US010611818B2

(12) United States Patent
Schøller et al.

(10) Patent No.: US 10,611,818 B2
(45) Date of Patent: Apr. 7, 2020

(54) MHC MULTIMERS IN TUBERCULOSIS DIAGNOSTICS, VACCINE AND THERAPEUTICS

(75) Inventors: Jørgen Schøller, Lyngby (DK); Liselotte Brix, Bagsværd (DK); Henrik Pedersen, Lynge (DK); Tina Jakobsen, Ballerup (DK)

(73) Assignee: Agilent Technologies, Inc., Santa Clara, CA (US)

( * ) Notice: Subject to any disclaimer, the term of this patent is extended or adjusted under 35 U.S.C. 154(b) by 986 days.

(21) Appl. No.: 12/680,248

(22) PCT Filed: Sep. 29, 2008

(86) PCT No.: PCT/DK2008/000339

§ 371 (c)(1), (2), (4) Date: Feb. 25, 2011

(87) PCT Pub. No.: WO2009/039854

PCT Pub. Date: Apr. 2, 2009

(65) Prior Publication Data

US 2011/0236411 A1 Sep. 29, 2011

Related U.S. Application Data

(60) Provisional application No. 60/960,394, filed on Sep. 27, 2007.

(30) Foreign Application Priority Data

Sep. 27, 2007 (DK) ................................ 2007 01395

(51) Int. Cl.

| | |
|---|---|
| ***A61K 39/04*** | (2006.01) |
| ***A61K 39/00*** | (2006.01) |
| ***C07K 14/74*** | (2006.01) |
| ***G01N 33/569*** | (2006.01) |
| ***A61K 39/245*** | (2006.01) |
| ***A61K 39/12*** | (2006.01) |
| ***A61K 47/61*** | (2017.01) |
| ***A61K 47/64*** | (2017.01) |

(52) U.S. Cl.

CPC .... *C07K 14/70539* (2013.01); *A61K 39/0011* (2013.01); *A61K 39/04* (2013.01); *A61K 39/12* (2013.01); *A61K 39/245* (2013.01); *A61K 47/61* (2017.08); *A61K 47/6425* (2017.08); *G01N 33/56972* (2013.01); *A61K 2039/605* (2013.01); *A61K 2039/6087* (2013.01); *A61K 2039/625* (2013.01); *C12N 2710/16134* (2013.01); *G01N 2333/35* (2013.01); *G01N 2333/70539* (2013.01)

(58) Field of Classification Search

None

See application file for complete search history.

(56) References Cited

U.S. PATENT DOCUMENTS

| | | | |
|---|---|---|---|
| 4,281,081 | A | 7/1981 | Jost et al. |
| 4,336,173 | A | 6/1982 | Ugelstad |
| 4,387,164 | A | 6/1983 | Hevey et al. |
| 4,459,378 | A | 7/1984 | Ugelstad |
| 4,654,267 | A | 3/1987 | Ugelstad et al. |
| 4,876,190 | A | 10/1989 | Recktenwald |
| 5,039,487 | A | 8/1991 | Smith |
| 5,130,297 | A | 7/1992 | Sharma et al. |
| 5,194,425 | A | 3/1993 | Sharma et al. |
| 5,260,422 | A | 11/1993 | Clark et al. |
| 5,284,935 | A | 2/1994 | Clark et al. |
| 5,312,744 | A | 5/1994 | Shibata |
| 5,468,481 | A | 11/1995 | Sharma et al. |
| 5,583,031 | A | 12/1996 | Stern |
| 5,627,037 | A | 5/1997 | Ward et al. |
| 5,635,363 | A | 7/1997 | Altman et al. |
| 5,652,342 | A | 7/1997 | Zimmerman et al. |
| 5,807,552 | A | 9/1998 | Stanton et al. |
| 5,869,270 | A | 2/1999 | Rhode et al. |
| 5,891,741 | A | 4/1999 | Siiman et al. |
| 5,955,079 | A | 9/1999 | Mond et al. |
| 5,994,089 | A | 11/1999 | Siiman et al. |
| 5,998,204 | A | 12/1999 | Tsien et al. |
| 6,015,884 | A | 1/2000 | Schneck et al. |
| 6,156,317 | A | 5/2000 | Diamond et al. |
| 6,074,645 | A | 6/2000 | Diamond et al. |
| 6,090,587 | A | 7/2000 | Rhode et al. |
| 6,096,315 | A | 8/2000 | Zimmerman et al. |
| 6,106,840 | A | 8/2000 | Clark et al. |
| 6,129,916 | A | 10/2000 | Chang |
| 6,140,113 | A | 10/2000 | Schneck et al. |
| 6,156,514 | A | 12/2000 | Acevedo et al. |
| 6,197,302 | B1 | 3/2001 | Hirsch et al. |
| 6,197,928 | B1 | 3/2001 | Tsien et al. |
| 6,211,342 | B1 | 4/2001 | Hirsch et al. |
| 6,232,445 | B1 | 5/2001 | Rhode et al. |
| 6,248,564 | B1 | 6/2001 | Walter et al. |
| 6,251,399 | B1 | 6/2001 | Diamond et al. |
| 6,268,411 | B1 | 7/2001 | Schneck et al. |
| 6,306,605 | B1 | 10/2001 | Acevedo et al. |
| 6,309,645 | B1 | 10/2001 | Rhode et al. |

(Continued)

FOREIGN PATENT DOCUMENTS

| | | |
|---|---|---|
| DE | 197 40 735 | 3/1999 |
| DE | 102 47 014 | 4/2004 |

(Continued)

OTHER PUBLICATIONS

Denkberg et al (Eur. J. Immunol., 2000, 30: 3522-3532).*

(Continued)

*Primary Examiner* — G. R. Ewoldt
*Assistant Examiner* — Marianne DiBrino
(74) *Attorney, Agent, or Firm* — Verrill Dana LLP

(57) ABSTRACT

The present invention relates to MHC-peptide complexes and uses thereof in the diagnosis of, treatment of or vaccination against a disease in an individual. More specifically the invention discloses MHC complexes comprising *Mycobacterium tuberculosis* antigenic peptides and uses there of.

8 Claims, 1161 Drawing Sheets

Figure 1:
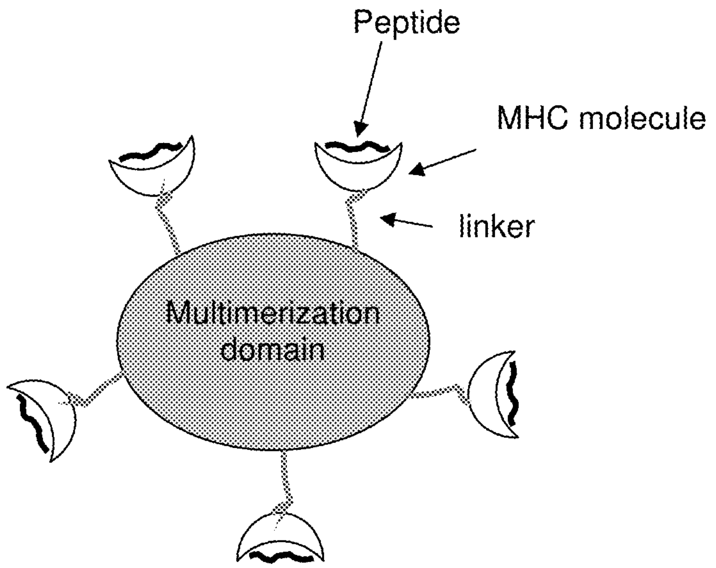

Specification includes a Sequence Listing.

(56) References Cited

U.S. PATENT DOCUMENTS

| | | | |
|---|---|---|---|
| 6,335,173 | B1 | 1/2002 | Kaplan |
| 6,387,622 | B1 | 5/2002 | Siiman et al. |
| 6,448,071 | B1 | 9/2002 | Schneck et al. |
| 6,451,314 | B1 | 9/2002 | Clark et al. |
| 6,451,769 | B1 | 9/2002 | Huebner et al. |
| 6,458,354 | B1 | 10/2002 | Schneck et al. |
| 6,458,933 | B1 | 10/2002 | Hansen |
| 6,486,130 | B1 | 11/2002 | Livey et al. |
| 6,517,838 | B1 | 2/2003 | Hook et al. |
| 6,534,633 | B1 | 3/2003 | Weidanz et al. |
| 6,548,067 | B1 | 4/2003 | Seeman et al. |
| 6,605,711 | B1 | 8/2003 | Valmori et al. |
| 6,734,013 | B2 | 5/2004 | Schneck et al. |
| 7,041,442 | B1 | 5/2006 | Kern et al. |
| 7,060,869 | B2 | 6/2006 | Tsien et al. |
| 7,064,190 | B1 | 6/2006 | Endl et al. |
| 7,074,904 | B2 | 7/2006 | Wong et al. |
| 7,094,555 | B2 | 8/2006 | Kwok et al. |
| 7,116,407 | B2 | 10/2006 | Hansen et al. |
| 7,141,656 | B2 | 11/2006 | Rhode et al. |
| 7,202,349 | B2 | 4/2007 | Davis et al. |
| 7,364,869 | B2 | 4/2008 | Nixon et al. |
| 7,502,580 | B2 | 3/2009 | Hays |
| 7,518,318 | B2 | 4/2009 | Kurogawa et al. |
| 7,524,503 | B2 | 4/2009 | Khanna et al. |
| 7,706,782 | B1 | 4/2010 | Hosmer et al. |
| 7,902,121 | B2 | 3/2011 | Chen et al. |
| 8,114,669 | B2 | 2/2012 | Choo |
| 8,268,964 | B2 | 9/2012 | Scholler et al. |
| 8,298,782 | B2 | 10/2012 | Busch et al. |
| 2002/0006903 | A1 | 1/2002 | Schneck et al. |
| 2002/0034513 | A1 | 3/2002 | Rhode et al. |
| 2002/0058787 | A1 | 5/2002 | Strominger et al. |
| 2002/0082411 | A1 | 6/2002 | Carter et al. |
| 2002/0091079 | A1 | 7/2002 | Rhode et al. |
| 2002/0119149 | A1 | 8/2002 | Jakobsen et al. |
| 2002/0127231 | A1 | 9/2002 | Schneck et al. |
| 2002/0164340 | A1 | 11/2002 | Brumeanu et al. |
| 2002/0165364 | A1 | 11/2002 | Tsien et al. |
| 2002/0198144 | A1 | 12/2002 | Wong et al. |
| 2003/0017447 | A1 | 1/2003 | Bernardo et al. |
| 2003/0073102 | A1 | 4/2003 | Kwok et al. |
| 2003/0096432 | A1 | 5/2003 | Jakobsen |
| 2003/0104635 | A1 | 6/2003 | Jakobsen |
| 2003/0118594 | A1 | 6/2003 | Nag et al. |
| 2003/0171290 | A1 | 9/2003 | Carr et al. |
| 2003/0199438 | A1 | 10/2003 | Shaw et al. |
| 2003/0228258 | A1 | 12/2003 | Scheinberg et al. |
| 2004/0068100 | A1 | 4/2004 | Mach et al. |
| 2004/0072262 | A1 | 4/2004 | Montero-Julian et al. |
| 2004/0082012 | A1 | 4/2004 | Busch et al. |
| 2004/0086520 | A1 | 5/2004 | Diamond |
| 2004/0137642 | A1 | 7/2004 | Erfle et al. |
| 2004/0141958 | A1 | 7/2004 | Steinaa et al. |
| 2004/0143094 | A1 | 7/2004 | Donda et al. |
| 2004/0204565 | A1 | 10/2004 | Schneck et al. |
| 2004/0209295 | A1 | 10/2004 | Schwabe et al. |
| 2004/0209314 | A1 | 10/2004 | Lang et al. |
| 2004/0223977 | A1 | 11/2004 | Diamond |
| 2004/0253632 | A1 | 12/2004 | Rhode et al. |
| 2005/0003431 | A1 | 1/2005 | Wucherpfennig et al. |
| 2005/0074822 | A1 | 4/2005 | Nixon et al. |
| 2005/0074848 | A1 | 4/2005 | Schwabe |
| 2005/0079152 | A1 | 4/2005 | Bot et al. |
| 2005/0095655 | A1 | 5/2005 | Montero-Julian et al. |
| 2005/0208529 | A1 | 9/2005 | Winther et al. |
| 2005/0214284 | A1 | 9/2005 | Price-Schiavi et al. |
| 2005/0214852 | A1* | 9/2005 | Gaynor et al. .................... 435/6 |
| 2005/0239160 | A1 | 10/2005 | Shaw et al. |
| 2006/0018878 | A1 | 1/2006 | Cooper et al. |
| 2006/0018929 | A1 | 1/2006 | Zaia et al. |
| 2006/0073159 | A1 | 4/2006 | Vonderheide et al. |
| 2006/0078563 | A1 | 4/2006 | Srivastava |
| 2006/0084116 | A1 | 4/2006 | Muchhal |
| 2006/0112440 | A1 | 5/2006 | Tsien et al. |
| 2006/0141540 | A1 | 6/2006 | Miltenyi et al. |
| 2006/0155115 | A1 | 7/2006 | Jakobsen et al. |
| 2006/0166214 | A1 | 7/2006 | Kato et al. |
| 2006/0166875 | A1 | 7/2006 | Jakobsen et al. |
| 2006/0171954 | A1 | 8/2006 | Endl et al. |
| 2006/0228758 | A1 | 10/2006 | Muchhal et al. |
| 2006/0228759 | A1 | 10/2006 | Muchhal et al. |
| 2006/0234309 | A1 | 10/2006 | Shankar et al. |
| 2006/0234310 | A1 | 10/2006 | Cai et al. |
| 2006/0240482 | A1 | 10/2006 | Kwok et al. |
| 2007/0026503 | A1 | 2/2007 | Lacey |
| 2007/0134814 | A1 | 6/2007 | Kajander et al. |
| 2007/0154953 | A1 | 7/2007 | Brunner et al. |
| 2007/0178532 | A1 | 8/2007 | Jacobson et al. |
| 2007/0184022 | A1 | 8/2007 | Wang et al. |
| 2007/0280957 | A1 | 12/2007 | Falk et al. |
| 2008/0219947 | A1 | 9/2008 | Linette et al. |
| 2009/0004213 | A1 | 1/2009 | Singh et al. |
| 2009/0061478 | A1 | 3/2009 | Poulsen et al. |
| 2009/0232766 | A1 | 9/2009 | Wang et al. |
| 2009/0324630 | A1 | 12/2009 | Jensen |
| 2010/0159594 | A1 | 6/2010 | Hansen et al. |
| 2012/0020998 | A1 | 1/2012 | Plumas et al. |

FOREIGN PATENT DOCUMENTS

| | | |
|---|---|---|
| EP | 0 106 873 | 5/1984 |
| EP | 0 352 761 | 1/1990 |
| EP | 0 516 953 | 12/1992 |
| EP | 0 633 028 | 1/1995 |
| EP | 0 636 696 | 2/1995 |
| EP | 0636696 A1 | 2/1995 |
| EP | 0 420 913 | 11/1995 |
| EP | 0 423 201 | 6/1996 |
| EP | 0 742 014 | 11/1996 |
| EP | 0 949 508 | 10/1999 |
| EP | 0946592 | 10/1999 |
| EP | 1023319 | 8/2000 |
| EP | 0 776 339 | 10/2000 |
| EP | 1 051 619 | 11/2000 |
| EP | 1181313 | 2/2002 |
| EP | 0 981 747 | 7/2002 |
| EP | 1 227 321 | 7/2002 |
| EP | 0 630 255 | 12/2002 |
| EP | 0 812 331 | 5/2004 |
| EP | 0 935 607 | 7/2004 |
| EP | 1 437 366 | 7/2004 |
| EP | 0 877 760 | 9/2004 |
| EP | 1 526 141 | 8/2005 |
| EP | 0 997 477 | 3/2006 |
| EP | 1 017 799 | 3/2006 |
| EP | 1 349 569 | 4/2007 |
| EP | 0 665 289 | 5/2007 |
| EP | 1 012 320 | 10/2007 |
| RU | 2 260 047 | 4/2005 |
| WO | WO 89/12458 | 12/1989 |
| WO | WO 89/12459 | 12/1989 |
| WO | WO 90/04411 | 5/1990 |
| WO | WO 91/09870 | 7/1991 |
| WO | WO 91/15766 | 10/1991 |
| WO | WO 92/00055 | 1/1992 |
| WO | WO 92/08983 | 5/1992 |
| WO | WO 92/18150 | 10/1992 |
| WO | WO 92/21972 | 12/1992 |
| WO | WO 93/01498 | 1/1993 |
| WO | WO 93/04175 | 3/1993 |
| WO | WO 93/08306 | 4/1993 |
| WO | WO 93/10220 | 5/1993 |
| WO | WO 94/11078 | 5/1994 |
| WO | WO 94/12196 | 6/1994 |
| WO | WO 95/11998 | 5/1995 |
| WO | WO 95/12676 | 5/1995 |
| WO | WO 95/14781 | 6/1995 |
| WO | WO 96/04314 | 2/1996 |
| WO | WO 96/26962 | 9/1996 |
| WO | WO 97/05239 | 2/1997 |
| WO | WO 97/28191 | 8/1997 |
| WO | WO 97/35991 | 10/1997 |

(56) References Cited

FOREIGN PATENT DOCUMENTS

| | | | |
|---|---|---|---|
| WO | WO 97/42221 | | 11/1997 |
| WO | WO 97/44667 | | 11/1997 |
| WO | WO 98/03552 | | 1/1998 |
| WO | WO 98/05965 | | 2/1998 |
| WO | WO 98/06749 | | 2/1998 |
| WO | WO 98/05684 | | 5/1998 |
| WO | WO 1999/002183 | | 1/1999 |
| WO | WO 99/11661 | | 3/1999 |
| WO | WO 99/11775 | | 3/1999 |
| WO | WO 99/14236 | | 3/1999 |
| WO | 1999024577 | A1 | 5/1999 |
| WO | WO 99/21572 | | 5/1999 |
| WO | WO 99/13095 | | 7/1999 |
| WO | WO 1999/36568 | | 7/1999 |
| WO | WO 99/42597 | | 8/1999 |
| WO | WO 99/50637 | | 10/1999 |
| WO | WO 99/58557 | | 11/1999 |
| WO | WO 99/60119 | | 11/1999 |
| WO | WO 2000/006745 | | 2/2000 |
| WO | WO 2000/015665 | | 3/2000 |
| WO | 200021989 | A1 | 4/2000 |
| WO | WO 2000/023053 | | 4/2000 |
| WO | WO 2000/075180 | | 12/2000 |
| WO | WO 2000/078966 | | 12/2000 |
| WO | WO 2003/000720 | | 1/2001 |
| WO | WO 2001/63286 | | 8/2001 |
| WO | 200173443 | A3 | 10/2001 |
| WO | WO 2001/72782 | | 10/2001 |
| WO | WO 2001/072782 | | 10/2001 |
| WO | WO 2001/070245 | | 11/2001 |
| WO | WO 2001/080833 | | 11/2001 |
| WO | WO 2001/090198 | | 11/2001 |
| WO | WO 2001/090747 | | 11/2001 |
| WO | WO 2002/016422 | | 2/2002 |
| WO | WO 2002/054065 | | 7/2002 |
| WO | WO 2002/072631 | | 9/2002 |
| WO | WO 2002/089837 | | 11/2002 |
| WO | WO 03/016905 | | 2/2003 |
| WO | WO 2002/055992 | | 3/2003 |
| WO | WO 2003/073097 | | 9/2003 |
| WO | WO 2002/083906 | | 10/2003 |
| WO | WO 2003/101473 | | 12/2003 |
| WO | WO 2004/000873 | | 12/2003 |
| WO | WO 2004/014957 | | 2/2004 |
| WO | WO 2004-018520 | | 3/2004 |
| WO | WO 2004-033497 | | 4/2004 |
| WO | WO 2004/093905 | | 11/2004 |
| WO | WO 2005/002621 | | 1/2005 |
| WO | WO 2005/007689 | | 1/2005 |
| WO | WO 2005/035567 | | 4/2005 |
| WO | WO 2005/049073 | | 6/2005 |
| WO | WO 2005/116051 | | 12/2005 |
| WO | WO 2006/009838 | | 1/2006 |
| WO | WO 2006/014292 | | 2/2006 |
| WO | WO 2006/056027 | | 6/2006 |
| WO | WO 2006/071990 | | 7/2006 |
| WO | WO 2006/081826 | | 8/2006 |
| WO | WO 2006/082387 | | 8/2006 |
| WO | WO 2006/090283 | | 8/2006 |
| WO | WO 2006/113622 | | 10/2006 |
| WO | 2007015168 | A3 | 2/2007 |
| WO | WO 2007/065098 | | 6/2007 |
| WO | WO 2007/085266 | | 8/2007 |
| WO | WO 2007/136778 | | 11/2007 |
| WO | WO 2008/019366 | | 2/2008 |
| WO | WO 2008/031133 | | 3/2008 |
| WO | WO 2008/116468 | | 10/2008 |
| WO | WO 2009/003492 | | 1/2009 |
| WO | WO 2009/003493 | | 1/2009 |
| WO | WO 2009/039854 | | 4/2009 |
| WO | 2009077173 | A2 | 6/2009 |
| WO | WO 2009/106073 | | 9/2009 |
| WO | WO 2009/114207 | | 9/2009 |
| WO | 2009126828 | A2 | 10/2009 |
| WO | WO 2009/125231 | | 10/2009 |
| WO | WO 2009/126816 | | 10/2009 |
| WO | WO 2009/155535 | | 11/2009 |
| WO | WO 2010/009735 | | 1/2010 |
| WO | WO 2010/032022 | | 3/2010 |
| WO | WO 2010/037395 | | 4/2010 |
| WO | WO 2010/037397 | | 4/2010 |
| WO | WO 2010/037402 | | 4/2010 |
| WO | 2012044999 | A2 | 4/2012 |
| WO | 2012094492 | A2 | 7/2012 |

OTHER PUBLICATIONS

Klein et al (J. Infect. Dis. 2001, 183: 928-934).*

Yik et al (J. Immunol. 2002, 168: 3145-3149).*

Greten and Schneck (Clin. Diag. Lab. Immunol. 2002, 9(2): 216-220).*

Larsen, M.V. (4/07, Prediction of T-cell Epitopes for Therapeutic and Prophylactic Vaccines, Ph.D. Thesis, Center for Biological Sequence Analyhsis BioCentrum Technical Univeristy of Denmark).*

Maher (2106, world wide web at dynamicchirpractic.com).*

Free Dictionary, 2017.*

Oxford Learner's Dictionaries, 2017.*

Celis et al (Mol. Immunol. 1994, 31 (18): 1423-1430) (Year: 1994).*

Ochoa-Garay et al (Mol. Immunol. 1997, 34(3): 273-281) (Year: 1997).*

Karin et al (J. Exp. Med. 1994, 180: 2227-2237) (Year: 1994).*

HLA Nomenclature 2015 (Year: 2015).*

Alp, et al., "Fine specificity of cellular immune responses in humans to human cytomegalovirus immediate-early 1 protein", Journal of Virology, vol. 65, No. 9, 1991 pp. 4812-4820.

Bleesing, et al., "Cell Function-Based Flow Cytometry" Seminars in Hematology, Apr. 2001, pp. 169-178, vol. 38, No. 2.

Bross, et al., "Approval summary: Gemtuzumab ozogamicin in relapsed acute myeloid leukemia", Clin. Cancer Res., 2001, 7:1490-1496.

Cecconi, et al., "Use of MHC Class II Tetramers to Investigate CD4 + T Cell Responses: Problems and Solutions," Cytrometry, 2008, Part A 73, No. 11, pp. 1010-10018.

Chattopadhyay, et al., "Techniques to improve the direct Ex Vivo detection of low frequency antigen-specific CD8+T cells with peptide-major histocompatibility complex class I tetramers," Cytometry, 2008, Part A, vol. 73, pp. 1001-1009.

Drouin, et al., "Molecular Characterization of the OspA161-175 T cell epitope associated with the treatment-resistant Lyme Arthritis: difference among the three pathogenic species of Borrelia burgdorferu sensu lato", Journal of Autoimmunity, 2004, vol. 23, No. 3, pp. 281-292.

Ferré, et al., "Purification of correctly oxidized MHC class I heavy-chain molecules under denaturing conditions: A novel strategy exploiting disulfide assisted protein folding", Protein Science, 2003, 12, pp. 551-559.

Fornas, et al., Flow Cytometry Counting of CD34+ cells in whole blood, Nature Medicine, 6 (2000) 7:833-836.

Heijnen, et al., "Enumeration of Antigen-Specific CD8+ T Lymphocytes by Single-Platform, HLA Tetramer-Based Flow Cytometry: A European Multicenter Evaluation", Clinical Cytometry, 2004, pp. 1-13, vol. 62B.

International Search report dated May 6, 2007 in International Application No. PCT/DK2007/000045.

Lissina, et al., "Protein Kinase Inhibitors Substantially Improve the Physical Detection of T-Cells with Peptide-MHC Tetramers," J. Immunol. Methods, 2009, vol. 340, pp. 11-24.

Maloney, et al., "IDEC-C2B8 (Rituximab) anti-CD20 monoclonal antibody therapy in patients with relapsed low-grade non-Hodgkin's lymphoma," Sep. 1997, Blood, 90 (6):21 :88-2195.

Melenhorst, et al.,"Detection of Low Avidity CD8+ T Cell Populations with Coreceptor-Enhanced Peptide-Major Histocompatibility Complex Class I Tetramers," J. Immunol. Methods, 2008, vol. 338, No. 1-2, pp. 31-39.

(56) References Cited

OTHER PUBLICATIONS

Vollers, et al., "Class II Major Histocompatibility Complex Tetramer Staining: Progress, Problems, and Prospects," Immunology, 2008, vol. 123, pp. 305-313.
Weichsel, et al. ,"Profound Inhibition of Antigen-Specific T-Cell Effector Functions by Dasatinib," Clin. Cancer Res.2008, vol. 14, pp. 2484-2491.
Wolfl, et al., "Quantitation of MHC Tetramer-Positive Cells From Whole Blood: Evaluation of Single-Platform, Six-parameter Flow Cytometric Method", Cytometry Part A, 2004, pp. 120-130, vol. 57A.
U.S. Appl. No. 12/619,039, filed Nov. 16, 2009, Jorgen Scholler.
U.S. Appl. No. 12/644,554, filed Dec. 22, 2009, Liselotte Brix.
U.S. Appl. No. 12/647,747, filed Dec. 18, 2009, Kivin Jacobsen.
U.S. Appl. No. 12/919,405, filed Aug. 25, 2010, Jorgen Scholler.
U.S. Appl. No. 08/202,349, filed Jan. 18, 1995, Boehringer Mannheim.
Altman et al., "Formation of functional peptide complexes of class II major histocompatibility complex proteins from subunits produced in *Escherichia coli*," Proc. Natl. Acad. Sci. USA, pp. 10330-10334, Nov. 1993, vol. 90.
Altman et al., "Phenotypic Analysis of Antigen-Specific T Lymphocytes," Science 274:94-97, 1996.
Appel et al., "Anergy induction by dimeric TCR ligands," J. Immunol., pp. 5279-5285, Apr. 15, 2001, vol. 166.
Appel et al., "Kinetics of T-cell receptor binding by bivalent HLA-DR-peptide complexes that activate antigen-specific human T-cells," J. Biol. Chem., pp. 312-321, Jan. 7, 2000, vol. 275.
Andersen et al., "Spontaneous cytotoxic T-cell responses against survivin MHC class I-restricted T-cell epttopes in situ as well as ex vivo in cancer patients," Cancer Res., vol. 61, pp. 5964-5968, Aug. 15, 2001.
Ausubel et al., "Characterization of in vivo expanded OspA-specific human T-cell clones," Clinical Immunology, Academic Press, pp. 313-322, Jun. 1, 2005 (Jun. 1, 2005), vol. 115, No. 3.
Bakker et al., "MHC multimer technology: Current status and future prospects," Current Opinion in Immunology, 17:428-433, 2005.
Barany et al., "Solid-phase peptide synthesis: A silver anniversary report," Int. J. Peptide Protein Res., 30:705-739, 1987 (Abstract Only).
Batard et al., "Dextramers: New generation of fluorescent MHC class I-peptide multimers for visualization of antigen-specific CD8<+> T cells," Journal of Immunological Methods, Elsevier Science Publishers, pp. 136-148, Mar. 20, 2006 (Mar. 20, 2006), vol. 310, No. 1-2.
Berger et al., "Circulation and hoimg of melanoma-reactive T cells to both cutaneous and visceral metastases after vaccinnation with monocyte-derived dendritic cells," Int. J. Cancer, pp. 229-237, 2004, vol. 111.
Bergmeier et al., "Innate and adoptive mucosal immunity in protection against HIV infection," Advances in Dental Research 2006, pp. 21-28, 2006, vol. 19, No. 1, XP002562924.
Bill et al., "Use of soluble MHC class II-peptide multimers to detect antigen-specific T cells in human disease," Arthritis Res., pp. 261-265, Feb. 28, 2002, vol. 4.
Bjorkman et al., "The foreign antigen binding site and T cell recognition regions of class I histocompatibility antigen," Nature 329:512-518, 1987.
Bogers, "CCR5 targeted SIV vaccination strategy preventing or inhabiting SIV infection," Vaccine, Butterworth Scientific, pp. 2974-2984, Aug. 13, 2004 (Aug. 13, 2004), vol. 22, No. 23-24. Guildford, GB.
Burlingham et al., "Soluble MHC, Immunoregulation, and tolerance: A progress report," Human Immunol., pp. 1316-1319, Dec. 2000, vol. 61.
Callan et al., "Direct Visualizing of Antigen.specific CD8+ T Cells during th ePRimary Immune Response to Epstein-Barr Virus in Vivo," J. Exp. Med., May 1998, pp. 1395-1402, vol. 187, No. 9.
Cameron et al., "Labeling antigen-specific DC4(+) T cells with class II MHC oligomers," J. Immunol. Methods, pp. 51-69, Oct. 1, 2002, vol. 268.
Carena et al., "Major Histocompatibility Complex Class I Molecules Modulate Activation Threshold and Early Signaling of T-Cell Antigen Receptor-γδ Stimulated by Nonpeptidic Ligands," J. Exp. Med., Nov. 17, 1997, pp. 1769-1774, 186 (10).
Casares et al., "Antigen-specific downregulation of T cells by doxorubicin delivered through a recombinant MHC II-peptide chimera," Nature Biotech., pp. 142-147, Feb. 2001, vol. 19 (Abstract Only).
Cochran et al., "Receptor clustering and transmembrane signaling T cells," TIBS, pp. 304-310, May 2001, vol. 26.
Coles et al., "Memory CD8 T lymphocytes express inhibitory MHC-specific Ly49 receptors," EUR. J. Immunol. 30:236-244, 2000.
Constantin et al., "Major histocompatibility complex (MHC) tetramer technologt: An evaluation," Biol. Res. Nursing, pp. 115-127, Oct. 2002, vol. 4.
Dal Porto et al, "A soluble divalent class I major histocompatibility complex molecule inhibits alloreactive T cells at nanomolar concentrations," Porc. Natl. Acad. Sci. 90.6671-6675, 1993.
Dako: "MHC Dextramers" Internet Article Jul. 6, 2006 URL: pri.dako.com-00207_mhcdex_0406.pdf.
Devito-Haynes et al., "Soluble donor HLA class I and β2-m-free heavy chain in serum of lung transplant recipients: Steady-state levels and increases in patients with recurrent CMV infection, acute rejection episodes, and poor outcome," Human Immunol., pp. 1370-1382, Dec. 2000, vol. 61.
Drouin et al., "Searching for borrelial T-cell epitopes associated with antibiotic-refractory Lyme arthritis," Molecular Immunology, pp. 2323-2332, Jan. 11, 2008 (Jan. 11, 2008), vol. 45, No. 8, GB.
Ed. Charron, "HLA: Genetic diversity of HLA. Functional and Medical Implication," EDK Press, pages corresponding to Tables 1A and 1B, 1997.
Erout et al., "Preparation of Conjugates between Oligonucleotide and N-Vinylpyrrolidone-N-Acryoxysuccinimide Coplymers and Applications in Nucleic Acid Assays to Improve Sensitivity," Bioconjugate Chem. 1996, pp. 568-575, vol. 7.
Fields et al., "Solid phase peptide synthesis utilizing 9-fluorenylmethoxycarbonyl amino acids," Int. J. Peptide Res., 353:161-214, 1990 (Abstract Only).
Frayser et al., "Empty and peptide-loaded class II major histocompatibility complex proteins produced by expression in *Escherichia coli* and folding in vitro," Protein Expression and Purification, pp. 105-114, Feb. 1999, vol. 15 (Abstract Only).
Garboczi et al., "HLA-A2.peptide complexes: Refolding and crystallization of molecules expressed in *Escherichia coli* and complexed with single antigenic peptides," Proc. Natl. Acad. Sci., 89:3429-3433, 1992.
Gordon et al., "Applications of Combinatorial Technologies to Drug Discovery. 2. Combinatorial Organic Synthesis, Library Screening Strategies, and Future Directions," Journal of Medicinal Chemistry, 37 (10):1385-1401, 1994 (Abstract Only).
Haanen et al., "In situ detection of virus- and tumor-specific T-cell Immunity," Nature Medicine, Sep. 2000, pp. 1056-1060, vol. 6 (Abstract Only).
Hadrup et al., "Persistence of survivin specific T cells for seven years in a melanoma patient during complete remission," Cancer Biol. Ther., pp. 480-482, May 2006, vol. 5.
Houghten et al., "Generation and use of synthetic peptide combinatorial libraries for basic research and drug discovery," Nature, 354:84-86, 1991 (Abstract Only).
Huges et al., "Generation and use of alternative multimers of peptide-MHC complexes," Journal of Immunological Methods, 268:83-92, 2002.
Jung et al., "Multiple Peptide Synthesis Methods and their Applications," Angewandte Chemie, 31 (4):367-486, 1992 (Abstract Only).
Kalandadze et al., "Expression of Recombinant HLA-DR2 molecules," J. Biol. Chem., pp. 20156-20162, Aug. 16, 1996, vol. 271.

(56) References Cited

OTHER PUBLICATIONS

Knabel et al., "Reversible MHC multimer staining for functional isolation of T-cell populations and effective adoptive transfer," Nature Medicine, Nature Publishing Group, pp. 631-637, Jun. 1, 2002 (Jun. 1, 2002), vol. 8, No. 6.
König, "Interactions between MHC molecules and co-receptors of the TCR," Current Opinion in Immunology, pp. 75-83, 2002, vol. 14.
Kozono et al., "Production of soluble MHC class II proteins with covalently bound single peptides," Nature, pp. 151-154, May 12, 1994, vol. 369 (Abstract Only).
Kuroda et al., "Analysis of Gag-specific Cytotoxic T Lymphocytes in Simian Immunodeficiency Virus-intected Rhesus Monkeys by Cell Staining with Tetrameric Major Histocompatibility Complex Class I-Peptide Complex," J.Exp. Med., May 4, 1998, 1373-1381, vol. 187, No. 9.
Kuttler et al., "An Algorithm for the Prediction of Proteasomal Cleavages," J. Miol. Biol., 298:417-429, 2000.
Larsson, "Immunocytochemical detection systems," in Immunocytohemistry: Theory and Practice, pp. 77-145, CRC Press, 1988.
Lee et al., "Characterizatio of circulating T cells specific for tumor-associateda ntigens in melanoma patients," Nature Medicine, Jun. 1999, pp. 677-685, vol. 5, No. 6.
Lehner, "Allomicrovac: A combined microbicidal-immunising strategy against SIV and HIV infection," Vaccines for Humans, pp. 64-65, Dec. 5, 2008 (Dec. 5, 2008), XP0025629223, URL:biblioteca.porto.ucp.pt-docbweb-MULTIMEDIA-ASSOCIA-PDF-VAC.Pdf.
Ljunggren et al., "Empty MHC class I molecules come out in the cold," Nature 346:476-480, 1990.
Mallone et al., "MHC class II tetramers and the pursuit of antigen-specific T cells: Define, deviate, delete," Clin. Immunol., pp. 232-242, 2004, vol. 110.
Marchand et al., "Tumor regression responses in melanoma patients treated with a peptide encoded by gene MAGE-3,"Int. J. Cancer, 63:883-885, 1995.
Matsumura et al., "Emerging Principles for the Recognition of Peptide Antigen by MHC class I Molecules," Science 257:927-934, 1992.
Matsumura et al., "In vitro peptide binding to soluble empty calss I major histocompatibility complex molecules isolated from transfected *Drosophila melanogaster* cells," J. Biol. Chem., pp. 23589-23595, Nov. 25, 1992, vol. 267.
McCluskey et al., "T-cell activation by purified, soluble , class I MHC molecules: Requirement for polyvalency," J. Immunol. 141(5): 1451-55, 1988.
McHeyzer-Williams et al., "Tracking antigen-specific helper T cell responses," Current Opinion in Immunology, pp. 278-284, 1996, vol. 8.
Merrifield et al., "Instrument for Automated Synthesis of peptides," Analytical Chemistry, 38 (13):1905-1914, 1966 (Abstract Only).
Merrifield, "Solid Phase Synthesis," Science 232:341-347, 1986 (Abstract Only).
Meyer et al., "Direct enumeration of Borrelia-reactive CD4 T-cell ex vivo by using MHC class II tetramers," Proceedings of the National Academy of Sciences of USA. (PNAS), National Academy of Science, pp. 11433-11438, Oct. 10, 2000 (Oct. 10, 2000), vol. 97, No. 21, Washington D.C., US.
Mutis et al., "Tetrameric HLA class 1-minor histocompatability antigen peptide complexes demnstrate minor histocompatibility antigen-specific cytoxic T lymphocytes in patients with graft-visus-host disease," Nature Medicine, Jul. 1999, pp. 839-842, vol. 5, No. 7.
Neudorfer et al., "Reversible HLA multimers (streptamers) for the isolation of human cytotoxic T lymphocytes functionally active against tumor- and virus-derived antigens," Journal of Immunological Methods, 320:119-131, 2007.
O'Herrin et al., "Analysis of the Expression of Peptide-Major Histocaompatibility Complexes using high affinity Soluble Divalent T-Cell Receptors," The Journal of Biological Chemistry, Oct. 20, 1997, pp. 1333-1345, vol. 186, No. 8.
Reich et al., "Stability of empty and peptide-loaded class II major histocompatibility complex molecules at neutral and endosomal pH: Comparison to class I proteins," Proc. Natl. Acad. Sci. USA, pp. 2495-2500, Mar. 1997, vol. 94.
Reijonen et al., "Use of HLA class II tetramers in tracking antigen-specific T cell and mapping T-call epitopes," pp. 282-288, 2003, vol. 29.
Scheirle et al., "Peptide binding to soluble HLA-DR4 molecules produced by insect cells," J. Immunol., pp. 1994-1999, Sep. 15, 1992, vol. 149 (Abstract Only).
Scheffold et al., "Recent Development in Flow Cytometry," Journal of Clinical Immunology, Aug. 2000, vol. 20, No. 6.
Sengupta et al., "Heat shock protein-mediated cross-presentation of exogenous HIV antigen on HLA class I and class II," Journal of Immunology, American Association of Immunologists, pp. 1987-1993, Aug. 1, 2004 (Aug. 1, 2004), vol. 173, No. 3.
Shambrook, Fritsch and Maniatis, "Molecular Cloning," Cold Spring Harbor Press, 1989, Index and Table of Contents pp. xi to xxxviii and I-1 to I-47.
Shields et al., "The Effect of Human β2-Microglobulin on Major Histocompatibility Complex I Peptide Loading and the Engineering of a High Affinity Variant," The Journal of Biological Chemistry, Oct. 23, 1998, pp. 28010-28018, vol. 273, No. 43.
Siiman et al., Bioconjugate Chem. 1999, pp. 1090-1106.
Skinner et al., "In situ tetramer staining," J. Immunol. Meth., pp. 29-34, 2002, vol. 268.
Sørensen et al., "Efficient tumor cell lysis mediated by a bcl-X(L) specific T cell clone isolated from a breast cancer patient," Cancer Immunology, Immunotherapy, Springer, pp. 527-533, Jul. 19, 2006 (Jul. 19, 2006), vol. 56, No. 4.
Stern et al., "The human class II MHC protein HLA-DR1 assembles as empty alpha beta heterodimers in the absence of antigenic peptide," Cell, pp. 465-477, Feb. 7, 1992, vol. 68 (Abstract Only).
Stratmann et al., "Susceptible MHC Alleles, not background genes, select an autoimmune T cell reactivity," The Journal of Clinical Investigation, pp. 902-914, Sep. 2003, vol. 112, No. 6.
Stöckel et al., "Refolding of human class II major histocompatibility complex molecules isolated from *Escherichia coli*", J. Biol. Chem., pp. 29571-29578, Nov. 25, 1994, vol. 269.
Sun et al., "MHC class I multimers," Arthritis Res., pp. 265-269, Jul. 2001, vol. 3.
Ugolini et al., "Regulation of T cell function by NK cell receptors for classical MHC class I molecules," Current Opinion in Immunology 12:295-300, 2000.
Valmori et al., "Enhanced generation of specific tumor-reactive CTL in vitro by selected Melan-A-MART-1 immunodominant peptide analogues," J. Immunol., pp. 1750-1758, Feb. 15, 1998, vol. 160.
Viola et al., "T-cell activation and the dynamic world of rafts.," APMIS 107:615-623, 1999.
Vyth-Dreese et al., "In situ visualization of antigen specific T cells in cryopreserved human tissues," J. Immunol. Meth., pp. 78-85, 2006, vol. 310.
White et al., "Soluble class I MHC with β2-microglobulin covalently linked peptides: Specific binding to a T cell hybridoma," J. Immunol., pp. 2671-2676, Mar. 1, 1999, vol. 162.
Xu et al., "MHC-peptide tetramer-based studies of T cell function," J. Immunol Meth., pp. 21-28, 2002, vol. 268.
Zhang et al., "Essential role of LAT in T cell development," Immunity 10:323-332, 1999.
Akiyama, "Analysis of HLA-A24-restricted CMVpp65 peptide-specific CTL with HLA-A*2402-CMVpp65 tetramer," Immunology Letters, vol. 95, Issue 2, pp. 199-205 (2004).
Busch, "Detection of Borrelia burgdorferi-Specific CD8+ Cytotoxic T Cells in Patients with Lyme Arthritis," The of Immunology, vol. 157, No. 8, pp. 3534-3541 (1996) Journal.
Celis, "Identification of potential CTL Epitopes of Tumor-Associated Antigen Mage-1 for Five Common HLA-A Alleles," Molecular Immunology, vol. 31, No. 18, pp. 1423-1430 (1994).

(56) References Cited

OTHER PUBLICATIONS

Chen, "Modulation of CD1d-restricted NKT cell responses by CD4," Journal of Leukocyte Biology, vol. 82, pp. 1455-1465 (2007).
Dibrino, "Endogenous peptides bound to HLA-A3 possess a specific combination of anchor residues that permit identification of potential antigenic peptides," Proc. Natl. Acad. Sci. USA, vol. 90, pp. 1508-1512 (1993).
Denkberg, "Recombinant human single-chain MHC-peptide complexes made from *E. coli* by in vitro refolding: functional single-chain MHC-peptide complexes and tetramers with tumor associated antigens," Eur. J. Immunol., vol. 30, pp. 3522-3532 (2000).
Drake, "Cutting Edge: Lipid Raft Integrity Affects the Efficiency of MHC Class I Tetramer Binding and Cell Surface TCR Arrangement on CD8+ T Cells," The Journal of Immunology, vol. 166, No. 12, pp. 7009-7013 (2001).
He, "Procedure for preparing peptide-major histocompatibility complex tetramers for direct quantification of antigen-specific cytotoxic T lymphocytes," World J Gastroenterol, vol. 11, No. 27, pp. 4180-4187 (2005).
Kao, "Loss of CD8 and TCR binding to Class I MHC ligands following T cell activation," International Immunology, vol. 17, No. 12, pp. 1607-1617 (2005).
Karin, "Reversal of Experimental Autoimmune Encephalomyelitis by a Soluble Peptide Variant of a Myelin Basic Protein Epitope: T Cell Receptor Antagonism and Reduction of Interferon γ and Tumor Necrosis Factor α Production," J. Exp. Med., vol. 180, pp. 2227-2237 (1994).
Kronenberg, "The Unconventional Lifestyle of NKT Cells," Nature Reviews Immunology, vol. 2, pp. 557-568 (2002).
Nepom, "MHC Multimers: expanding the clinical toolkit," Clinical Immunology, vol. 106, pp. 1-4 (2003).
Parker, "Peptide Binding to HLA-A2 and HLA-B27 Isolated from *Escherichia coli*," The Journal of Biological Chemistry, vol. 267, pp. 5451-5459 (1992).
Rognan, "Rational design of nonnatural peptides as high-affinity ligands for the HLA-B*2705 human leukocyte antigen," Proc. Natl. Acad. Sci. USA, vol. 92, pp. 753-757 (1995).
Ruan, "Preparation of HLA-A*0201 NLVPMVATV peptide tetramers and application to detect cytomegalovirus specific CTL," Zhonghua Weishengwuxue He Mianyixue Zazhi, vol. 26., No. 9, pp. 855-858 (2006)—English Abstract Only.
Ruan, "Improved preparation of class I HLA tetramers and their use in detecting CMV-specific CTL," Journal of Immunological Methods, vol. 312, pp. 148-156 (2006).
Schueler-Furman, "Structure-based prediction of binding peptides to MHC class I molecules: Application to a broad range of MHC alleles," Protein Science, vol. 9, pp. 1838-1846 (2000).
Theisen, "Evolution of the borrelia burgdorferi outer surface protein OspC," Journal of Bacteriology vol. 177, No. 11, pp. 3036-3044 (1995).
Weinberg, "The Biology of Cancer," Garland Science, pp. 737-747 (2007).
Wulff, "Guide to Flow Cytometry," Dako Educational Guide, worldwideweb dako.com, (2006).
Andersen et al., Parallel detection of antigen-specific T-cell responses by combinatorial encoding of MHC multimers. NatProtoc., vol. 7, No. 5, pp. 891-902 (2012).
HLA nomenclature—HLA allele numbers (hla.alleles.org/nomenclature/stats.html (2010).
Bauer et al., "Maximizing immune responses: the effects of covalent peptide linkage to beta-2-microglobulin"; Oncol Res. 17(5):205-16, (2008).
Celis et al., Induction of anti-tumor cytotoxic T lymphocytes in normal humans using primary cultures and synthetic peptide epitopes. Proc Natl Acad Sci USA, vol. 91, 2105-2109 (1994).
Cortez-Gonzales et al., Immunogenic HLA-B7-restricted peptides of hTRT. Intl Immunology vol. 18, No. 12 1707-1718 (2006).
Desrosiers, "Prospects for an AID vaccine", Nature Medicine 10, 221-223 (2004).
Dibrino et al., "HLA-A1 and HLA-A3 T cell epitopes derived from influenza virus proteins predicted from peptide binding motifs." J Immunol., 151(11):5930-5 (1993).
Greten et al., "Peptide-beta2-microglobulin-MHC fusion molecules bind antigen-specific T cells and can be used for multivalent MHC-Ig complexes", J Immunol Methods. 271(1-2):125-35 (2002).
Hackett and Sharma, "Frontiers in peptide-MHC class II multimer technology", Nature Immunology 3, 887-889 (2002).
Lauritsen et al., Two distinct pathways exist for down-regulation of the TCR. J Immunology, 161:260-7 (1998).
Matthews et al., "Prospects for Development of a Vaccine Against HTLV-III-Related Disorders"; AIDS Research and Human Retroviruses, 3: 197-206 (1987).
Nikolich-Zugich, "The many important facets of t-cell repertoire diversity. Nature Reviews Immunology," vol. 4, 123-132 (2004).
Ochoa-Garay et al., The ability of peptides to induce cytotoxic T cells in vitro does not strongly correlate with their affinity for the H-2Ld molecule: Implications for vaccine design and immunotherapy. Molecular Immunology vol. 34, No. 3, 273-281 (1997).
Oka et al., Induction of WT1 (Wilms' tumor gene)-specific cytotoxic T lymphocytes by WT1 peptide vaccine and the resultant cancer regression. PNAS vol. 101, No. 38, 13885-13890 (2004).
Rammensee, "MHC ligands and peptide motifs: first listing. Immunogenetics," 41:178-228 (1995).
Hadrup et al., "Parallel detection of antigen-specific T-cell responses by multidimensional encoding of MHC multimers", Nature Methods (Nature Publishing Group), Basingstoke GB, vol. 6, No. 7, doi:10.1038/NMETH.1345, ISSN 1548-7091, pp. 520-528, (2009).
Schroers et al., Identification of HLA DR7-restricted epitopes from human telomerase reverse transcriptase recognized by CD4+ T-helper cells, Cancer Research 62, 2600-2605 (2002).
Speiser et al., In Vivo Activation of Melanoma-Specific CD8(+) T Cells by Endogenous Tumor Antigen and Peptide Vaccines. A Comparison to Virus-Specific T Cells. Eur J Immunol 32:731-741 (2002).
Stoeva et al., "Multiplexed Detection of Protein Cancer Markers with Biobarcoded Nanoparticle Probes", Journal of the American Chemical Society, American Chemical Society, US, vol. 128, No. 26, doi:10.1021/JA0613106, ISSN 0002-7863, (2006), pp. 8378-8379 (2006).
Sano, "Immuno-PCR: Very sensitive antigen detection by means of specific antibody-DNA conjugates," Science American Association for the Advancement of Science, UA, vol. 258, No. 5079, 120-122 (1992).
Xu, "Preparation and Characterization of HLA-A *0201 Tretamer Loaded with IE-1 316-324 Antigenic Peptide of Human Cytomegalovirus," Cullular & Molecular Immunology, vol. 3, No. 5, pp. 367-371 (2006).
Yang et al. "Immunization with recombinant macaque major histocompatibility complex class I and II and human immunodeficiency virus gp140 inhibits simian-human immunodeficiency virus infection in macaques," Journal of General Virology, vol. 93, pp. 1506-1518 (2012).

* cited by examiner

Figure 1: Schematic representation of MHC multimer

Figure 2: Program for peptide sequence motifs prediction

```
Imports System.IO


Public Class Form1

    Dim TRACE_LOG = ""
    Dim CR = "-"
    Dim BACKSLASH = "\"
    Dim COLON = ":"
    Dim SPACE = " "

    Private Sub Button_valgmappe_Click(ByVal sender As System.Object, ByVal e As
System.EventArgs) Handles Button_valgmappe.Click
        Dim fdlg As FolderBrowserDialog = New FolderBrowserDialog()

        If fdlg.ShowDialog() = Windows.Forms.DialogResult.OK Then
            Txt_mappe.Text = fdlg.SelectedPath
        End If
    End Sub

    Private Sub Button_gem_Click(ByVal sender As System.Object, ByVal e As
System.EventArgs) Handles Button_gem.Click
        If Txt_sekvens.Text = Nothing Then
            MessageBox.Show("Indtast sekvens")
            Exit Sub
        End If
        If Txt_fil.Text = Nothing Then
            MessageBox.Show("Indtast filnavn")
            Exit Sub
        End If
        If Txt_mappe.Text = Nothing Then
            MessageBox.Show("Vælg mappe")
            Exit Sub
        End If

        TRACE_LOG = Txt_mappe.Text + "/" + Txt_fil.Text + ".txt"
        If File.Exists(TRACE_LOG) Then
            MessageBox.Show("Filen findes allerede og kan ikke overskrives")
            Exit Sub
```

```
    End If

    Dim n = Txt_sekvens.Text.Length
    Trace_skriv("Sequence length: " & n)
    Trace_skriv("CR")
    Trace_skriv("CR")

    Dim min = CInt(Txt_min.Text)
    Dim max = CInt(Txt_max.Text)
    Dim j As Integer
    Dim i As Integer
    Dim tmptxt As String
    Dim peptid As String

    For j = min To max
        Trace_skriv(j & " mers:")
        Trace_skriv("CR")
        tmptxt = ""
        For i = 0 To n - j
            peptid = Txt_sekvens.Text.Substring(i, j)
            If CheckBox_validering.Checked Then
                If valideret(peptid) Then
                    tmptxt = tmptxt + peptid & CR
                End If
            Else
                tmptxt = tmptxt + peptid & CR
            End If
        Next
        Trace_skriv(tmptxt)
        Trace_skriv("CR")
        Trace_skriv("CR")
    Next

End Sub

Private Function valideret(ByVal peptid As String)
    If CheckBox_validering_stopkodon.Checked Then
        If InStr(peptid, "*") Then
            Return False
        Else
            Return True
        End If
    Else
        Return True
```

Fig. 2 continued

```
        End If
    End Function

    Private Sub Form1_Load(ByVal sender As System.Object, ByVal e As
System.EventArgs) Handles MyBase.Load
        Txt_min.Text = 8
        Txt_max.Text = 11
    End Sub

    Friend Sub Trace_skriv(ByVal texttoadd As String)
        Dim logtext() As String
        Dim fileline() As String
        Dim fs As StreamWriter
        Dim strace As New StackTrace(True)
        Try
            If Not File.Exists(TRACE_LOG) Then
                fs = File.CreateText(TRACE_LOG)
                'fs.Write("Trace Log " & Format(Now) & CR & CR)
                fs.Flush()
                fs.Close()
            End If
            logtext = strace.GetFrame(1).ToString.Split(Space)
            fileline = logtext(6).Split(BACKSLASH)
            Dim i As Integer = fileline.GetUpperBound(0)
            fs = File.AppendText(TRACE_LOG)
            If texttoadd = "CR" Then
                fs.WriteLine()
            Else
                Dim tmp = Split(texttoadd, CR)
                If UBound(tmp) = 0 Then
                    fs.Write(tmp(0))
                Else
                    For i = LBound(tmp) To UBound(tmp) - 1
                        fs.Write(tmp(i))
                        If Me.CheckBox_semikolon.Checked Then
                            fs.Write("; ")
                        End If
                        If Me.CheckBox_linie.Checked And i < UBound(tmp) - 1 Then
                            fs.WriteLine()
                        End If
                    Next
                End If
            End If
            fs.Flush()
```

Fig. 2 continued

```
            fs.Close()
        Catch ex As Exception
            MsgBox(ex.ToString)
        End Try
    End Sub
End Class
```

Fig. 2 continued

Figure 3:
Full List of HLA Class I alleles assigned as of January 2007 from http://www.anthonynolan.org.uk/HIG/lists/class1list.html

HLA-AHLA-BHLA-CHLA-EHLA-FHLA-G
A*01010101B*070201Cw*010201E*01010101F*01010101G*01010101
A*01010102NB*070202Cw*010202E*01010102F*01010102G*01010102
A*010102B*070203Cw*010203E*01010103F*01010103G*01010103
A*010103B*070204Cw*010204E*01030101F*01010104G*01010104
A*010104B*0703Cw*0103E*01030102F*01010105G*01010105
A*0102B*0704Cw*0104E*010302F*01010106G*01010201
A*0103B*070501Cw*0105E*010303F*01010107G*01010202
A*0104NB*070502Cw*0106E*010304F*01010108G*010103
A*0106B*070503Cw*0107E*0104F*01010201G*010104
A*0107B*0706Cw*0108F*01010202G*010105
A*0108B*0707Cw*0109F*01010203G*010106
A*0109B*0708Cw*0110F*01010204G*010107
A*0110B*0709Cw*0111F*01010205G*010108
A*0111NB*0710Cw*0112F*01010301G*010109
A*0112B*0711Cw*0113F*01010302G*010110
A*0113B*0712Cw*020201F*01010303G*0102
A*0114B*0713Cw*020202F*01010304G*0103
A*0115NB*0714Cw*020203F*0102G*010401
A*0116NB*0715Cw*020205F*01030101G*010402
A*0117B*0716Cw*0203F*01030102G*010403
A*0118NB*0717Cw*0204F*0104G*0105N
A*0119B*0718Cw*0205G*0106
A*0120B*0719Cw*0206G*0107
A*02010101B*0720Cw*0207
A*02010102LB*0721Cw*0208
A*020102B*0722Cw*0209
A*020103B*0723Cw*0210
A*020104B*0724Cw*0211
A*020105B*0725Cw*0212
A*020106B*0726Cw*0213
A*020107B*0727Cw*0214
A*020108B*0728Cw*0215
A*020109B*0729Cw*0216
A*020110B*0730Cw*0217
A*020111B*0731Cw*030201
A*020112B*0732Cw*030202
A*0202B*0733Cw*030301
A*020301B*0734Cw*030302
A*020302B*0735Cw*030303

A*0204B*0736Cw*030304
A*0205B*0737Cw*030305
A*020601B*0738Cw*030401
A*020602B*0739Cw*030402
A*020603B*0740Cw*030403
A*0207B*0741Cw*030404
A*0208B*0742Cw*030405
A*0209B*0743Cw*0305
A*0210B*0744Cw*0306
A*0211B*0745Cw*0307
A*0212B*0746Cw*0308
A*0213B*0747Cw*0309
A*0214B*0748Cw*0310
A*0215NB*0749NCw*031101
A*0216B*0750Cw*031102
A*021701B*0751Cw*0312
A*021702B*080101Cw*0313
A*0218B*080102Cw*0314
A*0219B*080103Cw*0315
A*022001B*0802Cw*0316
A*022002B*0803Cw*0317
A*0221B*0804Cw*0318
A*0222B*0805Cw*0319
A*0224B*0806Cw*0320N
A*0225B*0807Cw*0321
A*0226B*0808NCw*0322Q
A*0227B*0809Cw*0323
A*0228B*0810Cw*0324
A*0229B*0811Cw*0325
A*0230B*0812Cw*0326
A*0231B*0813Cw*0327
A*0232NB*0814Cw*0328
A*0233B*0815Cw*0329
A*0234B*0816Cw*0330
A*023501B*0817Cw*0331
A*023502B*0818Cw*0332
A*0236B*0819NCw*0333
A*0237B*0820Cw*0334
A*0238B*0821Cw*0335
A*0239B*0822Cw*04010101
A*0240B*0823Cw*04010102
A*0241B*0824Cw*040102
A*0242B*0825Cw*040103
A*0243NB*0826Cw*040104

Fig. 3 continued

A*0244B*0827Cw*0403
A*0245B*0828Cw*040401
A*0246B*0829Cw*040402
A*0247B*0830NCw*0405
A*0248B*0831Cw*0406
A*0249B*1301Cw*0407
A*0250B*130201Cw*0408
A*0251B*130202Cw*0409N
A*0252B*130203Cw*0410
A*0253NB*1303Cw*0411
A*0254B*1304Cw*0412
A*0255B*1306Cw*0413
A*0256B*1307NCw*0414
A*0257B*1308Cw*0415
A*0258B*1309Cw*0416
A*0259B*1310Cw*0417
A*0260B*1311Cw*0418
A*0261B*1312Cw*0419
A*0262B*1313Cw*0420
A*0263B*1314Cw*0421
A*0264B*1315Cw*0423
A*0265B*1316Cw*0424
A*0266B*1317Cw*050101
A*0267B*1401Cw*050102
A*0268B*140201Cw*050103
A*0269B*140202Cw*0502
A*0270B*1403Cw*0503
A*0271B*1404Cw*0504
A*0272B*1405Cw*0505
A*0273B*140601Cw*0506
A*027401B*140602Cw*0507N
A*027402B*1407NCw*0508
A*0275B*15010101Cw*0509
A*0276B*15010102NCw*0510
A*0277B*150102Cw*0511
A*0278B*150103Cw*0512
A*0279B*150104Cw*0513
A*0280B*1502Cw*0514
A*0281B*1503Cw*0515
A*0282NB*1504Cw*06020101
A*0283NB*1505Cw*06020102
A*0284B*1506Cw*060202
A*0285B*1507Cw*0603
A*0286B*1508Cw*0604

Fig. 3 continued

A*0287B*1509Cw*0605
A*0288NB*1510Cw*0606
A*0289B*151101Cw*0607
A*0290B*151102Cw*0608
A*0291B*151103Cw*0609
A*0292B*1512Cw*0610
A*0293B*1513Cw*0611
A*0294NB*1514Cw*0612
A*0295B*1515Cw*0613
A*0296B*1516Cw*0614
A*0297B*15170101Cw*070101
A*0299B*15170102Cw*070102
A*03010101B*151702Cw*070103
A*03010102NB*1518Cw*070104
A*03010103B*1519Cw*070105
A*030102B*1520Cw*070106
A*030103B*1521Cw*070107
A*030104B*1523Cw*07020101
A*030105B*1524Cw*07020102
A*0302B*1525Cw*07020103
A*0303NB*1526NCw*0703
A*0304B*1527Cw*070401
A*0305B*1528Cw*070402
A*0306B*1529Cw*0705
A*0307B*1530Cw*0706
A*0308B*1531Cw*0707
A*0309B*1532Cw*0708
A*0310B*1533Cw*0709
A*0311NB*1534Cw*0710
A*0312B*1535Cw*0711
A*0313B*1536Cw*0712
A*0314B*1537Cw*0713
A*0315B*1538Cw*0714
A*0316B*1539Cw*0715
A*0317B*1540Cw*0716
A*0318B*1542Cw*0717
A*0319B*1543Cw*0718
A*0320B*1544Cw*0719
A*0321NB*1545Cw*0720
A*0322B*1546Cw*0721
A*0323B*1547Cw*0722
A*0324B*1548Cw*0723
A*0325B*1549Cw*0724
A*0326B*1550Cw*0725

Fig. 3 continued

A*110101B*1551Cw*0726
A*110102B*1552Cw*0727
A*110103B*1553Cw*0728
A*110104B*1554Cw*0729
A*110105B*1555Cw*0730
A*110106B*1556Cw*0731
A*110201B*1557Cw*0732N
A*110202B*1558Cw*0733N
A*1103B*1560Cw*0734
A*1104B*1561Cw*0735
A*1105B*1562Cw*0736
A*1106B*1563Cw*0737
A*1107B*1564Cw*0738
A*1108B*1565Cw*0739
A*1109B*1566Cw*0740
A*1110B*1567Cw*0741
A*1111B*1568Cw*0742
A*1112B*1569Cw*0743
A*1113B*1570Cw*0744
A*1114B*1571Cw*0745
A*1115B*1572Cw*080101
A*1116B*1573Cw*080102
A*1117B*1574Cw*0802
A*1118B*1575Cw*0803
A*1119B*1576Cw*0804
A*1120B*1577Cw*0805
A*1121NB*1578Cw*0806
A*1122B*1579NCw*0807
A*1123B*1580Cw*0808
A*1124B*1581Cw*0809
A*1125B*1582Cw*0810
A*1126B*1583Cw*0811
A*1127B*1584Cw*0812
A*1128B*1585Cw*0813
A*1129B*1586Cw*0814
A*2301B*1587Cw*120201
A*2302B*1588Cw*120202
A*2303B*1589Cw*120203
A*2304B*1590Cw*12030101
A*2305B*1591Cw*12030102
A*2306B*1592Cw*120302
A*2307NB*1593Cw*120303
A*2308NB*1594NCw*120304
A*2309B*1595Cw*120401

Fig. 3 continued

A*2310B*1596Cw*120402
A*2311NB*1597Cw*1205
A*2312B*1598Cw*1206
A*2313B*1599Cw*1207
A*2314B*9501Cw*1208
A*24020101B*9502Cw*1209
A*24020102LB*9503Cw*1210
A*240202B*9504Cw*1211
A*240203B*9505Cw*1212
A*240204B*9506Cw*1213
A*240205B*9507Cw*1214
A*240206B*9508Cw*1215
A*240207B*9509Cw*1216
A*240208B*9510Cw*1217
A*240209B*9511NCw*1218
A*240210B*9512Cw*1219
A*240211B*9513Cw*140201
A*240212B*9514Cw*140202
A*240213B*9515Cw*140203
A*240301B*9516Cw*140204
A*240302B*9517Cw*1403
A*2404B*9518Cw*1404
A*2405B*9519Cw*1405
A*2406B*9520Cw*1406
A*2407B*9521Cw*1407N
A*2408B*9522Cw*1408
A*2409NB*180101Cw*150201
A*2410B*180102Cw*150202
A*2411NB*180103Cw*150203
A*2413B*1802Cw*1503
A*2414B*1803Cw*1504
A*2415B*1804Cw*150501
A*2417B*1805Cw*150502
A*2418B*1806Cw*150503
A*2419B*1807Cw*150504
A*2420B*1808Cw*1506
A*2421B*1809Cw*1507
A*2422B*1810Cw*1508
A*2423B*1811Cw*1509
A*2424B*1812Cw*1510
A*2425B*1813Cw*1511
A*2426B*1814Cw*1512
A*2427B*1815Cw*1513
A*2428B*1817NCw*1514

Fig. 3 continued

A*2429B*1818Cw*1515
A*2430B*1819Cw*1516
A*2431B*1820Cw*1517
A*2432B*1821Cw*160101
A*2433B*1822Cw*160102
A*2434B*1823NCw*1602
A*2435B*1824Cw*160401
A*2436NB*2701Cw*1606
A*2437B*2702Cw*1607
A*2438B*2703Cw*1608
A*2439B*270401Cw*1609
A*2440NB*270402Cw*1701
A*2441B*270502Cw*1702
A*2442B*270503Cw*1703
A*2443B*270504Cw*1704
A*2444B*270505Cw*1801
A*2445NB*270506Cw*1802
A*2446B*270507
A*2447B*270508
A*2448NB*270509
A*2449B*2706
A*2450B*2707
A*2451B*2708
A*2452B*2709
A*2453B*2710
A*2454B*2711
A*2455B*2712
A*2456B*2713
A*2457B*2714
A*2458B*2715
A*2459B*2716
A*2460NB*2717
A*2461B*2718
A*2462B*2719
A*2463B*2720
A*2464B*2721
A*2465B*2723
A*2466B*2724
A*2467B*2725
A*2468B*2726
A*250101B*2727
A*250102B*2728
A*2502B*2729
A*2503B*2730

HLA-HHLA-JHLA-KHLA-LHLA-P
H*01010101J*01010101K*01010101L*01010101P*01010101
H*01010102J*01010102K*01010102L*01010102P*01010102
H*01010103J*01010103K*01010103L*01010103P*02010101
H*0102J*01010104K*01010104L*010102P*02010102
H*02010101J*01010105K*0102L*0102
H*02010102J*01010106K*0103
H*0202J*01010107
H*0203J*01010108
H*0204J*0201
H*0205
H*0206
H*0301

Fig. 3 continued

Figure 4: Top 30 HLA class 1 allele frequency in human ethnic groups

| % chance of allele expressed in an individual | | | | | | | |
|---|---|---|---|---|---|---|---|
| Top 30 expressed alleles | | | | | | | |
| Allele | Caucasian | Allele | African-American | Allele | Hispanic | Allele | Oriental |
| A*0201 | 45.6% | C*0401 | 29.0% | A*0201 | 37.1% | A*1101 | 38.4% |
| C*0701 | 27.7% | C*0701 | 26.4% | C*0401 | 25.4% | A*2402 | 33.7% |
| A*0101 | 27.4% | C*0602 | 25.0% | A*2402 | 24.9% | C*0702 | 33.3% |
| A*0301 | 23.8% | A*0201 | 22.3% | C*0702 | 24.2% | C*0102 | 27.7% |
| C*0702 | 21.5% | A*2301 | 20.7% | C*0701 | 20.8% | A*3303 | 23.3% |
| C*0401 | 21.2% | C*0202 | 19.0% | C*0304 | 14.4% | C*0801 | 21.6% |
| B*4402 | 20.2% | A*0301 | 18.7% | A*0301 | 14.3% | C*0304 | 19.9% |
| B*0702 | 18.1% | C*0702 | 18.1% | B*0702 | 13.2% | A*0201 | 18.1% |
| B*0801 | 18.1% | B*5301 | 18.1% | B*3501 | 12.8% | B*4001 | 15.2% |
| C*0501 | 17.2% | B*0702 | 15.8% | C*0602 | 12.3% | C*0401 | 14.0% |
| C*0304 | 16.8% | C*1601 | 15.7% | C*0501 | 11.9% | B*5801 | 13.3% |
| C*0602 | 15.7% | B*1503 | 13.9% | A*0101 | 11.4% | B*4601 | 12.7% |
| A*1101 | 15.3% | B*5801 | 13.5% | A*1101 | 11.0% | B*5101 | 12.4% |
| B*4001 | 13.6% | A*6802 | 12.7% | B*5101 | 10.8% | C*0302 | 12.0% |
| A*2402 | 12.1% | C*1701 | 11.7% | C*1601 | 10.6% | B*3802 | 11.4% |
| B*3501 | 10.7% | B*4501 | 10.8% | B*4403 | 9.9% | A*0207 | 11.0% |
| C*0303 | 10.6% | B*4201 | 10.5% | C*0102 | 9.7% | B*1501 | 9.4% |
| B*5101 | 10.4% | A*3001 | 10.4% | A*2902 | 9.7% | A*0206 | 9.3% |
| C*1203 | 9.9% | B*3501 | 10.1% | C*0802 | 9.3% | C*0303 | 9.2% |
| B*1501 | 9.6% | A*0101 | 10.0% | B*1801 | 9.1% | B*1502 | 9.1% |
| A*2902 | 8.9% | C*0304 | 9.3% | A*3101 | 8.9% | A*0203 | 8.8% |
| A*2601 | 8.2% | A*3002 | 9.2% | B*5201 | 8.6% | B*4403 | 8.6% |
| A*3201 | 8.2% | B*0801 | 8.5% | B*1402 | 8.6% | C*1402 | 8.4% |
| C*0802 | 7.7% | A*3402 | 8.4% | C*0202 | 7.6% | B*3501 | 7.2% |
| A*2501 | 7.5% | A*7401 | 8.4% | C*1203 | 7.6% | C*0602 | 7.0% |
| B*5701 | 7.1% | A*3303 | 8.0% | A*2601 | 7.6% | B*5401 | 6.9% |
| B*1402 | 6.7% | C*1801 | 7.3% | A*6801 | 7.1% | B*1301 | 6.6% |
| C*0202 | 6.6% | A*2902 | 7.2% | B*0801 | 7.0% | B*4002 | 6.3% |
| B*1801 | 6.4% | B*4403 | 6.9% | A*3002 | 6.9% | B*5502 | 6.3% |
| B*4403 | 6.4% | B*4901 | 6.9% | B*4402 | 6.5% | A*2601 | 6.0% |

Data from HLA Matchmaker, http://tpis.upmc.edu/tpis/HLAMatchmaker/

A
Nucleophilic substitution reaction
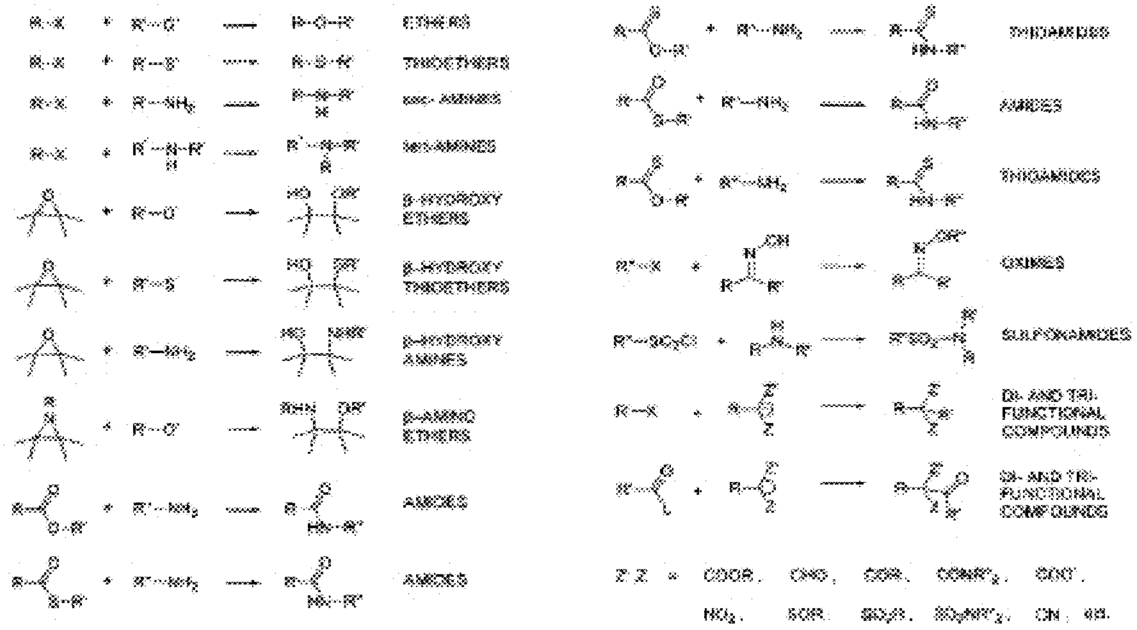
Aromatic nucleophilic substitution
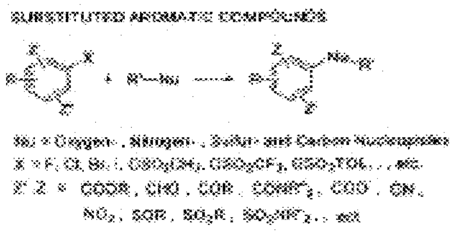
Transition metal catalysed reactions
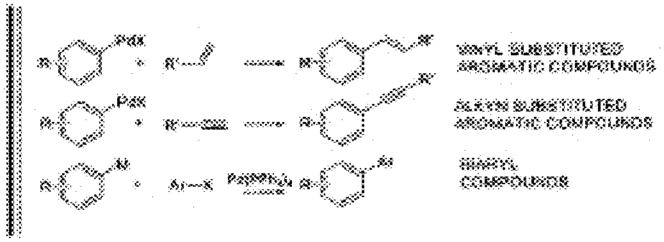
Figure 5: Reactive groups and the bonds formed upon their reaction.

B
Addition to carbon-carbon multiplebonds
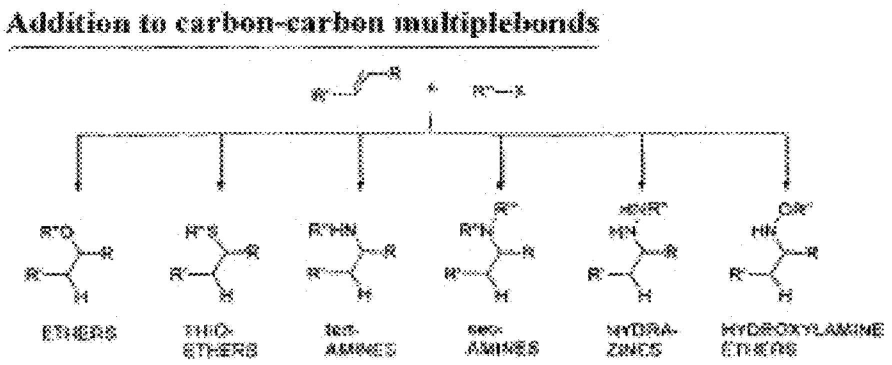
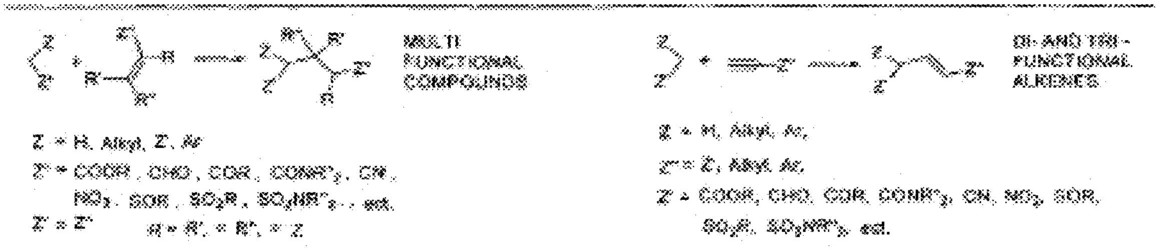
Cycloaddition to multiple bounds
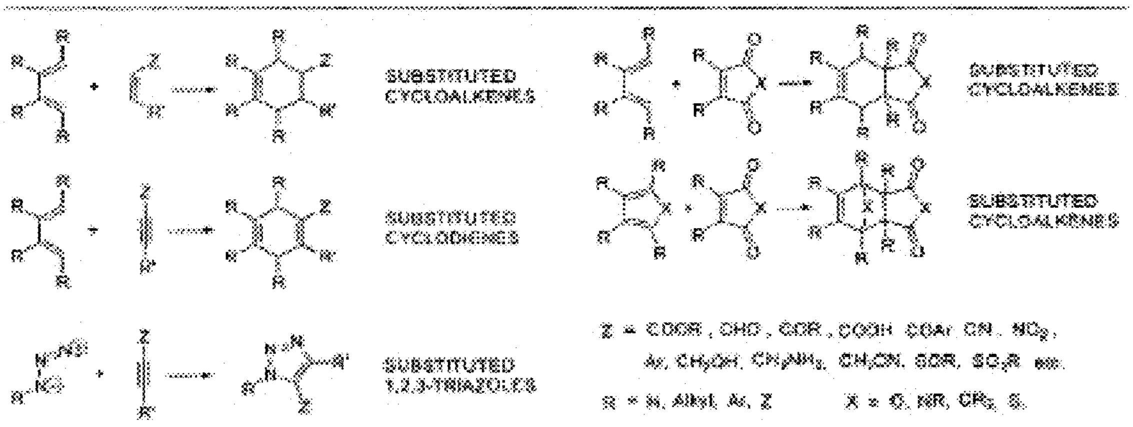
Figure 5, continued: Reactive groups and the bonds formed upon their reaction.

C
Addition to carbon-hetero multiple bonds
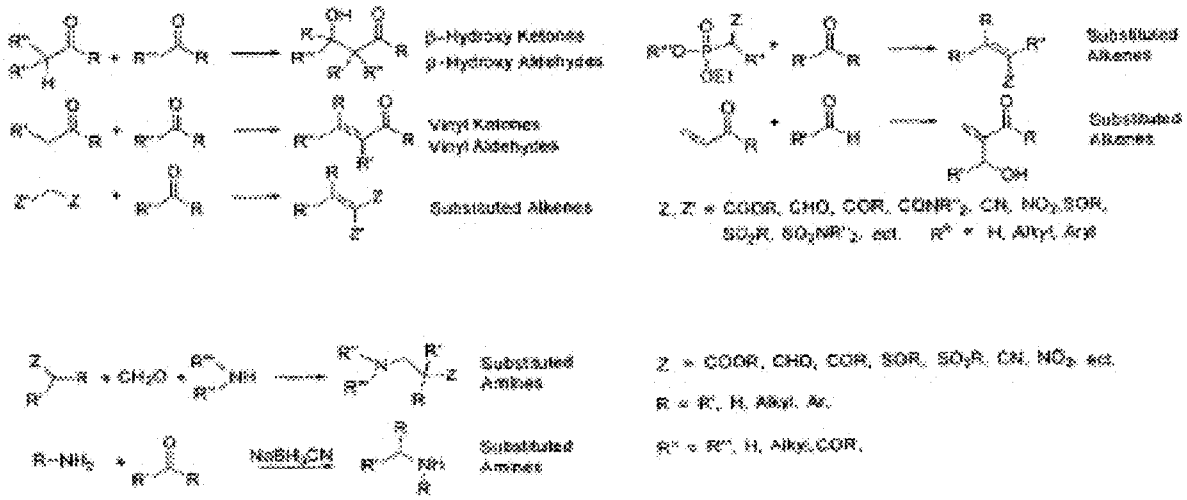
Figure 5, continued. Reactive groups and the bonds formed upon their reaction.

A. Linker for the formation of Ketones, Aldehydes, Amides and Acids

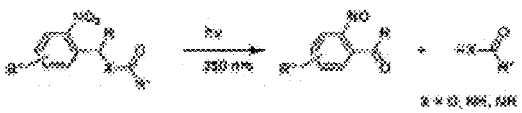

B. Linker for the formation of Ketones, Amides and Acids

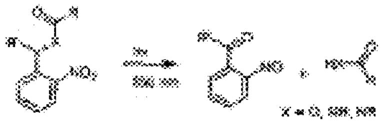

C. Linker for the formation of Aldehydes and Ketones

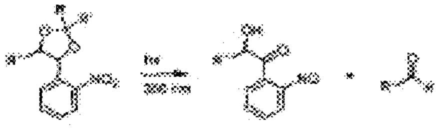

D. Linker for the formation of Alcohols and Acids

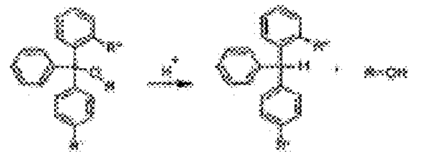

E. Linker for the formation of Amines and Alcohols

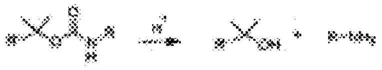

F. Linker for the formation of Esters, Thioesters, Amides and Alcohols

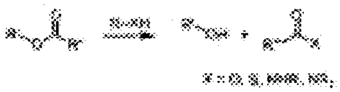

G. Linker for the formation of Sulfonamides and Alcohols

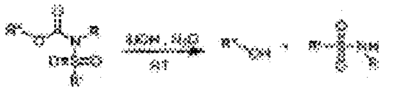

H. Linker for the formation of Ketones, Amines and Alcohols

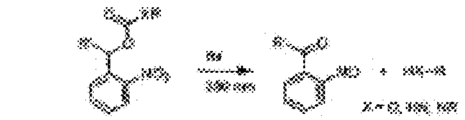

I. Linker for the formation of Ketones, Amines, Alcohols and Mercaptanes

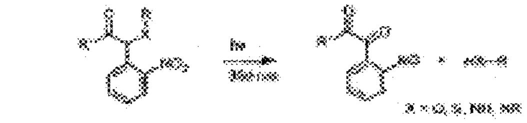

J. Linker for the formation of Biaryl and Biheteraryl

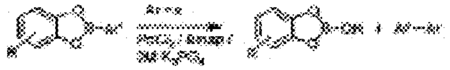

K. Linker for the formation of Benzyles, Amines, Aniline Alcohols and Phenoles

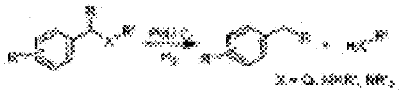

L. Linker for the formation of Mercaptanes

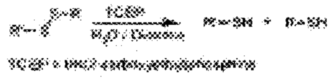

M. Linker for the formation of Glycosides

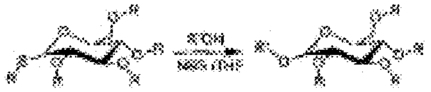

N. Linker for the formation of Aldehydes and Glyoxylamides

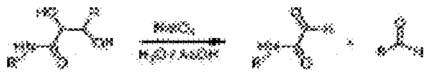

O. Linker for the formation of Aldehydes, Ketones and Aminoalcohols

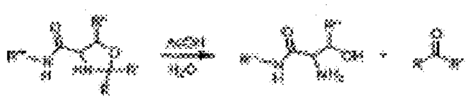

Figure 6: Cleavable linkers, conditions for cleaving them and the resulting products of the cleavage.

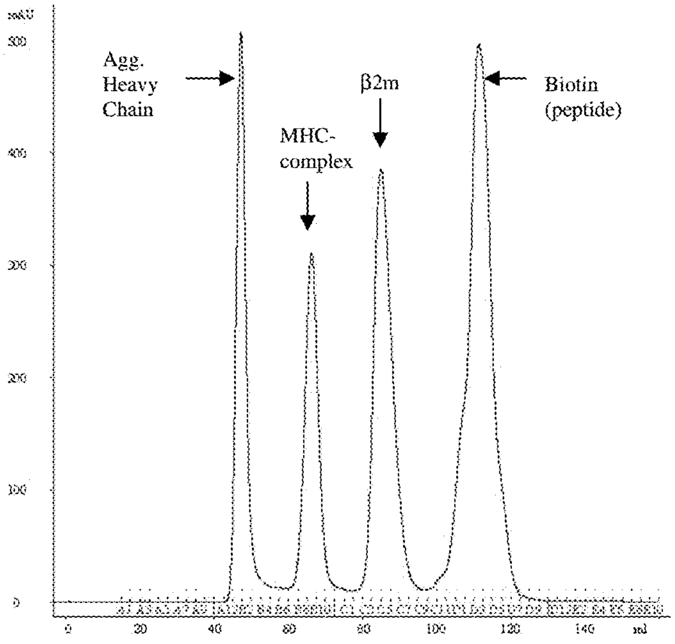
**Figure 7: Size exclusion chromatography of folded HLA-A*0201-β2m-QLFEELQEL-complex (SEQ ID NO 201986)**
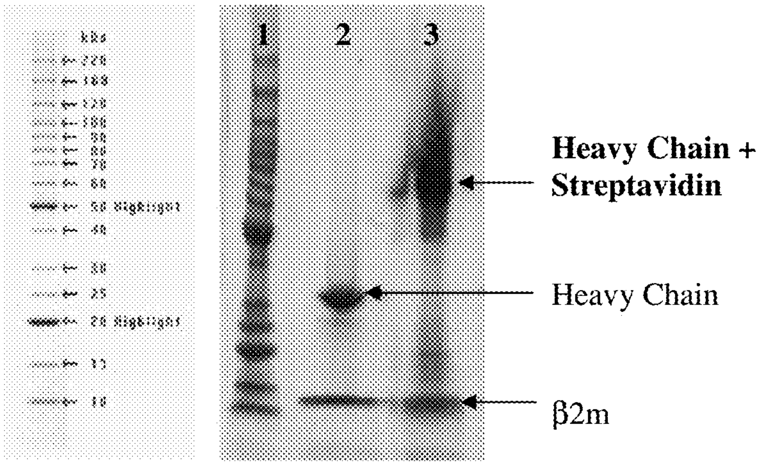
Figure 8: MHC-SHIFT Assay

A
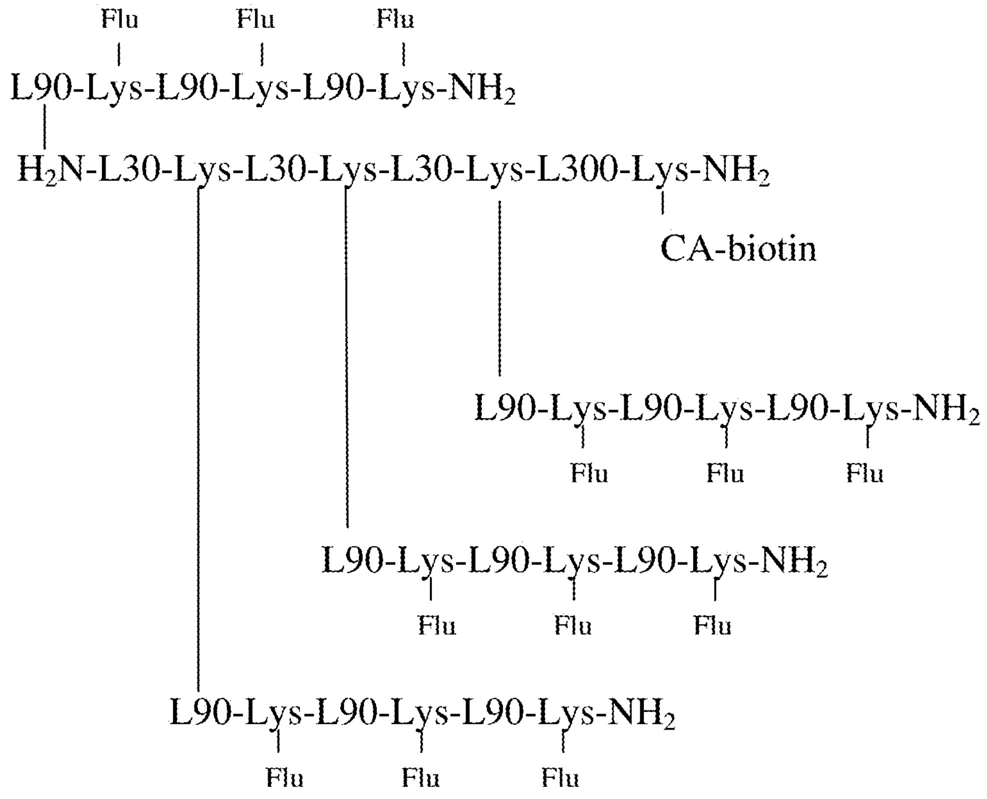
B
L15 linker composition:
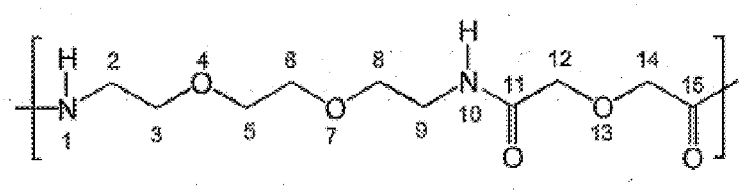
Figure 9: Composition of a Fluorescein-linker molecule

| Database | Alleles |
|---|---|
| http://www.cbs.dtu.dk/services/NetMHC/ | HLA-A0101, HLA-A0201, HLA-A0202, HLA-A0203, HLA-A0204, HLA-A0206, HLA-A0211, HLA-A0212, HLA-A0216, HLA-A0219, HLA-A0301, HLA-A1101, HLA-A2301, HLA-A2402, HLA-A2403, HLA-A2601, HLA-A2602, HLA-A2902, HLA-A3002, HLA-A3101, HLA-A3301, HLA-A6801, HLA-A6802, HLA-A6901 |
| http://www.cbs.dtu.dk/services/NetMHCII/ | HLA-DRB1*0101, HLA-DRB1*0301, HLA-DRB1*0401, HLA-DRB1*0404, HLA-DRB1*0405, HLA-DRB1*0701, HLA-DRB1*0802, HLA-DRB1*0901, HLA-DRB1*1101, HLA-DRB1*1302, HLA-DRB1*1501, HLA-DRB3*0101, HLA-DRB4*0101, HLA-DRB1*0501 |

Figure 10. HLA alleles of the NetMHC databases

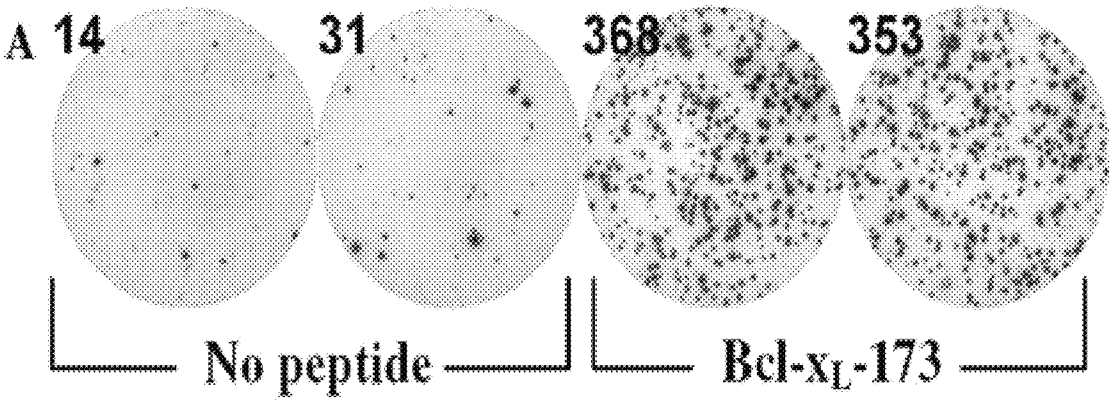
Figure 11: Ex vivo ELISPOT analysis of BclX(L)-specific CD8 positive T cells in PBL from a breast cancer patient.

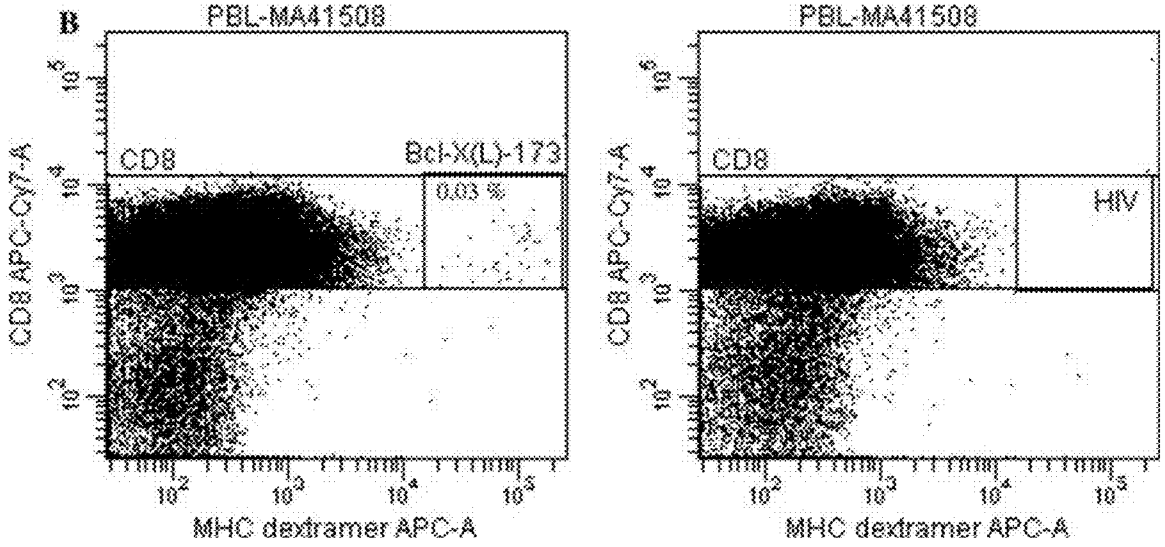
Figure 12: PBL from a breast cancer patient analyzed by flow cytometry.

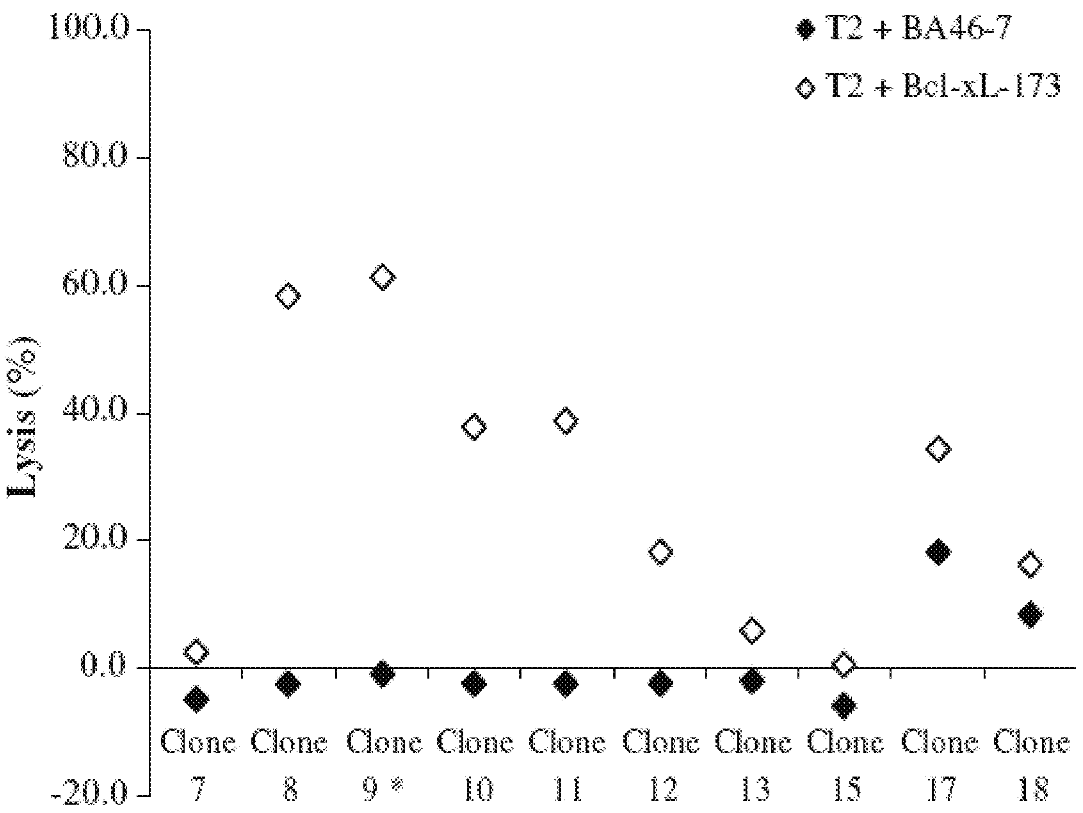
Figure 13: 51-Cr release assay of isolated T cell clones.

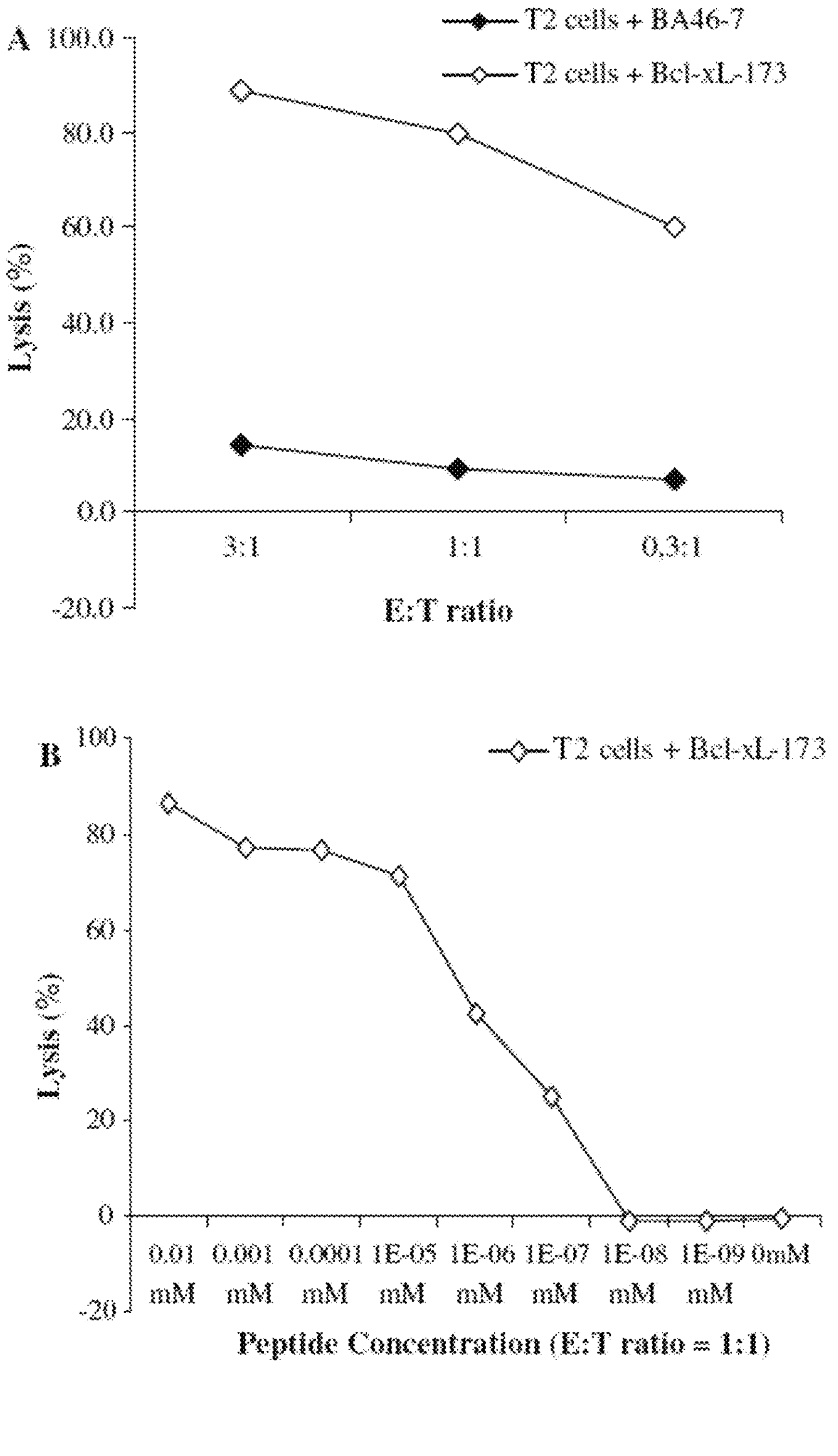
Figure 14: Bcl-X(L)173–182 specific clone tested for its cytotoxic potential in 51-Cr release assays.

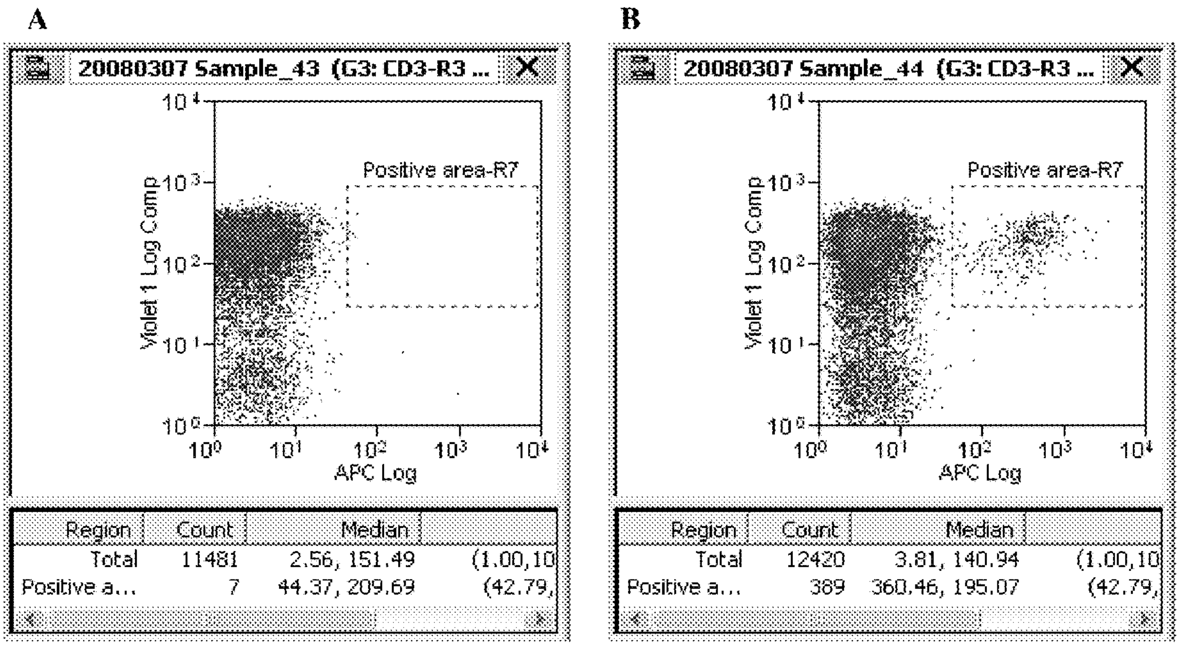
Figure 15: Detection of CMV specific T cells using MHC dextramers.

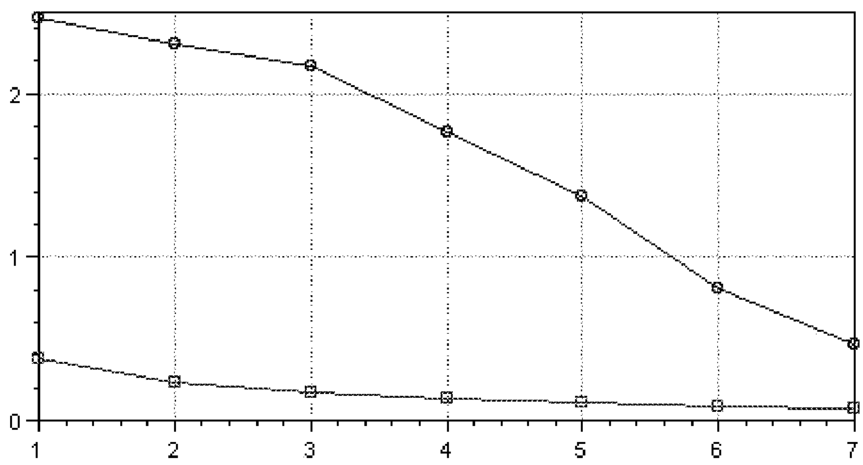
○ Folded β2m/HLA-A*0201/QLFEELQEL (SEQ ID NO 201986)
□ Neg. control (β2m)
Figure 16: Conformational ELISA

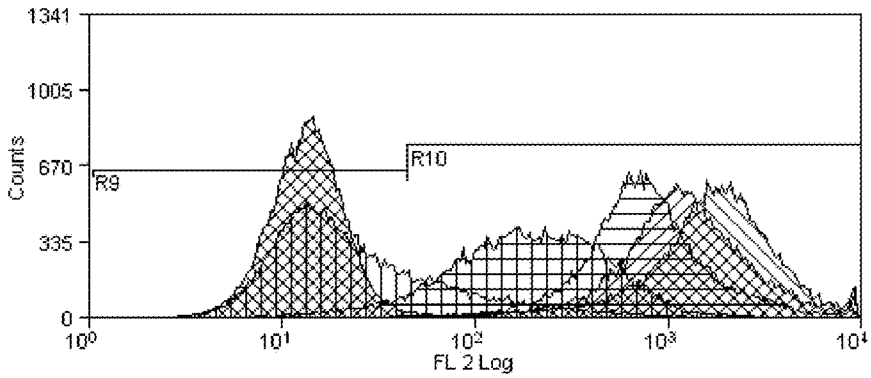

| MHC-complex | TCR | Percentage of cells in R10 (Positive events) |
|---|---|---|
| HLA-A*0201(NLVPMVATV) | 20 µg dimeric TCR | 99,8% |
| HLA-A*0201(NLVPMVATV) | 10 µg dimeric TCR | 99,8% |
| HLA-A*0201(NLVPMVATV) | 5 µg dimeric TCR | 99,7% |
| HLA-A*0201(NLVPMVATV) | 2 µg dimeric TCR | 93,1% |
| HLA-A*0201(NLVPMVATV) | 0 µg dimeric TCR | 25,1% |
| HLA-A*0201(ILKEPVHGV) | 10 ug dimeric TCR | 1,5% |

**Figure 17: Carboxylate-modified beads coupled to TCR and stained with HLA-A*0201(NLVPMVATV)/RPE (SEQ ID NO 201990) or HLA-A*0201(ILKEPVHGV)/RPE (SEQ ID NO 201991) dextramers.**

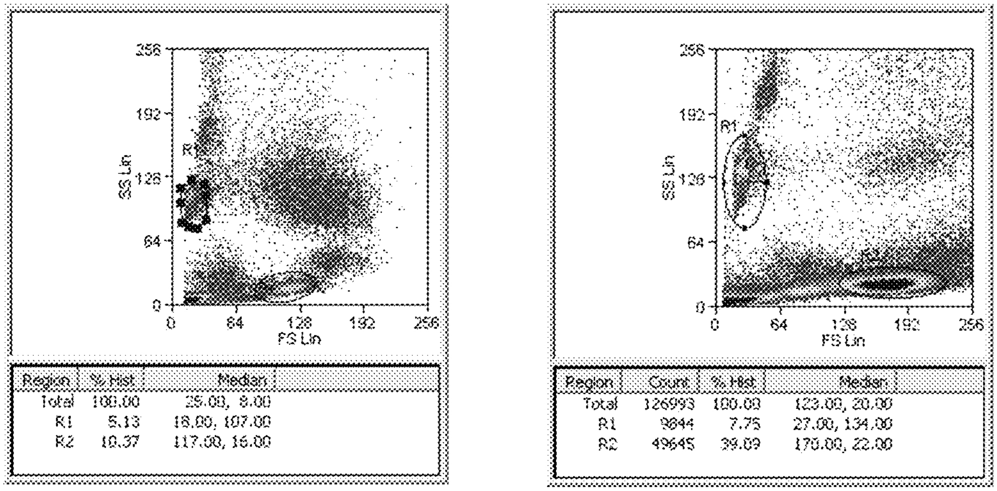
Figure 18: Flow cytometry analysis of human cell samples added TCR-coated beads.

Figure 19: Flow cytometry analysis of MHC multimer constructs carrying nonsense peptides. NLVPMVATV is SEQ ID NO 201990) and ILKEPVHGV is SEQ ID NO 201991.
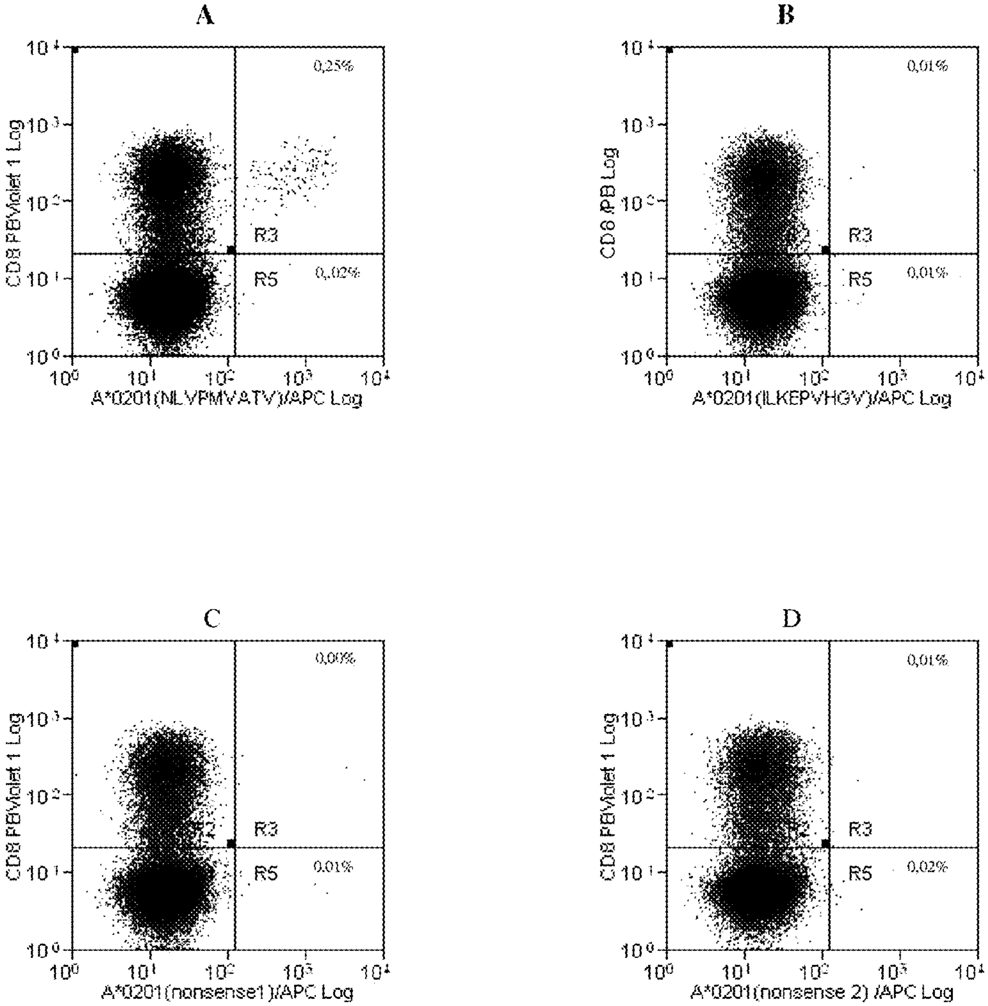

| | *Positive* | *Negative* | Construct 1 | Construct 2 | Construct 3 | Construct 4 | Construct 5 |
|---|---|---|---|---|---|---|---|
| **Donor** | | | | | | | |
| **1** | – | A2(NLVPMVATV)<br>A2(ILKEPVHGV) | - | - | - | nt | - |
| **2** | A2(NLVPMVATV) | A2(ILKEPVHGV) | - | - | + | nt | - |
| **3** | A2(NLVPMVATV) | A2(ILKEPVHGV) | - | - | + | nt | - |
| **4** | A2(NLVPMVATV) | A2(ILKEPVHGV) | - | - | + | nt | - |
| **5** | A2(NLVPMVATV) | A2(ILKEPVHGV) | - | - | + | nt | - |
| **6** | A2(NLVPMVATV) | A2(ILKEPVHGV) | - | - | + | nt | - |
| **7** | - | A2(ILKEPVHGV)<br>A2(GLCTLVAML) | - | - | nt | - | - |
| **8** | A2(GLCTLVAML) | A2(ILKEPVHGV) | - | - | nt | + | - |
| **9** | A2(GLCTLVAML) | A2(ILKEPVHGV) | - | - | nt | + | - |

Figure 20: Summary of flow cytometry analysis of the binding of different MHC multimer constructs to specific T cells in purified Human Peripheral Blood. NLVPMVATV is SEQ ID NO 201990), ILKEPVHGV is SEQ ID NO 201991 and GLCTLVAML is SEQ ID NO 201993.

A
B
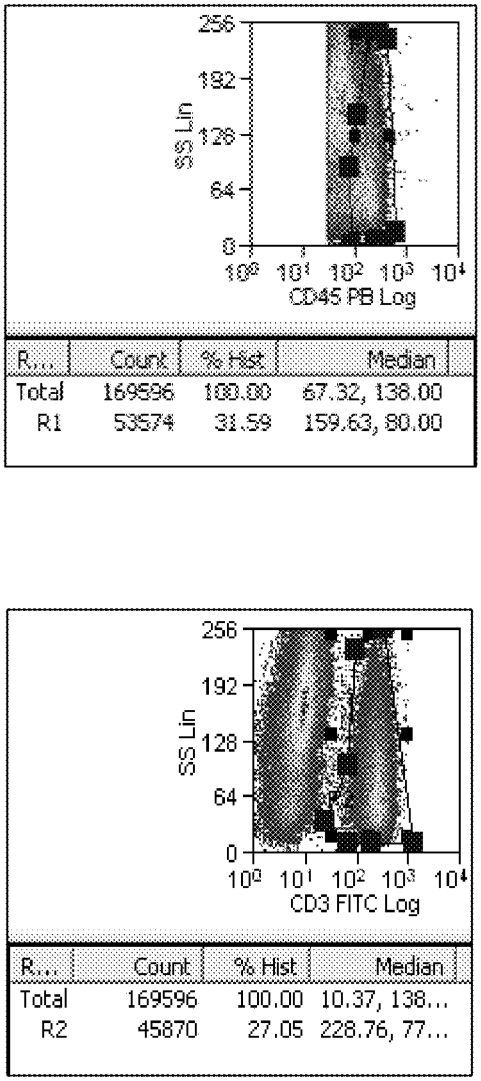
Figure 21: Gating strategy for no-lyse no-wash procedure.

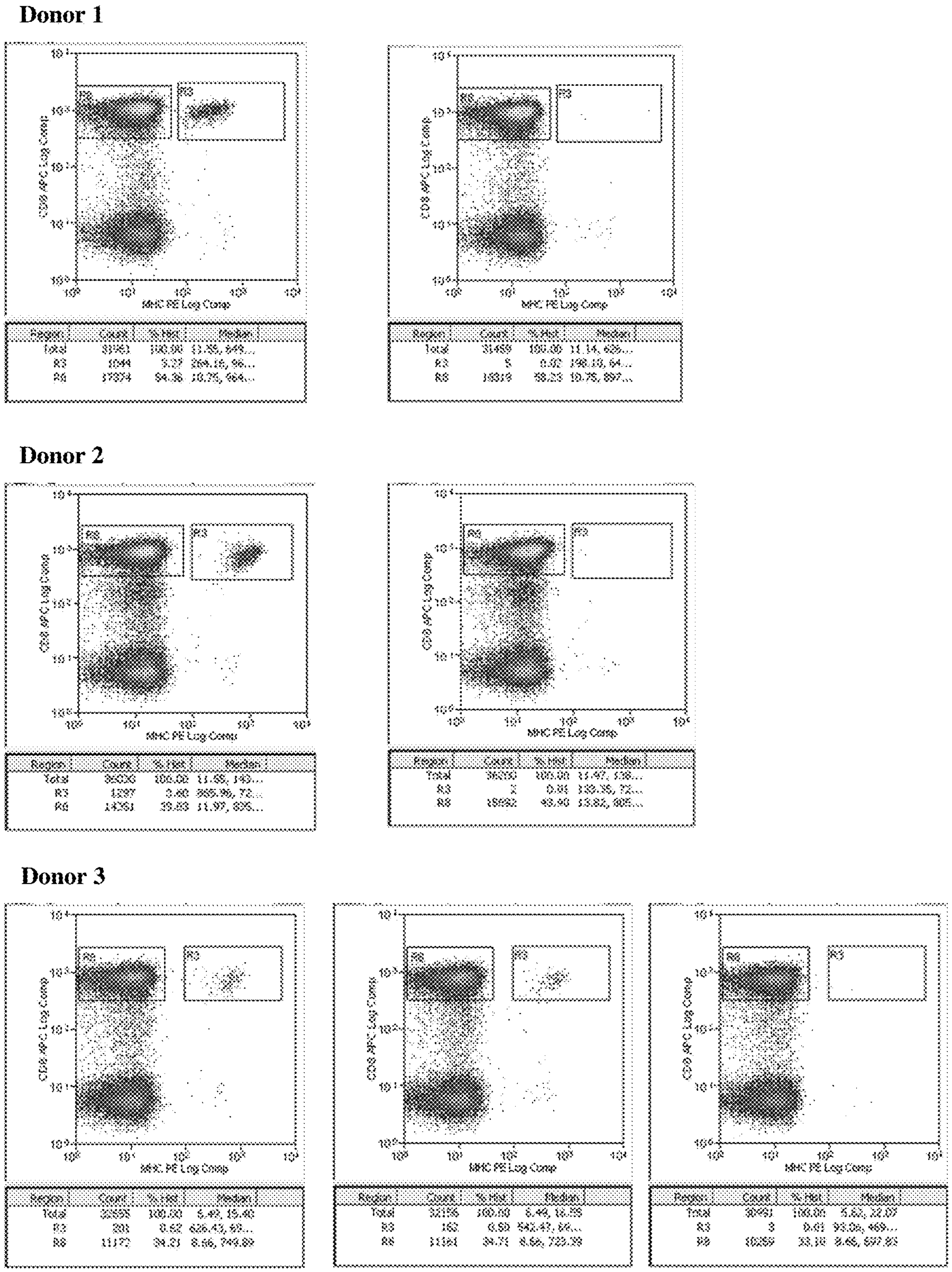
Figure 22: Identification of CMV-specific T cells in a blood sample using no-lyse no-wash procedure.

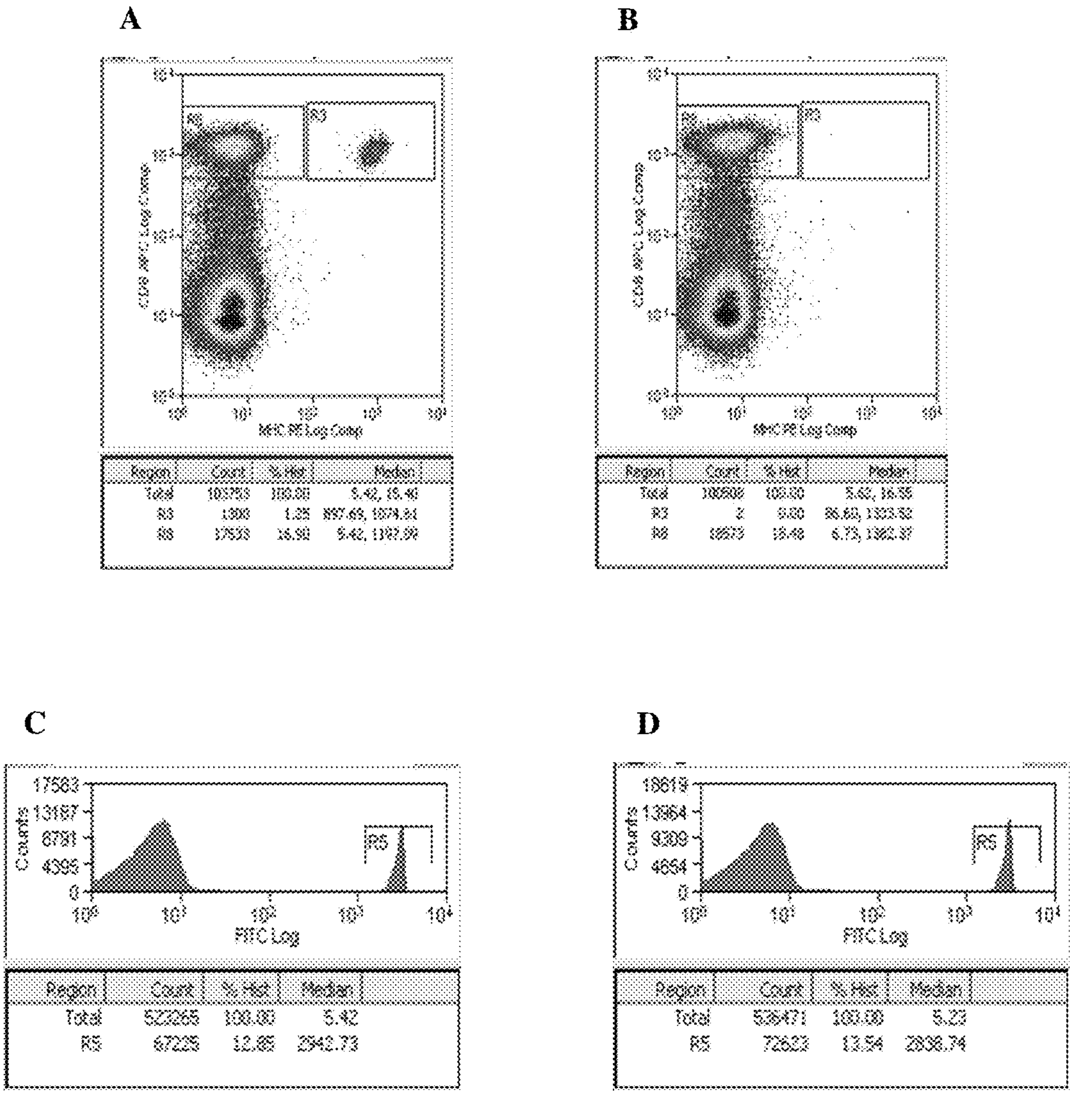
Figure 23: Enumeration of specific T cells using CytoCount™ beads.

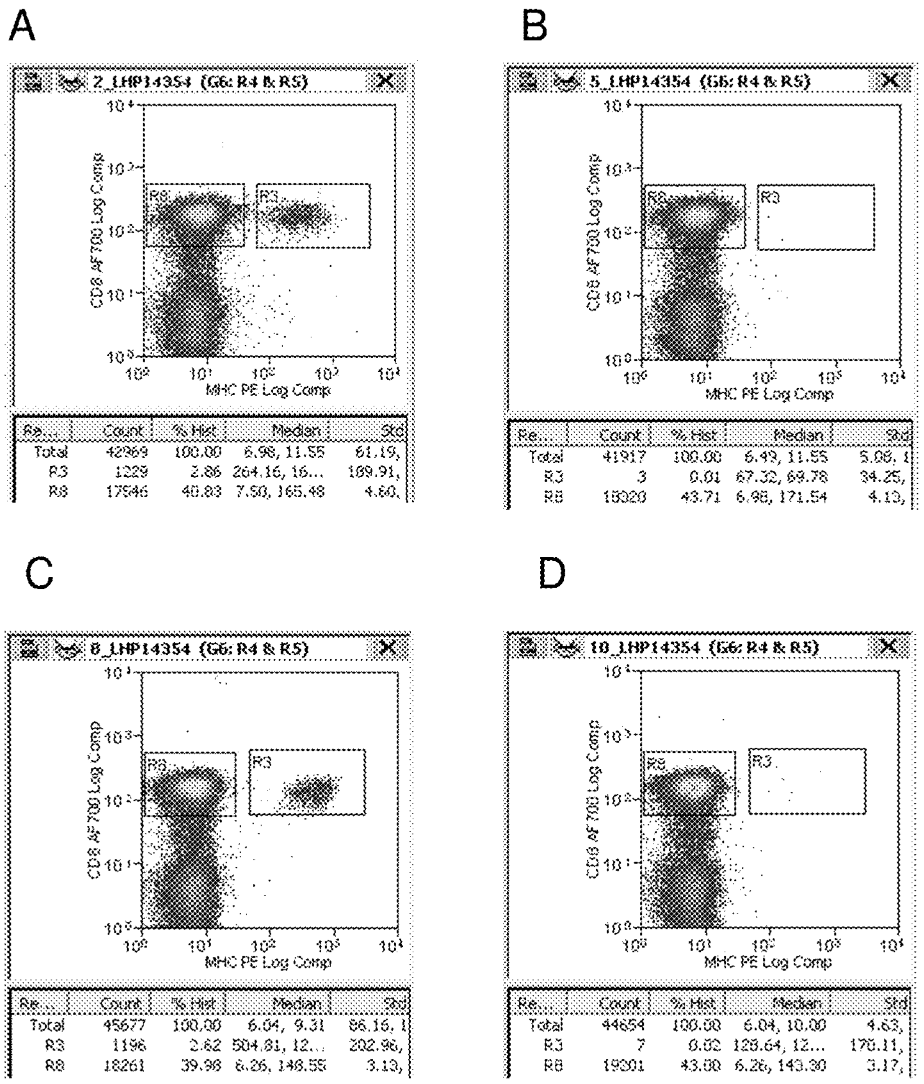
Figure 24: MHC-peptide complexes can be embedded in a sugar matrix together with antibodies and used for detection of specific T cells in a blood sample.

Figure 25: Summary flow chart, ELISPOT.
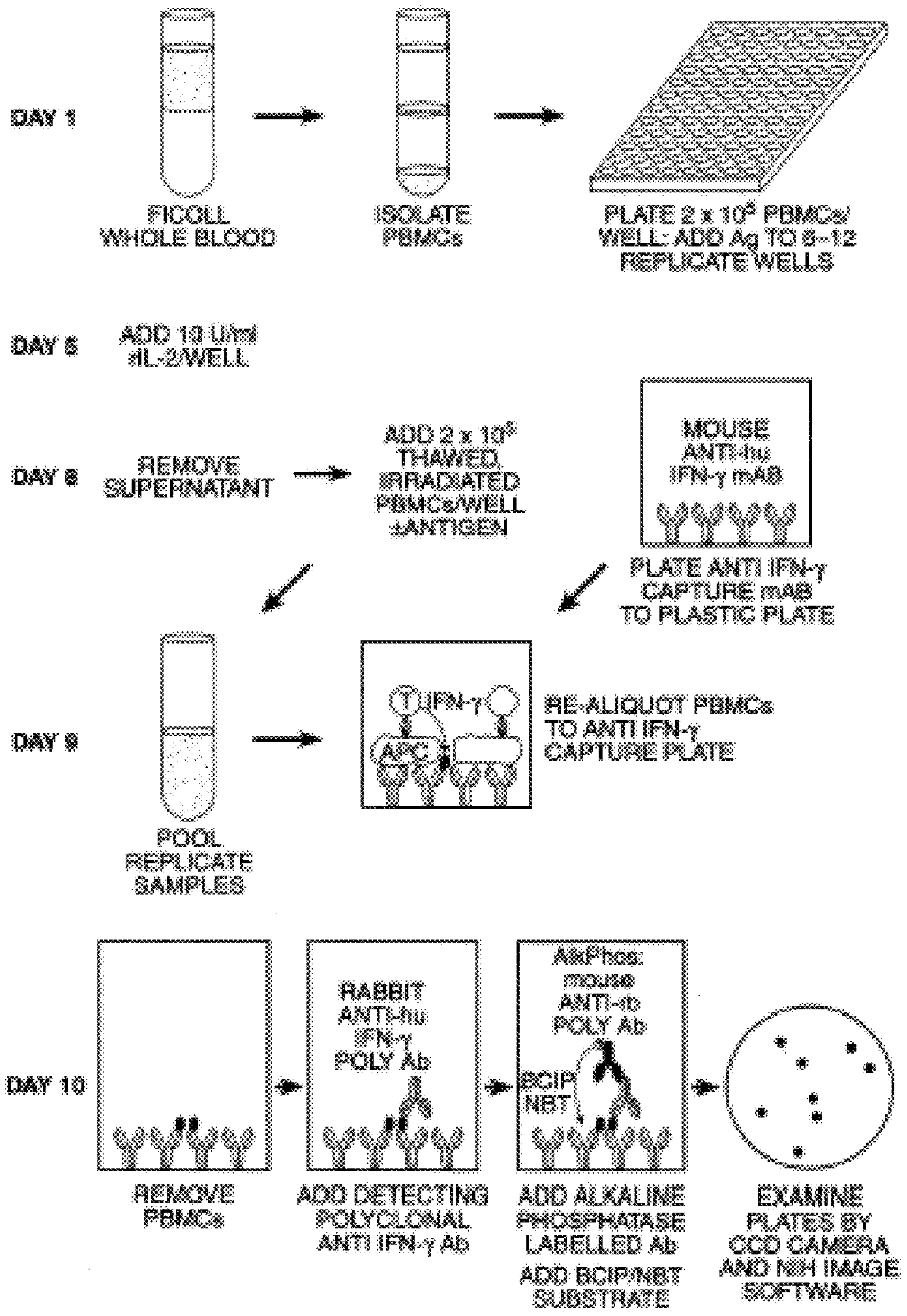

Figure 26: Prediction of cancer antigen BclX(L) specific MHC class 1, 8- , 9-, 10-, 11-mer peptide binders. Peptide sequences corresponds to SEQ ID NO 200681-201473 in the sequence listing.

| pos | peptide | logscore | affinity(nM) | Bind Level | Protein Name | Allele |
|---|---|---|---|---|---|---|
| | 8-mers | | | | | |
| 57 | HLADSPAV | 0.691 | 28 | SB | Sequence | A0201 |
| 213 | FLTGMTVA | 0.687 | 29 | SB | Sequence | A0201 |
| 166 | AAWMATYL | 0.477 | 285 | WB | Sequence | A0201 |
| 160 | VLVSRIAA | 0.463 | 333 | WB | Sequence | A0201 |
| 119 | YQSFEQVV | 0.436 | 448 | WB | Sequence | A0201 |
| 147 | GALCVESV | 0.431 | 472 | WB | Sequence | A0201 |
| 223 | VLLGSLFS | 0.427 | 494 | WB | Sequence | A0201 |
| 213 | FLTGMTVA | 0.777 | 11 | SB | Sequence | A0202 |
| 57 | HLADSPAV | 0.771 | 11 | SB | Sequence | A0202 |
| 119 | YQSFEQVV | 0.590 | 84 | WB | Sequence | A0202 |
| 218 | TVAGVVLL | 0.565 | 110 | WB | Sequence | A0202 |
| 11 | FLSYKLSQ | 0.545 | 137 | WB | Sequence | A0202 |
| 82 | MAAVKQAL | 0.512 | 195 | WB | Sequence | A0202 |
| 73 | SLDAREVI | 0.475 | 294 | WB | Sequence | A0202 |
| 192 | ELYGNNAA | 0.444 | 410 | WB | Sequence | A0202 |
| 217 | MTVAGVVL | 0.440 | 425 | WB | Sequence | A0202 |
| 160 | VLVSRIAA | 0.434 | 454 | WB | Sequence | A0202 |
| 1 | SQSNRELV | 0.434 | 457 | WB | Sequence | A0202 |
| 213 | FLTGMTVA | 0.852 | 4 | SB | Sequence | A0203 |
| 57 | HLADSPAV | 0.831 | 6 | SB | Sequence | A0203 |
| 160 | VLVSRIAA | 0.642 | 48 | SB | Sequence | A0203 |
| 158 | MQVLVSRI | 0.602 | 74 | WB | Sequence | A0203 |
| 11 | FLSYKLSQ | 0.582 | 92 | WB | Sequence | A0203 |
| 133 | GVNWGRIV | 0.581 | 92 | WB | Sequence | A0203 |
| 216 | GMTVAGVV | 0.579 | 94 | WB | Sequence | A0203 |
| 119 | YQSFEQVV | 0.578 | 96 | WB | Sequence | A0203 |
| 164 | RIAAWMAT | 0.573 | 101 | WB | Sequence | A0203 |
| 78 | EVIPMAAV | 0.486 | 261 | WB | Sequence | A0203 |
| 1 | SQSNRELV | 0.481 | 274 | WB | Sequence | A0203 |
| 217 | MTVAGVVL | 0.467 | 318 | WB | Sequence | A0203 |
| 147 | GALCVESV | 0.464 | 328 | WB | Sequence | A0203 |
| 221 | GVVLLGSL | 0.443 | 412 | WB | Sequence | A0203 |
| 218 | TVAGVVLL | 0.440 | 429 | WB | Sequence | A0203 |
| 57 | HLADSPAV | 0.555 | 122 | WB | Sequence | A0204 |
| 153 | SVDKEMQV | 0.431 | 469 | WB | Sequence | A0204 |
| 57 | HLADSPAV | 0.780 | 10 | SB | Sequence | A0206 |
| 158 | MQVLVSRI | 0.733 | 18 | SB | Sequence | A0206 |
| 213 | FLTGMTVA | 0.682 | 31 | SB | Sequence | A0206 |
| 1 | SQSNRELV | 0.677 | 32 | SB | Sequence | A0206 |
| 119 | YQSFEQVV | 0.677 | 33 | SB | Sequence | A0206 |
| 138 | RIVAFFSF | 0.653 | 42 | SB | Sequence | A0206 |
| 164 | RIAAWMAT | 0.575 | 99 | WB | Sequence | A0206 |
| 147 | GALCVESV | 0.568 | 106 | WB | Sequence | A0206 |
| 166 | AAWMATYL | 0.567 | 108 | WB | Sequence | A0206 |
| 217 | MTVAGVVL | 0.563 | 112 | WB | Sequence | A0206 |
| 160 | VLVSRIAA | 0.517 | 185 | WB | Sequence | A0206 |
| 42 | SEMETPSA | 0.514 | 191 | WB | Sequence | A0206 |
| 78 | EVIPMAAV | 0.496 | 233 | WB | Sequence | A0206 |
| 153 | SVDKEMQV | 0.493 | 240 | WB | Sequence | A0206 |

| | | | | | | |
|---|---|---|---|---|---|---|
| 57 | HLADSPAV | 0.955 | 1 | SB | Sequence | A0211 |
| 153 | SVDKEMQV | 0.898 | 3 | SB | Sequence | A0211 |
| 213 | FLTGMTVA | 0.893 | 3 | SB | Sequence | A0211 |
| 73 | SLDAREVI | 0.877 | 3 | SB | Sequence | A0211 |
| 192 | ELYGNNAA | 0.834 | 6 | SB | Sequence | A0211 |
| 218 | TVAGVVLL | 0.797 | 8 | SB | Sequence | A0211 |
| 172 | YLNDHLEP | 0.751 | 14 | SB | Sequence | A0211 |
| 78 | EVIPMAAV | 0.739 | 16 | SB | Sequence | A0211 |
| 216 | GMTVAGVV | 0.718 | 21 | SB | Sequence | A0211 |
| 160 | VLVSRIAA | 0.684 | 30 | SB | Sequence | A0211 |
| 223 | VLLGSLFS | 0.683 | 30 | SB | Sequence | A0211 |
| 133 | GVNWGRIV | 0.668 | 36 | SB | Sequence | A0211 |
| 212 | WFLTGMTV | 0.668 | 36 | SB | Sequence | A0211 |
| 144 | SFGGALCV | 0.591 | 83 | WB | Sequence | A0211 |
| 72 | SSLDAREV | 0.590 | 84 | WB | Sequence | A0211 |
| 106 | DLTSQLHI | 0.564 | 111 | WB | Sequence | A0211 |
| 119 | YQSFEQVV | 0.545 | 136 | WB | Sequence | A0211 |
| 81 | PMAAVKQA | 0.532 | 158 | WB | Sequence | A0211 |
| 11 | FLSYKLSQ | 0.511 | 198 | WB | Sequence | A0211 |
| 166 | AAWMATYL | 0.456 | 360 | WB | Sequence | A0211 |
| 1 | SQSNRELV | 0.439 | 431 | WB | Sequence | A0211 |
| 147 | GALCVESV | 0.439 | 434 | WB | Sequence | A0211 |
| | | | | | | |
| 57 | HLADSPAV | 0.915 | 2 | SB | Sequence | A0212 |
| 192 | ELYGNNAA | 0.813 | 7 | SB | Sequence | A0212 |
| 213 | FLTGMTVA | 0.801 | 8 | SB | Sequence | A0212 |
| 153 | SVDKEMQV | 0.732 | 18 | SB | Sequence | A0212 |
| 73 | SLDAREVI | 0.714 | 22 | SB | Sequence | A0212 |
| 160 | VLVSRIAA | 0.662 | 38 | SB | Sequence | A0212 |
| 172 | YLNDHLEP | 0.662 | 38 | SB | Sequence | A0212 |
| 119 | YQSFEQVV | 0.586 | 88 | WB | Sequence | A0212 |
| 78 | EVIPMAAV | 0.585 | 88 | WB | Sequence | A0212 |
| 223 | VLLGSLFS | 0.582 | 92 | WB | Sequence | A0212 |
| 11 | FLSYKLSQ | 0.573 | 101 | WB | Sequence | A0212 |
| 212 | WFLTGMTV | 0.541 | 142 | WB | Sequence | A0212 |
| 216 | GMTVAGVV | 0.466 | 321 | WB | Sequence | A0212 |
| | | | | | | |
| 57 | HLADSPAV | 0.892 | 3 | SB | Sequence | A0216 |
| 153 | SVDKEMQV | 0.817 | 7 | SB | Sequence | A0216 |
| 213 | FLTGMTVA | 0.761 | 13 | SB | Sequence | A0216 |
| 192 | ELYGNNAA | 0.715 | 21 | SB | Sequence | A0216 |
| 78 | EVIPMAAV | 0.666 | 37 | SB | Sequence | A0216 |
| 218 | TVAGVVLL | 0.657 | 41 | SB | Sequence | A0216 |
| 73 | SLDAREVI | 0.640 | 49 | SB | Sequence | A0216 |
| 144 | SFGGALCV | 0.630 | 54 | WB | Sequence | A0216 |
| 216 | GMTVAGVV | 0.613 | 65 | WB | Sequence | A0216 |
| 166 | AAWMATYL | 0.603 | 73 | WB | Sequence | A0216 |
| 160 | VLVSRIAA | 0.583 | 91 | WB | Sequence | A0216 |
| 212 | WFLTGMTV | 0.565 | 110 | WB | Sequence | A0216 |
| 11 | FLSYKLSQ | 0.488 | 255 | WB | Sequence | A0216 |
| 106 | DLTSQLHI | 0.487 | 258 | WB | Sequence | A0216 |
| 133 | GVNWGRIV | 0.470 | 308 | WB | Sequence | A0216 |
| 81 | PMAAVKQA | 0.469 | 311 | WB | Sequence | A0216 |
| 118 | AYQSFEQV | 0.461 | 342 | WB | Sequence | A0216 |
| 223 | VLLGSLFS | 0.442 | 417 | WB | Sequence | A0216 |
| 147 | GALCVESV | 0.438 | 436 | WB | Sequence | A0216 |
| | | | | | | |
| 57 | HLADSPAV | 0.924 | 2 | SB | Sequence | A0219 |
| 213 | FLTGMTVA | 0.668 | 36 | SB | Sequence | A0219 |
| 153 | SVDKEMQV | 0.597 | 78 | WB | Sequence | A0219 |
| 73 | SLDAREVI | 0.576 | 98 | WB | Sequence | A0219 |
| 218 | TVAGVVLL | 0.517 | 185 | WB | Sequence | A0219 |
| 192 | ELYGNNAA | 0.486 | 259 | WB | Sequence | A0219 |
| 212 | WFLTGMTV | 0.458 | 352 | WB | Sequence | A0219 |
| 166 | AAWMATYL | 0.455 | 362 | WB | Sequence | A0219 |
| 106 | DLTSQLHI | 0.446 | 390 | WB | Sequence | A0219 |

Fig. 26 continued

| | | | | | | |
|---|---|---|---|---|---|---|
| 223 | VLLGSLFS | 0.431 | 471 | WB | Sequence | A0219 |
| 12 | LSYKLSQK | 0.761 | 13 | SB | Sequence | A0301 |
| 8 | VVDFLSYK | 0.551 | 128 | WB | Sequence | A0301 |
| 224 | LLGSLFSR | 0.487 | 257 | WB | Sequence | A0301 |
| 8 | VVDFLSYK | 0.751 | 14 | SB | Sequence | A1101 |
| 12 | LSYKLSQK | 0.721 | 20 | SB | Sequence | A1101 |
| 79 | VIPMAAVK | 0.509 | 203 | WB | Sequence | A1101 |
| 124 | QVVNELFR | 0.472 | 302 | WB | Sequence | A1101 |
| 7 | LVVDFLSY | 0.457 | 355 | WB | Sequence | A1101 |
| 197 | NAAAESRK | 0.455 | 363 | WB | Sequence | A1101 |
| 135 | NWGRIVAF | 0.600 | 75 | WB | Sequence | A2301 |
| 138 | RIVAFFSF | 0.466 | 321 | WB | Sequence | A2301 |
| 222 | VVLLGSLF | 0.461 | 339 | WB | Sequence | A2301 |
| 135 | NWGRIVAF | 0.617 | 62 | WB | Sequence | A2402 |
| 118 | AYQSFEQV | 0.569 | 105 | WB | Sequence | A2403 |
| 78 | EVIPMAAV | 0.598 | 77 | WB | Sequence | A2601 |
| 7 | LVVDFLSY | 0.541 | 144 | WB | Sequence | A2601 |
| 78 | EVIPMAAV | 0.862 | 4 | SB | Sequence | A2602 |
| 7 | LVVDFLSY | 0.797 | 9 | SB | Sequence | A2602 |
| 112 | HTIPGTAY | 0.755 | 14 | SB | Sequence | A2602 |
| 97 | ELRYRRAF | 0.589 | 85 | WB | Sequence | A2602 |
| 138 | RIVAFFSF | 0.529 | 164 | WB | Sequence | A2602 |
| 112 | HTIPGTAY | 0.597 | 78 | WB | Sequence | A2902 |
| 7 | LVVDFLSY | 0.480 | 276 | WB | Sequence | A2902 |
| 204 | KGQERFNR | 0.743 | 16 | SB | Sequence | A3101 |
| 224 | LLGSLFSR | 0.697 | 26 | SB | Sequence | A3101 |
| 157 | EMQVLVSR | 0.583 | 90 | WB | Sequence | A3101 |
| 70 | HSSSLDAR | 0.577 | 97 | WB | Sequence | A3101 |
| 83 | AAVKQALR | 0.539 | 146 | WB | Sequence | A3101 |
| 95 | EFELRYRR | 0.509 | 201 | WB | Sequence | A3101 |
| 124 | QVVNELFR | 0.453 | 369 | WB | Sequence | A3101 |
| 12 | LSYKLSQK | 0.447 | 397 | WB | Sequence | A3101 |
| 95 | EFELRYRR | 0.823 | 6 | SB | Sequence | A3301 |
| 157 | EMQVLVSR | 0.738 | 16 | SB | Sequence | A3301 |
| 94 | DEFELRYR | 0.650 | 43 | SB | Sequence | A3301 |
| 201 | ESRKGQER | 0.606 | 71 | WB | Sequence | A3301 |
| 224 | LLGSLFSR | 0.538 | 148 | WB | Sequence | A3301 |
| 70 | HSSSLDAR | 0.463 | 332 | WB | Sequence | A3301 |
| 124 | QVVNELFR | 0.803 | 8 | SB | Sequence | A6801 |
| 70 | HSSSLDAR | 0.775 | 11 | SB | Sequence | A6801 |
| 197 | NAAAESRK | 0.681 | 31 | SB | Sequence | A6801 |
| 12 | LSYKLSQK | 0.647 | 45 | SB | Sequence | A6801 |
| 157 | EMQVLVSR | 0.599 | 76 | WB | Sequence | A6801 |
| 196 | NNAAAESR | 0.585 | 88 | WB | Sequence | A6801 |
| 83 | AAVKQALR | 0.535 | 153 | WB | Sequence | A6801 |
| 201 | ESRKGQER | 0.532 | 158 | WB | Sequence | A6801 |
| 165 | IAAWMATY | 0.532 | 158 | WB | Sequence | A6801 |
| 95 | EFELRYRR | 0.511 | 198 | WB | Sequence | A6801 |
| 117 | TAYQSFEQ | 0.507 | 208 | WB | Sequence | A6801 |
| 8 | VVDFLSYK | 0.481 | 273 | WB | Sequence | A6801 |
| 94 | DEFELRYR | 0.457 | 357 | WB | Sequence | A6801 |
| 26 | FSDVEENR | 0.442 | 418 | WB | Sequence | A6801 |
| 224 | LLGSLFSR | 0.430 | 476 | WB | Sequence | A6801 |
| 78 | EVIPMAAV | 0.868 | 3 | SB | Sequence | A6802 |
| 218 | TVAGVVLL | 0.790 | 9 | SB | Sequence | A6802 |

Fig. 26 continued

| | | | | | | |
|---|---|---|---|---|---|---|
| 215 | TGMIVAGV | 0.742 | 16 | SB | Sequence | A6802 |
| 217 | MTVAGVVL | 0.697 | 26 | SB | Sequence | A6802 |
| 82 | MAAVKQAL | 0.633 | 52 | WB | Sequence | A6802 |
| 57 | HLADSPAV | 0.549 | 131 | WB | Sequence | A6802 |
| 207 | ERFNRWFL | 0.481 | 273 | WB | Sequence | A6802 |
| 60 | DSPAVNGA | 0.473 | 300 | WB | Sequence | A6802 |
| 192 | ELYGNNAA | 0.447 | 395 | WB | Sequence | A6802 |
| 91 | EAGDEFEL | 0.436 | 444 | WB | Sequence | A6802 |
| | | | | | | |
| 78 | EVIPMAAV | 0.812 | 7 | SB | Sequence | A6901 |
| 57 | HLADSPAV | 0.740 | 16 | SB | Sequence | A6901 |
| 192 | ELYGNNAA | 0.570 | 104 | WB | Sequence | A6901 |
| 217 | MTVAGVVL | 0.544 | 138 | WB | Sequence | A6901 |
| 218 | TVAGVVLL | 0.507 | 206 | WB | Sequence | A6901 |
| 91 | EAGDEFEL | 0.489 | 252 | WB | Sequence | A6901 |
| 153 | SVDKEMQV | 0.437 | 441 | WB | Sequence | A6901 |
| 212 | WFLTGMIV | 0.436 | 445 | WB | Sequence | A6901 |
| | | | | | | |
| 61 | SPAVNGAT | 0.657 | 41 | SB | Sequence | B0702 |
| 82 | MAAVKQAL | 0.468 | 316 | WB | Sequence | B0702 |
| 166 | AAWMATYL | 0.430 | 477 | WB | Sequence | B0702 |
| | | | | | | |
| 97 | ELRYRRAF | 0.589 | 85 | WB | Sequence | B0801 |
| | | | | | | |
| 7 | LVVDFLSY | 0.511 | 198 | WB | Sequence | B1501 |
| 138 | RIVAFFSF | 0.493 | 240 | WB | Sequence | B1501 |
| 112 | HTTPGTAY | 0.492 | 243 | WB | Sequence | B1501 |
| 165 | IAAWMATY | 0.473 | 300 | WB | Sequence | B1501 |
| 97 | ELRYRRAF | 0.439 | 430 | WB | Sequence | B1501 |
| 222 | VVLLGSLF | 0.433 | 461 | WB | Sequence | B1501 |
| | | | | | | |
| 206 | QERFNRWF | 0.528 | 165 | WB | Sequence | B1801 |
| 5 | RELVVDFL | 0.517 | 185 | WB | Sequence | B1801 |
| 122 | FEQVVNEL | 0.508 | 205 | WB | Sequence | B1801 |
| | | | | | | |
| 210 | NRWFLTGM | 0.510 | 200 | WB | Sequence | B2705 |
| | | | | | | |
| 165 | IAAWMATY | 0.806 | 8 | SB | Sequence | B3501 |
| 7 | LVVDFLSY | 0.629 | 55 | WB | Sequence | B3501 |
| 82 | MAAVKQAL | 0.591 | 83 | WB | Sequence | B3501 |
| 112 | HTTPGTAY | 0.543 | 140 | WB | Sequence | B3501 |
| 75 | DAREVIPM | 0.516 | 187 | WB | Sequence | B3501 |
| 142 | FFSFGGAL | 0.499 | 226 | WB | Sequence | B3501 |
| 61 | SPAVNGAT | 0.478 | 283 | WB | Sequence | B3501 |
| 166 | AAWMATYL | 0.476 | 289 | WB | Sequence | B3501 |
| 217 | MTVAGVVL | 0.470 | 307 | WB | Sequence | B3501 |
| | | | | | | |
| 5 | RELVVDFL | 0.624 | 58 | WB | Sequence | B4001 |
| 122 | FEQVVNEL | 0.618 | 62 | WB | Sequence | B4001 |
| | | | | | | |
| 5 | RELVVDFL | 0.442 | 420 | WB | Sequence | B4002 |
| | | | | | | |
| 156 | KEMQVLVS | 0.430 | 478 | WB | Sequence | B4403 |
| | | | | | | |
| 77 | REVIPMAA | 0.434 | 456 | WB | Sequence | B4501 |
| | | | | | | |
| 161 | LVSRIAAW | 0.626 | 57 | WB | Sequence | B5801 |
| 165 | IAAWMATY | 0.593 | 81 | WB | Sequence | B5801 |
| 16 | LSQKGYSW | 0.586 | 88 | WB | Sequence | B5801 |
| 19 | KGYSWSQF | 0.543 | 141 | WB | Sequence | B5801 |
| 138 | RIVAFFSF | 0.467 | 320 | WB | Sequence | B5801 |
| 49 | AINGNPSW | 0.447 | 394 | WB | Sequence | B5801 |

9.mers

| | | | | | | |
|---|---|---|---|---|---|---|
| 104 | FSDLTSQLH | 0.462 | 270 | WB | Sequence | A0101 |

Fig. 26 continued

| | | | | | | |
|---|---|---|---|---|---|---|
| 143 | FSFGGALCV | 0.518 | 183 | WB | Sequence | A0201 |
| 217 | MIVAGVVLL | 0.478 | 282 | WB | Sequence | A0201 |
| 172 | YLNDHLEPW | 0.739 | 16 | SB | Sequence | A0202 |
| 217 | MIVAGVVLL | 0.604 | 72 | WB | Sequence | A0202 |
| 165 | IAAWMATYL | 0.568 | 107 | WB | Sequence | A0202 |
| 213 | FLTGMIVAG | 0.564 | 111 | WB | Sequence | A0202 |
| 11 | FLSYKLSQK | 0.520 | 179 | WB | Sequence | A0202 |
| 161 | LVSRIAAWM | 0.450 | 382 | WB | Sequence | A0202 |
| 8 | VVDFLSYKL | 0.449 | 387 | WB | Sequence | A0202 |
| 192 | ELYGNNAAA | 0.447 | 394 | WB | Sequence | A0202 |
| 81 | PMAAVKQAL | 0.437 | 441 | WB | Sequence | A0202 |
| 216 | GMIVAGVVL | 0.436 | 448 | WB | Sequence | A0202 |
| 214 | LTGMIVAGV | 0.691 | 28 | SB | Sequence | A0203 |
| 217 | MIVAGVVLL | 0.609 | 69 | WB | Sequence | A0203 |
| 165 | IAAWMATYL | 0.530 | 161 | WB | Sequence | A0203 |
| 84 | AVKQALREA | 0.518 | 183 | WB | Sequence | A0203 |
| 110 | QLHITPGTA | 0.507 | 206 | WB | Sequence | A0203 |
| 172 | YLNDHLEPW | 0.493 | 240 | WB | Sequence | A0203 |
| 117 | TAYQSFEQV | 0.473 | 300 | WB | Sequence | A0203 |
| 11 | FLSYKLSQK | 0.447 | 396 | WB | Sequence | A0203 |
| 214 | LTGMIVAGV | 0.504 | 213 | WB | Sequence | A0204 |
| 217 | MIVAGVVLL | 0.475 | 291 | WB | Sequence | A0204 |
| 109 | SQLHITPGT | 0.712 | 22 | SB | Sequence | A0206 |
| 217 | MIVAGVVLL | 0.675 | 33 | SB | Sequence | A0206 |
| 117 | TAYQSFEQV | 0.650 | 43 | SB | Sequence | A0206 |
| 1 | SQSNRELVV | 0.648 | 45 | SB | Sequence | A0206 |
| 143 | FSFGGALCV | 0.584 | 90 | WB | Sequence | A0206 |
| 77 | REVIPMAAV | 0.572 | 103 | WB | Sequence | A0206 |
| 165 | IAAWMATYL | 0.551 | 128 | WB | Sequence | A0206 |
| 158 | MQVLVSRIA | 0.544 | 138 | WB | Sequence | A0206 |
| 214 | LTGMIVAGV | 0.492 | 244 | WB | Sequence | A0206 |
| 172 | YLNDHLEPW | 0.464 | 331 | WB | Sequence | A0206 |
| 42 | SEMETPSAI | 0.440 | 426 | WB | Sequence | A0206 |
| 192 | ELYGNNAAA | 0.863 | 4 | SB | Sequence | A0211 |
| 143 | FSFGGALCV | 0.797 | 8 | SB | Sequence | A0211 |
| 81 | PMAAVKQAL | 0.794 | 9 | SB | Sequence | A0211 |
| 172 | YLNDHLEPW | 0.715 | 21 | SB | Sequence | A0211 |
| 153 | SVDKEMQVL | 0.703 | 24 | SB | Sequence | A0211 |
| 8 | VVDFLSYKL | 0.696 | 26 | SB | Sequence | A0211 |
| 217 | MIVAGVVLL | 0.634 | 52 | WB | Sequence | A0211 |
| 112 | HITPGTAYQ | 0.618 | 62 | WB | Sequence | A0211 |
| 117 | TAYQSFEQV | 0.617 | 63 | WB | Sequence | A0211 |
| 223 | VLLGSLFSR | 0.581 | 93 | WB | Sequence | A0211 |
| 213 | FLTGMIVAG | 0.581 | 93 | WB | Sequence | A0211 |
| 133 | GVNWGRIVA | 0.575 | 99 | WB | Sequence | A0211 |
| 216 | GMIVAGVVL | 0.553 | 126 | WB | Sequence | A0211 |
| 185 | GGWDTFVEL | 0.550 | 130 | WB | Sequence | A0211 |
| 103 | AFSDLTSQL | 0.472 | 302 | WB | Sequence | A0211 |
| 176 | HLEPWIQEN | 0.427 | 493 | WB | Sequence | A0211 |
| 192 | ELYGNNAAA | 0.845 | 5 | SB | Sequence | A0212 |
| 81 | PMAAVKQAL | 0.789 | 9 | SB | Sequence | A0212 |
| 143 | FSFGGALCV | 0.702 | 25 | SB | Sequence | A0212 |
| 172 | YLNDHLEPW | 0.673 | 34 | SB | Sequence | A0212 |
| 223 | VLLGSLFSR | 0.573 | 101 | WB | Sequence | A0212 |
| 8 | VVDFLSYKL | 0.561 | 115 | WB | Sequence | A0212 |
| 153 | SVDKEMQVL | 0.535 | 153 | WB | Sequence | A0212 |
| 213 | FLTGMIVAG | 0.521 | 178 | WB | Sequence | A0212 |
| 118 | AYQSFEQVV | 0.476 | 290 | WB | Sequence | A0212 |
| 192 | ELYGNNAAA | 0.741 | 16 | SB | Sequence | A0216 |
| 81 | PMAAVKQAL | 0.710 | 22 | SB | Sequence | A0216 |

Fig. 26 continued

| | | | | | | |
|---|---|---|---|---|---|---|
| 143 | FSFGGALCV | 0.652 | 42 | SB | Sequence | A0216 |
| 117 | TAYQSFEQV | 0.593 | 81 | WB | Sequence | A0216 |
| 112 | HITPGTAYQ | 0.512 | 196 | WB | Sequence | A0216 |
| 216 | GMTVAGVVL | 0.430 | 479 | WB | Sequence | A0216 |
| | | | | | | |
| 81 | PMAAVKQAL | 0.675 | 33 | SB | Sequence | A0219 |
| 143 | FSFGGALCV | 0.652 | 43 | SB | Sequence | A0219 |
| 192 | ELYGNNAAA | 0.541 | 142 | WB | Sequence | A0219 |
| 117 | TAYQSFEQV | 0.497 | 232 | WB | Sequence | A0219 |
| 172 | YLNDHLEPW | 0.459 | 348 | WB | Sequence | A0219 |
| 223 | VLLGSLFSR | 0.456 | 361 | WB | Sequence | A0219 |
| 214 | LTGMTVAGV | 0.450 | 384 | WB | Sequence | A0219 |
| | | | | | | |
| 224 | LLGSLFSRK | 0.762 | 13 | SB | Sequence | A0301 |
| 11 | FLSYKLSQK | 0.710 | 23 | SB | Sequence | A0301 |
| 164 | RIAAWMATY | 0.698 | 26 | SB | Sequence | A0301 |
| 223 | VLLGSLFSR | 0.615 | 64 | WB | Sequence | A0301 |
| 7 | LVVDFLSYK | 0.497 | 231 | WB | Sequence | A0301 |
| | | | | | | |
| 7 | LVVDFLSYK | 0.767 | 12 | SB | Sequence | A1101 |
| 224 | LLGSLFSRK | 0.612 | 66 | WB | Sequence | A1101 |
| 223 | VLLGSLFSR | 0.595 | 79 | WB | Sequence | A1101 |
| 164 | RIAAWMATY | 0.575 | 99 | WB | Sequence | A1101 |
| 148 | ALCVESVDK | 0.529 | 163 | WB | Sequence | A1101 |
| 78 | EVIPMAAVK | 0.509 | 201 | WB | Sequence | A1101 |
| 11 | FLSYKLSQK | 0.430 | 477 | WB | Sequence | A1101 |
| | | | | | | |
| 99 | RYRRAFSDL | 0.690 | 28 | SB | Sequence | A2301 |
| 135 | NWGRIVAFF | 0.644 | 47 | SB | Sequence | A2301 |
| 137 | GRIVAFFSF | 0.459 | 346 | WB | Sequence | A2301 |
| | | | | | | |
| 135 | NWGRIVAFF | 0.739 | 16 | SB | Sequence | A2402 |
| 99 | RYRRAFSDL | 0.550 | 129 | WB | Sequence | A2402 |
| | | | | | | |
| 99 | RYRRAFSDL | 0.748 | 15 | SB | Sequence | A2403 |
| 121 | SFEQVVNEL | 0.557 | 120 | WB | Sequence | A2403 |
| 118 | AYQSFEQVV | 0.487 | 256 | WB | Sequence | A2403 |
| | | | | | | |
| 6 | ELVVDFLSY | 0.532 | 158 | WB | Sequence | A2601 |
| 164 | RIAAWMATY | 0.495 | 235 | WB | Sequence | A2601 |
| | | | | | | |
| 164 | RIAAWMATY | 0.923 | 2 | SB | Sequence | A2602 |
| 6 | ELVVDFLSY | 0.873 | 3 | SB | Sequence | A2602 |
| 161 | LVSRIAAWM | 0.677 | 32 | SB | Sequence | A2602 |
| 153 | SVDKEMQVL | 0.639 | 49 | SB | Sequence | A2602 |
| 78 | EVIPMAAVK | 0.496 | 234 | WB | Sequence | A2602 |
| 217 | MTVAGVVLL | 0.481 | 273 | WB | Sequence | A2602 |
| | | | | | | |
| 111 | LHITPGTAY | 0.553 | 125 | WB | Sequence | A2902 |
| 6 | ELVVDFLSY | 0.539 | 146 | WB | Sequence | A2902 |
| | | | | | | |
| 164 | RIAAWMATY | 0.463 | 334 | WB | Sequence | A3002 |
| | | | | | | |
| 82 | MAAVKQALR | 0.766 | 12 | SB | Sequence | A3101 |
| 223 | VLLGSLFSR | 0.686 | 30 | SB | Sequence | A3101 |
| 7 | LVVDFLSYK | 0.573 | 101 | WB | Sequence | A3101 |
| 156 | KEMQVLVSR | 0.474 | 296 | WB | Sequence | A3101 |
| | | | | | | |
| 94 | DEFELRYRR | 0.721 | 20 | SB | Sequence | A3301 |
| 82 | MAAVKQALR | 0.665 | 37 | SB | Sequence | A3301 |
| 97 | ELRYRRAFS | 0.614 | 65 | WB | Sequence | A3301 |
| 223 | VLLGSLFSR | 0.581 | 92 | WB | Sequence | A3301 |
| 91 | EAGDEFELR | 0.532 | 157 | WB | Sequence | A3301 |
| 25 | QFSDVEENR | 0.531 | 159 | WB | Sequence | A3301 |
| | | | | | | |
| 78 | EVIPMAAVK | 0.848 | 5 | SB | Sequence | A6801 |
| 82 | MAAVKQALR | 0.813 | 7 | SB | Sequence | A6801 |

Fig. 26 continued

| | | | | | | |
|---|---|---|---|---|---|---|
| 7 | LVVDFLSYK | 0.786 | 10 | SB | Sequence | A6801 |
| 91 | EAGDEFELR | 0.710 | 23 | SB | Sequence | A6801 |
| 123 | EQVVNELFR | 0.635 | 51 | WB | Sequence | A6801 |
| 11 | FLSYKLSQK | 0.558 | 119 | WB | Sequence | A6801 |
| 94 | DEFELRYRR | 0.544 | 139 | WB | Sequence | A6801 |
| 25 | QFSDVEENR | 0.540 | 145 | WB | Sequence | A6801 |
| 196 | NNAAAESRK | 0.474 | 295 | WB | Sequence | A6801 |
| 223 | VLLGSLFSR | 0.430 | 477 | WB | Sequence | A6801 |
| | | | | | | |
| 217 | MTVAGVVLL | 0.796 | 9 | SB | Sequence | A6802 |
| 117 | TAYQSFEQV | 0.729 | 18 | SB | Sequence | A6802 |
| 215 | TGMTVAGVV | 0.654 | 42 | SB | Sequence | A6802 |
| 0 | MSQSNRELV | 0.587 | 86 | WB | Sequence | A6802 |
| 21 | YSWSQFSDV | 0.549 | 131 | WB | Sequence | A6802 |
| 143 | FSFGGALCV | 0.526 | 169 | WB | Sequence | A6802 |
| 152 | ESVDKEMQV | 0.525 | 171 | WB | Sequence | A6802 |
| 169 | MATYLNDHL | 0.520 | 180 | WB | Sequence | A6802 |
| 192 | ELYGNNAAA | 0.509 | 202 | WB | Sequence | A6802 |
| 140 | VAFFSFGGA | 0.500 | 222 | WB | Sequence | A6802 |
| 214 | LTGMTVAGV | 0.464 | 330 | WB | Sequence | A6802 |
| 165 | IAAWMATYL | 0.451 | 378 | WB | Sequence | A6802 |
| | | | | | | |
| 217 | MTVAGVVLL | 0.705 | 24 | SB | Sequence | A6901 |
| 117 | TAYQSFEQV | 0.623 | 58 | WB | Sequence | A6901 |
| 192 | ELYGNNAAA | 0.604 | 72 | WB | Sequence | A6901 |
| 143 | FSFGGALCV | 0.589 | 85 | WB | Sequence | A6901 |
| 214 | LTGMTVAGV | 0.557 | 120 | WB | Sequence | A6901 |
| 21 | YSWSQFSDV | 0.489 | 252 | WB | Sequence | A6901 |
| | | | | | | |
| 36 | APEGTESEM | 0.519 | 181 | WB | Sequence | B0702 |
| 61 | SPAVNGAIG | 0.454 | 369 | WB | Sequence | B0702 |
| 114 | TPGTAYQSF | 0.450 | 382 | WB | Sequence | B0702 |
| | | | | | | |
| 96 | FELRYRRAF | 0.497 | 229 | WB | Sequence | B0801 |
| | | | | | | |
| 164 | RIAAWMATY | 0.586 | 87 | WB | Sequence | B1501 |
| 88 | ALREAGDEF | 0.520 | 180 | WB | Sequence | B1501 |
| | | | | | | |
| 96 | FELRYRRAF | 0.752 | 14 | SB | Sequence | B1801 |
| 206 | QERFNRWFL | 0.592 | 82 | WB | Sequence | B1801 |
| 122 | FEQVVNELF | 0.523 | 174 | WB | Sequence | B1801 |
| 182 | QENGGWDTF | 0.476 | 290 | WB | Sequence | B1801 |
| | | | | | | |
| 137 | GRIVAFFSF | 0.554 | 124 | WB | Sequence | B2705 |
| 101 | RRAFSDLTS | 0.434 | 459 | WB | Sequence | B2705 |
| | | | | | | |
| 114 | TPGTAYQSF | 0.705 | 24 | SB | Sequence | B3501 |
| 165 | IAAWMATYL | 0.649 | 44 | SB | Sequence | B3501 |
| 36 | APEGTESEM | 0.540 | 144 | WB | Sequence | B3501 |
| 6 | ELVVDFLSY | 0.531 | 159 | WB | Sequence | B3501 |
| 111 | LHITPGTAY | 0.437 | 441 | WB | Sequence | B3501 |
| 53 | NPSWHLADS | 0.429 | 480 | WB | Sequence | B3501 |
| 164 | RIAAWMATY | 0.428 | 485 | WB | Sequence | B3501 |
| | | | | | | |
| 90 | REAGDEFEL | 0.788 | 9 | SB | Sequence | B4001 |
| 206 | QERFNRWFL | 0.597 | 78 | WB | Sequence | B4001 |
| 182 | QENGGWDTF | 0.525 | 170 | WB | Sequence | B4001 |
| 122 | FEQVVNELF | 0.453 | 370 | WB | Sequence | B4001 |
| 96 | FELRYRRAF | 0.446 | 399 | WB | Sequence | B4001 |
| | | | | | | |
| 42 | SEMETPSAI | 0.504 | 215 | WB | Sequence | B4002 |
| 96 | FELRYRRAF | 0.473 | 299 | WB | Sequence | B4002 |
| | | | | | | |
| 182 | QENGGWDTF | 0.434 | 455 | WB | Sequence | B4402 |
| | | | | | | |
| 42 | SEMETPSAI | 0.467 | 319 | WB | Sequence | B4403 |
| 5 | RELVVDFLS | 0.444 | 407 | WB | Sequence | B4403 |

Fig. 26 continued

| | | | | | | |
|---|---|---|---|---|---|---|
| 77 | REVIPMAAV | 0.438 | 438 | WB | Sequence | B4501 |
| 165 | IAAWMATYL | 0.442 | 416 | WB | Sequence | B5301 |
| 80 | IPMAAVKQA | 0.716 | 21 | SB | Sequence | B5401 |
| 48 | SAINGNPSW | 0.641 | 46 | SB | Sequence | B5801 |
| 15 | KLSQKGYSW | 0.596 | 79 | WB | Sequence | B5801 |
| 165 | IAAWMATYL | 0.559 | 118 | WB | Sequence | B5801 |
| 172 | YLNDHLEPW | 0.506 | 208 | WB | Sequence | B5801 |

10-mers

| | | | | | | |
|---|---|---|---|---|---|---|
| 104 | FSDLTSQLHI | 0.427 | 492 | WB | Sequence | A0101 |
| 172 | YLNDHLEPWI | 0.866 | 4 | SB | Sequence | A0201 |
| 213 | FLTGMTVAGV | 0.841 | 5 | SB | Sequence | A0201 |
| 164 | RIAAWMATYL | 0.651 | 43 | SB | Sequence | A0201 |
| 168 | WMATYLNDHL | 0.573 | 101 | WB | Sequence | A0201 |
| 7 | LVVDFLSYKL | 0.524 | 173 | WB | Sequence | A0201 |
| 73 | SLDAREVIPM | 0.491 | 246 | WB | Sequence | A0201 |
| 160 | VLVSRIAAWM | 0.486 | 259 | WB | Sequence | A0201 |
| 153 | SVDKEMQVLV | 0.473 | 298 | WB | Sequence | A0201 |
| 216 | GMTVAGVVLL | 0.444 | 411 | WB | Sequence | A0201 |
| 213 | FLTGMTVAGV | 0.811 | 7 | SB | Sequence | A0202 |
| 168 | WMATYLNDHL | 0.772 | 11 | SB | Sequence | A0202 |
| 164 | RIAAWMATYL | 0.763 | 13 | SB | Sequence | A0202 |
| 7 | LVVDFLSYKL | 0.651 | 43 | SB | Sequence | A0202 |
| 102 | RAFSDLTSQL | 0.617 | 63 | WB | Sequence | A0202 |
| 73 | SLDAREVIPM | 0.616 | 63 | WB | Sequence | A0202 |
| 172 | YLNDHLEPWI | 0.587 | 87 | WB | Sequence | A0202 |
| 216 | GMTVAGVVLL | 0.496 | 233 | WB | Sequence | A0202 |
| 145 | FGGALCVESV | 0.480 | 276 | WB | Sequence | A0202 |
| 160 | VLVSRIAAWM | 0.430 | 476 | WB | Sequence | A0202 |
| 213 | FLTGMTVAGV | 0.936 | 2 | SB | Sequence | A0203 |
| 172 | YLNDHLEPWI | 0.891 | 3 | SB | Sequence | A0203 |
| 164 | RIAAWMATYL | 0.837 | 5 | SB | Sequence | A0203 |
| 168 | WMATYLNDHL | 0.647 | 45 | SB | Sequence | A0203 |
| 160 | VLVSRIAAWM | 0.613 | 66 | WB | Sequence | A0203 |
| 139 | IVAFFSFGGA | 0.596 | 79 | WB | Sequence | A0203 |
| 7 | LVVDFLSYKL | 0.581 | 92 | WB | Sequence | A0203 |
| 125 | VVNELFRDGV | 0.570 | 105 | WB | Sequence | A0203 |
| 216 | GMTVAGVVLL | 0.476 | 269 | WB | Sequence | A0203 |
| 102 | RAFSDLTSQL | 0.470 | 308 | WB | Sequence | A0203 |
| 214 | LTGMTVAGVV | 0.468 | 315 | WB | Sequence | A0203 |
| 116 | GTAYQSFEQV | 0.463 | 335 | WB | Sequence | A0203 |
| 213 | FLTGMTVAGV | 0.697 | 26 | SB | Sequence | A0204 |
| 172 | YLNDHLEPWI | 0.664 | 37 | SB | Sequence | A0204 |
| 73 | SLDAREVIPM | 0.477 | 287 | WB | Sequence | A0204 |
| 164 | RIAAWMATYL | 0.476 | 290 | WB | Sequence | A0204 |
| 7 | LVVDFLSYKL | 0.468 | 317 | WB | Sequence | A0204 |
| 49 | AINGNPSWHL | 0.452 | 374 | WB | Sequence | A0204 |
| 213 | FLTGMTVAGV | 0.869 | 4 | SB | Sequence | A0206 |
| 164 | RIAAWMATYL | 0.809 | 7 | SB | Sequence | A0206 |
| 172 | YLNDHLEPWI | 0.722 | 20 | SB | Sequence | A0206 |
| 158 | MQVLVSRIAA | 0.689 | 28 | SB | Sequence | A0206 |
| 7 | LVVDFLSYKL | 0.684 | 30 | SB | Sequence | A0206 |
| 168 | WMATYLNDHL | 0.680 | 31 | SB | Sequence | A0206 |
| 109 | SQLHITFGTA | 0.652 | 43 | SB | Sequence | A0206 |
| 116 | GTAYQSFEQV | 0.572 | 102 | WB | Sequence | A0206 |
| 153 | SVDKEMQVLV | 0.558 | 119 | WB | Sequence | A0206 |
| 102 | RAFSDLTSQL | 0.543 | 140 | WB | Sequence | A0206 |

Fig. 26 continued

| | | | | | | |
|---|---|---|---|---|---|---|
| 156 | KEMQVLVSRI | 0.508 | 204 | WB | Sequence | A0206 |
| 181 | IQENGGWDIF | 0.508 | 205 | WB | Sequence | A0206 |
| 139 | IVAFFSFGGA | 0.495 | 235 | WB | Sequence | A0206 |
| 125 | VVNELFRDGV | 0.483 | 269 | WB | Sequence | A0206 |
| 117 | TAYQSFEQVV | 0.450 | 383 | WB | Sequence | A0206 |
| | | | | | | |
| 213 | FLTGMIVAGV | 0.966 | 1 | SB | Sequence | A0211 |
| 172 | YLNDHLEPWI | 0.951 | 1 | SB | Sequence | A0211 |
| 153 | SVDKEMQVLV | 0.905 | 2 | SB | Sequence | A0211 |
| 73 | SLDAREVIPM | 0.826 | 6 | SB | Sequence | A0211 |
| 216 | GMIVAGVVLL | 0.737 | 17 | SB | Sequence | A0211 |
| 7 | LVVDFLSYKL | 0.730 | 18 | SB | Sequence | A0211 |
| 164 | RIAAWMATYL | 0.711 | 22 | SB | Sequence | A0211 |
| 125 | VVNELFRDGV | 0.687 | 29 | SB | Sequence | A0211 |
| 49 | AINGNPSWHL | 0.686 | 29 | SB | Sequence | A0211 |
| 168 | WMATYLNDHL | 0.685 | 30 | SB | Sequence | A0211 |
| 117 | TAYQSFEQVV | 0.633 | 52 | WB | Sequence | A0211 |
| 160 | VLVSRIAAWM | 0.632 | 53 | WB | Sequence | A0211 |
| 142 | FFSFGGALCV | 0.567 | 107 | WB | Sequence | A0211 |
| 223 | VLLGSLFSRK | 0.498 | 228 | WB | Sequence | A0211 |
| 102 | RAFSDLTSQL | 0.453 | 372 | WB | Sequence | A0211 |
| 116 | GTAYQSFEQV | 0.429 | 481 | WB | Sequence | A0211 |
| | | | | | | |
| 213 | FLTGMIVAGV | 0.932 | 2 | SB | Sequence | A0212 |
| 172 | YLNDHLEPWI | 0.916 | 2 | SB | Sequence | A0212 |
| 153 | SVDKEMQVLV | 0.742 | 16 | SB | Sequence | A0212 |
| 168 | WMATYLNDHL | 0.697 | 26 | SB | Sequence | A0212 |
| 125 | VVNELFRDGV | 0.695 | 27 | SB | Sequence | A0212 |
| 7 | LVVDFLSYKL | 0.648 | 45 | SB | Sequence | A0212 |
| 160 | VLVSRIAAWM | 0.604 | 72 | WB | Sequence | A0212 |
| 73 | SLDAREVIPM | 0.594 | 80 | WB | Sequence | A0212 |
| 49 | AINGNPSWHL | 0.570 | 104 | WB | Sequence | A0212 |
| 164 | RIAAWMATYL | 0.550 | 129 | WB | Sequence | A0212 |
| 142 | FFSFGGALCV | 0.494 | 238 | WB | Sequence | A0212 |
| 223 | VLLGSLFSRK | 0.487 | 258 | WB | Sequence | A0212 |
| 117 | TAYQSFEQVV | 0.482 | 270 | WB | Sequence | A0212 |
| 192 | ELYGNNAAAE | 0.475 | 293 | WB | Sequence | A0212 |
| 216 | GMIVAGVVLL | 0.440 | 426 | WB | Sequence | A0212 |
| | | | | | | |
| 213 | FLTGMIVAGV | 0.911 | 2 | SB | Sequence | A0216 |
| 172 | YLNDHLEPWI | 0.869 | 4 | SB | Sequence | A0216 |
| 153 | SVDKEMQVLV | 0.772 | 11 | SB | Sequence | A0216 |
| 168 | WMATYLNDHL | 0.696 | 26 | SB | Sequence | A0216 |
| 164 | RIAAWMATYL | 0.695 | 27 | SB | Sequence | A0216 |
| 49 | AINGNPSWHL | 0.680 | 31 | SB | Sequence | A0216 |
| 160 | VLVSRIAAWM | 0.657 | 41 | SB | Sequence | A0216 |
| 7 | LVVDFLSYKL | 0.643 | 47 | SB | Sequence | A0216 |
| 73 | SLDAREVIPM | 0.617 | 62 | WB | Sequence | A0216 |
| 216 | GMIVAGVVLL | 0.588 | 85 | WB | Sequence | A0216 |
| 117 | TAYQSFEQVV | 0.530 | 161 | WB | Sequence | A0216 |
| 142 | FFSFGGALCV | 0.487 | 256 | WB | Sequence | A0216 |
| 116 | GTAYQSFEQV | 0.444 | 408 | WB | Sequence | A0216 |
| | | | | | | |
| 213 | FLTGMIVAGV | 0.927 | 2 | SB | Sequence | A0219 |
| 172 | YLNDHLEPWI | 0.884 | 3 | SB | Sequence | A0219 |
| 168 | WMATYLNDHL | 0.611 | 67 | WB | Sequence | A0219 |
| 49 | AINGNPSWHL | 0.543 | 140 | WB | Sequence | A0219 |
| 7 | LVVDFLSYKL | 0.539 | 146 | WB | Sequence | A0219 |
| 153 | SVDKEMQVLV | 0.533 | 156 | WB | Sequence | A0219 |
| 164 | RIAAWMATYL | 0.449 | 387 | WB | Sequence | A0219 |
| 73 | SLDAREVIPM | 0.445 | 404 | WB | Sequence | A0219 |
| 160 | VLVSRIAAWM | 0.441 | 421 | WB | Sequence | A0219 |
| | | | | | | |
| 223 | VLLGSLFSRK | 0.767 | 12 | SB | Sequence | A0301 |
| 6 | ELVVDFLSYK | 0.504 | 213 | WB | Sequence | A0301 |
| 147 | GALCVESVDK | 0.468 | 253 | WB | Sequence | A0301 |
| 222 | VVLLGSLFSR | 0.457 | 356 | WB | Sequence | A0301 |

Fig. 26 continued

| | | | | | |
|---|---|---|---|---|---|
| 77 | REVIPMAAVK | 0.453 | 372 | WB | Sequence A0301 |
| 223 | VLLGSLFSRK | 0.742 | 16 | SB | Sequence A1101 |
| 222 | VVLLGSLFSR | 0.681 | 31 | SB | Sequence A1101 |
| 147 | GALCVESVDK | 0.515 | 190 | WB | Sequence A1101 |
| 24 | SQFSDVEENR | 0.470 | 310 | WB | Sequence A1101 |
| 121 | SFEQVVNELF | 0.581 | 92 | WB | Sequence A2301 |
| 171 | TYLNDHLEPW | 0.547 | 134 | WB | Sequence A2301 |
| 121 | SFEQVVNELF | 0.528 | 165 | WB | Sequence A2402 |
| 171 | TYLNDHLEPW | 0.520 | 180 | WB | Sequence A2402 |
| 113 | ITPGTAYQSF | 0.460 | 343 | WB | Sequence A2402 |
| 171 | TYLNDHLEPW | 0.739 | 16 | SB | Sequence A2403 |
| 121 | SFEQVVNELF | 0.546 | 136 | WB | Sequence A2403 |
| 113 | ITPGTAYQSF | 0.508 | 204 | WB | Sequence A2403 |
| 35 | EAPEGTESEM | 0.448 | 390 | WB | Sequence A2601 |
| 164 | RIAAWMATYL | 0.626 | 57 | WB | Sequence A2602 |
| 113 | ITPGTAYQSF | 0.581 | 92 | WB | Sequence A2602 |
| 160 | VLVSRIAAWM | 0.553 | 126 | WB | Sequence A2602 |
| 35 | EAPEGTESEM | 0.507 | 207 | WB | Sequence A2602 |
| 152 | ESVDKEMQVL | 0.490 | 249 | WB | Sequence A2602 |
| 95 | EFELRYRRAF | 0.483 | 268 | WB | Sequence A2602 |
| 110 | QLHITPGTAY | 0.506 | 209 | WB | Sequence A2902 |
| 222 | VVLLGSLFSR | 0.683 | 30 | SB | Sequence A3101 |
| 129 | LFRDGVNWGR | 0.667 | 36 | SB | Sequence A3101 |
| 202 | SRKGQERFNR | 0.608 | 69 | WB | Sequence A3101 |
| 81 | PMAAVKQALR | 0.521 | 177 | WB | Sequence A3101 |
| 222 | VVLLGSLFSR | 0.572 | 103 | WB | Sequence A3301 |
| 129 | LFRDGVNWGR | 0.553 | 126 | WB | Sequence A3301 |
| 10 | DFLSYKLSQK | 0.470 | 308 | WB | Sequence A3301 |
| 6 | ELVVDFLSYK | 0.702 | 25 | SB | Sequence A6801 |
| 24 | SQFSDVEENR | 0.532 | 158 | WB | Sequence A6801 |
| 222 | VVLLGSLFSR | 0.516 | 188 | WB | Sequence A6801 |
| 194 | YGNNAAAESR | 0.493 | 240 | WB | Sequence A6801 |
| 78 | EVIPMAAVKQ | 0.454 | 368 | WB | Sequence A6801 |
| 169 | MATYLNDHLE | 0.448 | 394 | WB | Sequence A6801 |
| 139 | IVAFFSFGGA | 0.742 | 16 | SB | Sequence A6802 |
| 116 | GTAYQSFEQV | 0.673 | 34 | SB | Sequence A6802 |
| 7 | LVVDFLSYKL | 0.659 | 39 | SB | Sequence A6802 |
| 120 | QSFEQVVNEL | 0.618 | 62 | WB | Sequence A6802 |
| 213 | FLTGMTVAGV | 0.577 | 96 | WB | Sequence A6802 |
| 117 | TAYQSFEQVV | 0.561 | 115 | WB | Sequence A6802 |
| 164 | RIAAWMATYL | 0.519 | 182 | WB | Sequence A6802 |
| 65 | NGATGHSSSL | 0.496 | 234 | WB | Sequence A6802 |
| 218 | TVAGVVLLGS | 0.491 | 246 | WB | Sequence A6802 |
| 145 | FGGALCVESV | 0.474 | 294 | WB | Sequence A6802 |
| 125 | VVNELFRDGV | 0.465 | 328 | WB | Sequence A6802 |
| 161 | LVSRIAAWMA | 0.451 | 380 | WB | Sequence A6802 |
| 215 | TGMTVAGVVL | 0.450 | 382 | WB | Sequence A6802 |
| 153 | SVDKEMQVLV | 0.534 | 155 | WB | Sequence A6901 |
| 213 | FLTGMTVAGV | 0.527 | 166 | WB | Sequence A6901 |
| 117 | TAYQSFEQVV | 0.466 | 324 | WB | Sequence A6901 |
| 7 | LVVDFLSYKL | 0.451 | 378 | WB | Sequence A6901 |
| 164 | RIAAWMATYL | 0.443 | 412 | WB | Sequence A6901 |
| 116 | GTAYQSFEQV | 0.427 | 493 | WB | Sequence A6901 |
| 80 | IPMAAVKQAL | 0.704 | 24 | SB | Sequence B0702 |

Fig. 26 continued

| | | | | | | |
|---|---|---|---|---|---|---|
| 17 | SQKGYSWSQF | 0.572 | 102 | WB | Sequence | B1501 |
| 110 | QLHITPGTAY | 0.557 | 121 | WB | Sequence | B1501 |
| 133 | GVNWGRIVAF | 0.548 | 132 | WB | Sequence | B1501 |
| 181 | IQENGGWDTF | 0.522 | 175 | WB | Sequence | B1501 |
| 12 | LSYKLSQKGY | 0.455 | 364 | WB | Sequence | B1501 |
| 5 | RELVVDFLSY | 0.759 | 13 | SB | Sequence | B1801 |
| 163 | SRIAAWMATY | 0.588 | 86 | WB | Sequence | B2705 |
| 101 | RRAFSDLTSQ | 0.461 | 340 | WB | Sequence | B2705 |
| 80 | IPMAAVKQAL | 0.609 | 69 | WB | Sequence | B3501 |
| 178 | EPWIQENGGW | 0.604 | 72 | WB | Sequence | B3501 |
| 91 | EAGDEFELRY | 0.566 | 109 | WB | Sequence | B3501 |
| 35 | EAPEGTESEM | 0.563 | 112 | WB | Sequence | B3501 |
| 87 | QALREAGDEF | 0.508 | 206 | WB | Sequence | B3501 |
| 61 | SPAVNGATGH | 0.490 | 249 | WB | Sequence | B3501 |
| 46 | TPSAINGNPS | 0.483 | 269 | WB | Sequence | B3501 |
| 133 | GVNWGRIVAF | 0.455 | 362 | WB | Sequence | B3501 |
| 140 | VAFFSFGGAL | 0.454 | 367 | WB | Sequence | B3501 |
| 190 | FVELYGNNAA | 0.439 | 430 | WB | Sequence | B3501 |
| 200 | AESRKGQERF | 0.453 | 370 | WB | Sequence | B4501 |
| 178 | EPWIQENGGW | 0.603 | 73 | WB | Sequence | B5301 |
| 2 | QSNRELVVDF | 0.474 | 295 | WB | Sequence | B5801 |
| 159 | QVLVSRIAAW | 0.467 | 320 | WB | Sequence | B5801 |
| 47 | PSAINGNPSW | 0.437 | 444 | WB | Sequence | B5801 |

11-mers

| | | | | | | |
|---|---|---|---|---|---|---|
| 213 | FLTGMTVAGVV | 0.627 | 56 | WB | Sequence | A0201 |
| 73 | SLDAREVIPMA | 0.561 | 115 | WB | Sequence | A0201 |
| 160 | VLVSRIAAWMA | 0.547 | 135 | WB | Sequence | A0201 |
| 57 | HLADSPAVNGA | 0.539 | 147 | WB | Sequence | A0201 |
| 172 | YLNDHLEPWIQ | 0.480 | 278 | WB | Sequence | A0201 |
| 88 | ALREAGDEFEL | 0.470 | 309 | WB | Sequence | A0201 |
| 119 | YQSFEQVVNEL | 0.426 | 497 | WB | Sequence | A0201 |
| 57 | HLADSPAVNGA | 0.763 | 12 | SB | Sequence | A0202 |
| 213 | FLTGMTVAGVV | 0.754 | 14 | SB | Sequence | A0202 |
| 119 | YQSFEQVVNEL | 0.734 | 17 | SB | Sequence | A0202 |
| 88 | ALREAGDEFEL | 0.679 | 32 | SB | Sequence | A0202 |
| 172 | YLNDHLEPWIQ | 0.611 | 67 | WB | Sequence | A0202 |
| 139 | IVAFFSFGGAL | 0.553 | 119 | WB | Sequence | A0202 |
| 218 | TVAGVVLLGSL | 0.537 | 149 | WB | Sequence | A0202 |
| 160 | VLVSRIAAWMA | 0.525 | 170 | WB | Sequence | A0202 |
| 15 | KLSQKGYSWSQ | 0.450 | 382 | WB | Sequence | A0202 |
| 6 | ELVVDFLSYKL | 0.449 | 387 | WB | Sequence | A0202 |
| 73 | SLDAREVIPMA | 0.446 | 401 | WB | Sequence | A0202 |
| 213 | FLTGMTVAGVV | 0.864 | 4 | SB | Sequence | A0203 |
| 57 | HLADSPAVNGA | 0.844 | 5 | SB | Sequence | A0203 |
| 138 | RIVAFFSFGGA | 0.752 | 14 | SB | Sequence | A0203 |
| 160 | VLVSRIAAWMA | 0.649 | 44 | SB | Sequence | A0203 |
| 218 | TVAGVVLLGSL | 0.619 | 61 | WB | Sequence | A0203 |
| 88 | ALREAGDEFEL | 0.604 | 72 | WB | Sequence | A0203 |
| 119 | YQSFEQVVNEL | 0.567 | 109 | WB | Sequence | A0203 |
| 172 | YLNDHLEPWIQ | 0.565 | 110 | WB | Sequence | A0203 |
| 49 | AINGNPSWHLA | 0.562 | 114 | WB | Sequence | A0203 |
| 209 | FNRWFLTGMTV | 0.494 | 239 | WB | Sequence | A0203 |
| 139 | IVAFFSFGGAL | 0.487 | 257 | WB | Sequence | A0203 |
| 73 | SLDAREVIPMA | 0.480 | 276 | WB | Sequence | A0203 |
| 82 | MAAVKQALREA | 0.430 | 477 | WB | Sequence | A0203 |

Fig. 26 continued

| | | | | | | |
|---|---|---|---|---|---|---|
| 124 | QVVNELFRDGV | 0.426 | 496 | WB | Sequence | A0203 |
| 213 | FLTGMTVAGVV | 0.584 | 90 | WB | Sequence | A0204 |
| 88 | ALREAGDEFEL | 0.526 | 168 | WB | Sequence | A0204 |
| 160 | VLVSRIAAWMA | 0.517 | 185 | WB | Sequence | A0204 |
| 172 | YLNDHLEPWIQ | 0.517 | 186 | WB | Sequence | A0204 |
| 73 | SLDAREVIPMA | 0.485 | 263 | WB | Sequence | A0204 |
| 213 | FLTGMTVAGVV | 0.746 | 15 | SB | Sequence | A0206 |
| 138 | RIVAFFSFGGA | 0.725 | 19 | SB | Sequence | A0206 |
| 181 | IQENGGWDTFV | 0.704 | 24 | SB | Sequence | A0206 |
| 119 | YQSFEQVVNEL | 0.671 | 35 | SB | Sequence | A0206 |
| 48 | SAINGNPSWHL | 0.664 | 38 | SB | Sequence | A0206 |
| 124 | QVVNELFRDGV | 0.619 | 62 | WB | Sequence | A0206 |
| 160 | VLVSRIAAWMA | 0.584 | 90 | WB | Sequence | A0206 |
| 86 | KQALREAGDEF | 0.547 | 134 | WB | Sequence | A0206 |
| 57 | HLADSPAVNGA | 0.509 | 201 | WB | Sequence | A0206 |
| 218 | TVAGVVLLGSL | 0.456 | 358 | WB | Sequence | A0206 |
| 88 | ALREAGDEFEL | 0.442 | 420 | WB | Sequence | A0206 |
| 109 | SQLHITPGTAY | 0.441 | 422 | WB | Sequence | A0206 |
| 213 | FLTGMTVAGVV | 0.943 | 1 | SB | Sequence | A0211 |
| 73 | SLDAREVIPMA | 0.876 | 3 | SB | Sequence | A0211 |
| 172 | YLNDHLEPWIQ | 0.852 | 4 | SB | Sequence | A0211 |
| 88 | ALREAGDEFEL | 0.799 | 8 | SB | Sequence | A0211 |
| 57 | HLADSPAVNGA | 0.787 | 10 | SB | Sequence | A0211 |
| 160 | VLVSRIAAWMA | 0.759 | 13 | SB | Sequence | A0211 |
| 15 | KLSQKGYSWSQ | 0.743 | 16 | SB | Sequence | A0211 |
| 6 | ELVVDFLSYKL | 0.682 | 31 | SB | Sequence | A0211 |
| 218 | TVAGVVLLGSL | 0.628 | 55 | WB | Sequence | A0211 |
| 49 | AINGNPSWHLA | 0.612 | 66 | WB | Sequence | A0211 |
| 212 | WFLTGMTVAGV | 0.577 | 97 | WB | Sequence | A0211 |
| 141 | AFFSFGGALCV | 0.571 | 103 | WB | Sequence | A0211 |
| 144 | SFGGALCVESV | 0.569 | 105 | WB | Sequence | A0211 |
| 79 | VIPMAAVKQAL | 0.568 | 107 | WB | Sequence | A0211 |
| 124 | QVVNELFRDGV | 0.535 | 152 | WB | Sequence | A0211 |
| 130 | FRDGVNWGRIV | 0.516 | 187 | WB | Sequence | A0211 |
| 48 | SAINGNPSWHL | 0.515 | 189 | WB | Sequence | A0211 |
| 192 | ELYGNNAAAES | 0.504 | 214 | WB | Sequence | A0211 |
| 150 | CVESVDKEMQV | 0.489 | 252 | WB | Sequence | A0211 |
| 116 | GTAYQSFEQVV | 0.452 | 376 | WB | Sequence | A0211 |
| 139 | IVAFFSFGGAL | 0.444 | 411 | WB | Sequence | A0211 |
| 213 | FLTGMTVAGVV | 0.824 | 6 | SB | Sequence | A0212 |
| 172 | YLNDHLEPWIQ | 0.812 | 7 | SB | Sequence | A0212 |
| 88 | ALREAGDEFEL | 0.779 | 10 | SB | Sequence | A0212 |
| 73 | SLDAREVIPMA | 0.745 | 15 | SB | Sequence | A0212 |
| 57 | HLADSPAVNGA | 0.714 | 22 | SB | Sequence | A0212 |
| 160 | VLVSRIAAWMA | 0.681 | 31 | SB | Sequence | A0212 |
| 79 | VIPMAAVKQAL | 0.604 | 72 | WB | Sequence | A0212 |
| 15 | KLSQKGYSWSQ | 0.566 | 107 | WB | Sequence | A0212 |
| 212 | WFLTGMTVAGV | 0.504 | 213 | WB | Sequence | A0212 |
| 6 | ELVVDFLSYKL | 0.451 | 380 | WB | Sequence | A0212 |
| 130 | FRDGVNWGRIV | 0.431 | 473 | WB | Sequence | A0212 |
| 213 | FLTGMTVAGVV | 0.862 | 4 | SB | Sequence | A0216 |
| 88 | ALREAGDEFEL | 0.821 | 6 | SB | Sequence | A0216 |
| 73 | SLDAREVIPMA | 0.744 | 16 | SB | Sequence | A0216 |
| 160 | VLVSRIAAWMA | 0.649 | 44 | SB | Sequence | A0216 |
| 150 | CVESVDKEMQV | 0.641 | 48 | SB | Sequence | A0216 |
| 57 | HLADSPAVNGA | 0.595 | 79 | WB | Sequence | A0216 |
| 144 | SFGGALCVESV | 0.591 | 83 | WB | Sequence | A0216 |
| 172 | YLNDHLEPWIQ | 0.581 | 92 | WB | Sequence | A0216 |
| 15 | KLSQKGYSWSQ | 0.561 | 115 | WB | Sequence | A0216 |
| 6 | ELVVDFLSYKL | 0.544 | 138 | WB | Sequence | A0216 |
| 218 | TVAGVVLLGSL | 0.534 | 154 | WB | Sequence | A0216 |
| 141 | AFFSFGGALCV | 0.526 | 168 | WB | Sequence | A0216 |

Fig. 26 continued

| | | | | | | |
|---|---|---|---|---|---|---|
| 131 | IQENGGWDTFV | 0.497 | 231 | WB | Sequence | A0216 |
| 124 | QVVNELFRDGV | 0.490 | 249 | WB | Sequence | A0216 |
| 79 | VIPMAAVKQAL | 0.487 | 257 | WB | Sequence | A0216 |
| 192 | ELYGNNAAAES | 0.478 | 283 | WB | Sequence | A0216 |
| 48 | SAINGNPSWHL | 0.468 | 315 | WB | Sequence | A0216 |
| 212 | WFLTGMTVAGV | 0.437 | 441 | WB | Sequence | A0216 |
| 49 | AINGNPSWHLA | 0.436 | 447 | WB | Sequence | A0216 |
| 213 | FLTGMTVAGVV | 0.781 | 10 | SB | Sequence | A0219 |
| 57 | HLADSPAVNGA | 0.730 | 18 | SB | Sequence | A0219 |
| 172 | YLNDHLEPWIQ | 0.695 | 27 | SB | Sequence | A0219 |
| 73 | SLDAREVIPMA | 0.609 | 68 | WB | Sequence | A0219 |
| 88 | ALREAGDEFEL | 0.549 | 131 | WB | Sequence | A0219 |
| 212 | WFLTGMTVAGV | 0.524 | 172 | WB | Sequence | A0219 |
| 160 | VLVSRIAAWMA | 0.499 | 225 | WB | Sequence | A0219 |
| 222 | VVLLGSLFSRK | 0.683 | 29 | SB | Sequence | A0301 |
| 222 | VVLLGSLFSRK | 0.786 | 10 | SB | Sequence | A1101 |
| 221 | GVVLLGSLFSR | 0.596 | 78 | WB | Sequence | A1101 |
| 67 | ATGHSSSLDAR | 0.505 | 212 | WB | Sequence | A1101 |
| 5 | RELVVDFLSYK | 0.428 | 489 | WB | Sequence | A1101 |
| 135 | NWGRIVAFFSF | 0.695 | 26 | SB | Sequence | A2301 |
| 171 | TYLNDHLEPWI | 0.576 | 98 | WB | Sequence | A2301 |
| 167 | AWMATYLNDHL | 0.534 | 154 | WB | Sequence | A2301 |
| 13 | SYKLSQKGYSW | 0.531 | 159 | WB | Sequence | A2301 |
| 135 | NWGRIVAFFSF | 0.746 | 15 | SB | Sequence | A2402 |
| 171 | TYLNDHLEPWI | 0.746 | 15 | SB | Sequence | A2402 |
| 167 | AWMATYLNDHL | 0.520 | 180 | WB | Sequence | A2402 |
| 171 | TYLNDHLEPWI | 0.660 | 39 | SB | Sequence | A2403 |
| 167 | AWMATYLNDHL | 0.523 | 174 | WB | Sequence | A2403 |
| 13 | SYKLSQKGYSW | 0.523 | 174 | WB | Sequence | A2403 |
| 112 | HITPGTAYQSF | 0.431 | 473 | WB | Sequence | A2403 |
| 159 | QVLVSRIAAWM | 0.640 | 49 | SB | Sequence | A2602 |
| 112 | HITPGTAYQSF | 0.573 | 101 | WB | Sequence | A2602 |
| 130 | WIQENGGWDTF | 0.518 | 183 | WB | Sequence | A2602 |
| 11 | FLSYKLSQKGY | 0.516 | 188 | WB | Sequence | A2602 |
| 132 | DGVNWGRIVAF | 0.462 | 336 | WB | Sequence | A2602 |
| 218 | TVAGVVLLGSL | 0.443 | 415 | WB | Sequence | A2602 |
| 109 | SQLHITPGTAY | 0.516 | 188 | WB | Sequence | A2902 |
| 222 | VVLLGSLFSRK | 0.435 | 453 | WB | Sequence | A3001 |
| 99 | RYRRAFSDLTS | 0.428 | 486 | WB | Sequence | A3001 |
| 221 | GVVLLGSLFSR | 0.598 | 77 | WB | Sequence | A3101 |
| 121 | SFEQVVNELFR | 0.552 | 127 | WB | Sequence | A3101 |
| 201 | ESRKGQERFNR | 0.511 | 198 | WB | Sequence | A3101 |
| 67 | ATGHSSSLDAR | 0.475 | 292 | WB | Sequence | A3101 |
| 5 | RELVVDFLSYK | 0.442 | 417 | WB | Sequence | A3101 |
| 193 | LYGNNAAAESR | 0.435 | 449 | WB | Sequence | A3101 |
| 201 | ESRKGQERFNR | 0.690 | 28 | SB | Sequence | A3301 |
| 128 | ELFRDGVNWGR | 0.634 | 52 | WB | Sequence | A3301 |
| 91 | EAGDEFELRYR | 0.538 | 148 | WB | Sequence | A3301 |
| 121 | SFEQVVNELFR | 0.472 | 303 | WB | Sequence | A3301 |
| 221 | GVVLLGSLFSR | 0.447 | 396 | WB | Sequence | A3301 |
| 95 | EFELRYRRAFS | 0.435 | 449 | WB | Sequence | A3301 |
| 128 | ELFRDGVNWGR | 0.739 | 16 | SB | Sequence | A6801 |
| 23 | WSQFSDVEENR | 0.667 | 36 | SB | Sequence | A6801 |
| 201 | ESRKGQERFNR | 0.666 | 36 | SB | Sequence | A6801 |
| 91 | EAGDEFELRYR | 0.643 | 47 | SB | Sequence | A6801 |

Fig. 26 continued

| | | | | | | |
|---|---|---|---|---|---|---|
| 221 | GVVLLGSLFSR | 0.638 | 49 | SB | Sequence | A6801 |
| 80 | IPMAAVKQALR | 0.566 | 109 | WB | Sequence | A6801 |
| 121 | SFEQVVNELFR | 0.536 | 151 | WB | Sequence | A6801 |
| | | | | | | |
| 218 | TVAGVVLLGSL | 0.796 | 9 | SB | Sequence | A6802 |
| 124 | QVVNELFRDGV | 0.712 | 22 | SB | Sequence | A6802 |
| 139 | IVAFFSFGGAL | 0.684 | 30 | SB | Sequence | A6802 |
| 152 | ESVDKEMQVLV | 0.613 | 65 | WB | Sequence | A6802 |
| 215 | TGMTVAGVVLL | 0.561 | 116 | WB | Sequence | A6802 |
| 6 | ELVVDFLSYKL | 0.551 | 129 | WB | Sequence | A6802 |
| 138 | RIVAFFSFGGA | 0.548 | 132 | WB | Sequence | A6802 |
| 188 | DTFVELYGNNA | 0.530 | 161 | WB | Sequence | A6802 |
| 78 | EVIPMAAVKQA | 0.516 | 188 | WB | Sequence | A6802 |
| 116 | GTAYQSFEQVV | 0.514 | 191 | WB | Sequence | A6802 |
| 75 | DAREVIPMAAV | 0.509 | 203 | WB | Sequence | A6802 |
| 57 | HLADSPAVNGA | 0.508 | 206 | WB | Sequence | A6802 |
| 217 | MTVAGVVLLGS | 0.480 | 277 | WB | Sequence | A6802 |
| 45 | HTPSAINGNPS | 0.479 | 279 | WB | Sequence | A6802 |
| 213 | FLTGMTVAGVV | 0.470 | 308 | WB | Sequence | A6802 |
| 70 | HSSSLDAREVI | 0.447 | 397 | WB | Sequence | A6802 |
| | | | | | | |
| 48 | SAINGNPSWHL | 0.541 | 143 | WB | Sequence | A6901 |
| 75 | DAREVIPMAAV | 0.527 | 166 | WB | Sequence | A6901 |
| 152 | ESVDKEMQVLV | 0.511 | 199 | WB | Sequence | A6901 |
| 57 | HLADSPAVNGA | 0.485 | 263 | WB | Sequence | A6901 |
| 54 | PSWHLADSPAV | 0.469 | 312 | WB | Sequence | A6901 |
| 212 | WFLTGMTVAGV | 0.453 | 369 | WB | Sequence | A6901 |
| 78 | EVIPMAAVKQA | 0.442 | 417 | WB | Sequence | A6901 |
| 6 | ELVVDFLSYKL | 0.442 | 417 | WB | Sequence | A6901 |
| 218 | TVAGVVLLGSL | 0.430 | 475 | WB | Sequence | A6901 |
| 188 | DTFVELYGNNA | 0.427 | 494 | WB | Sequence | A6901 |
| | | | | | | |
| 139 | IVAFFSFGGAL | 0.518 | 183 | WB | Sequence | B0702 |
| 53 | NPSWHLADSPA | 0.499 | 224 | WB | Sequence | B0702 |
| 61 | SPAVNGATGHS | 0.457 | 355 | WB | Sequence | B0702 |
| | | | | | | |
| 109 | SQLHITPGTAY | 0.605 | 72 | WB | Sequence | B1501 |
| 86 | KQALPEAGDEF | 0.567 | 108 | WB | Sequence | B1501 |
| 1 | SQSNRELVVDF | 0.540 | 144 | WB | Sequence | B1501 |
| 119 | YQSFEQVVNEL | 0.515 | 189 | WB | Sequence | B1501 |
| 158 | MQVLVSRIAAW | 0.512 | 196 | WB | Sequence | B1501 |
| 162 | VSRIAAWMATY | 0.477 | 235 | WB | Sequence | B1501 |
| 11 | FLSYKLSQKGY | 0.474 | 294 | WB | Sequence | B1501 |
| 180 | WIQENGGWDTF | 0.473 | 299 | WB | Sequence | B1501 |
| 120 | QSFEQVVNELF | 0.450 | 386 | WB | Sequence | B1501 |
| 112 | HITPGTAYQSF | 0.447 | 394 | WB | Sequence | B1501 |
| 133 | GVNWGRIVAFF | 0.433 | 463 | WB | Sequence | B1501 |
| | | | | | | |
| 94 | DEFELRYRRAF | 0.829 | 6 | SB | Sequence | B1801 |
| 90 | REAGDEFELRY | 0.560 | 116 | WB | Sequence | B1801 |
| 109 | SQLHITPGTAY | 0.539 | 146 | WB | Sequence | B1801 |
| 151 | VESVDKEMQVL | 0.476 | 288 | WB | Sequence | B1801 |
| 177 | LEPWIQENGGW | 0.466 | 321 | WB | Sequence | B1801 |
| 209 | FNRWFLTGMTV | 0.444 | 409 | WB | Sequence | B1801 |
| | | | | | | |
| 101 | RRAFSDLTSQL | 0.563 | 113 | WB | Sequence | B2705 |
| 163 | SRIAAWMATYL | 0.470 | 310 | WB | Sequence | B2705 |
| | | | | | | |
| 53 | NPSWHLADSPA | 0.623 | 59 | WB | Sequence | B3501 |
| 46 | TPSAINGNPSW | 0.485 | 263 | WB | Sequence | B3501 |
| 180 | WIQENGGWDTF | 0.474 | 297 | WB | Sequence | B3501 |
| 132 | DGVNWGRIVAF | 0.442 | 419 | WB | Sequence | B3501 |
| | | | | | | |
| 119 | YQSFEQVVNEL | 0.610 | 68 | WB | Sequence | B3901 |
| | | | | | | |
| 151 | VESVDKEMQVL | 0.492 | 243 | WB | Sequence | B4001 |

Fig. 26 continued

| | | | | | | |
|---|---|---|---|---|---|---|
| 40 | TESEMETPSAI | 0.446 | 402 | WB | Sequence | B4002 |
| 30 | EENRTEAPEGT | 0.498 | 228 | WB | Sequence | B4501 |
| 46 | TPSAINGNPSW | 0.772 | 11 | SB | Sequence | B5301 |
| 53 | NPSWHLADSPA | 0.430 | 474 | WB | Sequence | B5401 |
| 170 | ATYLNDHLEPW | 0.540 | 145 | WB | Sequence | B5701 |
| 170 | ATYLNDHLEPW | 0.537 | 150 | WB | Sequence | B5801 |
| 120 | QSFEQVVNELF | 0.495 | 235 | WB | Sequence | B5801 |

Fig. 26 continued

Figure 27: Prediction of cancer antigen BclX(L) specific MHC class 2, 15-mer peptide binders. Peptide sequences corresponds to SEQ ID NO 201474-201985 in the sequence listing.

| Allele | pos | peptide | core | 1-log50k(aff) | affinity(nM) | Bind Level | Identity |
|---|---|---|---|---|---|---|---|
| DRB1_0101 | 212 | RWFLTGMTVAGVVLL | LTGMTVAGV | 0.8028 | 8 | SB | BclX(L) |
| DRB1_0101 | 209 | RFNRWFLTGMTVAGV | FLTGMTVAG | 0.7932 | 9 | SB | BclX(L) |
| DRB1_0101 | 210 | FNRWFLTGMTVAGVV | LTGMTVAGV | 0.7940 | 9 | SB | BclX(L) |
| DRB1_0101 | 211 | NRWFLTGMTVAGVVL | LTGMTVAGV | 0.7970 | 9 | SB | BclX(L) |
| DRB1_0101 | 213 | WFLTGMTVAGVVLLG | LTGMTVAGV | 0.7753 | 11 | SB | BclX(L) |
| DRB1_0101 | 76 | DAREVIPMAAVKQAL | VIPMAAVKQ | 0.7755 | 11 | SB | BclX(L) |
| DRB1_0101 | 77 | AREVIPMAAVKQALR | VIPMAAVKQ | 0.7788 | 11 | SB | BclX(L) |
| DRB1_0101 | 78 | REVIPMAAVKQALRE | VIPMAAVKQ | 0.7772 | 11 | SB | BclX(L) |
| DRB1_0101 | 75 | LDAREVIPMAAVKQA | VIPMAAVKQ | 0.7730 | 12 | SB | BclX(L) |
| DRB1_0101 | 157 | KEMQVLVSRIAAWMA | MQVLVSRIA | 0.7458 | 16 | SB | BclX(L) |
| DRB1_0101 | 108 | LTSQLHITPGTAYQS | LHITPGTAY | 0.7338 | 18 | SB | BclX(L) |
| DRB1_0101 | 109 | TSQLHITPGTAYQSF | ITPGTAYQS | 0.7313 | 18 | SB | BclX(L) |
| DRB1_0101 | 74 | SLDAREVIPMAAVKQ | AREVIPMAA | 0.7348 | 18 | SB | BclX(L) |
| DRB1_0101 | 110 | SQLHITPGTAYQSFE | ITPGTAYQS | 0.7287 | 19 | SB | BclX(L) |
| DRB1_0101 | 214 | FLTGMTVAGVVLLGS | LTGMTVAGV | 0.7282 | 19 | SB | BclX(L) |
| DRB1_0101 | 156 | DKEMQVLVSRIAAWM | MQVLVSRIA | 0.7226 | 20 | SB | BclX(L) |
| DRB1_0101 | 111 | QLHITPGTAYQSFEQ | ITPGTAYQS | 0.7202 | 21 | SB | BclX(L) |
| DRB1_0101 | 112 | LHITPGTAYQSFEQV | ITPGTAYQS | 0.7189 | 21 | SB | BclX(L) |
| DRB1_0101 | 154 | SVDKEMQVLVSRIAA | MQVLVSRIA | 0.7165 | 21 | SB | BclX(L) |
| DRB1_0101 | 79 | EVIPMAAVKQALREA | IPMAAVKQA | 0.7208 | 21 | SB | BclX(L) |
| DRB1_0101 | 153 | ESVDKEMQVLVSRIA | VDKEMQVLV | 0.7145 | 22 | SB | BclX(L) |
| DRB1_0101 | 155 | VDKEMQVLVSRIAAW | MQVLVSRIA | 0.7141 | 22 | SB | BclX(L) |
| DRB1_0101 | 215 | LTGMTVAGVVLLGSL | LTGMTVAGV | 0.7090 | 23 | SB | BclX(L) |
| DRB1_0101 | 208 | ERFNRWFLTGMTVAG | FNRWFLTGM | 0.7077 | 24 | SB | BclX(L) |
| DRB1_0101 | 46 | ETPSAINGNPSWHLA | INGNPSWHL | 0.7051 | 24 | SB | BclX(L) |
| DRB1_0101 | 47 | TPSAINGNPSWHLAD | INGNPSWHL | 0.7051 | 24 | SB | BclX(L) |
| DRB1_0101 | 48 | PSAINGNPSWHLADS | INGNPSWHL | 0.7076 | 24 | SB | BclX(L) |
| DRB1_0101 | 49 | SAINGNPSWHLADSP | INGNPSWHL | 0.7072 | 24 | SB | BclX(L) |
| DRB1_0101 | 45 | METPSAINGNPSWHL | PSAINGNPS | 0.7034 | 25 | SB | BclX(L) |
| DRB1_0101 | 158 | EMQVLVSRIAAWMAT | MQVLVSRIA | 0.6845 | 30 | SB | BclX(L) |
| DRB1_0101 | 80 | VIPMAAVKQALREAG | VIPMAAVKQ | 0.6856 | 30 | SB | BclX(L) |
| DRB1_0101 | 159 | MQVLVSRIAAWMATY | MQVLVSRIA | 0.6834 | 31 | SB | BclX(L) |
| DRB1_0101 | 161 | VLVSRIAAWMATYLN | IAAWMATYL | 0.6838 | 31 | SB | BclX(L) |
| DRB1_0101 | 217 | GMTVAGVVLLGSLFS | MTVAGVVLL | 0.6800 | 32 | SB | BclX(L) |
| DRB1_0101 | 218 | MTVAGVVLLGSLFSR | VVLLGSLFS | 0.6800 | 32 | SB | BclX(L) |
| DRB1_0101 | 51 | INGNPSWHLADSPAV | INGNPSWHL | 0.6778 | 33 | SB | BclX(L) |
| DRB1_0101 | 192 | VELYGNNAAAESRKG | YGNNAAAES | 0.6693 | 36 | SB | BclX(L) |
| DRB1_0101 | 219 | TVAGVVLLGSLFSRK | VVLLGSLFS | 0.6677 | 36 | SB | BclX(L) |
| DRB1_0101 | 160 | QVLVSRIAAWMATYL | VSRIAAWMA | 0.6652 | 37 | SB | BclX(L) |
| DRB1_0101 | 191 | FVELYGNNAAAESRK | YGNNAAAES | 0.6658 | 37 | SB | BclX(L) |
| DRB1_0101 | 193 | ELYGNNAAAESRKGQ | YGNNAAAES | 0.6661 | 37 | SB | BclX(L) |
| DRB1_0101 | 99 | LRYRRAFSDLTSQLH | YRRAFSDLT | 0.6657 | 37 | SB | BclX(L) |
| DRB1_0101 | 162 | LVSRIAAWMATYLND | IAAWMATYL | 0.6627 | 38 | SB | BclX(L) |
| DRB1_0101 | 190 | TFVELYGNNAAAESR | YGNNAAAES | 0.6628 | 38 | SB | BclX(L) |
| DRB1_0101 | 189 | DTFVELYGNNAAAES | FVELYGNNA | 0.6613 | 39 | SB | BclX(L) |
| DRB1_0101 | 54 | NPSWHLADSPAVNGA | WHLADSPAV | 0.6617 | 39 | SB | BclX(L) |
| DRB1_0101 | 55 | PSWHLADSPAVNGAT | WHLADSPAV | 0.6611 | 39 | SB | BclX(L) |
| DRB1_0101 | 216 | TGMTVAGVVLLGSLF | MTVAGVVLL | 0.6543 | 42 | SB | BclX(L) |
| DRB1_0101 | 163 | VSRIAAWMATYLNDH | IAAWMATYL | 0.6531 | 43 | SB | BclX(L) |
| DRB1_0101 | 53 | GNPSWHLADSPAVNG | WHLADSPAV | 0.6532 | 43 | SB | BclX(L) |
| DRB1_0101 | 59 | LADSPAVNGATGHSS | LADSPAVNG | 0.6361 | 51 | WB | BclX(L) |
| DRB1_0101 | 98 | ELRYRRAFSDLTSQL | YRRAFSDLT | 0.6357 | 51 | WB | BclX(L) |
| DRB1_0101 | 164 | SRIAAWMATYLNDHL | IAAWMATYL | 0.6357 | 52 | WB | BclX(L) |
| DRB1_0101 | 97 | FELRYRRAFSDLTSQ | YRRAFSDLT | 0.6337 | 53 | WB | BclX(L) |
| DRB1_0101 | 96 | EFELRYRRAFSDLTS | YRRAFSDLT | 0.6321 | 54 | WB | BclX(L) |
| DRB1_0101 | 95 | DEFELRYRRAFSDLT | LRYRRAFSD | 0.6294 | 55 | WB | BclX(L) |
| DRB1_0101 | 140 | IVAFFSFGGALCVES | FSFGGALCV | 0.6203 | 61 | WB | BclX(L) |
| DRB1_0101 | 56 | SWHLADSPAVNGATG | LADSPAVNG | 0.6196 | 61 | WB | BclX(L) |
| DRB1_0101 | 61 | DSPAVNGATGHSSSL | VNGATGHSS | 0.6197 | 61 | WB | BclX(L) |

| | | | | | | | |
|---|---|---|---|---|---|---|---|
| DRB1_0101 | 62 | SPAVNGATGHSSSLD | VNGATGHSS | 0.6205 | 61 | WB | BclX(L) |
| DRB1_0101 | 141 | VAFFSFGGALCVESV | FSFGGALCV | 0.6191 | 62 | WB | BclX(L) |
| DRB1_0101 | 60 | ADSPAVNGATGHSSS | VNGATGHSS | 0.6174 | 63 | WB | BclX(L) |
| DRB1_0101 | 142 | AFFSFGGALCVESVD | FSFGGALCV | 0.6153 | 64 | WB | BclX(L) |
| DRB1_0101 | 57 | WHLADSPAVNGATGH | LADSPAVNG | 0.6162 | 64 | WB | BclX(L) |
| DRB1_0101 | 113 | HITPGTAYQSFEQVV | ITPGTAYQS | 0.6121 | 66 | WB | BclX(L) |
| DRB1_0101 | 114 | ITPGTAYQSFEQVVN | ITPGTAYQS | 0.6131 | 66 | WB | BclX(L) |
| DRB1_0101 | 50 | AINGNPSWHLADSPA | INGNPSWHL | 0.6133 | 66 | WB | BclX(L) |
| DRB1_0101 | 63 | PAVNGATGHSSSLDA | VNGATGHSS | 0.6078 | 70 | WB | BclX(L) |
| DRB1_0101 | 100 | RYRRAFSDLTSQLHI | YRRAFSDLT | 0.6026 | 74 | WB | BclX(L) |
| DRB1_0101 | 101 | YRRAFSDLTSQLHIT | YRRAFSDLT | 0.6021 | 74 | WB | BclX(L) |
| DRB1_0101 | 52 | NGNPSWHLADSPAVN | WHLADSPAV | 0.6004 | 75 | WB | BclX(L) |
| DRB1_0101 | 138 | GRIVAFFSFGGALCV | IVAFFSFGG | 0.5864 | 88 | WB | BclX(L) |
| DRB1_0101 | 194 | LYGNNAAAESRKGQE | YGNNAAAES | 0.5808 | 93 | WB | BclX(L) |
| DRB1_0101 | 165 | RIAAWMATYLNDHLE | AAWMATYLN | 0.5762 | 98 | WB | BclX(L) |
| DRB1_0101 | 195 | YGNNAAAESRKGQER | YGNNAAAES | 0.5731 | 101 | WB | BclX(L) |
| DRB1_0101 | 139 | RIVAFFSFGGALCVE | FSFGGALCV | 0.5729 | 102 | WB | BclX(L) |
| DRB1_0101 | 131 | FRDGVNWGRIVAFFS | VNWGRIVAF | 0.5627 | 114 | WB | BclX(L) |
| DRB1_0101 | 143 | FFSFGGALCVESVDK | FSFGGALCV | 0.5613 | 115 | WB | BclX(L) |
| DRB1_0101 | 144 | FSFGGALCVESVDKE | FSFGGALCV | 0.5583 | 119 | WB | BclX(L) |
| DRB1_0101 | 132 | RDGVNWGRIVAFFSF | VNWGRIVAF | 0.5561 | 122 | WB | BclX(L) |
| DRB1_0101 | 133 | DGVNWGRIVAFFSFG | VNWGRIVAF | 0.5558 | 122 | WB | BclX(L) |
| DRB1_0101 | 81 | IPMAAVKQALREAGD | IPMAAVKQA | 0.5527 | 126 | WB | BclX(L) |
| DRB1_0101 | 102 | RRAFSDLTSQLHITP | FSDLTSQLH | 0.5334 | 156 | WB | BclX(L) |
| DRB1_0101 | 103 | RAFSDLTSQLHITPG | FSDLTSQLH | 0.5314 | 159 | WB | BclX(L) |
| DRB1_0101 | 58 | HLADSPAVNGATGHS | LADSPAVNG | 0.5293 | 163 | WB | BclX(L) |
| DRB1_0101 | 134 | GVNWGRIVAFFSFGG | VNWGRIVAF | 0.5282 | 165 | WB | BclX(L) |
| DRB1_0101 | 166 | IAAWMATYLNDHLEP | IAAWMATYL | 0.5271 | 167 | WB | BclX(L) |
| DRB1_0101 | 64 | AVNGATGHSSSLDAR | VNGATGHSS | 0.5266 | 168 | WB | BclX(L) |
| DRB1_0101 | 135 | VNWGRIVAFFSFGGA | VNWGRIVAF | 0.5248 | 171 | WB | BclX(L) |
| DRB1_0101 | 7 | ELVVDFLSYKLSQKG | VVDFLSYKL | 0.5243 | 172 | WB | BclX(L) |
| DRB1_0101 | 129 | ELFRDGVNWGRIVAF | FRDGVNWGR | 0.5154 | 189 | WB | BclX(L) |
| DRB1_0101 | 65 | VNGATGHSSSLDARE | VNGATGHSS | 0.5156 | 189 | WB | BclX(L) |
| DRB1_0101 | 130 | LFRDGVNWGRIVAFF | VNWGRIVAF | 0.5023 | 218 | WB | BclX(L) |
| DRB1_0101 | 8 | LVVDFLSYKLSQKGY | LSYKLSQKG | 0.4921 | 244 | WB | BclX(L) |
| DRB1_0101 | 9 | VVDFLSYKLSQKGYS | LSYKLSQKG | 0.4892 | 251 | WB | BclX(L) |
| DRB1_0101 | 207 | QERFNRWFLTGMTVA | FNRWFLTGM | 0.4845 | 264 | WB | BclX(L) |
| DRB1_0101 | 42 | ESEMETPSAINGNPS | METPSAING | 0.4626 | 335 | WB | BclX(L) |
| DRB1_0101 | 40 | GTESEMETPSAINGN | METPSAING | 0.4622 | 337 | WB | BclX(L) |
| DRB1_0101 | 107 | DLTSQLHITPGTAYQ | LHITPGTAY | 0.4593 | 347 | WB | BclX(L) |
| DRB1_0101 | 39 | EGTESEMETPSAING | ESEMETPSA | 0.4591 | 348 | WB | BclX(L) |
| DRB1_0101 | 43 | SEMETPSAINGNPSW | METPSAING | 0.4590 | 348 | WB | BclX(L) |
| DRB1_0101 | 106 | SDLTSQLHITPGTAY | SQLHITPGT | 0.4569 | 356 | WB | BclX(L) |
| DRB1_0101 | 10 | VDFLSYKLSQKGYSW | LSYKLSQKG | 0.4565 | 358 | WB | BclX(L) |
| DRB1_0101 | 41 | TESEMETPSAINGNP | METPSAING | 0.4564 | 358 | WB | BclX(L) |
| DRB1_0101 | 167 | AAWMATYLNDHLEPW | AAWMATYLN | 0.4556 | 361 | WB | BclX(L) |
| DRB1_0101 | 11 | DFLSYKLSQKGYSWS | LSYKLSQKG | 0.4515 | 378 | WB | BclX(L) |
| DRB1_0101 | 104 | AFSDLTSQLHITPGT | FSDLTSQLH | 0.4453 | 404 | WB | BclX(L) |
| DRB1_0101 | 105 | FSDLTSQLHITPGTA | FSDLTSQLH | 0.4451 | 405 | WB | BclX(L) |
| DRB1_0101 | 137 | WGRIVAFFSFGGALC | IVAFFSFGG | 0.4311 | 471 | WB | BclX(L) |
| DRB1_0101 | 206 | GQERFNRWFLTGMTV | FNRWFLTGM | 0.4277 | 489 | WB | BclX(L) |
| DRB1_0401 | 99 | LRYRRAFSDLTSQLH | YRRAFSDLT | 0.5618 | 115 | WB | BclX(L) |
| DRB1_0401 | 97 | FELRYRRAFSDLTSQ | YRRAFSDLT | 0.5300 | 162 | WB | BclX(L) |
| DRB1_0401 | 96 | EFELRYRRAFSDLTS | YRRAFSDLT | 0.5284 | 164 | WB | BclX(L) |
| DRB1_0401 | 95 | DEFELRYRRAFSDLT | DEFELRYRR | 0.5275 | 166 | WB | BclX(L) |
| DRB1_0401 | 98 | ELRYRRAFSDLTSQL | YRRAFSDLT | 0.5259 | 169 | WB | BclX(L) |
| DRB1_0401 | 185 | NGGWDTFVELYGNNA | WDTFVELYG | 0.5189 | 182 | WB | BclX(L) |
| DRB1_0401 | 186 | GGWDTFVELYGNNAA | FVELYGNNA | 0.5180 | 184 | WB | BclX(L) |
| DRB1_0401 | 188 | WDTFVELYGNNAAAE | FVELYGNNA | 0.5159 | 188 | WB | BclX(L) |
| DRB1_0401 | 187 | GWDTFVELYGNNAAA | FVELYGNNA | 0.5157 | 189 | WB | BclX(L) |
| DRB1_0401 | 189 | DTFVELYGNNAAAES | FVELYGNNA | 0.5154 | 189 | WB | BclX(L) |
| DRB1_0401 | 100 | RYRRAFSDLTSQLHI | YRRAFSDLT | 0.4844 | 265 | WB | BclX(L) |
| DRB1_0401 | 101 | YRRAFSDLTSQLHIT | YRRAFSDLT | 0.4813 | 274 | WB | BclX(L) |
| DRB1_0401 | 153 | ESVDKEMQVLVSRIA | KEMQVLVSR | 0.4561 | 360 | WB | BclX(L) |
| DRB1_0401 | 155 | VDKEMQVLVSRIAAW | MQVLVSRIA | 0.4519 | 376 | WB | BclX(L) |
| DRB1_0401 | 208 | ERFNRWFLTGMTVAG | WFLTGMTVA | 0.4512 | 379 | WB | BclX(L) |

Fig. 27 continued

| | | | | | | | |
|---|---|---|---|---|---|---|---|
| DRB1_0401 | 154 | SVDKEMQVLVSRIAA | MQVLVSRIA | 0.4495 | 386 | WB | BclX(L) |
| DRB1_0401 | 209 | RFNRWFLTGMTVAGV | FLTGMTVAG | 0.4467 | 398 | WB | BclX(L) |
| DRB1_0401 | 210 | FNRWFLTGMTVAGVV | FLTGMTVAG | 0.4427 | 416 | WB | BclX(L) |
| DRB1_0401 | 157 | KEMQVLVSRIAAWMA | MQVLVSRIA | 0.4419 | 419 | WB | BclX(L) |
| DRB1_0401 | 156 | DKEMQVLVSRIAAWM | MQVLVSRIA | 0.4413 | 422 | WB | BclX(L) |
| DRB1_0401 | 211 | NRWFLTGMTVAGVVL | FLTGMTVAG | 0.4327 | 463 | WB | BclX(L) |
| DRB1_0404 | 167 | AAWMATYLNDHLEPW | WMATYLNDH | 0.5484 | 132 | WB | BclX(L) |
| DRB1_0404 | 164 | SRIAAWMATYLNDHL | WMATYLNDH | 0.5424 | 141 | WB | BclX(L) |
| DRB1_0404 | 165 | RIAAWMATYLNDHLE | WMATYLNDH | 0.5417 | 142 | WB | BclX(L) |
| DRB1_0404 | 166 | IAAWMATYLNDHLEP | WMATYLNDH | 0.5330 | 156 | WB | BclX(L) |
| DRB1_0404 | 163 | VSRIAAWMATYLNDH | AAWMATYLN | 0.5217 | 177 | WB | BclX(L) |
| DRB1_0404 | 219 | TVAGVVLLGSLFSRK | VVLLGSLFS | 0.5094 | 202 | WB | BclX(L) |
| DRB1_0404 | 209 | RFNRWFLTGMTVAGV | FLTGMTVAG | 0.4902 | 249 | WB | BclX(L) |
| DRB1_0404 | 210 | FNRWFLTGMTVAGVV | FLTGMTVAG | 0.4853 | 262 | WB | BclX(L) |
| DRB1_0404 | 211 | NRWFLTGMTVAGVVL | FLTGMTVAG | 0.4826 | 270 | WB | BclX(L) |
| DRB1_0404 | 208 | ERFNRWFLTGMTVAG | WFLTGMTVA | 0.4761 | 290 | WB | BclX(L) |
| DRB1_0404 | 168 | AWMATYLNDHLEPWI | WMATYLNDH | 0.4694 | 311 | WB | BclX(L) |
| DRB1_0404 | 212 | RWFLTGMTVAGVVLL | FLTGMTVAG | 0.4547 | 365 | WB | BclX(L) |
| DRB1_0404 | 189 | DTFVELYGNNAAAES | FVELYGNNA | 0.4505 | 382 | WB | BclX(L) |
| DRB1_0404 | 187 | GWDTFVELYGNNAAA | FVELYGNNA | 0.4498 | 385 | WB | BclX(L) |
| DRB1_0404 | 169 | WMATYLNDHLEPWIQ | WMATYLNDH | 0.4478 | 393 | WB | BclX(L) |
| DRB1_0404 | 188 | WDTFVELYGNNAAAE | FVELYGNNA | 0.4462 | 400 | WB | BclX(L) |
| DRB1_0404 | 186 | GGWDTFVELYGNNAA | FVELYGNNA | 0.4437 | 411 | WB | BclX(L) |
| DRB1_0404 | 185 | NGGWDTFVELYGNNA | GWDTFVELY | 0.4388 | 434 | WB | BclX(L) |
| DRB1_0405 | 118 | TAYQSFEQVVNELFR | YQSFEQVVN | 0.5794 | 95 | WB | BclX(L) |
| DRB1_0405 | 117 | GTAYQSFEQVVNELF | YQSFEQVVN | 0.5772 | 97 | WB | BclX(L) |
| DRB1_0405 | 115 | TPGTAYQSFEQVVNE | YQSFEQVVN | 0.5541 | 124 | WB | BclX(L) |
| DRB1_0405 | 116 | PGTAYQSFEQVVNEL | YQSFEQVVN | 0.5538 | 125 | WB | BclX(L) |
| DRB1_0405 | 114 | ITPGTAYQSFEQVVN | AYQSFEQVV | 0.5505 | 129 | WB | BclX(L) |
| DRB1_0405 | 163 | VSRIAAWMATYLNDH | AAWMATYLN | 0.5510 | 129 | WB | BclX(L) |
| DRB1_0405 | 162 | LVSRIAAWMATYLND | AAWMATYLN | 0.5473 | 134 | WB | BclX(L) |
| DRB1_0405 | 161 | VLVSRIAAWMATYLN | IAAWMATYL | 0.5442 | 139 | WB | BclX(L) |
| DRB1_0405 | 164 | SRIAAWMATYLNDHL | AAWMATYLN | 0.5402 | 145 | WB | BclX(L) |
| DRB1_0405 | 99 | LRYRRAFSDLTSQLH | YRRAFSDLT | 0.5100 | 201 | WB | BclX(L) |
| DRB1_0405 | 97 | FELRYRRAFSDLTSQ | YRRAFSDLT | 0.5085 | 204 | WB | BclX(L) |
| DRB1_0405 | 96 | EFELRYRRAFSDLTS | YRRAFSDLT | 0.5069 | 208 | WB | BclX(L) |
| DRB1_0405 | 165 | RIAAWMATYLNDHLE | AAWMATYLN | 0.5055 | 211 | WB | BclX(L) |
| DRB1_0405 | 119 | AYQSFEQVVNELFRD | YQSFEQVVN | 0.4974 | 230 | WB | BclX(L) |
| DRB1_0405 | 120 | YQSFEQVVNELFRDG | YQSFEQVVN | 0.4968 | 231 | WB | BclX(L) |
| DRB1_0405 | 98 | ELRYRRAFSDLTSQL | YRRAFSDLT | 0.4923 | 243 | WB | BclX(L) |
| DRB1_0405 | 18 | SQKGYSWSQFSDVEE | GYSWSQFSD | 0.4575 | 354 | WB | BclX(L) |
| DRB1_0405 | 95 | DEFELRYRRAFSDLT | LRYRRAFSD | 0.4574 | 355 | WB | BclX(L) |
| DRB1_0405 | 19 | QKGYSWSQFSDVEEN | WSQFSDVEE | 0.4562 | 359 | WB | BclX(L) |
| DRB1_0405 | 100 | RYRRAFSDLTSQLHI | YRRAFSDLT | 0.4475 | 395 | WB | BclX(L) |
| DRB1_0405 | 20 | KGYSWSQFSDVEENR | WSQFSDVEE | 0.4430 | 414 | WB | BclX(L) |
| DRB1_0405 | 166 | IAAWMATYLNDHLEP | AAWMATYLN | 0.4423 | 418 | WB | BclX(L) |
| DRB1_0405 | 21 | GYSWSQFSDVEENRT | WSQFSDVEE | 0.4353 | 450 | WB | BclX(L) |
| DRB1_0701 | 157 | KEMQVLVSRIAAWMA | VLVSRIAAW | 0.5228 | 175 | WB | BclX(L) |
| DRB1_0701 | 159 | MQVLVSRIAAWMATY | VLVSRIAAW | 0.5194 | 181 | WB | BclX(L) |
| DRB1_0701 | 158 | EMQVLVSRIAAWMAT | VLVSRIAAW | 0.5191 | 182 | WB | BclX(L) |
| DRB1_0701 | 156 | DKEMQVLVSRIAAWM | VLVSRIAAW | 0.4971 | 231 | WB | BclX(L) |
| DRB1_0701 | 160 | QVLVSRIAAWMATYL | VLVSRIAAW | 0.4833 | 268 | WB | BclX(L) |
| DRB1_0701 | 46 | ETPSAINGNPSWHLA | INGNPSWHL | 0.4783 | 283 | WB | BclX(L) |
| DRB1_0701 | 45 | METPSAINGNPSWHL | AINGNPSWH | 0.4779 | 284 | WB | BclX(L) |
| DRB1_0701 | 155 | VDKEMQVLVSRIAAW | MQVLVSRIA | 0.4772 | 286 | WB | BclX(L) |
| DRB1_0701 | 47 | TPSAINGNPSWHLAD | INGNPSWHL | 0.4774 | 286 | WB | BclX(L) |
| DRB1_0701 | 48 | PSAINGNPSWHLADS | INGNPSWHL | 0.4764 | 289 | WB | BclX(L) |
| DRB1_0701 | 161 | VLVSRIAAWMATYLN | VLVSRIAAW | 0.4745 | 295 | WB | BclX(L) |
| DRB1_0701 | 49 | SAINGNPSWHLADSP | INGNPSWHL | 0.4718 | 303 | WB | BclX(L) |
| DRB1_0701 | 99 | LRYRRAFSDLTSQLH | YRRAFSDLT | 0.4627 | 335 | WB | BclX(L) |
| DRB1_0701 | 100 | RYRRAFSDLTSQLHI | FSDLTSQLH | 0.4416 | 420 | WB | BclX(L) |
| DRB1_0701 | 101 | YRRAFSDLTSQLHIT | FSDLTSQLH | 0.4344 | 455 | WB | BclX(L) |
| DRB1_0701 | 51 | INGNPSWHLADSPAV | INGNPSWHL | 0.4291 | 481 | WB | BclX(L) |

Fig. 27 continued

| | | | | | | | |
|---|---|---|---|---|---|---|---|
| DRB1_0901 | 55 | PSWHLADSPAVNGAT | WHLADSPAV | 0.5482 | 133 | WB | BclX(L) |
| DRB1_0901 | 54 | NPSWHLADSPAVNGA | WHLADSPAV | 0.5414 | 143 | WB | BclX(L) |
| DRB1_0901 | 53 | GNPSWHLADSPAVNG | WHLADSPAV | 0.5408 | 144 | WB | BclX(L) |
| DRB1_0901 | 51 | INGNPSWHLADSPAV | SWHLADSPA | 0.5289 | 164 | WB | BclX(L) |
| DRB1_0901 | 52 | NGNPSWHLADSPAVN | WHLADSPAV | 0.5284 | 164 | WB | BclX(L) |
| DRB1_0901 | 56 | SWHLADSPAVNGATG | WHLADSPAV | 0.4678 | 317 | WB | BclX(L) |
| DRB1_0901 | 57 | WHLADSPAVNGATGH | WHLADSPAV | 0.4636 | 331 | WB | BclX(L) |
| DRB1_0901 | 212 | RWFLTGMTVAGVVLL | FLTGMTVAG | 0.4483 | 391 | WB | BclX(L) |
| DRB1_0901 | 213 | WFLTGMTVAGVVLLG | MTVAGVVLL | 0.4445 | 408 | WB | BclX(L) |
| DRB1_0901 | 214 | FLTGMTVAGVVLLGS | MTVAGVVLL | 0.4327 | 463 | WB | BclX(L) |
| | | | | | | | |
| DRB1_1101 | 157 | KEMQVLVSRIAAWMA | MQVLVSRIA | 0.4319 | 467 | WB | BclX(L) |
| DRB1_1101 | 131 | FRDGVNWGRIVAFFS | GVNWGRIVA | 0.4310 | 472 | WB | BclX(L) |
| DRB1_1101 | 156 | DKEMQVLVSRIAAWM | MQVLVSRIA | 0.4308 | 473 | WB | BclX(L) |
| DRB1_1101 | 155 | VDKEMQVLVSRIAAW | MQVLVSRIA | 0.4292 | 481 | WB | BclX(L) |
| DRB1_1101 | 132 | RDGVNWGRIVAFFSF | GVNWGRIVA | 0.4283 | 486 | WB | BclX(L) |
| DRB1_1101 | 154 | SVDKEMQVLVSRIAA | MQVLVSRIA | 0.4267 | 494 | WB | BclX(L) |
| | | | | | | | |
| DRB1_1302 | 218 | MTVAGVVLLGSLFSR | VVLLGSLFS | 0.4945 | 237 | WB | BclX(L) |
| DRB1_1302 | 216 | TGMTVAGVVLLGSLF | MTVAGVVLL | 0.4855 | 262 | WB | BclX(L) |
| DRB1_1302 | 214 | FLTGMTVAGVVLLGS | MTVAGVVLL | 0.4842 | 265 | WB | BclX(L) |
| DRB1_1302 | 217 | GMTVAGVVLLGSLFS | MTVAGVVLL | 0.4840 | 266 | WB | BclX(L) |
| DRB1_1302 | 212 | RWFLTGMTVAGVVLL | FLTGMTVAG | 0.4832 | 268 | WB | BclX(L) |
| DRB1_1302 | 215 | LTGMTVAGVVLLGSL | MTVAGVVLL | 0.4775 | 285 | WB | BclX(L) |
| DRB1_1302 | 213 | WFLTGMTVAGVVLLG | MTVAGVVLL | 0.4716 | 304 | WB | BclX(L) |
| DRB1_1302 | 189 | DTFVELYGNNAAAES | VELYGNNAA | 0.4688 | 313 | WB | BclX(L) |
| DRB1_1302 | 190 | TFVELYGNNAAAESR | YGNNAAAES | 0.4615 | 339 | WB | BclX(L) |
| DRB1_1302 | 191 | FVELYGNNAAAESRK | YGNNAAAES | 0.4526 | 373 | WB | BclX(L) |
| DRB1_1302 | 192 | VELYGNNAAAESRKG | YGNNAAAES | 0.4415 | 421 | WB | BclX(L) |
| DRB1_1302 | 219 | TVAGVVLLGSLFSRK | VVLLGSLFS | 0.4384 | 436 | WB | BclX(L) |
| DRB1_1302 | 193 | ELYGNNAAAESRKGQ | YGNNAAAES | 0.4275 | 490 | WB | BclX(L) |
| | | | | | | | |
| DRB1_1501 | 219 | TVAGVVLLGSLFSRK | VLLGSLFSR | 0.6681 | 36 | SB | BclX(L) |
| DRB1_1501 | 218 | MTVAGVVLLGSLFSR | VVLLGSLFS | 0.6441 | 47 | SB | BclX(L) |
| DRB1_1501 | 6 | RELVVDFLSYKLSQK | LVVDFLSYK | 0.5208 | 179 | WB | BclX(L) |
| DRB1_1501 | 7 | ELVVDFLSYKLSQKG | FLSYKLSQK | 0.5009 | 221 | WB | BclX(L) |
| DRB1_1501 | 157 | KEMQVLVSRIAAWMA | MQVLVSRIA | 0.4969 | 231 | WB | BclX(L) |
| DRB1_1501 | 156 | DKEMQVLVSRIAAWM | MQVLVSRIA | 0.4965 | 232 | WB | BclX(L) |
| DRB1_1501 | 209 | RFNRWFLTGMTVAGV | FNRWFLTGM | 0.4870 | 257 | WB | BclX(L) |
| DRB1_1501 | 164 | SRIAAWMATYLNDHL | WMATYLNDH | 0.4849 | 263 | WB | BclX(L) |
| DRB1_1501 | 210 | FNRWFLTGMTVAGVV | LTGMTVAGV | 0.4836 | 267 | WB | BclX(L) |
| DRB1_1501 | 8 | LVVDFLSYKLSQKGY | FLSYKLSQK | 0.4778 | 284 | WB | BclX(L) |
| DRB1_1501 | 5 | NRELVVDFLSYKLSQ | LVVDFLSYK | 0.4777 | 285 | WB | BclX(L) |
| DRB1_1501 | 135 | VNWGRIVAFFSFGGA | IVAFFSFGG | 0.4756 | 291 | WB | BclX(L) |
| DRB1_1501 | 4 | SNRELVVDFLSYKLS | LVVDFLSYK | 0.4755 | 291 | WB | BclX(L) |
| DRB1_1501 | 159 | MQVLVSRIAAWMATY | LVSRIAAWM | 0.4693 | 312 | WB | BclX(L) |
| DRB1_1501 | 163 | VSRIAAWMATYLNDH | IAAWMATYL | 0.4691 | 312 | WB | BclX(L) |
| DRB1_1501 | 158 | EMQVLVSRIAAWMAT | VLVSRIAAW | 0.4683 | 315 | WB | BclX(L) |
| DRB1_1501 | 165 | RIAAWMATYLNDHLE | WMATYLNDH | 0.4685 | 315 | WB | BclX(L) |
| DRB1_1501 | 128 | NELFRDGVNWGRIVA | LFRDGVNWG | 0.4675 | 318 | WB | BclX(L) |
| DRB1_1501 | 125 | QVVNELFRDGVNWGR | LFRDGVNWG | 0.4668 | 320 | WB | BclX(L) |
| DRB1_1501 | 126 | VVNELFRDGVNWGRI | LFRDGVNWG | 0.4668 | 320 | WB | BclX(L) |
| DRB1_1501 | 166 | IAAWMATYLNDHLEP | WMATYLNDH | 0.4649 | 327 | WB | BclX(L) |
| DRB1_1501 | 137 | WGRIVAFFSFGGALC | IVAFFSFGG | 0.4643 | 329 | WB | BclX(L) |
| DRB1_1501 | 136 | NWGRIVAFFSFGGAL | IVAFFSFGG | 0.4638 | 331 | WB | BclX(L) |
| DRB1_1501 | 207 | QERFNRWFLTGMTVA | FNRWFLTGM | 0.4608 | 342 | WB | BclX(L) |
| DRB1_1501 | 208 | ERFNRWFLTGMTVAG | FNRWFLTGM | 0.4602 | 344 | WB | BclX(L) |
| DRB1_1501 | 138 | GRIVAFFSFGGALCV | IVAFFSFGG | 0.4587 | 350 | WB | BclX(L) |
| DRB1_1501 | 9 | VVDFLSYKLSQKGYS | FLSYKLSQK | 0.4584 | 351 | WB | BclX(L) |
| DRB1_1501 | 155 | VDKEMQVLVSRIAAW | MQVLVSRIA | 0.4570 | 356 | WB | BclX(L) |
| DRB1_1501 | 167 | AAWMATYLNDHLEPW | WMATYLNDH | 0.4551 | 364 | WB | BclX(L) |
| DRB1_1501 | 3 | QSNRELVVDFLSYKL | LVVDFLSYK | 0.4543 | 367 | WB | BclX(L) |
| DRB1_1501 | 127 | VNELFRDGVNWGRIV | LFRDGVNWG | 0.4431 | 414 | WB | BclX(L) |
| DRB1_1501 | 134 | GVNWGRIVAFFSFGG | VNWGRIVAF | 0.4391 | 432 | WB | BclX(L) |
| DRB1_1501 | 129 | ELFRDGVNWGRIVAF | LFRDGVNWG | 0.4390 | 433 | WB | BclX(L) |
| DRB1_1501 | 217 | GMTVAGVVLLGSLFS | VAGVVLLGS | 0.4377 | 439 | WB | BclX(L) |
| DRB1_1501 | 124 | EQVVNELFRDGVNWG | VVNELFRDG | 0.4373 | 441 | WB | BclX(L) |

Fig. 27 continued

| | | | | | | | |
|---|---|---|---|---|---|---|---|
| DRB1_1501 | 139 | RIVAFFSFGGALCVE | IVAFFSFGG | 0.4300 | 477 | WB | BclX(L) |
| DRB1_1501 | 211 | NRWFLTGMTVAGVVL | LTGMTVAGV | 0.4264 | 496 | WB | BclX(L) |
| DRB4_0101 | 99 | LRYRRAFSDLTSQLH | YRRAFSDLT | 0.4654 | 325 | WB | BclX(L) |
| DRB4_0101 | 100 | RYRRAFSDLTSQLHI | FSDLTSQLH | 0.4328 | 463 | WB | BclX(L) |

Fig. 27 continued

FIGURE 28

| Antigen designation | Amino acid sequence | SEQ ID NO |
|---|---|---|
| 1) Rv0116c | 8 mers:<br>MRRVVRYL; RRVVRYLS; RVVRYLSV; VVRYLSVV; VRYLSVVV; RYLSVVVA; YLSVVVAI; LSVVVAIT; SVVVAITL; VVVAITLM; VVAITLML; VAITLMLT; AITLMLTA; ITLMLTAE; TLMLTAES; LMLTAESV; MLTAESVS; LTAESVSI; TAESVSIA; AESVSIAT; ESVSIATA; SVSIATAA; VSIATAAV; SIATAAVP; IATAAVPP; ATAAVPPL; TAAVPPLQ; AAVPPLQP; AVPPLQPI; VPPLQPIP; PPLQPIPG; PLQPIPGV; LQPIPGVA; QPIPGVAS; PIPGVASV; IPGVASVS; PGVASVSP; GVASVSPA; VASVSPAN; ASVSPANG; SVSPANGA; VSPANGAV; SPANGAVV; PANGAVVG; ANGAVVGV; NGAVVGVA; GAVVGVAH; AVVGVAHP; VVGVAHPV; VGVAHPVV; GVAHPVVV; VAHPVVVT; AHPVVVTF; HPVVVTFT; PVVVTFTT; VVVTFTTP; VVTFTTPV; VTFTTPVT; TFTTPVTD; FTTPVTDR; TTPVTDRR; TPVTDRRA; PVTDRRAV; VTDRRAVE; TDRRAVER; DRRAVERS; RRAVERSI; RAVERSIR; AVERSIRI; VERSIRIS; ERSIRIST; RSIRISTP; SIRISTPH; IRISTPHN; RISTPHNT; ISTPHNTT; STPHNTTG; TPHNTTGH; PHNTTGHF; HNTTGHFE; NTTGHFEW; TTGHFEWV; TGHFEWVA; GHFEWVAS; HFEWVASN; FEWVASNV; EWVASNVV; WVASNVVR; VASNVVRW; ASNVVRWV; SNVVRWVP; NVVRWVPH; VVRWVPHR; VRWVPHRY; RWVPHRYW; WVPHRYWP; VPHRYWPP; PHRYWPPH; HRYWPPHT; RYWPPHTR; YWPPHTRV; WPPHTRVS; PPHTRVSV; PHTRVSVG; HTRVSVGV; TRVSVGVQ; RVSVGVQE; VSVGVQEL; SVGVQELT; VGVQELTE; GVQELTEG; VQELTEGF; QELTEGFE; ELTEGFET; LTEGFETG; TEGFETGD; EGFETGDA; GFETGDAL; FETGDALI; ETGDALIG; TGDALIGV; GDALIGVA; DALIGVAS; ALIGVASI; LIGVASIS; IGVASISA; GVASISAH; VASISAHT; ASISAHTF; SISAHTFT; ISAHTFTV; SAHTFTVS; AHTFTVSR; HTFTVSRN; TFTVSRNG; FTVSRNGE; TVSRNGEV; VSRNGEVL; SRNGEVLR; RNGEVLRT; NGEVLRTM; GEVLRTMP; EVLRTMPA; VLRTMPAS; LRTMPASL; RTMPASLG; TMPASLGK; MPASLGKP; PASLGKPS; ASLGKPSR; SLGKPSRP; LGKPSRPT; GKPSRPTP; KPSRPTPI; PSRPTPIG; SRPTPIGS; RPTPIGSF; PTPIGSFH; TPIGSFHA; PIGSFHAM; IGSFHAMS; GSFHAMSK; SFHAMSKE; FHAMSKER; HAMSKERT; AMSKERTV; MSKERTVV; SKERTVVM; KERTVVMD; ERTVVMDS; RTVVMDSR; TVVMDSRT; VVMDSRTI; VMDSRTIG; MDSRTIGI; DSRTIGIP; SRTIGIPL; RTIGIPLN; TIGIPLNS; IGIPLNSS; GIPLNSSD; IPLNSSDG; PLNSSDGY; LNSSDGYL; NSSDGYLL; SSDGYLLT; SDGYLLTA; DGYLLTAH; GYLLTAHY; YLLTAHYA; LLTAHYAV; LTAHYAVR; TAHYAVRV; AHYAVRVT; HYAVRVTW; YAVRVTWS; AVRVTWSG; VRVTWSGV; RVTWSGVY; VTWSGVYV; TWSGVYVH; WSGVYVHS; SGVYVHSA; GVYVHSAP; VYVHSAPW; YVHSAPWS; VHSAPWSV; HSAPWSVN; SAPWSVNS; APWSVNSQ; PWSVNSQG; WSVNSQGY; SVNSQGYA; VNSQGYAN; NSQGYANV; SQGYANVS; QGYANVSH; GYANVSHG; YANVSHGC; ANVSHGCI; NVSHGCIN; VSHGCINL; SHGCINLS; HGCINLSP; GCINLSPD; CINLSPDN; INLSPDNA; NLSPDNAA; LSPDNAAW; SPDNAAWY; PDNAAWYF; DNAAWYFD; NAAWYFDA; AAWYFDAV; AWYFDAVT; WYFDAVTV; YFDAVTVG; | 83-1052 |

| | | |
|---|---|---|
| | FDAVTVGD; DAVTVGDP; AVTVGDPI; VTVGDPIE; TVGDPIEV; VGDPIEVV; GDPIEVVG<br><br>9 mers:<br>MRRVVRYLS; RRVVRYLSV; RVVRYLSVV; VVRYLSVVV; VRYLSVVVA; RYLSVVVAI; YLSVVVAIT; LSVVVAITL; SVVVAITLM; VVVAITLML; VVAITLMLT; VAITLMLTA; AITLMLTAE; ITLMLTAES; TLMLTAESV; LMLTAESVS; MLTAESVSI; LTAESVSIA; TAESVSIAT; AESVSIATA; ESVSIATAA; SVSIATAAV; VSIATAAVP; SIATAAVPP; IATAAVPPL; ATAAVPPLQ; TAAVPPLQP; AAVPPLQPI; AVPPLQPIP; VPPLQPIPG; PPLQPIPGV; PLQPIPGVA; LQPIPGVAS; QPIPGVASV; PIPGVASVS; IPGVASVSP; PGVASVSPA; GVASVSPAN; VASVSPANG; ASVSPANGA; SVSPANGAV; VSPANGAVV; SPANGAVVG; PANGAVVGV; ANGAVVGVA; NGAVVGVAH; GAVVGVAHP; AVVGVAHPV; VVGVAHPVV; VGVAHPVVV; GVAHPVVVT; VAHPVVVTF; AHPVVVTFT; HPVVVTFTT; PVVVTFTTP; VVVTFTTPV; VVTFTTPVT; VTFTTPVTD; TFTTPVTDR; FTTPVTDRR; TTPVTDRRA; TPVTDRRAV; PVTDRRAVE; VTDRRAVER; TDRRAVERS; DRRAVERSI; RRAVERSIR; RAVERSIRI; AVERSIRIS; VERSIRIST; ERSIRISTP; RSIRISTPH; SIRISTPHN; IRISTPHNT; RISTPHNTT; ISTPHNTTG; STPHNTTGH; TPHNTTGHF; PHNTTGHFE; HNTTGHFEW; NTTGHFEWV; TTGHFEWVA; TGHFEWVAS; GHFEWVASN; HFEWVASNV; FEWVASNVV; EWVASNVVR; WVASNVVRW; VASNVVRWV; ASNVVRWVP; SNVVRWVPH; NVVRWVPHR; VVRWVPHRY; VRWVPHRYW; RWVPHRYWP; WVPHRYWPP; VPHRYWPPH; PHRYWPPHT; HRYWPPHTR; RYWPPHTRV; YWPPHTRVS; WPPHTRVSV; PPHTRVSVG; PHTRVSVGV; HTRVSVGVQ; TRVSVGVQE; RVSVGVQEL; VSVGVQELT; SVGVQELTE; VGVQELTEG; GVQELTEGF; VQELTEGFE; QELTEGFET; ELTEGFETG; LTEGFETGD; TEGFETGDA; EGFETGDAL; GFETGDALI; FETGDALIG; ETGDALIGV; TGDALIGVA; GDALIGVAS; DALIGVASI; ALIGVASIS; LIGVASISA; IGVASISAH; GVASISAHT; VASISAHTF; ASISAHTFT; SISAHTFTV; ISAHTFTVS; SAHTFTVSR; AHTFTVSRN; HTFTVSRNG; TFTVSRNGE; FTVSRNGEV; TVSRNGEVL; VSRNGEVLR; SRNGEVLRT; RNGEVLRTM; NGEVLRTMP; GEVLRTMPA; EVLRTMPAS; VLRTMPASL; LRTMPASLG; RTMPASLGK; TMPASLGKP; MPASLGKPS; PASLGKPSR; ASLGKPSRP; SLGKPSRPT; LGKPSRPTP; GKPSRPTPI; KPSRPTPIG; PSRPTPIGS; SRPTPIGSF; RPTPIGSFH; PTPIGSFHA; TPIGSFHAM; PIGSFHAMS; IGSFHAMSK; GSFHAMSKE; SFHAMSKER; FHAMSKERT; HAMSKERTV; AMSKERTVV; MSKERTVVM; SKERTVVMD; KERTVVMDS; ERTVVMDSR; RTVVMDSRT; TVVMDSRTI; VVMDSRTIG; VMDSRTIGI; MDSRTIGIP; DSRTIGIPL; SRTIGIPLN; RTIGIPLNS; TIGIPLNSS; IGIPLNSSD; GIPLNSSDG; IPLNSSDGY; PLNSSDGYL; LNSSDGYLL; NSSDGYLLT; SSDGYLLTA; SDGYLLTAH; DGYLLTAHY; GYLLTAHYA; YLLTAHYAV; LLTAHYAVR; LTAHYAVRV; TAHYAVRVT; AHYAVRVTW; HYAVRVTWS; YAVRVTWSG; AVRVTWSGV; VRVTWSGVY; RVTWSGVYV; VTWSGVYVH; TWSGVYVHS; WSGVYVHSA; SGVYVHSAP; GVYVHSAPW; VYVHSAPWS; YVHSAPWSV; VHSAPWSVN; HSAPWSVNS; SAPWSVNSQ; APWSVNSQG; PWSVNSQGY; WSVNSQGYA; SVNSQGYAN; VNSQGYANV; NSQGYANVS; SQGYANVSH; QGYANVSHG; | |

Fig. 28 continued

| | | |
|---|---|---|
| | GYANVSHGC; YANVSHGCI; ANVSHGCIN; NVSHGCINL; VSHGCINLS; SHGCINLSP; HGCINLSPD; GCINLSPDN; CINLSPDNA; INLSPDNAA; NLSPDNAAW; LSPDNAAWY; SPDNAAWYF; PDNAAWYFD; DNAAWYFDA; NAAWYFDAV; AAWYFDAVT; AWYFDAVTV; WYFDAVTVG; YFDAVTVGD; FDAVTVGDP; DAVTVGDPI; AVTVGDPIE; VTVGDPIEV; TVGDPIEVV; VGDPIEVVG<br><br>10 mers:<br>MRRVVRYLSV; RRVVRYLSVV; RVVRYLSVVV; VVRYLSVVVA; VRYLSVVVAI; RYLSVVVAIT; YLSVVVAITL; LSVVVAITLM; SVVVAITLML; VVVAITLMLT; VVAITLMLTA; VAITLMLTAE; AITLMLTAES; ITLMLTAESV; TLMLTAESVS; LMLTAESVSI; MLTAESVSIA; LTAESVSIAT; TAESVSIATA; AESVSIATAA; ESVSIATAAV; SVSIATAAVP; VSIATAAVPP; SIATAAVPPL; IATAAVPPLQ; ATAAVPPLQP; TAAVPPLQPI; AAVPPLQPIP; AVPPLQPIPG; VPPLQPIPGV; PPLQPIPGVA; PLQPIPGVAS; LQPIPGVASV; QPIPGVASVS; PIPGVASVSP; IPGVASVSPA; PGVASVSPAN; GVASVSPANG; VASVSPANGA; ASVSPANGAV; SVSPANGAVV; VSPANGAVVG; SPANGAVVGV; PANGAVVGVA; ANGAVVGVAH; NGAVVGVAHP; GAVVGVAHPV; AVVGVAHPVV; VVGVAHPVVV; VGVAHPVVVT; GVAHPVVVTF; VAHPVVVTFT; AHPVVVTFTT; HPVVVTFTTP; PVVVTFTTPV; VVVTFTTPVT; VVTFTTPVTD; VTFTTPVTDR; TFTTPVTDRR; FTTPVTDRRA; TTPVTDRRAV; TPVTDRRAVE; PVTDRRAVER; VTDRRAVERS; TDRRAVERSI; DRRAVERSIR; RRAVERSIRI; RAVERSIRIS; AVERSIRIST; VERSIRISTP; ERSIRISTPH; RSIRISTPHN; SIRISTPHNT; IRISTPHNTT; RISTPHNTTG; ISTPHNTTGH; STPHNTTGHF; TPHNTTGHFE; PHNTTGHFEW; HNTTGHFEWV; NTTGHFEWVA; TTGHFEWVAS; TGHFEWVASN; GHFEWVASNV; HFEWVASNVV; FEWVASNVVR; EWVASNVVRW; WVASNVVRWV; VASNVVRWVP; ASNVVRWVPH; SNVVRWVPHR; NVVRWVPHRY; VVRWVPHRYW; VRWVPHRYWP; RWVPHRYWPP; WVPHRYWPPH; VPHRYWPPHT; PHRYWPPHTR; HRYWPPHTRV; RYWPPHTRVS; YWPPHTRVSV; WPPHTRVSVG; PPHTRVSVGV; PHTRVSVGVQ; HTRVSVGVQE; TRVSVGVQEL; RVSVGVQELT; VSVGVQELTE; SVGVQELTEG; VGVQELTEGF; GVQELTEGFE; VQELTEGFET; QELTEGFETG; ELTEGFETGD; LTEGFETGDA; TEGFETGDAL; EGFETGDALI; GFETGDALIG; FETGDALIGV; ETGDALIGVA; TGDALIGVAS; GDALIGVASI; DALIGVASIS; ALIGVASISA; LIGVASISAH; IGVASISAHT; GVASISAHTF; VASISAHTFT; ASISAHTFTV; SISAHTFTVS; ISAHTFTVSR; SAHTFTVSRN; AHTFTVSRNG; HTFTVSRNGE; TFTVSRNGEV; FTVSRNGEVL; TVSRNGEVLR; VSRNGEVLRT; SRNGEVLRTM; RNGEVLRTMP; NGEVLRTMPA; GEVLRTMPAS; EVLRTMPASL; VLRTMPASLG; LRTMPASLGK; RTMPASLGKP; TMPASLGKPS; MPASLGKPSR; PASLGKPSRP; ASLGKPSRPT; SLGKPSRPTP; LGKPSRPTPI; GKPSRPTPIG; KPSRPTPIGS; PSRPTPIGSF; SRPTPIGSFH; RPTPIGSFHA; PTPIGSFHAM; TPIGSFHAMS; PIGSFHAMSK; IGSFHAMSKE; GSFHAMSKER; SFHAMSKERT; FHAMSKERTV; HAMSKERTVV; AMSKERTVVM; MSKERTVVMD; SKERTVVMDS; KERTVVMDSR; ERTVVMDSRT; RTVVMDSRTI; TVVMDSRTIG; VVMDSRTIGI; VMDSRTIGIP; MDSRTIGIPL; DSRTIGIPLN; SRTIGIPLNS; RTIGIPLNSS; TIGIPLNSSD; IGIPLNSSDG; | |

Fig. 28 continued

| | | |
|---|---|---|
| | GIPLNSSDGY; IPLNSSDGYL; PLNSSDGYLL; LNSSDGYLLT; NSSDGYLLTA; SSDGYLLTAH; SDGYLLTAHY; DGYLLTAHYA; GYLLTAHYAV; YLLTAHYAVR; LLTAHYAVRV; LTAHYAVRVT; TAHYAVRVTW; AHYAVRVTWS; HYAVRVTWSG; YAVRVTWSGV; AVRVTWSGVY; VRVTWSGVYV; RVTWSGVYVH; VTWSGVYVHS; TWSGVYVHSA; WSGVYVHSAP; SGVYVHSAPW; GVYVHSAPWS; VYVHSAPWSV; YVHSAPWSVN; VHSAPWSVNS; HSAPWSVNSQ; SAPWSVNSQG; APWSVNSQGY; PWSVNSQGYA; WSVNSQGYAN; SVNSQGYANV; VNSQGYANVS; NSQGYANVSH; SQGYANVSHG; QGYANVSHGC; GYANVSHGCI; YANVSHGCIN; ANVSHGCINL; NVSHGCINLS; VSHGCINLSP; SHGCINLSPD; HGCINLSPDN; GCINLSPDNA; CINLSPDNAA; INLSPDNAAW; NLSPDNAAWY; LSPDNAAWYF; SPDNAAWYFD; PDNAAWYFDA; DNAAWYFDAV; NAAWYFDAVT; AAWYFDAVTV; AWYFDAVTVG; WYFDAVTVGD; YFDAVTVGDP; FDAVTVGDPI; DAVTVGDPIE; AVTVGDPIEV; VTVGDPIEVV; TVGDPIEVVG<br><br>11 mers:<br>MRRVVRYLSVV; RRVVRYLSVVV; RVVRYLSVVVA; VVRYLSVVVAI; VRYLSVVVAIT; RYLSVVVAITL; YLSVVVAITLM; LSVVVAITLML; SVVVAITLMLT; VVVAITLMLTA; VVAITLMLTAE; VAITLMLTAES; AITLMLTAESV; ITLMLTAESVS; TLMLTAESVSI; LMLTAESVSIA; MLTAESVSIAT; LTAESVSIATA; TAESVSIATAA; AESVSIATAAV; ESVSIATAAVP; SVSIATAAVPP; VSIATAAVPPL; SIATAAVPPLQ; IATAAVPPLQP; ATAAVPPLQPI; TAAVPPLQPIP; AAVPPLQPIPG; AVPPLQPIPGV; VPPLQPIPGVA; PPLQPIPGVAS; PLQPIPGVASV; LQPIPGVASVS; QPIPGVASVSP; PIPGVASVSPA; IPGVASVSPAN; PGVASVSPANG; GVASVSPANGA; VASVSPANGAV; ASVSPANGAVV; SVSPANGAVVG; VSPANGAVVGV; SPANGAVVGVA; PANGAVVGVAH; ANGAVVGVAHP; NGAVVGVAHPV; GAVVGVAHPVV; AVVGVAHPVVV; VVGVAHPVVVT; VGVAHPVVVTF; GVAHPVVVTFT; VAHPVVVTFTT; AHPVVVTFTTP; HPVVVTFTTPV; PVVVTFTTPVT; VVVTFTTPVTD; VVTFTTPVTDR; VTFTTPVTDRR; TFTTPVTDRRA; FTTPVTDRRAV; TTPVTDRRAVE; TPVTDRRAVER; PVTDRRAVERS; VTDRRAVERSI; TDRRAVERSIR; DRRAVERSIRI; RRAVERSIRIS; RAVERSIRIST; AVERSIRISTP; VERSIRISTPH; ERSIRISTPHN; RSIRISTPHNT; SIRISTPHNTT; IRISTPHNTTG; RISTPHNTTGH; ISTPHNTTGHF; STPHNTTGHFE; TPHNTTGHFEW; PHNTTGHFEWV; HNTTGHFEWVA; NTTGHFEWVAS; TTGHFEWVASN; TGHFEWVASNV; GHFEWVASNVV; HFEWVASNVVR; FEWVASNVVRW; EWVASNVVRWV; WVASNVVRWVP; VASNVVRWVPH; ASNVVRWVPHR; SNVVRWVPHRY; NVVRWVPHRYW; VVRWVPHRYWP; VRWVPHRYWPP; RWVPHRYWPPH; WVPHRYWPPHT; VPHRYWPPHTR; PHRYWPPHTRV; HRYWPPHTRVS; RYWPPHTRVSV; YWPPHTRVSVG; WPPHTRVSVGV; PPHTRVSVGVQ; PHTRVSVGVQE; HTRVSVGVQEL; TRVSVGVQELT; RVSVGVQELTE; VSVGVQELTEG; SVGVQELTEGF; VGVQELTEGFE; GVQELTEGFET; VQELTEGFETG; QELTEGFETGD; ELTEGFETGDA; LTEGFETGDAL; TEGFETGDALI; EGFETGDALIG; GFETGDALIGV; FETGDALIGVA; ETGDALIGVAS; TGDALIGVASI; GDALIGVASIS; DALIGVASISA; ALIGVASISAH; LIGVASISAHT; IGVASISAHTF; GVASISAHTFT; VASISAHTFTV; ASISAHTFTVS; SISAHTFTVSR; | |

Fig. 28 continued

| | | |
|---|---|---|
| | ISAHTFTVSRN; SAHTFTVSRNG; AHTFTVSRNGE; HTFTVSRNGEV; TFTVSRNGEVL; FTVSRNGEVLR; TVSRNGEVLRT; VSRNGEVLRTM; SRNGEVLRTMP; RNGEVLRTMPA; NGEVLRTMPAS; GEVLRTMPASL; EVLRTMPASLG; VLRTMPASLGK; LRTMPASLGKP; RTMPASLGKPS; TMPASLGKPSR; MPASLGKPSRP; PASLGKPSRPT; ASLGKPSRPTP; SLGKPSRPTPI; LGKPSRPTPIG; GKPSRPTPIGS; KPSRPTPIGSF; PSRPTPIGSFH; SRPTPIGSFHA; RPTPIGSFHAM; PTPIGSFHAMS; TPIGSFHAMSK; PIGSFHAMSKE; IGSFHAMSKER; GSFHAMSKERT; SFHAMSKERTV; FHAMSKERTVV; HAMSKERTVVM; AMSKERTVVMD; MSKERTVVMDS; SKERTVVMDSR; KERTVVMDSRT; ERTVVMDSRTI; RTVVMDSRTIG; TVVMDSRTIGI; VVMDSRTIGIP; VMDSRTIGIPL; MDSRTIGIPLN; DSRTIGIPLNS; SRTIGIPLNSS; RTIGIPLNSSD; TIGIPLNSSDG; IGIPLNSSDGY; GIPLNSSDGYL; IPLNSSDGYLL; PLNSSDGYLLT; LNSSDGYLLTA; NSSDGYLLTAH; SSDGYLLTAHY; SDGYLLTAHYA; DGYLLTAHYAV; GYLLTAHYAVR; YLLTAHYAVRV; LLTAHYAVRVT; LTAHYAVRVTW; TAHYAVRVTWS; AHYAVRVTWSG; HYAVRVTWSGV; YAVRVTWSGVY; AVRVTWSGVYV; VRVTWSGVYVH; RVTWSGVYVHS; VTWSGVYVHSA; TWSGVYVHSAP; WSGVYVHSAPW; SGVYVHSAPWS; GVYVHSAPWSV; VYVHSAPWSVN; YVHSAPWSVNS; VHSAPWSVNSQ; HSAPWSVNSQG; SAPWSVNSQGY; APWSVNSQGYA; PWSVNSQGYAN; WSVNSQGYANV; SVNSQGYANVS; VNSQGYANVSH; NSQGYANVSHG; SQGYANVSHGC; QGYANVSHGCI; GYANVSHGCIN; YANVSHGCINL; ANVSHGCINLS; NVSHGCINLSP; VSHGCINLSPD; SHGCINLSPDN; HGCINLSPDNA; GCINLSPDNAA; CINLSPDNAAW; INLSPDNAAWY; NLSPDNAAWYF; LSPDNAAWYFD; SPDNAAWYFDA; PDNAAWYFDAV; DNAAWYFDAVT; NAAWYFDAVTV; AAWYFDAVTVG; AWYFDAVTVGD; WYFDAVTVGDP; YFDAVTVGDPI; FDAVTVGDPIE; DAVTVGDPIEV; AVTVGDPIEVV; VTVGDPIEVVG | |
| 2) Rv0122 | 8 mers:<br>MAGSVSAA; AGSVSAAA; GSVSAAAG; SVSAAAGI; VSAAAGIG; SAAAGIGW; AAAGIGWV; AAGIGWVG; AGIGWVGL; GIGWVGLN; IGWVGLNV; GWVGLNVT; WVGLNVTE; VGLNVTET; GLNVTETN; LNVTETNR; NVTETNRD; VTETNRDQ; TETNRDQC; ETNRDQCY; TNRDQCYR; NRDQCYRV; RDQCYRVE; DQCYRVER; QCYRVERT; CYRVERTT; YRVERTTV; RVERTTVD; VERTTVDA; ERTTVDAL; RTTVDALT; TTVDALTH; TVDALTHP; VDALTHPE; DALTHPEY; ALTHPEYR; LTHPEYRV; THPEYRVH; HPEYRVHT; PEYRVHTR; EYRVHTRG; YRVHTRGV; RVHTRGVQ; VHTRGVQR; HTRGVQRV; TRGVQRVR; RGVQRVRV; GVQRVRVT; VQRVRVTR; QRVRVTRN; RVRVTRNA; VRVTRNAR; RVTRNARK; VTRNARKH; TRNARKHR; RNARKHRV; NARKHRVS; ARKHRVSK; RKHRVSKH; KHRVSKHR; HRVSKHRI; RVSKHRIV; VSKHRIVA; SKHRIVAA; KHRIVAAM; HRIVAAMR; RIVAAMRH; IVAAMRHC; VAAMRHCG; AAMRHCGV; AMRHCGVP; MRHCGVPV; RHCGVPVI; HCGVPVIQ; CGVPVIQE; GVPVIQED; VPVIQEDG; PVIQEDGS; VIQEDGSL; IQEDGSLY; QEDGSLYY; EDGSLYYQ; DGSLYYQG; GSLYYQGR; SLYYQGRD; LYYQGRDT; YYQGRDTS; YQGRDTSG; QGRDTSGR; GRDTSGRL; RDTSGRLT; DTSGRLTE; TSGRLTEV; SGRLTEVV; GRLTEVVA; RLTEVVAV; LTEVVAVE; TEVVAVEA; EVVAVEAD; VVAVEADD; | 1053-1505 |

Fig. 28 continued

| | | |
|---|---|---|
| | VAVEADDG; AVEADDGD; VEADDGDL; EADDGDLI; ADDGDLII; DDGDLIIT; DGDLIITH; GDLIITHA; DLIITHAM; LIITHAMP; IITHAMPK; ITHAMPKE; THAMPKEW; HAMPKEWK; AMPKEWKR<br><br>9 mers:<br>MAGSVSAAA; AGSVSAAAG; GSVSAAAGI; SVSAAAGIG; VSAAAGIGW; SAAAGIGWV; AAAGIGWVG; AAGIGWVGL; AGIGWVGLN; GIGWVGLNV; IGWVGLNVT; GWVGLNVTE; WVGLNVTET; VGLNVTETN; GLNVTETNR; LNVTETNRD; NVTETNRDQ; VTETNRDQC; TETNRDQCY; ETNRDQCYR; TNRDQCYRV; NRDQCYRVE; RDQCYRVER; DQCYRVERT; QCYRVERTT; CYRVERTTV; YRVERTTVD; RVERTTVDA; VERTTVDAL; ERTTVDALT; RTTVDALTH; TTVDALTHP; TVDALTHPE; VDALTHPEY; DALTHPEYR; ALTHPEYRV; LTHPEYRVH; THPEYRVHT; HPEYRVHTR; PEYRVHTRG; EYRVHTRGV; YRVHTRGVQ; RVHTRGVQR; VHTRGVQRV; HTRGVQRVR; TRGVQRVRV; RGVQRVRVT; GVQRVRVTR; VQRVRVTRN; QRVRVTRNA; RVRVTRNAR; VRVTRNARK; RVTRNARKH; VTRNARKHR; TRNARKHRV; RNARKHRVS; NARKHRVSK; ARKHRVSKH; RKHRVSKHR; KHRVSKHRI; HRVSKHRIV; RVSKHRIVA; VSKHRIVAA; SKHRIVAAM; KHRIVAAMR; HRIVAAMRH; RIVAAMRHC; IVAAMRHCG; VAAMRHCGV; AAMRHCGVP; AMRHCGVPV; MRHCGVPVI; RHCGVPVIQ; HCGVPVIQE; CGVPVIQED; GVPVIQEDG; VPVIQEDGS; PVIQEDGSL; VIQEDGSLY; IQEDGSLYY; QEDGSLYYQ; EDGSLYYQG; DGSLYYQGR; GSLYYQGRD; SLYYQGRDT; LYYQGRDTS; YYQGRDTSG; YQGRDTSGR; QGRDTSGRL; GRDTSGRLT; RDTSGRLTE; DTSGRLTEV; TSGRLTEVV; SGRLTEVVA; GRLTEVVAV; RLTEVVAVE; LTEVVAVEA; TEVVAVEAD; EVVAVEADD; VVAVEADDG; VAVEADDGD; AVEADDGDL; VEADDGDLI; EADDGDLII; ADDGDLIIT; DDGDLIITH; DGDLIITHA; GDLIITHAM; DLIITHAMP; LIITHAMPK; IITHAMPKE; ITHAMPKEW; THAMPKEWK;<br><br>10 mers:<br>MAGSVSAAAG; AGSVSAAAGI; GSVSAAAGIG; SVSAAAGIGW; VSAAAGIGWV; SAAAGIGWVG; AAAGIGWVGL; AAGIGWVGLN; AGIGWVGLNV; GIGWVGLNVT; IGWVGLNVTE; GWVGLNVTET; WVGLNVTETN; VGLNVTETNR; GLNVTETNRD; LNVTETNRDQ; NVTETNRDQC; VTETNRDQCY; TETNRDQCYR; ETNRDQCYRV; TNRDQCYRVE; NRDQCYRVER; RDQCYRVERT; DQCYRVERTT; QCYRVERTTV; CYRVERTTVD; YRVERTTVDA; RVERTTVDAL; VERTTVDALT; ERTTVDALTH; RTTVDALTHP; TTVDALTHPE; TVDALTHPEY; VDALTHPEYR; DALTHPEYRV; ALTHPEYRVH; LTHPEYRVHT; THPEYRVHTR; HPEYRVHTRG; PEYRVHTRGV; EYRVHTRGVQ; YRVHTRGVQR; RVHTRGVQRV; VHTRGVQRVR; HTRGVQRVRV; TRGVQRVRVT; RGVQRVRVTR; GVQRVRVTRN; VQRVRVTRNA; QRVRVTRNAR; RVRVTRNARK; VRVTRNARKH; RVTRNARKHR; VTRNARKHRV; TRNARKHRVS; RNARKHRVSK; NARKHRVSKH; ARKHRVSKHR; RKHRVSKHRI; KHRVSKHRIV; HRVSKHRIVA; RVSKHRIVAA; VSKHRIVAAM; SKHRIVAAMR; KHRIVAAMRH; HRIVAAMRHC; RIVAAMRHCG; IVAAMRHCGV; VAAMRHCGVP; AAMRHCGVPV; AMRHCGVPVI; MRHCGVPVIQ; RHCGVPVIQE; HCGVPVIQED; CGVPVIQEDG; GVPVIQEDGS; | |

Fig. 28 continued

| | | |
|---|---|---|
| | VPVIQEDGSL; PVIQEDGSLY; VIQEDGSLYY; IQEDGSLYYQ; QEDGSLYYQG; EDGSLYYQGR; DGSLYYQGRD; GSLYYQGRDT; SLYYQGRDTS; LYYQGRDTSG; YYQGRDTSGR; YQGRDTSGRL; QGRDTSGRLT; GRDTSGRLTE; RDTSGRLTEV; DTSGRLTEVV; TSGRLTEVVA; SGRLTEVVAV; GRLTEVVAVE; RLTEVVAVEA; LTEVVAVEAD; TEVVAVEADD; EVVAVEADDG; VVAVEADDGD; VAVEADDGDL; AVEADDGDLI; VEADDGDLII; EADDGDLIIT; ADDGDLIITH; DDGDLIITHA; DGDLIITHAM; GDLIITHAMP; DLIITHAMPK; LIITHAMPKE; IITHAMPKEW; ITHAMPKEWK; THAMPKEWKR<br><br>11 mers:<br>MAGSVSAAAGI; AGSVSAAAGIG; GSVSAAAGIGW; SVSAAAGIGWV; VSAAAGIGWVG; SAAAGIGWVGL; AAAGIGWVGLN; AAGIGWVGLNV; AGIGWVGLNVT; GIGWVGLNVTE; IGWVGLNVTET; GWVGLNVTETN; WVGLNVTETNR; VGLNVTETNRD; GLNVTETNRDQ; LNVTETNRDQC; NVTETNRDQCY; VTETNRDQCYR; TETNRDQCYRV; ETNRDQCYRVE; TNRDQCYRVER; NRDQCYRVERT; RDQCYRVERTT; DQCYRVERTTV; QCYRVERTTVD; CYRVERTTVDA; YRVERTTVDAL; RVERTTVDALT; VERTTVDALTH; ERTTVDALTHP; RTTVDALTHPE; TTVDALTHPEY; TVDALTHPEYR; VDALTHPEYRV; DALTHPEYRVH; ALTHPEYRVHT; LTHPEYRVHTR; THPEYRVHTRG; HPEYRVHTRGV; PEYRVHTRGVQ; EYRVHTRGVQR; YRVHTRGVQRV; RVHTRGVQRVR; VHTRGVQRVRV; HTRGVQRVRVT; TRGVQRVRVTR; RGVQRVRVTRN; GVQRVRVTRNA; VQRVRVTRNAR; QRVRVTRNARK; RVRVTRNARKH; VRVTRNARKHR; RVTRNARKHRV; VTRNARKHRVS; TRNARKHRVSK; RNARKHRVSKH; NARKHRVSKHR; ARKHRVSKHRI; RKHRVSKHRIV; KHRVSKHRIVA; HRVSKHRIVAA; RVSKHRIVAAM; VSKHRIVAAMR; SKHRIVAAMRH; KHRIVAAMRHC; HRIVAAMRHCG; RIVAAMRHCGV; IVAAMRHCGVP; VAAMRHCGVPV; AAMRHCGVPVI; AMRHCGVPVIQ; MRHCGVPVIQE; RHCGVPVIQED; HCGVPVIQEDG; CGVPVIQEDGS; GVPVIQEDGSL; VPVIQEDGSLY; PVIQEDGSLYY; VIQEDGSLYYQ; IQEDGSLYYQG; QEDGSLYYQGR; EDGSLYYQGRD; DGSLYYQGRDT; GSLYYQGRDTS; SLYYQGRDTSG; LYYQGRDTSGR; YYQGRDTSGRL; YQGRDTSGRLT; QGRDTSGRLTE; GRDTSGRLTEV; RDTSGRLTEVV; DTSGRLTEVVA; TSGRLTEVVAV; SGRLTEVVAVE; GRLTEVVAVEA; RLTEVVAVEAD; LTEVVAVEADD; TEVVAVEADDG; EVVAVEADDGD; VVAVEADDGDL; VAVEADDGDLI; AVEADDGDLII; VEADDGDLIIT; EADDGDLIITH; ADDGDLIITHA; DDGDLIITHAM; DGDLIITHAMP; GDLIITHAMPK; DLIITHAMPKE; LIITHAMPKEW; IITHAMPKEWK; ITHAMPKEWKR | |
| 3) Rv0188 | 8 mers:<br>MSTVHSSI; STVHSSID; TVHSSIDQ; VHSSIDQH; HSSIDQHP; SSIDQHPD; SIDQHPDL; IDQHPDLL; DQHPDLLA; QHPDLLAL; HPDLLALR; PDLLALRA; DLLALRAS; LLALRASF; LALRASFD; ALRASFDR; LRASFDRA; RASFDRAA; ASFDRAAE; SFDRAAES; FDRAAEST; DRAAESTI; RAAESTIA; AAESTIAH; AESTIAHF; ESTIAHFT; STIAHFTF; TIAHFTFG; IAHFTFGL; AHFTFGLA; HFTFGLAL; FTFGLALL; TFGLALLA; FGLALLAG; GLALLAGL; LALLAGLY; ALLAGLYV; LLAGLYVA; LAGLYVAA; AGLYVAAS; | 1506-2042 |

Fig. 28 continued

| | | | |
|---|---|---|---|
| | GLYVAASP; LYVAASPW; YVAASPWI; VAASPWIV; AASPWIVG; ASPWIVGF; SPWIVGFS; PWIVGFSA; WIVGFSAT; IVGFSATR; VGFSATRG; GFSATRGL; FSATRGLP; SATRGLPT; ATRGLPTC; TRGLPTCD; RGLPTCDL; GLPTCDLI; LPTCDLIV; PTCDLIVG; TCDLIVGI; CDLIVGIA; DLIVGIAV; LIVGIAVA; IVGIAVAY; VGIAVAYL; GIAVAYLA; IAVAYLAY; AVAYLAYG; VAYLAYGF; AYLAYGFA; YLAYGFAS; LAYGFASA; AYGFASAL; YGFASALD; GFASALDR; FASALDRT; ASALDRTH; SALDRTHG; ALDRTHGM; LDRTHGMT; DRTHGMTW; RTHGMTWT; THGMTWTL; HGMTWTLP; GMTWTLPV; MTWTLPVL; TWTLPVLG; WTLPVLGV; TLPVLGVW; LPVLGVWV; PVLGVWVI; VLGVWVIF; LGVWVIFS; GVWVIFSP; VWVIFSPW; WVIFSPWV; VIFSPWVL; IFSPWVLP; FSPWVLPG; SPWVLPGV; PWVLPGVA; WVLPGVAV; VLPGVAVT; LPGVAVTA; PGVAVTAG; GVAVTAGM; VAVTAGMM; AVTAGMMW; VTAGMMWS; TAGMMWSH; AGMMWSHI; GMMWSHII; MMWSHIIA; MWSHIIAG; WSHIIAGA; SHIIAGAV; HIIAGAVV; IIAGAVVA; IAGAVVAV; AGAVVAVL; GAVVAVLG; AVVAVLGF; VVAVLGFY; VAVLGFYF; AVLGFYFG; VLGFYFGM; LGFYFGMR; GFYFGMRT; FYFGMRTR; YFGMRTRA; FGMRTRAA; GMRTRAAA; MRTRAAAN; RTRAAANQ<br><br>9 mers:<br>MSTVHSSID; STVHSSIDQ; TVHSSIDQH; VHSSIDQHP; HSSIDQHPD; SSIDQHPDL; SIDQHPDLL; IDQHPDLLA; DQHPDLLAL; QHPDLLALR; HPDLLALRA; PDLLALRAS; DLLALRASF; LLALRASFD; LALRASFDR; ALRASFDRA; LRASFDRAA; RASFDRAAE; ASFDRAAES; SFDRAAEST; FDRAAESTI; DRAAESTIA; RAAESTIAH; AAESTIAHF; AESTIAHFT; ESTIAHFTF; STIAHFTFG; TIAHFTFGL; IAHFTFGLA; AHFTFGLAL; HFTFGLALL; FTFGLALLA; TFGLALLAG; FGLALLAGL; GLALLAGLY; LALLAGLYV; ALLAGLYVA; LLAGLYVAA; LAGLYVAAS; AGLYVAASP; GLYVAASPW; LYVAASPWI; YVAASPWIV; VAASPWIVG; AASPWIVGF; ASPWIVGFS; SPWIVGFSA; PWIVGFSAT; WIVGFSATR; IVGFSATRG; VGFSATRGL; GFSATRGLP; FSATRGLPT; SATRGLPTC; ATRGLPTCD; TRGLPTCDL; RGLPTCDLI; GLPTCDLIV; LPTCDLIVG; PTCDLIVGI; TCDLIVGIA; CDLIVGIAV; DLIVGIAVA; LIVGIAVAY; IVGIAVAYL; VGIAVAYLA; GIAVAYLAY; IAVAYLAYG; AVAYLAYGF; VAYLAYGFA; AYLAYGFAS; YLAYGFASA; LAYGFASAL; AYGFASALD; YGFASALDR; GFASALDRT; FASALDRTH; ASALDRTHG; SALDRTHGM; ALDRTHGMT; LDRTHGMTW; DRTHGMTWT; RTHGMTWTL; THGMTWTLP; HGMTWTLPV; GMTWTLPVL; MTWTLPVLG; TWTLPVLGV; WTLPVLGVW; TLPVLGVWV; LPVLGVWVI; PVLGVWVIF; VLGVWVIFS; LGVWVIFSP; GVWVIFSPW; VWVIFSPWV; WVIFSPWVL; VIFSPWVLP; IFSPWVLPG; FSPWVLPGV; SPWVLPGVA; PWVLPGVAV; WVLPGVAVT; VLPGVAVTA; LPGVAVTAG; PGVAVTAGM; GVAVTAGMM; VAVTAGMMW; AVTAGMMWS; VTAGMMWSH; TAGMMWSHI; AGMMWSHII; GMMWSHIIA; MMWSHIIAG; MWSHIIAGA; WSHIIAGAV; SHIIAGAVV; HIIAGAVVA; IIAGAVVAV; IAGAVVAVL; AGAVVAVLG; GAVVAVLGF; AVVAVLGFY; VVAVLGFYF; VAVLGFYFG; AVLGFYFGM; VLGFYFGMR; LGFYFGMRT; GFYFGMRTR; FYFGMRTRA; YFGMRTRAA; FGMRTRAAA; GMRTRAAAN; MRTRAAANQ; RTRAAANQG | | |

Fig. 28 continued

| | | |
|---|---|---|
| | 10 mers:<br>MSTVHSSIDQ; STVHSSIDQH; TVHSSIDQHP; VHSSIDQHPD; HSSIDQHPDL; SSIDQHPDLL; SIDQHPDLLA; IDQHPDLLAL; DQHPDLLALR; QHPDLLALRA; HPDLLALRAS; PDLLALRASF; DLLALRASFD; LLALRASFDR; LALRASFDRA; ALRASFDRAA; LRASFDRAAE; RASFDRAAES; ASFDRAAEST; SFDRAAESTI; FDRAAESTIA; DRAAESTIAH; RAAESTIAHF; AAESTIAHFT; AESTIAHFTF; ESTIAHFTFG; STIAHFTFGL; TIAHFTFGLA; IAHFTFGLAL; AHFTFGLALL; HFTFGLALLA; FTFGLALLAG; TFGLALLAGL; FGLALLAGLY; GLALLAGLYV; LALLAGLYVA; ALLAGLYVAA; LLAGLYVAAS; LAGLYVAASP; AGLYVAASPW; GLYVAASPWI; LYVAASPWIV; YVAASPWIVG; VAASPWIVGF; AASPWIVGFS; ASPWIVGFSA; SPWIVGFSAT; PWIVGFSATR; WIVGFSATRG; IVGFSATRGL; VGFSATRGLP; GFSATRGLPT; FSATRGLPTC; SATRGLPTCD; ATRGLPTCDL; TRGLPTCDLI; RGLPTCDLIV; GLPTCDLIVG; LPTCDLIVGI; PTCDLIVGIA; TCDLIVGIAV; CDLIVGIAVA; DLIVGIAVAY; LIVGIAVAYL; IVGIAVAYLA; VGIAVAYLAY; GIAVAYLAYG; IAVAYLAYGF; AVAYLAYGFA; VAYLAYGFAS; AYLAYGFASA; YLAYGFASAL; LAYGFASALD; AYGFASALDR; YGFASALDRT; GFASALDRTH; FASALDRTHG; ASALDRTHGM; SALDRTHGMT; ALDRTHGMTW; LDRTHGMTWT; DRTHGMTWTL; RTHGMTWTLP; THGMTWTLPV; HGMTWTLPVL; GMTWTLPVLG; MTWTLPVLGV; TWTLPVLGVW; WTLPVLGVWV; TLPVLGVWVI; LPVLGVWVIF; PVLGVWVIFS; VLGVWVIFSP; LGVWVIFSPW; GVWVIFSPWV; VWVIFSPWVL; WVIFSPWVLP; VIFSPWVLPG; IFSPWVLPGV; FSPWVLPGVA; SPWVLPGVAV; PWVLPGVAVT; WVLPGVAVTA; VLPGVAVTAG; LPGVAVTAGM; PGVAVTAGMM; GVAVTAGMMW; VAVTAGMMWS; AVTAGMMWSH; VTAGMMWSHI; TAGMMWSHII; AGMMWSHIIA; GMMWSHIIAG; MMWSHIIAGA; MWSHIIAGAV; WSHIIAGAVV; SHIIAGAVVA; HIIAGAVVAV; IIAGAVVAVL; IAGAVVAVLG; AGAVVAVLGF; GAVVAVLGFY; AVVAVLGFYF; VVAVLGFYFG; VAVLGFYFGM; AVLGFYFGMR; VLGFYFGMRT; LGFYFGMRTR; GFYFGMRTRA; FYFGMRTRAA; YFGMRTRAAA; FGMRTRAAAN; GMRTRAAANQ; MRTRAAANQG<br><br>11 mers:<br>MSTVHSSIDQH; STVHSSIDQHP; TVHSSIDQHPD; VHSSIDQHPDL; HSSIDQHPDLL; SSIDQHPDLLA; SIDQHPDLLAL; IDQHPDLLALR; DQHPDLLALRA; QHPDLLALRAS; HPDLLALRASF; PDLLALRASFD; DLLALRASFDR; LLALRASFDRA; LALRASFDRAA; ALRASFDRAAE; LRASFDRAAES; RASFDRAAEST; ASFDRAAESTI; SFDRAAESTIA; FDRAAESTIAH; DRAAESTIAHF; RAAESTIAHFT; AAESTIAHFTF; AESTIAHFTFG; ESTIAHFTFGL; STIAHFTFGLA; TIAHFTFGLAL; IAHFTFGLALL; AHFTFGLALLA; HFTFGLALLAG; FTFGLALLAGL; TFGLALLAGLY; FGLALLAGLYV; GLALLAGLYVA; LALLAGLYVAA; ALLAGLYVAAS; LLAGLYVAASP; LAGLYVAASPW; AGLYVAASPWI; GLYVAASPWIV; LYVAASPWIVG; YVAASPWIVGF; VAASPWIVGFS; AASPWIVGFSA; ASPWIVGFSAT; SPWIVGFSATR; PWIVGFSATRG; WIVGFSATRGL; IVGFSATRGLP; VGFSATRGLPT; GFSATRGLPTC; FSATRGLPTCD; SATRGLPTCDL; ATRGLPTCDLI; TRGLPTCDLIV; RGLPTCDLIVG; GLPTCDLIVGI; LPTCDLIVGIA; PTCDLIVGIAV; TCDLIVGIAVA; CDLIVGIAVAY; DLIVGIAVAYL; LIVGIAVAYLA; | |

Fig. 28 continued

| | | |
|---|---|---|
| | IVGIAVAYLAY; VGIAVAYLAYG; GIAVAYLAYGF; IAVAYLAYGFA; AVAYLAYGFAS; VAYLAYGFASA; AYLAYGFASAL; YLAYGFASALD; LAYGFASALDR; AYGFASALDRT; YGFASALDRTH; GFASALDRTHG; FASALDRTHGM; ASALDRTHGMT; SALDRTHGMTW; ALDRTHGMTWT; LDRTHGMTWTL; DRTHGMTWTLP; RTHGMTWTLPV; THGMTWTLPVL; HGMTWTLPVLG; GMTWTLPVLGV; MTWTLPVLGVW; TWTLPVLGVWV; WTLPVLGVWVI; TLPVLGVWVIF; LPVLGVWVIFS; PVLGVWVIFSP; VLGVWVIFSPW; LGVWVIFSPWV; GVWVIFSPWVL; VWVIFSPWVLP; WVIFSPWVLPG; VIFSPWVLPGV; IFSPWVLPGVA; FSPWVLPGVAV; SPWVLPGVAVT; PWVLPGVAVTA; WVLPGVAVTAG; VLPGVAVTAGM; LPGVAVTAGMM; PGVAVTAGMMW; GVAVTAGMMWS; VAVTAGMMWSH; AVTAGMMWSHI; VTAGMMWSHII; TAGMMWSHIIA; AGMMWSHIIAG; GMMWSHIIAGA; MMWSHIIAGAV; MWSHIIAGAVV; WSHIIAGAVVA; SHIIAGAVVAV; HIIAGAVVAVL; IIAGAVVAVLG; IAGAVVAVLGF; AGAVVAVLGFY; GAVVAVLGFYF; AVVAVLGFYFG; VVAVLGFYFGM; VAVLGFYFGMR; AVLGFYFGMRT; VLGFYFGMRTR; LGFYFGMRTRA; GFYFGMRTRAA; FYFGMRTRAAA; YFGMRTRAAAN; FGMRTRAAANQ; GMRTRAAANQG | |
| 4) Rv0284 | 8 mers:<br>MSRLIFEA; SRLIFEAR; RLIFEARR; LIFEARRR; IFEARRRL; FEARRRLA; EARRRLAP; ARRRLAPP; RRRLAPPS; RRLAPPSS; RLAPPSSH; LAPPSSHQ; APPSSHQG; PPSSHQGT; PSSHQGTI; SSHQGTII; SHQGTIII; HQGTIIIE; QGTIIIEA; GTIIIEAP; TIIIEAPP; IIIEAPPE; IIEAPPEL; IEAPPELP; EAPPELPR; APPELPRV; PPELPRVI; PELPRVIP; ELPRVIPP; LPRVIPPS; PRVIPPSL; RVIPPSLL; VIPPSLLR; IPPSLLRR; PPSLLRRA; PSLLRRAL; SLLRRALP; LLRRALPY; LRRALPYL; RRALPYLI; RALPYLIG; ALPYLIGI; LPYLIGIL; PYLIGILI; YLIGILIV; LIGILIVG; IGILIVGM; GILIVGMI; ILIVGMIV; LIVGMIVA; IVGMIVAL; VGMIVALV; GMIVALVA; MIVALVAT; IVALVATG; VALVATGM; ALVATGMR; LVATGMRV; VATGMRVI; ATGMRVIS; TGMRVISP; GMRVISPQ; MRVISPQT; RVISPQTL; VISPQTLF; ISPQTLFF; SPQTLFFP; PQTLFFPF; QTLFFPFV; TLFFPFVL; LFFPFVLL; FFPFVLLL; FPFVLLLA; PFVLLLAA; FVLLLAAT; VLLLAATA; LLLAATAL; LLAATALY; LAATALYR; AATALYRG; ATALYRGN; TALYRGND; ALYRGNDK; LYRGNDKK; YRGNDKKM; RGNDKKMR; GNDKKMRT; NDKKMRTE; DKKMRTEE; KKMRTEEV; KMRTEEVD; MRTEEVDA; RTEEVDAE; TEEVDAER; EEVDAERA; EVDAERAD; VDAERADY; DAERADYL; AERADYLR; ERADYLRY; RADYLRYL; ADYLRYLS; DYLRYLSV; YLRYLSVV; LRYLSVVR; RYLSVVRD; YLSVVRDN; LSVVRDNI; SVVRDNIR; VVRDNIRA; VRDNIRAQ; RDNIRAQA; DNIRAQAA; NIRAQAAE; IRAQAAEQ; RAQAAEQR; AQAAEQRA; QAAEQRAS; AAEQRASA; AEQRASAL; EQRASALW; QRASALWS; RASALWSH; ASALWSHP; SALWSHPD; ALWSHPDP; LWSHPDPT; WSHPDPTA; SHPDPTAL; HPDPTALA; PDPTALAS; DPTALASV; PTALASVP; TALASVPG; ALASVPGS; LASVPGSR; ASVPGSRR; SVPGSRRQ; VPGSRRQW; PGSRRQWE; GSRRQWER; SRRQWERD; RRQWERDP; RQWERDPH; QWERDPHD; WERDPHDP; ERDPHDPD; RDPHDPDF; DPHDPDFL; PHDPDFLV; HDPDFLVL; DPDFLVLR; PDFLVLRA; DFLVLRAG; FLVLRAGR; LVLRAGRH; VLRAGRHT; LRAGRHTV; RAGRHTVP; | 2043-7328 |

Fig. 28 continued

| | | |
|---|---|---|
| | AGRHTVPL; GRHTVPLA; RHTVPLAT; HTVPLATT; TVPLATTL; VPLATTLR; PLATTLRV; LATTLRVN; ATTLRVND; TTLRVNDT; TLRVNDTA; LRVNDTAD; RVNDTADE; VNDTADEI; NDTADEID; DTADEIDL; TADEIDLE; ADEIDLEP; DEIDLEPV; EIDLEPVS; IDLEPVSH; DLEPVSHS; LEPVSHSA; EPVSHSAL; PVSHSALR; VSHSALRS; SHSALRSL; HSALRSLL; SALRSLLD; ALRSLLDT; LRSLLDTQ; RSLLDTQR; SLLDTQRS; LLDTQRSI; LDTQRSIG; DTQRSIGD; TQRSIGDV; QRSIGDVP; RSIGDVPT; SIGDVPTG; IGDVPTGI; GDVPTGID; DVPTGIDL; VPTGIDLT; PTGIDLTK; TGIDLTKV; GIDLTKVS; IDLTKVSP; DLTKVSPI; LTKVSPIT; TKVSPITV; KVSPITVL; VSPITVLG; SPITVLGE; PITVLGER; ITVLGERA; TVLGERAQ; VLGERAQV; LGERAQVR; GERAQVRA; ERAQVRAV; RAQVRAVL; AQVRAVLR; QVRAVLRA; VRAVLRAW; RAVLRAWI; AVLRAWIA; VLRAWIAQ; LRAWIAQA; RAWIAQAV; AWIAQAVT; WIAQAVTW; IAQAVTWH; AQAVTWHD; QAVTWHDP; AVTWHDPT; VTWHDPTV; TWHDPTVL; WHDPTVLG; HDPTVLGV; DPTVLGVA; PTVLGVAL; TVLGVALA; VLGVALAA; LGVALAAR; GVALAARD; VALAARDL; ALAARDLE; LAARDLEG; AARDLEGR; ARDLEGRD; RDLEGRDW; DLEGRDWN; LEGRDWNW; EGRDWNWL; GRDWNWLK; RDWNWLKW; DWNWLKWL; WNWLKWLP; NWLKWLPH; WLKWLPHV; LKWLPHVD; KWLPHVDI; WLPHVDIP; LPHVDIPG; PHVDIPGR; HVDIPGRL; VDIPGRLD; DIPGRLDA; IPGRLDAL; PGRLDALG; GRLDALGP; RLDALGPA; LDALGPAR; DALGPARN; ALGPARNL; LGPARNLS; GPARNLST; PARNLSTD; ARNLSTDP; RNLSTDPD; NLSTDPDE; LSTDPDEL; STDPDELI; TDPDELIA; DPDELIAL; PDELIALL; DELIALLG; ELIALLGP; LIALLGPV; IALLGPVL; ALLGPVLA; LLGPVLAD; LGPVLADR; GPVLADRP; PVLADRPA; VLADRPAF; LADRPAFT; ADRPAFTG; DRPAFTGQ; RPAFTGQP; PAFTGQPT; AFTGQPTD; FTGQPTDA; TGQPTDAL; GQPTDALR; QPTDALRH; PTDALRHL; TDALRHLL; DALRHLLI; ALRHLLIV; LRHLLIVV; RHLLIVVD; HLLIVVDD; LLIVVDDP; LIVVDDPD; IVVDDPDY; VVDDPDYD; VDDPDYDL; DDPDYDLG; DPDYDLGA; PDYDLGAS; DYDLGASP; YDLGASPL; DLGASPLA; LGASPLAV; GASPLAVG; ASPLAVGR; SPLAVGRA; PLAVGRAG; LAVGRAGV; AVGRAGVT; VGRAGVTV; GRAGVTVV; RAGVTVVH; AGVTVVHC; GVTVVHCS; VTVVHCSA; TVVHCSAS; VVHCSASA; VHCSASAP; HCSASAPH; CSASAPHR; SASAPHRE; ASAPHREQ; SAPHREQY; APHREQYS; PHREQYSD; HREQYSDP; REQYSDPE; EQYSDPEK; QYSDPEKP; YSDPEKPI; SDPEKPIL; DPEKPILR; PEKPILRV; EKPILRVA; KPILRVAH; PILRVAHG; ILRVAHGA; LRVAHGAI; RVAHGAIE; VAHGAIER; AHGAIERW; HGAIERWQ; GAIERWQT; AIERWQTG; IERWQTGG; ERWQTGGW; RWQTGGWQ; WQTGGWQP; QTGGWQPY; TGGWQPYI; GGWQPYID; GWQPYIDA; WQPYIDAA; QPYIDAAD; PYIDAADQ; YIDAADQF; IDAADQFS; DAADQFSA; AADQFSAD; ADQFSADE; DQFSADEA; QFSADEAA; FSADEAAH; SADEAAHL; ADEAAHLA; DEAAHLAR; EAAHLARR; AAHLARRL; AHLARRLS; HLARRLSR; LARRLSRW; ARRLSRWD; RRLSRWDS; RLSRWDSN; LSRWDSNP; SRWDSNPT; RWDSNPTH; WDSNPTHA; DSNPTHAG; SNPTHAGL; NPTHAGLR; PTHAGLRS; THAGLRSA; HAGLRSAA; AGLRSAAT; GLRSAATR; LRSAATRG; RSAATRGA; SAATRGAS; AATRGASF; ATRGASFT; TRGASFTT; RGASFTTL; GASFTTLL; ASFTTLLG; SFTTLLGI; FTTLLGIE; TTLLGIED; TLLGIEDA; LLGIEDAS; LGIEDASR; GIEDASRL; | |

Fig. 28 continued

| | | |
|---|---|---|
| | IEDASRLD; EDASRLDV; DASRLDVP; ASRLDVPA; SRLDVPAL; RLDVPALW; LDVPALWA; DVPALWAP; VPALWAPR; PALWAPRR; ALWAPRRR; LWAPRRRD; WAPRRRDE; APRRRDEE; PRRRDEEL; RRRDEELR; RRDEELRV; RDEELRVP; DEELRVPI; EELRVPIG; ELRVPIGV; LRVPIGVT; RVPIGVTG; VPIGVTGT; PIGVTGTG; IGVTGTGE; GVTGTGEP; VTGTGEPL; TGTGEPLM; GTGEPLMF; TGEPLMFD; GEPLMFDL; EPLMFDLK; PLMFDLKD; LMFDLKDE; MFDLKDEA; FDLKDEAE; DLKDEAEG; LKDEAEGG; KDEAEGGM; DEAEGGMG; EAEGGMGP; AEGGMGPH; EGGMGPHG; GGMGPHGL; GMGPHGLM; MGPHGLMI; GPHGLMIG; PHGLMIGM; HGLMIGMT; GLMIGMTG; LMIGMTGS; MIGMTGSG; IGMTGSGK; GMTGSGKS; MTGSGKSQ; TGSGKSQT; GSGKSQTL; SGKSQTLM; GKSQTLMS; KSQTLMSI; SQTLMSIL; QTLMSILL; TLMSILLS; LMSILLSL; MSILLSLL; SILLSLLT; ILLSLLTT; LLSLLTTH; LSLLTTHS; SLLTTHSA; LLTTHSAE; LTTHSAER; TTHSAERL; THSAERLI; HSAERLIV; SAERLIVI; AERLIVIY; ERLIVIYA; RLIVIYAD; LIVIYADF; IVIYADFK; VIYADFKG; IYADFKGE; YADFKGEA; ADFKGEAG; DFKGEAGA; FKGEAGAD; KGEAGADS; GEAGADSF; EAGADSFR; AGADSFRD; GADSFRDF; ADSFRDFP; DSFRDFPQ; SFRDFPQV; FRDFPQVV; RDFPQVVA; DFPQVVAV; FPQVVAVI; PQVVAVIS; QVVAVISN; VVAVISNM; VAVISNMA; AVISNMAE; VISNMAEK; ISNMAEKK; SNMAEKKS; NMAEKKSL; MAEKKSLA; AEKKSLAD; EKKSLADR; KKSLADRF; KSLADRFA; SLADRFAD; LADRFADT; ADRFADTL; DRFADTLR; RFADTLRG; FADTLRGE; ADTLRGEV; DTLRGEVA; TLRGEVAR; LRGEVARR; RGEVARRE; GEVARREM; EVARREML; VARREMLL; ARREMLLR; RREMLLRE; REMLLREA; EMLLREAG; MLLREAGR; LLREAGRK; LREAGRKV; REAGRKVQ; EAGRKVQG; AGRKVQGS; GRKVQGSA; RKVQGSAF; KVQGSAFN; VQGSAFNS; QGSAFNSV; GSAFNSVL; SAFNSVLE; AFNSVLEY; FNSVLEYE; NSVLEYEN; SVLEYENA; VLEYENAI; LEYENAIA; EYENAIAA; YENAIAAG; ENAIAAGH; NAIAAGHS; AIAAGHSL; IAAGHSLP; AAGHSLPP; AGHSLPPI; GHSLPPIP; HSLPPIPT; SLPPIPTL; LPPIPTLF; PPIPTLFV; PIPTLFVV; IPTLFVVA; PTLFVVAD; TLFVVADE; LFVVADEF; FVVADEFT; VVADEFTL; VADEFTLM; ADEFTLML; DEFTLMLA; EFTLMLAD; FTLMLADH; TLMLADHP; LMLADHPE; MLADHPEY; LADHPEYA; ADHPEYAE; DHPEYAEL; HPEYAELF; PEYAELFD; EYAELFDY; YAELFDYV; AELFDYVA; ELFDYVAR; LFDYVARK; FDYVARKG; DYVARKGR; YVARKGRS; VARKGRSF; ARKGRSFR; RKGRSFRI; KGRSFRIH; GRSFRIHI; RSFRIHIL; SFRIHILF; FRIHILFA; RIHILFAS; IHILFASQ; HILFASQT; ILFASQTL; LFASQTLD; FASQTLDV; ASQTLDVG; SQTLDVGK; QTLDVGKI; TLDVGKIK; LDVGKIKD; DVGKIKDI; VGKIKDID; GKIKDIDK; KIKDIDKN; IKDIDKNT; KDIDKNTA; DIDKNTAY; IDKNTAYR; DKNTAYRI; KNTAYRIG; NTAYRIGL; TAYRIGLK; AYRIGLKV; YRIGLKVA; RIGLKVAS; IGLKVASP; GLKVASPS; LKVASPSV; KVASPSVS; VASPSVSR; ASPSVSRQ; SPSVSRQI; PSVSRQII; SVSRQIIG; VSRQIIGV; SRQIIGVE; RQIIGVED; QIIGVEDA; IIGVEDAY; IGVEDAYH; GVEDAYHI; VEDAYHIE; EDAYHIES; DAYHIESG; AYHIESGK; YHIESGKE; HIESGKEH; IESGKEHK; ESGKEHKG; SGKEHKGV; GKEHKGVG; KEHKGVGF; EHKGVGFL; HKGVGFLV; KGVGFLVP; GVGFLVPA; VGFLVPAP; GFLVPAPG; FLVPAPGA; LVPAPGAT; VPAPGATP; PAPGATPI; APGATPIR; PGATPIRF; GATPIRFR; ATPIRFRS; TPIRFRST; PIRFRSTY; IRFRSTYV; RFRSTYVD; FRSTYVDG; | |

Fig. 28 continued

| | | |
|---|---|---|
| | RSTYVDGI; STYVDGIY; TYVDGIYE; YVDGIYEP; VDGIYEPP; DGIYEPPQ; GIYEPPQT; IYEPPQTA; YEPPQTAK; EPPQTAKA; PPQTAKAV; PQTAKAVV; QTAKAVVV; TAKAVVVQ; AKAVVVQS; KAVVVQSV; AVVVQSVP; VVVQSVPE; VVQSVPEP; VQSVPEPK; QSVPEPKL; SVPEPKLF; VPEPKLFT; PEPKLFTA; EPKLFTAA; PKLFTAAA; KLFTAAAV; LFTAAAVE; FTAAAVEP; TAAAVEPD; AAAVEPDP; AAVEPDPG; AVEPDPGT; VEPDPGTV; EPDPGTVI; PDPGTVIA; DPGTVIAD; PGTVIADT; GTVIADTD; TVIADTDE; VIADTDEQ; IADTDEQE; ADTDEQEP; DTDEQEPA; TDEQEPAD; DEQEPADP; EQEPADPP; QEPADPPR; EPADPPRK; PADPPRKL; ADPPRKLI; DPPRKLIA; PPRKLIAT; PRKLIATI; RKLIATIG; KLIATIGE; LIATIGEQ; IATIGEQL; ATIGEQLA; TIGEQLAR; IGEQLARY; GEQLARYG; EQLARYGP; QLARYGPR; LARYGPRA; ARYGPRAP; RYGPRAPQ; YGPRAPQL; GPRAPQLW; PRAPQLWL; RAPQLWLP; APQLWLPP; PQLWLPPL; QLWLPPLD; LWLPPLDE; WLPPLDET; LPPLDETI; PPLDETIP; PLDETIPL; LDETIPLS; DETIPLSA; ETIPLSAA; TIPLSAAL; IPLSAALA; PLSAALAR; LSAALARA; SAALARAG; AALARAGV; ALARAGVG; LARAGVGP; ARAGVGPR; RAGVGPRQ; AGVGPRQW; GVGPRQWR; VGPRQWRW; GPRQWRWP; PRQWRWPL; RQWRWPLG; QWRWPLGE; WRWPLGEI; RWPLGEID; WPLGEIDR; PLGEIDRP; LGEIDRPF; GEIDRPFE; EIDRPFEM; IDRPFEMR; DRPFEMRR; RPFEMRRD; PFEMRRDP; FEMRRDPL; EMRRDPLV; MRRDPLVF; RRDPLVFD; RDPLVFDA; DPLVFDAR; PLVFDARS; LVFDARSS; VFDARSSA; FDARSSAG; DARSSAGN; ARSSAGNM; RSSAGNMV; SSAGNMVI; SAGNMVIH; AGNMVIHG; GNMVIHGG; NMVIHGGP; MVIHGGPK; VIHGGPKS; IHGGPKSG; HGGPKSGK; GGPKSGKS; GPKSGKST; PKSGKSTA; KSGKSTAL; SGKSTALQ; GKSTALQT; KSTALQTF; STALQTFI; TALQTFIL; ALQTFILS; LQTFILSA; QTFILSAA; TFILSAAS; FILSAASL; ILSAASLH; LSAASLHS; SAASLHSP; AASLHSPH; ASLHSPHE; SLHSPHEV; LHSPHEVS; HSPHEVSF; SPHEVSFY; PHEVSFYC; HEVSFYCL; EVSFYCLD; VSFYCLDY; SFYCLDYG; FYCLDYGG; YCLDYGGG; CLDYGGGQ; LDYGGGQL; DYGGGQLR; YGGGQLRA; GGGQLRAL; GGQLRALQ; GQLRALQD; QLRALQDL; LRALQDLA; RALQDLAH; ALQDLAHV; LQDLAHVG; QDLAHVGS; DLAHVGSV; LAHVGSVA; AHVGSVAS; HVGSVASA; VGSVASAL; GSVASALE; SVASALEP; VASALEPE; ASALEPER; SALEPERI; ALEPERIR; LEPERIRR; EPERIRRT; PERIRRTF; ERIRRTFG; RIRRTFGE; IRRTFGEL; RRTFGELE; RTFGELEQ; TFGELEQL; FGELEQLL; GELEQLLL; ELEQLLLS; LEQLLLSR; EQLLLSRQ; QLLLSRQQ; LLLSRQQR; LLSRQQRE; LSRQQREV; SRQQREVF; RQQREVFR; QQREVFRD; QREVFRDR; REVFRDRG; EVFRDRGA; VFRDRGAN; FRDRGANG; RDRGANGS; DRGANGST; RGANGSTP; GANGSTPD; ANGSTPDD; NGSTPDDG; GSTPDDGF; STPDDGFG; TPDDGFGE; PDDGFGEV; DDGFGEVF; DGFGEVFL; GFGEVFLV; FGEVFLVI; GEVFLVID; EVFLVIDN; VFLVIDNL; FLVIDNLY; LVIDNLYG; VIDNLYGF; IDNLYGFG; DNLYGFGR; NLYGFGRD; LYGFGRDN; YGFGRDNT; GFGRDNTD; FGRDNTDQ; GRDNTDQF; RDNTDQFN; DNTDQFNT; NTDQFNTR; TDQFNTRN; DQFNTRNP; QFNTRNPL; FNTRNPLL; NTRNPLLA; TRNPLLAR; RNPLLARV; NPLLARVT; PLLARVTE; LLARVTEL; LARVTELV; ARVTELVN; RVTELVNV; VTELVNVG; TELVNVGL; ELVNVGLA; LVNVGLAY; VNVGLAYG; NVGLAYGI; VGLAYGIH; GLAYGIHV; LAYGIHVI; AYGIHVII; YGIHVIIT; GIHVIITT; | |

Fig. 28 continued

| | | |
|---|---|---|
| | IHVIITTP; HVIITTPS; VIITTPSW; IITTPSWL; ITTPSWLE; TTPSWLEV;<br>TPSWLEVP; PSWLEVPL; SWLEVPLA; WLEVPLAM; LEVPLAMR;<br>EVPLAMRD; VPLAMRDG; PLAMRDGL; LAMRDGLG; AMRDGLGL;<br>MRDGLGLR; RDGLGLRL; DGLGLRLE; GLGLRLEL; LGLRLELR;<br>GLRLELRL; LRLELRLH; RLELRLHD; LELRLHDA; ELRLHDAR;<br>LRLHDARD; RLHDARDS; LHDARDSN; HDARDSNV; DARDSNVR;<br>ARDSNVRV; RDSNVRVV; DSNVRVVG; SNVRVVGA; NVRVVGAL;<br>VRVVGALR; RVVGALRR; VVGALRRP; VGALRRPA; GALRRPAD;<br>ALRRPADA; LRRPADAV; RRPADAVP; RPADAVPH; PADAVPHD;<br>ADAVPHDQ; DAVPHDQP; AVPHDQPG; VPHDQPGR; PHDQPGRG;<br>HDQPGRGL; DQPGRGLT; QPGRGLTM; PGRGLTMA; GRGLTMAA;<br>RGLTMAAE; GLTMAAEH; LTMAAEHF; TMAAEHFL; MAAEHFLF;<br>AAEHFLFA; AEHFLFAA; EHFLFAAP; HFLFAAPE; FLFAAPEL;<br>LFAAPELD; FAAPELDA; AAPELDAQ; APELDAQT; PELDAQTN;<br>ELDAQTNP; LDAQTNPV; DAQTNPVA; AQTNPVAA; QTNPVAAI;<br>TNPVAAIN; NPVAAINA; PVAAINAR; VAAINARY; AAINARYP;<br>AINARYPG; INARYPGM; NARYPGMA; ARYPGMAA; RYPGMAAP;<br>YPGMAAPP; PGMAAPPV; GMAAPPVR; MAAPPVRL; AAPPVRLL;<br>APPVRLLP; PPVRLLPT; PVRLLPTN; VRLLPTNL; RLLPTNLA;<br>LLPTNLAP; LPTNLAPH; PTNLAPHA; TNLAPHAV; NLAPHAVG;<br>LAPHAVGE; APHAVGEL; PHAVGELY; HAVGELYR; AVGELYRG;<br>VGELYRGP; GELYRGPD; ELYRGPDQ; LYRGPDQL; YRGPDQLV;<br>RGPDQLVI; GPDQLVIG; PDQLVIGQ; DQLVIGQR; QLVIGQRE;<br>LVIGQREE; VIGQREED; IGQREEDL; GQREEDLA; QREEDLAP;<br>REEDLAPV; EEDLAPVI; EDLAPVIL; DLAPVILD; LAPVILDL;<br>APVILDLA; PVILDLAA; VILDLAAN; ILDLAANP; LDLAANPL;<br>DLAANPLL; LAANPLLM; AANPLLMV; ANPLLMVF; NPLLMVFG;<br>PLLMVFGD; LLMVFGDA; LMVFGDAR; MVFGDARS; VFGDARSG;<br>FGDARSGK; GDARSGKT; DARSGKTT; ARSGKTTL; RSGKTTLL;<br>SGKTTLLR; GKTTLLRH; KTTLLRHI; TTLLRHII; TLLRHIIR; LLRHIIRT;<br>LRHIIRTV; RHIIRTVR; HIIRTVRE; IIRTVREH; IRTVREHS; RTVREHST;<br>TVREHSTA; VREHSTAD; REHSTADR; EHSTADRV; HSTADRVA;<br>STADRVAF; TADRVAFT; ADRVAFTV; DRVAFTVL; RVAFTVLD;<br>VAFTVLDR; AFTVLDRR; FTVLDRRL; TVLDRRLH; VLDRRLHL;<br>LDRRLHLV; DRRLHLVD; RRLHLVDE; RLHLVDEP; LHLVDEPL;<br>HLVDEPLF; LVDEPLFP; VDEPLFPD; DEPLFPDN; EPLFPDNE;<br>PLFPDNEY; LFPDNEYT; FPDNEYTA; PDNEYTAN; DNEYTANI;<br>NEYTANID; EYTANIDR; YTANIDRI; TANIDRII; ANIDRIIP; NIDRIIPA;<br>IDRIIPAM; DRIIPAML; RIIPAMLG; IIPAMLGL; IPAMLGLA; PAMLGLAN;<br>AMLGLANL; MLGLANLI; LGLANLIE; GLANLIEA; LANLIEAR;<br>ANLIEARR; NLIEARRP; LIEARRPP; IEARRPPA; EARRPPAG;<br>ARRPPAGM; RRPPAGMS; RPPAGMSA; PPAGMSAA; PAGMSAAE;<br>AGMSAAEL; GMSAAELS; MSAAELSR; SAAELSRW; AAELSRWT;<br>AELSRWTF; ELSRWTFA; LSRWTFAG; SRWTFAGH; RWTFAGHT;<br>WTFAGHTH; TFAGHTHY; FAGHTHYL; AGHTHYLI; GHTHYLII;<br>HTHYLIID; THYLIIDD; HYLIIDDV; YLIIDDVD; LIIDDVDQ; IIDDVDQV;<br>IDDVDQVP; DDVDQVPD; DVDQVPDS; VDQVPDSP; DQVPDSPA;<br>QVPDSPAM; VPDSPAMT; PDSPAMTG; DSPAMTGP; SPAMTGPY;<br>PAMTGPYI; AMTGPYIG; MTGPYIGQ; TGPYIGQR; GPYIGQRP;<br>PYIGQRPW; YIGQRPWT; IGQRPWTP; GQRPWTPL; QRPWTPLI;<br>RPWTPLIG; PWTPLIGL; WTPLIGLL; TPLIGLLA; PLIGLLAQ;<br>LIGLLAQA; IGLLAQAG; GLLAQAGD; LLAQAGDL; LAQAGDLG;<br>AQAGDLGL; QAGDLGLR; AGDLGLRV; GDLGLRVI; DLGLRVIV; | |

Fig. 28 continued

LGLRVIVT; GLRVIVTG; LRVIVTGR; RVIVTGRA; VIVTGRAT; IVTGRATG; VTGRATGS; TGRATGSA; GRATGSAH; RATGSAHL; ATGSAHLL; TGSAHLLM; GSAHLLMT; SAHLLMTS; AHLLMTSP; HLLMTSPL; LLMTSPLL; LMTSPLLR; MTSPLLRR; TSPLLRRF; SPLLRRFN; PLLRRFND; LLRRFNDL; LRRFNDLQ; RRFNDLQA; RFNDLQAT; FNDLQATT; NDLQATTL; DLQATTLM; LQATTLML; QATTLMLA; ATTLMLAG; TTLMLAGN; TLMLAGNP; LMLAGNPA; MLAGNPAD; LAGNPADS; AGNPADSG; GNPADSGK; NPADSGKI; PADSGKIR; ADSGKIRG; DSGKIRGE; SGKIRGER; GKIRGERF; KIRGERFA; IRGERFAR; RGERFARL; GERFARLP; ERFARLPA; RFARLPAG; FARLPAGR; ARLPAGRA; RLPAGRAI; LPAGRAIL; PAGRAILL; AGRAILLT; GRAILLTD; RAILLTDS; AILLTDSD; ILLTDSDS; LLTDSDSP; LTDSDSPT; TDSDSPTY; DSDSPTYV; SDSPTYVQ; DSPTYVQL; SPTYVQLI; PTYVQLIN; TYVQLINP; YVQLINPL; VQLINPLV; QLINPLVD; LINPLVDA; INPLVDAA; NPLVDAAA; PLVDAAAV; LVDAAAVS; VDAAAVSG; DAAAVSGE; AAAVSGET; AAVSGETQ; AVSGETQQ; VSGETQQK; SGETQQKG; GETQQKGS; ETQQKGSQ; TQQKGSQS 9 mers:

MSRLIFEAR; SRLIFEARR; RLIFEARRR; LIFEARRRL; IFEARRRLA; FEARRRLAP; EARRRLAPP; ARRRLAPPS; RRRLAPPSS; RRLAPPSSH; RLAPPSSHQ; LAPPSSHQG; APPSSHQGT; PPSSHQGTI; PSSHQGTII; SSHQGTIII; SHQGTIIIE; HQGTIIIEA; QGTIIIEAP; GTIIIEAPP; TIIIEAPPE; IIIEAPPEL; IIEAPPELP; IEAPPELPR; EAPPELPRV; APPELPRVI; PPELPRVIP; PELPRVIPP; ELPRVIPPS; LPRVIPPSL; PRVIPPSLL; RVIPPSLLR; VIPPSLLRR; IPPSLLRRA; PPSLLRRAL; PSLLRRALP; SLLRRALPY; LLRRALPYL; LRRALPYLI; RRALPYLIG; RALPYLIGI; ALPYLIGIL; LPYLIGILI; PYLIGILIV; YLIGILIVG; LIGILIVGM; IGILIVGMI; GILIVGMIV; ILIVGMIVA; LIVGMIVAL; IVGMIVALV; VGMIVALVA; GMIVALVAT; MIVALVATG; IVALVATGM; VALVATGMR; ALVATGMRV; LVATGMRVI; VATGMRVIS; ATGMRVISP; TGMRVISPQ; GMRVISPQT; MRVISPQTL; RVISPQTLF; VISPQTLFF; ISPQTLFFP; SPQTLFFPF; PQTLFFPFV; QTLFFPFVL; TLFFPFVLL; LFFPFVLLL; FFPFVLLLA; FPFVLLLAA; PFVLLLAAT; FVLLLAATA; VLLLAATAL; LLLAATALY; LLAATALYR; LAATALYRG; AATALYRGN; ATALYRGND; TALYRGNDK; ALYRGNDKK; LYRGNDKKM; YRGNDKKMR; RGNDKKMRT; GNDKKMRTE; NDKKMRTEE; DKKMRTEEV; KKMRTEEVD; KMRTEEVDA; MRTEEVDAE; RTEEVDAER; TEEVDAERA; EEVDAERAD; EVDAERADY; VDAERADYL; DAERADYLR; AERADYLRY; ERADYLRYL; RADYLRYLS; ADYLRYLSV; DYLRYLSVV; YLRYLSVVR; LRYLSVVRD; RYLSVVRDN; YLSVVRDNI; LSVVRDNIR; SVVRDNIRA; VVRDNIRAQ; VRDNIRAQA; RDNIRAQAA; DNIRAQAAE; NIRAQAAEQ; IRAQAAEQR; RAQAAEQRA; AQAAEQRAS; QAAEQRASA; AAEQRASAL; AEQRASALW; EQRASALWS; QRASALWSH; RASALWSHP; ASALWSHPD; SALWSHPDP; ALWSHPDPT; LWSHPDPTA; WSHPDPTAL; SHPDPTALA; HPDPTALAS; PDPTALASV; DPTALASVP; PTALASVPG; TALASVPGS; ALASVPGSR; LASVPGSRR; ASVPGSRRQ; SVPGSRRQW; VPGSRRQWE; PGSRRQWER; GSRRQWERD; SRRQWERDP; RRQWERDPH; RQWERDPHD; QWERDPHDP; WERDPHDPD; ERDPHDPDF; RDPHDPDFL; DPHDPDFLV;

Fig. 28 continued

| | | |
|---|---|---|
| | PHDPDFLVL; HDPDFLVLR; DPDFLVLRA; PDFLVLRAG; DFLVLRAGR; FLVLRAGRH; LVLRAGRHT; VLRAGRHTV; LRAGRHTVP; RAGRHTVPL; AGRHTVPLA; GRHTVPLAT; RHTVPLATT; HTVPLATTL; TVPLATTLR; VPLATTLRV; PLATTLRVN; LATTLRVND; ATTLRVNDT; TTLRVNDTA; TLRVNDTAD; LRVNDTADE; RVNDTADEI; VNDTADEID; NDTADEIDL; DTADEIDLE; TADEIDLEP; ADEIDLEPV; DEIDLEPVS; EIDLEPVSH; IDLEPVSHS; DLEPVSHSA; LEPVSHSAL; EPVSHSALR; PVSHSALRS; VSHSALRSL; SHSALRSLL; HSALRSLLD; SALRSLLDT; ALRSLLDTQ; LRSLLDTQR; RSLLDTQRS; SLLDTQRSI; LLDTQRSIG; LDTQRSIGD; DTQRSIGDV; TQRSIGDVP; QRSIGDVPT; RSIGDVPTG; SIGDVPTGI; IGDVPTGID; GDVPTGIDL; DVPTGIDLT; VPTGIDLTK; PTGIDLTKV; TGIDLTKVS; GIDLTKVSP; IDLTKVSPI; DLTKVSPIT; LTKVSPITV; TKVSPITVL; KVSPITVLG; VSPITVLGE; SPITVLGER; PITVLGERA; ITVLGERAQ; TVLGERAQV; VLGERAQVR; LGERAQVRA; GERAQVRAV; ERAQVRAVL; RAQVRAVLR; AQVRAVLRA; QVRAVLRAW; VRAVLRAWI; RAVLRAWIA; AVLRAWIAQ; VLRAWIAQA; LRAWIAQAV; RAWIAQAVT; AWIAQAVTW; WIAQAVTWH; IAQAVTWHD; AQAVTWHDP; QAVTWHDPT; AVTWHDPTV; VTWHDPTVL; TWHDPTVLG; WHDPTVLGV; HDPTVLGVA; DPTVLGVAL; PTVLGVALA; TVLGVALAA; VLGVALAAR; LGVALAARD; GVALAARDL; VALAARDLE; ALAARDLEG; LAARDLEGR; AARDLEGRD; ARDLEGRDW; RDLEGRDWN; DLEGRDWNW; LEGRDWNWL; EGRDWNWLK; GRDWNWLKW; RDWNWLKWL; DWNWLKWLP; WNWLKWLPH; NWLKWLPHV; WLKWLPHVD; LKWLPHVDI; KWLPHVDIP; WLPHVDIPG; LPHVDIPGR; PHVDIPGRL; HVDIPGRLD; VDIPGRLDA; DIPGRLDAL; IPGRLDALG; PGRLDALGP; GRLDALGPA; RLDALGPAR; LDALGPARN; DALGPARNL; ALGPARNLS; LGPARNLST; GPARNLSTD; PARNLSTDP; ARNLSTDPD; RNLSTDPDE; NLSTDPDEL; LSTDPDELI; STDPDELIA; TDPDELIAL; DPDELIALL; PDELIALLG; DELIALLGP; ELIALLGPV; LIALLGPVL; IALLGPVLA; ALLGPVLAD; LLGPVLADR; LGPVLADRP; GPVLADRPA; PVLADRPAF; VLADRPAFT; LADRPAFTG; ADRPAFTGQ; DRPAFTGQP; RPAFTGQPT; PAFTGQPTD; AFTGQPTDA; FTGQPTDAL; TGQPTDALR; GQPTDALRH; QPTDALRHL; PTDALRHLL; TDALRHLLI; DALRHLLIV; ALRHLLIVV; LRHLLIVVD; RHLLIVVDD; HLLIVVDDP; LLIVVDDPD; LIVVDDPDY; IVVDDPDYD; VVDDPDYDL; VDDPDYDLG; DDPDYDLGA; DPDYDLGAS; PDYDLGASP; DYDLGASPL; YDLGASPLA; DLGASPLAV; LGASPLAVG; GASPLAVGR; ASPLAVGRA; SPLAVGRAG; PLAVGRAGV; LAVGRAGVT; AVGRAGVTV; VGRAGVTVV; GRAGVTVVH; RAGVTVVHC; AGVTVVHCS; GVTVVHCSA; VTVVHCSAS; TVVHCSASA; VVHCSASAP; VHCSASAPH; HCSASAPHR; CSASAPHRE; SASAPHREQ; ASAPHREQY; SAPHREQYS; APHREQYSD; PHREQYSDP; HREQYSDPE; REQYSDPEK; EQYSDPEKP; QYSDPEKPI; YSDPEKPIL; SDPEKPILR; DPEKPILRV; PEKPILRVA; EKPILRVAH; KPILRVAHG; PILRVAHGA; ILRVAHGAI; LRVAHGAIE; RVAHGAIER; VAHGAIERW; AHGAIERWQ; HGAIERWQT; GAIERWQTG; AIERWQTGG; IERWQTGGW; ERWQTGGWQ; RWQTGGWQP; WQTGGWQPY; QTGGWQPYI; TGGWQPYID; GGWQPYIDA; GWQPYIDAA; WQPYIDAAD; QPYIDAADQ; PYIDAADQF; YIDAADQFS; IDAADQFSA; DAADQFSAD; AADQFSADE; ADQFSADEA; DQFSADEAA; QFSADEAAH; | |

Fig. 28 continued

| | | |
|---|---|---|
| | FSADEAAHL; SADEAAHLA; ADEAAHLAR; DEAAHLARR; EAAHLARRL; AAHLARRLS; AHLARRLSR; HLARRLSRW; LARRLSRWD; ARRLSRWDS; RRLSRWDSN; RLSRWDSNP; LSRWDSNPT; SRWDSNPTH; RWDSNPTHA; WDSNPTHAG; DSNPTHAGL; SNPTHAGLR; NPTHAGLRS; PTHAGLRSA; THAGLRSAA; HAGLRSAAT; AGLRSAATR; GLRSAATRG; LRSAATRGA; RSAATRGAS; SAATRGASF; AATRGASFT; ATRGASFTT; TRGASFTTL; RGASFTTLL; GASFTTLLG; ASFTTLLGI; SFTTLLGIE; FTTLLGIED; TTLLGIEDA; TLLGIEDAS; LLGIEDASR; LGIEDASRL; GIEDASRLD; IEDASRLDV; EDASRLDVP; DASRLDVPA; ASRLDVPAL; SRLDVPALW; RLDVPALWA; LDVPALWAP; DVPALWAPR; VPALWAPRR; PALWAPRRR; ALWAPRRRD; LWAPRRRDE; WAPRRRDEE; APRRRDEEL; PRRRDEELR; RRRDEELRV; RRDEELRVP; RDEELRVPI; DEELRVPIG; EELRVPIGV; ELRVPIGVT; LRVPIGVTG; RVPIGVTGT; VPIGVTGTG; PIGVTGTGE; IGVTGTGEP; GVTGTGEPL; VTGTGEPLM; TGTGEPLMF; GTGEPLMFD; TGEPLMFDL; GEPLMFDLK; EPLMFDLKD; PLMFDLKDE; LMFDLKDEA; MFDLKDEAE; FDLKDEAEG; DLKDEAEGG; LKDEAEGGM; KDEAEGGMG; DEAEGGMGP; EAEGGMGPH; AEGGMGPHG; EGGMGPHGL; GGMGPHGLM; GMGPHGLMI; MGPHGLMIG; GPHGLMIGM; PHGLMIGMT; HGLMIGMTG; GLMIGMTGS; LMIGMTGSG; MIGMTGSGK; IGMTGSGKS; GMTGSGKSQ; MTGSGKSQT; TGSGKSQTL; GSGKSQTLM; SGKSQTLMS; GKSQTLMSI; KSQTLMSIL; SQTLMSILL; QTLMSILLS; TLMSILLSL; LMSILLSLL; MSILLSLLT; SILLSLLTT; ILLSLLTTH; LLSLLTTHS; LSLLTTHSA; SLLTTHSAE; LLTTHSAER; LTTHSAERL; TTHSAERLI; THSAERLIV; HSAERLIVI; SAERLIVIY; AERLIVIYA; ERLIVIYAD; RLIVIYADF; LIVIYADFK; IVIYADFKG; VIYADFKGE; IYADFKGEA; YADFKGEAG; ADFKGEAGA; DFKGEAGAD; FKGEAGADS; KGEAGADSF; GEAGADSFR; EAGADSFRD; AGADSFRDF; GADSFRDFP; ADSFRDFPQ; DSFRDFPQV; SFRDFPQVV; FRDFPQVVA; RDFPQVVAV; DFPQVVAVI; FPQVVAVIS; PQVVAVISN; QVVAVISNM; VVAVISNMA; VAVISNMAE; AVISNMAEK; VISNMAEKK; ISNMAEKKS; SNMAEKKSL; NMAEKKSLA; MAEKKSLAD; AEKKSLADR; EKKSLADRF; KKSLADRFA; KSLADRFAD; SLADRFADT; LADRFADTL; ADRFADTLR; DRFADTLRG; RFADTLRGE; FADTLRGEV; ADTLRGEVA; DTLRGEVAR; TLRGEVARR; LRGEVARRE; RGEVARREM; GEVARREML; EVARREMLL; VARREMLLR; ARREMLLRE; RREMLLREA; REMLLREAG; EMLLREAGR; MLLREAGRK; LLREAGRKV; LREAGRKVQ; REAGRKVQG; EAGRKVQGS; AGRKVQGSA; GRKVQGSAF; RKVQGSAFN; KVQGSAFNS; VQGSAFNSV; QGSAFNSVL; GSAFNSVLE; SAFNSVLEY; AFNSVLEYE; FNSVLEYEN; NSVLEYENA; SVLEYENAI; VLEYENAIA; LEYENAIAA; EYENAIAAG; YENAIAAGH; ENAIAAGHS; NAIAAGHSL; AIAAGHSLP; IAAGHSLPP; AAGHSLPPI; AGHSLPPIP; GHSLPPIPT; HSLPPIPTL; SLPPIPTLF; LPPIPTLFV; PPIPTLFVV; PIPTLFVVA; IPTLFVVAD; PTLFVVADE; TLFVVADEF; LFVVADEFT; FVVADEFTL; VVADEFTLM; VADEFTLML; ADEFTLMLA; DEFTLMLAD; EFTLMLADH; FTLMLADHP; TLMLADHPE; LMLADHPEY; MLADHPEYA; LADHPEYAE; ADHPEYAEL; DHPEYAELF; HPEYAELFD; PEYAELFDY; EYAELFDYV; YAELFDYVA; AELFDYVAR; ELFDYVARK; LFDYVARKG; FDYVARKGR; DYVARKGRS; | |

Fig. 28 continued

| | | |
|---|---|---|
| | YVARKGRSF; VARKGRSFR; ARKGRSFRI; RKGRSFRIH; KGRSFRIHI; GRSFRIHIL; RSFRIHILF; SFRIHILFA; FRIHILFAS; RIHILFASQ; IHILFASQT; HILFASQTL; ILFASQTLD; LFASQTLDV; FASQTLDVG; ASQTLDVGK; SQTLDVGKI; QTLDVGKIK; TLDVGKIKD; LDVGKIKDI; DVGKIKDID; VGKIKDIDK; GKIKDIDKN; KIKDIDKNT; IKDIDKNTA; KDIDKNTAY; DIDKNTAYR; IDKNTAYRI; DKNTAYRIG; KNTAYRIGL; NTAYRIGLK; TAYRIGLKV; AYRIGLKVA; YRIGLKVAS; RIGLKVASP; IGLKVASPS; GLKVASPSV; LKVASPSVS; KVASPSVSR; VASPSVSRQ; ASPSVSRQI; SPSVSRQII; PSVSRQIIG; SVSRQIIGV; VSRQIIGVE; SRQIIGVED; RQIIGVEDA; QIIGVEDAY; IIGVEDAYH; IGVEDAYHI; GVEDAYHIE; VEDAYHIES; EDAYHIESG; DAYHIESGK; AYHIESGKE; YHIESGKEH; HIESGKEHK; IESGKEHKG; ESGKEHKGV; SGKEHKGVG; GKEHKGVGF; KEHKGVGFL; EHKGVGFLV; HKGVGFLVP; KGVGFLVPA; GVGFLVPAP; VGFLVPAPG; GFLVPAPGA; FLVPAPGAT; LVPAPGATP; VPAPGATPI; PAPGATPIR; APGATPIRF; PGATPIRFR; GATPIRFRS; ATPIRFRST; TPIRFRSTY; PIRFRSTYV; IRFRSTYVD; RFRSTYVDG; FRSTYVDGI; RSTYVDGIY; STYVDGIYE; TYVDGIYEP; YVDGIYEPP; VDGIYEPPQ; DGIYEPPQT; GIYEPPQTA; IYEPPQTAK; YEPPQTAKA; EPPQTAKAV; PPQTAKAVV; PQTAKAVVV; QTAKAVVVQ; TAKAVVVQS; AKAVVVQSV; KAVVVQSVP; AVVVQSVPE; VVVQSVPEP; VVQSVPEPK; VQSVPEPKL; QSVPEPKLF; SVPEPKLFT; VPEPKLFTA; PEPKLFTAA; EPKLFTAAA; PKLFTAAAV; KLFTAAAVE; LFTAAAVEP; FTAAAVEPD; TAAAVEPDP; AAAVEPDPG; AAVEPDPGT; AVEPDPGTV; VEPDPGTVI; EPDPGTVIA; PDPGTVIAD; DPGTVIADT; PGTVIADTD; GTVIADTDE; TVIADTDEQ; VIADTDEQE; IADTDEQEP; ADTDEQEPA; DTDEQEPAD; TDEQEPADP; DEQEPADPP; EQEPADPPR; QEPADPPRK; EPADPPRKL; PADPPRKLI; ADPPRKLIA; DPPRKLIAT; PPRKLIATI; PRKLIATIG; RKLIATIGE; KLIATIGEQ; LIATIGEQL; IATIGEQLA; ATIGEQLAR; TIGEQLARY; IGEQLARYG; GEQLARYGP; EQLARYGPR; QLARYGPRA; LARYGPRAP; ARYGPRAPQ; RYGPRAPQL; YGPRAPQLW; GPRAPQLWL; PRAPQLWLP; RAPQLWLPP; APQLWLPPL; PQLWLPPLD; QLWLPPLDE; LWLPPLDET; WLPPLDETI; LPPLDETIP; PPLDETIPL; PLDETIPLS; LDETIPLSA; DETIPLSAA; ETIPLSAAL; TIPLSAALA; IPLSAALAR; PLSAALARA; LSAALARAG; SAALARAGV; AALARAGVG; ALARAGVGP; LARAGVGPR; ARAGVGPRQ; RAGVGPRQW; AGVGPRQWR; GVGPRQWRW; VGPRQWRWP; GPRQWRWPL; PRQWRWPLG; RQWRWPLGE; QWRWPLGEI; WRWPLGEID; RWPLGEIDR; WPLGEIDRP; PLGEIDRPF; LGEIDRPFE; GEIDRPFEM; EIDRPFEMR; IDRPFEMRR; DRPFEMRRD; RPFEMRRDP; PFEMRRDPL; FEMRRDPLV; EMRRDPLVF; MRRDPLVFD; RRDPLVFDA; RDPLVFDAR; DPLVFDARS; PLVFDARSS; LVFDARSSA; VFDARSSAG; FDARSSAGN; DARSSAGNM; ARSSAGNMV; RSSAGNMVI; SSAGNMVIH; SAGNMVIHG; AGNMVIHGG; GNMVIHGGP; NMVIHGGPK; MVIHGGPKS; VIHGGPKSG; IHGGPKSGK; HGGPKSGKS; GGPKSGKST; GPKSGKSTA; PKSGKSTAL; KSGKSTALQ; SGKSTALQT; GKSTALQTF; KSTALQTFI; STALQTFIL; TALQTFILS; ALQTFILSA; LQTFILSAA; QTFILSAAS; TFILSAASL; FILSAASLH; ILSAASLHS; LSAASLHSP; SAASLHSPH; AASLHSPHE; ASLHSPHEV; SLHSPHEVS; LHSPHEVSF; HSPHEVSFY; SPHEVSFYC; PHEVSFYCL; HEVSFYCLD; EVSFYCLDY; VSFYCLDYG; | |

Fig. 28 continued

| | | | |
|---|---|---|---|
| | SFYCLDYGG; FYCLDYGGG; YCLDYGGGQ; CLDYGGGQL; LDYGGGQLR; DYGGGQLRA; YGGGQLRAL; GGGQLRALQ; GGQLRALQD; GQLRALQDL; QLRALQDLA; LRALQDLAH; RALQDLAHV; ALQDLAHVG; LQDLAHVGS; QDLAHVGSV; DLAHVGSVA; LAHVGSVAS; AHVGSVASA; HVGSVASAL; VGSVASALE; GSVASALEP; SVASALEPE; VASALEPER; ASALEPERI; SALEPERIR; ALEPERIRR; LEPERIRRT; EPERIRRTF; PERIRRTFG; ERIRRTFGE; RIRRTFGEL; IRRTFGELE; RRTFGELEQ; RTFGELEQL; TFGELEQLL; FGELEQLLL; GELEQLLLS; ELEQLLLSR; LEQLLLSRQ; EQLLLSRQQ; QLLLSRQQR; LLLSRQQRE; LLSRQQREV; LSRQQREVF; SRQQREVFR; RQQREVFRD; QQREVFRDR; QREVFRDRG; REVFRDRGA; EVFRDRGAN; VFRDRGANG; FRDRGANGS; RDRGANGST; DRGANGSTP; RGANGSTPD; GANGSTPDD; ANGSTPDDG; NGSTPDDGF; GSTPDDGFG; STPDDGFGE; TPDDGFGEV; PDDGFGEVF; DDGFGEVFL; DGFGEVFLV; GFGEVFLVI; FGEVFLVID; GEVFLVIDN; EVFLVIDNL; VFLVIDNLY; FLVIDNLYG; LVIDNLYGF; VIDNLYGFG; IDNLYGFGR; DNLYGFGRD; NLYGFGRDN; LYGFGRDNT; YGFGRDNTD; GFGRDNTDQ; FGRDNTDQF; GRDNTDQFN; RDNTDQFNT; DNTDQFNTR; NTDQFNTRN; TDQFNTRNP; DQFNTRNPL; QFNTRNPLL; FNTRNPLLA; NTRNPLLAR; TRNPLLARV; RNPLLARVT; NPLLARVTE; PLLARVTEL; LLARVTELV; LARVTELVN; ARVTELVNV; RVTELVNVG; VTELVNVGL; TELVNVGLA; ELVNVGLAY; LVNVGLAYG; VNVGLAYGI; NVGLAYGIH; VGLAYGIHV; GLAYGIHVI; LAYGIHVII; AYGIHVIIT; YGIHVIITT; GIHVIITTP; IHVIITTPS; HVIITTPSW; VIITTPSWL; IITTPSWLE; ITTPSWLEV; TTPSWLEVP; TPSWLEVPL; PSWLEVPLA; SWLEVPLAM; WLEVPLAMR; LEVPLAMRD; EVPLAMRDG; VPLAMRDGL; PLAMRDGLG; LAMRDGLGL; AMRDGLGLR; MRDGLGLRL; RDGLGLRLE; DGLGLRLEL; GLGLRLELR; LGLRLELRL; GLRLELRLH; LRLELRLHD; RLELRLHDA; LELRLHDAR; ELRLHDARD; LRLHDARDS; RLHDARDSN; LHDARDSNV; HDARDSNVR; DARDSNVRV; ARDSNVRVV; RDSNVRVVG; DSNVRVVGA; SNVRVVGAL; NVRVVGALR; VRVVGALRR; RVVGALRRP; VVGALRRPA; VGALRRPAD; GALRRPADA; ALRRPADAV; LRRPADAVP; RRPADAVPH; RPADAVPHD; PADAVPHDQ; ADAVPHDQP; DAVPHDQPG; AVPHDQPGR; VPHDQPGRG; PHDQPGRGL; HDQPGRGLT; DQPGRGLTM; QPGRGLTMA; PGRGLTMAA; GRGLTMAAE; RGLTMAAEH; GLTMAAEHF; LTMAAEHFL; TMAAEHFLF; MAAEHFLFA; AAEHFLFAA; AEHFLFAAP; EHFLFAAPE; HFLFAAPEL; FLFAAPELD; LFAAPELDA; FAAPELDAQ; AAPELDAQT; APELDAQTN; PELDAQTNP; ELDAQTNPV; LDAQTNPVA; DAQTNPVAA; AQTNPVAAI; QTNPVAAIN; TNPVAAINA; NPVAAINAR; PVAAINARY; VAAINARYP; AAINARYPG; AINARYPGM; INARYPGMA; NARYPGMAA; ARYPGMAAP; RYPGMAAPP; YPGMAAPPV; PGMAAPPVR; GMAAPPVRL; MAAPPVRLL; AAPPVRLLP; APPVRLLPT; PPVRLLPTN; PVRLLPTNL; VRLLPTNLA; RLLPTNLAP; LLPTNLAPH; LPTNLAPHA; PTNLAPHAV; TNLAPHAVG; NLAPHAVGE; LAPHAVGEL; APHAVGELY; PHAVGELYR; HAVGELYRG; AVGELYRGP; VGELYRGPD; GELYRGPDQ; ELYRGPDQL; LYRGPDQLV; YRGPDQLVI; RGPDQLVIG; GPDQLVIGQ; PDQLVIGQR; DQLVIGQRE; QLVIGQREE; LVIGQREED; VIGQREEDL; IGQREEDLA; GQREEDLAP; QREEDLAPV; REEDLAPVI; EEDLAPVIL; | |

Fig. 28 continued

| | | | |
|---|---|---|---|
| | EDLAPVILD; DLAPVILDL; LAPVILDLA; APVILDLAA; PVILDLAAN; VILDLAANP; ILDLAANPL; LDLAANPLL; DLAANPLLM; LAANPLLMV; AANPLLMVF; ANPLLMVFG; NPLLMVFGD; PLLMVFGDA; LLMVFGDAR; LMVFGDARS; MVFGDARSG; VFGDARSGK; FGDARSGKT; GDARSGKTT; DARSGKTTL; ARSGKTTLL; RSGKTTLLR; SGKTTLLRH; GKTTLLRHI; KTTLLRHII; TTLLRHIIR; TLLRHIIRT; LLRHIIRTV; LRHIIRTVR; RHIIRTVRE; HIIRTVREH; IIRTVREHS; IRTVREHST; RTVREHSTA; TVREHSTAD; VREHSTADR; REHSTADRV; EHSTADRVA; HSTADRVAF; STADRVAFT; TADRVAFTV; ADRVAFTVL; DRVAFTVLD; RVAFTVLDR; VAFTVLDRR; AFTVLDRRL; FTVLDRRLH; TVLDRRLHL; VLDRRLHLV; LDRRLHLVD; DRRLHLVDE; RRLHLVDEP; RLHLVDEPL; LHLVDEPLF; HLVDEPLFP; LVDEPLFPD; VDEPLFPDN; DEPLFPDNE; EPLFPDNEY; PLFPDNEYT; LFPDNEYTA; FPDNEYTAN; PDNEYTANI; DNEYTANID; NEYTANIDR; EYTANIDRI; YTANIDRII; TANIDRIIP; ANIDRIIPA; NIDRIIPAM; IDRIIPAML; DRIIPAMLG; RIIPAMLGL; IIPAMLGLA; IPAMLGLAN; PAMLGLANL; AMLGLANLI; MLGLANLIE; LGLANLIEA; GLANLIEAR; LANLIEARR; ANLIEARRP; NLIEARRPP; LIEARRPPA; IEARRPPAG; EARRPPAGM; ARRPPAGMS; RRPPAGMSA; RPPAGMSAA; PPAGMSAAE; PAGMSAAEL; AGMSAAELS; GMSAAELSR; MSAAELSRW; SAAELSRWT; AAELSRWTF; AELSRWTFA; ELSRWTFAG; LSRWTFAGH; SRWTFAGHT; RWTFAGHTH; WTFAGHTHY; TFAGHTHYL; FAGHTHYLI; AGHTHYLII; GHTHYLIID; HTHYLIIDD; THYLIIDDV; HYLIIDDVD; YLIIDDVDQ; LIIDDVDQV; IIDDVDQVP; IDDVDQVPD; DDVDQVPDS; DVDQVPDSP; VDQVPDSPA; DQVPDSPAM; QVPDSPAMT; VPDSPAMTG; PDSPAMTGP; DSPAMTGPY; SPAMTGPYI; PAMTGPYIG; AMTGPYIGQ; MTGPYIGQR; TGPYIGQRP; GPYIGQRPW; PYIGQRPWT; YIGQRPWTP; IGQRPWTPL; GQRPWTPLI; QRPWTPLIG; RPWTPLIGL; PWTPLIGLL; WTPLIGLLA; TPLIGLLAQ; PLIGLLAQA; LIGLLAQAG; IGLLAQAGD; GLLAQAGDL; LLAQAGDLG; LAQAGDLGL; AQAGDLGLR; QAGDLGLRV; AGDLGLRVI; GDLGLRVIV; DLGLRVIVT; LGLRVIVTG; GLRVIVTGR; LRVIVTGRA; RVIVTGRAT; VIVTGRATG; IVTGRATGS; VTGRATGSA; TGRATGSAH; GRATGSAHL; RATGSAHLL; ATGSAHLLM; TGSAHLLMT; GSAHLLMTS; SAHLLMTSP; AHLLMTSPL; HLLMTSPLL; LLMTSPLLR; LMTSPLLRR; MTSPLLRRF; TSPLLRRFN; SPLLRRFND; PLLRRFNDL; LLRRFNDLQ; LRRFNDLQA; RRFNDLQAT; RFNDLQATT; FNDLQATTL; NDLQATTLM; DLQATTLML; LQATTLMLA; QATTLMLAG; ATTLMLAGN; TTLMLAGNP; TLMLAGNPA; LMLAGNPAD; MLAGNPADS; LAGNPADSG; AGNPADSGK; GNPADSGKI; NPADSGKIR; PADSGKIRG; ADSGKIRGE; DSGKIRGER; SGKIRGERF; GKIRGERFA; KIRGERFAR; IRGERFARL; RGERFARLP; GERFARLPA; ERFARLPAG; RFARLPAGR; FARLPAGRA; ARLPAGRAI; RLPAGRAIL; LPAGRAILL; PAGRAILLT; AGRAILLTD; GRAILLTDS; RAILLTDSD; AILLTDSDS; ILLTDSDSP; LLTDSDSPT; LTDSDSPTY; TDSDSPTYV; DSDSPTYVQ; SDSPTYVQL; DSPTYVQLI; SPTYVQLIN; PTYVQLINP; TYVQLINPL; YVQLINPLV; VQLINPLVD; QLINPLVDA; LINPLVDAA; INPLVDAAA; NPLVDAAAV; PLVDAAAVS; LVDAAAVSG; VDAAAVSGE; DAAAVSGET; AAAVSGETQ; AAVSGETQQ; AVSGETQQK; VSGETQQKG; SGETQQKGS; GETQQKGSQ; ETQQKGSQS | |

Fig. 28 continued

| | | |
|---|---|---|
| | 10 mers:<br>MSRLIFEARR; SRLIFEARRR; RLIFEARRRL; LIFEARRRLA; IFEARRRLAP; FEARRRLAPP; EARRRLAPPS; ARRRLAPPSS; RRRLAPPSSH; RRLAPPSSHQ; RLAPPSSHQG; LAPPSSHQGT; APPSSHQGTI; PPSSHQGTII; PSSHQGTIII; SSHQGTIIIE; SHQGTIIIEA; HQGTIIIEAP; QGTIIIEAPP; GTIIIEAPPE; TIIIEAPPEL; IIIEAPPELP; IIEAPPELPR; IEAPPELPRV; EAPPELPRVI; APPELPRVIP; PPELPRVIPP; PELPRVIPPS; ELPRVIPPSL; LPRVIPPSLL; PRVIPPSLLR; RVIPPSLLRR; VIPPSLLRRA; IPPSLLRRAL; PPSLLRRALP; PSLLRRALPY; SLLRRALPYL; LLRRALPYLI; LRRALPYLIG; RRALPYLIGI; RALPYLIGIL; ALPYLIGILI; LPYLIGILIV; PYLIGILIVG; YLIGILIVGM; LIGILIVGMI; IGILIVGMIV; GILIVGMIVA; ILIVGMIVAL; LIVGMIVALV; IVGMIVALVA; VGMIVALVAT; GMIVALVATG; MIVALVATGM; IVALVATGMR; VALVATGMRV; ALVATGMRVI; LVATGMRVIS; VATGMRVISP; ATGMRVISPQ; TGMRVISPQT; GMRVISPQTL; MRVISPQTLF; RVISPQTLFF; VISPQTLFFP; ISPQTLFFPF; SPQTLFFPFV; PQTLFFPFVL; QTLFFPFVLL; TLFFPFVLLL; LFFPFVLLLA; FFPFVLLLAA; FPFVLLLAAT; PFVLLLAATA; FVLLLAATAL; VLLLAATALY; LLLAATALYR; LLAATALYRG; LAATALYRGN; AATALYRGND; ATALYRGNDK; TALYRGNDKK; ALYRGNDKKM; LYRGNDKKMR; YRGNDKKMRT; RGNDKKMRTE; GNDKKMRTEE; NDKKMRTEEV; DKKMRTEEVD; KKMRTEEVDA; KMRTEEVDAE; MRTEEVDAER; RTEEVDAERA; TEEVDAERAD; EEVDAERADY; EVDAERADYL; VDAERADYLR; DAERADYLRY; AERADYLRYL; ERADYLRYLS; RADYLRYLSV; ADYLRYLSVV; DYLRYLSVVR; YLRYLSVVRD; LRYLSVVRDN; RYLSVVRDNI; YLSVVRDNIR; LSVVRDNIRA; SVVRDNIRAQ; VVRDNIRAQA; VRDNIRAQAA; RDNIRAQAAE; DNIRAQAAEQ; NIRAQAAEQR; IRAQAAEQRA; RAQAAEQRAS; AQAAEQRASA; QAAEQRASAL; AAEQRASALW; AEQRASALWS; EQRASALWSH; QRASALWSHP; RASALWSHPD; ASALWSHPDP; SALWSHPDPT; ALWSHPDPTA; LWSHPDPTAL; WSHPDPTALA; SHPDPTALAS; HPDPTALASV; PDPTALASVP; DPTALASVPG; PTALASVPGS; TALASVPGSR; ALASVPGSRR; LASVPGSRRQ; ASVPGSRRQW; SVPGSRRQWE; VPGSRRQWER; PGSRRQWERD; GSRRQWERDP; SRRQWERDPH; RRQWERDPHD; RQWERDPHDP; QWERDPHDPD; WERDPHDPDF; ERDPHDPDFL; RDPHDPDFLV; DPHDPDFLVL; PHDPDFLVLR; HDPDFLVLRA; DPDFLVLRAG; PDFLVLRAGR; DFLVLRAGRH; FLVLRAGRHT; LVLRAGRHTV; VLRAGRHTVP; LRAGRHTVPL; RAGRHTVPLA; AGRHTVPLAT; GRHTVPLATT; RHTVPLATTL; HTVPLATTLR; TVPLATTLRV; VPLATTLRVN; PLATTLRVND; LATTLRVNDT; ATTLRVNDTA; TTLRVNDTAD; TLRVNDTADE; LRVNDTADEI; RVNDTADEID; VNDTADEIDL; NDTADEIDLE; DTADEIDLEP; TADEIDLEPV; ADEIDLEPVS; DEIDLEPVSH; EIDLEPVSHS; IDLEPVSHSA; DLEPVSHSAL; LEPVSHSALR; EPVSHSALRS; PVSHSALRSL; VSHSALRSLL; SHSALRSLLD; HSALRSLLDT; SALRSLLDTQ; ALRSLLDTQR; LRSLLDTQRS; RSLLDTQRSI; SLLDTQRSIG; LLDTQRSIGD; LDTQRSIGDV; DTQRSIGDVP; TQRSIGDVPT; QRSIGDVPTG; RSIGDVPTGI; SIGDVPTGID; IGDVPTGIDL; GDVPTGIDLT; DVPTGIDLTK; VPTGIDLTKV; PTGIDLTKVS; TGIDLTKVSP; GIDLTKVSPI; IDLTKVSPIT; DLTKVSPITV; LTKVSPITVL; TKVSPITVLG; KVSPITVLGE; | |

Fig. 28 continued

| | | | |
|---|---|---|---|
| | VSPITVLGER; SPITVLGERA; PITVLGERAQ; ITVLGERAQV;<br>TVLGERAQVR; VLGERAQVRA; LGERAQVRAV; GERAQVRAVL;<br>ERAQVRAVLR; RAQVRAVLRA; AQVRAVLRAW; QVRAVLRAWI;<br>VRAVLRAWIA; RAVLRAWIAQ; AVLRAWIAQA; VLRAWIAQAV;<br>LRAWIAQAVT; RAWIAQAVTW; AWIAQAVTWH; WIAQAVTWHD;<br>IAQAVTWHDP; AQAVTWHDPT; QAVTWHDPTV; AVTWHDPTVL;<br>VTWHDPTVLG; TWHDPTVLGV; WHDPTVLGVA; HDPTVLGVAL;<br>DPTVLGVALA; PTVLGVALAA; TVLGVALAAR; VLGVALAARD;<br>LGVALAARDL; GVALAARDLE; VALAARDLEG; ALAARDLEGR;<br>LAARDLEGRD; AARDLEGRDW; ARDLEGRDWN; RDLEGRDWNW;<br>DLEGRDWNWL; LEGRDWNWLK; EGRDWNWLKW; GRDWNWLKWL;<br>RDWNWLKWLP; DWNWLKWLPH; WNWLKWLPHV; NWLKWLPHVD;<br>WLKWLPHVDI; LKWLPHVDIP; KWLPHVDIPG; WLPHVDIPGR;<br>LPHVDIPGRL; PHVDIPGRLD; HVDIPGRLDA; VDIPGRLDAL;<br>DIPGRLDALG; IPGRLDALGP; PGRLDALGPA; GRLDALGPAR;<br>RLDALGPARN; LDALGPARNL; DALGPARNLS; ALGPARNLST;<br>LGPARNLSTD; GPARNLSTDP; PARNLSTDPD; ARNLSTDPDE;<br>RNLSTDPDEL; NLSTDPDELI; LSTDPDELIA; STDPDELIAL;<br>TDPDELIALL; DPDELIALLG; PDELIALLGP; DELIALLGPV;<br>ELIALLGPVL; LIALLGPVLA; IALLGPVLAD; ALLGPVLADR;<br>LLGPVLADRP; LGPVLADRPA; GPVLADRPAF; PVLADRPAFT;<br>VLADRPAFTG; LADRPAFTGQ; ADRPAFTGQP; DRPAFTGQPT;<br>RPAFTGQPTD; PAFTGQPTDA; AFTGQPTDAL; FTGQPTDALR;<br>TGQPTDALRH; GQPTDALRHL; QPTDALRHLL; PTDALRHLLI;<br>TDALRHLLIV; DALRHLLIVV; ALRHLLIVVD; LRHLLIVVDD;<br>RHLLIVVDDP; HLLIVVDDPD; LLIVVDDPDY; LIVVDDPDYD;<br>IVVDDPDYDL; VVDDPDYDLG; VDDPDYDLGA; DDPDYDLGAS;<br>DPDYDLGASP; PDYDLGASPL; DYDLGASPLA; YDLGASPLAV;<br>DLGASPLAVG; LGASPLAVGR; GASPLAVGRA; ASPLAVGRAG;<br>SPLAVGRAGV; PLAVGRAGVT; LAVGRAGVTV; AVGRAGVTVV;<br>VGRAGVTVVH; GRAGVTVVHC; RAGVTVVHCS; AGVTVVHCSA;<br>GVTVVHCSAS; VTVVHCSASA; TVVHCSASAP; VVHCSASAPH;<br>VHCSASAPHR; HCSASAPHRE; CSASAPHREQ; SASAPHREQY;<br>ASAPHREQYS; SAPHREQYSD; APHREQYSDP; PHREQYSDPE;<br>HREQYSDPEK; REQYSDPEKP; EQYSDPEKPI; QYSDPEKPIL;<br>YSDPEKPILR; SDPEKPILRV; DPEKPILRVA; PEKPILRVAH;<br>EKPILRVAHG; KPILRVAHGA; PILRVAHGAI; ILRVAHGAIE;<br>LRVAHGAIER; RVAHGAIERW; VAHGAIERWQ; AHGAIERWQT;<br>HGAIERWQTG; GAIERWQTGG; AIERWQTGGW; IERWQTGGWQ;<br>ERWQTGGWQP; RWQTGGWQPY; WQTGGWQPYI; QTGGWQPYID;<br>TGGWQPYIDA; GGWQPYIDAA; GWQPYIDAAD; WQPYIDAADQ;<br>QPYIDAADQF; PYIDAADQFS; YIDAADQFSA; IDAADQFSAD;<br>DAADQFSADE; AADQFSADEA; ADQFSADEAA; DQFSADEAAH;<br>QFSADEAAHL; FSADEAAHLA; SADEAAHLAR; ADEAAHLARR;<br>DEAAHLARRL; EAAHLARRLS; AAHLARRLSR; AHLARRLSRW;<br>HLARRLSRWD; LARRLSRWDS; ARRLSRWDSN; RRLSRWDSNP;<br>RLSRWDSNPT; LSRWDSNPTH; SRWDSNPTHA; RWDSNPTHAG;<br>WDSNPTHAGL; DSNPTHAGLR; SNPTHAGLRS; NPTHAGLRSA;<br>PTHAGLRSAA; THAGLRSAAT; HAGLRSAATR; AGLRSAATRG;<br>GLRSAATRGA; LRSAATRGAS; RSAATRGASF; SAATRGASFT;<br>AATRGASFTT; ATRGASFTTL; TRGASFTTLL; RGASFTTLLG;<br>GASFTTLLGI; ASFTTLLGIE; SFTTLLGIED; FTTLLGIEDA;<br>TTLLGIEDAS; TLLGIEDASR; LLGIEDASRL; LGIEDASRLD; | | |

Fig. 28 continued

| | | |
|---|---|---|
| | GIEDASRLDV; IEDASRLDVP; EDASRLDVPA; DASRLDVPAL; ASRLDVPALW; SRLDVPALWA; RLDVPALWAP; LDVPALWAPR; DVPALWAPRR; VPALWAPRRR; PALWAPRRRD; ALWAPRRRDE; LWAPRRRDEE; WAPRRRDEEL; APRRRDEELR; PRRRDEELRV; RRRDEELRVP; RRDEELRVPI; RDEELRVPIG; DEELRVPIGV; EELRVPIGVT; ELRVPIGVTG; LRVPIGVTGT; RVPIGVTGTG; VPIGVTGTGE; PIGVTGTGEP; IGVTGTGEPL; GVTGTGEPLM; VTGTGEPLMF; TGTGEPLMFD; GTGEPLMFDL; TGEPLMFDLK; GEPLMFDLKD; EPLMFDLKDE; PLMFDLKDEA; LMFDLKDEAE; MFDLKDEAEG; FDLKDEAEGG; DLKDEAEGGM; LKDEAEGGMG; KDEAEGGMGP; DEAEGGMGPH; EAEGGMGPHG; AEGGMGPHGL; EGGMGPHGLM; GGMGPHGLMI; GMGPHGLMIG; MGPHGLMIGM; GPHGLMIGMT; PHGLMIGMTG; HGLMIGMTGS; GLMIGMTGSG; LMIGMTGSGK; MIGMTGSGKS; IGMTGSGKSQ; GMTGSGKSQT; MTGSGKSQTL; TGSGKSQTLM; GSGKSQTLMS; SGKSQTLMSI; GKSQTLMSIL; KSQTLMSILL; SQTLMSILLS; QTLMSILLSL; TLMSILLSLL; LMSILLSLLT; MSILLSLLTT; SILLSLLTTH; ILLSLLTTHS; LLSLLTTHSA; LSLLTTHSAE; SLLTTHSAER; LLTTHSAERL; LTTHSAERLI; TTHSAERLIV; THSAERLIVI; HSAERLIVIY; SAERLIVIYA; AERLIVIYAD; ERLIVIYADF; RLIVIYADFK; LIVIYADFKG; IVIYADFKGE; VIYADFKGEA; IYADFKGEAG; YADFKGEAGA; ADFKGEAGAD; DFKGEAGADS; FKGEAGADSF; KGEAGADSFR; GEAGADSFRD; EAGADSFRDF; AGADSFRDFP; GADSFRDFPQ; ADSFRDFPQV; DSFRDFPQVV; SFRDFPQVVA; FRDFPQVVAV; RDFPQVVAVI; DFPQVVAVIS; FPQVVAVISN; PQVVAVISNM; QVVAVISNMA; VVAVISNMAE; VAVISNMAEK; AVISNMAEKK; VISNMAEKKS; ISNMAEKKSL; SNMAEKKSLA; NMAEKKSLAD; MAEKKSLADR; AEKKSLADRF; EKKSLADRFA; KKSLADRFAD; KSLADRFADT; SLADRFADTL; LADRFADTLR; ADRFADTLRG; DRFADTLRGE; RFADTLRGEV; FADTLRGEVA; ADTLRGEVAR; DTLRGEVARR; TLRGEVARRE; LRGEVARREM; RGEVARREML; GEVARREMLL; EVARREMLLR; VARREMLLRE; ARREMLLREA; RREMLLREAG; REMLLREAGR; EMLLREAGRK; MLLREAGRKV; LLREAGRKVQ; LREAGRKVQG; REAGRKVQGS; EAGRKVQGSA; AGRKVQGSAF; GRKVQGSAFN; RKVQGSAFNS; KVQGSAFNSV; VQGSAFNSVL; QGSAFNSVLE; GSAFNSVLEY; SAFNSVLEYE; AFNSVLEYEN; FNSVLEYENA; NSVLEYENAI; SVLEYENAIA; VLEYENAIAA; LEYENAIAAG; EYENAIAAGH; YENAIAAGHS; ENAIAAGHSL; NAIAAGHSLP; AIAAGHSLPP; IAAGHSLPPI; AAGHSLPPIP; AGHSLPPIPT; GHSLPPIPTL; HSLPPIPTLF; SLPPIPTLFV; LPPIPTLFVV; PPIPTLFVVA; PIPTLFVVAD; IPTLFVVADE; PTLFVVADEF; TLFVVADEFT; LFVVADEFTL; FVVADEFTLM; VVADEFTLML; VADEFTLMLA; ADEFTLMLAD; DEFTLMLADH; EFTLMLADHP; FTLMLADHPE; TLMLADHPEY; LMLADHPEYA; MLADHPEYAE; LADHPEYAEL; ADHPEYAELF; DHPEYAELFD; HPEYAELFDY; PEYAELFDYV; EYAELFDYVA; YAELFDYVAR; AELFDYVARK; ELFDYVARKG; LFDYVARKGR; FDYVARKGRS; DYVARKGRSF; YVARKGRSFR; VARKGRSFRI; ARKGRSFRIH; RKGRSFRIHI; KGRSFRIHIL; GRSFRIHILF; RSFRIHILFA; SFRIHILFAS; FRIHILFASQ; RIHILFASQT; IHILFASQTL; HILFASQTLD; ILFASQTLDV; LFASQTLDVG; FASQTLDVGK; ASQTLDVGKI; SQTLDVGKIK; QTLDVGKIKD; TLDVGKIKDI; LDVGKIKDID; DVGKIKDIDK; VGKIKDIDKN; GKIKDIDKNT; | |

Fig. 28 continued

| | | | |
|---|---|---|---|
| | KIKDIDKNTA; IKDIDKNTAY; KDIDKNTAYR; DIDKNTAYRI; IDKNTAYRIG; DKNTAYRIGL; KNTAYRIGLK; NTAYRIGLKV; TAYRIGLKVA; AYRIGLKVAS; YRIGLKVASP; RIGLKVASPS; IGLKVASPSV; GLKVASPSVS; LKVASPSVSR; KVASPSVSRQ; VASPSVSRQI; ASPSVSRQII; SPSVSRQIIG; PSVSRQIIGV; SVSRQIIGVE; VSRQIIGVED; SRQIIGVEDA; RQIIGVEDAY; QIIGVEDAYH; IIGVEDAYHI; IGVEDAYHIE; GVEDAYHIES; VEDAYHIESG; EDAYHIESGK; DAYHIESGKE; AYHIESGKEH; YHIESGKEHK; HIESGKEHKG; IESGKEHKGV; ESGKEHKGVG; SGKEHKGVGF; GKEHKGVGFL; KEHKGVGFLV; EHKGVGFLVP; HKGVGFLVPA; KGVGFLVPAP; GVGFLVPAPG; VGFLVPAPGA; GFLVPAPGAT; FLVPAPGATP; LVPAPGATPI; VPAPGATPIR; PAPGATPIRF; APGATPIRFR; PGATPIRFRS; GATPIRFRST; ATPIRFRSTY; TPIRFRSTYV; PIRFRSTYVD; IRFRSTYVDG; RFRSTYVDGI; FRSTYVDGIY; RSTYVDGIYE; STYVDGIYEP; TYVDGIYEPP; YVDGIYEPPQ; VDGIYEPPQT; DGIYEPPQTA; GIYEPPQTAK; IYEPPQTAKA; YEPPQTAKAV; EPPQTAKAVV; PPQTAKAVVV; PQTAKAVVVQ; QTAKAVVVQS; TAKAVVVQSV; AKAVVVQSVP; KAVVVQSVPE; AVVVQSVPEP; VVVQSVPEPK; VVQSVPEPKL; VQSVPEPKLF; QSVPEPKLFT; SVPEPKLFTA; VPEPKLFTAA; PEPKLFTAAA; EPKLFTAAAV; PKLFTAAAVE; KLFTAAAVEP; LFTAAAVEPD; FTAAAVEPDP; TAAAVEPDPG; AAAVEPDPGT; AAVEPDPGTV; AVEPDPGTVI; VEPDPGTVIA; EPDPGTVIAD; PDPGTVIADT; DPGTVIADTD; PGTVIADTDE; GTVIADTDEQ; TVIADTDEQE; VIADTDEQEP; IADTDEQEPA; ADTDEQEPAD; DTDEQEPADP; TDEQEPADPP; DEQEPADPPR; EQEPADPPRK; QEPADPPRKL; EPADPPRKLI; PADPPRKLIA; ADPPRKLIAT; DPPRKLIATI; PPRKLIATIG; PRKLIATIGE; RKLIATIGEQ; KLIATIGEQL; LIATIGEQLA; IATIGEQLAR; ATIGEQLARY; TIGEQLARYG; IGEQLARYGP; GEQLARYGPR; EQLARYGPRA; QLARYGPRAP; LARYGPRAPQ; ARYGPRAPQL; RYGPRAPQLW; YGPRAPQLWL; GPRAPQLWLP; PRAPQLWLPP; RAPQLWLPPL; APQLWLPPLD; PQLWLPPLDE; QLWLPPLDET; LWLPPLDETI; WLPPLDETIP; LPPLDETIPL; PPLDETIPLS; PLDETIPLSA; LDETIPLSAA; DETIPLSAAL; ETIPLSAALA; TIPLSAALAR; IPLSAALARA; PLSAALARAG; LSAALARAGV; SAALARAGVG; AALARAGVGP; ALARAGVGPR; LARAGVGPRQ; ARAGVGPRQW; RAGVGPRQWR; AGVGPRQWRW; GVGPRQWRWP; VGPRQWRWPL; GPRQWRWPLG; PRQWRWPLGE; RQWRWPLGEI; QWRWPLGEID; WRWPLGEIDR; RWPLGEIDRP; WPLGEIDRPF; PLGEIDRPFE; LGEIDRPFEM; GEIDRPFEMR; EIDRPFEMRR; IDRPFEMRRD; DRPFEMRRDP; RPFEMRRDPL; PFEMRRDPLV; FEMRRDPLVF; EMRRDPLVFD; MRRDPLVFDA; RRDPLVFDAR; RDPLVFDARS; DPLVFDARSS; PLVFDARSSA; LVFDARSSAG; VFDARSSAGN; FDARSSAGNM; DARSSAGNMV; ARSSAGNMVI; RSSAGNMVIH; SSAGNMVIHG; SAGNMVIHGG; AGNMVIHGGP; GNMVIHGGPK; NMVIHGGPKS; MVIHGGPKSG; VIHGGPKSGK; IHGGPKSGKS; HGGPKSGKST; GGPKSGKSTA; GPKSGKSTAL; PKSGKSTALQ; KSGKSTALQT; SGKSTALQTF; GKSTALQTFI; KSTALQTFIL; STALQTFILS; TALQTFILSA; ALQTFILSAA; LQTFILSAAS; QTFILSAASL; TFILSAASLH; FILSAASLHS; ILSAASLHSP; LSAASLHSPH; SAASLHSPHE; AASLHSPHEV; ASLHSPHEVS; SLHSPHEVSF; LHSPHEVSFY; HSPHEVSFYC; | |

Fig. 28 continued

| | | |
|---|---|---|
| | SPHEVSFYCL; PHEVSFYCLD; HEVSFYCLDY; EVSFYCLDYG; VSFYCLDYGG; SFYCLDYGGG; FYCLDYGGGQ; YCLDYGGGQL; CLDYGGGQLR; LDYGGGQLRA; DYGGGQLRAL; YGGGQLRALQ; GGGQLRALQD; GGQLRALQDL; GQLRALQDLA; QLRALQDLAH; LRALQDLAHV; RALQDLAHVG; ALQDLAHVGS; LQDLAHVGSV; QDLAHVGSVA; DLAHVGSVAS; LAHVGSVASA; AHVGSVASAL; HVGSVASALE; VGSVASALEP; GSVASALEPE; SVASALEPER; VASALEPERI; ASALEPERIR; SALEPERIRR; ALEPERIRRT; LEPERIRRTF; EPERIRRTFG; PERIRRTFGE; ERIRRTFGEL; RIRRTFGELE; IRRTFGELEQ; RRTFGELEQL; RTFGELEQLL; TFGELEQLLL; FGELEQLLLS; GELEQLLLSR; ELEQLLLSRQ; LEQLLLSRQQ; EQLLLSRQQR; QLLLSRQQRE; LLLSRQQREV; LLSRQQREVF; LSRQQREVFR; SRQQREVFRD; RQQREVFRDR; QQREVFRDRG; QREVFRDRGA; REVFRDRGAN; EVFRDRGANG; VFRDRGANGS; FRDRGANGST; RDRGANGSTP; DRGANGSTPD; RGANGSTPDD; GANGSTPDDG; ANGSTPDDGF; NGSTPDDGFG; GSTPDDGFGE; STPDDGFGEV; TPDDGFGEVF; PDDGFGEVFL; DDGFGEVFLV; DGFGEVFLVI; GFGEVFLVID; FGEVFLVIDN; GEVFLVIDNL; EVFLVIDNLY; VFLVIDNLYG; FLVIDNLYGF; LVIDNLYGFG; VIDNLYGFGR; IDNLYGFGRD; DNLYGFGRDN; NLYGFGRDNT; LYGFGRDNTD; YGFGRDNTDQ; GFGRDNTDQF; FGRDNTDQFN; GRDNTDQFNT; RDNTDQFNTR; DNTDQFNTRN; NTDQFNTRNP; TDQFNTRNPL; DQFNTRNPLL; QFNTRNPLLA; FNTRNPLLAR; NTRNPLLARV; TRNPLLARVT; RNPLLARVTE; NPLLARVTEL; PLLARVTELV; LLARVTELVN; LARVTELVNV; ARVTELVNVG; RVTELVNVGL; VTELVNVGLA; TELVNVGLAY; ELVNVGLAYG; LVNVGLAYGI; VNVGLAYGIH; NVGLAYGIHV; VGLAYGIHVI; GLAYGIHVII; LAYGIHVIIT; AYGIHVIITT; YGIHVIITTP; GIHVIITTPS; IHVIITTPSW; HVIITTPSWL; VIITTPSWLE; IITTPSWLEV; ITTPSWLEVP; TTPSWLEVPL; TPSWLEVPLA; PSWLEVPLAM; SWLEVPLAMR; WLEVPLAMRD; LEVPLAMRDG; EVPLAMRDGL; VPLAMRDGLG; PLAMRDGLGL; LAMRDGLGLR; AMRDGLGLRL; MRDGLGLRLE; RDGLGLRLEL; DGLGLRLELR; GLGLRLELRL; LGLRLELRLH; GLRLELRLHD; LRLELRLHDA; RLELRLHDAR; LELRLHDARD; ELRLHDARDS; LRLHDARDSN; RLHDARDSNV; LHDARDSNVR; HDARDSNVRV; DARDSNVRVV; ARDSNVRVVG; RDSNVRVVGA; DSNVRVVGAL; SNVRVVGALR; NVRVVGALRR; VRVVGALRRP; RVVGALRRPA; VVGALRRPAD; VGALRRPADA; GALRRPADAV; ALRRPADAVP; LRRPADAVPH; RRPADAVPHD; RPADAVPHDQ; PADAVPHDQP; ADAVPHDQPG; DAVPHDQPGR; AVPHDQPGRG; VPHDQPGRGL; PHDQPGRGLT; HDQPGRGLTM; DQPGRGLTMA; QPGRGLTMAA; PGRGLTMAAE; GRGLTMAAEH; RGLTMAAEHF; GLTMAAEHFL; LTMAAEHFLF; TMAAEHFLFA; MAAEHFLFAA; AAEHFLFAAP; AEHFLFAAPE; EHFLFAAPEL; HFLFAAPELD; FLFAAPELDA; LFAAPELDAQ; FAAPELDAQT; AAPELDAQTN; APELDAQTNP; PELDAQTNPV; ELDAQTNPVA; LDAQTNPVAA; DAQTNPVAAI; AQTNPVAAIN; QTNPVAAINA; TNPVAAINAR; NPVAAINARY; PVAAINARYP; VAAINARYPG; AAINARYPGM; AINARYPGMA; INARYPGMAA; NARYPGMAAP; ARYPGMAAPP; RYPGMAAPPV; YPGMAAPPVR; PGMAAPPVRL; GMAAPPVRLL; MAAPPVRLLP; AAPPVRLLPT; APPVRLLPTN; PPVRLLPTNL; PVRLLPTNLA; VRLLPTNLAP; RLLPTNLAPH; LLPTNLAPHA; LPTNLAPHAV; PTNLAPHAVG; TNLAPHAVGE; | |

Fig. 28 continued

| | | |
|---|---|---|
| | NLAPHAVGEL; LAPHAVGELY; APHAVGELYR; PHAVGELYRG; HAVGELYRGP; AVGELYRGPD; VGELYRGPDQ; GELYRGPDQL; ELYRGPDQLV; LYRGPDQLVI; YRGPDQLVIG; RGPDQLVIGQ; GPDQLVIGQR; PDQLVIGQRE; DQLVIGQREE; QLVIGQREED; LVIGQREEDL; VIGQREEDLA; IGQREEDLAP; GQREEDLAPV; QREEDLAPVI; REEDLAPVIL; EEDLAPVILD; EDLAPVILDL; DLAPVILDLA; LAPVILDLAA; APVILDLAAN; PVILDLAANP; VILDLAANPL; ILDLAANPLL; LDLAANPLLM; DLAANPLLMV; LAANPLLMVF; AANPLLMVFG; ANPLLMVFGD; NPLLMVFGDA; PLLMVFGDAR; LLMVFGDARS; LMVFGDARSG; MVFGDARSGK; VFGDARSGKT; FGDARSGKTT; GDARSGKTTL; DARSGKTTLL; ARSGKTTLLR; RSGKTTLLRH; SGKTTLLRHI; GKTTLLRHII; KTTLLRHIIR; TTLLRHIIRT; TLLRHIIRTV; LLRHIIRTVR; LRHIIRTVRE; RHIIRTVREH; HIIRTVREHS; IIRTVREHST; IRTVREHSTA; RTVREHSTAD; TVREHSTADR; VREHSTADRV; REHSTADRVA; EHSTADRVAF; HSTADRVAFT; STADRVAFTV; TADRVAFTVL; ADRVAFTVLD; DRVAFTVLDR; RVAFTVLDRR; VAFTVLDRRL; AFTVLDRRLH; FTVLDRRLHL; TVLDRRLHLV; VLDRRLHLVD; LDRRLHLVDE; DRRLHLVDEP; RRLHLVDEPL; RLHLVDEPLF; LHLVDEPLFP; HLVDEPLFPD; LVDEPLFPDN; VDEPLFPDNE; DEPLFPDNEY; EPLFPDNEYT; PLFPDNEYTA; LFPDNEYTAN; FPDNEYTANI; PDNEYTANID; DNEYTANIDR; NEYTANIDRI; EYTANIDRII; YTANIDRIIP; TANIDRIIPA; ANIDRIIPAM; NIDRIIPAML; IDRIIPAMLG; DRIIPAMLGL; RIIPAMLGLA; IIPAMLGLAN; IPAMLGLANL; PAMLGLANLI; AMLGLANLIE; MLGLANLIEA; LGLANLIEAR; GLANLIEARR; LANLIEARRP; ANLIEARRPP; NLIEARRPPA; LIEARRPPAG; IEARRPPAGM; EARRPPAGMS; ARRPPAGMSA; RRPPAGMSAA; RPPAGMSAAE; PPAGMSAAEL; PAGMSAAELS; AGMSAAELSR; GMSAAELSRW; MSAAELSRWT; SAAELSRWTF; AAELSRWTFA; AELSRWTFAG; ELSRWTFAGH; LSRWTFAGHT; SRWTFAGHTH; RWTFAGHTHY; WTFAGHTHYL; TFAGHTHYLI; FAGHTHYLII; AGHTHYLIID; GHTHYLIIDD; HTHYLIIDDV; THYLIIDDVD; HYLIIDDVDQ; YLIIDDVDQV; LIIDDVDQVP; IIDDVDQVPD; IDDVDQVPDS; DDVDQVPDSP; DVDQVPDSPA; VDQVPDSPAM; DQVPDSPAMT; QVPDSPAMTG; VPDSPAMTGP; PDSPAMTGPY; DSPAMTGPYI; SPAMTGPYIG; PAMTGPYIGQ; AMTGPYIGQR; MTGPYIGQRP; TGPYIGQRPW; GPYIGQRPWT; PYIGQRPWTP; YIGQRPWTPL; IGQRPWTPLI; GQRPWTPLIG; QRPWTPLIGL; RPWTPLIGLL; PWTPLIGLLA; WTPLIGLLAQ; TPLIGLLAQA; PLIGLLAQAG; LIGLLAQAGD; IGLLAQAGDL; GLLAQAGDLG; LLAQAGDLGL; LAQAGDLGLR; AQAGDLGLRV; QAGDLGLRVI; AGDLGLRVIV; GDLGLRVIVT; DLGLRVIVTG; LGLRVIVTGR; GLRVIVTGRA; LRVIVTGRAT; RVIVTGRATG; VIVTGRATGS; IVTGRATGSA; VTGRATGSAH; TGRATGSAHL; GRATGSAHLL; RATGSAHLLM; ATGSAHLLMT; TGSAHLLMTS; GSAHLLMTSP; SAHLLMTSPL; AHLLMTSPLL; HLLMTSPLLR; LLMTSPLLRR; LMTSPLLRRF; MTSPLLRRFN; TSPLLRRFND; SPLLRRFNDL; PLLRRFNDLQ; LLRRFNDLQA; LRRFNDLQAT; RRFNDLQATT; RFNDLQATTL; FNDLQATTLM; NDLQATTLML; DLQATTLMLA; LQATTLMLAG; QATTLMLAGN; ATTLMLAGNP; TTLMLAGNPA; TLMLAGNPAD; LMLAGNPADS; MLAGNPADSG; LAGNPADSGK; AGNPADSGKI; GNPADSGKIR; NPADSGKIRG; PADSGKIRGE; ADSGKIRGER; DSGKIRGERF; | |

Fig. 28 continued

SGKIRGERFA; GKIRGERFAR; KIRGERFARL; IRGERFARLP;
RGERFARLPA; GERFARLPAG; ERFARLPAGR; RFARLPAGRA;
FARLPAGRAI; ARLPAGRAIL; RLPAGRAILL; LPAGRAILLT;
PAGRAILLTD; AGRAILLTDS; GRAILLTDSD; RAILLTDSDS;
AILLTDSDSP; ILLTDSDSPT; LLTDSDSPTY; LTDSDSPTYV;
TDSDSPTYVQ; DSDSPTYVQL; SDSPTYVQLI; DSPTYVQLIN;
SPTYVQLINP; PTYVQLINPL; TYVQLINPLV; YVQLINPLVD;
VQLINPLVDA; QLINPLVDAA; LINPLVDAAA; INPLVDAAAV;
NPLVDAAAVS; PLVDAAAVSG; LVDAAAVSGE; VDAAAVSGET;
DAAAVSGETQ; AAAVSGETQQ; AAVSGETQQK; AVSGETQQKG;
VSGETQQKGS; SGETQQKGSQ; GETQQKGSQS 11 mers:
MSRLIFEARRR; SRLIFEARRRL; RLIFEARRRLA; LIFEARRRLAP;
IFEARRRLAPP; FEARRRLAPPS; EARRRLAPPSS; ARRRLAPPSSH;
RRRLAPPSSHQ; RRLAPPSSHQG; RLAPPSSHQGT; LAPPSSHQGTI;
APPSSHQGTII; PPSSHQGTIII; PSSHQGTIIIE; SSHQGTIIIEA;
SHQGTIIIEAP; HQGTIIIEAPP; QGTIIIEAPPE; GTIIIEAPPEL;
TIIIEAPPELP; IIIEAPPELPR; IIEAPPELPRV; IEAPPELPRVI;
EAPPELPRVIP; APPELPRVIPP; PPELPRVIPPS; PELPRVIPPSL;
ELPRVIPPSLL; LPRVIPPSLLR; PRVIPPSLLRR; RVIPPSLLRRA;
VIPPSLLRRAL; IPPSLLRRALP; PPSLLRRALPY; PSLLRRALPYL;
SLLRRALPYLI; LLRRALPYLIG; LRRALPYLIGI; RRALPYLIGIL;
RALPYLIGILI; ALPYLIGILIV; LPYLIGILIVG; PYLIGILIVGM;
YLIGILIVGMI; LIGILIVGMIV; IGILIVGMIVA; GILIVGMIVAL;
ILIVGMIVALV; LIVGMIVALVA; IVGMIVALVAT; VGMIVALVATG;
GMIVALVATGM; MIVALVATGMR; IVALVATGMRV; VALVATGMRVI;
ALVATGMRVIS; LVATGMRVISP; VATGMRVISPQ; ATGMRVISPQT;
TGMRVISPQTL; GMRVISPQTLF; MRVISPQTLFF; RVISPQTLFFP;
VISPQTLFFPF; ISPQTLFFPFV; SPQTLFFPFVL; PQTLFFPFVLL;
QTLFFPFVLLL; TLFFPFVLLLA; LFFPFVLLLAA; FFPFVLLLAAT;
FPFVLLLAATA; PFVLLLAATAL; FVLLLAATALY; VLLLAATALYR;
LLLAATALYRG; LLAATALYRGN; LAATALYRGND; AATALYRGNDK;
ATALYRGNDKK; TALYRGNDKKM; ALYRGNDKKMR;
LYRGNDKKMRT; YRGNDKKMRTE; RGNDKKMRTEE;
GNDKKMRTEEV; NDKKMRTEEVD; DKKMRTEEVDA;
KKMRTEEVDAE; KMRTEEVDAER; MRTEEVDAERA;
RTEEVDAERAD; TEEVDAERADY; EEVDAERADYL; EVDAERADYLR;
VDAERADYLRY; DAERADYLRYL; AERADYLRYLS; ERADYLRYLSV;
RADYLRYLSVV; ADYLRYLSVVR; DYLRYLSVVRD; YLRYLSVVRDN;
LRYLSVVRDNI; RYLSVVRDNIR; YLSVVRDNIRA; LSVVRDNIRAQ;
SVVRDNIRAQA; VVRDNIRAQAA; VRDNIRAQAAE; RDNIRAQAAEQ;
DNIRAQAAEQR; NIRAQAAEQRA; IRAQAAEQRAS; RAQAAEQRASA;
AQAAEQRASAL; QAAEQRASALW; AAEQRASALWS;
AEQRASALWSH; EQRASALWSHP; QRASALWSHPD;
RASALWSHPDP; ASALWSHPDPT; SALWSHPDPTA; ALWSHPDPTAL;
LWSHPDPTALA; WSHPDPTALAS; SHPDPTALASV; HPDPTALASVP;
PDPTALASVPG; DPTALASVPGS; PTALASVPGSR; TALASVPGSRR;
ALASVPGSRRQ; LASVPGSRRQW; ASVPGSRRQWE;
SVPGSRRQWER; VPGSRRQWERD; PGSRRQWERDP;
GSRRQWERDPH; SRRQWERDPHD; RRQWERDPHDP;
RQWERDPHDPD; QWERDPHDPDF; WERDPHDPDFL;
ERDPHDPDFLV; RDPHDPDFLVL; DPHDPDFLVLR; PHDPDFLVLRA;

Fig. 28 continued

| | | |
|---|---|---|
| | HDPDFLVLRAG; DPDFLVLRAGR; PDFLVLRAGRH; DFLVLRAGRHT; FLVLRAGRHTV; LVLRAGRHTVP; VLRAGRHTVPL; LRAGRHTVPLA; RAGRHTVPLAT; AGRHTVPLATT; GRHTVPLATTL; RHTVPLATTLR; HTVPLATTLRV; TVPLATTLRVN; VPLATTLRVND; PLATTLRVNDT; LATTLRVNDTA; ATTLRVNDTAD; TTLRVNDTADE; TLRVNDTADEI; LRVNDTADEID; RVNDTADEIDL; VNDTADEIDLE; NDTADEIDLEP; DTADEIDLEPV; TADEIDLEPVS; ADEIDLEPVSH; DEIDLEPVSHS; EIDLEPVSHSA; IDLEPVSHSAL; DLEPVSHSALR; LEPVSHSALRS; EPVSHSALRSL; PVSHSALRSLL; VSHSALRSLLD; SHSALRSLLDT; HSALRSLLDTQ; SALRSLLDTQR; ALRSLLDTQRS; LRSLLDTQRSI; RSLLDTQRSIG; SLLDTQRSIGD; LLDTQRSIGDV; LDTQRSIGDVP; DTQRSIGDVPT; TQRSIGDVPTG; QRSIGDVPTGI; RSIGDVPTGID; SIGDVPTGIDL; IGDVPTGIDLT; GDVPTGIDLTK; DVPTGIDLTKV; VPTGIDLTKVS; PTGIDLTKVSP; TGIDLTKVSPI; GIDLTKVSPIT; IDLTKVSPITV; DLTKVSPITVL; LTKVSPITVLG; TKVSPITVLGE; KVSPITVLGER; VSPITVLGERA; SPITVLGERAQ; PITVLGERAQV; ITVLGERAQVR; TVLGERAQVRA; VLGERAQVRAV; LGERAQVRAVL; GERAQVRAVLR; ERAQVRAVLRA; RAQVRAVLRAW; AQVRAVLRAWI; QVRAVLRAWIA; VRAVLRAWIAQ; RAVLRAWIAQA; AVLRAWIAQAV; VLRAWIAQAVT; LRAWIAQAVTW; RAWIAQAVTWH; AWIAQAVTWHD; WIAQAVTWHDP; IAQAVTWHDPT; AQAVTWHDPTV; QAVTWHDPTVL; AVTWHDPTVLG; VTWHDPTVLGV; TWHDPTVLGVA; WHDPTVLGVAL; HDPTVLGVALA; DPTVLGVALAA; PTVLGVALAAR; TVLGVALAARD; VLGVALAARDL; LGVALAARDLE; GVALAARDLEG; VALAARDLEGR; ALAARDLEGRD; LAARDLEGRDW; AARDLEGRDWN; ARDLEGRDWNW; RDLEGRDWNWL; DLEGRDWNWLK; LEGRDWNWLKW; EGRDWNWLKWL; GRDWNWLKWLP; RDWNWLKWLPH; DWNWLKWLPHV; WNWLKWLPHVD; NWLKWLPHVDI; WLKWLPHVDIP; LKWLPHVDIPG; KWLPHVDIPGR; WLPHVDIPGRL; LPHVDIPGRLD; PHVDIPGRLDA; HVDIPGRLDAL; VDIPGRLDALG; DIPGRLDALGP; IPGRLDALGPA; PGRLDALGPAR; GRLDALGPARN; RLDALGPARNL; LDALGPARNLS; DALGPARNLST; ALGPARNLSTD; LGPARNLSTDP; GPARNLSTDPD; PARNLSTDPDE; ARNLSTDPDEL; RNLSTDPDELI; NLSTDPDELIA; LSTDPDELIAL; STDPDELIALL; TDPDELIALLG; DPDELIALLGP; PDELIALLGPV; DELIALLGPVL; ELIALLGPVLA; LIALLGPVLAD; IALLGPVLADR; ALLGPVLADRP; LLGPVLADRPA; LGPVLADRPAF; GPVLADRPAFT; PVLADRPAFTG; VLADRPAFTGQ; LADRPAFTGQP; ADRPAFTGQPT; DRPAFTGQPTD; RPAFTGQPTDA; PAFTGQPTDAL; AFTGQPTDALR; FTGQPTDALRH; TGQPTDALRHL; GQPTDALRHLL; QPTDALRHLLI; PTDALRHLLIV; TDALRHLLIVV; DALRHLLIVVD; ALRHLLIVVDD; LRHLLIVVDDP; RHLLIVVDDPD; HLLIVVDDPDY; LLIVVDDPDYD; LIVVDDPDYDL; IVVDDPDYDLG; VVDDPDYDLGA; VDDPDYDLGAS; DDPDYDLGASP; DPDYDLGASPL; PDYDLGASPLA; DYDLGASPLAV; YDLGASPLAVG; DLGASPLAVGR; LGASPLAVGRA; GASPLAVGRAG; ASPLAVGRAGV; SPLAVGRAGVT; PLAVGRAGVTV; LAVGRAGVTVV; AVGRAGVTVVH; VGRAGVTVVHC; GRAGVTVVHCS; RAGVTVVHCSA; AGVTVVHCSAS; GVTVVHCSASA; VTVVHCSASAP; TVVHCSASAPH; VVHCSASAPHR; VHCSASAPHRE; HCSASAPHREQ; CSASAPHREQY; SASAPHREQYS; ASAPHREQYSD; SAPHREQYSDP; APHREQYSDPE; PHREQYSDPEK; HREQYSDPEKP; REQYSDPEKPI; EQYSDPEKPIL; QYSDPEKPILR; YSDPEKPILRV; SDPEKPILRVA; DPEKPILRVAH; | |

Fig. 28 continued

| | | | |
|---|---|---|---|
| | PEKPILRVAHG; EKPILRVAHGA; KPILRVAHGAI; PILRVAHGAIE; ILRVAHGAIER; LRVAHGAIERW; RVAHGAIERWQ; VAHGAIERWQT; AHGAIERWQTG; HGAIERWQTGG; GAIERWQTGGW; AIERWQTGGWQ; IERWQTGGWQP; ERWQTGGWQPY; RWQTGGWQPYI; WQTGGWQPYID; QTGGWQPYIDA; TGGWQPYIDAA; GGWQPYIDAAD; GWQPYIDAADQ; WQPYIDAADQF; QPYIDAADQFS; PYIDAADQFSA; YIDAADQFSAD; IDAADQFSADE; DAADQFSADEA; AADQFSADEAA; ADQFSADEAAH; DQFSADEAAHL; QFSADEAAHLA; FSADEAAHLAR; SADEAAHLARR; ADEAAHLARRL; DEAAHLARRLS; EAAHLARRLSR; AAHLARRLSRW; AHLARRLSRWD; HLARRLSRWDS; LARRLSRWDSN; ARRLSRWDSNP; RRLSRWDSNPT; RLSRWDSNPTH; LSRWDSNPTHA; SRWDSNPTHAG; RWDSNPTHAGL; WDSNPTHAGLR; DSNPTHAGLRS; SNPTHAGLRSA; NPTHAGLRSAA; PTHAGLRSAAT; THAGLRSAATR; HAGLRSAATRG; AGLRSAATRGA; GLRSAATRGAS; LRSAATRGASF; RSAATRGASFT; SAATRGASFTT; AATRGASFTTL; ATRGASFTTLL; TRGASFTTLLG; RGASFTTLLGI; GASFTTLLGIE; ASFTTLLGIED; SFTTLLGIEDA; FTTLLGIEDAS; TTLLGIEDASR; TLLGIEDASRL; LLGIEDASRLD; LGIEDASRLDV; GIEDASRLDVP; IEDASRLDVPA; EDASRLDVPAL; DASRLDVPALW; ASRLDVPALWA; SRLDVPALWAP; RLDVPALWAPR; LDVPALWAPRR; DVPALWAPRRR; VPALWAPRRRD; PALWAPRRRDE; ALWAPRRRDEE; LWAPRRRDEEL; WAPRRRDEELR; APRRRDEELRV; PRRRDEELRVP; RRRDEELRVPI; RRDEELRVPIG; RDEELRVPIGV; DEELRVPIGVT; EELRVPIGVTG; ELRVPIGVTGT; LRVPIGVTGTG; RVPIGVTGTGE; VPIGVTGTGEP; PIGVTGTGEPL; IGVTGTGEPLM; GVTGTGEPLMF; VTGTGEPLMFD; TGTGEPLMFDL; GTGEPLMFDLK; TGEPLMFDLKD; GEPLMFDLKDE; EPLMFDLKDEA; PLMFDLKDEAE; LMFDLKDEAEG; MFDLKDEAEGG; FDLKDEAEGGM; DLKDEAEGGMG; LKDEAEGGMGP; KDEAEGGMGPH; DEAEGGMGPHG; EAEGGMGPHGL; AEGGMGPHGLM; EGGMGPHGLMI; GGMGPHGLMIG; GMGPHGLMIGM; MGPHGLMIGMT; GPHGLMIGMTG; PHGLMIGMTGS; HGLMIGMTGSG; GLMIGMTGSGK; LMIGMTGSGKS; MIGMTGSGKSQ; IGMTGSGKSQT; GMTGSGKSQTL; MTGSGKSQTLM; TGSGKSQTLMS; GSGKSQTLMSI; SGKSQTLMSIL; GKSQTLMSILL; KSQTLMSILLS; SQTLMSILLSL; QTLMSILLSLL; TLMSILLSLLT; LMSILLSLLTT; MSILLSLLTTH; SILLSLLTTHS; ILLSLLTTHSA; LLSLLTTHSAE; LSLLTTHSAER; SLLTTHSAERL; LLTTHSAERLI; LTTHSAERLIV; TTHSAERLIVI; THSAERLIVIY; HSAERLIVIYA; SAERLIVIYAD; AERLIVIYADF; ERLIVIYADFK; RLIVIYADFKG; LIVIYADFKGE; IVIYADFKGEA; VIYADFKGEAG; IYADFKGEAGA; YADFKGEAGAD; ADFKGEAGADS; DFKGEAGADSF; FKGEAGADSFR; KGEAGADSFRD; GEAGADSFRDF; EAGADSFRDFP; AGADSFRDFPQ; GADSFRDFPQV; ADSFRDFPQVV; DSFRDFPQVVA; SFRDFPQVVAV; FRDFPQVVAVI; RDFPQVVAVIS; DFPQVVAVISN; FPQVVAVISNM; PQVVAVISNMA; QVVAVISNMAE; VVAVISNMAEK; VAVISNMAEKK; AVISNMAEKKS; VISNMAEKKSL; ISNMAEKKSLA; SNMAEKKSLAD; NMAEKKSLADR; MAEKKSLADRF; AEKKSLADRFA; EKKSLADRFAD; KKSLADRFADT; KSLADRFADTL; SLADRFADTLR; LADRFADTLRG; ADRFADTLRGE; DRFADTLRGEV; RFADTLRGEVA; FADTLRGEVAR; ADTLRGEVARR; DTLRGEVARRE; TLRGEVARREM; LRGEVARREML; RGEVARREMLL; | |

Fig. 28 continued

| | | |
|---|---|---|
| | GEVARREMLLR; EVARREMLLRE; VARREMLLREA; ARREMLLREAG; RREMLLREAGR; REMLLREAGRK; EMLLREAGRKV; MLLREAGRKVQ; LLREAGRKVQG; LREAGRKVQGS; REAGRKVQGSA; EAGRKVQGSAF; AGRKVQGSAFN; GRKVQGSAFNS; RKVQGSAFNSV; KVQGSAFNSVL; VQGSAFNSVLE; QGSAFNSVLEY; GSAFNSVLEYE; SAFNSVLEYEN; AFNSVLEYENA; FNSVLEYENAI; NSVLEYENAIA; SVLEYENAIAA; VLEYENAIAAG; LEYENAIAAGH; EYENAIAAGHS; YENAIAAGHSL; ENAIAAGHSLP; NAIAAGHSLPP; AIAAGHSLPPI; IAAGHSLPPIP; AAGHSLPPIPT; AGHSLPPIPTL; GHSLPPIPTLF; HSLPPIPTLFV; SLPPIPTLFVV; LPPIPTLFVVA; PPIPTLFVVAD; PIPTLFVVADE; IPTLFVVADEF; PTLFVVADEFT; TLFVVADEFTL; LFVVADEFTLM; FVVADEFTLML; VVADEFTLMLA; VADEFTLMLAD; ADEFTLMLADH; DEFTLMLADHP; EFTLMLADHPE; FTLMLADHPEY; TLMLADHPEYA; LMLADHPEYAE; MLADHPEYAEL; LADHPEYAELF; ADHPEYAELFD; DHPEYAELFDY; HPEYAELFDYV; PEYAELFDYVA; EYAELFDYVAR; YAELFDYVARK; AELFDYVARKG; ELFDYVARKGR; LFDYVARKGRS; FDYVARKGRSF; DYVARKGRSFR; YVARKGRSFRI; VARKGRSFRIH; ARKGRSFRIHI; RKGRSFRIHIL; KGRSFRIHILF; GRSFRIHILFA; RSFRIHILFAS; SFRIHILFASQ; FRIHILFASQT; RIHILFASQTL; IHILFASQTLD; HILFASQTLDV; ILFASQTLDVG; LFASQTLDVGK; FASQTLDVGKI; ASQTLDVGKIK; SQTLDVGKIKD; QTLDVGKIKDI; TLDVGKIKDID; LDVGKIKDIDK; DVGKIKDIDKN; VGKIKDIDKNT; GKIKDIDKNTA; KIKDIDKNTAY; IKDIDKNTAYR; KDIDKNTAYRI; DIDKNTAYRIG; IDKNTAYRIGL; DKNTAYRIGLK; KNTAYRIGLKV; NTAYRIGLKVA; TAYRIGLKVAS; AYRIGLKVASP; YRIGLKVASPS; RIGLKVASPSV; IGLKVASPSVS; GLKVASPSVSR; LKVASPSVSRQ; KVASPSVSRQI; VASPSVSRQII; ASPSVSRQIIG; SPSVSRQIIGV; PSVSRQIIGVE; SVSRQIIGVED; VSRQIIGVEDA; SRQIIGVEDAY; RQIIGVEDAYH; QIIGVEDAYHI; IIGVEDAYHIE; IGVEDAYHIES; GVEDAYHIESG; VEDAYHIESGK; EDAYHIESGKE; DAYHIESGKEH; AYHIESGKEHK; YHIESGKEHKG; HIESGKEHKGV; IESGKEHKGVG; ESGKEHKGVGF; SGKEHKGVGFL; GKEHKGVGFLV; KEHKGVGFLVP; EHKGVGFLVPA; HKGVGFLVPAP; KGVGFLVPAPG; GVGFLVPAPGA; VGFLVPAPGAT; GFLVPAPGATP; FLVPAPGATPI; LVPAPGATPIR; VPAPGATPIRF; PAPGATPIRFR; APGATPIRFRS; PGATPIRFRST; GATPIRFRSTY; ATPIRFRSTYV; TPIRFRSTYVD; PIRFRSTYVDG; IRFRSTYVDGI; RFRSTYVDGIY; FRSTYVDGIYE; RSTYVDGIYEP; STYVDGIYEPP; TYVDGIYEPPQ; YVDGIYEPPQT; VDGIYEPPQTA; DGIYEPPQTAK; GIYEPPQTAKA; IYEPPQTAKAV; YEPPQTAKAVV; EPPQTAKAVVV; PPQTAKAVVVQ; PQTAKAVVVQS; QTAKAVVVQSV; TAKAVVVQSVP; AKAVVVQSVPE; KAVVVQSVPEP; AVVVQSVPEPK; VVVQSVPEPKL; VVQSVPEPKLF; VQSVPEPKLFT; QSVPEPKLFTA; SVPEPKLFTAA; VPEPKLFTAAA; PEPKLFTAAAV; EPKLFTAAAVE; PKLFTAAAVEP; KLFTAAAVEPD; LFTAAAVEPDP; FTAAAVEPDPG; TAAAVEPDPGT; AAAVEPDPGTV; AAVEPDPGTVI; AVEPDPGTVIA; VEPDPGTVIAD; EPDPGTVIADT; PDPGTVIADTD; DPGTVIADTDE; PGTVIADTDEQ; GTVIADTDEQE; TVIADTDEQEP; VIADTDEQEPA; IADTDEQEPAD; ADTDEQEPADP; DTDEQEPADPP; TDEQEPADPPR; DEQEPADPPRK; EQEPADPPRKL; QEPADPPRKLI; EPADPPRKLIA; PADPPRKLIAT; ADPPRKLIATI; DPPRKLIATIG; PPRKLIATIGE; PRKLIATIGEQ; RKLIATIGEQL; KLIATIGEQLA; LIATIGEQLAR; IATIGEQLARY; ATIGEQLARYG; TIGEQLARYGP; IGEQLARYGPR; | |

Fig. 28 continued

| | | |
|---|---|---|
| | GEQLARYGPRA; EQLARYGPRAP; QLARYGPRAPQ; LARYGPRAPQL; ARYGPRAPQLW; RYGPRAPQLWL; YGPRAPQLWLP; GPRAPQLWLPP; PRAPQLWLPPL; RAPQLWLPPLD; APQLWLPPLDE; PQLWLPPLDET; QLWLPPLDETI; LWLPPLDETIP; WLPPLDETIPL; LPPLDETIPLS; PPLDETIPLSA; PLDETIPLSAA; LDETIPLSAAL; DETIPLSAALA; ETIPLSAALAR; TIPLSAALARA; IPLSAALARAG; PLSAALARAGV; LSAALARAGVG; SAALARAGVGP; AALARAGVGPR; ALARAGVGPRQ; LARAGVGPRQW; ARAGVGPRQWR; RAGVGPRQWRW; AGVGPRQWRWP; GVGPRQWRWPL; VGPRQWRWPLG; GPRQWRWPLGE; PRQWRWPLGEI; RQWRWPLGEID; QWRWPLGEIDR; WRWPLGEIDRP; RWPLGEIDRPF; WPLGEIDRPFE; PLGEIDRPFEM; LGEIDRPFEMR; GEIDRPFEMRR; EIDRPFEMRRD; IDRPFEMRRDP; DRPFEMRRDPL; RPFEMRRDPLV; PFEMRRDPLVF; FEMRRDPLVFD; EMRRDPLVFDA; MRRDPLVFDAR; RRDPLVFDARS; RDPLVFDARSS; DPLVFDARSSA; PLVFDARSSAG; LVFDARSSAGN; VFDARSSAGNM; FDARSSAGNMV; DARSSAGNMVI; ARSSAGNMVIH; RSSAGNMVIHG; SSAGNMVIHGG; SAGNMVIHGGP; AGNMVIHGGPK; GNMVIHGGPKS; NMVIHGGPKSG; MVIHGGPKSGK; VIHGGPKSGKS; IHGGPKSGKST; HGGPKSGKSTA; GGPKSGKSTAL; GPKSGKSTALQ; PKSGKSTALQT; KSGKSTALQTF; SGKSTALQTFI; GKSTALQTFIL; KSTALQTFILS; STALQTFILSA; TALQTFILSAA; ALQTFILSAAS; LQTFILSAASL; QTFILSAASLH; TFILSAASLHS; FILSAASLHSP; ILSAASLHSPH; LSAASLHSPHE; SAASLHSPHEV; AASLHSPHEVS; ASLHSPHEVSF; SLHSPHEVSFY; LHSPHEVSFYC; HSPHEVSFYCL; SPHEVSFYCLD; PHEVSFYCLDY; HEVSFYCLDYG; EVSFYCLDYGG; VSFYCLDYGGG; SFYCLDYGGGQ; FYCLDYGGGQL; YCLDYGGGQLR; CLDYGGGQLRA; LDYGGGQLRAL; DYGGGQLRALQ; YGGGQLRALQD; GGGQLRALQDL; GGQLRALQDLA; GQLRALQDLAH; QLRALQDLAHV; LRALQDLAHVG; RALQDLAHVGS; ALQDLAHVGSV; LQDLAHVGSVA; QDLAHVGSVAS; DLAHVGSVASA; LAHVGSVASAL; AHVGSVASALE; HVGSVASALEP; VGSVASALEPE; GSVASALEPER; SVASALEPERI; VASALEPERIR; ASALEPERIRR; SALEPERIRRT; ALEPERIRRTF; LEPERIRRTFG; EPERIRRTFGE; PERIRRTFGEL; ERIRRTFGELE; RIRRTFGELEQ; IRRTFGELEQL; RRTFGELEQLL; RTFGELEQLLL; TFGELEQLLLS; FGELEQLLLSR; GELEQLLLSRQ; ELEQLLLSRQQ; LEQLLLSRQQR; EQLLLSRQQRE; QLLLSRQQREV; LLLSRQQREVF; LLSRQQREVFR; LSRQQREVFRD; SRQQREVFRDR; RQQREVFRDRG; QQREVFRDRGA; QREVFRDRGAN; REVFRDRGANG; EVFRDRGANGS; VFRDRGANGST; FRDRGANGSTP; RDRGANGSTPD; DRGANGSTPDD; RGANGSTPDDG; GANGSTPDDGF; ANGSTPDDGFG; NGSTPDDGFGE; GSTPDDGFGEV; STPDDGFGEVF; TPDDGFGEVFL; PDDGFGEVFLV; DDGFGEVFLVI; DGFGEVFLVID; GFGEVFLVIDN; FGEVFLVIDNL; GEVFLVIDNLY; EVFLVIDNLYG; VFLVIDNLYGF; FLVIDNLYGFG; LVIDNLYGFGR; VIDNLYGFGRD; IDNLYGFGRDN; DNLYGFGRDNT; NLYGFGRDNTD; LYGFGRDNTDQ; YGFGRDNTDQF; GFGRDNTDQFN; FGRDNTDQFNT; GRDNTDQFNTR; RDNTDQFNTRN; DNTDQFNTRNP; NTDQFNTRNPL; TDQFNTRNPLL; DQFNTRNPLLA; QFNTRNPLLAR; FNTRNPLLARV; NTRNPLLARVT; TRNPLLARVTE; RNPLLARVTEL; NPLLARVTELV; PLLARVTELVN; LLARVTELVNV; LARVTELVNVG; ARVTELVNVGL; RVTELVNVGLA; | |

Fig. 28 continued

| | | |
|---|---|---|
| | VTELVNVGLAY; TELVNVGLAYG; ELVNVGLAYGI; LVNVGLAYGIH;<br>VNVGLAYGIHV; NVGLAYGIHVI; VGLAYGIHVII; GLAYGIHVIIT;<br>LAYGIHVIITT; AYGIHVIITTP; YGIHVIITTPS; GIHVIITTPSW;<br>IHVIITTPSWL; HVIITTPSWLE; VIITTPSWLEV; IITTPSWLEVP;<br>ITTPSWLEVPL; TTPSWLEVPLA; TPSWLEVPLAM; PSWLEVPLAMR;<br>SWLEVPLAMRD; WLEVPLAMRDG; LEVPLAMRDGL;<br>EVPLAMRDGLG; VPLAMRDGLGL; PLAMRDGLGLR; LAMRDGLGLRL;<br>AMRDGLGLRLE; MRDGLGLRLEL; RDGLGLRLELR; DGLGLRLELRL;<br>GLGLRLELRLH; LGLRLELRLHD; GLRLELRLHDA; LRLELRLHDAR;<br>RLELRLHDARD; LELRLHDARDS; ELRLHDARDSN; LRLHDARDSNV;<br>RLHDARDSNVR; LHDARDSNVRV; HDARDSNVRVV;<br>DARDSNVRVVG; ARDSNVRVVGA; RDSNVRVVGAL;<br>DSNVRVVGALR; SNVRVVGALRR; NVRVVGALRRP; VRVVGALRRPA;<br>RVVGALRRPAD; VVGALRRPADA; VGALRRPADAV; GALRRPADAVP;<br>ALRRPADAVPH; LRRPADAVPHD; RRPADAVPHDQ;<br>RPADAVPHDQP; PADAVPHDQPG; ADAVPHDQPGR;<br>DAVPHDQPGRG; AVPHDQPGRGL; VPHDQPGRGLT;<br>PHDQPGRGLTM; HDQPGRGLTMA; DQPGRGLTMAA;<br>QPGRGLTMAAE; PGRGLTMAAEH; GRGLTMAAEHF;<br>RGLTMAAEHFL; GLTMAAEHFLF; LTMAAEHFLFA; TMAAEHFLFAA;<br>MAAEHFLFAAP; AAEHFLFAAPE; AEHFLFAAPEL; EHFLFAAPELD;<br>HFLFAAPELDA; FLFAAPELDAQ; LFAAPELDAQT; FAAPELDAQTN;<br>AAPELDAQTNP; APELDAQTNPV; PELDAQTNPVA; ELDAQTNPVAA;<br>LDAQTNPVAAI; DAQTNPVAAIN; AQTNPVAAINA; QTNPVAAINAR;<br>TNPVAAINARY; NPVAAINARYP; PVAAINARYPG; VAAINARYPGM;<br>AAINARYPGMA; AINARYPGMAA; INARYPGMAAP; NARYPGMAAPP;<br>ARYPGMAAPPV; RYPGMAAPPVR; YPGMAAPPVRL;<br>PGMAAPPVRLL; GMAAPPVRLLP; MAAPPVRLLPT; AAPPVRLLPTN;<br>APPVRLLPTNL; PPVRLLPTNLA; PVRLLPTNLAP; VRLLPTNLAPH;<br>RLLPTNLAPHA; LLPTNLAPHAV; LPTNLAPHAVG; PTNLAPHAVGE;<br>TNLAPHAVGEL; NLAPHAVGELY; LAPHAVGELYR; APHAVGELYRG;<br>PHAVGELYRGP; HAVGELYRGPD; AVGELYRGPDQ;<br>VGELYRGPDQL; GELYRGPDQLV; ELYRGPDQLVI; LYRGPDQLVIG;<br>YRGPDQLVIGQ; RGPDQLVIGQR; GPDQLVIGQRE; PDQLVIGQREE;<br>DQLVIGQREED; QLVIGQREEDL; LVIGQREEDLA; VIGQREEDLAP;<br>IGQREEDLAPV; GQREEDLAPVI; QREEDLAPVIL; REEDLAPVILD;<br>EEDLAPVILDL; EDLAPVILDLA; DLAPVILDLAA; LAPVILDLAAN;<br>APVILDLAANP; PVILDLAANPL; VILDLAANPLL; ILDLAANPLLM;<br>LDLAANPLLMV; DLAANPLLMVF; LAANPLLMVFG; AANPLLMVFGD;<br>ANPLLMVFGDA; NPLLMVFGDAR; PLLMVFGDARS; LLMVFGDARSG;<br>LMVFGDARSGK; MVFGDARSGKT; VFGDARSGKTT;<br>FGDARSGKTTL; GDARSGKTTLL; DARSGKTTLLR; ARSGKTTLLRH;<br>RSGKTTLLRHI; SGKTTLLRHII; GKTTLLRHIIR; KTTLLRHIIRT;<br>TTLLRHIIRTV; TLLRHIIRTVR; LLRHIIRTVRE; LRHIIRTVREH;<br>RHIIRTVREHS; HIIRTVREHST; IIRTVREHSTA; IRTVREHSTAD;<br>RTVREHSTADR; TVREHSTADRV; VREHSTADRVA; REHSTADRVAF;<br>EHSTADRVAFT; HSTADRVAFTV; STADRVAFTVL; TADRVAFTVLD;<br>ADRVAFTVLDR; DRVAFTVLDRR; RVAFTVLDRRL; VAFTVLDRRLH;<br>AFTVLDRRLHL; FTVLDRRLHLV; TVLDRRLHLVD; VLDRRLHLVDE;<br>LDRRLHLVDEP; DRRLHLVDEPL; RRLHLVDEPLF; RLHLVDEPLFP;<br>LHLVDEPLFPD; HLVDEPLFPDN; LVDEPLFPDNE; VDEPLFPDNEY;<br>DEPLFPDNEYT; EPLFPDNEYTA; PLFPDNEYTAN; LFPDNEYTANI;<br>FPDNEYTANID; PDNEYTANIDR; DNEYTANIDRI; NEYTANIDRII; | |

Fig. 28 continued

| | | |
|---|---|---|
| | EYTANIDRIIP; YTANIDRIIPA; TANIDRIIPAM; ANIDRIIPAML; NIDRIIPAMLG; IDRIIPAMLGL; DRIIPAMLGLA; RIIPAMLGLAN; IIPAMLGLANL; IPAMLGLANLI; PAMLGLANLIE; AMLGLANLIEA; MLGLANLIEAR; LGLANLIEARR; GLANLIEARRP; LANLIEARRPP; ANLIEARRPPA; NLIEARRPPAG; LIEARRPPAGM; IEARRPPAGMS; EARRPPAGMSA; ARRPPAGMSAA; RRPPAGMSAAE; RPPAGMSAAEL; PPAGMSAAELS; PAGMSAAELSR; AGMSAAELSRW; GMSAAELSRWT; MSAAELSRWTF; SAAELSRWTFA; AAELSRWTFAG; AELSRWTFAGH; ELSRWTFAGHT; LSRWTFAGHTH; SRWTFAGHTHY; RWTFAGHTHYL; WTFAGHTHYLI; TFAGHTHYLII; FAGHTHYLIID; AGHTHYLIIDD; GHTHYLIIDDV; HTHYLIIDDVD; THYLIIDDVDQ; HYLIIDDVDQV; YLIIDDVDQVP; LIIDDVDQVPD; IIDDVDQVPDS; IDDVDQVPDSP; DDVDQVPDSPA; DVDQVPDSPAM; VDQVPDSPAMT; DQVPDSPAMTG; QVPDSPAMTGP; VPDSPAMTGPY; PDSPAMTGPYI; DSPAMTGPYIG; SPAMTGPYIGQ; PAMTGPYIGQR; AMTGPYIGQRP; MTGPYIGQRPW; TGPYIGQRPWT; GPYIGQRPWTP; PYIGQRPWTPL; YIGQRPWTPLI; IGQRPWTPLIG; GQRPWTPLIGL; QRPWTPLIGLL; RPWTPLIGLLA; PWTPLIGLLAQ; WTPLIGLLAQA; TPLIGLLAQAG; PLIGLLAQAGD; LIGLLAQAGDL; IGLLAQAGDLG; GLLAQAGDLGL; LLAQAGDLGLR; LAQAGDLGLRV; AQAGDLGLRVI; QAGDLGLRVIV; AGDLGLRVIVT; GDLGLRVIVTG; DLGLRVIVTGR; LGLRVIVTGRA; GLRVIVTGRAT; LRVIVTGRATG; RVIVTGRATGS; VIVTGRATGSA; IVTGRATGSAH; VTGRATGSAHL; TGRATGSAHLL; GRATGSAHLLM; RATGSAHLLMT; ATGSAHLLMTS; TGSAHLLMTSP; GSAHLLMTSPL; SAHLLMTSPLL; AHLLMTSPLLR; HLLMTSPLLRR; LLMTSPLLRRF; LMTSPLLRRFN; MTSPLLRRFND; TSPLLRRFNDL; SPLLRRFNDLQ; PLLRRFNDLQA; LLRRFNDLQAT; LRRFNDLQATT; RRFNDLQATTL; RFNDLQATTLM; FNDLQATTLML; NDLQATTLMLA; DLQATTLMLAG; LQATTLMLAGN; QATTLMLAGNP; ATTLMLAGNPA; TTLMLAGNPAD; TLMLAGNPADS; LMLAGNPADSG; MLAGNPADSGK; LAGNPADSGKI; AGNPADSGKIR; GNPADSGKIRG; NPADSGKIRGE; PADSGKIRGER; ADSGKIRGERF; DSGKIRGERFA; SGKIRGERFAR; GKIRGERFARL; KIRGERFARLP; IRGERFARLPA; RGERFARLPAG; GERFARLPAGR; ERFARLPAGRA; RFARLPAGRAI; FARLPAGRAIL; ARLPAGRAILL; RLPAGRAILLT; LPAGRAILLTD; PAGRAILLTDS; AGRAILLTDSD; GRAILLTDSDS; RAILLTDSDSP; AILLTDSDSPT; ILLTDSDSPTY; LLTDSDSPTYV; LTDSDSPTYVQ; TDSDSPTYVQL; DSDSPTYVQLI; SDSPTYVQLIN; DSPTYVQLINP; SPTYVQLINPL; PTYVQLINPLV; TYVQLINPLVD; YVQLINPLVDA; VQLINPLVDAA; QLINPLVDAAA; LINPLVDAAAV; INPLVDAAAVS; NPLVDAAAVSG; PLVDAAAVSGE; LVDAAAVSGET; VDAAAVSGETQ; DAAAVSGETQQ; AAAVSGETQQK; AAVSGETQQKG; AVSGETQQKGS; VSGETQQKGSQ; SGETQQKGSQS | |
| 5) Rv0285 | 8 mers:<br>MTLRVVPE; TLRVVPEG; LRVVPEGL; RVVPEGLA; VVPEGLAA; VPEGLAAA; PEGLAAAS; EGLAAASA; GLAAASAA; LAAASAAV; AAASAAVE; AASAAVEA; ASAAVEAL; SAAVEALT; AAVEALTA; AVEALTAR; VEALTARL; EALTARLA; ALTARLAA; LTARLAAA; TARLAAAH; ARLAAAHA; RLAAAHAS; LAAAHASA; AAAHASAA; AAHASAAP; AHASAAPV; HASAAPVI; ASAAPVIT; SAAPVITA; AAPVITAV; APVITAVV; PVITAVVP; VITAVVPP; ITAVVPPA; | 7329-7702 |

Fig. 28 continued

| | | | |
|---|---|---|---|
| | TAVVPPAA; AVVPPAAD; VVPPAADP; VPPAADPV; PPAADPVS; PAADPVSL; AADPVSLQ; ADPVSLQT; DPVSLQTA; PVSLQTAA; VSLQTAAG; SLQTAAGF; LQTAAGFS; QTAAGFSA; TAAGFSAQ; AAGFSAQG; AGFSAQGV; GFSAQGVE; FSAQGVEH; SAQGVEHA; AQGVEHAV; QGVEHAVV; GVEHAVVT; VEHAVVTA; EHAVVTAE; HAVVTAEG; AVVTAEGV; VVTAEGVE; VTAEGVEE; TAEGVEEL; AEGVEELG; EGVEELGR; GVEELGRA; VEELGRAG; EELGRAGV; ELGRAGVG; LGRAGVGV; GRAGVGVG; RAGVGVGE; AGVGVGES; GVGVGESG; VGVGESGA; GVGESGAS; VGESGASY; GESGASYL; ESGASYLA; SGASYLAG; GASYLAGD; ASYLAGDA; SYLAGDAA; YLAGDAAA; LAGDAAAA; AGDAAAAA; GDAAAAAT; DAAAAATY; AAAAATYG; AAAATYGV; AAATYGVV; AATYGVVG; ATYGVVGG<br><br>9 mers:<br>MTLRVVPEG; TLRVVPEGL; LRVVPEGLA; RVVPEGLAA; VVPEGLAAA; VPEGLAAAS; PEGLAAASA; EGLAAASAA; GLAAASAAV; LAAASAAVE; AAASAAVEA; AASAAVEAL; ASAAVEALT; SAAVEALTA; AAVEALTAR; AVEALTARL; VEALTARLA; EALTARLAA; ALTARLAAA; LTARLAAAH; TARLAAAHA; ARLAAAHAS; RLAAAHASA; LAAAHASAA; AAAHASAAP; AAHASAAPV; AHASAAPVI; HASAAPVIT; ASAAPVITA; SAAPVITAV; AAPVITAVV; APVITAVVP; PVITAVVPP; VITAVVPPA; ITAVVPPAA; TAVVPPAAD; AVVPPAADP; VVPPAADPV; VPPAADPVS; PPAADPVSL; PAADPVSLQ; AADPVSLQT; ADPVSLQTA; DPVSLQTAA; PVSLQTAAG; VSLQTAAGF; SLQTAAGFS; LQTAAGFSA; QTAAGFSAQ; TAAGFSAQG; AAGFSAQGV; AGFSAQGVE; GFSAQGVEH; FSAQGVEHA; SAQGVEHAV; AQGVEHAVV; QGVEHAVVT; GVEHAVVTA; VEHAVVTAE; EHAVVTAEG; HAVVTAEGV; AVVTAEGVE; VVTAEGVEE; VTAEGVEEL; TAEGVEELG; AEGVEELGR; EGVEELGRA; GVEELGRAG; VEELGRAGV; EELGRAGVG; ELGRAGVGV; LGRAGVGVG; GRAGVGVGE; RAGVGVGES; AGVGVGESG; GVGVGESGA; VGVGESGAS; GVGESGASY; VGESGASYL; GESGASYLA; ESGASYLAG; SGASYLAGD; GASYLAGDA; ASYLAGDAA; SYLAGDAAA; YLAGDAAAA; LAGDAAAAA; AGDAAAAAT; GDAAAAATY; DAAAAATYG; AAAAATYGV; AAAATYGVV; AAATYGVVG; AATYGVVGG<br><br>10 mers:<br>MTLRVVPEGL; TLRVVPEGLA; LRVVPEGLAA; RVVPEGLAAA; VVPEGLAAAS; VPEGLAAASA; PEGLAAASAA; EGLAAASAAV; GLAAASAAVE; LAAASAAVEA; AAASAAVEAL; AASAAVEALT; ASAAVEALTA; SAAVEALTAR; AAVEALTARL; AVEALTARLA; VEALTARLAA; EALTARLAAA; ALTARLAAAH; LTARLAAAHA; TARLAAAHAS; ARLAAAHASA; RLAAAHASAA; LAAAHASAAP; AAAHASAAPV; AAHASAAPVI; AHASAAPVIT; HASAAPVITA; ASAAPVITAV; SAAPVITAVV; AAPVITAVVP; APVITAVVPP; PVITAVVPPA; VITAVVPPAA; ITAVVPPAAD; TAVVPPAADP; AVVPPAADPV; VVPPAADPVS; VPPAADPVSL; PPAADPVSLQ; PAADPVSLQT; AADPVSLQTA; ADPVSLQTAA; DPVSLQTAAG; PVSLQTAAGF; VSLQTAAGFS; SLQTAAGFSA; LQTAAGFSAQ; QTAAGFSAQG; TAAGFSAQGV; AAGFSAQGVE; AGFSAQGVEH; GFSAQGVEHA; FSAQGVEHAV; SAQGVEHAVV; AQGVEHAVVT; QGVEHAVVTA; GVEHAVVTAE; VEHAVVTAEG; EHAVVTAEGV; | |

Fig. 28 continued

| | | |
|---|---|---|
| | HAVVTAEGVE; AVVTAEGVEE; VVTAEGVEEL; VTAEGVEELG; TAEGVEELGR; AEGVEELGRA; EGVEELGRAG; GVEELGRAGV; VEELGRAGVG; EELGRAGVGV; ELGRAGVGVG; LGRAGVGVGE; GRAGVGVGES; RAGVGVGESG; AGVGVGESGA; GVGVGESGAS; VGVGESGASY; GVGESGASYL; VGESGASYLA; GESGASYLAG; ESGASYLAGD; SGASYLAGDA; GASYLAGDAA; ASYLAGDAAA; SYLAGDAAAA; YLAGDAAAAA; LAGDAAAAAT; AGDAAAAATY; GDAAAAATYG; DAAAAATYGV; AAAAATYGVV; AAAATYGVVG; AAATYGVVGG;<br><br>11 mers:<br>MTLRVVPEGLA; TLRVVPEGLAA; LRVVPEGLAAA; RVVPEGLAAAS; VVPEGLAAASA; VPEGLAAASAA; PEGLAAASAAV; EGLAAASAAVE; GLAAASAAVEA; LAAASAAVEAL; AAASAAVEALT; AASAAVEALTA; ASAAVEALTAR; SAAVEALTARL; AAVEALTARLA; AVEALTARLAA; VEALTARLAAA; EALTARLAAAH; ALTARLAAAHA; LTARLAAAHAS; TARLAAAHASA; ARLAAAHASAA; RLAAAHASAAP; LAAAHASAAPV; AAAHASAAPVI; AAHASAAPVIT; AHASAAPVITA; HASAAPVITAV; ASAAPVITAVV; SAAPVITAVVP; AAPVITAVVPP; APVITAVVPPA; PVITAVVPPAA; VITAVVPPAAD; ITAVVPPAADP; TAVVPPAADPV; AVVPPAADPVS; VVPPAADPVSL; VPPAADPVSLQ; PPAADPVSLQT; PAADPVSLQTA; AADPVSLQTAA; ADPVSLQTAAG; DPVSLQTAAGF; PVSLQTAAGFS; VSLQTAAGFSA; SLQTAAGFSAQ; LQTAAGFSAQG; QTAAGFSAQGV; TAAGFSAQGVE; AAGFSAQGVEH; AGFSAQGVEHA; GFSAQGVEHAV; FSAQGVEHAVV; SAQGVEHAVVT; AQGVEHAVVTA; QGVEHAVVTAE; GVEHAVVTAEG; VEHAVVTAEGV; EHAVVTAEGVE; HAVVTAEGVEE; AVVTAEGVEEL; VVTAEGVEELG; VTAEGVEELGR; TAEGVEELGRA; AEGVEELGRAG; EGVEELGRAGV; GVEELGRAGVG; VEELGRAGVGV; EELGRAGVGVG; ELGRAGVGVGE; LGRAGVGVGES; GRAGVGVGESG; RAGVGVGESGA; AGVGVGESGAS; GVGVGESGASY; VGVGESGASYL; GVGESGASYLA; VGESGASYLAG; GESGASYLAGD; ESGASYLAGDA; SGASYLAGDAA; GASYLAGDAAA; ASYLAGDAAAA; SYLAGDAAAAA; YLAGDAAAAAT; LAGDAAAAATY; AGDAAAAATYG; GDAAAAATYGV; DAAAAATYGVV; AAAAATYGVVG; AAAATYGVVGG; | |
| 6) Rv0287 | 8 mers:<br>MSLLDAHI; SLLDAHIP; LLDAHIPQ; LDAHIPQL; DAHIPQLV; AHIPQLVA; HIPQLVAS; IPQLVASQ; PQLVASQS; QLVASQSA; LVASQSAF; VASQSAFA; ASQSAFAA; SQSAFAAK; QSAFAAKA; SAFAAKAG; AFAAKAGL; FAAKAGLM; AAKAGLMR; AKAGLMRH; KAGLMRHT; AGLMRHTI; GLMRHTIG; LMRHTIGQ; MRHTIGQA; RHTIGQAE; HTIGQAEQ; TIGQAEQA; IGQAEQAA; GQAEQAAM; QAEQAAMS; AEQAAMSA; EQAAMSAQ; QAAMSAQA; AAMSAQAF; AMSAQAFH; MSAQAFHQ; SAQAFHQG; AQAFHQGE; QAFHQGES; AFHQGESS; FHQGESSA; HQGESSAA; QGESSAAF; GESSAAFQ; ESSAAFQA; SSAAFQAA; SAAFQAAH; AAFQAAHA; AFQAAHAR; FQAAHARF; QAAHARFV; AAHARFVA; AHARFVAA; HARFVAAA; ARFVAAAA; RFVAAAAK; FVAAAAKV; VAAAAKVN; AAAAKVNT; AAAKVNTL; AAKVNTLL; AKVNTLLD; KVNTLLDV; VNTLLDVA; NTLLDVAQ; TLLDVAQA; LLDVAQAN; LDVAQANL; DVAQANLG; VAQANLGE; AQANLGEA; QANLGEAA; ANLGEAAG; NLGEAAGT; | 7703-8056 |

Fig. 28 continued

| | | |
|---|---|---|
| | LGEAAGTY; GEAAGTYV; EAAGTYVA; AAGTYVAA; AGTYVAAD; GTYVAADA; TYVAADAA; YVAADAAA; VAADAAAA; AADAAAAS; ADAAAAST; DAAAASTY; AAAASTYT; AAASTYTG; AASTYTGF<br><br>9 mers:<br>MSLLDAHIP; SLLDAHIPQ; LLDAHIPQL; LDAHIPQLV; DAHIPQLVA; AHIPQLVAS; HIPQLVASQ; IPQLVASQS; PQLVASQSA; QLVASQSAF; LVASQSAFA; VASQSAFAA; ASQSAFAAK; SQSAFAAKA; QSAFAAKAG; SAFAAKAGL; AFAAKAGLM; FAAKAGLMR; AAKAGLMRH; AKAGLMRHT; KAGLMRHTI; AGLMRHTIG; GLMRHTIGQ; LMRHTIGQA; MRHTIGQAE; RHTIGQAEQ; HTIGQAEQA; TIGQAEQAA; IGQAEQAAM; GQAEQAAMS; QAEQAAMSA; AEQAAMSAQ; EQAAMSAQA; QAAMSAQAF; AAMSAQAFH; AMSAQAFHQ; MSAQAFHQG; SAQAFHQGE; AQAFHQGES; QAFHQGESS; AFHQGESSA; FHQGESSAA; HQGESSAAF; QGESSAAFQ; GESSAAFQA; ESSAAFQAA; SSAAFQAAH; SAAFQAAHA; AAFQAAHAR; AFQAAHARF; FQAAHARFV; QAAHARFVA; AAHARFVAA; AHARFVAAA; HARFVAAAA; ARFVAAAAK; RFVAAAAKV; FVAAAAKVN; VAAAAKVNT; AAAAKVNTL; AAAKVNTLL; AAKVNTLLD; AKVNTLLDV; KVNTLLDVA; VNTLLDVAQ; NTLLDVAQA; TLLDVAQAN; LLDVAQANL; LDVAQANLG; DVAQANLGE; VAQANLGEA; AQANLGEAA; QANLGEAAG; ANLGEAAGT; NLGEAAGTY; LGEAAGTYV; GEAAGTYVA; EAAGTYVAA; AAGTYVAAD; AGTYVAADA; GTYVAADAA; TYVAADAAA; YVAADAAAA; VAADAAAAS; AADAAAAST; ADAAAASTY; DAAAASTYT; AAAASTYTG; AAASTYTGF<br><br>10 mers:<br>MSLLDAHIPQ; SLLDAHIPQL; LLDAHIPQLV; LDAHIPQLVA; DAHIPQLVAS; AHIPQLVASQ; HIPQLVASQS; IPQLVASQSA; PQLVASQSAF; QLVASQSAFA; LVASQSAFAA; VASQSAFAAK; ASQSAFAAKA; SQSAFAAKAG; QSAFAAKAGL; SAFAAKAGLM; AFAAKAGLMR; FAAKAGLMRH; AAKAGLMRHT; AKAGLMRHTI; KAGLMRHTIG; AGLMRHTIGQ; GLMRHTIGQA; LMRHTIGQAE; MRHTIGQAEQ; RHTIGQAEQA; HTIGQAEQAA; TIGQAEQAAM; IGQAEQAAMS; GQAEQAAMSA; QAEQAAMSAQ; AEQAAMSAQA; EQAAMSAQAF; QAAMSAQAFH; AAMSAQAFHQ; AMSAQAFHQG; MSAQAFHQGE; SAQAFHQGES; AQAFHQGESS; QAFHQGESSA; AFHQGESSAA; FHQGESSAAF; HQGESSAAFQ; QGESSAAFQA; GESSAAFQAA; ESSAAFQAAH; SSAAFQAAHA; SAAFQAAHAR; AAFQAAHARF; AFQAAHARFV; FQAAHARFVA; QAAHARFVAA; AAHARFVAAA; AHARFVAAAA; HARFVAAAAK; ARFVAAAAKV; RFVAAAAKVN; FVAAAAKVNT; VAAAAKVNTL; AAAAKVNTLL; AAAKVNTLLD; AAKVNTLLDV; AKVNTLLDVA; KVNTLLDVAQ; VNTLLDVAQA; NTLLDVAQAN; TLLDVAQANL; LLDVAQANLG; LDVAQANLGE; DVAQANLGEA; VAQANLGEAA; AQANLGEAAG; QANLGEAAGT; ANLGEAAGTY; NLGEAAGTYV; LGEAAGTYVA; GEAAGTYVAA; EAAGTYVAAD; AAGTYVAADA; AGTYVAADAA; GTYVAADAAA; TYVAADAAAA; YVAADAAAAS; VAADAAAAST; AADAAAASTY; ADAAAASTYT; DAAAASTYTG; AAAASTYTGF<br><br>11 mers:<br>MSLLDAHIPQL; SLLDAHIPQLV; LLDAHIPQLVA; LDAHIPQLVAS; | |

Fig. 28 continued

| | | |
|---|---|---|
| | DAHIPQLVASQ; AHIPQLVASQS; HIPQLVASQSA; IPQLVASQSAF; PQLVASQSAFA; QLVASQSAFAA; LVASQSAFAAK; VASQSAFAAKA; ASQSAFAAKAG; SQSAFAAKAGL; QSAFAAKAGLM; SAFAAKAGLMR; AFAAKAGLMRH; FAAKAGLMRHT; AAKAGLMRHTI; AKAGLMRHTIG; KAGLMRHTIGQ; AGLMRHTIGQA; GLMRHTIGQAE; LMRHTIGQAEQ; MRHTIGQAEQA; RHTIGQAEQAA; HTIGQAEQAAM; TIGQAEQAAMS; IGQAEQAAMSA; GQAEQAAMSAQ; QAEQAAMSAQA; AEQAAMSAQAF; EQAAMSAQAFH; QAAMSAQAFHQ; AAMSAQAFHQG; AMSAQAFHQGE; MSAQAFHQGES; SAQAFHQGESS; AQAFHQGESSA; QAFHQGESSAA; AFHQGESSAAF; FHQGESSAAFQ; HQGESSAAFQA; QGESSAAFQAA; GESSAAFQAAH; ESSAAFQAAHA; SSAAFQAAHAR; SAAFQAAHARF; AAFQAAHARFV; AFQAAHARFVA; FQAAHARFVAA; QAAHARFVAAA; AAHARFVAAAA; AHARFVAAAAK; HARFVAAAAKV; ARFVAAAAKVN; RFVAAAAKVNT; FVAAAAKVNTL; VAAAAKVNTLL; AAAAKVNTLLD; AAAKVNTLLDV; AAKVNTLLDVA; AKVNTLLDVAQ; KVNTLLDVAQA; VNTLLDVAQAN; NTLLDVAQANL; TLLDVAQANLG; LLDVAQANLGE; LDVAQANLGEA; DVAQANLGEAA; VAQANLGEAAG; AQANLGEAAGT; QANLGEAAGTY; ANLGEAAGTYV; NLGEAAGTYVA; LGEAAGTYVAA; GEAAGTYVAAD; EAAGTYVAADA; AAGTYVAADAA; AGTYVAADAAA; GTYVAADAAAA; TYVAADAAAAS; YVAADAAAAST; VAADAAAASTY; AADAAAASTYT; ADAAAASTYTG; DAAAASTYTGF | |
| 7) Rv0288 | 8 mers:<br>MSQIMYNY; SQIMYNYP; QIMYNYPA; IMYNYPAM; MYNYPAML; YNYPAMLG; NYPAMLGH; YPAMLGHA; PAMLGHAG; AMLGHAGD; MLGHAGDM; LGHAGDMA; GHAGDMAG; HAGDMAGY; AGDMAGYA; GDMAGYAG; DMAGYAGT; MAGYAGTL; AGYAGTLQ; GYAGTLQS; YAGTLQSL; AGTLQSLG; GTLQSLGA; TLQSLGAE; LQSLGAEI; QSLGAEIA; SLGAEIAV; LGAEIAVE; GAEIAVEQ; AEIAVEQA; EIAVEQAA; IAVEQAAL; AVEQAALQ; VEQAALQS; EQAALQSA; QAALQSAW; AALQSAWQ; ALQSAWQG; LQSAWQGD; QSAWQGDT; SAWQGDTG; AWQGDTGI; WQGDTGIT; QGDTGITY; GDTGITYQ; DTGITYQA; TGITYQAW; GITYQAWQ; ITYQAWQA; TYQAWQAQ; YQAWQAQW; QAWQAQWN; AWQAQWNQ; WQAQWNQA; QAQWNQAM; AQWNQAME; QWNQAMED; WNQAMEDL; NQAMEDLV; QAMEDLVR; AMEDLVRA; MEDLVRAY; EDLVRAYH; DLVRAYHA; LVRAYHAM; VRAYHAMS; RAYHAMSS; AYHAMSST; YHAMSSTH; HAMSSTHE; AMSSTHEA; MSSTHEAN; SSTHEANT; STHEANTM; THEANTMA; HEANTMAM; EANTMAMM; ANTMAMMA; NTMAMMAR; TMAMMARD; MAMMARDT; AMMARDTA; MMARDTAE; MARDTAEA; ARDTAEAA; RDTAEAAK; DTAEAAKW; TAEAAKWG; AEAAKWGG;<br><br>9 mers:<br>MSQIMYNYP; SQIMYNYPA; QIMYNYPAM; IMYNYPAML; MYNYPAMLG; YNYPAMLGH; NYPAMLGHA; YPAMLGHAG; PAMLGHAGD; AMLGHAGDM; MLGHAGDMA; LGHAGDMAG; GHAGDMAGY; HAGDMAGYA; AGDMAGYAG; GDMAGYAGT; DMAGYAGTL; MAGYAGTLQ; AGYAGTLQS; GYAGTLQSL; YAGTLQSLG; AGTLQSLGA; GTLQSLGAE; TLQSLGAEI; LQSLGAEIA; QSLGAEIAV; SLGAEIAVE; LGAEIAVEQ; GAEIAVEQA; AEIAVEQAA; EIAVEQAAL; IAVEQAALQ; AVEQAALQS; VEQAALQSA; | 8057-8406 |

Fig. 28 continued

| | | |
|---|---|---|
| | EQAALQSAW; QAALQSAWQ; AALQSAWQG; ALQSAWQGD; LQSAWQGDT; QSAWQGDTG; SAWQGDTGI; AWQGDTGIT; WQGDTGITY; QGDTGITYQ; GDTGITYQA; DTGITYQAW; TGITYQAWQ; GITYQAWQA; ITYQAWQAQ; TYQAWQAQW; YQAWQAQWN; QAWQAQWNQ; AWQAQWNQA; WQAQWNQAM; QAQWNQAME; AQWNQAMED; QWNQAMEDL; WNQAMEDLV; NQAMEDLVR; QAMEDLVRA; AMEDLVRAY; MEDLVRAYH; EDLVRAYHA; DLVRAYHAM; LVRAYHAMS; VRAYHAMSS; RAYHAMSST; AYHAMSSTH; YHAMSSTHE; HAMSSTHEA; AMSSTHEAN; MSSTHEANT; SSTHEANTM; STHEANTMA; THEANTMAM; HEANTMAMM; EANTMAMMA; ANTMAMMAR; NTMAMMARD; TMAMMARDT; MAMMARDTA; AMMARDTAE; MMARDTAEA; MARDTAEAA; ARDTAEAAK; RDTAEAAKW; DTAEAAKWG; TAEAAKWGG;<br><br>10 mers:<br>MSQIMYNYPA; SQIMYNYPAM; QIMYNYPAML; IMYNYPAMLG; MYNYPAMLGH; YNYPAMLGHA; NYPAMLGHAG; YPAMLGHAGD; PAMLGHAGDM; AMLGHAGDMA; MLGHAGDMAG; LGHAGDMAGY; GHAGDMAGYA; HAGDMAGYAG; AGDMAGYAGT; GDMAGYAGTL; DMAGYAGTLQ; MAGYAGTLQS; AGYAGTLQSL; GYAGTLQSLG; YAGTLQSLGA; AGTLQSLGAE; GTLQSLGAEI; TLQSLGAEIA; LQSLGAEIAV; QSLGAEIAVE; SLGAEIAVEQ; LGAEIAVEQA; GAEIAVEQAA; AEIAVEQAAL; EIAVEQAALQ; IAVEQAALQS; AVEQAALQSA; VEQAALQSAW; EQAALQSAWQ; QAALQSAWQG; AALQSAWQGD; ALQSAWQGDT; LQSAWQGDTG; QSAWQGDTGI; SAWQGDTGIT; AWQGDTGITY; WQGDTGITYQ; QGDTGITYQA; GDTGITYQAW; DTGITYQAWQ; TGITYQAWQA; GITYQAWQAQ; ITYQAWQAQW; TYQAWQAQWN; YQAWQAQWNQ; QAWQAQWNQA; AWQAQWNQAM; WQAQWNQAME; QAQWNQAMED; AQWNQAMEDL; QWNQAMEDLV; WNQAMEDLVR; NQAMEDLVRA; QAMEDLVRAY; AMEDLVRAYH; MEDLVRAYHA; EDLVRAYHAM; DLVRAYHAMS; LVRAYHAMSS; VRAYHAMSST; RAYHAMSSTH; AYHAMSSTHE; YHAMSSTHEA; HAMSSTHEAN; AMSSTHEANT; MSSTHEANTM; SSTHEANTMA; STHEANTMAM; THEANTMAMM; HEANTMAMMA; EANTMAMMAR; ANTMAMMARD; NTMAMMARDT; TMAMMARDTA; MAMMARDTAE; AMMARDTAEA; MMARDTAEAA; MARDTAEAAK; ARDTAEAAKW; RDTAEAAKWG; DTAEAAKWGG;<br><br>11 mers:<br>MSQIMYNYPAM; SQIMYNYPAML; QIMYNYPAMLG; IMYNYPAMLGH; MYNYPAMLGHA; YNYPAMLGHAG; NYPAMLGHAGD; YPAMLGHAGDM; PAMLGHAGDMA; AMLGHAGDMAG; MLGHAGDMAGY; LGHAGDMAGYA; GHAGDMAGYAG; HAGDMAGYAGT; AGDMAGYAGTL; GDMAGYAGTLQ; DMAGYAGTLQS; MAGYAGTLQSL; AGYAGTLQSLG; GYAGTLQSLGA; YAGTLQSLGAE; AGTLQSLGAEI; GTLQSLGAEIA; TLQSLGAEIAV; LQSLGAEIAVE; QSLGAEIAVEQ; SLGAEIAVEQA; LGAEIAVEQAA; GAEIAVEQAAL; AEIAVEQAALQ; EIAVEQAALQS; IAVEQAALQSA; AVEQAALQSAW; VEQAALQSAWQ; EQAALQSAWQG; QAALQSAWQGD; AALQSAWQGDT; ALQSAWQGDTG; LQSAWQGDTGI; QSAWQGDTGIT; SAWQGDTGITY; AWQGDTGITYQ; WQGDTGITYQA; | |

Fig. 28 continued

| | | |
|---|---|---|
| | QGDTGITYQAW; GDTGITYQAWQ; DTGITYQAWQA; TGITYQAWQAQ; GITYQAWQAQW; ITYQAWQAQWN; TYQAWQAQWNQ; YQAWQAQWNQA; QAWQAQWNQAM; AWQAQWNQAME; WQAQWNQAMED; QAQWNQAMEDL; AQWNQAMEDLV; QWNQAMEDLVR; WNQAMEDLVRA; NQAMEDLVRAY; QAMEDLVRAYH; AMEDLVRAYHA; MEDLVRAYHAM; EDLVRAYHAMS; DLVRAYHAMSS; LVRAYHAMSST; VRAYHAMSSTH; RAYHAMSSTHE; AYHAMSSTHEA; YHAMSSTHEAN; HAMSSTHEANT; AMSSTHEANTM; MSSTHEANTMA; SSTHEANTMAM; STHEANTMAMM; THEANTMAMMA; HEANTMAMMAR; EANTMAMMARD; ANTMAMMARDT; NTMAMMARDTA; TMAMMARDTAE; MAMMARDTAEA; AMMARDTAEAA; MMARDTAEAAK; MARDTAEAAKW; ARDTAEAAKWG; RDTAEAAKWGG; | |
| 8) Rv0455c | 8 mers:<br>MSRLSSIL; SRLSSILR; RLSSILRA; LSSILRAG; SSILRAGA; SILRAGAA; ILRAGAAF; LRAGAAFL; RAGAAFLV; AGAAFLVL; GAAFLVLG; AAFLVLGI; AFLVLGIA; FLVLGIAA; LVLGIAAA; VLGIAAAT; LGIAAATF; GIAAATFP; IAAATFPQ; AAATFPQS; AATFPQSA; ATFPQSAA; TFPQSAAA; FPQSAAAD; PQSAAADS; QSAAADST; SAAADSTE; AAADSTED; AADSTEDF; ADSTEDFP; DSTEDFPI; STEDFPIP; TEDFPIPR; EDFPIPRR; DFPIPRRM; FPIPRRMI; PIPRRMIA; IPRRMIAT; PRRMIATT; RRMIATTC; RMIATTCD; MIATTCDA; IATTCDAE; ATTCDAEQ; TTCDAEQY; TCDAEQYL; CDAEQYLA; DAEQYLAA; AEQYLAAV; EQYLAAVR; QYLAAVRD; YLAAVRDT; LAAVRDTS; AAVRDTSP; AVRDTSPV; VRDTSPVY; RDTSPVYY; DTSPVYYQ; TSPVYYQR; SPVYYQRY; PVYYQRYM; VYYQRYMI; YYQRYMID; YQRYMIDF; QRYMIDFN; RYMIDFNN; YMIDFNNH; MIDFNNHA; IDFNNHAN; DFNNHANL; FNNHANLQ; NNHANLQQ; NHANLQQA; HANLQQAT; ANLQQATI; NLQQATIN; LQQATINK; QQATINKA; QATINKAH; ATINKAHW; TINKAHWF; INKAHWFF; NKAHWFFS; KAHWFFSL; AHWFFSLS; HWFFSLSP; WFFSLSPA; FFSLSPAE; FSLSPAER; SLSPAERR; LSPAERRD; SPAERRDY; PAERRDYS; AERRDYSE; ERRDYSEH; RRDYSEHF; RDYSEHFY; DYSEHFYN; YSEHFYNG; SEHFYNGD; EHFYNGDP; HFYNGDPL; FYNGDPLT; YNGDPLTF; NGDPLTFA; GDPLTFAW; DPLTFAWV; PLTFAWVN; LTFAWVNH; TFAWVNHM; FAWVNHMK; AWVNHMKI; WVNHMKIF; VNHMKIFF; NHMKIFFN; HMKIFFNN; MKIFFNNK; KIFFNNKG; IFFNNKGV; FFNNKGVV; FNNKGVVA; NNKGVVAK; NKGVVAKG; KGVVAKGT; GVVAKGTE; VVAKGTEV; VAKGTEVC; AKGTEVCN; KGTEVCNG; GTEVCNGY; TEVCNGYP; EVCNGYPA; VCNGYPAG; CNGYPAGD; NGYPAGDM; GYPAGDMS; YPAGDMSV; PAGDMSVW; AGDMSVWN; GDMSVWNW; DMSVWNWA;<br><br>9 mers:<br>MSRLSSILR; SRLSSILRA; RLSSILRAG; LSSILRAGA; SSILRAGAA; SILRAGAAF; ILRAGAAFL; LRAGAAFLV; RAGAAFLVL; AGAAFLVLG; GAAFLVLGI; AAFLVLGIA; AFLVLGIAA; FLVLGIAAA; LVLGIAAAT; VLGIAAATF; LGIAAATFP; GIAAATFPQ; IAAATFPQS; AAATFPQSA; AATFPQSAA; ATFPQSAAA; TFPQSAAAD; FPQSAAADS; PQSAAADST; QSAAADSTE; SAAADSTED; AAADSTEDF; | 8407-8964 |

Fig. 28 continued

| | | |
|---|---|---|
| | AADSTEDFP; ADSTEDFPI; DSTEDFPIP; STEDFPIPR; TEDFPIPRR; EDFPIPRRM; DFPIPRRMI; FPIPRRMIA; PIPRRMIAT; IPRRMIATT; PRRMIATTC; RRMIATTCD; RMIATTCDA; MIATTCDAE; IATTCDAEQ; ATTCDAEQY; TTCDAEQYL; TCDAEQYLA; CDAEQYLAA; DAEQYLAAV; AEQYLAAVR; EQYLAAVRD; QYLAAVRDT; YLAAVRDTS; LAAVRDTSP; AAVRDTSPV; AVRDTSPVY; VRDTSPVYY; RDTSPVYYQ; DTSPVYYQR; TSPVYYQRY; SPVYYQRYM; PVYYQRYMI; VYYQRYMID; YYQRYMIDF; YQRYMIDFN; QRYMIDFNN; RYMIDFNNH; YMIDFNNHA; MIDFNNHAN; IDFNNHANL; DFNNHANLQ; FNNHANLQQ; NNHANLQQA; NHANLQQAT; HANLQQATI; ANLQQATIN; NLQQATINK; LQQATINKA; QQATINKAH; QATINKAHW; ATINKAHWF; TINKAHWFF; INKAHWFFS; NKAHWFFSL; KAHWFFSLS; AHWFFSLSP; HWFFSLSPA; WFFSLSPAE; FFSLSPAER; FSLSPAERR; SLSPAERRD; LSPAERRDY; SPAERRDYS; PAERRDYSE; AERRDYSEH; ERRDYSEHF; RRDYSEHFY; RDYSEHFYN; DYSEHFYNG; YSEHFYNGD; SEHFYNGDP; EHFYNGDPL; HFYNGDPLT; FYNGDPLTF; YNGDPLTFA; NGDPLTFAW; GDPLTFAWV; DPLTFAWVN; PLTFAWVNH; LTFAWVNHM; TFAWVNHMK; FAWVNHMKI; AWVNHMKIF; WVNHMKIFF; VNHMKIFFN; NHMKIFFNN; HMKIFFNNK; MKIFFNNKG; KIFFNNKGV; IFFNNKGVV; FFNNKGVVA; FNNKGVVAK; NNKGVVAKG; NKGVVAKGT; KGVVAKGTE; GVVAKGTEV; VVAKGTEVC; VAKGTEVCN; AKGTEVCNG; KGTEVCNGY; GTEVCNGYP; TEVCNGYPA; EVCNGYPAG; VCNGYPAGD; CNGYPAGDM; NGYPAGDMS; GYPAGDMSV; YPAGDMSVW; PAGDMSVWN; AGDMSVWNW; GDMSVWNWA;<br><br>10 mers:<br>MSRLSSILRA; SRLSSILRAG; RLSSILRAGA; LSSILRAGAA; SSILRAGAAF; SILRAGAAFL; ILRAGAAFLV; LRAGAAFLVL; RAGAAFLVLG; AGAAFLVLGI; GAAFLVLGIA; AAFLVLGIAA; AFLVLGIAAA; FLVLGIAAAT; LVLGIAAATF; VLGIAAATFP; LGIAAATFPQ; GIAAATFPQS; IAAATFPQSA; AAATFPQSAA; AATFPQSAAA; ATFPQSAAAD; TFPQSAAADS; FPQSAAADST; PQSAAADSTE; QSAAADSTED; SAAADSTEDF; AAADSTEDFP; AADSTEDFPI; ADSTEDFPIP; DSTEDFPIPR; STEDFPIPRR; TEDFPIPRRM; EDFPIPRRMI; DFPIPRRMIA; FPIPRRMIAT; PIPRRMIATT; IPRRMIATTC; PRRMIATTCD; RRMIATTCDA; RMIATTCDAE; MIATTCDAEQ; IATTCDAEQY; ATTCDAEQYL; TTCDAEQYLA; TCDAEQYLAA; CDAEQYLAAV; DAEQYLAAVR; AEQYLAAVRD; EQYLAAVRDT; QYLAAVRDTS; YLAAVRDTSP; LAAVRDTSPV; AAVRDTSPVY; AVRDTSPVYY; VRDTSPVYYQ; RDTSPVYYQR; DTSPVYYQRY; TSPVYYQRYM; SPVYYQRYMI; PVYYQRYMID; VYYQRYMIDF; YYQRYMIDFN; YQRYMIDFNN; QRYMIDFNNH; RYMIDFNNHA; YMIDFNNHAN; MIDFNNHANL; IDFNNHANLQ; DFNNHANLQQ; FNNHANLQQA; NNHANLQQAT; NHANLQQATI; HANLQQATIN; ANLQQATINK; NLQQATINKA; LQQATINKAH; QQATINKAHW; QATINKAHWF; ATINKAHWFF; TINKAHWFFS; INKAHWFFSL; NKAHWFFSLS; KAHWFFSLSP; AHWFFSLSPA; HWFFSLSPAE; WFFSLSPAER; FFSLSPAERR; FSLSPAERRD; SLSPAERRDY; LSPAERRDYS; SPAERRDYSE; PAERRDYSEH; AERRDYSEHF; ERRDYSEHFY; RRDYSEHFYN; | |

Fig. 28 continued

| | | |
|---|---|---|
| | RDYSEHFYNG; DYSEHFYNGD; YSEHFYNGDP; SEHFYNGDPL; EHFYNGDPLT; HFYNGDPLTF; FYNGDPLTFA; YNGDPLTFAW; NGDPLTFAWV; GDPLTFAWVN; DPLTFAWVNH; PLTFAWVNHM; LTFAWVNHMK; TFAWVNHMKI; FAWVNHMKIF; AWVNHMKIFF; WVNHMKIFFN; VNHMKIFFNN; NHMKIFFNNK; HMKIFFNNKG; MKIFFNNKGV; KIFFNNKGVV; IFFNNKGVVA; FFNNKGVVAK; FNNKGVVAKG; NNKGVVAKGT; NKGVVAKGTE; KGVVAKGTEV; GVVAKGTEVC; VVAKGTEVCN; VAKGTEVCNG; AKGTEVCNGY; KGTEVCNGYP; GTEVCNGYPA; TEVCNGYPAG; EVCNGYPAGD; VCNGYPAGDM; CNGYPAGDMS; NGYPAGDMSV; GYPAGDMSVW; YPAGDMSVWN; PAGDMSVWNW; AGDMSVWNWA;<br><br>11 mers:<br>MSRLSSILRAG; SRLSSILRAGA; RLSSILRAGAA; LSSILRAGAAF; SSILRAGAAFL; SILRAGAAFLV; ILRAGAAFLVL; LRAGAAFLVLG; RAGAAFLVLGI; AGAAFLVLGIA; GAAFLVLGIAA; AAFLVLGIAAA; AFLVLGIAAAT; FLVLGIAAATF; LVLGIAAATFP; VLGIAAATFPQ; LGIAAATFPQS; GIAAATFPQSA; IAAATFPQSAA; AAATFPQSAAA; AATFPQSAAAD; ATFPQSAAADS; TFPQSAAADST; FPQSAAADSTE; PQSAAADSTED; QSAAADSTEDF; SAAADSTEDFP; AAADSTEDFPI; AADSTEDFPIP; ADSTEDFPIPR; DSTEDFPIPRR; STEDFPIPRRM; TEDFPIPRRMI; EDFPIPRRMIA; DFPIPRRMIAT; FPIPRRMIATT; PIPRRMIATTC; IPRRMIATTCD; PRRMIATTCDA; RRMIATTCDAE; RMIATTCDAEQ; MIATTCDAEQY; IATTCDAEQYL; ATTCDAEQYLA; TTCDAEQYLAA; TCDAEQYLAAV; CDAEQYLAAVR; DAEQYLAAVRD; AEQYLAAVRDT; EQYLAAVRDTS; QYLAAVRDTSP; YLAAVRDTSPV; LAAVRDTSPVY; AAVRDTSPVYY; AVRDTSPVYYQ; VRDTSPVYYQR; RDTSPVYYQRY; DTSPVYYQRYM; TSPVYYQRYMI; SPVYYQRYMID; PVYYQRYMIDF; VYYQRYMIDFN; YYQRYMIDFNN; YQRYMIDFNNH; QRYMIDFNNHA; RYMIDFNNHAN; YMIDFNNHANL; MIDFNNHANLQ; IDFNNHANLQQ; DFNNHANLQQA; FNNHANLQQAT; NNHANLQQATI; NHANLQQATIN; HANLQQATINK; ANLQQATINKA; NLQQATINKAH; LQQATINKAHW; QQATINKAHWF; QATINKAHWFF; ATINKAHWFFS; TINKAHWFFSL; INKAHWFFSLS; NKAHWFFSLSP; KAHWFFSLSPA; AHWFFSLSPAE; HWFFSLSPAER; WFFSLSPAERR; FFSLSPAERRD; FSLSPAERRDY; SLSPAERRDYS; LSPAERRDYSE; SPAERRDYSEH; PAERRDYSEHF; AERRDYSEHFY; ERRDYSEHFYN; RRDYSEHFYNG; RDYSEHFYNGD; DYSEHFYNGDP; YSEHFYNGDPL; SEHFYNGDPLT; EHFYNGDPLTF; HFYNGDPLTFA; FYNGDPLTFAW; YNGDPLTFAWV; NGDPLTFAWVN; GDPLTFAWVNH; DPLTFAWVNHM; PLTFAWVNHMK; LTFAWVNHMKI; TFAWVNHMKIF; FAWVNHMKIFF; AWVNHMKIFFN; WVNHMKIFFNN; VNHMKIFFNNK; NHMKIFFNNKG; HMKIFFNNKGV; MKIFFNNKGVV; KIFFNNKGVVA; IFFNNKGVVAK; FFNNKGVVAKG; FNNKGVVAKGT; NNKGVVAKGTE; NKGVVAKGTEV; KGVVAKGTEVC; GVVAKGTEVCN; VVAKGTEVCNG; VAKGTEVCNGY; AKGTEVCNGYP; KGTEVCNGYPA; GTEVCNGYPAG; TEVCNGYPAGD; EVCNGYPAGDM; VCNGYPAGDMS; CNGYPAGDMSV; NGYPAGDMSVW; GYPAGDMSVWN; YPAGDMSVWNW; PAGDMSVWNWA; | |
| 9) Rv0516c | 8 mers:<br>MTTTIPTS; TTTIPTSK; TTIPTSKS; TIPTSKSA; IPTSKSAC; | 8965-9563 |

Fig. 28 continued

| | | | |
|---|---|---|---|
| | PTSKSACS; TSKSACSV; SKSACSVT; KSACSVTT; SACSVTTR; ACSVTTRP; CSVTTRPG; SVTTRPGN; VTTRPGNA; TTRPGNAA; TRPGNAAV; RPGNAAVD; PGNAAVDY; GNAAVDYG; NAAVDYGG; AAVDYGGA; AVDYGGAQ; VDYGGAQI; DYGGAQIR; YGGAQIRA; GGAQIRAY; GAQIRAYL; AQIRAYLH; QIRAYLHH; IRAYLHHL; RAYLHHLA; AYLHHLAT; YLHHLATV; LHHLATVV; HHLATVVT; HLATVVTI; LATVVTIR; ATVVTIRG; TVVTIRGE; VVTIRGEI; VTIRGEID; TIRGEIDA; IRGEIDAA; RGEIDAAN; GEIDAANV; EIDAANVE; IDAANVEQ; DAANVEQI; AANVEQIS; ANVEQISE; NVEQISEH; VEQISEHV; EQISEHVR; QISEHVRR; ISEHVRRF; SEHVRRFS; EHVRRFSL; HVRRFSLG; VRRFSLGT; RRFSLGTN; RFSLGTNP; FSLGTNPM; SLGTNPMV; LGTNPMVL; GTNPMVLD; TNPMVLDL; NPMVLDLS; PMVLDLSE; MVLDLSEL; VLDLSELS; LDLSELSH; DLSELSHF; LSELSHFS; SELSHFSG; ELSHFSGA; LSHFSGAG; SHFSGAGI; HFSGAGIS; FSGAGISL; SGAGISLL; GAGISLLC; AGISLLCI; GISLLCIL; ISLLCILD; SLLCILDE; LLCILDED; LCILDEDC; CILDEDCR; ILDEDCRA; LDEDCRAA; DEDCRAAG; EDCRAAGV; DCRAAGVQ; CRAAGVQW; RAAGVQWA; AAGVQWAL; AGVQWALV; GVQWALVA; VQWALVAS; QWALVASP; WALVASPA; ALVASPAV; LVASPAVV; VASPAVVE; ASPAVVEQ; SPAVVEQL; PAVVEQLG; AVVEQLGG; VVEQLGGR; VEQLGGRC; EQLGGRCD; QLGGRCDQ; LGGRCDQG; GGRCDQGE; GRCDQGEH; RCDQGEHE; CDQGEHES; DQGEHESM; QGEHESMF; GEHESMFP; EHESMFPM; HESMFPMA; ESMFPMAR; SMFPMARS; MFPMARSV; FPMARSVH; PMARSVHK; MARSVHKA; ARSVHKAL; RSVHKALH; SVHKALHD; VHKALHDL; HKALHDLA; KALHDLAD; ALHDLADA; LHDLADAI; HDLADAID; DLADAIDR; LADAIDRR; ADAIDRRR; DAIDRRRQ; AIDRRRQL; IDRRRQLV; DRRRQLVL; RRRQLVLP; RRQLVLPL; RQLVLPLI; QLVLPLIS; LVLPLISR; VLPLISRS; LPLISRSA<br><br>9 mers:<br>MTTTIPTSK; TTTIPTSKS; TTIPTSKSA; TIPTSKSAC; IPTSKSACS; PTSKSACSV; TSKSACSVT; SKSACSVTT; KSACSVTTR; SACSVTTRP; ACSVTTRPG; CSVTTRPGN; SVTTRPGNA; VTTRPGNAA; TTRPGNAAV; TRPGNAAVD; RPGNAAVDY; PGNAAVDYG; GNAAVDYGG; NAAVDYGGA; AAVDYGGAQ; AVDYGGAQI; VDYGGAQIR; DYGGAQIRA; YGGAQIRAY; GGAQIRAYL; GAQIRAYLH; AQIRAYLHH; QIRAYLHHL; IRAYLHHLA; RAYLHHLAT; AYLHHLATV; YLHHLATVV; LHHLATVVT; HHLATVVTI; HLATVVTIR; LATVVTIRG; ATVVTIRGE; TVVTIRGEI; VVTIRGEID; VTIRGEIDA; TIRGEIDAA; IRGEIDAAN; RGEIDAANV; GEIDAANVE; EIDAANVEQ; IDAANVEQI; DAANVEQIS; AANVEQISE; ANVEQISEH; NVEQISEHV; VEQISEHVR; EQISEHVRR; QISEHVRRF; ISEHVRRFS; SEHVRRFSL; EHVRRFSLG; HVRRFSLGT; VRRFSLGTN; RRFSLGTNP; RFSLGTNPM; FSLGTNPMV; SLGTNPMVL; LGTNPMVLD; GTNPMVLDL; TNPMVLDLS; NPMVLDLSE; PMVLDLSEL; MVLDLSELS; VLDLSELSH; LDLSELSHF; DLSELSHFS; LSELSHFSG; SELSHFSGA; ELSHFSGAG; LSHFSGAGI; SHFSGAGIS; HFSGAGISL; FSGAGISLL; SGAGISLLC; GAGISLLCI; AGISLLCIL; GISLLCILD; ISLLCILDE; SLLCILDED; LLCILDEDC; LCILDEDCR; CILDEDCRA; ILDEDCRAA; LDEDCRAAG; DEDCRAAGV; EDCRAAGVQ; DCRAAGVQW; CRAAGVQWA; RAAGVQWAL; AAGVQWALV; AGVQWALVA; GVQWALVAS; VQWALVASP; | |

Fig. 28 continued

| | | |
|---|---|---|
| | QWALVASPA; WALVASPAV; ALVASPAVV; LVASPAVVE; VASPAVVEQ; ASPAVVEQL; SPAVVEQLG; PAVVEQLGG; AVVEQLGGR; VVEQLGGRC; VEQLGGRCD; EQLGGRCDQ; QLGGRCDQG; LGGRCDQGE; GGRCDQGEH; GRCDQGEHE; RCDQGEHES; CDQGEHESM; DQGEHESMF; QGEHESMFP; GEHESMFPM; EHESMFPMA; HESMFPMAR; ESMFPMARS; SMFPMARSV; MFPMARSVH; FPMARSVHK; PMARSVHKA; MARSVHKAL; ARSVHKALH; RSVHKALHD; SVHKALHDL; VHKALHDLA; HKALHDLAD; KALHDLADA; ALHDLADAI; LHDLADAID; HDLADAIDR; DLADAIDRR; LADAIDRRR; ADAIDRRRQ; DAIDRRRQL; AIDRRRQLV; IDRRRQLVL; DRRRQLVLP; RRRQLVLPL; RRQLVLPLI; RQLVLPLIS; QLVLPLISR; LVLPLISRS; VLPLISRSA<br><br>10 mers:<br>MTTTIPTSKS; TTTIPTSKSA; TTIPTSKSAC; TIPTSKSACS; IPTSKSACSV; PTSKSACSVT; TSKSACSVTT; SKSACSVTTR; KSACSVTTRP; SACSVTTRPG; ACSVTTRPGN; CSVTTRPGNA; SVTTRPGNAA; VTTRPGNAAV; TTRPGNAAVD; TRPGNAAVDY; RPGNAAVDYG; PGNAAVDYGG; GNAAVDYGGA; NAAVDYGGAQ; AAVDYGGAQI; AVDYGGAQIR; VDYGGAQIRA; DYGGAQIRAY; YGGAQIRAYL; GGAQIRAYLH; GAQIRAYLHH; AQIRAYLHHL; QIRAYLHHLA; IRAYLHHLAT; RAYLHHLATV; AYLHHLATVV; YLHHLATVVT; LHHLATVVTI; HHLATVVTIR; HLATVVTIRG; LATVVTIRGE; ATVVTIRGEI; TVVTIRGEID; VVTIRGEIDA; VTIRGEIDAA; TIRGEIDAAN; IRGEIDAANV; RGEIDAANVE; GEIDAANVEQ; EIDAANVEQI; IDAANVEQIS; DAANVEQISE; AANVEQISEH; ANVEQISEHV; NVEQISEHVR; VEQISEHVRR; EQISEHVRRF; QISEHVRRFS; ISEHVRRFSL; SEHVRRFSLG; EHVRRFSLGT; HVRRFSLGTN; VRRFSLGTNP; RRFSLGTNPM; RFSLGTNPMV; FSLGTNPMVL; SLGTNPMVLD; LGTNPMVLDL; GTNPMVLDLS; TNPMVLDLSE; NPMVLDLSEL; PMVLDLSELS; MVLDLSELSH; VLDLSELSHF; LDLSELSHFS; DLSELSHFSG; LSELSHFSGA; SELSHFSGAG; ELSHFSGAGI; LSHFSGAGIS; SHFSGAGISL; HFSGAGISLL; FSGAGISLLC; SGAGISLLCI; GAGISLLCIL; AGISLLCILD; GISLLCILDE; ISLLCILDED; SLLCILDEDC; LLCILDEDCR; LCILDEDCRA; CILDEDCRAA; ILDEDCRAAG; LDEDCRAAGV; DEDCRAAGVQ; EDCRAAGVQW; DCRAAGVQWA; CRAAGVQWAL; RAAGVQWALV; AAGVQWALVA; AGVQWALVAS; GVQWALVASP; VQWALVASPA; QWALVASPAV; WALVASPAVV; ALVASPAVVE; LVASPAVVEQ; VASPAVVEQL; ASPAVVEQLG; SPAVVEQLGG; PAVVEQLGGR; AVVEQLGGRC; VVEQLGGRCD; VEQLGGRCDQ; EQLGGRCDQG; QLGGRCDQGE; LGGRCDQGEH; GGRCDQGEHE; GRCDQGEHES; RCDQGEHESM; CDQGEHESMF; DQGEHESMFP; QGEHESMFPM; GEHESMFPMA; EHESMFPMAR; HESMFPMARS; ESMFPMARSV; SMFPMARSVH; MFPMARSVHK; FPMARSVHKA; PMARSVHKAL; MARSVHKALH; ARSVHKALHD; RSVHKALHDL; SVHKALHDLA; VHKALHDLAD; HKALHDLADA; KALHDLADAI; ALHDLADAID; LHDLADAIDR; HDLADAIDRR; DLADAIDRRR; LADAIDRRRQ; ADAIDRRRQL; DAIDRRRQLV; AIDRRRQLVL; IDRRRQLVLP; DRRRQLVLPL; RRRQLVLPLI; RRQLVLPLIS; RQLVLPLISR; QLVLPLISRS; LVLPLISRSA<br><br>11 mers: | |

Fig. 28 continued

| | | |
|---|---|---|
| | MTTTIPTSKSA; TTTIPTSKSAC; TTIPTSKSACS; TIPTSKSACSV; IPTSKSACSVT; PTSKSACSVTT; TSKSACSVTTR; SKSACSVTTRP; KSACSVTTRPG; SACSVTTRPGN; ACSVTTRPGNA; CSVTTRPGNAA; SVTTRPGNAAV; VTTRPGNAAVD; TTRPGNAAVDY; TRPGNAAVDYG; RPGNAAVDYGG; PGNAAVDYGGA; GNAAVDYGGAQ; NAAVDYGGAQI; AAVDYGGAQIR; AVDYGGAQIRA; VDYGGAQIRAY; DYGGAQIRAYL; YGGAQIRAYLH; GGAQIRAYLHH; GAQIRAYLHHL; AQIRAYLHHLA; QIRAYLHHLAT; IRAYLHHLATV; RAYLHHLATVV; AYLHHLATVVT; YLHHLATVVTI; LHHLATVVTIR; HHLATVVTIRG; HLATVVTIRGE; LATVVTIRGEI; ATVVTIRGEID; TVVTIRGEIDA; VVTIRGEIDAA; VTIRGEIDAAN; TIRGEIDAANV; IRGEIDAANVE; RGEIDAANVEQ; GEIDAANVEQI; EIDAANVEQIS; IDAANVEQISE; DAANVEQISEH; AANVEQISEHV; ANVEQISEHVR; NVEQISEHVRR; VEQISEHVRRF; EQISEHVRRFS; QISEHVRRFSL; ISEHVRRFSLG; SEHVRRFSLGT; EHVRRFSLGTN; HVRRFSLGTNP; VRRFSLGTNPM; RRFSLGTNPMV; RFSLGTNPMVL; FSLGTNPMVLD; SLGTNPMVLDL; LGTNPMVLDLS; GTNPMVLDLSE; TNPMVLDLSEL; NPMVLDLSELS; PMVLDLSELSH; MVLDLSELSHF; VLDLSELSHFS; LDLSELSHFSG; DLSELSHFSGA; LSELSHFSGAG; SELSHFSGAGI; ELSHFSGAGIS; LSHFSGAGISL; SHFSGAGISLL; HFSGAGISLLC; FSGAGISLLCI; SGAGISLLCIL; GAGISLLCILD; AGISLLCILDE; GISLLCILDED; ISLLCILDEDC; SLLCILDEDCR; LLCILDEDCRA; LCILDEDCRAA; CILDEDCRAAG; ILDEDCRAAGV; LDEDCRAAGVQ; DEDCRAAGVQW; EDCRAAGVQWA; DCRAAGVQWAL; CRAAGVQWALV; RAAGVQWALVA; AAGVQWALVAS; AGVQWALVASP; GVQWALVASPA; VQWALVASPAV; QWALVASPAVV; WALVASPAVVE; ALVASPAVVEQ; LVASPAVVEQL; VASPAVVEQLG; ASPAVVEQLGG; SPAVVEQLGGR; PAVVEQLGGRC; AVVEQLGGRCD; VVEQLGGRCDQ; VEQLGGRCDQG; EQLGGRCDQGE; QLGGRCDQGEH; LGGRCDQGEHE; GGRCDQGEHES; GRCDQGEHESM; RCDQGEHESMF; CDQGEHESMFP; DQGEHESMFPM; QGEHESMFPMA; GEHESMFPMAR; EHESMFPMARS; HESMFPMARSV; ESMFPMARSVH; SMFPMARSVHK; MFPMARSVHKA; FPMARSVHKAL; PMARSVHKALH; MARSVHKALHD; ARSVHKALHDL; RSVHKALHDLA; SVHKALHDLAD; VHKALHDLADA; HKALHDLADAI; KALHDLADAID; ALHDLADAIDR; LHDLADAIDRR; HDLADAIDRRR; DLADAIDRRRQ; LADAIDRRRQL; ADAIDRRRQLV; DAIDRRRQLVL; AIDRRRQLVLP; IDRRRQLVLPL; DRRRQLVLPLI; RRRQLVLPLIS; RRQLVLPLISR; RQLVLPLISRS; QLVLPLISRSA | |
| 10) Rv0569 | 8 mers:<br>MKAKVGDW; KAKVGDWL; AKVGDWLV; KVGDWLVI; VGDWLVIK; GDWLVIKG; DWLVIKGA; WLVIKGAT; LVIKGATI; VIKGATID; IKGATIDQ; KGATIDQP; GATIDQPD; ATIDQPDH; TIDQPDHR; IDQPDHRG; DQPDHRGL; QPDHRGLI; PDHRGLII; DHRGLIIE; HRGLIIEV; RGLIIEVR; GLIIEVRS; LIIEVRSS; IIEVRSSD; IEVRSSDG; EVRSSDGS; VRSSDGSP; RSSDGSPP; SSDGSPPY; SDGSPPYV; DGSPPYVV; GSPPYVVR; SPPYVVRW; PPYVVRWL; PYVVRWLE; YVVRWLET; VVRWLETD; VRWLETDH; RWLETDHV; WLETDHVA; LETDHVAT; ETDHVATV; TDHVATVI; DHVATVIP; HVATVIPG; VATVIPGP; ATVIPGPD; TVIPGPDA; VIPGPDAV; IPGPDAVV; PGPDAVVV; GPDAVVVT; PDAVVVTA; DAVVVTAE; AVVVTAEE; VVVTAEEQ; VVTAEEQN; VTAEEQNA; TAEEQNAA; AEEQNAAD; | 9563-9880 |

Fig. 28 continued

| | | | |
|---|---|---|---|
| | EEQNAADE; EQNAADER; QNAADERA; NAADERAQ; AADERAQH; ADERAQHR; DERAQHRF; ERAQHRFG; RAQHRFGA; AQHRFGAV; QHRFGAVQ; HRFGAVQS; RFGAVQSA; FGAVQSAI; GAVQSAIL; AVQSAILH; VQSAILHA; QSAILHAR; SAILHARG; AILHARGT;<br><br>9 mers:<br>MKAKVGDWL; KAKVGDWLV; AKVGDWLVI; KVGDWLVIK; VGDWLVIKG; GDWLVIKGA; DWLVIKGAT; WLVIKGATI; LVIKGATID; VIKGATIDQ; IKGATIDQP; KGATIDQPD; GATIDQPDH; ATIDQPDHR; TIDQPDHRG; IDQPDHRGL; DQPDHRGLI; QPDHRGLII; PDHRGLIIE; DHRGLIIEV; HRGLIIEVR; RGLIIEVRS; GLIIEVRSS; LIIEVRSSD; IIEVRSSDG; IEVRSSDGS; EVRSSDGSP; VRSSDGSPP; RSSDGSPPY; SSDGSPPYV; SDGSPPYVV; DGSPPYVVR; GSPPYVVRW; SPPYVVRWL; PPYVVRWLE; PYVVRWLET; YVVRWLETD; VVRWLETDH; VRWLETDHV; RWLETDHVA; WLETDHVAT; LETDHVATV; ETDHVATVI; TDHVATVIP; DHVATVIPG; HVATVIPGP; VATVIPGPD; ATVIPGPDA; TVIPGPDAV; VIPGPDAVV; IPGPDAVVV; PGPDAVVVT; GPDAVVVTA; PDAVVVTAE; DAVVVTAEE; AVVVTAEEQ; VVVTAEEQN; VVTAEEQNA; VTAEEQNAA; TAEEQNAAD; AEEQNAADE; EEQNAADER; EQNAADERA; QNAADERAQ; NAADERAQH; AADERAQHR; ADERAQHRF; DERAQHRFG; ERAQHRFGA; RAQHRFGAV; AQHRFGAVQ; QHRFGAVQS; HRFGAVQSA; RFGAVQSAI; FGAVQSAIL; GAVQSAILH; AVQSAILHA; VQSAILHAR; QSAILHARG; SAILHARGT;<br><br>10 mers:<br>MKAKVGDWLV; KAKVGDWLVI; AKVGDWLVIK; KVGDWLVIKG; VGDWLVIKGA; GDWLVIKGAT; DWLVIKGATI; WLVIKGATID; LVIKGATIDQ; VIKGATIDQP; IKGATIDQPD; KGATIDQPDH; GATIDQPDHR; ATIDQPDHRG; TIDQPDHRGL; IDQPDHRGLI; DQPDHRGLII; QPDHRGLIIE; PDHRGLIIEV; DHRGLIIEVR; HRGLIIEVRS; RGLIIEVRSS; GLIIEVRSSD; LIIEVRSSDG; IIEVRSSDGS; IEVRSSDGSP; EVRSSDGSPP; VRSSDGSPPY; RSSDGSPPYV; SSDGSPPYVV; SDGSPPYVVR; DGSPPYVVRW; GSPPYVVRWL; SPPYVVRWLE; PPYVVRWLET; PYVVRWLETD; YVVRWLETDH; VVRWLETDHV; VRWLETDHVA; RWLETDHVAT; WLETDHVATV; LETDHVATVI; ETDHVATVIP; TDHVATVIPG; DHVATVIPGP; HVATVIPGPD; VATVIPGPDA; ATVIPGPDAV; TVIPGPDAVV; VIPGPDAVVV; IPGPDAVVVT; PGPDAVVVTA; GPDAVVVTAE; PDAVVVTAEE; DAVVVTAEEQ; AVVVTAEEQN; VVVTAEEQNA; VVTAEEQNAA; VTAEEQNAAD; TAEEQNAADE; AEEQNAADER; EEQNAADERA; EQNAADERAQ; QNAADERAQH; NAADERAQHR; AADERAQHRF; ADERAQHRFG; DERAQHRFGA; ERAQHRFGAV; RAQHRFGAVQ; AQHRFGAVQS; QHRFGAVQSA; HRFGAVQSAI; RFGAVQSAIL; FGAVQSAILH; GAVQSAILHA; AVQSAILHAR; VQSAILHARG; QSAILHARGT;<br><br>11 mers:<br>MKAKVGDWLVI; KAKVGDWLVIK; AKVGDWLVIKG; KVGDWLVIKGA; VGDWLVIKGAT; GDWLVIKGATI; DWLVIKGATID; WLVIKGATIDQ; LVIKGATIDQP; VIKGATIDQPD; IKGATIDQPDH; KGATIDQPDHR; GATIDQPDHRG; ATIDQPDHRGL; TIDQPDHRGLI; IDQPDHRGLII; | |

Fig. 28 continued

| | | |
|---|---|---|
| | DQPDHRGLIIE; QPDHRGLIIEV; PDHRGLIIEVR; DHRGLIIEVRS; HRGLIIEVRSS; RGLIIEVRSSD; GLIIEVRSSDG; LIIEVRSSDGS; IIEVRSSDGSP; IEVRSSDGSPP; EVRSSDGSPPY; VRSSDGSPPYV; RSSDGSPPYVV; SSDGSPPYVVR; SDGSPPYVVRW; DGSPPYVVRWL; GSPPYVVRWLE; SPPYVVRWLET; PPYVVRWLETD; PYVVRWLETDH; YVVRWLETDHV; VVRWLETDHVA; VRWLETDHVAT; RWLETDHVATV; WLETDHVATVI; LETDHVATVIP; ETDHVATVIPG; TDHVATVIPGP; DHVATVIPGPD; HVATVIPGPDA; VATVIPGPDAV; ATVIPGPDAVV; TVIPGPDAVVV; VIPGPDAVVVT; IPGPDAVVVTA; PGPDAVVVTAE; GPDAVVVTAEE; PDAVVVTAEEQ; DAVVVTAEEQN; AVVVTAEEQNA; VVVTAEEQNAA; VVTAEEQNAAD; VTAEEQNAADE; TAEEQNAADER; AEEQNAADERA; EEQNAADERAQ; EQNAADERAQH; QNAADERAQHR; NAADERAQHRF; AADERAQHRFG; ADERAQHRFGA; DERAQHRFGAV; ERAQHRFGAVQ; RAQHRFGAVQS; AQHRFGAVQSA; QHRFGAVQSAI; HRFGAVQSAIL; RFGAVQSAILH; FGAVQSAILHA; GAVQSAILHAR; AVQSAILHARG; VQSAILHARGT; | |
| 11) Rv0789c | 8 mers: MSRRAIHS; SRRAIHSG; RRAIHSGR; RAIHSGRA; AIHSGRAA; IHSGRAAP; HSGRAAPR; SGRAAPRR; GRAAPRRS; RAAPRRSG; AAPRRSGN; APRRSGNS; PRRSGNSH; RRSGNSHL; RSGNSHLV; SGNSHLVL; GNSHLVLR; NSHLVLRN; SHLVLRNR; HLVLRNRV; LVLRNRVP; VLRNRVPS; LRNRVPSS; RNRVPSSK; NRVPSSKD; RVPSSKDS; VPSSKDSP; PSSKDSPR; SSKDSPRR; SKDSPRRR; KDSPRRRP; DSPRRRPH; SPRRRPHH; PRRRPHHE; RRRPHHEF; RRPHHEFM; RPHHEFMT; PHHEFMTE; HHEFMTES; HEFMTESI; EFMTESIG; FMTESIGE; MTESIGEP; TESIGEPL; ESIGEPLS; SIGEPLST; IGEPLSTN; GEPLSTNL; EPLSTNLI; PLSTNLIE; LSTNLIER; STNLIERY; TNLIERYL; NLIERYLR; LIERYLRA; IERYLRAR; ERYLRARG; RYLRARGR; YLRARGRR; LRARGRRY; RARGRRYF; ARGRRYFR; RGRRYFRG; GRRYFRGH; RRYFRGHH; RYFRGHHD; YFRGHHDA; FRGHHDAE; RGHHDAEF; GHHDAEFF; HHDAEFFF; HDAEFFFV; DAEFFFVA; AEFFFVAN; EFFFVANA; FFFVANAH; FFVANAHL; FVANAHLL; VANAHLLH; ANAHLLHV; NAHLLHVH; AHLLHVHL; HLLHVHLE; LLHVHLEI; LHVHLEIS; HVHLEISP; VHLEISPA; HLEISPAY; LEISPAYR; EISPAYRD; ISPAYRDV; SPAYRDVF; PAYRDVFT; AYRDVFTI; YRDVFTIR; RDVFTIRV; DVFTIRVS; VFTIRVSP; FTIRVSPA; TIRVSPAY; IRVSPAYF; RVSPAYFF; VSPAYFFP; SPAYFFPA; PAYFFPAT; AYFFPATD; YFFPATDH; FFPATDHT; FPATDHTR; PATDHTRL; ATDHTRLA; TDHTRLAE; DHTRLAEI; HTRLAEIV; TRLAEIVN; RLAEIVNA; LAEIVNAW; AEIVNAWN; EIVNAWNL; IVNAWNLQ; VNAWNLQN; NAWNLQNH; AWNLQNHE; WNLQNHEV; NLQNHEVT; LQNHEVTA; QNHEVTAI; NHEVTAIV; HEVTAIVH; EVTAIVHG; VTAIVHGS; TAIVHGSS; AIVHGSSD; IVHGSSDP; VHGSSDPH; HGSSDPHR; GSSDPHRI; SSDPHRIG; SDPHRIGV; DPHRIGVA; PHRIGVAA; HRIGVAAE; RIGVAAER; IGVAAERS; GVAAERSL; VAAERSLI; AAERSLIR; AERSLIRD; ERSLIRDR; RSLIRDRI; SLIRDRIR; LIRDRIRF; IRDRIRFD; RDRIRFDD; DRIRFDDF; RIRFDDFA; IRFDDFAT; RFDDFATF; FDDFATFV; DDFATFVD; DFATFVDN; FATFVDNA; ATFVDNAV; TFVDNAVS; FVDNAVSA; VDNAVSAA; DNAVSAAT; NAVSAATE; AVSAATEL; VSAATELF; | 9881-10638 |

Fig. 28 continued

| | | | |
|---|---|---|---|
| | SAATELFG; AATELFGQ; ATELFGQL; TELFGQLT; ELFGQLTA; LFGQLTAA; FGQLTAAG; GQLTAAGL; QLTAAGLP; LTAAGLPP; TAAGLPPT; AAGLPPTA; AGLPPTAT; GLPPTATP; LPPTATPP; PPTATPPL; PTATPPLL; TATPPLLR; ATPPLLRD; TPPLLRDA; PPLLRDAG<br><br>9 mers:<br>MSRRAIHSG; SRRAIHSGR; RRAIHSGRA; RAIHSGRAA; AIHSGRAAP; IHSGRAAPR; HSGRAAPRR; SGRAAPRRS; GRAAPRRSG; RAAPRRSGN; AAPRRSGNS; APRRSGNSH; PRRSGNSHL; RRSGNSHLV; RSGNSHLVL; SGNSHLVLR; GNSHLVLRN; NSHLVLRNR; SHLVLRNRV; HLVLRNRVP; LVLRNRVPS; VLRNRVPSS; LRNRVPSSK; RNRVPSSKD; NRVPSSKDS; RVPSSKDSP; VPSSKDSPR; PSSKDSPRR; SSKDSPRRR; SKDSPRRRP; KDSPRRRPH; DSPRRRPHH; SPRRRPHHE; PRRRPHHEF; RRRPHHEFM; RRPHHEFMT; RPHHEFMTE; PHHEFMTES; HHEFMTESI; HEFMTESIG; EFMTESIGE; FMTESIGEP; MTESIGEPL; TESIGEPLS; ESIGEPLST; SIGEPLSTN; IGEPLSTNL; GEPLSTNLI; EPLSTNLIE; PLSTNLIER; LSTNLIERY; STNLIERYL; TNLIERYLR; NLIERYLRA; LIERYLRAR; IERYLRARG; ERYLRARGR; RYLRARGRR; YLRARGRRY; LRARGRRYF; RARGRRYFR; ARGRRYFRG; RGRRYFRGH; GRRYFRGHH; RRYFRGHHD; RYFRGHHDA; YFRGHHDAE; FRGHHDAEF; RGHHDAEFF; GHHDAEFFF; HHDAEFFFV; HDAEFFFVA; DAEFFFVAN; AEFFFVANA; EFFFVANAH; FFFVANAHL; FFVANAHLL; FVANAHLLH; VANAHLLHV; ANAHLLHVH; NAHLLHVHL; AHLLHVHLE; HLLHVHLEI; LLHVHLEIS; LHVHLEISP; HVHLEISPA; VHLEISPAY; HLEISPAYR; LEISPAYRD; EISPAYRDV; ISPAYRDVF; SPAYRDVFT; PAYRDVFTI; AYRDVFTIR; YRDVFTIRV; RDVFTIRVS; DVFTIRVSP; VFTIRVSPA; FTIRVSPAY; TIRVSPAYF; IRVSPAYFF; RVSPAYFFP; VSPAYFFPA; SPAYFFPAT; PAYFFPATD; AYFFPATDH; YFFPATDHT; FFPATDHTR; FPATDHTRL; PATDHTRLA; ATDHTRLAE; TDHTRLAEI; DHTRLAEIV; HTRLAEIVN; TRLAEIVNA; RLAEIVNAW; LAEIVNAWN; AEIVNAWNL; EIVNAWNLQ; IVNAWNLQN; VNAWNLQNH; NAWNLQNHE; AWNLQNHEV; WNLQNHEVT; NLQNHEVTA; LQNHEVTAI; QNHEVTAIV; NHEVTAIVH; HEVTAIVHG; EVTAIVHGS; VTAIVHGSS; TAIVHGSSD; AIVHGSSDP; IVHGSSDPH; VHGSSDPHR; HGSSDPHRI; GSSDPHRIG; SSDPHRIGV; SDPHRIGVA; DPHRIGVAA; PHRIGVAAE; HRIGVAAER; RIGVAAERS; IGVAAERSL; GVAAERSLI; VAAERSLIR; AAERSLIRD; AERSLIRDR; ERSLIRDRI; RSLIRDRIR; SLIRDRIRF; LIRDRIRFD; IRDRIRFDD; RDRIRFDDF; DRIRFDDFA; RIRFDDFAT; IRFDDFATF; RFDDFATFV; FDDFATFVD; DDFATFVDN; DFATFVDNA; FATFVDNAV; ATFVDNAVS; TFVDNAVSA; FVDNAVSAA; VDNAVSAAT; DNAVSAATE; NAVSAATEL; AVSAATELF; VSAATELFG; SAATELFGQ; AATELFGQL; ATELFGQLT; TELFGQLTA; ELFGQLTAA; LFGQLTAAG; FGQLTAAGL; GQLTAAGLP; QLTAAGLPP; LTAAGLPPT; TAAGLPPTA; AAGLPPTAT; AGLPPTATP; GLPPTATPP; LPPTATPPL; PPTATPPLL; PTATPPLLR; TATPPLLRD; ATPPLLRDA; TPPLLRDAG<br><br>10 mers:<br>MSRRAIHSGR; SRRAIHSGRA; RRAIHSGRAA; RAIHSGRAAP; AIHSGRAAPR; IHSGRAAPRR; HSGRAAPRRS; SGRAAPRRSG; | |

Fig. 28 continued

| | | |
|---|---|---|
| | GRAAPRRSGN; RAAPRRSGNS; AAPRRSGNSH; APRRSGNSHL; PRRSGNSHLV; RRSGNSHLVL; RSGNSHLVLR; SGNSHLVLRN; GNSHLVLRNR; NSHLVLRNRV; SHLVLRNRVP; HLVLRNRVPS; LVLRNRVPSS; VLRNRVPSSK; LRNRVPSSKD; RNRVPSSKDS; NRVPSSKDSP; RVPSSKDSPR; VPSSKDSPRR; PSSKDSPRRR; SSKDSPRRRP; SKDSPRRRPH; KDSPRRRPHH; DSPRRRPHHE; SPRRRPHHEF; PRRRPHHEFM; RRRPHHEFMT; RRPHHEFMTE; RPHHEFMTES; PHHEFMTESI; HHEFMTESIG; HEFMTESIGE; EFMTESIGEP; FMTESIGEPL; MTESIGEPLS; TESIGEPLST; ESIGEPLSTN; SIGEPLSTNL; IGEPLSTNLI; GEPLSTNLIE; EPLSTNLIER; PLSTNLIERY; LSTNLIERYL; STNLIERYLR; TNLIERYLRA; NLIERYLRAR; LIERYLRARG; IERYLRARGR; ERYLRARGRR; RYLRARGRRY; YLRARGRRYF; LRARGRRYFR; RARGRRYFRG; ARGRRYFRGH; RGRRYFRGHH; GRRYFRGHHD; RRYFRGHHDA; RYFRGHHDAE; YFRGHHDAEF; FRGHHDAEFF; RGHHDAEFFF; GHHDAEFFFV; HHDAEFFFVA; HDAEFFFVAN; DAEFFFVANA; AEFFFVANAH; EFFFVANAHL; FFFVANAHLL; FFVANAHLLH; FVANAHLLHV; VANAHLLHVH; ANAHLLHVHL; NAHLLHVHLE; AHLLHVHLEI; HLLHVHLEIS; LLHVHLEISP; LHVHLEISPA; HVHLEISPAY; VHLEISPAYR; HLEISPAYRD; LEISPAYRDV; EISPAYRDVF; ISPAYRDVFT; SPAYRDVFTI; PAYRDVFTIR; AYRDVFTIRV; YRDVFTIRVS; RDVFTIRVSP; DVFTIRVSPA; VFTIRVSPAY; FTIRVSPAYF; TIRVSPAYFF; IRVSPAYFFP; RVSPAYFFPA; VSPAYFFPAT; SPAYFFPATD; PAYFFPATDH; AYFFPATDHT; YFFPATDHTR; FFPATDHTRL; FPATDHTRLA; PATDHTRLAE; ATDHTRLAEI; TDHTRLAEIV; DHTRLAEIVN; HTRLAEIVNA; TRLAEIVNAW; RLAEIVNAWN; LAEIVNAWNL; AEIVNAWNLQ; EIVNAWNLQN; IVNAWNLQNH; VNAWNLQNHE; NAWNLQNHEV; AWNLQNHEVT; WNLQNHEVTA; NLQNHEVTAI; LQNHEVTAIV; QNHEVTAIVH; NHEVTAIVHG; HEVTAIVHGS; EVTAIVHGSS; VTAIVHGSSD; TAIVHGSSDP; AIVHGSSDPH; IVHGSSDPHR; VHGSSDPHRI; HGSSDPHRIG; GSSDPHRIGV; SSDPHRIGVA; SDPHRIGVAA; DPHRIGVAAE; PHRIGVAAER; HRIGVAAERS; RIGVAAERSL; IGVAAERSLI; GVAAERSLIR; VAAERSLIRD; AAERSLIRDR; AERSLIRDRI; ERSLIRDRIR; RSLIRDRIRF; SLIRDRIRFD; LIRDRIRFDD; IRDRIRFDDF; RDRIRFDDFA; DRIRFDDFAT; RIRFDDFATF; IRFDDFATFV; RFDDFATFVD; FDDFATFVDN; DDFATFVDNA; DFATFVDNAV; FATFVDNAVS; ATFVDNAVSA; TFVDNAVSAA; FVDNAVSAAT; VDNAVSAATE; DNAVSAATEL; NAVSAATELF; AVSAATELFG; VSAATELFGQ; SAATELFGQL; AATELFGQLT; ATELFGQLTA; TELFGQLTAA; ELFGQLTAAG; LFGQLTAAGL; FGQLTAAGLP; GQLTAAGLPP; QLTAAGLPPT; LTAAGLPPTA; TAAGLPPTAT; AAGLPPTATP; AGLPPTATPP; GLPPTATPPL; LPPTATPPLL; PPTATPPLLR; PTATPPLLRD; TATPPLLRDA; ATPPLLRDAG<br><br>11 mers:<br>MSRRAIHSGRA; SRRAIHSGRAA; RRAIHSGRAAP; RAIHSGRAAPR; AIHSGRAAPRR; IHSGRAAPRRS; HSGRAAPRRSG; SGRAAPRRSGN; GRAAPRRSGNS; RAAPRRSGNSH; AAPRRSGNSHL; APRRSGNSHLV; PRRSGNSHLVL; RRSGNSHLVLR; RSGNSHLVLRN; SGNSHLVLRNR; GNSHLVLRNRV; NSHLVLRNRVP; SHLVLRNRVPS; | |

Fig. 28 continued

| | | |
|---|---|---|
| | HLVLRNRVPSS; LVLRNRVPSSK; VLRNRVPSSKD; LRNRVPSSKDS; RNRVPSSKDSP; NRVPSSKDSPR; RVPSSKDSPRR; VPSSKDSPRRR; PSSKDSPRRRP; SSKDSPRRRPH; SKDSPRRRPHH; KDSPRRRPHHE; DSPRRRPHHEF; SPRRRPHHEFM; PRRRPHHEFMT; RRRPHHEFMTE; RRPHHEFMTES; RPHHEFMTESI; PHHEFMTESIG; HHEFMTESIGE; HEFMTESIGEP; EFMTESIGEPL; FMTESIGEPLS; MTESIGEPLST; TESIGEPLSTN; ESIGEPLSTNL; SIGEPLSTNLI; IGEPLSTNLIE; GEPLSTNLIER; EPLSTNLIERY; PLSTNLIERYL; LSTNLIERYLR; STNLIERYLRA; TNLIERYLRAR; NLIERYLRARG; LIERYLRARGR; IERYLRARGRR; ERYLRARGRRY; RYLRARGRRYF; YLRARGRRYFR; LRARGRRYFRG; RARGRRYFRGH; ARGRRYFRGHH; RGRRYFRGHHD; GRRYFRGHHDA; RRYFRGHHDAE; RYFRGHHDAEF; YFRGHHDAEFF; FRGHHDAEFFF; RGHHDAEFFFV; GHHDAEFFFVA; HHDAEFFFVAN; HDAEFFFVANA; DAEFFFVANAH; AEFFFVANAHL; EFFFVANAHLL; FFFVANAHLLH; FFVANAHLLHV; FVANAHLLHVH; VANAHLLHVHL; ANAHLLHVHLE; NAHLLHVHLEI; AHLLHVHLEIS; HLLHVHLEISP; LLHVHLEISPA; LHVHLEISPAY; HVHLEISPAYR; VHLEISPAYRD; HLEISPAYRDV; LEISPAYRDVF; EISPAYRDVFT; ISPAYRDVFTI; SPAYRDVFTIR; PAYRDVFTIRV; AYRDVFTIRVS; YRDVFTIRVSP; RDVFTIRVSPA; DVFTIRVSPAY; VFTIRVSPAYF; FTIRVSPAYFF; TIRVSPAYFFP; IRVSPAYFFPA; RVSPAYFFPAT; VSPAYFFPATD; SPAYFFPATDH; PAYFFPATDHT; AYFFPATDHTR; YFFPATDHTRL; FFPATDHTRLA; FPATDHTRLAE; PATDHTRLAEI; ATDHTRLAEIV; TDHTRLAEIVN; DHTRLAEIVNA; HTRLAEIVNAW; TRLAEIVNAWN; RLAEIVNAWNL; LAEIVNAWNLQ; AEIVNAWNLQN; EIVNAWNLQNH; IVNAWNLQNHE; VNAWNLQNHEV; NAWNLQNHEVT; AWNLQNHEVTA; WNLQNHEVTAI; NLQNHEVTAIV; LQNHEVTAIVH; QNHEVTAIVHG; NHEVTAIVHGS; HEVTAIVHGSS; EVTAIVHGSSD; VTAIVHGSSDP; TAIVHGSSDPH; AIVHGSSDPHR; IVHGSSDPHRI; VHGSSDPHRIG; HGSSDPHRIGV; GSSDPHRIGVA; SSDPHRIGVAA; SDPHRIGVAAE; DPHRIGVAAER; PHRIGVAAERS; HRIGVAAERSL; RIGVAAERSLI; IGVAAERSLIR; GVAAERSLIRD; VAAERSLIRDR; AAERSLIRDRI; AERSLIRDRIR; ERSLIRDRIRF; RSLIRDRIRFD; SLIRDRIRFDD; LIRDRIRFDDF; IRDRIRFDDFA; RDRIRFDDFAT; DRIRFDDFATF; RIRFDDFATFV; IRFDDFATFVD; RFDDFATFVDN; FDDFATFVDNA; DDFATFVDNAV; DFATFVDNAVS; FATFVDNAVSA; ATFVDNAVSAA; TFVDNAVSAAT; FVDNAVSAATE; VDNAVSAATEL; DNAVSAATELF; NAVSAATELFG; AVSAATELFGQ; VSAATELFGQL; SAATELFGQLT; AATELFGQLTA; ATELFGQLTAA; TELFGQLTAAG; ELFGQLTAAGL; LFGQLTAAGLP; FGQLTAAGLPP; GQLTAAGLPPT; QLTAAGLPPTA; LTAAGLPPTAT; TAAGLPPTATP; AAGLPPTATPP; AGLPPTATPPL; GLPPTATPPLL; LPPTATPPLLR; PPTATPPLLRD; PTATPPLLRDA; TATPPLLRDAG | |
| 12) Rv0918 | 8 mers:<br>MHRAGAAV; HRAGAAVT; RAGAAVTA; AGAAVTAN; GAAVTANV; AAVTANVW; AVTANVWC; VTANVWCR; TANVWCRA; ANVWCRAG; NVWCRAGG; VWCRAGGI; WCRAGGIR; CRAGGIRM; RAGGIRMA; AGGIRMAP; GGIRMAPR; GIRMAPRP; IRMAPRPV; RMAPRPVI; MAPRPVIP; APRPVIPV; PRPVIPVA; RPVIPVAT; PVIPVATQ; VIPVATQQ; IPVATQQR; PVATQQRL; VATQQRLR; ATQQRLRR; TQQRLRRQ; QQRLRRQA; QRLRRQAD; RLRRQADR; LRRQADRQ; | 10639-11236 |

Fig. 28 continued

| | | | |
|---|---|---|---|
| | RRQADRQS; RQADRQSL; QADRQSLG; ADRQSLGS; DRQSLGSS; RQSLGSSG; QSLGSSGL; SLGSSGLP; LGSSGLPA; GSSGLPAL; SSGLPALN; SGLPALNC; GLPALNCT; LPALNCTP; PALNCTPI; ALNCTPIR; LNCTPIRH; NCTPIRHT; CTPIRHTI; TPIRHTID; PIRHTIDV; IRHTIDVM; RHTIDVMA; HTIDVMAT; TIDVMATK; IDVMATKP; DVMATKPE; VMATKPER; MATKPERK; ATKPERKT; TKPERKTE; KPERKTER; PERKTERL; ERKTERLA; RKTERLAA; KTERLAAR; TERLAARL; ERLAARLT; RLAARLTP; LAARLTPE; AARLTPEQ; ARLTPEQD; RLTPEQDA; LTPEQDAL; TPEQDALI; PEQDALIR; EQDALIRR; QDALIRRA; DALIRRAA; ALIRRAAE; LIRRAAEA; IRRAAEAE; RRAAEAEG; RAAEAEGT; AAEAEGTD; AEAEGTDL; EAEGTDLT; AEGTDLTN; EGTDLTNF; GTDLTNFT; TDLTNFTV; DLTNFTVT; LTNFTVTA; TNFTVTAA; NFTVTAAL; FTVTAALA; TVTAALAH; VTAALAHA; TAALAHAR; AALAHARD; ALAHARDV; LAHARDVL; AHARDVLA; HARDVLAD; ARDVLADR; RDVLADRR; DVLADRRL; VLADRRLF; LADRRLFV; ADRRLFVL; DRRLFVLT; RRLFVLTD; RLFVLTDA; LFVLTDAA; FVLTDAAW; VLTDAAWT; LTDAAWTE; TDAAWTEF; DAAWTEFL; AAWTEFLA; AWTEFLAA; WTEFLAAL; TEFLAALD; EFLAALDR; FLAALDRP; LAALDRPV; AALDRPVS; ALDRPVSH; LDRPVSHK; DRPVSHKP; RPVSHKPR; PVSHKPRL; VSHKPRLE; SHKPRLEK; HKPRLEKL; KPRLEKLF; PRLEKLFA; RLEKLFAA; LEKLFAAR; EKLFAARS; KLFAARSI; LFAARSIF; FAARSIFD; AARSIFDT; ARSIFDTE; RSIFDTEG<br><br>9 mers:<br>MHRAGAAVT; HRAGAAVTA; RAGAAVTAN; AGAAVTANV; GAAVTANVW; AAVTANVWC; AVTANVWCR; VTANVWCRA; TANVWCRAG; ANVWCRAGG; NVWCRAGGI; VWCRAGGIR; WCRAGGIRM; CRAGGIRMA; RAGGIRMAP; AGGIRMAPR; GGIRMAPRP; GIRMAPRPV; IRMAPRPVI; RMAPRPVIP; MAPRPVIPV; APRPVIPVA; PRPVIPVAT; RPVIPVATQ; PVIPVATQQ; VIPVATQQR; IPVATQQRL; PVATQQRLR; VATQQRLRR; ATQQRLRRQ; TQQRLRRQA; QQRLRRQAD; QRLRRQADR; RLRRQADRQ; LRRQADRQS; RRQADRQSL; RQADRQSLG; QADRQSLGS; ADRQSLGSS; DRQSLGSSG; RQSLGSSGL; QSLGSSGLP; SLGSSGLPA; LGSSGLPAL; GSSGLPALN; SSGLPALNC; SGLPALNCT; GLPALNCTP; LPALNCTPI; PALNCTPIR; ALNCTPIRH; LNCTPIRHT; NCTPIRHTI; CTPIRHTID; TPIRHTIDV; PIRHTIDVM; IRHTIDVMA; RHTIDVMAT; HTIDVMATK; TIDVMATKP; IDVMATKPE; DVMATKPER; VMATKPERK; MATKPERKT; ATKPERKTE; TKPERKTER; KPERKTERL; PERKTERLA; ERKTERLAA; RKTERLAAR; KTERLAARL; TERLAARLT; ERLAARLTP; RLAARLTPE; LAARLTPEQ; AARLTPEQD; ARLTPEQDA; RLTPEQDAL; LTPEQDALI; TPEQDALIR; PEQDALIRR; EQDALIRRA; QDALIRRAA; DALIRRAAE; ALIRRAAEA; LIRRAAEAE; IRRAAEAEG; RRAAEAEGT; RAAEAEGTD; AAEAEGTDL; AEAEGTDLT; EAEGTDLTN; AEGTDLTNF; EGTDLTNFT; GTDLTNFTV; TDLTNFTVT; DLTNFTVTA; LTNFTVTAA; TNFTVTAAL; NFTVTAALA; FTVTAALAH; TVTAALAHA; VTAALAHAR; TAALAHARD; AALAHARDV; ALAHARDVL; LAHARDVLA; AHARDVLAD; HARDVLADR; ARDVLADRR; RDVLADRRL; DVLADRRLF; VLADRRLFV; LADRRLFVL; ADRRLFVLT; DRRLFVLTD; RRLFVLTDA; RLFVLTDAA; LFVLTDAAW; FVLTDAAWT; VLTDAAWTE; LTDAAWTEF; TDAAWTEFL; DAAWTEFLA; | |

Fig. 28 continued

| | | |
|---|---|---|
| | AAWTEFLAA; AWTEFLAAL; WTEFLAALD; TEFLAALDR; EFLAALDRP; FLAALDRPV; LAALDRPVS; AALDRPVSH; ALDRPVSHK; LDRPVSHKP; DRPVSHKPR; RPVSHKPRL; PVSHKPRLE; VSHKPRLEK; SHKPRLEKL; HKPRLEKLF; KPRLEKLFA; PRLEKLFAA; RLEKLFAAR; LEKLFAARS; EKLFAARSI; KLFAARSIF; LFAARSIFD; FAARSIFDT; AARSIFDTE; ARSIFDTEG<br><br>10 mers:<br>MHRAGAAVTA; HRAGAAVTAN; RAGAAVTANV; AGAAVTANVW; GAAVTANVWC; AAVTANVWCR; AVTANVWCRA; VTANVWCRAG; TANVWCRAGG; ANVWCRAGGI; NVWCRAGGIR; VWCRAGGIRM; WCRAGGIRMA; CRAGGIRMAP; RAGGIRMAPR; AGGIRMAPRP; GGIRMAPRPV; GIRMAPRPVI; IRMAPRPVIP; RMAPRPVIPV; MAPRPVIPVA; APRPVIPVAT; PRPVIPVATQ; RPVIPVATQQ; PVIPVATQQR; VIPVATQQRL; IPVATQQRLR; PVATQQRLRR; VATQQRLRRQ; ATQQRLRRQA; TQQRLRRQAD; QQRLRRQADR; QRLRRQADRQ; RLRRQADRQS; LRRQADRQSL; RRQADRQSLG; RQADRQSLGS; QADRQSLGSS; ADRQSLGSSG; DRQSLGSSGL; RQSLGSSGLP; QSLGSSGLPA; SLGSSGLPAL; LGSSGLPALN; GSSGLPALNC; SSGLPALNCT; SGLPALNCTP; GLPALNCTPI; LPALNCTPIR; PALNCTPIRH; ALNCTPIRHT; LNCTPIRHTI; NCTPIRHTID; CTPIRHTIDV; TPIRHTIDVM; PIRHTIDVMA; IRHTIDVMAT; RHTIDVMATK; HTIDVMATKP; TIDVMATKPE; IDVMATKPER; DVMATKPERK; VMATKPERKT; MATKPERKTE; ATKPERKTER; TKPERKTERL; KPERKTERLA; PERKTERLAA; ERKTERLAAR; RKTERLAARL; KTERLAARLT; TERLAARLTP; ERLAARLTPE; RLAARLTPEQ; LAARLTPEQD; AARLTPEQDA; ARLTPEQDAL; RLTPEQDALI; LTPEQDALIR; TPEQDALIRR; PEQDALIRRA; EQDALIRRAA; QDALIRRAAE; DALIRRAAEA; ALIRRAAEAE; LIRRAAEAEG; IRRAAEAEGT; RRAAEAEGTD; RAAEAEGTDL; AAEAEGTDLT; AEAEGTDLTN; EAEGTDLTNF; AEGTDLTNFT; EGTDLTNFTV; GTDLTNFTVT; TDLTNFTVTA; DLTNFTVTAA; LTNFTVTAAL; TNFTVTAALA; NFTVTAALAH; FTVTAALAHA; TVTAALAHAR; VTAALAHARD; TAALAHARDV; AALAHARDVL; ALAHARDVLA; LAHARDVLAD; AHARDVLADR; HARDVLADRR; ARDVLADRRL; RDVLADRRLF; DVLADRRLFV; VLADRRLFVL; LADRRLFVLT; ADRRLFVLTD; DRRLFVLTDA; RRLFVLTDAA; RLFVLTDAAW; LFVLTDAAWT; FVLTDAAWTE; VLTDAAWTEF; LTDAAWTEFL; TDAAWTEFLA; DAAWTEFLAA; AAWTEFLAAL; AWTEFLAALD; WTEFLAALDR; TEFLAALDRP; EFLAALDRPV; FLAALDRPVS; LAALDRPVSH; AALDRPVSHK; ALDRPVSHKP; LDRPVSHKPR; DRPVSHKPRL; RPVSHKPRLE; PVSHKPRLEK; VSHKPRLEKL; SHKPRLEKLF; HKPRLEKLFA; KPRLEKLFAA; PRLEKLFAAR; RLEKLFAARS; LEKLFAARSI; EKLFAARSIF; KLFAARSIFD; LFAARSIFDT; FAARSIFDTE; AARSIFDTEG<br><br>11 mers:<br>MHRAGAAVTAN; HRAGAAVTANV; RAGAAVTANVW; AGAAVTANVWC; GAAVTANVWCR; AAVTANVWCRA; AVTANVWCRAG; VTANVWCRAGG; TANVWCRAGGI; ANVWCRAGGIR; NVWCRAGGIRM; VWCRAGGIRMA; WCRAGGIRMAP; CRAGGIRMAPR; RAGGIRMAPRP; | |

Fig. 28 continued

| | | |
|---|---|---|
| | AGGIRMAPRPV; GGIRMAPRPVI; GIRMAPRPVIP; IRMAPRPVIPV; RMAPRPVIPVA; MAPRPVIPVAT; APRPVIPVATQ; PRPVIPVATQQ; RPVIPVATQQR; PVIPVATQQRL; VIPVATQQRLR; IPVATQQRLRR; PVATQQRLRRQ; VATQQRLRRQA; ATQQRLRRQAD; TQQRLRRQADR; QQRLRRQADRQ; QRLRRQADRQS; RLRRQADRQSL; LRRQADRQSLG; RRQADRQSLGS; RQADRQSLGSS; QADRQSLGSSG; ADRQSLGSSGL; DRQSLGSSGLP; RQSLGSSGLPA; QSLGSSGLPAL; SLGSSGLPALN; LGSSGLPALNC; GSSGLPALNCT; SSGLPALNCTP; SGLPALNCTPI; GLPALNCTPIR; LPALNCTPIRH; PALNCTPIRHT; ALNCTPIRHTI; LNCTPIRHTID; NCTPIRHTIDV; CTPIRHTIDVM; TPIRHTIDVMA; PIRHTIDVMAT; IRHTIDVMATK; RHTIDVMATKP; HTIDVMATKPE; TIDVMATKPER; IDVMATKPERK; DVMATKPERKT; VMATKPERKTE; MATKPERKTER; ATKPERKTERL; TKPERKTERLA; KPERKTERLAA; PERKTERLAAR; ERKTERLAARL; RKTERLAARLT; KTERLAARLTP; TERLAARLTPE; ERLAARLTPEQ; RLAARLTPEQD; LAARLTPEQDA; AARLTPEQDAL; ARLTPEQDALI; RLTPEQDALIR; LTPEQDALIRR; TPEQDALIRRA; PEQDALIRRAA; EQDALIRRAAE; QDALIRRAAEA; DALIRRAAEAE; ALIRRAAEAEG; LIRRAAEAEGT; IRRAAEAEGTD; RRAAEAEGTDL; RAAEAEGTDLT; AAEAEGTDLTN; AEAEGTDLTNF; EAEGTDLTNFT; AEGTDLTNFTV; EGTDLTNFTVT; GTDLTNFTVTA; TDLTNFTVTAA; DLTNFTVTAAL; LTNFTVTAALA; TNFTVTAALAH; NFTVTAALAHA; FTVTAALAHAR; TVTAALAHARD; VTAALAHARDV; TAALAHARDVL; AALAHARDVLA; ALAHARDVLAD; LAHARDVLADR; AHARDVLADRR; HARDVLADRRL; ARDVLADRRLF; RDVLADRRLFV; DVLADRRLFVL; VLADRRLFVLT; LADRRLFVLTD; ADRRLFVLTDA; DRRLFVLTDAA; RRLFVLTDAAW; RLFVLTDAAWT; LFVLTDAAWTE; FVLTDAAWTEF; VLTDAAWTEFL; LTDAAWTEFLA; TDAAWTEFLAA; DAAWTEFLAAL; AAWTEFLAALD; AWTEFLAALDR; WTEFLAALDRP; TEFLAALDRPV; EFLAALDRPVS; FLAALDRPVSH; LAALDRPVSHK; AALDRPVSHKP; ALDRPVSHKPR; LDRPVSHKPRL; DRPVSHKPRLE; RPVSHKPRLEK; PVSHKPRLEKL; VSHKPRLEKLF; SHKPRLEKLFA; HKPRLEKLFAA; KPRLEKLFAAR; PRLEKLFAARS; RLEKLFAARSI; LEKLFAARSIF; EKLFAARSIFD; KLFAARSIFDT; LFAARSIFDTE; FAARSIFDTEG | |
| 13) Rv1036c | 8 mers: MFRTVGDQ; FRTVGDQA; RTVGDQAS; TVGDQASL; VGDQASLW; GDQASLWE; DQASLWES; QASLWESV; ASLWESVL; SLWESVLP; LWESVLPE; WESVLPEE; ESVLPEEL; SVLPEELR; VLPEELRR; LPEELRRL; PEELRRLP; EELRRLPE; ELRRLPEE; LRRLPEEL; RRLPEELA; RLPEELAR; LPEELARV; PEELARVD; EELARVDA; ELARVDAL; LARVDALL; ARVDALLD; RVDALLDD; VDALLDDS; DALLDDSA; ALLDDSAF; LLDDSAFF; LDDSAFFC; DDSAFFCP; DSAFFCPF; SAFFCPFV; AFFCPFVP; FFCPFVPF; FCPFVPFF; CPFVPFFD; PFVPFFDP; FVPFFDPR; VPFFDPRM; PFFDPRMG; FFDPRMGR; FDPRMGRP; DPRMGRPS; PRMGRPSI; RMGRPSIP; MGRPSIPM; GRPSIPME; RPSIPMET; PSIPMETY; SIPMETYL; IPMETYLR; PMETYLRL; METYLRLM; ETYLRLMF; TYLRLMFL; YLRLMFLK; LRLMFLKF; RLMFLKFR; LMFLKFRY; MFLKFRYR; FLKFRYRL; LKFRYRLG; KFRYRLGY; FRYRLGYE; RYRLGYES; YRLGYESL; RLGYESLC; LGYESLCR; GYESLCRE; YESLCREV; ESLCREVT; SLCREVTD; LCREVTDS; CREVTDSI; REVTDSIT; EVTDSITW; VTDSITWR; TDSITWRR; DSITWRRF; SITWRRFC; | 11237-12138 |

Fig. 28 continued

| | | |
|---|---|---|
| | ITWRRFCR; TWRRFCRI; WRRFCRIP; RRFCRIPL; RFCRIPLE; FCRIPLEG; CRIPLEGS; RIPLEGSV; IPLEGSVP; PLEGSVPH; LEGSVPHP; EGSVPHPT; GSVPHPTT; SVPHPTTL; VPHPTTLM; PHPTTLMK; HPTTLMKL; PTTLMKLT; TTLMKLTT; TLMKLTTR; LMKLTTRC; MKLTTRCG; KLTTRCGE; LTTRCGED; TTRCGEDA; TRCGEDAV; RCGEDAVA; CGEDAVAG; GEDAVAGL; EDAVAGLN; DAVAGLNE; AVAGLNEA; VAGLNEAL; AGLNEALL; GLNEALLA; LNEALLAK; NEALLAKA; EALLAKAA; ALLAKAAS; LLAKAASE; LAKAASEK; AKAASEKL; KAASEKLL; AASEKLLR; ASEKLLRT; SEKLLRTN; EKLLRTNK; KLLRTNKV; LLRTNKVR; LRTNKVRA; RTNKVRAD; TNKVRADT; NKVRADTT; KVRADTTV; VRADTTVV; RADTTVVE; ADTTVVEG; DTTVVEGD; TTVVEGDV; TVVEGDVG; VVEGDVGY; VEGDVGYP; EGDVGYPT; GDVGYPTD; DVGYPTDT; VGYPTDTG; GYPTDTGL; YPTDTGLL; PTDTGLLA; TDTGLLAK; DTGLLAKA; TGLLAKAV; GLLAKAVG; LLAKAVGS; LAKAVGSM; AKAVGSMA; KAVGSMAR; AVGSMART; VGSMARTV; GSMARTVA; SMARTVAR; MARTVARI; ARTVARIK; RTVARIKA; TVARIKAA; VARIKAAD; ARIKAADA; RIKAADAG; IKAADAGS; KAADAGSA; AADAGSAP; ADAGSAPL; DAGSAPLG; AGSAPLGG; GSAPLGGS; SAPLGGSS; APLGGSSG; PLGGSSGP; LGGSSGPR; GGSSGPRD; GSSGPRDR; SSGPRDRL; SGPRDRLQ; GPRDRLQA; PRDRLQAA; RDRLQAAV; DRLQAAVT; RLQAAVTR; LQAAVTRR; QAAVTRRA; AAVTRRAA; AVTRRAAT; VTRRAATR; TRRAATRS; RRAATRSG; RAATRSGA; AATRSGAG; ATRSGAGL; TRSGAGLR; RSGAGLRA; SGAGLRAP; GAGLRAPD; AGLRAPDH; GLRAPDHR; LRAPDHRG; RAPDHRGA; APDHRGAS; PDHRGASR; DHRGASRD; HRGASRDR; RGASRDRR; GASRDRRA; ASRDRRAG; SRDRRAGA; RDRRAGAD; DRRAGADR; RRAGADRG; RAGADRGC; AGADRGCR; GADRGCRG; ADRGCRGG; DRGCRGGT<br><br>9 mers:<br>MFRTVGDQA; FRTVGDQAS; RTVGDQASL; TVGDQASLW; VGDQASLWE; GDQASLWES; DQASLWESV; QASLWESVL; ASLWESVLP; SLWESVLPE; LWESVLPEE; WESVLPEEL; ESVLPEELR; SVLPEELRR; VLPEELRRL; LPEELRRLP; PEELRRLPE; EELRRLPEE; ELRRLPEEL; LRRLPEELA; RRLPEELAR; RLPEELARV; LPEELARVD; PEELARVDA; EELARVDAL; ELARVDALL; LARVDALLD; ARVDALLDD; RVDALLDDS; VDALLDDSA; DALLDDSAF; ALLDDSAFF; LLDDSAFFC; LDDSAFFCP; DDSAFFCPF; DSAFFCPFV; SAFFCPFVP; AFFCPFVPF; FFCPFVPFF; FCPFVPFFD; CPFVPFFDP; PFVPFFDPR; FVPFFDPRM; VPFFDPRMG; PFFDPRMGR; FFDPRMGRP; FDPRMGRPS; DPRMGRPSI; PRMGRPSIP; RMGRPSIPM; MGRPSIPME; GRPSIPMET; RPSIPMETY; PSIPMETYL; SIPMETYLR; IPMETYLRL; PMETYLRLM; METYLRLMF; ETYLRLMFL; TYLRLMFLK; YLRLMFLKF; LRLMFLKFR; RLMFLKFRY; LMFLKFRYR; MFLKFRYRL; FLKFRYRLG; LKFRYRLGY; KFRYRLGYE; FRYRLGYES; RYRLGYESL; YRLGYESLC; RLGYESLCR; LGYESLCRE; GYESLCREV; YESLCREVT; ESLCREVTD; SLCREVTDS; LCREVTDSI; CREVTDSIT; REVTDSITW; EVTDSITWR; VTDSITWRR; TDSITWRRF; DSITWRRFC; SITWRRFCR; ITWRRFCRI; TWRRFCRIP; WRRFCRIPL; RRFCRIPLE; RFCRIPLEG; FCRIPLEGS; CRIPLEGSV; RIPLEGSVP; IPLEGSVPH; PLEGSVPHP; LEGSVPHPT; EGSVPHPTT; GSVPHPTTL; SVPHPTTLM; VPHPTTLMK; PHPTTLMKL; HPTTLMKLT; | |

Fig. 28 continued

| | | |
|---|---|---|
| | PTTLMKLTT; TTLMKLTTR; TLMKLTTRC; LMKLTTRCG; MKLTTRCGE; KLTTRCGED; LTTRCGEDA; TTRCGEDAV; TRCGEDAVA; RCGEDAVAG; CGEDAVAGL; GEDAVAGLN; EDAVAGLNE; DAVAGLNEA; AVAGLNEAL; VAGLNEALL; AGLNEALLA; GLNEALLAK; LNEALLAKA; NEALLAKAA; EALLAKAAS; ALLAKAASE; LLAKAASEK; LAKAASEKL; AKAASEKLL; KAASEKLLR; AASEKLLRT; ASEKLLRTN; SEKLLRTNK; EKLLRTNKV; KLLRTNKVR; LLRTNKVRA; LRTNKVRAD; RTNKVRADT; TNKVRADTT; NKVRADTTV; KVRADTTVV; VRADTTVVE; RADTTVVEG; ADTTVVEGD; DTTVVEGDV; TTVVEGDVG; TVVEGDVGY; VVEGDVGYP; VEGDVGYPT; EGDVGYPTD; GDVGYPTDT; DVGYPTDTG; VGYPTDTGL; GYPTDTGLL; YPTDTGLLA; PTDTGLLAK; TDTGLLAKA; DTGLLAKAV; TGLLAKAVG; GLLAKAVGS; LLAKAVGSM; LAKAVGSMA; AKAVGSMAR; KAVGSMART; AVGSMARTV; VGSMARTVA; GSMARTVAR; SMARTVARI; MARTVARIK; ARTVARIKA; RTVARIKAA; TVARIKAAD; VARIKAADA; ARIKAADAG; RIKAADAGS; IKAADAGSA; KAADAGSAP; AADAGSAPL; ADAGSAPLG; DAGSAPLGG; AGSAPLGGS; GSAPLGGSS; SAPLGGSSG; APLGGSSGP; PLGGSSGPR; LGGSSGPRD; GGSSGPRDR; GSSGPRDRL; SSGPRDRLQ; SGPRDRLQA; GPRDRLQAA; PRDRLQAAV; RDRLQAAVT; DRLQAAVTR; RLQAAVTRR; LQAAVTRRA; QAAVTRRAA; AAVTRRAAT; AVTRRAATR; VTRRAATRS; TRRAATRSG; RRAATRSGA; RAATRSGAG; AATRSGAGL; ATRSGAGLR; TRSGAGLRA; RSGAGLRAP; SGAGLRAPD; GAGLRAPDH; AGLRAPDHR; GLRAPDHRG; LRAPDHRGA; RAPDHRGAS; APDHRGASR; PDHRGASRD; DHRGASRDR; HRGASRDRR; RGASRDRRA; GASRDRRAG; ASRDRRAGA; SRDRRAGAD; RDRRAGADR; DRRAGADRG; RRAGADRGC; RAGADRGCR; AGADRGCRG; GADRGCRGG; ADRGCRGGT<br><br>10 mers:<br>MFRTVGDQAS; FRTVGDQASL; RTVGDQASLW; TVGDQASLWE; VGDQASLWES; GDQASLWESV; DQASLWESVL; QASLWESVLP; ASLWESVLPE; SLWESVLPEE; LWESVLPEEL; WESVLPEELR; ESVLPEELRR; SVLPEELRRL; VLPEELRRLP; LPEELRRLPE; PEELRRLPEE; EELRRLPEEL; ELRRLPEELA; LRRLPEELAR; RRLPEELARV; RLPEELARVD; LPEELARVDA; PEELARVDAL; EELARVDALL; ELARVDALLD; LARVDALLDD; ARVDALLDDS; RVDALLDDSA; VDALLDDSAF; DALLDDSAFF; ALLDDSAFFC; LLDDSAFFCP; LDDSAFFCPF; DDSAFFCPFV; DSAFFCPFVP; SAFFCPFVPF; AFFCPFVPFF; FFCPFVPFFD; FCPFVPFFDP; CPFVPFFDPR; PFVPFFDPRM; FVPFFDPRMG; VPFFDPRMGR; PFFDPRMGRP; FFDPRMGRPS; FDPRMGRPSI; DPRMGRPSIP; PRMGRPSIPM; RMGRPSIPME; MGRPSIPMET; GRPSIPMETY; RPSIPMETYL; PSIPMETYLR; SIPMETYLRL; IPMETYLRLM; PMETYLRLMF; METYLRLMFL; ETYLRLMFLK; TYLRLMFLKF; YLRLMFLKFR; LRLMFLKFRY; RLMFLKFRYR; LMFLKFRYRL; MFLKFRYRLG; FLKFRYRLGY; LKFRYRLGYE; KFRYRLGYES; FRYRLGYESL; RYRLGYESLC; YRLGYESLCR; RLGYESLCRE; LGYESLCREV; GYESLCREVT; YESLCREVTD; ESLCREVTDS; SLCREVTDSI; LCREVTDSIT; CREVTDSITW; REVTDSITWR; EVTDSITWRR; VTDSITWRRF; TDSITWRRFC; DSITWRRFCR; SITWRRFCRI; ITWRRFCRIP; TWRRFCRIPL; WRRFCRIPLE; | |

Fig. 28 continued

| | | | |
|---|---|---|---|
| | RRFCRIPLEG; RFCRIPLEGS; FCRIPLEGSV; CRIPLEGSVP; RIPLEGSVPH; IPLEGSVPHP; PLEGSVPHPT; LEGSVPHPTT; EGSVPHPTTL; GSVPHPTTLM; SVPHPTTLMK; VPHPTTLMKL; PHPTTLMKLT; HPTTLMKLTT; PTTLMKLTTR; TTLMKLTTRC; TLMKLTTRCG; LMKLTTRCGE; MKLTTRCGED; KLTTRCGEDA; LTTRCGEDAV; TTRCGEDAVA; TRCGEDAVAG; RCGEDAVAGL; CGEDAVAGLN; GEDAVAGLNE; EDAVAGLNEA; DAVAGLNEAL; AVAGLNEALL; VAGLNEALLA; AGLNEALLAK; GLNEALLAKA; LNEALLAKAA; NEALLAKAAS; EALLAKAASE; ALLAKAASEK; LLAKAASEKL; LAKAASEKLL; AKAASEKLLR; KAASEKLLRT; AASEKLLRTN; ASEKLLRTNK; SEKLLRTNKV; EKLLRTNKVR; KLLRTNKVRA; LLRTNKVRAD; LRTNKVRADT; RTNKVRADTT; TNKVRADTTV; NKVRADTTVV; KVRADTTVVE; VRADTTVVEG; RADTTVVEGD; ADTTVVEGDV; DTTVVEGDVG; TTVVEGDVGY; TVVEGDVGYP; VVEGDVGYPT; VEGDVGYPTD; EGDVGYPTDT; GDVGYPTDTG; DVGYPTDTGL; VGYPTDTGLL; GYPTDTGLLA; YPTDTGLLAK; PTDTGLLAKA; TDTGLLAKAV; DTGLLAKAVG; TGLLAKAVGS; GLLAKAVGSM; LLAKAVGSMA; LAKAVGSMAR; AKAVGSMART; KAVGSMARTV; AVGSMARTVA; VGSMARTVAR; GSMARTVARI; SMARTVARIK; MARTVARIKA; ARTVARIKAA; RTVARIKAAD; TVARIKAADA; VARIKAADAG; ARIKAADAGS; RIKAADAGSA; IKAADAGSAP; KAADAGSAPL; AADAGSAPLG; ADAGSAPLGG; DAGSAPLGGS; AGSAPLGGSS; GSAPLGGSSG; SAPLGGSSGP; APLGGSSGPR; PLGGSSGPRD; LGGSSGPRDR; GGSSGPRDRL; GSSGPRDRLQ; SSGPRDRLQA; SGPRDRLQAA; GPRDRLQAAV; PRDRLQAAVT; RDRLQAAVTR; DRLQAAVTRR; RLQAAVTRRA; LQAAVTRRAA; QAAVTRRAAT; AAVTRRAATR; AVTRRAATRS; VTRRAATRSG; TRRAATRSGA; RRAATRSGAG; RAATRSGAGL; AATRSGAGLR; ATRSGAGLRA; TRSGAGLRAP; RSGAGLRAPD; SGAGLRAPDH; GAGLRAPDHR; AGLRAPDHRG; GLRAPDHRGA; LRAPDHRGAS; RAPDHRGASR; APDHRGASRD; PDHRGASRDR; DHRGASRDRR; HRGASRDRRA; RGASRDRRAG; GASRDRRAGA; ASRDRRAGAD; SRDRRAGADR; RDRRAGADRG; DRRAGADRGC; RRAGADRGCR; RAGADRGCRG; AGADRGCRGG; GADRGCRGGT<br><br>11 mers:<br>MFRTVGDQASL; FRTVGDQASLW; RTVGDQASLWE; TVGDQASLWES; VGDQASLWESV; GDQASLWESVL; DQASLWESVLP; QASLWESVLPE; ASLWESVLPEE; SLWESVLPEEL; LWESVLPEELR; WESVLPEELRR; ESVLPEELRRL; SVLPEELRRLP; VLPEELRRLPE; LPEELRRLPEE; PEELRRLPEEL; EELRRLPEELA; ELRRLPEELAR; LRRLPEELARV; RRLPEELARVD; RLPEELARVDA; LPEELARVDAL; PEELARVDALL; EELARVDALLD; ELARVDALLDD; LARVDALLDDS; ARVDALLDDSA; RVDALLDDSAF; VDALLDDSAFF; DALLDDSAFFC; ALLDDSAFFCP; LLDDSAFFCPF; LDDSAFFCPFV; DDSAFFCPFVP; DSAFFCPFVPF; SAFFCPFVPFF; AFFCPFVPFFD; FFCPFVPFFDP; FCPFVPFFDPR; CPFVPFFDPRM; PFVPFFDPRMG; FVPFFDPRMGR; VPFFDPRMGRP; PFFDPRMGRPS; FFDPRMGRPSI; FDPRMGRPSIP; DPRMGRPSIPM; PRMGRPSIPME; RMGRPSIPMET; MGRPSIPMETY; GRPSIPMETYL; RPSIPMETYLR; PSIPMETYLRL; SIPMETYLRLM; IPMETYLRLMF; PMETYLRLMFL; METYLRLMFLK; ETYLRLMFLKF; TYLRLMFLKFR; YLRLMFLKFRY; LRLMFLKFRYR; | |

Fig. 28 continued

| | | |
|---|---|---|
| | RLMFLKFRYRL; LMFLKFRYRLG; MFLKFRYRLGY; FLKFRYRLGYE; LKFRYRLGYES; KFRYRLGYESL; FRYRLGYESLC; RYRLGYESLCR; YRLGYESLCRE; RLGYESLCREV; LGYESLCREVT; GYESLCREVTD; YESLCREVTDS; ESLCREVTDSI; SLCREVTDSIT; LCREVTDSITW; CREVTDSITWR; REVTDSITWRR; EVTDSITWRRF; VTDSITWRRFC; TDSITWRRFCR; DSITWRRFCRI; SITWRRFCRIP; ITWRRFCRIPL; TWRRFCRIPLE; WRRFCRIPLEG; RRFCRIPLEGS; RFCRIPLEGSV; FCRIPLEGSVP; CRIPLEGSVPH; RIPLEGSVPHP; IPLEGSVPHPT; PLEGSVPHPTT; LEGSVPHPTTL; EGSVPHPTTLM; GSVPHPTTLMK; SVPHPTTLMKL; VPHPTTLMKLT; PHPTTLMKLTT; HPTTLMKLTTR; PTTLMKLTTRC; TTLMKLTTRCG; TLMKLTTRCGE; LMKLTTRCGED; MKLTTRCGEDA; KLTTRCGEDAV; LTTRCGEDAVA; TTRCGEDAVAG; TRCGEDAVAGL; RCGEDAVAGLN; CGEDAVAGLNE; GEDAVAGLNEA; EDAVAGLNEAL; DAVAGLNEALL; AVAGLNEALLA; VAGLNEALLAK; AGLNEALLAKA; GLNEALLAKAA; LNEALLAKAAS; NEALLAKAASE; EALLAKAASEK; ALLAKAASEKL; LLAKAASEKLL; LAKAASEKLLR; AKAASEKLLRT; KAASEKLLRTN; AASEKLLRTNK; ASEKLLRTNKV; SEKLLRTNKVR; EKLLRTNKVRA; KLLRTNKVRAD; LLRTNKVRADT; LRTNKVRADTT; RTNKVRADTTV; TNKVRADTTVV; NKVRADTTVVE; KVRADTTVVEG; VRADTTVVEGD; RADTTVVEGDV; ADTTVVEGDVG; DTTVVEGDVGY; TTVVEGDVGYP; TVVEGDVGYPT; VVEGDVGYPTD; VEGDVGYPTDT; EGDVGYPTDTG; GDVGYPTDTGL; DVGYPTDTGLL; VGYPTDTGLLA; GYPTDTGLLAK; YPTDTGLLAKA; PTDTGLLAKAV; TDTGLLAKAVG; DTGLLAKAVGS; TGLLAKAVGSM; GLLAKAVGSMA; LLAKAVGSMAR; LAKAVGSMART; AKAVGSMARTV; KAVGSMARTVA; AVGSMARTVAR; VGSMARTVARI; GSMARTVARIK; SMARTVARIKA; MARTVARIKAA; ARTVARIKAAD; RTVARIKAADA; TVARIKAADAG; VARIKAADAGS; ARIKAADAGSA; RIKAADAGSAP; IKAADAGSAPL; KAADAGSAPLG; AADAGSAPLGG; ADAGSAPLGGS; DAGSAPLGGSS; AGSAPLGGSSG; GSAPLGGSSGP; SAPLGGSSGPR; APLGGSSGPRD; PLGGSSGPRDR; LGGSSGPRDRL; GGSSGPRDRLQ; GSSGPRDRLQA; SSGPRDRLQAA; SGPRDRLQAAV; GPRDRLQAAVT; PRDRLQAAVTR; RDRLQAAVTRR; DRLQAAVTRRA; RLQAAVTRRAA; LQAAVTRRAAT; QAAVTRRAATR; AAVTRRAATRS; AVTRRAATRSG; VTRRAATRSGA; TRRAATRSGAG; RRAATRSGAGL; RAATRSGAGLR; AATRSGAGLRA; ATRSGAGLRAP; TRSGAGLRAPD; RSGAGLRAPDH; SGAGLRAPDHR; GAGLRAPDHRG; AGLRAPDHRGA; GLRAPDHRGAS; LRAPDHRGASR; RAPDHRGASRD; APDHRGASRDR; PDHRGASRDRR; DHRGASRDRRA; HRGASRDRRAG; RGASRDRRAGA; GASRDRRAGAD; ASRDRRAGADR; SRDRRAGADRG; RDRRAGADRGC; DRRAGADRGCR; RRAGADRGCRG; RAGADRGCRGG; AGADRGCRGGT | |
| 14) Rv1037c | 8 mers: MTINYQFG; TINYQFGD; INYQFGDV; NYQFGDVD; YQFGDVDA; QFGDVDAH; FGDVDAHG; GDVDAHGA; DVDAHGAM; VDAHGAMI; DAHGAMIR; AHGAMIRA; HGAMIRAQ; GAMIRAQA; AMIRAQAG; MIRAQAGS; IRAQAGSL; RAQAGSLE; AQAGSLEA; QAGSLEAE; AGSLEAEH; GSLEAEHQ; SLEAEHQA; LEAEHQAI; EAEHQAII; AEHQAIIS; EHQAIISD; HQAIISDV; QAIISDVL; AIISDVLT; IISDVLTA; ISDVLTAS; SDVLTASD; DVLTASDF; VLTASDFW; LTASDFWG; TASDFWGG; ASDFWGGA; SDFWGGAG; DFWGGAGS; FWGGAGSA; | 12139-12480 |

Fig. 28 continued

| | | |
|---|---|---|
| | WGGAGSAA; GGAGSAAC; GAGSAACQ; AGSAACQG; GSAACQGF; SAACQGFI; AACQGFIT; ACQGFITQ; CQGFITQL; QGFITQLG; GFITQLGR; FITQLGRN; ITQLGRNF; TQLGRNFQ; QLGRNFQV; LGRNFQVI; GRNFQVIY; RNFQVIYE; NFQVIYEQ; FQVIYEQA; QVIYEQAN; VIYEQANA; IYEQANAH; YEQANAHG; EQANAHGQ; QANAHGQK; ANAHGQKV; NAHGQKVQ; AHGQKVQA; HGQKVQAA; GQKVQAAG; QKVQAAGN; KVQAAGNN; VQAAGNNM; QAAGNNMA; AAGNNMAQ; AGNNMAQT; GNNMAQTD; NNMAQTDS; NMAQTDSA; MAQTDSAV; AQTDSAVG; QTDSAVGS; TDSAVGSS; DSAVGSSW; SAVGSSWA;<br><br>9 mers:<br>MTINYQFGD; TINYQFGDV; INYQFGDVD; NYQFGDVDA; YQFGDVDAH; QFGDVDAHG; FGDVDAHGA; GDVDAHGAM; DVDAHGAMI; VDAHGAMIR; DAHGAMIRA; AHGAMIRAQ; HGAMIRAQA; GAMIRAQAG; AMIRAQAGS; MIRAQAGSL; IRAQAGSLE; RAQAGSLEA; AQAGSLEAE; QAGSLEAEH; AGSLEAEHQ; GSLEAEHQA; SLEAEHQAI; LEAEHQAII; EAEHQAIIS; AEHQAIISD; EHQAIISDV; HQAIISDVL; QAIISDVLT; AIISDVLTA; IISDVLTAS; ISDVLTASD; SDVLTASDF; DVLTASDFW; VLTASDFWG; LTASDFWGG; TASDFWGGA; ASDFWGGAG; SDFWGGAGS; DFWGGAGSA; FWGGAGSAA; WGGAGSAAC; GGAGSAACQ; GAGSAACQG; AGSAACQGF; GSAACQGFI; SAACQGFIT; AACQGFITQ; ACQGFITQL; CQGFITQLG; QGFITQLGR; GFITQLGRN; FITQLGRNF; ITQLGRNFQ; TQLGRNFQV; QLGRNFQVI; LGRNFQVIY; GRNFQVIYE; RNFQVIYEQ; NFQVIYEQA; FQVIYEQAN; QVIYEQANA; VIYEQANAH; IYEQANAHG; YEQANAHGQ; EQANAHGQK; QANAHGQKV; ANAHGQKVQ; NAHGQKVQA; AHGQKVQAA; HGQKVQAAG; GQKVQAAGN; QKVQAAGNN; KVQAAGNNM; VQAAGNNMA; QAAGNNMAQ; AAGNNMAQT; AGNNMAQTD; GNNMAQTDS; NNMAQTDSA; NMAQTDSAV; MAQTDSAVG; AQTDSAVGS; QTDSAVGSS; TDSAVGSSW; DSAVGSSWA;<br><br>10 mers:<br>MTINYQFGDV; TINYQFGDVD; INYQFGDVDA; NYQFGDVDAH; YQFGDVDAHG; QFGDVDAHGA; FGDVDAHGAM; GDVDAHGAMI; DVDAHGAMIR; VDAHGAMIRA; DAHGAMIRAQ; AHGAMIRAQA; HGAMIRAQAG; GAMIRAQAGS; AMIRAQAGSL; MIRAQAGSLE; IRAQAGSLEA; RAQAGSLEAE; AQAGSLEAEH; QAGSLEAEHQ; AGSLEAEHQA; GSLEAEHQAI; SLEAEHQAII; LEAEHQAIIS; EAEHQAIISD; AEHQAIISDV; EHQAIISDVL; HQAIISDVLT; QAIISDVLTA; AIISDVLTAS; IISDVLTASD; ISDVLTASDF; SDVLTASDFW; DVLTASDFWG; VLTASDFWGG; LTASDFWGGA; TASDFWGGAG; ASDFWGGAGS; SDFWGGAGSA; DFWGGAGSAA; FWGGAGSAAC; WGGAGSAACQ; GGAGSAACQG; GAGSAACQGF; AGSAACQGFI; GSAACQGFIT; SAACQGFITQ; AACQGFITQL; ACQGFITQLG; CQGFITQLGR; QGFITQLGRN; GFITQLGRNF; FITQLGRNFQ; ITQLGRNFQV; TQLGRNFQVI; QLGRNFQVIY; LGRNFQVIYE; GRNFQVIYEQ; RNFQVIYEQA; NFQVIYEQAN; FQVIYEQANA; QVIYEQANAH; VIYEQANAHG; IYEQANAHGQ; YEQANAHGQK; EQANAHGQKV; QANAHGQKVQ; ANAHGQKVQA; NAHGQKVQAA; AHGQKVQAAG; HGQKVQAAGN; GQKVQAAGNN; QKVQAAGNNM; KVQAAGNNMA; VQAAGNNMAQ; QAAGNNMAQT; | |

Fig. 28 continued

| | | |
|---|---|---|
| | AAGNNMAQTD; AGNNMAQTDS; GNNMAQTDSA; NNMAQTDSAV; NMAQTDSAVG; MAQTDSAVGS; AQTDSAVGSS; QTDSAVGSSW; TDSAVGSSWA;<br><br>11 mers:<br>MTINYQFGDVD; TINYQFGDVDA; INYQFGDVDAH; NYQFGDVDAHG; YQFGDVDAHGA; QFGDVDAHGAM; FGDVDAHGAMI; GDVDAHGAMIR; DVDAHGAMIRA; VDAHGAMIRAQ; DAHGAMIRAQA; AHGAMIRAQAG; HGAMIRAQAGS; GAMIRAQAGSL; AMIRAQAGSLE; MIRAQAGSLEA; IRAQAGSLEAE; RAQAGSLEAEH; AQAGSLEAEHQ; QAGSLEAEHQA; AGSLEAEHQAI; GSLEAEHQAII; SLEAEHQAIIS; LEAEHQAIISD; EAEHQAIISDV; AEHQAIISDVL; EHQAIISDVLT; HQAIISDVLTA; QAIISDVLTAS; AIISDVLTASD; IISDVLTASDF; ISDVLTASDFW; SDVLTASDFWG; DVLTASDFWGG; VLTASDFWGGA; LTASDFWGGAG; TASDFWGGAGS; ASDFWGGAGSA; SDFWGGAGSAA; DFWGGAGSAAC; FWGGAGSAACQ; WGGAGSAACQG; GGAGSAACQGF; GAGSAACQGFI; AGSAACQGFIT; GSAACQGFITQ; SAACQGFITQL; AACQGFITQLG; ACQGFITQLGR; CQGFITQLGRN; QGFITQLGRNF; GFITQLGRNFQ; FITQLGRNFQV; ITQLGRNFQVI; TQLGRNFQVIY; QLGRNFQVIYE; LGRNFQVIYEQ; GRNFQVIYEQA; RNFQVIYEQAN; NFQVIYEQANA; FQVIYEQANAH; QVIYEQANAHG; VIYEQANAHGQ; IYEQANAHGQK; YEQANAHGQKV; EQANAHGQKVQ; QANAHGQKVQA; ANAHGQKVQAA; NAHGQKVQAAG; AHGQKVQAAGN; HGQKVQAAGNN; GQKVQAAGNNM; QKVQAAGNNMA; KVQAAGNNMAQ; VQAAGNNMAQT; QAAGNNMAQTD; AAGNNMAQTDS; AGNNMAQTDSA; GNNMAQTDSAV; NNMAQTDSAVG; NMAQTDSAVGS; MAQTDSAVGSS; AQTDSAVGSSW; QTDSAVGSSWA; | |
| 15) Rv1038c | 8 mers:<br>MASRFMTD; ASRFMTDP; SRFMTDPH; RFMTDPHA; FMTDPHAM; MTDPHAMR; TDPHAMRD; DPHAMRDM; PHAMRDMA; HAMRDMAG; AMRDMAGR; MRDMAGRF; RDMAGRFE; DMAGRFEV; MAGRFEVH; AGRFEVHA; GRFEVHAQ; RFEVHAQT; FEVHAQTV; EVHAQTVE; VHAQTVED; HAQTVEDE; AQTVEDEA; QTVEDEAR; TVEDEARR; VEDEARRM; EDEARRMW; DEARRMWA; EARRMWAS; ARRMWASA; RRMWASAQ; RMWASAQN; MWASAQNI; WASAQNIS; ASAQNISG; SAQNISGA; AQNISGAG; QNISGAGW; NISGAGWS; ISGAGWSG; SGAGWSGM; GAGWSGMA; AGWSGMAE; GWSGMAEA; WSGMAEAT; SGMAEATS; GMAEATSL; MAEATSLD; AEATSLDT; EATSLDTM; ATSLDTMT; TSLDTMTQ; SLDTMTQM; LDTMTQMN; DTMTQMNQ; TMTQMNQA; MTQMNQAF; TQMNQAFR; QMNQAFRN; MNQAFRNI; NQAFRNIV; QAFRNIVN; AFRNIVNM; FRNIVNML; RNIVNMLH; NIVNMLHG; IVNMLHGV; VNMLHGVR; NMLHGVRD; MLHGVRDG; LHGVRDGL; HGVRDGLV; GVRDGLVR; VRDGLVRD; RDGLVRDA; DGLVRDAN; GLVRDANN; LVRDANNY; VRDANNYE; RDANNYEQ; DANNYEQQ; ANNYEQQE; NNYEQQEQ; NYEQQEQA; YEQQEQAS; EQQEQASQ; QQEQASQQ; QEQASQQI; EQASQQIL; QASQQILS; ASQQILSS;<br><br>9 mers:<br>MASRFMTDP; ASRFMTDPH; SRFMTDPHA; RFMTDPHAM; FMTDPHAMR; MTDPHAMRD; TDPHAMRDM; DPHAMRDMA; | 12481-12838 |

Fig. 28 continued

| | | |
|---|---|---|
| | PHAMRDMAG; HAMRDMAGR; AMRDMAGRF; MRDMAGRFE; RDMAGRFEV; DMAGRFEVH; MAGRFEVHA; AGRFEVHAQ; GRFEVHAQT; RFEVHAQTV; FEVHAQTVE; EVHAQTVED; VHAQTVEDE; HAQTVEDEA; AQTVEDEAR; QTVEDEARR; TVEDEARRM; VEDEARRMW; EDEARRMWA; DEARRMWAS; EARRMWASA; ARRMWASAQ; RRMWASAQN; RMWASAQNI; MWASAQNIS; WASAQNISG; ASAQNISGA; SAQNISGAG; AQNISGAGW; QNISGAGWS; NISGAGWSG; ISGAGWSGM; SGAGWSGMA; GAGWSGMAE; AGWSGMAEA; GWSGMAEAT; WSGMAEATS; SGMAEATSL; GMAEATSLD; MAEATSLDT; AEATSLDTM; EATSLDTMT; ATSLDTMTQ; TSLDTMTQM; SLDTMTQMN; LDTMTQMNQ; DTMTQMNQA; TMTQMNQAF; MTQMNQAFR; TQMNQAFRN; QMNQAFRNI; MNQAFRNIV; NQAFRNIVN; QAFRNIVNM; AFRNIVNML; FRNIVNMLH; RNIVNMLHG; NIVNMLHGV; IVNMLHGVR; VNMLHGVRD; NMLHGVRDG; MLHGVRDGL; LHGVRDGLV; HGVRDGLVR; GVRDGLVRD; VRDGLVRDA; RDGLVRDAN; DGLVRDANN; GLVRDANNY; LVRDANNYE; VRDANNYEQ; RDANNYEQQ; DANNYEQQE; ANNYEQQEQ; NNYEQQEQA; NYEQQEQAS; YEQQEQASQ; EQQEQASQQ; QQEQASQQI; QEQASQQIL; EQASQQILS; QASQQILSS;<br><br>10 mers:<br>MASRFMTDPH; ASRFMTDPHA; SRFMTDPHAM; RFMTDPHAMR; FMTDPHAMRD; MTDPHAMRDM; TDPHAMRDMA; DPHAMRDMAG; PHAMRDMAGR; HAMRDMAGRF; AMRDMAGRFE; MRDMAGRFEV; RDMAGRFEVH; DMAGRFEVHA; MAGRFEVHAQ; AGRFEVHAQT; GRFEVHAQTV; RFEVHAQTVE; FEVHAQTVED; EVHAQTVEDE; VHAQTVEDEA; HAQTVEDEAR; AQTVEDEARR; QTVEDEARRM; TVEDEARRMW; VEDEARRMWA; EDEARRMWAS; DEARRMWASA; EARRMWASAQ; ARRMWASAQN; RRMWASAQNI; RMWASAQNIS; MWASAQNISG; WASAQNISGA; ASAQNISGAG; SAQNISGAGW; AQNISGAGWS; QNISGAGWSG; NISGAGWSGM; ISGAGWSGMA; SGAGWSGMAE; GAGWSGMAEA; AGWSGMAEAT; GWSGMAEATS; WSGMAEATSL; SGMAEATSLD; GMAEATSLDT; MAEATSLDTM; AEATSLDTMT; EATSLDTMTQ; ATSLDTMTQM; TSLDTMTQMN; SLDTMTQMNQ; LDTMTQMNQA; DTMTQMNQAF; TMTQMNQAFR; MTQMNQAFRN; TQMNQAFRNI; QMNQAFRNIV; MNQAFRNIVN; NQAFRNIVNM; QAFRNIVNML; AFRNIVNMLH; FRNIVNMLHG; RNIVNMLHGV; NIVNMLHGVR; IVNMLHGVRD; VNMLHGVRDG; NMLHGVRDGL; MLHGVRDGLV; LHGVRDGLVR; HGVRDGLVRD; GVRDGLVRDA; VRDGLVRDAN; RDGLVRDANN; DGLVRDANNY; GLVRDANNYE; LVRDANNYEQ; VRDANNYEQQ; RDANNYEQQE; DANNYEQQEQ; ANNYEQQEQA; NNYEQQEQAS; NYEQQEQASQ; YEQQEQASQQ; EQQEQASQQI; QQEQASQQIL; QEQASQQILS; EQASQQILSS;<br><br>11 mers:<br>MASRFMTDPHA; ASRFMTDPHAM; SRFMTDPHAMR; RFMTDPHAMRD; FMTDPHAMRDM; MTDPHAMRDMA; TDPHAMRDMAG; DPHAMRDMAGR; PHAMRDMAGRF; HAMRDMAGRFE; AMRDMAGRFEV; MRDMAGRFEVH; RDMAGRFEVHA; DMAGRFEVHAQ; MAGRFEVHAQT; | |

Fig. 28 continued

| | | |
|---|---|---|
| | AGRFEVHAQTV; GRFEVHAQTVE; RFEVHAQTVED; FEVHAQTVEDE; EVHAQTVEDEA; VHAQTVEDEAR; HAQTVEDEARR; AQTVEDEARRM; QTVEDEARRMW; TVEDEARRMWA; VEDEARRMWAS; EDEARRMWASA; DEARRMWASAQ; EARRMWASAQN; ARRMWASAQNI; RRMWASAQNIS; RMWASAQNISG; MWASAQNISGA; WASAQNISGAG; ASAQNISGAGW; SAQNISGAGWS; AQNISGAGWSG; QNISGAGWSGM; NISGAGWSGMA; ISGAGWSGMAE; SGAGWSGMAEA; GAGWSGMAEAT; AGWSGMAEATS; GWSGMAEATSL; WSGMAEATSLD; SGMAEATSLDT; GMAEATSLDTM; MAEATSLDTMT; AEATSLDTMTQ; EATSLDTMTQM; ATSLDTMTQMN; TSLDTMTQMNQ; SLDTMTQMNQA; LDTMTQMNQAF; DTMTQMNQAFR; TMTQMNQAFRN; MTQMNQAFRNI; TQMNQAFRNIV; QMNQAFRNIVN; MNQAFRNIVNM; NQAFRNIVNML; QAFRNIVNMLH; AFRNIVNMLHG; FRNIVNMLHGV; RNIVNMLHGVR; NIVNMLHGVRD; IVNMLHGVRDG; VNMLHGVRDGL; NMLHGVRDGLV; MLHGVRDGLVR; LHGVRDGLVRD; HGVRDGLVRDA; GVRDGLVRDAN; VRDGLVRDANN; RDGLVRDANNY; DGLVRDANNYE; GLVRDANNYEQ; LVRDANNYEQQ; VRDANNYEQQE; RDANNYEQQEQ; DANNYEQQEQA; ANNYEQQEQAS; NNYEQQEQASQ; NYEQQEQASQQ; YEQQEQASQQI; EQQEQASQQIL; QQEQASQQILS; QEQASQQILSS; | |
| 16) Rv1152 | 8 mers:<br>MELRDWLR; ELRDWLRV; LRDWLRVD; RDWLRVDV; DWLRVDVK; WLRVDVKA; LRVDVKAG; RVDVKAGK; VDVKAGKP; DVKAGKPL; VKAGKPLF; KAGKPLFD; AGKPLFDQ; GKPLFDQL; KPLFDQLR; PLFDQLRT; LFDQLRTQ; FDQLRTQV; DQLRTQVI; QLRTQVID; LRTQVIDG; RTQVIDGV; TQVIDGVR; QVIDGVRA; VIDGVRAG; IDGVRAGA; DGVRAGAL; GVRAGALP; VRAGALPP; RAGALPPG; AGALPPGT; GALPPGTR; ALPPGTRL; LPPGTRLP; PPGTRLPT; PGTRLPTV; GTRLPTVR; TRLPTVRD; RLPTVRDL; LPTVRDLA; PTVRDLAG; TVRDLAGQ; VRDLAGQL; RDLAGQLG; DLAGQLGV; LAGQLGVA; AGQLGVAA; GQLGVAAN; QLGVAANT; LGVAANTV; GVAANTVA; VAANTVAR; AANTVARA; ANTVARAY; NTVARAYR; TVARAYRE; VARAYREL; ARAYRELE; RAYRELES; AYRELESA; YRELESAA; RELESAAI; ELESAAIV; LESAAIVE; ESAAIVET; SAAIVETR; AAIVETRG; AIVETRGR; IVETRGRF; VETRGRFG; ETRGRFGT; TRGRFGTF; RGRFGTFI; GRFGTFIS; RFGTFISR; FGTFISRF; GTFISRFD; TFISRFDP; FISRFDPT; ISRFDPTD; SRFDPTDA; RFDPTDAA; FDPTDAAM; DPTDAAMA; PTDAAMAA; TDAAMAAA; DAAMAAAA; AAMAAAAK; AMAAAAKE; MAAAAKEY; AAAAKEYV; AAAKEYVG; AAKEYVGV; AKEYVGVA; KEYVGVAR; EYVGVARA; YVGVARAL; VGVARALG; GVARALGL; VARALGLT; ARALGLTK; RALGLTKS; ALGLTKSD; LGLTKSDA; GLTKSDAM; LTKSDAMR; TKSDAMRY; KSDAMRYL; SDAMRYLT; DAMRYLTH; AMRYLTHV; MRYLTHVP; RYLTHVPD; YLTHVPDD<br><br>9 mers:<br>MELRDWLRV; ELRDWLRVD; LRDWLRVDV; RDWLRVDVK; DWLRVDVKA; WLRVDVKAG; LRVDVKAGK; RVDVKAGKP; VDVKAGKPL; DVKAGKPLF; VKAGKPLFD; KAGKPLFDQ; | 12839-13286 |

Fig. 28 continued

| | | |
|---|---|---|
| | AGKPLFDQL; GKPLFDQLR; KPLFDQLRT; PLFDQLRTQ; LFDQLRTQV; FDQLRTQVI; DQLRTQVID; QLRTQVIDG; LRTQVIDGV; RTQVIDGVR; TQVIDGVRA; QVIDGVRAG; VIDGVRAGA; IDGVRAGAL; DGVRAGALP; GVRAGALPP; VRAGALPPG; RAGALPPGT; AGALPPGTR; GALPPGTRL; ALPPGTRLP; LPPGTRLPT; PPGTRLPTV; PGTRLPTVR; GTRLPTVRD; TRLPTVRDL; RLPTVRDLA; LPTVRDLAG; PTVRDLAGQ; TVRDLAGQL; VRDLAGQLG; RDLAGQLGV; DLAGQLGVA; LAGQLGVAA; AGQLGVAAN; GQLGVAANT; QLGVAANTV; LGVAANTVA; GVAANTVAR; VAANTVARA; AANTVARAY; ANTVARAYR; NTVARAYRE; TVARAYREL; VARAYRELE; ARAYRELES; RAYRELESA; AYRELESAA; YRELESAAI; RELESAAIV; ELESAAIVE; LESAAIVET; ESAAIVETR; SAAIVETRG; AAIVETRGR; AIVETRGRF; IVETRGRFG; VETRGRFGT; ETRGRFGTF; TRGRFGTFI; RGRFGTFIS; GRFGTFISR; RFGTFISRF; FGTFISRFD; GTFISRFDP; TFISRFDPT; FISRFDPTD; ISRFDPTDA; SRFDPTDAA; RFDPTDAAM; FDPTDAAMA; DPTDAAMAA; PTDAAMAAA; TDAAMAAAA; DAAMAAAAK; AAMAAAAKE; AMAAAAKEY; MAAAAKEYV; AAAAKEYVG; AAAKEYVGV; AAKEYVGVA; AKEYVGVAR; KEYVGVARA; EYVGVARAL; YVGVARALG; VGVARALGL; GVARALGLT; VARALGLTK; ARALGLTKS; RALGLTKSD; ALGLTKSDA; LGLTKSDAM; GLTKSDAMR; LTKSDAMRY; TKSDAMRYL; KSDAMRYLT; SDAMRYLTH; DAMRYLTHV; AMRYLTHVP; MRYLTHVPD; RYLTHVPDD;<br><br>10 mers:<br>MELRDWLRVD; ELRDWLRVDV; LRDWLRVDVK; RDWLRVDVKA; DWLRVDVKAG; WLRVDVKAGK; LRVDVKAGKP; RVDVKAGKPL; VDVKAGKPLF; DVKAGKPLFD; VKAGKPLFDQ; KAGKPLFDQL; AGKPLFDQLR; GKPLFDQLRT; KPLFDQLRTQ; PLFDQLRTQV; LFDQLRTQVI; FDQLRTQVID; DQLRTQVIDG; QLRTQVIDGV; LRTQVIDGVR; RTQVIDGVRA; TQVIDGVRAG; QVIDGVRAGA; VIDGVRAGAL; IDGVRAGALP; DGVRAGALPP; GVRAGALPPG; VRAGALPPGT; RAGALPPGTR; AGALPPGTRL; GALPPGTRLP; ALPPGTRLPT; LPPGTRLPTV; PPGTRLPTVR; PGTRLPTVRD; GTRLPTVRDL; TRLPTVRDLA; RLPTVRDLAG; LPTVRDLAGQ; PTVRDLAGQL; TVRDLAGQLG; VRDLAGQLGV; RDLAGQLGVA; DLAGQLGVAA; LAGQLGVAAN; AGQLGVAANT; GQLGVAANTV; QLGVAANTVA; LGVAANTVAR; GVAANTVARA; VAANTVARAY; AANTVARAYR; ANTVARAYRE; NTVARAYREL; TVARAYRELE; VARAYRELES; ARAYRELESA; RAYRELESAA; AYRELESAAI; YRELESAAIV; RELESAAIVE; ELESAAIVET; LESAAIVETR; ESAAIVETRG; SAAIVETRGR; AAIVETRGRF; AIVETRGRFG; IVETRGRFGT; VETRGRFGTF; ETRGRFGTFI; TRGRFGTFIS; RGRFGTFISR; GRFGTFISRF; RFGTFISRFD; FGTFISRFDP; GTFISRFDPT; TFISRFDPTD; FISRFDPTDA; ISRFDPTDAA; SRFDPTDAAM; RFDPTDAAMA; FDPTDAAMAA; DPTDAAMAAA; PTDAAMAAAA; TDAAMAAAAK; DAAMAAAAKE; AAMAAAAKEY; AMAAAAKEYV; MAAAAKEYVG; AAAAKEYVGV; AAAKEYVGVA; AAKEYVGVAR; AKEYVGVARA; KEYVGVARAL; EYVGVARALG; YVGVARALGL; VGVARALGLT; GVARALGLTK; VARALGLTKS; ARALGLTKSD; RALGLTKSDA; ALGLTKSDAM; LGLTKSDAMR; GLTKSDAMRY; LTKSDAMRYL; TKSDAMRYLT; KSDAMRYLTH; | |

Fig. 28 continued

| | | |
|---|---|---|
| | SDAMRYLTHV; DAMRYLTHVP<br><br>11 mers:<br>MELRDWLRVDV; ELRDWLRVDVK; LRDWLRVDVKA; RDWLRVDVKAG; DWLRVDVKAGK; WLRVDVKAGKP; LRVDVKAGKPL; RVDVKAGKPLF; VDVKAGKPLFD; DVKAGKPLFDQ; VKAGKPLFDQL; KAGKPLFDQLR; AGKPLFDQLRT; GKPLFDQLRTQ; KPLFDQLRTQV; PLFDQLRTQVI; LFDQLRTQVID; FDQLRTQVIDG; DQLRTQVIDGV; QLRTQVIDGVR; LRTQVIDGVRA; RTQVIDGVRAG; TQVIDGVRAGA; QVIDGVRAGAL; VIDGVRAGALP; IDGVRAGALPP; DGVRAGALPPG; GVRAGALPPGT; VRAGALPPGTR; RAGALPPGTRL; AGALPPGTRLP; GALPPGTRLPT; ALPPGTRLPTV; LPPGTRLPTVR; PPGTRLPTVRD; PGTRLPTVRDL; GTRLPTVRDLA; TRLPTVRDLAG; RLPTVRDLAGQ; LPTVRDLAGQL; PTVRDLAGQLG; TVRDLAGQLGV; VRDLAGQLGVA; RDLAGQLGVAA; DLAGQLGVAAN; LAGQLGVAANT; AGQLGVAANTV; GQLGVAANTVA; QLGVAANTVAR; LGVAANTVARA; GVAANTVARAY; VAANTVARAYR; AANTVARAYRE; ANTVARAYREL; NTVARAYRELE; TVARAYRELES; VARAYRELESA; ARAYRELESAA; RAYRELESAAI; AYRELESAAIV; YRELESAAIVE; RELESAAIVET; ELESAAIVETR; LESAAIVETRG; ESAAIVETRGR; SAAIVETRGRF; AAIVETRGRFG; AIVETRGRFGT; IVETRGRFGTF; VETRGRFGTFI; ETRGRFGTFIS; TRGRFGTFISR; RGRFGTFISRF; GRFGTFISRFD; RFGTFISRFDP; FGTFISRFDPT; GTFISRFDPTD; TFISRFDPTDA; FISRFDPTDAA; ISRFDPTDAAM; SRFDPTDAAMA; RFDPTDAAMAA; FDPTDAAMAAA; DPTDAAMAAAA; PTDAAMAAAAK; TDAAMAAAAKE; DAAMAAAAKEY; AAMAAAAKEYV; AMAAAAKEYVG; MAAAAKEYVGV; AAAAKEYVGVA; AAAKEYVGVAR; AAKEYVGVARA; AKEYVGVARAL; KEYVGVARALG; EYVGVARALGL; YVGVARALGLT; VGVARALGLTK; GVARALGLTKS; VARALGLTKSD; ARALGLTKSDA; RALGLTKSDAM; ALGLTKSDAMR; LGLTKSDAMRY; GLTKSDAMRYL; LTKSDAMRYLT; TKSDAMRYLTH; KSDAMRYLTHV; SDAMRYLTHVP; DAMRYLTHVPD; AMRYLTHVPDD | |
| 17) Rv1195 | 8 mers:<br>MSFVMAYP; SFVMAYPE; FVMAYPEM; VMAYPEML; MAYPEMLA; AYPEMLAA; YPEMLAAA; PEMLAAAA; EMLAAAAD; MLAAAADT; LAAAADTL; AAAADTLQ; AAADTLQS; AADTLQSI; ADTLQSIG; DTLQSIGA; TLQSIGAT; LQSIGATT; QSIGATTV; SIGATTVA; IGATTVAS; GATTVASN; ATTVASNA; TTVASNAA; TVASNAAA; VASNAAAA; ASNAAAAA; SNAAAAAP; NAAAAAPT; AAAAAPTT; AAAAPTTG; AAAPTTGV; AAPTTGVV; APTTGVVP; PTTGVVPP; TTGVVPPA; TGVVPPAA; GVVPPAAD; VVPPAADE; VPPAADEV; PPAADEVS; PAADEVSA; AADEVSAL; ADEVSALT; DEVSALTA; EVSALTAA; VSALTAAH; SALTAAHF; ALTAAHFA; LTAAHFAA; TAAHFAAH; AAHFAAHA; AHFAAHAA; HFAAHAAM; FAAHAAMY; AAHAAMYQ; AHAAMYQS; HAAMYQSV; AAMYQSVS; AMYQSVSA; MYQSVSAR; YQSVSARA; QSVSARAA; SVSARAAA; VSARAAAI; SARAAAIH; ARAAAIHD; RAAAIHDQ; AAAIHDQF; AAIHDQFV; AIHDQFVA; IHDQFVAT; HDQFVATL; DQFVATLA; QFVATLAS; FVATLASS; VATLASSA; ATLASSAS; TLASSASS; LASSASSY; ASSASSYA; SSASSYAA; SASSYAAT; ASSYAATE; SSYAATEV; SYAATEVA; YAATEVAN; AATEVANA; ATEVANAA; TEVANAAA; EVANAAAA; VANAAAAS | 13287-13649 |

Fig. 28 continued

| | | | |
|---|---|---|---|
| | 9 mers:<br>MSFVMAYPE; SFVMAYPEM; FVMAYPEML; VMAYPEMLA; MAYPEMLAA; AYPEMLAAA; YPEMLAAAA; PEMLAAAAD; EMLAAAADT; MLAAAADTL; LAAAADTLQ; AAAADTLQS; AAADTLQSI; AADTLQSIG; ADTLQSIGA; DTLQSIGAT; TLQSIGATT; LQSIGATTV; QSIGATTVA; SIGATTVAS; IGATTVASN; GATTVASNA; ATTVASNAA; TTVASNAAA; TVASNAAAA; VASNAAAAA; ASNAAAAAP; SNAAAAAPT; NAAAAAPTT; AAAAAPTTG; AAAAPTTGV; AAAPTTGVV; AAPTTGVVP; APTTGVVPP; PTTGVVPPA; TTGVVPPAA; TGVVPPAAD; GVVPPAADE; VVPPAADEV; VPPAADEVS; PPAADEVSA; PAADEVSAL; AADEVSALT; ADEVSALTA; DEVSALTAA; EVSALTAAH; VSALTAAHF; SALTAAHFA; ALTAAHFAA; LTAAHFAAH; TAAHFAAHA; AAHFAAHAA; AHFAAHAAM; HFAAHAAMY; FAAHAAMYQ; AAHAAMYQS; AHAAMYQSV; HAAMYQSVS; AAMYQSVSA; AMYQSVSAR; MYQSVSARA; YQSVSARAA; QSVSARAAA; SVSARAAAI; VSARAAAIH; SARAAAIHD; ARAAAIHDQ; RAAAIHDQF; AAAIHDQFV; AAIHDQFVA; AIHDQFVAT; IHDQFVATL; HDQFVATLA; DQFVATLAS; QFVATLASS; FVATLASSA; VATLASSAS; ATLASSASS; TLASSASSY; LASSASSYA; ASSASSYAA; SSASSYAAT; SASSYAATE; ASSYAATEV; SSYAATEVA; SYAATEVAN; YAATEVANA; AATEVANAA; ATEVANAAA; TEVANAAAA; EVANAAAAS; VANAAAAS<br><br>10 mers:<br>MSFVMAYPEM; SFVMAYPEML; FVMAYPEMLA; VMAYPEMLAA; MAYPEMLAAA; AYPEMLAAAA; YPEMLAAAAD; PEMLAAAADT; EMLAAAADTL; MLAAAADTLQ; LAAAADTLQS; AAAADTLQSI; AAADTLQSIG; AADTLQSIGA; ADTLQSIGAT; DTLQSIGATT; TLQSIGATTV; LQSIGATTVA; QSIGATTVAS; SIGATTVASN; IGATTVASNA; GATTVASNAA; ATTVASNAAA; TTVASNAAAA; TVASNAAAAA; VASNAAAAAP; ASNAAAAAPT; SNAAAAAPTT; NAAAAAPTTG; AAAAAPTTGV; AAAAPTTGVV; AAAPTTGVVP; AAPTTGVVPP; APTTGVVPPA; PTTGVVPPAA; TTGVVPPAAD; TGVVPPAADE; GVVPPAADEV; VVPPAADEVS; VPPAADEVSA; PPAADEVSAL; PAADEVSALT; AADEVSALTA; ADEVSALTAA; DEVSALTAAH; EVSALTAAHF; VSALTAAHFA; SALTAAHFAA; ALTAAHFAAH; LTAAHFAAHA; TAAHFAAHAA; AAHFAAHAAM; AHFAAHAAMY; HFAAHAAMYQ; FAAHAAMYQS; AAHAAMYQSV; AHAAMYQSVS; HAAMYQSVSA; AAMYQSVSAR; AMYQSVSARA; MYQSVSARAA; YQSVSARAAA; QSVSARAAAI; SVSARAAAIH; VSARAAAIHD; SARAAAIHDQ; ARAAAIHDQF; RAAAIHDQFV; AAAIHDQFVA; AAIHDQFVAT; AIHDQFVATL; IHDQFVATLA; HDQFVATLAS; DQFVATLASS; QFVATLASSA; FVATLASSAS; VATLASSASS; ATLASSASSY; TLASSASSYA; LASSASSYAA; ASSASSYAAT; SSASSYAATE; SASSYAATEV; ASSYAATEVA; SSYAATEVAN; SYAATEVANA; YAATEVANAA; AATEVANAAA; ATEVANAAAA; TEVANAAAAS<br><br>11 mers:<br>MSFVMAYPEML; SFVMAYPEMLA; FVMAYPEMLAA; VMAYPEMLAAA; MAYPEMLAAAA; AYPEMLAAAAD; YPEMLAAAADT; PEMLAAAADTL; EMLAAAADTLQ; MLAAAADTLQS; LAAAADTLQSI; AAAADTLQSIG; | |

Fig. 28 continued

| | | |
|---|---|---|
| | AAADTLQSIGA; AADTLQSIGAT; ADTLQSIGATT; DTLQSIGATTV; TLQSIGATTVA; LQSIGATTVAS; QSIGATTVASN; SIGATTVASNA; IGATTVASNAA; GATTVASNAAA; ATTVASNAAAA; TTVASNAAAAA; TVASNAAAAAP; VASNAAAAAPT; ASNAAAAAPTT; SNAAAAAPTTG; NAAAAAPTTGV; AAAAAPTTGVV; AAAAPTTGVVP; AAAPTTGVVPP; AAPTTGVVPPA; APTTGVVPPAA; PTTGVVPPAAD; TTGVVPPAADE; TGVVPPAADEV; GVVPPAADEVS; VVPPAADEVSA; VPPAADEVSAL; PPAADEVSALT; PAADEVSALTA; AADEVSALTAA; ADEVSALTAAH; DEVSALTAAHF; EVSALTAAHFA; VSALTAAHFAA; SALTAAHFAAH; ALTAAHFAAHA; LTAAHFAAHAA; TAAHFAAHAAM; AAHFAAHAAMY; AHFAAHAAMYQ; HFAAHAAMYQS; FAAHAAMYQSV; AAHAAMYQSVS; AHAAMYQSVSA; HAAMYQSVSAR; AAMYQSVSARA; AMYQSVSARAA; MYQSVSARAAA; YQSVSARAAAI; QSVSARAAAIH; SVSARAAAIHD; VSARAAAIHDQ; SARAAAIHDQF; ARAAAIHDQFV; RAAAIHDQFVA; AAAIHDQFVAT; AAIHDQFVATL; AIHDQFVATLA; IHDQFVATLAS; HDQFVATLASS; DQFVATLASSA; QFVATLASSAS; FVATLASSASS; VATLASSASSY; ATLASSASSYA; TLASSASSYAA; LASSASSYAAT; ASSASSYAATE; SSASSYAATEV; SASSYAATEVA; ASSYAATEVAN; SSYAATEVANA; SYAATEVANAA; YAATEVANAAA; AATEVANAAAA; ATEVANAAAAS | |
| 18) Rv1197 | 8 mers:<br>MASRFMTD; ASRFMTDP; SRFMTDPH; RFMTDPHA; FMTDPHAM; MTDPHAMR; TDPHAMRD; DPHAMRDM; PHAMRDMA; HAMRDMAG; AMRDMAGR; MRDMAGRF; RDMAGRFE; DMAGRFEV; MAGRFEVH; AGRFEVHA; GRFEVHAQ; RFEVHAQT; FEVHAQTV; EVHAQTVE; VHAQTVED; HAQTVEDE; AQTVEDEA; QTVEDEAR; TVEDEARR; VEDEARRM; EDEARRMW; DEARRMWA; EARRMWAS; ARRMWASA; RRMWASAQ; RMWASAQN; MWASAQNI; WASAQNIS; ASAQNISG; SAQNISGA; AQNISGAG; QNISGAGW; NISGAGWS; ISGAGWSG; SGAGWSGM; GAGWSGMA; AGWSGMAE; GWSGMAEA; WSGMAEAT; SGMAEATS; GMAEATSL; MAEATSLD; AEATSLDT; EATSLDTM; ATSLDTMA; TSLDTMAQ; SLDTMAQM; LDTMAQMN; DTMAQMNQ; TMAQMNQA; MAQMNQAF; AQMNQAFR; QMNQAFRN; MNQAFRNI; NQAFRNIV; QAFRNIVN; AFRNIVNM; FRNIVNML; RNIVNMLH; NIVNMLHG; IVNMLHGV; VNMLHGVR; NMLHGVRD; MLHGVRDG; LHGVRDGL; HGVRDGLV; GVRDGLVR; VRDGLVRD; RDGLVRDA; DGLVRDAN; GLVRDANN; LVRDANNY; VRDANNYE; RDANNYEQ; DANNYEQQ; ANNYEQQE; NNYEQQEQ; NYEQQEQA; YEQQEQAS; EQQEQASQ; QQEQASQQ; QEQASQQI; EQASQQIL; QASQQILS; ASQQILSS;<br><br>9 mers:<br>MASRFMTDP; ASRFMTDPH; SRFMTDPHA; RFMTDPHAM; FMTDPHAMR; MTDPHAMRD; TDPHAMRDM; DPHAMRDMA; PHAMRDMAG; HAMRDMAGR; AMRDMAGRF; MRDMAGRFE; RDMAGRFEV; DMAGRFEVH; MAGRFEVHA; AGRFEVHAQ; GRFEVHAQT; RFEVHAQTV; FEVHAQTVE; EVHAQTVED; VHAQTVEDE; HAQTVEDEA; AQTVEDEAR; QTVEDEARR; TVEDEARRM; VEDEARRMW; EDEARRMWA; DEARRMWAS; EARRMWASA; ARRMWASAQ; RRMWASAQN; RMWASAQNI; MWASAQNIS; WASAQNISG; ASAQNISGA; SAQNISGAG; AQNISGAGW; QNISGAGWS; NISGAGWSG; ISGAGWSGM; SGAGWSGMA; GAGWSGMAE; AGWSGMAEA; GWSGMAEAT; | 13650-14007 |

Fig. 28 continued

| | | | |
|---|---|---|---|
| | WSGMAEATS; SGMAEATSL; GMAEATSLD; MAEATSLDT; AEATSLDTM; EATSLDTMA; ATSLDTMAQ; TSLDTMAQM; SLDTMAQMN; LDTMAQMNQ; DTMAQMNQA; TMAQMNQAF; MAQMNQAFR; AQMNQAFRN; QMNQAFRNI; MNQAFRNIV; NQAFRNIVN; QAFRNIVNM; AFRNIVNML; FRNIVNMLH; RNIVNMLHG; NIVNMLHGV; IVNMLHGVR; VNMLHGVRD; NMLHGVRDG; MLHGVRDGL; LHGVRDGLV; HGVRDGLVR; GVRDGLVRD; VRDGLVRDA; RDGLVRDAN; DGLVRDANN; GLVRDANNY; LVRDANNYE; VRDANNYEQ; RDANNYEQQ; DANNYEQQE; ANNYEQQEQ; NNYEQQEQA; NYEQQEQAS; YEQQEQASQ; EQQEQASQQ; QQEQASQQI; QEQASQQIL; EQASQQILS; QASQQILSS;<br><br>10 mers:<br>MASRFMTDPH; ASRFMTDPHA; SRFMTDPHAM; RFMTDPHAMR; FMTDPHAMRD; MTDPHAMRDM; TDPHAMRDMA; DPHAMRDMAG; PHAMRDMAGR; HAMRDMAGRF; AMRDMAGRFE; MRDMAGRFEV; RDMAGRFEVH; DMAGRFEVHA; MAGRFEVHAQ; AGRFEVHAQT; GRFEVHAQTV; RFEVHAQTVE; FEVHAQTVED; EVHAQTVEDE; VHAQTVEDEA; HAQTVEDEAR; AQTVEDEARR; QTVEDEARRM; TVEDEARRMW; VEDEARRMWA; EDEARRMWAS; DEARRMWASA; EARRMWASAQ; ARRMWASAQN; RRMWASAQNI; RMWASAQNIS; MWASAQNISG; WASAQNISGA; ASAQNISGAG; SAQNISGAGW; AQNISGAGWS; QNISGAGWSG; NISGAGWSGM; ISGAGWSGMA; SGAGWSGMAE; GAGWSGMAEA; AGWSGMAEAT; GWSGMAEATS; WSGMAEATSL; SGMAEATSLD; GMAEATSLDT; MAEATSLDTM; AEATSLDTMA; EATSLDTMAQ; ATSLDTMAQM; TSLDTMAQMN; SLDTMAQMNQ; LDTMAQMNQA; DTMAQMNQAF; TMAQMNQAFR; MAQMNQAFRN; AQMNQAFRNI; QMNQAFRNIV; MNQAFRNIVN; NQAFRNIVNM; QAFRNIVNML; AFRNIVNMLH; FRNIVNMLHG; RNIVNMLHGV; NIVNMLHGVR; IVNMLHGVRD; VNMLHGVRDG; NMLHGVRDGL; MLHGVRDGLV; LHGVRDGLVR; HGVRDGLVRD; GVRDGLVRDA; VRDGLVRDAN; RDGLVRDANN; DGLVRDANNY; GLVRDANNYE; LVRDANNYEQ; VRDANNYEQQ; RDANNYEQQE; DANNYEQQEQ; ANNYEQQEQA; NNYEQQEQAS; NYEQQEQASQ; YEQQEQASQQ; EQQEQASQQI; QQEQASQQIL; QEQASQQILS; EQASQQILSS;<br><br>11 mers:<br>MASRFMTDPHA; ASRFMTDPHAM; SRFMTDPHAMR; RFMTDPHAMRD; FMTDPHAMRDM; MTDPHAMRDMA; TDPHAMRDMAG; DPHAMRDMAGR; PHAMRDMAGRF; HAMRDMAGRFE; AMRDMAGRFEV; MRDMAGRFEVH; RDMAGRFEVHA; DMAGRFEVHAQ; MAGRFEVHAQT; AGRFEVHAQTV; GRFEVHAQTVE; RFEVHAQTVED; FEVHAQTVEDE; EVHAQTVEDEA; VHAQTVEDEAR; HAQTVEDEARR; AQTVEDEARRM; QTVEDEARRMW; TVEDEARRMWA; VEDEARRMWAS; EDEARRMWASA; DEARRMWASAQ; EARRMWASAQN; ARRMWASAQNI; RRMWASAQNIS; RMWASAQNISG; MWASAQNISGA; WASAQNISGAG; ASAQNISGAGW; SAQNISGAGWS; AQNISGAGWSG; QNISGAGWSGM; NISGAGWSGMA; ISGAGWSGMAE; SGAGWSGMAEA; GAGWSGMAEAT; AGWSGMAEATS; | |

Fig. 28 continued

| | | |
|---|---|---|
| | GWSGMAEATSL; WSGMAEATSLD; SGMAEATSLDT; GMAEATSLDTM; MAEATSLDTMA; AEATSLDTMAQ; EATSLDTMAQM; ATSLDTMAQMN; TSLDTMAQMNQ; SLDTMAQMNQA; LDTMAQMNQAF; DTMAQMNQAFR; TMAQMNQAFRN; MAQMNQAFRNI; AQMNQAFRNIV; QMNQAFRNIVN; MNQAFRNIVNM; NQAFRNIVNML; QAFRNIVNMLH; AFRNIVNMLHG; FRNIVNMLHGV; RNIVNMLHGVR; NIVNMLHGVRD; IVNMLHGVRDG; VNMLHGVRDGL; NMLHGVRDGLV; MLHGVRDGLVR; LHGVRDGLVRD; HGVRDGLVRDA; GVRDGLVRDAN; VRDGLVRDANN; RDGLVRDANNY; DGLVRDANNYE; GLVRDANNYEQ; LVRDANNYEQQ; VRDANNYEQQE; RDANNYEQQEQ; DANNYEQQEQA; ANNYEQQEQAS; NNYEQQEQASQ; NYEQQEQASQQ; YEQQEQASQQI; EQQEQASQQIL; QQEQASQQILS; QEQASQQILSS; | |
| 19) Rv1198 | 8 mers:<br>MTINYQFG; TINYQFGD; INYQFGDV; NYQFGDVD; YQFGDVDA; QFGDVDAH; FGDVDAHG; GDVDAHGA; DVDAHGAM; VDAHGAMI; DAHGAMIR; AHGAMIRA; HGAMIRAQ; GAMIRAQA; AMIRAQAG; MIRAQAGS; IRAQAGSL; RAQAGSLE; AQAGSLEA; QAGSLEAE; AGSLEAEH; GSLEAEHQ; SLEAEHQA; LEAEHQAI; EAEHQAII; AEHQAIIS; EHQAIISD; HQAIISDV; QAIISDVL; AIISDVLT; IISDVLTA; ISDVLTAS; SDVLTASD; DVLTASDF; VLTASDFW; LTASDFWG; TASDFWGG; ASDFWGGA; SDFWGGAG; DFWGGAGS; FWGGAGSA; WGGAGSAA; GGAGSAAC; GAGSAACQ; AGSAACQG; GSAACQGF; SAACQGFI; AACQGFIT; ACQGFITQ; CQGFITQL; QGFITQLG; GFITQLGR; FITQLGRN; ITQLGRNF; TQLGRNFQ; QLGRNFQV; LGRNFQVI; GRNFQVIY; RNFQVIYE; NFQVIYEQ; FQVIYEQA; QVIYEQAN; VIYEQANA; IYEQANAH; YEQANAHG; EQANAHGQ; QANAHGQK; ANAHGQKV; NAHGQKVQ; AHGQKVQA; HGQKVQAA; GQKVQAAG; QKVQAAGN; KVQAAGNN; VQAAGNNM; QAAGNNMA; AAGNNMAQ; AGNNMAQT; GNNMAQTD; NNMAQTDS; NMAQTDSA; MAQTDSAV; AQTDSAVG; QTDSAVGS; TDSAVGSS; DSAVGSSW; SAVGSSWA;<br><br>9 mers:<br>MTINYQFGD; TINYQFGDV; INYQFGDVD; NYQFGDVDA; YQFGDVDAH; QFGDVDAHG; FGDVDAHGA; GDVDAHGAM; DVDAHGAMI; VDAHGAMIR; DAHGAMIRA; AHGAMIRAQ; HGAMIRAQA; GAMIRAQAG; AMIRAQAGS; MIRAQAGSL; IRAQAGSLE; RAQAGSLEA; AQAGSLEAE; QAGSLEAEH; AGSLEAEHQ; GSLEAEHQA; SLEAEHQAI; LEAEHQAII; EAEHQAIIS; AEHQAIISD; EHQAIISDV; HQAIISDVL; QAIISDVLT; AIISDVLTA; IISDVLTAS; ISDVLTASD; SDVLTASDF; DVLTASDFW; VLTASDFWG; LTASDFWGG; TASDFWGGA; ASDFWGGAG; SDFWGGAGS; DFWGGAGSA; FWGGAGSAA; WGGAGSAAC; GGAGSAACQ; GAGSAACQG; AGSAACQGF; GSAACQGFI; SAACQGFIT; AACQGFITQ; ACQGFITQL; CQGFITQLG; QGFITQLGR; GFITQLGRN; FITQLGRNF; ITQLGRNFQ; TQLGRNFQV; QLGRNFQVI; LGRNFQVIY; GRNFQVIYE; RNFQVIYEQ; NFQVIYEQA; FQVIYEQAN; QVIYEQANA; VIYEQANAH; IYEQANAHG; YEQANAHGQ; EQANAHGQK; QANAHGQKV; ANAHGQKVQ; NAHGQKVQA; AHGQKVQAA; HGQKVQAAG; GQKVQAAGN; QKVQAAGNN; KVQAAGNNM; | 14008-14349 |

Fig. 28 continued

| | | | |
|---|---|---|---|
| | VQAAGNNMA; QAAGNNMAQ; AAGNNMAQT; AGNNMAQTD; GNNMAQTDS; NNMAQTDSA; NMAQTDSAV; MAQTDSAVG; AQTDSAVGS; QTDSAVGSS; TDSAVGSSW; DSAVGSSWA;<br><br>10 mers:<br>MTINYQFGDV; TINYQFGDVD; INYQFGDVDA; NYQFGDVDAH; YQFGDVDAHG; QFGDVDAHGA; FGDVDAHGAM; GDVDAHGAMI; DVDAHGAMIR; VDAHGAMIRA; DAHGAMIRAQ; AHGAMIRAQA; HGAMIRAQAG; GAMIRAQAGS; AMIRAQAGSL; MIRAQAGSLE; IRAQAGSLEA; RAQAGSLEAE; AQAGSLEAEH; QAGSLEAEHQ; AGSLEAEHQA; GSLEAEHQAI; SLEAEHQAII; LEAEHQAIIS; EAEHQAIISD; AEHQAIISDV; EHQAIISDVL; HQAIISDVLT; QAIISDVLTA; AIISDVLTAS; IISDVLTASD; ISDVLTASDF; SDVLTASDFW; DVLTASDFWG; VLTASDFWGG; LTASDFWGGA; TASDFWGGAG; ASDFWGGAGS; SDFWGGAGSA; DFWGGAGSAA; FWGGAGSAAC; WGGAGSAACQ; GGAGSAACQG; GAGSAACQGF; AGSAACQGFI; GSAACQGFIT; SAACQGFITQ; AACQGFITQL; ACQGFITQLG; CQGFITQLGR; QGFITQLGRN; GFITQLGRNF; FITQLGRNFQ; ITQLGRNFQV; TQLGRNFQVI; QLGRNFQVIY; LGRNFQVIYE; GRNFQVIYEQ; RNFQVIYEQA; NFQVIYEQAN; FQVIYEQANA; QVIYEQANAH; VIYEQANAHG; IYEQANAHGQ; YEQANAHGQK; EQANAHGQKV; QANAHGQKVQ; ANAHGQKVQA; NAHGQKVQAA; AHGQKVQAAG; HGQKVQAAGN; GQKVQAAGNN; QKVQAAGNNM; KVQAAGNNMA; VQAAGNNMAQ; QAAGNNMAQT; AAGNNMAQTD; AGNNMAQTDS; GNNMAQTDSA; NNMAQTDSAV; NMAQTDSAVG; MAQTDSAVGS; AQTDSAVGSS; QTDSAVGSSW; TDSAVGSSWA;<br><br>11 mers:<br>MTINYQFGDVD; TINYQFGDVDA; INYQFGDVDAH; NYQFGDVDAHG; YQFGDVDAHGA; QFGDVDAHGAM; FGDVDAHGAMI; GDVDAHGAMIR; DVDAHGAMIRA; VDAHGAMIRAQ; DAHGAMIRAQA; AHGAMIRAQAG; HGAMIRAQAGS; GAMIRAQAGSL; AMIRAQAGSLE; MIRAQAGSLEA; IRAQAGSLEAE; RAQAGSLEAEH; AQAGSLEAEHQ; QAGSLEAEHQA; AGSLEAEHQAI; GSLEAEHQAII; SLEAEHQAIIS; LEAEHQAIISD; EAEHQAIISDV; AEHQAIISDVL; EHQAIISDVLT; HQAIISDVLTA; QAIISDVLTAS; AIISDVLTASD; IISDVLTASDF; ISDVLTASDFW; SDVLTASDFWG; DVLTASDFWGG; VLTASDFWGGA; LTASDFWGGAG; TASDFWGGAGS; ASDFWGGAGSA; SDFWGGAGSAA; DFWGGAGSAAC; FWGGAGSAACQ; WGGAGSAACQG; GGAGSAACQGF; GAGSAACQGFI; AGSAACQGFIT; GSAACQGFITQ; SAACQGFITQL; AACQGFITQLG; ACQGFITQLGR; CQGFITQLGRN; QGFITQLGRNF; GFITQLGRNFQ; FITQLGRNFQV; ITQLGRNFQVI; TQLGRNFQVIY; QLGRNFQVIYE; LGRNFQVIYEQ; GRNFQVIYEQA; RNFQVIYEQAN; NFQVIYEQANA; FQVIYEQANAH; QVIYEQANAHG; VIYEQANAHGQ; IYEQANAHGQK; YEQANAHGQKV; EQANAHGQKVQ; QANAHGQKVQA; ANAHGQKVQAA; NAHGQKVQAAG; AHGQKVQAAGN; HGQKVQAAGNN; GQKVQAAGNNM; QKVQAAGNNMA; KVQAAGNNMAQ; VQAAGNNMAQT; QAAGNNMAQTD; AAGNNMAQTDS; AGNNMAQTDSA; GNNMAQTDSAV; NNMAQTDSAVG; NMAQTDSAVGS; MAQTDSAVGSS; AQTDSAVGSSW; QTDSAVGSSWA; | |

Fig. 28 continued

| | | |
|---|---|---|
| 20) Rv1250 | 8 mers:<br>MTTAIRRA; TTAIRRAA; TAIRRAAG; AIRRAAGS; IRRAAGSS; RRAAGSSY; RAAGSSYF; AAGSSYFR; AGSSYFRN; GSSYFRNP; SSYFRNPW; SYFRNPWP; YFRNPWPA; FRNPWPAL; RNPWPALW; NPWPALWA; PWPALWAM; WPALWAMM; PALWAMMV; ALWAMMVG; LWAMMVGF; WAMMVGFF; AMMVGFFM; MMVGFFMI; MVGFFMIM; VGFFMIML; GFFMIMLD; FFMIMLDS; FMIMLDST; MIMLDSTV; IMLDSTVV; MLDSTVVA; LDSTVVAI; DSTVVAIA; STVVAIAN; TVVAIANP; VVAIANPT; VAIANPTI; AIANPTIM; IANPTIMA; ANPTIMAQ; NPTIMAQL; PTIMAQLR; TIMAQLRI; IMAQLRIG; MAQLRIGY; AQLRIGYA; QLRIGYAT; LRIGYATV; RIGYATVV; IGYATVVW; GYATVVWV; YATVVWVT; ATVVWVTS; TVVWVTSA; VVWVTSAY; VWVTSAYL; WVTSAYLL; VTSAYLLA; TSAYLLAY; SAYLLAYA; AYLLAYAV; YLLAYAVP; LLAYAVPM; LAYAVPML; AYAVPMLV; YAVPMLVA; AVPMLVAG; VPMLVAGR; PMLVAGRL; MLVAGRLG; LVAGRLGD; VAGRLGDR; AGRLGDRF; GRLGDRFG; RLGDRFGP; LGDRFGPK; GDRFGPKN; DRFGPKNL; RFGPKNLY; FGPKNLYL; GPKNLYLI; PKNLYLIG; KNLYLIGL; NLYLIGLG; LYLIGLGV; YLIGLGVF; LIGLGVFT; IGLGVFTV; GLGVFTVA; LGVFTVAS; GVFTVASL; VFTVASLG; FTVASLGC; TVASLGCG; VASLGCGL; ASLGCGLS; SLGCGLSS; LGCGLSSG; GCGLSSGA; CGLSSGAG; GLSSGAGM; LSSGAGML; SSGAGMLI; SGAGMLIA; GAGMLIAA; AGMLIAAR; GMLIAARV; MLIAARVV; LIAARVVQ; IAARVVQG; AARVVQGV; ARVVQGVG; RVVQGVGA; VVQGVGAG; VQGVGAGL; QGVGAGLL; GVGAGLLT; VGAGLLTP; GAGLLTPQ; AGLLTPQT; GLLTPQTL; LLTPQTLS; LTPQTLST; TPQTLSTI; PQTLSTIT; QTLSTITR; TLSTITRI; LSTITRIF; STITRIFP; TITRIFPA; ITRIFPAH; TRIFPAHR; RIFPAHRR; IFPAHRRG; FPAHRRGV; PAHRRGVA; AHRRGVAL; HRRGVALG; RRGVALGA; RGVALGAW; GVALGAWG; VALGAWGT; ALGAWGTV; LGAWGTVA; GAWGTVAS; AWGTVASV; WGTVASVA; GTVASVAS; TVASVASL; VASVASLV; ASVASLVG; SVASLVGP; VASLVGPL; ASLVGPLA; SLVGPLAG; LVGPLAGG; VGPLAGGA; GPLAGGAL; PLAGGALV; LAGGALVD; AGGALVDS; GGALVDSM; GALVDSMG; ALVDSMGW; LVDSMGWE; VDSMGWEW; DSMGWEWI; SMGWEWIF; MGWEWIFF; GWEWIFFV; WEWIFFVN; EWIFFVNV; WIFFVNVP; IFFVNVPV; FFVNVPVG; FVNVPVGV; VNVPVGVI; NVPVGVIG; VPVGVIGL; PVGVIGLI; VGVIGLIL; GVIGLILA; VIGLILAA; IGLILAAY; GLILAAYL; LILAAYLI; ILAAYLIP; LAAYLIPA; AAYLIPAL; AYLIPALP; YLIPALPH; LIPALPHH; IPALPHHP; PALPHHPH; ALPHHPHR; LPHHPHRF; PHHPHRFD; HHPHRFDW; HPHRFDWF; PHRFDWFG; HRFDWFGV; RFDWFGVG; FDWFGVGL; DWFGVGLS; WFGVGLSG; FGVGLSGA; GVGLSGAG; VGLSGAGM; GLSGAGMF; LSGAGMFL; SGAGMFLI; GAGMFLIV; AGMFLIVF; GMFLIVFG; MFLIVFGL; FLIVFGLQ; LIVFGLQQ; IVFGLQQG; VFGLQQGQ; FGLQQGQS; GLQQGQSA; LQQGQSAN; QQGQSANW; QGQSANWQ; GQSANWQP; QSANWQPW; SANWQPWI; ANWQPWIW; NWQPWIWA; WQPWIWAV; QPWIWAVI; PWIWAVIV; WIWAVIVG; IWAVIVGG; WAVIVGGI; AVIVGGIG; VIVGGIGF; IVGGIGFM; VGGIGFMS; GGIGFMSL; GIGFMSLF; IGFMSLFV; GFMSLFVY; FMSLFVYW; MSLFVYWQ; SLFVYWQA; LFVYWQAR; FVYWQARN; VYWQARNA; YWQARNAR; WQARNARE; QARNAREP; ARNAREPL; RNAREPLI; NAREPLIP; AREPLIPL; REPLIPLE; EPLIPLEV; PLIPLEVF; LIPLEVFN; IPLEVFND; PLEVFNDR; | 14350-16629 |

Fig. 28 continued

| | | |
|---|---|---|
| | LEVFNDRN; EVFNDRNF; VFNDRNFS; FNDRNFSL; NDRNFSLS; DRNFSLSN; RNFSLSNL; NFSLSNLR; FSLSNLRI; SLSNLRIA; LSNLRIAI; SNLRIAII; NLRIAIIA; LRIAIIAF; RIAIIAFA; IAIIAFAG; AIIAFAGT; IIAFAGTG; IAFAGTGM; AFAGTGMM; FAGTGMML; AGTGMMLP; GTGMMLPV; TGMMLPVT; GMMLPVTF; MMLPVTFY; MLPVTFYA; LPVTFYAQ; PVTFYAQA; VTFYAQAV; TFYAQAVC; FYAQAVCG; YAQAVCGL; AQAVCGLS; QAVCGLSP; AVCGLSPT; VCGLSPTH; CGLSPTHT; GLSPTHTA; LSPTHTAV; SPTHTAVL; PTHTAVLF; THTAVLFA; HTAVLFAP; TAVLFAPT; AVLFAPTA; VLFAPTAI; LFAPTAIV; FAPTAIVG; APTAIVGG; PTAIVGGV; TAIVGGVL; AIVGGVLA; IVGGVLAP; VGGVLAPF; GGVLAPFV; GVLAPFVG; VLAPFVGM; LAPFVGMI; APFVGMII; PFVGMIID; FVGMIIDR; VGMIIDRS; GMIIDRSH; MIIDRSHP; IIDRSHPL; IDRSHPLC; DRSHPLCV; RSHPLCVL; SHPLCVLG; HPLCVLGF; PLCVLGFG; LCVLGFGF; CVLGFGFS; VLGFGFSV; LGFGFSVL; GFGFSVLA; FGFSVLAI; GFSVLAIA; FSVLAIAM; SVLAIAMT; VLAIAMTW; LAIAMTWL; AIAMTWLL; IAMTWLLC; AMTWLLCE; MTWLLCEM; TWLLCEMA; WLLCEMAP; LLCEMAPG; LCEMAPGT; CEMAPGTP; EMAPGTPI; MAPGTPIW; APGTPIWR; PGTPIWRL; GTPIWRLV; TPIWRLVL; PIWRLVLP; IWRLVLPF; WRLVLPFI; RLVLPFIA; LVLPFIAL; VLPFIALG; LPFIALGV; PFIALGVA; FIALGVAG; IALGVAGA; ALGVAGAF; LGVAGAFV; GVAGAFVW; VAGAFVWS; AGAFVWSP; GAFVWSPL; AFVWSPLT; FVWSPLTV; VWSPLTVT; WSPLTVTA; SPLTVTAT; PLTVTATR; LTVTATRN; TVTATRNL; VTATRNLR; TATRNLRP; ATRNLRPH; TRNLRPHL; RNLRPHLA; NLRPHLAG; LRPHLAGA; RPHLAGAS; PHLAGASS; HLAGASSG; LAGASSGV; AGASSGVF; GASSGVFN; ASSGVFNA; SSGVFNAV; SGVFNAVR; GVFNAVRQ; VFNAVRQL; FNAVRQLG; NAVRQLGA; AVRQLGAV; VRQLGAVL; RQLGAVLG; QLGAVLGS; LGAVLGSA; GAVLGSAS; AVLGSASM; VLGSASMA; LGSASMAA; GSASMAAF; SASMAAFM; ASMAAFMT; SMAAFMTS; MAAFMTSR; AAFMTSRI; AFMTSRIA; FMTSRIAA; MTSRIAAE; TSRIAAEM; SRIAAEMP; RIAAEMPG; IAAEMPGG; AAEMPGGV; AEMPGGVD; EMPGGVDA; MPGGVDAL; PGGVDALT; GGVDALTG; GVDALTGP; VDALTGPA; DALTGPAG; ALTGPAGQ; LTGPAGQD; TGPAGQDA; GPAGQDAT; PAGQDATV; AGQDATVL; GQDATVLQ; QDATVLQL; DATVLQLP; ATVLQLPE; TVLQLPEF; VLQLPEFV; LQLPEFVR; QLPEFVRE; LPEFVREP; PEFVREPF; EFVREPFA; FVREPFAA; VREPFAAA; REPFAAAM; EPFAAAMS; PFAAAMSQ; FAAAMSQS; AAAMSQSM; AAMSQSML; AMSQSMLL; MSQSMLLP; SQSMLLPA; QSMLLPAF; SMLLPAFV; MLLPAFVA; LLPAFVAL; LPAFVALF; PAFVALFG; AFVALFGI; FVALFGIV; VALFGIVA; ALFGIVAA; LFGIVAAL; FGIVAALF; GIVAALFL; IVAALFLV; VAALFLVD; AALFLVDF; ALFLVDFT; LFLVDFTG; FLVDFTGA; LVDFTGAA; VDFTGAAV; DFTGAAVA; FTGAAVAK; TGAAVAKE; GAAVAKEP; AAVAKEPL; AVAKEPLP; VAKEPLPE; AKEPLPES; KEPLPESD; EPLPESDG; PLPESDGD; LPESDGDA; PESDGDAD; ESDGDADD; SDGDADDD; DGDADDDD; GDADDDDY; DADDDDYV; ADDDDYVE; DDDDYVEY; DDDYVEYI; DDYVEYIL; DYVEYILR; YVEYILRR; VEYILRRE; EYILRREP; YILRREPE; ILRREPEE; LRREPEED; RREPEEDC; REPEEDCD; EPEEDCDT; PEEDCDTQ; EEDCDTQP; EDCDTQPL; DCDTQPLR; CDTQPLRA; DTQPLRAS; TQPLRASR; QPLRASRP; PLRASRPA; LRASRPAA; RASRPAAA; ASRPAAAA; SRPAAAAA; RPAAAAAS; | |

Fig. 28 continued

PAAAAASR; AAAAASRS; AAAASRSG; AAASRSGA; AASRSGAG; ASRSGAGG; SRSGAGGP; RSGAGGPL; SGAGGPLA; GAGGPLAV; AGGPLAVS; GGPLAVSW; GPLAVSWS; PLAVSWST; LAVSWSTS; AVSWSTSA; VSWSTSAQ; SWSTSAQG; WSTSAQGM; STSAQGMP; TSAQGMPP; SAQGMPPG; AQGMPPGP; QGMPPGPP; GMPPGPPG; MPPGPPGR; PPGPPGRR; PGPPGRRA; GPPGRRAW; PPGRRAWQ; PGRRAWQA; GRRAWQAD; RRAWQADT; RAWQADTE; AWQADTES; WQADTEST; QADTESTA; ADTESTAP; DTESTAPS; TESTAPSA;

9 mers:
MTTAIRRAA; TTAIRRAAG; TAIRRAAGS; AIRRAAGSS; IRRAAGSSY; RRAAGSSYF; RAAGSSYFR; AAGSSYFRN; AGSSYFRNP; GSSYFRNPW; SSYFRNPWP; SYFRNPWPA; YFRNPWPAL; FRNPWPALW; RNPWPALWA; NPWPALWAM; PWPALWAMM; WPALWAMMV; PALWAMMVG; ALWAMMVGF; LWAMMVGFF; WAMMVGFFM; AMMVGFFMI; MMVGFFMIM; MVGFFMIML; VGFFMIMLD; GFFMIMLDS; FFMIMLDST; FMIMLDSTV; MIMLDSTVV; IMLDSTVVA; MLDSTVVAI; LDSTVVAIA; DSTVVAIAN; STVVAIANP; TVVAIANPT; VVAIANPTI; VAIANPTIM; AIANPTIMA; IANPTIMAQ; ANPTIMAQL; NPTIMAQLR; PTIMAQLRI; TIMAQLRIG; IMAQLRIGY; MAQLRIGYA; AQLRIGYAT; QLRIGYATV; LRIGYATVV; RIGYATVVW; IGYATVVWV; GYATVVWVT; YATVVWVTS; ATVVWVTSA; TVVWVTSAY; VVWVTSAYL; VWVTSAYLL; WVTSAYLLA; VTSAYLLAY; TSAYLLAYA; SAYLLAYAV; AYLLAYAVP; YLLAYAVPM; LLAYAVPML; LAYAVPMLV; AYAVPMLVA; YAVPMLVAG; AVPMLVAGR; VPMLVAGRL; PMLVAGRLG; MLVAGRLGD; LVAGRLGDR; VAGRLGDRF; AGRLGDRFG; GRLGDRFGP; RLGDRFGPK; LGDRFGPKN; GDRFGPKNL; DRFGPKNLY; RFGPKNLYL; FGPKNLYLI; GPKNLYLIG; PKNLYLIGL; KNLYLIGLG; NLYLIGLGV; LYLIGLGVF; YLIGLGVFT; LIGLGVFTV; IGLGVFTVA; GLGVFTVAS; LGVFTVASL; GVFTVASLG; VFTVASLGC; FTVASLGCG; TVASLGCGL; VASLGCGLS; ASLGCGLSS; SLGCGLSSG; LGCGLSSGA; GCGLSSGAG; CGLSSGAGM; GLSSGAGML; LSSGAGMLI; SSGAGMLIA; SGAGMLIAA; GAGMLIAAR; AGMLIAARV; GMLIAARVV; MLIAARVVQ; LIAARVVQG; IAARVVQGV; AARVVQGVG; ARVVQGVGA; RVVQGVGAG; VVQGVGAGL; VQGVGAGLL; QGVGAGLLT; GVGAGLLTP; VGAGLLTPQ; GAGLLTPQT; AGLLTPQTL; GLLTPQTLS; LLTPQTLST; LTPQTLSTI; TPQTLSTIT; PQTLSTITR; QTLSTITRI; TLSTITRIF; LSTITRIFP; STITRIFPA; TITRIFPAH; ITRIFPAHR; TRIFPAHRR; RIFPAHRRG; IFPAHRRGV; FPAHRRGVA; PAHRRGVAL; AHRRGVALG; HRRGVALGA; RRGVALGAW; RGVALGAWG; GVALGAWGT; VALGAWGTV; ALGAWGTVA; LGAWGTVAS; GAWGTVASV; AWGTVASVA; WGTVASVAS; GTVASVASL; TVASVASLV; VASVASLVG; ASVASLVGP; SVASLVGPL; VASLVGPLA; ASLVGPLAG; SLVGPLAGG; LVGPLAGGA; VGPLAGGAL; GPLAGGALV; PLAGGALVD; LAGGALVDS; AGGALVDSM; GGALVDSMG; GALVDSMGW; ALVDSMGWE; LVDSMGWEW; VDSMGWEWI; DSMGWEWIF; SMGWEWIFF; MGWEWIFFV; GWEWIFFVN; WEWIFFVNV; EWIFFVNVP; WIFFVNVPV; IFFVNVPVG; FFVNVPVGV; FVNVPVGVI; VNVPVGVIG; NVPVGVIGL; VPVGVIGLI; PVGVIGLIL; VGVIGLILA; GVIGLILAA; VIGLILAAY; IGLILAAYL; GLILAAYLI; LILAAYLIP; ILAAYLIPA; LAAYLIPAL; AAYLIPALP;

Fig. 28 continued

| | | |
|---|---|---|
| | AYLIPALPH; YLIPALPHH; LIPALPHHP; IPALPHHPH; PALPHHPHR; ALPHHPHRF; LPHHPHRFD; PHHPHRFDW; HHPHRFDWF; HPHRFDWFG; PHRFDWFGV; HRFDWFGVG; RFDWFGVGL; FDWFGVGLS; DWFGVGLSG; WFGVGLSGA; FGVGLSGAG; GVGLSGAGM; VGLSGAGMF; GLSGAGMFL; LSGAGMFLI; SGAGMFLIV; GAGMFLIVF; AGMFLIVFG; GMFLIVFGL; MFLIVFGLQ; FLIVFGLQQ; LIVFGLQQG; IVFGLQQGQ; VFGLQQGQS; FGLQQGQSA; GLQQGQSAN; LQQGQSANW; QQGQSANWQ; QGQSANWQP; GQSANWQPW; QSANWQPWI; SANWQPWIW; ANWQPWIWA; NWQPWIWAV; WQPWIWAVI; QPWIWAVIV; PWIWAVIVG; WIWAVIVGG; IWAVIVGGI; WAVIVGGIG; AVIVGGIGF; VIVGGIGFM; IVGGIGFMS; VGGIGFMSL; GGIGFMSLF; GIGFMSLFV; IGFMSLFVY; GFMSLFVYW; FMSLFVYWQ; MSLFVYWQA; SLFVYWQAR; LFVYWQARN; FVYWQARNA; VYWQARNAR; YWQARNARE; WQARNAREP; QARNAREPL; ARNAREPLI; RNAREPLIP; NAREPLIPL; AREPLIPLE; REPLIPLEV; EPLIPLEVF; PLIPLEVFN; LIPLEVFND; IPLEVFNDR; PLEVFNDRN; LEVFNDRNF; EVFNDRNFS; VFNDRNFSL; FNDRNFSLS; NDRNFSLSN; DRNFSLSNL; RNFSLSNLR; NFSLSNLRI; FSLSNLRIA; SLSNLRIAI; LSNLRIAII; SNLRIAIIA; NLRIAIIAF; LRIAIIAFA; RIAIIAFAG; IAIIAFAGT; AIIAFAGTG; IIAFAGTGM; IAFAGTGMM; AFAGTGMML; FAGTGMMLP; AGTGMMLPV; GTGMMLPVT; TGMMLPVTF; GMMLPVTFY; MMLPVTFYA; MLPVTFYAQ; LPVTFYAQA; PVTFYAQAV; VTFYAQAVC; TFYAQAVCG; FYAQAVCGL; YAQAVCGLS; AQAVCGLSP; QAVCGLSPT; AVCGLSPTH; VCGLSPTHT; CGLSPTHTA; GLSPTHTAV; LSPTHTAVL; SPTHTAVLF; PTHTAVLFA; THTAVLFAP; HTAVLFAPT; TAVLFAPTA; AVLFAPTAI; VLFAPTAIV; LFAPTAIVG; FAPTAIVGG; APTAIVGGV; PTAIVGGVL; TAIVGGVLA; AIVGGVLAP; IVGGVLAPF; VGGVLAPFV; GGVLAPFVG; GVLAPFVGM; VLAPFVGMI; LAPFVGMII; APFVGMIID; PFVGMIIDR; FVGMIIDRS; VGMIIDRSH; GMIIDRSHP; MIIDRSHPL; IIDRSHPLC; IDRSHPLCV; DRSHPLCVL; RSHPLCVLG; SHPLCVLGF; HPLCVLGFG; PLCVLGFGF; LCVLGFGFS; CVLGFGFSV; VLGFGFSVL; LGFGFSVLA; GFGFSVLAI; FGFSVLAIA; GFSVLAIAM; FSVLAIAMT; SVLAIAMTW; VLAIAMTWL; LAIAMTWLL; AIAMTWLLC; IAMTWLLCE; AMTWLLCEM; MTWLLCEMA; TWLLCEMAP; WLLCEMAPG; LLCEMAPGT; LCEMAPGTP; CEMAPGTPI; EMAPGTPIW; MAPGTPIWR; APGTPIWRL; PGTPIWRLV; GTPIWRLVL; TPIWRLVLP; PIWRLVLPF; IWRLVLPFI; WRLVLPFIA; RLVLPFIAL; LVLPFIALG; VLPFIALGV; LPFIALGVA; PFIALGVAG; FIALGVAGA; IALGVAGAF; ALGVAGAFV; LGVAGAFVW; GVAGAFVWS; VAGAFVWSP; AGAFVWSPL; GAFVWSPLT; AFVWSPLTV; FVWSPLTVT; VWSPLTVTA; WSPLTVTAT; SPLTVTATR; PLTVTATRN; LTVTATRNL; TVTATRNLR; VTATRNLRP; TATRNLRPH; ATRNLRPHL; TRNLRPHLA; RNLRPHLAG; NLRPHLAGA; LRPHLAGAS; RPHLAGASS; PHLAGASSG; HLAGASSGV; LAGASSGVF; AGASSGVFN; GASSGVFNA; ASSGVFNAV; SSGVFNAVR; SGVFNAVRQ; GVFNAVRQL; VFNAVRQLG; FNAVRQLGA; NAVRQLGAV; AVRQLGAVL; VRQLGAVLG; RQLGAVLGS; QLGAVLGSA; LGAVLGSAS; GAVLGSASM; AVLGSASMA; VLGSASMAA; LGSASMAAF; GSASMAAFM; SASMAAFMT; ASMAAFMTS; SMAAFMTSR; MAAFMTSRI; AAFMTSRIA; AFMTSRIAA; FMTSRIAAE; MTSRIAAEM; | |

Fig. 28 continued

| | | |
|---|---|---|
| | TSRIAAEMP; SRIAAEMPG; RIAAEMPGG; IAAEMPGGV;<br>AAEMPGGVD; AEMPGGVDA; EMPGGVDAL; MPGGVDALT;<br>PGGVDALTG; GGVDALTGP; GVDALTGPA; VDALTGPAG;<br>DALTGPAGQ; ALTGPAGQD; LTGPAGQDA; TGPAGQDAT;<br>GPAGQDATV; PAGQDATVL; AGQDATVLQ; GQDATVLQL;<br>QDATVLQLP; DATVLQLPE; ATVLQLPEF; TVLQLPEFV; VLQLPEFVR;<br>LQLPEFVRE; QLPEFVREP; LPEFVREPF; PEFVREPFA; EFVREPFAA;<br>FVREPFAAA; VREPFAAAM; REPFAAAMS; EPFAAAMSQ;<br>PFAAAMSQS; FAAAMSQSM; AAAMSQSML; AAMSQSMLL;<br>AMSQSMLLP; MSQSMLLPA; SQSMLLPAF; QSMLLPAFV;<br>SMLLPAFVA; MLLPAFVAL; LLPAFVALF; LPAFVALFG; PAFVALFGI;<br>AFVALFGIV; FVALFGIVA; VALFGIVAA; ALFGIVAAL; LFGIVAALF;<br>FGIVAALFL; GIVAALFLV; IVAALFLVD; VAALFLVDF; AALFLVDFT;<br>ALFLVDFTG; LFLVDFTGA; FLVDFTGAA; LVDFTGAAV; VDFTGAAVA;<br>DFTGAAVAK; FTGAAVAKE; TGAAVAKEP; GAAVAKEPL;<br>AAVAKEPLP; AVAKEPLPE; VAKEPLPES; AKEPLPESD; KEPLPESDG;<br>EPLPESDGD; PLPESDGDA; LPESDGDAD; PESDGDADD;<br>ESDGDADDD; SDGDADDDD; DGDADDDDY; GDADDDDYV;<br>DADDDDYVE; ADDDDYVEY; DDDDYVEYI; DDDYVEYIL; DDYVEYILR;<br>DYVEYILRR; YVEYILRRE; VEYILRREP; EYILRREPE; YILRREPEE;<br>ILRREPEED; LRREPEEDC; RREPEEDCD; REPEEDCDT;<br>EPEEDCDTQ; PEEDCDTQP; EEDCDTQPL; EDCDTQPLR;<br>DCDTQPLRA; CDTQPLRAS; DTQPLRASR; TQPLRASRP;<br>QPLRASRPA; PLRASRPAA; LRASRPAAA; RASRPAAAA;<br>ASRPAAAAA; SRPAAAAAS; RPAAAAASR; PAAAAASRS;<br>AAAAASRSG; AAAASRSGA; AAASRSGAG; AASRSGAGG;<br>ASRSGAGGP; SRSGAGGPL; RSGAGGPLA; SGAGGPLAV;<br>GAGGPLAVS; AGGPLAVSW; GGPLAVSWS; GPLAVSWST;<br>PLAVSWSTS; LAVSWSTSA; AVSWSTSAQ; VSWSTSAQG;<br>SWSTSAQGM; WSTSAQGMP; STSAQGMPP; TSAQGMPPG;<br>SAQGMPPGP; AQGMPPGPP; QGMPPGPPG; GMPPGPPGR;<br>MPPGPPGRR; PPGPPGRRA; PGPPGRRAW; GPPGRRAWQ;<br>PPGRRAWQA; PGRRAWQAD; GRRAWQADT; RRAWQADTE;<br>RAWQADTES; AWQADTEST; WQADTESTA; QADTESTAP;<br>ADTESTAPS; DTESTAPSA;<br><br>10 mers:<br>MTTAIRRAAG; TTAIRRAAGS; TAIRRAAGSS; AIRRAAGSSY;<br>IRRAAGSSYF; RRAAGSSYFR; RAAGSSYFRN; AAGSSYFRNP;<br>AGSSYFRNPW; GSSYFRNPWP; SSYFRNPWPA; SYFRNPWPAL;<br>YFRNPWPALW; FRNPWPALWA; RNPWPALWAM; NPWPALWAMM;<br>PWPALWAMMV; WPALWAMMVG; PALWAMMVGF; ALWAMMVGFF;<br>LWAMMVGFFM; WAMMVGFFMI; AMMVGFFMIM; MMVGFFMIML;<br>MVGFFMIMLD; VGFFMIMLDS; GFFMIMLDST; FFMIMLDSTV;<br>FMIMLDSTVV; MIMLDSTVVA; IMLDSTVVAI; MLDSTVVAIA;<br>LDSTVVAIAN; DSTVVAIANP; STVVAIANPT; TVVAIANPTI;<br>VVAIANPTIM; VAIANPTIMA; AIANPTIMAQ; IANPTIMAQL;<br>ANPTIMAQLR; NPTIMAQLRI; PTIMAQLRIG; TIMAQLRIGY;<br>IMAQLRIGYA; MAQLRIGYAT; AQLRIGYATV; QLRIGYATVV;<br>LRIGYATVVW; RIGYATVVWV; IGYATVVWVT; GYATVVWVTS;<br>YATVVWVTSA; ATVVWVTSAY; TVVWVTSAYL; VVWVTSAYLL;<br>VWVTSAYLLA; WVTSAYLLAY; VTSAYLLAYA; TSAYLLAYAV;<br>SAYLLAYAVP; AYLLAYAVPM; YLLAYAVPML; LLAYAVPMLV; | |

Fig. 28 continued

| | | |
|---|---|---|
| | LAYAVPMLVA; AYAVPMLVAG; YAVPMLVAGR; AVPMLVAGRL; VPMLVAGRLG; PMLVAGRLGD; MLVAGRLGDR; LVAGRLGDRF; VAGRLGDRFG; AGRLGDRFGP; GRLGDRFGPK; RLGDRFGPKN; LGDRFGPKNL; GDRFGPKNLY; DRFGPKNLYL; RFGPKNLYLI; FGPKNLYLIG; GPKNLYLIGL; PKNLYLIGLG; KNLYLIGLGV; NLYLIGLGVF; LYLIGLGVFT; YLIGLGVFTV; LIGLGVFTVA; IGLGVFTVAS; GLGVFTVASL; LGVFTVASLG; GVFTVASLGC; VFTVASLGCG; FTVASLGCGL; TVASLGCGLS; VASLGCGLSS; ASLGCGLSSG; SLGCGLSSGA; LGCGLSSGAG; GCGLSSGAGM; CGLSSGAGML; GLSSGAGMLI; LSSGAGMLIA; SSGAGMLIAA; SGAGMLIAAR; GAGMLIAARV; AGMLIAARVV; GMLIAARVVQ; MLIAARVVQG; LIAARVVQGV; IAARVVQGVG; AARVVQGVGA; ARVVQGVGAG; RVVQGVGAGL; VVQGVGAGLL; VQGVGAGLLT; QGVGAGLLTP; GVGAGLLTPQ; VGAGLLTPQT; GAGLLTPQTL; AGLLTPQTLS; GLLTPQTLST; LLTPQTLSTI; LTPQTLSTIT; TPQTLSTITR; PQTLSTITRI; QTLSTITRIF; TLSTITRIFP; LSTITRIFPA; STITRIFPAH; TITRIFPAHR; ITRIFPAHRR; TRIFPAHRRG; RIFPAHRRGV; IFPAHRRGVA; FPAHRRGVAL; PAHRRGVALG; AHRRGVALGA; HRRGVALGAW; RRGVALGAWG; RGVALGAWGT; GVALGAWGTV; VALGAWGTVA; ALGAWGTVAS; LGAWGTVASV; GAWGTVASVA; AWGTVASVAS; WGTVASVASL; GTVASVASLV; TVASVASLVG; VASVASLVGP; ASVASLVGPL; SVASLVGPLA; VASLVGPLAG; ASLVGPLAGG; SLVGPLAGGA; LVGPLAGGAL; VGPLAGGALV; GPLAGGALVD; PLAGGALVDS; LAGGALVDSM; AGGALVDSMG; GGALVDSMGW; GALVDSMGWE; ALVDSMGWEW; LVDSMGWEWI; VDSMGWEWIF; DSMGWEWIFF; SMGWEWIFFV; MGWEWIFFVN; GWEWIFFVNV; WEWIFFVNVP; EWIFFVNVPV; WIFFVNVPVG; IFFVNVPVGV; FFVNVPVGVI; FVNVPVGVIG; VNVPVGVIGL; NVPVGVIGLI; VPVGVIGLIL; PVGVIGLILA; VGVIGLILAA; GVIGLILAAY; VIGLILAAYL; IGLILAAYLI; GLILAAYLIP; LILAAYLIPA; ILAAYLIPAL; LAAYLIPALP; AAYLIPALPH; AYLIPALPHH; YLIPALPHHP; LIPALPHHPH; IPALPHHPHR; PALPHHPHRF; ALPHHPHRFD; LPHHPHRFDW; PHHPHRFDWF; HHPHRFDWFG; HPHRFDWFGV; PHRFDWFGVG; HRFDWFGVGL; RFDWFGVGLS; FDWFGVGLSG; DWFGVGLSGA; WFGVGLSGAG; FGVGLSGAGM; GVGLSGAGMF; VGLSGAGMFL; GLSGAGMFLI; LSGAGMFLIV; SGAGMFLIVF; GAGMFLIVFG; AGMFLIVFGL; GMFLIVFGLQ; MFLIVFGLQQ; FLIVFGLQQG; LIVFGLQQGQ; IVFGLQQGQS; VFGLQQGQSA; FGLQQGQSAN; GLQQGQSANW; LQQGQSANWQ; QQGQSANWQP; QGQSANWQPW; GQSANWQPWI; QSANWQPWIW; SANWQPWIWA; ANWQPWIWAV; NWQPWIWAVI; WQPWIWAVIV; QPWIWAVIVG; PWIWAVIVGG; WIWAVIVGGI; IWAVIVGGIG; WAVIVGGIGF; AVIVGGIGFM; VIVGGIGFMS; IVGGIGFMSL; VGGIGFMSLF; GGIGFMSLFV; GIGFMSLFVY; IGFMSLFVYW; GFMSLFVYWQ; FMSLFVYWQA; MSLFVYWQAR; SLFVYWQARN; LFVYWQARNA; FVYWQARNAR; VYWQARNARE; YWQARNAREP; WQARNAREPL; QARNAREPLI; ARNAREPLIP; RNAREPLIPL; NAREPLIPLE; AREPLIPLEV; REPLIPLEVF; EPLIPLEVFN; PLIPLEVFND; LIPLEVFNDR; IPLEVFNDRN; PLEVFNDRNF; LEVFNDRNFS; EVFNDRNFSL; VFNDRNFSLS; FNDRNFSLSN; NDRNFSLSNL; DRNFSLSNLR; RNFSLSNLRI; NFSLSNLRIA; FSLSNLRIAI; SLSNLRIAII; LSNLRIAIIA; SNLRIAIIAF; NLRIAIIAFA; LRIAIIAFAG; RIAIIAFAGT; IAIIAFAGTG; AIIAFAGTGM; IIAFAGTGMM; | |

Fig. 28 continued

| | | | |
|---|---|---|---|
| | IAFAGTGMML; AFAGTGMMLP; FAGTGMMLPV; AGTGMMLPVT; GTGMMLPVTF; TGMMLPVTFY; GMMLPVTFYA; MMLPVTFYAQ; MLPVTFYAQA; LPVTFYAQAV; PVTFYAQAVC; VTFYAQAVCG; TFYAQAVCGL; FYAQAVCGLS; YAQAVCGLSP; AQAVCGLSPT; QAVCGLSPTH; AVCGLSPTHT; VCGLSPTHTA; CGLSPTHTAV; GLSPTHTAVL; LSPTHTAVLF; SPTHTAVLFA; PTHTAVLFAP; THTAVLFAPT; HTAVLFAPTA; TAVLFAPTAI; AVLFAPTAIV; VLFAPTAIVG; LFAPTAIVGG; FAPTAIVGGV; APTAIVGGVL; PTAIVGGVLA; TAIVGGVLAP; AIVGGVLAPF; IVGGVLAPFV; VGGVLAPFVG; GGVLAPFVGM; GVLAPFVGMI; VLAPFVGMII; LAPFVGMIID; APFVGMIIDR; PFVGMIIDRS; FVGMIIDRSH; VGMIIDRSHP; GMIIDRSHPL; MIIDRSHPLC; IIDRSHPLCV; IDRSHPLCVL; DRSHPLCVLG; RSHPLCVLGF; SHPLCVLGFG; HPLCVLGFGF; PLCVLGFGFS; LCVLGFGFSV; CVLGFGFSVL; VLGFGFSVLA; LGFGFSVLAI; GFGFSVLAIA; FGFSVLAIAM; GFSVLAIAMT; FSVLAIAMTW; SVLAIAMTWL; VLAIAMTWLL; LAIAMTWLLC; AIAMTWLLCE; IAMTWLLCEM; AMTWLLCEMA; MTWLLCEMAP; TWLLCEMAPG; WLLCEMAPGT; LLCEMAPGTP; LCEMAPGTPI; CEMAPGTPIW; EMAPGTPIWR; MAPGTPIWRL; APGTPIWRLV; PGTPIWRLVL; GTPIWRLVLP; TPIWRLVLPF; PIWRLVLPFI; IWRLVLPFIA; WRLVLPFIAL; RLVLPFIALG; LVLPFIALGV; VLPFIALGVA; LPFIALGVAG; PFIALGVAGA; FIALGVAGAF; IALGVAGAFV; ALGVAGAFVW; LGVAGAFVWS; GVAGAFVWSP; VAGAFVWSPL; AGAFVWSPLT; GAFVWSPLTV; AFVWSPLTVT; FVWSPLTVTA; VWSPLTVTAT; WSPLTVTATR; SPLTVTATRN; PLTVTATRNL; LTVTATRNLR; TVTATRNLRP; VTATRNLRPH; TATRNLRPHL; ATRNLRPHLA; TRNLRPHLAG; RNLRPHLAGA; NLRPHLAGAS; LRPHLAGASS; RPHLAGASSG; PHLAGASSGV; HLAGASSGVF; LAGASSGVFN; AGASSGVFNA; GASSGVFNAV; ASSGVFNAVR; SSGVFNAVRQ; SGVFNAVRQL; GVFNAVRQLG; VFNAVRQLGA; FNAVRQLGAV; NAVRQLGAVL; AVRQLGAVLG; VRQLGAVLGS; RQLGAVLGSA; QLGAVLGSAS; LGAVLGSASM; GAVLGSASMA; AVLGSASMAA; VLGSASMAAF; LGSASMAAFM; GSASMAAFMT; SASMAAFMTS; ASMAAFMTSR; SMAAFMTSRI; MAAFMTSRIA; AAFMTSRIAA; AFMTSRIAAE; FMTSRIAAEM; MTSRIAAEMP; TSRIAAEMPG; SRIAAEMPGG; RIAAEMPGGV; IAAEMPGGVD; AAEMPGGVDA; AEMPGGVDAL; EMPGGVDALT; MPGGVDALTG; PGGVDALTGP; GGVDALTGPA; GVDALTGPAG; VDALTGPAGQ; DALTGPAGQD; ALTGPAGQDA; LTGPAGQDAT; TGPAGQDATV; GPAGQDATVL; PAGQDATVLQ; AGQDATVLQL; GQDATVLQLP; QDATVLQLPE; DATVLQLPEF; ATVLQLPEFV; TVLQLPEFVR; VLQLPEFVRE; LQLPEFVREP; QLPEFVREPF; LPEFVREPFA; PEFVREPFAA; EFVREPFAAA; FVREPFAAAM; VREPFAAAMS; REPFAAAMSQ; EPFAAAMSQS; PFAAAMSQSM; FAAAMSQSML; AAAMSQSMLL; AAMSQSMLLP; AMSQSMLLPA; MSQSMLLPAF; SQSMLLPAFV; QSMLLPAFVA; SMLLPAFVAL; MLLPAFVALF; LLPAFVALFG; LPAFVALFGI; PAFVALFGIV; AFVALFGIVA; FVALFGIVAA; VALFGIVAAL; ALFGIVAALF; LFGIVAALFL; FGIVAALFLV; GIVAALFLVD; IVAALFLVDF; VAALFLVDFT; AALFLVDFTG; ALFLVDFTGA; LFLVDFTGAA; FLVDFTGAAV; LVDFTGAAVA; VDFTGAAVAK; DFTGAAVAKE; FTGAAVAKEP; TGAAVAKEPL; GAAVAKEPLP; AAVAKEPLPE; AVAKEPLPES; VAKEPLPESD; AKEPLPESDG; | |

Fig. 28 continued

| | | | |
|---|---|---|---|
| | KEPLPESDGD; EPLPESDGDA; PLPESDGDAD; LPESDGDADD; PESDGDADDD; ESDGDADDDD; SDGDADDDDY; DGDADDDDYV; GDADDDDYVE; DADDDDYVEY; ADDDDYVEYI; DDDDYVEYIL; DDDYVEYILR; DDYVEYILRR; DYVEYILRRE; YVEYILRREP; VEYILRREPE; EYILRREPEE; YILRREPEED; ILRREPEEDC; LRREPEEDCD; RREPEEDCDT; REPEEDCDTQ; EPEEDCDTQP; PEEDCDTQPL; EEDCDTQPLR; EDCDTQPLRA; DCDTQPLRAS; CDTQPLRASR; DTQPLRASRP; TQPLRASRPA; QPLRASRPAA; PLRASRPAAA; LRASRPAAAA; RASRPAAAAA; ASRPAAAAAS; SRPAAAAASR; RPAAAAASRS; PAAAAASRSG; AAAAASRSGA; AAAASRSGAG; AAASRSGAGG; AASRSGAGGP; ASRSGAGGPL; SRSGAGGPLA; RSGAGGPLAV; SGAGGPLAVS; GAGGPLAVSW; AGGPLAVSWS; GGPLAVSWST; GPLAVSWSTS; PLAVSWSTSA; LAVSWSTSAQ; AVSWSTSAQG; VSWSTSAQGM; SWSTSAQGMP; WSTSAQGMPP; STSAQGMPPG; TSAQGMPPGP; SAQGMPPGPP; AQGMPPGPPG; QGMPPGPPGR; GMPPGPPGRR; MPPGPPGRRA; PPGPPGRRAW; PGPPGRRAWQ; GPPGRRAWQA; PPGRRAWQAD; PGRRAWQADT; GRRAWQADTE; RRAWQADTES; RAWQADTEST; AWQADTESTA; WQADTESTAP; QADTESTAPS; ADTESTAPSA; DTESTAPSAL<br><br>11 mers:<br>MTTAIRRAAGS; TTAIRRAAGSS; TAIRRAAGSSY; AIRRAAGSSYF; IRRAAGSSYFR; RRAAGSSYFRN; RAAGSSYFRNP; AAGSSYFRNPW; AGSSYFRNPWP; GSSYFRNPWPA; SSYFRNPWPAL; SYFRNPWPALW; YFRNPWPALWA; FRNPWPALWAM; RNPWPALWAMM; NPWPALWAMMV; PWPALWAMMVG; WPALWAMMVGF; PALWAMMVGFF; ALWAMMVGFFM; LWAMMVGFFMI; WAMMVGFFMIM; AMMVGFFMIML; MMVGFFMIMLD; MVGFFMIMLDS; VGFFMIMLDST; GFFMIMLDSTV; FFMIMLDSTVV; FMIMLDSTVVA; MIMLDSTVVAI; IMLDSTVVAIA; MLDSTVVAIAN; LDSTVVAIANP; DSTVVAIANPT; STVVAIANPTI; TVVAIANPTIM; VVAIANPTIMA; VAIANPTIMAQ; AIANPTIMAQL; IANPTIMAQLR; ANPTIMAQLRI; NPTIMAQLRIG; PTIMAQLRIGY; TIMAQLRIGYA; IMAQLRIGYAT; MAQLRIGYATV; AQLRIGYATVV; QLRIGYATVVW; LRIGYATVVWV; RIGYATVVWVT; IGYATVVWVTS; GYATVVWVTSA; YATVVWVTSAY; ATVVWVTSAYL; TVVWVTSAYLL; VVWVTSAYLLA; VWVTSAYLLAY; WVTSAYLLAYA; VTSAYLLAYAV; TSAYLLAYAVP; SAYLLAYAVPM; AYLLAYAVPML; YLLAYAVPMLV; LLAYAVPMLVA; LAYAVPMLVAG; AYAVPMLVAGR; YAVPMLVAGRL; AVPMLVAGRLG; VPMLVAGRLGD; PMLVAGRLGDR; MLVAGRLGDRF; LVAGRLGDRFG; VAGRLGDRFGP; AGRLGDRFGPK; GRLGDRFGPKN; RLGDRFGPKNL; LGDRFGPKNLY; GDRFGPKNLYL; DRFGPKNLYLI; RFGPKNLYLIG; FGPKNLYLIGL; GPKNLYLIGLG; PKNLYLIGLGV; KNLYLIGLGVF; NLYLIGLGVFT; LYLIGLGVFTV; YLIGLGVFTVA; LIGLGVFTVAS; IGLGVFTVASL; GLGVFTVASLG; LGVFTVASLGC; GVFTVASLGCG; VFTVASLGCGL; FTVASLGCGLS; TVASLGCGLSS; VASLGCGLSSG; ASLGCGLSSGA; SLGCGLSSGAG; LGCGLSSGAGM; GCGLSSGAGML; CGLSSGAGMLI; GLSSGAGMLIA; LSSGAGMLIAA; SSGAGMLIAAR; SGAGMLIAARV; GAGMLIAARVV; AGMLIAARVVQ; GMLIAARVVQG; MLIAARVVQGV; LIAARVVQGVG; IAARVVQGVGA; AARVVQGVGAG; ARVVQGVGAGL; RVVQGVGAGLL; | |

Fig. 28 continued

| | | |
|---|---|---|
| | VVQGVGAGLLT; VQGVGAGLLTP; QGVGAGLLTPQ; GVGAGLLTPQT;<br>VGAGLLTPQTL; GAGLLTPQTLS; AGLLTPQTLST; GLLTPQTLSTI;<br>LLTPQTLSTIT; LTPQTLSTITR; TPQTLSTITRI; PQTLSTITRIF;<br>QTLSTITRIFP; TLSTITRIFPA; LSTITRIFPAH; STITRIFPAHR;<br>TITRIFPAHRR; ITRIFPAHRRG; TRIFPAHRRGV; RIFPAHRRGVA;<br>IFPAHRRGVAL; FPAHRRGVALG; PAHRRGVALGA; AHRRGVALGAW;<br>HRRGVALGAWG; RRGVALGAWGT; RGVALGAWGTV;<br>GVALGAWGTVA; VALGAWGTVAS; ALGAWGTVASV;<br>LGAWGTVASVA; GAWGTVASVAS; AWGTVASVASL;<br>WGTVASVASLV; GTVASVASLVG; TVASVASLVGP; VASVASLVGPL;<br>ASVASLVGPLA; SVASLVGPLAG; VASLVGPLAGG; ASLVGPLAGGA;<br>SLVGPLAGGAL; LVGPLAGGALV; VGPLAGGALVD; GPLAGGALVDS;<br>PLAGGALVDSM; LAGGALVDSMG; AGGALVDSMGW;<br>GGALVDSMGWE; GALVDSMGWEW; ALVDSMGWEWI;<br>LVDSMGWEWIF; VDSMGWEWIFF; DSMGWEWIFFV;<br>SMGWEWIFFVN; MGWEWIFFVNV; GWEWIFFVNVP;<br>WEWIFFVNVPV; EWIFFVNVPVG; WIFFVNVPVGV; IFFVNVPVGVI;<br>FFVNVPVGVIG; FVNVPVGVIGL; VNVPVGVIGLI; NVPVGVIGLIL;<br>VPVGVIGLILA; PVGVIGLILAA; VGVIGLILAAY; GVIGLILAAYL;<br>VIGLILAAYLI; IGLILAAYLIP; GLILAAYLIPA; LILAAYLIPAL;<br>ILAAYLIPALP; LAAYLIPALPH; AAYLIPALPHH; AYLIPALPHHP;<br>YLIPALPHHPH; LIPALPHHPHR; IPALPHHPHRF; PALPHHPHRFD;<br>ALPHHPHRFDW; LPHHPHRFDWF; PHHPHRFDWFG;<br>HHPHRFDWFGV; HPHRFDWFGVG; PHRFDWFGVGL;<br>HRFDWFGVGLS; RFDWFGVGLSG; FDWFGVGLSGA;<br>DWFGVGLSGAG; WFGVGLSGAGM; FGVGLSGAGMF;<br>GVGLSGAGMFL; VGLSGAGMFLI; GLSGAGMFLIV; LSGAGMFLIVF;<br>SGAGMFLIVFG; GAGMFLIVFGL; AGMFLIVFGLQ; GMFLIVFGLQQ;<br>MFLIVFGLQQG; FLIVFGLQQGQ; LIVFGLQQGQS; IVFGLQQGQSA;<br>VFGLQQGQSAN; FGLQQGQSANW; GLQQGQSANWQ;<br>LQQGQSANWQP; QQGQSANWQPW; QGQSANWQPWI;<br>GQSANWQPWIW; QSANWQPWIWA; SANWQPWIWAV;<br>ANWQPWIWAVI; NWQPWIWAVIV; WQPWIWAVIVG; QPWIWAVIVGG;<br>PWIWAVIVGGI; WIWAVIVGGIG; IWAVIVGGIGF; WAVIVGGIGFM;<br>AVIVGGIGFMS; VIVGGIGFMSL; IVGGIGFMSLF; VGGIGFMSLFV;<br>GGIGFMSLFVY; GIGFMSLFVYW; IGFMSLFVYWQ; GFMSLFVYWQA;<br>FMSLFVYWQAR; MSLFVYWQARN; SLFVYWQARNA;<br>LFVYWQARNAR; FVYWQARNARE; VYWQARNAREP;<br>YWQARNAREPL; WQARNAREPLI; QARNAREPLIP; ARNAREPLIPL;<br>RNAREPLIPLE; NAREPLIPLEV; AREPLIPLEVF; REPLIPLEVFN;<br>EPLIPLEVFND; PLIPLEVFNDR; LIPLEVFNDRN; IPLEVFNDRNF;<br>PLEVFNDRNFS; LEVFNDRNFSL; EVFNDRNFSLS; VFNDRNFSLSN;<br>FNDRNFSLSNL; NDRNFSLSNLR; DRNFSLSNLRI; RNFSLSNLRIA;<br>NFSLSNLRIAI; FSLSNLRIAII; SLSNLRIAIIA; LSNLRIAIIAF;<br>SNLRIAIIAFA; NLRIAIIAFAG; LRIAIIAFAGT; RIAIIAFAGTG;<br>IAIIAFAGTGM; AIIAFAGTGMM; IIAFAGTGMML; IAFAGTGMMLP;<br>AFAGTGMMLPV; FAGTGMMLPVT; AGTGMMLPVTF;<br>GTGMMLPVTFY; TGMMLPVTFYA; GMMLPVTFYAQ;<br>MMLPVTFYAQA; MLPVTFYAQAV; LPVTFYAQAVC; PVTFYAQAVCG;<br>VTFYAQAVCGL; TFYAQAVCGLS; FYAQAVCGLSP; YAQAVCGLSPT;<br>AQAVCGLSPTH; QAVCGLSPTHT; AVCGLSPTHTA; VCGLSPTHTAV;<br>CGLSPTHTAVL; GLSPTHTAVLF; LSPTHTAVLFA; SPTHTAVLFAP;<br>PTHTAVLFAPT; THTAVLFAPTA; HTAVLFAPTAI; TAVLFAPTAIV; | |

Fig. 28 continued

| | | |
|---|---|---|
| | AVLFAPTAIVG; VLFAPTAIVGG; LFAPTAIVGGV; FAPTAIVGGVL;<br>APTAIVGGVLA; PTAIVGGVLAP; TAIVGGVLAPF; AIVGGVLAPFV;<br>IVGGVLAPFVG; VGGVLAPFVGM; GGVLAPFVGMI; GVLAPFVGMII;<br>VLAPFVGMIID; LAPFVGMIIDR; APFVGMIIDRS; PFVGMIIDRSH;<br>FVGMIIDRSHP; VGMIIDRSHPL; GMIIDRSHPLC; MIIDRSHPLCV;<br>IIDRSHPLCVL; IDRSHPLCVLG; DRSHPLCVLGF; RSHPLCVLGFG;<br>SHPLCVLGFGF; HPLCVLGFGFS; PLCVLGFGFSV; LCVLGFGFSVL;<br>CVLGFGFSVLA; VLGFGFSVLAI; LGFGFSVLAIA; GFGFSVLAIAM;<br>FGFSVLAIAMT; GFSVLAIAMTW; FSVLAIAMTWL; SVLAIAMTWLL;<br>VLAIAMTWLLC; LAIAMTWLLCE; AIAMTWLLCEM; IAMTWLLCEMA;<br>AMTWLLCEMAP; MTWLLCEMAPG; TWLLCEMAPGT;<br>WLLCEMAPGTP; LLCEMAPGTPI; LCEMAPGTPIW; CEMAPGTPIWR;<br>EMAPGTPIWRL; MAPGTPIWRLV; APGTPIWRLVL; PGTPIWRLVLP;<br>GTPIWRLVLPF; TPIWRLVLPFI; PIWRLVLPFIA; IWRLVLPFIAL;<br>WRLVLPFIALG; RLVLPFIALGV; LVLPFIALGVA; VLPFIALGVAG;<br>LPFIALGVAGA; PFIALGVAGAF; FIALGVAGAFV; IALGVAGAFVW;<br>ALGVAGAFVWS; LGVAGAFVWSP; GVAGAFVWSPL;<br>VAGAFVWSPLT; AGAFVWSPLTV; GAFVWSPLTVT; AFVWSPLTVTA;<br>FVWSPLTVTAT; VWSPLTVTATR; WSPLTVTATRN; SPLTVTATRNL;<br>PLTVTATRNLR; LTVTATRNLRP; TVTATRNLRPH; VTATRNLRPHL;<br>TATRNLRPHLA; ATRNLRPHLAG; TRNLRPHLAGA; RNLRPHLAGAS;<br>NLRPHLAGASS; LRPHLAGASSG; RPHLAGASSGV; PHLAGASSGVF;<br>HLAGASSGVFN; LAGASSGVFNA; AGASSGVFNAV; GASSGVFNAVR;<br>ASSGVFNAVRQ; SSGVFNAVRQL; SGVFNAVRQLG;<br>GVFNAVRQLGA; VFNAVRQLGAV; FNAVRQLGAVL; NAVRQLGAVLG;<br>AVRQLGAVLGS; VRQLGAVLGSA; RQLGAVLGSAS; QLGAVLGSASM;<br>LGAVLGSASMA; GAVLGSASMAA; AVLGSASMAAF; VLGSASMAAFM;<br>LGSASMAAFMT; GSASMAAFMTS; SASMAAFMTSR; ASMAAFMTSRI;<br>SMAAFMTSRIA; MAAFMTSRIAA; AAFMTSRIAAE; AFMTSRIAAEM;<br>FMTSRIAAEMP; MTSRIAAEMPG; TSRIAAEMPGG; SRIAAEMPGGV;<br>RIAAEMPGGVD; IAAEMPGGVDA; AAEMPGGVDAL; AEMPGGVDALT;<br>EMPGGVDALTG; MPGGVDALTGP; PGGVDALTGPA;<br>GGVDALTGPAG; GVDALTGPAGQ; VDALTGPAGQD;<br>DALTGPAGQDA; ALTGPAGQDAT; LTGPAGQDATV; TGPAGQDATVL;<br>GPAGQDATVLQ; PAGQDATVLQL; AGQDATVLQLP; GQDATVLQLPE;<br>QDATVLQLPEF; DATVLQLPEFV; ATVLQLPEFVR; TVLQLPEFVRE;<br>VLQLPEFVREP; LQLPEFVREPF; QLPEFVREPFA; LPEFVREPFAA;<br>PEFVREPFAAA; EFVREPFAAAM; FVREPFAAAMS; VREPFAAAMSQ;<br>REPFAAAMSQS; EPFAAAMSQSM; PFAAAMSQSML;<br>FAAAMSQSMLL; AAAMSQSMLLP; AAMSQSMLLPA; AMSQSMLLPAF;<br>MSQSMLLPAFV; SQSMLLPAFVA; QSMLLPAFVAL; SMLLPAFVALF;<br>MLLPAFVALFG; LLPAFVALFGI; LPAFVALFGIV; PAFVALFGIVA;<br>AFVALFGIVAA; FVALFGIVAAL; VALFGIVAALF; ALFGIVAALFL;<br>LFGIVAALFLV; FGIVAALFLVD; GIVAALFLVDF; IVAALFLVDFT;<br>VAALFLVDFTG; AALFLVDFTGA; ALFLVDFTGAA; LFLVDFTGAAV;<br>FLVDFTGAAVA; LVDFTGAAVAK; VDFTGAAVAKE; DFTGAAVAKEP;<br>FTGAAVAKEPL; TGAAVAKEPLP; GAAVAKEPLPE; AAVAKEPLPES;<br>AVAKEPLPESD; VAKEPLPESDG; AKEPLPESDGD; KEPLPESDGDA;<br>EPLPESDGDAD; PLPESDGDADD; LPESDGDADDD;<br>PESDGDADDDD; ESDGDADDDDY; SDGDADDDDYV;<br>DGDADDDDYVE; GDADDDDYVEY; DADDDDYVEYI; ADDDDYVEYIL;<br>DDDDYVEYILR; DDDYVEYILRR; DDYVEYILRRE; DYVEYILRREP;<br>YVEYILRREPE; VEYILRREPEE; EYILRREPEED; YILRREPEEDC; | |

Fig. 28 continued

| | | |
|---|---|---|
| | ILRREPEEDCD; LRREPEEDCDT; RREPEEDCDTQ; REPEEDCDTQP; EPEEDCDTQPL; PEEDCDTQPLR; EEDCDTQPLRA; EDCDTQPLRAS; DCDTQPLRASR; CDTQPLRASRP; DTQPLRASRPA; TQPLRASRPAA; QPLRASRPAAA; PLRASRPAAAA; LRASRPAAAAA; RASRPAAAAAS; ASRPAAAAASR; SRPAAAAASRS; RPAAAAASRSG; PAAAAASRSGA; AAAAASRSGAG; AAAASRSGAGG; AAASRSGAGGP; AASRSGAGGPL; ASRSGAGGPLA; SRSGAGGPLAV; RSGAGGPLAVS; SGAGGPLAVSW; GAGGPLAVSWS; AGGPLAVSWST; GGPLAVSWSTS; GPLAVSWSTSA; PLAVSWSTSAQ; LAVSWSTSAQG; AVSWSTSAQGM; VSWSTSAQGMP; SWSTSAQGMPP; WSTSAQGMPPG; STSAQGMPPGP; TSAQGMPPGPP; SAQGMPPGPPG; AQGMPPGPPGR; QGMPPGPPGRR; GMPPGPPGRRA; MPPGPPGRRAW; PPGPPGRRAWQ; PGPPGRRAWQA; GPPGRRAWQAD; PPGRRAWQADT; PGRRAWQADTE; GRRAWQADTES; RRAWQADTEST; RAWQADTESTA; AWQADTESTAP; WQADTESTAPS; QADTESTAPSA; ADTESTAPSAL | |
| 21) Rv1284 | 8 mers:<br>MTVTDDYL; TVTDDYLA; VTDDYLAN; TDDYLANN; DDYLANNV; DYLANNVD; YLANNVDY; LANNVDYA; ANNVDYAS; NNVDYASG; NVDYASGF; VDYASGFK; DYASGFKG; YASGFKGP; ASGFKGPL; SGFKGPLP; GFKGPLPM; FKGPLPMP; KGPLPMPP; GPLPMPPS; PLPMPPSK; LPMPPSKH; PMPPSKHI; MPPSKHIA; PPSKHIAI; PSKHIAIV; SKHIAIVA; KHIAIVAC; HIAIVACM; IAIVACMD; AIVACMDA; IVACMDAR; VACMDARL; ACMDARLD; CMDARLDV; MDARLDVY; DARLDVYR; ARLDVYRM; RLDVYRML; LDVYRMLG; DVYRMLGI; VYRMLGIK; YRMLGIKE; RMLGIKEG; MLGIKEGE; LGIKEGEA; GIKEGEAH; IKEGEAHV; KEGEAHVI; EGEAHVIR; GEAHVIRN; EAHVIRNA; AHVIRNAG; HVIRNAGC; VIRNAGCV; IRNAGCVV; RNAGCVVT; NAGCVVTD; AGCVVTDD; GCVVTDDV; CVVTDDVI; VVTDDVIR; VTDDVIRS; TDDVIRSL; DDVIRSLA; DVIRSLAI; VIRSLAIS; IRSLAISQ; RSLAISQR; SLAISQRL; LAISQRLL; AISQRLLG; ISQRLLGT; SQRLLGTR; QRLLGTRE; RLLGTREI; LLGTREII; LGTREIIL; GTREIILL; TREIILLH; REIILLHH; EIILLHHT; IILLHHTD; ILLHHTDC; LLHHTDCG; LHHTDCGM; HHTDCGML; HTDCGMLT; TDCGMLTF; DCGMLTFT; CGMLTFTD; GMLTFTDD; MLTFTDDD; LTFTDDDF; TFTDDDFK; FTDDDFKR; TDDDFKRA; DDDFKRAI; DDFKRAIQ; DFKRAIQD; FKRAIQDE; KRAIQDET; RAIQDETG; AIQDETGI; IQDETGIR; QDETGIRP; DETGIRPT; ETGIRPTW; TGIRPTWS; GIRPTWSP; IRPTWSPE; RPTWSPES; PTWSPESY; TWSPESYP; WSPESYPD; SPESYPDA; PESYPDAV; ESYPDAVE; SYPDAVED; YPDAVEDV; PDAVEDVR; DAVEDVRQ; AVEDVRQS; VEDVRQSL; EDVRQSLR; DVRQSLRR; VRQSLRRI; RQSLRRIE; QSLRRIEV; SLRRIEVN; LRRIEVNP; RRIEVNPF; RIEVNPFV; IEVNPFVT; EVNPFVTK; VNPFVTKH; NPFVTKHT; PFVTKHTS; FVTKHTSL; VTKHTSLR; TKHTSLRG; KHTSLRGF; HTSLRGFV; TSLRGFVF; SLRGFVFD; LRGFVFDV; RGFVFDVA; GFVFDVAT; FVFDVATG; VFDVATGK; FDVATGKL; DVATGKLN; VATGKLNE; ATGKLNEV; TGKLNEVT; GKLNEVTP<br><br>9 mers:<br>MTVTDDYLA; TVTDDYLAN; VTDDYLANN; TDDYLANNV; DDYLANNVD; DYLANNVDY; YLANNVDYA; LANNVDYAS; | 16630-17247 |

Fig. 28 continued

| | | | |
|---|---|---|---|
| | ANNVDYASG; NNVDYASGF; NVDYASGFK; VDYASGFKG; DYASGFKGP; YASGFKGPL; ASGFKGPLP; SGFKGPLPM; GFKGPLPMP; FKGPLPMPP; KGPLPMPPS; GPLPMPPSK; PLPMPPSKH; LPMPPSKHI; PMPPSKHIA; MPPSKHIAI; PPSKHIAIV; PSKHIAIVA; SKHIAIVAC; KHIAIVACM; HIAIVACMD; IAIVACMDA; AIVACMDAR; IVACMDARL; VACMDARLD; ACMDARLDV; CMDARLDVY; MDARLDVYR; DARLDVYRM; ARLDVYRML; RLDVYRMLG; LDVYRMLGI; DVYRMLGIK; VYRMLGIKE; YRMLGIKEG; RMLGIKEGE; MLGIKEGEA; LGIKEGEAH; GIKEGEAHV; IKEGEAHVI; KEGEAHVIR; EGEAHVIRN; GEAHVIRNA; EAHVIRNAG; AHVIRNAGC; HVIRNAGCV; VIRNAGCVV; IRNAGCVVT; RNAGCVVTD; NAGCVVTDD; AGCVVTDDV; GCVVTDDVI; CVVTDDVIR; VVTDDVIRS; VTDDVIRSL; TDDVIRSLA; DDVIRSLAI; DVIRSLAIS; VIRSLAISQ; IRSLAISQR; RSLAISQRL; SLAISQRLL; LAISQRLLG; AISQRLLGT; ISQRLLGTR; SQRLLGTRE; QRLLGTREI; RLLGTREII; LLGTREIIL; LGTREIILL; GTREIILLH; TREIILLHH; REIILLHHT; EIILLHHTD; IILLHHTDC; ILLHHTDCG; LLHHTDCGM; LHHTDCGML; HHTDCGMLT; HTDCGMLTF; TDCGMLTFT; DCGMLTFTD; CGMLTFTDD; GMLTFTDDD; MLTFTDDDF; LTFTDDDFK; TFTDDDFKR; FTDDDFKRA; TDDDFKRAI; DDDFKRAIQ; DDFKRAIQD; DFKRAIQDE; FKRAIQDET; KRAIQDETG; RAIQDETGI; AIQDETGIR; IQDETGIRP; QDETGIRPT; DETGIRPTW; ETGIRPTWS; TGIRPTWSP; GIRPTWSPE; IRPTWSPES; RPTWSPESY; PTWSPESYP; TWSPESYPD; WSPESYPDA; SPESYPDAV; PESYPDAVE; ESYPDAVED; SYPDAVEDV; YPDAVEDVR; PDAVEDVRQ; DAVEDVRQS; AVEDVRQSL; VEDVRQSLR; EDVRQSLRR; DVRQSLRRI; VRQSLRRIE; RQSLRRIEV; QSLRRIEVN; SLRRIEVNP; LRRIEVNPF; RRIEVNPFV; RIEVNPFVT; IEVNPFVTK; EVNPFVTKH; VNPFVTKHT; NPFVTKHTS; PFVTKHTSL; FVTKHTSLR; VTKHTSLRG; TKHTSLRGF; KHTSLRGFV; HTSLRGFVF; TSLRGFVFD; SLRGFVFDV; LRGFVFDVA; RGFVFDVAT; GFVFDVATG; FVFDVATGK; VFDVATGKL; FDVATGKLN; DVATGKLNE; VATGKLNEV; ATGKLNEVT; TGKLNEVTP<br><br>10 mers:<br>MTVTDDYLAN; TVTDDYLANN; VTDDYLANNV; TDDYLANNVD; DDYLANNVDY; DYLANNVDYA; YLANNVDYAS; LANNVDYASG; ANNVDYASGF; NNVDYASGFK; NVDYASGFKG; VDYASGFKGP; DYASGFKGPL; YASGFKGPLP; ASGFKGPLPM; SGFKGPLPMP; GFKGPLPMPP; FKGPLPMPPS; KGPLPMPPSK; GPLPMPPSKH; PLPMPPSKHI; LPMPPSKHIA; PMPPSKHIAI; MPPSKHIAIV; PPSKHIAIVA; PSKHIAIVAC; SKHIAIVACM; KHIAIVACMD; HIAIVACMDA; IAIVACMDAR; AIVACMDARL; IVACMDARLD; VACMDARLDV; ACMDARLDVY; CMDARLDVYR; MDARLDVYRM; DARLDVYRML; ARLDVYRMLG; RLDVYRMLGI; LDVYRMLGIK; DVYRMLGIKE; VYRMLGIKEG; YRMLGIKEGE; RMLGIKEGEA; MLGIKEGEAH; LGIKEGEAHV; GIKEGEAHVI; IKEGEAHVIR; KEGEAHVIRN; EGEAHVIRNA; GEAHVIRNAG; EAHVIRNAGC; AHVIRNAGCV; HVIRNAGCVV; VIRNAGCVVT; IRNAGCVVTD; RNAGCVVTDD; NAGCVVTDDV; AGCVVTDDVI; GCVVTDDVIR; CVVTDDVIRS; VVTDDVIRSL; VTDDVIRSLA; TDDVIRSLAI; DDVIRSLAIS; DVIRSLAISQ; VIRSLAISQR; IRSLAISQRL; RSLAISQRLL; SLAISQRLLG; LAISQRLLGT; AISQRLLGTR; | |

Fig. 28 continued

ISQRLLGTRE; SQRLLGTREI; QRLLGTREII; RLLGTREIIL; LLGTREIILL; LGTREIILLH; GTREIILLHH; TREIILLHHT; REIILLHHTD; EIILLHHTDC; IILLHHTDCG; ILLHHTDCGM; LLHHTDCGML; LHHTDCGMLT; HHTDCGMLTF; HTDCGMLTFT; TDCGMLTFTD; DCGMLTFTDD; CGMLTFTDDD; GMLTFTDDDF; MLTFTDDDFK; LTFTDDDFKR; TFTDDDFKRA; FTDDDFKRAI; TDDDFKRAIQ; DDDFKRAIQD; DDFKRAIQDE; DFKRAIQDET; FKRAIQDETG; KRAIQDETGI; RAIQDETGIR; AIQDETGIRP; IQDETGIRPT; QDETGIRPTW; DETGIRPTWS; ETGIRPTWSP; TGIRPTWSPE; GIRPTWSPES; IRPTWSPESY; RPTWSPESYP; PTWSPESYPD; TWSPESYPDA; WSPESYPDAV; SPESYPDAVE; PESYPDAVED; ESYPDAVEDV; SYPDAVEDVR; YPDAVEDVRQ; PDAVEDVRQS; DAVEDVRQSL; AVEDVRQSLR; VEDVRQSLRR; EDVRQSLRRI; DVRQSLRRIE; VRQSLRRIEV; RQSLRRIEVN; QSLRRIEVNP; SLRRIEVNPF; LRRIEVNPFV; RRIEVNPFVT; RIEVNPFVTK; IEVNPFVTKH; EVNPFVTKHT; VNPFVTKHTS; NPFVTKHTSL; PFVTKHTSLR; FVTKHTSLRG; VTKHTSLRGF; TKHTSLRGFV; KHTSLRGFVF; HTSLRGFVFD; TSLRGFVFDV; SLRGFVFDVA; LRGFVFDVAT; RGFVFDVATG; GFVFDVATGK; FVFDVATGKL; VFDVATGKLN; FDVATGKLNE; DVATGKLNEV; VATGKLNEVT; ATGKLNEVTP 11 mers:
MTVTDDYLANN; TVTDDYLANNV; VTDDYLANNVD; TDDYLANNVDY; DDYLANNVDYA; DYLANNVDYAS; YLANNVDYASG; LANNVDYASGF; ANNVDYASGFK; NNVDYASGFKG; NVDYASGFKGP; VDYASGFKGPL; DYASGFKGPLP; YASGFKGPLPM; ASGFKGPLPMP; SGFKGPLPMPP; GFKGPLPMPPS; FKGPLPMPPSK; KGPLPMPPSKH; GPLPMPPSKHI; PLPMPPSKHIA; LPMPPSKHIAI; PMPPSKHIAIV; MPPSKHIAIVA; PPSKHIAIVAC; PSKHIAIVACM; SKHIAIVACMD; KHIAIVACMDA; HIAIVACMDAR; IAIVACMDARL; AIVACMDARLD; IVACMDARLDV; VACMDARLDVY; ACMDARLDVYR; CMDARLDVYRM; MDARLDVYRML; DARLDVYRMLG; ARLDVYRMLGI; RLDVYRMLGIK; LDVYRMLGIKE; DVYRMLGIKEG; VYRMLGIKEGE; YRMLGIKEGEA; RMLGIKEGEAH; MLGIKEGEAHV; LGIKEGEAHVI; GIKEGEAHVIR; IKEGEAHVIRN; KEGEAHVIRNA; EGEAHVIRNAG; GEAHVIRNAGC; EAHVIRNAGCV; AHVIRNAGCVV; HVIRNAGCVVT; VIRNAGCVVTD; IRNAGCVVTDD; RNAGCVVTDDV; NAGCVVTDDVI; AGCVVTDDVIR; GCVVTDDVIRS; CVVTDDVIRSL; VVTDDVIRSLA; VTDDVIRSLAI; TDDVIRSLAIS; DDVIRSLAISQ; DVIRSLAISQR; VIRSLAISQRL; IRSLAISQRLL; RSLAISQRLLG; SLAISQRLLGT; LAISQRLLGTR; AISQRLLGTRE; ISQRLLGTREI; SQRLLGTREII; QRLLGTREIIL; RLLGTREIILL; LLGTREIILLH; LGTREIILLHH; GTREIILLHHT; TREIILLHHTD; REIILLHHTDC; EIILLHHTDCG; IILLHHTDCGM; ILLHHTDCGML; LLHHTDCGMLT; LHHTDCGMLTF; HHTDCGMLTFT; HTDCGMLTFTD; TDCGMLTFTDD; DCGMLTFTDDD; CGMLTFTDDDF; GMLTFTDDDFK; MLTFTDDDFKR; LTFTDDDFKRA; TFTDDDFKRAI; FTDDDFKRAIQ; TDDDFKRAIQD; DDDFKRAIQDE; DDFKRAIQDET; DFKRAIQDETG; FKRAIQDETGI; KRAIQDETGIR; RAIQDETGIRP; AIQDETGIRPT; IQDETGIRPTW; QDETGIRPTWS; DETGIRPTWSP; ETGIRPTWSPE; TGIRPTWSPES; GIRPTWSPESY; IRPTWSPESYP; RPTWSPESYPD; PTWSPESYPDA; TWSPESYPDAV; WSPESYPDAVE; SPESYPDAVED; PESYPDAVEDV;

Fig. 28 continued

| | | |
|---|---|---|
| | ESYPDAVEDVR; SYPDAVEDVRQ; YPDAVEDVRQS; PDAVEDVRQSL; DAVEDVRQSLR; AVEDVRQSLRR; VEDVRQSLRRI; EDVRQSLRRIE; DVRQSLRRIEV; VRQSLRRIEVN; RQSLRRIEVNP; QSLRRIEVNPF; SLRRIEVNPFV; LRRIEVNPFVT; RRIEVNPFVTK; RIEVNPFVTKH; IEVNPFVTKHT; EVNPFVTKHTS; VNPFVTKHTSL; NPFVTKHTSLR; PFVTKHTSLRG; FVTKHTSLRGF; VTKHTSLRGFV; TKHTSLRGFVF; KHTSLRGFVFD; HTSLRGFVFDV; TSLRGFVFDVA; SLRGFVFDVAT; LRGFVFDVATG; RGFVFDVATGK; GFVFDVATGKL; FVFDVATGKLN; VFDVATGKLNE; FDVATGKLNEV; DVATGKLNEVT; VATGKLNEVTP | |
| 22) Rv1386 | 8 mers:<br>MTLRVVPE; TLRVVPES; LRVVPESL; RVVPESLA; VVPESLAG; VPESLAGA; PESLAGAS; ESLAGASA; SLAGASAA; LAGASAAI; AGASAAIE; GASAAIEA; ASAAIEAV; SAAIEAVT; AAIEAVTA; AIEAVTAR; IEAVTARL; EAVTARLA; AVTARLAA; VTARLAAA; TARLAAAH; ARLAAAHA; RLAAAHAA; LAAAHAAA; AAAHAAAA; AAHAAAAP; AHAAAAPF; HAAAAPFI; AAAAPFIA; AAAPFIAA; AAPFIAAV; APFIAAVI; PFIAAVIP; FIAAVIPP; IAAVIPPG; AAVIPPGS; AVIPPGSD; VIPPGSDS; IPPGSDSV; PPGSDSVS; PGSDSVSV; GSDSVSVC; SDSVSVCN; DSVSVCNA; SVSVCNAV; VSVCNAVE; SVCNAVEF; VCNAVEFS; CNAVEFSV; NAVEFSVH; AVEFSVHG; VEFSVHGS; EFSVHGSQ; FSVHGSQH; SVHGSQHV; VHGSQHVA; HGSQHVAM; GSQHVAMA; SQHVAMAA; QHVAMAAQ; HVAMAAQG; VAMAAQGV; AMAAQGVE; MAAQGVEE; AAQGVEEL; AQGVEELG; QGVEELGR; GVEELGRS; VEELGRSG; EELGRSGV; ELGRSGVG; LGRSGVGV; GRSGVGVA; RSGVGVAE; SGVGVAES; GVGVAESG; VGVAESGA; GVAESGAS; VAESGASY; AESGASYA; ESGASYAA; SGASYAAR; GASYAARD; ASYAARDA; SYAARDAL; YAARDALA; AARDALAA; ARDALAAA; RDALAAAS; DALAAASY; ALAAASYL; LAAASYLS; AAASYLSG; AASYLSGG; ASYLSGGL;<br><br>9 mers:<br>MTLRVVPES; TLRVVPESL; LRVVPESLA; RVVPESLAG; VVPESLAGA; VPESLAGAS; PESLAGASA; ESLAGASAA; SLAGASAAI; LAGASAAIE; AGASAAIEA; GASAAIEAV; ASAAIEAVT; SAAIEAVTA; AAIEAVTAR; AIEAVTARL; IEAVTARLA; EAVTARLAA; AVTARLAAA; VTARLAAAH; TARLAAAHA; ARLAAAHAA; RLAAAHAAA; LAAAHAAAA; AAAHAAAAP; AAHAAAAPF; AHAAAAPFI; HAAAAPFIA; AAAAPFIAA; AAAPFIAAV; AAPFIAAVI; APFIAAVIP; PFIAAVIPP; FIAAVIPPG; IAAVIPPGS; AAVIPPGSD; AVIPPGSDS; VIPPGSDSV; IPPGSDSVS; PPGSDSVSV; PGSDSVSVC; GSDSVSVCN; SDSVSVCNA; DSVSVCNAV; SVSVCNAVE; VSVCNAVEF; SVCNAVEFS; VCNAVEFSV; CNAVEFSVH; NAVEFSVHG; AVEFSVHGS; VEFSVHGSQ; EFSVHGSQH; FSVHGSQHV; SVHGSQHVA; VHGSQHVAM; HGSQHVAMA; GSQHVAMAA; SQHVAMAAQ; QHVAMAAQG; HVAMAAQGV; VAMAAQGVE; AMAAQGVEE; MAAQGVEEL; AAQGVEELG; AQGVEELGR; QGVEELGRS; GVEELGRSG; VEELGRSGV; EELGRSGVG; ELGRSGVGV; LGRSGVGVA; GRSGVGVAE; RSGVGVAES; SGVGVAESG; GVGVAESGA; VGVAESGAS; GVAESGASY; VAESGASYA; AESGASYAA; ESGASYAAR; SGASYAARD; GASYAARDA; ASYAARDAL; SYAARDALA; YAARDALAA; AARDALAAA; ARDALAAAS; RDALAAASY; DALAAASYL; ALAAASYLS; LAAASYLSG; AAASYLSGG; AASYLSGGL; | 17248-17621 |

Fig. 28 continued

| | | |
|---|---|---|
| | 10 mers:<br>MTLRVVPESL; TLRVVPESLA; LRVVPESLAG; RVVPESLAGA; VVPESLAGAS; VPESLAGASA; PESLAGASAA; ESLAGASAAI; SLAGASAAIE; LAGASAAIEA; AGASAAIEAV; GASAAIEAVT; ASAAIEAVTA; SAAIEAVTAR; AAIEAVTARL; AIEAVTARLA; IEAVTARLAA; EAVTARLAAA; AVTARLAAAH; VTARLAAAHA; TARLAAAHAA; ARLAAAHAAA; RLAAAHAAAA; LAAAHAAAAP; AAAHAAAAPF; AAHAAAAPFI; AHAAAAPFIA; HAAAAPFIAA; AAAAPFIAAV; AAAPFIAAVI; AAPFIAAVIP; APFIAAVIPP; PFIAAVIPPG; FIAAVIPPGS; IAAVIPPGSD; AAVIPPGSDS; AVIPPGSDSV; VIPPGSDSVS; IPPGSDSVSV; PPGSDSVSVC; PGSDSVSVCN; GSDSVSVCNA; SDSVSVCNAV; DSVSVCNAVE; SVSVCNAVEF; VSVCNAVEFS; SVCNAVEFSV; VCNAVEFSVH; CNAVEFSVHG; NAVEFSVHGS; AVEFSVHGSQ; VEFSVHGSQH; EFSVHGSQHV; FSVHGSQHVA; SVHGSQHVAM; VHGSQHVAMA; HGSQHVAMAA; GSQHVAMAAQ; SQHVAMAAQG; QHVAMAAQGV; HVAMAAQGVE; VAMAAQGVEE; AMAAQGVEEL; MAAQGVEELG; AAQGVEELGR; AQGVEELGRS; QGVEELGRSG; GVEELGRSGV; VEELGRSGVG; EELGRSGVGV; ELGRSGVGVA; LGRSGVGVAE; GRSGVGVAES; RSGVGVAESG; SGVGVAESGA; GVGVAESGAS; VGVAESGASY; GVAESGASYA; VAESGASYAA; AESGASYAAR; ESGASYAARD; SGASYAARDA; GASYAARDAL; ASYAARDALA; SYAARDALAA; YAARDALAAA; AARDALAAAS; ARDALAAASY; RDALAAASYL; DALAAASYLS; ALAAASYLSG; LAAASYLSGG; AAASYLSGGL;<br><br>11 mers:<br>MTLRVVPESLA; TLRVVPESLAG; LRVVPESLAGA; RVVPESLAGAS; VVPESLAGASA; VPESLAGASAA; PESLAGASAAI; ESLAGASAAIE; SLAGASAAIEA; LAGASAAIEAV; AGASAAIEAVT; GASAAIEAVTA; ASAAIEAVTAR; SAAIEAVTARL; AAIEAVTARLA; AIEAVTARLAA; IEAVTARLAAA; EAVTARLAAAH; AVTARLAAAHA; VTARLAAAHAA; TARLAAAHAAA; ARLAAAHAAAA; RLAAAHAAAAP; LAAAHAAAAPF; AAAHAAAAPFI; AAHAAAAPFIA; AHAAAAPFIAA; HAAAAPFIAAV; AAAAPFIAAVI; AAAPFIAAVIP; AAPFIAAVIPP; APFIAAVIPPG; PFIAAVIPPGS; FIAAVIPPGSD; IAAVIPPGSDS; AAVIPPGSDSV; AVIPPGSDSVS; VIPPGSDSVSV; IPPGSDSVSVC; PPGSDSVSVCN; PGSDSVSVCNA; GSDSVSVCNAV; SDSVSVCNAVE; DSVSVCNAVEF; SVSVCNAVEFS; VSVCNAVEFSV; SVCNAVEFSVH; VCNAVEFSVHG; CNAVEFSVHGS; NAVEFSVHGSQ; AVEFSVHGSQH; VEFSVHGSQHV; EFSVHGSQHVA; FSVHGSQHVAM; SVHGSQHVAMA; VHGSQHVAMAA; HGSQHVAMAAQ; GSQHVAMAAQG; SQHVAMAAQGV; QHVAMAAQGVE; HVAMAAQGVEE; VAMAAQGVEEL; AMAAQGVEELG; MAAQGVEELGR; AAQGVEELGRS; AQGVEELGRSG; QGVEELGRSGV; GVEELGRSGVG; VEELGRSGVGV; EELGRSGVGVA; ELGRSGVGVAE; LGRSGVGVAES; GRSGVGVAESG; RSGVGVAESGA; SGVGVAESGAS; GVGVAESGASY; VGVAESGASYA; GVAESGASYAA; VAESGASYAAR; AESGASYAARD; ESGASYAARDA; SGASYAARDAL; GASYAARDALA; ASYAARDALAA; SYAARDALAAA; YAARDALAAAS; AARDALAAASY; ARDALAAASYL; RDALAAASYLS; DALAAASYLSG; ALAAASYLSGG; LAAASYLSGGL; | |

Fig. 28 continued

| | | |
|---|---|---|
| 23) Rv1472 | 8 mers:<br>MPHRCAAQ; PHRCAAQV; HRCAAQVV; RCAAQVVA; CAAQVVAG; AAQVVAGY; AQVVAGYR; QVVAGYRS; VVAGYRST; VAGYRSTV; AGYRSTVS; GYRSTVSL; YRSTVSLV; RSTVSLVL; STVSLVLV; TVSLVLVE; VSLVLVEH; SLVLVEHP; LVLVEHPR; VLVEHPRP; LVEHPRPE; VEHPRPEI; EHPRPEIA; HPRPEIAQ; PRPEIAQI; RPEIAQIT; PEIAQITL; EIAQITLN; IAQITLNR; AQITLNRP; QITLNRPE; ITLNRPER; TLNRPERM; LNRPERMN; NRPERMNS; RPERMNSM; PERMNSMA; ERMNSMAF; RMNSMAFD; MNSMAFDV; NSMAFDVM; SMAFDVMV; MAFDVMVP; AFDVMVPL; FDVMVPLK; DVMVPLKE; VMVPLKEA; MVPLKEAL; VPLKEALA; PLKEALAQ; LKEALAQV; KEALAQVS; EALAQVSY; ALAQVSYD; LAQVSYDN; AQVSYDNS; QVSYDNSV; VSYDNSVR; SYDNSVRV; YDNSVRVV; DNSVRVVV; NSVRVVVL; SVRVVVLT; VRVVVLTG; RVVVLTGA; VVVLTGAG; VVLTGAGR; VLTGAGRG; LTGAGRGF; TGAGRGFS; GAGRGFSP; AGRGFSPG; GRGFSPGA; RGFSPGAD; GFSPGADH; FSPGADHK; SPGADHKS; PGADHKSA; GADHKSAG; ADHKSAGV; DHKSAGVV; HKSAGVVP; KSAGVVPH; SAGVVPHV; AGVVPHVE; GVVPHVEN; VVPHVENL; VPHVENLT; PHVENLTR; HVENLTRP; VENLTRPT; ENLTRPTY; NLTRPTYA; LTRPTYAL; TRPTYALR; RPTYALRS; PTYALRSM; TYALRSME; YALRSMEL; ALRSMELL; LRSMELLD; RSMELLDD; SMELLDDV; MELLDDVI; ELLDDVIL; LLDDVILM; LDDVILML; DDVILMLR; DVILMLRR; VILMLRRL; ILMLRRLH; LMLRRLHQ; MLRRLHQP; LRRLHQPV; RRLHQPVI; RLHQPVIA; LHQPVIAA; HQPVIAAV; QPVIAAVN; PVIAAVNG; VIAAVNGP; IAAVNGPA; AAVNGPAI; AVNGPAIG; VNGPAIGG; NGPAIGGG; GPAIGGGL; PAIGGGLC; AIGGGLCL; IGGGLCLA; GGGLCLAL; GGLCLALA; GLCLALAA; LCLALAAD; CLALAADI; LALAADIR; ALAADIRV; LAADIRVA; AADIRVAS; ADIRVASS; DIRVASSS; IRVASSSA; RVASSSAY; VASSSAYF; ASSSAYFR; SSSAYFRA; SSAYFRAA; SAYFRAAG; AYFRAAGI; YFRAAGIN; FRAAGINN; RAAGINNG; AAGINNGL; AGINNGLT; GINNGLTA; INNGLTAS; NNGLTASE; NGLTASEL; GLTASELG; LTASELGL; TASELGLS; ASELGLSY; SELGLSYL; ELGLSYLL; LGLSYLLP; GLSYLLPR; LSYLLPRA; SYLLPRAI; YLLPRAIG; LLPRAIGS; LPRAIGSS; PRAIGSSR; RAIGSSRA; AIGSSRAF; IGSSRAFE; GSSRAFEI; SSRAFEIM; SRAFEIML; RAFEIMLT; AFEIMLTG; FEIMLTGR; EIMLTGRD; IMLTGRDV; MLTGRDVS; LTGRDVSA; TGRDVSAE; GRDVSAEE; RDVSAEEA; DVSAEEAE; VSAEEAER; SAEEAERI; AEEAERIG; EEAERIGL; EAERIGLV; AERIGLVS; ERIGLVSR; RIGLVSRQ; IGLVSRQV; GLVSRQVP; LVSRQVPD; VSRQVPDE; SRQVPDEQ; RQVPDEQL; QVPDEQLL; VPDEQLLD; PDEQLLDA; DEQLLDAC; EQLLDACY; QLLDACYA; LLDACYAI; LDACYAIA; DACYAIAA; ACYAIAAR; CYAIAARM; YAIAARMA; AIAARMAG; IAARMAGF; AARMAGFS; ARMAGFSR; RMAGFSRP; MAGFSRPG; AGFSRPGI; GFSRPGIE; FSRPGIEL; SRPGIELT; RPGIELTK; PGIELTKR; GIELTKRT; IELTKRTL; ELTKRTLW; LTKRTLWS; TKRTLWSG; KRTLWSGL; RTLWSGLD; TLWSGLDA; LWSGLDAA; WSGLDAAS; SGLDAASL; GLDAASLE; LDAASLEA; DAASLEAH; AASLEAHM; ASLEAHMQ; SLEAHMQA; LEAHMQAE; EAHMQAEG; AHMQAEGL; HMQAEGLG; MQAEGLGQ; QAEGLGQL; AEGLGQLF; EGLGQLFV; GLGQLFVR; LGQLFVRL; GQLFVRLL; QLFVRLLT; LFVRLLTA; FVRLLTAN; VRLLTANF; RLLTANFE; LLTANFEE; | 17622-18727 |

Fig. 28 continued

| | | | |
|---|---|---|---|
| | LTANFEEA; TANFEEAV; ANFEEAVA; NFEEAVAA; FEEAVAAR; EEAVAARA; EAVAARAE; AVAARAEQ; VAARAEQR; AARAEQRA; ARAEQRAP; RAEQRAPV; AEQRAPVF; EQRAPVFT; QRAPVFTD; RAPVFTDD; APVFTDDT<br><br>9 mers:<br>MPHRCAAQV; PHRCAAQVV; HRCAAQVVA; RCAAQVVAG; CAAQVVAGY; AAQVVAGYR; AQVVAGYRS; QVVAGYRST; VVAGYRSTV; VAGYRSTVS; AGYRSTVSL; GYRSTVSLV; YRSTVSLVL; RSTVSLVLV; STVSLVLVE; TVSLVLVEH; VSLVLVEHP; SLVLVEHPR; LVLVEHPRP; VLVEHPRPE; LVEHPRPEI; VEHPRPEIA; EHPRPEIAQ; HPRPEIAQI; PRPEIAQIT; RPEIAQITL; PEIAQITLN; EIAQITLNR; IAQITLNRP; AQITLNRPE; QITLNRPER; ITLNRPERM; TLNRPERMN; LNRPERMNS; NRPERMNSM; RPERMNSMA; PERMNSMAF; ERMNSMAFD; RMNSMAFDV; MNSMAFDVM; NSMAFDVMV; SMAFDVMVP; MAFDVMVPL; AFDVMVPLK; FDVMVPLKE; DVMVPLKEA; VMVPLKEAL; MVPLKEALA; VPLKEALAQ; PLKEALAQV; LKEALAQVS; KEALAQVSY; EALAQVSYD; ALAQVSYDN; LAQVSYDNS; AQVSYDNSV; QVSYDNSVR; VSYDNSVRV; SYDNSVRVV; YDNSVRVVV; DNSVRVVVL; NSVRVVVLT; SVRVVVLTG; VRVVVLTGA; RVVVLTGAG; VVVLTGAGR; VVLTGAGRG; VLTGAGRGF; LTGAGRGFS; TGAGRGFSP; GAGRGFSPG; AGRGFSPGA; GRGFSPGAD; RGFSPGADH; GFSPGADHK; FSPGADHKS; SPGADHKSA; PGADHKSAG; GADHKSAGV; ADHKSAGVV; DHKSAGVVP; HKSAGVVPH; KSAGVVPHV; SAGVVPHVE; AGVVPHVEN; GVVPHVENL; VVPHVENLT; VPHVENLTR; PHVENLTRP; HVENLTRPT; VENLTRPTY; ENLTRPTYA; NLTRPTYAL; LTRPTYALR; TRPTYALRS; RPTYALRSM; PTYALRSME; TYALRSMEL; YALRSMELL; ALRSMELLD; LRSMELLDD; RSMELLDDV; SMELLDDVI; MELLDDVIL; ELLDDVILM; LLDDVILML; LDDVILMLR; DDVILMLRR; DVILMLRRL; VILMLRRLH; ILMLRRLHQ; LMLRRLHQP; MLRRLHQPV; LRRLHQPVI; RRLHQPVIA; RLHQPVIAA; LHQPVIAAV; HQPVIAAVN; QPVIAAVNG; PVIAAVNGP; VIAAVNGPA; IAAVNGPAI; AAVNGPAIG; AVNGPAIGG; VNGPAIGGG; NGPAIGGGL; GPAIGGGLC; PAIGGGLCL; AIGGGLCLA; IGGGLCLAL; GGGLCLALA; GGLCLALAA; GLCLALAAD; LCLALAADI; CLALAADIR; LALAADIRV; ALAADIRVA; LAADIRVAS; AADIRVASS; ADIRVASSS; DIRVASSSA; IRVASSSAY; RVASSSAYF; VASSSAYFR; ASSSAYFRA; SSSAYFRAA; SSAYFRAAG; SAYFRAAGI; AYFRAAGIN; YFRAAGINN; FRAAGINNG; RAAGINNGL; AAGINNGLT; AGINNGLTA; GINNGLTAS; INNGLTASE; NNGLTASEL; NGLTASELG; GLTASELGL; LTASELGLS; TASELGLSY; ASELGLSYL; SELGLSYLL; ELGLSYLLP; LGLSYLLPR; GLSYLLPRA; LSYLLPRAI; SYLLPRAIG; YLLPRAIGS; LLPRAIGSS; LPRAIGSSR; PRAIGSSRA; RAIGSSRAF; AIGSSRAFE; IGSSRAFEI; GSSRAFEIM; SSRAFEIML; SRAFEIMLT; RAFEIMLTG; AFEIMLTGR; FEIMLTGRD; EIMLTGRDV; IMLTGRDVS; MLTGRDVSA; LTGRDVSAE; TGRDVSAEE; GRDVSAEEA; RDVSAEEAE; DVSAEEAER; VSAEEAERI; SAEEAERIG; AEEAERIGL; EEAERIGLV; EAERIGLVS; AERIGLVSR; ERIGLVSRQ; RIGLVSRQV; IGLVSRQVP; GLVSRQVPD; LVSRQVPDE; VSRQVPDEQ; SRQVPDEQL; RQVPDEQLL; QVPDEQLLD; VPDEQLLDA; PDEQLLDAC; DEQLLDACY; EQLLDACYA; QLLDACYAI; LLDACYAIA; LDACYAIAA; DACYAIAAR; | |

Fig. 28 continued

| | | |
|---|---|---|
| | ACYAIAARM; CYAIAARMA; YAIAARMAG; AIAARMAGF; IAARMAGFS; AARMAGFSR; ARMAGFSRP; RMAGFSRPG; MAGFSRPGI; AGFSRPGIE; GFSRPGIEL; FSRPGIELT; SRPGIELTK; RPGIELTKR; PGIELTKRT; GIELTKRTL; IELTKRTLW; ELTKRTLWS; LTKRTLWSG; TKRTLWSGL; KRTLWSGLD; RTLWSGLDA; TLWSGLDAA; LWSGLDAAS; WSGLDAASL; SGLDAASLE; GLDAASLEA; LDAASLEAH; DAASLEAHM; AASLEAHMQ; ASLEAHMQA; SLEAHMQAE; LEAHMQAEG; EAHMQAEGL; AHMQAEGLG; HMQAEGLGQ; MQAEGLGQL; QAEGLGQLF; AEGLGQLFV; EGLGQLFVR; GLGQLFVRL; LGQLFVRLL; GQLFVRLLT; QLFVRLLTA; LFVRLLTAN; FVRLLTANF; VRLLTANFE; RLLTANFEE; LLTANFEEA; LTANFEEAV; TANFEEAVA; ANFEEAVAA; NFEEAVAAR; FEEAVAARA; EEAVAARAE; EAVAARAEQ; AVAARAEQR; VAARAEQRA; AARAEQRAP; ARAEQRAPV; RAEQRAPVF; AEQRAPVFT; EQRAPVFTD; QRAPVFTDD; RAPVFTDDT<br><br>10 mers:<br>MPHRCAAQVV; PHRCAAQVVA; HRCAAQVVAG; RCAAQVVAGY; CAAQVVAGYR; AAQVVAGYRS; AQVVAGYRST; QVVAGYRSTV; VVAGYRSTVS; VAGYRSTVSL; AGYRSTVSLV; GYRSTVSLVL; YRSTVSLVLV; RSTVSLVLVE; STVSLVLVEH; TVSLVLVEHP; VSLVLVEHPR; SLVLVEHPRP; LVLVEHPRPE; VLVEHPRPEI; LVEHPRPEIA; VEHPRPEIAQ; EHPRPEIAQI; HPRPEIAQIT; PRPEIAQITL; RPEIAQITLN; PEIAQITLNR; EIAQITLNRP; IAQITLNRPE; AQITLNRPER; QITLNRPERM; ITLNRPERMN; TLNRPERMNS; LNRPERMNSM; NRPERMNSMA; RPERMNSMAF; PERMNSMAFD; ERMNSMAFDV; RMNSMAFDVM; MNSMAFDVMV; NSMAFDVMVP; SMAFDVMVPL; MAFDVMVPLK; AFDVMVPLKE; FDVMVPLKEA; DVMVPLKEAL; VMVPLKEALA; MVPLKEALAQ; VPLKEALAQV; PLKEALAQVS; LKEALAQVSY; KEALAQVSYD; EALAQVSYDN; ALAQVSYDNS; LAQVSYDNSV; AQVSYDNSVR; QVSYDNSVRV; VSYDNSVRVV; SYDNSVRVVV; YDNSVRVVVL; DNSVRVVVLT; NSVRVVVLTG; SVRVVVLTGA; VRVVVLTGAG; RVVVLTGAGR; VVVLTGAGRG; VVLTGAGRGF; VLTGAGRGFS; LTGAGRGFSP; TGAGRGFSPG; GAGRGFSPGA; AGRGFSPGAD; GRGFSPGADH; RGFSPGADHK; GFSPGADHKS; FSPGADHKSA; SPGADHKSAG; PGADHKSAGV; GADHKSAGVV; ADHKSAGVVP; DHKSAGVVPH; HKSAGVVPHV; KSAGVVPHVE; SAGVVPHVEN; AGVVPHVENL; GVVPHVENLT; VVPHVENLTR; VPHVENLTRP; PHVENLTRPT; HVENLTRPTY; VENLTRPTYA; ENLTRPTYAL; NLTRPTYALR; LTRPTYALRS; TRPTYALRSM; RPTYALRSME; PTYALRSMEL; TYALRSMELL; YALRSMELLD; ALRSMELLDD; LRSMELLDDV; RSMELLDDVI; SMELLDDVIL; MELLDDVILM; ELLDDVILML; LLDDVILMLR; LDDVILMLRR; DDVILMLRRL; DVILMLRRLH; VILMLRRLHQ; ILMLRRLHQP; LMLRRLHQPV; MLRRLHQPVI; LRRLHQPVIA; RRLHQPVIAA; RLHQPVIAAV; LHQPVIAAVN; HQPVIAAVNG; QPVIAAVNGP; PVIAAVNGPA; VIAAVNGPAI; IAAVNGPAIG; AAVNGPAIGG; AVNGPAIGGG; VNGPAIGGGL; NGPAIGGGLC; GPAIGGGLCL; PAIGGGLCLA; AIGGGLCLAL; IGGGLCLALA; GGGLCLALAA; GGLCLALAAD; GLCLALAADI; LCLALAADIR; CLALAADIRV; LALAADIRVA; ALAADIRVAS; LAADIRVASS; AADIRVASSS; ADIRVASSSA; DIRVASSSAY; IRVASSSAYF; RVASSSAYFR; VASSSAYFRA; ASSSAYFRAA; | |

Fig. 28 continued

| | | | |
|---|---|---|---|
| | SSSAYFRAAG; SSAYFRAAGI; SAYFRAAGIN; AYFRAAGINN; YFRAAGINNG; FRAAGINNGL; RAAGINNGLT; AAGINNGLTA; AGINNGLTAS; GINNGLTASE; INNGLTASEL; NNGLTASELG; NGLTASELGL; GLTASELGLS; LTASELGLSY; TASELGLSYL; ASELGLSYLL; SELGLSYLLP; ELGLSYLLPR; LGLSYLLPRA; GLSYLLPRAI; LSYLLPRAIG; SYLLPRAIGS; YLLPRAIGSS; LLPRAIGSSR; LPRAIGSSRA; PRAIGSSRAF; RAIGSSRAFE; AIGSSRAFEI; IGSSRAFEIM; GSSRAFEIML; SSRAFEIMLT; SRAFEIMLTG; RAFEIMLTGR; AFEIMLTGRD; FEIMLTGRDV; EIMLTGRDVS; IMLTGRDVSA; MLTGRDVSAE; LTGRDVSAEE; TGRDVSAEEA; GRDVSAEEAE; RDVSAEEAER; DVSAEEAERI; VSAEEAERIG; SAEEAERIGL; AEEAERIGLV; EEAERIGLVS; EAERIGLVSR; AERIGLVSRQ; ERIGLVSRQV; RIGLVSRQVP; IGLVSRQVPD; GLVSRQVPDE; LVSRQVPDEQ; VSRQVPDEQL; SRQVPDEQLL; RQVPDEQLLD; QVPDEQLLDA; VPDEQLLDAC; PDEQLLDACY; DEQLLDACYA; EQLLDACYAI; QLLDACYAIA; LLDACYAIAA; LDACYAIAAR; DACYAIAARM; ACYAIAARMA; CYAIAARMAG; YAIAARMAGF; AIAARMAGFS; IAARMAGFSR; AARMAGFSRP; ARMAGFSRPG; RMAGFSRPGI; MAGFSRPGIE; AGFSRPGIEL; GFSRPGIELT; FSRPGIELTK; SRPGIELTKR; RPGIELTKRT; PGIELTKRTL; GIELTKRTLW; IELTKRTLWS; ELTKRTLWSG; LTKRTLWSGL; TKRTLWSGLD; KRTLWSGLDA; RTLWSGLDAA; TLWSGLDAAS; LWSGLDAASL; WSGLDAASLE; SGLDAASLEA; GLDAASLEAH; LDAASLEAHM; DAASLEAHMQ; AASLEAHMQA; ASLEAHMQAE; SLEAHMQAEG; LEAHMQAEGL; EAHMQAEGLG; AHMQAEGLGQ; HMQAEGLGQL; MQAEGLGQLF; QAEGLGQLFV; AEGLGQLFVR; EGLGQLFVRL; GLGQLFVRLL; LGQLFVRLLT; GQLFVRLLTA; QLFVRLLTAN; LFVRLLTANF; FVRLLTANFE; VRLLTANFEE; RLLTANFEEA; LLTANFEEAV; LTANFEEAVA; TANFEEAVAA; ANFEEAVAAR; NFEEAVAARA; FEEAVAARAE; EEAVAARAEQ; EAVAARAEQR; AVAARAEQRA; VAARAEQRAP; AARAEQRAPV; ARAEQRAPVF; RAEQRAPVFT; AEQRAPVFTD; EQRAPVFTDD; QRAPVFTDDT<br><br>11 mers:<br>MPHRCAAQVVA; PHRCAAQVVAG; HRCAAQVVAGY; RCAAQVVAGYR; CAAQVVAGYRS; AAQVVAGYRST; AQVVAGYRSTV; QVVAGYRSTVS; VVAGYRSTVSL; VAGYRSTVSLV; AGYRSTVSLVL; GYRSTVSLVLV; YRSTVSLVLVE; RSTVSLVLVEH; STVSLVLVEHP; TVSLVLVEHPR; VSLVLVEHPRP; SLVLVEHPRPE; LVLVEHPRPEI; VLVEHPRPEIA; LVEHPRPEIAQ; VEHPRPEIAQI; EHPRPEIAQIT; HPRPEIAQITL; PRPEIAQITLN; RPEIAQITLNR; PEIAQITLNRP; EIAQITLNRPE; IAQITLNRPER; AQITLNRPERM; QITLNRPERMN; ITLNRPERMNS; TLNRPERMNSM; LNRPERMNSMA; NRPERMNSMAF; RPERMNSMAFD; PERMNSMAFDV; ERMNSMAFDVM; RMNSMAFDVMV; MNSMAFDVMVP; NSMAFDVMVPL; SMAFDVMVPLK; MAFDVMVPLKE; AFDVMVPLKEA; FDVMVPLKEAL; DVMVPLKEALA; VMVPLKEALAQ; MVPLKEALAQV; VPLKEALAQVS; PLKEALAQVSY; LKEALAQVSYD; KEALAQVSYDN; EALAQVSYDNS; ALAQVSYDNSV; LAQVSYDNSVR; AQVSYDNSVRV; QVSYDNSVRVV; VSYDNSVRVVV; SYDNSVRVVVL; YDNSVRVVVLT; DNSVRVVVLTG; NSVRVVVLTGA; SVRVVVLTGAG; VRVVVLTGAGR; RVVVLTGAGRG; VVVLTGAGRGF; VVLTGAGRGFS; VLTGAGRGFSP; | |

Fig. 28 continued

| | | | |
|---|---|---|---|
| | LTGAGRGFSPG; TGAGRGFSPGA; GAGRGFSPGAD; AGRGFSPGADH; GRGFSPGADHK; RGFSPGADHKS; GFSPGADHKSA; FSPGADHKSAG; SPGADHKSAGV; PGADHKSAGVV; GADHKSAGVVP; ADHKSAGVVPH; DHKSAGVVPHV; HKSAGVVPHVE; KSAGVVPHVEN; SAGVVPHVENL; AGVVPHVENLT; GVVPHVENLTR; VVPHVENLTRP; VPHVENLTRPT; PHVENLTRPTY; HVENLTRPTYA; VENLTRPTYAL; ENLTRPTYALR; NLTRPTYALRS; LTRPTYALRSM; TRPTYALRSME; RPTYALRSMEL; PTYALRSMELL; TYALRSMELLD; YALRSMELLDD; ALRSMELLDDV; LRSMELLDDVI; RSMELLDDVIL; SMELLDDVILM; MELLDDVILML; ELLDDVILMLR; LLDDVILMLRR; LDDVILMLRRL; DDVILMLRRLH; DVILMLRRLHQ; VILMLRRLHQP; ILMLRRLHQPV; LMLRRLHQPVI; MLRRLHQPVIA; LRRLHQPVIAA; RRLHQPVIAAV; RLHQPVIAAVN; LHQPVIAAVNG; HQPVIAAVNGP; QPVIAAVNGPA; PVIAAVNGPAI; VIAAVNGPAIG; IAAVNGPAIGG; AAVNGPAIGGG; AVNGPAIGGGL; VNGPAIGGGLC; NGPAIGGGLCL; GPAIGGGLCLA; PAIGGGLCLAL; AIGGGLCLALA; IGGGLCLALAA; GGGLCLALAAD; GGLCLALAADI; GLCLALAADIR; LCLALAADIRV; CLALAADIRVA; LALAADIRVAS; ALAADIRVASS; LAADIRVASSS; AADIRVASSSA; ADIRVASSSAY; DIRVASSSAYF; IRVASSSAYFR; RVASSSAYFRA; VASSSAYFRAA; ASSSAYFRAAG; SSSAYFRAAGI; SSAYFRAAGIN; SAYFRAAGINN; AYFRAAGINNG; YFRAAGINNGL; FRAAGINNGLT; RAAGINNGLTA; AAGINNGLTAS; AGINNGLTASE; GINNGLTASEL; INNGLTASELG; NNGLTASELGL; NGLTASELGLS; GLTASELGLSY; LTASELGLSYL; TASELGLSYLL; ASELGLSYLLP; SELGLSYLLPR; ELGLSYLLPRA; LGLSYLLPRAI; GLSYLLPRAIG; LSYLLPRAIGS; SYLLPRAIGSS; YLLPRAIGSSR; LLPRAIGSSRA; LPRAIGSSRAF; PRAIGSSRAFE; RAIGSSRAFEI; AIGSSRAFEIM; IGSSRAFEIML; GSSRAFEIMLT; SSRAFEIMLTG; SRAFEIMLTGR; RAFEIMLTGRD; AFEIMLTGRDV; FEIMLTGRDVS; EIMLTGRDVSA; IMLTGRDVSAE; MLTGRDVSAEE; LTGRDVSAEEA; TGRDVSAEEAE; GRDVSAEEAER; RDVSAEEAERI; DVSAEEAERIG; VSAEEAERIGL; SAEEAERIGLV; AEEAERIGLVS; EEAERIGLVSR; EAERIGLVSRQ; AERIGLVSRQV; ERIGLVSRQVP; RIGLVSRQVPD; IGLVSRQVPDE; GLVSRQVPDEQ; LVSRQVPDEQL; VSRQVPDEQLL; SRQVPDEQLLD; RQVPDEQLLDA; QVPDEQLLDAC; VPDEQLLDACY; PDEQLLDACYA; DEQLLDACYAI; EQLLDACYAIA; QLLDACYAIAA; LLDACYAIAAR; LDACYAIAARM; DACYAIAARMA; ACYAIAARMAG; CYAIAARMAGF; YAIAARMAGFS; AIAARMAGFSR; IAARMAGFSRP; AARMAGFSRPG; ARMAGFSRPGI; RMAGFSRPGIE; MAGFSRPGIEL; AGFSRPGIELT; GFSRPGIELTK; FSRPGIELTKR; SRPGIELTKRT; RPGIELTKRTL; PGIELTKRTLW; GIELTKRTLWS; IELTKRTLWSG; ELTKRTLWSGL; LTKRTLWSGLD; TKRTLWSGLDA; KRTLWSGLDAA; RTLWSGLDAAS; TLWSGLDAASL; LWSGLDAASLE; WSGLDAASLEA; SGLDAASLEAH; GLDAASLEAHM; LDAASLEAHMQ; DAASLEAHMQA; AASLEAHMQAE; ASLEAHMQAEG; SLEAHMQAEGL; LEAHMQAEGLG; EAHMQAEGLGQ; AHMQAEGLGQL; HMQAEGLGQLF; MQAEGLGQLFV; QAEGLGQLFVR; AEGLGQLFVRL; EGLGQLFVRLL; GLGQLFVRLLT; LGQLFVRLLTA; GQLFVRLLTAN; QLFVRLLTANF; LFVRLLTANFE; FVRLLTANFEE; VRLLTANFEEA; RLLTANFEEAV; LLTANFEEAVA; LTANFEEAVAA; TANFEEAVAAR; ANFEEAVAARA; NFEEAVAARAE; FEEAVAARAEQ; EEAVAARAEQR; EAVAARAEQRA; AVAARAEQRAP; VAARAEQRAPV; AARAEQRAPVF; ARAEQRAPVFT; RAEQRAPVFTD; | |

Fig. 28 continued

| | | |
|---|---|---|
| | AEQRAPVFTDD; EQRAPVFTDDT | |
| 24) Rv1552 | 8 mers:<br>MTAQHNIV; TAQHNIVV; AQHNIVVI; QHNIVVIG; HNIVVIGG; NIVVIGGG; IVVIGGGG; VVIGGGGA; VIGGGGAG; IGGGGAGL; GGGGAGLR; GGGAGLRA; GGAGLRAA; GAGLRAAI; AGLRAAIA; GLRAAIAI; LRAAIAIA; RAAIAIAE; AAIAIAET; AIAIAETN; IAIAETNP; AIAETNPH; IAETNPHL; AETNPHLD; ETNPHLDV; TNPHLDVA; NPHLDVAI; PHLDVAIV; HLDVAIVS; LDVAIVSK; DVAIVSKV; VAIVSKVY; AIVSKVYP; IVSKVYPM; VSKVYPMR; SKVYPMRS; KVYPMRSH; VYPMRSHT; YPMRSHTV; PMRSHTVS; MRSHTVSA; RSHTVSAE; SHTVSAEG; HTVSAEGG; TVSAEGGA; VSAEGGAA; SAEGGAAA; AEGGAAAV; EGGAAAVT; GGAAAVTG; GAAAVTGD; AAAVTGDD; AAVTGDDD; AVTGDDDS; VTGDDDSL; TGDDDSLD; GDDDSLDE; DDDSLDEH; DDSLDEHA; DSLDEHAH; SLDEHAHD; LDEHAHDT; DEHAHDTV; EHAHDTVS; HAHDTVSG; AHDTVSGG; HDTVSGGD; DTVSGGDW; TVSGGDWL; VSGGDWLC; SGGDWLCD; GGDWLCDQ; GDWLCDQD; DWLCDQDA; WLCDQDAV; LCDQDAVE; CDQDAVEA; DQDAVEAF; QDAVEAFV; DAVEAFVA; AVEAFVAE; VEAFVAEA; EAFVAEAP; AFVAEAPK; FVAEAPKE; VAEAPKEL; AEAPKELV; EAPKELVQ; APKELVQL; PKELVQLE; KELVQLEH; ELVQLEHW; LVQLEHWG; VQLEHWGC; QLEHWGCP; LEHWGCPW; EHWGCPWS; HWGCPWSR; WGCPWSRK; GCPWSRKP; CPWSRKPD; PWSRKPDG; WSRKPDGR; SRKPDGRV; RKPDGRVA; KPDGRVAV; PDGRVAVR; DGRVAVRP; GRVAVRPF; RVAVRPFG; VAVRPFGG; AVRPFGGM; VRPFGGMK; RPFGGMKK; PFGGMKKL; FGGMKKLR; GGMKKLRT; GMKKLRTW; MKKLRTWF; KKLRTWFA; KLRTWFAA; LRTWFAAD; RTWFAADK; TWFAADKT; WFAADKTG; FAADKTGF; AADKTGFH; ADKTGFHL; DKTGFHLL; KTGFHLLH; TGFHLLHT; GFHLLHTL; FHLLHTLF; HLLHTLFQ; LLHTLFQR; LHTLFQRL; HTLFQRLL; TLFQRLLT; LFQRLLTY; FQRLLTYS; QRLLTYSD; RLLTYSDV; LLTYSDVM; LTYSDVMR; TYSDVMRY; YSDVMRYD; SDVMRYDE; DVMRYDEW; VMRYDEWF; MRYDEWFA; RYDEWFAT; YDEWFATT; DEWFATTL; EWFATTLL; WFATTLLV; FATTLLVD; ATTLLVDD; TTLLVDDG; TLLVDDGR; LLVDDGRV; LVDDGRVC; VDDGRVCG; DDGRVCGL; DGRVCGLV; GRVCGLVA; RVCGLVAI; VCGLVAIE; CGLVAIEL; GLVAIELA; LVAIELAT; VAIELATG; AIELATGR; IELATGRI; ELATGRIE; LATGRIET; ATGRIETI; TGRIETIL; GRIETILA; RIETILAD; IETILADA; ETILADAV; TILADAVI; ILADAVIL; LADAVILC; ADAVILCT; DAVILCTG; AVILCTGG; VILCTGGC; ILCTGGCG; LCTGGCGR; CTGGCGRV; TGGCGRVF; GGCGRVFP; GCGRVFPF; CGRVFPFT; GRVFPFTT; RVFPFTTN; VFPFTTNA; FPFTTNAN; PFTTNANI; FTTNANIK; TTNANIKT; TNANIKTG; NANIKTGD; ANIKTGDG; NIKTGDGM; IKTGDGMA; KTGDGMAL; TGDGMALA; GDGMALAF; DGMALAFR; GMALAFRA; MALAFRAG; ALAFRAGA; LAFRAGAP; AFRAGAPL; FRAGAPLK; RAGAPLKD; AGAPLKDM; GAPLKDME; APLKDMEF; PLKDMEFV; LKDMEFVQ; KDMEFVQY; DMEFVQYH; MEFVQYHP; EFVQYHPT; FVQYHPTG; VQYHPTGL; QYHPTGLP; YHPTGLPF; HPTGLPFT; PTGLPFTG; TGLPFTGI; GLPFTGIL; LPFTGILI; PFTGILIT; FTGILITE; TGILITEA; GILITEAA; ILITEAAR; LITEAARA; ITEAARAE; TEAARAEG; EAARAEGG; AARAEGGW; ARAEGGWL; RAEGGWLL; AEGGWLLN; EGGWLLNK; GGWLLNKD; GWLLNKDG; WLLNKDGY; LLNKDGYR; LNKDGYRY; NKDGYRYL; KDGYRYLQ; DGYRYLQD; GYRYLQDY; | 18728-21025 |

Fig. 28 continued

| | | | |
|---|---|---|---|
| | YRYLQDYD; RYLQDYDL; YLQDYDLG; LQDYDLGK; QDYDLGKP;<br>DYDLGKPT; YDLGKPTP; DLGKPTPE; LGKPTPEP; GKPTPEPR;<br>KPTPEPRL; PTPEPRLR; TPEPRLRS; PEPRLRSM; EPRLRSME;<br>PRLRSMEL; RLRSMELG; LRSMELGP; RSMELGPR; SMELGPRD;<br>MELGPRDR; ELGPRDRL; LGPRDRLS; GPRDRLSQ; PRDRLSQA;<br>RDRLSQAF; DRLSQAFV; RLSQAFVH; LSQAFVHE; SQAFVHEH;<br>QAFVHEHN; AFVHEHNK; FVHEHNKG; VHEHNKGR; HEHNKGRT;<br>EHNKGRTV; HNKGRTVD; NKGRTVDT; KGRTVDTP; GRTVDTPY;<br>RTVDTPYG; TVDTPYGP; VDTPYGPV; DTPYGPVV; TPYGPVVY;<br>PYGPVVYL; YGPVVYLD; GPVVYLDL; PVVYLDLR; VVYLDLRH;<br>VYLDLRHL; YLDLRHLG; LDLRHLGA; DLRHLGAD; LRHLGADL;<br>RHLGADLI; HLGADLID; LGADLIDA; GADLIDAK; ADLIDAKL;<br>DLIDAKLP; LIDAKLPF; IDAKLPFV; DAKLPFVR; AKLPFVRE;<br>KLPFVREL; LPFVRELC; PFVRELCR; FVRELCRD; VRELCRDY;<br>RELCRDYQ; ELCRDYQH; LCRDYQHI; CRDYQHID; RDYQHIDP;<br>DYQHIDPV; YQHIDPVV; QHIDPVVE; HIDPVVEL; IDPVVELV;<br>DPVVELVP; PVVELVPV; VVELVPVR; VELVPVRP; ELVPVRPV;<br>LVPVRPVV; VPVRPVVH; PVRPVVHY; VRPVVHYM; RPVVHYMM;<br>PVVHYMMG; VVHYMMGG; VHYMMGGV; HYMMGGVH; YMMGGVHT;<br>MMGGVHTD; MGGVHTDI; GGVHTDIN; GVHTDING; VHTDINGA;<br>HTDINGAT; TDINGATT; DINGATTL; INGATTLP; NGATTLPG;<br>GATTLPGL; ATTLPGLY; TTLPGLYA; TLPGLYAA; LPGLYAAG;<br>PGLYAAGE; GLYAAGET; LYAAGETA; YAAGETAC; AAGETACV;<br>AGETACVS; GETACVSI; ETACVSIN; TACVSING; ACVSINGA;<br>CVSINGAN; VSINGANR; SINGANRL; INGANRLG; NGANRLGS;<br>GANRLGSN; ANRLGSNS; NRLGSNSL; RLGSNSLP; LGSNSLPE;<br>GSNSLPEL; SNSLPELL; NSLPELLV; SLPELLVF; LPELLVFG;<br>PELLVFGA; ELLVFGAR; LLVFGARA; LVFGARAG; VFGARAGR;<br>FGARAGRA; GARAGRAA; ARAGRAAA; RAGRAAAD; AGRAAADY;<br>GRAAADYA; RAAADYAA; AAADYAAR; AADYAARH; ADYAARHQ;<br>DYAARHQK; YAARHQKS; AARHQKSD; ARHQKSDR; RHQKSDRG;<br>HQKSDRGP; QKSDRGPS; KSDRGPSS; SDRGPSSA; DRGPSSAV;<br>RGPSSAVR; GPSSAVRA; PSSAVRAQ; SSAVRAQA; SAVRAQAR;<br>AVRAQART; VRAQARTE; RAQARTEA; AQARTEAL; QARTEALR;<br>ARTEALRL; RTEALRLE; TEALRLER; EALRLERE; ALRLEREL;<br>LRLERELS; RLERELSR; LERELSRH; ERELSRHG; RELSRHGQ;<br>ELSRHGQG; LSRHGQGG; SRHGQGGE; RHGQGGER; HGQGGERI;<br>GQGGERIA; QGGERIAD; GGERIADI; GERIADIR; ERIADIRA;<br>RIADIRAD; IADIRADM; ADIRADMQ; DIRADMQA; IRADMQAT;<br>RADMQATL; ADMQATLE; DMQATLES; MQATLESA; QATLESAA;<br>ATLESAAG; TLESAAGI; LESAAGIY; ESAAGIYR; SAAGIYRD;<br>AAGIYRDG; AGIYRDGP; GIYRDGPT; IYRDGPTL; YRDGPTLT;<br>RDGPTLTK; DGPTLTKA; GPTLTKAV; PTLTKAVE; TLTKAVEE;<br>LTKAVEEI; TKAVEEIR; KAVEEIRV; AVEEIRVL; VEEIRVLQ;<br>EEIRVLQE; EIRVLQER; IRVLQERF; RVLQERFA; VLQERFAT;<br>LQERFATA; QERFATAG; ERFATAGI; RFATAGID; FATAGIDD;<br>ATAGIDDH; TAGIDDHS; AGIDDHSR; GIDDHSRT; IDDHSRTF;<br>DDHSRTFN; DHSRTFNT; HSRTFNTE; SRTFNTEL; RTFNTELT;<br>TFNTELTA; FNTELTAL; NTELTALL; TELTALLE; ELTALLEL;<br>LTALLELS; TALLELSG; ALLELSGM; LLELSGML; LELSGMLD;<br>ELSGMLDV; LSGMLDVA; SGMLDVAL; GMLDVALA; MLDVALAI;<br>LDVALAIV; DVALAIVE; VALAIVES; ALAIVESG; LAIVESGL;<br>AIVESGLR; IVESGLRR; VESGLRRE; ESGLRREE; SGLRREES; | |

Fig. 28 continued

| | | | |
|---|---|---|---|
| | GLRREESR; LRREESRG; RREESRGA; REESRGAH; EESRGAHQ; ESRGAHQR; SRGAHQRT; RGAHQRTD; GAHQRTDF; AHQRTDFP; HQRTDFPN; QRTDFPNR; RTDFPNRD; TDFPNRDD; DFPNRDDE; FPNRDDEH; PNRDDEHF; NRDDEHFL; RDDEHFLA; DDEHFLAH; DEHFLAHT; EHFLAHTL; HFLAHTLV; FLAHTLVH; LAHTLVHR; AHTLVHRE; HTLVHRES; TLVHRESD; LVHRESDG; VHRESDGT; HRESDGTL; RESDGTLR; ESDGTLRV; SDGTLRVG; DGTLRVGY; GTLRVGYL; TLRVGYLP; LRVGYLPV; RVGYLPVT; VGYLPVTI; GYLPVTIT; YLPVTITR; LPVTITRW; PVTITRWP; VTITRWPP; TITRWPPG; ITRWPPGE; TRWPPGER; RWPPGERV; WPPGERVY; PPGERVYG; PGERVYGR<br><br>9 mers:<br>MTAQHNIVV; TAQHNIVVI; AQHNIVVIG; QHNIVVIGG; HNIVVIGGG; NIVVIGGGG; IVVIGGGGA; VVIGGGGAG; VIGGGGAGL; IGGGGAGLR; GGGGAGLRA; GGGAGLRAA; GGAGLRAAI; GAGLRAAIA; AGLRAAIAI; GLRAAIAIA; LRAAIAIAE; RAAIAIAET; AAIAIAETN; AIAIAETNP; IAIAETNPH; AIAETNPHL; IAETNPHLD; AETNPHLDV; ETNPHLDVA; TNPHLDVAI; NPHLDVAIV; PHLDVAIVS; HLDVAIVSK; LDVAIVSKV; DVAIVSKVY; VAIVSKVYP; AIVSKVYPM; IVSKVYPMR; VSKVYPMRS; SKVYPMRSH; KVYPMRSHT; VYPMRSHTV; YPMRSHTVS; PMRSHTVSA; MRSHTVSAE; RSHTVSAEG; SHTVSAEGG; HTVSAEGGA; TVSAEGGAA; VSAEGGAAA; SAEGGAAAV; AEGGAAAVT; EGGAAAVTG; GGAAAVTGD; GAAAVTGDD; AAAVTGDDD; AAVTGDDDS; AVTGDDDSL; VTGDDDSLD; TGDDDSLDE; GDDDSLDEH; DDDSLDEHA; DDSLDEHAH; DSLDEHAHD; SLDEHAHDT; LDEHAHDTV; DEHAHDTVS; EHAHDTVSG; HAHDTVSGG; AHDTVSGGD; HDTVSGGDW; DTVSGGDWL; TVSGGDWLC; VSGGDWLCD; SGGDWLCDQ; GGDWLCDQD; GDWLCDQDA; DWLCDQDAV; WLCDQDAVE; LCDQDAVEA; CDQDAVEAF; DQDAVEAFV; QDAVEAFVA; DAVEAFVAE; AVEAFVAEA; VEAFVAEAP; EAFVAEAPK; AFVAEAPKE; FVAEAPKEL; VAEAPKELV; AEAPKELVQ; EAPKELVQL; APKELVQLE; PKELVQLEH; KELVQLEHW; ELVQLEHWG; LVQLEHWGC; VQLEHWGCP; QLEHWGCPW; LEHWGCPWS; EHWGCPWSR; HWGCPWSRK; WGCPWSRKP; GCPWSRKPD; CPWSRKPDG; PWSRKPDGR; WSRKPDGRV; SRKPDGRVA; RKPDGRVAV; KPDGRVAVR; PDGRVAVRP; DGRVAVRPF; GRVAVRPFG; RVAVRPFGG; VAVRPFGGM; AVRPFGGMK; VRPFGGMKK; RPFGGMKKL; PFGGMKKLR; FGGMKKLRT; GGMKKLRTW; GMKKLRTWF; MKKLRTWFA; KKLRTWFAA; KLRTWFAAD; LRTWFAADK; RTWFAADKT; TWFAADKTG; WFAADKTGF; FAADKTGFH; AADKTGFHL; ADKTGFHLL; DKTGFHLLH; KTGFHLLHT; TGFHLLHTL; GFHLLHTLF; FHLLHTLFQ; HLLHTLFQR; LLHTLFQRL; LHTLFQRLL; HTLFQRLLT; TLFQRLLTY; LFQRLLTYS; FQRLLTYSD; QRLLTYSDV; RLLTYSDVM; LLTYSDVMR; LTYSDVMRY; TYSDVMRYD; YSDVMRYDE; SDVMRYDEW; DVMRYDEWF; VMRYDEWFA; MRYDEWFAT; RYDEWFATT; YDEWFATTL; DEWFATTLL; EWFATTLLV; WFATTLLVD; FATTLLVDD; ATTLLVDDG; TTLLVDDGR; TLLVDDGRV; LLVDDGRVC; LVDDGRVCG; VDDGRVCGL; DDGRVCGLV; DGRVCGLVA; GRVCGLVAI; RVCGLVAIE; VCGLVAIEL; CGLVAIELA; GLVAIELAT; LVAIELATG; VAIELATGR; | |

Fig. 28 continued

| | | |
|---|---|---|
| | AIELATGRI; IELATGRIE; ELATGRIET; LATGRIETI; ATGRIETIL;<br>TGRIETILA; GRIETILAD; RIETILADA; IETILADAV; ETILADAVI;<br>TILADAVIL; ILADAVILC; LADAVILCT; ADAVILCTG; DAVILCTGG;<br>AVILCTGGC; VILCTGGCG; ILCTGGCGR; LCTGGCGRV;<br>CTGGCGRVF; TGGCGRVFP; GGCGRVFPF; GCGRVFPFT;<br>CGRVFPFTT; GRVFPFTTN; RVFPFTTNA; VFPFTTNAN; FPFTTNANI;<br>PFTTNANIK; FTTNANIKT; TTNANIKTG; TNANIKTGD; NANIKTGDG;<br>ANIKTGDGM; NIKTGDGMA; IKTGDGMAL; KTGDGMALA;<br>TGDGMALAF; GDGMALAFR; DGMALAFRA; GMALAFRAG;<br>MALAFRAGA; ALAFRAGAP; LAFRAGAPL; AFRAGAPLK;<br>FRAGAPLKD; RAGAPLKDM; AGAPLKDME; GAPLKDMEF;<br>APLKDMEFV; PLKDMEFVQ; LKDMEFVQY; KDMEFVQYH;<br>DMEFVQYHP; MEFVQYHPT; EFVQYHPTG; FVQYHPTGL;<br>VQYHPTGLP; QYHPTGLPF; YHPTGLPFT; HPTGLPFTG; PTGLPFTGI;<br>TGLPFTGIL; GLPFTGILI; LPFTGILIT; PFTGILITE; FTGILITEA;<br>TGILITEAA; GILITEAAR; ILITEAARA; LITEAARAE; ITEAARAEG;<br>TEAARAEGG; EAARAEGGW; AARAEGGWL; ARAEGGWLL;<br>RAEGGWLLN; AEGGWLLNK; EGGWLLNKD; GGWLLNKDG;<br>GWLLNKDGY; WLLNKDGYR; LLNKDGYRY; LNKDGYRYL;<br>NKDGYRYLQ; KDGYRYLQD; DGYRYLQDY; GYRYLQDYD;<br>YRYLQDYDL; RYLQDYDLG; YLQDYDLGK; LQDYDLGKP;<br>QDYDLGKPT; DYDLGKPTP; YDLGKPTPE; DLGKPTPEP;<br>LGKPTPEPR; GKPTPEPRL; KPTPEPRLR; PTPEPRLRS;<br>TPEPRLRSM; PEPRLRSME; EPRLRSMEL; PRLRSMELG;<br>RLRSMELGP; LRSMELGPR; RSMELGPRD; SMELGPRDR;<br>MELGPRDRL; ELGPRDRLS; LGPRDRLSQ; GPRDRLSQA;<br>PRDRLSQAF; RDRLSQAFV; DRLSQAFVH; RLSQAFVHE;<br>LSQAFVHEH; SQAFVHEHN; QAFVHEHNK; AFVHEHNKG;<br>FVHEHNKGR; VHEHNKGRT; HEHNKGRTV; EHNKGRTVD;<br>HNKGRTVDT; NKGRTVDTP; KGRTVDTPY; GRTVDTPYG;<br>RTVDTPYGP; TVDTPYGPV; VDTPYGPVV; DTPYGPVVY;<br>TPYGPVVYL; PYGPVVYLD; YGPVVYLDL; GPVVYLDLR;<br>PVVYLDLRH; VVYLDLRHL; VYLDLRHLG; YLDLRHLGA; LDLRHLGAD;<br>DLRHLGADL; LRHLGADLI; RHLGADLID; HLGADLIDA; LGADLIDAK;<br>GADLIDAKL; ADLIDAKLP; DLIDAKLPF; LIDAKLPFV; IDAKLPFVR;<br>DAKLPFVRE; AKLPFVREL; KLPFVRELC; LPFVRELCR; PFVRELCRD;<br>FVRELCRDY; VRELCRDYQ; RELCRDYQH; ELCRDYQHI;<br>LCRDYQHID; CRDYQHIDP; RDYQHIDPV; DYQHIDPVV; YQHIDPVVE;<br>QHIDPVVEL; HIDPVVELV; IDPVVELVP; DPVVELVPV; PVVELVPVR;<br>VVELVPVRP; VELVPVRPV; ELVPVRPVV; LVPVRPVVH;<br>VPVRPVVHY; PVRPVVHYM; VRPVVHYMM; RPVVHYMMG;<br>PVVHYMMGG; VVHYMMGGV; VHYMMGGVH; HYMMGGVHT;<br>YMMGGVHTD; MMGGVHTDI; MGGVHTDIN; GGVHTDING;<br>GVHTDINGA; VHTDINGAT; HTDINGATT; TDINGATTL; DINGATTLP;<br>INGATTLPG; NGATTLPGL; GATTLPGLY; ATTLPGLYA; TTLPGLYAA;<br>TLPGLYAAG; LPGLYAAGE; PGLYAAGET; GLYAAGETA;<br>LYAAGETAC; YAAGETACV; AAGETACVS; AGETACVSI;<br>GETACVSIN; ETACVSING; TACVSINGA; ACVSINGAN; CVSINGANR;<br>VSINGANRL; SINGANRLG; INGANRLGS; NGANRLGSN;<br>GANRLGSNS; ANRLGSNSL; NRLGSNSLP; RLGSNSLPE;<br>LGSNSLPEL; GSNSLPELL; SNSLPELLV; NSLPELLVF; SLPELLVFG;<br>LPELLVFGA; PELLVFGAR; ELLVFGARA; LLVFGARAG; LVFGARAGR;<br>VFGARAGRA; FGARAGRAA; GARAGRAAA; ARAGRAAAD; | |

Fig. 28 continued

| | | | |
|---|---|---|---|
| | RAGRAAADY; AGRAAADYA; GRAAADYAA; RAAADYAAR; AAADYAARH; AADYAARHQ; ADYAARHQK; DYAARHQKS; YAARHQKSD; AARHQKSDR; ARHQKSDRG; RHQKSDRGP; HQKSDRGPS; QKSDRGPSS; KSDRGPSSA; SDRGPSSAV; DRGPSSAVR; RGPSSAVRA; GPSSAVRAQ; PSSAVRAQA; SSAVRAQAR; SAVRAQART; AVRAQARTE; VRAQARTEA; RAQARTEAL; AQARTEALR; QARTEALRL; ARTEALRLE; RTEALRLER; TEALRLERE; EALRLEREL; ALRLERELS; LRLERELSR; RLERELSRH; LERELSRHG; ERELSRHGQ; RELSRHGQG; ELSRHGQGG; LSRHGQGGE; SRHGQGGER; RHGQGGERI; HGQGGERIA; GQGGERIAD; QGGERIADI; GGERIADIR; GERIADIRA; ERIADIRAD; RIADIRADM; IADIRADMQ; ADIRADMQA; DIRADMQAT; IRADMQATL; RADMQATLE; ADMQATLES; DMQATLESA; MQATLESAA; QATLESAAG; ATLESAAGI; TLESAAGIY; LESAAGIYR; ESAAGIYRD; SAAGIYRDG; AAGIYRDGP; AGIYRDGPT; GIYRDGPTL; IYRDGPTLT; YRDGPTLTK; RDGPTLTKA; DGPTLTKAV; GPTLTKAVE; PTLTKAVEE; TLTKAVEEI; LTKAVEEIR; TKAVEEIRV; KAVEEIRVL; AVEEIRVLQ; VEEIRVLQE; EEIRVLQER; EIRVLQERF; IRVLQERFA; RVLQERFAT; VLQERFATA; LQERFATAG; QERFATAGI; ERFATAGID; RFATAGIDD; FATAGIDDH; ATAGIDDHS; TAGIDDHSR; AGIDDHSRT; GIDDHSRTF; IDDHSRTFN; DDHSRTFNT; DHSRTFNTE; HSRTFNTEL; SRTFNTELT; RTFNTELTA; TFNTELTAL; FNTELTALL; NTELTALLE; TELTALLEL; ELTALLELS; LTALLELSG; TALLELSGM; ALLELSGML; LLELSGMLD; LELSGMLDV; ELSGMLDVA; LSGMLDVAL; SGMLDVALA; GMLDVALAI; MLDVALAIV; LDVALAIVE; DVALAIVES; VALAIVESG; ALAIVESGL; LAIVESGLR; AIVESGLRR; IVESGLRRE; VESGLRREE; ESGLRREES; SGLRREESR; GLRREESRG; LRREESRGA; RREESRGAH; REESRGAHQ; EESRGAHQR; ESRGAHQRT; SRGAHQRTD; RGAHQRTDF; GAHQRTDFP; AHQRTDFPN; HQRTDFPNR; QRTDFPNRD; RTDFPNRDD; TDFPNRDDE; DFPNRDDEH; FPNRDDEHF; PNRDDEHFL; NRDDEHFLA; RDDEHFLAH; DDEHFLAHT; DEHFLAHTL; EHFLAHTLV; HFLAHTLVH; FLAHTLVHR; LAHTLVHRE; AHTLVHRES; HTLVHRESD; TLVHRESDG; LVHRESDGT; VHRESDGTL; HRESDGTLR; RESDGTLRV; ESDGTLRVG; SDGTLRVGY; DGTLRVGYL; GTLRVGYLP; TLRVGYLPV; LRVGYLPVT; RVGYLPVTI; VGYLPVTIT; GYLPVTITR; YLPVTITRW; LPVTITRWP; PVTITRWPP; VTITRWPPG; TITRWPPGE; ITRWPPGER; TRWPPGERV; RWPPGERVY; WPPGERVYG; PPGERVYGR<br><br>10 mers:<br>MTAQHNIVVI; TAQHNIVVIG; AQHNIVVIGG; QHNIVVIGGG; HNIVVIGGGG; NIVVIGGGGA; IVVIGGGGAG; VVIGGGGAGL; VIGGGGAGLR; IGGGGAGLRA; GGGGAGLRAA; GGGAGLRAAI; GGAGLRAAIA; GAGLRAAIAI; AGLRAAIAIA; GLRAAIAIAE; LRAAIAIAET; RAAIAIAETN; AAIAIAETNP; AIAIAETNPH; IAIAETNPHL; AIAETNPHLD; IAETNPHLDV; AETNPHLDVA; ETNPHLDVAI; TNPHLDVAIV; NPHLDVAIVS; PHLDVAIVSK; HLDVAIVSKV; LDVAIVSKVY; DVAIVSKVYP; VAIVSKVYPM; AIVSKVYPMR; IVSKVYPMRS; VSKVYPMRSH; SKVYPMRSHT; KVYPMRSHTV; VYPMRSHTVS; YPMRSHTVSA; PMRSHTVSAE; MRSHTVSAEG; RSHTVSAEGG; SHTVSAEGGA; HTVSAEGGAA; TVSAEGGAAA; VSAEGGAAAV; SAEGGAAAVT; AEGGAAAVTG; EGGAAAVTGD; | |

Fig. 28 continued

| | | | |
|---|---|---|---|
| | GGAAAVTGDD; GAAAVTGDDD; AAAVTGDDDS; AAVTGDDDSL;<br>AVTGDDDSLD; VTGDDDSLDE; TGDDDSLDEH; GDDDSLDEHA;<br>DDDSLDEHAH; DDSLDEHAHD; DSLDEHAHDT; SLDEHAHDTV;<br>LDEHAHDTVS; DEHAHDTVSG; EHAHDTVSGG; HAHDTVSGGD;<br>AHDTVSGGDW; HDTVSGGDWL; DTVSGGDWLC; TVSGGDWLCD;<br>VSGGDWLCDQ; SGGDWLCDQD; GGDWLCDQDA; GDWLCDQDAV;<br>DWLCDQDAVE; WLCDQDAVEA; LCDQDAVEAF; CDQDAVEAFV;<br>DQDAVEAFVA; QDAVEAFVAE; DAVEAFVAEA; AVEAFVAEAP;<br>VEAFVAEAPK; EAFVAEAPKE; AFVAEAPKEL; FVAEAPKELV;<br>VAEAPKELVQ; AEAPKELVQL; EAPKELVQLE; APKELVQLEH;<br>PKELVQLEHW; KELVQLEHWG; ELVQLEHWGC; LVQLEHWGCP;<br>VQLEHWGCPW; QLEHWGCPWS; LEHWGCPWSR; EHWGCPWSRK;<br>HWGCPWSRKP; WGCPWSRKPD; GCPWSRKPDG; CPWSRKPDGR;<br>PWSRKPDGRV; WSRKPDGRVA; SRKPDGRVAV; RKPDGRVAVR;<br>KPDGRVAVRP; PDGRVAVRPF; DGRVAVRPFG; GRVAVRPFGG;<br>RVAVRPFGGM; VAVRPFGGMK; AVRPFGGMKK; VRPFGGMKKL;<br>RPFGGMKKLR; PFGGMKKLRT; FGGMKKLRTW; GGMKKLRTWF;<br>GMKKLRTWFA; MKKLRTWFAA; KKLRTWFAAD; KLRTWFAADK;<br>LRTWFAADKT; RTWFAADKTG; TWFAADKTGF; WFAADKTGFH;<br>FAADKTGFHL; AADKTGFHLL; ADKTGFHLLH; DKTGFHLLHT;<br>KTGFHLLHTL; TGFHLLHTLF; GFHLLHTLFQ; FHLLHTLFQR;<br>HLLHTLFQRL; LLHTLFQRLL; LHTLFQRLLT; HTLFQRLLTY;<br>TLFQRLLTYS; LFQRLLTYSD; FQRLLTYSDV; QRLLTYSDVM;<br>RLLTYSDVMR; LLTYSDVMRY; LTYSDVMRYD; TYSDVMRYDE;<br>YSDVMRYDEW; SDVMRYDEWF; DVMRYDEWFA; VMRYDEWFAT;<br>MRYDEWFATT; RYDEWFATTL; YDEWFATTLL; DEWFATTLLV;<br>EWFATTLLVD; WFATTLLVDD; FATTLLVDDG; ATTLLVDDGR;<br>TTLLVDDGRV; TLLVDDGRVC; LLVDDGRVCG; LVDDGRVCGL;<br>VDDGRVCGLV; DDGRVCGLVA; DGRVCGLVAI; GRVCGLVAIE;<br>RVCGLVAIEL; VCGLVAIELA; CGLVAIELAT; GLVAIELATG;<br>LVAIELATGR; VAIELATGRI; AIELATGRIE; IELATGRIET; ELATGRIETI;<br>LATGRIETIL; ATGRIETILA; TGRIETILAD; GRIETILADA; RIETILADAV;<br>IETILADAVI; ETILADAVIL; TILADAVILC; ILADAVILCT; LADAVILCTG;<br>ADAVILCTGG; DAVILCTGGC; AVILCTGGCG; VILCTGGCGR;<br>ILCTGGCGRV; LCTGGCGRVF; CTGGCGRVFP; TGGCGRVFPF;<br>GGCGRVFPFT; GCGRVFPFTT; CGRVFPFTTN; GRVFPFTTNA;<br>RVFPFTTNAN; VFPFTTNANI; FPFTTNANIK; PFTTNANIKT;<br>FTTNANIKTG; TTNANIKTGD; TNANIKTGDG; NANIKTGDGM;<br>ANIKTGDGMA; NIKTGDGMAL; IKTGDGMALA; KTGDGMALAF;<br>TGDGMALAFR; GDGMALAFRA; DGMALAFRAG; GMALAFRAGA;<br>MALAFRAGAP; ALAFRAGAPL; LAFRAGAPLK; AFRAGAPLKD;<br>FRAGAPLKDM; RAGAPLKDME; AGAPLKDMEF; GAPLKDMEFV;<br>APLKDMEFVQ; PLKDMEFVQY; LKDMEFVQYH; KDMEFVQYHP;<br>DMEFVQYHPT; MEFVQYHPTG; EFVQYHPTGL; FVQYHPTGLP;<br>VQYHPTGLPF; QYHPTGLPFT; YHPTGLPFTG; HPTGLPFTGI;<br>PTGLPFTGIL; TGLPFTGILI; GLPFTGILIT; LPFTGILITE; PFTGILITEA;<br>FTGILITEAA; TGILITEAAR; GILITEAARA; ILITEAARAE; LITEAARAEG;<br>ITEAARAEGG; TEAARAEGGW; EAARAEGGWL; AARAEGGWLL;<br>ARAEGGWLLN; RAEGGWLLNK; AEGGWLLNKD; EGGWLLNKDG;<br>GGWLLNKDGY; GWLLNKDGYR; WLLNKDGYRY; LLNKDGYRYL;<br>LNKDGYRYLQ; NKDGYRYLQD; KDGYRYLQDY; DGYRYLQDYD;<br>GYRYLQDYDL; YRYLQDYDLG; RYLQDYDLGK; YLQDYDLGKP;<br>LQDYDLGKPT; QDYDLGKPTP; DYDLGKPTPE; YDLGKPTPEP; | |

Fig. 28 continued

| | | |
|---|---|---|
| | DLGKPTPEPR; LGKPTPEPRL; GKPTPEPRLR; KPTPEPRLRS; PTPEPRLRSM; TPEPRLRSME; PEPRLRSMEL; EPRLRSMELG; PRLRSMELGP; RLRSMELGPR; LRSMELGPRD; RSMELGPRDR; SMELGPRDRL; MELGPRDRLS; ELGPRDRLSQ; LGPRDRLSQA; GPRDRLSQAF; PRDRLSQAFV; RDRLSQAFVH; DRLSQAFVHE; RLSQAFVHEH; LSQAFVHEHN; SQAFVHEHNK; QAFVHEHNKG; AFVHEHNKGR; FVHEHNKGRT; VHEHNKGRTV; HEHNKGRTVD; EHNKGRTVDT; HNKGRTVDTP; NKGRTVDTPY; KGRTVDTPYG; GRTVDTPYGP; RTVDTPYGPV; TVDTPYGPVV; VDTPYGPVVY; DTPYGPVVYL; TPYGPVVYLD; PYGPVVYLDL; YGPVVYLDLR; GPVVYLDLRH; PVVYLDLRHL; VVYLDLRHLG; VYLDLRHLGA; YLDLRHLGAD; LDLRHLGADL; DLRHLGADLI; LRHLGADLID; RHLGADLIDA; HLGADLIDAK; LGADLIDAKL; GADLIDAKLP; ADLIDAKLPF; DLIDAKLPFV; LIDAKLPFVR; IDAKLPFVRE; DAKLPFVREL; AKLPFVRELC; KLPFVRELCR; LPFVRELCRD; PFVRELCRDY; FVRELCRDYQ; VRELCRDYQH; RELCRDYQHI; ELCRDYQHID; LCRDYQHIDP; CRDYQHIDPV; RDYQHIDPVV; DYQHIDPVVE; YQHIDPVVEL; QHIDPVVELV; HIDPVVELVP; IDPVVELVPV; DPVVELVPVR; PVVELVPVRP; VVELVPVRPV; VELVPVRPVV; ELVPVRPVVH; LVPVRPVVHY; VPVRPVVHYM; PVRPVVHYMM; VRPVVHYMMG; RPVVHYMMGG; PVVHYMMGGV; VVHYMMGGVH; VHYMMGGVHT; HYMMGGVHTD; YMMGGVHTDI; MMGGVHTDIN; MGGVHTDING; GGVHTDINGA; GVHTDINGAT; VHTDINGATT; HTDINGATTL; TDINGATTLP; DINGATTLPG; INGATTLPGL; NGATTLPGLY; GATTLPGLYA; ATTLPGLYAA; TTLPGLYAAG; TLPGLYAAGE; LPGLYAAGET; PGLYAAGETA; GLYAAGETAC; LYAAGETACV; YAAGETACVS; AAGETACVSI; AGETACVSIN; GETACVSING; ETACVSINGA; TACVSINGAN; ACVSINGANR; CVSINGANRL; VSINGANRLG; SINGANRLGS; INGANRLGSN; NGANRLGSNS; GANRLGSNSL; ANRLGSNSLP; NRLGSNSLPE; RLGSNSLPEL; LGSNSLPELL; GSNSLPELLV; SNSLPELLVF; NSLPELLVFG; SLPELLVFGA; LPELLVFGAR; PELLVFGARA; ELLVFGARAG; LLVFGARAGR; LVFGARAGRA; VFGARAGRAA; FGARAGRAAA; GARAGRAAAD; ARAGRAAADY; RAGRAAADYA; AGRAAADYAA; GRAAADYAAR; RAAADYAARH; AAADYAARHQ; AADYAARHQK; ADYAARHQKS; DYAARHQKSD; YAARHQKSDR; AARHQKSDRG; ARHQKSDRGP; RHQKSDRGPS; HQKSDRGPSS; QKSDRGPSSA; KSDRGPSSAV; SDRGPSSAVR; DRGPSSAVRA; RGPSSAVRAQ; GPSSAVRAQA; PSSAVRAQAR; SSAVRAQART; SAVRAQARTE; AVRAQARTEA; VRAQARTEAL; RAQARTEALR; AQARTEALRL; QARTEALRLE; ARTEALRLER; RTEALRLERE; TEALRLEREL; EALRLERELS; ALRLERELSR; LRLERELSRH; RLERELSRHG; LERELSRHGQ; ERELSRHGQG; RELSRHGQGG; ELSRHGQGGE; LSRHGQGGER; SRHGQGGERI; RHGQGGERIA; HGQGGERIAD; GQGGERIADI; QGGERIADIR; GGERIADIRA; GERIADIRAD; ERIADIRADM; RIADIRADMQ; IADIRADMQA; ADIRADMQAT; DIRADMQATL; IRADMQATLE; RADMQATLES; ADMQATLESA; DMQATLESAA; MQATLESAAG; QATLESAAGI; ATLESAAGIY; TLESAAGIYR; LESAAGIYRD; ESAAGIYRDG; SAAGIYRDGP; AAGIYRDGPT; AGIYRDGPTL; GIYRDGPTLT; IYRDGPTLTK; YRDGPTLTKA; RDGPTLTKAV; DGPTLTKAVE; GPTLTKAVEE; PTLTKAVEEI; TLTKAVEEIR; LTKAVEEIRV; TKAVEEIRVL; KAVEEIRVLQ; AVEEIRVLQE; | |

Fig. 28 continued

| | | | |
|---|---|---|---|
| | VEEIRVLQER; EEIRVLQERF; EIRVLQERFA; IRVLQERFAT;<br>RVLQERFATA; VLQERFATAG; LQERFATAGI; QERFATAGID;<br>ERFATAGIDD; RFATAGIDDH; FATAGIDDHS; ATAGIDDHSR;<br>TAGIDDHSRT; AGIDDHSRTF; GIDDHSRTFN; IDDHSRTFNT;<br>DDHSRTFNTE; DHSRTFNTEL; HSRTFNTELT; SRTFNTELTA;<br>RTFNTELTAL; TFNTELTALL; FNTELTALLE; NTELTALLEL;<br>TELTALLELS; ELTALLELSG; LTALLELSGM; TALLELSGML;<br>ALLELSGMLD; LLELSGMLDV; LELSGMLDVA; ELSGMLDVAL;<br>LSGMLDVALA; SGMLDVALAI; GMLDVALAIV; MLDVALAIVE;<br>LDVALAIVES; DVALAIVESG; VALAIVESGL; ALAIVESGLR;<br>LAIVESGLRR; AIVESGLRRE; IVESGLRREE; VESGLRREES;<br>ESGLRREESR; SGLRREESRG; GLRREESRGA; LRREESRGAH;<br>RREESRGAHQ; REESRGAHQR; EESRGAHQRT; ESRGAHQRTD;<br>SRGAHQRTDF; RGAHQRTDFP; GAHQRTDFPN; AHQRTDFPNR;<br>HQRTDFPNRD; QRTDFPNRDD; RTDFPNRDDE; TDFPNRDDEH;<br>DFPNRDDEHF; FPNRDDEHFL; PNRDDEHFLA; NRDDEHFLAH;<br>RDDEHFLAHT; DDEHFLAHTL; DEHFLAHTLV; EHFLAHTLVH;<br>HFLAHTLVHR; FLAHTLVHRE; LAHTLVHRES; AHTLVHRESD;<br>HTLVHRESDG; TLVHRESDGT; LVHRESDGTL; VHRESDGTLR;<br>HRESDGTLRV; RESDGTLRVG; ESDGTLRVGY; SDGTLRVGYL;<br>DGTLRVGYLP; GTLRVGYLPV; TLRVGYLPVT; LRVGYLPVTI;<br>RVGYLPVTIT; VGYLPVTITR; GYLPVTITRW; YLPVTITRWP;<br>LPVTITRWPP; PVTITRWPPG; VTITRWPPGE; TITRWPPGER;<br>ITRWPPGERV; TRWPPGERVY; RWPPGERVYG; WPPGERVYGR<br><br>11 mers:<br>MTAQHNIVVIG; TAQHNIVVIGG; AQHNIVVIGGG; QHNIVVIGGGG;<br>HNIVVIGGGGA; NIVVIGGGGAG; IVVIGGGGAGL; VVIGGGGAGLR;<br>VIGGGGAGLRA; IGGGGAGLRAA; GGGGAGLRAAI; GGGAGLRAAIA;<br>GGAGLRAAIAI; GAGLRAAIAIA; AGLRAAIAIAE; GLRAAIAIAET;<br>LRAAIAIAETN; RAAIAIAETNP; AAIAIAETNPH; AIAIAETNPHL;<br>IAIAETNPHLD; AIAETNPHLDV; IAETNPHLDVA; AETNPHLDVAI;<br>ETNPHLDVAIV; TNPHLDVAIVS; NPHLDVAIVSK; PHLDVAIVSKV;<br>HLDVAIVSKVY; LDVAIVSKVYP; DVAIVSKVYPM; VAIVSKVYPMR;<br>AIVSKVYPMRS; IVSKVYPMRSH; VSKVYPMRSHT; SKVYPMRSHTV;<br>KVYPMRSHTVS; VYPMRSHTVSA; YPMRSHTVSAE;<br>PMRSHTVSAEG; MRSHTVSAEGG; RSHTVSAEGGA;<br>SHTVSAEGGAA; HTVSAEGGAAA; TVSAEGGAAAV; VSAEGGAAAVT;<br>SAEGGAAAVTG; AEGGAAAVTGD; EGGAAAVTGDD;<br>GGAAAVTGDDD; GAAAVTGDDDS; AAAVTGDDDSL;<br>AAVTGDDDSLD; AVTGDDDSLDE; VTGDDDSLDEH; TGDDDSLDEHA;<br>GDDDSLDEHAH; DDDSLDEHAHD; DDSLDEHAHDT; DSLDEHAHDTV;<br>SLDEHAHDTVS; LDEHAHDTVSG; DEHAHDTVSGG;<br>EHAHDTVSGGD; HAHDTVSGGDW; AHDTVSGGDWL;<br>HDTVSGGDWLC; DTVSGGDWLCD; TVSGGDWLCDQ;<br>VSGGDWLCDQD; SGGDWLCDQDA; GGDWLCDQDAV;<br>GDWLCDQDAVE; DWLCDQDAVEA; WLCDQDAVEAF;<br>LCDQDAVEAFV; CDQDAVEAFVA; DQDAVEAFVAE; QDAVEAFVAEA;<br>DAVEAFVAEAP; AVEAFVAEAPK; VEAFVAEAPKE; EAFVAEAPKEL;<br>AFVAEAPKELV; FVAEAPKELVQ; VAEAPKELVQL; AEAPKELVQLE;<br>EAPKELVQLEH; APKELVQLEHW; PKELVQLEHWG; KELVQLEHWGC;<br>ELVQLEHWGCP; LVQLEHWGCPW; VQLEHWGCPWS;<br>QLEHWGCPWSR; LEHWGCPWSRK; EHWGCPWSRKP; | | |

Fig. 28 continued

| | | |
|---|---|---|
| | HWGCPWSRKPD; WGCPWSRKPDG; GCPWSRKPDGR; CPWSRKPDGRV; PWSRKPDGRVA; WSRKPDGRVAV; SRKPDGRVAVR; RKPDGRVAVRP; KPDGRVAVRPF; PDGRVAVRPFG; DGRVAVRPFGG; GRVAVRPFGGM; RVAVRPFGGMK; VAVRPFGGMKK; AVRPFGGMKKL; VRPFGGMKKLR; RPFGGMKKLRT; PFGGMKKLRTW; FGGMKKLRTWF; GGMKKLRTWFA; GMKKLRTWFAA; MKKLRTWFAAD; KKLRTWFAADK; KLRTWFAADKT; LRTWFAADKTG; RTWFAADKTGF; TWFAADKTGFH; WFAADKTGFHL; FAADKTGFHLL; AADKTGFHLLH; ADKTGFHLLHT; DKTGFHLLHTL; KTGFHLLHTLF; TGFHLLHTLFQ; GFHLLHTLFQR; FHLLHTLFQRL; HLLHTLFQRLL; LLHTLFQRLLT; LHTLFQRLLTY; HTLFQRLLTYS; TLFQRLLTYSD; LFQRLLTYSDV; FQRLLTYSDVM; QRLLTYSDVMR; RLLTYSDVMRY; LLTYSDVMRYD; LTYSDVMRYDE; TYSDVMRYDEW; YSDVMRYDEWF; SDVMRYDEWFA; DVMRYDEWFAT; VMRYDEWFATT; MRYDEWFATTL; RYDEWFATTLL; YDEWFATTLLV; DEWFATTLLVD; EWFATTLLVDD; WFATTLLVDDG; FATTLLVDDGR; ATTLLVDDGRV; TTLLVDDGRVC; TLLVDDGRVCG; LLVDDGRVCGL; LVDDGRVCGLV; VDDGRVCGLVA; DDGRVCGLVAI; DGRVCGLVAIE; GRVCGLVAIEL; RVCGLVAIELA; VCGLVAIELAT; CGLVAIELATG; GLVAIELATGR; LVAIELATGRI; VAIELATGRIE; AIELATGRIET; IELATGRIETI; ELATGRIETIL; LATGRIETILA; ATGRIETILAD; TGRIETILADA; GRIETILADAV; RIETILADAVI; IETILADAVIL; ETILADAVILC; TILADAVILCT; ILADAVILCTG; LADAVILCTGG; ADAVILCTGGC; DAVILCTGGCG; AVILCTGGCGR; VILCTGGCGRV; ILCTGGCGRVF; LCTGGCGRVFP; CTGGCGRVFPF; TGGCGRVFPFT; GGCGRVFPFTT; GCGRVFPFTTN; CGRVFPFTTNA; GRVFPFTTNAN; RVFPFTTNANI; VFPFTTNANIK; FPFTTNANIKT; PFTTNANIKTG; FTTNANIKTGD; TTNANIKTGDG; TNANIKTGDGM; NANIKTGDGMA; ANIKTGDGMAL; NIKTGDGMALA; IKTGDGMALAF; KTGDGMALAFR; TGDGMALAFRA; GDGMALAFRAG; DGMALAFRAGA; GMALAFRAGAP; MALAFRAGAPL; ALAFRAGAPLK; LAFRAGAPLKD; AFRAGAPLKDM; FRAGAPLKDME; RAGAPLKDMEF; AGAPLKDMEFV; GAPLKDMEFVQ; APLKDMEFVQY; PLKDMEFVQYH; LKDMEFVQYHP; KDMEFVQYHPT; DMEFVQYHPTG; MEFVQYHPTGL; EFVQYHPTGLP; FVQYHPTGLPF; VQYHPTGLPFT; QYHPTGLPFTG; YHPTGLPFTGI; HPTGLPFTGIL; PTGLPFTGILI; TGLPFTGILIT; GLPFTGILITE; LPFTGILITEA; PFTGILITEAA; FTGILITEAAR; TGILITEAARA; GILITEAARAE; ILITEAARAEG; LITEAARAEGG; ITEAARAEGGW; TEAARAEGGWL; EAARAEGGWLL; AARAEGGWLLN; ARAEGGWLLNK; RAEGGWLLNKD; AEGGWLLNKDG; EGGWLLNKDGY; GGWLLNKDGYR; GWLLNKDGYRY; WLLNKDGYRYL; LLNKDGYRYLQ; LNKDGYRYLQD; NKDGYRYLQDY; KDGYRYLQDYD; DGYRYLQDYDL; GYRYLQDYDLG; YRYLQDYDLGK; RYLQDYDLGKP; YLQDYDLGKPT; LQDYDLGKPTP; QDYDLGKPTPE; DYDLGKPTPEP; YDLGKPTPEPR; DLGKPTPEPRL; LGKPTPEPRLR; GKPTPEPRLRS; KPTPEPRLRSM; PTPEPRLRSME; TPEPRLRSMEL; PEPRLRSMELG; EPRLRSMELGP; PRLRSMELGPR; RLRSMELGPRD; LRSMELGPRDR; RSMELGPRDRL; SMELGPRDRLS; MELGPRDRLSQ; ELGPRDRLSQA; LGPRDRLSQAF; GPRDRLSQAFV; PRDRLSQAFVH; RDRLSQAFVHE; DRLSQAFVHEH; RLSQAFVHEHN; LSQAFVHEHNK; SQAFVHEHNKG; QAFVHEHNKGR; | |

Fig. 28 continued

| | | | |
|---|---|---|---|
| | AFVHEHNKGRT; FVHEHNKGRTV; VHEHNKGRTVD; HEHNKGRTVDT; EHNKGRTVDTP; HNKGRTVDTPY; NKGRTVDTPYG; KGRTVDTPYGP; GRTVDTPYGPV; RTVDTPYGPVV; TVDTPYGPVVY; VDTPYGPVVYL; DTPYGPVVYLD; TPYGPVVYLDL; PYGPVVYLDLR; YGPVVYLDLRH; GPVVYLDLRHL; PVVYLDLRHLG; VVYLDLRHLGA; VYLDLRHLGAD; YLDLRHLGADL; LDLRHLGADLI; DLRHLGADLID; LRHLGADLIDA; RHLGADLIDAK; HLGADLIDAKL; LGADLIDAKLP; GADLIDAKLPF; ADLIDAKLPFV; DLIDAKLPFVR; LIDAKLPFVRE; IDAKLPFVREL; DAKLPFVRELC; AKLPFVRELCR; KLPFVRELCRD; LPFVRELCRDY; PFVRELCRDYQ; FVRELCRDYQH; VRELCRDYQHI; RELCRDYQHID; ELCRDYQHIDP; LCRDYQHIDPV; CRDYQHIDPVV; RDYQHIDPVVE; DYQHIDPVVEL; YQHIDPVVELV; QHIDPVVELVP; HIDPVVELVPV; IDPVVELVPVR; DPVVELVPVRP; PVVELVPVRPV; VVELVPVRPVV; VELVPVRPVVH; ELVPVRPVVHY; LVPVRPVVHYM; VPVRPVVHYMM; PVRPVVHYMMG; VRPVVHYMMGG; RPVVHYMMGGV; PVVHYMMGGVH; VVHYMMGGVHT; VHYMMGGVHTD; HYMMGGVHTDI; YMMGGVHTDIN; MMGGVHTDING; MGGVHTDINGA; GGVHTDINGAT; GVHTDINGATT; VHTDINGATTL; HTDINGATTLP; TDINGATTLPG; DINGATTLPGL; INGATTLPGLY; NGATTLPGLYA; GATTLPGLYAA; ATTLPGLYAAG; TTLPGLYAAGE; TLPGLYAAGET; LPGLYAAGETA; PGLYAAGETAC; GLYAAGETACV; LYAAGETACVS; YAAGETACVSI; AAGETACVSIN; AGETACVSING; GETACVSINGA; ETACVSINGAN; TACVSINGANR; ACVSINGANRL; CVSINGANRLG; VSINGANRLGS; SINGANRLGSN; INGANRLGSNS; NGANRLGSNSL; GANRLGSNSLP; ANRLGSNSLPE; NRLGSNSLPEL; RLGSNSLPELL; LGSNSLPELLV; GSNSLPELLVF; SNSLPELLVFG; NSLPELLVFGA; SLPELLVFGAR; LPELLVFGARA; PELLVFGARAG; ELLVFGARAGR; LLVFGARAGRA; LVFGARAGRAA; VFGARAGRAAA; FGARAGRAAAD; GARAGRAAADY; ARAGRAAADYA; RAGRAAADYAA; AGRAAADYAAR; GRAAADYAARH; RAAADYAARHQ; AAADYAARHQK; AADYAARHQKS; ADYAARHQKSD; DYAARHQKSDR; YAARHQKSDRG; AARHQKSDRGP; ARHQKSDRGPS; RHQKSDRGPSS; HQKSDRGPSSA; QKSDRGPSSAV; KSDRGPSSAVR; SDRGPSSAVRA; DRGPSSAVRAQ; RGPSSAVRAQA; GPSSAVRAQAR; PSSAVRAQART; SSAVRAQARTE; SAVRAQARTEA; AVRAQARTEAL; VRAQARTEALR; RAQARTEALRL; AQARTEALRLE; QARTEALRLER; ARTEALRLERE; RTEALRLEREL; TEALRLERELS; EALRLERELSR; ALRLERELSRH; LRLERELSRHG; RLERELSRHGQ; LERELSRHGQG; ERELSRHGQGG; RELSRHGQGGE; ELSRHGQGGER; LSRHGQGGERI; SRHGQGGERIA; RHGQGGERIAD; HGQGGERIADI; GQGGERIADIR; QGGERIADIRA; GGERIADIRAD; GERIADIRADM; ERIADIRADMQ; RIADIRADMQA; IADIRADMQAT; ADIRADMQATL; DIRADMQATLE; IRADMQATLES; RADMQATLESA; ADMQATLESAA; DMQATLESAAG; MQATLESAAGI; QATLESAAGIY; ATLESAAGIYR; TLESAAGIYRD; LESAAGIYRDG; ESAAGIYRDGP; SAAGIYRDGPT; AAGIYRDGPTL; AGIYRDGPTLT; GIYRDGPTLTK; IYRDGPTLTKA; YRDGPTLTKAV; RDGPTLTKAVE; DGPTLTKAVEE; GPTLTKAVEEI; PTLTKAVEEIR; TLTKAVEEIRV; LTKAVEEIRVL; TKAVEEIRVLQ; KAVEEIRVLQE; AVEEIRVLQER; VEEIRVLQERF; EEIRVLQERFA; EIRVLQERFAT; IRVLQERFATA; RVLQERFATAG; VLQERFATAGI; LQERFATAGID; QERFATAGIDD; ERFATAGIDDH; RFATAGIDDHS; | |

Fig. 28 continued

| | | |
|---|---|---|
| | FATAGIDDHSR; ATAGIDDHSRT; TAGIDDHSRTF; AGIDDHSRTFN; GIDDHSRTFNT; IDDHSRTFNTE; DDHSRTFNTEL; DHSRTFNTELT; HSRTFNTELTA; SRTFNTELTAL; RTFNTELTALL; TFNTELTALLE; FNTELTALLEL; NTELTALLELS; TELTALLELSG; ELTALLELSGM; LTALLELSGML; TALLELSGMLD; ALLELSGMLDV; LLELSGMLDVA; LELSGMLDVAL; ELSGMLDVALA; LSGMLDVALAI; SGMLDVALAIV; GMLDVALAIVE; MLDVALAIVES; LDVALAIVESG; DVALAIVESGL; VALAIVESGLR; ALAIVESGLRR; LAIVESGLRRE; AIVESGLRREE; IVESGLRREES; VESGLRREESR; ESGLRREESRG; SGLRREESRGA; GLRREESRGAH; LRREESRGAHQ; RREESRGAHQR; REESRGAHQRT; EESRGAHQRTD; ESRGAHQRTDF; SRGAHQRTDFP; RGAHQRTDFPN; GAHQRTDFPNR; AHQRTDFPNRD; HQRTDFPNRDD; QRTDFPNRDDE; RTDFPNRDDEH; TDFPNRDDEHF; DFPNRDDEHFL; FPNRDDEHFLA; PNRDDEHFLAH; NRDDEHFLAHT; RDDEHFLAHTL; DDEHFLAHTLV; DEHFLAHTLVH; EHFLAHTLVHR; HFLAHTLVHRE; FLAHTLVHRES; LAHTLVHRESD; AHTLVHRESDG; HTLVHRESDGT; TLVHRESDGTL; LVHRESDGTLR; VHRESDGTLRV; HRESDGTLRVG; RESDGTLRVGY; ESDGTLRVGYL; SDGTLRVGYLP; DGTLRVGYLPV; GTLRVGYLPVT; TLRVGYLPVTI; LRVGYLPVTIT; RVGYLPVTITR; VGYLPVTITRW; GYLPVTITRWP; YLPVTITRWPP; LPVTITRWPPG; PVTITRWPPGE; VTITRWPPGER; TITRWPPGERV; ITRWPPGERVY; TRWPPGERVYG; RWPPGERVYGR | |
| 25) Rv1660 | 8 mers:<br>MSVIAGVF; SVIAGVFG; VIAGVFGA; IAGVFGAL; AGVFGALP; GVFGALPP; VFGALPPY; FGALPPYR; GALPPYRY; ALPPYRYS; LPPYRYSQ; PPYRYSQR; PYRYSQRE; YRYSQREL; RYSQRELT; YSQRELTD; SQRELTDS; QRELTDSF; RELTDSFV; ELTDSFVS; LTDSFVSI; TDSFVSIP; DSFVSIPD; SFVSIPDF; FVSIPDFE; VSIPDFEG; SIPDFEGY; IPDFEGYE; PDFEGYED; DFEGYEDI; FEGYEDIV; EGYEDIVR; GYEDIVRQ; YEDIVRQL; EDIVRQLH; DIVRQLHA; IVRQLHAS; VRQLHASA; RQLHASAK; QLHASAKV; LHASAKVN; HASAKVNS; ASAKVNSR; SAKVNSRH; AKVNSRHL; KVNSRHLV; VNSRHLVL; NSRHLVLP; SRHLVLPL; RHLVLPLE; HLVLPLEK; LVLPLEKY; VLPLEKYP; LPLEKYPK; PLEKYPKL; LEKYPKLT; EKYPKLTD; KYPKLTDF; YPKLTDFG; PKLTDFGE; KLTDFGEA; LTDFGEAN; TDFGEANK; DFGEANKI; FGEANKIF; GEANKIFI; EANKIFIE; ANKIFIEK; NKIFIEKA; KIFIEKAV; IFIEKAVD; FIEKAVDL; IEKAVDLG; EKAVDLGV; KAVDLGVQ; AVDLGVQA; VDLGVQAL; DLGVQALA; LGVQALAG; GVQALAGA; VQALAGAL; QALAGALD; ALAGALDE; LAGALDES; AGALDESG; GALDESGL; ALDESGLR; LDESGLRP; DESGLRPE; ESGLRPED; SGLRPEDL; GLRPEDLD; LRPEDLDV; RPEDLDVL; PEDLDVLI; EDLDVLIT; DLDVLITA; LDVLITAT; DVLITATV; VLITATVT; LITATVTG; ITATVTGL; TATVTGLA; ATVTGLAV; TVTGLAVP; VTGLAVPS; TGLAVPSL; GLAVPSLD; LAVPSLDA; AVPSLDAR; VPSLDARI; PSLDARIA; SLDARIAG; LDARIAGR; DARIAGRL; ARIAGRLG; RIAGRLGL; IAGRLGLR; AGRLGLRA; GRLGLRAD; RLGLRADV; LGLRADVR; GLRADVRR; LRADVRRV; RADVRRVP; ADVRRVPL; DVRRVPLF; VRRVPLFG; RRVPLFGL; RVPLFGLG; VPLFGLGC; PLFGLGCV; LFGLGCVA; FGLGCVAG; GLGCVAGA; LGCVAGAA; GCVAGAAG; CVAGAAGV; VAGAAGVA; AGAAGVAR; GAAGVARL; AAGVARLH; AGVARLHD; GVARLHDY; VARLHDYL; ARLHDYLR; RLHDYLRG; | 21026-22403 |

Fig. 28 continued

| | | |
|---|---|---|
| | LHDYLRGA; HDYLRGAP; DYLRGAPD; YLRGAPDG; LRGAPDGV; RGAPDGVA; GAPDGVAA; APDGVAAL; PDGVAALV; DGVAALVS; GVAALVSV; VAALVSVE; AALVSVEL; ALVSVELC; LVSVELCS; VSVELCSL; SVELCSLT; VELCSLTY; ELCSLTYP; LCSLTYPG; CSLTYPGY; SLTYPGYK; LTYPGYKP; TYPGYKPT; YPGYKPTL; PGYKPTLP; GYKPTLPG; YKPTLPGL; KPTLPGLV; PTLPGLVG; TLPGLVGS; LPGLVGSA; PGLVGSAL; GLVGSALF; LVGSALFA; VGSALFAD; GSALFADG; SALFADGA; ALFADGAA; LFADGAAA; FADGAAAV; ADGAAAVV; DGAAAVVA; GAAAVVAA; AAAVVAAG; AAVVAAGV; AVVAAGVK; VVAAGVKR; VAAGVKRA; AAGVKRAQ; AGVKRAQD; GVKRAQDI; VKRAQDIG; KRAQDIGA; RAQDIGAD; AQDIGADG; QDIGADGP; DIGADGPD; IGADGPDI; GADGPDIL; ADGPDILD; DGPDILDS; GPDILDSR; PDILDSRS; DILDSRSH; ILDSRSHL; LDSRSHLY; DSRSHLYP; SRSHLYPD; RSHLYPDS; SHLYPDSL; HLYPDSLR; LYPDSLRT; YPDSLRTM; PDSLRTMG; DSLRTMGY; SLRTMGYD; LRTMGYDV; RTMGYDVG; TMGYDVGS; MGYDVGSA; GYDVGSAG; YDVGSAGF; DVGSAGFE; VGSAGFEL; GSAGFELV; SAGFELVL; AGFELVLS; GFELVLSR; FELVLSRD; ELVLSRDL; LVLSRDLA; VLSRDLAA; LSRDLAAV; SRDLAAVV; RDLAAVVE; DLAAVVEQ; LAAVVEQY; AAVVEQYL; AVVEQYLG; VVEQYLGN; VEQYLGND; EQYLGNDV; QYLGNDVT; YLGNDVTT; LGNDVTTF; GNDVTTFL; NDVTTFLA; DVTTFLAS; VTTFLASH; TTFLASHG; TFLASHGL; FLASHGLS; LASHGLST; ASHGLSTT; SHGLSTTD; HGLSTTDV; GLSTTDVG; LSTTDVGA; STTDVGAW; TTDVGAWV; TDVGAWVT; DVGAWVTH; VGAWVTHP; GAWVTHPG; AWVTHPGG; WVTHPGGP; VTHPGGPK; THPGGPKI; HPGGPKII; PGGPKIIN; GGPKIINA; GPKIINAI; PKIINAIT; KIINAITE; IINAITET; INAITETL; NAITETLD; AITETLDL; ITETLDLS; TETLDLSP; ETLDLSPQ; TLDLSPQA; LDLSPQAL; DLSPQALE; LSPQALEL; SPQALELT; PQALELTW; QALELTWR; ALELTWRS; LELTWRSL; ELTWRSLG; LTWRSLGE; TWRSLGEI; WRSLGEIG; RSLGEIGN; SLGEIGNL; LGEIGNLS; GEIGNLSS; EIGNLSSA; IGNLSSAS; GNLSSASV; NLSSASVL; LSSASVLH; SSASVLHV; SASVLHVL; ASVLHVLR; SVLHVLRD; VLHVLRDT; LHVLRDTI; HVLRDTIA; VLRDTIAK; LRDTIAKP; RDTIAKPP; DTIAKPPP; TIAKPPPS; IAKPPPSG; AKPPPSGS; KPPPSGSP; PPPSGSPG; PPSGSPGL; PSGSPGLM; SGSPGLMI; GSPGLMIA; SPGLMIAM; PGLMIAMG; GLMIAMGP; LMIAMGPG; MIAMGPGF; IAMGPGFC; AMGPGFCS; MGPGFCSE; GPGFCSEL; PGFCSELV; GFCSELVL; FCSELVLL; CSELVLLR; SELVLLRW; ELVLLRWH<br><br>9 mers:<br>MSVIAGVFG; SVIAGVFGA; VIAGVFGAL; IAGVFGALP; AGVFGALPP; GVFGALPPY; VFGALPPYR; FGALPPYRY; GALPPYRYS; ALPPYRYSQ; LPPYRYSQR; PPYRYSQRE; PYRYSQREL; YRYSQRELT; RYSQRELTD; YSQRELTDS; SQRELTDSF; QRELTDSFV; RELTDSFVS; ELTDSFVSI; LTDSFVSIP; TDSFVSIPD; DSFVSIPDF; SFVSIPDFE; FVSIPDFEG; VSIPDFEGY; SIPDFEGYE; IPDFEGYED; PDFEGYEDI; DFEGYEDIV; FEGYEDIVR; EGYEDIVRQ; GYEDIVRQL; YEDIVRQLH; EDIVRQLHA; DIVRQLHAS; IVRQLHASA; VRQLHASAK; RQLHASAKV; QLHASAKVN; LHASAKVNS; HASAKVNSR; ASAKVNSRH; SAKVNSRHL; AKVNSRHLV; KVNSRHLVL; VNSRHLVLP; NSRHLVLPL; SRHLVLPLE; RHLVLPLEK; | |

Fig. 28 continued

| | | |
|---|---|---|
| | HLVLPLEKY; LVLPLEKYP; VLPLEKYPK; LPLEKYPKL; PLEKYPKLT; LEKYPKLTD; EKYPKLTDF; KYPKLTDFG; YPKLTDFGE; PKLTDFGEA; KLTDFGEAN; LTDFGEANK; TDFGEANKI; DFGEANKIF; FGEANKIFI; GEANKIFIE; EANKIFIEK; ANKIFIEKA; NKIFIEKAV; KIFIEKAVD; IFIEKAVDL; FIEKAVDLG; IEKAVDLGV; EKAVDLGVQ; KAVDLGVQA; AVDLGVQAL; VDLGVQALA; DLGVQALAG; LGVQALAGA; GVQALAGAL; VQALAGALD; QALAGALDE; ALAGALDES; LAGALDESG; AGALDESGL; GALDESGLR; ALDESGLRP; LDESGLRPE; DESGLRPED; ESGLRPEDL; SGLRPEDLD; GLRPEDLDV; LRPEDLDVL; RPEDLDVLI; PEDLDVLIT; EDLDVLITA; DLDVLITAT; LDVLITATV; DVLITATVT; VLITATVTG; LITATVTGL; ITATVTGLA; TATVTGLAV; ATVTGLAVP; TVTGLAVPS; VTGLAVPSL; TGLAVPSLD; GLAVPSLDA; LAVPSLDAR; AVPSLDARI; VPSLDARIA; PSLDARIAG; SLDARIAGR; LDARIAGRL; DARIAGRLG; ARIAGRLGL; RIAGRLGLR; IAGRLGLRA; AGRLGLRAD; GRLGLRADV; RLGLRADVR; LGLRADVRR; GLRADVRRV; LRADVRRVP; RADVRRVPL; ADVRRVPLF; DVRRVPLFG; VRRVPLFGL; RRVPLFGLG; RVPLFGLGC; VPLFGLGCV; PLFGLGCVA; LFGLGCVAG; FGLGCVAGA; GLGCVAGAA; LGCVAGAAG; GCVAGAAGV; CVAGAAGVA; VAGAAGVAR; AGAAGVARL; GAAGVARLH; AAGVARLHD; AGVARLHDY; GVARLHDYL; VARLHDYLR; ARLHDYLRG; RLHDYLRGA; LHDYLRGAP; HDYLRGAPD; DYLRGAPDG; YLRGAPDGV; LRGAPDGVA; RGAPDGVAA; GAPDGVAAL; APDGVAALV; PDGVAALVS; DGVAALVSV; GVAALVSVE; VAALVSVEL; AALVSVELC; ALVSVELCS; LVSVELCSL; VSVELCSLT; SVELCSLTY; VELCSLTYP; ELCSLTYPG; LCSLTYPGY; CSLTYPGYK; SLTYPGYKP; LTYPGYKPT; TYPGYKPTL; YPGYKPTLP; PGYKPTLPG; GYKPTLPGL; YKPTLPGLV; KPTLPGLVG; PTLPGLVGS; TLPGLVGSA; LPGLVGSAL; PGLVGSALF; GLVGSALFA; LVGSALFAD; VGSALFADG; GSALFADGA; SALFADGAA; ALFADGAAA; LFADGAAAV; FADGAAAVV; ADGAAAVVA; DGAAAVVAA; GAAAVVAAG; AAAVVAAGV; AAVVAAGVK; AVVAAGVKR; VVAAGVKRA; VAAGVKRAQ; AAGVKRAQD; AGVKRAQDI; GVKRAQDIG; VKRAQDIGA; KRAQDIGAD; RAQDIGADG; AQDIGADGP; QDIGADGPD; DIGADGPDI; IGADGPDIL; GADGPDILD; ADGPDILDS; DGPDILDSR; GPDILDSRS; PDILDSRSH; DILDSRSHL; ILDSRSHLY; LDSRSHLYP; DSRSHLYPD; SRSHLYPDS; RSHLYPDSL; SHLYPDSLR; HLYPDSLRT; LYPDSLRTM; YPDSLRTMG; PDSLRTMGY; DSLRTMGYD; SLRTMGYDV; LRTMGYDVG; RTMGYDVGS; TMGYDVGSA; MGYDVGSAG; GYDVGSAGF; YDVGSAGFE; DVGSAGFEL; VGSAGFELV; GSAGFELVL; SAGFELVLS; AGFELVLSR; GFELVLSRD; FELVLSRDL; ELVLSRDLA; LVLSRDLAA; VLSRDLAAV; LSRDLAAVV; SRDLAAVVE; RDLAAVVEQ; DLAAVVEQY; LAAVVEQYL; AAVVEQYLG; AVVEQYLGN; VVEQYLGND; VEQYLGNDV; EQYLGNDVT; QYLGNDVTT; YLGNDVTTF; LGNDVTTFL; GNDVTTFLA; NDVTTFLAS; DVTTFLASH; VTTFLASHG; TTFLASHGL; TFLASHGLS; FLASHGLST; LASHGLSTT; ASHGLSTTD; SHGLSTTDV; HGLSTTDVG; GLSTTDVGA; LSTTDVGAW; STTDVGAWV; TTDVGAWVT; TDVGAWVTH; DVGAWVTHP; VGAWVTHPG; GAWVTHPGG; AWVTHPGGP; WVTHPGGPK; VTHPGGPKI; THPGGPKII; HPGGPKIIN; PGGPKIINA; GGPKIINAI; GPKIINAIT; PKIINAITE; KIINAITET; IINAITETL; | |

Fig. 28 continued

| | | |
|---|---|---|
| | INAITETLD; NAITETLDL; AITETLDLS; ITETLDLSP; TETLDLSPQ; ETLDLSPQA; TLDLSPQAL; LDLSPQALE; DLSPQALEL; LSPQALELT; SPQALELTW; PQALELTWR; QALELTWRS; ALELTWRSL; LELTWRSLG; ELTWRSLGE; LTWRSLGEI; TWRSLGEIG; WRSLGEIGN; RSLGEIGNL; SLGEIGNLS; LGEIGNLSS; GEIGNLSSA; EIGNLSSAS; IGNLSSASV; GNLSSASVL; NLSSASVLH; LSSASVLHV; SSASVLHVL; SASVLHVLR; ASVLHVLRD; SVLHVLRDT; VLHVLRDTI; LHVLRDTIA; HVLRDTIAK; VLRDTIAKP; LRDTIAKPP; RDTIAKPPP; DTIAKPPPS; TIAKPPPSG; IAKPPPSGS; AKPPPSGSP; KPPPSGSPG; PPPSGSPGL; PPSGSPGLM; PSGSPGLMI; SGSPGLMIA; GSPGLMIAM; SPGLMIAMG; PGLMIAMGP; GLMIAMGPG; LMIAMGPGF; MIAMGPGFC; IAMGPGFCS; AMGPGFCSE; MGPGFCSEL; GPGFCSELV; PGFCSELVL; GFCSELVLL; FCSELVLLR; CSELVLLRW; SELVLLRWH<br><br>10 mers:<br>MSVIAGVFGA; SVIAGVFGAL; VIAGVFGALP; IAGVFGALPP; AGVFGALPPY; GVFGALPPYR; VFGALPPYRY; FGALPPYRYS; GALPPYRYSQ; ALPPYRYSQR; LPPYRYSQRE; PPYRYSQREL; PYRYSQRELT; YRYSQRELTD; RYSQRELTDS; YSQRELTDSF; SQRELTDSFV; QRELTDSFVS; RELTDSFVSI; ELTDSFVSIP; LTDSFVSIPD; TDSFVSIPDF; DSFVSIPDFE; SFVSIPDFEG; FVSIPDFEGY; VSIPDFEGYE; SIPDFEGYED; IPDFEGYEDI; PDFEGYEDIV; DFEGYEDIVR; FEGYEDIVRQ; EGYEDIVRQL; GYEDIVRQLH; YEDIVRQLHA; EDIVRQLHAS; DIVRQLHASA; IVRQLHASAK; VRQLHASAKV; RQLHASAKVN; QLHASAKVNS; LHASAKVNSR; HASAKVNSRH; ASAKVNSRHL; SAKVNSRHLV; AKVNSRHLVL; KVNSRHLVLP; VNSRHLVLPL; NSRHLVLPLE; SRHLVLPLEK; RHLVLPLEKY; HLVLPLEKYP; LVLPLEKYPK; VLPLEKYPKL; LPLEKYPKLT; PLEKYPKLTD; LEKYPKLTDF; EKYPKLTDFG; KYPKLTDFGE; YPKLTDFGEA; PKLTDFGEAN; KLTDFGEANK; LTDFGEANKI; TDFGEANKIF; DFGEANKIFI; FGEANKIFIE; GEANKIFIEK; EANKIFIEKA; ANKIFIEKAV; NKIFIEKAVD; KIFIEKAVDL; IFIEKAVDLG; FIEKAVDLGV; IEKAVDLGVQ; EKAVDLGVQA; KAVDLGVQAL; AVDLGVQALA; VDLGVQALAG; DLGVQALAGA; LGVQALAGAL; GVQALAGALD; VQALAGALDE; QALAGALDES; ALAGALDESG; LAGALDESGL; AGALDESGLR; GALDESGLRP; ALDESGLRPE; LDESGLRPED; DESGLRPEDL; ESGLRPEDLD; SGLRPEDLDV; GLRPEDLDVL; LRPEDLDVLI; RPEDLDVLIT; PEDLDVLITA; EDLDVLITAT; DLDVLITATV; LDVLITATVT; DVLITATVTG; VLITATVTGL; LITATVTGLA; ITATVTGLAV; TATVTGLAVP; ATVTGLAVPS; TVTGLAVPSL; VTGLAVPSLD; TGLAVPSLDA; GLAVPSLDAR; LAVPSLDARI; AVPSLDARIA; VPSLDARIAG; PSLDARIAGR; SLDARIAGRL; LDARIAGRLG; DARIAGRLGL; ARIAGRLGLR; RIAGRLGLRA; IAGRLGLRAD; AGRLGLRADV; GRLGLRADVR; RLGLRADVRR; LGLRADVRRV; GLRADVRRVP; LRADVRRVPL; RADVRRVPLF; ADVRRVPLFG; DVRRVPLFGL; VRRVPLFGLG; RRVPLFGLGC; RVPLFGLGCV; VPLFGLGCVA; PLFGLGCVAG; LFGLGCVAGA; FGLGCVAGAA; GLGCVAGAAG; LGCVAGAAGV; GCVAGAAGVA; CVAGAAGVAR; VAGAAGVARL; AGAAGVARLH; GAAGVARLHD; AAGVARLHDY; AGVARLHDYL; GVARLHDYLR; VARLHDYLRG; ARLHDYLRGA; RLHDYLRGAP; LHDYLRGAPD; HDYLRGAPDG; | |

Fig. 28 continued

| | | |
|---|---|---|
| | DYLRGAPDGV; YLRGAPDGVA; LRGAPDGVAA; RGAPDGVAAL; GAPDGVAALV; APDGVAALVS; PDGVAALVSV; DGVAALVSVE; GVAALVSVEL; VAALVSVELC; AALVSVELCS; ALVSVELCSL; LVSVELCSLT; VSVELCSLTY; SVELCSLTYP; VELCSLTYPG; ELCSLTYPGY; LCSLTYPGYK; CSLTYPGYKP; SLTYPGYKPT; LTYPGYKPTL; TYPGYKPTLP; YPGYKPTLPG; PGYKPTLPGL; GYKPTLPGLV; YKPTLPGLVG; KPTLPGLVGS; PTLPGLVGSA; TLPGLVGSAL; LPGLVGSALF; PGLVGSALFA; GLVGSALFAD; LVGSALFADG; VGSALFADGA; GSALFADGAA; SALFADGAAA; ALFADGAAAV; LFADGAAAVV; FADGAAAVVA; ADGAAAVVAA; DGAAAVVAAG; GAAAVVAAGV; AAAVVAAGVK; AAVVAAGVKR; AVVAAGVKRA; VVAAGVKRAQ; VAAGVKRAQD; AAGVKRAQDI; AGVKRAQDIG; GVKRAQDIGA; VKRAQDIGAD; KRAQDIGADG; RAQDIGADGP; AQDIGADGPD; QDIGADGPDI; DIGADGPDIL; IGADGPDILD; GADGPDILDS; ADGPDILDSR; DGPDILDSRS; GPDILDSRSH; PDILDSRSHL; DILDSRSHLY; ILDSRSHLYP; LDSRSHLYPD; DSRSHLYPDS; SRSHLYPDSL; RSHLYPDSLR; SHLYPDSLRT; HLYPDSLRTM; LYPDSLRTMG; YPDSLRTMGY; PDSLRTMGYD; DSLRTMGYDV; SLRTMGYDVG; LRTMGYDVGS; RTMGYDVGSA; TMGYDVGSAG; MGYDVGSAGF; GYDVGSAGFE; YDVGSAGFEL; DVGSAGFELV; VGSAGFELVL; GSAGFELVLS; SAGFELVLSR; AGFELVLSRD; GFELVLSRDL; FELVLSRDLA; ELVLSRDLAA; LVLSRDLAAV; VLSRDLAAVV; LSRDLAAVVE; SRDLAAVVEQ; RDLAAVVEQY; DLAAVVEQYL; LAAVVEQYLG; AAVVEQYLGN; AVVEQYLGND; VVEQYLGNDV; VEQYLGNDVT; EQYLGNDVTT; QYLGNDVTTF; YLGNDVTTFL; LGNDVTTFLA; GNDVTTFLAS; NDVTTFLASH; DVTTFLASHG; VTTFLASHGL; TTFLASHGLS; TFLASHGLST; FLASHGLSTT; LASHGLSTTD; ASHGLSTTDV; SHGLSTTDVG; HGLSTTDVGA; GLSTTDVGAW; LSTTDVGAWV; STTDVGAWVT; TTDVGAWVTH; TDVGAWVTHP; DVGAWVTHPG; VGAWVTHPGG; GAWVTHPGGP; AWVTHPGGPK; WVTHPGGPKI; VTHPGGPKII; THPGGPKIIN; HPGGPKIINA; PGGPKIINAI; GGPKIINAIT; GPKIINAITE; PKIINAITET; KIINAITETL; IINAITETLD; INAITETLDL; NAITETLDLS; AITETLDLSP; ITETLDLSPQ; TETLDLSPQA; ETLDLSPQAL; TLDLSPQALE; LDLSPQALEL; DLSPQALELT; LSPQALELTW; SPQALELTWR; PQALELTWRS; QALELTWRSL; ALELTWRSLG; LELTWRSLGE; ELTWRSLGEI; LTWRSLGEIG; TWRSLGEIGN; WRSLGEIGNL; RSLGEIGNLS; SLGEIGNLSS; LGEIGNLSSA; GEIGNLSSAS; EIGNLSSASV; IGNLSSASVL; GNLSSASVLH; NLSSASVLHV; LSSASVLHVL; SSASVLHVLR; SASVLHVLRD; ASVLHVLRDT; SVLHVLRDTI; VLHVLRDTIA; LHVLRDTIAK; HVLRDTIAKP; VLRDTIAKPP; LRDTIAKPPP; RDTIAKPPPS; DTIAKPPPSG; TIAKPPPSGS; IAKPPPSGSP; AKPPPSGSPG; KPPPSGSPGL; PPPSGSPGLM; PPSGSPGLMI; PSGSPGLMIA; SGSPGLMIAM; GSPGLMIAMG; SPGLMIAMGP; PGLMIAMGPG; GLMIAMGPGF; LMIAMGPGFC; MIAMGPGFCS; IAMGPGFCSE; AMGPGFCSEL; MGPGFCSELV; GPGFCSELVL; PGFCSELVLL; GFCSELVLLR; FCSELVLLRW; CSELVLLRWH<br><br>11 mers:<br>MSVIAGVFGAL; SVIAGVFGALP; VIAGVFGALPP; IAGVFGALPPY; AGVFGALPPYR; GVFGALPPYRY; VFGALPPYRYS; FGALPPYRYSQ; | |

Fig. 28 continued

| | | |
|---|---|---|
| | GALPPYRYSQR; ALPPYRYSQRE; LPPYRYSQREL; PPYRYSQRELT; PYRYSQRELTD; YRYSQRELTDS; RYSQRELTDSF; YSQRELTDSFV; SQRELTDSFVS; QRELTDSFVSI; RELTDSFVSIP; ELTDSFVSIPD; LTDSFVSIPDF; TDSFVSIPDFE; DSFVSIPDFEG; SFVSIPDFEGY; FVSIPDFEGYE; VSIPDFEGYED; SIPDFEGYEDI; IPDFEGYEDIV; PDFEGYEDIVR; DFEGYEDIVRQ; FEGYEDIVRQL; EGYEDIVRQLH; GYEDIVRQLHA; YEDIVRQLHAS; EDIVRQLHASA; DIVRQLHASAK; IVRQLHASAKV; VRQLHASAKVN; RQLHASAKVNS; QLHASAKVNSR; LHASAKVNSRH; HASAKVNSRHL; ASAKVNSRHLV; SAKVNSRHLVL; AKVNSRHLVLP; KVNSRHLVLPL; VNSRHLVLPLE; NSRHLVLPLEK; SRHLVLPLEKY; RHLVLPLEKYP; HLVLPLEKYPK; LVLPLEKYPKL; VLPLEKYPKLT; LPLEKYPKLTD; PLEKYPKLTDF; LEKYPKLTDFG; EKYPKLTDFGE; KYPKLTDFGEA; YPKLTDFGEAN; PKLTDFGEANK; KLTDFGEANKI; LTDFGEANKIF; TDFGEANKIFI; DFGEANKIFIE; FGEANKIFIEK; GEANKIFIEKA; EANKIFIEKAV; ANKIFIEKAVD; NKIFIEKAVDL; KIFIEKAVDLG; IFIEKAVDLGV; FIEKAVDLGVQ; IEKAVDLGVQA; EKAVDLGVQAL; KAVDLGVQALA; AVDLGVQALAG; VDLGVQALAGA; DLGVQALAGAL; LGVQALAGALD; GVQALAGALDE; VQALAGALDES; QALAGALDESG; ALAGALDESGL; LAGALDESGLR; AGALDESGLRP; GALDESGLRPE; ALDESGLRPED; LDESGLRPEDL; DESGLRPEDLD; ESGLRPEDLDV; SGLRPEDLDVL; GLRPEDLDVLI; LRPEDLDVLIT; RPEDLDVLITA; PEDLDVLITAT; EDLDVLITATV; DLDVLITATVT; LDVLITATVTG; DVLITATVTGL; VLITATVTGLA; LITATVTGLAV; ITATVTGLAVP; TATVTGLAVPS; ATVTGLAVPSL; TVTGLAVPSLD; VTGLAVPSLDA; TGLAVPSLDAR; GLAVPSLDARI; LAVPSLDARIA; AVPSLDARIAG; VPSLDARIAGR; PSLDARIAGRL; SLDARIAGRLG; LDARIAGRLGL; DARIAGRLGLR; ARIAGRLGLRA; RIAGRLGLRAD; IAGRLGLRADV; AGRLGLRADVR; GRLGLRADVRR; RLGLRADVRRV; LGLRADVRRVP; GLRADVRRVPL; LRADVRRVPLF; RADVRRVPLFG; ADVRRVPLFGL; DVRRVPLFGLG; VRRVPLFGLGC; RRVPLFGLGCV; RVPLFGLGCVA; VPLFGLGCVAG; PLFGLGCVAGA; LFGLGCVAGAA; FGLGCVAGAAG; GLGCVAGAAGV; LGCVAGAAGVA; GCVAGAAGVAR; CVAGAAGVARL; VAGAAGVARLH; AGAAGVARLHD; GAAGVARLHDY; AAGVARLHDYL; AGVARLHDYLR; GVARLHDYLRG; VARLHDYLRGA; ARLHDYLRGAP; RLHDYLRGAPD; LHDYLRGAPDG; HDYLRGAPDGV; DYLRGAPDGVA; YLRGAPDGVAA; LRGAPDGVAAL; RGAPDGVAALV; GAPDGVAALVS; APDGVAALVSV; PDGVAALVSVE; DGVAALVSVEL; GVAALVSVELC; VAALVSVELCS; AALVSVELCSL; ALVSVELCSLT; LVSVELCSLTY; VSVELCSLTYP; SVELCSLTYPG; VELCSLTYPGY; ELCSLTYPGYK; LCSLTYPGYKP; CSLTYPGYKPT; SLTYPGYKPTL; LTYPGYKPTLP; TYPGYKPTLPG; YPGYKPTLPGL; PGYKPTLPGLV; GYKPTLPGLVG; YKPTLPGLVGS; KPTLPGLVGSA; PTLPGLVGSAL; TLPGLVGSALF; LPGLVGSALFA; PGLVGSALFAD; GLVGSALFADG; LVGSALFADGA; VGSALFADGAA; GSALFADGAAA; SALFADGAAAV; ALFADGAAAVV; LFADGAAAVVA; FADGAAAVVAA; ADGAAAVVAAG; DGAAAVVAAGV; GAAAVVAAGVK; AAAVVAAGVKR; AAVVAAGVKRA; AVVAAGVKRAQ; VVAAGVKRAQD; VAAGVKRAQDI; AAGVKRAQDIG; AGVKRAQDIGA; GVKRAQDIGAD; VKRAQDIGADG; KRAQDIGADGP; RAQDIGADGPD; AQDIGADGPDI; QDIGADGPDIL; DIGADGPDILD; IGADGPDILDS; GADGPDILDSR; ADGPDILDSRS; DGPDILDSRSH; GPDILDSRSHL; PDILDSRSHLY; DILDSRSHLYP; ILDSRSHLYPD; LDSRSHLYPDS; DSRSHLYPDSL; SRSHLYPDSLR; RSHLYPDSLRT; | |

Fig. 28 continued

| | | |
|---|---|---|
| | SHLYPDSLRTM; HLYPDSLRTMG; LYPDSLRTMGY; YPDSLRTMGYD; PDSLRTMGYDV; DSLRTMGYDVG; SLRTMGYDVGS; LRTMGYDVGSA; RTMGYDVGSAG; TMGYDVGSAGF; MGYDVGSAGFE; GYDVGSAGFEL; YDVGSAGFELV; DVGSAGFELVL; VGSAGFELVLS; GSAGFELVLSR; SAGFELVLSRD; AGFELVLSRDL; GFELVLSRDLA; FELVLSRDLAA; ELVLSRDLAAV; LVLSRDLAAVV; VLSRDLAAVVE; LSRDLAAVVEQ; SRDLAAVVEQY; RDLAAVVEQYL; DLAAVVEQYLG; LAAVVEQYLGN; AAVVEQYLGND; AVVEQYLGNDV; VVEQYLGNDVT; VEQYLGNDVTT; EQYLGNDVTTF; QYLGNDVTTFL; YLGNDVTTFLA; LGNDVTTFLAS; GNDVTTFLASH; NDVTTFLASHG; DVTTFLASHGL; VTTFLASHGLS; TTFLASHGLST; TFLASHGLSTT; FLASHGLSTTD; LASHGLSTTDV; ASHGLSTTDVG; SHGLSTTDVGA; HGLSTTDVGAW; GLSTTDVGAWV; LSTTDVGAWVT; STTDVGAWVTH; TTDVGAWVTHP; TDVGAWVTHPG; DVGAWVTHPGG; VGAWVTHPGGP; GAWVTHPGGPK; AWVTHPGGPKI; WVTHPGGPKII; VTHPGGPKIIN; THPGGPKIINA; HPGGPKIINAI; PGGPKIINAIT; GGPKIINAITE; GPKIINAITET; PKIINAITETL; KIINAITETLD; IINAITETLDL; INAITETLDLS; NAITETLDLSP; AITETLDLSPQ; ITETLDLSPQA; TETLDLSPQAL; ETLDLSPQALE; TLDLSPQALEL; LDLSPQALELT; DLSPQALELTW; LSPQALELTWR; SPQALELTWRS; PQALELTWRSL; QALELTWRSLG; ALELTWRSLGE; LELTWRSLGEI; ELTWRSLGEIG; LTWRSLGEIGN; TWRSLGEIGNL; WRSLGEIGNLS; RSLGEIGNLSS; SLGEIGNLSSA; LGEIGNLSSAS; GEIGNLSSASV; EIGNLSSASVL; IGNLSSASVLH; GNLSSASVLHV; NLSSASVLHVL; LSSASVLHVLR; SSASVLHVLRD; SASVLHVLRDT; ASVLHVLRDTI; SVLHVLRDTIA; VLHVLRDTIAK; LHVLRDTIAKP; HVLRDTIAKPP; VLRDTIAKPPP; LRDTIAKPPPS; RDTIAKPPPSG; DTIAKPPPSGS; TIAKPPPSGSP; IAKPPPSGSPG; AKPPPSGSPGL; KPPPSGSPGLM; PPPSGSPGLMI; PPSGSPGLMIA; PSGSPGLMIAM; SGSPGLMIAMG; GSPGLMIAMGP; SPGLMIAMGPG; PGLMIAMGPGF; GLMIAMGPGFC; LMIAMGPGFCS; MIAMGPGFCSE; IAMGPGFCSEL; AMGPGFCSELV; MGPGFCSELVL; GPGFCSELVLL; PGFCSELVLLR; GFCSELVLLRW; FCSELVLLRWH | |
| 26) Rv1792 | 8 mers:<br>MATRFMTD; ATRFMTDP; TRFMTDPH; RFMTDPHA; FMTDPHAM; MTDPHAMR; TDPHAMRD; DPHAMRDM; PHAMRDMA; HAMRDMAG; AMRDMAGR; MRDMAGRF; RDMAGRFE; DMAGRFEV; MAGRFEVH; AGRFEVHA; GRFEVHAQ; RFEVHAQT; FEVHAQTV; EVHAQTVE; VHAQTVED; HAQTVEDE; AQTVEDEA; QTVEDEAR; TVEDEARR; VEDEARRM; EDEARRMW; DEARRMWA; EARRMWAS; ARRMWASA; RRMWASAQ; RMWASAQN; MWASAQNI; WASAQNIS; ASAQNISG; SAQNISGA; AQNISGAG; QNISGAGW; NISGAGWS; ISGAGWSG; SGAGWSGM; GAGWSGMA; AGWSGMAE; GWSGMAEA; WSGMAEAT; SGMAEATS; GMAEATSL; MAEATSLD; AEATSLDT; EATSLDTM; ATSLDTMA; TSLDTMAQ; SLDTMAQM; LDTMAQMN; DTMAQMNQ; TMAQMNQA; MAQMNQAF; AQMNQAFR; QMNQAFRN; MNQAFRNI; NQAFRNIV; QAFRNIVN; AFRNIVNM; FRNIVNML; RNIVNMLH; NIVNMLHG; IVNMLHGV; VNMLHGVR; NMLHGVRD; MLHGVRDG; LHGVRDGL; HGVRDGLV; GVRDGLVR; VRDGLVRD; RDGLVRDA; DGLVRDAN; GLVRDANN; LVRDANNY; VRDANNYE; RDANNYEQ; DANNYEQQ; ANNYEQQE; NNYEQQEQ; NYEQQEQA; YEQQEQAS; EQQEQASQ; QQEQASQQ; QEQASQQI; EQASQQIL; QASQQILS; ASQQILSS; | 22404-22761 |

Fig. 28 continued

| | | |
|---|---|---|
| | 9 mers:<br>MATRFMTDP; ATRFMTDPH; TRFMTDPHA; RFMTDPHAM;<br>FMTDPHAMR; MTDPHAMRD; TDPHAMRDM; DPHAMRDMA;<br>PHAMRDMAG; HAMRDMAGR; AMRDMAGRF; MRDMAGRFE;<br>RDMAGRFEV; DMAGRFEVH; MAGRFEVHA; AGRFEVHAQ;<br>GRFEVHAQT; RFEVHAQTV; FEVHAQTVE; EVHAQTVED;<br>VHAQTVEDE; HAQTVEDEA; AQTVEDEAR; QTVEDEARR;<br>TVEDEARRM; VEDEARRMW; EDEARRMWA; DEARRMWAS;<br>EARRMWASA; ARRMWASAQ; RRMWASAQN; RMWASAQNI;<br>MWASAQNIS; WASAQNISG; ASAQNISGA; SAQNISGAG;<br>AQNISGAGW; QNISGAGWS; NISGAGWSG; ISGAGWSGM;<br>SGAGWSGMA; GAGWSGMAE; AGWSGMAEA; GWSGMAEAT;<br>WSGMAEATS; SGMAEATSL; GMAEATSLD; MAEATSLDT;<br>AEATSLDTM; EATSLDTMA; ATSLDTMAQ; TSLDTMAQM;<br>SLDTMAQMN; LDTMAQMNQ; DTMAQMNQA; TMAQMNQAF;<br>MAQMNQAFR; AQMNQAFRN; QMNQAFRNI; MNQAFRNIV;<br>NQAFRNIVN; QAFRNIVNM; AFRNIVNML; FRNIVNMLH; RNIVNMLHG;<br>NIVNMLHGV; IVNMLHGVR; VNMLHGVRD; NMLHGVRDG;<br>MLHGVRDGL; LHGVRDGLV; HGVRDGLVR; GVRDGLVRD;<br>VRDGLVRDA; RDGLVRDAN; DGLVRDANN; GLVRDANNY;<br>LVRDANNYE; VRDANNYEQ; RDANNYEQQ; DANNYEQQE;<br>ANNYEQQEQ; NNYEQQEQA; NYEQQEQAS; YEQQEQASQ;<br>EQQEQASQQ; QQEQASQQI; QEQASQQIL; EQASQQILS;<br>QASQQILSS;<br><br>10 mers:<br>MATRFMTDPH; ATRFMTDPHA; TRFMTDPHAM; RFMTDPHAMR;<br>FMTDPHAMRD; MTDPHAMRDM; TDPHAMRDMA; DPHAMRDMAG;<br>PHAMRDMAGR; HAMRDMAGRF; AMRDMAGRFE; MRDMAGRFEV;<br>RDMAGRFEVH; DMAGRFEVHA; MAGRFEVHAQ; AGRFEVHAQT;<br>GRFEVHAQTV; RFEVHAQTVE; FEVHAQTVED; EVHAQTVEDE;<br>VHAQTVEDEA; HAQTVEDEAR; AQTVEDEARR; QTVEDEARRM;<br>TVEDEARRMW; VEDEARRMWA; EDEARRMWAS; DEARRMWASA;<br>EARRMWASAQ; ARRMWASAQN; RRMWASAQNI; RMWASAQNIS;<br>MWASAQNISG; WASAQNISGA; ASAQNISGAG; SAQNISGAGW;<br>AQNISGAGWS; QNISGAGWSG; NISGAGWSGM; ISGAGWSGMA;<br>SGAGWSGMAE; GAGWSGMAEA; AGWSGMAEAT; GWSGMAEATS;<br>WSGMAEATSL; SGMAEATSLD; GMAEATSLDT; MAEATSLDTM;<br>AEATSLDTMA; EATSLDTMAQ; ATSLDTMAQM; TSLDTMAQMN;<br>SLDTMAQMNQ; LDTMAQMNQA; DTMAQMNQAF; TMAQMNQAFR;<br>MAQMNQAFRN; AQMNQAFRNI; QMNQAFRNIV; MNQAFRNIVN;<br>NQAFRNIVNM; QAFRNIVNML; AFRNIVNMLH; FRNIVNMLHG;<br>RNIVNMLHGV; NIVNMLHGVR; IVNMLHGVRD; VNMLHGVRDG;<br>NMLHGVRDGL; MLHGVRDGLV; LHGVRDGLVR; HGVRDGLVRD;<br>GVRDGLVRDA; VRDGLVRDAN; RDGLVRDANN; DGLVRDANNY;<br>GLVRDANNYE; LVRDANNYEQ; VRDANNYEQQ; RDANNYEQQE;<br>DANNYEQQEQ; ANNYEQQEQA; NNYEQQEQAS; NYEQQEQASQ;<br>YEQQEQASQQ; EQQEQASQQI; QQEQASQQIL; QEQASQQILS;<br>EQASQQILSS;<br><br>11 mers:<br>MATRFMTDPHA; ATRFMTDPHAM; TRFMTDPHAMR; | |

Fig. 28 continued

| | | |
|---|---|---|
| | RFMTDPHAMRD; FMTDPHAMRDM; MTDPHAMRDMA; TDPHAMRDMAG; DPHAMRDMAGR; PHAMRDMAGRF; HAMRDMAGRFE; AMRDMAGRFEV; MRDMAGRFEVH; RDMAGRFEVHA; DMAGRFEVHAQ; MAGRFEVHAQT; AGRFEVHAQTV; GRFEVHAQTVE; RFEVHAQTVED; FEVHAQTVEDE; EVHAQTVEDEA; VHAQTVEDEAR; HAQTVEDEARR; AQTVEDEARRM; QTVEDEARRMW; TVEDEARRMWA; VEDEARRMWAS; EDEARRMWASA; DEARRMWASAQ; EARRMWASAQN; ARRMWASAQNI; RRMWASAQNIS; RMWASAQNISG; MWASAQNISGA; WASAQNISGAG; ASAQNISGAGW; SAQNISGAGWS; AQNISGAGWSG; QNISGAGWSGM; NISGAGWSGMA; ISGAGWSGMAE; SGAGWSGMAEA; GAGWSGMAEAT; AGWSGMAEATS; GWSGMAEATSL; WSGMAEATSLD; SGMAEATSLDT; GMAEATSLDTM; MAEATSLDTMA; AEATSLDTMAQ; EATSLDTMAQM; ATSLDTMAQMN; TSLDTMAQMNQ; SLDTMAQMNQA; LDTMAQMNQAF; DTMAQMNQAFR; TMAQMNQAFRN; MAQMNQAFRNI; AQMNQAFRNIV; QMNQAFRNIVN; MNQAFRNIVNM; NQAFRNIVNML; QAFRNIVNMLH; AFRNIVNMLHG; FRNIVNMLHGV; RNIVNMLHGVR; NIVNMLHGVRD; IVNMLHGVRDG; VNMLHGVRDGL; NMLHGVRDGLV; MLHGVRDGLVR; LHGVRDGLVRD; HGVRDGLVRDA; GVRDGLVRDAN; VRDGLVRDANN; RDGLVRDANNY; DGLVRDANNYE; GLVRDANNYEQ; LVRDANNYEQQ; VRDANNYEQQE; RDANNYEQQEQ; DANNYEQQEQA; ANNYEQQEQAS; NNYEQQEQASQ; NYEQQEQASQQ; YEQQEQASQQI; EQQEQASQQIL; QQEQASQQILS; QEQASQQILSS; | |
| 27) Rv1793 | 8 mers:<br>MTINYQFG; TINYQFGD; INYQFGDV; NYQFGDVD; YQFGDVDA; QFGDVDAH; FGDVDAHG; GDVDAHGA; DVDAHGAM; VDAHGAMI; DAHGAMIR; AHGAMIRA; HGAMIRAQ; GAMIRAQA; AMIRAQAA; MIRAQAAS; IRAQAASL; RAQAASLE; AQAASLEA; QAASLEAE; AASLEAEH; ASLEAEHQ; SLEAEHQA; LEAEHQAI; EAEHQAIV; AEHQAIVR; EHQAIVRD; HQAIVRDV; QAIVRDVL; AIVRDVLA; IVRDVLAA; VRDVLAAG; RDVLAAGD; DVLAAGDF; VLAAGDFW; LAAGDFWG; AAGDFWGG; AGDFWGGA; GDFWGGAG; DFWGGAGS; FWGGAGSV; WGGAGSVA; GGAGSVAC; GAGSVACQ; AGSVACQE; GSVACQEF; SVACQEFI; VACQEFIT; ACQEFITQ; CQEFITQL; QEFITQLG; EFITQLGR; FITQLGRN; ITQLGRNF; TQLGRNFQ; QLGRNFQV; LGRNFQVI; GRNFQVIY; RNFQVIYE; NFQVIYEQ; FQVIYEQA; QVIYEQAN; VIYEQANA; IYEQANAH; YEQANAHG; EQANAHGQ; QANAHGQK; ANAHGQKV; NAHGQKVQ; AHGQKVQA; HGQKVQAA; GQKVQAAG; QKVQAAGN; KVQAAGNN; VQAAGNNM; QAAGNNMA; AAGNNMAQ; AGNNMAQT; GNNMAQTD; NNMAQTDS; NMAQTDSA; MAQTDSAV; AQTDSAVG; QTDSAVGS; TDSAVGSS; DSAVGSSW; SAVGSSWA<br><br>9 mers:<br>MTINYQFGD; TINYQFGDV; INYQFGDVD; NYQFGDVDA; YQFGDVDAH; QFGDVDAHG; FGDVDAHGA; GDVDAHGAM; DVDAHGAMI; VDAHGAMIR; DAHGAMIRA; AHGAMIRAQ; HGAMIRAQA; GAMIRAQAA; AMIRAQAAS; MIRAQAASL; IRAQAASLE; | 22762-23103 |

Fig. 28 continued

| | | |
|---|---|---|
| | RAQAASLEA; AQAASLEAE; QAASLEAEH; AASLEAEHQ; ASLEAEHQA; SLEAEHQAI; LEAEHQAIV; EAEHQAIVR; AEHQAIVRD; EHQAIVRDV; HQAIVRDVL; QAIVRDVLA; AIVRDVLAA; IVRDVLAAG; VRDVLAAGD; RDVLAAGDF; DVLAAGDFW; VLAAGDFWG; LAAGDFWGG; AAGDFWGGA; AGDFWGGAG; GDFWGGAGS; DFWGGAGSV; FWGGAGSVA; WGGAGSVAC; GGAGSVACQ; GAGSVACQE; AGSVACQEF; GSVACQEFI; SVACQEFIT; VACQEFITQ; ACQEFITQL; CQEFITQLG; QEFITQLGR; EFITQLGRN; FITQLGRNF; ITQLGRNFQ; TQLGRNFQV; QLGRNFQVI; LGRNFQVIY; GRNFQVIYE; RNFQVIYEQ; NFQVIYEQA; FQVIYEQAN; QVIYEQANA; VIYEQANAH; IYEQANAHG; YEQANAHGQ; EQANAHGQK; QANAHGQKV; ANAHGQKVQ; NAHGQKVQA; AHGQKVQAA; HGQKVQAAG; GQKVQAAGN; QKVQAAGNN; KVQAAGNNM; VQAAGNNMA; QAAGNNMAQ; AAGNNMAQT; AGNNMAQTD; GNNMAQTDS; NNMAQTDSA; NMAQTDSAV; MAQTDSAVG; AQTDSAVGS; QTDSAVGSS; TDSAVGSSW; DSAVGSSWA<br><br>10 mers:<br>MTINYQFGDV; TINYQFGDVD; INYQFGDVDA; NYQFGDVDAH; YQFGDVDAHG; QFGDVDAHGA; FGDVDAHGAM; GDVDAHGAMI; DVDAHGAMIR; VDAHGAMIRA; DAHGAMIRAQ; AHGAMIRAQA; HGAMIRAQAA; GAMIRAQAAS; AMIRAQAASL; MIRAQAASLE; IRAQAASLEA; RAQAASLEAE; AQAASLEAEH; QAASLEAEHQ; AASLEAEHQA; ASLEAEHQAI; SLEAEHQAIV; LEAEHQAIVR; EAEHQAIVRD; AEHQAIVRDV; EHQAIVRDVL; HQAIVRDVLA; QAIVRDVLAA; AIVRDVLAAG; IVRDVLAAGD; VRDVLAAGDF; RDVLAAGDFW; DVLAAGDFWG; VLAAGDFWGG; LAAGDFWGGA; AAGDFWGGAG; AGDFWGGAGS; GDFWGGAGSV; DFWGGAGSVA; FWGGAGSVAC; WGGAGSVACQ; GGAGSVACQE; GAGSVACQEF; AGSVACQEFI; GSVACQEFIT; SVACQEFITQ; VACQEFITQL; ACQEFITQLG; CQEFITQLGR; QEFITQLGRN; EFITQLGRNF; FITQLGRNFQ; ITQLGRNFQV; TQLGRNFQVI; QLGRNFQVIY; LGRNFQVIYE; GRNFQVIYEQ; RNFQVIYEQA; NFQVIYEQAN; FQVIYEQANA; QVIYEQANAH; VIYEQANAHG; IYEQANAHGQ; YEQANAHGQK; EQANAHGQKV; QANAHGQKVQ; ANAHGQKVQA; NAHGQKVQAA; AHGQKVQAAG; HGQKVQAAGN; GQKVQAAGNN; QKVQAAGNNM; KVQAAGNNMA; VQAAGNNMAQ; QAAGNNMAQT; AAGNNMAQTD; AGNNMAQTDS; GNNMAQTDSA; NNMAQTDSAV; NMAQTDSAVG; MAQTDSAVGS; AQTDSAVGSS; QTDSAVGSSW; TDSAVGSSWA<br><br>11 mers:<br>MTINYQFGDVD; TINYQFGDVDA; INYQFGDVDAH; NYQFGDVDAHG; YQFGDVDAHGA; QFGDVDAHGAM; FGDVDAHGAMI; GDVDAHGAMIR; DVDAHGAMIRA; VDAHGAMIRAQ; DAHGAMIRAQA; AHGAMIRAQAA; HGAMIRAQAAS; GAMIRAQAASL; AMIRAQAASLE; MIRAQAASLEA; IRAQAASLEAE; RAQAASLEAEH; AQAASLEAEHQ; QAASLEAEHQA; AASLEAEHQAI; ASLEAEHQAIV; SLEAEHQAIVR; LEAEHQAIVRD; EAEHQAIVRDV; AEHQAIVRDVL; EHQAIVRDVLA; HQAIVRDVLAA; QAIVRDVLAAG; AIVRDVLAAGD; IVRDVLAAGDF; VRDVLAAGDFW; RDVLAAGDFWG; DVLAAGDFWGG; VLAAGDFWGGA; LAAGDFWGGAG; AAGDFWGGAGS; AGDFWGGAGSV; GDFWGGAGSVA; DFWGGAGSVAC; | |

Fig. 28 continued

| | | |
|---|---|---|
| | FWGGAGSVACQ; WGGAGSVACQE; GGAGSVACQEF; GAGSVACQEFI; AGSVACQEFIT; GSVACQEFITQ; SVACQEFITQL; VACQEFITQLG; ACQEFITQLGR; CQEFITQLGRN; QEFITQLGRNF; EFITQLGRNFQ; FITQLGRNFQV; ITQLGRNFQVI; TQLGRNFQVIY; QLGRNFQVIYE; LGRNFQVIYEQ; GRNFQVIYEQA; RNFQVIYEQAN; NFQVIYEQANA; FQVIYEQANAH; QVIYEQANAHG; VIYEQANAHGQ; IYEQANAHGQK; YEQANAHGQKV; EQANAHGQKVQ; QANAHGQKVQA; ANAHGQKVQAA; NAHGQKVQAAG; AHGQKVQAAGN; HGQKVQAAGNN; GQKVQAAGNNM; QKVQAAGNNMA; KVQAAGNNMAQ; VQAAGNNMAQT; QAAGNNMAQTD; AAGNNMAQTDS; AGNNMAQTDSA; GNNMAQTDSAV; NNMAQTDSAVG; NMAQTDSAVGS; MAQTDSAVGSS; AQTDSAVGSSW; QTDSAVGSSWA | |
| 28) Rv1809 | 8 mers:<br>MDFGLQPP; DFGLQPPE; FGLQPPEI; GLQPPEIT; LQPPEITS; QPPEITSG; PPEITSGE; PEITSGEM; EITSGEMY; ITSGEMYL; TSGEMYLG; SGEMYLGP; GEMYLGPG; EMYLGPGA; MYLGPGAG; YLGPGAGP; LGPGAGPM; GPGAGPML; PGAGPMLA; GAGPMLAA; AGPMLAAA; GPMLAAAV; PMLAAAVA; MLAAAVAW; LAAAVAWD; AAAVAWDG; AAVAWDGL; AVAWDGLA; VAWDGLAA; AWDGLAAE; WDGLAAEL; DGLAAELQ; GLAAELQS; LAAELQSM; AAELQSMA; AELQSMAA; ELQSMAAS; LQSMAASY; QSMAASYA; SMAASYAS; MAASYASI; AASYASIV; ASYASIVE; SYASIVEG; YASIVEGM; ASIVEGMA; SIVEGMAS; IVEGMASE; VEGMASES; EGMASESW; GMASESWL; MASESWLG; ASESWLGP; SESWLGPS; ESWLGPSS; SWLGPSSA; WLGPSSAG; LGPSSAGM; GPSSAGMA; PSSAGMAA; SSAGMAAA; SAGMAAAA; AGMAAAAA; GMAAAAAP; MAAAAAPY; AAAAAPYV; AAAAPYVT; AAAPYVTW; AAPYVTWM; APYVTWMS; PYVTWMSG; YVTWMSGT; VTWMSGTS; TWMSGTSA; WMSGTSAQ; MSGTSAQA; SGTSAQAK; GTSAQAKA; TSAQAKAA; SAQAKAAA; AQAKAAAD; QAKAAADQ; AKAAADQA; KAAADQAR; AAADQARA; AADQARAA; ADQARAAV; DQARAAVV; QARAAVVA; ARAAVVAY; RAAVVAYE; AAVVAYET; AVVAYETA; VVAYETAF; VAYETAFA; AYETAFAA; YETAFAAV; ETAFAAVV; TAFAAVVP; AFAAVVPP; FAAVVPPP; AAVVPPPQ; AVVPPPQI; VVPPPQIA; VPPPQIAA; PPPQIAAN; PPQIAANR; PQIAANRS; QIAANRSQ; IAANRSQL; AANRSQLI; ANRSQLIS; NRSQLISL; RSQLISLV; SQLISLVA; QLISLVAT; LISLVATN; ISLVATNI; SLVATNIF; LVATNIFG; VATNIFGQ; ATNIFGQN; TNIFGQNT; NIFGQNTA; IFGQNTAA; FGQNTAAI; GQNTAAIA; QNTAAIAA; NTAAIAAT; TAAIAATE; AAIAATEA; AIAATEAE; IAATEAEY; AATEAEYG; ATEAEYGE; TEAEYGEM; EAEYGEMW; AEYGEMWA; EYGEMWAQ; YGEMWAQD; GEMWAQDT; EMWAQDTM; MWAQDTMA; WAQDTMAM; AQDTMAMF; QDTMAMFG; DTMAMFGY; TMAMFGYA; MAMFGYAS; AMFGYASS; MFGYASSS; FGYASSSA; GYASSSAT; YASSSATA; ASSSATAS; SSSATASR; SSATASRL; SATASRLT; ATASRLTP; TASRLTPF; ASRLTPFT; SRLTPFTA; RLTPFTAP; LTPFTAPP; TPFTAPPQ; PFTAPPQT; FTAPPQTT; TAPPQTTN; APPQTTNP; PPQTTNPS; PQTTNPSG; QTTNPSGL; TTNPSGLA; TNPSGLAG; NPSGLAGQ; PSGLAGQA; SGLAGQAA; GLAGQAAA; LAGQAAAT; AGQAAATG; GQAAATGQ; QAAATGQA; AAATGQAT; AATGQATA; ATGQATAL; TGQATALA; GQATALAS; QATALASG; ATALASGT; TALASGTN; ALASGTNA; LASGTNAV; ASGTNAVT; SGTNAVTT; | 23104-24941 |

Fig. 28 continued

| | | |
|---|---|---|
| | GTNAVTTA; TNAVTTAL; NAVTTALS; AVTTALSS; VTTALSSA;<br>TTALSSAA; TALSSAAA; ALSSAAAQ; LSSAAAQF; SSAAAQFP;<br>SAAAQFPF; AAAQFPFD; AAQFPFDI; AQFPFDII; QFPFDIIP;<br>FPFDIIPT; PFDIIPTL; FDIIPTLL; DIIPTLLQ; IIPTLLQG; IPTLLQGL;<br>PTLLQGLA; TLLQGLAT; LLQGLATL; LQGLATLS; QGLATLST;<br>GLATLSTQ; LATLSTQY; ATLSTQYT; TLSTQYTQ; LSTQYTQL;<br>STQYTQLM; TQYTQLMG; QYTQLMGQ; YTQLMGQL; TQLMGQLI;<br>QLMGQLIN; LMGQLINA; MGQLINAI; GQLINAIF; QLINAIFG;<br>LINAIFGP; INAIFGPT; NAIFGPTG; AIFGPTGA; IFGPTGAT;<br>FGPTGATT; GPTGATTY; PTGATTYQ; TGATTYQN; GATTYQNV;<br>ATTYQNVF; TTYQNVFV; TYQNVFVT; YQNVFVTA; QNVFVTAA;<br>NVFVTAAN; VFVTAANV; FVTAANVT; VTAANVTK; TAANVTKF;<br>AANVTKFS; ANVTKFST; NVTKFSTW; VTKFSTWA; TKFSTWAN;<br>KFSTWAND; FSTWANDA; STWANDAM; TWANDAMS; WANDAMSA;<br>ANDAMSAP; NDAMSAPN; DAMSAPNL; AMSAPNLG; MSAPNLGM;<br>SAPNLGMT; APNLGMTE; PNLGMTEF; NLGMTEFK; LGMTEFKV;<br>GMTEFKVF; MTEFKVFW; TEFKVFWQ; EFKVFWQP; FKVFWQPP;<br>KVFWQPPP; VFWQPPPA; FWQPPPAP; WQPPPAPE; QPPPAPEI;<br>PPPAPEIP; PPAPEIPK; PAPEIPKS; APEIPKSS; PEIPKSSL;<br>EIPKSSLG; IPKSSLGA; PKSSLGAG; KSSLGAGL; SSLGAGLG;<br>SLGAGLGL; LGAGLGLR; GAGLGLRS; AGLGLRSG; GLGLRSGL;<br>LGLRSGLS; GLRSGLSA; LRSGLSAG; RSGLSAGL; SGLSAGLA;<br>GLSAGLAH; LSAGLAHA; SAGLAHAA; AGLAHAAS; GLAHAASA;<br>LAHAASAG; AHAASAGL; HAASAGLG; AASAGLGQ; ASAGLGQA;<br>SAGLGQAN; AGLGQANL; GLGQANLV; LGQANLVG; GQANLVGD;<br>QANLVGDL; ANLVGDLS; NLVGDLSV; LVGDLSVP; VGDLSVPP;<br>GDLSVPPS; DLSVPPSW; LSVPPSWA; SVPPSWAS; VPPSWASA;<br>PPSWASAT; PSWASATP; SWASATPA; WASATPAV; ASATPAVR;<br>SATPAVRL; ATPAVRLV; TPAVRLVA; PAVRLVAN; AVRLVANT;<br>VRLVANTL; RLVANTLP; LVANTLPA; VANTLPAT; ANTLPATS;<br>NTLPATSL; TLPATSLA; LPATSLAA; PATSLAAA; ATSLAAAP;<br>TSLAAAPA; SLAAAPAT; LAAAPATQ; AAAPATQI; AAPATQIP;<br>APATQIPA; PATQIPAN; ATQIPANL; TQIPANLL; QIPANLLG;<br>IPANLLGQ; PANLLGQM; ANLLGQMA; NLLGQMAL; LLGQMALG;<br>LGQMALGS; GQMALGSM; QMALGSMT; MALGSMTG; ALGSMTGG;<br>LGSMTGGA; GSMTGGAL; SMTGGALG; MTGGALGA; TGGALGAA;<br>GGALGAAA; GALGAAAP; ALGAAAPA; LGAAAPAI; GAAAPAIY;<br>AAAPAIYT; AAPAIYTG; APAIYTGS; PAIYTGSG; AIYTGSGA;<br>IYTGSGAR; YTGSGARA; TGSGARAR; GSGARARA; SGARARAN;<br>GARARANG; ARARANGG; RARANGGT; ARANGGTP; RANGGTPS;<br>ANGGTPSA; NGGTPSAE; GGTPSAEP; GTPSAEPV; TPSAEPVK;<br>PSAEPVKL; SAEPVKLE; AEPVKLEA; EPVKLEAV; PVKLEAVI;<br>VKLEAVIA; KLEAVIAQ; LEAVIAQL; EAVIAQLQ; AVIAQLQK;<br>VIAQLQKQ; IAQLQKQP; AQLQKQPD; QLQKQPDA; LQKQPDAV;<br>QKQPDAVR; KQPDAVRH; QPDAVRHW; PDAVRHWN; DAVRHWNV;<br>AVRHWNVD; VRHWNVDK; RHWNVDKA; HWNVDKAD; WNVDKADL;<br>NVDKADLD; VDKADLDG; DKADLDGL; KADLDGLL; ADLDGLLD;<br>DLDGLLDR; LDGLLDRL; DGLLDRLS; GLLDRLSK; LLDRLSKQ;<br>LDRLSKQP; DRLSKQPG; RLSKQPGI; LSKQPGIH; SKQPGIHA;<br>KQPGIHAV; QPGIHAVH; PGIHAVHV; GIHAVHVS; IHAVHVSN;<br>HAVHVSNG; AVHVSNGD; VHVSNGDK; HVSNGDKP; VSNGDKPK;<br>SNGDKPKV; NGDKPKVA; GDKPKVAL; DKPKVALP; KPKVALPD;<br>PKVALPDT; KVALPDTQ; VALPDTQL; ALPDTQLG; LPDTQLGS; | |

Fig. 28 continued

| | | |
|---|---|---|
| | PDTQLGSH<br><br>9 mers:<br>MDFGLQPPE; DFGLQPPEI; FGLQPPEIT; GLQPPEITS; LQPPEITSG; QPPEITSGE; PPEITSGEM; PEITSGEMY; EITSGEMYL; ITSGEMYLG; TSGEMYLGP; SGEMYLGPG; GEMYLGPGA; EMYLGPGAG; MYLGPGAGP; YLGPGAGPM; LGPGAGPML; GPGAGPMLA; PGAGPMLAA; GAGPMLAAA; AGPMLAAAV; GPMLAAAVA; PMLAAAVAW; MLAAAVAWD; LAAAVAWDG; AAAVAWDGL; AAVAWDGLA; AVAWDGLAA; VAWDGLAAE; AWDGLAAEL; WDGLAAELQ; DGLAAELQS; GLAAELQSM; LAAELQSMA; AAELQSMAA; AELQSMAAS; ELQSMAASY; LQSMAASYA; QSMAASYAS; SMAASYASI; MAASYASIV; AASYASIVE; ASYASIVEG; SYASIVEGM; YASIVEGMA; ASIVEGMAS; SIVEGMASE; IVEGMASES; VEGMASESW; EGMASESWL; GMASESWLG; MASESWLGP; ASESWLGPS; SESWLGPSS; ESWLGPSSA; SWLGPSSAG; WLGPSSAGM; LGPSSAGMA; GPSSAGMAA; PSSAGMAAA; SSAGMAAAA; SAGMAAAAA; AGMAAAAAP; GMAAAAAPY; MAAAAAPYV; AAAAAPYVT; AAAAPYVTW; AAAPYVTWM; AAPYVTWMS; APYVTWMSG; PYVTWMSGT; YVTWMSGTS; VTWMSGTSA; TWMSGTSAQ; WMSGTSAQA; MSGTSAQAK; SGTSAQAKA; GTSAQAKAA; TSAQAKAAA; SAQAKAAAD; AQAKAAADQ; QAKAAADQA; AKAAADQAR; KAAADQARA; AAADQARAA; AADQARAAV; ADQARAAVV; DQARAAVVA; QARAAVVAY; ARAAVVAYE; RAAVVAYET; AAVVAYETA; AVVAYETAF; VVAYETAFA; VAYETAFAA; AYETAFAAV; YETAFAAVV; ETAFAAVVP; TAFAAVVPP; AFAAVVPPP; FAAVVPPPQ; AAVVPPPQI; AVVPPPQIA; VVPPPQIAA; VPPPQIAAN; PPPQIAANR; PPQIAANRS; PQIAANRSQ; QIAANRSQL; IAANRSQLI; AANRSQLIS; ANRSQLISL; NRSQLISLV; RSQLISLVA; SQLISLVAT; QLISLVATN; LISLVATNI; ISLVATNIF; SLVATNIFG; LVATNIFGQ; VATNIFGQN; ATNIFGQNT; TNIFGQNTA; NIFGQNTAA; IFGQNTAAI; FGQNTAAIA; GQNTAAIAA; QNTAAIAAT; NTAAIAATE; TAAIAATEA; AAIAATEAE; AIAATEAEY; IAATEAEYG; AATEAEYGE; ATEAEYGEM; TEAEYGEMW; EAEYGEMWA; AEYGEMWAQ; EYGEMWAQD; YGEMWAQDT; GEMWAQDTM; EMWAQDTMA; MWAQDTMAM; WAQDTMAMF; AQDTMAMFG; QDTMAMFGY; DTMAMFGYA; TMAMFGYAS; MAMFGYASS; AMFGYASSS; MFGYASSSA; FGYASSSAT; GYASSSATA; YASSSATAS; ASSSATASR; SSSATASRL; SSATASRLT; SATASRLTP; ATASRLTPF; TASRLTPFT; ASRLTPFTA; SRLTPFTAP; RLTPFTAPP; LTPFTAPPQ; TPFTAPPQT; PFTAPPQTT; FTAPPQTTN; TAPPQTTNP; APPQTTNPS; PPQTTNPSG; PQTTNPSGL; QTTNPSGLA; TTNPSGLAG; TNPSGLAGQ; NPSGLAGQA; PSGLAGQAA; SGLAGQAAA; GLAGQAAAT; LAGQAAATG; AGQAAATGQ; GQAAATGQA; QAAATGQAT; AAATGQATA; AATGQATAL; ATGQATALA; TGQATALAS; GQATALASG; QATALASGT; ATALASGTN; TALASGTNA; ALASGTNAV; LASGTNAVT; ASGTNAVTT; SGTNAVTTA; GTNAVTTAL; TNAVTTALS; NAVTTALSS; AVTTALSSA; VTTALSSAA; TTALSSAAA; TALSSAAAQ; ALSSAAAQF; LSSAAAQFP; SSAAAQFPF; SAAAQFPFD; AAAQFPFDI; AAQFPFDII; AQFPFDIIP; QFPFDIIPT; FPFDIIPTL; PFDIIPTLL; FDIIPTLLQ; DIIPTLLQG; IIPTLLQGL; IPTLLQGLA; PTLLQGLAT; TLLQGLATL; LLQGLATLS; LQGLATLST; | |

Fig. 28 continued

| | | |
|---|---|---|
| | QGLATLSTQ; GLATLSTQY; LATLSTQYT; ATLSTQYTQ; TLSTQYTQL; LSTQYTQLM; STQYTQLMG; TQYTQLMGQ; QYTQLMGQL; YTQLMGQLI; TQLMGQLIN; QLMGQLINA; LMGQLINAI; MGQLINAIF; GQLINAIFG; QLINAIFGP; LINAIFGPT; INAIFGPTG; NAIFGPTGA; AIFGPTGAT; IFGPTGATT; FGPTGATTY; GPTGATTYQ; PTGATTYQN; TGATTYQNV; GATTYQNVF; ATTYQNVFV; TTYQNVFVT; TYQNVFVTA; YQNVFVTAA; QNVFVTAAN; NVFVTAANV; VFVTAANVT; FVTAANVTK; VTAANVTKF; TAANVTKFS; AANVTKFST; ANVTKFSTW; NVTKFSTWA; VTKFSTWAN; TKFSTWAND; KFSTWANDA; FSTWANDAM; STWANDAMS; TWANDAMSA; WANDAMSAP; ANDAMSAPN; NDAMSAPNL; DAMSAPNLG; AMSAPNLGM; MSAPNLGMT; SAPNLGMTE; APNLGMTEF; PNLGMTEFK; NLGMTEFKV; LGMTEFKVF; GMTEFKVFW; MTEFKVFWQ; TEFKVFWQP; EFKVFWQPP; FKVFWQPPP; KVFWQPPPA; VFWQPPPAP; FWQPPPAPE; WQPPPAPEI; QPPPAPEIP; PPPAPEIPK; PPAPEIPKS; PAPEIPKSS; APEIPKSSL; PEIPKSSLG; EIPKSSLGA; IPKSSLGAG; PKSSLGAGL; KSSLGAGLG; SSLGAGLGL; SLGAGLGLR; LGAGLGLRS; GAGLGLRSG; AGLGLRSGL; GLGLRSGLS; LGLRSGLSA; GLRSGLSAG; LRSGLSAGL; RSGLSAGLA; SGLSAGLAH; GLSAGLAHA; LSAGLAHAA; SAGLAHAAS; AGLAHAASA; GLAHAASAG; LAHAASAGL; AHAASAGLG; HAASAGLGQ; AASAGLGQA; ASAGLGQAN; SAGLGQANL; AGLGQANLV; GLGQANLVG; LGQANLVGD; GQANLVGDL; QANLVGDLS; ANLVGDLSV; NLVGDLSVP; LVGDLSVPP; VGDLSVPPS; GDLSVPPSW; DLSVPPSWA; LSVPPSWAS; SVPPSWASA; VPPSWASAT; PPSWASATP; PSWASATPA; SWASATPAV; WASATPAVR; ASATPAVRL; SATPAVRLV; ATPAVRLVA; TPAVRLVAN; PAVRLVANT; AVRLVANTL; VRLVANTLP; RLVANTLPA; LVANTLPAT; VANTLPATS; ANTLPATSL; NTLPATSLA; TLPATSLAA; LPATSLAAA; PATSLAAAP; ATSLAAAPA; TSLAAAPAT; SLAAAPATQ; LAAAPATQI; AAAPATQIP; AAPATQIPA; APATQIPAN; PATQIPANL; ATQIPANLL; TQIPANLLG; QIPANLLGQ; IPANLLGQM; PANLLGQMA; ANLLGQMAL; NLLGQMALG; LLGQMALGS; LGQMALGSM; GQMALGSMT; QMALGSMTG; MALGSMTGG; ALGSMTGGA; LGSMTGGAL; GSMTGGALG; SMTGGALGA; MTGGALGAA; TGGALGAAA; GGALGAAAP; GALGAAAPA; ALGAAAPAI; LGAAAPAIY; GAAAPAIYT; AAAPAIYTG; AAPAIYTGS; APAIYTGSG; PAIYTGSGA; AIYTGSGAR; IYTGSGARA; YTGSGARAR; TGSGARARA; GSGARARAN; SGARARANG; GARARANGG; ARARANGGT; RARANGGTP; ARANGGTPS; RANGGTPSA; ANGGTPSAE; NGGTPSAEP; GGTPSAEPV; GTPSAEPVK; TPSAEPVKL; PSAEPVKLE; SAEPVKLEA; AEPVKLEAV; EPVKLEAVI; PVKLEAVIA; VKLEAVIAQ; KLEAVIAQL; LEAVIAQLQ; EAVIAQLQK; AVIAQLQKQ; VIAQLQKQP; IAQLQKQPD; AQLQKQPDA; QLQKQPDAV; LQKQPDAVR; QKQPDAVRH; KQPDAVRHW; QPDAVRHWN; PDAVRHWNV; DAVRHWNVD; AVRHWNVDK; VRHWNVDKA; RHWNVDKAD; HWNVDKADL; WNVDKADLD; NVDKADLDG; VDKADLDGL; DKADLDGLL; KADLDGLLD; ADLDGLLDR; DLDGLLDRL; LDGLLDRLS; DGLLDRLSK; GLLDRLSKQ; LLDRLSKQP; LDRLSKQPG; DRLSKQPGI; RLSKQPGIH; LSKQPGIHA; SKQPGIHAV; KQPGIHAVH; QPGIHAVHV; PGIHAVHVS; GIHAVHVSN; IHAVHVSNG; HAVHVSNGD; AVHVSNGDK; VHVSNGDKP; HVSNGDKPK; | |

Fig. 28 continued

| | | | |
|---|---|---|---|
| | VSNGDKPKV; SNGDKPKVA; NGDKPKVAL; GDKPKVALP; DKPKVALPD; KPKVALPDT; PKVALPDTQ; KVALPDTQL; VALPDTQLG; ALPDTQLGS; LPDTQLGSH<br><br>10 mers:<br>MDFGLQPPEI; DFGLQPPEIT; FGLQPPEITS; GLQPPEITSG; LQPPEITSGE; QPPEITSGEM; PPEITSGEMY; PEITSGEMYL; EITSGEMYLG; ITSGEMYLGP; TSGEMYLGPG; SGEMYLGPGA; GEMYLGPGAG; EMYLGPGAGP; MYLGPGAGPM; YLGPGAGPML; LGPGAGPMLA; GPGAGPMLAA; PGAGPMLAAA; GAGPMLAAAV; AGPMLAAAVA; GPMLAAAVAW; PMLAAAVAWD; MLAAAVAWDG; LAAAVAWDGL; AAAVAWDGLA; AAVAWDGLAA; AVAWDGLAAE; VAWDGLAAEL; AWDGLAAELQ; WDGLAAELQS; DGLAAELQSM; GLAAELQSMA; LAAELQSMAA; AAELQSMAAS; AELQSMAASY; ELQSMAASYA; LQSMAASYAS; QSMAASYASI; SMAASYASIV; MAASYASIVE; AASYASIVEG; ASYASIVEGM; SYASIVEGMA; YASIVEGMAS; ASIVEGMASE; SIVEGMASES; IVEGMASESW; VEGMASESWL; EGMASESWLG; GMASESWLGP; MASESWLGPS; ASESWLGPSS; SESWLGPSSA; ESWLGPSSAG; SWLGPSSAGM; WLGPSSAGMA; LGPSSAGMAA; GPSSAGMAAA; PSSAGMAAAA; SSAGMAAAAA; SAGMAAAAAP; AGMAAAAAPY; GMAAAAAPYV; MAAAAAPYVT; AAAAAPYVTW; AAAAPYVTWM; AAAPYVTWMS; AAPYVTWMSG; APYVTWMSGT; PYVTWMSGTS; YVTWMSGTSA; VTWMSGTSAQ; TWMSGTSAQA; WMSGTSAQAK; MSGTSAQAKA; SGTSAQAKAA; GTSAQAKAAA; TSAQAKAAAD; SAQAKAAADQ; AQAKAAADQA; QAKAAADQAR; AKAAADQARA; KAAADQARAA; AAADQARAAV; AADQARAAVV; ADQARAAVVA; DQARAAVVAY; QARAAVVAYE; ARAAVVAYET; RAAVVAYETA; AAVVAYETAF; AVVAYETAFA; VVAYETAFAA; VAYETAFAAV; AYETAFAAVV; YETAFAAVVP; ETAFAAVVPP; TAFAAVVPPP; AFAAVVPPPQ; FAAVVPPPQI; AAVVPPPQIA; AVVPPPQIAA; VVPPPQIAAN; VPPPQIAANR; PPPQIAANRS; PPQIAANRSQ; PQIAANRSQL; QIAANRSQLI; IAANRSQLIS; AANRSQLISL; ANRSQLISLV; NRSQLISLVA; RSQLISLVAT; SQLISLVATN; QLISLVATNI; LISLVATNIF; ISLVATNIFG; SLVATNIFGQ; LVATNIFGQN; VATNIFGQNT; ATNIFGQNTA; TNIFGQNTAA; NIFGQNTAAI; IFGQNTAAIA; FGQNTAAIAA; GQNTAAIAAT; QNTAAIAATE; NTAAIAATEA; TAAIAATEAE; AAIAATEAEY; AIAATEAEYG; IAATEAEYGE; AATEAEYGEM; ATEAEYGEMW; TEAEYGEMWA; EAEYGEMWAQ; AEYGEMWAQD; EYGEMWAQDT; YGEMWAQDTM; GEMWAQDTMA; EMWAQDTMAM; MWAQDTMAMF; WAQDTMAMFG; AQDTMAMFGY; QDTMAMFGYA; DTMAMFGYAS; TMAMFGYASS; MAMFGYASSS; AMFGYASSSA; MFGYASSSAT; FGYASSSATA; GYASSSATAS; YASSSATASR; ASSSATASRL; SSSATASRLT; SSATASRLTP; SATASRLTPF; ATASRLTPFT; TASRLTPFTA; ASRLTPFTAP; SRLTPFTAPP; RLTPFTAPPQ; LTPFTAPPQT; TPFTAPPQTT; PFTAPPQTTN; FTAPPQTTNP; TAPPQTTNPS; APPQTTNPSG; PPQTTNPSGL; PQTTNPSGLA; QTTNPSGLAG; TTNPSGLAGQ; TNPSGLAGQA; NPSGLAGQAA; PSGLAGQAAA; SGLAGQAAAT; GLAGQAAATG; LAGQAAATGQ; AGQAAATGQA; GQAAATGQAT; QAAATGQATA; AAATGQATAL; AATGQATALA; ATGQATALAS; TGQATALASG; GQATALASGT; QATALASGTN; ATALASGTNA; TALASGTNAV; ALASGTNAVT; LASGTNAVTT; | |

Fig. 28 continued

| | | |
|---|---|---|
| | ASGTNAVTTA; SGTNAVTTAL; GTNAVTTALS; TNAVTTALSS; NAVTTALSSA; AVTTALSSAA; VTTALSSAAA; TTALSSAAAQ; TALSSAAAQF; ALSSAAAQFP; LSSAAAQFPF; SSAAAQFPFD; SAAAQFPFDI; AAAQFPFDII; AAQFPFDIIP; AQFPFDIIPT; QFPFDIIPTL; FPFDIIPTLL; PFDIIPTLLQ; FDIIPTLLQG; DIIPTLLQGL; IIPTLLQGLA; IPTLLQGLAT; PTLLQGLATL; TLLQGLATLS; LLQGLATLST; LQGLATLSTQ; QGLATLSTQY; GLATLSTQYT; LATLSTQYTQ; ATLSTQYTQL; TLSTQYTQLM; LSTQYTQLMG; STQYTQLMGQ; TQYTQLMGQL; QYTQLMGQLI; YTQLMGQLIN; TQLMGQLINA; QLMGQLINAI; LMGQLINAIF; MGQLINAIFG; GQLINAIFGP; QLINAIFGPT; LINAIFGPTG; INAIFGPTGA; NAIFGPTGAT; AIFGPTGATT; IFGPTGATTY; FGPTGATTYQ; GPTGATTYQN; PTGATTYQNV; TGATTYQNVF; GATTYQNVFV; ATTYQNVFVT; TTYQNVFVTA; TYQNVFVTAA; YQNVFVTAAN; QNVFVTAANV; NVFVTAANVT; VFVTAANVTK; FVTAANVTKF; VTAANVTKFS; TAANVTKFST; AANVTKFSTW; ANVTKFSTWA; NVTKFSTWAN; VTKFSTWAND; TKFSTWANDA; KFSTWANDAM; FSTWANDAMS; STWANDAMSA; TWANDAMSAP; WANDAMSAPN; ANDAMSAPNL; NDAMSAPNLG; DAMSAPNLGM; AMSAPNLGMT; MSAPNLGMTE; SAPNLGMTEF; APNLGMTEFK; PNLGMTEFKV; NLGMTEFKVF; LGMTEFKVFW; GMTEFKVFWQ; MTEFKVFWQP; TEFKVFWQPP; EFKVFWQPPP; FKVFWQPPPA; KVFWQPPPAP; VFWQPPPAPE; FWQPPPAPEI; WQPPPAPEIP; QPPPAPEIPK; PPPAPEIPKS; PPAPEIPKSS; PAPEIPKSSL; APEIPKSSLG; PEIPKSSLGA; EIPKSSLGAG; IPKSSLGAGL; PKSSLGAGLG; KSSLGAGLGL; SSLGAGLGLR; SLGAGLGLRS; LGAGLGLRSG; GAGLGLRSGL; AGLGLRSGLS; GLGLRSGLSA; LGLRSGLSAG; GLRSGLSAGL; LRSGLSAGLA; RSGLSAGLAH; SGLSAGLAHA; GLSAGLAHAA; LSAGLAHAAS; SAGLAHAASA; AGLAHAASAG; GLAHAASAGL; LAHAASAGLG; AHAASAGLGQ; HAASAGLGQA; AASAGLGQAN; ASAGLGQANL; SAGLGQANLV; AGLGQANLVG; GLGQANLVGD; LGQANLVGDL; GQANLVGDLS; QANLVGDLSV; ANLVGDLSVP; NLVGDLSVPP; LVGDLSVPPS; VGDLSVPPSW; GDLSVPPSWA; DLSVPPSWAS; LSVPPSWASA; SVPPSWASAT; VPPSWASATP; PPSWASATPA; PSWASATPAV; SWASATPAVR; WASATPAVRL; ASATPAVRLV; SATPAVRLVA; ATPAVRLVAN; TPAVRLVANT; PAVRLVANTL; AVRLVANTLP; VRLVANTLPA; RLVANTLPAT; LVANTLPATS; VANTLPATSL; ANTLPATSLA; NTLPATSLAA; TLPATSLAAA; LPATSLAAAP; PATSLAAAPA; ATSLAAAPAT; TSLAAAPATQ; SLAAAPATQI; LAAAPATQIP; AAAPATQIPA; AAPATQIPAN; APATQIPANL; PATQIPANLL; ATQIPANLLG; TQIPANLLGQ; QIPANLLGQM; IPANLLGQMA; PANLLGQMAL; ANLLGQMALG; NLLGQMALGS; LLGQMALGSM; LGQMALGSMT; GQMALGSMTG; QMALGSMTGG; MALGSMTGGA; ALGSMTGGAL; LGSMTGGALG; GSMTGGALGA; SMTGGALGAA; MTGGALGAAA; TGGALGAAAP; GGALGAAAPA; GALGAAAPAI; ALGAAAPAIY; LGAAAPAIYT; GAAAPAIYTG; AAAPAIYTGS; AAPAIYTGSG; APAIYTGSGA; PAIYTGSGAR; AIYTGSGARA; IYTGSGARAR; YTGSGARARA; TGSGARARAN; GSGARARANG; SGARARANGG; GARARANGGT; ARARANGGTP; RARANGGTPS; ARANGGTPSA; RANGGTPSAE; ANGGTPSAEP; NGGTPSAEPV; GGTPSAEPVK; GTPSAEPVKL; TPSAEPVKLE; PSAEPVKLEA; SAEPVKLEAV; AEPVKLEAVI; EPVKLEAVIA; PVKLEAVIAQ; | |

Fig. 28 continued

| | | |
|---|---|---|
| | VKLEAVIAQL; KLEAVIAQLQ; LEAVIAQLQK; EAVIAQLQKQ; AVIAQLQKQP; VIAQLQKQPD; IAQLQKQPDA; AQLQKQPDAV; QLQKQPDAVR; LQKQPDAVRH; QKQPDAVRHW; KQPDAVRHWN; QPDAVRHWNV; PDAVRHWNVD; DAVRHWNVDK; AVRHWNVDKA; VRHWNVDKAD; RHWNVDKADL; HWNVDKADLD; WNVDKADLDG; NVDKADLDGL; VDKADLDGLL; DKADLDGLLD; KADLDGLLDR; ADLDGLLDRL; DLDGLLDRLS; LDGLLDRLSK; DGLLDRLSKQ; GLLDRLSKQP; LLDRLSKQPG; LDRLSKQPGI; DRLSKQPGIH; RLSKQPGIHA; LSKQPGIHAV; SKQPGIHAVH; KQPGIHAVHV; QPGIHAVHVS; PGIHAVHVSN; GIHAVHVSNG; IHAVHVSNGD; HAVHVSNGDK; AVHVSNGDKP; VHVSNGDKPK; HVSNGDKPKV; VSNGDKPKVA; SNGDKPKVAL; NGDKPKVALP; GDKPKVALPD; DKPKVALPDT; KPKVALPDTQ; PKVALPDTQL; KVALPDTQLG; VALPDTQLGS; ALPDTQLGSH<br><br>11 mers:<br>MDFGLQPPEIT; DFGLQPPEITS; FGLQPPEITSG; GLQPPEITSGE; LQPPEITSGEM; QPPEITSGEMY; PPEITSGEMYL; PEITSGEMYLG; EITSGEMYLGP; ITSGEMYLGPG; TSGEMYLGPGA; SGEMYLGPGAG; GEMYLGPGAGP; EMYLGPGAGPM; MYLGPGAGPML; YLGPGAGPMLA; LGPGAGPMLAA; GPGAGPMLAAA; PGAGPMLAAAV; GAGPMLAAAVA; AGPMLAAAVAW; GPMLAAAVAWD; PMLAAAVAWDG; MLAAAVAWDGL; LAAAVAWDGLA; AAAVAWDGLAA; AAVAWDGLAAE; AVAWDGLAAEL; VAWDGLAAELQ; AWDGLAAELQS; WDGLAAELQSM; DGLAAELQSMA; GLAAELQSMAA; LAAELQSMAAS; AAELQSMAASY; AELQSMAASYA; ELQSMAASYAS; LQSMAASYASI; QSMAASYASIV; SMAASYASIVE; MAASYASIVEG; AASYASIVEGM; ASYASIVEGMA; SYASIVEGMAS; YASIVEGMASE; ASIVEGMASES; SIVEGMASESW; IVEGMASESWL; VEGMASESWLG; EGMASESWLGP; GMASESWLGPS; MASESWLGPSS; ASESWLGPSSA; SESWLGPSSAG; ESWLGPSSAGM; SWLGPSSAGMA; WLGPSSAGMAA; LGPSSAGMAAA; GPSSAGMAAAA; PSSAGMAAAAA; SSAGMAAAAAP; SAGMAAAAAPY; AGMAAAAAPYV; GMAAAAAPYVT; MAAAAAPYVTW; AAAAAPYVTWM; AAAAPYVTWMS; AAAPYVTWMSG; AAPYVTWMSGT; APYVTWMSGTS; PYVTWMSGTSA; YVTWMSGTSAQ; VTWMSGTSAQA; TWMSGTSAQAK; WMSGTSAQAKA; MSGTSAQAKAA; SGTSAQAKAAA; GTSAQAKAAAD; TSAQAKAAADQ; SAQAKAAADQA; AQAKAAADQAR; QAKAAADQARA; AKAAADQARAA; KAAADQARAAV; AAADQARAAVV; AADQARAAVVA; ADQARAAVVAY; DQARAAVVAYE; QARAAVVAYET; ARAAVVAYETA; RAAVVAYETAF; AAVVAYETAFA; AVVAYETAFAA; VVAYETAFAAV; VAYETAFAAVV; AYETAFAAVVP; YETAFAAVVPP; ETAFAAVVPPP; TAFAAVVPPPQ; AFAAVVPPPQI; FAAVVPPPQIA; AAVVPPPQIAA; AVVPPPQIAAN; VVPPPQIAANR; VPPPQIAANRS; PPPQIAANRSQ; PPQIAANRSQL; PQIAANRSQLI; QIAANRSQLIS; IAANRSQLISL; AANRSQLISLV; ANRSQLISLVA; NRSQLISLVAT; RSQLISLVATN; SQLISLVATNI; QLISLVATNIF; LISLVATNIFG; ISLVATNIFGQ; SLVATNIFGQN; LVATNIFGQNT; VATNIFGQNTA; ATNIFGQNTAA; TNIFGQNTAAI; NIFGQNTAAIA; IFGQNTAAIAA; FGQNTAAIAAT; GQNTAAIAATE; QNTAAIAATEA; NTAAIAATEAE; TAAIAATEAEY; AAIAATEAEYG; | |

Fig. 28 continued

| | | |
|---|---|---|
| | AIAATEAEYGE; IAATEAEYGEM; AATEAEYGEMW; ATEAEYGEMWA; TEAEYGEMWAQ; EAEYGEMWAQD; AEYGEMWAQDT; EYGEMWAQDTM; YGEMWAQDTMA; GEMWAQDTMAM; EMWAQDTMAMF; MWAQDTMAMFG; WAQDTMAMFGY; AQDTMAMFGYA; QDTMAMFGYAS; DTMAMFGYASS; TMAMFGYASSS; MAMFGYASSSA; AMFGYASSSAT; MFGYASSSATA; FGYASSSATAS; GYASSSATASR; YASSSATASRL; ASSSATASRLT; SSSATASRLTP; SSATASRLTPF; SATASRLTPFT; ATASRLTPFTA; TASRLTPFTAP; ASRLTPFTAPP; SRLTPFTAPPQ; RLTPFTAPPQT; LTPFTAPPQTT; TPFTAPPQTTN; PFTAPPQTTNP; FTAPPQTTNPS; TAPPQTTNPSG; APPQTTNPSGL; PPQTTNPSGLA; PQTTNPSGLAG; QTTNPSGLAGQ; TTNPSGLAGQA; TNPSGLAGQAA; NPSGLAGQAAA; PSGLAGQAAAT; SGLAGQAAATG; GLAGQAAATGQ; LAGQAAATGQA; AGQAAATGQAT; GQAAATGQATA; QAAATGQATAL; AAATGQATALA; AATGQATALAS; ATGQATALASG; TGQATALASGT; GQATALASGTN; QATALASGTNA; ATALASGTNAV; TALASGTNAVT; ALASGTNAVTT; LASGTNAVTTA; ASGTNAVTTAL; SGTNAVTTALS; GTNAVTTALSS; TNAVTTALSSA; NAVTTALSSAA; AVTTALSSAAA; VTTALSSAAAQ; TTALSSAAAQF; TALSSAAAQFP; ALSSAAAQFPF; LSSAAAQFPFD; SSAAAQFPFDI; SAAAQFPFDII; AAAQFPFDIIP; AAQFPFDIIPT; AQFPFDIIPTL; QFPFDIIPTLL; FPFDIIPTLLQ; PFDIIPTLLQG; FDIIPTLLQGL; DIIPTLLQGLA; IIPTLLQGLAT; IPTLLQGLATL; PTLLQGLATLS; TLLQGLATLST; LLQGLATLSTQ; LQGLATLSTQY; QGLATLSTQYT; GLATLSTQYTQ; LATLSTQYTQL; ATLSTQYTQLM; TLSTQYTQLMG; LSTQYTQLMGQ; STQYTQLMGQL; TQYTQLMGQLI; QYTQLMGQLIN; YTQLMGQLINA; TQLMGQLINAI; QLMGQLINAIF; LMGQLINAIFG; MGQLINAIFGP; GQLINAIFGPT; QLINAIFGPTG; LINAIFGPTGA; INAIFGPTGAT; NAIFGPTGATT; AIFGPTGATTY; IFGPTGATTYQ; FGPTGATTYQN; GPTGATTYQNV; PTGATTYQNVF; TGATTYQNVFV; GATTYQNVFVT; ATTYQNVFVTA; TTYQNVFVTAA; TYQNVFVTAAN; YQNVFVTAANV; QNVFVTAANVT; NVFVTAANVTK; VFVTAANVTKF; FVTAANVTKFS; VTAANVTKFST; TAANVTKFSTW; AANVTKFSTWA; ANVTKFSTWAN; NVTKFSTWAND; VTKFSTWANDA; TKFSTWANDAM; KFSTWANDAMS; FSTWANDAMSA; STWANDAMSAP; TWANDAMSAPN; WANDAMSAPNL; ANDAMSAPNLG; NDAMSAPNLGM; DAMSAPNLGMT; AMSAPNLGMTE; MSAPNLGMTEF; SAPNLGMTEFK; APNLGMTEFKV; PNLGMTEFKVF; NLGMTEFKVFW; LGMTEFKVFWQ; GMTEFKVFWQP; MTEFKVFWQPP; TEFKVFWQPPP; EFKVFWQPPPA; FKVFWQPPPAP; KVFWQPPPAPE; VFWQPPPAPEI; FWQPPPAPEIP; WQPPPAPEIPK; QPPPAPEIPKS; PPPAPEIPKSS; PPAPEIPKSSL; PAPEIPKSSLG; APEIPKSSLGA; PEIPKSSLGAG; EIPKSSLGAGL; IPKSSLGAGLG; PKSSLGAGLGL; KSSLGAGLGLR; SSLGAGLGLRS; SLGAGLGLRSG; LGAGLGLRSGL; GAGLGLRSGLS; AGLGLRSGLSA; GLGLRSGLSAG; LGLRSGLSAGL; GLRSGLSAGLA; LRSGLSAGLAH; RSGLSAGLAHA; SGLSAGLAHAA; GLSAGLAHAAS; LSAGLAHAASA; SAGLAHAASAG; AGLAHAASAGL; GLAHAASAGLG; LAHAASAGLGQ; AHAASAGLGQA; HAASAGLGQAN; AASAGLGQANL; ASAGLGQANLV; SAGLGQANLVG; AGLGQANLVGD; GLGQANLVGDL; LGQANLVGDLS; GQANLVGDLSV; QANLVGDLSVP; ANLVGDLSVPP; NLVGDLSVPPS; LVGDLSVPPSW; VGDLSVPPSWA; GDLSVPPSWAS; DLSVPPSWASA; | |

Fig. 28 continued

| | | |
|---|---|---|
| | LSVPPSWASAT; SVPPSWASATP; VPPSWASATPA; PPSWASATPAV; PSWASATPAVR; SWASATPAVRL; WASATPAVRLV; ASATPAVRLVA; SATPAVRLVAN; ATPAVRLVANT; TPAVRLVANTL; PAVRLVANTLP; AVRLVANTLPA; VRLVANTLPAT; RLVANTLPATS; LVANTLPATSL; VANTLPATSLA; ANTLPATSLAA; NTLPATSLAAA; TLPATSLAAAP; LPATSLAAAPA; PATSLAAAPAT; ATSLAAAPATQ; TSLAAAPATQI; SLAAAPATQIP; LAAAPATQIPA; AAAPATQIPAN; AAPATQIPANL; APATQIPANLL; PATQIPANLLG; ATQIPANLLGQ; TQIPANLLGQM; QIPANLLGQMA; IPANLLGQMAL; PANLLGQMALG; ANLLGQMALGS; NLLGQMALGSM; LLGQMALGSMT; LGQMALGSMTG; GQMALGSMTGG; QMALGSMTGGA; MALGSMTGGAL; ALGSMTGGALG; LGSMTGGALGA; GSMTGGALGAA; SMTGGALGAAA; MTGGALGAAAP; TGGALGAAAPA; GGALGAAAPAI; GALGAAAPAIY; ALGAAAPAIYT; LGAAAPAIYTG; GAAAPAIYTGS; AAAPAIYTGSG; AAPAIYTGSGA; APAIYTGSGAR; PAIYTGSGARA; AIYTGSGARAR; IYTGSGARARA; YTGSGARARAN; TGSGARARANG; GSGARARANGG; SGARARANGGT; GARARANGGTP; ARARANGGTPS; RARANGGTPSA; ARANGGTPSAE; RANGGTPSAEP; ANGGTPSAEPV; NGGTPSAEPVK; GGTPSAEPVKL; GTPSAEPVKLE; TPSAEPVKLEA; PSAEPVKLEAV; SAEPVKLEAVI; AEPVKLEAVIA; EPVKLEAVIAQ; PVKLEAVIAQL; VKLEAVIAQLQ; KLEAVIAQLQK; LEAVIAQLQKQ; EAVIAQLQKQP; AVIAQLQKQPD; VIAQLQKQPDA; IAQLQKQPDAV; AQLQKQPDAVR; QLQKQPDAVRH; LQKQPDAVRHW; QKQPDAVRHWN; KQPDAVRHWNV; QPDAVRHWNVD; PDAVRHWNVDK; DAVRHWNVDKA; AVRHWNVDKAD; VRHWNVDKADL; RHWNVDKADLD; HWNVDKADLDG; WNVDKADLDGL; NVDKADLDGLL; VDKADLDGLLD; DKADLDGLLDR; KADLDGLLDRL; ADLDGLLDRLS; DLDGLLDRLSK; LDGLLDRLSKQ; DGLLDRLSKQP; GLLDRLSKQPG; LLDRLSKQPGI; LDRLSKQPGIH; DRLSKQPGIHA; RLSKQPGIHAV; LSKQPGIHAVH; SKQPGIHAVHV; KQPGIHAVHVS; QPGIHAVHVSN; PGIHAVHVSNG; GIHAVHVSNGD; IHAVHVSNGDK; HAVHVSNGDKP; AVHVSNGDKPK; VHVSNGDKPKV; HVSNGDKPKVA; VSNGDKPKVAL; SNGDKPKVALP; NGDKPKVALPD; GDKPKVALPDT; DKPKVALPDTQ; KPKVALPDTQL; PKVALPDTQLG; KVALPDTQLGS; VALPDTQLGSH | |
| 29) Rv1954c | 8 mers: MAAGSGGG; AAGSGGGT; AGSGGGTV; GSGGGTVG; SGGGTVGL; GGGTVGLV; GGTVGLVL; GTVGLVLP; TVGLVLPR; VGLVLPRV; GLVLPRVA; LVLPRVAS; VLPRVASL; LPRVASLS; PRVASLSG; RVASLSGL; VASLSGLD; ASLSGLDG; SLSGLDGA; LSGLDGAP; SGLDGAPT; GLDGAPTV; LDGAPTVP; DGAPTVPE; GAPTVPEG; APTVPEGS; PTVPEGSD; TVPEGSDK; VPEGSDKA; PEGSDKAL; EGSDKALM; GSDKALMH; SDKALMHL; DKALMHLG; KALMHLGD; ALMHLGDP; LMHLGDPP; MHLGDPPR; HLGDPPRR; LGDPPRRC; GDPPRRCD; DPPRRCDT; PPRRCDTH; PRRCDTHP; RRCDTHPD; RCDTHPDG; CDTHPDGT; DTHPDGTS; THPDGTSS; HPDGTSSA; PDGTSSAA; DGTSSAAA; GTSSAAAA; TSSAAAAL; SSAAAALV; SAAAALVL; AAAALVLR; AAALVLRR; AALVLRRI; ALVLRRID; LVLRRIDV; VLRRIDVH; LRRIDVHP; RRIDVHPL; RIDVHPLL; IDVHPLLT; DVHPLLTG; VHPLLTGL; HPLLTGLG; PLLTGLGR; LLTGLGRG; LTGLGRGR; TGLGRGRQ; GLGRGRQT; LGRGRQTV; GRGRQTVS; RGRQTVSL; GRQTVSLR; RQTVSLRN; QTVSLRNG; | 24942-25598 |

Fig. 28 continued

| | | |
|---|---|---|
| | TVSLRNGH; VSLRNGHL; SLRNGHLV; LRNGHLVA; RNGHLVAT; NGHLVATA; GHLVATAN; HLVATANR; LVATANRA; VATANRAI; ATANRAIL; TANRAILS; ANRAILSR; NRAILSRR; RAILSRRR; AILSRRRS; ILSRRRSR; LSRRRSRL; SRRRSRLT; RRRSRLTR; RRSRLTRG; RSRLTRGR; SRLTRGRS; RLTRGRSF; LTRGRSFT; TRGRSFTS; RGRSFTSH; GRSFTSHL; RSFTSHLI; SFTSHLIT; FTSHLITS; TSHLITSC; SHLITSCP; HLITSCPR; LITSCPRL; ITSCPRLD; TSCPRLDD; SCPRLDDH; CPRLDDHQ; PRLDDHQH; RLDDHQHR; LDDHQHRH; DDHQHRHP; DHQHRHPT; HQHRHPTR; QHRHPTRC; HRHPTRCR; RHPTRCRA; HPTRCRAE; PTRCRAEH; TRCRAEHA; RCRAEHAG; CRAEHAGC; RAEHAGCT; AEHAGCTV; EHAGCTVA; HAGCTVAT; AGCTVATC; GCTVATCI; CTVATCIP; TVATCIPN; VATCIPNA; ATCIPNAH; TCIPNAHD; CIPNAHDP; IPNAHDPA; PNAHDPAP; NAHDPAPG; AHDPAPGH; HDPAPGHQ; DPAPGHQT; PAPGHQTP; APGHQTPR; PGHQTPRW; GHQTPRWG; HQTPRWGP; QTPRWGPF; TPRWGPFR; PRWGPFRL; RWGPFRLK; WGPFRLKP; GPFRLKPA; PFRLKPAY; FRLKPAYT; RLKPAYTR; LKPAYTRI<br><br>9 mers:<br>MAAGSGGGT; AAGSGGGTV; AGSGGGTVG; GSGGGTVGL; SGGGTVGLV; GGGTVGLVL; GGTVGLVLP; GTVGLVLPR; TVGLVLPRV; VGLVLPRVA; GLVLPRVAS; LVLPRVASL; VLPRVASLS; LPRVASLSG; PRVASLSGL; RVASLSGLD; VASLSGLDG; ASLSGLDGA; SLSGLDGAP; LSGLDGAPT; SGLDGAPTV; GLDGAPTVP; LDGAPTVPE; DGAPTVPEG; GAPTVPEGS; APTVPEGSD; PTVPEGSDK; TVPEGSDKA; VPEGSDKAL; PEGSDKALM; EGSDKALMH; GSDKALMHL; SDKALMHLG; DKALMHLGD; KALMHLGDP; ALMHLGDPP; LMHLGDPPR; MHLGDPPRR; HLGDPPRRC; LGDPPRRCD; GDPPRRCDT; DPPRRCDTH; PPRRCDTHP; PRRCDTHPD; RRCDTHPDG; RCDTHPDGT; CDTHPDGTS; DTHPDGTSS; THPDGTSSA; HPDGTSSAA; PDGTSSAAA; DGTSSAAAA; GTSSAAAAL; TSSAAAALV; SSAAAALVL; SAAAALVLR; AAAALVLRR; AAALVLRRI; AALVLRRID; ALVLRRIDV; LVLRRIDVH; VLRRIDVHP; LRRIDVHPL; RRIDVHPLL; RIDVHPLLT; IDVHPLLTG; DVHPLLTGL; VHPLLTGLG; HPLLTGLGR; PLLTGLGRG; LLTGLGRGR; LTGLGRGRQ; TGLGRGRQT; GLGRGRQTV; LGRGRQTVS; GRGRQTVSL; RGRQTVSLR; GRQTVSLRN; RQTVSLRNG; QTVSLRNGH; TVSLRNGHL; VSLRNGHLV; SLRNGHLVA; LRNGHLVAT; RNGHLVATA; NGHLVATAN; GHLVATANR; HLVATANRA; LVATANRAI; VATANRAIL; ATANRAILS; TANRAILSR; ANRAILSRR; NRAILSRRR; RAILSRRRS; AILSRRRSR; ILSRRRSRL; LSRRRSRLT; SRRRSRLTR; RRRSRLTRG; RRSRLTRGR; RSRLTRGRS; SRLTRGRSF; RLTRGRSFT; LTRGRSFTS; TRGRSFTSH; RGRSFTSHL; GRSFTSHLI; RSFTSHLIT; SFTSHLITS; FTSHLITSC; TSHLITSCP; SHLITSCPR; HLITSCPRL; LITSCPRLD; ITSCPRLDD; TSCPRLDDH; SCPRLDDHQ; CPRLDDHQH; PRLDDHQHR; RLDDHQHRH; LDDHQHRHP; DDHQHRHPT; DHQHRHPTR; HQHRHPTRC; QHRHPTRCR; HRHPTRCRA; RHPTRCRAE; HPTRCRAEH; PTRCRAEHA; TRCRAEHAG; RCRAEHAGC; CRAEHAGCT; RAEHAGCTV; AEHAGCTVA; EHAGCTVAT; HAGCTVATC; AGCTVATCI; GCTVATCIP; CTVATCIPN; TVATCIPNA; VATCIPNAH; ATCIPNAHD; TCIPNAHDP; CIPNAHDPA; IPNAHDPAP; | |

Fig. 28 continued

| | | |
|---|---|---|
| | PNAHDPAPG; NAHDPAPGH; AHDPAPGHQ; HDPAPGHQT; DPAPGHQTP; PAPGHQTPR; APGHQTPRW; PGHQTPRWG; GHQTPRWGP; HQTPRWGPF; QTPRWGPFR; TPRWGPFRL; PRWGPFRLK; RWGPFRLKP; WGPFRLKPA; GPFRLKPAY; PFRLKPAYT; FRLKPAYTR;<br><br>10 mers:<br>MAAGSGGGTV; AAGSGGGTVG; AGSGGGTVGL; GSGGGTVGLV; SGGGTVGLVL; GGGTVGLVLP; GGTVGLVLPR; GTVGLVLPRV; TVGLVLPRVA; VGLVLPRVAS; GLVLPRVASL; LVLPRVASLS; VLPRVASLSG; LPRVASLSGL; PRVASLSGLD; RVASLSGLDG; VASLSGLDGA; ASLSGLDGAP; SLSGLDGAPT; LSGLDGAPTV; SGLDGAPTVP; GLDGAPTVPE; LDGAPTVPEG; DGAPTVPEGS; GAPTVPEGSD; APTVPEGSDK; PTVPEGSDKA; TVPEGSDKAL; VPEGSDKALM; PEGSDKALMH; EGSDKALMHL; GSDKALMHLG; SDKALMHLGD; DKALMHLGDP; KALMHLGDPP; ALMHLGDPPR; LMHLGDPPRR; MHLGDPPRRC; HLGDPPRRCD; LGDPPRRCDT; GDPPRRCDTH; DPPRRCDTHP; PPRRCDTHPD; PRRCDTHPDG; RRCDTHPDGT; RCDTHPDGTS; CDTHPDGTSS; DTHPDGTSSA; THPDGTSSAA; HPDGTSSAAA; PDGTSSAAAA; DGTSSAAAAL; GTSSAAAALV; TSSAAAALVL; SSAAAALVLR; SAAAALVLRR; AAAALVLRRI; AAALVLRRID; AALVLRRIDV; ALVLRRIDVH; LVLRRIDVHP; VLRRIDVHPL; LRRIDVHPLL; RRIDVHPLLT; RIDVHPLLTG; IDVHPLLTGL; DVHPLLTGLG; VHPLLTGLGR; HPLLTGLGRG; PLLTGLGRGR; LLTGLGRGRQ; LTGLGRGRQT; TGLGRGRQTV; GLGRGRQTVS; LGRGRQTVSL; GRGRQTVSLR; RGRQTVSLRN; GRQTVSLRNG; RQTVSLRNGH; QTVSLRNGHL; TVSLRNGHLV; VSLRNGHLVA; SLRNGHLVAT; LRNGHLVATA; RNGHLVATAN; NGHLVATANR; GHLVATANRA; HLVATANRAI; LVATANRAIL; VATANRAILS; ATANRAILSR; TANRAILSRR; ANRAILSRRR; NRAILSRRRS; RAILSRRRSR; AILSRRRSRL; ILSRRRSRLT; LSRRRSRLTR; SRRRSRLTRG; RRRSRLTRGR; RRSRLTRGRS; RSRLTRGRSF; SRLTRGRSFT; RLTRGRSFTS; LTRGRSFTSH; TRGRSFTSHL; RGRSFTSHLI; GRSFTSHLIT; RSFTSHLITS; SFTSHLITSC; FTSHLITSCP; TSHLITSCPR; SHLITSCPRL; HLITSCPRLD; LITSCPRLDD; ITSCPRLDDH; TSCPRLDDHQ; SCPRLDDHQH; CPRLDDHQHR; PRLDDHQHRH; RLDDHQHRHP; LDDHQHRHPT; DDHQHRHPTR; DHQHRHPTRC; HQHRHPTRCR; QHRHPTRCRA; HRHPTRCRAE; RHPTRCRAEH; HPTRCRAEHA; PTRCRAEHAG; TRCRAEHAGC; RCRAEHAGCT; CRAEHAGCTV; RAEHAGCTVA; AEHAGCTVAT; EHAGCTVATC; HAGCTVATCI; AGCTVATCIP; GCTVATCIPN; CTVATCIPNA; TVATCIPNAH; VATCIPNAHD; ATCIPNAHDP; TCIPNAHDPA; CIPNAHDPAP; IPNAHDPAPG; PNAHDPAPGH; NAHDPAPGHQ; AHDPAPGHQT; HDPAPGHQTP; DPAPGHQTPR; PAPGHQTPRW; APGHQTPRWG; PGHQTPRWGP; GHQTPRWGPF; HQTPRWGPFR; QTPRWGPFRL; TPRWGPFRLK; PRWGPFRLKP; RWGPFRLKPA; WGPFRLKPAY; GPFRLKPAYT; PFRLKPAYTR; FRLKPAYTRI<br><br>11 mers:<br>MAAGSGGGTVG; AAGSGGGTVGL; AGSGGGTVGLV; GSGGGTVGLVL; SGGGTVGLVLP; GGGTVGLVLPR; GGTVGLVLPRV; GTVGLVLPRVA; TVGLVLPRVAS; VGLVLPRVASL; GLVLPRVASLS; | |

Fig. 28 continued

| | | |
|---|---|---|
| | LVLPRVASLSG; VLPRVASLSGL; LPRVASLSGLD; PRVASLSGLDG; RVASLSGLDGA; VASLSGLDGAP; ASLSGLDGAPT; SLSGLDGAPTV; LSGLDGAPTVP; SGLDGAPTVPE; GLDGAPTVPEG; LDGAPTVPEGS; DGAPTVPEGSD; GAPTVPEGSDK; APTVPEGSDKA; PTVPEGSDKAL; TVPEGSDKALM; VPEGSDKALMH; PEGSDKALMHL; EGSDKALMHLG; GSDKALMHLGD; SDKALMHLGDP; DKALMHLGDPP; KALMHLGDPPR; ALMHLGDPPRR; LMHLGDPPRRC; MHLGDPPRRCD; HLGDPPRRCDT; LGDPPRRCDTH; GDPPRRCDTHP; DPPRRCDTHPD; PPRRCDTHPDG; PRRCDTHPDGT; RRCDTHPDGTS; RCDTHPDGTSS; CDTHPDGTSSA; DTHPDGTSSAA; THPDGTSSAAA; HPDGTSSAAAA; PDGTSSAAAAL; DGTSSAAAALV; GTSSAAAALVL; TSSAAAALVLR; SSAAAALVLRR; SAAAALVLRRI; AAAALVLRRID; AAALVLRRIDV; AALVLRRIDVH; ALVLRRIDVHP; LVLRRIDVHPL; VLRRIDVHPLL; LRRIDVHPLLT; RRIDVHPLLTG; RIDVHPLLTGL; IDVHPLLTGLG; DVHPLLTGLGR; VHPLLTGLGRG; HPLLTGLGRGR; PLLTGLGRGRQ; LLTGLGRGRQT; LTGLGRGRQTV; TGLGRGRQTVS; GLGRGRQTVSL; LGRGRQTVSLR; GRGRQTVSLRN; RGRQTVSLRNG; GRQTVSLRNGH; RQTVSLRNGHL; QTVSLRNGHLV; TVSLRNGHLVA; VSLRNGHLVAT; SLRNGHLVATA; LRNGHLVATAN; RNGHLVATANR; NGHLVATANRA; GHLVATANRAI; HLVATANRAIL; LVATANRAILS; VATANRAILSR; ATANRAILSRR; TANRAILSRRR; ANRAILSRRRS; NRAILSRRRSR; RAILSRRRSRL; AILSRRRSRLT; ILSRRRSRLTR; LSRRRSRLTRG; SRRRSRLTRGR; RRRSRLTRGRS; RRSRLTRGRSF; RSRLTRGRSFT; SRLTRGRSFTS; RLTRGRSFTSH; LTRGRSFTSHL; TRGRSFTSHLI; RGRSFTSHLIT; GRSFTSHLITS; RSFTSHLITSC; SFTSHLITSCP; FTSHLITSCPR; TSHLITSCPRL; SHLITSCPRLD; HLITSCPRLDD; LITSCPRLDDH; ITSCPRLDDHQ; TSCPRLDDHQH; SCPRLDDHQHR; CPRLDDHQHRH; PRLDDHQHRHP; RLDDHQHRHPT; LDDHQHRHPTR; DDHQHRHPTRC; DHQHRHPTRCR; HQHRHPTRCRA; QHRHPTRCRAE; HRHPTRCRAEH; RHPTRCRAEHA; HPTRCRAEHAG; PTRCRAEHAGC; TRCRAEHAGCT; RCRAEHAGCTV; CRAEHAGCTVA; RAEHAGCTVAT; AEHAGCTVATC; EHAGCTVATCI; HAGCTVATCIP; AGCTVATCIPN; GCTVATCIPNA; CTVATCIPNAH; TVATCIPNAHD; VATCIPNAHDP; ATCIPNAHDPA; TCIPNAHDPAP; CIPNAHDPAPG; IPNAHDPAPGH; PNAHDPAPGHQ; NAHDPAPGHQT; AHDPAPGHQTP; HDPAPGHQTPR; DPAPGHQTPRW; PAPGHQTPRWG; APGHQTPRWGP; PGHQTPRWGPF; GHQTPRWGPFR; HQTPRWGPFRL; QTPRWGPFRLK; TPRWGPFRLKP; PRWGPFRLKPA; RWGPFRLKPAY; WGPFRLKPAYT; GPFRLKPAYTR; PFRLKPAYTRI | |
| 30) Rv1955 | 8 mers:<br>MPSGWVSH; PSGWVSHR; SGWVSHRL; GWVSHRLG; WVSHRLGG; VSHRLGGS; SHRLGGSP; HRLGGSPK; RLGGSPKC; LGGSPKCI; GGSPKCIS; GSPKCISA; SPKCISAL; PKCISALS; KCISALSL; CISALSLP; ISALSLPS; SALSLPSG; ALSLPSGT; LSLPSGTV; SLPSGTVG; LPSGTVGA; PSGTVGAP; SGTVGAPS; GTVGAPSK; TVGAPSKP; VGAPSKPD; GAPSKPDN; APSKPDND; PSKPDNDA; SKPDNDAT; KPDNDATR; PDNDATRG; DNDATRGR; NDATRGRT; DATRGRTR; ATRGRTRP; TRGRTRPT; RGRTRPTV; GRTRPTVP; RTRPTVPP; TRPTVPPP; RPTVPPPD; PTVPPPDP; TVPPPDPA; | 25599-26243 |

Fig. 28 continued

| | | |
|---|---|---|
| | VPPPDPAA; PPPDPAAM; PPDPAAMG; PDPAAMGT; DPAAMGTW; PAAMGTWK; AAMGTWKF; AMGTWKFF; MGTWKFFR; GTWKFFRA; TWKFFRAS; WKFFRASV; KFFRASVD; FFRASVDG; FRASVDGR; RASVDGRP; ASVDGRPV; SVDGRPVF; VDGRPVFK; DGRPVFKK; GRPVFKKE; RPVFKKEF; PVFKKEFD; VFKKEFDK; FKKEFDKL; KKEFDKLP; KEFDKLPD; EFDKLPDQ; FDKLPDQA; DKLPDQAR; KLPDQARA; LPDQARAA; PDQARAAL; DQARAALI; QARAALIV; ARAALIVL; RAALIVLM; AALIVLMQ; ALIVLMQR; LIVLMQRY; IVLMQRYL; VLMQRYLV; LMQRYLVG; MQRYLVGD; QRYLVGDL; RYLVGDLA; YLVGDLAA; LVGDLAAG; VGDLAAGS; GDLAAGSI; DLAAGSIK; LAAGSIKP; AAGSIKPI; AGSIKPIR; GSIKPIRG; SIKPIRGD; IKPIRGDI; KPIRGDIL; PIRGDILE; IRGDILEL; RGDILELR; GDILELRW; DILELRWH; ILELRWHE; LELRWHEA; ELRWHEAN; LRWHEANN; RWHEANNH; WHEANNHF; HEANNHFR; EANNHFRV; ANNHFRVL; NNHFRVLF; NHFRVLFF; HFRVLFFR; FRVLFFRW; RVLFFRWG; VLFFRWGQ; LFFRWGQH; FFRWGQHP; FRWGQHPV; RWGQHPVA; WGQHPVAL; GQHPVALT; QHPVALTA; HPVALTAF; PVALTAFY; VALTAFYK; ALTAFYKN; LTAFYKNQ; TAFYKNQQ; AFYKNQQK; FYKNQQKT; YKNQQKTP; KNQQKTPK; NQQKTPKT; QQKTPKTK; QKTPKTKI; KTPKTKIE; TPKTKIET; PKTKIETA; KTKIETAL; TKIETALD; KIETALDR; IETALDRQ; ETALDRQK; TALDRQKI; ALDRQKIW; LDRQKIWK; DRQKIWKR; RQKIWKRA; QKIWKRAF; KIWKRAFG; IWKRAFGD; WKRAFGDT; KRAFGDTP; RAFGDTPP; AFGDTPPI<br><br>9 mers:<br>MPSGWVSHR; PSGWVSHRL; SGWVSHRLG; GWVSHRLGG; WVSHRLGGS; VSHRLGGSP; SHRLGGSPK; HRLGGSPKC; RLGGSPKCI; LGGSPKCIS; GGSPKCISA; GSPKCISAL; SPKCISALS; PKCISALSL; KCISALSLP; CISALSLPS; ISALSLPSG; SALSLPSGT; ALSLPSGTV; LSLPSGTVG; SLPSGTVGA; LPSGTVGAP; PSGTVGAPS; SGTVGAPSK; GTVGAPSKP; TVGAPSKPD; VGAPSKPDN; GAPSKPDND; APSKPDNDA; PSKPDNDAT; SKPDNDATR; KPDNDATRG; PDNDATRGR; DNDATRGRT; NDATRGRTR; DATRGRTRP; ATRGRTRPT; TRGRTRPTV; RGRTRPTVP; GRTRPTVPP; RTRPTVPPP; TRPTVPPPD; RPTVPPPDP; PTVPPPDPA; TVPPPDPAA; VPPPDPAAM; PPPDPAAMG; PPDPAAMGT; PDPAAMGTW; DPAAMGTWK; PAAMGTWKF; AAMGTWKFF; AMGTWKFFR; MGTWKFFRA; GTWKFFRAS; TWKFFRASV; WKFFRASVD; KFFRASVDG; FFRASVDGR; FRASVDGRP; RASVDGRPV; ASVDGRPVF; SVDGRPVFK; VDGRPVFKK; DGRPVFKKE; GRPVFKKEF; RPVFKKEFD; PVFKKEFDK; VFKKEFDKL; FKKEFDKLP; KKEFDKLPD; KEFDKLPDQ; EFDKLPDQA; FDKLPDQAR; DKLPDQARA; KLPDQARAA; LPDQARAAL; PDQARAALI; DQARAALIV; QARAALIVL; ARAALIVLM; RAALIVLMQ; AALIVLMQR; ALIVLMQRY; LIVLMQRYL; IVLMQRYLV; VLMQRYLVG; LMQRYLVGD; MQRYLVGDL; QRYLVGDLA; RYLVGDLAA; YLVGDLAAG; LVGDLAAGS; VGDLAAGSI; GDLAAGSIK; DLAAGSIKP; LAAGSIKPI; AAGSIKPIR; AGSIKPIRG; GSIKPIRGD; SIKPIRGDI; IKPIRGDIL; KPIRGDILE; PIRGDILEL; IRGDILELR; RGDILELRW; GDILELRWH; DILELRWHE; ILELRWHEA; LELRWHEAN; ELRWHEANN; LRWHEANNH; RWHEANNHF; WHEANNHFR; HEANNHFRV; EANNHFRVL; ANNHFRVLF; NNHFRVLFF; NHFRVLFFR; HFRVLFFRW; | |

Fig. 28 continued

| | | | |
|---|---|---|---|
| | FRVLFFRWG; RVLFFRWGQ; VLFFRWGQH; LFFRWGQHP; FFRWGQHPV; FRWGQHPVA; RWGQHPVAL; WGQHPVALT; GQHPVALTA; QHPVALTAF; HPVALTAFY; PVALTAFYK; VALTAFYKN; ALTAFYKNQ; LTAFYKNQQ; TAFYKNQQK; AFYKNQQKT; FYKNQQKTP; YKNQQKTPK; KNQQKTPKT; NQQKTPKTK; QQKTPKTKI; QKTPKTKIE; KTPKTKIET; TPKTKIETA; PKTKIETAL; KTKIETALD; TKIETALDR; KIETALDRQ; IETALDRQK; ETALDRQKI; TALDRQKIW; ALDRQKIWK; LDRQKIWKR; DRQKIWKRA; RQKIWKRAF; QKIWKRAFG; KIWKRAFGD; IWKRAFGDT; WKRAFGDTP; KRAFGDTPP<br><br>10 mers:<br>MPSGWVSHRL; PSGWVSHRLG; SGWVSHRLGG; GWVSHRLGGS; WVSHRLGGSP; VSHRLGGSPK; SHRLGGSPKC; HRLGGSPKCI; RLGGSPKCIS; LGGSPKCISA; GGSPKCISAL; GSPKCISALS; SPKCISALSL; PKCISALSLP; KCISALSLPS; CISALSLPSG; ISALSLPSGT; SALSLPSGTV; ALSLPSGTVG; LSLPSGTVGA; SLPSGTVGAP; LPSGTVGAPS; PSGTVGAPSK; SGTVGAPSKP; GTVGAPSKPD; TVGAPSKPDN; VGAPSKPDND; GAPSKPDNDA; APSKPDNDAT; PSKPDNDATR; SKPDNDATRG; KPDNDATRGR; PDNDATRGRT; DNDATRGRTR; NDATRGRTRP; DATRGRTRPT; ATRGRTRPTV; TRGRTRPTVP; RGRTRPTVPP; GRTRPTVPPP; RTRPTVPPPD; TRPTVPPPDP; RPTVPPPDPA; PTVPPPDPAA; TVPPPDPAAM; VPPPDPAAMG; PPPDPAAMGT; PPDPAAMGTW; PDPAAMGTWK; DPAAMGTWKF; PAAMGTWKFF; AAMGTWKFFR; AMGTWKFFRA; MGTWKFFRAS; GTWKFFRASV; TWKFFRASVD; WKFFRASVDG; KFFRASVDGR; FFRASVDGRP; FRASVDGRPV; RASVDGRPVF; ASVDGRPVFK; SVDGRPVFKK; VDGRPVFKKE; DGRPVFKKEF; GRPVFKKEFD; RPVFKKEFDK; PVFKKEFDKL; VFKKEFDKLP; FKKEFDKLPD; KKEFDKLPDQ; KEFDKLPDQA; EFDKLPDQAR; FDKLPDQARA; DKLPDQARAA; KLPDQARAAL; LPDQARAALI; PDQARAALIV; DQARAALIVL; QARAALIVLM; ARAALIVLMQ; RAALIVLMQR; AALIVLMQRY; ALIVLMQRYL; LIVLMQRYLV; IVLMQRYLVG; VLMQRYLVGD; LMQRYLVGDL; MQRYLVGDLA; QRYLVGDLAA; RYLVGDLAAG; YLVGDLAAGS; LVGDLAAGSI; VGDLAAGSIK; GDLAAGSIKP; DLAAGSIKPI; LAAGSIKPIR; AAGSIKPIRG; AGSIKPIRGD; GSIKPIRGDI; SIKPIRGDIL; IKPIRGDILE; KPIRGDILEL; PIRGDILELR; IRGDILELRW; RGDILELRWH; GDILELRWHE; DILELRWHEA; ILELRWHEAN; LELRWHEANN; ELRWHEANNH; LRWHEANNHF; RWHEANNHFR; WHEANNHFRV; HEANNHFRVL; EANNHFRVLF; ANNHFRVLFF; NNHFRVLFFR; NHFRVLFFRW; HFRVLFFRWG; FRVLFFRWGQ; RVLFFRWGQH; VLFFRWGQHP; LFFRWGQHPV; FFRWGQHPVA; FRWGQHPVAL; RWGQHPVALT; WGQHPVALTA; GQHPVALTAF; QHPVALTAFY; HPVALTAFYK; PVALTAFYKN; VALTAFYKNQ; ALTAFYKNQQ; LTAFYKNQQK; TAFYKNQQKT; AFYKNQQKTP; FYKNQQKTPK; YKNQQKTPKT; KNQQKTPKTK; NQQKTPKTKI; QQKTPKTKIE; QKTPKTKIET; KTPKTKIETA; TPKTKIETAL; PKTKIETALD; KTKIETALDR; TKIETALDRQ; KIETALDRQK; IETALDRQKI; ETALDRQKIW; TALDRQKIWK; ALDRQKIWKR; LDRQKIWKRA; DRQKIWKRAF; RQKIWKRAFG; QKIWKRAFGD; KIWKRAFGDT; IWKRAFGDTP; WKRAFGDTPP; KRAFGDTPPI | |

Fig. 28 continued

| | | |
|---|---|---|
| | 11 mers:<br>MPSGWVSHRLG; PSGWVSHRLGG; SGWVSHRLGGS; GWVSHRLGGSP; WVSHRLGGSPK; VSHRLGGSPKC; SHRLGGSPKCI; HRLGGSPKCIS; RLGGSPKCISA; LGGSPKCISAL; GGSPKCISALS; GSPKCISALSL; SPKCISALSLP; PKCISALSLPS; KCISALSLPSG; CISALSLPSGT; ISALSLPSGTV; SALSLPSGTVG; ALSLPSGTVGA; LSLPSGTVGAP; SLPSGTVGAPS; LPSGTVGAPSK; PSGTVGAPSKP; SGTVGAPSKPD; GTVGAPSKPDN; TVGAPSKPDND; VGAPSKPDNDA; GAPSKPDNDAT; APSKPDNDATR; PSKPDNDATRG; SKPDNDATRGR; KPDNDATRGRT; PDNDATRGRTR; DNDATRGRTRP; NDATRGRTRPT; DATRGRTRPTV; ATRGRTRPTVP; TRGRTRPTVPP; RGRTRPTVPPP; GRTRPTVPPPD; RTRPTVPPPDP; TRPTVPPPDPA; RPTVPPPDPAA; PTVPPPDPAAM; TVPPPDPAAMG; VPPPDPAAMGT; PPPDPAAMGTW; PPDPAAMGTWK; PDPAAMGTWKF; DPAAMGTWKFF; PAAMGTWKFFR; AAMGTWKFFRA; AMGTWKFFRAS; MGTWKFFRASV; GTWKFFRASVD; TWKFFRASVDG; WKFFRASVDGR; KFFRASVDGRP; FFRASVDGRPV; FRASVDGRPVF; RASVDGRPVFK; ASVDGRPVFKK; SVDGRPVFKKE; VDGRPVFKKEF; DGRPVFKKEFD; GRPVFKKEFDK; RPVFKKEFDKL; PVFKKEFDKLP; VFKKEFDKLPD; FKKEFDKLPDQ; KKEFDKLPDQA; KEFDKLPDQAR; EFDKLPDQARA; FDKLPDQARAA; DKLPDQARAAL; KLPDQARAALI; LPDQARAALIV; PDQARAALIVL; DQARAALIVLM; QARAALIVLMQ; ARAALIVLMQR; RAALIVLMQRY; AALIVLMQRYL; ALIVLMQRYLV; LIVLMQRYLVG; IVLMQRYLVGD; VLMQRYLVGDL; LMQRYLVGDLA; MQRYLVGDLAA; QRYLVGDLAAG; RYLVGDLAAGS; YLVGDLAAGSI; LVGDLAAGSIK; VGDLAAGSIKP; GDLAAGSIKPI; DLAAGSIKPIR; LAAGSIKPIRG; AAGSIKPIRGD; AGSIKPIRGDI; GSIKPIRGDIL; SIKPIRGDILE; IKPIRGDILEL; KPIRGDILELR; PIRGDILELRW; IRGDILELRWH; RGDILELRWHE; GDILELRWHEA; DILELRWHEAN; ILELRWHEANN; LELRWHEANNH; ELRWHEANNHF; LRWHEANNHFR; RWHEANNHFRV; WHEANNHFRVL; HEANNHFRVLF; EANNHFRVLFF; ANNHFRVLFFR; NNHFRVLFFRW; NHFRVLFFRWG; HFRVLFFRWGQ; FRVLFFRWGQH; RVLFFRWGQHP; VLFFRWGQHPV; LFFRWGQHPVA; FFRWGQHPVAL; FRWGQHPVALT; RWGQHPVALTA; WGQHPVALTAF; GQHPVALTAFY; QHPVALTAFYK; HPVALTAFYKN; PVALTAFYKNQ; VALTAFYKNQQ; ALTAFYKNQQK; LTAFYKNQQKT; TAFYKNQQKTP; AFYKNQQKTPK; FYKNQQKTPKT; YKNQQKTPKTK; KNQQKTPKTKI; NQQKTPKTKIE; QQKTPKTKIET; QKTPKTKIETA; KTPKTKIETAL; TPKTKIETALD; PKTKIETALDR; KTKIETALDRQ; TKIETALDRQK; KIETALDRQKI; IETALDRQKIW; ETALDRQKIWK; TALDRQKIWKR; ALDRQKIWKRA; LDRQKIWKRAF; DRQKIWKRAFG; RQKIWKRAFGD; QKIWKRAFGDT; KIWKRAFGDTP; IWKRAFGDTPP; WKRAFGDTPPI | |
| 31) Rv2034 | 8 mers:<br>MSTYRSPD; STYRSPDR; TYRSPDRA; YRSPDRAW; RSPDRAWQ; SPDRAWQA; PDRAWQAL; DRAWQALA; RAWQALAD; AWQALADG; WQALADGT; QALADGTR; ALADGTRR; LADGTRRA; ADGTRRAI; DGTRRAIV; GTRRAIVE; TRRAIVER; RRAIVERL; RAIVERLA; AIVERLAH; IVERLAHG; VERLAHGP; ERLAHGPL; RLAHGPLA; LAHGPLAV; AHGPLAVG; HGPLAVGE; GPLAVGEL; PLAVGELA; LAVGELAR; AVGELARD; VGELARDL; GELARDLP; ELARDLPV; | 26244-26637 |

Fig. 28 continued

| | | |
|---|---|---|
| | LARDLPVS; ARDLPVSR; RDLPVSRP; DLPVSRPA; LPVSRPAV; PVSRPAVS; VSRPAVSQ; SRPAVSQH; RPAVSQHL; PAVSQHLK; AVSQHLKV; VSQHLKVL; SQHLKVLK; QHLKVLKT; HLKVLKTA; LKVLKTAR; KVLKTARL; VLKTARLV; LKTARLVC; KTARLVCD; TARLVCDR; ARLVCDRP; RLVCDRPA; LVCDRPAG; VCDRPAGT; CDRPAGTR; DRPAGTRR; RPAGTRRV; PAGTRRVY; AGTRRVYQ; GTRRVYQL; TRRVYQLD; RRVYQLDP; RVYQLDPT; VYQLDPTG; YQLDPTGL; QLDPTGLA; LDPTGLAA; DPTGLAAL; PTGLAALR; TGLAALRT; GLAALRTD; LAALRTDL; AALRTDLD; ALRTDLDR; LRTDLDRF; RTDLDRFW; TDLDRFWT; DLDRFWTR; LDRFWTRA; DRFWTRAL; RFWTRALT; FWTRALTG; WTRALTGY; TRALTGYA; RALTGYAQ; ALTGYAQL; LTGYAQLI; TGYAQLID; GYAQLIDS; YAQLIDSE; AQLIDSEG; QLIDSEGD; LIDSEGDD; IDSEGDDT<br><br>9 mers:<br>MSTYRSPDR; STYRSPDRA; TYRSPDRAW; YRSPDRAWQ; RSPDRAWQA; SPDRAWQAL; PDRAWQALA; DRAWQALAD; RAWQALADG; AWQALADGT; WQALADGTR; QALADGTRR; ALADGTRRA; LADGTRRAI; ADGTRRAIV; DGTRRAIVE; GTRRAIVER; TRRAIVERL; RRAIVERLA; RAIVERLAH; AIVERLAHG; IVERLAHGP; VERLAHGPL; ERLAHGPLA; RLAHGPLAV; LAHGPLAVG; AHGPLAVGE; HGPLAVGEL; GPLAVGELA; PLAVGELAR; LAVGELARD; AVGELARDL; VGELARDLP; GELARDLPV; ELARDLPVS; LARDLPVSR; ARDLPVSRP; RDLPVSRPA; DLPVSRPAV; LPVSRPAVS; PVSRPAVSQ; VSRPAVSQH; SRPAVSQHL; RPAVSQHLK; PAVSQHLKV; AVSQHLKVL; VSQHLKVLK; SQHLKVLKT; QHLKVLKTA; HLKVLKTAR; LKVLKTARL; KVLKTARLV; VLKTARLVC; LKTARLVCD; KTARLVCDR; TARLVCDRP; ARLVCDRPA; RLVCDRPAG; LVCDRPAGT; VCDRPAGTR; CDRPAGTRR; DRPAGTRRV; RPAGTRRVY; PAGTRRVYQ; AGTRRVYQL; GTRRVYQLD; TRRVYQLDP; RRVYQLDPT; RVYQLDPTG; VYQLDPTGL; YQLDPTGLA; QLDPTGLAA; LDPTGLAAL; DPTGLAALR; PTGLAALRT; TGLAALRTD; GLAALRTDL; LAALRTDLD; AALRTDLDR; ALRTDLDRF; LRTDLDRFW; RTDLDRFWT; TDLDRFWTR; DLDRFWTRA; LDRFWTRAL; DRFWTRALT; RFWTRALTG; FWTRALTGY; WTRALTGYA; TRALTGYAQ; RALTGYAQL; ALTGYAQLI; LTGYAQLID; TGYAQLIDS; GYAQLIDSE; YAQLIDSEG; AQLIDSEGD; QLIDSEGDD; LIDSEGDDT<br><br>10 mers:<br>MSTYRSPDRA; STYRSPDRAW; TYRSPDRAWQ; YRSPDRAWQA; RSPDRAWQAL; SPDRAWQALA; PDRAWQALAD; DRAWQALADG; RAWQALADGT; AWQALADGTR; WQALADGTRR; QALADGTRRA; ALADGTRRAI; LADGTRRAIV; ADGTRRAIVE; DGTRRAIVER; GTRRAIVERL; TRRAIVERLA; RRAIVERLAH; RAIVERLAHG; AIVERLAHGP; IVERLAHGPL; VERLAHGPLA; ERLAHGPLAV; RLAHGPLAVG; LAHGPLAVGE; AHGPLAVGEL; HGPLAVGELA; GPLAVGELAR; PLAVGELARD; LAVGELARDL; AVGELARDLP; VGELARDLPV; GELARDLPVS; ELARDLPVSR; LARDLPVSRP; ARDLPVSRPA; RDLPVSRPAV; DLPVSRPAVS; LPVSRPAVSQ; PVSRPAVSQH; VSRPAVSQHL; SRPAVSQHLK; RPAVSQHLKV; PAVSQHLKVL; AVSQHLKVLK; VSQHLKVLKT; SQHLKVLKTA; QHLKVLKTAR; HLKVLKTARL; LKVLKTARLV; KVLKTARLVC; | |

Fig. 28 continued

| | | |
|---|---|---|
| | VLKTARLVCD; LKTARLVCDR; KTARLVCDRP; TARLVCDRPA; ARLVCDRPAG; RLVCDRPAGT; LVCDRPAGTR; VCDRPAGTRR; CDRPAGTRRV; DRPAGTRRVY; RPAGTRRVYQ; PAGTRRVYQL; AGTRRVYQLD; GTRRVYQLDP; TRRVYQLDPT; RRVYQLDPTG; RVYQLDPTGL; VYQLDPTGLA; YQLDPTGLAA; QLDPTGLAAL; LDPTGLAALR; DPTGLAALRT; PTGLAALRTD; TGLAALRTDL; GLAALRTDLD; LAALRTDLDR; AALRTDLDRF; ALRTDLDRFW; LRTDLDRFWT; RTDLDRFWTR; TDLDRFWTRA; DLDRFWTRAL; LDRFWTRALT; DRFWTRALTG; RFWTRALTGY; FWTRALTGYA; WTRALTGYAQ; TRALTGYAQL; RALTGYAQLI; ALTGYAQLID; LTGYAQLIDS; TGYAQLIDSE; GYAQLIDSEG; YAQLIDSEGD; AQLIDSEGDD; QLIDSEGDDT<br><br>11 mers:<br>MSTYRSPDRAW; STYRSPDRAWQ; TYRSPDRAWQA; YRSPDRAWQAL; RSPDRAWQALA; SPDRAWQALAD; PDRAWQALADG; DRAWQALADGT; RAWQALADGTR; AWQALADGTRR; WQALADGTRRA; QALADGTRRAI; ALADGTRRAIV; LADGTRRAIVE; ADGTRRAIVER; DGTRRAIVERL; GTRRAIVERLA; TRRAIVERLAH; RRAIVERLAHG; RAIVERLAHGP; AIVERLAHGPL; IVERLAHGPLA; VERLAHGPLAV; ERLAHGPLAVG; RLAHGPLAVGE; LAHGPLAVGEL; AHGPLAVGELA; HGPLAVGELAR; GPLAVGELARD; PLAVGELARDL; LAVGELARDLP; AVGELARDLPV; VGELARDLPVS; GELARDLPVSR; ELARDLPVSRP; LARDLPVSRPA; ARDLPVSRPAV; RDLPVSRPAVS; DLPVSRPAVSQ; LPVSRPAVSQH; PVSRPAVSQHL; VSRPAVSQHLK; SRPAVSQHLKV; RPAVSQHLKVL; PAVSQHLKVLK; AVSQHLKVLKT; VSQHLKVLKTA; SQHLKVLKTAR; QHLKVLKTARL; HLKVLKTARLV; LKVLKTARLVC; KVLKTARLVCD; VLKTARLVCDR; LKTARLVCDRP; KTARLVCDRPA; TARLVCDRPAG; ARLVCDRPAGT; RLVCDRPAGTR; LVCDRPAGTRR; VCDRPAGTRRV; CDRPAGTRRVY; DRPAGTRRVYQ; RPAGTRRVYQL; PAGTRRVYQLD; AGTRRVYQLDP; GTRRVYQLDPT; TRRVYQLDPTG; RRVYQLDPTGL; RVYQLDPTGLA; VYQLDPTGLAA; YQLDPTGLAAL; QLDPTGLAALR; LDPTGLAALRT; DPTGLAALRTD; PTGLAALRTDL; TGLAALRTDLD; GLAALRTDLDR; LAALRTDLDRF; AALRTDLDRFW; ALRTDLDRFWT; LRTDLDRFWTR; RTDLDRFWTRA; TDLDRFWTRAL; DLDRFWTRALT; LDRFWTRALTG; DRFWTRALTGY; RFWTRALTGYA; FWTRALTGYAQ; WTRALTGYAQL; TRALTGYAQLI; RALTGYAQLID; ALTGYAQLIDS; LTGYAQLIDSE; TGYAQLIDSEG; GYAQLIDSEGD; YAQLIDSEGDD; AQLIDSEGDDT | |
| 32) Rv2050 | 8 mers:<br>MADRVLRG; ADRVLRGS; DRVLRGSR; RVLRGSRL; VLRGSRLG; LRGSRLGA; RGSRLGAV; GSRLGAVS; SRLGAVSY; RLGAVSYE; LGAVSYET; GAVSYETD; AVSYETDR; VSYETDRN; SYETDRNH; YETDRNHD; ETDRNHDL; TDRNHDLA; DRNHDLAP; RNHDLAPR; NHDLAPRQ; HDLAPRQI; DLAPRQIA; LAPRQIAR; APRQIARY; PRQIARYR; RQIARYRT; QIARYRTD; IARYRTDN; ARYRTDNG; RYRTDNGE; YRTDNGEE; RTDNGEEF; TDNGEEFE; DNGEEFEV; NGEEFEVP; GEEFEVPF; EEFEVPFA; EFEVPFAD; FEVPFADD; EVPFADDA; VPFADDAE; PFADDAEI; FADDAEIP; ADDAEIPG; DDAEIPGT; DAEIPGTW; AEIPGTWL; EIPGTWLC; IPGTWLCR; PGTWLCRN; GTWLCRNG; TWLCRNGM; WLCRNGME; LCRNGMEG; CRNGMEGT; RNGMEGTL; NGMEGTLI; GMEGTLIE; MEGTLIEG; | 26638-27047 |

Fig. 28 continued

| | | | |
|---|---|---|---|
| | EGTLIEGD; GTLIEGDL; TLIEGDLP; LIEGDLPE; IEGDLPEP; EGDLPEPK; GDLPEPKK; DLPEPKKV; LPEPKKVK; PEPKKVKP; EPKKVKPP; PKKVKPPR; KKVKPPRT; KVKPPRTH; VKPPRTHW; KPPRTHWD; PPRTHWDM; PRTHWDML; RTHWDMLL; THWDMLLE; HWDMLLER; WDMLLERR; DMLLERRS; MLLERRSI; LLERRSIE; LERRSIEE; ERRSIEEL; RRSIEELE; RSIEELEE; SIEELEEL; IEELEELL; EELEELLK; ELEELLKE; LEELLKER; EELLKERL; ELLKERLE; LLKERLEL; LKERLELI; KERLELIR; ERLELIRS; RLELIRSR; LELIRSRR; ELIRSRRR; LIRSRRRG<br><br>9 mers:<br>MADRVLRGS; ADRVLRGSR; DRVLRGSRL; RVLRGSRLG; VLRGSRLGA; LRGSRLGAV; RGSRLGAVS; GSRLGAVSY; SRLGAVSYE; RLGAVSYET; LGAVSYETD; GAVSYETDR; AVSYETDRN; VSYETDRNH; SYETDRNHD; YETDRNHDL; ETDRNHDLA; TDRNHDLAP; DRNHDLAPR; RNHDLAPRQ; NHDLAPRQI; HDLAPRQIA; DLAPRQIAR; LAPRQIARY; APRQIARYR; PRQIARYRT; RQIARYRTD; QIARYRTDN; IARYRTDNG; ARYRTDNGE; RYRTDNGEE; YRTDNGEEF; RTDNGEEFE; TDNGEEFEV; DNGEEFEVP; NGEEFEVPF; GEEFEVPFA; EEFEVPFAD; EFEVPFADD; FEVPFADDA; EVPFADDAE; VPFADDAEI; PFADDAEIP; FADDAEIPG; ADDAEIPGT; DDAEIPGTW; DAEIPGTWL; AEIPGTWLC; EIPGTWLCR; IPGTWLCRN; PGTWLCRNG; GTWLCRNGM; TWLCRNGME; WLCRNGMEG; LCRNGMEGT; CRNGMEGTL; RNGMEGTLI; NGMEGTLIE; GMEGTLIEG; MEGTLIEGD; EGTLIEGDL; GTLIEGDLP; TLIEGDLPE; LIEGDLPEP; IEGDLPEPK; EGDLPEPKK; GDLPEPKKV; DLPEPKKVK; LPEPKKVKP; PEPKKVKPP; EPKKVKPPR; PKKVKPPRT; KKVKPPRTH; KVKPPRTHW; VKPPRTHWD; KPPRTHWDM; PPRTHWDML; PRTHWDMLL; RTHWDMLLE; THWDMLLER; HWDMLLERR; WDMLLERRS; DMLLERRSI; MLLERRSIE; LLERRSIEE; LERRSIEEL; ERRSIEELE; RRSIEELEE; RSIEELEEL; SIEELEELL; IEELEELLK; EELEELLKE; ELEELLKER; LEELLKERL; EELLKERLE; ELLKERLEL; LLKERLELI; LKERLELIR; KERLELIRS; ERLELIRSR; RLELIRSRR; LELIRSRRR; ELIRSRRRG<br><br>10 mers:<br>MADRVLRGSR; ADRVLRGSRL; DRVLRGSRLG; RVLRGSRLGA; VLRGSRLGAV; LRGSRLGAVS; RGSRLGAVSY; GSRLGAVSYE; SRLGAVSYET; RLGAVSYETD; LGAVSYETDR; GAVSYETDRN; AVSYETDRNH; VSYETDRNHD; SYETDRNHDL; YETDRNHDLA; ETDRNHDLAP; TDRNHDLAPR; DRNHDLAPRQ; RNHDLAPRQI; NHDLAPRQIA; HDLAPRQIAR; DLAPRQIARY; LAPRQIARYR; APRQIARYRT; PRQIARYRTD; RQIARYRTDN; QIARYRTDNG; IARYRTDNGE; ARYRTDNGEE; RYRTDNGEEF; YRTDNGEEFE; RTDNGEEFEV; TDNGEEFEVP; DNGEEFEVPF; NGEEFEVPFA; GEEFEVPFAD; EEFEVPFADD; EFEVPFADDA; FEVPFADDAE; EVPFADDAEI; VPFADDAEIP; PFADDAEIPG; FADDAEIPGT; ADDAEIPGTW; DDAEIPGTWL; DAEIPGTWLC; AEIPGTWLCR; EIPGTWLCRN; IPGTWLCRNG; PGTWLCRNGM; GTWLCRNGME; TWLCRNGMEG; WLCRNGMEGT; LCRNGMEGTL; CRNGMEGTLI; RNGMEGTLIE; NGMEGTLIEG; GMEGTLIEGD; MEGTLIEGDL; EGTLIEGDLP; GTLIEGDLPE; TLIEGDLPEP; LIEGDLPEPK; | |

Fig. 28 continued

| | | |
|---|---|---|
| | IEGDLPEPKK; EGDLPEPKKV; GDLPEPKKVK; DLPEPKKVKP; LPEPKKVKPP; PEPKKVKPPR; EPKKVKPPRT; PKKVKPPRTH; KKVKPPRTHW; KVKPPRTHWD; VKPPRTHWDM; KPPRTHWDML; PPRTHWDMLL; PRTHWDMLLE; RTHWDMLLER; THWDMLLERR; HWDMLLERRS; WDMLLERRSI; DMLLERRSIE; MLLERRSIEE; LLERRSIEEL; LERRSIEELE; ERRSIEELEE; RRSIEELEEL; RSIEELEELL; SIEELEELLK; IEELEELLKE; EELEELLKER; ELEELLKERL; LEELLKERLE; EELLKERLEL; ELLKERLELI; LLKERLELIR; LKERLELIRS; KERLELIRSR; ERLELIRSRR; RLELIRSRRR; LELIRSRRRG<br><br>11 mers:<br>MADRVLRGSRL; ADRVLRGSRLG; DRVLRGSRLGA; RVLRGSRLGAV; VLRGSRLGAVS; LRGSRLGAVSY; RGSRLGAVSYE; GSRLGAVSYET; SRLGAVSYETD; RLGAVSYETDR; LGAVSYETDRN; GAVSYETDRNH; AVSYETDRNHD; VSYETDRNHDL; SYETDRNHDLA; YETDRNHDLAP; ETDRNHDLAPR; TDRNHDLAPRQ; DRNHDLAPRQI; RNHDLAPRQIA; NHDLAPRQIAR; HDLAPRQIARY; DLAPRQIARYR; LAPRQIARYRT; APRQIARYRTD; PRQIARYRTDN; RQIARYRTDNG; QIARYRTDNGE; IARYRTDNGEE; ARYRTDNGEEF; RYRTDNGEEFE; YRTDNGEEFEV; RTDNGEEFEVP; TDNGEEFEVPF; DNGEEFEVPFA; NGEEFEVPFAD; GEEFEVPFADD; EEFEVPFADDA; EFEVPFADDAE; FEVPFADDAEI; EVPFADDAEIP; VPFADDAEIPG; PFADDAEIPGT; FADDAEIPGTW; ADDAEIPGTWL; DDAEIPGTWLC; DAEIPGTWLCR; AEIPGTWLCRN; EIPGTWLCRNG; IPGTWLCRNGM; PGTWLCRNGME; GTWLCRNGMEG; TWLCRNGMEGT; WLCRNGMEGTL; LCRNGMEGTLI; CRNGMEGTLIE; RNGMEGTLIEG; NGMEGTLIEGD; GMEGTLIEGDL; MEGTLIEGDLP; EGTLIEGDLPE; GTLIEGDLPEP; TLIEGDLPEPK; LIEGDLPEPKK; IEGDLPEPKKV; EGDLPEPKKVK; GDLPEPKKVKP; DLPEPKKVKPP; LPEPKKVKPPR; PEPKKVKPPRT; EPKKVKPPRTH; PKKVKPPRTHW; KKVKPPRTHWD; KVKPPRTHWDM; VKPPRTHWDML; KPPRTHWDMLL; PPRTHWDMLLE; PRTHWDMLLER; RTHWDMLLERR; THWDMLLERRS; HWDMLLERRSI; WDMLLERRSIE; DMLLERRSIEE; MLLERRSIEEL; LLERRSIEELE; LERRSIEELEE; ERRSIEELEEL; RRSIEELEELL; RSIEELEELLK; SIEELEELLKE; IEELEELLKER; EELEELLKERL; ELEELLKERLE; LEELLKERLEL; EELLKERLELI; ELLKERLELIR; LLKERLELIRS; LKERLELIRSR; KERLELIRSRR; ERLELIRSRRR; RLELIRSRRRG | |
| 33) Rv2169c | 8 mers:<br>MPLSDHEQ; PLSDHEQR; LSDHEQRM; SDHEQRML; DHEQRMLD; HEQRMLDQ; EQRMLDQI; QRMLDQIE; RMLDQIES; MLDQIESA; LDQIESAL; DQIESALY; QIESALYA; IESALYAE; ESALYAED; SALYAEDP; ALYAEDPK; LYAEDPKF; YAEDPKFA; AEDPKFAS; EDPKFASS; DPKFASSV; PKFASSVR; KFASSVRG; FASSVRGG; ASSVRGGG; SSVRGGGF; SVRGGGFR; VRGGGFRA; RGGGFRAP; GGGFRAPT; GGFRAPTA; GFRAPTAR; FRAPTARR; RAPTARRR; APTARRRL; PTARRRLQ; TARRRLQG; ARRRLQGA; RRRLQGAA; RRLQGAAL; RLQGAALF; LQGAALFI; QGAALFII; GAALFIIG; AALFIIGL; ALFIIGLG; LFIIGLGM; FIIGLGML; IIGLGMLV; IGLGMLVS; GLGMLVSG; LGMLVSGV; GMLVSGVA; MLVSGVAF; LVSGVAFK; VSGVAFKE; SGVAFKET; GVAFKETM; VAFKETMI; AFKETMIG; FKETMIGS; KETMIGSF; ETMIGSFP; TMIGSFPI; MIGSFPIL; | 27048-27549 |

Fig. 28 continued

| | | |
|---|---|---|
| | IGSFPILS; GSFPILSV; SFPILSVF; FPILSVFG; PILSVFGF; ILSVFGFV; LSVFGFVV; SVFGFVVM; VFGFVVMF; FGFVVMFG; GFVVMFGG; FVVMFGGV; VVMFGGVV; VMFGGVVY; MFGGVVYA; FGGVVYAI; GGVVYAIT; GVVYAITG; VVYAITGP; VYAITGPR; YAITGPRL; AITGPRLS; ITGPRLSG; TGPRLSGR; GPRLSGRM; PRLSGRMD; RLSGRMDR; LSGRMDRG; SGRMDRGG; GRMDRGGS; RMDRGGSA; MDRGGSAA; DRGGSAAG; RGGSAAGA; GGSAAGAS; GSAAGASR; SAAGASRQ; AAGASRQR; AGASRQRR; GASRQRRT; ASRQRRTK; SRQRRTKG; RQRRTKGA; QRRTKGAG; RRTKGAGG; RTKGAGGS; TKGAGGSF; KGAGGSFT; GAGGSFTS; AGGSFTSR; GGSFTSRM; GSFTSRME; SFTSRMED; FTSRMEDR; TSRMEDRF; SRMEDRFR; RMEDRFRR; MEDRFRRR; EDRFRRRF; DRFRRRFD; RFRRRFDE<br><br>9 mers:<br>MPLSDHEQR; PLSDHEQRM; LSDHEQRML; SDHEQRMLD; DHEQRMLDQ; HEQRMLDQI; EQRMLDQIE; QRMLDQIES; RMLDQIESA; MLDQIESAL; LDQIESALY; DQIESALYA; QIESALYAE; IESALYAED; ESALYAEDP; SALYAEDPK; ALYAEDPKF; LYAEDPKFA; YAEDPKFAS; AEDPKFASS; EDPKFASSV; DPKFASSVR; PKFASSVRG; KFASSVRGG; FASSVRGGG; ASSVRGGGF; SSVRGGGFR; SVRGGGFRA; VRGGGFRAP; RGGGFRAPT; GGGFRAPTA; GGFRAPTAR; GFRAPTARR; FRAPTARRR; RAPTARRRL; APTARRRLQ; PTARRRLQG; TARRRLQGA; ARRRLQGAA; RRRLQGAAL; RRLQGAALF; RLQGAALFI; LQGAALFII; QGAALFIIG; GAALFIIGL; AALFIIGLG; ALFIIGLGM; LFIIGLGML; FIIGLGMLV; IIGLGMLVS; IGLGMLVSG; GLGMLVSGV; LGMLVSGVA; GMLVSGVAF; MLVSGVAFK; LVSGVAFKE; VSGVAFKET; SGVAFKETM; GVAFKETMI; VAFKETMIG; AFKETMIGS; FKETMIGSF; KETMIGSFP; ETMIGSFPI; TMIGSFPIL; MIGSFPILS; IGSFPILSV; GSFPILSVF; SFPILSVFG; FPILSVFGF; PILSVFGFV; ILSVFGFVV; LSVFGFVVM; SVFGFVVMF; VFGFVVMFG; FGFVVMFGG; GFVVMFGGV; FVVMFGGVV; VVMFGGVVY; VMFGGVVYA; MFGGVVYAI; FGGVVYAIT; GGVVYAITG; GVVYAITGP; VVYAITGPR; VYAITGPRL; YAITGPRLS; AITGPRLSG; ITGPRLSGR; TGPRLSGRM; GPRLSGRMD; PRLSGRMDR; RLSGRMDRG; LSGRMDRGG; SGRMDRGGS; GRMDRGGSA; RMDRGGSAA; MDRGGSAAG; DRGGSAAGA; RGGSAAGAS; GGSAAGASR; GSAAGASRQ; SAAGASRQR; AAGASRQRR; AGASRQRRT; GASRQRRTK; ASRQRRTKG; SRQRRTKGA; RQRRTKGAG; QRRTKGAGG; RRTKGAGGS; RTKGAGGSF; TKGAGGSFT; KGAGGSFTS; GAGGSFTSR; AGGSFTSRM; GGSFTSRME; GSFTSRMED; SFTSRMEDR; FTSRMEDRF; TSRMEDRFR; SRMEDRFRR; RMEDRFRRR; MEDRFRRRF; EDRFRRRFD; DRFRRRFDE<br><br>10 mers:<br>MPLSDHEQRM; PLSDHEQRML; LSDHEQRMLD; SDHEQRMLDQ; DHEQRMLDQI; HEQRMLDQIE; EQRMLDQIES; QRMLDQIESA; RMLDQIESAL; MLDQIESALY; LDQIESALYA; DQIESALYAE; QIESALYAED; IESALYAEDP; ESALYAEDPK; SALYAEDPKF; ALYAEDPKFA; LYAEDPKFAS; YAEDPKFASS; AEDPKFASSV; EDPKFASSVR; DPKFASSVRG; PKFASSVRGG; KFASSVRGGG; FASSVRGGGF; ASSVRGGGFR; SSVRGGGFRA; SVRGGGFRAP; VRGGGFRAPT; RGGGFRAPTA; GGGFRAPTAR; GGFRAPTARR; | |

Fig. 28 continued

| | | | |
|---|---|---|---|
| | GFRAPTARRR; FRAPTARRRL; RAPTARRRLQ; APTARRRLQG; PTARRRLQGA; TARRRLQGAA; ARRRLQGAAL; RRRLQGAALF; RRLQGAALFI; RLQGAALFII; LQGAALFIIG; QGAALFIIGL; GAALFIIGLG; AALFIIGLGM; ALFIIGLGML; LFIIGLGMLV; FIIGLGMLVS; IIGLGMLVSG; IGLGMLVSGV; GLGMLVSGVA; LGMLVSGVAF; GMLVSGVAFK; MLVSGVAFKE; LVSGVAFKET; VSGVAFKETM; SGVAFKETMI; GVAFKETMIG; VAFKETMIGS; AFKETMIGSF; FKETMIGSFP; KETMIGSFPI; ETMIGSFPIL; TMIGSFPILS; MIGSFPILSV; IGSFPILSVF; GSFPILSVFG; SFPILSVFGF; FPILSVFGFV; PILSVFGFVV; ILSVFGFVVM; LSVFGFVVMF; SVFGFVVMFG; VFGFVVMFGG; FGFVVMFGGV; GFVVMFGGVV; FVVMFGGVVY; VVMFGGVVYA; VMFGGVVYAI; MFGGVVYAIT; FGGVVYAITG; GGVVYAITGP; GVVYAITGPR; VVYAITGPRL; VYAITGPRLS; YAITGPRLSG; AITGPRLSGR; ITGPRLSGRM; TGPRLSGRMD; GPRLSGRMDR; PRLSGRMDRG; RLSGRMDRGG; LSGRMDRGGS; SGRMDRGGSA; GRMDRGGSAA; RMDRGGSAAG; MDRGGSAAGA; DRGGSAAGAS; RGGSAAGASR; GGSAAGASRQ; GSAAGASRQR; SAAGASRQRR; AAGASRQRRT; AGASRQRRTK; GASRQRRTKG; ASRQRRTKGA; SRQRRTKGAG; RQRRTKGAGG; QRRTKGAGGS; RRTKGAGGSF; RTKGAGGSFT; TKGAGGSFTS; KGAGGSFTSR; GAGGSFTSRM; AGGSFTSRME; GGSFTSRMED; GSFTSRMEDR; SFTSRMEDRF; FTSRMEDRFR; TSRMEDRFRR; SRMEDRFRRR; RMEDRFRRRF; MEDRFRRRFD; EDRFRRRFDE<br><br>11 mers:<br>MPLSDHEQRML; PLSDHEQRMLD; LSDHEQRMLDQ; SDHEQRMLDQI; DHEQRMLDQIE; HEQRMLDQIES; EQRMLDQIESA; QRMLDQIESAL; RMLDQIESALY; MLDQIESALYA; LDQIESALYAE; DQIESALYAED; QIESALYAEDP; IESALYAEDPK; ESALYAEDPKF; SALYAEDPKFA; ALYAEDPKFAS; LYAEDPKFASS; YAEDPKFASSV; AEDPKFASSVR; EDPKFASSVRG; DPKFASSVRGG; PKFASSVRGGG; KFASSVRGGGF; FASSVRGGGFR; ASSVRGGGFRA; SSVRGGGFRAP; SVRGGGFRAPT; VRGGGFRAPTA; RGGGFRAPTAR; GGGFRAPTARR; GGFRAPTARRR; GFRAPTARRRL; FRAPTARRRLQ; RAPTARRRLQG; APTARRRLQGA; PTARRRLQGAA; TARRRLQGAAL; ARRRLQGAALF; RRRLQGAALFI; RRLQGAALFII; RLQGAALFIIG; LQGAALFIIGL; QGAALFIIGLG; GAALFIIGLGM; AALFIIGLGML; ALFIIGLGMLV; LFIIGLGMLVS; FIIGLGMLVSG; IIGLGMLVSGV; IGLGMLVSGVA; GLGMLVSGVAF; LGMLVSGVAFK; GMLVSGVAFKE; MLVSGVAFKET; LVSGVAFKETM; VSGVAFKETMI; SGVAFKETMIG; GVAFKETMIGS; VAFKETMIGSF; AFKETMIGSFP; FKETMIGSFPI; KETMIGSFPIL; ETMIGSFPILS; TMIGSFPILSV; MIGSFPILSVF; IGSFPILSVFG; GSFPILSVFGF; SFPILSVFGFV; FPILSVFGFVV; PILSVFGFVVM; ILSVFGFVVMF; LSVFGFVVMFG; SVFGFVVMFGG; VFGFVVMFGGV; FGFVVMFGGVV; GFVVMFGGVVY; FVVMFGGVVYA; VVMFGGVVYAI; VMFGGVVYAIT; MFGGVVYAITG; FGGVVYAITGP; GGVVYAITGPR; GVVYAITGPRL; VVYAITGPRLS; VYAITGPRLSG; YAITGPRLSGR; AITGPRLSGRM; ITGPRLSGRMD; TGPRLSGRMDR; GPRLSGRMDRG; PRLSGRMDRGG; RLSGRMDRGGS; LSGRMDRGGSA; SGRMDRGGSAA; GRMDRGGSAAG; RMDRGGSAAGA; MDRGGSAAGAS; DRGGSAAGASR; | |

Fig. 28 continued

| | | |
|---|---|---|
| | RGGSAAGASRQ; GGSAAGASRQR; GSAAGASRQRR; SAAGASRQRRT; AAGASRQRRTK; AGASRQRRTKG; GASRQRRTKGA; ASRQRRTKGAG; SRQRRTKGAGG; RQRRTKGAGGS; QRRTKGAGGSF; RRTKGAGGSFT; RTKGAGGSFTS; TKGAGGSFTSR; KGAGGSFTSRM; GAGGSFTSRME; AGGSFTSRMED; GGSFTSRMEDR; GSFTSRMEDRF; SFTSRMEDRFR; FTSRMEDRFRR; TSRMEDRFRRR; SRMEDRFRRRF; RMEDRFRRRFD; MEDRFRRRFDE | |
| 34) Rv2270 | 8 mers:<br>MRLPGRHV; RLPGRHVL; LPGRHVLY; PGRHVLYA; GRHVLYAL; RHVLYALS; HVLYALSA; VLYALSAV; LYALSAVT; YALSAVTM; ALSAVTML; LSAVTMLA; SAVTMLAA; AVTMLAAC; VTMLAACS; TMLAACSS; MLAACSSN; LAACSSNG; AACSSNGA; ACSSNGAR; CSSNGARG; SSNGARGG; SNGARGGI; NGARGGIA; GARGGIAS; ARGGIAST; RGGIASTN; GGIASTNM; GIASTNMN; IASTNMNP; ASTNMNPT; STNMNPTN; TNMNPTNP; NMNPTNPP; MNPTNPPA; NPTNPPAT; PTNPPATA; TNPPATAE; NPPATAET; PPATAETA; PATAETAT; ATAETATV; TAETATVS; AETATVSP; ETATVSPT; TATVSPTP; ATVSPTPA; TVSPTPAP; VSPTPAPQ; SPTPAPQS; PTPAPQSA; TPAPQSAR; PAPQSART; APQSARTE; PQSARTET; QSARTETW; SARTETWI; ARTETWIN; RTETWINL; TETWINLQ; ETWINLQV; TWINLQVG; WINLQVGD; INLQVGDC; NLQVGDCL; LQVGDCLA; QVGDCLAD; VGDCLADL; GDCLADLP; DCLADLPP; CLADLPPA; LADLPPAD; ADLPPADL; DLPPADLS; LPPADLSR; PPADLSRI; PADLSRIT; ADLSRITV; DLSRITVT; LSRITVTI; SRITVTIV; RITVTIVD; ITVTIVDC; TVTIVDCA; VTIVDCAT; TIVDCATA; IVDCATAH; VDCATAHS; DCATAHSA; CATAHSAE; ATAHSAEV; TAHSAEVY; AHSAEVYL; HSAEVYLR; SAEVYLRA; AEVYLRAP; EVYLRAPV; VYLRAPVA; YLRAPVAV; LRAPVAVD; RAPVAVDA; APVAVDAA; PVAVDAAV; VAVDAAVV; AVDAAVVS; VDAAVVSM; DAAVVSMA; AAVVSMAN; AVVSMANR; VVSMANRD; VSMANRDC; SMANRDCA; MANRDCAA; ANRDCAAG; NRDCAAGF; RDCAAGFA; DCAAGFAP; CAAGFAPY; AAGFAPYT; AGFAPYTG; GFAPYTGQ; FAPYTGQS; APYTGQSV; PYTGQSVD; YTGQSVDT; TGQSVDTS; GQSVDTSP; QSVDTSPY; SVDTSPYS; VDTSPYSV; DTSPYSVA; TSPYSVAY; SPYSVAYL; PYSVAYLI; YSVAYLID; SVAYLIDS; VAYLIDSH; AYLIDSHQ; YLIDSHQD; LIDSHQDR; IDSHQDRT; DSHQDRTG; SHQDRTGA; HQDRTGAD; QDRTGADP; DRTGADPT; RTGADPTP; TGADPTPS; GADPTPST; ADPTPSTV; DPTPSTVI; PTPSTVIC; TPSTVICL; PSTVICLL; STVICLLQ; TVICLLQP; VICLLQPA; ICLLQPAN; CLLQPANG; LLQPANGQ; LQPANGQL; QPANGQLL; PANGQLLT; ANGQLLTG; NGQLLTGS; GQLLTGSA; QLLTGSAR; LLTGSARR<br><br>9 mers:<br>MRLPGRHVL; RLPGRHVLY; LPGRHVLYA; PGRHVLYAL; GRHVLYALS; RHVLYALSA; HVLYALSAV; VLYALSAVT; LYALSAVTM; YALSAVTML; ALSAVTMLA; LSAVTMLAA; SAVTMLAAC; AVTMLAACS; VTMLAACSS; TMLAACSSN; MLAACSSNG; LAACSSNGA; AACSSNGAR; ACSSNGARG; CSSNGARGG; SSNGARGGI; SNGARGGIA; NGARGGIAS; GARGGIAST; ARGGIASTN; RGGIASTNM; GGIASTNMN; GIASTNMNP; IASTNMNPT; ASTNMNPTN; STNMNPTNP; TNMNPTNPP; | 27550-28215 |

Fig. 28 continued

| | | |
|---|---|---|
| | NMNPTNPPA; MNPTNPPAT; NPTNPPATA; PTNPPATAE; TNPPATAET; NPPATAETA; PPATAETAT; PATAETATV; ATAETATVS; TAETATVSP; AETATVSPT; ETATVSPTP; TATVSPTPA; ATVSPTPAP; TVSPTPAPQ; VSPTPAPQS; SPTPAPQSA; PTPAPQSAR; TPAPQSART; PAPQSARTE; APQSARTET; PQSARTETW; QSARTETWI; SARTETWIN; ARTETWINL; RTETWINLQ; TETWINLQV; ETWINLQVG; TWINLQVGD; WINLQVGDC; INLQVGDCL; NLQVGDCLA; LQVGDCLAD; QVGDCLADL; VGDCLADLP; GDCLADLPP; DCLADLPPA; CLADLPPAD; LADLPPADL; ADLPPADLS; DLPPADLSR; LPPADLSRI; PPADLSRIT; PADLSRITV; ADLSRITVT; DLSRITVTI; LSRITVTIV; SRITVTIVD; RITVTIVDC; ITVTIVDCA; TVTIVDCAT; VTIVDCATA; TIVDCATAH; IVDCATAHS; VDCATAHSA; DCATAHSAE; CATAHSAEV; ATAHSAEVY; TAHSAEVYL; AHSAEVYLR; HSAEVYLRA; SAEVYLRAP; AEVYLRAPV; EVYLRAPVA; VYLRAPVAV; YLRAPVAVD; LRAPVAVDA; RAPVAVDAA; APVAVDAAV; PVAVDAAVV; VAVDAAVVS; AVDAAVVSM; VDAAVVSMA; DAAVVSMAN; AAVVSMANR; AVVSMANRD; VVSMANRDC; VSMANRDCA; SMANRDCAA; MANRDCAAG; ANRDCAAGF; NRDCAAGFA; RDCAAGFAP; DCAAGFAPY; CAAGFAPYT; AAGFAPYTG; AGFAPYTGQ; GFAPYTGQS; FAPYTGQSV; APYTGQSVD; PYTGQSVDT; YTGQSVDTS; TGQSVDTSP; GQSVDTSPY; QSVDTSPYS; SVDTSPYSV; VDTSPYSVA; DTSPYSVAY; TSPYSVAYL; SPYSVAYLI; PYSVAYLID; YSVAYLIDS; SVAYLIDSH; VAYLIDSHQ; AYLIDSHQD; YLIDSHQDR; LIDSHQDRT; IDSHQDRTG; DSHQDRTGA; SHQDRTGAD; HQDRTGADP; QDRTGADPT; DRTGADPTP; RTGADPTPS; TGADPTPST; GADPTPSTV; ADPTPSTVI; DPTPSTVIC; PTPSTVICL; TPSTVICLL; PSTVICLLQ; STVICLLQP; TVICLLQPA; VICLLQPAN; ICLLQPANG; CLLQPANGQ; LLQPANGQL; LQPANGQLL; QPANGQLLT; PANGQLLTG; ANGQLLTGS; NGQLLTGSA; GQLLTGSAR; QLLTGSARR<br><br>10 mers:<br>MRLPGRHVLY; RLPGRHVLYA; LPGRHVLYAL; PGRHVLYALS; GRHVLYALSA; RHVLYALSAV; HVLYALSAVT; VLYALSAVTM; LYALSAVTML; YALSAVTMLA; ALSAVTMLAA; LSAVTMLAAC; SAVTMLAACS; AVTMLAACSS; VTMLAACSSN; TMLAACSSNG; MLAACSSNGA; LAACSSNGAR; AACSSNGARG; ACSSNGARGG; CSSNGARGGI; SSNGARGGIA; SNGARGGIAS; NGARGGIAST; GARGGIASTN; ARGGIASTNM; RGGIASTNMN; GGIASTNMNP; GIASTNMNPT; IASTNMNPTN; ASTNMNPTNP; STNMNPTNPP; TNMNPTNPPA; NMNPTNPPAT; MNPTNPPATA; NPTNPPATAE; PTNPPATAET; TNPPATAETA; NPPATAETAT; PPATAETATV; PATAETATVS; ATAETATVSP; TAETATVSPT; AETATVSPTP; ETATVSPTPA; TATVSPTPAP; ATVSPTPAPQ; TVSPTPAPQS; VSPTPAPQSA; SPTPAPQSAR; PTPAPQSART; TPAPQSARTE; PAPQSARTET; APQSARTETW; PQSARTETWI; QSARTETWIN; SARTETWINL; ARTETWINLQ; RTETWINLQV; TETWINLQVG; ETWINLQVGD; TWINLQVGDC; WINLQVGDCL; INLQVGDCLA; NLQVGDCLAD; LQVGDCLADL; QVGDCLADLP; VGDCLADLPP; GDCLADLPPA; DCLADLPPAD; CLADLPPADL; LADLPPADLS; ADLPPADLSR; DLPPADLSRI; LPPADLSRIT; PPADLSRITV; PADLSRITVT; ADLSRITVTI; DLSRITVTIV; LSRITVTIVD; SRITVTIVDC; | |

Fig. 28 continued

| | | |
|---|---|---|
| | RITVTIVDCA; ITVTIVDCAT; TVTIVDCATA; VTIVDCATAH; TIVDCATAHS; IVDCATAHSA; VDCATAHSAE; DCATAHSAEV; CATAHSAEVY; ATAHSAEVYL; TAHSAEVYLR; AHSAEVYLRA; HSAEVYLRAP; SAEVYLRAPV; AEVYLRAPVA; EVYLRAPVAV; VYLRAPVAVD; YLRAPVAVDA; LRAPVAVDAA; RAPVAVDAAV; APVAVDAAVV; PVAVDAAVVS; VAVDAAVVSM; AVDAAVVSMA; VDAAVVSMAN; DAAVVSMANR; AAVVSMANRD; AVVSMANRDC; VVSMANRDCA; VSMANRDCAA; SMANRDCAAG; MANRDCAAGF; ANRDCAAGFA; NRDCAAGFAP; RDCAAGFAPY; DCAAGFAPYT; CAAGFAPYTG; AAGFAPYTGQ; AGFAPYTGQS; GFAPYTGQSV; FAPYTGQSVD; APYTGQSVDT; PYTGQSVDTS; YTGQSVDTSP; TGQSVDTSPY; GQSVDTSPYS; QSVDTSPYSV; SVDTSPYSVA; VDTSPYSVAY; DTSPYSVAYL; TSPYSVAYLI; SPYSVAYLID; PYSVAYLIDS; YSVAYLIDSH; SVAYLIDSHQ; VAYLIDSHQD; AYLIDSHQDR; YLIDSHQDRT; LIDSHQDRTG; IDSHQDRTGA; DSHQDRTGAD; SHQDRTGADP; HQDRTGADPT; QDRTGADPTP; DRTGADPTPS; RTGADPTPST; TGADPTPSTV; GADPTPSTVI; ADPTPSTVIC; DPTPSTVICL; PTPSTVICLL; TPSTVICLLQ; PSTVICLLQP; STVICLLQPA; TVICLLQPAN; VICLLQPANG; ICLLQPANGQ; CLLQPANGQL; LLQPANGQLL; LQPANGQLLT; QPANGQLLTG; PANGQLLTGS; ANGQLLTGSA; NGQLLTGSAR; GQLLTGSARR<br><br>11 mers:<br>MRLPGRHVLYA; RLPGRHVLYAL; LPGRHVLYALS; PGRHVLYALSA; GRHVLYALSAV; RHVLYALSAVT; HVLYALSAVTM; VLYALSAVTML; LYALSAVTMLA; YALSAVTMLAA; ALSAVTMLAAC; LSAVTMLAACS; SAVTMLAACSS; AVTMLAACSSN; VTMLAACSSNG; TMLAACSSNGA; MLAACSSNGAR; LAACSSNGARG; AACSSNGARGG; ACSSNGARGGI; CSSNGARGGIA; SSNGARGGIAS; SNGARGGIAST; NGARGGIASTN; GARGGIASTNM; ARGGIASTNMN; RGGIASTNMNP; GGIASTNMNPT; GIASTNMNPTN; IASTNMNPTNP; ASTNMNPTNPP; STNMNPTNPPA; TNMNPTNPPAT; NMNPTNPPATA; MNPTNPPATAE; NPTNPPATAET; PTNPPATAETA; TNPPATAETAT; NPPATAETATV; PPATAETATVS; PATAETATVSP; ATAETATVSPT; TAETATVSPTP; AETATVSPTPA; ETATVSPTPAP; TATVSPTPAPQ; ATVSPTPAPQS; TVSPTPAPQSA; VSPTPAPQSAR; SPTPAPQSART; PTPAPQSARTE; TPAPQSARTET; PAPQSARTETW; APQSARTETWI; PQSARTETWIN; QSARTETWINL; SARTETWINLQ; ARTETWINLQV; RTETWINLQVG; TETWINLQVGD; ETWINLQVGDC; TWINLQVGDCL; WINLQVGDCLA; INLQVGDCLAD; NLQVGDCLADL; LQVGDCLADLP; QVGDCLADLPP; VGDCLADLPPA; GDCLADLPPAD; DCLADLPPADL; CLADLPPADLS; LADLPPADLSR; ADLPPADLSRI; DLPPADLSRIT; LPPADLSRITV; PPADLSRITVT; PADLSRITVTI; ADLSRITVTIV; DLSRITVTIVD; LSRITVTIVDC; SRITVTIVDCA; RITVTIVDCAT; ITVTIVDCATA; TVTIVDCATAH; VTIVDCATAHS; TIVDCATAHSA; IVDCATAHSAE; VDCATAHSAEV; DCATAHSAEVY; CATAHSAEVYL; ATAHSAEVYLR; TAHSAEVYLRA; AHSAEVYLRAP; HSAEVYLRAPV; SAEVYLRAPVA; AEVYLRAPVAV; EVYLRAPVAVD; VYLRAPVAVDA; YLRAPVAVDAA; LRAPVAVDAAV; RAPVAVDAAVV; APVAVDAAVVS; PVAVDAAVVSM; VAVDAAVVSMA; AVDAAVVSMAN; VDAAVVSMANR; DAAVVSMANRD; AAVVSMANRDC; AVVSMANRDCA; VVSMANRDCAA; VSMANRDCAAG; SMANRDCAAGF; | |

Fig. 28 continued

| | | |
|---|---|---|
| | MANRDCAAGFA; ANRDCAAGFAP; NRDCAAGFAPY; RDCAAGFAPYT; DCAAGFAPYTG; CAAGFAPYTGQ; AAGFAPYTGQS; AGFAPYTGQSV; GFAPYTGQSVD; FAPYTGQSVDT; APYTGQSVDTS; PYTGQSVDTSP; YTGQSVDTSPY; TGQSVDTSPYS; GQSVDTSPYSV; QSVDTSPYSVA; SVDTSPYSVAY; VDTSPYSVAYL; DTSPYSVAYLI; TSPYSVAYLID; SPYSVAYLIDS; PYSVAYLIDSH; YSVAYLIDSHQ; SVAYLIDSHQD; VAYLIDSHQDR; AYLIDSHQDRT; YLIDSHQDRTG; LIDSHQDRTGA; IDSHQDRTGAD; DSHQDRTGADP; SHQDRTGADPT; HQDRTGADPTP; QDRTGADPTPS; DRTGADPTPST; RTGADPTPSTV; TGADPTPSTVI; GADPTPSTVIC; ADPTPSTVICL; DPTPSTVICLL; PTPSTVICLLQ; TPSTVICLLQP; PSTVICLLQPA; STVICLLQPAN; TVICLLQPANG; VICLLQPANGQ; ICLLQPANGQL; CLLQPANGQLL; LLQPANGQLLT; LQPANGQLLTG; QPANGQLLTGS; PANGQLLTGSA; ANGQLLTGSAR; NGQLLTGSARR | |
| 35) Rv2302 | 8 mers:<br>MHAKVGDY; HAKVGDYL; AKVGDYLV; KVGDYLVV; VGDYLVVK; GDYLVVKG; DYLVVKGT; YLVVKGTT; LVVKGTTT; VVKGTTTE; VKGTTTER; KGTTTERH; GTTTERHD; TTTERHDQ; TTERHDQH; TERHDQHA; ERHDQHAE; RHDQHAEI; HDQHAEII; DQHAEIIE; QHAEIIEV; HAEIIEVR; AEIIEVRS; EIIEVRSA; IIEVRSAD; IEVRSADG; EVRSADGS; VRSADGSP; RSADGSPP; SADGSPPY; ADGSPPYV; DGSPPYVV; GSPPYVVR; SPPYVVRW; PPYVVRWL; PYVVRWLV; YVVRWLVN; VVRWLVNG; VRWLVNGH; RWLVNGHE; WLVNGHET; LVNGHETT; VNGHETTV; NGHETTVY; GHETTVYP; HETTVYPG; ETTVYPGS; TTVYPGSD; TVYPGSDA; VYPGSDAV; YPGSDAVV; PGSDAVVV; GSDAVVVT; SDAVVVTA; DAVVVTAT; AVVVTATE; VVVTATEH; VVTATEHA; VTATEHAE; TATEHAEA; ATEHAEAE; TEHAEAEK; EHAEAEKR; HAEAEKRA; AEAEKRAA; EAEKRAAA; AEKRAAAR; EKRAAARA; KRAAARAG; RAAARAGH; AAARAGHA; AARAGHAA; ARAGHAAT<br><br>9 mers:<br>MHAKVGDYL; HAKVGDYLV; AKVGDYLVV; KVGDYLVVK; VGDYLVVKG; GDYLVVKGT; DYLVVKGTT; YLVVKGTTT; LVVKGTTTE; VVKGTTTER; VKGTTTERH; KGTTTERHD; GTTTERHDQ; TTTERHDQH; TTERHDQHA; TERHDQHAE; ERHDQHAEI; RHDQHAEII; HDQHAEIIE; DQHAEIIEV; QHAEIIEVR; HAEIIEVRS; AEIIEVRSA; EIIEVRSAD; IIEVRSADG; IEVRSADGS; EVRSADGSP; VRSADGSPP; RSADGSPPY; SADGSPPYV; ADGSPPYVV; DGSPPYVVR; GSPPYVVRW; SPPYVVRWL; PPYVVRWLV; PYVVRWLVN; YVVRWLVNG; VVRWLVNGH; VRWLVNGHE; RWLVNGHET; WLVNGHETT; LVNGHETTV; VNGHETTVY; NGHETTVYP; GHETTVYPG; HETTVYPGS; ETTVYPGSD; TTVYPGSDA; TVYPGSDAV; VYPGSDAVV; YPGSDAVVV; PGSDAVVVT; GSDAVVVTA; SDAVVVTAT; DAVVVTATE; AVVVTATEH; VVVTATEHA; VVTATEHAE; VTATEHAEA; TATEHAEAE; ATEHAEAEK; TEHAEAEKR; EHAEAEKRA; HAEAEKRAA; AEAEKRAAA; EAEKRAAAR; AEKRAAARA; EKRAAARAG; KRAAARAGH; RAAARAGHA; AAARAGHAA; AARAGHAAT<br><br>10 mers:<br>MHAKVGDYLV; HAKVGDYLVV; AKVGDYLVVK; KVGDYLVVKG; | 28216-28501 |

Fig. 28 continued

| | | |
|---|---|---|
| | VGDYLVVKGT; GDYLVVKGTT; DYLVVKGTTT; YLVVKGTTTE; LVVKGTTTER; VVKGTTTERH; VKGTTTERHD; KGTTTERHDQ; GTTTERHDQH; TTTERHDQHA; TTERHDQHAE; TERHDQHAEI; ERHDQHAEII; RHDQHAEIIE; HDQHAEIIEV; DQHAEIIEVR; QHAEIIEVRS; HAEIIEVRSA; AEIIEVRSAD; EIIEVRSADG; IIEVRSADGS; IEVRSADGSP; EVRSADGSPP; VRSADGSPPY; RSADGSPPYV; SADGSPPYVV; ADGSPPYVVR; DGSPPYVVRW; GSPPYVVRWL; SPPYVVRWLV; PPYVVRWLVN; PYVVRWLVNG; YVVRWLVNGH; VVRWLVNGHE; VRWLVNGHET; RWLVNGHETT; WLVNGHETTV; LVNGHETTVY; VNGHETTVYP; NGHETTVYPG; GHETTVYPGS; HETTVYPGSD; ETTVYPGSDA; TTVYPGSDAV; TVYPGSDAVV; VYPGSDAVVV; YPGSDAVVVT; PGSDAVVVTA; GSDAVVVTAT; SDAVVVTATE; DAVVVTATEH; AVVVTATEHA; VVVTATEHAE; VVTATEHAEA; VTATEHAEAE; TATEHAEAEK; ATEHAEAEKR; TEHAEAEKRA; EHAEAEKRAA; HAEAEKRAAA; AEAEKRAAAR; EAEKRAAARA; AEKRAAARAG; EKRAAARAGH; KRAAARAGHA; RAAARAGHAA; AAARAGHAAT<br><br>11 mers:<br>MHAKVGDYLVV; HAKVGDYLVVK; AKVGDYLVVKG; KVGDYLVVKGT; VGDYLVVKGTT; GDYLVVKGTTT; DYLVVKGTTTE; YLVVKGTTTER; LVVKGTTTERH; VVKGTTTERHD; VKGTTTERHDQ; KGTTTERHDQH; GTTTERHDQHA; TTTERHDQHAE; TTERHDQHAEI; TERHDQHAEII; ERHDQHAEIIE; RHDQHAEIIEV; HDQHAEIIEVR; DQHAEIIEVRS; QHAEIIEVRSA; HAEIIEVRSAD; AEIIEVRSADG; EIIEVRSADGS; IIEVRSADGSP; IEVRSADGSPP; EVRSADGSPPY; VRSADGSPPYV; RSADGSPPYVV; SADGSPPYVVR; ADGSPPYVVRW; DGSPPYVVRWL; GSPPYVVRWLV; SPPYVVRWLVN; PPYVVRWLVNG; PYVVRWLVNGH; YVVRWLVNGHE; VVRWLVNGHET; VRWLVNGHETT; RWLVNGHETTV; WLVNGHETTVY; LVNGHETTVYP; VNGHETTVYPG; NGHETTVYPGS; GHETTVYPGSD; HETTVYPGSDA; ETTVYPGSDAV; TTVYPGSDAVV; TVYPGSDAVVV; VYPGSDAVVVT; YPGSDAVVVTA; PGSDAVVVTAT; GSDAVVVTATE; SDAVVVTATEH; DAVVVTATEHA; AVVVTATEHAE; VVVTATEHAEA; VVTATEHAEAE; VTATEHAEAEK; TATEHAEAEKR; ATEHAEAEKRA; TEHAEAEKRAA; EHAEAEKRAAA; HAEAEKRAAAR; AEAEKRAAARA; EAEKRAAARAG; AEKRAAARAGH; EKRAAARAGHA; KRAAARAGHAA; RAAARAGHAAT | |
| 36) Rv2346c | 8 mers:<br>MTINYQFG; TINYQFGD; INYQFGDV; NYQFGDVD; YQFGDVDA; QFGDVDAH; FGDVDAHG; GDVDAHGA; DVDAHGAM; VDAHGAMI; DAHGAMIR; AHGAMIRA; HGAMIRAQ; GAMIRAQA; AMIRAQAG; MIRAQAGL; IRAQAGLL; RAQAGLLE; AQAGLLEA; QAGLLEAE; AGLLEAEH; GLLEAEHQ; LLEAEHQA; LEAEHQAI; EAEHQAIV; AEHQAIVR; EHQAIVRD; HQAIVRDV; QAIVRDVL; AIVRDVLA; IVRDVLAA; VRDVLAAG; RDVLAAGD; DVLAAGDF; VLAAGDFW; LAAGDFWG; AAGDFWGG; AGDFWGGA; GDFWGGAG; DFWGGAGS; FWGGAGSV; WGGAGSVA; GGAGSVAC; GAGSVACQ; AGSVACQE; GSVACQEF; SVACQEFI; VACQEFIT; ACQEFITQ; CQEFITQL; QEFITQLG; EFITQLGR; FITQLGRN; ITQLGRNF; TQLGRNFQ; QLGRNFQV; LGRNFQVI; GRNFQVIY; RNFQVIYE; NFQVIYEQ; FQVIYEQA; QVIYEQAN; VIYEQANA; IYEQANAH; YEQANAHG; EQANAHGQ; QANAHGQK; ANAHGQKV; NAHGQKVQ; AHGQKVQA; | 28502-28843 |

Fig. 28 continued

| | | |
|---|---|---|
| | HGQKVQAA; GQKVQAAG; QKVQAAGN; KVQAAGNN; VQAAGNNM; QAAGNNMA; AAGNNMAQ; AGNNMAQT; GNNMAQTD; NNMAQTDS; NMAQTDSA; MAQTDSAV; AQTDSAVG; QTDSAVGS; TDSAVGSS; DSAVGSSW; SAVGSSWA<br><br>9 mers:<br>MTINYQFGD; TINYQFGDV; INYQFGDVD; NYQFGDVDA; YQFGDVDAH; QFGDVDAHG; FGDVDAHGA; GDVDAHGAM; DVDAHGAMI; VDAHGAMIR; DAHGAMIRA; AHGAMIRAQ; HGAMIRAQA; GAMIRAQAG; AMIRAQAGL; MIRAQAGLL; IRAQAGLLE; RAQAGLLEA; AQAGLLEAE; QAGLLEAEH; AGLLEAEHQ; GLLEAEHQA; LLEAEHQAI; LEAEHQAIV; EAEHQAIVR; AEHQAIVRD; EHQAIVRDV; HQAIVRDVL; QAIVRDVLA; AIVRDVLAA; IVRDVLAAG; VRDVLAAGD; RDVLAAGDF; DVLAAGDFW; VLAAGDFWG; LAAGDFWGG; AAGDFWGGA; AGDFWGGAG; GDFWGGAGS; DFWGGAGSV; FWGGAGSVA; WGGAGSVAC; GGAGSVACQ; GAGSVACQE; AGSVACQEF; GSVACQEFI; SVACQEFIT; VACQEFITQ; ACQEFITQL; CQEFITQLG; QEFITQLGR; EFITQLGRN; FITQLGRNF; ITQLGRNFQ; TQLGRNFQV; QLGRNFQVI; LGRNFQVIY; GRNFQVIYE; RNFQVIYEQ; NFQVIYEQA; FQVIYEQAN; QVIYEQANA; VIYEQANAH; IYEQANAHG; YEQANAHGQ; EQANAHGQK; QANAHGQKV; ANAHGQKVQ; NAHGQKVQA; AHGQKVQAA; HGQKVQAAG; GQKVQAAGN; QKVQAAGNN; KVQAAGNNM; VQAAGNNMA; QAAGNNMAQ; AAGNNMAQT; AGNNMAQTD; GNNMAQTDS; NNMAQTDSA; NMAQTDSAV; MAQTDSAVG; AQTDSAVGS; QTDSAVGSS; TDSAVGSSW; DSAVGSSWA<br><br>10 mers:<br>MTINYQFGDV; TINYQFGDVD; INYQFGDVDA; NYQFGDVDAH; YQFGDVDAHG; QFGDVDAHGA; FGDVDAHGAM; GDVDAHGAMI; DVDAHGAMIR; VDAHGAMIRA; DAHGAMIRAQ; AHGAMIRAQA; HGAMIRAQAG; GAMIRAQAGL; AMIRAQAGLL; MIRAQAGLLE; IRAQAGLLEA; RAQAGLLEAE; AQAGLLEAEH; QAGLLEAEHQ; AGLLEAEHQA; GLLEAEHQAI; LLEAEHQAIV; LEAEHQAIVR; EAEHQAIVRD; AEHQAIVRDV; EHQAIVRDVL; HQAIVRDVLA; QAIVRDVLAA; AIVRDVLAAG; IVRDVLAAGD; VRDVLAAGDF; RDVLAAGDFW; DVLAAGDFWG; VLAAGDFWGG; LAAGDFWGGA; AAGDFWGGAG; AGDFWGGAGS; GDFWGGAGSV; DFWGGAGSVA; FWGGAGSVAC; WGGAGSVACQ; GGAGSVACQE; GAGSVACQEF; AGSVACQEFI; GSVACQEFIT; SVACQEFITQ; VACQEFITQL; ACQEFITQLG; CQEFITQLGR; QEFITQLGRN; EFITQLGRNF; FITQLGRNFQ; ITQLGRNFQV; TQLGRNFQVI; QLGRNFQVIY; LGRNFQVIYE; GRNFQVIYEQ; RNFQVIYEQA; NFQVIYEQAN; FQVIYEQANA; QVIYEQANAH; VIYEQANAHG; IYEQANAHGQ; YEQANAHGQK; EQANAHGQKV; QANAHGQKVQ; ANAHGQKVQA; NAHGQKVQAA; AHGQKVQAAG; HGQKVQAAGN; GQKVQAAGNN; QKVQAAGNNM; KVQAAGNNMA; VQAAGNNMAQ; QAAGNNMAQT; AAGNNMAQTD; AGNNMAQTDS; GNNMAQTDSA; NNMAQTDSAV; NMAQTDSAVG; MAQTDSAVGS; AQTDSAVGSS; QTDSAVGSSW; TDSAVGSSWA<br><br>11 mers: | |

Fig. 28 continued

| | | |
|---|---|---|
| | MTINYQFGDVD; TINYQFGDVDA; INYQFGDVDAH; NYQFGDVDAHG; YQFGDVDAHGA; QFGDVDAHGAM; FGDVDAHGAMI; GDVDAHGAMIR; DVDAHGAMIRA; VDAHGAMIRAQ; DAHGAMIRAQA; AHGAMIRAQAG; HGAMIRAQAGL; GAMIRAQAGLL; AMIRAQAGLLE; MIRAQAGLLEA; IRAQAGLLEAE; RAQAGLLEAEH; AQAGLLEAEHQ; QAGLLEAEHQA; AGLLEAEHQAI; GLLEAEHQAIV; LLEAEHQAIVR; LEAEHQAIVRD; EAEHQAIVRDV; AEHQAIVRDVL; EHQAIVRDVLA; HQAIVRDVLAA; QAIVRDVLAAG; AIVRDVLAAGD; IVRDVLAAGDF; VRDVLAAGDFW; RDVLAAGDFWG; DVLAAGDFWGG; VLAAGDFWGGA; LAAGDFWGGAG; AAGDFWGGAGS; AGDFWGGAGSV; GDFWGGAGSVA; DFWGGAGSVAC; FWGGAGSVACQ; WGGAGSVACQE; GGAGSVACQEF; GAGSVACQEFI; AGSVACQEFIT; GSVACQEFITQ; SVACQEFITQL; VACQEFITQLG; ACQEFITQLGR; CQEFITQLGRN; QEFITQLGRNF; EFITQLGRNFQ; FITQLGRNFQV; ITQLGRNFQVI; TQLGRNFQVIY; QLGRNFQVIYE; LGRNFQVIYEQ; GRNFQVIYEQA; RNFQVIYEQAN; NFQVIYEQANA; FQVIYEQANAH; QVIYEQANAHG; VIYEQANAHGQ; IYEQANAHGQK; YEQANAHGQKV; EQANAHGQKVQ; QANAHGQKVQA; ANAHGQKVQAA; NAHGQKVQAAG; AHGQKVQAAGN; HGQKVQAAGNN; GQKVQAAGNNM; QKVQAAGNNMA; KVQAAGNNMAQ; VQAAGNNMAQT; QAAGNNMAQTD; AAGNNMAQTDS; AGNNMAQTDSA; GNNMAQTDSAV; NNMAQTDSAVG; NMAQTDSAVGS; MAQTDSAVGSS; AQTDSAVGSSW; QTDSAVGSSWA | |
| 37) Rv2347c | 8 mers:<br>MATRFMTD; ATRFMTDP; TRFMTDPH; RFMTDPHA; FMTDPHAM; MTDPHAMR; TDPHAMRD; DPHAMRDM; PHAMRDMA; HAMRDMAG; AMRDMAGR; MRDMAGRF; RDMAGRFE; DMAGRFEV; MAGRFEVH; AGRFEVHA; GRFEVHAQ; RFEVHAQT; FEVHAQTV; EVHAQTVE; VHAQTVED; HAQTVEDE; AQTVEDEA; QTVEDEAR; TVEDEARR; VEDEARRM; EDEARRMW; DEARRMWA; EARRMWAS; ARRMWASA; RRMWASAQ; RMWASAQN; MWASAQNI; WASAQNIS; ASAQNISG; SAQNISGA; AQNISGAG; QNISGAGW; NISGAGWS; ISGAGWSG; SGAGWSGM; GAGWSGMA; AGWSGMAE; GWSGMAEA; WSGMAEAT; SGMAEATS; GMAEATSL; MAEATSLD; AEATSLDT; EATSLDTM; ATSLDTMA; TSLDTMAQ; SLDTMAQM; LDTMAQMN; DTMAQMNQ; TMAQMNQA; MAQMNQAF; AQMNQAFR; QMNQAFRN; MNQAFRNI; NQAFRNIV; QAFRNIVN; AFRNIVNM; FRNIVNML; RNIVNMLH; NIVNMLHG; IVNMLHGV; VNMLHGVR; NMLHGVRD; MLHGVRDG; LHGVRDGL; HGVRDGLV; GVRDGLVR; VRDGLVRD; RDGLVRDA; DGLVRDAN; GLVRDANN; LVRDANNY; VRDANNYE; RDANNYEQ; DANNYEQQ; ANNYEQQE; NNYEQQEQ; NYEQQEQA; YEQQEQAS; EQQEQASQ; QQEQASQQ; QEQASQQI; EQASQQIL; QASQQILS; ASQQILSS;<br><br>9 mers:<br>MATRFMTDP; ATRFMTDPH; TRFMTDPHA; RFMTDPHAM; FMTDPHAMR; MTDPHAMRD; TDPHAMRDM; DPHAMRDMA; PHAMRDMAG; HAMRDMAGR; AMRDMAGRF; MRDMAGRFE; RDMAGRFEV; DMAGRFEVH; MAGRFEVHA; AGRFEVHAQ; GRFEVHAQT; RFEVHAQTV; FEVHAQTVE; EVHAQTVED; VHAQTVEDE; HAQTVEDEA; AQTVEDEAR; QTVEDEARR; TVEDEARRM; VEDEARRMW; EDEARRMWA; DEARRMWAS; | 28844-29201 |

Fig. 28 continued

| | | | |
|---|---|---|---|
| | EARRMWASA; ARRMWASAQ; RRMWASAQN; RMWASAQNI; MWASAQNIS; WASAQNISG; ASAQNISGA; SAQNISGAG; AQNISGAGW; QNISGAGWS; NISGAGWSG; ISGAGWSGM; SGAGWSGMA; GAGWSGMAE; AGWSGMAEA; GWSGMAEAT; WSGMAEATS; SGMAEATSL; GMAEATSLD; MAEATSLDT; AEATSLDTM; EATSLDTMA; ATSLDTMAQ; TSLDTMAQM; SLDTMAQMN; LDTMAQMNQ; DTMAQMNQA; TMAQMNQAF; MAQMNQAFR; AQMNQAFRN; QMNQAFRNI; MNQAFRNIV; NQAFRNIVN; QAFRNIVNM; AFRNIVNML; FRNIVNMLH; RNIVNMLHG; NIVNMLHGV; IVNMLHGVR; VNMLHGVRD; NMLHGVRDG; MLHGVRDGL; LHGVRDGLV; HGVRDGLVR; GVRDGLVRD; VRDGLVRDA; RDGLVRDAN; DGLVRDANN; GLVRDANNY; LVRDANNYE; VRDANNYEQ; RDANNYEQQ; DANNYEQQE; ANNYEQQEQ; NNYEQQEQA; NYEQQEQAS; YEQQEQASQ; EQQEQASQQ; QQEQASQQI; QEQASQQIL; EQASQQILS; QASQQILSS;<br><br>10 mers:<br>MATRFMTDPH; ATRFMTDPHA; TRFMTDPHAM; RFMTDPHAMR; FMTDPHAMRD; MTDPHAMRDM; TDPHAMRDMA; DPHAMRDMAG; PHAMRDMAGR; HAMRDMAGRF; AMRDMAGRFE; MRDMAGRFEV; RDMAGRFEVH; DMAGRFEVHA; MAGRFEVHAQ; AGRFEVHAQT; GRFEVHAQTV; RFEVHAQTVE; FEVHAQTVED; EVHAQTVEDE; VHAQTVEDEA; HAQTVEDEAR; AQTVEDEARR; QTVEDEARRM; TVEDEARRMW; VEDEARRMWA; EDEARRMWAS; DEARRMWASA; EARRMWASAQ; ARRMWASAQN; RRMWASAQNI; RMWASAQNIS; MWASAQNISG; WASAQNISGA; ASAQNISGAG; SAQNISGAGW; AQNISGAGWS; QNISGAGWSG; NISGAGWSGM; ISGAGWSGMA; SGAGWSGMAE; GAGWSGMAEA; AGWSGMAEAT; GWSGMAEATS; WSGMAEATSL; SGMAEATSLD; GMAEATSLDT; MAEATSLDTM; AEATSLDTMA; EATSLDTMAQ; ATSLDTMAQM; TSLDTMAQMN; SLDTMAQMNQ; LDTMAQMNQA; DTMAQMNQAF; TMAQMNQAFR; MAQMNQAFRN; AQMNQAFRNI; QMNQAFRNIV; MNQAFRNIVN; NQAFRNIVNM; QAFRNIVNML; AFRNIVNMLH; FRNIVNMLHG; RNIVNMLHGV; NIVNMLHGVR; IVNMLHGVRD; VNMLHGVRDG; NMLHGVRDGL; MLHGVRDGLV; LHGVRDGLVR; HGVRDGLVRD; GVRDGLVRDA; VRDGLVRDAN; RDGLVRDANN; DGLVRDANNY; GLVRDANNYE; LVRDANNYEQ; VRDANNYEQQ; RDANNYEQQE; DANNYEQQEQ; ANNYEQQEQA; NNYEQQEQAS; NYEQQEQASQ; YEQQEQASQQ; EQQEQASQQI; QQEQASQQIL; QEQASQQILS; EQASQQILSS;<br><br>11 mers:<br>MATRFMTDPHA; ATRFMTDPHAM; TRFMTDPHAMR; RFMTDPHAMRD; FMTDPHAMRDM; MTDPHAMRDMA; TDPHAMRDMAG; DPHAMRDMAGR; PHAMRDMAGRF; HAMRDMAGRFE; AMRDMAGRFEV; MRDMAGRFEVH; RDMAGRFEVHA; DMAGRFEVHAQ; MAGRFEVHAQT; AGRFEVHAQTV; GRFEVHAQTVE; RFEVHAQTVED; FEVHAQTVEDE; EVHAQTVEDEA; VHAQTVEDEAR; HAQTVEDEARR; AQTVEDEARRM; QTVEDEARRMW; TVEDEARRMWA; VEDEARRMWAS; EDEARRMWASA; DEARRMWASAQ; EARRMWASAQN; ARRMWASAQNI; RRMWASAQNIS; | |

Fig. 28 continued

| | | |
|---|---|---|
| | RMWASAQNISG; MWASAQNISGA; WASAQNISGAG; ASAQNISGAGW; SAQNISGAGWS; AQNISGAGWSG; QNISGAGWSGM; NISGAGWSGMA; ISGAGWSGMAE; SGAGWSGMAEA; GAGWSGMAEAT; AGWSGMAEATS; GWSGMAEATSL; WSGMAEATSLD; SGMAEATSLDT; GMAEATSLDTM; MAEATSLDTMA; AEATSLDTMAQ; EATSLDTMAQM; ATSLDTMAQMN; TSLDTMAQMNQ; SLDTMAQMNQA; LDTMAQMNQAF; DTMAQMNQAFR; TMAQMNQAFRN; MAQMNQAFRNI; AQMNQAFRNIV; QMNQAFRNIVN; MNQAFRNIVNM; NQAFRNIVNML; QAFRNIVNMLH; AFRNIVNMLHG; FRNIVNMLHGV; RNIVNMLHGVR; NIVNMLHGVRD; IVNMLHGVRDG; VNMLHGVRDGL; NMLHGVRDGLV; MLHGVRDGLVR; LHGVRDGLVRD; HGVRDGLVRDA; GVRDGLVRDAN; VRDGLVRDANN; RDGLVRDANNY; DGLVRDANNYE; GLVRDANNYEQ; LVRDANNYEQQ; VRDANNYEQQE; RDANNYEQQEQ; DANNYEQQEQA; ANNYEQQEQAS; NNYEQQEQASQ; NYEQQEQASQQ; YEQQEQASQQI; EQQEQASQQIL; QQEQASQQILS; QEQASQQILSS; | |
| 38) Rv2348c | 8 mers:<br>MLLPLGPP; LLPLGPPL; LPLGPPLP; PLGPPLPP; LGPPLPPD; GPPLPPDA; PPLPPDAV; PLPPDAVV; LPPDAVVA; PPDAVVAK; PDAVVAKR; DAVVAKRA; AVVAKRAE; VVAKRAES; VAKRAESG; AKRAESGM; KRAESGML; RAESGMLG; AESGMLGG; ESGMLGGL; SGMLGGLS; GMLGGLSV; MLGGLSVP; LGGLSVPL; GGLSVPLS; GLSVPLSW; LSVPLSWG; SVPLSWGV; VPLSWGVA; PLSWGVAV; LSWGVAVP; SWGVAVPP; WGVAVPPD; GVAVPPDD; VAVPPDDY; AVPPDDYD; VPPDDYDH; PPDDYDHW; PDDYDHWA; DDYDHWAP; DYDHWAPA; YDHWAPAP; DHWAPAPE; HWAPAPED; WAPAPEDG; APAPEDGA; PAPEDGAD; APEDGADV; PEDGADVD; EDGADVDV; DGADVDVQ; GADVDVQA; ADVDVQAA; DVDVQAAE; VDVQAAEG; DVQAAEGA; VQAAEGAD; QAAEGADA; AAEGADAE; AEGADAEA; EGADAEAA; GADAEAAA; ADAEAAAM; DAEAAAMD; AEAAAMDE; EAAAMDEW; AAAMDEWD; AAMDEWDE; AMDEWDEW; MDEWDEWQ; DEWDEWQA; EWDEWQAW; WDEWQAWN; DEWQAWNE; EWQAWNEW; WQAWNEWV; QAWNEWVA; AWNEWVAE; WNEWVAEN; NEWVAENA; EWVAENAE; WVAENAEP; VAENAEPR; AENAEPRF; ENAEPRFE; NAEPRFEV; AEPRFEVP; EPRFEVPR; PRFEVPRS; RFEVPRSS; FEVPRSSS; EVPRSSSS; VPRSSSSV; PRSSSSVI; RSSSSVIP; SSSSVIPH; SSSVIPHS; SSVIPHSP; SVIPHSPA; VIPHSPAA; IPHSPAAG;<br><br>9 mers:<br>MLLPLGPPL; LLPLGPPLP; LPLGPPLPP; PLGPPLPPD; LGPPLPPDA; GPPLPPDAV; PPLPPDAVV; PLPPDAVVA; LPPDAVVAK; PPDAVVAKR; PDAVVAKRA; DAVVAKRAE; AVVAKRAES; VVAKRAESG; VAKRAESGM; AKRAESGML; KRAESGMLG; RAESGMLGG; AESGMLGGL; ESGMLGGLS; SGMLGGLSV; GMLGGLSVP; MLGGLSVPL; LGGLSVPLS; GGLSVPLSW; GLSVPLSWG; LSVPLSWGV; SVPLSWGVA; VPLSWGVAV; PLSWGVAVP; LSWGVAVPP; SWGVAVPPD; WGVAVPPDD; GVAVPPDDY; VAVPPDDYD; AVPPDDYDH; VPPDDYDHW; PPDDYDHWA; PDDYDHWAP; DDYDHWAPA; DYDHWAPAP; YDHWAPAPE; DHWAPAPED; HWAPAPEDG; WAPAPEDGA; | 29202-29599 |

Fig. 28 continued

| | | | |
|---|---|---|---|
| | APAPEDGAD; PAPEDGADV; APEDGADVD; PEDGADVDV; EDGADVDVQ; DGADVDVQA; GADVDVQAA; ADVDVQAAE; DVDVQAAEG; VDVQAAEGA; DVQAAEGAD; VQAAEGADA; QAAEGADAE; AAEGADAEA; AEGADAEAA; EGADAEAAA; GADAEAAAM; ADAEAAAMD; DAEAAAMDE; AEAAAMDEW; EAAAMDEWD; AAAMDEWDE; AAMDEWDEW; AMDEWDEWQ; MDEWDEWQA; DEWDEWQAW; EWDEWQAWN; WDEWQAWNE; DEWQAWNEW; EWQAWNEWV; WQAWNEWVA; QAWNEWVAE; AWNEWVAEN; WNEWVAENA; NEWVAENAE; EWVAENAEP; WVAENAEPR; VAENAEPRF; AENAEPRFE; ENAEPRFEV; NAEPRFEVP; AEPRFEVPR; EPRFEVPRS; PRFEVPRSS; RFEVPRSSS; FEVPRSSSS; EVPRSSSSV; VPRSSSSVI; PRSSSSVIP; RSSSSVIPH; SSSSVIPHS; SSSVIPHSP; SSVIPHSPA; SVIPHSPAA; VIPHSPAAG;<br><br>10 mers:<br>MLLPLGPPLP; LLPLGPPLPP; LPLGPPLPPD; PLGPPLPPDA; LGPPLPPDAV; GPPLPPDAVV; PPLPPDAVVA; PLPPDAVVAK; LPPDAVVAKR; PPDAVVAKRA; PDAVVAKRAE; DAVVAKRAES; AVVAKRAESG; VVAKRAESGM; VAKRAESGML; AKRAESGMLG; KRAESGMLGG; RAESGMLGGL; AESGMLGGLS; ESGMLGGLSV; SGMLGGLSVP; GMLGGLSVPL; MLGGLSVPLS; LGGLSVPLSW; GGLSVPLSWG; GLSVPLSWGV; LSVPLSWGVA; SVPLSWGVAV; VPLSWGVAVP; PLSWGVAVPP; LSWGVAVPPD; SWGVAVPPDD; WGVAVPPDDY; GVAVPPDDYD; VAVPPDDYDH; AVPPDDYDHW; VPPDDYDHWA; PPDDYDHWAP; PDDYDHWAPA; DDYDHWAPAP; DYDHWAPAPE; YDHWAPAPED; DHWAPAPEDG; HWAPAPEDGA; WAPAPEDGAD; APAPEDGADV; PAPEDGADVD; APEDGADVDV; PEDGADVDVQ; EDGADVDVQA; DGADVDVQAA; GADVDVQAAE; ADVDVQAAEG; DVDVQAAEGA; VDVQAAEGAD; DVQAAEGADA; VQAAEGADAE; QAAEGADAEA; AAEGADAEAA; AEGADAEAAA; EGADAEAAAM; GADAEAAAMD; ADAEAAAMDE; DAEAAAMDEW; AEAAAMDEWD; EAAAMDEWDE; AAAMDEWDEW; AAMDEWDEWQ; AMDEWDEWQA; MDEWDEWQAW; DEWDEWQAWN; EWDEWQAWNE; WDEWQAWNEW; DEWQAWNEWV; EWQAWNEWVA; WQAWNEWVAE; QAWNEWVAEN; AWNEWVAENA; WNEWVAENAE; NEWVAENAEP; EWVAENAEPR; WVAENAEPRF; VAENAEPRFE; AENAEPRFEV; ENAEPRFEVP; NAEPRFEVPR; AEPRFEVPRS; EPRFEVPRSS; PRFEVPRSSS; RFEVPRSSSS; FEVPRSSSSV; EVPRSSSSVI; VPRSSSSVIP; PRSSSSVIPH; RSSSSVIPHS; SSSSVIPHSP; SSSVIPHSPA; SSVIPHSPAA; SVIPHSPAAG;<br><br>11 mers:<br>MLLPLGPPLPP; LLPLGPPLPPD; LPLGPPLPPDA; PLGPPLPPDAV; LGPPLPPDAVV; GPPLPPDAVVA; PPLPPDAVVAK; PLPPDAVVAKR; LPPDAVVAKRA; PPDAVVAKRAE; PDAVVAKRAES; DAVVAKRAESG; AVVAKRAESGM; VVAKRAESGML; VAKRAESGMLG; AKRAESGMLGG; KRAESGMLGGL; RAESGMLGGLS; AESGMLGGLSV; ESGMLGGLSVP; SGMLGGLSVPL; GMLGGLSVPLS; MLGGLSVPLSW; LGGLSVPLSWG; GGLSVPLSWGV; GLSVPLSWGVA; LSVPLSWGVAV; SVPLSWGVAVP; VPLSWGVAVPP; PLSWGVAVPPD; LSWGVAVPPDD; | |

Fig. 28 continued

| | | |
|---|---|---|
| | SWGVAVPPDDY; WGVAVPPDDYD; GVAVPPDDYDH; VAVPPDDYDHW; AVPPDDYDHWA; VPPDDYDHWAP; PPDDYDHWAPA; PDDYDHWAPAP; DDYDHWAPAPE; DYDHWAPAPED; YDHWAPAPEDG; DHWAPAPEDGA; HWAPAPEDGAD; WAPAPEDGADV; APAPEDGADVD; PAPEDGADVDV; APEDGADVDVQ; PEDGADVDVQA; EDGADVDVQAA; DGADVDVQAAE; GADVDVQAAEG; ADVDVQAAEGA; DVDVQAAEGAD; VDVQAAEGADA; DVQAAEGADAE; VQAAEGADAEA; QAAEGADAEAA; AAEGADAEAAA; AEGADAEAAAM; EGADAEAAAMD; GADAEAAAMDE; ADAEAAAMDEW; DAEAAAMDEWD; AEAAAMDEWDE; EAAAMDEWDEW; AAAMDEWDEWQ; AAMDEWDEWQA; AMDEWDEWQAW; MDEWDEWQAWN; DEWDEWQAWNE; EWDEWQAWNEW; WDEWQAWNEWV; DEWQAWNEWVA; EWQAWNEWVAE; WQAWNEWVAEN; QAWNEWVAENA; AWNEWVAENAE; WNEWVAENAEP; NEWVAENAEPR; EWVAENAEPRF; WVAENAEPRFE; VAENAEPRFEV; AENAEPRFEVP; ENAEPRFEVPR; NAEPRFEVPRS; AEPRFEVPRSS; EPRFEVPRSSS; PRFEVPRSSSS; RFEVPRSSSSV; FEVPRSSSSVI; EVPRSSSSVIP; VPRSSSSVIPH; PRSSSSVIPHS; RSSSSVIPHSP; SSSSVIPHSPA; SSSVIPHSPAA; SSVIPHSPAAG; | |
| 39) Rv2497c | 8 mers:<br>MGEGSRRP; GEGSRRPS; EGSRRPSG; GSRRPSGM; SRRPSGML; RRPSGMLM; RPSGMLMS; PSGMLMSV; SGMLMSVD; GMLMSVDL; MLMSVDLE; LMSVDLEP; MSVDLEPV; SVDLEPVQ; VDLEPVQL; DLEPVQLV; LEPVQLVG; EPVQLVGP; PVQLVGPD; VQLVGPDG; QLVGPDGT; LVGPDGTP; VGPDGTPT; GPDGTPTA; PDGTPTAE; DGTPTAER; GTPTAERR; TPTAERRY; PTAERRYH; TAERRYHR; AERRYHRD; ERRYHRDL; RRYHRDLP; RYHRDLPE; YHRDLPEE; HRDLPEET; RDLPEETL; DLPEETLR; LPEETLRW; PEETLRWL; EETLRWLY; ETLRWLYE; TLRWLYEM; LRWLYEMM; RWLYEMMV; WLYEMMVV; LYEMMVVT; YEMMVVTR; EMMVVTRE; MMVVTREL; MVVTRELD; VVTRELDT; VTRELDTE; TRELDTEF; RELDTEFV; ELDTEFVN; LDTEFVNL; DTEFVNLQ; TEFVNLQR; EFVNLQRQ; FVNLQRQG; VNLQRQGE; NLQRQGEL; LQRQGELA; QRQGELAL; RQGELALY; QGELALYT; GELALYTP; ELALYTPC; LALYTPCR; ALYTPCRG; LYTPCRGQ; YTPCRGQE; TPCRGQEA; PCRGQEAA; CRGQEAAQ; RGQEAAQV; GQEAAQVG; QEAAQVGA; EAAQVGAA; AAQVGAAA; AQVGAAAC; QVGAAACL; VGAAACLR; GAAACLRK; AAACLRKT; AACLRKTD; ACLRKTDW; CLRKTDWL; LRKTDWLF; RKTDWLFP; KTDWLFPQ; TDWLFPQY; DWLFPQYR; WLFPQYRE; LFPQYREL; FPQYRELG; PQYRELGV; QYRELGVY; YRELGVYL; RELGVYLV; ELGVYLVR; LGVYLVRG; GVYLVRGI; VYLVRGIP; YLVRGIPP; LVRGIPPG; VRGIPPGH; RGIPPGHV; GIPPGHVG; IPPGHVGV; PPGHVGVA; PGHVGVAW; GHVGVAWR; HVGVAWRG; VGVAWRGT; GVAWRGTW; VAWRGTWH; AWRGTWHG; WRGTWHGG; RGTWHGGL; GTWHGGLQ; TWHGGLQF; WHGGLQFT; HGGLQFTT; GGLQFTTK; GLQFTTKC; LQFTTKCC; QFTTKCCA; FTTKCCAP; TTKCCAPM; TKCCAPMS; KCCAPMSV; CCAPMSVP; CAPMSVPI; APMSVPIG; PMSVPIGT; MSVPIGTQ; SVPIGTQT; VPIGTQTL; PIGTQTLH; IGTQTLHA; GTQTLHAV; TQTLHAVG; QTLHAVGA; TLHAVGAA; LHAVGAAM; HAVGAAMA; AVGAAMAA; VGAAMAAQ; GAAMAAQR; AAMAAQRL; AMAAQRLD; MAAQRLDE; | 29600-31033 |

Fig. 28 continued

| | | |
|---|---|---|
| | AAQRLDED; AQRLDEDS; QRLDEDSV; RLDEDSVT; LDEDSVTV; DEDSVTVA; EDSVTVAF; DSVTVAFL; SVTVAFLG; VTVAFLGD; TVAFLGDG; VAFLGDGA; AFLGDGAT; FLGDGATS; LGDGATSE; GDGATSEG; DGATSEGD; GATSEGDV; ATSEGDVH; TSEGDVHE; SEGDVHEA; EGDVHEAL; GDVHEALN; DVHEALNF; VHEALNFA; HEALNFAA; EALNFAAV; ALNFAAVF; LNFAAVFT; NFAAVFTT; FAAVFTTP; AAVFTTPC; AVFTTPCV; VFTTPCVF; FTTPCVFY; TTPCVFYV; TPCVFYVQ; PCVFYVQN; CVFYVQNN; VFYVQNNQ; FYVQNNQW; YVQNNQWA; VQNNQWAI; QNNQWAIS; NNQWAISM; NQWAISMP; QWAISMPV; WAISMPVS; AISMPVSR; ISMPVSRQ; SMPVSRQT; MPVSRQTA; PVSRQTAA; VSRQTAAP; SRQTAAPS; RQTAAPSI; QTAAPSIA; TAAPSIAH; AAPSIAHK; APSIAHKA; PSIAHKAI; SIAHKAIG; IAHKAIGY; AHKAIGYG; HKAIGYGM; KAIGYGMP; AIGYGMPG; IGYGMPGI; GYGMPGIR; YGMPGIRV; GMPGIRVD; MPGIRVDG; PGIRVDGN; GIRVDGND; IRVDGNDV; RVDGNDVL; VDGNDVLA; DGNDVLAC; GNDVLACY; NDVLACYA; DVLACYAV; VLACYAVM; LACYAVMA; ACYAVMAE; CYAVMAEA; YAVMAEAA; AVMAEAAA; VMAEAAAR; MAEAAARA; AEAAARAR; EAAARARA; AAARARAG; AARARAGD; ARARAGDG; RARAGDGP; ARAGDGPT; RAGDGPTL; AGDGPTLI; GDGPTLIE; DGPTLIEA; GPTLIEAV; PTLIEAVT; TLIEAVTY; LIEAVTYR; IEAVTYRL; EAVTYRLG; AVTYRLGP; VTYRLGPH; TYRLGPHT; YRLGPHTT; RLGPHTTA; LGPHTTAD; GPHTTADD; PHTTADDP; HTTADDPT; TTADDPTR; TADDPTRY; ADDPTRYR; DDPTRYRS; DPTRYRSQ; PTRYRSQE; TRYRSQEE; RYRSQEEV; YRSQEEVD; RSQEEVDR; SQEEVDRW; QEEVDRWA; EEVDRWAT; EVDRWATL; VDRWATLD; DRWATLDP; RWATLDPI; WATLDPIP; ATLDPIPR; TLDPIPRY; LDPIPRYR; DPIPRYRT; PIPRYRTY; IPRYRTYL; PRYRTYLQ; RYRTYLQD; YRTYLQDQ; RTYLQDQG; TYLQDQGL; YLQDQGLW; LQDQGLWS; QDQGLWSQ; DQGLWSQR; QGLWSQRL; GLWSQRLE; LWSQRLEE; WSQRLEEQ; SQRLEEQV; QRLEEQVT; RLEEQVTA; LEEQVTAR; EEQVTARA; EQVTARAK; QVTARAKH; VTARAKHV; TARAKHVR; ARAKHVRS; RAKHVRSE; AKHVRSEL; KHVRSELR; HVRSELRD; VRSELRDA; RSELRDAV; SELRDAVF; ELRDAVFD; LRDAVFDA; RDAVFDAP; DAVFDAPD; AVFDAPDF; VFDAPDFD; FDAPDFDV; DAPDFDVD; APDFDVDE; PDFDVDEV; DFDVDEVF; FDVDEVFT; DVDEVFTT; VDEVFTTV; DEVFTTVY; EVFTTVYA; VFTTVYAE; FTTVYAEI; TTVYAEIT; TVYAEITP; VYAEITPG; YAEITPGL; AEITPGLQ; EITPGLQA; ITPGLQAQ; TPGLQAQR; PGLQAQRE; GLQAQREQ; LQAQREQL; QAQREQLR; AQREQLRA; QREQLRAE; REQLRAEL; EQLRAELA; QLRAELAR; LRAELART; RAELARTD<br><br>9 mers:<br>MGEGSRRPS; GEGSRRPSG; EGSRRPSGM; GSRRPSGML; SRRPSGMLM; RRPSGMLMS; RPSGMLMSV; PSGMLMSVD; SGMLMSVDL; GMLMSVDLE; MLMSVDLEP; LMSVDLEPV; MSVDLEPVQ; SVDLEPVQL; VDLEPVQLV; DLEPVQLVG; LEPVQLVGP; EPVQLVGPD; PVQLVGPDG; VQLVGPDGT; QLVGPDGTP; LVGPDGTPT; VGPDGTPTA; GPDGTPTAE; PDGTPTAER; DGTPTAERR; GTPTAERRY; TPTAERRYH; PTAERRYHR; TAERRYHRD; AERRYHRDL; ERRYHRDLP; RRYHRDLPE; RYHRDLPEE; YHRDLPEET; HRDLPEETL; | |

Fig. 28 continued

| | | |
|---|---|---|
| | RDLPEETLR; DLPEETLRW; LPEETLRWL; PEETLRWLY; EETLRWLYE; ETLRWLYEM; TLRWLYEMM; LRWLYEMMV; RWLYEMMVV; WLYEMMVVT; LYEMMVVTR; YEMMVVTRE; EMMVVTREL; MMVVTRELD; MVVTRELDT; VVTRELDTE; VTRELDTEF; TRELDTEFV; RELDTEFVN; ELDTEFVNL; LDTEFVNLQ; DTEFVNLQR; TEFVNLQRQ; EFVNLQRQG; FVNLQRQGE; VNLQRQGEL; NLQRQGELA; LQRQGELAL; QRQGELALY; RQGELALYT; QGELALYTP; GELALYTPC; ELALYTPCR; LALYTPCRG; ALYTPCRGQ; LYTPCRGQE; YTPCRGQEA; TPCRGQEAA; PCRGQEAAQ; CRGQEAAQV; RGQEAAQVG; GQEAAQVGA; QEAAQVGAA; EAAQVGAAA; AAQVGAAAC; AQVGAAACL; QVGAAACLR; VGAAACLRK; GAAACLRKT; AAACLRKTD; AACLRKTDW; ACLRKTDWL; CLRKTDWLF; LRKTDWLFP; RKTDWLFPQ; KTDWLFPQY; TDWLFPQYR; DWLFPQYRE; WLFPQYREL; LFPQYRELG; FPQYRELGV; PQYRELGVY; QYRELGVYL; YRELGVYLV; RELGVYLVR; ELGVYLVRG; LGVYLVRGI; GVYLVRGIP; VYLVRGIPP; YLVRGIPPG; LVRGIPPGH; VRGIPPGHV; RGIPPGHVG; GIPPGHVGV; IPPGHVGVA; PPGHVGVAW; PGHVGVAWR; GHVGVAWRG; HVGVAWRGT; VGVAWRGTW; GVAWRGTWH; VAWRGTWHG; AWRGTWHGG; WRGTWHGGL; RGTWHGGLQ; GTWHGGLQF; TWHGGLQFT; WHGGLQFTT; HGGLQFTTK; GGLQFTTKC; GLQFTTKCC; LQFTTKCCA; QFTTKCCAP; FTTKCCAPM; TTKCCAPMS; TKCCAPMSV; KCCAPMSVP; CCAPMSVPI; CAPMSVPIG; APMSVPIGT; PMSVPIGTQ; MSVPIGTQT; SVPIGTQTL; VPIGTQTLH; PIGTQTLHA; IGTQTLHAV; GTQTLHAVG; TQTLHAVGA; QTLHAVGAA; TLHAVGAAM; LHAVGAAMA; HAVGAAMAA; AVGAAMAAQ; VGAAMAAQR; GAAMAAQRL; AAMAAQRLD; AMAAQRLDE; MAAQRLDED; AAQRLDEDS; AQRLDEDSV; QRLDEDSVT; RLDEDSVTV; LDEDSVTVA; DEDSVTVAF; EDSVTVAFL; DSVTVAFLG; SVTVAFLGD; VTVAFLGDG; TVAFLGDGA; VAFLGDGAT; AFLGDGATS; FLGDGATSE; LGDGATSEG; GDGATSEGD; DGATSEGDV; GATSEGDVH; ATSEGDVHE; TSEGDVHEA; SEGDVHEAL; EGDVHEALN; GDVHEALNF; DVHEALNFA; VHEALNFAA; HEALNFAAV; EALNFAAVF; ALNFAAVFT; LNFAAVFTT; NFAAVFTTP; FAAVFTTPC; AAVFTTPCV; AVFTTPCVF; VFTTPCVFY; FTTPCVFYV; TTPCVFYVQ; TPCVFYVQN; PCVFYVQNN; CVFYVQNNQ; VFYVQNNQW; FYVQNNQWA; YVQNNQWAI; VQNNQWAIS; QNNQWAISM; NNQWAISMP; NQWAISMPV; QWAISMPVS; WAISMPVSR; AISMPVSRQ; ISMPVSRQT; SMPVSRQTA; MPVSRQTAA; PVSRQTAAP; VSRQTAAPS; SRQTAAPSI; RQTAAPSIA; QTAAPSIAH; TAAPSIAHK; AAPSIAHKA; APSIAHKAI; PSIAHKAIG; SIAHKAIGY; IAHKAIGYG; AHKAIGYGM; HKAIGYGMP; KAIGYGMPG; AIGYGMPGI; IGYGMPGIR; GYGMPGIRV; YGMPGIRVD; GMPGIRVDG; MPGIRVDGN; PGIRVDGND; GIRVDGNDV; IRVDGNDVL; RVDGNDVLA; VDGNDVLAC; DGNDVLACY; GNDVLACYA; NDVLACYAV; DVLACYAVM; VLACYAVMA; LACYAVMAE; ACYAVMAEA; CYAVMAEAA; YAVMAEAAA; AVMAEAAAR; VMAEAAARA; MAEAAARAR; AEAAARARA; EAAARARAG; AAARARAGD; AARARAGDG; ARARAGDGP; RARAGDGPT; ARAGDGPTL; RAGDGPTLI; AGDGPTLIE; GDGPTLIEA; DGPTLIEAV; GPTLIEAVT; PTLIEAVTY; TLIEAVTYR; LIEAVTYRL; IEAVTYRLG; | |

Fig. 28 continued

| | | | |
|---|---|---|---|
| | EAVTYRLGP; AVTYRLGPH; VTYRLGPHT; TYRLGPHTT; YRLGPHTTA; RLGPHTTAD; LGPHTTADD; GPHTTADDP; PHTTADDPT; HTTADDPTR; TTADDPTRY; TADDPTRYR; ADDPTRYRS; DDPTRYRSQ; DPTRYRSQE; PTRYRSQEE; TRYRSQEEV; RYRSQEEVD; YRSQEEVDR; RSQEEVDRW; SQEEVDRWA; QEEVDRWAT; EEVDRWATL; EVDRWATLD; VDRWATLDP; DRWATLDPI; RWATLDPIP; WATLDPIPR; ATLDPIPRY; TLDPIPRYR; LDPIPRYRT; DPIPRYRTY; PIPRYRTYL; IPRYRTYLQ; PRYRTYLQD; RYRTYLQDQ; YRTYLQDQG; RTYLQDQGL; TYLQDQGLW; YLQDQGLWS; LQDQGLWSQ; QDQGLWSQR; DQGLWSQRL; QGLWSQRLE; GLWSQRLEE; LWSQRLEEQ; WSQRLEEQV; SQRLEEQVT; QRLEEQVTA; RLEEQVTAR; LEEQVTARA; EEQVTARAK; EQVTARAKH; QVTARAKHV; VTARAKHVR; TARAKHVRS; ARAKHVRSE; RAKHVRSEL; AKHVRSELR; KHVRSELRD; HVRSELRDA; VRSELRDAV; RSELRDAVF; SELRDAVFD; ELRDAVFDA; LRDAVFDAP; RDAVFDAPD; DAVFDAPDF; AVFDAPDFD; VFDAPDFDV; FDAPDFDVD; DAPDFDVDE; APDFDVDEV; PDFDVDEVF; DFDVDEVFT; FDVDEVFTT; DVDEVFTTV; VDEVFTTVY; DEVFTTVYA; EVFTTVYAE; VFTTVYAEI; FTTVYAEIT; TTVYAEITP; TVYAEITPG; VYAEITPGL; YAEITPGLQ; AEITPGLQA; EITPGLQAQ; ITPGLQAQR; TPGLQAQRE; PGLQAQREQ; GLQAQREQL; LQAQREQLR; QAQREQLRA; AQREQLRAE; QREQLRAEL; REQLRAELA; EQLRAELAR; QLRAELART; LRAELARTD<br><br>10 mers:<br>MGEGSRRPSG; GEGSRRPSGM; EGSRRPSGML; GSRRPSGMLM; SRRPSGMLMS; RRPSGMLMSV; RPSGMLMSVD; PSGMLMSVDL; SGMLMSVDLE; GMLMSVDLEP; MLMSVDLEPV; LMSVDLEPVQ; MSVDLEPVQL; SVDLEPVQLV; VDLEPVQLVG; DLEPVQLVGP; LEPVQLVGPD; EPVQLVGPDG; PVQLVGPDGT; VQLVGPDGTP; QLVGPDGTPT; LVGPDGTPTA; VGPDGTPTAE; GPDGTPTAER; PDGTPTAERR; DGTPTAERRY; GTPTAERRYH; TPTAERRYHR; PTAERRYHRD; TAERRYHRDL; AERRYHRDLP; ERRYHRDLPE; RRYHRDLPEE; RYHRDLPEET; YHRDLPEETL; HRDLPEETLR; RDLPEETLRW; DLPEETLRWL; LPEETLRWLY; PEETLRWLYE; EETLRWLYEM; ETLRWLYEMM; TLRWLYEMMV; LRWLYEMMVV; RWLYEMMVVT; WLYEMMVVTR; LYEMMVVTRE; YEMMVVTREL; EMMVVTRELD; MMVVTRELDT; MVVTRELDTE; VVTRELDTEF; VTRELDTEFV; TRELDTEFVN; RELDTEFVNL; ELDTEFVNLQ; LDTEFVNLQR; DTEFVNLQRQ; TEFVNLQRQG; EFVNLQRQGE; FVNLQRQGEL; VNLQRQGELA; NLQRQGELAL; LQRQGELALY; QRQGELALYT; RQGELALYTP; QGELALYTPC; GELALYTPCR; ELALYTPCRG; LALYTPCRGQ; ALYTPCRGQE; LYTPCRGQEA; YTPCRGQEAA; TPCRGQEAAQ; PCRGQEAAQV; CRGQEAAQVG; RGQEAAQVGA; GQEAAQVGAA; QEAAQVGAAA; EAAQVGAAAC; AAQVGAAACL; AQVGAAACLR; QVGAAACLRK; VGAAACLRKT; GAAACLRKTD; AAACLRKTDW; AACLRKTDWL; ACLRKTDWLF; CLRKTDWLFP; LRKTDWLFPQ; RKTDWLFPQY; KTDWLFPQYR; TDWLFPQYRE; DWLFPQYREL; WLFPQYRELG; LFPQYRELGV; FPQYRELGVY; PQYRELGVYL; QYRELGVYLV; YRELGVYLVR; RELGVYLVRG; ELGVYLVRGI; LGVYLVRGIP; GVYLVRGIPP; VYLVRGIPPG; YLVRGIPPGH; LVRGIPPGHV; VRGIPPGHVG; | |

Fig. 28 continued

| | | |
|---|---|---|
| | RGIPPGHVGV; GIPPGHVGVA; IPPGHVGVAW; PPGHVGVAWR; PGHVGVAWRG; GHVGVAWRGT; HVGVAWRGTW; VGVAWRGTWH; GVAWRGTWHG; VAWRGTWHGG; AWRGTWHGGL; WRGTWHGGLQ; RGTWHGGLQF; GTWHGGLQFT; TWHGGLQFTT; WHGGLQFTTK; HGGLQFTTKC; GGLQFTTKCC; GLQFTTKCCA; LQFTTKCCAP; QFTTKCCAPM; FTTKCCAPMS; TTKCCAPMSV; TKCCAPMSVP; KCCAPMSVPI; CCAPMSVPIG; CAPMSVPIGT; APMSVPIGTQ; PMSVPIGTQT; MSVPIGTQTL; SVPIGTQTLH; VPIGTQTLHA; PIGTQTLHAV; IGTQTLHAVG; GTQTLHAVGA; TQTLHAVGAA; QTLHAVGAAM; TLHAVGAAMA; LHAVGAAMAA; HAVGAAMAAQ; AVGAAMAAQR; VGAAMAAQRL; GAAMAAQRLD; AAMAAQRLDE; AMAAQRLDED; MAAQRLDEDS; AAQRLDEDSV; AQRLDEDSVT; QRLDEDSVTV; RLDEDSVTVA; LDEDSVTVAF; DEDSVTVAFL; EDSVTVAFLG; DSVTVAFLGD; SVTVAFLGDG; VTVAFLGDGA; TVAFLGDGAT; VAFLGDGATS; AFLGDGATSE; FLGDGATSEG; LGDGATSEGD; GDGATSEGDV; DGATSEGDVH; GATSEGDVHE; ATSEGDVHEA; TSEGDVHEAL; SEGDVHEALN; EGDVHEALNF; GDVHEALNFA; DVHEALNFAA; VHEALNFAAV; HEALNFAAVF; EALNFAAVFT; ALNFAAVFTT; LNFAAVFTTP; NFAAVFTTPC; FAAVFTTPCV; AAVFTTPCVF; AVFTTPCVFY; VFTTPCVFYV; FTTPCVFYVQ; TTPCVFYVQN; TPCVFYVQNN; PCVFYVQNNQ; CVFYVQNNQW; VFYVQNNQWA; FYVQNNQWAI; YVQNNQWAIS; VQNNQWAISM; QNNQWAISMP; NNQWAISMPV; NQWAISMPVS; QWAISMPVSR; WAISMPVSRQ; AISMPVSRQT; ISMPVSRQTA; SMPVSRQTAA; MPVSRQTAAP; PVSRQTAAPS; VSRQTAAPSI; SRQTAAPSIA; RQTAAPSIAH; QTAAPSIAHK; TAAPSIAHKA; AAPSIAHKAI; APSIAHKAIG; PSIAHKAIGY; SIAHKAIGYG; IAHKAIGYGM; AHKAIGYGMP; HKAIGYGMPG; KAIGYGMPGI; AIGYGMPGIR; IGYGMPGIRV; GYGMPGIRVD; YGMPGIRVDG; GMPGIRVDGN; MPGIRVDGND; PGIRVDGNDV; GIRVDGNDVL; IRVDGNDVLA; RVDGNDVLAC; VDGNDVLACY; DGNDVLACYA; GNDVLACYAV; NDVLACYAVM; DVLACYAVMA; VLACYAVMAE; LACYAVMAEA; ACYAVMAEAA; CYAVMAEAAA; YAVMAEAAAR; AVMAEAAARA; VMAEAAARAR; MAEAAARARA; AEAAARARAG; EAAARARAGD; AAARARAGDG; AARARAGDGP; ARARAGDGPT; RARAGDGPTL; ARAGDGPTLI; RAGDGPTLIE; AGDGPTLIEA; GDGPTLIEAV; DGPTLIEAVT; GPTLIEAVTY; PTLIEAVTYR; TLIEAVTYRL; LIEAVTYRLG; IEAVTYRLGP; EAVTYRLGPH; AVTYRLGPHT; VTYRLGPHTT; TYRLGPHTTA; YRLGPHTTAD; RLGPHTTADD; LGPHTTADDP; GPHTTADDPT; PHTTADDPTR; HTTADDPTRY; TTADDPTRYR; TADDPTRYRS; ADDPTRYRSQ; DDPTRYRSQE; DPTRYRSQEE; PTRYRSQEEV; TRYRSQEEVD; RYRSQEEVDR; YRSQEEVDRW; RSQEEVDRWA; SQEEVDRWAT; QEEVDRWATL; EEVDRWATLD; EVDRWATLDP; VDRWATLDPI; DRWATLDPIP; RWATLDPIPR; WATLDPIPRY; ATLDPIPRYR; TLDPIPRYRT; LDPIPRYRTY; DPIPRYRTYL; PIPRYRTYLQ; IPRYRTYLQD; PRYRTYLQDQ; RYRTYLQDQG; YRTYLQDQGL; RTYLQDQGLW; TYLQDQGLWS; YLQDQGLWSQ; LQDQGLWSQR; QDQGLWSQRL; DQGLWSQRLE; QGLWSQRLEE; GLWSQRLEEQ; LWSQRLEEQV; WSQRLEEQVT; SQRLEEQVTA; QRLEEQVTAR; RLEEQVTARA; LEEQVTARAK; EEQVTARAKH; EQVTARAKHV; QVTARAKHVR; VTARAKHVRS; TARAKHVRSE; ARAKHVRSEL; RAKHVRSELR; AKHVRSELRD; KHVRSELRDA; | |

Fig. 28 continued

| | | | |
|---|---|---|---|
| | HVRSELRDAV; VRSELRDAVF; RSELRDAVFD; SELRDAVFDA; ELRDAVFDAP; LRDAVFDAPD; RDAVFDAPDF; DAVFDAPDFD; AVFDAPDFDV; VFDAPDFDVD; FDAPDFDVDE; DAPDFDVDEV; APDFDVDEVF; PDFDVDEVFT; DFDVDEVFTT; FDVDEVFTTV; DVDEVFTTVY; VDEVFTTVYA; DEVFTTVYAE; EVFTTVYAEI; VFTTVYAEIT; FTTVYAEITP; TTVYAEITPG; TVYAEITPGL; VYAEITPGLQ; YAEITPGLQA; AEITPGLQAQ; EITPGLQAQR; ITPGLQAQRE; TPGLQAQREQ; PGLQAQREQL; GLQAQREQLR; LQAQREQLRA; QAQREQLRAE; AQREQLRAEL; QREQLRAELA; REQLRAELAR; EQLRAELART; QLRAELARTD<br><br>11 mers:<br>MGEGSRRPSGM; GEGSRRPSGML; EGSRRPSGMLM; GSRRPSGMLMS; SRRPSGMLMSV; RRPSGMLMSVD; RPSGMLMSVDL; PSGMLMSVDLE; SGMLMSVDLEP; GMLMSVDLEPV; MLMSVDLEPVQ; LMSVDLEPVQL; MSVDLEPVQLV; SVDLEPVQLVG; VDLEPVQLVGP; DLEPVQLVGPD; LEPVQLVGPDG; EPVQLVGPDGT; PVQLVGPDGTP; VQLVGPDGTPT; QLVGPDGTPTA; LVGPDGTPTAE; VGPDGTPTAER; GPDGTPTAERR; PDGTPTAERRY; DGTPTAERRYH; GTPTAERRYHR; TPTAERRYHRD; PTAERRYHRDL; TAERRYHRDLP; AERRYHRDLPE; ERRYHRDLPEE; RRYHRDLPEET; RYHRDLPEETL; YHRDLPEETLR; HRDLPEETLRW; RDLPEETLRWL; DLPEETLRWLY; LPEETLRWLYE; PEETLRWLYEM; EETLRWLYEMM; ETLRWLYEMMV; TLRWLYEMMVV; LRWLYEMMVVT; RWLYEMMVVTR; WLYEMMVVTRE; LYEMMVVTREL; YEMMVVTRELD; EMMVVTRELDT; MMVVTRELDTE; MVVTRELDTEF; VVTRELDTEFV; VTRELDTEFVN; TRELDTEFVNL; RELDTEFVNLQ; ELDTEFVNLQR; LDTEFVNLQRQ; DTEFVNLQRQG; TEFVNLQRQGE; EFVNLQRQGEL; FVNLQRQGELA; VNLQRQGELAL; NLQRQGELALY; LQRQGELALYT; QRQGELALYTP; RQGELALYTPC; QGELALYTPCR; GELALYTPCRG; ELALYTPCRGQ; LALYTPCRGQE; ALYTPCRGQEA; LYTPCRGQEAA; YTPCRGQEAAQ; TPCRGQEAAQV; PCRGQEAAQVG; CRGQEAAQVGA; RGQEAAQVGAA; GQEAAQVGAAA; QEAAQVGAAAC; EAAQVGAAACL; AAQVGAAACLR; AQVGAAACLRK; QVGAAACLRKT; VGAAACLRKTD; GAAACLRKTDW; AAACLRKTDWL; AACLRKTDWLF; ACLRKTDWLFP; CLRKTDWLFPQ; LRKTDWLFPQY; RKTDWLFPQYR; KTDWLFPQYRE; TDWLFPQYREL; DWLFPQYRELG; WLFPQYRELGV; LFPQYRELGVY; FPQYRELGVYL; PQYRELGVYLV; QYRELGVYLVR; YRELGVYLVRG; RELGVYLVRGI; ELGVYLVRGIP; LGVYLVRGIPP; GVYLVRGIPPG; VYLVRGIPPGH; YLVRGIPPGHV; LVRGIPPGHVG; VRGIPPGHVGV; RGIPPGHVGVA; GIPPGHVGVAW; IPPGHVGVAWR; PPGHVGVAWRG; PGHVGVAWRGT; GHVGVAWRGTW; HVGVAWRGTWH; VGVAWRGTWHG; GVAWRGTWHGG; VAWRGTWHGGL; AWRGTWHGGLQ; WRGTWHGGLQF; RGTWHGGLQFT; GTWHGGLQFTT; TWHGGLQFTTK; WHGGLQFTTKC; HGGLQFTTKCC; GGLQFTTKCCA; GLQFTTKCCAP; LQFTTKCCAPM; QFTTKCCAPMS; FTTKCCAPMSV; TTKCCAPMSVP; TKCCAPMSVPI; KCCAPMSVPIG; CCAPMSVPIGT; CAPMSVPIGTQ; APMSVPIGTQT; PMSVPIGTQTL; MSVPIGTQTLH; SVPIGTQTLHA; VPIGTQTLHAV; PIGTQTLHAVG; IGTQTLHAVGA; GTQTLHAVGAA; TQTLHAVGAAM; QTLHAVGAAMA; TLHAVGAAMAA; LHAVGAAMAAQ; HAVGAAMAAQR; | |

Fig. 28 continued

| | | |
|---|---|---|
| | AVGAAMAAQRL; VGAAMAAQRLD; GAAMAAQRLDE; AAMAAQRLDED; AMAAQRLDEDS; MAAQRLDEDSV; AAQRLDEDSVT; AQRLDEDSVTV; QRLDEDSVTVA; RLDEDSVTVAF; LDEDSVTVAFL; DEDSVTVAFLG; EDSVTVAFLGD; DSVTVAFLGDG; SVTVAFLGDGA; VTVAFLGDGAT; TVAFLGDGATS; VAFLGDGATSE; AFLGDGATSEG; FLGDGATSEGD; LGDGATSEGDV; GDGATSEGDVH; DGATSEGDVHE; GATSEGDVHEA; ATSEGDVHEAL; TSEGDVHEALN; SEGDVHEALNF; EGDVHEALNFA; GDVHEALNFAA; DVHEALNFAAV; VHEALNFAAVF; HEALNFAAVFT; EALNFAAVFTT; ALNFAAVFTTP; LNFAAVFTTPC; NFAAVFTTPCV; FAAVFTTPCVF; AAVFTTPCVFY; AVFTTPCVFYV; VFTTPCVFYVQ; FTTPCVFYVQN; TTPCVFYVQNN; TPCVFYVQNNQ; PCVFYVQNNQW; CVFYVQNNQWA; VFYVQNNQWAI; FYVQNNQWAIS; YVQNNQWAISM; VQNNQWAISMP; QNNQWAISMPV; NNQWAISMPVS; NQWAISMPVSR; QWAISMPVSRQ; WAISMPVSRQT; AISMPVSRQTA; ISMPVSRQTAA; SMPVSRQTAAP; MPVSRQTAAPS; PVSRQTAAPSI; VSRQTAAPSIA; SRQTAAPSIAH; RQTAAPSIAHK; QTAAPSIAHKA; TAAPSIAHKAI; AAPSIAHKAIG; APSIAHKAIGY; PSIAHKAIGYG; SIAHKAIGYGM; IAHKAIGYGMP; AHKAIGYGMPG; HKAIGYGMPGI; KAIGYGMPGIR; AIGYGMPGIRV; IGYGMPGIRVD; GYGMPGIRVDG; YGMPGIRVDGN; GMPGIRVDGND; MPGIRVDGNDV; PGIRVDGNDVL; GIRVDGNDVLA; IRVDGNDVLAC; RVDGNDVLACY; VDGNDVLACYA; DGNDVLACYAV; GNDVLACYAVM; NDVLACYAVMA; DVLACYAVMAE; VLACYAVMAEA; LACYAVMAEAA; ACYAVMAEAAA; CYAVMAEAAAR; YAVMAEAAARA; AVMAEAAARAR; VMAEAAARARA; MAEAAARARAG; AEAAARARAGD; EAAARARAGDG; AAARARAGDGP; AARARAGDGPT; ARARAGDGPTL; RARAGDGPTLI; ARAGDGPTLIE; RAGDGPTLIEA; AGDGPTLIEAV; GDGPTLIEAVT; DGPTLIEAVTY; GPTLIEAVTYR; PTLIEAVTYRL; TLIEAVTYRLG; LIEAVTYRLGP; IEAVTYRLGPH; EAVTYRLGPHT; AVTYRLGPHTT; VTYRLGPHTTA; TYRLGPHTTAD; YRLGPHTTADD; RLGPHTTADDP; LGPHTTADDPT; GPHTTADDPTR; PHTTADDPTRY; HTTADDPTRYR; TTADDPTRYRS; TADDPTRYRSQ; ADDPTRYRSQE; DDPTRYRSQEE; DPTRYRSQEEV; PTRYRSQEEVD; TRYRSQEEVDR; RYRSQEEVDRW; YRSQEEVDRWA; RSQEEVDRWAT; SQEEVDRWATL; QEEVDRWATLD; EEVDRWATLDP; EVDRWATLDPI; VDRWATLDPIP; DRWATLDPIPR; RWATLDPIPRY; WATLDPIPRYR; ATLDPIPRYRT; TLDPIPRYRTY; LDPIPRYRTYL; DPIPRYRTYLQ; PIPRYRTYLQD; IPRYRTYLQDQ; PRYRTYLQDQG; RYRTYLQDQGL; YRTYLQDQGLW; RTYLQDQGLWS; TYLQDQGLWSQ; YLQDQGLWSQR; LQDQGLWSQRL; QDQGLWSQRLE; DQGLWSQRLEE; QGLWSQRLEEQ; GLWSQRLEEQV; LWSQRLEEQVT; WSQRLEEQVTA; SQRLEEQVTAR; QRLEEQVTARA; RLEEQVTARAK; LEEQVTARAKH; EEQVTARAKHV; EQVTARAKHVR; QVTARAKHVRS; VTARAKHVRSE; TARAKHVRSEL; ARAKHVRSELR; RAKHVRSELRD; AKHVRSELRDA; KHVRSELRDAV; HVRSELRDAVF; VRSELRDAVFD; RSELRDAVFDA; SELRDAVFDAP; ELRDAVFDAPD; LRDAVFDAPDF; RDAVFDAPDFD; DAVFDAPDFDV; AVFDAPDFDVD; VFDAPDFDVDE; FDAPDFDVDEV; DAPDFDVDEVF; APDFDVDEVFT; PDFDVDEVFTT; DFDVDEVFTTV; FDVDEVFTTVY; DVDEVFTTVYA; VDEVFTTVYAE; DEVFTTVYAEI; EVFTTVYAEIT; VFTTVYAEITP; FTTVYAEITPG; TTVYAEITPGL; TVYAEITPGLQ; | |

Fig. 28 continued

| | | |
|---|---|---|
| | VYAEITPGLQA; YAEITPGLQAQ; AEITPGLQAQR; EITPGLQAQRE; ITPGLQAQREQ; TPGLQAQREQL; PGLQAQREQLR; GLQAQREQLRA; LQAQREQLRAE; QAQREQLRAEL; AQREQLRAELA; QREQLRAELAR; REQLRAELART; EQLRAELARTD | |
| 40) Rv2517c | 8 mers:<br>MNSAIIKI; NSAIIKIA; SAIIKIAK; AIIKIAKW; IIKIAKWA; IKIAKWAQ; KIAKWAQS; IAKWAQSQ; AKWAQSQQ; KWAQSQQW; WAQSQQWT; AQSQQWTV; QSQQWTVE; SQQWTVED; QQWTVEDD; QWTVEDDA; WTVEDDAS; TVEDDASG; VEDDASGY; EDDASGYT; DDASGYTR; DASGYTRF; ASGYTRFY; SGYTRFYN; GYTRFYNP; YTRFYNPQ; TRFYNPQG; RFYNPQGV; FYNPQGVY; YNPQGVYI; NPQGVYIA; PQGVYIAR; QGVYIARF; GVYIARFP; VYIARFPA; YIARFPAT; IARFPATP; ARFPATPS; RFPATPSN; FPATPSNE; PATPSNEY; ATPSNEYR; TPSNEYRR; PSNEYRRM; SNEYRRMR; NEYRRMRD; EYRRMRDL; YRRMRDLL; RRMRDLLG; RMRDLLGA; MRDLLGAL; RDLLGALK; DLLGALKK; LLGALKKA; LGALKKAG; GALKKAGL; ALKKAGLT; LKKAGLTW; KKAGLTWP; KAGLTWPP; AGLTWPPP; GLTWPPPS; LTWPPPSK; TWPPPSKK; WPPPSKKE; PPPSKKER; PPSKKERR; PSKKERRA; SKKERRAQ; KKERRAQH; KERRAQHR; ERRAQHRK; RRAQHRKE; RAQHRKEG; AQHRKEGA; QHRKEGAQ<br><br>9 mers:<br>MNSAIIKIA; NSAIIKIAK; SAIIKIAKW; AIIKIAKWA; IIKIAKWAQ; IKIAKWAQS; KIAKWAQSQ; IAKWAQSQQ; AKWAQSQQW; KWAQSQQWT; WAQSQQWTV; AQSQQWTVE; QSQQWTVED; SQQWTVEDD; QQWTVEDDA; QWTVEDDAS; WTVEDDASG; TVEDDASGY; VEDDASGYT; EDDASGYTR; DDASGYTRF; DASGYTRFY; ASGYTRFYN; SGYTRFYNP; GYTRFYNPQ; YTRFYNPQG; TRFYNPQGV; RFYNPQGVY; FYNPQGVYI; YNPQGVYIA; NPQGVYIAR; PQGVYIARF; QGVYIARFP; GVYIARFPA; VYIARFPAT; YIARFPATP; IARFPATPS; ARFPATPSN; RFPATPSNE; FPATPSNEY; PATPSNEYR; ATPSNEYRR; TPSNEYRRM; PSNEYRRMR; SNEYRRMRD; NEYRRMRDL; EYRRMRDLL; YRRMRDLLG; RRMRDLLGA; RMRDLLGAL; MRDLLGALK; RDLLGALKK; DLLGALKKA; LLGALKKAG; LGALKKAGL; GALKKAGLT; ALKKAGLTW; LKKAGLTWP; KKAGLTWPP; KAGLTWPPP; AGLTWPPPS; GLTWPPPSK; LTWPPPSKK; TWPPPSKKE; WPPPSKKER; PPPSKKERR; PPSKKERRA; PSKKERRAQ; SKKERRAQH; KKERRAQHR; KERRAQHRK; ERRAQHRKE; RRAQHRKEG; RAQHRKEGA; AQHRKEGAQ<br><br>10 mers:<br>MNSAIIKIAK; NSAIIKIAKW; SAIIKIAKWA; AIIKIAKWAQ; IIKIAKWAQS; IKIAKWAQSQ; KIAKWAQSQQ; IAKWAQSQQW; AKWAQSQQWT; KWAQSQQWTV; WAQSQQWTVE; AQSQQWTVED; QSQQWTVEDD; SQQWTVEDDA; QQWTVEDDAS; QWTVEDDASG; WTVEDDASGY; TVEDDASGYT; VEDDASGYTR; EDDASGYTRF; DDASGYTRFY; DASGYTRFYN; ASGYTRFYNP; SGYTRFYNPQ; GYTRFYNPQG; YTRFYNPQGV; TRFYNPQGVY; RFYNPQGVYI; FYNPQGVYIA; YNPQGVYIAR; NPQGVYIARF; PQGVYIARFP; QGVYIARFPA; GVYIARFPAT; VYIARFPATP; YIARFPATPS; IARFPATPSN; ARFPATPSNE; RFPATPSNEY; FPATPSNEYR; PATPSNEYRR; ATPSNEYRRM; TPSNEYRRMR; PSNEYRRMRD; SNEYRRMRDL; | 31034-31331 |

Fig. 28 continued

| | | |
|---|---|---|
| | NEYRRMRDLL; EYRRMRDLLG; YRRMRDLLGA; RRMRDLLGAL; RMRDLLGALK; MRDLLGALKK; RDLLGALKKA; DLLGALKKAG; LLGALKKAGL; LGALKKAGLT; GALKKAGLTW; ALKKAGLTWP; LKKAGLTWPP; KKAGLTWPPP; KAGLTWPPPS; AGLTWPPPSK; GLTWPPPSKK; LTWPPPSKKE; TWPPPSKKER; WPPPSKKERR; PPPSKKERRA; PPSKKERRAQ; PSKKERRAQH; SKKERRAQHR; KKERRAQHRK; KERRAQHRKE; ERRAQHRKEG; RRAQHRKEGA; RAQHRKEGAQ<br><br>11 mers:<br>MNSAIIKIAKW; NSAIIKIAKWA; SAIIKIAKWAQ; AIIKIAKWAQS; IIKIAKWAQSQ; IKIAKWAQSQQ; KIAKWAQSQQW; IAKWAQSQQWT; AKWAQSQQWTV; KWAQSQQWTVE; WAQSQQWTVED; AQSQQWTVEDD; QSQQWTVEDDA; SQQWTVEDDAS; QQWTVEDDASG; QWTVEDDASGY; WTVEDDASGYT; TVEDDASGYTR; VEDDASGYTRF; EDDASGYTRFY; DDASGYTRFYN; DASGYTRFYNP; ASGYTRFYNPQ; SGYTRFYNPQG; GYTRFYNPQGV; YTRFYNPQGVY; TRFYNPQGVYI; RFYNPQGVYIA; FYNPQGVYIAR; YNPQGVYIARF; NPQGVYIARFP; PQGVYIARFPA; QGVYIARFPAT; GVYIARFPATP; VYIARFPATPS; YIARFPATPSN; IARFPATPSNE; ARFPATPSNEY; RFPATPSNEYR; FPATPSNEYRR; PATPSNEYRRM; ATPSNEYRRMR; TPSNEYRRMRD; PSNEYRRMRDL; SNEYRRMRDLL; NEYRRMRDLLG; EYRRMRDLLGA; YRRMRDLLGAL; RRMRDLLGALK; RMRDLLGALKK; MRDLLGALKKA; RDLLGALKKAG; DLLGALKKAGL; LLGALKKAGLT; LGALKKAGLTW; GALKKAGLTWP; ALKKAGLTWPP; LKKAGLTWPPP; KKAGLTWPPPS; KAGLTWPPPSK; AGLTWPPPSKK; GLTWPPPSKKE; LTWPPPSKKER; TWPPPSKKERR; WPPPSKKERRA; PPPSKKERRAQ; PPSKKERRAQH; PSKKERRAQHR; SKKERRAQHRK; KKERRAQHRKE; KERRAQHRKEG; ERRAQHRKEGA; RRAQHRKEGAQ | |
| 41) Rv2526 | 8 mers:<br>MTVKRTTI; TVKRTTIE; VKRTTIEL; KRTTIELD; RTTIELDE; TTIELDED; TIELDEDL; IELDEDLV; ELDEDLVR; LDEDLVRA; DEDLVRAA; EDLVRAAQ; DLVRAAQA; LVRAAQAV; VRAAQAVT; RAAQAVTG; AAQAVTGE; AQAVTGET; QAVTGETL; AVTGETLR; VTGETLRA; TGETLRAT; GETLRATV; ETLRATVE; TLRATVER; LRATVERA; RATVERAL; ATVERALQ; TVERALQQ; VERALQQL; ERALQQLV; RALQQLVA; ALQQLVAA; LQQLVAAA; QQLVAAAA; QLVAAAAE; LVAAAAEQ; VAAAAEQA; AAAAEQAA; AAAEQAAA; AAEQAAAR; AEQAAARR; EQAAARRR; QAAARRRR; AAARRRRI; AARRRRIV; ARRRRIVD; RRRRIVDH; RRRIVDHL; RRIVDHLA; RIVDHLAH; IVDHLAHA; VDHLAHAG; DHLAHAGT; HLAHAGTH; LAHAGTHV; AHAGTHVD; HAGTHVDA; AGTHVDAD; GTHVDADV; THVDADVL; HVDADVLL; VDADVLLS; DADVLLSE; ADVLLSEQ; DVLLSEQA; VLLSEQAW; LLSEQAWR<br><br>9 mers:<br>MTVKRTTIE; TVKRTTIEL; VKRTTIELD; KRTTIELDE; RTTIELDED; TTIELDEDL; TIELDEDLV; IELDEDLVR; ELDEDLVRA; LDEDLVRAA; DEDLVRAAQ; EDLVRAAQA; DLVRAAQAV; LVRAAQAVT; VRAAQAVTG; RAAQAVTGE; AAQAVTGET; AQAVTGETL; QAVTGETLR; AVTGETLRA; VTGETLRAT; TGETLRATV; | 31332-31597 |

Fig. 28 continued

| | | |
|---|---|---|
| | GETLRATVE; ETLRATVER; TLRATVERA; LRATVERAL; RATVERALQ; ATVERALQQ; TVERALQQL; VERALQQLV; ERALQQLVA; RALQQLVAA; ALQQLVAAA; LQQLVAAAA; QQLVAAAAE; QLVAAAAEQ; LVAAAAEQA; VAAAAEQAA; AAAAEQAAA; AAAEQAAAR; AAEQAAARR; AEQAAARRR; EQAAARRRR; QAAARRRRI; AAARRRRIV; AARRRRIVD; ARRRRIVDH; RRRRIVDHL; RRRIVDHLA; RRIVDHLAH; RIVDHLAHA; IVDHLAHAG; VDHLAHAGT; DHLAHAGTH; HLAHAGTHV; LAHAGTHVD; AHAGTHVDA; HAGTHVDAD; AGTHVDADV; GTHVDADVL; THVDADVLL; HVDADVLLS; VDADVLLSE; DADVLLSEQ; ADVLLSEQA; DVLLSEQAW; VLLSEQAWR<br><br>10 mers:<br>MTVKRTTIEL; TVKRTTIELD; VKRTTIELDE; KRTTIELDED; RTTIELDEDL; TTIELDEDLV; TIELDEDLVR; IELDEDLVRA; ELDEDLVRAA; LDEDLVRAAQ; DEDLVRAAQA; EDLVRAAQAV; DLVRAAQAVT; LVRAAQAVTG; VRAAQAVTGE; RAAQAVTGET; AAQAVTGETL; AQAVTGETLR; QAVTGETLRA; AVTGETLRAT; VTGETLRATV; TGETLRATVE; GETLRATVER; ETLRATVERA; TLRATVERAL; LRATVERALQ; RATVERALQQ; ATVERALQQL; TVERALQQLV; VERALQQLVA; ERALQQLVAA; RALQQLVAAA; ALQQLVAAAA; LQQLVAAAAE; QQLVAAAAEQ; QLVAAAAEQA; LVAAAAEQAA; VAAAAEQAAA; AAAAEQAAAR; AAAEQAAARR; AAEQAAARRR; AEQAAARRRR; EQAAARRRRI; QAAARRRRIV; AAARRRRIVD; AARRRRIVDH; ARRRRIVDHL; RRRRIVDHLA; RRRIVDHLAH; RRIVDHLAHA; RIVDHLAHAG; IVDHLAHAGT; VDHLAHAGTH; DHLAHAGTHV; HLAHAGTHVD; LAHAGTHVDA; AHAGTHVDAD; HAGTHVDADV; AGTHVDADVL; GTHVDADVLL; THVDADVLLS; HVDADVLLSE; VDADVLLSEQ; DADVLLSEQA; ADVLLSEQAW; DVLLSEQAWR<br><br>11 mers:<br>MTVKRTTIELD; TVKRTTIELDE; VKRTTIELDED; KRTTIELDEDL; RTTIELDEDLV; TTIELDEDLVR; TIELDEDLVRA; IELDEDLVRAA; ELDEDLVRAAQ; LDEDLVRAAQA; DEDLVRAAQAV; EDLVRAAQAVT; DLVRAAQAVTG; LVRAAQAVTGE; VRAAQAVTGET; RAAQAVTGETL; AAQAVTGETLR; AQAVTGETLRA; QAVTGETLRAT; AVTGETLRATV; VTGETLRATVE; TGETLRATVER; GETLRATVERA; ETLRATVERAL; TLRATVERALQ; LRATVERALQQ; RATVERALQQL; ATVERALQQLV; TVERALQQLVA; VERALQQLVAA; ERALQQLVAAA; RALQQLVAAAA; ALQQLVAAAAE; LQQLVAAAAEQ; QQLVAAAAEQA; QLVAAAAEQAA; LVAAAAEQAAA; VAAAAEQAAAR; AAAAEQAAARR; AAAEQAAARRR; AAEQAAARRRR; AEQAAARRRRI; EQAAARRRRIV; QAAARRRRIVD; AAARRRRIVDH; AARRRRIVDHL; ARRRRIVDHLA; RRRRIVDHLAH; RRRIVDHLAHA; RRIVDHLAHAG; RIVDHLAHAGT; IVDHLAHAGTH; VDHLAHAGTHV; DHLAHAGTHVD; HLAHAGTHVDA; LAHAGTHVDAD; AHAGTHVDADV; HAGTHVDADVL; AGTHVDADVLL; GTHVDADVLLS; THVDADVLLSE; HVDADVLLSEQ; VDADVLLSEQA; DADVLLSEQAW; ADVLLSEQAWR | |
| 42) Rv2557 | 8 mers:<br>MTGGATGA; TGGATGAL; GGATGALP; GATGALPR; ATGALPRT; TGALPRTM; GALPRTMK; ALPRTMKE; LPRTMKEG; PRTMKEGW; RTMKEGWI; TMKEGWIV; MKEGWIVY; KEGWIVYA; EGWIVYAR; | 31598-32459 |

Fig. 28 continued

GWIVYARS; WIVYARST; IVYARSTT; VYARSTTI; YARSTTIQ;
ARSTTIQA; RSTTIQAQ; STTIQAQS; TTIQAQSE; TIQAQSEC;
IQAQSECI; QAQSECID; AQSECIDT; QSECIDTG; SECIDTGI;
ECIDTGIA; CIDTGIAH; IDTGIAHV; DTGIAHVR; TGIAHVRD;
GIAHVRDV; IAHVRDVV; AHVRDVVM; HVRDVVMP; VRDVVMPA;
RDVVMPAL; DVVMPALQ; VVMPALQG; VMPALQGM; MPALQGMD;
PALQGMDG; ALQGMDGC; LQGMDGCI; QGMDGCIG; GMDGCIGV;
MDGCIGVS; DGCIGVSL; GCIGVSLL; CIGVSLLV; IGVSLLVD;
GVSLLVDR; VSLLVDRQ; SLLVDRQS; LLVDRQSG; LVDRQSGR;
VDRQSGRC; DRQSGRCI; RQSGRCIA; QSGRCIAT; SGRCIATS;
GRCIATSA; RCIATSAW; CIATSAWE; IATSAWET; ATSAWETA;
TSAWETAE; SAWETAEA; AWETAEAM; WETAEAMH; ETAEAMHA;
TAEAMHAS; AEAMHASR; EAMHASRE; AMHASREQ; MHASREQV;
HASREQVT; ASREQVTP; SREQVTPI; REQVTPIR; EQVTPIRD;
QVTPIRDR; VTPIRDRC; TPIRDRCA; PIRDRCAE; IRDRCAEM;
RDRCAEMF; DRCAEMFG; RCAEMFGG; CAEMFGGT; AEMFGGTP;
EMFGGTPA; MFGGTPAV; FGGTPAVE; GGTPAVEE; GTPAVEEW;
TPAVEEWE; PAVEEWEI; AVEEWEIA; VEEWEIAA; EEWEIAAM;
EWEIAAMH; WEIAAMHR; EIAAMHRD; IAAMHRDH; AAMHRDHR;
AMHRDHRS; MHRDHRSA; HRDHRSAE; RDHRSAEG; DHRSAEGA;
HRSAEGAC; RSAEGACV; SAEGACVR; AEGACVRA; EGACVRAT;
GACVRATW; ACVRATWV; CVRATWVK; VRATWVKV; RATWVKVP;
ATWVKVPA; TWVKVPAD; WVKVPADQ; VKVPADQV; KVPADQVD;
VPADQVDQ; PADQVDQG; ADQVDQGI; DQVDQGIE; QVDQGIEY;
VDQGIEYY; DQGIEYYK; QGIEYYKS; GIEYYKSS; IEYYKSSV;
EYYKSSVL; YYKSSVLP; YKSSVLPQ; KSSVLPQI; SSVLPQIE;
SVLPQIEG; VLPQIEGL; LPQIEGLD; PQIEGLDG; QIEGLDGF;
IEGLDGFC; EGLDGFCS; GLDGFCSA; LDGFCSAS; DGFCSASL;
GFCSASLL; FCSASLLV; CSASLLVD; SASLLVDR; ASLLVDRT;
SLLVDRTS; LLVDRTSG; LVDRTSGR; VDRTSGRA; DRTSGRAV;
RTSGRAVS; TSGRAVSS; SGRAVSSA; GRAVSSAT; RAVSSATF;
AVSSATFD; VSSATFDS; SSATFDSF; SATFDSFD; ATFDSFDA;
TFDSFDAM; FDSFDAME; DSFDAMER; SFDAMERN; FDAMERNR;
DAMERNRD; AMERNRDQ; MERNRDQS; ERNRDQSN; RNRDQSNA;
NRDQSNAL; RDQSNALK; DQSNALKA; QSNALKAT; SNALKATS;
NALKATSL; ALKATSLR; LKATSLRE; KATSLREA; ATSLREAG;
TSLREAGG; SLREAGGE; LREAGGEE; REAGGEEL; EAGGEELD;
AGGEELDE; GGEELDEC; GEELDECE; EELDECEF; ELDECEFE;
LDECEFEL; DECEFELA; ECEFELAL; CEFELALA; EFELALAH;
FELALAHL; ELALAHLR; LALAHLRV; ALAHLRVP; LAHLRVPE;
AHLRVPEL; HLRVPELV 9 mers:
MTGGATGAL; TGGATGALP; GGATGALPR; GATGALPRT;
ATGALPRTM; TGALPRTMK; GALPRTMKE; ALPRTMKEG;
LPRTMKEGW; PRTMKEGWI; RTMKEGWIV; TMKEGWIVY;
MKEGWIVYA; KEGWIVYAR; EGWIVYARS; GWIVYARST;
WIVYARSTT; IVYARSTTI; VYARSTTIQ; YARSTTIQA; ARSTTIQAQ;
RSTTIQAQS; STTIQAQSE; TTIQAQSEC; TIQAQSECI; IQAQSECID;
QAQSECIDT; AQSECIDTG; QSECIDTGI; SECIDTGIA; ECIDTGIAH;
CIDTGIAHV; IDTGIAHVR; DTGIAHVRD; TGIAHVRDV; GIAHVRDVV;
IAHVRDVVM; AHVRDVVMP; HVRDVVMPA; VRDVVMPAL;
RDVVMPALQ; DVVMPALQG; VVMPALQGM; VMPALQGMD;

Fig. 28 continued

| | | |
|---|---|---|
| | MPALQGMDG; PALQGMDGC; ALQGMDGCI; LQGMDGCIG; QGMDGCIGV; GMDGCIGVS; MDGCIGVSL; DGCIGVSLL; GCIGVSLLV; CIGVSLLVD; IGVSLLVDR; GVSLLVDRQ; VSLLVDRQS; SLLVDRQSG; LLVDRQSGR; LVDRQSGRC; VDRQSGRCI; DRQSGRCIA; RQSGRCIAT; QSGRCIATS; SGRCIATSA; GRCIATSAW; RCIATSAWE; CIATSAWET; IATSAWETA; ATSAWETAE; TSAWETAEA; SAWETAEAM; AWETAEAMH; WETAEAMHA; ETAEAMHAS; TAEAMHASR; AEAMHASRE; EAMHASREQ; AMHASREQV; MHASREQVT; HASREQVTP; ASREQVTPI; SREQVTPIR; REQVTPIRD; EQVTPIRDR; QVTPIRDRC; VTPIRDRCA; TPIRDRCAE; PIRDRCAEM; IRDRCAEMF; RDRCAEMFG; DRCAEMFGG; RCAEMFGGT; CAEMFGGTP; AEMFGGTPA; EMFGGTPAV; MFGGTPAVE; FGGTPAVEE; GGTPAVEEW; GTPAVEEWE; TPAVEEWEI; PAVEEWEIA; AVEEWEIAA; VEEWEIAAM; EEWEIAAMH; EWEIAAMHR; WEIAAMHRD; EIAAMHRDH; IAAMHRDHR; AAMHRDHRS; AMHRDHRSA; MHRDHRSAE; HRDHRSAEG; RDHRSAEGA; DHRSAEGAC; HRSAEGACV; RSAEGACVR; SAEGACVRA; AEGACVRAT; EGACVRATW; GACVRATWV; ACVRATWVK; CVRATWVKV; VRATWVKVP; RATWVKVPA; ATWVKVPAD; TWVKVPADQ; WVKVPADQV; VKVPADQVD; KVPADQVDQ; VPADQVDQG; PADQVDQGI; ADQVDQGIE; DQVDQGIEY; QVDQGIEYY; VDQGIEYYK; DQGIEYYKS; QGIEYYKSS; GIEYYKSSV; IEYYKSSVL; EYYKSSVLP; YYKSSVLPQ; YKSSVLPQI; KSSVLPQIE; SSVLPQIEG; SVLPQIEGL; VLPQIEGLD; LPQIEGLDG; PQIEGLDGF; QIEGLDGFC; IEGLDGFCS; EGLDGFCSA; GLDGFCSAS; LDGFCSASL; DGFCSASLL; GFCSASLLV; FCSASLLVD; CSASLLVDR; SASLLVDRT; ASLLVDRTS; SLLVDRTSG; LLVDRTSGR; LVDRTSGRA; VDRTSGRAV; DRTSGRAVS; RTSGRAVSS; TSGRAVSSA; SGRAVSSAT; GRAVSSATF; RAVSSATFD; AVSSATFDS; VSSATFDSF; SSATFDSFD; SATFDSFDA; ATFDSFDAM; TFDSFDAME; FDSFDAMER; DSFDAMERN; SFDAMERNR; FDAMERNRD; DAMERNRDQ; AMERNRDQS; MERNRDQSN; ERNRDQSNA; RNRDQSNAL; NRDQSNALK; RDQSNALKA; DQSNALKAT; QSNALKATS; SNALKATSL; NALKATSLR; ALKATSLRE; LKATSLREA; KATSLREAG; ATSLREAGG; TSLREAGGE; SLREAGGEE; LREAGGEEL; REAGGEELD; EAGGEELDE; AGGEELDEC; GGEELDECE; GEELDECEF; EELDECEFE; ELDECEFEL; LDECEFELA; DECEFELAL; ECEFELALA; CEFELALAH; EFELALAHL; FELALAHLR; ELALAHLRV; LALAHLRVP; ALAHLRVPE; LAHLRVPEL; AHLRVPELV<br><br>10 mers:<br>MTGGATGALP; TGGATGALPR; GGATGALPRT; GATGALPRTM; ATGALPRTMK; TGALPRTMKE; GALPRTMKEG; ALPRTMKEGW; LPRTMKEGWI; PRTMKEGWIV; RTMKEGWIVY; TMKEGWIVYA; MKEGWIVYAR; KEGWIVYARS; EGWIVYARST; GWIVYARSTT; WIVYARSTTI; IVYARSTTIQ; VYARSTTIQA; YARSTTIQAQ; ARSTTIQAQS; RSTTIQAQSE; STTIQAQSEC; TTIQAQSECI; TIQAQSECID; IQAQSECIDT; QAQSECIDTG; AQSECIDTGI; QSECIDTGIA; SECIDTGIAH; ECIDTGIAHV; CIDTGIAHVR; IDTGIAHVRD; DTGIAHVRDV; TGIAHVRDVV; GIAHVRDVVM; IAHVRDVVMP; AHVRDVVMPA; HVRDVVMPAL; VRDVVMPALQ; | |

Fig. 28 continued

| | | |
|---|---|---|
| | RDVVMPALQG; DVVMPALQGM; VVMPALQGMD; VMPALQGMDG; MPALQGMDGC; PALQGMDGCI; ALQGMDGCIG; LQGMDGCIGV; QGMDGCIGVS; GMDGCIGVSL; MDGCIGVSLL; DGCIGVSLLV; GCIGVSLLVD; CIGVSLLVDR; IGVSLLVDRQ; GVSLLVDRQS; VSLLVDRQSG; SLLVDRQSGR; LLVDRQSGRC; LVDRQSGRCI; VDRQSGRCIA; DRQSGRCIAT; RQSGRCIATS; QSGRCIATSA; SGRCIATSAW; GRCIATSAWE; RCIATSAWET; CIATSAWETA; IATSAWETAE; ATSAWETAEA; TSAWETAEAM; SAWETAEAMH; AWETAEAMHA; WETAEAMHAS; ETAEAMHASR; TAEAMHASRE; AEAMHASREQ; EAMHASREQV; AMHASREQVT; MHASREQVTP; HASREQVTPI; ASREQVTPIR; SREQVTPIRD; REQVTPIRDR; EQVTPIRDRC; QVTPIRDRCA; VTPIRDRCAE; TPIRDRCAEM; PIRDRCAEMF; IRDRCAEMFG; RDRCAEMFGG; DRCAEMFGGT; RCAEMFGGTP; CAEMFGGTPA; AEMFGGTPAV; EMFGGTPAVE; MFGGTPAVEE; FGGTPAVEEW; GGTPAVEEWE; GTPAVEEWEI; TPAVEEWEIA; PAVEEWEIAA; AVEEWEIAAM; VEEWEIAAMH; EEWEIAAMHR; EWEIAAMHRD; WEIAAMHRDH; EIAAMHRDHR; IAAMHRDHRS; AAMHRDHRSA; AMHRDHRSAE; MHRDHRSAEG; HRDHRSAEGA; RDHRSAEGAC; DHRSAEGACV; HRSAEGACVR; RSAEGACVRA; SAEGACVRAT; AEGACVRATW; EGACVRATWV; GACVRATWVK; ACVRATWVKV; CVRATWVKVP; VRATWVKVPA; RATWVKVPAD; ATWVKVPADQ; TWVKVPADQV; WVKVPADQVD; VKVPADQVDQ; KVPADQVDQG; VPADQVDQGI; PADQVDQGIE; ADQVDQGIEY; DQVDQGIEYY; QVDQGIEYYK; VDQGIEYYKS; DQGIEYYKSS; QGIEYYKSSV; GIEYYKSSVL; IEYYKSSVLP; EYYKSSVLPQ; YYKSSVLPQI; YKSSVLPQIE; KSSVLPQIEG; SSVLPQIEGL; SVLPQIEGLD; VLPQIEGLDG; LPQIEGLDGF; PQIEGLDGFC; QIEGLDGFCS; IEGLDGFCSA; EGLDGFCSAS; GLDGFCSASL; LDGFCSASLL; DGFCSASLLV; GFCSASLLVD; FCSASLLVDR; CSASLLVDRT; SASLLVDRTS; ASLLVDRTSG; SLLVDRTSGR; LLVDRTSGRA; LVDRTSGRAV; VDRTSGRAVS; DRTSGRAVSS; RTSGRAVSSA; TSGRAVSSAT; SGRAVSSATF; GRAVSSATFD; RAVSSATFDS; AVSSATFDSF; VSSATFDSFD; SSATFDSFDA; SATFDSFDAM; ATFDSFDAME; TFDSFDAMER; FDSFDAMERN; DSFDAMERNR; SFDAMERNRD; FDAMERNRDQ; DAMERNRDQS; AMERNRDQSN; MERNRDQSNA; ERNRDQSNAL; RNRDQSNALK; NRDQSNALKA; RDQSNALKAT; DQSNALKATS; QSNALKATSL; SNALKATSLR; NALKATSLRE; ALKATSLREA; LKATSLREAG; KATSLREAGG; ATSLREAGGE; TSLREAGGEE; SLREAGGEEL; LREAGGEELD; REAGGEELDE; EAGGEELDEC; AGGEELDECE; GGEELDECEF; GEELDECEFE; EELDECEFEL; ELDECEFELA; LDECEFELAL; DECEFELALA; ECEFELALAH; CEFELALAHL; EFELALAHLR; FELALAHLRV; ELALAHLRVP; LALAHLRVPE; ALAHLRVPEL; LAHLRVPELV<br><br>11 mers:<br>MTGGATGALPR; TGGATGALPRT; GGATGALPRTM; GATGALPRTMK; ATGALPRTMKE; TGALPRTMKEG; GALPRTMKEGW; ALPRTMKEGWI; LPRTMKEGWIV; PRTMKEGWIVY; RTMKEGWIVYA; TMKEGWIVYAR; MKEGWIVYARS; KEGWIVYARST; EGWIVYARSTT; GWIVYARSTTI; WIVYARSTTIQ; IVYARSTTIQA; VYARSTTIQAQ; YARSTTIQAQS; ARSTTIQAQSE; RSTTIQAQSEC; STTIQAQSECI; TTIQAQSECID; TIQAQSECIDT; IQAQSECIDTG; | |

Fig. 28 continued

| | | |
|---|---|---|
| | QAQSECIDTGI; AQSECIDTGIA; QSECIDTGIAH; SECIDTGIAHV; ECIDTGIAHVR; CIDTGIAHVRD; IDTGIAHVRDV; DTGIAHVRDVV; TGIAHVRDVVM; GIAHVRDVVMP; IAHVRDVVMPA; AHVRDVVMPAL; HVRDVVMPALQ; VRDVVMPALQG; RDVVMPALQGM; DVVMPALQGMD; VVMPALQGMDG; VMPALQGMDGC; MPALQGMDGCI; PALQGMDGCIG; ALQGMDGCIGV; LQGMDGCIGVS; QGMDGCIGVSL; GMDGCIGVSLL; MDGCIGVSLLV; DGCIGVSLLVD; GCIGVSLLVDR; CIGVSLLVDRQ; IGVSLLVDRQS; GVSLLVDRQSG; VSLLVDRQSGR; SLLVDRQSGRC; LLVDRQSGRCI; LVDRQSGRCIA; VDRQSGRCIAT; DRQSGRCIATS; RQSGRCIATSA; QSGRCIATSAW; SGRCIATSAWE; GRCIATSAWET; RCIATSAWETA; CIATSAWETAE; IATSAWETAEA; ATSAWETAEAM; TSAWETAEAMH; SAWETAEAMHA; AWETAEAMHAS; WETAEAMHASR; ETAEAMHASRE; TAEAMHASREQ; AEAMHASREQV; EAMHASREQVT; AMHASREQVTP; MHASREQVTPI; HASREQVTPIR; ASREQVTPIRD; SREQVTPIRDR; REQVTPIRDRC; EQVTPIRDRCA; QVTPIRDRCAE; VTPIRDRCAEM; TPIRDRCAEMF; PIRDRCAEMFG; IRDRCAEMFGG; RDRCAEMFGGT; DRCAEMFGGTP; RCAEMFGGTPA; CAEMFGGTPAV; AEMFGGTPAVE; EMFGGTPAVEE; MFGGTPAVEEW; FGGTPAVEEWE; GGTPAVEEWEI; GTPAVEEWEIA; TPAVEEWEIAA; PAVEEWEIAAM; AVEEWEIAAMH; VEEWEIAAMHR; EEWEIAAMHRD; EWEIAAMHRDH; WEIAAMHRDHR; EIAAMHRDHRS; IAAMHRDHRSA; AAMHRDHRSAE; AMHRDHRSAEG; MHRDHRSAEGA; HRDHRSAEGAC; RDHRSAEGACV; DHRSAEGACVR; HRSAEGACVRA; RSAEGACVRAT; SAEGACVRATW; AEGACVRATWV; EGACVRATWVK; GACVRATWVKV; ACVRATWVKVP; CVRATWVKVPA; VRATWVKVPAD; RATWVKVPADQ; ATWVKVPADQV; TWVKVPADQVD; WVKVPADQVDQ; VKVPADQVDQG; KVPADQVDQGI; VPADQVDQGIE; PADQVDQGIEY; ADQVDQGIEYY; DQVDQGIEYYK; QVDQGIEYYKS; VDQGIEYYKSS; DQGIEYYKSSV; QGIEYYKSSVL; GIEYYKSSVLP; IEYYKSSVLPQ; EYYKSSVLPQI; YYKSSVLPQIE; YKSSVLPQIEG; KSSVLPQIEGL; SSVLPQIEGLD; SVLPQIEGLDG; VLPQIEGLDGF; LPQIEGLDGFC; PQIEGLDGFCS; QIEGLDGFCSA; IEGLDGFCSAS; EGLDGFCSASL; GLDGFCSASLL; LDGFCSASLLV; DGFCSASLLVD; GFCSASLLVDR; FCSASLLVDRT; CSASLLVDRTS; SASLLVDRTSG; ASLLVDRTSGR; SLLVDRTSGRA; LLVDRTSGRAV; LVDRTSGRAVS; VDRTSGRAVSS; DRTSGRAVSSA; RTSGRAVSSAT; TSGRAVSSATF; SGRAVSSATFD; GRAVSSATFDS; RAVSSATFDSF; AVSSATFDSFD; VSSATFDSFDA; SSATFDSFDAM; SATFDSFDAME; ATFDSFDAMER; TFDSFDAMERN; FDSFDAMERNR; DSFDAMERNRD; SFDAMERNRDQ; FDAMERNRDQS; DAMERNRDQSN; AMERNRDQSNA; MERNRDQSNAL; ERNRDQSNALK; RNRDQSNALKA; NRDQSNALKAT; RDQSNALKATS; DQSNALKATSL; QSNALKATSLR; SNALKATSLRE; NALKATSLREA; ALKATSLREAG; LKATSLREAGG; KATSLREAGGE; ATSLREAGGEE; TSLREAGGEEL; SLREAGGEELD; LREAGGEELDE; REAGGEELDEC; EAGGEELDECE; AGGEELDECEF; GGEELDECEFE; GEELDECEFEL; EELDECEFELA; ELDECEFELAL; LDECEFELALA; DECEFELALAH; ECEFELALAHL; CEFELALAHLR; EFELALAHLRV; FELALAHLRVP; ELALAHLRVPE; LALAHLRVPEL; ALAHLRVPELV | |
| 43) Rv2558 | 8 mers: | 32460- |

Fig. 28 continued

| | | |
|---|---|---|
| | MPGSAGWR; PGSAGWRK; GSAGWRKV; SAGWRKVF; AGWRKVFG; GWRKVFGG; WRKVFGGT; RKVFGGTG; KVFGGTGG; VFGGTGGA; FGGTGGAT; GGTGGATG; GTGGATGA; TGGATGAL; GGATGALP; GATGALPR; ATGALPRH; TGALPRHG; GALPRHGR; ALPRHGRG; LPRHGRGS; PRHGRGSI; RHGRGSIV; HGRGSIVY; GRGSIVYA; RGSIVYAR; GSIVYARS; SIVYARST; IVYARSTT; VYARSTTI; YARSTTIE; ARSTTIEA; RSTTIEAQ; STTIEAQP; TTIEAQPL; TIEAQPLS; IEAQPLSV; EAQPLSVD; AQPLSVDI; QPLSVDIG; PLSVDIGI; LSVDIGIA; SVDIGIAH; VDIGIAHV; DIGIAHVR; IGIAHVRD; GIAHVRDV; IAHVRDVV; AHVRDVVM; HVRDVVMP; VRDVVMPA; RDVVMPAL; DVVMPALQ; VVMPALQE; VMPALQEI; MPALQEID; PALQEIDG; ALQEIDGC; LQEIDGCV; QEIDGCVG; EIDGCVGV; IDGCVGVS; DGCVGVSL; GCVGVSLL; CVGVSLLV; VGVSLLVD; GVSLLVDR; VSLLVDRQ; SLLVDRQS; LLVDRQSG; LVDRQSGR; VDRQSGRC; DRQSGRCI; RQSGRCIA; QSGRCIAT; SGRCIATS; GRCIATSA; RCIATSAW; CIATSAWE; IATSAWET; ATSAWETL; TSAWETLE; SAWETLEA; AWETLEAM; WETLEAMR; ETLEAMRA; TLEAMRAS; LEAMRASV; EAMRASVE; AMRASVER; MRASVERV; RASVERVA; ASVERVAP; SVERVAPI; VERVAPIR; ERVAPIRD; RVAPIRDR; VAPIRDRA; APIRDRAA; PIRDRAAL; IRDRAALM; RDRAALMF; DRAALMFA; RAALMFAG; AALMFAGS; ALMFAGSA; LMFAGSAR; MFAGSARV; FAGSARVE; AGSARVEE; GSARVEEW; SARVEEWD; ARVEEWDI; RVEEWDIA; VEEWDIAL; EEWDIALL; EWDIALLH; WDIALLHR; DIALLHRD; IALLHRDH; ALLHRDHP; LLHRDHPS; LHRDHPSH; HRDHPSHE; RDHPSHEG; DHPSHEGA; HPSHEGAC; PSHEGACV; SHEGACVR; HEGACVRA; EGACVRAT; GACVRATW; ACVRATWL; CVRATWLK; VRATWLKV; RATWLKVV; ATWLKVVP; TWLKVVPD; WLKVVPDQ; LKVVPDQL; KVVPDQLG; VVPDQLGR; VPDQLGRS; PDQLGRSL; DQLGRSLE; QLGRSLEF; LGRSLEFY; GRSLEFYR; RSLEFYRT; SLEFYRTS; LEFYRTSV; EFYRTSVL; FYRTSVLP; YRTSVLPE; RTSVLPEL; TSVLPELE; SVLPELES; VLPELESL; LPELESLD; PELESLDG; ELESLDGF; LESLDGFC; ESLDGFCS; SLDGFCSA; LDGFCSAS; DGFCSASL; GFCSASLM; FCSASLMV; CSASLMVD; SASLMVDH; ASLMVDHP; SLMVDHPA; LMVDHPAC; MVDHPACR; VDHPACRR; DHPACRRA; HPACRRAV; PACRRAVS; ACRRAVSC; CRRAVSCS; RRAVSCST; RAVSCSTF; AVSCSTFD; VSCSTFDS; SCSTFDSM; CSTFDSMD; STFDSMDA; TFDSMDAM; FDSMDAMA; DSMDAMAR; SMDAMARN; MDAMARNR; DAMARNRD; AMARNRDR; MARNRDRA; ARNRDRAS; RNRDRASE; NRDRASEL; RDRASELR; DRASELRS; RASELRSR; ASELRSRR; SELRSRRV; ELRSRRVR; LRSRRVRE; RSRRVREL; SRRVRELG; RRVRELGA; RVRELGAE; VRELGAEV; RELGAEVL; ELGAEVLD; LGAEVLDV; GAEVLDVA; AEVLDVAE; EVLDVAEF; VLDVAEFE; LDVAEFEL; DVAEFELA; VAEFELAI; AEFELAIA; EFELAIAH; FELAIAHL; ELAIAHLR; LAIAHLRV; AIAHLRVP; IAHLRVPE; AHLRVPEL; HLRVPELV<br><br>9 mers:<br>MPGSAGWRK; PGSAGWRKV; GSAGWRKVF; SAGWRKVFG; AGWRKVFGG; GWRKVFGGT; WRKVFGGTG; RKVFGGTGG; KVFGGTGGA; VFGGTGGAT; FGGTGGATG; GGTGGATGA; GTGGATGAL; TGGATGALP; GGATGALPR; GATGALPRH; ATGALPRHG; TGALPRHGR; GALPRHGRG; ALPRHGRGS; | 33369 |

Fig. 28 continued

| | | | |
|---|---|---|---|
| | LPRHGRGSI; PRHGRGSIV; RHGRGSIVY; HGRGSIVYA; GRGSIVYAR; RGSIVYARS; GSIVYARST; SIVYARSTT; IVYARSTTI; VYARSTTIE; YARSTTIEA; ARSTTIEAQ; RSTTIEAQP; STTIEAQPL; TTIEAQPLS; TIEAQPLSV; IEAQPLSVD; EAQPLSVDI; AQPLSVDIG; QPLSVDIGI; PLSVDIGIA; LSVDIGIAH; SVDIGIAHV; VDIGIAHVR; DIGIAHVRD; IGIAHVRDV; GIAHVRDVV; IAHVRDVVM; AHVRDVVMP; HVRDVVMPA; VRDVVMPAL; RDVVMPALQ; DVVMPALQE; VVMPALQEI; VMPALQEID; MPALQEIDG; PALQEIDGC; ALQEIDGCV; LQEIDGCVG; QEIDGCVGV; EIDGCVGVS; IDGCVGVSL; DGCVGVSLL; GCVGVSLLV; CVGVSLLVD; VGVSLLVDR; GVSLLVDRQ; VSLLVDRQS; SLLVDRQSG; LLVDRQSGR; LVDRQSGRC; VDRQSGRCI; DRQSGRCIA; RQSGRCIAT; QSGRCIATS; SGRCIATSA; GRCIATSAW; RCIATSAWE; CIATSAWET; IATSAWETL; ATSAWETLE; TSAWETLEA; SAWETLEAM; AWETLEAMR; WETLEAMRA; ETLEAMRAS; TLEAMRASV; LEAMRASVE; EAMRASVER; AMRASVERV; MRASVERVA; RASVERVAP; ASVERVAPI; SVERVAPIR; VERVAPIRD; ERVAPIRDR; RVAPIRDRA; VAPIRDRAA; APIRDRAAL; PIRDRAALM; IRDRAALMF; RDRAALMFA; DRAALMFAG; RAALMFAGS; AALMFAGSA; ALMFAGSAR; LMFAGSARV; MFAGSARVE; FAGSARVEE; AGSARVEEW; GSARVEEWD; SARVEEWDI; ARVEEWDIA; RVEEWDIAL; VEEWDIALL; EEWDIALLH; EWDIALLHR; WDIALLHRD; DIALLHRDH; IALLHRDHP; ALLHRDHPS; LLHRDHPSH; LHRDHPSHE; HRDHPSHEG; RDHPSHEGA; DHPSHEGAC; HPSHEGACV; PSHEGACVR; SHEGACVRA; HEGACVRAT; EGACVRATW; GACVRATWL; ACVRATWLK; CVRATWLKV; VRATWLKVV; RATWLKVVP; ATWLKVVPD; TWLKVVPDQ; WLKVVPDQL; LKVVPDQLG; KVVPDQLGR; VVPDQLGRS; VPDQLGRSL; PDQLGRSLE; DQLGRSLEF; QLGRSLEFY; LGRSLEFYR; GRSLEFYRT; RSLEFYRTS; SLEFYRTSV; LEFYRTSVL; EFYRTSVLP; FYRTSVLPE; YRTSVLPEL; RTSVLPELE; TSVLPELES; SVLPELESL; VLPELESLD; LPELESLDG; PELESLDGF; ELESLDGFC; LESLDGFCS; ESLDGFCSA; SLDGFCSAS; LDGFCSASL; DGFCSASLM; GFCSASLMV; FCSASLMVD; CSASLMVDH; SASLMVDHP; ASLMVDHPA; SLMVDHPAC; LMVDHPACR; MVDHPACRR; VDHPACRRA; DHPACRRAV; HPACRRAVS; PACRRAVSC; ACRRAVSCS; CRRAVSCST; RRAVSCSTF; RAVSCSTFD; AVSCSTFDS; VSCSTFDSM; SCSTFDSMD; CSTFDSMDA; STFDSMDAM; TFDSMDAMA; FDSMDAMAR; DSMDAMARN; SMDAMARNR; MDAMARNRD; DAMARNRDR; AMARNRDRA; MARNRDRAS; ARNRDRASE; RNRDRASEL; NRDRASELR; RDRASELRS; DRASELRSR; RASELRSRR; ASELRSRRV; SELRSRRVR; ELRSRRVRE; LRSRRVREL; RSRRVRELG; SRRVRELGA; RRVRELGAE; RVRELGAEV; VRELGAEVL; RELGAEVLD; ELGAEVLDV; LGAEVLDVA; GAEVLDVAE; AEVLDVAEF; EVLDVAEFE; VLDVAEFEL; LDVAEFELA; DVAEFELAI; VAEFELAIA; AEFELAIAH; EFELAIAHL; FELAIAHLR; ELAIAHLRV; LAIAHLRVP; AIAHLRVPE; IAHLRVPEL; AHLRVPELV<br><br>10 mers:<br>MPGSAGWRKV; PGSAGWRKVF; GSAGWRKVFG; SAGWRKVFGG; AGWRKVFGGT; GWRKVFGGTG; WRKVFGGTGG; RKVFGGTGGA; KVFGGTGGAT; VFGGTGGATG; FGGTGGATGA; GGTGGATGAL; | |

Fig. 28 continued

| | | |
|---|---|---|
| | GTGGATGALP; TGGATGALPR; GGATGALPRH; GATGALPRHG; ATGALPRHGR; TGALPRHGRG; GALPRHGRGS; ALPRHGRGSI; LPRHGRGSIV; PRHGRGSIVY; RHGRGSIVYA; HGRGSIVYAR; GRGSIVYARS; RGSIVYARST; GSIVYARSTT; SIVYARSTTI; IVYARSTTIE; VYARSTTIEA; YARSTTIEAQ; ARSTTIEAQP; RSTTIEAQPL; STTIEAQPLS; TTIEAQPLSV; TIEAQPLSVD; IEAQPLSVDI; EAQPLSVDIG; AQPLSVDIGI; QPLSVDIGIA; PLSVDIGIAH; LSVDIGIAHV; SVDIGIAHVR; VDIGIAHVRD; DIGIAHVRDV; IGIAHVRDVV; GIAHVRDVVM; IAHVRDVVMP; AHVRDVVMPA; HVRDVVMPAL; VRDVVMPALQ; RDVVMPALQE; DVVMPALQEI; VVMPALQEID; VMPALQEIDG; MPALQEIDGC; PALQEIDGCV; ALQEIDGCVG; LQEIDGCVGV; QEIDGCVGVS; EIDGCVGVSL; IDGCVGVSLL; DGCVGVSLLV; GCVGVSLLVD; CVGVSLLVDR; VGVSLLVDRQ; GVSLLVDRQS; VSLLVDRQSG; SLLVDRQSGR; LLVDRQSGRC; LVDRQSGRCI; VDRQSGRCIA; DRQSGRCIAT; RQSGRCIATS; QSGRCIATSA; SGRCIATSAW; GRCIATSAWE; RCIATSAWET; CIATSAWETL; IATSAWETLE; ATSAWETLEA; TSAWETLEAM; SAWETLEAMR; AWETLEAMRA; WETLEAMRAS; ETLEAMRASV; TLEAMRASVE; LEAMRASVER; EAMRASVERV; AMRASVERVA; MRASVERVAP; RASVERVAPI; ASVERVAPIR; SVERVAPIRD; VERVAPIRDR; ERVAPIRDRA; RVAPIRDRAA; VAPIRDRAAL; APIRDRAALM; PIRDRAALMF; IRDRAALMFA; RDRAALMFAG; DRAALMFAGS; RAALMFAGSA; AALMFAGSAR; ALMFAGSARV; LMFAGSARVE; MFAGSARVEE; FAGSARVEEW; AGSARVEEWD; GSARVEEWDI; SARVEEWDIA; ARVEEWDIAL; RVEEWDIALL; VEEWDIALLH; EEWDIALLHR; EWDIALLHRD; WDIALLHRDH; DIALLHRDHP; IALLHRDHPS; ALLHRDHPSH; LLHRDHPSHE; LHRDHPSHEG; HRDHPSHEGA; RDHPSHEGAC; DHPSHEGACV; HPSHEGACVR; PSHEGACVRA; SHEGACVRAT; HEGACVRATW; EGACVRATWL; GACVRATWLK; ACVRATWLKV; CVRATWLKVV; VRATWLKVVP; RATWLKVVPD; ATWLKVVPDQ; TWLKVVPDQL; WLKVVPDQLG; LKVVPDQLGR; KVVPDQLGRS; VVPDQLGRSL; VPDQLGRSLE; PDQLGRSLEF; DQLGRSLEFY; QLGRSLEFYR; LGRSLEFYRT; GRSLEFYRTS; RSLEFYRTSV; SLEFYRTSVL; LEFYRTSVLP; EFYRTSVLPE; FYRTSVLPEL; YRTSVLPELE; RTSVLPELES; TSVLPELESL; SVLPELESLD; VLPELESLDG; LPELESLDGF; PELESLDGFC; ELESLDGFCS; LESLDGFCSA; ESLDGFCSAS; SLDGFCSASL; LDGFCSASLM; DGFCSASLMV; GFCSASLMVD; FCSASLMVDH; CSASLMVDHP; SASLMVDHPA; ASLMVDHPAC; SLMVDHPACR; LMVDHPACRR; MVDHPACRRA; VDHPACRRAV; DHPACRRAVS; HPACRRAVSC; PACRRAVSCS; ACRRAVSCST; CRRAVSCSTF; RRAVSCSTFD; RAVSCSTFDS; AVSCSTFDSM; VSCSTFDSMD; SCSTFDSMDA; CSTFDSMDAM; STFDSMDAMA; TFDSMDAMAR; FDSMDAMARN; DSMDAMARNR; SMDAMARNRD; MDAMARNRDR; DAMARNRDRA; AMARNRDRAS; MARNRDRASE; ARNRDRASEL; RNRDRASELR; NRDRASELRS; RDRASELRSR; DRASELRSRR; RASELRSRRV; ASELRSRRVR; SELRSRRVRE; ELRSRRVREL; LRSRRVRELG; RSRRVRELGA; SRRVRELGAE; RRVRELGAEV; RVRELGAEVL; VRELGAEVLD; RELGAEVLDV; ELGAEVLDVA; LGAEVLDVAE; GAEVLDVAEF; AEVLDVAEFE; EVLDVAEFEL; VLDVAEFELA; LDVAEFELAI; DVAEFELAIA; VAEFELAIAH; AEFELAIAHL; EFELAIAHLR; FELAIAHLRV; ELAIAHLRVP; | |

Fig. 28 continued

| | | | |
|---|---|---|---|
| | LAIAHLRVPE; AIAHLRVPEL; IAHLRVPELV<br><br>11 mers:<br>MPGSAGWRKVF; PGSAGWRKVFG; GSAGWRKVFGG; SAGWRKVFGGT; AGWRKVFGGTG; GWRKVFGGTGG; WRKVFGGTGGA; RKVFGGTGGAT; KVFGGTGGATG; VFGGTGGATGA; FGGTGGATGAL; GGTGGATGALP; GTGGATGALPR; TGGATGALPRH; GGATGALPRHG; GATGALPRHGR; ATGALPRHGRG; TGALPRHGRGS; GALPRHGRGSI; ALPRHGRGSIV; LPRHGRGSIVY; PRHGRGSIVYA; RHGRGSIVYAR; HGRGSIVYARS; GRGSIVYARST; RGSIVYARSTT; GSIVYARSTTI; SIVYARSTTIE; IVYARSTTIEA; VYARSTTIEAQ; YARSTTIEAQP; ARSTTIEAQPL; RSTTIEAQPLS; STTIEAQPLSV; TTIEAQPLSVD; TIEAQPLSVDI; IEAQPLSVDIG; EAQPLSVDIGI; AQPLSVDIGIA; QPLSVDIGIAH; PLSVDIGIAHV; LSVDIGIAHVR; SVDIGIAHVRD; VDIGIAHVRDV; DIGIAHVRDVV; IGIAHVRDVVM; GIAHVRDVVMP; IAHVRDVVMPA; AHVRDVVMPAL; HVRDVVMPALQ; VRDVVMPALQE; RDVVMPALQEI; DVVMPALQEID; VVMPALQEIDG; VMPALQEIDGC; MPALQEIDGCV; PALQEIDGCVG; ALQEIDGCVGV; LQEIDGCVGVS; QEIDGCVGVSL; EIDGCVGVSLL; IDGCVGVSLLV; DGCVGVSLLVD; GCVGVSLLVDR; CVGVSLLVDRQ; VGVSLLVDRQS; GVSLLVDRQSG; VSLLVDRQSGR; SLLVDRQSGRC; LLVDRQSGRCI; LVDRQSGRCIA; VDRQSGRCIAT; DRQSGRCIATS; RQSGRCIATSA; QSGRCIATSAW; SGRCIATSAWE; GRCIATSAWET; RCIATSAWETL; CIATSAWETLE; IATSAWETLEA; ATSAWETLEAM; TSAWETLEAMR; SAWETLEAMRA; AWETLEAMRAS; WETLEAMRASV; ETLEAMRASVE; TLEAMRASVER; LEAMRASVERV; EAMRASVERVA; AMRASVERVAP; MRASVERVAPI; RASVERVAPIR; ASVERVAPIRD; SVERVAPIRDR; VERVAPIRDRA; ERVAPIRDRAA; RVAPIRDRAAL; VAPIRDRAALM; APIRDRAALMF; PIRDRAALMFA; IRDRAALMFAG; RDRAALMFAGS; DRAALMFAGSA; RAALMFAGSAR; AALMFAGSARV; ALMFAGSARVE; LMFAGSARVEE; MFAGSARVEEW; FAGSARVEEWD; AGSARVEEWDI; GSARVEEWDIA; SARVEEWDIAL; ARVEEWDIALL; RVEEWDIALLH; VEEWDIALLHR; EEWDIALLHRD; EWDIALLHRDH; WDIALLHRDHP; DIALLHRDHPS; IALLHRDHPSH; ALLHRDHPSHE; LLHRDHPSHEG; LHRDHPSHEGA; HRDHPSHEGAC; RDHPSHEGACV; DHPSHEGACVR; HPSHEGACVRA; PSHEGACVRAT; SHEGACVRATW; HEGACVRATWL; EGACVRATWLK; GACVRATWLKV; ACVRATWLKVV; CVRATWLKVVP; VRATWLKVVPD; RATWLKVVPDQ; ATWLKVVPDQL; TWLKVVPDQLG; WLKVVPDQLGR; LKVVPDQLGRS; KVVPDQLGRSL; VVPDQLGRSLE; VPDQLGRSLEF; PDQLGRSLEFY; DQLGRSLEFYR; QLGRSLEFYRT; LGRSLEFYRTS; GRSLEFYRTSV; RSLEFYRTSVL; SLEFYRTSVLP; LEFYRTSVLPE; EFYRTSVLPEL; FYRTSVLPELE; YRTSVLPELES; RTSVLPELESL; TSVLPELESLD; SVLPELESLDG; VLPELESLDGF; LPELESLDGFC; PELESLDGFCS; ELESLDGFCSA; LESLDGFCSAS; ESLDGFCSASL; SLDGFCSASLM; LDGFCSASLMV; DGFCSASLMVD; GFCSASLMVDH; FCSASLMVDHP; CSASLMVDHPA; SASLMVDHPAC; ASLMVDHPACR; SLMVDHPACRR; LMVDHPACRRA; MVDHPACRRAV; VDHPACRRAVS; DHPACRRAVSC; HPACRRAVSCS; PACRRAVSCST; ACRRAVSCSTF; CRRAVSCSTFD; RRAVSCSTFDS; RAVSCSTFDSM; AVSCSTFDSMD; VSCSTFDSMDA; | | |

Fig. 28 continued

| | | |
|---|---|---|
| | SCSTFDSMDAM; CSTFDSMDAMA; STFDSMDAMAR; TFDSMDAMARN; FDSMDAMARNR; DSMDAMARNRD; SMDAMARNRDR; MDAMARNRDRA; DAMARNRDRAS; AMARNRDRASE; MARNRDRASEL; ARNRDRASELR; RNRDRASELRS; NRDRASELRSR; RDRASELRSRR; DRASELRSRRV; RASELRSRRVR; ASELRSRRVRE; SELRSRRVREL; ELRSRRVRELG; LRSRRVRELGA; RSRRVRELGAE; SRRVRELGAEV; RRVRELGAEVL; RVRELGAEVLD; VRELGAEVLDV; RELGAEVLDVA; ELGAEVLDVAE; LGAEVLDVAEF; GAEVLDVAEFE; AEVLDVAEFEL; EVLDVAEFELA; VLDVAEFELAI; LDVAEFELAIA; DVAEFELAIAH; VAEFELAIAHL; AEFELAIAHLR; EFELAIAHLRV; FELAIAHLRVP; ELAIAHLRVPE; LAIAHLRVPEL; AIAHLRVPELV | |
| 44) Rv2653c | 8 mers:<br>MTHKRTKR; THKRTKRQ; HKRTKRQP; KRTKRQPA; RTKRQPAI; TKRQPAIA; KRQPAIAA; RQPAIAAG; QPAIAAGL; PAIAAGLN; AIAAGLNA; IAAGLNAP; AAGLNAPR; AGLNAPRR; GLNAPRRN; LNAPRRNR; NAPRRNRV; APRRNRVG; PRRNRVGR; RRNRVGRQ; RNRVGRQH; NRVGRQHG; RVGRQHGW; VGRQHGWP; GRQHGWPA; RQHGWPAD; QHGWPADV; HGWPADVP; GWPADVPS; WPADVPSA; PADVPSAE; ADVPSAEQ; DVPSAEQR; VPSAEQRR; PSAEQRRA; SAEQRRAQ; AEQRRAQR; EQRRAQRQ; QRRAQRQR; RRAQRQRD; RAQRQRDL; AQRQRDLE; QRQRDLEA; RQRDLEAI; QRDLEAIR; RDLEAIRR; DLEAIRRA; LEAIRRAY; EAIRRAYA; AIRRAYAE; IRRAYAEM; RRAYAEMV; RAYAEMVA; AYAEMVAT; YAEMVATS; AEMVATSH; EMVATSHE; MVATSHEI; VATSHEID; ATSHEIDD; TSHEIDDD; SHEIDDDT; HEIDDDTA; EIDDDTAE; IDDDTAEL; DDDTAELA; DDTAELAL; DTAELALL; TAELALLS; AELALLSM; ELALLSMH; LALLSMHL; ALLSMHLD; LLSMHLDD; LSMHLDDE; SMHLDDEQ; MHLDDEQR; HLDDEQRR; LDDEQRRL; DDEQRRLE; DEQRRLEA; EQRRLEAG; QRRLEAGM; RRLEAGMK; RLEAGMKL; LEAGMKLG; EAGMKLGW; AGMKLGWH; GMKLGWHP; MKLGWHPY; KLGWHPYH; LGWHPYHF; GWHPYHFP; WHPYHFPD; HPYHFPDE; PYHFPDEP; YHFPDEPD; HFPDEPDS; FPDEPDSK; PDEPDSKQ;<br><br>9 mers:<br>MTHKRTKRQ; THKRTKRQP; HKRTKRQPA; KRTKRQPAI; RTKRQPAIA; TKRQPAIAA; KRQPAIAAG; RQPAIAAGL; QPAIAAGLN; PAIAAGLNA; AIAAGLNAP; IAAGLNAPR; AAGLNAPRR; AGLNAPRRN; GLNAPRRNR; LNAPRRNRV; NAPRRNRVG; APRRNRVGR; PRRNRVGRQ; RRNRVGRQH; RNRVGRQHG; NRVGRQHGW; RVGRQHGWP; VGRQHGWPA; GRQHGWPAD; RQHGWPADV; QHGWPADVP; HGWPADVPS; GWPADVPSA; WPADVPSAE; PADVPSAEQ; ADVPSAEQR; DVPSAEQRR; VPSAEQRRA; PSAEQRRAQ; SAEQRRAQR; AEQRRAQRQ; EQRRAQRQR; QRRAQRQRD; RRAQRQRDL; RAQRQRDLE; AQRQRDLEA; QRQRDLEAI; RQRDLEAIR; QRDLEAIRR; RDLEAIRRA; DLEAIRRAY; LEAIRRAYA; EAIRRAYAE; AIRRAYAEM; IRRAYAEMV; RRAYAEMVA; RAYAEMVAT; AYAEMVATS; YAEMVATSH; AEMVATSHE; EMVATSHEI; MVATSHEID; VATSHEIDD; ATSHEIDDD; TSHEIDDDT; SHEIDDDTA; HEIDDDTAE; EIDDDTAEL; IDDDTAELA; DDDTAELAL; DDTAELALL; DTAELALLS; TAELALLSM; AELALLSMH; ELALLSMHL; LALLSMHLD; ALLSMHLDD; LLSMHLDDE; LSMHLDDEQ; | 33370-33763 |

Fig. 28 continued

| | | |
|---|---|---|
| | SMHLDDEQR; MHLDDEQRR; HLDDEQRRL; LDDEQRRLE; DDEQRRLEA; DEQRRLEAG; EQRRLEAGM; QRRLEAGMK; RRLEAGMKL; RLEAGMKLG; LEAGMKLGW; EAGMKLGWH; AGMKLGWHP; GMKLGWHPY; MKLGWHPYH; KLGWHPYHF; LGWHPYHFP; GWHPYHFPD; WHPYHFPDE; HPYHFPDEP; PYHFPDEPD; YHFPDEPDS; HFPDEPDSK; FPDEPDSKQ;<br><br>10 mers:<br>MTHKRTKRQP; THKRTKRQPA; HKRTKRQPAI; KRTKRQPAIA; RTKRQPAIAA; TKRQPAIAAG; KRQPAIAAGL; RQPAIAAGLN; QPAIAAGLNA; PAIAAGLNAP; AIAAGLNAPR; IAAGLNAPRR; AAGLNAPRRN; AGLNAPRRNR; GLNAPRRNRV; LNAPRRNRVG; NAPRRNRVGR; APRRNRVGRQ; PRRNRVGRQH; RRNRVGRQHG; RNRVGRQHGW; NRVGRQHGWP; RVGRQHGWPA; VGRQHGWPAD; GRQHGWPADV; RQHGWPADVP; QHGWPADVPS; HGWPADVPSA; GWPADVPSAE; WPADVPSAEQ; PADVPSAEQR; ADVPSAEQRR; DVPSAEQRRA; VPSAEQRRAQ; PSAEQRRAQR; SAEQRRAQRQ; AEQRRAQRQR; EQRRAQRQRD; QRRAQRQRDL; RRAQRQRDLE; RAQRQRDLEA; AQRQRDLEAI; QRQRDLEAIR; RQRDLEAIRR; QRDLEAIRRA; RDLEAIRRAY; DLEAIRRAYA; LEAIRRAYAE; EAIRRAYAEM; AIRRAYAEMV; IRRAYAEMVA; RRAYAEMVAT; RAYAEMVATS; AYAEMVATSH; YAEMVATSHE; AEMVATSHEI; EMVATSHEID; MVATSHEIDD; VATSHEIDDD; ATSHEIDDDT; TSHEIDDDTA; SHEIDDDTAE; HEIDDDTAEL; EIDDDTAELA; IDDDTAELAL; DDDTAELALL; DDTAELALLS; DTAELALLSM; TAELALLSMH; AELALLSMHL; ELALLSMHLD; LALLSMHLDD; ALLSMHLDDE; LLSMHLDDEQ; LSMHLDDEQR; SMHLDDEQRR; MHLDDEQRRL; HLDDEQRRLE; LDDEQRRLEA; DDEQRRLEAG; DEQRRLEAGM; EQRRLEAGMK; QRRLEAGMKL; RRLEAGMKLG; RLEAGMKLGW; LEAGMKLGWH; EAGMKLGWHP; AGMKLGWHPY; GMKLGWHPYH; MKLGWHPYHF; KLGWHPYHFP; LGWHPYHFPD; GWHPYHFPDE; WHPYHFPDEP; HPYHFPDEPD; PYHFPDEPDS; YHFPDEPDSK; HFPDEPDSKQ;<br><br>11 mers:<br>MTHKRTKRQPA; THKRTKRQPAI; HKRTKRQPAIA; KRTKRQPAIAA; RTKRQPAIAAG; TKRQPAIAAGL; KRQPAIAAGLN; RQPAIAAGLNA; QPAIAAGLNAP; PAIAAGLNAPR; AIAAGLNAPRR; IAAGLNAPRRN; AAGLNAPRRNR; AGLNAPRRNRV; GLNAPRRNRVG; LNAPRRNRVGR; NAPRRNRVGRQ; APRRNRVGRQH; PRRNRVGRQHG; RRNRVGRQHGW; RNRVGRQHGWP; NRVGRQHGWPA; RVGRQHGWPAD; VGRQHGWPADV; GRQHGWPADVP; RQHGWPADVPS; QHGWPADVPSA; HGWPADVPSAE; GWPADVPSAEQ; WPADVPSAEQR; PADVPSAEQRR; ADVPSAEQRRA; DVPSAEQRRAQ; VPSAEQRRAQR; PSAEQRRAQRQ; SAEQRRAQRQR; AEQRRAQRQRD; EQRRAQRQRDL; QRRAQRQRDLE; RRAQRQRDLEA; RAQRQRDLEAI; AQRQRDLEAIR; QRQRDLEAIRR; RQRDLEAIRRA; QRDLEAIRRAY; RDLEAIRRAYA; DLEAIRRAYAE; LEAIRRAYAEM; EAIRRAYAEMV; AIRRAYAEMVA; IRRAYAEMVAT; RRAYAEMVATS; RAYAEMVATSH; AYAEMVATSHE; YAEMVATSHEI; AEMVATSHEID; EMVATSHEIDD; MVATSHEIDDD; VATSHEIDDDT; ATSHEIDDDTA; TSHEIDDDTAE; SHEIDDDTAEL; HEIDDDTAELA; | |

Fig. 28 continued

| | | |
|---|---|---|
| | EIDDDTAELAL; IDDDTAELALL; DDDTAELALLS; DDTAELALLSM; DTAELALLSMH; TAELALLSMHL; AELALLSMHLD; ELALLSMHLDD; LALLSMHLDDE; ALLSMHLDDEQ; LLSMHLDDEQR; LSMHLDDEQRR; SMHLDDEQRRL; MHLDDEQRRLE; HLDDEQRRLEA; LDDEQRRLEAG; DDEQRRLEAGM; DEQRRLEAGMK; EQRRLEAGMKL; QRRLEAGMKLG; RRLEAGMKLGW; RLEAGMKLGWH; LEAGMKLGWHP; EAGMKLGWHPY; AGMKLGWHPYH; GMKLGWHPYHF; MKLGWHPYHFP; KLGWHPYHFPD; LGWHPYHFPDE; GWHPYHFPDEP; WHPYHFPDEPD; HPYHFPDEPDS; PYHFPDEPDSK; YHFPDEPDSKQ; | |
| 45) Rv2654c | 8 mers:<br>MSGHALAA; SGHALAAR; GHALAART; HALAARTL; ALAARTLL; LAARTLLA; AARTLLAA; ARTLLAAA; RTLLAAAD; TLLAAADE; LLAAADEL; LAAADELV; AAADELVG; AADELVGG; ADELVGGP; DELVGGPP; ELVGGPPV; LVGGPPVE; VGGPPVEA; GGPPVEAS; GPPVEASA; PPVEASAA; PVEASAAA; VEASAAAL; EASAAALA; ASAAALAG; SAAALAGD; AAALAGDA; AALAGDAA; ALAGDAAG; LAGDAAGA; AGDAAGAW; GDAAGAWR; DAAGAWRT; AAGAWRTA; AGAWRTAA; GAWRTAAV; AWRTAAVE; WRTAAVEL; RTAAVELA; TAAVELAR; AAVELARA; AVELARAL; VELARALV; ELARALVR; LARALVRA; ARALVRAV; RALVRAVA; ALVRAVAE; LVRAVAES; VRAVAESH; RAVAESHG; AVAESHGV; VAESHGVA; AESHGVAA; ESHGVAAV; SHGVAAVL; HGVAAVLF; GVAAVLFA; VAAVLFAA; AAVLFAAT; AVLFAATA; VLFAATAA; LFAATAAA; FAATAAAA; AATAAAAA; ATAAAAAA; TAAAAAAV; AAAAAAVD; AAAAAVDR; AAAAVDRG; AAAVDRGD; AAVDRGDP; AVDRGDPP;<br><br>9 mers:<br>MSGHALAAR; SGHALAART; GHALAARTL; HALAARTLL; ALAARTLLA; LAARTLLAA; AARTLLAAA; ARTLLAAAD; RTLLAAADE; TLLAAADEL; LLAAADELV; LAAADELVG; AAADELVGG; AADELVGGP; ADELVGGPP; DELVGGPPV; ELVGGPPVE; LVGGPPVEA; VGGPPVEAS; GGPPVEASA; GPPVEASAA; PPVEASAAA; PVEASAAAL; VEASAAALA; EASAAALAG; ASAAALAGD; SAAALAGDA; AAALAGDAA; AALAGDAAG; ALAGDAAGA; LAGDAAGAW; AGDAAGAWR; GDAAGAWRT; DAAGAWRTA; AAGAWRTAA; AGAWRTAAV; GAWRTAAVE; AWRTAAVEL; WRTAAVELA; RTAAVELAR; TAAVELARA; AAVELARAL; AVELARALV; VELARALVR; ELARALVRA; LARALVRAV; ARALVRAVA; RALVRAVAE; ALVRAVAES; LVRAVAESH; VRAVAESHG; RAVAESHGV; AVAESHGVA; VAESHGVAA; AESHGVAAV; ESHGVAAVL; SHGVAAVLF; HGVAAVLFA; GVAAVLFAA; VAAVLFAAT; AAVLFAATA; AVLFAATAA; VLFAATAAA; LFAATAAAA; FAATAAAAA; AATAAAAAA; ATAAAAAAV; TAAAAAAVD; AAAAAAVDR; AAAAAVDRG; AAAAVDRGD; AAAVDRGDP; AAVDRGDPP;<br><br>10 mers:<br>MSGHALAART; SGHALAARTL; GHALAARTLL; HALAARTLLA; ALAARTLLAA; LAARTLLAAA; AARTLLAAAD; ARTLLAAADE; RTLLAAADEL; TLLAAADELV; LLAAADELVG; LAAADELVGG; AAADELVGGP; AADELVGGPP; ADELVGGPPV; DELVGGPPVE; ELVGGPPVEA; LVGGPPVEAS; VGGPPVEASA; GGPPVEASAA; | 33764-34053 |

Fig. 28 continued

| | | |
|---|---|---|
| | GPPVEASAAA; PPVEASAAAL; PVEASAAALA; VEASAAALAG; EASAAALAGD; ASAAALAGDA; SAAALAGDAA; AAALAGDAAG; AALAGDAAGA; ALAGDAAGAW; LAGDAAGAWR; AGDAAGAWRT; GDAAGAWRTA; DAAGAWRTAA; AAGAWRTAAV; AGAWRTAAVE; GAWRTAAVEL; AWRTAAVELA; WRTAAVELAR; RTAAVELARA; TAAVELARAL; AAVELARALV; AVELARALVR; VELARALVRA; ELARALVRAV; LARALVRAVA; ARALVRAVAE; RALVRAVAES; ALVRAVAESH; LVRAVAESHG; VRAVAESHGV; RAVAESHGVA; AVAESHGVAA; VAESHGVAAV; AESHGVAAVL; ESHGVAAVLF; SHGVAAVLFA; HGVAAVLFAA; GVAAVLFAAT; VAAVLFAATA; AAVLFAATAA; AVLFAATAAA; VLFAATAAAA; LFAATAAAAA; FAATAAAAAA; AATAAAAAAV; ATAAAAAAVD; TAAAAAAVDR; AAAAAAVDRG; AAAAAVDRGD; AAAAVDRGDP; AAAVDRGDPP;<br><br>11 mers:<br>MSGHALAARTL; SGHALAARTLL; GHALAARTLLA; HALAARTLLAA; ALAARTLLAAA; LAARTLLAAAD; AARTLLAAADE; ARTLLAAADEL; RTLLAAADELV; TLLAAADELVG; LLAAADELVGG; LAAADELVGGP; AAADELVGGPP; AADELVGGPPV; ADELVGGPPVE; DELVGGPPVEA; ELVGGPPVEAS; LVGGPPVEASA; VGGPPVEASAA; GGPPVEASAAA; GPPVEASAAAL; PPVEASAAALA; PVEASAAALAG; VEASAAALAGD; EASAAALAGDA; ASAAALAGDAA; SAAALAGDAAG; AAALAGDAAGA; AALAGDAAGAW; ALAGDAAGAWR; LAGDAAGAWRT; AGDAAGAWRTA; GDAAGAWRTAA; DAAGAWRTAAV; AAGAWRTAAVE; AGAWRTAAVEL; GAWRTAAVELA; AWRTAAVELAR; WRTAAVELARA; RTAAVELARAL; TAAVELARALV; AAVELARALVR; AVELARALVRA; VELARALVRAV; ELARALVRAVA; LARALVRAVAE; ARALVRAVAES; RALVRAVAESH; ALVRAVAESHG; LVRAVAESHGV; VRAVAESHGVA; RAVAESHGVAA; AVAESHGVAAV; VAESHGVAAVL; AESHGVAAVLF; ESHGVAAVLFA; SHGVAAVLFAA; HGVAAVLFAAT; GVAAVLFAATA; VAAVLFAATAA; AAVLFAATAAA; AVLFAATAAAA; VLFAATAAAAA; LFAATAAAAAA; FAATAAAAAAV; AATAAAAAAVD; ATAAAAAAVDR; TAAAAAAVDRG; AAAAAAVDRGD; AAAAAVDRGDP; AAAAVDRGDPP; | |
| 46) Rv2655c | 8 mers:<br>MADIPYGR; ADIPYGRD; DIPYGRDY; IPYGRDYP; PYGRDYPD; YGRDYPDP; GRDYPDPI; RDYPDPIW; DYPDPIWC; YPDPIWCD; PDPIWCDE; DPIWCDED; PIWCDEDG; IWCDEDGQ; WCDEDGQP; CDEDGQPM; DEDGQPMP; EDGQPMPP; DGQPMPPV; GQPMPPVG; QPMPPVGA; PMPPVGAE; MPPVGAEL; PPVGAELL; PVGAELLD; VGAELLDD; GAELLDDI; AELLDDIR; ELLDDIRA; LLDDIRAF; LDDIRAFL; DDIRAFLR; DIRAFLRR; IRAFLRRF; RAFLRRFV; AFLRRFVV; FLRRFVVY; LRRFVVYP; RRFVVYPS; RFVVYPSD; FVVYPSDH; VVYPSDHE; VYPSDHEL; YPSDHELI; PSDHELIA; SDHELIAH; DHELIAHT; HELIAHTL; ELIAHTLW; LIAHTLWI; IAHTLWIA; AHTLWIAH; HTLWIAHC; TLWIAHCW; LWIAHCWF; WIAHCWFM; IAHCWFME; AHCWFMEA; HCWFMEAW; CWFMEAWD; WFMEAWDS; FMEAWDST; MEAWDSTP; EAWDSTPR; AWDSTPRI; WDSTPRIA; DSTPRIAF; STPRIAFL; TPRIAFLS; PRIAFLSP; RIAFLSPE; IAFLSPEP; AFLSPEPG; FLSPEPGS; LSPEPGSG; SPEPGSGK; PEPGSGKS; EPGSGKSR; PGSGKSRA; GSGKSRAL; SGKSRALE; GKSRALEV; KSRALEVT; SRALEVTE; RALEVTEP; ALEVTEPL; LEVTEPLV; EVTEPLVP; VTEPLVPR; TEPLVPRP; EPLVPRPV; PLVPRPVH; | 34054-35919 |

Fig. 28 continued

| | | |
|---|---|---|
| | LVPRPVHA; VPRPVHAI; PRPVHAIN; RPVHAINC; PVHAINCT; VHAINCTP; HAINCTPA; AINCTPAY; INCTPAYL; NCTPAYLF; CTPAYLFR; TPAYLFRR; PAYLFRRV; AYLFRRVA; YLFRRVAD; LFRRVADP; FRRVADPV; RRVADPVG; RVADPVGR; VADPVGRP; ADPVGRPT; DPVGRPTV; PVGRPTVL; VGRPTVLY; GRPTVLYD; RPTVLYDE; PTVLYDEC; TVLYDECD; VLYDECDT; LYDECDTL; YDECDTLF; DECDTLFG; ECDTLFGP; CDTLFGPK; DTLFGPKA; TLFGPKAK; LFGPKAKE; FGPKAKEH; GPKAKEHE; PKAKEHEE; KAKEHEEI; AKEHEEIR; KEHEEIRG; EHEEIRGV; HEEIRGVI; EEIRGVIN; EIRGVINA; IRGVINAG; RGVINAGH; GVINAGHR; VINAGHRK; INAGHRKG; NAGHRKGA; AGHRKGAV; GHRKGAVA; HRKGAVAG; RKGAVAGR; KGAVAGRC; GAVAGRCV; AVAGRCVI; VAGRCVIR; AGRCVIRG; GRCVIRGK; RCVIRGKI; CVIRGKIV; VIRGKIVE; IRGKIVET; RGKIVETE; GKIVETEE; KIVETEEL; IVETEELP; VETEELPA; ETEELPAY; TEELPAYC; EELPAYCA; ELPAYCAV; LPAYCAVA; PAYCAVAL; AYCAVALA; YCAVALAG; CAVALAGL; AVALAGLD; VALAGLDD; ALAGLDDL; LAGLDDLP; AGLDDLPD; GLDDLPDT; LDDLPDTI; DDLPDTIM; DLPDTIMS; LPDTIMSR; PDTIMSRS; DTIMSRSI; TIMSRSIV; IMSRSIVV; MSRSIVVR; SRSIVVRM; RSIVVRMR; SIVVRMRR; IVVRMRRR; VVRMRRRA; VRMRRRAP; RMRRRAPT; MRRRAPTE; RRRAPTEP; RRAPTEPV; RAPTEPVE; APTEPVEP; PTEPVEPW; TEPVEPWR; EPVEPWRP; PVEPWRPR; VEPWRPRV; EPWRPRVN; PWRPRVNG; WRPRVNGP; RPRVNGPE; PRVNGPEA; RVNGPEAE; VNGPEAEK; NGPEAEKL; GPEAEKLH; PEAEKLHD; EAEKLHDR; AEKLHDRL; EKLHDRLA; KLHDRLAN; LHDRLANW; HDRLANWA; DRLANWAA; RLANWAAA; LANWAAAI; ANWAAAIN; NWAAAINP; WAAAINPL; AAAINPLE; AAINPLES; AINPLESG; INPLESGW; NPLESGWP; PLESGWPA; LESGWPAM; ESGWPAMP; SGWPAMPD; GWPAMPDG; WPAMPDGV; PAMPDGVT; AMPDGVTD; MPDGVTDR; PDGVTDRR; DGVTDRRA; GVTDRRAD; VTDRRADV; TDRRADVW; DRRADVWE; RRADVWES; RADVWESL; ADVWESLV; DVWESLVA; VWESLVAV; WESLVAVA; ESLVAVAD; SLVAVADT; LVAVADTA; VAVADTAG; AVADTAGG; VADTAGGH; ADTAGGHW; DTAGGHWP; TAGGHWPK; AGGHWPKT; GGHWPKTA; GHWPKTAR; HWPKTARA; WPKTARAT; PKTARATA; KTARATAE; TARATAET; ARATAETD; RATAETDA; ATAETDAT; TAETDATA; AETDATAN; ETDATANR; TDATANRG; DATANRGA; ATANRGAK; TANRGAKP; ANRGAKPS; NRGAKPSI; RGAKPSIG; GAKPSIGV; AKPSIGVL; KPSIGVLL; PSIGVLLL; SIGVLLLR; IGVLLLRD; GVLLLRDI; VLLLRDIR; LLLRDIRR; LLRDIRRV; LRDIRRVF; RDIRRVFS; DIRRVFSD; IRRVFSDR; RRVFSDRD; RVFSDRDR; VFSDRDRM; FSDRDRMR; SDRDRMRT; DRDRMRTS; RDRMRTSD; DRMRTSDI; RMRTSDIL; MRTSDILT; RTSDILTG; TSDILTGL; SDILTGLN; DILTGLNR; ILTGLNRM; LTGLNRME; TGLNRMEE; GLNRMEEG; LNRMEEGP; NRMEEGPW; RMEEGPWG; MEEGPWGS; EEGPWGSI; EGPWGSIR; GPWGSIRR; PWGSIRRG; WGSIRRGD; GSIRRGDP; SIRRGDPL; IRRGDPLD; RRGDPLDA; RGDPLDAR; GDPLDARG; DPLDARGL; PLDARGLA; LDARGLAT; DARGLATR; ARGLATRL; RGLATRLG; GLATRLGR; LATRLGRY; ATRLGRYG; TRLGRYGI; RLGRYGIG; LGRYGIGP; GRYGIGPK; RYGIGPKF; YGIGPKFQ; GIGPKFQH; IGPKFQHS; GPKFQHSG; PKFQHSGG; KFQHSGGE; FQHSGGEP; QHSGGEPP; HSGGEPPY; SGGEPPYK; GGEPPYKG; GEPPYKGY; EPPYKGYS; PPYKGYSR; | |

Fig. 28 continued

PYKGYSRT; YKGYSRTQ; KGYSRTQF; GYSRTQFE; YSRTQFED;
SRTQFEDA; RTQFEDAW; TQFEDAWS; QFEDAWSR; FEDAWSRY;
EDAWSRYL; DAWSRYLS; AWSRYLSA; WSRYLSAD; SRYLSADD;
RYLSADDE; YLSADDET; LSADDETP; SADDETPE; ADDETPEE;
DDETPEER; DETPEERD; ETPEERDL; TPEERDLS; PEERDLSV;
EERDLSVS; ERDLSVSA; RDLSVSAV; DLSVSAVS; LSVSAVSA;
SVSAVSAV; VSAVSAVS; SAVSAVSP; AVSAVSPP; VSAVSPPV;
SAVSPPVG; AVSPPVGD; VSPPVGDP; SPPVGDPG; PPVGDPGD;
PVGDPGDA; VGDPGDAT; GDPGDATG; DPGDATGA; PGDATGAT;
GDATGATD; DATGATDA; ATGATDAT; TGATDATD; GATDATDL;
ATDATDLP; TDATDLPE; DATDLPEA; ATDLPEAG; TDLPEAGD;
DLPEAGDL; LPEAGDLP; PEAGDLPY; EAGDLPYE; AGDLPYEP;
GDLPYEPP; DLPYEPPA; LPYEPPAP; PYEPPAPN; YEPPAPNG;
EPPAPNGH; PPAPNGHP; PAPNGHPN; APNGHPNG; PNGHPNGD;
NGHPNGDA; GHPNGDAP; HPNGDAPL; PNGDAPLC; NGDAPLCS;
GDAPLCSG; DAPLCSGP; APLCSGPG; PLCSGPGC; LCSGPGCP;
CSGPGCPN; SGPGCPNK; GPGCPNKL; PGCPNKLL; GCPNKLLS;
CPNKLLST; PNKLLSTE; NKLLSTEA; KLLSTEAK; LLSTEAKA;
LSTEAKAA; STEAKAAG; TEAKAAGK; EAKAAGKC; AKAAGKCR;
KAAGKCRP; AAGKCRPC; AGKCRPCR; GKCRPCRG; KCRPCRGR;
CRPCRGRA; RPCRGRAA; PCRGRAAA; CRGRAAAS; RGRAAASA;
GRAAASAR; RAAASARD; AAASARDG; AASARDGA; ASARDGAR 9 mers:
MADIPYGRD; ADIPYGRDY; DIPYGRDYP; IPYGRDYPD;
PYGRDYPDP; YGRDYPDPI; GRDYPDPIW; RDYPDPIWC;
DYPDPIWCD; YPDPIWCDE; PDPIWCDED; DPIWCDEDG;
PIWCDEDGQ; IWCDEDGQP; WCDEDGQPM; CDEDGQPMP;
DEDGQPMPP; EDGQPMPPV; DGQPMPPVG; GQPMPPVGA;
QPMPPVGAE; PMPPVGAEL; MPPVGAELL; PPVGAELLD;
PVGAELLDD; VGAELLDDI; GAELLDDIR; AELLDDIRA; ELLDDIRAF;
LLDDIRAFL; LDDIRAFLR; DDIRAFLRR; DIRAFLRRF; IRAFLRRFV;
RAFLRRFVV; AFLRRFVVY; FLRRFVVYP; LRRFVVYPS;
RRFVVYPSD; RFVVYPSDH; FVVYPSDHE; VVYPSDHEL;
VYPSDHELI; YPSDHELIA; PSDHELIAH; SDHELIAHT; DHELIAHTL;
HELIAHTLW; ELIAHTLWI; LIAHTLWIA; IAHTLWIAH; AHTLWIAHC;
HTLWIAHCW; TLWIAHCWF; LWIAHCWFM; WIAHCWFME;
IAHCWFMEA; AHCWFMEAW; HCWFMEAWD; CWFMEAWDS;
WFMEAWDST; FMEAWDSTP; MEAWDSTPR; EAWDSTPRI;
AWDSTPRIA; WDSTPRIAF; DSTPRIAFL; STPRIAFLS; TPRIAFLSP;
PRIAFLSPE; RIAFLSPEP; IAFLSPEPG; AFLSPEPGS; FLSPEPGSG;
LSPEPGSGK; SPEPGSGKS; PEPGSGKSR; EPGSGKSRA;
PGSGKSRAL; GSGKSRALE; SGKSRALEV; GKSRALEVT;
KSRALEVTE; SRALEVTEP; RALEVTEPL; ALEVTEPLV; LEVTEPLVP;
EVTEPLVPR; VTEPLVPRP; TEPLVPRPV; EPLVPRPVH; PLVPRPVHA;
LVPRPVHAI; VPRPVHAIN; PRPVHAINC; RPVHAINCT; PVHAINCTP;
VHAINCTPA; HAINCTPAY; AINCTPAYL; INCTPAYLF; NCTPAYLFR;
CTPAYLFRR; TPAYLFRRV; PAYLFRRVA; AYLFRRVAD;
YLFRRVADP; LFRRVADPV; FRRVADPVG; RRVADPVGR;
RVADPVGRP; VADPVGRPT; ADPVGRPTV; DPVGRPTVL;
PVGRPTVLY; VGRPTVLYD; GRPTVLYDE; RPTVLYDEC;
PTVLYDECD; TVLYDECDT; VLYDECDTL; LYDECDTLF;
YDECDTLFG; DECDTLFGP; ECDTLFGPK; CDTLFGPKA;

Fig. 28 continued

| | | |
|---|---|---|
| | DTLFGPKAK; TLFGPKAKE; LFGPKAKEH; FGPKAKEHE; GPKAKEHEE; PKAKEHEEI; KAKEHEEIR; AKEHEEIRG; KEHEEIRGV; EHEEIRGVI; HEEIRGVIN; EEIRGVINA; EIRGVINAG; IRGVINAGH; RGVINAGHR; GVINAGHRK; VINAGHRKG; INAGHRKGA; NAGHRKGAV; AGHRKGAVA; GHRKGAVAG; HRKGAVAGR; RKGAVAGRC; KGAVAGRCV; GAVAGRCVI; AVAGRCVIR; VAGRCVIRG; AGRCVIRGK; GRCVIRGKI; RCVIRGKIV; CVIRGKIVE; VIRGKIVET; IRGKIVETE; RGKIVETEE; GKIVETEEL; KIVETEELP; IVETEELPA; VETEELPAY; ETEELPAYC; TEELPAYCA; EELPAYCAV; ELPAYCAVA; LPAYCAVAL; PAYCAVALA; AYCAVALAG; YCAVALAGL; CAVALAGLD; AVALAGLDD; VALAGLDDL; ALAGLDDLP; LAGLDDLPD; AGLDDLPDT; GLDDLPDTI; LDDLPDTIM; DDLPDTIMS; DLPDTIMSR; LPDTIMSRS; PDTIMSRSI; DTIMSRSIV; TIMSRSIVV; IMSRSIVVR; MSRSIVVRM; SRSIVVRMR; RSIVVRMRR; SIVVRMRRR; IVVRMRRRA; VVRMRRRAP; VRMRRRAPT; RMRRRAPTE; MRRRAPTEP; RRRAPTEPV; RRAPTEPVE; RAPTEPVEP; APTEPVEPW; PTEPVEPWR; TEPVEPWRP; EPVEPWRPR; PVEPWRPRV; VEPWRPRVN; EPWRPRVNG; PWRPRVNGP; WRPRVNGPE; RPRVNGPEA; PRVNGPEAE; RVNGPEAEK; VNGPEAEKL; NGPEAEKLH; GPEAEKLHD; PEAEKLHDR; EAEKLHDRL; AEKLHDRLA; EKLHDRLAN; KLHDRLANW; LHDRLANWA; HDRLANWAA; DRLANWAAA; RLANWAAAI; LANWAAAIN; ANWAAAINP; NWAAAINPL; WAAAINPLE; AAAINPLES; AAINPLESG; AINPLESGW; INPLESGWP; NPLESGWPA; PLESGWPAM; LESGWPAMP; ESGWPAMPD; SGWPAMPDG; GWPAMPDGV; WPAMPDGVT; PAMPDGVTD; AMPDGVTDR; MPDGVTDRR; PDGVTDRRA; DGVTDRRAD; GVTDRRADV; VTDRRADVW; TDRRADVWE; DRRADVWES; RRADVWESL; RADVWESLV; ADVWESLVA; DVWESLVAV; VWESLVAVA; WESLVAVAD; ESLVAVADT; SLVAVADTA; LVAVADTAG; VAVADTAGG; AVADTAGGH; VADTAGGHW; ADTAGGHWP; DTAGGHWPK; TAGGHWPKT; AGGHWPKTA; GGHWPKTAR; GHWPKTARA; HWPKTARAT; WPKTARATA; PKTARATAE; KTARATAET; TARATAETD; ARATAETDA; RATAETDAT; ATAETDATA; TAETDATAN; AETDATANR; ETDATANRG; TDATANRGA; DATANRGAK; ATANRGAKP; TANRGAKPS; ANRGAKPSI; NRGAKPSIG; RGAKPSIGV; GAKPSIGVL; AKPSIGVLL; KPSIGVLLL; PSIGVLLLR; SIGVLLLRD; IGVLLLRDI; GVLLLRDIR; VLLLRDIRR; LLLRDIRRV; LLRDIRRVF; LRDIRRVFS; RDIRRVFSD; DIRRVFSDR; IRRVFSDRD; RRVFSDRDR; RVFSDRDRM; VFSDRDRMR; FSDRDRMRT; SDRDRMRTS; DRDRMRTSD; RDRMRTSDI; DRMRTSDIL; RMRTSDILT; MRTSDILTG; RTSDILTGL; TSDILTGLN; SDILTGLNR; DILTGLNRM; ILTGLNRME; LTGLNRMEE; TGLNRMEEG; GLNRMEEGP; LNRMEEGPW; NRMEEGPWG; RMEEGPWGS; MEEGPWGSI; EEGPWGSIR; EGPWGSIRR; GPWGSIRRG; PWGSIRRGD; WGSIRRGDP; GSIRRGDPL; SIRRGDPLD; IRRGDPLDA; RRGDPLDAR; RGDPLDARG; GDPLDARGL; DPLDARGLA; PLDARGLAT; LDARGLATR; DARGLATRL; ARGLATRLG; RGLATRLGR; GLATRLGRY; LATRLGRYG; ATRLGRYGI; TRLGRYGIG; RLGRYGIGP; LGRYGIGPK; GRYGIGPKF; RYGIGPKFQ; YGIGPKFQH; GIGPKFQHS; IGPKFQHSG; GPKFQHSGG; PKFQHSGGE; KFQHSGGEP; FQHSGGEPP; QHSGGEPPY; HSGGEPPYK; SGGEPPYKG; GGEPPYKGY; | |

Fig. 28 continued

| | | | |
|---|---|---|---|
| | GEPPYKGYS; EPPYKGYSR; PPYKGYSRT; PYKGYSRTQ; YKGYSRTQF; KGYSRTQFE; GYSRTQFED; YSRTQFEDA; SRTQFEDAW; RTQFEDAWS; TQFEDAWSR; QFEDAWSRY; FEDAWSRYL; EDAWSRYLS; DAWSRYLSA; AWSRYLSAD; WSRYLSADD; SRYLSADDE; RYLSADDET; YLSADDETP; LSADDETPE; SADDETPEE; ADDETPEER; DDETPEERD; DETPEERDL; ETPEERDLS; TPEERDLSV; PEERDLSVS; EERDLSVSA; ERDLSVSAV; RDLSVSAVS; DLSVSAVSA; LSVSAVSAV; SVSAVSAVS; VSAVSAVSP; SAVSAVSPP; AVSAVSPPV; VSAVSPPVG; SAVSPPVGD; AVSPPVGDP; VSPPVGDPG; SPPVGDPGD; PPVGDPGDA; PVGDPGDAT; VGDPGDATG; GDPGDATGA; DPGDATGAT; PGDATGATD; GDATGATDA; DATGATDAT; ATGATDATD; TGATDATDL; GATDATDLP; ATDATDLPE; TDATDLPEA; DATDLPEAG; ATDLPEAGD; TDLPEAGDL; DLPEAGDLP; LPEAGDLPY; PEAGDLPYE; EAGDLPYEP; AGDLPYEPP; GDLPYEPPA; DLPYEPPAP; LPYEPPAPN; PYEPPAPNG; YEPPAPNGH; EPPAPNGHP; PPAPNGHPN; PAPNGHPNG; APNGHPNGD; PNGHPNGDA; NGHPNGDAP; GHPNGDAPL; HPNGDAPLC; PNGDAPLCS; NGDAPLCSG; GDAPLCSGP; DAPLCSGPG; APLCSGPGC; PLCSGPGCP; LCSGPGCPN; CSGPGCPNK; SGPGCPNKL; GPGCPNKLL; PGCPNKLLS; GCPNKLLST; CPNKLLSTE; PNKLLSTEA; NKLLSTEAK; KLLSTEAKA; LLSTEAKAA; LSTEAKAAG; STEAKAAGK; TEAKAAGKC; EAKAAGKCR; AKAAGKCRP; KAAGKCRPC; AAGKCRPCR; AGKCRPCRG; GKCRPCRGR; KCRPCRGRA; CRPCRGRAA; RPCRGRAAA; PCRGRAAAS; CRGRAAASA; RGRAAASAR; GRAAASARD; RAAASARDG; AAASARDGA; AASARDGAR<br><br>10 mers:<br>MADIPYGRDY; ADIPYGRDYP; DIPYGRDYPD; IPYGRDYPDP; PYGRDYPDPI; YGRDYPDPIW; GRDYPDPIWC; RDYPDPIWCD; DYPDPIWCDE; YPDPIWCDED; PDPIWCDEDG; DPIWCDEDGQ; PIWCDEDGQP; IWCDEDGQPM; WCDEDGQPMP; CDEDGQPMPP; DEDGQPMPPV; EDGQPMPPVG; DGQPMPPVGA; GQPMPPVGAE; QPMPPVGAEL; PMPPVGAELL; MPPVGAELLD; PPVGAELLDD; PVGAELLDDI; VGAELLDDIR; GAELLDDIRA; AELLDDIRAF; ELLDDIRAFL; LLDDIRAFLR; LDDIRAFLRR; DDIRAFLRRF; DIRAFLRRFV; IRAFLRRFVV; RAFLRRFVVY; AFLRRFVVYP; FLRRFVVYPS; LRRFVVYPSD; RRFVVYPSDH; RFVVYPSDHE; FVVYPSDHEL; VVYPSDHELI; VYPSDHELIA; YPSDHELIAH; PSDHELIAHT; SDHELIAHTL; DHELIAHTLW; HELIAHTLWI; ELIAHTLWIA; LIAHTLWIAH; IAHTLWIAHC; AHTLWIAHCW; HTLWIAHCWF; TLWIAHCWFM; LWIAHCWFME; WIAHCWFMEA; IAHCWFMEAW; AHCWFMEAWD; HCWFMEAWDS; CWFMEAWDST; WFMEAWDSTP; FMEAWDSTPR; MEAWDSTPRI; EAWDSTPRIA; AWDSTPRIAF; WDSTPRIAFL; DSTPRIAFLS; STPRIAFLSP; TPRIAFLSPE; PRIAFLSPEP; RIAFLSPEPG; IAFLSPEPGS; AFLSPEPGSG; FLSPEPGSGK; LSPEPGSGKS; SPEPGSGKSR; PEPGSGKSRA; EPGSGKSRAL; PGSGKSRALE; GSGKSRALEV; SGKSRALEVT; GKSRALEVTE; KSRALEVTEP; SRALEVTEPL; RALEVTEPLV; ALEVTEPLVP; LEVTEPLVPR; EVTEPLVPRP; VTEPLVPRPV; TEPLVPRPVH; EPLVPRPVHA; PLVPRPVHAI; | |

Fig. 28 continued

| | | |
|---|---|---|
| | LVPRPVHAIN; VPRPVHAINC; PRPVHAINCT; RPVHAINCTP; PVHAINCTPA; VHAINCTPAY; HAINCTPAYL; AINCTPAYLF; INCTPAYLFR; NCTPAYLFRR; CTPAYLFRRV; TPAYLFRRVA; PAYLFRRVAD; AYLFRRVADP; YLFRRVADPV; LFRRVADPVG; FRRVADPVGR; RRVADPVGRP; RVADPVGRPT; VADPVGRPTV; ADPVGRPTVL; DPVGRPTVLY; PVGRPTVLYD; VGRPTVLYDE; GRPTVLYDEC; RPTVLYDECD; PTVLYDECDT; TVLYDECDTL; VLYDECDTLF; LYDECDTLFG; YDECDTLFGP; DECDTLFGPK; ECDTLFGPKA; CDTLFGPKAK; DTLFGPKAKE; TLFGPKAKEH; LFGPKAKEHE; FGPKAKEHEE; GPKAKEHEEI; PKAKEHEEIR; KAKEHEEIRG; AKEHEEIRGV; KEHEEIRGVI; EHEEIRGVIN; HEEIRGVINA; EEIRGVINAG; EIRGVINAGH; IRGVINAGHR; RGVINAGHRK; GVINAGHRKG; VINAGHRKGA; INAGHRKGAV; NAGHRKGAVA; AGHRKGAVAG; GHRKGAVAGR; HRKGAVAGRC; RKGAVAGRCV; KGAVAGRCVI; GAVAGRCVIR; AVAGRCVIRG; VAGRCVIRGK; AGRCVIRGKI; GRCVIRGKIV; RCVIRGKIVE; CVIRGKIVET; VIRGKIVETE; IRGKIVETEE; RGKIVETEEL; GKIVETEELP; KIVETEELPA; IVETEELPAY; VETEELPAYC; ETEELPAYCA; TEELPAYCAV; EELPAYCAVA; ELPAYCAVAL; LPAYCAVALA; PAYCAVALAG; AYCAVALAGL; YCAVALAGLD; CAVALAGLDD; AVALAGLDDL; VALAGLDDLP; ALAGLDDLPD; LAGLDDLPDT; AGLDDLPDTI; GLDDLPDTIM; LDDLPDTIMS; DDLPDTIMSR; DLPDTIMSRS; LPDTIMSRSI; PDTIMSRSIV; DTIMSRSIVV; TIMSRSIVVR; IMSRSIVVRM; MSRSIVVRMR; SRSIVVRMRR; RSIVVRMRRR; SIVVRMRRRA; IVVRMRRRAP; VVRMRRRAPT; VRMRRRAPTE; RMRRRAPTEP; MRRRAPTEPV; RRRAPTEPVE; RRAPTEPVEP; RAPTEPVEPW; APTEPVEPWR; PTEPVEPWRP; TEPVEPWRPR; EPVEPWRPRV; PVEPWRPRVN; VEPWRPRVNG; EPWRPRVNGP; PWRPRVNGPE; WRPRVNGPEA; RPRVNGPEAE; PRVNGPEAEK; RVNGPEAEKL; VNGPEAEKLH; NGPEAEKLHD; GPEAEKLHDR; PEAEKLHDRL; EAEKLHDRLA; AEKLHDRLAN; EKLHDRLANW; KLHDRLANWA; LHDRLANWAA; HDRLANWAAA; DRLANWAAAI; RLANWAAAIN; LANWAAAINP; ANWAAAINPL; NWAAAINPLE; WAAAINPLES; AAAINPLESG; AAINPLESGW; AINPLESGWP; INPLESGWPA; NPLESGWPAM; PLESGWPAMP; LESGWPAMPD; ESGWPAMPDG; SGWPAMPDGV; GWPAMPDGVT; WPAMPDGVTD; PAMPDGVTDR; AMPDGVTDRR; MPDGVTDRRA; PDGVTDRRAD; DGVTDRRADV; GVTDRRADVW; VTDRRADVWE; TDRRADVWES; DRRADVWESL; RRADVWESLV; RADVWESLVA; ADVWESLVAV; DVWESLVAVA; VWESLVAVAD; WESLVAVADT; ESLVAVADTA; SLVAVADTAG; LVAVADTAGG; VAVADTAGGH; AVADTAGGHW; VADTAGGHWP; ADTAGGHWPK; DTAGGHWPKT; TAGGHWPKTA; AGGHWPKTAR; GGHWPKTARA; GHWPKTARAT; HWPKTARATA; WPKTARATAE; PKTARATAET; KTARATAETD; TARATAETDA; ARATAETDAT; RATAETDATA; ATAETDATAN; TAETDATANR; AETDATANRG; ETDATANRGA; TDATANRGAK; DATANRGAKP; ATANRGAKPS; TANRGAKPSI; ANRGAKPSIG; NRGAKPSIGV; RGAKPSIGVL; GAKPSIGVLL; AKPSIGVLLL; KPSIGVLLLR; PSIGVLLLRD; SIGVLLLRDI; IGVLLLRDIR; GVLLLRDIRR; VLLLRDIRRV; LLLRDIRRVF; LLRDIRRVFS; LRDIRRVFSD; RDIRRVFSDR; DIRRVFSDRD; IRRVFSDRDR; RRVFSDRDRM; RVFSDRDRMR; VFSDRDRMRT; FSDRDRMRTS; SDRDRMRTSD; DRDRMRTSDI; RDRMRTSDIL; | |

Fig. 28 continued

| | | |
|---|---|---|
| | DRMRTSDILT; RMRTSDILTG; MRTSDILTGL; RTSDILTGLN; TSDILTGLNR; SDILTGLNRM; DILTGLNRME; ILTGLNRMEE; LTGLNRMEEG; TGLNRMEEGP; GLNRMEEGPW; LNRMEEGPWG; NRMEEGPWGS; RMEEGPWGSI; MEEGPWGSIR; EEGPWGSIRR; EGPWGSIRRG; GPWGSIRRGD; PWGSIRRGDP; WGSIRRGDPL; GSIRRGDPLD; SIRRGDPLDA; IRRGDPLDAR; RRGDPLDARG; RGDPLDARGL; GDPLDARGLA; DPLDARGLAT; PLDARGLATR; LDARGLATRL; DARGLATRLG; ARGLATRLGR; RGLATRLGRY; GLATRLGRYG; LATRLGRYGI; ATRLGRYGIG; TRLGRYGIGP; RLGRYGIGPK; LGRYGIGPKF; GRYGIGPKFQ; RYGIGPKFQH; YGIGPKFQHS; GIGPKFQHSG; IGPKFQHSGG; GPKFQHSGGE; PKFQHSGGEP; KFQHSGGEPP; FQHSGGEPPY; QHSGGEPPYK; HSGGEPPYKG; SGGEPPYKGY; GGEPPYKGYS; GEPPYKGYSR; EPPYKGYSRT; PPYKGYSRTQ; PYKGYSRTQF; YKGYSRTQFE; KGYSRTQFED; GYSRTQFEDA; YSRTQFEDAW; SRTQFEDAWS; RTQFEDAWSR; TQFEDAWSRY; QFEDAWSRYL; FEDAWSRYLS; EDAWSRYLSA; DAWSRYLSAD; AWSRYLSADD; WSRYLSADDE; SRYLSADDET; RYLSADDETP; YLSADDETPE; LSADDETPEE; SADDETPEER; ADDETPEERD; DDETPEERDL; DETPEERDLS; ETPEERDLSV; TPEERDLSVS; PEERDLSVSA; EERDLSVSAV; ERDLSVSAVS; RDLSVSAVSA; DLSVSAVSAV; LSVSAVSAVS; SVSAVSAVSP; VSAVSAVSPP; SAVSAVSPPV; AVSAVSPPVG; VSAVSPPVGD; SAVSPPVGDP; AVSPPVGDPG; VSPPVGDPGD; SPPVGDPGDA; PPVGDPGDAT; PVGDPGDATG; VGDPGDATGA; GDPGDATGAT; DPGDATGATD; PGDATGATDA; GDATGATDAT; DATGATDATD; ATGATDATDL; TGATDATDLP; GATDATDLPE; ATDATDLPEA; TDATDLPEAG; DATDLPEAGD; ATDLPEAGDL; TDLPEAGDLP; DLPEAGDLPY; LPEAGDLPYE; PEAGDLPYEP; EAGDLPYEPP; AGDLPYEPPA; GDLPYEPPAP; DLPYEPPAPN; LPYEPPAPNG; PYEPPAPNGH; YEPPAPNGHP; EPPAPNGHPN; PPAPNGHPNG; PAPNGHPNGD; APNGHPNGDA; PNGHPNGDAP; NGHPNGDAPL; GHPNGDAPLC; HPNGDAPLCS; PNGDAPLCSG; NGDAPLCSGP; GDAPLCSGPG; DAPLCSGPGC; APLCSGPGCP; PLCSGPGCPN; LCSGPGCPNK; CSGPGCPNKL; SGPGCPNKLL; GPGCPNKLLS; PGCPNKLLST; GCPNKLLSTE; CPNKLLSTEA; PNKLLSTEAK; NKLLSTEAKA; KLLSTEAKAA; LLSTEAKAAG; LSTEAKAAGK; STEAKAAGKC; TEAKAAGKCR; EAKAAGKCRP; AKAAGKCRPC; KAAGKCRPCR; AAGKCRPCRG; AGKCRPCRGR; GKCRPCRGRA; KCRPCRGRAA; CRPCRGRAAA; RPCRGRAAAS; PCRGRAAASA; CRGRAAASAR; RGRAAASARD; GRAAASARDG; RAAASARDGA; AAASARDGAR<br><br>11 mers:<br>MADIPYGRDYP; ADIPYGRDYPD; DIPYGRDYPDP; IPYGRDYPDPI; PYGRDYPDPIW; YGRDYPDPIWC; GRDYPDPIWCD; RDYPDPIWCDE; DYPDPIWCDED; YPDPIWCDEDG; PDPIWCDEDGQ; DPIWCDEDGQP; PIWCDEDGQPM; IWCDEDGQPMP; WCDEDGQPMPP; CDEDGQPMPPV; DEDGQPMPPVG; EDGQPMPPVGA; DGQPMPPVGAE; GQPMPPVGAEL; QPMPPVGAELL; PMPPVGAELLD; MPPVGAELLDD; PPVGAELLDDI; PVGAELLDDIR; VGAELLDDIRA; GAELLDDIRAF; AELLDDIRAFL; ELLDDIRAFLR; LLDDIRAFLRR; LDDIRAFLRRF; DDIRAFLRRFV; DIRAFLRRFVV; IRAFLRRFVVY; RAFLRRFVVYP; AFLRRFVVYPS; | |

Fig. 28 continued

| | | |
|---|---|---|
| | FLRRFVVYPSD; LRRFVVYPSDH; RRFVVYPSDHE; RFVVYPSDHEL; FVVYPSDHELI; VVYPSDHELIA; VYPSDHELIAH; YPSDHELIAHT; PSDHELIAHTL; SDHELIAHTLW; DHELIAHTLWI; HELIAHTLWIA; ELIAHTLWIAH; LIAHTLWIAHC; IAHTLWIAHCW; AHTLWIAHCWF; HTLWIAHCWFM; TLWIAHCWFME; LWIAHCWFMEA; WIAHCWFMEAW; IAHCWFMEAWD; AHCWFMEAWDS; HCWFMEAWDST; CWFMEAWDSTP; WFMEAWDSTPR; FMEAWDSTPRI; MEAWDSTPRIA; EAWDSTPRIAF; AWDSTPRIAFL; WDSTPRIAFLS; DSTPRIAFLSP; STPRIAFLSPE; TPRIAFLSPEP; PRIAFLSPEPG; RIAFLSPEPGS; IAFLSPEPGSG; AFLSPEPGSGK; FLSPEPGSGKS; LSPEPGSGKSR; SPEPGSGKSRA; PEPGSGKSRAL; EPGSGKSRALE; PGSGKSRALEV; GSGKSRALEVT; SGKSRALEVTE; GKSRALEVTEP; KSRALEVTEPL; SRALEVTEPLV; RALEVTEPLVP; ALEVTEPLVPR; LEVTEPLVPRP; EVTEPLVPRPV; VTEPLVPRPVH; TEPLVPRPVHA; EPLVPRPVHAI; PLVPRPVHAIN; LVPRPVHAINC; VPRPVHAINCT; PRPVHAINCTP; RPVHAINCTPA; PVHAINCTPAY; VHAINCTPAYL; HAINCTPAYLF; AINCTPAYLFR; INCTPAYLFRR; NCTPAYLFRRV; CTPAYLFRRVA; TPAYLFRRVAD; PAYLFRRVADP; AYLFRRVADPV; YLFRRVADPVG; LFRRVADPVGR; FRRVADPVGRP; RRVADPVGRPT; RVADPVGRPTV; VADPVGRPTVL; ADPVGRPTVLY; DPVGRPTVLYD; PVGRPTVLYDE; VGRPTVLYDEC; GRPTVLYDECD; RPTVLYDECDT; PTVLYDECDTL; TVLYDECDTLF; VLYDECDTLFG; LYDECDTLFGP; YDECDTLFGPK; DECDTLFGPKA; ECDTLFGPKAK; CDTLFGPKAKE; DTLFGPKAKEH; TLFGPKAKEHE; LFGPKAKEHEE; FGPKAKEHEEI; GPKAKEHEEIR; PKAKEHEEIRG; KAKEHEEIRGV; AKEHEEIRGVI; KEHEEIRGVIN; EHEEIRGVINA; HEEIRGVINAG; EEIRGVINAGH; EIRGVINAGHR; IRGVINAGHRK; RGVINAGHRKG; GVINAGHRKGA; VINAGHRKGAV; INAGHRKGAVA; NAGHRKGAVAG; AGHRKGAVAGR; GHRKGAVAGRC; HRKGAVAGRCV; RKGAVAGRCVI; KGAVAGRCVIR; GAVAGRCVIRG; AVAGRCVIRGK; VAGRCVIRGKI; AGRCVIRGKIV; GRCVIRGKIVE; RCVIRGKIVET; CVIRGKIVETE; VIRGKIVETEE; IRGKIVETEEL; RGKIVETEELP; GKIVETEELPA; KIVETEELPAY; IVETEELPAYC; VETEELPAYCA; ETEELPAYCAV; TEELPAYCAVA; EELPAYCAVAL; ELPAYCAVALA; LPAYCAVALAG; PAYCAVALAGL; AYCAVALAGLD; YCAVALAGLDD; CAVALAGLDDL; AVALAGLDDLP; VALAGLDDLPD; ALAGLDDLPDT; LAGLDDLPDTI; AGLDDLPDTIM; GLDDLPDTIMS; LDDLPDTIMSR; DDLPDTIMSRS; DLPDTIMSRSI; LPDTIMSRSIV; PDTIMSRSIVV; DTIMSRSIVVR; TIMSRSIVVRM; IMSRSIVVRMR; MSRSIVVRMRR; SRSIVVRMRRR; RSIVVRMRRRA; SIVVRMRRRAP; IVVRMRRRAPT; VVRMRRRAPTE; VRMRRRAPTEP; RMRRRAPTEPV; MRRRAPTEPVE; RRRAPTEPVEP; RRAPTEPVEPW; RAPTEPVEPWR; APTEPVEPWRP; PTEPVEPWRPR; TEPVEPWRPRV; EPVEPWRPRVN; PVEPWRPRVNG; VEPWRPRVNGP; EPWRPRVNGPE; PWRPRVNGPEA; WRPRVNGPEAE; RPRVNGPEAEK; PRVNGPEAEKL; RVNGPEAEKLH; VNGPEAEKLHD; NGPEAEKLHDR; GPEAEKLHDRL; PEAEKLHDRLA; EAEKLHDRLAN; AEKLHDRLANW; EKLHDRLANWA; KLHDRLANWAA; LHDRLANWAAA; HDRLANWAAAI; DRLANWAAAIN; RLANWAAAINP; LANWAAAINPL; ANWAAAINPLE; NWAAAINPLES; WAAAINPLESG; AAAINPLESGW; AAINPLESGWP; AINPLESGWPA; INPLESGWPAM; NPLESGWPAMP; PLESGWPAMPD; LESGWPAMPDG; ESGWPAMPDGV; SGWPAMPDGVT; | |

Fig. 28 continued

| | | | |
|---|---|---|---|
| | GWPAMPDGVTD; WPAMPDGVTDR; PAMPDGVTDRR; AMPDGVTDRRA; MPDGVTDRRAD; PDGVTDRRADV; DGVTDRRADVW; GVTDRRADVWE; VTDRRADVWES; TDRRADVWESL; DRRADVWESLV; RRADVWESLVA; RADVWESLVAV; ADVWESLVAVA; DVWESLVAVAD; VWESLVAVADT; WESLVAVADTA; ESLVAVADTAG; SLVAVADTAGG; LVAVADTAGGH; VAVADTAGGHW; AVADTAGGHWP; VADTAGGHWPK; ADTAGGHWPKT; DTAGGHWPKTA; TAGGHWPKTAR; AGGHWPKTARA; GGHWPKTARAT; GHWPKTARATA; HWPKTARATAE; WPKTARATAET; PKTARATAETD; KTARATAETDA; TARATAETDAT; ARATAETDATA; RATAETDATAN; ATAETDATANR; TAETDATANRG; AETDATANRGA; ETDATANRGAK; TDATANRGAKP; DATANRGAKPS; ATANRGAKPSI; TANRGAKPSIG; ANRGAKPSIGV; NRGAKPSIGVL; RGAKPSIGVLL; GAKPSIGVLLL; AKPSIGVLLLR; KPSIGVLLLRD; PSIGVLLLRDI; SIGVLLLRDIR; IGVLLLRDIRR; GVLLLRDIRRV; VLLLRDIRRVF; LLLRDIRRVFS; LLRDIRRVFSD; LRDIRRVFSDR; RDIRRVFSDRD; DIRRVFSDRDR; IRRVFSDRDRM; RRVFSDRDRMR; RVFSDRDRMRT; VFSDRDRMRTS; FSDRDRMRTSD; SDRDRMRTSDI; DRDRMRTSDIL; RDRMRTSDILT; DRMRTSDILTG; RMRTSDILTGL; MRTSDILTGLN; RTSDILTGLNR; TSDILTGLNRM; SDILTGLNRME; DILTGLNRMEE; ILTGLNRMEEG; LTGLNRMEEGP; TGLNRMEEGPW; GLNRMEEGPWG; LNRMEEGPWGS; NRMEEGPWGSI; RMEEGPWGSIR; MEEGPWGSIRR; EEGPWGSIRRG; EGPWGSIRRGD; GPWGSIRRGDP; PWGSIRRGDPL; WGSIRRGDPLD; GSIRRGDPLDA; SIRRGDPLDAR; IRRGDPLDARG; RRGDPLDARGL; RGDPLDARGLA; GDPLDARGLAT; DPLDARGLATR; PLDARGLATRL; LDARGLATRLG; DARGLATRLGR; ARGLATRLGRY; RGLATRLGRYG; GLATRLGRYGI; LATRLGRYGIG; ATRLGRYGIGP; TRLGRYGIGPK; RLGRYGIGPKF; LGRYGIGPKFQ; GRYGIGPKFQH; RYGIGPKFQHS; YGIGPKFQHSG; GIGPKFQHSGG; IGPKFQHSGGE; GPKFQHSGGEP; PKFQHSGGEPP; KFQHSGGEPPY; FQHSGGEPPYK; QHSGGEPPYKG; HSGGEPPYKGY; SGGEPPYKGYS; GGEPPYKGYSR; GEPPYKGYSRT; EPPYKGYSRTQ; PPYKGYSRTQF; PYKGYSRTQFE; YKGYSRTQFED; KGYSRTQFEDA; GYSRTQFEDAW; YSRTQFEDAWS; SRTQFEDAWSR; RTQFEDAWSRY; TQFEDAWSRYL; QFEDAWSRYLS; FEDAWSRYLSA; EDAWSRYLSAD; DAWSRYLSADD; AWSRYLSADDE; WSRYLSADDET; SRYLSADDETP; RYLSADDETPE; YLSADDETPEE; LSADDETPEER; SADDETPEERD; ADDETPEERDL; DDETPEERDLS; DETPEERDLSV; ETPEERDLSVS; TPEERDLSVSA; PEERDLSVSAV; EERDLSVSAVS; ERDLSVSAVSA; RDLSVSAVSAV; DLSVSAVSAVS; LSVSAVSAVSP; SVSAVSAVSPP; VSAVSAVSPPV; SAVSAVSPPVG; AVSAVSPPVGD; VSAVSPPVGDP; SAVSPPVGDPG; AVSPPVGDPGD; VSPPVGDPGDA; SPPVGDPGDAT; PPVGDPGDATG; PVGDPGDATGA; VGDPGDATGAT; GDPGDATGATD; DPGDATGATDA; PGDATGATDAT; GDATGATDATD; DATGATDATDL; ATGATDATDLP; TGATDATDLPE; GATDATDLPEA; ATDATDLPEAG; TDATDLPEAGD; DATDLPEAGDL; ATDLPEAGDLP; TDLPEAGDLPY; DLPEAGDLPYE; LPEAGDLPYEP; PEAGDLPYEPP; EAGDLPYEPPA; AGDLPYEPPAP; GDLPYEPPAPN; DLPYEPPAPNG; LPYEPPAPNGH; PYEPPAPNGHP; YEPPAPNGHPN; EPPAPNGHPNG; | |

Fig. 28 continued

| | | |
|---|---|---|
| | PPAPNGHPNGD; PAPNGHPNGDA; APNGHPNGDAP; PNGHPNGDAPL; NGHPNGDAPLC; GHPNGDAPLCS; HPNGDAPLCSG; PNGDAPLCSGP; NGDAPLCSGPG; GDAPLCSGPGC; DAPLCSGPGCP; APLCSGPGCPN; PLCSGPGCPNK; LCSGPGCPNKL; CSGPGCPNKLL; SGPGCPNKLLS; GPGCPNKLLST; PGCPNKLLSTE; GCPNKLLSTEA; CPNKLLSTEAK; PNKLLSTEAKA; NKLLSTEAKAA; KLLSTEAKAAG; LLSTEAKAAGK; LSTEAKAAGKC; STEAKAAGKCR; TEAKAAGKCRP; EAKAAGKCRPC; AKAAGKCRPCR; KAAGKCRPCRG; AAGKCRPCRGR; AGKCRPCRGRA; GKCRPCRGRAA; KCRPCRGRAAA; CRPCRGRAAAS; RPCRGRAAASA; PCRGRAAASAR; CRGRAAASARD; RGRAAASARDG; GRAAASARDGA; RAAASARDGAR | |
| 47) Rv2656c | 8 mers:<br>MTAVGGSP; TAVGGSPP; AVGGSPPT; VGGSPPTR; GGSPPTRR; GSPPTRRC; SPPTRRCP; PPTRRCPA; PTRRCPAT; TRRCPATE; RRCPATED; RCPATEDR; CPATEDRA; PATEDRAP; ATEDRAPA; TEDRAPAT; EDRAPATV; DRAPATVA; RAPATVAT; APATVATP; PATVATPS; ATVATPSS; TVATPSST; VATPSSTD; ATPSSTDP; TPSSTDPT; PSSTDPTA; SSTDPTAS; STDPTASR; TDPTASRA; DPTASRAV; PTASRAVS; TASRAVSW; ASRAVSWW; SRAVSWWS; RAVSWWSV; AVSWWSVH; VSWWSVHE; SWWSVHEY; WWSVHEYV; WSVHEYVA; SVHEYVAP; VHEYVAPT; HEYVAPTL; EYVAPTLA; YVAPTLAA; VAPTLAAA; APTLAAAV; PTLAAAVE; TLAAAVEW; LAAAVEWP; AAAVEWPM; AAVEWPMA; AVEWPMAG; VEWPMAGT; EWPMAGTP; WPMAGTPA; PMAGTPAW; MAGTPAWC; AGTPAWCD; GTPAWCDL; TPAWCDLD; PAWCDLDD; AWCDLDDT; WCDLDDTD; CDLDDTDP; DLDDTDPV; LDDTDPVK; DDTDPVKW; DTDPVKWA; TDPVKWAA; DPVKWAAI; PVKWAAIC; VKWAAICD; KWAAICDA; WAAICDAA; AAICDAAR; AICDAARH; ICDAARHW; CDAARHWA; DAARHWAL; AARHWALR; ARHWALRV; RHWALRVE; HWALRVET; WALRVETC; ALRVETCQ; LRVETCQA; RVETCQAA; VETCQAAS; ETCQAASA; TCQAASAE; CQAASAEA; QAASAEAS; AASAEASR; ASAEASRD; SAEASRDV; AEASRDVS; EASRDVSA; ASRDVSAA; SRDVSAAA; RDVSAAAD; DVSAAADW; VSAAADWP; SAAADWPA; AAADWPAV; AADWPAVS; ADWPAVSR; DWPAVSRE; WPAVSREI; PAVSREIQ; AVSREIQR; VSREIQRR; SREIQRRR; REIQRRRD; EIQRRRDA; IQRRRDAY; QRRRDAYI; RRRDAYIR; RRDAYIRR; RDAYIRRV; DAYIRRVV; AYIRRVVV<br><br>9 mers:<br>MTAVGGSPP; TAVGGSPPT; AVGGSPPTR; VGGSPPTRR; GGSPPTRRC; GSPPTRRCP; SPPTRRCPA; PPTRRCPAT; PTRRCPATE; TRRCPATED; RRCPATEDR; RCPATEDRA; CPATEDRAP; PATEDRAPA; ATEDRAPAT; TEDRAPATV; EDRAPATVA; DRAPATVAT; RAPATVATP; APATVATPS; PATVATPSS; ATVATPSST; TVATPSSTD; VATPSSTDP; ATPSSTDPT; TPSSTDPTA; PSSTDPTAS; SSTDPTASR; STDPTASRA; TDPTASRAV; DPTASRAVS; PTASRAVSW; TASRAVSWW; ASRAVSWWS; SRAVSWWSV; RAVSWWSVH; AVSWWSVHE; VSWWSVHEY; SWWSVHEYV; WWSVHEYVA; WSVHEYVAP; SVHEYVAPT; VHEYVAPTL; HEYVAPTLA; EYVAPTLAA; YVAPTLAAA; VAPTLAAAV; APTLAAAVE; PTLAAAVEW; TLAAAVEWP; | 35920-36405 |

Fig. 28 continued

| | | |
|---|---|---|
| | LAAAVEWPM; AAAVEWPMA; AAVEWPMAG; AVEWPMAGT; VEWPMAGTP; EWPMAGTPA; WPMAGTPAW; PMAGTPAWC; MAGTPAWCD; AGTPAWCDL; GTPAWCDLD; TPAWCDLDD; PAWCDLDDT; AWCDLDDTD; WCDLDDTDP; CDLDDTDPV; DLDDTDPVK; LDDTDPVKW; DDTDPVKWA; DTDPVKWAA; TDPVKWAAI; DPVKWAAIC; PVKWAAICD; VKWAAICDA; KWAAICDAA; WAAICDAAR; AAICDAARH; AICDAARHW; ICDAARHWA; CDAARHWAL; DAARHWALR; AARHWALRV; ARHWALRVE; RHWALRVET; HWALRVETC; WALRVETCQ; ALRVETCQA; LRVETCQAA; RVETCQAAS; VETCQAASA; ETCQAASAE; TCQAASAEA; CQAASAEAS; QAASAEASR; AASAEASRD; ASAEASRDV; SAEASRDVS; AEASRDVSA; EASRDVSAA; ASRDVSAAA; SRDVSAAAD; RDVSAAADW; DVSAAADWP; VSAAADWPA; SAAADWPAV; AAADWPAVS; AADWPAVSR; ADWPAVSRE; DWPAVSREI; WPAVSREIQ; PAVSREIQR; AVSREIQRR; VSREIQRRR; SREIQRRRD; REIQRRRDA; EIQRRRDAY; IQRRRDAYI; QRRRDAYIR; RRRDAYIRR; RRDAYIRRV; RDAYIRRVV; DAYIRRVVV<br><br>10 mers:<br>MTAVGGSPPT; TAVGGSPPTR; AVGGSPPTRR; VGGSPPTRRC; GGSPPTRRCP; GSPPTRRCPA; SPPTRRCPAT; PPTRRCPATE; PTRRCPATED; TRRCPATEDR; RRCPATEDRA; RCPATEDRAP; CPATEDRAPA; PATEDRAPAT; ATEDRAPATV; TEDRAPATVA; EDRAPATVAT; DRAPATVATP; RAPATVATPS; APATVATPSS; PATVATPSST; ATVATPSSTD; TVATPSSTDP; VATPSSTDPT; ATPSSTDPTA; TPSSTDPTAS; PSSTDPTASR; SSTDPTASRA; STDPTASRAV; TDPTASRAVS; DPTASRAVSW; PTASRAVSWW; TASRAVSWWS; ASRAVSWWSV; SRAVSWWSVH; RAVSWWSVHE; AVSWWSVHEY; VSWWSVHEYV; SWWSVHEYVA; WWSVHEYVAP; WSVHEYVAPT; SVHEYVAPTL; VHEYVAPTLA; HEYVAPTLAA; EYVAPTLAAA; YVAPTLAAAV; VAPTLAAAVE; APTLAAAVEW; PTLAAAVEWP; TLAAAVEWPM; LAAAVEWPMA; AAAVEWPMAG; AAVEWPMAGT; AVEWPMAGTP; VEWPMAGTPA; EWPMAGTPAW; WPMAGTPAWC; PMAGTPAWCD; MAGTPAWCDL; AGTPAWCDLD; GTPAWCDLDD; TPAWCDLDDT; PAWCDLDDTD; AWCDLDDTDP; WCDLDDTDPV; CDLDDTDPVK; DLDDTDPVKW; LDDTDPVKWA; DDTDPVKWAA; DTDPVKWAAI; TDPVKWAAIC; DPVKWAAICD; PVKWAAICDA; VKWAAICDAA; KWAAICDAAR; WAAICDAARH; AAICDAARHW; AICDAARHWA; ICDAARHWAL; CDAARHWALR; DAARHWALRV; AARHWALRVE; ARHWALRVET; RHWALRVETC; HWALRVETCQ; WALRVETCQA; ALRVETCQAA; LRVETCQAAS; RVETCQAASA; VETCQAASAE; ETCQAASAEA; TCQAASAEAS; CQAASAEASR; QAASAEASRD; AASAEASRDV; ASAEASRDVS; SAEASRDVSA; AEASRDVSAA; EASRDVSAAA; ASRDVSAAAD; SRDVSAAADW; RDVSAAADWP; DVSAAADWPA; VSAAADWPAV; SAAADWPAVS; AAADWPAVSR; AADWPAVSRE; ADWPAVSREI; DWPAVSREIQ; WPAVSREIQR; PAVSREIQRR; AVSREIQRRR; VSREIQRRRD; SREIQRRRDA; REIQRRRDAY; EIQRRRDAYI; IQRRRDAYIR; QRRRDAYIRR; RRRDAYIRRV; RRDAYIRRVV; RDAYIRRVVV<br><br>11 mers: | |

Fig. 28 continued

| | | |
|---|---|---|
| | MTAVGGSPPTR; TAVGGSPPTRR; AVGGSPPTRRC; VGGSPPTRRCP; GGSPPTRRCPA; GSPPTRRCPAT; SPPTRRCPATE; PPTRRCPATED; PTRRCPATEDR; TRRCPATEDRA; RRCPATEDRAP; RCPATEDRAPA; CPATEDRAPAT; PATEDRAPATV; ATEDRAPATVA; TEDRAPATVAT; EDRAPATVATP; DRAPATVATPS; RAPATVATPSS; APATVATPSST; PATVATPSSTD; ATVATPSSTDP; TVATPSSTDPT; VATPSSTDPTA; ATPSSTDPTAS; TPSSTDPTASR; PSSTDPTASRA; SSTDPTASRAV; STDPTASRAVS; TDPTASRAVSW; DPTASRAVSWW; PTASRAVSWWS; TASRAVSWWSV; ASRAVSWWSVH; SRAVSWWSVHE; RAVSWWSVHEY; AVSWWSVHEYV; VSWWSVHEYVA; SWWSVHEYVAP; WWSVHEYVAPT; WSVHEYVAPTL; SVHEYVAPTLA; VHEYVAPTLAA; HEYVAPTLAAA; EYVAPTLAAAV; YVAPTLAAAVE; VAPTLAAAVEW; APTLAAAVEWP; PTLAAAVEWPM; TLAAAVEWPMA; LAAAVEWPMAG; AAAVEWPMAGT; AAVEWPMAGTP; AVEWPMAGTPA; VEWPMAGTPAW; EWPMAGTPAWC; WPMAGTPAWCD; PMAGTPAWCDL; MAGTPAWCDLD; AGTPAWCDLDD; GTPAWCDLDDT; TPAWCDLDDTD; PAWCDLDDTDP; AWCDLDDTDPV; WCDLDDTDPVK; CDLDDTDPVKW; DLDDTDPVKWA; LDDTDPVKWAA; DDTDPVKWAAI; DTDPVKWAAIC; TDPVKWAAICD; DPVKWAAICDA; PVKWAAICDAA; VKWAAICDAAR; KWAAICDAARH; WAAICDAARHW; AAICDAARHWA; AICDAARHWAL; ICDAARHWALR; CDAARHWALRV; DAARHWALRVE; AARHWALRVET; ARHWALRVETC; RHWALRVETCQ; HWALRVETCQA; WALRVETCQAA; ALRVETCQAAS; LRVETCQAASA; RVETCQAASAE; VETCQAASAEA; ETCQAASAEAS; TCQAASAEASR; CQAASAEASRD; QAASAEASRDV; AASAEASRDVS; ASAEASRDVSA; SAEASRDVSAA; AEASRDVSAAA; EASRDVSAAAD; ASRDVSAAADW; SRDVSAAADWP; RDVSAAADWPA; DVSAAADWPAV; VSAAADWPAVS; SAAADWPAVSR; AAADWPAVSRE; AADWPAVSREI; ADWPAVSREIQ; DWPAVSREIQR; WPAVSREIQRR; PAVSREIQRRR; AVSREIQRRRD; VSREIQRRRDA; SREIQRRRDAY; REIQRRRDAYI; EIQRRRDAYIR; IQRRRDAYIRR; QRRRDAYIRRV; RRRDAYIRRVV; RRDAYIRRVVV | |
| 48) Rv2657c | 8 mers:<br>MCAFPSPS; CAFPSPSL; AFPSPSLG; FPSPSLGW; PSPSLGWT; SPSLGWTV; PSLGWTVS; SLGWTVSH; LGWTVSHE; GWTVSHET; WTVSHETE; TVSHETER; VSHETERP; SHETERPG; HETERPGM; ETERPGMA; TERPGMAD; ERPGMADA; RPGMADAP; PGMADAPP; GMADAPPL; MADAPPLS; ADAPPLSR; DAPPLSRR; APPLSRRY; PPLSRRYI; PLSRRYIT; LSRRYITI; SRRYITIS; RRYITISE; RYITISEA; YITISEAA; ITISEAAE; TISEAAEY; ISEAAEYL; SEAAEYLA; EAAEYLAV; AAEYLAVT; AEYLAVTD; EYLAVTDR; YLAVTDRT; LAVTDRTV; AVTDRTVR; VTDRTVRQ; TDRTVRQM; DRTVRQMI; RTVRQMIA; TVRQMIAD; VRQMIADG; RQMIADGR; QMIADGRL; MIADGRLR; IADGRLRG; ADGRLRGY; DGRLRGYR; GRLRGYRS; RLRGYRSG; LRGYRSGT; RGYRSGTR; GYRSGTRL; YRSGTRLV; RSGTRLVR; SGTRLVRL; GTRLVRLR; TRLVRLRR; RLVRLRRD; LVRLRRDE; VRLRRDEV; RLRRDEVD; LRRDEVDG; RRDEVDGA; RDEVDGAM; DEVDGAMH; EVDGAMHP; VDGAMHPF; DGAMHPFG; GAMHPFGG; AMHPFGGA; MHPFGGAA | 36406-36714 |

Fig. 28 continued

| | | | |
|---|---|---|---|
| | 9 mers:<br>MCAFPSPSL; CAFPSPSLG; AFPSPSLGW; FPSPSLGWT; PSPSLGWTV; SPSLGWTVS; PSLGWTVSH; SLGWTVSHE; LGWTVSHET; GWTVSHETE; WTVSHETER; TVSHETERP; VSHETERPG; SHETERPGM; HETERPGMA; ETERPGMAD; TERPGMADA; ERPGMADAP; RPGMADAPP; PGMADAPPL; GMADAPPLS; MADAPPLSR; ADAPPLSRR; DAPPLSRRY; APPLSRRYI; PPLSRRYIT; PLSRRYITI; LSRRYITIS; SRRYITISE; RRYITISEA; RYITISEAA; YITISEAAE; ITISEAAEY; TISEAAEYL; ISEAAEYLA; SEAAEYLAV; EAAEYLAVT; AAEYLAVTD; AEYLAVTDR; EYLAVTDRT; YLAVTDRTV; LAVTDRTVR; AVTDRTVRQ; VTDRTVRQM; TDRTVRQMI; DRTVRQMIA; RTVRQMIAD; TVRQMIADG; VRQMIADGR; RQMIADGRL; QMIADGRLR; MIADGRLRG; IADGRLRGY; ADGRLRGYR; DGRLRGYRS; GRLRGYRSG; RLRGYRSGT; LRGYRSGTR; RGYRSGTRL; GYRSGTRLV; YRSGTRLVR; RSGTRLVRL; SGTRLVRLR; GTRLVRLRR; TRLVRLRRD; RLVRLRRDE; LVRLRRDEV; VRLRRDEVD; RLRRDEVDG; LRRDEVDGA; RRDEVDGAM; RDEVDGAMH; DEVDGAMHP; EVDGAMHPF; VDGAMHPFG; DGAMHPFGG; GAMHPFGGA<br><br>10 mers:<br>MCAFPSPSLG; CAFPSPSLGW; AFPSPSLGWT; FPSPSLGWTV; PSPSLGWTVS; SPSLGWTVSH; PSLGWTVSHE; SLGWTVSHET; LGWTVSHETE; GWTVSHETER; WTVSHETERP; TVSHETERPG; VSHETERPGM; SHETERPGMA; HETERPGMAD; ETERPGMADA; TERPGMADAP; ERPGMADAPP; RPGMADAPPL; PGMADAPPLS; GMADAPPLSR; MADAPPLSRR; ADAPPLSRRY; DAPPLSRRYI; APPLSRRYIT; PPLSRRYITI; PLSRRYITIS; LSRRYITISE; SRRYITISEA; RRYITISEAA; RYITISEAAE; YITISEAAEY; ITISEAAEYL; TISEAAEYLA; ISEAAEYLAV; SEAAEYLAVT; EAAEYLAVTD; AAEYLAVTDR; AEYLAVTDRT; EYLAVTDRTV; YLAVTDRTVR; LAVTDRTVRQ; AVTDRTVRQM; VTDRTVRQMI; TDRTVRQMIA; DRTVRQMIAD; RTVRQMIADG; TVRQMIADGR; VRQMIADGRL; RQMIADGRLR; QMIADGRLRG; MIADGRLRGY; IADGRLRGYR; ADGRLRGYRS; DGRLRGYRSG; GRLRGYRSGT; RLRGYRSGTR; LRGYRSGTRL; RGYRSGTRLV; GYRSGTRLVR; YRSGTRLVRL; RSGTRLVRLR; SGTRLVRLRR; GTRLVRLRRD; TRLVRLRRDE; RLVRLRRDEV; LVRLRRDEVD; VRLRRDEVDG; RLRRDEVDGA; LRRDEVDGAM; RRDEVDGAMH; RDEVDGAMHP; DEVDGAMHPF; EVDGAMHPFG; VDGAMHPFGG; DGAMHPFGGA; GAMHPFGGAA<br><br>11 mers:<br>MCAFPSPSLGW; CAFPSPSLGWT; AFPSPSLGWTV; FPSPSLGWTVS; PSPSLGWTVSH; SPSLGWTVSHE; PSLGWTVSHET; SLGWTVSHETE; LGWTVSHETER; GWTVSHETERP; WTVSHETERPG; TVSHETERPGM; VSHETERPGMA; SHETERPGMAD; HETERPGMADA; ETERPGMADAP; TERPGMADAPP; ERPGMADAPPL; RPGMADAPPLS; PGMADAPPLSR; GMADAPPLSRR; MADAPPLSRRY; ADAPPLSRRYI; DAPPLSRRYIT; APPLSRRYITI; PPLSRRYITIS; PLSRRYITISE; LSRRYITISEA; SRRYITISEAA; | |

Fig. 28 continued

| | | |
|---|---|---|
| | RRYITISEAAE; RYITISEAAEY; YITISEAAEYL; ITISEAAEYLA; TISEAAEYLAV; ISEAAEYLAVT; SEAAEYLAVTD; EAAEYLAVTDR; AAEYLAVTDRT; AEYLAVTDRTV; EYLAVTDRTVR; YLAVTDRTVRQ; LAVTDRTVRQM; AVTDRTVRQMI; VTDRTVRQMIA; TDRTVRQMIAD; DRTVRQMIADG; RTVRQMIADGR; TVRQMIADGRL; VRQMIADGRLR; RQMIADGRLRG; QMIADGRLRGY; MIADGRLRGYR; IADGRLRGYRS; ADGRLRGYRSG; DGRLRGYRSGT; GRLRGYRSGTR; RLRGYRSGTRL; LRGYRSGTRLV; RGYRSGTRLVR; GYRSGTRLVRL; YRSGTRLVRLR; RSGTRLVRLRR; SGTRLVRLRRD; GTRLVRLRRDE; TRLVRLRRDEV; RLVRLRRDEVD; LVRLRRDEVDG; VRLRRDEVDGA; RLRRDEVDGAM; LRRDEVDGAMH; RRDEVDGAMHP; RDEVDGAMHPF; DEVDGAMHPFG; EVDGAMHPFGG; VDGAMHPFGGA; DGAMHPFGGAA | |
| 49) Rv2658c | 8 mers:<br>MADAVKYV; ADAVKYVV; DAVKYVVM; AVKYVVMC; VKYVVMCN; KYVVMCNC; YVVMCNCD; VVMCNCDD; VMCNCDDE; MCNCDDEP; CNCDDEPG; NCDDEPGA; CDDEPGAL; DDEPGALI; DEPGALII; EPGALIIA; PGALIIAW; GALIIAWI; ALIIAWID; LIIAWIDD; IIAWIDDE; IAWIDDER; AWIDDERP; WIDDERPA; IDDERPAG; DDERPAGG; DERPAGGH; ERPAGGHI; RPAGGHIQ; PAGGHIQM; AGGHIQMR; GGHIQMRS; GHIQMRSN; HIQMRSNT; IQMRSNTR; QMRSNTRF; MRSNTRFT; RSNTRFTE; SNTRFTET; NTRFTETQ; TRFTETQW; RFTETQWG; FTETQWGR; TETQWGRH; ETQWGRHI; TQWGRHIE; QWGRHIEW; WGRHIEWK; GRHIEWKL; RHIEWKLE; HIEWKLEC; IEWKLECR; EWKLECRA; WKLECRAC; KLECRACR; LECRACRK; ECRACRKY; CRACRKYA; RACRKYAP; ACRKYAPI; CRKYAPIS; RKYAPISE; KYAPISEM; YAPISEMT; APISEMTA; PISEMTAA; ISEMTAAA; SEMTAAAI; EMTAAAIL; MTAAAILD; TAAAILDG; AAAILDGF; AAILDGFG; AILDGFGA; ILDGFGAK; LDGFGAKL; DGFGAKLH; GFGAKLHE; FGAKLHEL; GAKLHELR; AKLHELRT; KLHELRTS; LHELRTST; HELRTSTI; ELRTSTIP; LRTSTIPD; RTSTIPDA; TSTIPDAD; STIPDADD; TIPDADDP; IPDADDPS; PDADDPSI; DADDPSIA; ADDPSIAE; DDPSIAEA; DPSIAEAR; PSIAEARH; SIAEARHV; IAEARHVI; AEARHVIP; EARHVIPF; ARHVIPFS; RHVIPFSA; HVIPFSAL; VIPFSALC; IPFSALCL; PFSALCLR; FSALCLRL; SALCLRLS; ALCLRLSQ; LCLRLSQL; CLRLSQLG; LRLSQLGG<br><br>9 mers:<br>MADAVKYVV; ADAVKYVVM; DAVKYVVMC; AVKYVVMCN; VKYVVMCNC; KYVVMCNCD; YVVMCNCDD; VVMCNCDDE; VMCNCDDEP; MCNCDDEPG; CNCDDEPGA; NCDDEPGAL; CDDEPGALI; DDEPGALII; DEPGALIIA; EPGALIIAW; PGALIIAWI; GALIIAWID; ALIIAWIDD; LIIAWIDDE; IIAWIDDER; IAWIDDERP; AWIDDERPA; WIDDERPAG; IDDERPAGG; DDERPAGGH; DERPAGGHI; ERPAGGHIQ; RPAGGHIQM; PAGGHIQMR; AGGHIQMRS; GGHIQMRSN; GHIQMRSNT; HIQMRSNTR; IQMRSNTRF; QMRSNTRFT; MRSNTRFTE; RSNTRFTET; SNTRFTETQ; NTRFTETQW; TRFTETQWG; RFTETQWGR; FTETQWGRH; TETQWGRHI; ETQWGRHIE; TQWGRHIEW; QWGRHIEWK; WGRHIEWKL; GRHIEWKLE; RHIEWKLEC; HIEWKLECR; IEWKLECRA; EWKLECRAC; WKLECRACR; | 36715-37160 |

Fig. 28 continued

| | | |
|---|---|---|
| | KLECRACRK; LECRACRKY; ECRACRKYA; CRACRKYAP; RACRKYAPI; ACRKYAPIS; CRKYAPISE; RKYAPISEM; KYAPISEMT; YAPISEMTA; APISEMTAA; PISEMTAAA; ISEMTAAAI; SEMTAAAIL; EMTAAAILD; MTAAAILDG; TAAAILDGF; AAAILDGFG; AAILDGFGA; AILDGFGAK; ILDGFGAKL; LDGFGAKLH; DGFGAKLHE; GFGAKLHEL; FGAKLHELR; GAKLHELRT; AKLHELRTS; KLHELRTST; LHELRTSTI; HELRTSTIP; ELRTSTIPD; LRTSTIPDA; RTSTIPDAD; TSTIPDADD; STIPDADDP; TIPDADDPS; IPDADDPSI; PDADDPSIA; DADDPSIAE; ADDPSIAEA; DDPSIAEAR; DPSIAEARH; PSIAEARHV; SIAEARHVI; IAEARHVIP; AEARHVIPF; EARHVIPFS; ARHVIPFSA; RHVIPFSAL; HVIPFSALC; VIPFSALCL; IPFSALCLR; PFSALCLRL; FSALCLRLS; SALCLRLSQ; ALCLRLSQL; LCLRLSQLG; CLRLSQLGG<br><br>10 mers:<br>MADAVKYVVM; ADAVKYVVMC; DAVKYVVMCN; AVKYVVMCNC; VKYVVMCNCD; KYVVMCNCDD; YVVMCNCDDE; VVMCNCDDEP; VMCNCDDEPG; MCNCDDEPGA; CNCDDEPGAL; NCDDEPGALI; CDDEPGALII; DDEPGALIIA; DEPGALIIAW; EPGALIIAWI; PGALIIAWID; GALIIAWIDD; ALIIAWIDDE; LIIAWIDDER; IIAWIDDERP; IAWIDDERPA; AWIDDERPAG; WIDDERPAGG; IDDERPAGGH; DDERPAGGHI; DERPAGGHIQ; ERPAGGHIQM; RPAGGHIQMR; PAGGHIQMRS; AGGHIQMRSN; GGHIQMRSNT; GHIQMRSNTR; HIQMRSNTRF; IQMRSNTRFT; QMRSNTRFTE; MRSNTRFTET; RSNTRFTETQ; SNTRFTETQW; NTRFTETQWG; TRFTETQWGR; RFTETQWGRH; FTETQWGRHI; TETQWGRHIE; ETQWGRHIEW; TQWGRHIEWK; QWGRHIEWKL; WGRHIEWKLE; GRHIEWKLEC; RHIEWKLECR; HIEWKLECRA; IEWKLECRAC; EWKLECRACR; WKLECRACRK; KLECRACRKY; LECRACRKYA; ECRACRKYAP; CRACRKYAPI; RACRKYAPIS; ACRKYAPISE; CRKYAPISEM; RKYAPISEMT; KYAPISEMTA; YAPISEMTAA; APISEMTAAA; PISEMTAAAI; ISEMTAAAIL; SEMTAAAILD; EMTAAAILDG; MTAAAILDGF; TAAAILDGFG; AAAILDGFGA; AAILDGFGAK; AILDGFGAKL; ILDGFGAKLH; LDGFGAKLHE; DGFGAKLHEL; GFGAKLHELR; FGAKLHELRT; GAKLHELRTS; AKLHELRTST; KLHELRTSTI; LHELRTSTIP; HELRTSTIPD; ELRTSTIPDA; LRTSTIPDAD; RTSTIPDADD; TSTIPDADDP; STIPDADDPS; TIPDADDPSI; IPDADDPSIA; PDADDPSIAE; DADDPSIAEA; ADDPSIAEAR; DDPSIAEARH; DPSIAEARHV; PSIAEARHVI; SIAEARHVIP; IAEARHVIPF; AEARHVIPFS; EARHVIPFSA; ARHVIPFSAL; RHVIPFSALC; HVIPFSALCL; VIPFSALCLR; IPFSALCLRL; PFSALCLRLS; FSALCLRLSQ; SALCLRLSQL; ALCLRLSQLG; LCLRLSQLGG<br><br>11 mers:<br>MADAVKYVVMC; ADAVKYVVMCN; DAVKYVVMCNC; AVKYVVMCNCD; VKYVVMCNCDD; KYVVMCNCDDE; YVVMCNCDDEP; VVMCNCDDEPG; VMCNCDDEPGA; MCNCDDEPGAL; CNCDDEPGALI; NCDDEPGALII; CDDEPGALIIA; DDEPGALIIAW; DEPGALIIAWI; EPGALIIAWID; PGALIIAWIDD; GALIIAWIDDE; ALIIAWIDDER; LIIAWIDDERP; IIAWIDDERPA; IAWIDDERPAG; AWIDDERPAGG; WIDDERPAGGH; IDDERPAGGHI; DDERPAGGHIQ; DERPAGGHIQM; ERPAGGHIQMR; RPAGGHIQMRS; PAGGHIQMRSN; AGGHIQMRSNT; | |

Fig. 28 continued

| | | |
|---|---|---|
| | GGHIQMRSNTR; GHIQMRSNTRF; HIQMRSNTRFT; IQMRSNTRFTE; QMRSNTRFTET; MRSNTRFTETQ; RSNTRFTETQW; SNTRFTETQWG; NTRFTETQWGR; TRFTETQWGRH; RFTETQWGRHI; FTETQWGRHIE; TETQWGRHIEW; ETQWGRHIEWK; TQWGRHIEWKL; QWGRHIEWKLE; WGRHIEWKLEC; GRHIEWKLECR; RHIEWKLECRA; HIEWKLECRAC; IEWKLECRACR; EWKLECRACRK; WKLECRACRKY; KLECRACRKYA; LECRACRKYAP; ECRACRKYAPI; CRACRKYAPIS; RACRKYAPISE; ACRKYAPISEM; CRKYAPISEMT; RKYAPISEMTA; KYAPISEMTAA; YAPISEMTAAA; APISEMTAAAI; PISEMTAAAIL; ISEMTAAAILD; SEMTAAAILDG; EMTAAAILDGF; MTAAAILDGFG; TAAAILDGFGA; AAAILDGFGAK; AAILDGFGAKL; AILDGFGAKLH; ILDGFGAKLHE; LDGFGAKLHEL; DGFGAKLHELR; GFGAKLHELRT; FGAKLHELRTS; GAKLHELRTST; AKLHELRTSTI; KLHELRTSTIP; LHELRTSTIPD; HELRTSTIPDA; ELRTSTIPDAD; LRTSTIPDADD; RTSTIPDADDP; TSTIPDADDPS; STIPDADDPSI; TIPDADDPSIA; IPDADDPSIAE; PDADDPSIAEA; DADDPSIAEAR; ADDPSIAEARH; DDPSIAEARHV; DPSIAEARHVI; PSIAEARHVIP; SIAEARHVIPF; IAEARHVIPFS; AEARHVIPFSA; EARHVIPFSAL; ARHVIPFSALC; RHVIPFSALCL; HVIPFSALCLR; VIPFSALCLRL; IPFSALCLRLS; PFSALCLRLSQ; FSALCLRLSQL; SALCLRLSQLG; ALCLRLSQLGG | |
| 50) Rv2659c | 8 mers: MTQTGKRQ; TQTGKRQR; QTGKRQRR; TGKRQRRK; GKRQRRKF; KRQRRKFG; RQRRKFGR; QRRKFGRI; RRKFGRIR; RKFGRIRQ; KFGRIRQF; FGRIRQFN; GRIRQFNS; RIRQFNSG; IRQFNSGR; RQFNSGRW; QFNSGRWQ; FNSGRWQA; NSGRWQAS; SGRWQASY; GRWQASYT; RWQASYTG; WQASYTGP; QASYTGPD; ASYTGPDG; SYTGPDGR; YTGPDGRV; TGPDGRVY; GPDGRVYI; PDGRVYIA; DGRVYIAP; GRVYIAPK; RVYIAPKT; VYIAPKTF; YIAPKTFN; IAPKTFNA; APKTFNAK; PKTFNAKI; KTFNAKID; TFNAKIDA; FNAKIDAE; NAKIDAEA; AKIDAEAW; KIDAEAWL; IDAEAWLT; DAEAWLTD; AEAWLTDR; EAWLTDRR; AWLTDRRR; WLTDRRRE; LTDRRREI; TDRRREID; DRRREIDR; RRREIDRQ; RREIDRQL; REIDRQLW; EIDRQLWS; IDRQLWSP; DRQLWSPA; RQLWSPAS; QLWSPASG; LWSPASGQ; WSPASGQE; SPASGQED; PASGQEDR; ASGQEDRP; SGQEDRPG; GQEDRPGA; QEDRPGAP; EDRPGAPF; DRPGAPFG; RPGAPFGE; PGAPFGEY; GAPFGEYA; APFGEYAE; PFGEYAEG; FGEYAEGW; GEYAEGWL; EYAEGWLK; YAEGWLKQ; AEGWLKQR; EGWLKQRG; GWLKQRGI; WLKQRGIK; LKQRGIKD; KQRGIKDR; QRGIKDRT; RGIKDRTR; GIKDRTRA; IKDRTRAH; KDRTRAHY; DRTRAHYR; RTRAHYRK; TRAHYRKL; RAHYRKLL; AHYRKLLD; HYRKLLDN; YRKLLDNH; RKLLDNHI; KLLDNHIL; LLDNHILA; LDNHILAT; DNHILATF; NHILATFA; HILATFAD; ILATFADT; LATFADTD; ATFADTDL; TFADTDLR; FADTDLRD; ADTDLRDI; DTDLRDIT; TDLRDITP; DLRDITPA; LRDITPAA; RDITPAAV; DITPAAVR; ITPAAVRR; TPAAVRRW; PAAVRRWY; AAVRRWYA; AVRRWYAT; VRRWYATT; RRWYATTA; RWYATTAV; WYATTAVG; YATTAVGT; ATTAVGTP; TTAVGTPT; TAVGTPTM; AVGTPTMR; VGTPTMRA; GTPTMRAH; TPTMRAHS; PTMRAHSY; TMRAHSYS; MRAHSYSL; RAHSYSLL; AHSYSLLR; HSYSLLRA; SYSLLRAI; YSLLRAIM; SLLRAIMQ; LLRAIMQT; LRAIMQTA; RAIMQTAL; AIMQTALA; IMQTALAD; MQTALADD; QTALADDL; TALADDLI; | 37161-38628 |

Fig. 28 continued

| | | | |
|---|---|---|---|
| | ALADDLID; LADDLIDS; ADDLIDSN; DDLIDSNP; DLIDSNPC; LIDSNPCR; IDSNPCRI; DSNPCRIS; SNPCRISG; NPCRISGA; PCRISGAS; CRISGAST; RISGASTA; ISGASTAR; SGASTARR; GASTARRV; ASTARRVH; STARRVHK; TARRVHKI; ARRVHKIR; RRVHKIRP; RVHKIRPA; VHKIRPAT; HKIRPATL; KIRPATLD; IRPATLDE; RPATLDEL; PATLDELE; ATLDELET; TLDELETI; LDELETIT; DELETITK; ELETITKA; LETITKAM; ETITKAMP; TITKAMPD; ITKAMPDP; TKAMPDPY; KAMPDPYQ; AMPDPYQA; MPDPYQAF; PDPYQAFV; DPYQAFVL; PYQAFVLM; YQAFVLMA; QAFVLMAA; AFVLMAAW; FVLMAAWL; VLMAAWLA; LMAAWLAM; MAAWLAMR; AAWLAMRY; AWLAMRYG; WLAMRYGE; LAMRYGEL; AMRYGELT; MRYGELTE; RYGELTEL; YGELTELR; GELTELRR; ELTELRRK; LTELRRKD; TELRRKDI; ELRRKDID; LRRKDIDL; RRKDIDLH; RKDIDLHG; KDIDLHGE; DIDLHGEV; IDLHGEVA; DLHGEVAR; LHGEVARV; HGEVARVR; GEVARVRR; EVARVRRA; VARVRRAV; ARVRRAVV; RVRRAVVR; VRRAVVRV; RRAVVRVG; RAVVRVGE; AVVRVGEG; VVRVGEGF; VRVGEGFK; RVGEGFKV; VGEGFKVT; GEGFKVTT; EGFKVTTP; GFKVTTPK; FKVTTPKS; KVTTPKSD; VTTPKSDA; TTPKSDAG; TPKSDAGV; PKSDAGVR; KSDAGVRD; SDAGVRDI; DAGVRDIS; AGVRDISI; GVRDISIP; VRDISIPP; RDISIPPH; DISIPPHL; ISIPPHLI; SIPPHLIP; IPPHLIPA; PPHLIPAI; PHLIPAIE; HLIPAIED; LIPAIEDH; IPAIEDHL; PAIEDHLH; AIEDHLHK; IEDHLHKH; EDHLHKHV; DHLHKHVN; HLHKHVNP; LHKHVNPG; HKHVNPGR; KHVNPGRE; HVNPGRES; VNPGRESL; NPGRESLL; PGRESLLF; GRESLLFP; RESLLFPS; ESLLFPSV; SLLFPSVN; LLFPSVND; LFPSVNDP; FPSVNDPN; PSVNDPNR; SVNDPNRH; VNDPNRHL; NDPNRHLA; DPNRHLAP; PNRHLAPS; NRHLAPSA; RHLAPSAL; HLAPSALY; LAPSALYR; APSALYRM; PSALYRMF; SALYRMFY; ALYRMFYK; LYRMFYKA; YRMFYKAR; RMFYKARK; MFYKARKA; FYKARKAA; YKARKAAG; KARKAAGR; ARKAAGRP; RKAAGRPD; KAAGRPDL; AAGRPDLR; AGRPDLRV; GRPDLRVH; RPDLRVHD; PDLRVHDL; DLRVHDLR; LRVHDLRH; RVHDLRHS; VHDLRHSG; HDLRHSGA; DLRHSGAV; LRHSGAVL; RHSGAVLA; HSGAVLAA; SGAVLAAS; GAVLAAST; AVLAASTG; VLAASTGA; LAASTGAT; AASTGATL; ASTGATLA; STGATLAE; TGATLAEL; GATLAELM; ATLAELMQ; TLAELMQR; LAELMQRL; AELMQRLG; ELMQRLGH; LMQRLGHS; MQRLGHST; QRLGHSTA; RLGHSTAG; LGHSTAGA; GHSTAGAA; HSTAGAAL; STAGAALR; TAGAALRY; AGAALRYQ; GAALRYQH; AALRYQHA; ALRYQHAA; LRYQHAAK; RYQHAAKG; YQHAAKGR; QHAAKGRD; HAAKGRDR; AAKGRDRE; AKGRDREI; KGRDREIA; GRDREIAA; RDREIAAL; DREIAALL; REIAALLS; EIAALLSK; IAALLSKL; AALLSKLA; ALLSKLAE; LLSKLAEN; LSKLAENQ; SKLAENQE; KLAENQEM<br><br>9 mers:<br>MTQTGKRQR; TQTGKRQRR; QTGKRQRRK; TGKRQRRKF; GKRQRRKFG; KRQRRKFGR; RQRRKFGRI; QRRKFGRIR; RRKFGRIRQ; RKFGRIRQF; KFGRIRQFN; FGRIRQFNS; GRIRQFNSG; RIRQFNSGR; IRQFNSGRW; RQFNSGRWQ; QFNSGRWQA; FNSGRWQAS; NSGRWQASY; SGRWQASYT; GRWQASYTG; RWQASYTGP; WQASYTGPD; QASYTGPDG; ASYTGPDGR; SYTGPDGRV; YTGPDGRVY; TGPDGRVYI; GPDGRVYIA; PDGRVYIAP; DGRVYIAPK; GRVYIAPKT; RVYIAPKTF; | |

Fig. 28 continued

| | | |
|---|---|---|
| | VYIAPKTFN; YIAPKTFNA; IAPKTFNAK; APKTFNAKI; PKTFNAKID; KTFNAKIDA; TFNAKIDAE; FNAKIDAEA; NAKIDAEAW; AKIDAEAWL; KIDAEAWLT; IDAEAWLTD; DAEAWLTDR; AEAWLTDRR; EAWLTDRRR; AWLTDRRRE; WLTDRRREI; LTDRRREID; TDRRREIDR; DRRREIDRQ; RRREIDRQL; RREIDRQLW; REIDRQLWS; EIDRQLWSP; IDRQLWSPA; DRQLWSPAS; RQLWSPASG; QLWSPASGQ; LWSPASGQE; WSPASGQED; SPASGQEDR; PASGQEDRP; ASGQEDRPG; SGQEDRPGA; GQEDRPGAP; QEDRPGAPF; EDRPGAPFG; DRPGAPFGE; RPGAPFGEY; PGAPFGEYA; GAPFGEYAE; APFGEYAEG; PFGEYAEGW; FGEYAEGWL; GEYAEGWLK; EYAEGWLKQ; YAEGWLKQR; AEGWLKQRG; EGWLKQRGI; GWLKQRGIK; WLKQRGIKD; LKQRGIKDR; KQRGIKDRT; QRGIKDRTR; RGIKDRTRA; GIKDRTRAH; IKDRTRAHY; KDRTRAHYR; DRTRAHYRK; RTRAHYRKL; TRAHYRKLL; RAHYRKLLD; AHYRKLLDN; HYRKLLDNH; YRKLLDNHI; RKLLDNHIL; KLLDNHILA; LLDNHILAT; LDNHILATF; DNHILATFA; NHILATFAD; HILATFADT; ILATFADTD; LATFADTDL; ATFADTDLR; TFADTDLRD; FADTDLRDI; ADTDLRDIT; DTDLRDITP; TDLRDITPA; DLRDITPAA; LRDITPAAV; RDITPAAVR; DITPAAVRR; ITPAAVRRW; TPAAVRRWY; PAAVRRWYA; AAVRRWYAT; AVRRWYATT; VRRWYATTA; RRWYATTAV; RWYATTAVG; WYATTAVGT; YATTAVGTP; ATTAVGTPT; TTAVGTPTM; TAVGTPTMR; AVGTPTMRA; VGTPTMRAH; GTPTMRAHS; TPTMRAHSY; PTMRAHSYS; TMRAHSYSL; MRAHSYSLL; RAHSYSLLR; AHSYSLLRA; HSYSLLRAI; SYSLLRAIM; YSLLRAIMQ; SLLRAIMQT; LLRAIMQTA; LRAIMQTAL; RAIMQTALA; AIMQTALAD; IMQTALADD; MQTALADDL; QTALADDLI; TALADDLID; ALADDLIDS; LADDLIDSN; ADDLIDSNP; DDLIDSNPC; DLIDSNPCR; LIDSNPCRI; IDSNPCRIS; DSNPCRISG; SNPCRISGA; NPCRISGAS; PCRISGAST; CRISGASTA; RISGASTAR; ISGASTARR; SGASTARRV; GASTARRVH; ASTARRVHK; STARRVHKI; TARRVHKIR; ARRVHKIRP; RRVHKIRPA; RVHKIRPAT; VHKIRPATL; HKIRPATLD; KIRPATLDE; IRPATLDEL; RPATLDELE; PATLDELET; ATLDELETI; TLDELETIT; LDELETITK; DELETITKA; ELETITKAM; LETITKAMP; ETITKAMPD; TITKAMPDP; ITKAMPDPY; TKAMPDPYQ; KAMPDPYQA; AMPDPYQAF; MPDPYQAFV; PDPYQAFVL; DPYQAFVLM; PYQAFVLMA; YQAFVLMAA; QAFVLMAAW; AFVLMAAWL; FVLMAAWLA; VLMAAWLAM; LMAAWLAMR; MAAWLAMRY; AAWLAMRYG; AWLAMRYGE; WLAMRYGEL; LAMRYGELT; AMRYGELTE; MRYGELTEL; RYGELTELR; YGELTELRR; GELTELRRK; ELTELRRKD; LTELRRKDI; TELRRKDID; ELRRKDIDL; LRRKDIDLH; RRKDIDLHG; RKDIDLHGE; KDIDLHGEV; DIDLHGEVA; IDLHGEVAR; DLHGEVARV; LHGEVARVR; HGEVARVRR; GEVARVRRA; EVARVRRAV; VARVRRAVV; ARVRRAVVR; RVRRAVVRV; VRRAVVRVG; RRAVVRVGE; RAVVRVGEG; AVVRVGEGF; VVRVGEGFK; VRVGEGFKV; RVGEGFKVT; VGEGFKVTT; GEGFKVTTP; EGFKVTTPK; GFKVTTPKS; FKVTTPKSD; KVTTPKSDA; VTTPKSDAG; TTPKSDAGV; TPKSDAGVR; PKSDAGVRD; KSDAGVRDI; SDAGVRDIS; DAGVRDISI; AGVRDISIP; GVRDISIPP; VRDISIPPH; RDISIPPHL; DISIPPHLI; ISIPPHLIP; SIPPHLIPA; IPPHLIPAI; PPHLIPAIE; PHLIPAIED; HLIPAIEDH; LIPAIEDHL; IPAIEDHLH; PAIEDHLHK; AIEDHLHKH; IEDHLHKHV; EDHLHKHVN; DHLHKHVNP; | |

Fig. 28 continued

| | | | |
|---|---|---|---|
| | HLHKHVNPG; LHKHVNPGR; HKHVNPGRE; KHVNPGRES; HVNPGRESL; VNPGRESLL; NPGRESLLF; PGRESLLFP; GRESLLFPS; RESLLFPSV; ESLLFPSVN; SLLFPSVND; LLFPSVNDP; LFPSVNDPN; FPSVNDPNR; PSVNDPNRH; SVNDPNRHL; VNDPNRHLA; NDPNRHLAP; DPNRHLAPS; PNRHLAPSA; NRHLAPSAL; RHLAPSALY; HLAPSALYR; LAPSALYRM; APSALYRMF; PSALYRMFY; SALYRMFYK; ALYRMFYKA; LYRMFYKAR; YRMFYKARK; RMFYKARKA; MFYKARKAA; FYKARKAAG; YKARKAAGR; KARKAAGRP; ARKAAGRPD; RKAAGRPDL; KAAGRPDLR; AAGRPDLRV; AGRPDLRVH; GRPDLRVHD; RPDLRVHDL; PDLRVHDLR; DLRVHDLRH; LRVHDLRHS; RVHDLRHSG; VHDLRHSGA; HDLRHSGAV; DLRHSGAVL; LRHSGAVLA; RHSGAVLAA; HSGAVLAAS; SGAVLAAST; GAVLAASTG; AVLAASTGA; VLAASTGAT; LAASTGATL; AASTGATLA; ASTGATLAE; STGATLAEL; TGATLAELM; GATLAELMQ; ATLAELMQR; TLAELMQRL; LAELMQRLG; AELMQRLGH; ELMQRLGHS; LMQRLGHST; MQRLGHSTA; QRLGHSTAG; RLGHSTAGA; LGHSTAGAA; GHSTAGAAL; HSTAGAALR; STAGAALRY; TAGAALRYQ; AGAALRYQH; GAALRYQHA; AALRYQHAA; ALRYQHAAK; LRYQHAAKG; RYQHAAKGR; YQHAAKGRD; QHAAKGRDR; HAAKGRDRE; AAKGRDREI; AKGRDREIA; KGRDREIAA; GRDREIAAL; RDREIAALL; DREIAALLS; REIAALLSK; EIAALLSKL; IAALLSKLA; AALLSKLAE; ALLSKLAEN; LLSKLAENQ; LSKLAENQE; SKLAENQEM<br><br>10 mers:<br>MTQTGKRQRR; TQTGKRQRRK; QTGKRQRRKF; TGKRQRRKFG; GKRQRRKFGR; KRQRRKFGRI; RQRRKFGRIR; QRRKFGRIRQ; RRKFGRIRQF; RKFGRIRQFN; KFGRIRQFNS; FGRIRQFNSG; GRIRQFNSGR; RIRQFNSGRW; IRQFNSGRWQ; RQFNSGRWQA; QFNSGRWQAS; FNSGRWQASY; NSGRWQASYT; SGRWQASYTG; GRWQASYTGP; RWQASYTGPD; WQASYTGPDG; QASYTGPDGR; ASYTGPDGRV; SYTGPDGRVY; YTGPDGRVYI; TGPDGRVYIA; GPDGRVYIAP; PDGRVYIAPK; DGRVYIAPKT; GRVYIAPKTF; RVYIAPKTFN; VYIAPKTFNA; YIAPKTFNAK; IAPKTFNAKI; APKTFNAKID; PKTFNAKIDA; KTFNAKIDAE; TFNAKIDAEA; FNAKIDAEAW; NAKIDAEAWL; AKIDAEAWLT; KIDAEAWLTD; IDAEAWLTDR; DAEAWLTDRR; AEAWLTDRRR; EAWLTDRRRE; AWLTDRRREI; WLTDRRREID; LTDRRREIDR; TDRRREIDRQ; DRRREIDRQL; RRREIDRQLW; RREIDRQLWS; REIDRQLWSP; EIDRQLWSPA; IDRQLWSPAS; DRQLWSPASG; RQLWSPASGQ; QLWSPASGQE; LWSPASGQED; WSPASGQEDR; SPASGQEDRP; PASGQEDRPG; ASGQEDRPGA; SGQEDRPGAP; GQEDRPGAPF; QEDRPGAPFG; EDRPGAPFGE; DRPGAPFGEY; RPGAPFGEYA; PGAPFGEYAE; GAPFGEYAEG; APFGEYAEGW; PFGEYAEGWL; FGEYAEGWLK; GEYAEGWLKQ; EYAEGWLKQR; YAEGWLKQRG; AEGWLKQRGI; EGWLKQRGIK; GWLKQRGIKD; WLKQRGIKDR; LKQRGIKDRT; KQRGIKDRTR; QRGIKDRTRA; RGIKDRTRAH; GIKDRTRAHY; IKDRTRAHYR; KDRTRAHYRK; DRTRAHYRKL; RTRAHYRKLL; TRAHYRKLLD; RAHYRKLLDN; AHYRKLLDNH; HYRKLLDNHI; YRKLLDNHIL; RKLLDNHILA; KLLDNHILAT; LLDNHILATF; LDNHILATFA; DNHILATFAD; NHILATFADT; HILATFADTD; ILATFADTDL; LATFADTDLR; ATFADTDLRD; | |

Fig. 28 continued

| | | | |
|---|---|---|---|
| | TFADTDLRDI; FADTDLRDIT; ADTDLRDITP; DTDLRDITPA; TDLRDITPAA; DLRDITPAAV; LRDITPAAVR; RDITPAAVRR; DITPAAVRRW; ITPAAVRRWY; TPAAVRRWYA; PAAVRRWYAT; AAVRRWYATT; AVRRWYATTA; VRRWYATTAV; RRWYATTAVG; RWYATTAVGT; WYATTAVGTP; YATTAVGTPT; ATTAVGTPTM; TTAVGTPTMR; TAVGTPTMRA; AVGTPTMRAH; VGTPTMRAHS; GTPTMRAHSY; TPTMRAHSYS; PTMRAHSYSL; TMRAHSYSLL; MRAHSYSLLR; RAHSYSLLRA; AHSYSLLRAI; HSYSLLRAIM; SYSLLRAIMQ; YSLLRAIMQT; SLLRAIMQTA; LLRAIMQTAL; LRAIMQTALA; RAIMQTALAD; AIMQTALADD; IMQTALADDL; MQTALADDLI; QTALADDLID; TALADDLIDS; ALADDLIDSN; LADDLIDSNP; ADDLIDSNPC; DDLIDSNPCR; DLIDSNPCRI; LIDSNPCRIS; IDSNPCRISG; DSNPCRISGA; SNPCRISGAS; NPCRISGAST; PCRISGASTA; CRISGASTAR; RISGASTARR; ISGASTARRV; SGASTARRVH; GASTARRVHK; ASTARRVHKI; STARRVHKIR; TARRVHKIRP; ARRVHKIRPA; RRVHKIRPAT; RVHKIRPATL; VHKIRPATLD; HKIRPATLDE; KIRPATLDEL; IRPATLDELE; RPATLDELET; PATLDELETI; ATLDELETIT; TLDELETITK; LDELETITKA; DELETITKAM; ELETITKAMP; LETITKAMPD; ETITKAMPDP; TITKAMPDPY; ITKAMPDPYQ; TKAMPDPYQA; KAMPDPYQAF; AMPDPYQAFV; MPDPYQAFVL; PDPYQAFVLM; DPYQAFVLMA; PYQAFVLMAA; YQAFVLMAAW; QAFVLMAAWL; AFVLMAAWLA; FVLMAAWLAM; VLMAAWLAMR; LMAAWLAMRY; MAAWLAMRYG; AAWLAMRYGE; AWLAMRYGEL; WLAMRYGELT; LAMRYGELTE; AMRYGELTEL; MRYGELTELR; RYGELTELRR; YGELTELRRK; GELTELRRKD; ELTELRRKDI; LTELRRKDID; TELRRKDIDL; ELRRKDIDLH; LRRKDIDLHG; RRKDIDLHGE; RKDIDLHGEV; KDIDLHGEVA; DIDLHGEVAR; IDLHGEVARV; DLHGEVARVR; LHGEVARVRR; HGEVARVRRA; GEVARVRRAV; EVARVRRAVV; VARVRRAVVR; ARVRRAVVRV; RVRRAVVRVG; VRRAVVRVGE; RRAVVRVGEG; RAVVRVGEGF; AVVRVGEGFK; VVRVGEGFKV; VRVGEGFKVT; RVGEGFKVTT; VGEGFKVTTP; GEGFKVTTPK; EGFKVTTPKS; GFKVTTPKSD; FKVTTPKSDA; KVTTPKSDAG; VTTPKSDAGV; TTPKSDAGVR; TPKSDAGVRD; PKSDAGVRDI; KSDAGVRDIS; SDAGVRDISI; DAGVRDISIP; AGVRDISIPP; GVRDISIPPH; VRDISIPPHL; RDISIPPHLI; DISIPPHLIP; ISIPPHLIPA; SIPPHLIPAI; IPPHLIPAIE; PPHLIPAIED; PHLIPAIEDH; HLIPAIEDHL; LIPAIEDHLH; IPAIEDHLHK; PAIEDHLHKH; AIEDHLHKHV; IEDHLHKHVN; EDHLHKHVNP; DHLHKHVNPG; HLHKHVNPGR; LHKHVNPGRE; HKHVNPGRES; KHVNPGRESL; HVNPGRESLL; VNPGRESLLF; NPGRESLLFP; PGRESLLFPS; GRESLLFPSV; RESLLFPSVN; ESLLFPSVND; SLLFPSVNDP; LLFPSVNDPN; LFPSVNDPNR; FPSVNDPNRH; PSVNDPNRHL; SVNDPNRHLA; VNDPNRHLAP; NDPNRHLAPS; DPNRHLAPSA; PNRHLAPSAL; NRHLAPSALY; RHLAPSALYR; HLAPSALYRM; LAPSALYRMF; APSALYRMFY; PSALYRMFYK; SALYRMFYKA; ALYRMFYKAR; LYRMFYKARK; YRMFYKARKA; RMFYKARKAA; MFYKARKAAG; FYKARKAAGR; YKARKAAGRP; KARKAAGRPD; ARKAAGRPDL; RKAAGRPDLR; KAAGRPDLRV; AAGRPDLRVH; AGRPDLRVHD; GRPDLRVHDL; RPDLRVHDLR; PDLRVHDLRH; DLRVHDLRHS; LRVHDLRHSG; RVHDLRHSGA; VHDLRHSGAV; HDLRHSGAVL; DLRHSGAVLA; LRHSGAVLAA; RHSGAVLAAS; HSGAVLAAST; SGAVLAASTG; GAVLAASTGA; | |

Fig. 28 continued

| | | | |
|---|---|---|---|
| | AVLAASTGAT; VLAASTGATL; LAASTGATLA; AASTGATLAE; ASTGATLAEL; STGATLAELM; TGATLAELMQ; GATLAELMQR; ATLAELMQRL; TLAELMQRLG; LAELMQRLGH; AELMQRLGHS; ELMQRLGHST; LMQRLGHSTA; MQRLGHSTAG; QRLGHSTAGA; RLGHSTAGAA; LGHSTAGAAL; GHSTAGAALR; HSTAGAALRY; STAGAALRYQ; TAGAALRYQH; AGAALRYQHA; GAALRYQHAA; AALRYQHAAK; ALRYQHAAKG; LRYQHAAKGR; RYQHAAKGRD; YQHAAKGRDR; QHAAKGRDRE; HAAKGRDREI; AAKGRDREIA; AKGRDREIAA; KGRDREIAAL; GRDREIAALL; RDREIAALLS; DREIAALLSK; REIAALLSKL; EIAALLSKLA; IAALLSKLAE; AALLSKLAEN; ALLSKLAENQ; LLSKLAENQE; LSKLAENQEM<br><br>11 mers:<br>MTQTGKRQRRK; TQTGKRQRRKF; QTGKRQRRKFG; TGKRQRRKFGR; GKRQRRKFGRI; KRQRRKFGRIR; RQRRKFGRIRQ; QRRKFGRIRQF; RRKFGRIRQFN; RKFGRIRQFNS; KFGRIRQFNSG; FGRIRQFNSGR; GRIRQFNSGRW; RIRQFNSGRWQ; IRQFNSGRWQA; RQFNSGRWQAS; QFNSGRWQASY; FNSGRWQASYT; NSGRWQASYTG; SGRWQASYTGP; GRWQASYTGPD; RWQASYTGPDG; WQASYTGPDGR; QASYTGPDGRV; ASYTGPDGRVY; SYTGPDGRVYI; YTGPDGRVYIA; TGPDGRVYIAP; GPDGRVYIAPK; PDGRVYIAPKT; DGRVYIAPKTF; GRVYIAPKTFN; RVYIAPKTFNA; VYIAPKTFNAK; YIAPKTFNAKI; IAPKTFNAKID; APKTFNAKIDA; PKTFNAKIDAE; KTFNAKIDAEA; TFNAKIDAEAW; FNAKIDAEAWL; NAKIDAEAWLT; AKIDAEAWLTD; KIDAEAWLTDR; IDAEAWLTDRR; DAEAWLTDRRR; AEAWLTDRRRE; EAWLTDRRREI; AWLTDRRREID; WLTDRRREIDR; LTDRRREIDRQ; TDRRREIDRQL; DRRREIDRQLW; RRREIDRQLWS; RREIDRQLWSP; REIDRQLWSPA; EIDRQLWSPAS; IDRQLWSPASG; DRQLWSPASGQ; RQLWSPASGQE; QLWSPASGQED; LWSPASGQEDR; WSPASGQEDRP; SPASGQEDRPG; PASGQEDRPGA; ASGQEDRPGAP; SGQEDRPGAPF; GQEDRPGAPFG; QEDRPGAPFGE; EDRPGAPFGEY; DRPGAPFGEYA; RPGAPFGEYAE; PGAPFGEYAEG; GAPFGEYAEGW; APFGEYAEGWL; PFGEYAEGWLK; FGEYAEGWLKQ; GEYAEGWLKQR; EYAEGWLKQRG; YAEGWLKQRGI; AEGWLKQRGIK; EGWLKQRGIKD; GWLKQRGIKDR; WLKQRGIKDRT; LKQRGIKDRTR; KQRGIKDRTRA; QRGIKDRTRAH; RGIKDRTRAHY; GIKDRTRAHYR; IKDRTRAHYRK; KDRTRAHYRKL; DRTRAHYRKLL; RTRAHYRKLLD; TRAHYRKLLDN; RAHYRKLLDNH; AHYRKLLDNHI; HYRKLLDNHIL; YRKLLDNHILA; RKLLDNHILAT; KLLDNHILATF; LLDNHILATFA; LDNHILATFAD; DNHILATFADT; NHILATFADTD; HILATFADTDL; ILATFADTDLR; LATFADTDLRD; ATFADTDLRDI; TFADTDLRDIT; FADTDLRDITP; ADTDLRDITPA; DTDLRDITPAA; TDLRDITPAAV; DLRDITPAAVR; LRDITPAAVRR; RDITPAAVRRW; DITPAAVRRWY; ITPAAVRRWYA; TPAAVRRWYAT; PAAVRRWYATT; AAVRRWYATTA; AVRRWYATTAV; VRRWYATTAVG; RRWYATTAVGT; RWYATTAVGTP; WYATTAVGTPT; YATTAVGTPTM; ATTAVGTPTMR; TTAVGTPTMRA; TAVGTPTMRAH; AVGTPTMRAHS; VGTPTMRAHSY; GTPTMRAHSYS; TPTMRAHSYSL; PTMRAHSYSLL; TMRAHSYSLLR; MRAHSYSLLRA; RAHSYSLLRAI; AHSYSLLRAIM; HSYSLLRAIMQ; SYSLLRAIMQT; YSLLRAIMQTA; SLLRAIMQTAL; LLRAIMQTALA; LRAIMQTALAD; RAIMQTALADD; AIMQTALADDL; | |

Fig. 28 continued

| | | |
|---|---|---|
| | IMQTALADDLI; MQTALADDLID; QTALADDLIDS; TALADDLIDSN;<br>ALADDLIDSNP; LADDLIDSNPC; ADDLIDSNPCR; DDLIDSNPCRI;<br>DLIDSNPCRIS; LIDSNPCRISG; IDSNPCRISGA; DSNPCRISGAS;<br>SNPCRISGAST; NPCRISGASTA; PCRISGASTAR; CRISGASTARR;<br>RISGASTARRV; ISGASTARRVH; SGASTARRVHK; GASTARRVHKI;<br>ASTARRVHKIR; STARRVHKIRP; TARRVHKIRPA; ARRVHKIRPAT;<br>RRVHKIRPATL; RVHKIRPATLD; VHKIRPATLDE; HKIRPATLDEL;<br>KIRPATLDELE; IRPATLDELET; RPATLDELETI; PATLDELETIT;<br>ATLDELETITK; TLDELETITKA; LDELETITKAM; DELETITKAMP;<br>ELETITKAMPD; LETITKAMPDP; ETITKAMPDPY; TITKAMPDPYQ;<br>ITKAMPDPYQA; TKAMPDPYQAF; KAMPDPYQAFV; AMPDPYQAFVL;<br>MPDPYQAFVLM; PDPYQAFVLMA; DPYQAFVLMAA;<br>PYQAFVLMAAW; YQAFVLMAAWL; QAFVLMAAWLA;<br>AFVLMAAWLAM; FVLMAAWLAMR; VLMAAWLAMRY;<br>LMAAWLAMRYG; MAAWLAMRYGE; AAWLAMRYGEL;<br>AWLAMRYGELT; WLAMRYGELTE; LAMRYGELTEL; AMRYGELTELR;<br>MRYGELTELRR; RYGELTELRRK; YGELTELRRKD; GELTELRRKDI;<br>ELTELRRKDID; LTELRRKDIDL; TELRRKDIDLH; ELRRKDIDLHG;<br>LRRKDIDLHGE; RRKDIDLHGEV; RKDIDLHGEVA; KDIDLHGEVAR;<br>DIDLHGEVARV; IDLHGEVARVR; DLHGEVARVRR; LHGEVARVRRA;<br>HGEVARVRRAV; GEVARVRRAVV; EVARVRRAVVR;<br>VARVRRAVVRV; ARVRRAVVRVG; RVRRAVVRVGE;<br>VRRAVVRVGEG; RRAVVRVGEGF; RAVVRVGEGFK;<br>AVVRVGEGFKV; VVRVGEGFKVT; VRVGEGFKVTT; RVGEGFKVTTP;<br>VGEGFKVTTPK; GEGFKVTTPKS; EGFKVTTPKSD; GFKVTTPKSDA;<br>FKVTTPKSDAG; KVTTPKSDAGV; VTTPKSDAGVR; TTPKSDAGVRD;<br>TPKSDAGVRDI; PKSDAGVRDIS; KSDAGVRDISI; SDAGVRDISIP;<br>DAGVRDISIPP; AGVRDISIPPH; GVRDISIPPHL; VRDISIPPHLI;<br>RDISIPPHLIP; DISIPPHLIPA; ISIPPHLIPAI; SIPPHLIPAIE;<br>IPPHLIPAIED; PPHLIPAIEDH; PHLIPAIEDHL; HLIPAIEDHLH;<br>LIPAIEDHLHK; IPAIEDHLHKH; PAIEDHLHKHV; AIEDHLHKHVN;<br>IEDHLHKHVNP; EDHLHKHVNPG; DHLHKHVNPGR; HLHKHVNPGRE;<br>LHKHVNPGRES; HKHVNPGRESL; KHVNPGRESLL; HVNPGRESLLF;<br>VNPGRESLLFP; NPGRESLLFPS; PGRESLLFPSV; GRESLLFPSVN;<br>RESLLFPSVND; ESLLFPSVNDP; SLLFPSVNDPN; LLFPSVNDPNR;<br>LFPSVNDPNRH; FPSVNDPNRHL; PSVNDPNRHLA; SVNDPNRHLAP;<br>VNDPNRHLAPS; NDPNRHLAPSA; DPNRHLAPSAL; PNRHLAPSALY;<br>NRHLAPSALYR; RHLAPSALYRM; HLAPSALYRMF; LAPSALYRMFY;<br>APSALYRMFYK; PSALYRMFYKA; SALYRMFYKAR; ALYRMFYKARK;<br>LYRMFYKARKA; YRMFYKARKAA; RMFYKARKAAG;<br>MFYKARKAAGR; FYKARKAAGRP; YKARKAAGRPD;<br>KARKAAGRPDL; ARKAAGRPDLR; RKAAGRPDLRV; KAAGRPDLRVH;<br>AAGRPDLRVHD; AGRPDLRVHDL; GRPDLRVHDLR; RPDLRVHDLRH;<br>PDLRVHDLRHS; DLRVHDLRHSG; LRVHDLRHSGA; RVHDLRHSGAV;<br>VHDLRHSGAVL; HDLRHSGAVLA; DLRHSGAVLAA; LRHSGAVLAAS;<br>RHSGAVLAAST; HSGAVLAASTG; SGAVLAASTGA; GAVLAASTGAT;<br>AVLAASTGATL; VLAASTGATLA; LAASTGATLAE; AASTGATLAEL;<br>ASTGATLAELM; STGATLAELMQ; TGATLAELMQR; GATLAELMQRL;<br>ATLAELMQRLG; TLAELMQRLGH; LAELMQRLGHS; AELMQRLGHST;<br>ELMQRLGHSTA; LMQRLGHSTAG; MQRLGHSTAGA;<br>QRLGHSTAGAA; RLGHSTAGAAL; LGHSTAGAALR; GHSTAGAALRY;<br>HSTAGAALRYQ; STAGAALRYQH; TAGAALRYQHA; AGAALRYQHAA;<br>GAALRYQHAAK; AALRYQHAAKG; ALRYQHAAKGR; | |

Fig. 28 continued

| | | |
|---|---|---|
| | LRYQHAAKGRD; RYQHAAKGRDR; YQHAAKGRDRE; QHAAKGRDREI; HAAKGRDREIA; AAKGRDREIAA; AKGRDREIAAL; KGRDREIAALL; GRDREIAALLS; RDREIAALLSK; DREIAALLSKL; REIAALLSKLA; EIAALLSKLAE; IAALLSKLAEN; AALLSKLAENQ; ALLSKLAENQE; LLSKLAENQEM; LSKLAENQEM ; SKLAENQEM | |
| 51) Rv2660c | 8 mers:<br>MIAGVDQA; IAGVDQAL; AGVDQALA; GVDQALAA; VDQALAAT; DQALAATG; QALAATGQ; ALAATGQA; LAATGQAS; AATGQASQ; ATGQASQR; TGQASQRA; GQASQRAA; QASQRAAG; ASQRAAGA; SQRAAGAS; QRAAGASG; RAAGASGG; AAGASGGV; AGASGGVT; GASGGVTV; ASGGVTVG; SGGVTVGV; GGVTVGVG; GVTVGVGV; VTVGVGVG; TVGVGVGT; VGVGVGTE; GVGVGTEQ; VGVGTEQR; GVGTEQRN; VGTEQRNL; GTEQRNLS; TEQRNLSV; EQRNLSVV; QRNLSVVA; RNLSVVAP; NLSVVAPS; LSVVAPSQ; SVVAPSQF; VVAPSQFT; VAPSQFTF; APSQFTFS; PSQFTFSS; SQFTFSSR; QFTFSSRS; FTFSSRSP; TFSSRSPD; FSSRSPDF; SSRSPDFV; SRSPDFVD; RSPDFVDE; SPDFVDET; PDFVDETA; DFVDETAG; FVDETAGQ; VDETAGQS; DETAGQSW; ETAGQSWC; TAGQSWCA; AGQSWCAI; GQSWCAIL; QSWCAILG; SWCAILGL; WCAILGLN; CAILGLNQ; AILGLNQF; ILGLNQFH<br><br>9 mers:<br>MIAGVDQAL; IAGVDQALA; AGVDQALAA; GVDQALAAT; VDQALAATG; DQALAATGQ; QALAATGQA; ALAATGQAS; LAATGQASQ; AATGQASQR; ATGQASQRA; TGQASQRAA; GQASQRAAG; QASQRAAGA; ASQRAAGAS; SQRAAGASG; QRAAGASGG; RAAGASGGV; AAGASGGVT; AGASGGVTV; GASGGVTVG; ASGGVTVGV; SGGVTVGVG; GGVTVGVGV; GVTVGVGVG; VTVGVGVGT; TVGVGVGTE; VGVGVGTEQ; GVGVGTEQR; VGVGTEQRN; GVGTEQRNL; VGTEQRNLS; GTEQRNLSV; TEQRNLSVV; EQRNLSVVA; QRNLSVVAP; RNLSVVAPS; NLSVVAPSQ; LSVVAPSQF; SVVAPSQFT; VVAPSQFTF; VAPSQFTFS; APSQFTFSS; PSQFTFSSR; SQFTFSSRS; QFTFSSRSP; FTFSSRSPD; TFSSRSPDF; FSSRSPDFV; SSRSPDFVD; SRSPDFVDE; RSPDFVDET; SPDFVDETA; PDFVDETAG; DFVDETAGQ; FVDETAGQS; VDETAGQSW; DETAGQSWC; ETAGQSWCA; TAGQSWCAI; AGQSWCAIL; GQSWCAILG; QSWCAILGL; SWCAILGLN; WCAILGLNQ; CAILGLNQF; AILGLNQFH<br><br>10 mers:<br>MIAGVDQALA; IAGVDQALAA; AGVDQALAAT; GVDQALAATG; VDQALAATGQ; DQALAATGQA; QALAATGQAS; ALAATGQASQ; LAATGQASQR; AATGQASQRA; ATGQASQRAA; TGQASQRAAG; GQASQRAAGA; QASQRAAGAS; ASQRAAGASG; SQRAAGASGG; QRAAGASGGV; RAAGASGGVT; AAGASGGVTV; AGASGGVTVG; GASGGVTVGV; ASGGVTVGVG; SGGVTVGVGV; GGVTVGVGVG; GVTVGVGVGT; VTVGVGVGTE; TVGVGVGTEQ; VGVGVGTEQR; GVGVGTEQRN; VGVGTEQRNL; GVGTEQRNLS; VGTEQRNLSV; GTEQRNLSVV; TEQRNLSVVA; EQRNLSVVAP; QRNLSVVAPS; RNLSVVAPSQ; NLSVVAPSQF; LSVVAPSQFT; SVVAPSQFTF; | 38629-38894 |

Fig. 28 continued

| | | |
|---|---|---|
| | VVAPSQFTFS; VAPSQFTFSS; APSQFTFSSR; PSQFTFSSRS; SQFTFSSRSP; QFTFSSRSPD; FTFSSRSPDF; TFSSRSPDFV; FSSRSPDFVD; SSRSPDFVDE; SRSPDFVDET; RSPDFVDETA; SPDFVDETAG; PDFVDETAGQ; DFVDETAGQS; FVDETAGQSW; VDETAGQSWC; DETAGQSWCA; ETAGQSWCAI; TAGQSWCAIL; AGQSWCAILG; GQSWCAILGL; QSWCAILGLN; SWCAILGLNQ; WCAILGLNQF; CAILGLNQFH<br><br>11 mers:<br>MIAGVDQALAA; IAGVDQALAAT; AGVDQALAATG; GVDQALAATGQ; VDQALAATGQA; DQALAATGQAS; QALAATGQASQ; ALAATGQASQR; LAATGQASQRA; AATGQASQRAA; ATGQASQRAAG; TGQASQRAAGA; GQASQRAAGAS; QASQRAAGASG; ASQRAAGASGG; SQRAAGASGGV; QRAAGASGGVT; RAAGASGGVTV; AAGASGGVTVG; AGASGGVTVGV; GASGGVTVGVG; ASGGVTVGVGV; SGGVTVGVGVG; GGVTVGVGVGT; GVTVGVGVGTE; VTVGVGVGTEQ; TVGVGVGTEQR; VGVGVGTEQRN; GVGVGTEQRNL; VGVGTEQRNLS; GVGTEQRNLSV; VGTEQRNLSVV; GTEQRNLSVVA; TEQRNLSVVAP; EQRNLSVVAPS; QRNLSVVAPSQ; RNLSVVAPSQF; NLSVVAPSQFT; LSVVAPSQFTF; SVVAPSQFTFS; VVAPSQFTFSS; VAPSQFTFSSR; APSQFTFSSRS; PSQFTFSSRSP; SQFTFSSRSPD; QFTFSSRSPDF; FTFSSRSPDFV; TFSSRSPDFVD; FSSRSPDFVDE; SSRSPDFVDET; SRSPDFVDETA; RSPDFVDETAG; SPDFVDETAGQ; PDFVDETAGQS; DFVDETAGQSW; FVDETAGQSWC; VDETAGQSWCA; DETAGQSWCAI; ETAGQSWCAIL; TAGQSWCAILG; AGQSWCAILGL; GQSWCAILGLN; QSWCAILGLNQ; SWCAILGLNQF; WCAILGLNQFH | |
| 52)<br>Rv2661c | 8 mers:<br>MRARSDAG; RARSDAGG; ARSDAGGQ; RSDAGGQS; SDAGGQSV; DAGGQSVK; AGGQSVKS; GGQSVKSR; GQSVKSRT; QSVKSRTS; SVKSRTSN; VKSRTSNR; KSRTSNRS; SRTSNRSR; RTSNRSRS; TSNRSRSS; SNRSRSSR; NRSRSSRR; RSRSSRRS; SRSSRRSR; RSSRRSRV; SSRRSRVR; SRRSRVRS; RRSRVRSS; RSRVRSSI; SRVRSSIS; RVRSSISA; VRSSISAL; RSSISALV; SSISALVD; SISALVDN; ISALVDNP; SALVDNPQ; ALVDNPQA; LVDNPQAR; VDNPQARP; DNPQARPR; NPQARPRE; PQARPREL; QARPRELP; ARPRELPV; RPRELPVL; PRELPVLC; RELPVLCG; ELPVLCGW; LPVLCGWP; PVLCGWPV; VLCGWPVV; LCGWPVVR; CGWPVVRV; GWPVVRVE; WPVVRVEP; PVVRVEPV; VVRVEPVC; VRVEPVCE; RVEPVCEF; VEPVCEFV; EPVCEFVP; PVCEFVPE; VCEFVPEP; CEFVPEPV; EFVPEPVC; FVPEPVCG; VPEPVCGQ; PEPVCGQA; EPVCGQAE; PVCGQAEV; VCGQAEVL; CGQAEVLG; GQAEVLGE; QAEVLGEP; AEVLGEPA; EVLGEPAA; VLGEPAAA; LGEPAAAH; GEPAAAHR; EPAAAHRV; PAAAHRVT; AAAHRVTS; AAHRVTSA; AHRVTSAR; HRVTSARR; RVTSARRS; VTSARRSP; TSARRSPS; SARRSPST; ARRSPSTT; RRSPSTTV; RSPSTTVC; SPSTTVCS; PSTTVCSR; STTVCSRS; TTVCSRSQ; TVCSRSQK; VCSRSQKA; CSRSQKAS; SRSQKASA; RSQKASAV; SQKASAVV; QKASAVVI; KASAVVIS; ASAVVISS; SAVVISSV; AVVISSVS; VVISSVSS; VISSVSSV; ISSVSSVA; SSVSSVAR; SVSSVARV; VSSVARVR; SSVARVRR; SVARVRRA; VARVRRAS; ARVRRASV; RVRRASVS; | 38895-<br>39376 |

Fig. 28 continued

| | | |
|---|---|---|
| | VRRASVSS; RRASVSSV; RASVSSVD; ASVSSVDA; SVSSVDAT;<br>VSSVDATT; SSVDATTA<br><br>9 mers:<br>MRARSDAGG; RARSDAGGQ; ARSDAGGQS; RSDAGGQSV;<br>SDAGGQSVK; DAGGQSVKS; AGGQSVKSR; GGQSVKSRT;<br>GQSVKSRTS; QSVKSRTSN; SVKSRTSNR; VKSRTSNRS;<br>KSRTSNRSR; SRTSNRSRS; RTSNRSRSS; TSNRSRSSR;<br>SNRSRSSRR; NRSRSSRRS; RSRSSRRSR; SRSSRRSRV;<br>RSSRRSRVR; SSRRSRVRS; SRRSRVRSS; RRSRVRSSI;<br>RSRVRSSIS; SRVRSSISA; RVRSSISAL; VRSSISALV; RSSISALVD;<br>SSISALVDN; SISALVDNP; ISALVDNPQ; SALVDNPQA; ALVDNPQAR;<br>LVDNPQARP; VDNPQARPR; DNPQARPRE; NPQARPREL;<br>PQARPRELP; QARPRELPV; ARPRELPVL; RPRELPVLC;<br>PRELPVLCG; RELPVLCGW; ELPVLCGWP; LPVLCGWPV;<br>PVLCGWPVV; VLCGWPVVR; LCGWPVVRV; CGWPVVRVE;<br>GWPVVRVEP; WPVVRVEPV; PVVRVEPVC; VVRVEPVCE;<br>VRVEPVCEF; RVEPVCEFV; VEPVCEFVP; EPVCEFVPE;<br>PVCEFVPEP; VCEFVPEPV; CEFVPEPVC; EFVPEPVCG;<br>FVPEPVCGQ; VPEPVCGQA; PEPVCGQAE; EPVCGQAEV;<br>PVCGQAEVL; VCGQAEVLG; CGQAEVLGE; GQAEVLGEP;<br>QAEVLGEPA; AEVLGEPAA; EVLGEPAAA; VLGEPAAAH;<br>LGEPAAAHR; GEPAAAHRV; EPAAAHRVT; PAAAHRVTS;<br>AAAHRVTSA; AAHRVTSAR; AHRVTSARR; HRVTSARRS;<br>RVTSARRSP; VTSARRSPS; TSARRSPST; SARRSPSTT;<br>ARRSPSTTV; RRSPSTTVC; RSPSTTVCS; SPSTTVCSR;<br>PSTTVCSRS; STTVCSRSQ; TTVCSRSQK; TVCSRSQKA;<br>VCSRSQKAS; CSRSQKASA; SRSQKASAV; RSQKASAVV;<br>SQKASAVVI; QKASAVVIS; KASAVVISS; ASAVVISSV; SAVVISSVS;<br>AVVISSVSS; VVISSVSSV; VISSVSSVA; ISSVSSVAR; SSVSSVARV;<br>SVSSVARVR; VSSVARVRR; SSVARVRRA; SVARVRRAS;<br>VARVRRASV; ARVRRASVS; RVRRASVSS; VRRASVSSV;<br>RRASVSSVD; RASVSSVDA; ASVSSVDAT; SVSSVDATT;<br>VSSVDATTA<br><br>10 mers:<br>MRARSDAGGQ; RARSDAGGQS; ARSDAGGQSV; RSDAGGQSVK;<br>SDAGGQSVKS; DAGGQSVKSR; AGGQSVKSRT; GGQSVKSRTS;<br>GQSVKSRTSN; QSVKSRTSNR; SVKSRTSNRS; VKSRTSNRSR;<br>KSRTSNRSRS; SRTSNRSRSS; RTSNRSRSSR; TSNRSRSSRR;<br>SNRSRSSRRS; NRSRSSRRSR; RSRSSRRSRV; SRSSRRSRVR;<br>RSSRRSRVRS; SSRRSRVRSS; SRRSRVRSSI; RRSRVRSSIS;<br>RSRVRSSISA; SRVRSSISAL; RVRSSISALV; VRSSISALVD;<br>RSSISALVDN; SSISALVDNP; SISALVDNPQ; ISALVDNPQA;<br>SALVDNPQAR; ALVDNPQARP; LVDNPQARPR; VDNPQARPRE;<br>DNPQARPREL; NPQARPRELP; PQARPRELPV; QARPRELPVL;<br>ARPRELPVLC; RPRELPVLCG; PRELPVLCGW; RELPVLCGWP;<br>ELPVLCGWPV; LPVLCGWPVV; PVLCGWPVVR; VLCGWPVVRV;<br>LCGWPVVRVE; CGWPVVRVEP; GWPVVRVEPV; WPVVRVEPVC;<br>PVVRVEPVCE; VVRVEPVCEF; VRVEPVCEFV; RVEPVCEFVP;<br>VEPVCEFVPE; EPVCEFVPEP; PVCEFVPEPV; VCEFVPEPVC;<br>CEFVPEPVCG; EFVPEPVCGQ; FVPEPVCGQA; VPEPVCGQAE;<br>PEPVCGQAEV; EPVCGQAEVL; PVCGQAEVLG; VCGQAEVLGE; | |

Fig. 28 continued

| | | |
|---|---|---|
| | CGQAEVLGEP; GQAEVLGEPA; QAEVLGEPAA; AEVLGEPAAA; EVLGEPAAAH; VLGEPAAAHR; LGEPAAAHRV; GEPAAAHRVT; EPAAAHRVTS; PAAAHRVTSA; AAAHRVTSAR; AAHRVTSARR; AHRVTSARRS; HRVTSARRSP; RVTSARRSPS; VTSARRSPST; TSARRSPSTT; SARRSPSTTV; ARRSPSTTVC; RRSPSTTVCS; RSPSTTVCSR; SPSTTVCSRS; PSTTVCSRSQ; STTVCSRSQK; TTVCSRSQKA; TVCSRSQKAS; VCSRSQKASA; CSRSQKASAV; SRSQKASAVV; RSQKASAVVI; SQKASAVVIS; QKASAVVISS; KASAVVISSV; ASAVVISSVS; SAVVISSVSS; AVVISSVSSV; VVISSVSSVA; VISSVSSVAR; ISSVSSVARV; SSVSSVARVR; SVSSVARVRR; VSSVARVRRA; SSVARVRRAS; SVARVRRASV; VARVRRASVS; ARVRRASVSS; RVRRASVSSV; VRRASVSSVD; RRASVSSVDA; RASVSSVDAT; ASVSSVDATT; SVSSVDATTA<br><br>11 mers:<br>MRARSDAGGQS; RARSDAGGQSV; ARSDAGGQSVK; RSDAGGQSVKS; SDAGGQSVKSR; DAGGQSVKSRT; AGGQSVKSRTS; GGQSVKSRTSN; GQSVKSRTSNR; QSVKSRTSNRS; SVKSRTSNRSR; VKSRTSNRSRS; KSRTSNRSRSS; SRTSNRSRSSR; RTSNRSRSSRR; TSNRSRSSRRS; SNRSRSSRRSR; NRSRSSRRSRV; RSRSSRRSRVR; SRSSRRSRVRS; RSSRRSRVRSS; SSRRSRVRSSI; SRRSRVRSSIS; RRSRVRSSISA; RSRVRSSISAL; SRVRSSISALV; RVRSSISALVD; VRSSISALVDN; RSSISALVDNP; SSISALVDNPQ; SISALVDNPQA; ISALVDNPQAR; SALVDNPQARP; ALVDNPQARPR; LVDNPQARPRE; VDNPQARPREL; DNPQARPRELP; NPQARPRELPV; PQARPRELPVL; QARPRELPVLC; ARPRELPVLCG; RPRELPVLCGW; PRELPVLCGWP; RELPVLCGWPV; ELPVLCGWPVV; LPVLCGWPVVR; PVLCGWPVVRV; VLCGWPVVRVE; LCGWPVVRVEP; CGWPVVRVEPV; GWPVVRVEPVC; WPVVRVEPVCE; PVVRVEPVCEF; VVRVEPVCEFV; VRVEPVCEFVP; RVEPVCEFVPE; VEPVCEFVPEP; EPVCEFVPEPV; PVCEFVPEPVC; VCEFVPEPVCG; CEFVPEPVCGQ; EFVPEPVCGQA; FVPEPVCGQAE; VPEPVCGQAEV; PEPVCGQAEVL; EPVCGQAEVLG; PVCGQAEVLGE; VCGQAEVLGEP; CGQAEVLGEPA; GQAEVLGEPAA; QAEVLGEPAAA; AEVLGEPAAAH; EVLGEPAAAHR; VLGEPAAAHRV; LGEPAAAHRVT; GEPAAAHRVTS; EPAAAHRVTSA; PAAAHRVTSAR; AAAHRVTSARR; AAHRVTSARRS; AHRVTSARRSP; HRVTSARRSPS; RVTSARRSPST; VTSARRSPSTT; TSARRSPSTTV; SARRSPSTTVC; ARRSPSTTVCS; RRSPSTTVCSR; RSPSTTVCSRS; SPSTTVCSRSQ; PSTTVCSRSQK; STTVCSRSQKA; TTVCSRSQKAS; TVCSRSQKASA; VCSRSQKASAV; CSRSQKASAVV; SRSQKASAVVI; RSQKASAVVIS; SQKASAVVISS; QKASAVVISSV; KASAVVISSVS; ASAVVISSVSS; SAVVISSVSSV; AVVISSVSSVA; VVISSVSSVAR; VISSVSSVARV; ISSVSSVARVR; SSVSSVARVRR; SVSSVARVRRA; VSSVARVRRAS; SSVARVRRASV; SVARVRRASVS; VARVRRASVSS; ARVRRASVSSV; RVRRASVSSVD; VRRASVSSVDA; RRASVSSVDAT; RASVSSVDATT; ASVSSVDATTA | |
| 53) Rv2662 | 8 mers:<br>MDDLTRLR; DDLTRLRR; DLTRLRRE; LTRLRREL; TRLRRELL; RLRRELLD; LRRELLDR; RRELLDRF; RELLDRFD; ELLDRFDV; LLDRFDVR; LDRFDVRD; DRFDVRDF; RFDVRDFT; FDVRDFTD; | 39377-39702 |

Fig. 28 continued

| | | |
|---|---|---|
| | DVRDFTDW; VRDFTDWP; RDFTDWPP; DFTDWPPA; FTDWPPAS; TDWPPASL; DWPPASLR; WPPASLRA; PPASLRAL; PASLRALI; ASLRALIA; SLRALIAT; LRALIATY; RALIATYD; ALIATYDP; LIATYDPW; IATYDPWI; ATYDPWID; TYDPWIDM; YDPWIDMT; DPWIDMTA; PWIDMTAS; WIDMTASP; IDMTASPP; DMTASPPQ; MTASPPQP; TASPPQPV; ASPPQPVS; SPPQPVSP; PPQPVSPG; PQPVSPGG; QPVSPGGP; PVSPGGPR; VSPGGPRL; SPGGPRLR; PGGPRLRL; GGPRLRLV; GPRLRLVR; PRLRLVRL; RLRLVRLT; LRLVRLTT; RLVRLTTN; LVRLTTNP; VRLTTNPS; RLTTNPSA; LTTNPSAR; TTNPSARA; TNPSARAA; NPSARAAP; PSARAAPI; SARAAPIG; ARAAPIGN; RAAPIGNG; AAPIGNGG; APIGNGGD; PIGNGGDS; IGNGGDSS; GNGGDSSV; NGGDSSVC; GGDSSVCA; GDSSVCAG; DSSVCAGE; SSVCAGEK; SVCAGEKQ; VCAGEKQC; CAGEKQCR; AGEKQCRP; GEKQCRPP<br><br>9 mers:<br>MDDLTRLRR; DDLTRLRRE; DLTRLRREL; LTRLRRELL; TRLRRELLD; RLRRELLDR; LRRELLDRF; RRELLDRFD; RELLDRFDV; ELLDRFDVR; LLDRFDVRD; LDRFDVRDF; DRFDVRDFT; RFDVRDFTD; FDVRDFTDW; DVRDFTDWP; VRDFTDWPP; RDFTDWPPA; DFTDWPPAS; FTDWPPASL; TDWPPASLR; DWPPASLRA; WPPASLRAL; PPASLRALI; PASLRALIA; ASLRALIAT; SLRALIATY; LRALIATYD; RALIATYDP; ALIATYDPW; LIATYDPWI; IATYDPWID; ATYDPWIDM; TYDPWIDMT; YDPWIDMTA; DPWIDMTAS; PWIDMTASP; WIDMTASPP; IDMTASPPQ; DMTASPPQP; MTASPPQPV; TASPPQPVS; ASPPQPVSP; SPPQPVSPG; PPQPVSPGG; PQPVSPGGP; QPVSPGGPR; PVSPGGPRL; VSPGGPRLR; SPGGPRLRL; PGGPRLRLV; GGPRLRLVR; GPRLRLVRL; PRLRLVRLT; RLRLVRLTT; LRLVRLTTN; RLVRLTTNP; LVRLTTNPS; VRLTTNPSA; RLTTNPSAR; LTTNPSARA; TTNPSARAA; TNPSARAAP; NPSARAAPI; PSARAAPIG; SARAAPIGN; ARAAPIGNG; RAAPIGNGG; AAPIGNGGD; APIGNGGDS; PIGNGGDSS; IGNGGDSSV; GNGGDSSVC; NGGDSSVCA; GGDSSVCAG; GDSSVCAGE; DSSVCAGEK; SSVCAGEKQ; SVCAGEKQC; VCAGEKQCR; CAGEKQCRP; AGEKQCRPP<br><br>10 mers:<br>MDDLTRLRRE; DDLTRLRREL; DLTRLRRELL; LTRLRRELLD; TRLRRELLDR; RLRRELLDRF; LRRELLDRFD; RRELLDRFDV; RELLDRFDVR; ELLDRFDVRD; LLDRFDVRDF; LDRFDVRDFT; DRFDVRDFTD; RFDVRDFTDW; FDVRDFTDWP; DVRDFTDWPP; VRDFTDWPPA; RDFTDWPPAS; DFTDWPPASL; FTDWPPASLR; TDWPPASLRA; DWPPASLRAL; WPPASLRALI; PPASLRALIA; PASLRALIAT; ASLRALIATY; SLRALIATYD; LRALIATYDP; RALIATYDPW; ALIATYDPWI; LIATYDPWID; IATYDPWIDM; ATYDPWIDMT; TYDPWIDMTA; YDPWIDMTAS; DPWIDMTASP; PWIDMTASPP; WIDMTASPPQ; IDMTASPPQP; DMTASPPQPV; MTASPPQPVS; TASPPQPVSP; ASPPQPVSPG; SPPQPVSPGG; PPQPVSPGGP; PQPVSPGGPR; QPVSPGGPRL; PVSPGGPRLR; VSPGGPRLRL; SPGGPRLRLV; PGGPRLRLVR; GGPRLRLVRL; GPRLRLVRLT; PRLRLVRLTT; RLRLVRLTTN; LRLVRLTTNP; RLVRLTTNPS; LVRLTTNPSA; VRLTTNPSAR; RLTTNPSARA; LTTNPSARAA; TTNPSARAAP; TNPSARAAPI; NPSARAAPIG; | |

Fig. 28 continued

| | | |
|---|---|---|
| | PSARAAPIGN; SARAAPIGNG; ARAAPIGNGG; RAAPIGNGGD; AAPIGNGGDS; APIGNGGDSS; PIGNGGDSSV; IGNGGDSSVC; GNGGDSSVCA; NGGDSSVCAG; GGDSSVCAGE; GDSSVCAGEK; DSSVCAGEKQ; SSVCAGEKQC; SVCAGEKQCR; VCAGEKQCRP; CAGEKQCRPP<br><br>11 mers:<br>MDDLTRLRREL; DDLTRLRRELL; DLTRLRRELLD; LTRLRRELLDR; TRLRRELLDRF; RLRRELLDRFD; LRRELLDRFDV; RRELLDRFDVR; RELLDRFDVRD; ELLDRFDVRDF; LLDRFDVRDFT; LDRFDVRDFTD; DRFDVRDFTDW; RFDVRDFTDWP; FDVRDFTDWPP; DVRDFTDWPPA; VRDFTDWPPAS; RDFTDWPPASL; DFTDWPPASLR; FTDWPPASLRA; TDWPPASLRAL; DWPPASLRALI; WPPASLRALIA; PPASLRALIAT; PASLRALIATY; ASLRALIATYD; SLRALIATYDP; LRALIATYDPW; RALIATYDPWI; ALIATYDPWID; LIATYDPWIDM; IATYDPWIDMT; ATYDPWIDMTA; TYDPWIDMTAS; YDPWIDMTASP; DPWIDMTASPP; PWIDMTASPPQ; WIDMTASPPQP; IDMTASPPQPV; DMTASPPQPVS; MTASPPQPVSP; TASPPQPVSPG; ASPPQPVSPGG; SPPQPVSPGGP; PPQPVSPGGPR; PQPVSPGGPRL; QPVSPGGPRLR; PVSPGGPRLRL; VSPGGPRLRLV; SPGGPRLRLVR; PGGPRLRLVRL; GGPRLRLVRLT; GPRLRLVRLTT; PRLRLVRLTTN; RLRLVRLTTNP; LRLVRLTTNPS; RLVRLTTNPSA; LVRLTTNPSAR; VRLTTNPSARA; RLTTNPSARAA; LTTNPSARAAP; TTNPSARAAPI; TNPSARAAPIG; NPSARAAPIGN; PSARAAPIGNG; SARAAPIGNGG; ARAAPIGNGGD; RAAPIGNGGDS; AAPIGNGGDSS; APIGNGGDSSV; PIGNGGDSSVC; IGNGGDSSVCA; GNGGDSSVCAG; NGGDSSVCAGE; GGDSSVCAGEK; GDSSVCAGEKQ; DSSVCAGEKQC; SSVCAGEKQCR; SVCAGEKQCRP; VCAGEKQCRPP | |
| 54) Rv2663 | 8 mers:<br>MEVRASAR; EVRASARK; VRASARKH; RASARKHG; ASARKHGI; SARKHGIN; ARKHGIND; RKHGINDD; KHGINDDA; HGINDDAM; GINDDAML; INDDAMLH; NDDAMLHA; DDAMLHAY; DAMLHAYR; AMLHAYRN; MLHAYRNA; LHAYRNAL; HAYRNALR; AYRNALRY; YRNALRYV; RNALRYVE; NALRYVEL; ALRYVELE; LRYVELEY; RYVELEYH; YVELEYHG; VELEYHGE; ELEYHGEV; LEYHGEVQ; EYHGEVQL; YHGEVQLL; HGEVQLLV; GEVQLLVI; EVQLLVIG; VQLLVIGP; QLLVIGPD; LLVIGPDQ; LVIGPDQT; VIGPDQTG; IGPDQTGR; GPDQTGRL; PDQTGRLL; DQTGRLLE; QTGRLLEL; TGRLLELV; GRLLELVI; RLLELVIP; LLELVIPA; LELVIPAD; ELVIPADE; LVIPADEP; VIPADEPP; IPADEPPR; PADEPPRI; ADEPPRII; DEPPRIIH; EPPRIIHA; PPRIIHAN; PRIIHANV; RIIHANVL; IIHANVLR; IHANVLRP; HANVLRPK; ANVLRPKF; NVLRPKFY; VLRPKFYD; LRPKFYDY; RPKFYDYL; PKFYDYLR<br><br>9 mers:<br>MEVRASARK; EVRASARKH; VRASARKHG; RASARKHGI; ASARKHGIN; SARKHGIND; ARKHGINDD; RKHGINDDA; KHGINDDAM; HGINDDAML; GINDDAMLH; INDDAMLHA; NDDAMLHAY; DDAMLHAYR; DAMLHAYRN; AMLHAYRNA; MLHAYRNAL; LHAYRNALR; HAYRNALRY; AYRNALRYV; YRNALRYVE; RNALRYVEL; NALRYVELE; ALRYVELEY; LRYVELEYH; | 39703-39976 |

Fig. 28 continued

| | | |
|---|---|---|
| | RYVELEYHG; YVELEYHGE; VELEYHGEV; ELEYHGEVQ; LEYHGEVQL; EYHGEVQLL; YHGEVQLLV; HGEVQLLVI; GEVQLLVIG; EVQLLVIGP; VQLLVIGPD; QLLVIGPDQ; LLVIGPDQT; LVIGPDQTG; VIGPDQTGR; IGPDQTGRL; GPDQTGRLL; PDQTGRLLE; DQTGRLLEL; QTGRLLELV; TGRLLELVI; GRLLELVIP; RLLELVIPA; LLELVIPAD; LELVIPADE; ELVIPADEP; LVIPADEPP; VIPADEPPR; IPADEPPRI; PADEPPRII; ADEPPRIIH; DEPPRIIHA; EPPRIIHAN; PPRIIHANV; PRIIHANVL; RIIHANVLR; IIHANVLRP; IHANVLRPK; HANVLRPKF; ANVLRPKFY; NVLRPKFYD; VLRPKFYDY; LRPKFYDYL; RPKFYDYLR<br><br>10 mers:<br>MEVRASARKH; EVRASARKHG; VRASARKHGI; RASARKHGIN; ASARKHGIND; SARKHGINDD; ARKHGINDDA; RKHGINDDAM; KHGINDDAML; HGINDDAMLH; GINDDAMLHA; INDDAMLHAY; NDDAMLHAYR; DDAMLHAYRN; DAMLHAYRNA; AMLHAYRNAL; MLHAYRNALR; LHAYRNALRY; HAYRNALRYV; AYRNALRYVE; YRNALRYVEL; RNALRYVELE; NALRYVELEY; ALRYVELEYH; LRYVELEYHG; RYVELEYHGE; YVELEYHGEV; VELEYHGEVQ; ELEYHGEVQL; LEYHGEVQLL; EYHGEVQLLV; YHGEVQLLVI; HGEVQLLVIG; GEVQLLVIGP; EVQLLVIGPD; VQLLVIGPDQ; QLLVIGPDQT; LLVIGPDQTG; LVIGPDQTGR; VIGPDQTGRL; IGPDQTGRLL; GPDQTGRLLE; PDQTGRLLEL; DQTGRLLELV; QTGRLLELVI; TGRLLELVIP; GRLLELVIPA; RLLELVIPAD; LLELVIPADE; LELVIPADEP; ELVIPADEPP; LVIPADEPPR; VIPADEPPRI; IPADEPPRII; PADEPPRIIH; ADEPPRIIHA; DEPPRIIHAN; EPPRIIHANV; PPRIIHANVL; PRIIHANVLR; RIIHANVLRP; IIHANVLRPK; IHANVLRPKF; HANVLRPKFY; ANVLRPKFYD; NVLRPKFYDY; VLRPKFYDYL; LRPKFYDYLR<br><br>11 mers:<br>MEVRASARKHG; EVRASARKHGI; VRASARKHGIN; RASARKHGIND; ASARKHGINDD; SARKHGINDDA; ARKHGINDDAM; RKHGINDDAML; KHGINDDAMLH; HGINDDAMLHA; GINDDAMLHAY; INDDAMLHAYR; NDDAMLHAYRN; DDAMLHAYRNA; DAMLHAYRNAL; AMLHAYRNALR; MLHAYRNALRY; LHAYRNALRYV; HAYRNALRYVE; AYRNALRYVEL; YRNALRYVELE; RNALRYVELEY; NALRYVELEYH; ALRYVELEYHG; LRYVELEYHGE; RYVELEYHGEV; YVELEYHGEVQ; VELEYHGEVQL; ELEYHGEVQLL; LEYHGEVQLLV; EYHGEVQLLVI; YHGEVQLLVIG; HGEVQLLVIGP; GEVQLLVIGPD; EVQLLVIGPDQ; VQLLVIGPDQT; QLLVIGPDQTG; LLVIGPDQTGR; LVIGPDQTGRL; VIGPDQTGRLL; IGPDQTGRLLE; GPDQTGRLLEL; PDQTGRLLELV; DQTGRLLELVI; QTGRLLELVIP; TGRLLELVIPA; GRLLELVIPAD; RLLELVIPADE; LLELVIPADEP; LELVIPADEPP; ELVIPADEPPR; LVIPADEPPRI; VIPADEPPRII; IPADEPPRIIH; PADEPPRIIHA; ADEPPRIIHAN; DEPPRIIHANV; EPPRIIHANVL; PPRIIHANVLR; PRIIHANVLRP; RIIHANVLRPK; IIHANVLRPKF; IHANVLRPKFY; HANVLRPKFYD; ANVLRPKFYDY; NVLRPKFYDYL; VLRPKFYDYLR | |
| 55) Rv2745c | 8 mers:<br>MSVGFVTP; SVGFVTPV; VGFVTPVG; GFVTPVGV; FVTPVGVR; VTPVGVRW; TPVGVRWS; PVGVRWSD; VGVRWSDI; GVRWSDID; VRWSDIDM; RWSDIDMY; WSDIDMYQ; SDIDMYQH; DIDMYQHV; | 39977-40494 |

Fig. 28 continued

| | | | |
|---|---|---|---|
| | IDMYQHVN; DMYQHVNH; MYQHVNHA; YQHVNHAT; QHVNHATM; HVNHATMV; VNHATMVT; NHATMVTI; HATMVTIL; ATMVTILE; TMVTILEE; MVTILEEA; VTILEEAR; TILEEARV; ILEEARVP; LEEARVPF; EEARVPFL; EARVPFLK; ARVPFLKD; RVPFLKDA; VPFLKDAF; PFLKDAFG; FLKDAFGA; LKDAFGAD; KDAFGADI; DAFGADIT; AFGADITS; FGADITST; GADITSTG; ADITSTGL; DITSTGLL; ITSTGLLI; TSTGLLIA; STGLLIAD; TGLLIADV; GLLIADVR; LLIADVRV; LIADVRVT; IADVRVTY; ADVRVTYK; DVRVTYKG; VRVTYKGQ; RVTYKGQL; VTYKGQLR; TYKGQLRL; YKGQLRLS; KGQLRLSD; GQLRLSDS; QLRLSDSP; LRLSDSPL; RLSDSPLQ; LSDSPLQV; SDSPLQVT; DSPLQVTI; SPLQVTIW; PLQVTIWT; LQVTIWTK; QVTIWTKR; VTIWTKRL; TIWTKRLR; IWTKRLRA; WTKRLRAV; TKRLRAVD; KRLRAVDF; RLRAVDFT; LRAVDFTL; RAVDFTLG; AVDFTLGY; VDFTLGYE; DFTLGYEV; FTLGYEVR; TLGYEVRS; LGYEVRSV; GYEVRSVN; YEVRSVNA; EVRSVNAE; VRSVNAEP; RSVNAEPD; SVNAEPDS; VNAEPDSR; NAEPDSRP; AEPDSRPA; EPDSRPAV; PDSRPAVI; DSRPAVIA; SRPAVIAE; RPAVIAES; PAVIAESQ; AVIAESQL; VIAESQLA; IAESQLAA; AESQLAAF; ESQLAAFH; SQLAAFHI; QLAAFHIE; LAAFHIEE; AAFHIEEQ; AFHIEEQR; FHIEEQRL; HIEEQRLV; IEEQRLVR; EEQRLVRL; EQRLVRLS; QRLVRLSP; RLVRLSPH; LVRLSPHH; VRLSPHHR; RLSPHHRE; LSPHHREY; SPHHREYL; PHHREYLQ; HHREYLQR; HREYLQRW; REYLQRWF; EYLQRWFR; YLQRWFRG<br><br>9 mers:<br>MSVGFVTPV; SVGFVTPVG; VGFVTPVGV; GFVTPVGVR; FVTPVGVRW; VTPVGVRWS; TPVGVRWSD; PVGVRWSDI; VGVRWSDID; GVRWSDIDM; VRWSDIDMY; RWSDIDMYQ; WSDIDMYQH; SDIDMYQHV; DIDMYQHVN; IDMYQHVNH; DMYQHVNHA; MYQHVNHAT; YQHVNHATM; QHVNHATMV; HVNHATMVT; VNHATMVTI; NHATMVTIL; HATMVTILE; ATMVTILEE; TMVTILEEA; MVTILEEAR; VTILEEARV; TILEEARVP; ILEEARVPF; LEEARVPFL; EEARVPFLK; EARVPFLKD; ARVPFLKDA; RVPFLKDAF; VPFLKDAFG; PFLKDAFGA; FLKDAFGAD; LKDAFGADI; KDAFGADIT; DAFGADITS; AFGADITST; FGADITSTG; GADITSTGL; ADITSTGLL; DITSTGLLI; ITSTGLLIA; TSTGLLIAD; STGLLIADV; TGLLIADVR; GLLIADVRV; LLIADVRVT; LIADVRVTY; IADVRVTYK; ADVRVTYKG; DVRVTYKGQ; VRVTYKGQL; RVTYKGQLR; VTYKGQLRL; TYKGQLRLS; YKGQLRLSD; KGQLRLSDS; GQLRLSDSP; QLRLSDSPL; LRLSDSPLQ; RLSDSPLQV; LSDSPLQVT; SDSPLQVTI; DSPLQVTIW; SPLQVTIWT; PLQVTIWTK; LQVTIWTKR; QVTIWTKRL; VTIWTKRLR; TIWTKRLRA; IWTKRLRAV; WTKRLRAVD; TKRLRAVDF; KRLRAVDFT; RLRAVDFTL; LRAVDFTLG; RAVDFTLGY; AVDFTLGYE; VDFTLGYEV; DFTLGYEVR; FTLGYEVRS; TLGYEVRSV; LGYEVRSVN; GYEVRSVNA; YEVRSVNAE; EVRSVNAEP; VRSVNAEPD; RSVNAEPDS; SVNAEPDSR; VNAEPDSRP; NAEPDSRPA; AEPDSRPAV; EPDSRPAVI; PDSRPAVIA; DSRPAVIAE; SRPAVIAES; RPAVIAESQ; PAVIAESQL; AVIAESQLA; VIAESQLAA; IAESQLAAF; AESQLAAFH; ESQLAAFHI; SQLAAFHIE; QLAAFHIEE; LAAFHIEEQ; AAFHIEEQR; AFHIEEQRL; FHIEEQRLV; HIEEQRLVR; IEEQRLVRL; EEQRLVRLS; EQRLVRLSP; QRLVRLSPH; RLVRLSPHH; LVRLSPHHR; VRLSPHHRE; RLSPHHREY; LSPHHREYL; SPHHREYLQ; PHHREYLQR; HHREYLQRW; HREYLQRWF; | |

Fig. 28 continued

REYLQRWFR; EYLQRWFRG 10 mers:
MSVGFVTPVG; SVGFVTPVGV; VGFVTPVGVR; GFVTPVGVRW; FVTPVGVRWS; VTPVGVRWSD; TPVGVRWSDI; PVGVRWSDID; VGVRWSDIDM; GVRWSDIDMY; VRWSDIDMYQ; RWSDIDMYQH; WSDIDMYQHV; SDIDMYQHVN; DIDMYQHVNH; IDMYQHVNHA; DMYQHVNHAT; MYQHVNHATM; YQHVNHATMV; QHVNHATMVT; HVNHATMVTI; VNHATMVTIL; NHATMVTILE; HATMVTILEE; ATMVTILEEA; TMVTILEEAR; MVTILEEARV; VTILEEARVP; TILEEARVPF; ILEEARVPFL; LEEARVPFLK; EEARVPFLKD; EARVPFLKDA; ARVPFLKDAF; RVPFLKDAFG; VPFLKDAFGA; PFLKDAFGAD; FLKDAFGADI; LKDAFGADIT; KDAFGADITS; DAFGADITST; AFGADITSTG; FGADITSTGL; GADITSTGLL; ADITSTGLLI; DITSTGLLIA; ITSTGLLIAD; TSTGLLIADV; STGLLIADVR; TGLLIADVRV; GLLIADVRVT; LLIADVRVTY; LIADVRVTYK; IADVRVTYKG; ADVRVTYKGQ; DVRVTYKGQL; VRVTYKGQLR; RVTYKGQLRL; VTYKGQLRLS; TYKGQLRLSD; YKGQLRLSDS; KGQLRLSDSP; GQLRLSDSPL; QLRLSDSPLQ; LRLSDSPLQV; RLSDSPLQVT; LSDSPLQVTI; SDSPLQVTIW; DSPLQVTIWT; SPLQVTIWTK; PLQVTIWTKR; LQVTIWTKRL; QVTIWTKRLR; VTIWTKRLRA; TIWTKRLRAV; IWTKRLRAVD; WTKRLRAVDF; TKRLRAVDFT; KRLRAVDFTL; RLRAVDFTLG; LRAVDFTLGY; RAVDFTLGYE; AVDFTLGYEV; VDFTLGYEVR; DFTLGYEVRS; FTLGYEVRSV; TLGYEVRSVN; LGYEVRSVNA; GYEVRSVNAE; YEVRSVNAEP; EVRSVNAEPD; VRSVNAEPDS; RSVNAEPDSR; SVNAEPDSRP; VNAEPDSRPA; NAEPDSRPAV; AEPDSRPAVI; EPDSRPAVIA; PDSRPAVIAE; DSRPAVIAES; SRPAVIAESQ; RPAVIAESQL; PAVIAESQLA; AVIAESQLAA; VIAESQLAAF; IAESQLAAFH; AESQLAAFHI; ESQLAAFHIE; SQLAAFHIEE; QLAAFHIEEQ; LAAFHIEEQR; AAFHIEEQRL; AFHIEEQRLV; FHIEEQRLVR; HIEEQRLVRL; IEEQRLVRLS; EEQRLVRLSP; EQRLVRLSPH; QRLVRLSPHH; RLVRLSPHHR; LVRLSPHHRE; VRLSPHHREY; RLSPHHREYL; LSPHHREYLQ; SPHHREYLQR; PHHREYLQRW; HHREYLQRWF; HREYLQRWFR; REYLQRWFRG 11 mers:
MSVGFVTPVGV; SVGFVTPVGVR; VGFVTPVGVRW; GFVTPVGVRWS; FVTPVGVRWSD; VTPVGVRWSDI; TPVGVRWSDID; PVGVRWSDIDM; VGVRWSDIDMY; GVRWSDIDMYQ; VRWSDIDMYQH; RWSDIDMYQHV; WSDIDMYQHVN; SDIDMYQHVNH; DIDMYQHVNHA; IDMYQHVNHAT; DMYQHVNHATM; MYQHVNHATMV; YQHVNHATMVT; QHVNHATMVTI; HVNHATMVTIL; VNHATMVTILE; NHATMVTILEE; HATMVTILEEA; ATMVTILEEAR; TMVTILEEARV; MVTILEEARVP; VTILEEARVPF; TILEEARVPFL; ILEEARVPFLK; LEEARVPFLKD; EEARVPFLKDA; EARVPFLKDAF; ARVPFLKDAFG; RVPFLKDAFGA; VPFLKDAFGAD; PFLKDAFGADI; FLKDAFGADIT; LKDAFGADITS; KDAFGADITST; DAFGADITSTG; AFGADITSTGL; FGADITSTGLL; GADITSTGLLI; ADITSTGLLIA; DITSTGLLIAD; ITSTGLLIADV; TSTGLLIADVR; STGLLIADVRV; TGLLIADVRVT; GLLIADVRVTY; LLIADVRVTYK; LIADVRVTYKG; IADVRVTYKGQ; ADVRVTYKGQL; DVRVTYKGQLR; VRVTYKGQLRL; RVTYKGQLRLS; VTYKGQLRLSD;

Fig. 28 continued

| | | |
|---|---|---|
| | TYKGQLRLSDS; YKGQLRLSDSP; KGQLRLSDSPL; GQLRLSDSPLQ; QLRLSDSPLQV; LRLSDSPLQVT; RLSDSPLQVTI; LSDSPLQVTIW; SDSPLQVTIWT; DSPLQVTIWTK; SPLQVTIWTKR; PLQVTIWTKRL; LQVTIWTKRLR; QVTIWTKRLRA; VTIWTKRLRAV; TIWTKRLRAVD; IWTKRLRAVDF; WTKRLRAVDFT; TKRLRAVDFTL; KRLRAVDFTLG; RLRAVDFTLGY; LRAVDFTLGYE; RAVDFTLGYEV; AVDFTLGYEVR; VDFTLGYEVRS; DFTLGYEVRSV; FTLGYEVRSVN; TLGYEVRSVNA; LGYEVRSVNAE; GYEVRSVNAEP; YEVRSVNAEPD; EVRSVNAEPDS; VRSVNAEPDSR; RSVNAEPDSRP; SVNAEPDSRPA; VNAEPDSRPAV; NAEPDSRPAVI; AEPDSRPAVIA; EPDSRPAVIAE; PDSRPAVIAES; DSRPAVIAESQ; SRPAVIAESQL; RPAVIAESQLA; PAVIAESQLAA; AVIAESQLAAF; VIAESQLAAFH; IAESQLAAFHI; AESQLAAFHIE; ESQLAAFHIEE; SQLAAFHIEEQ; QLAAFHIEEQR; LAAFHIEEQRL; AAFHIEEQRLV; AFHIEEQRLVR; FHIEEQRLVRL; HIEEQRLVRLS; IEEQRLVRLSP; EEQRLVRLSPH; EQRLVRLSPHH; QRLVRLSPHHR; RLVRLSPHHRE; LVRLSPHHREY; VRLSPHHREYL; RLSPHHREYLQ; LSPHHREYLQR; SPHHREYLQRW; PHHREYLQRWF; HHREYLQRWFR; HREYLQRWFRG | |
| 56) Rv3019c | 8 mers:<br>MSQIMYNY; SQIMYNYP; QIMYNYPA; IMYNYPAM; MYNYPAMM; YNYPAMMA; NYPAMMAH; YPAMMAHA; PAMMAHAG; AMMAHAGD; MMAHAGDM; MAHAGDMA; AHAGDMAG; HAGDMAGY; AGDMAGYA; GDMAGYAG; DMAGYAGT; MAGYAGTL; AGYAGTLQ; GYAGTLQS; YAGTLQSL; AGTLQSLG; GTLQSLGA; TLQSLGAD; LQSLGADI; QSLGADIA; SLGADIAS; LGADIASE; GADIASEQ; ADIASEQA; DIASEQAV; IASEQAVL; ASEQAVLS; SEQAVLSS; EQAVLSSA; QAVLSSAW; AVLSSAWQ; VLSSAWQG; LSSAWQGD; SSAWQGDT; SAWQGDTG; AWQGDTGI; WQGDTGIT; QGDTGITY; GDTGITYQ; DTGITYQG; TGITYQGW; GITYQGWQ; ITYQGWQT; TYQGWQTQ; YQGWQTQW; QGWQTQWN; GWQTQWNQ; WQTQWNQA; QTQWNQAL; TQWNQALE; QWNQALED; WNQALEDL; NQALEDLV; QALEDLVR; ALEDLVRA; LEDLVRAY; EDLVRAYQ; DLVRAYQS; LVRAYQSM; VRAYQSMS; RAYQSMSG; AYQSMSGT; YQSMSGTH; QSMSGTHE; SMSGTHES; MSGTHESN; SGTHESNT; GTHESNTM; THESNTMA; HESNTMAM; ESNTMAML; SNTMAMLA; NTMAMLAR; TMAMLARD; MAMLARDG; AMLARDGA; MLARDGAE; LARDGAEA; ARDGAEAA; RDGAEAAK; DGAEAAKW; GAEAAKWG; AEAAKWGG;<br><br>9 mers:<br>MSQIMYNYP; SQIMYNYPA; QIMYNYPAM; IMYNYPAMM; MYNYPAMMA; YNYPAMMAH; NYPAMMAHA; YPAMMAHAG; PAMMAHAGD; AMMAHAGDM; MMAHAGDMA; MAHAGDMAG; AHAGDMAGY; HAGDMAGYA; AGDMAGYAG; GDMAGYAGT; DMAGYAGTL; MAGYAGTLQ; AGYAGTLQS; GYAGTLQSL; YAGTLQSLG; AGTLQSLGA; GTLQSLGAD; TLQSLGADI; LQSLGADIA; QSLGADIAS; SLGADIASE; LGADIASEQ; GADIASEQA; ADIASEQAV; DIASEQAVL; IASEQAVLS; ASEQAVLSS; SEQAVLSSA; EQAVLSSAW; QAVLSSAWQ; AVLSSAWQG; VLSSAWQGD; LSSAWQGDT; SSAWQGDTG; SAWQGDTGI; AWQGDTGIT; WQGDTGITY; QGDTGITYQ; GDTGITYQG; DTGITYQGW; TGITYQGWQ; GITYQGWQT; ITYQGWQTQ; TYQGWQTQW; YQGWQTQWN; QGWQTQWNQ; GWQTQWNQA; WQTQWNQAL; QTQWNQALE; | 40495-40844 |

Fig. 28 continued

| | | |
|---|---|---|
| | TQWNQALED; QWNQALEDL; WNQALEDLV; NQALEDLVR; QALEDLVRA; ALEDLVRAY; LEDLVRAYQ; EDLVRAYQS; DLVRAYQSM; LVRAYQSMS; VRAYQSMSG; RAYQSMSGT; AYQSMSGTH; YQSMSGTHE; QSMSGTHES; SMSGTHESN; MSGTHESNT; SGTHESNTM; GTHESNTMA; THESNTMAM; HESNTMAML; ESNTMAMLA; SNTMAMLAR; NTMAMLARD; TMAMLARDG; MAMLARDGA; AMLARDGAE; MLARDGAEA; LARDGAEAA; ARDGAEAAK; RDGAEAAKW; DGAEAAKWG; GAEAAKWGG;<br><br>10 mers:<br>MSQIMYNYPA; SQIMYNYPAM; QIMYNYPAMM; IMYNYPAMMA; MYNYPAMMAH; YNYPAMMAHA; NYPAMMAHAG; YPAMMAHAGD; PAMMAHAGDM; AMMAHAGDMA; MMAHAGDMAG; MAHAGDMAGY; AHAGDMAGYA; HAGDMAGYAG; AGDMAGYAGT; GDMAGYAGTL; DMAGYAGTLQ; MAGYAGTLQS; AGYAGTLQSL; GYAGTLQSLG; YAGTLQSLGA; AGTLQSLGAD; GTLQSLGADI; TLQSLGADIA; LQSLGADIAS; QSLGADIASE; SLGADIASEQ; LGADIASEQA; GADIASEQAV; ADIASEQAVL; DIASEQAVLS; IASEQAVLSS; ASEQAVLSSA; SEQAVLSSAW; EQAVLSSAWQ; QAVLSSAWQG; AVLSSAWQGD; VLSSAWQGDT; LSSAWQGDTG; SSAWQGDTGI; SAWQGDTGIT; AWQGDTGITY; WQGDTGITYQ; QGDTGITYQG; GDTGITYQGW; DTGITYQGWQ; TGITYQGWQT; GITYQGWQTQ; ITYQGWQTQW; TYQGWQTQWN; YQGWQTQWNQ; QGWQTQWNQA; GWQTQWNQAL; WQTQWNQALE; QTQWNQALED; TQWNQALEDL; QWNQALEDLV; WNQALEDLVR; NQALEDLVRA; QALEDLVRAY; ALEDLVRAYQ; LEDLVRAYQS; EDLVRAYQSM; DLVRAYQSMS; LVRAYQSMSG; VRAYQSMSGT; RAYQSMSGTH; AYQSMSGTHE; YQSMSGTHES; QSMSGTHESN; SMSGTHESNT; MSGTHESNTM; SGTHESNTMA; GTHESNTMAM; THESNTMAML; HESNTMAMLA; ESNTMAMLAR; SNTMAMLARD; NTMAMLARDG; TMAMLARDGA; MAMLARDGAE; AMLARDGAEA; MLARDGAEAA; LARDGAEAAK; ARDGAEAAKW; RDGAEAAKWG; DGAEAAKWGG;<br><br>11 mers:<br>MSQIMYNYPAM; SQIMYNYPAMM; QIMYNYPAMMA; IMYNYPAMMAH; MYNYPAMMAHA; YNYPAMMAHAG; NYPAMMAHAGD; YPAMMAHAGDM; PAMMAHAGDMA; AMMAHAGDMAG; MMAHAGDMAGY; MAHAGDMAGYA; AHAGDMAGYAG; HAGDMAGYAGT; AGDMAGYAGTL; GDMAGYAGTLQ; DMAGYAGTLQS; MAGYAGTLQSL; AGYAGTLQSLG; GYAGTLQSLGA; YAGTLQSLGAD; AGTLQSLGADI; GTLQSLGADIA; TLQSLGADIAS; LQSLGADIASE; QSLGADIASEQ; SLGADIASEQA; LGADIASEQAV; GADIASEQAVL; ADIASEQAVLS; DIASEQAVLSS; IASEQAVLSSA; ASEQAVLSSAW; SEQAVLSSAWQ; EQAVLSSAWQG; QAVLSSAWQGD; AVLSSAWQGDT; VLSSAWQGDTG; LSSAWQGDTGI; SSAWQGDTGIT; SAWQGDTGITY; AWQGDTGITYQ; WQGDTGITYQG; QGDTGITYQGW; GDTGITYQGWQ; DTGITYQGWQT; TGITYQGWQTQ; GITYQGWQTQW; ITYQGWQTQWN; TYQGWQTQWNQ; YQGWQTQWNQA; QGWQTQWNQAL; GWQTQWNQALE; WQTQWNQALED; QTQWNQALEDL; TQWNQALEDLV; QWNQALEDLVR; WNQALEDLVRA; | |

Fig. 28 continued

| | | |
|---|---|---|
| | NQALEDLVRAY; QALEDLVRAYQ; ALEDLVRAYQS; LEDLVRAYQSM; EDLVRAYQSMS; DLVRAYQSMSG; LVRAYQSMSGT; VRAYQSMSGTH; RAYQSMSGTHE; AYQSMSGTHES; YQSMSGTHESN; QSMSGTHESNT; SMSGTHESNTM; MSGTHESNTMA; SGTHESNTMAM; GTHESNTMAML; THESNTMAMLA; HESNTMAMLAR; ESNTMAMLARD; SNTMAMLARDG; NTMAMLARDGA; TMAMLARDGAE; MAMLARDGAEA; AMLARDGAEAA; MLARDGAEAAK; LARDGAEAAKW; ARDGAEAAKWG; RDGAEAAKWGG; | |
| 57) Rv3020c | 8 mers:<br>MSLLDAHI; SLLDAHIP; LLDAHIPQ; LDAHIPQL; DAHIPQLI; AHIPQLIA; HIPQLIAS; IPQLIASH; PQLIASHT; QLIASHTA; LIASHTAF; IASHTAFA; ASHTAFAA; SHTAFAAK; HTAFAAKA; TAFAAKAG; AFAAKAGL; FAAKAGLM; AAKAGLMR; AKAGLMRH; KAGLMRHT; AGLMRHTI; GLMRHTIG; LMRHTIGQ; MRHTIGQA; RHTIGQAE; HTIGQAEQ; TIGQAEQQ; IGQAEQQA; GQAEQQAM; QAEQQAMS; AEQQAMSA; EQQAMSAQ; QQAMSAQA; QAMSAQAF; AMSAQAFH; MSAQAFHQ; SAQAFHQG; AQAFHQGE; QAFHQGES; AFHQGESA; FHQGESAA; HQGESAAA; QGESAAAF; GESAAAFQ; ESAAAFQG; SAAAFQGA; AAAFQGAH; AAFQGAHA; AFQGAHAR; FQGAHARF; QGAHARFV; GAHARFVA; AHARFVAA; HARFVAAA; ARFVAAAA; RFVAAAAK; FVAAAAKV; VAAAAKVN; AAAAKVNT; AAAKVNTL; AAKVNTLL; AKVNTLLD; KVNTLLDI; VNTLLDIA; NTLLDIAQ; TLLDIAQA; LLDIAQAN; LDIAQANL; DIAQANLG; IAQANLGE; AQANLGEA; QANLGEAA; ANLGEAAG; NLGEAAGT; LGEAAGTY; GEAAGTYV; EAAGTYVA; AAGTYVAA; AGTYVAAD; GTYVAADA; TYVAADAA; YVAADAAA; VAADAAAA; AADAAAAS; ADAAAASS; DAAAASSY; AAAASSYT; AAASSYTG; AASSYTGF;<br><br>9 mers:<br>MSLLDAHIP; SLLDAHIPQ; LLDAHIPQL; LDAHIPQLI; DAHIPQLIA; AHIPQLIAS; HIPQLIASH; IPQLIASHT; PQLIASHTA; QLIASHTAF; LIASHTAFA; IASHTAFAA; ASHTAFAAK; SHTAFAAKA; HTAFAAKAG; TAFAAKAGL; AFAAKAGLM; FAAKAGLMR; AAKAGLMRH; AKAGLMRHT; KAGLMRHTI; AGLMRHTIG; GLMRHTIGQ; LMRHTIGQA; MRHTIGQAE; RHTIGQAEQ; HTIGQAEQQ; TIGQAEQQA; IGQAEQQAM; GQAEQQAMS; QAEQQAMSA; AEQQAMSAQ; EQQAMSAQA; QQAMSAQAF; QAMSAQAFH; AMSAQAFHQ; MSAQAFHQG; SAQAFHQGE; AQAFHQGES; QAFHQGESA; AFHQGESAA; FHQGESAAA; HQGESAAAF; QGESAAAFQ; GESAAAFQG; ESAAAFQGA; SAAAFQGAH; AAAFQGAHA; AAFQGAHAR; AFQGAHARF; FQGAHARFV; QGAHARFVA; GAHARFVAA; AHARFVAAA; HARFVAAAA; ARFVAAAAK; RFVAAAAKV; FVAAAAKVN; VAAAAKVNT; AAAAKVNTL; AAAKVNTLL; AAKVNTLLD; AKVNTLLDI; KVNTLLDIA; VNTLLDIAQ; NTLLDIAQA; TLLDIAQAN; LLDIAQANL; LDIAQANLG; DIAQANLGE; IAQANLGEA; AQANLGEAA; QANLGEAAG; ANLGEAAGT; NLGEAAGTY; LGEAAGTYV; GEAAGTYVA; EAAGTYVAA; AAGTYVAAD; AGTYVAADA; GTYVAADAA; TYVAADAAA; YVAADAAAA; VAADAAAAS; AADAAAASS; ADAAAASSY; DAAAASSYT; AAAASSYTG; AAASSYTGF; | 40845-41198 |

Fig. 28 continued

| | | |
|---|---|---|
| | 10 mers:<br>MSLLDAHIPQ; SLLDAHIPQL; LLDAHIPQLI; LDAHIPQLIA; DAHIPQLIAS; AHIPQLIASH; HIPQLIASHT; IPQLIASHTA; PQLIASHTAF; QLIASHTAFA; LIASHTAFAA; IASHTAFAAK; ASHTAFAAKA; SHTAFAAKAG; HTAFAAKAGL; TAFAAKAGLM; AFAAKAGLMR; FAAKAGLMRH; AAKAGLMRHT; AKAGLMRHTI; KAGLMRHTIG; AGLMRHTIGQ; GLMRHTIGQA; LMRHTIGQAE; MRHTIGQAEQ; RHTIGQAEQQ; HTIGQAEQQA; TIGQAEQQAM; IGQAEQQAMS; GQAEQQAMSA; QAEQQAMSAQ; AEQQAMSAQA; EQQAMSAQAF; QQAMSAQAFH; QAMSAQAFHQ; AMSAQAFHQG; MSAQAFHQGE; SAQAFHQGES; AQAFHQGESA; QAFHQGESAA; AFHQGESAAA; FHQGESAAAF; HQGESAAAFQ; QGESAAAFQG; GESAAAFQGA; ESAAAFQGAH; SAAAFQGAHA; AAAFQGAHAR; AAFQGAHARF; AFQGAHARFV; FQGAHARFVA; QGAHARFVAA; GAHARFVAAA; AHARFVAAAA; HARFVAAAAK; ARFVAAAAKV; RFVAAAAKVN; FVAAAAKVNT; VAAAAKVNTL; AAAAKVNTLL; AAAKVNTLLD; AAKVNTLLDI; AKVNTLLDIA; KVNTLLDIAQ; VNTLLDIAQA; NTLLDIAQAN; TLLDIAQANL; LLDIAQANLG; LDIAQANLGE; DIAQANLGEA; IAQANLGEAA; AQANLGEAAG; QANLGEAAGT; ANLGEAAGTY; NLGEAAGTYV; LGEAAGTYVA; GEAAGTYVAA; EAAGTYVAAD; AAGTYVAADA; AGTYVAADAA; GTYVAADAAA; TYVAADAAAA; YVAADAAAAS; VAADAAAASS; AADAAAASSY; ADAAAASSYT; DAAAASSYTG; AAAASSYTGF;<br><br>11 mers:<br>MSLLDAHIPQL; SLLDAHIPQLI; LLDAHIPQLIA; LDAHIPQLIAS; DAHIPQLIASH; AHIPQLIASHT; HIPQLIASHTA; IPQLIASHTAF; PQLIASHTAFA; QLIASHTAFAA; LIASHTAFAAK; IASHTAFAAKA; ASHTAFAAKAG; SHTAFAAKAGL; HTAFAAKAGLM; TAFAAKAGLMR; AFAAKAGLMRH; FAAKAGLMRHT; AAKAGLMRHTI; AKAGLMRHTIG; KAGLMRHTIGQ; AGLMRHTIGQA; GLMRHTIGQAE; LMRHTIGQAEQ; MRHTIGQAEQQ; RHTIGQAEQQA; HTIGQAEQQAM; TIGQAEQQAMS; IGQAEQQAMSA; GQAEQQAMSAQ; QAEQQAMSAQA; AEQQAMSAQAF; EQQAMSAQAFH; QQAMSAQAFHQ; QAMSAQAFHQG; AMSAQAFHQGE; MSAQAFHQGES; SAQAFHQGESA; AQAFHQGESAA; QAFHQGESAAA; AFHQGESAAAF; FHQGESAAAFQ; HQGESAAAFQG; QGESAAAFQGA; GESAAAFQGAH; ESAAAFQGAHA; SAAAFQGAHAR; AAAFQGAHARF; AAFQGAHARFV; AFQGAHARFVA; FQGAHARFVAA; QGAHARFVAAA; GAHARFVAAAA; AHARFVAAAAK; HARFVAAAAKV; ARFVAAAAKVN; RFVAAAAKVNT; FVAAAAKVNTL; VAAAAKVNTLL; AAAAKVNTLLD; AAAKVNTLLDI; AAKVNTLLDIA; AKVNTLLDIAQ; KVNTLLDIAQA; VNTLLDIAQAN; NTLLDIAQANL; TLLDIAQANLG; LLDIAQANLGE; LDIAQANLGEA; DIAQANLGEAA; IAQANLGEAAG; AQANLGEAAGT; QANLGEAAGTY; ANLGEAAGTYV; NLGEAAGTYVA; LGEAAGTYVAA; GEAAGTYVAAD; EAAGTYVAADA; AAGTYVAADAA; AGTYVAADAAA; GTYVAADAAAA; TYVAADAAAAS; YVAADAAAASS; VAADAAAASSY; AADAAAASSYT; ADAAAASSYTG; DAAAASSYTGF; | |
| 58) Rv3287c | 8 mers:<br>MADSDLPT; ADSDLPTK; DSDLPTKG; SDLPTKGR; DLPTKGRQ; LPTKGRQR; PTKGRQRG; TKGRQRGV; KGRQRGVR; GRQRGVRA; | 41199-41744 |

Fig. 28 continued

| | | |
|---|---|---|
| | RQRGVRAV; QRGVRAVE; RGVRAVEL; GVRAVELN; VRAVELNV; RAVELNVA; AVELNVAA; VELNVAAR; ELNVAARL; LNVAARLE; NVAARLEN; VAARLENL; AARLENLA; ARLENLAL; RLENLALL; LENLALLR; ENLALLRT; NLALLRTL; LALLRTLV; ALLRTLVG; LLRTLVGA; LRTLVGAI; RTLVGAIG; TLVGAIGT; LVGAIGTF; VGAIGTFE; GAIGTFED; AIGTFEDL; IGTFEDLD; GTFEDLDF; TFEDLDFD; FEDLDFDA; EDLDFDAV; DLDFDAVA; LDFDAVAD; DFDAVADL; FDAVADLR; DAVADLRL; AVADLRLA; VADLRLAV; ADLRLAVD; DLRLAVDE; LRLAVDEV; RLAVDEVC; LAVDEVCT; AVDEVCTR; VDEVCTRL; DEVCTRLI; EVCTRLIR; VCTRLIRS; CTRLIRSA; TRLIRSAL; RLIRSALP; LIRSALPD; IRSALPDA; RSALPDAT; SALPDATL; ALPDATLR; LPDATLRL; PDATLRLV; DATLRLVV; ATLRLVVD; TLRLVVDP; LRLVVDPR; RLVVDPRK; LVVDPRKD; VVDPRKDE; VDPRKDEV; DPRKDEVV; PRKDEVVV; RKDEVVVE; KDEVVVEA; DEVVVEAS; EVVVEASA; VVVEASAA; VVEASAAC; VEASAACD; EASAACDT; ASAACDTH; SAACDTHD; AACDTHDV; ACDTHDVV; CDTHDVVA; DTHDVVAP; THDVVAPG; HDVVAPGS; DVVAPGSF; VVAPGSFS; VAPGSFSW; APGSFSWH; PGSFSWHV; GSFSWHVL; SFSWHVLT; FSWHVLTA; SWHVLTAL; WHVLTALA; HVLTALAD; VLTALADD; LTALADDV; TALADDVQ; ALADDVQT; LADDVQTF; ADDVQTFH; DDVQTFHD; DVQTFHDG; VQTFHDGR; QTFHDGRQ; TFHDGRQP; FHDGRQPD; HDGRQPDV; DGRQPDVA; GRQPDVAG; RQPDVAGS; QPDVAGSV; PDVAGSVF; DVAGSVFG; VAGSVFGI; AGSVFGIT; GSVFGITL; SVFGITLT; VFGITLTA; FGITLTAR; GITLTARR; ITLTARRA; TLTARRAA; LTARRAAS; TARRAASS; ARRAASSR<br><br>9 mers:<br>MADSDLPTK; ADSDLPTKG; DSDLPTKGR; SDLPTKGRQ; DLPTKGRQR; LPTKGRQRG; PTKGRQRGV; TKGRQRGVR; KGRQRGVRA; GRQRGVRAV; RQRGVRAVE; QRGVRAVEL; RGVRAVELN; GVRAVELNV; VRAVELNVA; RAVELNVAA; AVELNVAAR; VELNVAARL; ELNVAARLE; LNVAARLEN; NVAARLENL; VAARLENLA; AARLENLAL; ARLENLALL; RLENLALLR; LENLALLRT; ENLALLRTL; NLALLRTLV; LALLRTLVG; ALLRTLVGA; LLRTLVGAI; LRTLVGAIG; RTLVGAIGT; TLVGAIGTF; LVGAIGTFE; VGAIGTFED; GAIGTFEDL; AIGTFEDLD; IGTFEDLDF; GTFEDLDFD; TFEDLDFDA; FEDLDFDAV; EDLDFDAVA; DLDFDAVAD; LDFDAVADL; DFDAVADLR; FDAVADLRL; DAVADLRLA; AVADLRLAV; VADLRLAVD; ADLRLAVDE; DLRLAVDEV; LRLAVDEVC; RLAVDEVCT; LAVDEVCTR; AVDEVCTRL; VDEVCTRLI; DEVCTRLIR; EVCTRLIRS; VCTRLIRSA; CTRLIRSAL; TRLIRSALP; RLIRSALPD; LIRSALPDA; IRSALPDAT; RSALPDATL; SALPDATLR; ALPDATLRL; LPDATLRLV; PDATLRLVV; DATLRLVVD; ATLRLVVDP; TLRLVVDPR; LRLVVDPRK; RLVVDPRKD; LVVDPRKDE; VVDPRKDEV; VDPRKDEVV; DPRKDEVVV; PRKDEVVVE; RKDEVVVEA; KDEVVVEAS; DEVVVEASA; EVVVEASAA; VVVEASAAC; VVEASAACD; VEASAACDT; EASAACDTH; ASAACDTHD; SAACDTHDV; AACDTHDVV; ACDTHDVVA; CDTHDVVAP; DTHDVVAPG; THDVVAPGS; HDVVAPGSF; DVVAPGSFS; VVAPGSFSW; VAPGSFSWH; APGSFSWHV; PGSFSWHVL; GSFSWHVLT; SFSWHVLTA; FSWHVLTAL; SWHVLTALA; WHVLTALAD; HVLTALADD; VLTALADDV; LTALADDVQ; | |

Fig. 28 continued

| | | | |
|---|---|---|---|
| | TALADDVQT; ALADDVQTF; LADDVQTFH; ADDVQTFHD; DDVQTFHDG; DVQTFHDGR; VQTFHDGRQ; QTFHDGRQP; TFHDGRQPD; FHDGRQPDV; HDGRQPDVA; DGRQPDVAG; GRQPDVAGS; RQPDVAGSV; QPDVAGSVF; PDVAGSVFG; DVAGSVFGI; VAGSVFGIT; AGSVFGITL; GSVFGITLT; SVFGITLTA; VFGITLTAR; FGITLTARR; GITLTARRA; ITLTARRAA; TLTARRAAS; LTARRAASS; TARRAASSR<br><br>10 mers:<br>MADSDLPTKG; ADSDLPTKGR; DSDLPTKGRQ; SDLPTKGRQR; DLPTKGRQRG; LPTKGRQRGV; PTKGRQRGVR; TKGRQRGVRA; KGRQRGVRAV; GRQRGVRAVE; RQRGVRAVEL; QRGVRAVELN; RGVRAVELNV; GVRAVELNVA; VRAVELNVAA; RAVELNVAAR; AVELNVAARL; VELNVAARLE; ELNVAARLEN; LNVAARLENL; NVAARLENLA; VAARLENLAL; AARLENLALL; ARLENLALLR; RLENLALLRT; LENLALLRTL; ENLALLRTLV; NLALLRTLVG; LALLRTLVGA; ALLRTLVGAI; LLRTLVGAIG; LRTLVGAIGT; RTLVGAIGTF; TLVGAIGTFE; LVGAIGTFED; VGAIGTFEDL; GAIGTFEDLD; AIGTFEDLDF; IGTFEDLDFD; GTFEDLDFDA; TFEDLDFDAV; FEDLDFDAVA; EDLDFDAVAD; DLDFDAVADL; LDFDAVADLR; DFDAVADLRL; FDAVADLRLA; DAVADLRLAV; AVADLRLAVD; VADLRLAVDE; ADLRLAVDEV; DLRLAVDEVC; LRLAVDEVCT; RLAVDEVCTR; LAVDEVCTRL; AVDEVCTRLI; VDEVCTRLIR; DEVCTRLIRS; EVCTRLIRSA; VCTRLIRSAL; CTRLIRSALP; TRLIRSALPD; RLIRSALPDA; LIRSALPDAT; IRSALPDATL; RSALPDATLR; SALPDATLRL; ALPDATLRLV; LPDATLRLVV; PDATLRLVVD; DATLRLVVDP; ATLRLVVDPR; TLRLVVDPRK; LRLVVDPRKD; RLVVDPRKDE; LVVDPRKDEV; VVDPRKDEVV; VDPRKDEVVV; DPRKDEVVVE; PRKDEVVVEA; RKDEVVVEAS; KDEVVVEASA; DEVVVEASAA; EVVVEASAAC; VVVEASAACD; VVEASAACDT; VEASAACDTH; EASAACDTHD; ASAACDTHDV; SAACDTHDVV; AACDTHDVVA; ACDTHDVVAP; CDTHDVVAPG; DTHDVVAPGS; THDVVAPGSF; HDVVAPGSFS; DVVAPGSFSW; VVAPGSFSWH; VAPGSFSWHV; APGSFSWHVL; PGSFSWHVLT; GSFSWHVLTA; SFSWHVLTAL; FSWHVLTALA; SWHVLTALAD; WHVLTALADD; HVLTALADDV; VLTALADDVQ; LTALADDVQT; TALADDVQTF; ALADDVQTFH; LADDVQTFHD; ADDVQTFHDG; DDVQTFHDGR; DVQTFHDGRQ; VQTFHDGRQP; QTFHDGRQPD; TFHDGRQPDV; FHDGRQPDVA; HDGRQPDVAG; DGRQPDVAGS; GRQPDVAGSV; RQPDVAGSVF; QPDVAGSVFG; PDVAGSVFGI; DVAGSVFGIT; VAGSVFGITL; AGSVFGITLT; GSVFGITLTA; SVFGITLTAR; VFGITLTARR; FGITLTARRA; GITLTARRAA; ITLTARRAAS; TLTARRAASS; LTARRAASSR<br><br>11 mers:<br>MADSDLPTKGR; ADSDLPTKGRQ; DSDLPTKGRQR; SDLPTKGRQRG; DLPTKGRQRGV; LPTKGRQRGVR; PTKGRQRGVRA; TKGRQRGVRAV; KGRQRGVRAVE; GRQRGVRAVEL; RQRGVRAVELN; QRGVRAVELNV; RGVRAVELNVA; GVRAVELNVAA; VRAVELNVAAR; RAVELNVAARL; AVELNVAARLE; VELNVAARLEN; ELNVAARLENL; LNVAARLENLA; NVAARLENLAL; VAARLENLALL; AARLENLALLR; ARLENLALLRT; RLENLALLRTL; LENLALLRTLV; ENLALLRTLVG; NLALLRTLVGA; | |

Fig. 28 continued

| | | |
|---|---|---|
| | LALLRTLVGAI; ALLRTLVGAIG; LLRTLVGAIGT; LRTLVGAIGTF; RTLVGAIGTFE; TLVGAIGTFED; LVGAIGTFEDL; VGAIGTFEDLD; GAIGTFEDLDF; AIGTFEDLDFD; IGTFEDLDFDA; GTFEDLDFDAV; TFEDLDFDAVA; FEDLDFDAVAD; EDLDFDAVADL; DLDFDAVADLR; LDFDAVADLRL; DFDAVADLRLA; FDAVADLRLAV; DAVADLRLAVD; AVADLRLAVDE; VADLRLAVDEV; ADLRLAVDEVC; DLRLAVDEVCT; LRLAVDEVCTR; RLAVDEVCTRL; LAVDEVCTRLI; AVDEVCTRLIR; VDEVCTRLIRS; DEVCTRLIRSA; EVCTRLIRSAL; VCTRLIRSALP; CTRLIRSALPD; TRLIRSALPDA; RLIRSALPDAT; LIRSALPDATL; IRSALPDATLR; RSALPDATLRL; SALPDATLRLV; ALPDATLRLVV; LPDATLRLVVD; PDATLRLVVDP; DATLRLVVDPR; ATLRLVVDPRK; TLRLVVDPRKD; LRLVVDPRKDE; RLVVDPRKDEV; LVVDPRKDEVV; VVDPRKDEVVV; VDPRKDEVVVE; DPRKDEVVVEA; PRKDEVVVEAS; RKDEVVVEASA; KDEVVVEASAA; DEVVVEASAAC; EVVVEASAACD; VVVEASAACDT; VVEASAACDTH; VEASAACDTHD; EASAACDTHDV; ASAACDTHDVV; SAACDTHDVVA; AACDTHDVVAP; ACDTHDVVAPG; CDTHDVVAPGS; DTHDVVAPGSF; THDVVAPGSFS; HDVVAPGSFSW; DVVAPGSFSWH; VVAPGSFSWHV; VAPGSFSWHVL; APGSFSWHVLT; PGSFSWHVLTA; GSFSWHVLTAL; SFSWHVLTALA; FSWHVLTALAD; SWHVLTALADD; WHVLTALADDV; HVLTALADDVQ; VLTALADDVQT; LTALADDVQTF; TALADDVQTFH; ALADDVQTFHD; LADDVQTFHDG; ADDVQTFHDGR; DDVQTFHDGRQ; DVQTFHDGRQP; VQTFHDGRQPD; QTFHDGRQPDV; TFHDGRQPDVA; FHDGRQPDVAG; HDGRQPDVAGS; DGRQPDVAGSV; GRQPDVAGSVF; RQPDVAGSVFG; QPDVAGSVFGI; PDVAGSVFGIT; DVAGSVFGITL; VAGSVFGITLT; AGSVFGITLTA; GSVFGITLTAR; SVFGITLTARR; VFGITLTARRA; FGITLTARRAA; GITLTARRAAS; ITLTARRAASS; TLTARRAASSR | |
| 59) Rv3288c | 8 mers: MGQIPPQP; GQIPPQPV; QIPPQPVR; IPPQPVRR; PPQPVRRV; PQPVRRVL; QPVRRVLP; PVRRVLPL; VRRVLPLM; RRVLPLMV; RVLPLMVV; VLPLMVVP; LPLMVVPG; PLMVVPGN; LMVVPGNG; MVVPGNGQ; VVPGNGQK; VPGNGQKW; PGNGQKWR; GNGQKWRN; NGQKWRNR; GQKWRNRT; QKWRNRTE; KWRNRTET; WRNRTETE; RNRTETEE; NRTETEEA; RTETEEAM; TETEEAMG; ETEEAMGD; TEEAMGDT; EEAMGDTY; EAMGDTYR; AMGDTYRD; MGDTYRDP; GDTYRDPV; DTYRDPVD; TYRDPVDH; YRDPVDHL; RDPVDHLR; DPVDHLRT; PVDHLRTT; VDHLRTTR; DHLRTTRP; HLRTTRPL; LRTTRPLA; RTTRPLAG; TTRPLAGE; TRPLAGES; RPLAGESL; PLAGESLI; LAGESLID; AGESLIDV; GESLIDVV; ESLIDVVH; SLIDVVHW; LIDVVHWP; IDVVHWPG; DVVHWPGY; VVHWPGYL; VHWPGYLL; HWPGYLLI; WPGYLLIV; PGYLLIVA; GYLLIVAG; YLLIVAGV; LLIVAGVV; LIVAGVVG; IVAGVVGG; VAGVVGGV; AGVVGGVG; GVVGGVGA; VVGGVGAL; VGGVGALA; GGVGALAA; GVGALAAF; VGALAAFG; GALAAFGT; ALAAFGTG; LAAFGTGH; AAFGTGHH; AFGTGHHA; FGTGHHAE; GTGHHAEG; TGHHAEGM; GHHAEGMT; HHAEGMTF; HAEGMTFG; AEGMTFGV; EGMTFGVV; GMTFGVVA; MTFGVVAI; TFGVVAIV; FGVVAIVV; GVVAIVVT; VVAIVVTV; VAIVVTVV; AIVVTVVG; IVVTVVGL; VVTVVGLA; VTVVGLAW; TVVGLAWL; VVGLAWLA; VGLAWLAF; GLAWLAFE; LAWLAFEH; AWLAFEHR; WLAFEHRR; LAFEHRRI; | 41745-42258 |

Fig. 28 continued

| | | | |
|---|---|---|---|
| | AFEHRRIR; FEHRRIRK; EHRRIRKI; HRRIRKIA; RRIRKIAD; RIRKIADR; IRKIADRW; RKIADRWY; KIADRWYT; IADRWYTE; ADRWYTEH; DRWYTEHP; RWYTEHPE; WYTEHPEV; YTEHPEVR; TEHPEVRR; EHPEVRRQ; HPEVRRQR; PEVRRQRL; EVRRQRLA; VRRQRLAG<br><br>9 mers:<br>MGQIPPQPV; GQIPPQPVR; QIPPQPVRR; IPPQPVRRV; PPQPVRRVL; PQPVRRVLP; QPVRRVLPL; PVRRVLPLM; VRRVLPLMV; RRVLPLMVV; RVLPLMVVP; VLPLMVVPG; LPLMVVPGN; PLMVVPGNG; LMVVPGNGQ; MVVPGNGQK; VVPGNGQKW; VPGNGQKWR; PGNGQKWRN; GNGQKWRNR; NGQKWRNRT; GQKWRNRTE; QKWRNRTET; KWRNRTETE; WRNRTETEE; RNRTETEEA; NRTETEEAM; RTETEEAMG; TETEEAMGD; ETEEAMGDT; TEEAMGDTY; EEAMGDTYR; EAMGDTYRD; AMGDTYRDP; MGDTYRDPV; GDTYRDPVD; DTYRDPVDH; TYRDPVDHL; YRDPVDHLR; RDPVDHLRT; DPVDHLRTT; PVDHLRTTR; VDHLRTTRP; DHLRTTRPL; HLRTTRPLA; LRTTRPLAG; RTTRPLAGE; TTRPLAGES; TRPLAGESL; RPLAGESLI; PLAGESLID; LAGESLIDV; AGESLIDVV; GESLIDVVH; ESLIDVVHW; SLIDVVHWP; LIDVVHWPG; IDVVHWPGY; DVVHWPGYL; VVHWPGYLL; VHWPGYLLI; HWPGYLLIV; WPGYLLIVA; PGYLLIVAG; GYLLIVAGV; YLLIVAGVV; LLIVAGVVG; LIVAGVVGG; IVAGVVGGV; VAGVVGGVG; AGVVGGVGA; GVVGGVGAL; VVGGVGALA; VGGVGALAA; GGVGALAAF; GVGALAAFG; VGALAAFGT; GALAAFGTG; ALAAFGTGH; LAAFGTGHH; AAFGTGHHA; AFGTGHHAE; FGTGHHAEG; GTGHHAEGM; TGHHAEGMT; GHHAEGMTF; HHAEGMTFG; HAEGMTFGV; AEGMTFGVV; EGMTFGVVA; GMTFGVVAI; MTFGVVAIV; TFGVVAIVV; FGVVAIVVT; GVVAIVVTV; VVAIVVTVV; VAIVVTVVG; AIVVTVVGL; IVVTVVGLA; VVTVVGLAW; VTVVGLAWL; TVVGLAWLA; VVGLAWLAF; VGLAWLAFE; GLAWLAFEH; LAWLAFEHR; AWLAFEHRR; WLAFEHRRI; LAFEHRRIR; AFEHRRIRK; FEHRRIRKI; EHRRIRKIA; HRRIRKIAD; RRIRKIADR; RIRKIADRW; IRKIADRWY; RKIADRWYT; KIADRWYTE; IADRWYTEH; ADRWYTEHP; DRWYTEHPE; RWYTEHPEV; WYTEHPEVR; YTEHPEVRR; TEHPEVRRQ; EHPEVRRQR; HPEVRRQRL; PEVRRQRLA; EVRRQRLAG<br><br>10 mers:<br>MGQIPPQPVR; GQIPPQPVRR; QIPPQPVRRV; IPPQPVRRVL; PPQPVRRVLP; PQPVRRVLPL; QPVRRVLPLM; PVRRVLPLMV; VRRVLPLMVV; RRVLPLMVVP; RVLPLMVVPG; VLPLMVVPGN; LPLMVVPGNG; PLMVVPGNGQ; LMVVPGNGQK; MVVPGNGQKW; VVPGNGQKWR; VPGNGQKWRN; PGNGQKWRNR; GNGQKWRNRT; NGQKWRNRTE; GQKWRNRTET; QKWRNRTETE; KWRNRTETEE; WRNRTETEEA; RNRTETEEAM; NRTETEEAMG; RTETEEAMGD; TETEEAMGDT; ETEEAMGDTY; TEEAMGDTYR; EEAMGDTYRD; EAMGDTYRDP; AMGDTYRDPV; MGDTYRDPVD; GDTYRDPVDH; DTYRDPVDHL; TYRDPVDHLR; YRDPVDHLRT; RDPVDHLRTT; DPVDHLRTTR; PVDHLRTTRP; VDHLRTTRPL; DHLRTTRPLA; HLRTTRPLAG; LRTTRPLAGE; RTTRPLAGES; TTRPLAGESL; TRPLAGESLI; RPLAGESLID; PLAGESLIDV; LAGESLIDVV; | |

Fig. 28 continued

| | | |
|---|---|---|
| | AGESLIDVVH; GESLIDVVHW; ESLIDVVHWP; SLIDVVHWPG; LIDVVHWPGY; IDVVHWPGYL; DVVHWPGYLL; VVHWPGYLLI; VHWPGYLLIV; HWPGYLLIVA; WPGYLLIVAG; PGYLLIVAGV; GYLLIVAGVV; YLLIVAGVVG; LLIVAGVVGG; LIVAGVVGGV; IVAGVVGGVG; VAGVVGGVGA; AGVVGGVGAL; GVVGGVGALA; VVGGVGALAA; VGGVGALAAF; GGVGALAAFG; GVGALAAFGT; VGALAAFGTG; GALAAFGTGH; ALAAFGTGHH; LAAFGTGHHA; AAFGTGHHAE; AFGTGHHAEG; FGTGHHAEGM; GTGHHAEGMT; TGHHAEGMTF; GHHAEGMTFG; HHAEGMTFGV; HAEGMTFGVV; AEGMTFGVVA; EGMTFGVVAI; GMTFGVVAIV; MTFGVVAIVV; TFGVVAIVVT; FGVVAIVVTV; GVVAIVVTVV; VVAIVVTVVG; VAIVVTVVGL; AIVVTVVGLA; IVVTVVGLAW; VVTVVGLAWL; VTVVGLAWLA; TVVGLAWLAF; VVGLAWLAFE; VGLAWLAFEH; GLAWLAFEHR; LAWLAFEHRR; AWLAFEHRRI; WLAFEHRRIR; LAFEHRRIRK; AFEHRRIRKI; FEHRRIRKIA; EHRRIRKIAD; HRRIRKIADR; RRIRKIADRW; RIRKIADRWY; IRKIADRWYT; RKIADRWYTE; KIADRWYTEH; IADRWYTEHP; ADRWYTEHPE; DRWYTEHPEV; RWYTEHPEVR; WYTEHPEVRR; YTEHPEVRRQ; TEHPEVRRQR; EHPEVRRQRL; HPEVRRQRLA; PEVRRQRLAG<br><br>11 mers:<br>MGQIPPQPVRR; GQIPPQPVRRV; QIPPQPVRRVL; IPPQPVRRVLP; PPQPVRRVLPL; PQPVRRVLPLM; QPVRRVLPLMV; PVRRVLPLMVV; VRRVLPLMVVP; RRVLPLMVVPG; RVLPLMVVPGN; VLPLMVVPGNG; LPLMVVPGNGQ; PLMVVPGNGQK; LMVVPGNGQKW; MVVPGNGQKWR; VVPGNGQKWRN; VPGNGQKWRNR; PGNGQKWRNRT; GNGQKWRNRTE; NGQKWRNRTET; GQKWRNRTETE; QKWRNRTETEE; KWRNRTETEEA; WRNRTETEEAM; RNRTETEEAMG; NRTETEEAMGD; RTETEEAMGDT; TETEEAMGDTY; ETEEAMGDTYR; TEEAMGDTYRD; EEAMGDTYRDP; EAMGDTYRDPV; AMGDTYRDPVD; MGDTYRDPVDH; GDTYRDPVDHL; DTYRDPVDHLR; TYRDPVDHLRT; YRDPVDHLRTT; RDPVDHLRTTR; DPVDHLRTTRP; PVDHLRTTRPL; VDHLRTTRPLA; DHLRTTRPLAG; HLRTTRPLAGE; LRTTRPLAGES; RTTRPLAGESL; TTRPLAGESLI; TRPLAGESLID; RPLAGESLIDV; PLAGESLIDVV; LAGESLIDVVH; AGESLIDVVHW; GESLIDVVHWP; ESLIDVVHWPG; SLIDVVHWPGY; LIDVVHWPGYL; IDVVHWPGYLL; DVVHWPGYLLI; VVHWPGYLLIV; VHWPGYLLIVA; HWPGYLLIVAG; WPGYLLIVAGV; PGYLLIVAGVV; GYLLIVAGVVG; YLLIVAGVVGG; LLIVAGVVGGV; LIVAGVVGGVG; IVAGVVGGVGA; VAGVVGGVGAL; AGVVGGVGALA; GVVGGVGALAA; VVGGVGALAAF; VGGVGALAAFG; GGVGALAAFGT; GVGALAAFGTG; VGALAAFGTGH; GALAAFGTGHH; ALAAFGTGHHA; LAAFGTGHHAE; AAFGTGHHAEG; AFGTGHHAEGM; FGTGHHAEGMT; GTGHHAEGMTF; TGHHAEGMTFG; GHHAEGMTFGV; HHAEGMTFGVV; HAEGMTFGVVA; AEGMTFGVVAI; EGMTFGVVAIV; GMTFGVVAIVV; MTFGVVAIVVT; TFGVVAIVVTV; FGVVAIVVTVV; GVVAIVVTVVG; VVAIVVTVVGL; VAIVVTVVGLA; AIVVTVVGLAW; IVVTVVGLAWL; VVTVVGLAWLA; VTVVGLAWLAF; TVVGLAWLAFE; VVGLAWLAFEH; VGLAWLAFEHR; GLAWLAFEHRR; LAWLAFEHRRI; AWLAFEHRRIR; WLAFEHRRIRK; LAFEHRRIRKI; AFEHRRIRKIA; FEHRRIRKIAD; EHRRIRKIADR; HRRIRKIADRW; RRIRKIADRWY; RIRKIADRWYT; | |

Fig. 28 continued

| | | |
|---|---|---|
| | IRKIADRWYTE; RKIADRWYTEH; KIADRWYTEHP; IADRWYTEHPE; ADRWYTEHPEV; DRWYTEHPEVR; RWYTEHPEVRR; WYTEHPEVRRQ; YTEHPEVRRQR; TEHPEVRRQRL; EHPEVRRQRLA; HPEVRRQRLAG | |
| 60) Rv3289c | 8 mers:<br>MHEVGGPS; HEVGGPSR; EVGGPSRG; VGGPSRGD; GGPSRGDR; GPSRGDRL; PSRGDRLG; SRGDRLGR; RGDRLGRD; GDRLGRDD; DRLGRDDS; RLGRDDSE; LGRDDSEV; GRDDSEVH; RDDSEVHS; DDSEVHSA; DSEVHSAI; SEVHSAIR; EVHSAIRF; VHSAIRFA; HSAIRFAV; SAIRFAVV; AIRFAVVA; IRFAVVAA; RFAVVAAV; FAVVAAVV; AVVAAVVG; VVAAVVGV; VAAVVGVG; AAVVGVGF; AVVGVGFL; VVGVGFLI; VGVGFLIM; GVGFLIMG; VGFLIMGA; GFLIMGAL; FLIMGALL; LIMGALLV; IMGALLVS; MGALLVST; GALLVSTC; ALLVSTCS; LLVSTCSG; LVSTCSGV; VSTCSGVD; STCSGVDT; TCSGVDTA; CSGVDTAA; SGVDTAAC; GVDTAACG; VDTAACGP; DTAACGPP; TAACGPPQ; AACGPPQR; ACGPPQRI; CGPPQRIL; GPPQRILL; PPQRILLA; PQRILLAL; QRILLALG; RILLALGG; ILLALGGP; LLALGGPL; LALGGPLI; ALGGPLIL; LGGPLILC; GGPLILCA; GPLILCAA; PLILCAAG; LILCAAGL; ILCAAGLW; LCAAGLWA; CAAGLWAF; AAGLWAFL; AGLWAFLR; GLWAFLRT; LWAFLRTY; WAFLRTYR; AFLRTYRV; FLRTYRVW; LRTYRVWR; RTYRVWRA; TYRVWRAE; YRVWRAEG; RVWRAEGT; VWRAEGTW; WRAEGTWW; RAEGTWWG; AEGTWWGW; EGTWWGWH; GTWWGWHG; TWWGWHGA; WWGWHGAG; WGWHGAGW; GWHGAGWF; WHGAGWFL; HGAGWFLL; GAGWFLLT; AGWFLLTL; GWFLLTLM; WFLLTLMV; FLLTLMVL; LLTLMVLT; LTLMVLTL; TLMVLTLC; LMVLTLCI; MVLTLCIG; VLTLCIGV; LTLCIGVP; TLCIGVPP; LCIGVPPI; CIGVPPIA; IGVPPIAG; GVPPIAGP; VPPIAGPV; PPIAGPVM; PIAGPVMA; IAGPVMAP<br><br>9 mers:<br>MHEVGGPSR; HEVGGPSRG; EVGGPSRGD; VGGPSRGDR; GGPSRGDRL; GPSRGDRLG; PSRGDRLGR; SRGDRLGRD; RGDRLGRDD; GDRLGRDDS; DRLGRDDSE; RLGRDDSEV; LGRDDSEVH; GRDDSEVHS; RDDSEVHSA; DDSEVHSAI; DSEVHSAIR; SEVHSAIRF; EVHSAIRFA; VHSAIRFAV; HSAIRFAVV; SAIRFAVVA; AIRFAVVAA; IRFAVVAAV; RFAVVAAVV; FAVVAAVVG; AVVAAVVGV; VVAAVVGVG; VAAVVGVGF; AAVVGVGFL; AVVGVGFLI; VVGVGFLIM; VGVGFLIMG; GVGFLIMGA; VGFLIMGAL; GFLIMGALL; FLIMGALLV; LIMGALLVS; IMGALLVST; MGALLVSTC; GALLVSTCS; ALLVSTCSG; LLVSTCSGV; LVSTCSGVD; VSTCSGVDT; STCSGVDTA; TCSGVDTAA; CSGVDTAAC; SGVDTAACG; GVDTAACGP; VDTAACGPP; DTAACGPPQ; TAACGPPQR; AACGPPQRI; ACGPPQRIL; CGPPQRILL; GPPQRILLA; PPQRILLAL; PQRILLALG; QRILLALGG; RILLALGGP; ILLALGGPL; LLALGGPLI; LALGGPLIL; ALGGPLILC; LGGPLILCA; GGPLILCAA; GPLILCAAG; PLILCAAGL; LILCAAGLW; ILCAAGLWA; LCAAGLWAF; CAAGLWAFL; AAGLWAFLR; AGLWAFLRT; GLWAFLRTY; LWAFLRTYR; WAFLRTYRV; AFLRTYRVW; FLRTYRVWR; LRTYRVWRA; RTYRVWRAE; TYRVWRAEG; YRVWRAEGT; RVWRAEGTW; VWRAEGTWW; WRAEGTWWG; RAEGTWWGW; AEGTWWGWH; EGTWWGWHG; GTWWGWHGA; TWWGWHGAG; WWGWHGAGW; WGWHGAGWF; GWHGAGWFL; WHGAGWFLL; | 42259-42724 |

Fig. 28 continued

| | | | |
|---|---|---|---|
| | HGAGWFLLT; GAGWFLLTL; AGWFLLTLM; GWFLLTLMV; WFLLTLMVL; FLLTLMVLT; LLTLMVLTL; LTLMVLTLC; TLMVLTLCI; LMVLTLCIG; MVLTLCIGV; VLTLCIGVP; LTLCIGVPP; TLCIGVPPI; LCIGVPPIA; CIGVPPIAG; IGVPPIAGP; GVPPIAGPV; VPPIAGPVM; PPIAGPVMA; PIAGPVMAP<br><br>10 mers:<br>MHEVGGPSRG; HEVGGPSRGD; EVGGPSRGDR; VGGPSRGDRL; GGPSRGDRLG; GPSRGDRLGR; PSRGDRLGRD; SRGDRLGRDD; RGDRLGRDDS; GDRLGRDDSE; DRLGRDDSEV; RLGRDDSEVH; LGRDDSEVHS; GRDDSEVHSA; RDDSEVHSAI; DDSEVHSAIR; DSEVHSAIRF; SEVHSAIRFA; EVHSAIRFAV; VHSAIRFAVV; HSAIRFAVVA; SAIRFAVVAA; AIRFAVVAAV; IRFAVVAAVV; RFAVVAAVVG; FAVVAAVVGV; AVVAAVVGVG; VVAAVVGVGF; VAAVVGVGFL; AAVVGVGFLI; AVVGVGFLIM; VVGVGFLIMG; VGVGFLIMGA; GVGFLIMGAL; VGFLIMGALL; GFLIMGALLV; FLIMGALLVS; LIMGALLVST; IMGALLVSTC; MGALLVSTCS; GALLVSTCSG; ALLVSTCSGV; LLVSTCSGVD; LVSTCSGVDT; VSTCSGVDTA; STCSGVDTAA; TCSGVDTAAC; CSGVDTAACG; SGVDTAACGP; GVDTAACGPP; VDTAACGPPQ; DTAACGPPQR; TAACGPPQRI; AACGPPQRIL; ACGPPQRILL; CGPPQRILLA; GPPQRILLAL; PPQRILLALG; PQRILLALGG; QRILLALGGP; RILLALGGPL; ILLALGGPLI; LLALGGPLIL; LALGGPLILC; ALGGPLILCA; LGGPLILCAA; GGPLILCAAG; GPLILCAAGL; PLILCAAGLW; LILCAAGLWA; ILCAAGLWAF; LCAAGLWAFL; CAAGLWAFLR; AAGLWAFLRT; AGLWAFLRTY; GLWAFLRTYR; LWAFLRTYRV; WAFLRTYRVW; AFLRTYRVWR; FLRTYRVWRA; LRTYRVWRAE; RTYRVWRAEG; TYRVWRAEGT; YRVWRAEGTW; RVWRAEGTWW; VWRAEGTWWG; WRAEGTWWGW; RAEGTWWGWH; AEGTWWGWHG; EGTWWGWHGA; GTWWGWHGAG; TWWGWHGAGW; WWGWHGAGWF; WGWHGAGWFL; GWHGAGWFLL; WHGAGWFLLT; HGAGWFLLTL; GAGWFLLTLM; AGWFLLTLMV; GWFLLTLMVL; WFLLTLMVLT; FLLTLMVLTL; LLTLMVLTLC; LTLMVLTLCI; TLMVLTLCIG; LMVLTLCIGV; MVLTLCIGVP; VLTLCIGVPP; LTLCIGVPPI; TLCIGVPPIA; LCIGVPPIAG; CIGVPPIAGP; IGVPPIAGPV; GVPPIAGPVM; VPPIAGPVMA; PPIAGPVMAP<br><br>11 mers:<br>MHEVGGPSRGD; HEVGGPSRGDR; EVGGPSRGDRL; VGGPSRGDRLG; GGPSRGDRLGR; GPSRGDRLGRD; PSRGDRLGRDD; SRGDRLGRDDS; RGDRLGRDDSE; GDRLGRDDSEV; DRLGRDDSEVH; RLGRDDSEVHS; LGRDDSEVHSA; GRDDSEVHSAI; RDDSEVHSAIR; DDSEVHSAIRF; DSEVHSAIRFA; SEVHSAIRFAV; EVHSAIRFAVV; VHSAIRFAVVA; HSAIRFAVVAA; SAIRFAVVAAV; AIRFAVVAAVV; IRFAVVAAVVG; RFAVVAAVVGV; FAVVAAVVGVG; AVVAAVVGVGF; VVAAVVGVGFL; VAAVVGVGFLI; AAVVGVGFLIM; AVVGVGFLIMG; VVGVGFLIMGA; VGVGFLIMGAL; GVGFLIMGALL; VGFLIMGALLV; GFLIMGALLVS; FLIMGALLVST; LIMGALLVSTC; IMGALLVSTCS; MGALLVSTCSG; GALLVSTCSGV; ALLVSTCSGVD; LLVSTCSGVDT; LVSTCSGVDTA; VSTCSGVDTAA; STCSGVDTAAC; TCSGVDTAACG; CSGVDTAACGP; SGVDTAACGPP; GVDTAACGPPQ; VDTAACGPPQR; | |

Fig. 28 continued

| | | |
|---|---|---|
| | DTAACGPPQRI; TAACGPPQRIL; AACGPPQRILL; ACGPPQRILLA; CGPPQRILLAL; GPPQRILLALG; PPQRILLALGG; PQRILLALGGP; QRILLALGGPL; RILLALGGPLI; ILLALGGPLIL; LLALGGPLILC; LALGGPLILCA; ALGGPLILCAA; LGGPLILCAAG; GGPLILCAAGL; GPLILCAAGLW; PLILCAAGLWA; LILCAAGLWAF; ILCAAGLWAFL; LCAAGLWAFLR; CAAGLWAFLRT; AAGLWAFLRTY; AGLWAFLRTYR; GLWAFLRTYRV; LWAFLRTYRVW; WAFLRTYRVWR; AFLRTYRVWRA; FLRTYRVWRAE; LRTYRVWRAEG; RTYRVWRAEGT; TYRVWRAEGTW; YRVWRAEGTWW; RVWRAEGTWWG; VWRAEGTWWGW; WRAEGTWWGWH; RAEGTWWGWHG; AEGTWWGWHGA; EGTWWGWHGAG; GTWWGWHGAGW; TWWGWHGAGWF; WWGWHGAGWFL; WGWHGAGWFLL; GWHGAGWFLLT; WHGAGWFLLTL; HGAGWFLLTLM; GAGWFLLTLMV; AGWFLLTLMVL; GWFLLTLMVLT; WFLLTLMVLTL; FLLTLMVLTLC; LLTLMVLTLCI; LTLMVLTLCIG; TLMVLTLCIGV; LMVLTLCIGVP; MVLTLCIGVPP; VLTLCIGVPPI; LTLCIGVPPIA; TLCIGVPPIAG; LCIGVPPIAGP; CIGVPPIAGPV; IGVPPIAGPVM; GVPPIAGPVMA; VPPIAGPVMAP | |
| 61) Rv3290c | 8 mers:<br>MAAVVKSV; AAVVKSVA; AVVKSVAL; VVKSVALA; VKSVALAG; KSVALAGR; SVALAGRP; VALAGRPT; ALAGRPTT; LAGRPTTP; AGRPTTPD; GRPTTPDR; RPTTPDRV; PTTPDRVH; TTPDRVHE; TPDRVHEV; PDRVHEVL; DRVHEVLG; RVHEVLGR; VHEVLGRS; HEVLGRSM; EVLGRSML; VLGRSMLV; LGRSMLVD; GRSMLVDG; RSMLVDGL; SMLVDGLD; MLVDGLDI; LVDGLDIV; VDGLDIVL; DGLDIVLD; GLDIVLDL; LDIVLDLT; DIVLDLTR; IVLDLTRS; VLDLTRSG; LDLTRSGG; DLTRSGGS; LTRSGGSY; TRSGGSYL; RSGGSYLV; SGGSYLVD; GGSYLVDA; GSYLVDAI; SYLVDAIT; YLVDAITG; LVDAITGR; VDAITGRR; DAITGRRY; AITGRRYL; ITGRRYLD; TGRRYLDM; GRRYLDMF; RRYLDMFT; RYLDMFTF; YLDMFTFV; LDMFTFVA; DMFTFVAS; MFTFVASS; FTFVASSA; TFVASSAL; FVASSALG; VASSALGM; ASSALGMN; SSALGMNP; SALGMNPP; ALGMNPPA; LGMNPPAL; GMNPPALV; MNPPALVD; NPPALVDD; PPALVDDR; PALVDDRE; ALVDDREF; LVDDREFH; VDDREFHA; DDREFHAE; DREFHAEL; REFHAELM; EFHAELMQ; FHAELMQA; HAELMQAA; AELMQAAL; ELMQAALN; LMQAALNK; MQAALNKP; QAALNKPS; AALNKPSN; ALNKPSNS; LNKPSNSD; NKPSNSDV; KPSNSDVY; PSNSDVYS; SNSDVYSV; NSDVYSVA; SDVYSVAM; DVYSVAMA; VYSVAMAR; YSVAMARF; SVAMARFV; VAMARFVE; AMARFVET; MARFVETF; ARFVETFA; RFVETFAR; FVETFARV; VETFARVL; ETFARVLG; TFARVLGD; FARVLGDP; ARVLGDPA; RVLGDPAL; VLGDPALP; LGDPALPH; GDPALPHL; DPALPHLF; PALPHLFF; ALPHLFFV; LPHLFFVE; PHLFFVEG; HLFFVEGG; LFFVEGGA; FFVEGGAL; FVEGGALA; VEGGALAV; EGGALAVE; GGALAVEN; GALAVENA; ALAVENAL; LAVENALK; AVENALKA; VENALKAA; ENALKAAF; NALKAAFD; ALKAAFDW; LKAAFDWK; KAAFDWKS; AAFDWKSR; AFDWKSRH; FDWKSRHN; DWKSRHNQ; WKSRHNQA; KSRHNQAH; SRHNQAHG; RHNQAHGI; HNQAHGID; NQAHGIDP; QAHGIDPA; AHGIDPAL; HGIDPALG; GIDPALGT; IDPALGTQ; DPALGTQV; PALGTQVL; ALGTQVLH; LGTQVLHL; GTQVLHLR; TQVLHLRG; QVLHLRGA; VLHLRGAF; LHLRGAFH; HLRGAFHG; LRGAFHGR; RGAFHGRS; GAFHGRSG; | 42725-44485 |

Fig. 28 continued

| | | |
|---|---|---|
| | AFHGRSGY; FHGRSGYT; HGRSGYTL; GRSGYTLS; RSGYTLSL; SGYTLSLT; GYTLSLTN; YTLSLTNT; TLSLTNTK; LSLTNTKP; SLTNTKPT; LTNTKPTI; TNTKPTIT; NTKPTITA; TKPTITAR; KPTITARF; PTITARFP; TITARFPK; ITARFPKF; TARFPKFD; ARFPKFDW; RFPKFDWP; FPKFDWPR; PKFDWPRI; KFDWPRID; FDWPRIDA; DWPRIDAP; WPRIDAPY; PRIDAPYM; RIDAPYMR; IDAPYMRP; DAPYMRPG; APYMRPGL; PYMRPGLD; YMRPGLDE; MRPGLDEP; RPGLDEPA; PGLDEPAM; GLDEPAMA; LDEPAMAA; DEPAMAAL; EPAMAALE; PAMAALEA; AMAALEAE; MAALEAEA; AALEAEAL; ALEAEALR; LEAEALRQ; EAEALRQA; AEALRQAR; EALRQARA; ALRQARAA; LRQARAAF; RQARAAFE; QARAAFET; ARAAFETR; RAAFETRP; AAFETRPH; AFETRPHD; FETRPHDI; ETRPHDIA; TRPHDIAC; RPHDIACF; PHDIACFV; HDIACFVA; DIACFVAE; IACFVAEP; ACFVAEPI; CFVAEPIQ; FVAEPIQG; VAEPIQGE; AEPIQGEG; EPIQGEGG; PIQGEGGD; IQGEGGDR; QGEGGDRH; GEGGDRHF; EGGDRHFR; GGDRHFRP; GDRHFRPE; DRHFRPEF; RHFRPEFF; HFRPEFFA; FRPEFFAA; RPEFFAAM; PEFFAAMR; EFFAAMRE; FFAAMREL; FAAMRELC; AAMRELCD; AMRELCDE; MRELCDEF; RELCDEFD; ELCDEFDA; LCDEFDAL; CDEFDALL; DEFDALLI; EFDALLIF; FDALLIFD; DALLIFDE; ALLIFDEV; LLIFDEVQ; LIFDEVQT; IFDEVQTG; FDEVQTGC; DEVQTGCG; EVQTGCGL; VQTGCGLT; QTGCGLTG; TGCGLTGT; GCGLTGTA; CGLTGTAW; GLTGTAWA; LTGTAWAY; TGTAWAYQ; GTAWAYQQ; TAWAYQQL; AWAYQQLD; WAYQQLDV; AYQQLDVA; YQQLDVAP; QQLDVAPD; QLDVAPDI; LDVAPDIV; DVAPDIVA; VAPDIVAF; APDIVAFG; PDIVAFGK; DIVAFGKK; IVAFGKKT; VAFGKKTQ; AFGKKTQV; FGKKTQVC; GKKTQVCG; KKTQVCGV; KTQVCGVM; TQVCGVMA; QVCGVMAG; VCGVMAGR; CGVMAGRR; GVMAGRRV; VMAGRRVD; MAGRRVDE; AGRRVDEV; GRRVDEVA; RRVDEVAD; RVDEVADN; VDEVADNV; DEVADNVF; EVADNVFA; VADNVFAV; ADNVFAVP; DNVFAVPS; NVFAVPSR; VFAVPSRL; FAVPSRLN; AVPSRLNS; VPSRLNST; PSRLNSTW; SRLNSTWG; RLNSTWGG; LNSTWGGN; NSTWGGNL; STWGGNLT; TWGGNLTD; WGGNLTDM; GGNLTDMV; GNLTDMVR; NLTDMVRA; LTDMVRAR; TDMVRARR; DMVRARRI; MVRARRIL; VRARRILE; RARRILEV; ARRILEVI; RRILEVIE; RILEVIEA; ILEVIEAE; LEVIEAEG; EVIEAEGL; VIEAEGLF; IEAEGLFE; EAEGLFER; AEGLFERA; EGLFERAV; GLFERAVQ; LFERAVQH; FERAVQHG; ERAVQHGK; RAVQHGKY; AVQHGKYL; VQHGKYLR; QHGKYLRA; HGKYLRAR; GKYLRARL; KYLRARLD; YLRARLDE; LRARLDEL; RARLDELA; ARLDELAA; RLDELAAD; LDELAADF; DELAADFP; ELAADFPA; LAADFPAV; AADFPAVV; ADFPAVVL; DFPAVVLD; FPAVVLDP; PAVVLDPR; AVVLDPRG; VVLDPRGR; VLDPRGRG; LDPRGRGL; DPRGRGLM; PRGRGLMC; RGRGLMCA; GRGLMCAF; RGLMCAFS; GLMCAFSL; LMCAFSLP; MCAFSLPT; CAFSLPTT; AFSLPTTA; FSLPTTAD; SLPTTADR; LPTTADRD; PTTADRDE; TTADRDEL; TADRDELI; ADRDELIR; DRDELIRQ; RDELIRQL; DELIRQLW; ELIRQLWQ; LIRQLWQR; IRQLWQRA; RQLWQRAV; QLWQRAVI; LWQRAVIV; WQRAVIVL; QRAVIVLP; RAVIVLPA; AVIVLPAG; VIVLPAGA; IVLPAGAD; VLPAGADT; LPAGADTV; PAGADTVR; AGADTVRF; GADTVRFR; ADTVRFRP; DTVRFRPP; TVRFRPPL; VRFRPPLT; RFRPPLTV; FRPPLTVS; RPPLTVST; PPLTVSTA; PLTVSTAE; LTVSTAEI; TVSTAEID; VSTAEIDA; STAEIDAA; TAEIDAAI; AEIDAAIA; EIDAAIAA; IDAAIAAV; | |

Fig. 28 continued

| | | |
|---|---|---|
| | DAAIAAVR; AAIAAVRS; AIAAVRSA; IAAVRSAL; AAVRSALP; AVRSALPV; VRSALPVV; RSALPVVT<br><br>9 mers:<br>MAAVVKSVA; AAVVKSVAL; AVVKSVALA; VVKSVALAG; VKSVALAGR; KSVALAGRP; SVALAGRPT; VALAGRPTT; ALAGRPTTP; LAGRPTTPD; AGRPTTPDR; GRPTTPDRV; RPTTPDRVH; PTTPDRVHE; TTPDRVHEV; TPDRVHEVL; PDRVHEVLG; DRVHEVLGR; RVHEVLGRS; VHEVLGRSM; HEVLGRSML; EVLGRSMLV; VLGRSMLVD; LGRSMLVDG; GRSMLVDGL; RSMLVDGLD; SMLVDGLDI; MLVDGLDIV; LVDGLDIVL; VDGLDIVLD; DGLDIVLDL; GLDIVLDLT; LDIVLDLTR; DIVLDLTRS; IVLDLTRSG; VLDLTRSGG; LDLTRSGGS; DLTRSGGSY; LTRSGGSYL; TRSGGSYLV; RSGGSYLVD; SGGSYLVDA; GGSYLVDAI; GSYLVDAIT; SYLVDAITG; YLVDAITGR; LVDAITGRR; VDAITGRRY; DAITGRRYL; AITGRRYLD; ITGRRYLDM; TGRRYLDMF; GRRYLDMFT; RRYLDMFTF; RYLDMFTFV; YLDMFTFVA; LDMFTFVAS; DMFTFVASS; MFTFVASSA; FTFVASSAL; TFVASSALG; FVASSALGM; VASSALGMN; ASSALGMNP; SSALGMNPP; SALGMNPPA; ALGMNPPAL; LGMNPPALV; GMNPPALVD; MNPPALVDD; NPPALVDDR; PPALVDDRE; PALVDDREF; ALVDDREFH; LVDDREFHA; VDDREFHAE; DDREFHAEL; DREFHAELM; REFHAELMQ; EFHAELMQA; FHAELMQAA; HAELMQAAL; AELMQAALN; ELMQAALNK; LMQAALNKP; MQAALNKPS; QAALNKPSN; AALNKPSNS; ALNKPSNSD; LNKPSNSDV; NKPSNSDVY; KPSNSDVYS; PSNSDVYSV; SNSDVYSVA; NSDVYSVAM; SDVYSVAMA; DVYSVAMAR; VYSVAMARF; YSVAMARFV; SVAMARFVE; VAMARFVET; AMARFVETF; MARFVETFA; ARFVETFAR; RFVETFARV; FVETFARVL; VETFARVLG; ETFARVLGD; TFARVLGDP; FARVLGDPA; ARVLGDPAL; RVLGDPALP; VLGDPALPH; LGDPALPHL; GDPALPHLF; DPALPHLFF; PALPHLFFV; ALPHLFFVE; LPHLFFVEG; PHLFFVEGG; HLFFVEGGA; LFFVEGGAL; FFVEGGALA; FVEGGALAV; VEGGALAVE; EGGALAVEN; GGALAVENA; GALAVENAL; ALAVENALK; LAVENALKA; AVENALKAA; VENALKAAF; ENALKAAFD; NALKAAFDW; ALKAAFDWK; LKAAFDWKS; KAAFDWKSR; AAFDWKSRH; AFDWKSRHN; FDWKSRHNQ; DWKSRHNQA; WKSRHNQAH; KSRHNQAHG; SRHNQAHGI; RHNQAHGID; HNQAHGIDP; NQAHGIDPA; QAHGIDPAL; AHGIDPALG; HGIDPALGT; GIDPALGTQ; IDPALGTQV; DPALGTQVL; PALGTQVLH; ALGTQVLHL; LGTQVLHLR; GTQVLHLRG; TQVLHLRGA; QVLHLRGAF; VLHLRGAFH; LHLRGAFHG; HLRGAFHGR; LRGAFHGRS; RGAFHGRSG; GAFHGRSGY; AFHGRSGYT; FHGRSGYTL; HGRSGYTLS; GRSGYTLSL; RSGYTLSLT; SGYTLSLTN; GYTLSLTNT; YTLSLTNTK; TLSLTNTKP; LSLTNTKPT; SLTNTKPTI; LTNTKPTIT; TNTKPTITA; NTKPTITAR; TKPTITARF; KPTITARFP; PTITARFPK; TITARFPKF; ITARFPKFD; TARFPKFDW; ARFPKFDWP; RFPKFDWPR; FPKFDWPRI; PKFDWPRID; KFDWPRIDA; FDWPRIDAP; DWPRIDAPY; WPRIDAPYM; PRIDAPYMR; RIDAPYMRP; IDAPYMRPG; DAPYMRPGL; APYMRPGLD; PYMRPGLDE; YMRPGLDEP; MRPGLDEPA; RPGLDEPAM; PGLDEPAMA; GLDEPAMAA; LDEPAMAAL; DEPAMAALE; EPAMAALEA; | |

Fig. 28 continued

| | | |
|---|---|---|
| | PAMAALEAE; AMAALEAEA; MAALEAEAL; AALEAEALR; ALEAEALRQ; LEAEALRQA; EAEALRQAR; AEALRQARA; EALRQARAA; ALRQARAAF; LRQARAAFE; RQARAAFET; QARAAFETR; ARAAFETRP; RAAFETRPH; AAFETRPHD; AFETRPHDI; FETRPHDIA; ETRPHDIAC; TRPHDIACF; RPHDIACFV; PHDIACFVA; HDIACFVAE; DIACFVAEP; IACFVAEPI; ACFVAEPIQ; CFVAEPIQG; FVAEPIQGE; VAEPIQGEG; AEPIQGEGG; EPIQGEGGD; PIQGEGGDR; IQGEGGDRH; QGEGGDRHF; GEGGDRHFR; EGGDRHFRP; GGDRHFRPE; GDRHFRPEF; DRHFRPEFF; RHFRPEFFA; HFRPEFFAA; FRPEFFAAM; RPEFFAAMR; PEFFAAMRE; EFFAAMREL; FFAAMRELC; FAAMRELCD; AAMRELCDE; AMRELCDEF; MRELCDEFD; RELCDEFDA; ELCDEFDAL; LCDEFDALL; CDEFDALLI; DEFDALLIF; EFDALLIFD; FDALLIFDE; DALLIFDEV; ALLIFDEVQ; LLIFDEVQT; LIFDEVQTG; IFDEVQTGC; FDEVQTGCG; DEVQTGCGL; EVQTGCGLT; VQTGCGLTG; QTGCGLTGT; TGCGLTGTA; GCGLTGTAW; CGLTGTAWA; GLTGTAWAY; LTGTAWAYQ; TGTAWAYQQ; GTAWAYQQL; TAWAYQQLD; AWAYQQLDV; WAYQQLDVA; AYQQLDVAP; YQQLDVAPD; QQLDVAPDI; QLDVAPDIV; LDVAPDIVA; DVAPDIVAF; VAPDIVAFG; APDIVAFGK; PDIVAFGKK; DIVAFGKKT; IVAFGKKTQ; VAFGKKTQV; AFGKKTQVC; FGKKTQVCG; GKKTQVCGV; KKTQVCGVM; KTQVCGVMA; TQVCGVMAG; QVCGVMAGR; VCGVMAGRR; CGVMAGRRV; GVMAGRRVD; VMAGRRVDE; MAGRRVDEV; AGRRVDEVA; GRRVDEVAD; RRVDEVADN; RVDEVADNV; VDEVADNVF; DEVADNVFA; EVADNVFAV; VADNVFAVP; ADNVFAVPS; DNVFAVPSR; NVFAVPSRL; VFAVPSRLN; FAVPSRLNS; AVPSRLNST; VPSRLNSTW; PSRLNSTWG; SRLNSTWGG; RLNSTWGGN; LNSTWGGNL; NSTWGGNLT; STWGGNLTD; TWGGNLTDM; WGGNLTDMV; GGNLTDMVR; GNLTDMVRA; NLTDMVRAR; LTDMVRARR; TDMVRARRI; DMVRARRIL; MVRARRILE; VRARRILEV; RARRILEVI; ARRILEVIE; RRILEVIEA; RILEVIEAE; ILEVIEAEG; LEVIEAEGL; EVIEAEGLF; VIEAEGLFE; IEAEGLFER; EAEGLFERA; AEGLFERAV; EGLFERAVQ; GLFERAVQH; LFERAVQHG; FERAVQHGK; ERAVQHGKY; RAVQHGKYL; AVQHGKYLR; VQHGKYLRA; QHGKYLRAR; HGKYLRARL; GKYLRARLD; KYLRARLDE; YLRARLDEL; LRARLDELA; RARLDELAA; ARLDELAAD; RLDELAADF; LDELAADFP; DELAADFPA; ELAADFPAV; LAADFPAVV; AADFPAVVL; ADFPAVVLD; DFPAVVLDP; FPAVVLDPR; PAVVLDPRG; AVVLDPRGR; VVLDPRGRG; VLDPRGRGL; LDPRGRGLM; DPRGRGLMC; PRGRGLMCA; RGRGLMCAF; GRGLMCAFS; RGLMCAFSL; GLMCAFSLP; LMCAFSLPT; MCAFSLPTT; CAFSLPTTA; AFSLPTTAD; FSLPTTADR; SLPTTADRD; LPTTADRDE; PTTADRDEL; TTADRDELI; TADRDELIR; ADRDELIRQ; DRDELIRQL; RDELIRQLW; DELIRQLWQ; ELIRQLWQR; LIRQLWQRA; IRQLWQRAV; RQLWQRAVI; QLWQRAVIV; LWQRAVIVL; WQRAVIVLP; QRAVIVLPA; RAVIVLPAG; AVIVLPAGA; VIVLPAGAD; IVLPAGADT; VLPAGADTV; LPAGADTVR; PAGADTVRF; AGADTVRFR; GADTVRFRP; ADTVRFRPP; DTVRFRPPL; TVRFRPPLT; VRFRPPLTV; RFRPPLTVS; FRPPLTVST; RPPLTVSTA; PPLTVSTAE; PLTVSTAEI; LTVSTAEID; TVSTAEIDA; VSTAEIDAA; STAEIDAAI; TAEIDAAIA; AEIDAAIAA; EIDAAIAAV; IDAAIAAVR; DAAIAAVRS; AAIAAVRSA; AIAAVRSAL; IAAVRSALP; | |

Fig. 28 continued

| | | | |
|---|---|---|---|
| | AAVRSALPV; AVRSALPVV; VRSALPVVT<br><br>10 mers:<br>MAAVVKSVAL; AAVVKSVALA; AVVKSVALAG; VVKSVALAGR; VKSVALAGRP; KSVALAGRPT; SVALAGRPTT; VALAGRPTTP; ALAGRPTTPD; LAGRPTTPDR; AGRPTTPDRV; GRPTTPDRVH; RPTTPDRVHE; PTTPDRVHEV; TTPDRVHEVL; TPDRVHEVLG; PDRVHEVLGR; DRVHEVLGRS; RVHEVLGRSM; VHEVLGRSML; HEVLGRSMLV; EVLGRSMLVD; VLGRSMLVDG; LGRSMLVDGL; GRSMLVDGLD; RSMLVDGLDI; SMLVDGLDIV; MLVDGLDIVL; LVDGLDIVLD; VDGLDIVLDL; DGLDIVLDLT; GLDIVLDLTR; LDIVLDLTRS; DIVLDLTRSG; IVLDLTRSGG; VLDLTRSGGS; LDLTRSGGSY; DLTRSGGSYL; LTRSGGSYLV; TRSGGSYLVD; RSGGSYLVDA; SGGSYLVDAI; GGSYLVDAIT; GSYLVDAITG; SYLVDAITGR; YLVDAITGRR; LVDAITGRRY; VDAITGRRYL; DAITGRRYLD; AITGRRYLDM; ITGRRYLDMF; TGRRYLDMFT; GRRYLDMFTF; RRYLDMFTFV; RYLDMFTFVA; YLDMFTFVAS; LDMFTFVASS; DMFTFVASSA; MFTFVASSAL; FTFVASSALG; TFVASSALGM; FVASSALGMN; VASSALGMNP; ASSALGMNPP; SSALGMNPPA; SALGMNPPAL; ALGMNPPALV; LGMNPPALVD; GMNPPALVDD; MNPPALVDDR; NPPALVDDRE; PPALVDDREF; PALVDDREFH; ALVDDREFHA; LVDDREFHAE; VDDREFHAEL; DDREFHAELM; DREFHAELMQ; REFHAELMQA; EFHAELMQAA; FHAELMQAAL; HAELMQAALN; AELMQAALNK; ELMQAALNKP; LMQAALNKPS; MQAALNKPSN; QAALNKPSNS; AALNKPSNSD; ALNKPSNSDV; LNKPSNSDVY; NKPSNSDVYS; KPSNSDVYSV; PSNSDVYSVA; SNSDVYSVAM; NSDVYSVAMA; SDVYSVAMAR; DVYSVAMARF; VYSVAMARFV; YSVAMARFVE; SVAMARFVET; VAMARFVETF; AMARFVETFA; MARFVETFAR; ARFVETFARV; RFVETFARVL; FVETFARVLG; VETFARVLGD; ETFARVLGDP; TFARVLGDPA; FARVLGDPAL; ARVLGDPALP; RVLGDPALPH; VLGDPALPHL; LGDPALPHLF; GDPALPHLFF; DPALPHLFFV; PALPHLFFVE; ALPHLFFVEG; LPHLFFVEGG; PHLFFVEGGA; HLFFVEGGAL; LFFVEGGALA; FFVEGGALAV; FVEGGALAVE; VEGGALAVEN; EGGALAVENA; GGALAVENAL; GALAVENALK; ALAVENALKA; LAVENALKAA; AVENALKAAF; VENALKAAFD; ENALKAAFDW; NALKAAFDWK; ALKAAFDWKS; LKAAFDWKSR; KAAFDWKSRH; AAFDWKSRHN; AFDWKSRHNQ; FDWKSRHNQA; DWKSRHNQAH; WKSRHNQAHG; KSRHNQAHGI; SRHNQAHGID; RHNQAHGIDP; HNQAHGIDPA; NQAHGIDPAL; QAHGIDPALG; AHGIDPALGT; HGIDPALGTQ; GIDPALGTQV; IDPALGTQVL; DPALGTQVLH; PALGTQVLHL; ALGTQVLHLR; LGTQVLHLRG; GTQVLHLRGA; TQVLHLRGAF; QVLHLRGAFH; VLHLRGAFHG; LHLRGAFHGR; HLRGAFHGRS; LRGAFHGRSG; RGAFHGRSGY; GAFHGRSGYT; AFHGRSGYTL; FHGRSGYTLS; HGRSGYTLSL; GRSGYTLSLT; RSGYTLSLTN; SGYTLSLTNT; GYTLSLTNTK; YTLSLTNTKP; TLSLTNTKPT; LSLTNTKPTI; SLTNTKPTIT; LTNTKPTITA; TNTKPTITAR; NTKPTITARF; TKPTITARFP; KPTITARFPK; PTITARFPKF; TITARFPKFD; ITARFPKFDW; TARFPKFDWP; ARFPKFDWPR; RFPKFDWPRI; FPKFDWPRID; PKFDWPRIDA; KFDWPRIDAP; FDWPRIDAPY; DWPRIDAPYM; WPRIDAPYMR; PRIDAPYMRP; RIDAPYMRPG; IDAPYMRPGL; DAPYMRPGLD; APYMRPGLDE; PYMRPGLDEP; YMRPGLDEPA; | |

Fig. 28 continued

MRPGLDEPAM; RPGLDEPAMA; PGLDEPAMAA; GLDEPAMAAL;
LDEPAMAALE; DEPAMAALEA; EPAMAALEAE; PAMAALEAEA;
AMAALEAEAL; MAALEAEALR; AALEAEALRQ; ALEAEALRQA;
LEAEALRQAR; EAEALRQARA; AEALRQARAA; EALRQARAAF;
ALRQARAAFE; LRQARAAFET; RQARAAFETR; QARAAFETRP;
ARAAFETRPH; RAAFETRPHD; AAFETRPHDI; AFETRPHDIA;
FETRPHDIAC; ETRPHDIACF; TRPHDIACFV; RPHDIACFVA;
PHDIACFVAE; HDIACFVAEP; DIACFVAEPI; IACFVAEPIQ;
ACFVAEPIQG; CFVAEPIQGE; FVAEPIQGEG; VAEPIQGEGG;
AEPIQGEGGD; EPIQGEGGDR; PIQGEGGDRH; IQGEGGDRHF;
QGEGGDRHFR; GEGGDRHFRP; EGGDRHFRPE; GGDRHFRPEF;
GDRHFRPEFF; DRHFRPEFFA; RHFRPEFFAA; HFRPEFFAAM;
FRPEFFAAMR; RPEFFAAMRE; PEFFAAMREL; EFFAAMRELC;
FFAAMRELCD; FAAMRELCDE; AAMRELCDEF; AMRELCDEFD;
MRELCDEFDA; RELCDEFDAL; ELCDEFDALL; LCDEFDALLI;
CDEFDALLIF; DEFDALLIFD; EFDALLIFDE; FDALLIFDEV;
DALLIFDEVQ; ALLIFDEVQT; LLIFDEVQTG; LIFDEVQTGC;
IFDEVQTGCG; FDEVQTGCGL; DEVQTGCGLT; EVQTGCGLTG;
VQTGCGLTGT; QTGCGLTGTA; TGCGLTGTAW; GCGLTGTAWA;
CGLTGTAWAY; GLTGTAWAYQ; LTGTAWAYQQ; TGTAWAYQQL;
GTAWAYQQLD; TAWAYQQLDV; AWAYQQLDVA; WAYQQLDVAP;
AYQQLDVAPD; YQQLDVAPDI; QQLDVAPDIV; QLDVAPDIVA;
LDVAPDIVAF; DVAPDIVAFG; VAPDIVAFGK; APDIVAFGKK;
PDIVAFGKKT; DIVAFGKKTQ; IVAFGKKTQV; VAFGKKTQVC;
AFGKKTQVCG; FGKKTQVCGV; GKKTQVCGVM; KKTQVCGVMA;
KTQVCGVMAG; TQVCGVMAGR; QVCGVMAGRR; VCGVMAGRRV;
CGVMAGRRVD; GVMAGRRVDE; VMAGRRVDEV; MAGRRVDEVA;
AGRRVDEVAD; GRRVDEVADN; RRVDEVADNV; RVDEVADNVF;
VDEVADNVFA; DEVADNVFAV; EVADNVFAVP; VADNVFAVPS;
ADNVFAVPSR; DNVFAVPSRL; NVFAVPSRLN; VFAVPSRLNS;
FAVPSRLNST; AVPSRLNSTW; VPSRLNSTWG; PSRLNSTWGG;
SRLNSTWGGN; RLNSTWGGNL; LNSTWGGNLT; NSTWGGNLTD;
STWGGNLTDM; TWGGNLTDMV; WGGNLTDMVR; GGNLTDMVRA;
GNLTDMVRAR; NLTDMVRARR; LTDMVRARRI; TDMVRARRIL;
DMVRARRILE; MVRARRILEV; VRARRILEVI; RARRILEVIE;
ARRILEVIEA; RRILEVIEAE; RILEVIEAEG; ILEVIEAEGL; LEVIEAEGLF;
EVIEAEGLFE; VIEAEGLFER; IEAEGLFERA; EAEGLFERAV;
AEGLFERAVQ; EGLFERAVQH; GLFERAVQHG; LFERAVQHGK;
FERAVQHGKY; ERAVQHGKYL; RAVQHGKYLR; AVQHGKYLRA;
VQHGKYLRAR; QHGKYLRARL; HGKYLRARLD; GKYLRARLDE;
KYLRARLDEL; YLRARLDELA; LRARLDELAA; RARLDELAAD;
ARLDELAADF; RLDELAADFP; LDELAADFPA; DELAADFPAV;
ELAADFPAVV; LAADFPAVVL; AADFPAVVLD; ADFPAVVLDP;
DFPAVVLDPR; FPAVVLDPRG; PAVVLDPRGR; AVVLDPRGRG;
VVLDPRGRGL; VLDPRGRGLM; LDPRGRGLMC; DPRGRGLMCA;
PRGRGLMCAF; RGRGLMCAFS; GRGLMCAFSL; RGLMCAFSLP;
GLMCAFSLPT; LMCAFSLPTT; MCAFSLPTTA; CAFSLPTTAD;
AFSLPTTADR; FSLPTTADRD; SLPTTADRDE; LPTTADRDEL;
PTTADRDELI; TTADRDELIR; TADRDELIRQ; ADRDELIRQL;
DRDELIRQLW; RDELIRQLWQ; DELIRQLWQR; ELIRQLWQRA;
LIRQLWQRAV; IRQLWQRAVI; RQLWQRAVIV; QLWQRAVIVL;
LWQRAVIVLP; WQRAVIVLPA; QRAVIVLPAG; RAVIVLPAGA;
AVIVLPAGAD; VIVLPAGADT; IVLPAGADTV; VLPAGADTVR;

Fig. 28 continued

LPAGADTVRF; PAGADTVRFR; AGADTVRFRP; GADTVRFRPP; ADTVRFRPPL; DTVRFRPPLT; TVRFRPPLTV; VRFRPPLTVS; RFRPPLTVST; FRPPLTVSTA; RPPLTVSTAE; PPLTVSTAEI; PLTVSTAEID; LTVSTAEIDA; TVSTAEIDAA; VSTAEIDAAI; STAEIDAAIA; TAEIDAAIAA; AEIDAAIAAV; EIDAAIAAVR; IDAAIAAVRS; DAAIAAVRSA; AAIAAVRSAL; AIAAVRSALP; IAAVRSALPV; AAVRSALPVV;

11 mers:
MAAVVKSVALA; AAVVKSVALAG; AVVKSVALAGR; VVKSVALAGRP; VKSVALAGRPT; KSVALAGRPTT; SVALAGRPTTP; VALAGRPTTPD; ALAGRPTTPDR; LAGRPTTPDRV; AGRPTTPDRVH; GRPTTPDRVHE; RPTTPDRVHEV; PTTPDRVHEVL; TTPDRVHEVLG; TPDRVHEVLGR; PDRVHEVLGRS; DRVHEVLGRSM; RVHEVLGRSML; VHEVLGRSMLV; HEVLGRSMLVD; EVLGRSMLVDG; VLGRSMLVDGL; LGRSMLVDGLD; GRSMLVDGLDI; RSMLVDGLDIV; SMLVDGLDIVL; MLVDGLDIVLD; LVDGLDIVLDL; VDGLDIVLDLT; DGLDIVLDLTR; GLDIVLDLTRS; LDIVLDLTRSG; DIVLDLTRSGG; IVLDLTRSGGS; VLDLTRSGGSY; LDLTRSGGSYL; DLTRSGGSYLV; LTRSGGSYLVD; TRSGGSYLVDA; RSGGSYLVDAI; SGGSYLVDAIT; GGSYLVDAITG; GSYLVDAITGR; SYLVDAITGRR; YLVDAITGRRY; LVDAITGRRYL; VDAITGRRYLD; DAITGRRYLDM; AITGRRYLDMF; ITGRRYLDMFT; TGRRYLDMFTF; GRRYLDMFTFV; RRYLDMFTFVA; RYLDMFTFVAS; YLDMFTFVASS; LDMFTFVASSA; DMFTFVASSAL; MFTFVASSALG; FTFVASSALGM; TFVASSALGMN; FVASSALGMNP; VASSALGMNPP; ASSALGMNPPA; SSALGMNPPAL; SALGMNPPALV; ALGMNPPALVD; LGMNPPALVDD; GMNPPALVDDR; MNPPALVDDRE; NPPALVDDREF; PPALVDDREFH; PALVDDREFHA; ALVDDREFHAE; LVDDREFHAEL; VDDREFHAELM; DDREFHAELMQ; DREFHAELMQA; REFHAELMQAA; EFHAELMQAAL; FHAELMQAALN; HAELMQAALNK; AELMQAALNKP; ELMQAALNKPS; LMQAALNKPSN; MQAALNKPSNS; QAALNKPSNSD; AALNKPSNSDV; ALNKPSNSDVY; LNKPSNSDVYS; NKPSNSDVYSV; KPSNSDVYSVA; PSNSDVYSVAM; SNSDVYSVAMA; NSDVYSVAMAR; SDVYSVAMARF; DVYSVAMARFV; VYSVAMARFVE; YSVAMARFVET; SVAMARFVETF; VAMARFVETFA; AMARFVETFAR; MARFVETFARV; ARFVETFARVL; RFVETFARVLG; FVETFARVLGD; VETFARVLGDP; ETFARVLGDPA; TFARVLGDPAL; FARVLGDPALP; ARVLGDPALPH; RVLGDPALPHL; VLGDPALPHLF; LGDPALPHLFF; GDPALPHLFFV; DPALPHLFFVE; PALPHLFFVEG; ALPHLFFVEGG; LPHLFFVEGGA; PHLFFVEGGAL; HLFFVEGGALA; LFFVEGGALAV; FFVEGGALAVE; FVEGGALAVEN; VEGGALAVENA; EGGALAVENAL; GGALAVENALK; GALAVENALKA; ALAVENALKAA; LAVENALKAAF; AVENALKAAFD; VENALKAAFDW; ENALKAAFDWK; NALKAAFDWKS; ALKAAFDWKSR; LKAAFDWKSRH; KAAFDWKSRHN; AAFDWKSRHNQ; AFDWKSRHNQA; FDWKSRHNQAH; DWKSRHNQAHG; WKSRHNQAHGI; KSRHNQAHGID; SRHNQAHGIDP; RHNQAHGIDPA; HNQAHGIDPAL; NQAHGIDPALG; QAHGIDPALGT; AHGIDPALGTQ; HGIDPALGTQV; GIDPALGTQVL; IDPALGTQVLH; DPALGTQVLHL; PALGTQVLHLR; ALGTQVLHLRG; LGTQVLHLRGA; GTQVLHLRGAF; TQVLHLRGAFH; QVLHLRGAFHG; VLHLRGAFHGR; LHLRGAFHGRS; HLRGAFHGRSG; LRGAFHGRSGY; RGAFHGRSGYT; GAFHGRSGYTL; AFHGRSGYTLS; FHGRSGYTLSL; HGRSGYTLSLT;

Fig. 28 continued

| | | |
|---|---|---|
| | GRSGYTLSLTN; RSGYTLSLTNT; SGYTLSLTNTK; GYTLSLTNTKP;<br>YTLSLTNTKPT; TLSLTNTKPTI; LSLTNTKPTIT; SLTNTKPTITA;<br>LTNTKPTITAR; TNTKPTITARF; NTKPTITARFP; TKPTITARFPK;<br>KPTITARFPKF; PTITARFPKFD; TITARFPKFDW; ITARFPKFDWP;<br>TARFPKFDWPR; ARFPKFDWPRI; RFPKFDWPRID; FPKFDWPRIDA;<br>PKFDWPRIDAP; KFDWPRIDAPY; FDWPRIDAPYM; DWPRIDAPYMR;<br>WPRIDAPYMRP; PRIDAPYMRPG; RIDAPYMRPGL; IDAPYMRPGLD;<br>DAPYMRPGLDE; APYMRPGLDEP; PYMRPGLDEPA;<br>YMRPGLDEPAM; MRPGLDEPAMA; RPGLDEPAMAA;<br>PGLDEPAMAAL; GLDEPAMAALE; LDEPAMAALEA; DEPAMAALEAE;<br>EPAMAALEAEA; PAMAALEAEAL; AMAALEAEALR; MAALEAEALRQ;<br>AALEAEALRQA; ALEAEALRQAR; LEAEALRQARA; EAEALRQARAA;<br>AEALRQARAAF; EALRQARAAFE; ALRQARAAFET; LRQARAAFETR;<br>RQARAAFETRP; QARAAFETRPH; ARAAFETRPHD; RAAFETRPHDI;<br>AAFETRPHDIA; AFETRPHDIAC; FETRPHDIACF; ETRPHDIACFV;<br>TRPHDIACFVA; RPHDIACFVAE; PHDIACFVAEP; HDIACFVAEPI;<br>DIACFVAEPIQ; IACFVAEPIQG; ACFVAEPIQGE; CFVAEPIQGEG;<br>FVAEPIQGEGG; VAEPIQGEGGD; AEPIQGEGGDR; EPIQGEGGDRH;<br>PIQGEGGDRHF; IQGEGGDRHFR; QGEGGDRHFRP;<br>GEGGDRHFRPE; EGGDRHFRPEF; GGDRHFRPEFF;<br>GDRHFRPEFFA; DRHFRPEFFAA; RHFRPEFFAAM; HFRPEFFAAMR;<br>FRPEFFAAMRE; RPEFFAAMREL; PEFFAAMRELC; EFFAAMRELCD;<br>FFAAMRELCDE; FAAMRELCDEF; AAMRELCDEFD; AMRELCDEFDA;<br>MRELCDEFDAL; RELCDEFDALL; ELCDEFDALLI; LCDEFDALLIF;<br>CDEFDALLIFD; DEFDALLIFDE; EFDALLIFDEV; FDALLIFDEVQ;<br>DALLIFDEVQT; ALLIFDEVQTG; LLIFDEVQTGC; LIFDEVQTGCG;<br>IFDEVQTGCGL; FDEVQTGCGLT; DEVQTGCGLTG; EVQTGCGLTGT;<br>VQTGCGLTGTA; QTGCGLTGTAW; TGCGLTGTAWA;<br>GCGLTGTAWAY; CGLTGTAWAYQ; GLTGTAWAYQQ;<br>LTGTAWAYQQL; TGTAWAYQQLD; GTAWAYQQLDV;<br>TAWAYQQLDVA; AWAYQQLDVAP; WAYQQLDVAPD;<br>AYQQLDVAPDI; YQQLDVAPDIV; QQLDVAPDIVA; QLDVAPDIVAF;<br>LDVAPDIVAFG; DVAPDIVAFGK; VAPDIVAFGKK; APDIVAFGKKT;<br>PDIVAFGKKTQ; DIVAFGKKTQV; IVAFGKKTQVC; VAFGKKTQVCG;<br>AFGKKTQVCGV; FGKKTQVCGVM; GKKTQVCGVMA;<br>KKTQVCGVMAG; KTQVCGVMAGR; TQVCGVMAGRR;<br>QVCGVMAGRRV; VCGVMAGRRVD; CGVMAGRRVDE;<br>GVMAGRRVDEV; VMAGRRVDEVA; MAGRRVDEVAD;<br>AGRRVDEVADN; GRRVDEVADNV; RRVDEVADNVF;<br>RVDEVADNVFA; VDEVADNVFAV; DEVADNVFAVP; EVADNVFAVPS;<br>VADNVFAVPSR; ADNVFAVPSRL; DNVFAVPSRLN; NVFAVPSRLNS;<br>VFAVPSRLNST; FAVPSRLNSTW; AVPSRLNSTWG; VPSRLNSTWGG;<br>PSRLNSTWGGN; SRLNSTWGGNL; RLNSTWGGNLT;<br>LNSTWGGNLTD; NSTWGGNLTDM; STWGGNLTDMV;<br>TWGGNLTDMVR; WGGNLTDMVRA; GGNLTDMVRAR;<br>GNLTDMVRARR; NLTDMVRARRI; LTDMVRARRIL; TDMVRARRILE;<br>DMVRARRILEV; MVRARRILEVI; VRARRILEVIE; RARRILEVIEA;<br>ARRILEVIEAE; RRILEVIEAEG; RILEVIEAEGL; ILEVIEAEGLF;<br>LEVIEAEGLFE; EVIEAEGLFER; VIEAEGLFERA; IEAEGLFERAV;<br>EAEGLFERAVQ; AEGLFERAVQH; EGLFERAVQHG; GLFERAVQHGK;<br>LFERAVQHGKY; FERAVQHGKYL; ERAVQHGKYLR; RAVQHGKYLRA;<br>AVQHGKYLRAR; VQHGKYLRARL; QHGKYLRARLD; HGKYLRARLDE;<br>GKYLRARLDEL; KYLRARLDELA; YLRARLDELAA; LRARLDELAAD; | |

Fig. 28 continued

| | | |
|---|---|---|
| | RARLDELAADF; ARLDELAADFP; RLDELAADFPA; LDELAADFPAV; DELAADFPAVV; ELAADFPAVVL; LAADFPAVVLD; AADFPAVVLDP; ADFPAVVLDPR; DFPAVVLDPRG; FPAVVLDPRGR; PAVVLDPRGRG; AVVLDPRGRGL; VVLDPRGRGLM; VLDPRGRGLMC; LDPRGRGLMCA; DPRGRGLMCAF; PRGRGLMCAFS; RGRGLMCAFSL; GRGLMCAFSLP; RGLMCAFSLPT; GLMCAFSLPTT; LMCAFSLPTTA; MCAFSLPTTAD; CAFSLPTTADR; AFSLPTTADRD; FSLPTTADRDE; SLPTTADRDEL; LPTTADRDELI; PTTADRDELIR; TTADRDELIRQ; TADRDELIRQL; ADRDELIRQLW; DRDELIRQLWQ; RDELIRQLWQR; DELIRQLWQRA; ELIRQLWQRAV; LIRQLWQRAVI; IRQLWQRAVIV; RQLWQRAVIVL; QLWQRAVIVLP; LWQRAVIVLPA; WQRAVIVLPAG; QRAVIVLPAGA; RAVIVLPAGAD; AVIVLPAGADT; VIVLPAGADTV; IVLPAGADTVR; VLPAGADTVRF; LPAGADTVRFR; PAGADTVRFRP; AGADTVRFRPP; GADTVRFRPPL; ADTVRFRPPLT; DTVRFRPPLTV; TVRFRPPLTVS; VRFRPPLTVST; RFRPPLTVSTA; FRPPLTVSTAE; RPPLTVSTAEI; PPLTVSTAEID; PLTVSTAEIDA; LTVSTAEIDAA; TVSTAEIDAAI; VSTAEIDAAIA; STAEIDAAIAA; TAEIDAAIAAV; AEIDAAIAAVR; EIDAAIAAVRS; IDAAIAAVRSA; DAAIAAVRSAL; AAIAAVRSALP; AIAAVRSALPV; IAAVRSALPVV; AAVRSALPVVT | |
| 62) Rv3291c | 8 mers:<br>MNEALDDI; NEALDDID; EALDDIDR; ALDDIDRI; LDDIDRIL; DDIDRILV; DIDRILVR; IDRILVRE; DRILVREL; RILVRELA; ILVRELAA; LVRELAAD; VRELAADG; RELAADGR; ELAADGRA; LAADGRAT; AADGRATL; ADGRATLS; DGRATLSE; GRATLSEL; RATLSELA; ATLSELAT; TLSELATR; LSELATRA; SELATRAG; ELATRAGL; LATRAGLS; ATRAGLSV; TRAGLSVS; RAGLSVSA; AGLSVSAV; GLSVSAVQ; LSVSAVQS; SVSAVQSR; VSAVQSRV; SAVQSRVR; AVQSRVRR; VQSRVRRL; QSRVRRLE; SRVRRLES; RVRRLESR; VRRLESRG; RRLESRGV; RLESRGVV; LESRGVVQ; ESRGVVQG; SRGVVQGY; RGVVQGYS; GVVQGYSA; VVQGYSAR; VQGYSARI; QGYSARIN; GYSARINP; YSARINPE; SARINPEA; ARINPEAV; RINPEAVG; INPEAVGH; NPEAVGHL; PEAVGHLL; EAVGHLLS; AVGHLLSA; VGHLLSAF; GHLLSAFV; HLLSAFVA; LLSAFVAI; LSAFVAIT; SAFVAITP; AFVAITPL; FVAITPLD; VAITPLDP; AITPLDPS; ITPLDPSQ; TPLDPSQP; PLDPSQPD; LDPSQPDD; DPSQPDDA; PSQPDDAP; SQPDDAPA; QPDDAPAR; PDDAPARL; DDAPARLE; DAPARLEH; APARLEHI; PARLEHIE; ARLEHIEE; RLEHIEEV; LEHIEEVE; EHIEEVES; HIEEVESC; IEEVESCY; EEVESCYS; EVESCYSV; VESCYSVA; ESCYSVAG; SCYSVAGE; CYSVAGEE; YSVAGEES; SVAGEESY; VAGEESYV; AGEESYVL; GEESYVLL; EESYVLLV; ESYVLLVR; SYVLLVRV; YVLLVRVA; VLLVRVAS; LLVRVASA; LVRVASAR; VRVASARA; RVASARAL; VASARALE; ASARALED; SARALEDL; ARALEDLL; RALEDLLQ; ALEDLLQR; LEDLLQRI; EDLLQRIR; DLLQRIRT; LLQRIRTT; LQRIRTTA; QRIRTTAN; RIRTTANV; IRTTANVR; RTTANVRT; TTANVRTR; TANVRTRS; ANVRTRST; NVRTRSTI; VRTRSTII; RTRSTIIL; TRSTIILN; RSTIILNT; STIILNTF; TIILNTFY; IILNTFYS; ILNTFYSD; LNTFYSDR; NTFYSDRQ; TFYSDRQH; FYSDRQHI; YSDRQHIP<br><br>9 mers:<br>MNEALDDID; NEALDDIDR; EALDDIDRI; ALDDIDRIL; LDDIDRILV; | 44486-45051 |

Fig. 28 continued

| | | |
|---|---|---|
| | DDIDRILVR; DIDRILVRE; IDRILVREL; DRILVRELA; RILVRELAA;<br>ILVRELAAD; LVRELAADG; VRELAADGR; RELAADGRA;<br>ELAADGRAT; LAADGRATL; AADGRATLS; ADGRATLSE;<br>DGRATLSEL; GRATLSELA; RATLSELAT; ATLSELATR; TLSELATRA;<br>LSELATRAG; SELATRAGL; ELATRAGLS; LATRAGLSV; ATRAGLSVS;<br>TRAGLSVSA; RAGLSVSAV; AGLSVSAVQ; GLSVSAVQS;<br>LSVSAVQSR; SVSAVQSRV; VSAVQSRVR; SAVQSRVRR;<br>AVQSRVRRL; VQSRVRRLE; QSRVRRLES; SRVRRLESR;<br>RVRRLESRG; VRRLESRGV; RRLESRGVV; RLESRGVVQ;<br>LESRGVVQG; ESRGVVQGY; SRGVVQGYS; RGVVQGYSA;<br>GVVQGYSAR; VVQGYSARI; VQGYSARIN; QGYSARINP;<br>GYSARINPE; YSARINPEA; SARINPEAV; ARINPEAVG; RINPEAVGH;<br>INPEAVGHL; NPEAVGHLL; PEAVGHLLS; EAVGHLLSA; AVGHLLSAF;<br>VGHLLSAFV; GHLLSAFVA; HLLSAFVAI; LLSAFVAIT; LSAFVAITP;<br>SAFVAITPL; AFVAITPLD; FVAITPLDP; VAITPLDPS; AITPLDPSQ;<br>ITPLDPSQP; TPLDPSQPD; PLDPSQPDD; LDPSQPDDA;<br>DPSQPDDAP; PSQPDDAPA; SQPDDAPAR; QPDDAPARL;<br>PDDAPARLE; DDAPARLEH; DAPARLEHI; APARLEHIE; PARLEHIEE;<br>ARLEHIEEV; RLEHIEEVE; LEHIEEVES; EHIEEVESC; HIEEVESCY;<br>IEEVESCYS; EEVESCYSV; EVESCYSVA; VESCYSVAG;<br>ESCYSVAGE; SCYSVAGEE; CYSVAGEES; YSVAGEESY;<br>SVAGEESYV; VAGEESYVL; AGEESYVLL; GEESYVLLV;<br>EESYVLLVR; ESYVLLVRV; SYVLLVRVA; YVLLVRVAS; VLLVRVASA;<br>LLVRVASAR; LVRVASARA; VRVASARAL; RVASARALE;<br>VASARALED; ASARALEDL; SARALEDLL; ARALEDLLQ; RALEDLLQR;<br>ALEDLLQRI; LEDLLQRIR; EDLLQRIRT; DLLQRIRTT; LLQRIRTTA;<br>LQRIRTTAN; QRIRTTANV; RIRTTANVR; IRTTANVRT; RTTANVRTR;<br>TTANVRTRS; TANVRTRST; ANVRTRSTI; NVRTRSTII; VRTRSTIIL;<br>RTRSTIILN; TRSTIILNT; RSTIILNTF; STIILNTFY; TIILNTFYS;<br>IILNTFYSD; ILNTFYSDR; LNTFYSDRQ; NTFYSDRQH; TFYSDRQHI;<br>FYSDRQHIP<br><br>10 mers:<br>MNEALDDIDR; NEALDDIDRI; EALDDIDRIL; ALDDIDRILV;<br>LDDIDRILVR; DDIDRILVRE; DIDRILVREL; IDRILVRELA;<br>DRILVRELAA; RILVRELAAD; ILVRELAADG; LVRELAADGR;<br>VRELAADGRA; RELAADGRAT; ELAADGRATL; LAADGRATLS;<br>AADGRATLSE; ADGRATLSEL; DGRATLSELA; GRATLSELAT;<br>RATLSELATR; ATLSELATRA; TLSELATRAG; LSELATRAGL;<br>SELATRAGLS; ELATRAGLSV; LATRAGLSVS; ATRAGLSVSA;<br>TRAGLSVSAV; RAGLSVSAVQ; AGLSVSAVQS; GLSVSAVQSR;<br>LSVSAVQSRV; SVSAVQSRVR; VSAVQSRVRR; SAVQSRVRRL;<br>AVQSRVRRLE; VQSRVRRLES; QSRVRRLESR; SRVRRLESRG;<br>RVRRLESRGV; VRRLESRGVV; RRLESRGVVQ; RLESRGVVQG;<br>LESRGVVQGY; ESRGVVQGYS; SRGVVQGYSA; RGVVQGYSAR;<br>GVVQGYSARI; VVQGYSARIN; VQGYSARINP; QGYSARINPE;<br>GYSARINPEA; YSARINPEAV; SARINPEAVG; ARINPEAVGH;<br>RINPEAVGHL; INPEAVGHLL; NPEAVGHLLS; PEAVGHLLSA;<br>EAVGHLLSAF; AVGHLLSAFV; VGHLLSAFVA; GHLLSAFVAI;<br>HLLSAFVAIT; LLSAFVAITP; LSAFVAITPL; SAFVAITPLD;<br>AFVAITPLDP; FVAITPLDPS; VAITPLDPSQ; AITPLDPSQP;<br>ITPLDPSQPD; TPLDPSQPDD; PLDPSQPDDA; LDPSQPDDAP;<br>DPSQPDDAPA; PSQPDDAPAR; SQPDDAPARL; QPDDAPARLE; | |

Fig. 28 continued

| | | |
|---|---|---|
| | PDDAPARLEH; DDAPARLEHI; DAPARLEHIE; APARLEHIEE; PARLEHIEEV; ARLEHIEEVE; RLEHIEEVES; LEHIEEVESC; EHIEEVESCY; HIEEVESCYS; IEEVESCYSV; EEVESCYSVA; EVESCYSVAG; VESCYSVAGE; ESCYSVAGEE; SCYSVAGEES; CYSVAGEESY; YSVAGEESYV; SVAGEESYVL; VAGEESYVLL; AGEESYVLLV; GEESYVLLVR; EESYVLLVRV; ESYVLLVRVA; SYVLLVRVAS; YVLLVRVASA; VLLVRVASAR; LLVRVASARA; LVRVASARAL; VRVASARALE; RVASARALED; VASARALEDL; ASARALEDLL; SARALEDLLQ; ARALEDLLQR; RALEDLLQRI; ALEDLLQRIR; LEDLLQRIRT; EDLLQRIRTT; DLLQRIRTTA; LLQRIRTTAN; LQRIRTTANV; QRIRTTANVR; RIRTTANVRT; IRTTANVRTR; RTTANVRTRS; TTANVRTRST; TANVRTRSTI; ANVRTRSTII; NVRTRSTIIL; VRTRSTIILN; RTRSTIILNT; TRSTIILNTF; RSTIILNTFY; STIILNTFYS; TIILNTFYSD; IILNTFYSDR; ILNTFYSDRQ; LNTFYSDRQH; NTFYSDRQHI; TFYSDRQHIP<br><br>11 mers:<br>MNEALDDIDRI; NEALDDIDRIL; EALDDIDRILV; ALDDIDRILVR; LDDIDRILVRE; DDIDRILVREL; DIDRILVRELA; IDRILVRELAA; DRILVRELAAD; RILVRELAADG; ILVRELAADGR; LVRELAADGRA; VRELAADGRAT; RELAADGRATL; ELAADGRATLS; LAADGRATLSE; AADGRATLSEL; ADGRATLSELA; DGRATLSELAT; GRATLSELATR; RATLSELATRA; ATLSELATRAG; TLSELATRAGL; LSELATRAGLS; SELATRAGLSV; ELATRAGLSVS; LATRAGLSVSA; ATRAGLSVSAV; TRAGLSVSAVQ; RAGLSVSAVQS; AGLSVSAVQSR; GLSVSAVQSRV; LSVSAVQSRVR; SVSAVQSRVRR; VSAVQSRVRRL; SAVQSRVRRLE; AVQSRVRRLES; VQSRVRRLESR; QSRVRRLESRG; SRVRRLESRGV; RVRRLESRGVV; VRRLESRGVVQ; RRLESRGVVQG; RLESRGVVQGY; LESRGVVQGYS; ESRGVVQGYSA; SRGVVQGYSAR; RGVVQGYSARI; GVVQGYSARIN; VVQGYSARINP; VQGYSARINPE; QGYSARINPEA; GYSARINPEAV; YSARINPEAVG; SARINPEAVGH; ARINPEAVGHL; RINPEAVGHLL; INPEAVGHLLS; NPEAVGHLLSA; PEAVGHLLSAF; EAVGHLLSAFV; AVGHLLSAFVA; VGHLLSAFVAI; GHLLSAFVAIT; HLLSAFVAITP; LLSAFVAITPL; LSAFVAITPLD; SAFVAITPLDP; AFVAITPLDPS; FVAITPLDPSQ; VAITPLDPSQP; AITPLDPSQPD; ITPLDPSQPDD; TPLDPSQPDDA; PLDPSQPDDAP; LDPSQPDDAPA; DPSQPDDAPAR; PSQPDDAPARL; SQPDDAPARLE; QPDDAPARLEH; PDDAPARLEHI; DDAPARLEHIE; DAPARLEHIEE; APARLEHIEEV; PARLEHIEEVE; ARLEHIEEVES; RLEHIEEVESC; LEHIEEVESCY; EHIEEVESCYS; HIEEVESCYSV; IEEVESCYSVA; EEVESCYSVAG; EVESCYSVAGE; VESCYSVAGEE; ESCYSVAGEES; SCYSVAGEESY; CYSVAGEESYV; YSVAGEESYVL; SVAGEESYVLL; VAGEESYVLLV; AGEESYVLLVR; GEESYVLLVRV; EESYVLLVRVA; ESYVLLVRVAS; SYVLLVRVASA; YVLLVRVASAR; VLLVRVASARA; LLVRVASARAL; LVRVASARALE; VRVASARALED; RVASARALEDL; VASARALEDLL; ASARALEDLLQ; SARALEDLLQR; ARALEDLLQRI; RALEDLLQRIR; ALEDLLQRIRT; LEDLLQRIRTT; EDLLQRIRTTA; DLLQRIRTTAN; LLQRIRTTANV; LQRIRTTANVR; QRIRTTANVRT; RIRTTANVRTR; IRTTANVRTRS; RTTANVRTRST; TTANVRTRSTI; TANVRTRSTII; ANVRTRSTIIL; NVRTRSTIILN; VRTRSTIILNT; RTRSTIILNTF; TRSTIILNTFY; RSTIILNTFYS; STIILNTFYSD; TIILNTFYSDR; IILNTFYSDRQ; ILNTFYSDRQH; LNTFYSDRQHI; NTFYSDRQHIP | |

Fig. 28 continued

| | | |
|---|---|---|
| 63) Rv3444c | 8 mers:<br>MNADPVLS; NADPVLSY; ADPVLSYN; DPVLSYNF; PVLSYNFD; VLSYNFDA; LSYNFDAI; SYNFDAIE; YNFDAIEY; NFDAIEYS; FDAIEYSV; DAIEYSVR; AIEYSVRQ; IEYSVRQE; EYSVRQEI; YSVRQEIH; SVRQEIHT; VRQEIHTT; RQEIHTTA; QEIHTTAA; EIHTTAAR; IHTTAARF; HTTAARFN; TTAARFNA; TAARFNAA; AARFNAAL; ARFNAALQ; RFNAALQE; FNAALQEL; NAALQELR; AALQELRS; ALQELRSQ; LQELRSQI; QELRSQIA; ELRSQIAP; LRSQIAPL; RSQIAPLQ; SQIAPLQQ; QIAPLQQL; IAPLQQLW; APLQQLWT; PLQQLWTR; LQQLWTRE; QQLWTREA; QLWTREAA; LWTREAAA; WTREAAAA; TREAAAAY; REAAAAYH; EAAAAYHA; AAAAYHAE; AAAYHAEQ; AAYHAEQL; AYHAEQLK; YHAEQLKW; HAEQLKWH; AEQLKWHQ; EQLKWHQA; QLKWHQAA; LKWHQAAS; KWHQAASA; WHQAASAL; HQAASALN; QAASALNE; AASALNEI; ASALNEIL; SALNEILI; ALNEILID; LNEILIDL; NEILIDLG; EILIDLGN; ILIDLGNA; LIDLGNAV; IDLGNAVR; DLGNAVRH; LGNAVRHG; GNAVRHGA; NAVRHGAD; AVRHGADD; VRHGADDV; RHGADDVA; HGADDVAH; GADDVAHA; ADDVAHAD; DDVAHADR; DVAHADRR; VAHADRRA; AHADRRAA; HADRRAAG; ADRRAAGA; DRRAAGAW; RRAAGAWA; RAAGAWAR;<br><br>9 mers:<br>MNADPVLSY; NADPVLSYN; ADPVLSYNF; DPVLSYNFD; PVLSYNFDA; VLSYNFDAI; LSYNFDAIE; SYNFDAIEY; YNFDAIEYS; NFDAIEYSV; FDAIEYSVR; DAIEYSVRQ; AIEYSVRQE; IEYSVRQEI; EYSVRQEIH; YSVRQEIHT; SVRQEIHTT; VRQEIHTTA; RQEIHTTAA; QEIHTTAAR; EIHTTAARF; IHTTAARFN; HTTAARFNA; TTAARFNAA; TAARFNAAL; AARFNAALQ; ARFNAALQE; RFNAALQEL; FNAALQELR; NAALQELRS; AALQELRSQ; ALQELRSQI; LQELRSQIA; QELRSQIAP; ELRSQIAPL; LRSQIAPLQ; RSQIAPLQQ; SQIAPLQQL; QIAPLQQLW; IAPLQQLWT; APLQQLWTR; PLQQLWTRE; LQQLWTREA; QQLWTREAA; QLWTREAAA; LWTREAAAA; WTREAAAAY; TREAAAAYH; REAAAAYHA; EAAAAYHAE; AAAAYHAEQ; AAAYHAEQL; AAYHAEQLK; AYHAEQLKW; YHAEQLKWH; HAEQLKWHQ; AEQLKWHQA; EQLKWHQAA; QLKWHQAAS; LKWHQAASA; KWHQAASAL; WHQAASALN; HQAASALNE; QAASALNEI; AASALNEIL; ASALNEILI; SALNEILID; ALNEILIDL; LNEILIDLG; NEILIDLGN; EILIDLGNA; ILIDLGNAV; LIDLGNAVR; IDLGNAVRH; DLGNAVRHG; LGNAVRHGA; GNAVRHGAD; NAVRHGADD; AVRHGADDV; VRHGADDVA; RHGADDVAH; HGADDVAHA; GADDVAHAD; ADDVAHADR; DDVAHADRR; DVAHADRRA; VAHADRRAA; AHADRRAAG; HADRRAAGA; ADRRAAGAW; DRRAAGAWA; RRAAGAWAR;<br><br>10 mers:<br>MNADPVLSYN; NADPVLSYNF; ADPVLSYNFD; DPVLSYNFDA; PVLSYNFDAI; VLSYNFDAIE; LSYNFDAIEY; SYNFDAIEYS; YNFDAIEYSV; NFDAIEYSVR; FDAIEYSVRQ; DAIEYSVRQE; AIEYSVRQEI; IEYSVRQEIH; EYSVRQEIHT; YSVRQEIHTT; SVRQEIHTTA; VRQEIHTTAA; RQEIHTTAAR; QEIHTTAARF; EIHTTAARFN; IHTTAARFNA; HTTAARFNAA; TTAARFNAAL; TAARFNAALQ; AARFNAALQE; ARFNAALQEL; RFNAALQELR; | 45052-45417 |

Fig. 28 continued

| | | |
|---|---|---|
| | FNAALQELRS; NAALQELRSQ; AALQELRSQI; ALQELRSQIA; LQELRSQIAP; QELRSQIAPL; ELRSQIAPLQ; LRSQIAPLQQ; RSQIAPLQQL; SQIAPLQQLW; QIAPLQQLWT; IAPLQQLWTR; APLQQLWTRE; PLQQLWTREA; LQQLWTREAA; QQLWTREAAA; QLWTREAAAA; LWTREAAAAY; WTREAAAAYH; TREAAAAYHA; REAAAAYHAE; EAAAAYHAEQ; AAAAYHAEQL; AAAYHAEQLK; AAYHAEQLKW; AYHAEQLKWH; YHAEQLKWHQ; HAEQLKWHQA; AEQLKWHQAA; EQLKWHQAAS; QLKWHQAASA; LKWHQAASAL; KWHQAASALN; WHQAASALNE; HQAASALNEI; QAASALNEIL; AASALNEILI; ASALNEILID; SALNEILIDL; ALNEILIDLG; LNEILIDLGN; NEILIDLGNA; EILIDLGNAV; ILIDLGNAVR; LIDLGNAVRH; IDLGNAVRHG; DLGNAVRHGA; LGNAVRHGAD; GNAVRHGADD; NAVRHGADDV; AVRHGADDVA; VRHGADDVAH; RHGADDVAHA; HGADDVAHAD; GADDVAHADR; ADDVAHADRR; DDVAHADRRA; DVAHADRRAA; VAHADRRAAG; AHADRRAAGA; HADRRAAGAW; ADRRAAGAWA; DRRAAGAWAR;<br><br>11 mers:<br>MNADPVLSYNF; NADPVLSYNFD; ADPVLSYNFDA; DPVLSYNFDAI; PVLSYNFDAIE; VLSYNFDAIEY; LSYNFDAIEYS; SYNFDAIEYSV; YNFDAIEYSVR; NFDAIEYSVRQ; FDAIEYSVRQE; DAIEYSVRQEI; AIEYSVRQEIH; IEYSVRQEIHT; EYSVRQEIHTT; YSVRQEIHTTA; SVRQEIHTTAA; VRQEIHTTAAR; RQEIHTTAARF; QEIHTTAARFN; EIHTTAARFNA; IHTTAARFNAA; HTTAARFNAAL; TTAARFNAALQ; TAARFNAALQE; AARFNAALQEL; ARFNAALQELR; RFNAALQELRS; FNAALQELRSQ; NAALQELRSQI; AALQELRSQIA; ALQELRSQIAP; LQELRSQIAPL; QELRSQIAPLQ; ELRSQIAPLQQ; LRSQIAPLQQL; RSQIAPLQQLW; SQIAPLQQLWT; QIAPLQQLWTR; IAPLQQLWTRE; APLQQLWTREA; PLQQLWTREAA; LQQLWTREAAA; QQLWTREAAAA; QLWTREAAAAY; LWTREAAAAYH; WTREAAAAYHA; TREAAAAYHAE; REAAAAYHAEQ; EAAAAYHAEQL; AAAAYHAEQLK; AAAYHAEQLKW; AAYHAEQLKWH; AYHAEQLKWHQ; YHAEQLKWHQA; HAEQLKWHQAA; AEQLKWHQAAS; EQLKWHQAASA; QLKWHQAASAL; LKWHQAASALN; KWHQAASALNE; WHQAASALNEI; HQAASALNEIL; QAASALNEILI; AASALNEILID; ASALNEILIDL; SALNEILIDLG; ALNEILIDLGN; LNEILIDLGNA; NEILIDLGNAV; EILIDLGNAVR; ILIDLGNAVRH; LIDLGNAVRHG; IDLGNAVRHGA; DLGNAVRHGAD; LGNAVRHGADD; GNAVRHGADDV; NAVRHGADDVA; AVRHGADDVAH; VRHGADDVAHA; RHGADDVAHAD; HGADDVAHADR; GADDVAHADRR; ADDVAHADRRA; DDVAHADRRAA; DVAHADRRAAG; VAHADRRAAGA; AHADRRAAGAW; HADRRAAGAWA; ADRRAAGAWAR; | |
| 64) Rv3445c | 8 mers:<br>MVEPGRIG; VEPGRIGG; EPGRIGGN; PGRIGGNQ; GRIGGNQT; RIGGNQTR; IGGNQTRL; GGNQTRLA; GNQTRLAA; NQTRLAAV; QTRLAAVL; TRLAAVLL; RLAAVLLD; LAAVLLDV; AAVLLDVS; AVLLDVST; VLLDVSTP; LLDVSTPN; LDVSTPNT; DVSTPNTL; VSTPNTLN; STPNTLNA; TPNTLNAD; PNTLNADF; NTLNADFD; TLNADFDL; LNADFDLM; NADFDLMR; ADFDLMRS; DFDLMRSV; FDLMRSVA; DLMRSVAG; LMRSVAGI; MRSVAGIT; RSVAGITD; SVAGITDA; VAGITDAR; AGITDARN; GITDARNE; ITDARNEE; | 45418-45883 |

Fig. 28 continued

| | | |
|---|---|---|
| | TDARNEEI; DARNEEIR; ARNEEIRA; RNEEIRAM; NEEIRAML; EEIRAMLQ; EIRAMLQA; IRAMLQAF; RAMLQAFI; AMLQAFIG; MLQAFIGR; LQAFIGRM; QAFIGRMS; AFIGRMSG; FIGRMSGV; IGRMSGVP; GRMSGVPP; RMSGVPPS; MSGVPPSV; SGVPPSVW; GVPPSVWG; VPPSVWGG; PPSVWGGL; PSVWGGLA; SVWGGLAA; VWGGLAAA; WGGLAAAR; GGLAAARF; GLAAARFQ; LAAARFQD; AAARFQDV; AARFQDVV; ARFQDVVD; RFQDVVDR; FQDVVDRW; QDVVDRWN; DVVDRWNA; VVDRWNAE; VDRWNAES; DRWNAEST; RWNAESTR; WNAESTRL; NAESTRLY; AESTRLYH; ESTRLYHV; STRLYHVL; TRLYHVLH; RLYHVLHA; LYHVLHAI; YHVLHAIA; HVLHAIAD; VLHAIADT; LHAIADTI; HAIADTIR; AIADTIRH; IADTIRHN; ADTIRHNE; DTIRHNEA; TIRHNEAA; IRHNEAAL; RHNEAALR; HNEAALRE; NEAALREA; EAALREAG; AALREAGQ; ALREAGQI; LREAGQIH; REAGQIHA; EAGQIHAR; AGQIHARH; GQIHARHI; QIHARHIA; IHARHIAA; HARHIAAA; ARHIAAAG; RHIAAAGG; HIAAAGGD; IAAAGGDL;<br><br>9 mers:<br>MVEPGRIGG; VEPGRIGGN; EPGRIGGNQ; PGRIGGNQT; GRIGGNQTR; RIGGNQTRL; IGGNQTRLA; GGNQTRLAA; GNQTRLAAV; NQTRLAAVL; QTRLAAVLL; TRLAAVLLD; RLAAVLLDV; LAAVLLDVS; AAVLLDVST; AVLLDVSTP; VLLDVSTPN; LLDVSTPNT; LDVSTPNTL; DVSTPNTLN; VSTPNTLNA; STPNTLNAD; TPNTLNADF; PNTLNADFD; NTLNADFDL; TLNADFDLM; LNADFDLMR; NADFDLMRS; ADFDLMRSV; DFDLMRSVA; FDLMRSVAG; DLMRSVAGI; LMRSVAGIT; MRSVAGITD; RSVAGITDA; SVAGITDAR; VAGITDARN; AGITDARNE; GITDARNEE; ITDARNEEI; TDARNEEIR; DARNEEIRA; ARNEEIRAM; RNEEIRAML; NEEIRAMLQ; EEIRAMLQA; EIRAMLQAF; IRAMLQAFI; RAMLQAFIG; AMLQAFIGR; MLQAFIGRM; LQAFIGRMS; QAFIGRMSG; AFIGRMSGV; FIGRMSGVP; IGRMSGVPP; GRMSGVPPS; RMSGVPPSV; MSGVPPSVW; SGVPPSVWG; GVPPSVWGG; VPPSVWGGL; PPSVWGGLA; PSVWGGLAA; SVWGGLAAA; VWGGLAAAR; WGGLAAARF; GGLAAARFQ; GLAAARFQD; LAAARFQDV; AAARFQDVV; AARFQDVVD; ARFQDVVDR; RFQDVVDRW; FQDVVDRWN; QDVVDRWNA; DVVDRWNAE; VVDRWNAES; VDRWNAEST; DRWNAESTR; RWNAESTRL; WNAESTRLY; NAESTRLYH; AESTRLYHV; ESTRLYHVL; STRLYHVLH; TRLYHVLHA; RLYHVLHAI; LYHVLHAIA; YHVLHAIAD; HVLHAIADT; VLHAIADTI; LHAIADTIR; HAIADTIRH; AIADTIRHN; IADTIRHNE; ADTIRHNEA; DTIRHNEAA; TIRHNEAAL; IRHNEAALR; RHNEAALRE; HNEAALREA; NEAALREAG; EAALREAGQ; AALREAGQI; ALREAGQIH; LREAGQIHA; REAGQIHAR; EAGQIHARH; AGQIHARHI; GQIHARHIA; QIHARHIAA; IHARHIAAA; HARHIAAAG; ARHIAAAGG; RHIAAAGGD; HIAAAGGDL;<br><br>10 mers:<br>MVEPGRIGGN; VEPGRIGGNQ; EPGRIGGNQT; PGRIGGNQTR; GRIGGNQTRL; RIGGNQTRLA; IGGNQTRLAA; GGNQTRLAAV; GNQTRLAAVL; NQTRLAAVLL; QTRLAAVLLD; TRLAAVLLDV; RLAAVLLDVS; LAAVLLDVST; AAVLLDVSTP; AVLLDVSTPN; VLLDVSTPNT; LLDVSTPNTL; LDVSTPNTLN; DVSTPNTLNA; VSTPNTLNAD; STPNTLNADF; TPNTLNADFD; PNTLNADFDL; NTLNADFDLM; TLNADFDLMR; LNADFDLMRS; NADFDLMRSV; | |

Fig. 28 continued

| | | |
|---|---|---|
| | ADFDLMRSVA; DFDLMRSVAG; FDLMRSVAGI; DLMRSVAGIT; LMRSVAGITD; MRSVAGITDA; RSVAGITDAR; SVAGITDARN; VAGITDARNE; AGITDARNEE; GITDARNEEI; ITDARNEEIR; TDARNEEIRA; DARNEEIRAM; ARNEEIRAML; RNEEIRAMLQ; NEEIRAMLQA; EEIRAMLQAF; EIRAMLQAFI; IRAMLQAFIG; RAMLQAFIGR; AMLQAFIGRM; MLQAFIGRMS; LQAFIGRMSG; QAFIGRMSGV; AFIGRMSGVP; FIGRMSGVPP; IGRMSGVPPS; GRMSGVPPSV; RMSGVPPSVW; MSGVPPSVWG; SGVPPSVWGG; GVPPSVWGGL; VPPSVWGGLA; PPSVWGGLAA; PSVWGGLAAA; SVWGGLAAAR; VWGGLAAARF; WGGLAAARFQ; GGLAAARFQD; GLAAARFQDV; LAAARFQDVV; AAARFQDVVD; AARFQDVVDR; ARFQDVVDRW; RFQDVVDRWN; FQDVVDRWNA; QDVVDRWNAE; DVVDRWNAES; VVDRWNAEST; VDRWNAESTR; DRWNAESTRL; RWNAESTRLY; WNAESTRLYH; NAESTRLYHV; AESTRLYHVL; ESTRLYHVLH; STRLYHVLHA; TRLYHVLHAI; RLYHVLHAIA; LYHVLHAIAD; YHVLHAIADT; HVLHAIADTI; VLHAIADTIR; LHAIADTIRH; HAIADTIRHN; AIADTIRHNE; IADTIRHNEA; ADTIRHNEAA; DTIRHNEAAL; TIRHNEAALR; IRHNEAALRE; RHNEAALREA; HNEAALREAG; NEAALREAGQ; EAALREAGQI; AALREAGQIH; ALREAGQIHA; LREAGQIHAR; REAGQIHARH; EAGQIHARHI; AGQIHARHIA; GQIHARHIAA; QIHARHIAAA; IHARHIAAAG; HARHIAAAGG; ARHIAAAGGD; RHIAAAGGDL;<br><br>11 mers:<br>MVEPGRIGGNQ; VEPGRIGGNQT; EPGRIGGNQTR; PGRIGGNQTRL; GRIGGNQTRLA; RIGGNQTRLAA; IGGNQTRLAAV; GGNQTRLAAVL; GNQTRLAAVLL; NQTRLAAVLLD; QTRLAAVLLDV; TRLAAVLLDVS; RLAAVLLDVST; LAAVLLDVSTP; AAVLLDVSTPN; AVLLDVSTPNT; VLLDVSTPNTL; LLDVSTPNTLN; LDVSTPNTLNA; DVSTPNTLNAD; VSTPNTLNADF; STPNTLNADFD; TPNTLNADFDL; PNTLNADFDLM; NTLNADFDLMR; TLNADFDLMRS; LNADFDLMRSV; NADFDLMRSVA; ADFDLMRSVAG; DFDLMRSVAGI; FDLMRSVAGIT; DLMRSVAGITD; LMRSVAGITDA; MRSVAGITDAR; RSVAGITDARN; SVAGITDARNE; VAGITDARNEE; AGITDARNEEI; GITDARNEEIR; ITDARNEEIRA; TDARNEEIRAM; DARNEEIRAML; ARNEEIRAMLQ; RNEEIRAMLQA; NEEIRAMLQAF; EEIRAMLQAFI; EIRAMLQAFIG; IRAMLQAFIGR; RAMLQAFIGRM; AMLQAFIGRMS; MLQAFIGRMSG; LQAFIGRMSGV; QAFIGRMSGVP; AFIGRMSGVPP; FIGRMSGVPPS; IGRMSGVPPSV; GRMSGVPPSVW; RMSGVPPSVWG; MSGVPPSVWGG; SGVPPSVWGGL; GVPPSVWGGLA; VPPSVWGGLAA; PPSVWGGLAAA; PSVWGGLAAAR; SVWGGLAAARF; VWGGLAAARFQ; WGGLAAARFQD; GGLAAARFQDV; GLAAARFQDVV; LAAARFQDVVD; AAARFQDVVDR; AARFQDVVDRW; ARFQDVVDRWN; RFQDVVDRWNA; FQDVVDRWNAE; QDVVDRWNAES; DVVDRWNAEST; VVDRWNAESTR; VDRWNAESTRL; DRWNAESTRLY; RWNAESTRLYH; WNAESTRLYHV; NAESTRLYHVL; AESTRLYHVLH; ESTRLYHVLHA; STRLYHVLHAI; TRLYHVLHAIA; RLYHVLHAIAD; LYHVLHAIADT; YHVLHAIADTI; HVLHAIADTIR; VLHAIADTIRH; LHAIADTIRHN; HAIADTIRHNE; AIADTIRHNEA; IADTIRHNEAA; ADTIRHNEAAL; DTIRHNEAALR; TIRHNEAALRE; IRHNEAALREA; RHNEAALREAG; HNEAALREAGQ; NEAALREAGQI; EAALREAGQIH; AALREAGQIHA; ALREAGQIHAR; LREAGQIHARH; REAGQIHARHI; | |

Fig. 28 continued

| | | |
|---|---|---|
| | EAGQIHARHIA; AGQIHARHIAA; GQIHARHIAAA; QIHARHIAAAG; IHARHIAAAGG; HARHIAAAGGD; ARHIAAAGGDL; | |
| 65) Rv3477 | 8 mers:<br>MSFTAQPE; SFTAQPEM; FTAQPEML; TAQPEMLA; AQPEMLAA; QPEMLAAA; PEMLAAAA; EMLAAAAG; MLAAAAGE; LAAAAGEL; AAAAGELR; AAAGELRS; AAGELRSL; AGELRSLG; GELRSLGA; ELRSLGAT; LRSLGATL; RSLGATLK; SLGATLKA; LGATLKAS; GATLKASN; ATLKASNA; TLKASNAA; LKASNAAA; KASNAAAA; ASNAAAAV; SNAAAAVP; NAAAAVPT; AAAAVPTT; AAAVPTTG; AAVPTTGV; AVPTTGVV; VPTTGVVP; PTTGVVPP; TTGVVPPA; TGVVPPAA; GVVPPAAD; VVPPAADE; VPPAADEV; PPAADEVS; PAADEVSL; AADEVSLL; ADEVSLLL; DEVSLLLA; EVSLLLAT; VSLLLATQ; SLLLATQF; LLLATQFR; LLATQFRT; LATQFRTH; ATQFRTHA; TQFRTHAA; QFRTHAAT; FRTHAATY; RTHAATYQ; THAATYQT; HAATYQTA; AATYQTAS; ATYQTASA; TYQTASAK; YQTASAKA; QTASAKAA; TASAKAAV; ASAKAAVI; SAKAAVIH; AKAAVIHE; KAAVIHEQ; AAVIHEQF; AVIHEQFV; VIHEQFVT; IHEQFVTT; HEQFVTTL; EQFVTTLA; QFVTTLAT; FVTTLATS; VTTLATSA; TTLATSAS; TLATSASS; LATSASSY; ATSASSYA; TSASSYAD; SASSYADT; ASSYADTE; SSYADTEA; SYADTEAA; YADTEAAN; ADTEAANA; DTEAANAV; TEAANAVV; EAANAVVT; AANAVVTG;<br><br>9 mers:<br>MSFTAQPEM; SFTAQPEML; FTAQPEMLA; TAQPEMLAA; AQPEMLAAA; QPEMLAAAA; PEMLAAAAG; EMLAAAAGE; MLAAAAGEL; LAAAAGELR; AAAAGELRS; AAAGELRSL; AAGELRSLG; AGELRSLGA; GELRSLGAT; ELRSLGATL; LRSLGATLK; RSLGATLKA; SLGATLKAS; LGATLKASN; GATLKASNA; ATLKASNAA; TLKASNAAA; LKASNAAAA; KASNAAAAV; ASNAAAAVP; SNAAAAVPT; NAAAAVPTT; AAAAVPTTG; AAAVPTTGV; AAVPTTGVV; AVPTTGVVP; VPTTGVVPP; PTTGVVPPA; TTGVVPPAA; TGVVPPAAD; GVVPPAADE; VVPPAADEV; VPPAADEVS; PPAADEVSL; PAADEVSLL; AADEVSLLL; ADEVSLLLA; DEVSLLLAT; EVSLLLATQ; VSLLLATQF; SLLLATQFR; LLLATQFRT; LLATQFRTH; LATQFRTHA; ATQFRTHAA; TQFRTHAAT; QFRTHAATY; FRTHAATYQ; RTHAATYQT; THAATYQTA; HAATYQTAS; AATYQTASA; ATYQTASAK; TYQTASAKA; YQTASAKAA; QTASAKAAV; TASAKAAVI; ASAKAAVIH; SAKAAVIHE; AKAAVIHEQ; KAAVIHEQF; AAVIHEQFV; AVIHEQFVT; VIHEQFVTT; IHEQFVTTL; HEQFVTTLA; EQFVTTLAT; QFVTTLATS; FVTTLATSA; VTTLATSAS; TTLATSASS; TLATSASSY; LATSASSYA; ATSASSYAD; TSASSYADT; SASSYADTE; ASSYADTEA; SSYADTEAA; SYADTEAAN; YADTEAANA; ADTEAANAV; DTEAANAVV; TEAANAVVT; EAANAVVTG;<br><br>10 mers:<br>MSFTAQPEML; SFTAQPEMLA; FTAQPEMLAA; TAQPEMLAAA; AQPEMLAAAA; QPEMLAAAAG; PEMLAAAAGE; EMLAAAAGEL; MLAAAAGELR; LAAAAGELRS; AAAAGELRSL; AAAGELRSLG; AAGELRSLGA; AGELRSLGAT; GELRSLGATL; ELRSLGATLK; LRSLGATLKA; RSLGATLKAS; SLGATLKASN; LGATLKASNA; | 45884-46241 |

Fig. 28 continued

| | | |
|---|---|---|
| | GATLKASNAA; ATLKASNAAA; TLKASNAAAA; LKASNAAAAV; KASNAAAAVP; ASNAAAAVPT; SNAAAAVPTT; NAAAAVPTTG; AAAAVPTTGV; AAAVPTTGVV; AAVPTTGVVP; AVPTTGVVPP; VPTTGVVPPA; PTTGVVPPAA; TTGVVPPAAD; TGVVPPAADE; GVVPPAADEV; VVPPAADEVS; VPPAADEVSL; PPAADEVSLL; PAADEVSLLL; AADEVSLLLA; ADEVSLLLAT; DEVSLLLATQ; EVSLLLATQF; VSLLLATQFR; SLLLATQFRT; LLLATQFRTH; LLATQFRTHA; LATQFRTHAA; ATQFRTHAAT; TQFRTHAATY; QFRTHAATYQ; FRTHAATYQT; RTHAATYQTA; THAATYQTAS; HAATYQTASA; AATYQTASAK; ATYQTASAKA; TYQTASAKAA; YQTASAKAAV; QTASAKAAVI; TASAKAAVIH; ASAKAAVIHE; SAKAAVIHEQ; AKAAVIHEQF; KAAVIHEQFV; AAVIHEQFVT; AVIHEQFVTT; VIHEQFVTTL; IHEQFVTTLA; HEQFVTTLAT; EQFVTTLATS; QFVTTLATSA; FVTTLATSAS; VTTLATSASS; TTLATSASSY; TLATSASSYA; LATSASSYAD; ATSASSYADT; TSASSYADTE; SASSYADTEA; ASSYADTEAA; SSYADTEAAN; SYADTEAANA; YADTEAANAV; ADTEAANAVV; DTEAANAVVT; TEAANAVVTG;<br><br>11 mers:<br>MSFTAQPEMLA; SFTAQPEMLAA; FTAQPEMLAAA; TAQPEMLAAAA; AQPEMLAAAAG; QPEMLAAAAGE; PEMLAAAAGEL; EMLAAAAGELR; MLAAAAGELRS; LAAAAGELRSL; AAAAGELRSLG; AAAGELRSLGA; AAGELRSLGAT; AGELRSLGATL; GELRSLGATLK; ELRSLGATLKA; LRSLGATLKAS; RSLGATLKASN; SLGATLKASNA; LGATLKASNAA; GATLKASNAAA; ATLKASNAAAA; TLKASNAAAAV; LKASNAAAAVP; KASNAAAAVPT; ASNAAAAVPTT; SNAAAAVPTTG; NAAAAVPTTGV; AAAAVPTTGVV; AAAVPTTGVVP; AAVPTTGVVPP; AVPTTGVVPPA; VPTTGVVPPAA; PTTGVVPPAAD; TTGVVPPAADE; TGVVPPAADEV; GVVPPAADEVS; VVPPAADEVSL; VPPAADEVSLL; PPAADEVSLLL; PAADEVSLLLA; AADEVSLLLAT; ADEVSLLLATQ; DEVSLLLATQF; EVSLLLATQFR; VSLLLATQFRT; SLLLATQFRTH; LLLATQFRTHA; LLATQFRTHAA; LATQFRTHAAT; ATQFRTHAATY; TQFRTHAATYQ; QFRTHAATYQT; FRTHAATYQTA; RTHAATYQTAS; THAATYQTASA; HAATYQTASAK; AATYQTASAKA; ATYQTASAKAA; TYQTASAKAAV; YQTASAKAAVI; QTASAKAAVIH; TASAKAAVIHE; ASAKAAVIHEQ; SAKAAVIHEQF; AKAAVIHEQFV; KAAVIHEQFVT; AAVIHEQFVTT; AVIHEQFVTTL; VIHEQFVTTLA; IHEQFVTTLAT; HEQFVTTLATS; EQFVTTLATSA; QFVTTLATSAS; FVTTLATSASS; VTTLATSASSY; TTLATSASSYA; TLATSASSYAD; LATSASSYADT; ATSASSYADTE; TSASSYADTEA; SASSYADTEAA; ASSYADTEAAN; SSYADTEAANA; SYADTEAANAV; YADTEAANAVV; ADTEAANAVVT; DTEAANAVVTG; | |
| 66) Rv3619c | 8 mers:<br>MTINYQFG; TINYQFGD; INYQFGDV; NYQFGDVD; YQFGDVDA; QFGDVDAH; FGDVDAHG; GDVDAHGA; DVDAHGAM; VDAHGAMI; DAHGAMIR; AHGAMIRA; HGAMIRAQ; GAMIRAQA; AMIRAQAG; MIRAQAGS; IRAQAGSL; RAQAGSLE; AQAGSLEA; QAGSLEAE; AGSLEAEH; GSLEAEHQ; SLEAEHQA; LEAEHQAI; EAEHQAII; AEHQAIIS; EHQAIISD; HQAIISDV; QAIISDVL; AIISDVLT; IISDVLTA; ISDVLTAS; SDVLTASD; DVLTASDF; VLTASDFW; LTASDFWG; TASDFWGG; ASDFWGGA; SDFWGGAG; DFWGGAGS; FWGGAGSA; WGGAGSAA; GGAGSAAC; GAGSAACQ; AGSAACQG; GSAACQGF; | 46242-46583 |

Fig. 28 continued

| | | | |
|---|---|---|---|
| | SAACQGFI; AACQGFIT; ACQGFITQ; CQGFITQL; QGFITQLG; GFITQLGR; FITQLGRN; ITQLGRNF; TQLGRNFQ; QLGRNFQV; LGRNFQVI; GRNFQVIY; RNFQVIYE; NFQVIYEQ; FQVIYEQA; QVIYEQAN; VIYEQANA; IYEQANAH; YEQANAHG; EQANAHGQ; QANAHGQK; ANAHGQKV; NAHGQKVQ; AHGQKVQA; HGQKVQAA; GQKVQAAG; QKVQAAGN; KVQAAGNN; VQAAGNNM; QAAGNNMA; AAGNNMAQ; AGNNMAQT; GNNMAQTD; NNMAQTDS; NMAQTDSA; MAQTDSAV; AQTDSAVG; QTDSAVGS; TDSAVGSS; DSAVGSSW; SAVGSSWA;<br><br>9 mers:<br>MTINYQFGD; TINYQFGDV; INYQFGDVD; NYQFGDVDA; YQFGDVDAH; QFGDVDAHG; FGDVDAHGA; GDVDAHGAM; DVDAHGAMI; VDAHGAMIR; DAHGAMIRA; AHGAMIRAQ; HGAMIRAQA; GAMIRAQAG; AMIRAQAGS; MIRAQAGSL; IRAQAGSLE; RAQAGSLEA; AQAGSLEAE; QAGSLEAEH; AGSLEAEHQ; GSLEAEHQA; SLEAEHQAI; LEAEHQAII; EAEHQAIIS; AEHQAIISD; EHQAIISDV; HQAIISDVL; QAIISDVLT; AIISDVLTA; IISDVLTAS; ISDVLTASD; SDVLTASDF; DVLTASDFW; VLTASDFWG; LTASDFWGG; TASDFWGGA; ASDFWGGAG; SDFWGGAGS; DFWGGAGSA; FWGGAGSAA; WGGAGSAAC; GGAGSAACQ; GAGSAACQG; AGSAACQGF; GSAACQGFI; SAACQGFIT; AACQGFITQ; ACQGFITQL; CQGFITQLG; QGFITQLGR; GFITQLGRN; FITQLGRNF; ITQLGRNFQ; TQLGRNFQV; QLGRNFQVI; LGRNFQVIY; GRNFQVIYE; RNFQVIYEQ; NFQVIYEQA; FQVIYEQAN; QVIYEQANA; VIYEQANAH; IYEQANAHG; YEQANAHGQ; EQANAHGQK; QANAHGQKV; ANAHGQKVQ; NAHGQKVQA; AHGQKVQAA; HGQKVQAAG; GQKVQAAGN; QKVQAAGNN; KVQAAGNNM; VQAAGNNMA; QAAGNNMAQ; AAGNNMAQT; AGNNMAQTD; GNNMAQTDS; NNMAQTDSA; NMAQTDSAV; MAQTDSAVG; AQTDSAVGS; QTDSAVGSS; TDSAVGSSW; DSAVGSSWA;<br><br>10 mers:<br>MTINYQFGDV; TINYQFGDVD; INYQFGDVDA; NYQFGDVDAH; YQFGDVDAHG; QFGDVDAHGA; FGDVDAHGAM; GDVDAHGAMI; DVDAHGAMIR; VDAHGAMIRA; DAHGAMIRAQ; AHGAMIRAQA; HGAMIRAQAG; GAMIRAQAGS; AMIRAQAGSL; MIRAQAGSLE; IRAQAGSLEA; RAQAGSLEAE; AQAGSLEAEH; QAGSLEAEHQ; AGSLEAEHQA; GSLEAEHQAI; SLEAEHQAII; LEAEHQAIIS; EAEHQAIISD; AEHQAIISDV; EHQAIISDVL; HQAIISDVLT; QAIISDVLTA; AIISDVLTAS; IISDVLTASD; ISDVLTASDF; SDVLTASDFW; DVLTASDFWG; VLTASDFWGG; LTASDFWGGA; TASDFWGGAG; ASDFWGGAGS; SDFWGGAGSA; DFWGGAGSAA; FWGGAGSAAC; WGGAGSAACQ; GGAGSAACQG; GAGSAACQGF; AGSAACQGFI; GSAACQGFIT; SAACQGFITQ; AACQGFITQL; ACQGFITQLG; CQGFITQLGR; QGFITQLGRN; GFITQLGRNF; FITQLGRNFQ; ITQLGRNFQV; TQLGRNFQVI; QLGRNFQVIY; LGRNFQVIYE; GRNFQVIYEQ; RNFQVIYEQA; NFQVIYEQAN; FQVIYEQANA; QVIYEQANAH; VIYEQANAHG; IYEQANAHGQ; YEQANAHGQK; EQANAHGQKV; QANAHGQKVQ; ANAHGQKVQA; NAHGQKVQAA; AHGQKVQAAG; HGQKVQAAGN; GQKVQAAGNN; QKVQAAGNNM; KVQAAGNNMA; VQAAGNNMAQ; QAAGNNMAQT; AAGNNMAQTD; AGNNMAQTDS; GNNMAQTDSA; NNMAQTDSAV; | |

Fig. 28 continued

| | | |
|---|---|---|
| | NMAQTDSAVG; MAQTDSAVGS; AQTDSAVGSS; QTDSAVGSSW; TDSAVGSSWA;<br><br>11 mers:<br>MTINYQFGDVD; TINYQFGDVDA; INYQFGDVDAH; NYQFGDVDAHG; YQFGDVDAHGA; QFGDVDAHGAM; FGDVDAHGAMI; GDVDAHGAMIR; DVDAHGAMIRA; VDAHGAMIRAQ; DAHGAMIRAQA; AHGAMIRAQAG; HGAMIRAQAGS; GAMIRAQAGSL; AMIRAQAGSLE; MIRAQAGSLEA; IRAQAGSLEAE; RAQAGSLEAEH; AQAGSLEAEHQ; QAGSLEAEHQA; AGSLEAEHQAI; GSLEAEHQAII; SLEAEHQAIIS; LEAEHQAIISD; EAEHQAIISDV; AEHQAIISDVL; EHQAIISDVLT; HQAIISDVLTA; QAIISDVLTAS; AIISDVLTASD; IISDVLTASDF; ISDVLTASDFW; SDVLTASDFWG; DVLTASDFWGG; VLTASDFWGGA; LTASDFWGGAG; TASDFWGGAGS; ASDFWGGAGSA; SDFWGGAGSAA; DFWGGAGSAAC; FWGGAGSAACQ; WGGAGSAACQG; GGAGSAACQGF; GAGSAACQGFI; AGSAACQGFIT; GSAACQGFITQ; SAACQGFITQL; AACQGFITQLG; ACQGFITQLGR; CQGFITQLGRN; QGFITQLGRNF; GFITQLGRNFQ; FITQLGRNFQV; ITQLGRNFQVI; TQLGRNFQVIY; QLGRNFQVIYE; LGRNFQVIYEQ; GRNFQVIYEQA; RNFQVIYEQAN; NFQVIYEQANA; FQVIYEQANAH; QVIYEQANAHG; VIYEQANAHGQ; IYEQANAHGQK; YEQANAHGQKV; EQANAHGQKVQ; QANAHGQKVQA; ANAHGQKVQAA; NAHGQKVQAAG; AHGQKVQAAGN; HGQKVQAAGNN; GQKVQAAGNNM; QKVQAAGNNMA; KVQAAGNNMAQ; VQAAGNNMAQT; QAAGNNMAQTD; AAGNNMAQTDS; AGNNMAQTDSA; GNNMAQTDSAV; NNMAQTDSAVG; NMAQTDSAVGS; MAQTDSAVGSS; AQTDSAVGSSW; QTDSAVGSSWA; | |
| 67) Rv3620c | 8 mers:<br>MTSRFMTD; TSRFMTDP; SRFMTDPH; RFMTDPHA; FMTDPHAM; MTDPHAMR; TDPHAMRD; DPHAMRDM; PHAMRDMA; HAMRDMAG; AMRDMAGR; MRDMAGRF; RDMAGRFE; DMAGRFEV; MAGRFEVH; AGRFEVHA; GRFEVHAQ; RFEVHAQT; FEVHAQTV; EVHAQTVE; VHAQTVED; HAQTVEDE; AQTVEDEA; QTVEDEAR; TVEDEARR; VEDEARRM; EDEARRMW; DEARRMWA; EARRMWAS; ARRMWASA; RRMWASAQ; RMWASAQN; MWASAQNI; WASAQNIS; ASAQNISG; SAQNISGA; AQNISGAG; QNISGAGW; NISGAGWS; ISGAGWSG; SGAGWSGM; GAGWSGMA; AGWSGMAE; GWSGMAEA; WSGMAEAT; SGMAEATS; GMAEATSL; MAEATSLD; AEATSLDT; EATSLDTM; ATSLDTMT; TSLDTMTQ; SLDTMTQM; LDTMTQMN; DTMTQMNQ; TMTQMNQA; MTQMNQAF; TQMNQAFR; QMNQAFRN; MNQAFRNI; NQAFRNIV; QAFRNIVN; AFRNIVNM; FRNIVNML; RNIVNMLH; NIVNMLHG; IVNMLHGV; VNMLHGVR; NMLHGVRD; MLHGVRDG; LHGVRDGL; HGVRDGLV; GVRDGLVR; VRDGLVRD; RDGLVRDA; DGLVRDAN; GLVRDANN; LVRDANNY; VRDANNYE; RDANNYEQ; DANNYEQQ; ANNYEQQE; NNYEQQEQ; NYEQQEQA; YEQQEQAS; EQQEQASQ; QQEQASQQ; QEQASQQI; EQASQQIL; QASQQILS; ASQQILSS;<br><br>9 mers:<br>MTSRFMTDP; TSRFMTDPH; SRFMTDPHA; RFMTDPHAM; FMTDPHAMR; MTDPHAMRD; TDPHAMRDM; DPHAMRDMA; | 46584-46941 |

Fig. 28 continued

| | | | |
|---|---|---|---|
| | PHAMRDMAG; HAMRDMAGR; AMRDMAGRF; MRDMAGRFE; RDMAGRFEV; DMAGRFEVH; MAGRFEVHA; AGRFEVHAQ; GRFEVHAQT; RFEVHAQTV; FEVHAQTVE; EVHAQTVED; VHAQTVEDE; HAQTVEDEA; AQTVEDEAR; QTVEDEARR; TVEDEARRM; VEDEARRMW; EDEARRMWA; DEARRMWAS; EARRMWASA; ARRMWASAQ; RRMWASAQN; RMWASAQNI; MWASAQNIS; WASAQNISG; ASAQNISGA; SAQNISGAG; AQNISGAGW; QNISGAGWS; NISGAGWSG; ISGAGWSGM; SGAGWSGMA; GAGWSGMAE; AGWSGMAEA; GWSGMAEAT; WSGMAEATS; SGMAEATSL; GMAEATSLD; MAEATSLDT; AEATSLDTM; EATSLDTMT; ATSLDTMTQ; TSLDTMTQM; SLDTMTQMN; LDTMTQMNQ; DTMTQMNQA; TMTQMNQAF; MTQMNQAFR; TQMNQAFRN; QMNQAFRNI; MNQAFRNIV; NQAFRNIVN; QAFRNIVNM; AFRNIVNML; FRNIVNMLH; RNIVNMLHG; NIVNMLHGV; IVNMLHGVR; VNMLHGVRD; NMLHGVRDG; MLHGVRDGL; LHGVRDGLV; HGVRDGLVR; GVRDGLVRD; VRDGLVRDA; RDGLVRDAN; DGLVRDANN; GLVRDANNY; LVRDANNYE; VRDANNYEQ; RDANNYEQQ; DANNYEQQE; ANNYEQQEQ; NNYEQQEQA; NYEQQEQAS; YEQQEQASQ; EQQEQASQQ; QQEQASQQI; QEQASQQIL; EQASQQILS; QASQQILSS;<br><br>10 mers:<br>MTSRFMTDPH; TSRFMTDPHA; SRFMTDPHAM; RFMTDPHAMR; FMTDPHAMRD; MTDPHAMRDM; TDPHAMRDMA; DPHAMRDMAG; PHAMRDMAGR; HAMRDMAGRF; AMRDMAGRFE; MRDMAGRFEV; RDMAGRFEVH; DMAGRFEVHA; MAGRFEVHAQ; AGRFEVHAQT; GRFEVHAQTV; RFEVHAQTVE; FEVHAQTVED; EVHAQTVEDE; VHAQTVEDEA; HAQTVEDEAR; AQTVEDEARR; QTVEDEARRM; TVEDEARRMW; VEDEARRMWA; EDEARRMWAS; DEARRMWASA; EARRMWASAQ; ARRMWASAQN; RRMWASAQNI; RMWASAQNIS; MWASAQNISG; WASAQNISGA; ASAQNISGAG; SAQNISGAGW; AQNISGAGWS; QNISGAGWSG; NISGAGWSGM; ISGAGWSGMA; SGAGWSGMAE; GAGWSGMAEA; AGWSGMAEAT; GWSGMAEATS; WSGMAEATSL; SGMAEATSLD; GMAEATSLDT; MAEATSLDTM; AEATSLDTMT; EATSLDTMTQ; ATSLDTMTQM; TSLDTMTQMN; SLDTMTQMNQ; LDTMTQMNQA; DTMTQMNQAF; TMTQMNQAFR; MTQMNQAFRN; TQMNQAFRNI; QMNQAFRNIV; MNQAFRNIVN; NQAFRNIVNM; QAFRNIVNML; AFRNIVNMLH; FRNIVNMLHG; RNIVNMLHGV; NIVNMLHGVR; IVNMLHGVRD; VNMLHGVRDG; NMLHGVRDGL; MLHGVRDGLV; LHGVRDGLVR; HGVRDGLVRD; GVRDGLVRDA; VRDGLVRDAN; RDGLVRDANN; DGLVRDANNY; GLVRDANNYE; LVRDANNYEQ; VRDANNYEQQ; RDANNYEQQE; DANNYEQQEQ; ANNYEQQEQA; NNYEQQEQAS; NYEQQEQASQ; YEQQEQASQQ; EQQEQASQQI; QQEQASQQIL; QEQASQQILS; EQASQQILSS;<br><br>11 mers:<br>MTSRFMTDPHA; TSRFMTDPHAM; SRFMTDPHAMR; RFMTDPHAMRD; FMTDPHAMRDM; MTDPHAMRDMA; TDPHAMRDMAG; DPHAMRDMAGR; PHAMRDMAGRF; HAMRDMAGRFE; AMRDMAGRFEV; MRDMAGRFEVH; RDMAGRFEVHA; DMAGRFEVHAQ; MAGRFEVHAQT; | |

Fig. 28 continued

| | | |
|---|---|---|
| | AGRFEVHAQTV; GRFEVHAQTVE; RFEVHAQTVED; FEVHAQTVEDE; EVHAQTVEDEA; VHAQTVEDEAR; HAQTVEDEARR; AQTVEDEARRM; QTVEDEARRMW; TVEDEARRMWA; VEDEARRMWAS; EDEARRMWASA; DEARRMWASAQ; EARRMWASAQN; ARRMWASAQNI; RRMWASAQNIS; RMWASAQNISG; MWASAQNISGA; WASAQNISGAG; ASAQNISGAGW; SAQNISGAGWS; AQNISGAGWSG; QNISGAGWSGM; NISGAGWSGMA; ISGAGWSGMAE; SGAGWSGMAEA; GAGWSGMAEAT; AGWSGMAEATS; GWSGMAEATSL; WSGMAEATSLD; SGMAEATSLDT; GMAEATSLDTM; MAEATSLDTMT; AEATSLDTMTQ; EATSLDTMTQM; ATSLDTMTQMN; TSLDTMTQMNQ; SLDTMTQMNQA; LDTMTQMNQAF; DTMTQMNQAFR; TMTQMNQAFRN; MTQMNQAFRNI; TQMNQAFRNIV; QMNQAFRNIVN; MNQAFRNIVNM; NQAFRNIVNML; QAFRNIVNMLH; AFRNIVNMLHG; FRNIVNMLHGV; RNIVNMLHGVR; NIVNMLHGVRD; IVNMLHGVRDG; VNMLHGVRDGL; NMLHGVRDGLV; MLHGVRDGLVR; LHGVRDGLVRD; HGVRDGLVRDA; GVRDGLVRDAN; VRDGLVRDANN; RDGLVRDANNY; DGLVRDANNYE; GLVRDANNYEQ; LVRDANNYEQQ; VRDANNYEQQE; RDANNYEQQEQ; DANNYEQQEQA; ANNYEQQEQAS; NNYEQQEQASQ; NYEQQEQASQQ; YEQQEQASQQI; EQQEQASQQIL; QQEQASQQILS; QEQASQQILSS; | |
| 68) Rv3675 | 8 mers:<br>MFTLLVSW; FTLLVSWL; TLLVSWLL; LLVSWLLV; LVSWLLVA; VSWLLVAC; SWLLVACV; WLLVACVP; LLVACVPG; LVACVPGL; VACVPGLL; ACVPGLLM; CVPGLLML; VPGLLMLA; PGLLMLAT; GLLMLATL; LLMLATLG; LMLATLGL; MLATLGLG; LATLGLGR; ATLGLGRL; TLGLGRLE; LGLGRLER; GLGRLERF; LGRLERFL; GRLERFLA; RLERFLAR; LERFLARD; ERFLARDT; RFLARDTV; FLARDTVT; LARDTVTA; ARDTVTAT; RDTVTATD; DTVTATDV; TVTATDVA; VTATDVAE; TATDVAEF; ATDVAEFL; TDVAEFLE; DVAEFLEQ; VAEFLEQA; AEFLEQAE; EFLEQAEA; FLEQAEAV; LEQAEAVD; EQAEAVDV; QAEAVDVH; AEAVDVHT; EAVDVHTL; AVDVHTLA; VDVHTLAR; DVHTLARN; VHTLARNG; HTLARNGM; TLARNGMP; LARNGMPE; ARNGMPEA; RNGMPEAL; NGMPEALD; GMPEALDY; MPEALDYL; PEALDYLH; EALDYLHR; ALDYLHRR; LDYLHRRQ; DYLHRRQA; YLHRRQAR; LHRRQARR; HRRQARRI; RRQARRIT; RQARRITD; QARRITDS; ARRITDSP; RRITDSPP; RITDSPPL; ITDSPPLG; TDSPPLGS; DSPPLGSG; SPPLGSGA; PPLGSGAG; PLGSGAGP; LGSGAGPR; GSGAGPRY; SGAGPRYA; GAGPRYAG; AGPRYAGP; GPRYAGPL; PRYAGPLF; RYAGPLFV; YAGPLFVT; AGPLFVTD; GPLFVTDL; PLFVTDLD; LFVTDLDS; FVTDLDSP; VTDLDSPV; TDLDSPVE; DLDSPVEP; LDSPVEPP; DSPVEPPR; SPVEPPRH; PVEPPRHG; VEPPRHGQ; EPPRHGQP; PPRHGQPN; PRHGQPNP; RHGQPNPQ; HGQPNPQF; GQPNPQFR; QPNPQFRT; PNPQFRTA; NPQFRTAR; PQFRTARH; QFRTARHA; FRTARHAN; RTARHANH; TARHANHV<br><br>9 mers:<br>MFTLLVSWL; FTLLVSWLL; TLLVSWLLV; LLVSWLLVA; LVSWLLVAC; VSWLLVACV; SWLLVACVP; WLLVACVPG; LLVACVPGL; LVACVPGLL; VACVPGLLM; ACVPGLLML; CVPGLLMLA; | 46942-47407 |

Fig. 28 continued

| | | |
|---|---|---|
| | VPGLLMLAT; PGLLMLATL; GLLMLATLG; LLMLATLGL; LMLATLGLG; MLATLGLGR; LATLGLGRL; ATLGLGRLE; TLGLGRLER; LGLGRLERF; GLGRLERFL; LGRLERFLA; GRLERFLAR; RLERFLARD; LERFLARDT; ERFLARDTV; RFLARDTVT; FLARDTVTA; LARDTVTAT; ARDTVTATD; RDTVTATDV; DTVTATDVA; TVTATDVAE; VTATDVAEF; TATDVAEFL; ATDVAEFLE; TDVAEFLEQ; DVAEFLEQA; VAEFLEQAE; AEFLEQAEA; EFLEQAEAV; FLEQAEAVD; LEQAEAVDV; EQAEAVDVH; QAEAVDVHT; AEAVDVHTL; EAVDVHTLA; AVDVHTLAR; VDVHTLARN; DVHTLARNG; VHTLARNGM; HTLARNGMP; TLARNGMPE; LARNGMPEA; ARNGMPEAL; RNGMPEALD; NGMPEALDY; GMPEALDYL; MPEALDYLH; PEALDYLHR; EALDYLHRR; ALDYLHRRQ; LDYLHRRQA; DYLHRRQAR; YLHRRQARR; LHRRQARRI; HRRQARRIT; RRQARRITD; RQARRITDS; QARRITDSP; ARRITDSPP; RRITDSPPL; RITDSPPLG; ITDSPPLGS; TDSPPLGSG; DSPPLGSGA; SPPLGSGAG; PPLGSGAGP; PLGSGAGPR; LGSGAGPRY; GSGAGPRYA; SGAGPRYAG; GAGPRYAGP; AGPRYAGPL; GPRYAGPLF; PRYAGPLFV; RYAGPLFVT; YAGPLFVTD; AGPLFVTDL; GPLFVTDLD; PLFVTDLDS; LFVTDLDSP; FVTDLDSPV; VTDLDSPVE; TDLDSPVEP; DLDSPVEPP; LDSPVEPPR; DSPVEPPRH; SPVEPPRHG; PVEPPRHGQ; VEPPRHGQP; EPPRHGQPN; PPRHGQPNP; PRHGQPNPQ; RHGQPNPQF; HGQPNPQFR; GQPNPQFRT; QPNPQFRTA; PNPQFRTAR; NPQFRTARH; PQFRTARHA; QFRTARHAN; FRTARHANH; RTARHANHV<br><br>10 mers:<br>MFTLLVSWLL; FTLLVSWLLV; TLLVSWLLVA; LLVSWLLVAC; LVSWLLVACV; VSWLLVACVP; SWLLVACVPG; WLLVACVPGL; LLVACVPGLL; LVACVPGLLM; VACVPGLLML; ACVPGLLMLA; CVPGLLMLAT; VPGLLMLATL; PGLLMLATLG; GLLMLATLGL; LLMLATLGLG; LMLATLGLGR; MLATLGLGRL; LATLGLGRLE; ATLGLGRLER; TLGLGRLERF; LGLGRLERFL; GLGRLERFLA; LGRLERFLAR; GRLERFLARD; RLERFLARDT; LERFLARDTV; ERFLARDTVT; RFLARDTVTA; FLARDTVTAT; LARDTVTATD; ARDTVTATDV; RDTVTATDVA; DTVTATDVAE; TVTATDVAEF; VTATDVAEFL; TATDVAEFLE; ATDVAEFLEQ; TDVAEFLEQA; DVAEFLEQAE; VAEFLEQAEA; AEFLEQAEAV; EFLEQAEAVD; FLEQAEAVDV; LEQAEAVDVH; EQAEAVDVHT; QAEAVDVHTL; AEAVDVHTLA; EAVDVHTLAR; AVDVHTLARN; VDVHTLARNG; DVHTLARNGM; VHTLARNGMP; HTLARNGMPE; TLARNGMPEA; LARNGMPEAL; ARNGMPEALD; RNGMPEALDY; NGMPEALDYL; GMPEALDYLH; MPEALDYLHR; PEALDYLHRR; EALDYLHRRQ; ALDYLHRRQA; LDYLHRRQAR; DYLHRRQARR; YLHRRQARRI; LHRRQARRIT; HRRQARRITD; RRQARRITDS; RQARRITDSP; QARRITDSPP; ARRITDSPPL; RRITDSPPLG; RITDSPPLGS; ITDSPPLGSG; TDSPPLGSGA; DSPPLGSGAG; SPPLGSGAGP; PPLGSGAGPR; PLGSGAGPRY; LGSGAGPRYA; GSGAGPRYAG; SGAGPRYAGP; GAGPRYAGPL; AGPRYAGPLF; GPRYAGPLFV; PRYAGPLFVT; RYAGPLFVTD; YAGPLFVTDL; AGPLFVTDLD; GPLFVTDLDS; PLFVTDLDSP; LFVTDLDSPV; FVTDLDSPVE; VTDLDSPVEP; TDLDSPVEPP; DLDSPVEPPR; LDSPVEPPRH; DSPVEPPRHG; SPVEPPRHGQ; PVEPPRHGQP; VEPPRHGQPN; EPPRHGQPNP; PPRHGQPNPQ; PRHGQPNPQF; RHGQPNPQFR; | |

Fig. 28 continued

| | | |
|---|---|---|
| | HGQPNPQFRT; GQPNPQFRTA; QPNPQFRTAR; PNPQFRTARH; NPQFRTARHA; PQFRTARHAN; QFRTARHANH; FRTARHANHV<br><br>11 mers:<br>MFTLLVSWLLV; FTLLVSWLLVA; TLLVSWLLVAC; LLVSWLLVACV; LVSWLLVACVP; VSWLLVACVPG; SWLLVACVPGL; WLLVACVPGLL; LLVACVPGLLM; LVACVPGLLML; VACVPGLLMLA; ACVPGLLMLAT; CVPGLLMLATL; VPGLLMLATLG; PGLLMLATLGL; GLLMLATLGLG; LLMLATLGLGR; LMLATLGLGRL; MLATLGLGRLE; LATLGLGRLER; ATLGLGRLERF; TLGLGRLERFL; LGLGRLERFLA; GLGRLERFLAR; LGRLERFLARD; GRLERFLARDT; RLERFLARDTV; LERFLARDTVT; ERFLARDTVTA; RFLARDTVTAT; FLARDTVTATD; LARDTVTATDV; ARDTVTATDVA; RDTVTATDVAE; DTVTATDVAEF; TVTATDVAEFL; VTATDVAEFLE; TATDVAEFLEQ; ATDVAEFLEQA; TDVAEFLEQAE; DVAEFLEQAEA; VAEFLEQAEAV; AEFLEQAEAVD; EFLEQAEAVDV; FLEQAEAVDVH; LEQAEAVDVHT; EQAEAVDVHTL; QAEAVDVHTLA; AEAVDVHTLAR; EAVDVHTLARN; AVDVHTLARNG; VDVHTLARNGM; DVHTLARNGMP; VHTLARNGMPE; HTLARNGMPEA; TLARNGMPEAL; LARNGMPEALD; ARNGMPEALDY; RNGMPEALDYL; NGMPEALDYLH; GMPEALDYLHR; MPEALDYLHRR; PEALDYLHRRQ; EALDYLHRRQA; ALDYLHRRQAR; LDYLHRRQARR; DYLHRRQARRI; YLHRRQARRIT; LHRRQARRITD; HRRQARRITDS; RRQARRITDSP; RQARRITDSPP; QARRITDSPPL; ARRITDSPPLG; RRITDSPPLGS; RITDSPPLGSG; ITDSPPLGSGA; TDSPPLGSGAG; DSPPLGSGAGP; SPPLGSGAGPR; PPLGSGAGPRY; PLGSGAGPRYA; LGSGAGPRYAG; GSGAGPRYAGP; SGAGPRYAGPL; GAGPRYAGPLF; AGPRYAGPLFV; GPRYAGPLFVT; PRYAGPLFVTD; RYAGPLFVTDL; YAGPLFVTDLD; AGPLFVTDLDS; GPLFVTDLDSP; PLFVTDLDSPV; LFVTDLDSPVE; FVTDLDSPVEP; VTDLDSPVEPP; TDLDSPVEPPR; DLDSPVEPPRH; LDSPVEPPRHG; DSPVEPPRHGQ; SPVEPPRHGQP; PVEPPRHGQPN; VEPPRHGQPNP; EPPRHGQPNPQ; PPRHGQPNPQF; PRHGQPNPQFR; RHGQPNPQFRT; HGQPNPQFRTA; GQPNPQFRTAR; QPNPQFRTARH; PNPQFRTARHA; NPQFRTARHAN; PQFRTARHANH; QFRTARHANHV | |
| 69) Rv3735 | 8 mers:<br>MSLAWDVV; SLAWDVVS; LAWDVVSV; AWDVVSVD; WDVVSVDK; DVVSVDKP; VVSVDKPD; VSVDKPDD; SVDKPDDV; VDKPDDVN; DKPDDVNV; KPDDVNVV; PDDVNVVI; DDVNVVIG; DVNVVIGQ; VNVVIGQA; NVVIGQAH; VVIGQAHF; VIGQAHFI; IGQAHFIK; GQAHFIKA; QAHFIKAV; AHFIKAVE; HFIKAVED; FIKAVEDL; IKAVEDLH; KAVEDLHE; AVEDLHEA; VEDLHEAM; EDLHEAMV; DLHEAMVG; LHEAMVGV; HEAMVGVS; EAMVGVSP; AMVGVSPS; MVGVSPSL; VGVSPSLR; GVSPSLRF; VSPSLRFG; SPSLRFGL; PSLRFGLA; SLRFGLAF; LRFGLAFC; RFGLAFCE; FGLAFCEA; GLAFCEAS; LAFCEASG; AFCEASGP; FCEASGPR; CEASGPRL; EASGPRLV; ASGPRLVR; SGPRLVRH; GPRLVRHT; PRLVRHTG; RLVRHTGN; LVRHTGND; VRHTGNDG; RHTGNDGD; HTGNDGDL; TGNDGDLV; GNDGDLVE; NDGDLVEL; DGDLVELA; GDLVELAT; DLVELATR; LVELATRT; VELATRTA; ELATRTAL; LATRTALA; ATRTALAI; TRTALAIA; RTALAIAA; TALAIAAG; ALAIAAGH; LAIAAGHS; AIAAGHSF; IAAGHSFV; AAGHSFVI; AGHSFVIF; | 47408-48021 |

Fig. 28 continued

| | | |
|---|---|---|
| | GHSFVIFL; HSFVIFLR; SFVIFLRE; FVIFLREG; VIFLREGF; IFLREGFP; FLREGFPI; LREGFPIN; REGFPINI; EGFPINIL; GFPINILN; FPINILNP; PINILNPV; INILNPVQ; NILNPVQA; ILNPVQAV; LNPVQAVP; NPVQAVPE; PVQAVPEV; VQAVPEVC; QAVPEVCT; AVPEVCTI; VPEVCTIY; PEVCTIYC; EVCTIYCA; VCTIYCAT; CTIYCATA; TIYCATAN; IYCATANP; YCATANPV; CATANPVD; ATANPVDV; TANPVDVV; ANPVDVVV; NPVDVVVA; PVDVVVAV; VDVVVAVT; DVVVAVTP; VVVAVTPH; VVAVTPHG; VAVTPHGR; AVTPHGRG; VTPHGRGI; TPHGRGIV; PHGRGIVG; HGRGIVGV; GRGIVGVV; RGIVGVVD; GIVGVVDG; IVGVVDGQ; VGVVDGQT; GVVDGQTP; VVDGQTPL; VDGQTPLG; DGQTPLGV; GQTPLGVE; QTPLGVET; TPLGVETD; PLGVETDR; LGVETDRD; GVETDRDI; VETDRDIA; ETDRDIAQ; TDRDIAQR; DRDIAQRR; RDIAQRRD; DIAQRRDL; IAQRRDLL; AQRRDLLR; QRRDLLRA; RRDLLRAI; RDLLRAIG; DLLRAIGY; LLRAIGYK; LRAIGYKL<br><br>9 mers:<br>MSLAWDVVS; SLAWDVVSV; LAWDVVSVD; AWDVVSVDK; WDVVSVDKP; DVVSVDKPD; VVSVDKPDD; VSVDKPDDV; SVDKPDDVN; VDKPDDVNV; DKPDDVNVV; KPDDVNVVI; PDDVNVVIG; DDVNVVIGQ; DVNVVIGQA; VNVVIGQAH; NVVIGQAHF; VVIGQAHFI; VIGQAHFIK; IGQAHFIKA; GQAHFIKAV; QAHFIKAVE; AHFIKAVED; HFIKAVEDL; FIKAVEDLH; IKAVEDLHE; KAVEDLHEA; AVEDLHEAM; VEDLHEAMV; EDLHEAMVG; DLHEAMVGV; LHEAMVGVS; HEAMVGVSP; EAMVGVSPS; AMVGVSPSL; MVGVSPSLR; VGVSPSLRF; GVSPSLRFG; VSPSLRFGL; SPSLRFGLA; PSLRFGLAF; SLRFGLAFC; LRFGLAFCE; RFGLAFCEA; FGLAFCEAS; GLAFCEASG; LAFCEASGP; AFCEASGPR; FCEASGPRL; CEASGPRLV; EASGPRLVR; ASGPRLVRH; SGPRLVRHT; GPRLVRHTG; PRLVRHTGN; RLVRHTGND; LVRHTGNDG; VRHTGNDGD; RHTGNDGDL; HTGNDGDLV; TGNDGDLVE; GNDGDLVEL; NDGDLVELA; DGDLVELAT; GDLVELATR; DLVELATRT; LVELATRTA; VELATRTAL; ELATRTALA; LATRTALAI; ATRTALAIA; TRTALAIAA; RTALAIAAG; TALAIAAGH; ALAIAAGHS; LAIAAGHSF; AIAAGHSFV; IAAGHSFVI; AAGHSFVIF; AGHSFVIFL; GHSFVIFLR; HSFVIFLRE; SFVIFLREG; FVIFLREGF; VIFLREGFP; IFLREGFPI; FLREGFPIN; LREGFPINI; REGFPINIL; EGFPINILN; GFPINILNP; FPINILNPV; PINILNPVQ; INILNPVQA; NILNPVQAV; ILNPVQAVP; LNPVQAVPE; NPVQAVPEV; PVQAVPEVC; VQAVPEVCT; QAVPEVCTI; AVPEVCTIY; VPEVCTIYC; PEVCTIYCA; EVCTIYCAT; VCTIYCATA; CTIYCATAN; TIYCATANP; IYCATANPV; YCATANPVD; CATANPVDV; ATANPVDVV; TANPVDVVV; ANPVDVVVA; NPVDVVVAV; PVDVVVAVT; VDVVVAVTP; DVVVAVTPH; VVVAVTPHG; VVAVTPHGR; VAVTPHGRG; AVTPHGRGI; VTPHGRGIV; TPHGRGIVG; PHGRGIVGV; HGRGIVGVV; GRGIVGVVD; RGIVGVVDG; GIVGVVDGQ; IVGVVDGQT; VGVVDGQTP; GVVDGQTPL; VVDGQTPLG; VDGQTPLGV; DGQTPLGVE; GQTPLGVET; QTPLGVETD; TPLGVETDR; PLGVETDRD; LGVETDRDI; GVETDRDIA; VETDRDIAQ; ETDRDIAQR; TDRDIAQRR; DRDIAQRRD; RDIAQRRDL; DIAQRRDLL; IAQRRDLLR; AQRRDLLRA; QRRDLLRAI; RRDLLRAIG; RDLLRAIGY; DLLRAIGYK; LLRAIGYKL | |

Fig. 28 continued

| | | |
|---|---|---|
| | 10 mers:<br>MSLAWDVVSV; SLAWDVVSVD; LAWDVVSVDK; AWDVVSVDKP; WDVVSVDKPD; DVVSVDKPDD; VVSVDKPDDV; VSVDKPDDVN; SVDKPDDVNV; VDKPDDVNVV; DKPDDVNVVI; KPDDVNVVIG; PDDVNVVIGQ; DDVNVVIGQA; DVNVVIGQAH; VNVVIGQAHF; NVVIGQAHFI; VVIGQAHFIK; VIGQAHFIKA; IGQAHFIKAV; GQAHFIKAVE; QAHFIKAVED; AHFIKAVEDL; HFIKAVEDLH; FIKAVEDLHE; IKAVEDLHEA; KAVEDLHEAM; AVEDLHEAMV; VEDLHEAMVG; EDLHEAMVGV; DLHEAMVGVS; LHEAMVGVSP; HEAMVGVSPS; EAMVGVSPSL; AMVGVSPSLR; MVGVSPSLRF; VGVSPSLRFG; GVSPSLRFGL; VSPSLRFGLA; SPSLRFGLAF; PSLRFGLAFC; SLRFGLAFCE; LRFGLAFCEA; RFGLAFCEAS; FGLAFCEASG; GLAFCEASGP; LAFCEASGPR; AFCEASGPRL; FCEASGPRLV; CEASGPRLVR; EASGPRLVRH; ASGPRLVRHT; SGPRLVRHTG; GPRLVRHTGN; PRLVRHTGND; RLVRHTGNDG; LVRHTGNDGD; VRHTGNDGDL; RHTGNDGDLV; HTGNDGDLVE; TGNDGDLVEL; GNDGDLVELA; NDGDLVELAT; DGDLVELATR; GDLVELATRT; DLVELATRTA; LVELATRTAL; VELATRTALA; ELATRTALAI; LATRTALAIA; ATRTALAIAA; TRTALAIAAG; RTALAIAAGH; TALAIAAGHS; ALAIAAGHSF; LAIAAGHSFV; AIAAGHSFVI; IAAGHSFVIF; AAGHSFVIFL; AGHSFVIFLR; GHSFVIFLRE; HSFVIFLREG; SFVIFLREGF; FVIFLREGFP; VIFLREGFPI; IFLREGFPIN; FLREGFPINI; LREGFPINIL; REGFPINILN; EGFPINILNP; GFPINILNPV; FPINILNPVQ; PINILNPVQA; INILNPVQAV; NILNPVQAVP; ILNPVQAVPE; LNPVQAVPEV; NPVQAVPEVC; PVQAVPEVCT; VQAVPEVCTI; QAVPEVCTIY; AVPEVCTIYC; VPEVCTIYCA; PEVCTIYCAT; EVCTIYCATA; VCTIYCATAN; CTIYCATANP; TIYCATANPV; IYCATANPVD; YCATANPVDV; CATANPVDVV; ATANPVDVVV; TANPVDVVVA; ANPVDVVVAV; NPVDVVVAVT; PVDVVVAVTP; VDVVVAVTPH; DVVVAVTPHG; VVVAVTPHGR; VVAVTPHGRG; VAVTPHGRGI; AVTPHGRGIV; VTPHGRGIVG; TPHGRGIVGV; PHGRGIVGVV; HGRGIVGVVD; GRGIVGVVDG; RGIVGVVDGQ; GIVGVVDGQT; IVGVVDGQTP; VGVVDGQTPL; GVVDGQTPLG; VVDGQTPLGV; VDGQTPLGVE; DGQTPLGVET; GQTPLGVETD; QTPLGVETDR; TPLGVETDRD; PLGVETDRDI; LGVETDRDIA; GVETDRDIAQ; VETDRDIAQR; ETDRDIAQRR; TDRDIAQRRD; DRDIAQRRDL; RDIAQRRDLL; DIAQRRDLLR; IAQRRDLLRA; AQRRDLLRAI; QRRDLLRAIG; RRDLLRAIGY; RDLLRAIGYK; DLLRAIGYKL<br><br>11 mers:<br>MSLAWDVVSVD; SLAWDVVSVDK; LAWDVVSVDKP; AWDVVSVDKPD; WDVVSVDKPDD; DVVSVDKPDDV; VVSVDKPDDVN; VSVDKPDDVNV; SVDKPDDVNVV; VDKPDDVNVVI; DKPDDVNVVIG; KPDDVNVVIGQ; PDDVNVVIGQA; DDVNVVIGQAH; DVNVVIGQAHF; VNVVIGQAHFI; NVVIGQAHFIK; VVIGQAHFIKA; VIGQAHFIKAV; IGQAHFIKAVE; GQAHFIKAVED; QAHFIKAVEDL; AHFIKAVEDLH; HFIKAVEDLHE; FIKAVEDLHEA; IKAVEDLHEAM; KAVEDLHEAMV; AVEDLHEAMVG; VEDLHEAMVGV; EDLHEAMVGVS; DLHEAMVGVSP; LHEAMVGVSPS; HEAMVGVSPSL; EAMVGVSPSLR; AMVGVSPSLRF; MVGVSPSLRFG; VGVSPSLRFGL; GVSPSLRFGLA; VSPSLRFGLAF; SPSLRFGLAFC; PSLRFGLAFCE; SLRFGLAFCEA; LRFGLAFCEAS; RFGLAFCEASG; | |

Fig. 28 continued

| | | |
|---|---|---|
| | FGLAFCEASGP; GLAFCEASGPR; LAFCEASGPRL; AFCEASGPRLV; FCEASGPRLVR; CEASGPRLVRH; EASGPRLVRHT; ASGPRLVRHTG; SGPRLVRHTGN; GPRLVRHTGND; PRLVRHTGNDG; RLVRHTGNDGD; LVRHTGNDGDL; VRHTGNDGDLV; RHTGNDGDLVE; HTGNDGDLVEL; TGNDGDLVELA; GNDGDLVELAT; NDGDLVELATR; DGDLVELATRT; GDLVELATRTA; DLVELATRTAL; LVELATRTALA; VELATRTALAI; ELATRTALAIA; LATRTALAIAA; ATRTALAIAAG; TRTALAIAAGH; RTALAIAAGHS; TALAIAAGHSF; ALAIAAGHSFV; LAIAAGHSFVI; AIAAGHSFVIF; IAAGHSFVIFL; AAGHSFVIFLR; AGHSFVIFLRE; GHSFVIFLREG; HSFVIFLREGF; SFVIFLREGFP; FVIFLREGFPI; VIFLREGFPIN; IFLREGFPINI; FLREGFPINIL; LREGFPINILN; REGFPINILNP; EGFPINILNPV; GFPINILNPVQ; FPINILNPVQA; PINILNPVQAV; INILNPVQAVP; NILNPVQAVPE; ILNPVQAVPEV; LNPVQAVPEVC; NPVQAVPEVCT; PVQAVPEVCTI; VQAVPEVCTIY; QAVPEVCTIYC; AVPEVCTIYCA; VPEVCTIYCAT; PEVCTIYCATA; EVCTIYCATAN; VCTIYCATANP; CTIYCATANPV; TIYCATANPVD; IYCATANPVDV; YCATANPVDVV; CATANPVDVVV; ATANPVDVVVA; TANPVDVVVAV; ANPVDVVVAVT; NPVDVVVAVTP; PVDVVVAVTPH; VDVVVAVTPHG; DVVVAVTPHGR; VVVAVTPHGRG; VVAVTPHGRGI; VAVTPHGRGIV; AVTPHGRGIVG; VTPHGRGIVGV; TPHGRGIVGVV; PHGRGIVGVVD; HGRGIVGVVDG; GRGIVGVVDGQ; RGIVGVVDGQT; GIVGVVDGQTP; IVGVVDGQTPL; VGVVDGQTPLG; GVVDGQTPLGV; VVDGQTPLGVE; VDGQTPLGVET; DGQTPLGVETD; GQTPLGVETDR; QTPLGVETDRD; TPLGVETDRDI; PLGVETDRDIA; LGVETDRDIAQ; GVETDRDIAQR; VETDRDIAQRR; ETDRDIAQRRD; TDRDIAQRRDL; DRDIAQRRDLL; RDIAQRRDLLR; DIAQRRDLLRA; IAQRRDLLRAI; AQRRDLLRAIG; QRRDLLRAIGY; RRDLLRAIGYK; RDLLRAIGYKL | |
| 70) Rv3810 | 8 mers:<br>MPNRRRRK; PNRRRRKL; NRRRRKLS; RRRRKLST; RRRKLSTA; RRKLSTAM; RKLSTAMS; KLSTAMSA; LSTAMSAV; STAMSAVA; TAMSAVAA; AMSAVAAL; MSAVAALA; SAVAALAV; AVAALAVA; VAALAVAS; AALAVASP; ALAVASPC; LAVASPCA; AVASPCAY; VASPCAYF; ASPCAYFL; SPCAYFLV; PCAYFLVY; CAYFLVYE; AYFLVYES; YFLVYEST; FLVYESTE; LVYESTET; VYESTETT; YESTETTE; ESTETTER; STETTERP; TETTERPE; ETTERPEH; TTERPEHH; TERPEHHE; ERPEHHEF; RPEHHEFK; PEHHEFKQ; EHHEFKQA; HHEFKQAA; HEFKQAAV; EFKQAAVL; FKQAAVLT; KQAAVLTD; QAAVLTDL; AAVLTDLP; AVLTDLPG; VLTDLPGE; LTDLPGEL; TDLPGELM; DLPGELMS; LPGELMSA; PGELMSAL; GELMSALS; ELMSALSQ; LMSALSQG; MSALSQGL; SALSQGLS; ALSQGLSQ; LSQGLSQF; SQGLSQFG; QGLSQFGI; GLSQFGIN; LSQFGINI; SQFGINIP; QFGINIPP; FGINIPPV; GINIPPVP; INIPPVPS; NIPPVPSL; IPPVPSLT; PPVPSLTG; PVPSLTGS; VPSLTGSG; PSLTGSGD; SLTGSGDA; LTGSGDAS; TGSGDAST; GSGDASTG; SGDASTGL; GDASTGLT; DASTGLTG; ASTGLTGP; STGLTGPG; TGLTGPGL; GLTGPGLT; LTGPGLTS; TGPGLTSP; GPGLTSPG; PGLTSPGL; GLTSPGLT; LTSPGLTS; TSPGLTSP; SPGLTSPG; PGLTSPGL; GLTSPGLT; LTSPGLTS; TSPGLTSP; SPGLTSPG; PGLTSPGL; GLTSPGLT; LTSPGLTD; TSPGLTDP; SPGLTDPA; PGLTDPAL; GLTDPALT; LTDPALTS; TDPALTSP; DPALTSPG; PALTSPGL; ALTSPGLT; LTSPGLTP; TSPGLTPT; SPGLTPTL; | 48022-49123 |

Fig. 28 continued

| | | | |
|---|---|---|---|
| | PGLTPTLP; GLTPTLPG; LTPTLPGS; TPTLPGSL; PTLPGSLA; TLPGSLAA; LPGSLAAP; PGSLAAPG; GSLAAPGT; SLAAPGTT; LAAPGTTL; AAPGTTLA; APGTTLAP; PGTTLAPT; GTTLAPTP; TTLAPTPG; TLAPTPGV; LAPTPGVG; APTPGVGA; PTPGVGAN; TPGVGANP; PGVGANPA; GVGANPAL; VGANPALT; GANPALTN; ANPALTNP; NPALTNPA; PALTNPAL; ALTNPALT; LTNPALTS; TNPALTSP; NPALTSPT; PALTSPTG; ALTSPTGA; LTSPTGAT; TSPTGATP; SPTGATPG; PTGATPGL; TGATPGLT; GATPGLTS; ATPGLTSP; TPGLTSPT; PGLTSPTG; GLTSPTGL; LTSPTGLD; TSPTGLDP; SPTGLDPA; PTGLDPAL; TGLDPALG; GLDPALGG; LDPALGGA; DPALGGAN; PALGGANE; ALGGANEI; LGGANEIP; GGANEIPI; GANEIPIT; ANEIPITT; NEIPITTP; EIPITTPV; IPITTPVG; PITTPVGL; ITTPVGLD; TTPVGLDP; TPVGLDPG; PVGLDPGA; VGLDPGAD; GLDPGADG; LDPGADGT; DPGADGTY; PGADGTYP; GADGTYPI; ADGTYPIL; DGTYPILG; GTYPILGD; TYPILGDP; YPILGDPT; PILGDPTL; ILGDPTLG; LGDPTLGT; GDPTLGTI; DPTLGTIP; PTLGTIPS; TLGTIPSS; LGTIPSSP; GTIPSSPA; TIPSSPAT; IPSSPATT; PSSPATTS; SSPATTST; SPATTSTG; PATTSTGG; ATTSTGGG; TTSTGGGG; TSTGGGGL; STGGGGLV; TGGGGLVN; GGGGLVND; GGGLVNDV; GGLVNDVM; GLVNDVMQ; LVNDVMQV; VNDVMQVA; NDVMQVAN; DVMQVANE; VMQVANEL; MQVANELG; QVANELGA; VANELGAS; ANELGASQ; NELGASQA; ELGASQAI; LGASQAID; GASQAIDL; ASQAIDLL; SQAIDLLK; QAIDLLKG; AIDLLKGV; IDLLKGVL; DLLKGVLM; LLKGVLMP; LKGVLMPS; KGVLMPSI; GVLMPSIM; VLMPSIMQ; LMPSIMQA; MPSIMQAV; PSIMQAVQ; SIMQAVQN; IMQAVQNG; MQAVQNGG; QAVQNGGA; AVQNGGAA; VQNGGAAA; QNGGAAAP; NGGAAAPA; GGAAAPAA; GAAAPAAS; AAAPAASP; AAPAASPP; APAASPPV; PAASPPVP; AASPPVPP; ASPPVPPI; SPPVPPIP; PPVPPIPA; PVPPIPAA; VPPIPAAA; PPIPAAAA; PIPAAAAV; IPAAAAVP; PAAAAVPP; AAAAVPPT; AAAVPPTD; AAVPPTDP; AVPPTDPI; VPPTDPIT; PPTDPITV; PTDPITVP; TDPITVPV; DPITVPVA<br><br>9 mers:<br>MPNRRRRKL; PNRRRRKLS; NRRRRKLST; RRRRKLSTA; RRRKLSTAM; RRKLSTAMS; RKLSTAMSA; KLSTAMSAV; LSTAMSAVA; STAMSAVAA; TAMSAVAAL; AMSAVAALA; MSAVAALAV; SAVAALAVA; AVAALAVAS; VAALAVASP; AALAVASPC; ALAVASPCA; LAVASPCAY; AVASPCAYF; VASPCAYFL; ASPCAYFLV; SPCAYFLVY; PCAYFLVYE; CAYFLVYES; AYFLVYEST; YFLVYESTE; FLVYESTET; LVYESTETT; VYESTETTE; YESTETTER; ESTETTERP; STETTERPE; TETTERPEH; ETTERPEHH; TTERPEHHE; TERPEHHEF; ERPEHHEFK; RPEHHEFKQ; PEHHEFKQA; EHHEFKQAA; HHEFKQAAV; HEFKQAAVL; EFKQAAVLT; FKQAAVLTD; KQAAVLTDL; QAAVLTDLP; AAVLTDLPG; AVLTDLPGE; VLTDLPGEL; LTDLPGELM; TDLPGELMS; DLPGELMSA; LPGELMSAL; PGELMSALS; GELMSALSQ; ELMSALSQG; LMSALSQGL; MSALSQGLS; SALSQGLSQ; ALSQGLSQF; LSQGLSQFG; SQGLSQFGI; QGLSQFGIN; GLSQFGINI; LSQFGINIP; SQFGINIPP; QFGINIPPV; FGINIPPVP; GINIPPVPS; INIPPVPSL; NIPPVPSLT; IPPVPSLTG; PPVPSLTGS; PVPSLTGSG; VPSLTGSGD; PSLTGSGDA; SLTGSGDAS; LTGSGDAST; TGSGDASTG; GSGDASTGL; SGDASTGLT; GDASTGLTG; DASTGLTGP; | |

Fig. 28 continued

| | | | |
|---|---|---|---|
| | ASTGLTGPG; STGLTGPGL; TGLTGPGLT; GLTGPGLTS; LTGPGLTSP; TGPGLTSPG; GPGLTSPGL; PGLTSPGLT; GLTSPGLTS; LTSPGLTSP; TSPGLTSPG; SPGLTSPGL; PGLTSPGLT; GLTSPGLTS; LTSPGLTSP; TSPGLTSPG; SPGLTSPGL; PGLTSPGLT; GLTSPGLTD; LTSPGLTDP; TSPGLTDPA; SPGLTDPAL; PGLTDPALT; GLTDPALTS; LTDPALTSP; TDPALTSPG; DPALTSPGL; PALTSPGLT; ALTSPGLTP; LTSPGLTPT; TSPGLTPTL; SPGLTPTLP; PGLTPTLPG; GLTPTLPGS; LTPTLPGSL; TPTLPGSLA; PTLPGSLAA; TLPGSLAAP; LPGSLAAPG; PGSLAAPGT; GSLAAPGTT; SLAAPGTTL; LAAPGTTLA; AAPGTTLAP; APGTTLAPT; PGTTLAPTP; GTTLAPTPG; TTLAPTPGV; TLAPTPGVG; LAPTPGVGA; APTPGVGAN; PTPGVGANP; TPGVGANPA; PGVGANPAL; GVGANPALT; VGANPALTN; GANPALTNP; ANPALTNPA; NPALTNPAL; PALTNPALT; ALTNPALTS; LTNPALTSP; TNPALTSPT; NPALTSPTG; PALTSPTGA; ALTSPTGAT; LTSPTGATP; TSPTGATPG; SPTGATPGL; PTGATPGLT; TGATPGLTS; GATPGLTSP; ATPGLTSPT; TPGLTSPTG; PGLTSPTGL; GLTSPTGLD; LTSPTGLDP; TSPTGLDPA; SPTGLDPAL; PTGLDPALG; TGLDPALGG; GLDPALGGA; LDPALGGAN; DPALGGANE; PALGGANEI; ALGGANEIP; LGGANEIPI; GGANEIPIT; GANEIPITT; ANEIPITTP; NEIPITTPV; EIPITTPVG; IPITTPVGL; PITTPVGLD; ITTPVGLDP; TTPVGLDPG; TPVGLDPGA; PVGLDPGAD; VGLDPGADG; GLDPGADGT; LDPGADGTY; DPGADGTYP; PGADGTYPI; GADGTYPIL; ADGTYPILG; DGTYPILGD; GTYPILGDP; TYPILGDPT; YPILGDPTL; PILGDPTLG; ILGDPTLGT; LGDPTLGTI; GDPTLGTIP; DPTLGTIPS; PTLGTIPSS; TLGTIPSSP; LGTIPSSPA; GTIPSSPAT; TIPSSPATT; IPSSPATTS; PSSPATTST; SSPATTSTG; SPATTSTGG; PATTSTGGG; ATTSTGGGG; TTSTGGGGL; TSTGGGGLV; STGGGGLVN; TGGGGLVND; GGGGLVNDV; GGGLVNDVM; GGLVNDVMQ; GLVNDVMQV; LVNDVMQVA; VNDVMQVAN; NDVMQVANE; DVMQVANEL; VMQVANELG; MQVANELGA; QVANELGAS; VANELGASQ; ANELGASQA; NELGASQAI; ELGASQAID; LGASQAIDL; GASQAIDLL; ASQAIDLLK; SQAIDLLKG; QAIDLLKGV; AIDLLKGVL; IDLLKGVLM; DLLKGVLMP; LLKGVLMPS; LKGVLMPSI; KGVLMPSIM; GVLMPSIMQ; VLMPSIMQA; LMPSIMQAV; MPSIMQAVQ; PSIMQAVQN; SIMQAVQNG; IMQAVQNGG; MQAVQNGGA; QAVQNGGAA; AVQNGGAAA; VQNGGAAAP; QNGGAAAPA; NGGAAAPAA; GGAAAPAAS; GAAAPAASP; AAAPAASPP; AAPAASPPV; APAASPPVP; PAASPPVPP; AASPPVPPI; ASPPVPPIP; SPPVPPIPA; PPVPPIPAA; PVPPIPAAA; VPPIPAAAA; PPIPAAAAV; PIPAAAAVP; IPAAAAVPP; PAAAAVPPT; AAAAVPPTD; AAAVPPTDP; AAVPPTDPI; AVPPTDPIT; VPPTDPITV; PPTDPITVP; PTDPITVPV; TDPITVPVA<br><br>10 mers:<br>MPNRRRRKLS; PNRRRRKLST; NRRRRKLSTA; RRRRKLSTAM; RRRKLSTAMS; RRKLSTAMSA; RKLSTAMSAV; KLSTAMSAVA; LSTAMSAVAA; STAMSAVAAL; TAMSAVAALA; AMSAVAALAV; MSAVAALAVA; SAVAALAVAS; AVAALAVASP; VAALAVASPC; AALAVASPCA; ALAVASPCAY; LAVASPCAYF; AVASPCAYFL; VASPCAYFLV; ASPCAYFLVY; SPCAYFLVYE; PCAYFLVYES; CAYFLVYEST; AYFLVYESTE; YFLVYESTET; FLVYESTETT; LVYESTETTE; VYESTETTER; YESTETTERP; ESTETTERPE; STETTERPEH; TETTERPEHH; ETTERPEHHE; TTERPEHHEF; | |

Fig. 28 continued

| | | |
|---|---|---|
| | TERPEHHEFK; ERPEHHEFKQ; RPEHHEFKQA; PEHHEFKQAA; EHHEFKQAAV; HHEFKQAAVL; HEFKQAAVLT; EFKQAAVLTD; FKQAAVLTDL; KQAAVLTDLP; QAAVLTDLPG; AAVLTDLPGE; AVLTDLPGEL; VLTDLPGELM; LTDLPGELMS; TDLPGELMSA; DLPGELMSAL; LPGELMSALS; PGELMSALSQ; GELMSALSQG; ELMSALSQGL; LMSALSQGLS; MSALSQGLSQ; SALSQGLSQF; ALSQGLSQFG; LSQGLSQFGI; SQGLSQFGIN; QGLSQFGINI; GLSQFGINIP; LSQFGINIPP; SQFGINIPPV; QFGINIPPVP; FGINIPPVPS; GINIPPVPSL; INIPPVPSLT; NIPPVPSLTG; IPPVPSLTGS; PPVPSLTGSG; PVPSLTGSGD; VPSLTGSGDA; PSLTGSGDAS; SLTGSGDAST; LTGSGDASTG; TGSGDASTGL; GSGDASTGLT; SGDASTGLTG; GDASTGLTGP; DASTGLTGPG; ASTGLTGPGL; STGLTGPGLT; TGLTGPGLTS; GLTGPGLTSP; LTGPGLTSPG; TGPGLTSPGL; GPGLTSPGLT; PGLTSPGLTS; GLTSPGLTSP; LTSPGLTSPG; TSPGLTSPGL; SPGLTSPGLT; PGLTSPGLTS; GLTSPGLTSP; LTSPGLTSPG; TSPGLTSPGL; SPGLTSPGLT; PGLTSPGLTD; GLTSPGLTDP; LTSPGLTDPA; TSPGLTDPAL; SPGLTDPALT; PGLTDPALTS; GLTDPALTSP; LTDPALTSPG; TDPALTSPGL; DPALTSPGLT; PALTSPGLTP; ALTSPGLTPT; LTSPGLTPTL; TSPGLTPTLP; SPGLTPTLPG; PGLTPTLPGS; GLTPTLPGSL; LTPTLPGSLA; TPTLPGSLAA; PTLPGSLAAP; TLPGSLAAPG; LPGSLAAPGT; PGSLAAPGTT; GSLAAPGTTL; SLAAPGTTLA; LAAPGTTLAP; AAPGTTLAPT; APGTTLAPTP; PGTTLAPTPG; GTTLAPTPGV; TTLAPTPGVG; TLAPTPGVGA; LAPTPGVGAN; APTPGVGANP; PTPGVGANPA; TPGVGANPAL; PGVGANPALT; GVGANPALTN; VGANPALTNP; GANPALTNPA; ANPALTNPAL; NPALTNPALT; PALTNPALTS; ALTNPALTSP; LTNPALTSPT; TNPALTSPTG; NPALTSPTGA; PALTSPTGAT; ALTSPTGATP; LTSPTGATPG; TSPTGATPGL; SPTGATPGLT; PTGATPGLTS; TGATPGLTSP; GATPGLTSPT; ATPGLTSPTG; TPGLTSPTGL; PGLTSPTGLD; GLTSPTGLDP; LTSPTGLDPA; TSPTGLDPAL; SPTGLDPALG; PTGLDPALGG; TGLDPALGGA; GLDPALGGAN; LDPALGGANE; DPALGGANEI; PALGGANEIP; ALGGANEIPI; LGGANEIPIT; GGANEIPITT; GANEIPITTP; ANEIPITTPV; NEIPITTPVG; EIPITTPVGL; IPITTPVGLD; PITTPVGLDP; ITTPVGLDPG; TTPVGLDPGA; TPVGLDPGAD; PVGLDPGADG; VGLDPGADGT; GLDPGADGTY; LDPGADGTYP; DPGADGTYPI; PGADGTYPIL; GADGTYPILG; ADGTYPILGD; DGTYPILGDP; GTYPILGDPT; TYPILGDPTL; YPILGDPTLG; PILGDPTLGT; ILGDPTLGTI; LGDPTLGTIP; GDPTLGTIPS; DPTLGTIPSS; PTLGTIPSSP; TLGTIPSSPA; LGTIPSSPAT; GTIPSSPATT; TIPSSPATTS; IPSSPATTST; PSSPATTSTG; SSPATTSTGG; SPATTSTGGG; PATTSTGGGG; ATTSTGGGGL; TTSTGGGGLV; TSTGGGGLVN; STGGGGLVND; TGGGGLVNDV; GGGGLVNDVM; GGGLVNDVMQ; GGLVNDVMQV; GLVNDVMQVA; LVNDVMQVAN; VNDVMQVANE; NDVMQVANEL; DVMQVANELG; VMQVANELGA; MQVANELGAS; QVANELGASQ; VANELGASQA; ANELGASQAI; NELGASQAID; ELGASQAIDL; LGASQAIDLL; GASQAIDLLK; ASQAIDLLKG; SQAIDLLKGV; QAIDLLKGVL; AIDLLKGVLM; IDLLKGVLMP; DLLKGVLMPS; LLKGVLMPSI; LKGVLMPSIM; KGVLMPSIMQ; GVLMPSIMQA; VLMPSIMQAV; LMPSIMQAVQ; MPSIMQAVQN; PSIMQAVQNG; SIMQAVQNGG; IMQAVQNGGA; MQAVQNGGAA; QAVQNGGAAA; AVQNGGAAAP; | |

Fig. 28 continued

VQNGGAAAPA; QNGGAAAPAA; NGGAAAPAAS; GGAAAPAASP;
GAAAPAASPP; AAAPAASPPV; AAPAASPPVP; APAASPPVPP;
PAASPPVPPI; AASPPVPPIP; ASPPVPPIPA; SPPVPPIPAA;
PPVPPIPAAA; PVPPIPAAAA; VPPIPAAAAV; PPIPAAAAVP;
PIPAAAAVPP; IPAAAAVPPT; PAAAAVPPTD; AAAAVPPTDP;
AAAVPPTDPI; AAVPPTDPIT; AVPPTDPITV; VPPTDPITVP;
PPTDPITVPV; PTDPITVPVA 11 mers:
MPNRRRRKLST; PNRRRRKLSTA; NRRRRKLSTAM; RRRRKLSTAMS;
RRRKLSTAMSA; RRKLSTAMSAV; RKLSTAMSAVA; KLSTAMSAVAA;
LSTAMSAVAAL; STAMSAVAALA; TAMSAVAALAV; AMSAVAALAVA;
MSAVAALAVAS; SAVAALAVASP; AVAALAVASPC; VAALAVASPCA;
AALAVASPCAY; ALAVASPCAYF; LAVASPCAYFL; AVASPCAYFLV;
VASPCAYFLVY; ASPCAYFLVYE; SPCAYFLVYES; PCAYFLVYEST;
CAYFLVYESTE; AYFLVYESTET; YFLVYESTETT; FLVYESTETTE;
LVYESTETTER; VYESTETTERP; YESTETTERPE; ESTETTERPEH;
STETTERPEHH; TETTERPEHHE; ETTERPEHHEF; TTERPEHHEFK;
TERPEHHEFKQ; ERPEHHEFKQA; RPEHHEFKQAA; PEHHEFKQAAV;
EHHEFKQAAVL; HHEFKQAAVLT; HEFKQAAVLTD; EFKQAAVLTDL;
FKQAAVLTDLP; KQAAVLTDLPG; QAAVLTDLPGE; AAVLTDLPGEL;
AVLTDLPGELM; VLTDLPGELMS; LTDLPGELMSA; TDLPGELMSAL;
DLPGELMSALS; LPGELMSALSQ; PGELMSALSQG; GELMSALSQGL;
ELMSALSQGLS; LMSALSQGLSQ; MSALSQGLSQF; SALSQGLSQFG;
ALSQGLSQFGI; LSQGLSQFGIN; SQGLSQFGINI; QGLSQFGINIP;
GLSQFGINIPP; LSQFGINIPPV; SQFGINIPPVP; QFGINIPPVPS;
FGINIPPVPSL; GINIPPVPSLT; INIPPVPSLTG; NIPPVPSLTGS;
IPPVPSLTGSG; PPVPSLTGSGD; PVPSLTGSGDA; VPSLTGSGDAS;
PSLTGSGDAST; SLTGSGDASTG; LTGSGDASTGL; TGSGDASTGLT;
GSGDASTGLTG; SGDASTGLTGP; GDASTGLTGPG; DASTGLTGPGL;
ASTGLTGPGLT; STGLTGPGLTS; TGLTGPGLTSP; GLTGPGLTSPG;
LTGPGLTSPGL; TGPGLTSPGLT; GPGLTSPGLTS; PGLTSPGLTSP;
GLTSPGLTSPG; LTSPGLTSPGL; TSPGLTSPGLT; SPGLTSPGLTS;
PGLTSPGLTSP; GLTSPGLTSPG; LTSPGLTSPGL; TSPGLTSPGLT;
SPGLTSPGLTD; PGLTSPGLTDP; GLTSPGLTDPA; LTSPGLTDPAL;
TSPGLTDPALT; SPGLTDPALTS; PGLTDPALTSP; GLTDPALTSPG;
LTDPALTSPGL; TDPALTSPGLT; DPALTSPGLTP; PALTSPGLTPT;
ALTSPGLTPTL; LTSPGLTPTLP; TSPGLTPTLPG; SPGLTPTLPGS;
PGLTPTLPGSL; GLTPTLPGSLA; LTPTLPGSLAA; TPTLPGSLAAP;
PTLPGSLAAPG; TLPGSLAAPGT; LPGSLAAPGTT; PGSLAAPGTTL;
GSLAAPGTTLA; SLAAPGTTLAP; LAAPGTTLAPT; AAPGTTLAPTP;
APGTTLAPTPG; PGTTLAPTPGV; GTTLAPTPGVG; TTLAPTPGVGA;
TLAPTPGVGAN; LAPTPGVGANP; APTPGVGANPA; PTPGVGANPAL;
TPGVGANPALT; PGVGANPALTN; GVGANPALTNP; VGANPALTNPA;
GANPALTNPAL; ANPALTNPALT; NPALTNPALTS; PALTNPALTSP;
ALTNPALTSPT; LTNPALTSPTG; TNPALTSPTGA; NPALTSPTGAT;
PALTSPTGATP; ALTSPTGATPG; LTSPTGATPGL; TSPTGATPGLT;
SPTGATPGLTS; PTGATPGLTSP; TGATPGLTSPT; GATPGLTSPTG;
ATPGLTSPTGL; TPGLTSPTGLD; PGLTSPTGLDP; GLTSPTGLDPA;
LTSPTGLDPAL; TSPTGLDPALG; SPTGLDPALGG; PTGLDPALGGA;
TGLDPALGGAN; GLDPALGGANE; LDPALGGANEI; DPALGGANEIP;
PALGGANEIPI; ALGGANEIPIT; LGGANEIPITT; GGANEIPITTP;
GANEIPITTPV; ANEIPITTPVG; NEIPITTPVGL; EIPITTPVGLD;

Fig. 28 continued

| | | |
|---|---|---|
| | IPITTPVGLDP; PITTPVGLDPG; ITTPVGLDPGA; TTPVGLDPGAD; TPVGLDPGADG; PVGLDPGADGT; VGLDPGADGTY; GLDPGADGTYP; LDPGADGTYPI; DPGADGTYPIL; PGADGTYPILG; GADGTYPILGD; ADGTYPILGDP; DGTYPILGDPT; GTYPILGDPTL; TYPILGDPTLG; YPILGDPTLGT; PILGDPTLGTI; ILGDPTLGTIP; LGDPTLGTIPS; GDPTLGTIPSS; DPTLGTIPSSP; PTLGTIPSSPA; TLGTIPSSPAT; LGTIPSSPATT; GTIPSSPATTS; TIPSSPATTST; IPSSPATTSTG; PSSPATTSTGG; SSPATTSTGGG; SPATTSTGGGG; PATTSTGGGGL; ATTSTGGGGLV; TTSTGGGGLVN; TSTGGGGLVND; STGGGGLVNDV; TGGGGLVNDVM; GGGGLVNDVMQ; GGGLVNDVMQV; GGLVNDVMQVA; GLVNDVMQVAN; LVNDVMQVANE; VNDVMQVANEL; NDVMQVANELG; DVMQVANELGA; VMQVANELGAS; MQVANELGASQ; QVANELGASQA; VANELGASQAI; ANELGASQAID; NELGASQAIDL; ELGASQAIDLL; LGASQAIDLLK; GASQAIDLLKG; ASQAIDLLKGV; SQAIDLLKGVL; QAIDLLKGVLM; AIDLLKGVLMP; IDLLKGVLMPS; DLLKGVLMPSI; LLKGVLMPSIM; LKGVLMPSIMQ; KGVLMPSIMQA; GVLMPSIMQAV; VLMPSIMQAVQ; LMPSIMQAVQN; MPSIMQAVQNG; PSIMQAVQNGG; SIMQAVQNGGA; IMQAVQNGGAA; MQAVQNGGAAA; QAVQNGGAAAP; AVQNGGAAAPA; VQNGGAAAPAA; QNGGAAAPAAS; NGGAAAPAASP; GGAAAPAASPP; GAAAPAASPPV; AAAPAASPPVP; AAPAASPPVPP; APAASPPVPPI; PAASPPVPPIP; AASPPVPPIPA; ASPPVPPIPAA; SPPVPPIPAAA; PPVPPIPAAAA; PVPPIPAAAAV; VPPIPAAAAVP; PPIPAAAAVPP; PIPAAAAVPPT; IPAAAAVPPTD; PAAAAVPPTDP; AAAAVPPTDPI; AAAVPPTDPIT; AAVPPTDPITV; AVPPTDPITVP; VPPTDPITVPV; PPTDPITVPVA | |
| 71) Rv3873 | 8 mers:<br>MLWHAMPP; LWHAMPPE; WHAMPPEL; HAMPPELN; AMPPELNT; MPPELNTA; PPELNTAR; PELNTARL; ELNTARLM; LNTARLMA; NTARLMAG; TARLMAGA; ARLMAGAG; RLMAGAGP; LMAGAGPA; MAGAGPAP; AGAGPAPM; GAGPAPML; AGPAPMLA; GPAPMLAA; PAPMLAAA; APMLAAAA; PMLAAAAG; MLAAAAGW; LAAAAGWQ; AAAAGWQT; AAAGWQTL; AAGWQTLS; AGWQTLSA; GWQTLSAA; WQTLSAAL; QTLSAALD; TLSAALDA; LSAALDAQ; SAALDAQA; AALDAQAV; ALDAQAVE; LDAQAVEL; DAQAVELT; AQAVELTA; QAVELTAR; AVELTARL; VELTARLN; ELTARLNS; LTARLNSL; TARLNSLG; ARLNSLGE; RLNSLGEA; LNSLGEAW; NSLGEAWT; SLGEAWTG; LGEAWTGG; GEAWTGGG; EAWTGGGS; AWTGGGSD; WTGGGSDK; TGGGSDKA; GGGSDKAL; GGSDKALA; GSDKALAA; SDKALAAA; DKALAAAT; KALAAATP; ALAAATPM; LAAATPMV; AAATPMVV; AATPMVVW; ATPMVVWL; TPMVVWLQ; PMVVWLQT; MVVWLQTA; VVWLQTAS; VWLQTAST; WLQTASTQ; LQTASTQA; QTASTQAK; TASTQAKT; ASTQAKTR; STQAKTRA; TQAKTRAM; QAKTRAMQ; AKTRAMQA; KTRAMQAT; TRAMQATA; RAMQATAQ; AMQATAQA; MQATAQAA; QATAQAAA; ATAQAAAY; TAQAAAYT; AQAAAYTQ; QAAAYTQA; AAAYTQAM; AAYTQAMA; AYTQAMAT; YTQAMATT; TQAMATTP; QAMATTPS; AMATTPSL; MATTPSLP; ATTPSLPE; TTPSLPEI; TPSLPEIA; PSLPEIAA; SLPEIAAN; LPEIAANH; PEIAANHI; EIAANHIT; IAANHITQ; AANHITQA; ANHITQAV; NHITQAVL; HITQAVLT; ITQAVLTA; TQAVLTAT; QAVLTATN; AVLTATNF; VLTATNFF; LTATNFFG; TATNFFGI; | 49124-50561 |

Fig. 28 continued

| | | | |
|---|---|---|---|
| | ATNFFGIN; TNFFGINT; NFFGINTI; FFGINTIP; FGINTIPI; GINTIPIA; INTIPIAL; NTIPIALT; TIPIALTE; IPIALTEM; PIALTEMD; IALTEMDY; ALTEMDYF; LTEMDYFI; TEMDYFIR; EMDYFIRM; MDYFIRMW; DYFIRMWN; YFIRMWNQ; FIRMWNQA; IRMWNQAA; RMWNQAAL; MWNQAALA; WNQAALAM; NQAALAME; QAALAMEV; AALAMEVY; ALAMEVYQ; LAMEVYQA; AMEVYQAE; MEVYQAET; EVYQAETA; VYQAETAV; YQAETAVN; QAETAVNT; AETAVNTL; ETAVNTLF; TAVNTLFE; AVNTLFEK; VNTLFEKL; NTLFEKLE; TLFEKLEP; LFEKLEPM; FEKLEPMA; EKLEPMAS; KLEPMASI; LEPMASIL; EPMASILD; PMASILDP; MASILDPG; ASILDPGA; SILDPGAS; ILDPGASQ; LDPGASQS; DPGASQST; PGASQSTT; GASQSTTN; ASQSTTNP; SQSTTNPI; QSTTNPIF; STTNPIFG; TTNPIFGM; TNPIFGMP; NPIFGMPS; PIFGMPSP; IFGMPSPG; FGMPSPGS; GMPSPGSS; MPSPGSST; PSPGSSTP; SPGSSTPV; PGSSTPVG; GSSTPVGQ; SSTPVGQL; STPVGQLP; TPVGQLPP; PVGQLPPA; VGQLPPAA; GQLPPAAT; QLPPAATQ; LPPAATQT; PPAATQTL; PAATQTLG; AATQTLGQ; ATQTLGQL; TQTLGQLG; QTLGQLGE; TLGQLGEM; LGQLGEMS; GQLGEMSG; QLGEMSGP; LGEMSGPM; GEMSGPMQ; EMSGPMQQ; MSGPMQQL; SGPMQQLT; GPMQQLTQ; PMQQLTQP; MQQLTQPL; QQLTQPLQ; QLTQPLQQ; LTQPLQQV; TQPLQQVT; QPLQQVTS; PLQQVTSL; LQQVTSLF; QQVTSLFS; QVTSLFSQ; VTSLFSQV; TSLFSQVG; SLFSQVGG; LFSQVGGT; FSQVGGTG; SQVGGTGG; QVGGTGGG; VGGTGGGN; GGTGGGNP; GTGGGNPA; TGGGNPAD; GGGNPADE; GGNPADEE; GNPADEEA; NPADEEAA; PADEEAAQ; ADEEAAQM; DEEAAQMG; EEAAQMGL; EAAQMGLL; AAQMGLLG; AQMGLLGT; QMGLLGTS; MGLLGTSP; GLLGTSPL; LLGTSPLS; LGTSPLSN; GTSPLSNH; TSPLSNHP; SPLSNHPL; PLSNHPLA; LSNHPLAG; SNHPLAGG; NHPLAGGS; HPLAGGSG; PLAGGSGP; LAGGSGPS; AGGSGPSA; GGSGPSAG; GSGPSAGA; SGPSAGAG; GPSAGAGL; PSAGAGLL; SAGAGLLR; AGAGLLRA; GAGLLRAE; AGLLRAES; GLLRAESL; LLRAESLP; LRAESLPG; RAESLPGA; AESLPGAG; ESLPGAGG; SLPGAGGS; LPGAGGSL; PGAGGSLT; GAGGSLTR; AGGSLTRT; GGSLTRTP; GSLTRTPL; SLTRTPLM; LTRTPLMS; TRTPLMSQ; RTPLMSQL; TPLMSQLI; PLMSQLIE; LMSQLIEK; MSQLIEKP; SQLIEKPV; QLIEKPVA; LIEKPVAP; IEKPVAPS; EKPVAPSV; KPVAPSVM; PVAPSVMP; VAPSVMPA; APSVMPAA; PSVMPAAA; SVMPAAAA; VMPAAAAG; MPAAAAGS; PAAAAGSS; AAAAGSSA; AAAGSSAT; AAGSSATG; AGSSATGG; GSSATGGA; SSATGGAA; SATGGAAP; ATGGAAPV; TGGAAPVG; GGAAPVGA; GAAPVGAG; AAPVGAGA; APVGAGAM; PVGAGAMG; VGAGAMGQ; GAGAMGQG; AGAMGQGA; GAMGQGAQ; AMGQGAQS; MGQGAQSG; GQGAQSGG; QGAQSGGS; GAQSGGST; AQSGGSTR; QSGGSTRP; SGGSTRPG; GGSTRPGL; GSTRPGLV; STRPGLVA; TRPGLVAP; RPGLVAPA; PGLVAPAP; GLVAPAPL; LVAPAPLA; VAPAPLAQ; APAPLAQE; PAPLAQER; APLAQERE; PLAQEREE; LAQEREED; AQEREEDD; QEREEDDE; EREEDDED; REEDDEDD; EEDDEDDW; EDDEDDWD; DDEDDWDE; DEDDWDEE; EDDWDEED; DDWDEEDD; DWDEEDDW;<br><br>9 mers:<br>MLWHAMPPE; LWHAMPPEL; WHAMPPELN; HAMPPELNT; AMPPELNTA; MPPELNTAR; PPELNTARL; PELNTARLM; ELNTARLMA; LNTARLMAG; NTARLMAGA; TARLMAGAG; | |

Fig. 28 continued

| | | | |
|---|---|---|---|
| | ARLMAGAGP; RLMAGAGPA; LMAGAGPAP; MAGAGPAPM; AGAGPAPML; GAGPAPMLA; AGPAPMLAA; GPAPMLAAA; PAPMLAAAA; APMLAAAAG; PMLAAAAGW; MLAAAAGWQ; LAAAAGWQT; AAAAGWQTL; AAAGWQTLS; AAGWQTLSA; AGWQTLSAA; GWQTLSAAL; WQTLSAALD; QTLSAALDA; TLSAALDAQ; LSAALDAQA; SAALDAQAV; AALDAQAVE; ALDAQAVEL; LDAQAVELT; DAQAVELTA; AQAVELTAR; QAVELTARL; AVELTARLN; VELTARLNS; ELTARLNSL; LTARLNSLG; TARLNSLGE; ARLNSLGEA; RLNSLGEAW; LNSLGEAWT; NSLGEAWTG; SLGEAWTGG; LGEAWTGGG; GEAWTGGGS; EAWTGGGSD; AWTGGGSDK; WTGGGSDKA; TGGGSDKAL; GGGSDKALA; GGSDKALAA; GSDKALAAA; SDKALAAAT; DKALAAATP; KALAAATPM; ALAAATPMV; LAAATPMVV; AAATPMVVW; AATPMVVWL; ATPMVVWLQ; TPMVVWLQT; PMVVWLQTA; MVVWLQTAS; VVWLQTAST; VWLQTASTQ; WLQTASTQA; LQTASTQAK; QTASTQAKT; TASTQAKTR; ASTQAKTRA; STQAKTRAM; TQAKTRAMQ; QAKTRAMQA; AKTRAMQAT; KTRAMQATA; TRAMQATAQ; RAMQATAQA; AMQATAQAA; MQATAQAAA; QATAQAAAY; ATAQAAAYT; TAQAAAYTQ; AQAAAYTQA; QAAAYTQAM; AAAYTQAMA; AAYTQAMAT; AYTQAMATT; YTQAMATTP; TQAMATTPS; QAMATTPSL; AMATTPSLP; MATTPSLPE; ATTPSLPEI; TTPSLPEIA; TPSLPEIAA; PSLPEIAAN; SLPEIAANH; LPEIAANHI; PEIAANHIT; EIAANHITQ; IAANHITQA; AANHITQAV; ANHITQAVL; NHITQAVLT; HITQAVLTA; ITQAVLTAT; TQAVLTATN; QAVLTATNF; AVLTATNFF; VLTATNFFG; LTATNFFGI; TATNFFGIN; ATNFFGINT; TNFFGINTI; NFFGINTIP; FFGINTIPI; FGINTIPIA; GINTIPIAL; INTIPIALT; NTIPIALTE; TIPIALTEM; IPIALTEMD; PIALTEMDY; IALTEMDYF; ALTEMDYFI; LTEMDYFIR; TEMDYFIRM; EMDYFIRMW; MDYFIRMWN; DYFIRMWNQ; YFIRMWNQA; FIRMWNQAA; IRMWNQAAL; RMWNQAALA; MWNQAALAM; WNQAALAME; NQAALAMEV; QAALAMEVY; AALAMEVYQ; ALAMEVYQA; LAMEVYQAE; AMEVYQAET; MEVYQAETA; EVYQAETAV; VYQAETAVN; YQAETAVNT; QAETAVNTL; AETAVNTLF; ETAVNTLFE; TAVNTLFEK; AVNTLFEKL; VNTLFEKLE; NTLFEKLEP; TLFEKLEPM; LFEKLEPMA; FEKLEPMAS; EKLEPMASI; KLEPMASIL; LEPMASILD; EPMASILDP; PMASILDPG; MASILDPGA; ASILDPGAS; SILDPGASQ; ILDPGASQS; LDPGASQST; DPGASQSTT; PGASQSTTN; GASQSTTNP; ASQSTTNPI; SQSTTNPIF; QSTTNPIFG; STTNPIFGM; TTNPIFGMP; TNPIFGMPS; NPIFGMPSP; PIFGMPSPG; IFGMPSPGS; FGMPSPGSS; GMPSPGSST; MPSPGSSTP; PSPGSSTPV; SPGSSTPVG; PGSSTPVGQ; GSSTPVGQL; SSTPVGQLP; STPVGQLPP; TPVGQLPPA; PVGQLPPAA; VGQLPPAAT; GQLPPAATQ; QLPPAATQT; LPPAATQTL; PPAATQTLG; PAATQTLGQ; AATQTLGQL; ATQTLGQLG; TQTLGQLGE; QTLGQLGEM; TLGQLGEMS; LGQLGEMSG; GQLGEMSGP; QLGEMSGPM; LGEMSGPMQ; GEMSGPMQQ; EMSGPMQQL; MSGPMQQLT; SGPMQQLTQ; GPMQQLTQP; PMQQLTQPL; MQQLTQPLQ; QQLTQPLQQ; QLTQPLQQV; LTQPLQQVT; TQPLQQVTS; QPLQQVTSL; PLQQVTSLF; LQQVTSLFS; QQVTSLFSQ; QVTSLFSQV; VTSLFSQVG; TSLFSQVGG; SLFSQVGGT; LFSQVGGTG; FSQVGGTGG; SQVGGTGGG; QVGGTGGGN; VGGTGGGNP; GGTGGGNPA; GTGGGNPAD; | |

Fig. 28 continued

| | | | |
|---|---|---|---|
| | TGGGNPADE; GGGNPADEE; GGNPADEEA; GNPADEEAA; NPADEEAAQ; PADEEAAQM; ADEEAAQMG; DEEAAQMGL; EEAAQMGLL; EAAQMGLLG; AAQMGLLGT; AQMGLLGTS; QMGLLGTSP; MGLLGTSPL; GLLGTSPLS; LLGTSPLSN; LGTSPLSNH; GTSPLSNHP; TSPLSNHPL; SPLSNHPLA; PLSNHPLAG; LSNHPLAGG; SNHPLAGGS; NHPLAGGSG; HPLAGGSGP; PLAGGSGPS; LAGGSGPSA; AGGSGPSAG; GGSGPSAGA; GSGPSAGAG; SGPSAGAGL; GPSAGAGLL; PSAGAGLLR; SAGAGLLRA; AGAGLLRAE; GAGLLRAES; AGLLRAESL; GLLRAESLP; LLRAESLPG; LRAESLPGA; RAESLPGAG; AESLPGAGG; ESLPGAGGS; SLPGAGGSL; LPGAGGSLT; PGAGGSLTR; GAGGSLTRT; AGGSLTRTP; GGSLTRTPL; GSLTRTPLM; SLTRTPLMS; LTRTPLMSQ; TRTPLMSQL; RTPLMSQLI; TPLMSQLIE; PLMSQLIEK; LMSQLIEKP; MSQLIEKPV; SQLIEKPVA; QLIEKPVAP; LIEKPVAPS; IEKPVAPSV; EKPVAPSVM; KPVAPSVMP; PVAPSVMPA; VAPSVMPAA; APSVMPAAA; PSVMPAAAA; SVMPAAAAG; VMPAAAAGS; MPAAAAGSS; PAAAAGSSA; AAAAGSSAT; AAAGSSATG; AAGSSATGG; AGSSATGGA; GSSATGGAA; SSATGGAAP; SATGGAAPV; ATGGAAPVG; TGGAAPVGA; GGAAPVGAG; GAAPVGAGA; AAPVGAGAM; APVGAGAMG; PVGAGAMGQ; VGAGAMGQG; GAGAMGQGA; AGAMGQGAQ; GAMGQGAQS; AMGQGAQSG; MGQGAQSGG; GQGAQSGGS; QGAQSGGST; GAQSGGSTR; AQSGGSTRP; QSGGSTRPG; SGGSTRPGL; GGSTRPGLV; GSTRPGLVA; STRPGLVAP; TRPGLVAPA; RPGLVAPAP; PGLVAPAPL; GLVAPAPLA; LVAPAPLAQ; VAPAPLAQE; APAPLAQER; PAPLAQERE; APLAQEREE; PLAQEREED; LAQEREEDD; AQEREEDDE; QEREEDDED; EREEDDEDD; REEDDEDDW; EEDDEDDWD; EDDEDDWDE; DDEDDWDEE; DEDDWDEED; EDDWDEEDD; DDWDEEDDW;<br><br>10 mers:<br>MLWHAMPPEL; LWHAMPPELN; WHAMPPELNT; HAMPPELNTA; AMPPELNTAR; MPPELNTARL; PPELNTARLM; PELNTARLMA; ELNTARLMAG; LNTARLMAGA; NTARLMAGAG; TARLMAGAGP; ARLMAGAGPA; RLMAGAGPAP; LMAGAGPAPM; MAGAGPAPML; AGAGPAPMLA; GAGPAPMLAA; AGPAPMLAAA; GPAPMLAAAA; PAPMLAAAAG; APMLAAAAGW; PMLAAAAGWQ; MLAAAAGWQT; LAAAAGWQTL; AAAAGWQTLS; AAAGWQTLSA; AAGWQTLSAA; AGWQTLSAAL; GWQTLSAALD; WQTLSAALDA; QTLSAALDAQ; TLSAALDAQA; LSAALDAQAV; SAALDAQAVE; AALDAQAVEL; ALDAQAVELT; LDAQAVELTA; DAQAVELTAR; AQAVELTARL; QAVELTARLN; AVELTARLNS; VELTARLNSL; ELTARLNSLG; LTARLNSLGE; TARLNSLGEA; ARLNSLGEAW; RLNSLGEAWT; LNSLGEAWTG; NSLGEAWTGG; SLGEAWTGGG; LGEAWTGGGS; GEAWTGGGSD; EAWTGGGSDK; AWTGGGSDKA; WTGGGSDKAL; TGGGSDKALA; GGGSDKALAA; GGSDKALAAA; GSDKALAAAT; SDKALAAATP; DKALAAATPM; KALAAATPMV; ALAAATPMVV; LAAATPMVVW; AAATPMVVWL; AATPMVVWLQ; ATPMVVWLQT; TPMVVWLQTA; PMVVWLQTAS; MVVWLQTAST; VVWLQTASTQ; VWLQTASTQA; WLQTASTQAK; LQTASTQAKT; QTASTQAKTR; TASTQAKTRA; ASTQAKTRAM; STQAKTRAMQ; TQAKTRAMQA; QAKTRAMQAT; AKTRAMQATA; KTRAMQATAQ; TRAMQATAQA; | |

Fig. 28 continued

| | | | |
|---|---|---|---|
| | RAMQATAQAA; AMQATAQAAA; MQATAQAAAY; QATAQAAAYT; ATAQAAAYTQ; TAQAAAYTQA; AQAAAYTQAM; QAAAYTQAMA; AAAYTQAMAT; AAYTQAMATT; AYTQAMATTP; YTQAMATTPS; TQAMATTPSL; QAMATTPSLP; AMATTPSLPE; MATTPSLPEI; ATTPSLPEIA; TTPSLPEIAA; TPSLPEIAAN; PSLPEIAANH; SLPEIAANHI; LPEIAANHIT; PEIAANHITQ; EIAANHITQA; IAANHITQAV; AANHITQAVL; ANHITQAVLT; NHITQAVLTA; HITQAVLTAT; ITQAVLTATN; TQAVLTATNF; QAVLTATNFF; AVLTATNFFG; VLTATNFFGI; LTATNFFGIN; TATNFFGINT; ATNFFGINTI; TNFFGINTIP; NFFGINTIPI; FFGINTIPIA; FGINTIPIAL; GINTIPIALT; INTIPIALTE; NTIPIALTEM; TIPIALTEMD; IPIALTEMDY; PIALTEMDYF; IALTEMDYFI; ALTEMDYFIR; LTEMDYFIRM; TEMDYFIRMW; EMDYFIRMWN; MDYFIRMWNQ; DYFIRMWNQA; YFIRMWNQAA; FIRMWNQAAL; IRMWNQAALA; RMWNQAALAM; MWNQAALAME; WNQAALAMEV; NQAALAMEVY; QAALAMEVYQ; AALAMEVYQA; ALAMEVYQAE; LAMEVYQAET; AMEVYQAETA; MEVYQAETAV; EVYQAETAVN; VYQAETAVNT; YQAETAVNTL; QAETAVNTLF; AETAVNTLFE; ETAVNTLFEK; TAVNTLFEKL; AVNTLFEKLE; VNTLFEKLEP; NTLFEKLEPM; TLFEKLEPMA; LFEKLEPMAS; FEKLEPMASI; EKLEPMASIL; KLEPMASILD; LEPMASILDP; EPMASILDPG; PMASILDPGA; MASILDPGAS; ASILDPGASQ; SILDPGASQS; ILDPGASQST; LDPGASQSTT; DPGASQSTTN; PGASQSTTNP; GASQSTTNPI; ASQSTTNPIF; SQSTTNPIFG; QSTTNPIFGM; STTNPIFGMP; TTNPIFGMPS; TNPIFGMPSP; NPIFGMPSPG; PIFGMPSPGS; IFGMPSPGSS; FGMPSPGSST; GMPSPGSSTP; MPSPGSSTPV; PSPGSSTPVG; SPGSSTPVGQ; PGSSTPVGQL; GSSTPVGQLP; SSTPVGQLPP; STPVGQLPPA; TPVGQLPPAA; PVGQLPPAAT; VGQLPPAATQ; GQLPPAATQT; QLPPAATQTL; LPPAATQTLG; PPAATQTLGQ; PAATQTLGQL; AATQTLGQLG; ATQTLGQLGE; TQTLGQLGEM; QTLGQLGEMS; TLGQLGEMSG; LGQLGEMSGP; GQLGEMSGPM; QLGEMSGPMQ; LGEMSGPMQQ; GEMSGPMQQL; EMSGPMQQLT; MSGPMQQLTQ; SGPMQQLTQP; GPMQQLTQPL; PMQQLTQPLQ; MQQLTQPLQQ; QQLTQPLQQV; QLTQPLQQVT; LTQPLQQVTS; TQPLQQVTSL; QPLQQVTSLF; PLQQVTSLFS; LQQVTSLFSQ; QQVTSLFSQV; QVTSLFSQVG; VTSLFSQVGG; TSLFSQVGGT; SLFSQVGGTG; LFSQVGGTGG; FSQVGGTGGG; SQVGGTGGGN; QVGGTGGGNP; VGGTGGGNPA; GGTGGGNPAD; GTGGGNPADE; TGGGNPADEE; GGGNPADEEA; GGNPADEEAA; GNPADEEAAQ; NPADEEAAQM; PADEEAAQMG; ADEEAAQMGL; DEEAAQMGLL; EEAAQMGLLG; EAAQMGLLGT; AAQMGLLGTS; AQMGLLGTSP; QMGLLGTSPL; MGLLGTSPLS; GLLGTSPLSN; LLGTSPLSNH; LGTSPLSNHP; GTSPLSNHPL; TSPLSNHPLA; SPLSNHPLAG; PLSNHPLAGG; LSNHPLAGGS; SNHPLAGGSG; NHPLAGGSGP; HPLAGGSGPS; PLAGGSGPSA; LAGGSGPSAG; AGGSGPSAGA; GGSGPSAGAG; GSGPSAGAGL; SGPSAGAGLL; GPSAGAGLLR; PSAGAGLLRA; SAGAGLLRAE; AGAGLLRAES; GAGLLRAESL; AGLLRAESLP; GLLRAESLPG; LLRAESLPGA; LRAESLPGAG; RAESLPGAGG; AESLPGAGGS; ESLPGAGGSL; SLPGAGGSLT; LPGAGGSLTR; PGAGGSLTRT; GAGGSLTRTP; AGGSLTRTPL; GGSLTRTPLM; GSLTRTPLMS; SLTRTPLMSQ; LTRTPLMSQL; TRTPLMSQLI; RTPLMSQLIE; TPLMSQLIEK; PLMSQLIEKP; LMSQLIEKPV; MSQLIEKPVA; SQLIEKPVAP; QLIEKPVAPS; | |

Fig. 28 continued

| | | | |
|---|---|---|---|
| | LIEKPVAPSV; IEKPVAPSVM; EKPVAPSVMP; KPVAPSVMPA; PVAPSVMPAA; VAPSVMPAAA; APSVMPAAAA; PSVMPAAAAG; SVMPAAAAGS; VMPAAAAGSS; MPAAAAGSSA; PAAAAGSSAT; AAAAGSSATG; AAAGSSATGG; AAGSSATGGA; AGSSATGGAA; GSSATGGAAP; SSATGGAAPV; SATGGAAPVG; ATGGAAPVGA; TGGAAPVGAG; GGAAPVGAGA; GAAPVGAGAM; AAPVGAGAMG; APVGAGAMGQ; PVGAGAMGQG; VGAGAMGQGA; GAGAMGQGAQ; AGAMGQGAQS; GAMGQGAQSG; AMGQGAQSGG; MGQGAQSGGS; GQGAQSGGST; QGAQSGGSTR; GAQSGGSTRP; AQSGGSTRPG; QSGGSTRPGL; SGGSTRPGLV; GGSTRPGLVA; GSTRPGLVAP; STRPGLVAPA; TRPGLVAPAP; RPGLVAPAPL; PGLVAPAPLA; GLVAPAPLAQ; LVAPAPLAQE; VAPAPLAQER; APAPLAQERE; PAPLAQEREE; APLAQEREED; PLAQEREEDD; LAQEREEDDE; AQEREEDDED; QEREEDDEDD; EREEDDEDDW; REEDDEDDWD; EEDDEDDWDE; EDDEDDWDEE; DDEDDWDEED; DEDDWDEEDD; EDDWDEEDDW;<br><br>11 mers:<br>MLWHAMPPELN; LWHAMPPELNT; WHAMPPELNTA; HAMPPELNTAR; AMPPELNTARL; MPPELNTARLM; PPELNTARLMA; PELNTARLMAG; ELNTARLMAGA; LNTARLMAGAG; NTARLMAGAGP; TARLMAGAGPA; ARLMAGAGPAP; RLMAGAGPAPM; LMAGAGPAPML; MAGAGPAPMLA; AGAGPAPMLAA; GAGPAPMLAAA; AGPAPMLAAAA; GPAPMLAAAAG; PAPMLAAAAGW; APMLAAAAGWQ; PMLAAAAGWQT; MLAAAAGWQTL; LAAAAGWQTLS; AAAAGWQTLSA; AAAGWQTLSAA; AAGWQTLSAAL; AGWQTLSAALD; GWQTLSAALDA; WQTLSAALDAQ; QTLSAALDAQA; TLSAALDAQAV; LSAALDAQAVE; SAALDAQAVEL; AALDAQAVELT; ALDAQAVELTA; LDAQAVELTAR; DAQAVELTARL; AQAVELTARLN; QAVELTARLNS; AVELTARLNSL; VELTARLNSLG; ELTARLNSLGE; LTARLNSLGEA; TARLNSLGEAW; ARLNSLGEAWT; RLNSLGEAWTG; LNSLGEAWTGG; NSLGEAWTGGG; SLGEAWTGGGS; LGEAWTGGGSD; GEAWTGGGSDK; EAWTGGGSDKA; AWTGGGSDKAL; WTGGGSDKALA; TGGGSDKALAA; GGGSDKALAAA; GGSDKALAAAT; GSDKALAAATP; SDKALAAATPM; DKALAAATPMV; KALAAATPMVV; ALAAATPMVVW; LAAATPMVVWL; AAATPMVVWLQ; AATPMVVWLQT; ATPMVVWLQTA; TPMVVWLQTAS; PMVVWLQTAST; MVVWLQTASTQ; VVWLQTASTQA; VWLQTASTQAK; WLQTASTQAKT; LQTASTQAKTR; QTASTQAKTRA; TASTQAKTRAM; ASTQAKTRAMQ; STQAKTRAMQA; TQAKTRAMQAT; QAKTRAMQATA; AKTRAMQATAQ; KTRAMQATAQA; TRAMQATAQAA; RAMQATAQAAA; AMQATAQAAAY; MQATAQAAAYT; QATAQAAAYTQ; ATAQAAAYTQA; TAQAAAYTQAM; AQAAAYTQAMA; QAAAYTQAMAT; AAAYTQAMATT; AAYTQAMATTP; AYTQAMATTPS; YTQAMATTPSL; TQAMATTPSLP; QAMATTPSLPE; AMATTPSLPEI; MATTPSLPEIA; ATTPSLPEIAA; TTPSLPEIAAN; TPSLPEIAANH; PSLPEIAANHI; SLPEIAANHIT; LPEIAANHITQ; PEIAANHITQA; EIAANHITQAV; IAANHITQAVL; AANHITQAVLT; ANHITQAVLTA; NHITQAVLTAT; HITQAVLTATN; ITQAVLTATNF; TQAVLTATNFF; QAVLTATNFFG; AVLTATNFFGI; VLTATNFFGIN; LTATNFFGINT; TATNFFGINTI; ATNFFGINTIP; TNFFGINTIPI; | |

Fig. 28 continued

| | | | |
|---|---|---|---|
| | NFFGINTIPIA; FFGINTIPIAL; FGINTIPIALT; GINTIPIALTE; INTIPIALTEM; NTIPIALTEMD; TIPIALTEMDY; IPIALTEMDYF; PIALTEMDYFI; IALTEMDYFIR; ALTEMDYFIRM; LTEMDYFIRMW; TEMDYFIRMWN; EMDYFIRMWNQ; MDYFIRMWNQA; DYFIRMWNQAA; YFIRMWNQAAL; FIRMWNQAALA; IRMWNQAALAM; RMWNQAALAME; MWNQAALAMEV; WNQAALAMEVY; NQAALAMEVYQ; QAALAMEVYQA; AALAMEVYQAE; ALAMEVYQAET; LAMEVYQAETA; AMEVYQAETAV; MEVYQAETAVN; EVYQAETAVNT; VYQAETAVNTL; YQAETAVNTLF; QAETAVNTLFE; AETAVNTLFEK; ETAVNTLFEKL; TAVNTLFEKLE; AVNTLFEKLEP; VNTLFEKLEPM; NTLFEKLEPMA; TLFEKLEPMAS; LFEKLEPMASI; FEKLEPMASIL; EKLEPMASILD; KLEPMASILDP; LEPMASILDPG; EPMASILDPGA; PMASILDPGAS; MASILDPGASQ; ASILDPGASQS; SILDPGASQST; ILDPGASQSTT; LDPGASQSTTN; DPGASQSTTNP; PGASQSTTNPI; GASQSTTNPIF; ASQSTTNPIFG; SQSTTNPIFGM; QSTTNPIFGMP; STTNPIFGMPS; TTNPIFGMPSP; TNPIFGMPSPG; NPIFGMPSPGS; PIFGMPSPGSS; IFGMPSPGSST; FGMPSPGSSTP; GMPSPGSSTPV; MPSPGSSTPVG; PSPGSSTPVGQ; SPGSSTPVGQL; PGSSTPVGQLP; GSSTPVGQLPP; SSTPVGQLPPA; STPVGQLPPAA; TPVGQLPPAAT; PVGQLPPAATQ; VGQLPPAATQT; GQLPPAATQTL; QLPPAATQTLG; LPPAATQTLGQ; PPAATQTLGQL; PAATQTLGQLG; AATQTLGQLGE; ATQTLGQLGEM; TQTLGQLGEMS; QTLGQLGEMSG; TLGQLGEMSGP; LGQLGEMSGPM; GQLGEMSGPMQ; QLGEMSGPMQQ; LGEMSGPMQQL; GEMSGPMQQLT; EMSGPMQQLTQ; MSGPMQQLTQP; SGPMQQLTQPL; GPMQQLTQPLQ; PMQQLTQPLQQ; MQQLTQPLQQV; QQLTQPLQQVT; QLTQPLQQVTS; LTQPLQQVTSL; TQPLQQVTSLF; QPLQQVTSLFS; PLQQVTSLFSQ; LQQVTSLFSQV; QQVTSLFSQVG; QVTSLFSQVGG; VTSLFSQVGGT; TSLFSQVGGTG; SLFSQVGGTGG; LFSQVGGTGGG; FSQVGGTGGGN; SQVGGTGGGNP; QVGGTGGGNPA; VGGTGGGNPAD; GGTGGGNPADE; GTGGGNPADEE; TGGGNPADEEA; GGGNPADEEAA; GGNPADEEAAQ; GNPADEEAAQM; NPADEEAAQMG; PADEEAAQMGL; ADEEAAQMGLL; DEEAAQMGLLG; EEAAQMGLLGT; EAAQMGLLGTS; AAQMGLLGTSP; AQMGLLGTSPL; QMGLLGTSPLS; MGLLGTSPLSN; GLLGTSPLSNH; LLGTSPLSNHP; LGTSPLSNHPL; GTSPLSNHPLA; TSPLSNHPLAG; SPLSNHPLAGG; PLSNHPLAGGS; LSNHPLAGGSG; SNHPLAGGSGP; NHPLAGGSGPS; HPLAGGSGPSA; PLAGGSGPSAG; LAGGSGPSAGA; AGGSGPSAGAG; GGSGPSAGAGL; GSGPSAGAGLL; SGPSAGAGLLR; GPSAGAGLLRA; PSAGAGLLRAE; SAGAGLLRAES; AGAGLLRAESL; GAGLLRAESLP; AGLLRAESLPG; GLLRAESLPGA; LLRAESLPGAG; LRAESLPGAGG; RAESLPGAGGS; AESLPGAGGSL; ESLPGAGGSLT; SLPGAGGSLTR; LPGAGGSLTRT; PGAGGSLTRTP; GAGGSLTRTPL; AGGSLTRTPLM; GGSLTRTPLMS; GSLTRTPLMSQ; SLTRTPLMSQL; LTRTPLMSQLI; TRTPLMSQLIE; RTPLMSQLIEK; TPLMSQLIEKP; PLMSQLIEKPV; LMSQLIEKPVA; MSQLIEKPVAP; SQLIEKPVAPS; QLIEKPVAPSV; LIEKPVAPSVM; IEKPVAPSVMP; EKPVAPSVMPA; KPVAPSVMPAA; PVAPSVMPAAA; VAPSVMPAAAA; APSVMPAAAAG; PSVMPAAAAGS; SVMPAAAAGSS; VMPAAAAGSSA; MPAAAAGSSAT; PAAAAGSSATG; AAAAGSSATGG; AAAGSSATGGA; AAGSSATGGAA; AGSSATGGAAP; | |

Fig. 28 continued

| | | |
|---|---|---|
| | GSSATGGAAPV; SSATGGAAPVG; SATGGAAPVGA; ATGGAAPVGAG; TGGAAPVGAGA; GGAAPVGAGAM; GAAPVGAGAMG; AAPVGAGAMGQ; APVGAGAMGQG; PVGAGAMGQGA; VGAGAMGQGAQ; GAGAMGQGAQS; AGAMGQGAQSG; GAMGQGAQSGG; AMGQGAQSGGS; MGQGAQSGGST; GQGAQSGGSTR; QGAQSGGSTRP; GAQSGGSTRPG; AQSGGSTRPGL; QSGGSTRPGLV; SGGSTRPGLVA; GGSTRPGLVAP; GSTRPGLVAPA; STRPGLVAPAP; TRPGLVAPAPL; RPGLVAPAPLA; PGLVAPAPLAQ; GLVAPAPLAQE; LVAPAPLAQER; VAPAPLAQERE; APAPLAQEREE; PAPLAQEREED; APLAQEREEDD; PLAQEREEDDE; LAQEREEDDED; AQEREEDDEDD; QEREEDDEDDW; EREEDDEDDWD; REEDDEDDWDE; EEDDEDDWDEE; EDDEDDWDEED; DDEDDWDEEDD; DEDDWDEEDDW; | |
| 72) Rv3874/CFP10 | 8 mers:<br>MAEMKTDA; AEMKTDAA; EMKTDAAT; MKTDAATL; KTDAATLA; TDAATLAQ; DAATLAQE; AATLAQEA; ATLAQEAG; TLAQEAGN; LAQEAGNF; AQEAGNFE; QEAGNFER; EAGNFERI; AGNFERIS; GNFERISG; NFERISGD; FERISGDL; ERISGDLK; RISGDLKT; ISGDLKTQ; SGDLKTQI; GDLKTQID; DLKTQIDQ; LKTQIDQV; KTQIDQVE; TQIDQVES; QIDQVEST; IDQVESTA; DQVESTAG; QVESTAGS; VESTAGSL; ESTAGSLQ; STAGSLQG; TAGSLQGQ; AGSLQGQW; GSLQGQWR; SLQGQWRG; LQGQWRGA; QGQWRGAA; GQWRGAAG; QWRGAAGT; WRGAAGTA; RGAAGTAA; GAAGTAAQ; AAGTAAQA; AGTAAQAA; GTAAQAAV; TAAQAAVV; AAQAAVVR; AQAAVVRF; QAAVVRFQ; AAVVRFQE; AVVRFQEA; VVRFQEAA; VRFQEAAN; RFQEAANK; FQEAANKQ; QEAANKQK; EAANKQKQ; AANKQKQE; ANKQKQEL; NKQKQELD; KQKQELDE; QKQELDEI; KQELDEIS; QELDEIST; ELDEISTN; LDEISTNI; DEISTNIR; EISTNIRQ; ISTNIRQA; STNIRQAG; TNIRQAGV; NIRQAGVQ; IRQAGVQY; RQAGVQYS; QAGVQYSR; AGVQYSRA; GVQYSRAD; VQYSRADE; QYSRADEE; YSRADEEQ; SRADEEQQ; RADEEQQQ; ADEEQQQA; DEEQQQAL; EEQQQALS; EQQQALSS; QQQALSSQ; QQALSSQM; QALSSQMG; ALSSQMGF;<br><br>9 mers:<br>MAEMKTDAA; AEMKTDAAT; EMKTDAATL; MKTDAATLA; KTDAATLAQ; TDAATLAQE; DAATLAQEA; AATLAQEAG; ATLAQEAGN; TLAQEAGNF; LAQEAGNFE; AQEAGNFER; QEAGNFERI; EAGNFERIS; AGNFERISG; GNFERISGD; NFERISGDL; FERISGDLK; ERISGDLKT; RISGDLKTQ; ISGDLKTQI; SGDLKTQID; GDLKTQIDQ; DLKTQIDQV; LKTQIDQVE; KTQIDQVES; TQIDQVEST; QIDQVESTA; IDQVESTAG; DQVESTAGS; QVESTAGSL; VESTAGSLQ; ESTAGSLQG; STAGSLQGQ; TAGSLQGQW; AGSLQGQWR; GSLQGQWRG; SLQGQWRGA; LQGQWRGAA; QGQWRGAAG; GQWRGAAGT; QWRGAAGTA; WRGAAGTAA; RGAAGTAAQ; GAAGTAAQA; AAGTAAQAA; AGTAAQAAV; GTAAQAAVV; TAAQAAVVR; AAQAAVVRF; AQAAVVRFQ; QAAVVRFQE; AAVVRFQEA; AVVRFQEAA; VVRFQEAAN; VRFQEAANK; RFQEAANKQ; FQEAANKQK; QEAANKQKQ; EAANKQKQE; AANKQKQEL; ANKQKQELD; NKQKQELDE; KQKQELDEI; QKQELDEIS; KQELDEIST; QELDEISTN; ELDEISTNI; LDEISTNIR; DEISTNIRQ; EISTNIRQA; ISTNIRQAG; STNIRQAGV; | 50562-50927 |

Fig. 28 continued

| | | | |
|---|---|---|---|
| | TNIRQAGVQ; NIRQAGVQY; IRQAGVQYS; RQAGVQYSR; QAGVQYSRA; AGVQYSRAD; GVQYSRADE; VQYSRADEE; QYSRADEEQ; YSRADEEQQ; SRADEEQQQ; RADEEQQQA; ADEEQQQAL; DEEQQQALS; EEQQQALSS; EQQQALSSQ; QQQALSSQM; QQALSSQMG; QALSSQMGF;<br><br>10 mers:<br>MAEMKTDAAT; AEMKTDAATL; EMKTDAATLA; MKTDAATLAQ; KTDAATLAQE; TDAATLAQEA; DAATLAQEAG; AATLAQEAGN; ATLAQEAGNF; TLAQEAGNFE; LAQEAGNFER; AQEAGNFERI; QEAGNFERIS; EAGNFERISG; AGNFERISGD; GNFERISGDL; NFERISGDLK; FERISGDLKT; ERISGDLKTQ; RISGDLKTQI; ISGDLKTQID; SGDLKTQIDQ; GDLKTQIDQV; DLKTQIDQVE; LKTQIDQVES; KTQIDQVEST; TQIDQVESTA; QIDQVESTAG; IDQVESTAGS; DQVESTAGSL; QVESTAGSLQ; VESTAGSLQG; ESTAGSLQGQ; STAGSLQGQW; TAGSLQGQWR; AGSLQGQWRG; GSLQGQWRGA; SLQGQWRGAA; LQGQWRGAAG; QGQWRGAAGT; GQWRGAAGTA; QWRGAAGTAA; WRGAAGTAAQ; RGAAGTAAQA; GAAGTAAQAA; AAGTAAQAAV; AGTAAQAAVV; GTAAQAAVVR; TAAQAAVVRF; AAQAAVVRFQ; AQAAVVRFQE; QAAVVRFQEA; AAVVRFQEAA; AVVRFQEAAN; VVRFQEAANK; VRFQEAANKQ; RFQEAANKQK; FQEAANKQKQ; QEAANKQKQE; EAANKQKQEL; AANKQKQELD; ANKQKQELDE; NKQKQELDEI; KQKQELDEIS; QKQELDEIST; KQELDEISTN; QELDEISTNI; ELDEISTNIR; LDEISTNIRQ; DEISTNIRQA; EISTNIRQAG; ISTNIRQAGV; STNIRQAGVQ; TNIRQAGVQY; NIRQAGVQYS; IRQAGVQYSR; RQAGVQYSRA; QAGVQYSRAD; AGVQYSRADE; GVQYSRADEE; VQYSRADEEQ; QYSRADEEQQ; YSRADEEQQQ; SRADEEQQQA; RADEEQQQAL; ADEEQQQALS; DEEQQQALSS; EEQQQALSSQ; EQQQALSSQM; QQQALSSQMG; QQALSSQMGF;<br><br>11 mers:<br>MAEMKTDAATL; AEMKTDAATLA; EMKTDAATLAQ; MKTDAATLAQE; KTDAATLAQEA; TDAATLAQEAG; DAATLAQEAGN; AATLAQEAGNF; ATLAQEAGNFE; TLAQEAGNFER; LAQEAGNFERI; AQEAGNFERIS; QEAGNFERISG; EAGNFERISGD; AGNFERISGDL; GNFERISGDLK; NFERISGDLKT; FERISGDLKTQ; ERISGDLKTQI; RISGDLKTQID; ISGDLKTQIDQ; SGDLKTQIDQV; GDLKTQIDQVE; DLKTQIDQVES; LKTQIDQVEST; KTQIDQVESTA; TQIDQVESTAG; QIDQVESTAGS; IDQVESTAGSL; DQVESTAGSLQ; QVESTAGSLQG; VESTAGSLQGQ; ESTAGSLQGQW; STAGSLQGQWR; TAGSLQGQWRG; AGSLQGQWRGA; GSLQGQWRGAA; SLQGQWRGAAG; LQGQWRGAAGT; QGQWRGAAGTA; GQWRGAAGTAA; QWRGAAGTAAQ; WRGAAGTAAQA; RGAAGTAAQAA; GAAGTAAQAAV; AAGTAAQAAVV; AGTAAQAAVVR; GTAAQAAVVRF; TAAQAAVVRFQ; AAQAAVVRFQE; AQAAVVRFQEA; QAAVVRFQEAA; AAVVRFQEAAN; AVVRFQEAANK; VVRFQEAANKQ; VRFQEAANKQK; RFQEAANKQKQ; FQEAANKQKQE; QEAANKQKQEL; EAANKQKQELD; AANKQKQELDE; ANKQKQELDEI; NKQKQELDEIS; KQKQELDEIST; QKQELDEISTN; KQELDEISTNI; QELDEISTNIR; ELDEISTNIRQ; LDEISTNIRQA; DEISTNIRQAG; EISTNIRQAGV; ISTNIRQAGVQ; STNIRQAGVQY; TNIRQAGVQYS; NIRQAGVQYSR; IRQAGVQYSRA; RQAGVQYSRAD; QAGVQYSRADE; | |

Fig. 28 continued

| | | |
|---|---|---|
| | AGVQYSRADEE; GVQYSRADEEQ; VQYSRADEEQQ; QYSRADEEQQQ; YSRADEEQQQA; SRADEEQQQAL; RADEEQQQALS; ADEEQQQALSS; DEEQQQALSSQ; EEQQQALSSQM; EQQQALSSQMG; QQQALSSQMGF; | |
| 73) Rv3875/ESAT-6 | 8 mers:<br>MTEQQWNF; TEQQWNFA; EQQWNFAG; QQWNFAGI; QWNFAGIE; WNFAGIEA; NFAGIEAA; FAGIEAAA; AGIEAAAS; GIEAAASA; IEAAASAI; EAAASAIQ; AAASAIQG; AASAIQGN; ASAIQGNV; SAIQGNVT; AIQGNVTS; IQGNVTSI; QGNVTSIH; GNVTSIHS; NVTSIHSL; VTSIHSLL; TSIHSLLD; SIHSLLDE; IHSLLDEG; HSLLDEGK; SLLDEGKQ; LLDEGKQS; LDEGKQSL; DEGKQSLT; EGKQSLTK; GKQSLTKL; KQSLTKLA; QSLTKLAA; SLTKLAAA; LTKLAAAW; TKLAAAWG; KLAAAWGG; LAAAWGGS; AAAWGGSG; AAWGGSGS; AWGGSGSE; WGGSGSEA; GGSGSEAY; GSGSEAYQ; SGSEAYQG; GSEAYQGV; SEAYQGVQ; EAYQGVQQ; AYQGVQQK; YQGVQQKW; QGVQQKWD; GVQQKWDA; VQQKWDAT; QQKWDATA; QKWDATAT; KWDATATE; WDATATEL; DATATELN; ATATELNN; TATELNNA; ATELNNAL; TELNNALQ; ELNNALQN; LNNALQNL; NNALQNLA; NALQNLAR; ALQNLART; LQNLARTI; QNLARTIS; NLARTISE; LARTISEA; ARTISEAG; RTISEAGQ; TISEAGQA; ISEAGQAM; SEAGQAMA; EAGQAMAS; AGQAMAST; GQAMASTE; QAMASTEG; AMASTEGN; MASTEGNV; ASTEGNVT; STEGNVTG; TEGNVTGM; EGNVTGMF; GNVTGMFA;<br><br>9 mers:<br>MTEQQWNFA; TEQQWNFAG; EQQWNFAGI; QQWNFAGIE; QWNFAGIEA; WNFAGIEAA; NFAGIEAAA; FAGIEAAAS; AGIEAAASA; GIEAAASAI; IEAAASAIQ; EAAASAIQG; AAASAIQGN; AASAIQGNV; ASAIQGNVT; SAIQGNVTS; AIQGNVTSI; IQGNVTSIH; QGNVTSIHS; GNVTSIHSL; NVTSIHSLL; VTSIHSLLD; TSIHSLLDE; SIHSLLDEG; IHSLLDEGK; HSLLDEGKQ; SLLDEGKQS; LLDEGKQSL; LDEGKQSLT; DEGKQSLTK; EGKQSLTKL; GKQSLTKLA; KQSLTKLAA; QSLTKLAAA; SLTKLAAAW; LTKLAAAWG; TKLAAAWGG; KLAAAWGGS; LAAAWGGSG; AAAWGGSGS; AAWGGSGSE; AWGGSGSEA; WGGSGSEAY; GGSGSEAYQ; GSGSEAYQG; SGSEAYQGV; GSEAYQGVQ; SEAYQGVQQ; EAYQGVQQK; AYQGVQQKW; YQGVQQKWD; QGVQQKWDA; GVQQKWDAT; VQQKWDATA; QQKWDATAT; QKWDATATE; KWDATATEL; WDATATELN; DATATELNN; ATATELNNA; TATELNNAL; ATELNNALQ; TELNNALQN; ELNNALQNL; LNNALQNLA; NNALQNLAR; NALQNLART; ALQNLARTI; LQNLARTIS; QNLARTISE; NLARTISEA; LARTISEAG; ARTISEAGQ; RTISEAGQA; TISEAGQAM; ISEAGQAMA; SEAGQAMAS; EAGQAMAST; AGQAMASTE; GQAMASTEG; QAMASTEGN; AMASTEGNV; MASTEGNVT; ASTEGNVTG; STEGNVTGM; TEGNVTGMF; EGNVTGMFA;<br><br>10 mers:<br>MTEQQWNFAG; TEQQWNFAGI; EQQWNFAGIE; QQWNFAGIEA; QWNFAGIEAA; WNFAGIEAAA; NFAGIEAAAS; FAGIEAAASA; AGIEAAASAI; GIEAAASAIQ; IEAAASAIQG; EAAASAIQGN; AAASAIQGNV; AASAIQGNVT; ASAIQGNVTS; SAIQGNVTSI; AIQGNVTSIH; IQGNVTSIHS; QGNVTSIHSL; GNVTSIHSLL; NVTSIHSLLD; VTSIHSLLDE; TSIHSLLDEG; SIHSLLDEGK; | 50928-51273 |

Fig. 28 continued

| | | |
|---|---|---|
| | IHSLLDEGKQ; HSLLDEGKQS; SLLDEGKQSL; LLDEGKQSLT; LDEGKQSLTK; DEGKQSLTKL; EGKQSLTKLA; GKQSLTKLAA; KQSLTKLAAA; QSLTKLAAAW; SLTKLAAAWG; LTKLAAAWGG; TKLAAAWGGS; KLAAAWGGSG; LAAAWGGSGS; AAAWGGSGSE; AAWGGSGSEA; AWGGSGSEAY; WGGSGSEAYQ; GGSGSEAYQG; GSGSEAYQGV; SGSEAYQGVQ; GSEAYQGVQQ; SEAYQGVQQK; EAYQGVQQKW; AYQGVQQKWD; YQGVQQKWDA; QGVQQKWDAT; GVQQKWDATA; VQQKWDATAT; QQKWDATATE; QKWDATATEL; KWDATATELN; WDATATELNN; DATATELNNA; ATATELNNAL; TATELNNALQ; ATELNNALQN; TELNNALQNL; ELNNALQNLA; LNNALQNLAR; NNALQNLART; NALQNLARTI; ALQNLARTIS; LQNLARTISE; QNLARTISEA; NLARTISEAG; LARTISEAGQ; ARTISEAGQA; RTISEAGQAM; TISEAGQAMA; ISEAGQAMAS; SEAGQAMAST; EAGQAMASTE; AGQAMASTEG; GQAMASTEGN; QAMASTEGNV; AMASTEGNVT; MASTEGNVTG; ASTEGNVTGM; STEGNVTGMF; TEGNVTGMFA;<br><br>11 mers:<br>MTEQQWNFAGI; TEQQWNFAGIE; EQQWNFAGIEA; QQWNFAGIEAA; QWNFAGIEAAA; WNFAGIEAAAS; NFAGIEAAASA; FAGIEAAASAI; AGIEAAASAIQ; GIEAAASAIQG; IEAAASAIQGN; EAAASAIQGNV; AAASAIQGNVT; AASAIQGNVTS; ASAIQGNVTSI; SAIQGNVTSIH; AIQGNVTSIHS; IQGNVTSIHSL; QGNVTSIHSLL; GNVTSIHSLLD; NVTSIHSLLDE; VTSIHSLLDEG; TSIHSLLDEGK; SIHSLLDEGKQ; IHSLLDEGKQS; HSLLDEGKQSL; SLLDEGKQSLT; LLDEGKQSLTK; LDEGKQSLTKL; DEGKQSLTKLA; EGKQSLTKLAA; GKQSLTKLAAA; KQSLTKLAAAW; QSLTKLAAAWG; SLTKLAAAWGG; LTKLAAAWGGS; TKLAAAWGGSG; KLAAAWGGSGS; LAAAWGGSGSE; AAAWGGSGSEA; AAWGGSGSEAY; AWGGSGSEAYQ; WGGSGSEAYQG; GGSGSEAYQGV; GSGSEAYQGVQ; SGSEAYQGVQQ; GSEAYQGVQQK; SEAYQGVQQKW; EAYQGVQQKWD; AYQGVQQKWDA; YQGVQQKWDAT; QGVQQKWDATA; GVQQKWDATAT; VQQKWDATATE; QQKWDATATEL; QKWDATATELN; KWDATATELNN; WDATATELNNA; DATATELNNAL; ATATELNNALQ; TATELNNALQN; ATELNNALQNL; TELNNALQNLA; ELNNALQNLAR; LNNALQNLART; NNALQNLARTI; NALQNLARTIS; ALQNLARTISE; LQNLARTISEA; QNLARTISEAG; NLARTISEAGQ; LARTISEAGQA; ARTISEAGQAM; RTISEAGQAMA; TISEAGQAMAS; ISEAGQAMAST; SEAGQAMASTE; EAGQAMASTEG; AGQAMASTEGN; GQAMASTEGNV; QAMASTEGNVT; AMASTEGNVTG; MASTEGNVTGM; ASTEGNVTGMF; STEGNVTGMFA; | |
| 74) Rv3878 | 8 mers:<br>MAEPLAVD; AEPLAVDP; EPLAVDPT; PLAVDPTG; LAVDPTGL; AVDPTGLS; VDPTGLSA; DPTGLSAA; PTGLSAAA; TGLSAAAA; GLSAAAAK; LSAAAAKL; SAAAAKLA; AAAAKLAG; AAAKLAGL; AAKLAGLV; AKLAGLVF; KLAGLVFP; LAGLVFPQ; AGLVFPQP; GLVFPQPP; LVFPQPPA; VFPQPPAP; FPQPPAPI; PQPPAPIA; QPPAPIAV; PPAPIAVS; PAPIAVSG; APIAVSGT; PIAVSGTD; IAVSGTDS; AVSGTDSV; VSGTDSVV; SGTDSVVA; GTDSVVAA; TDSVVAAI; DSVVAAIN; SVVAAINE; VVAAINET; VAAINETM; AAINETMP; AINETMPS; INETMPSI; NETMPSIE; ETMPSIES; | 51274-52359 |

Fig. 28 continued

| | | | |
|---|---|---|---|
| | TMPSIESL; MPSIESLV; PSIESLVS; SIESLVSD; IESLVSDG; ESLVSDGL; SLVSDGLP; LVSDGLPG; VSDGLPGV; SDGLPGVK; DGLPGVKA; GLPGVKAA; LPGVKAAL; PGVKAALT; GVKAALTR; VKAALTRT; KAALTRTA; AALTRTAS; ALTRTASN; LTRTASNM; TRTASNMN; RTASNMNA; TASNMNAA; ASNMNAAA; SNMNAAAD; NMNAAADV; MNAAADVY; NAAADVYA; AAADVYAK; AADVYAKT; ADVYAKTD; DVYAKTDQ; VYAKTDQS; YAKTDQSL; AKTDQSLG; KTDQSLGT; TDQSLGTS; DQSLGTSL; QSLGTSLS; SLGTSLSQ; LGTSLSQY; GTSLSQYA; TSLSQYAF; SLSQYAFG; LSQYAFGS; SQYAFGSS; QYAFGSSG; YAFGSSGE; AFGSSGEG; FGSSGEGL; GSSGEGLA; SSGEGLAG; SGEGLAGV; GEGLAGVA; EGLAGVAS; GLAGVASV; LAGVASVG; AGVASVGG; GVASVGGQ; VASVGGQP; ASVGGQPS; SVGGQPSQ; VGGQPSQA; GGQPSQAT; GQPSQATQ; QPSQATQL; PSQATQLL; SQATQLLS; QATQLLST; ATQLLSTP; TQLLSTPV; QLLSTPVS; LLSTPVSQ; LSTPVSQV; STPVSQVT; TPVSQVTT; PVSQVTTQ; VSQVTTQL; SQVTTQLG; QVTTQLGE; VTTQLGET; TTQLGETA; TQLGETAA; QLGETAAE; LGETAAEL; GETAAELA; ETAAELAP; TAAELAPR; AAELAPRV; AELAPRVV; ELAPRVVA; LAPRVVAT; APRVVATV; PRVVATVP; RVVATVPQ; VVATVPQL; VATVPQLV; ATVPQLVQ; TVPQLVQL; VPQLVQLA; PQLVQLAP; QLVQLAPH; LVQLAPHA; VQLAPHAV; QLAPHAVQ; LAPHAVQM; APHAVQMS; PHAVQMSQ; HAVQMSQN; AVQMSQNA; VQMSQNAS; QMSQNASP; MSQNASPI; SQNASPIA; QNASPIAQ; NASPIAQT; ASPIAQTI; SPIAQTIS; PIAQTISQ; IAQTISQT; AQTISQTA; QTISQTAQ; TISQTAQQ; ISQTAQQA; SQTAQQAA; QTAQQAAQ; TAQQAAQS; AQQAAQSA; QQAAQSAQ; QAAQSAQG; AAQSAQGG; AQSAQGGS; QSAQGGSG; SAQGGSGP; AQGGSGPM; QGGSGPMP; GGSGPMPA; GSGPMPAQ; SGPMPAQL; GPMPAQLA; PMPAQLAS; MPAQLASA; PAQLASAE; AQLASAEK; QLASAEKP; LASAEKPA; ASAEKPAT; SAEKPATE; AEKPATEQ; EKPATEQA; KPATEQAE; PATEQAEP; ATEQAEPV; TEQAEPVH; EQAEPVHE; QAEPVHEV; AEPVHEVT; EPVHEVTN; PVHEVTND; VHEVTNDD; HEVTNDDQ; EVTNDDQG; VTNDDQGD; TNDDQGDQ; NDDQGDQG; DDQGDQGD; DQGDQGDV; QGDQGDVQ; GDQGDVQP; DQGDVQPA; QGDVQPAE; GDVQPAEV; DVQPAEVV; VQPAEVVA; QPAEVVAA; PAEVVAAA; AEVVAAAR; EVVAAARD; VVAAARDE; VAAARDEG; AAARDEGA; AARDEGAG; ARDEGAGA; RDEGAGAS; DEGAGASP; EGAGASPG; GAGASPGQ; AGASPGQQ; GASPGQQP; ASPGQQPG; SPGQQPGG; PGQQPGGG; GQQPGGGV; QQPGGGVP; QPGGGVPA; PGGGVPAQ; GGGVPAQA; GGVPAQAM; GVPAQAMD; VPAQAMDT; PAQAMDTG; AQAMDTGA; QAMDTGAG; AMDTGAGA; MDTGAGAR; DTGAGARP; TGAGARPA; GAGARPAA; AGARPAAS; GARPAASP; ARPAASPL; RPAASPLA; PAASPLAA; AASPLAAP; ASPLAAPV; SPLAAPVD; PLAAPVDP; LAAPVDPS; AAPVDPST; APVDPSTP; PVDPSTPA; VDPSTPAP; DPSTPAPS; PSTPAPST; STPAPSTT; TPAPSTTT; PAPSTTTT; APSTTTTL;<br><br>9 mers:<br>MAEPLAVDP; AEPLAVDPT; EPLAVDPTG; PLAVDPTGL; LAVDPTGLS; AVDPTGLSA; VDPTGLSAA; DPTGLSAAA; PTGLSAAAA; TGLSAAAAK; GLSAAAAKL; LSAAAAKLA; SAAAAKLAG; AAAAKLAGL; AAAKLAGLV; AAKLAGLVF; AKLAGLVFP; KLAGLVFPQ; LAGLVFPQP; AGLVFPQPP; GLVFPQPPA; LVFPQPPAP; VFPQPPAPI; | |

Fig. 28 continued

| | | |
|---|---|---|
| | FPQPPAPIA; PQPPAPIAV; QPPAPIAVS; PPAPIAVSG; PAPIAVSGT; APIAVSGTD; PIAVSGTDS; IAVSGTDSV; AVSGTDSVV; VSGTDSVVA; SGTDSVVAA; GTDSVVAAI; TDSVVAAIN; DSVVAAINE; SVVAAINET; VVAAINETM; VAAINETMP; AAINETMPS; AINETMPSI; INETMPSIE; NETMPSIES; ETMPSIESL; TMPSIESLV; MPSIESLVS; PSIESLVSD; SIESLVSDG; IESLVSDGL; ESLVSDGLP; SLVSDGLPG; LVSDGLPGV; VSDGLPGVK; SDGLPGVKA; DGLPGVKAA; GLPGVKAAL; LPGVKAALT; PGVKAALTR; GVKAALTRT; VKAALTRTA; KAALTRTAS; AALTRTASN; ALTRTASNM; LTRTASNMN; TRTASNMNA; RTASNMNAA; TASNMNAAA; ASNMNAAAD; SNMNAAADV; NMNAAADVY; MNAAADVYA; NAAADVYAK; AAADVYAKT; AADVYAKTD; ADVYAKTDQ; DVYAKTDQS; VYAKTDQSL; YAKTDQSLG; AKTDQSLGT; KTDQSLGTS; TDQSLGTSL; DQSLGTSLS; QSLGTSLSQ; SLGTSLSQY; LGTSLSQYA; GTSLSQYAF; TSLSQYAFG; SLSQYAFGS; LSQYAFGSS; SQYAFGSSG; QYAFGSSGE; YAFGSSGEG; AFGSSGEGL; FGSSGEGLA; GSSGEGLAG; SSGEGLAGV; SGEGLAGVA; GEGLAGVAS; EGLAGVASV; GLAGVASVG; LAGVASVGG; AGVASVGGQ; GVASVGGQP; VASVGGQPS; ASVGGQPSQ; SVGGQPSQA; VGGQPSQAT; GGQPSQATQ; GQPSQATQL; QPSQATQLL; PSQATQLLS; SQATQLLST; QATQLLSTP; ATQLLSTPV; TQLLSTPVS; QLLSTPVSQ; LLSTPVSQV; LSTPVSQVT; STPVSQVTT; TPVSQVTTQ; PVSQVTTQL; VSQVTTQLG; SQVTTQLGE; QVTTQLGET; VTTQLGETA; TTQLGETAA; TQLGETAAE; QLGETAAEL; LGETAAELA; GETAAELAP; ETAAELAPR; TAAELAPRV; AAELAPRVV; AELAPRVVA; ELAPRVVAT; LAPRVVATV; APRVVATVP; PRVVATVPQ; RVVATVPQL; VVATVPQLV; VATVPQLVQ; ATVPQLVQL; TVPQLVQLA; VPQLVQLAP; PQLVQLAPH; QLVQLAPHA; LVQLAPHAV; VQLAPHAVQ; QLAPHAVQM; LAPHAVQMS; APHAVQMSQ; PHAVQMSQN; HAVQMSQNA; AVQMSQNAS; VQMSQNASP; QMSQNASPI; MSQNASPIA; SQNASPIAQ; QNASPIAQT; NASPIAQTI; ASPIAQTIS; SPIAQTISQ; PIAQTISQT; IAQTISQTA; AQTISQTAQ; QTISQTAQQ; TISQTAQQA; ISQTAQQAA; SQTAQQAAQ; QTAQQAAQS; TAQQAAQSA; AQQAAQSAQ; QQAAQSAQG; QAAQSAQGG; AAQSAQGGS; AQSAQGGSG; QSAQGGSGP; SAQGGSGPM; AQGGSGPMP; QGGSGPMPA; GGSGPMPAQ; GSGPMPAQL; SGPMPAQLA; GPMPAQLAS; PMPAQLASA; MPAQLASAE; PAQLASAEK; AQLASAEKP; QLASAEKPA; LASAEKPAT; ASAEKPATE; SAEKPATEQ; AEKPATEQA; EKPATEQAE; KPATEQAEP; PATEQAEPV; ATEQAEPVH; TEQAEPVHE; EQAEPVHEV; QAEPVHEVT; AEPVHEVTN; EPVHEVTND; PVHEVTNDD; VHEVTNDDQ; HEVTNDDQG; EVTNDDQGD; VTNDDQGDQ; TNDDQGDQG; NDDQGDQGD; DDQGDQGDV; DQGDQGDVQ; QGDQGDVQP; GDQGDVQPA; DQGDVQPAE; QGDVQPAEV; GDVQPAEVV; DVQPAEVVA; VQPAEVVAA; QPAEVVAAA; PAEVVAAAR; AEVVAAARD; EVVAAARDE; VVAAARDEG; VAAARDEGA; AAARDEGAG; AARDEGAGA; ARDEGAGAS; RDEGAGASP; DEGAGASPG; EGAGASPGQ; GAGASPGQQ; AGASPGQQP; GASPGQQPG; ASPGQQPGG; SPGQQPGGG; PGQQPGGGV; GQQPGGGVP; QQPGGGVPA; QPGGGVPAQ; PGGGVPAQA; GGGVPAQAM; GGVPAQAMD; GVPAQAMDT; VPAQAMDTG; PAQAMDTGA; AQAMDTGAG; QAMDTGAGA; | |

Fig. 28 continued

| | | | |
|---|---|---|---|
| | AMDTGAGAR; MDTGAGARP; DTGAGARPA; TGAGARPAA; GAGARPAAS; AGARPAASP; GARPAASPL; ARPAASPLA; RPAASPLAA; PAASPLAAP; AASPLAAPV; ASPLAAPVD; SPLAAPVDP; PLAAPVDPS; LAAPVDPST; AAPVDPSTP; APVDPSTPA; PVDPSTPAP; VDPSTPAPS; DPSTPAPST; PSTPAPSTT; STPAPSTTT; TPAPSTTTT; PAPSTTTTL;<br><br>10 mers:<br>MAEPLAVDPT; AEPLAVDPTG; EPLAVDPTGL; PLAVDPTGLS; LAVDPTGLSA; AVDPTGLSAA; VDPTGLSAAA; DPTGLSAAAA; PTGLSAAAAK; TGLSAAAAKL; GLSAAAAKLA; LSAAAAKLAG; SAAAAKLAGL; AAAAKLAGLV; AAAKLAGLVF; AAKLAGLVFP; AKLAGLVFPQ; KLAGLVFPQP; LAGLVFPQPP; AGLVFPQPPA; GLVFPQPPAP; LVFPQPPAPI; VFPQPPAPIA; FPQPPAPIAV; PQPPAPIAVS; QPPAPIAVSG; PPAPIAVSGT; PAPIAVSGTD; APIAVSGTDS; PIAVSGTDSV; IAVSGTDSVV; AVSGTDSVVA; VSGTDSVVAA; SGTDSVVAAI; GTDSVVAAIN; TDSVVAAINE; DSVVAAINET; SVVAAINETM; VVAAINETMP; VAAINETMPS; AAINETMPSI; AINETMPSIE; INETMPSIES; NETMPSIESL; ETMPSIESLV; TMPSIESLVS; MPSIESLVSD; PSIESLVSDG; SIESLVSDGL; IESLVSDGLP; ESLVSDGLPG; SLVSDGLPGV; LVSDGLPGVK; VSDGLPGVKA; SDGLPGVKAA; DGLPGVKAAL; GLPGVKAALT; LPGVKAALTR; PGVKAALTRT; GVKAALTRTA; VKAALTRTAS; KAALTRTASN; AALTRTASNM; ALTRTASNMN; LTRTASNMNA; TRTASNMNAA; RTASNMNAAA; TASNMNAAAD; ASNMNAAADV; SNMNAAADVY; NMNAAADVYA; MNAAADVYAK; NAAADVYAKT; AAADVYAKTD; AADVYAKTDQ; ADVYAKTDQS; DVYAKTDQSL; VYAKTDQSLG; YAKTDQSLGT; AKTDQSLGTS; KTDQSLGTSL; TDQSLGTSLS; DQSLGTSLSQ; QSLGTSLSQY; SLGTSLSQYA; LGTSLSQYAF; GTSLSQYAFG; TSLSQYAFGS; SLSQYAFGSS; LSQYAFGSSG; SQYAFGSSGE; QYAFGSSGEG; YAFGSSGEGL; AFGSSGEGLA; FGSSGEGLAG; GSSGEGLAGV; SSGEGLAGVA; SGEGLAGVAS; GEGLAGVASV; EGLAGVASVG; GLAGVASVGG; LAGVASVGGQ; AGVASVGGQP; GVASVGGQPS; VASVGGQPSQ; ASVGGQPSQA; SVGGQPSQAT; VGGQPSQATQ; GGQPSQATQL; GQPSQATQLL; QPSQATQLLS; PSQATQLLST; SQATQLLSTP; QATQLLSTPV; ATQLLSTPVS; TQLLSTPVSQ; QLLSTPVSQV; LLSTPVSQVT; LSTPVSQVTT; STPVSQVTTQ; TPVSQVTTQL; PVSQVTTQLG; VSQVTTQLGE; SQVTTQLGET; QVTTQLGETA; VTTQLGETAA; TTQLGETAAE; TQLGETAAEL; QLGETAAELA; LGETAAELAP; GETAAELAPR; ETAAELAPRV; TAAELAPRVV; AAELAPRVVA; AELAPRVVAT; ELAPRVVATV; LAPRVVATVP; APRVVATVPQ; PRVVATVPQL; RVVATVPQLV; VVATVPQLVQ; VATVPQLVQL; ATVPQLVQLA; TVPQLVQLAP; VPQLVQLAPH; PQLVQLAPHA; QLVQLAPHAV; LVQLAPHAVQ; VQLAPHAVQM; QLAPHAVQMS; LAPHAVQMSQ; APHAVQMSQN; PHAVQMSQNA; HAVQMSQNAS; AVQMSQNASP; VQMSQNASPI; QMSQNASPIA; MSQNASPIAQ; SQNASPIAQT; QNASPIAQTI; NASPIAQTIS; ASPIAQTISQ; SPIAQTISQT; PIAQTISQTA; IAQTISQTAQ; AQTISQTAQQ; QTISQTAQQA; TISQTAQQAA; ISQTAQQAAQ; SQTAQQAAQS; QTAQQAAQSA; TAQQAAQSAQ; AQQAAQSAQG; QQAAQSAQGG; QAAQSAQGGS; AAQSAQGGSG; AQSAQGGSGP; QSAQGGSGPM; SAQGGSGPMP; AQGGSGPMPA; | |

Fig. 28 continued

| | | | |
|---|---|---|---|
| | QGGSGPMPAQ; GGSGPMPAQL; GSGPMPAQLA; SGPMPAQLAS; GPMPAQLASA; PMPAQLASAE; MPAQLASAEK; PAQLASAEKP; AQLASAEKPA; QLASAEKPAT; LASAEKPATE; ASAEKPATEQ; SAEKPATEQA; AEKPATEQAE; EKPATEQAEP; KPATEQAEPV; PATEQAEPVH; ATEQAEPVHE; TEQAEPVHEV; EQAEPVHEVT; QAEPVHEVTN; AEPVHEVTND; EPVHEVTNDD; PVHEVTNDDQ; VHEVTNDDQG; HEVTNDDQGD; EVTNDDQGDQ; VTNDDQGDQG; TNDDQGDQGD; NDDQGDQGDV; DDQGDQGDVQ; DQGDQGDVQP; QGDQGDVQPA; GDQGDVQPAE; DQGDVQPAEV; QGDVQPAEVV; GDVQPAEVVA; DVQPAEVVAA; VQPAEVVAAA; QPAEVVAAAR; PAEVVAAARD; AEVVAAARDE; EVVAAARDEG; VVAAARDEGA; VAAARDEGAG; AAARDEGAGA; AARDEGAGAS; ARDEGAGASP; RDEGAGASPG; DEGAGASPGQ; EGAGASPGQQ; GAGASPGQQP; AGASPGQQPG; GASPGQQPGG; ASPGQQPGGG; SPGQQPGGGV; PGQQPGGGVP; GQQPGGGVPA; QQPGGGVPAQ; QPGGGVPAQA; PGGGVPAQAM; GGGVPAQAMD; GGVPAQAMDT; GVPAQAMDTG; VPAQAMDTGA; PAQAMDTGAG; AQAMDTGAGA; QAMDTGAGAR; AMDTGAGARP; MDTGAGARPA; DTGAGARPAA; TGAGARPAAS; GAGARPAASP; AGARPAASPL; GARPAASPLA; ARPAASPLAA; RPAASPLAAP; PAASPLAAPV; AASPLAAPVD; ASPLAAPVDP; SPLAAPVDPS; PLAAPVDPST; LAAPVDPSTP; AAPVDPSTPA; APVDPSTPAP; PVDPSTPAPS; VDPSTPAPST; DPSTPAPSTT; PSTPAPSTTT; STPAPSTTTT; TPAPSTTTTL;<br><br>11 mers:<br>MAEPLAVDPTG; AEPLAVDPTGL; EPLAVDPTGLS; PLAVDPTGLSA; LAVDPTGLSAA; AVDPTGLSAAA; VDPTGLSAAAA; DPTGLSAAAAK; PTGLSAAAAKL; TGLSAAAAKLA; GLSAAAAKLAG; LSAAAAKLAGL; SAAAAKLAGLV; AAAAKLAGLVF; AAAKLAGLVFP; AAKLAGLVFPQ; AKLAGLVFPQP; KLAGLVFPQPP; LAGLVFPQPPA; AGLVFPQPPAP; GLVFPQPPAPI; LVFPQPPAPIA; VFPQPPAPIAV; FPQPPAPIAVS; PQPPAPIAVSG; QPPAPIAVSGT; PPAPIAVSGTD; PAPIAVSGTDS; APIAVSGTDSV; PIAVSGTDSVV; IAVSGTDSVVA; AVSGTDSVVAA; VSGTDSVVAAI; SGTDSVVAAIN; GTDSVVAAINE; TDSVVAAINET; DSVVAAINETM; SVVAAINETMP; VVAAINETMPS; VAAINETMPSI; AAINETMPSIE; AINETMPSIES; INETMPSIESL; NETMPSIESLV; ETMPSIESLVS; TMPSIESLVSD; MPSIESLVSDG; PSIESLVSDGL; SIESLVSDGLP; IESLVSDGLPG; ESLVSDGLPGV; SLVSDGLPGVK; LVSDGLPGVKA; VSDGLPGVKAA; SDGLPGVKAAL; DGLPGVKAALT; GLPGVKAALTR; LPGVKAALTRT; PGVKAALTRTA; GVKAALTRTAS; VKAALTRTASN; KAALTRTASNM; AALTRTASNMN; ALTRTASNMNA; LTRTASNMNAA; TRTASNMNAAA; RTASNMNAAAD; TASNMNAAADV; ASNMNAAADVY; SNMNAAADVYA; NMNAAADVYAK; MNAAADVYAKT; NAAADVYAKTD; AAADVYAKTDQ; AADVYAKTDQS; ADVYAKTDQSL; DVYAKTDQSLG; VYAKTDQSLGT; YAKTDQSLGTS; AKTDQSLGTSL; KTDQSLGTSLS; TDQSLGTSLSQ; DQSLGTSLSQY; QSLGTSLSQYA; SLGTSLSQYAF; LGTSLSQYAFG; GTSLSQYAFGS; TSLSQYAFGSS; SLSQYAFGSSG; LSQYAFGSSGE; SQYAFGSSGEG; QYAFGSSGEGL; YAFGSSGEGLA; AFGSSGEGLAG; FGSSGEGLAGV; GSSGEGLAGVA; SSGEGLAGVAS; SGEGLAGVASV; GEGLAGVASVG; EGLAGVASVGG; GLAGVASVGGQ; LAGVASVGGQP; AGVASVGGQPS; GVASVGGQPSQ; VASVGGQPSQA; | |

Fig. 28 continued

| | | |
|---|---|---|
| | ASVGGQPSQAT; SVGGQPSQATQ; VGGQPSQATQL; GGQPSQATQLL; GQPSQATQLLS; QPSQATQLLST; PSQATQLLSTP; SQATQLLSTPV; QATQLLSTPVS; ATQLLSTPVSQ; TQLLSTPVSQV; QLLSTPVSQVT; LLSTPVSQVTT; LSTPVSQVTTQ; STPVSQVTTQL; TPVSQVTTQLG; PVSQVTTQLGE; VSQVTTQLGET; SQVTTQLGETA; QVTTQLGETAA; VTTQLGETAAE; TTQLGETAAEL; TQLGETAAELA; QLGETAAELAP; LGETAAELAPR; GETAAELAPRV; ETAAELAPRVV; TAAELAPRVVA; AAELAPRVVAT; AELAPRVVATV; ELAPRVVATVP; LAPRVVATVPQ; APRVVATVPQL; PRVVATVPQLV; RVVATVPQLVQ; VVATVPQLVQL; VATVPQLVQLA; ATVPQLVQLAP; TVPQLVQLAPH; VPQLVQLAPHA; PQLVQLAPHAV; QLVQLAPHAVQ; LVQLAPHAVQM; VQLAPHAVQMS; QLAPHAVQMSQ; LAPHAVQMSQN; APHAVQMSQNA; PHAVQMSQNAS; HAVQMSQNASP; AVQMSQNASPI; VQMSQNASPIA; QMSQNASPIAQ; MSQNASPIAQT; SQNASPIAQTI; QNASPIAQTIS; NASPIAQTISQ; ASPIAQTISQT; SPIAQTISQTA; PIAQTISQTAQ; IAQTISQTAQQ; AQTISQTAQQA; QTISQTAQQAA; TISQTAQQAAQ; ISQTAQQAAQS; SQTAQQAAQSA; QTAQQAAQSAQ; TAQQAAQSAQG; AQQAAQSAQGG; QQAAQSAQGGS; QAAQSAQGGSG; AAQSAQGGSGP; AQSAQGGSGPM; QSAQGGSGPMP; SAQGGSGPMPA; AQGGSGPMPAQ; QGGSGPMPAQL; GGSGPMPAQLA; GSGPMPAQLAS; SGPMPAQLASA; GPMPAQLASAE; PMPAQLASAEK; MPAQLASAEKP; PAQLASAEKPA; AQLASAEKPAT; QLASAEKPATE; LASAEKPATEQ; ASAEKPATEQA; SAEKPATEQAE; AEKPATEQAEP; EKPATEQAEPV; KPATEQAEPVH; PATEQAEPVHE; ATEQAEPVHEV; TEQAEPVHEVT; EQAEPVHEVTN; QAEPVHEVTND; AEPVHEVTNDD; EPVHEVTNDDQ; PVHEVTNDDQG; VHEVTNDDQGD; HEVTNDDQGDQ; EVTNDDQGDQG; VTNDDQGDQGD; TNDDQGDQGDV; NDDQGDQGDVQ; DDQGDQGDVQP; DQGDQGDVQPA; QGDQGDVQPAE; GDQGDVQPAEV; DQGDVQPAEVV; QGDVQPAEVVA; GDVQPAEVVAA; DVQPAEVVAAA; VQPAEVVAAAR; QPAEVVAAARD; PAEVVAAARDE; AEVVAAARDEG; EVVAAARDEGA; VVAAARDEGAG; VAAARDEGAGA; AAARDEGAGAS; AARDEGAGASP; ARDEGAGASPG; RDEGAGASPGQ; DEGAGASPGQQ; EGAGASPGQQP; GAGASPGQQPG; AGASPGQQPGG; GASPGQQPGGG; ASPGQQPGGGV; SPGQQPGGGVP; PGQQPGGGVPA; GQQPGGGVPAQ; QQPGGGVPAQA; QPGGGVPAQAM; PGGGVPAQAMD; GGGVPAQAMDT; GGVPAQAMDTG; GVPAQAMDTGA; VPAQAMDTGAG; PAQAMDTGAGA; AQAMDTGAGAR; QAMDTGAGARP; AMDTGAGARPA; MDTGAGARPAA; DTGAGARPAAS; TGAGARPAASP; GAGARPAASPL; AGARPAASPLA; GARPAASPLAA; ARPAASPLAAP; RPAASPLAAPV; PAASPLAAPVD; AASPLAAPVDP; ASPLAAPVDPS; SPLAAPVDPST; PLAAPVDPSTP; LAAPVDPSTPA; AAPVDPSTPAP; APVDPSTPAPS; PVDPSTPAPST; VDPSTPAPSTT; DPSTPAPSTTT; PSTPAPSTTTT; STPAPSTTTTL; | |
| 75) Rv3879c | 8 mers: MSITRPTG; SITRPTGS; ITRPTGSY; TRPTGSYA; RPTGSYAR; PTGSYARQ; TGSYARQM; GSYARQML; SYARQMLD; YARQMLDP; ARQMLDPG; RQMLDPGG; QMLDPGGW; MLDPGGWV; LDPGGWVE; DPGGWVEA; PGGWVEAD; GGWVEADE; GWVEADED; WVEADEDT; | 52360-55241 |

Fig. 28 continued

| | | |
|---|---|---|
| | VEADEDTF; EADEDTFY; ADEDTFYD; DEDTFYDR; EDTFYDRA;<br>DTFYDRAQ; TFYDRAQE; FYDRAQEY; YDRAQEYS; DRAQEYSQ;<br>RAQEYSQV; AQEYSQVL; QEYSQVLQ; EYSQVLQR; YSQVLQRV;<br>SQVLQRVT; QVLQRVTD; VLQRVTDV; LQRVTDVL; QRVTDVLD;<br>RVTDVLDT; VTDVLDTC; TDVLDTCR; DVLDTCRQ; VLDTCRQQ;<br>LDTCRQQK; DTCRQQKG; TCRQQKGH; CRQQKGHV; RQQKGHVF;<br>QQKGHVFE; QKGHVFEG; KGHVFEGG; GHVFEGGL; HVFEGGLW;<br>VFEGGLWS; FEGGLWSG; EGGLWSGG; GGLWSGGA; GLWSGGAA;<br>LWSGGAAN; WSGGAANA; SGGAANAA; GGAANAAN; GAANAANG;<br>AANAANGA; ANAANGAL; NAANGALG; AANGALGA; ANGALGAN;<br>NGALGANI; GALGANIN; ALGANINQ; LGANINQL; GANINQLM;<br>ANINQLMT; NINQLMTL; INQLMTLQ; NQLMTLQD; QLMTLQDY;<br>LMTLQDYL; MTLQDYLA; TLQDYLAT; LQDYLATV; QDYLATVI;<br>DYLATVIT; YLATVITW; LATVITWH; ATVITWHR; TVITWHRH;<br>VITWHRHI; ITWHRHIA; TWHRHIAG; WHRHIAGL; HRHIAGLI;<br>RHIAGLIE; HIAGLIEQ; IAGLIEQA; AGLIEQAK; GLIEQAKS;<br>LIEQAKSD; IEQAKSDI; EQAKSDIG; QAKSDIGN; AKSDIGNN;<br>KSDIGNNV; SDIGNNVD; DIGNNVDG; IGNNVDGA; GNNVDGAQ;<br>NNVDGAQR; NVDGAQRE; VDGAQREI; DGAQREID; GAQREIDI;<br>AQREIDIL; QREIDILE; REIDILEN; EIDILEND; IDILENDP; DILENDPS;<br>ILENDPSL; LENDPSLD; ENDPSLDA; NDPSLDAD; DPSLDADE;<br>PSLDADER; SLDADERH; LDADERHT; DADERHTA; ADERHTAI;<br>DERHTAIN; ERHTAINS; RHTAINSL; HTAINSLV; TAINSLVT;<br>AINSLVTA; INSLVTAT; NSLVTATH; SLVTATHG; LVTATHGA;<br>VTATHGAN; TATHGANV; ATHGANVS; THGANVSL; HGANVSLV;<br>GANVSLVA; ANVSLVAE; NVSLVAET; VSLVAETA; SLVAETAE;<br>LVAETAER; VAETAERV; AETAERVL; ETAERVLE; TAERVLES;<br>AERVLESK; ERVLESKN; RVLESKNW; VLESKNWK; LESKNWKP;<br>ESKNWKPP; SKNWKPPK; KNWKPPKN; NWKPPKNA; WKPPKNAL;<br>KPPKNALE; PPKNALED; PKNALEDL; KNALEDLL; NALEDLLQ;<br>ALEDLLQQ; LEDLLQQK; EDLLQQKS; DLLQQKSP; LLQQKSPP;<br>LQQKSPPP; QQKSPPPP; QKSPPPPD; KSPPPPDV; SPPPPDVP;<br>PPPPDVPT; PPPDVPTL; PPDVPTLV; PDVPTLVV; DVPTLVVP;<br>VPTLVVPS; PTLVVPSP; TLVVPSPG; LVVPSPGT; VVPSPGTP;<br>VPSPGTPG; PSPGTPGT; SPGTPGTP; PGTPGTPG; GTPGTPGT;<br>TPGTPGTP; PGTPGTPI; GTPGTPIT; TPGTPITP; PGTPITPG;<br>GTPITPGT; TPITPGTP; PITPGTPI; ITPGTPIT; TPGTPITP; PGTPITPG;<br>GTPITPGT; TPITPGTP; PITPGTPI; ITPGTPIT; TPGTPITP; PGTPITPI;<br>GTPITPIP; TPITPIPG; PITPIPGA; ITPIPGAP; TPIPGAPV; PIPGAPVT;<br>IPGAPVTP; PGAPVTPI; GAPVTPIT; APVTPITP; PVTPITPT;<br>VTPITPTP; TPITPTPG; PITPTPGT; ITPTPGTP; TPTPGTPV;<br>PTPGTPVT; TPGTPVTP; PGTPVTPV; GTPVTPVT; TPVTPVTP;<br>PVTPVTPG; VTPVTPGK; TPVTPGKP; PVTPGKPV; VTPGKPVT;<br>TPGKPVTP; PGKPVTPV; GKPVTPVT; KPVTPVTP; PVTPVTPV;<br>VTPVTPVK; TPVTPVKP; PVTPVKPG; VTPVKPGT; TPVKPGTP;<br>PVKPGTPG; VKPGTPGE; KPGTPGEP; PGTPGEPT; GTPGEPTP;<br>TPGEPTPI; PGEPTPIT; GEPTPITP; EPTPITPV; PTPITPVT;<br>TPITPVTP; PITPVTPP; ITPVTPPV; TPVTPPVA; PVTPPVAP;<br>VTPPVAPA; TPPVAPAT; PPVAPATP; PVAPATPA; VAPATPAT;<br>APATPATP; PATPATPA; ATPATPAT; TPATPATP; PATPATPV;<br>ATPATPVT; TPATPVTP; PATPVTPA; ATPVTPAP; TPVTPAPA;<br>PVTPAPAP; VTPAPAPH; TPAPAPHP; PAPAPHPQ; APAPHPQP;<br>PAPHPQPA; APHPQPAP; PHPQPAPA; HPQPAPAP; PQPAPAPA; | |

Fig. 28 continued

| | | | |
|---|---|---|---|
| | QPAPAPAP; PAPAPAPS; APAPAPSP; PAPAPSPG; APAPSPGP; PAPSPGPQ; APSPGPQP; PSPGPQPV; SPGPQPVT; PGPQPVTP; GPQPVTPA; PQPVTPAT; QPVTPATP; PVTPATPG; VTPATPGP; TPATPGPS; PATPGPSG; ATPGPSGP; TPGPSGPA; PGPSGPAT; GPSGPATP; PSGPATPG; SGPATPGT; GPATPGTP; PATPGTPG; ATPGTPGG; TPGTPGGE; PGTPGGEP; GTPGGEPA; TPGGEPAP; PGGEPAPH; GGEPAPHV; GEPAPHVK; EPAPHVKP; PAPHVKPA; APHVKPAA; PHVKPAAL; HVKPAALA; VKPAALAE; KPAALAEQ; PAALAEQP; AALAEQPG; ALAEQPGV; LAEQPGVP; AEQPGVPG; EQPGVPGQ; QPGVPGQH; PGVPGQHA; GVPGQHAG; VPGQHAGG; PGQHAGGG; GQHAGGGT; QHAGGGTQ; HAGGGTQS; AGGGTQSG; GGGTQSGP; GGTQSGPA; GTQSGPAH; TQSGPAHA; QSGPAHAD; SGPAHADE; GPAHADES; PAHADESA; AHADESAA; HADESAAS; ADESAASV; DESAASVT; ESAASVTP; SAASVTPA; AASVTPAA; ASVTPAAA; SVTPAAAS; VTPAAASG; TPAAASGV; PAAASGVP; AAASGVPG; AASGVPGA; ASGVPGAR; SGVPGARA; GVPGARAA; VPGARAAA; PGARAAAA; GARAAAAA; ARAAAAAP; RAAAAAPS; AAAAAPSG; AAAAPSGT; AAAPSGTA; AAPSGTAV; APSGTAVG; PSGTAVGA; SGTAVGAG; GTAVGAGA; TAVGAGAR; AVGAGARS; VGAGARSS; GAGARSSV; AGARSSVG; GARSSVGT; ARSSVGTA; RSSVGTAA; SSVGTAAA; SVGTAAAS; VGTAAASG; GTAAASGA; TAAASGAG; AAASGAGS; AASGAGSH; ASGAGSHA; SGAGSHAA; GAGSHAAT; AGSHAATG; GSHAATGR; SHAATGRA; HAATGRAP; AATGRAPV; ATGRAPVA; TGRAPVAT; GRAPVATS; RAPVATSD; APVATSDK; PVATSDKA; VATSDKAA; ATSDKAAA; TSDKAAAP; SDKAAAPS; DKAAAPST; KAAAPSTR; AAAPSTRA; AAPSTRAA; APSTRAAS; PSTRAASA; STRAASAR; TRAASART; RAASARTA; AASARTAP; ASARTAPP; SARTAPPA; ARTAPPAR; RTAPPARP; TAPPARPP; APPARPPS; PPARPPST; PARPPSTD; ARPPSTDH; RPPSTDHI; PPSTDHID; PSTDHIDK; STDHIDKP; TDHIDKPD; DHIDKPDR; HIDKPDRS; IDKPDRSE; DKPDRSES; KPDRSESA; PDRSESAD; DRSESADD; RSESADDG; SESADDGT; ESADDGTP; SADDGTPV; ADDGTPVS; DDGTPVSM; DGTPVSMI; GTPVSMIP; TPVSMIPV; PVSMIPVS; VSMIPVSA; SMIPVSAA; MIPVSAAR; IPVSAARA; PVSAARAA; VSAARAAR; SAARAARD; AARAARDA; ARAARDAA; RAARDAAT; AARDAATA; ARDAATAA; RDAATAAA; DAATAAAS; AATAAASA; ATAAASAR; TAAASARQ; AAASARQR; AASARQRG; ASARQRGR; SARQRGRG; ARQRGRGD; RQRGRGDA; QRGRGDAL; RGRGDALR; GRGDALRL; RGDALRLA; GDALRLAR; DALRLARR; ALRLARRI; LRLARRIA; RLARRIAA; LARRIAAA; ARRIAAAL; RRIAAALN; RIAAALNA; IAAALNAS; AAALNASD; AALNASDN; ALNASDNN; LNASDNNA; NASDNNAG; ASDNNAGD; SDNNAGDY; DNNAGDYG; NNAGDYGF; NAGDYGFF; AGDYGFFW; GDYGFFWI; DYGFFWIT; YGFFWITA; GFFWITAV; FFWITAVT; FWITAVTT; WITAVTTD; ITAVTTDG; TAVTTDGS; AVTTDGSI; VTTDGSIV; TTDGSIVV; TDGSIVVA; DGSIVVAN; GSIVVANS; SIVVANSY; IVVANSYG; VVANSYGL; VANSYGLA; ANSYGLAY; NSYGLAYI; SYGLAYIP; YGLAYIPD; GLAYIPDG; LAYIPDGM; AYIPDGME; YIPDGMEL; IPDGMELP; PDGMELPN; DGMELPNK; GMELPNKV; MELPNKVY; ELPNKVYL; LPNKVYLA; PNKVYLAS; NKVYLASA; KVYLASAD; VYLASADH; YLASADHA; LASADHAI; ASADHAIP; SADHAIPV; ADHAIPVD; DHAIPVDE; HAIPVDEI; AIPVDEIA; IPVDEIAR; PVDEIARC; VDEIARCA; DEIARCAT; | |

Fig. 28 continued

| | | |
|---|---|---|
| | EIARCATY; IARCATYP; ARCATYPV; RCATYPVL; CATYPVLA; ATYPVLAV; TYPVLAVQ; YPVLAVQA; PVLAVQAW; VLAVQAWA; LAVQAWAA; AVQAWAAF; VQAWAAFH; QAWAAFHD; AWAAFHDM; WAAFHDMT; AAFHDMTL; AFHDMTLR; FHDMTLRA; HDMTLRAV; DMTLRAVI; MTLRAVIG; TLRAVIGT; LRAVIGTA; RAVIGTAE; AVIGTAEQ; VIGTAEQL; IGTAEQLA; GTAEQLAS; TAEQLASS; AEQLASSD; EQLASSDP; QLASSDPG; LASSDPGV; ASSDPGVA; SSDPGVAK; SDPGVAKI; DPGVAKIV; PGVAKIVL; GVAKIVLE; VAKIVLEP; AKIVLEPD; KIVLEPDD; IVLEPDDI; VLEPDDIP; LEPDDIPE; EPDDIPES; PDDIPESG; DDIPESGK; DIPESGKM; IPESGKMT; PESGKMTG; ESGKMTGR; SGKMTGRS; GKMTGRSR; KMTGRSRL; MTGRSRLE; TGRSRLEV; GRSRLEVV; RSRLEVVD; SRLEVVDP; RLEVVDPS; LEVVDPSA; EVVDPSAA; VVDPSAAA; VDPSAAAQ; DPSAAAQL; PSAAAQLA; SAAAQLAD; AAAQLADT; AAQLADTT; AQLADTTD; QLADTTDQ; LADTTDQR; ADTTDQRL; DTTDQRLL; TTDQRLLD; TDQRLLDL; DQRLLDLL; QRLLDLLP; RLLDLLPP; LLDLLPPA; LDLLPPAP; DLLPPAPV; LLPPAPVD; LPPAPVDV; PPAPVDVN; PAPVDVNP; APVDVNPP; PVDVNPPG; VDVNPPGD; DVNPPGDE; VNPPGDER; NPPGDERH; PPGDERHM; PGDERHML; GDERHMLW; DERHMLWF; ERHMLWFE; RHMLWFEL; HMLWFELM; MLWFELMK; LWFELMKP; WFELMKPM; FELMKPMT; ELMKPMTS; LMKPMTST; MKPMTSTA; KPMTSTAT; PMTSTATG; MTSTATGR; TSTATGRE; STATGREA; TATGREAA; ATGREAAH; TGREAAHL; GREAAHLR; REAAHLRA; EAAHLRAF; AAHLRAFR; AHLRAFRA; HLRAFRAY; LRAFRAYA; RAFRAYAA; AFRAYAAH; FRAYAAHS; RAYAAHSQ; AYAAHSQE; YAAHSQEI; AAHSQEIA; AHSQEIAL; HSQEIALH; SQEIALHQ; QEIALHQA; EIALHQAH; IALHQAHT; ALHQAHTA; LHQAHTAT; HQAHTATD; QAHTATDA; AHTATDAA; HTATDAAV; TATDAAVQ; ATDAAVQR; TDAAVQRV; DAAVQRVA; AAVQRVAV; AVQRVAVA; VQRVAVAD; QRVAVADW; RVAVADWL; VAVADWLY; AVADWLYW; VADWLYWQ; ADWLYWQY; DWLYWQYV; WLYWQYVT; LYWQYVTG; YWQYVTGL; WQYVTGLL; QYVTGLLD; YVTGLLDR; VTGLLDRA; TGLLDRAL; GLLDRALA; LLDRALAA; LDRALAAA; DRALAAAC;<br><br>9 mers:<br>MSITRPTGS; SITRPTGSY; ITRPTGSYA; TRPTGSYAR; RPTGSYARQ; PTGSYARQM; TGSYARQML; GSYARQMLD; SYARQMLDP; YARQMLDPG; ARQMLDPGG; RQMLDPGGW; QMLDPGGWV; MLDPGGWVE; LDPGGWVEA; DPGGWVEAD; PGGWVEADE; GGWVEADED; GWVEADEDT; WVEADEDTF; VEADEDTFY; EADEDTFYD; ADEDTFYDR; DEDTFYDRA; EDTFYDRAQ; DTFYDRAQE; TFYDRAQEY; FYDRAQEYS; YDRAQEYSQ; DRAQEYSQV; RAQEYSQVL; AQEYSQVLQ; QEYSQVLQR; EYSQVLQRV; YSQVLQRVT; SQVLQRVTD; QVLQRVTDV; VLQRVTDVL; LQRVTDVLD; QRVTDVLDT; RVTDVLDTC; VTDVLDTCR; TDVLDTCRQ; DVLDTCRQQ; VLDTCRQQK; LDTCRQQKG; DTCRQQKGH; TCRQQKGHV; CRQQKGHVF; RQQKGHVFE; QQKGHVFEG; QKGHVFEGG; KGHVFEGGL; GHVFEGGLW; HVFEGGLWS; VFEGGLWSG; FEGGLWSGG; EGGLWSGGA; GGLWSGGAA; GLWSGGAAN; LWSGGAANA; WSGGAANAA; SGGAANAAN; GGAANAANG; GAANAANGA; AANAANGAL; ANAANGALG; NAANGALGA; AANGALGAN; | |

Fig. 28 continued

| | | |
|---|---|---|
| | ANGALGANI; NGALGANIN; GALGANINQ; ALGANINQL; LGANINQLM; GANINQLMT; ANINQLMTL; NINQLMTLQ; INQLMTLQD; NQLMTLQDY; QLMTLQDYL; LMTLQDYLA; MTLQDYLAT; TLQDYLATV; LQDYLATVI; QDYLATVIT; DYLATVITW; YLATVITWH; LATVITWHR; ATVITWHRH; TVITWHRHI; VITWHRHIA; ITWHRHIAG; TWHRHIAGL; WHRHIAGLI; HRHIAGLIE; RHIAGLIEQ; HIAGLIEQA; IAGLIEQAK; AGLIEQAKS; GLIEQAKSD; LIEQAKSDI; IEQAKSDIG; EQAKSDIGN; QAKSDIGNN; AKSDIGNNV; KSDIGNNVD; SDIGNNVDG; DIGNNVDGA; IGNNVDGAQ; GNNVDGAQR; NNVDGAQRE; NVDGAQREI; VDGAQREID; DGAQREIDI; GAQREIDIL; AQREIDILE; QREIDILEN; REIDILEND; EIDILENDP; IDILENDPS; DILENDPSL; ILENDPSLD; LENDPSLDA; ENDPSLDAD; NDPSLDADE; DPSLDADER; PSLDADERH; SLDADERHT; LDADERHTA; DADERHTAI; ADERHTAIN; DERHTAINS; ERHTAINSL; RHTAINSLV; HTAINSLVT; TAINSLVTA; AINSLVTAT; INSLVTATH; NSLVTATHG; SLVTATHGA; LVTATHGAN; VTATHGANV; TATHGANVS; ATHGANVSL; THGANVSLV; HGANVSLVA; GANVSLVAE; ANVSLVAET; NVSLVAETA; VSLVAETAE; SLVAETAER; LVAETAERV; VAETAERVL; AETAERVLE; ETAERVLES; TAERVLESK; AERVLESKN; ERVLESKNW; RVLESKNWK; VLESKNWKP; LESKNWKPP; ESKNWKPPK; SKNWKPPKN; KNWKPPKNA; NWKPPKNAL; WKPPKNALE; KPPKNALED; PPKNALEDL; PKNALEDLL; KNALEDLLQ; NALEDLLQQ; ALEDLLQQK; LEDLLQQKS; EDLLQQKSP; DLLQQKSPP; LLQQKSPPP; LQQKSPPPP; QQKSPPPPD; QKSPPPPDV; KSPPPPDVP; SPPPPDVPT; PPPPDVPTL; PPPDVPTLV; PPDVPTLVV; PDVPTLVVP; DVPTLVVPS; VPTLVVPSP; PTLVVPSPG; TLVVPSPGT; LVVPSPGTP; VVPSPGTPG; VPSPGTPGT; PSPGTPGTP; SPGTPGTPG; PGTPGTPGT; GTPGTPGTP; TPGTPGTPI; PGTPGTPIT; GTPGTPITP; TPGTPITPG; PGTPITPGT; GTPITPGTP; TPITPGTPI; PITPGTPIT; ITPGTPITP; TPGTPITPG; PGTPITPGT; GTPITPGTP; TPITPGTPI; PITPGTPIT; ITPGTPITP; TPGTPITPI; PGTPITPIP; GTPITPIPG; TPITPIPGA; PITPIPGAP; ITPIPGAPV; TPIPGAPVT; PIPGAPVTP; IPGAPVTPI; PGAPVTPIT; GAPVTPITP; APVTPITPT; PVTPITPTP; VTPITPTPG; TPITPTPGT; PITPTPGTP; ITPTPGTPV; TPTPGTPVT; PTPGTPVTP; TPGTPVTPV; PGTPVTPVT; GTPVTPVTP; TPVTPVTPG; PVTPVTPGK; VTPVTPGKP; TPVTPGKPV; PVTPGKPVT; VTPGKPVTP; TPGKPVTPV; PGKPVTPVT; GKPVTPVTP; KPVTPVTPV; PVTPVTPVK; VTPVTPVKP; TPVTPVKPG; PVTPVKPGT; VTPVKPGTP; TPVKPGTPG; PVKPGTPGE; VKPGTPGEP; KPGTPGEPT; PGTPGEPTP; GTPGEPTPI; TPGEPTPIT; PGEPTPITP; GEPTPITPV; EPTPITPVT; PTPITPVTP; TPITPVTPP; PITPVTPPV; ITPVTPPVA; TPVTPPVAP; PVTPPVAPA; VTPPVAPAT; TPPVAPATP; PPVAPATPA; PVAPATPAT; VAPATPATP; APATPATPA; PATPATPAT; ATPATPATP; TPATPATPV; PATPATPVT; ATPATPVTP; TPATPVTPA; PATPVTPAP; ATPVTPAPA; TPVTPAPAP; PVTPAPAPH; VTPAPAPHP; TPAPAPHPQ; PAPAPHPQP; APAPHPQPA; PAPHPQPAP; APHPQPAPA; PHPQPAPAP; HPQPAPAPA; PQPAPAPAP; QPAPAPAPS; PAPAPAPSP; APAPAPSPG; PAPAPSPGP; APAPSPGPQ; PAPSPGPQP; APSPGPQPV; PSPGPQPVT; SPGPQPVTP; PGPQPVTPA; GPQPVTPAT; PQPVTPATP; QPVTPATPG; PVTPATPGP; VTPATPGPS; TPATPGPSG; PATPGPSGP; ATPGPSGPA; TPGPSGPAT; | |

Fig. 28 continued

| | | | |
|---|---|---|---|
| | PGPSGPATP; GPSGPATPG; PSGPATPGT; SGPATPGTP; GPATPGTPG; PATPGTPGG; ATPGTPGGE; TPGTPGGEP; PGTPGGEPA; GTPGGEPAP; TPGGEPAPH; PGGEPAPHV; GGEPAPHVK; GEPAPHVKP; EPAPHVKPA; PAPHVKPAA; APHVKPAAL; PHVKPAALA; HVKPAALAE; VKPAALAEQ; KPAALAEQP; PAALAEQPG; AALAEQPGV; ALAEQPGVP; LAEQPGVPG; AEQPGVPGQ; EQPGVPGQH; QPGVPGQHA; PGVPGQHAG; GVPGQHAGG; VPGQHAGGG; PGQHAGGGT; GQHAGGGTQ; QHAGGGTQS; HAGGGTQSG; AGGGTQSGP; GGGTQSGPA; GGTQSGPAH; GTQSGPAHA; TQSGPAHAD; QSGPAHADE; SGPAHADES; GPAHADESA; PAHADESAA; AHADESAAS; HADESAASV; ADESAASVT; DESAASVTP; ESAASVTPA; SAASVTPAA; AASVTPAAA; ASVTPAAAS; SVTPAAASG; VTPAAASGV; TPAAASGVP; PAAASGVPG; AAASGVPGA; AASGVPGAR; ASGVPGARA; SGVPGARAA; GVPGARAAA; VPGARAAAA; PGARAAAAA; GARAAAAAP; ARAAAAAPS; RAAAAAPSG; AAAAAPSGT; AAAAPSGTA; AAAPSGTAV; AAPSGTAVG; APSGTAVGA; PSGTAVGAG; SGTAVGAGA; GTAVGAGAR; TAVGAGARS; AVGAGARSS; VGAGARSSV; GAGARSSVG; AGARSSVGT; GARSSVGTA; ARSSVGTAA; RSSVGTAAA; SSVGTAAAS; SVGTAAASG; VGTAAASGA; GTAAASGAG; TAAASGAGS; AAASGAGSH; AASGAGSHA; ASGAGSHAA; SGAGSHAAT; GAGSHAATG; AGSHAATGR; GSHAATGRA; SHAATGRAP; HAATGRAPV; AATGRAPVA; ATGRAPVAT; TGRAPVATS; GRAPVATSD; RAPVATSDK; APVATSDKA; PVATSDKAA; VATSDKAAA; ATSDKAAAP; TSDKAAAPS; SDKAAAPST; DKAAAPSTR; KAAAPSTRA; AAAPSTRAA; AAPSTRAAS; APSTRAASA; PSTRAASAR; STRAASART; TRAASARTA; RAASARTAP; AASARTAPP; ASARTAPPA; SARTAPPAR; ARTAPPARP; RTAPPARPP; TAPPARPPS; APPARPPST; PPARPPSTD; PARPPSTDH; ARPPSTDHI; RPPSTDHID; PPSTDHIDK; PSTDHIDKP; STDHIDKPD; TDHIDKPDR; DHIDKPDRS; HIDKPDRSE; IDKPDRSES; DKPDRSESA; KPDRSESAD; PDRSESADD; DRSESADDG; RSESADDGT; SESADDGTP; ESADDGTPV; SADDGTPVS; ADDGTPVSM; DDGTPVSMI; DGTPVSMIP; GTPVSMIPV; TPVSMIPVS; PVSMIPVSA; VSMIPVSAA; SMIPVSAAR; MIPVSAARA; IPVSAARAA; PVSAARAAR; VSAARAARD; SAARAARDA; AARAARDAA; ARAARDAAT; RAARDAATA; AARDAATAA; ARDAATAAA; RDAATAAAS; DAATAAASA; AATAAASAR; ATAAASARQ; TAAASARQR; AAASARQRG; AASARQRGR; ASARQRGRG; SARQRGRGD; ARQRGRGDA; RQRGRGDAL; QRGRGDALR; RGRGDALRL; GRGDALRLA; RGDALRLAR; GDALRLARR; DALRLARRI; ALRLARRIA; LRLARRIAA; RLARRIAAA; LARRIAAAL; ARRIAAALN; RRIAAALNA; RIAAALNAS; IAAALNASD; AAALNASDN; AALNASDNN; ALNASDNNA; LNASDNNAG; NASDNNAGD; ASDNNAGDY; SDNNAGDYG; DNNAGDYGF; NNAGDYGFF; NAGDYGFFW; AGDYGFFWI; GDYGFFWIT; DYGFFWITA; YGFFWITAV; GFFWITAVT; FFWITAVTT; FWITAVTTD; WITAVTTDG; ITAVTTDGS; TAVTTDGSI; AVTTDGSIV; VTTDGSIVV; TTDGSIVVA; TDGSIVVAN; DGSIVVANS; GSIVVANSY; SIVVANSYG; IVVANSYGL; VVANSYGLA; VANSYGLAY; ANSYGLAYI; NSYGLAYIP; SYGLAYIPD; YGLAYIPDG; GLAYIPDGM; LAYIPDGME; AYIPDGMEL; | |

Fig. 28 continued

| | | | |
|---|---|---|---|
| | YIPDGMELP; IPDGMELPN; PDGMELPNK; DGMELPNKV; GMELPNKVY; MELPNKVYL; ELPNKVYLA; LPNKVYLAS; PNKVYLASA; NKVYLASAD; KVYLASADH; VYLASADHA; YLASADHAI; LASADHAIP; ASADHAIPV; SADHAIPVD; ADHAIPVDE; DHAIPVDEI; HAIPVDEIA; AIPVDEIAR; IPVDEIARC; PVDEIARCA; VDEIARCAT; DEIARCATY; EIARCATYP; IARCATYPV; ARCATYPVL; RCATYPVLA; CATYPVLAV; ATYPVLAVQ; TYPVLAVQA; YPVLAVQAW; PVLAVQAWA; VLAVQAWAA; LAVQAWAAF; AVQAWAAFH; VQAWAAFHD; QAWAAFHDM; AWAAFHDMT; WAAFHDMTL; AAFHDMTLR; AFHDMTLRA; FHDMTLRAV; HDMTLRAVI; DMTLRAVIG; MTLRAVIGT; TLRAVIGTA; LRAVIGTAE; RAVIGTAEQ; AVIGTAEQL; VIGTAEQLA; IGTAEQLAS; GTAEQLASS; TAEQLASSD; AEQLASSDP; EQLASSDPG; QLASSDPGV; LASSDPGVA; ASSDPGVAK; SSDPGVAKI; SDPGVAKIV; DPGVAKIVL; PGVAKIVLE; GVAKIVLEP; VAKIVLEPD; AKIVLEPDD; KIVLEPDDI; IVLEPDDIP; VLEPDDIPE; LEPDDIPES; EPDDIPESG; PDDIPESGK; DDIPESGKM; DIPESGKMT; IPESGKMTG; PESGKMTGR; ESGKMTGRS; SGKMTGRSR; GKMTGRSRL; KMTGRSRLE; MTGRSRLEV; TGRSRLEVV; GRSRLEVVD; RSRLEVVDP; SRLEVVDPS; RLEVVDPSA; LEVVDPSAA; EVVDPSAAA; VVDPSAAAQ; VDPSAAAQL; DPSAAAQLA; PSAAAQLAD; SAAAQLADT; AAAQLADTT; AAQLADTTD; AQLADTTDQ; QLADTTDQR; LADTTDQRL; ADTTDQRLL; DTTDQRLLD; TTDQRLLDL; TDQRLLDLL; DQRLLDLLP; QRLLDLLPP; RLLDLLPPA; LLDLLPPAP; LDLLPPAPV; DLLPPAPVD; LLPPAPVDV; LPPAPVDVN; PPAPVDVNP; PAPVDVNPP; APVDVNPPG; PVDVNPPGD; VDVNPPGDE; DVNPPGDER; VNPPGDERH; NPPGDERHM; PPGDERHML; PGDERHMLW; GDERHMLWF; DERHMLWFE; ERHMLWFEL; RHMLWFELM; HMLWFELMK; MLWFELMKP; LWFELMKPM; WFELMKPMT; FELMKPMTS; ELMKPMTST; LMKPMTSTA; MKPMTSTAT; KPMTSTATG; PMTSTATGR; MTSTATGRE; TSTATGREA; STATGREAA; TATGREAAH; ATGREAAHL; TGREAAHLR; GREAAHLRA; REAAHLRAF; EAAHLRAFR; AAHLRAFRA; AHLRAFRAY; HLRAFRAYA; LRAFRAYAA; RAFRAYAAH; AFRAYAAHS; FRAYAAHSQ; RAYAAHSQE; AYAAHSQEI; YAAHSQEIA; AAHSQEIAL; AHSQEIALH; HSQEIALHQ; SQEIALHQA; QEIALHQAH; EIALHQAHT; IALHQAHTA; ALHQAHTAT; LHQAHTATD; HQAHTATDA; QAHTATDAA; AHTATDAAV; HTATDAAVQ; TATDAAVQR; ATDAAVQRV; TDAAVQRVA; DAAVQRVAV; AAVQRVAVA; AVQRVAVAD; VQRVAVADW; QRVAVADWL; RVAVADWLY; VAVADWLYW; AVADWLYWQ; VADWLYWQY; ADWLYWQYV; DWLYWQYVT; WLYWQYVTG; LYWQYVTGL; YWQYVTGLL; WQYVTGLLD; QYVTGLLDR; YVTGLLDRA; VTGLLDRAL; TGLLDRALA; GLLDRALAA; LLDRALAAA; LDRALAAAC;<br><br>10 mers:<br>MSITRPTGSY; SITRPTGSYA; ITRPTGSYAR; TRPTGSYARQ; RPTGSYARQM; PTGSYARQML; TGSYARQMLD; GSYARQMLDP; SYARQMLDPG; YARQMLDPGG; ARQMLDPGGW; RQMLDPGGWV; QMLDPGGWVE; MLDPGGWVEA; LDPGGWVEAD; DPGGWVEADE; PGGWVEADED; GGWVEADEDT; GWVEADEDTF; WVEADEDTFY; VEADEDTFYD; EADEDTFYDR; ADEDTFYDRA; DEDTFYDRAQ; | |

Fig. 28 continued

| | | |
|---|---|---|
| | EDTFYDRAQE; DTFYDRAQEY; TFYDRAQEYS; FYDRAQEYSQ; YDRAQEYSQV; DRAQEYSQVL; RAQEYSQVLQ; AQEYSQVLQR; QEYSQVLQRV; EYSQVLQRVT; YSQVLQRVTD; SQVLQRVTDV; QVLQRVTDVL; VLQRVTDVLD; LQRVTDVLDT; QRVTDVLDTC; RVTDVLDTCR; VTDVLDTCRQ; TDVLDTCRQQ; DVLDTCRQQK; VLDTCRQQKG; LDTCRQQKGH; DTCRQQKGHV; TCRQQKGHVF; CRQQKGHVFE; RQQKGHVFEG; QQKGHVFEGG; QKGHVFEGGL; KGHVFEGGLW; GHVFEGGLWS; HVFEGGLWSG; VFEGGLWSGG; FEGGLWSGGA; EGGLWSGGAA; GGLWSGGAAN; GLWSGGAANA; LWSGGAANAA; WSGGAANAAN; SGGAANAANG; GGAANAANGA; GAANAANGAL; AANAANGALG; ANAANGALGA; NAANGALGAN; AANGALGANI; ANGALGANIN; NGALGANINQ; GALGANINQL; ALGANINQLM; LGANINQLMT; GANINQLMTL; ANINQLMTLQ; NINQLMTLQD; INQLMTLQDY; NQLMTLQDYL; QLMTLQDYLA; LMTLQDYLAT; MTLQDYLATV; TLQDYLATVI; LQDYLATVIT; QDYLATVITW; DYLATVITWH; YLATVITWHR; LATVITWHRH; ATVITWHRHI; TVITWHRHIA; VITWHRHIAG; ITWHRHIAGL; TWHRHIAGLI; WHRHIAGLIE; HRHIAGLIEQ; RHIAGLIEQA; HIAGLIEQAK; IAGLIEQAKS; AGLIEQAKSD; GLIEQAKSDI; LIEQAKSDIG; IEQAKSDIGN; EQAKSDIGNN; QAKSDIGNNV; AKSDIGNNVD; KSDIGNNVDG; SDIGNNVDGA; DIGNNVDGAQ; IGNNVDGAQR; GNNVDGAQRE; NNVDGAQREI; NVDGAQREID; VDGAQREIDI; DGAQREIDIL; GAQREIDILE; AQREIDILEN; QREIDILEND; REIDILENDP; EIDILENDPS; IDILENDPSL; DILENDPSLD; ILENDPSLDA; LENDPSLDAD; ENDPSLDADE; NDPSLDADER; DPSLDADERH; PSLDADERHT; SLDADERHTA; LDADERHTAI; DADERHTAIN; ADERHTAINS; DERHTAINSL; ERHTAINSLV; RHTAINSLVT; HTAINSLVTA; TAINSLVTAT; AINSLVTATH; INSLVTATHG; NSLVTATHGA; SLVTATHGAN; LVTATHGANV; VTATHGANVS; TATHGANVSL; ATHGANVSLV; THGANVSLVA; HGANVSLVAE; GANVSLVAET; ANVSLVAETA; NVSLVAETAE; VSLVAETAER; SLVAETAERV; LVAETAERVL; VAETAERVLE; AETAERVLES; ETAERVLESK; TAERVLESKN; AERVLESKNW; ERVLESKNWK; RVLESKNWKP; VLESKNWKPP; LESKNWKPPK; ESKNWKPPKN; SKNWKPPKNA; KNWKPPKNAL; NWKPPKNALE; WKPPKNALED; KPPKNALEDL; PPKNALEDLL; PKNALEDLLQ; KNALEDLLQQ; NALEDLLQQK; ALEDLLQQKS; LEDLLQQKSP; EDLLQQKSPP; DLLQQKSPPP; LLQQKSPPPP; LQQKSPPPPD; QQKSPPPPDV; QKSPPPPDVP; KSPPPPDVPT; SPPPPDVPTL; PPPPDVPTLV; PPPDVPTLVV; PPDVPTLVVP; PDVPTLVVPS; DVPTLVVPSP; VPTLVVPSPG; PTLVVPSPGT; TLVVPSPGTP; LVVPSPGTPG; VVPSPGTPGT; VPSPGTPGTP; PSPGTPGTPG; SPGTPGTPGT; PGTPGTPGTP; GTPGTPGTPI; TPGTPGTPIT; PGTPGTPITP; GTPGTPITPG; TPGTPITPGT; PGTPITPGTP; GTPITPGTPI; TPITPGTPIT; PITPGTPITP; ITPGTPITPG; TPGTPITPGT; PGTPITPGTP; GTPITPGTPI; TPITPGTPIT; PITPGTPITP; ITPGTPITPI; TPGTPITPIP; PGTPITPIPG; GTPITPIPGA; TPITPIPGAP; PITPIPGAPV; ITPIPGAPVT; TPIPGAPVTP; PIPGAPVTPI; IPGAPVTPIT; PGAPVTPITP; GAPVTPITPT; APVTPITPTP; PVTPITPTPG; VTPITPTPGT; TPITPTPGTP; PITPTPGTPV; ITPTPGTPVT; TPTPGTPVTP; PTPGTPVTPV; TPGTPVTPVT; PGTPVTPVTP; GTPVTPVTPG; TPVTPVTPGK; PVTPVTPGKP; VTPVTPGKPV; TPVTPGKPVT; | |

Fig. 28 continued

| | | | |
|---|---|---|---|
| | PVTPGKPVTP; VTPGKPVTPV; TPGKPVTPVT; PGKPVTPVTP;<br>GKPVTPVTPV; KPVTPVTPVK; PVTPVTPVKP; VTPVTPVKPG;<br>TPVTPVKPGT; PVTPVKPGTP; VTPVKPGTPG; TPVKPGTPGE;<br>PVKPGTPGEP; VKPGTPGEPT; KPGTPGEPTP; PGTPGEPTPI;<br>GTPGEPTPIT; TPGEPTPITP; PGEPTPITPV; GEPTPITPVT;<br>EPTPITPVTP; PTPITPVTPP; TPITPVTPPV; PITPVTPPVA;<br>ITPVTPPVAP; TPVTPPVAPA; PVTPPVAPAT; VTPPVAPATP;<br>TPPVAPATPA; PPVAPATPAT; PVAPATPATP; VAPATPATPA;<br>APATPATPAT; PATPATPATP; ATPATPATPV; TPATPATPVT;<br>PATPATPVTP; ATPATPVTPA; TPATPVTPAP; PATPVTPAPA;<br>ATPVTPAPAP; TPVTPAPAPH; PVTPAPAPHP; VTPAPAPHPQ;<br>TPAPAPHPQP; PAPAPHPQPA; APAPHPQPAP; PAPHPQPAPA;<br>APHPQPAPAP; PHPQPAPAPA; HPQPAPAPAP; PQPAPAPAPS;<br>QPAPAPAPSP; PAPAPAPSPG; APAPAPSPGP; PAPAPSPGPQ;<br>APAPSPGPQP; PAPSPGPQPV; APSPGPQPVT; PSPGPQPVTP;<br>SPGPQPVTPA; PGPQPVTPAT; GPQPVTPATP; PQPVTPATPG;<br>QPVTPATPGP; PVTPATPGPS; VTPATPGPSG; TPATPGPSGP;<br>PATPGPSGPA; ATPGPSGPAT; TPGPSGPATP; PGPSGPATPG;<br>GPSGPATPGT; PSGPATPGTP; SGPATPGTPG; GPATPGTPGG;<br>PATPGTPGGE; ATPGTPGGEP; TPGTPGGEPA; PGTPGGEPAP;<br>GTPGGEPAPH; TPGGEPAPHV; PGGEPAPHVK; GGEPAPHVKP;<br>GEPAPHVKPA; EPAPHVKPAA; PAPHVKPAAL; APHVKPAALA;<br>PHVKPAALAE; HVKPAALAEQ; VKPAALAEQP; KPAALAEQPG;<br>PAALAEQPGV; AALAEQPGVP; ALAEQPGVPG; LAEQPGVPGQ;<br>AEQPGVPGQH; EQPGVPGQHA; QPGVPGQHAG; PGVPGQHAGG;<br>GVPGQHAGGG; VPGQHAGGGT; PGQHAGGGTQ; GQHAGGGTQS;<br>QHAGGGTQSG; HAGGGTQSGP; AGGGTQSGPA; GGGTQSGPAH;<br>GGTQSGPAHA; GTQSGPAHAD; TQSGPAHADE; QSGPAHADES;<br>SGPAHADESA; GPAHADESAA; PAHADESAAS; AHADESAASV;<br>HADESAASVT; ADESAASVTP; DESAASVTPA; ESAASVTPAA;<br>SAASVTPAAA; AASVTPAAAS; ASVTPAAASG; SVTPAAASGV;<br>VTPAAASGVP; TPAAASGVPG; PAAASGVPGA; AAASGVPGAR;<br>AASGVPGARA; ASGVPGARAA; SGVPGARAAA; GVPGARAAAA;<br>VPGARAAAAA; PGARAAAAAP; GARAAAAAPS; ARAAAAAPSG;<br>RAAAAAPSGT; AAAAAPSGTA; AAAAPSGTAV; AAAPSGTAVG;<br>AAPSGTAVGA; APSGTAVGAG; PSGTAVGAGA; SGTAVGAGAR;<br>GTAVGAGARS; TAVGAGARSS; AVGAGARSSV; VGAGARSSVG;<br>GAGARSSVGT; AGARSSVGTA; GARSSVGTAA; ARSSVGTAAA;<br>RSSVGTAAAS; SSVGTAAASG; SVGTAAASGA; VGTAAASGAG;<br>GTAAASGAGS; TAAASGAGSH; AAASGAGSHA; AASGAGSHAA;<br>ASGAGSHAAT; SGAGSHAATG; GAGSHAATGR; AGSHAATGRA;<br>GSHAATGRAP; SHAATGRAPV; HAATGRAPVA; AATGRAPVAT;<br>ATGRAPVATS; TGRAPVATSD; GRAPVATSDK; RAPVATSDKA;<br>APVATSDKAA; PVATSDKAAA; VATSDKAAAP; ATSDKAAAPS;<br>TSDKAAAPST; SDKAAAPSTR; DKAAAPSTRA; KAAAPSTRAA;<br>AAAPSTRAAS; AAPSTRAASA; APSTRAASAR; PSTRAASART;<br>STRAASARTA; TRAASARTAP; RAASARTAPP; AASARTAPPA;<br>ASARTAPPAR; SARTAPPARP; ARTAPPARPP; RTAPPARPPS;<br>TAPPARPPST; APPARPPSTD; PPARPPSTDH; PARPPSTDHI;<br>ARPPSTDHID; RPPSTDHIDK; PPSTDHIDKP; PSTDHIDKPD;<br>STDHIDKPDR; TDHIDKPDRS; DHIDKPDRSE; HIDKPDRSES;<br>IDKPDRSESA; DKPDRSESAD; KPDRSESADD; PDRSESADDG;<br>DRSESADDGT; RSESADDGTP; SESADDGTPV; ESADDGTPVS; | | |

Fig. 28 continued

| | | |
|---|---|---|
| | SADDGTPVSM; ADDGTPVSMI; DDGTPVSMIP; DGTPVSMIPV; GTPVSMIPVS; TPVSMIPVSA; PVSMIPVSAA; VSMIPVSAAR; SMIPVSAARA; MIPVSAARAA; IPVSAARAAR; PVSAARAARD; VSAARAARDA; SAARAARDAA; AARAARDAAT; ARAARDAATA; RAARDAATAA; AARDAATAAA; ARDAATAAAS; RDAATAAASA; DAATAAASAR; AATAAASARQ; ATAAASARQR; TAAASARQRG; AAASARQRGR; AASARQRGRG; ASARQRGRGD; SARQRGRGDA; ARQRGRGDAL; RQRGRGDALR; QRGRGDALRL; RGRGDALRLA; GRGDALRLAR; RGDALRLARR; GDALRLARRI; DALRLARRIA; ALRLARRIAA; LRLARRIAAA; RLARRIAAAL; LARRIAAALN; ARRIAAALNA; RRIAAALNAS; RIAAALNASD; IAAALNASDN; AAALNASDNN; AALNASDNNA; ALNASDNNAG; LNASDNNAGD; NASDNNAGDY; ASDNNAGDYG; SDNNAGDYGF; DNNAGDYGFF; NNAGDYGFFW; NAGDYGFFWI; AGDYGFFWIT; GDYGFFWITA; DYGFFWITAV; YGFFWITAVT; GFFWITAVTT; FFWITAVTTD; FWITAVTTDG; WITAVTTDGS; ITAVTTDGSI; TAVTTDGSIV; AVTTDGSIVV; VTTDGSIVVA; TTDGSIVVAN; TDGSIVVANS; DGSIVVANSY; GSIVVANSYG; SIVVANSYGL; IVVANSYGLA; VVANSYGLAY; VANSYGLAYI; ANSYGLAYIP; NSYGLAYIPD; SYGLAYIPDG; YGLAYIPDGM; GLAYIPDGME; LAYIPDGMEL; AYIPDGMELP; YIPDGMELPN; IPDGMELPNK; PDGMELPNKV; DGMELPNKVY; GMELPNKVYL; MELPNKVYLA; ELPNKVYLAS; LPNKVYLASA; PNKVYLASAD; NKVYLASADH; KVYLASADHA; VYLASADHAI; YLASADHAIP; LASADHAIPV; ASADHAIPVD; SADHAIPVDE; ADHAIPVDEI; DHAIPVDEIA; HAIPVDEIAR; AIPVDEIARC; IPVDEIARCA; PVDEIARCAT; VDEIARCATY; DEIARCATYP; EIARCATYPV; IARCATYPVL; ARCATYPVLA; RCATYPVLAV; CATYPVLAVQ; ATYPVLAVQA; TYPVLAVQAW; YPVLAVQAWA; PVLAVQAWAA; VLAVQAWAAF; LAVQAWAAFH; AVQAWAAFHD; VQAWAAFHDM; QAWAAFHDMT; AWAAFHDMTL; WAAFHDMTLR; AAFHDMTLRA; AFHDMTLRAV; FHDMTLRAVI; HDMTLRAVIG; DMTLRAVIGT; MTLRAVIGTA; TLRAVIGTAE; LRAVIGTAEQ; RAVIGTAEQL; AVIGTAEQLA; VIGTAEQLAS; IGTAEQLASS; GTAEQLASSD; TAEQLASSDP; AEQLASSDPG; EQLASSDPGV; QLASSDPGVA; LASSDPGVAK; ASSDPGVAKI; SSDPGVAKIV; SDPGVAKIVL; DPGVAKIVLE; PGVAKIVLEP; GVAKIVLEPD; VAKIVLEPDD; AKIVLEPDDI; KIVLEPDDIP; IVLEPDDIPE; VLEPDDIPES; LEPDDIPESG; EPDDIPESGK; PDDIPESGKM; DDIPESGKMT; DIPESGKMTG; IPESGKMTGR; PESGKMTGRS; ESGKMTGRSR; SGKMTGRSRL; GKMTGRSRLE; KMTGRSRLEV; MTGRSRLEVV; TGRSRLEVVD; GRSRLEVVDP; RSRLEVVDPS; SRLEVVDPSA; RLEVVDPSAA; LEVVDPSAAA; EVVDPSAAAQ; VVDPSAAAQL; VDPSAAAQLA; DPSAAAQLAD; PSAAAQLADT; SAAAQLADTT; AAAQLADTTD; AAQLADTTDQ; AQLADTTDQR; QLADTTDQRL; LADTTDQRLL; ADTTDQRLLD; DTTDQRLLDL; TTDQRLLDLL; TDQRLLDLLP; DQRLLDLLPP; QRLLDLLPPA; RLLDLLPPAP; LLDLLPPAPV; LDLLPPAPVD; DLLPPAPVDV; LLPPAPVDVN; LPPAPVDVNP; PPAPVDVNPP; PAPVDVNPPG; APVDVNPPGD; PVDVNPPGDE; VDVNPPGDER; DVNPPGDERH; VNPPGDERHM; NPPGDERHML; PPGDERHMLW; PGDERHMLWF; GDERHMLWFE; DERHMLWFEL; ERHMLWFELM; RHMLWFELMK; HMLWFELMKP; MLWFELMKPM; LWFELMKPMT; WFELMKPMTS; FELMKPMTST; ELMKPMTSTA; LMKPMTSTAT; | |

Fig. 28 continued

| | | |
|---|---|---|
| | MKPMTSTATG; KPMTSTATGR; PMTSTATGRE; MTSTATGREA; TSTATGREAA; STATGREAAH; TATGREAAHL; ATGREAAHLR; TGREAAHLRA; GREAAHLRAF; REAAHLRAFR; EAAHLRAFRA; AAHLRAFRAY; AHLRAFRAYA; HLRAFRAYAA; LRAFRAYAAH; RAFRAYAAHS; AFRAYAAHSQ; FRAYAAHSQE; RAYAAHSQEI; AYAAHSQEIA; YAAHSQEIAL; AAHSQEIALH; AHSQEIALHQ; HSQEIALHQA; SQEIALHQAH; QEIALHQAHT; EIALHQAHTA; IALHQAHTAT; ALHQAHTATD; LHQAHTATDA; HQAHTATDAA; QAHTATDAAV; AHTATDAAVQ; HTATDAAVQR; TATDAAVQRV; ATDAAVQRVA; TDAAVQRVAV; DAAVQRVAVA; AAVQRVAVAD; AVQRVAVADW; VQRVAVADWL; QRVAVADWLY; RVAVADWLYW; VAVADWLYWQ; AVADWLYWQY; VADWLYWQYV; ADWLYWQYVT; DWLYWQYVTG; WLYWQYVTGL; LYWQYVTGLL; YWQYVTGLLD; WQYVTGLLDR; QYVTGLLDRA; YVTGLLDRAL; VTGLLDRALA; TGLLDRALAA; GLLDRALAAA; LLDRALAAAC;<br><br>11 mers:<br>MSITRPTGSYA; SITRPTGSYAR; ITRPTGSYARQ; TRPTGSYARQM; RPTGSYARQML; PTGSYARQMLD; TGSYARQMLDP; GSYARQMLDPG; SYARQMLDPGG; YARQMLDPGGW; ARQMLDPGGWV; RQMLDPGGWVE; QMLDPGGWVEA; MLDPGGWVEAD; LDPGGWVEADE; DPGGWVEADED; PGGWVEADEDT; GGWVEADEDTF; GWVEADEDTFY; WVEADEDTFYD; VEADEDTFYDR; EADEDTFYDRA; ADEDTFYDRAQ; DEDTFYDRAQE; EDTFYDRAQEY; DTFYDRAQEYS; TFYDRAQEYSQ; FYDRAQEYSQV; YDRAQEYSQVL; DRAQEYSQVLQ; RAQEYSQVLQR; AQEYSQVLQRV; QEYSQVLQRVT; EYSQVLQRVTD; YSQVLQRVTDV; SQVLQRVTDVL; QVLQRVTDVLD; VLQRVTDVLDT; LQRVTDVLDTC; QRVTDVLDTCR; RVTDVLDTCRQ; VTDVLDTCRQQ; TDVLDTCRQQK; DVLDTCRQQKG; VLDTCRQQKGH; LDTCRQQKGHV; DTCRQQKGHVF; TCRQQKGHVFE; CRQQKGHVFEG; RQQKGHVFEGG; QQKGHVFEGGL; QKGHVFEGGLW; KGHVFEGGLWS; GHVFEGGLWSG; HVFEGGLWSGG; VFEGGLWSGGA; FEGGLWSGGAA; EGGLWSGGAAN; GGLWSGGAANA; GLWSGGAANAA; LWSGGAANAAN; WSGGAANAANG; SGGAANAANGA; GGAANAANGAL; GAANAANGALG; AANAANGALGA; ANAANGALGAN; NAANGALGANI; AANGALGANIN; ANGALGANINQ; NGALGANINQL; GALGANINQLM; ALGANINQLMT; LGANINQLMTL; GANINQLMTLQ; ANINQLMTLQD; NINQLMTLQDY; INQLMTLQDYL; NQLMTLQDYLA; QLMTLQDYLAT; LMTLQDYLATV; MTLQDYLATVI; TLQDYLATVIT; LQDYLATVITW; QDYLATVITWH; DYLATVITWHR; YLATVITWHRH; LATVITWHRHI; ATVITWHRHIA; TVITWHRHIAG; VITWHRHIAGL; ITWHRHIAGLI; TWHRHIAGLIE; WHRHIAGLIEQ; HRHIAGLIEQA; RHIAGLIEQAK; HIAGLIEQAKS; IAGLIEQAKSD; AGLIEQAKSDI; GLIEQAKSDIG; LIEQAKSDIGN; IEQAKSDIGNN; EQAKSDIGNNV; QAKSDIGNNVD; AKSDIGNNVDG; KSDIGNNVDGA; SDIGNNVDGAQ; DIGNNVDGAQR; IGNNVDGAQRE; GNNVDGAQREI; NNVDGAQREID; NVDGAQREIDI; VDGAQREIDIL; DGAQREIDILE; GAQREIDILEN; AQREIDILEND; QREIDILENDP; REIDILENDPS; EIDILENDPSL; IDILENDPSLD; DILENDPSLDA; ILENDPSLDAD; LENDPSLDADE; ENDPSLDADER; NDPSLDADERH; DPSLDADERHT; PSLDADERHTA; SLDADERHTAI; LDADERHTAIN; | |

Fig. 28 continued

| | | |
|---|---|---|
| | DADERHTAINS; ADERHTAINSL; DERHTAINSLV; ERHTAINSLVT; RHTAINSLVTA; HTAINSLVTAT; TAINSLVTATH; AINSLVTATHG; INSLVTATHGA; NSLVTATHGAN; SLVTATHGANV; LVTATHGANVS; VTATHGANVSL; TATHGANVSLV; ATHGANVSLVA; THGANVSLVAE; HGANVSLVAET; GANVSLVAETA; ANVSLVAETAE; NVSLVAETAER; VSLVAETAERV; SLVAETAERVL; LVAETAERVLE; VAETAERVLES; AETAERVLESK; ETAERVLESKN; TAERVLESKNW; AERVLESKNWK; ERVLESKNWKP; RVLESKNWKPP; VLESKNWKPPK; LESKNWKPPKN; ESKNWKPPKNA; SKNWKPPKNAL; KNWKPPKNALE; NWKPPKNALED; WKPPKNALEDL; KPPKNALEDLL; PPKNALEDLLQ; PKNALEDLLQQ; KNALEDLLQQK; NALEDLLQQKS; ALEDLLQQKSP; LEDLLQQKSPP; EDLLQQKSPPP; DLLQQKSPPPP; LLQQKSPPPPD; LQQKSPPPPDV; QQKSPPPPDVP; QKSPPPPDVPT; KSPPPPDVPTL; SPPPPDVPTLV; PPPPDVPTLVV; PPPDVPTLVVP; PPDVPTLVVPS; PDVPTLVVPSP; DVPTLVVPSPG; VPTLVVPSPGT; PTLVVPSPGTP; TLVVPSPGTPG; LVVPSPGTPGT; VVPSPGTPGTP; VPSPGTPGTPG; PSPGTPGTPGT; SPGTPGTPGTP; PGTPGTPGTPI; GTPGTPGTPIT; TPGTPGTPITP; PGTPGTPITPG; GTPGTPITPGT; TPGTPITPGTP; PGTPITPGTPI; GTPITPGTPIT; TPITPGTPITP; PITPGTPITPG; ITPGTPITPGT; TPGTPITPGTP; PGTPITPGTPI; GTPITPGTPIT; TPITPGTPITP; PITPGTPITPI; ITPGTPITPIP; TPGTPITPIPG; PGTPITPIPGA; GTPITPIPGAP; TPITPIPGAPV; PITPIPGAPVT; ITPIPGAPVTP; TPIPGAPVTPI; PIPGAPVTPIT; IPGAPVTPITP; PGAPVTPITPT; GAPVTPITPTP; APVTPITPTPG; PVTPITPTPGT; VTPITPTPGTP; TPITPTPGTPV; PITPTPGTPVT; ITPTPGTPVTP; TPTPGTPVTPV; PTPGTPVTPVT; TPGTPVTPVTP; PGTPVTPVTPG; GTPVTPVTPGK; TPVTPVTPGKP; PVTPVTPGKPV; VTPVTPGKPVT; TPVTPGKPVTP; PVTPGKPVTPV; VTPGKPVTPVT; TPGKPVTPVTP; PGKPVTPVTPV; GKPVTPVTPVK; KPVTPVTPVKP; PVTPVTPVKPG; VTPVTPVKPGT; TPVTPVKPGTP; PVTPVKPGTPG; VTPVKPGTPGE; TPVKPGTPGEP; PVKPGTPGEPT; VKPGTPGEPTP; KPGTPGEPTPI; PGTPGEPTPIT; GTPGEPTPITP; TPGEPTPITPV; PGEPTPITPVT; GEPTPITPVTP; EPTPITPVTPP; PTPITPVTPPV; TPITPVTPPVA; PITPVTPPVAP; ITPVTPPVAPA; TPVTPPVAPAT; PVTPPVAPATP; VTPPVAPATPA; TPPVAPATPAT; PPVAPATPATP; PVAPATPATPA; VAPATPATPAT; APATPATPATP; PATPATPATPV; ATPATPATPVT; TPATPATPVTP; PATPATPVTPA; ATPATPVTPAP; TPATPVTPAPA; PATPVTPAPAP; ATPVTPAPAPH; TPVTPAPAPHP; PVTPAPAPHPQ; VTPAPAPHPQP; TPAPAPHPQPA; PAPAPHPQPAP; APAPHPQPAPA; PAPHPQPAPAP; APHPQPAPAPA; PHPQPAPAPAP; HPQPAPAPAPS; PQPAPAPAPSP; QPAPAPAPSPG; PAPAPAPSPGP; APAPAPSPGPQ; PAPAPSPGPQP; APAPSPGPQPV; PAPSPGPQPVT; APSPGPQPVTP; PSPGPQPVTPA; SPGPQPVTPAT; PGPQPVTPATP; GPQPVTPATPG; PQPVTPATPGP; QPVTPATPGPS; PVTPATPGPSG; VTPATPGPSGP; TPATPGPSGPA; PATPGPSGPAT; ATPGPSGPATP; TPGPSGPATPG; PGPSGPATPGT; GPSGPATPGTP; PSGPATPGTPG; SGPATPGTPGG; GPATPGTPGGE; PATPGTPGGEP; ATPGTPGGEPA; TPGTPGGEPAP; PGTPGGEPAPH; GTPGGEPAPHV; TPGGEPAPHVK; PGGEPAPHVKP; GGEPAPHVKPA; GEPAPHVKPAA; EPAPHVKPAAL; PAPHVKPAALA; APHVKPAALAE; PHVKPAALAEQ; HVKPAALAEQP; VKPAALAEQPG; KPAALAEQPGV; PAALAEQPGVP; AALAEQPGVPG; ALAEQPGVPGQ; LAEQPGVPGQH; AEQPGVPGQHA; EQPGVPGQHAG; | |

Fig. 28 continued

| | | |
|---|---|---|
| | QPGVPGQHAGG; PGVPGQHAGGG; GVPGQHAGGGT; VPGQHAGGGTQ; PGQHAGGGTQS; GQHAGGGTQSG; QHAGGGTQSGP; HAGGGTQSGPA; AGGGTQSGPAH; GGGTQSGPAHA; GGTQSGPAHAD; GTQSGPAHADE; TQSGPAHADES; QSGPAHADESA; SGPAHADESAA; GPAHADESAAS; PAHADESAASV; AHADESAASVT; HADESAASVTP; ADESAASVTPA; DESAASVTPAA; ESAASVTPAAA; SAASVTPAAAS; AASVTPAAASG; ASVTPAAASGV; SVTPAAASGVP; VTPAAASGVPG; TPAAASGVPGA; PAAASGVPGAR; AAASGVPGARA; AASGVPGARAA; ASGVPGARAAA; SGVPGARAAAA; GVPGARAAAAA; VPGARAAAAAP; PGARAAAAAPS; GARAAAAAPSG; ARAAAAAPSGT; RAAAAAPSGTA; AAAAAPSGTAV; AAAAPSGTAVG; AAAPSGTAVGA; AAPSGTAVGAG; APSGTAVGAGA; PSGTAVGAGAR; SGTAVGAGARS; GTAVGAGARSS; TAVGAGARSSV; AVGAGARSSVG; VGAGARSSVGT; GAGARSSVGTA; AGARSSVGTAA; GARSSVGTAAA; ARSSVGTAAAS; RSSVGTAAASG; SSVGTAAASGA; SVGTAAASGAG; VGTAAASGAGS; GTAAASGAGSH; TAAASGAGSHA; AAASGAGSHAA; AASGAGSHAAT; ASGAGSHAATG; SGAGSHAATGR; GAGSHAATGRA; AGSHAATGRAP; GSHAATGRAPV; SHAATGRAPVA; HAATGRAPVAT; AATGRAPVATS; ATGRAPVATSD; TGRAPVATSDK; GRAPVATSDKA; RAPVATSDKAA; APVATSDKAAA; PVATSDKAAAP; VATSDKAAAPS; ATSDKAAAPST; TSDKAAAPSTR; SDKAAAPSTRA; DKAAAPSTRAA; KAAAPSTRAAS; AAAPSTRAASA; AAPSTRAASAR; APSTRAASART; PSTRAASARTA; STRAASARTAP; TRAASARTAPP; RAASARTAPPA; AASARTAPPAR; ASARTAPPARP; SARTAPPARPP; ARTAPPARPPS; RTAPPARPPST; TAPPARPPSTD; APPARPPSTDH; PPARPPSTDHI; PARPPSTDHID; ARPPSTDHIDK; RPPSTDHIDKP; PPSTDHIDKPD; PSTDHIDKPDR; STDHIDKPDRS; TDHIDKPDRSE; DHIDKPDRSES; HIDKPDRSESA; IDKPDRSESAD; DKPDRSESADD; KPDRSESADDG; PDRSESADDGT; DRSESADDGTP; RSESADDGTPV; SESADDGTPVS; ESADDGTPVSM; SADDGTPVSMI; ADDGTPVSMIP; DDGTPVSMIPV; DGTPVSMIPVS; GTPVSMIPVSA; TPVSMIPVSAA; PVSMIPVSAAR; VSMIPVSAARA; SMIPVSAARAA; MIPVSAARAAR; IPVSAARAARD; PVSAARAARDA; VSAARAARDAA; SAARAARDAAT; AARAARDAATA; ARAARDAATAA; RAARDAATAAA; AARDAATAAAS; ARDAATAAASA; RDAATAAASAR; DAATAAASARQ; AATAAASARQR; ATAAASARQRG; TAAASARQRGR; AAASARQRGRG; AASARQRGRGD; ASARQRGRGDA; SARQRGRGDAL; ARQRGRGDALR; RQRGRGDALRL; QRGRGDALRLA; RGRGDALRLAR; GRGDALRLARR; RGDALRLARRI; GDALRLARRIA; DALRLARRIAA; ALRLARRIAAA; LRLARRIAAAL; RLARRIAAALN; LARRIAAALNA; ARRIAAALNAS; RRIAAALNASD; RIAAALNASDN; IAAALNASDNN; AAALNASDNNA; AALNASDNNAG; ALNASDNNAGD; LNASDNNAGDY; NASDNNAGDYG; ASDNNAGDYGF; SDNNAGDYGFF; DNNAGDYGFFW; NNAGDYGFFWI; NAGDYGFFWIT; AGDYGFFWITA; GDYGFFWITAV; DYGFFWITAVT; YGFFWITAVTT; GFFWITAVTTD; FFWITAVTTDG; FWITAVTTDGS; WITAVTTDGSI; ITAVTTDGSIV; TAVTTDGSIVV; AVTTDGSIVVA; VTTDGSIVVAN; TTDGSIVVANS; TDGSIVVANSY; DGSIVVANSYG; GSIVVANSYGL; SIVVANSYGLA; IVVANSYGLAY; VVANSYGLAYI; VANSYGLAYIP; ANSYGLAYIPD; NSYGLAYIPDG; SYGLAYIPDGM; YGLAYIPDGME; GLAYIPDGMEL; | |

Fig. 28 continued

| | | |
|---|---|---|
| | LAYIPDGMELP; AYIPDGMELPN; YIPDGMELPNK; IPDGMELPNKV;<br>PDGMELPNKVY; DGMELPNKVYL; GMELPNKVYLA; MELPNKVYLAS;<br>ELPNKVYLASA; LPNKVYLASAD; PNKVYLASADH; NKVYLASADHA;<br>KVYLASADHAI; VYLASADHAIP; YLASADHAIPV; LASADHAIPVD;<br>ASADHAIPVDE; SADHAIPVDEI; ADHAIPVDEIA; DHAIPVDEIAR;<br>HAIPVDEIARC; AIPVDEIARCA; IPVDEIARCAT; PVDEIARCATY;<br>VDEIARCATYP; DEIARCATYPV; EIARCATYPVL; IARCATYPVLA;<br>ARCATYPVLAV; RCATYPVLAVQ; CATYPVLAVQA; ATYPVLAVQAW;<br>TYPVLAVQAWA; YPVLAVQAWAA; PVLAVQAWAAF;<br>VLAVQAWAAFH; LAVQAWAAFHD; AVQAWAAFHDM;<br>VQAWAAFHDMT; QAWAAFHDMTL; AWAAFHDMTLR;<br>WAAFHDMTLRA; AAFHDMTLRAV; AFHDMTLRAVI; FHDMTLRAVIG;<br>HDMTLRAVIGT; DMTLRAVIGTA; MTLRAVIGTAE; TLRAVIGTAEQ;<br>LRAVIGTAEQL; RAVIGTAEQLA; AVIGTAEQLAS; VIGTAEQLASS;<br>IGTAEQLASSD; GTAEQLASSDP; TAEQLASSDPG; AEQLASSDPGV;<br>EQLASSDPGVA; QLASSDPGVAK; LASSDPGVAKI; ASSDPGVAKIV;<br>SSDPGVAKIVL; SDPGVAKIVLE; DPGVAKIVLEP; PGVAKIVLEPD;<br>GVAKIVLEPDD; VAKIVLEPDDI; AKIVLEPDDIP; KIVLEPDDIPE;<br>IVLEPDDIPES; VLEPDDIPESG; LEPDDIPESGK; EPDDIPESGKM;<br>PDDIPESGKMT; DDIPESGKMTG; DIPESGKMTGR; IPESGKMTGRS;<br>PESGKMTGRSR; ESGKMTGRSRL; SGKMTGRSRLE;<br>GKMTGRSRLEV; KMTGRSRLEVV; MTGRSRLEVVD;<br>TGRSRLEVVDP; GRSRLEVVDPS; RSRLEVVDPSA; SRLEVVDPSAA;<br>RLEVVDPSAAA; LEVVDPSAAAQ; EVVDPSAAAQL; VVDPSAAAQLA;<br>VDPSAAAQLAD; DPSAAAQLADT; PSAAAQLADTT; SAAAQLADTTD;<br>AAAQLADTTDQ; AAQLADTTDQR; AQLADTTDQRL; QLADTTDQRLL;<br>LADTTDQRLLD; ADTTDQRLLDL; DTTDQRLLDLL; TTDQRLLDLLP;<br>TDQRLLDLLPP; DQRLLDLLPPA; QRLLDLLPPAP; RLLDLLPPAPV;<br>LLDLLPPAPVD; LDLLPPAPVDV; DLLPPAPVDVN; LLPPAPVDVNP;<br>LPPAPVDVNPP; PPAPVDVNPPG; PAPVDVNPPGD; APVDVNPPGDE;<br>PVDVNPPGDER; VDVNPPGDERH; DVNPPGDERHM;<br>VNPPGDERHML; NPPGDERHMLW; PPGDERHMLWF;<br>PGDERHMLWFE; GDERHMLWFEL; DERHMLWFELM;<br>ERHMLWFELMK; RHMLWFELMKP; HMLWFELMKPM;<br>MLWFELMKPMT; LWFELMKPMTS; WFELMKPMTST;<br>FELMKPMTSTA; ELMKPMTSTAT; LMKPMTSTATG; MKPMTSTATGR;<br>KPMTSTATGRE; PMTSTATGREA; MTSTATGREAA; TSTATGREAAH;<br>STATGREAAHL; TATGREAAHLR; ATGREAAHLRA; TGREAAHLRAF;<br>GREAAHLRAFR; REAAHLRAFRA; EAAHLRAFRAY; AAHLRAFRAYA;<br>AHLRAFRAYAA; HLRAFRAYAAH; LRAFRAYAAHS; RAFRAYAAHSQ;<br>AFRAYAAHSQE; FRAYAAHSQEI; RAYAAHSQEIA; AYAAHSQEIAL;<br>YAAHSQEIALH; AAHSQEIALHQ; AHSQEIALHQA; HSQEIALHQAH;<br>SQEIALHQAHT; QEIALHQAHTA; EIALHQAHTAT; IALHQAHTATD;<br>ALHQAHTATDA; LHQAHTATDAA; HQAHTATDAAV; QAHTATDAAVQ;<br>AHTATDAAVQR; HTATDAAVQRV; TATDAAVQRVA; ATDAAVQRVAV;<br>TDAAVQRVAVA; DAAVQRVAVAD; AAVQRVAVADW;<br>AVQRVAVADWL; VQRVAVADWLY; QRVAVADWLYW;<br>RVAVADWLYWQ; VAVADWLYWQY; AVADWLYWQYV;<br>VADWLYWQYVT; ADWLYWQYVTG; DWLYWQYVTGL;<br>WLYWQYVTGLL; LYWQYVTGLLD; YWQYVTGLLDR;<br>WQYVTGLLDRA; QYVTGLLDRAL; YVTGLLDRALA; VTGLLDRALAA;<br>TGLLDRALAAA; GLLDRALAAAC; | |

Fig. 28 continued

| | | |
|---|---|---|
| 76) Rv3890c | 8 mers:<br>MSDQITYN; SDQITYNP; DQITYNPG; QITYNPGA; ITYNPGAV; TYNPGAVS; YNPGAVSD; NPGAVSDF; PGAVSDFA; GAVSDFAS; AVSDFASD; VSDFASDV; SDFASDVG; DFASDVGS; FASDVGSR; ASDVGSRA; SDVGSRAG; DVGSRAGQ; VGSRAGQL; GSRAGQLH; SRAGQLHM; RAGQLHMI; AGQLHMIY; GQLHMIYE; QLHMIYED; LHMIYEDT; HMIYEDTA; MIYEDTAS; IYEDTASK; YEDTASKT; EDTASKTN; DTASKTNA; TASKTNAL; ASKTNALQ; SKTNALQE; KTNALQEF; TNALQEFF; NALQEFFA; ALQEFFAG; LQEFFAGH; QEFFAGHG; EFFAGHGA; FFAGHGAQ; FAGHGAQG; AGHGAQGF; GHGAQGFF; HGAQGFFD; GAQGFFDA; AQGFFDAQ; QGFFDAQA; GFFDAQAQ; FFDAQAQM; FDAQAQML; DAQAQMLS; AQAQMLSG; QAQMLSGL; AQMLSGLQ; QMLSGLQG; MLSGLQGL; LSGLQGLI; SGLQGLIE; GLQGLIET; LQGLIETV; QGLIETVG; GLIETVGQ; LIETVGQH; IETVGQHG; ETVGQHGT; TVGQHGTT; VGQHGTTT; GQHGTTTG; QHGTTTGH; HGTTTGHV; GTTTGHVL; TTTGHVLD; TTGHVLDN; TGHVLDNA; GHVLDNAI; HVLDNAIG; VLDNAIGT; LDNAIGTD; DNAIGTDQ; NAIGTDQA; AIGTDQAI; IGTDQAIA; GTDQAIAG; TDQAIAGL; DQAIAGLF;<br><br>9 mers:<br>MSDQITYNP; SDQITYNPG; DQITYNPGA; QITYNPGAV; ITYNPGAVS; TYNPGAVSD; YNPGAVSDF; NPGAVSDFA; PGAVSDFAS; GAVSDFASD; AVSDFASDV; VSDFASDVG; SDFASDVGS; DFASDVGSR; FASDVGSRA; ASDVGSRAG; SDVGSRAGQ; DVGSRAGQL; VGSRAGQLH; GSRAGQLHM; SRAGQLHMI; RAGQLHMIY; AGQLHMIYE; GQLHMIYED; QLHMIYEDT; LHMIYEDTA; HMIYEDTAS; MIYEDTASK; IYEDTASKT; YEDTASKTN; EDTASKTNA; DTASKTNAL; TASKTNALQ; ASKTNALQE; SKTNALQEF; KTNALQEFF; TNALQEFFA; NALQEFFAG; ALQEFFAGH; LQEFFAGHG; QEFFAGHGA; EFFAGHGAQ; FFAGHGAQG; FAGHGAQGF; AGHGAQGFF; GHGAQGFFD; HGAQGFFDA; GAQGFFDAQ; AQGFFDAQA; QGFFDAQAQ; GFFDAQAQM; FFDAQAQML; FDAQAQMLS; DAQAQMLSG; AQAQMLSGL; QAQMLSGLQ; AQMLSGLQG; QMLSGLQGL; MLSGLQGLI; LSGLQGLIE; SGLQGLIET; GLQGLIETV; LQGLIETVG; QGLIETVGQ; GLIETVGQH; LIETVGQHG; IETVGQHGT; ETVGQHGTT; TVGQHGTTT; VGQHGTTTG; GQHGTTTGH; QHGTTTGHV; HGTTTGHVL; GTTTGHVLD; TTTGHVLDN; TTGHVLDNA; TGHVLDNAI; GHVLDNAIG; HVLDNAIGT; VLDNAIGTD; LDNAIGTDQ; DNAIGTDQA; NAIGTDQAI; AIGTDQAIA; IGTDQAIAG; GTDQAIAGL; TDQAIAGLF;<br><br>10 mers:<br>MSDQITYNPG; SDQITYNPGA; DQITYNPGAV; QITYNPGAVS; ITYNPGAVSD; TYNPGAVSDF; YNPGAVSDFA; NPGAVSDFAS; PGAVSDFASD; GAVSDFASDV; AVSDFASDVG; VSDFASDVGS; SDFASDVGSR; DFASDVGSRA; FASDVGSRAG; ASDVGSRAGQ; SDVGSRAGQL; DVGSRAGQLH; VGSRAGQLHM; GSRAGQLHMI; SRAGQLHMIY; RAGQLHMIYE; AGQLHMIYED; GQLHMIYEDT; QLHMIYEDTA; LHMIYEDTAS; HMIYEDTASK; MIYEDTASKT; IYEDTASKTN; YEDTASKTNA; EDTASKTNAL; DTASKTNALQ; TASKTNALQE; ASKTNALQEF; SKTNALQEFF; KTNALQEFFA; TNALQEFFAG; NALQEFFAGH; ALQEFFAGHG; LQEFFAGHGA; | 55242-55587 |

Fig. 28 continued

| | | |
|---|---|---|
| | QEFFAGHGAQ; EFFAGHGAQG; FFAGHGAQGF; FAGHGAQGFF; AGHGAQGFFD; GHGAQGFFDA; HGAQGFFDAQ; GAQGFFDAQA; AQGFFDAQAQ; QGFFDAQAQM; GFFDAQAQML; FFDAQAQMLS; FDAQAQMLSG; DAQAQMLSGL; AQAQMLSGLQ; QAQMLSGLQG; AQMLSGLQGL; QMLSGLQGLI; MLSGLQGLIE; LSGLQGLIET; SGLQGLIETV; GLQGLIETVG; LQGLIETVGQ; QGLIETVGQH; GLIETVGQHG; LIETVGQHGT; IETVGQHGTT; ETVGQHGTTT; TVGQHGTTTG; VGQHGTTTGH; GQHGTTTGHV; QHGTTTGHVL; HGTTTGHVLD; GTTTGHVLDN; TTTGHVLDNA; TTGHVLDNAI; TGHVLDNAIG; GHVLDNAIGT; HVLDNAIGTD; VLDNAIGTDQ; LDNAIGTDQA; DNAIGTDQAI; NAIGTDQAIA; AIGTDQAIAG; IGTDQAIAGL; GTDQAIAGLF;<br><br>11 mers:<br>MSDQITYNPGA; SDQITYNPGAV; DQITYNPGAVS; QITYNPGAVSD; ITYNPGAVSDF; TYNPGAVSDFA; YNPGAVSDFAS; NPGAVSDFASD; PGAVSDFASDV; GAVSDFASDVG; AVSDFASDVGS; VSDFASDVGSR; SDFASDVGSRA; DFASDVGSRAG; FASDVGSRAGQ; ASDVGSRAGQL; SDVGSRAGQLH; DVGSRAGQLHM; VGSRAGQLHMI; GSRAGQLHMIY; SRAGQLHMIYE; RAGQLHMIYED; AGQLHMIYEDT; GQLHMIYEDTA; QLHMIYEDTAS; LHMIYEDTASK; HMIYEDTASKT; MIYEDTASKTN; IYEDTASKTNA; YEDTASKTNAL; EDTASKTNALQ; DTASKTNALQE; TASKTNALQEF; ASKTNALQEFF; SKTNALQEFFA; KTNALQEFFAG; TNALQEFFAGH; NALQEFFAGHG; ALQEFFAGHGA; LQEFFAGHGAQ; QEFFAGHGAQG; EFFAGHGAQGF; FFAGHGAQGFF; FAGHGAQGFFD; AGHGAQGFFDA; GHGAQGFFDAQ; HGAQGFFDAQA; GAQGFFDAQAQ; AQGFFDAQAQM; QGFFDAQAQML; GFFDAQAQMLS; FFDAQAQMLSG; FDAQAQMLSGL; DAQAQMLSGLQ; AQAQMLSGLQG; QAQMLSGLQGL; AQMLSGLQGLI; QMLSGLQGLIE; MLSGLQGLIET; LSGLQGLIETV; SGLQGLIETVG; GLQGLIETVGQ; LQGLIETVGQH; QGLIETVGQHG; GLIETVGQHGT; LIETVGQHGTT; IETVGQHGTTT; ETVGQHGTTTG; TVGQHGTTTGH; VGQHGTTTGHV; GQHGTTTGHVL; QHGTTTGHVLD; HGTTTGHVLDN; GTTTGHVLDNA; TTTGHVLDNAI; TTGHVLDNAIG; TGHVLDNAIGT; GHVLDNAIGTD; HVLDNAIGTDQ; VLDNAIGTDQA; LDNAIGTDQAI; DNAIGTDQAIA; NAIGTDQAIAG; AIGTDQAIAGL; IGTDQAIAGLF; | |
| 77) Rv3891c | 8 mers:<br>MADTIQVT; ADTIQVTP; DTIQVTPQ; TIQVTPQM; IQVTPQML; QVTPQMLR; VTPQMLRS; TPQMLRST; PQMLRSTA; QMLRSTAN; MLRSTAND; LRSTANDI; RSTANDIQ; STANDIQA; TANDIQAN; ANDIQANM; NDIQANME; DIQANMEQ; IQANMEQA; QANMEQAM; ANMEQAMG; NMEQAMGI; MEQAMGIA; EQAMGIAK; QAMGIAKG; AMGIAKGY; MGIAKGYL; GIAKGYLA; IAKGYLAN; AKGYLANQ; KGYLANQE; GYLANQEN; YLANQENV; LANQENVM; ANQENVMN; NQENVMNP; QENVMNPA; ENVMNPAT; NVMNPATW; VMNPATWS; MNPATWSG; NPATWSGT; PATWSGTG; ATWSGTGV; TWSGTGVV; WSGTGVVA; SGTGVVAS; GTGVVASH; TGVVASHM; GVVASHMT; VVASHMTA; VASHMTAT; ASHMTATE; SHMTATEI; HMTATEIT; MTATEITN; TATEITNE; ATEITNEL; TEITNELN; EITNELNK; ITNELNKV; TNELNKVL; NELNKVLT; ELNKVLTG; LNKVLTGG; | 55588-55981 |

Fig. 28 continued

| | | |
|---|---|---|
| | NKVLTGGT; KVLTGGTR; VLTGGTRL; LTGGTRLA; TGGTRLAE; GGTRLAEG; GTRLAEGL; TRLAEGLV; RLAEGLVQ; LAEGLVQA; AEGLVQAA; EGLVQAAA; GLVQAAAL; LVQAAALM; VQAAALME; QAAALMEG; AAALMEGH; AALMEGHE; ALMEGHEA; LMEGHEAD; MEGHEADS; EGHEADSQ; GHEADSQT; HEADSQTA; EADSQTAF; ADSQTAFQ; DSQTAFQA; SQTAFQAL; QTAFQALF; TAFQALFG; AFQALFGA; FQALFGAS; QALFGASH; ALFGASHG; LFGASHGS;<br><br>9 mers:<br>MADTIQVTP; ADTIQVTPQ; DTIQVTPQM; TIQVTPQML; IQVTPQMLR; QVTPQMLRS; VTPQMLRST; TPQMLRSTA; PQMLRSTAN; QMLRSTAND; MLRSTANDI; LRSTANDIQ; RSTANDIQA; STANDIQAN; TANDIQANM; ANDIQANME; NDIQANMEQ; DIQANMEQA; IQANMEQAM; QANMEQAMG; ANMEQAMGI; NMEQAMGIA; MEQAMGIAK; EQAMGIAKG; QAMGIAKGY; AMGIAKGYL; MGIAKGYLA; GIAKGYLAN; IAKGYLANQ; AKGYLANQE; KGYLANQEN; GYLANQENV; YLANQENVM; LANQENVMN; ANQENVMNP; NQENVMNPA; QENVMNPAT; ENVMNPATW; NVMNPATWS; VMNPATWSG; MNPATWSGT; NPATWSGTG; PATWSGTGV; ATWSGTGVV; TWSGTGVVA; WSGTGVVAS; SGTGVVASH; GTGVVASHM; TGVVASHMT; GVVASHMTA; VVASHMTAT; VASHMTATE; ASHMTATEI; SHMTATEIT; HMTATEITN; MTATEITNE; TATEITNEL; ATEITNELN; TEITNELNK; EITNELNKV; ITNELNKVL; TNELNKVLT; NELNKVLTG; ELNKVLTGG; LNKVLTGGT; NKVLTGGTR; KVLTGGTRL; VLTGGTRLA; LTGGTRLAE; TGGTRLAEG; GGTRLAEGL; GTRLAEGLV; TRLAEGLVQ; RLAEGLVQA; LAEGLVQAA; AEGLVQAAA; EGLVQAAAL; GLVQAAALM; LVQAAALME; VQAAALMEG; QAAALMEGH; AAALMEGHE; AALMEGHEA; ALMEGHEAD; LMEGHEADS; MEGHEADSQ; EGHEADSQT; GHEADSQTA; HEADSQTAF; EADSQTAFQ; ADSQTAFQA; DSQTAFQAL; SQTAFQALF; QTAFQALFG; TAFQALFGA; AFQALFGAS; FQALFGASH; QALFGASHG; ALFGASHGS;<br><br>10 mers:<br>MADTIQVTPQ; ADTIQVTPQM; DTIQVTPQML; TIQVTPQMLR; IQVTPQMLRS; QVTPQMLRST; VTPQMLRSTA; TPQMLRSTAN; PQMLRSTAND; QMLRSTANDI; MLRSTANDIQ; LRSTANDIQA; RSTANDIQAN; STANDIQANM; TANDIQANME; ANDIQANMEQ; NDIQANMEQA; DIQANMEQAM; IQANMEQAMG; QANMEQAMGI; ANMEQAMGIA; NMEQAMGIAK; MEQAMGIAKG; EQAMGIAKGY; QAMGIAKGYL; AMGIAKGYLA; MGIAKGYLAN; GIAKGYLANQ; IAKGYLANQE; AKGYLANQEN; KGYLANQENV; GYLANQENVM; YLANQENVMN; LANQENVMNP; ANQENVMNPA; NQENVMNPAT; QENVMNPATW; ENVMNPATWS; NVMNPATWSG; VMNPATWSGT; MNPATWSGTG; NPATWSGTGV; PATWSGTGVV; ATWSGTGVVA; TWSGTGVVAS; WSGTGVVASH; SGTGVVASHM; GTGVVASHMT; TGVVASHMTA; GVVASHMTAT; VVASHMTATE; VASHMTATEI; ASHMTATEIT; SHMTATEITN; HMTATEITNE; MTATEITNEL; TATEITNELN; ATEITNELNK; TEITNELNKV; EITNELNKVL; ITNELNKVLT; TNELNKVLTG; NELNKVLTGG; ELNKVLTGGT; LNKVLTGGTR; NKVLTGGTRL; KVLTGGTRLA; VLTGGTRLAE; LTGGTRLAEG; TGGTRLAEGL; GGTRLAEGLV; GTRLAEGLVQ; | |

Fig. 28 continued

| | | |
|---|---|---|
| | TRLAEGLVQA; RLAEGLVQAA; LAEGLVQAAA; AEGLVQAAAL; EGLVQAAALM; GLVQAAALME; LVQAAALMEG; VQAAALMEGH; QAAALMEGHE; AAALMEGHEA; AALMEGHEAD; ALMEGHEADS; LMEGHEADSQ; MEGHEADSQT; EGHEADSQTA; GHEADSQTAF; HEADSQTAFQ; EADSQTAFQA; ADSQTAFQAL; DSQTAFQALF; SQTAFQALFG; QTAFQALFGA; TAFQALFGAS; AFQALFGASH; FQALFGASHG; QALFGASHGS;<br><br>11 mers:<br>MADTIQVTPQM; ADTIQVTPQML; DTIQVTPQMLR; TIQVTPQMLRS; IQVTPQMLRST; QVTPQMLRSTA; VTPQMLRSTAN; TPQMLRSTAND; PQMLRSTANDI; QMLRSTANDIQ; MLRSTANDIQA; LRSTANDIQAN; RSTANDIQANM; STANDIQANME; TANDIQANMEQ; ANDIQANMEQA; NDIQANMEQAM; DIQANMEQAMG; IQANMEQAMGI; QANMEQAMGIA; ANMEQAMGIAK; NMEQAMGIAKG; MEQAMGIAKGY; EQAMGIAKGYL; QAMGIAKGYLA; AMGIAKGYLAN; MGIAKGYLANQ; GIAKGYLANQE; IAKGYLANQEN; AKGYLANQENV; KGYLANQENVM; GYLANQENVMN; YLANQENVMNP; LANQENVMNPA; ANQENVMNPAT; NQENVMNPATW; QENVMNPATWS; ENVMNPATWSG; NVMNPATWSGT; VMNPATWSGTG; MNPATWSGTGV; NPATWSGTGVV; PATWSGTGVVA; ATWSGTGVVAS; TWSGTGVVASH; WSGTGVVASHM; SGTGVVASHMT; GTGVVASHMTA; TGVVASHMTAT; GVVASHMTATE; VVASHMTATEI; VASHMTATEIT; ASHMTATEITN; SHMTATEITNE; HMTATEITNEL; MTATEITNELN; TATEITNELNK; ATEITNELNKV; TEITNELNKVL; EITNELNKVLT; ITNELNKVLTG; TNELNKVLTGG; NELNKVLTGGT; ELNKVLTGGTR; LNKVLTGGTRL; NKVLTGGTRLA; KVLTGGTRLAE; VLTGGTRLAEG; LTGGTRLAEGL; TGGTRLAEGLV; GGTRLAEGLVQ; GTRLAEGLVQA; TRLAEGLVQAA; RLAEGLVQAAA; LAEGLVQAAAL; AEGLVQAAALM; EGLVQAAALME; GLVQAAALMEG; LVQAAALMEGH; VQAAALMEGHE; QAAALMEGHEA; AAALMEGHEAD; AALMEGHEADS; ALMEGHEADSQ; LMEGHEADSQT; MEGHEADSQTA; EGHEADSQTAF; GHEADSQTAFQ; HEADSQTAFQA; EADSQTAFQAL; ADSQTAFQALF; DSQTAFQALFG; SQTAFQALFGA; QTAFQALFGAS; TAFQALFGASH; AFQALFGASHG; FQALFGASHGS; | |
| 78) Rv3904c | 8 mers:<br>MDPTVLAD; DPTVLADA; PTVLADAV; TVLADAVA; VLADAVAR; LADAVARM; ADAVARMA; DAVARMAE; AVARMAEF; VARMAEFG; ARMAEFGR; RMAEFGRH; MAEFGRHV; AEFGRHVE; EFGRHVEE; FGRHVEEL; GRHVEELV; RHVEELVA; HVEELVAE; VEELVAEI; EELVAEIE; ELVAEIES; LVAEIESL; VAEIESLV; AEIESLVT; EIESLVTR; IESLVTRL; ESLVTRLH; SLVTRLHV; LVTRLHVT; VTRLHVTW; TRLHVTWT; RLHVTWTG; LHVTWTGE; HVTWTGEG; VTWTGEGA; TWTGEGAA; WTGEGAAA; TGEGAAAH; GEGAAAHA; EGAAAHAE; GAAAHAEA; AAAHAEAQ; AAHAEAQR; AHAEAQRH; HAEAQRHW; AEAQRHWA; EAQRHWAA; AQRHWAAG; QRHWAAGE; RHWAAGEA; HWAAGEAM; WAAGEAMM; AAGEAMMR; AGEAMMRQ; GEAMMRQA; EAMMRQAL; AMMRQALA; MMRQALAQ; MRQALAQL; RQALAQLT; QALAQLTA; ALAQLTAA; LAQLTAAG; AQLTAAGQ; | 55982-56308 |

Fig. 28 continued

| | | |
|---|---|---|
| | QLTAAGQS; LTAAGQSA; TAAGQSAH; AAGQSAHA; AGQSAHAN; GQSAHANY; QSAHANYT; SAHANYTG; AHANYTGA; HANYTGAM; ANYTGAMA; NYTGAMAT; YTGAMATN; TGAMATNL; GAMATNLG; AMATNLGM; MATNLGMW; ATNLGMWS;<br><br>9 mers:<br>MDPTVLADA; DPTVLADAV; PTVLADAVA; TVLADAVAR; VLADAVARM; LADAVARMA; ADAVARMAE; DAVARMAEF; AVARMAEFG; VARMAEFGR; ARMAEFGRH; RMAEFGRHV; MAEFGRHVE; AEFGRHVEE; EFGRHVEEL; FGRHVEELV; GRHVEELVA; RHVEELVAE; HVEELVAEI; VEELVAEIE; EELVAEIES; ELVAEIESL; LVAEIESLV; VAEIESLVT; AEIESLVTR; EIESLVTRL; IESLVTRLH; ESLVTRLHV; SLVTRLHVT; LVTRLHVTW; VTRLHVTWT; TRLHVTWTG; RLHVTWTGE; LHVTWTGEG; HVTWTGEGA; VTWTGEGAA; TWTGEGAAA; WTGEGAAAH; TGEGAAAHA; GEGAAAHAE; EGAAAHAEA; GAAAHAEAQ; AAAHAEAQR; AAHAEAQRH; AHAEAQRHW; HAEAQRHWA; AEAQRHWAA; EAQRHWAAG; AQRHWAAGE; QRHWAAGEA; RHWAAGEAM; HWAAGEAMM; WAAGEAMMR; AAGEAMMRQ; AGEAMMRQA; GEAMMRQAL; EAMMRQALA; AMMRQALAQ; MMRQALAQL; MRQALAQLT; RQALAQLTA; QALAQLTAA; ALAQLTAAG; LAQLTAAGQ; AQLTAAGQS; QLTAAGQSA; LTAAGQSAH; TAAGQSAHA; AAGQSAHAN; AGQSAHANY; GQSAHANYT; QSAHANYTG; SAHANYTGA; AHANYTGAM; HANYTGAMA; ANYTGAMAT; NYTGAMATN; YTGAMATNL; TGAMATNLG; GAMATNLGM; AMATNLGMW; MATNLGMWS;<br><br>10 mers:<br>MDPTVLADAV; DPTVLADAVA; PTVLADAVAR; TVLADAVARM; VLADAVARMA; LADAVARMAE; ADAVARMAEF; DAVARMAEFG; AVARMAEFGR; VARMAEFGRH; ARMAEFGRHV; RMAEFGRHVE; MAEFGRHVEE; AEFGRHVEEL; EFGRHVEELV; FGRHVEELVA; GRHVEELVAE; RHVEELVAEI; HVEELVAEIE; VEELVAEIES; EELVAEIESL; ELVAEIESLV; LVAEIESLVT; VAEIESLVTR; AEIESLVTRL; EIESLVTRLH; IESLVTRLHV; ESLVTRLHVT; SLVTRLHVTW; LVTRLHVTWT; VTRLHVTWTG; TRLHVTWTGE; RLHVTWTGEG; LHVTWTGEGA; HVTWTGEGAA; VTWTGEGAAA; TWTGEGAAAH; WTGEGAAAHA; TGEGAAAHAE; GEGAAAHAEA; EGAAAHAEAQ; GAAAHAEAQR; AAAHAEAQRH; AAHAEAQRHW; AHAEAQRHWA; HAEAQRHWAA; AEAQRHWAAG; EAQRHWAAGE; AQRHWAAGEA; QRHWAAGEAM; RHWAAGEAMM; HWAAGEAMMR; WAAGEAMMRQ; AAGEAMMRQA; AGEAMMRQAL; GEAMMRQALA; EAMMRQALAQ; AMMRQALAQL; MMRQALAQLT; MRQALAQLTA; RQALAQLTAA; QALAQLTAAG; ALAQLTAAGQ; LAQLTAAGQS; AQLTAAGQSA; QLTAAGQSAH; LTAAGQSAHA; TAAGQSAHAN; AAGQSAHANY; AGQSAHANYT; GQSAHANYTG; QSAHANYTGA; SAHANYTGAM; AHANYTGAMA; HANYTGAMAT; ANYTGAMATN; NYTGAMATNL; YTGAMATNLG; TGAMATNLGM; GAMATNLGMW; AMATNLGMWS;<br><br>11 mers:<br>MDPTVLADAVA; DPTVLADAVAR; PTVLADAVARM; TVLADAVARMA; VLADAVARMAE; LADAVARMAEF; ADAVARMAEFG; | |

Fig. 28 continued

| | | |
|---|---|---|
| | DAVARMAEFGR; AVARMAEFGRH; VARMAEFGRHV; ARMAEFGRHVE; RMAEFGRHVEE; MAEFGRHVEEL; AEFGRHVEELV; EFGRHVEELVA; FGRHVEELVAE; GRHVEELVAEI; RHVEELVAEIE; HVEELVAEIES; VEELVAEIESL; EELVAEIESLV; ELVAEIESLVT; LVAEIESLVTR; VAEIESLVTRL; AEIESLVTRLH; EIESLVTRLHV; IESLVTRLHVT; ESLVTRLHVTW; SLVTRLHVTWT; LVTRLHVTWTG; VTRLHVTWTGE; TRLHVTWTGEG; RLHVTWTGEGA; LHVTWTGEGAA; HVTWTGEGAAA; VTWTGEGAAAH; TWTGEGAAAHA; WTGEGAAAHAE; TGEGAAAHAEA; GEGAAAHAEAQ; EGAAAHAEAQR; GAAAHAEAQRH; AAAHAEAQRHW; AAHAEAQRHWA; AHAEAQRHWAA; HAEAQRHWAAG; AEAQRHWAAGE; EAQRHWAAGEA; AQRHWAAGEAM; QRHWAAGEAMM; RHWAAGEAMMR; HWAAGEAMMRQ; WAAGEAMMRQA; AAGEAMMRQAL; AGEAMMRQALA; GEAMMRQALAQ; EAMMRQALAQL; AMMRQALAQLT; MMRQALAQLTA; MRQALAQLTAA; RQALAQLTAAG; QALAQLTAAGQ; ALAQLTAAGQS; LAQLTAAGQSA; AQLTAAGQSAH; QLTAAGQSAHA; LTAAGQSAHAN; TAAGQSAHANY; AAGQSAHANYT; AGQSAHANYTG; GQSAHANYTGA; QSAHANYTGAM; SAHANYTGAMA; AHANYTGAMAT; HANYTGAMATN; ANYTGAMATNL; NYTGAMATNLG; YTGAMATNLGM; TGAMATNLGMW; GAMATNLGMWS;<br>MDPTVLADAVARMAEFGRHVEELVAEIESLVTRLHVTWTGEGAAAHA<br>EAQRHWAAGEAMMRQALA<br>QLTAAGQSAHANYTGAMATNLGMWS | |
| 79) Rv3905c | 8 mers:<br>MGADDTLR; GADDTLRV; ADDTLRVE; DDTLRVEP; DTLRVEPA; TLRVEPAV; LRVEPAVM; RVEPAVMQ; VEPAVMQG; EPAVMQGF; PAVMQGFA; AVMQGFAA; VMQGFAAS; MQGFAASL; QGFAASLD; GFAASLDG; FAASLDGA; AASLDGAA; ASLDGAAE; SLDGAAEH; LDGAAEHL; DGAAEHLA; GAAEHLAV; AAEHLAVQ; AEHLAVQL; EHLAVQLA; HLAVQLAE; LAVQLAEL; AVQLAELD; VQLAELDA; QLAELDAQ; LAELDAQV; AELDAQVG; ELDAQVGQ; LDAQVGQM; DAQVGQML; AQVGQMLG; QVGQMLGG; VGQMLGGW; GQMLGGWR; QMLGGWRG; MLGGWRGA; LGGWRGAS; GGWRGASG; GWRGASGS; WRGASGSA; RGASGSAY; GASGSAYG; ASGSAYGS; SGSAYGSA; GSAYGSAW; SAYGSAWE; AYGSAWEL; YGSAWELW; GSAWELWH; SAWELWHR; AWELWHRG; WELWHRGA; ELWHRGAG; LWHRGAGE; WHRGAGEV; HRGAGEVQ; RGAGEVQL; GAGEVQLG; AGEVQLGL; GEVQLGLS; EVQLGLSM; VQLGLSML; QLGLSMLA; LGLSMLAA; GLSMLAAA; LSMLAAAI; SMLAAAIA; MLAAAIAH; LAAAIAHA; AAAIAHAG; AAIAHAGA; AIAHAGAG; IAHAGAGY; AHAGAGYQ; HAGAGYQH; AGAGYQHN; GAGYQHNE; AGYQHNET; GYQHNETA; YQHNETAS; QHNETASA; HNETASAQ; NETASAQV; ETASAQVL; TASAQVLR; ASAQVLRE; SAQVLREV; AQVLREVG; QVLREVGG; VLREVGGG;<br><br>9 mers:<br>MGADDTLRV; GADDTLRVE; ADDTLRVEP; DDTLRVEPA; DTLRVEPAV; TLRVEPAVM; LRVEPAVMQ; RVEPAVMQG; VEPAVMQGF; EPAVMQGFA; PAVMQGFAA; AVMQGFAAS; VMQGFAASL; MQGFAASLD; QGFAASLDG; GFAASLDGA; | 56309-56686 |

Fig. 28 continued

| | | | |
|---|---|---|---|
| | FAASLDGAA; AASLDGAAE; ASLDGAAEH; SLDGAAEHL; LDGAAEHLA; DGAAEHLAV; GAAEHLAVQ; AAEHLAVQL; AEHLAVQLA; EHLAVQLAE; HLAVQLAEL; LAVQLAELD; AVQLAELDA; VQLAELDAQ; QLAELDAQV; LAELDAQVG; AELDAQVGQ; ELDAQVGQM; LDAQVGQML; DAQVGQMLG; AQVGQMLGG; QVGQMLGGW; VGQMLGGWR; GQMLGGWRG; QMLGGWRGA; MLGGWRGAS; LGGWRGASG; GGWRGASGS; GWRGASGSA; WRGASGSAY; RGASGSAYG; GASGSAYGS; ASGSAYGSA; SGSAYGSAW; GSAYGSAWE; SAYGSAWEL; AYGSAWELW; YGSAWELWH; GSAWELWHR; SAWELWHRG; AWELWHRGA; WELWHRGAG; ELWHRGAGE; LWHRGAGEV; WHRGAGEVQ; HRGAGEVQL; RGAGEVQLG; GAGEVQLGL; AGEVQLGLS; GEVQLGLSM; EVQLGLSML; VQLGLSMLA; QLGLSMLAA; LGLSMLAAA; GLSMLAAAI; LSMLAAAIA; SMLAAAIAH; MLAAAIAHA; LAAAIAHAG; AAAIAHAGA; AAIAHAGAG; AIAHAGAGY; IAHAGAGYQ; AHAGAGYQH; HAGAGYQHN; AGAGYQHNE; GAGYQHNET; AGYQHNETA; GYQHNETAS; YQHNETASA; QHNETASAQ; HNETASAQV; NETASAQVL; ETASAQVLR; TASAQVLRE; ASAQVLREV; SAQVLREVG; AQVLREVGG; QVLREVGGG;<br><br>10 mers:<br>MGADDTLRVE; GADDTLRVEP; ADDTLRVEPA; DDTLRVEPAV; DTLRVEPAVM; TLRVEPAVMQ; LRVEPAVMQG; RVEPAVMQGF; VEPAVMQGFA; EPAVMQGFAA; PAVMQGFAAS; AVMQGFAASL; VMQGFAASLD; MQGFAASLDG; QGFAASLDGA; GFAASLDGAA; FAASLDGAAE; AASLDGAAEH; ASLDGAAEHL; SLDGAAEHLA; LDGAAEHLAV; DGAAEHLAVQ; GAAEHLAVQL; AAEHLAVQLA; AEHLAVQLAE; EHLAVQLAEL; HLAVQLAELD; LAVQLAELDA; AVQLAELDAQ; VQLAELDAQV; QLAELDAQVG; LAELDAQVGQ; AELDAQVGQM; ELDAQVGQML; LDAQVGQMLG; DAQVGQMLGG; AQVGQMLGGW; QVGQMLGGWR; VGQMLGGWRG; GQMLGGWRGA; QMLGGWRGAS; MLGGWRGASG; LGGWRGASGS; GGWRGASGSA; GWRGASGSAY; WRGASGSAYG; RGASGSAYGS; GASGSAYGSA; ASGSAYGSAW; SGSAYGSAWE; GSAYGSAWEL; SAYGSAWELW; AYGSAWELWH; YGSAWELWHR; GSAWELWHRG; SAWELWHRGA; AWELWHRGAG; WELWHRGAGE; ELWHRGAGEV; LWHRGAGEVQ; WHRGAGEVQL; HRGAGEVQLG; RGAGEVQLGL; GAGEVQLGLS; AGEVQLGLSM; GEVQLGLSML; EVQLGLSMLA; VQLGLSMLAA; QLGLSMLAAA; LGLSMLAAAI; GLSMLAAAIA; LSMLAAAIAH; SMLAAAIAHA; MLAAAIAHAG; LAAAIAHAGA; AAAIAHAGAG; AAIAHAGAGY; AIAHAGAGYQ; IAHAGAGYQH; AHAGAGYQHN; HAGAGYQHNE; AGAGYQHNET; GAGYQHNETA; AGYQHNETAS; GYQHNETASA; YQHNETASAQ; QHNETASAQV; HNETASAQVL; NETASAQVLR; ETASAQVLRE; TASAQVLREV; ASAQVLREVG; SAQVLREVGG; AQVLREVGGG;<br><br>11 mers:<br>MGADDTLRVEP; GADDTLRVEPA; ADDTLRVEPAV; DDTLRVEPAVM; DTLRVEPAVMQ; TLRVEPAVMQG; LRVEPAVMQGF; RVEPAVMQGFA; VEPAVMQGFAA; EPAVMQGFAAS; PAVMQGFAASL; AVMQGFAASLD; VMQGFAASLDG; MQGFAASLDGA; QGFAASLDGAA; GFAASLDGAAE; FAASLDGAAEH; AASLDGAAEHL; ASLDGAAEHLA; SLDGAAEHLAV; LDGAAEHLAVQ; | |

Fig. 28 continued

| | | |
|---|---|---|
| | DGAAEHLAVQL; GAAEHLAVQLA; AAEHLAVQLAE; AEHLAVQLAEL; EHLAVQLAELD; HLAVQLAELDA; LAVQLAELDAQ; AVQLAELDAQV; VQLAELDAQVG; QLAELDAQVGQ; LAELDAQVGQM; AELDAQVGQML; ELDAQVGQMLG; LDAQVGQMLGG; DAQVGQMLGGW; AQVGQMLGGWR; QVGQMLGGWRG; VGQMLGGWRGA; GQMLGGWRGAS; QMLGGWRGASG; MLGGWRGASGS; LGGWRGASGSA; GGWRGASGSAY; GWRGASGSAYG; WRGASGSAYGS; RGASGSAYGSA; GASGSAYGSAW; ASGSAYGSAWE; SGSAYGSAWEL; GSAYGSAWELW; SAYGSAWELWH; AYGSAWELWHR; YGSAWELWHRG; GSAWELWHRGA; SAWELWHRGAG; AWELWHRGAGE; WELWHRGAGEV; ELWHRGAGEVQ; LWHRGAGEVQL; WHRGAGEVQLG; HRGAGEVQLGL; RGAGEVQLGLS; GAGEVQLGLSM; AGEVQLGLSML; GEVQLGLSMLA; EVQLGLSMLAA; VQLGLSMLAAA; QLGLSMLAAAI; LGLSMLAAAIA; GLSMLAAAIAH; LSMLAAAIAHA; SMLAAAIAHAG; MLAAAIAHAGA; LAAAIAHAGAG; AAAIAHAGAGY; AAIAHAGAGYQ; AIAHAGAGYQH; IAHAGAGYQHN; AHAGAGYQHNE; HAGAGYQHNET; AGAGYQHNETA; GAGYQHNETAS; AGYQHNETASA; GYQHNETASAQ; YQHNETASAQV; QHNETASAQVL; HNETASAQVLR; NETASAQVLRE; ETASAQVLREV; TASAQVLREVG; ASAQVLREVGG; SAQVLREVGGG; | |
| 80) MT3106.1 | 8 mers:<br>MSRQASRQ; SRQASRQV; RQASRQVS; QASRQVSI; ASRQVSII; SRQVSIIR; RQVSIIRS; QVSIIRSA; VSIIRSAG; SIIRSAGD; IIRSAGDG; IRSAGDGN; RSAGDGNR; SAGDGNRS; AGDGNRSC; GDGNRSCG; DGNRSCGC; GNRSCGCV; NRSCGCVT; RSCGCVTP; SCGCVTPK; CGCVTPKE; GCVTPKEG; CVTPKEGV; VTPKEGVW; TPKEGVWV; PKEGVWVV; KEGVWVVT; EGVWVVTL; GVWVVTLR; VWVVTLRV; WVVTLRVV; VVTLRVVP; VTLRVVPE; TLRVVPEG; LRVVPEGL; RVVPEGLA; VVPEGLAA; VPEGLAAA; PEGLAAAS; EGLAAASA; GLAAASAA; LAAASAAV; AAASAAVE; AASAAVEA; ASAAVEAL; SAAVEALT; AAVEALTA; AVEALTAR; VEALTARL; EALTARLA; ALTARLAA; LTARLAAA; TARLAAAH; ARLAAAHA; RLAAAHAG; LAAAHAGA; AAAHAGAA; AAHAGAAP; AHAGAAPA; HAGAAPAI; AGAAPAIT; GAAPAITA; AAPAITAV; APAITAVV; PAITAVVA; AITAVVAP; ITAVVAPA; TAVVAPAA; AVVAPAAD; VVAPAADP; VAPAADPV; APAADPVS; PAADPVSL; AADPVSLQ; ADPVSLQS; DPVSLQSA; PVSLQSAV; VSLQSAVG; SLQSAVGF; LQSAVGFS; QSAVGFSA; SAVGFSAL; AVGFSALG; VGFSALGS; GFSALGSE; FSALGSEH; SALGSEHA; ALGSEHAA; LGSEHAAI; GSEHAAIA; SEHAAIAG; EHAAIAGE; HAAIAGEG; AAIAGEGV; AIAGEGVE; IAGEGVEE; AGEGVEEL; GEGVEELG; EGVEELGR; GVEELGRS; VEELGRSG; EELGRSGV; ELGRSGVA; LGRSGVAV; GRSGVAVG; RSGVAVGE; SGVAVGES; GVAVGESG; VAVGESGI; AVGESGIG; VGESGIGY; GESGIGYA; ESGIGYAA; SGIGYAAG; GIGYAAGD; IGYAAGDA; GYAAGDAV; YAAGDAVA; AAGDAVAA; AGDAVAAA; GDAVAAAT; DAVAAATY; AVAAATYL; VAAATYLV; AAATYLVS; AATYLVSG; ATYLVSGG; TYLVSGGS; YLVSGGSL;<br><br>9 mers:<br>MSRQASRQV; SRQASRQVS; RQASRQVSI; QASRQVSII; ASRQVSIIR; SRQVSIIRS; RQVSIIRSA; QVSIIRSAG; VSIIRSAGD; | 56687-57201 |

Fig. 28 continued

| | | | |
|---|---|---|---|
| | SIIRSAGDG; IIRSAGDGN; IRSAGDGNR; RSAGDGNRS; SAGDGNRSC; AGDGNRSCG; GDGNRSCGC; DGNRSCGCV; GNRSCGCVT; NRSCGCVTP; RSCGCVTPK; SCGCVTPKE; CGCVTPKEG; GCVTPKEGV; CVTPKEGVW; VTPKEGVWV; TPKEGVWVV; PKEGVWVVT; KEGVWVVTL; EGVWVVTLR; GVWVVTLRV; VWVVTLRVV; WVVTLRVVP; VVTLRVVPE; VTLRVVPEG; TLRVVPEGL; LRVVPEGLA; RVVPEGLAA; VVPEGLAAA; VPEGLAAAS; PEGLAAASA; EGLAAASAA; GLAAASAAV; LAAASAAVE; AAASAAVEA; AASAAVEAL; ASAAVEALT; SAAVEALTA; AAVEALTAR; AVEALTARL; VEALTARLA; EALTARLAA; ALTARLAAA; LTARLAAAH; TARLAAAHA; ARLAAAHAG; RLAAAHAGA; LAAAHAGAA; AAAHAGAAP; AAHAGAAPA; AHAGAAPAI; HAGAAPAIT; AGAAPAITA; GAAPAITAV; AAPAITAVV; APAITAVVA; PAITAVVAP; AITAVVAPA; ITAVVAPAA; TAVVAPAAD; AVVAPAADP; VVAPAADPV; VAPAADPVS; APAADPVSL; PAADPVSLQ; AADPVSLQS; ADPVSLQSA; DPVSLQSAV; PVSLQSAVG; VSLQSAVGF; SLQSAVGFS; LQSAVGFSA; QSAVGFSAL; SAVGFSALG; AVGFSALGS; VGFSALGSE; GFSALGSEH; FSALGSEHA; SALGSEHAA; ALGSEHAAI; LGSEHAAIA; GSEHAAIAG; SEHAAIAGE; EHAAIAGEG; HAAIAGEGV; AAIAGEGVE; AIAGEGVEE; IAGEGVEEL; AGEGVEELG; GEGVEELGR; EGVEELGRS; GVEELGRSG; VEELGRSGV; EELGRSGVA; ELGRSGVAV; LGRSGVAVG; GRSGVAVGE; RSGVAVGES; SGVAVGESG; GVAVGESGI; VAVGESGIG; AVGESGIGY; VGESGIGYA; GESGIGYAA; ESGIGYAAG; SGIGYAAGD; GIGYAAGDA; IGYAAGDAV; GYAAGDAVA; YAAGDAVAA; AAGDAVAAA; AGDAVAAAT; GDAVAAATY; DAVAAATYL; AVAAATYLV; VAAATYLVS; AAATYLVSG; AATYLVSGG; ATYLVSGGS; TYLVSGGSL;<br><br>10 mers:<br>MSRQASRQVS; SRQASRQVSI; RQASRQVSII; QASRQVSIIR; ASRQVSIIRS; SRQVSIIRSA; RQVSIIRSAG; QVSIIRSAGD; VSIIRSAGDG; SIIRSAGDGN; IIRSAGDGNR; IRSAGDGNRS; RSAGDGNRSC; SAGDGNRSCG; AGDGNRSCGC; GDGNRSCGCV; DGNRSCGCVT; GNRSCGCVTP; NRSCGCVTPK; RSCGCVTPKE; SCGCVTPKEG; CGCVTPKEGV; GCVTPKEGVW; CVTPKEGVWV; VTPKEGVWVV; TPKEGVWVVT; PKEGVWVVTL; KEGVWVVTLR; EGVWVVTLRV; GVWVVTLRVV; VWVVTLRVVP; WVVTLRVVPE; VVTLRVVPEG; VTLRVVPEGL; TLRVVPEGLA; LRVVPEGLAA; RVVPEGLAAA; VVPEGLAAAS; VPEGLAAASA; PEGLAAASAA; EGLAAASAAV; GLAAASAAVE; LAAASAAVEA; AAASAAVEAL; AASAAVEALT; ASAAVEALTA; SAAVEALTAR; AAVEALTARL; AVEALTARLA; VEALTARLAA; EALTARLAAA; ALTARLAAAH; LTARLAAAHA; TARLAAAHAG; ARLAAAHAGA; RLAAAHAGAA; LAAAHAGAAP; AAAHAGAAPA; AAHAGAAPAI; AHAGAAPAIT; HAGAAPAITA; AGAAPAITAV; GAAPAITAVV; AAPAITAVVA; APAITAVVAP; PAITAVVAPA; AITAVVAPAA; ITAVVAPAAD; TAVVAPAADP; AVVAPAADPV; VVAPAADPVS; VAPAADPVSL; APAADPVSLQ; PAADPVSLQS; AADPVSLQSA; ADPVSLQSAV; DPVSLQSAVG; PVSLQSAVGF; VSLQSAVGFS; SLQSAVGFSA; LQSAVGFSAL; QSAVGFSALG; SAVGFSALGS; AVGFSALGSE; VGFSALGSEH; GFSALGSEHA; FSALGSEHAA; SALGSEHAAI; | |

Fig. 28 continued

| | | |
|---|---|---|
| | ALGSEHAAIA; LGSEHAAIAG; GSEHAAIAGE; SEHAAIAGEG; EHAAIAGEGV; HAAIAGEGVE; AAIAGEGVEE; AIAGEGVEEL; IAGEGVEELG; AGEGVEELGR; GEGVEELGRS; EGVEELGRSG; GVEELGRSGV; VEELGRSGVA; EELGRSGVAV; ELGRSGVAVG; LGRSGVAVGE; GRSGVAVGES; RSGVAVGESG; SGVAVGESGI; GVAVGESGIG; VAVGESGIGY; AVGESGIGYA; VGESGIGYAA; GESGIGYAAG; ESGIGYAAGD; SGIGYAAGDA; GIGYAAGDAV; IGYAAGDAVA; GYAAGDAVAA; YAAGDAVAAA; AAGDAVAAAT; AGDAVAAATY; GDAVAAATYL; DAVAAATYLV; AVAAATYLVS; VAAATYLVSG; AAATYLVSGG; AATYLVSGGS; ATYLVSGGSL;<br><br>11 mers:<br>MSRQASRQVSI; SRQASRQVSII; RQASRQVSIIR; QASRQVSIIRS; ASRQVSIIRSA; SRQVSIIRSAG; RQVSIIRSAGD; QVSIIRSAGDG; VSIIRSAGDGN; SIIRSAGDGNR; IIRSAGDGNRS; IRSAGDGNRSC; RSAGDGNRSCG; SAGDGNRSCGC; AGDGNRSCGCV; GDGNRSCGCVT; DGNRSCGCVTP; GNRSCGCVTPK; NRSCGCVTPKE; RSCGCVTPKEG; SCGCVTPKEGV; CGCVTPKEGVW; GCVTPKEGVWV; CVTPKEGVWVV; VTPKEGVWVVT; TPKEGVWVVTL; PKEGVWVVTLR; KEGVWVVTLRV; EGVWVVTLRVV; GVWVVTLRVVP; VWVVTLRVVPE; WVVTLRVVPEG; VVTLRVVPEGL; VTLRVVPEGLA; TLRVVPEGLAA; LRVVPEGLAAA; RVVPEGLAAAS; VVPEGLAAASA; VPEGLAAASAA; PEGLAAASAAV; EGLAAASAAVE; GLAAASAAVEA; LAAASAAVEAL; AAASAAVEALT; AASAAVEALTA; ASAAVEALTAR; SAAVEALTARL; AAVEALTARLA; AVEALTARLAA; VEALTARLAAA; EALTARLAAAH; ALTARLAAAHA; LTARLAAAHAG; TARLAAAHAGA; ARLAAAHAGAA; RLAAAHAGAAP; LAAAHAGAAPA; AAAHAGAAPAI; AAHAGAAPAIT; AHAGAAPAITA; HAGAAPAITAV; AGAAPAITAVV; GAAPAITAVVA; AAPAITAVVAP; APAITAVVAPA; PAITAVVAPAA; AITAVVAPAAD; ITAVVAPAADP; TAVVAPAADPV; AVVAPAADPVS; VVAPAADPVSL; VAPAADPVSLQ; APAADPVSLQS; PAADPVSLQSA; AADPVSLQSAV; ADPVSLQSAVG; DPVSLQSAVGF; PVSLQSAVGFS; VSLQSAVGFSA; SLQSAVGFSAL; LQSAVGFSALG; QSAVGFSALGS; SAVGFSALGSE; AVGFSALGSEH; VGFSALGSEHA; GFSALGSEHAA; FSALGSEHAAI; SALGSEHAAIA; ALGSEHAAIAG; LGSEHAAIAGE; GSEHAAIAGEG; SEHAAIAGEGV; EHAAIAGEGVE; HAAIAGEGVEE; AAIAGEGVEEL; AIAGEGVEELG; IAGEGVEELGR; AGEGVEELGRS; GEGVEELGRSG; EGVEELGRSGV; GVEELGRSGVA; VEELGRSGVAV; EELGRSGVAVG; ELGRSGVAVGE; LGRSGVAVGES; GRSGVAVGESG; RSGVAVGESGI; SGVAVGESGIG; GVAVGESGIGY; VAVGESGIGYA; AVGESGIGYAA; VGESGIGYAAG; GESGIGYAAGD; ESGIGYAAGDA; SGIGYAAGDAV; GIGYAAGDAVA; IGYAAGDAVAA; GYAAGDAVAAA; YAAGDAVAAAT; AAGDAVAAATY; AGDAVAAATYL; GDAVAAATYLV; DAVAAATYLVS; AVAAATYLVSG; VAAATYLVSGG; AAATYLVSGGS; AATYLVSGGSL; | |
| 81) Rv3804c/Ag85A | 8 mers:<br>MQLVDRVR; QLVDRVRG; LVDRVRGA; VDRVRGAV; DRVRGAVT; RVRGAVTG; VRGAVTGM; RGAVTGMS; GAVTGMSR; AVTGMSRR; VTGMSRRL; TGMSRRLV; GMSRRLVV; MSRRLVVG; SRRLVVGA; RRLVVGAV; RLVVGAVG; LVVGAVGA; VVGAVGAA; VGAVGAAL; GAVGAALV; AVGAALVS; VGAALVSG; GAALVSGL; AALVSGLV; | 57202-58518 |

Fig. 28 continued

| | | |
|---|---|---|
| | ALVSGLVG; LVSGLVGA; VSGLVGAV; SGLVGAVG; GLVGAVGG; LVGAVGGT; VGAVGGTA; GAVGGTAT; AVGGTATA; VGGTATAG; GGTATAGA; GTATAGAF; TATAGAFS; ATAGAFSR; TAGAFSRP; AGAFSRPG; GAFSRPGL; AFSRPGLP; FSRPGLPV; SRPGLPVE; RPGLPVEY; PGLPVEYL; GLPVEYLQ; LPVEYLQV; PVEYLQVP; VEYLQVPS; EYLQVPSP; YLQVPSPS; LQVPSPSM; QVPSPSMG; VPSPSMGR; PSPSMGRD; SPSMGRDI; PSMGRDIK; SMGRDIKV; MGRDIKVQ; GRDIKVQF; RDIKVQFQ; DIKVQFQS; IKVQFQSG; KVQFQSGG; VQFQSGGA; QFQSGGAN; FQSGGANS; QSGGANSP; SGGANSPA; GGANSPAL; GANSPALY; ANSPALYL; NSPALYLL; SPALYLLD; PALYLLDG; ALYLLDGL; LYLLDGLR; YLLDGLRA; LLDGLRAQ; LDGLRAQD; DGLRAQDD; GLRAQDDF; LRAQDDFS; RAQDDFSG; AQDDFSGW; QDDFSGWD; DDFSGWDI; DFSGWDIN; FSGWDINT; SGWDINTP; GWDINTPA; WDINTPAF; DINTPAFE; INTPAFEW; NTPAFEWY; TPAFEWYD; PAFEWYDQ; AFEWYDQS; FEWYDQSG; EWYDQSGL; WYDQSGLS; YDQSGLSV; DQSGLSVV; QSGLSVVM; SGLSVVMP; GLSVVMPV; LSVVMPVG; SVVMPVGG; VVMPVGGQ; VMPVGGQS; MPVGGQSS; PVGGQSSF; VGGQSSFY; GGQSSFYS; GQSSFYSD; QSSFYSDW; SSFYSDWY; SFYSDWYQ; FYSDWYQP; YSDWYQPA; SDWYQPAC; DWYQPACG; WYQPACGK; YQPACGKA; QPACGKAG; PACGKAGC; ACGKAGCQ; CGKAGCQT; GKAGCQTY; KAGCQTYK; AGCQTYKW; GCQTYKWE; CQTYKWET; QTYKWETF; TYKWETFL; YKWETFLT; KWETFLTS; WETFLTSE; ETFLTSEL; TFLTSELP; FLTSELPG; LTSELPGW; TSELPGWL; SELPGWLQ; ELPGWLQA; LPGWLQAN; PGWLQANR; GWLQANRH; WLQANRHV; LQANRHVK; QANRHVKP; ANRHVKPT; NRHVKPTG; RHVKPTGS; HVKPTGSA; VKPTGSAV; KPTGSAVV; PTGSAVVG; TGSAVVGL; GSAVVGLS; SAVVGLSM; AVVGLSMA; VVGLSMAA; VGLSMAAS; GLSMAASS; LSMAASSA; SMAASSAL; MAASSALT; AASSALTL; ASSALTLA; SSALTLAI; SALTLAIY; ALTLAIYH; LTLAIYHP; TLAIYHPQ; LAIYHPQQ; AIYHPQQF; IYHPQQFV; YHPQQFVY; HPQQFVYA; PQQFVYAG; QQFVYAGA; QFVYAGAM; FVYAGAMS; VYAGAMSG; YAGAMSGL; AGAMSGLL; GAMSGLLD; AMSGLLDP; MSGLLDPS; SGLLDPSQ; GLLDPSQA; LLDPSQAM; LDPSQAMG; DPSQAMGP; PSQAMGPT; SQAMGPTL; QAMGPTLI; AMGPTLIG; MGPTLIGL; GPTLIGLA; PTLIGLAM; TLIGLAMG; LIGLAMGD; IGLAMGDA; GLAMGDAG; LAMGDAGG; AMGDAGGY; MGDAGGYK; GDAGGYKA; DAGGYKAS; AGGYKASD; GGYKASDM; GYKASDMW; YKASDMWG; KASDMWGP; ASDMWGPK; SDMWGPKE; DMWGPKED; MWGPKEDP; WGPKEDPA; GPKEDPAW; PKEDPAWQ; KEDPAWQR; EDPAWQRN; DPAWQRND; PAWQRNDP; AWQRNDPL; WQRNDPLL; QRNDPLLN; RNDPLLNV; NDPLLNVG; DPLLNVGK; PLLNVGKL; LLNVGKLI; LNVGKLIA; NVGKLIAN; VGKLIANN; GKLIANNT; KLIANNTR; LIANNTRV; IANNTRVW; ANNTRVWV; NNTRVWVY; NTRVWVYC; TRVWVYCG; RVWVYCGN; VWVYCGNG; WVYCGNGK; VYCGNGKP; YCGNGKPS; CGNGKPSD; GNGKPSDL; NGKPSDLG; GKPSDLGG; KPSDLGGN; PSDLGGNN; SDLGGNNL; DLGGNNLP; LGGNNLPA; GGNNLPAK; GNNLPAKF; NNLPAKFL; NLPAKFLE; LPAKFLEG; PAKFLEGF; AKFLEGFV; KFLEGFVR; FLEGFVRT; LEGFVRTS; EGFVRTSN; GFVRTSNI; FVRTSNIK; VRTSNIKF; RTSNIKFQ; TSNIKFQD; SNIKFQDA; NIKFQDAY; IKFQDAYN; KFQDAYNA; FQDAYNAG; QDAYNAGG; DAYNAGGG; AYNAGGGH; YNAGGGHN; NAGGGHNG; AGGGHNGV; GGGHNGVF; | |

Fig. 28 continued

| | | | |
|---|---|---|---|
| | GGHNGVFD; GHNGVFDF; HNGVFDFP; NGVFDFPD; GVFDFPDS; VFDFPDSG; FDFPDSGT; DFPDSGTH; FPDSGTHS; PDSGTHSW; DSGTHSWE; SGTHSWEY; GTHSWEYW; THSWEYWG; HSWEYWGA; SWEYWGAQ; WEYWGAQL; EYWGAQLN; YWGAQLNA; WGAQLNAM; GAQLNAMK; AQLNAMKP; QLNAMKPD; LNAMKPDL; NAMKPDLQ; AMKPDLQR; MKPDLQRA; KPDLQRAL; PDLQRALG; DLQRALGA; LQRALGAT; QRALGATP; RALGATPN; ALGATPNT; LGATPNTG; GATPNTGP; ATPNTGPA; TPNTGPAP; PNTGPAPQ; NTGPAPQG; TGPAPQGA;<br><br>9 mers:<br>MQLVDRVRG; QLVDRVRGA; LVDRVRGAV; VDRVRGAVT; DRVRGAVTG; RVRGAVTGM; VRGAVTGMS; RGAVTGMSR; GAVTGMSRR; AVTGMSRRL; VTGMSRRLV; TGMSRRLVV; GMSRRLVVG; MSRRLVVGA; SRRLVVGAV; RRLVVGAVG; RLVVGAVGA; LVVGAVGAA; VVGAVGAAL; VGAVGAALV; GAVGAALVS; AVGAALVSG; VGAALVSGL; GAALVSGLV; AALVSGLVG; ALVSGLVGA; LVSGLVGAV; VSGLVGAVG; SGLVGAVGG; GLVGAVGGT; LVGAVGGTA; VGAVGGTAT; GAVGGTATA; AVGGTATAG; VGGTATAGA; GGTATAGAF; GTATAGAFS; TATAGAFSR; ATAGAFSRP; TAGAFSRPG; AGAFSRPGL; GAFSRPGLP; AFSRPGLPV; FSRPGLPVE; SRPGLPVEY; RPGLPVEYL; PGLPVEYLQ; GLPVEYLQV; LPVEYLQVP; PVEYLQVPS; VEYLQVPSP; EYLQVPSPS; YLQVPSPSM; LQVPSPSMG; QVPSPSMGR; VPSPSMGRD; PSPSMGRDI; SPSMGRDIK; PSMGRDIKV; SMGRDIKVQ; MGRDIKVQF; GRDIKVQFQ; RDIKVQFQS; DIKVQFQSG; IKVQFQSGG; KVQFQSGGA; VQFQSGGAN; QFQSGGANS; FQSGGANSP; QSGGANSPA; SGGANSPAL; GGANSPALY; GANSPALYL; ANSPALYLL; NSPALYLLD; SPALYLLDG; PALYLLDGL; ALYLLDGLR; LYLLDGLRA; YLLDGLRAQ; LLDGLRAQD; LDGLRAQDD; DGLRAQDDF; GLRAQDDFS; LRAQDDFSG; RAQDDFSGW; AQDDFSGWD; QDDFSGWDI; DDFSGWDIN; DFSGWDINT; FSGWDINTP; SGWDINTPA; GWDINTPAF; WDINTPAFE; DINTPAFEW; INTPAFEWY; NTPAFEWYD; TPAFEWYDQ; PAFEWYDQS; AFEWYDQSG; FEWYDQSGL; EWYDQSGLS; WYDQSGLSV; YDQSGLSVV; DQSGLSVVM; QSGLSVVMP; SGLSVVMPV; GLSVVMPVG; LSVVMPVGG; SVVMPVGGQ; VVMPVGGQS; VMPVGGQSS; MPVGGQSSF; PVGGQSSFY; VGGQSSFYS; GGQSSFYSD; GQSSFYSDW; QSSFYSDWY; SSFYSDWYQ; SFYSDWYQP; FYSDWYQPA; YSDWYQPAC; SDWYQPACG; DWYQPACGK; WYQPACGKA; YQPACGKAG; QPACGKAGC; PACGKAGCQ; ACGKAGCQT; CGKAGCQTY; GKAGCQTYK; KAGCQTYKW; AGCQTYKWE; GCQTYKWET; CQTYKWETF; QTYKWETFL; TYKWETFLT; YKWETFLTS; KWETFLTSE; WETFLTSEL; ETFLTSELP; TFLTSELPG; FLTSELPGW; LTSELPGWL; TSELPGWLQ; SELPGWLQA; ELPGWLQAN; LPGWLQANR; PGWLQANRH; GWLQANRHV; WLQANRHVK; LQANRHVKP; QANRHVKPT; ANRHVKPTG; NRHVKPTGS; RHVKPTGSA; HVKPTGSAV; VKPTGSAVV; KPTGSAVVG; PTGSAVVGL; TGSAVVGLS; GSAVVGLSM; SAVVGLSMA; AVVGLSMAA; VVGLSMAAS; VGLSMAASS; GLSMAASSA; LSMAASSAL; SMAASSALT; MAASSALTL; | |

Fig. 28 continued

| | | |
|---|---|---|
| | AASSALTLA; ASSALTLAI; SSALTLAIY; SALTLAIYH; ALTLAIYHP; LTLAIYHPQ; TLAIYHPQQ; LAIYHPQQF; AIYHPQQFV; IYHPQQFVY; YHPQQFVYA; HPQQFVYAG; PQQFVYAGA; QQFVYAGAM; QFVYAGAMS; FVYAGAMSG; VYAGAMSGL; YAGAMSGLL; AGAMSGLLD; GAMSGLLDP; AMSGLLDPS; MSGLLDPSQ; SGLLDPSQA; GLLDPSQAM; LLDPSQAMG; LDPSQAMGP; DPSQAMGPT; PSQAMGPTL; SQAMGPTLI; QAMGPTLIG; AMGPTLIGL; MGPTLIGLA; GPTLIGLAM; PTLIGLAMG; TLIGLAMGD; LIGLAMGDA; IGLAMGDAG; GLAMGDAGG; LAMGDAGGY; AMGDAGGYK; MGDAGGYKA; GDAGGYKAS; DAGGYKASD; AGGYKASDM; GGYKASDMW; GYKASDMWG; YKASDMWGP; KASDMWGPK; ASDMWGPKE; SDMWGPKED; DMWGPKEDP; MWGPKEDPA; WGPKEDPAW; GPKEDPAWQ; PKEDPAWQR; KEDPAWQRN; EDPAWQRND; DPAWQRNDP; PAWQRNDPL; AWQRNDPLL; WQRNDPLLN; QRNDPLLNV; RNDPLLNVG; NDPLLNVGK; DPLLNVGKL; PLLNVGKLI; LLNVGKLIA; LNVGKLIAN; NVGKLIANN; VGKLIANNT; GKLIANNTR; KLIANNTRV; LIANNTRVW; IANNTRVWV; ANNTRVWVY; NNTRVWVYC; NTRVWVYCG; TRVWVYCGN; RVWVYCGNG; VWVYCGNGK; WVYCGNGKP; VYCGNGKPS; YCGNGKPSD; CGNGKPSDL; GNGKPSDLG; NGKPSDLGG; GKPSDLGGN; KPSDLGGNN; PSDLGGNNL; SDLGGNNLP; DLGGNNLPA; LGGNNLPAK; GGNNLPAKF; GNNLPAKFL; NNLPAKFLE; NLPAKFLEG; LPAKFLEGF; PAKFLEGFV; AKFLEGFVR; KFLEGFVRT; FLEGFVRTS; LEGFVRTSN; EGFVRTSNI; GFVRTSNIK; FVRTSNIKF; VRTSNIKFQ; RTSNIKFQD; TSNIKFQDA; SNIKFQDAY; NIKFQDAYN; IKFQDAYNA; KFQDAYNAG; FQDAYNAGG; QDAYNAGGG; DAYNAGGGH; AYNAGGGHN; YNAGGGHNG; NAGGGHNGV; AGGGHNGVF; GGGHNGVFD; GGHNGVFDF; GHNGVFDFP; HNGVFDFPD; NGVFDFPDS; GVFDFPDSG; VFDFPDSGT; FDFPDSGTH; DFPDSGTHS; FPDSGTHSW; PDSGTHSWE; DSGTHSWEY; SGTHSWEYW; GTHSWEYWG; THSWEYWGA; HSWEYWGAQ; SWEYWGAQL; WEYWGAQLN; EYWGAQLNA; YWGAQLNAM; WGAQLNAMK; GAQLNAMKP; AQLNAMKPD; QLNAMKPDL; LNAMKPDLQ; NAMKPDLQR; AMKPDLQRA; MKPDLQRAL; KPDLQRALG; PDLQRALGA; DLQRALGAT; LQRALGATP; QRALGATPN; RALGATPNT; ALGATPNTG; LGATPNTGP; GATPNTGPA; ATPNTGPAP; TPNTGPAPQ; PNTGPAPQG; NTGPAPQGA;<br><br>10 mers:<br>MQLVDRVRGA; QLVDRVRGAV; LVDRVRGAVT; VDRVRGAVTG; DRVRGAVTGM; RVRGAVTGMS; VRGAVTGMSR; RGAVTGMSRR; GAVTGMSRRL; AVTGMSRRLV; VTGMSRRLVV; TGMSRRLVVG; GMSRRLVVGA; MSRRLVVGAV; SRRLVVGAVG; RRLVVGAVGA; RLVVGAVGAA; LVVGAVGAAL; VVGAVGAALV; VGAVGAALVS; GAVGAALVSG; AVGAALVSGL; VGAALVSGLV; GAALVSGLVG; AALVSGLVGA; ALVSGLVGAV; LVSGLVGAVG; VSGLVGAVGG; SGLVGAVGGT; GLVGAVGGTA; LVGAVGGTAT; VGAVGGTATA; GAVGGTATAG; AVGGTATAGA; VGGTATAGAF; GGTATAGAFS; GTATAGAFSR; TATAGAFSRP; ATAGAFSRPG; TAGAFSRPGL; AGAFSRPGLP; GAFSRPGLPV; AFSRPGLPVE; FSRPGLPVEY; SRPGLPVEYL; RPGLPVEYLQ; PGLPVEYLQV; GLPVEYLQVP; LPVEYLQVPS; PVEYLQVPSP; VEYLQVPSPS; EYLQVPSPSM; | |

Fig. 28 continued

| | | |
|---|---|---|
| | YLQVPSPSMG; LQVPSPSMGR; QVPSPSMGRD; VPSPSMGRDI; PSPSMGRDIK; SPSMGRDIKV; PSMGRDIKVQ; SMGRDIKVQF; MGRDIKVQFQ; GRDIKVQFQS; RDIKVQFQSG; DIKVQFQSGG; IKVQFQSGGA; KVQFQSGGAN; VQFQSGGANS; QFQSGGANSP; FQSGGANSPA; QSGGANSPAL; SGGANSPALY; GGANSPALYL; GANSPALYLL; ANSPALYLLD; NSPALYLLDG; SPALYLLDGL; PALYLLDGLR; ALYLLDGLRA; LYLLDGLRAQ; YLLDGLRAQD; LLDGLRAQDD; LDGLRAQDDF; DGLRAQDDFS; GLRAQDDFSG; LRAQDDFSGW; RAQDDFSGWD; AQDDFSGWDI; QDDFSGWDIN; DDFSGWDINT; DFSGWDINTP; FSGWDINTPA; SGWDINTPAF; GWDINTPAFE; WDINTPAFEW; DINTPAFEWY; INTPAFEWYD; NTPAFEWYDQ; TPAFEWYDQS; PAFEWYDQSG; AFEWYDQSGL; FEWYDQSGLS; EWYDQSGLSV; WYDQSGLSVV; YDQSGLSVVM; DQSGLSVVMP; QSGLSVVMPV; SGLSVVMPVG; GLSVVMPVGG; LSVVMPVGGQ; SVVMPVGGQS; VVMPVGGQSS; VMPVGGQSSF; MPVGGQSSFY; PVGGQSSFYS; VGGQSSFYSD; GGQSSFYSDW; GQSSFYSDWY; QSSFYSDWYQ; SSFYSDWYQP; SFYSDWYQPA; FYSDWYQPAC; YSDWYQPACG; SDWYQPACGK; DWYQPACGKA; WYQPACGKAG; YQPACGKAGC; QPACGKAGCQ; PACGKAGCQT; ACGKAGCQTY; CGKAGCQTYK; GKAGCQTYKW; KAGCQTYKWE; AGCQTYKWET; GCQTYKWETF; CQTYKWETFL; QTYKWETFLT; TYKWETFLTS; YKWETFLTSE; KWETFLTSEL; WETFLTSELP; ETFLTSELPG; TFLTSELPGW; FLTSELPGWL; LTSELPGWLQ; TSELPGWLQA; SELPGWLQAN; ELPGWLQANR; LPGWLQANRH; PGWLQANRHV; GWLQANRHVK; WLQANRHVKP; LQANRHVKPT; QANRHVKPTG; ANRHVKPTGS; NRHVKPTGSA; RHVKPTGSAV; HVKPTGSAVV; VKPTGSAVVG; KPTGSAVVGL; PTGSAVVGLS; TGSAVVGLSM; GSAVVGLSMA; SAVVGLSMAA; AVVGLSMAAS; VVGLSMAASS; VGLSMAASSA; GLSMAASSAL; LSMAASSALT; SMAASSALTL; MAASSALTLA; AASSALTLAI; ASSALTLAIY; SSALTLAIYH; SALTLAIYHP; ALTLAIYHPQ; LTLAIYHPQQ; TLAIYHPQQF; LAIYHPQQFV; AIYHPQQFVY; IYHPQQFVYA; YHPQQFVYAG; HPQQFVYAGA; PQQFVYAGAM; QQFVYAGAMS; QFVYAGAMSG; FVYAGAMSGL; VYAGAMSGLL; YAGAMSGLLD; AGAMSGLLDP; GAMSGLLDPS; AMSGLLDPSQ; MSGLLDPSQA; SGLLDPSQAM; GLLDPSQAMG; LLDPSQAMGP; LDPSQAMGPT; DPSQAMGPTL; PSQAMGPTLI; SQAMGPTLIG; QAMGPTLIGL; AMGPTLIGLA; MGPTLIGLAM; GPTLIGLAMG; PTLIGLAMGD; TLIGLAMGDA; LIGLAMGDAG; IGLAMGDAGG; GLAMGDAGGY; LAMGDAGGYK; AMGDAGGYKA; MGDAGGYKAS; GDAGGYKASD; DAGGYKASDM; AGGYKASDMW; GGYKASDMWG; GYKASDMWGP; YKASDMWGPK; KASDMWGPKE; ASDMWGPKED; SDMWGPKEDP; DMWGPKEDPA; MWGPKEDPAW; WGPKEDPAWQ; GPKEDPAWQR; PKEDPAWQRN; KEDPAWQRND; EDPAWQRNDP; DPAWQRNDPL; PAWQRNDPLL; AWQRNDPLLN; WQRNDPLLNV; QRNDPLLNVG; RNDPLLNVGK; NDPLLNVGKL; DPLLNVGKLI; PLLNVGKLIA; LLNVGKLIAN; LNVGKLIANN; NVGKLIANNT; VGKLIANNTR; GKLIANNTRV; KLIANNTRVW; LIANNTRVWV; IANNTRVWVY; ANNTRVWVYC; NNTRVWVYCG; NTRVWVYCGN; TRVWVYCGNG; RVWVYCGNGK; VWVYCGNGKP; WVYCGNGKPS; VYCGNGKPSD; YCGNGKPSDL; CGNGKPSDLG; GNGKPSDLGG; NGKPSDLGGN; GKPSDLGGNN; KPSDLGGNNL; PSDLGGNNLP; SDLGGNNLPA; DLGGNNLPAK; LGGNNLPAKF; GGNNLPAKFL; GNNLPAKFLE; | |

Fig. 28 continued

| | | |
|---|---|---|
| | NNLPAKFLEG; NLPAKFLEGF; LPAKFLEGFV; PAKFLEGFVR;<br>AKFLEGFVRT; KFLEGFVRTS; FLEGFVRTSN; LEGFVRTSNI;<br>EGFVRTSNIK; GFVRTSNIKF; FVRTSNIKFQ; VRTSNIKFQD;<br>RTSNIKFQDA; TSNIKFQDAY; SNIKFQDAYN; NIKFQDAYNA;<br>IKFQDAYNAG; KFQDAYNAGG; FQDAYNAGGG; QDAYNAGGGH;<br>DAYNAGGGHN; AYNAGGGHNG; YNAGGGHNGV; NAGGGHNGVF;<br>AGGGHNGVFD; GGGHNGVFDF; GGHNGVFDFP; GHNGVFDFPD;<br>HNGVFDFPDS; NGVFDFPDSG; GVFDFPDSGT; VFDFPDSGTH;<br>FDFPDSGTHS; DFPDSGTHSW; FPDSGTHSWE; PDSGTHSWEY;<br>DSGTHSWEYW; SGTHSWEYWG; GTHSWEYWGA; THSWEYWGAQ;<br>HSWEYWGAQL; SWEYWGAQLN; WEYWGAQLNA; EYWGAQLNAM;<br>YWGAQLNAMK; WGAQLNAMKP; GAQLNAMKPD; AQLNAMKPDL;<br>QLNAMKPDLQ; LNAMKPDLQR; NAMKPDLQRA; AMKPDLQRAL;<br>MKPDLQRALG; KPDLQRALGA; PDLQRALGAT; DLQRALGATP;<br>LQRALGATPN; QRALGATPNT; RALGATPNTG; ALGATPNTGP;<br>LGATPNTGPA; GATPNTGPAP; ATPNTGPAPQ; TPNTGPAPQG;<br>PNTGPAPQGA;<br><br>11 mers:<br>MQLVDRVRGAV; QLVDRVRGAVT; LVDRVRGAVTG;<br>VDRVRGAVTGM; DRVRGAVTGMS; RVRGAVTGMSR;<br>VRGAVTGMSRR; RGAVTGMSRRL; GAVTGMSRRLV;<br>AVTGMSRRLVV; VTGMSRRLVVG; TGMSRRLVVGA;<br>GMSRRLVVGAV; MSRRLVVGAVG; SRRLVVGAVGA;<br>RRLVVGAVGAA; RLVVGAVGAAL; LVVGAVGAALV; VVGAVGAALVS;<br>VGAVGAALVSG; GAVGAALVSGL; AVGAALVSGLV; VGAALVSGLVG;<br>GAALVSGLVGA; AALVSGLVGAV; ALVSGLVGAVG; LVSGLVGAVGG;<br>VSGLVGAVGGT; SGLVGAVGGTA; GLVGAVGGTAT; LVGAVGGTATA;<br>VGAVGGTATAG; GAVGGTATAGA; AVGGTATAGAF;<br>VGGTATAGAFS; GGTATAGAFSR; GTATAGAFSRP; TATAGAFSRPG;<br>ATAGAFSRPGL; TAGAFSRPGLP; AGAFSRPGLPV; GAFSRPGLPVE;<br>AFSRPGLPVEY; FSRPGLPVEYL; SRPGLPVEYLQ; RPGLPVEYLQV;<br>PGLPVEYLQVP; GLPVEYLQVPS; LPVEYLQVPSP; PVEYLQVPSPS;<br>VEYLQVPSPSM; EYLQVPSPSMG; YLQVPSPSMGR;<br>LQVPSPSMGRD; QVPSPSMGRDI; VPSPSMGRDIK; PSPSMGRDIKV;<br>SPSMGRDIKVQ; PSMGRDIKVQF; SMGRDIKVQFQ; MGRDIKVQFQS;<br>GRDIKVQFQSG; RDIKVQFQSGG; DIKVQFQSGGA; IKVQFQSGGAN;<br>KVQFQSGGANS; VQFQSGGANSP; QFQSGGANSPA;<br>FQSGGANSPAL; QSGGANSPALY; SGGANSPALYL; GGANSPALYLL;<br>GANSPALYLLD; ANSPALYLLDG; NSPALYLLDGL; SPALYLLDGLR;<br>PALYLLDGLRA; ALYLLDGLRAQ; LYLLDGLRAQD; YLLDGLRAQDD;<br>LLDGLRAQDDF; LDGLRAQDDFS; DGLRAQDDFSG;<br>GLRAQDDFSGW; LRAQDDFSGWD; RAQDDFSGWDI;<br>AQDDFSGWDIN; QDDFSGWDINT; DDFSGWDINTP; DFSGWDINTPA;<br>FSGWDINTPAF; SGWDINTPAFE; GWDINTPAFEW; WDINTPAFEWY;<br>DINTPAFEWYD; INTPAFEWYDQ; NTPAFEWYDQS; TPAFEWYDQSG;<br>PAFEWYDQSGL; AFEWYDQSGLS; FEWYDQSGLSV;<br>EWYDQSGLSVV; WYDQSGLSVVM; YDQSGLSVVMP;<br>DQSGLSVVMPV; QSGLSVVMPVG; SGLSVVMPVGG;<br>GLSVVMPVGGQ; LSVVMPVGGQS; SVVMPVGGQSS;<br>VVMPVGGQSSF; VMPVGGQSSFY; MPVGGQSSFYS;<br>PVGGQSSFYSD; VGGQSSFYSDW; GGQSSFYSDWY;<br>GQSSFYSDWYQ; QSSFYSDWYQP; SSFYSDWYQPA; | |

Fig. 28 continued

| | | | |
|---|---|---|---|
| | SFYSDWYQPAC; FYSDWYQPACG; YSDWYQPACGK; SDWYQPACGKA; DWYQPACGKAG; WYQPACGKAGC; YQPACGKAGCQ; QPACGKAGCQT; PACGKAGCQTY; ACGKAGCQTYK; CGKAGCQTYKW; GKAGCQTYKWE; KAGCQTYKWET; AGCQTYKWETF; GCQTYKWETFL; CQTYKWETFLT; QTYKWETFLTS; TYKWETFLTSE; YKWETFLTSEL; KWETFLTSELP; WETFLTSELPG; ETFLTSELPGW; TFLTSELPGWL; FLTSELPGWLQ; LTSELPGWLQA; TSELPGWLQAN; SELPGWLQANR; ELPGWLQANRH; LPGWLQANRHV; PGWLQANRHVK; GWLQANRHVKP; WLQANRHVKPT; LQANRHVKPTG; QANRHVKPTGS; ANRHVKPTGSA; NRHVKPTGSAV; RHVKPTGSAVV; HVKPTGSAVVG; VKPTGSAVVGL; KPTGSAVVGLS; PTGSAVVGLSM; TGSAVVGLSMA; GSAVVGLSMAA; SAVVGLSMAAS; AVVGLSMAASS; VVGLSMAASSA; VGLSMAASSAL; GLSMAASSALT; LSMAASSALTL; SMAASSALTLA; MAASSALTLAI; AASSALTLAIY; ASSALTLAIYH; SSALTLAIYHP; SALTLAIYHPQ; ALTLAIYHPQQ; LTLAIYHPQQF; TLAIYHPQQFV; LAIYHPQQFVY; AIYHPQQFVYA; IYHPQQFVYAG; YHPQQFVYAGA; HPQQFVYAGAM; PQQFVYAGAMS; QQFVYAGAMSG; QFVYAGAMSGL; FVYAGAMSGLL; VYAGAMSGLLD; YAGAMSGLLDP; AGAMSGLLDPS; GAMSGLLDPSQ; AMSGLLDPSQA; MSGLLDPSQAM; SGLLDPSQAMG; GLLDPSQAMGP; LLDPSQAMGPT; LDPSQAMGPTL; DPSQAMGPTLI; PSQAMGPTLIG; SQAMGPTLIGL; QAMGPTLIGLA; AMGPTLIGLAM; MGPTLIGLAMG; GPTLIGLAMGD; PTLIGLAMGDA; TLIGLAMGDAG; LIGLAMGDAGG; IGLAMGDAGGY; GLAMGDAGGYK; LAMGDAGGYKA; AMGDAGGYKAS; MGDAGGYKASD; GDAGGYKASDM; DAGGYKASDMW; AGGYKASDMWG; GGYKASDMWGP; GYKASDMWGPK; YKASDMWGPKE; KASDMWGPKED; ASDMWGPKEDP; SDMWGPKEDPA; DMWGPKEDPAW; MWGPKEDPAWQ; WGPKEDPAWQR; GPKEDPAWQRN; PKEDPAWQRND; KEDPAWQRNDP; EDPAWQRNDPL; DPAWQRNDPLL; PAWQRNDPLLN; AWQRNDPLLNV; WQRNDPLLNVG; QRNDPLLNVGK; RNDPLLNVGKL; NDPLLNVGKLI; DPLLNVGKLIA; PLLNVGKLIAN; LLNVGKLIANN; LNVGKLIANNT; NVGKLIANNTR; VGKLIANNTRV; GKLIANNTRVW; KLIANNTRVWV; LIANNTRVWVY; IANNTRVWVYC; ANNTRVWVYCG; NNTRVWVYCGN; NTRVWVYCGNG; TRVWVYCGNGK; RVWVYCGNGKP; VWVYCGNGKPS; WVYCGNGKPSD; VYCGNGKPSDL; YCGNGKPSDLG; CGNGKPSDLGG; GNGKPSDLGGN; NGKPSDLGGNN; GKPSDLGGNNL; KPSDLGGNNLP; PSDLGGNNLPA; SDLGGNNLPAK; DLGGNNLPAKF; LGGNNLPAKFL; GGNNLPAKFLE; GNNLPAKFLEG; NNLPAKFLEGF; NLPAKFLEGFV; LPAKFLEGFVR; PAKFLEGFVRT; AKFLEGFVRTS; KFLEGFVRTSN; FLEGFVRTSNI; LEGFVRTSNIK; EGFVRTSNIKF; GFVRTSNIKFQ; FVRTSNIKFQD; VRTSNIKFQDA; RTSNIKFQDAY; TSNIKFQDAYN; SNIKFQDAYNA; NIKFQDAYNAG; IKFQDAYNAGG; KFQDAYNAGGG; FQDAYNAGGGH; QDAYNAGGGHN; DAYNAGGGHNG; AYNAGGGHNGV; YNAGGGHNGVF; NAGGGHNGVFD; AGGGHNGVFDF; GGGHNGVFDFP; GGHNGVFDFPD; GHNGVFDFPDS; HNGVFDFPDSG; NGVFDFPDSGT; GVFDFPDSGTH; VFDFPDSGTHS; FDFPDSGTHSW; DFPDSGTHSWE; FPDSGTHSWEY; PDSGTHSWEYW; | |

Fig. 28 continued

| | | |
|---|---|---|
| | DSGTHSWEYWG; SGTHSWEYWGA; GTHSWEYWGAQ; THSWEYWGAQL; HSWEYWGAQLN; SWEYWGAQLNA; WEYWGAQLNAM; EYWGAQLNAMK; YWGAQLNAMKP; WGAQLNAMKPD; GAQLNAMKPDL; AQLNAMKPDLQ; QLNAMKPDLQR; LNAMKPDLQRA; NAMKPDLQRAL; AMKPDLQRALG; MKPDLQRALGA; KPDLQRALGAT; PDLQRALGATP; DLQRALGATPN; LQRALGATPNT; QRALGATPNTG; RALGATPNTGP; ALGATPNTGPA; LGATPNTGPAP; GATPNTGPAPQ; ATPNTGPAPQG; TPNTGPAPQGA; | |
| 82) Rv1886c/Ag85B | 8 mers:<br>MTDVSRKI; TDVSRKIR; DVSRKIRA; VSRKIRAW; SRKIRAWG; RKIRAWGR; KIRAWGRR; IRAWGRRL; RAWGRRLM; AWGRRLMI; WGRRLMIG; GRRLMIGT; RRLMIGTA; RLMIGTAA; LMIGTAAA; MIGTAAAV; IGTAAAVV; GTAAAVVL; TAAAVVLP; AAAVVLPG; AAVVLPGL; AVVLPGLV; VVLPGLVG; VLPGLVGL; LPGLVGLA; PGLVGLAG; GLVGLAGG; LVGLAGGA; VGLAGGAA; GLAGGAAT; LAGGAATA; AGGAATAG; GGAATAGA; GAATAGAF; AATAGAFS; ATAGAFSR; TAGAFSRP; AGAFSRPG; GAFSRPGL; AFSRPGLP; FSRPGLPV; SRPGLPVE; RPGLPVEY; PGLPVEYL; GLPVEYLQ; LPVEYLQV; PVEYLQVP; VEYLQVPS; EYLQVPSP; YLQVPSPS; LQVPSPSM; QVPSPSMG; VPSPSMGR; PSPSMGRD; SPSMGRDI; PSMGRDIK; SMGRDIKV; MGRDIKVQ; GRDIKVQF; RDIKVQFQ; DIKVQFQS; IKVQFQSG; KVQFQSGG; VQFQSGGN; QFQSGGNN; FQSGGNNS; QSGGNNSP; SGGNNSPA; GGNNSPAV; GNNSPAVY; NNSPAVYL; NSPAVYLL; SPAVYLLD; PAVYLLDG; AVYLLDGL; VYLLDGLR; YLLDGLRA; LLDGLRAQ; LDGLRAQD; DGLRAQDD; GLRAQDDY; LRAQDDYN; RAQDDYNG; AQDDYNGW; QDDYNGWD; DDYNGWDI; DYNGWDIN; YNGWDINT; NGWDINTP; GWDINTPA; WDINTPAF; DINTPAFE; INTPAFEW; NTPAFEWY; TPAFEWYY; PAFEWYYQ; AFEWYYQS; FEWYYQSG; EWYYQSGL; WYYQSGLS; YYQSGLSI; YQSGLSIV; QSGLSIVM; SGLSIVMP; GLSIVMPV; LSIVMPVG; SIVMPVGG; IVMPVGGQ; VMPVGGQS; MPVGGQSS; PVGGQSSF; VGGQSSFY; GGQSSFYS; GQSSFYSD; QSSFYSDW; SSFYSDWY; SFYSDWYS; FYSDWYSP; YSDWYSPA; SDWYSPAC; DWYSPACG; WYSPACGK; YSPACGKA; SPACGKAG; PACGKAGC; ACGKAGCQ; CGKAGCQT; GKAGCQTY; KAGCQTYK; AGCQTYKW; GCQTYKWE; CQTYKWET; QTYKWETF; TYKWETFL; YKWETFLT; KWETFLTS; WETFLTSE; ETFLTSEL; TFLTSELP; FLTSELPQ; LTSELPQW; TSELPQWL; SELPQWLS; ELPQWLSA; LPQWLSAN; PQWLSANR; QWLSANRA; WLSANRAV; LSANRAVK; SANRAVKP; ANRAVKPT; NRAVKPTG; RAVKPTGS; AVKPTGSA; VKPTGSAA; KPTGSAAI; PTGSAAIG; TGSAAIGL; GSAAIGLS; SAAIGLSM; AAIGLSMA; AIGLSMAG; IGLSMAGS; GLSMAGSS; LSMAGSSA; SMAGSSAM; MAGSSAMI; AGSSAMIL; GSSAMILA; SSAMILAA; SAMILAAY; AMILAAYH; MILAAYHP; ILAAYHPQ; LAAYHPQQ; AAYHPQQF; AYHPQQFI; YHPQQFIY; HPQQFIYA; PQQFIYAG; QQFIYAGS; QFIYAGSL; FIYAGSLS; IYAGSLSA; YAGSLSAL; AGSLSALL; GSLSALLD; SLSALLDP; LSALLDPS; SALLDPSQ; ALLDPSQG; LLDPSQGM; LDPSQGMG; DPSQGMGP; PSQGMGPS; SQGMGPSL; QGMGPSLI; GMGPSLIG; MGPSLIGL; GPSLIGLA; PSLIGLAM; SLIGLAMG; LIGLAMGD; IGLAMGDA; GLAMGDAG; LAMGDAGG; AMGDAGGY; MGDAGGYK; GDAGGYKA; DAGGYKAA; | 58519-59784 |

Fig. 28 continued

| | | |
|---|---|---|
| | AGGYKAAD; GGYKAADM; GYKAADMW; YKAADMWG; KAADMWGP; AADMWGPS; ADMWGPSS; DMWGPSSD; MWGPSSDP; WGPSSDPA; GPSSDPAW; PSSDPAWE; SSDPAWER; SDPAWERN; DPAWERND; PAWERNDP; AWERNDPT; WERNDPTQ; ERNDPTQQ; RNDPTQQI; NDPTQQIP; DPTQQIPK; PTQQIPKL; TQQIPKLV; QQIPKLVA; QIPKLVAN; IPKLVANN; PKLVANNT; KLVANNTR; LVANNTRL; VANNTRLW; ANNTRLWV; NNTRLWVY; NTRLWVYC; TRLWVYCG; RLWVYCGN; LWVYCGNG; WVYCGNGT; VYCGNGTP; YCGNGTPN; CGNGTPNE; GNGTPNEL; NGTPNELG; GTPNELGG; TPNELGGA; PNELGGAN; NELGGANI; ELGGANIP; LGGANIPA; GGANIPAE; GANIPAEF; ANIPAEFL; NIPAEFLE; IPAEFLEN; PAEFLENF; AEFLENFV; EFLENFVR; FLENFVRS; LENFVRSS; ENFVRSSN; NFVRSSNL; FVRSSNLK; VRSSNLKF; RSSNLKFQ; SSNLKFQD; SNLKFQDA; NLKFQDAY; LKFQDAYN; KFQDAYNA; FQDAYNAA; QDAYNAAG; DAYNAAGG; AYNAAGGH; YNAAGGHN; NAAGGHNA; AAGGHNAV; AGGHNAVF; GGHNAVFN; GHNAVFNF; HNAVFNFP; NAVFNFPP; AVFNFPPN; VFNFPPNG; FNFPPNGT; NFPPNGTH; FPPNGTHS; PPNGTHSW; PNGTHSWE; NGTHSWEY; GTHSWEYW; THSWEYWG; HSWEYWGA; SWEYWGAQ; WEYWGAQL; EYWGAQLN; YWGAQLNA; WGAQLNAM; GAQLNAMK; AQLNAMKG; QLNAMKGD; LNAMKGDL; NAMKGDLQ; AMKGDLQS; MKGDLQSS; KGDLQSSL; GDLQSSLG; DLQSSLGA; LQSSLGAG<br><br>9 mers:<br>MTDVSRKIR; TDVSRKIRA; DVSRKIRAW; VSRKIRAWG; SRKIRAWGR; RKIRAWGRR; KIRAWGRRL; IRAWGRRLM; RAWGRRLMI; AWGRRLMIG; WGRRLMIGT; GRRLMIGTA; RRLMIGTAA; RLMIGTAAA; LMIGTAAAV; MIGTAAAVV; IGTAAAVVL; GTAAAVVLP; TAAAVVLPG; AAAVVLPGL; AAVVLPGLV; AVVLPGLVG; VVLPGLVGL; VLPGLVGLA; LPGLVGLAG; PGLVGLAGG; GLVGLAGGA; LVGLAGGAA; VGLAGGAAT; GLAGGAATA; LAGGAATAG; AGGAATAGA; GGAATAGAF; GAATAGAFS; AATAGAFSR; ATAGAFSRP; TAGAFSRPG; AGAFSRPGL; GAFSRPGLP; AFSRPGLPV; FSRPGLPVE; SRPGLPVEY; RPGLPVEYL; PGLPVEYLQ; GLPVEYLQV; LPVEYLQVP; PVEYLQVPS; VEYLQVPSP; EYLQVPSPS; YLQVPSPSM; LQVPSPSMG; QVPSPSMGR; VPSPSMGRD; PSPSMGRDI; SPSMGRDIK; PSMGRDIKV; SMGRDIKVQ; MGRDIKVQF; GRDIKVQFQ; RDIKVQFQS; DIKVQFQSG; IKVQFQSGG; KVQFQSGGN; VQFQSGGNN; QFQSGGNNS; FQSGGNNSP; QSGGNNSPA; SGGNNSPAV; GGNNSPAVY; GNNSPAVYL; NNSPAVYLL; NSPAVYLLD; SPAVYLLDG; PAVYLLDGL; AVYLLDGLR; VYLLDGLRA; YLLDGLRAQ; LLDGLRAQD; LDGLRAQDD; DGLRAQDDY; GLRAQDDYN; LRAQDDYNG; RAQDDYNGW; AQDDYNGWD; QDDYNGWDI; DDYNGWDIN; DYNGWDINT; YNGWDINTP; NGWDINTPA; GWDINTPAF; WDINTPAFE; DINTPAFEW; INTPAFEWY; NTPAFEWYY; TPAFEWYYQ; PAFEWYYQS; AFEWYYQSG; FEWYYQSGL; EWYYQSGLS; WYYQSGLSI; YYQSGLSIV; YQSGLSIVM; QSGLSIVMP; SGLSIVMPV; GLSIVMPVG; LSIVMPVGG; SIVMPVGGQ; IVMPVGGQS; VMPVGGQSS; MPVGGQSSF; PVGGQSSFY; VGGQSSFYS; GGQSSFYSD; GQSSFYSDW; QSSFYSDWY; SSFYSDWYS; SFYSDWYSP; FYSDWYSPA; YSDWYSPAC; SDWYSPACG; | |

Fig. 28 continued

| | | | |
|---|---|---|---|
| | DWYSPACGK; WYSPACGKA; YSPACGKAG; SPACGKAGC; PACGKAGCQ; ACGKAGCQT; CGKAGCQTY; GKAGCQTYK; KAGCQTYKW; AGCQTYKWE; GCQTYKWET; CQTYKWETF; QTYKWETFL; TYKWETFLT; YKWETFLTS; KWETFLTSE; WETFLTSEL; ETFLTSELP; TFLTSELPQ; FLTSELPQW; LTSELPQWL; TSELPQWLS; SELPQWLSA; ELPQWLSAN; LPQWLSANR; PQWLSANRA; QWLSANRAV; WLSANRAVK; LSANRAVKP; SANRAVKPT; ANRAVKPTG; NRAVKPTGS; RAVKPTGSA; AVKPTGSAA; VKPTGSAAI; KPTGSAAIG; PTGSAAIGL; TGSAAIGLS; GSAAIGLSM; SAAIGLSMA; AAIGLSMAG; AIGLSMAGS; IGLSMAGSS; GLSMAGSSA; LSMAGSSAM; SMAGSSAMI; MAGSSAMIL; AGSSAMILA; GSSAMILAA; SSAMILAAY; SAMILAAYH; AMILAAYHP; MILAAYHPQ; ILAAYHPQQ; LAAYHPQQF; AAYHPQQFI; AYHPQQFIY; YHPQQFIYA; HPQQFIYAG; PQQFIYAGS; QQFIYAGSL; QFIYAGSLS; FIYAGSLSA; IYAGSLSAL; YAGSLSALL; AGSLSALLD; GSLSALLDP; SLSALLDPS; LSALLDPSQ; SALLDPSQG; ALLDPSQGM; LLDPSQGMG; LDPSQGMGP; DPSQGMGPS; PSQGMGPSL; SQGMGPSLI; QGMGPSLIG; GMGPSLIGL; MGPSLIGLA; GPSLIGLAM; PSLIGLAMG; SLIGLAMGD; LIGLAMGDA; IGLAMGDAG; GLAMGDAGG; LAMGDAGGY; AMGDAGGYK; MGDAGGYKA; GDAGGYKAA; DAGGYKAAD; AGGYKAADM; GGYKAADMW; GYKAADMWG; YKAADMWGP; KAADMWGPS; AADMWGPSS; ADMWGPSSD; DMWGPSSDP; MWGPSSDPA; WGPSSDPAW; GPSSDPAWE; PSSDPAWER; SSDPAWERN; SDPAWERND; DPAWERNDP; PAWERNDPT; AWERNDPTQ; WERNDPTQQ; ERNDPTQQI; RNDPTQQIP; NDPTQQIPK; DPTQQIPKL; PTQQIPKLV; TQQIPKLVA; QQIPKLVAN; QIPKLVANN; IPKLVANNT; PKLVANNTR; KLVANNTRL; LVANNTRLW; VANNTRLWV; ANNTRLWVY; NNTRLWVYC; NTRLWVYCG; TRLWVYCGN; RLWVYCGNG; LWVYCGNGT; WVYCGNGTP; VYCGNGTPN; YCGNGTPNE; CGNGTPNEL; GNGTPNELG; NGTPNELGG; GTPNELGGA; TPNELGGAN; PNELGGANI; NELGGANIP; ELGGANIPA; LGGANIPAE; GGANIPAEF; GANIPAEFL; ANIPAEFLE; NIPAEFLEN; IPAEFLENF; PAEFLENFV; AEFLENFVR; EFLENFVRS; FLENFVRSS; LENFVRSSN; ENFVRSSNL; NFVRSSNLK; FVRSSNLKF; VRSSNLKFQ; RSSNLKFQD; SSNLKFQDA; SNLKFQDAY; NLKFQDAYN; LKFQDAYNA; KFQDAYNAA; FQDAYNAAG; QDAYNAAGG; DAYNAAGGH; AYNAAGGHN; YNAAGGHNA; NAAGGHNAV; AAGGHNAVF; AGGHNAVFN; GGHNAVFNF; GHNAVFNFP; HNAVFNFPP; NAVFNFPPN; AVFNFPPNG; VFNFPPNGT; FNFPPNGTH; NFPPNGTHS; FPPNGTHSW; PPNGTHSWE; PNGTHSWEY; NGTHSWEYW; GTHSWEYWG; THSWEYWGA; HSWEYWGAQ; SWEYWGAQL; WEYWGAQLN; EYWGAQLNA; YWGAQLNAM; WGAQLNAMK; GAQLNAMKG; AQLNAMKGD; QLNAMKGDL; LNAMKGDLQ; NAMKGDLQS; AMKGDLQSS; MKGDLQSSL; KGDLQSSLG; GDLQSSLGA; DLQSSLGAG<br><br>10 mers:<br>MTDVSRKIRA; TDVSRKIRAW; DVSRKIRAWG; VSRKIRAWGR; SRKIRAWGRR; RKIRAWGRRL; KIRAWGRRLM; IRAWGRRLMI; RAWGRRLMIG; AWGRRLMIGT; WGRRLMIGTA; GRRLMIGTAA; RRLMIGTAAA; RLMIGTAAAV; LMIGTAAAVV; MIGTAAAVVL; IGTAAAVVLP; GTAAAVVLPG; TAAAVVLPGL; AAAVVLPGLV; | |

Fig. 28 continued

| | | |
|---|---|---|
| | AAVVLPGLVG; AVVLPGLVGL; VVLPGLVGLA; VLPGLVGLAG; LPGLVGLAGG; PGLVGLAGGA; GLVGLAGGAA; LVGLAGGAAT; VGLAGGAATA; GLAGGAATAG; LAGGAATAGA; AGGAATAGAF; GGAATAGAFS; GAATAGAFSR; AATAGAFSRP; ATAGAFSRPG; TAGAFSRPGL; AGAFSRPGLP; GAFSRPGLPV; AFSRPGLPVE; FSRPGLPVEY; SRPGLPVEYL; RPGLPVEYLQ; PGLPVEYLQV; GLPVEYLQVP; LPVEYLQVPS; PVEYLQVPSP; VEYLQVPSPS; EYLQVPSPSM; YLQVPSPSMG; LQVPSPSMGR; QVPSPSMGRD; VPSPSMGRDI; PSPSMGRDIK; SPSMGRDIKV; PSMGRDIKVQ; SMGRDIKVQF; MGRDIKVQFQ; GRDIKVQFQS; RDIKVQFQSG; DIKVQFQSGG; IKVQFQSGGN; KVQFQSGGNN; VQFQSGGNNS; QFQSGGNNSP; FQSGGNNSPA; QSGGNNSPAV; SGGNNSPAVY; GGNNSPAVYL; GNNSPAVYLL; NNSPAVYLLD; NSPAVYLLDG; SPAVYLLDGL; PAVYLLDGLR; AVYLLDGLRA; VYLLDGLRAQ; YLLDGLRAQD; LLDGLRAQDD; LDGLRAQDDY; DGLRAQDDYN; GLRAQDDYNG; LRAQDDYNGW; RAQDDYNGWD; AQDDYNGWDI; QDDYNGWDIN; DDYNGWDINT; DYNGWDINTP; YNGWDINTPA; NGWDINTPAF; GWDINTPAFE; WDINTPAFEW; DINTPAFEWY; INTPAFEWYY; NTPAFEWYYQ; TPAFEWYYQS; PAFEWYYQSG; AFEWYYQSGL; FEWYYQSGLS; EWYYQSGLSI; WYYQSGLSIV; YYQSGLSIVM; YQSGLSIVMP; QSGLSIVMPV; SGLSIVMPVG; GLSIVMPVGG; LSIVMPVGGQ; SIVMPVGGQS; IVMPVGGQSS; VMPVGGQSSF; MPVGGQSSFY; PVGGQSSFYS; VGGQSSFYSD; GGQSSFYSDW; GQSSFYSDWY; QSSFYSDWYS; SSFYSDWYSP; SFYSDWYSPA; FYSDWYSPAC; YSDWYSPACG; SDWYSPACGK; DWYSPACGKA; WYSPACGKAG; YSPACGKAGC; SPACGKAGCQ; PACGKAGCQT; ACGKAGCQTY; CGKAGCQTYK; GKAGCQTYKW; KAGCQTYKWE; AGCQTYKWET; GCQTYKWETF; CQTYKWETFL; QTYKWETFLT; TYKWETFLTS; YKWETFLTSE; KWETFLTSEL; WETFLTSELP; ETFLTSELPQ; TFLTSELPQW; FLTSELPQWL; LTSELPQWLS; TSELPQWLSA; SELPQWLSAN; ELPQWLSANR; LPQWLSANRA; PQWLSANRAV; QWLSANRAVK; WLSANRAVKP; LSANRAVKPT; SANRAVKPTG; ANRAVKPTGS; NRAVKPTGSA; RAVKPTGSAA; AVKPTGSAAI; VKPTGSAAIG; KPTGSAAIGL; PTGSAAIGLS; TGSAAIGLSM; GSAAIGLSMA; SAAIGLSMAG; AAIGLSMAGS; AIGLSMAGSS; IGLSMAGSSA; GLSMAGSSAM; LSMAGSSAMI; SMAGSSAMIL; MAGSSAMILA; AGSSAMILAA; GSSAMILAAY; SSAMILAAYH; SAMILAAYHP; AMILAAYHPQ; MILAAYHPQQ; ILAAYHPQQF; LAAYHPQQFI; AAYHPQQFIY; AYHPQQFIYA; YHPQQFIYAG; HPQQFIYAGS; PQQFIYAGSL; QQFIYAGSLS; QFIYAGSLSA; FIYAGSLSAL; IYAGSLSALL; YAGSLSALLD; AGSLSALLDP; GSLSALLDPS; SLSALLDPSQ; LSALLDPSQG; SALLDPSQGM; ALLDPSQGMG; LLDPSQGMGP; LDPSQGMGPS; DPSQGMGPSL; PSQGMGPSLI; SQGMGPSLIG; QGMGPSLIGL; GMGPSLIGLA; MGPSLIGLAM; GPSLIGLAMG; PSLIGLAMGD; SLIGLAMGDA; LIGLAMGDAG; IGLAMGDAGG; GLAMGDAGGY; LAMGDAGGYK; AMGDAGGYKA; MGDAGGYKAA; GDAGGYKAAD; DAGGYKAADM; AGGYKAADMW; GGYKAADMWG; GYKAADMWGP; YKAADMWGPS; KAADMWGPSS; AADMWGPSSD; ADMWGPSSDP; DMWGPSSDPA; MWGPSSDPAW; WGPSSDPAWE; GPSSDPAWER; PSSDPAWERN; SSDPAWERND; SDPAWERNDP; DPAWERNDPT; PAWERNDPTQ; AWERNDPTQQ; WERNDPTQQI; ERNDPTQQIP; RNDPTQQIPK; NDPTQQIPKL; DPTQQIPKLV; | |

Fig. 28 continued

| | | |
|---|---|---|
| | PTQQIPKLVA; TQQIPKLVAN; QQIPKLVANN; QIPKLVANNT; IPKLVANNTR; PKLVANNTRL; KLVANNTRLW; LVANNTRLWV; VANNTRLWVY; ANNTRLWVYC; NNTRLWVYCG; NTRLWVYCGN; TRLWVYCGNG; RLWVYCGNGT; LWVYCGNGTP; WVYCGNGTPN; VYCGNGTPNE; YCGNGTPNEL; CGNGTPNELG; GNGTPNELGG; NGTPNELGGA; GTPNELGGAN; TPNELGGANI; PNELGGANIP; NELGGANIPA; ELGGANIPAE; LGGANIPAEF; GGANIPAEFL; GANIPAEFLE; ANIPAEFLEN; NIPAEFLENF; IPAEFLENFV; PAEFLENFVR; AEFLENFVRS; EFLENFVRSS; FLENFVRSSN; LENFVRSSNL; ENFVRSSNLK; NFVRSSNLKF; FVRSSNLKFQ; VRSSNLKFQD; RSSNLKFQDA; SSNLKFQDAY; SNLKFQDAYN; NLKFQDAYNA; LKFQDAYNAA; KFQDAYNAAG; FQDAYNAAGG; QDAYNAAGGH; DAYNAAGGHN; AYNAAGGHNA; YNAAGGHNAV; NAAGGHNAVF; AAGGHNAVFN; AGGHNAVFNF; GGHNAVFNFP; GHNAVFNFPP; HNAVFNFPPN; NAVFNFPPNG; AVFNFPPNGT; VFNFPPNGTH; FNFPPNGTHS; NFPPNGTHSW; FPPNGTHSWE; PPNGTHSWEY; PNGTHSWEYW; NGTHSWEYWG; GTHSWEYWGA; THSWEYWGAQ; HSWEYWGAQL; SWEYWGAQLN; WEYWGAQLNA; EYWGAQLNAM; YWGAQLNAMK; WGAQLNAMKG; GAQLNAMKGD; AQLNAMKGDL; QLNAMKGDLQ; LNAMKGDLQS; NAMKGDLQSS; AMKGDLQSSL; MKGDLQSSLG; KGDLQSSLGA; GDLQSSLGAG<br><br>11 mers:<br>MTDVSRKIRAW; TDVSRKIRAWG; DVSRKIRAWGR; VSRKIRAWGRR; SRKIRAWGRRL; RKIRAWGRRLM; KIRAWGRRLMI; IRAWGRRLMIG; RAWGRRLMIGT; AWGRRLMIGTA; WGRRLMIGTAA; GRRLMIGTAAA; RRLMIGTAAAV; RLMIGTAAAVV; LMIGTAAAVVL; MIGTAAAVVLP; IGTAAAVVLPG; GTAAAVVLPGL; TAAAVVLPGLV; AAAVVLPGLVG; AAVVLPGLVGL; AVVLPGLVGLA; VVLPGLVGLAG; VLPGLVGLAGG; LPGLVGLAGGA; PGLVGLAGGAA; GLVGLAGGAAT; LVGLAGGAATA; VGLAGGAATAG; GLAGGAATAGA; LAGGAATAGAF; AGGAATAGAFS; GGAATAGAFSR; GAATAGAFSRP; AATAGAFSRPG; ATAGAFSRPGL; TAGAFSRPGLP; AGAFSRPGLPV; GAFSRPGLPVE; AFSRPGLPVEY; FSRPGLPVEYL; SRPGLPVEYLQ; RPGLPVEYLQV; PGLPVEYLQVP; GLPVEYLQVPS; LPVEYLQVPSP; PVEYLQVPSPS; VEYLQVPSPSM; EYLQVPSPSMG; YLQVPSPSMGR; LQVPSPSMGRD; QVPSPSMGRDI; VPSPSMGRDIK; PSPSMGRDIKV; SPSMGRDIKVQ; PSMGRDIKVQF; SMGRDIKVQFQ; MGRDIKVQFQS; GRDIKVQFQSG; RDIKVQFQSGG; DIKVQFQSGGN; IKVQFQSGGNN; KVQFQSGGNNS; VQFQSGGNNSP; QFQSGGNNSPA; FQSGGNNSPAV; QSGGNNSPAVY; SGGNNSPAVYL; GGNNSPAVYLL; GNNSPAVYLLD; NNSPAVYLLDG; NSPAVYLLDGL; SPAVYLLDGLR; PAVYLLDGLRA; AVYLLDGLRAQ; VYLLDGLRAQD; YLLDGLRAQDD; LLDGLRAQDDY; LDGLRAQDDYN; DGLRAQDDYNG; GLRAQDDYNGW; LRAQDDYNGWD; RAQDDYNGWDI; AQDDYNGWDIN; QDDYNGWDINT; DDYNGWDINTP; DYNGWDINTPA; YNGWDINTPAF; NGWDINTPAFE; GWDINTPAFEW; WDINTPAFEWY; DINTPAFEWYY; INTPAFEWYYQ; NTPAFEWYYQS; TPAFEWYYQSG; PAFEWYYQSGL; AFEWYYQSGLS; FEWYYQSGLSI; EWYYQSGLSIV; WYYQSGLSIVM; YYQSGLSIVMP; YQSGLSIVMPV; QSGLSIVMPVG; SGLSIVMPVGG; GLSIVMPVGGQ; LSIVMPVGGQS; SIVMPVGGQSS; IVMPVGGQSSF; VMPVGGQSSFY; MPVGGQSSFYS; PVGGQSSFYSD; VGGQSSFYSDW; GGQSSFYSDWY; | |

Fig. 28 continued

GQSSFYSDWYS; QSSFYSDWYSP; SSFYSDWYSPA;
SFYSDWYSPAC; FYSDWYSPACG; YSDWYSPACGK;
SDWYSPACGKA; DWYSPACGKAG; WYSPACGKAGC;
YSPACGKAGCQ; SPACGKAGCQT; PACGKAGCQTY;
ACGKAGCQTYK; CGKAGCQTYKW; GKAGCQTYKWE;
KAGCQTYKWET; AGCQTYKWETF; GCQTYKWETFL;
CQTYKWETFLT; QTYKWETFLTS; TYKWETFLTSE; YKWETFLTSEL;
KWETFLTSELP; WETFLTSELPQ; ETFLTSELPQW; TFLTSELPQWL;
FLTSELPQWLS; LTSELPQWLSA; TSELPQWLSAN; SELPQWLSANR;
ELPQWLSANRA; LPQWLSANRAV; PQWLSANRAVK;
QWLSANRAVKP; WLSANRAVKPT; LSANRAVKPTG; SANRAVKPTGS;
ANRAVKPTGSA; NRAVKPTGSAA; RAVKPTGSAAI; AVKPTGSAAIG;
VKPTGSAAIGL; KPTGSAAIGLS; PTGSAAIGLSM; TGSAAIGLSMA;
GSAAIGLSMAG; SAAIGLSMAGS; AAIGLSMAGSS; AIGLSMAGSSA;
IGLSMAGSSAM; GLSMAGSSAMI; LSMAGSSAMIL; SMAGSSAMILA;
MAGSSAMILAA; AGSSAMILAAY; GSSAMILAAYH; SSAMILAAYHP;
SAMILAAYHPQ; AMILAAYHPQQ; MILAAYHPQQF; ILAAYHPQQFI;
LAAYHPQQFIY; AAYHPQQFIYA; AYHPQQFIYAG; YHPQQFIYAGS;
HPQQFIYAGSL; PQQFIYAGSLS; QQFIYAGSLSA; QFIYAGSLSAL;
FIYAGSLSALL; IYAGSLSALLD; YAGSLSALLDP; AGSLSALLDPS;
GSLSALLDPSQ; SLSALLDPSQG; LSALLDPSQGM; SALLDPSQGMG;
ALLDPSQGMGP; LLDPSQGMGPS; LDPSQGMGPSL;
DPSQGMGPSLI; PSQGMGPSLIG; SQGMGPSLIGL; QGMGPSLIGLA;
GMGPSLIGLAM; MGPSLIGLAMG; GPSLIGLAMGD; PSLIGLAMGDA;
SLIGLAMGDAG; LIGLAMGDAGG; IGLAMGDAGGY; GLAMGDAGGYK;
LAMGDAGGYKA; AMGDAGGYKAA; MGDAGGYKAAD;
GDAGGYKAADM; DAGGYKAADMW; AGGYKAADMWG;
GGYKAADMWGP; GYKAADMWGPS; YKAADMWGPSS;
KAADMWGPSSD; AADMWGPSSDP; ADMWGPSSDPA;
DMWGPSSDPAW; MWGPSSDPAWE; WGPSSDPAWER;
GPSSDPAWERN; PSSDPAWERND; SSDPAWERNDP;
SDPAWERNDPT; DPAWERNDPTQ; PAWERNDPTQQ;
AWERNDPTQQI; WERNDPTQQIP; ERNDPTQQIPK; RNDPTQQIPKL;
NDPTQQIPKLV; DPTQQIPKLVA; PTQQIPKLVAN; TQQIPKLVANN;
QQIPKLVANNT; QIPKLVANNTR; IPKLVANNTRL; PKLVANNTRLW;
KLVANNTRLWV; LVANNTRLWVY; VANNTRLWVYC;
ANNTRLWVYCG; NNTRLWVYCGN; NTRLWVYCGNG;
TRLWVYCGNGT; RLWVYCGNGTP; LWVYCGNGTPN;
WVYCGNGTPNE; VYCGNGTPNEL; YCGNGTPNELG;
CGNGTPNELGG; GNGTPNELGGA; NGTPNELGGAN;
GTPNELGGANI; TPNELGGANIP; PNELGGANIPA; NELGGANIPAE;
ELGGANIPAEF; LGGANIPAEFL; GGANIPAEFLE; GANIPAEFLEN;
ANIPAEFLENF; NIPAEFLENFV; IPAEFLENFVR; PAEFLENFVRS;
AEFLENFVRSS; EFLENFVRSSN; FLENFVRSSNL; LENFVRSSNLK;
ENFVRSSNLKF; NFVRSSNLKFQ; FVRSSNLKFQD; VRSSNLKFQDA;
RSSNLKFQDAY; SSNLKFQDAYN; SNLKFQDAYNA; NLKFQDAYNAA;
LKFQDAYNAAG; KFQDAYNAAGG; FQDAYNAAGGH;
QDAYNAAGGHN; DAYNAAGGHNA; AYNAAGGHNAV;
YNAAGGHNAVF; NAAGGHNAVFN; AAGGHNAVFNF;
AGGHNAVFNFP; GGHNAVFNFPP; GHNAVFNFPPN;
HNAVFNFPPNG; NAVFNFPPNGT; AVFNFPPNGTH; VFNFPPNGTHS;
FNFPPNGTHSW; NFPPNGTHSWE; FPPNGTHSWEY;
PPNGTHSWEYW; PNGTHSWEYWG; NGTHSWEYWGA;

Fig. 28 continued

| | | |
|---|---|---|
| | GTHSWEYWGAQ; THSWEYWGAQL; HSWEYWGAQLN; SWEYWGAQLNA; WEYWGAQLNAM; EYWGAQLNAMK; YWGAQLNAMKG; WGAQLNAMKGD; GAQLNAMKGDL; AQLNAMKGDLQ; QLNAMKGDLQS; LNAMKGDLQSS; NAMKGDLQSSL; AMKGDLQSSLG; MKGDLQSSLGA; KGDLQSSLGAG | |

Fig. 28 continued

Figure 29

| Antigen designation | Amino acid sequence | SEQ ID NO |
|---|---|---|
| 1) Rv0116c | 13 mers: MRRVVRYLSVVVA; RRVVRYLSVVVAI; RVVRYLSVVVAIT; VVRYLSVVVAITL; VRYLSVVVAITLM; RYLSVVVAITLML; YLSVVVAITLMLT; LSVVVAITLMLTA; SVVVAITLMLTAE; VVVAITLMLTAES; VVAITLMLTAESV; VAITLMLTAESVS; AITLMLTAESVSI; ITLMLTAESVSIA; TLMLTAESVSIAT; LMLTAESVSIATA; MLTAESVSIATAA; LTAESVSIATAAV; TAESVSIATAAVP; AESVSIATAAVPP; ESVSIATAAVPPL; SVSIATAAVPPLQ; VSIATAAVPPLQP; SIATAAVPPLQPI; IATAAVPPLQPIP; ATAAVPPLQPIPG; TAAVPPLQPIPGV; AAVPPLQPIPGVA; AVPPLQPIPGVAS; VPPLQPIPGVASV; PPLQPIPGVASVS; PLQPIPGVASVSP; LQPIPGVASVSPA; QPIPGVASVSPAN; PIPGVASVSPANG; IPGVASVSPANGA; PGVASVSPANGAV; GVASVSPANGAVV; VASVSPANGAVVG; ASVSPANGAVVGV; SVSPANGAVVGVA; VSPANGAVVGVAH; SPANGAVVGVAHP; PANGAVVGVAHPV; ANGAVVGVAHPVV; NGAVVGVAHPVVV; GAVVGVAHPVVVT; AVVGVAHPVVVTF; VVGVAHPVVVTFT; VGVAHPVVVTFTT; GVAHPVVVTFTTP; VAHPVVVTFTTPV; AHPVVVTFTTPVT; HPVVVTFTTPVTD; PVVVTFTTPVTDR; VVVTFTTPVTDRR; VVTFTTPVTDRRA; VTFTTPVTDRRAV; TFTTPVTDRRAVE; FTTPVTDRRAVER; TTPVTDRRAVERS; TPVTDRRAVERSI; PVTDRRAVERSIR; VTDRRAVERSIRI; TDRRAVERSIRIS; DRRAVERSIRIST; RRAVERSIRISTP; RAVERSIRISTPH; AVERSIRISTPHN; VERSIRISTPHNT; ERSIRISTPHNTT; RSIRISTPHNTTG; SIRISTPHNTTGH; IRISTPHNTTGHF; RISTPHNTTGHFE; ISTPHNTTGHFEW; STPHNTTGHFEWV; TPHNTTGHFEWVA; PHNTTGHFEWVAS; HNTTGHFEWVASN; NTTGHFEWVASNV; TTGHFEWVASNVV; TGHFEWVASNVVR; GHFEWVASNVVRW; HFEWVASNVVRWV; FEWVASNVVRWVP; EWVASNVVRWVPH; WVASNVVRWVPHR; VASNVVRWVPHRY; ASNVVRWVPHRYW; SNVVRWVPHRYWP; NVVRWVPHRYWPP; VVRWVPHRYWPPH; VRWVPHRYWPPHT; RWVPHRYWPPHTR; WVPHRYWPPHTRV; VPHRYWPPHTRVS; PHRYWPPHTRVSV; HRYWPPHTRVSVG; RYWPPHTRVSVGV; YWPPHTRVSVGVQ; WPPHTRVSVGVQE; PPHTRVSVGVQEL; PHTRVSVGVQELT; HTRVSVGVQELTE; TRVSVGVQELTEG; RVSVGVQELTEGF; VSVGVQELTEGFE; SVGVQELTEGFET; VGVQELTEGFETG; GVQELTEGFETGD; VQELTEGFETGDA; QELTEGFETGDAL; ELTEGFETGDALI; LTEGFETGDALIG; TEGFETGDALIGV; EGFETGDALIGVA; GFETGDALIGVAS; FETGDALIGVASI; ETGDALIGVASIS; TGDALIGVASISA; GDALIGVASISAH; DALIGVASISAHT; ALIGVASISAHTF; LIGVASISAHTFT; IGVASISAHTFTV; GVASISAHTFTVS; VASISAHTFTVSR; ASISAHTFTVSRN; SISAHTFTVSRNG; ISAHTFTVSRNGE; SAHTFTVSRNGEV; AHTFTVSRNGEVL; HTFTVSRNGEVLR; TFTVSRNGEVLRT; FTVSRNGEVLRTM; TVSRNGEVLRTMP; VSRNGEVLRTMPA; SRNGEVLRTMPAS; RNGEVLRTMPASL; NGEVLRTMPASLG; GEVLRTMPASLGK; EVLRTMPASLGKP; VLRTMPASLGKPS; LRTMPASLGKPSR; RTMPASLGKPSRP; TMPASLGKPSRPT; MPASLGKPSRPTP; PASLGKPSRPTPI; ASLGKPSRPTPIG; SLGKPSRPTPIGS; LGKPSRPTPIGSF; GKPSRPTPIGSFH; KPSRPTPIGSFHA; PSRPTPIGSFHAM; SRPTPIGSFHAMS; RPTPIGSFHAMSK; PTPIGSFHAMSKE; TPIGSFHAMSKER; PIGSFHAMSKERT; IGSFHAMSKERTV; GSFHAMSKERTVV; SFHAMSKERTVVM; FHAMSKERTVVMD; HAMSKERTVVMDS; AMSKERTVVMDSR; MSKERTVVMDSRT; SKERTVVMDSRTI; KERTVVMDSRTIG; ERTVVMDSRTIGI; RTVVMDSRTIGIP; TVVMDSRTIGIPL; VVMDSRTIGIPLN; VMDSRTIGIPLNS; | 59785-60734 |

| | | |
|---|---|---|
| | MDSRTIGIPLNSS; DSRTIGIPLNSSD; SRTIGIPLNSSDG; RTIGIPLNSSDGY; TIGIPLNSSDGYL; IGIPLNSSDGYLL; GIPLNSSDGYLLT; IPLNSSDGYLLTA; PLNSSDGYLLTAH; LNSSDGYLLTAHY; NSSDGYLLTAHYA; SSDGYLLTAHYAV; SDGYLLTAHYAVR; DGYLLTAHYAVRV; GYLLTAHYAVRVT; YLLTAHYAVRVTW; LLTAHYAVRVTWS; LTAHYAVRVTWSG; TAHYAVRVTWSGV; AHYAVRVTWSGVY; HYAVRVTWSGVYV; YAVRVTWSGVYVH; AVRVTWSGVYVHS; VRVTWSGVYVHSA; RVTWSGVYVHSAP; VTWSGVYVHSAPW; TWSGVYVHSAPWS; WSGVYVHSAPWSV; SGVYVHSAPWSVN; GVYVHSAPWSVNS; VYVHSAPWSVNSQ; YVHSAPWSVNSQG; VHSAPWSVNSQGY; HSAPWSVNSQGYA; SAPWSVNSQGYAN; APWSVNSQGYANV; PWSVNSQGYANVS; WSVNSQGYANVSH; SVNSQGYANVSHG; VNSQGYANVSHGC; NSQGYANVSHGCI; SQGYANVSHGCIN; QGYANVSHGCINL; GYANVSHGCINLS; YANVSHGCINLSP; ANVSHGCINLSPD; NVSHGCINLSPDN; VSHGCINLSPDNA; SHGCINLSPDNAA; HGCINLSPDNAAW; GCINLSPDNAAWY; CINLSPDNAAWYF; INLSPDNAAWYFD; NLSPDNAAWYFDA; LSPDNAAWYFDAV; SPDNAAWYFDAVT; PDNAAWYFDAVTV; DNAAWYFDAVTVG; NAAWYFDAVTVGD; AAWYFDAVTVGDP; AWYFDAVTVGDPI; WYFDAVTVGDPIE; YFDAVTVGDPIEV; FDAVTVGDPIEVV; DAVTVGDPIEVVG<br><br>14 mers:<br>MRRVVRYLSVVVAI; RRVVRYLSVVVAIT; RVVRYLSVVVAITL; VVRYLSVVVAITLM; VRYLSVVVAITLML; RYLSVVVAITLMLT; YLSVVVAITLMLTA; LSVVVAITLMLTAE; SVVVAITLMLTAES; VVVAITLMLTAESV; VVAITLMLTAESVS; VAITLMLTAESVSI; AITLMLTAESVSIA; ITLMLTAESVSIAT; TLMLTAESVSIATA; LMLTAESVSIATAA; MLTAESVSIATAAV; LTAESVSIATAAVP; TAESVSIATAAVPP; AESVSIATAAVPPL; ESVSIATAAVPPLQ; SVSIATAAVPPLQP; VSIATAAVPPLQPI; SIATAAVPPLQPIP; IATAAVPPLQPIPG; ATAAVPPLQPIPGV; TAAVPPLQPIPGVA; AAVPPLQPIPGVAS; AVPPLQPIPGVASV; VPPLQPIPGVASVS; PPLQPIPGVASVSP; PLQPIPGVASVSPA; LQPIPGVASVSPAN; QPIPGVASVSPANG; PIPGVASVSPANGA; IPGVASVSPANGAV; PGVASVSPANGAVV; GVASVSPANGAVVG; VASVSPANGAVVGV; ASVSPANGAVVGVA; SVSPANGAVVGVAH; VSPANGAVVGVAHP; SPANGAVVGVAHPV; PANGAVVGVAHPVV; ANGAVVGVAHPVVV; NGAVVGVAHPVVVT; GAVVGVAHPVVVTF; AVVGVAHPVVVTFT; VVGVAHPVVVTFTT; VGVAHPVVVTFTTP; GVAHPVVVTFTTPV; VAHPVVVTFTTPVT; AHPVVVTFTTPVTD; HPVVVTFTTPVTDR; PVVVTFTTPVTDRR; VVVTFTTPVTDRRA; VVTFTTPVTDRRAV; VTFTTPVTDRRAVE; TFTTPVTDRRAVER; FTTPVTDRRAVERS; TTPVTDRRAVERSI; TPVTDRRAVERSIR; PVTDRRAVERSIRI; VTDRRAVERSIRIS; TDRRAVERSIRIST; DRRAVERSIRISTP; RRAVERSIRISTPH; RAVERSIRISTPHN; AVERSIRISTPHNT; VERSIRISTPHNTT; ERSIRISTPHNTTG; RSIRISTPHNTTGH; SIRISTPHNTTGHF; IRISTPHNTTGHFE; RISTPHNTTGHFEW; ISTPHNTTGHFEWV; STPHNTTGHFEWVA; TPHNTTGHFEWVAS; PHNTTGHFEWVASN; HNTTGHFEWVASNV; NTTGHFEWVASNVV; TTGHFEWVASNVVR; TGHFEWVASNVVRW; GHFEWVASNVVRWV; HFEWVASNVVRWVP; FEWVASNVVRWVPH; EWVASNVVRWVPHR; WVASNVVRWVPHRY; VASNVVRWVPHRYW; ASNVVRWVPHRYWP; SNVVRWVPHRYWPP; NVVRWVPHRYWPPH; VVRWVPHRYWPPHT; VRWVPHRYWPPHTR; RWVPHRYWPPHTRV; WVPHRYWPPHTRVS; VPHRYWPPHTRVSV; PHRYWPPHTRVSVG; HRYWPPHTRVSVGV; RYWPPHTRVSVGVQ; YWPPHTRVSVGVQE; WPPHTRVSVGVQEL; PPHTRVSVGVQELT; PHTRVSVGVQELTE; | |

Fig. 29 continued

| | | |
|---|---|---|
| | HTRVSVGVQELTEG; TRVSVGVQELTEGF; RVSVGVQELTEGFE; VSVGVQELTEGFET; SVGVQELTEGFETG; VGVQELTEGFETGD; GVQELTEGFETGDA; VQELTEGFETGDAL; QELTEGFETGDALI; ELTEGFETGDALIG; LTEGFETGDALIGV; TEGFETGDALIGVA; EGFETGDALIGVAS; GFETGDALIGVASI; FETGDALIGVASIS; ETGDALIGVASISA; TGDALIGVASISAH; GDALIGVASISAHT; DALIGVASISAHTF; ALIGVASISAHTFT; LIGVASISAHTFTV; IGVASISAHTFTVS; GVASISAHTFTVSR; VASISAHTFTVSRN; ASISAHTFTVSRNG; SISAHTFTVSRNGE; ISAHTFTVSRNGEV; SAHTFTVSRNGEVL; AHTFTVSRNGEVLR; HTFTVSRNGEVLRT; TFTVSRNGEVLRTM; FTVSRNGEVLRTMP; TVSRNGEVLRTMPA; VSRNGEVLRTMPAS; SRNGEVLRTMPASL; RNGEVLRTMPASLG; NGEVLRTMPASLGK; GEVLRTMPASLGKP; EVLRTMPASLGKPS; VLRTMPASLGKPSR; LRTMPASLGKPSRP; RTMPASLGKPSRPT; TMPASLGKPSRPTP; MPASLGKPSRPTPI; PASLGKPSRPTPIG; ASLGKPSRPTPIGS; SLGKPSRPTPIGSF; LGKPSRPTPIGSFH; GKPSRPTPIGSFHA; KPSRPTPIGSFHAM; PSRPTPIGSFHAMS; SRPTPIGSFHAMSK; RPTPIGSFHAMSKE; PTPIGSFHAMSKER; TPIGSFHAMSKERT; PIGSFHAMSKERTV; IGSFHAMSKERTVV; GSFHAMSKERTVVM; SFHAMSKERTVVMD; FHAMSKERTVVMDS; HAMSKERTVVMDSR; AMSKERTVVMDSRT; MSKERTVVMDSRTI; SKERTVVMDSRTIG; KERTVVMDSRTIGI; ERTVVMDSRTIGIP; RTVVMDSRTIGIPL; TVVMDSRTIGIPLN; VVMDSRTIGIPLNS; VMDSRTIGIPLNSS; MDSRTIGIPLNSSD; DSRTIGIPLNSSDG; SRTIGIPLNSSDGY; RTIGIPLNSSDGYL; TIGIPLNSSDGYLL; IGIPLNSSDGYLLT; GIPLNSSDGYLLTA; IPLNSSDGYLLTAH; PLNSSDGYLLTAHY; LNSSDGYLLTAHYA; NSSDGYLLTAHYAV; SSDGYLLTAHYAVR; SDGYLLTAHYAVRV; DGYLLTAHYAVRVT; GYLLTAHYAVRVTW; YLLTAHYAVRVTWS; LLTAHYAVRVTWSG; LTAHYAVRVTWSGV; TAHYAVRVTWSGVY; AHYAVRVTWSGVYV; HYAVRVTWSGVYVH; YAVRVTWSGVYVHS; AVRVTWSGVYVHSA; VRVTWSGVYVHSAP; RVTWSGVYVHSAPW; VTWSGVYVHSAPWS; TWSGVYVHSAPWSV; WSGVYVHSAPWSVN; SGVYVHSAPWSVNS; GVYVHSAPWSVNSQ; VYVHSAPWSVNSQG; YVHSAPWSVNSQGY; VHSAPWSVNSQGYA; HSAPWSVNSQGYAN; SAPWSVNSQGYANV; APWSVNSQGYANVS; PWSVNSQGYANVSH; WSVNSQGYANVSHG; SVNSQGYANVSHGC; VNSQGYANVSHGCI; NSQGYANVSHGCIN; SQGYANVSHGCINL; QGYANVSHGCINLS; GYANVSHGCINLSP; YANVSHGCINLSPD; ANVSHGCINLSPDN; NVSHGCINLSPDNA; VSHGCINLSPDNAA; SHGCINLSPDNAAW; HGCINLSPDNAAWY; GCINLSPDNAAWYF; CINLSPDNAAWYFD; INLSPDNAAWYFDA; NLSPDNAAWYFDAV; LSPDNAAWYFDAVT; SPDNAAWYFDAVTV; PDNAAWYFDAVTVG; DNAAWYFDAVTVGD; NAAWYFDAVTVGDP; AAWYFDAVTVGDPI; AWYFDAVTVGDPIE; WYFDAVTVGDPIEV; YFDAVTVGDPIEVV; FDAVTVGDPIEVVG<br><br>15 mers:<br>MRRVVRYLSVVVAIT; RRVVRYLSVVVAITL; RVVRYLSVVVAITLM; VVRYLSVVVAITLML; VRYLSVVVAITLMLT; RYLSVVVAITLMLTA; YLSVVVAITLMLTAE; LSVVVAITLMLTAES; SVVVAITLMLTAESV; VVVAITLMLTAESVS; VVAITLMLTAESVSI; VAITLMLTAESVSIA; AITLMLTAESVSIAT; ITLMLTAESVSIATA; TLMLTAESVSIATAA; LMLTAESVSIATAAV; MLTAESVSIATAAVP; LTAESVSIATAAVPP; TAESVSIATAAVPPL; AESVSIATAAVPPLQ; ESVSIATAAVPPLQP; SVSIATAAVPPLQPI; VSIATAAVPPLQPIP; SIATAAVPPLQPIPG; | |

Fig. 29 continued

| | | | |
|---|---|---|---|
| | IATAAVPPLQPIPGV; ATAAVPPLQPIPGVA; TAAVPPLQPIPGVAS;<br>AAVPPLQPIPGVASV; AVPPLQPIPGVASVS; VPPLQPIPGVASVSP;<br>PPLQPIPGVASVSPA; PLQPIPGVASVSPAN; LQPIPGVASVSPANG;<br>QPIPGVASVSPANGA; PIPGVASVSPANGAV; IPGVASVSPANGAVV;<br>PGVASVSPANGAVVG; GVASVSPANGAVVGV; VASVSPANGAVVGVA;<br>ASVSPANGAVVGVAH; SVSPANGAVVGVAHP; VSPANGAVVGVAHPV;<br>SPANGAVVGVAHPVV; PANGAVVGVAHPVVV; ANGAVVGVAHPVVVT;<br>NGAVVGVAHPVVVTF; GAVVGVAHPVVVTFT; AVVGVAHPVVVTFTT;<br>VVGVAHPVVVTFTTP; VGVAHPVVVTFTTPV; GVAHPVVVTFTTPVT;<br>VAHPVVVTFTTPVTD; AHPVVVTFTTPVTDR; HPVVVTFTTPVTDRR;<br>PVVVTFTTPVTDRRA; VVVTFTTPVTDRRAV; VVTFTTPVTDRRAVE;<br>VTFTTPVTDRRAVER; TFTTPVTDRRAVERS; FTTPVTDRRAVERSI;<br>TTPVTDRRAVERSIR; TPVTDRRAVERSIRI; PVTDRRAVERSIRIS;<br>VTDRRAVERSIRIST; TDRRAVERSIRISTP; DRRAVERSIRISTPH;<br>RRAVERSIRISTPHN; RAVERSIRISTPHNT; AVERSIRISTPHNTT;<br>VERSIRISTPHNTTG; ERSIRISTPHNTTGH; RSIRISTPHNTTGHF;<br>SIRISTPHNTTGHFE; IRISTPHNTTGHFEW; RISTPHNTTGHFEWV;<br>ISTPHNTTGHFEWVA; STPHNTTGHFEWVAS; TPHNTTGHFEWVASN;<br>PHNTTGHFEWVASNV; HNTTGHFEWVASNVV; NTTGHFEWVASNVVR;<br>TTGHFEWVASNVVRW; TGHFEWVASNVVRWV; GHFEWVASNVVRWVP;<br>HFEWVASNVVRWVPH; FEWVASNVVRWVPHR; EWVASNVVRWVPHRY;<br>WVASNVVRWVPHRYW; VASNVVRWVPHRYWP; ASNVVRWVPHRYWPP;<br>SNVVRWVPHRYWPPH; NVVRWVPHRYWPPHT; VVRWVPHRYWPPHTR;<br>VRWVPHRYWPPHTRV; RWVPHRYWPPHTRVS; WVPHRYWPPHTRVSV;<br>VPHRYWPPHTRVSVG; PHRYWPPHTRVSVGV; HRYWPPHTRVSVGVQ;<br>RYWPPHTRVSVGVQE; YWPPHTRVSVGVQEL; WPPHTRVSVGVQELT;<br>PPHTRVSVGVQELTE; PHTRVSVGVQELTEG; HTRVSVGVQELTEGF;<br>TRVSVGVQELTEGFE; RVSVGVQELTEGFET; VSVGVQELTEGFETG;<br>SVGVQELTEGFETGD; VGVQELTEGFETGDA; GVQELTEGFETGDAL;<br>VQELTEGFETGDALI; QELTEGFETGDALIG; ELTEGFETGDALIGV;<br>LTEGFETGDALIGVA; TEGFETGDALIGVAS; EGFETGDALIGVASI;<br>GFETGDALIGVASIS; FETGDALIGVASISA; ETGDALIGVASISAH;<br>TGDALIGVASISAHT; GDALIGVASISAHTF; DALIGVASISAHTFT;<br>ALIGVASISAHTFTV; LIGVASISAHTFTVS; IGVASISAHTFTVSR;<br>GVASISAHTFTVSRN; VASISAHTFTVSRNG; ASISAHTFTVSRNGE;<br>SISAHTFTVSRNGEV; ISAHTFTVSRNGEVL; SAHTFTVSRNGEVLR;<br>AHTFTVSRNGEVLRT; HTFTVSRNGEVLRTM; TFTVSRNGEVLRTMP;<br>FTVSRNGEVLRTMPA; TVSRNGEVLRTMPAS; VSRNGEVLRTMPASL;<br>SRNGEVLRTMPASLG; RNGEVLRTMPASLGK; NGEVLRTMPASLGKP;<br>GEVLRTMPASLGKPS; EVLRTMPASLGKPSR; VLRTMPASLGKPSRP;<br>LRTMPASLGKPSRPT; RTMPASLGKPSRPTP; TMPASLGKPSRPTPI;<br>MPASLGKPSRPTPIG; PASLGKPSRPTPIGS; ASLGKPSRPTPIGSF;<br>SLGKPSRPTPIGSFH; LGKPSRPTPIGSFHA; GKPSRPTPIGSFHAM;<br>KPSRPTPIGSFHAMS; PSRPTPIGSFHAMSK; SRPTPIGSFHAMSKE;<br>RPTPIGSFHAMSKER; PTPIGSFHAMSKERT; TPIGSFHAMSKERTV;<br>PIGSFHAMSKERTVV; IGSFHAMSKERTVVM; GSFHAMSKERTVVMD;<br>SFHAMSKERTVVMDS; FHAMSKERTVVMDSR; HAMSKERTVVMDSRT;<br>AMSKERTVVMDSRTI; MSKERTVVMDSRTIG; SKERTVVMDSRTIGI;<br>KERTVVMDSRTIGIP; ERTVVMDSRTIGIPL; RTVVMDSRTIGIPLN;<br>TVVMDSRTIGIPLNS; VVMDSRTIGIPLNSS; VMDSRTIGIPLNSSD;<br>MDSRTIGIPLNSSDG; DSRTIGIPLNSSDGY; SRTIGIPLNSSDGYL;<br>RTIGIPLNSSDGYLL; TIGIPLNSSDGYLLT; IGIPLNSSDGYLLTA;<br>GIPLNSSDGYLLTAH; IPLNSSDGYLLTAHY; PLNSSDGYLLTAHYA; | | |

Fig. 29 continued

| | | | |
|---|---|---|---|
| | LNSSDGYLLTAHYAV; NSSDGYLLTAHYAVR; SSDGYLLTAHYAVRV; SDGYLLTAHYAVRVT; DGYLLTAHYAVRVTW; GYLLTAHYAVRVTWS; YLLTAHYAVRVTWSG; LLTAHYAVRVTWSGV; LTAHYAVRVTWSGVY; TAHYAVRVTWSGVYV; AHYAVRVTWSGVYVH; HYAVRVTWSGVYVHS; YAVRVTWSGVYVHSA; AVRVTWSGVYVHSAP; VRVTWSGVYVHSAPW; RVTWSGVYVHSAPWS; VTWSGVYVHSAPWSV; TWSGVYVHSAPWSVN; WSGVYVHSAPWSVNS; SGVYVHSAPWSVNSQ; GVYVHSAPWSVNSQG; VYVHSAPWSVNSQGY; YVHSAPWSVNSQGYA; VHSAPWSVNSQGYAN; HSAPWSVNSQGYANV; SAPWSVNSQGYANVS; APWSVNSQGYANVSH; PWSVNSQGYANVSHG; WSVNSQGYANVSHGC; SVNSQGYANVSHGCI; VNSQGYANVSHGCIN; NSQGYANVSHGCINL; SQGYANVSHGCINLS; QGYANVSHGCINLSP; GYANVSHGCINLSPD; YANVSHGCINLSPDN; ANVSHGCINLSPDNA; NVSHGCINLSPDNAA; VSHGCINLSPDNAAW; SHGCINLSPDNAAWY; HGCINLSPDNAAWYF; GCINLSPDNAAWYFD; CINLSPDNAAWYFDA; INLSPDNAAWYFDAV; NLSPDNAAWYFDAVT; LSPDNAAWYFDAVTV; SPDNAAWYFDAVTVG; PDNAAWYFDAVTVGD; DNAAWYFDAVTVGDP; NAAWYFDAVTVGDPI; AAWYFDAVTVGDPIE; AWYFDAVTVGDPIEV; WYFDAVTVGDPIEVV; YFDAVTVGDPIEVVG<br><br>16 mers:<br>MRRVVRYLSVVVAITL; RRVVRYLSVVVAITLM; RVVRYLSVVVAITLML; VVRYLSVVVAITLMLT; VRYLSVVVAITLMLTA; RYLSVVVAITLMLTAE; YLSVVVAITLMLTAES; LSVVVAITLMLTAESV; SVVVAITLMLTAESVS; VVVAITLMLTAESVSI; VVAITLMLTAESVSIA; VAITLMLTAESVSIAT; AITLMLTAESVSIATA; ITLMLTAESVSIATAA; TLMLTAESVSIATAAV; LMLTAESVSIATAAVP; MLTAESVSIATAAVPP; LTAESVSIATAAVPPL; TAESVSIATAAVPPLQ; AESVSIATAAVPPLQP; ESVSIATAAVPPLQPI; SVSIATAAVPPLQPIP; VSIATAAVPPLQPIPG; SIATAAVPPLQPIPGV; IATAAVPPLQPIPGVA; ATAAVPPLQPIPGVAS; TAAVPPLQPIPGVASV; AAVPPLQPIPGVASVS; AVPPLQPIPGVASVSP; VPPLQPIPGVASVSPA; PPLQPIPGVASVSPAN; PLQPIPGVASVSPANG; LQPIPGVASVSPANGA; QPIPGVASVSPANGAV; PIPGVASVSPANGAVV; IPGVASVSPANGAVVG; PGVASVSPANGAVVGV; GVASVSPANGAVVGVA; VASVSPANGAVVGVAH; ASVSPANGAVVGVAHP; SVSPANGAVVGVAHPV; VSPANGAVVGVAHPVV; SPANGAVVGVAHPVVV; PANGAVVGVAHPVVVT; ANGAVVGVAHPVVVTF; NGAVVGVAHPVVVTFT; GAVVGVAHPVVVTFTT; AVVGVAHPVVVTFTTP; VVGVAHPVVVTFTTPV; VGVAHPVVVTFTTPVT; GVAHPVVVTFTTPVTD; VAHPVVVTFTTPVTDR; AHPVVVTFTTPVTDRR; HPVVVTFTTPVTDRRA; PVVVTFTTPVTDRRAV; VVVTFTTPVTDRRAVE; VVTFTTPVTDRRAVER; VTFTTPVTDRRAVERS; TFTTPVTDRRAVERSI; FTTPVTDRRAVERSIR; TTPVTDRRAVERSIRI; TPVTDRRAVERSIRIS; PVTDRRAVERSIRIST; VTDRRAVERSIRISTP; TDRRAVERSIRISTPH; DRRAVERSIRISTPHN; RRAVERSIRISTPHNT; RAVERSIRISTPHNTT; AVERSIRISTPHNTTG; VERSIRISTPHNTTGH; ERSIRISTPHNTTGHF; RSIRISTPHNTTGHFE; SIRISTPHNTTGHFEW; IRISTPHNTTGHFEWV; RISTPHNTTGHFEWVA; ISTPHNTTGHFEWVAS; STPHNTTGHFEWVASN; TPHNTTGHFEWVASNV; PHNTTGHFEWVASNVV; HNTTGHFEWVASNVVR; NTTGHFEWVASNVVRW; TTGHFEWVASNVVRWV; TGHFEWVASNVVRWVP; GHFEWVASNVVRWVPH; HFEWVASNVVRWVPHR; FEWVASNVVRWVPHRY; EWVASNVVRWVPHRYW; WVASNVVRWVPHRYWP; VASNVVRWVPHRYWPP; ASNVVRWVPHRYWPPH; SNVVRWVPHRYWPPHT; NVVRWVPHRYWPPHTR; VVRWVPHRYWPPHTRV; VRWVPHRYWPPHTRVS; RWVPHRYWPPHTRVSV; WVPHRYWPPHTRVSVG; VPHRYWPPHTRVSVGV; PHRYWPPHTRVSVGVQ; HRYWPPHTRVSVGVQE; | |

Fig. 29 continued

| | | |
|---|---|---|
| | RYWPPHTRVSVGVQEL; YWPPHTRVSVGVQELT; WPPHTRVSVGVQELTE; PPHTRVSVGVQELTEG; PHTRVSVGVQELTEGF; HTRVSVGVQELTEGFE; TRVSVGVQELTEGFET; RVSVGVQELTEGFETG; VSVGVQELTEGFETGD; SVGVQELTEGFETGDA; VGVQELTEGFETGDAL; GVQELTEGFETGDALI; VQELTEGFETGDALIG; QELTEGFETGDALIGV; ELTEGFETGDALIGVA; LTEGFETGDALIGVAS; TEGFETGDALIGVASI; EGFETGDALIGVASIS; GFETGDALIGVASISA; FETGDALIGVASISAH; ETGDALIGVASISAHT; TGDALIGVASISAHTF; GDALIGVASISAHTFT; DALIGVASISAHTFTV; ALIGVASISAHTFTVS; LIGVASISAHTFTVSR; IGVASISAHTFTVSRN; GVASISAHTFTVSRNG; VASISAHTFTVSRNGE; ASISAHTFTVSRNGEV; SISAHTFTVSRNGEVL; ISAHTFTVSRNGEVLR; SAHTFTVSRNGEVLRT; AHTFTVSRNGEVLRTM; HTFTVSRNGEVLRTMP; TFTVSRNGEVLRTMPA; FTVSRNGEVLRTMPAS; TVSRNGEVLRTMPASL; VSRNGEVLRTMPASLG; SRNGEVLRTMPASLGK; RNGEVLRTMPASLGKP; NGEVLRTMPASLGKPS; GEVLRTMPASLGKPSR; EVLRTMPASLGKPSRP; VLRTMPASLGKPSRPT; LRTMPASLGKPSRPTP; RTMPASLGKPSRPTPI; TMPASLGKPSRPTPIG; MPASLGKPSRPTPIGS; PASLGKPSRPTPIGSF; ASLGKPSRPTPIGSFH; SLGKPSRPTPIGSFHA; LGKPSRPTPIGSFHAM; GKPSRPTPIGSFHAMS; KPSRPTPIGSFHAMSK; PSRPTPIGSFHAMSKE; SRPTPIGSFHAMSKER; RPTPIGSFHAMSKERT; PTPIGSFHAMSKERTV; TPIGSFHAMSKERTVV; PIGSFHAMSKERTVVM; IGSFHAMSKERTVVMD; GSFHAMSKERTVVMDS; SFHAMSKERTVVMDSR; FHAMSKERTVVMDSRT; HAMSKERTVVMDSRTI; AMSKERTVVMDSRTIG; MSKERTVVMDSRTIGI; SKERTVVMDSRTIGIP; KERTVVMDSRTIGIPL; ERTVVMDSRTIGIPLN; RTVVMDSRTIGIPLNS; TVVMDSRTIGIPLNSS; VVMDSRTIGIPLNSSD; VMDSRTIGIPLNSSDG; MDSRTIGIPLNSSDGY; DSRTIGIPLNSSDGYL; SRTIGIPLNSSDGYLL; RTIGIPLNSSDGYLLT; TIGIPLNSSDGYLLTA; IGIPLNSSDGYLLTAH; GIPLNSSDGYLLTAHY; IPLNSSDGYLLTAHYA; PLNSSDGYLLTAHYAV; LNSSDGYLLTAHYAVR; NSSDGYLLTAHYAVRV; SSDGYLLTAHYAVRVT; SDGYLLTAHYAVRVTW; DGYLLTAHYAVRVTWS; GYLLTAHYAVRVTWSG; YLLTAHYAVRVTWSGV; LLTAHYAVRVTWSGVY; LTAHYAVRVTWSGVYV; TAHYAVRVTWSGVYVH; AHYAVRVTWSGVYVHS; HYAVRVTWSGVYVHSA; YAVRVTWSGVYVHSAP; AVRVTWSGVYVHSAPW; VRVTWSGVYVHSAPWS; RVTWSGVYVHSAPWSV; VTWSGVYVHSAPWSVN; TWSGVYVHSAPWSVNS; WSGVYVHSAPWSVNSQ; SGVYVHSAPWSVNSQG; GVYVHSAPWSVNSQGY; VYVHSAPWSVNSQGYA; YVHSAPWSVNSQGYAN; VHSAPWSVNSQGYANV; HSAPWSVNSQGYANVS; SAPWSVNSQGYANVSH; APWSVNSQGYANVSHG; PWSVNSQGYANVSHGC; WSVNSQGYANVSHGCI; SVNSQGYANVSHGCIN; VNSQGYANVSHGCINL; NSQGYANVSHGCINLS; SQGYANVSHGCINLSP; QGYANVSHGCINLSPD; GYANVSHGCINLSPDN; YANVSHGCINLSPDNA; ANVSHGCINLSPDNAA; NVSHGCINLSPDNAAW; VSHGCINLSPDNAAWY; SHGCINLSPDNAAWYF; HGCINLSPDNAAWYFD; GCINLSPDNAAWYFDA; CINLSPDNAAWYFDAV; INLSPDNAAWYFDAVT; NLSPDNAAWYFDAVTV; LSPDNAAWYFDAVTVG; SPDNAAWYFDAVTVGD; PDNAAWYFDAVTVGDP; DNAAWYFDAVTVGDPI; NAAWYFDAVTVGDPIE; AAWYFDAVTVGDPIEV; AWYFDAVTVGDPIEVV; WYFDAVTVGDPIEVVG | |
| 2) Rv0122 | 13 mers:<br>MAGSVSAAAGIGW; AGSVSAAAGIGWV; GSVSAAAGIGWVG; SVSAAAGIGWVGL; VSAAAGIGWVGLN; SAAAGIGWVGLNV; AAAGIGWVGLNVT; AAGIGWVGLNVTE; AGIGWVGLNVTET; GIGWVGLNVTETN; IGWVGLNVTETNR; GWVGLNVTETNRD; WVGLNVTETNRDQ; VGLNVTETNRDQC; GLNVTETNRDQCY; LNVTETNRDQCYR; NVTETNRDQCYRV; | 60735-61168 |

Fig. 29 continued

| | | |
|---|---|---|
| | VTETNRDQCYRVE; TETNRDQCYRVER; ETNRDQCYRVERT; TNRDQCYRVERTT; NRDQCYRVERTTV; RDQCYRVERTTVD; DQCYRVERTTVDA; QCYRVERTTVDAL; CYRVERTTVDALT; YRVERTTVDALTH; RVERTTVDALTHP; VERTTVDALTHPE; ERTTVDALTHPEY; RTTVDALTHPEYR; TTVDALTHPEYRV; TVDALTHPEYRVH; VDALTHPEYRVHT; DALTHPEYRVHTR; ALTHPEYRVHTRG; LTHPEYRVHTRGV; THPEYRVHTRGVQ; HPEYRVHTRGVQR; PEYRVHTRGVQRV; EYRVHTRGVQRVR; YRVHTRGVQRVRV; RVHTRGVQRVRVT; VHTRGVQRVRVTR; HTRGVQRVRVTRN; TRGVQRVRVTRNA; RGVQRVRVTRNAR; GVQRVRVTRNARK; VQRVRVTRNARKH; QRVRVTRNARKHR; RVRVTRNARKHRV; VRVTRNARKHRVS; RVTRNARKHRVSK; VTRNARKHRVSKH; TRNARKHRVSKHR; RNARKHRVSKHRI; NARKHRVSKHRIV; ARKHRVSKHRIVA; RKHRVSKHRIVAA; KHRVSKHRIVAAM; HRVSKHRIVAAMR; RVSKHRIVAAMRH; VSKHRIVAAMRHC; SKHRIVAAMRHCG; KHRIVAAMRHCGV; HRIVAAMRHCGVP; RIVAAMRHCGVPV; IVAAMRHCGVPVI; VAAMRHCGVPVIQ; AAMRHCGVPVIQE; AMRHCGVPVIQED; MRHCGVPVIQEDG; RHCGVPVIQEDGS; HCGVPVIQEDGSL; CGVPVIQEDGSLY; GVPVIQEDGSLYY; VPVIQEDGSLYYQ; PVIQEDGSLYYQG; VIQEDGSLYYQGR; IQEDGSLYYQGRD; QEDGSLYYQGRDT; EDGSLYYQGRDTS; DGSLYYQGRDTSG; GSLYYQGRDTSGR; SLYYQGRDTSGRL; LYYQGRDTSGRLT; YYQGRDTSGRLTE; YQGRDTSGRLTEV; QGRDTSGRLTEVV; GRDTSGRLTEVVA; RDTSGRLTEVVAV; DTSGRLTEVVAVE; TSGRLTEVVAVEA; SGRLTEVVAVEAD; GRLTEVVAVEADD; RLTEVVAVEADDG; LTEVVAVEADDGD; TEVVAVEADDGDL; EVVAVEADDGDLI; VVAVEADDGDLII; VAVEADDGDLIIT; AVEADDGDLIITH; VEADDGDLIITHA; EADDGDLIITHAM; ADDGDLIITHAMP; DDGDLIITHAMPK; DGDLIITHAMPKE; GDLIITHAMPKEW; DLIITHAMPKEWK; LIITHAMPKEWKR<br><br>14 mers:<br>MAGSVSAAAGIGWV; AGSVSAAAGIGWVG; GSVSAAAGIGWVGL; SVSAAAGIGWVGLN; VSAAAGIGWVGLNV; SAAAGIGWVGLNVT; AAAGIGWVGLNVTE; AAGIGWVGLNVTET; AGIGWVGLNVTETN; GIGWVGLNVTETNR; IGWVGLNVTETNRD; GWVGLNVTETNRDQ; WVGLNVTETNRDQC; VGLNVTETNRDQCY; GLNVTETNRDQCYR; LNVTETNRDQCYRV; NVTETNRDQCYRVE; VTETNRDQCYRVER; TETNRDQCYRVERT; ETNRDQCYRVERTT; TNRDQCYRVERTTV; NRDQCYRVERTTVD; RDQCYRVERTTVDA; DQCYRVERTTVDAL; QCYRVERTTVDALT; CYRVERTTVDALTH; YRVERTTVDALTHP; RVERTTVDALTHPE; VERTTVDALTHPEY; ERTTVDALTHPEYR; RTTVDALTHPEYRV; TTVDALTHPEYRVH; TVDALTHPEYRVHT; VDALTHPEYRVHTR; DALTHPEYRVHTRG; ALTHPEYRVHTRGV; LTHPEYRVHTRGVQ; THPEYRVHTRGVQR; HPEYRVHTRGVQRV; PEYRVHTRGVQRVR; EYRVHTRGVQRVRV; YRVHTRGVQRVRVT; RVHTRGVQRVRVTR; VHTRGVQRVRVTRN; HTRGVQRVRVTRNA; TRGVQRVRVTRNAR; RGVQRVRVTRNARK; GVQRVRVTRNARKH; VQRVRVTRNARKHR; QRVRVTRNARKHRV; RVRVTRNARKHRVS; VRVTRNARKHRVSK; RVTRNARKHRVSKH; VTRNARKHRVSKHR; TRNARKHRVSKHRI; RNARKHRVSKHRIV; NARKHRVSKHRIVA; ARKHRVSKHRIVAA; RKHRVSKHRIVAAM; KHRVSKHRIVAAMR; HRVSKHRIVAAMRH; RVSKHRIVAAMRHC; VSKHRIVAAMRHCG; SKHRIVAAMRHCGV; KHRIVAAMRHCGVP; HRIVAAMRHCGVPV; RIVAAMRHCGVPVI; IVAAMRHCGVPVIQ; VAAMRHCGVPVIQE; AAMRHCGVPVIQED; AMRHCGVPVIQEDG; MRHCGVPVIQEDGS; | |

Fig. 29 continued

| | | |
|---|---|---|
| | RHCGVPVIQEDGSL; HCGVPVIQEDGSLY; CGVPVIQEDGSLYY; GVPVIQEDGSLYYQ; VPVIQEDGSLYYQG; PVIQEDGSLYYQGR; VIQEDGSLYYQGRD; IQEDGSLYYQGRDT; QEDGSLYYQGRDTS; EDGSLYYQGRDTSG; DGSLYYQGRDTSGR; GSLYYQGRDTSGRL; SLYYQGRDTSGRLT; LYYQGRDTSGRLTE; YYQGRDTSGRLTEV; YQGRDTSGRLTEVV; QGRDTSGRLTEVVA; GRDTSGRLTEVVAV; RDTSGRLTEVVAVE; DTSGRLTEVVAVEA; TSGRLTEVVAVEAD; SGRLTEVVAVEADD; GRLTEVVAVEADDG; RLTEVVAVEADDGD; LTEVVAVEADDGDL; TEVVAVEADDGDLI; EVVAVEADDGDLII; VVAVEADDGDLIIT; VAVEADDGDLIITH; AVEADDGDLIITHA; VEADDGDLIITHAM; EADDGDLIITHAMP; ADDGDLIITHAMPK; DDGDLIITHAMPKE; DGDLIITHAMPKEW; GDLIITHAMPKEWK; DLIITHAMPKEWKR<br><br>15 mers:<br>MAGSVSAAAGIGWVG; AGSVSAAAGIGWVGL; GSVSAAAGIGWVGLN; SVSAAAGIGWVGLNV; VSAAAGIGWVGLNVT; SAAAGIGWVGLNVTE; AAAGIGWVGLNVTET; AAGIGWVGLNVTETN; AGIGWVGLNVTETNR; GIGWVGLNVTETNRD; IGWVGLNVTETNRDQ; GWVGLNVTETNRDQC; WVGLNVTETNRDQCY; VGLNVTETNRDQCYR; GLNVTETNRDQCYRV; LNVTETNRDQCYRVE; NVTETNRDQCYRVER; VTETNRDQCYRVERT; TETNRDQCYRVERTT; ETNRDQCYRVERTTV; TNRDQCYRVERTTVD; NRDQCYRVERTTVDA; RDQCYRVERTTVDAL; DQCYRVERTTVDALT; QCYRVERTTVDALTH; CYRVERTTVDALTHP; YRVERTTVDALTHPE; RVERTTVDALTHPEY; VERTTVDALTHPEYR; ERTTVDALTHPEYRV; RTTVDALTHPEYRVH; TTVDALTHPEYRVHT; TVDALTHPEYRVHTR; VDALTHPEYRVHTRG; DALTHPEYRVHTRGV; ALTHPEYRVHTRGVQ; LTHPEYRVHTRGVQR; THPEYRVHTRGVQRV; HPEYRVHTRGVQRVR; PEYRVHTRGVQRVRV; EYRVHTRGVQRVRVT; YRVHTRGVQRVRVTR; RVHTRGVQRVRVTRN; VHTRGVQRVRVTRNA; HTRGVQRVRVTRNAR; TRGVQRVRVTRNARK; RGVQRVRVTRNARKH; GVQRVRVTRNARKHR; VQRVRVTRNARKHRV; QRVRVTRNARKHRVS; RVRVTRNARKHRVSK; VRVTRNARKHRVSKH; RVTRNARKHRVSKHR; VTRNARKHRVSKHRI; TRNARKHRVSKHRIV; RNARKHRVSKHRIVA; NARKHRVSKHRIVAA; ARKHRVSKHRIVAAM; RKHRVSKHRIVAAMR; KHRVSKHRIVAAMRH; HRVSKHRIVAAMRHC; RVSKHRIVAAMRHCG; VSKHRIVAAMRHCGV; SKHRIVAAMRHCGVP; KHRIVAAMRHCGVPV; HRIVAAMRHCGVPVI; RIVAAMRHCGVPVIQ; IVAAMRHCGVPVIQE; VAAMRHCGVPVIQED; AAMRHCGVPVIQEDG; AMRHCGVPVIQEDGS; MRHCGVPVIQEDGSL; RHCGVPVIQEDGSLY; HCGVPVIQEDGSLYY; CGVPVIQEDGSLYYQ; GVPVIQEDGSLYYQG; VPVIQEDGSLYYQGR; PVIQEDGSLYYQGRD; VIQEDGSLYYQGRDT; IQEDGSLYYQGRDTS; QEDGSLYYQGRDTSG; EDGSLYYQGRDTSGR; DGSLYYQGRDTSGRL; GSLYYQGRDTSGRLT; SLYYQGRDTSGRLTE; LYYQGRDTSGRLTEV; YYQGRDTSGRLTEVV; YQGRDTSGRLTEVVA; QGRDTSGRLTEVVAV; GRDTSGRLTEVVAVE; RDTSGRLTEVVAVEA; DTSGRLTEVVAVEAD; TSGRLTEVVAVEADD; SGRLTEVVAVEADDG; GRLTEVVAVEADDGD; RLTEVVAVEADDGDL; LTEVVAVEADDGDLI; TEVVAVEADDGDLII; EVVAVEADDGDLIIT; VVAVEADDGDLIITH; VAVEADDGDLIITHA; AVEADDGDLIITHAM; VEADDGDLIITHAMP; EADDGDLIITHAMPK; ADDGDLIITHAMPKE; DDGDLIITHAMPKEW; DGDLIITHAMPKEWK; GDLIITHAMPKEWKR<br><br>16 mers:<br>MAGSVSAAAGIGWVGL; AGSVSAAAGIGWVGLN; GSVSAAAGIGWVGLNV; | |

Fig. 29 continued

| | | |
|---|---|---|
| | SVSAAAGIGWVGLNVT; VSAAAGIGWVGLNVTE; SAAAGIGWVGLNVTET; AAAGIGWVGLNVTETN; AAGIGWVGLNVTETNR; AGIGWVGLNVTETNRD; GIGWVGLNVTETNRDQ; IGWVGLNVTETNRDQC; GWVGLNVTETNRDQCY; WVGLNVTETNRDQCYR; VGLNVTETNRDQCYRV; GLNVTETNRDQCYRVE; LNVTETNRDQCYRVER; NVTETNRDQCYRVERT; VTETNRDQCYRVERTT; TETNRDQCYRVERTTV; ETNRDQCYRVERTTVD; TNRDQCYRVERTTVDA; NRDQCYRVERTTVDAL; RDQCYRVERTTVDALT; DQCYRVERTTVDALTH; QCYRVERTTVDALTHP; CYRVERTTVDALTHPE; YRVERTTVDALTHPEY; RVERTTVDALTHPEYR; VERTTVDALTHPEYRV; ERTTVDALTHPEYRVH; RTTVDALTHPEYRVHT; TTVDALTHPEYRVHTR; TVDALTHPEYRVHTRG; VDALTHPEYRVHTRGV; DALTHPEYRVHTRGVQ; ALTHPEYRVHTRGVQR; LTHPEYRVHTRGVQRV; THPEYRVHTRGVQRVR; HPEYRVHTRGVQRVRV; PEYRVHTRGVQRVRVT; EYRVHTRGVQRVRVTR; YRVHTRGVQRVRVTRN; RVHTRGVQRVRVTRNA; VHTRGVQRVRVTRNAR; HTRGVQRVRVTRNARK; TRGVQRVRVTRNARKH; RGVQRVRVTRNARKHR; GVQRVRVTRNARKHRV; VQRVRVTRNARKHRVS; QRVRVTRNARKHRVSK; RVRVTRNARKHRVSKH; VRVTRNARKHRVSKHR; RVTRNARKHRVSKHRI; VTRNARKHRVSKHRIV; TRNARKHRVSKHRIVA; RNARKHRVSKHRIVAA; NARKHRVSKHRIVAAM; ARKHRVSKHRIVAAMR; RKHRVSKHRIVAAMRH; KHRVSKHRIVAAMRHC; HRVSKHRIVAAMRHCG; RVSKHRIVAAMRHCGV; VSKHRIVAAMRHCGVP; SKHRIVAAMRHCGVPV; KHRIVAAMRHCGVPVI; HRIVAAMRHCGVPVIQ; RIVAAMRHCGVPVIQE; IVAAMRHCGVPVIQED; VAAMRHCGVPVIQEDG; AAMRHCGVPVIQEDGS; AMRHCGVPVIQEDGSL; MRHCGVPVIQEDGSLY; RHCGVPVIQEDGSLYY; HCGVPVIQEDGSLYYQ; CGVPVIQEDGSLYYQG; GVPVIQEDGSLYYQGR; VPVIQEDGSLYYQGRD; PVIQEDGSLYYQGRDT; VIQEDGSLYYQGRDTS; IQEDGSLYYQGRDTSG; QEDGSLYYQGRDTSGR; EDGSLYYQGRDTSGRL; DGSLYYQGRDTSGRLT; GSLYYQGRDTSGRLTE; SLYYQGRDTSGRLTEV; LYYQGRDTSGRLTEVV; YYQGRDTSGRLTEVVA; YQGRDTSGRLTEVVAV; QGRDTSGRLTEVVAVE; GRDTSGRLTEVVAVEA; RDTSGRLTEVVAVEAD; DTSGRLTEVVAVEADD; TSGRLTEVVAVEADDG; SGRLTEVVAVEADDGD; GRLTEVVAVEADDGDL; RLTEVVAVEADDGDLI; LTEVVAVEADDGDLII; TEVVAVEADDGDLIIT; EVVAVEADDGDLIITH; VVAVEADDGDLIITHA; VAVEADDGDLIITHAM; AVEADDGDLIITHAMP; VEADDGDLIITHAMPK; EADDGDLIITHAMPKE; ADDGDLIITHAMPKEW; DDGDLIITHAMPKEWK; DGDLIITHAMPKEWKR | |
| 3) Rv0188 | 13 mers:<br>MSTVHSSIDQHPD; STVHSSIDQHPDL; TVHSSIDQHPDLL; VHSSIDQHPDLLA; HSSIDQHPDLLAL; SSIDQHPDLLALR; SIDQHPDLLALRA; IDQHPDLLALRAS; DQHPDLLALRASF; QHPDLLALRASFD; HPDLLALRASFDR; PDLLALRASFDRA; DLLALRASFDRAA; LLALRASFDRAAE; LALRASFDRAAES; ALRASFDRAAEST; LRASFDRAAESTI; RASFDRAAESTIA; ASFDRAAESTIAH; SFDRAAESTIAHF; FDRAAESTIAHFT; DRAAESTIAHFTF; RAAESTIAHFTFG; AAESTIAHFTFGL; AESTIAHFTFGLA; ESTIAHFTFGLAL; STIAHFTFGLALL; TIAHFTFGLALLA; IAHFTFGLALLAG; AHFTFGLALLAGL; HFTFGLALLAGLY; FTFGLALLAGLYV; TFGLALLAGLYVA; FGLALLAGLYVAA; GLALLAGLYVAAS; LALLAGLYVAASP; ALLAGLYVAASPW; LLAGLYVAASPWI; LAGLYVAASPWIV; AGLYVAASPWIVG; GLYVAASPWIVGF; LYVAASPWIVGFS; YVAASPWIVGFSA; VAASPWIVGFSAT; AASPWIVGFSATR; ASPWIVGFSATRG; SPWIVGFSATRGL; PWIVGFSATRGLP; WIVGFSATRGLPT; IVGFSATRGLPTC; VGFSATRGLPTCD; GFSATRGLPTCDL; FSATRGLPTCDLI; SATRGLPTCDLIV; ATRGLPTCDLIVG; TRGLPTCDLIVGI; RGLPTCDLIVGIA; GLPTCDLIVGIAV; LPTCDLIVGIAVA; PTCDLIVGIAVAY; TCDLIVGIAVAYL; CDLIVGIAVAYLA; DLIVGIAVAYLAY; LIVGIAVAYLAYG; | 61169-<br>61686 |

Fig. 29 continued

| | | |
|---|---|---|
| | IVGIAVAYLAYGF; VGIAVAYLAYGFA; GIAVAYLAYGFAS; IAVAYLAYGFASA; AVAYLAYGFASAL; VAYLAYGFASALD; AYLAYGFASALDR; YLAYGFASALDRT; LAYGFASALDRTH; AYGFASALDRTHG; YGFASALDRTHGM; GFASALDRTHGMT; FASALDRTHGMTW; ASALDRTHGMTWT; SALDRTHGMTWTL; ALDRTHGMTWTLP; LDRTHGMTWTLPV; DRTHGMTWTLPVL; RTHGMTWTLPVLG; THGMTWTLPVLGV; HGMTWTLPVLGVW; GMTWTLPVLGVWV; MTWTLPVLGVWVI; TWTLPVLGVWVIF; WTLPVLGVWVIFS; TLPVLGVWVIFSP; LPVLGVWVIFSPW; PVLGVWVIFSPWV; VLGVWVIFSPWVL; LGVWVIFSPWVLP; GVWVIFSPWVLPG; VWVIFSPWVLPGV; WVIFSPWVLPGVA; VIFSPWVLPGVAV; IFSPWVLPGVAVT; FSPWVLPGVAVTA; SPWVLPGVAVTAG; PWVLPGVAVTAGM; WVLPGVAVTAGMM; VLPGVAVTAGMMW; LPGVAVTAGMMWS; PGVAVTAGMMWSH; GVAVTAGMMWSHI; VAVTAGMMWSHII; AVTAGMMWSHIIA; VTAGMMWSHIIAG; TAGMMWSHIIAGA; AGMMWSHIIAGAV; GMMWSHIIAGAVV; MMWSHIIAGAVVA; MWSHIIAGAVVAV; WSHIIAGAVVAVL; SHIIAGAVVAVLG; HIIAGAVVAVLGF; IIAGAVVAVLGFY; IAGAVVAVLGFYF; AGAVVAVLGFYFG; GAVVAVLGFYFGM; AVVAVLGFYFGMR; VVAVLGFYFGMRT; VAVLGFYFGMRTR; AVLGFYFGMRTRA; VLGFYFGMRTRAA; LGFYFGMRTRAAA; GFYFGMRTRAAAN; FYFGMRTRAAANQ; YFGMRTRAAANQG<br><br>14 mers:<br>MSTVHSSIDQHPDL; STVHSSIDQHPDLL; TVHSSIDQHPDLLA; VHSSIDQHPDLLAL; HSSIDQHPDLLALR; SSIDQHPDLLALRA; SIDQHPDLLALRAS; IDQHPDLLALRASF; DQHPDLLALRASFD; QHPDLLALRASFDR; HPDLLALRASFDRA; PDLLALRASFDRAA; DLLALRASFDRAAE; LLALRASFDRAAES; LALRASFDRAAEST; ALRASFDRAAESTI; LRASFDRAAESTIA; RASFDRAAESTIAH; ASFDRAAESTIAHF; SFDRAAESTIAHFT; FDRAAESTIAHFTF; DRAAESTIAHFTFG; RAAESTIAHFTFGL; AAESTIAHFTFGLA; AESTIAHFTFGLAL; ESTIAHFTFGLALL; STIAHFTFGLALLA; TIAHFTFGLALLAG; IAHFTFGLALLAGL; AHFTFGLALLAGLY; HFTFGLALLAGLYV; FTFGLALLAGLYVA; TFGLALLAGLYVAA; FGLALLAGLYVAAS; GLALLAGLYVAASP; LALLAGLYVAASPW; ALLAGLYVAASPWI; LLAGLYVAASPWIV; LAGLYVAASPWIVG; AGLYVAASPWIVGF; GLYVAASPWIVGFS; LYVAASPWIVGFSA; YVAASPWIVGFSAT; VAASPWIVGFSATR; AASPWIVGFSATRG; ASPWIVGFSATRGL; SPWIVGFSATRGLP; PWIVGFSATRGLPT; WIVGFSATRGLPTC; IVGFSATRGLPTCD; VGFSATRGLPTCDL; GFSATRGLPTCDLI; FSATRGLPTCDLIV; SATRGLPTCDLIVG; ATRGLPTCDLIVGI; TRGLPTCDLIVGIA; RGLPTCDLIVGIAV; GLPTCDLIVGIAVA; LPTCDLIVGIAVAY; PTCDLIVGIAVAYL; TCDLIVGIAVAYLA; CDLIVGIAVAYLAY; DLIVGIAVAYLAYG; LIVGIAVAYLAYGF; IVGIAVAYLAYGFA; VGIAVAYLAYGFAS; GIAVAYLAYGFASA; IAVAYLAYGFASAL; AVAYLAYGFASALD; VAYLAYGFASALDR; AYLAYGFASALDRT; YLAYGFASALDRTH; LAYGFASALDRTHG; AYGFASALDRTHGM; YGFASALDRTHGMT; GFASALDRTHGMTW; FASALDRTHGMTWT; ASALDRTHGMTWTL; SALDRTHGMTWTLP; ALDRTHGMTWTLPV; LDRTHGMTWTLPVL; DRTHGMTWTLPVLG; RTHGMTWTLPVLGV; THGMTWTLPVLGVW; HGMTWTLPVLGVWV; GMTWTLPVLGVWVI; MTWTLPVLGVWVIF; TWTLPVLGVWVIFS; WTLPVLGVWVIFSP; TLPVLGVWVIFSPW; LPVLGVWVIFSPWV; PVLGVWVIFSPWVL; VLGVWVIFSPWVLP; LGVWVIFSPWVLPG; GVWVIFSPWVLPGV; VWVIFSPWVLPGVA; WVIFSPWVLPGVAV; VIFSPWVLPGVAVT; IFSPWVLPGVAVTA; FSPWVLPGVAVTAG; SPWVLPGVAVTAGM; | |

Fig. 29 continued

| | | | |
|---|---|---|---|
| | PWVLPGVAVTAGMM; WVLPGVAVTAGMMW; VLPGVAVTAGMMWS; LPGVAVTAGMMWSH; PGVAVTAGMMWSHI; GVAVTAGMMWSHII; VAVTAGMMWSHIIA; AVTAGMMWSHIIAG; VTAGMMWSHIIAGA; TAGMMWSHIIAGAV; AGMMWSHIIAGAVV; GMMWSHIIAGAVVA; MMWSHIIAGAVVAV; MWSHIIAGAVVAVL; WSHIIAGAVVAVLG; SHIIAGAVVAVLGF; HIIAGAVVAVLGFY; IIAGAVVAVLGFYF; IAGAVVAVLGFYFG; AGAVVAVLGFYFGM; GAVVAVLGFYFGMR; AVVAVLGFYFGMRT; VVAVLGFYFGMRTR; VAVLGFYFGMRTRA; AVLGFYFGMRTRAA; VLGFYFGMRTRAAA; LGFYFGMRTRAAAN; GFYFGMRTRAAANQ; FYFGMRTRAAANQG<br><br>15 mers:<br>MSTVHSSIDQHPDLL; STVHSSIDQHPDLLA; TVHSSIDQHPDLLAL; VHSSIDQHPDLLALR; HSSIDQHPDLLALRA; SSIDQHPDLLALRAS; SIDQHPDLLALRASF; IDQHPDLLALRASFD; DQHPDLLALRASFDR; QHPDLLALRASFDRA; HPDLLALRASFDRAA; PDLLALRASFDRAAE; DLLALRASFDRAAES; LLALRASFDRAAEST; LALRASFDRAAESTI; ALRASFDRAAESTIA; LRASFDRAAESTIAH; RASFDRAAESTIAHF; ASFDRAAESTIAHFT; SFDRAAESTIAHFTF; FDRAAESTIAHFTFG; DRAAESTIAHFTFGL; RAAESTIAHFTFGLA; AAESTIAHFTFGLAL; AESTIAHFTFGLALL; ESTIAHFTFGLALLA; STIAHFTFGLALLAG; TIAHFTFGLALLAGL; IAHFTFGLALLAGLY; AHFTFGLALLAGLYV; HFTFGLALLAGLYVA; FTFGLALLAGLYVAA; TFGLALLAGLYVAAS; FGLALLAGLYVAASP; GLALLAGLYVAASPW; LALLAGLYVAASPWI; ALLAGLYVAASPWIV; LLAGLYVAASPWIVG; LAGLYVAASPWIVGF; AGLYVAASPWIVGFS; GLYVAASPWIVGFSA; LYVAASPWIVGFSAT; YVAASPWIVGFSATR; VAASPWIVGFSATRG; AASPWIVGFSATRGL; ASPWIVGFSATRGLP; SPWIVGFSATRGLPT; PWIVGFSATRGLPTC; WIVGFSATRGLPTCD; IVGFSATRGLPTCDL; VGFSATRGLPTCDLI; GFSATRGLPTCDLIV; FSATRGLPTCDLIVG; SATRGLPTCDLIVGI; ATRGLPTCDLIVGIA; TRGLPTCDLIVGIAV; RGLPTCDLIVGIAVA; GLPTCDLIVGIAVAY; LPTCDLIVGIAVAYL; PTCDLIVGIAVAYLA; TCDLIVGIAVAYLAY; CDLIVGIAVAYLAYG; DLIVGIAVAYLAYGF; LIVGIAVAYLAYGFA; IVGIAVAYLAYGFAS; VGIAVAYLAYGFASA; GIAVAYLAYGFASAL; IAVAYLAYGFASALD; AVAYLAYGFASALDR; VAYLAYGFASALDRT; AYLAYGFASALDRTH; YLAYGFASALDRTHG; LAYGFASALDRTHGM; AYGFASALDRTHGMT; YGFASALDRTHGMTW; GFASALDRTHGMTWT; FASALDRTHGMTWTL; ASALDRTHGMTWTLP; SALDRTHGMTWTLPV; ALDRTHGMTWTLPVL; LDRTHGMTWTLPVLG; DRTHGMTWTLPVLGV; RTHGMTWTLPVLGVW; THGMTWTLPVLGVWV; HGMTWTLPVLGVWVI; GMTWTLPVLGVWVIF; MTWTLPVLGVWVIFS; TWTLPVLGVWVIFSP; WTLPVLGVWVIFSPW; TLPVLGVWVIFSPWV; LPVLGVWVIFSPWVL; PVLGVWVIFSPWVLP; VLGVWVIFSPWVLPG; LGVWVIFSPWVLPGV; GVWVIFSPWVLPGVA; VWVIFSPWVLPGVAV; WVIFSPWVLPGVAVT; VIFSPWVLPGVAVTA; IFSPWVLPGVAVTAG; FSPWVLPGVAVTAGM; SPWVLPGVAVTAGMM; PWVLPGVAVTAGMMW; WVLPGVAVTAGMMWS; VLPGVAVTAGMMWSH; LPGVAVTAGMMWSHI; PGVAVTAGMMWSHII; GVAVTAGMMWSHIIA; VAVTAGMMWSHIIAG; AVTAGMMWSHIIAGA; VTAGMMWSHIIAGAV; TAGMMWSHIIAGAVV; AGMMWSHIIAGAVVA; GMMWSHIIAGAVVAV; MMWSHIIAGAVVAVL; MWSHIIAGAVVAVLG; WSHIIAGAVVAVLGF; SHIIAGAVVAVLGFY; HIIAGAVVAVLGFYF; IIAGAVVAVLGFYFG; IAGAVVAVLGFYFGM; AGAVVAVLGFYFGMR; GAVVAVLGFYFGMRT; AVVAVLGFYFGMRTR; | |

Fig. 29 continued

| | | |
|---|---|---|
| | VVAVLGFYFGMRTRA; VAVLGFYFGMRTRAA; AVLGFYFGMRTRAAA; VLGFYFGMRTRAAAN; LGFYFGMRTRAAANQ; GFYFGMRTRAAANQG<br><br>16 mers:<br>MSTVHSSIDQHPDLLA; STVHSSIDQHPDLLAL; TVHSSIDQHPDLLALR; VHSSIDQHPDLLALRA; HSSIDQHPDLLALRAS; SSIDQHPDLLALRASF; SIDQHPDLLALRASFD; IDQHPDLLALRASFDR; DQHPDLLALRASFDRA; QHPDLLALRASFDRAA; HPDLLALRASFDRAAE; PDLLALRASFDRAAES; DLLALRASFDRAAEST; LLALRASFDRAAESTI; LALRASFDRAAESTIA; ALRASFDRAAESTIAH; LRASFDRAAESTIAHF; RASFDRAAESTIAHFT; ASFDRAAESTIAHFTF; SFDRAAESTIAHFTFG; FDRAAESTIAHFTFGL; DRAAESTIAHFTFGLA; RAAESTIAHFTFGLAL; AAESTIAHFTFGLALL; AESTIAHFTFGLALLA; ESTIAHFTFGLALLAG; STIAHFTFGLALLAGL; TIAHFTFGLALLAGLY; IAHFTFGLALLAGLYV; AHFTFGLALLAGLYVA; HFTFGLALLAGLYVAA; FTFGLALLAGLYVAAS; TFGLALLAGLYVAASP; FGLALLAGLYVAASPW; GLALLAGLYVAASPWI; LALLAGLYVAASPWIV; ALLAGLYVAASPWIVG; LLAGLYVAASPWIVGF; LAGLYVAASPWIVGFS; AGLYVAASPWIVGFSA; GLYVAASPWIVGFSAT; LYVAASPWIVGFSATR; YVAASPWIVGFSATRG; VAASPWIVGFSATRGL; AASPWIVGFSATRGLP; ASPWIVGFSATRGLPT; SPWIVGFSATRGLPTC; PWIVGFSATRGLPTCD; WIVGFSATRGLPTCDL; IVGFSATRGLPTCDLI; VGFSATRGLPTCDLIV; GFSATRGLPTCDLIVG; FSATRGLPTCDLIVGI; SATRGLPTCDLIVGIA; ATRGLPTCDLIVGIAV; TRGLPTCDLIVGIAVA; RGLPTCDLIVGIAVAY; GLPTCDLIVGIAVAYL; LPTCDLIVGIAVAYLA; PTCDLIVGIAVAYLAY; TCDLIVGIAVAYLAYG; CDLIVGIAVAYLAYGF; DLIVGIAVAYLAYGFA; LIVGIAVAYLAYGFAS; IVGIAVAYLAYGFASA; VGIAVAYLAYGFASAL; GIAVAYLAYGFASALD; IAVAYLAYGFASALDR; AVAYLAYGFASALDRT; VAYLAYGFASALDRTH; AYLAYGFASALDRTHG; YLAYGFASALDRTHGM; LAYGFASALDRTHGMT; AYGFASALDRTHGMTW; YGFASALDRTHGMTWT; GFASALDRTHGMTWTL; FASALDRTHGMTWTLP; ASALDRTHGMTWTLPV; SALDRTHGMTWTLPVL; ALDRTHGMTWTLPVLG; LDRTHGMTWTLPVLGV; DRTHGMTWTLPVLGVW; RTHGMTWTLPVLGVWV; THGMTWTLPVLGVWVI; HGMTWTLPVLGVWVIF; GMTWTLPVLGVWVIFS; MTWTLPVLGVWVIFSP; TWTLPVLGVWVIFSPW; WTLPVLGVWVIFSPWV; TLPVLGVWVIFSPWVL; LPVLGVWVIFSPWVLP; PVLGVWVIFSPWVLPG; VLGVWVIFSPWVLPGV; LGVWVIFSPWVLPGVA; GVWVIFSPWVLPGVAV; VWVIFSPWVLPGVAVT; WVIFSPWVLPGVAVTA; VIFSPWVLPGVAVTAG; IFSPWVLPGVAVTAGM; FSPWVLPGVAVTAGMM; SPWVLPGVAVTAGMMW; PWVLPGVAVTAGMMWS; WVLPGVAVTAGMMWSH; VLPGVAVTAGMMWSHI; LPGVAVTAGMMWSHII; PGVAVTAGMMWSHIIA; GVAVTAGMMWSHIIAG; VAVTAGMMWSHIIAGA; AVTAGMMWSHIIAGAV; VTAGMMWSHIIAGAVV; TAGMMWSHIIAGAVVA; AGMMWSHIIAGAVVAV; GMMWSHIIAGAVVAVL; MMWSHIIAGAVVAVLG; MWSHIIAGAVVAVLGF; WSHIIAGAVVAVLGFY; SHIIAGAVVAVLGFYF; HIIAGAVVAVLGFYFG; IIAGAVVAVLGFYFGM; IAGAVVAVLGFYFGMR; AGAVVAVLGFYFGMRT; GAVVAVLGFYFGMRTR; AVVAVLGFYFGMRTRA; VVAVLGFYFGMRTRAA; VAVLGFYFGMRTRAAA; AVLGFYFGMRTRAAAN; VLGFYFGMRTRAAANQ; LGFYFGMRTRAAANQG | |
| 4) Rv0284 | 13 mers:<br>MSRLIFEARRRLA; SRLIFEARRRLAP; RLIFEARRRLAPP; LIFEARRRLAPPS; IFEARRRLAPPSS; FEARRRLAPPSSH; EARRRLAPPSSHQ; ARRRLAPPSSHQG; RRRLAPPSSHQGT; RRLAPPSSHQGTI; RLAPPSSHQGTII; LAPPSSHQGTIII; APPSSHQGTIIIE; PPSSHQGTIIIEA; PSSHQGTIIIEAP; SSHQGTIIIEAPP; | 61687-66952 |

Fig. 29 continued

SHQGTIIIEAPPE; HQGTIIIEAPPEL; QGTIIIEAPPELP; GTIIIEAPPELPR;
TIIIEAPPELPRV; IIIEAPPELPRVI; IIEAPPELPRVIP; IEAPPELPRVIPP;
EAPPELPRVIPPS; APPELPRVIPPSL; PPELPRVIPPSLL; PELPRVIPPSLLR;
ELPRVIPPSLLRR; LPRVIPPSLLRRA; PRVIPPSLLRRAL; RVIPPSLLRRALP;
VIPPSLLRRALPY; IPPSLLRRALPYL; PPSLLRRALPYLI; PSLLRRALPYLIG;
SLLRRALPYLIGI; LLRRALPYLIGIL; LRRALPYLIGILI; RRALPYLIGILIV;
RALPYLIGILIVG; ALPYLIGILIVGM; LPYLIGILIVGMI; PYLIGILIVGMIV;
YLIGILIVGMIVA; LIGILIVGMIVAL; IGILIVGMIVALV; GILIVGMIVALVA;
ILIVGMIVALVAT; LIVGMIVALVATG; IVGMIVALVATGM; VGMIVALVATGMR;
GMIVALVATGMRV; MIVALVATGMRVI; IVALVATGMRVIS; VALVATGMRVISP;
ALVATGMRVISPQ; LVATGMRVISPQT; VATGMRVISPQTL; ATGMRVISPQTLF;
TGMRVISPQTLFF; GMRVISPQTLFFP; MRVISPQTLFFPF; RVISPQTLFFPFV;
VISPQTLFFPFVL; ISPQTLFFPFVLL; SPQTLFFPFVLLL; PQTLFFPFVLLLA;
QTLFFPFVLLLAA; TLFFPFVLLLAAT; LFFPFVLLLAATA; FFPFVLLLAATAL;
FPFVLLLAATALY; PFVLLLAATALYR; FVLLLAATALYRG; VLLLAATALYRGN;
LLLAATALYRGND; LLAATALYRGNDK; LAATALYRGNDKK; AATALYRGNDKKM;
ATALYRGNDKKMR; TALYRGNDKKMRT; ALYRGNDKKMRTE;
LYRGNDKKMRTEE; YRGNDKKMRTEEV; RGNDKKMRTEEVD;
GNDKKMRTEEVDA; NDKKMRTEEVDAE; DKKMRTEEVDAER;
KKMRTEEVDAERA; KMRTEEVDAERAD; MRTEEVDAERADY;
RTEEVDAERADYL; TEEVDAERADYLR; EEVDAERADYLRY; EVDAERADYLRYL;
VDAERADYLRYLS; DAERADYLRYLSV; AERADYLRYLSVV; ERADYLRYLSVVR;
RADYLRYLSVVRD; ADYLRYLSVVRDN; DYLRYLSVVRDNI; YLRYLSVVRDNIR;
LRYLSVVRDNIRA; RYLSVVRDNIRAQ; YLSVVRDNIRAQA; LSVVRDNIRAQAA;
SVVRDNIRAQAAE; VVRDNIRAQAAEQ; VRDNIRAQAAEQR; RDNIRAQAAEQRA;
DNIRAQAAEQRAS; NIRAQAAEQRASA; IRAQAAEQRASAL; RAQAAEQRASALW;
AQAAEQRASALWS; QAAEQRASALWSH; AAEQRASALWSHP;
AEQRASALWSHPD; EQRASALWSHPDP; QRASALWSHPDPT;
RASALWSHPDPTA; ASALWSHPDPTAL; SALWSHPDPTALA; ALWSHPDPTALAS;
LWSHPDPTALASV; WSHPDPTALASVP; SHPDPTALASVPG; HPDPTALASVPGS;
PDPTALASVPGSR; DPTALASVPGSRR; PTALASVPGSRRQ;
TALASVPGSRRQW; ALASVPGSRRQWE; LASVPGSRRQWER;
ASVPGSRRQWERD; SVPGSRRQWERDP; VPGSRRQWERDPH;
PGSRRQWERDPHD; GSRRQWERDPHDP; SRRQWERDPHDPD;
RRQWERDPHDPDF; RQWERDPHDPDFL; QWERDPHDPDFLV;
WERDPHDPDFLVL; ERDPHDPDFLVLR; RDPHDPDFLVLRA; DPHDPDFLVLRAG;
PHDPDFLVLRAGR; HDPDFLVLRAGRH; DPDFLVLRAGRHT; PDFLVLRAGRHTV;
DFLVLRAGRHTVP; FLVLRAGRHTVPL; LVLRAGRHTVPLA; VLRAGRHTVPLAT;
LRAGRHTVPLATT; RAGRHTVPLATTL; AGRHTVPLATTLR; GRHTVPLATTLRV;
RHTVPLATTLRVN; HTVPLATTLRVND; TVPLATTLRVNDT; VPLATTLRVNDTA;
PLATTLRVNDTAD; LATTLRVNDTADE; ATTLRVNDTADEI; TTLRVNDTADEID;
TLRVNDTADEIDL; LRVNDTADEIDLE; RVNDTADEIDLEP; VNDTADEIDLEPV;
NDTADEIDLEPVS; DTADEIDLEPVSH; TADEIDLEPVSHS; ADEIDLEPVSHSA;
DEIDLEPVSHSAL; EIDLEPVSHSALR; IDLEPVSHSALRS; DLEPVSHSALRSL;
LEPVSHSALRSLL; EPVSHSALRSLLD; PVSHSALRSLLDT; VSHSALRSLLDTQ;
SHSALRSLLDTQR; HSALRSLLDTQRS; SALRSLLDTQRSI; ALRSLLDTQRSIG;
LRSLLDTQRSIGD; RSLLDTQRSIGDV; SLLDTQRSIGDVP; LLDTQRSIGDVPT;
LDTQRSIGDVPTG; DTQRSIGDVPTGI; TQRSIGDVPTGID; QRSIGDVPTGIDL;
RSIGDVPTGIDLT; SIGDVPTGIDLTK; IGDVPTGIDLTKV; GDVPTGIDLTKVS;
DVPTGIDLTKVSP; VPTGIDLTKVSPI; PTGIDLTKVSPIT; TGIDLTKVSPITV;
GIDLTKVSPITVL; IDLTKVSPITVLG; DLTKVSPITVLGE; LTKVSPITVLGER;
TKVSPITVLGERA; KVSPITVLGERAQ; VSPITVLGERAQV; SPITVLGERAQVR;
PITVLGERAQVRA; ITVLGERAQVRAV; TVLGERAQVRAVL; VLGERAQVRAVLR;

Fig. 29 continued

| | | |
|---|---|---|
| | LGERAQVRAVLRA; GERAQVRAVLRAW; ERAQVRAVLRAWI; | |
| | RAQVRAVLRAWIA; AQVRAVLRAWIAQ; QVRAVLRAWIAQA; VRAVLRAWIAQAV; | |
| | RAVLRAWIAQAVT; AVLRAWIAQAVTW; VLRAWIAQAVTWH; LRAWIAQAVTWHD; | |
| | RAWIAQAVTWHDP; AWIAQAVTWHDPT; WIAQAVTWHDPTV; | |
| | IAQAVTWHDPTVL; AQAVTWHDPTVLG; QAVTWHDPTVLGV; | |
| | AVTWHDPTVLGVA; VTWHDPTVLGVAL; TWHDPTVLGVALA; | |
| | WHDPTVLGVALAA; HDPTVLGVALAAR; DPTVLGVALAARD; PTVLGVALAARDL; | |
| | TVLGVALAARDLE; VLGVALAARDLEG; LGVALAARDLEGR; GVALAARDLEGRD; | |
| | VALAARDLEGRDW; ALAARDLEGRDWN; LAARDLEGRDWNW; | |
| | AARDLEGRDWNWL; ARDLEGRDWNWLK; RDLEGRDWNWLKW; | |
| | DLEGRDWNWLKWL; LEGRDWNWLKWLP; EGRDWNWLKWLPH; | |
| | GRDWNWLKWLPHV; RDWNWLKWLPHVD; DWNWLKWLPHVDI; | |
| | WNWLKWLPHVDIP; NWLKWLPHVDIPG; WLKWLPHVDIPGR; LKWLPHVDIPGRL; | |
| | KWLPHVDIPGRLD; WLPHVDIPGRLDA; LPHVDIPGRLDAL; PHVDIPGRLDALG; | |
| | HVDIPGRLDALGP; VDIPGRLDALGPA; DIPGRLDALGPAR; IPGRLDALGPARN; | |
| | PGRLDALGPARNL; GRLDALGPARNLS; RLDALGPARNLST; LDALGPARNLSTD; | |
| | DALGPARNLSTDP; ALGPARNLSTDPD; LGPARNLSTDPDE; GPARNLSTDPDEL; | |
| | PARNLSTDPDELI; ARNLSTDPDELIA; RNLSTDPDELIAL; NLSTDPDELIALL; | |
| | LSTDPDELIALLG; STDPDELIALLGP; TDPDELIALLGPV; DPDELIALLGPVL; | |
| | PDELIALLGPVLA; DELIALLGPVLAD; ELIALLGPVLADR; LIALLGPVLADRP; | |
| | IALLGPVLADRPA; ALLGPVLADRPAF; LLGPVLADRPAFT; LGPVLADRPAFTG; | |
| | GPVLADRPAFTGQ; PVLADRPAFTGQP; VLADRPAFTGQPT; LADRPAFTGQPTD; | |
| | ADRPAFTGQPTDA; DRPAFTGQPTDAL; RPAFTGQPTDALR; PAFTGQPTDALRH; | |
| | AFTGQPTDALRHL; FTGQPTDALRHLL; TGQPTDALRHLLI; GQPTDALRHLLIV; | |
| | QPTDALRHLLIVV; PTDALRHLLIVVD; TDALRHLLIVVDD; DALRHLLIVVDDP; | |
| | ALRHLLIVVDDPD; LRHLLIVVDDPDY; RHLLIVVDDPDYD; HLLIVVDDPDYDL; | |
| | LLIVVDDPDYDLG; LIVVDDPDYDLGA; IVVDDPDYDLGAS; VVDDPDYDLGASP; | |
| | VDDPDYDLGASPL; DDPDYDLGASPLA; DPDYDLGASPLAV; PDYDLGASPLAVG; | |
| | DYDLGASPLAVGR; YDLGASPLAVGRA; DLGASPLAVGRAG; LGASPLAVGRAGV; | |
| | GASPLAVGRAGVT; ASPLAVGRAGVTV; SPLAVGRAGVTVV; PLAVGRAGVTVVH; | |
| | LAVGRAGVTVVHC; AVGRAGVTVVHCS; VGRAGVTVVHCSA; | |
| | GRAGVTVVHCSAS; RAGVTVVHCSASA; AGVTVVHCSASAP; | |
| | GVTVVHCSASAPH; VTVVHCSASAPHR; TVVHCSASAPHRE; | |
| | VVHCSASAPHREQ; VHCSASAPHREQY; HCSASAPHREQYS; | |
| | CSASAPHREQYSD; SASAPHREQYSDP; ASAPHREQYSDPE; | |
| | SAPHREQYSDPEK; APHREQYSDPEKP; PHREQYSDPEKPI; HREQYSDPEKPIL; | |
| | REQYSDPEKPILR; EQYSDPEKPILRV; QYSDPEKPILRVA; YSDPEKPILRVAH; | |
| | SDPEKPILRVAHG; DPEKPILRVAHGA; PEKPILRVAHGAI; EKPILRVAHGAIE; | |
| | KPILRVAHGAIER; PILRVAHGAIERW; ILRVAHGAIERWQ; LRVAHGAIERWQT; | |
| | RVAHGAIERWQTG; VAHGAIERWQTGG; AHGAIERWQTGGW; | |
| | HGAIERWQTGGWQ; GAIERWQTGGWQP; AIERWQTGGWQPY; | |
| | IERWQTGGWQPYI; ERWQTGGWQPYID; RWQTGGWQPYIDA; | |
| | WQTGGWQPYIDAA; QTGGWQPYIDAAD; TGGWQPYIDAADQ; | |
| | GGWQPYIDAADQF; GWQPYIDAADQFS; WQPYIDAADQFSA; | |
| | QPYIDAADQFSAD; PYIDAADQFSADE; YIDAADQFSADEA; IDAADQFSADEAA; | |
| | DAADQFSADEAAH; AADQFSADEAAHL; ADQFSADEAAHLA; DQFSADEAAHLAR; | |
| | QFSADEAAHLARR; FSADEAAHLARRL; SADEAAHLARRLS; ADEAAHLARRLSR; | |
| | DEAAHLARRLSRW; EAAHLARRLSRWD; AAHLARRLSRWDS; | |
| | AHLARRLSRWDSN; HLARRLSRWDSNP; LARRLSRWDSNPT; | |
| | ARRLSRWDSNPTH; RRLSRWDSNPTHA; RLSRWDSNPTHAG; | |
| | LSRWDSNPTHAGL; SRWDSNPTHAGLR; RWDSNPTHAGLRS; | |
| | WDSNPTHAGLRSA; DSNPTHAGLRSAA; SNPTHAGLRSAAT; | |
| | NPTHAGLRSAATR; PTHAGLRSAATRG; THAGLRSAATRGA; HAGLRSAATRGAS; | |

Fig. 29 continued

| | | |
|---|---|---|
| | AGLRSAATRGASF; GLRSAATRGASFT; LRSAATRGASFTT; RSAATRGASFTTL;<br>SAATRGASFTTLL; AATRGASFTTLLG; ATRGASFTTLLGI; TRGASFTTLLGIE;<br>RGASFTTLLGIED; GASFTTLLGIEDA; ASFTTLLGIEDAS; SFTTLLGIEDASR;<br>FTTLLGIEDASRL; TTLLGIEDASRLD; TLLGIEDASRLDV; LLGIEDASRLDVP;<br>LGIEDASRLDVPA; GIEDASRLDVPAL; IEDASRLDVPALW; EDASRLDVPALWA;<br>DASRLDVPALWAP; ASRLDVPALWAPR; SRLDVPALWAPRR;<br>RLDVPALWAPRRR; LDVPALWAPRRRD; DVPALWAPRRRDE;<br>VPALWAPRRRDEE; PALWAPRRRDEEL; ALWAPRRRDEELR;<br>LWAPRRRDEELRV; WAPRRRDEELRVP; APRRRDEELRVPI; PRRRDEELRVPIG;<br>RRRDEELRVPIGV; RRDEELRVPIGVT; RDEELRVPIGVTG; DEELRVPIGVTGT;<br>EELRVPIGVTGTG; ELRVPIGVTGTGE; LRVPIGVTGTGEP; RVPIGVTGTGEPL;<br>VPIGVTGTGEPLM; PIGVTGTGEPLMF; IGVTGTGEPLMFD; GVTGTGEPLMFDL;<br>VTGTGEPLMFDLK; TGTGEPLMFDLKD; GTGEPLMFDLKDE; TGEPLMFDLKDEA;<br>GEPLMFDLKDEAE; EPLMFDLKDEAEG; PLMFDLKDEAEGG;<br>LMFDLKDEAEGGM; MFDLKDEAEGGMG; FDLKDEAEGGMGP;<br>DLKDEAEGGMGPH; LKDEAEGGMGPHG; KDEAEGGMGPHGL;<br>DEAEGGMGPHGLM; EAEGGMGPHGLMI; AEGGMGPHGLMIG;<br>EGGMGPHGLMIGM; GGMGPHGLMIGMT; GMGPHGLMIGMTG;<br>MGPHGLMIGMTGS; GPHGLMIGMTGSG; PHGLMIGMTGSGK;<br>HGLMIGMTGSGKS; GLMIGMTGSGKSQ; LMIGMTGSGKSQT;<br>MIGMTGSGKSQTL; IGMTGSGKSQTLM; GMTGSGKSQTLMS;<br>MTGSGKSQTLMSI; TGSGKSQTLMSIL; GSGKSQTLMSILL; SGKSQTLMSILLS;<br>GKSQTLMSILLSL; KSQTLMSILLSLL; SQTLMSILLSLLT; QTLMSILLSLLTT;<br>TLMSILLSLLTTH; LMSILLSLLTTHS; MSILLSLLTTHSA; SILLSLLTTHSAE;<br>ILLSLLTTHSAER; LLSLLTTHSAERL; LSLLTTHSAERLI; SLLTTHSAERLIV;<br>LLTTHSAERLIVI; LTTHSAERLIVIY; TTHSAERLIVIYA; THSAERLIVIYAD;<br>HSAERLIVIYADF; SAERLIVIYADFK; AERLIVIYADFKG; ERLIVIYADFKGE;<br>RLIVIYADFKGEA; LIVIYADFKGEAG; IVIYADFKGEAGA; VIYADFKGEAGAD;<br>IYADFKGEAGADS; YADFKGEAGADSF; ADFKGEAGADSFR; DFKGEAGADSFRD;<br>FKGEAGADSFRDF; KGEAGADSFRDFP; GEAGADSFRDFPQ;<br>EAGADSFRDFPQV; AGADSFRDFPQVV; GADSFRDFPQVVA;<br>ADSFRDFPQVVAV; DSFRDFPQVVAVI; SFRDFPQVVAVIS; FRDFPQVVAVISN;<br>RDFPQVVAVISNM; DFPQVVAVISNMA; FPQVVAVISNMAE; PQVVAVISNMAEK;<br>QVVAVISNMAEKK; VVAVISNMAEKKS; VAVISNMAEKKSL; AVISNMAEKKSLA;<br>VISNMAEKKSLAD; ISNMAEKKSLADR; SNMAEKKSLADRF; NMAEKKSLADRFA;<br>MAEKKSLADRFAD; AEKKSLADRFADT; EKKSLADRFADTL; KKSLADRFADTLR;<br>KSLADRFADTLRG; SLADRFADTLRGE; LADRFADTLRGEV; ADRFADTLRGEVA;<br>DRFADTLRGEVAR; RFADTLRGEVARR; FADTLRGEVARRE;<br>ADTLRGEVARREM; DTLRGEVARREML; TLRGEVARREMLL;<br>LRGEVARREMLLR; RGEVARREMLLRE; GEVARREMLLREA;<br>EVARREMLLREAG; VARREMLLREAGR; ARREMLLREAGRK;<br>RREMLLREAGRKV; REMLLREAGRKVQ; EMLLREAGRKVQG;<br>MLLREAGRKVQGS; LLREAGRKVQGSA; LREAGRKVQGSAF;<br>REAGRKVQGSAFN; EAGRKVQGSAFNS; AGRKVQGSAFNSV;<br>GRKVQGSAFNSVL; RKVQGSAFNSVLE; KVQGSAFNSVLEY; VQGSAFNSVLEYE;<br>QGSAFNSVLEYEN; GSAFNSVLEYENA; SAFNSVLEYENAI; AFNSVLEYENAIA;<br>FNSVLEYENAIAA; NSVLEYENAIAAG; SVLEYENAIAAGH; VLEYENAIAAGHS;<br>LEYENAIAAGHSL; EYENAIAAGHSLP; YENAIAAGHSLPP; ENAIAAGHSLPPI;<br>NAIAAGHSLPPIP; AIAAGHSLPPIPT; IAAGHSLPPIPTL; AAGHSLPPIPTLF;<br>AGHSLPPIPTLFV; GHSLPPIPTLFVV; HSLPPIPTLFVVA; SLPPIPTLFVVAD;<br>LPPIPTLFVVADE; PPIPTLFVVADEF; PIPTLFVVADEFT; IPTLFVVADEFTL;<br>PTLFVVADEFTLM; TLFVVADEFTLML; LFVVADEFTLMLA; FVVADEFTLMLAD;<br>VVADEFTLMLADH; VADEFTLMLADHP; ADEFTLMLADHPE; DEFTLMLADHPEY; | |

Fig. 29 continued

EFTLMLADHPEYA; FTLMLADHPEYAE; TLMLADHPEYAEL; LMLADHPEYAELF;
MLADHPEYAELFD; LADHPEYAELFDY; ADHPEYAELFDYV; DHPEYAELFDYVA;
HPEYAELFDYVAR; PEYAELFDYVARK; EYAELFDYVARKG; YAELFDYVARKGR;
AELFDYVARKGRS; ELFDYVARKGRSF; LFDYVARKGRSFR; FDYVARKGRSFRI;
DYVARKGRSFRIH; YVARKGRSFRIHI; VARKGRSFRIHIL; ARKGRSFRIHILF;
RKGRSFRIHILFA; KGRSFRIHILFAS; GRSFRIHILFASQ; RSFRIHILFASQT;
SFRIHILFASQTL; FRIHILFASQTLD; RIHILFASQTLDV; IHILFASQTLDVG;
HILFASQTLDVGK; ILFASQTLDVGKI; LFASQTLDVGKIK; FASQTLDVGKIKD;
ASQTLDVGKIKDI; SQTLDVGKIKDID; QTLDVGKIKDIDK; TLDVGKIKDIDKN;
LDVGKIKDIDKNT; DVGKIKDIDKNTA; VGKIKDIDKNTAY; GKIKDIDKNTAYR;
KIKDIDKNTAYRI; IKDIDKNTAYRIG; KDIDKNTAYRIGL; DIDKNTAYRIGLK;
IDKNTAYRIGLKV; DKNTAYRIGLKVA; KNTAYRIGLKVAS; NTAYRIGLKVASP;
TAYRIGLKVASPS; AYRIGLKVASPSV; YRIGLKVASPSVS; RIGLKVASPSVSR;
IGLKVASPSVSRQ; GLKVASPSVSRQI; LKVASPSVSRQII; KVASPSVSRQIIG;
VASPSVSRQIIGV; ASPSVSRQIIGVE; SPSVSRQIIGVED; PSVSRQIIGVEDA;
SVSRQIIGVEDAY; VSRQIIGVEDAYH; SRQIIGVEDAYHI; RQIIGVEDAYHIE;
QIIGVEDAYHIES; IIGVEDAYHIESG; IGVEDAYHIESGK; GVEDAYHIESGKE;
VEDAYHIESGKEH; EDAYHIESGKEHK; DAYHIESGKEHKG; AYHIESGKEHKGV;
YHIESGKEHKGVG; HIESGKEHKGVGF; IESGKEHKGVGFL; ESGKEHKGVGFLV;
SGKEHKGVGFLVP; GKEHKGVGFLVPA; KEHKGVGFLVPAP;
EHKGVGFLVPAPG; HKGVGFLVPAPGA; KGVGFLVPAPGAT; GVGFLVPAPGATP;
VGFLVPAPGATPI; GFLVPAPGATPIR; FLVPAPGATPIRF; LVPAPGATPIRFR;
VPAPGATPIRFRS; PAPGATPIRFRST; APGATPIRFRSTY; PGATPIRFRSTYV;
GATPIRFRSTYVD; ATPIRFRSTYVDG; TPIRFRSTYVDGI; PIRFRSTYVDGIY;
IRFRSTYVDGIYE; RFRSTYVDGIYEP; FRSTYVDGIYEPP; RSTYVDGIYEPPQ;
STYVDGIYEPPQT; TYVDGIYEPPQTA; YVDGIYEPPQTAK; VDGIYEPPQTAKA;
DGIYEPPQTAKAV; GIYEPPQTAKAVV; IYEPPQTAKAVVV; YEPPQTAKAVVVQ;
EPPQTAKAVVVQS; PPQTAKAVVVQSV; PQTAKAVVVQSVP; QTAKAVVVQSVPE;
TAKAVVVQSVPEP; AKAVVVQSVPEPK; KAVVVQSVPEPKL; AVVVQSVPEPKLF;
VVVQSVPEPKLFT; VVQSVPEPKLFTA; VQSVPEPKLFTAA; QSVPEPKLFTAAA;
SVPEPKLFTAAAV; VPEPKLFTAAAVE; PEPKLFTAAAVEP; EPKLFTAAAVEPD;
PKLFTAAAVEPDP; KLFTAAAVEPDPG; LFTAAAVEPDPGT; FTAAAVEPDPGTV;
TAAAVEPDPGTVI; AAAVEPDPGTVIA; AAVEPDPGTVIAD; AVEPDPGTVIADT;
VEPDPGTVIADTD; EPDPGTVIADTDE; PDPGTVIADTDEQ; DPGTVIADTDEQE;
PGTVIADTDEQEP; GTVIADTDEQEPA; TVIADTDEQEPAD; VIADTDEQEPADP;
IADTDEQEPADPP; ADTDEQEPADPPR; DTDEQEPADPPRK; TDEQEPADPPRKL;
DEQEPADPPRKLI; EQEPADPPRKLIA; QEPADPPRKLIAT; EPADPPRKLIATI;
PADPPRKLIATIG; ADPPRKLIATIGE; DPPRKLIATIGEQ; PPRKLIATIGEQL;
PRKLIATIGEQLA; RKLIATIGEQLAR; KLIATIGEQLARY; LIATIGEQLARYG;
IATIGEQLARYGP; ATIGEQLARYGPR; TIGEQLARYGPRA; IGEQLARYGPRAP;
GEQLARYGPRAPQ; EQLARYGPRAPQL; QLARYGPRAPQLW;
LARYGPRAPQLWL; ARYGPRAPQLWLP; RYGPRAPQLWLPP;
YGPRAPQLWLPPL; GPRAPQLWLPPLD; PRAPQLWLPPLDE;
RAPQLWLPPLDET; APQLWLPPLDETI; PQLWLPPLDETIP; QLWLPPLDETIPL;
LWLPPLDETIPLS; WLPPLDETIPLSA; LPPLDETIPLSAA; PPLDETIPLSAAL;
PLDETIPLSAALA; LDETIPLSAALAR; DETIPLSAALARA; ETIPLSAALARAG;
TIPLSAALARAGV; IPLSAALARAGVG; PLSAALARAGVGP; LSAALARAGVGPR;
SAALARAGVGPRQ; AALARAGVGPRQW; ALARAGVGPRQWR;
LARAGVGPRQWRW; ARAGVGPRQWRWP; RAGVGPRQWRWPL;
AGVGPRQWRWPLG; GVGPRQWRWPLGE; VGPRQWRWPLGEI;
GPRQWRWPLGEID; PRQWRWPLGEIDR; RQWRWPLGEIDRP;
QWRWPLGEIDRPF; WRWPLGEIDRPFE; RWPLGEIDRPFEM;
WPLGEIDRPFEMR; PLGEIDRPFEMRR; LGEIDRPFEMRRD; GEIDRPFEMRRDP;

Fig. 29 continued

| | | |
|---|---|---|
| | EIDRPFEMRRDPL; IDRPFEMRRDPLV; DRPFEMRRDPLVF; RPFEMRRDPLVFD; PFEMRRDPLVFDA; FEMRRDPLVFDAR; EMRRDPLVFDARS; MRRDPLVFDARSS; RRDPLVFDARSSA; RDPLVFDARSSAG; DPLVFDARSSAGN; PLVFDARSSAGNM; LVFDARSSAGNMV; VFDARSSAGNMVI; FDARSSAGNMVIH; DARSSAGNMVIHG; ARSSAGNMVIHGG; RSSAGNMVIHGGP; SSAGNMVIHGGPK; SAGNMVIHGGPKS; AGNMVIHGGPKSG; GNMVIHGGPKSGK; NMVIHGGPKSGKS; MVIHGGPKSGKST; VIHGGPKSGKSTA; IHGGPKSGKSTAL; HGGPKSGKSTALQ; GGPKSGKSTALQT; GPKSGKSTALQTF; PKSGKSTALQTFI; KSGKSTALQTFIL; SGKSTALQTFILS; GKSTALQTFILSA; KSTALQTFILSAA; STALQTFILSAAS; TALQTFILSAASL; ALQTFILSAASLH; LQTFILSAASLHS; QTFILSAASLHSP; TFILSAASLHSPH; FILSAASLHSPHE; ILSAASLHSPHEV; LSAASLHSPHEVS; SAASLHSPHEVSF; AASLHSPHEVSFY; ASLHSPHEVSFYC; SLHSPHEVSFYCL; LHSPHEVSFYCLD; HSPHEVSFYCLDY; SPHEVSFYCLDYG; PHEVSFYCLDYGG; HEVSFYCLDYGGG; EVSFYCLDYGGGQ; VSFYCLDYGGGQL; SFYCLDYGGGQLR; FYCLDYGGGQLRA; YCLDYGGGQLRAL; CLDYGGGQLRALQ; LDYGGGQLRALQD; DYGGGQLRALQDL; YGGGQLRALQDLA; GGGQLRALQDLAH; GGQLRALQDLAHV; GQLRALQDLAHVG; QLRALQDLAHVGS; LRALQDLAHVGSV; RALQDLAHVGSVA; ALQDLAHVGSVAS; LQDLAHVGSVASA; QDLAHVGSVASAL; DLAHVGSVASALE; LAHVGSVASALEP; AHVGSVASALEPE; HVGSVASALEPER; VGSVASALEPERI; GSVASALEPERIR; SVASALEPERIRR; VASALEPERIRRT; ASALEPERIRRTF; SALEPERIRRTFG; ALEPERIRRTFGE; LEPERIRRTFGEL; EPERIRRTFGELE; PERIRRTFGELEQ; ERIRRTFGELEQL; RIRRTFGELEQLL; IRRTFGELEQLLL; RRTFGELEQLLLS; RTFGELEQLLLSR; TFGELEQLLLSRQ; FGELEQLLLSRQQ; GELEQLLLSRQQR; ELEQLLLSRQQRE; LEQLLLSRQQREV; EQLLLSRQQREVF; QLLLSRQQREVFR; LLLSRQQREVFRD; LLSRQQREVFRDR; LSRQQREVFRDRG; SRQQREVFRDRGA; RQQREVFRDRGAN; QQREVFRDRGANG; QREVFRDRGANGS; REVFRDRGANGST; EVFRDRGANGSTP; VFRDRGANGSTPD; FRDRGANGSTPDD; RDRGANGSTPDDG; DRGANGSTPDDGF; RGANGSTPDDGFG; GANGSTPDDGFGE; ANGSTPDDGFGEV; NGSTPDDGFGEVF; GSTPDDGFGEVFL; STPDDGFGEVFLV; TPDDGFGEVFLVI; PDDGFGEVFLVID; DDGFGEVFLVIDN; DGFGEVFLVIDNL; GFGEVFLVIDNLY; FGEVFLVIDNLYG; GEVFLVIDNLYGF; EVFLVIDNLYGFG; VFLVIDNLYGFGR; FLVIDNLYGFGRD; LVIDNLYGFGRDN; VIDNLYGFGRDNT; IDNLYGFGRDNTD; DNLYGFGRDNTDQ; NLYGFGRDNTDQF; LYGFGRDNTDQFN; YGFGRDNTDQFNT; GFGRDNTDQFNTR; FGRDNTDQFNTRN; GRDNTDQFNTRNP; RDNTDQFNTRNPL; DNTDQFNTRNPLL; NTDQFNTRNPLLA; TDQFNTRNPLLAR; DQFNTRNPLLARV; QFNTRNPLLARVT; FNTRNPLLARVTE; NTRNPLLARVTEL; TRNPLLARVTELV; RNPLLARVTELVN; NPLLARVTELVNV; PLLARVTELVNVG; LLARVTELVNVGL; LARVTELVNVGLA; ARVTELVNVGLAY; RVTELVNVGLAYG; VTELVNVGLAYGI; TELVNVGLAYGIH; ELVNVGLAYGIHV; LVNVGLAYGIHVI; VNVGLAYGIHVII; NVGLAYGIHVIIT; VGLAYGIHVIITT; GLAYGIHVIITTP; LAYGIHVIITTPS; AYGIHVIITTPSW; YGIHVIITTPSWL; GIHVIITTPSWLE; IHVIITTPSWLEV; HVIITTPSWLEVP; VIITTPSWLEVPL; IITTPSWLEVPLA; ITTPSWLEVPLAM; TTPSWLEVPLAMR; TPSWLEVPLAMRD; PSWLEVPLAMRDG; SWLEVPLAMRDGL; WLEVPLAMRDGLG; LEVPLAMRDGLGL; EVPLAMRDGLGLR; VPLAMRDGLGLRL; PLAMRDGLGLRLE; LAMRDGLGLRLEL; AMRDGLGLRLELR; MRDGLGLRLELRL; RDGLGLRLELRLH; DGLGLRLELRLHD; GLGLRLELRLHDA; LGLRLELRLHDAR; GLRLELRLHDARD; LRLELRLHDARDS; RLELRLHDARDSN; LELRLHDARDSNV; ELRLHDARDSNVR; LRLHDARDSNVRV; RLHDARDSNVRVV; LHDARDSNVRVVG; HDARDSNVRVVGA; | |

Fig. 29 continued

| | | |
|---|---|---|
| | DARDSNVRVVGAL; ARDSNVRVVGALR; RDSNVRVVGALRR;<br>DSNVRVVGALRRP; SNVRVVGALRRPA; NVRVVGALRRPAD;<br>VRVVGALRRPADA; RVVGALRRPADAV; VVGALRRPADAVP;<br>VGALRRPADAVPH; GALRRPADAVPHD; ALRRPADAVPHDQ;<br>LRRPADAVPHDQP; RRPADAVPHDQPG; RPADAVPHDQPGR;<br>PADAVPHDQPGRG; ADAVPHDQPGRGL; DAVPHDQPGRGLT;<br>AVPHDQPGRGLTM; VPHDQPGRGLTMA; PHDQPGRGLTMAA;<br>HDQPGRGLTMAAE; DQPGRGLTMAAEH; QPGRGLTMAAEHF;<br>PGRGLTMAAEHFL; GRGLTMAAEHFLF; RGLTMAAEHFLFA; GLTMAAEHFLFAA;<br>LTMAAEHFLFAAP; TMAAEHFLFAAPE; MAAEHFLFAAPEL; AAEHFLFAAPELD;<br>AEHFLFAAPELDA; EHFLFAAPELDAQ; HFLFAAPELDAQT; FLFAAPELDAQTN;<br>LFAAPELDAQTNP; FAAPELDAQTNPV; AAPELDAQTNPVA; APELDAQTNPVAA;<br>PELDAQTNPVAAI; ELDAQTNPVAAIN; LDAQTNPVAAINA; DAQTNPVAAINAR;<br>AQTNPVAAINARY; QTNPVAAINARYP; TNPVAAINARYPG; NPVAAINARYPGM;<br>PVAAINARYPGMA; VAAINARYPGMAA; AAINARYPGMAAP; AINARYPGMAAPP;<br>INARYPGMAAPPV; NARYPGMAAPPVR; ARYPGMAAPPVRL;<br>RYPGMAAPPVRLL; YPGMAAPPVRLLP; PGMAAPPVRLLPT; GMAAPPVRLLPTN;<br>MAAPPVRLLPTNL; AAPPVRLLPTNLA; APPVRLLPTNLAP; PPVRLLPTNLAPH;<br>PVRLLPTNLAPHA; VRLLPTNLAPHAV; RLLPTNLAPHAVG; LLPTNLAPHAVGE;<br>LPTNLAPHAVGEL; PTNLAPHAVGELY; TNLAPHAVGELYR; NLAPHAVGELYRG;<br>LAPHAVGELYRGP; APHAVGELYRGPD; PHAVGELYRGPDQ;<br>HAVGELYRGPDQL; AVGELYRGPDQLV; VGELYRGPDQLVI; GELYRGPDQLVIG;<br>ELYRGPDQLVIGQ; LYRGPDQLVIGQR; YRGPDQLVIGQRE; RGPDQLVIGQREE;<br>GPDQLVIGQREED; PDQLVIGQREEDL; DQLVIGQREEDLA; QLVIGQREEDLAP;<br>LVIGQREEDLAPV; VIGQREEDLAPVI; IGQREEDLAPVIL; GQREEDLAPVILD;<br>QREEDLAPVILDL; REEDLAPVILDLA; EEDLAPVILDLAA; EDLAPVILDLAAN;<br>DLAPVILDLAANP; LAPVILDLAANPL; APVILDLAANPLL; PVILDLAANPLLM;<br>VILDLAANPLLMV; ILDLAANPLLMVF; LDLAANPLLMVFG; DLAANPLLMVFGD;<br>LAANPLLMVFGDA; AANPLLMVFGDAR; ANPLLMVFGDARS; NPLLMVFGDARSG;<br>PLLMVFGDARSGK; LLMVFGDARSGKT; LMVFGDARSGKTT;<br>MVFGDARSGKTTL; VFGDARSGKTTLL; FGDARSGKTTLLR; GDARSGKTTLLRH;<br>DARSGKTTLLRHI; ARSGKTTLLRHII; RSGKTTLLRHIIR; SGKTTLLRHIIRT;<br>GKTTLLRHIIRTV; KTTLLRHIIRTVR; TTLLRHIIRTVRE; TLLRHIIRTVREH;<br>LLRHIIRTVREHS; LRHIIRTVREHST; RHIIRTVREHSTA; HIIRTVREHSTAD;<br>IIRTVREHSTADR; IRTVREHSTADRV; RTVREHSTADRVA; TVREHSTADRVAF;<br>VREHSTADRVAFT; REHSTADRVAFTV; EHSTADRVAFTVL; HSTADRVAFTVLD;<br>STADRVAFTVLDR; TADRVAFTVLDRR; ADRVAFTVLDRRL; DRVAFTVLDRRLH;<br>RVAFTVLDRRLHL; VAFTVLDRRLHLV; AFTVLDRRLHLVD; FTVLDRRLHLVDE;<br>TVLDRRLHLVDEP; VLDRRLHLVDEPL; LDRRLHLVDEPLF; DRRLHLVDEPLFP;<br>RRLHLVDEPLFPD; RLHLVDEPLFPDN; LHLVDEPLFPDNE; HLVDEPLFPDNEY;<br>LVDEPLFPDNEYT; VDEPLFPDNEYTA; DEPLFPDNEYTAN; EPLFPDNEYTANI;<br>PLFPDNEYTANID; LFPDNEYTANIDR; FPDNEYTANIDRI; PDNEYTANIDRII;<br>DNEYTANIDRIIP; NEYTANIDRIIPA; EYTANIDRIIPAM; YTANIDRIIPAML;<br>TANIDRIIPAMLG; ANIDRIIPAMLGL; NIDRIIPAMLGLA; IDRIIPAMLGLAN;<br>DRIIPAMLGLANL; RIIPAMLGLANLI; IIPAMLGLANLIE; IPAMLGLANLIEA;<br>PAMLGLANLIEAR; AMLGLANLIEARR; MLGLANLIEARRP; LGLANLIEARRPP;<br>GLANLIEARRPPA; LANLIEARRPPAG; ANLIEARRPPAGM; NLIEARRPPAGMS;<br>LIEARRPPAGMSA; IEARRPPAGMSAA; EARRPPAGMSAAE; ARRPPAGMSAAEL;<br>RRPPAGMSAAELS; RPPAGMSAAELSR; PPAGMSAAELSRW;<br>PAGMSAAELSRWT; AGMSAAELSRWTF; GMSAAELSRWTFA;<br>MSAAELSRWTFAG; SAAELSRWTFAGH; AAELSRWTFAGHT;<br>AELSRWTFAGHTH; ELSRWTFAGHTHY; LSRWTFAGHTHYL; SRWTFAGHTHYLI;<br>RWTFAGHTHYLII; WTFAGHTHYLIID; TFAGHTHYLIIDD; FAGHTHYLIIDDV; | |

Fig. 29 continued

AGHTHYLIIDDVD; GHTHYLIIDDVDQ; HTHYLIIDDVDQV; THYLIIDDVDQVP; HYLIIDDVDQVPD; YLIIDDVDQVPDS; LIIDDVDQVPDSP; IIDDVDQVPDSPA; IDDVDQVPDSPAM; DDVDQVPDSPAMT; DVDQVPDSPAMTG; VDQVPDSPAMTGP; DQVPDSPAMTGPY; QVPDSPAMTGPYI; VPDSPAMTGPYIG; PDSPAMTGPYIGQ; DSPAMTGPYIGQR; SPAMTGPYIGQRP; PAMTGPYIGQRPW; AMTGPYIGQRPWT; MTGPYIGQRPWTP; TGPYIGQRPWTPL; GPYIGQRPWTPLI; PYIGQRPWTPLIG; YIGQRPWTPLIGL; IGQRPWTPLIGLL; GQRPWTPLIGLLA; QRPWTPLIGLLAQ; RPWTPLIGLLAQA; PWTPLIGLLAQAG; WTPLIGLLAQAGD; TPLIGLLAQAGDL; PLIGLLAQAGDLG; LIGLLAQAGDLGL; IGLLAQAGDLGLR; GLLAQAGDLGLRV; LLAQAGDLGLRVI; LAQAGDLGLRVIV; AQAGDLGLRVIVT; QAGDLGLRVIVTG; AGDLGLRVIVTGR; GDLGLRVIVTGRA; DLGLRVIVTGRAT; LGLRVIVTGRATG; GLRVIVTGRATGS; LRVIVTGRATGSA; RVIVTGRATGSAH; VIVTGRATGSAHL; IVTGRATGSAHLL; VTGRATGSAHLLM; TGRATGSAHLLMT; GRATGSAHLLMTS; RATGSAHLLMTSP; ATGSAHLLMTSPL; TGSAHLLMTSPLL; GSAHLLMTSPLLR; SAHLLMTSPLLRR; AHLLMTSPLLRRF; HLLMTSPLLRRFN; LLMTSPLLRRFND; LMTSPLLRRFNDL; MTSPLLRRFNDLQ; TSPLLRRFNDLQA; SPLLRRFNDLQAT; PLLRRFNDLQATT; LLRRFNDLQATTL; LRRFNDLQATTLM; RRFNDLQATTLML; RFNDLQATTLMLA; FNDLQATTLMLAG; NDLQATTLMLAGN; DLQATTLMLAGNP; LQATTLMLAGNPA; QATTLMLAGNPAD; ATTLMLAGNPADS; TTLMLAGNPADSG; TLMLAGNPADSGK; LMLAGNPADSGKI; MLAGNPADSGKIR; LAGNPADSGKIRG; AGNPADSGKIRGE; GNPADSGKIRGER; NPADSGKIRGERF; PADSGKIRGERFA; ADSGKIRGERFAR; DSGKIRGERFARL; SGKIRGERFARLP; GKIRGERFARLPA; KIRGERFARLPAG; IRGERFARLPAGR; RGERFARLPAGRA; GERFARLPAGRAI; ERFARLPAGRAIL; RFARLPAGRAILL; FARLPAGRAILLT; ARLPAGRAILLTD; RLPAGRAILLTDS; LPAGRAILLTDSD; PAGRAILLTDSDS; AGRAILLTDSDSP; GRAILLTDSDSPT; RAILLTDSDSPTY; AILLTDSDSPTYV; ILLTDSDSPTYVQ; LLTDSDSPTYVQL; LTDSDSPTYVQLI; TDSDSPTYVQLIN; DSDSPTYVQLINP; SDSPTYVQLINPL; DSPTYVQLINPLV; SPTYVQLINPLVD; PTYVQLINPLVDA; TYVQLINPLVDAA; YVQLINPLVDAAA; VQLINPLVDAAAV; QLINPLVDAAAVS; LINPLVDAAAVSG; INPLVDAAAVSGE; NPLVDAAAVSGET; PLVDAAAVSGETQ; LVDAAAVSGETQQ; VDAAAVSGETQQK; DAAAVSGETQQKG; AAAVSGETQQKGS; AAVSGETQQKGSQ; AVSGETQQKGSQS;

14 mers:
MSRLIFEARRRLAP; SRLIFEARRRLAPP; RLIFEARRRLAPPS; LIFEARRRLAPPSS; IFEARRRLAPPSSH; FEARRRLAPPSSHQ; EARRRLAPPSSHQG; ARRRLAPPSSHQGT; RRRLAPPSSHQGTI; RRLAPPSSHQGTII; RLAPPSSHQGTIII; LAPPSSHQGTIIIE; APPSSHQGTIIIEA; PPSSHQGTIIIEAP; PSSHQGTIIIEAPP; SSHQGTIIIEAPPE; SHQGTIIIEAPPEL; HQGTIIIEAPPELP; QGTIIIEAPPELPR; GTIIIEAPPELPRV; TIIIEAPPELPRVI; IIIEAPPELPRVIP; IIEAPPELPRVIPP; IEAPPELPRVIPPS; EAPPELPRVIPPSL; APPELPRVIPPSLL; PPELPRVIPPSLLR; PELPRVIPPSLLRR; ELPRVIPPSLLRRA; LPRVIPPSLLRRAL; PRVIPPSLLRRALP; RVIPPSLLRRALPY; VIPPSLLRRALPYL; IPPSLLRRALPYLI; PPSLLRRALPYLIG; PSLLRRALPYLIGI; SLLRRALPYLIGIL; LLRRALPYLIGILI; LRRALPYLIGILIV; RRALPYLIGILIVG; RALPYLIGILIVGM; ALPYLIGILIVGMI; LPYLIGILIVGMIV; PYLIGILIVGMIVA; YLIGILIVGMIVAL; LIGILIVGMIVALV; IGILIVGMIVALVA; GILIVGMIVALVAT; ILIVGMIVALVATG; LIVGMIVALVATGM; IVGMIVALVATGMR; VGMIVALVATGMRV; GMIVALVATGMRVI; MIVALVATGMRVIS; IVALVATGMRVISP; VALVATGMRVISPQ; ALVATGMRVISPQT; LVATGMRVISPQTL; VATGMRVISPQTLF; ATGMRVISPQTLFF; TGMRVISPQTLFFP; GMRVISPQTLFFPF; MRVISPQTLFFPFV; RVISPQTLFFPFVL; VISPQTLFFPFVLL;

Fig. 29 continued

| | | |
|---|---|---|
| | ISPQTLFFPFVLLL; SPQTLFFPFVLLLA; PQTLFFPFVLLLAA; QTLFFPFVLLLAAT;<br>TLFFPFVLLLAATA; LFFPFVLLLAATAL; FFPFVLLLAATALY; FPFVLLLAATALYR;<br>PFVLLLAATALYRG; FVLLLAATALYRGN; VLLLAATALYRGND;<br>LLLAATALYRGNDK; LLAATALYRGNDKK; LAATALYRGNDKKM;<br>AATALYRGNDKKMR; ATALYRGNDKKMRT; TALYRGNDKKMRTE;<br>ALYRGNDKKMRTEE; LYRGNDKKMRTEEV; YRGNDKKMRTEEVD;<br>RGNDKKMRTEEVDA; GNDKKMRTEEVDAE; NDKKMRTEEVDAER;<br>DKKMRTEEVDAERA; KKMRTEEVDAERAD; KMRTEEVDAERADY;<br>MRTEEVDAERADYL; RTEEVDAERADYLR; TEEVDAERADYLRY;<br>EEVDAERADYLRYL; EVDAERADYLRYLS; VDAERADYLRYLSV;<br>DAERADYLRYLSVV; AERADYLRYLSVVR; ERADYLRYLSVVRD;<br>RADYLRYLSVVRDN; ADYLRYLSVVRDNI; DYLRYLSVVRDNIR;<br>YLRYLSVVRDNIRA; LRYLSVVRDNIRAQ; RYLSVVRDNIRAQA;<br>YLSVVRDNIRAQAA; LSVVRDNIRAQAAE; SVVRDNIRAQAAEQ;<br>VVRDNIRAQAAEQR; VRDNIRAQAAEQRA; RDNIRAQAAEQRAS;<br>DNIRAQAAEQRASA; NIRAQAAEQRASAL; IRAQAAEQRASALW;<br>RAQAAEQRASALWS; AQAAEQRASALWSH; QAAEQRASALWSHP;<br>AAEQRASALWSHPD; AEQRASALWSHPDP; EQRASALWSHPDPT;<br>QRASALWSHPDPTA; RASALWSHPDPTAL; ASALWSHPDPTALA;<br>SALWSHPDPTALAS; ALWSHPDPTALASV; LWSHPDPTALASVP;<br>WSHPDPTALASVPG; SHPDPTALASVPGS; HPDPTALASVPGSR;<br>PDPTALASVPGSRR; DPTALASVPGSRRQ; PTALASVPGSRRQW;<br>TALASVPGSRRQWE; ALASVPGSRRQWER; LASVPGSRRQWERD;<br>ASVPGSRRQWERDP; SVPGSRRQWERDPH; VPGSRRQWERDPHD;<br>PGSRRQWERDPHDP; GSRRQWERDPHDPD; SRRQWERDPHDPDF;<br>RRQWERDPHDPDFL; RQWERDPHDPDFLV; QWERDPHDPDFLVL;<br>WERDPHDPDFLVLR; ERDPHDPDFLVLRA; RDPHDPDFLVLRAG;<br>DPHDPDFLVLRAGR; PHDPDFLVLRAGRH; HDPDFLVLRAGRHT;<br>DPDFLVLRAGRHTV; PDFLVLRAGRHTVP; DFLVLRAGRHTVPL;<br>FLVLRAGRHTVPLA; LVLRAGRHTVPLAT; VLRAGRHTVPLATT;<br>LRAGRHTVPLATTL; RAGRHTVPLATTLR; AGRHTVPLATTLRV;<br>GRHTVPLATTLRVN; RHTVPLATTLRVND; HTVPLATTLRVNDT;<br>TVPLATTLRVNDTA; VPLATTLRVNDTAD; PLATTLRVNDTADE;<br>LATTLRVNDTADEI; ATTLRVNDTADEID; TTLRVNDTADEIDL;<br>TLRVNDTADEIDLE; LRVNDTADEIDLEP; RVNDTADEIDLEPV;<br>VNDTADEIDLEPVS; NDTADEIDLEPVSH; DTADEIDLEPVSHS;<br>TADEIDLEPVSHSA; ADEIDLEPVSHSAL; DEIDLEPVSHSALR;<br>EIDLEPVSHSALRS; IDLEPVSHSALRSL; DLEPVSHSALRSLL;<br>LEPVSHSALRSLLD; EPVSHSALRSLLDT; PVSHSALRSLLDTQ;<br>VSHSALRSLLDTQR; SHSALRSLLDTQRS; HSALRSLLDTQRSI;<br>SALRSLLDTQRSIG; ALRSLLDTQRSIGD; LRSLLDTQRSIGDV;<br>RSLLDTQRSIGDVP; SLLDTQRSIGDVPT; LLDTQRSIGDVPTG;<br>LDTQRSIGDVPTGI; DTQRSIGDVPTGID; TQRSIGDVPTGIDL;<br>QRSIGDVPTGIDLT; RSIGDVPTGIDLTK; SIGDVPTGIDLTKV; IGDVPTGIDLTKVS;<br>GDVPTGIDLTKVSP; DVPTGIDLTKVSPI; VPTGIDLTKVSPIT; PTGIDLTKVSPITV;<br>TGIDLTKVSPITVL; GIDLTKVSPITVLG; IDLTKVSPITVLGE; DLTKVSPITVLGER;<br>LTKVSPITVLGERA; TKVSPITVLGERAQ; KVSPITVLGERAQV;<br>VSPITVLGERAQVR; SPITVLGERAQVRA; PITVLGERAQVRAV;<br>ITVLGERAQVRAVL; TVLGERAQVRAVLR; VLGERAQVRAVLRA;<br>LGERAQVRAVLRAW; GERAQVRAVLRAWI; ERAQVRAVLRAWIA;<br>RAQVRAVLRAWIAQ; AQVRAVLRAWIAQA; QVRAVLRAWIAQAV;<br>VRAVLRAWIAQAVT; RAVLRAWIAQAVTW; AVLRAWIAQAVTWH;<br>VLRAWIAQAVTWHD; LRAWIAQAVTWHDP; RAWIAQAVTWHDPT; | |

Fig. 29 continued

| | | |
|---|---|---|
| | AWIAQAVTWHDPTV; WIAQAVTWHDPTVL; IAQAVTWHDPTVLG; AQAVTWHDPTVLGV; QAVTWHDPTVLGVA; AVTWHDPTVLGVAL; VTWHDPTVLGVALA; TWHDPTVLGVALAA; WHDPTVLGVALAAR; HDPTVLGVALAARD; DPTVLGVALAARDL; PTVLGVALAARDLE; TVLGVALAARDLEG; VLGVALAARDLEGR; LGVALAARDLEGRD; GVALAARDLEGRDW; VALAARDLEGRDWN; ALAARDLEGRDWNW; LAARDLEGRDWNWL; AARDLEGRDWNWLK; ARDLEGRDWNWLKW; RDLEGRDWNWLKWL; DLEGRDWNWLKWLP; LEGRDWNWLKWLPH; EGRDWNWLKWLPHV; GRDWNWLKWLPHVD; RDWNWLKWLPHVDI; DWNWLKWLPHVDIP; WNWLKWLPHVDIPG; NWLKWLPHVDIPGR; WLKWLPHVDIPGRL; LKWLPHVDIPGRLD; KWLPHVDIPGRLDA; WLPHVDIPGRLDAL; LPHVDIPGRLDALG; PHVDIPGRLDALGP; HVDIPGRLDALGPA; VDIPGRLDALGPAR; DIPGRLDALGPARN; IPGRLDALGPARNL; PGRLDALGPARNLS; GRLDALGPARNLST; RLDALGPARNLSTD; LDALGPARNLSTDP; DALGPARNLSTDPD; ALGPARNLSTDPDE; LGPARNLSTDPDEL; GPARNLSTDPDELI; PARNLSTDPDELIA; ARNLSTDPDELIAL; RNLSTDPDELIALL; NLSTDPDELIALLG; LSTDPDELIALLGP; STDPDELIALLGPV; TDPDELIALLGPVL; DPDELIALLGPVLA; PDELIALLGPVLAD; DELIALLGPVLADR; ELIALLGPVLADRP; LIALLGPVLADRPA; IALLGPVLADRPAF; ALLGPVLADRPAFT; LLGPVLADRPAFTG; LGPVLADRPAFTGQ; GPVLADRPAFTGQP; PVLADRPAFTGQPT; VLADRPAFTGQPTD; LADRPAFTGQPTDA; ADRPAFTGQPTDAL; DRPAFTGQPTDALR; RPAFTGQPTDALRH; PAFTGQPTDALRHL; AFTGQPTDALRHLL; FTGQPTDALRHLLI; TGQPTDALRHLLIV; GQPTDALRHLLIVV; QPTDALRHLLIVVD; PTDALRHLLIVVDD; TDALRHLLIVVDDP; DALRHLLIVVDDPD; ALRHLLIVVDDPDY; LRHLLIVVDDPDYD; RHLLIVVDDPDYDL; HLLIVVDDPDYDLG; LLIVVDDPDYDLGA; LIVVDDPDYDLGAS; IVVDDPDYDLGASP; VVDDPDYDLGASPL; VDDPDYDLGASPLA; DDPDYDLGASPLAV; DPDYDLGASPLAVG; PDYDLGASPLAVGR; DYDLGASPLAVGRA; YDLGASPLAVGRAG; DLGASPLAVGRAGV; LGASPLAVGRAGVT; GASPLAVGRAGVTV; ASPLAVGRAGVTVV; SPLAVGRAGVTVVH; PLAVGRAGVTVVHC; LAVGRAGVTVVHCS; AVGRAGVTVVHCSA; VGRAGVTVVHCSAS; GRAGVTVVHCSASA; RAGVTVVHCSASAP; AGVTVVHCSASAPH; GVTVVHCSASAPHR; VTVVHCSASAPHRE; TVVHCSASAPHREQ; VVHCSASAPHREQY; VHCSASAPHREQYS; HCSASAPHREQYSD; CSASAPHREQYSDP; SASAPHREQYSDPE; ASAPHREQYSDPEK; SAPHREQYSDPEKP; APHREQYSDPEKPI; PHREQYSDPEKPIL; HREQYSDPEKPILR; REQYSDPEKPILRV; EQYSDPEKPILRVA; QYSDPEKPILRVAH; YSDPEKPILRVAHG; SDPEKPILRVAHGA; DPEKPILRVAHGAI; PEKPILRVAHGAIE; EKPILRVAHGAIER; KPILRVAHGAIERW; PILRVAHGAIERWQ; ILRVAHGAIERWQT; LRVAHGAIERWQTG; RVAHGAIERWQTGG; VAHGAIERWQTGGW; AHGAIERWQTGGWQ; HGAIERWQTGGWQP; GAIERWQTGGWQPY; AIERWQTGGWQPYI; IERWQTGGWQPYID; ERWQTGGWQPYIDA; RWQTGGWQPYIDAA; WQTGGWQPYIDAAD; QTGGWQPYIDAADQ; TGGWQPYIDAADQF; GGWQPYIDAADQFS; GWQPYIDAADQFSA; WQPYIDAADQFSAD; QPYIDAADQFSADE; PYIDAADQFSADEA; YIDAADQFSADEAA; IDAADQFSADEAAH; DAADQFSADEAAHL; AADQFSADEAAHLA; ADQFSADEAAHLAR; DQFSADEAAHLARR; QFSADEAAHLARRL; FSADEAAHLARRLS; SADEAAHLARRLSR; ADEAAHLARRLSRW; DEAAHLARRLSRWD; EAAHLARRLSRWDS; AAHLARRLSRWDSN; AHLARRLSRWDSNP; HLARRLSRWDSNPT; | |

Fig. 29 continued

| | | | |
|---|---|---|---|
| | LARRLSRWDSNPTH; ARRLSRWDSNPTHA; RRLSRWDSNPTHAG; RLSRWDSNPTHAGL; LSRWDSNPTHAGLR; SRWDSNPTHAGLRS; RWDSNPTHAGLRSA; WDSNPTHAGLRSAA; DSNPTHAGLRSAAT; SNPTHAGLRSAATR; NPTHAGLRSAATRG; PTHAGLRSAATRGA; THAGLRSAATRGAS; HAGLRSAATRGASF; AGLRSAATRGASFT; GLRSAATRGASFTT; LRSAATRGASFTTL; RSAATRGASFTTLL; SAATRGASFTTLLG; AATRGASFTTLLGI; ATRGASFTTLLGIE; TRGASFTTLLGIED; RGASFTTLLGIEDA; GASFTTLLGIEDAS; ASFTTLLGIEDASR; SFTTLLGIEDASRL; FTTLLGIEDASRLD; TTLLGIEDASRLDV; TLLGIEDASRLDVP; LLGIEDASRLDVPA; LGIEDASRLDVPAL; GIEDASRLDVPALW; IEDASRLDVPALWA; EDASRLDVPALWAP; DASRLDVPALWAPR; ASRLDVPALWAPRR; SRLDVPALWAPRRR; RLDVPALWAPRRRD; LDVPALWAPRRRDE; DVPALWAPRRRDEE; VPALWAPRRRDEEL; PALWAPRRRDEELR; ALWAPRRRDEELRV; LWAPRRRDEELRVP; WAPRRRDEELRVPI; APRRRDEELRVPIG; PRRRDEELRVPIGV; RRRDEELRVPIGVT; RRDEELRVPIGVTG; RDEELRVPIGVTGT; DEELRVPIGVTGTG; EELRVPIGVTGTGE; ELRVPIGVTGTGEP; LRVPIGVTGTGEPL; RVPIGVTGTGEPLM; VPIGVTGTGEPLMF; PIGVTGTGEPLMFD; IGVTGTGEPLMFDL; GVTGTGEPLMFDLK; VTGTGEPLMFDLKD; TGTGEPLMFDLKDE; GTGEPLMFDLKDEA; TGEPLMFDLKDEAE; GEPLMFDLKDEAEG; EPLMFDLKDEAEGG; PLMFDLKDEAEGGM; LMFDLKDEAEGGMG; MFDLKDEAEGGMGP; FDLKDEAEGGMGPH; DLKDEAEGGMGPHG; LKDEAEGGMGPHGL; KDEAEGGMGPHGLM; DEAEGGMGPHGLMI; EAEGGMGPHGLMIG; AEGGMGPHGLMIGM; EGGMGPHGLMIGMT; GGMGPHGLMIGMTG; GMGPHGLMIGMTGS; MGPHGLMIGMTGSG; GPHGLMIGMTGSGK; PHGLMIGMTGSGKS; HGLMIGMTGSGKSQ; GLMIGMTGSGKSQT; LMIGMTGSGKSQTL; MIGMTGSGKSQTLM; IGMTGSGKSQTLMS; GMTGSGKSQTLMSI; MTGSGKSQTLMSIL; TGSGKSQTLMSILL; GSGKSQTLMSILLS; SGKSQTLMSILLSL; GKSQTLMSILLSLL; KSQTLMSILLSLLT; SQTLMSILLSLLTT; QTLMSILLSLLTTH; TLMSILLSLLTTHS; LMSILLSLLTTHSA; MSILLSLLTTHSAE; SILLSLLTTHSAER; ILLSLLTTHSAERL; LLSLLTTHSAERLI; LSLLTTHSAERLIV; SLLTTHSAERLIVI; LLTTHSAERLIVIY; LTTHSAERLIVIYA; TTHSAERLIVIYAD; THSAERLIVIYADF; HSAERLIVIYADFK; SAERLIVIYADFKG; AERLIVIYADFKGE; ERLIVIYADFKGEA; RLIVIYADFKGEAG; LIVIYADFKGEAGA; IVIYADFKGEAGAD; VIYADFKGEAGADS; IYADFKGEAGADSF; YADFKGEAGADSFR; ADFKGEAGADSFRD; DFKGEAGADSFRDF; FKGEAGADSFRDFP; KGEAGADSFRDFPQ; GEAGADSFRDFPQV; EAGADSFRDFPQVV; AGADSFRDFPQVVA; GADSFRDFPQVVAV; ADSFRDFPQVVAVI; DSFRDFPQVVAVIS; SFRDFPQVVAVISN; FRDFPQVVAVISNM; RDFPQVVAVISNMA; DFPQVVAVISNMAE; FPQVVAVISNMAEK; PQVVAVISNMAEKK; QVVAVISNMAEKKS; VVAVISNMAEKKSL; VAVISNMAEKKSLA; AVISNMAEKKSLAD; VISNMAEKKSLADR; ISNMAEKKSLADRF; SNMAEKKSLADRFA; NMAEKKSLADRFAD; MAEKKSLADRFADT; AEKKSLADRFADTL; EKKSLADRFADTLR; KKSLADRFADTLRG; KSLADRFADTLRGE; SLADRFADTLRGEV; LADRFADTLRGEVA; ADRFADTLRGEVAR; DRFADTLRGEVARR; RFADTLRGEVARRE; FADTLRGEVARREM; ADTLRGEVARREML; DTLRGEVARREMLL; TLRGEVARREMLLR; LRGEVARREMLLRE; RGEVARREMLLREA; GEVARREMLLREAG; EVARREMLLREAGR; VARREMLLREAGRK; ARREMLLREAGRKV; RREMLLREAGRKVQ; REMLLREAGRKVQG; EMLLREAGRKVQGS; MLLREAGRKVQGSA; LLREAGRKVQGSAF; LREAGRKVQGSAFN; | |

Fig. 29 continued

| | | | |
|---|---|---|---|
| | REAGRKVQGSAFNS; EAGRKVQGSAFNSV; AGRKVQGSAFNSVL; GRKVQGSAFNSVLE; RKVQGSAFNSVLEY; KVQGSAFNSVLEYE; VQGSAFNSVLEYEN; QGSAFNSVLEYENA; GSAFNSVLEYENAI; SAFNSVLEYENAIA; AFNSVLEYENAIAA; FNSVLEYENAIAAG; NSVLEYENAIAAGH; SVLEYENAIAAGHS; VLEYENAIAAGHSL; LEYENAIAAGHSLP; EYENAIAAGHSLPP; YENAIAAGHSLPPI; ENAIAAGHSLPPIP; NAIAAGHSLPPIPT; AIAAGHSLPPIPTL; IAAGHSLPPIPTLF; AAGHSLPPIPTLFV; AGHSLPPIPTLFVV; GHSLPPIPTLFVVA; HSLPPIPTLFVVAD; SLPPIPTLFVVADE; LPPIPTLFVVADEF; PPIPTLFVVADEFT; PIPTLFVVADEFTL; IPTLFVVADEFTLM; PTLFVVADEFTLML; TLFVVADEFTLMLA; LFVVADEFTLMLAD; FVVADEFTLMLADH; VVADEFTLMLADHP; VADEFTLMLADHPE; ADEFTLMLADHPEY; DEFTLMLADHPEYA; EFTLMLADHPEYAE; FTLMLADHPEYAEL; TLMLADHPEYAELF; LMLADHPEYAELFD; MLADHPEYAELFDY; LADHPEYAELFDYV; ADHPEYAELFDYVA; DHPEYAELFDYVAR; HPEYAELFDYVARK; PEYAELFDYVARKG; EYAELFDYVARKGR; YAELFDYVARKGRS; AELFDYVARKGRSF; ELFDYVARKGRSFR; LFDYVARKGRSFRI; FDYVARKGRSFRIH; DYVARKGRSFRIHI; YVARKGRSFRIHIL; VARKGRSFRIHILF; ARKGRSFRIHILFA; RKGRSFRIHILFAS; KGRSFRIHILFASQ; GRSFRIHILFASQT; RSFRIHILFASQTL; SFRIHILFASQTLD; FRIHILFASQTLDV; RIHILFASQTLDVG; IHILFASQTLDVGK; HILFASQTLDVGKI; ILFASQTLDVGKIK; LFASQTLDVGKIKD; FASQTLDVGKIKDI; ASQTLDVGKIKDID; SQTLDVGKIKDIDK; QTLDVGKIKDIDKN; TLDVGKIKDIDKNT; LDVGKIKDIDKNTA; DVGKIKDIDKNTAY; VGKIKDIDKNTAYR; GKIKDIDKNTAYRI; KIKDIDKNTAYRIG; IKDIDKNTAYRIGL; KDIDKNTAYRIGLK; DIDKNTAYRIGLKV; IDKNTAYRIGLKVA; DKNTAYRIGLKVAS; KNTAYRIGLKVASP; NTAYRIGLKVASPS; TAYRIGLKVASPSV; AYRIGLKVASPSVS; YRIGLKVASPSVSR; RIGLKVASPSVSRQ; IGLKVASPSVSRQI; GLKVASPSVSRQII; LKVASPSVSRQIIG; KVASPSVSRQIIGV; VASPSVSRQIIGVE; ASPSVSRQIIGVED; SPSVSRQIIGVEDA; PSVSRQIIGVEDAY; SVSRQIIGVEDAYH; VSRQIIGVEDAYHI; SRQIIGVEDAYHIE; RQIIGVEDAYHIES; QIIGVEDAYHIESG; IIGVEDAYHIESGK; IGVEDAYHIESGKE; GVEDAYHIESGKEH; VEDAYHIESGKEHK; EDAYHIESGKEHKG; DAYHIESGKEHKGV; AYHIESGKEHKGVG; YHIESGKEHKGVGF; HIESGKEHKGVGFL; IESGKEHKGVGFLV; ESGKEHKGVGFLVP; SGKEHKGVGFLVPA; GKEHKGVGFLVPAP; KEHKGVGFLVPAPG; EHKGVGFLVPAPGA; HKGVGFLVPAPGAT; KGVGFLVPAPGATP; GVGFLVPAPGATPI; VGFLVPAPGATPIR; GFLVPAPGATPIRF; FLVPAPGATPIRFR; LVPAPGATPIRFRS; VPAPGATPIRFRST; PAPGATPIRFRSTY; APGATPIRFRSTYV; PGATPIRFRSTYVD; GATPIRFRSTYVDG; ATPIRFRSTYVDGI; TPIRFRSTYVDGIY; PIRFRSTYVDGIYE; IRFRSTYVDGIYEP; RFRSTYVDGIYEPP; FRSTYVDGIYEPPQ; RSTYVDGIYEPPQT; STYVDGIYEPPQTA; TYVDGIYEPPQTAK; YVDGIYEPPQTAKA; VDGIYEPPQTAKAV; DGIYEPPQTAKAVV; GIYEPPQTAKAVVV; IYEPPQTAKAVVVQ; YEPPQTAKAVVVQS; EPPQTAKAVVVQSV; PPQTAKAVVVQSVP; PQTAKAVVVQSVPE; QTAKAVVVQSVPEP; TAKAVVVQSVPEPK; AKAVVVQSVPEPKL; KAVVVQSVPEPKLF; AVVVQSVPEPKLFT; VVVQSVPEPKLFTA; VVQSVPEPKLFTAA; VQSVPEPKLFTAAA; QSVPEPKLFTAAAV; SVPEPKLFTAAAVE; VPEPKLFTAAAVEP; PEPKLFTAAAVEPD; EPKLFTAAAVEPDP; PKLFTAAAVEPDPG; KLFTAAAVEPDPGT; LFTAAAVEPDPGTV; FTAAAVEPDPGTVI; TAAAVEPDPGTVIA; AAAVEPDPGTVIAD; AAVEPDPGTVIADT; AVEPDPGTVIADTD; VEPDPGTVIADTDE; EPDPGTVIADTDEQ; PDPGTVIADTDEQE; DPGTVIADTDEQEP; | |

Fig. 29 continued

| | | |
|---|---|---|
| | PGTVIADTDEQEPA; GTVIADTDEQEPAD; TVIADTDEQEPADP; VIADTDEQEPADPP; IADTDEQEPADPPR; ADTDEQEPADPPRK; DTDEQEPADPPRKL; TDEQEPADPPRKLI; DEQEPADPPRKLIA; EQEPADPPRKLIAT; QEPADPPRKLIATI; EPADPPRKLIATIG; PADPPRKLIATIGE; ADPPRKLIATIGEQ; DPPRKLIATIGEQL; PPRKLIATIGEQLA; PRKLIATIGEQLAR; RKLIATIGEQLARY; KLIATIGEQLARYG; LIATIGEQLARYGP; IATIGEQLARYGPR; ATIGEQLARYGPRA; TIGEQLARYGPRAP; IGEQLARYGPRAPQ; GEQLARYGPRAPQL; EQLARYGPRAPQLW; QLARYGPRAPQLWL; LARYGPRAPQLWLP; ARYGPRAPQLWLPP; RYGPRAPQLWLPPL; YGPRAPQLWLPPLD; GPRAPQLWLPPLDE; PRAPQLWLPPLDET; RAPQLWLPPLDETI; APQLWLPPLDETIP; PQLWLPPLDETIPL; QLWLPPLDETIPLS; LWLPPLDETIPLSA; WLPPLDETIPLSAA; LPPLDETIPLSAAL; PPLDETIPLSAALA; PLDETIPLSAALAR; LDETIPLSAALARA; DETIPLSAALARAG; ETIPLSAALARAGV; TIPLSAALARAGVG; IPLSAALARAGVGP; PLSAALARAGVGPR; LSAALARAGVGPRQ; SAALARAGVGPRQW; AALARAGVGPRQWR; ALARAGVGPRQWRW; LARAGVGPRQWRWP; ARAGVGPRQWRWPL; RAGVGPRQWRWPLG; AGVGPRQWRWPLGE; GVGPRQWRWPLGEI; VGPRQWRWPLGEID; GPRQWRWPLGEIDR; PRQWRWPLGEIDRP; RQWRWPLGEIDRPF; QWRWPLGEIDRPFE; WRWPLGEIDRPFEM; RWPLGEIDRPFEMR; WPLGEIDRPFEMRR; PLGEIDRPFEMRRD; LGEIDRPFEMRRDP; GEIDRPFEMRRDPL; EIDRPFEMRRDPLV; IDRPFEMRRDPLVF; DRPFEMRRDPLVFD; RPFEMRRDPLVFDA; PFEMRRDPLVFDAR; FEMRRDPLVFDARS; EMRRDPLVFDARSS; MRRDPLVFDARSSA; RRDPLVFDARSSAG; RDPLVFDARSSAGN; DPLVFDARSSAGNM; PLVFDARSSAGNMV; LVFDARSSAGNMVI; VFDARSSAGNMVIH; FDARSSAGNMVIHG; DARSSAGNMVIHGG; ARSSAGNMVIHGGP; RSSAGNMVIHGGPK; SSAGNMVIHGGPKS; SAGNMVIHGGPKSG; AGNMVIHGGPKSGK; GNMVIHGGPKSGKS; NMVIHGGPKSGKST; MVIHGGPKSGKSTA; VIHGGPKSGKSTAL; IHGGPKSGKSTALQ; HGGPKSGKSTALQT; GGPKSGKSTALQTF; GPKSGKSTALQTFI; PKSGKSTALQTFIL; KSGKSTALQTFILS; SGKSTALQTFILSA; GKSTALQTFILSAA; KSTALQTFILSAAS; STALQTFILSAASL; TALQTFILSAASLH; ALQTFILSAASLHS; LQTFILSAASLHSP; QTFILSAASLHSPH; TFILSAASLHSPHE; FILSAASLHSPHEV; ILSAASLHSPHEVS; LSAASLHSPHEVSF; SAASLHSPHEVSFY; AASLHSPHEVSFYC; ASLHSPHEVSFYCL; SLHSPHEVSFYCLD; LHSPHEVSFYCLDY; HSPHEVSFYCLDYG; SPHEVSFYCLDYGG; PHEVSFYCLDYGGG; HEVSFYCLDYGGGQ; EVSFYCLDYGGGQL; VSFYCLDYGGGQLR; SFYCLDYGGGQLRA; FYCLDYGGGQLRAL; YCLDYGGGQLRALQ; CLDYGGGQLRALQD; LDYGGGQLRALQDL; DYGGGQLRALQDLA; YGGGQLRALQDLAH; GGGQLRALQDLAHV; GGQLRALQDLAHVG; GQLRALQDLAHVGS; QLRALQDLAHVGSV; LRALQDLAHVGSVA; RALQDLAHVGSVAS; ALQDLAHVGSVASA; LQDLAHVGSVASAL; QDLAHVGSVASALE; DLAHVGSVASALEP; LAHVGSVASALEPE; AHVGSVASALEPER; HVGSVASALEPERI; VGSVASALEPERIR; GSVASALEPERIRR; SVASALEPERIRRT; VASALEPERIRRTF; ASALEPERIRRTFG; SALEPERIRRTFGE; ALEPERIRRTFGEL; LEPERIRRTFGELE; EPERIRRTFGELEQ; PERIRRTFGELEQL; ERIRRTFGELEQLL; RIRRTFGELEQLLL; IRRTFGELEQLLLS; RRTFGELEQLLLSR; RTFGELEQLLLSRQ; TFGELEQLLLSRQQ; FGELEQLLLSRQQR; GELEQLLLSRQQRE; ELEQLLLSRQQREV; LEQLLLSRQQREVF; EQLLLSRQQREVFR; QLLLSRQQREVFRD; LLLSRQQREVFRDR; LLSRQQREVFRDRG; LSRQQREVFRDRGA; | |

Fig. 29 continued

| | | |
|---|---|---|
| | SRQQREVFRDRGAN; RQQREVFRDRGANG; QQREVFRDRGANGS; QREVFRDRGANGST; REVFRDRGANGSTP; EVFRDRGANGSTPD; VFRDRGANGSTPDD; FRDRGANGSTPDDG; RDRGANGSTPDDGF; DRGANGSTPDDGFG; RGANGSTPDDGFGE; GANGSTPDDGFGEV; ANGSTPDDGFGEVF; NGSTPDDGFGEVFL; GSTPDDGFGEVFLV; STPDDGFGEVFLVI; TPDDGFGEVFLVID; PDDGFGEVFLVIDN; DDGFGEVFLVIDNL; DGFGEVFLVIDNLY; GFGEVFLVIDNLYG; FGEVFLVIDNLYGF; GEVFLVIDNLYGFG; EVFLVIDNLYGFGR; VFLVIDNLYGFGRD; FLVIDNLYGFGRDN; LVIDNLYGFGRDNT; VIDNLYGFGRDNTD; IDNLYGFGRDNTDQ; DNLYGFGRDNTDQF; NLYGFGRDNTDQFN; LYGFGRDNTDQFNT; YGFGRDNTDQFNTR; GFGRDNTDQFNTRN; FGRDNTDQFNTRNP; GRDNTDQFNTRNPL; RDNTDQFNTRNPLL; DNTDQFNTRNPLLA; NTDQFNTRNPLLAR; TDQFNTRNPLLARV; DQFNTRNPLLARVT; QFNTRNPLLARVTE; FNTRNPLLARVTEL; NTRNPLLARVTELV; TRNPLLARVTELVN; RNPLLARVTELVNV; NPLLARVTELVNVG; PLLARVTELVNVGL; LLARVTELVNVGLA; LARVTELVNVGLAY; ARVTELVNVGLAYG; RVTELVNVGLAYGI; VTELVNVGLAYGIH; TELVNVGLAYGIHV; ELVNVGLAYGIHVI; LVNVGLAYGIHVII; VNVGLAYGIHVIIT; NVGLAYGIHVIITT; VGLAYGIHVIITTP; GLAYGIHVIITTPS; LAYGIHVIITTPSW; AYGIHVIITTPSWL; YGIHVIITTPSWLE; GIHVIITTPSWLEV; IHVIITTPSWLEVP; HVIITTPSWLEVPL; VIITTPSWLEVPLA; IITTPSWLEVPLAM; ITTPSWLEVPLAMR; TTPSWLEVPLAMRD; TPSWLEVPLAMRDG; PSWLEVPLAMRDGL; SWLEVPLAMRDGLG; WLEVPLAMRDGLGL; LEVPLAMRDGLGLR; EVPLAMRDGLGLRL; VPLAMRDGLGLRLE; PLAMRDGLGLRLEL; LAMRDGLGLRLELR; AMRDGLGLRLELRL; MRDGLGLRLELRLH; RDGLGLRLELRLHD; DGLGLRLELRLHDA; GLGLRLELRLHDAR; LGLRLELRLHDARD; GLRLELRLHDARDS; LRLELRLHDARDSN; RLELRLHDARDSNV; LELRLHDARDSNVR; ELRLHDARDSNVRV; LRLHDARDSNVRVV; RLHDARDSNVRVVG; LHDARDSNVRVVGA; HDARDSNVRVVGAL; DARDSNVRVVGALR; ARDSNVRVVGALRR; RDSNVRVVGALRRP; DSNVRVVGALRRPA; SNVRVVGALRRPAD; NVRVVGALRRPADA; VRVVGALRRPADAV; RVVGALRRPADAVP; VVGALRRPADAVPH; VGALRRPADAVPHD; GALRRPADAVPHDQ; ALRRPADAVPHDQP; LRRPADAVPHDQPG; RRPADAVPHDQPGR; RPADAVPHDQPGRG; PADAVPHDQPGRGL; ADAVPHDQPGRGLT; DAVPHDQPGRGLTM; AVPHDQPGRGLTMA; VPHDQPGRGLTMAA; PHDQPGRGLTMAAE; HDQPGRGLTMAAEH; DQPGRGLTMAAEHF; QPGRGLTMAAEHFL; PGRGLTMAAEHFLF; GRGLTMAAEHFLFA; RGLTMAAEHFLFAA; GLTMAAEHFLFAAP; LTMAAEHFLFAAPE; TMAAEHFLFAAPEL; MAAEHFLFAAPELD; AAEHFLFAAPELDA; AEHFLFAAPELDAQ; EHFLFAAPELDAQT; HFLFAAPELDAQTN; FLFAAPELDAQTNP; LFAAPELDAQTNPV; FAAPELDAQTNPVA; AAPELDAQTNPVAA; APELDAQTNPVAAI; PELDAQTNPVAAIN; ELDAQTNPVAAINA; LDAQTNPVAAINAR; DAQTNPVAAINARY; AQTNPVAAINARYP; QTNPVAAINARYPG; TNPVAAINARYPGM; NPVAAINARYPGMA; PVAAINARYPGMAA; VAAINARYPGMAAP; AAINARYPGMAAPP; AINARYPGMAAPPV; INARYPGMAAPPVR; NARYPGMAAPPVRL; ARYPGMAAPPVRLL; RYPGMAAPPVRLLP; YPGMAAPPVRLLPT; PGMAAPPVRLLPTN; GMAAPPVRLLPTNL; MAAPPVRLLPTNLA; AAPPVRLLPTNLAP; APPVRLLPTNLAPH; PPVRLLPTNLAPHA; PVRLLPTNLAPHAV; VRLLPTNLAPHAVG; RLLPTNLAPHAVGE; LLPTNLAPHAVGEL; LPTNLAPHAVGELY; | |

Fig. 29 continued

| | | | |
|---|---|---|---|
| | PTNLAPHAVGELYR; TNLAPHAVGELYRG; NLAPHAVGELYRGP;<br>LAPHAVGELYRGPD; APHAVGELYRGPDQ; PHAVGELYRGPDQL;<br>HAVGELYRGPDQLV; AVGELYRGPDQLVI; VGELYRGPDQLVIG;<br>GELYRGPDQLVIGQ; ELYRGPDQLVIGQR; LYRGPDQLVIGQRE;<br>YRGPDQLVIGQREE; RGPDQLVIGQREED; GPDQLVIGQREEDL;<br>PDQLVIGQREEDLA; DQLVIGQREEDLAP; QLVIGQREEDLAPV;<br>LVIGQREEDLAPVI; VIGQREEDLAPVIL; IGQREEDLAPVILD; GQREEDLAPVILDL;<br>QREEDLAPVILDLA; REEDLAPVILDLAA; EEDLAPVILDLAAN; EDLAPVILDLAANP;<br>DLAPVILDLAANPL; LAPVILDLAANPLL; APVILDLAANPLLM; PVILDLAANPLLMV;<br>VILDLAANPLLMVF; ILDLAANPLLMVFG; LDLAANPLLMVFGD;<br>DLAANPLLMVFGDA; LAANPLLMVFGDAR; AANPLLMVFGDARS;<br>ANPLLMVFGDARSG; NPLLMVFGDARSGK; PLLMVFGDARSGKT;<br>LLMVFGDARSGKTT; LMVFGDARSGKTTL; MVFGDARSGKTTLL;<br>VFGDARSGKTTLLR; FGDARSGKTTLLRH; GDARSGKTTLLRHI;<br>DARSGKTTLLRHII; ARSGKTTLLRHIIR; RSGKTTLLRHIIRT; SGKTTLLRHIIRTV;<br>GKTTLLRHIIRTVR; KTTLLRHIIRTVRE; TTLLRHIIRTVREH; TLLRHIIRTVREHS;<br>LLRHIIRTVREHST; LRHIIRTVREHSTA; RHIIRTVREHSTAD; HIIRTVREHSTADR;<br>IIRTVREHSTADRV; IRTVREHSTADRVA; RTVREHSTADRVAF;<br>TVREHSTADRVAFT; VREHSTADRVAFTV; REHSTADRVAFTVL;<br>EHSTADRVAFTVLD; HSTADRVAFTVLDR; STADRVAFTVLDRR;<br>TADRVAFTVLDRRL; ADRVAFTVLDRRLH; DRVAFTVLDRRLHL;<br>RVAFTVLDRRLHLV; VAFTVLDRRLHLVD; AFTVLDRRLHLVDE;<br>FTVLDRRLHLVDEP; TVLDRRLHLVDEPL; VLDRRLHLVDEPLF;<br>LDRRLHLVDEPLFP; DRRLHLVDEPLFPD; RRLHLVDEPLFPDN;<br>RLHLVDEPLFPDNE; LHLVDEPLFPDNEY; HLVDEPLFPDNEYT;<br>LVDEPLFPDNEYTA; VDEPLFPDNEYTAN; DEPLFPDNEYTANI;<br>EPLFPDNEYTANID; PLFPDNEYTANIDR; LFPDNEYTANIDRI; FPDNEYTANIDRII;<br>PDNEYTANIDRIIP; DNEYTANIDRIIPA; NEYTANIDRIIPAM; EYTANIDRIIPAML;<br>YTANIDRIIPAMLG; TANIDRIIPAMLGL; ANIDRIIPAMLGLA; NIDRIIPAMLGLAN;<br>IDRIIPAMLGLANL; DRIIPAMLGLANLI; RIIPAMLGLANLIE; IIPAMLGLANLIEA;<br>IPAMLGLANLIEAR; PAMLGLANLIEARR; AMLGLANLIEARRP;<br>MLGLANLIEARRPP; LGLANLIEARRPPA; GLANLIEARRPPAG;<br>LANLIEARRPPAGM; ANLIEARRPPAGMS; NLIEARRPPAGMSA;<br>LIEARRPPAGMSAA; IEARRPPAGMSAAE; EARRPPAGMSAAEL;<br>ARRPPAGMSAAELS; RRPPAGMSAAELSR; RPPAGMSAAELSRW;<br>PPAGMSAAELSRWT; PAGMSAAELSRWTF; AGMSAAELSRWTFA;<br>GMSAAELSRWTFAG; MSAAELSRWTFAGH; SAAELSRWTFAGHT;<br>AAELSRWTFAGHTH; AELSRWTFAGHTHY; ELSRWTFAGHTHYL;<br>LSRWTFAGHTHYLI; SRWTFAGHTHYLII; RWTFAGHTHYLIID;<br>WTFAGHTHYLIIDD; TFAGHTHYLIIDDV; FAGHTHYLIIDDVD; AGHTHYLIIDDVDQ;<br>GHTHYLIIDDVDQV; HTHYLIIDDVDQVP; THYLIIDDVDQVPD; HYLIIDDVDQVPDS;<br>YLIIDDVDQVPDSP; LIIDDVDQVPDSPA; IIDDVDQVPDSPAM;<br>IDDVDQVPDSPAMT; DDVDQVPDSPAMTG; DVDQVPDSPAMTGP;<br>VDQVPDSPAMTGPY; DQVPDSPAMTGPYI; QVPDSPAMTGPYIG;<br>VPDSPAMTGPYIGQ; PDSPAMTGPYIGQR; DSPAMTGPYIGQRP;<br>SPAMTGPYIGQRPW; PAMTGPYIGQRPWT; AMTGPYIGQRPWTP;<br>MTGPYIGQRPWTPL; TGPYIGQRPWTPLI; GPYIGQRPWTPLIG;<br>PYIGQRPWTPLIGL; YIGQRPWTPLIGLL; IGQRPWTPLIGLLA;<br>GQRPWTPLIGLLAQ; QRPWTPLIGLLAQA; RPWTPLIGLLAQAG;<br>PWTPLIGLLAQAGD; WTPLIGLLAQAGDL; TPLIGLLAQAGDLG;<br>PLIGLLAQAGDLGL; LIGLLAQAGDLGLR; IGLLAQAGDLGLRV;<br>GLLAQAGDLGLRVI; LLAQAGDLGLRVIV; LAQAGDLGLRVIVT;<br>AQAGDLGLRVIVTG; QAGDLGLRVIVTGR; AGDLGLRVIVTGRA; | | |

Fig. 29 continued

GDLGLRVIVTGRAT; DLGLRVIVTGRATG; LGLRVIVTGRATGS;
GLRVIVTGRATGSA; LRVIVTGRATGSAH; RVIVTGRATGSAHL;
VIVTGRATGSAHLL; IVTGRATGSAHLLM; VTGRATGSAHLLMT;
TGRATGSAHLLMTS; GRATGSAHLLMTSP; RATGSAHLLMTSPL;
ATGSAHLLMTSPLL; TGSAHLLMTSPLLR; GSAHLLMTSPLLRR;
SAHLLMTSPLLRRF; AHLLMTSPLLRRFN; HLLMTSPLLRRFND;
LLMTSPLLRRFNDL; LMTSPLLRRFNDLQ; MTSPLLRRFNDLQA;
TSPLLRRFNDLQAT; SPLLRRFNDLQATT; PLLRRFNDLQATTL;
LLRRFNDLQATTLM; LRRFNDLQATTLML; RRFNDLQATTLMLA;
RFNDLQATTLMLAG; FNDLQATTLMLAGN; NDLQATTLMLAGNP;
DLQATTLMLAGNPA; LQATTLMLAGNPAD; QATTLMLAGNPADS;
ATTLMLAGNPADSG; TTLMLAGNPADSGK; TLMLAGNPADSGKI;
LMLAGNPADSGKIR; MLAGNPADSGKIRG; LAGNPADSGKIRGE;
AGNPADSGKIRGER; GNPADSGKIRGERF; NPADSGKIRGERFA;
PADSGKIRGERFAR; ADSGKIRGERFARL; DSGKIRGERFARLP;
SGKIRGERFARLPA; GKIRGERFARLPAG; KIRGERFARLPAGR;
IRGERFARLPAGRA; RGERFARLPAGRAI; GERFARLPAGRAIL;
ERFARLPAGRAILL; RFARLPAGRAILLT; FARLPAGRAILLTD; ARLPAGRAILLTDS;
RLPAGRAILLTDSD; LPAGRAILLTDSDS; PAGRAILLTDSDSP;
AGRAILLTDSDSPT; GRAILLTDSDSPTY; RAILLTDSDSPTYV; AILLTDSDSPTYVQ;
ILLTDSDSPTYVQL; LLTDSDSPTYVQLI; LTDSDSPTYVQLIN; TDSDSPTYVQLINP;
DSDSPTYVQLINPL; SDSPTYVQLINPLV; DSPTYVQLINPLVD;
SPTYVQLINPLVDA; PTYVQLINPLVDAA; TYVQLINPLVDAAA;
YVQLINPLVDAAAV; VQLINPLVDAAAVS; QLINPLVDAAAVSG;
LINPLVDAAAVSGE; INPLVDAAAVSGET; NPLVDAAAVSGETQ;
PLVDAAAVSGETQQ; LVDAAAVSGETQQK; VDAAAVSGETQQKG;
DAAAVSGETQQKGS; AAAVSGETQQKGSQ; AAVSGETQQKGSQS;

15 mers:
MSRLIFEARRRLAPP; SRLIFEARRRLAPPS; RLIFEARRRLAPPSS;
LIFEARRRLAPPSSH; IFEARRRLAPPSSHQ; FEARRRLAPPSSHQG;
EARRRLAPPSSHQGT; ARRRLAPPSSHQGTI; RRRLAPPSSHQGTII;
RRLAPPSSHQGTIII; RLAPPSSHQGTIIIE; LAPPSSHQGTIIIEA;
APPSSHQGTIIIEAP; PPSSHQGTIIIEAPP; PSSHQGTIIIEAPPE;
SSHQGTIIIEAPPEL; SHQGTIIIEAPPELP; HQGTIIIEAPPELPR;
QGTIIIEAPPELPRV; GTIIIEAPPELPRVI; TIIIEAPPELPRVIP; IIIEAPPELPRVIPP;
IIEAPPELPRVIPPS; IEAPPELPRVIPPSL; EAPPELPRVIPPSLL;
APPELPRVIPPSLLR; PPELPRVIPPSLLRR; PELPRVIPPSLLRRA;
ELPRVIPPSLLRRAL; LPRVIPPSLLRRALP; PRVIPPSLLRRALPY;
RVIPPSLLRRALPYL; VIPPSLLRRALPYLI; IPPSLLRRALPYLIG;
PPSLLRRALPYLIGI; PSLLRRALPYLIGIL; SLLRRALPYLIGILI; LLRRALPYLIGILIV;
LRRALPYLIGILIVG; RRALPYLIGILIVGM; RALPYLIGILIVGMI; ALPYLIGILIVGMIV;
LPYLIGILIVGMIVA; PYLIGILIVGMIVAL; YLIGILIVGMIVALV; LIGILIVGMIVALVA;
IGILIVGMIVALVAT; GILIVGMIVALVATG; ILIVGMIVALVATGM;
LIVGMIVALVATGMR; IVGMIVALVATGMRV; VGMIVALVATGMRVI;
GMIVALVATGMRVIS; MIVALVATGMRVISP; IVALVATGMRVISPQ;
VALVATGMRVISPQT; ALVATGMRVISPQTL; LVATGMRVISPQTLF;
VATGMRVISPQTLFF; ATGMRVISPQTLFFP; TGMRVISPQTLFFPF;
GMRVISPQTLFFPFV; MRVISPQTLFFPFVL; RVISPQTLFFPFVLL;
VISPQTLFFPFVLLL; ISPQTLFFPFVLLLA; SPQTLFFPFVLLLAA;
PQTLFFPFVLLLAAT; QTLFFPFVLLLAATA; TLFFPFVLLLAATAL;
LFFPFVLLLAATALY; FFPFVLLLAATALYR; FPFVLLLAATALYRG;
PFVLLLAATALYRGN; FVLLLAATALYRGND; VLLLAATALYRGNDK;

Fig. 29 continued

| | | |
|---|---|---|
| | LLLAATALYRGNDKK; LLAATALYRGNDKKM; LAATALYRGNDKKMR;<br>AATALYRGNDKKMRT; ATALYRGNDKKMRTE; TALYRGNDKKMRTEE;<br>ALYRGNDKKMRTEEV; LYRGNDKKMRTEEVD; YRGNDKKMRTEEVDA;<br>RGNDKKMRTEEVDAE; GNDKKMRTEEVDAER; NDKKMRTEEVDAERA;<br>DKKMRTEEVDAERAD; KKMRTEEVDAERADY; KMRTEEVDAERADYL;<br>MRTEEVDAERADYLR; RTEEVDAERADYLRY; TEEVDAERADYLRYL;<br>EEVDAERADYLRYLS; EVDAERADYLRYLSV; VDAERADYLRYLSVV;<br>DAERADYLRYLSVVR; AERADYLRYLSVVRD; ERADYLRYLSVVRDN;<br>RADYLRYLSVVRDNI; ADYLRYLSVVRDNIR; DYLRYLSVVRDNIRA;<br>YLRYLSVVRDNIRAQ; LRYLSVVRDNIRAQA; RYLSVVRDNIRAQAA;<br>YLSVVRDNIRAQAAE; LSVVRDNIRAQAAEQ; SVVRDNIRAQAAEQR;<br>VVRDNIRAQAAEQRA; VRDNIRAQAAEQRAS; RDNIRAQAAEQRASA;<br>DNIRAQAAEQRASAL; NIRAQAAEQRASALW; IRAQAAEQRASALWS;<br>RAQAAEQRASALWSH; AQAAEQRASALWSHP; QAAEQRASALWSHPD;<br>AAEQRASALWSHPDP; AEQRASALWSHPDPT; EQRASALWSHPDPTA;<br>QRASALWSHPDPTAL; RASALWSHPDPTALA; ASALWSHPDPTALAS;<br>SALWSHPDPTALASV; ALWSHPDPTALASVP; LWSHPDPTALASVPG;<br>WSHPDPTALASVPGS; SHPDPTALASVPGSR; HPDPTALASVPGSRR;<br>PDPTALASVPGSRRQ; DPTALASVPGSRRQW; PTALASVPGSRRQWE;<br>TALASVPGSRRQWER; ALASVPGSRRQWERD; LASVPGSRRQWERDP;<br>ASVPGSRRQWERDPH; SVPGSRRQWERDPHD; VPGSRRQWERDPHDP;<br>PGSRRQWERDPHDPD; GSRRQWERDPHDPDF; SRRQWERDPHDPDFL;<br>RRQWERDPHDPDFLV; RQWERDPHDPDFLVL; QWERDPHDPDFLVLR;<br>WERDPHDPDFLVLRA; ERDPHDPDFLVLRAG; RDPHDPDFLVLRAGR;<br>DPHDPDFLVLRAGRH; PHDPDFLVLRAGRHT; HDPDFLVLRAGRHTV;<br>DPDFLVLRAGRHTVP; PDFLVLRAGRHTVPL; DFLVLRAGRHTVPLA;<br>FLVLRAGRHTVPLAT; LVLRAGRHTVPLATT; VLRAGRHTVPLATTL;<br>LRAGRHTVPLATTLR; RAGRHTVPLATTLRV; AGRHTVPLATTLRVN;<br>GRHTVPLATTLRVND; RHTVPLATTLRVNDT; HTVPLATTLRVNDTA;<br>TVPLATTLRVNDTAD; VPLATTLRVNDTADE; PLATTLRVNDTADEI;<br>LATTLRVNDTADEID; ATTLRVNDTADEIDL; TTLRVNDTADEIDLE;<br>TLRVNDTADEIDLEP; LRVNDTADEIDLEPV; RVNDTADEIDLEPVS;<br>VNDTADEIDLEPVSH; NDTADEIDLEPVSHS; DTADEIDLEPVSHSA;<br>TADEIDLEPVSHSAL; ADEIDLEPVSHSALR; DEIDLEPVSHSALRS;<br>EIDLEPVSHSALRSL; IDLEPVSHSALRSLL; DLEPVSHSALRSLLD;<br>LEPVSHSALRSLLDT; EPVSHSALRSLLDTQ; PVSHSALRSLLDTQR;<br>VSHSALRSLLDTQRS; SHSALRSLLDTQRSI; HSALRSLLDTQRSIG;<br>SALRSLLDTQRSIGD; ALRSLLDTQRSIGDV; LRSLLDTQRSIGDVP;<br>RSLLDTQRSIGDVPT; SLLDTQRSIGDVPTG; LLDTQRSIGDVPTGI;<br>LDTQRSIGDVPTGID; DTQRSIGDVPTGIDL; TQRSIGDVPTGIDLT;<br>QRSIGDVPTGIDLTK; RSIGDVPTGIDLTKV; SIGDVPTGIDLTKVS;<br>IGDVPTGIDLTKVSP; GDVPTGIDLTKVSPI; DVPTGIDLTKVSPIT;<br>VPTGIDLTKVSPITV; PTGIDLTKVSPITVL; TGIDLTKVSPITVLG;<br>GIDLTKVSPITVLGE; IDLTKVSPITVLGER; DLTKVSPITVLGERA;<br>LTKVSPITVLGERAQ; TKVSPITVLGERAQV; KVSPITVLGERAQVR;<br>VSPITVLGERAQVRA; SPITVLGERAQVRAV; PITVLGERAQVRAVL;<br>ITVLGERAQVRAVLR; TVLGERAQVRAVLRA; VLGERAQVRAVLRAW;<br>LGERAQVRAVLRAWI; GERAQVRAVLRAWIA; ERAQVRAVLRAWIAQ;<br>RAQVRAVLRAWIAQA; AQVRAVLRAWIAQAV; QVRAVLRAWIAQAVT;<br>VRAVLRAWIAQAVTW; RAVLRAWIAQAVTWH; AVLRAWIAQAVTWHD;<br>VLRAWIAQAVTWHDP; LRAWIAQAVTWHDPT; RAWIAQAVTWHDPTV;<br>AWIAQAVTWHDPTVL; WIAQAVTWHDPTVLG; IAQAVTWHDPTVLGV;<br>AQAVTWHDPTVLGVA; QAVTWHDPTVLGVAL; AVTWHDPTVLGVALA; | |

Fig. 29 continued

| | | | |
|---|---|---|---|
| | VTWHDPTVLGVALAA; TWHDPTVLGVALAAR; WHDPTVLGVALAARD;<br>HDPTVLGVALAARDL; DPTVLGVALAARDLE; PTVLGVALAARDLEG;<br>TVLGVALAARDLEGR; VLGVALAARDLEGRD; LGVALAARDLEGRDW;<br>GVALAARDLEGRDWN; VALAARDLEGRDWNW; ALAARDLEGRDWNWL;<br>LAARDLEGRDWNWLK; AARDLEGRDWNWLKW; ARDLEGRDWNWLKWL;<br>RDLEGRDWNWLKWLP; DLEGRDWNWLKWLPH; LEGRDWNWLKWLPHV;<br>EGRDWNWLKWLPHVD; GRDWNWLKWLPHVDI; RDWNWLKWLPHVDIP;<br>DWNWLKWLPHVDIPG; WNWLKWLPHVDIPGR; NWLKWLPHVDIPGRL;<br>WLKWLPHVDIPGRLD; LKWLPHVDIPGRLDA; KWLPHVDIPGRLDAL;<br>WLPHVDIPGRLDALG; LPHVDIPGRLDALGP; PHVDIPGRLDALGPA;<br>HVDIPGRLDALGPAR; VDIPGRLDALGPARN; DIPGRLDALGPARNL;<br>IPGRLDALGPARNLS; PGRLDALGPARNLST; GRLDALGPARNLSTD;<br>RLDALGPARNLSTDP; LDALGPARNLSTDPD; DALGPARNLSTDPDE;<br>ALGPARNLSTDPDEL; LGPARNLSTDPDELI; GPARNLSTDPDELIA;<br>PARNLSTDPDELIAL; ARNLSTDPDELIALL; RNLSTDPDELIALLG;<br>NLSTDPDELIALLGP; LSTDPDELIALLGPV; STDPDELIALLGPVL;<br>TDPDELIALLGPVLA; DPDELIALLGPVLAD; PDELIALLGPVLADR;<br>DELIALLGPVLADRP; ELIALLGPVLADRPA; LIALLGPVLADRPAF;<br>IALLGPVLADRPAFT; ALLGPVLADRPAFTG; LLGPVLADRPAFTGQ;<br>LGPVLADRPAFTGQP; GPVLADRPAFTGQPT; PVLADRPAFTGQPTD;<br>VLADRPAFTGQPTDA; LADRPAFTGQPTDAL; ADRPAFTGQPTDALR;<br>DRPAFTGQPTDALRH; RPAFTGQPTDALRHL; PAFTGQPTDALRHLL;<br>AFTGQPTDALRHLLI; FTGQPTDALRHLLIV; TGQPTDALRHLLIVV;<br>GQPTDALRHLLIVVD; QPTDALRHLLIVVDD; PTDALRHLLIVVDDP;<br>TDALRHLLIVVDDPD; DALRHLLIVVDDPDY; ALRHLLIVVDDPDYD;<br>LRHLLIVVDDPDYDL; RHLLIVVDDPDYDLG; HLLIVVDDPDYDLGA;<br>LLIVVDDPDYDLGAS; LIVVDDPDYDLGASP; IVVDDPDYDLGASPL;<br>VVDDPDYDLGASPLA; VDDPDYDLGASPLAV; DDPDYDLGASPLAVG;<br>DPDYDLGASPLAVGR; PDYDLGASPLAVGRA; DYDLGASPLAVGRAG;<br>YDLGASPLAVGRAGV; DLGASPLAVGRAGVT; LGASPLAVGRAGVTV;<br>GASPLAVGRAGVTVV; ASPLAVGRAGVTVVH; SPLAVGRAGVTVVHC;<br>PLAVGRAGVTVVHCS; LAVGRAGVTVVHCSA; AVGRAGVTVVHCSAS;<br>VGRAGVTVVHCSASA; GRAGVTVVHCSASAP; RAGVTVVHCSASAPH;<br>AGVTVVHCSASAPHR; GVTVVHCSASAPHRE; VTVVHCSASAPHREQ;<br>TVVHCSASAPHREQY; VVHCSASAPHREQYS; VHCSASAPHREQYSD;<br>HCSASAPHREQYSDP; CSASAPHREQYSDPE; SASAPHREQYSDPEK;<br>ASAPHREQYSDPEKP; SAPHREQYSDPEKPI; APHREQYSDPEKPIL;<br>PHREQYSDPEKPILR; HREQYSDPEKPILRV; REQYSDPEKPILRVA;<br>EQYSDPEKPILRVAH; QYSDPEKPILRVAHG; YSDPEKPILRVAHGA;<br>SDPEKPILRVAHGAI; DPEKPILRVAHGAIE; PEKPILRVAHGAIER;<br>EKPILRVAHGAIERW; KPILRVAHGAIERWQ; PILRVAHGAIERWQT;<br>ILRVAHGAIERWQTG; LRVAHGAIERWQTGG; RVAHGAIERWQTGGW;<br>VAHGAIERWQTGGWQ; AHGAIERWQTGGWQP; HGAIERWQTGGWQPY;<br>GAIERWQTGGWQPYI; AIERWQTGGWQPYID; IERWQTGGWQPYIDA;<br>ERWQTGGWQPYIDAA; RWQTGGWQPYIDAAD; WQTGGWQPYIDAADQ;<br>QTGGWQPYIDAADQF; TGGWQPYIDAADQFS; GGWQPYIDAADQFSA;<br>GWQPYIDAADQFSAD; WQPYIDAADQFSADE; QPYIDAADQFSADEA;<br>PYIDAADQFSADEAA; YIDAADQFSADEAAH; IDAADQFSADEAAHL;<br>DAADQFSADEAAHLA; AADQFSADEAAHLAR; ADQFSADEAAHLARR;<br>DQFSADEAAHLARRL; QFSADEAAHLARRLS; FSADEAAHLARRLSR;<br>SADEAAHLARRLSRW; ADEAAHLARRLSRWD; DEAAHLARRLSRWDS;<br>EAAHLARRLSRWDSN; AAHLARRLSRWDSNP; AHLARRLSRWDSNPT;<br>HLARRLSRWDSNPTH; LARRLSRWDSNPTHA; ARRLSRWDSNPTHAG; | | |

Fig. 29 continued

| | | | |
|---|---|---|---|
| | RRLSRWDSNPTHAGL; RLSRWDSNPTHAGLR; LSRWDSNPTHAGLRS; SRWDSNPTHAGLRSA; RWDSNPTHAGLRSAA; WDSNPTHAGLRSAAT; DSNPTHAGLRSAATR; SNPTHAGLRSAATRG; NPTHAGLRSAATRGA; PTHAGLRSAATRGAS; THAGLRSAATRGASF; HAGLRSAATRGASFT; AGLRSAATRGASFTT; GLRSAATRGASFTTL; LRSAATRGASFTTLL; RSAATRGASFTTLLG; SAATRGASFTTLLGI; AATRGASFTTLLGIE; ATRGASFTTLLGIED; TRGASFTTLLGIEDA; RGASFTTLLGIEDAS; GASFTTLLGIEDASR; ASFTTLLGIEDASRL; SFTTLLGIEDASRLD; FTTLLGIEDASRLDV; TTLLGIEDASRLDVP; TLLGIEDASRLDVPA; LLGIEDASRLDVPAL; LGIEDASRLDVPALW; GIEDASRLDVPALWA; IEDASRLDVPALWAP; EDASRLDVPALWAPR; DASRLDVPALWAPRR; ASRLDVPALWAPRRR; SRLDVPALWAPRRRD; RLDVPALWAPRRRDE; LDVPALWAPRRRDEE; DVPALWAPRRRDEEL; VPALWAPRRRDEELR; PALWAPRRRDEELRV; ALWAPRRRDEELRVP; LWAPRRRDEELRVPI; WAPRRRDEELRVPIG; APRRRDEELRVPIGV; PRRRDEELRVPIGVT; RRRDEELRVPIGVTG; RRDEELRVPIGVTGT; RDEELRVPIGVTGTG; DEELRVPIGVTGTGE; EELRVPIGVTGTGEP; ELRVPIGVTGTGEPL; LRVPIGVTGTGEPLM; RVPIGVTGTGEPLMF; VPIGVTGTGEPLMFD; PIGVTGTGEPLMFDL; IGVTGTGEPLMFDLK; GVTGTGEPLMFDLKD; VTGTGEPLMFDLKDE; TGTGEPLMFDLKDEA; GTGEPLMFDLKDEAE; TGEPLMFDLKDEAEG; GEPLMFDLKDEAEGG; EPLMFDLKDEAEGGM; PLMFDLKDEAEGGMG; LMFDLKDEAEGGMGP; MFDLKDEAEGGMGPH; FDLKDEAEGGMGPHG; DLKDEAEGGMGPHGL; LKDEAEGGMGPHGLM; KDEAEGGMGPHGLMI; DEAEGGMGPHGLMIG; EAEGGMGPHGLMIGM; AEGGMGPHGLMIGMT; EGGMGPHGLMIGMTG; GGMGPHGLMIGMTGS; GMGPHGLMIGMTGSG; MGPHGLMIGMTGSGK; GPHGLMIGMTGSGKS; PHGLMIGMTGSGKSQ; HGLMIGMTGSGKSQT; GLMIGMTGSGKSQTL; LMIGMTGSGKSQTLM; MIGMTGSGKSQTLMS; IGMTGSGKSQTLMSI; GMTGSGKSQTLMSIL; MTGSGKSQTLMSILL; TGSGKSQTLMSILLS; GSGKSQTLMSILLSL; SGKSQTLMSILLSLL; GKSQTLMSILLSLLT; KSQTLMSILLSLLTT; SQTLMSILLSLLTTH; QTLMSILLSLLTTHS; TLMSILLSLLTTHSA; LMSILLSLLTTHSAE; MSILLSLLTTHSAER; SILLSLLTTHSAERL; ILLSLLTTHSAERLI; LLSLLTTHSAERLIV; LSLLTTHSAERLIVI; SLLTTHSAERLIVIY; LLTTHSAERLIVIYA; LTTHSAERLIVIYAD; TTHSAERLIVIYADF; THSAERLIVIYADFK; HSAERLIVIYADFKG; SAERLIVIYADFKGE; AERLIVIYADFKGEA; ERLIVIYADFKGEAG; RLIVIYADFKGEAGA; LIVIYADFKGEAGAD; IVIYADFKGEAGADS; VIYADFKGEAGADSF; IYADFKGEAGADSFR; YADFKGEAGADSFRD; ADFKGEAGADSFRDF; DFKGEAGADSFRDFP; FKGEAGADSFRDFPQ; KGEAGADSFRDFPQV; GEAGADSFRDFPQVV; EAGADSFRDFPQVVA; AGADSFRDFPQVVAV; GADSFRDFPQVVAVI; ADSFRDFPQVVAVIS; DSFRDFPQVVAVISN; SFRDFPQVVAVISNM; FRDFPQVVAVISNMA; RDFPQVVAVISNMAE; DFPQVVAVISNMAEK; FPQVVAVISNMAEKK; PQVVAVISNMAEKKS; QVVAVISNMAEKKSL; VVAVISNMAEKKSLA; VAVISNMAEKKSLAD; AVISNMAEKKSLADR; VISNMAEKKSLADRF; ISNMAEKKSLADRFA; SNMAEKKSLADRFAD; NMAEKKSLADRFADT; MAEKKSLADRFADTL; AEKKSLADRFADTLR; EKKSLADRFADTLRG; KKSLADRFADTLRGE; KSLADRFADTLRGEV; SLADRFADTLRGEVA; LADRFADTLRGEVAR; ADRFADTLRGEVARR; DRFADTLRGEVARRE; RFADTLRGEVARREM; FADTLRGEVARREML; ADTLRGEVARREMLL; DTLRGEVARREMLLR; TLRGEVARREMLLRE; LRGEVARREMLLREA; RGEVARREMLLREAG; GEVARREMLLREAGR; EVARREMLLREAGRK; VARREMLLREAGRKV; ARREMLLREAGRKVQ; | |

Fig. 29 continued

| | | | |
|---|---|---|---|
| | RREMLLREAGRKVQG; REMLLREAGRKVQGS; EMLLREAGRKVQGSA;<br>MLLREAGRKVQGSAF; LLREAGRKVQGSAFN; LREAGRKVQGSAFNS;<br>REAGRKVQGSAFNSV; EAGRKVQGSAFNSVL; AGRKVQGSAFNSVLE;<br>GRKVQGSAFNSVLEY; RKVQGSAFNSVLEYE; KVQGSAFNSVLEYEN;<br>VQGSAFNSVLEYENA; QGSAFNSVLEYENAI; GSAFNSVLEYENAIA;<br>SAFNSVLEYENAIAA; AFNSVLEYENAIAAG; FNSVLEYENAIAAGH;<br>NSVLEYENAIAAGHS; SVLEYENAIAAGHSL; VLEYENAIAAGHSLP;<br>LEYENAIAAGHSLPP; EYENAIAAGHSLPPI; YENAIAAGHSLPPIP;<br>ENAIAAGHSLPPIPT; NAIAAGHSLPPIPTL; AIAAGHSLPPIPTLF;<br>IAAGHSLPPIPTLFV; AAGHSLPPIPTLFVV; AGHSLPPIPTLFVVA;<br>GHSLPPIPTLFVVAD; HSLPPIPTLFVVADE; SLPPIPTLFVVADEF;<br>LPPIPTLFVVADEFT; PPIPTLFVVADEFTL; PIPTLFVVADEFTLM;<br>IPTLFVVADEFTLML; PTLFVVADEFTLMLA; TLFVVADEFTLMLAD;<br>LFVVADEFTLMLADH; FVVADEFTLMLADHP; VVADEFTLMLADHPE;<br>VADEFTLMLADHPEY; ADEFTLMLADHPEYA; DEFTLMLADHPEYAE;<br>EFTLMLADHPEYAEL; FTLMLADHPEYAELF; TLMLADHPEYAELFD;<br>LMLADHPEYAELFDY; MLADHPEYAELFDYV; LADHPEYAELFDYVA;<br>ADHPEYAELFDYVAR; DHPEYAELFDYVARK; HPEYAELFDYVARKG;<br>PEYAELFDYVARKGR; EYAELFDYVARKGRS; YAELFDYVARKGRSF;<br>AELFDYVARKGRSFR; ELFDYVARKGRSFRI; LFDYVARKGRSFRIH;<br>FDYVARKGRSFRIHI; DYVARKGRSFRIHIL; YVARKGRSFRIHILF;<br>VARKGRSFRIHILFA; ARKGRSFRIHILFAS; RKGRSFRIHILFASQ;<br>KGRSFRIHILFASQT; GRSFRIHILFASQTL; RSFRIHILFASQTLD;<br>SFRIHILFASQTLDV; FRIHILFASQTLDVG; RIHILFASQTLDVGK;<br>IHILFASQTLDVGKI; HILFASQTLDVGKIK; ILFASQTLDVGKIKD;<br>LFASQTLDVGKIKDI; FASQTLDVGKIKDID; ASQTLDVGKIKDIDK;<br>SQTLDVGKIKDIDKN; QTLDVGKIKDIDKNT; TLDVGKIKDIDKNTA;<br>LDVGKIKDIDKNTAY; DVGKIKDIDKNTAYR; VGKIKDIDKNTAYRI;<br>GKIKDIDKNTAYRIG; KIKDIDKNTAYRIGL; IKDIDKNTAYRIGLK;<br>KDIDKNTAYRIGLKV; DIDKNTAYRIGLKVA; IDKNTAYRIGLKVAS;<br>DKNTAYRIGLKVASP; KNTAYRIGLKVASPS; NTAYRIGLKVASPSV;<br>TAYRIGLKVASPSVS; AYRIGLKVASPSVSR; YRIGLKVASPSVSRQ;<br>RIGLKVASPSVSRQI; IGLKVASPSVSRQII; GLKVASPSVSRQIIG;<br>LKVASPSVSRQIIGV; KVASPSVSRQIIGVE; VASPSVSRQIIGVED;<br>ASPSVSRQIIGVEDA; SPSVSRQIIGVEDAY; PSVSRQIIGVEDAYH;<br>SVSRQIIGVEDAYHI; VSRQIIGVEDAYHIE; SRQIIGVEDAYHIES;<br>RQIIGVEDAYHIESG; QIIGVEDAYHIESGK; IIGVEDAYHIESGKE;<br>IGVEDAYHIESGKEH; GVEDAYHIESGKEHK; VEDAYHIESGKEHKG;<br>EDAYHIESGKEHKGV; DAYHIESGKEHKGVG; AYHIESGKEHKGVGF;<br>YHIESGKEHKGVGFL; HIESGKEHKGVGFLV; IESGKEHKGVGFLVP;<br>ESGKEHKGVGFLVPA; SGKEHKGVGFLVPAP; GKEHKGVGFLVPAPG;<br>KEHKGVGFLVPAPGA; EHKGVGFLVPAPGAT; HKGVGFLVPAPGATP;<br>KGVGFLVPAPGATPI; GVGFLVPAPGATPIR; VGFLVPAPGATPIRF;<br>GFLVPAPGATPIRFR; FLVPAPGATPIRFRS; LVPAPGATPIRFRST;<br>VPAPGATPIRFRSTY; PAPGATPIRFRSTYV; APGATPIRFRSTYVD;<br>PGATPIRFRSTYVDG; GATPIRFRSTYVDGI; ATPIRFRSTYVDGIY;<br>TPIRFRSTYVDGIYE; PIRFRSTYVDGIYEP; IRFRSTYVDGIYEPP;<br>RFRSTYVDGIYEPPQ; FRSTYVDGIYEPPQT; RSTYVDGIYEPPQTA;<br>STYVDGIYEPPQTAK; TYVDGIYEPPQTAKA; YVDGIYEPPQTAKAV;<br>VDGIYEPPQTAKAVV; DGIYEPPQTAKAVVV; GIYEPPQTAKAVVVQ;<br>IYEPPQTAKAVVVQS; YEPPQTAKAVVVQSV; EPPQTAKAVVVQSVP;<br>PPQTAKAVVVQSVPE; PQTAKAVVVQSVPEP; QTAKAVVVQSVPEPK;<br>TAKAVVVQSVPEPKL; AKAVVVQSVPEPKLF; KAVVVQSVPEPKLFT; | | |

Fig. 29 continued

| | | |
|---|---|---|
| | AVVVQSVPEPKLFTA; VVVQSVPEPKLFTAA; VVQSVPEPKLFTAAA;<br>VQSVPEPKLFTAAAV; QSVPEPKLFTAAAVE; SVPEPKLFTAAAVEP;<br>VPEPKLFTAAAVEPD; PEPKLFTAAAVEPDP; EPKLFTAAAVEPDPG;<br>PKLFTAAAVEPDPGT; KLFTAAAVEPDPGTV; LFTAAAVEPDPGTVI;<br>FTAAAVEPDPGTVIA; TAAAVEPDPGTVIAD; AAAVEPDPGTVIADT;<br>AAVEPDPGTVIADTD; AVEPDPGTVIADTDE; VEPDPGTVIADTDEQ;<br>EPDPGTVIADTDEQE; PDPGTVIADTDEQEP; DPGTVIADTDEQEPA;<br>PGTVIADTDEQEPAD; GTVIADTDEQEPADP; TVIADTDEQEPADPP;<br>VIADTDEQEPADPPR; IADTDEQEPADPPRK; ADTDEQEPADPPRKL;<br>DTDEQEPADPPRKLI; TDEQEPADPPRKLIA; DEQEPADPPRKLIAT;<br>EQEPADPPRKLIATI; QEPADPPRKLIATIG; EPADPPRKLIATIGE;<br>PADPPRKLIATIGEQ; ADPPRKLIATIGEQL; DPPRKLIATIGEQLA;<br>PPRKLIATIGEQLAR; PRKLIATIGEQLARY; RKLIATIGEQLARYG;<br>KLIATIGEQLARYGP; LIATIGEQLARYGPR; IATIGEQLARYGPRA;<br>ATIGEQLARYGPRAP; TIGEQLARYGPRAPQ; IGEQLARYGPRAPQL;<br>GEQLARYGPRAPQLW; EQLARYGPRAPQLWL; QLARYGPRAPQLWLP;<br>LARYGPRAPQLWLPP; ARYGPRAPQLWLPPL; RYGPRAPQLWLPPLD;<br>YGPRAPQLWLPPLDE; GPRAPQLWLPPLDET; PRAPQLWLPPLDETI;<br>RAPQLWLPPLDETIP; APQLWLPPLDETIPL; PQLWLPPLDETIPLS;<br>QLWLPPLDETIPLSA; LWLPPLDETIPLSAA; WLPPLDETIPLSAAL;<br>LPPLDETIPLSAALA; PPLDETIPLSAALAR; PLDETIPLSAALARA;<br>LDETIPLSAALARAG; DETIPLSAALARAGV; ETIPLSAALARAGVG;<br>TIPLSAALARAGVGP; IPLSAALARAGVGPR; PLSAALARAGVGPRQ;<br>LSAALARAGVGPRQW; SAALARAGVGPRQWR; AALARAGVGPRQWRW;<br>ALARAGVGPRQWRWP; LARAGVGPRQWRWPL; ARAGVGPRQWRWPLG;<br>RAGVGPRQWRWPLGE; AGVGPRQWRWPLGEI; GVGPRQWRWPLGEID;<br>VGPRQWRWPLGEIDR; GPRQWRWPLGEIDRP; PRQWRWPLGEIDRPF;<br>RQWRWPLGEIDRPFE; QWRWPLGEIDRPFEM; WRWPLGEIDRPFEMR;<br>RWPLGEIDRPFEMRR; WPLGEIDRPFEMRRD; PLGEIDRPFEMRRDP;<br>LGEIDRPFEMRRDPL; GEIDRPFEMRRDPLV; EIDRPFEMRRDPLVF;<br>IDRPFEMRRDPLVFD; DRPFEMRRDPLVFDA; RPFEMRRDPLVFDAR;<br>PFEMRRDPLVFDARS; FEMRRDPLVFDARSS; EMRRDPLVFDARSSA;<br>MRRDPLVFDARSSAG; RRDPLVFDARSSAGN; RDPLVFDARSSAGNM;<br>DPLVFDARSSAGNMV; PLVFDARSSAGNMVI; LVFDARSSAGNMVIH;<br>VFDARSSAGNMVIHG; FDARSSAGNMVIHGG; DARSSAGNMVIHGGP;<br>ARSSAGNMVIHGGPK; RSSAGNMVIHGGPKS; SSAGNMVIHGGPKSG;<br>SAGNMVIHGGPKSGK; AGNMVIHGGPKSGKS; GNMVIHGGPKSGKST;<br>NMVIHGGPKSGKSTA; MVIHGGPKSGKSTAL; VIHGGPKSGKSTALQ;<br>IHGGPKSGKSTALQT; HGGPKSGKSTALQTF; GGPKSGKSTALQTFI;<br>GPKSGKSTALQTFIL; PKSGKSTALQTFILS; KSGKSTALQTFILSA;<br>SGKSTALQTFILSAA; GKSTALQTFILSAAS; KSTALQTFILSAASL;<br>STALQTFILSAASLH; TALQTFILSAASLHS; ALQTFILSAASLHSP;<br>LQTFILSAASLHSPH; QTFILSAASLHSPHE; TFILSAASLHSPHEV;<br>FILSAASLHSPHEVS; ILSAASLHSPHEVSF; LSAASLHSPHEVSFY;<br>SAASLHSPHEVSFYC; AASLHSPHEVSFYCL; ASLHSPHEVSFYCLD;<br>SLHSPHEVSFYCLDY; LHSPHEVSFYCLDYG; HSPHEVSFYCLDYGG;<br>SPHEVSFYCLDYGGG; PHEVSFYCLDYGGGQ; HEVSFYCLDYGGGQL;<br>EVSFYCLDYGGGQLR; VSFYCLDYGGGQLRA; SFYCLDYGGGQLRAL;<br>FYCLDYGGGQLRALQ; YCLDYGGGQLRALQD; CLDYGGGQLRALQDL;<br>LDYGGGQLRALQDLA; DYGGGQLRALQDLAH; YGGGQLRALQDLAHV;<br>GGGQLRALQDLAHVG; GGQLRALQDLAHVGS; GQLRALQDLAHVGSV;<br>QLRALQDLAHVGSVA; LRALQDLAHVGSVAS; RALQDLAHVGSVASA;<br>ALQDLAHVGSVASAL; LQDLAHVGSVASALE; QDLAHVGSVASALEP; | |

Fig. 29 continued

| | | |
|---|---|---|
| | DLAHVGSVASALEPE; LAHVGSVASALEPER; AHVGSVASALEPERI; HVGSVASALEPERIR; VGSVASALEPERIRR; GSVASALEPERIRRT; SVASALEPERIRRTF; VASALEPERIRRTFG; ASALEPERIRRTFGE; SALEPERIRRTFGEL; ALEPERIRRTFGELE; LEPERIRRTFGELEQ; EPERIRRTFGELEQL; PERIRRTFGELEQLL; ERIRRTFGELEQLLL; RIRRTFGELEQLLLS; IRRTFGELEQLLLSR; RRTFGELEQLLLSRQ; RTFGELEQLLLSRQQ; TFGELEQLLLSRQQR; FGELEQLLLSRQQRE; GELEQLLLSRQQREV; ELEQLLLSRQQREVF; LEQLLLSRQQREVFR; EQLLLSRQQREVFRD; QLLLSRQQREVFRDR; LLLSRQQREVFRDRG; LLSRQQREVFRDRGA; LSRQQREVFRDRGAN; SRQQREVFRDRGANG; RQQREVFRDRGANGS; QQREVFRDRGANGST; QREVFRDRGANGSTP; REVFRDRGANGSTPD; EVFRDRGANGSTPDD; VFRDRGANGSTPDDG; FRDRGANGSTPDDGF; RDRGANGSTPDDGFG; DRGANGSTPDDGFGE; RGANGSTPDDGFGEV; GANGSTPDDGFGEVF; ANGSTPDDGFGEVFL; NGSTPDDGFGEVFLV; GSTPDDGFGEVFLVI; STPDDGFGEVFLVID; TPDDGFGEVFLVIDN; PDDGFGEVFLVIDNL; DDGFGEVFLVIDNLY; DGFGEVFLVIDNLYG; GFGEVFLVIDNLYGF; FGEVFLVIDNLYGFG; GEVFLVIDNLYGFGR; EVFLVIDNLYGFGRD; VFLVIDNLYGFGRDN; FLVIDNLYGFGRDNT; LVIDNLYGFGRDNTD; VIDNLYGFGRDNTDQ; IDNLYGFGRDNTDQF; DNLYGFGRDNTDQFN; NLYGFGRDNTDQFNT; LYGFGRDNTDQFNTR; YGFGRDNTDQFNTRN; GFGRDNTDQFNTRNP; FGRDNTDQFNTRNPL; GRDNTDQFNTRNPLL; RDNTDQFNTRNPLLA; DNTDQFNTRNPLLAR; NTDQFNTRNPLLARV; TDQFNTRNPLLARVT; DQFNTRNPLLARVTE; QFNTRNPLLARVTEL; FNTRNPLLARVTELV; NTRNPLLARVTELVN; TRNPLLARVTELVNV; RNPLLARVTELVNVG; NPLLARVTELVNVGL; PLLARVTELVNVGLA; LLARVTELVNVGLAY; LARVTELVNVGLAYG; ARVTELVNVGLAYGI; RVTELVNVGLAYGIH; VTELVNVGLAYGIHV; TELVNVGLAYGIHVI; ELVNVGLAYGIHVII; LVNVGLAYGIHVIIT; VNVGLAYGIHVIITT; NVGLAYGIHVIITTP; VGLAYGIHVIITTPS; GLAYGIHVIITTPSW; LAYGIHVIITTPSWL; AYGIHVIITTPSWLE; YGIHVIITTPSWLEV; GIHVIITTPSWLEVP; IHVIITTPSWLEVPL; HVIITTPSWLEVPLA; VIITTPSWLEVPLAM; IITTPSWLEVPLAMR; ITTPSWLEVPLAMRD; TTPSWLEVPLAMRDG; TPSWLEVPLAMRDGL; PSWLEVPLAMRDGLG; SWLEVPLAMRDGLGL; WLEVPLAMRDGLGLR; LEVPLAMRDGLGLRL; EVPLAMRDGLGLRLE; VPLAMRDGLGLRLEL; PLAMRDGLGLRLELR; LAMRDGLGLRLELRL; AMRDGLGLRLELRLH; MRDGLGLRLELRLHD; RDGLGLRLELRLHDA; DGLGLRLELRLHDAR; GLGLRLELRLHDARD; LGLRLELRLHDARDS; GLRLELRLHDARDSN; LRLELRLHDARDSNV; RLELRLHDARDSNVR; LELRLHDARDSNVRV; ELRLHDARDSNVRVV; LRLHDARDSNVRVVG; RLHDARDSNVRVVGA; LHDARDSNVRVVGAL; HDARDSNVRVVGALR; DARDSNVRVVGALRR; ARDSNVRVVGALRRP; RDSNVRVVGALRRPA; DSNVRVVGALRRPAD; SNVRVVGALRRPADA; NVRVVGALRRPADAV; VRVVGALRRPADAVP; RVVGALRRPADAVPH; VVGALRRPADAVPHD; VGALRRPADAVPHDQ; GALRRPADAVPHDQP; ALRRPADAVPHDQPG; LRRPADAVPHDQPGR; RRPADAVPHDQPGRG; RPADAVPHDQPGRGL; PADAVPHDQPGRGLT; ADAVPHDQPGRGLTM; DAVPHDQPGRGLTMA; AVPHDQPGRGLTMAA; VPHDQPGRGLTMAAE; PHDQPGRGLTMAAEH; HDQPGRGLTMAAEHF; DQPGRGLTMAAEHFL; QPGRGLTMAAEHFLF; PGRGLTMAAEHFLFA; GRGLTMAAEHFLFAA; RGLTMAAEHFLFAAP; GLTMAAEHFLFAAPE; LTMAAEHFLFAAPEL; TMAAEHFLFAAPELD; MAAEHFLFAAPELDA; AAEHFLFAAPELDAQ; AEHFLFAAPELDAQT; EHFLFAAPELDAQTN; HFLFAAPELDAQTNP; FLFAAPELDAQTNPV; | |

Fig. 29 continued

| | | | |
|---|---|---|---|
| | LFAAPELDAQTNPVA; FAAPELDAQTNPVAA; AAPELDAQTNPVAAI;<br>APELDAQTNPVAAIN; PELDAQTNPVAAINA; ELDAQTNPVAAINAR;<br>LDAQTNPVAAINARY; DAQTNPVAAINARYP; AQTNPVAAINARYPG;<br>QTNPVAAINARYPGM; TNPVAAINARYPGMA; NPVAAINARYPGMAA;<br>PVAAINARYPGMAAP; VAAINARYPGMAAPP; AAINARYPGMAAPPV;<br>AINARYPGMAAPPVR; INARYPGMAAPPVRL; NARYPGMAAPPVRLL;<br>ARYPGMAAPPVRLLP; RYPGMAAPPVRLLPT; YPGMAAPPVRLLPTN;<br>PGMAAPPVRLLPTNL; GMAAPPVRLLPTNLA; MAAPPVRLLPTNLAP;<br>AAPPVRLLPTNLAPH; APPVRLLPTNLAPHA; PPVRLLPTNLAPHAV;<br>PVRLLPTNLAPHAVG; VRLLPTNLAPHAVGE; RLLPTNLAPHAVGEL;<br>LLPTNLAPHAVGELY; LPTNLAPHAVGELYR; PTNLAPHAVGELYRG;<br>TNLAPHAVGELYRGP; NLAPHAVGELYRGPD; LAPHAVGELYRGPDQ;<br>APHAVGELYRGPDQL; PHAVGELYRGPDQLV; HAVGELYRGPDQLVI;<br>AVGELYRGPDQLVIG; VGELYRGPDQLVIGQ; GELYRGPDQLVIGQR;<br>ELYRGPDQLVIGQRE; LYRGPDQLVIGQREE; YRGPDQLVIGQREED;<br>RGPDQLVIGQREEDL; GPDQLVIGQREEDLA; PDQLVIGQREEDLAP;<br>DQLVIGQREEDLAPV; QLVIGQREEDLAPVI; LVIGQREEDLAPVIL;<br>VIGQREEDLAPVILD; IGQREEDLAPVILDL; GQREEDLAPVILDLA;<br>QREEDLAPVILDLAA; REEDLAPVILDLAAN; EEDLAPVILDLAANP;<br>EDLAPVILDLAANPL; DLAPVILDLAANPLL; LAPVILDLAANPLLM;<br>APVILDLAANPLLMV; PVILDLAANPLLMVF; VILDLAANPLLMVFG;<br>ILDLAANPLLMVFGD; LDLAANPLLMVFGDA; DLAANPLLMVFGDAR;<br>LAANPLLMVFGDARS; AANPLLMVFGDARSG; ANPLLMVFGDARSGK;<br>NPLLMVFGDARSGKT; PLLMVFGDARSGKTT; LLMVFGDARSGKTTL;<br>LMVFGDARSGKTTLL; MVFGDARSGKTTLLR; VFGDARSGKTTLLRH;<br>FGDARSGKTTLLRHI; GDARSGKTTLLRHII; DARSGKTTLLRHIIR;<br>ARSGKTTLLRHIIRT; RSGKTTLLRHIIRTV; SGKTTLLRHIIRTVR;<br>GKTTLLRHIIRTVRE; KTTLLRHIIRTVREH; TTLLRHIIRTVREHS;<br>TLLRHIIRTVREHST; LLRHIIRTVREHSTA; LRHIIRTVREHSTAD;<br>RHIIRTVREHSTADR; HIIRTVREHSTADRV; IIRTVREHSTADRVA;<br>IRTVREHSTADRVAF; RTVREHSTADRVAFT; TVREHSTADRVAFTV;<br>VREHSTADRVAFTVL; REHSTADRVAFTVLD; EHSTADRVAFTVLDR;<br>HSTADRVAFTVLDRR; STADRVAFTVLDRRL; TADRVAFTVLDRRLH;<br>ADRVAFTVLDRRLHL; DRVAFTVLDRRLHLV; RVAFTVLDRRLHLVD;<br>VAFTVLDRRLHLVDE; AFTVLDRRLHLVDEP; FTVLDRRLHLVDEPL;<br>TVLDRRLHLVDEPLF; VLDRRLHLVDEPLFP; LDRRLHLVDEPLFPD;<br>DRRLHLVDEPLFPDN; RRLHLVDEPLFPDNE; RLHLVDEPLFPDNEY;<br>LHLVDEPLFPDNEYT; HLVDEPLFPDNEYTA; LVDEPLFPDNEYTAN;<br>VDEPLFPDNEYTANI; DEPLFPDNEYTANID; EPLFPDNEYTANIDR;<br>PLFPDNEYTANIDRI; LFPDNEYTANIDRII; FPDNEYTANIDRIIP;<br>PDNEYTANIDRIIPA; DNEYTANIDRIIPAM; NEYTANIDRIIPAML;<br>EYTANIDRIIPAMLG; YTANIDRIIPAMLGL; TANIDRIIPAMLGLA;<br>ANIDRIIPAMLGLAN; NIDRIIPAMLGLANL; IDRIIPAMLGLANLI;<br>DRIIPAMLGLANLIE; RIIPAMLGLANLIEA; IIPAMLGLANLIEAR;<br>IPAMLGLANLIEARR; PAMLGLANLIEARRP; AMLGLANLIEARRPP;<br>MLGLANLIEARRPPA; LGLANLIEARRPPAG; GLANLIEARRPPAGM;<br>LANLIEARRPPAGMS; ANLIEARRPPAGMSA; NLIEARRPPAGMSAA;<br>LIEARRPPAGMSAAE; IEARRPPAGMSAAEL; EARRPPAGMSAAELS;<br>ARRPPAGMSAAELSR; RRPPAGMSAAELSRW; RPPAGMSAAELSRWT;<br>PPAGMSAAELSRWTF; PAGMSAAELSRWTFA; AGMSAAELSRWTFAG;<br>GMSAAELSRWTFAGH; MSAAELSRWTFAGHT; SAAELSRWTFAGHTH;<br>AAELSRWTFAGHTHY; AELSRWTFAGHTHYL; ELSRWTFAGHTHYLI;<br>LSRWTFAGHTHYLII; SRWTFAGHTHYLIID; RWTFAGHTHYLIIDD; | | |

Fig. 29 continued

| | | |
|---|---|---|
| | WTFAGHTHYLIIDDV; TFAGHTHYLIIDDVD; FAGHTHYLIIDDVDQ; AGHTHYLIIDDVDQV; GHTHYLIIDDVDQVP; HTHYLIIDDVDQVPD; THYLIIDDVDQVPDS; HYLIIDDVDQVPDSP; YLIIDDVDQVPDSPA; LIIDDVDQVPDSPAM; IIDDVDQVPDSPAMT; IDDVDQVPDSPAMTG; DDVDQVPDSPAMTGP; DVDQVPDSPAMTGPY; VDQVPDSPAMTGPYI; DQVPDSPAMTGPYIG; QVPDSPAMTGPYIGQ; VPDSPAMTGPYIGQR; PDSPAMTGPYIGQRP; DSPAMTGPYIGQRPW; SPAMTGPYIGQRPWT; PAMTGPYIGQRPWTP; AMTGPYIGQRPWTPL; MTGPYIGQRPWTPLI; TGPYIGQRPWTPLIG; GPYIGQRPWTPLIGL; PYIGQRPWTPLIGLL; YIGQRPWTPLIGLLA; IGQRPWTPLIGLLAQ; GQRPWTPLIGLLAQA; QRPWTPLIGLLAQAG; RPWTPLIGLLAQAGD; PWTPLIGLLAQAGDL; WTPLIGLLAQAGDLG; TPLIGLLAQAGDLGL; PLIGLLAQAGDLGLR; LIGLLAQAGDLGLRV; IGLLAQAGDLGLRVI; GLLAQAGDLGLRVIV; LLAQAGDLGLRVIVT; LAQAGDLGLRVIVTG; AQAGDLGLRVIVTGR; QAGDLGLRVIVTGRA; AGDLGLRVIVTGRAT; GDLGLRVIVTGRATG; DLGLRVIVTGRATGS; LGLRVIVTGRATGSA; GLRVIVTGRATGSAH; LRVIVTGRATGSAHL; RVIVTGRATGSAHLL; VIVTGRATGSAHLLM; IVTGRATGSAHLLMT; VTGRATGSAHLLMTS; TGRATGSAHLLMTSP; GRATGSAHLLMTSPL; RATGSAHLLMTSPLL; ATGSAHLLMTSPLLR; TGSAHLLMTSPLLRR; GSAHLLMTSPLLRRF; SAHLLMTSPLLRRFN; AHLLMTSPLLRRFND; HLLMTSPLLRRFNDL; LLMTSPLLRRFNDLQ; LMTSPLLRRFNDLQA; MTSPLLRRFNDLQAT; TSPLLRRFNDLQATT; SPLLRRFNDLQATTL; PLLRRFNDLQATTLM; LLRRFNDLQATTLML; LRRFNDLQATTLMLA; RRFNDLQATTLMLAG; RFNDLQATTLMLAGN; FNDLQATTLMLAGNP; NDLQATTLMLAGNPA; DLQATTLMLAGNPAD; LQATTLMLAGNPADS; QATTLMLAGNPADSG; ATTLMLAGNPADSGK; TTLMLAGNPADSGKI; TLMLAGNPADSGKIR; LMLAGNPADSGKIRG; MLAGNPADSGKIRGE; LAGNPADSGKIRGER; AGNPADSGKIRGERF; GNPADSGKIRGERFA; NPADSGKIRGERFAR; PADSGKIRGERFARL; ADSGKIRGERFARLP; DSGKIRGERFARLPA; SGKIRGERFARLPAG; GKIRGERFARLPAGR; KIRGERFARLPAGRA; IRGERFARLPAGRAI; RGERFARLPAGRAIL; GERFARLPAGRAILL; ERFARLPAGRAILLT; RFARLPAGRAILLTD; FARLPAGRAILLTDS; ARLPAGRAILLTDSD; RLPAGRAILLTDSDS; LPAGRAILLTDSDSP; PAGRAILLTDSDSPT; AGRAILLTDSDSPTY; GRAILLTDSDSPTYV; RAILLTDSDSPTYVQ; AILLTDSDSPTYVQL; ILLTDSDSPTYVQLI; LLTDSDSPTYVQLIN; LTDSDSPTYVQLINP; TDSDSPTYVQLINPL; DSDSPTYVQLINPLV; SDSPTYVQLINPLVD; DSPTYVQLINPLVDA; SPTYVQLINPLVDAA; PTYVQLINPLVDAAA; TYVQLINPLVDAAAV; YVQLINPLVDAAAVS; VQLINPLVDAAAVSG; QLINPLVDAAAVSGE; LINPLVDAAAVSGET; INPLVDAAAVSGETQ; NPLVDAAAVSGETQQ; PLVDAAAVSGETQQK; LVDAAAVSGETQQKG; VDAAAVSGETQQKGS; DAAAVSGETQQKGSQ; AAAVSGETQQKGSQS;<br><br>16 mers:<br>MSRLIFEARRRLAPPS; SRLIFEARRRLAPPSS; RLIFEARRRLAPPSSH; LIFEARRRLAPPSSHQ; IFEARRRLAPPSSHQG; FEARRRLAPPSSHQGT; EARRRLAPPSSHQGTI; ARRRLAPPSSHQGTII; RRRLAPPSSHQGTIII; RRLAPPSSHQGTIIIE; RLAPPSSHQGTIIIEA; LAPPSSHQGTIIIEAP; APPSSHQGTIIIEAPP; PPSSHQGTIIIEAPPE; PSSHQGTIIIEAPPEL; SSHQGTIIIEAPPELP; SHQGTIIIEAPPELPR; HQGTIIIEAPPELPRV; QGTIIIEAPPELPRVI; GTIIIEAPPELPRVIP; TIIIEAPPELPRVIPP; IIIEAPPELPRVIPPS; IIEAPPELPRVIPPSL; IEAPPELPRVIPPSLL; | |

Fig. 29 continued

| | | |
|---|---|---|
| | EAPPELPRVIPPSLLR; APPELPRVIPPSLLRR; PPELPRVIPPSLLRRA;<br>PELPRVIPPSLLRRAL; ELPRVIPPSLLRRALP; LPRVIPPSLLRRALPY;<br>PRVIPPSLLRRALPYL; RVIPPSLLRRALPYLI; VIPPSLLRRALPYLIG;<br>IPPSLLRRALPYLIGI; PPSLLRRALPYLIGIL; PSLLRRALPYLIGILI;<br>SLLRRALPYLIGILIV; LLRRALPYLIGILIVG; LRRALPYLIGILIVGM;<br>RRALPYLIGILIVGMI; RALPYLIGILIVGMIV; ALPYLIGILIVGMIVA;<br>LPYLIGILIVGMIVAL; PYLIGILIVGMIVALV; YLIGILIVGMIVALVA;<br>LIGILIVGMIVALVAT; IGILIVGMIVALVATG; GILIVGMIVALVATGM;<br>ILIVGMIVALVATGMR; LIVGMIVALVATGMRV; IVGMIVALVATGMRVI;<br>VGMIVALVATGMRVIS; GMIVALVATGMRVISP; MIVALVATGMRVISPQ;<br>IVALVATGMRVISPQT; VALVATGMRVISPQTL; ALVATGMRVISPQTLF;<br>LVATGMRVISPQTLFF; VATGMRVISPQTLFFP; ATGMRVISPQTLFFPF;<br>TGMRVISPQTLFFPFV; GMRVISPQTLFFPFVL; MRVISPQTLFFPFVLL;<br>RVISPQTLFFPFVLLL; VISPQTLFFPFVLLLA; ISPQTLFFPFVLLLAA;<br>SPQTLFFPFVLLLAAT; PQTLFFPFVLLLAATA; QTLFFPFVLLLAATAL;<br>TLFFPFVLLLAATALY; LFFPFVLLLAATALYR; FFPFVLLLAATALYRG;<br>FPFVLLLAATALYRGN; PFVLLLAATALYRGND; FVLLLAATALYRGNDK;<br>VLLLAATALYRGNDKK; LLLAATALYRGNDKKM; LLAATALYRGNDKKMR;<br>LAATALYRGNDKKMRT; AATALYRGNDKKMRTE; ATALYRGNDKKMRTEE;<br>TALYRGNDKKMRTEEV; ALYRGNDKKMRTEEVD; LYRGNDKKMRTEEVDA;<br>YRGNDKKMRTEEVDAE; RGNDKKMRTEEVDAER; GNDKKMRTEEVDAERA;<br>NDKKMRTEEVDAERAD; DKKMRTEEVDAERADY; KKMRTEEVDAERADYL;<br>KMRTEEVDAERADYLR; MRTEEVDAERADYLRY; RTEEVDAERADYLRYL;<br>TEEVDAERADYLRYLS; EEVDAERADYLRYLSV; EVDAERADYLRYLSVV;<br>VDAERADYLRYLSVVR; DAERADYLRYLSVVRD; AERADYLRYLSVVRDN;<br>ERADYLRYLSVVRDNI; RADYLRYLSVVRDNIR; ADYLRYLSVVRDNIRA;<br>DYLRYLSVVRDNIRAQ; YLRYLSVVRDNIRAQA; LRYLSVVRDNIRAQAA;<br>RYLSVVRDNIRAQAAE; YLSVVRDNIRAQAAEQ; LSVVRDNIRAQAAEQR;<br>SVVRDNIRAQAAEQRA; VVRDNIRAQAAEQRAS; VRDNIRAQAAEQRASA;<br>RDNIRAQAAEQRASAL; DNIRAQAAEQRASALW; NIRAQAAEQRASALWS;<br>IRAQAAEQRASALWSH; RAQAAEQRASALWSHP; AQAAEQRASALWSHPD;<br>QAAEQRASALWSHPDP; AAEQRASALWSHPDPT; AEQRASALWSHPDPTA;<br>EQRASALWSHPDPTAL; QRASALWSHPDPTALA; RASALWSHPDPTALAS;<br>ASALWSHPDPTALASV; SALWSHPDPTALASVP; ALWSHPDPTALASVPG;<br>LWSHPDPTALASVPGS; WSHPDPTALASVPGSR; SHPDPTALASVPGSRR;<br>HPDPTALASVPGSRRQ; PDPTALASVPGSRRQW; DPTALASVPGSRRQWE;<br>PTALASVPGSRRQWER; TALASVPGSRRQWERD; ALASVPGSRRQWERDP;<br>LASVPGSRRQWERDPH; ASVPGSRRQWERDPHD; SVPGSRRQWERDPHDP;<br>VPGSRRQWERDPHDPD; PGSRRQWERDPHDPDF; GSRRQWERDPHDPDFL;<br>SRRQWERDPHDPDFLV; RRQWERDPHDPDFLVL; RQWERDPHDPDFLVLR;<br>QWERDPHDPDFLVLRA; WERDPHDPDFLVLRAG; ERDPHDPDFLVLRAGR;<br>RDPHDPDFLVLRAGRH; DPHDPDFLVLRAGRHT; PHDPDFLVLRAGRHTV;<br>HDPDFLVLRAGRHTVP; DPDFLVLRAGRHTVPL; PDFLVLRAGRHTVPLA;<br>DFLVLRAGRHTVPLAT; FLVLRAGRHTVPLATT; LVLRAGRHTVPLATTL;<br>VLRAGRHTVPLATTLR; LRAGRHTVPLATTLRV; RAGRHTVPLATTLRVN;<br>AGRHTVPLATTLRVND; GRHTVPLATTLRVNDT; RHTVPLATTLRVNDTA;<br>HTVPLATTLRVNDTAD; TVPLATTLRVNDTADE; VPLATTLRVNDTADEI;<br>PLATTLRVNDTADEID; LATTLRVNDTADEIDL; ATTLRVNDTADEIDLE;<br>TTLRVNDTADEIDLEP; TLRVNDTADEIDLEPV; LRVNDTADEIDLEPVS;<br>RVNDTADEIDLEPVSH; VNDTADEIDLEPVSHS; NDTADEIDLEPVSHSA;<br>DTADEIDLEPVSHSAL; TADEIDLEPVSHSALR; ADEIDLEPVSHSALRS;<br>DEIDLEPVSHSALRSL; EIDLEPVSHSALRSLL; IDLEPVSHSALRSLLD;<br>DLEPVSHSALRSLLDT; LEPVSHSALRSLLDTQ; EPVSHSALRSLLDTQR; | |

Fig. 29 continued

| | | |
|---|---|---|
| | PVSHSALRSLLDTQRS; VSHSALRSLLDTQRSI; SHSALRSLLDTQRSIG; HSALRSLLDTQRSIGD; SALRSLLDTQRSIGDV; ALRSLLDTQRSIGDVP; LRSLLDTQRSIGDVPT; RSLLDTQRSIGDVPTG; SLLDTQRSIGDVPTGI; LLDTQRSIGDVPTGID; LDTQRSIGDVPTGIDL; DTQRSIGDVPTGIDLT; TQRSIGDVPTGIDLTK; QRSIGDVPTGIDLTKV; RSIGDVPTGIDLTKVS; SIGDVPTGIDLTKVSP; IGDVPTGIDLTKVSPI; GDVPTGIDLTKVSPIT; DVPTGIDLTKVSPITV; VPTGIDLTKVSPITVL; PTGIDLTKVSPITVLG; TGIDLTKVSPITVLGE; GIDLTKVSPITVLGER; IDLTKVSPITVLGERA; DLTKVSPITVLGERAQ; LTKVSPITVLGERAQV; TKVSPITVLGERAQVR; KVSPITVLGERAQVRA; VSPITVLGERAQVRAV; SPITVLGERAQVRAVL; PITVLGERAQVRAVLR; ITVLGERAQVRAVLRA; TVLGERAQVRAVLRAW; VLGERAQVRAVLRAWI; LGERAQVRAVLRAWIA; GERAQVRAVLRAWIAQ; ERAQVRAVLRAWIAQA; RAQVRAVLRAWIAQAV; AQVRAVLRAWIAQAVT; QVRAVLRAWIAQAVTW; VRAVLRAWIAQAVTWH; RAVLRAWIAQAVTWHD; AVLRAWIAQAVTWHDP; VLRAWIAQAVTWHDPT; LRAWIAQAVTWHDPTV; RAWIAQAVTWHDPTVL; AWIAQAVTWHDPTVLG; WIAQAVTWHDPTVLGV; IAQAVTWHDPTVLGVA; AQAVTWHDPTVLGVAL; QAVTWHDPTVLGVALA; AVTWHDPTVLGVALAA; VTWHDPTVLGVALAAR; TWHDPTVLGVALAARD; WHDPTVLGVALAARDL; HDPTVLGVALAARDLE; DPTVLGVALAARDLEG; PTVLGVALAARDLEGR; TVLGVALAARDLEGRD; VLGVALAARDLEGRDW; LGVALAARDLEGRDWN; GVALAARDLEGRDWNW; VALAARDLEGRDWNWL; ALAARDLEGRDWNWLK; LAARDLEGRDWNWLKW; AARDLEGRDWNWLKWL; ARDLEGRDWNWLKWLP; RDLEGRDWNWLKWLPH; DLEGRDWNWLKWLPHV; LEGRDWNWLKWLPHVD; EGRDWNWLKWLPHVDI; GRDWNWLKWLPHVDIP; RDWNWLKWLPHVDIPG; DWNWLKWLPHVDIPGR; WNWLKWLPHVDIPGRL; NWLKWLPHVDIPGRLD; WLKWLPHVDIPGRLDA; LKWLPHVDIPGRLDAL; KWLPHVDIPGRLDALG; WLPHVDIPGRLDALGP; LPHVDIPGRLDALGPA; PHVDIPGRLDALGPAR; HVDIPGRLDALGPARN; VDIPGRLDALGPARNL; DIPGRLDALGPARNLS; IPGRLDALGPARNLST; PGRLDALGPARNLSTD; GRLDALGPARNLSTDP; RLDALGPARNLSTDPD; LDALGPARNLSTDPDE; DALGPARNLSTDPDEL; ALGPARNLSTDPDELI; LGPARNLSTDPDELIA; GPARNLSTDPDELIAL; PARNLSTDPDELIALL; ARNLSTDPDELIALLG; RNLSTDPDELIALLGP; NLSTDPDELIALLGPV; LSTDPDELIALLGPVL; STDPDELIALLGPVLA; TDPDELIALLGPVLAD; DPDELIALLGPVLADR; PDELIALLGPVLADRP; DELIALLGPVLADRPA; ELIALLGPVLADRPAF; LIALLGPVLADRPAFT; IALLGPVLADRPAFTG; ALLGPVLADRPAFTGQ; LLGPVLADRPAFTGQP; LGPVLADRPAFTGQPT; GPVLADRPAFTGQPTD; PVLADRPAFTGQPTDA; VLADRPAFTGQPTDAL; LADRPAFTGQPTDALR; ADRPAFTGQPTDALRH; DRPAFTGQPTDALRHL; RPAFTGQPTDALRHLL; PAFTGQPTDALRHLLI; AFTGQPTDALRHLLIV; FTGQPTDALRHLLIVV; TGQPTDALRHLLIVVD; GQPTDALRHLLIVVDD; QPTDALRHLLIVVDDP; PTDALRHLLIVVDDPD; TDALRHLLIVVDDPDY; DALRHLLIVVDDPDYD; ALRHLLIVVDDPDYDL; LRHLLIVVDDPDYDLG; RHLLIVVDDPDYDLGA; HLLIVVDDPDYDLGAS; LLIVVDDPDYDLGASP; LIVVDDPDYDLGASPL; IVVDDPDYDLGASPLA; VVDDPDYDLGASPLAV; VDDPDYDLGASPLAVG; DDPDYDLGASPLAVGR; DPDYDLGASPLAVGRA; PDYDLGASPLAVGRAG; DYDLGASPLAVGRAGV; YDLGASPLAVGRAGVT; DLGASPLAVGRAGVTV; LGASPLAVGRAGVTVV; GASPLAVGRAGVTVVH; ASPLAVGRAGVTVVHC; SPLAVGRAGVTVVHCS; PLAVGRAGVTVVHCSA; LAVGRAGVTVVHCSAS; AVGRAGVTVVHCSASA; VGRAGVTVVHCSASAP; GRAGVTVVHCSASAPH; RAGVTVVHCSASAPHR; AGVTVVHCSASAPHRE; GVTVVHCSASAPHREQ; VTVVHCSASAPHREQY; TVVHCSASAPHREQYS; VVHCSASAPHREQYSD; VHCSASAPHREQYSDP; HCSASAPHREQYSDPE; CSASAPHREQYSDPEK; | |

Fig. 29 continued

SASAPHREQYSDPEKP; ASAPHREQYSDPEKPI; SAPHREQYSDPEKPIL;
APHREQYSDPEKPILR; PHREQYSDPEKPILRV; HREQYSDPEKPILRVA;
REQYSDPEKPILRVAH; EQYSDPEKPILRVAHG; QYSDPEKPILRVAHGA;
YSDPEKPILRVAHGAI; SDPEKPILRVAHGAIE; DPEKPILRVAHGAIER;
PEKPILRVAHGAIERW; EKPILRVAHGAIERWQ; KPILRVAHGAIERWQT;
PILRVAHGAIERWQTG; ILRVAHGAIERWQTGG; LRVAHGAIERWQTGGW;
RVAHGAIERWQTGGWQ; VAHGAIERWQTGGWQP; AHGAIERWQTGGWQPY;
HGAIERWQTGGWQPYI; GAIERWQTGGWQPYID; AIERWQTGGWQPYIDA;
IERWQTGGWQPYIDAA; ERWQTGGWQPYIDAAD; RWQTGGWQPYIDAADQ;
WQTGGWQPYIDAADQF; QTGGWQPYIDAADQFS; TGGWQPYIDAADQFSA;
GGWQPYIDAADQFSAD; GWQPYIDAADQFSADE; WQPYIDAADQFSADEA;
QPYIDAADQFSADEAA; PYIDAADQFSADEAAH; YIDAADQFSADEAAHL;
IDAADQFSADEAAHLA; DAADQFSADEAAHLAR; AADQFSADEAAHLARR;
ADQFSADEAAHLARRL; DQFSADEAAHLARRLS; QFSADEAAHLARRLSR;
FSADEAAHLARRLSRW; SADEAAHLARRLSRWD; ADEAAHLARRLSRWDS;
DEAAHLARRLSRWDSN; EAAHLARRLSRWDSNP; AAHLARRLSRWDSNPT;
AHLARRLSRWDSNPTH; HLARRLSRWDSNPTHA; LARRLSRWDSNPTHAG;
ARRLSRWDSNPTHAGL; RRLSRWDSNPTHAGLR; RLSRWDSNPTHAGLRS;
LSRWDSNPTHAGLRSA; SRWDSNPTHAGLRSAA; RWDSNPTHAGLRSAAT;
WDSNPTHAGLRSAATR; DSNPTHAGLRSAATRG; SNPTHAGLRSAATRGA;
NPTHAGLRSAATRGAS; PTHAGLRSAATRGASF; THAGLRSAATRGASFT;
HAGLRSAATRGASFTT; AGLRSAATRGASFTTL; GLRSAATRGASFTTLL;
LRSAATRGASFTTLLG; RSAATRGASFTTLLGI; SAATRGASFTTLLGIE;
AATRGASFTTLLGIED; ATRGASFTTLLGIEDA; TRGASFTTLLGIEDAS;
RGASFTTLLGIEDASR; GASFTTLLGIEDASRL; ASFTTLLGIEDASRLD;
SFTTLLGIEDASRLDV; FTTLLGIEDASRLDVP; TTLLGIEDASRLDVPA;
TLLGIEDASRLDVPAL; LLGIEDASRLDVPALW; LGIEDASRLDVPALWA;
GIEDASRLDVPALWAP; IEDASRLDVPALWAPR; EDASRLDVPALWAPRR;
DASRLDVPALWAPRRR; ASRLDVPALWAPRRRD; SRLDVPALWAPRRRDE;
RLDVPALWAPRRRDEE; LDVPALWAPRRRDEEL; DVPALWAPRRRDEELR;
VPALWAPRRRDEELRV; PALWAPRRRDEELRVP; ALWAPRRRDEELRVPI;
LWAPRRRDEELRVPIG; WAPRRRDEELRVPIGV; APRRRDEELRVPIGVT;
PRRRDEELRVPIGVTG; RRRDEELRVPIGVTGT; RRDEELRVPIGVTGTG;
RDEELRVPIGVTGTGE; DEELRVPIGVTGTGEP; EELRVPIGVTGTGEPL;
ELRVPIGVTGTGEPLM; LRVPIGVTGTGEPLMF; RVPIGVTGTGEPLMFD;
VPIGVTGTGEPLMFDL; PIGVTGTGEPLMFDLK; IGVTGTGEPLMFDLKD;
GVTGTGEPLMFDLKDE; VTGTGEPLMFDLKDEA; TGTGEPLMFDLKDEAE;
GTGEPLMFDLKDEAEG; TGEPLMFDLKDEAEGG; GEPLMFDLKDEAEGGM;
EPLMFDLKDEAEGGMG; PLMFDLKDEAEGGMGP; LMFDLKDEAEGGMGPH;
MFDLKDEAEGGMGPHG; FDLKDEAEGGMGPHGL; DLKDEAEGGMGPHGLM;
LKDEAEGGMGPHGLMI; KDEAEGGMGPHGLMIG; DEAEGGMGPHGLMIGM;
EAEGGMGPHGLMIGMT; AEGGMGPHGLMIGMTG; EGGMGPHGLMIGMTGS;
GGMGPHGLMIGMTGSG; GMGPHGLMIGMTGSGK; MGPHGLMIGMTGSGKS;
GPHGLMIGMTGSGKSQ; PHGLMIGMTGSGKSQT; HGLMIGMTGSGKSQTL;
GLMIGMTGSGKSQTLM; LMIGMTGSGKSQTLMS; MIGMTGSGKSQTLMSI;
IGMTGSGKSQTLMSIL; GMTGSGKSQTLMSILL; MTGSGKSQTLMSILLS;
TGSGKSQTLMSILLSL; GSGKSQTLMSILLSLL; SGKSQTLMSILLSLLT;
GKSQTLMSILLSLLTT; KSQTLMSILLSLLTTH; SQTLMSILLSLLTTHS;
QTLMSILLSLLTTHSA; TLMSILLSLLTTHSAE; LMSILLSLLTTHSAER;
MSILLSLLTTHSAERL; SILLSLLTTHSAERLI; ILLSLLTTHSAERLIV;
LLSLLTTHSAERLIVI; LSLLTTHSAERLIVIY; SLLTTHSAERLIVIYA;
LLTTHSAERLIVIYAD; LTTHSAERLIVIYADF; TTHSAERLIVIYADFK;
THSAERLIVIYADFKG; HSAERLIVIYADFKGE; SAERLIVIYADFKGEA;

Fig. 29 continued

| | | |
|---|---|---|
| | AERLIVIYADFKGEAG; ERLIVIYADFKGEAGA; RLIVIYADFKGEAGAD;<br>LIVIYADFKGEAGADS; IVIYADFKGEAGADSF; VIYADFKGEAGADSFR;<br>IYADFKGEAGADSFRD; YADFKGEAGADSFRDF; ADFKGEAGADSFRDFP;<br>DFKGEAGADSFRDFPQ; FKGEAGADSFRDFPQV; KGEAGADSFRDFPQVV;<br>GEAGADSFRDFPQVVA; EAGADSFRDFPQVVAV; AGADSFRDFPQVVAVI;<br>GADSFRDFPQVVAVIS; ADSFRDFPQVVAVISN; DSFRDFPQVVAVISNM;<br>SFRDFPQVVAVISNMA; FRDFPQVVAVISNMAE; RDFPQVVAVISNMAEK;<br>DFPQVVAVISNMAEKK; FPQVVAVISNMAEKKS; PQVVAVISNMAEKKSL;<br>QVVAVISNMAEKKSLA; VVAVISNMAEKKSLAD; VAVISNMAEKKSLADR;<br>AVISNMAEKKSLADRF; VISNMAEKKSLADRFA; ISNMAEKKSLADRFAD;<br>SNMAEKKSLADRFADT; NMAEKKSLADRFADTL; MAEKKSLADRFADTLR;<br>AEKKSLADRFADTLRG; EKKSLADRFADTLRGE; KKSLADRFADTLRGEV;<br>KSLADRFADTLRGEVA; SLADRFADTLRGEVAR; LADRFADTLRGEVARR;<br>ADRFADTLRGEVARRE; DRFADTLRGEVARREM; RFADTLRGEVARREML;<br>FADTLRGEVARREMLL; ADTLRGEVARREMLLR; DTLRGEVARREMLLRE;<br>TLRGEVARREMLLREA; LRGEVARREMLLREAG; RGEVARREMLLREAGR;<br>GEVARREMLLREAGRK; EVARREMLLREAGRKV; VARREMLLREAGRKVQ;<br>ARREMLLREAGRKVQG; RREMLLREAGRKVQGS; REMLLREAGRKVQGSA;<br>EMLLREAGRKVQGSAF; MLLREAGRKVQGSAFN; LLREAGRKVQGSAFNS;<br>LREAGRKVQGSAFNSV; REAGRKVQGSAFNSVL; EAGRKVQGSAFNSVLE;<br>AGRKVQGSAFNSVLEY; GRKVQGSAFNSVLEYE; RKVQGSAFNSVLEYEN;<br>KVQGSAFNSVLEYENA; VQGSAFNSVLEYENAI; QGSAFNSVLEYENAIA;<br>GSAFNSVLEYENAIAA; SAFNSVLEYENAIAAG; AFNSVLEYENAIAAGH;<br>FNSVLEYENAIAAGHS; NSVLEYENAIAAGHSL; SVLEYENAIAAGHSLP;<br>VLEYENAIAAGHSLPP; LEYENAIAAGHSLPPI; EYENAIAAGHSLPPIP;<br>YENAIAAGHSLPPIPT; ENAIAAGHSLPPIPTL; NAIAAGHSLPPIPTLF;<br>AIAAGHSLPPIPTLFV; IAAGHSLPPIPTLFVV; AAGHSLPPIPTLFVVA;<br>AGHSLPPIPTLFVVAD; GHSLPPIPTLFVVADE; HSLPPIPTLFVVADEF;<br>SLPPIPTLFVVADEFT; LPPIPTLFVVADEFTL; PPIPTLFVVADEFTLM;<br>PIPTLFVVADEFTLML; IPTLFVVADEFTLMLA; PTLFVVADEFTLMLAD;<br>TLFVVADEFTLMLADH; LFVVADEFTLMLADHP; FVVADEFTLMLADHPE;<br>VVADEFTLMLADHPEY; VADEFTLMLADHPEYA; ADEFTLMLADHPEYAE;<br>DEFTLMLADHPEYAEL; EFTLMLADHPEYAELF; FTLMLADHPEYAELFD;<br>TLMLADHPEYAELFDY; LMLADHPEYAELFDYV; MLADHPEYAELFDYVA;<br>LADHPEYAELFDYVAR; ADHPEYAELFDYVARK; DHPEYAELFDYVARKG;<br>HPEYAELFDYVARKGR; PEYAELFDYVARKGRS; EYAELFDYVARKGRSF;<br>YAELFDYVARKGRSFR; AELFDYVARKGRSFRI; ELFDYVARKGRSFRIH;<br>LFDYVARKGRSFRIHI; FDYVARKGRSFRIHIL; DYVARKGRSFRIHILF;<br>YVARKGRSFRIHILFA; VARKGRSFRIHILFAS; ARKGRSFRIHILFASQ;<br>RKGRSFRIHILFASQT; KGRSFRIHILFASQTL; GRSFRIHILFASQTLD;<br>RSFRIHILFASQTLDV; SFRIHILFASQTLDVG; FRIHILFASQTLDVGK;<br>RIHILFASQTLDVGKI; IHILFASQTLDVGKIK; HILFASQTLDVGKIKD;<br>ILFASQTLDVGKIKDI; LFASQTLDVGKIKDID; FASQTLDVGKIKDIDK;<br>ASQTLDVGKIKDIDKN; SQTLDVGKIKDIDKNT; QTLDVGKIKDIDKNTA;<br>TLDVGKIKDIDKNTAY; LDVGKIKDIDKNTAYR; DVGKIKDIDKNTAYRI;<br>VGKIKDIDKNTAYRIG; GKIKDIDKNTAYRIGL; KIKDIDKNTAYRIGLK;<br>IKDIDKNTAYRIGLKV; KDIDKNTAYRIGLKVA; DIDKNTAYRIGLKVAS;<br>IDKNTAYRIGLKVASP; DKNTAYRIGLKVASPS; KNTAYRIGLKVASPSV;<br>NTAYRIGLKVASPSVS; TAYRIGLKVASPSVSR; AYRIGLKVASPSVSRQ;<br>YRIGLKVASPSVSRQI; RIGLKVASPSVSRQII; IGLKVASPSVSRQIIG;<br>GLKVASPSVSRQIIGV; LKVASPSVSRQIIGVE; KVASPSVSRQIIGVED;<br>VASPSVSRQIIGVEDA; ASPSVSRQIIGVEDAY; SPSVSRQIIGVEDAYH;<br>PSVSRQIIGVEDAYHI; SVSRQIIGVEDAYHIE; VSRQIIGVEDAYHIES; | |

Fig. 29 continued

| | | |
|---|---|---|
| | SRQIIGVEDAYHIESG; RQIIGVEDAYHIESGK; QIIGVEDAYHIESGKE;<br>IIGVEDAYHIESGKEH; IGVEDAYHIESGKEHK; GVEDAYHIESGKEHKG;<br>VEDAYHIESGKEHKGV; EDAYHIESGKEHKGVG; DAYHIESGKEHKGVGF;<br>AYHIESGKEHKGVGFL; YHIESGKEHKGVGFLV; HIESGKEHKGVGFLVP;<br>IESGKEHKGVGFLVPA; ESGKEHKGVGFLVPAP; SGKEHKGVGFLVPAPG;<br>GKEHKGVGFLVPAPGA; KEHKGVGFLVPAPGAT; EHKGVGFLVPAPGATP;<br>HKGVGFLVPAPGATPI; KGVGFLVPAPGATPIR; GVGFLVPAPGATPIRF;<br>VGFLVPAPGATPIRFR; GFLVPAPGATPIRFRS; FLVPAPGATPIRFRST;<br>LVPAPGATPIRFRSTY; VPAPGATPIRFRSTYV; PAPGATPIRFRSTYVD;<br>APGATPIRFRSTYVDG; PGATPIRFRSTYVDGI; GATPIRFRSTYVDGIY;<br>ATPIRFRSTYVDGIYE; TPIRFRSTYVDGIYEP; PIRFRSTYVDGIYEPP;<br>IRFRSTYVDGIYEPPQ; RFRSTYVDGIYEPPQT; FRSTYVDGIYEPPQTA;<br>RSTYVDGIYEPPQTAK; STYVDGIYEPPQTAKA; TYVDGIYEPPQTAKAV;<br>YVDGIYEPPQTAKAVV; VDGIYEPPQTAKAVVV; DGIYEPPQTAKAVVVQ;<br>GIYEPPQTAKAVVVQS; IYEPPQTAKAVVVQSV; YEPPQTAKAVVVQSVP;<br>EPPQTAKAVVVQSVPE; PPQTAKAVVVQSVPEP; PQTAKAVVVQSVPEPK;<br>QTAKAVVVQSVPEPKL; TAKAVVVQSVPEPKLF; AKAVVVQSVPEPKLFT;<br>KAVVVQSVPEPKLFTA; AVVVQSVPEPKLFTAA; VVVQSVPEPKLFTAAA;<br>VVQSVPEPKLFTAAAV; VQSVPEPKLFTAAAVE; QSVPEPKLFTAAAVEP;<br>SVPEPKLFTAAAVEPD; VPEPKLFTAAAVEPDP; PEPKLFTAAAVEPDPG;<br>EPKLFTAAAVEPDPGT; PKLFTAAAVEPDPGTV; KLFTAAAVEPDPGTVI;<br>LFTAAAVEPDPGTVIA; FTAAAVEPDPGTVIAD; TAAAVEPDPGTVIADT;<br>AAAVEPDPGTVIADTD; AAVEPDPGTVIADTDE; AVEPDPGTVIADTDEQ;<br>VEPDPGTVIADTDEQE; EPDPGTVIADTDEQEP; PDPGTVIADTDEQEPA;<br>DPGTVIADTDEQEPAD; PGTVIADTDEQEPADP; GTVIADTDEQEPADPP;<br>TVIADTDEQEPADPPR; VIADTDEQEPADPPRK; IADTDEQEPADPPRKL;<br>ADTDEQEPADPPRKLI; DTDEQEPADPPRKLIA; TDEQEPADPPRKLIAT;<br>DEQEPADPPRKLIATI; EQEPADPPRKLIATIG; QEPADPPRKLIATIGE;<br>EPADPPRKLIATIGEQ; PADPPRKLIATIGEQL; ADPPRKLIATIGEQLA;<br>DPPRKLIATIGEQLAR; PPRKLIATIGEQLARY; PRKLIATIGEQLARYG;<br>RKLIATIGEQLARYGP; KLIATIGEQLARYGPR; LIATIGEQLARYGPRA;<br>IATIGEQLARYGPRAP; ATIGEQLARYGPRAPQ; TIGEQLARYGPRAPQL;<br>IGEQLARYGPRAPQLW; GEQLARYGPRAPQLWL; EQLARYGPRAPQLWLP;<br>QLARYGPRAPQLWLPP; LARYGPRAPQLWLPPL; ARYGPRAPQLWLPPLD;<br>RYGPRAPQLWLPPLDE; YGPRAPQLWLPPLDET; GPRAPQLWLPPLDETI;<br>PRAPQLWLPPLDETIP; RAPQLWLPPLDETIPL; APQLWLPPLDETIPLS;<br>PQLWLPPLDETIPLSA; QLWLPPLDETIPLSAA; LWLPPLDETIPLSAAL;<br>WLPPLDETIPLSAALA; LPPLDETIPLSAALAR; PPLDETIPLSAALARA;<br>PLDETIPLSAALARAG; LDETIPLSAALARAGV; DETIPLSAALARAGVG;<br>ETIPLSAALARAGVGP; TIPLSAALARAGVGPR; IPLSAALARAGVGPRQ;<br>PLSAALARAGVGPRQW; LSAALARAGVGPRQWR; SAALARAGVGPRQWRW;<br>AALARAGVGPRQWRWP; ALARAGVGPRQWRWPL; LARAGVGPRQWRWPLG;<br>ARAGVGPRQWRWPLGE; RAGVGPRQWRWPLGEI; AGVGPRQWRWPLGEID;<br>GVGPRQWRWPLGEIDR; VGPRQWRWPLGEIDRP; GPRQWRWPLGEIDRPF;<br>PRQWRWPLGEIDRPFE; RQWRWPLGEIDRPFEM; QWRWPLGEIDRPFEMR;<br>WRWPLGEIDRPFEMRR; RWPLGEIDRPFEMRRD; WPLGEIDRPFEMRRDP;<br>PLGEIDRPFEMRRDPL; LGEIDRPFEMRRDPLV; GEIDRPFEMRRDPLVF;<br>EIDRPFEMRRDPLVFD; IDRPFEMRRDPLVFDA; DRPFEMRRDPLVFDAR;<br>RPFEMRRDPLVFDARS; PFEMRRDPLVFDARSS; FEMRRDPLVFDARSSA;<br>EMRRDPLVFDARSSAG; MRRDPLVFDARSSAGN; RRDPLVFDARSSAGNM;<br>RDPLVFDARSSAGNMV; DPLVFDARSSAGNMVI; PLVFDARSSAGNMVIH;<br>LVFDARSSAGNMVIHG; VFDARSSAGNMVIHGG; FDARSSAGNMVIHGGP;<br>DARSSAGNMVIHGGPK; ARSSAGNMVIHGGPKS; RSSAGNMVIHGGPKSG; | |

Fig. 29 continued

SSAGNMVIHGGPKSGK; SAGNMVIHGGPKSGKS; AGNMVIHGGPKSGKST;
GNMVIHGGPKSGKSTA; NMVIHGGPKSGKSTAL; MVIHGGPKSGKSTALQ;
VIHGGPKSGKSTALQT; IHGGPKSGKSTALQTF; HGGPKSGKSTALQTFI;
GGPKSGKSTALQTFIL; GPKSGKSTALQTFILS; PKSGKSTALQTFILSA;
KSGKSTALQTFILSAA; SGKSTALQTFILSAAS; GKSTALQTFILSAASL;
KSTALQTFILSAASLH; STALQTFILSAASLHS; TALQTFILSAASLHSP;
ALQTFILSAASLHSPH; LQTFILSAASLHSPHE; QTFILSAASLHSPHEV;
TFILSAASLHSPHEVS; FILSAASLHSPHEVSF; ILSAASLHSPHEVSFY;
LSAASLHSPHEVSFYC; SAASLHSPHEVSFYCL; AASLHSPHEVSFYCLD;
ASLHSPHEVSFYCLDY; SLHSPHEVSFYCLDYG; LHSPHEVSFYCLDYGG;
HSPHEVSFYCLDYGGG; SPHEVSFYCLDYGGGQ; PHEVSFYCLDYGGGQL;
HEVSFYCLDYGGGQLR; EVSFYCLDYGGGQLRA; VSFYCLDYGGGQLRAL;
SFYCLDYGGGQLRALQ; FYCLDYGGGQLRALQD; YCLDYGGGQLRALQDL;
CLDYGGGQLRALQDLA; LDYGGGQLRALQDLAH; DYGGGQLRALQDLAHV;
YGGGQLRALQDLAHVG; GGGQLRALQDLAHVGS; GGQLRALQDLAHVGSV;
GQLRALQDLAHVGSVA; QLRALQDLAHVGSVAS; LRALQDLAHVGSVASA;
RALQDLAHVGSVASAL; ALQDLAHVGSVASALE; LQDLAHVGSVASALEP;
QDLAHVGSVASALEPE; DLAHVGSVASALEPER; LAHVGSVASALEPERI;
AHVGSVASALEPERIR; HVGSVASALEPERIRR; VGSVASALEPERIRRT;
GSVASALEPERIRRTF; SVASALEPERIRRTFG; VASALEPERIRRTFGE;
ASALEPERIRRTFGEL; SALEPERIRRTFGELE; ALEPERIRRTFGELEQ;
LEPERIRRTFGELEQL; EPERIRRTFGELEQLL; PERIRRTFGELEQLLL;
ERIRRTFGELEQLLLS; RIRRTFGELEQLLLSR; IRRTFGELEQLLLSRQ;
RRTFGELEQLLLSRQQ; RTFGELEQLLLSRQQR; TFGELEQLLLSRQQRE;
FGELEQLLLSRQQREV; GELEQLLLSRQQREVF; ELEQLLLSRQQREVFR;
LEQLLLSRQQREVFRD; EQLLLSRQQREVFRDR; QLLLSRQQREVFRDRG;
LLLSRQQREVFRDRGA; LLSRQQREVFRDRGAN; LSRQQREVFRDRGANG;
SRQQREVFRDRGANGS; RQQREVFRDRGANGST; QQREVFRDRGANGSTP;
QREVFRDRGANGSTPD; REVFRDRGANGSTPDD; EVFRDRGANGSTPDDG;
VFRDRGANGSTPDDGF; FRDRGANGSTPDDGFG; RDRGANGSTPDDGFGE;
DRGANGSTPDDGFGEV; RGANGSTPDDGFGEVF; GANGSTPDDGFGEVFL;
ANGSTPDDGFGEVFLV; NGSTPDDGFGEVFLVI; GSTPDDGFGEVFLVID;
STPDDGFGEVFLVIDN; TPDDGFGEVFLVIDNL; PDDGFGEVFLVIDNLY;
DDGFGEVFLVIDNLYG; DGFGEVFLVIDNLYGF; GFGEVFLVIDNLYGFG;
FGEVFLVIDNLYGFGR; GEVFLVIDNLYGFGRD; EVFLVIDNLYGFGRDN;
VFLVIDNLYGFGRDNT; FLVIDNLYGFGRDNTD; LVIDNLYGFGRDNTDQ;
VIDNLYGFGRDNTDQF; IDNLYGFGRDNTDQFN; DNLYGFGRDNTDQFNT;
NLYGFGRDNTDQFNTR; LYGFGRDNTDQFNTRN; YGFGRDNTDQFNTRNP;
GFGRDNTDQFNTRNPL; FGRDNTDQFNTRNPLL; GRDNTDQFNTRNPLLA;
RDNTDQFNTRNPLLAR; DNTDQFNTRNPLLARV; NTDQFNTRNPLLARVT;
TDQFNTRNPLLARVTE; DQFNTRNPLLARVTEL; QFNTRNPLLARVTELV;
FNTRNPLLARVTELVN; NTRNPLLARVTELVNV; TRNPLLARVTELVNVG;
RNPLLARVTELVNVGL; NPLLARVTELVNVGLA; PLLARVTELVNVGLAY;
LLARVTELVNVGLAYG; LARVTELVNVGLAYGI; ARVTELVNVGLAYGIH;
RVTELVNVGLAYGIHV; VTELVNVGLAYGIHVI; TELVNVGLAYGIHVII;
ELVNVGLAYGIHVIIT; LVNVGLAYGIHVIITT; VNVGLAYGIHVIITTP;
NVGLAYGIHVIITTPS; VGLAYGIHVIITTPSW; GLAYGIHVIITTPSWL;
LAYGIHVIITTPSWLE; AYGIHVIITTPSWLEV; YGIHVIITTPSWLEVP;
GIHVIITTPSWLEVPL; IHVIITTPSWLEVPLA; HVIITTPSWLEVPLAM;
VIITTPSWLEVPLAMR; IITTPSWLEVPLAMRD; ITTPSWLEVPLAMRDG;
TTPSWLEVPLAMRDGL; TPSWLEVPLAMRDGLG; PSWLEVPLAMRDGLGL;
SWLEVPLAMRDGLGLR; WLEVPLAMRDGLGLRL; LEVPLAMRDGLGLRLE;
EVPLAMRDGLGLRLEL; VPLAMRDGLGLRLELR; PLAMRDGLGLRLELRL;

Fig. 29 continued

| | | |
|---|---|---|
| | LAMRDGLGLRLELRLH; AMRDGLGLRLELRLHD; MRDGLGLRLELRLHDA;<br>RDGLGLRLELRLHDAR; DGLGLRLELRLHDARD; GLGLRLELRLHDARDS;<br>LGLRLELRLHDARDSN; GLRLELRLHDARDSNV; LRLELRLHDARDSNVR;<br>RLELRLHDARDSNVRV; LELRLHDARDSNVRVV; ELRLHDARDSNVRVVG;<br>LRLHDARDSNVRVVGA; RLHDARDSNVRVVGAL; LHDARDSNVRVVGALR;<br>HDARDSNVRVVGALRR; DARDSNVRVVGALRRP; ARDSNVRVVGALRRPA;<br>RDSNVRVVGALRRPAD; DSNVRVVGALRRPADA; SNVRVVGALRRPADAV;<br>NVRVVGALRRPADAVP; VRVVGALRRPADAVPH; RVVGALRRPADAVPHD;<br>VVGALRRPADAVPHDQ; VGALRRPADAVPHDQP; GALRRPADAVPHDQPG;<br>ALRRPADAVPHDQPGR; LRRPADAVPHDQPGRG; RRPADAVPHDQPGRGL;<br>RPADAVPHDQPGRGLT; PADAVPHDQPGRGLTM; ADAVPHDQPGRGLTMA;<br>DAVPHDQPGRGLTMAA; AVPHDQPGRGLTMAAE; VPHDQPGRGLTMAAEH;<br>PHDQPGRGLTMAAEHF; HDQPGRGLTMAAEHFL; DQPGRGLTMAAEHFLF;<br>QPGRGLTMAAEHFLFA; PGRGLTMAAEHFLFAA; GRGLTMAAEHFLFAAP;<br>RGLTMAAEHFLFAAPE; GLTMAAEHFLFAAPEL; LTMAAEHFLFAAPELD;<br>TMAAEHFLFAAPELDA; MAAEHFLFAAPELDAQ; AAEHFLFAAPELDAQT;<br>AEHFLFAAPELDAQTN; EHFLFAAPELDAQTNP; HFLFAAPELDAQTNPV;<br>FLFAAPELDAQTNPVA; LFAAPELDAQTNPVAA; FAAPELDAQTNPVAAI;<br>AAPELDAQTNPVAAIN; APELDAQTNPVAAINA; PELDAQTNPVAAINAR;<br>ELDAQTNPVAAINARY; LDAQTNPVAAINARYP; DAQTNPVAAINARYPG;<br>AQTNPVAAINARYPGM; QTNPVAAINARYPGMA; TNPVAAINARYPGMAA;<br>NPVAAINARYPGMAAP; PVAAINARYPGMAAPP; VAAINARYPGMAAPPV;<br>AAINARYPGMAAPPVR; AINARYPGMAAPPVRL; INARYPGMAAPPVRLL;<br>NARYPGMAAPPVRLLP; ARYPGMAAPPVRLLPT; RYPGMAAPPVRLLPTN;<br>YPGMAAPPVRLLPTNL; PGMAAPPVRLLPTNLA; GMAAPPVRLLPTNLAP;<br>MAAPPVRLLPTNLAPH; AAPPVRLLPTNLAPHA; APPVRLLPTNLAPHAV;<br>PPVRLLPTNLAPHAVG; PVRLLPTNLAPHAVGE; VRLLPTNLAPHAVGEL;<br>RLLPTNLAPHAVGELY; LLPTNLAPHAVGELYR; LPTNLAPHAVGELYRG;<br>PTNLAPHAVGELYRGP; TNLAPHAVGELYRGPD; NLAPHAVGELYRGPDQ;<br>LAPHAVGELYRGPDQL; APHAVGELYRGPDQLV; PHAVGELYRGPDQLVI;<br>HAVGELYRGPDQLVIG; AVGELYRGPDQLVIGQ; VGELYRGPDQLVIGQR;<br>GELYRGPDQLVIGQRE; ELYRGPDQLVIGQREE; LYRGPDQLVIGQREED;<br>YRGPDQLVIGQREEDL; RGPDQLVIGQREEDLA; GPDQLVIGQREEDLAP;<br>PDQLVIGQREEDLAPV; DQLVIGQREEDLAPVI; QLVIGQREEDLAPVIL;<br>LVIGQREEDLAPVILD; VIGQREEDLAPVILDL; IGQREEDLAPVILDLA;<br>GQREEDLAPVILDLAA; QREEDLAPVILDLAAN; REEDLAPVILDLAANP;<br>EEDLAPVILDLAANPL; EDLAPVILDLAANPLL; DLAPVILDLAANPLLM;<br>LAPVILDLAANPLLMV; APVILDLAANPLLMVF; PVILDLAANPLLMVFG;<br>VILDLAANPLLMVFGD; ILDLAANPLLMVFGDA; LDLAANPLLMVFGDAR;<br>DLAANPLLMVFGDARS; LAANPLLMVFGDARSG; AANPLLMVFGDARSGK;<br>ANPLLMVFGDARSGKT; NPLLMVFGDARSGKTT; PLLMVFGDARSGKTTL;<br>LLMVFGDARSGKTTLL; LMVFGDARSGKTTLLR; MVFGDARSGKTTLLRH;<br>VFGDARSGKTTLLRHI; FGDARSGKTTLLRHII; GDARSGKTTLLRHIIR;<br>DARSGKTTLLRHIIRT; ARSGKTTLLRHIIRTV; RSGKTTLLRHIIRTVR;<br>SGKTTLLRHIIRTVRE; GKTTLLRHIIRTVREH; KTTLLRHIIRTVREHS;<br>TTLLRHIIRTVREHST; TLLRHIIRTVREHSTA; LLRHIIRTVREHSTAD;<br>LRHIIRTVREHSTADR; RHIIRTVREHSTADRV; HIIRTVREHSTADRVA;<br>IIRTVREHSTADRVAF; IRTVREHSTADRVAFT; RTVREHSTADRVAFTV;<br>TVREHSTADRVAFTVL; VREHSTADRVAFTVLD; REHSTADRVAFTVLDR;<br>EHSTADRVAFTVLDRR; HSTADRVAFTVLDRRL; STADRVAFTVLDRRLH;<br>TADRVAFTVLDRRLHL; ADRVAFTVLDRRLHLV; DRVAFTVLDRRLHLVD;<br>RVAFTVLDRRLHLVDE; VAFTVLDRRLHLVDEP; AFTVLDRRLHLVDEPL;<br>FTVLDRRLHLVDEPLF; TVLDRRLHLVDEPLFP; VLDRRLHLVDEPLFPD; | |

Fig. 29 continued

| | | |
|---|---|---|
| | LDRRLHLVDEPLFPDN; DRRLHLVDEPLFPDNE; RRLHLVDEPLFPDNEY;<br>RLHLVDEPLFPDNEYT; LHLVDEPLFPDNEYTA; HLVDEPLFPDNEYTAN;<br>LVDEPLFPDNEYTANI; VDEPLFPDNEYTANID; DEPLFPDNEYTANIDR;<br>EPLFPDNEYTANIDRI; PLFPDNEYTANIDRII; LFPDNEYTANIDRIIP;<br>FPDNEYTANIDRIIPA; PDNEYTANIDRIIPAM; DNEYTANIDRIIPAML;<br>NEYTANIDRIIPAMLG; EYTANIDRIIPAMLGL; YTANIDRIIPAMLGLA;<br>TANIDRIIPAMLGLAN; ANIDRIIPAMLGLANL; NIDRIIPAMLGLANLI;<br>IDRIIPAMLGLANLIE; DRIIPAMLGLANLIEA; RIIPAMLGLANLIEAR;<br>IIPAMLGLANLIEARR; IPAMLGLANLIEARRP; PAMLGLANLIEARRPP;<br>AMLGLANLIEARRPPA; MLGLANLIEARRPPAG; LGLANLIEARRPPAGM;<br>GLANLIEARRPPAGMS; LANLIEARRPPAGMSA; ANLIEARRPPAGMSAA;<br>NLIEARRPPAGMSAAE; LIEARRPPAGMSAAEL; IEARRPPAGMSAAELS;<br>EARRPPAGMSAAELSR; ARRPPAGMSAAELSRW; RRPPAGMSAAELSRWT;<br>RPPAGMSAAELSRWTF; PPAGMSAAELSRWTFA; PAGMSAAELSRWTFAG;<br>AGMSAAELSRWTFAGH; GMSAAELSRWTFAGHT; MSAAELSRWTFAGHTH;<br>SAAELSRWTFAGHTHY; AAELSRWTFAGHTHYL; AELSRWTFAGHTHYLI;<br>ELSRWTFAGHTHYLII; LSRWTFAGHTHYLIID; SRWTFAGHTHYLIIDD;<br>RWTFAGHTHYLIIDDV; WTFAGHTHYLIIDDVD; TFAGHTHYLIIDDVDQ;<br>FAGHTHYLIIDDVDQV; AGHTHYLIIDDVDQVP; GHTHYLIIDDVDQVPD;<br>HTHYLIIDDVDQVPDS; THYLIIDDVDQVPDSP; HYLIIDDVDQVPDSPA;<br>YLIIDDVDQVPDSPAM; LIIDDVDQVPDSPAMT; IIDDVDQVPDSPAMTG;<br>IDDVDQVPDSPAMTGP; DDVDQVPDSPAMTGPY; DVDQVPDSPAMTGPYI;<br>VDQVPDSPAMTGPYIG; DQVPDSPAMTGPYIGQ; QVPDSPAMTGPYIGQR;<br>VPDSPAMTGPYIGQRP; PDSPAMTGPYIGQRPW; DSPAMTGPYIGQRPWT;<br>SPAMTGPYIGQRPWTP; PAMTGPYIGQRPWTPL; AMTGPYIGQRPWTPLI;<br>MTGPYIGQRPWTPLIG; TGPYIGQRPWTPLIGL; GPYIGQRPWTPLIGLL;<br>PYIGQRPWTPLIGLLA; YIGQRPWTPLIGLLAQ; IGQRPWTPLIGLLAQA;<br>GQRPWTPLIGLLAQAG; QRPWTPLIGLLAQAGD; RPWTPLIGLLAQAGDL;<br>PWTPLIGLLAQAGDLG; WTPLIGLLAQAGDLGL; TPLIGLLAQAGDLGLR;<br>PLIGLLAQAGDLGLRV; LIGLLAQAGDLGLRVI; IGLLAQAGDLGLRVIV;<br>GLLAQAGDLGLRVIVT; LLAQAGDLGLRVIVTG; LAQAGDLGLRVIVTGR;<br>AQAGDLGLRVIVTGRA; QAGDLGLRVIVTGRAT; AGDLGLRVIVTGRATG;<br>GDLGLRVIVTGRATGS; DLGLRVIVTGRATGSA; LGLRVIVTGRATGSAH;<br>GLRVIVTGRATGSAHL; LRVIVTGRATGSAHLL; RVIVTGRATGSAHLLM;<br>VIVTGRATGSAHLLMT; IVTGRATGSAHLLMTS; VTGRATGSAHLLMTSP;<br>TGRATGSAHLLMTSPL; GRATGSAHLLMTSPLL; RATGSAHLLMTSPLLR;<br>ATGSAHLLMTSPLLRR; TGSAHLLMTSPLLRRF; GSAHLLMTSPLLRRFN;<br>SAHLLMTSPLLRRFND; AHLLMTSPLLRRFNDL; HLLMTSPLLRRFNDLQ;<br>LLMTSPLLRRFNDLQA; LMTSPLLRRFNDLQAT; MTSPLLRRFNDLQATT;<br>TSPLLRRFNDLQATTL; SPLLRRFNDLQATTLM; PLLRRFNDLQATTLML;<br>LLRRFNDLQATTLMLA; LRRFNDLQATTLMLAG; RRFNDLQATTLMLAGN;<br>RFNDLQATTLMLAGNP; FNDLQATTLMLAGNPA; NDLQATTLMLAGNPAD;<br>DLQATTLMLAGNPADS; LQATTLMLAGNPADSG; QATTLMLAGNPADSGK;<br>ATTLMLAGNPADSGKI; TTLMLAGNPADSGKIR; TLMLAGNPADSGKIRG;<br>LMLAGNPADSGKIRGE; MLAGNPADSGKIRGER; LAGNPADSGKIRGERF;<br>AGNPADSGKIRGERFA; GNPADSGKIRGERFAR; NPADSGKIRGERFARL;<br>PADSGKIRGERFARLP; ADSGKIRGERFARLPA; DSGKIRGERFARLPAG;<br>SGKIRGERFARLPAGR; GKIRGERFARLPAGRA; KIRGERFARLPAGRAI;<br>IRGERFARLPAGRAIL; RGERFARLPAGRAILL; GERFARLPAGRAILLT;<br>ERFARLPAGRAILLTD; RFARLPAGRAILLTDS; FARLPAGRAILLTDSD;<br>ARLPAGRAILLTDSDS; RLPAGRAILLTDSDSP; LPAGRAILLTDSDSPT;<br>PAGRAILLTDSDSPTY; AGRAILLTDSDSPTYV; GRAILLTDSDSPTYVQ;<br>RAILLTDSDSPTYVQL; AILLTDSDSPTYVQLI; ILLTDSDSPTYVQLIN; | |

Fig. 29 continued

| | | |
|---|---|---|
| | LLTDSDSPTYVQLINP; LTDSDSPTYVQLINPL; TDSDSPTYVQLINPLV; DSDSPTYVQLINPLVD; SDSPTYVQLINPLVDA; DSPTYVQLINPLVDAA; SPTYVQLINPLVDAAA; PTYVQLINPLVDAAAV; TYVQLINPLVDAAAVS; YVQLINPLVDAAAVSG; VQLINPLVDAAAVSGE; QLINPLVDAAAVSGET; LINPLVDAAAVSGETQ; INPLVDAAAVSGETQQ; NPLVDAAAVSGETQQK; PLVDAAAVSGETQQKG; LVDAAAVSGETQQKGS; VDAAAVSGETQQKGSQ; DAAAVSGETQQKGSQS; | |
| 5) Rv0285 | 13 mers:<br>MTLRVVPEGLAAA; TLRVVPEGLAAAS; LRVVPEGLAAASA; RVVPEGLAAASAA; VVPEGLAAASAAV; VPEGLAAASAAVE; PEGLAAASAAVEA; EGLAAASAAVEAL; GLAAASAAVEALT; LAAASAAVEALTA; AAASAAVEALTAR; AASAAVEALTARL; ASAAVEALTARLA; SAAVEALTARLAA; AAVEALTARLAAA; AVEALTARLAAAH; VEALTARLAAAHA; EALTARLAAAHAS; ALTARLAAAHASA; LTARLAAAHASAA; TARLAAAHASAAP; ARLAAAHASAAPV; RLAAAHASAAPVI; LAAAHASAAPVIT; AAAHASAAPVITA; AAHASAAPVITAV; AHASAAPVITAVV; HASAAPVITAVVP; ASAAPVITAVVPP; SAAPVITAVVPPA; AAPVITAVVPPAA; APVITAVVPPAAD; PVITAVVPPAADP; VITAVVPPAADPV; ITAVVPPAADPVS; TAVVPPAADPVSL; AVVPPAADPVSLQ; VVPPAADPVSLQT; VPPAADPVSLQTA; PPAADPVSLQTAA; PAADPVSLQTAAG; AADPVSLQTAAGF; ADPVSLQTAAGFS; DPVSLQTAAGFSA; PVSLQTAAGFSAQ; VSLQTAAGFSAQG; SLQTAAGFSAQGV; LQTAAGFSAQGVE; QTAAGFSAQGVEH; TAAGFSAQGVEHA; AAGFSAQGVEHAV; AGFSAQGVEHAVV; GFSAQGVEHAVVT; FSAQGVEHAVVTA; SAQGVEHAVVTAE; AQGVEHAVVTAEG; QGVEHAVVTAEGV; GVEHAVVTAEGVE; VEHAVVTAEGVEE; EHAVVTAEGVEEL; HAVVTAEGVEELG; AVVTAEGVEELGR; VVTAEGVEELGRA; VTAEGVEELGRAG; TAEGVEELGRAGV; AEGVEELGRAGVG; EGVEELGRAGVGV; GVEELGRAGVGVG; VEELGRAGVGVGE; EELGRAGVGVGES; ELGRAGVGVGESG; LGRAGVGVGESGA; GRAGVGVGESGAS; RAGVGVGESGASY; AGVGVGESGASYL; GVGVGESGASYLA; VGVGESGASYLAG; GVGESGASYLAGD; VGESGASYLAGDA; GESGASYLAGDAA; ESGASYLAGDAAA; SGASYLAGDAAAA; GASYLAGDAAAAA; ASYLAGDAAAAAT; SYLAGDAAAAATY; YLAGDAAAAATYG; LAGDAAAAATYGV; AGDAAAAATYGVV; GDAAAAATYGVVG; DAAAAATYGVVGG;<br><br>14 mers:<br>MTLRVVPEGLAAAS; TLRVVPEGLAAASA; LRVVPEGLAAASAA; RVVPEGLAAASAAV; VVPEGLAAASAAVE; VPEGLAAASAAVEA; PEGLAAASAAVEAL; EGLAAASAAVEALT; GLAAASAAVEALTA; LAAASAAVEALTAR; AAASAAVEALTARL; AASAAVEALTARLA; ASAAVEALTARLAA; SAAVEALTARLAAA; AAVEALTARLAAAH; AVEALTARLAAAHA; VEALTARLAAAHAS; EALTARLAAAHASA; ALTARLAAAHASAA; LTARLAAAHASAAP; TARLAAAHASAAPV; ARLAAAHASAAPVI; RLAAAHASAAPVIT; LAAAHASAAPVITA; AAAHASAAPVITAV; AAHASAAPVITAVV; AHASAAPVITAVVP; HASAAPVITAVVPP; ASAAPVITAVVPPA; SAAPVITAVVPPAA; AAPVITAVVPPAAD; APVITAVVPPAADP; PVITAVVPPAADPV; VITAVVPPAADPVS; ITAVVPPAADPVSL; TAVVPPAADPVSLQ; AVVPPAADPVSLQT; VVPPAADPVSLQTA; VPPAADPVSLQTAA; PPAADPVSLQTAAG; PAADPVSLQTAAGF; AADPVSLQTAAGFS; ADPVSLQTAAGFSA; DPVSLQTAAGFSAQ; PVSLQTAAGFSAQG; VSLQTAAGFSAQGV; SLQTAAGFSAQGVE; LQTAAGFSAQGVEH; | 66953-67306 |

Fig. 29 continued

| | | | |
|---|---|---|---|
| | QTAAGFSAQGVEHA; TAAGFSAQGVEHAV; AAGFSAQGVEHAVV; AGFSAQGVEHAVVT; GFSAQGVEHAVVTA; FSAQGVEHAVVTAE; SAQGVEHAVVTAEG; AQGVEHAVVTAEGV; QGVEHAVVTAEGVE; GVEHAVVTAEGVEE; VEHAVVTAEGVEEL; EHAVVTAEGVEELG; HAVVTAEGVEELGR; AVVTAEGVEELGRA; VVTAEGVEELGRAG; VTAEGVEELGRAGV; TAEGVEELGRAGVG; AEGVEELGRAGVGV; EGVEELGRAGVGVG; GVEELGRAGVGVGE; VEELGRAGVGVGES; EELGRAGVGVGESG; ELGRAGVGVGESGA; LGRAGVGVGESGAS; GRAGVGVGESGASY; RAGVGVGESGASYL; AGVGVGESGASYLA; GVGVGESGASYLAG; VGVGESGASYLAGD; GVGESGASYLAGDA; VGESGASYLAGDAA; GESGASYLAGDAAA; ESGASYLAGDAAAA; SGASYLAGDAAAAA; GASYLAGDAAAAAT; ASYLAGDAAAAATY; SYLAGDAAAAATYG; YLAGDAAAAATYGV; LAGDAAAAATYGVV; AGDAAAAATYGVVG; GDAAAAATYGVVGG;<br><br>15 mers:<br>MTLRVVPEGLAAASA; TLRVVPEGLAAASAA; LRVVPEGLAAASAAV; RVVPEGLAAASAAVE; VVPEGLAAASAAVEA; VPEGLAAASAAVEAL; PEGLAAASAAVEALT; EGLAAASAAVEALTA; GLAAASAAVEALTAR; LAAASAAVEALTARL; AAASAAVEALTARLA; AASAAVEALTARLAA; ASAAVEALTARLAAA; SAAVEALTARLAAAH; AAVEALTARLAAAHA; AVEALTARLAAAHAS; VEALTARLAAAHASA; EALTARLAAAHASAA; ALTARLAAAHASAAP; LTARLAAAHASAAPV; TARLAAAHASAAPVI; ARLAAAHASAAPVIT; RLAAAHASAAPVITA; LAAAHASAAPVITAV; AAAHASAAPVITAVV; AAHASAAPVITAVVP; AHASAAPVITAVVPP; HASAAPVITAVVPPA; ASAAPVITAVVPPAA; SAAPVITAVVPPAAD; AAPVITAVVPPAADP; APVITAVVPPAADPV; PVITAVVPPAADPVS; VITAVVPPAADPVSL; ITAVVPPAADPVSLQ; TAVVPPAADPVSLQT; AVVPPAADPVSLQTA; VVPPAADPVSLQTAA; VPPAADPVSLQTAAG; PPAADPVSLQTAAGF; PAADPVSLQTAAGFS; AADPVSLQTAAGFSA; ADPVSLQTAAGFSAQ; DPVSLQTAAGFSAQG; PVSLQTAAGFSAQGV; VSLQTAAGFSAQGVE; SLQTAAGFSAQGVEH; LQTAAGFSAQGVEHA; QTAAGFSAQGVEHAV; TAAGFSAQGVEHAVV; AAGFSAQGVEHAVVT; AGFSAQGVEHAVVTA; GFSAQGVEHAVVTAE; FSAQGVEHAVVTAEG; SAQGVEHAVVTAEGV; AQGVEHAVVTAEGVE; QGVEHAVVTAEGVEE; GVEHAVVTAEGVEEL; VEHAVVTAEGVEELG; EHAVVTAEGVEELGR; HAVVTAEGVEELGRA; AVVTAEGVEELGRAG; VVTAEGVEELGRAGV; VTAEGVEELGRAGVG; TAEGVEELGRAGVGV; AEGVEELGRAGVGVG; EGVEELGRAGVGVGE; GVEELGRAGVGVGES; VEELGRAGVGVGESG; EELGRAGVGVGESGA; ELGRAGVGVGESGAS; LGRAGVGVGESGASY; GRAGVGVGESGASYL; RAGVGVGESGASYLA; AGVGVGESGASYLAG; GVGVGESGASYLAGD; VGVGESGASYLAGDA; GVGESGASYLAGDAA; VGESGASYLAGDAAA; GESGASYLAGDAAAA; ESGASYLAGDAAAAA; SGASYLAGDAAAAAT; GASYLAGDAAAAATY; ASYLAGDAAAAATYG; SYLAGDAAAAATYGV; YLAGDAAAAATYGVV; LAGDAAAAATYGVVG; AGDAAAAATYGVVGG;<br><br>16 mers:<br>MTLRVVPEGLAAASAA; TLRVVPEGLAAASAAV; LRVVPEGLAAASAAVE; RVVPEGLAAASAAVEA; VVPEGLAAASAAVEAL; VPEGLAAASAAVEALT; PEGLAAASAAVEALTA; EGLAAASAAVEALTAR; GLAAASAAVEALTARL; LAAASAAVEALTARLA; AAASAAVEALTARLAA; AASAAVEALTARLAAA; ASAAVEALTARLAAAH; SAAVEALTARLAAAHA; AAVEALTARLAAAHAS; | |

Fig. 29 continued

| | | |
|---|---|---|
| | AVEALTARLAAAHASA; VEALTARLAAAHASAA; EALTARLAAAHASAAP; ALTARLAAAHASAAPV; LTARLAAAHASAAPVI; TARLAAAHASAAPVIT; ARLAAAHASAAPVITA; RLAAAHASAAPVITAV; LAAAHASAAPVITAVV; AAAHASAAPVITAVVP; AAHASAAPVITAVVPP; AHASAAPVITAVVPPA; HASAAPVITAVVPPAA; ASAAPVITAVVPPAAD; SAAPVITAVVPPAADP; AAPVITAVVPPAADPV; APVITAVVPPAADPVS; PVITAVVPPAADPVSL; VITAVVPPAADPVSLQ; ITAVVPPAADPVSLQT; TAVVPPAADPVSLQTA; AVVPPAADPVSLQTAA; VVPPAADPVSLQTAAG; VPPAADPVSLQTAAGF; PPAADPVSLQTAAGFS; PAADPVSLQTAAGFSA; AADPVSLQTAAGFSAQ; ADPVSLQTAAGFSAQG; DPVSLQTAAGFSAQGV; PVSLQTAAGFSAQGVE; VSLQTAAGFSAQGVEH; SLQTAAGFSAQGVEHA; LQTAAGFSAQGVEHAV; QTAAGFSAQGVEHAVV; TAAGFSAQGVEHAVVT; AAGFSAQGVEHAVVTA; AGFSAQGVEHAVVTAE; GFSAQGVEHAVVTAEG; FSAQGVEHAVVTAEGV; SAQGVEHAVVTAEGVE; AQGVEHAVVTAEGVEE; QGVEHAVVTAEGVEEL; GVEHAVVTAEGVEELG; VEHAVVTAEGVEELGR; EHAVVTAEGVEELGRA; HAVVTAEGVEELGRAG; AVVTAEGVEELGRAGV; VVTAEGVEELGRAGVG; VTAEGVEELGRAGVGV; TAEGVEELGRAGVGVG; AEGVEELGRAGVGVGE; EGVEELGRAGVGVGES; GVEELGRAGVGVGESG; VEELGRAGVGVGESGA; EELGRAGVGVGESGAS; ELGRAGVGVGESGASY; LGRAGVGVGESGASYL; GRAGVGVGESGASYLA; RAGVGVGESGASYLAG; AGVGVGESGASYLAGD; GVGVGESGASYLAGDA; VGVGESGASYLAGDAA; GVGESGASYLAGDAAA; VGESGASYLAGDAAAA; GESGASYLAGDAAAAA; ESGASYLAGDAAAAAT; SGASYLAGDAAAAATY; GASYLAGDAAAAATYG; ASYLAGDAAAAATYGV; SYLAGDAAAAATYGVV; YLAGDAAAAATYGVVG; LAGDAAAAATYGVVGG; | |
| 6) Rv0287 | 13 mers:<br>MSLLDAHIPQLVA; SLLDAHIPQLVAS; LLDAHIPQLVASQ; LDAHIPQLVASQS; DAHIPQLVASQSA; AHIPQLVASQSAF; HIPQLVASQSAFA; IPQLVASQSAFAA; PQLVASQSAFAAK; QLVASQSAFAAKA; LVASQSAFAAKAG; VASQSAFAAKAGL; ASQSAFAAKAGLM; SQSAFAAKAGLMR; QSAFAAKAGLMRH; SAFAAKAGLMRHT; AFAAKAGLMRHTI; FAAKAGLMRHTIG; AAKAGLMRHTIGQ; AKAGLMRHTIGQA; KAGLMRHTIGQAE; AGLMRHTIGQAEQ; GLMRHTIGQAEQA; LMRHTIGQAEQAA; MRHTIGQAEQAAM; RHTIGQAEQAAMS; HTIGQAEQAAMSA; TIGQAEQAAMSAQ; IGQAEQAAMSAQA; GQAEQAAMSAQAF; QAEQAAMSAQAFH; AEQAAMSAQAFHQ; EQAAMSAQAFHQG; QAAMSAQAFHQGE; AAMSAQAFHQGES; AMSAQAFHQGESS; MSAQAFHQGESSA; SAQAFHQGESSAA; AQAFHQGESSAAF; QAFHQGESSAAFQ; AFHQGESSAAFQA; FHQGESSAAFQAA; HQGESSAAFQAAH; QGESSAAFQAAHA; GESSAAFQAAHAR; ESSAAFQAAHARF; SSAAFQAAHARFV; SAAFQAAHARFVA; AAFQAAHARFVAA; AFQAAHARFVAAA; FQAAHARFVAAAA; QAAHARFVAAAAK; AAHARFVAAAAKV; AHARFVAAAAKVN; HARFVAAAAKVNT; ARFVAAAAKVNTL; RFVAAAAKVNTLL; FVAAAAKVNTLLD; VAAAAKVNTLLDV; AAAAKVNTLLDVA; AAAKVNTLLDVAQ; AAKVNTLLDVAQA; AKVNTLLDVAQAN; KVNTLLDVAQANL; VNTLLDVAQANLG; NTLLDVAQANLGE; TLLDVAQANLGEA; LLDVAQANLGEAA; LDVAQANLGEAAG; DVAQANLGEAAGT; VAQANLGEAAGTY; AQANLGEAAGTYV; QANLGEAAGTYVA; ANLGEAAGTYVAA; NLGEAAGTYVAAD; LGEAAGTYVAADA; GEAAGTYVAADAA; EAAGTYVAADAAA; AAGTYVAADAAAA; AGTYVAADAAAAS; GTYVAADAAAAST; TYVAADAAAASTY; YVAADAAAASTYT; VAADAAAASTYTG; AADAAAASTYTGF;<br><br>14 mers:<br>MSLLDAHIPQLVAS; SLLDAHIPQLVASQ; LLDAHIPQLVASQS; | 67307-67640 |

Fig. 29 continued

| | | |
|---|---|---|
| | LDAHIPQLVASQSA; DAHIPQLVASQSAF; AHIPQLVASQSAFA;<br>HIPQLVASQSAFAA; IPQLVASQSAFAAK; PQLVASQSAFAAKA;<br>QLVASQSAFAAKAG; LVASQSAFAAKAGL; VASQSAFAAKAGLM;<br>ASQSAFAAKAGLMR; SQSAFAAKAGLMRH; QSAFAAKAGLMRHT;<br>SAFAAKAGLMRHTI; AFAAKAGLMRHTIG; FAAKAGLMRHTIGQ;<br>AAKAGLMRHTIGQA; AKAGLMRHTIGQAE; KAGLMRHTIGQAEQ;<br>AGLMRHTIGQAEQA; GLMRHTIGQAEQAA; LMRHTIGQAEQAAM;<br>MRHTIGQAEQAAMS; RHTIGQAEQAAMSA; HTIGQAEQAAMSAQ;<br>TIGQAEQAAMSAQA; IGQAEQAAMSAQAF; GQAEQAAMSAQAFH;<br>QAEQAAMSAQAFHQ; AEQAAMSAQAFHQG; EQAAMSAQAFHQGE;<br>QAAMSAQAFHQGES; AAMSAQAFHQGESS; AMSAQAFHQGESSA;<br>MSAQAFHQGESSAA; SAQAFHQGESSAAF; AQAFHQGESSAAFQ;<br>QAFHQGESSAAFQA; AFHQGESSAAFQAA; FHQGESSAAFQAAH;<br>HQGESSAAFQAAHA; QGESSAAFQAAHAR; GESSAAFQAAHARF;<br>ESSAAFQAAHARFV; SSAAFQAAHARFVA; SAAFQAAHARFVAA;<br>AAFQAAHARFVAAA; AFQAAHARFVAAAA; FQAAHARFVAAAAK;<br>QAAHARFVAAAAKV; AAHARFVAAAAKVN; AHARFVAAAAKVNT;<br>HARFVAAAAKVNTL; ARFVAAAAKVNTLL; RFVAAAAKVNTLLD;<br>FVAAAAKVNTLLDV; VAAAAKVNTLLDVA; AAAAKVNTLLDVAQ;<br>AAAKVNTLLDVAQA; AAKVNTLLDVAQAN; AKVNTLLDVAQANL;<br>KVNTLLDVAQANLG; VNTLLDVAQANLGE; NTLLDVAQANLGEA;<br>TLLDVAQANLGEAA; LLDVAQANLGEAAG; LDVAQANLGEAAGT;<br>DVAQANLGEAAGTY; VAQANLGEAAGTYV; AQANLGEAAGTYVA;<br>QANLGEAAGTYVAA; ANLGEAAGTYVAAD; NLGEAAGTYVAADA;<br>LGEAAGTYVAADAA; GEAAGTYVAADAAA; EAAGTYVAADAAAA;<br>AAGTYVAADAAAAS; AGTYVAADAAAAST; GTYVAADAAAASTY;<br>TYVAADAAAASTYT; YVAADAAAASTYTG; VAADAAAASTYTGF;<br><br>15 mers:<br>MSLLDAHIPQLVASQ; SLLDAHIPQLVASQS; LLDAHIPQLVASQSA;<br>LDAHIPQLVASQSAF; DAHIPQLVASQSAFA; AHIPQLVASQSAFAA;<br>HIPQLVASQSAFAAK; IPQLVASQSAFAAKA; PQLVASQSAFAAKAG;<br>QLVASQSAFAAKAGL; LVASQSAFAAKAGLM; VASQSAFAAKAGLMR;<br>ASQSAFAAKAGLMRH; SQSAFAAKAGLMRHT; QSAFAAKAGLMRHTI;<br>SAFAAKAGLMRHTIG; AFAAKAGLMRHTIGQ; FAAKAGLMRHTIGQA;<br>AAKAGLMRHTIGQAE; AKAGLMRHTIGQAEQ; KAGLMRHTIGQAEQA;<br>AGLMRHTIGQAEQAA; GLMRHTIGQAEQAAM; LMRHTIGQAEQAAMS;<br>MRHTIGQAEQAAMSA; RHTIGQAEQAAMSAQ; HTIGQAEQAAMSAQA;<br>TIGQAEQAAMSAQAF; IGQAEQAAMSAQAFH; GQAEQAAMSAQAFHQ;<br>QAEQAAMSAQAFHQG; AEQAAMSAQAFHQGE; EQAAMSAQAFHQGES;<br>QAAMSAQAFHQGESS; AAMSAQAFHQGESSA; AMSAQAFHQGESSAA;<br>MSAQAFHQGESSAAF; SAQAFHQGESSAAFQ; AQAFHQGESSAAFQA;<br>QAFHQGESSAAFQAA; AFHQGESSAAFQAAH; FHQGESSAAFQAAHA;<br>HQGESSAAFQAAHAR; QGESSAAFQAAHARF; GESSAAFQAAHARFV;<br>ESSAAFQAAHARFVA; SSAAFQAAHARFVAA; SAAFQAAHARFVAAA;<br>AAFQAAHARFVAAAA; AFQAAHARFVAAAAK; FQAAHARFVAAAAKV;<br>QAAHARFVAAAAKVN; AAHARFVAAAAKVNT; AHARFVAAAAKVNTL;<br>HARFVAAAAKVNTLL; ARFVAAAAKVNTLLD; RFVAAAAKVNTLLDV;<br>FVAAAAKVNTLLDVA; VAAAAKVNTLLDVAQ; AAAAKVNTLLDVAQA;<br>AAAKVNTLLDVAQAN; AAKVNTLLDVAQANL; AKVNTLLDVAQANLG;<br>KVNTLLDVAQANLGE; VNTLLDVAQANLGEA; NTLLDVAQANLGEAA;<br>TLLDVAQANLGEAAG; LLDVAQANLGEAAGT; LDVAQANLGEAAGTY;<br>DVAQANLGEAAGTYV; VAQANLGEAAGTYVA; AQANLGEAAGTYVAA; | |

Fig. 29 continued

| | | |
|---|---|---|
| | QANLGEAAGTYVAAD; ANLGEAAGTYVAADA; NLGEAAGTYVAADAA; LGEAAGTYVAADAAA; GEAAGTYVAADAAAA; EAAGTYVAADAAAAS; AAGTYVAADAAAAST; AGTYVAADAAAASTY; GTYVAADAAAASTYT; TYVAADAAAASTYTG; YVAADAAAASTYTGF;<br><br>16 mers:<br>MSLLDAHIPQLVASQS; SLLDAHIPQLVASQSA; LLDAHIPQLVASQSAF; LDAHIPQLVASQSAFA; DAHIPQLVASQSAFAA; AHIPQLVASQSAFAAK; HIPQLVASQSAFAAKA; IPQLVASQSAFAAKAG; PQLVASQSAFAAKAGL; QLVASQSAFAAKAGLM; LVASQSAFAAKAGLMR; VASQSAFAAKAGLMRH; ASQSAFAAKAGLMRHT; SQSAFAAKAGLMRHTI; QSAFAAKAGLMRHTIG; SAFAAKAGLMRHTIGQ; AFAAKAGLMRHTIGQA; FAAKAGLMRHTIGQAE; AAKAGLMRHTIGQAEQ; AKAGLMRHTIGQAEQA; KAGLMRHTIGQAEQAA; AGLMRHTIGQAEQAAM; GLMRHTIGQAEQAAMS; LMRHTIGQAEQAAMSA; MRHTIGQAEQAAMSAQ; RHTIGQAEQAAMSAQA; HTIGQAEQAAMSAQAF; TIGQAEQAAMSAQAFH; IGQAEQAAMSAQAFHQ; GQAEQAAMSAQAFHQG; QAEQAAMSAQAFHQGE; AEQAAMSAQAFHQGES; EQAAMSAQAFHQGESS; QAAMSAQAFHQGESSA; AAMSAQAFHQGESSAA; AMSAQAFHQGESSAAF; MSAQAFHQGESSAAFQ; SAQAFHQGESSAAFQA; AQAFHQGESSAAFQAA; QAFHQGESSAAFQAAH; AFHQGESSAAFQAAHA; FHQGESSAAFQAAHAR; HQGESSAAFQAAHARF; QGESSAAFQAAHARFV; GESSAAFQAAHARFVA; ESSAAFQAAHARFVAA; SSAAFQAAHARFVAAA; SAAFQAAHARFVAAAA; AAFQAAHARFVAAAAK; AFQAAHARFVAAAAKV; FQAAHARFVAAAAKVN; QAAHARFVAAAAKVNT; AAHARFVAAAAKVNTL; AHARFVAAAAKVNTLL; HARFVAAAAKVNTLLD; ARFVAAAAKVNTLLDV; RFVAAAAKVNTLLDVA; FVAAAAKVNTLLDVAQ; VAAAAKVNTLLDVAQA; AAAAKVNTLLDVAQAN; AAAKVNTLLDVAQANL; AAKVNTLLDVAQANLG; AKVNTLLDVAQANLGE; KVNTLLDVAQANLGEA; VNTLLDVAQANLGEAA; NTLLDVAQANLGEAAG; TLLDVAQANLGEAAGT; LLDVAQANLGEAAGTY; LDVAQANLGEAAGTYV; DVAQANLGEAAGTYVA; VAQANLGEAAGTYVAA; AQANLGEAAGTYVAAD; QANLGEAAGTYVAADA; ANLGEAAGTYVAADAA; NLGEAAGTYVAADAAA; LGEAAGTYVAADAAAA; GEAAGTYVAADAAAAS; EAAGTYVAADAAAAST; AAGTYVAADAAAASTY; AGTYVAADAAAASTYT; GTYVAADAAAASTYTG; TYVAADAAAASTYTGF; | |
| 7) Rv0288 | 13 mers:<br>MSQIMYNYPAMLG; SQIMYNYPAMLGH; QIMYNYPAMLGHA; IMYNYPAMLGHAG; MYNYPAMLGHAGD; YNYPAMLGHAGDM; NYPAMLGHAGDMA; YPAMLGHAGDMAG; PAMLGHAGDMAGY; AMLGHAGDMAGYA; MLGHAGDMAGYAG; LGHAGDMAGYAGT; GHAGDMAGYAGTL; HAGDMAGYAGTLQ; AGDMAGYAGTLQS; GDMAGYAGTLQSL; DMAGYAGTLQSLG; MAGYAGTLQSLGA; AGYAGTLQSLGAE; GYAGTLQSLGAEI; YAGTLQSLGAEIA; AGTLQSLGAEIAV; GTLQSLGAEIAVE; TLQSLGAEIAVEQ; LQSLGAEIAVEQA; QSLGAEIAVEQAA; SLGAEIAVEQAAL; LGAEIAVEQAALQ; GAEIAVEQAALQS; AEIAVEQAALQSA; EIAVEQAALQSAW; IAVEQAALQSAWQ; AVEQAALQSAWQG; VEQAALQSAWQGD; EQAALQSAWQGDT; QAALQSAWQGDTG; AALQSAWQGDTGI; ALQSAWQGDTGIT; LQSAWQGDTGITY; QSAWQGDTGITYQ; SAWQGDTGITYQA; AWQGDTGITYQAW; WQGDTGITYQAWQ; QGDTGITYQAWQA; GDTGITYQAWQAQ; DTGITYQAWQAQW; TGITYQAWQAQWN; GITYQAWQAQWNQ; ITYQAWQAQWNQA; TYQAWQAQWNQAM; YQAWQAQWNQAME; QAWQAQWNQAMED; AWQAQWNQAMEDL; WQAQWNQAMEDLV; | 67641-67970 |

Fig. 29 continued

| | | |
|---|---|---|
| | QAQWNQAMEDLVR; AQWNQAMEDLVRA; QWNQAMEDLVRAY; WNQAMEDLVRAYH; NQAMEDLVRAYHA; QAMEDLVRAYHAM; AMEDLVRAYHAMS; MEDLVRAYHAMSS; EDLVRAYHAMSST; DLVRAYHAMSSTH; LVRAYHAMSSTHE; VRAYHAMSSTHEA; RAYHAMSSTHEAN; AYHAMSSTHEANT; YHAMSSTHEANTM; HAMSSTHEANTMA; AMSSTHEANTMAM; MSSTHEANTMAMM; SSTHEANTMAMMA; STHEANTMAMMAR; THEANTMAMMARD; HEANTMAMMARDT; EANTMAMMARDTA; ANTMAMMARDTAE; NTMAMMARDTAEA; TMAMMARDTAEAA; MAMMARDTAEAAK; AMMARDTAEAAKW; MMARDTAEAAKWG; MARDTAEAAKWGG;<br><br>14 mers:<br>MSQIMYNYPAMLGH; SQIMYNYPAMLGHA; QIMYNYPAMLGHAG; IMYNYPAMLGHAGD; MYNYPAMLGHAGDM; YNYPAMLGHAGDMA; NYPAMLGHAGDMAG; YPAMLGHAGDMAGY; PAMLGHAGDMAGYA; AMLGHAGDMAGYAG; MLGHAGDMAGYAGT; LGHAGDMAGYAGTL; GHAGDMAGYAGTLQ; HAGDMAGYAGTLQS; AGDMAGYAGTLQSL; GDMAGYAGTLQSLG; DMAGYAGTLQSLGA; MAGYAGTLQSLGAE; AGYAGTLQSLGAEI; GYAGTLQSLGAEIA; YAGTLQSLGAEIAV; AGTLQSLGAEIAVE; GTLQSLGAEIAVEQ; TLQSLGAEIAVEQA; LQSLGAEIAVEQAA; QSLGAEIAVEQAAL; SLGAEIAVEQAALQ; LGAEIAVEQAALQS; GAEIAVEQAALQSA; AEIAVEQAALQSAW; EIAVEQAALQSAWQ; IAVEQAALQSAWQG; AVEQAALQSAWQGD; VEQAALQSAWQGDT; EQAALQSAWQGDTG; QAALQSAWQGDTGI; AALQSAWQGDTGIT; ALQSAWQGDTGITY; LQSAWQGDTGITYQ; QSAWQGDTGITYQA; SAWQGDTGITYQAW; AWQGDTGITYQAWQ; WQGDTGITYQAWQA; QGDTGITYQAWQAQ; GDTGITYQAWQAQW; DTGITYQAWQAQWN; TGITYQAWQAQWNQ; GITYQAWQAQWNQA; ITYQAWQAQWNQAM; TYQAWQAQWNQAME; YQAWQAQWNQAMED; QAWQAQWNQAMEDL; AWQAQWNQAMEDLV; WQAQWNQAMEDLVR; QAQWNQAMEDLVRA; AQWNQAMEDLVRAY; QWNQAMEDLVRAYH; WNQAMEDLVRAYHA; NQAMEDLVRAYHAM; QAMEDLVRAYHAMS; AMEDLVRAYHAMSS; MEDLVRAYHAMSST; EDLVRAYHAMSSTH; DLVRAYHAMSSTHE; LVRAYHAMSSTHEA; VRAYHAMSSTHEAN; RAYHAMSSTHEANT; AYHAMSSTHEANTM; YHAMSSTHEANTMA; HAMSSTHEANTMAM; AMSSTHEANTMAMM; MSSTHEANTMAMMA; SSTHEANTMAMMAR; STHEANTMAMMARD; THEANTMAMMARDT; HEANTMAMMARDTA; EANTMAMMARDTAE; ANTMAMMARDTAEA; NTMAMMARDTAEAA; TMAMMARDTAEAAK; MAMMARDTAEAAKW; AMMARDTAEAAKWG; MMARDTAEAAKWGG;<br><br>15 mers:<br>MSQIMYNYPAMLGHA; SQIMYNYPAMLGHAG; QIMYNYPAMLGHAGD; IMYNYPAMLGHAGDM; MYNYPAMLGHAGDMA; YNYPAMLGHAGDMAG; NYPAMLGHAGDMAGY; YPAMLGHAGDMAGYA; PAMLGHAGDMAGYAG; AMLGHAGDMAGYAGT; MLGHAGDMAGYAGTL; LGHAGDMAGYAGTLQ; GHAGDMAGYAGTLQS; HAGDMAGYAGTLQSL; AGDMAGYAGTLQSLG; GDMAGYAGTLQSLGA; DMAGYAGTLQSLGAE; MAGYAGTLQSLGAEI; AGYAGTLQSLGAEIA; GYAGTLQSLGAEIAV; YAGTLQSLGAEIAVE; AGTLQSLGAEIAVEQ; GTLQSLGAEIAVEQA; TLQSLGAEIAVEQAA; LQSLGAEIAVEQAAL; QSLGAEIAVEQAALQ; SLGAEIAVEQAALQS; LGAEIAVEQAALQSA; GAEIAVEQAALQSAW; AEIAVEQAALQSAWQ; EIAVEQAALQSAWQG; IAVEQAALQSAWQGD; AVEQAALQSAWQGDT; | |

Fig. 29 continued

| | | |
|---|---|---|
| | VEQAALQSAWQGDTG; EQAALQSAWQGDTGI; QAALQSAWQGDTGIT; AALQSAWQGDTGITY; ALQSAWQGDTGITYQ; LQSAWQGDTGITYQA; QSAWQGDTGITYQAW; SAWQGDTGITYQAWQ; AWQGDTGITYQAWQA; WQGDTGITYQAWQAQ; QGDTGITYQAWQAQW; GDTGITYQAWQAQWN; DTGITYQAWQAQWNQ; TGITYQAWQAQWNQA; GITYQAWQAQWNQAM; ITYQAWQAQWNQAME; TYQAWQAQWNQAMED; YQAWQAQWNQAMEDL; QAWQAQWNQAMEDLV; AWQAQWNQAMEDLVR; WQAQWNQAMEDLVRA; QAQWNQAMEDLVRAY; AQWNQAMEDLVRAYH; QWNQAMEDLVRAYHA; WNQAMEDLVRAYHAM; NQAMEDLVRAYHAMS; QAMEDLVRAYHAMSS; AMEDLVRAYHAMSST; MEDLVRAYHAMSSTH; EDLVRAYHAMSSTHE; DLVRAYHAMSSTHEA; LVRAYHAMSSTHEAN; VRAYHAMSSTHEANT; RAYHAMSSTHEANTM; AYHAMSSTHEANTMA; YHAMSSTHEANTMAM; HAMSSTHEANTMAMM; AMSSTHEANTMAMMA; MSSTHEANTMAMMAR; SSTHEANTMAMMARD; STHEANTMAMMARDT; THEANTMAMMARDTA; HEANTMAMMARDTAE; EANTMAMMARDTAEA; ANTMAMMARDTAEAA; NTMAMMARDTAEAAK; TMAMMARDTAEAAKW; MAMMARDTAEAAKWG; AMMARDTAEAAKWGG;<br><br>16 mers:<br>MSQIMYNYPAMLGHAG; SQIMYNYPAMLGHAGD; QIMYNYPAMLGHAGDM; IMYNYPAMLGHAGDMA; MYNYPAMLGHAGDMAG; YNYPAMLGHAGDMAGY; NYPAMLGHAGDMAGYA; YPAMLGHAGDMAGYAG; PAMLGHAGDMAGYAGT; AMLGHAGDMAGYAGTL; MLGHAGDMAGYAGTLQ; LGHAGDMAGYAGTLQS; GHAGDMAGYAGTLQSL; HAGDMAGYAGTLQSLG; AGDMAGYAGTLQSLGA; GDMAGYAGTLQSLGAE; DMAGYAGTLQSLGAEI; MAGYAGTLQSLGAEIA; AGYAGTLQSLGAEIAV; GYAGTLQSLGAEIAVE; YAGTLQSLGAEIAVEQ; AGTLQSLGAEIAVEQA; GTLQSLGAEIAVEQAA; TLQSLGAEIAVEQAAL; LQSLGAEIAVEQAALQ; QSLGAEIAVEQAALQS; SLGAEIAVEQAALQSA; LGAEIAVEQAALQSAW; GAEIAVEQAALQSAWQ; AEIAVEQAALQSAWQG; EIAVEQAALQSAWQGD; IAVEQAALQSAWQGDT; AVEQAALQSAWQGDTG; VEQAALQSAWQGDTGI; EQAALQSAWQGDTGIT; QAALQSAWQGDTGITY; AALQSAWQGDTGITYQ; ALQSAWQGDTGITYQA; LQSAWQGDTGITYQAW; QSAWQGDTGITYQAWQ; SAWQGDTGITYQAWQA; AWQGDTGITYQAWQAQ; WQGDTGITYQAWQAQW; QGDTGITYQAWQAQWN; GDTGITYQAWQAQWNQ; DTGITYQAWQAQWNQA; TGITYQAWQAQWNQAM; GITYQAWQAQWNQAME; ITYQAWQAQWNQAMED; TYQAWQAQWNQAMEDL; YQAWQAQWNQAMEDLV; QAWQAQWNQAMEDLVR; AWQAQWNQAMEDLVRA; WQAQWNQAMEDLVRAY; QAQWNQAMEDLVRAYH; AQWNQAMEDLVRAYHA; QWNQAMEDLVRAYHAM; WNQAMEDLVRAYHAMS; NQAMEDLVRAYHAMSS; QAMEDLVRAYHAMSST; AMEDLVRAYHAMSSTH; MEDLVRAYHAMSSTHE; EDLVRAYHAMSSTHEA; DLVRAYHAMSSTHEAN; LVRAYHAMSSTHEANT; VRAYHAMSSTHEANTM; RAYHAMSSTHEANTMA; AYHAMSSTHEANTMAM; YHAMSSTHEANTMAMM; HAMSSTHEANTMAMMA; AMSSTHEANTMAMMAR; MSSTHEANTMAMMARD; SSTHEANTMAMMARDT; STHEANTMAMMARDTA; THEANTMAMMARDTAE; HEANTMAMMARDTAEA; EANTMAMMARDTAEAA; ANTMAMMARDTAEAAK; NTMAMMARDTAEAAKW; TMAMMARDTAEAAKWG; MAMMARDTAEAAKWGG; | |
| 8) Rv0455c | 13 mers:<br>MSRLSSILRAGAA; SRLSSILRAGAAF; RLSSILRAGAAFL; LSSILRAGAAFLV; SSILRAGAAFLVL; SILRAGAAFLVLG; ILRAGAAFLVLGI; LRAGAAFLVLGIA; RAGAAFLVLGIAA; AGAAFLVLGIAAA; GAAFLVLGIAAAT; AAFLVLGIAAATF; AFLVLGIAAATFP; FLVLGIAAATFPQ; LVLGIAAATFPQS; VLGIAAATFPQSA; LGIAAATFPQSAA; GIAAATFPQSAAA; IAAATFPQSAAAD; AAATFPQSAAADS; | 67971-68508 |

Fig. 29 continued

AATFPQSAAADST; ATFPQSAAADSTE; TFPQSAAADSTED; FPQSAAADSTEDF; PQSAAADSTEDFP; QSAAADSTEDFPI; SAAADSTEDFPIP; AAADSTEDFPIPR; AADSTEDFPIPRR; ADSTEDFPIPRRM; DSTEDFPIPRRMI; STEDFPIPRRMIA; TEDFPIPRRMIAT; EDFPIPRRMIATT; DFPIPRRMIATTC; FPIPRRMIATTCD; PIPRRMIATTCDA; IPRRMIATTCDAE; PRRMIATTCDAEQ; RRMIATTCDAEQY; RMIATTCDAEQYL; MIATTCDAEQYLA; IATTCDAEQYLAA; ATTCDAEQYLAAV; TTCDAEQYLAAVR; TCDAEQYLAAVRD; CDAEQYLAAVRDT; DAEQYLAAVRDTS; AEQYLAAVRDTSP; EQYLAAVRDTSPV; QYLAAVRDTSPVY; YLAAVRDTSPVYY; LAAVRDTSPVYYQ; AAVRDTSPVYYQR; AVRDTSPVYYQRY; VRDTSPVYYQRYM; RDTSPVYYQRYMI; DTSPVYYQRYMID; TSPVYYQRYMIDF; SPVYYQRYMIDFN; PVYYQRYMIDFNN; VYYQRYMIDFNNH; YYQRYMIDFNNHA; YQRYMIDFNNHAN; QRYMIDFNNHANL; RYMIDFNNHANLQ; YMIDFNNHANLQQ; MIDFNNHANLQQA; IDFNNHANLQQAT; DFNNHANLQQATI; FNNHANLQQATIN; NNHANLQQATINK; NHANLQQATINKA; HANLQQATINKAH; ANLQQATINKAHW; NLQQATINKAHWF; LQQATINKAHWFF; QQATINKAHWFFS; QATINKAHWFFSL; ATINKAHWFFSLS; TINKAHWFFSLSP; INKAHWFFSLSPA; NKAHWFFSLSPAE; KAHWFFSLSPAER; AHWFFSLSPAERR; HWFFSLSPAERRD; WFFSLSPAERRDY; FFSLSPAERRDYS; FSLSPAERRDYSE; SLSPAERRDYSEH; LSPAERRDYSEHF; SPAERRDYSEHFY; PAERRDYSEHFYN; AERRDYSEHFYNG; ERRDYSEHFYNGD; RRDYSEHFYNGDP; RDYSEHFYNGDPL; DYSEHFYNGDPLT; YSEHFYNGDPLTF; SEHFYNGDPLTFA; EHFYNGDPLTFAW; HFYNGDPLTFAWV; FYNGDPLTFAWVN; YNGDPLTFAWVNH; NGDPLTFAWVNHM; GDPLTFAWVNHMK; DPLTFAWVNHMKI; PLTFAWVNHMKIF; LTFAWVNHMKIFF; TFAWVNHMKIFFN; FAWVNHMKIFFNN; AWVNHMKIFFNNK; WVNHMKIFFNNKG; VNHMKIFFNNKGV; NHMKIFFNNKGVV; HMKIFFNNKGVVA; MKIFFNNKGVVAK; KIFFNNKGVVAKG; IFFNNKGVVAKGT; FFNNKGVVAKGTE; FNNKGVVAKGTEV; NNKGVVAKGTEVC; NKGVVAKGTEVCN; KGVVAKGTEVCNG; GVVAKGTEVCNGY; VVAKGTEVCNGYP; VAKGTEVCNGYPA; AKGTEVCNGYPAG; KGTEVCNGYPAGD; GTEVCNGYPAGDM; TEVCNGYPAGDMS; EVCNGYPAGDMSV; VCNGYPAGDMSVW; CNGYPAGDMSVWN; NGYPAGDMSVWNW; GYPAGDMSVWNWA;

14 mers:
MSRLSSILRAGAAF; SRLSSILRAGAAFL; RLSSILRAGAAFLV; LSSILRAGAAFLVL; SSILRAGAAFLVLG; SILRAGAAFLVLGI; ILRAGAAFLVLGIA; LRAGAAFLVLGIAA; RAGAAFLVLGIAAA; AGAAFLVLGIAAAT; GAAFLVLGIAAATF; AAFLVLGIAAATFP; AFLVLGIAAATFPQ; FLVLGIAAATFPQS; LVLGIAAATFPQSA; VLGIAAATFPQSAA; LGIAAATFPQSAAA; GIAAATFPQSAAAD; IAAATFPQSAAADS; AAATFPQSAAADST; AATFPQSAAADSTE; ATFPQSAAADSTED; TFPQSAAADSTEDF; FPQSAAADSTEDFP; PQSAAADSTEDFPI; QSAAADSTEDFPIP; SAAADSTEDFPIPR; AAADSTEDFPIPRR; AADSTEDFPIPRRM; ADSTEDFPIPRRMI; DSTEDFPIPRRMIA; STEDFPIPRRMIAT; TEDFPIPRRMIATT; EDFPIPRRMIATTC; DFPIPRRMIATTCD; FPIPRRMIATTCDA; PIPRRMIATTCDAE; IPRRMIATTCDAEQ; PRRMIATTCDAEQY; RRMIATTCDAEQYL; RMIATTCDAEQYLA; MIATTCDAEQYLAA; IATTCDAEQYLAAV; ATTCDAEQYLAAVR; TTCDAEQYLAAVRD; TCDAEQYLAAVRDT; CDAEQYLAAVRDTS; DAEQYLAAVRDTSP; AEQYLAAVRDTSPV; EQYLAAVRDTSPVY; QYLAAVRDTSPVYY; YLAAVRDTSPVYYQ; LAAVRDTSPVYYQR; AAVRDTSPVYYQRY; AVRDTSPVYYQRYM; VRDTSPVYYQRYMI; RDTSPVYYQRYMID; DTSPVYYQRYMIDF; TSPVYYQRYMIDFN; SPVYYQRYMIDFNN; PVYYQRYMIDFNNH; VYYQRYMIDFNNHA;

Fig. 29 continued

| | | | |
|---|---|---|---|
| | YYQRYMIDFNNHAN; YQRYMIDFNNHANL; QRYMIDFNNHANLQ; RYMIDFNNHANLQQ; YMIDFNNHANLQQA; MIDFNNHANLQQAT; IDFNNHANLQQATI; DFNNHANLQQATIN; FNNHANLQQATINK; NNHANLQQATINKA; NHANLQQATINKAH; HANLQQATINKAHW; ANLQQATINKAHWF; NLQQATINKAHWFF; LQQATINKAHWFFS; QQATINKAHWFFSL; QATINKAHWFFSLS; ATINKAHWFFSLSP; TINKAHWFFSLSPA; INKAHWFFSLSPAE; NKAHWFFSLSPAER; KAHWFFSLSPAERR; AHWFFSLSPAERRD; HWFFSLSPAERRDY; WFFSLSPAERRDYS; FFSLSPAERRDYSE; FSLSPAERRDYSEH; SLSPAERRDYSEHF; LSPAERRDYSEHFY; SPAERRDYSEHFYN; PAERRDYSEHFYNG; AERRDYSEHFYNGD; ERRDYSEHFYNGDP; RRDYSEHFYNGDPL; RDYSEHFYNGDPLT; DYSEHFYNGDPLTF; YSEHFYNGDPLTFA; SEHFYNGDPLTFAW; EHFYNGDPLTFAWV; HFYNGDPLTFAWVN; FYNGDPLTFAWVNH; YNGDPLTFAWVNHM; NGDPLTFAWVNHMK; GDPLTFAWVNHMKI; DPLTFAWVNHMKIF; PLTFAWVNHMKIFF; LTFAWVNHMKIFFN; TFAWVNHMKIFFNN; FAWVNHMKIFFNNK; AWVNHMKIFFNNKG; WVNHMKIFFNNKGV; VNHMKIFFNNKGVV; NHMKIFFNNKGVVA; HMKIFFNNKGVVAK; MKIFFNNKGVVAKG; KIFFNNKGVVAKGT; IFFNNKGVVAKGTE; FFNNKGVVAKGTEV; FNNKGVVAKGTEVC; NNKGVVAKGTEVCN; NKGVVAKGTEVCNG; KGVVAKGTEVCNGY; GVVAKGTEVCNGYP; VVAKGTEVCNGYPA; VAKGTEVCNGYPAG; AKGTEVCNGYPAGD; KGTEVCNGYPAGDM; GTEVCNGYPAGDMS; TEVCNGYPAGDMSV; EVCNGYPAGDMSVW; VCNGYPAGDMSVWN; CNGYPAGDMSVWNW; NGYPAGDMSVWNWA;<br><br>15 mers:<br>MSRLSSILRAGAAFL; SRLSSILRAGAAFLV; RLSSILRAGAAFLVL; LSSILRAGAAFLVLG; SSILRAGAAFLVLGI; SILRAGAAFLVLGIA; ILRAGAAFLVLGIAA; LRAGAAFLVLGIAAA; RAGAAFLVLGIAAAT; AGAAFLVLGIAAATF; GAAFLVLGIAAATFP; AAFLVLGIAAATFPQ; AFLVLGIAAATFPQS; FLVLGIAAATFPQSA; LVLGIAAATFPQSAA; VLGIAAATFPQSAAA; LGIAAATFPQSAAAD; GIAAATFPQSAAADS; IAAATFPQSAAADST; AAATFPQSAAADSTE; AATFPQSAAADSTED; ATFPQSAAADSTEDF; TFPQSAAADSTEDFP; FPQSAAADSTEDFPI; PQSAAADSTEDFPIP; QSAAADSTEDFPIPR; SAAADSTEDFPIPRR; AAADSTEDFPIPRRM; AADSTEDFPIPRRMI; ADSTEDFPIPRRMIA; DSTEDFPIPRRMIAT; STEDFPIPRRMIATT; TEDFPIPRRMIATTC; EDFPIPRRMIATTCD; DFPIPRRMIATTCDA; FPIPRRMIATTCDAE; PIPRRMIATTCDAEQ; IPRRMIATTCDAEQY; PRRMIATTCDAEQYL; RRMIATTCDAEQYLA; RMIATTCDAEQYLAA; MIATTCDAEQYLAAV; IATTCDAEQYLAAVR; ATTCDAEQYLAAVRD; TTCDAEQYLAAVRDT; TCDAEQYLAAVRDTS; CDAEQYLAAVRDTSP; DAEQYLAAVRDTSPV; AEQYLAAVRDTSPVY; EQYLAAVRDTSPVYY; QYLAAVRDTSPVYYQ; YLAAVRDTSPVYYQR; LAAVRDTSPVYYQRY; AAVRDTSPVYYQRYM; AVRDTSPVYYQRYMI; VRDTSPVYYQRYMID; RDTSPVYYQRYMIDF; DTSPVYYQRYMIDFN; TSPVYYQRYMIDFNN; SPVYYQRYMIDFNNH; PVYYQRYMIDFNNHA; VYYQRYMIDFNNHAN; YYQRYMIDFNNHANL; YQRYMIDFNNHANLQ; QRYMIDFNNHANLQQ; RYMIDFNNHANLQQA; YMIDFNNHANLQQAT; MIDFNNHANLQQATI; IDFNNHANLQQATIN; DFNNHANLQQATINK; FNNHANLQQATINKA; NNHANLQQATINKAH; NHANLQQATINKAHW; HANLQQATINKAHWF; ANLQQATINKAHWFF; NLQQATINKAHWFFS; LQQATINKAHWFFSL; QQATINKAHWFFSLS; | | |

Fig. 29 continued

| | | |
|---|---|---|
| | QATINKAHWFFSLSP; ATINKAHWFFSLSPA; TINKAHWFFSLSPAE;<br>INKAHWFFSLSPAER; NKAHWFFSLSPAERR; KAHWFFSLSPAERRD;<br>AHWFFSLSPAERRDY; HWFFSLSPAERRDYS; WFFSLSPAERRDYSE;<br>FFSLSPAERRDYSEH; FSLSPAERRDYSEHF; SLSPAERRDYSEHFY;<br>LSPAERRDYSEHFYN; SPAERRDYSEHFYNG; PAERRDYSEHFYNGD;<br>AERRDYSEHFYNGDP; ERRDYSEHFYNGDPL; RRDYSEHFYNGDPLT;<br>RDYSEHFYNGDPLTF; DYSEHFYNGDPLTFA; YSEHFYNGDPLTFAW;<br>SEHFYNGDPLTFAWV; EHFYNGDPLTFAWVN; HFYNGDPLTFAWVNH;<br>FYNGDPLTFAWVNHM; YNGDPLTFAWVNHMK; NGDPLTFAWVNHMKI;<br>GDPLTFAWVNHMKIF; DPLTFAWVNHMKIFF; PLTFAWVNHMKIFFN;<br>LTFAWVNHMKIFFNN; TFAWVNHMKIFFNNK; FAWVNHMKIFFNNKG;<br>AWVNHMKIFFNNKGV; WVNHMKIFFNNKGVV; VNHMKIFFNNKGVVA;<br>NHMKIFFNNKGVVAK; HMKIFFNNKGVVAKG; MKIFFNNKGVVAKGT;<br>KIFFNNKGVVAKGTE; IFFNNKGVVAKGTEV; FFNNKGVVAKGTEVC;<br>FNNKGVVAKGTEVCN; NNKGVVAKGTEVCNG; NKGVVAKGTEVCNGY;<br>KGVVAKGTEVCNGYP; GVVAKGTEVCNGYPA; VVAKGTEVCNGYPAG;<br>VAKGTEVCNGYPAGD; AKGTEVCNGYPAGDM; KGTEVCNGYPAGDMS;<br>GTEVCNGYPAGDMSV; TEVCNGYPAGDMSVW; EVCNGYPAGDMSVWN;<br>VCNGYPAGDMSVWNW; CNGYPAGDMSVWNWA;<br><br>16 mers:<br>MSRLSSILRAGAAFLV; SRLSSILRAGAAFLVL; RLSSILRAGAAFLVLG;<br>LSSILRAGAAFLVLGI; SSILRAGAAFLVLGIA; SILRAGAAFLVLGIAA;<br>ILRAGAAFLVLGIAAA; LRAGAAFLVLGIAAAT; RAGAAFLVLGIAAATF;<br>AGAAFLVLGIAAATFP; GAAFLVLGIAAATFPQ; AAFLVLGIAAATFPQS;<br>AFLVLGIAAATFPQSA; FLVLGIAAATFPQSAA; LVLGIAAATFPQSAAA;<br>VLGIAAATFPQSAAAD; LGIAAATFPQSAAADS; GIAAATFPQSAAADST;<br>IAAATFPQSAAADSTE; AAATFPQSAAADSTED; AATFPQSAAADSTEDF;<br>ATFPQSAAADSTEDFP; TFPQSAAADSTEDFPI; FPQSAAADSTEDFPIP;<br>PQSAAADSTEDFPIPR; QSAAADSTEDFPIPRR; SAAADSTEDFPIPRRM;<br>AAADSTEDFPIPRRMI; AADSTEDFPIPRRMIA; ADSTEDFPIPRRMIAT;<br>DSTEDFPIPRRMIATT; STEDFPIPRRMIATTC; TEDFPIPRRMIATTCD;<br>EDFPIPRRMIATTCDA; DFPIPRRMIATTCDAE; FPIPRRMIATTCDAEQ;<br>PIPRRMIATTCDAEQY; IPRRMIATTCDAEQYL; PRRMIATTCDAEQYLA;<br>RRMIATTCDAEQYLAA; RMIATTCDAEQYLAAV; MIATTCDAEQYLAAVR;<br>IATTCDAEQYLAAVRD; ATTCDAEQYLAAVRDT; TTCDAEQYLAAVRDTS;<br>TCDAEQYLAAVRDTSP; CDAEQYLAAVRDTSPV; DAEQYLAAVRDTSPVY;<br>AEQYLAAVRDTSPVYY; EQYLAAVRDTSPVYYQ; QYLAAVRDTSPVYYQR;<br>YLAAVRDTSPVYYQRY; LAAVRDTSPVYYQRYM; AAVRDTSPVYYQRYMI;<br>AVRDTSPVYYQRYMID; VRDTSPVYYQRYMIDF; RDTSPVYYQRYMIDFN;<br>DTSPVYYQRYMIDFNN; TSPVYYQRYMIDFNNH; SPVYYQRYMIDFNNHA;<br>PVYYQRYMIDFNNHAN; VYYQRYMIDFNNHANL; YYQRYMIDFNNHANLQ;<br>YQRYMIDFNNHANLQQ; QRYMIDFNNHANLQQA; RYMIDFNNHANLQQAT;<br>YMIDFNNHANLQQATI; MIDFNNHANLQQATIN; IDFNNHANLQQATINK;<br>DFNNHANLQQATINKA; FNNHANLQQATINKAH; NNHANLQQATINKAHW;<br>NHANLQQATINKAHWF; HANLQQATINKAHWFF; ANLQQATINKAHWFFS;<br>NLQQATINKAHWFFSL; LQQATINKAHWFFSLS; QQATINKAHWFFSLSP;<br>QATINKAHWFFSLSPA; ATINKAHWFFSLSPAE; TINKAHWFFSLSPAER;<br>INKAHWFFSLSPAERR; NKAHWFFSLSPAERRD; KAHWFFSLSPAERRDY;<br>AHWFFSLSPAERRDYS; HWFFSLSPAERRDYSE; WFFSLSPAERRDYSEH;<br>FFSLSPAERRDYSEHF; FSLSPAERRDYSEHFY; SLSPAERRDYSEHFYN;<br>LSPAERRDYSEHFYNG; SPAERRDYSEHFYNGD; PAERRDYSEHFYNGDP;<br>AERRDYSEHFYNGDPL; ERRDYSEHFYNGDPLT; RRDYSEHFYNGDPLTF; | |

Fig. 29 continued

| | | |
|---|---|---|
| | RDYSEHFYNGDPLTFA; DYSEHFYNGDPLTFAW; YSEHFYNGDPLTFAWV; SEHFYNGDPLTFAWVN; EHFYNGDPLTFAWVNH; HFYNGDPLTFAWVNHM; FYNGDPLTFAWVNHMK; YNGDPLTFAWVNHMKI; NGDPLTFAWVNHMKIF; GDPLTFAWVNHMKIFF; DPLTFAWVNHMKIFFN; PLTFAWVNHMKIFFNN; LTFAWVNHMKIFFNNK; TFAWVNHMKIFFNNKG; FAWVNHMKIFFNNKGV; AWVNHMKIFFNNKGVV; WVNHMKIFFNNKGVVA; VNHMKIFFNNKGVVAK; NHMKIFFNNKGVVAKG; HMKIFFNNKGVVAKGT; MKIFFNNKGVVAKGTE; KIFFNNKGVVAKGTEV; IFFNNKGVVAKGTEVC; FFNNKGVVAKGTEVCN; FNNKGVVAKGTEVCNG; NNKGVVAKGTEVCNGY; NKGVVAKGTEVCNGYP; KGVVAKGTEVCNGYPA; GVVAKGTEVCNGYPAG; VVAKGTEVCNGYPAGD; VAKGTEVCNGYPAGDM; AKGTEVCNGYPAGDMS; KGTEVCNGYPAGDMSV; GTEVCNGYPAGDMSVW; TEVCNGYPAGDMSVWN; EVCNGYPAGDMSVWNW; VCNGYPAGDMSVWNWA; | |
| 9) Rv0516c | 13 mers: MTTTIPTSKSACS; TTTIPTSKSACSV; TTIPTSKSACSVT; TIPTSKSACSVTT; IPTSKSACSVTTR; PTSKSACSVTTRP; TSKSACSVTTRPG; SKSACSVTTRPGN; KSACSVTTRPGNA; SACSVTTRPGNAA; ACSVTTRPGNAAV; CSVTTRPGNAAVD; SVTTRPGNAAVDY; VTTRPGNAAVDYG; TTRPGNAAVDYGG; TRPGNAAVDYGGA; RPGNAAVDYGGAQ; PGNAAVDYGGAQI; GNAAVDYGGAQIR; NAAVDYGGAQIRA; AAVDYGGAQIRAY; AVDYGGAQIRAYL; VDYGGAQIRAYLH; DYGGAQIRAYLHH; YGGAQIRAYLHHL; GGAQIRAYLHHLA; GAQIRAYLHHLAT; AQIRAYLHHLATV; QIRAYLHHLATVV; IRAYLHHLATVVT; RAYLHHLATVVTI; AYLHHLATVVTIR; YLHHLATVVTIRG; LHHLATVVTIRGE; HHLATVVTIRGEI; HLATVVTIRGEID; LATVVTIRGEIDA; ATVVTIRGEIDAA; TVVTIRGEIDAAN; VVTIRGEIDAANV; VTIRGEIDAANVE; TIRGEIDAANVEQ; IRGEIDAANVEQI; RGEIDAANVEQIS; GEIDAANVEQISE; EIDAANVEQISEH; IDAANVEQISEHV; DAANVEQISEHVR; AANVEQISEHVRR; ANVEQISEHVRRF; NVEQISEHVRRFS; VEQISEHVRRFSL; EQISEHVRRFSLG; QISEHVRRFSLGT; ISEHVRRFSLGTN; SEHVRRFSLGTNP; EHVRRFSLGTNPM; HVRRFSLGTNPMV; VRRFSLGTNPMVL; RRFSLGTNPMVLD; RFSLGTNPMVLDL; FSLGTNPMVLDLS; SLGTNPMVLDLSE; LGTNPMVLDLSEL; GTNPMVLDLSELS; TNPMVLDLSELSH; NPMVLDLSELSHF; PMVLDLSELSHFS; MVLDLSELSHFSG; VLDLSELSHFSGA; LDLSELSHFSGAG; DLSELSHFSGAGI; LSELSHFSGAGIS; SELSHFSGAGISL; ELSHFSGAGISLL; LSHFSGAGISLLC; SHFSGAGISLLCI; HFSGAGISLLCIL; FSGAGISLLCILD; SGAGISLLCILDE; GAGISLLCILDED; AGISLLCILDEDC; GISLLCILDEDCR; ISLLCILDEDCRA; SLLCILDEDCRAA; LLCILDEDCRAAG; LCILDEDCRAAGV; CILDEDCRAAGVQ; ILDEDCRAAGVQW; LDEDCRAAGVQWA; DEDCRAAGVQWAL; EDCRAAGVQWALV; DCRAAGVQWALVA; CRAAGVQWALVAS; RAAGVQWALVASP; AAGVQWALVASPA; AGVQWALVASPAV; GVQWALVASPAVV; VQWALVASPAVVE; QWALVASPAVVEQ; WALVASPAVVEQL; ALVASPAVVEQLG; LVASPAVVEQLGG; VASPAVVEQLGGR; ASPAVVEQLGGRC; SPAVVEQLGGRCD; PAVVEQLGGRCDQ; AVVEQLGGRCDQG; VVEQLGGRCDQGE; VEQLGGRCDQGEH; EQLGGRCDQGEHE; QLGGRCDQGEHES; LGGRCDQGEHESM; GGRCDQGEHESMF; GRCDQGEHESMFP; RCDQGEHESMFPM; CDQGEHESMFPMA; DQGEHESMFPMAR; QGEHESMFPMARS; GEHESMFPMARSV; EHESMFPMARSVH; HESMFPMARSVHK; ESMFPMARSVHKA; SMFPMARSVHKAL; MFPMARSVHKALH; FPMARSVHKALHD; PMARSVHKALHDL; MARSVHKALHDLA; ARSVHKALHDLAD; RSVHKALHDLADA; SVHKALHDLADAI; VHKALHDLADAID; HKALHDLADAIDR; KALHDLADAIDRR; ALHDLADAIDRRR; LHDLADAIDRRRQ; HDLADAIDRRRQL; DLADAIDRRRQLV; LADAIDRRRQLVL; ADAIDRRRQLVLP; DAIDRRRQLVLPL; AIDRRRQLVLPLI; IDRRRQLVLPLIS; | 68509-69086 |

Fig. 29 continued

| | | |
|---|---|---|
| | DRRRQLVLPLISR; RRRQLVLPLISRS; RRQLVLPLISRSA<br><br>14 mers:<br>MTTTIPTSKSACSV; TTTIPTSKSACSVT; TTIPTSKSACSVTT; TIPTSKSACSVTTR; IPTSKSACSVTTRP; PTSKSACSVTTRPG; TSKSACSVTTRPGN; SKSACSVTTRPGNA; KSACSVTTRPGNAA; SACSVTTRPGNAAV; ACSVTTRPGNAAVD; CSVTTRPGNAAVDY; SVTTRPGNAAVDYG; VTTRPGNAAVDYGG; TTRPGNAAVDYGGA; TRPGNAAVDYGGAQ; RPGNAAVDYGGAQI; PGNAAVDYGGAQIR; GNAAVDYGGAQIRA; NAAVDYGGAQIRAY; AAVDYGGAQIRAYL; AVDYGGAQIRAYLH; VDYGGAQIRAYLHH; DYGGAQIRAYLHHL; YGGAQIRAYLHHLA; GGAQIRAYLHHLAT; GAQIRAYLHHLATV; AQIRAYLHHLATVV; QIRAYLHHLATVVT; IRAYLHHLATVVTI; RAYLHHLATVVTIR; AYLHHLATVVTIRG; YLHHLATVVTIRGE; LHHLATVVTIRGEI; HHLATVVTIRGEID; HLATVVTIRGEIDA; LATVVTIRGEIDAA; ATVVTIRGEIDAAN; TVVTIRGEIDAANV; VVTIRGEIDAANVE; VTIRGEIDAANVEQ; TIRGEIDAANVEQI; IRGEIDAANVEQIS; RGEIDAANVEQISE; GEIDAANVEQISEH; EIDAANVEQISEHV; IDAANVEQISEHVR; DAANVEQISEHVRR; AANVEQISEHVRRF; ANVEQISEHVRRFS; NVEQISEHVRRFSL; VEQISEHVRRFSLG; EQISEHVRRFSLGT; QISEHVRRFSLGTN; ISEHVRRFSLGTNP; SEHVRRFSLGTNPM; EHVRRFSLGTNPMV; HVRRFSLGTNPMVL; VRRFSLGTNPMVLD; RRFSLGTNPMVLDL; RFSLGTNPMVLDLS; FSLGTNPMVLDLSE; SLGTNPMVLDLSEL; LGTNPMVLDLSELS; GTNPMVLDLSELSH; TNPMVLDLSELSHF; NPMVLDLSELSHFS; PMVLDLSELSHFSG; MVLDLSELSHFSGA; VLDLSELSHFSGAG; LDLSELSHFSGAGI; DLSELSHFSGAGIS; LSELSHFSGAGISL; SELSHFSGAGISLL; ELSHFSGAGISLLC; LSHFSGAGISLLCI; SHFSGAGISLLCIL; HFSGAGISLLCILD; FSGAGISLLCILDE; SGAGISLLCILDED; GAGISLLCILDEDC; AGISLLCILDEDCR; GISLLCILDEDCRA; ISLLCILDEDCRAA; SLLCILDEDCRAAG; LLCILDEDCRAAGV; LCILDEDCRAAGVQ; CILDEDCRAAGVQW; ILDEDCRAAGVQWA; LDEDCRAAGVQWAL; DEDCRAAGVQWALV; EDCRAAGVQWALVA; DCRAAGVQWALVAS; CRAAGVQWALVASP; RAAGVQWALVASPA; AAGVQWALVASPAV; AGVQWALVASPAVV; GVQWALVASPAVVE; VQWALVASPAVVEQ; QWALVASPAVVEQL; WALVASPAVVEQLG; ALVASPAVVEQLGG; LVASPAVVEQLGGR; VASPAVVEQLGGRC; ASPAVVEQLGGRCD; SPAVVEQLGGRCDQ; PAVVEQLGGRCDQG; AVVEQLGGRCDQGE; VVEQLGGRCDQGEH; VEQLGGRCDQGEHE; EQLGGRCDQGEHES; QLGGRCDQGEHESM; LGGRCDQGEHESMF; GGRCDQGEHESMFP; GRCDQGEHESMFPM; RCDQGEHESMFPMA; CDQGEHESMFPMAR; DQGEHESMFPMARS; QGEHESMFPMARSV; GEHESMFPMARSVH; EHESMFPMARSVHK; HESMFPMARSVHKA; ESMFPMARSVHKAL; SMFPMARSVHKALH; MFPMARSVHKALHD; FPMARSVHKALHDL; PMARSVHKALHDLA; MARSVHKALHDLAD; ARSVHKALHDLADA; RSVHKALHDLADAI; SVHKALHDLADAID; VHKALHDLADAIDR; HKALHDLADAIDRR; KALHDLADAIDRRR; ALHDLADAIDRRRQ; LHDLADAIDRRRQL; HDLADAIDRRRQLV; DLADAIDRRRQLVL; LADAIDRRRQLVLP; ADAIDRRRQLVLPL; DAIDRRRQLVLPLI; AIDRRRQLVLPLIS; IDRRRQLVLPLISR; DRRRQLVLPLISRS; RRRQLVLPLISRSA<br><br>15 mers:<br>MTTTIPTSKSACSVT; TTTIPTSKSACSVTT; TTIPTSKSACSVTTR; TIPTSKSACSVTTRP; IPTSKSACSVTTRPG; PTSKSACSVTTRPGN; | |

Fig. 29 continued

| | | |
|---|---|---|
| | TSKSACSVTTRPGNA; SKSACSVTTRPGNAA; KSACSVTTRPGNAAV;<br>SACSVTTRPGNAAVD; ACSVTTRPGNAAVDY; CSVTTRPGNAAVDYG;<br>SVTTRPGNAAVDYGG; VTTRPGNAAVDYGGA; TTRPGNAAVDYGGAQ;<br>TRPGNAAVDYGGAQI; RPGNAAVDYGGAQIR; PGNAAVDYGGAQIRA;<br>GNAAVDYGGAQIRAY; NAAVDYGGAQIRAYL; AAVDYGGAQIRAYLH;<br>AVDYGGAQIRAYLHH; VDYGGAQIRAYLHHL; DYGGAQIRAYLHHLA;<br>YGGAQIRAYLHHLAT; GGAQIRAYLHHLATV; GAQIRAYLHHLATVV;<br>AQIRAYLHHLATVVT; QIRAYLHHLATVVTI; IRAYLHHLATVVTIR;<br>RAYLHHLATVVTIRG; AYLHHLATVVTIRGE; YLHHLATVVTIRGEI;<br>LHHLATVVTIRGEID; HHLATVVTIRGEIDA; HLATVVTIRGEIDAA;<br>LATVVTIRGEIDAAN; ATVVTIRGEIDAANV; TVVTIRGEIDAANVE;<br>VVTIRGEIDAANVEQ; VTIRGEIDAANVEQI; TIRGEIDAANVEQIS;<br>IRGEIDAANVEQISE; RGEIDAANVEQISEH; GEIDAANVEQISEHV;<br>EIDAANVEQISEHVR; IDAANVEQISEHVRR; DAANVEQISEHVRRF;<br>AANVEQISEHVRRFS; ANVEQISEHVRRFSL; NVEQISEHVRRFSLG;<br>VEQISEHVRRFSLGT; EQISEHVRRFSLGTN; QISEHVRRFSLGTNP;<br>ISEHVRRFSLGTNPM; SEHVRRFSLGTNPMV; EHVRRFSLGTNPMVL;<br>HVRRFSLGTNPMVLD; VRRFSLGTNPMVLDL; RRFSLGTNPMVLDLS;<br>RFSLGTNPMVLDLSE; FSLGTNPMVLDLSEL; SLGTNPMVLDLSELS;<br>LGTNPMVLDLSELSH; GTNPMVLDLSELSHF; TNPMVLDLSELSHFS;<br>NPMVLDLSELSHFSG; PMVLDLSELSHFSGA; MVLDLSELSHFSGAG;<br>VLDLSELSHFSGAGI; LDLSELSHFSGAGIS; DLSELSHFSGAGISL;<br>LSELSHFSGAGISLL; SELSHFSGAGISLLC; ELSHFSGAGISLLCI;<br>LSHFSGAGISLLCIL; SHFSGAGISLLCILD; HFSGAGISLLCILDE;<br>FSGAGISLLCILDED; SGAGISLLCILDEDC; GAGISLLCILDEDCR;<br>AGISLLCILDEDCRA; GISLLCILDEDCRAA; ISLLCILDEDCRAAG;<br>SLLCILDEDCRAAGV; LLCILDEDCRAAGVQ; LCILDEDCRAAGVQW;<br>CILDEDCRAAGVQWA; ILDEDCRAAGVQWAL; LDEDCRAAGVQWALV;<br>DEDCRAAGVQWALVA; EDCRAAGVQWALVAS; DCRAAGVQWALVASP;<br>CRAAGVQWALVASPA; RAAGVQWALVASPAV; AAGVQWALVASPAVV;<br>AGVQWALVASPAVVE; GVQWALVASPAVVEQ; VQWALVASPAVVEQL;<br>QWALVASPAVVEQLG; WALVASPAVVEQLGG; ALVASPAVVEQLGGR;<br>LVASPAVVEQLGGRC; VASPAVVEQLGGRCD; ASPAVVEQLGGRCDQ;<br>SPAVVEQLGGRCDQG; PAVVEQLGGRCDQGE; AVVEQLGGRCDQGEH;<br>VVEQLGGRCDQGEHE; VEQLGGRCDQGEHES; EQLGGRCDQGEHESM;<br>QLGGRCDQGEHESMF; LGGRCDQGEHESMFP; GGRCDQGEHESMFPM;<br>GRCDQGEHESMFPMA; RCDQGEHESMFPMAR; CDQGEHESMFPMARS;<br>DQGEHESMFPMARSV; QGEHESMFPMARSVH; GEHESMFPMARSVHK;<br>EHESMFPMARSVHKA; HESMFPMARSVHKAL; ESMFPMARSVHKALH;<br>SMFPMARSVHKALHD; MFPMARSVHKALHDL; FPMARSVHKALHDLA;<br>PMARSVHKALHDLAD; MARSVHKALHDLADA; ARSVHKALHDLADAI;<br>RSVHKALHDLADAID; SVHKALHDLADAIDR; VHKALHDLADAIDRR;<br>HKALHDLADAIDRRR; KALHDLADAIDRRRQ; ALHDLADAIDRRRQL;<br>LHDLADAIDRRRQLV; HDLADAIDRRRQLVL; DLADAIDRRRQLVLP;<br>LADAIDRRRQLVLPL; ADAIDRRRQLVLPLI; DAIDRRRQLVLPLIS;<br>AIDRRRQLVLPLISR; IDRRRQLVLPLISRS; DRRRQLVLPLISRSA<br><br>16 mers:<br>MTTTIPTSKSACSVTT; TTTIPTSKSACSVTTR; TTIPTSKSACSVTTRP;<br>TIPTSKSACSVTTRPG; IPTSKSACSVTTRPGN; PTSKSACSVTTRPGNA;<br>TSKSACSVTTRPGNAA; SKSACSVTTRPGNAAV; KSACSVTTRPGNAAVD;<br>SACSVTTRPGNAAVDY; ACSVTTRPGNAAVDYG; CSVTTRPGNAAVDYGG;<br>SVTTRPGNAAVDYGGA; VTTRPGNAAVDYGGAQ; TTRPGNAAVDYGGAQI; | |

Fig. 29 continued

| | | |
|---|---|---|
| | TRPGNAAVDYGGAQIR; RPGNAAVDYGGAQIRA; PGNAAVDYGGAQIRAY; GNAAVDYGGAQIRAYL; NAAVDYGGAQIRAYLH; AAVDYGGAQIRAYLHH; AVDYGGAQIRAYLHHL; VDYGGAQIRAYLHHLA; DYGGAQIRAYLHHLAT; YGGAQIRAYLHHLATV; GGAQIRAYLHHLATVV; GAQIRAYLHHLATVVT; AQIRAYLHHLATVVTI; QIRAYLHHLATVVTIR; IRAYLHHLATVVTIRG; RAYLHHLATVVTIRGE; AYLHHLATVVTIRGEI; YLHHLATVVTIRGEID; LHHLATVVTIRGEIDA; HHLATVVTIRGEIDAA; HLATVVTIRGEIDAAN; LATVVTIRGEIDAANV; ATVVTIRGEIDAANVE; TVVTIRGEIDAANVEQ; VVTIRGEIDAANVEQI; VTIRGEIDAANVEQIS; TIRGEIDAANVEQISE; IRGEIDAANVEQISEH; RGEIDAANVEQISEHV; GEIDAANVEQISEHVR; EIDAANVEQISEHVRR; IDAANVEQISEHVRRF; DAANVEQISEHVRRFS; AANVEQISEHVRRFSL; ANVEQISEHVRRFSLG; NVEQISEHVRRFSLGT; VEQISEHVRRFSLGTN; EQISEHVRRFSLGTNP; QISEHVRRFSLGTNPM; ISEHVRRFSLGTNPMV; SEHVRRFSLGTNPMVL; EHVRRFSLGTNPMVLD; HVRRFSLGTNPMVLDL; VRRFSLGTNPMVLDLS; RRFSLGTNPMVLDLSE; RFSLGTNPMVLDLSEL; FSLGTNPMVLDLSELS; SLGTNPMVLDLSELSH; LGTNPMVLDLSELSHF; GTNPMVLDLSELSHFS; TNPMVLDLSELSHFSG; NPMVLDLSELSHFSGA; PMVLDLSELSHFSGAG; MVLDLSELSHFSGAGI; VLDLSELSHFSGAGIS; LDLSELSHFSGAGISL; DLSELSHFSGAGISLL; LSELSHFSGAGISLLC; SELSHFSGAGISLLCI; ELSHFSGAGISLLCIL; LSHFSGAGISLLCILD; SHFSGAGISLLCILDE; HFSGAGISLLCILDED; FSGAGISLLCILDEDC; SGAGISLLCILDEDCR; GAGISLLCILDEDCRA; AGISLLCILDEDCRAA; GISLLCILDEDCRAAG; ISLLCILDEDCRAAGV; SLLCILDEDCRAAGVQ; LLCILDEDCRAAGVQW; LCILDEDCRAAGVQWA; CILDEDCRAAGVQWAL; ILDEDCRAAGVQWALV; LDEDCRAAGVQWALVA; DEDCRAAGVQWALVAS; EDCRAAGVQWALVASP; DCRAAGVQWALVASPA; CRAAGVQWALVASPAV; RAAGVQWALVASPAVV; AAGVQWALVASPAVVE; AGVQWALVASPAVVEQ; GVQWALVASPAVVEQL; VQWALVASPAVVEQLG; QWALVASPAVVEQLGG; WALVASPAVVEQLGGR; ALVASPAVVEQLGGRC; LVASPAVVEQLGGRCD; VASPAVVEQLGGRCDQ; ASPAVVEQLGGRCDQG; SPAVVEQLGGRCDQGE; PAVVEQLGGRCDQGEH; AVVEQLGGRCDQGEHE; VVEQLGGRCDQGEHES; VEQLGGRCDQGEHESM; EQLGGRCDQGEHESMF; QLGGRCDQGEHESMFP; LGGRCDQGEHESMFPM; GGRCDQGEHESMFPMA; GRCDQGEHESMFPMAR; RCDQGEHESMFPMARS; CDQGEHESMFPMARSV; DQGEHESMFPMARSVH; QGEHESMFPMARSVHK; GEHESMFPMARSVHKA; EHESMFPMARSVHKAL; HESMFPMARSVHKALH; ESMFPMARSVHKALHD; SMFPMARSVHKALHDL; MFPMARSVHKALHDLA; FPMARSVHKALHDLAD; PMARSVHKALHDLADA; MARSVHKALHDLADAI; ARSVHKALHDLADAID; RSVHKALHDLADAIDR; SVHKALHDLADAIDRR; VHKALHDLADAIDRRR; HKALHDLADAIDRRRQ; KALHDLADAIDRRRQL; ALHDLADAIDRRRQLV; LHDLADAIDRRRQLVL; HDLADAIDRRRQLVLP; DLADAIDRRRQLVLPL; LADAIDRRRQLVLPLI; ADAIDRRRQLVLPLIS; DAIDRRRQLVLPLISR; AIDRRRQLVLPLISRS; IDRRRQLVLPLISRSA | |
| 10) Rv0569 | 13 mers: MKAKVGDWLVIKG; KAKVGDWLVIKGA; AKVGDWLVIKGAT; KVGDWLVIKGATI; VGDWLVIKGATID; GDWLVIKGATIDQ; DWLVIKGATIDQP; WLVIKGATIDQPD; LVIKGATIDQPDH; VIKGATIDQPDHR; IKGATIDQPDHRG; KGATIDQPDHRGL; GATIDQPDHRGLI; ATIDQPDHRGLII; TIDQPDHRGLIIE; IDQPDHRGLIIEV; DQPDHRGLIIEVR; QPDHRGLIIEVRS; PDHRGLIIEVRSS; DHRGLIIEVRSSD; HRGLIIEVRSSDG; RGLIIEVRSSDGS; GLIIEVRSSDGSP; LIIEVRSSDGSPP; IIEVRSSDGSPPY; IEVRSSDGSPPYV; EVRSSDGSPPYVV; VRSSDGSPPYVVR; RSSDGSPPYVVRW; SSDGSPPYVVRWL; SDGSPPYVVRWLE; | 69087-69384 |

Fig. 29 continued

| | | | |
|---|---|---|---|
| | DGSPPYVVRWLET; GSPPYVVRWLETD; SPPYVVRWLETDH; PPYVVRWLETDHV; PYVVRWLETDHVA; YVVRWLETDHVAT; VVRWLETDHVATV; VRWLETDHVATVI; RWLETDHVATVIP; WLETDHVATVIPG; LETDHVATVIPGP; ETDHVATVIPGPD; TDHVATVIPGPDA; DHVATVIPGPDAV; HVATVIPGPDAVV; VATVIPGPDAVVV; ATVIPGPDAVVVT; TVIPGPDAVVVTA; VIPGPDAVVVTAE; IPGPDAVVVTAEE; PGPDAVVVTAEEQ; GPDAVVVTAEEQN; PDAVVVTAEEQNA; DAVVVTAEEQNAA; AVVVTAEEQNAAD; VVVTAEEQNAADE; VVTAEEQNAADER; VTAEEQNAADERA; TAEEQNAADERAQ; AEEQNAADERAQH; EEQNAADERAQHR; EQNAADERAQHRF; QNAADERAQHRFG; NAADERAQHRFGA; AADERAQHRFGAV; ADERAQHRFGAVQ; DERAQHRFGAVQS; ERAQHRFGAVQSA; RAQHRFGAVQSAI; AQHRFGAVQSAIL; QHRFGAVQSAILH; HRFGAVQSAILHA; RFGAVQSAILHAR; FGAVQSAILHARG; GAVQSAILHARGT;<br><br>14 mers:<br>MKAKVGDWLVIKGA; KAKVGDWLVIKGAT; AKVGDWLVIKGATI; KVGDWLVIKGATID; VGDWLVIKGATIDQ; GDWLVIKGATIDQP; DWLVIKGATIDQPD; WLVIKGATIDQPDH; LVIKGATIDQPDHR; VIKGATIDQPDHRG; IKGATIDQPDHRGL; KGATIDQPDHRGLI; GATIDQPDHRGLII; ATIDQPDHRGLIIE; TIDQPDHRGLIIEV; IDQPDHRGLIIEVR; DQPDHRGLIIEVRS; QPDHRGLIIEVRSS; PDHRGLIIEVRSSD; DHRGLIIEVRSSDG; HRGLIIEVRSSDGS; RGLIIEVRSSDGSP; GLIIEVRSSDGSPP; LIIEVRSSDGSPPY; IIEVRSSDGSPPYV; IEVRSSDGSPPYVV; EVRSSDGSPPYVVR; VRSSDGSPPYVVRW; RSSDGSPPYVVRWL; SSDGSPPYVVRWLE; SDGSPPYVVRWLET; DGSPPYVVRWLETD; GSPPYVVRWLETDH; SPPYVVRWLETDHV; PPYVVRWLETDHVA; PYVVRWLETDHVAT; YVVRWLETDHVATV; VVRWLETDHVATVI; VRWLETDHVATVIP; RWLETDHVATVIPG; WLETDHVATVIPGP; LETDHVATVIPGPD; ETDHVATVIPGPDA; TDHVATVIPGPDAV; DHVATVIPGPDAVV; HVATVIPGPDAVVV; VATVIPGPDAVVVT; ATVIPGPDAVVVTA; TVIPGPDAVVVTAE; VIPGPDAVVVTAEE; IPGPDAVVVTAEEQ; PGPDAVVVTAEEQN; GPDAVVVTAEEQNA; PDAVVVTAEEQNAA; DAVVVTAEEQNAAD; AVVVTAEEQNAADE; VVVTAEEQNAADER; VVTAEEQNAADERA; VTAEEQNAADERAQ; TAEEQNAADERAQH; AEEQNAADERAQHR; EEQNAADERAQHRF; EQNAADERAQHRFG; QNAADERAQHRFGA; NAADERAQHRFGAV; AADERAQHRFGAVQ; ADERAQHRFGAVQS; DERAQHRFGAVQSA; ERAQHRFGAVQSAI; RAQHRFGAVQSAIL; AQHRFGAVQSAILH; QHRFGAVQSAILHA; HRFGAVQSAILHAR; RFGAVQSAILHARG; FGAVQSAILHARGT;<br><br>15 mers:<br>MKAKVGDWLVIKGAT; KAKVGDWLVIKGATI; AKVGDWLVIKGATID; KVGDWLVIKGATIDQ; VGDWLVIKGATIDQP; GDWLVIKGATIDQPD; DWLVIKGATIDQPDH; WLVIKGATIDQPDHR; LVIKGATIDQPDHRG; VIKGATIDQPDHRGL; IKGATIDQPDHRGLI; KGATIDQPDHRGLII; GATIDQPDHRGLIIE; ATIDQPDHRGLIIEV; TIDQPDHRGLIIEVR; IDQPDHRGLIIEVRS; DQPDHRGLIIEVRSS; QPDHRGLIIEVRSSD; PDHRGLIIEVRSSDG; DHRGLIIEVRSSDGS; HRGLIIEVRSSDGSP; RGLIIEVRSSDGSPP; GLIIEVRSSDGSPPY; LIIEVRSSDGSPPYV; IIEVRSSDGSPPYVV; IEVRSSDGSPPYVVR; EVRSSDGSPPYVVRW; VRSSDGSPPYVVRWL; RSSDGSPPYVVRWLE; SSDGSPPYVVRWLET; SDGSPPYVVRWLETD; DGSPPYVVRWLETDH; GSPPYVVRWLETDHV; | |

Fig. 29 continued

| | | |
|---|---|---|
| | SPPYVVRWLETDHVA; PPYVVRWLETDHVAT; PYVVRWLETDHVATV; YVVRWLETDHVATVI; VVRWLETDHVATVIP; VRWLETDHVATVIPG; RWLETDHVATVIPGP; WLETDHVATVIPGPD; LETDHVATVIPGPDA; ETDHVATVIPGPDAV; TDHVATVIPGPDAVV; DHVATVIPGPDAVVV; HVATVIPGPDAVVVT; VATVIPGPDAVVVTA; ATVIPGPDAVVVTAE; TVIPGPDAVVVTAEE; VIPGPDAVVVTAEEQ; IPGPDAVVVTAEEQN; PGPDAVVVTAEEQNA; GPDAVVVTAEEQNAA; PDAVVVTAEEQNAAD; DAVVVTAEEQNAADE; AVVVTAEEQNAADER; VVVTAEEQNAADERA; VVTAEEQNAADERAQ; VTAEEQNAADERAQH; TAEEQNAADERAQHR; AEEQNAADERAQHRF; EEQNAADERAQHRFG; EQNAADERAQHRFGA; QNAADERAQHRFGAV; NAADERAQHRFGAVQ; AADERAQHRFGAVQS; ADERAQHRFGAVQSA; DERAQHRFGAVQSAI; ERAQHRFGAVQSAIL; RAQHRFGAVQSAILH; AQHRFGAVQSAILHA; QHRFGAVQSAILHAR; HRFGAVQSAILHARG; RFGAVQSAILHARGT;<br><br>16 mers:<br>MKAKVGDWLVIKGATI; KAKVGDWLVIKGATID; AKVGDWLVIKGATIDQ; KVGDWLVIKGATIDQP; VGDWLVIKGATIDQPD; GDWLVIKGATIDQPDH; DWLVIKGATIDQPDHR; WLVIKGATIDQPDHRG; LVIKGATIDQPDHRGL; VIKGATIDQPDHRGLI; IKGATIDQPDHRGLII; KGATIDQPDHRGLIIE; GATIDQPDHRGLIIEV; ATIDQPDHRGLIIEVR; TIDQPDHRGLIIEVRS; IDQPDHRGLIIEVRSS; DQPDHRGLIIEVRSSD; QPDHRGLIIEVRSSDG; PDHRGLIIEVRSSDGS; DHRGLIIEVRSSDGSP; HRGLIIEVRSSDGSPP; RGLIIEVRSSDGSPPY; GLIIEVRSSDGSPPYV; LIIEVRSSDGSPPYVV; IIEVRSSDGSPPYVVR; IEVRSSDGSPPYVVRW; EVRSSDGSPPYVVRWL; VRSSDGSPPYVVRWLE; RSSDGSPPYVVRWLET; SSDGSPPYVVRWLETD; SDGSPPYVVRWLETDH; DGSPPYVVRWLETDHV; GSPPYVVRWLETDHVA; SPPYVVRWLETDHVAT; PPYVVRWLETDHVATV; PYVVRWLETDHVATVI; YVVRWLETDHVATVIP; VVRWLETDHVATVIPG; VRWLETDHVATVIPGP; RWLETDHVATVIPGPD; WLETDHVATVIPGPDA; LETDHVATVIPGPDAV; ETDHVATVIPGPDAVV; TDHVATVIPGPDAVVV; DHVATVIPGPDAVVVT; HVATVIPGPDAVVVTA; VATVIPGPDAVVVTAE; ATVIPGPDAVVVTAEE; TVIPGPDAVVVTAEEQ; VIPGPDAVVVTAEEQN; IPGPDAVVVTAEEQNA; PGPDAVVVTAEEQNAA; GPDAVVVTAEEQNAAD; PDAVVVTAEEQNAADE; DAVVVTAEEQNAADER; AVVVTAEEQNAADERA; VVVTAEEQNAADERAQ; VVTAEEQNAADERAQH; VTAEEQNAADERAQHR; TAEEQNAADERAQHRF; AEEQNAADERAQHRFG; EEQNAADERAQHRFGA; EQNAADERAQHRFGAV; QNAADERAQHRFGAVQ; NAADERAQHRFGAVQS; AADERAQHRFGAVQSA; ADERAQHRFGAVQSAI; DERAQHRFGAVQSAIL; ERAQHRFGAVQSAILH; RAQHRFGAVQSAILHA; AQHRFGAVQSAILHAR; QHRFGAVQSAILHARG; HRFGAVQSAILHARGT; | |
| 11) Rv0789c | 13 mers:<br>MSRRAIHSGRAAP; SRRAIHSGRAAPR; RRAIHSGRAAPRR; RAIHSGRAAPRRS; AIHSGRAAPRRSG; IHSGRAAPRRSGN; HSGRAAPRRSGNS; SGRAAPRRSGNSH; GRAAPRRSGNSHL; RAAPRRSGNSHLV; AAPRRSGNSHLVL; APRRSGNSHLVLR; PRRSGNSHLVLRN; RRSGNSHLVLRNR; RSGNSHLVLRNRV; SGNSHLVLRNRVP; GNSHLVLRNRVPS; NSHLVLRNRVPSS; SHLVLRNRVPSSK; HLVLRNRVPSSKD; LVLRNRVPSSKDS; VLRNRVPSSKDSP; LRNRVPSSKDSPR; RNRVPSSKDSPRR; NRVPSSKDSPRRR; RVPSSKDSPRRRP; VPSSKDSPRRRPH; PSSKDSPRRRPHH; SSKDSPRRRPHHE; SKDSPRRRPHHEF; KDSPRRRPHHEFM; DSPRRRPHHEFMT; SPRRRPHHEFMTE; | 69385-70122 |

Fig. 29 continued

PRRRPHHEFMTES; RRRPHHEFMTESI; RRPHHEFMTESIG; RPHHEFMTESIGE;
PHHEFMTESIGEP; HHEFMTESIGEPL; HEFMTESIGEPLS; EFMTESIGEPLST;
FMTESIGEPLSTN; MTESIGEPLSTNL; TESIGEPLSTNLI; ESIGEPLSTNLIE;
SIGEPLSTNLIER; IGEPLSTNLIERY; GEPLSTNLIERYL; EPLSTNLIERYLR;
PLSTNLIERYLRA; LSTNLIERYLRAR; STNLIERYLRARG; TNLIERYLRARGR;
NLIERYLRARGRR; LIERYLRARGRRY; IERYLRARGRRYF; ERYLRARGRRYFR;
RYLRARGRRYFRG; YLRARGRRYFRGH; LRARGRRYFRGHH;
RARGRRYFRGHHD; ARGRRYFRGHHDA; RGRRYFRGHHDAE;
GRRYFRGHHDAEF; RRYFRGHHDAEFF; RYFRGHHDAEFFF;
YFRGHHDAEFFFV; FRGHHDAEFFFVA; RGHHDAEFFFVAN; GHHDAEFFFVANA;
HHDAEFFFVANAH; HDAEFFFVANAHL; DAEFFFVANAHLL; AEFFFVANAHLLH;
EFFFVANAHLLHV; FFFVANAHLLHVH; FFVANAHLLHVHL; FVANAHLLHVHLE;
VANAHLLHVHLEI; ANAHLLHVHLEIS; NAHLLHVHLEISP; AHLLHVHLEISPA;
HLLHVHLEISPAY; LLHVHLEISPAYR; LHVHLEISPAYRD; HVHLEISPAYRDV;
VHLEISPAYRDVF; HLEISPAYRDVFT; LEISPAYRDVFTI; EISPAYRDVFTIR;
ISPAYRDVFTIRV; SPAYRDVFTIRVS; PAYRDVFTIRVSP; AYRDVFTIRVSPA;
YRDVFTIRVSPAY; RDVFTIRVSPAYF; DVFTIRVSPAYFF; VFTIRVSPAYFFP;
FTIRVSPAYFFPA; TIRVSPAYFFPAT; IRVSPAYFFPATD; RVSPAYFFPATDH;
VSPAYFFPATDHT; SPAYFFPATDHTR; PAYFFPATDHTRL; AYFFPATDHTRLA;
YFFPATDHTRLAE; FFPATDHTRLAEI; FPATDHTRLAEIV; PATDHTRLAEIVN;
ATDHTRLAEIVNA; TDHTRLAEIVNAW; DHTRLAEIVNAWN; HTRLAEIVNAWNL;
TRLAEIVNAWNLQ; RLAEIVNAWNLQN; LAEIVNAWNLQNH; AEIVNAWNLQNHE;
EIVNAWNLQNHEV; IVNAWNLQNHEVT; VNAWNLQNHEVTA; NAWNLQNHEVTAI;
AWNLQNHEVTAIV; WNLQNHEVTAIVH; NLQNHEVTAIVHG; LQNHEVTAIVHGS;
QNHEVTAIVHGSS; NHEVTAIVHGSSD; HEVTAIVHGSSDP; EVTAIVHGSSDPH;
VTAIVHGSSDPHR; TAIVHGSSDPHRI; AIVHGSSDPHRIG; IVHGSSDPHRIGV;
VHGSSDPHRIGVA; HGSSDPHRIGVAA; GSSDPHRIGVAAE; SSDPHRIGVAAER;
SDPHRIGVAAERS; DPHRIGVAAERSL; PHRIGVAAERSLI; HRIGVAAERSLIR;
RIGVAAERSLIRD; IGVAAERSLIRDR; GVAAERSLIRDRI; VAAERSLIRDRIR;
AAERSLIRDRIRF; AERSLIRDRIRFD; ERSLIRDRIRFDD; RSLIRDRIRFDDF;
SLIRDRIRFDDFA; LIRDRIRFDDFAT; IRDRIRFDDFATF; RDRIRFDDFATFV;
DRIRFDDFATFVD; RIRFDDFATFVDN; IRFDDFATFVDNA; RFDDFATFVDNAV;
FDDFATFVDNAVS; DDFATFVDNAVSA; DFATFVDNAVSAA; FATFVDNAVSAAT;
ATFVDNAVSAATE; TFVDNAVSAATEL; FVDNAVSAATELF; VDNAVSAATELFG;
DNAVSAATELFGQ; NAVSAATELFGQL; AVSAATELFGQLT; VSAATELFGQLTA;
SAATELFGQLTAA; AATELFGQLTAAG; ATELFGQLTAAGL; TELFGQLTAAGLP;
ELFGQLTAAGLPP; LFGQLTAAGLPPT; FGQLTAAGLPPTA; GQLTAAGLPPTAT;
QLTAAGLPPTATP; LTAAGLPPTATPP; TAAGLPPTATPPL; AAGLPPTATPPLL;
AGLPPTATPPLLR; GLPPTATPPLLRD; LPPTATPPLLRDA; PPTATPPLLRDAG 14 mers:
MSRRAIHSGRAAPR; SRRAIHSGRAAPRR; RRAIHSGRAAPRRS;
RAIHSGRAAPRRSG; AIHSGRAAPRRSGN; IHSGRAAPRRSGNS;
HSGRAAPRRSGNSH; SGRAAPRRSGNSHL; GRAAPRRSGNSHLV;
RAAPRRSGNSHLVL; AAPRRSGNSHLVLR; APRRSGNSHLVLRN;
PRRSGNSHLVLRNR; RRSGNSHLVLRNRV; RSGNSHLVLRNRVP;
SGNSHLVLRNRVPS; GNSHLVLRNRVPSS; NSHLVLRNRVPSSK;
SHLVLRNRVPSSKD; HLVLRNRVPSSKDS; LVLRNRVPSSKDSP;
VLRNRVPSSKDSPR; LRNRVPSSKDSPRR; RNRVPSSKDSPRRR;
NRVPSSKDSPRRRP; RVPSSKDSPRRRPH; VPSSKDSPRRRPHH;
PSSKDSPRRRPHHE; SSKDSPRRRPHHEF; SKDSPRRRPHHEFM;
KDSPRRRPHHEFMT; DSPRRRPHHEFMTE; SPRRRPHHEFMTES;
PRRRPHHEFMTESI; RRRPHHEFMTESIG; RRPHHEFMTESIGE;

Fig. 29 continued

| | | |
|---|---|---|
| | RPHHEFMTESIGEP; PHHEFMTESIGEPL; HHEFMTESIGEPLS;<br>HEFMTESIGEPLST; EFMTESIGEPLSTN; FMTESIGEPLSTNL;<br>MTESIGEPLSTNLI; TESIGEPLSTNLIE; ESIGEPLSTNLIER; SIGEPLSTNLIERY;<br>IGEPLSTNLIERYL; GEPLSTNLIERYLR; EPLSTNLIERYLRA; PLSTNLIERYLRAR;<br>LSTNLIERYLRARG; STNLIERYLRARGR; TNLIERYLRARGRR;<br>NLIERYLRARGRRY; LIERYLRARGRRYF; IERYLRARGRRYFR;<br>ERYLRARGRRYFRG; RYLRARGRRYFRGH; YLRARGRRYFRGHH;<br>LRARGRRYFRGHHD; RARGRRYFRGHHDA; ARGRRYFRGHHDAE;<br>RGRRYFRGHHDAEF; GRRYFRGHHDAEFF; RRYFRGHHDAEFFF;<br>RYFRGHHDAEFFFV; YFRGHHDAEFFFVA; FRGHHDAEFFFVAN;<br>RGHHDAEFFFVANA; GHHDAEFFFVANAH; HHDAEFFFVANAHL;<br>HDAEFFFVANAHLL; DAEFFFVANAHLLH; AEFFFVANAHLLHV;<br>EFFFVANAHLLHVH; FFFVANAHLLHVHL; FFVANAHLLHVHLE;<br>FVANAHLLHVHLEI; VANAHLLHVHLEIS; ANAHLLHVHLEISP; NAHLLHVHLEISPA;<br>AHLLHVHLEISPAY; HLLHVHLEISPAYR; LLHVHLEISPAYRD; LHVHLEISPAYRDV;<br>HVHLEISPAYRDVF; VHLEISPAYRDVFT; HLEISPAYRDVFTI; LEISPAYRDVFTIR;<br>EISPAYRDVFTIRV; ISPAYRDVFTIRVS; SPAYRDVFTIRVSP; PAYRDVFTIRVSPA;<br>AYRDVFTIRVSPAY; YRDVFTIRVSPAYF; RDVFTIRVSPAYFF;<br>DVFTIRVSPAYFFP; VFTIRVSPAYFFPA; FTIRVSPAYFFPAT; TIRVSPAYFFPATD;<br>IRVSPAYFFPATDH; RVSPAYFFPATDHT; VSPAYFFPATDHTR;<br>SPAYFFPATDHTRL; PAYFFPATDHTRLA; AYFFPATDHTRLAE;<br>YFFPATDHTRLAEI; FFPATDHTRLAEIV; FPATDHTRLAEIVN; PATDHTRLAEIVNA;<br>ATDHTRLAEIVNAW; TDHTRLAEIVNAWN; DHTRLAEIVNAWNL;<br>HTRLAEIVNAWNLQ; TRLAEIVNAWNLQN; RLAEIVNAWNLQNH;<br>LAEIVNAWNLQNHE; AEIVNAWNLQNHEV; EIVNAWNLQNHEVT;<br>IVNAWNLQNHEVTA; VNAWNLQNHEVTAI; NAWNLQNHEVTAIV;<br>AWNLQNHEVTAIVH; WNLQNHEVTAIVHG; NLQNHEVTAIVHGS;<br>LQNHEVTAIVHGSS; QNHEVTAIVHGSSD; NHEVTAIVHGSSDP;<br>HEVTAIVHGSSDPH; EVTAIVHGSSDPHR; VTAIVHGSSDPHRI;<br>TAIVHGSSDPHRIG; AIVHGSSDPHRIGV; IVHGSSDPHRIGVA;<br>VHGSSDPHRIGVAA; HGSSDPHRIGVAAE; GSSDPHRIGVAAER;<br>SSDPHRIGVAAERS; SDPHRIGVAAERSL; DPHRIGVAAERSLI;<br>PHRIGVAAERSLIR; HRIGVAAERSLIRD; RIGVAAERSLIRDR; IGVAAERSLIRDRI;<br>GVAAERSLIRDRIR; VAAERSLIRDRIRF; AAERSLIRDRIRFD; AERSLIRDRIRFDD;<br>ERSLIRDRIRFDDF; RSLIRDRIRFDDFA; SLIRDRIRFDDFAT; LIRDRIRFDDFATF;<br>IRDRIRFDDFATFV; RDRIRFDDFATFVD; DRIRFDDFATFVDN;<br>RIRFDDFATFVDNA; IRFDDFATFVDNAV; RFDDFATFVDNAVS;<br>FDDFATFVDNAVSA; DDFATFVDNAVSAA; DFATFVDNAVSAAT;<br>FATFVDNAVSAATE; ATFVDNAVSAATEL; TFVDNAVSAATELF;<br>FVDNAVSAATELFG; VDNAVSAATELFGQ; DNAVSAATELFGQL;<br>NAVSAATELFGQLT; AVSAATELFGQLTA; VSAATELFGQLTAA;<br>SAATELFGQLTAAG; AATELFGQLTAAGL; ATELFGQLTAAGLP;<br>TELFGQLTAAGLPP; ELFGQLTAAGLPPT; LFGQLTAAGLPPTA;<br>FGQLTAAGLPPTAT; GQLTAAGLPPTATP; QLTAAGLPPTATPP;<br>LTAAGLPPTATPPL; TAAGLPPTATPPLL; AAGLPPTATPPLLR;<br>AGLPPTATPPLLRD; GLPPTATPPLLRDA; LPPTATPPLLRDAG<br><br>15 mers:<br>MSRRAIHSGRAAPRR; SRRAIHSGRAAPRRS; RRAIHSGRAAPRRSG;<br>RAIHSGRAAPRRSGN; AIHSGRAAPRRSGNS; IHSGRAAPRRSGNSH;<br>HSGRAAPRRSGNSHL; SGRAAPRRSGNSHLV; GRAAPRRSGNSHLVL;<br>RAAPRRSGNSHLVLR; AAPRRSGNSHLVLRN; APRRSGNSHLVLRNR;<br>PRRSGNSHLVLRNRV; RRSGNSHLVLRNRVP; RSGNSHLVLRNRVPS; | |

Fig. 29 continued

| | | |
|---|---|---|
| | SGNSHLVLRNRVPSS; GNSHLVLRNRVPSSK; NSHLVLRNRVPSSKD; SHLVLRNRVPSSKDS; HLVLRNRVPSSKDSP; LVLRNRVPSSKDSPR; VLRNRVPSSKDSPRR; LRNRVPSSKDSPRRR; RNRVPSSKDSPRRRP; NRVPSSKDSPRRRPH; RVPSSKDSPRRRPHH; VPSSKDSPRRRPHHE; PSSKDSPRRRPHHEF; SSKDSPRRRPHHEFM; SKDSPRRRPHHEFMT; KDSPRRRPHHEFMTE; DSPRRRPHHEFMTES; SPRRRPHHEFMTESI; PRRRPHHEFMTESIG; RRRPHHEFMTESIGE; RRPHHEFMTESIGEP; RPHHEFMTESIGEPL; PHHEFMTESIGEPLS; HHEFMTESIGEPLST; HEFMTESIGEPLSTN; EFMTESIGEPLSTNL; FMTESIGEPLSTNLI; MTESIGEPLSTNLIE; TESIGEPLSTNLIER; ESIGEPLSTNLIERY; SIGEPLSTNLIERYL; IGEPLSTNLIERYLR; GEPLSTNLIERYLRA; EPLSTNLIERYLRAR; PLSTNLIERYLRARG; LSTNLIERYLRARGR; STNLIERYLRARGRR; TNLIERYLRARGRRY; NLIERYLRARGRRYF; LIERYLRARGRRYFR; IERYLRARGRRYFRG; ERYLRARGRRYFRGH; RYLRARGRRYFRGHH; YLRARGRRYFRGHHD; LRARGRRYFRGHHDA; RARGRRYFRGHHDAE; ARGRRYFRGHHDAEF; RGRRYFRGHHDAEFF; GRRYFRGHHDAEFFF; RRYFRGHHDAEFFFV; RYFRGHHDAEFFFVA; YFRGHHDAEFFFVAN; FRGHHDAEFFFVANA; RGHHDAEFFFVANAH; GHHDAEFFFVANAHL; HHDAEFFFVANAHLL; HDAEFFFVANAHLLH; DAEFFFVANAHLLHV; AEFFFVANAHLLHVH; EFFFVANAHLLHVHL; FFFVANAHLLHVHLE; FFVANAHLLHVHLEI; FVANAHLLHVHLEIS; VANAHLLHVHLEISP; ANAHLLHVHLEISPA; NAHLLHVHLEISPAY; AHLLHVHLEISPAYR; HLLHVHLEISPAYRD; LLHVHLEISPAYRDV; LHVHLEISPAYRDVF; HVHLEISPAYRDVFT; VHLEISPAYRDVFTI; HLEISPAYRDVFTIR; LEISPAYRDVFTIRV; EISPAYRDVFTIRVS; ISPAYRDVFTIRVSP; SPAYRDVFTIRVSPA; PAYRDVFTIRVSPAY; AYRDVFTIRVSPAYF; YRDVFTIRVSPAYFF; RDVFTIRVSPAYFFP; DVFTIRVSPAYFFPA; VFTIRVSPAYFFPAT; FTIRVSPAYFFPATD; TIRVSPAYFFPATDH; IRVSPAYFFPATDHT; RVSPAYFFPATDHTR; VSPAYFFPATDHTRL; SPAYFFPATDHTRLA; PAYFFPATDHTRLAE; AYFFPATDHTRLAEI; YFFPATDHTRLAEIV; FFPATDHTRLAEIVN; FPATDHTRLAEIVNA; PATDHTRLAEIVNAW; ATDHTRLAEIVNAWN; TDHTRLAEIVNAWNL; DHTRLAEIVNAWNLQ; HTRLAEIVNAWNLQN; TRLAEIVNAWNLQNH; RLAEIVNAWNLQNHE; LAEIVNAWNLQNHEV; AEIVNAWNLQNHEVT; EIVNAWNLQNHEVTA; IVNAWNLQNHEVTAI; VNAWNLQNHEVTAIV; NAWNLQNHEVTAIVH; AWNLQNHEVTAIVHG; WNLQNHEVTAIVHGS; NLQNHEVTAIVHGSS; LQNHEVTAIVHGSSD; QNHEVTAIVHGSSDP; NHEVTAIVHGSSDPH; HEVTAIVHGSSDPHR; EVTAIVHGSSDPHRI; VTAIVHGSSDPHRIG; TAIVHGSSDPHRIGV; AIVHGSSDPHRIGVA; IVHGSSDPHRIGVAA; VHGSSDPHRIGVAAE; HGSSDPHRIGVAAER; GSSDPHRIGVAAERS; SSDPHRIGVAAERSL; SDPHRIGVAAERSLI; DPHRIGVAAERSLIR; PHRIGVAAERSLIRD; HRIGVAAERSLIRDR; RIGVAAERSLIRDRI; IGVAAERSLIRDRIR; GVAAERSLIRDRIRF; VAAERSLIRDRIRFD; AAERSLIRDRIRFDD; AERSLIRDRIRFDDF; ERSLIRDRIRFDDFA; RSLIRDRIRFDDFAT; SLIRDRIRFDDFATF; LIRDRIRFDDFATFV; IRDRIRFDDFATFVD; RDRIRFDDFATFVDN; DRIRFDDFATFVDNA; RIRFDDFATFVDNAV; IRFDDFATFVDNAVS; RFDDFATFVDNAVSA; FDDFATFVDNAVSAA; DDFATFVDNAVSAAT; DFATFVDNAVSAATE; FATFVDNAVSAATEL; ATFVDNAVSAATELF; TFVDNAVSAATELFG; FVDNAVSAATELFGQ; VDNAVSAATELFGQL; DNAVSAATELFGQLT; NAVSAATELFGQLTA; AVSAATELFGQLTAA; VSAATELFGQLTAAG; SAATELFGQLTAAGL; AATELFGQLTAAGLP; ATELFGQLTAAGLPP; TELFGQLTAAGLPPT; | |

Fig. 29 continued

ELFGQLTAAGLPPTA; LFGQLTAAGLPPTAT; FGQLTAAGLPPTATP; GQLTAAGLPPTATPP; QLTAAGLPPTATPPL; LTAAGLPPTATPPLL; TAAGLPPTATPPLLR; AAGLPPTATPPLLRD; AGLPPTATPPLLRDA; GLPPTATPPLLRDAG 16 mers:
MSRRAIHSGRAAPRRS; SRRAIHSGRAAPRRSG; RRAIHSGRAAPRRSGN; RAIHSGRAAPRRSGNS; AIHSGRAAPRRSGNSH; IHSGRAAPRRSGNSHL; HSGRAAPRRSGNSHLV; SGRAAPRRSGNSHLVL; GRAAPRRSGNSHLVLR; RAAPRRSGNSHLVLRN; AAPRRSGNSHLVLRNR; APRRSGNSHLVLRNRV; PRRSGNSHLVLRNRVP; RRSGNSHLVLRNRVPS; RSGNSHLVLRNRVPSS; SGNSHLVLRNRVPSSK; GNSHLVLRNRVPSSKD; NSHLVLRNRVPSSKDS; SHLVLRNRVPSSKDSP; HLVLRNRVPSSKDSPR; LVLRNRVPSSKDSPRR; VLRNRVPSSKDSPRRR; LRNRVPSSKDSPRRRP; RNRVPSSKDSPRRRPH; NRVPSSKDSPRRRPHH; RVPSSKDSPRRRPHHE; VPSSKDSPRRRPHHEF; PSSKDSPRRRPHHEFM; SSKDSPRRRPHHEFMT; SKDSPRRRPHHEFMTE; KDSPRRRPHHEFMTES; DSPRRRPHHEFMTESI; SPRRRPHHEFMTESIG; PRRRPHHEFMTESIGE; RRRPHHEFMTESIGEP; RRPHHEFMTESIGEPL; RPHHEFMTESIGEPLS; PHHEFMTESIGEPLST; HHEFMTESIGEPLSTN; HEFMTESIGEPLSTNL; EFMTESIGEPLSTNLI; FMTESIGEPLSTNLIE; MTESIGEPLSTNLIER; TESIGEPLSTNLIERY; ESIGEPLSTNLIERYL; SIGEPLSTNLIERYLR; IGEPLSTNLIERYLRA; GEPLSTNLIERYLRAR; EPLSTNLIERYLRARG; PLSTNLIERYLRARGR; LSTNLIERYLRARGRR; STNLIERYLRARGRRY; TNLIERYLRARGRRYF; NLIERYLRARGRRYFR; LIERYLRARGRRYFRG; IERYLRARGRRYFRGH; ERYLRARGRRYFRGHH; RYLRARGRRYFRGHHD; YLRARGRRYFRGHHDA; LRARGRRYFRGHHDAE; RARGRRYFRGHHDAEF; ARGRRYFRGHHDAEFF; RGRRYFRGHHDAEFFF; GRRYFRGHHDAEFFFV; RRYFRGHHDAEFFFVA; RYFRGHHDAEFFFVAN; YFRGHHDAEFFFVANA; FRGHHDAEFFFVANAH; RGHHDAEFFFVANAHL; GHHDAEFFFVANAHLL; HHDAEFFFVANAHLLH; HDAEFFFVANAHLLHV; DAEFFFVANAHLLHVH; AEFFFVANAHLLHVHL; EFFFVANAHLLHVHLE; FFFVANAHLLHVHLEI; FFVANAHLLHVHLEIS; FVANAHLLHVHLEISP; VANAHLLHVHLEISPA; ANAHLLHVHLEISPAY; NAHLLHVHLEISPAYR; AHLLHVHLEISPAYRD; HLLHVHLEISPAYRDV; LLHVHLEISPAYRDVF; LHVHLEISPAYRDVFT; HVHLEISPAYRDVFTI; VHLEISPAYRDVFTIR; HLEISPAYRDVFTIRV; LEISPAYRDVFTIRVS; EISPAYRDVFTIRVSP; ISPAYRDVFTIRVSPA; SPAYRDVFTIRVSPAY; PAYRDVFTIRVSPAYF; AYRDVFTIRVSPAYFF; YRDVFTIRVSPAYFFP; RDVFTIRVSPAYFFPA; DVFTIRVSPAYFFPAT; VFTIRVSPAYFFPATD; FTIRVSPAYFFPATDH; TIRVSPAYFFPATDHT; IRVSPAYFFPATDHTR; RVSPAYFFPATDHTRL; VSPAYFFPATDHTRLA; SPAYFFPATDHTRLAE; PAYFFPATDHTRLAEI; AYFFPATDHTRLAEIV; YFFPATDHTRLAEIVN; FFPATDHTRLAEIVNA; FPATDHTRLAEIVNAW; PATDHTRLAEIVNAWN; ATDHTRLAEIVNAWNL; TDHTRLAEIVNAWNLQ; DHTRLAEIVNAWNLQN; HTRLAEIVNAWNLQNH; TRLAEIVNAWNLQNHE; RLAEIVNAWNLQNHEV; LAEIVNAWNLQNHEVT; AEIVNAWNLQNHEVTA; EIVNAWNLQNHEVTAI; IVNAWNLQNHEVTAIV; VNAWNLQNHEVTAIVH; NAWNLQNHEVTAIVHG; AWNLQNHEVTAIVHGS; WNLQNHEVTAIVHGSS; NLQNHEVTAIVHGSSD; LQNHEVTAIVHGSSDP; QNHEVTAIVHGSSDPH; NHEVTAIVHGSSDPHR; HEVTAIVHGSSDPHRI; EVTAIVHGSSDPHRIG; VTAIVHGSSDPHRIGV; TAIVHGSSDPHRIGVA; AIVHGSSDPHRIGVAA; IVHGSSDPHRIGVAAE; VHGSSDPHRIGVAAER; HGSSDPHRIGVAAERS; GSSDPHRIGVAAERSL; SSDPHRIGVAAERSLI; SDPHRIGVAAERSLIR; DPHRIGVAAERSLIRD; PHRIGVAAERSLIRDR;

Fig. 29 continued

| | | |
|---|---|---|
| | HRIGVAAERSLIRDRI; RIGVAAERSLIRDRIR; IGVAAERSLIRDRIRF; GVAAERSLIRDRIRFD; VAAERSLIRDRIRFDD; AAERSLIRDRIRFDDF; AERSLIRDRIRFDDFA; ERSLIRDRIRFDDFAT; RSLIRDRIRFDDFATF; SLIRDRIRFDDFATFV; LIRDRIRFDDFATFVD; IRDRIRFDDFATFVDN; RDRIRFDDFATFVDNA; DRIRFDDFATFVDNAV; RIRFDDFATFVDNAVS; IRFDDFATFVDNAVSA; RFDDFATFVDNAVSAA; FDDFATFVDNAVSAAT; DDFATFVDNAVSAATE; DFATFVDNAVSAATEL; FATFVDNAVSAATELF; ATFVDNAVSAATELFG; TFVDNAVSAATELFGQ; FVDNAVSAATELFGQL; VDNAVSAATELFGQLT; DNAVSAATELFGQLTA; NAVSAATELFGQLTAA; AVSAATELFGQLTAAG; VSAATELFGQLTAAGL; SAATELFGQLTAAGLP; AATELFGQLTAAGLPP; ATELFGQLTAAGLPPT; TELFGQLTAAGLPPTA; ELFGQLTAAGLPPTAT; LFGQLTAAGLPPTATP; FGQLTAAGLPPTATPP; GQLTAAGLPPTATPPL; QLTAAGLPPTATPPLL; LTAAGLPPTATPPLLR; TAAGLPPTATPPLLRD; AAGLPPTATPPLLRDA; AGLPPTATPPLLRDAG | |
| 12) Rv0918 | 13 mers:<br>MHRAGAAVTANVW; HRAGAAVTANVWC; RAGAAVTANVWCR; AGAAVTANVWCRA; GAAVTANVWCRAG; AAVTANVWCRAGG; AVTANVWCRAGGI; VTANVWCRAGGIR; TANVWCRAGGIRM; ANVWCRAGGIRMA; NVWCRAGGIRMAP; VWCRAGGIRMAPR; WCRAGGIRMAPRP; CRAGGIRMAPRPV; RAGGIRMAPRPVI; AGGIRMAPRPVIP; GGIRMAPRPVIPV; GIRMAPRPVIPVA; IRMAPRPVIPVAT; RMAPRPVIPVATQ; MAPRPVIPVATQQ; APRPVIPVATQQR; PRPVIPVATQQRL; RPVIPVATQQRLR; PVIPVATQQRLRR; VIPVATQQRLRRQ; IPVATQQRLRRQA; PVATQQRLRRQAD; VATQQRLRRQADR; ATQQRLRRQADRQ; TQQRLRRQADRQS; QQRLRRQADRQSL; QRLRRQADRQSLG; RLRRQADRQSLGS; LRRQADRQSLGSS; RRQADRQSLGSSG; RQADRQSLGSSGL; QADRQSLGSSGLP; ADRQSLGSSGLPA; DRQSLGSSGLPAL; RQSLGSSGLPALN; QSLGSSGLPALNC; SLGSSGLPALNCT; LGSSGLPALNCTP; GSSGLPALNCTPI; SSGLPALNCTPIR; SGLPALNCTPIRH; GLPALNCTPIRHT; LPALNCTPIRHTI; PALNCTPIRHTID; ALNCTPIRHTIDV; LNCTPIRHTIDVM; NCTPIRHTIDVMA; CTPIRHTIDVMAT; TPIRHTIDVMATK; PIRHTIDVMATKP; IRHTIDVMATKPE; RHTIDVMATKPER; HTIDVMATKPERK; TIDVMATKPERKT; IDVMATKPERKTE; DVMATKPERKTER; VMATKPERKTERL; MATKPERKTERLA; ATKPERKTERLAA; TKPERKTERLAAR; KPERKTERLAARL; PERKTERLAARLT; ERKTERLAARLTP; RKTERLAARLTPE; KTERLAARLTPEQ; TERLAARLTPEQD; ERLAARLTPEQDA; RLAARLTPEQDAL; LAARLTPEQDALI; AARLTPEQDALIR; ARLTPEQDALIRR; RLTPEQDALIRRA; LTPEQDALIRRAA; TPEQDALIRRAAE; PEQDALIRRAAEA; EQDALIRRAAEAE; QDALIRRAAEAEG; DALIRRAAEAEGT; ALIRRAAEAEGTD; LIRRAAEAEGTDL; IRRAAEAEGTDLT; RRAAEAEGTDLTN; RAAEAEGTDLTNF; AAEAEGTDLTNFT; AEAEGTDLTNFTV; EAEGTDLTNFTVT; AEGTDLTNFTVTA; EGTDLTNFTVTAA; GTDLTNFTVTAAL; TDLTNFTVTAALA; DLTNFTVTAALAH; LTNFTVTAALAHA; TNFTVTAALAHAR; NFTVTAALAHARD; FTVTAALAHARDV; TVTAALAHARDVL; VTAALAHARDVLA; TAALAHARDVLAD; AALAHARDVLADR; ALAHARDVLADRR; LAHARDVLADRRL; AHARDVLADRRLF; HARDVLADRRLFV; ARDVLADRRLFVL; RDVLADRRLFVLT; DVLADRRLFVLTD; VLADRRLFVLTDA; LADRRLFVLTDAA; ADRRLFVLTDAAW; DRRLFVLTDAAWT; RRLFVLTDAAWTE; RLFVLTDAAWTEF; LFVLTDAAWTEFL; FVLTDAAWTEFLA; VLTDAAWTEFLAA; LTDAAWTEFLAAL; TDAAWTEFLAALD; DAAWTEFLAALDR; AAWTEFLAALDRP; AWTEFLAALDRPV; WTEFLAALDRPVS; TEFLAALDRPVSH; EFLAALDRPVSHK; FLAALDRPVSHKP; LAALDRPVSHKPR; AALDRPVSHKPRL; ALDRPVSHKPRLE; LDRPVSHKPRLEK; DRPVSHKPRLEKL; RPVSHKPRLEKLF; PVSHKPRLEKLFA; VSHKPRLEKLFAA; SHKPRLEKLFAAR; HKPRLEKLFAARS; | 70123-70700 |

Fig. 29 continued

| | | |
|---|---|---|
| | KPRLEKLFAARSI; PRLEKLFAARSIF; RLEKLFAARSIFD; LEKLFAARSIFDT; EKLFAARSIFDTE; KLFAARSIFDTEG<br><br>14 mers:<br>MHRAGAAVTANVWC; HRAGAAVTANVWCR; RAGAAVTANVWCRA; AGAAVTANVWCRAG; GAAVTANVWCRAGG; AAVTANVWCRAGGI; AVTANVWCRAGGIR; VTANVWCRAGGIRM; TANVWCRAGGIRMA; ANVWCRAGGIRMAP; NVWCRAGGIRMAPR; VWCRAGGIRMAPRP; WCRAGGIRMAPRPV; CRAGGIRMAPRPVI; RAGGIRMAPRPVIP; AGGIRMAPRPVIPV; GGIRMAPRPVIPVA; GIRMAPRPVIPVAT; IRMAPRPVIPVATQ; RMAPRPVIPVATQQ; MAPRPVIPVATQQR; APRPVIPVATQQRL; PRPVIPVATQQRLR; RPVIPVATQQRLRR; PVIPVATQQRLRRQ; VIPVATQQRLRRQA; IPVATQQRLRRQAD; PVATQQRLRRQADR; VATQQRLRRQADRQ; ATQQRLRRQADRQS; TQQRLRRQADRQSL; QQRLRRQADRQSLG; QRLRRQADRQSLGS; RLRRQADRQSLGSS; LRRQADRQSLGSSG; RRQADRQSLGSSGL; RQADRQSLGSSGLP; QADRQSLGSSGLPA; ADRQSLGSSGLPAL; DRQSLGSSGLPALN; RQSLGSSGLPALNC; QSLGSSGLPALNCT; SLGSSGLPALNCTP; LGSSGLPALNCTPI; GSSGLPALNCTPIR; SSGLPALNCTPIRH; SGLPALNCTPIRHT; GLPALNCTPIRHTI; LPALNCTPIRHTID; PALNCTPIRHTIDV; ALNCTPIRHTIDVM; LNCTPIRHTIDVMA; NCTPIRHTIDVMAT; CTPIRHTIDVMATK; TPIRHTIDVMATKP; PIRHTIDVMATKPE; IRHTIDVMATKPER; RHTIDVMATKPERK; HTIDVMATKPERKT; TIDVMATKPERKTE; IDVMATKPERKTER; DVMATKPERKTERL; VMATKPERKTERLA; MATKPERKTERLAA; ATKPERKTERLAAR; TKPERKTERLAARL; KPERKTERLAARLT; PERKTERLAARLTP; ERKTERLAARLTPE; RKTERLAARLTPEQ; KTERLAARLTPEQD; TERLAARLTPEQDA; ERLAARLTPEQDAL; RLAARLTPEQDALI; LAARLTPEQDALIR; AARLTPEQDALIRR; ARLTPEQDALIRRA; RLTPEQDALIRRAA; LTPEQDALIRRAAE; TPEQDALIRRAAEA; PEQDALIRRAAEAE; EQDALIRRAAEAEG; QDALIRRAAEAEGT; DALIRRAAEAEGTD; ALIRRAAEAEGTDL; LIRRAAEAEGTDLT; IRRAAEAEGTDLTN; RRAAEAEGTDLTNF; RAAEAEGTDLTNFT; AAEAEGTDLTNFTV; AEAEGTDLTNFTVT; EAEGTDLTNFTVTA; AEGTDLTNFTVTAA; EGTDLTNFTVTAAL; GTDLTNFTVTAALA; TDLTNFTVTAALAH; DLTNFTVTAALAHA; LTNFTVTAALAHAR; TNFTVTAALAHARD; NFTVTAALAHARDV; FTVTAALAHARDVL; TVTAALAHARDVLA; VTAALAHARDVLAD; TAALAHARDVLADR; AALAHARDVLADRR; ALAHARDVLADRRL; LAHARDVLADRRLF; AHARDVLADRRLFV; HARDVLADRRLFVL; ARDVLADRRLFVLT; RDVLADRRLFVLTD; DVLADRRLFVLTDA; VLADRRLFVLTDAA; LADRRLFVLTDAAW; ADRRLFVLTDAAWT; DRRLFVLTDAAWTE; RRLFVLTDAAWTEF; RLFVLTDAAWTEFL; LFVLTDAAWTEFLA; FVLTDAAWTEFLAA; VLTDAAWTEFLAAL; LTDAAWTEFLAALD; TDAAWTEFLAALDR; DAAWTEFLAALDRP; AAWTEFLAALDRPV; AWTEFLAALDRPVS; WTEFLAALDRPVSH; TEFLAALDRPVSHK; EFLAALDRPVSHKP; FLAALDRPVSHKPR; LAALDRPVSHKPRL; AALDRPVSHKPRLE; ALDRPVSHKPRLEK; LDRPVSHKPRLEKL; DRPVSHKPRLEKLF; RPVSHKPRLEKLFA; PVSHKPRLEKLFAA; VSHKPRLEKLFAAR; SHKPRLEKLFAARS; HKPRLEKLFAARSI; KPRLEKLFAARSIF; PRLEKLFAARSIFD; RLEKLFAARSIFDT; LEKLFAARSIFDTE; EKLFAARSIFDTEG<br><br>15 mers: | |

Fig. 29 continued

| | | |
|---|---|---|
| | MHRAGAAVTANVWCR; HRAGAAVTANVWCRA; RAGAAVTANVWCRAG;<br>AGAAVTANVWCRAGG; GAAVTANVWCRAGGI; AAVTANVWCRAGGIR;<br>AVTANVWCRAGGIRM; VTANVWCRAGGIRMA; TANVWCRAGGIRMAP;<br>ANVWCRAGGIRMAPR; NVWCRAGGIRMAPRP; VWCRAGGIRMAPRPV;<br>WCRAGGIRMAPRPVI; CRAGGIRMAPRPVIP; RAGGIRMAPRPVIPV;<br>AGGIRMAPRPVIPVA; GGIRMAPRPVIPVAT; GIRMAPRPVIPVATQ;<br>IRMAPRPVIPVATQQ; RMAPRPVIPVATQQR; MAPRPVIPVATQQRL;<br>APRPVIPVATQQRLR; PRPVIPVATQQRLRR; RPVIPVATQQRLRRQ;<br>PVIPVATQQRLRRQA; VIPVATQQRLRRQAD; IPVATQQRLRRQADR;<br>PVATQQRLRRQADRQ; VATQQRLRRQADRQS; ATQQRLRRQADRQSL;<br>TQQRLRRQADRQSLG; QQRLRRQADRQSLGS; QRLRRQADRQSLGSS;<br>RLRRQADRQSLGSSG; LRRQADRQSLGSSGL; RRQADRQSLGSSGLP;<br>RQADRQSLGSSGLPA; QADRQSLGSSGLPAL; ADRQSLGSSGLPALN;<br>DRQSLGSSGLPALNC; RQSLGSSGLPALNCT; QSLGSSGLPALNCTP;<br>SLGSSGLPALNCTPI; LGSSGLPALNCTPIR; GSSGLPALNCTPIRH;<br>SSGLPALNCTPIRHT; SGLPALNCTPIRHTI; GLPALNCTPIRHTID;<br>LPALNCTPIRHTIDV; PALNCTPIRHTIDVM; ALNCTPIRHTIDVMA;<br>LNCTPIRHTIDVMAT; NCTPIRHTIDVMATK; CTPIRHTIDVMATKP;<br>TPIRHTIDVMATKPE; PIRHTIDVMATKPER; IRHTIDVMATKPERK;<br>RHTIDVMATKPERKT; HTIDVMATKPERKTE; TIDVMATKPERKTER;<br>IDVMATKPERKTERL; DVMATKPERKTERLA; VMATKPERKTERLAA;<br>MATKPERKTERLAAR; ATKPERKTERLAARL; TKPERKTERLAARLT;<br>KPERKTERLAARLTP; PERKTERLAARLTPE; ERKTERLAARLTPEQ;<br>RKTERLAARLTPEQD; KTERLAARLTPEQDA; TERLAARLTPEQDAL;<br>ERLAARLTPEQDALI; RLAARLTPEQDALIR; LAARLTPEQDALIRR;<br>AARLTPEQDALIRRA; ARLTPEQDALIRRAA; RLTPEQDALIRRAAE;<br>LTPEQDALIRRAAEA; TPEQDALIRRAAEAE; PEQDALIRRAAEAEG;<br>EQDALIRRAAEAEGT; QDALIRRAAEAEGTD; DALIRRAAEAEGTDL;<br>ALIRRAAEAEGTDLT; LIRRAAEAEGTDLTN; IRRAAEAEGTDLTNF;<br>RRAAEAEGTDLTNFT; RAAEAEGTDLTNFTV; AAEAEGTDLTNFTVT;<br>AEAEGTDLTNFTVTA; EAEGTDLTNFTVTAA; AEGTDLTNFTVTAAL;<br>EGTDLTNFTVTAALA; GTDLTNFTVTAALAH; TDLTNFTVTAALAHA;<br>DLTNFTVTAALAHAR; LTNFTVTAALAHARD; TNFTVTAALAHARDV;<br>NFTVTAALAHARDVL; FTVTAALAHARDVLA; TVTAALAHARDVLAD;<br>VTAALAHARDVLADR; TAALAHARDVLADRR; AALAHARDVLADRRL;<br>ALAHARDVLADRRLF; LAHARDVLADRRLFV; AHARDVLADRRLFVL;<br>HARDVLADRRLFVLT; ARDVLADRRLFVLTD; RDVLADRRLFVLTDA;<br>DVLADRRLFVLTDAA; VLADRRLFVLTDAAW; LADRRLFVLTDAAWT;<br>ADRRLFVLTDAAWTE; DRRLFVLTDAAWTEF; RRLFVLTDAAWTEFL;<br>RLFVLTDAAWTEFLA; LFVLTDAAWTEFLAA; FVLTDAAWTEFLAAL;<br>VLTDAAWTEFLAALD; LTDAAWTEFLAALDR; TDAAWTEFLAALDRP;<br>DAAWTEFLAALDRPV; AAWTEFLAALDRPVS; AWTEFLAALDRPVSH;<br>WTEFLAALDRPVSHK; TEFLAALDRPVSHKP; EFLAALDRPVSHKPR;<br>FLAALDRPVSHKPRL; LAALDRPVSHKPRLE; AALDRPVSHKPRLEK;<br>ALDRPVSHKPRLEKL; LDRPVSHKPRLEKLF; DRPVSHKPRLEKLFA;<br>RPVSHKPRLEKLFAA; PVSHKPRLEKLFAAR; VSHKPRLEKLFAARS;<br>SHKPRLEKLFAARSI; HKPRLEKLFAARSIF; KPRLEKLFAARSIFD;<br>PRLEKLFAARSIFDT; RLEKLFAARSIFDTE; LEKLFAARSIFDTEG<br><br>16 mers:<br>MHRAGAAVTANVWCRA; HRAGAAVTANVWCRAG; RAGAAVTANVWCRAGG;<br>AGAAVTANVWCRAGGI; GAAVTANVWCRAGGIR; AAVTANVWCRAGGIRM;<br>AVTANVWCRAGGIRMA; VTANVWCRAGGIRMAP; TANVWCRAGGIRMAPR; | |

Fig. 29 continued

| | | |
|---|---|---|
| | ANVWCRAGGIRMAPRP; NVWCRAGGIRMAPRPV; VWCRAGGIRMAPRPVI; WCRAGGIRMAPRPVIP; CRAGGIRMAPRPVIPV; RAGGIRMAPRPVIPVA; AGGIRMAPRPVIPVAT; GGIRMAPRPVIPVATQ; GIRMAPRPVIPVATQQ; IRMAPRPVIPVATQQR; RMAPRPVIPVATQQRL; MAPRPVIPVATQQRLR; APRPVIPVATQQRLRR; PRPVIPVATQQRLRRQ; RPVIPVATQQRLRRQA; PVIPVATQQRLRRQAD; VIPVATQQRLRRQADR; IPVATQQRLRRQADRQ; PVATQQRLRRQADRQS; VATQQRLRRQADRQSL; ATQQRLRRQADRQSLG; TQQRLRRQADRQSLGS; QQRLRRQADRQSLGSS; QRLRRQADRQSLGSSG; RLRRQADRQSLGSSGL; LRRQADRQSLGSSGLP; RRQADRQSLGSSGLPA; RQADRQSLGSSGLPAL; QADRQSLGSSGLPALN; ADRQSLGSSGLPALNC; DRQSLGSSGLPALNCT; RQSLGSSGLPALNCTP; QSLGSSGLPALNCTPI; SLGSSGLPALNCTPIR; LGSSGLPALNCTPIRH; GSSGLPALNCTPIRHT; SSGLPALNCTPIRHTI; SGLPALNCTPIRHTID; GLPALNCTPIRHTIDV; LPALNCTPIRHTIDVM; PALNCTPIRHTIDVMA; ALNCTPIRHTIDVMAT; LNCTPIRHTIDVMATK; NCTPIRHTIDVMATKP; CTPIRHTIDVMATKPE; TPIRHTIDVMATKPER; PIRHTIDVMATKPERK; IRHTIDVMATKPERKT; RHTIDVMATKPERKTE; HTIDVMATKPERKTER; TIDVMATKPERKTERL; IDVMATKPERKTERLA; DVMATKPERKTERLAA; VMATKPERKTERLAAR; MATKPERKTERLAARL; ATKPERKTERLAARLT; TKPERKTERLAARLTP; KPERKTERLAARLTPE; PERKTERLAARLTPEQ; ERKTERLAARLTPEQD; RKTERLAARLTPEQDA; KTERLAARLTPEQDAL; TERLAARLTPEQDALI; ERLAARLTPEQDALIR; RLAARLTPEQDALIRR; LAARLTPEQDALIRRA; AARLTPEQDALIRRAA; ARLTPEQDALIRRAAE; RLTPEQDALIRRAAEA; LTPEQDALIRRAAEAE; TPEQDALIRRAAEAEG; PEQDALIRRAAEAEGT; EQDALIRRAAEAEGTD; QDALIRRAAEAEGTDL; DALIRRAAEAEGTDLT; ALIRRAAEAEGTDLTN; LIRRAAEAEGTDLTNF; IRRAAEAEGTDLTNFT; RRAAEAEGTDLTNFTV; RAAEAEGTDLTNFTVT; AAEAEGTDLTNFTVTA; AEAEGTDLTNFTVTAA; EAEGTDLTNFTVTAAL; AEGTDLTNFTVTAALA; EGTDLTNFTVTAALAH; GTDLTNFTVTAALAHA; TDLTNFTVTAALAHAR; DLTNFTVTAALAHARD; LTNFTVTAALAHARDV; TNFTVTAALAHARDVL; NFTVTAALAHARDVLA; FTVTAALAHARDVLAD; TVTAALAHARDVLADR; VTAALAHARDVLADRR; TAALAHARDVLADRRL; AALAHARDVLADRRLF; ALAHARDVLADRRLFV; LAHARDVLADRRLFVL; AHARDVLADRRLFVLT; HARDVLADRRLFVLTD; ARDVLADRRLFVLTDA; RDVLADRRLFVLTDAA; DVLADRRLFVLTDAAW; VLADRRLFVLTDAAWT; LADRRLFVLTDAAWTE; ADRRLFVLTDAAWTEF; DRRLFVLTDAAWTEFL; RRLFVLTDAAWTEFLA; RLFVLTDAAWTEFLAA; LFVLTDAAWTEFLAAL; FVLTDAAWTEFLAALD; VLTDAAWTEFLAALDR; LTDAAWTEFLAALDRP; TDAAWTEFLAALDRPV; DAAWTEFLAALDRPVS; AAWTEFLAALDRPVSH; AWTEFLAALDRPVSHK; WTEFLAALDRPVSHKP; TEFLAALDRPVSHKPR; EFLAALDRPVSHKPRL; FLAALDRPVSHKPRLE; LAALDRPVSHKPRLEK; AALDRPVSHKPRLEKL; ALDRPVSHKPRLEKLF; LDRPVSHKPRLEKLFA; DRPVSHKPRLEKLFAA; RPVSHKPRLEKLFAAR; PVSHKPRLEKLFAARS; VSHKPRLEKLFAARSI; SHKPRLEKLFAARSIF; HKPRLEKLFAARSIFD; KPRLEKLFAARSIFDT; PRLEKLFAARSIFDTE; RLEKLFAARSIFDTEG | |
| 13) Rv1036c | 13 mers: MFRTVGDQASLWE; FRTVGDQASLWES; RTVGDQASLWESV; TVGDQASLWESVL; VGDQASLWESVLP; GDQASLWESVLPE; DQASLWESVLPEE; QASLWESVLPEEL; ASLWESVLPEELR; SLWESVLPEELRR; LWESVLPEELRRL; WESVLPEELRRLP; ESVLPEELRRLPE; SVLPEELRRLPEE; VLPEELRRLPEEL; LPEELRRLPEELA; PEELRRLPEELAR; EELRRLPEELARV; ELRRLPEELARVD; LRRLPEELARVDA; RRLPEELARVDAL; RLPEELARVDALL; | 70701-71582 |

Fig. 29 continued

| | | |
|---|---|---|
| | LPEELARVDALLD; PEELARVDALLDD; EELARVDALLDDS; ELARVDALLDDSA; LARVDALLDDSAF; ARVDALLDDSAFF; RVDALLDDSAFFC; VDALLDDSAFFCP; DALLDDSAFFCPF; ALLDDSAFFCPFV; LLDDSAFFCPFVP; LDDSAFFCPFVPF; DDSAFFCPFVPFF; DSAFFCPFVPFFD; SAFFCPFVPFFDP; AFFCPFVPFFDPR; FFCPFVPFFDPRM; FCPFVPFFDPRMG; CPFVPFFDPRMGR; PFVPFFDPRMGRP; FVPFFDPRMGRPS; VPFFDPRMGRPSI; PFFDPRMGRPSIP; FFDPRMGRPSIPM; FDPRMGRPSIPME; DPRMGRPSIPMET; PRMGRPSIPMETY; RMGRPSIPMETYL; MGRPSIPMETYLR; GRPSIPMETYLRL; RPSIPMETYLRLM; PSIPMETYLRLMF; SIPMETYLRLMFL; IPMETYLRLMFLK; PMETYLRLMFLKF; METYLRLMFLKFR; ETYLRLMFLKFRY; TYLRLMFLKFRYR; YLRLMFLKFRYRL; LRLMFLKFRYRLG; RLMFLKFRYRLGY; LMFLKFRYRLGYE; MFLKFRYRLGYES; FLKFRYRLGYESL; LKFRYRLGYESLC; KFRYRLGYESLCR; FRYRLGYESLCRE; RYRLGYESLCREV; YRLGYESLCREVT; RLGYESLCREVTD; LGYESLCREVTDS; GYESLCREVTDSI; YESLCREVTDSIT; ESLCREVTDSITW; SLCREVTDSITWR; LCREVTDSITWRR; CREVTDSITWRRF; REVTDSITWRRFC; EVTDSITWRRFCR; VTDSITWRRFCRI; TDSITWRRFCRIP; DSITWRRFCRIPL; SITWRRFCRIPLE; ITWRRFCRIPLEG; TWRRFCRIPLEGS; WRRFCRIPLEGSV; RRFCRIPLEGSVP; RFCRIPLEGSVPH; FCRIPLEGSVPHP; CRIPLEGSVPHPT; RIPLEGSVPHPTT; IPLEGSVPHPTTL; PLEGSVPHPTTLM; LEGSVPHPTTLMK; EGSVPHPTTLMKL; GSVPHPTTLMKLT; SVPHPTTLMKLTT; VPHPTTLMKLTTR; PHPTTLMKLTTRC; HPTTLMKLTTRCG; PTTLMKLTTRCGE; TTLMKLTTRCGED; TLMKLTTRCGEDA; LMKLTTRCGEDAV; MKLTTRCGEDAVA; KLTTRCGEDAVAG; LTTRCGEDAVAGL; TTRCGEDAVAGLN; TRCGEDAVAGLNE; RCGEDAVAGLNEA; CGEDAVAGLNEAL; GEDAVAGLNEALL; EDAVAGLNEALLA; DAVAGLNEALLAK; AVAGLNEALLAKA; VAGLNEALLAKAA; AGLNEALLAKAAS; GLNEALLAKAASE; LNEALLAKAASEK; NEALLAKAASEKL; EALLAKAASEKLL; ALLAKAASEKLLR; LLAKAASEKLLRT; LAKAASEKLLRTN; AKAASEKLLRTNK; KAASEKLLRTNKV; AASEKLLRTNKVR; ASEKLLRTNKVRA; SEKLLRTNKVRAD; EKLLRTNKVRADT; KLLRTNKVRADTT; LLRTNKVRADTTV; LRTNKVRADTTVV; RTNKVRADTTVVE; TNKVRADTTVVEG; NKVRADTTVVEGD; KVRADTTVVEGDV; VRADTTVVEGDVG; RADTTVVEGDVGY; ADTTVVEGDVGYP; DTTVVEGDVGYPT; TTVVEGDVGYPTD; TVVEGDVGYPTDT; VVEGDVGYPTDTG; VEGDVGYPTDTGL; EGDVGYPTDTGLL; GDVGYPTDTGLLA; DVGYPTDTGLLAK; VGYPTDTGLLAKA; GYPTDTGLLAKAV; YPTDTGLLAKAVG; PTDTGLLAKAVGS; TDTGLLAKAVGSM; DTGLLAKAVGSMA; TGLLAKAVGSMAR; GLLAKAVGSMART; LLAKAVGSMARTV; LAKAVGSMARTVA; AKAVGSMARTVAR; KAVGSMARTVARI; AVGSMARTVARIK; VGSMARTVARIKA; GSMARTVARIKAA; SMARTVARIKAAD; MARTVARIKAADA; ARTVARIKAADAG; RTVARIKAADAGS; TVARIKAADAGSA; VARIKAADAGSAP; ARIKAADAGSAPL; RIKAADAGSAPLG; IKAADAGSAPLGG; KAADAGSAPLGGS; AADAGSAPLGGSS; ADAGSAPLGGSSG; DAGSAPLGGSSGP; AGSAPLGGSSGPR; GSAPLGGSSGPRD; SAPLGGSSGPRDR; APLGGSSGPRDRL; PLGGSSGPRDRLQ; LGGSSGPRDRLQA; GGSSGPRDRLQAA; GSSGPRDRLQAAV; SSGPRDRLQAAVT; SGPRDRLQAAVTR; GPRDRLQAAVTRR; PRDRLQAAVTRRA; RDRLQAAVTRRAA; DRLQAAVTRRAAT; RLQAAVTRRAATR; LQAAVTRRAATRS; QAAVTRRAATRSG; AAVTRRAATRSGA; AVTRRAATRSGAG; VTRRAATRSGAGL; TRRAATRSGAGLR; RRAATRSGAGLRA; RAATRSGAGLRAP; AATRSGAGLRAPD; ATRSGAGLRAPDH; TRSGAGLRAPDHR; RSGAGLRAPDHRG; SGAGLRAPDHRGA; GAGLRAPDHRGAS; AGLRAPDHRGASR; GLRAPDHRGASRD; LRAPDHRGASRDR; RAPDHRGASRDRR; APDHRGASRDRRA; PDHRGASRDRRAG; DHRGASRDRRAGA; HRGASRDRRAGAD; RGASRDRRAGADR; | |

Fig. 29 continued

| | | | |
|---|---|---|---|
| | GASRDRRAGADRG; ASRDRRAGADRGC; SRDRRAGADRGCR; RDRRAGADRGCRG; DRRAGADRGCRGG; RRAGADRGCRGGT;<br><br>14 mers:<br>MFRTVGDQASLWES; FRTVGDQASLWESV; RTVGDQASLWESVL; TVGDQASLWESVLP; VGDQASLWESVLPE; GDQASLWESVLPEE; DQASLWESVLPEEL; QASLWESVLPEELR; ASLWESVLPEELRR; SLWESVLPEELRRL; LWESVLPEELRRLP; WESVLPEELRRLPE; ESVLPEELRRLPEE; SVLPEELRRLPEEL; VLPEELRRLPEELA; LPEELRRLPEELAR; PEELRRLPEELARV; EELRRLPEELARVD; ELRRLPEELARVDA; LRRLPEELARVDAL; RRLPEELARVDALL; RLPEELARVDALLD; LPEELARVDALLDD; PEELARVDALLDDS; EELARVDALLDDSA; ELARVDALLDDSAF; LARVDALLDDSAFF; ARVDALLDDSAFFC; RVDALLDDSAFFCP; VDALLDDSAFFCPF; DALLDDSAFFCPFV; ALLDDSAFFCPFVP; LLDDSAFFCPFVPF; LDDSAFFCPFVPFF; DDSAFFCPFVPFFD; DSAFFCPFVPFFDP; SAFFCPFVPFFDPR; AFFCPFVPFFDPRM; FFCPFVPFFDPRMG; FCPFVPFFDPRMGR; CPFVPFFDPRMGRP; PFVPFFDPRMGRPS; FVPFFDPRMGRPSI; VPFFDPRMGRPSIP; PFFDPRMGRPSIPM; FFDPRMGRPSIPME; FDPRMGRPSIPMET; DPRMGRPSIPMETY; PRMGRPSIPMETYL; RMGRPSIPMETYLR; MGRPSIPMETYLRL; GRPSIPMETYLRLM; RPSIPMETYLRLMF; PSIPMETYLRLMFL; SIPMETYLRLMFLK; IPMETYLRLMFLKF; PMETYLRLMFLKFR; METYLRLMFLKFRY; ETYLRLMFLKFRYR; TYLRLMFLKFRYRL; YLRLMFLKFRYRLG; LRLMFLKFRYRLGY; RLMFLKFRYRLGYE; LMFLKFRYRLGYES; MFLKFRYRLGYESL; FLKFRYRLGYESLC; LKFRYRLGYESLCR; KFRYRLGYESLCRE; FRYRLGYESLCREV; RYRLGYESLCREVT; YRLGYESLCREVTD; RLGYESLCREVTDS; LGYESLCREVTDSI; GYESLCREVTDSIT; YESLCREVTDSITW; ESLCREVTDSITWR; SLCREVTDSITWRR; LCREVTDSITWRRF; CREVTDSITWRRFC; REVTDSITWRRFCR; EVTDSITWRRFCRI; VTDSITWRRFCRIP; TDSITWRRFCRIPL; DSITWRRFCRIPLE; SITWRRFCRIPLEG; ITWRRFCRIPLEGS; TWRRFCRIPLEGSV; WRRFCRIPLEGSVP; RRFCRIPLEGSVPH; RFCRIPLEGSVPHP; FCRIPLEGSVPHPT; CRIPLEGSVPHPTT; RIPLEGSVPHPTTL; IPLEGSVPHPTTLM; PLEGSVPHPTTLMK; LEGSVPHPTTLMKL; EGSVPHPTTLMKLT; GSVPHPTTLMKLTT; SVPHPTTLMKLTTR; VPHPTTLMKLTTRC; PHPTTLMKLTTRCG; HPTTLMKLTTRCGE; PTTLMKLTTRCGED; TTLMKLTTRCGEDA; TLMKLTTRCGEDAV; LMKLTTRCGEDAVA; MKLTTRCGEDAVAG; KLTTRCGEDAVAGL; LTTRCGEDAVAGLN; TTRCGEDAVAGLNE; TRCGEDAVAGLNEA; RCGEDAVAGLNEAL; CGEDAVAGLNEALL; GEDAVAGLNEALLA; EDAVAGLNEALLAK; DAVAGLNEALLAKA; AVAGLNEALLAKAA; VAGLNEALLAKAAS; AGLNEALLAKAASE; GLNEALLAKAASEK; LNEALLAKAASEKL; NEALLAKAASEKLL; EALLAKAASEKLLR; ALLAKAASEKLLRT; LLAKAASEKLLRTN; LAKAASEKLLRTNK; AKAASEKLLRTNKV; KAASEKLLRTNKVR; AASEKLLRTNKVRA; ASEKLLRTNKVRAD; SEKLLRTNKVRADT; EKLLRTNKVRADTT; KLLRTNKVRADTTV; LLRTNKVRADTTVV; LRTNKVRADTTVVE; RTNKVRADTTVVEG; TNKVRADTTVVEGD; NKVRADTTVVEGDV; KVRADTTVVEGDVG; VRADTTVVEGDVGY; RADTTVVEGDVGYP; ADTTVVEGDVGYPT; DTTVVEGDVGYPTD; TTVVEGDVGYPTDT; TVVEGDVGYPTDTG; VVEGDVGYPTDTGL; VEGDVGYPTDTGLL; | |

Fig. 29 continued

| | | | |
|---|---|---|---|
| | EGDVGYPTDTGLLA; GDVGYPTDTGLLAK; DVGYPTDTGLLAKA; VGYPTDTGLLAKAV; GYPTDTGLLAKAVG; YPTDTGLLAKAVGS; PTDTGLLAKAVGSM; TDTGLLAKAVGSMA; DTGLLAKAVGSMAR; TGLLAKAVGSMART; GLLAKAVGSMARTV; LLAKAVGSMARTVA; LAKAVGSMARTVAR; AKAVGSMARTVARI; KAVGSMARTVARIK; AVGSMARTVARIKA; VGSMARTVARIKAA; GSMARTVARIKAAD; SMARTVARIKAADA; MARTVARIKAADAG; ARTVARIKAADAGS; RTVARIKAADAGSA; TVARIKAADAGSAP; VARIKAADAGSAPL; ARIKAADAGSAPLG; RIKAADAGSAPLGG; IKAADAGSAPLGGS; KAADAGSAPLGGSS; AADAGSAPLGGSSG; ADAGSAPLGGSSGP; DAGSAPLGGSSGPR; AGSAPLGGSSGPRD; GSAPLGGSSGPRDR; SAPLGGSSGPRDRL; APLGGSSGPRDRLQ; PLGGSSGPRDRLQA; LGGSSGPRDRLQAA; GGSSGPRDRLQAAV; GSSGPRDRLQAAVT; SSGPRDRLQAAVTR; SGPRDRLQAAVTRR; GPRDRLQAAVTRRA; PRDRLQAAVTRRAA; RDRLQAAVTRRAAT; DRLQAAVTRRAATR; RLQAAVTRRAATRS; LQAAVTRRAATRSG; QAAVTRRAATRSGA; AAVTRRAATRSGAG; AVTRRAATRSGAGL; VTRRAATRSGAGLR; TRRAATRSGAGLRA; RRAATRSGAGLRAP; RAATRSGAGLRAPD; AATRSGAGLRAPDH; ATRSGAGLRAPDHR; TRSGAGLRAPDHRG; RSGAGLRAPDHRGA; SGAGLRAPDHRGAS; GAGLRAPDHRGASR; AGLRAPDHRGASRD; GLRAPDHRGASRDR; LRAPDHRGASRDRR; RAPDHRGASRDRRA; APDHRGASRDRRAG; PDHRGASRDRRAGA; DHRGASRDRRAGAD; HRGASRDRRAGADR; RGASRDRRAGADRG; GASRDRRAGADRGC; ASRDRRAGADRGCR; SRDRRAGADRGCRG; RDRRAGADRGCRGG; DRRAGADRGCRGGT;<br><br>15 mers:<br>MFRTVGDQASLWESV; FRTVGDQASLWESVL; RTVGDQASLWESVLP; TVGDQASLWESVLPE; VGDQASLWESVLPEE; GDQASLWESVLPEEL; DQASLWESVLPEELR; QASLWESVLPEELRR; ASLWESVLPEELRRL; SLWESVLPEELRRLP; LWESVLPEELRRLPE; WESVLPEELRRLPEE; ESVLPEELRRLPEEL; SVLPEELRRLPEELA; VLPEELRRLPEELAR; LPEELRRLPEELARV; PEELRRLPEELARVD; EELRRLPEELARVDA; ELRRLPEELARVDAL; LRRLPEELARVDALL; RRLPEELARVDALLD; RLPEELARVDALLDD; LPEELARVDALLDDS; PEELARVDALLDDSA; EELARVDALLDDSAF; ELARVDALLDDSAFF; LARVDALLDDSAFFC; ARVDALLDDSAFFCP; RVDALLDDSAFFCPF; VDALLDDSAFFCPFV; DALLDDSAFFCPFVP; ALLDDSAFFCPFVPF; LLDDSAFFCPFVPFF; LDDSAFFCPFVPFFD; DDSAFFCPFVPFFDP; DSAFFCPFVPFFDPR; SAFFCPFVPFFDPRM; AFFCPFVPFFDPRMG; FFCPFVPFFDPRMGR; FCPFVPFFDPRMGRP; CPFVPFFDPRMGRPS; PFVPFFDPRMGRPSI; FVPFFDPRMGRPSIP; VPFFDPRMGRPSIPM; PFFDPRMGRPSIPME; FFDPRMGRPSIPMET; FDPRMGRPSIPMETY; DPRMGRPSIPMETYL; PRMGRPSIPMETYLR; RMGRPSIPMETYLRL; MGRPSIPMETYLRLM; GRPSIPMETYLRLMF; RPSIPMETYLRLMFL; PSIPMETYLRLMFLK; SIPMETYLRLMFLKF; IPMETYLRLMFLKFR; PMETYLRLMFLKFRY; METYLRLMFLKFRYR; ETYLRLMFLKFRYRL; TYLRLMFLKFRYRLG; YLRLMFLKFRYRLGY; LRLMFLKFRYRLGYE; RLMFLKFRYRLGYES; LMFLKFRYRLGYESL; MFLKFRYRLGYESLC; FLKFRYRLGYESLCR; LKFRYRLGYESLCRE; KFRYRLGYESLCREV; FRYRLGYESLCREVT; RYRLGYESLCREVTD; YRLGYESLCREVTDS; RLGYESLCREVTDSI; LGYESLCREVTDSIT; GYESLCREVTDSITW; YESLCREVTDSITWR; ESLCREVTDSITWRR; SLCREVTDSITWRRF; LCREVTDSITWRRFC; | |

Fig. 29 continued

| | | |
|---|---|---|
| | CREVTDSITWRRFCR; REVTDSITWRRFCRI; EVTDSITWRRFCRIP;<br>VTDSITWRRFCRIPL; TDSITWRRFCRIPLE; DSITWRRFCRIPLEG;<br>SITWRRFCRIPLEGS; ITWRRFCRIPLEGSV; TWRRFCRIPLEGSVP;<br>WRRFCRIPLEGSVPH; RRFCRIPLEGSVPHP; RFCRIPLEGSVPHPT;<br>FCRIPLEGSVPHPTT; CRIPLEGSVPHPTTL; RIPLEGSVPHPTTLM;<br>IPLEGSVPHPTTLMK; PLEGSVPHPTTLMKL; LEGSVPHPTTLMKLT;<br>EGSVPHPTTLMKLTT; GSVPHPTTLMKLTTR; SVPHPTTLMKLTTRC;<br>VPHPTTLMKLTTRCG; PHPTTLMKLTTRCGE; HPTTLMKLTTRCGED;<br>PTTLMKLTTRCGEDA; TTLMKLTTRCGEDAV; TLMKLTTRCGEDAVA;<br>LMKLTTRCGEDAVAG; MKLTTRCGEDAVAGL; KLTTRCGEDAVAGLN;<br>LTTRCGEDAVAGLNE; TTRCGEDAVAGLNEA; TRCGEDAVAGLNEAL;<br>RCGEDAVAGLNEALL; CGEDAVAGLNEALLA; GEDAVAGLNEALLAK;<br>EDAVAGLNEALLAKA; DAVAGLNEALLAKAA; AVAGLNEALLAKAAS;<br>VAGLNEALLAKAASE; AGLNEALLAKAASEK; GLNEALLAKAASEKL;<br>LNEALLAKAASEKLL; NEALLAKAASEKLLR; EALLAKAASEKLLRT;<br>ALLAKAASEKLLRTN; LLAKAASEKLLRTNK; LAKAASEKLLRTNKV;<br>AKAASEKLLRTNKVR; KAASEKLLRTNKVRA; AASEKLLRTNKVRAD;<br>ASEKLLRTNKVRADT; SEKLLRTNKVRADTT; EKLLRTNKVRADTTV;<br>KLLRTNKVRADTTVV; LLRTNKVRADTTVVE; LRTNKVRADTTVVEG;<br>RTNKVRADTTVVEGD; TNKVRADTTVVEGDV; NKVRADTTVVEGDVG;<br>KVRADTTVVEGDVGY; VRADTTVVEGDVGYP; RADTTVVEGDVGYPT;<br>ADTTVVEGDVGYPTD; DTTVVEGDVGYPTDT; TTVVEGDVGYPTDTG;<br>TVVEGDVGYPTDTGL; VVEGDVGYPTDTGLL; VEGDVGYPTDTGLLA;<br>EGDVGYPTDTGLLAK; GDVGYPTDTGLLAKA; DVGYPTDTGLLAKAV;<br>VGYPTDTGLLAKAVG; GYPTDTGLLAKAVGS; YPTDTGLLAKAVGSM;<br>PTDTGLLAKAVGSMA; TDTGLLAKAVGSMAR; DTGLLAKAVGSMART;<br>TGLLAKAVGSMARTV; GLLAKAVGSMARTVA; LLAKAVGSMARTVAR;<br>LAKAVGSMARTVARI; AKAVGSMARTVARIK; KAVGSMARTVARIKA;<br>AVGSMARTVARIKAA; VGSMARTVARIKAAD; GSMARTVARIKAADA;<br>SMARTVARIKAADAG; MARTVARIKAADAGS; ARTVARIKAADAGSA;<br>RTVARIKAADAGSAP; TVARIKAADAGSAPL; VARIKAADAGSAPLG;<br>ARIKAADAGSAPLGG; RIKAADAGSAPLGGS; IKAADAGSAPLGGSS;<br>KAADAGSAPLGGSSG; AADAGSAPLGGSSGP; ADAGSAPLGGSSGPR;<br>DAGSAPLGGSSGPRD; AGSAPLGGSSGPRDR; GSAPLGGSSGPRDRL;<br>SAPLGGSSGPRDRLQ; APLGGSSGPRDRLQA; PLGGSSGPRDRLQAA;<br>LGGSSGPRDRLQAAV; GGSSGPRDRLQAAVT; GSSGPRDRLQAAVTR;<br>SSGPRDRLQAAVTRR; SGPRDRLQAAVTRRA; GPRDRLQAAVTRRAA;<br>PRDRLQAAVTRRAAT; RDRLQAAVTRRAATR; DRLQAAVTRRAATRS;<br>RLQAAVTRRAATRSG; LQAAVTRRAATRSGA; QAAVTRRAATRSGAG;<br>AAVTRRAATRSGAGL; AVTRRAATRSGAGLR; VTRRAATRSGAGLRA;<br>TRRAATRSGAGLRAP; RRAATRSGAGLRAPD; RAATRSGAGLRAPDH;<br>AATRSGAGLRAPDHR; ATRSGAGLRAPDHRG; TRSGAGLRAPDHRGA;<br>RSGAGLRAPDHRGAS; SGAGLRAPDHRGASR; GAGLRAPDHRGASRD;<br>AGLRAPDHRGASRDR; GLRAPDHRGASRDRR; LRAPDHRGASRDRRA;<br>RAPDHRGASRDRRAG; APDHRGASRDRRAGA; PDHRGASRDRRAGAD;<br>DHRGASRDRRAGADR; HRGASRDRRAGADRG; RGASRDRRAGADRGC;<br>GASRDRRAGADRGCR; ASRDRRAGADRGCRG; SRDRRAGADRGCRGG;<br>RDRRAGADRGCRGGT;<br><br>16 mers:<br>MFRTVGDQASLWESVL; FRTVGDQASLWESVLP; RTVGDQASLWESVLPE;<br>TVGDQASLWESVLPEE; VGDQASLWESVLPEEL; GDQASLWESVLPEELR;<br>DQASLWESVLPEELRR; QASLWESVLPEELRRL; ASLWESVLPEELRRLP; | |

Fig. 29 continued

| | | |
|---|---|---|
| | SLWESVLPEELRRLPE; LWESVLPEELRRLPEE; WESVLPEELRRLPEEL; ESVLPEELRRLPEELA; SVLPEELRRLPEELAR; VLPEELRRLPEELARV; LPEELRRLPEELARVD; PEELRRLPEELARVDA; EELRRLPEELARVDAL; ELRRLPEELARVDALL; LRRLPEELARVDALLD; RRLPEELARVDALLDD; RLPEELARVDALLDDS; LPEELARVDALLDDSA; PEELARVDALLDDSAF; EELARVDALLDDSAFF; ELARVDALLDDSAFFC; LARVDALLDDSAFFCP; ARVDALLDDSAFFCPF; RVDALLDDSAFFCPFV; VDALLDDSAFFCPFVP; DALLDDSAFFCPFVPF; ALLDDSAFFCPFVPFF; LLDDSAFFCPFVPFFD; LDDSAFFCPFVPFFDP; DDSAFFCPFVPFFDPR; DSAFFCPFVPFFDPRM; SAFFCPFVPFFDPRMG; AFFCPFVPFFDPRMGR; FFCPFVPFFDPRMGRP; FCPFVPFFDPRMGRPS; CPFVPFFDPRMGRPSI; PFVPFFDPRMGRPSIP; FVPFFDPRMGRPSIPM; VPFFDPRMGRPSIPME; PFFDPRMGRPSIPMET; FFDPRMGRPSIPMETY; FDPRMGRPSIPMETYL; DPRMGRPSIPMETYLR; PRMGRPSIPMETYLRL; RMGRPSIPMETYLRLM; MGRPSIPMETYLRLMF; GRPSIPMETYLRLMFL; RPSIPMETYLRLMFLK; PSIPMETYLRLMFLKF; SIPMETYLRLMFLKFR; IPMETYLRLMFLKFRY; PMETYLRLMFLKFRYR; METYLRLMFLKFRYRL; ETYLRLMFLKFRYRLG; TYLRLMFLKFRYRLGY; YLRLMFLKFRYRLGYE; LRLMFLKFRYRLGYES; RLMFLKFRYRLGYESL; LMFLKFRYRLGYESLC; MFLKFRYRLGYESLCR; FLKFRYRLGYESLCRE; LKFRYRLGYESLCREV; KFRYRLGYESLCREVT; FRYRLGYESLCREVTD; RYRLGYESLCREVTDS; YRLGYESLCREVTDSI; RLGYESLCREVTDSIT; LGYESLCREVTDSITW; GYESLCREVTDSITWR; YESLCREVTDSITWRR; ESLCREVTDSITWRRF; SLCREVTDSITWRRFC; LCREVTDSITWRRFCR; CREVTDSITWRRFCRI; REVTDSITWRRFCRIP; EVTDSITWRRFCRIPL; VTDSITWRRFCRIPLE; TDSITWRRFCRIPLEG; DSITWRRFCRIPLEGS; SITWRRFCRIPLEGSV; ITWRRFCRIPLEGSVP; TWRRFCRIPLEGSVPH; WRRFCRIPLEGSVPHP; RRFCRIPLEGSVPHPT; RFCRIPLEGSVPHPTT; FCRIPLEGSVPHPTTL; CRIPLEGSVPHPTTLM; RIPLEGSVPHPTTLMK; IPLEGSVPHPTTLMKL; PLEGSVPHPTTLMKLT; LEGSVPHPTTLMKLTT; EGSVPHPTTLMKLTTR; GSVPHPTTLMKLTTRC; SVPHPTTLMKLTTRCG; VPHPTTLMKLTTRCGE; PHPTTLMKLTTRCGED; HPTTLMKLTTRCGEDA; PTTLMKLTTRCGEDAV; TTLMKLTTRCGEDAVA; TLMKLTTRCGEDAVAG; LMKLTTRCGEDAVAGL; MKLTTRCGEDAVAGLN; KLTTRCGEDAVAGLNE; LTTRCGEDAVAGLNEA; TTRCGEDAVAGLNEAL; TRCGEDAVAGLNEALL; RCGEDAVAGLNEALLA; CGEDAVAGLNEALLAK; GEDAVAGLNEALLAKA; EDAVAGLNEALLAKAA; DAVAGLNEALLAKAAS; AVAGLNEALLAKAASE; VAGLNEALLAKAASEK; AGLNEALLAKAASEKL; GLNEALLAKAASEKLL; LNEALLAKAASEKLLR; NEALLAKAASEKLLRT; EALLAKAASEKLLRTN; ALLAKAASEKLLRTNK; LLAKAASEKLLRTNKV; LAKAASEKLLRTNKVR; AKAASEKLLRTNKVRA; KAASEKLLRTNKVRAD; AASEKLLRTNKVRADT; ASEKLLRTNKVRADTT; SEKLLRTNKVRADTTV; EKLLRTNKVRADTTVV; KLLRTNKVRADTTVVE; LLRTNKVRADTTVVEG; LRTNKVRADTTVVEGD; RTNKVRADTTVVEGDV; TNKVRADTTVVEGDVG; NKVRADTTVVEGDVGY; KVRADTTVVEGDVGYP; VRADTTVVEGDVGYPT; RADTTVVEGDVGYPTD; ADTTVVEGDVGYPTDT; DTTVVEGDVGYPTDTG; TTVVEGDVGYPTDTGL; TVVEGDVGYPTDTGLL; VVEGDVGYPTDTGLLA; VEGDVGYPTDTGLLAK; EGDVGYPTDTGLLAKA; GDVGYPTDTGLLAKAV; DVGYPTDTGLLAKAVG; VGYPTDTGLLAKAVGS; GYPTDTGLLAKAVGSM; YPTDTGLLAKAVGSMA; PTDTGLLAKAVGSMAR; TDTGLLAKAVGSMART; DTGLLAKAVGSMARTV; TGLLAKAVGSMARTVA; GLLAKAVGSMARTVAR; LLAKAVGSMARTVARI; LAKAVGSMARTVARIK; AKAVGSMARTVARIKA; KAVGSMARTVARIKAA; AVGSMARTVARIKAAD; VGSMARTVARIKAADA; GSMARTVARIKAADAG; SMARTVARIKAADAGS; MARTVARIKAADAGSA; ARTVARIKAADAGSAP; | |

Fig. 29 continued

| | | |
|---|---|---|
| | RTVARIKAADAGSAPL; TVARIKAADAGSAPLG; VARIKAADAGSAPLGG; ARIKAADAGSAPLGGS; RIKAADAGSAPLGGSS; IKAADAGSAPLGGSSG; KAADAGSAPLGGSSGP; AADAGSAPLGGSSGPR; ADAGSAPLGGSSGPRD; DAGSAPLGGSSGPRDR; AGSAPLGGSSGPRDRL; GSAPLGGSSGPRDRLQ; SAPLGGSSGPRDRLQA; APLGGSSGPRDRLQAA; PLGGSSGPRDRLQAAV; LGGSSGPRDRLQAAVT; GGSSGPRDRLQAAVTR; GSSGPRDRLQAAVTRR; SSGPRDRLQAAVTRRA; SGPRDRLQAAVTRRAA; GPRDRLQAAVTRRAAT; PRDRLQAAVTRRAATR; RDRLQAAVTRRAATRS; DRLQAAVTRRAATRSG; RLQAAVTRRAATRSGA; LQAAVTRRAATRSGAG; QAAVTRRAATRSGAGL; AAVTRRAATRSGAGLR; AVTRRAATRSGAGLRA; VTRRAATRSGAGLRAP; TRRAATRSGAGLRAPD; RRAATRSGAGLRAPDH; RAATRSGAGLRAPDHR; AATRSGAGLRAPDHRG; ATRSGAGLRAPDHRGA; TRSGAGLRAPDHRGAS; RSGAGLRAPDHRGASR; SGAGLRAPDHRGASRD; GAGLRAPDHRGASRDR; AGLRAPDHRGASRDRR; GLRAPDHRGASRDRRA; LRAPDHRGASRDRRAG; RAPDHRGASRDRRAGA; APDHRGASRDRRAGAD; PDHRGASRDRRAGADR; DHRGASRDRRAGADRG; HRGASRDRRAGADRGC; RGASRDRRAGADRGCR; GASRDRRAGADRGCRG; ASRDRRAGADRGCRGG; SRDRRAGADRGCRGGT; | |
| 14) Rv1037c | 13 mers:<br>MTINYQFGDVDAH; TINYQFGDVDAHG; INYQFGDVDAHGA; NYQFGDVDAHGAM; YQFGDVDAHGAMI; QFGDVDAHGAMIR; FGDVDAHGAMIRA; GDVDAHGAMIRAQ; DVDAHGAMIRAQA; VDAHGAMIRAQAG; DAHGAMIRAQAGS; AHGAMIRAQAGSL; HGAMIRAQAGSLE; GAMIRAQAGSLEA; AMIRAQAGSLEAE; MIRAQAGSLEAEH; IRAQAGSLEAEHQ; RAQAGSLEAEHQA; AQAGSLEAEHQAI; QAGSLEAEHQAII; AGSLEAEHQAIIS; GSLEAEHQAIISD; SLEAEHQAIISDV; LEAEHQAIISDVL; EAEHQAIISDVLT; AEHQAIISDVLTA; EHQAIISDVLTAS; HQAIISDVLTASD; QAIISDVLTASDF; AIISDVLTASDFW; IISDVLTASDFWG; ISDVLTASDFWGG; SDVLTASDFWGGA; DVLTASDFWGGAG; VLTASDFWGGAGS; LTASDFWGGAGSA; TASDFWGGAGSAA; ASDFWGGAGSAAC; SDFWGGAGSAACQ; DFWGGAGSAACQG; FWGGAGSAACQGF; WGGAGSAACQGFI; GGAGSAACQGFIT; GAGSAACQGFITQ; AGSAACQGFITQL; GSAACQGFITQLG; SAACQGFITQLGR; AACQGFITQLGRN; ACQGFITQLGRNF; CQGFITQLGRNFQ; QGFITQLGRNFQV; GFITQLGRNFQVI; FITQLGRNFQVIY; ITQLGRNFQVIYE; TQLGRNFQVIYEQ; QLGRNFQVIYEQA; LGRNFQVIYEQAN; GRNFQVIYEQANA; RNFQVIYEQANAH; NFQVIYEQANAHG; FQVIYEQANAHGQ; QVIYEQANAHGQK; VIYEQANAHGQKV; IYEQANAHGQKVQ; YEQANAHGQKVQA; EQANAHGQKVQAA; QANAHGQKVQAAG; ANAHGQKVQAAGN; NAHGQKVQAAGNN; AHGQKVQAAGNNM; HGQKVQAAGNNMA; GQKVQAAGNNMAQ; QKVQAAGNNMAQT; KVQAAGNNMAQTD; VQAAGNNMAQTDS; QAAGNNMAQTDSA; AAGNNMAQTDSAV; AGNNMAQTDSAVG; GNNMAQTDSAVGS; NNMAQTDSAVGSS; NMAQTDSAVGSSW; MAQTDSAVGSSWA;<br><br>14 mers:<br>MTINYQFGDVDAHG; TINYQFGDVDAHGA; INYQFGDVDAHGAM; NYQFGDVDAHGAMI; YQFGDVDAHGAMIR; QFGDVDAHGAMIRA; FGDVDAHGAMIRAQ; GDVDAHGAMIRAQA; DVDAHGAMIRAQAG; VDAHGAMIRAQAGS; DAHGAMIRAQAGSL; AHGAMIRAQAGSLE; HGAMIRAQAGSLEA; GAMIRAQAGSLEAE; AMIRAQAGSLEAEH; MIRAQAGSLEAEHQ; IRAQAGSLEAEHQA; RAQAGSLEAEHQAI; AQAGSLEAEHQAII; QAGSLEAEHQAIIS; AGSLEAEHQAIISD; GSLEAEHQAIISDV; SLEAEHQAIISDVL; LEAEHQAIISDVLT; EAEHQAIISDVLTA; AEHQAIISDVLTAS; | 71583-71904 |

Fig. 29 continued

| | | | |
|---|---|---|---|
| | EHQAIISDVLTASD; HQAIISDVLTASDF; QAIISDVLTASDFW; AIISDVLTASDFWG; IISDVLTASDFWGG; ISDVLTASDFWGGA; SDVLTASDFWGGAG; DVLTASDFWGGAGS; VLTASDFWGGAGSA; LTASDFWGGAGSAA; TASDFWGGAGSAAC; ASDFWGGAGSAACQ; SDFWGGAGSAACQG; DFWGGAGSAACQGF; FWGGAGSAACQGFI; WGGAGSAACQGFIT; GGAGSAACQGFITQ; GAGSAACQGFITQL; AGSAACQGFITQLG; GSAACQGFITQLGR; SAACQGFITQLGRN; AACQGFITQLGRNF; ACQGFITQLGRNFQ; CQGFITQLGRNFQV; QGFITQLGRNFQVI; GFITQLGRNFQVIY; FITQLGRNFQVIYE; ITQLGRNFQVIYEQ; TQLGRNFQVIYEQA; QLGRNFQVIYEQAN; LGRNFQVIYEQANA; GRNFQVIYEQANAH; RNFQVIYEQANAHG; NFQVIYEQANAHGQ; FQVIYEQANAHGQK; QVIYEQANAHGQKV; VIYEQANAHGQKVQ; IYEQANAHGQKVQA; YEQANAHGQKVQAA; EQANAHGQKVQAAG; QANAHGQKVQAAGN; ANAHGQKVQAAGNN; NAHGQKVQAAGNNM; AHGQKVQAAGNNMA; HGQKVQAAGNNMAQ; GQKVQAAGNNMAQT; QKVQAAGNNMAQTD; KVQAAGNNMAQTDS; VQAAGNNMAQTDSA; QAAGNNMAQTDSAV; AAGNNMAQTDSAVG; AGNNMAQTDSAVGS; GNNMAQTDSAVGSS; NNMAQTDSAVGSSW; NMAQTDSAVGSSWA;<br><br>15 mers:<br>MTINYQFGDVDAHGA; TINYQFGDVDAHGAM; INYQFGDVDAHGAMI; NYQFGDVDAHGAMIR; YQFGDVDAHGAMIRA; QFGDVDAHGAMIRAQ; FGDVDAHGAMIRAQA; GDVDAHGAMIRAQAG; DVDAHGAMIRAQAGS; VDAHGAMIRAQAGSL; DAHGAMIRAQAGSLE; AHGAMIRAQAGSLEA; HGAMIRAQAGSLEAE; GAMIRAQAGSLEAEH; AMIRAQAGSLEAEHQ; MIRAQAGSLEAEHQA; IRAQAGSLEAEHQAI; RAQAGSLEAEHQAII; AQAGSLEAEHQAIIS; QAGSLEAEHQAIISD; AGSLEAEHQAIISDV; GSLEAEHQAIISDVL; SLEAEHQAIISDVLT; LEAEHQAIISDVLTA; EAEHQAIISDVLTAS; AEHQAIISDVLTASD; EHQAIISDVLTASDF; HQAIISDVLTASDFW; QAIISDVLTASDFWG; AIISDVLTASDFWGG; IISDVLTASDFWGGA; ISDVLTASDFWGGAG; SDVLTASDFWGGAGS; DVLTASDFWGGAGSA; VLTASDFWGGAGSAA; LTASDFWGGAGSAAC; TASDFWGGAGSAACQ; ASDFWGGAGSAACQG; SDFWGGAGSAACQGF; DFWGGAGSAACQGFI; FWGGAGSAACQGFIT; WGGAGSAACQGFITQ; GGAGSAACQGFITQL; GAGSAACQGFITQLG; AGSAACQGFITQLGR; GSAACQGFITQLGRN; SAACQGFITQLGRNF; AACQGFITQLGRNFQ; ACQGFITQLGRNFQV; CQGFITQLGRNFQVI; QGFITQLGRNFQVIY; GFITQLGRNFQVIYE; FITQLGRNFQVIYEQ; ITQLGRNFQVIYEQA; TQLGRNFQVIYEQAN; QLGRNFQVIYEQANA; LGRNFQVIYEQANAH; GRNFQVIYEQANAHG; RNFQVIYEQANAHGQ; NFQVIYEQANAHGQK; FQVIYEQANAHGQKV; QVIYEQANAHGQKVQ; VIYEQANAHGQKVQA; IYEQANAHGQKVQAA; YEQANAHGQKVQAAG; EQANAHGQKVQAAGN; QANAHGQKVQAAGNN; ANAHGQKVQAAGNNM; NAHGQKVQAAGNNMA; AHGQKVQAAGNNMAQ; HGQKVQAAGNNMAQT; GQKVQAAGNNMAQTD; QKVQAAGNNMAQTDS; KVQAAGNNMAQTDSA; VQAAGNNMAQTDSAV; QAAGNNMAQTDSAVG; AAGNNMAQTDSAVGS; AGNNMAQTDSAVGSS; GNNMAQTDSAVGSSW; NNMAQTDSAVGSSWA;<br><br>16 mers:<br>MTINYQFGDVDAHGAM; TINYQFGDVDAHGAMI; INYQFGDVDAHGAMIR; NYQFGDVDAHGAMIRA; YQFGDVDAHGAMIRAQ; QFGDVDAHGAMIRAQA; FGDVDAHGAMIRAQAG; GDVDAHGAMIRAQAGS; DVDAHGAMIRAQAGSL; VDAHGAMIRAQAGSLE; DAHGAMIRAQAGSLEA; AHGAMIRAQAGSLEAE; | |

Fig. 29 continued

| | | |
|---|---|---|
| | HGAMIRAQAGSLEAEH; GAMIRAQAGSLEAEHQ; AMIRAQAGSLEAEHQA; MIRAQAGSLEAEHQAI; IRAQAGSLEAEHQAII; RAQAGSLEAEHQAIIS; AQAGSLEAEHQAIISD; QAGSLEAEHQAIISDV; AGSLEAEHQAIISDVL; GSLEAEHQAIISDVLT; SLEAEHQAIISDVLTA; LEAEHQAIISDVLTAS; EAEHQAIISDVLTASD; AEHQAIISDVLTASDF; EHQAIISDVLTASDFW; HQAIISDVLTASDFWG; QAIISDVLTASDFWGG; AIISDVLTASDFWGGA; IISDVLTASDFWGGAG; ISDVLTASDFWGGAGS; SDVLTASDFWGGAGSA; DVLTASDFWGGAGSAA; VLTASDFWGGAGSAAC; LTASDFWGGAGSAACQ; TASDFWGGAGSAACQG; ASDFWGGAGSAACQGF; SDFWGGAGSAACQGFI; DFWGGAGSAACQGFIT; FWGGAGSAACQGFITQ; WGGAGSAACQGFITQL; GGAGSAACQGFITQLG; GAGSAACQGFITQLGR; AGSAACQGFITQLGRN; GSAACQGFITQLGRNF; SAACQGFITQLGRNFQ; AACQGFITQLGRNFQV; ACQGFITQLGRNFQVI; CQGFITQLGRNFQVIY; QGFITQLGRNFQVIYE; GFITQLGRNFQVIYEQ; FITQLGRNFQVIYEQA; ITQLGRNFQVIYEQAN; TQLGRNFQVIYEQANA; QLGRNFQVIYEQANAH; LGRNFQVIYEQANAHG; GRNFQVIYEQANAHGQ; RNFQVIYEQANAHGQK; NFQVIYEQANAHGQKV; FQVIYEQANAHGQKVQ; QVIYEQANAHGQKVQA; VIYEQANAHGQKVQAA; IYEQANAHGQKVQAAG; YEQANAHGQKVQAAGN; EQANAHGQKVQAAGNN; QANAHGQKVQAAGNNM; ANAHGQKVQAAGNNMA; NAHGQKVQAAGNNMAQ; AHGQKVQAAGNNMAQT; HGQKVQAAGNNMAQTD; GQKVQAAGNNMAQTDS; QKVQAAGNNMAQTDSA; KVQAAGNNMAQTDSAV; VQAAGNNMAQTDSAVG; QAAGNNMAQTDSAVGS; AAGNNMAQTDSAVGSS; AGNNMAQTDSAVGSSW; GNNMAQTDSAVGSSWA; | |
| 15) Rv1038c | 13 mers: MASRFMTDPHAMR; ASRFMTDPHAMRD; SRFMTDPHAMRDM; RFMTDPHAMRDMA; FMTDPHAMRDMAG; MTDPHAMRDMAGR; TDPHAMRDMAGRF; DPHAMRDMAGRFE; PHAMRDMAGRFEV; HAMRDMAGRFEVH; AMRDMAGRFEVHA; MRDMAGRFEVHAQ; RDMAGRFEVHAQT; DMAGRFEVHAQTV; MAGRFEVHAQTVE; AGRFEVHAQTVED; GRFEVHAQTVEDE; RFEVHAQTVEDEA; FEVHAQTVEDEAR; EVHAQTVEDEARR; VHAQTVEDEARRM; HAQTVEDEARRMW; AQTVEDEARRMWA; QTVEDEARRMWAS; TVEDEARRMWASA; VEDEARRMWASAQ; EDEARRMWASAQN; DEARRMWASAQNI; EARRMWASAQNIS; ARRMWASAQNISG; RRMWASAQNISGA; RMWASAQNISGAG; MWASAQNISGAGW; WASAQNISGAGWS; ASAQNISGAGWSG; SAQNISGAGWSGM; AQNISGAGWSGMA; QNISGAGWSGMAE; NISGAGWSGMAEA; ISGAGWSGMAEAT; SGAGWSGMAEATS; GAGWSGMAEATSL; AGWSGMAEATSLD; GWSGMAEATSLDT; WSGMAEATSLDTM; SGMAEATSLDTMT; GMAEATSLDTMTQ; MAEATSLDTMTQM; AEATSLDTMTQMN; EATSLDTMTQMNQ; ATSLDTMTQMNQA; TSLDTMTQMNQAF; SLDTMTQMNQAFR; LDTMTQMNQAFRN; DTMTQMNQAFRNI; TMTQMNQAFRNIV; MTQMNQAFRNIVN; TQMNQAFRNIVNM; QMNQAFRNIVNML; MNQAFRNIVNMLH; NQAFRNIVNMLHG; QAFRNIVNMLHGV; AFRNIVNMLHGVR; FRNIVNMLHGVRD; RNIVNMLHGVRDG; NIVNMLHGVRDGL; IVNMLHGVRDGLV; VNMLHGVRDGLVR; NMLHGVRDGLVRD; MLHGVRDGLVRDA; LHGVRDGLVRDAN; HGVRDGLVRDANN; GVRDGLVRDANNY; VRDGLVRDANNYE; RDGLVRDANNYEQ; DGLVRDANNYEQQ; GLVRDANNYEQQE; LVRDANNYEQQEQ; VRDANNYEQQEQA; RDANNYEQQEQAS; DANNYEQQEQASQ; ANNYEQQEQASQQ; NNYEQQEQASQQI; NYEQQEQASQQIL; YEQQEQASQQILS; EQQEQASQQILSS; | 71905-72242 |

Fig. 29 continued

| | | |
|---|---|---|
| | 14 mers:<br>MASRFMTDPHAMRD; ASRFMTDPHAMRDM; SRFMTDPHAMRDMA; RFMTDPHAMRDMAG; FMTDPHAMRDMAGR; MTDPHAMRDMAGRF; TDPHAMRDMAGRFE; DPHAMRDMAGRFEV; PHAMRDMAGRFEVH; HAMRDMAGRFEVHA; AMRDMAGRFEVHAQ; MRDMAGRFEVHAQT; RDMAGRFEVHAQTV; DMAGRFEVHAQTVE; MAGRFEVHAQTVED; AGRFEVHAQTVEDE; GRFEVHAQTVEDEA; RFEVHAQTVEDEAR; FEVHAQTVEDEARR; EVHAQTVEDEARRM; VHAQTVEDEARRMW; HAQTVEDEARRMWA; AQTVEDEARRMWAS; QTVEDEARRMWASA; TVEDEARRMWASAQ; VEDEARRMWASAQN; EDEARRMWASAQNI; DEARRMWASAQNIS; EARRMWASAQNISG; ARRMWASAQNISGA; RRMWASAQNISGAG; RMWASAQNISGAGW; MWASAQNISGAGWS; WASAQNISGAGWSG; ASAQNISGAGWSGM; SAQNISGAGWSGMA; AQNISGAGWSGMAE; QNISGAGWSGMAEA; NISGAGWSGMAEAT; ISGAGWSGMAEATS; SGAGWSGMAEATSL; GAGWSGMAEATSLD; AGWSGMAEATSLDT; GWSGMAEATSLDTM; WSGMAEATSLDTMT; SGMAEATSLDTMTQ; GMAEATSLDTMTQM; MAEATSLDTMTQMN; AEATSLDTMTQMNQ; EATSLDTMTQMNQA; ATSLDTMTQMNQAF; TSLDTMTQMNQAFR; SLDTMTQMNQAFRN; LDTMTQMNQAFRNI; DTMTQMNQAFRNIV; TMTQMNQAFRNIVN; MTQMNQAFRNIVNM; TQMNQAFRNIVNML; QMNQAFRNIVNMLH; MNQAFRNIVNMLHG; NQAFRNIVNMLHGV; QAFRNIVNMLHGVR; AFRNIVNMLHGVRD; FRNIVNMLHGVRDG; RNIVNMLHGVRDGL; NIVNMLHGVRDGLV; IVNMLHGVRDGLVR; VNMLHGVRDGLVRD; NMLHGVRDGLVRDA; MLHGVRDGLVRDAN; LHGVRDGLVRDANN; HGVRDGLVRDANNY; GVRDGLVRDANNYE; VRDGLVRDANNYEQ; RDGLVRDANNYEQQ; DGLVRDANNYEQQE; GLVRDANNYEQQEQ; LVRDANNYEQQEQA; VRDANNYEQQEQAS; RDANNYEQQEQASQ; DANNYEQQEQASQQ; ANNYEQQEQASQQI; NNYEQQEQASQQIL; NYEQQEQASQQILS; YEQQEQASQQILSS;<br><br>15 mers:<br>MASRFMTDPHAMRDM; ASRFMTDPHAMRDMA; SRFMTDPHAMRDMAG; RFMTDPHAMRDMAGR; FMTDPHAMRDMAGRF; MTDPHAMRDMAGRFE; TDPHAMRDMAGRFEV; DPHAMRDMAGRFEVH; PHAMRDMAGRFEVHA; HAMRDMAGRFEVHAQ; AMRDMAGRFEVHAQT; MRDMAGRFEVHAQTV; RDMAGRFEVHAQTVE; DMAGRFEVHAQTVED; MAGRFEVHAQTVEDE; AGRFEVHAQTVEDEA; GRFEVHAQTVEDEAR; RFEVHAQTVEDEARR; FEVHAQTVEDEARRM; EVHAQTVEDEARRMW; VHAQTVEDEARRMWA; HAQTVEDEARRMWAS; AQTVEDEARRMWASA; QTVEDEARRMWASAQ; TVEDEARRMWASAQN; VEDEARRMWASAQNI; EDEARRMWASAQNIS; DEARRMWASAQNISG; EARRMWASAQNISGA; ARRMWASAQNISGAG; RRMWASAQNISGAGW; RMWASAQNISGAGWS; MWASAQNISGAGWSG; WASAQNISGAGWSGM; ASAQNISGAGWSGMA; SAQNISGAGWSGMAE; AQNISGAGWSGMAEA; QNISGAGWSGMAEAT; NISGAGWSGMAEATS; ISGAGWSGMAEATSL; SGAGWSGMAEATSLD; GAGWSGMAEATSLDT; AGWSGMAEATSLDTM; GWSGMAEATSLDTMT; WSGMAEATSLDTMTQ; SGMAEATSLDTMTQM; GMAEATSLDTMTQMN; MAEATSLDTMTQMNQ; AEATSLDTMTQMNQA; EATSLDTMTQMNQAF; ATSLDTMTQMNQAFR; TSLDTMTQMNQAFRN; SLDTMTQMNQAFRNI; LDTMTQMNQAFRNIV; DTMTQMNQAFRNIVN; TMTQMNQAFRNIVNM; MTQMNQAFRNIVNML; TQMNQAFRNIVNMLH; QMNQAFRNIVNMLHG; MNQAFRNIVNMLHGV; | |

Fig. 29 continued

| | | |
|---|---|---|
| | NQAFRNIVNMLHGVR; QAFRNIVNMLHGVRD; AFRNIVNMLHGVRDG; FRNIVNMLHGVRDGL; RNIVNMLHGVRDGLV; NIVNMLHGVRDGLVR; IVNMLHGVRDGLVRD; VNMLHGVRDGLVRDA; NMLHGVRDGLVRDAN; MLHGVRDGLVRDANN; LHGVRDGLVRDANNY; HGVRDGLVRDANNYE; GVRDGLVRDANNYEQ; VRDGLVRDANNYEQQ; RDGLVRDANNYEQQE; DGLVRDANNYEQQEQ; GLVRDANNYEQQEQA; LVRDANNYEQQEQAS; VRDANNYEQQEQASQ; RDANNYEQQEQASQQ; DANNYEQQEQASQQI; ANNYEQQEQASQQIL; NNYEQQEQASQQILS; NYEQQEQASQQILSS;<br><br>16 mers:<br>MASRFMTDPHAMRDMA; ASRFMTDPHAMRDMAG; SRFMTDPHAMRDMAGR; RFMTDPHAMRDMAGRF; FMTDPHAMRDMAGRFE; MTDPHAMRDMAGRFEV; TDPHAMRDMAGRFEVH; DPHAMRDMAGRFEVHA; PHAMRDMAGRFEVHAQ; HAMRDMAGRFEVHAQT; AMRDMAGRFEVHAQTV; MRDMAGRFEVHAQTVE; RDMAGRFEVHAQTVED; DMAGRFEVHAQTVEDE; MAGRFEVHAQTVEDEA; AGRFEVHAQTVEDEAR; GRFEVHAQTVEDEARR; RFEVHAQTVEDEARRM; FEVHAQTVEDEARRMW; EVHAQTVEDEARRMWA; VHAQTVEDEARRMWAS; HAQTVEDEARRMWASA; AQTVEDEARRMWASAQ; QTVEDEARRMWASAQN; TVEDEARRMWASAQNI; VEDEARRMWASAQNIS; EDEARRMWASAQNISG; DEARRMWASAQNISGA; EARRMWASAQNISGAG; ARRMWASAQNISGAGW; RRMWASAQNISGAGWS; RMWASAQNISGAGWSG; MWASAQNISGAGWSGM; WASAQNISGAGWSGMA; ASAQNISGAGWSGMAE; SAQNISGAGWSGMAEA; AQNISGAGWSGMAEAT; QNISGAGWSGMAEATS; NISGAGWSGMAEATSL; ISGAGWSGMAEATSLD; SGAGWSGMAEATSLDT; GAGWSGMAEATSLDTM; AGWSGMAEATSLDTMT; GWSGMAEATSLDTMTQ; WSGMAEATSLDTMTQM; SGMAEATSLDTMTQMN; GMAEATSLDTMTQMNQ; MAEATSLDTMTQMNQA; AEATSLDTMTQMNQAF; EATSLDTMTQMNQAFR; ATSLDTMTQMNQAFRN; TSLDTMTQMNQAFRNI; SLDTMTQMNQAFRNIV; LDTMTQMNQAFRNIVN; DTMTQMNQAFRNIVNM; TMTQMNQAFRNIVNML; MTQMNQAFRNIVNMLH; TQMNQAFRNIVNMLHG; QMNQAFRNIVNMLHGV; MNQAFRNIVNMLHGVR; NQAFRNIVNMLHGVRD; QAFRNIVNMLHGVRDG; AFRNIVNMLHGVRDGL; FRNIVNMLHGVRDGLV; RNIVNMLHGVRDGLVR; NIVNMLHGVRDGLVRD; IVNMLHGVRDGLVRDA; VNMLHGVRDGLVRDAN; NMLHGVRDGLVRDANN; MLHGVRDGLVRDANNY; LHGVRDGLVRDANNYE; HGVRDGLVRDANNYEQ; GVRDGLVRDANNYEQQ; VRDGLVRDANNYEQQE; RDGLVRDANNYEQQEQ; DGLVRDANNYEQQEQA; GLVRDANNYEQQEQAS; LVRDANNYEQQEQASQ; VRDANNYEQQEQASQQ; RDANNYEQQEQASQQI; DANNYEQQEQASQQIL; ANNYEQQEQASQQILS; NNYEQQEQASQQILSS; | |
| 16) Rv1152 | 13 mers:<br>MELRDWLRVDVKA; ELRDWLRVDVKAG; LRDWLRVDVKAGK; RDWLRVDVKAGKP; DWLRVDVKAGKPL; WLRVDVKAGKPLF; LRVDVKAGKPLFD; RVDVKAGKPLFDQ; VDVKAGKPLFDQL; DVKAGKPLFDQLR; VKAGKPLFDQLRT; KAGKPLFDQLRTQ; AGKPLFDQLRTQV; GKPLFDQLRTQVI; KPLFDQLRTQVID; PLFDQLRTQVIDG; LFDQLRTQVIDGV; FDQLRTQVIDGVR; DQLRTQVIDGVRA; QLRTQVIDGVRAG; LRTQVIDGVRAGA; RTQVIDGVRAGAL; TQVIDGVRAGALP; QVIDGVRAGALPP; VIDGVRAGALPPG; IDGVRAGALPPGT; DGVRAGALPPGTR; GVRAGALPPGTRL; VRAGALPPGTRLP; RAGALPPGTRLPT; AGALPPGTRLPTV; GALPPGTRLPTVR; ALPPGTRLPTVRD; LPPGTRLPTVRDL; PPGTRLPTVRDLA; PGTRLPTVRDLAG; GTRLPTVRDLAGQ; TRLPTVRDLAGQL; RLPTVRDLAGQLG; LPTVRDLAGQLGV; PTVRDLAGQLGVA; TVRDLAGQLGVAA; VRDLAGQLGVAAN; RDLAGQLGVAANT; DLAGQLGVAANTV; LAGQLGVAANTVA; AGQLGVAANTVAR; GQLGVAANTVARA; | 72243-72672 |

Fig. 29 continued

| | | |
|---|---|---|
| | QLGVAANTVARAY; LGVAANTVARAYR; GVAANTVARAYRE; VAANTVARAYREL; AANTVARAYRELE; ANTVARAYRELES; NTVARAYRELESA; TVARAYRELESAA; VARAYRELESAAI; ARAYRELESAAIV; RAYRELESAAIVE; AYRELESAAIVET; YRELESAAIVETR; RELESAAIVETRG; ELESAAIVETRGR; LESAAIVETRGRF; ESAAIVETRGRFG; SAAIVETRGRFGT; AAIVETRGRFGTF; AIVETRGRFGTFI; IVETRGRFGTFIS; VETRGRFGTFISR; ETRGRFGTFISRF; TRGRFGTFISRFD; RGRFGTFISRFDP; GRFGTFISRFDPT; RFGTFISRFDPTD; FGTFISRFDPTDA; GTFISRFDPTDAA; TFISRFDPTDAAM; FISRFDPTDAAMA; ISRFDPTDAAMAA; SRFDPTDAAMAAA; RFDPTDAAMAAAA; FDPTDAAMAAAAK; DPTDAAMAAAAKE; PTDAAMAAAAKEY; TDAAMAAAAKEYV; DAAMAAAAKEYVG; AAMAAAAKEYVGV; AMAAAAKEYVGVA; MAAAAKEYVGVAR; AAAAKEYVGVARA; AAAKEYVGVARAL; AAKEYVGVARALG; AKEYVGVARALGL; KEYVGVARALGLT; EYVGVARALGLTK; YVGVARALGLTKS; VGVARALGLTKSD; GVARALGLTKSDA; VARALGLTKSDAM; ARALGLTKSDAMR; RALGLTKSDAMRY; ALGLTKSDAMRYL; LGLTKSDAMRYLT; GLTKSDAMRYLTH; LTKSDAMRYLTHV; TKSDAMRYLTHVP; KSDAMRYLTHVPD; SDAMRYLTHVPDD<br><br>14 mers:<br>MELRDWLRVDVKAG; ELRDWLRVDVKAGK; LRDWLRVDVKAGKP; RDWLRVDVKAGKPL; DWLRVDVKAGKPLF; WLRVDVKAGKPLFD; LRVDVKAGKPLFDQ; RVDVKAGKPLFDQL; VDVKAGKPLFDQLR; DVKAGKPLFDQLRT; VKAGKPLFDQLRTQ; KAGKPLFDQLRTQV; AGKPLFDQLRTQVI; GKPLFDQLRTQVID; KPLFDQLRTQVIDG; PLFDQLRTQVIDGV; LFDQLRTQVIDGVR; FDQLRTQVIDGVRA; DQLRTQVIDGVRAG; QLRTQVIDGVRAGA; LRTQVIDGVRAGAL; RTQVIDGVRAGALP; TQVIDGVRAGALPP; QVIDGVRAGALPPG; VIDGVRAGALPPGT; IDGVRAGALPPGTR; DGVRAGALPPGTRL; GVRAGALPPGTRLP; VRAGALPPGTRLPT; RAGALPPGTRLPTV; AGALPPGTRLPTVR; GALPPGTRLPTVRD; ALPPGTRLPTVRDL; LPPGTRLPTVRDLA; PPGTRLPTVRDLAG; PGTRLPTVRDLAGQ; GTRLPTVRDLAGQL; TRLPTVRDLAGQLG; RLPTVRDLAGQLGV; LPTVRDLAGQLGVA; PTVRDLAGQLGVAA; TVRDLAGQLGVAAN; VRDLAGQLGVAANT; RDLAGQLGVAANTV; DLAGQLGVAANTVA; LAGQLGVAANTVAR; AGQLGVAANTVARA; GQLGVAANTVARAY; QLGVAANTVARAYR; LGVAANTVARAYRE; GVAANTVARAYREL; VAANTVARAYRELE; AANTVARAYRELES; ANTVARAYRELESA; NTVARAYRELESAA; TVARAYRELESAAI; VARAYRELESAAIV; ARAYRELESAAIVE; RAYRELESAAIVET; AYRELESAAIVETR; YRELESAAIVETRG; RELESAAIVETRGR; ELESAAIVETRGRF; LESAAIVETRGRFG; ESAAIVETRGRFGT; SAAIVETRGRFGTF; AAIVETRGRFGTFI; AIVETRGRFGTFIS; IVETRGRFGTFISR; VETRGRFGTFISRF; ETRGRFGTFISRFD; TRGRFGTFISRFDP; RGRFGTFISRFDPT; GRFGTFISRFDPTD; RFGTFISRFDPTDA; FGTFISRFDPTDAA; GTFISRFDPTDAAM; TFISRFDPTDAAMA; FISRFDPTDAAMAA; ISRFDPTDAAMAAA; SRFDPTDAAMAAAA; RFDPTDAAMAAAAK; FDPTDAAMAAAAKE; DPTDAAMAAAAKEY; PTDAAMAAAAKEYV; TDAAMAAAAKEYVG; DAAMAAAAKEYVGV; AAMAAAAKEYVGVA; AMAAAAKEYVGVAR; MAAAAKEYVGVARA; AAAAKEYVGVARAL; AAAKEYVGVARALG; AAKEYVGVARALGL; AKEYVGVARALGLT; KEYVGVARALGLTK; EYVGVARALGLTKS; YVGVARALGLTKSD; VGVARALGLTKSDA; GVARALGLTKSDAM; VARALGLTKSDAMR; ARALGLTKSDAMRY; RALGLTKSDAMRYL; ALGLTKSDAMRYLT; LGLTKSDAMRYLTH; GLTKSDAMRYLTHV; LTKSDAMRYLTHVP; | |

Fig. 29 continued

TKSDAMRYLTHVPD; KSDAMRYLTHVPDD 15 mers:
MELRDWLRVDVKAGK; ELRDWLRVDVKAGKP; LRDWLRVDVKAGKPL; RDWLRVDVKAGKPLF; DWLRVDVKAGKPLFD; WLRVDVKAGKPLFDQ; LRVDVKAGKPLFDQL; RVDVKAGKPLFDQLR; VDVKAGKPLFDQLRT; DVKAGKPLFDQLRTQ; VKAGKPLFDQLRTQV; KAGKPLFDQLRTQVI; AGKPLFDQLRTQVID; GKPLFDQLRTQVIDG; KPLFDQLRTQVIDGV; PLFDQLRTQVIDGVR; LFDQLRTQVIDGVRA; FDQLRTQVIDGVRAG; DQLRTQVIDGVRAGA; QLRTQVIDGVRAGAL; LRTQVIDGVRAGALP; RTQVIDGVRAGALPP; TQVIDGVRAGALPPG; QVIDGVRAGALPPGT; VIDGVRAGALPPGTR; IDGVRAGALPPGTRL; DGVRAGALPPGTRLP; GVRAGALPPGTRLPT; VRAGALPPGTRLPTV; RAGALPPGTRLPTVR; AGALPPGTRLPTVRD; GALPPGTRLPTVRDL; ALPPGTRLPTVRDLA; LPPGTRLPTVRDLAG; PPGTRLPTVRDLAGQ; PGTRLPTVRDLAGQL; GTRLPTVRDLAGQLG; TRLPTVRDLAGQLGV; RLPTVRDLAGQLGVA; LPTVRDLAGQLGVAA; PTVRDLAGQLGVAAN; TVRDLAGQLGVAANT; VRDLAGQLGVAANTV; RDLAGQLGVAANTVA; DLAGQLGVAANTVAR; LAGQLGVAANTVARA; AGQLGVAANTVARAY; GQLGVAANTVARAYR; QLGVAANTVARAYRE; LGVAANTVARAYREL; GVAANTVARAYRELE; VAANTVARAYRELES; AANTVARAYRELESA; ANTVARAYRELESAA; NTVARAYRELESAAI; TVARAYRELESAAIV; VARAYRELESAAIVE; ARAYRELESAAIVET; RAYRELESAAIVETR; AYRELESAAIVETRG; YRELESAAIVETRGR; RELESAAIVETRGRF; ELESAAIVETRGRFG; LESAAIVETRGRFGT; ESAAIVETRGRFGTF; SAAIVETRGRFGTFI; AAIVETRGRFGTFIS; AIVETRGRFGTFISR; IVETRGRFGTFISRF; VETRGRFGTFISRFD; ETRGRFGTFISRFDP; TRGRFGTFISRFDPT; RGRFGTFISRFDPTD; GRFGTFISRFDPTDA; RFGTFISRFDPTDAA; FGTFISRFDPTDAAM; GTFISRFDPTDAAMA; TFISRFDPTDAAMAA; FISRFDPTDAAMAAA; ISRFDPTDAAMAAAA; SRFDPTDAAMAAAAK; RFDPTDAAMAAAAKE; FDPTDAAMAAAAKEY; DPTDAAMAAAAKEYV; PTDAAMAAAAKEYVG; TDAAMAAAAKEYVGV; DAAMAAAAKEYVGVA; AAMAAAAKEYVGVAR; AMAAAAKEYVGVARA; MAAAAKEYVGVARAL; AAAAKEYVGVARALG; AAAKEYVGVARALGL; AAKEYVGVARALGLT; AKEYVGVARALGLTK; KEYVGVARALGLTKS; EYVGVARALGLTKSD; YVGVARALGLTKSDA; VGVARALGLTKSDAM; GVARALGLTKSDAMR; VARALGLTKSDAMRY; ARALGLTKSDAMRYL; RALGLTKSDAMRYLT; ALGLTKSDAMRYLTH; LGLTKSDAMRYLTHV; GLTKSDAMRYLTHVP; LTKSDAMRYLTHVPD; TKSDAMRYLTHVPDD 16 mers:
MELRDWLRVDVKAGKP; ELRDWLRVDVKAGKPL; LRDWLRVDVKAGKPLF; RDWLRVDVKAGKPLFD; DWLRVDVKAGKPLFDQ; WLRVDVKAGKPLFDQL; LRVDVKAGKPLFDQLR; RVDVKAGKPLFDQLRT; VDVKAGKPLFDQLRTQ; DVKAGKPLFDQLRTQV; VKAGKPLFDQLRTQVI; KAGKPLFDQLRTQVID; AGKPLFDQLRTQVIDG; GKPLFDQLRTQVIDGV; KPLFDQLRTQVIDGVR; PLFDQLRTQVIDGVRA; LFDQLRTQVIDGVRAG; FDQLRTQVIDGVRAGA; DQLRTQVIDGVRAGAL; QLRTQVIDGVRAGALP; LRTQVIDGVRAGALPP; RTQVIDGVRAGALPPG; TQVIDGVRAGALPPGT; QVIDGVRAGALPPGTR; VIDGVRAGALPPGTRL; IDGVRAGALPPGTRLP; DGVRAGALPPGTRLPT; GVRAGALPPGTRLPTV; VRAGALPPGTRLPTVR; RAGALPPGTRLPTVRD; AGALPPGTRLPTVRDL; GALPPGTRLPTVRDLA; ALPPGTRLPTVRDLAG; LPPGTRLPTVRDLAGQ; PPGTRLPTVRDLAGQL; PGTRLPTVRDLAGQLG;

Fig. 29 continued

| | | |
|---|---|---|
| | GTRLPTVRDLAGQLGV; TRLPTVRDLAGQLGVA; RLPTVRDLAGQLGVAA; LPTVRDLAGQLGVAAN; PTVRDLAGQLGVAANT; TVRDLAGQLGVAANTV; VRDLAGQLGVAANTVA; RDLAGQLGVAANTVAR; DLAGQLGVAANTVARA; LAGQLGVAANTVARAY; AGQLGVAANTVARAYR; GQLGVAANTVARAYRE; QLGVAANTVARAYREL; LGVAANTVARAYRELE; GVAANTVARAYRELES; VAANTVARAYRELESA; AANTVARAYRELESAA; ANTVARAYRELESAAI; NTVARAYRELESAAIV; TVARAYRELESAAIVE; VARAYRELESAAIVET; ARAYRELESAAIVETR; RAYRELESAAIVETRG; AYRELESAAIVETRGR; YRELESAAIVETRGRF; RELESAAIVETRGRFG; ELESAAIVETRGRFGT; LESAAIVETRGRFGTF; ESAAIVETRGRFGTFI; SAAIVETRGRFGTFIS; AAIVETRGRFGTFISR; AIVETRGRFGTFISRF; IVETRGRFGTFISRFD; VETRGRFGTFISRFDP; ETRGRFGTFISRFDPT; TRGRFGTFISRFDPTD; RGRFGTFISRFDPTDA; GRFGTFISRFDPTDAA; RFGTFISRFDPTDAAM; FGTFISRFDPTDAAMA; GTFISRFDPTDAAMAA; TFISRFDPTDAAMAAA; FISRFDPTDAAMAAAA; ISRFDPTDAAMAAAAK; SRFDPTDAAMAAAAKE; RFDPTDAAMAAAAKEY; FDPTDAAMAAAAKEYV; DPTDAAMAAAAKEYVG; PTDAAMAAAAKEYVGV; TDAAMAAAAKEYVGVA; DAAMAAAAKEYVGVAR; AAMAAAAKEYVGVARA; AMAAAAKEYVGVARAL; MAAAAKEYVGVARALG; AAAAKEYVGVARALGL; AAAKEYVGVARALGLT; AAKEYVGVARALGLTK; AKEYVGVARALGLTKS; KEYVGVARALGLTKSD; EYVGVARALGLTKSDA; YVGVARALGLTKSDAM; VGVARALGLTKSDAMR; GVARALGLTKSDAMRY; VARALGLTKSDAMRYL; ARALGLTKSDAMRYLT; RALGLTKSDAMRYLTH; ALGLTKSDAMRYLTHV; LGLTKSDAMRYLTHVP; GLTKSDAMRYLTHVPD; LTKSDAMRYLTHVPDD | |
| 17) Rv1195 | 8 mers:<br>MSFVMAYP; SFVMAYPE; FVMAYPEM; VMAYPEML; MAYPEMLA; AYPEMLAA; YPEMLAAA; PEMLAAAA; EMLAAAAD; MLAAAADT; LAAAADTL; AAAADTLQ; AAADTLQS; AADTLQSI; ADTLQSIG; DTLQSIGA; TLQSIGAT; LQSIGATT; QSIGATTV; SIGATTVA; IGATTVAS; GATTVASN; ATTVASNA; TTVASNAA; TVASNAAA; VASNAAAA; ASNAAAAA; SNAAAAAP; NAAAAAPT; AAAAAPTT; AAAAPTTG; AAAPTTGV; AAPTTGVV; APTTGVVP; PTTGVVPP; TTGVVPPA; TGVVPPAA; GVVPPAAD; VVPPAADE; VPPAADEV; PPAADEVS; PAADEVSA; AADEVSAL; ADEVSALT; DEVSALTA; EVSALTAA; VSALTAAH; SALTAAHF; ALTAAHFA; LTAAHFAA; TAAHFAAH; AAHFAAHA; AHFAAHAA; HFAAHAAM; FAAHAAMY; AAHAAMYQ; AHAAMYQS; HAAMYQSV; AAMYQSVS; AMYQSVSA; MYQSVSAR; YQSVSARA; QSVSARAA; SVSARAAA; VSARAAAI; SARAAAIH; ARAAAIHD; RAAAIHDQ; AAAIHDQF; AAIHDQFV; AIHDQFVA; IHDQFVAT; HDQFVATL; DQFVATLA; QFVATLAS; FVATLASS; VATLASSA; ATLASSAS; TLASSASS; LASSASSY; ASSASSYA; SSASSYAA; SASSYAAT; ASSYAATE; SSYAATEV; SYAATEVA; YAATEVAN; AATEVANA; ATEVANAA; TEVANAAA; EVANAAAA; VANAAAAS;<br><br>9 mers:<br>MSFVMAYPE; SFVMAYPEM; FVMAYPEML; VMAYPEMLA; MAYPEMLAA; AYPEMLAAA; YPEMLAAAA; PEMLAAAAD; EMLAAAADT; MLAAAADTL; LAAAADTLQ; AAAADTLQS; AAADTLQSI; AADTLQSIG; ADTLQSIGA; DTLQSIGAT; TLQSIGATT; LQSIGATTV; QSIGATTVA; SIGATTVAS; IGATTVASN; GATTVASNA; ATTVASNAA; TTVASNAAA; TVASNAAAA; VASNAAAAA; ASNAAAAAP; SNAAAAAPT; NAAAAAPTT; AAAAAPTTG; AAAAPTTGV; AAAPTTGVV; AAPTTGVVP; APTTGVVPP; PTTGVVPPA; TTGVVPPAA; TGVVPPAAD; GVVPPAADE; VVPPAADEV; VPPAADEVS; PPAADEVSA; PAADEVSAL; AADEVSALT; ADEVSALTA; DEVSALTAA; EVSALTAAH; | 72673-73034 |

Fig. 29 continued

| | | | |
|---|---|---|---|
| | VSALTAAHF; SALTAAHFA; ALTAAHFAA; LTAAHFAAH; TAAHFAAHA; AAHFAAHAA; AHFAAHAAM; HFAAHAAMY; FAAHAAMYQ; AAHAAMYQS; AHAAMYQSV; HAAMYQSVS; AAMYQSVSA; AMYQSVSAR; MYQSVSARA; YQSVSARAA; QSVSARAAA; SVSARAAAI; VSARAAAIH; SARAAAIHD; ARAAAIHDQ; RAAAIHDQF; AAAIHDQFV; AAIHDQFVA; AIHDQFVAT; IHDQFVATL; HDQFVATLA; DQFVATLAS; QFVATLASS; FVATLASSA; VATLASSAS; ATLASSASS; TLASSASSY; LASSASSYA; ASSASSYAA; SSASSYAAT; SASSYAATE; ASSYAATEV; SSYAATEVA; SYAATEVAN; YAATEVANA; AATEVANAA; ATEVANAAA; TEVANAAAA; EVANAAAAS;<br><br>10 mers:<br>MSFVMAYPEM; SFVMAYPEML; FVMAYPEMLA; VMAYPEMLAA; MAYPEMLAAA; AYPEMLAAAA; YPEMLAAAAD; PEMLAAAADT; EMLAAAADTL; MLAAAADTLQ; LAAAADTLQS; AAAADTLQSI; AAADTLQSIG; AADTLQSIGA; ADTLQSIGAT; DTLQSIGATT; TLQSIGATTV; LQSIGATTVA; QSIGATTVAS; SIGATTVASN; IGATTVASNA; GATTVASNAA; ATTVASNAAA; TTVASNAAAA; TVASNAAAAA; VASNAAAAAP; ASNAAAAAPT; SNAAAAAPTT; NAAAAAPTTG; AAAAAPTTGV; AAAAPTTGVV; AAAPTTGVVP; AAPTTGVVPP; APTTGVVPPA; PTTGVVPPAA; TTGVVPPAAD; TGVVPPAADE; GVVPPAADEV; VVPPAADEVS; VPPAADEVSA; PPAADEVSAL; PAADEVSALT; AADEVSALTA; ADEVSALTAA; DEVSALTAAH; EVSALTAAHF; VSALTAAHFA; SALTAAHFAA; ALTAAHFAAH; LTAAHFAAHA; TAAHFAAHAA; AAHFAAHAAM; AHFAAHAAMY; HFAAHAAMYQ; FAAHAAMYQS; AAHAAMYQSV; AHAAMYQSVS; HAAMYQSVSA; AAMYQSVSAR; AMYQSVSARA; MYQSVSARAA; YQSVSARAAA; QSVSARAAAI; SVSARAAAIH; VSARAAAIHD; SARAAAIHDQ; ARAAAIHDQF; RAAAIHDQFV; AAAIHDQFVA; AAIHDQFVAT; AIHDQFVATL; IHDQFVATLA; HDQFVATLAS; DQFVATLASS; QFVATLASSA; FVATLASSAS; VATLASSASS; ATLASSASSY; TLASSASSYA; LASSASSYAA; ASSASSYAAT; SSASSYAATE; SASSYAATEV; ASSYAATEVA; SSYAATEVAN; SYAATEVANA; YAATEVANAA; AATEVANAAA; ATEVANAAAA; TEVANAAAAS;<br><br>11 mers:<br>MSFVMAYPEML; SFVMAYPEMLA; FVMAYPEMLAA; VMAYPEMLAAA; MAYPEMLAAAA; AYPEMLAAAAD; YPEMLAAAADT; PEMLAAAADTL; EMLAAAADTLQ; MLAAAADTLQS; LAAAADTLQSI; AAAADTLQSIG; AAADTLQSIGA; AADTLQSIGAT; ADTLQSIGATT; DTLQSIGATTV; TLQSIGATTVA; LQSIGATTVAS; QSIGATTVASN; SIGATTVASNA; IGATTVASNAA; GATTVASNAAA; ATTVASNAAAA; TTVASNAAAAA; TVASNAAAAAP; VASNAAAAAPT; ASNAAAAAPTT; SNAAAAAPTTG; NAAAAAPTTGV; AAAAAPTTGVV; AAAAPTTGVVP; AAAPTTGVVPP; AAPTTGVVPPA; APTTGVVPPAA; PTTGVVPPAAD; TTGVVPPAADE; TGVVPPAADEV; GVVPPAADEVS; VVPPAADEVSA; VPPAADEVSAL; PPAADEVSALT; PAADEVSALTA; AADEVSALTAA; ADEVSALTAAH; DEVSALTAAHF; EVSALTAAHFA; VSALTAAHFAA; SALTAAHFAAH; ALTAAHFAAHA; LTAAHFAAHAA; TAAHFAAHAAM; AAHFAAHAAMY; AHFAAHAAMYQ; HFAAHAAMYQS; FAAHAAMYQSV; AAHAAMYQSVS; AHAAMYQSVSA; HAAMYQSVSAR; AAMYQSVSARA; AMYQSVSARAA; MYQSVSARAAA; YQSVSARAAAI; QSVSARAAAIH; SVSARAAAIHD; VSARAAAIHDQ; SARAAAIHDQF; ARAAAIHDQFV; RAAAIHDQFVA; AAAIHDQFVAT; AAIHDQFVATL; AIHDQFVATLA; IHDQFVATLAS; HDQFVATLASS; DQFVATLASSA; QFVATLASSAS; FVATLASSASS; VATLASSASSY; ATLASSASSYA; TLASSASSYAA; LASSASSYAAT; ASSASSYAATE; SSASSYAATEV; SASSYAATEVA; ASSYAATEVAN; SSYAATEVANA; | |

Fig. 29 continued

| | | |
|---|---|---|
| | SYAATEVANAA; YAATEVANAAA; AATEVANAAAA; ATEVANAAAAS; | |
| 18) Rv1197 | 13 mers:<br>MASRFMTDPHAMR; ASRFMTDPHAMRD; SRFMTDPHAMRDM; RFMTDPHAMRDMA; FMTDPHAMRDMAG; MTDPHAMRDMAGR; TDPHAMRDMAGRF; DPHAMRDMAGRFE; PHAMRDMAGRFEV; HAMRDMAGRFEVH; AMRDMAGRFEVHA; MRDMAGRFEVHAQ; RDMAGRFEVHAQT; DMAGRFEVHAQTV; MAGRFEVHAQTVE; AGRFEVHAQTVED; GRFEVHAQTVEDE; RFEVHAQTVEDEA; FEVHAQTVEDEAR; EVHAQTVEDEARR; VHAQTVEDEARRM; HAQTVEDEARRMW; AQTVEDEARRMWA; QTVEDEARRMWAS; TVEDEARRMWASA; VEDEARRMWASAQ; EDEARRMWASAQN; DEARRMWASAQNI; EARRMWASAQNIS; ARRMWASAQNISG; RRMWASAQNISGA; RMWASAQNISGAG; MWASAQNISGAGW; WASAQNISGAGWS; ASAQNISGAGWSG; SAQNISGAGWSGM; AQNISGAGWSGMA; QNISGAGWSGMAE; NISGAGWSGMAEA; ISGAGWSGMAEAT; SGAGWSGMAEATS; GAGWSGMAEATSL; AGWSGMAEATSLD; GWSGMAEATSLDT; WSGMAEATSLDTM; SGMAEATSLDTMA; GMAEATSLDTMAQ; MAEATSLDTMAQM; AEATSLDTMAQMN; EATSLDTMAQMNQ; ATSLDTMAQMNQA; TSLDTMAQMNQAF; SLDTMAQMNQAFR; LDTMAQMNQAFRN; DTMAQMNQAFRNI; TMAQMNQAFRNIV; MAQMNQAFRNIVN; AQMNQAFRNIVNM; QMNQAFRNIVNML; MNQAFRNIVNMLH; NQAFRNIVNMLHG; QAFRNIVNMLHGV; AFRNIVNMLHGVR; FRNIVNMLHGVRD; RNIVNMLHGVRDG; NIVNMLHGVRDGL; IVNMLHGVRDGLV; VNMLHGVRDGLVR; NMLHGVRDGLVRD; MLHGVRDGLVRDA; LHGVRDGLVRDAN; HGVRDGLVRDANN; GVRDGLVRDANNY; VRDGLVRDANNYE; RDGLVRDANNYEQ; DGLVRDANNYEQQ; GLVRDANNYEQQE; LVRDANNYEQQEQ; VRDANNYEQQEQA; RDANNYEQQEQAS; DANNYEQQEQASQ; ANNYEQQEQASQQ; NNYEQQEQASQQI; NYEQQEQASQQIL; YEQQEQASQQILS; EQQEQASQQILSS;<br><br>14 mers:<br>MASRFMTDPHAMRD; ASRFMTDPHAMRDM; SRFMTDPHAMRDMA; RFMTDPHAMRDMAG; FMTDPHAMRDMAGR; MTDPHAMRDMAGRF; TDPHAMRDMAGRFE; DPHAMRDMAGRFEV; PHAMRDMAGRFEVH; HAMRDMAGRFEVHA; AMRDMAGRFEVHAQ; MRDMAGRFEVHAQT; RDMAGRFEVHAQTV; DMAGRFEVHAQTVE; MAGRFEVHAQTVED; AGRFEVHAQTVEDE; GRFEVHAQTVEDEA; RFEVHAQTVEDEAR; FEVHAQTVEDEARR; EVHAQTVEDEARRM; VHAQTVEDEARRMW; HAQTVEDEARRMWA; AQTVEDEARRMWAS; QTVEDEARRMWASA; TVEDEARRMWASAQ; VEDEARRMWASAQN; EDEARRMWASAQNI; DEARRMWASAQNIS; EARRMWASAQNISG; ARRMWASAQNISGA; RRMWASAQNISGAG; RMWASAQNISGAGW; MWASAQNISGAGWS; WASAQNISGAGWSG; ASAQNISGAGWSGM; SAQNISGAGWSGMA; AQNISGAGWSGMAE; QNISGAGWSGMAEA; NISGAGWSGMAEAT; ISGAGWSGMAEATS; SGAGWSGMAEATSL; GAGWSGMAEATSLD; AGWSGMAEATSLDT; GWSGMAEATSLDTM; WSGMAEATSLDTMA; SGMAEATSLDTMAQ; GMAEATSLDTMAQM; MAEATSLDTMAQMN; AEATSLDTMAQMNQ; EATSLDTMAQMNQA; ATSLDTMAQMNQAF; TSLDTMAQMNQAFR; SLDTMAQMNQAFRN; LDTMAQMNQAFRNI; DTMAQMNQAFRNIV; TMAQMNQAFRNIVN; MAQMNQAFRNIVNM; AQMNQAFRNIVNML; QMNQAFRNIVNMLH; MNQAFRNIVNMLHG; | 73035-73372 |

Fig. 29 continued

| | | |
|---|---|---|
| | NQAFRNIVNMLHGV; QAFRNIVNMLHGVR; AFRNIVNMLHGVRD; FRNIVNMLHGVRDG; RNIVNMLHGVRDGL; NIVNMLHGVRDGLV; IVNMLHGVRDGLVR; VNMLHGVRDGLVRD; NMLHGVRDGLVRDA; MLHGVRDGLVRDAN; LHGVRDGLVRDANN; HGVRDGLVRDANNY; GVRDGLVRDANNYE; VRDGLVRDANNYEQ; RDGLVRDANNYEQQ; DGLVRDANNYEQQE; GLVRDANNYEQQEQ; LVRDANNYEQQEQA; VRDANNYEQQEQAS; RDANNYEQQEQASQ; DANNYEQQEQASQQ; ANNYEQQEQASQQI; NNYEQQEQASQQIL; NYEQQEQASQQILS; YEQQEQASQQILSS;<br><br>15 mers:<br>MASRFMTDPHAMRDM; ASRFMTDPHAMRDMA; SRFMTDPHAMRDMAG; RFMTDPHAMRDMAGR; FMTDPHAMRDMAGRF; MTDPHAMRDMAGRFE; TDPHAMRDMAGRFEV; DPHAMRDMAGRFEVH; PHAMRDMAGRFEVHA; HAMRDMAGRFEVHAQ; AMRDMAGRFEVHAQT; MRDMAGRFEVHAQTV; RDMAGRFEVHAQTVE; DMAGRFEVHAQTVED; MAGRFEVHAQTVEDE; AGRFEVHAQTVEDEA; GRFEVHAQTVEDEAR; RFEVHAQTVEDEARR; FEVHAQTVEDEARRM; EVHAQTVEDEARRMW; VHAQTVEDEARRMWA; HAQTVEDEARRMWAS; AQTVEDEARRMWASA; QTVEDEARRMWASAQ; TVEDEARRMWASAQN; VEDEARRMWASAQNI; EDEARRMWASAQNIS; DEARRMWASAQNISG; EARRMWASAQNISGA; ARRMWASAQNISGAG; RRMWASAQNISGAGW; RMWASAQNISGAGWS; MWASAQNISGAGWSG; WASAQNISGAGWSGM; ASAQNISGAGWSGMA; SAQNISGAGWSGMAE; AQNISGAGWSGMAEA; QNISGAGWSGMAEAT; NISGAGWSGMAEATS; ISGAGWSGMAEATSL; SGAGWSGMAEATSLD; GAGWSGMAEATSLDT; AGWSGMAEATSLDTM; GWSGMAEATSLDTMA; WSGMAEATSLDTMAQ; SGMAEATSLDTMAQM; GMAEATSLDTMAQMN; MAEATSLDTMAQMNQ; AEATSLDTMAQMNQA; EATSLDTMAQMNQAF; ATSLDTMAQMNQAFR; TSLDTMAQMNQAFRN; SLDTMAQMNQAFRNI; LDTMAQMNQAFRNIV; DTMAQMNQAFRNIVN; TMAQMNQAFRNIVNM; MAQMNQAFRNIVNML; AQMNQAFRNIVNMLH; QMNQAFRNIVNMLHG; MNQAFRNIVNMLHGV; NQAFRNIVNMLHGVR; QAFRNIVNMLHGVRD; AFRNIVNMLHGVRDG; FRNIVNMLHGVRDGL; RNIVNMLHGVRDGLV; NIVNMLHGVRDGLVR; IVNMLHGVRDGLVRD; VNMLHGVRDGLVRDA; NMLHGVRDGLVRDAN; MLHGVRDGLVRDANN; LHGVRDGLVRDANNY; HGVRDGLVRDANNYE; GVRDGLVRDANNYEQ; VRDGLVRDANNYEQQ; RDGLVRDANNYEQQE; DGLVRDANNYEQQEQ; GLVRDANNYEQQEQA; LVRDANNYEQQEQAS; VRDANNYEQQEQASQ; RDANNYEQQEQASQQ; DANNYEQQEQASQQI; ANNYEQQEQASQQIL; NNYEQQEQASQQILS; NYEQQEQASQQILSS;<br><br>16 mers:<br>MASRFMTDPHAMRDMA; ASRFMTDPHAMRDMAG; SRFMTDPHAMRDMAGR; RFMTDPHAMRDMAGRF; FMTDPHAMRDMAGRFE; MTDPHAMRDMAGRFEV; TDPHAMRDMAGRFEVH; DPHAMRDMAGRFEVHA; PHAMRDMAGRFEVHAQ; HAMRDMAGRFEVHAQT; AMRDMAGRFEVHAQTV; MRDMAGRFEVHAQTVE; RDMAGRFEVHAQTVED; DMAGRFEVHAQTVEDE; MAGRFEVHAQTVEDEA; AGRFEVHAQTVEDEAR; GRFEVHAQTVEDEARR; RFEVHAQTVEDEARRM; FEVHAQTVEDEARRMW; EVHAQTVEDEARRMWA; VHAQTVEDEARRMWAS; HAQTVEDEARRMWASA; AQTVEDEARRMWASAQ; QTVEDEARRMWASAQN; TVEDEARRMWASAQNI; VEDEARRMWASAQNIS; EDEARRMWASAQNISG; DEARRMWASAQNISGA; EARRMWASAQNISGAG; ARRMWASAQNISGAGW; RRMWASAQNISGAGWS; RMWASAQNISGAGWSG; MWASAQNISGAGWSGM; WASAQNISGAGWSGMA; ASAQNISGAGWSGMAE; SAQNISGAGWSGMAEA; | |

Fig. 29 continued

| | | |
|---|---|---|
| | AQNISGAGWSGMAEAT; QNISGAGWSGMAEATS; NISGAGWSGMAEATSL; ISGAGWSGMAEATSLD; SGAGWSGMAEATSLDT; GAGWSGMAEATSLDTM; AGWSGMAEATSLDTMA; GWSGMAEATSLDTMAQ; WSGMAEATSLDTMAQM; SGMAEATSLDTMAQMN; GMAEATSLDTMAQMNQ; MAEATSLDTMAQMNQA; AEATSLDTMAQMNQAF; EATSLDTMAQMNQAFR; ATSLDTMAQMNQAFRN; TSLDTMAQMNQAFRNI; SLDTMAQMNQAFRNIV; LDTMAQMNQAFRNIVN; DTMAQMNQAFRNIVNM; TMAQMNQAFRNIVNML; MAQMNQAFRNIVNMLH; AQMNQAFRNIVNMLHG; QMNQAFRNIVNMLHGV; MNQAFRNIVNMLHGVR; NQAFRNIVNMLHGVRD; QAFRNIVNMLHGVRDG; AFRNIVNMLHGVRDGL; FRNIVNMLHGVRDGLV; RNIVNMLHGVRDGLVR; NIVNMLHGVRDGLVRD; IVNMLHGVRDGLVRDA; VNMLHGVRDGLVRDAN; NMLHGVRDGLVRDANN; MLHGVRDGLVRDANNY; LHGVRDGLVRDANNYE; HGVRDGLVRDANNYEQ; GVRDGLVRDANNYEQQ; VRDGLVRDANNYEQQE; RDGLVRDANNYEQQEQ; DGLVRDANNYEQQEQA; GLVRDANNYEQQEQAS; LVRDANNYEQQEQASQ; VRDANNYEQQEQASQQ; RDANNYEQQEQASQQI; DANNYEQQEQASQQIL; ANNYEQQEQASQQILS; NNYEQQEQASQQILSS; | |
| 19) Rv1198 | 13 mers:<br>MTINYQFGDVDAH; TINYQFGDVDAHG; INYQFGDVDAHGA; NYQFGDVDAHGAM; YQFGDVDAHGAMI; QFGDVDAHGAMIR; FGDVDAHGAMIRA; GDVDAHGAMIRAQ; DVDAHGAMIRAQA; VDAHGAMIRAQAG; DAHGAMIRAQAGS; AHGAMIRAQAGSL; HGAMIRAQAGSLE; GAMIRAQAGSLEA; AMIRAQAGSLEAE; MIRAQAGSLEAEH; IRAQAGSLEAEHQ; RAQAGSLEAEHQA; AQAGSLEAEHQAI; QAGSLEAEHQAII; AGSLEAEHQAIIS; GSLEAEHQAIISD; SLEAEHQAIISDV; LEAEHQAIISDVL; EAEHQAIISDVLT; AEHQAIISDVLTA; EHQAIISDVLTAS; HQAIISDVLTASD; QAIISDVLTASDF; AIISDVLTASDFW; IISDVLTASDFWG; ISDVLTASDFWGG; SDVLTASDFWGGA; DVLTASDFWGGAG; VLTASDFWGGAGS; LTASDFWGGAGSA; TASDFWGGAGSAA; ASDFWGGAGSAAC; SDFWGGAGSAACQ; DFWGGAGSAACQG; FWGGAGSAACQGF; WGGAGSAACQGFI; GGAGSAACQGFIT; GAGSAACQGFITQ; AGSAACQGFITQL; GSAACQGFITQLG; SAACQGFITQLGR; AACQGFITQLGRN; ACQGFITQLGRNF; CQGFITQLGRNFQ; QGFITQLGRNFQV; GFITQLGRNFQVI; FITQLGRNFQVIY; ITQLGRNFQVIYE; TQLGRNFQVIYEQ; QLGRNFQVIYEQA; LGRNFQVIYEQAN; GRNFQVIYEQANA; RNFQVIYEQANAH; NFQVIYEQANAHG; FQVIYEQANAHGQ; QVIYEQANAHGQK; VIYEQANAHGQKV; IYEQANAHGQKVQ; YEQANAHGQKVQA; EQANAHGQKVQAA; QANAHGQKVQAAG; ANAHGQKVQAAGN; NAHGQKVQAAGNN; AHGQKVQAAGNNM; HGQKVQAAGNNMA; GQKVQAAGNNMAQ; QKVQAAGNNMAQT; KVQAAGNNMAQTD; VQAAGNNMAQTDS; QAAGNNMAQTDSA; AAGNNMAQTDSAV; AGNNMAQTDSAVG; GNNMAQTDSAVGS; NNMAQTDSAVGSS; NMAQTDSAVGSSW; MAQTDSAVGSSWA;<br><br>14 mers:<br>MTINYQFGDVDAHG; TINYQFGDVDAHGA; INYQFGDVDAHGAM; NYQFGDVDAHGAMI; YQFGDVDAHGAMIR; QFGDVDAHGAMIRA; FGDVDAHGAMIRAQ; GDVDAHGAMIRAQA; DVDAHGAMIRAQAG; VDAHGAMIRAQAGS; DAHGAMIRAQAGSL; AHGAMIRAQAGSLE; HGAMIRAQAGSLEA; GAMIRAQAGSLEAE; AMIRAQAGSLEAEH; MIRAQAGSLEAEHQ; IRAQAGSLEAEHQA; RAQAGSLEAEHQAI; AQAGSLEAEHQAII; QAGSLEAEHQAIIS; AGSLEAEHQAIISD; GSLEAEHQAIISDV; SLEAEHQAIISDVL; LEAEHQAIISDVLT; EAEHQAIISDVLTA; AEHQAIISDVLTAS; EHQAIISDVLTASD; HQAIISDVLTASDF; QAIISDVLTASDFW; AIISDVLTASDFWG; | 73373-73694 |

Fig. 29 continued

| | | | |
|---|---|---|---|
| | IISDVLTASDFWGG; ISDVLTASDFWGGA; SDVLTASDFWGGAG;<br>DVLTASDFWGGAGS; VLTASDFWGGAGSA; LTASDFWGGAGSAA;<br>TASDFWGGAGSAAC; ASDFWGGAGSAACQ; SDFWGGAGSAACQG;<br>DFWGGAGSAACQGF; FWGGAGSAACQGFI; WGGAGSAACQGFIT;<br>GGAGSAACQGFITQ; GAGSAACQGFITQL; AGSAACQGFITQLG;<br>GSAACQGFITQLGR; SAACQGFITQLGRN; AACQGFITQLGRNF;<br>ACQGFITQLGRNFQ; CQGFITQLGRNFQV; QGFITQLGRNFQVI;<br>GFITQLGRNFQVIY; FITQLGRNFQVIYE; ITQLGRNFQVIYEQ;<br>TQLGRNFQVIYEQA; QLGRNFQVIYEQAN; LGRNFQVIYEQANA;<br>GRNFQVIYEQANAH; RNFQVIYEQANAHG; NFQVIYEQANAHGQ;<br>FQVIYEQANAHGQK; QVIYEQANAHGQKV; VIYEQANAHGQKVQ;<br>IYEQANAHGQKVQA; YEQANAHGQKVQAA; EQANAHGQKVQAAG;<br>QANAHGQKVQAAGN; ANAHGQKVQAAGNN; NAHGQKVQAAGNNM;<br>AHGQKVQAAGNNMA; HGQKVQAAGNNMAQ; GQKVQAAGNNMAQT;<br>QKVQAAGNNMAQTD; KVQAAGNNMAQTDS; VQAAGNNMAQTDSA;<br>QAAGNNMAQTDSAV; AAGNNMAQTDSAVG; AGNNMAQTDSAVGS;<br>GNNMAQTDSAVGSS; NNMAQTDSAVGSSW; NMAQTDSAVGSSWA;<br><br>15 mers:<br>MTINYQFGDVDAHGA; TINYQFGDVDAHGAM; INYQFGDVDAHGAMI;<br>NYQFGDVDAHGAMIR; YQFGDVDAHGAMIRA; QFGDVDAHGAMIRAQ;<br>FGDVDAHGAMIRAQA; GDVDAHGAMIRAQAG; DVDAHGAMIRAQAGS;<br>VDAHGAMIRAQAGSL; DAHGAMIRAQAGSLE; AHGAMIRAQAGSLEA;<br>HGAMIRAQAGSLEAE; GAMIRAQAGSLEAEH; AMIRAQAGSLEAEHQ;<br>MIRAQAGSLEAEHQA; IRAQAGSLEAEHQAI; RAQAGSLEAEHQAII;<br>AQAGSLEAEHQAIIS; QAGSLEAEHQAIISD; AGSLEAEHQAIISDV;<br>GSLEAEHQAIISDVL; SLEAEHQAIISDVLT; LEAEHQAIISDVLTA;<br>EAEHQAIISDVLTAS; AEHQAIISDVLTASD; EHQAIISDVLTASDF;<br>HQAIISDVLTASDFW; QAIISDVLTASDFWG; AIISDVLTASDFWGG;<br>IISDVLTASDFWGGA; ISDVLTASDFWGGAG; SDVLTASDFWGGAGS;<br>DVLTASDFWGGAGSA; VLTASDFWGGAGSAA; LTASDFWGGAGSAAC;<br>TASDFWGGAGSAACQ; ASDFWGGAGSAACQG; SDFWGGAGSAACQGF;<br>DFWGGAGSAACQGFI; FWGGAGSAACQGFIT; WGGAGSAACQGFITQ;<br>GGAGSAACQGFITQL; GAGSAACQGFITQLG; AGSAACQGFITQLGR;<br>GSAACQGFITQLGRN; SAACQGFITQLGRNF; AACQGFITQLGRNFQ;<br>ACQGFITQLGRNFQV; CQGFITQLGRNFQVI; QGFITQLGRNFQVIY;<br>GFITQLGRNFQVIYE; FITQLGRNFQVIYEQ; ITQLGRNFQVIYEQA;<br>TQLGRNFQVIYEQAN; QLGRNFQVIYEQANA; LGRNFQVIYEQANAH;<br>GRNFQVIYEQANAHG; RNFQVIYEQANAHGQ; NFQVIYEQANAHGQK;<br>FQVIYEQANAHGQKV; QVIYEQANAHGQKVQ; VIYEQANAHGQKVQA;<br>IYEQANAHGQKVQAA; YEQANAHGQKVQAAG; EQANAHGQKVQAAGN;<br>QANAHGQKVQAAGNN; ANAHGQKVQAAGNNM; NAHGQKVQAAGNNMA;<br>AHGQKVQAAGNNMAQ; HGQKVQAAGNNMAQT; GQKVQAAGNNMAQTD;<br>QKVQAAGNNMAQTDS; KVQAAGNNMAQTDSA; VQAAGNNMAQTDSAV;<br>QAAGNNMAQTDSAVG; AAGNNMAQTDSAVGS; AGNNMAQTDSAVGSS;<br>GNNMAQTDSAVGSSW; NNMAQTDSAVGSSWA;<br><br>16 mers:<br>MTINYQFGDVDAHGAM; TINYQFGDVDAHGAMI; INYQFGDVDAHGAMIR;<br>NYQFGDVDAHGAMIRA; YQFGDVDAHGAMIRAQ; QFGDVDAHGAMIRAQA;<br>FGDVDAHGAMIRAQAG; GDVDAHGAMIRAQAGS; DVDAHGAMIRAQAGSL;<br>VDAHGAMIRAQAGSLE; DAHGAMIRAQAGSLEA; AHGAMIRAQAGSLEAE;<br>HGAMIRAQAGSLEAEH; GAMIRAQAGSLEAEHQ; AMIRAQAGSLEAEHQA; | |

Fig. 29 continued

| | | |
|---|---|---|
| | MIRAQAGSLEAEHQAI; IRAQAGSLEAEHQAII; RAQAGSLEAEHQAIIS; AQAGSLEAEHQAIISD; QAGSLEAEHQAIISDV; AGSLEAEHQAIISDVL; GSLEAEHQAIISDVLT; SLEAEHQAIISDVLTA; LEAEHQAIISDVLTAS; EAEHQAIISDVLTASD; AEHQAIISDVLTASDF; EHQAIISDVLTASDFW; HQAIISDVLTASDFWG; QAIISDVLTASDFWGG; AIISDVLTASDFWGGA; IISDVLTASDFWGGAG; ISDVLTASDFWGGAGS; SDVLTASDFWGGAGSA; DVLTASDFWGGAGSAA; VLTASDFWGGAGSAAC; LTASDFWGGAGSAACQ; TASDFWGGAGSAACQG; ASDFWGGAGSAACQGF; SDFWGGAGSAACQGFI; DFWGGAGSAACQGFIT; FWGGAGSAACQGFITQ; WGGAGSAACQGFITQL; GGAGSAACQGFITQLG; GAGSAACQGFITQLGR; AGSAACQGFITQLGRN; GSAACQGFITQLGRNF; SAACQGFITQLGRNFQ; AACQGFITQLGRNFQV; ACQGFITQLGRNFQVI; CQGFITQLGRNFQVIY; QGFITQLGRNFQVIYE; GFITQLGRNFQVIYEQ; FITQLGRNFQVIYEQA; ITQLGRNFQVIYEQAN; TQLGRNFQVIYEQANA; QLGRNFQVIYEQANAH; LGRNFQVIYEQANAHG; GRNFQVIYEQANAHGQ; RNFQVIYEQANAHGQK; NFQVIYEQANAHGQKV; FQVIYEQANAHGQKVQ; QVIYEQANAHGQKVQA; VIYEQANAHGQKVQAA; IYEQANAHGQKVQAAG; YEQANAHGQKVQAAGN; EQANAHGQKVQAAGNN; QANAHGQKVQAAGNNM; ANAHGQKVQAAGNNMA; NAHGQKVQAAGNNMAQ; AHGQKVQAAGNNMAQT; HGQKVQAAGNNMAQTD; GQKVQAAGNNMAQTDS; QKVQAAGNNMAQTDSA; KVQAAGNNMAQTDSAV; VQAAGNNMAQTDSAVG; QAAGNNMAQTDSAVGS; AAGNNMAQTDSAVGSS; AGNNMAQTDSAVGSSW; GNNMAQTDSAVGSSWA; | |
| 20) Rv1250 | 13 mers: MTTAIRRAAGSSY; TTAIRRAAGSSYF; TAIRRAAGSSYFR; AIRRAAGSSYFRN; IRRAAGSSYFRNP; RRAAGSSYFRNPW; RAAGSSYFRNPWP; AAGSSYFRNPWPA; AGSSYFRNPWPAL; GSSYFRNPWPALW; SSYFRNPWPALWA; SYFRNPWPALWAM; YFRNPWPALWAMM; FRNPWPALWAMMV; RNPWPALWAMMVG; NPWPALWAMMVGF; PWPALWAMMVGFF; WPALWAMMVGFFM; PALWAMMVGFFMI; ALWAMMVGFFMIM; LWAMMVGFFMIML; WAMMVGFFMIMLD; AMMVGFFMIMLDS; MMVGFFMIMLDST; MVGFFMIMLDSTV; VGFFMIMLDSTVV; GFFMIMLDSTVVA; FFMIMLDSTVVAI; FMIMLDSTVVAIA; MIMLDSTVVAIAN; IMLDSTVVAIANP; MLDSTVVAIANPT; LDSTVVAIANPTI; DSTVVAIANPTIM; STVVAIANPTIMA; TVVAIANPTIMAQ; VVAIANPTIMAQL; VAIANPTIMAQLR; AIANPTIMAQLRI; IANPTIMAQLRIG; ANPTIMAQLRIGY; NPTIMAQLRIGYA; PTIMAQLRIGYAT; TIMAQLRIGYATV; IMAQLRIGYATVV; MAQLRIGYATVVW; AQLRIGYATVVWV; QLRIGYATVVWVT; LRIGYATVVWVTS; RIGYATVVWVTSA; IGYATVVWVTSAY; GYATVVWVTSAYL; YATVVWVTSAYLL; ATVVWVTSAYLLA; TVVWVTSAYLLAY; VVWVTSAYLLAYA; VWVTSAYLLAYAV; WVTSAYLLAYAVP; VTSAYLLAYAVPM; TSAYLLAYAVPML; SAYLLAYAVPMLV; AYLLAYAVPMLVA; YLLAYAVPMLVAG; LLAYAVPMLVAGR; LAYAVPMLVAGRL; AYAVPMLVAGRLG; YAVPMLVAGRLGD; AVPMLVAGRLGDR; VPMLVAGRLGDRF; PMLVAGRLGDRFG; MLVAGRLGDRFGP; LVAGRLGDRFGPK; VAGRLGDRFGPKN; AGRLGDRFGPKNL; GRLGDRFGPKNLY; RLGDRFGPKNLYL; LGDRFGPKNLYLI; GDRFGPKNLYLIG; DRFGPKNLYLIGL; RFGPKNLYLIGLG; FGPKNLYLIGLGV; GPKNLYLIGLGVF; PKNLYLIGLGVFT; KNLYLIGLGVFTV; NLYLIGLGVFTVA; LYLIGLGVFTVAS; YLIGLGVFTVASL; LIGLGVFTVASLG; IGLGVFTVASLGC; GLGVFTVASLGCG; LGVFTVASLGCGL; GVFTVASLGCGLS; VFTVASLGCGLSS; FTVASLGCGLSSG; TVASLGCGLSSGA; VASLGCGLSSGAG; ASLGCGLSSGAGM; SLGCGLSSGAGML; LGCGLSSGAGMLI; GCGLSSGAGMLIA; CGLSSGAGMLIAA; GLSSGAGMLIAAR; LSSGAGMLIAARV; SSGAGMLIAARVV; SGAGMLIAARVVQ; GAGMLIAARVVQG; | 73695-75954 |

Fig. 29 continued

| | | |
|---|---|---|
| | AGMLIAARVVQGV; GMLIAARVVQGVG; MLIAARVVQGVGA; LIAARVVQGVGAG; IAARVVQGVGAGL; AARVVQGVGAGLL; ARVVQGVGAGLLT; RVVQGVGAGLLTP; VVQGVGAGLLTPQ; VQGVGAGLLTPQT; QGVGAGLLTPQTL; GVGAGLLTPQTLS; VGAGLLTPQTLST; GAGLLTPQTLSTI; AGLLTPQTLSTIT; GLLTPQTLSTITR; LLTPQTLSTITRI; LTPQTLSTITRIF; TPQTLSTITRIFP; PQTLSTITRIFPA; QTLSTITRIFPAH; TLSTITRIFPAHR; LSTITRIFPAHRR; STITRIFPAHRRG; TITRIFPAHRRGV; ITRIFPAHRRGVA; TRIFPAHRRGVAL; RIFPAHRRGVALG; IFPAHRRGVALGA; FPAHRRGVALGAW; PAHRRGVALGAWG; AHRRGVALGAWGT; HRRGVALGAWGTV; RRGVALGAWGTVA; RGVALGAWGTVAS; GVALGAWGTVASV; VALGAWGTVASVA; ALGAWGTVASVAS; LGAWGTVASVASL; GAWGTVASVASLV; AWGTVASVASLVG; WGTVASVASLVGP; GTVASVASLVGPL; TVASVASLVGPLA; VASVASLVGPLAG; ASVASLVGPLAGG; SVASLVGPLAGGA; VASLVGPLAGGAL; ASLVGPLAGGALV; SLVGPLAGGALVD; LVGPLAGGALVDS; VGPLAGGALVDSM; GPLAGGALVDSMG; PLAGGALVDSMGW; LAGGALVDSMGWE; AGGALVDSMGWEW; GGALVDSMGWEWI; GALVDSMGWEWIF; ALVDSMGWEWIFF; LVDSMGWEWIFFV; VDSMGWEWIFFVN; DSMGWEWIFFVNV; SMGWEWIFFVNVP; MGWEWIFFVNVPV; GWEWIFFVNVPVG; WEWIFFVNVPVGV; EWIFFVNVPVGVI; WIFFVNVPVGVIG; IFFVNVPVGVIGL; FFVNVPVGVIGLI; FVNVPVGVIGLIL; VNVPVGVIGLILA; NVPVGVIGLILAA; VPVGVIGLILAAY; PVGVIGLILAAYL; VGVIGLILAAYLI; GVIGLILAAYLIP; VIGLILAAYLIPA; IGLILAAYLIPAL; GLILAAYLIPALP; LILAAYLIPALPH; ILAAYLIPALPHH; LAAYLIPALPHHP; AAYLIPALPHHPH; AYLIPALPHHPHR; YLIPALPHHPHRF; LIPALPHHPHRFD; IPALPHHPHRFDW; PALPHHPHRFDWF; ALPHHPHRFDWFG; LPHHPHRFDWFGV; PHHPHRFDWFGVG; HHPHRFDWFGVGL; HPHRFDWFGVGLS; PHRFDWFGVGLSG; HRFDWFGVGLSGA; RFDWFGVGLSGAG; FDWFGVGLSGAGM; DWFGVGLSGAGMF; WFGVGLSGAGMFL; FGVGLSGAGMFLI; GVGLSGAGMFLIV; VGLSGAGMFLIVF; GLSGAGMFLIVFG; LSGAGMFLIVFGL; SGAGMFLIVFGLQ; GAGMFLIVFGLQQ; AGMFLIVFGLQQG; GMFLIVFGLQQGQ; MFLIVFGLQQGQS; FLIVFGLQQGQSA; LIVFGLQQGQSAN; IVFGLQQGQSANW; VFGLQQGQSANWQ; FGLQQGQSANWQP; GLQQGQSANWQPW; LQQGQSANWQPWI; QQGQSANWQPWIW; QGQSANWQPWIWA; GQSANWQPWIWAV; QSANWQPWIWAVI; SANWQPWIWAVIV; ANWQPWIWAVIVG; NWQPWIWAVIVGG; WQPWIWAVIVGGI; QPWIWAVIVGGIG; PWIWAVIVGGIGF; WIWAVIVGGIGFM; IWAVIVGGIGFMS; WAVIVGGIGFMSL; AVIVGGIGFMSLF; VIVGGIGFMSLFV; IVGGIGFMSLFVY; VGGIGFMSLFVYW; GGIGFMSLFVYWQ; GIGFMSLFVYWQA; IGFMSLFVYWQAR; GFMSLFVYWQARN; FMSLFVYWQARNA; MSLFVYWQARNAR; SLFVYWQARNARE; LFVYWQARNAREP; FVYWQARNAREPL; VYWQARNAREPLI; YWQARNAREPLIP; WQARNAREPLIPL; QARNAREPLIPLE; ARNAREPLIPLEV; RNAREPLIPLEVF; NAREPLIPLEVFN; AREPLIPLEVFND; REPLIPLEVFNDR; EPLIPLEVFNDRN; PLIPLEVFNDRNF; LIPLEVFNDRNFS; IPLEVFNDRNFSL; PLEVFNDRNFSLS; LEVFNDRNFSLSN; EVFNDRNFSLSNL; VFNDRNFSLSNLR; FNDRNFSLSNLRI; NDRNFSLSNLRIA; DRNFSLSNLRIAI; RNFSLSNLRIAII; NFSLSNLRIAIIA; FSLSNLRIAIIAF; SLSNLRIAIIAFA; LSNLRIAIIAFAG; SNLRIAIIAFAGT; NLRIAIIAFAGTG; LRIAIIAFAGTGM; RIAIIAFAGTGMM; IAIIAFAGTGMML; AIIAFAGTGMMLP; IIAFAGTGMMLPV; IAFAGTGMMLPVT; AFAGTGMMLPVTF; FAGTGMMLPVTFY; AGTGMMLPVTFYA; GTGMMLPVTFYAQ; TGMMLPVTFYAQA; GMMLPVTFYAQAV; MMLPVTFYAQAVC; MLPVTFYAQAVCG; LPVTFYAQAVCGL; PVTFYAQAVCGLS; VTFYAQAVCGLSP; TFYAQAVCGLSPT; FYAQAVCGLSPTH; YAQAVCGLSPTHT; AQAVCGLSPTHTA; QAVCGLSPTHTAV; | |

Fig. 29 continued

| | | |
|---|---|---|
| | AVCGLSPTHTAVL; VCGLSPTHTAVLF; CGLSPTHTAVLFA; GLSPTHTAVLFAP;<br>LSPTHTAVLFAPT; SPTHTAVLFAPTA; PTHTAVLFAPTAI; THTAVLFAPTAIV;<br>HTAVLFAPTAIVG; TAVLFAPTAIVGG; AVLFAPTAIVGGV; VLFAPTAIVGGVL;<br>LFAPTAIVGGVLA; FAPTAIVGGVLAP; APTAIVGGVLAPF; PTAIVGGVLAPFV;<br>TAIVGGVLAPFVG; AIVGGVLAPFVGM; IVGGVLAPFVGMI; VGGVLAPFVGMII;<br>GGVLAPFVGMIID; GVLAPFVGMIIDR; VLAPFVGMIIDRS; LAPFVGMIIDRSH;<br>APFVGMIIDRSHP; PFVGMIIDRSHPL; FVGMIIDRSHPLC; VGMIIDRSHPLCV;<br>GMIIDRSHPLCVL; MIIDRSHPLCVLG; IIDRSHPLCVLGF; IDRSHPLCVLGFG;<br>DRSHPLCVLGFGF; RSHPLCVLGFGFS; SHPLCVLGFGFSV; HPLCVLGFGFSVL;<br>PLCVLGFGFSVLA; LCVLGFGFSVLAI; CVLGFGFSVLAIA; VLGFGFSVLAIAM;<br>LGFGFSVLAIAMT; GFGFSVLAIAMTW; FGFSVLAIAMTWL; GFSVLAIAMTWLL;<br>FSVLAIAMTWLLC; SVLAIAMTWLLCE; VLAIAMTWLLCEM; LAIAMTWLLCEMA;<br>AIAMTWLLCEMAP; IAMTWLLCEMAPG; AMTWLLCEMAPGT;<br>MTWLLCEMAPGTP; TWLLCEMAPGTPI; WLLCEMAPGTPIW; LLCEMAPGTPIWR;<br>LCEMAPGTPIWRL; CEMAPGTPIWRLV; EMAPGTPIWRLVL; MAPGTPIWRLVLP;<br>APGTPIWRLVLPF; PGTPIWRLVLPFI; GTPIWRLVLPFIA; TPIWRLVLPFIAL;<br>PIWRLVLPFIALG; IWRLVLPFIALGV; WRLVLPFIALGVA; RLVLPFIALGVAG;<br>LVLPFIALGVAGA; VLPFIALGVAGAF; LPFIALGVAGAFV; PFIALGVAGAFVW;<br>FIALGVAGAFVWS; IALGVAGAFVWSP; ALGVAGAFVWSPL; LGVAGAFVWSPLT;<br>GVAGAFVWSPLTV; VAGAFVWSPLTVT; AGAFVWSPLTVTA; GAFVWSPLTVTAT;<br>AFVWSPLTVTATR; FVWSPLTVTATRN; VWSPLTVTATRNL; WSPLTVTATRNLR;<br>SPLTVTATRNLRP; PLTVTATRNLRPH; LTVTATRNLRPHL; TVTATRNLRPHLA;<br>VTATRNLRPHLAG; TATRNLRPHLAGA; ATRNLRPHLAGAS; TRNLRPHLAGASS;<br>RNLRPHLAGASSG; NLRPHLAGASSGV; LRPHLAGASSGVF; RPHLAGASSGVFN;<br>PHLAGASSGVFNA; HLAGASSGVFNAV; LAGASSGVFNAVR;<br>AGASSGVFNAVRQ; GASSGVFNAVRQL; ASSGVFNAVRQLG;<br>SSGVFNAVRQLGA; SGVFNAVRQLGAV; GVFNAVRQLGAVL;<br>VFNAVRQLGAVLG; FNAVRQLGAVLGS; NAVRQLGAVLGSA; AVRQLGAVLGSAS;<br>VRQLGAVLGSASM; RQLGAVLGSASMA; QLGAVLGSASMAA;<br>LGAVLGSASMAAF; GAVLGSASMAAFM; AVLGSASMAAFMT;<br>VLGSASMAAFMTS; LGSASMAAFMTSR; GSASMAAFMTSRI; SASMAAFMTSRIA;<br>ASMAAFMTSRIAA; SMAAFMTSRIAAE; MAAFMTSRIAAEM; AAFMTSRIAAEMP;<br>AFMTSRIAAEMPG; FMTSRIAAEMPGG; MTSRIAAEMPGGV; TSRIAAEMPGGVD;<br>SRIAAEMPGGVDA; RIAAEMPGGVDAL; IAAEMPGGVDALT; AAEMPGGVDALTG;<br>AEMPGGVDALTGP; EMPGGVDALTGPA; MPGGVDALTGPAG;<br>PGGVDALTGPAGQ; GGVDALTGPAGQD; GVDALTGPAGQDA;<br>VDALTGPAGQDAT; DALTGPAGQDATV; ALTGPAGQDATVL; LTGPAGQDATVLQ;<br>TGPAGQDATVLQL; GPAGQDATVLQLP; PAGQDATVLQLPE; AGQDATVLQLPEF;<br>GQDATVLQLPEFV; QDATVLQLPEFVR; DATVLQLPEFVRE; ATVLQLPEFVREP;<br>TVLQLPEFVREPF; VLQLPEFVREPFA; LQLPEFVREPFAA; QLPEFVREPFAAA;<br>LPEFVREPFAAAM; PEFVREPFAAAMS; EFVREPFAAAMSQ; FVREPFAAAMSQS;<br>VREPFAAAMSQSM; REPFAAAMSQSML; EPFAAAMSQSMLL;<br>PFAAAMSQSMLLP; FAAAMSQSMLLPA; AAAMSQSMLLPAF; AAMSQSMLLPAFV;<br>AMSQSMLLPAFVA; MSQSMLLPAFVAL; SQSMLLPAFVALF; QSMLLPAFVALFG;<br>SMLLPAFVALFGI; MLLPAFVALFGIV; LLPAFVALFGIVA; LPAFVALFGIVAA;<br>PAFVALFGIVAAL; AFVALFGIVAALF; FVALFGIVAALFL; VALFGIVAALFLV;<br>ALFGIVAALFLVD; LFGIVAALFLVDF; FGIVAALFLVDFT; GIVAALFLVDFTG;<br>IVAALFLVDFTGA; VAALFLVDFTGAA; AALFLVDFTGAAV; ALFLVDFTGAAVA;<br>LFLVDFTGAAVAK; FLVDFTGAAVAKE; LVDFTGAAVAKEP; VDFTGAAVAKEPL;<br>DFTGAAVAKEPLP; FTGAAVAKEPLPE; TGAAVAKEPLPES; GAAVAKEPLPESD;<br>AAVAKEPLPESDG; AVAKEPLPESDGD; VAKEPLPESDGDA; AKEPLPESDGDAD;<br>KEPLPESDGDADD; EPLPESDGDADDD; PLPESDGDADDDD;<br>LPESDGDADDDDY; PESDGDADDDDYV; ESDGDADDDDYVE; | |

Fig. 29 continued

| | | |
|---|---|---|
| | SDGDADDDDYVEY; DGDADDDDYVEYI; GDADDDDYVEYIL; DADDDDYVEYILR; ADDDDYVEYILRR; DDDDYVEYILRRE; DDDYVEYILRREP; DDYVEYILRREPE; DYVEYILRREPEE; YVEYILRREPEED; VEYILRREPEEDC; EYILRREPEEDCD; YILRREPEEDCDT; ILRREPEEDCDTQ; LRREPEEDCDTQP; RREPEEDCDTQPL; REPEEDCDTQPLR; EPEEDCDTQPLRA; PEEDCDTQPLRAS; EEDCDTQPLRASR; EDCDTQPLRASRP; DCDTQPLRASRPA; CDTQPLRASRPAA; DTQPLRASRPAAA; TQPLRASRPAAAA; QPLRASRPAAAAA; PLRASRPAAAAAS; LRASRPAAAAASR; RASRPAAAAASRS; ASRPAAAAASRSG; SRPAAAAASRSGA; RPAAAAASRSGAG; PAAAAASRSGAGG; AAAAASRSGAGGP; AAAASRSGAGGPL; AAASRSGAGGPLA; AASRSGAGGPLAV; ASRSGAGGPLAVS; SRSGAGGPLAVSW; RSGAGGPLAVSWS; SGAGGPLAVSWST; GAGGPLAVSWSTS; AGGPLAVSWSTSA; GGPLAVSWSTSAQ; GPLAVSWSTSAQG; PLAVSWSTSAQGM; LAVSWSTSAQGMP; AVSWSTSAQGMPP; VSWSTSAQGMPPG; SWSTSAQGMPPGP; WSTSAQGMPPGPP; STSAQGMPPGPPG; TSAQGMPPGPPGR; SAQGMPPGPPGRR; AQGMPPGPPGRRA; QGMPPGPPGRRAW; GMPPGPPGRRAWQ; MPPGPPGRRAWQA; PPGPPGRRAWQAD; PGPPGRRAWQADT; GPPGRRAWQADTE; PPGRRAWQADTES; PGRRAWQADTEST; GRRAWQADTESTA; RRAWQADTESTAP; RAWQADTESTAPS; AWQADTESTAPSA; WQADTESTAPSAL<br><br>14 mers:<br>MTTAIRRAAGSSYF; TTAIRRAAGSSYFR; TAIRRAAGSSYFRN; AIRRAAGSSYFRNP; IRRAAGSSYFRNPW; RRAAGSSYFRNPWP; RAAGSSYFRNPWPA; AAGSSYFRNPWPAL; AGSSYFRNPWPALW; GSSYFRNPWPALWA; SSYFRNPWPALWAM; SYFRNPWPALWAMM; YFRNPWPALWAMMV; FRNPWPALWAMMVG; RNPWPALWAMMVGF; NPWPALWAMMVGFF; PWPALWAMMVGFFM; WPALWAMMVGFFMI; PALWAMMVGFFMIM; ALWAMMVGFFMIML; LWAMMVGFFMIMLD; WAMMVGFFMIMLDS; AMMVGFFMIMLDST; MMVGFFMIMLDSTV; MVGFFMIMLDSTVV; VGFFMIMLDSTVVA; GFFMIMLDSTVVAI; FFMIMLDSTVVAIA; FMIMLDSTVVAIAN; MIMLDSTVVAIANP; IMLDSTVVAIANPT; MLDSTVVAIANPTI; LDSTVVAIANPTIM; DSTVVAIANPTIMA; STVVAIANPTIMAQ; TVVAIANPTIMAQL; VVAIANPTIMAQLR; VAIANPTIMAQLRI; AIANPTIMAQLRIG; IANPTIMAQLRIGY; ANPTIMAQLRIGYA; NPTIMAQLRIGYAT; PTIMAQLRIGYATV; TIMAQLRIGYATVV; IMAQLRIGYATVVW; MAQLRIGYATVVWV; AQLRIGYATVVWVT; QLRIGYATVVWVTS; LRIGYATVVWVTSA; RIGYATVVWVTSAY; IGYATVVWVTSAYL; GYATVVWVTSAYLL; YATVVWVTSAYLLA; ATVVWVTSAYLLAY; TVVWVTSAYLLAYA; VVWVTSAYLLAYAV; VWVTSAYLLAYAVP; WVTSAYLLAYAVPM; VTSAYLLAYAVPML; TSAYLLAYAVPMLV; SAYLLAYAVPMLVA; AYLLAYAVPMLVAG; YLLAYAVPMLVAGR; LLAYAVPMLVAGRL; LAYAVPMLVAGRLG; AYAVPMLVAGRLGD; YAVPMLVAGRLGDR; AVPMLVAGRLGDRF; VPMLVAGRLGDRFG; PMLVAGRLGDRFGP; MLVAGRLGDRFGPK; LVAGRLGDRFGPKN; VAGRLGDRFGPKNL; AGRLGDRFGPKNLY; GRLGDRFGPKNLYL; RLGDRFGPKNLYLI; LGDRFGPKNLYLIG; GDRFGPKNLYLIGL; DRFGPKNLYLIGLG; RFGPKNLYLIGLGV; FGPKNLYLIGLGVF; GPKNLYLIGLGVFT; PKNLYLIGLGVFTV; KNLYLIGLGVFTVA; NLYLIGLGVFTVAS; LYLIGLGVFTVASL; YLIGLGVFTVASLG; LIGLGVFTVASLGC; IGLGVFTVASLGCG; GLGVFTVASLGCGL; LGVFTVASLGCGLS; GVFTVASLGCGLSS; VFTVASLGCGLSSG; FTVASLGCGLSSGA; TVASLGCGLSSGAG; | |

Fig. 29 continued

| | | |
|---|---|---|
| | VASLGCGLSSGAGM; ASLGCGLSSGAGML; SLGCGLSSGAGMLI;<br>LGCGLSSGAGMLIA; GCGLSSGAGMLIAA; CGLSSGAGMLIAAR;<br>GLSSGAGMLIAARV; LSSGAGMLIAARVV; SSGAGMLIAARVVQ;<br>SGAGMLIAARVVQG; GAGMLIAARVVQGV; AGMLIAARVVQGVG;<br>GMLIAARVVQGVGA; MLIAARVVQGVGAG; LIAARVVQGVGAGL;<br>IAARVVQGVGAGLL; AARVVQGVGAGLLT; ARVVQGVGAGLLTP;<br>RVVQGVGAGLLTPQ; VVQGVGAGLLTPQT; VQGVGAGLLTPQTL;<br>QGVGAGLLTPQTLS; GVGAGLLTPQTLST; VGAGLLTPQTLSTI;<br>GAGLLTPQTLSTIT; AGLLTPQTLSTITR; GLLTPQTLSTITRI; LLTPQTLSTITRIF;<br>LTPQTLSTITRIFP; TPQTLSTITRIFPA; PQTLSTITRIFPAH; QTLSTITRIFPAHR;<br>TLSTITRIFPAHRR; LSTITRIFPAHRRG; STITRIFPAHRRGV; TITRIFPAHRRGVA;<br>ITRIFPAHRRGVAL; TRIFPAHRRGVALG; RIFPAHRRGVALGA;<br>IFPAHRRGVALGAW; FPAHRRGVALGAWG; PAHRRGVALGAWGT;<br>AHRRGVALGAWGTV; HRRGVALGAWGTVA; RRGVALGAWGTVAS;<br>RGVALGAWGTVASV; GVALGAWGTVASVA; VALGAWGTVASVAS;<br>ALGAWGTVASVASL; LGAWGTVASVASLV; GAWGTVASVASLVG;<br>AWGTVASVASLVGP; WGTVASVASLVGPL; GTVASVASLVGPLA;<br>TVASVASLVGPLAG; VASVASLVGPLAGG; ASVASLVGPLAGGA;<br>SVASLVGPLAGGAL; VASLVGPLAGGALV; ASLVGPLAGGALVD;<br>SLVGPLAGGALVDS; LVGPLAGGALVDSM; VGPLAGGALVDSMG;<br>GPLAGGALVDSMGW; PLAGGALVDSMGWE; LAGGALVDSMGWEW;<br>AGGALVDSMGWEWI; GGALVDSMGWEWIF; GALVDSMGWEWIFF;<br>ALVDSMGWEWIFFV; LVDSMGWEWIFFVN; VDSMGWEWIFFVNV;<br>DSMGWEWIFFVNVP; SMGWEWIFFVNVPV; MGWEWIFFVNVPVG;<br>GWEWIFFVNVPVGV; WEWIFFVNVPVGVI; EWIFFVNVPVGVIG;<br>WIFFVNVPVGVIGL; IFFVNVPVGVIGLI; FFVNVPVGVIGLIL; FVNVPVGVIGLILA;<br>VNVPVGVIGLILAA; NVPVGVIGLILAAY; VPVGVIGLILAAYL; PVGVIGLILAAYLI;<br>VGVIGLILAAYLIP; GVIGLILAAYLIPA; VIGLILAAYLIPAL; IGLILAAYLIPALP;<br>GLILAAYLIPALPH; LILAAYLIPALPHH; ILAAYLIPALPHHP; LAAYLIPALPHHPH;<br>AAYLIPALPHHPHR; AYLIPALPHHPHRF; YLIPALPHHPHRFD;<br>LIPALPHHPHRFDW; IPALPHHPHRFDWF; PALPHHPHRFDWFG;<br>ALPHHPHRFDWFGV; LPHHPHRFDWFGVG; PHHPHRFDWFGVGL;<br>HHPHRFDWFGVGLS; HPHRFDWFGVGLSG; PHRFDWFGVGLSGA;<br>HRFDWFGVGLSGAG; RFDWFGVGLSGAGM; FDWFGVGLSGAGMF;<br>DWFGVGLSGAGMFL; WFGVGLSGAGMFLI; FGVGLSGAGMFLIV;<br>GVGLSGAGMFLIVF; VGLSGAGMFLIVFG; GLSGAGMFLIVFGL;<br>LSGAGMFLIVFGLQ; SGAGMFLIVFGLQQ; GAGMFLIVFGLQQG;<br>AGMFLIVFGLQQGQ; GMFLIVFGLQQGQS; MFLIVFGLQQGQSA;<br>FLIVFGLQQGQSAN; LIVFGLQQGQSANW; IVFGLQQGQSANWQ;<br>VFGLQQGQSANWQP; FGLQQGQSANWQPW; GLQQGQSANWQPWI;<br>LQQGQSANWQPWIW; QQGQSANWQPWIWA; QGQSANWQPWIWAV;<br>GQSANWQPWIWAVI; QSANWQPWIWAVIV; SANWQPWIWAVIVG;<br>ANWQPWIWAVIVGG; NWQPWIWAVIVGGI; WQPWIWAVIVGGIG;<br>QPWIWAVIVGGIGF; PWIWAVIVGGIGFM; WIWAVIVGGIGFMS;<br>IWAVIVGGIGFMSL; WAVIVGGIGFMSLF; AVIVGGIGFMSLFV;<br>VIVGGIGFMSLFVY; IVGGIGFMSLFVYW; VGGIGFMSLFVYWQ;<br>GGIGFMSLFVYWQA; GIGFMSLFVYWQAR; IGFMSLFVYWQARN;<br>GFMSLFVYWQARNA; FMSLFVYWQARNAR; MSLFVYWQARNARE;<br>SLFVYWQARNAREP; LFVYWQARNAREPL; FVYWQARNAREPLI;<br>VYWQARNAREPLIP; YWQARNAREPLIPL; WQARNAREPLIPLE;<br>QARNAREPLIPLEV; ARNAREPLIPLEVF; RNAREPLIPLEVFN;<br>NAREPLIPLEVFND; AREPLIPLEVFNDR; REPLIPLEVFNDRN;<br>EPLIPLEVFNDRNF; PLIPLEVFNDRNFS; LIPLEVFNDRNFSL; IPLEVFNDRNFSLS; | |

Fig. 29 continued

| | | | |
|---|---|---|---|
| | PLEVFNDRNFSLSN; LEVFNDRNFSLSNL; EVFNDRNFSLSNLR; VFNDRNFSLSNLRI; FNDRNFSLSNLRIA; NDRNFSLSNLRIAI; DRNFSLSNLRIAII; RNFSLSNLRIAIIA; NFSLSNLRIAIIAF; FSLSNLRIAIIAFA; SLSNLRIAIIAFAG; LSNLRIAIIAFAGT; SNLRIAIIAFAGTG; NLRIAIIAFAGTGM; LRIAIIAFAGTGMM; RIAIIAFAGTGMML; IAIIAFAGTGMMLP; AIIAFAGTGMMLPV; IIAFAGTGMMLPVT; IAFAGTGMMLPVTF; AFAGTGMMLPVTFY; FAGTGMMLPVTFYA; AGTGMMLPVTFYAQ; GTGMMLPVTFYAQA; TGMMLPVTFYAQAV; GMMLPVTFYAQAVC; MMLPVTFYAQAVCG; MLPVTFYAQAVCGL; LPVTFYAQAVCGLS; PVTFYAQAVCGLSP; VTFYAQAVCGLSPT; TFYAQAVCGLSPTH; FYAQAVCGLSPTHT; YAQAVCGLSPTHTA; AQAVCGLSPTHTAV; QAVCGLSPTHTAVL; AVCGLSPTHTAVLF; VCGLSPTHTAVLFA; CGLSPTHTAVLFAP; GLSPTHTAVLFAPT; LSPTHTAVLFAPTA; SPTHTAVLFAPTAI; PTHTAVLFAPTAIV; THTAVLFAPTAIVG; HTAVLFAPTAIVGG; TAVLFAPTAIVGGV; AVLFAPTAIVGGVL; VLFAPTAIVGGVLA; LFAPTAIVGGVLAP; FAPTAIVGGVLAPF; APTAIVGGVLAPFV; PTAIVGGVLAPFVG; TAIVGGVLAPFVGM; AIVGGVLAPFVGMI; IVGGVLAPFVGMII; VGGVLAPFVGMIID; GGVLAPFVGMIIDR; GVLAPFVGMIIDRS; VLAPFVGMIIDRSH; LAPFVGMIIDRSHP; APFVGMIIDRSHPL; PFVGMIIDRSHPLC; FVGMIIDRSHPLCV; VGMIIDRSHPLCVL; GMIIDRSHPLCVLG; MIIDRSHPLCVLGF; IIDRSHPLCVLGFG; IDRSHPLCVLGFGF; DRSHPLCVLGFGFS; RSHPLCVLGFGFSV; SHPLCVLGFGFSVL; HPLCVLGFGFSVLA; PLCVLGFGFSVLAI; LCVLGFGFSVLAIA; CVLGFGFSVLAIAM; VLGFGFSVLAIAMT; LGFGFSVLAIAMTW; GFGFSVLAIAMTWL; FGFSVLAIAMTWLL; GFSVLAIAMTWLLC; FSVLAIAMTWLLCE; SVLAIAMTWLLCEM; VLAIAMTWLLCEMA; LAIAMTWLLCEMAP; AIAMTWLLCEMAPG; IAMTWLLCEMAPGT; AMTWLLCEMAPGTP; MTWLLCEMAPGTPI; TWLLCEMAPGTPIW; WLLCEMAPGTPIWR; LLCEMAPGTPIWRL; LCEMAPGTPIWRLV; CEMAPGTPIWRLVL; EMAPGTPIWRLVLP; MAPGTPIWRLVLPF; APGTPIWRLVLPFI; PGTPIWRLVLPFIA; GTPIWRLVLPFIAL; TPIWRLVLPFIALG; PIWRLVLPFIALGV; IWRLVLPFIALGVA; WRLVLPFIALGVAG; RLVLPFIALGVAGA; LVLPFIALGVAGAF; VLPFIALGVAGAFV; LPFIALGVAGAFVW; PFIALGVAGAFVWS; FIALGVAGAFVWSP; IALGVAGAFVWSPL; ALGVAGAFVWSPLT; LGVAGAFVWSPLTV; GVAGAFVWSPLTVT; VAGAFVWSPLTVTA; AGAFVWSPLTVTAT; GAFVWSPLTVTATR; AFVWSPLTVTATRN; FVWSPLTVTATRNL; VWSPLTVTATRNLR; WSPLTVTATRNLRP; SPLTVTATRNLRPH; PLTVTATRNLRPHL; LTVTATRNLRPHLA; TVTATRNLRPHLAG; VTATRNLRPHLAGA; TATRNLRPHLAGAS; ATRNLRPHLAGASS; TRNLRPHLAGASSG; RNLRPHLAGASSGV; NLRPHLAGASSGVF; LRPHLAGASSGVFN; RPHLAGASSGVFNA; PHLAGASSGVFNAV; HLAGASSGVFNAVR; LAGASSGVFNAVRQ; AGASSGVFNAVRQL; GASSGVFNAVRQLG; ASSGVFNAVRQLGA; SSGVFNAVRQLGAV; SGVFNAVRQLGAVL; GVFNAVRQLGAVLG; VFNAVRQLGAVLGS; FNAVRQLGAVLGSA; NAVRQLGAVLGSAS; AVRQLGAVLGSASM; VRQLGAVLGSASMA; RQLGAVLGSASMAA; QLGAVLGSASMAAF; LGAVLGSASMAAFM; GAVLGSASMAAFMT; AVLGSASMAAFMTS; VLGSASMAAFMTSR; LGSASMAAFMTSRI; GSASMAAFMTSRIA; SASMAAFMTSRIAA; ASMAAFMTSRIAAE; SMAAFMTSRIAAEM; MAAFMTSRIAAEMP; AAFMTSRIAAEMPG; AFMTSRIAAEMPGG; FMTSRIAAEMPGGV; MTSRIAAEMPGGVD; TSRIAAEMPGGVDA; SRIAAEMPGGVDAL; RIAAEMPGGVDALT; IAAEMPGGVDALTG; AAEMPGGVDALTGP; AEMPGGVDALTGPA; EMPGGVDALTGPAG; | |

Fig. 29 continued

| | | | |
|---|---|---|---|
| | MPGGVDALTGPAGQ; PGGVDALTGPAGQD; GGVDALTGPAGQDA; GVDALTGPAGQDAT; VDALTGPAGQDATV; DALTGPAGQDATVL; ALTGPAGQDATVLQ; LTGPAGQDATVLQL; TGPAGQDATVLQLP; GPAGQDATVLQLPE; PAGQDATVLQLPEF; AGQDATVLQLPEFV; GQDATVLQLPEFVR; QDATVLQLPEFVRE; DATVLQLPEFVREP; ATVLQLPEFVREPF; TVLQLPEFVREPFA; VLQLPEFVREPFAA; LQLPEFVREPFAAA; QLPEFVREPFAAAM; LPEFVREPFAAAMS; PEFVREPFAAAMSQ; EFVREPFAAAMSQS; FVREPFAAAMSQSM; VREPFAAAMSQSML; REPFAAAMSQSMLL; EPFAAAMSQSMLLP; PFAAAMSQSMLLPA; FAAAMSQSMLLPAF; AAAMSQSMLLPAFV; AAMSQSMLLPAFVA; AMSQSMLLPAFVAL; MSQSMLLPAFVALF; SQSMLLPAFVALFG; QSMLLPAFVALFGI; SMLLPAFVALFGIV; MLLPAFVALFGIVA; LLPAFVALFGIVAA; LPAFVALFGIVAAL; PAFVALFGIVAALF; AFVALFGIVAALFL; FVALFGIVAALFLV; VALFGIVAALFLVD; ALFGIVAALFLVDF; LFGIVAALFLVDFT; FGIVAALFLVDFTG; GIVAALFLVDFTGA; IVAALFLVDFTGAA; VAALFLVDFTGAAV; AALFLVDFTGAAVA; ALFLVDFTGAAVAK; LFLVDFTGAAVAKE; FLVDFTGAAVAKEP; LVDFTGAAVAKEPL; VDFTGAAVAKEPLP; DFTGAAVAKEPLPE; FTGAAVAKEPLPES; TGAAVAKEPLPESD; GAAVAKEPLPESDG; AAVAKEPLPESDGD; AVAKEPLPESDGDA; VAKEPLPESDGDAD; AKEPLPESDGDADD; KEPLPESDGDADDD; EPLPESDGDADDDD; PLPESDGDADDDDY; LPESDGDADDDDYV; PESDGDADDDDYVE; ESDGDADDDDYVEY; SDGDADDDDYVEYI; DGDADDDDYVEYIL; GDADDDDYVEYILR; DADDDDYVEYILRR; ADDDDYVEYILRRE; DDDDYVEYILRREP; DDDYVEYILRREPE; DDYVEYILRREPEE; DYVEYILRREPEED; YVEYILRREPEEDC; VEYILRREPEEDCD; EYILRREPEEDCDT; YILRREPEEDCDTQ; ILRREPEEDCDTQP; LRREPEEDCDTQPL; RREPEEDCDTQPLR; REPEEDCDTQPLRA; EPEEDCDTQPLRAS; PEEDCDTQPLRASR; EEDCDTQPLRASRP; EDCDTQPLRASRPA; DCDTQPLRASRPAA; CDTQPLRASRPAAA; DTQPLRASRPAAAA; TQPLRASRPAAAAA; QPLRASRPAAAAAS; PLRASRPAAAAASR; LRASRPAAAAASRS; RASRPAAAAASRSG; ASRPAAAAASRSGA; SRPAAAAASRSGAG; RPAAAAASRSGAGG; PAAAAASRSGAGGP; AAAAASRSGAGGPL; AAAASRSGAGGPLA; AAASRSGAGGPLAV; AASRSGAGGPLAVS; ASRSGAGGPLAVSW; SRSGAGGPLAVSWS; RSGAGGPLAVSWST; SGAGGPLAVSWSTS; GAGGPLAVSWSTSA; AGGPLAVSWSTSAQ; GGPLAVSWSTSAQG; GPLAVSWSTSAQGM; PLAVSWSTSAQGMP; LAVSWSTSAQGMPP; AVSWSTSAQGMPPG; VSWSTSAQGMPPGP; SWSTSAQGMPPGPP; WSTSAQGMPPGPPG; STSAQGMPPGPPGR; TSAQGMPPGPPGRR; SAQGMPPGPPGRRA; AQGMPPGPPGRRAW; QGMPPGPPGRRAWQ; GMPPGPPGRRAWQA; MPPGPPGRRAWQAD; PPGPPGRRAWQADT; PGPPGRRAWQADTE; GPPGRRAWQADTES; PPGRRAWQADTEST; PGRRAWQADTESTA; GRRAWQADTESTAP; RRAWQADTESTAPS; RAWQADTESTAPSA<br><br>15 mers:<br>MTTAIRRAAGSSYFR; TTAIRRAAGSSYFRN; TAIRRAAGSSYFRNP; AIRRAAGSSYFRNPW; IRRAAGSSYFRNPWP; RRAAGSSYFRNPWPA; RAAGSSYFRNPWPAL; AAGSSYFRNPWPALW; AGSSYFRNPWPALWA; GSSYFRNPWPALWAM; SSYFRNPWPALWAMM; SYFRNPWPALWAMMV; YFRNPWPALWAMMVG; FRNPWPALWAMMVGF; RNPWPALWAMMVGFF; NPWPALWAMMVGFFM; PWPALWAMMVGFFMI; WPALWAMMVGFFMIM; PALWAMMVGFFMIML; ALWAMMVGFFMIMLD; LWAMMVGFFMIMLDS; | | |

Fig. 29 continued

| | | |
|---|---|---|
| | WAMMVGFFMIMLDST; AMMVGFFMIMLDSTV; MMVGFFMIMLDSTVV;<br>MVGFFMIMLDSTVVA; VGFFMIMLDSTVVAI; GFFMIMLDSTVVAIA;<br>FFMIMLDSTVVAIAN; FMIMLDSTVVAIANP; MIMLDSTVVAIANPT;<br>IMLDSTVVAIANPTI; MLDSTVVAIANPTIM; LDSTVVAIANPTIMA;<br>DSTVVAIANPTIMAQ; STVVAIANPTIMAQL; TVVAIANPTIMAQLR;<br>VVAIANPTIMAQLRI; VAIANPTIMAQLRIG; AIANPTIMAQLRIGY;<br>IANPTIMAQLRIGYA; ANPTIMAQLRIGYAT; NPTIMAQLRIGYATV;<br>PTIMAQLRIGYATVV; TIMAQLRIGYATVVW; IMAQLRIGYATVVWV;<br>MAQLRIGYATVVWVT; AQLRIGYATVVWVTS; QLRIGYATVVWVTSA;<br>LRIGYATVVWVTSAY; RIGYATVVWVTSAYL; IGYATVVWVTSAYLL;<br>GYATVVWVTSAYLLA; YATVVWVTSAYLLAY; ATVVWVTSAYLLAYA;<br>TVVWVTSAYLLAYAV; VVWVTSAYLLAYAVP; VWVTSAYLLAYAVPM;<br>WVTSAYLLAYAVPML; VTSAYLLAYAVPMLV; TSAYLLAYAVPMLVA;<br>SAYLLAYAVPMLVAG; AYLLAYAVPMLVAGR; YLLAYAVPMLVAGRL;<br>LLAYAVPMLVAGRLG; LAYAVPMLVAGRLGD; AYAVPMLVAGRLGDR;<br>YAVPMLVAGRLGDRF; AVPMLVAGRLGDRFG; VPMLVAGRLGDRFGP;<br>PMLVAGRLGDRFGPK; MLVAGRLGDRFGPKN; LVAGRLGDRFGPKNL;<br>VAGRLGDRFGPKNLY; AGRLGDRFGPKNLYL; GRLGDRFGPKNLYLI;<br>RLGDRFGPKNLYLIG; LGDRFGPKNLYLIGL; GDRFGPKNLYLIGLG;<br>DRFGPKNLYLIGLGV; RFGPKNLYLIGLGVF; FGPKNLYLIGLGVFT;<br>GPKNLYLIGLGVFTV; PKNLYLIGLGVFTVA; KNLYLIGLGVFTVAS;<br>NLYLIGLGVFTVASL; LYLIGLGVFTVASLG; YLIGLGVFTVASLGC;<br>LIGLGVFTVASLGCG; IGLGVFTVASLGCGL; GLGVFTVASLGCGLS;<br>LGVFTVASLGCGLSS; GVFTVASLGCGLSSG; VFTVASLGCGLSSGA;<br>FTVASLGCGLSSGAG; TVASLGCGLSSGAGM; VASLGCGLSSGAGML;<br>ASLGCGLSSGAGMLI; SLGCGLSSGAGMLIA; LGCGLSSGAGMLIAA;<br>GCGLSSGAGMLIAAR; CGLSSGAGMLIAARV; GLSSGAGMLIAARVV;<br>LSSGAGMLIAARVVQ; SSGAGMLIAARVVQG; SGAGMLIAARVVQGV;<br>GAGMLIAARVVQGVG; AGMLIAARVVQGVGA; GMLIAARVVQGVGAG;<br>MLIAARVVQGVGAGL; LIAARVVQGVGAGLL; IAARVVQGVGAGLLT;<br>AARVVQGVGAGLLTP; ARVVQGVGAGLLTPQ; RVVQGVGAGLLTPQT;<br>VVQGVGAGLLTPQTL; VQGVGAGLLTPQTLS; QGVGAGLLTPQTLST;<br>GVGAGLLTPQTLSTI; VGAGLLTPQTLSTIT; GAGLLTPQTLSTITR;<br>AGLLTPQTLSTITRI; GLLTPQTLSTITRIF; LLTPQTLSTITRIFP;<br>LTPQTLSTITRIFPA; TPQTLSTITRIFPAH; PQTLSTITRIFPAHR;<br>QTLSTITRIFPAHRR; TLSTITRIFPAHRRG; LSTITRIFPAHRRGV;<br>STITRIFPAHRRGVA; TITRIFPAHRRGVAL; ITRIFPAHRRGVALG;<br>TRIFPAHRRGVALGA; RIFPAHRRGVALGAW; IFPAHRRGVALGAWG;<br>FPAHRRGVALGAWGT; PAHRRGVALGAWGTV; AHRRGVALGAWGTVA;<br>HRRGVALGAWGTVAS; RRGVALGAWGTVASV; RGVALGAWGTVASVA;<br>GVALGAWGTVASVAS; VALGAWGTVASVASL; ALGAWGTVASVASLV;<br>LGAWGTVASVASLVG; GAWGTVASVASLVGP; AWGTVASVASLVGPL;<br>WGTVASVASLVGPLA; GTVASVASLVGPLAG; TVASVASLVGPLAGG;<br>VASVASLVGPLAGGA; ASVASLVGPLAGGAL; SVASLVGPLAGGALV;<br>VASLVGPLAGGALVD; ASLVGPLAGGALVDS; SLVGPLAGGALVDSM;<br>LVGPLAGGALVDSMG; VGPLAGGALVDSMGW; GPLAGGALVDSMGWE;<br>PLAGGALVDSMGWEW; LAGGALVDSMGWEWI; AGGALVDSMGWEWIF;<br>GGALVDSMGWEWIFF; GALVDSMGWEWIFFV; ALVDSMGWEWIFFVN;<br>LVDSMGWEWIFFVNV; VDSMGWEWIFFVNVP; DSMGWEWIFFVNVPV;<br>SMGWEWIFFVNVPVG; MGWEWIFFVNVPVGV; GWEWIFFVNVPVGVI;<br>WEWIFFVNVPVGVIG; EWIFFVNVPVGVIGL; WIFFVNVPVGVIGLI;<br>IFFVNVPVGVIGLIL; FFVNVPVGVIGLILA; FVNVPVGVIGLILAA;<br>VNVPVGVIGLILAAY; NVPVGVIGLILAAYL; VPVGVIGLILAAYLI; | |

Fig. 29 continued

| | | |
|---|---|---|
| | PVGVIGLILAAYLIP; VGVIGLILAAYLIPA; GVIGLILAAYLIPAL; VIGLILAAYLIPALP;<br>IGLILAAYLIPALPH; GLILAAYLIPALPHH; LILAAYLIPALPHHP;<br>ILAAYLIPALPHHPH; LAAYLIPALPHHPHR; AAYLIPALPHHPHRF;<br>AYLIPALPHHPHRFD; YLIPALPHHPHRFDW; LIPALPHHPHRFDWF;<br>IPALPHHPHRFDWFG; PALPHHPHRFDWFGV; ALPHHPHRFDWFGVG;<br>LPHHPHRFDWFGVGL; PHHPHRFDWFGVGLS; HHPHRFDWFGVGLSG;<br>HPHRFDWFGVGLSGA; PHRFDWFGVGLSGAG; HRFDWFGVGLSGAGM;<br>RFDWFGVGLSGAGMF; FDWFGVGLSGAGMFL; DWFGVGLSGAGMFLI;<br>WFGVGLSGAGMFLIV; FGVGLSGAGMFLIVF; GVGLSGAGMFLIVFG;<br>VGLSGAGMFLIVFGL; GLSGAGMFLIVFGLQ; LSGAGMFLIVFGLQQ;<br>SGAGMFLIVFGLQQG; GAGMFLIVFGLQQGQ; AGMFLIVFGLQQGQS;<br>GMFLIVFGLQQGQSA; MFLIVFGLQQGQSAN; FLIVFGLQQGQSANW;<br>LIVFGLQQGQSANWQ; IVFGLQQGQSANWQP; VFGLQQGQSANWQPW;<br>FGLQQGQSANWQPWI; GLQQGQSANWQPWIW; LQQGQSANWQPWIWA;<br>QQGQSANWQPWIWAV; QGQSANWQPWIWAVI; GQSANWQPWIWAVIV;<br>QSANWQPWIWAVIVG; SANWQPWIWAVIVGG; ANWQPWIWAVIVGGI;<br>NWQPWIWAVIVGGIG; WQPWIWAVIVGGIGF; QPWIWAVIVGGIGFM;<br>PWIWAVIVGGIGFMS; WIWAVIVGGIGFMSL; IWAVIVGGIGFMSLF;<br>WAVIVGGIGFMSLFV; AVIVGGIGFMSLFVY; VIVGGIGFMSLFVYW;<br>IVGGIGFMSLFVYWQ; VGGIGFMSLFVYWQA; GGIGFMSLFVYWQAR;<br>GIGFMSLFVYWQARN; IGFMSLFVYWQARNA; GFMSLFVYWQARNAR;<br>FMSLFVYWQARNARE; MSLFVYWQARNAREP; SLFVYWQARNAREPL;<br>LFVYWQARNAREPLI; FVYWQARNAREPLIP; VYWQARNAREPLIPL;<br>YWQARNAREPLIPLE; WQARNAREPLIPLEV; QARNAREPLIPLEVF;<br>ARNAREPLIPLEVFN; RNAREPLIPLEVFND; NAREPLIPLEVFNDR;<br>AREPLIPLEVFNDRN; REPLIPLEVFNDRNF; EPLIPLEVFNDRNFS;<br>PLIPLEVFNDRNFSL; LIPLEVFNDRNFSLS; IPLEVFNDRNFSLSN;<br>PLEVFNDRNFSLSNL; LEVFNDRNFSLSNLR; EVFNDRNFSLSNLRI;<br>VFNDRNFSLSNLRIA; FNDRNFSLSNLRIAI; NDRNFSLSNLRIAII;<br>DRNFSLSNLRIAIIA; RNFSLSNLRIAIIAF; NFSLSNLRIAIIAFA; FSLSNLRIAIIAFAG;<br>SLSNLRIAIIAFAGT; LSNLRIAIIAFAGTG; SNLRIAIIAFAGTGM;<br>NLRIAIIAFAGTGMM; LRIAIIAFAGTGMML; RIAIIAFAGTGMMLP;<br>IAIIAFAGTGMMLPV; AIIAFAGTGMMLPVT; IIAFAGTGMMLPVTF;<br>IAFAGTGMMLPVTFY; AFAGTGMMLPVTFYA; FAGTGMMLPVTFYAQ;<br>AGTGMMLPVTFYAQA; GTGMMLPVTFYAQAV; TGMMLPVTFYAQAVC;<br>GMMLPVTFYAQAVCG; MMLPVTFYAQAVCGL; MLPVTFYAQAVCGLS;<br>LPVTFYAQAVCGLSP; PVTFYAQAVCGLSPT; VTFYAQAVCGLSPTH;<br>TFYAQAVCGLSPTHT; FYAQAVCGLSPTHTA; YAQAVCGLSPTHTAV;<br>AQAVCGLSPTHTAVL; QAVCGLSPTHTAVLF; AVCGLSPTHTAVLFA;<br>VCGLSPTHTAVLFAP; CGLSPTHTAVLFAPT; GLSPTHTAVLFAPTA;<br>LSPTHTAVLFAPTAI; SPTHTAVLFAPTAIV; PTHTAVLFAPTAIVG;<br>THTAVLFAPTAIVGG; HTAVLFAPTAIVGGV; TAVLFAPTAIVGGVL;<br>AVLFAPTAIVGGVLA; VLFAPTAIVGGVLAP; LFAPTAIVGGVLAPF;<br>FAPTAIVGGVLAPFV; APTAIVGGVLAPFVG; PTAIVGGVLAPFVGM;<br>TAIVGGVLAPFVGMI; AIVGGVLAPFVGMII; IVGGVLAPFVGMIID;<br>VGGVLAPFVGMIIDR; GGVLAPFVGMIIDRS; GVLAPFVGMIIDRSH;<br>VLAPFVGMIIDRSHP; LAPFVGMIIDRSHPL; APFVGMIIDRSHPLC;<br>PFVGMIIDRSHPLCV; FVGMIIDRSHPLCVL; VGMIIDRSHPLCVLG;<br>GMIIDRSHPLCVLGF; MIIDRSHPLCVLGFG; IIDRSHPLCVLGFGF;<br>IDRSHPLCVLGFGFS; DRSHPLCVLGFGFSV; RSHPLCVLGFGFSVL;<br>SHPLCVLGFGFSVLA; HPLCVLGFGFSVLAI; PLCVLGFGFSVLAIA;<br>LCVLGFGFSVLAIAM; CVLGFGFSVLAIAMT; VLGFGFSVLAIAMTW;<br>LGFGFSVLAIAMTWL; GFGFSVLAIAMTWLL; FGFSVLAIAMTWLLC; | |

Fig. 29 continued

| | | |
|---|---|---|
| | GFSVLAIAMTWLLCE; FSVLAIAMTWLLCEM; SVLAIAMTWLLCEMA; | |
| | VLAIAMTWLLCEMAP; LAIAMTWLLCEMAPG; AIAMTWLLCEMAPGT; | |
| | IAMTWLLCEMAPGTP; AMTWLLCEMAPGTPI; MTWLLCEMAPGTPIW; | |
| | TWLLCEMAPGTPIWR; WLLCEMAPGTPIWRL; LLCEMAPGTPIWRLV; | |
| | LCEMAPGTPIWRLVL; CEMAPGTPIWRLVLP; EMAPGTPIWRLVLPF; | |
| | MAPGTPIWRLVLPFI; APGTPIWRLVLPFIA; PGTPIWRLVLPFIAL; | |
| | GTPIWRLVLPFIALG; TPIWRLVLPFIALGV; PIWRLVLPFIALGVA; | |
| | IWRLVLPFIALGVAG; WRLVLPFIALGVAGA; RLVLPFIALGVAGAF; | |
| | LVLPFIALGVAGAFV; VLPFIALGVAGAFVW; LPFIALGVAGAFVWS; | |
| | PFIALGVAGAFVWSP; FIALGVAGAFVWSPL; IALGVAGAFVWSPLT; | |
| | ALGVAGAFVWSPLTV; LGVAGAFVWSPLTVT; GVAGAFVWSPLTVTA; | |
| | VAGAFVWSPLTVTAT; AGAFVWSPLTVTATR; GAFVWSPLTVTATRN; | |
| | AFVWSPLTVTATRNL; FVWSPLTVTATRNLR; VWSPLTVTATRNLRP; | |
| | WSPLTVTATRNLRPH; SPLTVTATRNLRPHL; PLTVTATRNLRPHLA; | |
| | LTVTATRNLRPHLAG; TVTATRNLRPHLAGA; VTATRNLRPHLAGAS; | |
| | TATRNLRPHLAGASS; ATRNLRPHLAGASSG; TRNLRPHLAGASSGV; | |
| | RNLRPHLAGASSGVF; NLRPHLAGASSGVFN; LRPHLAGASSGVFNA; | |
| | RPHLAGASSGVFNAV; PHLAGASSGVFNAVR; HLAGASSGVFNAVRQ; | |
| | LAGASSGVFNAVRQL; AGASSGVFNAVRQLG; GASSGVFNAVRQLGA; | |
| | ASSGVFNAVRQLGAV; SSGVFNAVRQLGAVL; SGVFNAVRQLGAVLG; | |
| | GVFNAVRQLGAVLGS; VFNAVRQLGAVLGSA; FNAVRQLGAVLGSAS; | |
| | NAVRQLGAVLGSASM; AVRQLGAVLGSASMA; VRQLGAVLGSASMAA; | |
| | RQLGAVLGSASMAAF; QLGAVLGSASMAAFM; LGAVLGSASMAAFMT; | |
| | GAVLGSASMAAFMTS; AVLGSASMAAFMTSR; VLGSASMAAFMTSRI; | |
| | LGSASMAAFMTSRIA; GSASMAAFMTSRIAA; SASMAAFMTSRIAAE; | |
| | ASMAAFMTSRIAAEM; SMAAFMTSRIAAEMP; MAAFMTSRIAAEMPG; | |
| | AAFMTSRIAAEMPGG; AFMTSRIAAEMPGGV; FMTSRIAAEMPGGVD; | |
| | MTSRIAAEMPGGVDA; TSRIAAEMPGGVDAL; SRIAAEMPGGVDALT; | |
| | RIAAEMPGGVDALTG; IAAEMPGGVDALTGP; AAEMPGGVDALTGPA; | |
| | AEMPGGVDALTGPAG; EMPGGVDALTGPAGQ; MPGGVDALTGPAGQD; | |
| | PGGVDALTGPAGQDA; GGVDALTGPAGQDAT; GVDALTGPAGQDATV; | |
| | VDALTGPAGQDATVL; DALTGPAGQDATVLQ; ALTGPAGQDATVLQL; | |
| | LTGPAGQDATVLQLP; TGPAGQDATVLQLPE; GPAGQDATVLQLPEF; | |
| | PAGQDATVLQLPEFV; AGQDATVLQLPEFVR; GQDATVLQLPEFVRE; | |
| | QDATVLQLPEFVREP; DATVLQLPEFVREPF; ATVLQLPEFVREPFA; | |
| | TVLQLPEFVREPFAA; VLQLPEFVREPFAAA; LQLPEFVREPFAAAM; | |
| | QLPEFVREPFAAAMS; LPEFVREPFAAAMSQ; PEFVREPFAAAMSQS; | |
| | EFVREPFAAAMSQSM; FVREPFAAAMSQSML; VREPFAAAMSQSMLL; | |
| | REPFAAAMSQSMLLP; EPFAAAMSQSMLLPA; PFAAAMSQSMLLPAF; | |
| | FAAAMSQSMLLPAFV; AAAMSQSMLLPAFVA; AAMSQSMLLPAFVAL; | |
| | AMSQSMLLPAFVALF; MSQSMLLPAFVALFG; SQSMLLPAFVALFGI; | |
| | QSMLLPAFVALFGIV; SMLLPAFVALFGIVA; MLLPAFVALFGIVAA; | |
| | LLPAFVALFGIVAAL; LPAFVALFGIVAALF; PAFVALFGIVAALFL; | |
| | AFVALFGIVAALFLV; FVALFGIVAALFLVD; VALFGIVAALFLVDF; | |
| | ALFGIVAALFLVDFT; LFGIVAALFLVDFTG; FGIVAALFLVDFTGA; | |
| | GIVAALFLVDFTGAA; IVAALFLVDFTGAAV; VAALFLVDFTGAAVA; | |
| | AALFLVDFTGAAVAK; ALFLVDFTGAAVAKE; LFLVDFTGAAVAKEP; | |
| | FLVDFTGAAVAKEPL; LVDFTGAAVAKEPLP; VDFTGAAVAKEPLPE; | |
| | DFTGAAVAKEPLPES; FTGAAVAKEPLPESD; TGAAVAKEPLPESDG; | |
| | GAAVAKEPLPESDGD; AAVAKEPLPESDGDA; AVAKEPLPESDGDAD; | |
| | VAKEPLPESDGDADD; AKEPLPESDGDADDD; KEPLPESDGDADDDD; | |
| | EPLPESDGDADDDDY; PLPESDGDADDDDYV; LPESDGDADDDDYVE; | |
| | PESDGDADDDDYVEY; ESDGDADDDDYVEYI; SDGDADDDDYVEYIL; | |

Fig. 29 continued

DGDADDDDYVEYILR; GDADDDDYVEYILRR; DADDDDYVEYILRRE;
ADDDDYVEYILRREP; DDDDYVEYILRREPE; DDDYVEYILRREPEE;
DDYVEYILRREPEED; DYVEYILRREPEEDC; YVEYILRREPEEDCD;
VEYILRREPEEDCDT; EYILRREPEEDCDTQ; YILRREPEEDCDTQP;
ILRREPEEDCDTQPL; LRREPEEDCDTQPLR; RREPEEDCDTQPLRA;
REPEEDCDTQPLRAS; EPEEDCDTQPLRASR; PEEDCDTQPLRASRP;
EEDCDTQPLRASRPA; EDCDTQPLRASRPAA; DCDTQPLRASRPAAA;
CDTQPLRASRPAAAA; DTQPLRASRPAAAAA; TQPLRASRPAAAAAS;
QPLRASRPAAAAASR; PLRASRPAAAAASRS; LRASRPAAAAASRSG;
RASRPAAAAASRSGA; ASRPAAAAASRSGAG; SRPAAAAASRSGAGG;
RPAAAAASRSGAGGP; PAAAAASRSGAGGPL; AAAAASRSGAGGPLA;
AAAASRSGAGGPLAV; AAASRSGAGGPLAVS; AASRSGAGGPLAVSW;
ASRSGAGGPLAVSWS; SRSGAGGPLAVSWST; RSGAGGPLAVSWSTS;
SGAGGPLAVSWSTSA; GAGGPLAVSWSTSAQ; AGGPLAVSWSTSAQG;
GGPLAVSWSTSAQGM; GPLAVSWSTSAQGMP; PLAVSWSTSAQGMPP;
LAVSWSTSAQGMPPG; AVSWSTSAQGMPPGP; VSWSTSAQGMPPGPP;
SWSTSAQGMPPGPPG; WSTSAQGMPPGPPGR; STSAQGMPPGPPGRR;
TSAQGMPPGPPGRRA; SAQGMPPGPPGRRAW; AQGMPPGPPGRRAWQ;
QGMPPGPPGRRAWQA; GMPPGPPGRRAWQAD; MPPGPPGRRAWQADT;
PPGPPGRRAWQADTE; PGPPGRRAWQADTES; GPPGRRAWQADTEST;
PPGRRAWQADTESTA; PGRRAWQADTESTAP; GRRAWQADTESTAPS;
RRAWQADTESTAPSA;

16 mers:
MTTAIRRAAGSSYFRN; TTAIRRAAGSSYFRNP; TAIRRAAGSSYFRNPW;
AIRRAAGSSYFRNPWP; IRRAAGSSYFRNPWPA; RRAAGSSYFRNPWPAL;
RAAGSSYFRNPWPALW; AAGSSYFRNPWPALWA; AGSSYFRNPWPALWAM;
GSSYFRNPWPALWAMM; SSYFRNPWPALWAMMV; SYFRNPWPALWAMMVG;
YFRNPWPALWAMMVGF; FRNPWPALWAMMVGFF; RNPWPALWAMMVGFFM;
NPWPALWAMMVGFFMI; PWPALWAMMVGFFMIM; WPALWAMMVGFFMIML;
PALWAMMVGFFMIMLD; ALWAMMVGFFMIMLDS; LWAMMVGFFMIMLDST;
WAMMVGFFMIMLDSTV; AMMVGFFMIMLDSTVV; MMVGFFMIMLDSTVVA;
MVGFFMIMLDSTVVAI; VGFFMIMLDSTVVAIA; GFFMIMLDSTVVAIAN;
FFMIMLDSTVVAIANP; FMIMLDSTVVAIANPT; MIMLDSTVVAIANPTI;
IMLDSTVVAIANPTIM; MLDSTVVAIANPTIMA; LDSTVVAIANPTIMAQ;
DSTVVAIANPTIMAQL; STVVAIANPTIMAQLR; TVVAIANPTIMAQLRI;
VVAIANPTIMAQLRIG; VAIANPTIMAQLRIGY; AIANPTIMAQLRIGYA;
IANPTIMAQLRIGYAT; ANPTIMAQLRIGYATV; NPTIMAQLRIGYATVV;
PTIMAQLRIGYATVVW; TIMAQLRIGYATVVWV; IMAQLRIGYATVVWVT;
MAQLRIGYATVVWVTS; AQLRIGYATVVWVTSA; QLRIGYATVVWVTSAY;
LRIGYATVVWVTSAYL; RIGYATVVWVTSAYLL; IGYATVVWVTSAYLLA;
GYATVVWVTSAYLLAY; YATVVWVTSAYLLAYA; ATVVWVTSAYLLAYAV;
TVVWVTSAYLLAYAVP; VVWVTSAYLLAYAVPM; VWVTSAYLLAYAVPML;
WVTSAYLLAYAVPMLV; VTSAYLLAYAVPMLVA; TSAYLLAYAVPMLVAG;
SAYLLAYAVPMLVAGR; AYLLAYAVPMLVAGRL; YLLAYAVPMLVAGRLG;
LLAYAVPMLVAGRLGD; LAYAVPMLVAGRLGDR; AYAVPMLVAGRLGDRF;
YAVPMLVAGRLGDRFG; AVPMLVAGRLGDRFGP; VPMLVAGRLGDRFGPK;
PMLVAGRLGDRFGPKN; MLVAGRLGDRFGPKNL; LVAGRLGDRFGPKNLY;
VAGRLGDRFGPKNLYL; AGRLGDRFGPKNLYLI; GRLGDRFGPKNLYLIG;
RLGDRFGPKNLYLIGL; LGDRFGPKNLYLIGLG; GDRFGPKNLYLIGLGV;
DRFGPKNLYLIGLGVF; RFGPKNLYLIGLGVFT; FGPKNLYLIGLGVFTV;
GPKNLYLIGLGVFTVA; PKNLYLIGLGVFTVAS; KNLYLIGLGVFTVASL;
NLYLIGLGVFTVASLG; LYLIGLGVFTVASLGC; YLIGLGVFTVASLGCG;

Fig. 29 continued

| | | |
|---|---|---|
| | LIGLGVFTVASLGCGL; IGLGVFTVASLGCGLS; GLGVFTVASLGCGLSS; LGVFTVASLGCGLSSG; GVFTVASLGCGLSSGA; VFTVASLGCGLSSGAG; FTVASLGCGLSSGAGM; TVASLGCGLSSGAGML; VASLGCGLSSGAGMLI; ASLGCGLSSGAGMLIA; SLGCGLSSGAGMLIAA; LGCGLSSGAGMLIAAR; GCGLSSGAGMLIAARV; CGLSSGAGMLIAARVV; GLSSGAGMLIAARVVQ; LSSGAGMLIAARVVQG; SSGAGMLIAARVVQGV; SGAGMLIAARVVQGVG; GAGMLIAARVVQGVGA; AGMLIAARVVQGVGAG; GMLIAARVVQGVGAGL; MLIAARVVQGVGAGLL; LIAARVVQGVGAGLLT; IAARVVQGVGAGLLTP; AARVVQGVGAGLLTPQ; ARVVQGVGAGLLTPQT; RVVQGVGAGLLTPQTL; VVQGVGAGLLTPQTLS; VQGVGAGLLTPQTLST; QGVGAGLLTPQTLSTI; GVGAGLLTPQTLSTIT; VGAGLLTPQTLSTITR; GAGLLTPQTLSTITRI; AGLLTPQTLSTITRIF; GLLTPQTLSTITRIFP; LLTPQTLSTITRIFPA; LTPQTLSTITRIFPAH; TPQTLSTITRIFPAHR; PQTLSTITRIFPAHRR; QTLSTITRIFPAHRRG; TLSTITRIFPAHRRGV; LSTITRIFPAHRRGVA; STITRIFPAHRRGVAL; TITRIFPAHRRGVALG; ITRIFPAHRRGVALGA; TRIFPAHRRGVALGAW; RIFPAHRRGVALGAWG; IFPAHRRGVALGAWGT; FPAHRRGVALGAWGTV; PAHRRGVALGAWGTVA; AHRRGVALGAWGTVAS; HRRGVALGAWGTVASV; RRGVALGAWGTVASVA; RGVALGAWGTVASVAS; GVALGAWGTVASVASL; VALGAWGTVASVASLV; ALGAWGTVASVASLVG; LGAWGTVASVASLVGP; GAWGTVASVASLVGPL; AWGTVASVASLVGPLA; WGTVASVASLVGPLAG; GTVASVASLVGPLAGG; TVASVASLVGPLAGGA; VASVASLVGPLAGGAL; ASVASLVGPLAGGALV; SVASLVGPLAGGALVD; VASLVGPLAGGALVDS; ASLVGPLAGGALVDSM; SLVGPLAGGALVDSMG; LVGPLAGGALVDSMGW; VGPLAGGALVDSMGWE; GPLAGGALVDSMGWEW; PLAGGALVDSMGWEWI; LAGGALVDSMGWEWIF; AGGALVDSMGWEWIFF; GGALVDSMGWEWIFFV; GALVDSMGWEWIFFVN; ALVDSMGWEWIFFVNV; LVDSMGWEWIFFVNVP; VDSMGWEWIFFVNVPV; DSMGWEWIFFVNVPVG; SMGWEWIFFVNVPVGV; MGWEWIFFVNVPVGVI; GWEWIFFVNVPVGVIG; WEWIFFVNVPVGVIGL; EWIFFVNVPVGVIGLI; WIFFVNVPVGVIGLIL; IFFVNVPVGVIGLILA; FFVNVPVGVIGLILAA; FVNVPVGVIGLILAAY; VNVPVGVIGLILAAYL; NVPVGVIGLILAAYLI; VPVGVIGLILAAYLIP; PVGVIGLILAAYLIPA; VGVIGLILAAYLIPAL; GVIGLILAAYLIPALP; VIGLILAAYLIPALPH; IGLILAAYLIPALPHH; GLILAAYLIPALPHHP; LILAAYLIPALPHHPH; ILAAYLIPALPHHPHR; LAAYLIPALPHHPHRF; AAYLIPALPHHPHRFD; AYLIPALPHHPHRFDW; YLIPALPHHPHRFDWF; LIPALPHHPHRFDWFG; IPALPHHPHRFDWFGV; PALPHHPHRFDWFGVG; ALPHHPHRFDWFGVGL; LPHHPHRFDWFGVGLS; PHHPHRFDWFGVGLSG; HHPHRFDWFGVGLSGA; HPHRFDWFGVGLSGAG; PHRFDWFGVGLSGAGM; HRFDWFGVGLSGAGMF; RFDWFGVGLSGAGMFL; FDWFGVGLSGAGMFLI; DWFGVGLSGAGMFLIV; WFGVGLSGAGMFLIVF; FGVGLSGAGMFLIVFG; GVGLSGAGMFLIVFGL; VGLSGAGMFLIVFGLQ; GLSGAGMFLIVFGLQQ; LSGAGMFLIVFGLQQG; SGAGMFLIVFGLQQGQ; GAGMFLIVFGLQQGQS; AGMFLIVFGLQQGQSA; GMFLIVFGLQQGQSAN; MFLIVFGLQQGQSANW; FLIVFGLQQGQSANWQ; LIVFGLQQGQSANWQP; IVFGLQQGQSANWQPW; VFGLQQGQSANWQPWI; FGLQQGQSANWQPWIW; GLQQGQSANWQPWIWA; LQQGQSANWQPWIWAV; QQGQSANWQPWIWAVI; QGQSANWQPWIWAVIV; GQSANWQPWIWAVIVG; QSANWQPWIWAVIVGG; SANWQPWIWAVIVGGI; ANWQPWIWAVIVGGIG; NWQPWIWAVIVGGIGF; WQPWIWAVIVGGIGFM; QPWIWAVIVGGIGFMS; PWIWAVIVGGIGFMSL; WIWAVIVGGIGFMSLF; IWAVIVGGIGFMSLFV; WAVIVGGIGFMSLFVY; AVIVGGIGFMSLFVYW; VIVGGIGFMSLFVYWQ; IVGGIGFMSLFVYWQA; VGGIGFMSLFVYWQAR; GGIGFMSLFVYWQARN; GIGFMSLFVYWQARNA; IGFMSLFVYWQARNAR; GFMSLFVYWQARNARE; FMSLFVYWQARNAREP; MSLFVYWQARNAREPL; | |

Fig. 29 continued

| | | |
|---|---|---|
| | SLFVYWQARNAREPLI; LFVYWQARNAREPLIP; FVYWQARNAREPLIPL;<br>VYWQARNAREPLIPLE; YWQARNAREPLIPLEV; WQARNAREPLIPLEVF;<br>QARNAREPLIPLEVFN; ARNAREPLIPLEVFND; RNAREPLIPLEVFNDR;<br>NAREPLIPLEVFNDRN; AREPLIPLEVFNDRNF; REPLIPLEVFNDRNFS;<br>EPLIPLEVFNDRNFSL; PLIPLEVFNDRNFSLS; LIPLEVFNDRNFSLSN;<br>IPLEVFNDRNFSLSNL; PLEVFNDRNFSLSNLR; LEVFNDRNFSLSNLRI;<br>EVFNDRNFSLSNLRIA; VFNDRNFSLSNLRIAI; FNDRNFSLSNLRIAII;<br>NDRNFSLSNLRIAIIA; DRNFSLSNLRIAIIAF; RNFSLSNLRIAIIAFA;<br>NFSLSNLRIAIIAFAG; FSLSNLRIAIIAFAGT; SLSNLRIAIIAFAGTG;<br>LSNLRIAIIAFAGTGM; SNLRIAIIAFAGTGMM; NLRIAIIAFAGTGMML;<br>LRIAIIAFAGTGMMLP; RIAIIAFAGTGMMLPV; IAIIAFAGTGMMLPVT;<br>AIIAFAGTGMMLPVTF; IIAFAGTGMMLPVTFY; IAFAGTGMMLPVTFYA;<br>AFAGTGMMLPVTFYAQ; FAGTGMMLPVTFYAQA; AGTGMMLPVTFYAQAV;<br>GTGMMLPVTFYAQAVC; TGMMLPVTFYAQAVCG; GMMLPVTFYAQAVCGL;<br>MMLPVTFYAQAVCGLS; MLPVTFYAQAVCGLSP; LPVTFYAQAVCGLSPT;<br>PVTFYAQAVCGLSPTH; VTFYAQAVCGLSPTHT; TFYAQAVCGLSPTHTA;<br>FYAQAVCGLSPTHTAV; YAQAVCGLSPTHTAVL; AQAVCGLSPTHTAVLF;<br>QAVCGLSPTHTAVLFA; AVCGLSPTHTAVLFAP; VCGLSPTHTAVLFAPT;<br>CGLSPTHTAVLFAPTA; GLSPTHTAVLFAPTAI; LSPTHTAVLFAPTAIV;<br>SPTHTAVLFAPTAIVG; PTHTAVLFAPTAIVGG; THTAVLFAPTAIVGGV;<br>HTAVLFAPTAIVGGVL; TAVLFAPTAIVGGVLA; AVLFAPTAIVGGVLAP;<br>VLFAPTAIVGGVLAPF; LFAPTAIVGGVLAPFV; FAPTAIVGGVLAPFVG;<br>APTAIVGGVLAPFVGM; PTAIVGGVLAPFVGMI; TAIVGGVLAPFVGMII;<br>AIVGGVLAPFVGMIID; IVGGVLAPFVGMIIDR; VGGVLAPFVGMIIDRS;<br>GGVLAPFVGMIIDRSH; GVLAPFVGMIIDRSHP; VLAPFVGMIIDRSHPL;<br>LAPFVGMIIDRSHPLC; APFVGMIIDRSHPLCV; PFVGMIIDRSHPLCVL;<br>FVGMIIDRSHPLCVLG; VGMIIDRSHPLCVLGF; GMIIDRSHPLCVLGFG;<br>MIIDRSHPLCVLGFGF; IIDRSHPLCVLGFGFS; IDRSHPLCVLGFGFSV;<br>DRSHPLCVLGFGFSVL; RSHPLCVLGFGFSVLA; SHPLCVLGFGFSVLAI;<br>HPLCVLGFGFSVLAIA; PLCVLGFGFSVLAIAM; LCVLGFGFSVLAIAMT;<br>CVLGFGFSVLAIAMTW; VLGFGFSVLAIAMTWL; LGFGFSVLAIAMTWLL;<br>GFGFSVLAIAMTWLLC; FGFSVLAIAMTWLLCE; GFSVLAIAMTWLLCEM;<br>FSVLAIAMTWLLCEMA; SVLAIAMTWLLCEMAP; VLAIAMTWLLCEMAPG;<br>LAIAMTWLLCEMAPGT; AIAMTWLLCEMAPGTP; IAMTWLLCEMAPGTPI;<br>AMTWLLCEMAPGTPIW; MTWLLCEMAPGTPIWR; TWLLCEMAPGTPIWRL;<br>WLLCEMAPGTPIWRLV; LLCEMAPGTPIWRLVL; LCEMAPGTPIWRLVLP;<br>CEMAPGTPIWRLVLPF; EMAPGTPIWRLVLPFI; MAPGTPIWRLVLPFIA;<br>APGTPIWRLVLPFIAL; PGTPIWRLVLPFIALG; GTPIWRLVLPFIALGV;<br>TPIWRLVLPFIALGVA; PIWRLVLPFIALGVAG; IWRLVLPFIALGVAGA;<br>WRLVLPFIALGVAGAF; RLVLPFIALGVAGAFV; LVLPFIALGVAGAFVW;<br>VLPFIALGVAGAFVWS; LPFIALGVAGAFVWSP; PFIALGVAGAFVWSPL;<br>FIALGVAGAFVWSPLT; IALGVAGAFVWSPLTV; ALGVAGAFVWSPLTVT;<br>LGVAGAFVWSPLTVTA; GVAGAFVWSPLTVTAT; VAGAFVWSPLTVTATR;<br>AGAFVWSPLTVTATRN; GAFVWSPLTVTATRNL; AFVWSPLTVTATRNLR;<br>FVWSPLTVTATRNLRP; VWSPLTVTATRNLRPH; WSPLTVTATRNLRPHL;<br>SPLTVTATRNLRPHLA; PLTVTATRNLRPHLAG; LTVTATRNLRPHLAGA;<br>TVTATRNLRPHLAGAS; VTATRNLRPHLAGASS; TATRNLRPHLAGASSG;<br>ATRNLRPHLAGASSGV; TRNLRPHLAGASSGVF; RNLRPHLAGASSGVFN;<br>NLRPHLAGASSGVFNA; LRPHLAGASSGVFNAV; RPHLAGASSGVFNAVR;<br>PHLAGASSGVFNAVRQ; HLAGASSGVFNAVRQL; LAGASSGVFNAVRQLG;<br>AGASSGVFNAVRQLGA; GASSGVFNAVRQLGAV; ASSGVFNAVRQLGAVL;<br>SSGVFNAVRQLGAVLG; SGVFNAVRQLGAVLGS; GVFNAVRQLGAVLGSA;<br>VFNAVRQLGAVLGSAS; FNAVRQLGAVLGSASM; NAVRQLGAVLGSASMA; | |

Fig. 29 continued

| | | | |
|---|---|---|---|
| | AVRQLGAVLGSASMAA; VRQLGAVLGSASMAAF; RQLGAVLGSASMAAFM;<br>QLGAVLGSASMAAFMT; LGAVLGSASMAAFMTS; GAVLGSASMAAFMTSR;<br>AVLGSASMAAFMTSRI; VLGSASMAAFMTSRIA; LGSASMAAFMTSRIAA;<br>GSASMAAFMTSRIAAE; SASMAAFMTSRIAAEM; ASMAAFMTSRIAAEMP;<br>SMAAFMTSRIAAEMPG; MAAFMTSRIAAEMPGG; AAFMTSRIAAEMPGGV;<br>AFMTSRIAAEMPGGVD; FMTSRIAAEMPGGVDA; MTSRIAAEMPGGVDAL;<br>TSRIAAEMPGGVDALT; SRIAAEMPGGVDALTG; RIAAEMPGGVDALTGP;<br>IAAEMPGGVDALTGPA; AAEMPGGVDALTGPAG; AEMPGGVDALTGPAGQ;<br>EMPGGVDALTGPAGQD; MPGGVDALTGPAGQDA; PGGVDALTGPAGQDAT;<br>GGVDALTGPAGQDATV; GVDALTGPAGQDATVL; VDALTGPAGQDATVLQ;<br>DALTGPAGQDATVLQL; ALTGPAGQDATVLQLP; LTGPAGQDATVLQLPE;<br>TGPAGQDATVLQLPEF; GPAGQDATVLQLPEFV; PAGQDATVLQLPEFVR;<br>AGQDATVLQLPEFVRE; GQDATVLQLPEFVREP; QDATVLQLPEFVREPF;<br>DATVLQLPEFVREPFA; ATVLQLPEFVREPFAA; TVLQLPEFVREPFAAA;<br>VLQLPEFVREPFAAAM; LQLPEFVREPFAAAMS; QLPEFVREPFAAAMSQ;<br>LPEFVREPFAAAMSQS; PEFVREPFAAAMSQSM; EFVREPFAAAMSQSML;<br>FVREPFAAAMSQSMLL; VREPFAAAMSQSMLLP; REPFAAAMSQSMLLPA;<br>EPFAAAMSQSMLLPAF; PFAAAMSQSMLLPAFV; FAAAMSQSMLLPAFVA;<br>AAAMSQSMLLPAFVAL; AAMSQSMLLPAFVALF; AMSQSMLLPAFVALFG;<br>MSQSMLLPAFVALFGI; SQSMLLPAFVALFGIV; QSMLLPAFVALFGIVA;<br>SMLLPAFVALFGIVAA; MLLPAFVALFGIVAAL; LLPAFVALFGIVAALF;<br>LPAFVALFGIVAALFL; PAFVALFGIVAALFLV; AFVALFGIVAALFLVD;<br>FVALFGIVAALFLVDF; VALFGIVAALFLVDFT; ALFGIVAALFLVDFTG;<br>LFGIVAALFLVDFTGA; FGIVAALFLVDFTGAA; GIVAALFLVDFTGAAV;<br>IVAALFLVDFTGAAVA; VAALFLVDFTGAAVAK; AALFLVDFTGAAVAKE;<br>ALFLVDFTGAAVAKEP; LFLVDFTGAAVAKEPL; FLVDFTGAAVAKEPLP;<br>LVDFTGAAVAKEPLPE; VDFTGAAVAKEPLPES; DFTGAAVAKEPLPESD;<br>FTGAAVAKEPLPESDG; TGAAVAKEPLPESDGD; GAAVAKEPLPESDGDA;<br>AAVAKEPLPESDGDAD; AVAKEPLPESDGDADD; VAKEPLPESDGDADDD;<br>AKEPLPESDGDADDDD; KEPLPESDGDADDDDY; EPLPESDGDADDDDYV;<br>PLPESDGDADDDDYVE; LPESDGDADDDDYVEY; PESDGDADDDDYVEYI;<br>ESDGDADDDDYVEYIL; SDGDADDDDYVEYILR; DGDADDDDYVEYILRR;<br>GDADDDDYVEYILRRE; DADDDDYVEYILRREP; ADDDDYVEYILRREPE;<br>DDDDYVEYILRREPEE; DDDYVEYILRREPEED; DDYVEYILRREPEEDC;<br>DYVEYILRREPEEDCD; YVEYILRREPEEDCDT; VEYILRREPEEDCDTQ;<br>EYILRREPEEDCDTQP; YILRREPEEDCDTQPL; ILRREPEEDCDTQPLR;<br>LRREPEEDCDTQPLRA; RREPEEDCDTQPLRAS; REPEEDCDTQPLRASR;<br>EPEEDCDTQPLRASRP; PEEDCDTQPLRASRPA; EEDCDTQPLRASRPAA;<br>EDCDTQPLRASRPAAA; DCDTQPLRASRPAAAA; CDTQPLRASRPAAAAA;<br>DTQPLRASRPAAAAAS; TQPLRASRPAAAAASR; QPLRASRPAAAAASRS;<br>PLRASRPAAAAASRSG; LRASRPAAAAASRSGA; RASRPAAAAASRSGAG;<br>ASRPAAAAASRSGAGG; SRPAAAAASRSGAGGP; RPAAAAASRSGAGGPL;<br>PAAAAASRSGAGGPLA; AAAAASRSGAGGPLAV; AAAASRSGAGGPLAVS;<br>AAASRSGAGGPLAVSW; AASRSGAGGPLAVSWS; ASRSGAGGPLAVSWST;<br>SRSGAGGPLAVSWSTS; RSGAGGPLAVSWSTSA; SGAGGPLAVSWSTSAQ;<br>GAGGPLAVSWSTSAQG; AGGPLAVSWSTSAQGM; GGPLAVSWSTSAQGMP;<br>GPLAVSWSTSAQGMPP; PLAVSWSTSAQGMPPG; LAVSWSTSAQGMPPGP;<br>AVSWSTSAQGMPPGPP; VSWSTSAQGMPPGPPG; SWSTSAQGMPPGPPGR;<br>WSTSAQGMPPGPPGRR; STSAQGMPPGPPGRRA; TSAQGMPPGPPGRRAW;<br>SAQGMPPGPPGRRAWQ; AQGMPPGPPGRRAWQA; QGMPPGPPGRRAWQAD;<br>GMPPGPPGRRAWQADT; MPPGPPGRRAWQADTE; PPGPPGRRAWQADTES;<br>PGPPGRRAWQADTEST; GPPGRRAWQADTESTA; PPGRRAWQADTESTAP;<br>PGRRAWQADTESTAPS; GRRAWQADTESTAPSA; RRAWQADTESTAPSAL | | |

Fig. 29 continued

| | | |
|---|---|---|
| 21) Rv1284 | 13 mers:<br>MTVTDDYLANNVD; TVTDDYLANNVDY; VTDDYLANNVDYA; TDDYLANNVDYAS; DDYLANNVDYASG; DYLANNVDYASGF; YLANNVDYASGFK; LANNVDYASGFKG; ANNVDYASGFKGP; NNVDYASGFKGPL; NVDYASGFKGPLP; VDYASGFKGPLPM; DYASGFKGPLPMP; YASGFKGPLPMPP; ASGFKGPLPMPPS; SGFKGPLPMPPSK; GFKGPLPMPPSKH; FKGPLPMPPSKHI; KGPLPMPPSKHIA; GPLPMPPSKHIAI; PLPMPPSKHIAIV; LPMPPSKHIAIVA; PMPPSKHIAIVAC; MPPSKHIAIVACM; PPSKHIAIVACMD; PSKHIAIVACMDA; SKHIAIVACMDAR; KHIAIVACMDARL; HIAIVACMDARLD; IAIVACMDARLDV; AIVACMDARLDVY; IVACMDARLDVYR; VACMDARLDVYRM; ACMDARLDVYRML; CMDARLDVYRMLG; MDARLDVYRMLGI; DARLDVYRMLGIK; ARLDVYRMLGIKE; RLDVYRMLGIKEG; LDVYRMLGIKEGE; DVYRMLGIKEGEA; VYRMLGIKEGEAH; YRMLGIKEGEAHV; RMLGIKEGEAHVI; MLGIKEGEAHVIR; LGIKEGEAHVIRN; GIKEGEAHVIRNA; IKEGEAHVIRNAG; KEGEAHVIRNAGC; EGEAHVIRNAGCV; GEAHVIRNAGCVV; EAHVIRNAGCVVT; AHVIRNAGCVVTD; HVIRNAGCVVTDD; VIRNAGCVVTDDV; IRNAGCVVTDDVI; RNAGCVVTDDVIR; NAGCVVTDDVIRS; AGCVVTDDVIRSL; GCVVTDDVIRSLA; CVVTDDVIRSLAI; VVTDDVIRSLAIS; VTDDVIRSLAISQ; TDDVIRSLAISQR; DDVIRSLAISQRL; DVIRSLAISQRLL; VIRSLAISQRLLG; IRSLAISQRLLGT; RSLAISQRLLGTR; SLAISQRLLGTRE; LAISQRLLGTREI; AISQRLLGTREII; ISQRLLGTREIIL; SQRLLGTREIILL; QRLLGTREIILLH; RLLGTREIILLHH; LLGTREIILLHHT; LGTREIILLHHTD; GTREIILLHHTDC; TREIILLHHTDCG; REIILLHHTDCGM; EIILLHHTDCGML; IILLHHTDCGMLT; ILLHHTDCGMLTF; LLHHTDCGMLTFT; LHHTDCGMLTFTD; HHTDCGMLTFTDD; HTDCGMLTFTDDD; TDCGMLTFTDDDF; DCGMLTFTDDDFK; CGMLTFTDDDFKR; GMLTFTDDDFKRA; MLTFTDDDFKRAI; LTFTDDDFKRAIQ; TFTDDDFKRAIQD; FTDDDFKRAIQDE; TDDDFKRAIQDET; DDDFKRAIQDETG; DDFKRAIQDETGI; DFKRAIQDETGIR; FKRAIQDETGIRP; KRAIQDETGIRPT; RAIQDETGIRPTW; AIQDETGIRPTWS; IQDETGIRPTWSP; QDETGIRPTWSPE; DETGIRPTWSPES; ETGIRPTWSPESY; TGIRPTWSPESYP; GIRPTWSPESYPD; IRPTWSPESYPDA; RPTWSPESYPDAV; PTWSPESYPDAVE; TWSPESYPDAVED; WSPESYPDAVEDV; SPESYPDAVEDVR; PESYPDAVEDVRQ; ESYPDAVEDVRQS; SYPDAVEDVRQSL; YPDAVEDVRQSLR; PDAVEDVRQSLRR; DAVEDVRQSLRRI; AVEDVRQSLRRIE; VEDVRQSLRRIEV; EDVRQSLRRIEVN; DVRQSLRRIEVNP; VRQSLRRIEVNPF; RQSLRRIEVNPFV; QSLRRIEVNPFVT; SLRRIEVNPFVTK; LRRIEVNPFVTKH; RRIEVNPFVTKHT; RIEVNPFVTKHTS; IEVNPFVTKHTSL; EVNPFVTKHTSLR; VNPFVTKHTSLRG; NPFVTKHTSLRGF; PFVTKHTSLRGFV; FVTKHTSLRGFVF; VTKHTSLRGFVFD; TKHTSLRGFVFDV; KHTSLRGFVFDVA; HTSLRGFVFDVAT; TSLRGFVFDVATG; SLRGFVFDVATGK; LRGFVFDVATGKL; RGFVFDVATGKLN; GFVFDVATGKLNE; FVFDVATGKLNEV; VFDVATGKLNEVT; FDVATGKLNEVTP;<br><br>14 mers:<br>MTVTDDYLANNVDY; TVTDDYLANNVDYA; VTDDYLANNVDYAS; TDDYLANNVDYASG; DDYLANNVDYASGF; DYLANNVDYASGFK; YLANNVDYASGFKG; LANNVDYASGFKGP; ANNVDYASGFKGPL; NNVDYASGFKGPLP; NVDYASGFKGPLPM; VDYASGFKGPLPMP; DYASGFKGPLPMPP; YASGFKGPLPMPPS; ASGFKGPLPMPPSK; SGFKGPLPMPPSKH; GFKGPLPMPPSKHI; FKGPLPMPPSKHIA; KGPLPMPPSKHIAI; GPLPMPPSKHIAIV; PLPMPPSKHIAIVA; LPMPPSKHIAIVAC; PMPPSKHIAIVACM; MPPSKHIAIVACMD; PPSKHIAIVACMDA; PSKHIAIVACMDAR; SKHIAIVACMDARL; KHIAIVACMDARLD; HIAIVACMDARLDV; IAIVACMDARLDVY; AIVACMDARLDVYR; | 75955-76552 |

Fig. 29 continued

IVACMDARLDVYRM; VACMDARLDVYRML; ACMDARLDVYRMLG;
CMDARLDVYRMLGI; MDARLDVYRMLGIK; DARLDVYRMLGIKE;
ARLDVYRMLGIKEG; RLDVYRMLGIKEGE; LDVYRMLGIKEGEA;
DVYRMLGIKEGEAH; VYRMLGIKEGEAHV; YRMLGIKEGEAHVI;
RMLGIKEGEAHVIR; MLGIKEGEAHVIRN; LGIKEGEAHVIRNA;
GIKEGEAHVIRNAG; IKEGEAHVIRNAGC; KEGEAHVIRNAGCV;
EGEAHVIRNAGCVV; GEAHVIRNAGCVVT; EAHVIRNAGCVVTD;
AHVIRNAGCVVTDD; HVIRNAGCVVTDDV; VIRNAGCVVTDDVI;
IRNAGCVVTDDVIR; RNAGCVVTDDVIRS; NAGCVVTDDVIRSL;
AGCVVTDDVIRSLA; GCVVTDDVIRSLAI; CVVTDDVIRSLAIS; VVTDDVIRSLAISQ;
VTDDVIRSLAISQR; TDDVIRSLAISQRL; DDVIRSLAISQRLL; DVIRSLAISQRLLG;
VIRSLAISQRLLGT; IRSLAISQRLLGTR; RSLAISQRLLGTRE; SLAISQRLLGTREI;
LAISQRLLGTREII; AISQRLLGTREIIL; ISQRLLGTREIILL; SQRLLGTREIILLH;
QRLLGTREIILLHH; RLLGTREIILLHHT; LLGTREIILLHHTD; LGTREIILLHHTDC;
GTREIILLHHTDCG; TREIILLHHTDCGM; REIILLHHTDCGML; EIILLHHTDCGMLT;
IILLHHTDCGMLTF; ILLHHTDCGMLTFT; LLHHTDCGMLTFTD;
LHHTDCGMLTFTDD; HHTDCGMLTFTDDD; HTDCGMLTFTDDDF;
TDCGMLTFTDDDFK; DCGMLTFTDDDFKR; CGMLTFTDDDFKRA;
GMLTFTDDDFKRAI; MLTFTDDDFKRAIQ; LTFTDDDFKRAIQD;
TFTDDDFKRAIQDE; FTDDDFKRAIQDET; TDDDFKRAIQDETG;
DDDFKRAIQDETGI; DDFKRAIQDETGIR; DFKRAIQDETGIRP;
FKRAIQDETGIRPT; KRAIQDETGIRPTW; RAIQDETGIRPTWS;
AIQDETGIRPTWSP; IQDETGIRPTWSPE; QDETGIRPTWSPES;
DETGIRPTWSPESY; ETGIRPTWSPESYP; TGIRPTWSPESYPD;
GIRPTWSPESYPDA; IRPTWSPESYPDAV; RPTWSPESYPDAVE;
PTWSPESYPDAVED; TWSPESYPDAVEDV; WSPESYPDAVEDVR;
SPESYPDAVEDVRQ; PESYPDAVEDVRQS; ESYPDAVEDVRQSL;
SYPDAVEDVRQSLR; YPDAVEDVRQSLRR; PDAVEDVRQSLRRI;
DAVEDVRQSLRRIE; AVEDVRQSLRRIEV; VEDVRQSLRRIEVN;
EDVRQSLRRIEVNP; DVRQSLRRIEVNPF; VRQSLRRIEVNPFV;
RQSLRRIEVNPFVT; QSLRRIEVNPFVTK; SLRRIEVNPFVTKH;
LRRIEVNPFVTKHT; RRIEVNPFVTKHTS; RIEVNPFVTKHTSL;
IEVNPFVTKHTSLR; EVNPFVTKHTSLRG; VNPFVTKHTSLRGF;
NPFVTKHTSLRGFV; PFVTKHTSLRGFVF; FVTKHTSLRGFVFD;
VTKHTSLRGFVFDV; TKHTSLRGFVFDVA; KHTSLRGFVFDVAT;
HTSLRGFVFDVATG; TSLRGFVFDVATGK; SLRGFVFDVATGKL;
LRGFVFDVATGKLN; RGFVFDVATGKLNE; GFVFDVATGKLNEV;
FVFDVATGKLNEVT; VFDVATGKLNEVTP 15 mers:
MTVTDDYLANNVDYA; TVTDDYLANNVDYAS; VTDDYLANNVDYASG;
TDDYLANNVDYASGF; DDYLANNVDYASGFK; DYLANNVDYASGFKG;
YLANNVDYASGFKGP; LANNVDYASGFKGPL; ANNVDYASGFKGPLP;
NNVDYASGFKGPLPM; NVDYASGFKGPLPMP; VDYASGFKGPLPMPP;
DYASGFKGPLPMPPS; YASGFKGPLPMPPSK; ASGFKGPLPMPPSKH;
SGFKGPLPMPPSKHI; GFKGPLPMPPSKHIA; FKGPLPMPPSKHIAI;
KGPLPMPPSKHIAIV; GPLPMPPSKHIAIVA; PLPMPPSKHIAIVAC;
LPMPPSKHIAIVACM; PMPPSKHIAIVACMD; MPPSKHIAIVACMDA;
PPSKHIAIVACMDAR; PSKHIAIVACMDARL; SKHIAIVACMDARLD;
KHIAIVACMDARLDV; HIAIVACMDARLDVY; IAIVACMDARLDVYR;
AIVACMDARLDVYRM; IVACMDARLDVYRML; VACMDARLDVYRMLG;
ACMDARLDVYRMLGI; CMDARLDVYRMLGIK; MDARLDVYRMLGIKE;
DARLDVYRMLGIKEG; ARLDVYRMLGIKEGE; RLDVYRMLGIKEGEA;

Fig. 29 continued

| | | | |
|---|---|---|---|
| | LDVYRMLGIKEGEAH; DVYRMLGIKEGEAHV; VYRMLGIKEGEAHVI; YRMLGIKEGEAHVIR; RMLGIKEGEAHVIRN; MLGIKEGEAHVIRNA; LGIKEGEAHVIRNAG; GIKEGEAHVIRNAGC; IKEGEAHVIRNAGCV; KEGEAHVIRNAGCVV; EGEAHVIRNAGCVVT; GEAHVIRNAGCVVTD; EAHVIRNAGCVVTDD; AHVIRNAGCVVTDDV; HVIRNAGCVVTDDVI; VIRNAGCVVTDDVIR; IRNAGCVVTDDVIRS; RNAGCVVTDDVIRSL; NAGCVVTDDVIRSLA; AGCVVTDDVIRSLAI; GCVVTDDVIRSLAIS; CVVTDDVIRSLAISQ; VVTDDVIRSLAISQR; VTDDVIRSLAISQRL; TDDVIRSLAISQRLL; DDVIRSLAISQRLLG; DVIRSLAISQRLLGT; VIRSLAISQRLLGTR; IRSLAISQRLLGTRE; RSLAISQRLLGTREI; SLAISQRLLGTREII; LAISQRLLGTREIIL; AISQRLLGTREIILL; ISQRLLGTREIILLH; SQRLLGTREIILLHH; QRLLGTREIILLHHT; RLLGTREIILLHHTD; LLGTREIILLHHTDC; LGTREIILLHHTDCG; GTREIILLHHTDCGM; TREIILLHHTDCGML; REIILLHHTDCGMLT; EIILLHHTDCGMLTF; IILLHHTDCGMLTFT; ILLHHTDCGMLTFTD; LLHHTDCGMLTFTDD; LHHTDCGMLTFTDDD; HHTDCGMLTFTDDDF; HTDCGMLTFTDDDFK; TDCGMLTFTDDDFKR; DCGMLTFTDDDFKRA; CGMLTFTDDDFKRAI; GMLTFTDDDFKRAIQ; MLTFTDDDFKRAIQD; LTFTDDDFKRAIQDE; TFTDDDFKRAIQDET; FTDDDFKRAIQDETG; TDDDFKRAIQDETGI; DDDFKRAIQDETGIR; DDFKRAIQDETGIRP; DFKRAIQDETGIRPT; FKRAIQDETGIRPTW; KRAIQDETGIRPTWS; RAIQDETGIRPTWSP; AIQDETGIRPTWSPE; IQDETGIRPTWSPES; QDETGIRPTWSPESY; DETGIRPTWSPESYP; ETGIRPTWSPESYPD; TGIRPTWSPESYPDA; GIRPTWSPESYPDAV; IRPTWSPESYPDAVE; RPTWSPESYPDAVED; PTWSPESYPDAVEDV; TWSPESYPDAVEDVR; WSPESYPDAVEDVRQ; SPESYPDAVEDVRQS; PESYPDAVEDVRQSL; ESYPDAVEDVRQSLR; SYPDAVEDVRQSLRR; YPDAVEDVRQSLRRI; PDAVEDVRQSLRRIE; DAVEDVRQSLRRIEV; AVEDVRQSLRRIEVN; VEDVRQSLRRIEVNP; EDVRQSLRRIEVNPF; DVRQSLRRIEVNPFV; VRQSLRRIEVNPFVT; RQSLRRIEVNPFVTK; QSLRRIEVNPFVTKH; SLRRIEVNPFVTKHT; LRRIEVNPFVTKHTS; RRIEVNPFVTKHTSL; RIEVNPFVTKHTSLR; IEVNPFVTKHTSLRG; EVNPFVTKHTSLRGF; VNPFVTKHTSLRGFV; NPFVTKHTSLRGFVF; PFVTKHTSLRGFVFD; FVTKHTSLRGFVFDV; VTKHTSLRGFVFDVA; TKHTSLRGFVFDVAT; KHTSLRGFVFDVATG; HTSLRGFVFDVATGK; TSLRGFVFDVATGKL; SLRGFVFDVATGKLN; LRGFVFDVATGKLNE; RGFVFDVATGKLNEV; GFVFDVATGKLNEVT; FVFDVATGKLNEVTP<br><br>16 mers:<br>MTVTDDYLANNVDYAS; TVTDDYLANNVDYASG; VTDDYLANNVDYASGF; TDDYLANNVDYASGFK; DDYLANNVDYASGFKG; DYLANNVDYASGFKGP; YLANNVDYASGFKGPL; LANNVDYASGFKGPLP; ANNVDYASGFKGPLPM; NNVDYASGFKGPLPMP; NVDYASGFKGPLPMPP; VDYASGFKGPLPMPPS; DYASGFKGPLPMPPSK; YASGFKGPLPMPPSKH; ASGFKGPLPMPPSKHI; SGFKGPLPMPPSKHIA; GFKGPLPMPPSKHIAI; FKGPLPMPPSKHIAIV; KGPLPMPPSKHIAIVA; GPLPMPPSKHIAIVAC; PLPMPPSKHIAIVACM; LPMPPSKHIAIVACMD; PMPPSKHIAIVACMDA; MPPSKHIAIVACMDAR; PPSKHIAIVACMDARL; PSKHIAIVACMDARLD; SKHIAIVACMDARLDV; KHIAIVACMDARLDVY; HIAIVACMDARLDVYR; IAIVACMDARLDVYRM; AIVACMDARLDVYRML; IVACMDARLDVYRMLG; VACMDARLDVYRMLGI; ACMDARLDVYRMLGIK; CMDARLDVYRMLGIKE; MDARLDVYRMLGIKEG; DARLDVYRMLGIKEGE; ARLDVYRMLGIKEGEA; RLDVYRMLGIKEGEAH; LDVYRMLGIKEGEAHV; DVYRMLGIKEGEAHVI; VYRMLGIKEGEAHVIR; | |

Fig. 29 continued

| | | |
|---|---|---|
| | YRMLGIKEGEAHVIRN; RMLGIKEGEAHVIRNA; MLGIKEGEAHVIRNAG; LGIKEGEAHVIRNAGC; GIKEGEAHVIRNAGCV; IKEGEAHVIRNAGCVV; KEGEAHVIRNAGCVVT; EGEAHVIRNAGCVVTD; GEAHVIRNAGCVVTDD; EAHVIRNAGCVVTDDV; AHVIRNAGCVVTDDVI; HVIRNAGCVVTDDVIR; VIRNAGCVVTDDVIRS; IRNAGCVVTDDVIRSL; RNAGCVVTDDVIRSLA; NAGCVVTDDVIRSLAI; AGCVVTDDVIRSLAIS; GCVVTDDVIRSLAISQ; CVVTDDVIRSLAISQR; VVTDDVIRSLAISQRL; VTDDVIRSLAISQRLL; TDDVIRSLAISQRLLG; DDVIRSLAISQRLLGT; DVIRSLAISQRLLGTR; VIRSLAISQRLLGTRE; IRSLAISQRLLGTREI; RSLAISQRLLGTREII; SLAISQRLLGTREIIL; LAISQRLLGTREIILL; AISQRLLGTREIILLH; ISQRLLGTREIILLHH; SQRLLGTREIILLHHT; QRLLGTREIILLHHTD; RLLGTREIILLHHTDC; LLGTREIILLHHTDCG; LGTREIILLHHTDCGM; GTREIILLHHTDCGML; TREIILLHHTDCGMLT; REIILLHHTDCGMLTF; EIILLHHTDCGMLTFT; IILLHHTDCGMLTFTD; ILLHHTDCGMLTFTDD; LLHHTDCGMLTFTDDD; LHHTDCGMLTFTDDDF; HHTDCGMLTFTDDDFK; HTDCGMLTFTDDDFKR; TDCGMLTFTDDDFKRA; DCGMLTFTDDDFKRAI; CGMLTFTDDDFKRAIQ; GMLTFTDDDFKRAIQD; MLTFTDDDFKRAIQDE; LTFTDDDFKRAIQDET; TFTDDDFKRAIQDETG; FTDDDFKRAIQDETGI; TDDDFKRAIQDETGIR; DDDFKRAIQDETGIRP; DDFKRAIQDETGIRPT; DFKRAIQDETGIRPTW; FKRAIQDETGIRPTWS; KRAIQDETGIRPTWSP; RAIQDETGIRPTWSPE; AIQDETGIRPTWSPES; IQDETGIRPTWSPESY; QDETGIRPTWSPESYP; DETGIRPTWSPESYPD; ETGIRPTWSPESYPDA; TGIRPTWSPESYPDAV; GIRPTWSPESYPDAVE; IRPTWSPESYPDAVED; RPTWSPESYPDAVEDV; PTWSPESYPDAVEDVR; TWSPESYPDAVEDVRQ; WSPESYPDAVEDVRQS; SPESYPDAVEDVRQSL; PESYPDAVEDVRQSLR; ESYPDAVEDVRQSLRR; SYPDAVEDVRQSLRRI; YPDAVEDVRQSLRRIE; PDAVEDVRQSLRRIEV; DAVEDVRQSLRRIEVN; AVEDVRQSLRRIEVNP; VEDVRQSLRRIEVNPF; EDVRQSLRRIEVNPFV; DVRQSLRRIEVNPFVT; VRQSLRRIEVNPFVTK; RQSLRRIEVNPFVTKH; QSLRRIEVNPFVTKHT; SLRRIEVNPFVTKHTS; LRRIEVNPFVTKHTSL; RRIEVNPFVTKHTSLR; RIEVNPFVTKHTSLRG; IEVNPFVTKHTSLRGF; EVNPFVTKHTSLRGFV; VNPFVTKHTSLRGFVF; NPFVTKHTSLRGFVFD; PFVTKHTSLRGFVFDV; FVTKHTSLRGFVFDVA; VTKHTSLRGFVFDVAT; TKHTSLRGFVFDVATG; KHTSLRGFVFDVATGK; HTSLRGFVFDVATGKL; TSLRGFVFDVATGKLN; SLRGFVFDVATGKLNE; LRGFVFDVATGKLNEV; RGFVFDVATGKLNEVT; GFVFDVATGKLNEVTP | |
| 22) Rv1386 | 13 mers: MTLRVVPESLAGA; TLRVVPESLAGAS; LRVVPESLAGASA; RVVPESLAGASAA; VVPESLAGASAAI; VPESLAGASAAIE; PESLAGASAAIEA; ESLAGASAAIEAV; SLAGASAAIEAVT; LAGASAAIEAVTA; AGASAAIEAVTAR; GASAAIEAVTARL; ASAAIEAVTARLA; SAAIEAVTARLAA; AAIEAVTARLAAA; AIEAVTARLAAAH; IEAVTARLAAAHA; EAVTARLAAAHAA; AVTARLAAAHAAA; VTARLAAAHAAAA; TARLAAAHAAAAP; ARLAAAHAAAAPF; RLAAAHAAAAPFI; LAAAHAAAAPFIA; AAAHAAAAPFIAA; AAHAAAAPFIAAV; AHAAAAPFIAAVI; HAAAAPFIAAVIP; AAAAPFIAAVIPP; AAAPFIAAVIPPG; AAPFIAAVIPPGS; APFIAAVIPPGSD; PFIAAVIPPGSDS; FIAAVIPPGSDSV; IAAVIPPGSDSVS; AAVIPPGSDSVSV; AVIPPGSDSVSVC; VIPPGSDSVSVCN; IPPGSDSVSVCNA; PPGSDSVSVCNAV; PGSDSVSVCNAVE; GSDSVSVCNAVEF; SDSVSVCNAVEFS; DSVSVCNAVEFSV; SVSVCNAVEFSVH; VSVCNAVEFSVHG; SVCNAVEFSVHGS; VCNAVEFSVHGSQ; CNAVEFSVHGSQH; NAVEFSVHGSQHV; AVEFSVHGSQHVA; VEFSVHGSQHVAM; EFSVHGSQHVAMA; FSVHGSQHVAMAA; SVHGSQHVAMAAQ; VHGSQHVAMAAQG; | 76553-76906 |

Fig. 29 continued

| | | | |
|---|---|---|---|
| | HGSQHVAMAAQGV; GSQHVAMAAQGVE; SQHVAMAAQGVEE; QHVAMAAQGVEEL; HVAMAAQGVEELG; VAMAAQGVEELGR; AMAAQGVEELGRS; MAAQGVEELGRSG; AAQGVEELGRSGV; AQGVEELGRSGVG; QGVEELGRSGVGV; GVEELGRSGVGVA; VEELGRSGVGVAE; EELGRSGVGVAES; ELGRSGVGVAESG; LGRSGVGVAESGA; GRSGVGVAESGAS; RSGVGVAESGASY; SGVGVAESGASYA; GVGVAESGASYAA; VGVAESGASYAAR; GVAESGASYAARD; VAESGASYAARDA; AESGASYAARDAL; ESGASYAARDALA; SGASYAARDALAA; GASYAARDALAAA; ASYAARDALAAAS; SYAARDALAAASY; YAARDALAAASYL; AARDALAAASYLS; ARDALAAASYLSG; RDALAAASYLSGG; DALAAASYLSGGL;<br><br>14 mers:<br>MTLRVVPESLAGAS; TLRVVPESLAGASA; LRVVPESLAGASAA; RVVPESLAGASAAI; VVPESLAGASAAIE; VPESLAGASAAIEA; PESLAGASAAIEAV; ESLAGASAAIEAVT; SLAGASAAIEAVTA; LAGASAAIEAVTAR; AGASAAIEAVTARL; GASAAIEAVTARLA; ASAAIEAVTARLAA; SAAIEAVTARLAAA; AAIEAVTARLAAAH; AIEAVTARLAAAHA; IEAVTARLAAAHAA; EAVTARLAAAHAAA; AVTARLAAAHAAAA; VTARLAAAHAAAAP; TARLAAAHAAAAPF; ARLAAAHAAAAPFI; RLAAAHAAAAPFIA; LAAAHAAAAPFIAA; AAAHAAAAPFIAAV; AAHAAAAPFIAAVI; AHAAAAPFIAAVIP; HAAAAPFIAAVIPP; AAAAPFIAAVIPPG; AAAPFIAAVIPPGS; AAPFIAAVIPPGSD; APFIAAVIPPGSDS; PFIAAVIPPGSDSV; FIAAVIPPGSDSVS; IAAVIPPGSDSVSV; AAVIPPGSDSVSVC; AVIPPGSDSVSVCN; VIPPGSDSVSVCNA; IPPGSDSVSVCNAV; PPGSDSVSVCNAVE; PGSDSVSVCNAVEF; GSDSVSVCNAVEFS; SDSVSVCNAVEFSV; DSVSVCNAVEFSVH; SVSVCNAVEFSVHG; VSVCNAVEFSVHGS; SVCNAVEFSVHGSQ; VCNAVEFSVHGSQH; CNAVEFSVHGSQHV; NAVEFSVHGSQHVA; AVEFSVHGSQHVAM; VEFSVHGSQHVAMA; EFSVHGSQHVAMAA; FSVHGSQHVAMAAQ; SVHGSQHVAMAAQG; VHGSQHVAMAAQGV; HGSQHVAMAAQGVE; GSQHVAMAAQGVEE; SQHVAMAAQGVEEL; QHVAMAAQGVEELG; HVAMAAQGVEELGR; VAMAAQGVEELGRS; AMAAQGVEELGRSG; MAAQGVEELGRSGV; AAQGVEELGRSGVG; AQGVEELGRSGVGV; QGVEELGRSGVGVA; GVEELGRSGVGVAE; VEELGRSGVGVAES; EELGRSGVGVAESG; ELGRSGVGVAESGA; LGRSGVGVAESGAS; GRSGVGVAESGASY; RSGVGVAESGASYA; SGVGVAESGASYAA; GVGVAESGASYAAR; VGVAESGASYAARD; GVAESGASYAARDA; VAESGASYAARDAL; AESGASYAARDALA; ESGASYAARDALAA; SGASYAARDALAAA; GASYAARDALAAAS; ASYAARDALAAASY; SYAARDALAAASYL; YAARDALAAASYLS; AARDALAAASYLSG; ARDALAAASYLSGG; RDALAAASYLSGGL;<br><br>15 mers:<br>MTLRVVPESLAGASA; TLRVVPESLAGASAA; LRVVPESLAGASAAI; RVVPESLAGASAAIE; VVPESLAGASAAIEA; VPESLAGASAAIEAV; PESLAGASAAIEAVT; ESLAGASAAIEAVTA; SLAGASAAIEAVTAR; LAGASAAIEAVTARL; AGASAAIEAVTARLA; GASAAIEAVTARLAA; ASAAIEAVTARLAAA; SAAIEAVTARLAAAH; AAIEAVTARLAAAHA; AIEAVTARLAAAHAA; IEAVTARLAAAHAAA; EAVTARLAAAHAAAA; AVTARLAAAHAAAAP; VTARLAAAHAAAAPF; TARLAAAHAAAAPFI; ARLAAAHAAAAPFIA; RLAAAHAAAAPFIAA; LAAAHAAAAPFIAAV; AAAHAAAAPFIAAVI; AAHAAAAPFIAAVIP; AHAAAAPFIAAVIPP; | |

Fig. 29 continued

| | | |
|---|---|---|
| | HAAAAPFIAAVIPPG; AAAAPFIAAVIPPGS; AAAPFIAAVIPPGSD; AAPFIAAVIPPGSDS; APFIAAVIPPGSDSV; PFIAAVIPPGSDSVS; FIAAVIPPGSDSVSV; IAAVIPPGSDSVSVC; AAVIPPGSDSVSVCN; AVIPPGSDSVSVCNA; VIPPGSDSVSVCNAV; IPPGSDSVSVCNAVE; PPGSDSVSVCNAVEF; PGSDSVSVCNAVEFS; GSDSVSVCNAVEFSV; SDSVSVCNAVEFSVH; DSVSVCNAVEFSVHG; SVSVCNAVEFSVHGS; VSVCNAVEFSVHGSQ; SVCNAVEFSVHGSQH; VCNAVEFSVHGSQHV; CNAVEFSVHGSQHVA; NAVEFSVHGSQHVAM; AVEFSVHGSQHVAMA; VEFSVHGSQHVAMAA; EFSVHGSQHVAMAAQ; FSVHGSQHVAMAAQG; SVHGSQHVAMAAQGV; VHGSQHVAMAAQGVE; HGSQHVAMAAQGVEE; GSQHVAMAAQGVEEL; SQHVAMAAQGVEELG; QHVAMAAQGVEELGR; HVAMAAQGVEELGRS; VAMAAQGVEELGRSG; AMAAQGVEELGRSGV; MAAQGVEELGRSGVG; AAQGVEELGRSGVGV; AQGVEELGRSGVGVA; QGVEELGRSGVGVAE; GVEELGRSGVGVAES; VEELGRSGVGVAESG; EELGRSGVGVAESGA; ELGRSGVGVAESGAS; LGRSGVGVAESGASY; GRSGVGVAESGASYA; RSGVGVAESGASYAA; SGVGVAESGASYAAR; GVGVAESGASYAARD; VGVAESGASYAARDA; GVAESGASYAARDAL; VAESGASYAARDALA; AESGASYAARDALAA; ESGASYAARDALAAA; SGASYAARDALAAAS; GASYAARDALAAASY; ASYAARDALAAASYL; SYAARDALAAASYLS; YAARDALAAASYLSG; AARDALAAASYLSGG; ARDALAAASYLSGGL;<br><br>16 mers:<br>MTLRVVPESLAGASAA; TLRVVPESLAGASAAI; LRVVPESLAGASAAIE; RVVPESLAGASAAIEA; VVPESLAGASAAIEAV; VPESLAGASAAIEAVT; PESLAGASAAIEAVTA; ESLAGASAAIEAVTAR; SLAGASAAIEAVTARL; LAGASAAIEAVTARLA; AGASAAIEAVTARLAA; GASAAIEAVTARLAAA; ASAAIEAVTARLAAAH; SAAIEAVTARLAAAHA; AAIEAVTARLAAAHAA; AIEAVTARLAAAHAAA; IEAVTARLAAAHAAAA; EAVTARLAAAHAAAAP; AVTARLAAAHAAAAPF; VTARLAAAHAAAAPFI; TARLAAAHAAAAPFIA; ARLAAAHAAAAPFIAA; RLAAAHAAAAPFIAAV; LAAAHAAAAPFIAAVI; AAAHAAAAPFIAAVIP; AAHAAAAPFIAAVIPP; AHAAAAPFIAAVIPPG; HAAAAPFIAAVIPPGS; AAAAPFIAAVIPPGSD; AAAPFIAAVIPPGSDS; AAPFIAAVIPPGSDSV; APFIAAVIPPGSDSVS; PFIAAVIPPGSDSVSV; FIAAVIPPGSDSVSVC; IAAVIPPGSDSVSVCN; AAVIPPGSDSVSVCNA; AVIPPGSDSVSVCNAV; VIPPGSDSVSVCNAVE; IPPGSDSVSVCNAVEF; PPGSDSVSVCNAVEFS; PGSDSVSVCNAVEFSV; GSDSVSVCNAVEFSVH; SDSVSVCNAVEFSVHG; DSVSVCNAVEFSVHGS; SVSVCNAVEFSVHGSQ; VSVCNAVEFSVHGSQH; SVCNAVEFSVHGSQHV; VCNAVEFSVHGSQHVA; CNAVEFSVHGSQHVAM; NAVEFSVHGSQHVAMA; AVEFSVHGSQHVAMAA; VEFSVHGSQHVAMAAQ; EFSVHGSQHVAMAAQG; FSVHGSQHVAMAAQGV; SVHGSQHVAMAAQGVE; VHGSQHVAMAAQGVEE; HGSQHVAMAAQGVEEL; GSQHVAMAAQGVEELG; SQHVAMAAQGVEELGR; QHVAMAAQGVEELGRS; HVAMAAQGVEELGRSG; VAMAAQGVEELGRSGV; AMAAQGVEELGRSGVG; MAAQGVEELGRSGVGV; AAQGVEELGRSGVGVA; AQGVEELGRSGVGVAE; QGVEELGRSGVGVAES; GVEELGRSGVGVAESG; VEELGRSGVGVAESGA; EELGRSGVGVAESGAS; ELGRSGVGVAESGASY; LGRSGVGVAESGASYA; GRSGVGVAESGASYAA; RSGVGVAESGASYAAR; SGVGVAESGASYAARD; GVGVAESGASYAARDA; VGVAESGASYAARDAL; GVAESGASYAARDALA; VAESGASYAARDALAA; AESGASYAARDALAAA; ESGASYAARDALAAAS; SGASYAARDALAAASY; GASYAARDALAAASYL; ASYAARDALAAASYLS; SYAARDALAAASYLSG; YAARDALAAASYLSGG; AARDALAAASYLSGGL; | |
| 23) | 13 mers: | 76907- |

Fig. 29 continued

| | | |
|---|---|---|
| Rv1472 | MPHRCAAQVVAGY; PHRCAAQVVAGYR; HRCAAQVVAGYRS; RCAAQVVAGYRST; CAAQVVAGYRSTV; AAQVVAGYRSTVS; AQVVAGYRSTVSL; QVVAGYRSTVSLV; VVAGYRSTVSLVL; VAGYRSTVSLVLV; AGYRSTVSLVLVE; GYRSTVSLVLVEH; YRSTVSLVLVEHP; RSTVSLVLVEHPR; STVSLVLVEHPRP; TVSLVLVEHPRPE; VSLVLVEHPRPEI; SLVLVEHPRPEIA; LVLVEHPRPEIAQ; VLVEHPRPEIAQI; LVEHPRPEIAQIT; VEHPRPEIAQITL; EHPRPEIAQITLN; HPRPEIAQITLNR; PRPEIAQITLNRP; RPEIAQITLNRPE; PEIAQITLNRPER; EIAQITLNRPERM; IAQITLNRPERMN; AQITLNRPERMNS; QITLNRPERMNSM; ITLNRPERMNSMA; TLNRPERMNSMAF; LNRPERMNSMAFD; NRPERMNSMAFDV; RPERMNSMAFDVM; PERMNSMAFDVMV; ERMNSMAFDVMVP; RMNSMAFDVMVPL; MNSMAFDVMVPLK; NSMAFDVMVPLKE; SMAFDVMVPLKEA; MAFDVMVPLKEAL; AFDVMVPLKEALA; FDVMVPLKEALAQ; DVMVPLKEALAQV; VMVPLKEALAQVS; MVPLKEALAQVSY; VPLKEALAQVSYD; PLKEALAQVSYDN; LKEALAQVSYDNS; KEALAQVSYDNSV; EALAQVSYDNSVR; ALAQVSYDNSVRV; LAQVSYDNSVRVV; AQVSYDNSVRVVV; QVSYDNSVRVVVL; VSYDNSVRVVVLT; SYDNSVRVVVLTG; YDNSVRVVVLTGA; DNSVRVVVLTGAG; NSVRVVVLTGAGR; SVRVVVLTGAGRG; VRVVVLTGAGRGF; RVVVLTGAGRGFS; VVVLTGAGRGFSP; VVLTGAGRGFSPG; VLTGAGRGFSPGA; LTGAGRGFSPGAD; TGAGRGFSPGADH; GAGRGFSPGADHK; AGRGFSPGADHKS; GRGFSPGADHKSA; RGFSPGADHKSAG; GFSPGADHKSAGV; FSPGADHKSAGVV; SPGADHKSAGVVP; PGADHKSAGVVPH; GADHKSAGVVPHV; ADHKSAGVVPHVE; DHKSAGVVPHVEN; HKSAGVVPHVENL; KSAGVVPHVENLT; SAGVVPHVENLTR; AGVVPHVENLTRP; GVVPHVENLTRPT; VVPHVENLTRPTY; VPHVENLTRPTYA; PHVENLTRPTYAL; HVENLTRPTYALR; VENLTRPTYALRS; ENLTRPTYALRSM; NLTRPTYALRSME; LTRPTYALRSMEL; TRPTYALRSMELL; RPTYALRSMELLD; PTYALRSMELLDD; TYALRSMELLDDV; YALRSMELLDDVI; ALRSMELLDDVIL; LRSMELLDDVILM; RSMELLDDVILML; SMELLDDVILMLR; MELLDDVILMLRR; ELLDDVILMLRRL; LLDDVILMLRRLH; LDDVILMLRRLHQ; DDVILMLRRLHQP; DVILMLRRLHQPV; VILMLRRLHQPVI; ILMLRRLHQPVIA; LMLRRLHQPVIAA; MLRRLHQPVIAAV; LRRLHQPVIAAVN; RRLHQPVIAAVNG; RLHQPVIAAVNGP; LHQPVIAAVNGPA; HQPVIAAVNGPAI; QPVIAAVNGPAIG; PVIAAVNGPAIGG; VIAAVNGPAIGGG; IAAVNGPAIGGGL; AAVNGPAIGGGLC; AVNGPAIGGGLCL; VNGPAIGGGLCLA; NGPAIGGGLCLAL; GPAIGGGLCLALA; PAIGGGLCLALAA; AIGGGLCLALAAD; IGGGLCLALAADI; GGGLCLALAADIR; GGLCLALAADIRV; GLCLALAADIRVA; LCLALAADIRVAS; CLALAADIRVASS; LALAADIRVASSS; ALAADIRVASSSA; LAADIRVASSSAY; AADIRVASSSAYF; ADIRVASSSAYFR; DIRVASSSAYFRA; IRVASSSAYFRAA; RVASSSAYFRAAG; VASSSAYFRAAGI; ASSSAYFRAAGIN; SSSAYFRAAGINN; SSAYFRAAGINNG; SAYFRAAGINNGL; AYFRAAGINNGLT; YFRAAGINNGLTA; FRAAGINNGLTAS; RAAGINNGLTASE; AAGINNGLTASEL; AGINNGLTASELG; GINNGLTASELGL; INNGLTASELGLS; NNGLTASELGLSY; NGLTASELGLSYL; GLTASELGLSYLL; LTASELGLSYLLP; TASELGLSYLLPR; ASELGLSYLLPRA; SELGLSYLLPRAI; ELGLSYLLPRAIG; LGLSYLLPRAIGS; GLSYLLPRAIGSS; LSYLLPRAIGSSR; SYLLPRAIGSSRA; YLLPRAIGSSRAF; LLPRAIGSSRAFE; LPRAIGSSRAFEI; PRAIGSSRAFEIM; RAIGSSRAFEIML; AIGSSRAFEIMLT; IGSSRAFEIMLTG; GSSRAFEIMLTGR; SSRAFEIMLTGRD; SRAFEIMLTGRDV; RAFEIMLTGRDVS; AFEIMLTGRDVSA; FEIMLTGRDVSAE; EIMLTGRDVSAEE; IMLTGRDVSAEEA; MLTGRDVSAEEAE; LTGRDVSAEEAER; TGRDVSAEEAERI; GRDVSAEEAERIG; RDVSAEEAERIGL; DVSAEEAERIGLV; VSAEEAERIGLVS; SAEEAERIGLVSR; AEEAERIGLVSRQ; EEAERIGLVSRQV; EAERIGLVSRQVP; AERIGLVSRQVPD; ERIGLVSRQVPDE; RIGLVSRQVPDEQ; IGLVSRQVPDEQL; GLVSRQVPDEQLL; LVSRQVPDEQLLD; | 77992 |

Fig. 29 continued

| | | |
|---|---|---|
| | VSRQVPDEQLLDA; SRQVPDEQLLDAC; RQVPDEQLLDACY; QVPDEQLLDACYA; VPDEQLLDACYAI; PDEQLLDACYAIA; DEQLLDACYAIAA; EQLLDACYAIAAR; QLLDACYAIAARM; LLDACYAIAARMA; LDACYAIAARMAG; DACYAIAARMAGF; ACYAIAARMAGFS; CYAIAARMAGFSR; YAIAARMAGFSRP; AIAARMAGFSRPG; IAARMAGFSRPGI; AARMAGFSRPGIE; ARMAGFSRPGIEL; RMAGFSRPGIELT; MAGFSRPGIELTK; AGFSRPGIELTKR; GFSRPGIELTKRT; FSRPGIELTKRTL; SRPGIELTKRTLW; RPGIELTKRTLWS; PGIELTKRTLWSG; GIELTKRTLWSGL; IELTKRTLWSGLD; ELTKRTLWSGLDA; LTKRTLWSGLDAA; TKRTLWSGLDAAS; KRTLWSGLDAASL; RTLWSGLDAASLE; TLWSGLDAASLEA; LWSGLDAASLEAH; WSGLDAASLEAHM; SGLDAASLEAHMQ; GLDAASLEAHMQA; LDAASLEAHMQAE; DAASLEAHMQAEG; AASLEAHMQAEGL; ASLEAHMQAEGLG; SLEAHMQAEGLGQ; LEAHMQAEGLGQL; EAHMQAEGLGQLF; AHMQAEGLGQLFV; HMQAEGLGQLFVR; MQAEGLGQLFVRL; QAEGLGQLFVRLL; AEGLGQLFVRLLT; EGLGQLFVRLLTA; GLGQLFVRLLTAN; LGQLFVRLLTANF; GQLFVRLLTANFE; QLFVRLLTANFEE; LFVRLLTANFEEA; FVRLLTANFEEAV; VRLLTANFEEAVA; RLLTANFEEAVAA; LLTANFEEAVAAR; LTANFEEAVAARA; TANFEEAVAARAE; ANFEEAVAARAEQ; NFEEAVAARAEQR; FEEAVAARAEQRA; EEAVAARAEQRAP; EAVAARAEQRAPV; AVAARAEQRAPVF; VAARAEQRAPVFT; AARAEQRAPVFTD; ARAEQRAPVFTDD; RAEQRAPVFTDDT<br><br>14 mers:<br>MPHRCAAQVVAGYR; PHRCAAQVVAGYRS; HRCAAQVVAGYRST; RCAAQVVAGYRSTV; CAAQVVAGYRSTVS; AAQVVAGYRSTVSL; AQVVAGYRSTVSLV; QVVAGYRSTVSLVL; VVAGYRSTVSLVLV; VAGYRSTVSLVLVE; AGYRSTVSLVLVEH; GYRSTVSLVLVEHP; YRSTVSLVLVEHPR; RSTVSLVLVEHPRP; STVSLVLVEHPRPE; TVSLVLVEHPRPEI; VSLVLVEHPRPEIA; SLVLVEHPRPEIAQ; LVLVEHPRPEIAQI; VLVEHPRPEIAQIT; LVEHPRPEIAQITL; VEHPRPEIAQITLN; EHPRPEIAQITLNR; HPRPEIAQITLNRP; PRPEIAQITLNRPE; RPEIAQITLNRPER; PEIAQITLNRPERM; EIAQITLNRPERMN; IAQITLNRPERMNS; AQITLNRPERMNSM; QITLNRPERMNSMA; ITLNRPERMNSMAF; TLNRPERMNSMAFD; LNRPERMNSMAFDV; NRPERMNSMAFDVM; RPERMNSMAFDVMV; PERMNSMAFDVMVP; ERMNSMAFDVMVPL; RMNSMAFDVMVPLK; MNSMAFDVMVPLKE; NSMAFDVMVPLKEA; SMAFDVMVPLKEAL; MAFDVMVPLKEALA; AFDVMVPLKEALAQ; FDVMVPLKEALAQV; DVMVPLKEALAQVS; VMVPLKEALAQVSY; MVPLKEALAQVSYD; VPLKEALAQVSYDN; PLKEALAQVSYDNS; LKEALAQVSYDNSV; KEALAQVSYDNSVR; EALAQVSYDNSVRV; ALAQVSYDNSVRVV; LAQVSYDNSVRVVV; AQVSYDNSVRVVVL; QVSYDNSVRVVVLT; VSYDNSVRVVVLTG; SYDNSVRVVVLTGA; YDNSVRVVVLTGAG; DNSVRVVVLTGAGR; NSVRVVVLTGAGRG; SVRVVVLTGAGRGF; VRVVVLTGAGRGFS; RVVVLTGAGRGFSP; VVVLTGAGRGFSPG; VVLTGAGRGFSPGA; VLTGAGRGFSPGAD; LTGAGRGFSPGADH; TGAGRGFSPGADHK; GAGRGFSPGADHKS; AGRGFSPGADHKSA; GRGFSPGADHKSAG; RGFSPGADHKSAGV; GFSPGADHKSAGVV; FSPGADHKSAGVVP; SPGADHKSAGVVPH; PGADHKSAGVVPHV; GADHKSAGVVPHVE; ADHKSAGVVPHVEN; DHKSAGVVPHVENL; HKSAGVVPHVENLT; KSAGVVPHVENLTR; SAGVVPHVENLTRP; AGVVPHVENLTRPT; GVVPHVENLTRPTY; VVPHVENLTRPTYA; VPHVENLTRPTYAL; PHVENLTRPTYALR; HVENLTRPTYALRS; VENLTRPTYALRSM; ENLTRPTYALRSME; NLTRPTYALRSMEL; LTRPTYALRSMELL; TRPTYALRSMELLD; RPTYALRSMELLDD; | |

Fig. 29 continued

| | | |
|---|---|---|
| | PTYALRSMELLDDV; TYALRSMELLDDVI; YALRSMELLDDVIL;<br>ALRSMELLDDVILM; LRSMELLDDVILML; RSMELLDDVILMLR;<br>SMELLDDVILMLRR; MELLDDVILMLRRL; ELLDDVILMLRRLH;<br>LLDDVILMLRRLHQ; LDDVILMLRRLHQP; DDVILMLRRLHQPV;<br>DVILMLRRLHQPVI; VILMLRRLHQPVIA; ILMLRRLHQPVIAA; LMLRRLHQPVIAAV;<br>MLRRLHQPVIAAVN; LRRLHQPVIAAVNG; RRLHQPVIAAVNGP;<br>RLHQPVIAAVNGPA; LHQPVIAAVNGPAI; HQPVIAAVNGPAIG;<br>QPVIAAVNGPAIGG; PVIAAVNGPAIGGG; VIAAVNGPAIGGGL;<br>IAAVNGPAIGGGLC; AAVNGPAIGGGLCL; AVNGPAIGGGLCLA;<br>VNGPAIGGGLCLAL; NGPAIGGGLCLALA; GPAIGGGLCLALAA;<br>PAIGGGLCLALAAD; AIGGGLCLALAADI; IGGGLCLALAADIR;<br>GGGLCLALAADIRV; GGLCLALAADIRVA; GLCLALAADIRVAS;<br>LCLALAADIRVASS; CLALAADIRVASSS; LALAADIRVASSSA;<br>ALAADIRVASSSAY; LAADIRVASSSAYF; AADIRVASSSAYFR;<br>ADIRVASSSAYFRA; DIRVASSSAYFRAA; IRVASSSAYFRAAG;<br>RVASSSAYFRAAGI; VASSSAYFRAAGIN; ASSSAYFRAAGINN;<br>SSSAYFRAAGINNG; SSAYFRAAGINNGL; SAYFRAAGINNGLT;<br>AYFRAAGINNGLTA; YFRAAGINNGLTAS; FRAAGINNGLTASE;<br>RAAGINNGLTASEL; AAGINNGLTASELG; AGINNGLTASELGL;<br>GINNGLTASELGLS; INNGLTASELGLSY; NNGLTASELGLSYL;<br>NGLTASELGLSYLL; GLTASELGLSYLLP; LTASELGLSYLLPR;<br>TASELGLSYLLPRA; ASELGLSYLLPRAI; SELGLSYLLPRAIG; ELGLSYLLPRAIGS;<br>LGLSYLLPRAIGSS; GLSYLLPRAIGSSR; LSYLLPRAIGSSRA;<br>SYLLPRAIGSSRAF; YLLPRAIGSSRAFE; LLPRAIGSSRAFEI; LPRAIGSSRAFEIM;<br>PRAIGSSRAFEIML; RAIGSSRAFEIMLT; AIGSSRAFEIMLTG; IGSSRAFEIMLTGR;<br>GSSRAFEIMLTGRD; SSRAFEIMLTGRDV; SRAFEIMLTGRDVS;<br>RAFEIMLTGRDVSA; AFEIMLTGRDVSAE; FEIMLTGRDVSAEE;<br>EIMLTGRDVSAEEA; IMLTGRDVSAEEAE; MLTGRDVSAEEAER;<br>LTGRDVSAEEAERI; TGRDVSAEEAERIG; GRDVSAEEAERIGL;<br>RDVSAEEAERIGLV; DVSAEEAERIGLVS; VSAEEAERIGLVSR;<br>SAEEAERIGLVSRQ; AEEAERIGLVSRQV; EEAERIGLVSRQVP;<br>EAERIGLVSRQVPD; AERIGLVSRQVPDE; ERIGLVSRQVPDEQ;<br>RIGLVSRQVPDEQL; IGLVSRQVPDEQLL; GLVSRQVPDEQLLD;<br>LVSRQVPDEQLLDA; VSRQVPDEQLLDAC; SRQVPDEQLLDACY;<br>RQVPDEQLLDACYA; QVPDEQLLDACYAI; VPDEQLLDACYAIA;<br>PDEQLLDACYAIAA; DEQLLDACYAIAAR; EQLLDACYAIAARM;<br>QLLDACYAIAARMA; LLDACYAIAARMAG; LDACYAIAARMAGF;<br>DACYAIAARMAGFS; ACYAIAARMAGFSR; CYAIAARMAGFSRP;<br>YAIAARMAGFSRPG; AIAARMAGFSRPGI; IAARMAGFSRPGIE;<br>AARMAGFSRPGIEL; ARMAGFSRPGIELT; RMAGFSRPGIELTK;<br>MAGFSRPGIELTKR; AGFSRPGIELTKRT; GFSRPGIELTKRTL;<br>FSRPGIELTKRTLW; SRPGIELTKRTLWS; RPGIELTKRTLWSG;<br>PGIELTKRTLWSGL; GIELTKRTLWSGLD; IELTKRTLWSGLDA;<br>ELTKRTLWSGLDAA; LTKRTLWSGLDAAS; TKRTLWSGLDAASL;<br>KRTLWSGLDAASLE; RTLWSGLDAASLEA; TLWSGLDAASLEAH;<br>LWSGLDAASLEAHM; WSGLDAASLEAHMQ; SGLDAASLEAHMQA;<br>GLDAASLEAHMQAE; LDAASLEAHMQAEG; DAASLEAHMQAEGL;<br>AASLEAHMQAEGLG; ASLEAHMQAEGLGQ; SLEAHMQAEGLGQL;<br>LEAHMQAEGLGQLF; EAHMQAEGLGQLFV; AHMQAEGLGQLFVR;<br>HMQAEGLGQLFVRL; MQAEGLGQLFVRLL; QAEGLGQLFVRLLT;<br>AEGLGQLFVRLLTA; EGLGQLFVRLLTAN; GLGQLFVRLLTANF;<br>LGQLFVRLLTANFE; GQLFVRLLTANFEE; QLFVRLLTANFEEA;<br>LFVRLLTANFEEAV; FVRLLTANFEEAVA; VRLLTANFEEAVAA; | |

Fig. 29 continued

| | | | |
|---|---|---|---|
| | RLLTANFEEAVAAR; LLTANFEEAVAARA; LTANFEEAVAARAE;<br>TANFEEAVAARAEQ; ANFEEAVAARAEQR; NFEEAVAARAEQRA;<br>FEEAVAARAEQRAP; EEAVAARAEQRAPV; EAVAARAEQRAPVF;<br>AVAARAEQRAPVFT; VAARAEQRAPVFTD; AARAEQRAPVFTDD;<br>ARAEQRAPVFTDDT<br><br>15 mers:<br>MPHRCAAQVVAGYRS; PHRCAAQVVAGYRST; HRCAAQVVAGYRSTV;<br>RCAAQVVAGYRSTVS; CAAQVVAGYRSTVSL; AAQVVAGYRSTVSLV;<br>AQVVAGYRSTVSLVL; QVVAGYRSTVSLVLV; VVAGYRSTVSLVLVE;<br>VAGYRSTVSLVLVEH; AGYRSTVSLVLVEHP; GYRSTVSLVLVEHPR;<br>YRSTVSLVLVEHPRP; RSTVSLVLVEHPRPE; STVSLVLVEHPRPEI;<br>TVSLVLVEHPRPEIA; VSLVLVEHPRPEIAQ; SLVLVEHPRPEIAQI;<br>LVLVEHPRPEIAQIT; VLVEHPRPEIAQITL; LVEHPRPEIAQITLN;<br>VEHPRPEIAQITLNR; EHPRPEIAQITLNRP; HPRPEIAQITLNRPE;<br>PRPEIAQITLNRPER; RPEIAQITLNRPERM; PEIAQITLNRPERMN;<br>EIAQITLNRPERMNS; IAQITLNRPERMNSM; AQITLNRPERMNSMA;<br>QITLNRPERMNSMAF; ITLNRPERMNSMAFD; TLNRPERMNSMAFDV;<br>LNRPERMNSMAFDVM; NRPERMNSMAFDVMV; RPERMNSMAFDVMVP;<br>PERMNSMAFDVMVPL; ERMNSMAFDVMVPLK; RMNSMAFDVMVPLKE;<br>MNSMAFDVMVPLKEA; NSMAFDVMVPLKEAL; SMAFDVMVPLKEALA;<br>MAFDVMVPLKEALAQ; AFDVMVPLKEALAQV; FDVMVPLKEALAQVS;<br>DVMVPLKEALAQVSY; VMVPLKEALAQVSYD; MVPLKEALAQVSYDN;<br>VPLKEALAQVSYDNS; PLKEALAQVSYDNSV; LKEALAQVSYDNSVR;<br>KEALAQVSYDNSVRV; EALAQVSYDNSVRVV; ALAQVSYDNSVRVVV;<br>LAQVSYDNSVRVVVL; AQVSYDNSVRVVVLT; QVSYDNSVRVVVLTG;<br>VSYDNSVRVVVLTGA; SYDNSVRVVVLTGAG; YDNSVRVVVLTGAGR;<br>DNSVRVVVLTGAGRG; NSVRVVVLTGAGRGF; SVRVVVLTGAGRGFS;<br>VRVVVLTGAGRGFSP; RVVVLTGAGRGFSPG; VVVLTGAGRGFSPGA;<br>VVLTGAGRGFSPGAD; VLTGAGRGFSPGADH; LTGAGRGFSPGADHK;<br>TGAGRGFSPGADHKS; GAGRGFSPGADHKSA; AGRGFSPGADHKSAG;<br>GRGFSPGADHKSAGV; RGFSPGADHKSAGVV; GFSPGADHKSAGVVP;<br>FSPGADHKSAGVVPH; SPGADHKSAGVVPHV; PGADHKSAGVVPHVE;<br>GADHKSAGVVPHVEN; ADHKSAGVVPHVENL; DHKSAGVVPHVENLT;<br>HKSAGVVPHVENLTR; KSAGVVPHVENLTRP; SAGVVPHVENLTRPT;<br>AGVVPHVENLTRPTY; GVVPHVENLTRPTYA; VVPHVENLTRPTYAL;<br>VPHVENLTRPTYALR; PHVENLTRPTYALRS; HVENLTRPTYALRSM;<br>VENLTRPTYALRSME; ENLTRPTYALRSMEL; NLTRPTYALRSMELL;<br>LTRPTYALRSMELLD; TRPTYALRSMELLDD; RPTYALRSMELLDDV;<br>PTYALRSMELLDDVI; TYALRSMELLDDVIL; YALRSMELLDDVILM;<br>ALRSMELLDDVILML; LRSMELLDDVILMLR; RSMELLDDVILMLRR;<br>SMELLDDVILMLRRL; MELLDDVILMLRRLH; ELLDDVILMLRRLHQ;<br>LLDDVILMLRRLHQP; LDDVILMLRRLHQPV; DDVILMLRRLHQPVI;<br>DVILMLRRLHQPVIA; VILMLRRLHQPVIAA; ILMLRRLHQPVIAAV;<br>LMLRRLHQPVIAAVN; MLRRLHQPVIAAVNG; LRRLHQPVIAAVNGP;<br>RRLHQPVIAAVNGPA; RLHQPVIAAVNGPAI; LHQPVIAAVNGPAIG;<br>HQPVIAAVNGPAIGG; QPVIAAVNGPAIGGG; PVIAAVNGPAIGGGL;<br>VIAAVNGPAIGGGLC; IAAVNGPAIGGGLCL; AAVNGPAIGGGLCLA;<br>AVNGPAIGGGLCLAL; VNGPAIGGGLCLALA; NGPAIGGGLCLALAA;<br>GPAIGGGLCLALAAD; PAIGGGLCLALAADI; AIGGGLCLALAADIR;<br>IGGGLCLALAADIRV; GGGLCLALAADIRVA; GGLCLALAADIRVAS;<br>GLCLALAADIRVASS; LCLALAADIRVASSS; CLALAADIRVASSSA;<br>LALAADIRVASSSAY; ALAADIRVASSSAYF; LAADIRVASSSAYFR; | |

Fig. 29 continued

| | | | |
|---|---|---|---|
| | AADIRVASSSAYFRA; ADIRVASSSAYFRAA; DIRVASSSAYFRAAG;<br>IRVASSSAYFRAAGI; RVASSSAYFRAAGIN; VASSSAYFRAAGINN;<br>ASSSAYFRAAGINNG; SSSAYFRAAGINNGL; SSAYFRAAGINNGLT;<br>SAYFRAAGINNGLTA; AYFRAAGINNGLTAS; YFRAAGINNGLTASE;<br>FRAAGINNGLTASEL; RAAGINNGLTASELG; AAGINNGLTASELGL;<br>AGINNGLTASELGLS; GINNGLTASELGLSY; INNGLTASELGLSYL;<br>NNGLTASELGLSYLL; NGLTASELGLSYLLP; GLTASELGLSYLLPR;<br>LTASELGLSYLLPRA; TASELGLSYLLPRAI; ASELGLSYLLPRAIG;<br>SELGLSYLLPRAIGS; ELGLSYLLPRAIGSS; LGLSYLLPRAIGSSR;<br>GLSYLLPRAIGSSRA; LSYLLPRAIGSSRAF; SYLLPRAIGSSRAFE;<br>YLLPRAIGSSRAFEI; LLPRAIGSSRAFEIM; LPRAIGSSRAFEIML;<br>PRAIGSSRAFEIMLT; RAIGSSRAFEIMLTG; AIGSSRAFEIMLTGR;<br>IGSSRAFEIMLTGRD; GSSRAFEIMLTGRDV; SSRAFEIMLTGRDVS;<br>SRAFEIMLTGRDVSA; RAFEIMLTGRDVSAE; AFEIMLTGRDVSAEE;<br>FEIMLTGRDVSAEEA; EIMLTGRDVSAEEAE; IMLTGRDVSAEEAER;<br>MLTGRDVSAEEAERI; LTGRDVSAEEAERIG; TGRDVSAEEAERIGL;<br>GRDVSAEEAERIGLV; RDVSAEEAERIGLVS; DVSAEEAERIGLVSR;<br>VSAEEAERIGLVSRQ; SAEEAERIGLVSRQV; AEEAERIGLVSRQVP;<br>EEAERIGLVSRQVPD; EAERIGLVSRQVPDE; AERIGLVSRQVPDEQ;<br>ERIGLVSRQVPDEQL; RIGLVSRQVPDEQLL; IGLVSRQVPDEQLLD;<br>GLVSRQVPDEQLLDA; LVSRQVPDEQLLDAC; VSRQVPDEQLLDACY;<br>SRQVPDEQLLDACYA; RQVPDEQLLDACYAI; QVPDEQLLDACYAIA;<br>VPDEQLLDACYAIAA; PDEQLLDACYAIAAR; DEQLLDACYAIAARM;<br>EQLLDACYAIAARMA; QLLDACYAIAARMAG; LLDACYAIAARMAGF;<br>LDACYAIAARMAGFS; DACYAIAARMAGFSR; ACYAIAARMAGFSRP;<br>CYAIAARMAGFSRPG; YAIAARMAGFSRPGI; AIAARMAGFSRPGIE;<br>IAARMAGFSRPGIEL; AARMAGFSRPGIELT; ARMAGFSRPGIELTK;<br>RMAGFSRPGIELTKR; MAGFSRPGIELTKRT; AGFSRPGIELTKRTL;<br>GFSRPGIELTKRTLW; FSRPGIELTKRTLWS; SRPGIELTKRTLWSG;<br>RPGIELTKRTLWSGL; PGIELTKRTLWSGLD; GIELTKRTLWSGLDA;<br>IELTKRTLWSGLDAA; ELTKRTLWSGLDAAS; LTKRTLWSGLDAASL;<br>TKRTLWSGLDAASLE; KRTLWSGLDAASLEA; RTLWSGLDAASLEAH;<br>TLWSGLDAASLEAHM; LWSGLDAASLEAHMQ; WSGLDAASLEAHMQA;<br>SGLDAASLEAHMQAE; GLDAASLEAHMQAEG; LDAASLEAHMQAEGL;<br>DAASLEAHMQAEGLG; AASLEAHMQAEGLGQ; ASLEAHMQAEGLGQL;<br>SLEAHMQAEGLGQLF; LEAHMQAEGLGQLFV; EAHMQAEGLGQLFVR;<br>AHMQAEGLGQLFVRL; HMQAEGLGQLFVRLL; MQAEGLGQLFVRLLT;<br>QAEGLGQLFVRLLTA; AEGLGQLFVRLLTAN; EGLGQLFVRLLTANF;<br>GLGQLFVRLLTANFE; LGQLFVRLLTANFEE; GQLFVRLLTANFEEA;<br>QLFVRLLTANFEEAV; LFVRLLTANFEEAVA; FVRLLTANFEEAVAA;<br>VRLLTANFEEAVAAR; RLLTANFEEAVAARA; LLTANFEEAVAARAE;<br>LTANFEEAVAARAEQ; TANFEEAVAARAEQR; ANFEEAVAARAEQRA;<br>NFEEAVAARAEQRAP; FEEAVAARAEQRAPV; EEAVAARAEQRAPVF;<br>EAVAARAEQRAPVFT; AVAARAEQRAPVFTD; VAARAEQRAPVFTDD;<br>AARAEQRAPVFTDDT<br><br>16 mers:<br>MPHRCAAQVVAGYRST; PHRCAAQVVAGYRSTV; HRCAAQVVAGYRSTVS;<br>RCAAQVVAGYRSTVSL; CAAQVVAGYRSTVSLV; AAQVVAGYRSTVSLVL;<br>AQVVAGYRSTVSLVLV; QVVAGYRSTVSLVLVE; VVAGYRSTVSLVLVEH;<br>VAGYRSTVSLVLVEHP; AGYRSTVSLVLVEHPR; GYRSTVSLVLVEHPRP;<br>YRSTVSLVLVEHPRPE; RSTVSLVLVEHPRPEI; STVSLVLVEHPRPEIA;<br>TVSLVLVEHPRPEIAQ; VSLVLVEHPRPEIAQI; SLVLVEHPRPEIAQIT; | | |

Fig. 29 continued

| | | | |
|---|---|---|---|
| | LVLVEHPRPEIAQITL; VLVEHPRPEIAQITLN; LVEHPRPEIAQITLNR;<br>VEHPRPEIAQITLNRP; EHPRPEIAQITLNRPE; HPRPEIAQITLNRPER;<br>PRPEIAQITLNRPERM; RPEIAQITLNRPERMN; PEIAQITLNRPERMNS;<br>EIAQITLNRPERMNSM; IAQITLNRPERMNSMA; AQITLNRPERMNSMAF;<br>QITLNRPERMNSMAFD; ITLNRPERMNSMAFDV; TLNRPERMNSMAFDVM;<br>LNRPERMNSMAFDVMV; NRPERMNSMAFDVMVP; RPERMNSMAFDVMVPL;<br>PERMNSMAFDVMVPLK; ERMNSMAFDVMVPLKE; RMNSMAFDVMVPLKEA;<br>MNSMAFDVMVPLKEAL; NSMAFDVMVPLKEALA; SMAFDVMVPLKEALAQ;<br>MAFDVMVPLKEALAQV; AFDVMVPLKEALAQVS; FDVMVPLKEALAQVSY;<br>DVMVPLKEALAQVSYD; VMVPLKEALAQVSYDN; MVPLKEALAQVSYDNS;<br>VPLKEALAQVSYDNSV; PLKEALAQVSYDNSVR; LKEALAQVSYDNSVRV;<br>KEALAQVSYDNSVRVV; EALAQVSYDNSVRVVV; ALAQVSYDNSVRVVVL;<br>LAQVSYDNSVRVVVLT; AQVSYDNSVRVVVLTG; QVSYDNSVRVVVLTGA;<br>VSYDNSVRVVVLTGAG; SYDNSVRVVVLTGAGR; YDNSVRVVVLTGAGRG;<br>DNSVRVVVLTGAGRGF; NSVRVVVLTGAGRGFS; SVRVVVLTGAGRGFSP;<br>VRVVVLTGAGRGFSPG; RVVVLTGAGRGFSPGA; VVVLTGAGRGFSPGAD;<br>VVLTGAGRGFSPGADH; VLTGAGRGFSPGADHK; LTGAGRGFSPGADHKS;<br>TGAGRGFSPGADHKSA; GAGRGFSPGADHKSAG; AGRGFSPGADHKSAGV;<br>GRGFSPGADHKSAGVV; RGFSPGADHKSAGVVP; GFSPGADHKSAGVVPH;<br>FSPGADHKSAGVVPHV; SPGADHKSAGVVPHVE; PGADHKSAGVVPHVEN;<br>GADHKSAGVVPHVENL; ADHKSAGVVPHVENLT; DHKSAGVVPHVENLTR;<br>HKSAGVVPHVENLTRP; KSAGVVPHVENLTRPT; SAGVVPHVENLTRPTY;<br>AGVVPHVENLTRPTYA; GVVPHVENLTRPTYAL; VVPHVENLTRPTYALR;<br>VPHVENLTRPTYALRS; PHVENLTRPTYALRSM; HVENLTRPTYALRSME;<br>VENLTRPTYALRSMEL; ENLTRPTYALRSMELL; NLTRPTYALRSMELLD;<br>LTRPTYALRSMELLDD; TRPTYALRSMELLDDV; RPTYALRSMELLDDVI;<br>PTYALRSMELLDDVIL; TYALRSMELLDDVILM; YALRSMELLDDVILML;<br>ALRSMELLDDVILMLR; LRSMELLDDVILMLRR; RSMELLDDVILMLRRL;<br>SMELLDDVILMLRRLH; MELLDDVILMLRRLHQ; ELLDDVILMLRRLHQP;<br>LLDDVILMLRRLHQPV; LDDVILMLRRLHQPVI; DDVILMLRRLHQPVIA;<br>DVILMLRRLHQPVIAA; VILMLRRLHQPVIAAV; ILMLRRLHQPVIAAVN;<br>LMLRRLHQPVIAAVNG; MLRRLHQPVIAAVNGP; LRRLHQPVIAAVNGPA;<br>RRLHQPVIAAVNGPAI; RLHQPVIAAVNGPAIG; LHQPVIAAVNGPAIGG;<br>HQPVIAAVNGPAIGGG; QPVIAAVNGPAIGGGL; PVIAAVNGPAIGGGLC;<br>VIAAVNGPAIGGGLCL; IAAVNGPAIGGGLCLA; AAVNGPAIGGGLCLAL;<br>AVNGPAIGGGLCLALA; VNGPAIGGGLCLALAA; NGPAIGGGLCLALAAD;<br>GPAIGGGLCLALAADI; PAIGGGLCLALAADIR; AIGGGLCLALAADIRV;<br>IGGGLCLALAADIRVA; GGGLCLALAADIRVAS; GGLCLALAADIRVASS;<br>GLCLALAADIRVASSS; LCLALAADIRVASSSA; CLALAADIRVASSSAY;<br>LALAADIRVASSSAYF; ALAADIRVASSSAYFR; LAADIRVASSSAYFRA;<br>AADIRVASSSAYFRAA; ADIRVASSSAYFRAAG; DIRVASSSAYFRAAGI;<br>IRVASSSAYFRAAGIN; RVASSSAYFRAAGINN; VASSSAYFRAAGINNG;<br>ASSSAYFRAAGINNGL; SSSAYFRAAGINNGLT; SSAYFRAAGINNGLTA;<br>SAYFRAAGINNGLTAS; AYFRAAGINNGLTASE; YFRAAGINNGLTASEL;<br>FRAAGINNGLTASELG; RAAGINNGLTASELGL; AAGINNGLTASELGLS;<br>AGINNGLTASELGLSY; GINNGLTASELGLSYL; INNGLTASELGLSYLL;<br>NNGLTASELGLSYLLP; NGLTASELGLSYLLPR; GLTASELGLSYLLPRA;<br>LTASELGLSYLLPRAI; TASELGLSYLLPRAIG; ASELGLSYLLPRAIGS;<br>SELGLSYLLPRAIGSS; ELGLSYLLPRAIGSSR; LGLSYLLPRAIGSSRA;<br>GLSYLLPRAIGSSRAF; LSYLLPRAIGSSRAFE; SYLLPRAIGSSRAFEI;<br>YLLPRAIGSSRAFEIM; LLPRAIGSSRAFEIML; LPRAIGSSRAFEIMLT;<br>PRAIGSSRAFEIMLTG; RAIGSSRAFEIMLTGR; AIGSSRAFEIMLTGRD;<br>IGSSRAFEIMLTGRDV; GSSRAFEIMLTGRDVS; SSRAFEIMLTGRDVSA; | | |

Fig. 29 continued

| | | |
|---|---|---|
| | SRAFEIMLTGRDVSAE; RAFEIMLTGRDVSAEE; AFEIMLTGRDVSAEEA; FEIMLTGRDVSAEEAE; EIMLTGRDVSAEEAER; IMLTGRDVSAEEAERI; MLTGRDVSAEEAERIG; LTGRDVSAEEAERIGL; TGRDVSAEEAERIGLV; GRDVSAEEAERIGLVS; RDVSAEEAERIGLVSR; DVSAEEAERIGLVSRQ; VSAEEAERIGLVSRQV; SAEEAERIGLVSRQVP; AEEAERIGLVSRQVPD; EEAERIGLVSRQVPDE; EAERIGLVSRQVPDEQ; AERIGLVSRQVPDEQL; ERIGLVSRQVPDEQLL; RIGLVSRQVPDEQLLD; IGLVSRQVPDEQLLDA; GLVSRQVPDEQLLDAC; LVSRQVPDEQLLDACY; VSRQVPDEQLLDACYA; SRQVPDEQLLDACYAI; RQVPDEQLLDACYAIA; QVPDEQLLDACYAIAA; VPDEQLLDACYAIAAR; PDEQLLDACYAIAARM; DEQLLDACYAIAARMA; EQLLDACYAIAARMAG; QLLDACYAIAARMAGF; LLDACYAIAARMAGFS; LDACYAIAARMAGFSR; DACYAIAARMAGFSRP; ACYAIAARMAGFSRPG; CYAIAARMAGFSRPGI; YAIAARMAGFSRPGIE; AIAARMAGFSRPGIEL; IAARMAGFSRPGIELT; AARMAGFSRPGIELTK; ARMAGFSRPGIELTKR; RMAGFSRPGIELTKRT; MAGFSRPGIELTKRTL; AGFSRPGIELTKRTLW; GFSRPGIELTKRTLWS; FSRPGIELTKRTLWSG; SRPGIELTKRTLWSGL; RPGIELTKRTLWSGLD; PGIELTKRTLWSGLDA; GIELTKRTLWSGLDAA; IELTKRTLWSGLDAAS; ELTKRTLWSGLDAASL; LTKRTLWSGLDAASLE; TKRTLWSGLDAASLEA; KRTLWSGLDAASLEAH; RTLWSGLDAASLEAHM; TLWSGLDAASLEAHMQ; LWSGLDAASLEAHMQA; WSGLDAASLEAHMQAE; SGLDAASLEAHMQAEG; GLDAASLEAHMQAEGL; LDAASLEAHMQAEGLG; DAASLEAHMQAEGLGQ; AASLEAHMQAEGLGQL; ASLEAHMQAEGLGQLF; SLEAHMQAEGLGQLFV; LEAHMQAEGLGQLFVR; EAHMQAEGLGQLFVRL; AHMQAEGLGQLFVRLL; HMQAEGLGQLFVRLLT; MQAEGLGQLFVRLLTA; QAEGLGQLFVRLLTAN; AEGLGQLFVRLLTANF; EGLGQLFVRLLTANFE; GLGQLFVRLLTANFEE; LGQLFVRLLTANFEEA; GQLFVRLLTANFEEAV; QLFVRLLTANFEEAVA; LFVRLLTANFEEAVAA; FVRLLTANFEEAVAAR; VRLLTANFEEAVAARA; RLLTANFEEAVAARAE; LLTANFEEAVAARAEQ; LTANFEEAVAARAEQR; TANFEEAVAARAEQRA; ANFEEAVAARAEQRAP; NFEEAVAARAEQRAPV; FEEAVAARAEQRAPVF; EEAVAARAEQRAPVFT; EAVAARAEQRAPVFTD; AVAARAEQRAPVFTDD; VAARAEQRAPVFTDDT | |
| 24) Rv1552 | 13 mers: MTAQHNIVVIGGG; TAQHNIVVIGGGG; AQHNIVVIGGGGA; QHNIVVIGGGGAG; HNIVVIGGGGAGL; NIVVIGGGGAGLR; IVVIGGGGAGLRA; VVIGGGGAGLRAA; VIGGGGAGLRAAI; IGGGGAGLRAAIA; GGGGAGLRAAIAI; GGGAGLRAAIAIA; GGAGLRAAIAIAE; GAGLRAAIAIAET; AGLRAAIAIAETN; GLRAAIAIAETNP; LRAAIAIAETNPH; RAAIAIAETNPHL; AAIAIAETNPHLD; AIAIAETNPHLDV; IAIAETNPHLDVA; AIAETNPHLDVAI; IAETNPHLDVAIV; AETNPHLDVAIVS; ETNPHLDVAIVSK; TNPHLDVAIVSKV; NPHLDVAIVSKVY; PHLDVAIVSKVYP; HLDVAIVSKVYPM; LDVAIVSKVYPMR; DVAIVSKVYPMRS; VAIVSKVYPMRSH; AIVSKVYPMRSHT; IVSKVYPMRSHTV; VSKVYPMRSHTVS; SKVYPMRSHTVSA; KVYPMRSHTVSAE; VYPMRSHTVSAEG; YPMRSHTVSAEGG; PMRSHTVSAEGGA; MRSHTVSAEGGAA; RSHTVSAEGGAAA; SHTVSAEGGAAAV; HTVSAEGGAAAVT; TVSAEGGAAAVTG; VSAEGGAAAVTGD; SAEGGAAAVTGDD; AEGGAAAVTGDDD; EGGAAAVTGDDDS; GGAAAVTGDDDSL; GAAAVTGDDDSLD; AAAVTGDDDSLDE; AAVTGDDDSLDEH; AVTGDDDSLDEHA; VTGDDDSLDEHAH; TGDDDSLDEHAHD; GDDDSLDEHAHDT; DDDSLDEHAHDTV; DDSLDEHAHDTVS; DSLDEHAHDTVSG; SLDEHAHDTVSGG; LDEHAHDTVSGGD; DEHAHDTVSGGDW; EHAHDTVSGGDWL; HAHDTVSGGDWLC; AHDTVSGGDWLCD; HDTVSGGDWLCDQ; DTVSGGDWLCDQD; TVSGGDWLCDQDA; | 77993-80270 |

Fig. 29 continued

| | | | |
|---|---|---|---|
| | VSGGDWLCDQDAV; SGGDWLCDQDAVE; GGDWLCDQDAVEA;<br>GDWLCDQDAVEAF; DWLCDQDAVEAFV; WLCDQDAVEAFVA;<br>LCDQDAVEAFVAE; CDQDAVEAFVAEA; DQDAVEAFVAEAP; QDAVEAFVAEAPK;<br>DAVEAFVAEAPKE; AVEAFVAEAPKEL; VEAFVAEAPKELV; EAFVAEAPKELVQ;<br>AFVAEAPKELVQL; FVAEAPKELVQLE; VAEAPKELVQLEH; AEAPKELVQLEHW;<br>EAPKELVQLEHWG; APKELVQLEHWGC; PKELVQLEHWGCP;<br>KELVQLEHWGCPW; ELVQLEHWGCPWS; LVQLEHWGCPWSR;<br>VQLEHWGCPWSRK; QLEHWGCPWSRKP; LEHWGCPWSRKPD;<br>EHWGCPWSRKPDG; HWGCPWSRKPDGR; WGCPWSRKPDGRV;<br>GCPWSRKPDGRVA; CPWSRKPDGRVAV; PWSRKPDGRVAVR;<br>WSRKPDGRVAVRP; SRKPDGRVAVRPF; RKPDGRVAVRPFG;<br>KPDGRVAVRPFGG; PDGRVAVRPFGGM; DGRVAVRPFGGMK;<br>GRVAVRPFGGMKK; RVAVRPFGGMKKL; VAVRPFGGMKKLR;<br>AVRPFGGMKKLRT; VRPFGGMKKLRTW; RPFGGMKKLRTWF;<br>PFGGMKKLRTWFA; FGGMKKLRTWFAA; GGMKKLRTWFAAD;<br>GMKKLRTWFAADK; MKKLRTWFAADKT; KKLRTWFAADKTG;<br>KLRTWFAADKTGF; LRTWFAADKTGFH; RTWFAADKTGFHL; TWFAADKTGFHLL;<br>WFAADKTGFHLLH; FAADKTGFHLLHT; AADKTGFHLLHTL; ADKTGFHLLHTLF;<br>DKTGFHLLHTLFQ; KTGFHLLHTLFQR; TGFHLLHTLFQRL; GFHLLHTLFQRLL;<br>FHLLHTLFQRLLT; HLLHTLFQRLLTY; LLHTLFQRLLTYS; LHTLFQRLLTYSD;<br>HTLFQRLLTYSDV; TLFQRLLTYSDVM; LFQRLLTYSDVMR; FQRLLTYSDVMRY;<br>QRLLTYSDVMRYD; RLLTYSDVMRYDE; LLTYSDVMRYDEW;<br>LTYSDVMRYDEWF; TYSDVMRYDEWFA; YSDVMRYDEWFAT;<br>SDVMRYDEWFATT; DVMRYDEWFATTL; VMRYDEWFATTLL;<br>MRYDEWFATTLLV; RYDEWFATTLLVD; YDEWFATTLLVDD; DEWFATTLLVDDG;<br>EWFATTLLVDDGR; WFATTLLVDDGRV; FATTLLVDDGRVC; ATTLLVDDGRVCG;<br>TTLLVDDGRVCGL; TLLVDDGRVCGLV; LLVDDGRVCGLVA; LVDDGRVCGLVAI;<br>VDDGRVCGLVAIE; DDGRVCGLVAIEL; DGRVCGLVAIELA; GRVCGLVAIELAT;<br>RVCGLVAIELATG; VCGLVAIELATGR; CGLVAIELATGRI; GLVAIELATGRIE;<br>LVAIELATGRIET; VAIELATGRIETI; AIELATGRIETIL; IELATGRIETILA;<br>ELATGRIETILAD; LATGRIETILADA; ATGRIETILADAV; TGRIETILADAVI;<br>GRIETILADAVIL; RIETILADAVILC; IETILADAVILCT; ETILADAVILCTG;<br>TILADAVILCTGG; ILADAVILCTGGC; LADAVILCTGGCG; ADAVILCTGGCGR;<br>DAVILCTGGCGRV; AVILCTGGCGRVF; VILCTGGCGRVFP; ILCTGGCGRVFPF;<br>LCTGGCGRVFPFT; CTGGCGRVFPFTT; TGGCGRVFPFTTN;<br>GGCGRVFPFTTNA; GCGRVFPFTTNAN; CGRVFPFTTNANI; GRVFPFTTNANIK;<br>RVFPFTTNANIKT; VFPFTTNANIKTG; FPFTTNANIKTGD; PFTTNANIKTGDG;<br>FTTNANIKTGDGM; TTNANIKTGDGMA; TNANIKTGDGMAL; NANIKTGDGMALA;<br>ANIKTGDGMALAF; NIKTGDGMALAFR; IKTGDGMALAFRA; KTGDGMALAFRAG;<br>TGDGMALAFRAGA; GDGMALAFRAGAP; DGMALAFRAGAPL;<br>GMALAFRAGAPLK; MALAFRAGAPLKD; ALAFRAGAPLKDM; LAFRAGAPLKDME;<br>AFRAGAPLKDMEF; FRAGAPLKDMEFV; RAGAPLKDMEFVQ;<br>AGAPLKDMEFVQY; GAPLKDMEFVQYH; APLKDMEFVQYHP;<br>PLKDMEFVQYHPT; LKDMEFVQYHPTG; KDMEFVQYHPTGL;<br>DMEFVQYHPTGLP; MEFVQYHPTGLPF; EFVQYHPTGLPFT; FVQYHPTGLPFTG;<br>VQYHPTGLPFTGI; QYHPTGLPFTGIL; YHPTGLPFTGILI; HPTGLPFTGILIT;<br>PTGLPFTGILITE; TGLPFTGILITEA; GLPFTGILITEAA; LPFTGILITEAAR;<br>PFTGILITEAARA; FTGILITEAARAE; TGILITEAARAEG; GILITEAARAEGG;<br>ILITEAARAEGGW; LITEAARAEGGWL; ITEAARAEGGWLL; TEAARAEGGWLLN;<br>EAARAEGGWLLNK; AARAEGGWLLNKD; ARAEGGWLLNKDG;<br>RAEGGWLLNKDGY; AEGGWLLNKDGYR; EGGWLLNKDGYRY;<br>GGWLLNKDGYRYL; GWLLNKDGYRYLQ; WLLNKDGYRYLQD;<br>LLNKDGYRYLQDY; LNKDGYRYLQDYD; NKDGYRYLQDYDL; | | |

Fig. 29 continued

| | | |
|---|---|---|
| | KDGYRYLQDYDLG; DGYRYLQDYDLGK; GYRYLQDYDLGKP; YRYLQDYDLGKPT; RYLQDYDLGKPTP; YLQDYDLGKPTPE; LQDYDLGKPTPEP; QDYDLGKPTPEPR; DYDLGKPTPEPRL; YDLGKPTPEPRLR; DLGKPTPEPRLRS; LGKPTPEPRLRSM; GKPTPEPRLRSME; KPTPEPRLRSMEL; PTPEPRLRSMELG; TPEPRLRSMELGP; PEPRLRSMELGPR; EPRLRSMELGPRD; PRLRSMELGPRDR; RLRSMELGPRDRL; LRSMELGPRDRLS; RSMELGPRDRLSQ; SMELGPRDRLSQA; MELGPRDRLSQAF; ELGPRDRLSQAFV; LGPRDRLSQAFVH; GPRDRLSQAFVHE; PRDRLSQAFVHEH; RDRLSQAFVHEHN; DRLSQAFVHEHNK; RLSQAFVHEHNKG; LSQAFVHEHNKGR; SQAFVHEHNKGRT; QAFVHEHNKGRTV; AFVHEHNKGRTVD; FVHEHNKGRTVDT; VHEHNKGRTVDTP; HEHNKGRTVDTPY; EHNKGRTVDTPYG; HNKGRTVDTPYGP; NKGRTVDTPYGPV; KGRTVDTPYGPVV; GRTVDTPYGPVVY; RTVDTPYGPVVYL; TVDTPYGPVVYLD; VDTPYGPVVYLDL; DTPYGPVVYLDLR; TPYGPVVYLDLRH; PYGPVVYLDLRHL; YGPVVYLDLRHLG; GPVVYLDLRHLGA; PVVYLDLRHLGAD; VVYLDLRHLGADL; VYLDLRHLGADLI; YLDLRHLGADLID; LDLRHLGADLIDA; DLRHLGADLIDAK; LRHLGADLIDAKL; RHLGADLIDAKLP; HLGADLIDAKLPF; LGADLIDAKLPFV; GADLIDAKLPFVR; ADLIDAKLPFVRE; DLIDAKLPFVREL; LIDAKLPFVRELC; IDAKLPFVRELCR; DAKLPFVRELCRD; AKLPFVRELCRDY; KLPFVRELCRDYQ; LPFVRELCRDYQH; PFVRELCRDYQHI; FVRELCRDYQHID; VRELCRDYQHIDP; RELCRDYQHIDPV; ELCRDYQHIDPVV; LCRDYQHIDPVVE; CRDYQHIDPVVEL; RDYQHIDPVVELV; DYQHIDPVVELVP; YQHIDPVVELVPV; QHIDPVVELVPVR; HIDPVVELVPVRP; IDPVVELVPVRPV; DPVVELVPVRPVV; PVVELVPVRPVVH; VVELVPVRPVVHY; VELVPVRPVVHYM; ELVPVRPVVHYMM; LVPVRPVVHYMMG; VPVRPVVHYMMGG; PVRPVVHYMMGGV; VRPVVHYMMGGVH; RPVVHYMMGGVHT; PVVHYMMGGVHTD; VVHYMMGGVHTDI; VHYMMGGVHTDIN; HYMMGGVHTDING; YMMGGVHTDINGA; MMGGVHTDINGAT; MGGVHTDINGATT; GGVHTDINGATTL; GVHTDINGATTLP; VHTDINGATTLPG; HTDINGATTLPGL; TDINGATTLPGLY; DINGATTLPGLYA; INGATTLPGLYAA; NGATTLPGLYAAG; GATTLPGLYAAGE; ATTLPGLYAAGET; TTLPGLYAAGETA; TLPGLYAAGETAC; LPGLYAAGETACV; PGLYAAGETACVS; GLYAAGETACVSI; LYAAGETACVSIN; YAAGETACVSING; AAGETACVSINGA; AGETACVSINGAN; GETACVSINGANR; ETACVSINGANRL; TACVSINGANRLG; ACVSINGANRLGS; CVSINGANRLGSN; VSINGANRLGSNS; SINGANRLGSNSL; INGANRLGSNSLP; NGANRLGSNSLPE; GANRLGSNSLPEL; ANRLGSNSLPELL; NRLGSNSLPELLV; RLGSNSLPELLVF; LGSNSLPELLVFG; GSNSLPELLVFGA; SNSLPELLVFGAR; NSLPELLVFGARA; SLPELLVFGARAG; LPELLVFGARAGR; PELLVFGARAGRA; ELLVFGARAGRAA; LLVFGARAGRAAA; LVFGARAGRAAAD; VFGARAGRAAADY; FGARAGRAAADYA; GARAGRAAADYAA; ARAGRAAADYAAR; RAGRAAADYAARH; AGRAAADYAARHQ; GRAAADYAARHQK; RAAADYAARHQKS; AAADYAARHQKSD; AADYAARHQKSDR; ADYAARHQKSDRG; DYAARHQKSDRGP; YAARHQKSDRGPS; AARHQKSDRGPSS; ARHQKSDRGPSSA; RHQKSDRGPSSAV; HQKSDRGPSSAVR; QKSDRGPSSAVRA; KSDRGPSSAVRAQ; SDRGPSSAVRAQA; DRGPSSAVRAQAR; RGPSSAVRAQART; GPSSAVRAQARTE; PSSAVRAQARTEA; SSAVRAQARTEAL; SAVRAQARTEALR; AVRAQARTEALRL; VRAQARTEALRLE; RAQARTEALRLER; AQARTEALRLERE; QARTEALRLEREL; ARTEALRLERELS; RTEALRLERELSR; TEALRLERELSRH; EALRLERELSRHG; ALRLERELSRHGQ; LRLERELSRHGQG; RLERELSRHGQGG; LERELSRHGQGGE; ERELSRHGQGGER; RELSRHGQGGERI; ELSRHGQGGERIA; LSRHGQGGERIAD; SRHGQGGERIADI; RHGQGGERIADIR; HGQGGERIADIRA; | |

Fig. 29 continued

GQGGERIADIRAD; QGGERIADIRADM; GGERIADIRADMQ; GERIADIRADMQA;
ERIADIRADMQAT; RIADIRADMQATL; IADIRADMQATLE; ADIRADMQATLES;
DIRADMQATLESA; IRADMQATLESAA; RADMQATLESAAG; ADMQATLESAAGI;
DMQATLESAAGIY; MQATLESAAGIYR; QATLESAAGIYRD; ATLESAAGIYRDG;
TLESAAGIYRDGP; LESAAGIYRDGPT; ESAAGIYRDGPTL; SAAGIYRDGPTLT;
AAGIYRDGPTLTK; AGIYRDGPTLTKA; GIYRDGPTLTKAV; IYRDGPTLTKAVE;
YRDGPTLTKAVEE; RDGPTLTKAVEEI; DGPTLTKAVEEIR; GPTLTKAVEEIRV;
PTLTKAVEEIRVL; TLTKAVEEIRVLQ; LTKAVEEIRVLQE; TKAVEEIRVLQER;
KAVEEIRVLQERF; AVEEIRVLQERFA; VEEIRVLQERFAT; EEIRVLQERFATA;
EIRVLQERFATAG; IRVLQERFATAGI; RVLQERFATAGID; VLQERFATAGIDD;
LQERFATAGIDDH; QERFATAGIDDHS; ERFATAGIDDHSR; RFATAGIDDHSRT;
FATAGIDDHSRTF; ATAGIDDHSRTFN; TAGIDDHSRTFNT; AGIDDHSRTFNTE;
GIDDHSRTFNTEL; IDDHSRTFNTELT; DDHSRTFNTELTA; DHSRTFNTELTAL;
HSRTFNTELTALL; SRTFNTELTALLE; RTFNTELTALLEL; TFNTELTALLELS;
FNTELTALLELSG; NTELTALLELSGM; TELTALLELSGML; ELTALLELSGMLD;
LTALLELSGMLDV; TALLELSGMLDVA; ALLELSGMLDVAL; LLELSGMLDVALA;
LELSGMLDVALAI; ELSGMLDVALAIV; LSGMLDVALAIVE; SGMLDVALAIVES;
GMLDVALAIVESG; MLDVALAIVESGL; LDVALAIVESGLR; DVALAIVESGLRR;
VALAIVESGLRRE; ALAIVESGLRREE; LAIVESGLRREES; AIVESGLRREESR;
IVESGLRREESRG; VESGLRREESRGA; ESGLRREESRGAH;
SGLRREESRGAHQ; GLRREESRGAHQR; LRREESRGAHQRT;
RREESRGAHQRTD; REESRGAHQRTDF; EESRGAHQRTDFP;
ESRGAHQRTDFPN; SRGAHQRTDFPNR; RGAHQRTDFPNRD;
GAHQRTDFPNRDD; AHQRTDFPNRDDE; HQRTDFPNRDDEH;
QRTDFPNRDDEHF; RTDFPNRDDEHFL; TDFPNRDDEHFLA; DFPNRDDEHFLAH;
FPNRDDEHFLAHT; PNRDDEHFLAHTL; NRDDEHFLAHTLV; RDDEHFLAHTLVH;
DDEHFLAHTLVHR; DEHFLAHTLVHRE; EHFLAHTLVHRES; HFLAHTLVHRESD;
FLAHTLVHRESDG; LAHTLVHRESDGT; AHTLVHRESDGTL; HTLVHRESDGTLR;
TLVHRESDGTLRV; LVHRESDGTLRVG; VHRESDGTLRVGY; HRESDGTLRVGYL;
RESDGTLRVGYLP; ESDGTLRVGYLPV; SDGTLRVGYLPVT; DGTLRVGYLPVTI;
GTLRVGYLPVTIT; TLRVGYLPVTITR; LRVGYLPVTITRW; RVGYLPVTITRWP;
VGYLPVTITRWPP; GYLPVTITRWPPG; YLPVTITRWPPGE; LPVTITRWPPGER;
PVTITRWPPGERV; VTITRWPPGERVY; TITRWPPGERVYG; ITRWPPGERVYGR 14 mers:
MTAQHNIVVIGGGG; TAQHNIVVIGGGGA; AQHNIVVIGGGGAG;
QHNIVVIGGGGAGL; HNIVVIGGGGAGLR; NIVVIGGGGAGLRA;
IVVIGGGGAGLRAA; VVIGGGGAGLRAAI; VIGGGGAGLRAAIA;
IGGGGAGLRAAIAI; GGGGAGLRAAIAIA; GGGAGLRAAIAIAE;
GGAGLRAAIAIAET; GAGLRAAIAIAETN; AGLRAAIAIAETNP; GLRAAIAIAETNPH;
LRAAIAIAETNPHL; RAAIAIAETNPHLD; AAIAIAETNPHLDV; AIAIAETNPHLDVA;
IAIAETNPHLDVAI; AIAETNPHLDVAIV; IAETNPHLDVAIVS; AETNPHLDVAIVSK;
ETNPHLDVAIVSKV; TNPHLDVAIVSKVY; NPHLDVAIVSKVYP;
PHLDVAIVSKVYPM; HLDVAIVSKVYPMR; LDVAIVSKVYPMRS;
DVAIVSKVYPMRSH; VAIVSKVYPMRSHT; AIVSKVYPMRSHTV;
IVSKVYPMRSHTVS; VSKVYPMRSHTVSA; SKVYPMRSHTVSAE;
KVYPMRSHTVSAEG; VYPMRSHTVSAEGG; YPMRSHTVSAEGGA;
PMRSHTVSAEGGAA; MRSHTVSAEGGAAA; RSHTVSAEGGAAAV;
SHTVSAEGGAAAVT; HTVSAEGGAAAVTG; TVSAEGGAAAVTGD;
VSAEGGAAAVTGDD; SAEGGAAAVTGDDD; AEGGAAAVTGDDDS;
EGGAAAVTGDDDSL; GGAAAVTGDDDSLD; GAAAVTGDDDSLDE;
AAAVTGDDDSLDEH; AAVTGDDDSLDEHA; AVTGDDDSLDEHAH;
VTGDDDSLDEHAHD; TGDDDSLDEHAHDT; GDDDSLDEHAHDTV;

Fig. 29 continued

| | | |
|---|---|---|
| | DDDSLDEHAHDTVS; DDSLDEHAHDTVSG; DSLDEHAHDTVSGG; SLDEHAHDTVSGGD; LDEHAHDTVSGGDW; DEHAHDTVSGGDWL; EHAHDTVSGGDWLC; HAHDTVSGGDWLCD; AHDTVSGGDWLCDQ; HDTVSGGDWLCDQD; DTVSGGDWLCDQDA; TVSGGDWLCDQDAV; VSGGDWLCDQDAVE; SGGDWLCDQDAVEA; GGDWLCDQDAVEAF; GDWLCDQDAVEAFV; DWLCDQDAVEAFVA; WLCDQDAVEAFVAE; LCDQDAVEAFVAEA; CDQDAVEAFVAEAP; DQDAVEAFVAEAPK; QDAVEAFVAEAPKE; DAVEAFVAEAPKEL; AVEAFVAEAPKELV; VEAFVAEAPKELVQ; EAFVAEAPKELVQL; AFVAEAPKELVQLE; FVAEAPKELVQLEH; VAEAPKELVQLEHW; AEAPKELVQLEHWG; EAPKELVQLEHWGC; APKELVQLEHWGCP; PKELVQLEHWGCPW; KELVQLEHWGCPWS; ELVQLEHWGCPWSR; LVQLEHWGCPWSRK; VQLEHWGCPWSRKP; QLEHWGCPWSRKPD; LEHWGCPWSRKPDG; EHWGCPWSRKPDGR; HWGCPWSRKPDGRV; WGCPWSRKPDGRVA; GCPWSRKPDGRVAV; CPWSRKPDGRVAVR; PWSRKPDGRVAVRP; WSRKPDGRVAVRPF; SRKPDGRVAVRPFG; RKPDGRVAVRPFGG; KPDGRVAVRPFGGM; PDGRVAVRPFGGMK; DGRVAVRPFGGMKK; GRVAVRPFGGMKKL; RVAVRPFGGMKKLR; VAVRPFGGMKKLRT; AVRPFGGMKKLRTW; VRPFGGMKKLRTWF; RPFGGMKKLRTWFA; PFGGMKKLRTWFAA; FGGMKKLRTWFAAD; GGMKKLRTWFAADK; GMKKLRTWFAADKT; MKKLRTWFAADKTG; KKLRTWFAADKTGF; KLRTWFAADKTGFH; LRTWFAADKTGFHL; RTWFAADKTGFHLL; TWFAADKTGFHLLH; WFAADKTGFHLLHT; FAADKTGFHLLHTL; AADKTGFHLLHTLF; ADKTGFHLLHTLFQ; DKTGFHLLHTLFQR; KTGFHLLHTLFQRL; TGFHLLHTLFQRLL; GFHLLHTLFQRLLT; FHLLHTLFQRLLTY; HLLHTLFQRLLTYS; LLHTLFQRLLTYSD; LHTLFQRLLTYSDV; HTLFQRLLTYSDVM; TLFQRLLTYSDVMR; LFQRLLTYSDVMRY; FQRLLTYSDVMRYD; QRLLTYSDVMRYDE; RLLTYSDVMRYDEW; LLTYSDVMRYDEWF; LTYSDVMRYDEWFA; TYSDVMRYDEWFAT; YSDVMRYDEWFATT; SDVMRYDEWFATTL; DVMRYDEWFATTLL; VMRYDEWFATTLLV; MRYDEWFATTLLVD; RYDEWFATTLLVDD; YDEWFATTLLVDDG; DEWFATTLLVDDGR; EWFATTLLVDDGRV; WFATTLLVDDGRVC; FATTLLVDDGRVCG; ATTLLVDDGRVCGL; TTLLVDDGRVCGLV; TLLVDDGRVCGLVA; LLVDDGRVCGLVAI; LVDDGRVCGLVAIE; VDDGRVCGLVAIEL; DDGRVCGLVAIELA; DGRVCGLVAIELAT; GRVCGLVAIELATG; RVCGLVAIELATGR; VCGLVAIELATGRI; CGLVAIELATGRIE; GLVAIELATGRIET; LVAIELATGRIETI; VAIELATGRIETIL; AIELATGRIETILA; IELATGRIETILAD; ELATGRIETILADA; LATGRIETILADAV; ATGRIETILADAVI; TGRIETILADAVIL; GRIETILADAVILC; RIETILADAVILCT; IETILADAVILCTG; ETILADAVILCTGG; TILADAVILCTGGC; ILADAVILCTGGCG; LADAVILCTGGCGR; ADAVILCTGGCGRV; DAVILCTGGCGRVF; AVILCTGGCGRVFP; VILCTGGCGRVFPF; ILCTGGCGRVFPFT; LCTGGCGRVFPFTT; CTGGCGRVFPFTTN; TGGCGRVFPFTTNA; GGCGRVFPFTTNAN; GCGRVFPFTTNANI; CGRVFPFTTNANIK; GRVFPFTTNANIKT; RVFPFTTNANIKTG; VFPFTTNANIKTGD; FPFTTNANIKTGDG; PFTTNANIKTGDGM; FTTNANIKTGDGMA; TTNANIKTGDGMAL; TNANIKTGDGMALA; NANIKTGDGMALAF; ANIKTGDGMALAFR; NIKTGDGMALAFRA; IKTGDGMALAFRAG; KTGDGMALAFRAGA; TGDGMALAFRAGAP; GDGMALAFRAGAPL; DGMALAFRAGAPLK; GMALAFRAGAPLKD; MALAFRAGAPLKDM; ALAFRAGAPLKDME; LAFRAGAPLKDMEF; AFRAGAPLKDMEFV; FRAGAPLKDMEFVQ; RAGAPLKDMEFVQY; AGAPLKDMEFVQYH; GAPLKDMEFVQYHP; | |

Fig. 29 continued

| | | |
|---|---|---|
| | APLKDMEFVQYHPT; PLKDMEFVQYHPTG; LKDMEFVQYHPTGL; KDMEFVQYHPTGLP; DMEFVQYHPTGLPF; MEFVQYHPTGLPFT; EFVQYHPTGLPFTG; FVQYHPTGLPFTGI; VQYHPTGLPFTGIL; QYHPTGLPFTGILI; YHPTGLPFTGILIT; HPTGLPFTGILITE; PTGLPFTGILITEA; TGLPFTGILITEAA; GLPFTGILITEAAR; LPFTGILITEAARA; PFTGILITEAARAE; FTGILITEAARAEG; TGILITEAARAEGG; GILITEAARAEGGW; ILITEAARAEGGWL; LITEAARAEGGWLL; ITEAARAEGGWLLN; TEAARAEGGWLLNK; EAARAEGGWLLNKD; AARAEGGWLLNKDG; ARAEGGWLLNKDGY; RAEGGWLLNKDGYR; AEGGWLLNKDGYRY; EGGWLLNKDGYRYL; GGWLLNKDGYRYLQ; GWLLNKDGYRYLQD; WLLNKDGYRYLQDY; LLNKDGYRYLQDYD; LNKDGYRYLQDYDL; NKDGYRYLQDYDLG; KDGYRYLQDYDLGK; DGYRYLQDYDLGKP; GYRYLQDYDLGKPT; YRYLQDYDLGKPTP; RYLQDYDLGKPTPE; YLQDYDLGKPTPEP; LQDYDLGKPTPEPR; QDYDLGKPTPEPRL; DYDLGKPTPEPRLR; YDLGKPTPEPRLRS; DLGKPTPEPRLRSM; LGKPTPEPRLRSME; GKPTPEPRLRSMEL; KPTPEPRLRSMELG; PTPEPRLRSMELGP; TPEPRLRSMELGPR; PEPRLRSMELGPRD; EPRLRSMELGPRDR; PRLRSMELGPRDRL; RLRSMELGPRDRLS; LRSMELGPRDRLSQ; RSMELGPRDRLSQA; SMELGPRDRLSQAF; MELGPRDRLSQAFV; ELGPRDRLSQAFVH; LGPRDRLSQAFVHE; GPRDRLSQAFVHEH; PRDRLSQAFVHEHN; RDRLSQAFVHEHNK; DRLSQAFVHEHNKG; RLSQAFVHEHNKGR; LSQAFVHEHNKGRT; SQAFVHEHNKGRTV; QAFVHEHNKGRTVD; AFVHEHNKGRTVDT; FVHEHNKGRTVDTP; VHEHNKGRTVDTPY; HEHNKGRTVDTPYG; EHNKGRTVDTPYGP; HNKGRTVDTPYGPV; NKGRTVDTPYGPVV; KGRTVDTPYGPVVY; GRTVDTPYGPVVYL; RTVDTPYGPVVYLD; TVDTPYGPVVYLDL; VDTPYGPVVYLDLR; DTPYGPVVYLDLRH; TPYGPVVYLDLRHL; PYGPVVYLDLRHLG; YGPVVYLDLRHLGA; GPVVYLDLRHLGAD; PVVYLDLRHLGADL; VVYLDLRHLGADLI; VYLDLRHLGADLID; YLDLRHLGADLIDA; LDLRHLGADLIDAK; DLRHLGADLIDAKL; LRHLGADLIDAKLP; RHLGADLIDAKLPF; HLGADLIDAKLPFV; LGADLIDAKLPFVR; GADLIDAKLPFVRE; ADLIDAKLPFVREL; DLIDAKLPFVRELC; LIDAKLPFVRELCR; IDAKLPFVRELCRD; DAKLPFVRELCRDY; AKLPFVRELCRDYQ; KLPFVRELCRDYQH; LPFVRELCRDYQHI; PFVRELCRDYQHID; FVRELCRDYQHIDP; VRELCRDYQHIDPV; RELCRDYQHIDPVV; ELCRDYQHIDPVVE; LCRDYQHIDPVVEL; CRDYQHIDPVVELV; RDYQHIDPVVELVP; DYQHIDPVVELVPV; YQHIDPVVELVPVR; QHIDPVVELVPVRP; HIDPVVELVPVRPV; IDPVVELVPVRPVV; DPVVELVPVRPVVH; PVVELVPVRPVVHY; VVELVPVRPVVHYM; VELVPVRPVVHYMM; ELVPVRPVVHYMMG; LVPVRPVVHYMMGG; VPVRPVVHYMMGGV; PVRPVVHYMMGGVH; VRPVVHYMMGGVHT; RPVVHYMMGGVHTD; PVVHYMMGGVHTDI; VVHYMMGGVHTDIN; VHYMMGGVHTDING; HYMMGGVHTDINGA; YMMGGVHTDINGAT; MMGGVHTDINGATT; MGGVHTDINGATTL; GGVHTDINGATTLP; GVHTDINGATTLPG; VHTDINGATTLPGL; HTDINGATTLPGLY; TDINGATTLPGLYA; DINGATTLPGLYAA; INGATTLPGLYAAG; NGATTLPGLYAAGE; GATTLPGLYAAGET; ATTLPGLYAAGETA; TTLPGLYAAGETAC; TLPGLYAAGETACV; LPGLYAAGETACVS; PGLYAAGETACVSI; GLYAAGETACVSIN; LYAAGETACVSING; YAAGETACVSINGA; AAGETACVSINGAN; AGETACVSINGANR; GETACVSINGANRL; ETACVSINGANRLG; TACVSINGANRLGS; ACVSINGANRLGSN; CVSINGANRLGSNS; VSINGANRLGSNSL; SINGANRLGSNSLP; INGANRLGSNSLPE; NGANRLGSNSLPEL; | |

Fig. 29 continued

| | | |
|---|---|---|
| | GANRLGSNSLPELL; ANRLGSNSLPELLV; NRLGSNSLPELLVF; RLGSNSLPELLVFG; LGSNSLPELLVFGA; GSNSLPELLVFGAR; SNSLPELLVFGARA; NSLPELLVFGARAG; SLPELLVFGARAGR; LPELLVFGARAGRA; PELLVFGARAGRAA; ELLVFGARAGRAAA; LLVFGARAGRAAAD; LVFGARAGRAAADY; VFGARAGRAAADYA; FGARAGRAAADYAA; GARAGRAAADYAAR; ARAGRAAADYAARH; RAGRAAADYAARHQ; AGRAAADYAARHQK; GRAAADYAARHQKS; RAAADYAARHQKSD; AAADYAARHQKSDR; AADYAARHQKSDRG; ADYAARHQKSDRGP; DYAARHQKSDRGPS; YAARHQKSDRGPSS; AARHQKSDRGPSSA; ARHQKSDRGPSSAV; RHQKSDRGPSSAVR; HQKSDRGPSSAVRA; QKSDRGPSSAVRAQ; KSDRGPSSAVRAQA; SDRGPSSAVRAQAR; DRGPSSAVRAQART; RGPSSAVRAQARTE; GPSSAVRAQARTEA; PSSAVRAQARTEAL; SSAVRAQARTEALR; SAVRAQARTEALRL; AVRAQARTEALRLE; VRAQARTEALRLER; RAQARTEALRLERE; AQARTEALRLEREL; QARTEALRLERELS; ARTEALRLERELSR; RTEALRLERELSRH; TEALRLERELSRHG; EALRLERELSRHGQ; ALRLERELSRHGQG; LRLERELSRHGQGG; RLERELSRHGQGGE; LERELSRHGQGGER; ERELSRHGQGGERI; RELSRHGQGGERIA; ELSRHGQGGERIAD; LSRHGQGGERIADI; SRHGQGGERIADIR; RHGQGGERIADIRA; HGQGGERIADIRAD; GQGGERIADIRADM; QGGERIADIRADMQ; GGERIADIRADMQA; GERIADIRADMQAT; ERIADIRADMQATL; RIADIRADMQATLE; IADIRADMQATLES; ADIRADMQATLESA; DIRADMQATLESAA; IRADMQATLESAAG; RADMQATLESAAGI; ADMQATLESAAGIY; DMQATLESAAGIYR; MQATLESAAGIYRD; QATLESAAGIYRDG; ATLESAAGIYRDGP; TLESAAGIYRDGPT; LESAAGIYRDGPTL; ESAAGIYRDGPTLT; SAAGIYRDGPTLTK; AAGIYRDGPTLTKA; AGIYRDGPTLTKAV; GIYRDGPTLTKAVE; IYRDGPTLTKAVEE; YRDGPTLTKAVEEI; RDGPTLTKAVEEIR; DGPTLTKAVEEIRV; GPTLTKAVEEIRVL; PTLTKAVEEIRVLQ; TLTKAVEEIRVLQE; LTKAVEEIRVLQER; TKAVEEIRVLQERF; KAVEEIRVLQERFA; AVEEIRVLQERFAT; VEEIRVLQERFATA; EEIRVLQERFATAG; EIRVLQERFATAGI; IRVLQERFATAGID; RVLQERFATAGIDD; VLQERFATAGIDDH; LQERFATAGIDDHS; QERFATAGIDDHSR; ERFATAGIDDHSRT; RFATAGIDDHSRTF; FATAGIDDHSRTFN; ATAGIDDHSRTFNT; TAGIDDHSRTFNTE; AGIDDHSRTFNTEL; GIDDHSRTFNTELT; IDDHSRTFNTELTA; DDHSRTFNTELTAL; DHSRTFNTELTALL; HSRTFNTELTALLE; SRTFNTELTALLEL; RTFNTELTALLELS; TFNTELTALLELSG; FNTELTALLELSGM; NTELTALLELSGML; TELTALLELSGMLD; ELTALLELSGMLDV; LTALLELSGMLDVA; TALLELSGMLDVAL; ALLELSGMLDVALA; LLELSGMLDVALAI; LELSGMLDVALAIV; ELSGMLDVALAIVE; LSGMLDVALAIVES; SGMLDVALAIVESG; GMLDVALAIVESGL; MLDVALAIVESGLR; LDVALAIVESGLRR; DVALAIVESGLRRE; VALAIVESGLRREE; ALAIVESGLRREES; LAIVESGLRREESR; AIVESGLRREESRG; IVESGLRREESRGA; VESGLRREESRGAH; ESGLRREESRGAHQ; SGLRREESRGAHQR; GLRREESRGAHQRT; LRREESRGAHQRTD; RREESRGAHQRTDF; REESRGAHQRTDFP; EESRGAHQRTDFPN; ESRGAHQRTDFPNR; SRGAHQRTDFPNRD; RGAHQRTDFPNRDD; GAHQRTDFPNRDDE; AHQRTDFPNRDDEH; HQRTDFPNRDDEHF; QRTDFPNRDDEHFL; RTDFPNRDDEHFLA; TDFPNRDDEHFLAH; DFPNRDDEHFLAHT; FPNRDDEHFLAHTL; PNRDDEHFLAHTLV; NRDDEHFLAHTLVH; RDDEHFLAHTLVHR; DDEHFLAHTLVHRE; DEHFLAHTLVHRES; | |

Fig. 29 continued

| | | | |
|---|---|---|---|
| | EHFLAHTLVHRESD; HFLAHTLVHRESDG; FLAHTLVHRESDGT; LAHTLVHRESDGTL; AHTLVHRESDGTLR; HTLVHRESDGTLRV; TLVHRESDGTLRVG; LVHRESDGTLRVGY; VHRESDGTLRVGYL; HRESDGTLRVGYLP; RESDGTLRVGYLPV; ESDGTLRVGYLPVT; SDGTLRVGYLPVTI; DGTLRVGYLPVTIT; GTLRVGYLPVTITR; TLRVGYLPVTITRW; LRVGYLPVTITRWP; RVGYLPVTITRWPP; VGYLPVTITRWPPG; GYLPVTITRWPPGE; YLPVTITRWPPGER; LPVTITRWPPGERV; PVTITRWPPGERVY; VTITRWPPGERVYG; TITRWPPGERVYGR<br><br>15 mers:<br>MTAQHNIVVIGGGGA; TAQHNIVVIGGGGAG; AQHNIVVIGGGGAGL; QHNIVVIGGGGAGLR; HNIVVIGGGGAGLRA; NIVVIGGGGAGLRAA; IVVIGGGGAGLRAAI; VVIGGGGAGLRAAIA; VIGGGGAGLRAAIAI; IGGGGAGLRAAIAIA; GGGGAGLRAAIAIAE; GGGAGLRAAIAIAET; GGAGLRAAIAIAETN; GAGLRAAIAIAETNP; AGLRAAIAIAETNPH; GLRAAIAIAETNPHL; LRAAIAIAETNPHLD; RAAIAIAETNPHLDV; AAIAIAETNPHLDVA; AIAIAETNPHLDVAI; IAIAETNPHLDVAIV; AIAETNPHLDVAIVS; IAETNPHLDVAIVSK; AETNPHLDVAIVSKV; ETNPHLDVAIVSKVY; TNPHLDVAIVSKVYP; NPHLDVAIVSKVYPM; PHLDVAIVSKVYPMR; HLDVAIVSKVYPMRS; LDVAIVSKVYPMRSH; DVAIVSKVYPMRSHT; VAIVSKVYPMRSHTV; AIVSKVYPMRSHTVS; IVSKVYPMRSHTVSA; VSKVYPMRSHTVSAE; SKVYPMRSHTVSAEG; KVYPMRSHTVSAEGG; VYPMRSHTVSAEGGA; YPMRSHTVSAEGGAA; PMRSHTVSAEGGAAA; MRSHTVSAEGGAAAV; RSHTVSAEGGAAAVT; SHTVSAEGGAAAVTG; HTVSAEGGAAAVTGD; TVSAEGGAAAVTGDD; VSAEGGAAAVTGDDD; SAEGGAAAVTGDDDS; AEGGAAAVTGDDDSL; EGGAAAVTGDDDSLD; GGAAAVTGDDDSLDE; GAAAVTGDDDSLDEH; AAAVTGDDDSLDEHA; AAVTGDDDSLDEHAH; AVTGDDDSLDEHAHD; VTGDDDSLDEHAHDT; TGDDDSLDEHAHDTV; GDDDSLDEHAHDTVS; DDDSLDEHAHDTVSG; DDSLDEHAHDTVSGG; DSLDEHAHDTVSGGD; SLDEHAHDTVSGGDW; LDEHAHDTVSGGDWL; DEHAHDTVSGGDWLC; EHAHDTVSGGDWLCD; HAHDTVSGGDWLCDQ; AHDTVSGGDWLCDQD; HDTVSGGDWLCDQDA; DTVSGGDWLCDQDAV; TVSGGDWLCDQDAVE; VSGGDWLCDQDAVEA; SGGDWLCDQDAVEAF; GGDWLCDQDAVEAFV; GDWLCDQDAVEAFVA; DWLCDQDAVEAFVAE; WLCDQDAVEAFVAEA; LCDQDAVEAFVAEAP; CDQDAVEAFVAEAPK; DQDAVEAFVAEAPKE; QDAVEAFVAEAPKEL; DAVEAFVAEAPKELV; AVEAFVAEAPKELVQ; VEAFVAEAPKELVQL; EAFVAEAPKELVQLE; AFVAEAPKELVQLEH; FVAEAPKELVQLEHW; VAEAPKELVQLEHWG; AEAPKELVQLEHWGC; EAPKELVQLEHWGCP; APKELVQLEHWGCPW; PKELVQLEHWGCPWS; KELVQLEHWGCPWSR; ELVQLEHWGCPWSRK; LVQLEHWGCPWSRKP; VQLEHWGCPWSRKPD; QLEHWGCPWSRKPDG; LEHWGCPWSRKPDGR; EHWGCPWSRKPDGRV; HWGCPWSRKPDGRVA; WGCPWSRKPDGRVAV; GCPWSRKPDGRVAVR; CPWSRKPDGRVAVRP; PWSRKPDGRVAVRPF; WSRKPDGRVAVRPFG; SRKPDGRVAVRPFGG; RKPDGRVAVRPFGGM; KPDGRVAVRPFGGMK; PDGRVAVRPFGGMKK; DGRVAVRPFGGMKKL; GRVAVRPFGGMKKLR; RVAVRPFGGMKKLRT; VAVRPFGGMKKLRTW; AVRPFGGMKKLRTWF; VRPFGGMKKLRTWFA; RPFGGMKKLRTWFAA; PFGGMKKLRTWFAAD; FGGMKKLRTWFAADK; GGMKKLRTWFAADKT; GMKKLRTWFAADKTG; MKKLRTWFAADKTGF; KKLRTWFAADKTGFH; KLRTWFAADKTGFHL; LRTWFAADKTGFHLL; RTWFAADKTGFHLLH; TWFAADKTGFHLLHT; WFAADKTGFHLLHTL; FAADKTGFHLLHTLF; | |

Fig. 29 continued

| | | |
|---|---|---|
| | AADKTGFHLLHTLFQ; ADKTGFHLLHTLFQR; DKTGFHLLHTLFQRL;<br>KTGFHLLHTLFQRLL; TGFHLLHTLFQRLLT; GFHLLHTLFQRLLTY;<br>FHLLHTLFQRLLTYS; HLLHTLFQRLLTYSD; LLHTLFQRLLTYSDV;<br>LHTLFQRLLTYSDVM; HTLFQRLLTYSDVMR; TLFQRLLTYSDVMRY;<br>LFQRLLTYSDVMRYD; FQRLLTYSDVMRYDE; QRLLTYSDVMRYDEW;<br>RLLTYSDVMRYDEWF; LLTYSDVMRYDEWFA; LTYSDVMRYDEWFAT;<br>TYSDVMRYDEWFATT; YSDVMRYDEWFATTL; SDVMRYDEWFATTLL;<br>DVMRYDEWFATTLLV; VMRYDEWFATTLLVD; MRYDEWFATTLLVDD;<br>RYDEWFATTLLVDDG; YDEWFATTLLVDDGR; DEWFATTLLVDDGRV;<br>EWFATTLLVDDGRVC; WFATTLLVDDGRVCG; FATTLLVDDGRVCGL;<br>ATTLLVDDGRVCGLV; TTLLVDDGRVCGLVA; TLLVDDGRVCGLVAI;<br>LLVDDGRVCGLVAIE; LVDDGRVCGLVAIEL; VDDGRVCGLVAIELA;<br>DDGRVCGLVAIELAT; DGRVCGLVAIELATG; GRVCGLVAIELATGR;<br>RVCGLVAIELATGRI; VCGLVAIELATGRIE; CGLVAIELATGRIET;<br>GLVAIELATGRIETI; LVAIELATGRIETIL; VAIELATGRIETILA; AIELATGRIETILAD;<br>IELATGRIETILADA; ELATGRIETILADAV; LATGRIETILADAVI; ATGRIETILADAVIL;<br>TGRIETILADAVILC; GRIETILADAVILCT; RIETILADAVILCTG; IETILADAVILCTGG;<br>ETILADAVILCTGGC; TILADAVILCTGGCG; ILADAVILCTGGCGR;<br>LADAVILCTGGCGRV; ADAVILCTGGCGRVF; DAVILCTGGCGRVFP;<br>AVILCTGGCGRVFPF; VILCTGGCGRVFPFT; ILCTGGCGRVFPFTT;<br>LCTGGCGRVFPFTTN; CTGGCGRVFPFTTNA; TGGCGRVFPFTTNAN;<br>GGCGRVFPFTTNANI; GCGRVFPFTTNANIK; CGRVFPFTTNANIKT;<br>GRVFPFTTNANIKTG; RVFPFTTNANIKTGD; VFPFTTNANIKTGDG;<br>FPFTTNANIKTGDGM; PFTTNANIKTGDGMA; FTTNANIKTGDGMAL;<br>TTNANIKTGDGMALA; TNANIKTGDGMALAF; NANIKTGDGMALAFR;<br>ANIKTGDGMALAFRA; NIKTGDGMALAFRAG; IKTGDGMALAFRAGA;<br>KTGDGMALAFRAGAP; TGDGMALAFRAGAPL; GDGMALAFRAGAPLK;<br>DGMALAFRAGAPLKD; GMALAFRAGAPLKDM; MALAFRAGAPLKDME;<br>ALAFRAGAPLKDMEF; LAFRAGAPLKDMEFV; AFRAGAPLKDMEFVQ;<br>FRAGAPLKDMEFVQY; RAGAPLKDMEFVQYH; AGAPLKDMEFVQYHP;<br>GAPLKDMEFVQYHPT; APLKDMEFVQYHPTG; PLKDMEFVQYHPTGL;<br>LKDMEFVQYHPTGLP; KDMEFVQYHPTGLPF; DMEFVQYHPTGLPFT;<br>MEFVQYHPTGLPFTG; EFVQYHPTGLPFTGI; FVQYHPTGLPFTGIL;<br>VQYHPTGLPFTGILI; QYHPTGLPFTGILIT; YHPTGLPFTGILITE;<br>HPTGLPFTGILITEA; PTGLPFTGILITEAA; TGLPFTGILITEAAR;<br>GLPFTGILITEAARA; LPFTGILITEAARAE; PFTGILITEAARAEG;<br>FTGILITEAARAEGG; TGILITEAARAEGGW; GILITEAARAEGGWL;<br>ILITEAARAEGGWLL; LITEAARAEGGWLLN; ITEAARAEGGWLLNK;<br>TEAARAEGGWLLNKD; EAARAEGGWLLNKDG; AARAEGGWLLNKDGY;<br>ARAEGGWLLNKDGYR; RAEGGWLLNKDGYRY; AEGGWLLNKDGYRYL;<br>EGGWLLNKDGYRYLQ; GGWLLNKDGYRYLQD; GWLLNKDGYRYLQDY;<br>WLLNKDGYRYLQDYD; LLNKDGYRYLQDYDL; LNKDGYRYLQDYDLG;<br>NKDGYRYLQDYDLGK; KDGYRYLQDYDLGKP; DGYRYLQDYDLGKPT;<br>GYRYLQDYDLGKPTP; YRYLQDYDLGKPTPE; RYLQDYDLGKPTPEP;<br>YLQDYDLGKPTPEPR; LQDYDLGKPTPEPRL; QDYDLGKPTPEPRLR;<br>DYDLGKPTPEPRLRS; YDLGKPTPEPRLRSM; DLGKPTPEPRLRSME;<br>LGKPTPEPRLRSMEL; GKPTPEPRLRSMELG; KPTPEPRLRSMELGP;<br>PTPEPRLRSMELGPR; TPEPRLRSMELGPRD; PEPRLRSMELGPRDR;<br>EPRLRSMELGPRDRL; PRLRSMELGPRDRLS; RLRSMELGPRDRLSQ;<br>LRSMELGPRDRLSQA; RSMELGPRDRLSQAF; SMELGPRDRLSQAFV;<br>MELGPRDRLSQAFVH; ELGPRDRLSQAFVHE; LGPRDRLSQAFVHEH;<br>GPRDRLSQAFVHEHN; PRDRLSQAFVHEHNK; RDRLSQAFVHEHNKG;<br>DRLSQAFVHEHNKGR; RLSQAFVHEHNKGRT; LSQAFVHEHNKGRTV; | |

Fig. 29 continued

| | | |
|---|---|---|
| | SQAFVHEHNKGRTVD; QAFVHEHNKGRTVDT; AFVHEHNKGRTVDTP; FVHEHNKGRTVDTPY; VHEHNKGRTVDTPYG; HEHNKGRTVDTPYGP; EHNKGRTVDTPYGPV; HNKGRTVDTPYGPVV; NKGRTVDTPYGPVVY; KGRTVDTPYGPVVYL; GRTVDTPYGPVVYLD; RTVDTPYGPVVYLDL; TVDTPYGPVVYLDLR; VDTPYGPVVYLDLRH; DTPYGPVVYLDLRHL; TPYGPVVYLDLRHLG; PYGPVVYLDLRHLGA; YGPVVYLDLRHLGAD; GPVVYLDLRHLGADL; PVVYLDLRHLGADLI; VVYLDLRHLGADLID; VYLDLRHLGADLIDA; YLDLRHLGADLIDAK; LDLRHLGADLIDAKL; DLRHLGADLIDAKLP; LRHLGADLIDAKLPF; RHLGADLIDAKLPFV; HLGADLIDAKLPFVR; LGADLIDAKLPFVRE; GADLIDAKLPFVREL; ADLIDAKLPFVRELC; DLIDAKLPFVRELCR; LIDAKLPFVRELCRD; IDAKLPFVRELCRDY; DAKLPFVRELCRDYQ; AKLPFVRELCRDYQH; KLPFVRELCRDYQHI; LPFVRELCRDYQHID; PFVRELCRDYQHIDP; FVRELCRDYQHIDPV; VRELCRDYQHIDPVV; RELCRDYQHIDPVVE; ELCRDYQHIDPVVEL; LCRDYQHIDPVVELV; CRDYQHIDPVVELVP; RDYQHIDPVVELVPV; DYQHIDPVVELVPVR; YQHIDPVVELVPVRP; QHIDPVVELVPVRPV; HIDPVVELVPVRPVV; IDPVVELVPVRPVVH; DPVVELVPVRPVVHY; PVVELVPVRPVVHYM; VVELVPVRPVVHYMM; VELVPVRPVVHYMMG; ELVPVRPVVHYMMGG; LVPVRPVVHYMMGGV; VPVRPVVHYMMGGVH; PVRPVVHYMMGGVHT; VRPVVHYMMGGVHTD; RPVVHYMMGGVHTDI; PVVHYMMGGVHTDIN; VVHYMMGGVHTDING; VHYMMGGVHTDINGA; HYMMGGVHTDINGAT; YMMGGVHTDINGATT; MMGGVHTDINGATTL; MGGVHTDINGATTLP; GGVHTDINGATTLPG; GVHTDINGATTLPGL; VHTDINGATTLPGLY; HTDINGATTLPGLYA; TDINGATTLPGLYAA; DINGATTLPGLYAAG; INGATTLPGLYAAGE; NGATTLPGLYAAGET; GATTLPGLYAAGETA; ATTLPGLYAAGETAC; TTLPGLYAAGETACV; TLPGLYAAGETACVS; LPGLYAAGETACVSI; PGLYAAGETACVSIN; GLYAAGETACVSING; LYAAGETACVSINGA; YAAGETACVSINGAN; AAGETACVSINGANR; AGETACVSINGANRL; GETACVSINGANRLG; ETACVSINGANRLGS; TACVSINGANRLGSN; ACVSINGANRLGSNS; CVSINGANRLGSNSL; VSINGANRLGSNSLP; SINGANRLGSNSLPE; INGANRLGSNSLPEL; NGANRLGSNSLPELL; GANRLGSNSLPELLV; ANRLGSNSLPELLVF; NRLGSNSLPELLVFG; RLGSNSLPELLVFGA; LGSNSLPELLVFGAR; GSNSLPELLVFGARA; SNSLPELLVFGARAG; NSLPELLVFGARAGR; SLPELLVFGARAGRA; LPELLVFGARAGRAA; PELLVFGARAGRAAA; ELLVFGARAGRAAAD; LLVFGARAGRAAADY; LVFGARAGRAAADYA; VFGARAGRAAADYAA; FGARAGRAAADYAAR; GARAGRAAADYAARH; ARAGRAAADYAARHQ; RAGRAAADYAARHQK; AGRAAADYAARHQKS; GRAAADYAARHQKSD; RAAADYAARHQKSDR; AAADYAARHQKSDRG; AADYAARHQKSDRGP; ADYAARHQKSDRGPS; DYAARHQKSDRGPSS; YAARHQKSDRGPSSA; AARHQKSDRGPSSAV; ARHQKSDRGPSSAVR; RHQKSDRGPSSAVRA; HQKSDRGPSSAVRAQ; QKSDRGPSSAVRAQA; KSDRGPSSAVRAQAR; SDRGPSSAVRAQART; DRGPSSAVRAQARTE; RGPSSAVRAQARTEA; GPSSAVRAQARTEAL; PSSAVRAQARTEALR; SSAVRAQARTEALRL; SAVRAQARTEALRLE; AVRAQARTEALRLER; VRAQARTEALRLERE; RAQARTEALRLEREL; AQARTEALRLERELS; QARTEALRLERELSR; ARTEALRLERELSRH; RTEALRLERELSRHG; TEALRLERELSRHGQ; EALRLERELSRHGQG; ALRLERELSRHGQGG; LRLERELSRHGQGGE; RLERELSRHGQGGER; LERELSRHGQGGERI; ERELSRHGQGGERIA; RELSRHGQGGERIAD; ELSRHGQGGERIADI; LSRHGQGGERIADIR; SRHGQGGERIADIRA; RHGQGGERIADIRAD; HGQGGERIADIRADM; GQGGERIADIRADMQ; QGGERIADIRADMQA; GGERIADIRADMQAT; | |

Fig. 29 continued

| | | | |
|---|---|---|---|
| | GERIADIRADMQATL; ERIADIRADMQATLE; RIADIRADMQATLES; IADIRADMQATLESA; ADIRADMQATLESAA; DIRADMQATLESAAG; IRADMQATLESAAGI; RADMQATLESAAGIY; ADMQATLESAAGIYR; DMQATLESAAGIYRD; MQATLESAAGIYRDG; QATLESAAGIYRDGP; ATLESAAGIYRDGPT; TLESAAGIYRDGPTL; LESAAGIYRDGPTLT; ESAAGIYRDGPTLTK; SAAGIYRDGPTLTKA; AAGIYRDGPTLTKAV; AGIYRDGPTLTKAVE; GIYRDGPTLTKAVEE; IYRDGPTLTKAVEEI; YRDGPTLTKAVEEIR; RDGPTLTKAVEEIRV; DGPTLTKAVEEIRVL; GPTLTKAVEEIRVLQ; PTLTKAVEEIRVLQE; TLTKAVEEIRVLQER; LTKAVEEIRVLQERF; TKAVEEIRVLQERFA; KAVEEIRVLQERFAT; AVEEIRVLQERFATA; VEEIRVLQERFATAG; EEIRVLQERFATAGI; EIRVLQERFATAGID; IRVLQERFATAGIDD; RVLQERFATAGIDDH; VLQERFATAGIDDHS; LQERFATAGIDDHSR; QERFATAGIDDHSRT; ERFATAGIDDHSRTF; RFATAGIDDHSRTFN; FATAGIDDHSRTFNT; ATAGIDDHSRTFNTE; TAGIDDHSRTFNTEL; AGIDDHSRTFNTELT; GIDDHSRTFNTELTA; IDDHSRTFNTELTAL; DDHSRTFNTELTALL; DHSRTFNTELTALLE; HSRTFNTELTALLEL; SRTFNTELTALLELS; RTFNTELTALLELSG; TFNTELTALLELSGM; FNTELTALLELSGML; NTELTALLELSGMLD; TELTALLELSGMLDV; ELTALLELSGMLDVA; LTALLELSGMLDVAL; TALLELSGMLDVALA; ALLELSGMLDVALAI; LLELSGMLDVALAIV; LELSGMLDVALAIVE; ELSGMLDVALAIVES; LSGMLDVALAIVESG; SGMLDVALAIVESGL; GMLDVALAIVESGLR; MLDVALAIVESGLRR; LDVALAIVESGLRRE; DVALAIVESGLRREE; VALAIVESGLRREES; ALAIVESGLRREESR; LAIVESGLRREESRG; AIVESGLRREESRGA; IVESGLRREESRGAH; VESGLRREESRGAHQ; ESGLRREESRGAHQR; SGLRREESRGAHQRT; GLRREESRGAHQRTD; LRREESRGAHQRTDF; RREESRGAHQRTDFP; REESRGAHQRTDFPN; EESRGAHQRTDFPNR; ESRGAHQRTDFPNRD; SRGAHQRTDFPNRDD; RGAHQRTDFPNRDDE; GAHQRTDFPNRDDEH; AHQRTDFPNRDDEHF; HQRTDFPNRDDEHFL; QRTDFPNRDDEHFLA; RTDFPNRDDEHFLAH; TDFPNRDDEHFLAHT; DFPNRDDEHFLAHTL; FPNRDDEHFLAHTLV; PNRDDEHFLAHTLVH; NRDDEHFLAHTLVHR; RDDEHFLAHTLVHRE; DDEHFLAHTLVHRES; DEHFLAHTLVHRESD; EHFLAHTLVHRESDG; HFLAHTLVHRESDGT; FLAHTLVHRESDGTL; LAHTLVHRESDGTLR; AHTLVHRESDGTLRV; HTLVHRESDGTLRVG; TLVHRESDGTLRVGY; LVHRESDGTLRVGYL; VHRESDGTLRVGYLP; HRESDGTLRVGYLPV; RESDGTLRVGYLPVT; ESDGTLRVGYLPVTI; SDGTLRVGYLPVTIT; DGTLRVGYLPVTITR; GTLRVGYLPVTITRW; TLRVGYLPVTITRWP; LRVGYLPVTITRWPP; RVGYLPVTITRWPPG; VGYLPVTITRWPPGE; GYLPVTITRWPPGER; YLPVTITRWPPGERV; LPVTITRWPPGERVY; PVTITRWPPGERVYG; VTITRWPPGERVYGR;<br><br>16 mers:<br>MTAQHNIVVIGGGGAG; TAQHNIVVIGGGGAGL; AQHNIVVIGGGGAGLR; QHNIVVIGGGGAGLRA; HNIVVIGGGGAGLRAA; NIVVIGGGGAGLRAAI; IVVIGGGGAGLRAAIA; VVIGGGGAGLRAAIAI; VIGGGGAGLRAAIAIA; IGGGGAGLRAAIAIAE; GGGGAGLRAAIAIAET; GGGAGLRAAIAIAETN; GGAGLRAAIAIAETNP; GAGLRAAIAIAETNPH; AGLRAAIAIAETNPHL; GLRAAIAIAETNPHLD; LRAAIAIAETNPHLDV; RAAIAIAETNPHLDVA; AAIAIAETNPHLDVAI; AIAIAETNPHLDVAIV; IAIAETNPHLDVAIVS; AIAETNPHLDVAIVSK; IAETNPHLDVAIVSKV; AETNPHLDVAIVSKVY; ETNPHLDVAIVSKVYP; TNPHLDVAIVSKVYPM; NPHLDVAIVSKVYPMR; PHLDVAIVSKVYPMRS; HLDVAIVSKVYPMRSH; LDVAIVSKVYPMRSHT; | |

Fig. 29 continued

| | | |
|---|---|---|
| | DVAIVSKVYPMRSHTV; VAIVSKVYPMRSHTVS; AIVSKVYPMRSHTVSA; IVSKVYPMRSHTVSAE; VSKVYPMRSHTVSAEG; SKVYPMRSHTVSAEGG; KVYPMRSHTVSAEGGA; VYPMRSHTVSAEGGAA; YPMRSHTVSAEGGAAA; PMRSHTVSAEGGAAAV; MRSHTVSAEGGAAAVT; RSHTVSAEGGAAAVTG; SHTVSAEGGAAAVTGD; HTVSAEGGAAAVTGDD; TVSAEGGAAAVTGDDD; VSAEGGAAAVTGDDDS; SAEGGAAAVTGDDDSL; AEGGAAAVTGDDDSLD; EGGAAAVTGDDDSLDE; GGAAAVTGDDDSLDEH; GAAAVTGDDDSLDEHA; AAAVTGDDDSLDEHAH; AAVTGDDDSLDEHAHD; AVTGDDDSLDEHAHDT; VTGDDDSLDEHAHDTV; TGDDDSLDEHAHDTVS; GDDDSLDEHAHDTVSG; DDDSLDEHAHDTVSGG; DDSLDEHAHDTVSGGD; DSLDEHAHDTVSGGDW; SLDEHAHDTVSGGDWL; LDEHAHDTVSGGDWLC; DEHAHDTVSGGDWLCD; EHAHDTVSGGDWLCDQ; HAHDTVSGGDWLCDQD; AHDTVSGGDWLCDQDA; HDTVSGGDWLCDQDAV; DTVSGGDWLCDQDAVE; TVSGGDWLCDQDAVEA; VSGGDWLCDQDAVEAF; SGGDWLCDQDAVEAFV; GGDWLCDQDAVEAFVA; GDWLCDQDAVEAFVAE; DWLCDQDAVEAFVAEA; WLCDQDAVEAFVAEAP; LCDQDAVEAFVAEAPK; CDQDAVEAFVAEAPKE; DQDAVEAFVAEAPKEL; QDAVEAFVAEAPKELV; DAVEAFVAEAPKELVQ; AVEAFVAEAPKELVQL; VEAFVAEAPKELVQLE; EAFVAEAPKELVQLEH; AFVAEAPKELVQLEHW; FVAEAPKELVQLEHWG; VAEAPKELVQLEHWGC; AEAPKELVQLEHWGCP; EAPKELVQLEHWGCPW; APKELVQLEHWGCPWS; PKELVQLEHWGCPWSR; KELVQLEHWGCPWSRK; ELVQLEHWGCPWSRKP; LVQLEHWGCPWSRKPD; VQLEHWGCPWSRKPDG; QLEHWGCPWSRKPDGR; LEHWGCPWSRKPDGRV; EHWGCPWSRKPDGRVA; HWGCPWSRKPDGRVAV; WGCPWSRKPDGRVAVR; GCPWSRKPDGRVAVRP; CPWSRKPDGRVAVRPF; PWSRKPDGRVAVRPFG; WSRKPDGRVAVRPFGG; SRKPDGRVAVRPFGGM; RKPDGRVAVRPFGGMK; KPDGRVAVRPFGGMKK; PDGRVAVRPFGGMKKL; DGRVAVRPFGGMKKLR; GRVAVRPFGGMKKLRT; RVAVRPFGGMKKLRTW; VAVRPFGGMKKLRTWF; AVRPFGGMKKLRTWFA; VRPFGGMKKLRTWFAA; RPFGGMKKLRTWFAAD; PFGGMKKLRTWFAADK; FGGMKKLRTWFAADKT; GGMKKLRTWFAADKTG; GMKKLRTWFAADKTGF; MKKLRTWFAADKTGFH; KKLRTWFAADKTGFHL; KLRTWFAADKTGFHLL; LRTWFAADKTGFHLLH; RTWFAADKTGFHLLHT; TWFAADKTGFHLLHTL; WFAADKTGFHLLHTLF; FAADKTGFHLLHTLFQ; AADKTGFHLLHTLFQR; ADKTGFHLLHTLFQRL; DKTGFHLLHTLFQRLL; KTGFHLLHTLFQRLLT; TGFHLLHTLFQRLLTY; GFHLLHTLFQRLLTYS; FHLLHTLFQRLLTYSD; HLLHTLFQRLLTYSDV; LLHTLFQRLLTYSDVM; LHTLFQRLLTYSDVMR; HTLFQRLLTYSDVMRY; TLFQRLLTYSDVMRYD; LFQRLLTYSDVMRYDE; FQRLLTYSDVMRYDEW; QRLLTYSDVMRYDEWF; RLLTYSDVMRYDEWFA; LLTYSDVMRYDEWFAT; LTYSDVMRYDEWFATT; TYSDVMRYDEWFATTL; YSDVMRYDEWFATTLL; SDVMRYDEWFATTLLV; DVMRYDEWFATTLLVD; VMRYDEWFATTLLVDD; MRYDEWFATTLLVDDG; RYDEWFATTLLVDDGR; YDEWFATTLLVDDGRV; DEWFATTLLVDDGRVC; EWFATTLLVDDGRVCG; WFATTLLVDDGRVCGL; FATTLLVDDGRVCGLV; ATTLLVDDGRVCGLVA; TTLLVDDGRVCGLVAI; TLLVDDGRVCGLVAIE; LLVDDGRVCGLVAIEL; LVDDGRVCGLVAIELA; VDDGRVCGLVAIELAT; DDGRVCGLVAIELATG; DGRVCGLVAIELATGR; GRVCGLVAIELATGRI; RVCGLVAIELATGRIE; VCGLVAIELATGRIET; CGLVAIELATGRIETI; GLVAIELATGRIETIL; LVAIELATGRIETILA; VAIELATGRIETILAD; AIELATGRIETILADA; IELATGRIETILADAV; ELATGRIETILADAVI; LATGRIETILADAVIL; ATGRIETILADAVILC; TGRIETILADAVILCT; GRIETILADAVILCTG; RIETILADAVILCTGG; IETILADAVILCTGGC; ETILADAVILCTGGCG; TILADAVILCTGGCGR; ILADAVILCTGGCGRV; LADAVILCTGGCGRVF; ADAVILCTGGCGRVFP; DAVILCTGGCGRVFPF; AVILCTGGCGRVFPFT; VILCTGGCGRVFPFTT; ILCTGGCGRVFPFTTN; | |

Fig. 29 continued

LCTGGCGRVFPFTTNA; CTGGCGRVFPFTTNAN; TGGCGRVFPFTTNANI;
GGCGRVFPFTTNANIK; GCGRVFPFTTNANIKT; CGRVFPFTTNANIKTG;
GRVFPFTTNANIKTGD; RVFPFTTNANIKTGDG; VFPFTTNANIKTGDGM;
FPFTTNANIKTGDGMA; PFTTNANIKTGDGMAL; FTTNANIKTGDGMALA;
TTNANIKTGDGMALAF; TNANIKTGDGMALAFR; NANIKTGDGMALAFRA;
ANIKTGDGMALAFRAG; NIKTGDGMALAFRAGA; IKTGDGMALAFRAGAP;
KTGDGMALAFRAGAPL; TGDGMALAFRAGAPLK; GDGMALAFRAGAPLKD;
DGMALAFRAGAPLKDM; GMALAFRAGAPLKDME; MALAFRAGAPLKDMEF;
ALAFRAGAPLKDMEFV; LAFRAGAPLKDMEFVQ; AFRAGAPLKDMEFVQY;
FRAGAPLKDMEFVQYH; RAGAPLKDMEFVQYHP; AGAPLKDMEFVQYHPT;
GAPLKDMEFVQYHPTG; APLKDMEFVQYHPTGL; PLKDMEFVQYHPTGLP;
LKDMEFVQYHPTGLPF; KDMEFVQYHPTGLPFT; DMEFVQYHPTGLPFTG;
MEFVQYHPTGLPFTGI; EFVQYHPTGLPFTGIL; FVQYHPTGLPFTGILI;
VQYHPTGLPFTGILIT; QYHPTGLPFTGILITE; YHPTGLPFTGILITEA;
HPTGLPFTGILITEAA; PTGLPFTGILITEAAR; TGLPFTGILITEAARA;
GLPFTGILITEAARAE; LPFTGILITEAARAEG; PFTGILITEAARAEGG;
FTGILITEAARAEGGW; TGILITEAARAEGGWL; GILITEAARAEGGWLL;
ILITEAARAEGGWLLN; LITEAARAEGGWLLNK; ITEAARAEGGWLLNKD;
TEAARAEGGWLLNKDG; EAARAEGGWLLNKDGY; AARAEGGWLLNKDGYR;
ARAEGGWLLNKDGYRY; RAEGGWLLNKDGYRYL; AEGGWLLNKDGYRYLQ;
EGGWLLNKDGYRYLQD; GGWLLNKDGYRYLQDY; GWLLNKDGYRYLQDYD;
WLLNKDGYRYLQDYDL; LLNKDGYRYLQDYDLG; LNKDGYRYLQDYDLGK;
NKDGYRYLQDYDLGKP; KDGYRYLQDYDLGKPT; DGYRYLQDYDLGKPTP;
GYRYLQDYDLGKPTPE; YRYLQDYDLGKPTPEP; RYLQDYDLGKPTPEPR;
YLQDYDLGKPTPEPRL; LQDYDLGKPTPEPRLR; QDYDLGKPTPEPRLRS;
DYDLGKPTPEPRLRSM; YDLGKPTPEPRLRSME; DLGKPTPEPRLRSMEL;
LGKPTPEPRLRSMELG; GKPTPEPRLRSMELGP; KPTPEPRLRSMELGPR;
PTPEPRLRSMELGPRD; TPEPRLRSMELGPRDR; PEPRLRSMELGPRDRL;
EPRLRSMELGPRDRLS; PRLRSMELGPRDRLSQ; RLRSMELGPRDRLSQA;
LRSMELGPRDRLSQAF; RSMELGPRDRLSQAFV; SMELGPRDRLSQAFVH;
MELGPRDRLSQAFVHE; ELGPRDRLSQAFVHEH; LGPRDRLSQAFVHEHN;
GPRDRLSQAFVHEHNK; PRDRLSQAFVHEHNKG; RDRLSQAFVHEHNKGR;
DRLSQAFVHEHNKGRT; RLSQAFVHEHNKGRTV; LSQAFVHEHNKGRTVD;
SQAFVHEHNKGRTVDT; QAFVHEHNKGRTVDTP; AFVHEHNKGRTVDTPY;
FVHEHNKGRTVDTPYG; VHEHNKGRTVDTPYGP; HEHNKGRTVDTPYGPV;
EHNKGRTVDTPYGPVV; HNKGRTVDTPYGPVVY; NKGRTVDTPYGPVVYL;
KGRTVDTPYGPVVYLD; GRTVDTPYGPVVYLDL; RTVDTPYGPVVYLDLR;
TVDTPYGPVVYLDLRH; VDTPYGPVVYLDLRHL; DTPYGPVVYLDLRHLG;
TPYGPVVYLDLRHLGA; PYGPVVYLDLRHLGAD; YGPVVYLDLRHLGADL;
GPVVYLDLRHLGADLI; PVVYLDLRHLGADLID; VVYLDLRHLGADLIDA;
VYLDLRHLGADLIDAK; YLDLRHLGADLIDAKL; LDLRHLGADLIDAKLP;
DLRHLGADLIDAKLPF; LRHLGADLIDAKLPFV; RHLGADLIDAKLPFVR;
HLGADLIDAKLPFVRE; LGADLIDAKLPFVREL; GADLIDAKLPFVRELC;
ADLIDAKLPFVRELCR; DLIDAKLPFVRELCRD; LIDAKLPFVRELCRDY;
IDAKLPFVRELCRDYQ; DAKLPFVRELCRDYQH; AKLPFVRELCRDYQHI;
KLPFVRELCRDYQHID; LPFVRELCRDYQHIDP; PFVRELCRDYQHIDPV;
FVRELCRDYQHIDPVV; VRELCRDYQHIDPVVE; RELCRDYQHIDPVVEL;
ELCRDYQHIDPVVELV; LCRDYQHIDPVVELVP; CRDYQHIDPVVELVPV;
RDYQHIDPVVELVPVR; DYQHIDPVVELVPVRP; YQHIDPVVELVPVRPV;
QHIDPVVELVPVRPVV; HIDPVVELVPVRPVVH; IDPVVELVPVRPVVHY;
DPVVELVPVRPVVHYM; PVVELVPVRPVVHYMM; VVELVPVRPVVHYMMG;
VELVPVRPVVHYMMGG; ELVPVRPVVHYMMGGV; LVPVRPVVHYMMGGVH;
VPVRPVVHYMMGGVHT; PVRPVVHYMMGGVHTD; VRPVVHYMMGGVHTDI;

Fig. 29 continued

| | | |
|---|---|---|
| | RPVVHYMMGGVHTDIN; PVVHYMMGGVHTDING; VVHYMMGGVHTDINGA;<br>VHYMMGGVHTDINGAT; HYMMGGVHTDINGATT; YMMGGVHTDINGATTL;<br>MMGGVHTDINGATTLP; MGGVHTDINGATTLPG; GGVHTDINGATTLPGL;<br>GVHTDINGATTLPGLY; VHTDINGATTLPGLYA; HTDINGATTLPGLYAA;<br>TDINGATTLPGLYAAG; DINGATTLPGLYAAGE; INGATTLPGLYAAGET;<br>NGATTLPGLYAAGETA; GATTLPGLYAAGETAC; ATTLPGLYAAGETACV;<br>TTLPGLYAAGETACVS; TLPGLYAAGETACVSI; LPGLYAAGETACVSIN;<br>PGLYAAGETACVSING; GLYAAGETACVSINGA; LYAAGETACVSINGAN;<br>YAAGETACVSINGANR; AAGETACVSINGANRL; AGETACVSINGANRLG;<br>GETACVSINGANRLGS; ETACVSINGANRLGSN; TACVSINGANRLGSNS;<br>ACVSINGANRLGSNSL; CVSINGANRLGSNSLP; VSINGANRLGSNSLPE;<br>SINGANRLGSNSLPEL; INGANRLGSNSLPELL; NGANRLGSNSLPELLV;<br>GANRLGSNSLPELLVF; ANRLGSNSLPELLVFG; NRLGSNSLPELLVFGA;<br>RLGSNSLPELLVFGAR; LGSNSLPELLVFGARA; GSNSLPELLVFGARAG;<br>SNSLPELLVFGARAGR; NSLPELLVFGARAGRA; SLPELLVFGARAGRAA;<br>LPELLVFGARAGRAAA; PELLVFGARAGRAAAD; ELLVFGARAGRAAADY;<br>LLVFGARAGRAAADYA; LVFGARAGRAAADYAA; VFGARAGRAAADYAAR;<br>FGARAGRAAADYAARH; GARAGRAAADYAARHQ; ARAGRAAADYAARHQK;<br>RAGRAAADYAARHQKS; AGRAAADYAARHQKSD; GRAAADYAARHQKSDR;<br>RAAADYAARHQKSDRG; AAADYAARHQKSDRGP; AADYAARHQKSDRGPS;<br>ADYAARHQKSDRGPSS; DYAARHQKSDRGPSSA; YAARHQKSDRGPSSAV;<br>AARHQKSDRGPSSAVR; ARHQKSDRGPSSAVRA; RHQKSDRGPSSAVRAQ;<br>HQKSDRGPSSAVRAQA; QKSDRGPSSAVRAQAR; KSDRGPSSAVRAQART;<br>SDRGPSSAVRAQARTE; DRGPSSAVRAQARTEA; RGPSSAVRAQARTEAL;<br>GPSSAVRAQARTEALR; PSSAVRAQARTEALRL; SSAVRAQARTEALRLE;<br>SAVRAQARTEALRLER; AVRAQARTEALRLERE; VRAQARTEALRLEREL;<br>RAQARTEALRLERELS; AQARTEALRLERELSR; QARTEALRLERELSRH;<br>ARTEALRLERELSRHG; RTEALRLERELSRHGQ; TEALRLERELSRHGQG;<br>EALRLERELSRHGQGG; ALRLERELSRHGQGGE; LRLERELSRHGQGGER;<br>RLERELSRHGQGGERI; LERELSRHGQGGERIA; ERELSRHGQGGERIAD;<br>RELSRHGQGGERIADI; ELSRHGQGGERIADIR; LSRHGQGGERIADIRA;<br>SRHGQGGERIADIRAD; RHGQGGERIADIRADM; HGQGGERIADIRADMQ;<br>GQGGERIADIRADMQA; QGGERIADIRADMQAT; GGERIADIRADMQATL;<br>GERIADIRADMQATLE; ERIADIRADMQATLES; RIADIRADMQATLESA;<br>IADIRADMQATLESAA; ADIRADMQATLESAAG; DIRADMQATLESAAGI;<br>IRADMQATLESAAGIY; RADMQATLESAAGIYR; ADMQATLESAAGIYRD;<br>DMQATLESAAGIYRDG; MQATLESAAGIYRDGP; QATLESAAGIYRDGPT;<br>ATLESAAGIYRDGPTL; TLESAAGIYRDGPTLT; LESAAGIYRDGPTLTK;<br>ESAAGIYRDGPTLTKA; SAAGIYRDGPTLTKAV; AAGIYRDGPTLTKAVE;<br>AGIYRDGPTLTKAVEE; GIYRDGPTLTKAVEEI; IYRDGPTLTKAVEEIR;<br>YRDGPTLTKAVEEIRV; RDGPTLTKAVEEIRVL; DGPTLTKAVEEIRVLQ;<br>GPTLTKAVEEIRVLQE; PTLTKAVEEIRVLQER; TLTKAVEEIRVLQERF;<br>LTKAVEEIRVLQERFA; TKAVEEIRVLQERFAT; KAVEEIRVLQERFATA;<br>AVEEIRVLQERFATAG; VEEIRVLQERFATAGI; EEIRVLQERFATAGID;<br>EIRVLQERFATAGIDD; IRVLQERFATAGIDDH; RVLQERFATAGIDDHS;<br>VLQERFATAGIDDHSR; LQERFATAGIDDHSRT; QERFATAGIDDHSRTF;<br>ERFATAGIDDHSRTFN; RFATAGIDDHSRTFNT; FATAGIDDHSRTFNTE;<br>ATAGIDDHSRTFNTEL; TAGIDDHSRTFNTELT; AGIDDHSRTFNTELTA;<br>GIDDHSRTFNTELTAL; IDDHSRTFNTELTALL; DDHSRTFNTELTALLE;<br>DHSRTFNTELTALLEL; HSRTFNTELTALLELS; SRTFNTELTALLELSG;<br>RTFNTELTALLELSGM; TFNTELTALLELSGML; FNTELTALLELSGMLD;<br>NTELTALLELSGMLDV; TELTALLELSGMLDVA; ELTALLELSGMLDVAL;<br>LTALLELSGMLDVALA; TALLELSGMLDVALAI; ALLELSGMLDVALAIV; | |

Fig. 29 continued

| | | |
|---|---|---|
| | LLELSGMLDVALAIVE; LELSGMLDVALAIVES; ELSGMLDVALAIVESG; LSGMLDVALAIVESGL; SGMLDVALAIVESGLR; GMLDVALAIVESGLRR; MLDVALAIVESGLRRE; LDVALAIVESGLRREE; DVALAIVESGLRREES; VALAIVESGLRREESR; ALAIVESGLRREESRG; LAIVESGLRREESRGA; AIVESGLRREESRGAH; IVESGLRREESRGAHQ; VESGLRREESRGAHQR; ESGLRREESRGAHQRT; SGLRREESRGAHQRTD; GLRREESRGAHQRTDF; LRREESRGAHQRTDFP; RREESRGAHQRTDFPN; REESRGAHQRTDFPNR; EESRGAHQRTDFPNRD; ESRGAHQRTDFPNRDD; SRGAHQRTDFPNRDDE; RGAHQRTDFPNRDDEH; GAHQRTDFPNRDDEHF; AHQRTDFPNRDDEHFL; HQRTDFPNRDDEHFLA; QRTDFPNRDDEHFLAH; RTDFPNRDDEHFLAHT; TDFPNRDDEHFLAHTL; DFPNRDDEHFLAHTLV; FPNRDDEHFLAHTLVH; PNRDDEHFLAHTLVHR; NRDDEHFLAHTLVHRE; RDDEHFLAHTLVHRES; DDEHFLAHTLVHRESD; DEHFLAHTLVHRESDG; EHFLAHTLVHRESDGT; HFLAHTLVHRESDGTL; FLAHTLVHRESDGTLR; LAHTLVHRESDGTLRV; AHTLVHRESDGTLRVG; HTLVHRESDGTLRVGY; TLVHRESDGTLRVGYL; LVHRESDGTLRVGYLP; VHRESDGTLRVGYLPV; HRESDGTLRVGYLPVT; RESDGTLRVGYLPVTI; ESDGTLRVGYLPVTIT; SDGTLRVGYLPVTITR; DGTLRVGYLPVTITRW; GTLRVGYLPVTITRWP; TLRVGYLPVTITRWPP; LRVGYLPVTITRWPPG; RVGYLPVTITRWPPGE; VGYLPVTITRWPPGER; GYLPVTITRWPPGERV; YLPVTITRWPPGERVY; LPVTITRWPPGERVYG; PVTITRWPPGERVYGR | |
| 25) Rv1660 | 13 mers: MSVIAGVFGALPP; SVIAGVFGALPPY; VIAGVFGALPPYR; IAGVFGALPPYRY; AGVFGALPPYRYS; GVFGALPPYRYSQ; VFGALPPYRYSQR; FGALPPYRYSQRE; GALPPYRYSQREL; ALPPYRYSQRELT; LPPYRYSQRELTD; PPYRYSQRELTDS; PYRYSQRELTDSF; YRYSQRELTDSFV; RYSQRELTDSFVS; YSQRELTDSFVSI; SQRELTDSFVSIP; QRELTDSFVSIPD; RELTDSFVSIPDF; ELTDSFVSIPDFE; LTDSFVSIPDFEG; TDSFVSIPDFEGY; DSFVSIPDFEGYE; SFVSIPDFEGYED; FVSIPDFEGYEDI; VSIPDFEGYEDIV; SIPDFEGYEDIVR; IPDFEGYEDIVRQ; PDFEGYEDIVRQL; DFEGYEDIVRQLH; FEGYEDIVRQLHA; EGYEDIVRQLHAS; GYEDIVRQLHASA; YEDIVRQLHASAK; EDIVRQLHASAKV; DIVRQLHASAKVN; IVRQLHASAKVNS; VRQLHASAKVNSR; RQLHASAKVNSRH; QLHASAKVNSRHL; LHASAKVNSRHLV; HASAKVNSRHLVL; ASAKVNSRHLVLP; SAKVNSRHLVLPL; AKVNSRHLVLPLE; KVNSRHLVLPLEK; VNSRHLVLPLEKY; NSRHLVLPLEKYP; SRHLVLPLEKYPK; RHLVLPLEKYPKL; HLVLPLEKYPKLT; LVLPLEKYPKLTD; VLPLEKYPKLTDF; LPLEKYPKLTDFG; PLEKYPKLTDFGE; LEKYPKLTDFGEA; EKYPKLTDFGEAN; KYPKLTDFGEANK; YPKLTDFGEANKI; PKLTDFGEANKIF; KLTDFGEANKIFI; LTDFGEANKIFIE; TDFGEANKIFIEK; DFGEANKIFIEKA; FGEANKIFIEKAV; GEANKIFIEKAVD; EANKIFIEKAVDL; ANKIFIEKAVDLG; NKIFIEKAVDLGV; KIFIEKAVDLGVQ; IFIEKAVDLGVQA; FIEKAVDLGVQAL; IEKAVDLGVQALA; EKAVDLGVQALAG; KAVDLGVQALAGA; AVDLGVQALAGAL; VDLGVQALAGALD; DLGVQALAGALDE; LGVQALAGALDES; GVQALAGALDESG; VQALAGALDESGL; QALAGALDESGLR; ALAGALDESGLRP; LAGALDESGLRPE; AGALDESGLRPED; GALDESGLRPEDL; ALDESGLRPEDLD; LDESGLRPEDLDV; DESGLRPEDLDVL; ESGLRPEDLDVLI; SGLRPEDLDVLIT; GLRPEDLDVLITA; LRPEDLDVLITAT; RPEDLDVLITATV; PEDLDVLITATVT; EDLDVLITATVTG; DLDVLITATVTGL; LDVLITATVTGLA; DVLITATVTGLAV; VLITATVTGLAVP; LITATVTGLAVPS; ITATVTGLAVPSL; TATVTGLAVPSLD; ATVTGLAVPSLDA; TVTGLAVPSLDAR; VTGLAVPSLDARI; TGLAVPSLDARIA; GLAVPSLDARIAG; LAVPSLDARIAGR; AVPSLDARIAGRL; VPSLDARIAGRLG; PSLDARIAGRLGL; SLDARIAGRLGLR; LDARIAGRLGLRA; DARIAGRLGLRAD; ARIAGRLGLRADV; RIAGRLGLRADVR; IAGRLGLRADVRR; AGRLGLRADVRRV; GRLGLRADVRRVP; | 80271-81628 |

Fig. 29 continued

RLGLRADVRRVPL; LGLRADVRRVPLF; GLRADVRRVPLFG; LRADVRRVPLFGL;
RADVRRVPLFGLG; ADVRRVPLFGLGC; DVRRVPLFGLGCV; VRRVPLFGLGCVA;
RRVPLFGLGCVAG; RVPLFGLGCVAGA; VPLFGLGCVAGAA; PLFGLGCVAGAAG;
LFGLGCVAGAAGV; FGLGCVAGAAGVA; GLGCVAGAAGVAR;
LGCVAGAAGVARL; GCVAGAAGVARLH; CVAGAAGVARLHD;
VAGAAGVARLHDY; AGAAGVARLHDYL; GAAGVARLHDYLR;
AAGVARLHDYLRG; AGVARLHDYLRGA; GVARLHDYLRGAP;
VARLHDYLRGAPD; ARLHDYLRGAPDG; RLHDYLRGAPDGV;
LHDYLRGAPDGVA; HDYLRGAPDGVAA; DYLRGAPDGVAAL;
YLRGAPDGVAALV; LRGAPDGVAALVS; RGAPDGVAALVSV; GAPDGVAALVSVE;
APDGVAALVSVEL; PDGVAALVSVELC; DGVAALVSVELCS; GVAALVSVELCSL;
VAALVSVELCSLT; AALVSVELCSLTY; ALVSVELCSLTYP; LVSVELCSLTYPG;
VSVELCSLTYPGY; SVELCSLTYPGYK; VELCSLTYPGYKP; ELCSLTYPGYKPT;
LCSLTYPGYKPTL; CSLTYPGYKPTLP; SLTYPGYKPTLPG; LTYPGYKPTLPGL;
TYPGYKPTLPGLV; YPGYKPTLPGLVG; PGYKPTLPGLVGS; GYKPTLPGLVGSA;
YKPTLPGLVGSAL; KPTLPGLVGSALF; PTLPGLVGSALFA; TLPGLVGSALFAD;
LPGLVGSALFADG; PGLVGSALFADGA; GLVGSALFADGAA; LVGSALFADGAAA;
VGSALFADGAAAV; GSALFADGAAAVV; SALFADGAAAVVA; ALFADGAAAVVAA;
LFADGAAAVVAAG; FADGAAAVVAAGV; ADGAAAVVAAGVK;
DGAAAVVAAGVKR; GAAAVVAAGVKRA; AAAVVAAGVKRAQ;
AAVVAAGVKRAQD; AVVAAGVKRAQDI; VVAAGVKRAQDIG; VAAGVKRAQDIGA;
AAGVKRAQDIGAD; AGVKRAQDIGADG; GVKRAQDIGADGP; VKRAQDIGADGPD;
KRAQDIGADGPDI; RAQDIGADGPDIL; AQDIGADGPDILD; QDIGADGPDILDS;
DIGADGPDILDSR; IGADGPDILDSRS; GADGPDILDSRSH; ADGPDILDSRSHL;
DGPDILDSRSHLY; GPDILDSRSHLYP; PDILDSRSHLYPD; DILDSRSHLYPDS;
ILDSRSHLYPDSL; LDSRSHLYPDSLR; DSRSHLYPDSLRT; SRSHLYPDSLRTM;
RSHLYPDSLRTMG; SHLYPDSLRTMGY; HLYPDSLRTMGYD;
LYPDSLRTMGYDV; YPDSLRTMGYDVG; PDSLRTMGYDVGS;
DSLRTMGYDVGSA; SLRTMGYDVGSAG; LRTMGYDVGSAGF;
RTMGYDVGSAGFE; TMGYDVGSAGFEL; MGYDVGSAGFELV;
GYDVGSAGFELVL; YDVGSAGFELVLS; DVGSAGFELVLSR; VGSAGFELVLSRD;
GSAGFELVLSRDL; SAGFELVLSRDLA; AGFELVLSRDLAA; GFELVLSRDLAAV;
FELVLSRDLAAVV; ELVLSRDLAAVVE; LVLSRDLAAVVEQ; VLSRDLAAVVEQY;
LSRDLAAVVEQYL; SRDLAAVVEQYLG; RDLAAVVEQYLGN; DLAAVVEQYLGND;
LAAVVEQYLGNDV; AAVVEQYLGNDVT; AVVEQYLGNDVTT; VVEQYLGNDVTTF;
VEQYLGNDVTTFL; EQYLGNDVTTFLA; QYLGNDVTTFLAS; YLGNDVTTFLASH;
LGNDVTTFLASHG; GNDVTTFLASHGL; NDVTTFLASHGLS; DVTTFLASHGLST;
VTTFLASHGLSTT; TTFLASHGLSTTD; TFLASHGLSTTDV; FLASHGLSTTDVG;
LASHGLSTTDVGA; ASHGLSTTDVGAW; SHGLSTTDVGAWV;
HGLSTTDVGAWVT; GLSTTDVGAWVTH; LSTTDVGAWVTHP;
STTDVGAWVTHPG; TTDVGAWVTHPGG; TDVGAWVTHPGGP;
DVGAWVTHPGGPK; VGAWVTHPGGPKI; GAWVTHPGGPKII; AWVTHPGGPKIIN;
WVTHPGGPKIINA; VTHPGGPKIINAI; THPGGPKIINAIT; HPGGPKIINAITE;
PGGPKIINAITET; GGPKIINAITETL; GPKIINAITETLD; PKIINAITETLDL;
KIINAITETLDLS; IINAITETLDLSP; INAITETLDLSPQ; NAITETLDLSPQA;
AITETLDLSPQAL; ITETLDLSPQALE; TETLDLSPQALEL; ETLDLSPQALELT;
TLDLSPQALELTW; LDLSPQALELTWR; DLSPQALELTWRS; LSPQALELTWRSL;
SPQALELTWRSLG; PQALELTWRSLGE; QALELTWRSLGEI; ALELTWRSLGEIG;
LELTWRSLGEIGN; ELTWRSLGEIGNL; LTWRSLGEIGNLS; TWRSLGEIGNLSS;
WRSLGEIGNLSSA; RSLGEIGNLSSAS; SLGEIGNLSSASV; LGEIGNLSSASVL;
GEIGNLSSASVLH; EIGNLSSASVLHV; IGNLSSASVLHVL; GNLSSASVLHVLR;
NLSSASVLHVLRD; LSSASVLHVLRDT; SSASVLHVLRDTI; SASVLHVLRDTIA;
ASVLHVLRDTIAK; SVLHVLRDTIAKP; VLHVLRDTIAKPP; LHVLRDTIAKPPP;

Fig. 29 continued

HVLRDTIAKPPPS; VLRDTIAKPPPSG; LRDTIAKPPPSGS; RDTIAKPPPSGSP; DTIAKPPPSGSPG; TIAKPPPSGSPGL; IAKPPPSGSPGLM; AKPPPSGSPGLMI; KPPPSGSPGLMIA; PPPSGSPGLMIAM; PPSGSPGLMIAMG; PSGSPGLMIAMGP; SGSPGLMIAMGPG; GSPGLMIAMGPGF; SPGLMIAMGPGFC; PGLMIAMGPGFCS; GLMIAMGPGFCSE; LMIAMGPGFCSEL; MIAMGPGFCSELV; IAMGPGFCSELVL; AMGPGFCSELVLL; MGPGFCSELVLLR; GPGFCSELVLLRW; PGFCSELVLLRWH 14 mers:
MSVIAGVFGALPPY; SVIAGVFGALPPYR; VIAGVFGALPPYRY; IAGVFGALPPYRYS; AGVFGALPPYRYSQ; GVFGALPPYRYSQR; VFGALPPYRYSQRE; FGALPPYRYSQREL; GALPPYRYSQRELT; ALPPYRYSQRELTD; LPPYRYSQRELTDS; PPYRYSQRELTDSF; PYRYSQRELTDSFV; YRYSQRELTDSFVS; RYSQRELTDSFVSI; YSQRELTDSFVSIP; SQRELTDSFVSIPD; QRELTDSFVSIPDF; RELTDSFVSIPDFE; ELTDSFVSIPDFEG; LTDSFVSIPDFEGY; TDSFVSIPDFEGYE; DSFVSIPDFEGYED; SFVSIPDFEGYEDI; FVSIPDFEGYEDIV; VSIPDFEGYEDIVR; SIPDFEGYEDIVRQ; IPDFEGYEDIVRQL; PDFEGYEDIVRQLH; DFEGYEDIVRQLHA; FEGYEDIVRQLHAS; EGYEDIVRQLHASA; GYEDIVRQLHASAK; YEDIVRQLHASAKV; EDIVRQLHASAKVN; DIVRQLHASAKVNS; IVRQLHASAKVNSR; VRQLHASAKVNSRH; RQLHASAKVNSRHL; QLHASAKVNSRHLV; LHASAKVNSRHLVL; HASAKVNSRHLVLP; ASAKVNSRHLVLPL; SAKVNSRHLVLPLE; AKVNSRHLVLPLEK; KVNSRHLVLPLEKY; VNSRHLVLPLEKYP; NSRHLVLPLEKYPK; SRHLVLPLEKYPKL; RHLVLPLEKYPKLT; HLVLPLEKYPKLTD; LVLPLEKYPKLTDF; VLPLEKYPKLTDFG; LPLEKYPKLTDFGE; PLEKYPKLTDFGEA; LEKYPKLTDFGEAN; EKYPKLTDFGEANK; KYPKLTDFGEANKI; YPKLTDFGEANKIF; PKLTDFGEANKIFI; KLTDFGEANKIFIE; LTDFGEANKIFIEK; TDFGEANKIFIEKA; DFGEANKIFIEKAV; FGEANKIFIEKAVD; GEANKIFIEKAVDL; EANKIFIEKAVDLG; ANKIFIEKAVDLGV; NKIFIEKAVDLGVQ; KIFIEKAVDLGVQA; IFIEKAVDLGVQAL; FIEKAVDLGVQALA; IEKAVDLGVQALAG; EKAVDLGVQALAGA; KAVDLGVQALAGAL; AVDLGVQALAGALD; VDLGVQALAGALDE; DLGVQALAGALDES; LGVQALAGALDESG; GVQALAGALDESGL; VQALAGALDESGLR; QALAGALDESGLRP; ALAGALDESGLRPE; LAGALDESGLRPED; AGALDESGLRPEDL; GALDESGLRPEDLD; ALDESGLRPEDLDV; LDESGLRPEDLDVL; DESGLRPEDLDVLI; ESGLRPEDLDVLIT; SGLRPEDLDVLITA; GLRPEDLDVLITAT; LRPEDLDVLITATV; RPEDLDVLITATVT; PEDLDVLITATVTG; EDLDVLITATVTGL; DLDVLITATVTGLA; LDVLITATVTGLAV; DVLITATVTGLAVP; VLITATVTGLAVPS; LITATVTGLAVPSL; ITATVTGLAVPSLD; TATVTGLAVPSLDA; ATVTGLAVPSLDAR; TVTGLAVPSLDARI; VTGLAVPSLDARIA; TGLAVPSLDARIAG; GLAVPSLDARIAGR; LAVPSLDARIAGRL; AVPSLDARIAGRLG; VPSLDARIAGRLGL; PSLDARIAGRLGLR; SLDARIAGRLGLRA; LDARIAGRLGLRAD; DARIAGRLGLRADV; ARIAGRLGLRADVR; RIAGRLGLRADVRR; IAGRLGLRADVRRV; AGRLGLRADVRRVP; GRLGLRADVRRVPL; RLGLRADVRRVPLF; LGLRADVRRVPLFG; GLRADVRRVPLFGL; LRADVRRVPLFGLG; RADVRRVPLFGLGC; ADVRRVPLFGLGCV; DVRRVPLFGLGCVA; VRRVPLFGLGCVAG; RRVPLFGLGCVAGA; RVPLFGLGCVAGAA; VPLFGLGCVAGAAG; PLFGLGCVAGAAGV; LFGLGCVAGAAGVA; FGLGCVAGAAGVAR; GLGCVAGAAGVARL; LGCVAGAAGVARLH; GCVAGAAGVARLHD; CVAGAAGVARLHDY; VAGAAGVARLHDYL;

Fig. 29 continued

| | | |
|---|---|---|
| | AGAAGVARLHDYLR; GAAGVARLHDYLRG; AAGVARLHDYLRGA; AGVARLHDYLRGAP; GVARLHDYLRGAPD; VARLHDYLRGAPDG; ARLHDYLRGAPDGV; RLHDYLRGAPDGVA; LHDYLRGAPDGVAA; HDYLRGAPDGVAAL; DYLRGAPDGVAALV; YLRGAPDGVAALVS; LRGAPDGVAALVSV; RGAPDGVAALVSVE; GAPDGVAALVSVEL; APDGVAALVSVELC; PDGVAALVSVELCS; DGVAALVSVELCSL; GVAALVSVELCSLT; VAALVSVELCSLTY; AALVSVELCSLTYP; ALVSVELCSLTYPG; LVSVELCSLTYPGY; VSVELCSLTYPGYK; SVELCSLTYPGYKP; VELCSLTYPGYKPT; ELCSLTYPGYKPTL; LCSLTYPGYKPTLP; CSLTYPGYKPTLPG; SLTYPGYKPTLPGL; LTYPGYKPTLPGLV; TYPGYKPTLPGLVG; YPGYKPTLPGLVGS; PGYKPTLPGLVGSA; GYKPTLPGLVGSAL; YKPTLPGLVGSALF; KPTLPGLVGSALFA; PTLPGLVGSALFAD; TLPGLVGSALFADG; LPGLVGSALFADGA; PGLVGSALFADGAA; GLVGSALFADGAAA; LVGSALFADGAAAV; VGSALFADGAAAVV; GSALFADGAAAVVA; SALFADGAAAVVAA; ALFADGAAAVVAAG; LFADGAAAVVAAGV; FADGAAAVVAAGVK; ADGAAAVVAAGVKR; DGAAAVVAAGVKRA; GAAAVVAAGVKRAQ; AAAVVAAGVKRAQD; AAVVAAGVKRAQDI; AVVAAGVKRAQDIG; VVAAGVKRAQDIGA; VAAGVKRAQDIGAD; AAGVKRAQDIGADG; AGVKRAQDIGADGP; GVKRAQDIGADGPD; VKRAQDIGADGPDI; KRAQDIGADGPDIL; RAQDIGADGPDILD; AQDIGADGPDILDS; QDIGADGPDILDSR; DIGADGPDILDSRS; IGADGPDILDSRSH; GADGPDILDSRSHL; ADGPDILDSRSHLY; DGPDILDSRSHLYP; GPDILDSRSHLYPD; PDILDSRSHLYPDS; DILDSRSHLYPDSL; ILDSRSHLYPDSLR; LDSRSHLYPDSLRT; DSRSHLYPDSLRTM; SRSHLYPDSLRTMG; RSHLYPDSLRTMGY; SHLYPDSLRTMGYD; HLYPDSLRTMGYDV; LYPDSLRTMGYDVG; YPDSLRTMGYDVGS; PDSLRTMGYDVGSA; DSLRTMGYDVGSAG; SLRTMGYDVGSAGF; LRTMGYDVGSAGFE; RTMGYDVGSAGFEL; TMGYDVGSAGFELV; MGYDVGSAGFELVL; GYDVGSAGFELVLS; YDVGSAGFELVLSR; DVGSAGFELVLSRD; VGSAGFELVLSRDL; GSAGFELVLSRDLA; SAGFELVLSRDLAA; AGFELVLSRDLAAV; GFELVLSRDLAAVV; FELVLSRDLAAVVE; ELVLSRDLAAVVEQ; LVLSRDLAAVVEQY; VLSRDLAAVVEQYL; LSRDLAAVVEQYLG; SRDLAAVVEQYLGN; RDLAAVVEQYLGND; DLAAVVEQYLGNDV; LAAVVEQYLGNDVT; AAVVEQYLGNDVTT; AVVEQYLGNDVTTF; VVEQYLGNDVTTFL; VEQYLGNDVTTFLA; EQYLGNDVTTFLAS; QYLGNDVTTFLASH; YLGNDVTTFLASHG; LGNDVTTFLASHGL; GNDVTTFLASHGLS; NDVTTFLASHGLST; DVTTFLASHGLSTT; VTTFLASHGLSTTD; TTFLASHGLSTTDV; TFLASHGLSTTDVG; FLASHGLSTTDVGA; LASHGLSTTDVGAW; ASHGLSTTDVGAWV; SHGLSTTDVGAWVT; HGLSTTDVGAWVTH; GLSTTDVGAWVTHP; LSTTDVGAWVTHPG; STTDVGAWVTHPGG; TTDVGAWVTHPGGP; TDVGAWVTHPGGPK; DVGAWVTHPGGPKI; VGAWVTHPGGPKII; GAWVTHPGGPKIIN; AWVTHPGGPKIINA; WVTHPGGPKIINAI; VTHPGGPKIINAIT; THPGGPKIINAITE; HPGGPKIINAITET; PGGPKIINAITETL; GGPKIINAITETLD; GPKIINAITETLDL; PKIINAITETLDLS; KIINAITETLDLSP; IINAITETLDLSPQ; INAITETLDLSPQA; NAITETLDLSPQAL; AITETLDLSPQALE; ITETLDLSPQALEL; TETLDLSPQALELT; ETLDLSPQALELTW; TLDLSPQALELTWR; LDLSPQALELTWRS; DLSPQALELTWRSL; LSPQALELTWRSLG; SPQALELTWRSLGE; PQALELTWRSLGEI; QALELTWRSLGEIG; ALELTWRSLGEIGN; LELTWRSLGEIGNL; ELTWRSLGEIGNLS; LTWRSLGEIGNLSS; TWRSLGEIGNLSSA; | |

Fig. 29 continued

| | | |
|---|---|---|
| | WRSLGEIGNLSSAS; RSLGEIGNLSSASV; SLGEIGNLSSASVL; LGEIGNLSSASVLH; GEIGNLSSASVLHV; EIGNLSSASVLHVL; IGNLSSASVLHVLR; GNLSSASVLHVLRD; NLSSASVLHVLRDT; LSSASVLHVLRDTI; SSASVLHVLRDTIA; SASVLHVLRDTIAK; ASVLHVLRDTIAKP; SVLHVLRDTIAKPP; VLHVLRDTIAKPPP; LHVLRDTIAKPPPS; HVLRDTIAKPPPSG; VLRDTIAKPPPSGS; LRDTIAKPPPSGSP; RDTIAKPPPSGSPG; DTIAKPPPSGSPGL; TIAKPPPSGSPGLM; IAKPPPSGSPGLMI; AKPPPSGSPGLMIA; KPPPSGSPGLMIAM; PPPSGSPGLMIAMG; PPSGSPGLMIAMGP; PSGSPGLMIAMGPG; SGSPGLMIAMGPGF; GSPGLMIAMGPGFC; SPGLMIAMGPGFCS; PGLMIAMGPGFCSE; GLMIAMGPGFCSEL; LMIAMGPGFCSELV; MIAMGPGFCSELVL; IAMGPGFCSELVLL; AMGPGFCSELVLLR; MGPGFCSELVLLRW; GPGFCSELVLLRWH<br><br>15 mers:<br>MSVIAGVFGALPPYR; SVIAGVFGALPPYRY; VIAGVFGALPPYRYS; IAGVFGALPPYRYSQ; AGVFGALPPYRYSQR; GVFGALPPYRYSQRE; VFGALPPYRYSQREL; FGALPPYRYSQRELT; GALPPYRYSQRELTD; ALPPYRYSQRELTDS; LPPYRYSQRELTDSF; PPYRYSQRELTDSFV; PYRYSQRELTDSFVS; YRYSQRELTDSFVSI; RYSQRELTDSFVSIP; YSQRELTDSFVSIPD; SQRELTDSFVSIPDF; QRELTDSFVSIPDFE; RELTDSFVSIPDFEG; ELTDSFVSIPDFEGY; LTDSFVSIPDFEGYE; TDSFVSIPDFEGYED; DSFVSIPDFEGYEDI; SFVSIPDFEGYEDIV; FVSIPDFEGYEDIVR; VSIPDFEGYEDIVRQ; SIPDFEGYEDIVRQL; IPDFEGYEDIVRQLH; PDFEGYEDIVRQLHA; DFEGYEDIVRQLHAS; FEGYEDIVRQLHASA; EGYEDIVRQLHASAK; GYEDIVRQLHASAKV; YEDIVRQLHASAKVN; EDIVRQLHASAKVNS; DIVRQLHASAKVNSR; IVRQLHASAKVNSRH; VRQLHASAKVNSRHL; RQLHASAKVNSRHLV; QLHASAKVNSRHLVL; LHASAKVNSRHLVLP; HASAKVNSRHLVLPL; ASAKVNSRHLVLPLE; SAKVNSRHLVLPLEK; AKVNSRHLVLPLEKY; KVNSRHLVLPLEKYP; VNSRHLVLPLEKYPK; NSRHLVLPLEKYPKL; SRHLVLPLEKYPKLT; RHLVLPLEKYPKLTD; HLVLPLEKYPKLTDF; LVLPLEKYPKLTDFG; VLPLEKYPKLTDFGE; LPLEKYPKLTDFGEA; PLEKYPKLTDFGEAN; LEKYPKLTDFGEANK; EKYPKLTDFGEANKI; KYPKLTDFGEANKIF; YPKLTDFGEANKIFI; PKLTDFGEANKIFIE; KLTDFGEANKIFIEK; LTDFGEANKIFIEKA; TDFGEANKIFIEKAV; DFGEANKIFIEKAVD; FGEANKIFIEKAVDL; GEANKIFIEKAVDLG; EANKIFIEKAVDLGV; ANKIFIEKAVDLGVQ; NKIFIEKAVDLGVQA; KIFIEKAVDLGVQAL; IFIEKAVDLGVQALA; FIEKAVDLGVQALAG; IEKAVDLGVQALAGA; EKAVDLGVQALAGAL; KAVDLGVQALAGALD; AVDLGVQALAGALDE; VDLGVQALAGALDES; DLGVQALAGALDESG; LGVQALAGALDESGL; GVQALAGALDESGLR; VQALAGALDESGLRP; QALAGALDESGLRPE; ALAGALDESGLRPED; LAGALDESGLRPEDL; AGALDESGLRPEDLD; GALDESGLRPEDLDV; ALDESGLRPEDLDVL; LDESGLRPEDLDVLI; DESGLRPEDLDVLIT; ESGLRPEDLDVLITA; SGLRPEDLDVLITAT; GLRPEDLDVLITATV; LRPEDLDVLITATVT; RPEDLDVLITATVTG; PEDLDVLITATVTGL; EDLDVLITATVTGLA; DLDVLITATVTGLAV; LDVLITATVTGLAVP; DVLITATVTGLAVPS; VLITATVTGLAVPSL; LITATVTGLAVPSLD; ITATVTGLAVPSLDA; TATVTGLAVPSLDAR; ATVTGLAVPSLDARI; TVTGLAVPSLDARIA; VTGLAVPSLDARIAG; TGLAVPSLDARIAGR; GLAVPSLDARIAGRL; LAVPSLDARIAGRLG; AVPSLDARIAGRLGL; VPSLDARIAGRLGLR; PSLDARIAGRLGLRA; SLDARIAGRLGLRAD; LDARIAGRLGLRADV; | |

Fig. 29 continued

| | | | |
|---|---|---|---|
| | DARIAGRLGLRADVR; ARIAGRLGLRADVRR; RIAGRLGLRADVRRV;<br>IAGRLGLRADVRRVP; AGRLGLRADVRRVPL; GRLGLRADVRRVPLF;<br>RLGLRADVRRVPLFG; LGLRADVRRVPLFGL; GLRADVRRVPLFGLG;<br>LRADVRRVPLFGLGC; RADVRRVPLFGLGCV; ADVRRVPLFGLGCVA;<br>DVRRVPLFGLGCVAG; VRRVPLFGLGCVAGA; RRVPLFGLGCVAGAA;<br>RVPLFGLGCVAGAAG; VPLFGLGCVAGAAGV; PLFGLGCVAGAAGVA;<br>LFGLGCVAGAAGVAR; FGLGCVAGAAGVARL; GLGCVAGAAGVARLH;<br>LGCVAGAAGVARLHD; GCVAGAAGVARLHDY; CVAGAAGVARLHDYL;<br>VAGAAGVARLHDYLR; AGAAGVARLHDYLRG; GAAGVARLHDYLRGA;<br>AAGVARLHDYLRGAP; AGVARLHDYLRGAPD; GVARLHDYLRGAPDG;<br>VARLHDYLRGAPDGV; ARLHDYLRGAPDGVA; RLHDYLRGAPDGVAA;<br>LHDYLRGAPDGVAAL; HDYLRGAPDGVAALV; DYLRGAPDGVAALVS;<br>YLRGAPDGVAALVSV; LRGAPDGVAALVSVE; RGAPDGVAALVSVEL;<br>GAPDGVAALVSVELC; APDGVAALVSVELCS; PDGVAALVSVELCSL;<br>DGVAALVSVELCSLT; GVAALVSVELCSLTY; VAALVSVELCSLTYP;<br>AALVSVELCSLTYPG; ALVSVELCSLTYPGY; LVSVELCSLTYPGYK;<br>VSVELCSLTYPGYKP; SVELCSLTYPGYKPT; VELCSLTYPGYKPTL;<br>ELCSLTYPGYKPTLP; LCSLTYPGYKPTLPG; CSLTYPGYKPTLPGL;<br>SLTYPGYKPTLPGLV; LTYPGYKPTLPGLVG; TYPGYKPTLPGLVGS;<br>YPGYKPTLPGLVGSA; PGYKPTLPGLVGSAL; GYKPTLPGLVGSALF;<br>YKPTLPGLVGSALFA; KPTLPGLVGSALFAD; PTLPGLVGSALFADG;<br>TLPGLVGSALFADGA; LPGLVGSALFADGAA; PGLVGSALFADGAAA;<br>GLVGSALFADGAAAV; LVGSALFADGAAAVV; VGSALFADGAAAVVA;<br>GSALFADGAAAVVAA; SALFADGAAAVVAAG; ALFADGAAAVVAAGV;<br>LFADGAAAVVAAGVK; FADGAAAVVAAGVKR; ADGAAAVVAAGVKRA;<br>DGAAAVVAAGVKRAQ; GAAAVVAAGVKRAQD; AAAVVAAGVKRAQDI;<br>AAVVAAGVKRAQDIG; AVVAAGVKRAQDIGA; VVAAGVKRAQDIGAD;<br>VAAGVKRAQDIGADG; AAGVKRAQDIGADGP; AGVKRAQDIGADGPD;<br>GVKRAQDIGADGPDI; VKRAQDIGADGPDIL; KRAQDIGADGPDILD;<br>RAQDIGADGPDILDS; AQDIGADGPDILDSR; QDIGADGPDILDSRS;<br>DIGADGPDILDSRSH; IGADGPDILDSRSHL; GADGPDILDSRSHLY;<br>ADGPDILDSRSHLYP; DGPDILDSRSHLYPD; GPDILDSRSHLYPDS;<br>PDILDSRSHLYPDSL; DILDSRSHLYPDSLR; ILDSRSHLYPDSLRT;<br>LDSRSHLYPDSLRTM; DSRSHLYPDSLRTMG; SRSHLYPDSLRTMGY;<br>RSHLYPDSLRTMGYD; SHLYPDSLRTMGYDV; HLYPDSLRTMGYDVG;<br>LYPDSLRTMGYDVGS; YPDSLRTMGYDVGSA; PDSLRTMGYDVGSAG;<br>DSLRTMGYDVGSAGF; SLRTMGYDVGSAGFE; LRTMGYDVGSAGFEL;<br>RTMGYDVGSAGFELV; TMGYDVGSAGFELVL; MGYDVGSAGFELVLS;<br>GYDVGSAGFELVLSR; YDVGSAGFELVLSRD; DVGSAGFELVLSRDL;<br>VGSAGFELVLSRDLA; GSAGFELVLSRDLAA; SAGFELVLSRDLAAV;<br>AGFELVLSRDLAAVV; GFELVLSRDLAAVVE; FELVLSRDLAAVVEQ;<br>ELVLSRDLAAVVEQY; LVLSRDLAAVVEQYL; VLSRDLAAVVEQYLG;<br>LSRDLAAVVEQYLGN; SRDLAAVVEQYLGND; RDLAAVVEQYLGNDV;<br>DLAAVVEQYLGNDVT; LAAVVEQYLGNDVTT; AAVVEQYLGNDVTTF;<br>AVVEQYLGNDVTTFL; VVEQYLGNDVTTFLA; VEQYLGNDVTTFLAS;<br>EQYLGNDVTTFLASH; QYLGNDVTTFLASHG; YLGNDVTTFLASHGL;<br>LGNDVTTFLASHGLS; GNDVTTFLASHGLST; NDVTTFLASHGLSTT;<br>DVTTFLASHGLSTTD; VTTFLASHGLSTTDV; TTFLASHGLSTTDVG;<br>TFLASHGLSTTDVGA; FLASHGLSTTDVGAW; LASHGLSTTDVGAWV;<br>ASHGLSTTDVGAWVT; SHGLSTTDVGAWVTH; HGLSTTDVGAWVTHP;<br>GLSTTDVGAWVTHPG; LSTTDVGAWVTHPGG; STTDVGAWVTHPGGP;<br>TTDVGAWVTHPGGPK; TDVGAWVTHPGGPKI; DVGAWVTHPGGPKII;<br>VGAWVTHPGGPKIIN; GAWVTHPGGPKIINA; AWVTHPGGPKIINAI; | | |

Fig. 29 continued

| | | | |
|---|---|---|---|
| | WVTHPGGPKIINAIT; VTHPGGPKIINAITE; THPGGPKIINAITET; HPGGPKIINAITETL; PGGPKIINAITETLD; GGPKIINAITETLDL; GPKIINAITETLDLS; PKIINAITETLDLSP; KIINAITETLDLSPQ; IINAITETLDLSPQA; INAITETLDLSPQAL; NAITETLDLSPQALE; AITETLDLSPQALEL; ITETLDLSPQALELT; TETLDLSPQALELTW; ETLDLSPQALELTWR; TLDLSPQALELTWRS; LDLSPQALELTWRSL; DLSPQALELTWRSLG; LSPQALELTWRSLGE; SPQALELTWRSLGEI; PQALELTWRSLGEIG; QALELTWRSLGEIGN; ALELTWRSLGEIGNL; LELTWRSLGEIGNLS; ELTWRSLGEIGNLSS; LTWRSLGEIGNLSSA; TWRSLGEIGNLSSAS; WRSLGEIGNLSSASV; RSLGEIGNLSSASVL; SLGEIGNLSSASVLH; LGEIGNLSSASVLHV; GEIGNLSSASVLHVL; EIGNLSSASVLHVLR; IGNLSSASVLHVLRD; GNLSSASVLHVLRDT; NLSSASVLHVLRDTI; LSSASVLHVLRDTIA; SSASVLHVLRDTIAK; SASVLHVLRDTIAKP; ASVLHVLRDTIAKPP; SVLHVLRDTIAKPPP; VLHVLRDTIAKPPPS; LHVLRDTIAKPPPSG; HVLRDTIAKPPPSGS; VLRDTIAKPPPSGSP; LRDTIAKPPPSGSPG; RDTIAKPPPSGSPGL; DTIAKPPPSGSPGLM; TIAKPPPSGSPGLMI; IAKPPPSGSPGLMIA; AKPPPSGSPGLMIAM; KPPPSGSPGLMIAMG; PPPSGSPGLMIAMGP; PPSGSPGLMIAMGPG; PSGSPGLMIAMGPGF; SGSPGLMIAMGPGFC; GSPGLMIAMGPGFCS; SPGLMIAMGPGFCSE; PGLMIAMGPGFCSEL; GLMIAMGPGFCSELV; LMIAMGPGFCSELVL; MIAMGPGFCSELVLL; IAMGPGFCSELVLLR; AMGPGFCSELVLLRW; MGPGFCSELVLLRWH<br><br>16 mers:<br>MSVIAGVFGALPPYRY; SVIAGVFGALPPYRYS; VIAGVFGALPPYRYSQ; IAGVFGALPPYRYSQR; AGVFGALPPYRYSQRE; GVFGALPPYRYSQREL; VFGALPPYRYSQRELT; FGALPPYRYSQRELTD; GALPPYRYSQRELTDS; ALPPYRYSQRELTDSF; LPPYRYSQRELTDSFV; PPYRYSQRELTDSFVS; PYRYSQRELTDSFVSI; YRYSQRELTDSFVSIP; RYSQRELTDSFVSIPD; YSQRELTDSFVSIPDF; SQRELTDSFVSIPDFE; QRELTDSFVSIPDFEG; RELTDSFVSIPDFEGY; ELTDSFVSIPDFEGYE; LTDSFVSIPDFEGYED; TDSFVSIPDFEGYEDI; DSFVSIPDFEGYEDIV; SFVSIPDFEGYEDIVR; FVSIPDFEGYEDIVRQ; VSIPDFEGYEDIVRQL; SIPDFEGYEDIVRQLH; IPDFEGYEDIVRQLHA; PDFEGYEDIVRQLHAS; DFEGYEDIVRQLHASA; FEGYEDIVRQLHASAK; EGYEDIVRQLHASAKV; GYEDIVRQLHASAKVN; YEDIVRQLHASAKVNS; EDIVRQLHASAKVNSR; DIVRQLHASAKVNSRH; IVRQLHASAKVNSRHL; VRQLHASAKVNSRHLV; RQLHASAKVNSRHLVL; QLHASAKVNSRHLVLP; LHASAKVNSRHLVLPL; HASAKVNSRHLVLPLE; ASAKVNSRHLVLPLEK; SAKVNSRHLVLPLEKY; AKVNSRHLVLPLEKYP; KVNSRHLVLPLEKYPK; VNSRHLVLPLEKYPKL; NSRHLVLPLEKYPKLT; SRHLVLPLEKYPKLTD; RHLVLPLEKYPKLTDF; HLVLPLEKYPKLTDFG; LVLPLEKYPKLTDFGE; VLPLEKYPKLTDFGEA; LPLEKYPKLTDFGEAN; PLEKYPKLTDFGEANK; LEKYPKLTDFGEANKI; EKYPKLTDFGEANKIF; KYPKLTDFGEANKIFI; YPKLTDFGEANKIFIE; PKLTDFGEANKIFIEK; KLTDFGEANKIFIEKA; LTDFGEANKIFIEKAV; TDFGEANKIFIEKAVD; DFGEANKIFIEKAVDL; FGEANKIFIEKAVDLG; GEANKIFIEKAVDLGV; EANKIFIEKAVDLGVQ; ANKIFIEKAVDLGVQA; NKIFIEKAVDLGVQAL; KIFIEKAVDLGVQALA; IFIEKAVDLGVQALAG; FIEKAVDLGVQALAGA; IEKAVDLGVQALAGAL; EKAVDLGVQALAGALD; KAVDLGVQALAGALDE; AVDLGVQALAGALDES; VDLGVQALAGALDESG; DLGVQALAGALDESGL; LGVQALAGALDESGLR; GVQALAGALDESGLRP; VQALAGALDESGLRPE; QALAGALDESGLRPED; ALAGALDESGLRPEDL; LAGALDESGLRPEDLD; AGALDESGLRPEDLDV; GALDESGLRPEDLDVL; ALDESGLRPEDLDVLI; | |

Fig. 29 continued

| | | |
|---|---|---|
| | LDESGLRPEDLDVLIT; DESGLRPEDLDVLITA; ESGLRPEDLDVLITAT; | |
| | SGLRPEDLDVLITATV; GLRPEDLDVLITATVT; LRPEDLDVLITATVTG; | |
| | RPEDLDVLITATVTGL; PEDLDVLITATVTGLA; EDLDVLITATVTGLAV; | |
| | DLDVLITATVTGLAVP; LDVLITATVTGLAVPS; DVLITATVTGLAVPSL; | |
| | VLITATVTGLAVPSLD; LITATVTGLAVPSLDA; ITATVTGLAVPSLDAR; | |
| | TATVTGLAVPSLDARI; ATVTGLAVPSLDARIA; TVTGLAVPSLDARIAG; | |
| | VTGLAVPSLDARIAGR; TGLAVPSLDARIAGRL; GLAVPSLDARIAGRLG; | |
| | LAVPSLDARIAGRLGL; AVPSLDARIAGRLGLR; VPSLDARIAGRLGLRA; | |
| | PSLDARIAGRLGLRAD; SLDARIAGRLGLRADV; LDARIAGRLGLRADVR; | |
| | DARIAGRLGLRADVRR; ARIAGRLGLRADVRRV; RIAGRLGLRADVRRVP; | |
| | IAGRLGLRADVRRVPL; AGRLGLRADVRRVPLF; GRLGLRADVRRVPLFG; | |
| | RLGLRADVRRVPLFGL; LGLRADVRRVPLFGLG; GLRADVRRVPLFGLGC; | |
| | LRADVRRVPLFGLGCV; RADVRRVPLFGLGCVA; ADVRRVPLFGLGCVAG; | |
| | DVRRVPLFGLGCVAGA; VRRVPLFGLGCVAGAA; RRVPLFGLGCVAGAAG; | |
| | RVPLFGLGCVAGAAGV; VPLFGLGCVAGAAGVA; PLFGLGCVAGAAGVAR; | |
| | LFGLGCVAGAAGVARL; FGLGCVAGAAGVARLH; GLGCVAGAAGVARLHD; | |
| | LGCVAGAAGVARLHDY; GCVAGAAGVARLHDYL; CVAGAAGVARLHDYLR; | |
| | VAGAAGVARLHDYLRG; AGAAGVARLHDYLRGA; GAAGVARLHDYLRGAP; | |
| | AAGVARLHDYLRGAPD; AGVARLHDYLRGAPDG; GVARLHDYLRGAPDGV; | |
| | VARLHDYLRGAPDGVA; ARLHDYLRGAPDGVAA; RLHDYLRGAPDGVAAL; | |
| | LHDYLRGAPDGVAALV; HDYLRGAPDGVAALVS; DYLRGAPDGVAALVSV; | |
| | YLRGAPDGVAALVSVE; LRGAPDGVAALVSVEL; RGAPDGVAALVSVELC; | |
| | GAPDGVAALVSVELCS; APDGVAALVSVELCSL; PDGVAALVSVELCSLT; | |
| | DGVAALVSVELCSLTY; GVAALVSVELCSLTYP; VAALVSVELCSLTYPG; | |
| | AALVSVELCSLTYPGY; ALVSVELCSLTYPGYK; LVSVELCSLTYPGYKP; | |
| | VSVELCSLTYPGYKPT; SVELCSLTYPGYKPTL; VELCSLTYPGYKPTLP; | |
| | ELCSLTYPGYKPTLPG; LCSLTYPGYKPTLPGL; CSLTYPGYKPTLPGLV; | |
| | SLTYPGYKPTLPGLVG; LTYPGYKPTLPGLVGS; TYPGYKPTLPGLVGSA; | |
| | YPGYKPTLPGLVGSAL; PGYKPTLPGLVGSALF; GYKPTLPGLVGSALFA; | |
| | YKPTLPGLVGSALFAD; KPTLPGLVGSALFADG; PTLPGLVGSALFADGA; | |
| | TLPGLVGSALFADGAA; LPGLVGSALFADGAAA; PGLVGSALFADGAAAV; | |
| | GLVGSALFADGAAAVV; LVGSALFADGAAAVVA; VGSALFADGAAAVVAA; | |
| | GSALFADGAAAVVAAG; SALFADGAAAVVAAGV; ALFADGAAAVVAAGVK; | |
| | LFADGAAAVVAAGVKR; FADGAAAVVAAGVKRA; ADGAAAVVAAGVKRAQ; | |
| | DGAAAVVAAGVKRAQD; GAAAVVAAGVKRAQDI; AAAVVAAGVKRAQDIG; | |
| | AAVVAAGVKRAQDIGA; AVVAAGVKRAQDIGAD; VVAAGVKRAQDIGADG; | |
| | VAAGVKRAQDIGADGP; AAGVKRAQDIGADGPD; AGVKRAQDIGADGPDI; | |
| | GVKRAQDIGADGPDIL; VKRAQDIGADGPDILD; KRAQDIGADGPDILDS; | |
| | RAQDIGADGPDILDSR; AQDIGADGPDILDSRS; QDIGADGPDILDSRSH; | |
| | DIGADGPDILDSRSHL; IGADGPDILDSRSHLY; GADGPDILDSRSHLYP; | |
| | ADGPDILDSRSHLYPD; DGPDILDSRSHLYPDS; GPDILDSRSHLYPDSL; | |
| | PDILDSRSHLYPDSLR; DILDSRSHLYPDSLRT; ILDSRSHLYPDSLRTM; | |
| | LDSRSHLYPDSLRTMG; DSRSHLYPDSLRTMGY; SRSHLYPDSLRTMGYD; | |
| | RSHLYPDSLRTMGYDV; SHLYPDSLRTMGYDVG; HLYPDSLRTMGYDVGS; | |
| | LYPDSLRTMGYDVGSA; YPDSLRTMGYDVGSAG; PDSLRTMGYDVGSAGF; | |
| | DSLRTMGYDVGSAGFE; SLRTMGYDVGSAGFEL; LRTMGYDVGSAGFELV; | |
| | RTMGYDVGSAGFELVL; TMGYDVGSAGFELVLS; MGYDVGSAGFELVLSR; | |
| | GYDVGSAGFELVLSRD; YDVGSAGFELVLSRDL; DVGSAGFELVLSRDLA; | |
| | VGSAGFELVLSRDLAA; GSAGFELVLSRDLAAV; SAGFELVLSRDLAAVV; | |
| | AGFELVLSRDLAAVVE; GFELVLSRDLAAVVEQ; FELVLSRDLAAVVEQY; | |
| | ELVLSRDLAAVVEQYL; LVLSRDLAAVVEQYLG; VLSRDLAAVVEQYLGN; | |
| | LSRDLAAVVEQYLGND; SRDLAAVVEQYLGNDV; RDLAAVVEQYLGNDVT; | |
| | DLAAVVEQYLGNDVTT; LAAVVEQYLGNDVTTF; AAVVEQYLGNDVTTFL; | |

Fig. 29 continued

| | | |
|---|---|---|
| | AVVEQYLGNDVTTFLA; VVEQYLGNDVTTFLAS; VEQYLGNDVTTFLASH; EQYLGNDVTTFLASHG; QYLGNDVTTFLASHGL; YLGNDVTTFLASHGLS; LGNDVTTFLASHGLST; GNDVTTFLASHGLSTT; NDVTTFLASHGLSTTD; DVTTFLASHGLSTTDV; VTTFLASHGLSTTDVG; TTFLASHGLSTTDVGA; TFLASHGLSTTDVGAW; FLASHGLSTTDVGAWV; LASHGLSTTDVGAWVT; ASHGLSTTDVGAWVTH; SHGLSTTDVGAWVTHP; HGLSTTDVGAWVTHPG; GLSTTDVGAWVTHPGG; LSTTDVGAWVTHPGGP; STTDVGAWVTHPGGPK; TTDVGAWVTHPGGPKI; TDVGAWVTHPGGPKII; DVGAWVTHPGGPKIIN; VGAWVTHPGGPKIINA; GAWVTHPGGPKIINAI; AWVTHPGGPKIINAIT; WVTHPGGPKIINAITE; VTHPGGPKIINAITET; THPGGPKIINAITETL; HPGGPKIINAITETLD; PGGPKIINAITETLDL; GGPKIINAITETLDLS; GPKIINAITETLDLSP; PKIINAITETLDLSPQ; KIINAITETLDLSPQA; IINAITETLDLSPQAL; INAITETLDLSPQALE; NAITETLDLSPQALEL; AITETLDLSPQALELT; ITETLDLSPQALELTW; TETLDLSPQALELTWR; ETLDLSPQALELTWRS; TLDLSPQALELTWRSL; LDLSPQALELTWRSLG; DLSPQALELTWRSLGE; LSPQALELTWRSLGEI; SPQALELTWRSLGEIG; PQALELTWRSLGEIGN; QALELTWRSLGEIGNL; ALELTWRSLGEIGNLS; LELTWRSLGEIGNLSS; ELTWRSLGEIGNLSSA; LTWRSLGEIGNLSSAS; TWRSLGEIGNLSSASV; WRSLGEIGNLSSASVL; RSLGEIGNLSSASVLH; SLGEIGNLSSASVLHV; LGEIGNLSSASVLHVL; GEIGNLSSASVLHVLR; EIGNLSSASVLHVLRD; IGNLSSASVLHVLRDT; GNLSSASVLHVLRDTI; NLSSASVLHVLRDTIA; LSSASVLHVLRDTIAK; SSASVLHVLRDTIAKP; SASVLHVLRDTIAKPP; ASVLHVLRDTIAKPPP; SVLHVLRDTIAKPPPS; VLHVLRDTIAKPPPSG; LHVLRDTIAKPPPSGS; HVLRDTIAKPPPSGSP; VLRDTIAKPPPSGSPG; LRDTIAKPPPSGSPGL; RDTIAKPPPSGSPGLM; DTIAKPPPSGSPGLMI; TIAKPPPSGSPGLMIA; IAKPPPSGSPGLMIAM; AKPPPSGSPGLMIAMG; KPPPSGSPGLMIAMGP; PPPSGSPGLMIAMGPG; PPSGSPGLMIAMGPGF; PSGSPGLMIAMGPGFC; SGSPGLMIAMGPGFCS; GSPGLMIAMGPGFCSE; SPGLMIAMGPGFCSEL; PGLMIAMGPGFCSELV; GLMIAMGPGFCSELVL; LMIAMGPGFCSELVLL; MIAMGPGFCSELVLLR; IAMGPGFCSELVLLRW; AMGPGFCSELVLLRWH | |
| 26) Rv1792 | 13 mers: MATRFMTDPHAMR; ATRFMTDPHAMRD; TRFMTDPHAMRDM; RFMTDPHAMRDMA; FMTDPHAMRDMAG; MTDPHAMRDMAGR; TDPHAMRDMAGRF; DPHAMRDMAGRFE; PHAMRDMAGRFEV; HAMRDMAGRFEVH; AMRDMAGRFEVHA; MRDMAGRFEVHAQ; RDMAGRFEVHAQT; DMAGRFEVHAQTV; MAGRFEVHAQTVE; AGRFEVHAQTVED; GRFEVHAQTVEDE; RFEVHAQTVEDEA; FEVHAQTVEDEAR; EVHAQTVEDEARR; VHAQTVEDEARRM; HAQTVEDEARRMW; AQTVEDEARRMWA; QTVEDEARRMWAS; TVEDEARRMWASA; VEDEARRMWASAQ; EDEARRMWASAQN; DEARRMWASAQNI; EARRMWASAQNIS; ARRMWASAQNISG; RRMWASAQNISGA; RMWASAQNISGAG; MWASAQNISGAGW; WASAQNISGAGWS; ASAQNISGAGWSG; SAQNISGAGWSGM; AQNISGAGWSGMA; QNISGAGWSGMAE; NISGAGWSGMAEA; ISGAGWSGMAEAT; SGAGWSGMAEATS; GAGWSGMAEATSL; AGWSGMAEATSLD; GWSGMAEATSLDT; WSGMAEATSLDTM; SGMAEATSLDTMA; GMAEATSLDTMAQ; MAEATSLDTMAQM; AEATSLDTMAQMN; EATSLDTMAQMNQ; ATSLDTMAQMNQA; TSLDTMAQMNQAF; SLDTMAQMNQAFR; LDTMAQMNQAFRN; DTMAQMNQAFRNI; TMAQMNQAFRNIV; MAQMNQAFRNIVN; AQMNQAFRNIVNM; QMNQAFRNIVNML; MNQAFRNIVNMLH; | 81629-81966 |

Fig. 29 continued

| | | |
|---|---|---|
| | NQAFRNIVNMLHG; QAFRNIVNMLHGV; AFRNIVNMLHGVR; FRNIVNMLHGVRD; RNIVNMLHGVRDG; NIVNMLHGVRDGL; IVNMLHGVRDGLV; VNMLHGVRDGLVR; NMLHGVRDGLVRD; MLHGVRDGLVRDA; LHGVRDGLVRDAN; HGVRDGLVRDANN; GVRDGLVRDANNY; VRDGLVRDANNYE; RDGLVRDANNYEQ; DGLVRDANNYEQQ; GLVRDANNYEQQE; LVRDANNYEQQEQ; VRDANNYEQQEQA; RDANNYEQQEQAS; DANNYEQQEQASQ; ANNYEQQEQASQQ; NNYEQQEQASQQI; NYEQQEQASQQIL; YEQQEQASQQILS; EQQEQASQQILSS;<br><br>14 mers:<br>MATRFMTDPHAMRD; ATRFMTDPHAMRDM; TRFMTDPHAMRDMA; RFMTDPHAMRDMAG; FMTDPHAMRDMAGR; MTDPHAMRDMAGRF; TDPHAMRDMAGRFE; DPHAMRDMAGRFEV; PHAMRDMAGRFEVH; HAMRDMAGRFEVHA; AMRDMAGRFEVHAQ; MRDMAGRFEVHAQT; RDMAGRFEVHAQTV; DMAGRFEVHAQTVE; MAGRFEVHAQTVED; AGRFEVHAQTVEDE; GRFEVHAQTVEDEA; RFEVHAQTVEDEAR; FEVHAQTVEDEARR; EVHAQTVEDEARRM; VHAQTVEDEARRMW; HAQTVEDEARRMWA; AQTVEDEARRMWAS; QTVEDEARRMWASA; TVEDEARRMWASAQ; VEDEARRMWASAQN; EDEARRMWASAQNI; DEARRMWASAQNIS; EARRMWASAQNISG; ARRMWASAQNISGA; RRMWASAQNISGAG; RMWASAQNISGAGW; MWASAQNISGAGWS; WASAQNISGAGWSG; ASAQNISGAGWSGM; SAQNISGAGWSGMA; AQNISGAGWSGMAE; QNISGAGWSGMAEA; NISGAGWSGMAEAT; ISGAGWSGMAEATS; SGAGWSGMAEATSL; GAGWSGMAEATSLD; AGWSGMAEATSLDT; GWSGMAEATSLDTM; WSGMAEATSLDTMA; SGMAEATSLDTMAQ; GMAEATSLDTMAQM; MAEATSLDTMAQMN; AEATSLDTMAQMNQ; EATSLDTMAQMNQA; ATSLDTMAQMNQAF; TSLDTMAQMNQAFR; SLDTMAQMNQAFRN; LDTMAQMNQAFRNI; DTMAQMNQAFRNIV; TMAQMNQAFRNIVN; MAQMNQAFRNIVNM; AQMNQAFRNIVNML; QMNQAFRNIVNMLH; MNQAFRNIVNMLHG; NQAFRNIVNMLHGV; QAFRNIVNMLHGVR; AFRNIVNMLHGVRD; FRNIVNMLHGVRDG; RNIVNMLHGVRDGL; NIVNMLHGVRDGLV; IVNMLHGVRDGLVR; VNMLHGVRDGLVRD; NMLHGVRDGLVRDA; MLHGVRDGLVRDAN; LHGVRDGLVRDANN; HGVRDGLVRDANNY; GVRDGLVRDANNYE; VRDGLVRDANNYEQ; RDGLVRDANNYEQQ; DGLVRDANNYEQQE; GLVRDANNYEQQEQ; LVRDANNYEQQEQA; VRDANNYEQQEQAS; RDANNYEQQEQASQ; DANNYEQQEQASQQ; ANNYEQQEQASQQI; NNYEQQEQASQQIL; NYEQQEQASQQILS; YEQQEQASQQILSS;<br><br>15 mers:<br>MATRFMTDPHAMRDM; ATRFMTDPHAMRDMA; TRFMTDPHAMRDMAG; RFMTDPHAMRDMAGR; FMTDPHAMRDMAGRF; MTDPHAMRDMAGRFE; TDPHAMRDMAGRFEV; DPHAMRDMAGRFEVH; PHAMRDMAGRFEVHA; HAMRDMAGRFEVHAQ; AMRDMAGRFEVHAQT; MRDMAGRFEVHAQTV; RDMAGRFEVHAQTVE; DMAGRFEVHAQTVED; MAGRFEVHAQTVEDE; AGRFEVHAQTVEDEA; GRFEVHAQTVEDEAR; RFEVHAQTVEDEARR; FEVHAQTVEDEARRM; EVHAQTVEDEARRMW; VHAQTVEDEARRMWA; HAQTVEDEARRMWAS; AQTVEDEARRMWASA; QTVEDEARRMWASAQ; TVEDEARRMWASAQN; VEDEARRMWASAQNI; EDEARRMWASAQNIS; DEARRMWASAQNISG; EARRMWASAQNISGA; ARRMWASAQNISGAG; RRMWASAQNISGAGW; RMWASAQNISGAGWS; MWASAQNISGAGWSG; WASAQNISGAGWSGM; ASAQNISGAGWSGMA; SAQNISGAGWSGMAE; | |

Fig. 29 continued

| | | |
|---|---|---|
| | AQNISGAGWSGMAEA; QNISGAGWSGMAEAT; NISGAGWSGMAEATS; ISGAGWSGMAEATSL; SGAGWSGMAEATSLD; GAGWSGMAEATSLDT; AGWSGMAEATSLDTM; GWSGMAEATSLDTMA; WSGMAEATSLDTMAQ; SGMAEATSLDTMAQM; GMAEATSLDTMAQMN; MAEATSLDTMAQMNQ; AEATSLDTMAQMNQA; EATSLDTMAQMNQAF; ATSLDTMAQMNQAFR; TSLDTMAQMNQAFRN; SLDTMAQMNQAFRNI; LDTMAQMNQAFRNIV; DTMAQMNQAFRNIVN; TMAQMNQAFRNIVNM; MAQMNQAFRNIVNML; AQMNQAFRNIVNMLH; QMNQAFRNIVNMLHG; MNQAFRNIVNMLHGV; NQAFRNIVNMLHGVR; QAFRNIVNMLHGVRD; AFRNIVNMLHGVRDG; FRNIVNMLHGVRDGL; RNIVNMLHGVRDGLV; NIVNMLHGVRDGLVR; IVNMLHGVRDGLVRD; VNMLHGVRDGLVRDA; NMLHGVRDGLVRDAN; MLHGVRDGLVRDANN; LHGVRDGLVRDANNY; HGVRDGLVRDANNYE; GVRDGLVRDANNYEQ; VRDGLVRDANNYEQQ; RDGLVRDANNYEQQE; DGLVRDANNYEQQEQ; GLVRDANNYEQQEQA; LVRDANNYEQQEQAS; VRDANNYEQQEQASQ; RDANNYEQQEQASQQ; DANNYEQQEQASQQI; ANNYEQQEQASQQIL; NNYEQQEQASQQILS; NYEQQEQASQQILSS;<br><br>16 mers:<br>MATRFMTDPHAMRDMA; ATRFMTDPHAMRDMAG; TRFMTDPHAMRDMAGR; RFMTDPHAMRDMAGRF; FMTDPHAMRDMAGRFE; MTDPHAMRDMAGRFEV; TDPHAMRDMAGRFEVH; DPHAMRDMAGRFEVHA; PHAMRDMAGRFEVHAQ; HAMRDMAGRFEVHAQT; AMRDMAGRFEVHAQTV; MRDMAGRFEVHAQTVE; RDMAGRFEVHAQTVED; DMAGRFEVHAQTVEDE; MAGRFEVHAQTVEDEA; AGRFEVHAQTVEDEAR; GRFEVHAQTVEDEARR; RFEVHAQTVEDEARRM; FEVHAQTVEDEARRMW; EVHAQTVEDEARRMWA; VHAQTVEDEARRMWAS; HAQTVEDEARRMWASA; AQTVEDEARRMWASAQ; QTVEDEARRMWASAQN; TVEDEARRMWASAQNI; VEDEARRMWASAQNIS; EDEARRMWASAQNISG; DEARRMWASAQNISGA; EARRMWASAQNISGAG; ARRMWASAQNISGAGW; RRMWASAQNISGAGWS; RMWASAQNISGAGWSG; MWASAQNISGAGWSGM; WASAQNISGAGWSGMA; ASAQNISGAGWSGMAE; SAQNISGAGWSGMAEA; AQNISGAGWSGMAEAT; QNISGAGWSGMAEATS; NISGAGWSGMAEATSL; ISGAGWSGMAEATSLD; SGAGWSGMAEATSLDT; GAGWSGMAEATSLDTM; AGWSGMAEATSLDTMA; GWSGMAEATSLDTMAQ; WSGMAEATSLDTMAQM; SGMAEATSLDTMAQMN; GMAEATSLDTMAQMNQ; MAEATSLDTMAQMNQA; AEATSLDTMAQMNQAF; EATSLDTMAQMNQAFR; ATSLDTMAQMNQAFRN; TSLDTMAQMNQAFRNI; SLDTMAQMNQAFRNIV; LDTMAQMNQAFRNIVN; DTMAQMNQAFRNIVNM; TMAQMNQAFRNIVNML; MAQMNQAFRNIVNMLH; AQMNQAFRNIVNMLHG; QMNQAFRNIVNMLHGV; MNQAFRNIVNMLHGVR; NQAFRNIVNMLHGVRD; QAFRNIVNMLHGVRDG; AFRNIVNMLHGVRDGL; FRNIVNMLHGVRDGLV; RNIVNMLHGVRDGLVR; NIVNMLHGVRDGLVRD; IVNMLHGVRDGLVRDA; VNMLHGVRDGLVRDAN; NMLHGVRDGLVRDANN; MLHGVRDGLVRDANNY; LHGVRDGLVRDANNYE; HGVRDGLVRDANNYEQ; GVRDGLVRDANNYEQQ; VRDGLVRDANNYEQQE; RDGLVRDANNYEQQEQ; DGLVRDANNYEQQEQA; GLVRDANNYEQQEQAS; LVRDANNYEQQEQASQ; VRDANNYEQQEQASQQ; RDANNYEQQEQASQQI; DANNYEQQEQASQQIL; ANNYEQQEQASQQILS; NNYEQQEQASQQILSS; | |
| 27) Rv1793 | 13 mers:<br>MTINYQFGDVDAH; TINYQFGDVDAHG; INYQFGDVDAHGA; NYQFGDVDAHGAM; YQFGDVDAHGAMI; QFGDVDAHGAMIR; FGDVDAHGAMIRA; GDVDAHGAMIRAQ; DVDAHGAMIRAQA; VDAHGAMIRAQAA; DAHGAMIRAQAAS; AHGAMIRAQAASL; HGAMIRAQAASLE; GAMIRAQAASLEA; AMIRAQAASLEAE; MIRAQAASLEAEH; IRAQAASLEAEHQ; RAQAASLEAEHQA; AQAASLEAEHQAI; QAASLEAEHQAIV; AASLEAEHQAIVR; | 81967-82288 |

Fig. 29 continued

| | | |
|---|---|---|
| | ASLEAEHQAIVRD; SLEAEHQAIVRDV; LEAEHQAIVRDVL; EAEHQAIVRDVLA; AEHQAIVRDVLAA; EHQAIVRDVLAAG; HQAIVRDVLAAGD; QAIVRDVLAAGDF; AIVRDVLAAGDFW; IVRDVLAAGDFWG; VRDVLAAGDFWGG; RDVLAAGDFWGGA; DVLAAGDFWGGAG; VLAAGDFWGGAGS; LAAGDFWGGAGSV; AAGDFWGGAGSVA; AGDFWGGAGSVAC; GDFWGGAGSVACQ; DFWGGAGSVACQE; FWGGAGSVACQEF; WGGAGSVACQEFI; GGAGSVACQEFIT; GAGSVACQEFITQ; AGSVACQEFITQL; GSVACQEFITQLG; SVACQEFITQLGR; VACQEFITQLGRN; ACQEFITQLGRNF; CQEFITQLGRNFQ; QEFITQLGRNFQV; EFITQLGRNFQVI; FITQLGRNFQVIY; ITQLGRNFQVIYE; TQLGRNFQVIYEQ; QLGRNFQVIYEQA; LGRNFQVIYEQAN; GRNFQVIYEQANA; RNFQVIYEQANAH; NFQVIYEQANAHG; FQVIYEQANAHGQ; QVIYEQANAHGQK; VIYEQANAHGQKV; IYEQANAHGQKVQ; YEQANAHGQKVQA; EQANAHGQKVQAA; QANAHGQKVQAAG; ANAHGQKVQAAGN; NAHGQKVQAAGNN; AHGQKVQAAGNNM; HGQKVQAAGNNMA; GQKVQAAGNNMAQ; QKVQAAGNNMAQT; KVQAAGNNMAQTD; VQAAGNNMAQTDS; QAAGNNMAQTDSA; AAGNNMAQTDSAV; AGNNMAQTDSAVG; GNNMAQTDSAVGS; NNMAQTDSAVGSS; NMAQTDSAVGSSW; MAQTDSAVGSSWA;<br><br>14 mers:<br>MTINYQFGDVDAHG; TINYQFGDVDAHGA; INYQFGDVDAHGAM; NYQFGDVDAHGAMI; YQFGDVDAHGAMIR; QFGDVDAHGAMIRA; FGDVDAHGAMIRAQ; GDVDAHGAMIRAQA; DVDAHGAMIRAQAA; VDAHGAMIRAQAAS; DAHGAMIRAQAASL; AHGAMIRAQAASLE; HGAMIRAQAASLEA; GAMIRAQAASLEAE; AMIRAQAASLEAEH; MIRAQAASLEAEHQ; IRAQAASLEAEHQA; RAQAASLEAEHQAI; AQAASLEAEHQAIV; QAASLEAEHQAIVR; AASLEAEHQAIVRD; ASLEAEHQAIVRDV; SLEAEHQAIVRDVL; LEAEHQAIVRDVLA; EAEHQAIVRDVLAA; AEHQAIVRDVLAAG; EHQAIVRDVLAAGD; HQAIVRDVLAAGDF; QAIVRDVLAAGDFW; AIVRDVLAAGDFWG; IVRDVLAAGDFWGG; VRDVLAAGDFWGGA; RDVLAAGDFWGGAG; DVLAAGDFWGGAGS; VLAAGDFWGGAGSV; LAAGDFWGGAGSVA; AAGDFWGGAGSVAC; AGDFWGGAGSVACQ; GDFWGGAGSVACQE; DFWGGAGSVACQEF; FWGGAGSVACQEFI; WGGAGSVACQEFIT; GGAGSVACQEFITQ; GAGSVACQEFITQL; AGSVACQEFITQLG; GSVACQEFITQLGR; SVACQEFITQLGRN; VACQEFITQLGRNF; ACQEFITQLGRNFQ; CQEFITQLGRNFQV; QEFITQLGRNFQVI; EFITQLGRNFQVIY; FITQLGRNFQVIYE; ITQLGRNFQVIYEQ; TQLGRNFQVIYEQA; QLGRNFQVIYEQAN; LGRNFQVIYEQANA; GRNFQVIYEQANAH; RNFQVIYEQANAHG; NFQVIYEQANAHGQ; FQVIYEQANAHGQK; QVIYEQANAHGQKV; VIYEQANAHGQKVQ; IYEQANAHGQKVQA; YEQANAHGQKVQAA; EQANAHGQKVQAAG; QANAHGQKVQAAGN; ANAHGQKVQAAGNN; NAHGQKVQAAGNNM; AHGQKVQAAGNNMA; HGQKVQAAGNNMAQ; GQKVQAAGNNMAQT; QKVQAAGNNMAQTD; KVQAAGNNMAQTDS; VQAAGNNMAQTDSA; QAAGNNMAQTDSAV; AAGNNMAQTDSAVG; AGNNMAQTDSAVGS; GNNMAQTDSAVGSS; NNMAQTDSAVGSSW; NMAQTDSAVGSSWA;<br><br>15 mers:<br>MTINYQFGDVDAHGA; TINYQFGDVDAHGAM; INYQFGDVDAHGAMI; NYQFGDVDAHGAMIR; YQFGDVDAHGAMIRA; QFGDVDAHGAMIRAQ; FGDVDAHGAMIRAQA; GDVDAHGAMIRAQAA; DVDAHGAMIRAQAAS; VDAHGAMIRAQAASL; DAHGAMIRAQAASLE; AHGAMIRAQAASLEA; | |

Fig. 29 continued

| | | |
|---|---|---|
| | HGAMIRAQAASLEAE; GAMIRAQAASLEAEH; AMIRAQAASLEAEHQ; MIRAQAASLEAEHQA; IRAQAASLEAEHQAI; RAQAASLEAEHQAIV; AQAASLEAEHQAIVR; QAASLEAEHQAIVRD; AASLEAEHQAIVRDV; ASLEAEHQAIVRDVL; SLEAEHQAIVRDVLA; LEAEHQAIVRDVLAA; EAEHQAIVRDVLAAG; AEHQAIVRDVLAAGD; EHQAIVRDVLAAGDF; HQAIVRDVLAAGDFW; QAIVRDVLAAGDFWG; AIVRDVLAAGDFWGG; IVRDVLAAGDFWGGA; VRDVLAAGDFWGGAG; RDVLAAGDFWGGAGS; DVLAAGDFWGGAGSV; VLAAGDFWGGAGSVA; LAAGDFWGGAGSVAC; AAGDFWGGAGSVACQ; AGDFWGGAGSVACQE; GDFWGGAGSVACQEF; DFWGGAGSVACQEFI; FWGGAGSVACQEFIT; WGGAGSVACQEFITQ; GGAGSVACQEFITQL; GAGSVACQEFITQLG; AGSVACQEFITQLGR; GSVACQEFITQLGRN; SVACQEFITQLGRNF; VACQEFITQLGRNFQ; ACQEFITQLGRNFQV; CQEFITQLGRNFQVI; QEFITQLGRNFQVIY; EFITQLGRNFQVIYE; FITQLGRNFQVIYEQ; ITQLGRNFQVIYEQA; TQLGRNFQVIYEQAN; QLGRNFQVIYEQANA; LGRNFQVIYEQANAH; GRNFQVIYEQANAHG; RNFQVIYEQANAHGQ; NFQVIYEQANAHGQK; FQVIYEQANAHGQKV; QVIYEQANAHGQKVQ; VIYEQANAHGQKVQA; IYEQANAHGQKVQAA; YEQANAHGQKVQAAG; EQANAHGQKVQAAGN; QANAHGQKVQAAGNN; ANAHGQKVQAAGNNM; NAHGQKVQAAGNNMA; AHGQKVQAAGNNMAQ; HGQKVQAAGNNMAQT; GQKVQAAGNNMAQTD; QKVQAAGNNMAQTDS; KVQAAGNNMAQTDSA; VQAAGNNMAQTDSAV; QAAGNNMAQTDSAVG; AAGNNMAQTDSAVGS; AGNNMAQTDSAVGSS; GNNMAQTDSAVGSSW; NNMAQTDSAVGSSWA;<br><br>16 mers:<br>MTINYQFGDVDAHGAM; TINYQFGDVDAHGAMI; INYQFGDVDAHGAMIR; NYQFGDVDAHGAMIRA; YQFGDVDAHGAMIRAQ; QFGDVDAHGAMIRAQA; FGDVDAHGAMIRAQAA; GDVDAHGAMIRAQAAS; DVDAHGAMIRAQAASL; VDAHGAMIRAQAASLE; DAHGAMIRAQAASLEA; AHGAMIRAQAASLEAE; HGAMIRAQAASLEAEH; GAMIRAQAASLEAEHQ; AMIRAQAASLEAEHQA; MIRAQAASLEAEHQAI; IRAQAASLEAEHQAIV; RAQAASLEAEHQAIVR; AQAASLEAEHQAIVRD; QAASLEAEHQAIVRDV; AASLEAEHQAIVRDVL; ASLEAEHQAIVRDVLA; SLEAEHQAIVRDVLAA; LEAEHQAIVRDVLAAG; EAEHQAIVRDVLAAGD; AEHQAIVRDVLAAGDF; EHQAIVRDVLAAGDFW; HQAIVRDVLAAGDFWG; QAIVRDVLAAGDFWGG; AIVRDVLAAGDFWGGA; IVRDVLAAGDFWGGAG; VRDVLAAGDFWGGAGS; RDVLAAGDFWGGAGSV; DVLAAGDFWGGAGSVA; VLAAGDFWGGAGSVAC; LAAGDFWGGAGSVACQ; AAGDFWGGAGSVACQE; AGDFWGGAGSVACQEF; GDFWGGAGSVACQEFI; DFWGGAGSVACQEFIT; FWGGAGSVACQEFITQ; WGGAGSVACQEFITQL; GGAGSVACQEFITQLG; GAGSVACQEFITQLGR; AGSVACQEFITQLGRN; GSVACQEFITQLGRNF; SVACQEFITQLGRNFQ; VACQEFITQLGRNFQV; ACQEFITQLGRNFQVI; CQEFITQLGRNFQVIY; QEFITQLGRNFQVIYE; EFITQLGRNFQVIYEQ; FITQLGRNFQVIYEQA; ITQLGRNFQVIYEQAN; TQLGRNFQVIYEQANA; QLGRNFQVIYEQANAH; LGRNFQVIYEQANAHG; GRNFQVIYEQANAHGQ; RNFQVIYEQANAHGQK; NFQVIYEQANAHGQKV; FQVIYEQANAHGQKVQ; QVIYEQANAHGQKVQA; VIYEQANAHGQKVQAA; IYEQANAHGQKVQAAG; YEQANAHGQKVQAAGN; EQANAHGQKVQAAGNN; QANAHGQKVQAAGNNM; ANAHGQKVQAAGNNMA; NAHGQKVQAAGNNMAQ; AHGQKVQAAGNNMAQT; HGQKVQAAGNNMAQTD; GQKVQAAGNNMAQTDS; QKVQAAGNNMAQTDSA; KVQAAGNNMAQTDSAV; VQAAGNNMAQTDSAVG; QAAGNNMAQTDSAVGS; AAGNNMAQTDSAVGSS; AGNNMAQTDSAVGSSW; GNNMAQTDSAVGSSWA; | |

Fig. 29 continued

| | | |
|---|---|---|
| 28) Rv1809 | 13 mers: MDFGLQPPEITSG; DFGLQPPEITSGE; FGLQPPEITSGEM; GLQPPEITSGEMY; LQPPEITSGEMYL; QPPEITSGEMYLG; PPEITSGEMYLGP; PEITSGEMYLGPG; EITSGEMYLGPGA; ITSGEMYLGPGAG; TSGEMYLGPGAGP; SGEMYLGPGAGPM; GEMYLGPGAGPML; EMYLGPGAGPMLA; MYLGPGAGPMLAA; YLGPGAGPMLAAA; LGPGAGPMLAAAV; GPGAGPMLAAAVA; PGAGPMLAAAVAW; GAGPMLAAAVAWD; AGPMLAAAVAWDG; GPMLAAAVAWDGL; PMLAAAVAWDGLA; MLAAAVAWDGLAA; LAAAVAWDGLAAE; AAAVAWDGLAAEL; AAVAWDGLAAELQ; AVAWDGLAAELQS; VAWDGLAAELQSM; AWDGLAAELQSMA; WDGLAAELQSMAA; DGLAAELQSMAAS; GLAAELQSMAASY; LAAELQSMAASYA; AAELQSMAASYAS; AELQSMAASYASI; ELQSMAASYASIV; LQSMAASYASIVE; QSMAASYASIVEG; SMAASYASIVEGM; MAASYASIVEGMA; AASYASIVEGMAS; ASYASIVEGMASE; SYASIVEGMASES; YASIVEGMASESW; ASIVEGMASESWL; SIVEGMASESWLG; IVEGMASESWLGP; VEGMASESWLGPS; EGMASESWLGPSS; GMASESWLGPSSA; MASESWLGPSSAG; ASESWLGPSSAGM; SESWLGPSSAGMA; ESWLGPSSAGMAA; SWLGPSSAGMAAA; WLGPSSAGMAAAA; LGPSSAGMAAAAA; GPSSAGMAAAAAP; PSSAGMAAAAAPY; SSAGMAAAAAPYV; SAGMAAAAAPYVT; AGMAAAAAPYVTW; GMAAAAAPYVTWM; MAAAAAPYVTWMS; AAAAAPYVTWMSG; AAAAPYVTWMSGT; AAAPYVTWMSGTS; AAPYVTWMSGTSA; APYVTWMSGTSAQ; PYVTWMSGTSAQA; YVTWMSGTSAQAK; VTWMSGTSAQAKA; TWMSGTSAQAKAA; WMSGTSAQAKAAA; MSGTSAQAKAAAD; SGTSAQAKAAADQ; GTSAQAKAAADQA; TSAQAKAAADQAR; SAQAKAAADQARA; AQAKAAADQARAA; QAKAAADQARAAV; AKAAADQARAAVV; KAAADQARAAVVA; AAADQARAAVVAY; AADQARAAVVAYE; ADQARAAVVAYET; DQARAAVVAYETA; QARAAVVAYETAF; ARAAVVAYETAFA; RAAVVAYETAFAA; AAVVAYETAFAAV; AVVAYETAFAAVV; VVAYETAFAAVVP; VAYETAFAAVVPP; AYETAFAAVVPPP; YETAFAAVVPPPQ; ETAFAAVVPPPQI; TAFAAVVPPPQIA; AFAAVVPPPQIAA; FAAVVPPPQIAAN; AAVVPPPQIAANR; AVVPPPQIAANRS; VVPPPQIAANRSQ; VPPPQIAANRSQL; PPPQIAANRSQLI; PPQIAANRSQLIS; PQIAANRSQLISL; QIAANRSQLISLV; IAANRSQLISLVA; AANRSQLISLVAT; ANRSQLISLVATN; NRSQLISLVATNI; RSQLISLVATNIF; SQLISLVATNIFG; QLISLVATNIFGQ; LISLVATNIFGQN; ISLVATNIFGQNT; SLVATNIFGQNTA; LVATNIFGQNTAA; VATNIFGQNTAAI; ATNIFGQNTAAIA; TNIFGQNTAAIAA; NIFGQNTAAIAAT; IFGQNTAAIAATE; FGQNTAAIAATEA; GQNTAAIAATEAE; QNTAAIAATEAEY; NTAAIAATEAEYG; TAAIAATEAEYGE; AAIAATEAEYGEM; AIAATEAEYGEMW; IAATEAEYGEMWA; AATEAEYGEMWAQ; ATEAEYGEMWAQD; TEAEYGEMWAQDT; EAEYGEMWAQDTM; AEYGEMWAQDTMA; EYGEMWAQDTMAM; YGEMWAQDTMAMF; GEMWAQDTMAMFG; EMWAQDTMAMFGY; MWAQDTMAMFGYA; WAQDTMAMFGYAS; AQDTMAMFGYASS; QDTMAMFGYASSS; DTMAMFGYASSSA; TMAMFGYASSSAT; MAMFGYASSSATA; AMFGYASSSATAS; MFGYASSSATASR; FGYASSSATASRL; GYASSSATASRLT; YASSSATASRLTP; ASSSATASRLTPF; SSSATASRLTPFT; SSATASRLTPFTA; SATASRLTPFTAP; ATASRLTPFTAPP; TASRLTPFTAPPQ; ASRLTPFTAPPQT; SRLTPFTAPPQTT; RLTPFTAPPQTTN; LTPFTAPPQTTNP; TPFTAPPQTTNPS; PFTAPPQTTNPSG; FTAPPQTTNPSGL; TAPPQTTNPSGLA; APPQTTNPSGLAG; PPQTTNPSGLAGQ; PQTTNPSGLAGQA; QTTNPSGLAGQAA; TTNPSGLAGQAAA; TNPSGLAGQAAAT; NPSGLAGQAAATG; PSGLAGQAAATGQ; SGLAGQAAATGQA; GLAGQAAATGQAT; | 82289-84106 |

Fig. 29 continued

| | | |
|---|---|---|
| | LAGQAAATGQATA; AGQAAATGQATAL; GQAAATGQATALA; QAAATGQATALAS; AAATGQATALASG; AATGQATALASGT; ATGQATALASGTN; TGQATALASGTNA; GQATALASGTNAV; QATALASGTNAVT; ATALASGTNAVTT; TALASGTNAVTTA; ALASGTNAVTTAL; LASGTNAVTTALS; ASGTNAVTTALSS; SGTNAVTTALSSA; GTNAVTTALSSAA; TNAVTTALSSAAA; NAVTTALSSAAAQ; AVTTALSSAAAQF; VTTALSSAAAQFP; TTALSSAAAQFPF; TALSSAAAQFPFD; ALSSAAAQFPFDI; LSSAAAQFPFDII; SSAAAQFPFDIIP; SAAAQFPFDIIPT; AAAQFPFDIIPTL; AAQFPFDIIPTLL; AQFPFDIIPTLLQ; QFPFDIIPTLLQG; FPFDIIPTLLQGL; PFDIIPTLLQGLA; FDIIPTLLQGLAT; DIIPTLLQGLATL; IIPTLLQGLATLS; IPTLLQGLATLST; PTLLQGLATLSTQ; TLLQGLATLSTQY; LLQGLATLSTQYT; LQGLATLSTQYTQ; QGLATLSTQYTQL; GLATLSTQYTQLM; LATLSTQYTQLMG; ATLSTQYTQLMGQ; TLSTQYTQLMGQL; LSTQYTQLMGQLI; STQYTQLMGQLIN; TQYTQLMGQLINA; QYTQLMGQLINAI; YTQLMGQLINAIF; TQLMGQLINAIFG; QLMGQLINAIFGP; LMGQLINAIFGPT; MGQLINAIFGPTG; GQLINAIFGPTGA; QLINAIFGPTGAT; LINAIFGPTGATT; INAIFGPTGATTY; NAIFGPTGATTYQ; AIFGPTGATTYQN; IFGPTGATTYQNV; FGPTGATTYQNVF; GPTGATTYQNVFV; PTGATTYQNVFVT; TGATTYQNVFVTA; GATTYQNVFVTAA; ATTYQNVFVTAAN; TTYQNVFVTAANV; TYQNVFVTAANVT; YQNVFVTAANVTK; QNVFVTAANVTKF; NVFVTAANVTKFS; VFVTAANVTKFST; FVTAANVTKFSTW; VTAANVTKFSTWA; TAANVTKFSTWAN; AANVTKFSTWAND; ANVTKFSTWANDA; NVTKFSTWANDAM; VTKFSTWANDAMS; TKFSTWANDAMSA; KFSTWANDAMSAP; FSTWANDAMSAPN; STWANDAMSAPNL; TWANDAMSAPNLG; WANDAMSAPNLGM; ANDAMSAPNLGMT; NDAMSAPNLGMTE; DAMSAPNLGMTEF; AMSAPNLGMTEFK; MSAPNLGMTEFKV; SAPNLGMTEFKVF; APNLGMTEFKVFW; PNLGMTEFKVFWQ; NLGMTEFKVFWQP; LGMTEFKVFWQPP; GMTEFKVFWQPPP; MTEFKVFWQPPPA; TEFKVFWQPPPAP; EFKVFWQPPPAPE; FKVFWQPPPAPEI; KVFWQPPPAPEIP; VFWQPPPAPEIPK; FWQPPPAPEIPKS; WQPPPAPEIPKSS; QPPPAPEIPKSSL; PPPAPEIPKSSLG; PPAPEIPKSSLGA; PAPEIPKSSLGAG; APEIPKSSLGAGL; PEIPKSSLGAGLG; EIPKSSLGAGLGL; IPKSSLGAGLGLR; PKSSLGAGLGLRS; KSSLGAGLGLRSG; SSLGAGLGLRSGL; SLGAGLGLRSGLS; LGAGLGLRSGLSA; GAGLGLRSGLSAG; AGLGLRSGLSAGL; GLGLRSGLSAGLA; LGLRSGLSAGLAH; GLRSGLSAGLAHA; LRSGLSAGLAHAA; RSGLSAGLAHAAS; SGLSAGLAHAASA; GLSAGLAHAASAG; LSAGLAHAASAGL; SAGLAHAASAGLG; AGLAHAASAGLGQ; GLAHAASAGLGQA; LAHAASAGLGQAN; AHAASAGLGQANL; HAASAGLGQANLV; AASAGLGQANLVG; ASAGLGQANLVGD; SAGLGQANLVGDL; AGLGQANLVGDLS; GLGQANLVGDLSV; LGQANLVGDLSVP; GQANLVGDLSVPP; QANLVGDLSVPPS; ANLVGDLSVPPSW; NLVGDLSVPPSWA; LVGDLSVPPSWAS; VGDLSVPPSWASA; GDLSVPPSWASAT; DLSVPPSWASATP; LSVPPSWASATPA; SVPPSWASATPAV; VPPSWASATPAVR; PPSWASATPAVRL; PSWASATPAVRLV; SWASATPAVRLVA; WASATPAVRLVAN; ASATPAVRLVANT; SATPAVRLVANTL; ATPAVRLVANTLP; TPAVRLVANTLPA; PAVRLVANTLPAT; AVRLVANTLPATS; VRLVANTLPATSL; RLVANTLPATSLA; LVANTLPATSLAA; VANTLPATSLAAA; ANTLPATSLAAAP; NTLPATSLAAAPA; TLPATSLAAAPAT; LPATSLAAAPATQ; PATSLAAAPATQI; ATSLAAAPATQIP; TSLAAAPATQIPA; SLAAAPATQIPAN; LAAAPATQIPANL; AAAPATQIPANLL; AAPATQIPANLLG; APATQIPANLLGQ; PATQIPANLLGQM; ATQIPANLLGQMA; TQIPANLLGQMAL; QIPANLLGQMALG; IPANLLGQMALGS; PANLLGQMALGSM; ANLLGQMALGSMT; NLLGQMALGSMTG; LLGQMALGSMTGG; LGQMALGSMTGGA; GQMALGSMTGGAL; QMALGSMTGGALG; MALGSMTGGALGA; ALGSMTGGALGAA; LGSMTGGALGAAA; GSMTGGALGAAAP; | |

Fig. 29 continued

| | | | |
|---|---|---|---|
| | SMTGGALGAAAPA; MTGGALGAAAPAI; TGGALGAAAPAIY; GGALGAAAPAIYT;<br>GALGAAAPAIYTG; ALGAAAPAIYTGS; LGAAAPAIYTGSG; GAAAPAIYTGSGA;<br>AAAPAIYTGSGAR; AAPAIYTGSGARA; APAIYTGSGARAR; PAIYTGSGARARA;<br>AIYTGSGARARAN; IYTGSGARARANG; YTGSGARARANGG;<br>TGSGARARANGGT; GSGARARANGGTP; SGARARANGGTPS;<br>GARARANGGTPSA; ARARANGGTPSAE; RARANGGTPSAEP;<br>ARANGGTPSAEPV; RANGGTPSAEPVK; ANGGTPSAEPVKL;<br>NGGTPSAEPVKLE; GGTPSAEPVKLEA; GTPSAEPVKLEAV; TPSAEPVKLEAVI;<br>PSAEPVKLEAVIA; SAEPVKLEAVIAQ; AEPVKLEAVIAQL; EPVKLEAVIAQLQ;<br>PVKLEAVIAQLQK; VKLEAVIAQLQKQ; KLEAVIAQLQKQP; LEAVIAQLQKQPD;<br>EAVIAQLQKQPDA; AVIAQLQKQPDAV; VIAQLQKQPDAVR; IAQLQKQPDAVRH;<br>AQLQKQPDAVRHW; QLQKQPDAVRHWN; LQKQPDAVRHWNV;<br>QKQPDAVRHWNVD; KQPDAVRHWNVDK; QPDAVRHWNVDKA;<br>PDAVRHWNVDKAD; DAVRHWNVDKADL; AVRHWNVDKADLD;<br>VRHWNVDKADLDG; RHWNVDKADLDGL; HWNVDKADLDGLL;<br>WNVDKADLDGLLD; NVDKADLDGLLDR; VDKADLDGLLDRL; DKADLDGLLDRLS;<br>KADLDGLLDRLSK; ADLDGLLDRLSKQ; DLDGLLDRLSKQP; LDGLLDRLSKQPG;<br>DGLLDRLSKQPGI; GLLDRLSKQPGIH; LLDRLSKQPGIHA; LDRLSKQPGIHAV;<br>DRLSKQPGIHAVH; RLSKQPGIHAVHV; LSKQPGIHAVHVS; SKQPGIHAVHVSN;<br>KQPGIHAVHVSNG; QPGIHAVHVSNGD; PGIHAVHVSNGDK; GIHAVHVSNGDKP;<br>IHAVHVSNGDKPK; HAVHVSNGDKPKV; AVHVSNGDKPKVA; VHVSNGDKPKVAL;<br>HVSNGDKPKVALP; VSNGDKPKVALPD; SNGDKPKVALPDT; NGDKPKVALPDTQ;<br>GDKPKVALPDTQL; DKPKVALPDTQLG; KPKVALPDTQLGS; PKVALPDTQLGSH<br><br>14 mers:<br>MDFGLQPPEITSGE; DFGLQPPEITSGEM; FGLQPPEITSGEMY;<br>GLQPPEITSGEMYL; LQPPEITSGEMYLG; QPPEITSGEMYLGP;<br>PPEITSGEMYLGPG; PEITSGEMYLGPGA; EITSGEMYLGPGAG;<br>ITSGEMYLGPGAGP; TSGEMYLGPGAGPM; SGEMYLGPGAGPML;<br>GEMYLGPGAGPMLA; EMYLGPGAGPMLAA; MYLGPGAGPMLAAA;<br>YLGPGAGPMLAAAV; LGPGAGPMLAAAVA; GPGAGPMLAAAVAW;<br>PGAGPMLAAAVAWD; GAGPMLAAAVAWDG; AGPMLAAAVAWDGL;<br>GPMLAAAVAWDGLA; PMLAAAVAWDGLAA; MLAAAVAWDGLAAE;<br>LAAAVAWDGLAAEL; AAAVAWDGLAAELQ; AAVAWDGLAAELQS;<br>AVAWDGLAAELQSM; VAWDGLAAELQSMA; AWDGLAAELQSMAA;<br>WDGLAAELQSMAAS; DGLAAELQSMAASY; GLAAELQSMAASYA;<br>LAAELQSMAASYAS; AAELQSMAASYASI; AELQSMAASYASIV;<br>ELQSMAASYASIVE; LQSMAASYASIVEG; QSMAASYASIVEGM;<br>SMAASYASIVEGMA; MAASYASIVEGMAS; AASYASIVEGMASE;<br>ASYASIVEGMASES; SYASIVEGMASESW; YASIVEGMASESWL;<br>ASIVEGMASESWLG; SIVEGMASESWLGP; IVEGMASESWLGPS;<br>VEGMASESWLGPSS; EGMASESWLGPSSA; GMASESWLGPSSAG;<br>MASESWLGPSSAGM; ASESWLGPSSAGMA; SESWLGPSSAGMAA;<br>ESWLGPSSAGMAAA; SWLGPSSAGMAAAA; WLGPSSAGMAAAAA;<br>LGPSSAGMAAAAAP; GPSSAGMAAAAAPY; PSSAGMAAAAAPYV;<br>SSAGMAAAAAPYVT; SAGMAAAAAPYVTW; AGMAAAAAPYVTWM;<br>GMAAAAAPYVTWMS; MAAAAAPYVTWMSG; AAAAAPYVTWMSGT;<br>AAAAPYVTWMSGTS; AAAPYVTWMSGTSA; AAPYVTWMSGTSAQ;<br>APYVTWMSGTSAQA; PYVTWMSGTSAQAK; YVTWMSGTSAQAKA;<br>VTWMSGTSAQAKAA; TWMSGTSAQAKAAA; WMSGTSAQAKAAAD;<br>MSGTSAQAKAAADQ; SGTSAQAKAAADQA; GTSAQAKAAADQAR;<br>TSAQAKAAADQARA; SAQAKAAADQARAA; AQAKAAADQARAAV;<br>QAKAAADQARAAVV; AKAAADQARAAVVA; KAAADQARAAVVAY; | | |

Fig. 29 continued

| | | | |
|---|---|---|---|
| | AAADQARAAVVAYE; AADQARAAVVAYET; ADQARAAVVAYETA; DQARAAVVAYETAF; QARAAVVAYETAFA; ARAAVVAYETAFAA; RAAVVAYETAFAAV; AAVVAYETAFAAVV; AVVAYETAFAAVVP; VVAYETAFAAVVPP; VAYETAFAAVVPPP; AYETAFAAVVPPPQ; YETAFAAVVPPPQI; ETAFAAVVPPPQIA; TAFAAVVPPPQIAA; AFAAVVPPPQIAAN; FAAVVPPPQIAANR; AAVVPPPQIAANRS; AVVPPPQIAANRSQ; VVPPPQIAANRSQL; VPPPQIAANRSQLI; PPPQIAANRSQLIS; PPQIAANRSQLISL; PQIAANRSQLISLV; QIAANRSQLISLVA; IAANRSQLISLVAT; AANRSQLISLVATN; ANRSQLISLVATNI; NRSQLISLVATNIF; RSQLISLVATNIFG; SQLISLVATNIFGQ; QLISLVATNIFGQN; LISLVATNIFGQNT; ISLVATNIFGQNTA; SLVATNIFGQNTAA; LVATNIFGQNTAAI; VATNIFGQNTAAIA; ATNIFGQNTAAIAA; TNIFGQNTAAIAAT; NIFGQNTAAIAATE; IFGQNTAAIAATEA; FGQNTAAIAATEAE; GQNTAAIAATEAEY; QNTAAIAATEAEYG; NTAAIAATEAEYGE; TAAIAATEAEYGEM; AAIAATEAEYGEMW; AIAATEAEYGEMWA; IAATEAEYGEMWAQ; AATEAEYGEMWAQD; ATEAEYGEMWAQDT; TEAEYGEMWAQDTM; EAEYGEMWAQDTMA; AEYGEMWAQDTMAM; EYGEMWAQDTMAMF; YGEMWAQDTMAMFG; GEMWAQDTMAMFGY; EMWAQDTMAMFGYA; MWAQDTMAMFGYAS; WAQDTMAMFGYASS; AQDTMAMFGYASSS; QDTMAMFGYASSSA; DTMAMFGYASSSAT; TMAMFGYASSSATA; MAMFGYASSSATAS; AMFGYASSSATASR; MFGYASSSATASRL; FGYASSSATASRLT; GYASSSATASRLTP; YASSSATASRLTPF; ASSSATASRLTPFT; SSSATASRLTPFTA; SSATASRLTPFTAP; SATASRLTPFTAPP; ATASRLTPFTAPPQ; TASRLTPFTAPPQT; ASRLTPFTAPPQTT; SRLTPFTAPPQTTN; RLTPFTAPPQTTNP; LTPFTAPPQTTNPS; TPFTAPPQTTNPSG; PFTAPPQTTNPSGL; FTAPPQTTNPSGLA; TAPPQTTNPSGLAG; APPQTTNPSGLAGQ; PPQTTNPSGLAGQA; PQTTNPSGLAGQAA; QTTNPSGLAGQAAA; TTNPSGLAGQAAAT; TNPSGLAGQAAATG; NPSGLAGQAAATGQ; PSGLAGQAAATGQA; SGLAGQAAATGQAT; GLAGQAAATGQATA; LAGQAAATGQATAL; AGQAAATGQATALA; GQAAATGQATALAS; QAAATGQATALASG; AAATGQATALASGT; AATGQATALASGTN; ATGQATALASGTNA; TGQATALASGTNAV; GQATALASGTNAVT; QATALASGTNAVTT; ATALASGTNAVTTA; TALASGTNAVTTAL; ALASGTNAVTTALS; LASGTNAVTTALSS; ASGTNAVTTALSSA; SGTNAVTTALSSAA; GTNAVTTALSSAAA; TNAVTTALSSAAAQ; NAVTTALSSAAAQF; AVTTALSSAAAQFP; VTTALSSAAAQFPF; TTALSSAAAQFPFD; TALSSAAAQFPFDI; ALSSAAAQFPFDII; LSSAAAQFPFDIIP; SSAAAQFPFDIIPT; SAAAQFPFDIIPTL; AAAQFPFDIIPTLL; AAQFPFDIIPTLLQ; AQFPFDIIPTLLQG; QFPFDIIPTLLQGL; FPFDIIPTLLQGLA; PFDIIPTLLQGLAT; FDIIPTLLQGLATL; DIIPTLLQGLATLS; IIPTLLQGLATLST; IPTLLQGLATLSTQ; PTLLQGLATLSTQY; TLLQGLATLSTQYT; LLQGLATLSTQYTQ; LQGLATLSTQYTQL; QGLATLSTQYTQLM; GLATLSTQYTQLMG; LATLSTQYTQLMGQ; ATLSTQYTQLMGQL; TLSTQYTQLMGQLI; LSTQYTQLMGQLIN; STQYTQLMGQLINA; TQYTQLMGQLINAI; QYTQLMGQLINAIF; YTQLMGQLINAIFG; TQLMGQLINAIFGP; QLMGQLINAIFGPT; LMGQLINAIFGPTG; MGQLINAIFGPTGA; GQLINAIFGPTGAT; QLINAIFGPTGATT; LINAIFGPTGATTY; INAIFGPTGATTYQ; NAIFGPTGATTYQN; AIFGPTGATTYQNV; IFGPTGATTYQNVF; FGPTGATTYQNVFV; GPTGATTYQNVFVT; PTGATTYQNVFVTA; TGATTYQNVFVTAA; GATTYQNVFVTAAN; ATTYQNVFVTAANV; TTYQNVFVTAANVT; TYQNVFVTAANVTK; YQNVFVTAANVTKF; QNVFVTAANVTKFS; NVFVTAANVTKFST; VFVTAANVTKFSTW; FVTAANVTKFSTWA; | | |

Fig. 29 continued

| | | |
|---|---|---|
| | VTAANVTKFSTWAN; TAANVTKFSTWAND; AANVTKFSTWANDA;<br>ANVTKFSTWANDAM; NVTKFSTWANDAMS; VTKFSTWANDAMSA;<br>TKFSTWANDAMSAP; KFSTWANDAMSAPN; FSTWANDAMSAPNL;<br>STWANDAMSAPNLG; TWANDAMSAPNLGM; WANDAMSAPNLGMT;<br>ANDAMSAPNLGMTE; NDAMSAPNLGMTEF; DAMSAPNLGMTEFK;<br>AMSAPNLGMTEFKV; MSAPNLGMTEFKVF; SAPNLGMTEFKVFW;<br>APNLGMTEFKVFWQ; PNLGMTEFKVFWQP; NLGMTEFKVFWQPP;<br>LGMTEFKVFWQPPP; GMTEFKVFWQPPPA; MTEFKVFWQPPPAP;<br>TEFKVFWQPPPAPE; EFKVFWQPPPAPEI; FKVFWQPPPAPEIP;<br>KVFWQPPPAPEIPK; VFWQPPPAPEIPKS; FWQPPPAPEIPKSS;<br>WQPPPAPEIPKSSL; QPPPAPEIPKSSLG; PPPAPEIPKSSLGA;<br>PPAPEIPKSSLGAG; PAPEIPKSSLGAGL; APEIPKSSLGAGLG;<br>PEIPKSSLGAGLGL; EIPKSSLGAGLGLR; IPKSSLGAGLGLRS;<br>PKSSLGAGLGLRSG; KSSLGAGLGLRSGL; SSLGAGLGLRSGLS;<br>SLGAGLGLRSGLSA; LGAGLGLRSGLSAG; GAGLGLRSGLSAGL;<br>AGLGLRSGLSAGLA; GLGLRSGLSAGLAH; LGLRSGLSAGLAHA;<br>GLRSGLSAGLAHAA; LRSGLSAGLAHAAS; RSGLSAGLAHAASA;<br>SGLSAGLAHAASAG; GLSAGLAHAASAGL; LSAGLAHAASAGLG;<br>SAGLAHAASAGLGQ; AGLAHAASAGLGQA; GLAHAASAGLGQAN;<br>LAHAASAGLGQANL; AHAASAGLGQANLV; HAASAGLGQANLVG;<br>AASAGLGQANLVGD; ASAGLGQANLVGDL; SAGLGQANLVGDLS;<br>AGLGQANLVGDLSV; GLGQANLVGDLSVP; LGQANLVGDLSVPP;<br>GQANLVGDLSVPPS; QANLVGDLSVPPSW; ANLVGDLSVPPSWA;<br>NLVGDLSVPPSWAS; LVGDLSVPPSWASA; VGDLSVPPSWASAT;<br>GDLSVPPSWASATP; DLSVPPSWASATPA; LSVPPSWASATPAV;<br>SVPPSWASATPAVR; VPPSWASATPAVRL; PPSWASATPAVRLV;<br>PSWASATPAVRLVA; SWASATPAVRLVAN; WASATPAVRLVANT;<br>ASATPAVRLVANTL; SATPAVRLVANTLP; ATPAVRLVANTLPA;<br>TPAVRLVANTLPAT; PAVRLVANTLPATS; AVRLVANTLPATSL;<br>VRLVANTLPATSLA; RLVANTLPATSLAA; LVANTLPATSLAAA;<br>VANTLPATSLAAAP; ANTLPATSLAAAPA; NTLPATSLAAAPAT;<br>TLPATSLAAAPATQ; LPATSLAAAPATQI; PATSLAAAPATQIP;<br>ATSLAAAPATQIPA; TSLAAAPATQIPAN; SLAAAPATQIPANL; LAAAPATQIPANLL;<br>AAAPATQIPANLLG; AAPATQIPANLLGQ; APATQIPANLLGQM;<br>PATQIPANLLGQMA; ATQIPANLLGQMAL; TQIPANLLGQMALG;<br>QIPANLLGQMALGS; IPANLLGQMALGSM; PANLLGQMALGSMT;<br>ANLLGQMALGSMTG; NLLGQMALGSMTGG; LLGQMALGSMTGGA;<br>LGQMALGSMTGGAL; GQMALGSMTGGALG; QMALGSMTGGALGA;<br>MALGSMTGGALGAA; ALGSMTGGALGAAA; LGSMTGGALGAAAP;<br>GSMTGGALGAAAPA; SMTGGALGAAAPAI; MTGGALGAAAPAIY;<br>TGGALGAAAPAIYT; GGALGAAAPAIYTG; GALGAAAPAIYTGS;<br>ALGAAAPAIYTGSG; LGAAAPAIYTGSGA; GAAAPAIYTGSGAR;<br>AAAPAIYTGSGARA; AAPAIYTGSGARAR; APAIYTGSGARARA;<br>PAIYTGSGARARAN; AIYTGSGARARANG; IYTGSGARARANGG;<br>YTGSGARARANGGT; TGSGARARANGGTP; GSGARARANGGTPS;<br>SGARARANGGTPSA; GARARANGGTPSAE; ARARANGGTPSAEP;<br>RARANGGTPSAEPV; ARANGGTPSAEPVK; RANGGTPSAEPVKL;<br>ANGGTPSAEPVKLE; NGGTPSAEPVKLEA; GGTPSAEPVKLEAV;<br>GTPSAEPVKLEAVI; TPSAEPVKLEAVIA; PSAEPVKLEAVIAQ;<br>SAEPVKLEAVIAQL; AEPVKLEAVIAQLQ; EPVKLEAVIAQLQK;<br>PVKLEAVIAQLQKQ; VKLEAVIAQLQKQP; KLEAVIAQLQKQPD;<br>LEAVIAQLQKQPDA; EAVIAQLQKQPDAV; AVIAQLQKQPDAVR;<br>VIAQLQKQPDAVRH; IAQLQKQPDAVRHW; AQLQKQPDAVRHWN; | |

Fig. 29 continued

| | | | |
|---|---|---|---|
| | QLQKQPDAVRHWNV; LQKQPDAVRHWNVD; QKQPDAVRHWNVDK; KQPDAVRHWNVDKA; QPDAVRHWNVDKAD; PDAVRHWNVDKADL; DAVRHWNVDKADLD; AVRHWNVDKADLDG; VRHWNVDKADLDGL; RHWNVDKADLDGLL; HWNVDKADLDGLLD; WNVDKADLDGLLDR; NVDKADLDGLLDRL; VDKADLDGLLDRLS; DKADLDGLLDRLSK; KADLDGLLDRLSKQ; ADLDGLLDRLSKQP; DLDGLLDRLSKQPG; LDGLLDRLSKQPGI; DGLLDRLSKQPGIH; GLLDRLSKQPGIHA; LLDRLSKQPGIHAV; LDRLSKQPGIHAVH; DRLSKQPGIHAVHV; RLSKQPGIHAVHVS; LSKQPGIHAVHVSN; SKQPGIHAVHVSNG; KQPGIHAVHVSNGD; QPGIHAVHVSNGDK; PGIHAVHVSNGDKP; GIHAVHVSNGDKPK; IHAVHVSNGDKPKV; HAVHVSNGDKPKVA; AVHVSNGDKPKVAL; VHVSNGDKPKVALP; HVSNGDKPKVALPD; VSNGDKPKVALPDT; SNGDKPKVALPDTQ; NGDKPKVALPDTQL; GDKPKVALPDTQLG; DKPKVALPDTQLGS; KPKVALPDTQLGSH<br><br>15 mers:<br>MDFGLQPPEITSGEM; DFGLQPPEITSGEMY; FGLQPPEITSGEMYL; GLQPPEITSGEMYLG; LQPPEITSGEMYLGP; QPPEITSGEMYLGPG; PPEITSGEMYLGPGA; PEITSGEMYLGPGAG; EITSGEMYLGPGAGP; ITSGEMYLGPGAGPM; TSGEMYLGPGAGPML; SGEMYLGPGAGPMLA; GEMYLGPGAGPMLAA; EMYLGPGAGPMLAAA; MYLGPGAGPMLAAAV; YLGPGAGPMLAAAVA; LGPGAGPMLAAAVAW; GPGAGPMLAAAVAWD; PGAGPMLAAAVAWDG; GAGPMLAAAVAWDGL; AGPMLAAAVAWDGLA; GPMLAAAVAWDGLAA; PMLAAAVAWDGLAAE; MLAAAVAWDGLAAEL; LAAAVAWDGLAAELQ; AAAVAWDGLAAELQS; AAVAWDGLAAELQSM; AVAWDGLAAELQSMA; VAWDGLAAELQSMAA; AWDGLAAELQSMAAS; WDGLAAELQSMAASY; DGLAAELQSMAASYA; GLAAELQSMAASYAS; LAAELQSMAASYASI; AAELQSMAASYASIV; AELQSMAASYASIVE; ELQSMAASYASIVEG; LQSMAASYASIVEGM; QSMAASYASIVEGMA; SMAASYASIVEGMAS; MAASYASIVEGMASE; AASYASIVEGMASES; ASYASIVEGMASESW; SYASIVEGMASESWL; YASIVEGMASESWLG; ASIVEGMASESWLGP; SIVEGMASESWLGPS; IVEGMASESWLGPSS; VEGMASESWLGPSSA; EGMASESWLGPSSAG; GMASESWLGPSSAGM; MASESWLGPSSAGMA; ASESWLGPSSAGMAA; SESWLGPSSAGMAAA; ESWLGPSSAGMAAAA; SWLGPSSAGMAAAAA; WLGPSSAGMAAAAAP; LGPSSAGMAAAAAPY; GPSSAGMAAAAAPYV; PSSAGMAAAAAPYVT; SSAGMAAAAAPYVTW; SAGMAAAAAPYVTWM; AGMAAAAAPYVTWMS; GMAAAAAPYVTWMSG; MAAAAAPYVTWMSGT; AAAAAPYVTWMSGTS; AAAAPYVTWMSGTSA; AAAPYVTWMSGTSAQ; AAPYVTWMSGTSAQA; APYVTWMSGTSAQAK; PYVTWMSGTSAQAKA; YVTWMSGTSAQAKAA; VTWMSGTSAQAKAAA; TWMSGTSAQAKAAAD; WMSGTSAQAKAAADQ; MSGTSAQAKAAADQA; SGTSAQAKAAADQAR; GTSAQAKAAADQARA; TSAQAKAAADQARAA; SAQAKAAADQARAAV; AQAKAAADQARAAVV; QAKAAADQARAAVVA; AKAAADQARAAVVAY; KAAADQARAAVVAYE; AAADQARAAVVAYET; AADQARAAVVAYETA; ADQARAAVVAYETAF; DQARAAVVAYETAFA; QARAAVVAYETAFAA; ARAAVVAYETAFAAV; RAAVVAYETAFAAVV; AAVVAYETAFAAVVP; AVVAYETAFAAVVPP; VVAYETAFAAVVPPP; VAYETAFAAVVPPPQ; AYETAFAAVVPPPQI; YETAFAAVVPPPQIA; ETAFAAVVPPPQIAA; TAFAAVVPPPQIAAN; AFAAVVPPPQIAANR; FAAVVPPPQIAANRS; AAVVPPPQIAANRSQ; AVVPPPQIAANRSQL; VVPPPQIAANRSQLI; VPPPQIAANRSQLIS; PPPQIAANRSQLISL; PPQIAANRSQLISLV; PQIAANRSQLISLVA; QIAANRSQLISLVAT; IAANRSQLISLVATN; AANRSQLISLVATNI; | |

Fig. 29 continued

| | | |
|---|---|---|
| | ANRSQLISLVATNIF; NRSQLISLVATNIFG; RSQLISLVATNIFGQ;<br>SQLISLVATNIFGQN; QLISLVATNIFGQNT; LISLVATNIFGQNTA;<br>ISLVATNIFGQNTAA; SLVATNIFGQNTAAI; LVATNIFGQNTAAIA;<br>VATNIFGQNTAAIAA; ATNIFGQNTAAIAAT; TNIFGQNTAAIAATE;<br>NIFGQNTAAIAATEA; IFGQNTAAIAATEAE; FGQNTAAIAATEAEY;<br>GQNTAAIAATEAEYG; QNTAAIAATEAEYGE; NTAAIAATEAEYGEM;<br>TAAIAATEAEYGEMW; AAIAATEAEYGEMWA; AIAATEAEYGEMWAQ;<br>IAATEAEYGEMWAQD; AATEAEYGEMWAQDT; ATEAEYGEMWAQDTM;<br>TEAEYGEMWAQDTMA; EAEYGEMWAQDTMAM; AEYGEMWAQDTMAMF;<br>EYGEMWAQDTMAMFG; YGEMWAQDTMAMFGY; GEMWAQDTMAMFGYA;<br>EMWAQDTMAMFGYAS; MWAQDTMAMFGYASS; WAQDTMAMFGYASSS;<br>AQDTMAMFGYASSSA; QDTMAMFGYASSSAT; DTMAMFGYASSSATA;<br>TMAMFGYASSSATAS; MAMFGYASSSATASR; AMFGYASSSATASRL;<br>MFGYASSSATASRLT; FGYASSSATASRLTP; GYASSSATASRLTPF;<br>YASSSATASRLTPFT; ASSSATASRLTPFTA; SSSATASRLTPFTAP;<br>SSATASRLTPFTAPP; SATASRLTPFTAPPQ; ATASRLTPFTAPPQT;<br>TASRLTPFTAPPQTT; ASRLTPFTAPPQTTN; SRLTPFTAPPQTTNP;<br>RLTPFTAPPQTTNPS; LTPFTAPPQTTNPSG; TPFTAPPQTTNPSGL;<br>PFTAPPQTTNPSGLA; FTAPPQTTNPSGLAG; TAPPQTTNPSGLAGQ;<br>APPQTTNPSGLAGQA; PPQTTNPSGLAGQAA; PQTTNPSGLAGQAAA;<br>QTTNPSGLAGQAAAT; TTNPSGLAGQAAATG; TNPSGLAGQAAATGQ;<br>NPSGLAGQAAATGQA; PSGLAGQAAATGQAT; SGLAGQAAATGQATA;<br>GLAGQAAATGQATAL; LAGQAAATGQATALA; AGQAAATGQATALAS;<br>GQAAATGQATALASG; QAAATGQATALASGT; AAATGQATALASGTN;<br>AATGQATALASGTNA; ATGQATALASGTNAV; TGQATALASGTNAVT;<br>GQATALASGTNAVTT; QATALASGTNAVTTA; ATALASGTNAVTTAL;<br>TALASGTNAVTTALS; ALASGTNAVTTALSS; LASGTNAVTTALSSA;<br>ASGTNAVTTALSSAA; SGTNAVTTALSSAAA; GTNAVTTALSSAAAQ;<br>TNAVTTALSSAAAQF; NAVTTALSSAAAQFP; AVTTALSSAAAQFPF;<br>VTTALSSAAAQFPFD; TTALSSAAAQFPFDI; TALSSAAAQFPFDII;<br>ALSSAAAQFPFDIIP; LSSAAAQFPFDIIPT; SSAAAQFPFDIIPTL;<br>SAAAQFPFDIIPTLL; AAAQFPFDIIPTLLQ; AAQFPFDIIPTLLQG;<br>AQFPFDIIPTLLQGL; QFPFDIIPTLLQGLA; FPFDIIPTLLQGLAT;<br>PFDIIPTLLQGLATL; FDIIPTLLQGLATLS; DIIPTLLQGLATLST;<br>IIPTLLQGLATLSTQ; IPTLLQGLATLSTQY; PTLLQGLATLSTQYT;<br>TLLQGLATLSTQYTQ; LLQGLATLSTQYTQL; LQGLATLSTQYTQLM;<br>QGLATLSTQYTQLMG; GLATLSTQYTQLMGQ; LATLSTQYTQLMGQL;<br>ATLSTQYTQLMGQLI; TLSTQYTQLMGQLIN; LSTQYTQLMGQLINA;<br>STQYTQLMGQLINAI; TQYTQLMGQLINAIF; QYTQLMGQLINAIFG;<br>YTQLMGQLINAIFGP; TQLMGQLINAIFGPT; QLMGQLINAIFGPTG;<br>LMGQLINAIFGPTGA; MGQLINAIFGPTGAT; GQLINAIFGPTGATT;<br>QLINAIFGPTGATTY; LINAIFGPTGATTYQ; INAIFGPTGATTYQN;<br>NAIFGPTGATTYQNV; AIFGPTGATTYQNVF; IFGPTGATTYQNVFV;<br>FGPTGATTYQNVFVT; GPTGATTYQNVFVTA; PTGATTYQNVFVTAA;<br>TGATTYQNVFVTAAN; GATTYQNVFVTAANV; ATTYQNVFVTAANVT;<br>TTYQNVFVTAANVTK; TYQNVFVTAANVTKF; YQNVFVTAANVTKFS;<br>QNVFVTAANVTKFST; NVFVTAANVTKFSTW; VFVTAANVTKFSTWA;<br>FVTAANVTKFSTWAN; VTAANVTKFSTWAND; TAANVTKFSTWANDA;<br>AANVTKFSTWANDAM; ANVTKFSTWANDAMS; NVTKFSTWANDAMSA;<br>VTKFSTWANDAMSAP; TKFSTWANDAMSAPN; KFSTWANDAMSAPNL;<br>FSTWANDAMSAPNLG; STWANDAMSAPNLGM; TWANDAMSAPNLGMT;<br>WANDAMSAPNLGMTE; ANDAMSAPNLGMTEF; NDAMSAPNLGMTEFK;<br>DAMSAPNLGMTEFKV; AMSAPNLGMTEFKVF; MSAPNLGMTEFKVFW; | |

Fig. 29 continued

| | | |
|---|---|---|
| | SAPNLGMTEFKVFWQ; APNLGMTEFKVFWQP; PNLGMTEFKVFWQPP; | |
| | NLGMTEFKVFWQPPP; LGMTEFKVFWQPPPA; GMTEFKVFWQPPPAP; | |
| | MTEFKVFWQPPPAPE; TEFKVFWQPPPAPEI; EFKVFWQPPPAPEIP; | |
| | FKVFWQPPPAPEIPK; KVFWQPPPAPEIPKS; VFWQPPPAPEIPKSS; | |
| | FWQPPPAPEIPKSSL; WQPPPAPEIPKSSLG; QPPPAPEIPKSSLGA; | |
| | PPPAPEIPKSSLGAG; PPAPEIPKSSLGAGL; PAPEIPKSSLGAGLG; | |
| | APEIPKSSLGAGLGL; PEIPKSSLGAGLGLR; EIPKSSLGAGLGLRS; | |
| | IPKSSLGAGLGLRSG; PKSSLGAGLGLRSGL; KSSLGAGLGLRSGLS; | |
| | SSLGAGLGLRSGLSA; SLGAGLGLRSGLSAG; LGAGLGLRSGLSAGL; | |
| | GAGLGLRSGLSAGLA; AGLGLRSGLSAGLAH; GLGLRSGLSAGLAHA; | |
| | LGLRSGLSAGLAHAA; GLRSGLSAGLAHAAS; LRSGLSAGLAHAASA; | |
| | RSGLSAGLAHAASAG; SGLSAGLAHAASAGL; GLSAGLAHAASAGLG; | |
| | LSAGLAHAASAGLGQ; SAGLAHAASAGLGQA; AGLAHAASAGLGQAN; | |
| | GLAHAASAGLGQANL; LAHAASAGLGQANLV; AHAASAGLGQANLVG; | |
| | HAASAGLGQANLVGD; AASAGLGQANLVGDL; ASAGLGQANLVGDLS; | |
| | SAGLGQANLVGDLSV; AGLGQANLVGDLSVP; GLGQANLVGDLSVPP; | |
| | LGQANLVGDLSVPPS; GQANLVGDLSVPPSW; QANLVGDLSVPPSWA; | |
| | ANLVGDLSVPPSWAS; NLVGDLSVPPSWASA; LVGDLSVPPSWASAT; | |
| | VGDLSVPPSWASATP; GDLSVPPSWASATPA; DLSVPPSWASATPAV; | |
| | LSVPPSWASATPAVR; SVPPSWASATPAVRL; VPPSWASATPAVRLV; | |
| | PPSWASATPAVRLVA; PSWASATPAVRLVAN; SWASATPAVRLVANT; | |
| | WASATPAVRLVANTL; ASATPAVRLVANTLP; SATPAVRLVANTLPA; | |
| | ATPAVRLVANTLPAT; TPAVRLVANTLPATS; PAVRLVANTLPATSL; | |
| | AVRLVANTLPATSLA; VRLVANTLPATSLAA; RLVANTLPATSLAAA; | |
| | LVANTLPATSLAAAP; VANTLPATSLAAAPA; ANTLPATSLAAAPAT; | |
| | NTLPATSLAAAPATQ; TLPATSLAAAPATQI; LPATSLAAAPATQIP; | |
| | PATSLAAAPATQIPA; ATSLAAAPATQIPAN; TSLAAAPATQIPANL; | |
| | SLAAAPATQIPANLL; LAAAPATQIPANLLG; AAAPATQIPANLLGQ; | |
| | AAPATQIPANLLGQM; APATQIPANLLGQMA; PATQIPANLLGQMAL; | |
| | ATQIPANLLGQMALG; TQIPANLLGQMALGS; QIPANLLGQMALGSM; | |
| | IPANLLGQMALGSMT; PANLLGQMALGSMTG; ANLLGQMALGSMTGG; | |
| | NLLGQMALGSMTGGA; LLGQMALGSMTGGAL; LGQMALGSMTGGALG; | |
| | GQMALGSMTGGALGA; QMALGSMTGGALGAA; MALGSMTGGALGAAA; | |
| | ALGSMTGGALGAAAP; LGSMTGGALGAAAPA; GSMTGGALGAAAPAI; | |
| | SMTGGALGAAAPAIY; MTGGALGAAAPAIYT; TGGALGAAAPAIYTG; | |
| | GGALGAAAPAIYTGS; GALGAAAPAIYTGSG; ALGAAAPAIYTGSGA; | |
| | LGAAAPAIYTGSGAR; GAAAPAIYTGSGARA; AAAPAIYTGSGARAR; | |
| | AAPAIYTGSGARARA; APAIYTGSGARARAN; PAIYTGSGARARANG; | |
| | AIYTGSGARARANGG; IYTGSGARARANGGT; YTGSGARARANGGTP; | |
| | TGSGARARANGGTPS; GSGARARANGGTPSA; SGARARANGGTPSAE; | |
| | GARARANGGTPSAEP; ARARANGGTPSAEPV; RARANGGTPSAEPVK; | |
| | ARANGGTPSAEPVKL; RANGGTPSAEPVKLE; ANGGTPSAEPVKLEA; | |
| | NGGTPSAEPVKLEAV; GGTPSAEPVKLEAVI; GTPSAEPVKLEAVIA; | |
| | TPSAEPVKLEAVIAQ; PSAEPVKLEAVIAQL; SAEPVKLEAVIAQLQ; | |
| | AEPVKLEAVIAQLQK; EPVKLEAVIAQLQKQ; PVKLEAVIAQLQKQP; | |
| | VKLEAVIAQLQKQPD; KLEAVIAQLQKQPDA; LEAVIAQLQKQPDAV; | |
| | EAVIAQLQKQPDAVR; AVIAQLQKQPDAVRH; VIAQLQKQPDAVRHW; | |
| | IAQLQKQPDAVRHWN; AQLQKQPDAVRHWNV; QLQKQPDAVRHWNVD; | |
| | LQKQPDAVRHWNVDK; QKQPDAVRHWNVDKA; KQPDAVRHWNVDKAD; | |
| | QPDAVRHWNVDKADL; PDAVRHWNVDKADLD; DAVRHWNVDKADLDG; | |
| | AVRHWNVDKADLDGL; VRHWNVDKADLDGLL; RHWNVDKADLDGLLD; | |
| | HWNVDKADLDGLLDR; WNVDKADLDGLLDRL; NVDKADLDGLLDRLS; | |
| | VDKADLDGLLDRLSK; DKADLDGLLDRLSKQ; KADLDGLLDRLSKQP; | |

Fig. 29 continued

| | | | |
|---|---|---|---|
| | ADLDGLLDRLSKQPG; DLDGLLDRLSKQPGI; LDGLLDRLSKQPGIH;<br>DGLLDRLSKQPGIHA; GLLDRLSKQPGIHAV; LLDRLSKQPGIHAVH;<br>LDRLSKQPGIHAVHV; DRLSKQPGIHAVHVS; RLSKQPGIHAVHVSN;<br>LSKQPGIHAVHVSNG; SKQPGIHAVHVSNGD; KQPGIHAVHVSNGDK;<br>QPGIHAVHVSNGDKP; PGIHAVHVSNGDKPK; GIHAVHVSNGDKPKV;<br>IHAVHVSNGDKPKVA; HAVHVSNGDKPKVAL; AVHVSNGDKPKVALP;<br>VHVSNGDKPKVALPD; HVSNGDKPKVALPDT; VSNGDKPKVALPDTQ;<br>SNGDKPKVALPDTQL; NGDKPKVALPDTQLG; GDKPKVALPDTQLGS;<br>DKPKVALPDTQLGSH<br><br>16 mers:<br>MDFGLQPPEITSGEMY; DFGLQPPEITSGEMYL; FGLQPPEITSGEMYLG;<br>GLQPPEITSGEMYLGP; LQPPEITSGEMYLGPG; QPPEITSGEMYLGPGA;<br>PPEITSGEMYLGPGAG; PEITSGEMYLGPGAGP; EITSGEMYLGPGAGPM;<br>ITSGEMYLGPGAGPML; TSGEMYLGPGAGPMLA; SGEMYLGPGAGPMLAA;<br>GEMYLGPGAGPMLAAA; EMYLGPGAGPMLAAAV; MYLGPGAGPMLAAAVA;<br>YLGPGAGPMLAAAVAW; LGPGAGPMLAAAVAWD; GPGAGPMLAAAVAWDG;<br>PGAGPMLAAAVAWDGL; GAGPMLAAAVAWDGLA; AGPMLAAAVAWDGLAA;<br>GPMLAAAVAWDGLAAE; PMLAAAVAWDGLAAEL; MLAAAVAWDGLAAELQ;<br>LAAAVAWDGLAAELQS; AAAVAWDGLAAELQSM; AAVAWDGLAAELQSMA;<br>AVAWDGLAAELQSMAA; VAWDGLAAELQSMAAS; AWDGLAAELQSMAASY;<br>WDGLAAELQSMAASYA; DGLAAELQSMAASYAS; GLAAELQSMAASYASI;<br>LAAELQSMAASYASIV; AAELQSMAASYASIVE; AELQSMAASYASIVEG;<br>ELQSMAASYASIVEGM; LQSMAASYASIVEGMA; QSMAASYASIVEGMAS;<br>SMAASYASIVEGMASE; MAASYASIVEGMASES; AASYASIVEGMASESW;<br>ASYASIVEGMASESWL; SYASIVEGMASESWLG; YASIVEGMASESWLGP;<br>ASIVEGMASESWLGPS; SIVEGMASESWLGPSS; IVEGMASESWLGPSSA;<br>VEGMASESWLGPSSAG; EGMASESWLGPSSAGM; GMASESWLGPSSAGMA;<br>MASESWLGPSSAGMAA; ASESWLGPSSAGMAAA; SESWLGPSSAGMAAAA;<br>ESWLGPSSAGMAAAAA; SWLGPSSAGMAAAAAP; WLGPSSAGMAAAAAPY;<br>LGPSSAGMAAAAAPYV; GPSSAGMAAAAAPYVT; PSSAGMAAAAAPYVTW;<br>SSAGMAAAAAPYVTWM; SAGMAAAAAPYVTWMS; AGMAAAAAPYVTWMSG;<br>GMAAAAAPYVTWMSGT; MAAAAAPYVTWMSGTS; AAAAAPYVTWMSGTSA;<br>AAAAPYVTWMSGTSAQ; AAAPYVTWMSGTSAQA; AAPYVTWMSGTSAQAK;<br>APYVTWMSGTSAQAKA; PYVTWMSGTSAQAKAA; YVTWMSGTSAQAKAAA;<br>VTWMSGTSAQAKAAAD; TWMSGTSAQAKAAADQ; WMSGTSAQAKAAADQA;<br>MSGTSAQAKAAADQAR; SGTSAQAKAAADQARA; GTSAQAKAAADQARAA;<br>TSAQAKAAADQARAAV; SAQAKAAADQARAAVV; AQAKAAADQARAAVVA;<br>QAKAAADQARAAVVAY; AKAAADQARAAVVAYE; KAAADQARAAVVAYET;<br>AAADQARAAVVAYETA; AADQARAAVVAYETAF; ADQARAAVVAYETAFA;<br>DQARAAVVAYETAFAA; QARAAVVAYETAFAAV; ARAAVVAYETAFAAVV;<br>RAAVVAYETAFAAVVP; AAVVAYETAFAAVVPP; AVVAYETAFAAVVPPP;<br>VVAYETAFAAVVPPPQ; VAYETAFAAVVPPPQI; AYETAFAAVVPPPQIA;<br>YETAFAAVVPPPQIAA; ETAFAAVVPPPQIAAN; TAFAAVVPPPQIAANR;<br>AFAAVVPPPQIAANRS; FAAVVPPPQIAANRSQ; AAVVPPPQIAANRSQL;<br>AVVPPPQIAANRSQLI; VVPPPQIAANRSQLIS; VPPPQIAANRSQLISL;<br>PPPQIAANRSQLISLV; PPQIAANRSQLISLVA; PQIAANRSQLISLVAT;<br>QIAANRSQLISLVATN; IAANRSQLISLVATNI; AANRSQLISLVATNIF;<br>ANRSQLISLVATNIFG; NRSQLISLVATNIFGQ; RSQLISLVATNIFGQN;<br>SQLISLVATNIFGQNT; QLISLVATNIFGQNTA; LISLVATNIFGQNTAA;<br>ISLVATNIFGQNTAAI; SLVATNIFGQNTAAIA; LVATNIFGQNTAAIAA;<br>VATNIFGQNTAAIAAT; ATNIFGQNTAAIAATE; TNIFGQNTAAIAATEA;<br>NIFGQNTAAIAATEAE; IFGQNTAAIAATEAEY; FGQNTAAIAATEAEYG; | | |

Fig. 29 continued

| | | | |
|---|---|---|---|
| | GQNTAAIAATEAEYGE; QNTAAIAATEAEYGEM; NTAAIAATEAEYGEMW;<br>TAAIAATEAEYGEMWA; AAIAATEAEYGEMWAQ; AIAATEAEYGEMWAQD;<br>IAATEAEYGEMWAQDT; AATEAEYGEMWAQDTM; ATEAEYGEMWAQDTMA;<br>TEAEYGEMWAQDTMAM; EAEYGEMWAQDTMAMF; AEYGEMWAQDTMAMFG;<br>EYGEMWAQDTMAMFGY; YGEMWAQDTMAMFGYA; GEMWAQDTMAMFGYAS;<br>EMWAQDTMAMFGYASS; MWAQDTMAMFGYASSS; WAQDTMAMFGYASSSA;<br>AQDTMAMFGYASSSAT; QDTMAMFGYASSSATA; DTMAMFGYASSSATAS;<br>TMAMFGYASSSATASR; MAMFGYASSSATASRL; AMFGYASSSATASRLT;<br>MFGYASSSATASRLTP; FGYASSSATASRLTPF; GYASSSATASRLTPFT;<br>YASSSATASRLTPFTA; ASSSATASRLTPFTAP; SSSATASRLTPFTAPP;<br>SSATASRLTPFTAPPQ; SATASRLTPFTAPPQT; ATASRLTPFTAPPQTT;<br>TASRLTPFTAPPQTTN; ASRLTPFTAPPQTTNP; SRLTPFTAPPQTTNPS;<br>RLTPFTAPPQTTNPSG; LTPFTAPPQTTNPSGL; TPFTAPPQTTNPSGLA;<br>PFTAPPQTTNPSGLAG; FTAPPQTTNPSGLAGQ; TAPPQTTNPSGLAGQA;<br>APPQTTNPSGLAGQAA; PPQTTNPSGLAGQAAA; PQTTNPSGLAGQAAAT;<br>QTTNPSGLAGQAAATG; TTNPSGLAGQAAATGQ; TNPSGLAGQAAATGQA;<br>NPSGLAGQAAATGQAT; PSGLAGQAAATGQATA; SGLAGQAAATGQATAL;<br>GLAGQAAATGQATALA; LAGQAAATGQATALAS; AGQAAATGQATALASG;<br>GQAAATGQATALASGT; QAAATGQATALASGTN; AAATGQATALASGTNA;<br>AATGQATALASGTNAV; ATGQATALASGTNAVT; TGQATALASGTNAVTT;<br>GQATALASGTNAVTTA; QATALASGTNAVTTAL; ATALASGTNAVTTALS;<br>TALASGTNAVTTALSS; ALASGTNAVTTALSSA; LASGTNAVTTALSSAA;<br>ASGTNAVTTALSSAAA; SGTNAVTTALSSAAAQ; GTNAVTTALSSAAAQF;<br>TNAVTTALSSAAAQFP; NAVTTALSSAAAQFPF; AVTTALSSAAAQFPFD;<br>VTTALSSAAAQFPFDI; TTALSSAAAQFPFDII; TALSSAAAQFPFDIIP;<br>ALSSAAAQFPFDIIPT; LSSAAAQFPFDIIPTL; SSAAAQFPFDIIPTLL;<br>SAAAQFPFDIIPTLLQ; AAAQFPFDIIPTLLQG; AAQFPFDIIPTLLQGL;<br>AQFPFDIIPTLLQGLA; QFPFDIIPTLLQGLAT; FPFDIIPTLLQGLATL;<br>PFDIIPTLLQGLATLS; FDIIPTLLQGLATLST; DIIPTLLQGLATLSTQ;<br>IIPTLLQGLATLSTQY; IPTLLQGLATLSTQYT; PTLLQGLATLSTQYTQ;<br>TLLQGLATLSTQYTQL; LLQGLATLSTQYTQLM; LQGLATLSTQYTQLMG;<br>QGLATLSTQYTQLMGQ; GLATLSTQYTQLMGQL; LATLSTQYTQLMGQLI;<br>ATLSTQYTQLMGQLIN; TLSTQYTQLMGQLINA; LSTQYTQLMGQLINAI;<br>STQYTQLMGQLINAIF; TQYTQLMGQLINAIFG; QYTQLMGQLINAIFGP;<br>YTQLMGQLINAIFGPT; TQLMGQLINAIFGPTG; QLMGQLINAIFGPTGA;<br>LMGQLINAIFGPTGAT; MGQLINAIFGPTGATT; GQLINAIFGPTGATTY;<br>QLINAIFGPTGATTYQ; LINAIFGPTGATTYQN; INAIFGPTGATTYQNV;<br>NAIFGPTGATTYQNVF; AIFGPTGATTYQNVFV; IFGPTGATTYQNVFVT;<br>FGPTGATTYQNVFVTA; GPTGATTYQNVFVTAA; PTGATTYQNVFVTAAN;<br>TGATTYQNVFVTAANV; GATTYQNVFVTAANVT; ATTYQNVFVTAANVTK;<br>TTYQNVFVTAANVTKF; TYQNVFVTAANVTKFS; YQNVFVTAANVTKFST;<br>QNVFVTAANVTKFSTW; NVFVTAANVTKFSTWA; VFVTAANVTKFSTWAN;<br>FVTAANVTKFSTWAND; VTAANVTKFSTWANDA; TAANVTKFSTWANDAM;<br>AANVTKFSTWANDAMS; ANVTKFSTWANDAMSA; NVTKFSTWANDAMSAP;<br>VTKFSTWANDAMSAPN; TKFSTWANDAMSAPNL; KFSTWANDAMSAPNLG;<br>FSTWANDAMSAPNLGM; STWANDAMSAPNLGMT; TWANDAMSAPNLGMTE;<br>WANDAMSAPNLGMTEF; ANDAMSAPNLGMTEFK; NDAMSAPNLGMTEFKV;<br>DAMSAPNLGMTEFKVF; AMSAPNLGMTEFKVFW; MSAPNLGMTEFKVFWQ;<br>SAPNLGMTEFKVFWQP; APNLGMTEFKVFWQPP; PNLGMTEFKVFWQPPP;<br>NLGMTEFKVFWQPPPA; LGMTEFKVFWQPPPAP; GMTEFKVFWQPPPAPE;<br>MTEFKVFWQPPPAPEI; TEFKVFWQPPPAPEIP; EFKVFWQPPPAPEIPK;<br>FKVFWQPPPAPEIPKS; KVFWQPPPAPEIPKSS; VFWQPPPAPEIPKSSL;<br>FWQPPPAPEIPKSSLG; WQPPPAPEIPKSSLGA; QPPPAPEIPKSSLGAG; | |

Fig. 29 continued

| | | |
|---|---|---|
| | PPPAPEIPKSSLGAGL; PPAPEIPKSSLGAGLG; PAPEIPKSSLGAGLGL;<br>APEIPKSSLGAGLGLR; PEIPKSSLGAGLGLRS; EIPKSSLGAGLGLRSG;<br>IPKSSLGAGLGLRSGL; PKSSLGAGLGLRSGLS; KSSLGAGLGLRSGLSA;<br>SSLGAGLGLRSGLSAG; SLGAGLGLRSGLSAGL; LGAGLGLRSGLSAGLA;<br>GAGLGLRSGLSAGLAH; AGLGLRSGLSAGLAHA; GLGLRSGLSAGLAHAA;<br>LGLRSGLSAGLAHAAS; GLRSGLSAGLAHAASA; LRSGLSAGLAHAASAG;<br>RSGLSAGLAHAASAGL; SGLSAGLAHAASAGLG; GLSAGLAHAASAGLGQ;<br>LSAGLAHAASAGLGQA; SAGLAHAASAGLGQAN; AGLAHAASAGLGQANL;<br>GLAHAASAGLGQANLV; LAHAASAGLGQANLVG; AHAASAGLGQANLVGD;<br>HAASAGLGQANLVGDL; AASAGLGQANLVGDLS; ASAGLGQANLVGDLSV;<br>SAGLGQANLVGDLSVP; AGLGQANLVGDLSVPP; GLGQANLVGDLSVPPS;<br>LGQANLVGDLSVPPSW; GQANLVGDLSVPPSWA; QANLVGDLSVPPSWAS;<br>ANLVGDLSVPPSWASA; NLVGDLSVPPSWASAT; LVGDLSVPPSWASATP;<br>VGDLSVPPSWASATPA; GDLSVPPSWASATPAV; DLSVPPSWASATPAVR;<br>LSVPPSWASATPAVRL; SVPPSWASATPAVRLV; VPPSWASATPAVRLVA;<br>PPSWASATPAVRLVAN; PSWASATPAVRLVANT; SWASATPAVRLVANTL;<br>WASATPAVRLVANTLP; ASATPAVRLVANTLPA; SATPAVRLVANTLPAT;<br>ATPAVRLVANTLPATS; TPAVRLVANTLPATSL; PAVRLVANTLPATSLA;<br>AVRLVANTLPATSLAA; VRLVANTLPATSLAAA; RLVANTLPATSLAAAP;<br>LVANTLPATSLAAAPA; VANTLPATSLAAAPAT; ANTLPATSLAAAPATQ;<br>NTLPATSLAAAPATQI; TLPATSLAAAPATQIP; LPATSLAAAPATQIPA;<br>PATSLAAAPATQIPAN; ATSLAAAPATQIPANL; TSLAAAPATQIPANLL;<br>SLAAAPATQIPANLLG; LAAAPATQIPANLLGQ; AAAPATQIPANLLGQM;<br>AAPATQIPANLLGQMA; APATQIPANLLGQMAL; PATQIPANLLGQMALG;<br>ATQIPANLLGQMALGS; TQIPANLLGQMALGSM; QIPANLLGQMALGSMT;<br>IPANLLGQMALGSMTG; PANLLGQMALGSMTGG; ANLLGQMALGSMTGGA;<br>NLLGQMALGSMTGGAL; LLGQMALGSMTGGALG; LGQMALGSMTGGALGA;<br>GQMALGSMTGGALGAA; QMALGSMTGGALGAAA; MALGSMTGGALGAAAP;<br>ALGSMTGGALGAAAPA; LGSMTGGALGAAAPAI; GSMTGGALGAAAPAIY;<br>SMTGGALGAAAPAIYT; MTGGALGAAAPAIYTG; TGGALGAAAPAIYTGS;<br>GGALGAAAPAIYTGSG; GALGAAAPAIYTGSGA; ALGAAAPAIYTGSGAR;<br>LGAAAPAIYTGSGARA; GAAAPAIYTGSGARAR; AAAPAIYTGSGARARA;<br>AAPAIYTGSGARARAN; APAIYTGSGARARANG; PAIYTGSGARARANGG;<br>AIYTGSGARARANGGT; IYTGSGARARANGGTP; YTGSGARARANGGTPS;<br>TGSGARARANGGTPSA; GSGARARANGGTPSAE; SGARARANGGTPSAEP;<br>GARARANGGTPSAEPV; ARARANGGTPSAEPVK; RARANGGTPSAEPVKL;<br>ARANGGTPSAEPVKLE; RANGGTPSAEPVKLEA; ANGGTPSAEPVKLEAV;<br>NGGTPSAEPVKLEAVI; GGTPSAEPVKLEAVIA; GTPSAEPVKLEAVIAQ;<br>TPSAEPVKLEAVIAQL; PSAEPVKLEAVIAQLQ; SAEPVKLEAVIAQLQK;<br>AEPVKLEAVIAQLQKQ; EPVKLEAVIAQLQKQP; PVKLEAVIAQLQKQPD;<br>VKLEAVIAQLQKQPDA; KLEAVIAQLQKQPDAV; LEAVIAQLQKQPDAVR;<br>EAVIAQLQKQPDAVRH; AVIAQLQKQPDAVRHW; VIAQLQKQPDAVRHWN;<br>IAQLQKQPDAVRHWNV; AQLQKQPDAVRHWNVD; QLQKQPDAVRHWNVDK;<br>LQKQPDAVRHWNVDKA; QKQPDAVRHWNVDKAD; KQPDAVRHWNVDKADL;<br>QPDAVRHWNVDKADLD; PDAVRHWNVDKADLDG; DAVRHWNVDKADLDGL;<br>AVRHWNVDKADLDGLL; VRHWNVDKADLDGLLD; RHWNVDKADLDGLLDR;<br>HWNVDKADLDGLLDRL; WNVDKADLDGLLDRLS; NVDKADLDGLLDRLSK;<br>VDKADLDGLLDRLSKQ; DKADLDGLLDRLSKQP; KADLDGLLDRLSKQPG;<br>ADLDGLLDRLSKQPGI; DLDGLLDRLSKQPGIH; LDGLLDRLSKQPGIHA;<br>DGLLDRLSKQPGIHAV; GLLDRLSKQPGIHAVH; LLDRLSKQPGIHAVHV;<br>LDRLSKQPGIHAVHVS; DRLSKQPGIHAVHVSN; RLSKQPGIHAVHVSNG;<br>LSKQPGIHAVHVSNGD; SKQPGIHAVHVSNGDK; KQPGIHAVHVSNGDKP;<br>QPGIHAVHVSNGDKPK; PGIHAVHVSNGDKPKV; GIHAVHVSNGDKPKVA; | |

Fig. 29 continued

| | | |
|---|---|---|
| | IHAVHVSNGDKPKVAL; HAVHVSNGDKPKVALP; AVHVSNGDKPKVALPD; VHVSNGDKPKVALPDT; HVSNGDKPKVALPDTQ; VSNGDKPKVALPDTQL; SNGDKPKVALPDTQLG; NGDKPKVALPDTQLGS; GDKPKVALPDTQLGSH | |
| 29) Rv1954c | 13 mers: MAAGSGGGTVGLV; AAGSGGGTVGLVL; AGSGGGTVGLVLP; GSGGGTVGLVLPR; SGGGTVGLVLPRV; GGGTVGLVLPRVA; GGTVGLVLPRVAS; GTVGLVLPRVASL; TVGLVLPRVASLS; VGLVLPRVASLSG; GLVLPRVASLSGL; LVLPRVASLSGLD; VLPRVASLSGLDG; LPRVASLSGLDGA; PRVASLSGLDGAP; RVASLSGLDGAPT; VASLSGLDGAPTV; ASLSGLDGAPTVP; SLSGLDGAPTVPE; LSGLDGAPTVPEG; SGLDGAPTVPEGS; GLDGAPTVPEGSD; LDGAPTVPEGSDK; DGAPTVPEGSDKA; GAPTVPEGSDKAL; APTVPEGSDKALM; PTVPEGSDKALMH; TVPEGSDKALMHL; VPEGSDKALMHLG; PEGSDKALMHLGD; EGSDKALMHLGDP; GSDKALMHLGDPP; SDKALMHLGDPPR; DKALMHLGDPPRR; KALMHLGDPPRRC; ALMHLGDPPRRCD; LMHLGDPPRRCDT; MHLGDPPRRCDTH; HLGDPPRRCDTHP; LGDPPRRCDTHPD; GDPPRRCDTHPDG; DPPRRCDTHPDGT; PPRRCDTHPDGTS; PRRCDTHPDGTSS; RRCDTHPDGTSSA; RCDTHPDGTSSAA; CDTHPDGTSSAAA; DTHPDGTSSAAAA; THPDGTSSAAAAL; HPDGTSSAAAALV; PDGTSSAAAALVL; DGTSSAAAALVLR; GTSSAAAALVLRR; TSSAAAALVLRRI; SSAAAALVLRRID; SAAAALVLRRIDV; AAAALVLRRIDVH; AAALVLRRIDVHP; AALVLRRIDVHPL; ALVLRRIDVHPLL; LVLRRIDVHPLLT; VLRRIDVHPLLTG; LRRIDVHPLLTGL; RRIDVHPLLTGLG; RIDVHPLLTGLGR; IDVHPLLTGLGRG; DVHPLLTGLGRGR; VHPLLTGLGRGRQ; HPLLTGLGRGRQT; PLLTGLGRGRQTV; LLTGLGRGRQTVS; LTGLGRGRQTVSL; TGLGRGRQTVSLR; GLGRGRQTVSLRN; LGRGRQTVSLRNG; GRGRQTVSLRNGH; RGRQTVSLRNGHL; GRQTVSLRNGHLV; RQTVSLRNGHLVA; QTVSLRNGHLVAT; TVSLRNGHLVATA; VSLRNGHLVATAN; SLRNGHLVATANR; LRNGHLVATANRA; RNGHLVATANRAI; NGHLVATANRAIL; GHLVATANRAILS; HLVATANRAILSR; LVATANRAILSRR; VATANRAILSRRR; ATANRAILSRRRS; TANRAILSRRRSR; ANRAILSRRRSRL; NRAILSRRRSRLT; RAILSRRRSRLTR; AILSRRRSRLTRG; ILSRRRSRLTRGR; LSRRRSRLTRGRS; SRRRSRLTRGRSF; RRRSRLTRGRSFT; RRSRLTRGRSFTS; RSRLTRGRSFTSH; SRLTRGRSFTSHL; RLTRGRSFTSHLI; LTRGRSFTSHLIT; TRGRSFTSHLITS; RGRSFTSHLITSC; GRSFTSHLITSCP; RSFTSHLITSCPR; SFTSHLITSCPRL; FTSHLITSCPRLD; TSHLITSCPRLDD; SHLITSCPRLDDH; HLITSCPRLDDHQ; LITSCPRLDDHQH; ITSCPRLDDHQHR; TSCPRLDDHQHRH; SCPRLDDHQHRHP; CPRLDDHQHRHPT; PRLDDHQHRHPTR; RLDDHQHRHPTRC; LDDHQHRHPTRCR; DDHQHRHPTRCRA; DHQHRHPTRCRAE; HQHRHPTRCRAEH; QHRHPTRCRAEHA; HRHPTRCRAEHAG; RHPTRCRAEHAGC; HPTRCRAEHAGCT; PTRCRAEHAGCTV; TRCRAEHAGCTVA; RCRAEHAGCTVAT; CRAEHAGCTVATC; RAEHAGCTVATCI; AEHAGCTVATCIP; EHAGCTVATCIPN; HAGCTVATCIPNA; AGCTVATCIPNAH; GCTVATCIPNAHD; CTVATCIPNAHDP; TVATCIPNAHDPA; VATCIPNAHDPAP; ATCIPNAHDPAPG; TCIPNAHDPAPGH; CIPNAHDPAPGHQ; IPNAHDPAPGHQT; PNAHDPAPGHQTP; NAHDPAPGHQTPR; AHDPAPGHQTPRW; HDPAPGHQTPRWG; DPAPGHQTPRWGP; PAPGHQTPRWGPF; APGHQTPRWGPFR; PGHQTPRWGPFRL; GHQTPRWGPFRLK; HQTPRWGPFRLKP; QTPRWGPFRLKPA; TPRWGPFRLKPAY; PRWGPFRLKPAYT; RWGPFRLKPAYTR; WGPFRLKPAYTRI | 84107-84742 |

Fig. 29 continued

| | | |
|---|---|---|
| | 14 mers:<br>MAAGSGGGTVGLVL; AAGSGGGTVGLVLP; AGSGGGTVGLVLPR;<br>GSGGGTVGLVLPRV; SGGGTVGLVLPRVA; GGGTVGLVLPRVAS;<br>GGTVGLVLPRVASL; GTVGLVLPRVASLS; TVGLVLPRVASLSG;<br>VGLVLPRVASLSGL; GLVLPRVASLSGLD; LVLPRVASLSGLDG;<br>VLPRVASLSGLDGA; LPRVASLSGLDGAP; PRVASLSGLDGAPT;<br>RVASLSGLDGAPTV; VASLSGLDGAPTVP; ASLSGLDGAPTVPE;<br>SLSGLDGAPTVPEG; LSGLDGAPTVPEGS; SGLDGAPTVPEGSD;<br>GLDGAPTVPEGSDK; LDGAPTVPEGSDKA; DGAPTVPEGSDKAL;<br>GAPTVPEGSDKALM; APTVPEGSDKALMH; PTVPEGSDKALMHL;<br>TVPEGSDKALMHLG; VPEGSDKALMHLGD; PEGSDKALMHLGDP;<br>EGSDKALMHLGDPP; GSDKALMHLGDPPR; SDKALMHLGDPPRR;<br>DKALMHLGDPPRRC; KALMHLGDPPRRCD; ALMHLGDPPRRCDT;<br>LMHLGDPPRRCDTH; MHLGDPPRRCDTHP; HLGDPPRRCDTHPD;<br>LGDPPRRCDTHPDG; GDPPRRCDTHPDGT; DPPRRCDTHPDGTS;<br>PPRRCDTHPDGTSS; PRRCDTHPDGTSSA; RRCDTHPDGTSSAA;<br>RCDTHPDGTSSAAA; CDTHPDGTSSAAAA; DTHPDGTSSAAAAL;<br>THPDGTSSAAAALV; HPDGTSSAAAALVL; PDGTSSAAAALVLR;<br>DGTSSAAAALVLRR; GTSSAAAALVLRRI; TSSAAAALVLRRID;<br>SSAAAALVLRRIDV; SAAAALVLRRIDVH; AAAALVLRRIDVHP;<br>AAALVLRRIDVHPL; AALVLRRIDVHPLL; ALVLRRIDVHPLLT; LVLRRIDVHPLLTG;<br>VLRRIDVHPLLTGL; LRRIDVHPLLTGLG; RRIDVHPLLTGLGR;<br>RIDVHPLLTGLGRG; IDVHPLLTGLGRGR; DVHPLLTGLGRGRQ;<br>VHPLLTGLGRGRQT; HPLLTGLGRGRQTV; PLLTGLGRGRQTVS;<br>LLTGLGRGRQTVSL; LTGLGRGRQTVSLR; TGLGRGRQTVSLRN;<br>GLGRGRQTVSLRNG; LGRGRQTVSLRNGH; GRGRQTVSLRNGHL;<br>RGRQTVSLRNGHLV; GRQTVSLRNGHLVA; RQTVSLRNGHLVAT;<br>QTVSLRNGHLVATA; TVSLRNGHLVATAN; VSLRNGHLVATANR;<br>SLRNGHLVATANRA; LRNGHLVATANRAI; RNGHLVATANRAIL;<br>NGHLVATANRAILS; GHLVATANRAILSR; HLVATANRAILSRR;<br>LVATANRAILSRRR; VATANRAILSRRRS; ATANRAILSRRRSR;<br>TANRAILSRRRSRL; ANRAILSRRRSRLT; NRAILSRRRSRLTR;<br>RAILSRRRSRLTRG; AILSRRRSRLTRGR; ILSRRRSRLTRGRS;<br>LSRRRSRLTRGRSF; SRRRSRLTRGRSFT; RRRSRLTRGRSFTS;<br>RRSRLTRGRSFTSH; RSRLTRGRSFTSHL; SRLTRGRSFTSHLI;<br>RLTRGRSFTSHLIT; LTRGRSFTSHLITS; TRGRSFTSHLITSC;<br>RGRSFTSHLITSCP; GRSFTSHLITSCPR; RSFTSHLITSCPRL;<br>SFTSHLITSCPRLD; FTSHLITSCPRLDD; TSHLITSCPRLDDH;<br>SHLITSCPRLDDHQ; HLITSCPRLDDHQH; LITSCPRLDDHQHR;<br>ITSCPRLDDHQHRH; TSCPRLDDHQHRHP; SCPRLDDHQHRHPT;<br>CPRLDDHQHRHPTR; PRLDDHQHRHPTRC; RLDDHQHRHPTRCR;<br>LDDHQHRHPTRCRA; DDHQHRHPTRCRAE; DHQHRHPTRCRAEH;<br>HQHRHPTRCRAEHA; QHRHPTRCRAEHAG; HRHPTRCRAEHAGC;<br>RHPTRCRAEHAGCT; HPTRCRAEHAGCTV; PTRCRAEHAGCTVA;<br>TRCRAEHAGCTVAT; RCRAEHAGCTVATC; CRAEHAGCTVATCI;<br>RAEHAGCTVATCIP; AEHAGCTVATCIPN; EHAGCTVATCIPNA;<br>HAGCTVATCIPNAH; AGCTVATCIPNAHD; GCTVATCIPNAHDP;<br>CTVATCIPNAHDPA; TVATCIPNAHDPAP; VATCIPNAHDPAPG;<br>ATCIPNAHDPAPGH; TCIPNAHDPAPGHQ; CIPNAHDPAPGHQT;<br>IPNAHDPAPGHQTP; PNAHDPAPGHQTPR; NAHDPAPGHQTPRW;<br>AHDPAPGHQTPRWG; HDPAPGHQTPRWGP; DPAPGHQTPRWGPF;<br>PAPGHQTPRWGPFR; APGHQTPRWGPFRL; PGHQTPRWGPFRLK;<br>GHQTPRWGPFRLKP; HQTPRWGPFRLKPA; QTPRWGPFRLKPAY; | |

Fig. 29 continued

| | | |
|---|---|---|
| | TPRWGPFRLKPAYT; PRWGPFRLKPAYTR;<br><br>15 mers:<br>MAAGSGGGTVGLVLP; AAGSGGGTVGLVLPR; AGSGGGTVGLVLPRV;<br>GSGGGTVGLVLPRVA; SGGGTVGLVLPRVAS; GGGTVGLVLPRVASL;<br>GGTVGLVLPRVASLS; GTVGLVLPRVASLSG; TVGLVLPRVASLSGL;<br>VGLVLPRVASLSGLD; GLVLPRVASLSGLDG; LVLPRVASLSGLDGA;<br>VLPRVASLSGLDGAP; LPRVASLSGLDGAPT; PRVASLSGLDGAPTV;<br>RVASLSGLDGAPTVP; VASLSGLDGAPTVPE; ASLSGLDGAPTVPEG;<br>SLSGLDGAPTVPEGS; LSGLDGAPTVPEGSD; SGLDGAPTVPEGSDK;<br>GLDGAPTVPEGSDKA; LDGAPTVPEGSDKAL; DGAPTVPEGSDKALM;<br>GAPTVPEGSDKALMH; APTVPEGSDKALMHL; PTVPEGSDKALMHLG;<br>TVPEGSDKALMHLGD; VPEGSDKALMHLGDP; PEGSDKALMHLGDPP;<br>EGSDKALMHLGDPPR; GSDKALMHLGDPPRR; SDKALMHLGDPPRRC;<br>DKALMHLGDPPRRCD; KALMHLGDPPRRCDT; ALMHLGDPPRRCDTH;<br>LMHLGDPPRRCDTHP; MHLGDPPRRCDTHPD; HLGDPPRRCDTHPDG;<br>LGDPPRRCDTHPDGT; GDPPRRCDTHPDGTS; DPPRRCDTHPDGTSS;<br>PPRRCDTHPDGTSSA; PRRCDTHPDGTSSAA; RRCDTHPDGTSSAAA;<br>RCDTHPDGTSSAAAA; CDTHPDGTSSAAAAL; DTHPDGTSSAAAALV;<br>THPDGTSSAAAALVL; HPDGTSSAAAALVLR; PDGTSSAAAALVLRR;<br>DGTSSAAAALVLRRI; GTSSAAAALVLRRID; TSSAAAALVLRRIDV;<br>SSAAAALVLRRIDVH; SAAAALVLRRIDVHP; AAAALVLRRIDVHPL;<br>AAALVLRRIDVHPLL; AALVLRRIDVHPLLT; ALVLRRIDVHPLLTG;<br>LVLRRIDVHPLLTGL; VLRRIDVHPLLTGLG; LRRIDVHPLLTGLGR;<br>RRIDVHPLLTGLGRG; RIDVHPLLTGLGRGR; IDVHPLLTGLGRGRQ;<br>DVHPLLTGLGRGRQT; VHPLLTGLGRGRQTV; HPLLTGLGRGRQTVS;<br>PLLTGLGRGRQTVSL; LLTGLGRGRQTVSLR; LTGLGRGRQTVSLRN;<br>TGLGRGRQTVSLRNG; GLGRGRQTVSLRNGH; LGRGRQTVSLRNGHL;<br>GRGRQTVSLRNGHLV; RGRQTVSLRNGHLVA; GRQTVSLRNGHLVAT;<br>RQTVSLRNGHLVATA; QTVSLRNGHLVATAN; TVSLRNGHLVATANR;<br>VSLRNGHLVATANRA; SLRNGHLVATANRAI; LRNGHLVATANRAIL;<br>RNGHLVATANRAILS; NGHLVATANRAILSR; GHLVATANRAILSRR;<br>HLVATANRAILSRRR; LVATANRAILSRRRS; VATANRAILSRRRSR;<br>ATANRAILSRRRSRL; TANRAILSRRRSRLT; ANRAILSRRRSRLTR;<br>NRAILSRRRSRLTRG; RAILSRRRSRLTRGR; AILSRRRSRLTRGRS;<br>ILSRRRSRLTRGRSF; LSRRRSRLTRGRSFT; SRRRSRLTRGRSFTS;<br>RRRSRLTRGRSFTSH; RRSRLTRGRSFTSHL; RSRLTRGRSFTSHLI;<br>SRLTRGRSFTSHLIT; RLTRGRSFTSHLITS; LTRGRSFTSHLITSC;<br>TRGRSFTSHLITSCP; RGRSFTSHLITSCPR; GRSFTSHLITSCPRL;<br>RSFTSHLITSCPRLD; SFTSHLITSCPRLDD; FTSHLITSCPRLDDH;<br>TSHLITSCPRLDDHQ; SHLITSCPRLDDHQH; HLITSCPRLDDHQHR;<br>LITSCPRLDDHQHRH; ITSCPRLDDHQHRHP; TSCPRLDDHQHRHPT;<br>SCPRLDDHQHRHPTR; CPRLDDHQHRHPTRC; PRLDDHQHRHPTRCR;<br>RLDDHQHRHPTRCRA; LDDHQHRHPTRCRAE; DDHQHRHPTRCRAEH;<br>DHQHRHPTRCRAEHA; HQHRHPTRCRAEHAG; QHRHPTRCRAEHAGC;<br>HRHPTRCRAEHAGCT; RHPTRCRAEHAGCTV; HPTRCRAEHAGCTVA;<br>PTRCRAEHAGCTVAT; TRCRAEHAGCTVATC; RCRAEHAGCTVATCI;<br>CRAEHAGCTVATCIP; RAEHAGCTVATCIPN; AEHAGCTVATCIPNA;<br>EHAGCTVATCIPNAH; HAGCTVATCIPNAHD; AGCTVATCIPNAHDP;<br>GCTVATCIPNAHDPA; CTVATCIPNAHDPAP; TVATCIPNAHDPAPG;<br>VATCIPNAHDPAPGH; ATCIPNAHDPAPGHQ; TCIPNAHDPAPGHQT;<br>CIPNAHDPAPGHQTP; IPNAHDPAPGHQTPR; PNAHDPAPGHQTPRW;<br>NAHDPAPGHQTPRWG; AHDPAPGHQTPRWGP; HDPAPGHQTPRWGPF; | |

Fig. 29 continued

DPAPGHQTPRWGPFR; PAPGHQTPRWGPFRL; APGHQTPRWGPFRLK;
PGHQTPRWGPFRLKP; GHQTPRWGPFRLKPA; HQTPRWGPFRLKPAY;
QTPRWGPFRLKPAYT; TPRWGPFRLKPAYTR;

16 mers:
MAAGSGGGTVGLVLPR; AAGSGGGTVGLVLPRV; AGSGGGTVGLVLPRVA;
GSGGGTVGLVLPRVAS; SGGGTVGLVLPRVASL; GGGTVGLVLPRVASLS;
GGTVGLVLPRVASLSG; GTVGLVLPRVASLSGL; TVGLVLPRVASLSGLD;
VGLVLPRVASLSGLDG; GLVLPRVASLSGLDGA; LVLPRVASLSGLDGAP;
VLPRVASLSGLDGAPT; LPRVASLSGLDGAPTV; PRVASLSGLDGAPTVP;
RVASLSGLDGAPTVPE; VASLSGLDGAPTVPEG; ASLSGLDGAPTVPEGS;
SLSGLDGAPTVPEGSD; LSGLDGAPTVPEGSDK; SGLDGAPTVPEGSDKA;
GLDGAPTVPEGSDKAL; LDGAPTVPEGSDKALM; DGAPTVPEGSDKALMH;
GAPTVPEGSDKALMHL; APTVPEGSDKALMHLG; PTVPEGSDKALMHLGD;
TVPEGSDKALMHLGDP; VPEGSDKALMHLGDPP; PEGSDKALMHLGDPPR;
EGSDKALMHLGDPPRR; GSDKALMHLGDPPRRC; SDKALMHLGDPPRRCD;
DKALMHLGDPPRRCDT; KALMHLGDPPRRCDTH; ALMHLGDPPRRCDTHP;
LMHLGDPPRRCDTHPD; MHLGDPPRRCDTHPDG; HLGDPPRRCDTHPDGT;
LGDPPRRCDTHPDGTS; GDPPRRCDTHPDGTSS; DPPRRCDTHPDGTSSA;
PPRRCDTHPDGTSSAA; PRRCDTHPDGTSSAAA; RRCDTHPDGTSSAAAA;
RCDTHPDGTSSAAAAL; CDTHPDGTSSAAAALV; DTHPDGTSSAAAALVL;
THPDGTSSAAAALVLR; HPDGTSSAAAALVLRR; PDGTSSAAAALVLRRI;
DGTSSAAAALVLRRID; GTSSAAAALVLRRIDV; TSSAAAALVLRRIDVH;
SSAAAALVLRRIDVHP; SAAAALVLRRIDVHPL; AAAALVLRRIDVHPLL;
AAALVLRRIDVHPLLT; AALVLRRIDVHPLLTG; ALVLRRIDVHPLLTGL;
LVLRRIDVHPLLTGLG; VLRRIDVHPLLTGLGR; LRRIDVHPLLTGLGRG;
RRIDVHPLLTGLGRGR; RIDVHPLLTGLGRGRQ; IDVHPLLTGLGRGRQT;
DVHPLLTGLGRGRQTV; VHPLLTGLGRGRQTVS; HPLLTGLGRGRQTVSL;
PLLTGLGRGRQTVSLR; LLTGLGRGRQTVSLRN; LTGLGRGRQTVSLRNG;
TGLGRGRQTVSLRNGH; GLGRGRQTVSLRNGHL; LGRGRQTVSLRNGHLV;
GRGRQTVSLRNGHLVA; RGRQTVSLRNGHLVAT; GRQTVSLRNGHLVATA;
RQTVSLRNGHLVATAN; QTVSLRNGHLVATANR; TVSLRNGHLVATANRA;
VSLRNGHLVATANRAI; SLRNGHLVATANRAIL; LRNGHLVATANRAILS;
RNGHLVATANRAILSR; NGHLVATANRAILSRR; GHLVATANRAILSRRR;
HLVATANRAILSRRRS; LVATANRAILSRRRSR; VATANRAILSRRRSRL;
ATANRAILSRRRSRLT; TANRAILSRRRSRLTR; ANRAILSRRRSRLTRG;
NRAILSRRRSRLTRGR; RAILSRRRSRLTRGRS; AILSRRRSRLTRGRSF;
ILSRRRSRLTRGRSFT; LSRRRSRLTRGRSFTS; SRRRSRLTRGRSFTSH;
RRRSRLTRGRSFTSHL; RRSRLTRGRSFTSHLI; RSRLTRGRSFTSHLIT;
SRLTRGRSFTSHLITS; RLTRGRSFTSHLITSC; LTRGRSFTSHLITSCP;
TRGRSFTSHLITSCPR; RGRSFTSHLITSCPRL; GRSFTSHLITSCPRLD;
RSFTSHLITSCPRLDD; SFTSHLITSCPRLDDH; FTSHLITSCPRLDDHQ;
TSHLITSCPRLDDHQH; SHLITSCPRLDDHQHR; HLITSCPRLDDHQHRH;
LITSCPRLDDHQHRHP; ITSCPRLDDHQHRHPT; TSCPRLDDHQHRHPTR;
SCPRLDDHQHRHPTRC; CPRLDDHQHRHPTRCR; PRLDDHQHRHPTRCRA;
RLDDHQHRHPTRCRAE; LDDHQHRHPTRCRAEH; DDHQHRHPTRCRAEHA;
DHQHRHPTRCRAEHAG; HQHRHPTRCRAEHAGC; QHRHPTRCRAEHAGCT;
HRHPTRCRAEHAGCTV; RHPTRCRAEHAGCTVA; HPTRCRAEHAGCTVAT;
PTRCRAEHAGCTVATC; TRCRAEHAGCTVATCI; RCRAEHAGCTVATCIP;
CRAEHAGCTVATCIPN; RAEHAGCTVATCIPNA; AEHAGCTVATCIPNAH;
EHAGCTVATCIPNAHD; HAGCTVATCIPNAHDP; AGCTVATCIPNAHDPA;
GCTVATCIPNAHDPAP; CTVATCIPNAHDPAPG; TVATCIPNAHDPAPGH;
VATCIPNAHDPAPGHQ; ATCIPNAHDPAPGHQT; TCIPNAHDPAPGHQTP;

Fig. 29 continued

| | | |
|---|---|---|
| | CIPNAHDPAPGHQTPR; IPNAHDPAPGHQTPRW; PNAHDPAPGHQTPRWG;<br>NAHDPAPGHQTPRWGP; AHDPAPGHQTPRWGPF; HDPAPGHQTPRWGPFR;<br>DPAPGHQTPRWGPFRL; PAPGHQTPRWGPFRLK; APGHQTPRWGPFRLKP;<br>PGHQTPRWGPFRLKPA; GHQTPRWGPFRLKPAY; HQTPRWGPFRLKPAYT;<br>QTPRWGPFRLKPAYTR; TPRWGPFRLKPAYTRI | |
| 30)<br>Rv1955 | 13 mers:<br>MPSGWVSHRLGGS; PSGWVSHRLGGSP; SGWVSHRLGGSPK;<br>GWVSHRLGGSPKC; WVSHRLGGSPKCI; VSHRLGGSPKCIS; SHRLGGSPKCISA;<br>HRLGGSPKCISAL; RLGGSPKCISALS; LGGSPKCISALSL; GGSPKCISALSLP;<br>GSPKCISALSLPS; SPKCISALSLPSG; PKCISALSLPSGT; KCISALSLPSGTV;<br>CISALSLPSGTVG; ISALSLPSGTVGA; SALSLPSGTVGAP; ALSLPSGTVGAPS;<br>LSLPSGTVGAPSK; SLPSGTVGAPSKP; LPSGTVGAPSKPD; PSGTVGAPSKPDN;<br>SGTVGAPSKPDND; GTVGAPSKPDNDA; TVGAPSKPDNDAT;<br>VGAPSKPDNDATR; GAPSKPDNDATRG; APSKPDNDATRGR;<br>PSKPDNDATRGRT; SKPDNDATRGRTR; KPDNDATRGRTRP;<br>PDNDATRGRTRPT; DNDATRGRTRPTV; NDATRGRTRPTVP;<br>DATRGRTRPTVPP; ATRGRTRPTVPPP; TRGRTRPTVPPPD; RGRTRPTVPPPDP;<br>GRTRPTVPPPDPA; RTRPTVPPPDPAA; TRPTVPPPDPAAM; RPTVPPPDPAAMG;<br>PTVPPPDPAAMGT; TVPPPDPAAMGTW; VPPPDPAAMGTWK;<br>PPPDPAAMGTWKF; PPDPAAMGTWKFF; PDPAAMGTWKFFR;<br>DPAAMGTWKFFRA; PAAMGTWKFFRAS; AAMGTWKFFRASV;<br>AMGTWKFFRASVD; MGTWKFFRASVDG; GTWKFFRASVDGR;<br>TWKFFRASVDGRP; WKFFRASVDGRPV; KFFRASVDGRPVF;<br>FFRASVDGRPVFK; FRASVDGRPVFKK; RASVDGRPVFKKE; ASVDGRPVFKKEF;<br>SVDGRPVFKKEFD; VDGRPVFKKEFDK; DGRPVFKKEFDKL; GRPVFKKEFDKLP;<br>RPVFKKEFDKLPD; PVFKKEFDKLPDQ; VFKKEFDKLPDQA; FKKEFDKLPDQAR;<br>KKEFDKLPDQARA; KEFDKLPDQARAA; EFDKLPDQARAAL; FDKLPDQARAALI;<br>DKLPDQARAALIV; KLPDQARAALIVL; LPDQARAALIVLM; PDQARAALIVLMQ;<br>DQARAALIVLMQR; QARAALIVLMQRY; ARAALIVLMQRYL; RAALIVLMQRYLV;<br>AALIVLMQRYLVG; ALIVLMQRYLVGD; LIVLMQRYLVGDL; IVLMQRYLVGDLA;<br>VLMQRYLVGDLAA; LMQRYLVGDLAAG; MQRYLVGDLAAGS; QRYLVGDLAAGSI;<br>RYLVGDLAAGSIK; YLVGDLAAGSIKP; LVGDLAAGSIKPI; VGDLAAGSIKPIR;<br>GDLAAGSIKPIRG; DLAAGSIKPIRGD; LAAGSIKPIRGDI; AAGSIKPIRGDIL;<br>AGSIKPIRGDILE; GSIKPIRGDILEL; SIKPIRGDILELR; IKPIRGDILELRW;<br>KPIRGDILELRWH; PIRGDILELRWHE; IRGDILELRWHEA; RGDILELRWHEAN;<br>GDILELRWHEANN; DILELRWHEANNH; ILELRWHEANNHF; LELRWHEANNHFR;<br>ELRWHEANNHFRV; LRWHEANNHFRVL; RWHEANNHFRVLF;<br>WHEANNHFRVLFF; HEANNHFRVLFFR; EANNHFRVLFFRW;<br>ANNHFRVLFFRWG; NNHFRVLFFRWGQ; NHFRVLFFRWGQH;<br>HFRVLFFRWGQHP; FRVLFFRWGQHPV; RVLFFRWGQHPVA;<br>VLFFRWGQHPVAL; LFFRWGQHPVALT; FFRWGQHPVALTA;<br>FRWGQHPVALTAF; RWGQHPVALTAFY; WGQHPVALTAFYK;<br>GQHPVALTAFYKN; QHPVALTAFYKNQ; HPVALTAFYKNQQ; PVALTAFYKNQQK;<br>VALTAFYKNQQKT; ALTAFYKNQQKTP; LTAFYKNQQKTPK; TAFYKNQQKTPKT;<br>AFYKNQQKTPKTK; FYKNQQKTPKTKI; YKNQQKTPKTKIE; KNQQKTPKTKIET;<br>NQQKTPKTKIETA; QQKTPKTKIETAL; QKTPKTKIETALD; KTPKTKIETALDR;<br>TPKTKIETALDRQ; PKTKIETALDRQK; KTKIETALDRQKI; TKIETALDRQKIW;<br>KIETALDRQKIWK; IETALDRQKIWKR; ETALDRQKIWKRA; TALDRQKIWKRAF;<br>ALDRQKIWKRAFG; LDRQKIWKRAFGD; DRQKIWKRAFGDT; RQKIWKRAFGDTP;<br>QKIWKRAFGDTPP; KIWKRAFGDTPPI<br><br>14 mers: | 84743-<br>85368 |

Fig. 29 continued

| | | | |
|---|---|---|---|
| | MPSGWVSHRLGGSP; PSGWVSHRLGGSPK; SGWVSHRLGGSPKC; GWVSHRLGGSPKCI; WVSHRLGGSPKCIS; VSHRLGGSPKCISA; SHRLGGSPKCISAL; HRLGGSPKCISALS; RLGGSPKCISALSL; LGGSPKCISALSLP; GGSPKCISALSLPS; GSPKCISALSLPSG; SPKCISALSLPSGT; PKCISALSLPSGTV; KCISALSLPSGTVG; CISALSLPSGTVGA; ISALSLPSGTVGAP; SALSLPSGTVGAPS; ALSLPSGTVGAPSK; LSLPSGTVGAPSKP; SLPSGTVGAPSKPD; LPSGTVGAPSKPDN; PSGTVGAPSKPDND; SGTVGAPSKPDNDA; GTVGAPSKPDNDAT; TVGAPSKPDNDATR; VGAPSKPDNDATRG; GAPSKPDNDATRGR; APSKPDNDATRGRT; PSKPDNDATRGRTR; SKPDNDATRGRTRP; KPDNDATRGRTRPT; PDNDATRGRTRPTV; DNDATRGRTRPTVP; NDATRGRTRPTVPP; DATRGRTRPTVPPP; ATRGRTRPTVPPPD; TRGRTRPTVPPPDP; RGRTRPTVPPPDPA; GRTRPTVPPPDPAA; RTRPTVPPPDPAAM; TRPTVPPPDPAAMG; RPTVPPPDPAAMGT; PTVPPPDPAAMGTW; TVPPPDPAAMGTWK; VPPPDPAAMGTWKF; PPPDPAAMGTWKFF; PPDPAAMGTWKFFR; PDPAAMGTWKFFRA; DPAAMGTWKFFRAS; PAAMGTWKFFRASV; AAMGTWKFFRASVD; AMGTWKFFRASVDG; MGTWKFFRASVDGR; GTWKFFRASVDGRP; TWKFFRASVDGRPV; WKFFRASVDGRPVF; KFFRASVDGRPVFK; FFRASVDGRPVFKK; FRASVDGRPVFKKE; RASVDGRPVFKKEF; ASVDGRPVFKKEFD; SVDGRPVFKKEFDK; VDGRPVFKKEFDKL; DGRPVFKKEFDKLP; GRPVFKKEFDKLPD; RPVFKKEFDKLPDQ; PVFKKEFDKLPDQA; VFKKEFDKLPDQAR; FKKEFDKLPDQARA; KKEFDKLPDQARAA; KEFDKLPDQARAAL; EFDKLPDQARAALI; FDKLPDQARAALIV; DKLPDQARAALIVL; KLPDQARAALIVLM; LPDQARAALIVLMQ; PDQARAALIVLMQR; DQARAALIVLMQRY; QARAALIVLMQRYL; ARAALIVLMQRYLV; RAALIVLMQRYLVG; AALIVLMQRYLVGD; ALIVLMQRYLVGDL; LIVLMQRYLVGDLA; IVLMQRYLVGDLAA; VLMQRYLVGDLAAG; LMQRYLVGDLAAGS; MQRYLVGDLAAGSI; QRYLVGDLAAGSIK; RYLVGDLAAGSIKP; YLVGDLAAGSIKPI; LVGDLAAGSIKPIR; VGDLAAGSIKPIRG; GDLAAGSIKPIRGD; DLAAGSIKPIRGDI; LAAGSIKPIRGDIL; AAGSIKPIRGDILE; AGSIKPIRGDILEL; GSIKPIRGDILELR; SIKPIRGDILELRW; IKPIRGDILELRWH; KPIRGDILELRWHE; PIRGDILELRWHEA; IRGDILELRWHEAN; RGDILELRWHEANN; GDILELRWHEANNH; DILELRWHEANNHF; ILELRWHEANNHFR; LELRWHEANNHFRV; ELRWHEANNHFRVL; LRWHEANNHFRVLF; RWHEANNHFRVLFF; WHEANNHFRVLFFR; HEANNHFRVLFFRW; EANNHFRVLFFRWG; ANNHFRVLFFRWGQ; NNHFRVLFFRWGQH; NHFRVLFFRWGQHP; HFRVLFFRWGQHPV; FRVLFFRWGQHPVA; RVLFFRWGQHPVAL; VLFFRWGQHPVALT; LFFRWGQHPVALTA; FFRWGQHPVALTAF; FRWGQHPVALTAFY; RWGQHPVALTAFYK; WGQHPVALTAFYKN; GQHPVALTAFYKNQ; QHPVALTAFYKNQQ; HPVALTAFYKNQQK; PVALTAFYKNQQKT; VALTAFYKNQQKTP; ALTAFYKNQQKTPK; LTAFYKNQQKTPKT; TAFYKNQQKTPKTK; AFYKNQQKTPKTKI; FYKNQQKTPKTKIE; YKNQQKTPKTKIET; KNQQKTPKTKIETA; NQQKTPKTKIETAL; QQKTPKTKIETALD; QKTPKTKIETALDR; KTPKTKIETALDRQ; TPKTKIETALDRQK; PKTKIETALDRQKI; KTKIETALDRQKIW; TKIETALDRQKIWK; KIETALDRQKIWKR; IETALDRQKIWKRA; ETALDRQKIWKRAF; TALDRQKIWKRAFG; ALDRQKIWKRAFGD; LDRQKIWKRAFGDT; DRQKIWKRAFGDTP; RQKIWKRAFGDTPP; QKIWKRAFGDTPPI<br><br>15 mers: | | |

Fig. 29 continued

| | | |
|---|---|---|
| | MPSGWVSHRLGGSPK; PSGWVSHRLGGSPKC; SGWVSHRLGGSPKCI;<br>GWVSHRLGGSPKCIS; WVSHRLGGSPKCISA; VSHRLGGSPKCISAL;<br>SHRLGGSPKCISALS; HRLGGSPKCISALSL; RLGGSPKCISALSLP;<br>LGGSPKCISALSLPS; GGSPKCISALSLPSG; GSPKCISALSLPSGT;<br>SPKCISALSLPSGTV; PKCISALSLPSGTVG; KCISALSLPSGTVGA;<br>CISALSLPSGTVGAP; ISALSLPSGTVGAPS; SALSLPSGTVGAPSK;<br>ALSLPSGTVGAPSKP; LSLPSGTVGAPSKPD; SLPSGTVGAPSKPDN;<br>LPSGTVGAPSKPDND; PSGTVGAPSKPDNDA; SGTVGAPSKPDNDAT;<br>GTVGAPSKPDNDATR; TVGAPSKPDNDATRG; VGAPSKPDNDATRGR;<br>GAPSKPDNDATRGRT; APSKPDNDATRGRTR; PSKPDNDATRGRTRP;<br>SKPDNDATRGRTRPT; KPDNDATRGRTRPTV; PDNDATRGRTRPTVP;<br>DNDATRGRTRPTVPP; NDATRGRTRPTVPPP; DATRGRTRPTVPPPD;<br>ATRGRTRPTVPPPDP; TRGRTRPTVPPPDPA; RGRTRPTVPPPDPAA;<br>GRTRPTVPPPDPAAM; RTRPTVPPPDPAAMG; TRPTVPPPDPAAMGT;<br>RPTVPPPDPAAMGTW; PTVPPPDPAAMGTWK; TVPPPDPAAMGTWKF;<br>VPPPDPAAMGTWKFF; PPPDPAAMGTWKFFR; PPDPAAMGTWKFFRA;<br>PDPAAMGTWKFFRAS; DPAAMGTWKFFRASV; PAAMGTWKFFRASVD;<br>AAMGTWKFFRASVDG; AMGTWKFFRASVDGR; MGTWKFFRASVDGRP;<br>GTWKFFRASVDGRPV; TWKFFRASVDGRPVF; WKFFRASVDGRPVFK;<br>KFFRASVDGRPVFKK; FFRASVDGRPVFKKE; FRASVDGRPVFKKEF;<br>RASVDGRPVFKKEFD; ASVDGRPVFKKEFDK; SVDGRPVFKKEFDKL;<br>VDGRPVFKKEFDKLP; DGRPVFKKEFDKLPD; GRPVFKKEFDKLPDQ;<br>RPVFKKEFDKLPDQA; PVFKKEFDKLPDQAR; VFKKEFDKLPDQARA;<br>FKKEFDKLPDQARAA; KKEFDKLPDQARAAL; KEFDKLPDQARAALI;<br>EFDKLPDQARAALIV; FDKLPDQARAALIVL; DKLPDQARAALIVLM;<br>KLPDQARAALIVLMQ; LPDQARAALIVLMQR; PDQARAALIVLMQRY;<br>DQARAALIVLMQRYL; QARAALIVLMQRYLV; ARAALIVLMQRYLVG;<br>RAALIVLMQRYLVGD; AALIVLMQRYLVGDL; ALIVLMQRYLVGDLA;<br>LIVLMQRYLVGDLAA; IVLMQRYLVGDLAAG; VLMQRYLVGDLAAGS;<br>LMQRYLVGDLAAGSI; MQRYLVGDLAAGSIK; QRYLVGDLAAGSIKP;<br>RYLVGDLAAGSIKPI; YLVGDLAAGSIKPIR; LVGDLAAGSIKPIRG;<br>VGDLAAGSIKPIRGD; GDLAAGSIKPIRGDI; DLAAGSIKPIRGDIL;<br>LAAGSIKPIRGDILE; AAGSIKPIRGDILEL; AGSIKPIRGDILELR;<br>GSIKPIRGDILELRW; SIKPIRGDILELRWH; IKPIRGDILELRWHE;<br>KPIRGDILELRWHEA; PIRGDILELRWHEAN; IRGDILELRWHEANN;<br>RGDILELRWHEANNH; GDILELRWHEANNHF; DILELRWHEANNHFR;<br>ILELRWHEANNHFRV; LELRWHEANNHFRVL; ELRWHEANNHFRVLF;<br>LRWHEANNHFRVLFF; RWHEANNHFRVLFFR; WHEANNHFRVLFFRW;<br>HEANNHFRVLFFRWG; EANNHFRVLFFRWGQ; ANNHFRVLFFRWGQH;<br>NNHFRVLFFRWGQHP; NHFRVLFFRWGQHPV; HFRVLFFRWGQHPVA;<br>FRVLFFRWGQHPVAL; RVLFFRWGQHPVALT; VLFFRWGQHPVALTA;<br>LFFRWGQHPVALTAF; FFRWGQHPVALTAFY; FRWGQHPVALTAFYK;<br>RWGQHPVALTAFYKN; WGQHPVALTAFYKNQ; GQHPVALTAFYKNQQ;<br>QHPVALTAFYKNQQK; HPVALTAFYKNQQKT; PVALTAFYKNQQKTP;<br>VALTAFYKNQQKTPK; ALTAFYKNQQKTPKT; LTAFYKNQQKTPKTK;<br>TAFYKNQQKTPKTKI; AFYKNQQKTPKTKIE; FYKNQQKTPKTKIET;<br>YKNQQKTPKTKIETA; KNQQKTPKTKIETAL; NQQKTPKTKIETALD;<br>QQKTPKTKIETALDR; QKTPKTKIETALDRQ; KTPKTKIETALDRQK;<br>TPKTKIETALDRQKI; PKTKIETALDRQKIW; KTKIETALDRQKIWK;<br>TKIETALDRQKIWKR; KIETALDRQKIWKRA; IETALDRQKIWKRAF;<br>ETALDRQKIWKRAFG; TALDRQKIWKRAFGD; ALDRQKIWKRAFGDT;<br>LDRQKIWKRAFGDTP; DRQKIWKRAFGDTPP; RQKIWKRAFGDTPPI | |

Fig. 29 continued 16 mers:
MPSGWVSHRLGGSPKC; PSGWVSHRLGGSPKCI; SGWVSHRLGGSPKCIS;
GWVSHRLGGSPKCISA; WVSHRLGGSPKCISAL; VSHRLGGSPKCISALS;
SHRLGGSPKCISALSL; HRLGGSPKCISALSLP; RLGGSPKCISALSLPS;
LGGSPKCISALSLPSG; GGSPKCISALSLPSGT; GSPKCISALSLPSGTV;
SPKCISALSLPSGTVG; PKCISALSLPSGTVGA; KCISALSLPSGTVGAP;
CISALSLPSGTVGAPS; ISALSLPSGTVGAPSK; SALSLPSGTVGAPSKP;
ALSLPSGTVGAPSKPD; LSLPSGTVGAPSKPDN; SLPSGTVGAPSKPDND;
LPSGTVGAPSKPDNDA; PSGTVGAPSKPDNDAT; SGTVGAPSKPDNDATR;
GTVGAPSKPDNDATRG; TVGAPSKPDNDATRGR; VGAPSKPDNDATRGRT;
GAPSKPDNDATRGRTR; APSKPDNDATRGRTRP; PSKPDNDATRGRTRPT;
SKPDNDATRGRTRPTV; KPDNDATRGRTRPTVP; PDNDATRGRTRPTVPP;
DNDATRGRTRPTVPPP; NDATRGRTRPTVPPPD; DATRGRTRPTVPPPDP;
ATRGRTRPTVPPPDPA; TRGRTRPTVPPPDPAA; RGRTRPTVPPPDPAAM;
GRTRPTVPPPDPAAMG; RTRPTVPPPDPAAMGT; TRPTVPPPDPAAMGTW;
RPTVPPPDPAAMGTWK; PTVPPPDPAAMGTWKF; TVPPPDPAAMGTWKFF;
VPPPDPAAMGTWKFFR; PPPDPAAMGTWKFFRA; PPDPAAMGTWKFFRAS;
PDPAAMGTWKFFRASV; DPAAMGTWKFFRASVD; PAAMGTWKFFRASVDG;
AAMGTWKFFRASVDGR; AMGTWKFFRASVDGRP; MGTWKFFRASVDGRPV;
GTWKFFRASVDGRPVF; TWKFFRASVDGRPVFK; WKFFRASVDGRPVFKK;
KFFRASVDGRPVFKKE; FFRASVDGRPVFKKEF; FRASVDGRPVFKKEFD;
RASVDGRPVFKKEFDK; ASVDGRPVFKKEFDKL; SVDGRPVFKKEFDKLP;
VDGRPVFKKEFDKLPD; DGRPVFKKEFDKLPDQ; GRPVFKKEFDKLPDQA;
RPVFKKEFDKLPDQAR; PVFKKEFDKLPDQARA; VFKKEFDKLPDQARAA;
FKKEFDKLPDQARAAL; KKEFDKLPDQARAALI; KEFDKLPDQARAALIV;
EFDKLPDQARAALIVL; FDKLPDQARAALIVLM; DKLPDQARAALIVLMQ;
KLPDQARAALIVLMQR; LPDQARAALIVLMQRY; PDQARAALIVLMQRYL;
DQARAALIVLMQRYLV; QARAALIVLMQRYLVG; ARAALIVLMQRYLVGD;
RAALIVLMQRYLVGDL; AALIVLMQRYLVGDLA; ALIVLMQRYLVGDLAA;
LIVLMQRYLVGDLAAG; IVLMQRYLVGDLAAGS; VLMQRYLVGDLAAGSI;
LMQRYLVGDLAAGSIK; MQRYLVGDLAAGSIKP; QRYLVGDLAAGSIKPI;
RYLVGDLAAGSIKPIR; YLVGDLAAGSIKPIRG; LVGDLAAGSIKPIRGD;
VGDLAAGSIKPIRGDI; GDLAAGSIKPIRGDIL; DLAAGSIKPIRGDILE;
LAAGSIKPIRGDILEL; AAGSIKPIRGDILELR; AGSIKPIRGDILELRW;
GSIKPIRGDILELRWH; SIKPIRGDILELRWHE; IKPIRGDILELRWHEA;
KPIRGDILELRWHEAN; PIRGDILELRWHEANN; IRGDILELRWHEANNH;
RGDILELRWHEANNHF; GDILELRWHEANNHFR; DILELRWHEANNHFRV;
ILELRWHEANNHFRVL; LELRWHEANNHFRVLF; ELRWHEANNHFRVLFF;
LRWHEANNHFRVLFFR; RWHEANNHFRVLFFRW; WHEANNHFRVLFFRWG;
HEANNHFRVLFFRWGQ; EANNHFRVLFFRWGQH; ANNHFRVLFFRWGQHP;
NNHFRVLFFRWGQHPV; NHFRVLFFRWGQHPVA; HFRVLFFRWGQHPVAL;
FRVLFFRWGQHPVALT; RVLFFRWGQHPVALTA; VLFFRWGQHPVALTAF;
LFFRWGQHPVALTAFY; FFRWGQHPVALTAFYK; FRWGQHPVALTAFYKN;
RWGQHPVALTAFYKNQ; WGQHPVALTAFYKNQQ; GQHPVALTAFYKNQQK;
QHPVALTAFYKNQQKT; HPVALTAFYKNQQKTP; PVALTAFYKNQQKTPK;
VALTAFYKNQQKTPKT; ALTAFYKNQQKTPKTK; LTAFYKNQQKTPKTKI;
TAFYKNQQKTPKTKIE; AFYKNQQKTPKTKIET; FYKNQQKTPKTKIETA;
YKNQQKTPKTKIETAL; KNQQKTPKTKIETALD; NQQKTPKTKIETALDR;
QQKTPKTKIETALDRQ; QKTPKTKIETALDRQK; KTPKTKIETALDRQKI;
TPKTKIETALDRQKIW; PKTKIETALDRQKIWK; KTKIETALDRQKIWKR;
TKIETALDRQKIWKRA; KIETALDRQKIWKRAF; IETALDRQKIWKRAFG;
ETALDRQKIWKRAFGD; TALDRQKIWKRAFGDT; ALDRQKIWKRAFGDTP;
LDRQKIWKRAFGDTPP; DRQKIWKRAFGDTPPI

Fig. 29 continued

| | | |
|---|---|---|
| | | |
| 31) Rv2034 | 13 mers:<br>MSTYRSPDRAWQA; STYRSPDRAWQAL; TYRSPDRAWQALA; YRSPDRAWQALAD; RSPDRAWQALADG; SPDRAWQALADGT; PDRAWQALADGTR; DRAWQALADGTRR; RAWQALADGTRRA; AWQALADGTRRAI; WQALADGTRRAIV; QALADGTRRAIVE; ALADGTRRAIVER; LADGTRRAIVERL; ADGTRRAIVERLA; DGTRRAIVERLAH; GTRRAIVERLAHG; TRRAIVERLAHGP; RRAIVERLAHGPL; RAIVERLAHGPLA; AIVERLAHGPLAV; IVERLAHGPLAVG; VERLAHGPLAVGE; ERLAHGPLAVGEL; RLAHGPLAVGELA; LAHGPLAVGELAR; AHGPLAVGELARD; HGPLAVGELARDL; GPLAVGELARDLP; PLAVGELARDLPV; LAVGELARDLPVS; AVGELARDLPVSR; VGELARDLPVSRP; GELARDLPVSRPA; ELARDLPVSRPAV; LARDLPVSRPAVS; ARDLPVSRPAVSQ; RDLPVSRPAVSQH; DLPVSRPAVSQHL; LPVSRPAVSQHLK; PVSRPAVSQHLKV; VSRPAVSQHLKVL; SRPAVSQHLKVLK; RPAVSQHLKVLKT; PAVSQHLKVLKTA; AVSQHLKVLKTAR; VSQHLKVLKTARL; SQHLKVLKTARLV; QHLKVLKTARLVC; HLKVLKTARLVCD; LKVLKTARLVCDR; KVLKTARLVCDRP; VLKTARLVCDRPA; LKTARLVCDRPAG; KTARLVCDRPAGT; TARLVCDRPAGTR; ARLVCDRPAGTRR; RLVCDRPAGTRRV; LVCDRPAGTRRVY; VCDRPAGTRRVYQ; CDRPAGTRRVYQL; DRPAGTRRVYQLD; RPAGTRRVYQLDP; PAGTRRVYQLDPT; AGTRRVYQLDPTG; GTRRVYQLDPTGL; TRRVYQLDPTGLA; RRVYQLDPTGLAA; RVYQLDPTGLAAL; VYQLDPTGLAALR; YQLDPTGLAALRT; QLDPTGLAALRTD; LDPTGLAALRTDL; DPTGLAALRTDLD; PTGLAALRTDLDR; TGLAALRTDLDRF; GLAALRTDLDRFW; LAALRTDLDRFWT; AALRTDLDRFWTR; ALRTDLDRFWTRA; LRTDLDRFWTRAL; RTDLDRFWTRALT; TDLDRFWTRALTG; DLDRFWTRALTGY; LDRFWTRALTGYA; DRFWTRALTGYAQ; RFWTRALTGYAQL; FWTRALTGYAQLI; WTRALTGYAQLID; TRALTGYAQLIDS; RALTGYAQLIDSE; ALTGYAQLIDSEG; LTGYAQLIDSEGD; TGYAQLIDSEGDD; GYAQLIDSEGDDT<br><br>14 mers:<br>MSTYRSPDRAWQAL; STYRSPDRAWQALA; TYRSPDRAWQALAD; YRSPDRAWQALADG; RSPDRAWQALADGT; SPDRAWQALADGTR; | 85369-85742 |

Fig. 29 continued

| | | |
|---|---|---|
| | PDRAWQALADGTRR; DRAWQALADGTRRA; RAWQALADGTRRAI;<br>AWQALADGTRRAIV; WQALADGTRRAIVE; QALADGTRRAIVER;<br>ALADGTRRAIVERL; LADGTRRAIVERLA; ADGTRRAIVERLAH;<br>DGTRRAIVERLAHG; GTRRAIVERLAHGP; TRRAIVERLAHGPL;<br>RRAIVERLAHGPLA; RAIVERLAHGPLAV; AIVERLAHGPLAVG;<br>IVERLAHGPLAVGE; VERLAHGPLAVGEL; ERLAHGPLAVGELA;<br>RLAHGPLAVGELAR; LAHGPLAVGELARD; AHGPLAVGELARDL;<br>HGPLAVGELARDLP; GPLAVGELARDLPV; PLAVGELARDLPVS;<br>LAVGELARDLPVSR; AVGELARDLPVSRP; VGELARDLPVSRPA;<br>GELARDLPVSRPAV; ELARDLPVSRPAVS; LARDLPVSRPAVSQ;<br>ARDLPVSRPAVSQH; RDLPVSRPAVSQHL; DLPVSRPAVSQHLK;<br>LPVSRPAVSQHLKV; PVSRPAVSQHLKVL; VSRPAVSQHLKVLK;<br>SRPAVSQHLKVLKT; RPAVSQHLKVLKTA; PAVSQHLKVLKTAR;<br>AVSQHLKVLKTARL; VSQHLKVLKTARLV; SQHLKVLKTARLVC;<br>QHLKVLKTARLVCD; HLKVLKTARLVCDR; LKVLKTARLVCDRP;<br>KVLKTARLVCDRPA; VLKTARLVCDRPAG; LKTARLVCDRPAGT;<br>KTARLVCDRPAGTR; TARLVCDRPAGTRR; ARLVCDRPAGTRRV;<br>RLVCDRPAGTRRVY; LVCDRPAGTRRVYQ; VCDRPAGTRRVYQL;<br>CDRPAGTRRVYQLD; DRPAGTRRVYQLDP; RPAGTRRVYQLDPT;<br>PAGTRRVYQLDPTG; AGTRRVYQLDPTGL; GTRRVYQLDPTGLA;<br>TRRVYQLDPTGLAA; RRVYQLDPTGLAAL; RVYQLDPTGLAALR;<br>VYQLDPTGLAALRT; YQLDPTGLAALRTD; QLDPTGLAALRTDL;<br>LDPTGLAALRTDLD; DPTGLAALRTDLDR; PTGLAALRTDLDRF;<br>TGLAALRTDLDRFW; GLAALRTDLDRFWT; LAALRTDLDRFWTR;<br>AALRTDLDRFWTRA; ALRTDLDRFWTRAL; LRTDLDRFWTRALT;<br>RTDLDRFWTRALTG; TDLDRFWTRALTGY; DLDRFWTRALTGYA;<br>LDRFWTRALTGYAQ; DRFWTRALTGYAQL; RFWTRALTGYAQLI;<br>FWTRALTGYAQLID; WTRALTGYAQLIDS; TRALTGYAQLIDSE;<br>RALTGYAQLIDSEG; ALTGYAQLIDSEGD; LTGYAQLIDSEGDD;<br>TGYAQLIDSEGDDT<br><br>15 mers:<br>MSTYRSPDRAWQALA; STYRSPDRAWQALAD; TYRSPDRAWQALADG;<br>YRSPDRAWQALADGT; RSPDRAWQALADGTR; SPDRAWQALADGTRR;<br>PDRAWQALADGTRRA; DRAWQALADGTRRAI; RAWQALADGTRRAIV;<br>AWQALADGTRRAIVE; WQALADGTRRAIVER; QALADGTRRAIVERL;<br>ALADGTRRAIVERLA; LADGTRRAIVERLAH; ADGTRRAIVERLAHG;<br>DGTRRAIVERLAHGP; GTRRAIVERLAHGPL; TRRAIVERLAHGPLA;<br>RRAIVERLAHGPLAV; RAIVERLAHGPLAVG; AIVERLAHGPLAVGE;<br>IVERLAHGPLAVGEL; VERLAHGPLAVGELA; ERLAHGPLAVGELAR;<br>RLAHGPLAVGELARD; LAHGPLAVGELARDL; AHGPLAVGELARDLP;<br>HGPLAVGELARDLPV; GPLAVGELARDLPVS; PLAVGELARDLPVSR;<br>LAVGELARDLPVSRP; AVGELARDLPVSRPA; VGELARDLPVSRPAV;<br>GELARDLPVSRPAVS; ELARDLPVSRPAVSQ; LARDLPVSRPAVSQH;<br>ARDLPVSRPAVSQHL; RDLPVSRPAVSQHLK; DLPVSRPAVSQHLKV;<br>LPVSRPAVSQHLKVL; PVSRPAVSQHLKVLK; VSRPAVSQHLKVLKT;<br>SRPAVSQHLKVLKTA; RPAVSQHLKVLKTAR; PAVSQHLKVLKTARL;<br>AVSQHLKVLKTARLV; VSQHLKVLKTARLVC; SQHLKVLKTARLVCD;<br>QHLKVLKTARLVCDR; HLKVLKTARLVCDRP; LKVLKTARLVCDRPA;<br>KVLKTARLVCDRPAG; VLKTARLVCDRPAGT; LKTARLVCDRPAGTR;<br>KTARLVCDRPAGTRR; TARLVCDRPAGTRRV; ARLVCDRPAGTRRVY;<br>RLVCDRPAGTRRVYQ; LVCDRPAGTRRVYQL; VCDRPAGTRRVYQLD;<br>CDRPAGTRRVYQLDP; DRPAGTRRVYQLDPT; RPAGTRRVYQLDPTG; | |

Fig. 29 continued

| | | |
|---|---|---|
| | PAGTRRVYQLDPTGL; AGTRRVYQLDPTGLA; GTRRVYQLDPTGLAA; TRRVYQLDPTGLAAL; RRVYQLDPTGLAALR; RVYQLDPTGLAALRT; VYQLDPTGLAALRTD; YQLDPTGLAALRTDL; QLDPTGLAALRTDLD; LDPTGLAALRTDLDR; DPTGLAALRTDLDRF; PTGLAALRTDLDRFW; TGLAALRTDLDRFWT; GLAALRTDLDRFWTR; LAALRTDLDRFWTRA; AALRTDLDRFWTRAL; ALRTDLDRFWTRALT; LRTDLDRFWTRALTG; RTDLDRFWTRALTGY; TDLDRFWTRALTGYA; DLDRFWTRALTGYAQ; LDRFWTRALTGYAQL; DRFWTRALTGYAQLI; RFWTRALTGYAQLID; FWTRALTGYAQLIDS; WTRALTGYAQLIDSE; TRALTGYAQLIDSEG; RALTGYAQLIDSEGD; ALTGYAQLIDSEGDD; LTGYAQLIDSEGDDT<br><br>16 mers:<br>MSTYRSPDRAWQALAD; STYRSPDRAWQALADG; TYRSPDRAWQALADGT; YRSPDRAWQALADGTR; RSPDRAWQALADGTRR; SPDRAWQALADGTRRA; PDRAWQALADGTRRAI; DRAWQALADGTRRAIV; RAWQALADGTRRAIVE; AWQALADGTRRAIVER; WQALADGTRRAIVERL; QALADGTRRAIVERLA; ALADGTRRAIVERLAH; LADGTRRAIVERLAHG; ADGTRRAIVERLAHGP; DGTRRAIVERLAHGPL; GTRRAIVERLAHGPLA; TRRAIVERLAHGPLAV; RRAIVERLAHGPLAVG; RAIVERLAHGPLAVGE; AIVERLAHGPLAVGEL; IVERLAHGPLAVGELA; VERLAHGPLAVGELAR; ERLAHGPLAVGELARD; RLAHGPLAVGELARDL; LAHGPLAVGELARDLP; AHGPLAVGELARDLPV; HGPLAVGELARDLPVS; GPLAVGELARDLPVSR; PLAVGELARDLPVSRP; LAVGELARDLPVSRPA; AVGELARDLPVSRPAV; VGELARDLPVSRPAVS; GELARDLPVSRPAVSQ; ELARDLPVSRPAVSQH; LARDLPVSRPAVSQHL; ARDLPVSRPAVSQHLK; RDLPVSRPAVSQHLKV; DLPVSRPAVSQHLKVL; LPVSRPAVSQHLKVLK; PVSRPAVSQHLKVLKT; VSRPAVSQHLKVLKTA; SRPAVSQHLKVLKTAR; RPAVSQHLKVLKTARL; PAVSQHLKVLKTARLV; AVSQHLKVLKTARLVC; VSQHLKVLKTARLVCD; SQHLKVLKTARLVCDR; QHLKVLKTARLVCDRP; HLKVLKTARLVCDRPA; LKVLKTARLVCDRPAG; KVLKTARLVCDRPAGT; VLKTARLVCDRPAGTR; LKTARLVCDRPAGTRR; KTARLVCDRPAGTRRV; TARLVCDRPAGTRRVY; ARLVCDRPAGTRRVYQ; RLVCDRPAGTRRVYQL; LVCDRPAGTRRVYQLD; VCDRPAGTRRVYQLDP; CDRPAGTRRVYQLDPT; DRPAGTRRVYQLDPTG; RPAGTRRVYQLDPTGL; PAGTRRVYQLDPTGLA; AGTRRVYQLDPTGLAA; GTRRVYQLDPTGLAAL; TRRVYQLDPTGLAALR; RRVYQLDPTGLAALRT; RVYQLDPTGLAALRTD; VYQLDPTGLAALRTDL; YQLDPTGLAALRTDLD; QLDPTGLAALRTDLDR; LDPTGLAALRTDLDRF; DPTGLAALRTDLDRFW; PTGLAALRTDLDRFWT; TGLAALRTDLDRFWTR; GLAALRTDLDRFWTRA; LAALRTDLDRFWTRAL; AALRTDLDRFWTRALT; ALRTDLDRFWTRALTG; LRTDLDRFWTRALTGY; RTDLDRFWTRALTGYA; TDLDRFWTRALTGYAQ; DLDRFWTRALTGYAQL; LDRFWTRALTGYAQLI; DRFWTRALTGYAQLID; RFWTRALTGYAQLIDS; FWTRALTGYAQLIDSE; WTRALTGYAQLIDSEG; TRALTGYAQLIDSEGD; RALTGYAQLIDSEGDD; ALTGYAQLIDSEGDDT | |
| 32) Rv2050 | 13 mers:<br>MADRVLRGSRLGA; ADRVLRGSRLGAV; DRVLRGSRLGAVS; RVLRGSRLGAVSY; VLRGSRLGAVSYE; LRGSRLGAVSYET; RGSRLGAVSYETD; GSRLGAVSYETDR; SRLGAVSYETDRN; RLGAVSYETDRNH; LGAVSYETDRNHD; GAVSYETDRNHDL; AVSYETDRNHDLA; VSYETDRNHDLAP; SYETDRNHDLAPR; YETDRNHDLAPRQ; ETDRNHDLAPRQI; TDRNHDLAPRQIA; DRNHDLAPRQIAR; RNHDLAPRQIARY; NHDLAPRQIARYR; HDLAPRQIARYRT; DLAPRQIARYRTD; LAPRQIARYRTDN; APRQIARYRTDNG; PRQIARYRTDNGE; RQIARYRTDNGEE; QIARYRTDNGEEF; IARYRTDNGEEFE; ARYRTDNGEEFEV; | 85743-86132 |

Fig. 29 continued

| | | |
|---|---|---|
| | RYRTDNGEEFEVP; YRTDNGEEFEVPF; RTDNGEEFEVPFA; TDNGEEFEVPFAD; DNGEEFEVPFADD; NGEEFEVPFADDA; GEEFEVPFADDAE; EEFEVPFADDAEI; EFEVPFADDAEIP; FEVPFADDAEIPG; EVPFADDAEIPGT; VPFADDAEIPGTW; PFADDAEIPGTWL; FADDAEIPGTWLC; ADDAEIPGTWLCR; DDAEIPGTWLCRN; DAEIPGTWLCRNG; AEIPGTWLCRNGM; EIPGTWLCRNGME; IPGTWLCRNGMEG; PGTWLCRNGMEGT; GTWLCRNGMEGTL; TWLCRNGMEGTLI; WLCRNGMEGTLIE; LCRNGMEGTLIEG; CRNGMEGTLIEGD; RNGMEGTLIEGDL; NGMEGTLIEGDLP; GMEGTLIEGDLPE; MEGTLIEGDLPEP; EGTLIEGDLPEPK; GTLIEGDLPEPKK; TLIEGDLPEPKKV; LIEGDLPEPKKVK; IEGDLPEPKKVKP; EGDLPEPKKVKPP; GDLPEPKKVKPPR; DLPEPKKVKPPRT; LPEPKKVKPPRTH; PEPKKVKPPRTHW; EPKKVKPPRTHWD; PKKVKPPRTHWDM; KKVKPPRTHWDML; KVKPPRTHWDMLL; VKPPRTHWDMLLE; KPPRTHWDMLLER; PPRTHWDMLLERR; PRTHWDMLLERRS; RTHWDMLLERRSI; THWDMLLERRSIE; HWDMLLERRSIEE; WDMLLERRSIEEL; DMLLERRSIEELE; MLLERRSIEELEE; LLERRSIEELEEL; LERRSIEELEELL; ERRSIEELEELLK; RRSIEELEELLKE; RSIEELEELLKER; SIEELEELLKERL; IEELEELLKERLE; EELEELLKERLEL; ELEELLKERLELI; LEELLKERLELIR; EELLKERLELIRS; ELLKERLELIRSR; LLKERLELIRSRR; LKERLELIRSRRR; KERLELIRSRRRG<br><br>14 mers:<br>MADRVLRGSRLGAV; ADRVLRGSRLGAVS; DRVLRGSRLGAVSY; RVLRGSRLGAVSYE; VLRGSRLGAVSYET; LRGSRLGAVSYETD; RGSRLGAVSYETDR; GSRLGAVSYETDRN; SRLGAVSYETDRNH; RLGAVSYETDRNHD; LGAVSYETDRNHDL; GAVSYETDRNHDLA; AVSYETDRNHDLAP; VSYETDRNHDLAPR; SYETDRNHDLAPRQ; YETDRNHDLAPRQI; ETDRNHDLAPRQIA; TDRNHDLAPRQIAR; DRNHDLAPRQIARY; RNHDLAPRQIARYR; NHDLAPRQIARYRT; HDLAPRQIARYRTD; DLAPRQIARYRTDN; LAPRQIARYRTDNG; APRQIARYRTDNGE; PRQIARYRTDNGEE; RQIARYRTDNGEEF; QIARYRTDNGEEFE; IARYRTDNGEEFEV; ARYRTDNGEEFEVP; RYRTDNGEEFEVPF; YRTDNGEEFEVPFA; RTDNGEEFEVPFAD; TDNGEEFEVPFADD; DNGEEFEVPFADDA; NGEEFEVPFADDAE; GEEFEVPFADDAEI; EEFEVPFADDAEIP; EFEVPFADDAEIPG; FEVPFADDAEIPGT; EVPFADDAEIPGTW; VPFADDAEIPGTWL; PFADDAEIPGTWLC; FADDAEIPGTWLCR; ADDAEIPGTWLCRN; DDAEIPGTWLCRNG; DAEIPGTWLCRNGM; AEIPGTWLCRNGME; EIPGTWLCRNGMEG; IPGTWLCRNGMEGT; PGTWLCRNGMEGTL; GTWLCRNGMEGTLI; TWLCRNGMEGTLIE; WLCRNGMEGTLIEG; LCRNGMEGTLIEGD; CRNGMEGTLIEGDL; RNGMEGTLIEGDLP; NGMEGTLIEGDLPE; GMEGTLIEGDLPEP; MEGTLIEGDLPEPK; EGTLIEGDLPEPKK; GTLIEGDLPEPKKV; TLIEGDLPEPKKVK; LIEGDLPEPKKVKP; IEGDLPEPKKVKPP; EGDLPEPKKVKPPR; GDLPEPKKVKPPRT; DLPEPKKVKPPRTH; LPEPKKVKPPRTHW; PEPKKVKPPRTHWD; EPKKVKPPRTHWDM; PKKVKPPRTHWDML; KKVKPPRTHWDMLL; KVKPPRTHWDMLLE; VKPPRTHWDMLLER; KPPRTHWDMLLERR; PPRTHWDMLLERRS; PRTHWDMLLERRSI; RTHWDMLLERRSIE; THWDMLLERRSIEE; HWDMLLERRSIEEL; WDMLLERRSIEELE; DMLLERRSIEELEE; MLLERRSIEELEEL; LLERRSIEELEELL; LERRSIEELEELLK; ERRSIEELEELLKE; RRSIEELEELLKER; RSIEELEELLKERL; SIEELEELLKERLE; IEELEELLKERLEL; EELEELLKERLELI; ELEELLKERLELIR; LEELLKERLELIRS; EELLKERLELIRSR; ELLKERLELIRSRR; LLKERLELIRSRRR; LKERLELIRSRRRG | |

Fig. 29 continued

| | | |
|---|---|---|
| | 15 mers:<br>MADRVLRGSRLGAVS; ADRVLRGSRLGAVSY; DRVLRGSRLGAVSYE;<br>RVLRGSRLGAVSYET; VLRGSRLGAVSYETD; LRGSRLGAVSYETDR;<br>RGSRLGAVSYETDRN; GSRLGAVSYETDRNH; SRLGAVSYETDRNHD;<br>RLGAVSYETDRNHDL; LGAVSYETDRNHDLA; GAVSYETDRNHDLAP;<br>AVSYETDRNHDLAPR; VSYETDRNHDLAPRQ; SYETDRNHDLAPRQI;<br>YETDRNHDLAPRQIA; ETDRNHDLAPRQIAR; TDRNHDLAPRQIARY;<br>DRNHDLAPRQIARYR; RNHDLAPRQIARYRT; NHDLAPRQIARYRTD;<br>HDLAPRQIARYRTDN; DLAPRQIARYRTDNG; LAPRQIARYRTDNGE;<br>APRQIARYRTDNGEE; PRQIARYRTDNGEEF; RQIARYRTDNGEEFE;<br>QIARYRTDNGEEFEV; IARYRTDNGEEFEVP; ARYRTDNGEEFEVPF;<br>RYRTDNGEEFEVPFA; YRTDNGEEFEVPFAD; RTDNGEEFEVPFADD;<br>TDNGEEFEVPFADDA; DNGEEFEVPFADDAE; NGEEFEVPFADDAEI;<br>GEEFEVPFADDAEIP; EEFEVPFADDAEIPG; EFEVPFADDAEIPGT;<br>FEVPFADDAEIPGTW; EVPFADDAEIPGTWL; VPFADDAEIPGTWLC;<br>PFADDAEIPGTWLCR; FADDAEIPGTWLCRN; ADDAEIPGTWLCRNG;<br>DDAEIPGTWLCRNGM; DAEIPGTWLCRNGME; AEIPGTWLCRNGMEG;<br>EIPGTWLCRNGMEGT; IPGTWLCRNGMEGTL; PGTWLCRNGMEGTLI;<br>GTWLCRNGMEGTLIE; TWLCRNGMEGTLIEG; WLCRNGMEGTLIEGD;<br>LCRNGMEGTLIEGDL; CRNGMEGTLIEGDLP; RNGMEGTLIEGDLPE;<br>NGMEGTLIEGDLPEP; GMEGTLIEGDLPEPK; MEGTLIEGDLPEPKK;<br>EGTLIEGDLPEPKKV; GTLIEGDLPEPKKVK; TLIEGDLPEPKKVKP;<br>LIEGDLPEPKKVKPP; IEGDLPEPKKVKPPR; EGDLPEPKKVKPPRT;<br>GDLPEPKKVKPPRTH; DLPEPKKVKPPRTHW; LPEPKKVKPPRTHWD;<br>PEPKKVKPPRTHWDM; EPKKVKPPRTHWDML; PKKVKPPRTHWDMLL;<br>KKVKPPRTHWDMLLE; KVKPPRTHWDMLLER; VKPPRTHWDMLLERR;<br>KPPRTHWDMLLERRS; PPRTHWDMLLERRSI; PRTHWDMLLERRSIE;<br>RTHWDMLLERRSIEE; THWDMLLERRSIEEL; HWDMLLERRSIEELE;<br>WDMLLERRSIEELEE; DMLLERRSIEELEEL; MLLERRSIEELEELL;<br>LLERRSIEELEELLK; LERRSIEELEELLKE; ERRSIEELEELLKER;<br>RRSIEELEELLKERL; RSIEELEELLKERLE; SIEELEELLKERLEL;<br>IEELEELLKERLELI; EELEELLKERLELIR; ELEELLKERLELIRS;<br>LEELLKERLELIRSR; EELLKERLELIRSRR; ELLKERLELIRSRRR;<br>LLKERLELIRSRRRG<br><br>16 mers:<br>MADRVLRGSRLGAVSY; ADRVLRGSRLGAVSYE; DRVLRGSRLGAVSYET;<br>RVLRGSRLGAVSYETD; VLRGSRLGAVSYETDR; LRGSRLGAVSYETDRN;<br>RGSRLGAVSYETDRNH; GSRLGAVSYETDRNHD; SRLGAVSYETDRNHDL;<br>RLGAVSYETDRNHDLA; LGAVSYETDRNHDLAP; GAVSYETDRNHDLAPR;<br>AVSYETDRNHDLAPRQ; VSYETDRNHDLAPRQI; SYETDRNHDLAPRQIA;<br>YETDRNHDLAPRQIAR; ETDRNHDLAPRQIARY; TDRNHDLAPRQIARYR;<br>DRNHDLAPRQIARYRT; RNHDLAPRQIARYRTD; NHDLAPRQIARYRTDN;<br>HDLAPRQIARYRTDNG; DLAPRQIARYRTDNGE; LAPRQIARYRTDNGEE;<br>APRQIARYRTDNGEEF; PRQIARYRTDNGEEFE; RQIARYRTDNGEEFEV;<br>QIARYRTDNGEEFEVP; IARYRTDNGEEFEVPF; ARYRTDNGEEFEVPFA;<br>RYRTDNGEEFEVPFAD; YRTDNGEEFEVPFADD; RTDNGEEFEVPFADDA;<br>TDNGEEFEVPFADDAE; DNGEEFEVPFADDAEI; NGEEFEVPFADDAEIP;<br>GEEFEVPFADDAEIPG; EEFEVPFADDAEIPGT; EFEVPFADDAEIPGTW;<br>FEVPFADDAEIPGTWL; EVPFADDAEIPGTWLC; VPFADDAEIPGTWLCR;<br>PFADDAEIPGTWLCRN; FADDAEIPGTWLCRNG; ADDAEIPGTWLCRNGM;<br>DDAEIPGTWLCRNGME; DAEIPGTWLCRNGMEG; AEIPGTWLCRNGMEGT; | |

Fig. 29 continued

| | | |
|---|---|---|
| | EIPGTWLCRNGMEGTL; IPGTWLCRNGMEGTLI; PGTWLCRNGMEGTLIE; GTWLCRNGMEGTLIEG; TWLCRNGMEGTLIEGD; WLCRNGMEGTLIEGDL; LCRNGMEGTLIEGDLP; CRNGMEGTLIEGDLPE; RNGMEGTLIEGDLPEP; NGMEGTLIEGDLPEPK; GMEGTLIEGDLPEPKK; MEGTLIEGDLPEPKKV; EGTLIEGDLPEPKKVK; GTLIEGDLPEPKKVKP; TLIEGDLPEPKKVKPP; LIEGDLPEPKKVKPPR; IEGDLPEPKKVKPPRT; EGDLPEPKKVKPPRTH; GDLPEPKKVKPPRTHW; DLPEPKKVKPPRTHWD; LPEPKKVKPPRTHWDM; PEPKKVKPPRTHWDML; EPKKVKPPRTHWDMLL; PKKVKPPRTHWDMLLE; KKVKPPRTHWDMLLER; KVKPPRTHWDMLLERR; VKPPRTHWDMLLERRS; KPPRTHWDMLLERRSI; PPRTHWDMLLERRSIE; PRTHWDMLLERRSIEE; RTHWDMLLERRSIEEL; THWDMLLERRSIEELE; HWDMLLERRSIEELEE; WDMLLERRSIEELEEL; DMLLERRSIEELEELL; MLLERRSIEELEELLK; LLERRSIEELEELLKE; LERRSIEELEELLKER; ERRSIEELEELLKERL; RRSIEELEELLKERLE; RSIEELEELLKERLEL; SIEELEELLKERLELI; IEELEELLKERLELIR; EELEELLKERLELIRS; ELEELLKERLELIRSR; LEELLKERLELIRSRR; EELLKERLELIRSRRR; ELLKERLELIRSRRRG | |
| 33) Rv2169c | 13 mers: MPLSDHEQRMLDQ; PLSDHEQRMLDQI; LSDHEQRMLDQIE; SDHEQRMLDQIES; DHEQRMLDQIESA; HEQRMLDQIESAL; EQRMLDQIESALY; QRMLDQIESALYA; RMLDQIESALYAE; MLDQIESALYAED; LDQIESALYAEDP; DQIESALYAEDPK; QIESALYAEDPKF; IESALYAEDPKFA; ESALYAEDPKFAS; SALYAEDPKFASS; ALYAEDPKFASSV; LYAEDPKFASSVR; YAEDPKFASSVRG; AEDPKFASSVRGG; EDPKFASSVRGGG; DPKFASSVRGGGF; PKFASSVRGGGFR; KFASSVRGGGFRA; FASSVRGGGFRAP; ASSVRGGGFRAPT; SSVRGGGFRAPTA; SVRGGGFRAPTAR; VRGGGFRAPTARR; RGGGFRAPTARRR; GGGFRAPTARRRL; GGFRAPTARRRLQ; GFRAPTARRRLQG; FRAPTARRRLQGA; RAPTARRRLQGAA; APTARRRLQGAAL; PTARRRLQGAALF; TARRRLQGAALFI; ARRRLQGAALFII; RRRLQGAALFIIG; RRLQGAALFIIGL; RLQGAALFIIGLG; LQGAALFIIGLGM; QGAALFIIGLGML; GAALFIIGLGMLV; AALFIIGLGMLVS; ALFIIGLGMLVSG; LFIIGLGMLVSGV; FIIGLGMLVSGVA; IIGLGMLVSGVAF; IGLGMLVSGVAFK; GLGMLVSGVAFKE; LGMLVSGVAFKET; GMLVSGVAFKETM; MLVSGVAFKETMI; LVSGVAFKETMIG; VSGVAFKETMIGS; SGVAFKETMIGSF; GVAFKETMIGSFP; VAFKETMIGSFPI; AFKETMIGSFPIL; FKETMIGSFPILS; KETMIGSFPILSV; ETMIGSFPILSVF; TMIGSFPILSVFG; MIGSFPILSVFGF; IGSFPILSVFGFV; GSFPILSVFGFVV; SFPILSVFGFVVM; FPILSVFGFVVMF; PILSVFGFVVMFG; ILSVFGFVVMFGG; LSVFGFVVMFGGV; SVFGFVVMFGGVV; VFGFVVMFGGVVY; FGFVVMFGGVVYA; GFVVMFGGVVYAI; FVVMFGGVVYAIT; VVMFGGVVYAITG; VMFGGVVYAITGP; MFGGVVYAITGPR; FGGVVYAITGPRL; GGVVYAITGPRLS; GVVYAITGPRLSG; VVYAITGPRLSGR; VYAITGPRLSGRM; YAITGPRLSGRMD; AITGPRLSGRMDR; ITGPRLSGRMDRG; TGPRLSGRMDRGG; GPRLSGRMDRGGS; PRLSGRMDRGGSA; RLSGRMDRGGSAA; LSGRMDRGGSAAG; SGRMDRGGSAAGA; GRMDRGGSAAGAS; RMDRGGSAAGASR; MDRGGSAAGASRQ; DRGGSAAGASRQR; RGGSAAGASRQRR; GGSAAGASRQRRT; GSAAGASRQRRTK; SAAGASRQRRTKG; AAGASRQRRTKGA; AGASRQRRTKGAG; GASRQRRTKGAGG; ASRQRRTKGAGGS; SRQRRTKGAGGSF; RQRRTKGAGGSFT; QRRTKGAGGSFTS; RRTKGAGGSFTSR; RTKGAGGSFTSRM; TKGAGGSFTSRME; KGAGGSFTSRMED; GAGGSFTSRMEDR; AGGSFTSRMEDRF; GGSFTSRMEDRFR; GSFTSRMEDRFRR; SFTSRMEDRFRRR; FTSRMEDRFRRRF; TSRMEDRFRRRFD; SRMEDRFRRRFDE | 86133-86615 |

Fig. 29 continued

| | | |
|---|---|---|
| | 14 mers:<br>MPLSDHEQRMLDQI; PLSDHEQRMLDQIE; LSDHEQRMLDQIES; SDHEQRMLDQIESA; DHEQRMLDQIESAL; HEQRMLDQIESALY; EQRMLDQIESALYA; QRMLDQIESALYAE; RMLDQIESALYAED; MLDQIESALYAEDP; LDQIESALYAEDPK; DQIESALYAEDPKF; QIESALYAEDPKFA; IESALYAEDPKFAS; ESALYAEDPKFASS; SALYAEDPKFASSV; ALYAEDPKFASSVR; LYAEDPKFASSVRG; YAEDPKFASSVRGG; AEDPKFASSVRGGG; EDPKFASSVRGGGF; DPKFASSVRGGGFR; PKFASSVRGGGFRA; KFASSVRGGGFRAP; FASSVRGGGFRAPT; ASSVRGGGFRAPTA; SSVRGGGFRAPTAR; SVRGGGFRAPTARR; VRGGGFRAPTARRR; RGGGFRAPTARRRL; GGGFRAPTARRRLQ; GGFRAPTARRRLQG; GFRAPTARRRLQGA; FRAPTARRRLQGAA; RAPTARRRLQGAAL; APTARRRLQGAALF; PTARRRLQGAALFI; TARRRLQGAALFII; ARRRLQGAALFIIG; RRRLQGAALFIIGL; RRLQGAALFIIGLG; RLQGAALFIIGLGM; LQGAALFIIGLGML; QGAALFIIGLGMLV; GAALFIIGLGMLVS; AALFIIGLGMLVSG; ALFIIGLGMLVSGV; LFIIGLGMLVSGVA; FIIGLGMLVSGVAF; IIGLGMLVSGVAFK; IGLGMLVSGVAFKE; GLGMLVSGVAFKET; LGMLVSGVAFKETM; GMLVSGVAFKETMI; MLVSGVAFKETMIG; LVSGVAFKETMIGS; VSGVAFKETMIGSF; SGVAFKETMIGSFP; GVAFKETMIGSFPI; VAFKETMIGSFPIL; AFKETMIGSFPILS; FKETMIGSFPILSV; KETMIGSFPILSVF; ETMIGSFPILSVFG; TMIGSFPILSVFGF; MIGSFPILSVFGFV; IGSFPILSVFGFVV; GSFPILSVFGFVVM; SFPILSVFGFVVMF; FPILSVFGFVVMFG; PILSVFGFVVMFGG; ILSVFGFVVMFGGV; LSVFGFVVMFGGVV; SVFGFVVMFGGVVY; VFGFVVMFGGVVYA; FGFVVMFGGVVYAI; GFVVMFGGVVYAIT; FVVMFGGVVYAITG; VVMFGGVVYAITGP; VMFGGVVYAITGPR; MFGGVVYAITGPRL; FGGVVYAITGPRLS; GGVVYAITGPRLSG; GVVYAITGPRLSGR; VVYAITGPRLSGRM; VYAITGPRLSGRMD; YAITGPRLSGRMDR; AITGPRLSGRMDRG; ITGPRLSGRMDRGG; TGPRLSGRMDRGGS; GPRLSGRMDRGGSA; PRLSGRMDRGGSAA; RLSGRMDRGGSAAG; LSGRMDRGGSAAGA; SGRMDRGGSAAGAS; GRMDRGGSAAGASR; RMDRGGSAAGASRQ; MDRGGSAAGASRQR; DRGGSAAGASRQRR; RGGSAAGASRQRRT; GGSAAGASRQRRTK; GSAAGASRQRRTKG; SAAGASRQRRTKGA; AAGASRQRRTKGAG; AGASRQRRTKGAGG; GASRQRRTKGAGGS; ASRQRRTKGAGGSF; SRQRRTKGAGGSFT; RQRRTKGAGGSFTS; QRRTKGAGGSFTSR; RRTKGAGGSFTSRM; RTKGAGGSFTSRME; TKGAGGSFTSRMED; KGAGGSFTSRMEDR; GAGGSFTSRMEDRF; AGGSFTSRMEDRFR; GGSFTSRMEDRFRR; GSFTSRMEDRFRRR; SFTSRMEDRFRRRF; FTSRMEDRFRRRFD; TSRMEDRFRRRFDE<br><br>15 mers:<br>MPLSDHEQRMLDQIE; PLSDHEQRMLDQIES; LSDHEQRMLDQIESA; SDHEQRMLDQIESAL; DHEQRMLDQIESALY; HEQRMLDQIESALYA; EQRMLDQIESALYAE; QRMLDQIESALYAED; RMLDQIESALYAEDP; MLDQIESALYAEDPK; LDQIESALYAEDPKF; DQIESALYAEDPKFA; QIESALYAEDPKFAS; IESALYAEDPKFASS; ESALYAEDPKFASSV; SALYAEDPKFASSVR; ALYAEDPKFASSVRG; LYAEDPKFASSVRGG; YAEDPKFASSVRGGG; AEDPKFASSVRGGGF; EDPKFASSVRGGGFR; DPKFASSVRGGGFRA; PKFASSVRGGGFRAP; KFASSVRGGGFRAPT; FASSVRGGGFRAPTA; ASSVRGGGFRAPTAR; SSVRGGGFRAPTARR; SVRGGGFRAPTARRR; VRGGGFRAPTARRRL; RGGGFRAPTARRRLQ; GGGFRAPTARRRLQG; GGFRAPTARRRLQGA; GFRAPTARRRLQGAA; | |

Fig. 29 continued

| | | | |
|---|---|---|---|
| | FRAPTARRRLQGAAL; RAPTARRRLQGAALF; APTARRRLQGAALFI; PTARRRLQGAALFII; TARRRLQGAALFIIG; ARRRLQGAALFIIGL; RRRLQGAALFIIGLG; RRLQGAALFIIGLGM; RLQGAALFIIGLGML; LQGAALFIIGLGMLV; QGAALFIIGLGMLVS; GAALFIIGLGMLVSG; AALFIIGLGMLVSGV; ALFIIGLGMLVSGVA; LFIIGLGMLVSGVAF; FIIGLGMLVSGVAFK; IIGLGMLVSGVAFKE; IGLGMLVSGVAFKET; GLGMLVSGVAFKETM; LGMLVSGVAFKETMI; GMLVSGVAFKETMIG; MLVSGVAFKETMIGS; LVSGVAFKETMIGSF; VSGVAFKETMIGSFP; SGVAFKETMIGSFPI; GVAFKETMIGSFPIL; VAFKETMIGSFPILS; AFKETMIGSFPILSV; FKETMIGSFPILSVF; KETMIGSFPILSVFG; ETMIGSFPILSVFGF; TMIGSFPILSVFGFV; MIGSFPILSVFGFVV; IGSFPILSVFGFVVM; GSFPILSVFGFVVMF; SFPILSVFGFVVMFG; FPILSVFGFVVMFGG; PILSVFGFVVMFGGV; ILSVFGFVVMFGGVV; LSVFGFVVMFGGVVY; SVFGFVVMFGGVVYA; VFGFVVMFGGVVYAI; FGFVVMFGGVVYAIT; GFVVMFGGVVYAITG; FVVMFGGVVYAITGP; VVMFGGVVYAITGPR; VMFGGVVYAITGPRL; MFGGVVYAITGPRLS; FGGVVYAITGPRLSG; GGVVYAITGPRLSGR; GVVYAITGPRLSGRM; VVYAITGPRLSGRMD; VYAITGPRLSGRMDR; YAITGPRLSGRMDRG; AITGPRLSGRMDRGG; ITGPRLSGRMDRGGS; TGPRLSGRMDRGGSA; GPRLSGRMDRGGSAA; PRLSGRMDRGGSAAG; RLSGRMDRGGSAAGA; LSGRMDRGGSAAGAS; SGRMDRGGSAAGASR; GRMDRGGSAAGASRQ; RMDRGGSAAGASRQR; MDRGGSAAGASRQRR; DRGGSAAGASRQRRT; RGGSAAGASRQRRTK; GGSAAGASRQRRTKG; GSAAGASRQRRTKGA; SAAGASRQRRTKGAG; AAGASRQRRTKGAGG; AGASRQRRTKGAGGS; GASRQRRTKGAGGSF; ASRQRRTKGAGGSFT; SRQRRTKGAGGSFTS; RQRRTKGAGGSFTSR; QRRTKGAGGSFTSRM; RRTKGAGGSFTSRME; RTKGAGGSFTSRMED; TKGAGGSFTSRMEDR; KGAGGSFTSRMEDRF; GAGGSFTSRMEDRFR; AGGSFTSRMEDRFRR; GGSFTSRMEDRFRRR; GSFTSRMEDRFRRRF; SFTSRMEDRFRRRFD; FTSRMEDRFRRRFDE; TSRMEDRFRRRFDE<br><br>16 mers:<br>MPLSDHEQRMLDQIES; PLSDHEQRMLDQIESA; LSDHEQRMLDQIESAL; SDHEQRMLDQIESALY; DHEQRMLDQIESALYA; HEQRMLDQIESALYAE; EQRMLDQIESALYAED; QRMLDQIESALYAEDP; RMLDQIESALYAEDPK; MLDQIESALYAEDPKF; LDQIESALYAEDPKFA; DQIESALYAEDPKFAS; QIESALYAEDPKFASS; IESALYAEDPKFASSV; ESALYAEDPKFASSVR; SALYAEDPKFASSVRG; ALYAEDPKFASSVRGG; LYAEDPKFASSVRGGG; YAEDPKFASSVRGGGF; AEDPKFASSVRGGGFR; EDPKFASSVRGGGFRA; DPKFASSVRGGGFRAP; PKFASSVRGGGFRAPT; KFASSVRGGGFRAPTA; FASSVRGGGFRAPTAR; ASSVRGGGFRAPTARR; SSVRGGGFRAPTARRR; SVRGGGFRAPTARRRL; VRGGGFRAPTARRRLQ; RGGGFRAPTARRRLQG; GGGFRAPTARRRLQGA; GGFRAPTARRRLQGAA; GFRAPTARRRLQGAAL; FRAPTARRRLQGAALF; RAPTARRRLQGAALFI; APTARRRLQGAALFII; PTARRRLQGAALFIIG; TARRRLQGAALFIIGL; ARRRLQGAALFIIGLG; RRRLQGAALFIIGLGM; RRLQGAALFIIGLGML; RLQGAALFIIGLGMLV; LQGAALFIIGLGMLVS; QGAALFIIGLGMLVSG; GAALFIIGLGMLVSGV; AALFIIGLGMLVSGVA; ALFIIGLGMLVSGVAF; LFIIGLGMLVSGVAFK; FIIGLGMLVSGVAFKE; IIGLGMLVSGVAFKET; IGLGMLVSGVAFKETM; GLGMLVSGVAFKETMI; LGMLVSGVAFKETMIG; GMLVSGVAFKETMIGS; MLVSGVAFKETMIGSF; LVSGVAFKETMIGSFP; VSGVAFKETMIGSFPI; SGVAFKETMIGSFPIL; GVAFKETMIGSFPILS; VAFKETMIGSFPILSV; AFKETMIGSFPILSVF; FKETMIGSFPILSVFG; KETMIGSFPILSVFGF; | |

Fig. 29 continued

| | | |
|---|---|---|
| | ETMIGSFPILSVFGFV; TMIGSFPILSVFGFVV; MIGSFPILSVFGFVVM; IGSFPILSVFGFVVMF; GSFPILSVFGFVVMFG; SFPILSVFGFVVMFGG; FPILSVFGFVVMFGGV; PILSVFGFVVMFGGVV; ILSVFGFVVMFGGVVY; LSVFGFVVMFGGVVYA; SVFGFVVMFGGVVYAI; VFGFVVMFGGVVYAIT; FGFVVMFGGVVYAITG; GFVVMFGGVVYAITGP; FVVMFGGVVYAITGPR; VVMFGGVVYAITGPRL; VMFGGVVYAITGPRLS; MFGGVVYAITGPRLSG; FGGVVYAITGPRLSGR; GGVVYAITGPRLSGRM; GVVYAITGPRLSGRMD; VVYAITGPRLSGRMDR; VYAITGPRLSGRMDRG; YAITGPRLSGRMDRGG; AITGPRLSGRMDRGGS; ITGPRLSGRMDRGGSA; TGPRLSGRMDRGGSAA; GPRLSGRMDRGGSAAG; PRLSGRMDRGGSAAGA; RLSGRMDRGGSAAGAS; LSGRMDRGGSAAGASR; SGRMDRGGSAAGASRQ; GRMDRGGSAAGASRQR; RMDRGGSAAGASRQRR; MDRGGSAAGASRQRRT; DRGGSAAGASRQRRTK; RGGSAAGASRQRRTKG; GGSAAGASRQRRTKGA; GSAAGASRQRRTKGAG; SAAGASRQRRTKGAGG; AAGASRQRRTKGAGGS; AGASRQRRTKGAGGSF; GASRQRRTKGAGGSFT; ASRQRRTKGAGGSFTS; SRQRRTKGAGGSFTSR; RQRRTKGAGGSFTSRM; QRRTKGAGGSFTSRME; RRTKGAGGSFTSRMED; RTKGAGGSFTSRMEDR; TKGAGGSFTSRMEDRF; KGAGGSFTSRMEDRFR; GAGGSFTSRMEDRFRR; AGGSFTSRMEDRFRRR; GGSFTSRMEDRFRRRF; GSFTSRMEDRFRRRFD; SFTSRMEDRFRRRFDE | |
| 34) Rv2270 | 13 mers: MRLPGRHVLYALS; RLPGRHVLYALSA; LPGRHVLYALSAV; PGRHVLYALSAVT; GRHVLYALSAVTM; RHVLYALSAVTML; HVLYALSAVTMLA; VLYALSAVTMLAA; LYALSAVTMLAAC; YALSAVTMLAACS; ALSAVTMLAACSS; LSAVTMLAACSSN; SAVTMLAACSSNG; AVTMLAACSSNGA; VTMLAACSSNGAR; TMLAACSSNGARG; MLAACSSNGARGG; LAACSSNGARGGI; AACSSNGARGGIA; ACSSNGARGGIAS; CSSNGARGGIAST; SSNGARGGIASTN; SNGARGGIASTNM; NGARGGIASTNMN; GARGGIASTNMNP; ARGGIASTNMNPT; RGGIASTNMNPTN; GGIASTNMNPTNP; GIASTNMNPTNPP; IASTNMNPTNPPA; ASTNMNPTNPPAT; STNMNPTNPPATA; TNMNPTNPPATAE; NMNPTNPPATAET; MNPTNPPATAETA; NPTNPPATAETAT; PTNPPATAETATV; TNPPATAETATVS; NPPATAETATVSP; PPATAETATVSPT; PATAETATVSPTP; ATAETATVSPTPA; TAETATVSPTPAP; AETATVSPTPAPQ; ETATVSPTPAPQS; TATVSPTPAPQSA; ATVSPTPAPQSAR; TVSPTPAPQSART; VSPTPAPQSARTE; SPTPAPQSARTET; PTPAPQSARTETW; TPAPQSARTETWI; PAPQSARTETWIN; APQSARTETWINL; PQSARTETWINLQ; QSARTETWINLQV; SARTETWINLQVG; ARTETWINLQVGD; RTETWINLQVGDC; TETWINLQVGDCL; ETWINLQVGDCLA; TWINLQVGDCLAD; WINLQVGDCLADL; INLQVGDCLADLP; NLQVGDCLADLPP; LQVGDCLADLPPA; QVGDCLADLPPAD; VGDCLADLPPADL; GDCLADLPPADLS; DCLADLPPADLSR; CLADLPPADLSRI; LADLPPADLSRIT; ADLPPADLSRITV; DLPPADLSRITVT; LPPADLSRITVTI; PPADLSRITVTIV; PADLSRITVTIVD; ADLSRITVTIVDC; DLSRITVTIVDCA; LSRITVTIVDCAT; SRITVTIVDCATA; RITVTIVDCATAH; ITVTIVDCATAHS; TVTIVDCATAHSA; VTIVDCATAHSAE; TIVDCATAHSAEV; IVDCATAHSAEVY; VDCATAHSAEVYL; DCATAHSAEVYLR; CATAHSAEVYLRA; ATAHSAEVYLRAP; TAHSAEVYLRAPV; AHSAEVYLRAPVA; HSAEVYLRAPVAV; SAEVYLRAPVAVD; AEVYLRAPVAVDA; EVYLRAPVAVDAA; VYLRAPVAVDAAV; YLRAPVAVDAAVV; LRAPVAVDAAVVS; RAPVAVDAAVVSM; APVAVDAAVVSMA; PVAVDAAVVSMAN; VAVDAAVVSMANR; AVDAAVVSMANRD; VDAAVVSMANRDC; DAAVVSMANRDCA; AAVVSMANRDCAA; AVVSMANRDCAAG; VVSMANRDCAAGF; VSMANRDCAAGFA; SMANRDCAAGFAP; MANRDCAAGFAPY; ANRDCAAGFAPYT; NRDCAAGFAPYTG; RDCAAGFAPYTGQ; DCAAGFAPYTGQS; CAAGFAPYTGQSV; AAGFAPYTGQSVD; AGFAPYTGQSVDT; GFAPYTGQSVDTS; FAPYTGQSVDTSP; APYTGQSVDTSPY; | 86616-87261 |

Fig. 29 continued

PYTGQSVDTSPYS; YTGQSVDTSPYSV; TGQSVDTSPYSVA; GQSVDTSPYSVAY;
QSVDTSPYSVAYL; SVDTSPYSVAYLI; VDTSPYSVAYLID; DTSPYSVAYLIDS;
TSPYSVAYLIDSH; SPYSVAYLIDSHQ; PYSVAYLIDSHQD; YSVAYLIDSHQDR;
SVAYLIDSHQDRT; VAYLIDSHQDRTG; AYLIDSHQDRTGA; YLIDSHQDRTGAD;
LIDSHQDRTGADP; IDSHQDRTGADPT; DSHQDRTGADPTP; SHQDRTGADPTPS;
HQDRTGADPTPST; QDRTGADPTPSTV; DRTGADPTPSTVI; RTGADPTPSTVIC;
TGADPTPSTVICL; GADPTPSTVICLL; ADPTPSTVICLLQ; DPTPSTVICLLQP;
PTPSTVICLLQPA; TPSTVICLLQPAN; PSTVICLLQPANG; STVICLLQPANGQ;
TVICLLQPANGQL; VICLLQPANGQLL; ICLLQPANGQLLT; CLLQPANGQLLTG;
LLQPANGQLLTGS; LQPANGQLLTGSA; QPANGQLLTGSAR; PANGQLLTGSARR 14 mers:
MRLPGRHVLYALSA; RLPGRHVLYALSAV; LPGRHVLYALSAVT;
PGRHVLYALSAVTM; GRHVLYALSAVTML; RHVLYALSAVTMLA;
HVLYALSAVTMLAA; VLYALSAVTMLAAC; LYALSAVTMLAACS;
YALSAVTMLAACSS; ALSAVTMLAACSSN; LSAVTMLAACSSNG;
SAVTMLAACSSNGA; AVTMLAACSSNGAR; VTMLAACSSNGARG;
TMLAACSSNGARGG; MLAACSSNGARGGI; LAACSSNGARGGIA;
AACSSNGARGGIAS; ACSSNGARGGIAST; CSSNGARGGIASTN;
SSNGARGGIASTNM; SNGARGGIASTNMN; NGARGGIASTNMNP;
GARGGIASTNMNPT; ARGGIASTNMNPTN; RGGIASTNMNPTNP;
GGIASTNMNPTNPP; GIASTNMNPTNPPA; IASTNMNPTNPPAT;
ASTNMNPTNPPATA; STNMNPTNPPATAE; TNMNPTNPPATAET;
NMNPTNPPATAETA; MNPTNPPATAETAT; NPTNPPATAETATV;
PTNPPATAETATVS; TNPPATAETATVSP; NPPATAETATVSPT;
PPATAETATVSPTP; PATAETATVSPTPA; ATAETATVSPTPAP;
TAETATVSPTPAPQ; AETATVSPTPAPQS; ETATVSPTPAPQSA;
TATVSPTPAPQSAR; ATVSPTPAPQSART; TVSPTPAPQSARTE;
VSPTPAPQSARTET; SPTPAPQSARTETW; PTPAPQSARTETWI;
TPAPQSARTETWIN; PAPQSARTETWINL; APQSARTETWINLQ;
PQSARTETWINLQV; QSARTETWINLQVG; SARTETWINLQVGD;
ARTETWINLQVGDC; RTETWINLQVGDCL; TETWINLQVGDCLA;
ETWINLQVGDCLAD; TWINLQVGDCLADL; WINLQVGDCLADLP;
INLQVGDCLADLPP; NLQVGDCLADLPPA; LQVGDCLADLPPAD;
QVGDCLADLPPADL; VGDCLADLPPADLS; GDCLADLPPADLSR;
DCLADLPPADLSRI; CLADLPPADLSRIT; LADLPPADLSRITV; ADLPPADLSRITVT;
DLPPADLSRITVTI; LPPADLSRITVTIV; PPADLSRITVTIVD; PADLSRITVTIVDC;
ADLSRITVTIVDCA; DLSRITVTIVDCAT; LSRITVTIVDCATA; SRITVTIVDCATAH;
RITVTIVDCATAHS; ITVTIVDCATAHSA; TVTIVDCATAHSAE; VTIVDCATAHSAEV;
TIVDCATAHSAEVY; IVDCATAHSAEVYL; VDCATAHSAEVYLR;
DCATAHSAEVYLRA; CATAHSAEVYLRAP; ATAHSAEVYLRAPV;
TAHSAEVYLRAPVA; AHSAEVYLRAPVAV; HSAEVYLRAPVAVD;
SAEVYLRAPVAVDA; AEVYLRAPVAVDAA; EVYLRAPVAVDAAV;
VYLRAPVAVDAAVV; YLRAPVAVDAAVVS; LRAPVAVDAAVVSM;
RAPVAVDAAVVSMA; APVAVDAAVVSMAN; PVAVDAAVVSMANR;
VAVDAAVVSMANRD; AVDAAVVSMANRDC; VDAAVVSMANRDCA;
DAAVVSMANRDCAA; AAVVSMANRDCAAG; AVVSMANRDCAAGF;
VVSMANRDCAAGFA; VSMANRDCAAGFAP; SMANRDCAAGFAPY;
MANRDCAAGFAPYT; ANRDCAAGFAPYTG; NRDCAAGFAPYTGQ;
RDCAAGFAPYTGQS; DCAAGFAPYTGQSV; CAAGFAPYTGQSVD;
AAGFAPYTGQSVDT; AGFAPYTGQSVDTS; GFAPYTGQSVDTSP;
FAPYTGQSVDTSPY; APYTGQSVDTSPYS; PYTGQSVDTSPYSV;
YTGQSVDTSPYSVA; TGQSVDTSPYSVAY; GQSVDTSPYSVAYL;

Fig. 29 continued

| | | | |
|---|---|---|---|
| | QSVDTSPYSVAYLI; SVDTSPYSVAYLID; VDTSPYSVAYLIDS; DTSPYSVAYLIDSH; TSPYSVAYLIDSHQ; SPYSVAYLIDSHQD; PYSVAYLIDSHQDR; YSVAYLIDSHQDRT; SVAYLIDSHQDRTG; VAYLIDSHQDRTGA; AYLIDSHQDRTGAD; YLIDSHQDRTGADP; LIDSHQDRTGADPT; IDSHQDRTGADPTP; DSHQDRTGADPTPS; SHQDRTGADPTPST; HQDRTGADPTPSTV; QDRTGADPTPSTVI; DRTGADPTPSTVIC; RTGADPTPSTVICL; TGADPTPSTVICLL; GADPTPSTVICLLQ; ADPTPSTVICLLQP; DPTPSTVICLLQPA; PTPSTVICLLQPAN; TPSTVICLLQPANG; PSTVICLLQPANGQ; STVICLLQPANGQL; TVICLLQPANGQLL; VICLLQPANGQLLT; ICLLQPANGQLLTG; CLLQPANGQLLTGS; LLQPANGQLLTGSA; LQPANGQLLTGSAR; QPANGQLLTGSARR<br><br>15 mers:<br>MRLPGRHVLYALSAV; RLPGRHVLYALSAVT; LPGRHVLYALSAVTM; PGRHVLYALSAVTML; GRHVLYALSAVTMLA; RHVLYALSAVTMLAA; HVLYALSAVTMLAAC; VLYALSAVTMLAACS; LYALSAVTMLAACSS; YALSAVTMLAACSSN; ALSAVTMLAACSSNG; LSAVTMLAACSSNGA; SAVTMLAACSSNGAR; AVTMLAACSSNGARG; VTMLAACSSNGARGG; TMLAACSSNGARGGI; MLAACSSNGARGGIA; LAACSSNGARGGIAS; AACSSNGARGGIAST; ACSSNGARGGIASTN; CSSNGARGGIASTNM; SSNGARGGIASTNMN; SNGARGGIASTNMNP; NGARGGIASTNMNPT; GARGGIASTNMNPTN; ARGGIASTNMNPTNP; RGGIASTNMNPTNPP; GGIASTNMNPTNPPA; GIASTNMNPTNPPAT; IASTNMNPTNPPATA; ASTNMNPTNPPATAE; STNMNPTNPPATAET; TNMNPTNPPATAETA; NMNPTNPPATAETAT; MNPTNPPATAETATV; NPTNPPATAETATVS; PTNPPATAETATVSP; TNPPATAETATVSPT; NPPATAETATVSPTP; PPATAETATVSPTPA; PATAETATVSPTPAP; ATAETATVSPTPAPQ; TAETATVSPTPAPQS; AETATVSPTPAPQSA; ETATVSPTPAPQSAR; TATVSPTPAPQSART; ATVSPTPAPQSARTE; TVSPTPAPQSARTET; VSPTPAPQSARTETW; SPTPAPQSARTETWI; PTPAPQSARTETWIN; TPAPQSARTETWINL; PAPQSARTETWINLQ; APQSARTETWINLQV; PQSARTETWINLQVG; QSARTETWINLQVGD; SARTETWINLQVGDC; ARTETWINLQVGDCL; RTETWINLQVGDCLA; TETWINLQVGDCLAD; ETWINLQVGDCLADL; TWINLQVGDCLADLP; WINLQVGDCLADLPP; INLQVGDCLADLPPA; NLQVGDCLADLPPAD; LQVGDCLADLPPADL; QVGDCLADLPPADLS; VGDCLADLPPADLSR; GDCLADLPPADLSRI; DCLADLPPADLSRIT; CLADLPPADLSRITV; LADLPPADLSRITVT; ADLPPADLSRITVTI; DLPPADLSRITVTIV; LPPADLSRITVTIVD; PPADLSRITVTIVDC; PADLSRITVTIVDCA; ADLSRITVTIVDCAT; DLSRITVTIVDCATA; LSRITVTIVDCATAH; SRITVTIVDCATAHS; RITVTIVDCATAHSA; ITVTIVDCATAHSAE; TVTIVDCATAHSAEV; VTIVDCATAHSAEVY; TIVDCATAHSAEVYL; IVDCATAHSAEVYLR; VDCATAHSAEVYLRA; DCATAHSAEVYLRAP; CATAHSAEVYLRAPV; ATAHSAEVYLRAPVA; TAHSAEVYLRAPVAV; AHSAEVYLRAPVAVD; HSAEVYLRAPVAVDA; SAEVYLRAPVAVDAA; AEVYLRAPVAVDAAV; EVYLRAPVAVDAAVV; VYLRAPVAVDAAVVS; YLRAPVAVDAAVVSM; LRAPVAVDAAVVSMA; RAPVAVDAAVVSMAN; APVAVDAAVVSMANR; PVAVDAAVVSMANRD; VAVDAAVVSMANRDC; AVDAAVVSMANRDCA; VDAAVVSMANRDCAA; DAAVVSMANRDCAAG; AAVVSMANRDCAAGF; AVVSMANRDCAAGFA; VVSMANRDCAAGFAP; VSMANRDCAAGFAPY; SMANRDCAAGFAPYT; MANRDCAAGFAPYTG; ANRDCAAGFAPYTGQ; NRDCAAGFAPYTGQS; RDCAAGFAPYTGQSV; DCAAGFAPYTGQSVD; | |

Fig. 29 continued

| | | | |
|---|---|---|---|
| | CAAGFAPYTGQSVDT; AAGFAPYTGQSVDTS; AGFAPYTGQSVDTSP; GFAPYTGQSVDTSPY; FAPYTGQSVDTSPYS; APYTGQSVDTSPYSV; PYTGQSVDTSPYSVA; YTGQSVDTSPYSVAY; TGQSVDTSPYSVAYL; GQSVDTSPYSVAYLI; QSVDTSPYSVAYLID; SVDTSPYSVAYLIDS; VDTSPYSVAYLIDSH; DTSPYSVAYLIDSHQ; TSPYSVAYLIDSHQD; SPYSVAYLIDSHQDR; PYSVAYLIDSHQDRT; YSVAYLIDSHQDRTG; SVAYLIDSHQDRTGA; VAYLIDSHQDRTGAD; AYLIDSHQDRTGADP; YLIDSHQDRTGADPT; LIDSHQDRTGADPTP; IDSHQDRTGADPTPS; DSHQDRTGADPTPST; SHQDRTGADPTPSTV; HQDRTGADPTPSTVI; QDRTGADPTPSTVIC; DRTGADPTPSTVICL; RTGADPTPSTVICLL; TGADPTPSTVICLLQ; GADPTPSTVICLLQP; ADPTPSTVICLLQPA; DPTPSTVICLLQPAN; PTPSTVICLLQPANG; TPSTVICLLQPANGQ; PSTVICLLQPANGQL; STVICLLQPANGQLL; TVICLLQPANGQLLT; VICLLQPANGQLLTG; ICLLQPANGQLLTGS; CLLQPANGQLLTGSA; LLQPANGQLLTGSAR; LQPANGQLLTGSARR<br><br>16 mers:<br>MRLPGRHVLYALSAVT; RLPGRHVLYALSAVTM; LPGRHVLYALSAVTML; PGRHVLYALSAVTMLA; GRHVLYALSAVTMLAA; RHVLYALSAVTMLAAC; HVLYALSAVTMLAACS; VLYALSAVTMLAACSS; LYALSAVTMLAACSSN; YALSAVTMLAACSSNG; ALSAVTMLAACSSNGA; LSAVTMLAACSSNGAR; SAVTMLAACSSNGARG; AVTMLAACSSNGARGG; VTMLAACSSNGARGGI; TMLAACSSNGARGGIA; MLAACSSNGARGGIAS; LAACSSNGARGGIAST; AACSSNGARGGIASTN; ACSSNGARGGIASTNM; CSSNGARGGIASTNMN; SSNGARGGIASTNMNP; SNGARGGIASTNMNPT; NGARGGIASTNMNPTN; GARGGIASTNMNPTNP; ARGGIASTNMNPTNPP; RGGIASTNMNPTNPPA; GGIASTNMNPTNPPAT; GIASTNMNPTNPPATA; IASTNMNPTNPPATAE; ASTNMNPTNPPATAET; STNMNPTNPPATAETA; TNMNPTNPPATAETAT; NMNPTNPPATAETATV; MNPTNPPATAETATVS; NPTNPPATAETATVSP; PTNPPATAETATVSPT; TNPPATAETATVSPTP; NPPATAETATVSPTPA; PPATAETATVSPTPAP; PATAETATVSPTPAPQ; ATAETATVSPTPAPQS; TAETATVSPTPAPQSA; AETATVSPTPAPQSAR; ETATVSPTPAPQSART; TATVSPTPAPQSARTE; ATVSPTPAPQSARTET; TVSPTPAPQSARTETW; VSPTPAPQSARTETWI; SPTPAPQSARTETWIN; PTPAPQSARTETWINL; TPAPQSARTETWINLQ; PAPQSARTETWINLQV; APQSARTETWINLQVG; PQSARTETWINLQVGD; QSARTETWINLQVGDC; SARTETWINLQVGDCL; ARTETWINLQVGDCLA; RTETWINLQVGDCLAD; TETWINLQVGDCLADL; ETWINLQVGDCLADLP; TWINLQVGDCLADLPP; WINLQVGDCLADLPPA; INLQVGDCLADLPPAD; NLQVGDCLADLPPADL; LQVGDCLADLPPADLS; QVGDCLADLPPADLSR; VGDCLADLPPADLSRI; GDCLADLPPADLSRIT; DCLADLPPADLSRITV; CLADLPPADLSRITVT; LADLPPADLSRITVTI; ADLPPADLSRITVTIV; DLPPADLSRITVTIVD; LPPADLSRITVTIVDC; PPADLSRITVTIVDCA; PADLSRITVTIVDCAT; ADLSRITVTIVDCATA; DLSRITVTIVDCATAH; LSRITVTIVDCATAHS; SRITVTIVDCATAHSA; RITVTIVDCATAHSAE; ITVTIVDCATAHSAEV; TVTIVDCATAHSAEVY; VTIVDCATAHSAEVYL; TIVDCATAHSAEVYLR; IVDCATAHSAEVYLRA; VDCATAHSAEVYLRAP; DCATAHSAEVYLRAPV; CATAHSAEVYLRAPVA; ATAHSAEVYLRAPVAV; TAHSAEVYLRAPVAVD; AHSAEVYLRAPVAVDA; HSAEVYLRAPVAVDAA; SAEVYLRAPVAVDAAV; AEVYLRAPVAVDAAVV; EVYLRAPVAVDAAVVS; VYLRAPVAVDAAVVSM; YLRAPVAVDAAVVSMA; LRAPVAVDAAVVSMAN; RAPVAVDAAVVSMANR; APVAVDAAVVSMANRD; PVAVDAAVVSMANRDC; VAVDAAVVSMANRDCA; AVDAAVVSMANRDCAA; VDAAVVSMANRDCAAG; DAAVVSMANRDCAAGF; AAVVSMANRDCAAGFA; | |

Fig. 29 continued

| | | |
|---|---|---|
| | AVVSMANRDCAAGFAP; VVSMANRDCAAGFAPY; VSMANRDCAAGFAPYT; SMANRDCAAGFAPYTG; MANRDCAAGFAPYTGQ; ANRDCAAGFAPYTGQS; NRDCAAGFAPYTGQSV; RDCAAGFAPYTGQSVD; DCAAGFAPYTGQSVDT; CAAGFAPYTGQSVDTS; AAGFAPYTGQSVDTSP; AGFAPYTGQSVDTSPY; GFAPYTGQSVDTSPYS; FAPYTGQSVDTSPYSV; APYTGQSVDTSPYSVA; PYTGQSVDTSPYSVAY; YTGQSVDTSPYSVAYL; TGQSVDTSPYSVAYLI; GQSVDTSPYSVAYLID; QSVDTSPYSVAYLIDS; SVDTSPYSVAYLIDSH; VDTSPYSVAYLIDSHQ; DTSPYSVAYLIDSHQD; TSPYSVAYLIDSHQDR; SPYSVAYLIDSHQDRT; PYSVAYLIDSHQDRTG; YSVAYLIDSHQDRTGA; SVAYLIDSHQDRTGAD; VAYLIDSHQDRTGADP; AYLIDSHQDRTGADPT; YLIDSHQDRTGADPTP; LIDSHQDRTGADPTPS; IDSHQDRTGADPTPST; DSHQDRTGADPTPSTV; SHQDRTGADPTPSTVI; HQDRTGADPTPSTVIC; QDRTGADPTPSTVICL; DRTGADPTPSTVICLL; RTGADPTPSTVICLLQ; TGADPTPSTVICLLQP; GADPTPSTVICLLQPA; ADPTPSTVICLLQPAN; DPTPSTVICLLQPANG; PTPSTVICLLQPANGQ; TPSTVICLLQPANGQL; PSTVICLLQPANGQLL; STVICLLQPANGQLLT; TVICLLQPANGQLLTG; VICLLQPANGQLLTGS; ICLLQPANGQLLTGSA; CLLQPANGQLLTGSAR; LLQPANGQLLTGSARR | |
| 35) Rv2302 | 13 mers:<br>MHAKVGDYLVVKG; HAKVGDYLVVKGT; AKVGDYLVVKGTT; KVGDYLVVKGTTT; VGDYLVVKGTTTE; GDYLVVKGTTTER; DYLVVKGTTTERH; YLVVKGTTTERHD; LVVKGTTTERHDQ; VVKGTTTERHDQH; VKGTTTERHDQHA; KGTTTERHDQHAE; GTTTERHDQHAEI; TTTERHDQHAEII; TTERHDQHAEIIE; TERHDQHAEIIEV; ERHDQHAEIIEVR; RHDQHAEIIEVRS; HDQHAEIIEVRSA; DQHAEIIEVRSAD; QHAEIIEVRSADG; HAEIIEVRSADGS; AEIIEVRSADGSP; EIIEVRSADGSPP; IIEVRSADGSPPY; IEVRSADGSPPYV; EVRSADGSPPYVV; VRSADGSPPYVVR; RSADGSPPYVVRW; SADGSPPYVVRWL; ADGSPPYVVRWLV; DGSPPYVVRWLVN; GSPPYVVRWLVNG; SPPYVVRWLVNGH; PPYVVRWLVNGHE; PYVVRWLVNGHET; YVVRWLVNGHETT; VVRWLVNGHETTV; VRWLVNGHETTVY; RWLVNGHETTVYP; WLVNGHETTVYPG; LVNGHETTVYPGS; VNGHETTVYPGSD; NGHETTVYPGSDA; GHETTVYPGSDAV; HETTVYPGSDAVV; ETTVYPGSDAVVV; TTVYPGSDAVVVT; TVYPGSDAVVVTA; VYPGSDAVVVTAT; YPGSDAVVVTATE; PGSDAVVVTATEH; GSDAVVVTATEHA; SDAVVVTATEHAE; DAVVVTATEHAEA; AVVVTATEHAEAE; VVVTATEHAEAEK; VVTATEHAEAEKR; VTATEHAEAEKRA; TATEHAEAEKRAA; ATEHAEAEKRAAA; TEHAEAEKRAAAR; EHAEAEKRAAARA; HAEAEKRAAARAG; AEAEKRAAARAGH; EAEKRAAARAGHA; AEKRAAARAGHAA; EKRAAARAGHAAT; KRAAARAGHAAT<br>; RAAARAGHAAT<br><br>14 mers:<br>MHAKVGDYLVVKGT; HAKVGDYLVVKGTT; AKVGDYLVVKGTTT; KVGDYLVVKGTTTE; VGDYLVVKGTTTER; GDYLVVKGTTTERH; DYLVVKGTTTERHD; YLVVKGTTTERHDQ; LVVKGTTTERHDQH; VVKGTTTERHDQHA; VKGTTTERHDQHAE; KGTTTERHDQHAEI; GTTTERHDQHAEII; TTTERHDQHAEIIE; TTERHDQHAEIIEV; TERHDQHAEIIEVR; ERHDQHAEIIEVRS; RHDQHAEIIEVRSA; HDQHAEIIEVRSAD; DQHAEIIEVRSADG; QHAEIIEVRSADGS; HAEIIEVRSADGSP; AEIIEVRSADGSPP; EIIEVRSADGSPPY; IIEVRSADGSPPYV; IEVRSADGSPPYVV; EVRSADGSPPYVVR; VRSADGSPPYVVRW; RSADGSPPYVVRWL; SADGSPPYVVRWLV; ADGSPPYVVRWLVN; | 87262-87529 |

Fig. 29 continued

| | | | |
|---|---|---|---|
| | DGSPPYVVRWLVNG; GSPPYVVRWLVNGH; SPPYVVRWLVNGHE; PPYVVRWLVNGHET; PYVVRWLVNGHETT; YVVRWLVNGHETTV; VVRWLVNGHETTVY; VRWLVNGHETTVYP; RWLVNGHETTVYPG; WLVNGHETTVYPGS; LVNGHETTVYPGSD; VNGHETTVYPGSDA; NGHETTVYPGSDAV; GHETTVYPGSDAVV; HETTVYPGSDAVVV; ETTVYPGSDAVVVT; TTVYPGSDAVVVTA; TVYPGSDAVVVTAT; VYPGSDAVVVTATE; YPGSDAVVVTATEH; PGSDAVVVTATEHA; GSDAVVVTATEHAE; SDAVVVTATEHAEA; DAVVVTATEHAEAE; AVVVTATEHAEAEK; VVVTATEHAEAEKR; VVTATEHAEAEKRA; VTATEHAEAEKRAA; TATEHAEAEKRAAA; ATEHAEAEKRAAAR; TEHAEAEKRAAARA; EHAEAEKRAAARAG; HAEAEKRAAARAGH; AEAEKRAAARAGHA; EAEKRAAARAGHAA; AEKRAAARAGHAAT<br><br>15 mers:<br>MHAKVGDYLVVKGTT; HAKVGDYLVVKGTTT; AKVGDYLVVKGTTTE; KVGDYLVVKGTTTER; VGDYLVVKGTTTERH; GDYLVVKGTTTERHD; DYLVVKGTTTERHDQ; YLVVKGTTTERHDQH; LVVKGTTTERHDQHA; VVKGTTTERHDQHAE; VKGTTTERHDQHAEI; KGTTTERHDQHAEII; GTTTERHDQHAEIIE; TTTERHDQHAEIIEV; TTERHDQHAEIIEVR; TERHDQHAEIIEVRS; ERHDQHAEIIEVRSA; RHDQHAEIIEVRSAD; HDQHAEIIEVRSADG; DQHAEIIEVRSADGS; QHAEIIEVRSADGSP; HAEIIEVRSADGSPP; AEIIEVRSADGSPPY; EIIEVRSADGSPPYV; IIEVRSADGSPPYVV; IEVRSADGSPPYVVR; EVRSADGSPPYVVRW; VRSADGSPPYVVRWL; RSADGSPPYVVRWLV; SADGSPPYVVRWLVN; ADGSPPYVVRWLVNG; DGSPPYVVRWLVNGH; GSPPYVVRWLVNGHE; SPPYVVRWLVNGHET; PPYVVRWLVNGHETT; PYVVRWLVNGHETTV; YVVRWLVNGHETTVY; VVRWLVNGHETTVYP; VRWLVNGHETTVYPG; RWLVNGHETTVYPGS; WLVNGHETTVYPGSD; LVNGHETTVYPGSDA; VNGHETTVYPGSDAV; NGHETTVYPGSDAVV; GHETTVYPGSDAVVV; HETTVYPGSDAVVVT; ETTVYPGSDAVVVTA; TTVYPGSDAVVVTAT; TVYPGSDAVVVTATE; VYPGSDAVVVTATEH; YPGSDAVVVTATEHA; PGSDAVVVTATEHAE; GSDAVVVTATEHAEA; SDAVVVTATEHAEAE; DAVVVTATEHAEAEK; AVVVTATEHAEAEKR; VVVTATEHAEAEKRA; VVTATEHAEAEKRAA; VTATEHAEAEKRAAA; TATEHAEAEKRAAAR; ATEHAEAEKRAAARA; TEHAEAEKRAAARAG; EHAEAEKRAAARAGH; HAEAEKRAAARAGHA; AEAEKRAAARAGHAA; EAEKRAAARAGHAAT<br><br>16 mers:<br>MHAKVGDYLVVKGTTT; HAKVGDYLVVKGTTTE; AKVGDYLVVKGTTTER; KVGDYLVVKGTTTERH; VGDYLVVKGTTTERHD; GDYLVVKGTTTERHDQ; DYLVVKGTTTERHDQH; YLVVKGTTTERHDQHA; LVVKGTTTERHDQHAE; VVKGTTTERHDQHAEI; VKGTTTERHDQHAEII; KGTTTERHDQHAEIIE; GTTTERHDQHAEIIEV; TTTERHDQHAEIIEVR; TTERHDQHAEIIEVRS; TERHDQHAEIIEVRSA; ERHDQHAEIIEVRSAD; RHDQHAEIIEVRSADG; HDQHAEIIEVRSADGS; DQHAEIIEVRSADGSP; QHAEIIEVRSADGSPP; HAEIIEVRSADGSPPY; AEIIEVRSADGSPPYV; EIIEVRSADGSPPYVV; IIEVRSADGSPPYVVR; IEVRSADGSPPYVVRW; EVRSADGSPPYVVRWL; VRSADGSPPYVVRWLV; RSADGSPPYVVRWLVN; SADGSPPYVVRWLVNG; ADGSPPYVVRWLVNGH; DGSPPYVVRWLVNGHE; GSPPYVVRWLVNGHET; SPPYVVRWLVNGHETT; PPYVVRWLVNGHETTV; PYVVRWLVNGHETTVY; YVVRWLVNGHETTVYP; VVRWLVNGHETTVYPG; VRWLVNGHETTVYPGS; RWLVNGHETTVYPGSD; WLVNGHETTVYPGSDA; LVNGHETTVYPGSDAV; VNGHETTVYPGSDAVV; NGHETTVYPGSDAVVV; GHETTVYPGSDAVVVT; | |

Fig. 29 continued

| | | |
|---|---|---|
| | HETTVYPGSDAVVVTA; ETTVYPGSDAVVVTAT; TTVYPGSDAVVVTATE; TVYPGSDAVVVTATEH; VYPGSDAVVVTATEHA; YPGSDAVVVTATEHAE; PGSDAVVVTATEHAEA; GSDAVVVTATEHAEAE; SDAVVVTATEHAEAEK; DAVVVTATEHAEAEKR; AVVVTATEHAEAEKRA; VVVTATEHAEAEKRAA; VVTATEHAEAEKRAAA; VTATEHAEAEKRAAAR; TATEHAEAEKRAAARA; ATEHAEAEKRAAARAG; TEHAEAEKRAAARAGH; EHAEAEKRAAARAGHA; HAEAEKRAAARAGHAA; AEAEKRAAARAGHAAT | |
| 36) Rv2346c | 13 mers:<br>MTINYQFGDVDAH; TINYQFGDVDAHG; INYQFGDVDAHGA; NYQFGDVDAHGAM; YQFGDVDAHGAMI; QFGDVDAHGAMIR; FGDVDAHGAMIRA; GDVDAHGAMIRAQ; DVDAHGAMIRAQA; VDAHGAMIRAQAG; DAHGAMIRAQAGL; AHGAMIRAQAGLL; HGAMIRAQAGLLE; GAMIRAQAGLLEA; AMIRAQAGLLEAE; MIRAQAGLLEAEH; IRAQAGLLEAEHQ; RAQAGLLEAEHQA; AQAGLLEAEHQAI; QAGLLEAEHQAIV; AGLLEAEHQAIVR; GLLEAEHQAIVRD; LLEAEHQAIVRDV; LEAEHQAIVRDVL; EAEHQAIVRDVLA; AEHQAIVRDVLAA; EHQAIVRDVLAAG; HQAIVRDVLAAGD; QAIVRDVLAAGDF; AIVRDVLAAGDFW; IVRDVLAAGDFWG; VRDVLAAGDFWGG; RDVLAAGDFWGGA; DVLAAGDFWGGAG; VLAAGDFWGGAGS; LAAGDFWGGAGSV; AAGDFWGGAGSVA; AGDFWGGAGSVAC; GDFWGGAGSVACQ; DFWGGAGSVACQE; FWGGAGSVACQEF; WGGAGSVACQEFI; GGAGSVACQEFIT; GAGSVACQEFITQ; AGSVACQEFITQL; GSVACQEFITQLG; SVACQEFITQLGR; VACQEFITQLGRN; ACQEFITQLGRNF; CQEFITQLGRNFQ; QEFITQLGRNFQV; EFITQLGRNFQVI; FITQLGRNFQVIY; ITQLGRNFQVIYE; TQLGRNFQVIYEQ; QLGRNFQVIYEQA; LGRNFQVIYEQAN; GRNFQVIYEQANA; RNFQVIYEQANAH; NFQVIYEQANAHG; FQVIYEQANAHGQ; QVIYEQANAHGQK; VIYEQANAHGQKV; IYEQANAHGQKVQ; YEQANAHGQKVQA; EQANAHGQKVQAA; QANAHGQKVQAAG; ANAHGQKVQAAGN; NAHGQKVQAAGNN; AHGQKVQAAGNNM; HGQKVQAAGNNMA; GQKVQAAGNNMAQ; QKVQAAGNNMAQT; KVQAAGNNMAQTD; VQAAGNNMAQTDS; QAAGNNMAQTDSA; AAGNNMAQTDSAV; AGNNMAQTDSAVG; GNNMAQTDSAVGS; NNMAQTDSAVGSS; NMAQTDSAVGSSW; MAQTDSAVGSSWA;<br><br>14 mers:<br>MTINYQFGDVDAHG; TINYQFGDVDAHGA; INYQFGDVDAHGAM; NYQFGDVDAHGAMI; YQFGDVDAHGAMIR; QFGDVDAHGAMIRA; FGDVDAHGAMIRAQ; GDVDAHGAMIRAQA; DVDAHGAMIRAQAG; VDAHGAMIRAQAGL; DAHGAMIRAQAGLL; AHGAMIRAQAGLLE; HGAMIRAQAGLLEA; GAMIRAQAGLLEAE; AMIRAQAGLLEAEH; MIRAQAGLLEAEHQ; IRAQAGLLEAEHQA; RAQAGLLEAEHQAI; AQAGLLEAEHQAIV; QAGLLEAEHQAIVR; AGLLEAEHQAIVRD; GLLEAEHQAIVRDV; LLEAEHQAIVRDVL; LEAEHQAIVRDVLA; EAEHQAIVRDVLAA; AEHQAIVRDVLAAG; EHQAIVRDVLAAGD; HQAIVRDVLAAGDF; QAIVRDVLAAGDFW; AIVRDVLAAGDFWG; IVRDVLAAGDFWGG; VRDVLAAGDFWGGA; RDVLAAGDFWGGAG; DVLAAGDFWGGAGS; VLAAGDFWGGAGSV; LAAGDFWGGAGSVA; AAGDFWGGAGSVAC; AGDFWGGAGSVACQ; GDFWGGAGSVACQE; DFWGGAGSVACQEF; FWGGAGSVACQEFI; WGGAGSVACQEFIT; GGAGSVACQEFITQ; GAGSVACQEFITQL; AGSVACQEFITQLG; GSVACQEFITQLGR; SVACQEFITQLGRN; VACQEFITQLGRNF; ACQEFITQLGRNFQ; CQEFITQLGRNFQV; QEFITQLGRNFQVI; EFITQLGRNFQVIY; FITQLGRNFQVIYE; ITQLGRNFQVIYEQ; TQLGRNFQVIYEQA; QLGRNFQVIYEQAN; LGRNFQVIYEQANA; | 87530-87851 |

Fig. 29 continued

GRNFQVIYEQANAH; RNFQVIYEQANAHG; NFQVIYEQANAHGQ; FQVIYEQANAHGQK; QVIYEQANAHGQKV; VIYEQANAHGQKVQ; IYEQANAHGQKVQA; YEQANAHGQKVQAA; EQANAHGQKVQAAG; QANAHGQKVQAAGN; ANAHGQKVQAAGNN; NAHGQKVQAAGNNM; AHGQKVQAAGNNMA; HGQKVQAAGNNMAQ; GQKVQAAGNNMAQT; QKVQAAGNNMAQTD; KVQAAGNNMAQTDS; VQAAGNNMAQTDSA; QAAGNNMAQTDSAV; AAGNNMAQTDSAVG; AGNNMAQTDSAVGS; GNNMAQTDSAVGSS; NNMAQTDSAVGSSW; NMAQTDSAVGSSWA;

15 mers:
MTINYQFGDVDAHGA; TINYQFGDVDAHGAM; INYQFGDVDAHGAMI; NYQFGDVDAHGAMIR; YQFGDVDAHGAMIRA; QFGDVDAHGAMIRAQ; FGDVDAHGAMIRAQA; GDVDAHGAMIRAQAG; DVDAHGAMIRAQAGL; VDAHGAMIRAQAGLL; DAHGAMIRAQAGLLE; AHGAMIRAQAGLLEA; HGAMIRAQAGLLEAE; GAMIRAQAGLLEAEH; AMIRAQAGLLEAEHQ; MIRAQAGLLEAEHQA; IRAQAGLLEAEHQAI; RAQAGLLEAEHQAIV; AQAGLLEAEHQAIVR; QAGLLEAEHQAIVRD; AGLLEAEHQAIVRDV; GLLEAEHQAIVRDVL; LLEAEHQAIVRDVLA; LEAEHQAIVRDVLAA; EAEHQAIVRDVLAAG; AEHQAIVRDVLAAGD; EHQAIVRDVLAAGDF; HQAIVRDVLAAGDFW; QAIVRDVLAAGDFWG; AIVRDVLAAGDFWGG; IVRDVLAAGDFWGGA; VRDVLAAGDFWGGAG; RDVLAAGDFWGGAGS; DVLAAGDFWGGAGSV; VLAAGDFWGGAGSVA; LAAGDFWGGAGSVAC; AAGDFWGGAGSVACQ; AGDFWGGAGSVACQE; GDFWGGAGSVACQEF; DFWGGAGSVACQEFI; FWGGAGSVACQEFIT; WGGAGSVACQEFITQ; GGAGSVACQEFITQL; GAGSVACQEFITQLG; AGSVACQEFITQLGR; GSVACQEFITQLGRN; SVACQEFITQLGRNF; VACQEFITQLGRNFQ; ACQEFITQLGRNFQV; CQEFITQLGRNFQVI; QEFITQLGRNFQVIY; EFITQLGRNFQVIYE; FITQLGRNFQVIYEQ; ITQLGRNFQVIYEQA; TQLGRNFQVIYEQAN; QLGRNFQVIYEQANA; LGRNFQVIYEQANAH; GRNFQVIYEQANAHG; RNFQVIYEQANAHGQ; NFQVIYEQANAHGQK; FQVIYEQANAHGQKV; QVIYEQANAHGQKVQ; VIYEQANAHGQKVQA; IYEQANAHGQKVQAA; YEQANAHGQKVQAAG; EQANAHGQKVQAAGN; QANAHGQKVQAAGNN; ANAHGQKVQAAGNNM; NAHGQKVQAAGNNMA; AHGQKVQAAGNNMAQ; HGQKVQAAGNNMAQT; GQKVQAAGNNMAQTD; QKVQAAGNNMAQTDS; KVQAAGNNMAQTDSA; VQAAGNNMAQTDSAV; QAAGNNMAQTDSAVG; AAGNNMAQTDSAVGS; AGNNMAQTDSAVGSS; GNNMAQTDSAVGSSW; NNMAQTDSAVGSSWA;

16 mers:
MTINYQFGDVDAHGAM; TINYQFGDVDAHGAMI; INYQFGDVDAHGAMIR; NYQFGDVDAHGAMIRA; YQFGDVDAHGAMIRAQ; QFGDVDAHGAMIRAQA; FGDVDAHGAMIRAQAG; GDVDAHGAMIRAQAGL; DVDAHGAMIRAQAGLL; VDAHGAMIRAQAGLLE; DAHGAMIRAQAGLLEA; AHGAMIRAQAGLLEAE; HGAMIRAQAGLLEAEH; GAMIRAQAGLLEAEHQ; AMIRAQAGLLEAEHQA; MIRAQAGLLEAEHQAI; IRAQAGLLEAEHQAIV; RAQAGLLEAEHQAIVR; AQAGLLEAEHQAIVRD; QAGLLEAEHQAIVRDV; AGLLEAEHQAIVRDVL; GLLEAEHQAIVRDVLA; LLEAEHQAIVRDVLAA; LEAEHQAIVRDVLAAG; EAEHQAIVRDVLAAGD; AEHQAIVRDVLAAGDF; EHQAIVRDVLAAGDFW; HQAIVRDVLAAGDFWG; QAIVRDVLAAGDFWGG; AIVRDVLAAGDFWGGA; IVRDVLAAGDFWGGAG; VRDVLAAGDFWGGAGS; RDVLAAGDFWGGAGSV; DVLAAGDFWGGAGSVA; VLAAGDFWGGAGSVAC; LAAGDFWGGAGSVACQ; AAGDFWGGAGSVACQE; AGDFWGGAGSVACQEF; GDFWGGAGSVACQEFI; DFWGGAGSVACQEFIT; FWGGAGSVACQEFITQ; WGGAGSVACQEFITQL;

Fig. 29 continued

| | | |
|---|---|---|
| | GGAGSVACQEFITQLG; GAGSVACQEFITQLGR; AGSVACQEFITQLGRN; GSVACQEFITQLGRNF; SVACQEFITQLGRNFQ; VACQEFITQLGRNFQV; ACQEFITQLGRNFQVI; CQEFITQLGRNFQVIY; QEFITQLGRNFQVIYE; EFITQLGRNFQVIYEQ; FITQLGRNFQVIYEQA; ITQLGRNFQVIYEQAN; TQLGRNFQVIYEQANA; QLGRNFQVIYEQANAH; LGRNFQVIYEQANAHG; GRNFQVIYEQANAHGQ; RNFQVIYEQANAHGQK; NFQVIYEQANAHGQKV; FQVIYEQANAHGQKVQ; QVIYEQANAHGQKVQA; VIYEQANAHGQKVQAA; IYEQANAHGQKVQAAG; YEQANAHGQKVQAAGN; EQANAHGQKVQAAGNN; QANAHGQKVQAAGNNM; ANAHGQKVQAAGNNMA; NAHGQKVQAAGNNMAQ; AHGQKVQAAGNNMAQT; HGQKVQAAGNNMAQTD; GQKVQAAGNNMAQTDS; QKVQAAGNNMAQTDSA; KVQAAGNNMAQTDSAV; VQAAGNNMAQTDSAVG; QAAGNNMAQTDSAVGS; AAGNNMAQTDSAVGSS; AGNNMAQTDSAVGSSW; GNNMAQTDSAVGSSWA | |
| 37) Rv2347c | 13 mers:<br>MATRFMTDPHAMR; ATRFMTDPHAMRD; TRFMTDPHAMRDM; RFMTDPHAMRDMA; FMTDPHAMRDMAG; MTDPHAMRDMAGR; TDPHAMRDMAGRF; DPHAMRDMAGRFE; PHAMRDMAGRFEV; HAMRDMAGRFEVH; AMRDMAGRFEVHA; MRDMAGRFEVHAQ; RDMAGRFEVHAQT; DMAGRFEVHAQTV; MAGRFEVHAQTVE; AGRFEVHAQTVED; GRFEVHAQTVEDE; RFEVHAQTVEDEA; FEVHAQTVEDEAR; EVHAQTVEDEARR; VHAQTVEDEARRM; HAQTVEDEARRMW; AQTVEDEARRMWA; QTVEDEARRMWAS; TVEDEARRMWASA; VEDEARRMWASAQ; EDEARRMWASAQN; DEARRMWASAQNI; EARRMWASAQNIS; ARRMWASAQNISG; RRMWASAQNISGA; RMWASAQNISGAG; MWASAQNISGAGW; WASAQNISGAGWS; ASAQNISGAGWSG; SAQNISGAGWSGM; AQNISGAGWSGMA; QNISGAGWSGMAE; NISGAGWSGMAEA; ISGAGWSGMAEAT; SGAGWSGMAEATS; GAGWSGMAEATSL; AGWSGMAEATSLD; GWSGMAEATSLDT; WSGMAEATSLDTM; SGMAEATSLDTMA; GMAEATSLDTMAQ; MAEATSLDTMAQM; AEATSLDTMAQMN; EATSLDTMAQMNQ; ATSLDTMAQMNQA; TSLDTMAQMNQAF; SLDTMAQMNQAFR; LDTMAQMNQAFRN; DTMAQMNQAFRNI; TMAQMNQAFRNIV; MAQMNQAFRNIVN; AQMNQAFRNIVNM; QMNQAFRNIVNML; MNQAFRNIVNMLH; NQAFRNIVNMLHG; QAFRNIVNMLHGV; AFRNIVNMLHGVR; FRNIVNMLHGVRD; RNIVNMLHGVRDG; NIVNMLHGVRDGL; IVNMLHGVRDGLV; VNMLHGVRDGLVR; NMLHGVRDGLVRD; MLHGVRDGLVRDA; LHGVRDGLVRDAN; HGVRDGLVRDANN; GVRDGLVRDANNY; VRDGLVRDANNYE; RDGLVRDANNYEQ; DGLVRDANNYEQQ; GLVRDANNYEQQE; LVRDANNYEQQEQ; VRDANNYEQQEQA; RDANNYEQQEQAS; DANNYEQQEQASQ; ANNYEQQEQASQQ; NNYEQQEQASQQI; NYEQQEQASQQIL; YEQQEQASQQILS; EQQEQASQQILSS;<br><br>14 mers:<br>MATRFMTDPHAMRD; ATRFMTDPHAMRDM; TRFMTDPHAMRDMA; RFMTDPHAMRDMAG; FMTDPHAMRDMAGR; MTDPHAMRDMAGRF; TDPHAMRDMAGRFE; DPHAMRDMAGRFEV; PHAMRDMAGRFEVH; HAMRDMAGRFEVHA; AMRDMAGRFEVHAQ; MRDMAGRFEVHAQT; RDMAGRFEVHAQTV; DMAGRFEVHAQTVE; MAGRFEVHAQTVED; AGRFEVHAQTVEDE; GRFEVHAQTVEDEA; RFEVHAQTVEDEAR; FEVHAQTVEDEARR; EVHAQTVEDEARRM; VHAQTVEDEARRMW; HAQTVEDEARRMWA; AQTVEDEARRMWAS; QTVEDEARRMWASA; TVEDEARRMWASAQ; VEDEARRMWASAQN; EDEARRMWASAQNI; | 87852-88189 |

Fig. 29 continued

DEARRMWASAQNIS; EARRMWASAQNISG; ARRMWASAQNISGA;
RRMWASAQNISGAG; RMWASAQNISGAGW; MWASAQNISGAGWS;
WASAQNISGAGWSG; ASAQNISGAGWSGM; SAQNISGAGWSGMA;
AQNISGAGWSGMAE; QNISGAGWSGMAEA; NISGAGWSGMAEAT;
ISGAGWSGMAEATS; SGAGWSGMAEATSL; GAGWSGMAEATSLD;
AGWSGMAEATSLDT; GWSGMAEATSLDTM; WSGMAEATSLDTMA;
SGMAEATSLDTMAQ; GMAEATSLDTMAQM; MAEATSLDTMAQMN;
AEATSLDTMAQMNQ; EATSLDTMAQMNQA; ATSLDTMAQMNQAF;
TSLDTMAQMNQAFR; SLDTMAQMNQAFRN; LDTMAQMNQAFRNI;
DTMAQMNQAFRNIV; TMAQMNQAFRNIVN; MAQMNQAFRNIVNM;
AQMNQAFRNIVNML; QMNQAFRNIVNMLH; MNQAFRNIVNMLHG;
NQAFRNIVNMLHGV; QAFRNIVNMLHGVR; AFRNIVNMLHGVRD;
FRNIVNMLHGVRDG; RNIVNMLHGVRDGL; NIVNMLHGVRDGLV;
IVNMLHGVRDGLVR; VNMLHGVRDGLVRD; NMLHGVRDGLVRDA;
MLHGVRDGLVRDAN; LHGVRDGLVRDANN; HGVRDGLVRDANNY;
GVRDGLVRDANNYE; VRDGLVRDANNYEQ; RDGLVRDANNYEQQ;
DGLVRDANNYEQQE; GLVRDANNYEQQEQ; LVRDANNYEQQEQA;
VRDANNYEQQEQAS; RDANNYEQQEQASQ; DANNYEQQEQASQQ;
ANNYEQQEQASQQI; NNYEQQEQASQQIL; NYEQQEQASQQILS;
YEQQEQASQQILSS;

15 mers:
MATRFMTDPHAMRDM; ATRFMTDPHAMRDMA; TRFMTDPHAMRDMAG;
RFMTDPHAMRDMAGR; FMTDPHAMRDMAGRF; MTDPHAMRDMAGRFE;
TDPHAMRDMAGRFEV; DPHAMRDMAGRFEVH; PHAMRDMAGRFEVHA;
HAMRDMAGRFEVHAQ; AMRDMAGRFEVHAQT; MRDMAGRFEVHAQTV;
RDMAGRFEVHAQTVE; DMAGRFEVHAQTVED; MAGRFEVHAQTVEDE;
AGRFEVHAQTVEDEA; GRFEVHAQTVEDEAR; RFEVHAQTVEDEARR;
FEVHAQTVEDEARRM; EVHAQTVEDEARRMW; VHAQTVEDEARRMWA;
HAQTVEDEARRMWAS; AQTVEDEARRMWASA; QTVEDEARRMWASAQ;
TVEDEARRMWASAQN; VEDEARRMWASAQNI; EDEARRMWASAQNIS;
DEARRMWASAQNISG; EARRMWASAQNISGA; ARRMWASAQNISGAG;
RRMWASAQNISGAGW; RMWASAQNISGAGWS; MWASAQNISGAGWSG;
WASAQNISGAGWSGM; ASAQNISGAGWSGMA; SAQNISGAGWSGMAE;
AQNISGAGWSGMAEA; QNISGAGWSGMAEAT; NISGAGWSGMAEATS;
ISGAGWSGMAEATSL; SGAGWSGMAEATSLD; GAGWSGMAEATSLDT;
AGWSGMAEATSLDTM; GWSGMAEATSLDTMA; WSGMAEATSLDTMAQ;
SGMAEATSLDTMAQM; GMAEATSLDTMAQMN; MAEATSLDTMAQMNQ;
AEATSLDTMAQMNQA; EATSLDTMAQMNQAF; ATSLDTMAQMNQAFR;
TSLDTMAQMNQAFRN; SLDTMAQMNQAFRNI; LDTMAQMNQAFRNIV;
DTMAQMNQAFRNIVN; TMAQMNQAFRNIVNM; MAQMNQAFRNIVNML;
AQMNQAFRNIVNMLH; QMNQAFRNIVNMLHG; MNQAFRNIVNMLHGV;
NQAFRNIVNMLHGVR; QAFRNIVNMLHGVRD; AFRNIVNMLHGVRDG;
FRNIVNMLHGVRDGL; RNIVNMLHGVRDGLV; NIVNMLHGVRDGLVR;
IVNMLHGVRDGLVRD; VNMLHGVRDGLVRDA; NMLHGVRDGLVRDAN;
MLHGVRDGLVRDANN; LHGVRDGLVRDANNY; HGVRDGLVRDANNYE;
GVRDGLVRDANNYEQ; VRDGLVRDANNYEQQ; RDGLVRDANNYEQQE;
DGLVRDANNYEQQEQ; GLVRDANNYEQQEQA; LVRDANNYEQQEQAS;
VRDANNYEQQEQASQ; RDANNYEQQEQASQQ; DANNYEQQEQASQQI;
ANNYEQQEQASQQIL; NNYEQQEQASQQILS; NYEQQEQASQQILSS;

16 mers:
MATRFMTDPHAMRDMA; ATRFMTDPHAMRDMAG; TRFMTDPHAMRDMAGR;

Fig. 29 continued

| | | |
|---|---|---|
| | RFMTDPHAMRDMAGRF; FMTDPHAMRDMAGRFE; MTDPHAMRDMAGRFEV; TDPHAMRDMAGRFEVH; DPHAMRDMAGRFEVHA; PHAMRDMAGRFEVHAQ; HAMRDMAGRFEVHAQT; AMRDMAGRFEVHAQTV; MRDMAGRFEVHAQTVE; RDMAGRFEVHAQTVED; DMAGRFEVHAQTVEDE; MAGRFEVHAQTVEDEA; AGRFEVHAQTVEDEAR; GRFEVHAQTVEDEARR; RFEVHAQTVEDEARRM; FEVHAQTVEDEARRMW; EVHAQTVEDEARRMWA; VHAQTVEDEARRMWAS; HAQTVEDEARRMWASA; AQTVEDEARRMWASAQ; QTVEDEARRMWASAQN; TVEDEARRMWASAQNI; VEDEARRMWASAQNIS; EDEARRMWASAQNISG; DEARRMWASAQNISGA; EARRMWASAQNISGAG; ARRMWASAQNISGAGW; RRMWASAQNISGAGWS; RMWASAQNISGAGWSG; MWASAQNISGAGWSGM; WASAQNISGAGWSGMA; ASAQNISGAGWSGMAE; SAQNISGAGWSGMAEA; AQNISGAGWSGMAEAT; QNISGAGWSGMAEATS; NISGAGWSGMAEATSL; ISGAGWSGMAEATSLD; SGAGWSGMAEATSLDT; GAGWSGMAEATSLDTM; AGWSGMAEATSLDTMA; GWSGMAEATSLDTMAQ; WSGMAEATSLDTMAQM; SGMAEATSLDTMAQMN; GMAEATSLDTMAQMNQ; MAEATSLDTMAQMNQA; AEATSLDTMAQMNQAF; EATSLDTMAQMNQAFR; ATSLDTMAQMNQAFRN; TSLDTMAQMNQAFRNI; SLDTMAQMNQAFRNIV; LDTMAQMNQAFRNIVN; DTMAQMNQAFRNIVNM; TMAQMNQAFRNIVNML; MAQMNQAFRNIVNMLH; AQMNQAFRNIVNMLHG; QMNQAFRNIVNMLHGV; MNQAFRNIVNMLHGVR; NQAFRNIVNMLHGVRD; QAFRNIVNMLHGVRDG; AFRNIVNMLHGVRDGL; FRNIVNMLHGVRDGLV; RNIVNMLHGVRDGLVR; NIVNMLHGVRDGLVRD; IVNMLHGVRDGLVRDA; VNMLHGVRDGLVRDAN; NMLHGVRDGLVRDANN; MLHGVRDGLVRDANNY; LHGVRDGLVRDANNYE; HGVRDGLVRDANNYEQ; GVRDGLVRDANNYEQQ; VRDGLVRDANNYEQQE; RDGLVRDANNYEQQEQ; DGLVRDANNYEQQEQA; GLVRDANNYEQQEQAS; LVRDANNYEQQEQASQ; VRDANNYEQQEQASQQ; RDANNYEQQEQASQQI; DANNYEQQEQASQQIL; ANNYEQQEQASQQILS; NNYEQQEQASQQILSS | |
| 38) Rv2348c | 13 mers: MLLPLGPPLPPDA; LLPLGPPLPPDAV; LPLGPPLPPDAVV; PLGPPLPPDAVVA; LGPPLPPDAVVAK; GPPLPPDAVVAKR; PPLPPDAVVAKRA; PLPPDAVVAKRAE; LPPDAVVAKRAES; PPDAVVAKRAESG; PDAVVAKRAESGM; DAVVAKRAESGML; AVVAKRAESGMLG; VVAKRAESGMLGG; VAKRAESGMLGGL; AKRAESGMLGGLS; KRAESGMLGGLSV; RAESGMLGGLSVP; AESGMLGGLSVPL; ESGMLGGLSVPLS; SGMLGGLSVPLSW; GMLGGLSVPLSWG; MLGGLSVPLSWGV; LGGLSVPLSWGVA; GGLSVPLSWGVAV; GLSVPLSWGVAVP; LSVPLSWGVAVPP; SVPLSWGVAVPPD; VPLSWGVAVPPDD; PLSWGVAVPPDDY; LSWGVAVPPDDYD; SWGVAVPPDDYDH; WGVAVPPDDYDHW; GVAVPPDDYDHWA; VAVPPDDYDHWAP; AVPPDDYDHWAPA; VPPDDYDHWAPAP; PPDDYDHWAPAPE; PDDYDHWAPAPED; DDYDHWAPAPEDG; DYDHWAPAPEDGA; YDHWAPAPEDGAD; DHWAPAPEDGADV; HWAPAPEDGADVD; WAPAPEDGADVDV; APAPEDGADVDVQ; PAPEDGADVDVQA; APEDGADVDVQAA; PEDGADVDVQAAE; EDGADVDVQAAEG; DGADVDVQAAEGA; GADVDVQAAEGAD; ADVDVQAAEGADA; DVDVQAAEGADAE; VDVQAAEGADAEA; DVQAAEGADAEAA; VQAAEGADAEAAA; QAAEGADAEAAAM; AAEGADAEAAAMD; AEGADAEAAAMDE; EGADAEAAAMDEW; GADAEAAAMDEWD; ADAEAAAMDEWDE; DAEAAAMDEWDEW; AEAAAMDEWDEWQ; EAAAMDEWDEWQA; AAAMDEWDEWQAW; AAMDEWDEWQAWN; AMDEWDEWQAWNE; MDEWDEWQAWNEW; DEWDEWQAWNEWV; EWDEWQAWNEWVA; WDEWQAWNEWVAE; DEWQAWNEWVAEN; EWQAWNEWVAENA; WQAWNEWVAENAE; QAWNEWVAENAEP; | 88190-88567 |

Fig. 29 continued

| | | |
|---|---|---|
| | AWNEWVAENAEPR; WNEWVAENAEPRF; NEWVAENAEPRFE; EWVAENAEPRFEV; WVAENAEPRFEVP; VAENAEPRFEVPR; AENAEPRFEVPRS; ENAEPRFEVPRSS; NAEPRFEVPRSSS; AEPRFEVPRSSSS; EPRFEVPRSSSSV; PRFEVPRSSSSVI; RFEVPRSSSSVIP; FEVPRSSSSVIPH; EVPRSSSSVIPHS; VPRSSSSVIPHSP; PRSSSSVIPHSPA; RSSSSVIPHSPAA; SSSSVIPHSPAAG;<br><br>14 mers:<br>MLLPLGPPLPPDAV; LLPLGPPLPPDAVV; LPLGPPLPPDAVVA; PLGPPLPPDAVVAK; LGPPLPPDAVVAKR; GPPLPPDAVVAKRA; PPLPPDAVVAKRAE; PLPPDAVVAKRAES; LPPDAVVAKRAESG; PPDAVVAKRAESGM; PDAVVAKRAESGML; DAVVAKRAESGMLG; AVVAKRAESGMLGG; VVAKRAESGMLGGL; VAKRAESGMLGGLS; AKRAESGMLGGLSV; KRAESGMLGGLSVP; RAESGMLGGLSVPL; AESGMLGGLSVPLS; ESGMLGGLSVPLSW; SGMLGGLSVPLSWG; GMLGGLSVPLSWGV; MLGGLSVPLSWGVA; LGGLSVPLSWGVAV; GGLSVPLSWGVAVP; GLSVPLSWGVAVPP; LSVPLSWGVAVPPD; SVPLSWGVAVPPDD; VPLSWGVAVPPDDY; PLSWGVAVPPDDYD; LSWGVAVPPDDYDH; SWGVAVPPDDYDHW; WGVAVPPDDYDHWA; GVAVPPDDYDHWAP; VAVPPDDYDHWAPA; AVPPDDYDHWAPAP; VPPDDYDHWAPAPE; PPDDYDHWAPAPED; PDDYDHWAPAPEDG; DDYDHWAPAPEDGA; DYDHWAPAPEDGAD; YDHWAPAPEDGADV; DHWAPAPEDGADVD; HWAPAPEDGADVDV; WAPAPEDGADVDVQ; APAPEDGADVDVQA; PAPEDGADVDVQAA; APEDGADVDVQAAE; PEDGADVDVQAAEG; EDGADVDVQAAEGA; DGADVDVQAAEGAD; GADVDVQAAEGADA; ADVDVQAAEGADAE; DVDVQAAEGADAEA; VDVQAAEGADAEAA; DVQAAEGADAEAAA; VQAAEGADAEAAAM; QAAEGADAEAAAMD; AAEGADAEAAAMDE; AEGADAEAAAMDEW; EGADAEAAAMDEWD; GADAEAAAMDEWDE; ADAEAAAMDEWDEW; DAEAAAMDEWDEWQ; AEAAAMDEWDEWQA; EAAAMDEWDEWQAW; AAAMDEWDEWQAWN; AAMDEWDEWQAWNE; AMDEWDEWQAWNEW; MDEWDEWQAWNEWV; DEWDEWQAWNEWVA; EWDEWQAWNEWVAE; WDEWQAWNEWVAEN; DEWQAWNEWVAENA; EWQAWNEWVAENAE; WQAWNEWVAENAEP; QAWNEWVAENAEPR; AWNEWVAENAEPRF; WNEWVAENAEPRFE; NEWVAENAEPRFEV; EWVAENAEPRFEVP; WVAENAEPRFEVPR; VAENAEPRFEVPRS; AENAEPRFEVPRSS; ENAEPRFEVPRSSS; NAEPRFEVPRSSSS; AEPRFEVPRSSSSV; EPRFEVPRSSSSVI; PRFEVPRSSSSVIP; RFEVPRSSSSVIPH; FEVPRSSSSVIPHS; EVPRSSSSVIPHSP; VPRSSSSVIPHSPA; PRSSSSVIPHSPAA; RSSSSVIPHSPAAG;<br><br>15 mers:<br>MLLPLGPPLPPDAVV; LLPLGPPLPPDAVVA; LPLGPPLPPDAVVAK; PLGPPLPPDAVVAKR; LGPPLPPDAVVAKRA; GPPLPPDAVVAKRAE; PPLPPDAVVAKRAES; PLPPDAVVAKRAESG; LPPDAVVAKRAESGM; PPDAVVAKRAESGML; PDAVVAKRAESGMLG; DAVVAKRAESGMLGG; AVVAKRAESGMLGGL; VVAKRAESGMLGGLS; VAKRAESGMLGGLSV; AKRAESGMLGGLSVP; KRAESGMLGGLSVPL; RAESGMLGGLSVPLS; AESGMLGGLSVPLSW; ESGMLGGLSVPLSWG; SGMLGGLSVPLSWGV; GMLGGLSVPLSWGVA; MLGGLSVPLSWGVAV; LGGLSVPLSWGVAVP; GGLSVPLSWGVAVPP; GLSVPLSWGVAVPPD; LSVPLSWGVAVPPDD; SVPLSWGVAVPPDDY; VPLSWGVAVPPDDYD; PLSWGVAVPPDDYDH; LSWGVAVPPDDYDHW; SWGVAVPPDDYDHWA; WGVAVPPDDYDHWAP; | |

Fig. 29 continued

GVAVPPDDYDHWAPA; VAVPPDDYDHWAPAP; AVPPDDYDHWAPAPE;
VPPDDYDHWAPAPED; PPDDYDHWAPAPEDG; PDDYDHWAPAPEDGA;
DDYDHWAPAPEDGAD; DYDHWAPAPEDGADV; YDHWAPAPEDGADVD;
DHWAPAPEDGADVDV; HWAPAPEDGADVDVQ; WAPAPEDGADVDVQA;
APAPEDGADVDVQAA; PAPEDGADVDVQAAE; APEDGADVDVQAAEG;
PEDGADVDVQAAEGA; EDGADVDVQAAEGAD; DGADVDVQAAEGADA;
GADVDVQAAEGADAE; ADVDVQAAEGADAEA; DVDVQAAEGADAEAA;
VDVQAAEGADAEAAA; DVQAAEGADAEAAAM; VQAAEGADAEAAAMD;
QAAEGADAEAAAMDE; AAEGADAEAAAMDEW; AEGADAEAAAMDEWD;
EGADAEAAAMDEWDE; GADAEAAAMDEWDEW; ADAEAAAMDEWDEWQ;
DAEAAAMDEWDEWQA; AEAAAMDEWDEWQAW; EAAAMDEWDEWQAWN;
AAAMDEWDEWQAWNE; AAMDEWDEWQAWNEW; AMDEWDEWQAWNEWV;
MDEWDEWQAWNEWVA; DEWDEWQAWNEWVAE; EWDEWQAWNEWVAEN;
WDEWQAWNEWVAENA; DEWQAWNEWVAENAE; EWQAWNEWVAENAEP;
WQAWNEWVAENAEPR; QAWNEWVAENAEPRF; AWNEWVAENAEPRFE;
WNEWVAENAEPRFEV; NEWVAENAEPRFEVP; EWVAENAEPRFEVPR;
WVAENAEPRFEVPRS; VAENAEPRFEVPRSS; AENAEPRFEVPRSSS;
ENAEPRFEVPRSSSS; NAEPRFEVPRSSSSV; AEPRFEVPRSSSSVI;
EPRFEVPRSSSSVIP; PRFEVPRSSSSVIPH; RFEVPRSSSSVIPHS;
FEVPRSSSSVIPHSP; EVPRSSSSVIPHSPA; VPRSSSSVIPHSPAA;
PRSSSSVIPHSPAAG;

16 mers:
MLLPLGPPLPPDAVVA; LLPLGPPLPPDAVVAK; LPLGPPLPPDAVVAKR;
PLGPPLPPDAVVAKRA; LGPPLPPDAVVAKRAE; GPPLPPDAVVAKRAES;
PPLPPDAVVAKRAESG; PLPPDAVVAKRAESGM; LPPDAVVAKRAESGML;
PPDAVVAKRAESGMLG; PDAVVAKRAESGMLGG; DAVVAKRAESGMLGGL;
AVVAKRAESGMLGGLS; VVAKRAESGMLGGLSV; VAKRAESGMLGGLSVP;
AKRAESGMLGGLSVPL; KRAESGMLGGLSVPLS; RAESGMLGGLSVPLSW;
AESGMLGGLSVPLSWG; ESGMLGGLSVPLSWGV; SGMLGGLSVPLSWGVA;
GMLGGLSVPLSWGVAV; MLGGLSVPLSWGVAVP; LGGLSVPLSWGVAVPP;
GGLSVPLSWGVAVPPD; GLSVPLSWGVAVPPDD; LSVPLSWGVAVPPDDY;
SVPLSWGVAVPPDDYD; VPLSWGVAVPPDDYDH; PLSWGVAVPPDDYDHW;
LSWGVAVPPDDYDHWA; SWGVAVPPDDYDHWAP; WGVAVPPDDYDHWAPA;
GVAVPPDDYDHWAPAP; VAVPPDDYDHWAPAPE; AVPPDDYDHWAPAPED;
VPPDDYDHWAPAPEDG; PPDDYDHWAPAPEDGA; PDDYDHWAPAPEDGAD;
DDYDHWAPAPEDGADV; DYDHWAPAPEDGADVD; YDHWAPAPEDGADVDV;
DHWAPAPEDGADVDVQ; HWAPAPEDGADVDVQA; WAPAPEDGADVDVQAA;
APAPEDGADVDVQAAE; PAPEDGADVDVQAAEG; APEDGADVDVQAAEGA;
PEDGADVDVQAAEGAD; EDGADVDVQAAEGADA; DGADVDVQAAEGADAE;
GADVDVQAAEGADAEA; ADVDVQAAEGADAEAA; DVDVQAAEGADAEAAA;
VDVQAAEGADAEAAAM; DVQAAEGADAEAAAMD; VQAAEGADAEAAAMDE;
QAAEGADAEAAAMDEW; AAEGADAEAAAMDEWD; AEGADAEAAAMDEWDE;
EGADAEAAAMDEWDEW; GADAEAAAMDEWDEWQ; ADAEAAAMDEWDEWQA;
DAEAAAMDEWDEWQAW; AEAAAMDEWDEWQAWN; EAAAMDEWDEWQAWNE;
AAAMDEWDEWQAWNEW; AAMDEWDEWQAWNEWV;
AMDEWDEWQAWNEWVA; MDEWDEWQAWNEWVAE;
DEWDEWQAWNEWVAEN; EWDEWQAWNEWVAENA;
WDEWQAWNEWVAENAE; DEWQAWNEWVAENAEP; EWQAWNEWVAENAEPR;
WQAWNEWVAENAEPRF; QAWNEWVAENAEPRFE; AWNEWVAENAEPRFEV;
WNEWVAENAEPRFEVP; NEWVAENAEPRFEVPR; EWVAENAEPRFEVPRS;
WVAENAEPRFEVPRSS; VAENAEPRFEVPRSSS; AENAEPRFEVPRSSSS;
ENAEPRFEVPRSSSSV; NAEPRFEVPRSSSSVI; AEPRFEVPRSSSSVIP;

Fig. 29 continued

| | | |
|---|---|---|
| | EPRFEVPRSSSSVIPH; PRFEVPRSSSSVIPHS; RFEVPRSSSSVIPHSP; FEVPRSSSSVIPHSPA; EVPRSSSSVIPHSPAA; VPRSSSSVIPHSPAAG; | |
| 39) Rv2497c | 13 mers: MGEGSRRPSGMLM; GEGSRRPSGMLMS; EGSRRPSGMLMSV; GSRRPSGMLMSVD; SRRPSGMLMSVDL; RRPSGMLMSVDLE; RPSGMLMSVDLEP; PSGMLMSVDLEPV; SGMLMSVDLEPVQ; GMLMSVDLEPVQL; MLMSVDLEPVQLV; LMSVDLEPVQLVG; MSVDLEPVQLVGP; SVDLEPVQLVGPD; VDLEPVQLVGPDG; DLEPVQLVGPDGT; LEPVQLVGPDGTP; EPVQLVGPDGTPT; PVQLVGPDGTPTA; VQLVGPDGTPTAE; QLVGPDGTPTAER; LVGPDGTPTAERR; VGPDGTPTAERRY; GPDGTPTAERRYH; PDGTPTAERRYHR; DGTPTAERRYHRD; GTPTAERRYHRDL; TPTAERRYHRDLP; PTAERRYHRDLPE; TAERRYHRDLPEE; AERRYHRDLPEET; ERRYHRDLPEETL; RRYHRDLPEETLR; RYHRDLPEETLRW; YHRDLPEETLRWL; HRDLPEETLRWLY; RDLPEETLRWLYE; DLPEETLRWLYEM; LPEETLRWLYEMM; PEETLRWLYEMMV; EETLRWLYEMMVV; ETLRWLYEMMVVT; TLRWLYEMMVVTR; LRWLYEMMVVTRE; RWLYEMMVVTREL; WLYEMMVVTRELD; LYEMMVVTRELDT; YEMMVVTRELDTE; EMMVVTRELDTEF; MMVVTRELDTEFV; MVVTRELDTEFVN; VVTRELDTEFVNL; VTRELDTEFVNLQ; TRELDTEFVNLQR; RELDTEFVNLQRQ; ELDTEFVNLQRQG; LDTEFVNLQRQGE; DTEFVNLQRQGEL; TEFVNLQRQGELA; EFVNLQRQGELAL; FVNLQRQGELALY; VNLQRQGELALYT; NLQRQGELALYTP; LQRQGELALYTPC; QRQGELALYTPCR; RQGELALYTPCRG; QGELALYTPCRGQ; GELALYTPCRGQE; ELALYTPCRGQEA; LALYTPCRGQEAA; ALYTPCRGQEAAQ; LYTPCRGQEAAQV; YTPCRGQEAAQVG; TPCRGQEAAQVGA; PCRGQEAAQVGAA; CRGQEAAQVGAAA; RGQEAAQVGAAAC; GQEAAQVGAAACL; QEAAQVGAAACLR; EAAQVGAAACLRK; AAQVGAAACLRKT; AQVGAAACLRKTD; QVGAAACLRKTDW; VGAAACLRKTDWL; GAAACLRKTDWLF; AAACLRKTDWLFP; AACLRKTDWLFPQ; ACLRKTDWLFPQY; CLRKTDWLFPQYR; LRKTDWLFPQYRE; RKTDWLFPQYREL; KTDWLFPQYRELG; TDWLFPQYRELGV; DWLFPQYRELGVY; WLFPQYRELGVYL; LFPQYRELGVYLV; FPQYRELGVYLVR; PQYRELGVYLVRG; QYRELGVYLVRGI; YRELGVYLVRGIP; RELGVYLVRGIPP; ELGVYLVRGIPPG; LGVYLVRGIPPGH; GVYLVRGIPPGHV; VYLVRGIPPGHVG; YLVRGIPPGHVGV; LVRGIPPGHVGVA; VRGIPPGHVGVAW; RGIPPGHVGVAWR; GIPPGHVGVAWRG; IPPGHVGVAWRGT; PPGHVGVAWRGTW; PGHVGVAWRGTWH; GHVGVAWRGTWHG; HVGVAWRGTWHGG; VGVAWRGTWHGGL; GVAWRGTWHGGLQ; VAWRGTWHGGLQF; AWRGTWHGGLQFT; WRGTWHGGLQFTT; RGTWHGGLQFTTK; GTWHGGLQFTTKC; TWHGGLQFTTKCC; WHGGLQFTTKCCA; HGGLQFTTKCCAP; GGLQFTTKCCAPM; GLQFTTKCCAPMS; LQFTTKCCAPMSV; QFTTKCCAPMSVP; FTTKCCAPMSVPI; TTKCCAPMSVPIG; TKCCAPMSVPIGT; KCCAPMSVPIGTQ; CCAPMSVPIGTQT; CAPMSVPIGTQTL; APMSVPIGTQTLH; PMSVPIGTQTLHA; MSVPIGTQTLHAV; SVPIGTQTLHAVG; VPIGTQTLHAVGA; PIGTQTLHAVGAA; IGTQTLHAVGAAM; GTQTLHAVGAAMA; TQTLHAVGAAMAA; QTLHAVGAAMAAQ; TLHAVGAAMAAQR; LHAVGAAMAAQRL; HAVGAAMAAQRLD; AVGAAMAAQRLDE; VGAAMAAQRLDED; GAAMAAQRLDEDS; AAMAAQRLDEDSV; AMAAQRLDEDSVT; MAAQRLDEDSVTV; AAQRLDEDSVTVA; AQRLDEDSVTVAF; QRLDEDSVTVAFL; RLDEDSVTVAFLG; LDEDSVTVAFLGD; DEDSVTVAFLGDG; EDSVTVAFLGDGA; DSVTVAFLGDGAT; SVTVAFLGDGATS; VTVAFLGDGATSE; TVAFLGDGATSEG; VAFLGDGATSEGD; AFLGDGATSEGDV; | 88568-89981 |

Fig. 29 continued

| | | |
|---|---|---|
| | FLGDGATSEGDVH; LGDGATSEGDVHE; GDGATSEGDVHEA;<br>DGATSEGDVHEAL; GATSEGDVHEALN; ATSEGDVHEALNF; TSEGDVHEALNFA;<br>SEGDVHEALNFAA; EGDVHEALNFAAV; GDVHEALNFAAVF; DVHEALNFAAVFT;<br>VHEALNFAAVFTT; HEALNFAAVFTTP; EALNFAAVFTTPC; ALNFAAVFTTPCV;<br>LNFAAVFTTPCVF; NFAAVFTTPCVFY; FAAVFTTPCVFYV; AAVFTTPCVFYVQ;<br>AVFTTPCVFYVQN; VFTTPCVFYVQNN; FTTPCVFYVQNNQ; TTPCVFYVQNNQW;<br>TPCVFYVQNNQWA; PCVFYVQNNQWAI; CVFYVQNNQWAIS;<br>VFYVQNNQWAISM; FYVQNNQWAISMP; YVQNNQWAISMPV;<br>VQNNQWAISMPVS; QNNQWAISMPVSR; NNQWAISMPVSRQ;<br>NQWAISMPVSRQT; QWAISMPVSRQTA; WAISMPVSRQTAA; AISMPVSRQTAAP;<br>ISMPVSRQTAAPS; SMPVSRQTAAPSI; MPVSRQTAAPSIA; PVSRQTAAPSIAH;<br>VSRQTAAPSIAHK; SRQTAAPSIAHKA; RQTAAPSIAHKAI; QTAAPSIAHKAIG;<br>TAAPSIAHKAIGY; AAPSIAHKAIGYG; APSIAHKAIGYGM; PSIAHKAIGYGMP;<br>SIAHKAIGYGMPG; IAHKAIGYGMPGI; AHKAIGYGMPGIR; HKAIGYGMPGIRV;<br>KAIGYGMPGIRVD; AIGYGMPGIRVDG; IGYGMPGIRVDGN; GYGMPGIRVDGND;<br>YGMPGIRVDGNDV; GMPGIRVDGNDVL; MPGIRVDGNDVLA; PGIRVDGNDVLAC;<br>GIRVDGNDVLACY; IRVDGNDVLACYA; RVDGNDVLACYAV; VDGNDVLACYAVM;<br>DGNDVLACYAVMA; GNDVLACYAVMAE; NDVLACYAVMAEA;<br>DVLACYAVMAEAA; VLACYAVMAEAAA; LACYAVMAEAAAR; ACYAVMAEAAARA;<br>CYAVMAEAAARAR; YAVMAEAAARARA; AVMAEAAARARAG;<br>VMAEAAARARAGD; MAEAAARARAGDG; AEAAARARAGDGP;<br>EAAARARAGDGPT; AAARARAGDGPTL; AARARAGDGPTLI; ARARAGDGPTLIE;<br>RARAGDGPTLIEA; ARAGDGPTLIEAV; RAGDGPTLIEAVT; AGDGPTLIEAVTY;<br>GDGPTLIEAVTYR; DGPTLIEAVTYRL; GPTLIEAVTYRLG; PTLIEAVTYRLGP;<br>TLIEAVTYRLGPH; LIEAVTYRLGPHT; IEAVTYRLGPHTT; EAVTYRLGPHTTA;<br>AVTYRLGPHTTAD; VTYRLGPHTTADD; TYRLGPHTTADDP; YRLGPHTTADDPT;<br>RLGPHTTADDPTR; LGPHTTADDPTRY; GPHTTADDPTRYR; PHTTADDPTRYRS;<br>HTTADDPTRYRSQ; TTADDPTRYRSQE; TADDPTRYRSQEE;<br>ADDPTRYRSQEEV; DDPTRYRSQEEVD; DPTRYRSQEEVDR;<br>PTRYRSQEEVDRW; TRYRSQEEVDRWA; RYRSQEEVDRWAT;<br>YRSQEEVDRWATL; RSQEEVDRWATLD; SQEEVDRWATLDP;<br>QEEVDRWATLDPI; EEVDRWATLDPIP; EVDRWATLDPIPR; VDRWATLDPIPRY;<br>DRWATLDPIPRYR; RWATLDPIPRYRT; WATLDPIPRYRTY; ATLDPIPRYRTYL;<br>TLDPIPRYRTYLQ; LDPIPRYRTYLQD; DPIPRYRTYLQDQ; PIPRYRTYLQDQG;<br>IPRYRTYLQDQGL; PRYRTYLQDQGLW; RYRTYLQDQGLWS;<br>YRTYLQDQGLWSQ; RTYLQDQGLWSQR; TYLQDQGLWSQRL;<br>YLQDQGLWSQRLE; LQDQGLWSQRLEE; QDQGLWSQRLEEQ;<br>DQGLWSQRLEEQV; QGLWSQRLEEQVT; GLWSQRLEEQVTA;<br>LWSQRLEEQVTAR; WSQRLEEQVTARA; SQRLEEQVTARAK;<br>QRLEEQVTARAKH; RLEEQVTARAKHV; LEEQVTARAKHVR; EEQVTARAKHVRS;<br>EQVTARAKHVRSE; QVTARAKHVRSEL; VTARAKHVRSELR; TARAKHVRSELRD;<br>ARAKHVRSELRDA; RAKHVRSELRDAV; AKHVRSELRDAVF; KHVRSELRDAVFD;<br>HVRSELRDAVFDA; VRSELRDAVFDAP; RSELRDAVFDAPD; SELRDAVFDAPDF;<br>ELRDAVFDAPDFD; LRDAVFDAPDFDV; RDAVFDAPDFDVD; DAVFDAPDFDVDE;<br>AVFDAPDFDVDEV; VFDAPDFDVDEVF; FDAPDFDVDEVFT; DAPDFDVDEVFTT;<br>APDFDVDEVFTTV; PDFDVDEVFTTVY; DFDVDEVFTTVYA; FDVDEVFTTVYAE;<br>DVDEVFTTVYAEI; VDEVFTTVYAEIT; DEVFTTVYAEITP; EVFTTVYAEITPG;<br>VFTTVYAEITPGL; FTTVYAEITPGLQ; TTVYAEITPGLQA; TVYAEITPGLQAQ;<br>VYAEITPGLQAQR; YAEITPGLQAQRE; AEITPGLQAQREQ; EITPGLQAQREQL;<br>ITPGLQAQREQLR; TPGLQAQREQLRA; PGLQAQREQLRAE; GLQAQREQLRAEL;<br>LQAQREQLRAELA; QAQREQLRAELAR; AQREQLRAELART; QREQLRAELARTD<br><br>14 mers: | |

Fig. 29 continued

| | | | |
|---|---|---|---|
| | MGEGSRRPSGMLMS; GEGSRRPSGMLMSV; EGSRRPSGMLMSVD; GSRRPSGMLMSVDL; SRRPSGMLMSVDLE; RRPSGMLMSVDLEP; RPSGMLMSVDLEPV; PSGMLMSVDLEPVQ; SGMLMSVDLEPVQL; GMLMSVDLEPVQLV; MLMSVDLEPVQLVG; LMSVDLEPVQLVGP; MSVDLEPVQLVGPD; SVDLEPVQLVGPDG; VDLEPVQLVGPDGT; DLEPVQLVGPDGTP; LEPVQLVGPDGTPT; EPVQLVGPDGTPTA; PVQLVGPDGTPTAE; VQLVGPDGTPTAER; QLVGPDGTPTAERR; LVGPDGTPTAERRY; VGPDGTPTAERRYH; GPDGTPTAERRYHR; PDGTPTAERRYHRD; DGTPTAERRYHRDL; GTPTAERRYHRDLP; TPTAERRYHRDLPE; PTAERRYHRDLPEE; TAERRYHRDLPEET; AERRYHRDLPEETL; ERRYHRDLPEETLR; RRYHRDLPEETLRW; RYHRDLPEETLRWL; YHRDLPEETLRWLY; HRDLPEETLRWLYE; RDLPEETLRWLYEM; DLPEETLRWLYEMM; LPEETLRWLYEMMV; PEETLRWLYEMMVV; EETLRWLYEMMVVT; ETLRWLYEMMVVTR; TLRWLYEMMVVTRE; LRWLYEMMVVTREL; RWLYEMMVVTRELD; WLYEMMVVTRELDT; LYEMMVVTRELDTE; YEMMVVTRELDTEF; EMMVVTRELDTEFV; MMVVTRELDTEFVN; MVVTRELDTEFVNL; VVTRELDTEFVNLQ; VTRELDTEFVNLQR; TRELDTEFVNLQRQ; RELDTEFVNLQRQG; ELDTEFVNLQRQGE; LDTEFVNLQRQGEL; DTEFVNLQRQGELA; TEFVNLQRQGELAL; EFVNLQRQGELALY; FVNLQRQGELALYT; VNLQRQGELALYTP; NLQRQGELALYTPC; LQRQGELALYTPCR; QRQGELALYTPCRG; RQGELALYTPCRGQ; QGELALYTPCRGQE; GELALYTPCRGQEA; ELALYTPCRGQEAA; LALYTPCRGQEAAQ; ALYTPCRGQEAAQV; LYTPCRGQEAAQVG; YTPCRGQEAAQVGA; TPCRGQEAAQVGAA; PCRGQEAAQVGAAA; CRGQEAAQVGAAAC; RGQEAAQVGAAACL; GQEAAQVGAAACLR; QEAAQVGAAACLRK; EAAQVGAAACLRKT; AAQVGAAACLRKTD; AQVGAAACLRKTDW; QVGAAACLRKTDWL; VGAAACLRKTDWLF; GAAACLRKTDWLFP; AAACLRKTDWLFPQ; AACLRKTDWLFPQY; ACLRKTDWLFPQYR; CLRKTDWLFPQYRE; LRKTDWLFPQYREL; RKTDWLFPQYRELG; KTDWLFPQYRELGV; TDWLFPQYRELGVY; DWLFPQYRELGVYL; WLFPQYRELGVYLV; LFPQYRELGVYLVR; FPQYRELGVYLVRG; PQYRELGVYLVRGI; QYRELGVYLVRGIP; YRELGVYLVRGIPP; RELGVYLVRGIPPG; ELGVYLVRGIPPGH; LGVYLVRGIPPGHV; GVYLVRGIPPGHVG; VYLVRGIPPGHVGV; YLVRGIPPGHVGVA; LVRGIPPGHVGVAW; VRGIPPGHVGVAWR; RGIPPGHVGVAWRG; GIPPGHVGVAWRGT; IPPGHVGVAWRGTW; PPGHVGVAWRGTWH; PGHVGVAWRGTWHG; GHVGVAWRGTWHGG; HVGVAWRGTWHGGL; VGVAWRGTWHGGLQ; GVAWRGTWHGGLQF; VAWRGTWHGGLQFT; AWRGTWHGGLQFTT; WRGTWHGGLQFTTK; RGTWHGGLQFTTKC; GTWHGGLQFTTKCC; TWHGGLQFTTKCCA; WHGGLQFTTKCCAP; HGGLQFTTKCCAPM; GGLQFTTKCCAPMS; GLQFTTKCCAPMSV; LQFTTKCCAPMSVP; QFTTKCCAPMSVPI; FTTKCCAPMSVPIG; TTKCCAPMSVPIGT; TKCCAPMSVPIGTQ; KCCAPMSVPIGTQT; CCAPMSVPIGTQTL; CAPMSVPIGTQTLH; APMSVPIGTQTLHA; PMSVPIGTQTLHAV; MSVPIGTQTLHAVG; SVPIGTQTLHAVGA; VPIGTQTLHAVGAA; PIGTQTLHAVGAAM; IGTQTLHAVGAAMA; GTQTLHAVGAAMAA; TQTLHAVGAAMAAQ; QTLHAVGAAMAAQR; TLHAVGAAMAAQRL; LHAVGAAMAAQRLD; HAVGAAMAAQRLDE; AVGAAMAAQRLDED; VGAAMAAQRLDEDS; GAAMAAQRLDEDSV; AAMAAQRLDEDSVT; AMAAQRLDEDSVTV; MAAQRLDEDSVTVA; AAQRLDEDSVTVAF; AQRLDEDSVTVAFL; QRLDEDSVTVAFLG; RLDEDSVTVAFLGD; LDEDSVTVAFLGDG; | |

Fig. 29 continued

| | | | |
|---|---|---|---|
| | DEDSVTVAFLGDGA; EDSVTVAFLGDGAT; DSVTVAFLGDGATS; SVTVAFLGDGATSE; VTVAFLGDGATSEG; TVAFLGDGATSEGD; VAFLGDGATSEGDV; AFLGDGATSEGDVH; FLGDGATSEGDVHE; LGDGATSEGDVHEA; GDGATSEGDVHEAL; DGATSEGDVHEALN; GATSEGDVHEALNF; ATSEGDVHEALNFA; TSEGDVHEALNFAA; SEGDVHEALNFAAV; EGDVHEALNFAAVF; GDVHEALNFAAVFT; DVHEALNFAAVFTT; VHEALNFAAVFTTP; HEALNFAAVFTTPC; EALNFAAVFTTPCV; ALNFAAVFTTPCVF; LNFAAVFTTPCVFY; NFAAVFTTPCVFYV; FAAVFTTPCVFYVQ; AAVFTTPCVFYVQN; AVFTTPCVFYVQNN; VFTTPCVFYVQNNQ; FTTPCVFYVQNNQW; TTPCVFYVQNNQWA; TPCVFYVQNNQWAI; PCVFYVQNNQWAIS; CVFYVQNNQWAISM; VFYVQNNQWAISMP; FYVQNNQWAISMPV; YVQNNQWAISMPVS; VQNNQWAISMPVSR; QNNQWAISMPVSRQ; NNQWAISMPVSRQT; NQWAISMPVSRQTA; QWAISMPVSRQTAA; WAISMPVSRQTAAP; AISMPVSRQTAAPS; ISMPVSRQTAAPSI; SMPVSRQTAAPSIA; MPVSRQTAAPSIAH; PVSRQTAAPSIAHK; VSRQTAAPSIAHKA; SRQTAAPSIAHKAI; RQTAAPSIAHKAIG; QTAAPSIAHKAIGY; TAAPSIAHKAIGYG; AAPSIAHKAIGYGM; APSIAHKAIGYGMP; PSIAHKAIGYGMPG; SIAHKAIGYGMPGI; IAHKAIGYGMPGIR; AHKAIGYGMPGIRV; HKAIGYGMPGIRVD; KAIGYGMPGIRVDG; AIGYGMPGIRVDGN; IGYGMPGIRVDGND; GYGMPGIRVDGNDV; YGMPGIRVDGNDVL; GMPGIRVDGNDVLA; MPGIRVDGNDVLAC; PGIRVDGNDVLACY; GIRVDGNDVLACYA; IRVDGNDVLACYAV; RVDGNDVLACYAVM; VDGNDVLACYAVMA; DGNDVLACYAVMAE; GNDVLACYAVMAEA; NDVLACYAVMAEAA; DVLACYAVMAEAAA; VLACYAVMAEAAAR; LACYAVMAEAAARA; ACYAVMAEAAARAR; CYAVMAEAAARARA; YAVMAEAAARARAG; AVMAEAAARARAGD; VMAEAAARARAGDG; MAEAAARARAGDGP; AEAAARARAGDGPT; EAAARARAGDGPTL; AAARARAGDGPTLI; AARARAGDGPTLIE; ARARAGDGPTLIEA; RARAGDGPTLIEAV; ARAGDGPTLIEAVT; RAGDGPTLIEAVTY; AGDGPTLIEAVTYR; GDGPTLIEAVTYRL; DGPTLIEAVTYRLG; GPTLIEAVTYRLGP; PTLIEAVTYRLGPH; TLIEAVTYRLGPHT; LIEAVTYRLGPHTT; IEAVTYRLGPHTTA; EAVTYRLGPHTTAD; AVTYRLGPHTTADD; VTYRLGPHTTADDP; TYRLGPHTTADDPT; YRLGPHTTADDPTR; RLGPHTTADDPTRY; LGPHTTADDPTRYR; GPHTTADDPTRYRS; PHTTADDPTRYRSQ; HTTADDPTRYRSQE; TTADDPTRYRSQEE; TADDPTRYRSQEEV; ADDPTRYRSQEEVD; DDPTRYRSQEEVDR; DPTRYRSQEEVDRW; PTRYRSQEEVDRWA; TRYRSQEEVDRWAT; RYRSQEEVDRWATL; YRSQEEVDRWATLD; RSQEEVDRWATLDP; SQEEVDRWATLDPI; QEEVDRWATLDPIP; EEVDRWATLDPIPR; EVDRWATLDPIPRY; VDRWATLDPIPRYR; DRWATLDPIPRYRT; RWATLDPIPRYRTY; WATLDPIPRYRTYL; ATLDPIPRYRTYLQ; TLDPIPRYRTYLQD; LDPIPRYRTYLQDQ; DPIPRYRTYLQDQG; PIPRYRTYLQDQGL; IPRYRTYLQDQGLW; PRYRTYLQDQGLWS; RYRTYLQDQGLWSQ; YRTYLQDQGLWSQR; RTYLQDQGLWSQRL; TYLQDQGLWSQRLE; YLQDQGLWSQRLEE; LQDQGLWSQRLEEQ; QDQGLWSQRLEEQV; DQGLWSQRLEEQVT; QGLWSQRLEEQVTA; GLWSQRLEEQVTAR; LWSQRLEEQVTARA; WSQRLEEQVTARAK; SQRLEEQVTARAKH; QRLEEQVTARAKHV; RLEEQVTARAKHVR; LEEQVTARAKHVRS; EEQVTARAKHVRSE; EQVTARAKHVRSEL; QVTARAKHVRSELR; VTARAKHVRSELRD; TARAKHVRSELRDA; ARAKHVRSELRDAV; RAKHVRSELRDAVF; AKHVRSELRDAVFD; KHVRSELRDAVFDA; | | |

Fig. 29 continued

| | | |
|---|---|---|
| | HVRSELRDAVFDAP; VRSELRDAVFDAPD; RSELRDAVFDAPDF;<br>SELRDAVFDAPDFD; ELRDAVFDAPDFDV; LRDAVFDAPDFDVD;<br>RDAVFDAPDFDVDE; DAVFDAPDFDVDEV; AVFDAPDFDVDEVF;<br>VFDAPDFDVDEVFT; FDAPDFDVDEVFTT; DAPDFDVDEVFTTV;<br>APDFDVDEVFTTVY; PDFDVDEVFTTVYA; DFDVDEVFTTVYAE;<br>FDVDEVFTTVYAEI; DVDEVFTTVYAEIT; VDEVFTTVYAEITP; DEVFTTVYAEITPG;<br>EVFTTVYAEITPGL; VFTTVYAEITPGLQ; FTTVYAEITPGLQA; TTVYAEITPGLQAQ;<br>TVYAEITPGLQAQR; VYAEITPGLQAQRE; YAEITPGLQAQREQ;<br>AEITPGLQAQREQL; EITPGLQAQREQLR; ITPGLQAQREQLRA;<br>TPGLQAQREQLRAE; PGLQAQREQLRAEL; GLQAQREQLRAELA;<br>LQAQREQLRAELAR; QAQREQLRAELART; AQREQLRAELARTD<br><br>15 mers:<br>MGEGSRRPSGMLMSV; GEGSRRPSGMLMSVD; EGSRRPSGMLMSVDL;<br>GSRRPSGMLMSVDLE; SRRPSGMLMSVDLEP; RRPSGMLMSVDLEPV;<br>RPSGMLMSVDLEPVQ; PSGMLMSVDLEPVQL; SGMLMSVDLEPVQLV;<br>GMLMSVDLEPVQLVG; MLMSVDLEPVQLVGP; LMSVDLEPVQLVGPD;<br>MSVDLEPVQLVGPDG; SVDLEPVQLVGPDGT; VDLEPVQLVGPDGTP;<br>DLEPVQLVGPDGTPT; LEPVQLVGPDGTPTA; EPVQLVGPDGTPTAE;<br>PVQLVGPDGTPTAER; VQLVGPDGTPTAERR; QLVGPDGTPTAERRY;<br>LVGPDGTPTAERRYH; VGPDGTPTAERRYHR; GPDGTPTAERRYHRD;<br>PDGTPTAERRYHRDL; DGTPTAERRYHRDLP; GTPTAERRYHRDLPE;<br>TPTAERRYHRDLPEE; PTAERRYHRDLPEET; TAERRYHRDLPEETL;<br>AERRYHRDLPEETLR; ERRYHRDLPEETLRW; RRYHRDLPEETLRWL;<br>RYHRDLPEETLRWLY; YHRDLPEETLRWLYE; HRDLPEETLRWLYEM;<br>RDLPEETLRWLYEMM; DLPEETLRWLYEMMV; LPEETLRWLYEMMVV;<br>PEETLRWLYEMMVVT; EETLRWLYEMMVVTR; ETLRWLYEMMVVTRE;<br>TLRWLYEMMVVTREL; LRWLYEMMVVTRELD; RWLYEMMVVTRELDT;<br>WLYEMMVVTRELDTE; LYEMMVVTRELDTEF; YEMMVVTRELDTEFV;<br>EMMVVTRELDTEFVN; MMVVTRELDTEFVNL; MVVTRELDTEFVNLQ;<br>VVTRELDTEFVNLQR; VTRELDTEFVNLQRQ; TRELDTEFVNLQRQG;<br>RELDTEFVNLQRQGE; ELDTEFVNLQRQGEL; LDTEFVNLQRQGELA;<br>DTEFVNLQRQGELAL; TEFVNLQRQGELALY; EFVNLQRQGELALYT;<br>FVNLQRQGELALYTP; VNLQRQGELALYTPC; NLQRQGELALYTPCR;<br>LQRQGELALYTPCRG; QRQGELALYTPCRGQ; RQGELALYTPCRGQE;<br>QGELALYTPCRGQEA; GELALYTPCRGQEAA; ELALYTPCRGQEAAQ;<br>LALYTPCRGQEAAQV; ALYTPCRGQEAAQVG; LYTPCRGQEAAQVGA;<br>YTPCRGQEAAQVGAA; TPCRGQEAAQVGAAA; PCRGQEAAQVGAAAC;<br>CRGQEAAQVGAAACL; RGQEAAQVGAAACLR; GQEAAQVGAAACLRK;<br>QEAAQVGAAACLRKT; EAAQVGAAACLRKTD; AAQVGAAACLRKTDW;<br>AQVGAAACLRKTDWL; QVGAAACLRKTDWLF; VGAAACLRKTDWLFP;<br>GAAACLRKTDWLFPQ; AAACLRKTDWLFPQY; AACLRKTDWLFPQYR;<br>ACLRKTDWLFPQYRE; CLRKTDWLFPQYREL; LRKTDWLFPQYRELG;<br>RKTDWLFPQYRELGV; KTDWLFPQYRELGVY; TDWLFPQYRELGVYL;<br>DWLFPQYRELGVYLV; WLFPQYRELGVYLVR; LFPQYRELGVYLVRG;<br>FPQYRELGVYLVRGI; PQYRELGVYLVRGIP; QYRELGVYLVRGIPP;<br>YRELGVYLVRGIPPG; RELGVYLVRGIPPGH; ELGVYLVRGIPPGHV;<br>LGVYLVRGIPPGHVG; GVYLVRGIPPGHVGV; VYLVRGIPPGHVGVA;<br>YLVRGIPPGHVGVAW; LVRGIPPGHVGVAWR; VRGIPPGHVGVAWRG;<br>RGIPPGHVGVAWRGT; GIPPGHVGVAWRGTW; IPPGHVGVAWRGTWH;<br>PPGHVGVAWRGTWHG; PGHVGVAWRGTWHGG; GHVGVAWRGTWHGGL;<br>HVGVAWRGTWHGGLQ; VGVAWRGTWHGGLQF; GVAWRGTWHGGLQFT;<br>VAWRGTWHGGLQFTT; AWRGTWHGGLQFTTK; WRGTWHGGLQFTTKC; | |

Fig. 29 continued

| | | |
|---|---|---|
| | RGTWHGGLQFTTKCC; GTWHGGLQFTTKCCA; TWHGGLQFTTKCCAP; WHGGLQFTTKCCAPM; HGGLQFTTKCCAPMS; GGLQFTTKCCAPMSV; GLQFTTKCCAPMSVP; LQFTTKCCAPMSVPI; QFTTKCCAPMSVPIG; FTTKCCAPMSVPIGT; TTKCCAPMSVPIGTQ; TKCCAPMSVPIGTQT; KCCAPMSVPIGTQTL; CCAPMSVPIGTQTLH; CAPMSVPIGTQTLHA; APMSVPIGTQTLHAV; PMSVPIGTQTLHAVG; MSVPIGTQTLHAVGA; SVPIGTQTLHAVGAA; VPIGTQTLHAVGAAM; PIGTQTLHAVGAAMA; IGTQTLHAVGAAMAA; GTQTLHAVGAAMAAQ; TQTLHAVGAAMAAQR; QTLHAVGAAMAAQRL; TLHAVGAAMAAQRLD; LHAVGAAMAAQRLDE; HAVGAAMAAQRLDED; AVGAAMAAQRLDEDS; VGAAMAAQRLDEDSV; GAAMAAQRLDEDSVT; AAMAAQRLDEDSVTV; AMAAQRLDEDSVTVA; MAAQRLDEDSVTVAF; AAQRLDEDSVTVAFL; AQRLDEDSVTVAFLG; QRLDEDSVTVAFLGD; RLDEDSVTVAFLGDG; LDEDSVTVAFLGDGA; DEDSVTVAFLGDGAT; EDSVTVAFLGDGATS; DSVTVAFLGDGATSE; SVTVAFLGDGATSEG; VTVAFLGDGATSEGD; TVAFLGDGATSEGDV; VAFLGDGATSEGDVH; AFLGDGATSEGDVHE; FLGDGATSEGDVHEA; LGDGATSEGDVHEAL; GDGATSEGDVHEALN; DGATSEGDVHEALNF; GATSEGDVHEALNFA; ATSEGDVHEALNFAA; TSEGDVHEALNFAAV; SEGDVHEALNFAAVF; EGDVHEALNFAAVFT; GDVHEALNFAAVFTT; DVHEALNFAAVFTTP; VHEALNFAAVFTTPC; HEALNFAAVFTTPCV; EALNFAAVFTTPCVF; ALNFAAVFTTPCVFY; LNFAAVFTTPCVFYV; NFAAVFTTPCVFYVQ; FAAVFTTPCVFYVQN; AAVFTTPCVFYVQNN; AVFTTPCVFYVQNNQ; VFTTPCVFYVQNNQW; FTTPCVFYVQNNQWA; TTPCVFYVQNNQWAI; TPCVFYVQNNQWAIS; PCVFYVQNNQWAISM; CVFYVQNNQWAISMP; VFYVQNNQWAISMPV; FYVQNNQWAISMPVS; YVQNNQWAISMPVSR; VQNNQWAISMPVSRQ; QNNQWAISMPVSRQT; NNQWAISMPVSRQTA; NQWAISMPVSRQTAA; QWAISMPVSRQTAAP; WAISMPVSRQTAAPS; AISMPVSRQTAAPSI; ISMPVSRQTAAPSIA; SMPVSRQTAAPSIAH; MPVSRQTAAPSIAHK; PVSRQTAAPSIAHKA; VSRQTAAPSIAHKAI; SRQTAAPSIAHKAIG; RQTAAPSIAHKAIGY; QTAAPSIAHKAIGYG; TAAPSIAHKAIGYGM; AAPSIAHKAIGYGMP; APSIAHKAIGYGMPG; PSIAHKAIGYGMPGI; SIAHKAIGYGMPGIR; IAHKAIGYGMPGIRV; AHKAIGYGMPGIRVD; HKAIGYGMPGIRVDG; KAIGYGMPGIRVDGN; AIGYGMPGIRVDGND; IGYGMPGIRVDGNDV; GYGMPGIRVDGNDVL; YGMPGIRVDGNDVLA; GMPGIRVDGNDVLAC; MPGIRVDGNDVLACY; PGIRVDGNDVLACYA; GIRVDGNDVLACYAV; IRVDGNDVLACYAVM; RVDGNDVLACYAVMA; VDGNDVLACYAVMAE; DGNDVLACYAVMAEA; GNDVLACYAVMAEAA; NDVLACYAVMAEAAA; DVLACYAVMAEAAAR; VLACYAVMAEAAARA; LACYAVMAEAAARAR; ACYAVMAEAAARARA; CYAVMAEAAARARAG; YAVMAEAAARARAGD; AVMAEAAARARAGDG; VMAEAAARARAGDGP; MAEAAARARAGDGPT; AEAAARARAGDGPTL; EAAARARAGDGPTLI; AAARARAGDGPTLIE; AARARAGDGPTLIEA; ARARAGDGPTLIEAV; RARAGDGPTLIEAVT; ARAGDGPTLIEAVTY; RAGDGPTLIEAVTYR; AGDGPTLIEAVTYRL; GDGPTLIEAVTYRLG; DGPTLIEAVTYRLGP; GPTLIEAVTYRLGPH; PTLIEAVTYRLGPHT; TLIEAVTYRLGPHTT; LIEAVTYRLGPHTTA; IEAVTYRLGPHTTAD; EAVTYRLGPHTTADD; AVTYRLGPHTTADDP; VTYRLGPHTTADDPT; TYRLGPHTTADDPTR; YRLGPHTTADDPTRY; RLGPHTTADDPTRYR; LGPHTTADDPTRYRS; GPHTTADDPTRYRSQ; PHTTADDPTRYRSQE; HTTADDPTRYRSQEE; TTADDPTRYRSQEEV; TADDPTRYRSQEEVD; ADDPTRYRSQEEVDR; DDPTRYRSQEEVDRW; DPTRYRSQEEVDRWA; PTRYRSQEEVDRWAT; TRYRSQEEVDRWATL; RYRSQEEVDRWATLD; YRSQEEVDRWATLDP; RSQEEVDRWATLDPI; | |

Fig. 29 continued

| | | |
|---|---|---|
| | SQEEVDRWATLDPIP; QEEVDRWATLDPIPR; EEVDRWATLDPIPRY;<br>EVDRWATLDPIPRYR; VDRWATLDPIPRYRT; DRWATLDPIPRYRTY;<br>RWATLDPIPRYRTYL; WATLDPIPRYRTYLQ; ATLDPIPRYRTYLQD;<br>TLDPIPRYRTYLQDQ; LDPIPRYRTYLQDQG; DPIPRYRTYLQDQGL;<br>PIPRYRTYLQDQGLW; IPRYRTYLQDQGLWS; PRYRTYLQDQGLWSQ;<br>RYRTYLQDQGLWSQR; YRTYLQDQGLWSQRL; RTYLQDQGLWSQRLE;<br>TYLQDQGLWSQRLEE; YLQDQGLWSQRLEEQ; LQDQGLWSQRLEEQV;<br>QDQGLWSQRLEEQVT; DQGLWSQRLEEQVTA; QGLWSQRLEEQVTAR;<br>GLWSQRLEEQVTARA; LWSQRLEEQVTARAK; WSQRLEEQVTARAKH;<br>SQRLEEQVTARAKHV; QRLEEQVTARAKHVR; RLEEQVTARAKHVRS;<br>LEEQVTARAKHVRSE; EEQVTARAKHVRSEL; EQVTARAKHVRSELR;<br>QVTARAKHVRSELRD; VTARAKHVRSELRDA; TARAKHVRSELRDAV;<br>ARAKHVRSELRDAVF; RAKHVRSELRDAVFD; AKHVRSELRDAVFDA;<br>KHVRSELRDAVFDAP; HVRSELRDAVFDAPD; VRSELRDAVFDAPDF;<br>RSELRDAVFDAPDFD; SELRDAVFDAPDFDV; ELRDAVFDAPDFDVD;<br>LRDAVFDAPDFDVDE; RDAVFDAPDFDVDEV; DAVFDAPDFDVDEVF;<br>AVFDAPDFDVDEVFT; VFDAPDFDVDEVFTT; FDAPDFDVDEVFTTV;<br>DAPDFDVDEVFTTVY; APDFDVDEVFTTVYA; PDFDVDEVFTTVYAE;<br>DFDVDEVFTTVYAEI; FDVDEVFTTVYAEIT; DVDEVFTTVYAEITP;<br>VDEVFTTVYAEITPG; DEVFTTVYAEITPGL; EVFTTVYAEITPGLQ;<br>VFTTVYAEITPGLQA; FTTVYAEITPGLQAQ; TTVYAEITPGLQAQR;<br>TVYAEITPGLQAQRE; VYAEITPGLQAQREQ; YAEITPGLQAQREQL;<br>AEITPGLQAQREQLR; EITPGLQAQREQLRA; ITPGLQAQREQLRAE;<br>TPGLQAQREQLRAEL; PGLQAQREQLRAELA; GLQAQREQLRAELAR;<br>LQAQREQLRAELART; QAQREQLRAELARTD<br><br>16 mers:<br>MGEGSRRPSGMLMSVD; GEGSRRPSGMLMSVDL; EGSRRPSGMLMSVDLE;<br>GSRRPSGMLMSVDLEP; SRRPSGMLMSVDLEPV; RRPSGMLMSVDLEPVQ;<br>RPSGMLMSVDLEPVQL; PSGMLMSVDLEPVQLV; SGMLMSVDLEPVQLVG;<br>GMLMSVDLEPVQLVGP; MLMSVDLEPVQLVGPD; LMSVDLEPVQLVGPDG;<br>MSVDLEPVQLVGPDGT; SVDLEPVQLVGPDGTP; VDLEPVQLVGPDGTPT;<br>DLEPVQLVGPDGTPTA; LEPVQLVGPDGTPTAE; EPVQLVGPDGTPTAER;<br>PVQLVGPDGTPTAERR; VQLVGPDGTPTAERRY; QLVGPDGTPTAERRYH;<br>LVGPDGTPTAERRYHR; VGPDGTPTAERRYHRD; GPDGTPTAERRYHRDL;<br>PDGTPTAERRYHRDLP; DGTPTAERRYHRDLPE; GTPTAERRYHRDLPEE;<br>TPTAERRYHRDLPEET; PTAERRYHRDLPEETL; TAERRYHRDLPEETLR;<br>AERRYHRDLPEETLRW; ERRYHRDLPEETLRWL; RRYHRDLPEETLRWLY;<br>RYHRDLPEETLRWLYE; YHRDLPEETLRWLYEM; HRDLPEETLRWLYEMM;<br>RDLPEETLRWLYEMMV; DLPEETLRWLYEMMVV; LPEETLRWLYEMMVVT;<br>PEETLRWLYEMMVVTR; EETLRWLYEMMVVTRE; ETLRWLYEMMVVTREL;<br>TLRWLYEMMVVTRELD; LRWLYEMMVVTRELDT; RWLYEMMVVTRELDTE;<br>WLYEMMVVTRELDTEF; LYEMMVVTRELDTEFV; YEMMVVTRELDTEFVN;<br>EMMVVTRELDTEFVNL; MMVVTRELDTEFVNLQ; MVVTRELDTEFVNLQR;<br>VVTRELDTEFVNLQRQ; VTRELDTEFVNLQRQG; TRELDTEFVNLQRQGE;<br>RELDTEFVNLQRQGEL; ELDTEFVNLQRQGELA; LDTEFVNLQRQGELAL;<br>DTEFVNLQRQGELALY; TEFVNLQRQGELALYT; EFVNLQRQGELALYTP;<br>FVNLQRQGELALYTPC; VNLQRQGELALYTPCR; NLQRQGELALYTPCRG;<br>LQRQGELALYTPCRGQ; QRQGELALYTPCRGQE; RQGELALYTPCRGQEA;<br>QGELALYTPCRGQEAA; GELALYTPCRGQEAAQ; ELALYTPCRGQEAAQV;<br>LALYTPCRGQEAAQVG; ALYTPCRGQEAAQVGA; LYTPCRGQEAAQVGAA;<br>YTPCRGQEAAQVGAAA; TPCRGQEAAQVGAAAC; PCRGQEAAQVGAAACL;<br>CRGQEAAQVGAAACLR; RGQEAAQVGAAACLRK; GQEAAQVGAAACLRKT; | |

Fig. 29 continued

| | | | |
|---|---|---|---|
| | QEAAQVGAAACLRKTD; EAAQVGAAACLRKTDW; AAQVGAAACLRKTDWL;<br>AQVGAAACLRKTDWLF; QVGAAACLRKTDWLFP; VGAAACLRKTDWLFPQ;<br>GAAACLRKTDWLFPQY; AAACLRKTDWLFPQYR; AACLRKTDWLFPQYRE;<br>ACLRKTDWLFPQYREL; CLRKTDWLFPQYRELG; LRKTDWLFPQYRELGV;<br>RKTDWLFPQYRELGVY; KTDWLFPQYRELGVYL; TDWLFPQYRELGVYLV;<br>DWLFPQYRELGVYLVR; WLFPQYRELGVYLVRG; LFPQYRELGVYLVRGI;<br>FPQYRELGVYLVRGIP; PQYRELGVYLVRGIPP; QYRELGVYLVRGIPPG;<br>YRELGVYLVRGIPPGH; RELGVYLVRGIPPGHV; ELGVYLVRGIPPGHVG;<br>LGVYLVRGIPPGHVGV; GVYLVRGIPPGHVGVA; VYLVRGIPPGHVGVAW;<br>YLVRGIPPGHVGVAWR; LVRGIPPGHVGVAWRG; VRGIPPGHVGVAWRGT;<br>RGIPPGHVGVAWRGTW; GIPPGHVGVAWRGTWH; IPPGHVGVAWRGTWHG;<br>PPGHVGVAWRGTWHGG; PGHVGVAWRGTWHGGL; GHVGVAWRGTWHGGLQ;<br>HVGVAWRGTWHGGLQF; VGVAWRGTWHGGLQFT; GVAWRGTWHGGLQFTT;<br>VAWRGTWHGGLQFTTK; AWRGTWHGGLQFTTKC; WRGTWHGGLQFTTKCC;<br>RGTWHGGLQFTTKCCA; GTWHGGLQFTTKCCAP; TWHGGLQFTTKCCAPM;<br>WHGGLQFTTKCCAPMS; HGGLQFTTKCCAPMSV; GGLQFTTKCCAPMSVP;<br>GLQFTTKCCAPMSVPI; LQFTTKCCAPMSVPIG; QFTTKCCAPMSVPIGT;<br>FTTKCCAPMSVPIGTQ; TTKCCAPMSVPIGTQT; TKCCAPMSVPIGTQTL;<br>KCCAPMSVPIGTQTLH; CCAPMSVPIGTQTLHA; CAPMSVPIGTQTLHAV;<br>APMSVPIGTQTLHAVG; PMSVPIGTQTLHAVGA; MSVPIGTQTLHAVGAA;<br>SVPIGTQTLHAVGAAM; VPIGTQTLHAVGAAMA; PIGTQTLHAVGAAMAA;<br>IGTQTLHAVGAAMAAQ; GTQTLHAVGAAMAAQR; TQTLHAVGAAMAAQRL;<br>QTLHAVGAAMAAQRLD; TLHAVGAAMAAQRLDE; LHAVGAAMAAQRLDED;<br>HAVGAAMAAQRLDEDS; AVGAAMAAQRLDEDSV; VGAAMAAQRLDEDSVT;<br>GAAMAAQRLDEDSVTV; AAMAAQRLDEDSVTVA; AMAAQRLDEDSVTVAF;<br>MAAQRLDEDSVTVAFL; AAQRLDEDSVTVAFLG; AQRLDEDSVTVAFLGD;<br>QRLDEDSVTVAFLGDG; RLDEDSVTVAFLGDGA; LDEDSVTVAFLGDGAT;<br>DEDSVTVAFLGDGATS; EDSVTVAFLGDGATSE; DSVTVAFLGDGATSEG;<br>SVTVAFLGDGATSEGD; VTVAFLGDGATSEGDV; TVAFLGDGATSEGDVH;<br>VAFLGDGATSEGDVHE; AFLGDGATSEGDVHEA; FLGDGATSEGDVHEAL;<br>LGDGATSEGDVHEALN; GDGATSEGDVHEALNF; DGATSEGDVHEALNFA;<br>GATSEGDVHEALNFAA; ATSEGDVHEALNFAAV; TSEGDVHEALNFAAVF;<br>SEGDVHEALNFAAVFT; EGDVHEALNFAAVFTT; GDVHEALNFAAVFTTP;<br>DVHEALNFAAVFTTPC; VHEALNFAAVFTTPCV; HEALNFAAVFTTPCVF;<br>EALNFAAVFTTPCVFY; ALNFAAVFTTPCVFYV; LNFAAVFTTPCVFYVQ;<br>NFAAVFTTPCVFYVQN; FAAVFTTPCVFYVQNN; AAVFTTPCVFYVQNNQ;<br>AVFTTPCVFYVQNNQW; VFTTPCVFYVQNNQWA; FTTPCVFYVQNNQWAI;<br>TTPCVFYVQNNQWAIS; TPCVFYVQNNQWAISM; PCVFYVQNNQWAISMP;<br>CVFYVQNNQWAISMPV; VFYVQNNQWAISMPVS; FYVQNNQWAISMPVSR;<br>YVQNNQWAISMPVSRQ; VQNNQWAISMPVSRQT; QNNQWAISMPVSRQTA;<br>NNQWAISMPVSRQTAA; NQWAISMPVSRQTAAP; QWAISMPVSRQTAAPS;<br>WAISMPVSRQTAAPSI; AISMPVSRQTAAPSIA; ISMPVSRQTAAPSIAH;<br>SMPVSRQTAAPSIAHK; MPVSRQTAAPSIAHKA; PVSRQTAAPSIAHKAI;<br>VSRQTAAPSIAHKAIG; SRQTAAPSIAHKAIGY; RQTAAPSIAHKAIGYG;<br>QTAAPSIAHKAIGYGM; TAAPSIAHKAIGYGMP; AAPSIAHKAIGYGMPG;<br>APSIAHKAIGYGMPGI; PSIAHKAIGYGMPGIR; SIAHKAIGYGMPGIRV;<br>IAHKAIGYGMPGIRVD; AHKAIGYGMPGIRVDG; HKAIGYGMPGIRVDGN;<br>KAIGYGMPGIRVDGND; AIGYGMPGIRVDGNDV; IGYGMPGIRVDGNDVL;<br>GYGMPGIRVDGNDVLA; YGMPGIRVDGNDVLAC; GMPGIRVDGNDVLACY;<br>MPGIRVDGNDVLACYA; PGIRVDGNDVLACYAV; GIRVDGNDVLACYAVM;<br>IRVDGNDVLACYAVMA; RVDGNDVLACYAVMAE; VDGNDVLACYAVMAEA;<br>DGNDVLACYAVMAEAA; GNDVLACYAVMAEAAA; NDVLACYAVMAEAAAR;<br>DVLACYAVMAEAAARA; VLACYAVMAEAAARAR; LACYAVMAEAAARARA; | |

Fig. 29 continued

| | | |
|---|---|---|
| | ACYAVMAEAAARARAG; CYAVMAEAAARARAGD; YAVMAEAAARARAGDG; AVMAEAAARARAGDGP; VMAEAAARARAGDGPT; MAEAAARARAGDGPTL; AEAAARARAGDGPTLI; EAAARARAGDGPTLIE; AAARARAGDGPTLIEA; AARARAGDGPTLIEAV; ARARAGDGPTLIEAVT; RARAGDGPTLIEAVTY; ARAGDGPTLIEAVTYR; RAGDGPTLIEAVTYRL; AGDGPTLIEAVTYRLG; GDGPTLIEAVTYRLGP; DGPTLIEAVTYRLGPH; GPTLIEAVTYRLGPHT; PTLIEAVTYRLGPHTT; TLIEAVTYRLGPHTTA; LIEAVTYRLGPHTTAD; IEAVTYRLGPHTTADD; EAVTYRLGPHTTADDP; AVTYRLGPHTTADDPT; VTYRLGPHTTADDPTR; TYRLGPHTTADDPTRY; YRLGPHTTADDPTRYR; RLGPHTTADDPTRYRS; LGPHTTADDPTRYRSQ; GPHTTADDPTRYRSQE; PHTTADDPTRYRSQEE; HTTADDPTRYRSQEEV; TTADDPTRYRSQEEVD; TADDPTRYRSQEEVDR; ADDPTRYRSQEEVDRW; DDPTRYRSQEEVDRWA; DPTRYRSQEEVDRWAT; PTRYRSQEEVDRWATL; TRYRSQEEVDRWATLD; RYRSQEEVDRWATLDP; YRSQEEVDRWATLDPI; RSQEEVDRWATLDPIP; SQEEVDRWATLDPIPR; QEEVDRWATLDPIPRY; EEVDRWATLDPIPRYR; EVDRWATLDPIPRYRT; VDRWATLDPIPRYRTY; DRWATLDPIPRYRTYL; RWATLDPIPRYRTYLQ; WATLDPIPRYRTYLQD; ATLDPIPRYRTYLQDQ; TLDPIPRYRTYLQDQG; LDPIPRYRTYLQDQGL; DPIPRYRTYLQDQGLW; PIPRYRTYLQDQGLWS; IPRYRTYLQDQGLWSQ; PRYRTYLQDQGLWSQR; RYRTYLQDQGLWSQRL; YRTYLQDQGLWSQRLE; RTYLQDQGLWSQRLEE; TYLQDQGLWSQRLEEQ; YLQDQGLWSQRLEEQV; LQDQGLWSQRLEEQVT; QDQGLWSQRLEEQVTA; DQGLWSQRLEEQVTAR; QGLWSQRLEEQVTARA; GLWSQRLEEQVTARAK; LWSQRLEEQVTARAKH; WSQRLEEQVTARAKHV; SQRLEEQVTARAKHVR; QRLEEQVTARAKHVRS; RLEEQVTARAKHVRSE; LEEQVTARAKHVRSEL; EEQVTARAKHVRSELR; EQVTARAKHVRSELRD; QVTARAKHVRSELRDA; VTARAKHVRSELRDAV; TARAKHVRSELRDAVF; ARAKHVRSELRDAVFD; RAKHVRSELRDAVFDA; AKHVRSELRDAVFDAP; KHVRSELRDAVFDAPD; HVRSELRDAVFDAPDF; VRSELRDAVFDAPDFD; RSELRDAVFDAPDFDV; SELRDAVFDAPDFDVD; ELRDAVFDAPDFDVDE; LRDAVFDAPDFDVDEV; RDAVFDAPDFDVDEVF; DAVFDAPDFDVDEVFT; AVFDAPDFDVDEVFTT; VFDAPDFDVDEVFTTV; FDAPDFDVDEVFTTVY; DAPDFDVDEVFTTVYA; APDFDVDEVFTTVYAE; PDFDVDEVFTTVYAEI; DFDVDEVFTTVYAEIT; FDVDEVFTTVYAEITP; DVDEVFTTVYAEITPG; VDEVFTTVYAEITPGL; DEVFTTVYAEITPGLQ; EVFTTVYAEITPGLQA; VFTTVYAEITPGLQAQ; FTTVYAEITPGLQAQR; TTVYAEITPGLQAQRE; TVYAEITPGLQAQREQ; VYAEITPGLQAQREQL; YAEITPGLQAQREQLR; AEITPGLQAQREQLRA; EITPGLQAQREQLRAE; ITPGLQAQREQLRAEL; TPGLQAQREQLRAELA; PGLQAQREQLRAELAR; GLQAQREQLRAELART; LQAQREQLRAELARTD | |
| 40) Rv2517c | 13 mers: MNSAIIKIAKWAQ; NSAIIKIAKWAQS; SAIIKIAKWAQSQ; AIIKIAKWAQSQQ; IIKIAKWAQSQQW; IKIAKWAQSQQWT; KIAKWAQSQQWTV; IAKWAQSQQWTVE; AKWAQSQQWTVED; KWAQSQQWTVEDD; WAQSQQWTVEDDA; AQSQQWTVEDDAS; QSQQWTVEDDASG; SQQWTVEDDASGY; QQWTVEDDASGYT; QWTVEDDASGYTR; WTVEDDASGYTRF; TVEDDASGYTRFY; VEDDASGYTRFYN; EDDASGYTRFYNP; DDASGYTRFYNPQ; DASGYTRFYNPQG; ASGYTRFYNPQGV; SGYTRFYNPQGVY; GYTRFYNPQGVYI; YTRFYNPQGVYIA; TRFYNPQGVYIAR; RFYNPQGVYIARF; FYNPQGVYIARFP; YNPQGVYIARFPA; NPQGVYIARFPAT; PQGVYIARFPATP; QGVYIARFPATPS; GVYIARFPATPSN; VYIARFPATPSNE; YIARFPATPSNEY; IARFPATPSNEYR; ARFPATPSNEYRR; RFPATPSNEYRRM; FPATPSNEYRRMR; PATPSNEYRRMRD; ATPSNEYRRMRDL; TPSNEYRRMRDLL; PSNEYRRMRDLLG; SNEYRRMRDLLGA; | 89982-90259 |

Fig. 29 continued

| | | |
|---|---|---|
| | NEYRRMRDLLGAL; EYRRMRDLLGALK; YRRMRDLLGALKK; RRMRDLLGALKKA; RMRDLLGALKKAG; MRDLLGALKKAGL; RDLLGALKKAGLT; DLLGALKKAGLTW; LLGALKKAGLTWP; LGALKKAGLTWPP; GALKKAGLTWPPP; ALKKAGLTWPPPS; LKKAGLTWPPPSK; KKAGLTWPPPSKK; KAGLTWPPPSKKE; AGLTWPPPSKKER; GLTWPPPSKKERR; LTWPPPSKKERRA; TWPPPSKKERRAQ; WPPPSKKERRAQH; PPPSKKERRAQHR; PPSKKERRAQHRK; PSKKERRAQHRKE; SKKERRAQHRKEG; KKERRAQHRKEGA; KERRAQHRKEGAQ<br><br>14 mers:<br>MNSAIIKIAKWAQS; NSAIIKIAKWAQSQ; SAIIKIAKWAQSQQ; AIIKIAKWAQSQQW; IIKIAKWAQSQQWT; IKIAKWAQSQQWTV; KIAKWAQSQQWTVE; IAKWAQSQQWTVED; AKWAQSQQWTVEDD; KWAQSQQWTVEDDA; WAQSQQWTVEDDAS; AQSQQWTVEDDASG; QSQQWTVEDDASGY; SQQWTVEDDASGYT; QQWTVEDDASGYTR; QWTVEDDASGYTRF; WTVEDDASGYTRFY; TVEDDASGYTRFYN; VEDDASGYTRFYNP; EDDASGYTRFYNPQ; DDASGYTRFYNPQG; DASGYTRFYNPQGV; ASGYTRFYNPQGVY; SGYTRFYNPQGVYI; GYTRFYNPQGVYIA; YTRFYNPQGVYIAR; TRFYNPQGVYIARF; RFYNPQGVYIARFP; FYNPQGVYIARFPA; YNPQGVYIARFPAT; NPQGVYIARFPATP; PQGVYIARFPATPS; QGVYIARFPATPSN; GVYIARFPATPSNE; VYIARFPATPSNEY; YIARFPATPSNEYR; IARFPATPSNEYRR; ARFPATPSNEYRRM; RFPATPSNEYRRMR; FPATPSNEYRRMRD; PATPSNEYRRMRDL; ATPSNEYRRMRDLL; TPSNEYRRMRDLLG; PSNEYRRMRDLLGA; SNEYRRMRDLLGAL; NEYRRMRDLLGALK; EYRRMRDLLGALKK; YRRMRDLLGALKKA; RRMRDLLGALKKAG; RMRDLLGALKKAGL; MRDLLGALKKAGLT; RDLLGALKKAGLTW; DLLGALKKAGLTWP; LLGALKKAGLTWPP; LGALKKAGLTWPPP; GALKKAGLTWPPPS; ALKKAGLTWPPPSK; LKKAGLTWPPPSKK; KKAGLTWPPPSKKE; KAGLTWPPPSKKER; AGLTWPPPSKKERR; GLTWPPPSKKERRA; LTWPPPSKKERRAQ; TWPPPSKKERRAQH; WPPPSKKERRAQHR; PPPSKKERRAQHRK; PPSKKERRAQHRKE; PSKKERRAQHRKEG; SKKERRAQHRKEGA; KKERRAQHRKEGAQ<br><br>15 mers:<br>MNSAIIKIAKWAQSQ; NSAIIKIAKWAQSQQ; SAIIKIAKWAQSQQW; AIIKIAKWAQSQQWT; IIKIAKWAQSQQWTV; IKIAKWAQSQQWTVE; KIAKWAQSQQWTVED; IAKWAQSQQWTVEDD; AKWAQSQQWTVEDDA; KWAQSQQWTVEDDAS; WAQSQQWTVEDDASG; AQSQQWTVEDDASGY; QSQQWTVEDDASGYT; SQQWTVEDDASGYTR; QQWTVEDDASGYTRF; QWTVEDDASGYTRFY; WTVEDDASGYTRFYN; TVEDDASGYTRFYNP; VEDDASGYTRFYNPQ; EDDASGYTRFYNPQG; DDASGYTRFYNPQGV; DASGYTRFYNPQGVY; ASGYTRFYNPQGVYI; SGYTRFYNPQGVYIA; GYTRFYNPQGVYIAR; YTRFYNPQGVYIARF; TRFYNPQGVYIARFP; RFYNPQGVYIARFPA; FYNPQGVYIARFPAT; YNPQGVYIARFPATP; NPQGVYIARFPATPS; PQGVYIARFPATPSN; QGVYIARFPATPSNE; GVYIARFPATPSNEY; VYIARFPATPSNEYR; YIARFPATPSNEYRR; IARFPATPSNEYRRM; ARFPATPSNEYRRMR; RFPATPSNEYRRMRD; FPATPSNEYRRMRDL; PATPSNEYRRMRDLL; ATPSNEYRRMRDLLG; TPSNEYRRMRDLLGA; PSNEYRRMRDLLGAL; SNEYRRMRDLLGALK; NEYRRMRDLLGALKK; EYRRMRDLLGALKKA; YRRMRDLLGALKKAG; RRMRDLLGALKKAGL; RMRDLLGALKKAGLT; MRDLLGALKKAGLTW; RDLLGALKKAGLTWP; DLLGALKKAGLTWPP; LLGALKKAGLTWPPP; | |

Fig. 29 continued

| | | |
|---|---|---|
| | LGALKKAGLTWPPPS; GALKKAGLTWPPPSK; ALKKAGLTWPPPSKK; LKKAGLTWPPPSKKE; KKAGLTWPPPSKKER; KAGLTWPPPSKKERR; AGLTWPPPSKKERRA; GLTWPPPSKKERRAQ; LTWPPPSKKERRAQH; TWPPPSKKERRAQHR; WPPPSKKERRAQHRK; PPPSKKERRAQHRKE; PPSKKERRAQHRKEG; PSKKERRAQHRKEGA; SKKERRAQHRKEGAQ<br><br>16 mers:<br>MNSAIIKIAKWAQSQQ; NSAIIKIAKWAQSQQW; SAIIKIAKWAQSQQWT; AIIKIAKWAQSQQWTV; IIKIAKWAQSQQWTVE; IKIAKWAQSQQWTVED; KIAKWAQSQQWTVEDD; IAKWAQSQQWTVEDDA; AKWAQSQQWTVEDDAS; KWAQSQQWTVEDDASG; WAQSQQWTVEDDASGY; AQSQQWTVEDDASGYT; QSQQWTVEDDASGYTR; SQQWTVEDDASGYTRF; QQWTVEDDASGYTRFY; QWTVEDDASGYTRFYN; WTVEDDASGYTRFYNP; TVEDDASGYTRFYNPQ; VEDDASGYTRFYNPQG; EDDASGYTRFYNPQGV; DDASGYTRFYNPQGVY; DASGYTRFYNPQGVYI; ASGYTRFYNPQGVYIA; SGYTRFYNPQGVYIAR; GYTRFYNPQGVYIARF; YTRFYNPQGVYIARFP; TRFYNPQGVYIARFPA; RFYNPQGVYIARFPAT; FYNPQGVYIARFPATP; YNPQGVYIARFPATPS; NPQGVYIARFPATPSN; PQGVYIARFPATPSNE; QGVYIARFPATPSNEY; GVYIARFPATPSNEYR; VYIARFPATPSNEYRR; YIARFPATPSNEYRRM; IARFPATPSNEYRRMR; ARFPATPSNEYRRMRD; RFPATPSNEYRRMRDL; FPATPSNEYRRMRDLL; PATPSNEYRRMRDLLG; ATPSNEYRRMRDLLGA; TPSNEYRRMRDLLGAL; PSNEYRRMRDLLGALK; SNEYRRMRDLLGALKK; NEYRRMRDLLGALKKA; EYRRMRDLLGALKKAG; YRRMRDLLGALKKAGL; RRMRDLLGALKKAGLT; RMRDLLGALKKAGLTW; MRDLLGALKKAGLTWP; RDLLGALKKAGLTWPP; DLLGALKKAGLTWPPP; LLGALKKAGLTWPPPS; LGALKKAGLTWPPPSK; GALKKAGLTWPPPSKK; ALKKAGLTWPPPSKKE; LKKAGLTWPPPSKKER; KKAGLTWPPPSKKERR; KAGLTWPPPSKKERRA; AGLTWPPPSKKERRAQ; GLTWPPPSKKERRAQH; LTWPPPSKKERRAQHR; TWPPPSKKERRAQHRK; WPPPSKKERRAQHRKE; PPPSKKERRAQHRKEG; PPSKKERRAQHRKEGA; PSKKERRAQHRKEGAQ | |
| 41) Rv2526 | 13 mers:<br>MTVKRTTIELDED; TVKRTTIELDEDL; VKRTTIELDEDLV; KRTTIELDEDLVR; RTTIELDEDLVRA; TTIELDEDLVRAA; TIELDEDLVRAAQ; IELDEDLVRAAQA; ELDEDLVRAAQAV; LDEDLVRAAQAVT; DEDLVRAAQAVTG; EDLVRAAQAVTGE; DLVRAAQAVTGET; LVRAAQAVTGETL; VRAAQAVTGETLR; RAAQAVTGETLRA; AAQAVTGETLRAT; AQAVTGETLRATV; QAVTGETLRATVE; AVTGETLRATVER; VTGETLRATVERA; TGETLRATVERAL; GETLRATVERALQ; ETLRATVERALQQ; TLRATVERALQQL; LRATVERALQQLV; RATVERALQQLVA; ATVERALQQLVAA; TVERALQQLVAAA; VERALQQLVAAAA; ERALQQLVAAAAE; RALQQLVAAAAEQ; ALQQLVAAAAEQA; LQQLVAAAAEQAA; QQLVAAAAEQAAA; QLVAAAAEQAAAR; LVAAAAEQAAARR; VAAAAEQAAARRR; AAAAEQAAARRRR; AAAEQAAARRRRI; AAEQAAARRRRIV; AEQAAARRRRIVD; EQAAARRRRIVDH; QAAARRRRIVDHL; AAARRRRIVDHLA; AARRRRIVDHLAH; ARRRRIVDHLAHA; RRRRIVDHLAHAG; RRRIVDHLAHAGT; RRIVDHLAHAGTH; RIVDHLAHAGTHV; IVDHLAHAGTHVD; VDHLAHAGTHVDA; DHLAHAGTHVDAD; HLAHAGTHVDADV; LAHAGTHVDADVL; AHAGTHVDADVLL; HAGTHVDADVLLS; AGTHVDADVLLSE; GTHVDADVLLSEQ; THVDADVLLSEQA; HVDADVLLSEQAW; VDADVLLSEQAWR<br><br>14 mers:<br>MTVKRTTIELDEDL; TVKRTTIELDEDLV; VKRTTIELDEDLVR; KRTTIELDEDLVRA; RTTIELDEDLVRAA; TTIELDEDLVRAAQ; TIELDEDLVRAAQA; IELDEDLVRAAQAV; ELDEDLVRAAQAVT; LDEDLVRAAQAVTG; DEDLVRAAQAVTGE; EDLVRAAQAVTGET; DLVRAAQAVTGETL; | 90260-90505 |

Fig. 29 continued

| | | | |
|---|---|---|---|
| | LVRAAQAVTGETLR; VRAAQAVTGETLRA; RAAQAVTGETLRAT; AAQAVTGETLRATV; AQAVTGETLRATVE; QAVTGETLRATVER; AVTGETLRATVERA; VTGETLRATVERAL; TGETLRATVERALQ; GETLRATVERALQQ; ETLRATVERALQQL; TLRATVERALQQLV; LRATVERALQQLVA; RATVERALQQLVAA; ATVERALQQLVAAA; TVERALQQLVAAAA; VERALQQLVAAAAE; ERALQQLVAAAAEQ; RALQQLVAAAAEQA; ALQQLVAAAAEQAA; LQQLVAAAAEQAAA; QQLVAAAAEQAAAR; QLVAAAAEQAAARR; LVAAAAEQAAARRR; VAAAAEQAAARRRR; AAAAEQAAARRRRI; AAAEQAAARRRRIV; AAEQAAARRRRIVD; AEQAAARRRRIVDH; EQAAARRRRIVDHL; QAAARRRRIVDHLA; AAARRRRIVDHLAH; AARRRRIVDHLAHA; ARRRRIVDHLAHAG; RRRRIVDHLAHAGT; RRRIVDHLAHAGTH; RRIVDHLAHAGTHV; RIVDHLAHAGTHVD; IVDHLAHAGTHVDA; VDHLAHAGTHVDAD; DHLAHAGTHVDADV; HLAHAGTHVDADVL; LAHAGTHVDADVLL; AHAGTHVDADVLLS; HAGTHVDADVLLSE; AGTHVDADVLLSEQ; GTHVDADVLLSEQA; THVDADVLLSEQAW; HVDADVLLSEQAWR<br><br>15 mers:<br>MTVKRTTIELDEDLV; TVKRTTIELDEDLVR; VKRTTIELDEDLVRA; KRTTIELDEDLVRAA; RTTIELDEDLVRAAQ; TTIELDEDLVRAAQA; TIELDEDLVRAAQAV; IELDEDLVRAAQAVT; ELDEDLVRAAQAVTG; LDEDLVRAAQAVTGE; DEDLVRAAQAVTGET; EDLVRAAQAVTGETL; DLVRAAQAVTGETLR; LVRAAQAVTGETLRA; VRAAQAVTGETLRAT; RAAQAVTGETLRATV; AAQAVTGETLRATVE; AQAVTGETLRATVER; QAVTGETLRATVERA; AVTGETLRATVERAL; VTGETLRATVERALQ; TGETLRATVERALQQ; GETLRATVERALQQL; ETLRATVERALQQLV; TLRATVERALQQLVA; LRATVERALQQLVAA; RATVERALQQLVAAA; ATVERALQQLVAAAA; TVERALQQLVAAAAE; VERALQQLVAAAAEQ; ERALQQLVAAAAEQA; RALQQLVAAAAEQAA; ALQQLVAAAAEQAAA; LQQLVAAAAEQAAAR; QQLVAAAAEQAAARR; QLVAAAAEQAAARRR; LVAAAAEQAAARRRR; VAAAAEQAAARRRRI; AAAAEQAAARRRRIV; AAAEQAAARRRRIVD; AAEQAAARRRRIVDH; AEQAAARRRRIVDHL; EQAAARRRRIVDHLA; QAAARRRRIVDHLAH; AAARRRRIVDHLAHA; AARRRRIVDHLAHAG; ARRRRIVDHLAHAGT; RRRRIVDHLAHAGTH; RRRIVDHLAHAGTHV; RRIVDHLAHAGTHVD; RIVDHLAHAGTHVDA; IVDHLAHAGTHVDAD; VDHLAHAGTHVDADV; DHLAHAGTHVDADVL; HLAHAGTHVDADVLL; LAHAGTHVDADVLLS; AHAGTHVDADVLLSE; HAGTHVDADVLLSEQ; AGTHVDADVLLSEQA; GTHVDADVLLSEQAW; THVDADVLLSEQAWR<br><br>16 mers:<br>MTVKRTTIELDEDLVR; TVKRTTIELDEDLVRA; VKRTTIELDEDLVRAA; KRTTIELDEDLVRAAQ; RTTIELDEDLVRAAQA; TTIELDEDLVRAAQAV; TIELDEDLVRAAQAVT; IELDEDLVRAAQAVTG; ELDEDLVRAAQAVTGE; LDEDLVRAAQAVTGET; DEDLVRAAQAVTGETL; EDLVRAAQAVTGETLR; DLVRAAQAVTGETLRA; LVRAAQAVTGETLRAT; VRAAQAVTGETLRATV; RAAQAVTGETLRATVE; AAQAVTGETLRATVER; AQAVTGETLRATVERA; QAVTGETLRATVERAL; AVTGETLRATVERALQ; VTGETLRATVERALQQ; TGETLRATVERALQQL; GETLRATVERALQQLV; ETLRATVERALQQLVA; TLRATVERALQQLVAA; LRATVERALQQLVAAA; RATVERALQQLVAAAA; ATVERALQQLVAAAAE; TVERALQQLVAAAAEQ; VERALQQLVAAAAEQA; ERALQQLVAAAAEQAA; RALQQLVAAAAEQAAA; ALQQLVAAAAEQAAAR; | |

Fig. 29 continued

| | | |
|---|---|---|
| | LQQLVAAAAEQAAARR; QQLVAAAAEQAAARRR; QLVAAAAEQAAARRRR; LVAAAAEQAAARRRRI; VAAAAEQAAARRRRIV; AAAAEQAAARRRRIVD; AAAEQAAARRRRIVDH; AAEQAAARRRRIVDHL; AEQAAARRRRIVDHLA; EQAAARRRRIVDHLAH; QAAARRRRIVDHLAHA; AAARRRRIVDHLAHAG; AARRRRIVDHLAHAGT; ARRRRIVDHLAHAGTH; RRRRIVDHLAHAGTHV; RRRIVDHLAHAGTHVD; RRIVDHLAHAGTHVDA; RIVDHLAHAGTHVDAD; IVDHLAHAGTHVDADV; VDHLAHAGTHVDADVL; DHLAHAGTHVDADVLL; HLAHAGTHVDADVLLS; LAHAGTHVDADVLLSE; AHAGTHVDADVLLSEQ; HAGTHVDADVLLSEQA; AGTHVDADVLLSEQAW; GTHVDADVLLSEQAWR | |
| 42) Rv2557 | 13 mers: MTGGATGALPRTM; TGGATGALPRTMK; GGATGALPRTMKE; GATGALPRTMKEG; ATGALPRTMKEGW; TGALPRTMKEGWI; GALPRTMKEGWIV; ALPRTMKEGWIVY; LPRTMKEGWIVYA; PRTMKEGWIVYAR; RTMKEGWIVYARS; TMKEGWIVYARST; MKEGWIVYARSTT; KEGWIVYARSTTI; EGWIVYARSTTIQ; GWIVYARSTTIQA; WIVYARSTTIQAQ; IVYARSTTIQAQS; VYARSTTIQAQSE; YARSTTIQAQSEC; ARSTTIQAQSECI; RSTTIQAQSECID; STTIQAQSECIDT; TTIQAQSECIDTG; TIQAQSECIDTGI; IQAQSECIDTGIA; QAQSECIDTGIAH; AQSECIDTGIAHV; QSECIDTGIAHVR; SECIDTGIAHVRD; ECIDTGIAHVRDV; CIDTGIAHVRDVV; IDTGIAHVRDVVM; DTGIAHVRDVVMP; TGIAHVRDVVMPA; GIAHVRDVVMPAL; IAHVRDVVMPALQ; AHVRDVVMPALQG; HVRDVVMPALQGM; VRDVVMPALQGMD; RDVVMPALQGMDG; DVVMPALQGMDGC; VVMPALQGMDGCI; VMPALQGMDGCIG; MPALQGMDGCIGV; PALQGMDGCIGVS; ALQGMDGCIGVSL; LQGMDGCIGVSLL; QGMDGCIGVSLLV; GMDGCIGVSLLVD; MDGCIGVSLLVDR; DGCIGVSLLVDRQ; GCIGVSLLVDRQS; CIGVSLLVDRQSG; IGVSLLVDRQSGR; GVSLLVDRQSGRC; VSLLVDRQSGRCI; SLLVDRQSGRCIA; LLVDRQSGRCIAT; LVDRQSGRCIATS; VDRQSGRCIATSA; DRQSGRCIATSAW; RQSGRCIATSAWE; QSGRCIATSAWET; SGRCIATSAWETA; GRCIATSAWETAE; RCIATSAWETAEA; CIATSAWETAEAM; IATSAWETAEAMH; ATSAWETAEAMHA; TSAWETAEAMHAS; SAWETAEAMHASR; AWETAEAMHASRE; WETAEAMHASREQ; ETAEAMHASREQV; TAEAMHASREQVT; AEAMHASREQVTP; EAMHASREQVTPI; AMHASREQVTPIR; MHASREQVTPIRD; HASREQVTPIRDR; ASREQVTPIRDRC; SREQVTPIRDRCA; REQVTPIRDRCAE; EQVTPIRDRCAEM; QVTPIRDRCAEMF; VTPIRDRCAEMFG; TPIRDRCAEMFGG; PIRDRCAEMFGGT; IRDRCAEMFGGTP; RDRCAEMFGGTPA; DRCAEMFGGTPAV; RCAEMFGGTPAVE; CAEMFGGTPAVEE; AEMFGGTPAVEEW; EMFGGTPAVEEWE; MFGGTPAVEEWEI; FGGTPAVEEWEIA; GGTPAVEEWEIAA; GTPAVEEWEIAAM; TPAVEEWEIAAMH; PAVEEWEIAAMHR; AVEEWEIAAMHRD; VEEWEIAAMHRDH; EEWEIAAMHRDHR; EWEIAAMHRDHRS; WEIAAMHRDHRSA; EIAAMHRDHRSAE; IAAMHRDHRSAEG; AAMHRDHRSAEGA; AMHRDHRSAEGAC; MHRDHRSAEGACV; HRDHRSAEGACVR; RDHRSAEGACVRA; DHRSAEGACVRAT; HRSAEGACVRATW; RSAEGACVRATWV; SAEGACVRATWVK; AEGACVRATWVKV; EGACVRATWVKVP; GACVRATWVKVPA; ACVRATWVKVPAD; CVRATWVKVPADQ; VRATWVKVPADQV; RATWVKVPADQVD; ATWVKVPADQVDQ; TWVKVPADQVDQG; WVKVPADQVDQGI; VKVPADQVDQGIE; KVPADQVDQGIEY; VPADQVDQGIEYY; PADQVDQGIEYYK; ADQVDQGIEYYKS; DQVDQGIEYYKSS; QVDQGIEYYKSSV; VDQGIEYYKSSVL; DQGIEYYKSSVLP; QGIEYYKSSVLPQ; GIEYYKSSVLPQI; IEYYKSSVLPQIE; EYYKSSVLPQIEG; YYKSSVLPQIEGL; YKSSVLPQIEGLD; KSSVLPQIEGLDG; SSVLPQIEGLDGF; SVLPQIEGLDGFC; VLPQIEGLDGFCS; LPQIEGLDGFCSA; PQIEGLDGFCSAS; | 90506-91347 |

Fig. 29 continued

| | | |
|---|---|---|
| | QIEGLDGFCSASL; IEGLDGFCSASLL; EGLDGFCSASLLV; GLDGFCSASLLVD; LDGFCSASLLVDR; DGFCSASLLVDRT; GFCSASLLVDRTS; FCSASLLVDRTSG; CSASLLVDRTSGR; SASLLVDRTSGRA; ASLLVDRTSGRAV; SLLVDRTSGRAVS; LLVDRTSGRAVSS; LVDRTSGRAVSSA; VDRTSGRAVSSAT; DRTSGRAVSSATF; RTSGRAVSSATFD; TSGRAVSSATFDS; SGRAVSSATFDSF; GRAVSSATFDSFD; RAVSSATFDSFDA; AVSSATFDSFDAM; VSSATFDSFDAME; SSATFDSFDAMER; SATFDSFDAMERN; ATFDSFDAMERNR; TFDSFDAMERNRD; FDSFDAMERNRDQ; DSFDAMERNRDQS; SFDAMERNRDQSN; FDAMERNRDQSNA; DAMERNRDQSNAL; AMERNRDQSNALK; MERNRDQSNALKA; ERNRDQSNALKAT; RNRDQSNALKATS; NRDQSNALKATSL; RDQSNALKATSLR; DQSNALKATSLRE; QSNALKATSLREA; SNALKATSLREAG; NALKATSLREAGG; ALKATSLREAGGE; LKATSLREAGGEE; KATSLREAGGEEL; ATSLREAGGEELD; TSLREAGGEELDE; SLREAGGEELDEC; LREAGGEELDECE; REAGGEELDECEF; EAGGEELDECEFE; AGGEELDECEFEL; GGEELDECEFELA; GEELDECEFELAL; EELDECEFELALA; ELDECEFELALAH; LDECEFELALAHL; DECEFELALAHLR; ECEFELALAHLRV; CEFELALAHLRVP; EFELALAHLRVPE; FELALAHLRVPEL; ELALAHLRVPELV<br><br>14 mers:<br>MTGGATGALPRTMK; TGGATGALPRTMKE; GGATGALPRTMKEG; GATGALPRTMKEGW; ATGALPRTMKEGWI; TGALPRTMKEGWIV; GALPRTMKEGWIVY; ALPRTMKEGWIVYA; LPRTMKEGWIVYAR; PRTMKEGWIVYARS; RTMKEGWIVYARST; TMKEGWIVYARSTT; MKEGWIVYARSTTI; KEGWIVYARSTTIQ; EGWIVYARSTTIQA; GWIVYARSTTIQAQ; WIVYARSTTIQAQS; IVYARSTTIQAQSE; VYARSTTIQAQSEC; YARSTTIQAQSECI; ARSTTIQAQSECID; RSTTIQAQSECIDT; STTIQAQSECIDTG; TTIQAQSECIDTGI; TIQAQSECIDTGIA; IQAQSECIDTGIAH; QAQSECIDTGIAHV; AQSECIDTGIAHVR; QSECIDTGIAHVRD; SECIDTGIAHVRDV; ECIDTGIAHVRDVV; CIDTGIAHVRDVVM; IDTGIAHVRDVVMP; DTGIAHVRDVVMPA; TGIAHVRDVVMPAL; GIAHVRDVVMPALQ; IAHVRDVVMPALQG; AHVRDVVMPALQGM; HVRDVVMPALQGMD; VRDVVMPALQGMDG; RDVVMPALQGMDGC; DVVMPALQGMDGCI; VVMPALQGMDGCIG; VMPALQGMDGCIGV; MPALQGMDGCIGVS; PALQGMDGCIGVSL; ALQGMDGCIGVSLL; LQGMDGCIGVSLLV; QGMDGCIGVSLLVD; GMDGCIGVSLLVDR; MDGCIGVSLLVDRQ; DGCIGVSLLVDRQS; GCIGVSLLVDRQSG; CIGVSLLVDRQSGR; IGVSLLVDRQSGRC; GVSLLVDRQSGRCI; VSLLVDRQSGRCIA; SLLVDRQSGRCIAT; LLVDRQSGRCIATS; LVDRQSGRCIATSA; VDRQSGRCIATSAW; DRQSGRCIATSAWE; RQSGRCIATSAWET; QSGRCIATSAWETA; SGRCIATSAWETAE; GRCIATSAWETAEA; RCIATSAWETAEAM; CIATSAWETAEAMH; IATSAWETAEAMHA; ATSAWETAEAMHAS; TSAWETAEAMHASR; SAWETAEAMHASRE; AWETAEAMHASREQ; WETAEAMHASREQV; ETAEAMHASREQVT; TAEAMHASREQVTP; AEAMHASREQVTPI; EAMHASREQVTPIR; AMHASREQVTPIRD; MHASREQVTPIRDR; HASREQVTPIRDRC; ASREQVTPIRDRCA; SREQVTPIRDRCAE; REQVTPIRDRCAEM; EQVTPIRDRCAEMF; QVTPIRDRCAEMFG; VTPIRDRCAEMFGG; TPIRDRCAEMFGGT; PIRDRCAEMFGGTP; IRDRCAEMFGGTPA; RDRCAEMFGGTPAV; DRCAEMFGGTPAVE; RCAEMFGGTPAVEE; CAEMFGGTPAVEEW; AEMFGGTPAVEEWE; EMFGGTPAVEEWEI; MFGGTPAVEEWEIA; FGGTPAVEEWEIAA; GGTPAVEEWEIAAM; GTPAVEEWEIAAMH; TPAVEEWEIAAMHR; PAVEEWEIAAMHRD; AVEEWEIAAMHRDH; | |

Fig. 29 continued

VEEWEIAAMHRDHR; EEWEIAAMHRDHRS; EWEIAAMHRDHRSA;
WEIAAMHRDHRSAE; EIAAMHRDHRSAEG; IAAMHRDHRSAEGA;
AAMHRDHRSAEGAC; AMHRDHRSAEGACV; MHRDHRSAEGACVR;
HRDHRSAEGACVRA; RDHRSAEGACVRAT; DHRSAEGACVRATW;
HRSAEGACVRATWV; RSAEGACVRATWVK; SAEGACVRATWVKV;
AEGACVRATWVKVP; EGACVRATWVKVPA; GACVRATWVKVPAD;
ACVRATWVKVPADQ; CVRATWVKVPADQV; VRATWVKVPADQVD;
RATWVKVPADQVDQ; ATWVKVPADQVDQG; TWVKVPADQVDQGI;
WVKVPADQVDQGIE; VKVPADQVDQGIEY; KVPADQVDQGIEYY;
VPADQVDQGIEYYK; PADQVDQGIEYYKS; ADQVDQGIEYYKSS;
DQVDQGIEYYKSSV; QVDQGIEYYKSSVL; VDQGIEYYKSSVLP;
DQGIEYYKSSVLPQ; QGIEYYKSSVLPQI; GIEYYKSSVLPQIE; IEYYKSSVLPQIEG;
EYYKSSVLPQIEGL; YYKSSVLPQIEGLD; YKSSVLPQIEGLDG;
KSSVLPQIEGLDGF; SSVLPQIEGLDGFC; SVLPQIEGLDGFCS;
VLPQIEGLDGFCSA; LPQIEGLDGFCSAS; PQIEGLDGFCSASL;
QIEGLDGFCSASLL; IEGLDGFCSASLLV; EGLDGFCSASLLVD;
GLDGFCSASLLVDR; LDGFCSASLLVDRT; DGFCSASLLVDRTS;
GFCSASLLVDRTSG; FCSASLLVDRTSGR; CSASLLVDRTSGRA;
SASLLVDRTSGRAV; ASLLVDRTSGRAVS; SLLVDRTSGRAVSS;
LLVDRTSGRAVSSA; LVDRTSGRAVSSAT; VDRTSGRAVSSATF;
DRTSGRAVSSATFD; RTSGRAVSSATFDS; TSGRAVSSATFDSF;
SGRAVSSATFDSFD; GRAVSSATFDSFDA; RAVSSATFDSFDAM;
AVSSATFDSFDAME; VSSATFDSFDAMER; SSATFDSFDAMERN;
SATFDSFDAMERNR; ATFDSFDAMERNRD; TFDSFDAMERNRDQ;
FDSFDAMERNRDQS; DSFDAMERNRDQSN; SFDAMERNRDQSNA;
FDAMERNRDQSNAL; DAMERNRDQSNALK; AMERNRDQSNALKA;
MERNRDQSNALKAT; ERNRDQSNALKATS; RNRDQSNALKATSL;
NRDQSNALKATSLR; RDQSNALKATSLRE; DQSNALKATSLREA;
QSNALKATSLREAG; SNALKATSLREAGG; NALKATSLREAGGE;
ALKATSLREAGGEE; LKATSLREAGGEEL; KATSLREAGGEELD;
ATSLREAGGEELDE; TSLREAGGEELDEC; SLREAGGEELDECE;
LREAGGEELDECEF; REAGGEELDECEFE; EAGGEELDECEFEL;
AGGEELDECEFELA; GGEELDECEFELAL; GEELDECEFELALA;
EELDECEFELALAH; ELDECEFELALAHL; LDECEFELALAHLR;
DECEFELALAHLRV; ECEFELALAHLRVP; CEFELALAHLRVPE;
EFELALAHLRVPEL; FELALAHLRVPELV 15 mers:
MTGGATGALPRTMKE; TGGATGALPRTMKEG; GGATGALPRTMKEGW;
GATGALPRTMKEGWI; ATGALPRTMKEGWIV; TGALPRTMKEGWIVY;
GALPRTMKEGWIVYA; ALPRTMKEGWIVYAR; LPRTMKEGWIVYARS;
PRTMKEGWIVYARST; RTMKEGWIVYARSTT; TMKEGWIVYARSTTI;
MKEGWIVYARSTTIQ; KEGWIVYARSTTIQA; EGWIVYARSTTIQAQ;
GWIVYARSTTIQAQS; WIVYARSTTIQAQSE; IVYARSTTIQAQSEC;
VYARSTTIQAQSECI; YARSTTIQAQSECID; ARSTTIQAQSECIDT;
RSTTIQAQSECIDTG; STTIQAQSECIDTGI; TTIQAQSECIDTGIA;
TIQAQSECIDTGIAH; IQAQSECIDTGIAHV; QAQSECIDTGIAHVR;
AQSECIDTGIAHVRD; QSECIDTGIAHVRDV; SECIDTGIAHVRDVV;
ECIDTGIAHVRDVVM; CIDTGIAHVRDVVMP; IDTGIAHVRDVVMPA;
DTGIAHVRDVVMPAL; TGIAHVRDVVMPALQ; GIAHVRDVVMPALQG;
IAHVRDVVMPALQGM; AHVRDVVMPALQGMD; HVRDVVMPALQGMDG;
VRDVVMPALQGMDGC; RDVVMPALQGMDGCI; DVVMPALQGMDGCIG;
VVMPALQGMDGCIGV; VMPALQGMDGCIGVS; MPALQGMDGCIGVSL;

Fig. 29 continued

| | | | |
|---|---|---|---|
| | PALQGMDGCIGVSLL; ALQGMDGCIGVSLLV; LQGMDGCIGVSLLVD; QGMDGCIGVSLLVDR; GMDGCIGVSLLVDRQ; MDGCIGVSLLVDRQS; DGCIGVSLLVDRQSG; GCIGVSLLVDRQSGR; CIGVSLLVDRQSGRC; IGVSLLVDRQSGRCI; GVSLLVDRQSGRCIA; VSLLVDRQSGRCIAT; SLLVDRQSGRCIATS; LLVDRQSGRCIATSA; LVDRQSGRCIATSAW; VDRQSGRCIATSAWE; DRQSGRCIATSAWET; RQSGRCIATSAWETA; QSGRCIATSAWETAE; SGRCIATSAWETAEA; GRCIATSAWETAEAM; RCIATSAWETAEAMH; CIATSAWETAEAMHA; IATSAWETAEAMHAS; ATSAWETAEAMHASR; TSAWETAEAMHASRE; SAWETAEAMHASREQ; AWETAEAMHASREQV; WETAEAMHASREQVT; ETAEAMHASREQVTP; TAEAMHASREQVTPI; AEAMHASREQVTPIR; EAMHASREQVTPIRD; AMHASREQVTPIRDR; MHASREQVTPIRDRC; HASREQVTPIRDRCA; ASREQVTPIRDRCAE; SREQVTPIRDRCAEM; REQVTPIRDRCAEMF; EQVTPIRDRCAEMFG; QVTPIRDRCAEMFGG; VTPIRDRCAEMFGGT; TPIRDRCAEMFGGTP; PIRDRCAEMFGGTPA; IRDRCAEMFGGTPAV; RDRCAEMFGGTPAVE; DRCAEMFGGTPAVEE; RCAEMFGGTPAVEEW; CAEMFGGTPAVEEWE; AEMFGGTPAVEEWEI; EMFGGTPAVEEWEIA; MFGGTPAVEEWEIAA; FGGTPAVEEWEIAAM; GGTPAVEEWEIAAMH; GTPAVEEWEIAAMHR; TPAVEEWEIAAMHRD; PAVEEWEIAAMHRDH; AVEEWEIAAMHRDHR; VEEWEIAAMHRDHRS; EEWEIAAMHRDHRSA; EWEIAAMHRDHRSAE; WEIAAMHRDHRSAEG; EIAAMHRDHRSAEGA; IAAMHRDHRSAEGAC; AAMHRDHRSAEGACV; AMHRDHRSAEGACVR; MHRDHRSAEGACVRA; HRDHRSAEGACVRAT; RDHRSAEGACVRATW; DHRSAEGACVRATWV; HRSAEGACVRATWVK; RSAEGACVRATWVKV; SAEGACVRATWVKVP; AEGACVRATWVKVPA; EGACVRATWVKVPAD; GACVRATWVKVPADQ; ACVRATWVKVPADQV; CVRATWVKVPADQVD; VRATWVKVPADQVDQ; RATWVKVPADQVDQG; ATWVKVPADQVDQGI; TWVKVPADQVDQGIE; WVKVPADQVDQGIEY; VKVPADQVDQGIEYY; KVPADQVDQGIEYYK; VPADQVDQGIEYYKS; PADQVDQGIEYYKSS; ADQVDQGIEYYKSSV; DQVDQGIEYYKSSVL; QVDQGIEYYKSSVLP; VDQGIEYYKSSVLPQ; DQGIEYYKSSVLPQI; QGIEYYKSSVLPQIE; GIEYYKSSVLPQIEG; IEYYKSSVLPQIEGL; EYYKSSVLPQIEGLD; YYKSSVLPQIEGLDG; YKSSVLPQIEGLDGF; KSSVLPQIEGLDGFC; SSVLPQIEGLDGFCS; SVLPQIEGLDGFCSA; VLPQIEGLDGFCSAS; LPQIEGLDGFCSASL; PQIEGLDGFCSASLL; QIEGLDGFCSASLLV; IEGLDGFCSASLLVD; EGLDGFCSASLLVDR; GLDGFCSASLLVDRT; LDGFCSASLLVDRTS; DGFCSASLLVDRTSG; GFCSASLLVDRTSGR; FCSASLLVDRTSGRA; CSASLLVDRTSGRAV; SASLLVDRTSGRAVS; ASLLVDRTSGRAVSS; SLLVDRTSGRAVSSA; LLVDRTSGRAVSSAT; LVDRTSGRAVSSATF; VDRTSGRAVSSATFD; DRTSGRAVSSATFDS; RTSGRAVSSATFDSF; TSGRAVSSATFDSFD; SGRAVSSATFDSFDA; GRAVSSATFDSFDAM; RAVSSATFDSFDAME; AVSSATFDSFDAMER; VSSATFDSFDAMERN; SSATFDSFDAMERNR; SATFDSFDAMERNRD; ATFDSFDAMERNRDQ; TFDSFDAMERNRDQS; FDSFDAMERNRDQSN; DSFDAMERNRDQSNA; SFDAMERNRDQSNAL; FDAMERNRDQSNALK; DAMERNRDQSNALKA; AMERNRDQSNALKAT; MERNRDQSNALKATS; ERNRDQSNALKATSL; RNRDQSNALKATSLR; NRDQSNALKATSLRE; RDQSNALKATSLREA; DQSNALKATSLREAG; QSNALKATSLREAGG; SNALKATSLREAGGE; NALKATSLREAGGEE; ALKATSLREAGGEEL; LKATSLREAGGEELD; KATSLREAGGEELDE; ATSLREAGGEELDEC; TSLREAGGEELDECE; SLREAGGEELDECEF; LREAGGEELDECEFE; REAGGEELDECEFEL; EAGGEELDECEFELA; AGGEELDECEFELAL; GGEELDECEFELALA; GEELDECEFELALAH; EELDECEFELALAHL; | |

Fig. 29 continued

| | | | |
|---|---|---|---|
| | ELDECEFELALAHLR; LDECEFELALAHLRV; DECEFELALAHLRVP;<br>ECEFELALAHLRVPE; CEFELALAHLRVPEL; EFELALAHLRVPELV<br><br>16 mers:<br>MTGGATGALPRTMKEG; TGGATGALPRTMKEGW; GGATGALPRTMKEGWI;<br>GATGALPRTMKEGWIV; ATGALPRTMKEGWIVY; TGALPRTMKEGWIVYA;<br>GALPRTMKEGWIVYAR; ALPRTMKEGWIVYARS; LPRTMKEGWIVYARST;<br>PRTMKEGWIVYARSTT; RTMKEGWIVYARSTTI; TMKEGWIVYARSTTIQ;<br>MKEGWIVYARSTTIQA; KEGWIVYARSTTIQAQ; EGWIVYARSTTIQAQS;<br>GWIVYARSTTIQAQSE; WIVYARSTTIQAQSEC; IVYARSTTIQAQSECI;<br>VYARSTTIQAQSECID; YARSTTIQAQSECIDT; ARSTTIQAQSECIDTG;<br>RSTTIQAQSECIDTGI; STTIQAQSECIDTGIA; TTIQAQSECIDTGIAH;<br>TIQAQSECIDTGIAHV; IQAQSECIDTGIAHVR; QAQSECIDTGIAHVRD;<br>AQSECIDTGIAHVRDV; QSECIDTGIAHVRDVV; SECIDTGIAHVRDVVM;<br>ECIDTGIAHVRDVVMP; CIDTGIAHVRDVVMPA; IDTGIAHVRDVVMPAL;<br>DTGIAHVRDVVMPALQ; TGIAHVRDVVMPALQG; GIAHVRDVVMPALQGM;<br>IAHVRDVVMPALQGMD; AHVRDVVMPALQGMDG; HVRDVVMPALQGMDGC;<br>VRDVVMPALQGMDGCI; RDVVMPALQGMDGCIG; DVVMPALQGMDGCIGV;<br>VVMPALQGMDGCIGVS; VMPALQGMDGCIGVSL; MPALQGMDGCIGVSLL;<br>PALQGMDGCIGVSLLV; ALQGMDGCIGVSLLVD; LQGMDGCIGVSLLVDR;<br>QGMDGCIGVSLLVDRQ; GMDGCIGVSLLVDRQS; MDGCIGVSLLVDRQSG;<br>DGCIGVSLLVDRQSGR; GCIGVSLLVDRQSGRC; CIGVSLLVDRQSGRCI;<br>IGVSLLVDRQSGRCIA; GVSLLVDRQSGRCIAT; VSLLVDRQSGRCIATS;<br>SLLVDRQSGRCIATSA; LLVDRQSGRCIATSAW; LVDRQSGRCIATSAWE;<br>VDRQSGRCIATSAWET; DRQSGRCIATSAWETA; RQSGRCIATSAWETAE;<br>QSGRCIATSAWETAEA; SGRCIATSAWETAEAM; GRCIATSAWETAEAMH;<br>RCIATSAWETAEAMHA; CIATSAWETAEAMHAS; IATSAWETAEAMHASR;<br>ATSAWETAEAMHASRE; TSAWETAEAMHASREQ; SAWETAEAMHASREQV;<br>AWETAEAMHASREQVT; WETAEAMHASREQVTP; ETAEAMHASREQVTPI;<br>TAEAMHASREQVTPIR; AEAMHASREQVTPIRD; EAMHASREQVTPIRDR;<br>AMHASREQVTPIRDRC; MHASREQVTPIRDRCA; HASREQVTPIRDRCAE;<br>ASREQVTPIRDRCAEM; SREQVTPIRDRCAEMF; REQVTPIRDRCAEMFG;<br>EQVTPIRDRCAEMFGG; QVTPIRDRCAEMFGGT; VTPIRDRCAEMFGGTP;<br>TPIRDRCAEMFGGTPA; PIRDRCAEMFGGTPAV; IRDRCAEMFGGTPAVE;<br>RDRCAEMFGGTPAVEE; DRCAEMFGGTPAVEEW; RCAEMFGGTPAVEEWE;<br>CAEMFGGTPAVEEWEI; AEMFGGTPAVEEWEIA; EMFGGTPAVEEWEIAA;<br>MFGGTPAVEEWEIAAM; FGGTPAVEEWEIAAMH; GGTPAVEEWEIAAMHR;<br>GTPAVEEWEIAAMHRD; TPAVEEWEIAAMHRDH; PAVEEWEIAAMHRDHR;<br>AVEEWEIAAMHRDHRS; VEEWEIAAMHRDHRSA; EEWEIAAMHRDHRSAE;<br>EWEIAAMHRDHRSAEG; WEIAAMHRDHRSAEGA; EIAAMHRDHRSAEGAC;<br>IAAMHRDHRSAEGACV; AAMHRDHRSAEGACVR; AMHRDHRSAEGACVRA;<br>MHRDHRSAEGACVRAT; HRDHRSAEGACVRATW; RDHRSAEGACVRATWV;<br>DHRSAEGACVRATWVK; HRSAEGACVRATWVKV; RSAEGACVRATWVKVP;<br>SAEGACVRATWVKVPA; AEGACVRATWVKVPAD; EGACVRATWVKVPADQ;<br>GACVRATWVKVPADQV; ACVRATWVKVPADQVD; CVRATWVKVPADQVDQ;<br>VRATWVKVPADQVDQG; RATWVKVPADQVDQGI; ATWVKVPADQVDQGIE;<br>TWVKVPADQVDQGIEY; WVKVPADQVDQGIEYY; VKVPADQVDQGIEYYK;<br>KVPADQVDQGIEYYKS; VPADQVDQGIEYYKSS; PADQVDQGIEYYKSSV;<br>ADQVDQGIEYYKSSVL; DQVDQGIEYYKSSVLP; QVDQGIEYYKSSVLPQ;<br>VDQGIEYYKSSVLPQI; DQGIEYYKSSVLPQIE; QGIEYYKSSVLPQIEG;<br>GIEYYKSSVLPQIEGL; IEYYKSSVLPQIEGLD; EYYKSSVLPQIEGLDG;<br>YYKSSVLPQIEGLDGF; YKSSVLPQIEGLDGFC; KSSVLPQIEGLDGFCS;<br>SSVLPQIEGLDGFCSA; SVLPQIEGLDGFCSAS; VLPQIEGLDGFCSASL; | | |

Fig. 29 continued

| | | |
|---|---|---|
| | LPQIEGLDGFCSASLL; PQIEGLDGFCSASLLV; QIEGLDGFCSASLLVD; IEGLDGFCSASLLVDR; EGLDGFCSASLLVDRT; GLDGFCSASLLVDRTS; LDGFCSASLLVDRTSG; DGFCSASLLVDRTSGR; GFCSASLLVDRTSGRA; FCSASLLVDRTSGRAV; CSASLLVDRTSGRAVS; SASLLVDRTSGRAVSS; ASLLVDRTSGRAVSSA; SLLVDRTSGRAVSSAT; LLVDRTSGRAVSSATF; LVDRTSGRAVSSATFD; VDRTSGRAVSSATFDS; DRTSGRAVSSATFDSF; RTSGRAVSSATFDSFD; TSGRAVSSATFDSFDA; SGRAVSSATFDSFDAM; GRAVSSATFDSFDAME; RAVSSATFDSFDAMER; AVSSATFDSFDAMERN; VSSATFDSFDAMERNR; SSATFDSFDAMERNRD; SATFDSFDAMERNRDQ; ATFDSFDAMERNRDQS; TFDSFDAMERNRDQSN; FDSFDAMERNRDQSNA; DSFDAMERNRDQSNAL; SFDAMERNRDQSNALK; FDAMERNRDQSNALKA; DAMERNRDQSNALKAT; AMERNRDQSNALKATS; MERNRDQSNALKATSL; ERNRDQSNALKATSLR; RNRDQSNALKATSLRE; NRDQSNALKATSLREA; RDQSNALKATSLREAG; DQSNALKATSLREAGG; QSNALKATSLREAGGE; SNALKATSLREAGGEE; NALKATSLREAGGEEL; ALKATSLREAGGEELD; LKATSLREAGGEELDE; KATSLREAGGEELDEC; ATSLREAGGEELDECE; TSLREAGGEELDECEF; SLREAGGEELDECEFE; LREAGGEELDECEFEL; REAGGEELDECEFELA; EAGGEELDECEFELAL; AGGEELDECEFELALA; GGEELDECEFELALAH; GEELDECEFELALAHL; EELDECEFELALAHLR; ELDECEFELALAHLRV; LDECEFELALAHLRVP; DECEFELALAHLRVPE; ECEFELALAHLRVPEL; CEFELALAHLRVPELV | |
| 43) Rv2558 | 13 mers: MPGSAGWRKVFGG; PGSAGWRKVFGGT; GSAGWRKVFGGTG; SAGWRKVFGGTGG; AGWRKVFGGTGGA; GWRKVFGGTGGAT; WRKVFGGTGGATG; RKVFGGTGGATGA; KVFGGTGGATGAL; VFGGTGGATGALP; FGGTGGATGALPR; GGTGGATGALPRH; GTGGATGALPRHG; TGGATGALPRHGR; GGATGALPRHGRG; GATGALPRHGRGS; ATGALPRHGRGSI; TGALPRHGRGSIV; GALPRHGRGSIVY; ALPRHGRGSIVYA; LPRHGRGSIVYAR; PRHGRGSIVYARS; RHGRGSIVYARST; HGRGSIVYARSTT; GRGSIVYARSTTI; RGSIVYARSTTIE; GSIVYARSTTIEA; SIVYARSTTIEAQ; IVYARSTTIEAQP; VYARSTTIEAQPL; YARSTTIEAQPLS; ARSTTIEAQPLSV; RSTTIEAQPLSVD; STTIEAQPLSVDI; TTIEAQPLSVDIG; TIEAQPLSVDIGI; IEAQPLSVDIGIA; EAQPLSVDIGIAH; AQPLSVDIGIAHV; QPLSVDIGIAHVR; PLSVDIGIAHVRD; LSVDIGIAHVRDV; SVDIGIAHVRDVV; VDIGIAHVRDVVM; DIGIAHVRDVVMP; IGIAHVRDVVMPA; GIAHVRDVVMPAL; IAHVRDVVMPALQ; AHVRDVVMPALQE; HVRDVVMPALQEI; VRDVVMPALQEID; RDVVMPALQEIDG; DVVMPALQEIDGC; VVMPALQEIDGCV; VMPALQEIDGCVG; MPALQEIDGCVGV; PALQEIDGCVGVS; ALQEIDGCVGVSL; LQEIDGCVGVSLL; QEIDGCVGVSLLV; EIDGCVGVSLLVD; IDGCVGVSLLVDR; DGCVGVSLLVDRQ; GCVGVSLLVDRQS; CVGVSLLVDRQSG; VGVSLLVDRQSGR; GVSLLVDRQSGRC; VSLLVDRQSGRCI; SLLVDRQSGRCIA; LLVDRQSGRCIAT; LVDRQSGRCIATS; VDRQSGRCIATSA; DRQSGRCIATSAW; RQSGRCIATSAWE; QSGRCIATSAWET; SGRCIATSAWETL; GRCIATSAWETLE; RCIATSAWETLEA; CIATSAWETLEAM; IATSAWETLEAMR; ATSAWETLEAMRA; TSAWETLEAMRAS; SAWETLEAMRASV; AWETLEAMRASVE; WETLEAMRASVER; ETLEAMRASVERV; TLEAMRASVERVA; LEAMRASVERVAP; EAMRASVERVAPI; AMRASVERVAPIR; MRASVERVAPIRD; RASVERVAPIRDR; ASVERVAPIRDRA; SVERVAPIRDRAA; VERVAPIRDRAAL; ERVAPIRDRAALM; RVAPIRDRAALMF; VAPIRDRAALMFA; APIRDRAALMFAG; PIRDRAALMFAGS; IRDRAALMFAGSA; RDRAALMFAGSAR; DRAALMFAGSARV; RAALMFAGSARVE; AALMFAGSARVEE; ALMFAGSARVEEW; LMFAGSARVEEWD; MFAGSARVEEWDI; FAGSARVEEWDIA; AGSARVEEWDIAL; GSARVEEWDIALL; SARVEEWDIALLH; ARVEEWDIALLHR; RVEEWDIALLHRD; VEEWDIALLHRDH; | 91348-92237 |

Fig. 29 continued

| | | |
|---|---|---|
| | EEWDIALLHRDHP; EWDIALLHRDHPS; WDIALLHRDHPSH; DIALLHRDHPSHE;<br>IALLHRDHPSHEG; ALLHRDHPSHEGA; LLHRDHPSHEGAC; LHRDHPSHEGACV;<br>HRDHPSHEGACVR; RDHPSHEGACVRA; DHPSHEGACVRAT;<br>HPSHEGACVRATW; PSHEGACVRATWL; SHEGACVRATWLK;<br>HEGACVRATWLKV; EGACVRATWLKVV; GACVRATWLKVVP;<br>ACVRATWLKVVPD; CVRATWLKVVPDQ; VRATWLKVVPDQL;<br>RATWLKVVPDQLG; ATWLKVVPDQLGR; TWLKVVPDQLGRS;<br>WLKVVPDQLGRSL; LKVVPDQLGRSLE; KVVPDQLGRSLEF; VVPDQLGRSLEFY;<br>VPDQLGRSLEFYR; PDQLGRSLEFYRT; DQLGRSLEFYRTS; QLGRSLEFYRTSV;<br>LGRSLEFYRTSVL; GRSLEFYRTSVLP; RSLEFYRTSVLPE; SLEFYRTSVLPEL;<br>LEFYRTSVLPELE; EFYRTSVLPELES; FYRTSVLPELESL; YRTSVLPELESLD;<br>RTSVLPELESLDG; TSVLPELESLDGF; SVLPELESLDGFC; VLPELESLDGFCS;<br>LPELESLDGFCSA; PELESLDGFCSAS; ELESLDGFCSASL; LESLDGFCSASLM;<br>ESLDGFCSASLMV; SLDGFCSASLMVD; LDGFCSASLMVDH;<br>DGFCSASLMVDHP; GFCSASLMVDHPA; FCSASLMVDHPAC;<br>CSASLMVDHPACR; SASLMVDHPACRR; ASLMVDHPACRRA;<br>SLMVDHPACRRAV; LMVDHPACRRAVS; MVDHPACRRAVSC;<br>VDHPACRRAVSCS; DHPACRRAVSCST; HPACRRAVSCSTF;<br>PACRRAVSCSTFD; ACRRAVSCSTFDS; CRRAVSCSTFDSM;<br>RRAVSCSTFDSMD; RAVSCSTFDSMDA; AVSCSTFDSMDAM;<br>VSCSTFDSMDAMA; SCSTFDSMDAMAR; CSTFDSMDAMARN;<br>STFDSMDAMARNR; TFDSMDAMARNRD; FDSMDAMARNRDR;<br>DSMDAMARNRDRA; SMDAMARNRDRAS; MDAMARNRDRASE;<br>DAMARNRDRASEL; AMARNRDRASELR; MARNRDRASELRS;<br>ARNRDRASELRSR; RNRDRASELRSRR; NRDRASELRSRRV;<br>RDRASELRSRRVR; DRASELRSRRVRE; RASELRSRRVREL; ASELRSRRVRELG;<br>SELRSRRVRELGA; ELRSRRVRELGAE; LRSRRVRELGAEV; RSRRVRELGAEVL;<br>SRRVRELGAEVLD; RRVRELGAEVLDV; RVRELGAEVLDVA; VRELGAEVLDVAE;<br>RELGAEVLDVAEF; ELGAEVLDVAEFE; LGAEVLDVAEFEL; GAEVLDVAEFELA;<br>AEVLDVAEFELAI; EVLDVAEFELAIA; VLDVAEFELAIAH; LDVAEFELAIAHL;<br>DVAEFELAIAHLR; VAEFELAIAHLRV; AEFELAIAHLRVP; EFELAIAHLRVPE;<br>FELAIAHLRVPEL; ELAIAHLRVPELV<br><br>14 mers:<br>MPGSAGWRKVFGGT; PGSAGWRKVFGGTG; GSAGWRKVFGGTGG;<br>SAGWRKVFGGTGGA; AGWRKVFGGTGGAT; GWRKVFGGTGGATG;<br>WRKVFGGTGGATGA; RKVFGGTGGATGAL; KVFGGTGGATGALP;<br>VFGGTGGATGALPR; FGGTGGATGALPRH; GGTGGATGALPRHG;<br>GTGGATGALPRHGR; TGGATGALPRHGRG; GGATGALPRHGRGS;<br>GATGALPRHGRGSI; ATGALPRHGRGSIV; TGALPRHGRGSIVY;<br>GALPRHGRGSIVYA; ALPRHGRGSIVYAR; LPRHGRGSIVYARS;<br>PRHGRGSIVYARST; RHGRGSIVYARSTT; HGRGSIVYARSTTI;<br>GRGSIVYARSTTIE; RGSIVYARSTTIEA; GSIVYARSTTIEAQ; SIVYARSTTIEAQP;<br>IVYARSTTIEAQPL; VYARSTTIEAQPLS; YARSTTIEAQPLSV; ARSTTIEAQPLSVD;<br>RSTTIEAQPLSVDI; STTIEAQPLSVDIG; TTIEAQPLSVDIGI; TIEAQPLSVDIGIA;<br>IEAQPLSVDIGIAH; EAQPLSVDIGIAHV; AQPLSVDIGIAHVR; QPLSVDIGIAHVRD;<br>PLSVDIGIAHVRDV; LSVDIGIAHVRDVV; SVDIGIAHVRDVVM;<br>VDIGIAHVRDVVMP; DIGIAHVRDVVMPA; IGIAHVRDVVMPAL;<br>GIAHVRDVVMPALQ; IAHVRDVVMPALQE; AHVRDVVMPALQEI;<br>HVRDVVMPALQEID; VRDVVMPALQEIDG; RDVVMPALQEIDGC;<br>DVVMPALQEIDGCV; VVMPALQEIDGCVG; VMPALQEIDGCVGV;<br>MPALQEIDGCVGVS; PALQEIDGCVGVSL; ALQEIDGCVGVSLL;<br>LQEIDGCVGVSLLV; QEIDGCVGVSLLVD; EIDGCVGVSLLVDR; | |

Fig. 29 continued

| | | |
|---|---|---|
| | IDGCVGVSLLVDRQ; DGCVGVSLLVDRQS; GCVGVSLLVDRQSG; CVGVSLLVDRQSGR; VGVSLLVDRQSGRC; GVSLLVDRQSGRCI; VSLLVDRQSGRCIA; SLLVDRQSGRCIAT; LLVDRQSGRCIATS; LVDRQSGRCIATSA; VDRQSGRCIATSAW; DRQSGRCIATSAWE; RQSGRCIATSAWET; QSGRCIATSAWETL; SGRCIATSAWETLE; GRCIATSAWETLEA; RCIATSAWETLEAM; CIATSAWETLEAMR; IATSAWETLEAMRA; ATSAWETLEAMRAS; TSAWETLEAMRASV; SAWETLEAMRASVE; AWETLEAMRASVER; WETLEAMRASVERV; ETLEAMRASVERVA; TLEAMRASVERVAP; LEAMRASVERVAPI; EAMRASVERVAPIR; AMRASVERVAPIRD; MRASVERVAPIRDR; RASVERVAPIRDRA; ASVERVAPIRDRAA; SVERVAPIRDRAAL; VERVAPIRDRAALM; ERVAPIRDRAALMF; RVAPIRDRAALMFA; VAPIRDRAALMFAG; APIRDRAALMFAGS; PIRDRAALMFAGSA; IRDRAALMFAGSAR; RDRAALMFAGSARV; DRAALMFAGSARVE; RAALMFAGSARVEE; AALMFAGSARVEEW; ALMFAGSARVEEWD; LMFAGSARVEEWDI; MFAGSARVEEWDIA; FAGSARVEEWDIAL; AGSARVEEWDIALL; GSARVEEWDIALLH; SARVEEWDIALLHR; ARVEEWDIALLHRD; RVEEWDIALLHRDH; VEEWDIALLHRDHP; EEWDIALLHRDHPS; EWDIALLHRDHPSH; WDIALLHRDHPSHE; DIALLHRDHPSHEG; IALLHRDHPSHEGA; ALLHRDHPSHEGAC; LLHRDHPSHEGACV; LHRDHPSHEGACVR; HRDHPSHEGACVRA; RDHPSHEGACVRAT; DHPSHEGACVRATW; HPSHEGACVRATWL; PSHEGACVRATWLK; SHEGACVRATWLKV; HEGACVRATWLKVV; EGACVRATWLKVVP; GACVRATWLKVVPD; ACVRATWLKVVPDQ; CVRATWLKVVPDQL; VRATWLKVVPDQLG; RATWLKVVPDQLGR; ATWLKVVPDQLGRS; TWLKVVPDQLGRSL; WLKVVPDQLGRSLE; LKVVPDQLGRSLEF; KVVPDQLGRSLEFY; VVPDQLGRSLEFYR; VPDQLGRSLEFYRT; PDQLGRSLEFYRTS; DQLGRSLEFYRTSV; QLGRSLEFYRTSVL; LGRSLEFYRTSVLP; GRSLEFYRTSVLPE; RSLEFYRTSVLPEL; SLEFYRTSVLPELE; LEFYRTSVLPELES; EFYRTSVLPELESL; FYRTSVLPELESLD; YRTSVLPELESLDG; RTSVLPELESLDGF; TSVLPELESLDGFC; SVLPELESLDGFCS; VLPELESLDGFCSA; LPELESLDGFCSAS; PELESLDGFCSASL; ELESLDGFCSASLM; LESLDGFCSASLMV; ESLDGFCSASLMVD; SLDGFCSASLMVDH; LDGFCSASLMVDHP; DGFCSASLMVDHPA; GFCSASLMVDHPAC; FCSASLMVDHPACR; CSASLMVDHPACRR; SASLMVDHPACRRA; ASLMVDHPACRRAV; SLMVDHPACRRAVS; LMVDHPACRRAVSC; MVDHPACRRAVSCS; VDHPACRRAVSCST; DHPACRRAVSCSTF; HPACRRAVSCSTFD; PACRRAVSCSTFDS; ACRRAVSCSTFDSM; CRRAVSCSTFDSMD; RRAVSCSTFDSMDA; RAVSCSTFDSMDAM; AVSCSTFDSMDAMA; VSCSTFDSMDAMAR; SCSTFDSMDAMARN; CSTFDSMDAMARNR; STFDSMDAMARNRD; TFDSMDAMARNRDR; FDSMDAMARNRDRA; DSMDAMARNRDRAS; SMDAMARNRDRASE; MDAMARNRDRASEL; DAMARNRDRASELR; AMARNRDRASELRS; MARNRDRASELRSR; ARNRDRASELRSRR; RNRDRASELRSRRV; NRDRASELRSRRVR; RDRASELRSRRVRE; DRASELRSRRVREL; RASELRSRRVRELG; ASELRSRRVRELGA; SELRSRRVRELGAE; ELRSRRVRELGAEV; LRSRRVRELGAEVL; RSRRVRELGAEVLD; SRRVRELGAEVLDV; RRVRELGAEVLDVA; RVRELGAEVLDVAE; VRELGAEVLDVAEF; RELGAEVLDVAEFE; ELGAEVLDVAEFEL; LGAEVLDVAEFELA; GAEVLDVAEFELAI; AEVLDVAEFELAIA; EVLDVAEFELAIAH; VLDVAEFELAIAHL; LDVAEFELAIAHLR; DVAEFELAIAHLRV; VAEFELAIAHLRVP; AEFELAIAHLRVPE; EFELAIAHLRVPEL; | |

Fig. 29 continued

| | | |
|---|---|---|
| | FELAIAHLRVPELV<br><br>15 mers:<br>MPGSAGWRKVFGGTG; PGSAGWRKVFGGTGG; GSAGWRKVFGGTGGA; SAGWRKVFGGTGGAT; AGWRKVFGGTGGATG; GWRKVFGGTGGATGA; WRKVFGGTGGATGAL; RKVFGGTGGATGALP; KVFGGTGGATGALPR; VFGGTGGATGALPRH; FGGTGGATGALPRHG; GGTGGATGALPRHGR; GTGGATGALPRHGRG; TGGATGALPRHGRGS; GGATGALPRHGRGSI; GATGALPRHGRGSIV; ATGALPRHGRGSIVY; TGALPRHGRGSIVYA; GALPRHGRGSIVYAR; ALPRHGRGSIVYARS; LPRHGRGSIVYARST; PRHGRGSIVYARSTT; RHGRGSIVYARSTTI; HGRGSIVYARSTTIE; GRGSIVYARSTTIEA; RGSIVYARSTTIEAQ; GSIVYARSTTIEAQP; SIVYARSTTIEAQPL; IVYARSTTIEAQPLS; VYARSTTIEAQPLSV; YARSTTIEAQPLSVD; ARSTTIEAQPLSVDI; RSTTIEAQPLSVDIG; STTIEAQPLSVDIGI; TTIEAQPLSVDIGIA; TIEAQPLSVDIGIAH; IEAQPLSVDIGIAHV; EAQPLSVDIGIAHVR; AQPLSVDIGIAHVRD; QPLSVDIGIAHVRDV; PLSVDIGIAHVRDVV; LSVDIGIAHVRDVVM; SVDIGIAHVRDVVMP; VDIGIAHVRDVVMPA; DIGIAHVRDVVMPAL; IGIAHVRDVVMPALQ; GIAHVRDVVMPALQE; IAHVRDVVMPALQEI; AHVRDVVMPALQEID; HVRDVVMPALQEIDG; VRDVVMPALQEIDGC; RDVVMPALQEIDGCV; DVVMPALQEIDGCVG; VVMPALQEIDGCVGV; VMPALQEIDGCVGVS; MPALQEIDGCVGVSL; PALQEIDGCVGVSLL; ALQEIDGCVGVSLLV; LQEIDGCVGVSLLVD; QEIDGCVGVSLLVDR; EIDGCVGVSLLVDRQ; IDGCVGVSLLVDRQS; DGCVGVSLLVDRQSG; GCVGVSLLVDRQSGR; CVGVSLLVDRQSGRC; VGVSLLVDRQSGRCI; GVSLLVDRQSGRCIA; VSLLVDRQSGRCIAT; SLLVDRQSGRCIATS; LLVDRQSGRCIATSA; LVDRQSGRCIATSAW; VDRQSGRCIATSAWE; DRQSGRCIATSAWET; RQSGRCIATSAWETL; QSGRCIATSAWETLE; SGRCIATSAWETLEA; GRCIATSAWETLEAM; RCIATSAWETLEAMR; CIATSAWETLEAMRA; IATSAWETLEAMRAS; ATSAWETLEAMRASV; TSAWETLEAMRASVE; SAWETLEAMRASVER; AWETLEAMRASVERV; WETLEAMRASVERVA; ETLEAMRASVERVAP; TLEAMRASVERVAPI; LEAMRASVERVAPIR; EAMRASVERVAPIRD; AMRASVERVAPIRDR; MRASVERVAPIRDRA; RASVERVAPIRDRAA; ASVERVAPIRDRAAL; SVERVAPIRDRAALM; VERVAPIRDRAALMF; ERVAPIRDRAALMFA; RVAPIRDRAALMFAG; VAPIRDRAALMFAGS; APIRDRAALMFAGSA; PIRDRAALMFAGSAR; IRDRAALMFAGSARV; RDRAALMFAGSARVE; DRAALMFAGSARVEE; RAALMFAGSARVEEW; AALMFAGSARVEEWD; ALMFAGSARVEEWDI; LMFAGSARVEEWDIA; MFAGSARVEEWDIAL; FAGSARVEEWDIALL; AGSARVEEWDIALLH; GSARVEEWDIALLHR; SARVEEWDIALLHRD; ARVEEWDIALLHRDH; RVEEWDIALLHRDHP; VEEWDIALLHRDHPS; EEWDIALLHRDHPSH; EWDIALLHRDHPSHE; WDIALLHRDHPSHEG; DIALLHRDHPSHEGA; IALLHRDHPSHEGAC; ALLHRDHPSHEGACV; LLHRDHPSHEGACVR; LHRDHPSHEGACVRA; HRDHPSHEGACVRAT; RDHPSHEGACVRATW; DHPSHEGACVRATWL; HPSHEGACVRATWLK; PSHEGACVRATWLKV; SHEGACVRATWLKVV; HEGACVRATWLKVVP; EGACVRATWLKVVPD; GACVRATWLKVVPDQ; ACVRATWLKVVPDQL; CVRATWLKVVPDQLG; VRATWLKVVPDQLGR; RATWLKVVPDQLGRS; ATWLKVVPDQLGRSL; TWLKVVPDQLGRSLE; WLKVVPDQLGRSLEF; LKVVPDQLGRSLEFY; KVVPDQLGRSLEFYR; VVPDQLGRSLEFYRT; VPDQLGRSLEFYRTS; PDQLGRSLEFYRTSV; DQLGRSLEFYRTSVL; QLGRSLEFYRTSVLP; LGRSLEFYRTSVLPE; GRSLEFYRTSVLPEL; RSLEFYRTSVLPELE; SLEFYRTSVLPELES; | |

Fig. 29 continued

| | | |
|---|---|---|
| | LEFYRTSVLPELESL; EFYRTSVLPELESLD; FYRTSVLPELESLDG;<br>YRTSVLPELESLDGF; RTSVLPELESLDGFC; TSVLPELESLDGFCS;<br>SVLPELESLDGFCSA; VLPELESLDGFCSAS; LPELESLDGFCSASL;<br>PELESLDGFCSASLM; ELESLDGFCSASLMV; LESLDGFCSASLMVD;<br>ESLDGFCSASLMVDH; SLDGFCSASLMVDHP; LDGFCSASLMVDHPA;<br>DGFCSASLMVDHPAC; GFCSASLMVDHPACR; FCSASLMVDHPACRR;<br>CSASLMVDHPACRRA; SASLMVDHPACRRAV; ASLMVDHPACRRAVS;<br>SLMVDHPACRRAVSC; LMVDHPACRRAVSCS; MVDHPACRRAVSCST;<br>VDHPACRRAVSCSTF; DHPACRRAVSCSTFD; HPACRRAVSCSTFDS;<br>PACRRAVSCSTFDSM; ACRRAVSCSTFDSMD; CRRAVSCSTFDSMDA;<br>RRAVSCSTFDSMDAM; RAVSCSTFDSMDAMA; AVSCSTFDSMDAMAR;<br>VSCSTFDSMDAMARN; SCSTFDSMDAMARNR; CSTFDSMDAMARNRD;<br>STFDSMDAMARNRDR; TFDSMDAMARNRDRA; FDSMDAMARNRDRAS;<br>DSMDAMARNRDRASE; SMDAMARNRDRASEL; MDAMARNRDRASELR;<br>DAMARNRDRASELRS; AMARNRDRASELRSR; MARNRDRASELRSRR;<br>ARNRDRASELRSRRV; RNRDRASELRSRRVR; NRDRASELRSRRVRE;<br>RDRASELRSRRVREL; DRASELRSRRVRELG; RASELRSRRVRELGA;<br>ASELRSRRVRELGAE; SELRSRRVRELGAEV; ELRSRRVRELGAEVL;<br>LRSRRVRELGAEVLD; RSRRVRELGAEVLDV; SRRVRELGAEVLDVA;<br>RRVRELGAEVLDVAE; RVRELGAEVLDVAEF; VRELGAEVLDVAEFE;<br>RELGAEVLDVAEFEL; ELGAEVLDVAEFELA; LGAEVLDVAEFELAI;<br>GAEVLDVAEFELAIA; AEVLDVAEFELAIAH; EVLDVAEFELAIAHL;<br>VLDVAEFELAIAHLR; LDVAEFELAIAHLRV; DVAEFELAIAHLRVP;<br>VAEFELAIAHLRVPE; AEFELAIAHLRVPEL; EFELAIAHLRVPELV<br><br>16 mers:<br>MPGSAGWRKVFGGTGG; PGSAGWRKVFGGTGGA; GSAGWRKVFGGTGGAT;<br>SAGWRKVFGGTGGATG; AGWRKVFGGTGGATGA; GWRKVFGGTGGATGAL;<br>WRKVFGGTGGATGALP; RKVFGGTGGATGALPR; KVFGGTGGATGALPRH;<br>VFGGTGGATGALPRHG; FGGTGGATGALPRHGR; GGTGGATGALPRHGRG;<br>GTGGATGALPRHGRGS; TGGATGALPRHGRGSI; GGATGALPRHGRGSIV;<br>GATGALPRHGRGSIVY; ATGALPRHGRGSIVYA; TGALPRHGRGSIVYAR;<br>GALPRHGRGSIVYARS; ALPRHGRGSIVYARST; LPRHGRGSIVYARSTT;<br>PRHGRGSIVYARSTTI; RHGRGSIVYARSTTIE; HGRGSIVYARSTTIEA;<br>GRGSIVYARSTTIEAQ; RGSIVYARSTTIEAQP; GSIVYARSTTIEAQPL;<br>SIVYARSTTIEAQPLS; IVYARSTTIEAQPLSV; VYARSTTIEAQPLSVD;<br>YARSTTIEAQPLSVDI; ARSTTIEAQPLSVDIG; RSTTIEAQPLSVDIGI;<br>STTIEAQPLSVDIGIA; TTIEAQPLSVDIGIAH; TIEAQPLSVDIGIAHV;<br>IEAQPLSVDIGIAHVR; EAQPLSVDIGIAHVRD; AQPLSVDIGIAHVRDV;<br>QPLSVDIGIAHVRDVV; PLSVDIGIAHVRDVVM; LSVDIGIAHVRDVVMP;<br>SVDIGIAHVRDVVMPA; VDIGIAHVRDVVMPAL; DIGIAHVRDVVMPALQ;<br>IGIAHVRDVVMPALQE; GIAHVRDVVMPALQEI; IAHVRDVVMPALQEID;<br>AHVRDVVMPALQEIDG; HVRDVVMPALQEIDGC; VRDVVMPALQEIDGCV;<br>RDVVMPALQEIDGCVG; DVVMPALQEIDGCVGV; VVMPALQEIDGCVGVS;<br>VMPALQEIDGCVGVSL; MPALQEIDGCVGVSLL; PALQEIDGCVGVSLLV;<br>ALQEIDGCVGVSLLVD; LQEIDGCVGVSLLVDR; QEIDGCVGVSLLVDRQ;<br>EIDGCVGVSLLVDRQS; IDGCVGVSLLVDRQSG; DGCVGVSLLVDRQSGR;<br>GCVGVSLLVDRQSGRC; CVGVSLLVDRQSGRCI; VGVSLLVDRQSGRCIA;<br>GVSLLVDRQSGRCIAT; VSLLVDRQSGRCIATS; SLLVDRQSGRCIATSA;<br>LLVDRQSGRCIATSAW; LVDRQSGRCIATSAWE; VDRQSGRCIATSAWET;<br>DRQSGRCIATSAWETL; RQSGRCIATSAWETLE; QSGRCIATSAWETLEA;<br>SGRCIATSAWETLEAM; GRCIATSAWETLEAMR; RCIATSAWETLEAMRA;<br>CIATSAWETLEAMRAS; IATSAWETLEAMRASV; ATSAWETLEAMRASVE; | |

Fig. 29 continued

| | | |
|---|---|---|
| | TSAWETLEAMRASVER; SAWETLEAMRASVERV; AWETLEAMRASVERVA; WETLEAMRASVERVAP; ETLEAMRASVERVAPI; TLEAMRASVERVAPIR; LEAMRASVERVAPIRD; EAMRASVERVAPIRDR; AMRASVERVAPIRDRA; MRASVERVAPIRDRAA; RASVERVAPIRDRAAL; ASVERVAPIRDRAALM; SVERVAPIRDRAALMF; VERVAPIRDRAALMFA; ERVAPIRDRAALMFAG; RVAPIRDRAALMFAGS; VAPIRDRAALMFAGSA; APIRDRAALMFAGSAR; PIRDRAALMFAGSARV; IRDRAALMFAGSARVE; RDRAALMFAGSARVEE; DRAALMFAGSARVEEW; RAALMFAGSARVEEWD; AALMFAGSARVEEWDI; ALMFAGSARVEEWDIA; LMFAGSARVEEWDIAL; MFAGSARVEEWDIALL; FAGSARVEEWDIALLH; AGSARVEEWDIALLHR; GSARVEEWDIALLHRD; SARVEEWDIALLHRDH; ARVEEWDIALLHRDHP; RVEEWDIALLHRDHPS; VEEWDIALLHRDHPSH; EEWDIALLHRDHPSHE; EWDIALLHRDHPSHEG; WDIALLHRDHPSHEGA; DIALLHRDHPSHEGAC; IALLHRDHPSHEGACV; ALLHRDHPSHEGACVR; LLHRDHPSHEGACVRA; LHRDHPSHEGACVRAT; HRDHPSHEGACVRATW; RDHPSHEGACVRATWL; DHPSHEGACVRATWLK; HPSHEGACVRATWLKV; PSHEGACVRATWLKVV; SHEGACVRATWLKVVP; HEGACVRATWLKVVPD; EGACVRATWLKVVPDQ; GACVRATWLKVVPDQL; ACVRATWLKVVPDQLG; CVRATWLKVVPDQLGR; VRATWLKVVPDQLGRS; RATWLKVVPDQLGRSL; ATWLKVVPDQLGRSLE; TWLKVVPDQLGRSLEF; WLKVVPDQLGRSLEFY; LKVVPDQLGRSLEFYR; KVVPDQLGRSLEFYRT; VVPDQLGRSLEFYRTS; VPDQLGRSLEFYRTSV; PDQLGRSLEFYRTSVL; DQLGRSLEFYRTSVLP; QLGRSLEFYRTSVLPE; LGRSLEFYRTSVLPEL; GRSLEFYRTSVLPELE; RSLEFYRTSVLPELES; SLEFYRTSVLPELESL; LEFYRTSVLPELESLD; EFYRTSVLPELESLDG; FYRTSVLPELESLDGF; YRTSVLPELESLDGFC; RTSVLPELESLDGFCS; TSVLPELESLDGFCSA; SVLPELESLDGFCSAS; VLPELESLDGFCSASL; LPELESLDGFCSASLM; PELESLDGFCSASLMV; ELESLDGFCSASLMVD; LESLDGFCSASLMVDH; ESLDGFCSASLMVDHP; SLDGFCSASLMVDHPA; LDGFCSASLMVDHPAC; DGFCSASLMVDHPACR; GFCSASLMVDHPACRR; FCSASLMVDHPACRRA; CSASLMVDHPACRRAV; SASLMVDHPACRRAVS; ASLMVDHPACRRAVSC; SLMVDHPACRRAVSCS; LMVDHPACRRAVSCST; MVDHPACRRAVSCSTF; VDHPACRRAVSCSTFD; DHPACRRAVSCSTFDS; HPACRRAVSCSTFDSM; PACRRAVSCSTFDSMD; ACRRAVSCSTFDSMDA; CRRAVSCSTFDSMDAM; RRAVSCSTFDSMDAMA; RAVSCSTFDSMDAMAR; AVSCSTFDSMDAMARN; VSCSTFDSMDAMARNR; SCSTFDSMDAMARNRD; CSTFDSMDAMARNRDR; STFDSMDAMARNRDRA; TFDSMDAMARNRDRAS; FDSMDAMARNRDRASE; DSMDAMARNRDRASEL; SMDAMARNRDRASELR; MDAMARNRDRASELRS; DAMARNRDRASELRSR; AMARNRDRASELRSRR; MARNRDRASELRSRRV; ARNRDRASELRSRRVR; RNRDRASELRSRRVRE; NRDRASELRSRRVREL; RDRASELRSRRVRELG; DRASELRSRRVRELGA; RASELRSRRVRELGAE; ASELRSRRVRELGAEV; SELRSRRVRELGAEVL; ELRSRRVRELGAEVLD; LRSRRVRELGAEVLDV; RSRRVRELGAEVLDVA; SRRVRELGAEVLDVAE; RRVRELGAEVLDVAEF; RVRELGAEVLDVAEFE; VRELGAEVLDVAEFEL; RELGAEVLDVAEFELA; ELGAEVLDVAEFELAI; LGAEVLDVAEFELAIA; GAEVLDVAEFELAIAH; AEVLDVAEFELAIAHL; EVLDVAEFELAIAHLR; VLDVAEFELAIAHLRV; LDVAEFELAIAHLRVP; DVAEFELAIAHLRVPE; VAEFELAIAHLRVPEL; AEFELAIAHLRVPELV | |
| 44) Rv2653c | 13 mers:<br>MTHKRTKRQPAIA; THKRTKRQPAIAA; HKRTKRQPAIAAG; KRTKRQPAIAAGL; RTKRQPAIAAGLN; TKRQPAIAAGLNA; KRQPAIAAGLNAP; RQPAIAAGLNAPR; QPAIAAGLNAPRR; PAIAAGLNAPRRN; AIAAGLNAPRRNR; IAAGLNAPRRNRV; AAGLNAPRRNRVG; AGLNAPRRNRVGR; GLNAPRRNRVGRQ; LNAPRRNRVGRQH; NAPRRNRVGRQHG; APRRNRVGRQHGW; | 92238-92611 |

Fig. 29 continued

| | | | |
|---|---|---|---|
| | PRRNRVGRQHGWP; RRNRVGRQHGWPA; RNRVGRQHGWPAD; NRVGRQHGWPADV; RVGRQHGWPADVP; VGRQHGWPADVPS; GRQHGWPADVPSA; RQHGWPADVPSAE; QHGWPADVPSAEQ; HGWPADVPSAEQR; GWPADVPSAEQRR; WPADVPSAEQRRA; PADVPSAEQRRAQ; ADVPSAEQRRAQR; DVPSAEQRRAQRQ; VPSAEQRRAQRQR; PSAEQRRAQRQRD; SAEQRRAQRQRDL; AEQRRAQRQRDLE; EQRRAQRQRDLEA; QRRAQRQRDLEAI; RRAQRQRDLEAIR; RAQRQRDLEAIRR; AQRQRDLEAIRRA; QRQRDLEAIRRAY; RQRDLEAIRRAYA; QRDLEAIRRAYAE; RDLEAIRRAYAEM; DLEAIRRAYAEMV; LEAIRRAYAEMVA; EAIRRAYAEMVAT; AIRRAYAEMVATS; IRRAYAEMVATSH; RRAYAEMVATSHE; RAYAEMVATSHEI; AYAEMVATSHEID; YAEMVATSHEIDD; AEMVATSHEIDDD; EMVATSHEIDDDT; MVATSHEIDDDTA; VATSHEIDDDTAE; ATSHEIDDDTAEL; TSHEIDDDTAELA; SHEIDDDTAELAL; HEIDDDTAELALL; EIDDDTAELALLS; IDDDTAELALLSM; DDDTAELALLSMH; DDTAELALLSMHL; DTAELALLSMHLD; TAELALLSMHLDD; AELALLSMHLDDE; ELALLSMHLDDEQ; LALLSMHLDDEQR; ALLSMHLDDEQRR; LLSMHLDDEQRRL; LSMHLDDEQRRLE; SMHLDDEQRRLEA; MHLDDEQRRLEAG; HLDDEQRRLEAGM; LDDEQRRLEAGMK; DDEQRRLEAGMKL; DEQRRLEAGMKLG; EQRRLEAGMKLGW; QRRLEAGMKLGWH; RRLEAGMKLGWHP; RLEAGMKLGWHPY; LEAGMKLGWHPYH; EAGMKLGWHPYHF; AGMKLGWHPYHFP; GMKLGWHPYHFPD; MKLGWHPYHFPDE; KLGWHPYHFPDEP; LGWHPYHFPDEPD; GWHPYHFPDEPDS; WHPYHFPDEPDSK; HPYHFPDEPDSKQ;<br><br>14 mers:<br>MTHKRTKRQPAIAA; THKRTKRQPAIAAG; HKRTKRQPAIAAGL; KRTKRQPAIAAGLN; RTKRQPAIAAGLNA; TKRQPAIAAGLNAP; KRQPAIAAGLNAPR; RQPAIAAGLNAPRR; QPAIAAGLNAPRRN; PAIAAGLNAPRRNR; AIAAGLNAPRRNRV; IAAGLNAPRRNRVG; AAGLNAPRRNRVGR; AGLNAPRRNRVGRQ; GLNAPRRNRVGRQH; LNAPRRNRVGRQHG; NAPRRNRVGRQHGW; APRRNRVGRQHGWP; PRRNRVGRQHGWPA; RRNRVGRQHGWPAD; RNRVGRQHGWPADV; NRVGRQHGWPADVP; RVGRQHGWPADVPS; VGRQHGWPADVPSA; GRQHGWPADVPSAE; RQHGWPADVPSAEQ; QHGWPADVPSAEQR; HGWPADVPSAEQRR; GWPADVPSAEQRRA; WPADVPSAEQRRAQ; PADVPSAEQRRAQR; ADVPSAEQRRAQRQ; DVPSAEQRRAQRQR; VPSAEQRRAQRQRD; PSAEQRRAQRQRDL; SAEQRRAQRQRDLE; AEQRRAQRQRDLEA; EQRRAQRQRDLEAI; QRRAQRQRDLEAIR; RRAQRQRDLEAIRR; RAQRQRDLEAIRRA; AQRQRDLEAIRRAY; QRQRDLEAIRRAYA; RQRDLEAIRRAYAE; QRDLEAIRRAYAEM; RDLEAIRRAYAEMV; DLEAIRRAYAEMVA; LEAIRRAYAEMVAT; EAIRRAYAEMVATS; AIRRAYAEMVATSH; IRRAYAEMVATSHE; RRAYAEMVATSHEI; RAYAEMVATSHEID; AYAEMVATSHEIDD; YAEMVATSHEIDDD; AEMVATSHEIDDDT; EMVATSHEIDDDTA; MVATSHEIDDDTAE; VATSHEIDDDTAEL; ATSHEIDDDTAELA; TSHEIDDDTAELAL; SHEIDDDTAELALL; HEIDDDTAELALLS; EIDDDTAELALLSM; IDDDTAELALLSMH; DDDTAELALLSMHL; DDTAELALLSMHLD; DTAELALLSMHLDD; TAELALLSMHLDDE; AELALLSMHLDDEQ; ELALLSMHLDDEQR; LALLSMHLDDEQRR; ALLSMHLDDEQRRL; LLSMHLDDEQRRLE; LSMHLDDEQRRLEA; SMHLDDEQRRLEAG; MHLDDEQRRLEAGM; HLDDEQRRLEAGMK; LDDEQRRLEAGMKL; DDEQRRLEAGMKLG; DEQRRLEAGMKLGW; EQRRLEAGMKLGWH; QRRLEAGMKLGWHP; RRLEAGMKLGWHPY; RLEAGMKLGWHPYH; | |

Fig. 29 continued

| | | | |
|---|---|---|---|
| | LEAGMKLGWHPYHF; EAGMKLGWHPYHFP; AGMKLGWHPYHFPD; GMKLGWHPYHFPDE; MKLGWHPYHFPDEP; KLGWHPYHFPDEPD; LGWHPYHFPDEPDS; GWHPYHFPDEPDSK; WHPYHFPDEPDSKQ;<br><br>15 mers:<br>MTHKRTKRQPAIAAG; THKRTKRQPAIAAGL; HKRTKRQPAIAAGLN; KRTKRQPAIAAGLNA; RTKRQPAIAAGLNAP; TKRQPAIAAGLNAPR; KRQPAIAAGLNAPRR; RQPAIAAGLNAPRRN; QPAIAAGLNAPRRNR; PAIAAGLNAPRRNRV; AIAAGLNAPRRNRVG; IAAGLNAPRRNRVGR; AAGLNAPRRNRVGRQ; AGLNAPRRNRVGRQH; GLNAPRRNRVGRQHG; LNAPRRNRVGRQHGW; NAPRRNRVGRQHGWP; APRRNRVGRQHGWPA; PRRNRVGRQHGWPAD; RRNRVGRQHGWPADV; RNRVGRQHGWPADVP; NRVGRQHGWPADVPS; RVGRQHGWPADVPSA; VGRQHGWPADVPSAE; GRQHGWPADVPSAEQ; RQHGWPADVPSAEQR; QHGWPADVPSAEQRR; HGWPADVPSAEQRRA; GWPADVPSAEQRRAQ; WPADVPSAEQRRAQR; PADVPSAEQRRAQRQ; ADVPSAEQRRAQRQR; DVPSAEQRRAQRQRD; VPSAEQRRAQRQRDL; PSAEQRRAQRQRDLE; SAEQRRAQRQRDLEA; AEQRRAQRQRDLEAI; EQRRAQRQRDLEAIR; QRRAQRQRDLEAIRR; RRAQRQRDLEAIRRA; RAQRQRDLEAIRRAY; AQRQRDLEAIRRAYA; QRQRDLEAIRRAYAE; RQRDLEAIRRAYAEM; QRDLEAIRRAYAEMV; RDLEAIRRAYAEMVA; DLEAIRRAYAEMVAT; LEAIRRAYAEMVATS; EAIRRAYAEMVATSH; AIRRAYAEMVATSHE; IRRAYAEMVATSHEI; RRAYAEMVATSHEID; RAYAEMVATSHEIDD; AYAEMVATSHEIDDD; YAEMVATSHEIDDDT; AEMVATSHEIDDDTA; EMVATSHEIDDDTAE; MVATSHEIDDDTAEL; VATSHEIDDDTAELA; ATSHEIDDDTAELAL; TSHEIDDDTAELALL; SHEIDDDTAELALLS; HEIDDDTAELALLSM; EIDDDTAELALLSMH; IDDDTAELALLSMHL; DDDTAELALLSMHLD; DDTAELALLSMHLDD; DTAELALLSMHLDDE; TAELALLSMHLDDEQ; AELALLSMHLDDEQR; ELALLSMHLDDEQRR; LALLSMHLDDEQRRL; ALLSMHLDDEQRRLE; LLSMHLDDEQRRLEA; LSMHLDDEQRRLEAG; SMHLDDEQRRLEAGM; MHLDDEQRRLEAGMK; HLDDEQRRLEAGMKL; LDDEQRRLEAGMKLG; DDEQRRLEAGMKLGW; DEQRRLEAGMKLGWH; EQRRLEAGMKLGWHP; QRRLEAGMKLGWHPY; RRLEAGMKLGWHPYH; RLEAGMKLGWHPYHF; LEAGMKLGWHPYHFP; EAGMKLGWHPYHFPD; AGMKLGWHPYHFPDE; GMKLGWHPYHFPDEP; MKLGWHPYHFPDEPD; KLGWHPYHFPDEPDS; LGWHPYHFPDEPDSK; GWHPYHFPDEPDSKQ;<br><br>16 mers:<br>MTHKRTKRQPAIAAGL; THKRTKRQPAIAAGLN; HKRTKRQPAIAAGLNA; KRTKRQPAIAAGLNAP; RTKRQPAIAAGLNAPR; TKRQPAIAAGLNAPRR; KRQPAIAAGLNAPRRN; RQPAIAAGLNAPRRNR; QPAIAAGLNAPRRNRV; PAIAAGLNAPRRNRVG; AIAAGLNAPRRNRVGR; IAAGLNAPRRNRVGRQ; AAGLNAPRRNRVGRQH; AGLNAPRRNRVGRQHG; GLNAPRRNRVGRQHGW; LNAPRRNRVGRQHGWP; NAPRRNRVGRQHGWPA; APRRNRVGRQHGWPAD; PRRNRVGRQHGWPADV; RRNRVGRQHGWPADVP; RNRVGRQHGWPADVPS; NRVGRQHGWPADVPSA; RVGRQHGWPADVPSAE; VGRQHGWPADVPSAEQ; GRQHGWPADVPSAEQR; RQHGWPADVPSAEQRR; QHGWPADVPSAEQRRA; HGWPADVPSAEQRRAQ; GWPADVPSAEQRRAQR; WPADVPSAEQRRAQRQ; PADVPSAEQRRAQRQR; ADVPSAEQRRAQRQRD; DVPSAEQRRAQRQRDL; VPSAEQRRAQRQRDLE; PSAEQRRAQRQRDLEA; SAEQRRAQRQRDLEAI; AEQRRAQRQRDLEAIR; EQRRAQRQRDLEAIRR; QRRAQRQRDLEAIRRA; RRAQRQRDLEAIRRAY; RAQRQRDLEAIRRAYA; AQRQRDLEAIRRAYAE; QRQRDLEAIRRAYAEM; RQRDLEAIRRAYAEMV; QRDLEAIRRAYAEMVA; | |

Fig. 29 continued

| | | |
|---|---|---|
| | RDLEAIRRAYAEMVAT; DLEAIRRAYAEMVATS; LEAIRRAYAEMVATSH; EAIRRAYAEMVATSHE; AIRRAYAEMVATSHEI; IRRAYAEMVATSHEID; RRAYAEMVATSHEIDD; RAYAEMVATSHEIDDD; AYAEMVATSHEIDDDT; YAEMVATSHEIDDDTA; AEMVATSHEIDDDTAE; EMVATSHEIDDDTAEL; MVATSHEIDDDTAELA; VATSHEIDDDTAELAL; ATSHEIDDDTAELALL; TSHEIDDDTAELALLS; SHEIDDDTAELALLSM; HEIDDDTAELALLSMH; EIDDDTAELALLSMHL; IDDDTAELALLSMHLD; DDDTAELALLSMHLDD; DDTAELALLSMHLDDE; DTAELALLSMHLDDEQ; TAELALLSMHLDDEQR; AELALLSMHLDDEQRR; ELALLSMHLDDEQRRL; LALLSMHLDDEQRRLE; ALLSMHLDDEQRRLEA; LLSMHLDDEQRRLEAG; LSMHLDDEQRRLEAGM; SMHLDDEQRRLEAGMK; MHLDDEQRRLEAGMKL; HLDDEQRRLEAGMKLG; LDDEQRRLEAGMKLGW; DDEQRRLEAGMKLGWH; DEQRRLEAGMKLGWHP; EQRRLEAGMKLGWHPY; QRRLEAGMKLGWHPYH; RRLEAGMKLGWHPYHF; RLEAGMKLGWHPYHFP; LEAGMKLGWHPYHFPD; EAGMKLGWHPYHFPDE; AGMKLGWHPYHFPDEP; GMKLGWHPYHFPDEPD; MKLGWHPYHFPDEPDS; KLGWHPYHFPDEPDSK; LGWHPYHFPDEPDSKQ | |
| 45) Rv2654c | 13 mers:<br>MSGHALAARTLLA; SGHALAARTLLAA; GHALAARTLLAAA; HALAARTLLAAAD; ALAARTLLAAADE; LAARTLLAAADEL; AARTLLAAADELV; ARTLLAAADELVG; RTLLAAADELVGG; TLLAAADELVGGP; LLAAADELVGGPP; LAAADELVGGPPV; AAADELVGGPPVE; AADELVGGPPVEA; ADELVGGPPVEAS; DELVGGPPVEASA; ELVGGPPVEASAA; LVGGPPVEASAAA; VGGPPVEASAAAL; GGPPVEASAAALA; GPPVEASAAALAG; PPVEASAAALAGD; PVEASAAALAGDA; VEASAAALAGDAA; EASAAALAGDAAG; ASAAALAGDAAGA; SAAALAGDAAGAW; AAALAGDAAGAWR; AALAGDAAGAWRT; ALAGDAAGAWRTA; LAGDAAGAWRTAA; AGDAAGAWRTAAV; GDAAGAWRTAAVE; DAAGAWRTAAVEL; AAGAWRTAAVELA; AGAWRTAAVELAR; GAWRTAAVELARA; AWRTAAVELARAL; WRTAAVELARALV; RTAAVELARALVR; TAAVELARALVRA; AAVELARALVRAV; AVELARALVRAVA; VELARALVRAVAE; ELARALVRAVAES; LARALVRAVAESH; ARALVRAVAESHG; RALVRAVAESHGV; ALVRAVAESHGVA; LVRAVAESHGVAA; VRAVAESHGVAAV; RAVAESHGVAAVL; AVAESHGVAAVLF; VAESHGVAAVLFA; AESHGVAAVLFAA; ESHGVAAVLFAAT; SHGVAAVLFAATA; HGVAAVLFAATAA; GVAAVLFAATAAA; VAAVLFAATAAAA; AAVLFAATAAAAA; AVLFAATAAAAAA; VLFAATAAAAAAV; LFAATAAAAAAVD; FAATAAAAAAVDR; AATAAAAAAVDRG; ATAAAAAAVDRGD; TAAAAAAVDRGDP; AAAAAAVDRGDPP;<br><br>14 mers:<br>MSGHALAARTLLAA; SGHALAARTLLAAA; GHALAARTLLAAAD; HALAARTLLAAADE; ALAARTLLAAADEL; LAARTLLAAADELV; AARTLLAAADELVG; ARTLLAAADELVGG; RTLLAAADELVGGP; TLLAAADELVGGPP; LLAAADELVGGPPV; LAAADELVGGPPVE; AAADELVGGPPVEA; AADELVGGPPVEAS; ADELVGGPPVEASA; DELVGGPPVEASAA; ELVGGPPVEASAAA; LVGGPPVEASAAAL; VGGPPVEASAAALA; GGPPVEASAAALAG; GPPVEASAAALAGD; PPVEASAAALAGDA; PVEASAAALAGDAA; VEASAAALAGDAAG; EASAAALAGDAAGA; ASAAALAGDAAGAW; SAAALAGDAAGAWR; AAALAGDAAGAWRT; AALAGDAAGAWRTA; ALAGDAAGAWRTAA; LAGDAAGAWRTAAV; AGDAAGAWRTAAVE; GDAAGAWRTAAVEL; DAAGAWRTAAVELA; AAGAWRTAAVELAR; AGAWRTAAVELARA; GAWRTAAVELARAL; AWRTAAVELARALV; WRTAAVELARALVR; RTAAVELARALVRA; TAAVELARALVRAV; AAVELARALVRAVA; AVELARALVRAVAE; VELARALVRAVAES; ELARALVRAVAESH; | 92612-92881 |

Fig. 29 continued

| | | | |
|---|---|---|---|
| | LARALVRAVAESHG; ARALVRAVAESHGV; RALVRAVAESHGVA; ALVRAVAESHGVAA; LVRAVAESHGVAAV; VRAVAESHGVAAVL; RAVAESHGVAAVLF; AVAESHGVAAVLFA; VAESHGVAAVLFAA; AESHGVAAVLFAAT; ESHGVAAVLFAATA; SHGVAAVLFAATAA; HGVAAVLFAATAAA; GVAAVLFAATAAAA; VAAVLFAATAAAAA; AAVLFAATAAAAAA; AVLFAATAAAAAAV; VLFAATAAAAAAVD; LFAATAAAAAAVDR; FAATAAAAAAVDRG; AATAAAAAAVDRGD; ATAAAAAAVDRGDP; TAAAAAAVDRGDPP;<br><br>15 mers:<br>MSGHALAARTLLAAA; SGHALAARTLLAAAD; GHALAARTLLAAADE; HALAARTLLAAADEL; ALAARTLLAAADELV; LAARTLLAAADELVG; AARTLLAAADELVGG; ARTLLAAADELVGGP; RTLLAAADELVGGPP; TLLAAADELVGGPPV; LLAAADELVGGPPVE; LAAADELVGGPPVEA; AAADELVGGPPVEAS; AADELVGGPPVEASA; ADELVGGPPVEASAA; DELVGGPPVEASAAA; ELVGGPPVEASAAAL; LVGGPPVEASAAALA; VGGPPVEASAAALAG; GGPPVEASAAALAGD; GPPVEASAAALAGDA; PPVEASAAALAGDAA; PVEASAAALAGDAAG; VEASAAALAGDAAGA; EASAAALAGDAAGAW; ASAAALAGDAAGAWR; SAAALAGDAAGAWRT; AAALAGDAAGAWRTA; AALAGDAAGAWRTAA; ALAGDAAGAWRTAAV; LAGDAAGAWRTAAVE; AGDAAGAWRTAAVEL; GDAAGAWRTAAVELA; DAAGAWRTAAVELAR; AAGAWRTAAVELARA; AGAWRTAAVELARAL; GAWRTAAVELARALV; AWRTAAVELARALVR; WRTAAVELARALVRA; RTAAVELARALVRAV; TAAVELARALVRAVA; AAVELARALVRAVAE; AVELARALVRAVAES; VELARALVRAVAESH; ELARALVRAVAESHG; LARALVRAVAESHGV; ARALVRAVAESHGVA; RALVRAVAESHGVAA; ALVRAVAESHGVAAV; LVRAVAESHGVAAVL; VRAVAESHGVAAVLF; RAVAESHGVAAVLFA; AVAESHGVAAVLFAA; VAESHGVAAVLFAAT; AESHGVAAVLFAATA; ESHGVAAVLFAATAA; SHGVAAVLFAATAAA; HGVAAVLFAATAAAA; GVAAVLFAATAAAAA; VAAVLFAATAAAAAA; AAVLFAATAAAAAAV; AVLFAATAAAAAAVD; VLFAATAAAAAAVDR; LFAATAAAAAAVDRG; FAATAAAAAAVDRGD; AATAAAAAAVDRGDP; ATAAAAAAVDRGDPP;<br><br>16 mers:<br>MSGHALAARTLLAAAD; SGHALAARTLLAAADE; GHALAARTLLAAADEL; HALAARTLLAAADELV; ALAARTLLAAADELVG; LAARTLLAAADELVGG; AARTLLAAADELVGGP; ARTLLAAADELVGGPP; RTLLAAADELVGGPPV; TLLAAADELVGGPPVE; LLAAADELVGGPPVEA; LAAADELVGGPPVEAS; AAADELVGGPPVEASA; AADELVGGPPVEASAA; ADELVGGPPVEASAAA; DELVGGPPVEASAAAL; ELVGGPPVEASAAALA; LVGGPPVEASAAALAG; VGGPPVEASAAALAGD; GGPPVEASAAALAGDA; GPPVEASAAALAGDAA; PPVEASAAALAGDAAG; PVEASAAALAGDAAGA; VEASAAALAGDAAGAW; EASAAALAGDAAGAWR; ASAAALAGDAAGAWRT; SAAALAGDAAGAWRTA; AAALAGDAAGAWRTAA; AALAGDAAGAWRTAAV; ALAGDAAGAWRTAAVE; LAGDAAGAWRTAAVEL; AGDAAGAWRTAAVELA; GDAAGAWRTAAVELAR; DAAGAWRTAAVELARA; AAGAWRTAAVELARAL; AGAWRTAAVELARALV; GAWRTAAVELARALVR; AWRTAAVELARALVRA; WRTAAVELARALVRAV; RTAAVELARALVRAVA; TAAVELARALVRAVAE; AAVELARALVRAVAES; AVELARALVRAVAESH; VELARALVRAVAESHG; ELARALVRAVAESHGV; LARALVRAVAESHGVA; ARALVRAVAESHGVAA; RALVRAVAESHGVAAV; ALVRAVAESHGVAAVL; LVRAVAESHGVAAVLF; VRAVAESHGVAAVLFA; RAVAESHGVAAVLFAA; AVAESHGVAAVLFAAT; VAESHGVAAVLFAATA; | |

Fig. 29 continued

| | | |
|---|---|---|
| | AESHGVAAVLFAATAA; ESHGVAAVLFAATAAA; SHGVAAVLFAATAAAA;<br>HGVAAVLFAATAAAAA; GVAAVLFAATAAAAAA; VAAVLFAATAAAAAAV;<br>AAVLFAATAAAAAAVD; AVLFAATAAAAAAVDR; VLFAATAAAAAAVDRG;<br>LFAATAAAAAAVDRGD; FAATAAAAAAVDRGDP; AATAAAAAAVDRGDPP | |
| 46)<br>Rv2655c | 13 mers:<br>MADIPYGRDYPDP; ADIPYGRDYPDPI; DIPYGRDYPDPIW; IPYGRDYPDPIWC;<br>PYGRDYPDPIWCD; YGRDYPDPIWCDE; GRDYPDPIWCDED;<br>RDYPDPIWCDEDG; DYPDPIWCDEDGQ; YPDPIWCDEDGQP;<br>PDPIWCDEDGQPM; DPIWCDEDGQPMP; PIWCDEDGQPMPP;<br>IWCDEDGQPMPPV; WCDEDGQPMPPVG; CDEDGQPMPPVGA;<br>DEDGQPMPPVGAE; EDGQPMPPVGAEL; DGQPMPPVGAELL;<br>GQPMPPVGAELLD; QPMPPVGAELLDD; PMPPVGAELLDDI; MPPVGAELLDDIR;<br>PPVGAELLDDIRA; PVGAELLDDIRAF; VGAELLDDIRAFL; GAELLDDIRAFLR;<br>AELLDDIRAFLRR; ELLDDIRAFLRRF; LLDDIRAFLRRFV; LDDIRAFLRRFVV;<br>DDIRAFLRRFVVY; DIRAFLRRFVVYP; IRAFLRRFVVYPS; RAFLRRFVVYPSD;<br>AFLRRFVVYPSDH; FLRRFVVYPSDHE; LRRFVVYPSDHEL; RRFVVYPSDHELI;<br>RFVVYPSDHELIA; FVVYPSDHELIAH; VVYPSDHELIAHT; VYPSDHELIAHTL;<br>YPSDHELIAHTLW; PSDHELIAHTLWI; SDHELIAHTLWIA; DHELIAHTLWIAH;<br>HELIAHTLWIAHC; ELIAHTLWIAHCW; LIAHTLWIAHCWF; IAHTLWIAHCWFM;<br>AHTLWIAHCWFME; HTLWIAHCWFMEA; TLWIAHCWFMEAW;<br>LWIAHCWFMEAWD; WIAHCWFMEAWDS; IAHCWFMEAWDST;<br>AHCWFMEAWDSTP; HCWFMEAWDSTPR; CWFMEAWDSTPRI;<br>WFMEAWDSTPRIA; FMEAWDSTPRIAF; MEAWDSTPRIAFL; EAWDSTPRIAFLS;<br>AWDSTPRIAFLSP; WDSTPRIAFLSPE; DSTPRIAFLSPEP; STPRIAFLSPEPG;<br>TPRIAFLSPEPGS; PRIAFLSPEPGSG; RIAFLSPEPGSGK; IAFLSPEPGSGKS;<br>AFLSPEPGSGKSR; FLSPEPGSGKSRA; LSPEPGSGKSRAL; SPEPGSGKSRALE;<br>PEPGSGKSRALEV; EPGSGKSRALEVT; PGSGKSRALEVTE; GSGKSRALEVTEP;<br>SGKSRALEVTEPL; GKSRALEVTEPLV; KSRALEVTEPLVP; SRALEVTEPLVPR;<br>RALEVTEPLVPRP; ALEVTEPLVPRPV; LEVTEPLVPRPVH; EVTEPLVPRPVHA;<br>VTEPLVPRPVHAI; TEPLVPRPVHAIN; EPLVPRPVHAINC; PLVPRPVHAINCT;<br>LVPRPVHAINCTP; VPRPVHAINCTPA; PRPVHAINCTPAY; RPVHAINCTPAYL;<br>PVHAINCTPAYLF; VHAINCTPAYLFR; HAINCTPAYLFRR; AINCTPAYLFRRV;<br>INCTPAYLFRRVA; NCTPAYLFRRVAD; CTPAYLFRRVADP; TPAYLFRRVADPV;<br>PAYLFRRVADPVG; AYLFRRVADPVGR; YLFRRVADPVGRP; LFRRVADPVGRPT;<br>FRRVADPVGRPTV; RRVADPVGRPTVL; RVADPVGRPTVLY; VADPVGRPTVLYD;<br>ADPVGRPTVLYDE; DPVGRPTVLYDEC; PVGRPTVLYDECD; VGRPTVLYDECDT;<br>GRPTVLYDECDTL; RPTVLYDECDTLF; PTVLYDECDTLFG; TVLYDECDTLFGP;<br>VLYDECDTLFGPK; LYDECDTLFGPKA; YDECDTLFGPKAK; DECDTLFGPKAKE;<br>ECDTLFGPKAKEH; CDTLFGPKAKEHE; DTLFGPKAKEHEE; TLFGPKAKEHEEI;<br>LFGPKAKEHEEIR; FGPKAKEHEEIRG; GPKAKEHEEIRGV; PKAKEHEEIRGVI;<br>KAKEHEEIRGVIN; AKEHEEIRGVINA; KEHEEIRGVINAG; EHEEIRGVINAGH;<br>HEEIRGVINAGHR; EEIRGVINAGHRK; EIRGVINAGHRKG; IRGVINAGHRKGA;<br>RGVINAGHRKGAV; GVINAGHRKGAVA; VINAGHRKGAVAG; INAGHRKGAVAGR;<br>NAGHRKGAVAGRC; AGHRKGAVAGRCV; GHRKGAVAGRCVI;<br>HRKGAVAGRCVIR; RKGAVAGRCVIRG; KGAVAGRCVIRGK; GAVAGRCVIRGKI;<br>AVAGRCVIRGKIV; VAGRCVIRGKIVE; AGRCVIRGKIVET; GRCVIRGKIVETE;<br>RCVIRGKIVETEE; CVIRGKIVETEEL; VIRGKIVETEELP; IRGKIVETEELPA;<br>RGKIVETEELPAY; GKIVETEELPAYC; KIVETEELPAYCA; IVETEELPAYCAV;<br>VETEELPAYCAVA; ETEELPAYCAVAL; TEELPAYCAVALA; EELPAYCAVALAG;<br>ELPAYCAVALAGL; LPAYCAVALAGLD; PAYCAVALAGLDD; AYCAVALAGLDDL;<br>YCAVALAGLDDLP; CAVALAGLDDLPD; AVALAGLDDLPDT; VALAGLDDLPDTI;<br>ALAGLDDLPDTIM; LAGLDDLPDTIMS; AGLDDLPDTIMSR; GLDDLPDTIMSRS;<br>LDDLPDTIMSRSI; DDLPDTIMSRSIV; DLPDTIMSRSIVV; LPDTIMSRSIVVR; | 92882-<br>94727 |

Fig. 29 continued

| | | |
|---|---|---|
| | PDTIMSRSIVVRM; DTIMSRSIVVRMR; TIMSRSIVVRMRR; IMSRSIVVRMRRR;<br>MSRSIVVRMRRRA; SRSIVVRMRRRAP; RSIVVRMRRRAPT; SIVVRMRRRAPTE;<br>IVVRMRRRAPTEP; VVRMRRRAPTEPV; VRMRRRAPTEPVE;<br>RMRRRAPTEPVEP; MRRRAPTEPVEPW; RRRAPTEPVEPWR;<br>RRAPTEPVEPWRP; RAPTEPVEPWRPR; APTEPVEPWRPRV;<br>PTEPVEPWRPRVN; TEPVEPWRPRVNG; EPVEPWRPRVNGP;<br>PVEPWRPRVNGPE; VEPWRPRVNGPEA; EPWRPRVNGPEAE;<br>PWRPRVNGPEAEK; WRPRVNGPEAEKL; RPRVNGPEAEKLH;<br>PRVNGPEAEKLHD; RVNGPEAEKLHDR; VNGPEAEKLHDRL; NGPEAEKLHDRLA;<br>GPEAEKLHDRLAN; PEAEKLHDRLANW; EAEKLHDRLANWA;<br>AEKLHDRLANWAA; EKLHDRLANWAAA; KLHDRLANWAAAI; LHDRLANWAAAIN;<br>HDRLANWAAAINP; DRLANWAAAINPL; RLANWAAAINPLE; LANWAAAINPLES;<br>ANWAAAINPLESG; NWAAAINPLESGW; WAAAINPLESGWP; AAAINPLESGWPA;<br>AAINPLESGWPAM; AINPLESGWPAMP; INPLESGWPAMPD;<br>NPLESGWPAMPDG; PLESGWPAMPDGV; LESGWPAMPDGVT;<br>ESGWPAMPDGVTD; SGWPAMPDGVTDR; GWPAMPDGVTDRR;<br>WPAMPDGVTDRRA; PAMPDGVTDRRAD; AMPDGVTDRRADV;<br>MPDGVTDRRADVW; PDGVTDRRADVWE; DGVTDRRADVWES;<br>GVTDRRADVWESL; VTDRRADVWESLV; TDRRADVWESLVA;<br>DRRADVWESLVAV; RRADVWESLVAVA; RADVWESLVAVAD;<br>ADVWESLVAVADT; DVWESLVAVADTA; VWESLVAVADTAG;<br>WESLVAVADTAGG; ESLVAVADTAGGH; SLVAVADTAGGHW;<br>LVAVADTAGGHWP; VAVADTAGGHWPK; AVADTAGGHWPKT;<br>VADTAGGHWPKTA; ADTAGGHWPKTAR; DTAGGHWPKTARA;<br>TAGGHWPKTARAT; AGGHWPKTARATA; GGHWPKTARATAE;<br>GHWPKTARATAET; HWPKTARATAETD; WPKTARATAETDA; PKTARATAETDAT;<br>KTARATAETDATA; TARATAETDATAN; ARATAETDATANR; RATAETDATANRG;<br>ATAETDATANRGA; TAETDATANRGAK; AETDATANRGAKP; ETDATANRGAKPS;<br>TDATANRGAKPSI; DATANRGAKPSIG; ATANRGAKPSIGV; TANRGAKPSIGVL;<br>ANRGAKPSIGVLL; NRGAKPSIGVLLL; RGAKPSIGVLLLR; GAKPSIGVLLLRD;<br>AKPSIGVLLLRDI; KPSIGVLLLRDIR; PSIGVLLLRDIRR; SIGVLLLRDIRRV;<br>IGVLLLRDIRRVF; GVLLLRDIRRVFS; VLLLRDIRRVFSD; LLLRDIRRVFSDR;<br>LLRDIRRVFSDRD; LRDIRRVFSDRDR; RDIRRVFSDRDRM; DIRRVFSDRDRMR;<br>IRRVFSDRDRMRT; RRVFSDRDRMRTS; RVFSDRDRMRTSD;<br>VFSDRDRMRTSDI; FSDRDRMRTSDIL; SDRDRMRTSDILT; DRDRMRTSDILTG;<br>RDRMRTSDILTGL; DRMRTSDILTGLN; RMRTSDILTGLNR; MRTSDILTGLNRM;<br>RTSDILTGLNRME; TSDILTGLNRMEE; SDILTGLNRMEEG; DILTGLNRMEEGP;<br>ILTGLNRMEEGPW; LTGLNRMEEGPWG; TGLNRMEEGPWGS;<br>GLNRMEEGPWGSI; LNRMEEGPWGSIR; NRMEEGPWGSIRR;<br>RMEEGPWGSIRRG; MEEGPWGSIRRGD; EEGPWGSIRRGDP;<br>EGPWGSIRRGDPL; GPWGSIRRGDPLD; PWGSIRRGDPLDA;<br>WGSIRRGDPLDAR; GSIRRGDPLDARG; SIRRGDPLDARGL; IRRGDPLDARGLA;<br>RRGDPLDARGLAT; RGDPLDARGLATR; GDPLDARGLATRL; DPLDARGLATRLG;<br>PLDARGLATRLGR; LDARGLATRLGRY; DARGLATRLGRYG; ARGLATRLGRYGI;<br>RGLATRLGRYGIG; GLATRLGRYGIGP; LATRLGRYGIGPK; ATRLGRYGIGPKF;<br>TRLGRYGIGPKFQ; RLGRYGIGPKFQH; LGRYGIGPKFQHS; GRYGIGPKFQHSG;<br>RYGIGPKFQHSGG; YGIGPKFQHSGGE; GIGPKFQHSGGEP; IGPKFQHSGGEPP;<br>GPKFQHSGGEPPY; PKFQHSGGEPPYK; KFQHSGGEPPYKG;<br>FQHSGGEPPYKGY; QHSGGEPPYKGYS; HSGGEPPYKGYSR;<br>SGGEPPYKGYSRT; GGEPPYKGYSRTQ; GEPPYKGYSRTQF;<br>EPPYKGYSRTQFE; PPYKGYSRTQFED; PYKGYSRTQFEDA;<br>YKGYSRTQFEDAW; KGYSRTQFEDAWS; GYSRTQFEDAWSR;<br>YSRTQFEDAWSRY; SRTQFEDAWSRYL; RTQFEDAWSRYLS; | |

Fig. 29 continued

| | | |
|---|---|---|
| | TQFEDAWSRYLSA; QFEDAWSRYLSAD; FEDAWSRYLSADD;<br>EDAWSRYLSADDE; DAWSRYLSADDET; AWSRYLSADDETP;<br>WSRYLSADDETPE; SRYLSADDETPEE; RYLSADDETPEER; YLSADDETPEERD;<br>LSADDETPEERDL; SADDETPEERDLS; ADDETPEERDLSV; DDETPEERDLSVS;<br>DETPEERDLSVSA; ETPEERDLSVSAV; TPEERDLSVSAVS; PEERDLSVSAVSA;<br>EERDLSVSAVSAV; ERDLSVSAVSAVS; RDLSVSAVSAVSP; DLSVSAVSAVSPP;<br>LSVSAVSAVSPPV; SVSAVSAVSPPVG; VSAVSAVSPPVGD; SAVSAVSPPVGDP;<br>AVSAVSPPVGDPG; VSAVSPPVGDPGD; SAVSPPVGDPGDA;<br>AVSPPVGDPGDAT; VSPPVGDPGDATG; SPPVGDPGDATGA;<br>PPVGDPGDATGAT; PVGDPGDATGATD; VGDPGDATGATDA;<br>GDPGDATGATDAT; DPGDATGATDATD; PGDATGATDATDL;<br>GDATGATDATDLP; DATGATDATDLPE; ATGATDATDLPEA; TGATDATDLPEAG;<br>GATDATDLPEAGD; ATDATDLPEAGDL; TDATDLPEAGDLP; DATDLPEAGDLPY;<br>ATDLPEAGDLPYE; TDLPEAGDLPYEP; DLPEAGDLPYEPP; LPEAGDLPYEPPA;<br>PEAGDLPYEPPAP; EAGDLPYEPPAPN; AGDLPYEPPAPNG; GDLPYEPPAPNGH;<br>DLPYEPPAPNGHP; LPYEPPAPNGHPN; PYEPPAPNGHPNG;<br>YEPPAPNGHPNGD; EPPAPNGHPNGDA; PPAPNGHPNGDAP;<br>PAPNGHPNGDAPL; APNGHPNGDAPLC; PNGHPNGDAPLCS;<br>NGHPNGDAPLCSG; GHPNGDAPLCSGP; HPNGDAPLCSGPG;<br>PNGDAPLCSGPGC; NGDAPLCSGPGCP; GDAPLCSGPGCPN;<br>DAPLCSGPGCPNK; APLCSGPGCPNKL; PLCSGPGCPNKLL; LCSGPGCPNKLLS;<br>CSGPGCPNKLLST; SGPGCPNKLLSTE; GPGCPNKLLSTEA; PGCPNKLLSTEAK;<br>GCPNKLLSTEAKA; CPNKLLSTEAKAA; PNKLLSTEAKAAG; NKLLSTEAKAAGK;<br>KLLSTEAKAAGKC; LLSTEAKAAGKCR; LSTEAKAAGKCRP; STEAKAAGKCRPC;<br>TEAKAAGKCRPCR; EAKAAGKCRPCRG; AKAAGKCRPCRGR;<br>KAAGKCRPCRGRA; AAGKCRPCRGRAA; AGKCRPCRGRAAA;<br>GKCRPCRGRAAAS; KCRPCRGRAAASA; CRPCRGRAAASAR;<br>RPCRGRAAASARD; PCRGRAAASARDG; CRGRAAASARDGA;<br>RGRAAASARDGAR<br><br>14 mers:<br>MADIPYGRDYPDPI; ADIPYGRDYPDPIW; DIPYGRDYPDPIWC;<br>IPYGRDYPDPIWCD; PYGRDYPDPIWCDE; YGRDYPDPIWCDED;<br>GRDYPDPIWCDEDG; RDYPDPIWCDEDGQ; DYPDPIWCDEDGQP;<br>YPDPIWCDEDGQPM; PDPIWCDEDGQPMP; DPIWCDEDGQPMPP;<br>PIWCDEDGQPMPPV; IWCDEDGQPMPPVG; WCDEDGQPMPPVGA;<br>CDEDGQPMPPVGAE; DEDGQPMPPVGAEL; EDGQPMPPVGAELL;<br>DGQPMPPVGAELLD; GQPMPPVGAELLDD; QPMPPVGAELLDDI;<br>PMPPVGAELLDDIR; MPPVGAELLDDIRA; PPVGAELLDDIRAF;<br>PVGAELLDDIRAFL; VGAELLDDIRAFLR; GAELLDDIRAFLRR;<br>AELLDDIRAFLRRF; ELLDDIRAFLRRFV; LLDDIRAFLRRFVV; LDDIRAFLRRFVVY;<br>DDIRAFLRRFVVYP; DIRAFLRRFVVYPS; IRAFLRRFVVYPSD;<br>RAFLRRFVVYPSDH; AFLRRFVVYPSDHE; FLRRFVVYPSDHEL;<br>LRRFVVYPSDHELI; RRFVVYPSDHELIA; RFVVYPSDHELIAH;<br>FVVYPSDHELIAHT; VVYPSDHELIAHTL; VYPSDHELIAHTLW;<br>YPSDHELIAHTLWI; PSDHELIAHTLWIA; SDHELIAHTLWIAH; DHELIAHTLWIAHC;<br>HELIAHTLWIAHCW; ELIAHTLWIAHCWF; LIAHTLWIAHCWFM;<br>IAHTLWIAHCWFME; AHTLWIAHCWFMEA; HTLWIAHCWFMEAW;<br>TLWIAHCWFMEAWD; LWIAHCWFMEAWDS; WIAHCWFMEAWDST;<br>IAHCWFMEAWDSTP; AHCWFMEAWDSTPR; HCWFMEAWDSTPRI;<br>CWFMEAWDSTPRIA; WFMEAWDSTPRIAF; FMEAWDSTPRIAFL;<br>MEAWDSTPRIAFLS; EAWDSTPRIAFLSP; AWDSTPRIAFLSPE;<br>WDSTPRIAFLSPEP; DSTPRIAFLSPEPG; STPRIAFLSPEPGS; | |

Fig. 29 continued

| | | | |
|---|---|---|---|
| | TPRIAFLSPEPGSG; PRIAFLSPEPGSGK; RIAFLSPEPGSGKS;<br>IAFLSPEPGSGKSR; AFLSPEPGSGKSRA; FLSPEPGSGKSRAL;<br>LSPEPGSGKSRALE; SPEPGSGKSRALEV; PEPGSGKSRALEVT;<br>EPGSGKSRALEVTE; PGSGKSRALEVTEP; GSGKSRALEVTEPL;<br>SGKSRALEVTEPLV; GKSRALEVTEPLVP; KSRALEVTEPLVPR;<br>SRALEVTEPLVPRP; RALEVTEPLVPRPV; ALEVTEPLVPRPVH;<br>LEVTEPLVPRPVHA; EVTEPLVPRPVHAI; VTEPLVPRPVHAIN;<br>TEPLVPRPVHAINC; EPLVPRPVHAINCT; PLVPRPVHAINCTP;<br>LVPRPVHAINCTPA; VPRPVHAINCTPAY; PRPVHAINCTPAYL;<br>RPVHAINCTPAYLF; PVHAINCTPAYLFR; VHAINCTPAYLFRR;<br>HAINCTPAYLFRRV; AINCTPAYLFRRVA; INCTPAYLFRRVAD;<br>NCTPAYLFRRVADP; CTPAYLFRRVADPV; TPAYLFRRVADPVG;<br>PAYLFRRVADPVGR; AYLFRRVADPVGRP; YLFRRVADPVGRPT;<br>LFRRVADPVGRPTV; FRRVADPVGRPTVL; RRVADPVGRPTVLY;<br>RVADPVGRPTVLYD; VADPVGRPTVLYDE; ADPVGRPTVLYDEC;<br>DPVGRPTVLYDECD; PVGRPTVLYDECDT; VGRPTVLYDECDTL;<br>GRPTVLYDECDTLF; RPTVLYDECDTLFG; PTVLYDECDTLFGP;<br>TVLYDECDTLFGPK; VLYDECDTLFGPKA; LYDECDTLFGPKAK;<br>YDECDTLFGPKAKE; DECDTLFGPKAKEH; ECDTLFGPKAKEHE;<br>CDTLFGPKAKEHEE; DTLFGPKAKEHEEI; TLFGPKAKEHEEIR;<br>LFGPKAKEHEEIRG; FGPKAKEHEEIRGV; GPKAKEHEEIRGVI;<br>PKAKEHEEIRGVIN; KAKEHEEIRGVINA; AKEHEEIRGVINAG;<br>KEHEEIRGVINAGH; EHEEIRGVINAGHR; HEEIRGVINAGHRK;<br>EEIRGVINAGHRKG; EIRGVINAGHRKGA; IRGVINAGHRKGAV;<br>RGVINAGHRKGAVA; GVINAGHRKGAVAG; VINAGHRKGAVAGR;<br>INAGHRKGAVAGRC; NAGHRKGAVAGRCV; AGHRKGAVAGRCVI;<br>GHRKGAVAGRCVIR; HRKGAVAGRCVIRG; RKGAVAGRCVIRGK;<br>KGAVAGRCVIRGKI; GAVAGRCVIRGKIV; AVAGRCVIRGKIVE;<br>VAGRCVIRGKIVET; AGRCVIRGKIVETE; GRCVIRGKIVETEE; RCVIRGKIVETEEL;<br>CVIRGKIVETEELP; VIRGKIVETEELPA; IRGKIVETEELPAY; RGKIVETEELPAYC;<br>GKIVETEELPAYCA; KIVETEELPAYCAV; IVETEELPAYCAVA;<br>VETEELPAYCAVAL; ETEELPAYCAVALA; TEELPAYCAVALAG;<br>EELPAYCAVALAGL; ELPAYCAVALAGLD; LPAYCAVALAGLDD;<br>PAYCAVALAGLDDL; AYCAVALAGLDDLP; YCAVALAGLDDLPD;<br>CAVALAGLDDLPDT; AVALAGLDDLPDTI; VALAGLDDLPDTIM;<br>ALAGLDDLPDTIMS; LAGLDDLPDTIMSR; AGLDDLPDTIMSRS;<br>GLDDLPDTIMSRSI; LDDLPDTIMSRSIV; DDLPDTIMSRSIVV; DLPDTIMSRSIVVR;<br>LPDTIMSRSIVVRM; PDTIMSRSIVVRMR; DTIMSRSIVVRMRR;<br>TIMSRSIVVRMRRR; IMSRSIVVRMRRRA; MSRSIVVRMRRRAP;<br>SRSIVVRMRRRAPT; RSIVVRMRRRAPTE; SIVVRMRRRAPTEP;<br>IVVRMRRRAPTEPV; VVRMRRRAPTEPVE; VRMRRRAPTEPVEP;<br>RMRRRAPTEPVEPW; MRRRAPTEPVEPWR; RRRAPTEPVEPWRP;<br>RRAPTEPVEPWRPR; RAPTEPVEPWRPRV; APTEPVEPWRPRVN;<br>PTEPVEPWRPRVNG; TEPVEPWRPRVNGP; EPVEPWRPRVNGPE;<br>PVEPWRPRVNGPEA; VEPWRPRVNGPEAE; EPWRPRVNGPEAEK;<br>PWRPRVNGPEAEKL; WRPRVNGPEAEKLH; RPRVNGPEAEKLHD;<br>PRVNGPEAEKLHDR; RVNGPEAEKLHDRL; VNGPEAEKLHDRLA;<br>NGPEAEKLHDRLAN; GPEAEKLHDRLANW; PEAEKLHDRLANWA;<br>EAEKLHDRLANWAA; AEKLHDRLANWAAA; EKLHDRLANWAAAI;<br>KLHDRLANWAAAIN; LHDRLANWAAAINP; HDRLANWAAAINPL;<br>DRLANWAAAINPLE; RLANWAAAINPLES; LANWAAAINPLESG;<br>ANWAAAINPLESGW; NWAAAINPLESGWP; WAAAINPLESGWPA;<br>AAAINPLESGWPAM; AAINPLESGWPAMP; AINPLESGWPAMPD; | | |

Fig. 29 continued

| | | | |
|---|---|---|---|
| | INPLESGWPAMPDG; NPLESGWPAMPDGV; PLESGWPAMPDGVT; LESGWPAMPDGVTD; ESGWPAMPDGVTDR; SGWPAMPDGVTDRR; GWPAMPDGVTDRRA; WPAMPDGVTDRRAD; PAMPDGVTDRRADV; AMPDGVTDRRADVW; MPDGVTDRRADVWE; PDGVTDRRADVWES; DGVTDRRADVWESL; GVTDRRADVWESLV; VTDRRADVWESLVA; TDRRADVWESLVAV; DRRADVWESLVAVA; RRADVWESLVAVAD; RADVWESLVAVADT; ADVWESLVAVADTA; DVWESLVAVADTAG; VWESLVAVADTAGG; WESLVAVADTAGGH; ESLVAVADTAGGHW; SLVAVADTAGGHWP; LVAVADTAGGHWPK; VAVADTAGGHWPKT; AVADTAGGHWPKTA; VADTAGGHWPKTAR; ADTAGGHWPKTARA; DTAGGHWPKTARAT; TAGGHWPKTARATA; AGGHWPKTARATAE; GGHWPKTARATAET; GHWPKTARATAETD; HWPKTARATAETDA; WPKTARATAETDAT; PKTARATAETDATA; KTARATAETDATAN; TARATAETDATANR; ARATAETDATANRG; RATAETDATANRGA; ATAETDATANRGAK; TAETDATANRGAKP; AETDATANRGAKPS; ETDATANRGAKPSI; TDATANRGAKPSIG; DATANRGAKPSIGV; ATANRGAKPSIGVL; TANRGAKPSIGVLL; ANRGAKPSIGVLLL; NRGAKPSIGVLLLR; RGAKPSIGVLLLRD; GAKPSIGVLLLRDI; AKPSIGVLLLRDIR; KPSIGVLLLRDIRR; PSIGVLLLRDIRRV; SIGVLLLRDIRRVF; IGVLLLRDIRRVFS; GVLLLRDIRRVFSD; VLLLRDIRRVFSDR; LLLRDIRRVFSDRD; LLRDIRRVFSDRDR; LRDIRRVFSDRDRM; RDIRRVFSDRDRMR; DIRRVFSDRDRMRT; IRRVFSDRDRMRTS; RRVFSDRDRMRTSD; RVFSDRDRMRTSDI; VFSDRDRMRTSDIL; FSDRDRMRTSDILT; SDRDRMRTSDILTG; DRDRMRTSDILTGL; RDRMRTSDILTGLN; DRMRTSDILTGLNR; RMRTSDILTGLNRM; MRTSDILTGLNRME; RTSDILTGLNRMEE; TSDILTGLNRMEEG; SDILTGLNRMEEGP; DILTGLNRMEEGPW; ILTGLNRMEEGPWG; LTGLNRMEEGPWGS; TGLNRMEEGPWGSI; GLNRMEEGPWGSIR; LNRMEEGPWGSIRR; NRMEEGPWGSIRRG; RMEEGPWGSIRRGD; MEEGPWGSIRRGDP; EEGPWGSIRRGDPL; EGPWGSIRRGDPLD; GPWGSIRRGDPLDA; PWGSIRRGDPLDAR; WGSIRRGDPLDARG; GSIRRGDPLDARGL; SIRRGDPLDARGLA; IRRGDPLDARGLAT; RRGDPLDARGLATR; RGDPLDARGLATRL; GDPLDARGLATRLG; DPLDARGLATRLGR; PLDARGLATRLGRY; LDARGLATRLGRYG; DARGLATRLGRYGI; ARGLATRLGRYGIG; RGLATRLGRYGIGP; GLATRLGRYGIGPK; LATRLGRYGIGPKF; ATRLGRYGIGPKFQ; TRLGRYGIGPKFQH; RLGRYGIGPKFQHS; LGRYGIGPKFQHSG; GRYGIGPKFQHSGG; RYGIGPKFQHSGGE; YGIGPKFQHSGGEP; GIGPKFQHSGGEPP; IGPKFQHSGGEPPY; GPKFQHSGGEPPYK; PKFQHSGGEPPYKG; KFQHSGGEPPYKGY; FQHSGGEPPYKGYS; QHSGGEPPYKGYSR; HSGGEPPYKGYSRT; SGGEPPYKGYSRTQ; GGEPPYKGYSRTQF; GEPPYKGYSRTQFE; EPPYKGYSRTQFED; PPYKGYSRTQFEDA; PYKGYSRTQFEDAW; YKGYSRTQFEDAWS; KGYSRTQFEDAWSR; GYSRTQFEDAWSRY; YSRTQFEDAWSRYL; SRTQFEDAWSRYLS; RTQFEDAWSRYLSA; TQFEDAWSRYLSAD; QFEDAWSRYLSADD; FEDAWSRYLSADDE; EDAWSRYLSADDET; DAWSRYLSADDETP; AWSRYLSADDETPE; WSRYLSADDETPEE; SRYLSADDETPEER; RYLSADDETPEERD; YLSADDETPEERDL; LSADDETPEERDLS; SADDETPEERDLSV; ADDETPEERDLSVS; DDETPEERDLSVSA; DETPEERDLSVSAV; ETPEERDLSVSAVS; TPEERDLSVSAVSA; PEERDLSVSAVSAV; EERDLSVSAVSAVS; ERDLSVSAVSAVSP; RDLSVSAVSAVSPP; DLSVSAVSAVSPPV; LSVSAVSAVSPPVG; SVSAVSAVSPPVGD; VSAVSAVSPPVGDP; SAVSAVSPPVGDPG; | |

Fig. 29 continued

| | | | |
|---|---|---|---|
| | AVSAVSPPVGDPGD; VSAVSPPVGDPGDA; SAVSPPVGDPGDAT; AVSPPVGDPGDATG; VSPPVGDPGDATGA; SPPVGDPGDATGAT; PPVGDPGDATGATD; PVGDPGDATGATDA; VGDPGDATGATDAT; GDPGDATGATDATD; DPGDATGATDATDL; PGDATGATDATDLP; GDATGATDATDLPE; DATGATDATDLPEA; ATGATDATDLPEAG; TGATDATDLPEAGD; GATDATDLPEAGDL; ATDATDLPEAGDLP; TDATDLPEAGDLPY; DATDLPEAGDLPYE; ATDLPEAGDLPYEP; TDLPEAGDLPYEPP; DLPEAGDLPYEPPA; LPEAGDLPYEPPAP; PEAGDLPYEPPAPN; EAGDLPYEPPAPNG; AGDLPYEPPAPNGH; GDLPYEPPAPNGHP; DLPYEPPAPNGHPN; LPYEPPAPNGHPNG; PYEPPAPNGHPNGD; YEPPAPNGHPNGDA; EPPAPNGHPNGDAP; PPAPNGHPNGDAPL; PAPNGHPNGDAPLC; APNGHPNGDAPLCS; PNGHPNGDAPLCSG; NGHPNGDAPLCSGP; GHPNGDAPLCSGPG; HPNGDAPLCSGPGC; PNGDAPLCSGPGCP; NGDAPLCSGPGCPN; GDAPLCSGPGCPNK; DAPLCSGPGCPNKL; APLCSGPGCPNKLL; PLCSGPGCPNKLLS; LCSGPGCPNKLLST; CSGPGCPNKLLSTE; SGPGCPNKLLSTEA; GPGCPNKLLSTEAK; PGCPNKLLSTEAKA; GCPNKLLSTEAKAA; CPNKLLSTEAKAAG; PNKLLSTEAKAAGK; NKLLSTEAKAAGKC; KLLSTEAKAAGKCR; LLSTEAKAAGKCRP; LSTEAKAAGKCRPC; STEAKAAGKCRPCR; TEAKAAGKCRPCRG; EAKAAGKCRPCRGR; AKAAGKCRPCRGRA; KAAGKCRPCRGRAA; AAGKCRPCRGRAAA; AGKCRPCRGRAAAS; GKCRPCRGRAAASA; KCRPCRGRAAASAR; CRPCRGRAAASARD; RPCRGRAAASARDG; PCRGRAAASARDGA; CRGRAAASARDGAR<br><br>15 mers:<br>MADIPYGRDYPDPIW; ADIPYGRDYPDPIWC; DIPYGRDYPDPIWCD; IPYGRDYPDPIWCDE; PYGRDYPDPIWCDED; YGRDYPDPIWCDEDG; GRDYPDPIWCDEDGQ; RDYPDPIWCDEDGQP; DYPDPIWCDEDGQPM; YPDPIWCDEDGQPMP; PDPIWCDEDGQPMPP; DPIWCDEDGQPMPPV; PIWCDEDGQPMPPVG; IWCDEDGQPMPPVGA; WCDEDGQPMPPVGAE; CDEDGQPMPPVGAEL; DEDGQPMPPVGAELL; EDGQPMPPVGAELLD; DGQPMPPVGAELLDD; GQPMPPVGAELLDDI; QPMPPVGAELLDDIR; PMPPVGAELLDDIRA; MPPVGAELLDDIRAF; PPVGAELLDDIRAFL; PVGAELLDDIRAFLR; VGAELLDDIRAFLRR; GAELLDDIRAFLRRF; AELLDDIRAFLRRFV; ELLDDIRAFLRRFVV; LLDDIRAFLRRFVVY; LDDIRAFLRRFVVYP; DDIRAFLRRFVVYPS; DIRAFLRRFVVYPSD; IRAFLRRFVVYPSDH; RAFLRRFVVYPSDHE; AFLRRFVVYPSDHEL; FLRRFVVYPSDHELI; LRRFVVYPSDHELIA; RRFVVYPSDHELIAH; RFVVYPSDHELIAHT; FVVYPSDHELIAHTL; VVYPSDHELIAHTLW; VYPSDHELIAHTLWI; YPSDHELIAHTLWIA; PSDHELIAHTLWIAH; SDHELIAHTLWIAHC; DHELIAHTLWIAHCW; HELIAHTLWIAHCWF; ELIAHTLWIAHCWFM; LIAHTLWIAHCWFME; IAHTLWIAHCWFMEA; AHTLWIAHCWFMEAW; HTLWIAHCWFMEAWD; TLWIAHCWFMEAWDS; LWIAHCWFMEAWDST; WIAHCWFMEAWDSTP; IAHCWFMEAWDSTPR; AHCWFMEAWDSTPRI; HCWFMEAWDSTPRIA; CWFMEAWDSTPRIAF; WFMEAWDSTPRIAFL; FMEAWDSTPRIAFLS; MEAWDSTPRIAFLSP; EAWDSTPRIAFLSPE; AWDSTPRIAFLSPEP; WDSTPRIAFLSPEPG; DSTPRIAFLSPEPGS; STPRIAFLSPEPGSG; TPRIAFLSPEPGSGK; PRIAFLSPEPGSGKS; RIAFLSPEPGSGKSR; IAFLSPEPGSGKSRA; AFLSPEPGSGKSRAL; FLSPEPGSGKSRALE; LSPEPGSGKSRALEV; SPEPGSGKSRALEVT; PEPGSGKSRALEVTE; EPGSGKSRALEVTEP; PGSGKSRALEVTEPL; GSGKSRALEVTEPLV; SGKSRALEVTEPLVP; | |

Fig. 29 continued

| | | |
|---|---|---|
| | GKSRALEVTEPLVPR; KSRALEVTEPLVPRP; SRALEVTEPLVPRPV; RALEVTEPLVPRPVH; ALEVTEPLVPRPVHA; LEVTEPLVPRPVHAI; EVTEPLVPRPVHAIN; VTEPLVPRPVHAINC; TEPLVPRPVHAINCT; EPLVPRPVHAINCTP; PLVPRPVHAINCTPA; LVPRPVHAINCTPAY; VPRPVHAINCTPAYL; PRPVHAINCTPAYLF; RPVHAINCTPAYLFR; PVHAINCTPAYLFRR; VHAINCTPAYLFRRV; HAINCTPAYLFRRVA; AINCTPAYLFRRVAD; INCTPAYLFRRVADP; NCTPAYLFRRVADPV; CTPAYLFRRVADPVG; TPAYLFRRVADPVGR; PAYLFRRVADPVGRP; AYLFRRVADPVGRPT; YLFRRVADPVGRPTV; LFRRVADPVGRPTVL; FRRVADPVGRPTVLY; RRVADPVGRPTVLYD; RVADPVGRPTVLYDE; VADPVGRPTVLYDEC; ADPVGRPTVLYDECD; DPVGRPTVLYDECDT; PVGRPTVLYDECDTL; VGRPTVLYDECDTLF; GRPTVLYDECDTLFG; RPTVLYDECDTLFGP; PTVLYDECDTLFGPK; TVLYDECDTLFGPKA; VLYDECDTLFGPKAK; LYDECDTLFGPKAKE; YDECDTLFGPKAKEH; DECDTLFGPKAKEHE; ECDTLFGPKAKEHEE; CDTLFGPKAKEHEEI; DTLFGPKAKEHEEIR; TLFGPKAKEHEEIRG; LFGPKAKEHEEIRGV; FGPKAKEHEEIRGVI; GPKAKEHEEIRGVIN; PKAKEHEEIRGVINA; KAKEHEEIRGVINAG; AKEHEEIRGVINAGH; KEHEEIRGVINAGHR; EHEEIRGVINAGHRK; HEEIRGVINAGHRKG; EEIRGVINAGHRKGA; EIRGVINAGHRKGAV; IRGVINAGHRKGAVA; RGVINAGHRKGAVAG; GVINAGHRKGAVAGR; VINAGHRKGAVAGRC; INAGHRKGAVAGRCV; NAGHRKGAVAGRCVI; AGHRKGAVAGRCVIR; GHRKGAVAGRCVIRG; HRKGAVAGRCVIRGK; RKGAVAGRCVIRGKI; KGAVAGRCVIRGKIV; GAVAGRCVIRGKIVE; AVAGRCVIRGKIVET; VAGRCVIRGKIVETE; AGRCVIRGKIVETEE; GRCVIRGKIVETEEL; RCVIRGKIVETEELP; CVIRGKIVETEELPA; VIRGKIVETEELPAY; IRGKIVETEELPAYC; RGKIVETEELPAYCA; GKIVETEELPAYCAV; KIVETEELPAYCAVA; IVETEELPAYCAVAL; VETEELPAYCAVALA; ETEELPAYCAVALAG; TEELPAYCAVALAGL; EELPAYCAVALAGLD; ELPAYCAVALAGLDD; LPAYCAVALAGLDDL; PAYCAVALAGLDDLP; AYCAVALAGLDDLPD; YCAVALAGLDDLPDT; CAVALAGLDDLPDTI; AVALAGLDDLPDTIM; VALAGLDDLPDTIMS; ALAGLDDLPDTIMSR; LAGLDDLPDTIMSRS; AGLDDLPDTIMSRSI; GLDDLPDTIMSRSIV; LDDLPDTIMSRSIVV; DDLPDTIMSRSIVVR; DLPDTIMSRSIVVRM; LPDTIMSRSIVVRMR; PDTIMSRSIVVRMRR; DTIMSRSIVVRMRRR; TIMSRSIVVRMRRRA; IMSRSIVVRMRRRAP; MSRSIVVRMRRRAPT; SRSIVVRMRRRAPTE; RSIVVRMRRRAPTEP; SIVVRMRRRAPTEPV; IVVRMRRRAPTEPVE; VVRMRRRAPTEPVEP; VRMRRRAPTEPVEPW; RMRRRAPTEPVEPWR; MRRRAPTEPVEPWRP; RRRAPTEPVEPWRPR; RRAPTEPVEPWRPRV; RAPTEPVEPWRPRVN; APTEPVEPWRPRVNG; PTEPVEPWRPRVNGP; TEPVEPWRPRVNGPE; EPVEPWRPRVNGPEA; PVEPWRPRVNGPEAE; VEPWRPRVNGPEAEK; EPWRPRVNGPEAEKL; PWRPRVNGPEAEKLH; WRPRVNGPEAEKLHD; RPRVNGPEAEKLHDR; PRVNGPEAEKLHDRL; RVNGPEAEKLHDRLA; VNGPEAEKLHDRLAN; NGPEAEKLHDRLANW; GPEAEKLHDRLANWA; PEAEKLHDRLANWAA; EAEKLHDRLANWAAA; AEKLHDRLANWAAAI; EKLHDRLANWAAAIN; KLHDRLANWAAAINP; LHDRLANWAAAINPL; HDRLANWAAAINPLE; DRLANWAAAINPLES; RLANWAAAINPLESG; LANWAAAINPLESGW; ANWAAAINPLESGWP; NWAAAINPLESGWPA; WAAAINPLESGWPAM; AAAINPLESGWPAMP; AAINPLESGWPAMPD; AINPLESGWPAMPDG; INPLESGWPAMPDGV; NPLESGWPAMPDGVT; PLESGWPAMPDGVTD; LESGWPAMPDGVTDR; ESGWPAMPDGVTDRR; SGWPAMPDGVTDRRA; GWPAMPDGVTDRRAD; WPAMPDGVTDRRADV; PAMPDGVTDRRADVW; AMPDGVTDRRADVWE; | |

Fig. 29 continued

| | | | |
|---|---|---|---|
| | MPDGVTDRRADVWES; PDGVTDRRADVWESL; DGVTDRRADVWESLV;<br>GVTDRRADVWESLVA; VTDRRADVWESLVAV; TDRRADVWESLVAVA;<br>DRRADVWESLVAVAD; RRADVWESLVAVADT; RADVWESLVAVADTA;<br>ADVWESLVAVADTAG; DVWESLVAVADTAGG; VWESLVAVADTAGGH;<br>WESLVAVADTAGGHW; ESLVAVADTAGGHWP; SLVAVADTAGGHWPK;<br>LVAVADTAGGHWPKT; VAVADTAGGHWPKTA; AVADTAGGHWPKTAR;<br>VADTAGGHWPKTARA; ADTAGGHWPKTARAT; DTAGGHWPKTARATA;<br>TAGGHWPKTARATAE; AGGHWPKTARATAET; GGHWPKTARATAETD;<br>GHWPKTARATAETDA; HWPKTARATAETDAT; WPKTARATAETDATA;<br>PKTARATAETDATAN; KTARATAETDATANR; TARATAETDATANRG;<br>ARATAETDATANRGA; RATAETDATANRGAK; ATAETDATANRGAKP;<br>TAETDATANRGAKPS; AETDATANRGAKPSI; ETDATANRGAKPSIG;<br>TDATANRGAKPSIGV; DATANRGAKPSIGVL; ATANRGAKPSIGVLL;<br>TANRGAKPSIGVLLL; ANRGAKPSIGVLLLR; NRGAKPSIGVLLLRD;<br>RGAKPSIGVLLLRDI; GAKPSIGVLLLRDIR; AKPSIGVLLLRDIRR;<br>KPSIGVLLLRDIRRV; PSIGVLLLRDIRRVF; SIGVLLLRDIRRVFS;<br>IGVLLLRDIRRVFSD; GVLLLRDIRRVFSDR; VLLLRDIRRVFSDRD;<br>LLLRDIRRVFSDRDR; LLRDIRRVFSDRDRM; LRDIRRVFSDRDRMR;<br>RDIRRVFSDRDRMRT; DIRRVFSDRDRMRTS; IRRVFSDRDRMRTSD;<br>RRVFSDRDRMRTSDI; RVFSDRDRMRTSDIL; VFSDRDRMRTSDILT;<br>FSDRDRMRTSDILTG; SDRDRMRTSDILTGL; DRDRMRTSDILTGLN;<br>RDRMRTSDILTGLNR; DRMRTSDILTGLNRM; RMRTSDILTGLNRME;<br>MRTSDILTGLNRMEE; RTSDILTGLNRMEEG; TSDILTGLNRMEEGP;<br>SDILTGLNRMEEGPW; DILTGLNRMEEGPWG; ILTGLNRMEEGPWGS;<br>LTGLNRMEEGPWGSI; TGLNRMEEGPWGSIR; GLNRMEEGPWGSIRR;<br>LNRMEEGPWGSIRRG; NRMEEGPWGSIRRGD; RMEEGPWGSIRRGDP;<br>MEEGPWGSIRRGDPL; EEGPWGSIRRGDPLD; EGPWGSIRRGDPLDA;<br>GPWGSIRRGDPLDAR; PWGSIRRGDPLDARG; WGSIRRGDPLDARGL;<br>GSIRRGDPLDARGLA; SIRRGDPLDARGLAT; IRRGDPLDARGLATR;<br>RRGDPLDARGLATRL; RGDPLDARGLATRLG; GDPLDARGLATRLGR;<br>DPLDARGLATRLGRY; PLDARGLATRLGRYG; LDARGLATRLGRYGI;<br>DARGLATRLGRYGIG; ARGLATRLGRYGIGP; RGLATRLGRYGIGPK;<br>GLATRLGRYGIGPKF; LATRLGRYGIGPKFQ; ATRLGRYGIGPKFQH;<br>TRLGRYGIGPKFQHS; RLGRYGIGPKFQHSG; LGRYGIGPKFQHSGG;<br>GRYGIGPKFQHSGGE; RYGIGPKFQHSGGEP; YGIGPKFQHSGGEPP;<br>GIGPKFQHSGGEPPY; IGPKFQHSGGEPPYK; GPKFQHSGGEPPYKG;<br>PKFQHSGGEPPYKGY; KFQHSGGEPPYKGYS; FQHSGGEPPYKGYSR;<br>QHSGGEPPYKGYSRT; HSGGEPPYKGYSRTQ; SGGEPPYKGYSRTQF;<br>GGEPPYKGYSRTQFE; GEPPYKGYSRTQFED; EPPYKGYSRTQFEDA;<br>PPYKGYSRTQFEDAW; PYKGYSRTQFEDAWS; YKGYSRTQFEDAWSR;<br>KGYSRTQFEDAWSRY; GYSRTQFEDAWSRYL; YSRTQFEDAWSRYLS;<br>SRTQFEDAWSRYLSA; RTQFEDAWSRYLSAD; TQFEDAWSRYLSADD;<br>QFEDAWSRYLSADDE; FEDAWSRYLSADDET; EDAWSRYLSADDETP;<br>DAWSRYLSADDETPE; AWSRYLSADDETPEE; WSRYLSADDETPEER;<br>SRYLSADDETPEERD; RYLSADDETPEERDL; YLSADDETPEERDLS;<br>LSADDETPEERDLSV; SADDETPEERDLSVS; ADDETPEERDLSVSA;<br>DDETPEERDLSVSAV; DETPEERDLSVSAVS; ETPEERDLSVSAVSA;<br>TPEERDLSVSAVSAV; PEERDLSVSAVSAVS; EERDLSVSAVSAVSP;<br>ERDLSVSAVSAVSPP; RDLSVSAVSAVSPPV; DLSVSAVSAVSPPVG;<br>LSVSAVSAVSPPVGD; SVSAVSAVSPPVGDP; VSAVSAVSPPVGDPG;<br>SAVSAVSPPVGDPGD; AVSAVSPPVGDPGDA; VSAVSPPVGDPGDAT;<br>SAVSPPVGDPGDATG; AVSPPVGDPGDATGA; VSPPVGDPGDATGAT;<br>SPPVGDPGDATGATD; PPVGDPGDATGATDA; PVGDPGDATGATDAT; | | |

Fig. 29 continued

VGDPGDATGATDATD; GDPGDATGATDATDL; DPGDATGATDATDLP;
PGDATGATDATDLPE; GDATGATDATDLPEA; DATGATDATDLPEAG;
ATGATDATDLPEAGD; TGATDATDLPEAGDL; GATDATDLPEAGDLP;
ATDATDLPEAGDLPY; TDATDLPEAGDLPYE; DATDLPEAGDLPYEP;
ATDLPEAGDLPYEPP; TDLPEAGDLPYEPPA; DLPEAGDLPYEPPAP;
LPEAGDLPYEPPAPN; PEAGDLPYEPPAPNG; EAGDLPYEPPAPNGH;
AGDLPYEPPAPNGHP; GDLPYEPPAPNGHPN; DLPYEPPAPNGHPNG;
LPYEPPAPNGHPNGD; PYEPPAPNGHPNGDA; YEPPAPNGHPNGDAP;
EPPAPNGHPNGDAPL; PPAPNGHPNGDAPLC; PAPNGHPNGDAPLCS;
APNGHPNGDAPLCSG; PNGHPNGDAPLCSGP; NGHPNGDAPLCSGPG;
GHPNGDAPLCSGPGC; HPNGDAPLCSGPGCP; PNGDAPLCSGPGCPN;
NGDAPLCSGPGCPNK; GDAPLCSGPGCPNKL; DAPLCSGPGCPNKLL;
APLCSGPGCPNKLLS; PLCSGPGCPNKLLST; LCSGPGCPNKLLSTE;
CSGPGCPNKLLSTEA; SGPGCPNKLLSTEAK; GPGCPNKLLSTEAKA;
PGCPNKLLSTEAKAA; GCPNKLLSTEAKAAG; CPNKLLSTEAKAAGK;
PNKLLSTEAKAAGKC; NKLLSTEAKAAGKCR; KLLSTEAKAAGKCRP;
LLSTEAKAAGKCRPC; LSTEAKAAGKCRPCR; STEAKAAGKCRPCRG;
TEAKAAGKCRPCRGR; EAKAAGKCRPCRGRA; AKAAGKCRPCRGRAA;
KAAGKCRPCRGRAAA; AAGKCRPCRGRAAAS; AGKCRPCRGRAAASA;
GKCRPCRGRAAASAR; KCRPCRGRAAASARD; CRPCRGRAAASARDG;
RPCRGRAAASARDGA; PCRGRAAASARDGAR 16 mers:
MADIPYGRDYPDPIWC; ADIPYGRDYPDPIWCD; DIPYGRDYPDPIWCDE;
IPYGRDYPDPIWCDED; PYGRDYPDPIWCDEDG; YGRDYPDPIWCDEDGQ;
GRDYPDPIWCDEDGQP; RDYPDPIWCDEDGQPM; DYPDPIWCDEDGQPMP;
YPDPIWCDEDGQPMPP; PDPIWCDEDGQPMPPV; DPIWCDEDGQPMPPVG;
PIWCDEDGQPMPPVGA; IWCDEDGQPMPPVGAE; WCDEDGQPMPPVGAEL;
CDEDGQPMPPVGAELL; DEDGQPMPPVGAELLD; EDGQPMPPVGAELLDD;
DGQPMPPVGAELLDDI; GQPMPPVGAELLDDIR; QPMPPVGAELLDDIRA;
PMPPVGAELLDDIRAF; MPPVGAELLDDIRAFL; PPVGAELLDDIRAFLR;
PVGAELLDDIRAFLRR; VGAELLDDIRAFLRRF; GAELLDDIRAFLRRFV;
AELLDDIRAFLRRFVV; ELLDDIRAFLRRFVVY; LLDDIRAFLRRFVVYP;
LDDIRAFLRRFVVYPS; DDIRAFLRRFVVYPSD; DIRAFLRRFVVYPSDH;
IRAFLRRFVVYPSDHE; RAFLRRFVVYPSDHEL; AFLRRFVVYPSDHELI;
FLRRFVVYPSDHELIA; LRRFVVYPSDHELIAH; RRFVVYPSDHELIAHT;
RFVVYPSDHELIAHTL; FVVYPSDHELIAHTLW; VVYPSDHELIAHTLWI;
VYPSDHELIAHTLWIA; YPSDHELIAHTLWIAH; PSDHELIAHTLWIAHC;
SDHELIAHTLWIAHCW; DHELIAHTLWIAHCWF; HELIAHTLWIAHCWFM;
ELIAHTLWIAHCWFME; LIAHTLWIAHCWFMEA; IAHTLWIAHCWFMEAW;
AHTLWIAHCWFMEAWD; HTLWIAHCWFMEAWDS; TLWIAHCWFMEAWDST;
LWIAHCWFMEAWDSTP; WIAHCWFMEAWDSTPR; IAHCWFMEAWDSTPRI;
AHCWFMEAWDSTPRIA; HCWFMEAWDSTPRIAF; CWFMEAWDSTPRIAFL;
WFMEAWDSTPRIAFLS; FMEAWDSTPRIAFLSP; MEAWDSTPRIAFLSPE;
EAWDSTPRIAFLSPEP; AWDSTPRIAFLSPEPG; WDSTPRIAFLSPEPGS;
DSTPRIAFLSPEPGSG; STPRIAFLSPEPGSGK; TPRIAFLSPEPGSGKS;
PRIAFLSPEPGSGKSR; RIAFLSPEPGSGKSRA; IAFLSPEPGSGKSRAL;
AFLSPEPGSGKSRALE; FLSPEPGSGKSRALEV; LSPEPGSGKSRALEVT;
SPEPGSGKSRALEVTE; PEPGSGKSRALEVTEP; EPGSGKSRALEVTEPL;
PGSGKSRALEVTEPLV; GSGKSRALEVTEPLVP; SGKSRALEVTEPLVPR;
GKSRALEVTEPLVPRP; KSRALEVTEPLVPRPV; SRALEVTEPLVPRPVH;
RALEVTEPLVPRPVHA; ALEVTEPLVPRPVHAI; LEVTEPLVPRPVHAIN;
EVTEPLVPRPVHAINC; VTEPLVPRPVHAINCT; TEPLVPRPVHAINCTP;

Fig. 29 continued

| | | |
|---|---|---|
| | EPLVPRPVHAINCTPA; PLVPRPVHAINCTPAY; LVPRPVHAINCTPAYL; VPRPVHAINCTPAYLF; PRPVHAINCTPAYLFR; RPVHAINCTPAYLFRR; PVHAINCTPAYLFRRV; VHAINCTPAYLFRRVA; HAINCTPAYLFRRVAD; AINCTPAYLFRRVADP; INCTPAYLFRRVADPV; NCTPAYLFRRVADPVG; CTPAYLFRRVADPVGR; TPAYLFRRVADPVGRP; PAYLFRRVADPVGRPT; AYLFRRVADPVGRPTV; YLFRRVADPVGRPTVL; LFRRVADPVGRPTVLY; FRRVADPVGRPTVLYD; RRVADPVGRPTVLYDE; RVADPVGRPTVLYDEC; VADPVGRPTVLYDECD; ADPVGRPTVLYDECDT; DPVGRPTVLYDECDTL; PVGRPTVLYDECDTLF; VGRPTVLYDECDTLFG; GRPTVLYDECDTLFGP; RPTVLYDECDTLFGPK; PTVLYDECDTLFGPKA; TVLYDECDTLFGPKAK; VLYDECDTLFGPKAKE; LYDECDTLFGPKAKEH; YDECDTLFGPKAKEHE; DECDTLFGPKAKEHEE; ECDTLFGPKAKEHEEI; CDTLFGPKAKEHEEIR; DTLFGPKAKEHEEIRG; TLFGPKAKEHEEIRGV; LFGPKAKEHEEIRGVI; FGPKAKEHEEIRGVIN; GPKAKEHEEIRGVINA; PKAKEHEEIRGVINAG; KAKEHEEIRGVINAGH; AKEHEEIRGVINAGHR; KEHEEIRGVINAGHRK; EHEEIRGVINAGHRKG; HEEIRGVINAGHRKGA; EEIRGVINAGHRKGAV; EIRGVINAGHRKGAVA; IRGVINAGHRKGAVAG; RGVINAGHRKGAVAGR; GVINAGHRKGAVAGRC; VINAGHRKGAVAGRCV; INAGHRKGAVAGRCVI; NAGHRKGAVAGRCVIR; AGHRKGAVAGRCVIRG; GHRKGAVAGRCVIRGK; HRKGAVAGRCVIRGKI; RKGAVAGRCVIRGKIV; KGAVAGRCVIRGKIVE; GAVAGRCVIRGKIVET; AVAGRCVIRGKIVETE; VAGRCVIRGKIVETEE; AGRCVIRGKIVETEEL; GRCVIRGKIVETEELP; RCVIRGKIVETEELPA; CVIRGKIVETEELPAY; VIRGKIVETEELPAYC; IRGKIVETEELPAYCA; RGKIVETEELPAYCAV; GKIVETEELPAYCAVA; KIVETEELPAYCAVAL; IVETEELPAYCAVALA; VETEELPAYCAVALAG; ETEELPAYCAVALAGL; TEELPAYCAVALAGLD; EELPAYCAVALAGLDD; ELPAYCAVALAGLDDL; LPAYCAVALAGLDDLP; PAYCAVALAGLDDLPD; AYCAVALAGLDDLPDT; YCAVALAGLDDLPDTI; CAVALAGLDDLPDTIM; AVALAGLDDLPDTIMS; VALAGLDDLPDTIMSR; ALAGLDDLPDTIMSRS; LAGLDDLPDTIMSRSI; AGLDDLPDTIMSRSIV; GLDDLPDTIMSRSIVV; LDDLPDTIMSRSIVVR; DDLPDTIMSRSIVVRM; DLPDTIMSRSIVVRMR; LPDTIMSRSIVVRMRR; PDTIMSRSIVVRMRRR; DTIMSRSIVVRMRRRA; TIMSRSIVVRMRRRAP; IMSRSIVVRMRRRAPT; MSRSIVVRMRRRAPTE; SRSIVVRMRRRAPTEP; RSIVVRMRRRAPTEPV; SIVVRMRRRAPTEPVE; IVVRMRRRAPTEPVEP; VVRMRRRAPTEPVEPW; VRMRRRAPTEPVEPWR; RMRRRAPTEPVEPWRP; MRRRAPTEPVEPWRPR; RRRAPTEPVEPWRPRV; RRAPTEPVEPWRPRVN; RAPTEPVEPWRPRVNG; APTEPVEPWRPRVNGP; PTEPVEPWRPRVNGPE; TEPVEPWRPRVNGPEA; EPVEPWRPRVNGPEAE; PVEPWRPRVNGPEAEK; VEPWRPRVNGPEAEKL; EPWRPRVNGPEAEKLH; PWRPRVNGPEAEKLHD; WRPRVNGPEAEKLHDR; RPRVNGPEAEKLHDRL; PRVNGPEAEKLHDRLA; RVNGPEAEKLHDRLAN; VNGPEAEKLHDRLANW; NGPEAEKLHDRLANWA; GPEAEKLHDRLANWAA; PEAEKLHDRLANWAAA; EAEKLHDRLANWAAAI; AEKLHDRLANWAAAIN; EKLHDRLANWAAAINP; KLHDRLANWAAAINPL; LHDRLANWAAAINPLE; HDRLANWAAAINPLES; DRLANWAAAINPLESG; RLANWAAAINPLESGW; LANWAAAINPLESGWP; ANWAAAINPLESGWPA; NWAAAINPLESGWPAM; WAAAINPLESGWPAMP; AAAINPLESGWPAMPD; AAINPLESGWPAMPDG; AINPLESGWPAMPDGV; INPLESGWPAMPDGVT; NPLESGWPAMPDGVTD; PLESGWPAMPDGVTDR; LESGWPAMPDGVTDRR; ESGWPAMPDGVTDRRA; SGWPAMPDGVTDRRAD; GWPAMPDGVTDRRADV; WPAMPDGVTDRRADVW; PAMPDGVTDRRADVWE; AMPDGVTDRRADVWES; MPDGVTDRRADVWESL; PDGVTDRRADVWESLV; DGVTDRRADVWESLVA; GVTDRRADVWESLVAV; VTDRRADVWESLVAVA; TDRRADVWESLVAVAD; DRRADVWESLVAVADT; RRADVWESLVAVADTA; RADVWESLVAVADTAG; | |

Fig. 29 continued

| | | | |
|---|---|---|---|
| | ADVWESLVAVADTAGG; DVWESLVAVADTAGGH; VWESLVAVADTAGGHW; WESLVAVADTAGGHWP; ESLVAVADTAGGHWPK; SLVAVADTAGGHWPKT; LVAVADTAGGHWPKTA; VAVADTAGGHWPKTAR; AVADTAGGHWPKTARA; VADTAGGHWPKTARAT; ADTAGGHWPKTARATA; DTAGGHWPKTARATAE; TAGGHWPKTARATAET; AGGHWPKTARATAETD; GGHWPKTARATAETDA; GHWPKTARATAETDAT; HWPKTARATAETDATA; WPKTARATAETDATAN; PKTARATAETDATANR; KTARATAETDATANRG; TARATAETDATANRGA; ARATAETDATANRGAK; RATAETDATANRGAKP; ATAETDATANRGAKPS; TAETDATANRGAKPSI; AETDATANRGAKPSIG; ETDATANRGAKPSIGV; TDATANRGAKPSIGVL; DATANRGAKPSIGVLL; ATANRGAKPSIGVLLL; TANRGAKPSIGVLLLR; ANRGAKPSIGVLLLRD; NRGAKPSIGVLLLRDI; RGAKPSIGVLLLRDIR; GAKPSIGVLLLRDIRR; AKPSIGVLLLRDIRRV; KPSIGVLLLRDIRRVF; PSIGVLLLRDIRRVFS; SIGVLLLRDIRRVFSD; IGVLLLRDIRRVFSDR; GVLLLRDIRRVFSDRD; VLLLRDIRRVFSDRDR; LLLRDIRRVFSDRDRM; LLRDIRRVFSDRDRMR; LRDIRRVFSDRDRMRT; RDIRRVFSDRDRMRTS; DIRRVFSDRDRMRTSD; IRRVFSDRDRMRTSDI; RRVFSDRDRMRTSDIL; RVFSDRDRMRTSDILT; VFSDRDRMRTSDILTG; FSDRDRMRTSDILTGL; SDRDRMRTSDILTGLN; DRDRMRTSDILTGLNR; RDRMRTSDILTGLNRM; DRMRTSDILTGLNRME; RMRTSDILTGLNRMEE; MRTSDILTGLNRMEEG; RTSDILTGLNRMEEGP; TSDILTGLNRMEEGPW; SDILTGLNRMEEGPWG; DILTGLNRMEEGPWGS; ILTGLNRMEEGPWGSI; LTGLNRMEEGPWGSIR; TGLNRMEEGPWGSIRR; GLNRMEEGPWGSIRRG; LNRMEEGPWGSIRRGD; NRMEEGPWGSIRRGDP; RMEEGPWGSIRRGDPL; MEEGPWGSIRRGDPLD; EEGPWGSIRRGDPLDA; EGPWGSIRRGDPLDAR; GPWGSIRRGDPLDARG; PWGSIRRGDPLDARGL; WGSIRRGDPLDARGLA; GSIRRGDPLDARGLAT; SIRRGDPLDARGLATR; IRRGDPLDARGLATRL; RRGDPLDARGLATRLG; RGDPLDARGLATRLGR; GDPLDARGLATRLGRY; DPLDARGLATRLGRYG; PLDARGLATRLGRYGI; LDARGLATRLGRYGIG; DARGLATRLGRYGIGP; ARGLATRLGRYGIGPK; RGLATRLGRYGIGPKF; GLATRLGRYGIGPKFQ; LATRLGRYGIGPKFQH; ATRLGRYGIGPKFQHS; TRLGRYGIGPKFQHSG; RLGRYGIGPKFQHSGG; LGRYGIGPKFQHSGGE; GRYGIGPKFQHSGGEP; RYGIGPKFQHSGGEPP; YGIGPKFQHSGGEPPY; GIGPKFQHSGGEPPYK; IGPKFQHSGGEPPYKG; GPKFQHSGGEPPYKGY; PKFQHSGGEPPYKGYS; KFQHSGGEPPYKGYSR; FQHSGGEPPYKGYSRT; QHSGGEPPYKGYSRTQ; HSGGEPPYKGYSRTQF; SGGEPPYKGYSRTQFE; GGEPPYKGYSRTQFED; GEPPYKGYSRTQFEDA; EPPYKGYSRTQFEDAW; PPYKGYSRTQFEDAWS; PYKGYSRTQFEDAWSR; YKGYSRTQFEDAWSRY; KGYSRTQFEDAWSRYL; GYSRTQFEDAWSRYLS; YSRTQFEDAWSRYLSA; SRTQFEDAWSRYLSAD; RTQFEDAWSRYLSADD; TQFEDAWSRYLSADDE; QFEDAWSRYLSADDET; FEDAWSRYLSADDETP; EDAWSRYLSADDETPE; DAWSRYLSADDETPEE; AWSRYLSADDETPEER; WSRYLSADDETPEERD; SRYLSADDETPEERDL; RYLSADDETPEERDLS; YLSADDETPEERDLSV; LSADDETPEERDLSVS; SADDETPEERDLSVSA; ADDETPEERDLSVSAV; DDETPEERDLSVSAVS; DETPEERDLSVSAVSA; ETPEERDLSVSAVSAV; TPEERDLSVSAVSAVS; PEERDLSVSAVSAVSP; EERDLSVSAVSAVSPP; ERDLSVSAVSAVSPPV; RDLSVSAVSAVSPPVG; DLSVSAVSAVSPPVGD; LSVSAVSAVSPPVGDP; SVSAVSAVSPPVGDPG; VSAVSAVSPPVGDPGD; SAVSAVSPPVGDPGDA; AVSAVSPPVGDPGDAT; VSAVSPPVGDPGDATG; SAVSPPVGDPGDATGA; AVSPPVGDPGDATGAT; VSPPVGDPGDATGATD; SPPVGDPGDATGATDA; PPVGDPGDATGATDAT; PVGDPGDATGATDATD; VGDPGDATGATDATDL; GDPGDATGATDATDLP; DPGDATGATDATDLPE; PGDATGATDATDLPEA; GDATGATDATDLPEAG; DATGATDATDLPEAGD; ATGATDATDLPEAGDL; TGATDATDLPEAGDLP; GATDATDLPEAGDLPY; | |

Fig. 29 continued

| | | |
|---|---|---|
| | ATDATDLPEAGDLPYE; TDATDLPEAGDLPYEP; DATDLPEAGDLPYEPP; ATDLPEAGDLPYEPPA; TDLPEAGDLPYEPPAP; DLPEAGDLPYEPPAPN; LPEAGDLPYEPPAPNG; PEAGDLPYEPPAPNGH; EAGDLPYEPPAPNGHP; AGDLPYEPPAPNGHPN; GDLPYEPPAPNGHPNG; DLPYEPPAPNGHPNGD; LPYEPPAPNGHPNGDA; PYEPPAPNGHPNGDAP; YEPPAPNGHPNGDAPL; EPPAPNGHPNGDAPLC; PPAPNGHPNGDAPLCS; PAPNGHPNGDAPLCSG; APNGHPNGDAPLCSGP; PNGHPNGDAPLCSGPG; NGHPNGDAPLCSGPGC; GHPNGDAPLCSGPGCP; HPNGDAPLCSGPGCPN; PNGDAPLCSGPGCPNK; NGDAPLCSGPGCPNKL; GDAPLCSGPGCPNKLL; DAPLCSGPGCPNKLLS; APLCSGPGCPNKLLST; PLCSGPGCPNKLLSTE; LCSGPGCPNKLLSTEA; CSGPGCPNKLLSTEAK; SGPGCPNKLLSTEAKA; GPGCPNKLLSTEAKAA; PGCPNKLLSTEAKAAG; GCPNKLLSTEAKAAGK; CPNKLLSTEAKAAGKC; PNKLLSTEAKAAGKCR; NKLLSTEAKAAGKCRP; KLLSTEAKAAGKCRPC; LLSTEAKAAGKCRPCR; LSTEAKAAGKCRPCRG; STEAKAAGKCRPCRGR; TEAKAAGKCRPCRGRA; EAKAAGKCRPCRGRAA; AKAAGKCRPCRGRAAA; KAAGKCRPCRGRAAAS; AAGKCRPCRGRAAASA; AGKCRPCRGRAAASAR; GKCRPCRGRAAASARD; KCRPCRGRAAASARDG; CRPCRGRAAASARDGA; RPCRGRAAASARDGAR | |
| 47) Rv2656c | 13 mers: MTAVGGSPPTRRC; TAVGGSPPTRRCP; AVGGSPPTRRCPA; VGGSPPTRRCPAT; GGSPPTRRCPATE; GSPPTRRCPATED; SPPTRRCPATEDR; PPTRRCPATEDRA; PTRRCPATEDRAP; TRRCPATEDRAPA; RRCPATEDRAPAT; RCPATEDRAPATV; CPATEDRAPATVA; PATEDRAPATVAT; ATEDRAPATVATP; TEDRAPATVATPS; EDRAPATVATPSS; DRAPATVATPSST; RAPATVATPSSTD; APATVATPSSTDP; PATVATPSSTDPT; ATVATPSSTDPTA; TVATPSSTDPTAS; VATPSSTDPTASR; ATPSSTDPTASRA; TPSSTDPTASRAV; PSSTDPTASRAVS; SSTDPTASRAVSW; STDPTASRAVSWW; TDPTASRAVSWWS; DPTASRAVSWWSV; PTASRAVSWWSVH; TASRAVSWWSVHE; ASRAVSWWSVHEY; SRAVSWWSVHEYV; RAVSWWSVHEYVA; AVSWWSVHEYVAP; VSWWSVHEYVAPT; SWWSVHEYVAPTL; WWSVHEYVAPTLA; WSVHEYVAPTLAA; SVHEYVAPTLAAA; VHEYVAPTLAAAV; HEYVAPTLAAAVE; EYVAPTLAAAVEW; YVAPTLAAAVEWP; VAPTLAAAVEWPM; APTLAAAVEWPMA; PTLAAAVEWPMAG; TLAAAVEWPMAGT; LAAAVEWPMAGTP; AAAVEWPMAGTPA; AAVEWPMAGTPAW; AVEWPMAGTPAWC; VEWPMAGTPAWCD; EWPMAGTPAWCDL; WPMAGTPAWCDLD; PMAGTPAWCDLDD; MAGTPAWCDLDDT; AGTPAWCDLDDTD; GTPAWCDLDDTDP; TPAWCDLDDTDPV; PAWCDLDDTDPVK; AWCDLDDTDPVKW; WCDLDDTDPVKWA; CDLDDTDPVKWAA; DLDDTDPVKWAAI; LDDTDPVKWAAIC; DDTDPVKWAAICD; DTDPVKWAAICDA; TDPVKWAAICDAA; DPVKWAAICDAAR; PVKWAAICDAARH; VKWAAICDAARHW; KWAAICDAARHWA; WAAICDAARHWAL; AAICDAARHWALR; AICDAARHWALRV; ICDAARHWALRVE; CDAARHWALRVET; DAARHWALRVETC; AARHWALRVETCQ; ARHWALRVETCQA; RHWALRVETCQAA; HWALRVETCQAAS; WALRVETCQAASA; ALRVETCQAASAE; LRVETCQAASAEA; RVETCQAASAEAS; VETCQAASAEASR; ETCQAASAEASRD; TCQAASAEASRDV; CQAASAEASRDVS; QAASAEASRDVSA; AASAEASRDVSAA; ASAEASRDVSAAA; SAEASRDVSAAAD; AEASRDVSAAADW; EASRDVSAAADWP; ASRDVSAAADWPA; SRDVSAAADWPAV; RDVSAAADWPAVS; DVSAAADWPAVSR; VSAAADWPAVSRE; SAAADWPAVSREI; AAADWPAVSREIQ; AADWPAVSREIQR; ADWPAVSREIQRR; DWPAVSREIQRRR; WPAVSREIQRRRD; PAVSREIQRRRDA; AVSREIQRRRDAY; VSREIQRRRDAYI; SREIQRRRDAYIR; | 94728-95193 |

Fig. 29 continued

| | | | |
|---|---|---|---|
| | REIQRRRDAYIRR; EIQRRRDAYIRRV; IQRRRDAYIRRVV; QRRRDAYIRRVVV<br><br>14 mers:<br>MTAVGGSPPTRRCP; TAVGGSPPTRRCPA; AVGGSPPTRRCPAT;<br>VGGSPPTRRCPATE; GGSPPTRRCPATED; GSPPTRRCPATEDR;<br>SPPTRRCPATEDRA; PPTRRCPATEDRAP; PTRRCPATEDRAPA;<br>TRRCPATEDRAPAT; RRCPATEDRAPATV; RCPATEDRAPATVA;<br>CPATEDRAPATVAT; PATEDRAPATVATP; ATEDRAPATVATPS;<br>TEDRAPATVATPSS; EDRAPATVATPSST; DRAPATVATPSSTD;<br>RAPATVATPSSTDP; APATVATPSSTDPT; PATVATPSSTDPTA;<br>ATVATPSSTDPTAS; TVATPSSTDPTASR; VATPSSTDPTASRA;<br>ATPSSTDPTASRAV; TPSSTDPTASRAVS; PSSTDPTASRAVSW;<br>SSTDPTASRAVSWW; STDPTASRAVSWWS; TDPTASRAVSWWSV;<br>DPTASRAVSWWSVH; PTASRAVSWWSVHE; TASRAVSWWSVHEY;<br>ASRAVSWWSVHEYV; SRAVSWWSVHEYVA; RAVSWWSVHEYVAP;<br>AVSWWSVHEYVAPT; VSWWSVHEYVAPTL; SWWSVHEYVAPTLA;<br>WWSVHEYVAPTLAA; WSVHEYVAPTLAAA; SVHEYVAPTLAAAV;<br>VHEYVAPTLAAAVE; HEYVAPTLAAAVEW; EYVAPTLAAAVEWP;<br>YVAPTLAAAVEWPM; VAPTLAAAVEWPMA; APTLAAAVEWPMAG;<br>PTLAAAVEWPMAGT; TLAAAVEWPMAGTP; LAAAVEWPMAGTPA;<br>AAAVEWPMAGTPAW; AAVEWPMAGTPAWC; AVEWPMAGTPAWCD;<br>VEWPMAGTPAWCDL; EWPMAGTPAWCDLD; WPMAGTPAWCDLDD;<br>PMAGTPAWCDLDDT; MAGTPAWCDLDDTD; AGTPAWCDLDDTDP;<br>GTPAWCDLDDTDPV; TPAWCDLDDTDPVK; PAWCDLDDTDPVKW;<br>AWCDLDDTDPVKWA; WCDLDDTDPVKWAA; CDLDDTDPVKWAAI;<br>DLDDTDPVKWAAIC; LDDTDPVKWAAICD; DDTDPVKWAAICDA;<br>DTDPVKWAAICDAA; TDPVKWAAICDAAR; DPVKWAAICDAARH;<br>PVKWAAICDAARHW; VKWAAICDAARHWA; KWAAICDAARHWAL;<br>WAAICDAARHWALR; AAICDAARHWALRV; AICDAARHWALRVE;<br>ICDAARHWALRVET; CDAARHWALRVETC; DAARHWALRVETCQ;<br>AARHWALRVETCQA; ARHWALRVETCQAA; RHWALRVETCQAAS;<br>HWALRVETCQAASA; WALRVETCQAASAE; ALRVETCQAASAEA;<br>LRVETCQAASAEAS; RVETCQAASAEASR; VETCQAASAEASRD;<br>ETCQAASAEASRDV; TCQAASAEASRDVS; CQAASAEASRDVSA;<br>QAASAEASRDVSAA; AASAEASRDVSAAA; ASAEASRDVSAAAD;<br>SAEASRDVSAAADW; AEASRDVSAAADWP; EASRDVSAAADWPA;<br>ASRDVSAAADWPAV; SRDVSAAADWPAVS; RDVSAAADWPAVSR;<br>DVSAAADWPAVSRE; VSAAADWPAVSREI; SAAADWPAVSREIQ;<br>AAADWPAVSREIQR; AADWPAVSREIQRR; ADWPAVSREIQRRR;<br>DWPAVSREIQRRRD; WPAVSREIQRRRDA; PAVSREIQRRRDAY;<br>AVSREIQRRRDAYI; VSREIQRRRDAYIR; SREIQRRRDAYIRR;<br>REIQRRRDAYIRRV; EIQRRRDAYIRRVV; IQRRRDAYIRRVVV<br><br>15 mers:<br>MTAVGGSPPTRRCPA; TAVGGSPPTRRCPAT; AVGGSPPTRRCPATE;<br>VGGSPPTRRCPATED; GGSPPTRRCPATEDR; GSPPTRRCPATEDRA;<br>SPPTRRCPATEDRAP; PPTRRCPATEDRAPA; PTRRCPATEDRAPAT;<br>TRRCPATEDRAPATV; RRCPATEDRAPATVA; RCPATEDRAPATVAT;<br>CPATEDRAPATVATP; PATEDRAPATVATPS; ATEDRAPATVATPSS;<br>TEDRAPATVATPSST; EDRAPATVATPSSTD; DRAPATVATPSSTDP;<br>RAPATVATPSSTDPT; APATVATPSSTDPTA; PATVATPSSTDPTAS;<br>ATVATPSSTDPTASR; TVATPSSTDPTASRA; VATPSSTDPTASRAV;<br>ATPSSTDPTASRAVS; TPSSTDPTASRAVSW; PSSTDPTASRAVSWW; | | |

Fig. 29 continued

| | | | |
|---|---|---|---|
| | SSTDPTASRAVSWWS; STDPTASRAVSWWSV; TDPTASRAVSWWSVH; DPTASRAVSWWSVHE; PTASRAVSWWSVHEY; TASRAVSWWSVHEYV; ASRAVSWWSVHEYVA; SRAVSWWSVHEYVAP; RAVSWWSVHEYVAPT; AVSWWSVHEYVAPTL; VSWWSVHEYVAPTLA; SWWSVHEYVAPTLAA; WWSVHEYVAPTLAAA; WSVHEYVAPTLAAAV; SVHEYVAPTLAAAVE; VHEYVAPTLAAAVEW; HEYVAPTLAAAVEWP; EYVAPTLAAAVEWPM; YVAPTLAAAVEWPMA; VAPTLAAAVEWPMAG; APTLAAAVEWPMAGT; PTLAAAVEWPMAGTP; TLAAAVEWPMAGTPA; LAAAVEWPMAGTPAW; AAAVEWPMAGTPAWC; AAVEWPMAGTPAWCD; AVEWPMAGTPAWCDL; VEWPMAGTPAWCDLD; EWPMAGTPAWCDLDD; WPMAGTPAWCDLDDT; PMAGTPAWCDLDDTD; MAGTPAWCDLDDTDP; AGTPAWCDLDDTDPV; GTPAWCDLDDTDPVK; TPAWCDLDDTDPVKW; PAWCDLDDTDPVKWA; AWCDLDDTDPVKWAA; WCDLDDTDPVKWAAI; CDLDDTDPVKWAAIC; DLDDTDPVKWAAICD; LDDTDPVKWAAICDA; DDTDPVKWAAICDAA; DTDPVKWAAICDAAR; TDPVKWAAICDAARH; DPVKWAAICDAARHW; PVKWAAICDAARHWA; VKWAAICDAARHWAL; KWAAICDAARHWALR; WAAICDAARHWALRV; AAICDAARHWALRVE; AICDAARHWALRVET; ICDAARHWALRVETC; CDAARHWALRVETCQ; DAARHWALRVETCQA; AARHWALRVETCQAA; ARHWALRVETCQAAS; RHWALRVETCQAASA; HWALRVETCQAASAE; WALRVETCQAASAEA; ALRVETCQAASAEAS; LRVETCQAASAEASR; RVETCQAASAEASRD; VETCQAASAEASRDV; ETCQAASAEASRDVS; TCQAASAEASRDVSA; CQAASAEASRDVSAA; QAASAEASRDVSAAA; AASAEASRDVSAAAD; ASAEASRDVSAAADW; SAEASRDVSAAADWP; AEASRDVSAAADWPA; EASRDVSAAADWPAV; ASRDVSAAADWPAVS; SRDVSAAADWPAVSR; RDVSAAADWPAVSRE; DVSAAADWPAVSREI; VSAAADWPAVSREIQ; SAAADWPAVSREIQR; AAADWPAVSREIQRR; AADWPAVSREIQRRR; ADWPAVSREIQRRRD; DWPAVSREIQRRRDA; WPAVSREIQRRRDAY; PAVSREIQRRRDAYI; AVSREIQRRRDAYIR; VSREIQRRRDAYIRR; SREIQRRRDAYIRRV; REIQRRRDAYIRRVV; EIQRRRDAYIRRVVV<br><br>16 mers:<br>MTAVGGSPPTRRCPAT; TAVGGSPPTRRCPATE; AVGGSPPTRRCPATED; VGGSPPTRRCPATEDR; GGSPPTRRCPATEDRA; GSPPTRRCPATEDRAP; SPPTRRCPATEDRAPA; PPTRRCPATEDRAPAT; PTRRCPATEDRAPATV; TRRCPATEDRAPATVA; RRCPATEDRAPATVAT; RCPATEDRAPATVATP; CPATEDRAPATVATPS; PATEDRAPATVATPSS; ATEDRAPATVATPSST; TEDRAPATVATPSSTD; EDRAPATVATPSSTDP; DRAPATVATPSSTDPT; RAPATVATPSSTDPTA; APATVATPSSTDPTAS; PATVATPSSTDPTASR; ATVATPSSTDPTASRA; TVATPSSTDPTASRAV; VATPSSTDPTASRAVS; ATPSSTDPTASRAVSW; TPSSTDPTASRAVSWW; PSSTDPTASRAVSWWS; SSTDPTASRAVSWWSV; STDPTASRAVSWWSVH; TDPTASRAVSWWSVHE; DPTASRAVSWWSVHEY; PTASRAVSWWSVHEYV; TASRAVSWWSVHEYVA; ASRAVSWWSVHEYVAP; SRAVSWWSVHEYVAPT; RAVSWWSVHEYVAPTL; AVSWWSVHEYVAPTLA; VSWWSVHEYVAPTLAA; SWWSVHEYVAPTLAAA; WWSVHEYVAPTLAAAV; WSVHEYVAPTLAAAVE; SVHEYVAPTLAAAVEW; VHEYVAPTLAAAVEWP; HEYVAPTLAAAVEWPM; EYVAPTLAAAVEWPMA; YVAPTLAAAVEWPMAG; VAPTLAAAVEWPMAGT; APTLAAAVEWPMAGTP; PTLAAAVEWPMAGTPA; TLAAAVEWPMAGTPAW; LAAAVEWPMAGTPAWC; AAAVEWPMAGTPAWCD; AAVEWPMAGTPAWCDL; AVEWPMAGTPAWCDLD; VEWPMAGTPAWCDLDD; EWPMAGTPAWCDLDDT; WPMAGTPAWCDLDDTD; PMAGTPAWCDLDDTDP; MAGTPAWCDLDDTDPV; AGTPAWCDLDDTDPVK; GTPAWCDLDDTDPVKW; TPAWCDLDDTDPVKWA; PAWCDLDDTDPVKWAA; | |

Fig. 29 continued

| | | |
|---|---|---|
| | AWCDLDDTDPVKWAAI; WCDLDDTDPVKWAAIC; CDLDDTDPVKWAAICD; DLDDTDPVKWAAICDA; LDDTDPVKWAAICDAA; DDTDPVKWAAICDAAR; DTDPVKWAAICDAARH; TDPVKWAAICDAARHW; DPVKWAAICDAARHWA; PVKWAAICDAARHWAL; VKWAAICDAARHWALR; KWAAICDAARHWALRV; WAAICDAARHWALRVE; AAICDAARHWALRVET; AICDAARHWALRVETC; ICDAARHWALRVETCQ; CDAARHWALRVETCQA; DAARHWALRVETCQAA; AARHWALRVETCQAAS; ARHWALRVETCQAASA; RHWALRVETCQAASAE; HWALRVETCQAASAEA; WALRVETCQAASAEAS; ALRVETCQAASAEASR; LRVETCQAASAEASRD; RVETCQAASAEASRDV; VETCQAASAEASRDVS; ETCQAASAEASRDVSA; TCQAASAEASRDVSAA; CQAASAEASRDVSAAA; QAASAEASRDVSAAAD; AASAEASRDVSAAADW; ASAEASRDVSAAADWP; SAEASRDVSAAADWPA; AEASRDVSAAADWPAV; EASRDVSAAADWPAVS; ASRDVSAAADWPAVSR; SRDVSAAADWPAVSRE; RDVSAAADWPAVSREI; DVSAAADWPAVSREIQ; VSAAADWPAVSREIQR; SAAADWPAVSREIQRR; AAADWPAVSREIQRRR; AADWPAVSREIQRRRD; ADWPAVSREIQRRRDA; DWPAVSREIQRRRDAY; WPAVSREIQRRRDAYI; PAVSREIQRRRDAYIR; AVSREIQRRRDAYIRR; VSREIQRRRDAYIRRV; SREIQRRRDAYIRRVV; REIQRRRDAYIRRVVV | |
| 48) Rv2657c | 13 mers: MCAFPSPSLGWTV; CAFPSPSLGWTVS; AFPSPSLGWTVSH; FPSPSLGWTVSHE; PSPSLGWTVSHET; SPSLGWTVSHETE; PSLGWTVSHETER; SLGWTVSHETERP; LGWTVSHETERPG; GWTVSHETERPGM; WTVSHETERPGMA; TVSHETERPGMAD; VSHETERPGMADA; SHETERPGMADAP; HETERPGMADAPP; ETERPGMADAPPL; TERPGMADAPPLS; ERPGMADAPPLSR; RPGMADAPPLSRR; PGMADAPPLSRRY; GMADAPPLSRRYI; MADAPPLSRRYIT; ADAPPLSRRYITI; DAPPLSRRYITIS; APPLSRRYITISE; PPLSRRYITISEA; PLSRRYITISEAA; LSRRYITISEAAE; SRRYITISEAAEY; RRYITISEAAEYL; RYITISEAAEYLA; YITISEAAEYLAV; ITISEAAEYLAVT; TISEAAEYLAVTD; ISEAAEYLAVTDR; SEAAEYLAVTDRT; EAAEYLAVTDRTV; AAEYLAVTDRTVR; AEYLAVTDRTVRQ; EYLAVTDRTVRQM; YLAVTDRTVRQMI; LAVTDRTVRQMIA; AVTDRTVRQMIAD; VTDRTVRQMIADG; TDRTVRQMIADGR; DRTVRQMIADGRL; RTVRQMIADGRLR; TVRQMIADGRLRG; VRQMIADGRLRGY; RQMIADGRLRGYR; QMIADGRLRGYRS; MIADGRLRGYRSG; IADGRLRGYRSGT; ADGRLRGYRSGTR; DGRLRGYRSGTRL; GRLRGYRSGTRLV; RLRGYRSGTRLVR; LRGYRSGTRLVRL; RGYRSGTRLVRLR; GYRSGTRLVRLRR; YRSGTRLVRLRRD; RSGTRLVRLRRDE; SGTRLVRLRRDEV; GTRLVRLRRDEVD; TRLVRLRRDEVDG; RLVRLRRDEVDGA; LVRLRRDEVDGAM; VRLRRDEVDGAMH; RLRRDEVDGAMHP; LRRDEVDGAMHPF; RRDEVDGAMHPFG; RDEVDGAMHPFGG; DEVDGAMHPFGGA; EVDGAMHPFGGAA<br><br>14 mers: MCAFPSPSLGWTVS; CAFPSPSLGWTVSH; AFPSPSLGWTVSHE; FPSPSLGWTVSHET; PSPSLGWTVSHETE; SPSLGWTVSHETER; PSLGWTVSHETERP; SLGWTVSHETERPG; LGWTVSHETERPGM; GWTVSHETERPGMA; WTVSHETERPGMAD; TVSHETERPGMADA; VSHETERPGMADAP; SHETERPGMADAPP; HETERPGMADAPPL; ETERPGMADAPPLS; TERPGMADAPPLSR; ERPGMADAPPLSRR; RPGMADAPPLSRRY; PGMADAPPLSRRYI; GMADAPPLSRRYIT; MADAPPLSRRYITI; ADAPPLSRRYITIS; DAPPLSRRYITISE; APPLSRRYITISEA; PPLSRRYITISEAA; PLSRRYITISEAAE; LSRRYITISEAAEY; SRRYITISEAAEYL; RRYITISEAAEYLA; RYITISEAAEYLAV; YITISEAAEYLAVT; ITISEAAEYLAVTD; | 95194-95483 |

Fig. 29 continued

| | | |
|---|---|---|
| | TISEAAEYLAVTDR; ISEAAEYLAVTDRT; SEAAEYLAVTDRTV; EAAEYLAVTDRTVR; AAEYLAVTDRTVRQ; AEYLAVTDRTVRQM; EYLAVTDRTVRQMI; YLAVTDRTVRQMIA; LAVTDRTVRQMIAD; AVTDRTVRQMIADG; VTDRTVRQMIADGR; TDRTVRQMIADGRL; DRTVRQMIADGRLR; RTVRQMIADGRLRG; TVRQMIADGRLRGY; VRQMIADGRLRGYR; RQMIADGRLRGYRS; QMIADGRLRGYRSG; MIADGRLRGYRSGT; IADGRLRGYRSGTR; ADGRLRGYRSGTRL; DGRLRGYRSGTRLV; GRLRGYRSGTRLVR; RLRGYRSGTRLVRL; LRGYRSGTRLVRLR; RGYRSGTRLVRLRR; GYRSGTRLVRLRRD; YRSGTRLVRLRRDE; RSGTRLVRLRRDEV; SGTRLVRLRRDEVD; GTRLVRLRRDEVDG; TRLVRLRRDEVDGA; RLVRLRRDEVDGAM; LVRLRRDEVDGAMH; VRLRRDEVDGAMHP; RLRRDEVDGAMHPF; LRRDEVDGAMHPFG; RRDEVDGAMHPFGG; RDEVDGAMHPFGGA; DEVDGAMHPFGGAA<br><br>15 mers:<br>MCAFPSPSLGWTVSH; CAFPSPSLGWTVSHE; AFPSPSLGWTVSHET; FPSPSLGWTVSHETE; PSPSLGWTVSHETER; SPSLGWTVSHETERP; PSLGWTVSHETERPG; SLGWTVSHETERPGM; LGWTVSHETERPGMA; GWTVSHETERPGMAD; WTVSHETERPGMADA; TVSHETERPGMADAP; VSHETERPGMADAPP; SHETERPGMADAPPL; HETERPGMADAPPLS; ETERPGMADAPPLSR; TERPGMADAPPLSRR; ERPGMADAPPLSRRY; RPGMADAPPLSRRYI; PGMADAPPLSRRYIT; GMADAPPLSRRYITI; MADAPPLSRRYITIS; ADAPPLSRRYITISE; DAPPLSRRYITISEA; APPLSRRYITISEAA; PPLSRRYITISEAAE; PLSRRYITISEAAEY; LSRRYITISEAAEYL; SRRYITISEAAEYLA; RRYITISEAAEYLAV; RYITISEAAEYLAVT; YITISEAAEYLAVTD; ITISEAAEYLAVTDR; TISEAAEYLAVTDRT; ISEAAEYLAVTDRTV; SEAAEYLAVTDRTVR; EAAEYLAVTDRTVRQ; AAEYLAVTDRTVRQM; AEYLAVTDRTVRQMI; EYLAVTDRTVRQMIA; YLAVTDRTVRQMIAD; LAVTDRTVRQMIADG; AVTDRTVRQMIADGR; VTDRTVRQMIADGRL; TDRTVRQMIADGRLR; DRTVRQMIADGRLRG; RTVRQMIADGRLRGY; TVRQMIADGRLRGYR; VRQMIADGRLRGYRS; RQMIADGRLRGYRSG; QMIADGRLRGYRSGT; MIADGRLRGYRSGTR; IADGRLRGYRSGTRL; ADGRLRGYRSGTRLV; DGRLRGYRSGTRLVR; GRLRGYRSGTRLVRL; RLRGYRSGTRLVRLR; LRGYRSGTRLVRLRR; RGYRSGTRLVRLRRD; GYRSGTRLVRLRRDE; YRSGTRLVRLRRDEV; RSGTRLVRLRRDEVD; SGTRLVRLRRDEVDG; GTRLVRLRRDEVDGA; TRLVRLRRDEVDGAM; RLVRLRRDEVDGAMH; LVRLRRDEVDGAMHP; VRLRRDEVDGAMHPF; RLRRDEVDGAMHPFG; LRRDEVDGAMHPFGG; RRDEVDGAMHPFGGA; RDEVDGAMHPFGGAA<br><br>16 mers:<br>MCAFPSPSLGWTVSHE; CAFPSPSLGWTVSHET; AFPSPSLGWTVSHETE; FPSPSLGWTVSHETER; PSPSLGWTVSHETERP; SPSLGWTVSHETERPG; PSLGWTVSHETERPGM; SLGWTVSHETERPGMA; LGWTVSHETERPGMAD; GWTVSHETERPGMADA; WTVSHETERPGMADAP; TVSHETERPGMADAPP; VSHETERPGMADAPPL; SHETERPGMADAPPLS; HETERPGMADAPPLSR; ETERPGMADAPPLSRR; TERPGMADAPPLSRRY; ERPGMADAPPLSRRYI; RPGMADAPPLSRRYIT; PGMADAPPLSRRYITI; GMADAPPLSRRYITIS; MADAPPLSRRYITISE; ADAPPLSRRYITISEA; DAPPLSRRYITISEAA; APPLSRRYITISEAAE; PPLSRRYITISEAAEY; PLSRRYITISEAAEYL; LSRRYITISEAAEYLA; SRRYITISEAAEYLAV; RRYITISEAAEYLAVT; RYITISEAAEYLAVTD; YITISEAAEYLAVTDR; ITISEAAEYLAVTDRT; | |

Fig. 29 continued

| | | |
|---|---|---|
| | TISEAAEYLAVTDRTV; ISEAAEYLAVTDRTVR; SEAAEYLAVTDRTVRQ; EAAEYLAVTDRTVRQM; AAEYLAVTDRTVRQMI; AEYLAVTDRTVRQMIA; EYLAVTDRTVRQMIAD; YLAVTDRTVRQMIADG; LAVTDRTVRQMIADGR; AVTDRTVRQMIADGRL; VTDRTVRQMIADGRLR; TDRTVRQMIADGRLRG; DRTVRQMIADGRLRGY; RTVRQMIADGRLRGYR; TVRQMIADGRLRGYRS; VRQMIADGRLRGYRSG; RQMIADGRLRGYRSGT; QMIADGRLRGYRSGTR; MIADGRLRGYRSGTRL; IADGRLRGYRSGTRLV; ADGRLRGYRSGTRLVR; DGRLRGYRSGTRLVRL; GRLRGYRSGTRLVRLR; RLRGYRSGTRLVRLRR; LRGYRSGTRLVRLRRD; RGYRSGTRLVRLRRDE; GYRSGTRLVRLRRDEV; YRSGTRLVRLRRDEVD; RSGTRLVRLRRDEVDG; SGTRLVRLRRDEVDGA; GTRLVRLRRDEVDGAM; TRLVRLRRDEVDGAMH; RLVRLRRDEVDGAMHP; LVRLRRDEVDGAMHPF; VRLRRDEVDGAMHPFG; RLRRDEVDGAMHPFGG; LRRDEVDGAMHPFGGA; RRDEVDGAMHPFGGAA | |
| 49) Rv2658c | 13 mers:<br>MADAVKYVVMCNC; ADAVKYVVMCNCD; DAVKYVVMCNCDD; AVKYVVMCNCDDE; VKYVVMCNCDDEP; KYVVMCNCDDEPG; YVVMCNCDDEPGA; VVMCNCDDEPGAL; VMCNCDDEPGALI; MCNCDDEPGALII; CNCDDEPGALIIA; NCDDEPGALIIAW; CDDEPGALIIAWI; DDEPGALIIAWID; DEPGALIIAWIDD; EPGALIIAWIDDE; PGALIIAWIDDER; GALIIAWIDDERP; ALIIAWIDDERPA; LIIAWIDDERPAG; IIAWIDDERPAGG; IAWIDDERPAGGH; AWIDDERPAGGHI; WIDDERPAGGHIQ; IDDERPAGGHIQM; DDERPAGGHIQMR; DERPAGGHIQMRS; ERPAGGHIQMRSN; RPAGGHIQMRSNT; PAGGHIQMRSNTR; AGGHIQMRSNTRF; GGHIQMRSNTRFT; GHIQMRSNTRFTE; HIQMRSNTRFTET; IQMRSNTRFTETQ; QMRSNTRFTETQW; MRSNTRFTETQWG; RSNTRFTETQWGR; SNTRFTETQWGRH; NTRFTETQWGRHI; TRFTETQWGRHIE; RFTETQWGRHIEW; FTETQWGRHIEWK; TETQWGRHIEWKL; ETQWGRHIEWKLE; TQWGRHIEWKLEC; QWGRHIEWKLECR; WGRHIEWKLECRA; GRHIEWKLECRAC; RHIEWKLECRACR; HIEWKLECRACRK; IEWKLECRACRKY; EWKLECRACRKYA; WKLECRACRKYAP; KLECRACRKYAPI; LECRACRKYAPIS; ECRACRKYAPISE; CRACRKYAPISEM; RACRKYAPISEMT; ACRKYAPISEMTA; CRKYAPISEMTAA; RKYAPISEMTAAA; KYAPISEMTAAAI; YAPISEMTAAAIL; APISEMTAAAILD; PISEMTAAAILDG; ISEMTAAAILDGF; SEMTAAAILDGFG; EMTAAAILDGFGA; MTAAAILDGFGAK; TAAAILDGFGAKL; AAAILDGFGAKLH; AAILDGFGAKLHE; AILDGFGAKLHEL; ILDGFGAKLHELR; LDGFGAKLHELRT; DGFGAKLHELRTS; GFGAKLHELRTST; FGAKLHELRTSTI; GAKLHELRTSTIP; AKLHELRTSTIPD; KLHELRTSTIPDA; LHELRTSTIPDAD; HELRTSTIPDADD; ELRTSTIPDADDP; LRTSTIPDADDPS; RTSTIPDADDPSI; TSTIPDADDPSIA; STIPDADDPSIAE; TIPDADDPSIAEA; IPDADDPSIAEAR; PDADDPSIAEARH; DADDPSIAEARHV; ADDPSIAEARHVI; DDPSIAEARHVIP; DPSIAEARHVIPF; PSIAEARHVIPFS; SIAEARHVIPFSA; IAEARHVIPFSAL; AEARHVIPFSALC; EARHVIPFSALCL; ARHVIPFSALCLR; RHVIPFSALCLRL; HVIPFSALCLRLS; VIPFSALCLRLSQ; IPFSALCLRLSQL; PFSALCLRLSQLG; FSALCLRLSQLGG<br><br>14 mers:<br>MADAVKYVVMCNCD; ADAVKYVVMCNCDD; DAVKYVVMCNCDDE; AVKYVVMCNCDDEP; VKYVVMCNCDDEPG; KYVVMCNCDDEPGA; YVVMCNCDDEPGAL; VVMCNCDDEPGALI; VMCNCDDEPGALII; MCNCDDEPGALIIA; CNCDDEPGALIIAW; NCDDEPGALIIAWI; CDDEPGALIIAWID; DDEPGALIIAWIDD; DEPGALIIAWIDDE; EPGALIIAWIDDER; PGALIIAWIDDERP; GALIIAWIDDERPA; ALIIAWIDDERPAG; LIIAWIDDERPAGG; IIAWIDDERPAGGH; IAWIDDERPAGGHI; AWIDDERPAGGHIQ; WIDDERPAGGHIQM; IDDERPAGGHIQMR; DDERPAGGHIQMRS; | 95484-95909 |

Fig. 29 continued

| | | | |
|---|---|---|---|
| | DERPAGGHIQMRSN; ERPAGGHIQMRSNT; RPAGGHIQMRSNTR; PAGGHIQMRSNTRF; AGGHIQMRSNTRFT; GGHIQMRSNTRFTE; GHIQMRSNTRFTET; HIQMRSNTRFTETQ; IQMRSNTRFTETQW; QMRSNTRFTETQWG; MRSNTRFTETQWGR; RSNTRFTETQWGRH; SNTRFTETQWGRHI; NTRFTETQWGRHIE; TRFTETQWGRHIEW; RFTETQWGRHIEWK; FTETQWGRHIEWKL; TETQWGRHIEWKLE; ETQWGRHIEWKLEC; TQWGRHIEWKLECR; QWGRHIEWKLECRA; WGRHIEWKLECRAC; GRHIEWKLECRACR; RHIEWKLECRACRK; HIEWKLECRACRKY; IEWKLECRACRKYA; EWKLECRACRKYAP; WKLECRACRKYAPI; KLECRACRKYAPIS; LECRACRKYAPISE; ECRACRKYAPISEM; CRACRKYAPISEMT; RACRKYAPISEMTA; ACRKYAPISEMTAA; CRKYAPISEMTAAA; RKYAPISEMTAAAI; KYAPISEMTAAAIL; YAPISEMTAAAILD; APISEMTAAAILDG; PISEMTAAAILDGF; ISEMTAAAILDGFG; SEMTAAAILDGFGA; EMTAAAILDGFGAK; MTAAAILDGFGAKL; TAAAILDGFGAKLH; AAAILDGFGAKLHE; AAILDGFGAKLHEL; AILDGFGAKLHELR; ILDGFGAKLHELRT; LDGFGAKLHELRTS; DGFGAKLHELRTST; GFGAKLHELRTSTI; FGAKLHELRTSTIP; GAKLHELRTSTIPD; AKLHELRTSTIPDA; KLHELRTSTIPDAD; LHELRTSTIPDADD; HELRTSTIPDADDP; ELRTSTIPDADDPS; LRTSTIPDADDPSI; RTSTIPDADDPSIA; TSTIPDADDPSIAE; STIPDADDPSIAEA; TIPDADDPSIAEAR; IPDADDPSIAEARH; PDADDPSIAEARHV; DADDPSIAEARHVI; ADDPSIAEARHVIP; DDPSIAEARHVIPF; DPSIAEARHVIPFS; PSIAEARHVIPFSA; SIAEARHVIPFSAL; IAEARHVIPFSALC; AEARHVIPFSALCL; EARHVIPFSALCLR; ARHVIPFSALCLRL; RHVIPFSALCLRLS; HVIPFSALCLRLSQ; VIPFSALCLRLSQL; IPFSALCLRLSQLG; PFSALCLRLSQLGG<br><br>15 mers:<br>MADAVKYVVMCNCDD; ADAVKYVVMCNCDDE; DAVKYVVMCNCDDEP; AVKYVVMCNCDDEPG; VKYVVMCNCDDEPGA; KYVVMCNCDDEPGAL; YVVMCNCDDEPGALI; VVMCNCDDEPGALII; VMCNCDDEPGALIIA; MCNCDDEPGALIIAW; CNCDDEPGALIIAWI; NCDDEPGALIIAWID; CDDEPGALIIAWIDD; DDEPGALIIAWIDDE; DEPGALIIAWIDDER; EPGALIIAWIDDERP; PGALIIAWIDDERPA; GALIIAWIDDERPAG; ALIIAWIDDERPAGG; LIIAWIDDERPAGGH; IIAWIDDERPAGGHI; IAWIDDERPAGGHIQ; AWIDDERPAGGHIQM; WIDDERPAGGHIQMR; IDDERPAGGHIQMRS; DDERPAGGHIQMRSN; DERPAGGHIQMRSNT; ERPAGGHIQMRSNTR; RPAGGHIQMRSNTRF; PAGGHIQMRSNTRFT; AGGHIQMRSNTRFTE; GGHIQMRSNTRFTET; GHIQMRSNTRFTETQ; HIQMRSNTRFTETQW; IQMRSNTRFTETQWG; QMRSNTRFTETQWGR; MRSNTRFTETQWGRH; RSNTRFTETQWGRHI; SNTRFTETQWGRHIE; NTRFTETQWGRHIEW; TRFTETQWGRHIEWK; RFTETQWGRHIEWKL; FTETQWGRHIEWKLE; TETQWGRHIEWKLEC; ETQWGRHIEWKLECR; TQWGRHIEWKLECRA; QWGRHIEWKLECRAC; WGRHIEWKLECRACR; GRHIEWKLECRACRK; RHIEWKLECRACRKY; HIEWKLECRACRKYA; IEWKLECRACRKYAP; EWKLECRACRKYAPI; WKLECRACRKYAPIS; KLECRACRKYAPISE; LECRACRKYAPISEM; ECRACRKYAPISEMT; CRACRKYAPISEMTA; RACRKYAPISEMTAA; ACRKYAPISEMTAAA; CRKYAPISEMTAAAI; RKYAPISEMTAAAIL; KYAPISEMTAAAILD; YAPISEMTAAAILDG; APISEMTAAAILDGF; PISEMTAAAILDGFG; ISEMTAAAILDGFGA; SEMTAAAILDGFGAK; EMTAAAILDGFGAKL; MTAAAILDGFGAKLH; TAAAILDGFGAKLHE; AAAILDGFGAKLHEL; AAILDGFGAKLHELR; AILDGFGAKLHELRT; ILDGFGAKLHELRTS; LDGFGAKLHELRTST; DGFGAKLHELRTSTI; GFGAKLHELRTSTIP; | |

Fig. 29 continued

| | | |
|---|---|---|
| | FGAKLHELRTSTIPD; GAKLHELRTSTIPDA; AKLHELRTSTIPDAD; KLHELRTSTIPDADD; LHELRTSTIPDADDP; HELRTSTIPDADDPS; ELRTSTIPDADDPSI; LRTSTIPDADDPSIA; RTSTIPDADDPSIAE; TSTIPDADDPSIAEA; STIPDADDPSIAEAR; TIPDADDPSIAEARH; IPDADDPSIAEARHV; PDADDPSIAEARHVI; DADDPSIAEARHVIP; ADDPSIAEARHVIPF; DDPSIAEARHVIPFS; DPSIAEARHVIPFSA; PSIAEARHVIPFSAL; SIAEARHVIPFSALC; IAEARHVIPFSALCL; AEARHVIPFSALCLR; EARHVIPFSALCLRL; ARHVIPFSALCLRLS; RHVIPFSALCLRLSQ; HVIPFSALCLRLSQL; VIPFSALCLRLSQLG; IPFSALCLRLSQLGG<br><br>16 mers:<br>MADAVKYVVMCNCDDE; ADAVKYVVMCNCDDEP; DAVKYVVMCNCDDEPG; AVKYVVMCNCDDEPGA; VKYVVMCNCDDEPGAL; KYVVMCNCDDEPGALI; YVVMCNCDDEPGALII; VVMCNCDDEPGALIIA; VMCNCDDEPGALIIAW; MCNCDDEPGALIIAWI; CNCDDEPGALIIAWID; NCDDEPGALIIAWIDD; CDDEPGALIIAWIDDE; DDEPGALIIAWIDDER; DEPGALIIAWIDDERP; EPGALIIAWIDDERPA; PGALIIAWIDDERPAG; GALIIAWIDDERPAGG; ALIIAWIDDERPAGGH; LIIAWIDDERPAGGHI; IIAWIDDERPAGGHIQ; IAWIDDERPAGGHIQM; AWIDDERPAGGHIQMR; WIDDERPAGGHIQMRS; IDDERPAGGHIQMRSN; DDERPAGGHIQMRSNT; DERPAGGHIQMRSNTR; ERPAGGHIQMRSNTRF; RPAGGHIQMRSNTRFT; PAGGHIQMRSNTRFTE; AGGHIQMRSNTRFTET; GGHIQMRSNTRFTETQ; GHIQMRSNTRFTETQW; HIQMRSNTRFTETQWG; IQMRSNTRFTETQWGR; QMRSNTRFTETQWGRH; MRSNTRFTETQWGRHI; RSNTRFTETQWGRHIE; SNTRFTETQWGRHIEW; NTRFTETQWGRHIEWK; TRFTETQWGRHIEWKL; RFTETQWGRHIEWKLE; FTETQWGRHIEWKLEC; TETQWGRHIEWKLECR; ETQWGRHIEWKLECRA; TQWGRHIEWKLECRAC; QWGRHIEWKLECRACR; WGRHIEWKLECRACRK; GRHIEWKLECRACRKY; RHIEWKLECRACRKYA; HIEWKLECRACRKYAP; IEWKLECRACRKYAPI; EWKLECRACRKYAPIS; WKLECRACRKYAPISE; KLECRACRKYAPISEM; LECRACRKYAPISEMT; ECRACRKYAPISEMTA; CRACRKYAPISEMTAA; RACRKYAPISEMTAAA; ACRKYAPISEMTAAAI; CRKYAPISEMTAAAIL; RKYAPISEMTAAAILD; KYAPISEMTAAAILDG; YAPISEMTAAAILDGF; APISEMTAAAILDGFG; PISEMTAAAILDGFGA; ISEMTAAAILDGFGAK; SEMTAAAILDGFGAKL; EMTAAAILDGFGAKLH; MTAAAILDGFGAKLHE; TAAAILDGFGAKLHEL; AAAILDGFGAKLHELR; AAILDGFGAKLHELRT; AILDGFGAKLHELRTS; ILDGFGAKLHELRTST; LDGFGAKLHELRTSTI; DGFGAKLHELRTSTIP; GFGAKLHELRTSTIPD; FGAKLHELRTSTIPDA; GAKLHELRTSTIPDAD; AKLHELRTSTIPDADD; KLHELRTSTIPDADDP; LHELRTSTIPDADDPS; HELRTSTIPDADDPSI; ELRTSTIPDADDPSIA; LRTSTIPDADDPSIAE; RTSTIPDADDPSIAEA; TSTIPDADDPSIAEAR; STIPDADDPSIAEARH; TIPDADDPSIAEARHV; IPDADDPSIAEARHVI; PDADDPSIAEARHVIP; DADDPSIAEARHVIPF; ADDPSIAEARHVIPFS; DDPSIAEARHVIPFSA; DPSIAEARHVIPFSAL; PSIAEARHVIPFSALC; SIAEARHVIPFSALCL; IAEARHVIPFSALCLR; AEARHVIPFSALCLRL; EARHVIPFSALCLRLS; ARHVIPFSALCLRLSQ; RHVIPFSALCLRLSQL; HVIPFSALCLRLSQLG; VIPFSALCLRLSQLGG | |
| 50) Rv2659c | 13 mers:<br>MTQTGKRQRRKFG; TQTGKRQRRKFGR; QTGKRQRRKFGRI; TGKRQRRKFGRIR; GKRQRRKFGRIRQ; KRQRRKFGRIRQF; RQRRKFGRIRQFN; QRRKFGRIRQFNS; RRKFGRIRQFNSG; RKFGRIRQFNSGR; KFGRIRQFNSGRW; FGRIRQFNSGRWQ; GRIRQFNSGRWQA; RIRQFNSGRWQAS; IRQFNSGRWQASY; RQFNSGRWQASYT; QFNSGRWQASYTG; | 95910-97355 |

Fig. 29 continued

| | | | |
|---|---|---|---|
| | FNSGRWQASYTGP; NSGRWQASYTGPD; SGRWQASYTGPDG; GRWQASYTGPDGR; RWQASYTGPDGRV; WQASYTGPDGRVY; QASYTGPDGRVYI; ASYTGPDGRVYIA; SYTGPDGRVYIAP; YTGPDGRVYIAPK; TGPDGRVYIAPKT; GPDGRVYIAPKTF; PDGRVYIAPKTFN; DGRVYIAPKTFNA; GRVYIAPKTFNAK; RVYIAPKTFNAKI; VYIAPKTFNAKID; YIAPKTFNAKIDA; IAPKTFNAKIDAE; APKTFNAKIDAEA; PKTFNAKIDAEAW; KTFNAKIDAEAWL; TFNAKIDAEAWLT; FNAKIDAEAWLTD; NAKIDAEAWLTDR; AKIDAEAWLTDRR; KIDAEAWLTDRRR; IDAEAWLTDRRRE; DAEAWLTDRRREI; AEAWLTDRRREID; EAWLTDRRREIDR; AWLTDRRREIDRQ; WLTDRRREIDRQL; LTDRRREIDRQLW; TDRRREIDRQLWS; DRRREIDRQLWSP; RRREIDRQLWSPA; RREIDRQLWSPAS; REIDRQLWSPASG; EIDRQLWSPASGQ; IDRQLWSPASGQE; DRQLWSPASGQED; RQLWSPASGQEDR; QLWSPASGQEDRP; LWSPASGQEDRPG; WSPASGQEDRPGA; SPASGQEDRPGAP; PASGQEDRPGAPF; ASGQEDRPGAPFG; SGQEDRPGAPFGE; GQEDRPGAPFGEY; QEDRPGAPFGEYA; EDRPGAPFGEYAE; DRPGAPFGEYAEG; RPGAPFGEYAEGW; PGAPFGEYAEGWL; GAPFGEYAEGWLK; APFGEYAEGWLKQ; PFGEYAEGWLKQR; FGEYAEGWLKQRG; GEYAEGWLKQRGI; EYAEGWLKQRGIK; YAEGWLKQRGIKD; AEGWLKQRGIKDR; EGWLKQRGIKDRT; GWLKQRGIKDRTR; WLKQRGIKDRTRA; LKQRGIKDRTRAH; KQRGIKDRTRAHY; QRGIKDRTRAHYR; RGIKDRTRAHYRK; GIKDRTRAHYRKL; IKDRTRAHYRKLL; KDRTRAHYRKLLD; DRTRAHYRKLLDN; RTRAHYRKLLDNH; TRAHYRKLLDNHI; RAHYRKLLDNHIL; AHYRKLLDNHILA; HYRKLLDNHILAT; YRKLLDNHILATF; RKLLDNHILATFA; KLLDNHILATFAD; LLDNHILATFADT; LDNHILATFADTD; DNHILATFADTDL; NHILATFADTDLR; HILATFADTDLRD; ILATFADTDLRDI; LATFADTDLRDIT; ATFADTDLRDITP; TFADTDLRDITPA; FADTDLRDITPAA; ADTDLRDITPAAV; DTDLRDITPAAVR; TDLRDITPAAVRR; DLRDITPAAVRRW; LRDITPAAVRRWY; RDITPAAVRRWYA; DITPAAVRRWYAT; ITPAAVRRWYATT; TPAAVRRWYATTA; PAAVRRWYATTAV; AAVRRWYATTAVG; AVRRWYATTAVGT; VRRWYATTAVGTP; RRWYATTAVGTPT; RWYATTAVGTPTM; WYATTAVGTPTMR; YATTAVGTPTMRA; ATTAVGTPTMRAH; TTAVGTPTMRAHS; TAVGTPTMRAHSY; AVGTPTMRAHSYS; VGTPTMRAHSYSL; GTPTMRAHSYSLL; TPTMRAHSYSLLR; PTMRAHSYSLLRA; TMRAHSYSLLRAI; MRAHSYSLLRAIM; RAHSYSLLRAIMQ; AHSYSLLRAIMQT; HSYSLLRAIMQTA; SYSLLRAIMQTAL; YSLLRAIMQTALA; SLLRAIMQTALAD; LLRAIMQTALADD; LRAIMQTALADDL; RAIMQTALADDLI; AIMQTALADDLID; IMQTALADDLIDS; MQTALADDLIDSN; QTALADDLIDSNP; TALADDLIDSNPC; ALADDLIDSNPCR; LADDLIDSNPCRI; ADDLIDSNPCRIS; DDLIDSNPCRISG; DLIDSNPCRISGA; LIDSNPCRISGAS; IDSNPCRISGAST; DSNPCRISGASTA; SNPCRISGASTAR; NPCRISGASTARR; PCRISGASTARRV; CRISGASTARRVH; RISGASTARRVHK; ISGASTARRVHKI; SGASTARRVHKIR; GASTARRVHKIRP; ASTARRVHKIRPA; STARRVHKIRPAT; TARRVHKIRPATL; ARRVHKIRPATLD; RRVHKIRPATLDE; RVHKIRPATLDEL; VHKIRPATLDELE; HKIRPATLDELET; KIRPATLDELETI; IRPATLDELETIT; RPATLDELETITK; PATLDELETITKA; ATLDELETITKAM; TLDELETITKAMP; LDELETITKAMPD; DELETITKAMPDP; ELETITKAMPDPY; LETITKAMPDPYQ; ETITKAMPDPYQA; TITKAMPDPYQAF; ITKAMPDPYQAFV; TKAMPDPYQAFVL; KAMPDPYQAFVLM; AMPDPYQAFVLMA; MPDPYQAFVLMAA; PDPYQAFVLMAAW; DPYQAFVLMAAWL; PYQAFVLMAAWLA; YQAFVLMAAWLAM; QAFVLMAAWLAMR; AFVLMAAWLAMRY; FVLMAAWLAMRYG; VLMAAWLAMRYGE; LMAAWLAMRYGEL; MAAWLAMRYGELT; AAWLAMRYGELTE; AWLAMRYGELTEL; WLAMRYGELTELR; LAMRYGELTELRR; AMRYGELTELRRK; MRYGELTELRRKD; RYGELTELRRKDI; | |

Fig. 29 continued

YGELTELRRKDID; GELTELRRKDIDL; ELTELRRKDIDLH; LTELRRKDIDLHG;
TELRRKDIDLHGE; ELRRKDIDLHGEV; LRRKDIDLHGEVA; RRKDIDLHGEVAR;
RKDIDLHGEVARV; KDIDLHGEVARVR; DIDLHGEVARVRR; IDLHGEVARVRRA;
DLHGEVARVRRAV; LHGEVARVRRAVV; HGEVARVRRAVVR;
GEVARVRRAVVRV; EVARVRRAVVRVG; VARVRRAVVRVGE;
ARVRRAVVRVGEG; RVRRAVVRVGEGF; VRRAVVRVGEGFK;
RRAVVRVGEGFKV; RAVVRVGEGFKVT; AVVRVGEGFKVTT;
VVRVGEGFKVTTP; VRVGEGFKVTTPK; RVGEGFKVTTPKS; VGEGFKVTTPKSD;
GEGFKVTTPKSDA; EGFKVTTPKSDAG; GFKVTTPKSDAGV; FKVTTPKSDAGVR;
KVTTPKSDAGVRD; VTTPKSDAGVRDI; TTPKSDAGVRDIS; TPKSDAGVRDISI;
PKSDAGVRDISIP; KSDAGVRDISIPP; SDAGVRDISIPPH; DAGVRDISIPPHL;
AGVRDISIPPHLI; GVRDISIPPHLIP; VRDISIPPHLIPA; RDISIPPHLIPAI;
DISIPPHLIPAIE; ISIPPHLIPAIED; SIPPHLIPAIEDH; IPPHLIPAIEDHL;
PPHLIPAIEDHLH; PHLIPAIEDHLHK; HLIPAIEDHLHKH; LIPAIEDHLHKHV;
IPAIEDHLHKHVN; PAIEDHLHKHVNP; AIEDHLHKHVNPG; IEDHLHKHVNPGR;
EDHLHKHVNPGRE; DHLHKHVNPGRES; HLHKHVNPGRESL;
LHKHVNPGRESLL; HKHVNPGRESLLF; KHVNPGRESLLFP; HVNPGRESLLFPS;
VNPGRESLLFPSV; NPGRESLLFPSVN; PGRESLLFPSVND; GRESLLFPSVNDP;
RESLLFPSVNDPN; ESLLFPSVNDPNR; SLLFPSVNDPNRH; LLFPSVNDPNRHL;
LFPSVNDPNRHLA; FPSVNDPNRHLAP; PSVNDPNRHLAPS; SVNDPNRHLAPSA;
VNDPNRHLAPSAL; NDPNRHLAPSALY; DPNRHLAPSALYR; PNRHLAPSALYRM;
NRHLAPSALYRMF; RHLAPSALYRMFY; HLAPSALYRMFYK; LAPSALYRMFYKA;
APSALYRMFYKAR; PSALYRMFYKARK; SALYRMFYKARKA; ALYRMFYKARKAA;
LYRMFYKARKAAG; YRMFYKARKAAGR; RMFYKARKAAGRP;
MFYKARKAAGRPD; FYKARKAAGRPDL; YKARKAAGRPDLR;
KARKAAGRPDLRV; ARKAAGRPDLRVH; RKAAGRPDLRVHD;
KAAGRPDLRVHDL; AAGRPDLRVHDLR; AGRPDLRVHDLRH;
GRPDLRVHDLRHS; RPDLRVHDLRHSG; PDLRVHDLRHSGA;
DLRVHDLRHSGAV; LRVHDLRHSGAVL; RVHDLRHSGAVLA; VHDLRHSGAVLAA;
HDLRHSGAVLAAS; DLRHSGAVLAAST; LRHSGAVLAASTG; RHSGAVLAASTGA;
HSGAVLAASTGAT; SGAVLAASTGATL; GAVLAASTGATLA; AVLAASTGATLAE;
VLAASTGATLAEL; LAASTGATLAELM; AASTGATLAELMQ; ASTGATLAELMQR;
STGATLAELMQRL; TGATLAELMQRLG; GATLAELMQRLGH; ATLAELMQRLGHS;
TLAELMQRLGHST; LAELMQRLGHSTA; AELMQRLGHSTAG;
ELMQRLGHSTAGA; LMQRLGHSTAGAA; MQRLGHSTAGAAL;
QRLGHSTAGAALR; RLGHSTAGAALRY; LGHSTAGAALRYQ;
GHSTAGAALRYQH; HSTAGAALRYQHA; STAGAALRYQHAA;
TAGAALRYQHAAK; AGAALRYQHAAKG; GAALRYQHAAKGR;
AALRYQHAAKGRD; ALRYQHAAKGRDR; LRYQHAAKGRDRE;
RYQHAAKGRDREI; YQHAAKGRDREIA; QHAAKGRDREIAA; HAAKGRDREIAAL;
AAKGRDREIAALL; AKGRDREIAALLS; KGRDREIAALLSK; GRDREIAALLSKL;
RDREIAALLSKLA; DREIAALLSKLAE; REIAALLSKLAEN; EIAALLSKLAENQ;
IAALLSKLAENQE; AALLSKLAENQEM 14 mers:
MTQTGKRQRRKFGR; TQTGKRQRRKFGRI; QTGKRQRRKFGRIR;
TGKRQRRKFGRIRQ; GKRQRRKFGRIRQF; KRQRRKFGRIRQFN;
RQRRKFGRIRQFNS; QRRKFGRIRQFNSG; RRKFGRIRQFNSGR;
RKFGRIRQFNSGRW; KFGRIRQFNSGRWQ; FGRIRQFNSGRWQA;
GRIRQFNSGRWQAS; RIRQFNSGRWQASY; IRQFNSGRWQASYT;
RQFNSGRWQASYTG; QFNSGRWQASYTGP; FNSGRWQASYTGPD;
NSGRWQASYTGPDG; SGRWQASYTGPDGR; GRWQASYTGPDGRV;
RWQASYTGPDGRVY; WQASYTGPDGRVYI; QASYTGPDGRVYIA;

Fig. 29 continued

| | | | |
|---|---|---|---|
| | ASYTGPDGRVYIAP; SYTGPDGRVYIAPK; YTGPDGRVYIAPKT; TGPDGRVYIAPKTF; GPDGRVYIAPKTFN; PDGRVYIAPKTFNA; DGRVYIAPKTFNAK; GRVYIAPKTFNAKI; RVYIAPKTFNAKID; VYIAPKTFNAKIDA; YIAPKTFNAKIDAE; IAPKTFNAKIDAEA; APKTFNAKIDAEAW; PKTFNAKIDAEAWL; KTFNAKIDAEAWLT; TFNAKIDAEAWLTD; FNAKIDAEAWLTDR; NAKIDAEAWLTDRR; AKIDAEAWLTDRRR; KIDAEAWLTDRRRE; IDAEAWLTDRRREI; DAEAWLTDRRREID; AEAWLTDRRREIDR; EAWLTDRRREIDRQ; AWLTDRRREIDRQL; WLTDRRREIDRQLW; LTDRRREIDRQLWS; TDRRREIDRQLWSP; DRRREIDRQLWSPA; RRREIDRQLWSPAS; RREIDRQLWSPASG; REIDRQLWSPASGQ; EIDRQLWSPASGQE; IDRQLWSPASGQED; DRQLWSPASGQEDR; RQLWSPASGQEDRP; QLWSPASGQEDRPG; LWSPASGQEDRPGA; WSPASGQEDRPGAP; SPASGQEDRPGAPF; PASGQEDRPGAPFG; ASGQEDRPGAPFGE; SGQEDRPGAPFGEY; GQEDRPGAPFGEYA; QEDRPGAPFGEYAE; EDRPGAPFGEYAEG; DRPGAPFGEYAEGW; RPGAPFGEYAEGWL; PGAPFGEYAEGWLK; GAPFGEYAEGWLKQ; APFGEYAEGWLKQR; PFGEYAEGWLKQRG; FGEYAEGWLKQRGI; GEYAEGWLKQRGIK; EYAEGWLKQRGIKD; YAEGWLKQRGIKDR; AEGWLKQRGIKDRT; EGWLKQRGIKDRTR; GWLKQRGIKDRTRA; WLKQRGIKDRTRAH; LKQRGIKDRTRAHY; KQRGIKDRTRAHYR; QRGIKDRTRAHYRK; RGIKDRTRAHYRKL; GIKDRTRAHYRKLL; IKDRTRAHYRKLLD; KDRTRAHYRKLLDN; DRTRAHYRKLLDNH; RTRAHYRKLLDNHI; TRAHYRKLLDNHIL; RAHYRKLLDNHILA; AHYRKLLDNHILAT; HYRKLLDNHILATF; YRKLLDNHILATFA; RKLLDNHILATFAD; KLLDNHILATFADT; LLDNHILATFADTD; LDNHILATFADTDL; DNHILATFADTDLR; NHILATFADTDLRD; HILATFADTDLRDI; ILATFADTDLRDIT; LATFADTDLRDITP; ATFADTDLRDITPA; TFADTDLRDITPAA; FADTDLRDITPAAV; ADTDLRDITPAAVR; DTDLRDITPAAVRR; TDLRDITPAAVRRW; DLRDITPAAVRRWY; LRDITPAAVRRWYA; RDITPAAVRRWYAT; DITPAAVRRWYATT; ITPAAVRRWYATTA; TPAAVRRWYATTAV; PAAVRRWYATTAVG; AAVRRWYATTAVGT; AVRRWYATTAVGTP; VRRWYATTAVGTPT; RRWYATTAVGTPTM; RWYATTAVGTPTMR; WYATTAVGTPTMRA; YATTAVGTPTMRAH; ATTAVGTPTMRAHS; TTAVGTPTMRAHSY; TAVGTPTMRAHSYS; AVGTPTMRAHSYSL; VGTPTMRAHSYSLL; GTPTMRAHSYSLLR; TPTMRAHSYSLLRA; PTMRAHSYSLLRAI; TMRAHSYSLLRAIM; MRAHSYSLLRAIMQ; RAHSYSLLRAIMQT; AHSYSLLRAIMQTA; HSYSLLRAIMQTAL; SYSLLRAIMQTALA; YSLLRAIMQTALAD; SLLRAIMQTALADD; LLRAIMQTALADDL; LRAIMQTALADDLI; RAIMQTALADDLID; AIMQTALADDLIDS; IMQTALADDLIDSN; MQTALADDLIDSNP; QTALADDLIDSNPC; TALADDLIDSNPCR; ALADDLIDSNPCRI; LADDLIDSNPCRIS; ADDLIDSNPCRISG; DDLIDSNPCRISGA; DLIDSNPCRISGAS; LIDSNPCRISGAST; IDSNPCRISGASTA; DSNPCRISGASTAR; SNPCRISGASTARR; NPCRISGASTARRV; PCRISGASTARRVH; CRISGASTARRVHK; RISGASTARRVHKI; ISGASTARRVHKIR; SGASTARRVHKIRP; GASTARRVHKIRPA; ASTARRVHKIRPAT; STARRVHKIRPATL; TARRVHKIRPATLD; ARRVHKIRPATLDE; RRVHKIRPATLDEL; RVHKIRPATLDELE; VHKIRPATLDELET; HKIRPATLDELETI; KIRPATLDELETIT; IRPATLDELETITK; RPATLDELETITKA; PATLDELETITKAM; ATLDELETITKAMP; TLDELETITKAMPD; LDELETITKAMPDP; DELETITKAMPDPY; ELETITKAMPDPYQ; LETITKAMPDPYQA; ETITKAMPDPYQAF; TITKAMPDPYQAFV; ITKAMPDPYQAFVL; TKAMPDPYQAFVLM; KAMPDPYQAFVLMA; AMPDPYQAFVLMAA; MPDPYQAFVLMAAW; PDPYQAFVLMAAWL; | |

Fig. 29 continued

| | | |
|---|---|---|
| | DPYQAFVLMAAWLA; PYQAFVLMAAWLAM; YQAFVLMAAWLAMR;<br>QAFVLMAAWLAMRY; AFVLMAAWLAMRYG; FVLMAAWLAMRYGE;<br>VLMAAWLAMRYGEL; LMAAWLAMRYGELT; MAAWLAMRYGELTE;<br>AAWLAMRYGELTEL; AWLAMRYGELTELR; WLAMRYGELTELRR;<br>LAMRYGELTELRRK; AMRYGELTELRRKD; MRYGELTELRRKDI;<br>RYGELTELRRKDID; YGELTELRRKDIDL; GELTELRRKDIDLH;<br>ELTELRRKDIDLHG; LTELRRKDIDLHGE; TELRRKDIDLHGEV;<br>ELRRKDIDLHGEVA; LRRKDIDLHGEVAR; RRKDIDLHGEVARV;<br>RKDIDLHGEVARVR; KDIDLHGEVARVRR; DIDLHGEVARVRRA;<br>IDLHGEVARVRRAV; DLHGEVARVRRAVV; LHGEVARVRRAVVR;<br>HGEVARVRRAVVRV; GEVARVRRAVVRVG; EVARVRRAVVRVGE;<br>VARVRRAVVRVGEG; ARVRRAVVRVGEGF; RVRRAVVRVGEGFK;<br>VRRAVVRVGEGFKV; RRAVVRVGEGFKVT; RAVVRVGEGFKVTT;<br>AVVRVGEGFKVTTP; VVRVGEGFKVTTPK; VRVGEGFKVTTPKS;<br>RVGEGFKVTTPKSD; VGEGFKVTTPKSDA; GEGFKVTTPKSDAG;<br>EGFKVTTPKSDAGV; GFKVTTPKSDAGVR; FKVTTPKSDAGVRD;<br>KVTTPKSDAGVRDI; VTTPKSDAGVRDIS; TTPKSDAGVRDISI;<br>TPKSDAGVRDISIP; PKSDAGVRDISIPP; KSDAGVRDISIPPH; SDAGVRDISIPPHL;<br>DAGVRDISIPPHLI; AGVRDISIPPHLIP; GVRDISIPPHLIPA; VRDISIPPHLIPAI;<br>RDISIPPHLIPAIE; DISIPPHLIPAIED; ISIPPHLIPAIEDH; SIPPHLIPAIEDHL;<br>IPPHLIPAIEDHLH; PPHLIPAIEDHLHK; PHLIPAIEDHLHKH; HLIPAIEDHLHKHV;<br>LIPAIEDHLHKHVN; IPAIEDHLHKHVNP; PAIEDHLHKHVNPG;<br>AIEDHLHKHVNPGR; IEDHLHKHVNPGRE; EDHLHKHVNPGRES;<br>DHLHKHVNPGRESL; HLHKHVNPGRESLL; LHKHVNPGRESLLF;<br>HKHVNPGRESLLFP; KHVNPGRESLLFPS; HVNPGRESLLFPSV;<br>VNPGRESLLFPSVN; NPGRESLLFPSVND; PGRESLLFPSVNDP;<br>GRESLLFPSVNDPN; RESLLFPSVNDPNR; ESLLFPSVNDPNRH;<br>SLLFPSVNDPNRHL; LLFPSVNDPNRHLA; LFPSVNDPNRHLAP;<br>FPSVNDPNRHLAPS; PSVNDPNRHLAPSA; SVNDPNRHLAPSAL;<br>VNDPNRHLAPSALY; NDPNRHLAPSALYR; DPNRHLAPSALYRM;<br>PNRHLAPSALYRMF; NRHLAPSALYRMFY; RHLAPSALYRMFYK;<br>HLAPSALYRMFYKA; LAPSALYRMFYKAR; APSALYRMFYKARK;<br>PSALYRMFYKARKA; SALYRMFYKARKAA; ALYRMFYKARKAAG;<br>LYRMFYKARKAAGR; YRMFYKARKAAGRP; RMFYKARKAAGRPD;<br>MFYKARKAAGRPDL; FYKARKAAGRPDLR; YKARKAAGRPDLRV;<br>KARKAAGRPDLRVH; ARKAAGRPDLRVHD; RKAAGRPDLRVHDL;<br>KAAGRPDLRVHDLR; AAGRPDLRVHDLRH; AGRPDLRVHDLRHS;<br>GRPDLRVHDLRHSG; RPDLRVHDLRHSGA; PDLRVHDLRHSGAV;<br>DLRVHDLRHSGAVL; LRVHDLRHSGAVLA; RVHDLRHSGAVLAA;<br>VHDLRHSGAVLAAS; HDLRHSGAVLAAST; DLRHSGAVLAASTG;<br>LRHSGAVLAASTGA; RHSGAVLAASTGAT; HSGAVLAASTGATL;<br>SGAVLAASTGATLA; GAVLAASTGATLAE; AVLAASTGATLAEL;<br>VLAASTGATLAELM; LAASTGATLAELMQ; AASTGATLAELMQR;<br>ASTGATLAELMQRL; STGATLAELMQRLG; TGATLAELMQRLGH;<br>GATLAELMQRLGHS; ATLAELMQRLGHST; TLAELMQRLGHSTA;<br>LAELMQRLGHSTAG; AELMQRLGHSTAGA; ELMQRLGHSTAGAA;<br>LMQRLGHSTAGAAL; MQRLGHSTAGAALR; QRLGHSTAGAALRY;<br>RLGHSTAGAALRYQ; LGHSTAGAALRYQH; GHSTAGAALRYQHA;<br>HSTAGAALRYQHAA; STAGAALRYQHAAK; TAGAALRYQHAAKG;<br>AGAALRYQHAAKGR; GAALRYQHAAKGRD; AALRYQHAAKGRDR;<br>ALRYQHAAKGRDRE; LRYQHAAKGRDREI; RYQHAAKGRDREIA;<br>YQHAAKGRDREIAA; QHAAKGRDREIAAL; HAAKGRDREIAALL;<br>AAKGRDREIAALLS; AKGRDREIAALLSK; KGRDREIAALLSKL; | |

Fig. 29 continued

| | | |
|---|---|---|
| | GRDREIAALLSKLA; RDREIAALLSKLAE; DREIAALLSKLAEN; REIAALLSKLAENQ; EIAALLSKLAENQE; IAALLSKLAENQEM<br><br>15 mers:<br>MTQTGKRQRRKFGRI; TQTGKRQRRKFGRIR; QTGKRQRRKFGRIRQ; TGKRQRRKFGRIRQF; GKRQRRKFGRIRQFN; KRQRRKFGRIRQFNS; RQRRKFGRIRQFNSG; QRRKFGRIRQFNSGR; RRKFGRIRQFNSGRW; RKFGRIRQFNSGRWQ; KFGRIRQFNSGRWQA; FGRIRQFNSGRWQAS; GRIRQFNSGRWQASY; RIRQFNSGRWQASYT; IRQFNSGRWQASYTG; RQFNSGRWQASYTGP; QFNSGRWQASYTGPD; FNSGRWQASYTGPDG; NSGRWQASYTGPDGR; SGRWQASYTGPDGRV; GRWQASYTGPDGRVY; RWQASYTGPDGRVYI; WQASYTGPDGRVYIA; QASYTGPDGRVYIAP; ASYTGPDGRVYIAPK; SYTGPDGRVYIAPKT; YTGPDGRVYIAPKTF; TGPDGRVYIAPKTFN; GPDGRVYIAPKTFNA; PDGRVYIAPKTFNAK; DGRVYIAPKTFNAKI; GRVYIAPKTFNAKID; RVYIAPKTFNAKIDA; VYIAPKTFNAKIDAE; YIAPKTFNAKIDAEA; IAPKTFNAKIDAEAW; APKTFNAKIDAEAWL; PKTFNAKIDAEAWLT; KTFNAKIDAEAWLTD; TFNAKIDAEAWLTDR; FNAKIDAEAWLTDRR; NAKIDAEAWLTDRRR; AKIDAEAWLTDRRRE; KIDAEAWLTDRRREI; IDAEAWLTDRRREID; DAEAWLTDRRREIDR; AEAWLTDRRREIDRQ; EAWLTDRRREIDRQL; AWLTDRRREIDRQLW; WLTDRRREIDRQLWS; LTDRRREIDRQLWSP; TDRRREIDRQLWSPA; DRRREIDRQLWSPAS; RRREIDRQLWSPASG; RREIDRQLWSPASGQ; REIDRQLWSPASGQE; EIDRQLWSPASGQED; IDRQLWSPASGQEDR; DRQLWSPASGQEDRP; RQLWSPASGQEDRPG; QLWSPASGQEDRPGA; LWSPASGQEDRPGAP; WSPASGQEDRPGAPF; SPASGQEDRPGAPFG; PASGQEDRPGAPFGE; ASGQEDRPGAPFGEY; SGQEDRPGAPFGEYA; GQEDRPGAPFGEYAE; QEDRPGAPFGEYAEG; EDRPGAPFGEYAEGW; DRPGAPFGEYAEGWL; RPGAPFGEYAEGWLK; PGAPFGEYAEGWLKQ; GAPFGEYAEGWLKQR; APFGEYAEGWLKQRG; PFGEYAEGWLKQRGI; FGEYAEGWLKQRGIK; GEYAEGWLKQRGIKD; EYAEGWLKQRGIKDR; YAEGWLKQRGIKDRT; AEGWLKQRGIKDRTR; EGWLKQRGIKDRTRA; GWLKQRGIKDRTRAH; WLKQRGIKDRTRAHY; LKQRGIKDRTRAHYR; KQRGIKDRTRAHYRK; QRGIKDRTRAHYRKL; RGIKDRTRAHYRKLL; GIKDRTRAHYRKLLD; IKDRTRAHYRKLLDN; KDRTRAHYRKLLDNH; DRTRAHYRKLLDNHI; RTRAHYRKLLDNHIL; TRAHYRKLLDNHILA; RAHYRKLLDNHILAT; AHYRKLLDNHILATF; HYRKLLDNHILATFA; YRKLLDNHILATFAD; RKLLDNHILATFADT; KLLDNHILATFADTD; LLDNHILATFADTDL; LDNHILATFADTDLR; DNHILATFADTDLRD; NHILATFADTDLRDI; HILATFADTDLRDIT; ILATFADTDLRDITP; LATFADTDLRDITPA; ATFADTDLRDITPAA; TFADTDLRDITPAAV; FADTDLRDITPAAVR; ADTDLRDITPAAVRR; DTDLRDITPAAVRRW; TDLRDITPAAVRRWY; DLRDITPAAVRRWYA; LRDITPAAVRRWYAT; RDITPAAVRRWYATT; DITPAAVRRWYATTA; ITPAAVRRWYATTAV; TPAAVRRWYATTAVG; PAAVRRWYATTAVGT; AAVRRWYATTAVGTP; AVRRWYATTAVGTPT; VRRWYATTAVGTPTM; RRWYATTAVGTPTMR; RWYATTAVGTPTMRA; WYATTAVGTPTMRAH; YATTAVGTPTMRAHS; ATTAVGTPTMRAHSY; TTAVGTPTMRAHSYS; TAVGTPTMRAHSYSL; AVGTPTMRAHSYSLL; VGTPTMRAHSYSLLR; GTPTMRAHSYSLLRA; TPTMRAHSYSLLRAI; PTMRAHSYSLLRAIM; TMRAHSYSLLRAIMQ; MRAHSYSLLRAIMQT; RAHSYSLLRAIMQTA; AHSYSLLRAIMQTAL; HSYSLLRAIMQTALA; SYSLLRAIMQTALAD; YSLLRAIMQTALADD; SLLRAIMQTALADDL; LLRAIMQTALADDLI; LRAIMQTALADDLID; RAIMQTALADDLIDS; AIMQTALADDLIDSN; | |

Fig. 29 continued

| | | |
|---|---|---|
| | IMQTALADDLIDSNP; MQTALADDLIDSNPC; QTALADDLIDSNPCR; | |
| | TALADDLIDSNPCRI; ALADDLIDSNPCRIS; LADDLIDSNPCRISG; | |
| | ADDLIDSNPCRISGA; DDLIDSNPCRISGAS; DLIDSNPCRISGAST; | |
| | LIDSNPCRISGASTA; IDSNPCRISGASTAR; DSNPCRISGASTARR; | |
| | SNPCRISGASTARRV; NPCRISGASTARRVH; PCRISGASTARRVHK; | |
| | CRISGASTARRVHKI; RISGASTARRVHKIR; ISGASTARRVHKIRP; | |
| | SGASTARRVHKIRPA; GASTARRVHKIRPAT; ASTARRVHKIRPATL; | |
| | STARRVHKIRPATLD; TARRVHKIRPATLDE; ARRVHKIRPATLDEL; | |
| | RRVHKIRPATLDELE; RVHKIRPATLDELET; VHKIRPATLDELETI; | |
| | HKIRPATLDELETIT; KIRPATLDELETITK; IRPATLDELETITKA; | |
| | RPATLDELETITKAM; PATLDELETITKAMP; ATLDELETITKAMPD; | |
| | TLDELETITKAMPDP; LDELETITKAMPDPY; DELETITKAMPDPYQ; | |
| | ELETITKAMPDPYQA; LETITKAMPDPYQAF; ETITKAMPDPYQAFV; | |
| | TITKAMPDPYQAFVL; ITKAMPDPYQAFVLM; TKAMPDPYQAFVLMA; | |
| | KAMPDPYQAFVLMAA; AMPDPYQAFVLMAAW; MPDPYQAFVLMAAWL; | |
| | PDPYQAFVLMAAWLA; DPYQAFVLMAAWLAM; PYQAFVLMAAWLAMR; | |
| | YQAFVLMAAWLAMRY; QAFVLMAAWLAMRYG; AFVLMAAWLAMRYGE; | |
| | FVLMAAWLAMRYGEL; VLMAAWLAMRYGELT; LMAAWLAMRYGELTE; | |
| | MAAWLAMRYGELTEL; AAWLAMRYGELTELR; AWLAMRYGELTELRR; | |
| | WLAMRYGELTELRRK; LAMRYGELTELRRKD; AMRYGELTELRRKDI; | |
| | MRYGELTELRRKDID; RYGELTELRRKDIDL; YGELTELRRKDIDLH; | |
| | GELTELRRKDIDLHG; ELTELRRKDIDLHGE; LTELRRKDIDLHGEV; | |
| | TELRRKDIDLHGEVA; ELRRKDIDLHGEVAR; LRRKDIDLHGEVARV; | |
| | RRKDIDLHGEVARVR; RKDIDLHGEVARVRR; KDIDLHGEVARVRRA; | |
| | DIDLHGEVARVRRAV; IDLHGEVARVRRAVV; DLHGEVARVRRAVVR; | |
| | LHGEVARVRRAVVRV; HGEVARVRRAVVRVG; GEVARVRRAVVRVGE; | |
| | EVARVRRAVVRVGEG; VARVRRAVVRVGEGF; ARVRRAVVRVGEGFK; | |
| | RVRRAVVRVGEGFKV; VRRAVVRVGEGFKVT; RRAVVRVGEGFKVTT; | |
| | RAVVRVGEGFKVTTP; AVVRVGEGFKVTTPK; VVRVGEGFKVTTPKS; | |
| | VRVGEGFKVTTPKSD; RVGEGFKVTTPKSDA; VGEGFKVTTPKSDAG; | |
| | GEGFKVTTPKSDAGV; EGFKVTTPKSDAGVR; GFKVTTPKSDAGVRD; | |
| | FKVTTPKSDAGVRDI; KVTTPKSDAGVRDIS; VTTPKSDAGVRDISI; | |
| | TTPKSDAGVRDISIP; TPKSDAGVRDISIPP; PKSDAGVRDISIPPH; | |
| | KSDAGVRDISIPPHL; SDAGVRDISIPPHLI; DAGVRDISIPPHLIP; | |
| | AGVRDISIPPHLIPA; GVRDISIPPHLIPAI; VRDISIPPHLIPAIE; RDISIPPHLIPAIED; | |
| | DISIPPHLIPAIEDH; ISIPPHLIPAIEDHL; SIPPHLIPAIEDHLH; IPPHLIPAIEDHLHK; | |
| | PPHLIPAIEDHLHKH; PHLIPAIEDHLHKHV; HLIPAIEDHLHKHVN; | |
| | LIPAIEDHLHKHVNP; IPAIEDHLHKHVNPG; PAIEDHLHKHVNPGR; | |
| | AIEDHLHKHVNPGRE; IEDHLHKHVNPGRES; EDHLHKHVNPGRESL; | |
| | DHLHKHVNPGRESLL; HLHKHVNPGRESLLF; LHKHVNPGRESLLFP; | |
| | HKHVNPGRESLLFPS; KHVNPGRESLLFPSV; HVNPGRESLLFPSVN; | |
| | VNPGRESLLFPSVND; NPGRESLLFPSVNDP; PGRESLLFPSVNDPN; | |
| | GRESLLFPSVNDPNR; RESLLFPSVNDPNRH; ESLLFPSVNDPNRHL; | |
| | SLLFPSVNDPNRHLA; LLFPSVNDPNRHLAP; LFPSVNDPNRHLAPS; | |
| | FPSVNDPNRHLAPSA; PSVNDPNRHLAPSAL; SVNDPNRHLAPSALY; | |
| | VNDPNRHLAPSALYR; NDPNRHLAPSALYRM; DPNRHLAPSALYRMF; | |
| | PNRHLAPSALYRMFY; NRHLAPSALYRMFYK; RHLAPSALYRMFYKA; | |
| | HLAPSALYRMFYKAR; LAPSALYRMFYKARK; APSALYRMFYKARKA; | |
| | PSALYRMFYKARKAA; SALYRMFYKARKAAG; ALYRMFYKARKAAGR; | |
| | LYRMFYKARKAAGRP; YRMFYKARKAAGRPD; RMFYKARKAAGRPDL; | |
| | MFYKARKAAGRPDLR; FYKARKAAGRPDLRV; YKARKAAGRPDLRVH; | |
| | KARKAAGRPDLRVHD; ARKAAGRPDLRVHDL; RKAAGRPDLRVHDLR; | |
| | KAAGRPDLRVHDLRH; AAGRPDLRVHDLRHS; AGRPDLRVHDLRHSG; | |

Fig. 29 continued

| | | | |
|---|---|---|---|
| | GRPDLRVHDLRHSGA; RPDLRVHDLRHSGAV; PDLRVHDLRHSGAVL; DLRVHDLRHSGAVLA; LRVHDLRHSGAVLAA; RVHDLRHSGAVLAAS; VHDLRHSGAVLAAST; HDLRHSGAVLAASTG; DLRHSGAVLAASTGA; LRHSGAVLAASTGAT; RHSGAVLAASTGATL; HSGAVLAASTGATLA; SGAVLAASTGATLAE; GAVLAASTGATLAEL; AVLAASTGATLAELM; VLAASTGATLAELMQ; LAASTGATLAELMQR; AASTGATLAELMQRL; ASTGATLAELMQRLG; STGATLAELMQRLGH; TGATLAELMQRLGHS; GATLAELMQRLGHST; ATLAELMQRLGHSTA; TLAELMQRLGHSTAG; LAELMQRLGHSTAGA; AELMQRLGHSTAGAA; ELMQRLGHSTAGAAL; LMQRLGHSTAGAALR; MQRLGHSTAGAALRY; QRLGHSTAGAALRYQ; RLGHSTAGAALRYQH; LGHSTAGAALRYQHA; GHSTAGAALRYQHAA; HSTAGAALRYQHAAK; STAGAALRYQHAAKG; TAGAALRYQHAAKGR; AGAALRYQHAAKGRD; GAALRYQHAAKGRDR; AALRYQHAAKGRDRE; ALRYQHAAKGRDREI; LRYQHAAKGRDREIA; RYQHAAKGRDREIAA; YQHAAKGRDREIAAL; QHAAKGRDREIAALL; HAAKGRDREIAALLS; AAKGRDREIAALLSK; AKGRDREIAALLSKL; KGRDREIAALLSKLA; GRDREIAALLSKLAE; RDREIAALLSKLAEN; DREIAALLSKLAENQ; REIAALLSKLAENQE; EIAALLSKLAENQEM<br><br>16 mers:<br>MTQTGKRQRRKFGRIR; TQTGKRQRRKFGRIRQ; QTGKRQRRKFGRIRQF; TGKRQRRKFGRIRQFN; GKRQRRKFGRIRQFNS; KRQRRKFGRIRQFNSG; RQRRKFGRIRQFNSGR; QRRKFGRIRQFNSGRW; RRKFGRIRQFNSGRWQ; RKFGRIRQFNSGRWQA; KFGRIRQFNSGRWQAS; FGRIRQFNSGRWQASY; GRIRQFNSGRWQASYT; RIRQFNSGRWQASYTG; IRQFNSGRWQASYTGP; RQFNSGRWQASYTGPD; QFNSGRWQASYTGPDG; FNSGRWQASYTGPDGR; NSGRWQASYTGPDGRV; SGRWQASYTGPDGRVY; GRWQASYTGPDGRVYI; RWQASYTGPDGRVYIA; WQASYTGPDGRVYIAP; QASYTGPDGRVYIAPK; ASYTGPDGRVYIAPKT; SYTGPDGRVYIAPKTF; YTGPDGRVYIAPKTFN; TGPDGRVYIAPKTFNA; GPDGRVYIAPKTFNAK; PDGRVYIAPKTFNAKI; DGRVYIAPKTFNAKID; GRVYIAPKTFNAKIDA; RVYIAPKTFNAKIDAE; VYIAPKTFNAKIDAEA; YIAPKTFNAKIDAEAW; IAPKTFNAKIDAEAWL; APKTFNAKIDAEAWLT; PKTFNAKIDAEAWLTD; KTFNAKIDAEAWLTDR; TFNAKIDAEAWLTDRR; FNAKIDAEAWLTDRRR; NAKIDAEAWLTDRRRE; AKIDAEAWLTDRRREI; KIDAEAWLTDRRREID; IDAEAWLTDRRREIDR; DAEAWLTDRRREIDRQ; AEAWLTDRRREIDRQL; EAWLTDRRREIDRQLW; AWLTDRRREIDRQLWS; WLTDRRREIDRQLWSP; LTDRRREIDRQLWSPA; TDRRREIDRQLWSPAS; DRRREIDRQLWSPASG; RRREIDRQLWSPASGQ; RREIDRQLWSPASGQE; REIDRQLWSPASGQED; EIDRQLWSPASGQEDR; IDRQLWSPASGQEDRP; DRQLWSPASGQEDRPG; RQLWSPASGQEDRPGA; QLWSPASGQEDRPGAP; LWSPASGQEDRPGAPF; WSPASGQEDRPGAPFG; SPASGQEDRPGAPFGE; PASGQEDRPGAPFGEY; ASGQEDRPGAPFGEYA; SGQEDRPGAPFGEYAE; GQEDRPGAPFGEYAEG; QEDRPGAPFGEYAEGW; EDRPGAPFGEYAEGWL; DRPGAPFGEYAEGWLK; RPGAPFGEYAEGWLKQ; PGAPFGEYAEGWLKQR; GAPFGEYAEGWLKQRG; APFGEYAEGWLKQRGI; PFGEYAEGWLKQRGIK; FGEYAEGWLKQRGIKD; GEYAEGWLKQRGIKDR; EYAEGWLKQRGIKDRT; YAEGWLKQRGIKDRTR; AEGWLKQRGIKDRTRA; EGWLKQRGIKDRTRAH; GWLKQRGIKDRTRAHY; WLKQRGIKDRTRAHYR; LKQRGIKDRTRAHYRK; KQRGIKDRTRAHYRKL; QRGIKDRTRAHYRKLL; RGIKDRTRAHYRKLLD; GIKDRTRAHYRKLLDN; IKDRTRAHYRKLLDNH; KDRTRAHYRKLLDNHI; DRTRAHYRKLLDNHIL; RTRAHYRKLLDNHILA; TRAHYRKLLDNHILAT; RAHYRKLLDNHILATF; AHYRKLLDNHILATFA; HYRKLLDNHILATFAD; YRKLLDNHILATFADT; RKLLDNHILATFADTD; | | |

Fig. 29 continued

| | | |
|---|---|---|
| | KLLDNHILATFADTDL; LLDNHILATFADTDLR; LDNHILATFADTDLRD; DNHILATFADTDLRDI; NHILATFADTDLRDIT; HILATFADTDLRDITP; ILATFADTDLRDITPA; LATFADTDLRDITPAA; ATFADTDLRDITPAAV; TFADTDLRDITPAAVR; FADTDLRDITPAAVRR; ADTDLRDITPAAVRRW; DTDLRDITPAAVRRWY; TDLRDITPAAVRRWYA; DLRDITPAAVRRWYAT; LRDITPAAVRRWYATT; RDITPAAVRRWYATTA; DITPAAVRRWYATTAV; ITPAAVRRWYATTAVG; TPAAVRRWYATTAVGT; PAAVRRWYATTAVGTP; AAVRRWYATTAVGTPT; AVRRWYATTAVGTPTM; VRRWYATTAVGTPTMR; RRWYATTAVGTPTMRA; RWYATTAVGTPTMRAH; WYATTAVGTPTMRAHS; YATTAVGTPTMRAHSY; ATTAVGTPTMRAHSYS; TTAVGTPTMRAHSYSL; TAVGTPTMRAHSYSLL; AVGTPTMRAHSYSLLR; VGTPTMRAHSYSLLRA; GTPTMRAHSYSLLRAI; TPTMRAHSYSLLRAIM; PTMRAHSYSLLRAIMQ; TMRAHSYSLLRAIMQT; MRAHSYSLLRAIMQTA; RAHSYSLLRAIMQTAL; AHSYSLLRAIMQTALA; HSYSLLRAIMQTALAD; SYSLLRAIMQTALADD; YSLLRAIMQTALADDL; SLLRAIMQTALADDLI; LLRAIMQTALADDLID; LRAIMQTALADDLIDS; RAIMQTALADDLIDSN; AIMQTALADDLIDSNP; IMQTALADDLIDSNPC; MQTALADDLIDSNPCR; QTALADDLIDSNPCRI; TALADDLIDSNPCRIS; ALADDLIDSNPCRISG; LADDLIDSNPCRISGA; ADDLIDSNPCRISGAS; DDLIDSNPCRISGAST; DLIDSNPCRISGASTA; LIDSNPCRISGASTAR; IDSNPCRISGASTARR; DSNPCRISGASTARRV; SNPCRISGASTARRVH; NPCRISGASTARRVHK; PCRISGASTARRVHKI; CRISGASTARRVHKIR; RISGASTARRVHKIRP; ISGASTARRVHKIRPA; SGASTARRVHKIRPAT; GASTARRVHKIRPATL; ASTARRVHKIRPATLD; STARRVHKIRPATLDE; TARRVHKIRPATLDEL; ARRVHKIRPATLDELE; RRVHKIRPATLDELET; RVHKIRPATLDELETI; VHKIRPATLDELETIT; HKIRPATLDELETITK; KIRPATLDELETITKA; IRPATLDELETITKAM; RPATLDELETITKAMP; PATLDELETITKAMPD; ATLDELETITKAMPDP; TLDELETITKAMPDPY; LDELETITKAMPDPYQ; DELETITKAMPDPYQA; ELETITKAMPDPYQAF; LETITKAMPDPYQAFV; ETITKAMPDPYQAFVL; TITKAMPDPYQAFVLM; ITKAMPDPYQAFVLMA; TKAMPDPYQAFVLMAA; KAMPDPYQAFVLMAAW; AMPDPYQAFVLMAAWL; MPDPYQAFVLMAAWLA; PDPYQAFVLMAAWLAM; DPYQAFVLMAAWLAMR; PYQAFVLMAAWLAMRY; YQAFVLMAAWLAMRYG; QAFVLMAAWLAMRYGE; AFVLMAAWLAMRYGEL; FVLMAAWLAMRYGELT; VLMAAWLAMRYGELTE; LMAAWLAMRYGELTEL; MAAWLAMRYGELTELR; AAWLAMRYGELTELRR; AWLAMRYGELTELRRK; WLAMRYGELTELRRKD; LAMRYGELTELRRKDI; AMRYGELTELRRKDID; MRYGELTELRRKDIDL; RYGELTELRRKDIDLH; YGELTELRRKDIDLHG; GELTELRRKDIDLHGE; ELTELRRKDIDLHGEV; LTELRRKDIDLHGEVA; TELRRKDIDLHGEVAR; ELRRKDIDLHGEVARV; LRRKDIDLHGEVARVR; RRKDIDLHGEVARVRR; RKDIDLHGEVARVRRA; KDIDLHGEVARVRRAV; DIDLHGEVARVRRAVV; IDLHGEVARVRRAVVR; DLHGEVARVRRAVVRV; LHGEVARVRRAVVRVG; HGEVARVRRAVVRVGE; GEVARVRRAVVRVGEG; EVARVRRAVVRVGEGF; VARVRRAVVRVGEGFK; ARVRRAVVRVGEGFKV; RVRRAVVRVGEGFKVT; VRRAVVRVGEGFKVTT; RRAVVRVGEGFKVTTP; RAVVRVGEGFKVTTPK; AVVRVGEGFKVTTPKS; VVRVGEGFKVTTPKSD; VRVGEGFKVTTPKSDA; RVGEGFKVTTPKSDAG; VGEGFKVTTPKSDAGV; GEGFKVTTPKSDAGVR; EGFKVTTPKSDAGVRD; GFKVTTPKSDAGVRDI; FKVTTPKSDAGVRDIS; KVTTPKSDAGVRDISI; VTTPKSDAGVRDISIP; TTPKSDAGVRDISIPP; TPKSDAGVRDISIPPH; PKSDAGVRDISIPPHL; KSDAGVRDISIPPHLI; SDAGVRDISIPPHLIP; DAGVRDISIPPHLIPA; AGVRDISIPPHLIPAI; GVRDISIPPHLIPAIE; VRDISIPPHLIPAIED; RDISIPPHLIPAIEDH; DISIPPHLIPAIEDHL; ISIPPHLIPAIEDHLH; SIPPHLIPAIEDHLHK; IPPHLIPAIEDHLHKH; PPHLIPAIEDHLHKHV; | |

Fig. 29 continued

| | | |
|---|---|---|
| | PHLIPAIEDHLHKHVN; HLIPAIEDHLHKHVNP; LIPAIEDHLHKHVNPG; IPAIEDHLHKHVNPGR; PAIEDHLHKHVNPGRE; AIEDHLHKHVNPGRES; IEDHLHKHVNPGRESL; EDHLHKHVNPGRESLL; DHLHKHVNPGRESLLF; HLHKHVNPGRESLLFP; LHKHVNPGRESLLFPS; HKHVNPGRESLLFPSV; KHVNPGRESLLFPSVN; HVNPGRESLLFPSVND; VNPGRESLLFPSVNDP; NPGRESLLFPSVNDPN; PGRESLLFPSVNDPNR; GRESLLFPSVNDPNRH; RESLLFPSVNDPNRHL; ESLLFPSVNDPNRHLA; SLLFPSVNDPNRHLAP; LLFPSVNDPNRHLAPS; LFPSVNDPNRHLAPSA; FPSVNDPNRHLAPSAL; PSVNDPNRHLAPSALY; SVNDPNRHLAPSALYR; VNDPNRHLAPSALYRM; NDPNRHLAPSALYRMF; DPNRHLAPSALYRMFY; PNRHLAPSALYRMFYK; NRHLAPSALYRMFYKA; RHLAPSALYRMFYKAR; HLAPSALYRMFYKARK; LAPSALYRMFYKARKA; APSALYRMFYKARKAA; PSALYRMFYKARKAAG; SALYRMFYKARKAAGR; ALYRMFYKARKAAGRP; LYRMFYKARKAAGRPD; YRMFYKARKAAGRPDL; RMFYKARKAAGRPDLR; MFYKARKAAGRPDLRV; FYKARKAAGRPDLRVH; YKARKAAGRPDLRVHD; KARKAAGRPDLRVHDL; ARKAAGRPDLRVHDLR; RKAAGRPDLRVHDLRH; KAAGRPDLRVHDLRHS; AAGRPDLRVHDLRHSG; AGRPDLRVHDLRHSGA; GRPDLRVHDLRHSGAV; RPDLRVHDLRHSGAVL; PDLRVHDLRHSGAVLA; DLRVHDLRHSGAVLAA; LRVHDLRHSGAVLAAS; RVHDLRHSGAVLAAST; VHDLRHSGAVLAASTG; HDLRHSGAVLAASTGA; DLRHSGAVLAASTGAT; LRHSGAVLAASTGATL; RHSGAVLAASTGATLA; HSGAVLAASTGATLAE; SGAVLAASTGATLAEL; GAVLAASTGATLAELM; AVLAASTGATLAELMQ; VLAASTGATLAELMQR; LAASTGATLAELMQRL; AASTGATLAELMQRLG; ASTGATLAELMQRLGH; STGATLAELMQRLGHS; TGATLAELMQRLGHST; GATLAELMQRLGHSTA; ATLAELMQRLGHSTAG; TLAELMQRLGHSTAGA; LAELMQRLGHSTAGAA; AELMQRLGHSTAGAAL; ELMQRLGHSTAGAALR; LMQRLGHSTAGAALRY; MQRLGHSTAGAALRYQ; QRLGHSTAGAALRYQH; RLGHSTAGAALRYQHA; LGHSTAGAALRYQHAA; GHSTAGAALRYQHAAK; HSTAGAALRYQHAAKG; STAGAALRYQHAAKGR; TAGAALRYQHAAKGRD; AGAALRYQHAAKGRDR; GAALRYQHAAKGRDRE; AALRYQHAAKGRDREI; ALRYQHAAKGRDREIA; LRYQHAAKGRDREIAA; RYQHAAKGRDREIAAL; YQHAAKGRDREIAALL; QHAAKGRDREIAALLS; HAAKGRDREIAALLSK; AAKGRDREIAALLSKL; AKGRDREIAALLSKLA; KGRDREIAALLSKLAE; GRDREIAALLSKLAEN; RDREIAALLSKLAENQ; DREIAALLSKLAENQE; REIAALLSKLAENQEM | |
| 51) Rv2660c | 13 mers: MIAGVDQALAATG; IAGVDQALAATGQ; AGVDQALAATGQA; GVDQALAATGQAS; VDQALAATGQASQ; DQALAATGQASQR; QALAATGQASQRA; ALAATGQASQRAA; LAATGQASQRAAG; AATGQASQRAAGA; ATGQASQRAAGAS; TGQASQRAAGASG; GQASQRAAGASGG; QASQRAAGASGGV; ASQRAAGASGGVT; SQRAAGASGGVTV; QRAAGASGGVTVG; RAAGASGGVTVGV; AAGASGGVTVGVG; AGASGGVTVGVGV; GASGGVTVGVGVG; ASGGVTVGVGVGT; SGGVTVGVGVGTE; GGVTVGVGVGTEQ; GVTVGVGVGTEQR; VTVGVGVGTEQRN; TVGVGVGTEQRNL; VGVGVGTEQRNLS; GVGVGTEQRNLSV; VGVGTEQRNLSVV; GVGTEQRNLSVVA; VGTEQRNLSVVAP; GTEQRNLSVVAPS; TEQRNLSVVAPSQ; EQRNLSVVAPSQF; QRNLSVVAPSQFT; RNLSVVAPSQFTF; NLSVVAPSQFTFS; LSVVAPSQFTFSS; SVVAPSQFTFSSR; VVAPSQFTFSSRS; VAPSQFTFSSRSP; APSQFTFSSRSPD; PSQFTFSSRSPDF; SQFTFSSRSPDFV; QFTFSSRSPDFVD; FTFSSRSPDFVDE; TFSSRSPDFVDET; FSSRSPDFVDETA; SSRSPDFVDETAG; SRSPDFVDETAGQ; RSPDFVDETAGQS; SPDFVDETAGQSW; PDFVDETAGQSWC; DFVDETAGQSWCA; FVDETAGQSWCAI; VDETAGQSWCAIL; DETAGQSWCAILG; ETAGQSWCAILGL; TAGQSWCAILGLN; AGQSWCAILGLNQ; | 97356-97601 |

Fig. 29 continued

GQSWCAILGLNQF; QSWCAILGLNQFH 14 mers:
MIAGVDQALAATGQ; IAGVDQALAATGQA; AGVDQALAATGQAS; GVDQALAATGQASQ; VDQALAATGQASQR; DQALAATGQASQRA; QALAATGQASQRAA; ALAATGQASQRAAG; LAATGQASQRAAGA; AATGQASQRAAGAS; ATGQASQRAAGASG; TGQASQRAAGASGG; GQASQRAAGASGGV; QASQRAAGASGGVT; ASQRAAGASGGVTV; SQRAAGASGGVTVG; QRAAGASGGVTVGV; RAAGASGGVTVGVG; AAGASGGVTVGVGV; AGASGGVTVGVGVG; GASGGVTVGVGVGT; ASGGVTVGVGVGTE; SGGVTVGVGVGTEQ; GGVTVGVGVGTEQR; GVTVGVGVGTEQRN; VTVGVGVGTEQRNL; TVGVGVGTEQRNLS; VGVGVGTEQRNLSV; GVGVGTEQRNLSVV; VGVGTEQRNLSVVA; GVGTEQRNLSVVAP; VGTEQRNLSVVAPS; GTEQRNLSVVAPSQ; TEQRNLSVVAPSQF; EQRNLSVVAPSQFT; QRNLSVVAPSQFTF; RNLSVVAPSQFTFS; NLSVVAPSQFTFSS; LSVVAPSQFTFSSR; SVVAPSQFTFSSRS; VVAPSQFTFSSRSP; VAPSQFTFSSRSPD; APSQFTFSSRSPDF; PSQFTFSSRSPDFV; SQFTFSSRSPDFVD; QFTFSSRSPDFVDE; FTFSSRSPDFVDET; TFSSRSPDFVDETA; FSSRSPDFVDETAG; SSRSPDFVDETAGQ; SRSPDFVDETAGQS; RSPDFVDETAGQSW; SPDFVDETAGQSWC; PDFVDETAGQSWCA; DFVDETAGQSWCAI; FVDETAGQSWCAIL; VDETAGQSWCAILG; DETAGQSWCAILGL; ETAGQSWCAILGLN; TAGQSWCAILGLNQ; AGQSWCAILGLNQF; GQSWCAILGLNQFH 15 mers:
MIAGVDQALAATGQA; IAGVDQALAATGQAS; AGVDQALAATGQASQ; GVDQALAATGQASQR; VDQALAATGQASQRA; DQALAATGQASQRAA; QALAATGQASQRAAG; ALAATGQASQRAAGA; LAATGQASQRAAGAS; AATGQASQRAAGASG; ATGQASQRAAGASGG; TGQASQRAAGASGGV; GQASQRAAGASGGVT; QASQRAAGASGGVTV; ASQRAAGASGGVTVG; SQRAAGASGGVTVGV; QRAAGASGGVTVGVG; RAAGASGGVTVGVGV; AAGASGGVTVGVGVG; AGASGGVTVGVGVGT; GASGGVTVGVGVGTE; ASGGVTVGVGVGTEQ; SGGVTVGVGVGTEQR; GGVTVGVGVGTEQRN; GVTVGVGVGTEQRNL; VTVGVGVGTEQRNLS; TVGVGVGTEQRNLSV; VGVGVGTEQRNLSVV; GVGVGTEQRNLSVVA; VGVGTEQRNLSVVAP; GVGTEQRNLSVVAPS; VGTEQRNLSVVAPSQ; GTEQRNLSVVAPSQF; TEQRNLSVVAPSQFT; EQRNLSVVAPSQFTF; QRNLSVVAPSQFTFS; RNLSVVAPSQFTFSS; NLSVVAPSQFTFSSR; LSVVAPSQFTFSSRS; SVVAPSQFTFSSRSP; VVAPSQFTFSSRSPD; VAPSQFTFSSRSPDF; APSQFTFSSRSPDFV; PSQFTFSSRSPDFVD; SQFTFSSRSPDFVDE; QFTFSSRSPDFVDET; FTFSSRSPDFVDETA; TFSSRSPDFVDETAG; FSSRSPDFVDETAGQ; SSRSPDFVDETAGQS; SRSPDFVDETAGQSW; RSPDFVDETAGQSWC; SPDFVDETAGQSWCA; PDFVDETAGQSWCAI; DFVDETAGQSWCAIL; FVDETAGQSWCAILG; VDETAGQSWCAILGL; DETAGQSWCAILGLN; ETAGQSWCAILGLNQ; TAGQSWCAILGLNQF; AGQSWCAILGLNQFH 16 mers:
MIAGVDQALAATGQAS; IAGVDQALAATGQASQ; AGVDQALAATGQASQR; GVDQALAATGQASQRA; VDQALAATGQASQRAA; DQALAATGQASQRAAG; QALAATGQASQRAAGA; ALAATGQASQRAAGAS; LAATGQASQRAAGASG;

Fig. 29 continued

| | | |
|---|---|---|
| | AATGQASQRAAGASGG; ATGQASQRAAGASGGV; TGQASQRAAGASGGVT; GQASQRAAGASGGVTV; QASQRAAGASGGVTVG; ASQRAAGASGGVTVGV; SQRAAGASGGVTVGVG; QRAAGASGGVTVGVGV; RAAGASGGVTVGVGVG; AAGASGGVTVGVGVGT; AGASGGVTVGVGVGTE; GASGGVTVGVGVGTEQ; ASGGVTVGVGVGTEQR; SGGVTVGVGVGTEQRN; GGVTVGVGVGTEQRNL; GVTVGVGVGTEQRNLS; VTVGVGVGTEQRNLSV; TVGVGVGTEQRNLSVV; VGVGVGTEQRNLSVVA; GVGVGTEQRNLSVVAP; VGVGTEQRNLSVVAPS; GVGTEQRNLSVVAPSQ; VGTEQRNLSVVAPSQF; GTEQRNLSVVAPSQFT; TEQRNLSVVAPSQFTF; EQRNLSVVAPSQFTFS; QRNLSVVAPSQFTFSS; RNLSVVAPSQFTFSSR; NLSVVAPSQFTFSSRS; LSVVAPSQFTFSSRSP; SVVAPSQFTFSSRSPD; VVAPSQFTFSSRSPDF; VAPSQFTFSSRSPDFV; APSQFTFSSRSPDFVD; PSQFTFSSRSPDFVDE; SQFTFSSRSPDFVDET; QFTFSSRSPDFVDETA; FTFSSRSPDFVDETAG; TFSSRSPDFVDETAGQ; FSSRSPDFVDETAGQS; SSRSPDFVDETAGQSW; SRSPDFVDETAGQSWC; RSPDFVDETAGQSWCA; SPDFVDETAGQSWCAI; PDFVDETAGQSWCAIL; DFVDETAGQSWCAILG; FVDETAGQSWCAILGL; VDETAGQSWCAILGLN; DETAGQSWCAILGLNQ; ETAGQSWCAILGLNQF; TAGQSWCAILGLNQFH | |
| 52) Rv2661c | 13 mers:<br>MRARSDAGGQSVK; RARSDAGGQSVKS; ARSDAGGQSVKSR; RSDAGGQSVKSRT; SDAGGQSVKSRTS; DAGGQSVKSRTSN; AGGQSVKSRTSNR; GGQSVKSRTSNRS; GQSVKSRTSNRSR; QSVKSRTSNRSRS; SVKSRTSNRSRSS; VKSRTSNRSRSSR; KSRTSNRSRSSRR; SRTSNRSRSSRRS; RTSNRSRSSRRSR; TSNRSRSSRRSRV; SNRSRSSRRSRVR; NRSRSSRRSRVRS; RSRSSRRSRVRSS; SRSSRRSRVRSSI; RSSRRSRVRSSIS; SSRRSRVRSSISA; SRRSRVRSSISAL; RRSRVRSSISALV; RSRVRSSISALVD; SRVRSSISALVDN; RVRSSISALVDNP; VRSSISALVDNPQ; RSSISALVDNPQA; SSISALVDNPQAR; SISALVDNPQARP; ISALVDNPQARPR; SALVDNPQARPRE; ALVDNPQARPREL; LVDNPQARPRELP; VDNPQARPRELPV; DNPQARPRELPVL; NPQARPRELPVLC; PQARPRELPVLCG; QARPRELPVLCGW; ARPRELPVLCGWP; RPRELPVLCGWPV; PRELPVLCGWPVV; RELPVLCGWPVVR; ELPVLCGWPVVRV; LPVLCGWPVVRVE; PVLCGWPVVRVEP; VLCGWPVVRVEPV; LCGWPVVRVEPVC; CGWPVVRVEPVCE; GWPVVRVEPVCEF; WPVVRVEPVCEFV; PVVRVEPVCEFVP; VVRVEPVCEFVPE; VRVEPVCEFVPEP; RVEPVCEFVPEPV; VEPVCEFVPEPVC; EPVCEFVPEPVCG; PVCEFVPEPVCGQ; VCEFVPEPVCGQA; CEFVPEPVCGQAE; EFVPEPVCGQAEV; FVPEPVCGQAEVL; VPEPVCGQAEVLG; PEPVCGQAEVLGE; EPVCGQAEVLGEP; PVCGQAEVLGEPA; VCGQAEVLGEPAA; CGQAEVLGEPAAA; GQAEVLGEPAAAH; QAEVLGEPAAAHR; AEVLGEPAAAHRV; EVLGEPAAAHRVT; VLGEPAAAHRVTS; LGEPAAAHRVTSA; GEPAAAHRVTSAR; EPAAAHRVTSARR; PAAAHRVTSARRS; AAAHRVTSARRSP; AAHRVTSARRSPS; AHRVTSARRSPST; HRVTSARRSPSTT; RVTSARRSPSTTV; VTSARRSPSTTVC; TSARRSPSTTVCS; SARRSPSTTVCSR; ARRSPSTTVCSRS; RRSPSTTVCSRSQ; RSPSTTVCSRSQK; SPSTTVCSRSQKA; PSTTVCSRSQKAS; STTVCSRSQKASA; TTVCSRSQKASAV; TVCSRSQKASAVV; VCSRSQKASAVVI; CSRSQKASAVVIS; SRSQKASAVVISS; RSQKASAVVISSV; SQKASAVVISSVS; QKASAVVISSVSS; KASAVVISSVSSV; ASAVVISSVSSVA; SAVVISSVSSVAR; AVVISSVSSVARV; VVISSVSSVARVR; VISSVSSVARVRR; ISSVSSVARVRRA; SSVSSVARVRRAS; SVSSVARVRRASV; VSSVARVRRASVS; SSVARVRRASVSS; SVARVRRASVSSV; VARVRRASVSSVD; ARVRRASVSSVDA; RVRRASVSSVDAT; VRRASVSSVDATT; RRASVSSVDATTA<br><br>14 mers: | 97602-98063 |

Fig. 29 continued

| | | | |
|---|---|---|---|
| | MRARSDAGGQSVKS; RARSDAGGQSVKSR; ARSDAGGQSVKSRT; RSDAGGQSVKSRTS; SDAGGQSVKSRTSN; DAGGQSVKSRTSNR; AGGQSVKSRTSNRS; GGQSVKSRTSNRSR; GQSVKSRTSNRSRS; QSVKSRTSNRSRSS; SVKSRTSNRSRSSR; VKSRTSNRSRSSRR; KSRTSNRSRSSRRS; SRTSNRSRSSRRSR; RTSNRSRSSRRSRV; TSNRSRSSRRSRVR; SNRSRSSRRSRVRS; NRSRSSRRSRVRSS; RSRSSRRSRVRSSI; SRSSRRSRVRSSIS; RSSRRSRVRSSISA; SSRRSRVRSSISAL; SRRSRVRSSISALV; RRSRVRSSISALVD; RSRVRSSISALVDN; SRVRSSISALVDNP; RVRSSISALVDNPQ; VRSSISALVDNPQA; RSSISALVDNPQAR; SSISALVDNPQARP; SISALVDNPQARPR; ISALVDNPQARPRE; SALVDNPQARPREL; ALVDNPQARPRELP; LVDNPQARPRELPV; VDNPQARPRELPVL; DNPQARPRELPVLC; NPQARPRELPVLCG; PQARPRELPVLCGW; QARPRELPVLCGWP; ARPRELPVLCGWPV; RPRELPVLCGWPVV; PRELPVLCGWPVVR; RELPVLCGWPVVRV; ELPVLCGWPVVRVE; LPVLCGWPVVRVEP; PVLCGWPVVRVEPV; VLCGWPVVRVEPVC; LCGWPVVRVEPVCE; CGWPVVRVEPVCEF; GWPVVRVEPVCEFV; WPVVRVEPVCEFVP; PVVRVEPVCEFVPE; VVRVEPVCEFVPEP; VRVEPVCEFVPEPV; RVEPVCEFVPEPVC; VEPVCEFVPEPVCG; EPVCEFVPEPVCGQ; PVCEFVPEPVCGQA; VCEFVPEPVCGQAE; CEFVPEPVCGQAEV; EFVPEPVCGQAEVL; FVPEPVCGQAEVLG; VPEPVCGQAEVLGE; PEPVCGQAEVLGEP; EPVCGQAEVLGEPA; PVCGQAEVLGEPAA; VCGQAEVLGEPAAA; CGQAEVLGEPAAAH; GQAEVLGEPAAAHR; QAEVLGEPAAAHRV; AEVLGEPAAAHRVT; EVLGEPAAAHRVTS; VLGEPAAAHRVTSA; LGEPAAAHRVTSAR; GEPAAAHRVTSARR; EPAAAHRVTSARRS; PAAAHRVTSARRSP; AAAHRVTSARRSPS; AAHRVTSARRSPST; AHRVTSARRSPSTT; HRVTSARRSPSTTV; RVTSARRSPSTTVC; VTSARRSPSTTVCS; TSARRSPSTTVCSR; SARRSPSTTVCSRS; ARRSPSTTVCSRSQ; RRSPSTTVCSRSQK; RSPSTTVCSRSQKA; SPSTTVCSRSQKAS; PSTTVCSRSQKASA; STTVCSRSQKASAV; TTVCSRSQKASAVV; TVCSRSQKASAVVI; VCSRSQKASAVVIS; CSRSQKASAVVISS; SRSQKASAVVISSV; RSQKASAVVISSVS; SQKASAVVISSVSS; QKASAVVISSVSSV; KASAVVISSVSSVA; ASAVVISSVSSVAR; SAVVISSVSSVARV; AVVISSVSSVARVR; VVISSVSSVARVRR; VISSVSSVARVRRA; ISSVSSVARVRRAS; SSVSSVARVRRASV; SVSSVARVRRASVS; VSSVARVRRASVSS; SSVARVRRASVSSV; SVARVRRASVSSVD; VARVRRASVSSVDA; ARVRRASVSSVDAT; RVRRASVSSVDATT; VRRASVSSVDATTA<br><br>15 mers:<br>MRARSDAGGQSVKSR; RARSDAGGQSVKSRT; ARSDAGGQSVKSRTS; RSDAGGQSVKSRTSN; SDAGGQSVKSRTSNR; DAGGQSVKSRTSNRS; AGGQSVKSRTSNRSR; GGQSVKSRTSNRSRS; GQSVKSRTSNRSRSS; QSVKSRTSNRSRSSR; SVKSRTSNRSRSSRR; VKSRTSNRSRSSRRS; KSRTSNRSRSSRRSR; SRTSNRSRSSRRSRV; RTSNRSRSSRRSRVR; TSNRSRSSRRSRVRS; SNRSRSSRRSRVRSS; NRSRSSRRSRVRSSI; RSRSSRRSRVRSSIS; SRSSRRSRVRSSISA; RSSRRSRVRSSISAL; SSRRSRVRSSISALV; SRRSRVRSSISALVD; RRSRVRSSISALVDN; RSRVRSSISALVDNP; SRVRSSISALVDNPQ; RVRSSISALVDNPQA; VRSSISALVDNPQAR; RSSISALVDNPQARP; SSISALVDNPQARPR; SISALVDNPQARPRE; ISALVDNPQARPREL; SALVDNPQARPRELP; ALVDNPQARPRELPV; LVDNPQARPRELPVL; VDNPQARPRELPVLC; | | |

Fig. 29 continued

| | | |
|---|---|---|
| | DNPQARPRELPVLCG; NPQARPRELPVLCGW; PQARPRELPVLCGWP; QARPRELPVLCGWPV; ARPRELPVLCGWPVV; RPRELPVLCGWPVVR; PRELPVLCGWPVVRV; RELPVLCGWPVVRVE; ELPVLCGWPVVRVEP; LPVLCGWPVVRVEPV; PVLCGWPVVRVEPVC; VLCGWPVVRVEPVCE; LCGWPVVRVEPVCEF; CGWPVVRVEPVCEFV; GWPVVRVEPVCEFVP; WPVVRVEPVCEFVPE; PVVRVEPVCEFVPEP; VVRVEPVCEFVPEPV; VRVEPVCEFVPEPVC; RVEPVCEFVPEPVCG; VEPVCEFVPEPVCGQ; EPVCEFVPEPVCGQA; PVCEFVPEPVCGQAE; VCEFVPEPVCGQAEV; CEFVPEPVCGQAEVL; EFVPEPVCGQAEVLG; FVPEPVCGQAEVLGE; VPEPVCGQAEVLGEP; PEPVCGQAEVLGEPA; EPVCGQAEVLGEPAA; PVCGQAEVLGEPAAA; VCGQAEVLGEPAAAH; CGQAEVLGEPAAAHR; GQAEVLGEPAAAHRV; QAEVLGEPAAAHRVT; AEVLGEPAAAHRVTS; EVLGEPAAAHRVTSA; VLGEPAAAHRVTSAR; LGEPAAAHRVTSARR; GEPAAAHRVTSARRS; EPAAAHRVTSARRSP; PAAAHRVTSARRSPS; AAAHRVTSARRSPST; AAHRVTSARRSPSTT; AHRVTSARRSPSTTV; HRVTSARRSPSTTVC; RVTSARRSPSTTVCS; VTSARRSPSTTVCSR; TSARRSPSTTVCSRS; SARRSPSTTVCSRSQ; ARRSPSTTVCSRSQK; RRSPSTTVCSRSQKA; RSPSTTVCSRSQKAS; SPSTTVCSRSQKASA; PSTTVCSRSQKASAV; STTVCSRSQKASAVV; TTVCSRSQKASAVVI; TVCSRSQKASAVVIS; VCSRSQKASAVVISS; CSRSQKASAVVISSV; SRSQKASAVVISSVS; RSQKASAVVISSVSS; SQKASAVVISSVSSV; QKASAVVISSVSSVA; KASAVVISSVSSVAR; ASAVVISSVSSVARV; SAVVISSVSSVARVR; AVVISSVSSVARVRR; VVISSVSSVARVRRA; VISSVSSVARVRRAS; ISSVSSVARVRRASV; SSVSSVARVRRASVS; SVSSVARVRRASVSS; VSSVARVRRASVSSV; SSVARVRRASVSSVD; SVARVRRASVSSVDA; VARVRRASVSSVDAT; ARVRRASVSSVDATT; RVRRASVSSVDATTA<br><br>16 mers:<br>MRARSDAGGQSVKSRT; RARSDAGGQSVKSRTS; ARSDAGGQSVKSRTSN; RSDAGGQSVKSRTSNR; SDAGGQSVKSRTSNRS; DAGGQSVKSRTSNRSR; AGGQSVKSRTSNRSRS; GGQSVKSRTSNRSRSS; GQSVKSRTSNRSRSSR; QSVKSRTSNRSRSSRR; SVKSRTSNRSRSSRRS; VKSRTSNRSRSSRRSR; KSRTSNRSRSSRRSRV; SRTSNRSRSSRRSRVR; RTSNRSRSSRRSRVRS; TSNRSRSSRRSRVRSS; SNRSRSSRRSRVRSSI; NRSRSSRRSRVRSSIS; RSRSSRRSRVRSSISA; SRSSRRSRVRSSISAL; RSSRRSRVRSSISALV; SSRRSRVRSSISALVD; SRRSRVRSSISALVDN; RRSRVRSSISALVDNP; RSRVRSSISALVDNPQ; SRVRSSISALVDNPQA; RVRSSISALVDNPQAR; VRSSISALVDNPQARP; RSSISALVDNPQARPR; SSISALVDNPQARPRE; SISALVDNPQARPREL; ISALVDNPQARPRELP; SALVDNPQARPRELPV; ALVDNPQARPRELPVL; LVDNPQARPRELPVLC; VDNPQARPRELPVLCG; DNPQARPRELPVLCGW; NPQARPRELPVLCGWP; PQARPRELPVLCGWPV; QARPRELPVLCGWPVV; ARPRELPVLCGWPVVR; RPRELPVLCGWPVVRV; PRELPVLCGWPVVRVE; RELPVLCGWPVVRVEP; ELPVLCGWPVVRVEPV; LPVLCGWPVVRVEPVC; PVLCGWPVVRVEPVCE; VLCGWPVVRVEPVCEF; LCGWPVVRVEPVCEFV; CGWPVVRVEPVCEFVP; GWPVVRVEPVCEFVPE; WPVVRVEPVCEFVPEP; PVVRVEPVCEFVPEPV; VVRVEPVCEFVPEPVC; VRVEPVCEFVPEPVCG; RVEPVCEFVPEPVCGQ; VEPVCEFVPEPVCGQA; EPVCEFVPEPVCGQAE; PVCEFVPEPVCGQAEV; VCEFVPEPVCGQAEVL; CEFVPEPVCGQAEVLG; EFVPEPVCGQAEVLGE; FVPEPVCGQAEVLGEP; VPEPVCGQAEVLGEPA; PEPVCGQAEVLGEPAA; EPVCGQAEVLGEPAAA; PVCGQAEVLGEPAAAH; VCGQAEVLGEPAAAHR; CGQAEVLGEPAAAHRV; GQAEVLGEPAAAHRVT; QAEVLGEPAAAHRVTS; AEVLGEPAAAHRVTSA; | |

Fig. 29 continued

| | | |
|---|---|---|
| | EVLGEPAAAHRVTSAR; VLGEPAAAHRVTSARR; LGEPAAAHRVTSARRS; GEPAAAHRVTSARRSP; EPAAAHRVTSARRSPS; PAAAHRVTSARRSPST; AAAHRVTSARRSPSTT; AAHRVTSARRSPSTTV; AHRVTSARRSPSTTVC; HRVTSARRSPSTTVCS; RVTSARRSPSTTVCSR; VTSARRSPSTTVCSRS; TSARRSPSTTVCSRSQ; SARRSPSTTVCSRSQK; ARRSPSTTVCSRSQKA; RRSPSTTVCSRSQKAS; RSPSTTVCSRSQKASA; SPSTTVCSRSQKASAV; PSTTVCSRSQKASAVV; STTVCSRSQKASAVVI; TTVCSRSQKASAVVIS; TVCSRSQKASAVVISS; VCSRSQKASAVVISSV; CSRSQKASAVVISSVS; SRSQKASAVVISSVSS; RSQKASAVVISSVSSV; SQKASAVVISSVSSVA; QKASAVVISSVSSVAR; KASAVVISSVSSVARV; ASAVVISSVSSVARVR; SAVVISSVSSVARVRR; AVVISSVSSVARVRRA; VVISSVSSVARVRRAS; VISSVSSVARVRRASV; ISSVSSVARVRRASVS; SSVSSVARVRRASVSS; SVSSVARVRRASVSSV; VSSVARVRRASVSSVD; SSVARVRRASVSSVDA; SVARVRRASVSSVDAT; VARVRRASVSSVDATT; ARVRRASVSSVDATTA | |
| 53) Rv2662 | 13 mers:<br>MDDLTRLRRELLD; DDLTRLRRELLDR; DLTRLRRELLDRF; LTRLRRELLDRFD; TRLRRELLDRFDV; RLRRELLDRFDVR; LRRELLDRFDVRD; RRELLDRFDVRDF; RELLDRFDVRDFT; ELLDRFDVRDFTD; LLDRFDVRDFTDW; LDRFDVRDFTDWP; DRFDVRDFTDWPP; RFDVRDFTDWPPA; FDVRDFTDWPPAS; DVRDFTDWPPASL; VRDFTDWPPASLR; RDFTDWPPASLRA; DFTDWPPASLRAL; FTDWPPASLRALI; TDWPPASLRALIA; DWPPASLRALIAT; WPPASLRALIATY; PPASLRALIATYD; PASLRALIATYDP; ASLRALIATYDPW; SLRALIATYDPWI; LRALIATYDPWID; RALIATYDPWIDM; ALIATYDPWIDMT; LIATYDPWIDMTA; IATYDPWIDMTAS; ATYDPWIDMTASP; TYDPWIDMTASPP; YDPWIDMTASPPQ; DPWIDMTASPPQP; PWIDMTASPPQPV; WIDMTASPPQPVS; IDMTASPPQPVSP; DMTASPPQPVSPG; MTASPPQPVSPGG; TASPPQPVSPGGP; ASPPQPVSPGGPR; SPPQPVSPGGPRL; PPQPVSPGGPRLR; PQPVSPGGPRLRL; QPVSPGGPRLRLV; PVSPGGPRLRLVR; VSPGGPRLRLVRL; SPGGPRLRLVRLT; PGGPRLRLVRLTT; GGPRLRLVRLTTN; GPRLRLVRLTTNP; PRLRLVRLTTNPS; RLRLVRLTTNPSA; LRLVRLTTNPSAR; RLVRLTTNPSARA; LVRLTTNPSARAA; VRLTTNPSARAAP; RLTTNPSARAAPI; LTTNPSARAAPIG; TTNPSARAAPIGN; TNPSARAAPIGNG; NPSARAAPIGNGG; PSARAAPIGNGGD; SARAAPIGNGGDS; ARAAPIGNGGDSS; RAAPIGNGGDSSV; AAPIGNGGDSSVC; APIGNGGDSSVCA; PIGNGGDSSVCAG; IGNGGDSSVCAGE; GNGGDSSVCAGEK; NGGDSSVCAGEKQ; GGDSSVCAGEKQC; GDSSVCAGEKQCR; DSSVCAGEKQCRP; SSVCAGEKQCRPP<br><br>14 mers:<br>MDDLTRLRRELLDR; DDLTRLRRELLDRF; DLTRLRRELLDRFD; LTRLRRELLDRFDV; TRLRRELLDRFDVR; RLRRELLDRFDVRD; LRRELLDRFDVRDF; RRELLDRFDVRDFT; RELLDRFDVRDFTD; ELLDRFDVRDFTDW; LLDRFDVRDFTDWP; LDRFDVRDFTDWPP; DRFDVRDFTDWPPA; RFDVRDFTDWPPAS; FDVRDFTDWPPASL; DVRDFTDWPPASLR; VRDFTDWPPASLRA; RDFTDWPPASLRAL; DFTDWPPASLRALI; FTDWPPASLRALIA; TDWPPASLRALIAT; DWPPASLRALIATY; WPPASLRALIATYD; PPASLRALIATYDP; PASLRALIATYDPW; ASLRALIATYDPWI; SLRALIATYDPWID; LRALIATYDPWIDM; RALIATYDPWIDMT; ALIATYDPWIDMTA; LIATYDPWIDMTAS; IATYDPWIDMTASP; ATYDPWIDMTASPP; TYDPWIDMTASPPQ; YDPWIDMTASPPQP; DPWIDMTASPPQPV; PWIDMTASPPQPVS; WIDMTASPPQPVSP; IDMTASPPQPVSPG; DMTASPPQPVSPGG; MTASPPQPVSPGGP; TASPPQPVSPGGPR; ASPPQPVSPGGPRL; | 98064-98369 |

Fig. 29 continued

| | | |
|---|---|---|
| | SPPQPVSPGGPRLR; PPQPVSPGGPRLRL; PQPVSPGGPRLRLV; QPVSPGGPRLRLVR; PVSPGGPRLRLVRL; VSPGGPRLRLVRLT; SPGGPRLRLVRLTT; PGGPRLRLVRLTTN; GGPRLRLVRLTTNP; GPRLRLVRLTTNPS; PRLRLVRLTTNPSA; RLRLVRLTTNPSAR; LRLVRLTTNPSARA; RLVRLTTNPSARAA; LVRLTTNPSARAAP; VRLTTNPSARAAPI; RLTTNPSARAAPIG; LTTNPSARAAPIGN; TTNPSARAAPIGNG; TNPSARAAPIGNGG; NPSARAAPIGNGGD; PSARAAPIGNGGDS; SARAAPIGNGGDSS; ARAAPIGNGGDSSV; RAAPIGNGGDSSVC; AAPIGNGGDSSVCA; APIGNGGDSSVCAG; PIGNGGDSSVCAGE; IGNGGDSSVCAGEK; GNGGDSSVCAGEKQ; NGGDSSVCAGEKQC; GGDSSVCAGEKQCR; GDSSVCAGEKQCRP; DSSVCAGEKQCRPP<br><br>15 mers:<br>MDDLTRLRRELLDRF; DDLTRLRRELLDRFD; DLTRLRRELLDRFDV; LTRLRRELLDRFDVR; TRLRRELLDRFDVRD; RLRRELLDRFDVRDF; LRRELLDRFDVRDFT; RRELLDRFDVRDFTD; RELLDRFDVRDFTDW; ELLDRFDVRDFTDWP; LLDRFDVRDFTDWPP; LDRFDVRDFTDWPPA; DRFDVRDFTDWPPAS; RFDVRDFTDWPPASL; FDVRDFTDWPPASLR; DVRDFTDWPPASLRA; VRDFTDWPPASLRAL; RDFTDWPPASLRALI; DFTDWPPASLRALIA; FTDWPPASLRALIAT; TDWPPASLRALIATY; DWPPASLRALIATYD; WPPASLRALIATYDP; PPASLRALIATYDPW; PASLRALIATYDPWI; ASLRALIATYDPWID; SLRALIATYDPWIDM; LRALIATYDPWIDMT; RALIATYDPWIDMTA; ALIATYDPWIDMTAS; LIATYDPWIDMTASP; IATYDPWIDMTASPP; ATYDPWIDMTASPPQ; TYDPWIDMTASPPQP; YDPWIDMTASPPQPV; DPWIDMTASPPQPVS; PWIDMTASPPQPVSP; WIDMTASPPQPVSPG; IDMTASPPQPVSPGG; DMTASPPQPVSPGGP; MTASPPQPVSPGGPR; TASPPQPVSPGGPRL; ASPPQPVSPGGPRLR; SPPQPVSPGGPRLRL; PPQPVSPGGPRLRLV; PQPVSPGGPRLRLVR; QPVSPGGPRLRLVRL; PVSPGGPRLRLVRLT; VSPGGPRLRLVRLTT; SPGGPRLRLVRLTTN; PGGPRLRLVRLTTNP; GGPRLRLVRLTTNPS; GPRLRLVRLTTNPSA; PRLRLVRLTTNPSAR; RLRLVRLTTNPSARA; LRLVRLTTNPSARAA; RLVRLTTNPSARAAP; LVRLTTNPSARAAPI; VRLTTNPSARAAPIG; RLTTNPSARAAPIGN; LTTNPSARAAPIGNG; TTNPSARAAPIGNGG; TNPSARAAPIGNGGD; NPSARAAPIGNGGDS; PSARAAPIGNGGDSS; SARAAPIGNGGDSSV; ARAAPIGNGGDSSVC; RAAPIGNGGDSSVCA; AAPIGNGGDSSVCAG; APIGNGGDSSVCAGE; PIGNGGDSSVCAGEK; IGNGGDSSVCAGEKQ; GNGGDSSVCAGEKQC; NGGDSSVCAGEKQCR; GGDSSVCAGEKQCRP; GDSSVCAGEKQCRPP<br><br>16 mers:<br>MDDLTRLRRELLDRFD; DDLTRLRRELLDRFDV; DLTRLRRELLDRFDVR; LTRLRRELLDRFDVRD; TRLRRELLDRFDVRDF; RLRRELLDRFDVRDFT; LRRELLDRFDVRDFTD; RRELLDRFDVRDFTDW; RELLDRFDVRDFTDWP; ELLDRFDVRDFTDWPP; LLDRFDVRDFTDWPPA; LDRFDVRDFTDWPPAS; DRFDVRDFTDWPPASL; RFDVRDFTDWPPASLR; FDVRDFTDWPPASLRA; DVRDFTDWPPASLRAL; VRDFTDWPPASLRALI; RDFTDWPPASLRALIA; DFTDWPPASLRALIAT; FTDWPPASLRALIATY; TDWPPASLRALIATYD; DWPPASLRALIATYDP; WPPASLRALIATYDPW; PPASLRALIATYDPWI; PASLRALIATYDPWID; ASLRALIATYDPWIDM; SLRALIATYDPWIDMT; LRALIATYDPWIDMTA; RALIATYDPWIDMTAS; ALIATYDPWIDMTASP; LIATYDPWIDMTASPP; IATYDPWIDMTASPPQ; ATYDPWIDMTASPPQP; | |

Fig. 29 continued

| | | |
|---|---|---|
| | TYDPWIDMTASPPQPV; YDPWIDMTASPPQPVS; DPWIDMTASPPQPVSP; PWIDMTASPPQPVSPG; WIDMTASPPQPVSPGG; IDMTASPPQPVSPGGP; DMTASPPQPVSPGGPR; MTASPPQPVSPGGPRL; TASPPQPVSPGGPRLR; ASPPQPVSPGGPRLRL; SPPQPVSPGGPRLRLV; PPQPVSPGGPRLRLVR; PQPVSPGGPRLRLVRL; QPVSPGGPRLRLVRLT; PVSPGGPRLRLVRLTT; VSPGGPRLRLVRLTTN; SPGGPRLRLVRLTTNP; PGGPRLRLVRLTTNPS; GGPRLRLVRLTTNPSA; GPRLRLVRLTTNPSAR; PRLRLVRLTTNPSARA; RLRLVRLTTNPSARAA; LRLVRLTTNPSARAAP; RLVRLTTNPSARAAPI; LVRLTTNPSARAAPIG; VRLTTNPSARAAPIGN; RLTTNPSARAAPIGNG; LTTNPSARAAPIGNGG; TTNPSARAAPIGNGGD; TNPSARAAPIGNGGDS; NPSARAAPIGNGGDSS; PSARAAPIGNGGDSSV; SARAAPIGNGGDSSVC; ARAAPIGNGGDSSVCA; RAAPIGNGGDSSVCAG; AAPIGNGGDSSVCAGE; APIGNGGDSSVCAGEK; PIGNGGDSSVCAGEKQ; IGNGGDSSVCAGEKQC; GNGGDSSVCAGEKQCR; NGGDSSVCAGEKQCRP; GGDSSVCAGEKQCRPP | |
| 54) Rv2663 | 13 mers:<br>MEVRASARKHGIN; EVRASARKHGIND; VRASARKHGINDD; RASARKHGINDDA; ASARKHGINDDAM; SARKHGINDDAML; ARKHGINDDAMLH; RKHGINDDAMLHA; KHGINDDAMLHAY; HGINDDAMLHAYR; GINDDAMLHAYRN; INDDAMLHAYRNA; NDDAMLHAYRNAL; DDAMLHAYRNALR; DAMLHAYRNALRY; AMLHAYRNALRYV; MLHAYRNALRYVE; LHAYRNALRYVEL; HAYRNALRYVELE; AYRNALRYVELEY; YRNALRYVELEYH; RNALRYVELEYHG; NALRYVELEYHGE; ALRYVELEYHGEV; LRYVELEYHGEVQ; RYVELEYHGEVQL; YVELEYHGEVQLL; VELEYHGEVQLLV; ELEYHGEVQLLVI; LEYHGEVQLLVIG; EYHGEVQLLVIGP; YHGEVQLLVIGPD; HGEVQLLVIGPDQ; GEVQLLVIGPDQT; EVQLLVIGPDQTG; VQLLVIGPDQTGR; QLLVIGPDQTGRL; LLVIGPDQTGRLL; LVIGPDQTGRLLE; VIGPDQTGRLLEL; IGPDQTGRLLELV; GPDQTGRLLELVI; PDQTGRLLELVIP; DQTGRLLELVIPA; QTGRLLELVIPAD; TGRLLELVIPADE; GRLLELVIPADEP; RLLELVIPADEPP; LLELVIPADEPPR; LELVIPADEPPRI; ELVIPADEPPRII; LVIPADEPPRIIH; VIPADEPPRIIHA; IPADEPPRIIHAN; PADEPPRIIHANV; ADEPPRIIHANVL; DEPPRIIHANVLR; EPPRIIHANVLRP; PPRIIHANVLRPK; PRIIHANVLRPKF; RIIHANVLRPKFY; IIHANVLRPKFYD; IHANVLRPKFYDY; HANVLRPKFYDYL; ANVLRPKFYDYLR<br><br>14 mers:<br>MEVRASARKHGIND; EVRASARKHGINDD; VRASARKHGINDDA; RASARKHGINDDAM; ASARKHGINDDAML; SARKHGINDDAMLH; ARKHGINDDAMLHA; RKHGINDDAMLHAY; KHGINDDAMLHAYR; HGINDDAMLHAYRN; GINDDAMLHAYRNA; INDDAMLHAYRNAL; NDDAMLHAYRNALR; DDAMLHAYRNALRY; DAMLHAYRNALRYV; AMLHAYRNALRYVE; MLHAYRNALRYVEL; LHAYRNALRYVELE; HAYRNALRYVELEY; AYRNALRYVELEYH; YRNALRYVELEYHG; RNALRYVELEYHGE; NALRYVELEYHGEV; ALRYVELEYHGEVQ; LRYVELEYHGEVQL; RYVELEYHGEVQLL; YVELEYHGEVQLLV; VELEYHGEVQLLVI; ELEYHGEVQLLVIG; LEYHGEVQLLVIGP; EYHGEVQLLVIGPD; YHGEVQLLVIGPDQ; HGEVQLLVIGPDQT; GEVQLLVIGPDQTG; EVQLLVIGPDQTGR; VQLLVIGPDQTGRL; QLLVIGPDQTGRLL; LLVIGPDQTGRLLE; LVIGPDQTGRLLEL; VIGPDQTGRLLELV; IGPDQTGRLLELVI; GPDQTGRLLELVIP; PDQTGRLLELVIPA; DQTGRLLELVIPAD; QTGRLLELVIPADE; TGRLLELVIPADEP; GRLLELVIPADEPP; RLLELVIPADEPPR; LLELVIPADEPPRI; LELVIPADEPPRII; ELVIPADEPPRIIH; LVIPADEPPRIIHA; VIPADEPPRIIHAN; IPADEPPRIIHANV; PADEPPRIIHANVL; ADEPPRIIHANVLR; DEPPRIIHANVLRP; EPPRIIHANVLRPK; PPRIIHANVLRPKF; PRIIHANVLRPKFY; RIIHANVLRPKFYD; | 98370-98623 |

Fig. 29 continued

| | | |
|---|---|---|
| | IIHANVLRPKFYDY; IHANVLRPKFYDYL; HANVLRPKFYDYLR<br><br>15 mers:<br>MEVRASARKHGINDD; EVRASARKHGINDDA; VRASARKHGINDDAM; RASARKHGINDDAML; ASARKHGINDDAMLH; SARKHGINDDAMLHA; ARKHGINDDAMLHAY; RKHGINDDAMLHAYR; KHGINDDAMLHAYRN; HGINDDAMLHAYRNA; GINDDAMLHAYRNAL; INDDAMLHAYRNALR; NDDAMLHAYRNALRY; DDAMLHAYRNALRYV; DAMLHAYRNALRYVE; AMLHAYRNALRYVEL; MLHAYRNALRYVELE; LHAYRNALRYVELEY; HAYRNALRYVELEYH; AYRNALRYVELEYHG; YRNALRYVELEYHGE; RNALRYVELEYHGEV; NALRYVELEYHGEVQ; ALRYVELEYHGEVQL; LRYVELEYHGEVQLL; RYVELEYHGEVQLLV; YVELEYHGEVQLLVI; VELEYHGEVQLLVIG; ELEYHGEVQLLVIGP; LEYHGEVQLLVIGPD; EYHGEVQLLVIGPDQ; YHGEVQLLVIGPDQT; HGEVQLLVIGPDQTG; GEVQLLVIGPDQTGR; EVQLLVIGPDQTGRL; VQLLVIGPDQTGRLL; QLLVIGPDQTGRLLE; LLVIGPDQTGRLLEL; LVIGPDQTGRLLELV; VIGPDQTGRLLELVI; IGPDQTGRLLELVIP; GPDQTGRLLELVIPA; PDQTGRLLELVIPAD; DQTGRLLELVIPADE; QTGRLLELVIPADEP; TGRLLELVIPADEPP; GRLLELVIPADEPPR; RLLELVIPADEPPRI; LLELVIPADEPPRII; LELVIPADEPPRIIH; ELVIPADEPPRIIHA; LVIPADEPPRIIHAN; VIPADEPPRIIHANV; IPADEPPRIIHANVL; PADEPPRIIHANVLR; ADEPPRIIHANVLRP; DEPPRIIHANVLRPK; EPPRIIHANVLRPKF; PPRIIHANVLRPKFY; PRIIHANVLRPKFYD; RIIHANVLRPKFYDY; IIHANVLRPKFYDYL; IHANVLRPKFYDYLR<br><br>16 mers:<br>MEVRASARKHGINDDA; EVRASARKHGINDDAM; VRASARKHGINDDAML; RASARKHGINDDAMLH; ASARKHGINDDAMLHA; SARKHGINDDAMLHAY; ARKHGINDDAMLHAYR; RKHGINDDAMLHAYRN; KHGINDDAMLHAYRNA; HGINDDAMLHAYRNAL; GINDDAMLHAYRNALR; INDDAMLHAYRNALRY; NDDAMLHAYRNALRYV; DDAMLHAYRNALRYVE; DAMLHAYRNALRYVEL; AMLHAYRNALRYVELE; MLHAYRNALRYVELEY; LHAYRNALRYVELEYH; HAYRNALRYVELEYHG; AYRNALRYVELEYHGE; YRNALRYVELEYHGEV; RNALRYVELEYHGEVQ; NALRYVELEYHGEVQL; ALRYVELEYHGEVQLL; LRYVELEYHGEVQLLV; RYVELEYHGEVQLLVI; YVELEYHGEVQLLVIG; VELEYHGEVQLLVIGP; ELEYHGEVQLLVIGPD; LEYHGEVQLLVIGPDQ; EYHGEVQLLVIGPDQT; YHGEVQLLVIGPDQTG; HGEVQLLVIGPDQTGR; GEVQLLVIGPDQTGRL; EVQLLVIGPDQTGRLL; VQLLVIGPDQTGRLLE; QLLVIGPDQTGRLLEL; LLVIGPDQTGRLLELV; LVIGPDQTGRLLELVI; VIGPDQTGRLLELVIP; IGPDQTGRLLELVIPA; GPDQTGRLLELVIPAD; PDQTGRLLELVIPADE; DQTGRLLELVIPADEP; QTGRLLELVIPADEPP; TGRLLELVIPADEPPR; GRLLELVIPADEPPRI; RLLELVIPADEPPRII; LLELVIPADEPPRIIH; LELVIPADEPPRIIHA; ELVIPADEPPRIIHAN; LVIPADEPPRIIHANV; VIPADEPPRIIHANVL; IPADEPPRIIHANVLR; PADEPPRIIHANVLRP; ADEPPRIIHANVLRPK; DEPPRIIHANVLRPKF; EPPRIIHANVLRPKFY; PPRIIHANVLRPKFYD; PRIIHANVLRPKFYDY; RIIHANVLRPKFYDYL; IIHANVLRPKFYDYLR | |
| 55) Rv2745c | 13 mers:<br>MSVGFVTPVGVRW; SVGFVTPVGVRWS; VGFVTPVGVRWSD; GFVTPVGVRWSDI; FVTPVGVRWSDID; VTPVGVRWSDIDM; TPVGVRWSDIDMY; PVGVRWSDIDMYQ; VGVRWSDIDMYQH; GVRWSDIDMYQHV; VRWSDIDMYQHVN; RWSDIDMYQHVNH; WSDIDMYQHVNHA; SDIDMYQHVNHAT; DIDMYQHVNHATM; IDMYQHVNHATMV; | 98624-99121 |

Fig. 29 continued

| | | |
|---|---|---|
| | DMYQHVNHATMVT; MYQHVNHATMVTI; YQHVNHATMVTIL; QHVNHATMVTILE; HVNHATMVTILEE; VNHATMVTILEEA; NHATMVTILEEAR; HATMVTILEEARV; ATMVTILEEARVP; TMVTILEEARVPF; MVTILEEARVPFL; VTILEEARVPFLK; TILEEARVPFLKD; ILEEARVPFLKDA; LEEARVPFLKDAF; EEARVPFLKDAFG; EARVPFLKDAFGA; ARVPFLKDAFGAD; RVPFLKDAFGADI; VPFLKDAFGADIT; PFLKDAFGADITS; FLKDAFGADITST; LKDAFGADITSTG; KDAFGADITSTGL; DAFGADITSTGLL; AFGADITSTGLLI; FGADITSTGLLIA; GADITSTGLLIAD; ADITSTGLLIADV; DITSTGLLIADVR; ITSTGLLIADVRV; TSTGLLIADVRVT; STGLLIADVRVTY; TGLLIADVRVTYK; GLLIADVRVTYKG; LLIADVRVTYKGQ; LIADVRVTYKGQL; IADVRVTYKGQLR; ADVRVTYKGQLRL; DVRVTYKGQLRLS; VRVTYKGQLRLSD; RVTYKGQLRLSDS; VTYKGQLRLSDSP; TYKGQLRLSDSPL; YKGQLRLSDSPLQ; KGQLRLSDSPLQV; GQLRLSDSPLQVT; QLRLSDSPLQVTI; LRLSDSPLQVTIW; RLSDSPLQVTIWT; LSDSPLQVTIWTK; SDSPLQVTIWTKR; DSPLQVTIWTKRL; SPLQVTIWTKRLR; PLQVTIWTKRLRA; LQVTIWTKRLRAV; QVTIWTKRLRAVD; VTIWTKRLRAVDF; TIWTKRLRAVDFT; IWTKRLRAVDFTL; WTKRLRAVDFTLG; TKRLRAVDFTLGY; KRLRAVDFTLGYE; RLRAVDFTLGYEV; LRAVDFTLGYEVR; RAVDFTLGYEVRS; AVDFTLGYEVRSV; VDFTLGYEVRSVN; DFTLGYEVRSVNA; FTLGYEVRSVNAE; TLGYEVRSVNAEP; LGYEVRSVNAEPD; GYEVRSVNAEPDS; YEVRSVNAEPDSR; EVRSVNAEPDSRP; VRSVNAEPDSRPA; RSVNAEPDSRPAV; SVNAEPDSRPAVI; VNAEPDSRPAVIA; NAEPDSRPAVIAE; AEPDSRPAVIAES; EPDSRPAVIAESQ; PDSRPAVIAESQL; DSRPAVIAESQLA; SRPAVIAESQLAA; RPAVIAESQLAAF; PAVIAESQLAAFH; AVIAESQLAAFHI; VIAESQLAAFHIE; IAESQLAAFHIEE; AESQLAAFHIEEQ; ESQLAAFHIEEQR; SQLAAFHIEEQRL; QLAAFHIEEQRLV; LAAFHIEEQRLVR; AAFHIEEQRLVRL; AFHIEEQRLVRLS; FHIEEQRLVRLSP; HIEEQRLVRLSPH; IEEQRLVRLSPHH; EEQRLVRLSPHHR; EQRLVRLSPHHRE; QRLVRLSPHHREY; RLVRLSPHHREYL; LVRLSPHHREYLQ; VRLSPHHREYLQR; RLSPHHREYLQRW; LSPHHREYLQRWF; SPHHREYLQRWFR; PHHREYLQRWFRG<br><br>14 mers:<br>MSVGFVTPVGVRWS; SVGFVTPVGVRWSD; VGFVTPVGVRWSDI; GFVTPVGVRWSDID; FVTPVGVRWSDIDM; VTPVGVRWSDIDMY; TPVGVRWSDIDMYQ; PVGVRWSDIDMYQH; VGVRWSDIDMYQHV; GVRWSDIDMYQHVN; VRWSDIDMYQHVNH; RWSDIDMYQHVNHA; WSDIDMYQHVNHAT; SDIDMYQHVNHATM; DIDMYQHVNHATMV; IDMYQHVNHATMVT; DMYQHVNHATMVTI; MYQHVNHATMVTIL; YQHVNHATMVTILE; QHVNHATMVTILEE; HVNHATMVTILEEA; VNHATMVTILEEAR; NHATMVTILEEARV; HATMVTILEEARVP; ATMVTILEEARVPF; TMVTILEEARVPFL; MVTILEEARVPFLK; VTILEEARVPFLKD; TILEEARVPFLKDA; ILEEARVPFLKDAF; LEEARVPFLKDAFG; EEARVPFLKDAFGA; EARVPFLKDAFGAD; ARVPFLKDAFGADI; RVPFLKDAFGADIT; VPFLKDAFGADITS; PFLKDAFGADITST; FLKDAFGADITSTG; LKDAFGADITSTGL; KDAFGADITSTGLL; DAFGADITSTGLLI; AFGADITSTGLLIA; FGADITSTGLLIAD; GADITSTGLLIADV; ADITSTGLLIADVR; DITSTGLLIADVRV; ITSTGLLIADVRVT; TSTGLLIADVRVTY; STGLLIADVRVTYK; TGLLIADVRVTYKG; GLLIADVRVTYKGQ; LLIADVRVTYKGQL; LIADVRVTYKGQLR; IADVRVTYKGQLRL; ADVRVTYKGQLRLS; DVRVTYKGQLRLSD; VRVTYKGQLRLSDS; RVTYKGQLRLSDSP; VTYKGQLRLSDSPL; TYKGQLRLSDSPLQ; YKGQLRLSDSPLQV; KGQLRLSDSPLQVT; GQLRLSDSPLQVTI; QLRLSDSPLQVTIW; LRLSDSPLQVTIWT; RLSDSPLQVTIWTK; LSDSPLQVTIWTKR; SDSPLQVTIWTKRL; DSPLQVTIWTKRLR; SPLQVTIWTKRLRA; PLQVTIWTKRLRAV; LQVTIWTKRLRAVD; QVTIWTKRLRAVDF; | |

Fig. 29 continued

| | | |
|---|---|---|
| | VTIWTKRLRAVDFT; TIWTKRLRAVDFTL; IWTKRLRAVDFTLG; WTKRLRAVDFTLGY; TKRLRAVDFTLGYE; KRLRAVDFTLGYEV; RLRAVDFTLGYEVR; LRAVDFTLGYEVRS; RAVDFTLGYEVRSV; AVDFTLGYEVRSVN; VDFTLGYEVRSVNA; DFTLGYEVRSVNAE; FTLGYEVRSVNAEP; TLGYEVRSVNAEPD; LGYEVRSVNAEPDS; GYEVRSVNAEPDSR; YEVRSVNAEPDSRP; EVRSVNAEPDSRPA; VRSVNAEPDSRPAV; RSVNAEPDSRPAVI; SVNAEPDSRPAVIA; VNAEPDSRPAVIAE; NAEPDSRPAVIAES; AEPDSRPAVIAESQ; EPDSRPAVIAESQL; PDSRPAVIAESQLA; DSRPAVIAESQLAA; SRPAVIAESQLAAF; RPAVIAESQLAAFH; PAVIAESQLAAFHI; AVIAESQLAAFHIE; VIAESQLAAFHIEE; IAESQLAAFHIEEQ; AESQLAAFHIEEQR; ESQLAAFHIEEQRL; SQLAAFHIEEQRLV; QLAAFHIEEQRLVR; LAAFHIEEQRLVRL; AAFHIEEQRLVRLS; AFHIEEQRLVRLSP; FHIEEQRLVRLSPH; HIEEQRLVRLSPHH; IEEQRLVRLSPHHR; EEQRLVRLSPHHRE; EQRLVRLSPHHREY; QRLVRLSPHHREYL; RLVRLSPHHREYLQ; LVRLSPHHREYLQR; VRLSPHHREYLQRW; RLSPHHREYLQRWF; LSPHHREYLQRWFR; SPHHREYLQRWFRG<br><br>15 mers:<br>MSVGFVTPVGVRWSD; SVGFVTPVGVRWSDI; VGFVTPVGVRWSDID; GFVTPVGVRWSDIDM; FVTPVGVRWSDIDMY; VTPVGVRWSDIDMYQ; TPVGVRWSDIDMYQH; PVGVRWSDIDMYQHV; VGVRWSDIDMYQHVN; GVRWSDIDMYQHVNH; VRWSDIDMYQHVNHA; RWSDIDMYQHVNHAT; WSDIDMYQHVNHATM; SDIDMYQHVNHATMV; DIDMYQHVNHATMVT; IDMYQHVNHATMVTI; DMYQHVNHATMVTIL; MYQHVNHATMVTILE; YQHVNHATMVTILEE; QHVNHATMVTILEEA; HVNHATMVTILEEAR; VNHATMVTILEEARV; NHATMVTILEEARVP; HATMVTILEEARVPF; ATMVTILEEARVPFL; TMVTILEEARVPFLK; MVTILEEARVPFLKD; VTILEEARVPFLKDA; TILEEARVPFLKDAF; ILEEARVPFLKDAFG; LEEARVPFLKDAFGA; EEARVPFLKDAFGAD; EARVPFLKDAFGADI; ARVPFLKDAFGADIT; RVPFLKDAFGADITS; VPFLKDAFGADITST; PFLKDAFGADITSTG; FLKDAFGADITSTGL; LKDAFGADITSTGLL; KDAFGADITSTGLLI; DAFGADITSTGLLIA; AFGADITSTGLLIAD; FGADITSTGLLIADV; GADITSTGLLIADVR; ADITSTGLLIADVRV; DITSTGLLIADVRVT; ITSTGLLIADVRVTY; TSTGLLIADVRVTYK; STGLLIADVRVTYKG; TGLLIADVRVTYKGQ; GLLIADVRVTYKGQL; LLIADVRVTYKGQLR; LIADVRVTYKGQLRL; IADVRVTYKGQLRLS; ADVRVTYKGQLRLSD; DVRVTYKGQLRLSDS; VRVTYKGQLRLSDSP; RVTYKGQLRLSDSPL; VTYKGQLRLSDSPLQ; TYKGQLRLSDSPLQV; YKGQLRLSDSPLQVT; KGQLRLSDSPLQVTI; GQLRLSDSPLQVTIW; QLRLSDSPLQVTIWT; LRLSDSPLQVTIWTK; RLSDSPLQVTIWTKR; LSDSPLQVTIWTKRL; SDSPLQVTIWTKRLR; DSPLQVTIWTKRLRA; SPLQVTIWTKRLRAV; PLQVTIWTKRLRAVD; LQVTIWTKRLRAVDF; QVTIWTKRLRAVDFT; VTIWTKRLRAVDFTL; TIWTKRLRAVDFTLG; IWTKRLRAVDFTLGY; WTKRLRAVDFTLGYE; TKRLRAVDFTLGYEV; KRLRAVDFTLGYEVR; RLRAVDFTLGYEVRS; LRAVDFTLGYEVRSV; RAVDFTLGYEVRSVN; AVDFTLGYEVRSVNA; VDFTLGYEVRSVNAE; DFTLGYEVRSVNAEP; FTLGYEVRSVNAEPD; TLGYEVRSVNAEPDS; LGYEVRSVNAEPDSR; GYEVRSVNAEPDSRP; YEVRSVNAEPDSRPA; EVRSVNAEPDSRPAV; VRSVNAEPDSRPAVI; RSVNAEPDSRPAVIA; SVNAEPDSRPAVIAE; VNAEPDSRPAVIAES; NAEPDSRPAVIAESQ; AEPDSRPAVIAESQL; EPDSRPAVIAESQLA; PDSRPAVIAESQLAA; DSRPAVIAESQLAAF; SRPAVIAESQLAAFH; RPAVIAESQLAAFHI; | |

Fig. 29 continued

| | | |
|---|---|---|
| | PAVIAESQLAAFHIE; AVIAESQLAAFHIEE; VIAESQLAAFHIEEQ; IAESQLAAFHIEEQR; AESQLAAFHIEEQRL; ESQLAAFHIEEQRLV; SQLAAFHIEEQRLVR; QLAAFHIEEQRLVRL; LAAFHIEEQRLVRLS; AAFHIEEQRLVRLSP; AFHIEEQRLVRLSPH; FHIEEQRLVRLSPHH; HIEEQRLVRLSPHHR; IEEQRLVRLSPHHRE; EEQRLVRLSPHHREY; EQRLVRLSPHHREYL; QRLVRLSPHHREYLQ; RLVRLSPHHREYLQR; LVRLSPHHREYLQRW; VRLSPHHREYLQRWF; RLSPHHREYLQRWFR; LSPHHREYLQRWFRG<br><br>16 mers:<br>MSVGFVTPVGVRWSDI; SVGFVTPVGVRWSDID; VGFVTPVGVRWSDIDM; GFVTPVGVRWSDIDMY; FVTPVGVRWSDIDMYQ; VTPVGVRWSDIDMYQH; TPVGVRWSDIDMYQHV; PVGVRWSDIDMYQHVN; VGVRWSDIDMYQHVNH; GVRWSDIDMYQHVNHA; VRWSDIDMYQHVNHAT; RWSDIDMYQHVNHATM; WSDIDMYQHVNHATMV; SDIDMYQHVNHATMVT; DIDMYQHVNHATMVTI; IDMYQHVNHATMVTIL; DMYQHVNHATMVTILE; MYQHVNHATMVTILEE; YQHVNHATMVTILEEA; QHVNHATMVTILEEAR; HVNHATMVTILEEARV; VNHATMVTILEEARVP; NHATMVTILEEARVPF; HATMVTILEEARVPFL; ATMVTILEEARVPFLK; TMVTILEEARVPFLKD; MVTILEEARVPFLKDA; VTILEEARVPFLKDAF; TILEEARVPFLKDAFG; ILEEARVPFLKDAFGA; LEEARVPFLKDAFGAD; EEARVPFLKDAFGADI; EARVPFLKDAFGADIT; ARVPFLKDAFGADITS; RVPFLKDAFGADITST; VPFLKDAFGADITSTG; PFLKDAFGADITSTGL; FLKDAFGADITSTGLL; LKDAFGADITSTGLLI; KDAFGADITSTGLLIA; DAFGADITSTGLLIAD; AFGADITSTGLLIADV; FGADITSTGLLIADVR; GADITSTGLLIADVRV; ADITSTGLLIADVRVT; DITSTGLLIADVRVTY; ITSTGLLIADVRVTYK; TSTGLLIADVRVTYKG; STGLLIADVRVTYKGQ; TGLLIADVRVTYKGQL; GLLIADVRVTYKGQLR; LLIADVRVTYKGQLRL; LIADVRVTYKGQLRLS; IADVRVTYKGQLRLSD; ADVRVTYKGQLRLSDS; DVRVTYKGQLRLSDSP; VRVTYKGQLRLSDSPL; RVTYKGQLRLSDSPLQ; VTYKGQLRLSDSPLQV; TYKGQLRLSDSPLQVT; YKGQLRLSDSPLQVTI; KGQLRLSDSPLQVTIW; GQLRLSDSPLQVTIWT; QLRLSDSPLQVTIWTK; LRLSDSPLQVTIWTKR; RLSDSPLQVTIWTKRL; LSDSPLQVTIWTKRLR; SDSPLQVTIWTKRLRA; DSPLQVTIWTKRLRAV; SPLQVTIWTKRLRAVD; PLQVTIWTKRLRAVDF; LQVTIWTKRLRAVDFT; QVTIWTKRLRAVDFTL; VTIWTKRLRAVDFTLG; TIWTKRLRAVDFTLGY; IWTKRLRAVDFTLGYE; WTKRLRAVDFTLGYEV; TKRLRAVDFTLGYEVR; KRLRAVDFTLGYEVRS; RLRAVDFTLGYEVRSV; LRAVDFTLGYEVRSVN; RAVDFTLGYEVRSVNA; AVDFTLGYEVRSVNAE; VDFTLGYEVRSVNAEP; DFTLGYEVRSVNAEPD; FTLGYEVRSVNAEPDS; TLGYEVRSVNAEPDSR; LGYEVRSVNAEPDSRP; GYEVRSVNAEPDSRPA; YEVRSVNAEPDSRPAV; EVRSVNAEPDSRPAVI; VRSVNAEPDSRPAVIA; RSVNAEPDSRPAVIAE; SVNAEPDSRPAVIAES; VNAEPDSRPAVIAESQ; NAEPDSRPAVIAESQL; AEPDSRPAVIAESQLA; EPDSRPAVIAESQLAA; PDSRPAVIAESQLAAF; DSRPAVIAESQLAAFH; SRPAVIAESQLAAFHI; RPAVIAESQLAAFHIE; PAVIAESQLAAFHIEE; AVIAESQLAAFHIEEQ; VIAESQLAAFHIEEQR; IAESQLAAFHIEEQRL; AESQLAAFHIEEQRLV; ESQLAAFHIEEQRLVR; SQLAAFHIEEQRLVRL; QLAAFHIEEQRLVRLS; LAAFHIEEQRLVRLSP; AAFHIEEQRLVRLSPH; AFHIEEQRLVRLSPHH; FHIEEQRLVRLSPHHR; HIEEQRLVRLSPHHRE; IEEQRLVRLSPHHREY; EEQRLVRLSPHHREYL; EQRLVRLSPHHREYLQ; QRLVRLSPHHREYLQR; RLVRLSPHHREYLQRW; LVRLSPHHREYLQRWF; VRLSPHHREYLQRWFR; RLSPHHREYLQRWFRG | |
| 56)<br>Rv3019c | 13 mers:<br>MSQIMYNYPAMMA; SQIMYNYPAMMAH; QIMYNYPAMMAHA; | 99122-<br>99451 |

Fig. 29 continued

IMYNYPAMMAHAG; MYNYPAMMAHAGD; YNYPAMMAHAGDM;
NYPAMMAHAGDMA; YPAMMAHAGDMAG; PAMMAHAGDMAGY;
AMMAHAGDMAGYA; MMAHAGDMAGYAG; MAHAGDMAGYAGT;
AHAGDMAGYAGTL; HAGDMAGYAGTLQ; AGDMAGYAGTLQS;
GDMAGYAGTLQSL; DMAGYAGTLQSLG; MAGYAGTLQSLGA;
AGYAGTLQSLGAD; GYAGTLQSLGADI; YAGTLQSLGADIA; AGTLQSLGADIAS;
GTLQSLGADIASE; TLQSLGADIASEQ; LQSLGADIASEQA; QSLGADIASEQAV;
SLGADIASEQAVL; LGADIASEQAVLS; GADIASEQAVLSS; ADIASEQAVLSSA;
DIASEQAVLSSAW; IASEQAVLSSAWQ; ASEQAVLSSAWQG;
SEQAVLSSAWQGD; EQAVLSSAWQGDT; QAVLSSAWQGDTG;
AVLSSAWQGDTGI; VLSSAWQGDTGIT; LSSAWQGDTGITY; SSAWQGDTGITYQ;
SAWQGDTGITYQG; AWQGDTGITYQGW; WQGDTGITYQGWQ;
QGDTGITYQGWQT; GDTGITYQGWQTQ; DTGITYQGWQTQW;
TGITYQGWQTQWN; GITYQGWQTQWNQ; ITYQGWQTQWNQA;
TYQGWQTQWNQAL; YQGWQTQWNQALE; QGWQTQWNQALED;
GWQTQWNQALEDL; WQTQWNQALEDLV; QTQWNQALEDLVR;
TQWNQALEDLVRA; QWNQALEDLVRAY; WNQALEDLVRAYQ;
NQALEDLVRAYQS; QALEDLVRAYQSM; ALEDLVRAYQSMS;
LEDLVRAYQSMSG; EDLVRAYQSMSGT; DLVRAYQSMSGTH;
LVRAYQSMSGTHE; VRAYQSMSGTHES; RAYQSMSGTHESN;
AYQSMSGTHESNT; YQSMSGTHESNTM; QSMSGTHESNTMA;
SMSGTHESNTMAM; MSGTHESNTMAML; SGTHESNTMAMLA;
GTHESNTMAMLAR; THESNTMAMLARD; HESNTMAMLARDG;
ESNTMAMLARDGA; SNTMAMLARDGAE; NTMAMLARDGAEA;
TMAMLARDGAEAA; MAMLARDGAEAAK; AMLARDGAEAAKW;
MLARDGAEAAKWG; LARDGAEAAKWGG;

14 mers:
MSQIMYNYPAMMAH; SQIMYNYPAMMAHA; QIMYNYPAMMAHAG;
IMYNYPAMMAHAGD; MYNYPAMMAHAGDM; YNYPAMMAHAGDMA;
NYPAMMAHAGDMAG; YPAMMAHAGDMAGY; PAMMAHAGDMAGYA;
AMMAHAGDMAGYAG; MMAHAGDMAGYAGT; MAHAGDMAGYAGTL;
AHAGDMAGYAGTLQ; HAGDMAGYAGTLQS; AGDMAGYAGTLQSL;
GDMAGYAGTLQSLG; DMAGYAGTLQSLGA; MAGYAGTLQSLGAD;
AGYAGTLQSLGADI; GYAGTLQSLGADIA; YAGTLQSLGADIAS;
AGTLQSLGADIASE; GTLQSLGADIASEQ; TLQSLGADIASEQA;
LQSLGADIASEQAV; QSLGADIASEQAVL; SLGADIASEQAVLS;
LGADIASEQAVLSS; GADIASEQAVLSSA; ADIASEQAVLSSAW;
DIASEQAVLSSAWQ; IASEQAVLSSAWQG; ASEQAVLSSAWQGD;
SEQAVLSSAWQGDT; EQAVLSSAWQGDTG; QAVLSSAWQGDTGI;
AVLSSAWQGDTGIT; VLSSAWQGDTGITY; LSSAWQGDTGITYQ;
SSAWQGDTGITYQG; SAWQGDTGITYQGW; AWQGDTGITYQGWQ;
WQGDTGITYQGWQT; QGDTGITYQGWQTQ; GDTGITYQGWQTQW;
DTGITYQGWQTQWN; TGITYQGWQTQWNQ; GITYQGWQTQWNQA;
ITYQGWQTQWNQAL; TYQGWQTQWNQALE; YQGWQTQWNQALED;
QGWQTQWNQALEDL; GWQTQWNQALEDLV; WQTQWNQALEDLVR;
QTQWNQALEDLVRA; TQWNQALEDLVRAY; QWNQALEDLVRAYQ;
WNQALEDLVRAYQS; NQALEDLVRAYQSM; QALEDLVRAYQSMS;
ALEDLVRAYQSMSG; LEDLVRAYQSMSGT; EDLVRAYQSMSGTH;
DLVRAYQSMSGTHE; LVRAYQSMSGTHES; VRAYQSMSGTHESN;
RAYQSMSGTHESNT; AYQSMSGTHESNTM; YQSMSGTHESNTMA;
QSMSGTHESNTMAM; SMSGTHESNTMAML; MSGTHESNTMAMLA;
SGTHESNTMAMLAR; GTHESNTMAMLARD; THESNTMAMLARDG;

Fig. 29 continued

| | | |
|---|---|---|
| | HESNTMAMLARDGA; ESNTMAMLARDGAE; SNTMAMLARDGAEA; NTMAMLARDGAEAA; TMAMLARDGAEAAK; MAMLARDGAEAAKW; AMLARDGAEAAKWG; MLARDGAEAAKWGG;<br><br>15 mers:<br>MSQIMYNYPAMMAHA; SQIMYNYPAMMAHAG; QIMYNYPAMMAHAGD; IMYNYPAMMAHAGDM; MYNYPAMMAHAGDMA; YNYPAMMAHAGDMAG; NYPAMMAHAGDMAGY; YPAMMAHAGDMAGYA; PAMMAHAGDMAGYAG; AMMAHAGDMAGYAGT; MMAHAGDMAGYAGTL; MAHAGDMAGYAGTLQ; AHAGDMAGYAGTLQS; HAGDMAGYAGTLQSL; AGDMAGYAGTLQSLG; GDMAGYAGTLQSLGA; DMAGYAGTLQSLGAD; MAGYAGTLQSLGADI; AGYAGTLQSLGADIA; GYAGTLQSLGADIAS; YAGTLQSLGADIASE; AGTLQSLGADIASEQ; GTLQSLGADIASEQA; TLQSLGADIASEQAV; LQSLGADIASEQAVL; QSLGADIASEQAVLS; SLGADIASEQAVLSS; LGADIASEQAVLSSA; GADIASEQAVLSSAW; ADIASEQAVLSSAWQ; DIASEQAVLSSAWQG; IASEQAVLSSAWQGD; ASEQAVLSSAWQGDT; SEQAVLSSAWQGDTG; EQAVLSSAWQGDTGI; QAVLSSAWQGDTGIT; AVLSSAWQGDTGITY; VLSSAWQGDTGITYQ; LSSAWQGDTGITYQG; SSAWQGDTGITYQGW; SAWQGDTGITYQGWQ; AWQGDTGITYQGWQT; WQGDTGITYQGWQTQ; QGDTGITYQGWQTQW; GDTGITYQGWQTQWN; DTGITYQGWQTQWNQ; TGITYQGWQTQWNQA; GITYQGWQTQWNQAL; ITYQGWQTQWNQALE; TYQGWQTQWNQALED; YQGWQTQWNQALEDL; QGWQTQWNQALEDLV; GWQTQWNQALEDLVR; WQTQWNQALEDLVRA; QTQWNQALEDLVRAY; TQWNQALEDLVRAYQ; QWNQALEDLVRAYQS; WNQALEDLVRAYQSM; NQALEDLVRAYQSMS; QALEDLVRAYQSMSG; ALEDLVRAYQSMSGT; LEDLVRAYQSMSGTH; EDLVRAYQSMSGTHE; DLVRAYQSMSGTHES; LVRAYQSMSGTHESN; VRAYQSMSGTHESNT; RAYQSMSGTHESNTM; AYQSMSGTHESNTMA; YQSMSGTHESNTMAM; QSMSGTHESNTMAML; SMSGTHESNTMAMLA; MSGTHESNTMAMLAR; SGTHESNTMAMLARD; GTHESNTMAMLARDG; THESNTMAMLARDGA; HESNTMAMLARDGAE; ESNTMAMLARDGAEA; SNTMAMLARDGAEAA; NTMAMLARDGAEAAK; TMAMLARDGAEAAKW; MAMLARDGAEAAKWG; AMLARDGAEAAKWGG;<br><br>16 mers:<br>MSQIMYNYPAMMAHAG; SQIMYNYPAMMAHAGD; QIMYNYPAMMAHAGDM; IMYNYPAMMAHAGDMA; MYNYPAMMAHAGDMAG; YNYPAMMAHAGDMAGY; NYPAMMAHAGDMAGYA; YPAMMAHAGDMAGYAG; PAMMAHAGDMAGYAGT; AMMAHAGDMAGYAGTL; MMAHAGDMAGYAGTLQ; MAHAGDMAGYAGTLQS; AHAGDMAGYAGTLQSL; HAGDMAGYAGTLQSLG; AGDMAGYAGTLQSLGA; GDMAGYAGTLQSLGAD; DMAGYAGTLQSLGADI; MAGYAGTLQSLGADIA; AGYAGTLQSLGADIAS; GYAGTLQSLGADIASE; YAGTLQSLGADIASEQ; AGTLQSLGADIASEQA; GTLQSLGADIASEQAV; TLQSLGADIASEQAVL; LQSLGADIASEQAVLS; QSLGADIASEQAVLSS; SLGADIASEQAVLSSA; LGADIASEQAVLSSAW; GADIASEQAVLSSAWQ; ADIASEQAVLSSAWQG; DIASEQAVLSSAWQGD; IASEQAVLSSAWQGDT; ASEQAVLSSAWQGDTG; SEQAVLSSAWQGDTGI; EQAVLSSAWQGDTGIT; QAVLSSAWQGDTGITY; AVLSSAWQGDTGITYQ; VLSSAWQGDTGITYQG; LSSAWQGDTGITYQGW; SSAWQGDTGITYQGWQ; SAWQGDTGITYQGWQT; AWQGDTGITYQGWQTQ; WQGDTGITYQGWQTQW; QGDTGITYQGWQTQWN; GDTGITYQGWQTQWNQ; DTGITYQGWQTQWNQA; TGITYQGWQTQWNQAL; GITYQGWQTQWNQALE; ITYQGWQTQWNQALED; TYQGWQTQWNQALEDL; YQGWQTQWNQALEDLV; QGWQTQWNQALEDLVR; GWQTQWNQALEDLVRA; WQTQWNQALEDLVRAY; | |

Fig. 29 continued

| | | |
|---|---|---|
| | QTQWNQALEDLVRAYQ; TQWNQALEDLVRAYQS; QWNQALEDLVRAYQSM; WNQALEDLVRAYQSMS; NQALEDLVRAYQSMSG; QALEDLVRAYQSMSGT; ALEDLVRAYQSMSGTH; LEDLVRAYQSMSGTHE; EDLVRAYQSMSGTHES; DLVRAYQSMSGTHESN; LVRAYQSMSGTHESNT; VRAYQSMSGTHESNTM; RAYQSMSGTHESNTMA; AYQSMSGTHESNTMAM; YQSMSGTHESNTMAML; QSMSGTHESNTMAMLA; SMSGTHESNTMAMLAR; MSGTHESNTMAMLARD; SGTHESNTMAMLARDG; GTHESNTMAMLARDGA; THESNTMAMLARDGAE; HESNTMAMLARDGAEA; ESNTMAMLARDGAEAA; SNTMAMLARDGAEAAK; NTMAMLARDGAEAAKW; TMAMLARDGAEAAKWG; MAMLARDGAEAAKWGG; | |
| 57) Rv3020c | 13 mers:<br>MSLLDAHIPQLIA; SLLDAHIPQLIAS; LLDAHIPQLIASH; LDAHIPQLIASHT; DAHIPQLIASHTA; AHIPQLIASHTAF; HIPQLIASHTAFA; IPQLIASHTAFAA; PQLIASHTAFAAK; QLIASHTAFAAKA; LIASHTAFAAKAG; IASHTAFAAKAGL; ASHTAFAAKAGLM; SHTAFAAKAGLMR; HTAFAAKAGLMRH; TAFAAKAGLMRHT; AFAAKAGLMRHTI; FAAKAGLMRHTIG; AAKAGLMRHTIGQ; AKAGLMRHTIGQA; KAGLMRHTIGQAE; AGLMRHTIGQAEQ; GLMRHTIGQAEQQ; LMRHTIGQAEQQA; MRHTIGQAEQQAM; RHTIGQAEQQAMS; HTIGQAEQQAMSA; TIGQAEQQAMSAQ; IGQAEQQAMSAQA; GQAEQQAMSAQAF; QAEQQAMSAQAFH; AEQQAMSAQAFHQ; EQQAMSAQAFHQG; QQAMSAQAFHQGE; QAMSAQAFHQGES; AMSAQAFHQGESA; MSAQAFHQGESAA; SAQAFHQGESAAA; AQAFHQGESAAAF; QAFHQGESAAAFQ; AFHQGESAAAFQG; FHQGESAAAFQGA; HQGESAAAFQGAH; QGESAAAFQGAHA; GESAAAFQGAHAR; ESAAAFQGAHARF; SAAAFQGAHARFV; AAAFQGAHARFVA; AAFQGAHARFVAA; AFQGAHARFVAAA; FQGAHARFVAAAA; QGAHARFVAAAAK; GAHARFVAAAAKV; AHARFVAAAAKVN; HARFVAAAAKVNT; ARFVAAAAKVNTL; RFVAAAAKVNTLL; FVAAAAKVNTLLD; VAAAAKVNTLLDI; AAAAKVNTLLDIA; AAAKVNTLLDIAQ; AAKVNTLLDIAQA; AKVNTLLDIAQAN; KVNTLLDIAQANL; VNTLLDIAQANLG; NTLLDIAQANLGE; TLLDIAQANLGEA; LLDIAQANLGEAA; LDIAQANLGEAAG; DIAQANLGEAAGT; IAQANLGEAAGTY; AQANLGEAAGTYV; QANLGEAAGTYVA; ANLGEAAGTYVAA; NLGEAAGTYVAAD; LGEAAGTYVAADA; GEAAGTYVAADAA; EAAGTYVAADAAA; AAGTYVAADAAAA; AGTYVAADAAAAS; GTYVAADAAAASS; TYVAADAAAASSY; YVAADAAAASSYT; VAADAAAASSYTG; AADAAAASSYTGF;<br><br>14 mers:<br>MSLLDAHIPQLIAS; SLLDAHIPQLIASH; LLDAHIPQLIASHT; LDAHIPQLIASHTA; DAHIPQLIASHTAF; AHIPQLIASHTAFA; HIPQLIASHTAFAA; IPQLIASHTAFAAK; PQLIASHTAFAAKA; QLIASHTAFAAKAG; LIASHTAFAAKAGL; IASHTAFAAKAGLM; ASHTAFAAKAGLMR; SHTAFAAKAGLMRH; HTAFAAKAGLMRHT; TAFAAKAGLMRHTI; AFAAKAGLMRHTIG; FAAKAGLMRHTIGQ; AAKAGLMRHTIGQA; AKAGLMRHTIGQAE; KAGLMRHTIGQAEQ; AGLMRHTIGQAEQQ; GLMRHTIGQAEQQA; LMRHTIGQAEQQAM; MRHTIGQAEQQAMS; RHTIGQAEQQAMSA; HTIGQAEQQAMSAQ; TIGQAEQQAMSAQA; IGQAEQQAMSAQAF; GQAEQQAMSAQAFH; QAEQQAMSAQAFHQ; AEQQAMSAQAFHQG; EQQAMSAQAFHQGE; QQAMSAQAFHQGES; QAMSAQAFHQGESA; AMSAQAFHQGESAA; MSAQAFHQGESAAA; SAQAFHQGESAAAF; AQAFHQGESAAAFQ; QAFHQGESAAAFQG; AFHQGESAAAFQGA; FHQGESAAAFQGAH; HQGESAAAFQGAHA; QGESAAAFQGAHAR; GESAAAFQGAHARF; ESAAAFQGAHARFV; SAAAFQGAHARFVA; AAAFQGAHARFVAA; AAFQGAHARFVAAA; AFQGAHARFVAAAA; FQGAHARFVAAAAK; QGAHARFVAAAAKV; GAHARFVAAAAKVN; | 99452-99785 |

Fig. 29 continued

| | | |
|---|---|---|
| | AHARFVAAAAKVNT; HARFVAAAAKVNTL; ARFVAAAAKVNTLL;<br>RFVAAAAKVNTLLD; FVAAAAKVNTLLDI; VAAAAKVNTLLDIA;<br>AAAAKVNTLLDIAQ; AAAKVNTLLDIAQA; AAKVNTLLDIAQAN;<br>AKVNTLLDIAQANL; KVNTLLDIAQANLG; VNTLLDIAQANLGE;<br>NTLLDIAQANLGEA; TLLDIAQANLGEAA; LLDIAQANLGEAAG;<br>LDIAQANLGEAAGT; DIAQANLGEAAGTY; IAQANLGEAAGTYV;<br>AQANLGEAAGTYVA; QANLGEAAGTYVAA; ANLGEAAGTYVAAD;<br>NLGEAAGTYVAADA; LGEAAGTYVAADAA; GEAAGTYVAADAAA;<br>EAAGTYVAADAAAA; AAGTYVAADAAAAS; AGTYVAADAAAASS;<br>GTYVAADAAAASSY; TYVAADAAAASSYT; YVAADAAAASSYTG;<br>VAADAAAASSYTGF;<br><br>15 mers:<br>MSLLDAHIPQLIASH; SLLDAHIPQLIASHT; LLDAHIPQLIASHTA;<br>LDAHIPQLIASHTAF; DAHIPQLIASHTAFA; AHIPQLIASHTAFAA;<br>HIPQLIASHTAFAAK; IPQLIASHTAFAAKA; PQLIASHTAFAAKAG;<br>QLIASHTAFAAKAGL; LIASHTAFAAKAGLM; IASHTAFAAKAGLMR;<br>ASHTAFAAKAGLMRH; SHTAFAAKAGLMRHT; HTAFAAKAGLMRHTI;<br>TAFAAKAGLMRHTIG; AFAAKAGLMRHTIGQ; FAAKAGLMRHTIGQA;<br>AAKAGLMRHTIGQAE; AKAGLMRHTIGQAEQ; KAGLMRHTIGQAEQQ;<br>AGLMRHTIGQAEQQA; GLMRHTIGQAEQQAM; LMRHTIGQAEQQAMS;<br>MRHTIGQAEQQAMSA; RHTIGQAEQQAMSAQ; HTIGQAEQQAMSAQA;<br>TIGQAEQQAMSAQAF; IGQAEQQAMSAQAFH; GQAEQQAMSAQAFHQ;<br>QAEQQAMSAQAFHQG; AEQQAMSAQAFHQGE; EQQAMSAQAFHQGES;<br>QQAMSAQAFHQGESA; QAMSAQAFHQGESAA; AMSAQAFHQGESAAA;<br>MSAQAFHQGESAAAF; SAQAFHQGESAAAFQ; AQAFHQGESAAAFQG;<br>QAFHQGESAAAFQGA; AFHQGESAAAFQGAH; FHQGESAAAFQGAHA;<br>HQGESAAAFQGAHAR; QGESAAAFQGAHARF; GESAAAFQGAHARFV;<br>ESAAAFQGAHARFVA; SAAAFQGAHARFVAA; AAAFQGAHARFVAAA;<br>AAFQGAHARFVAAAA; AFQGAHARFVAAAAK; FQGAHARFVAAAAKV;<br>QGAHARFVAAAAKVN; GAHARFVAAAAKVNT; AHARFVAAAAKVNTL;<br>HARFVAAAAKVNTLL; ARFVAAAAKVNTLLD; RFVAAAAKVNTLLDI;<br>FVAAAAKVNTLLDIA; VAAAAKVNTLLDIAQ; AAAAKVNTLLDIAQA;<br>AAAKVNTLLDIAQAN; AAKVNTLLDIAQANL; AKVNTLLDIAQANLG;<br>KVNTLLDIAQANLGE; VNTLLDIAQANLGEA; NTLLDIAQANLGEAA;<br>TLLDIAQANLGEAAG; LLDIAQANLGEAAGT; LDIAQANLGEAAGTY;<br>DIAQANLGEAAGTYV; IAQANLGEAAGTYVA; AQANLGEAAGTYVAA;<br>QANLGEAAGTYVAAD; ANLGEAAGTYVAADA; NLGEAAGTYVAADAA;<br>LGEAAGTYVAADAAA; GEAAGTYVAADAAAA; EAAGTYVAADAAAAS;<br>AAGTYVAADAAAASS; AGTYVAADAAAASSY; GTYVAADAAAASSYT;<br>TYVAADAAAASSYTG; YVAADAAAASSYTGF;<br><br>16 mers:<br>MSLLDAHIPQLIASHT; SLLDAHIPQLIASHTA; LLDAHIPQLIASHTAF;<br>LDAHIPQLIASHTAFA; DAHIPQLIASHTAFAA; AHIPQLIASHTAFAAK;<br>HIPQLIASHTAFAAKA; IPQLIASHTAFAAKAG; PQLIASHTAFAAKAGL;<br>QLIASHTAFAAKAGLM; LIASHTAFAAKAGLMR; IASHTAFAAKAGLMRH;<br>ASHTAFAAKAGLMRHT; SHTAFAAKAGLMRHTI; HTAFAAKAGLMRHTIG;<br>TAFAAKAGLMRHTIGQ; AFAAKAGLMRHTIGQA; FAAKAGLMRHTIGQAE;<br>AAKAGLMRHTIGQAEQ; AKAGLMRHTIGQAEQQ; KAGLMRHTIGQAEQQA;<br>AGLMRHTIGQAEQQAM; GLMRHTIGQAEQQAMS; LMRHTIGQAEQQAMSA;<br>MRHTIGQAEQQAMSAQ; RHTIGQAEQQAMSAQA; HTIGQAEQQAMSAQAF;<br>TIGQAEQQAMSAQAFH; IGQAEQQAMSAQAFHQ; GQAEQQAMSAQAFHQG; | |

Fig. 29 continued

| | | |
|---|---|---|
| | QAEQQAMSAQAFHQGE; AEQQAMSAQAFHQGES; EQQAMSAQAFHQGESA; QQAMSAQAFHQGESAA; QAMSAQAFHQGESAAA; AMSAQAFHQGESAAAF; MSAQAFHQGESAAAFQ; SAQAFHQGESAAAFQG; AQAFHQGESAAAFQGA; QAFHQGESAAAFQGAH; AFHQGESAAAFQGAHA; FHQGESAAAFQGAHAR; HQGESAAAFQGAHARF; QGESAAAFQGAHARFV; GESAAAFQGAHARFVA; ESAAAFQGAHARFVAA; SAAAFQGAHARFVAAA; AAAFQGAHARFVAAAA; AAFQGAHARFVAAAAK; AFQGAHARFVAAAAKV; FQGAHARFVAAAAKVN; QGAHARFVAAAAKVNT; GAHARFVAAAAKVNTL; AHARFVAAAAKVNTLL; HARFVAAAAKVNTLLD; ARFVAAAAKVNTLLDI; RFVAAAAKVNTLLDIA; FVAAAAKVNTLLDIAQ; VAAAAKVNTLLDIAQA; AAAAKVNTLLDIAQAN; AAAKVNTLLDIAQANL; AAKVNTLLDIAQANLG; AKVNTLLDIAQANLGE; KVNTLLDIAQANLGEA; VNTLLDIAQANLGEAA; NTLLDIAQANLGEAAG; TLLDIAQANLGEAAGT; LLDIAQANLGEAAGTY; LDIAQANLGEAAGTYV; DIAQANLGEAAGTYVA; IAQANLGEAAGTYVAA; AQANLGEAAGTYVAAD; QANLGEAAGTYVAADA; ANLGEAAGTYVAADAA; NLGEAAGTYVAADAAA; LGEAAGTYVAADAAAA; GEAAGTYVAADAAAAS; EAAGTYVAADAAAASS; AAGTYVAADAAAASSY; AGTYVAADAAAASSYT; GTYVAADAAAASSYTG; TYVAADAAAASSYTGF; | |
| 58) Rv3287c | 13 mers: MADSDLPTKGRQR; ADSDLPTKGRQRG; DSDLPTKGRQRGV; SDLPTKGRQRGVR; DLPTKGRQRGVRA; LPTKGRQRGVRAV; PTKGRQRGVRAVE; TKGRQRGVRAVEL; KGRQRGVRAVELN; GRQRGVRAVELNV; RQRGVRAVELNVA; QRGVRAVELNVAA; RGVRAVELNVAAR; GVRAVELNVAARL; VRAVELNVAARLE; RAVELNVAARLEN; AVELNVAARLENL; VELNVAARLENLA; ELNVAARLENLAL; LNVAARLENLALL; NVAARLENLALLR; VAARLENLALLRT; AARLENLALLRTL; ARLENLALLRTLV; RLENLALLRTLVG; LENLALLRTLVGA; ENLALLRTLVGAI; NLALLRTLVGAIG; LALLRTLVGAIGT; ALLRTLVGAIGTF; LLRTLVGAIGTFE; LRTLVGAIGTFED; RTLVGAIGTFEDL; TLVGAIGTFEDLD; LVGAIGTFEDLDF; VGAIGTFEDLDFD; GAIGTFEDLDFDA; AIGTFEDLDFDAV; IGTFEDLDFDAVA; GTFEDLDFDAVAD; TFEDLDFDAVADL; FEDLDFDAVADLR; EDLDFDAVADLRL; DLDFDAVADLRLA; LDFDAVADLRLAV; DFDAVADLRLAVD; FDAVADLRLAVDE; DAVADLRLAVDEV; AVADLRLAVDEVC; VADLRLAVDEVCT; ADLRLAVDEVCTR; DLRLAVDEVCTRL; LRLAVDEVCTRLI; RLAVDEVCTRLIR; LAVDEVCTRLIRS; AVDEVCTRLIRSA; VDEVCTRLIRSAL; DEVCTRLIRSALP; EVCTRLIRSALPD; VCTRLIRSALPDA; CTRLIRSALPDAT; TRLIRSALPDATL; RLIRSALPDATLR; LIRSALPDATLRL; IRSALPDATLRLV; RSALPDATLRLVV; SALPDATLRLVVD; ALPDATLRLVVDP; LPDATLRLVVDPR; PDATLRLVVDPRK; DATLRLVVDPRKD; ATLRLVVDPRKDE; TLRLVVDPRKDEV; LRLVVDPRKDEVV; RLVVDPRKDEVVV; LVVDPRKDEVVVE; VVDPRKDEVVVEA; VDPRKDEVVVEAS; DPRKDEVVVEASA; PRKDEVVVEASAA; RKDEVVVEASAAC; KDEVVVEASAACD; DEVVVEASAACDT; EVVVEASAACDTH; VVVEASAACDTHD; VVEASAACDTHDV; VEASAACDTHDVV; EASAACDTHDVVA; ASAACDTHDVVAP; SAACDTHDVVAPG; AACDTHDVVAPGS; ACDTHDVVAPGSF; CDTHDVVAPGSFS; DTHDVVAPGSFSW; THDVVAPGSFSWH; HDVVAPGSFSWHV; DVVAPGSFSWHVL; VVAPGSFSWHVLT; VAPGSFSWHVLTA; APGSFSWHVLTAL; PGSFSWHVLTALA; GSFSWHVLTALAD; SFSWHVLTALADD; FSWHVLTALADDV; SWHVLTALADDVQ; WHVLTALADDVQT; HVLTALADDVQTF; VLTALADDVQTFH; LTALADDVQTFHD; TALADDVQTFHDG; ALADDVQTFHDGR; LADDVQTFHDGRQ; ADDVQTFHDGRQP; DDVQTFHDGRQPD; DVQTFHDGRQPDV; VQTFHDGRQPDVA; QTFHDGRQPDVAG; TFHDGRQPDVAGS; FHDGRQPDVAGSV; HDGRQPDVAGSVF; DGRQPDVAGSVFG; GRQPDVAGSVFGI; RQPDVAGSVFGIT; QPDVAGSVFGITL; PDVAGSVFGITLT; | 99786-100311 |

Fig. 29 continued

| | | |
|---|---|---|
| | DVAGSVFGITLTA; VAGSVFGITLTAR; AGSVFGITLTARR; GSVFGITLTARRA; SVFGITLTARRAA; VFGITLTARRAAS; FGITLTARRAASS; GITLTARRAASSR<br><br>14 mers:<br>MADSDLPTKGRQRG; ADSDLPTKGRQRGV; DSDLPTKGRQRGVR; SDLPTKGRQRGVRA; DLPTKGRQRGVRAV; LPTKGRQRGVRAVE; PTKGRQRGVRAVEL; TKGRQRGVRAVELN; KGRQRGVRAVELNV; GRQRGVRAVELNVA; RQRGVRAVELNVAA; QRGVRAVELNVAAR; RGVRAVELNVAARL; GVRAVELNVAARLE; VRAVELNVAARLEN; RAVELNVAARLENL; AVELNVAARLENLA; VELNVAARLENLAL; ELNVAARLENLALL; LNVAARLENLALLR; NVAARLENLALLRT; VAARLENLALLRTL; AARLENLALLRTLV; ARLENLALLRTLVG; RLENLALLRTLVGA; LENLALLRTLVGAI; ENLALLRTLVGAIG; NLALLRTLVGAIGT; LALLRTLVGAIGTF; ALLRTLVGAIGTFE; LLRTLVGAIGTFED; LRTLVGAIGTFEDL; RTLVGAIGTFEDLD; TLVGAIGTFEDLDF; LVGAIGTFEDLDFD; VGAIGTFEDLDFDA; GAIGTFEDLDFDAV; AIGTFEDLDFDAVA; IGTFEDLDFDAVAD; GTFEDLDFDAVADL; TFEDLDFDAVADLR; FEDLDFDAVADLRL; EDLDFDAVADLRLA; DLDFDAVADLRLAV; LDFDAVADLRLAVD; DFDAVADLRLAVDE; FDAVADLRLAVDEV; DAVADLRLAVDEVC; AVADLRLAVDEVCT; VADLRLAVDEVCTR; ADLRLAVDEVCTRL; DLRLAVDEVCTRLI; LRLAVDEVCTRLIR; RLAVDEVCTRLIRS; LAVDEVCTRLIRSA; AVDEVCTRLIRSAL; VDEVCTRLIRSALP; DEVCTRLIRSALPD; EVCTRLIRSALPDA; VCTRLIRSALPDAT; CTRLIRSALPDATL; TRLIRSALPDATLR; RLIRSALPDATLRL; LIRSALPDATLRLV; IRSALPDATLRLVV; RSALPDATLRLVVD; SALPDATLRLVVDP; ALPDATLRLVVDPR; LPDATLRLVVDPRK; PDATLRLVVDPRKD; DATLRLVVDPRKDE; ATLRLVVDPRKDEV; TLRLVVDPRKDEVV; LRLVVDPRKDEVVV; RLVVDPRKDEVVVE; LVVDPRKDEVVVEA; VVDPRKDEVVVEAS; VDPRKDEVVVEASA; DPRKDEVVVEASAA; PRKDEVVVEASAAC; RKDEVVVEASAACD; KDEVVVEASAACDT; DEVVVEASAACDTH; EVVVEASAACDTHD; VVVEASAACDTHDV; VVEASAACDTHDVV; VEASAACDTHDVVA; EASAACDTHDVVAP; ASAACDTHDVVAPG; SAACDTHDVVAPGS; AACDTHDVVAPGSF; ACDTHDVVAPGSFS; CDTHDVVAPGSFSW; DTHDVVAPGSFSWH; THDVVAPGSFSWHV; HDVVAPGSFSWHVL; DVVAPGSFSWHVLT; VVAPGSFSWHVLTA; VAPGSFSWHVLTAL; APGSFSWHVLTALA; PGSFSWHVLTALAD; GSFSWHVLTALADD; SFSWHVLTALADDV; FSWHVLTALADDVQ; SWHVLTALADDVQT; WHVLTALADDVQTF; HVLTALADDVQTFH; VLTALADDVQTFHD; LTALADDVQTFHDG; TALADDVQTFHDGR; ALADDVQTFHDGRQ; LADDVQTFHDGRQP; ADDVQTFHDGRQPD; DDVQTFHDGRQPDV; DVQTFHDGRQPDVA; VQTFHDGRQPDVAG; QTFHDGRQPDVAGS; TFHDGRQPDVAGSV; FHDGRQPDVAGSVF; HDGRQPDVAGSVFG; DGRQPDVAGSVFGI; GRQPDVAGSVFGIT; RQPDVAGSVFGITL; QPDVAGSVFGITLT; PDVAGSVFGITLTA; DVAGSVFGITLTAR; VAGSVFGITLTARR; AGSVFGITLTARRA; GSVFGITLTARRAA; SVFGITLTARRAAS; VFGITLTARRAASS; FGITLTARRAASSR<br><br>15 mers:<br>MADSDLPTKGRQRGV; ADSDLPTKGRQRGVR; DSDLPTKGRQRGVRA; SDLPTKGRQRGVRAV; DLPTKGRQRGVRAVE; LPTKGRQRGVRAVEL; PTKGRQRGVRAVELN; TKGRQRGVRAVELNV; KGRQRGVRAVELNVA; GRQRGVRAVELNVAA; RQRGVRAVELNVAAR; QRGVRAVELNVAARL; | |

Fig. 29 continued

| | | |
|---|---|---|
| | RGVRAVELNVAARLE; GVRAVELNVAARLEN; VRAVELNVAARLENL;<br>RAVELNVAARLENLA; AVELNVAARLENLAL; VELNVAARLENLALL;<br>ELNVAARLENLALLR; LNVAARLENLALLRT; NVAARLENLALLRTL;<br>VAARLENLALLRTLV; AARLENLALLRTLVG; ARLENLALLRTLVGA;<br>RLENLALLRTLVGAI; LENLALLRTLVGAIG; ENLALLRTLVGAIGT;<br>NLALLRTLVGAIGTF; LALLRTLVGAIGTFE; ALLRTLVGAIGTFED;<br>LLRTLVGAIGTFEDL; LRTLVGAIGTFEDLD; RTLVGAIGTFEDLDF;<br>TLVGAIGTFEDLDFD; LVGAIGTFEDLDFDA; VGAIGTFEDLDFDAV;<br>GAIGTFEDLDFDAVA; AIGTFEDLDFDAVAD; IGTFEDLDFDAVADL;<br>GTFEDLDFDAVADLR; TFEDLDFDAVADLRL; FEDLDFDAVADLRLA;<br>EDLDFDAVADLRLAV; DLDFDAVADLRLAVD; LDFDAVADLRLAVDE;<br>DFDAVADLRLAVDEV; FDAVADLRLAVDEVC; DAVADLRLAVDEVCT;<br>AVADLRLAVDEVCTR; VADLRLAVDEVCTRL; ADLRLAVDEVCTRLI;<br>DLRLAVDEVCTRLIR; LRLAVDEVCTRLIRS; RLAVDEVCTRLIRSA;<br>LAVDEVCTRLIRSAL; AVDEVCTRLIRSALP; VDEVCTRLIRSALPD;<br>DEVCTRLIRSALPDA; EVCTRLIRSALPDAT; VCTRLIRSALPDATL;<br>CTRLIRSALPDATLR; TRLIRSALPDATLRL; RLIRSALPDATLRLV;<br>LIRSALPDATLRLVV; IRSALPDATLRLVVD; RSALPDATLRLVVDP;<br>SALPDATLRLVVDPR; ALPDATLRLVVDPRK; LPDATLRLVVDPRKD;<br>PDATLRLVVDPRKDE; DATLRLVVDPRKDEV; ATLRLVVDPRKDEVV;<br>TLRLVVDPRKDEVVV; LRLVVDPRKDEVVVE; RLVVDPRKDEVVVEA;<br>LVVDPRKDEVVVEAS; VVDPRKDEVVVEASA; VDPRKDEVVVEASAA;<br>DPRKDEVVVEASAAC; PRKDEVVVEASAACD; RKDEVVVEASAACDT;<br>KDEVVVEASAACDTH; DEVVVEASAACDTHD; EVVVEASAACDTHDV;<br>VVVEASAACDTHDVV; VVEASAACDTHDVVA; VEASAACDTHDVVAP;<br>EASAACDTHDVVAPG; ASAACDTHDVVAPGS; SAACDTHDVVAPGSF;<br>AACDTHDVVAPGSFS; ACDTHDVVAPGSFSW; CDTHDVVAPGSFSWH;<br>DTHDVVAPGSFSWHV; THDVVAPGSFSWHVL; HDVVAPGSFSWHVLT;<br>DVVAPGSFSWHVLTA; VVAPGSFSWHVLTAL; VAPGSFSWHVLTALA;<br>APGSFSWHVLTALAD; PGSFSWHVLTALADD; GSFSWHVLTALADDV;<br>SFSWHVLTALADDVQ; FSWHVLTALADDVQT; SWHVLTALADDVQTF;<br>WHVLTALADDVQTFH; HVLTALADDVQTFHD; VLTALADDVQTFHDG;<br>LTALADDVQTFHDGR; TALADDVQTFHDGRQ; ALADDVQTFHDGRQP;<br>LADDVQTFHDGRQPD; ADDVQTFHDGRQPDV; DDVQTFHDGRQPDVA;<br>DVQTFHDGRQPDVAG; VQTFHDGRQPDVAGS; QTFHDGRQPDVAGSV;<br>TFHDGRQPDVAGSVF; FHDGRQPDVAGSVFG; HDGRQPDVAGSVFGI;<br>DGRQPDVAGSVFGIT; GRQPDVAGSVFGITL; RQPDVAGSVFGITLT;<br>QPDVAGSVFGITLTA; PDVAGSVFGITLTAR; DVAGSVFGITLTARR;<br>VAGSVFGITLTARRA; AGSVFGITLTARRAA; GSVFGITLTARRAAS;<br>SVFGITLTARRAASS; VFGITLTARRAASSR<br><br>16 mers:<br>MADSDLPTKGRQRGVR; ADSDLPTKGRQRGVRA; DSDLPTKGRQRGVRAV;<br>SDLPTKGRQRGVRAVE; DLPTKGRQRGVRAVEL; LPTKGRQRGVRAVELN;<br>PTKGRQRGVRAVELNV; TKGRQRGVRAVELNVA; KGRQRGVRAVELNVAA;<br>GRQRGVRAVELNVAAR; RQRGVRAVELNVAARL; QRGVRAVELNVAARLE;<br>RGVRAVELNVAARLEN; GVRAVELNVAARLENL; VRAVELNVAARLENLA;<br>RAVELNVAARLENLAL; AVELNVAARLENLALL; VELNVAARLENLALLR;<br>ELNVAARLENLALLRT; LNVAARLENLALLRTL; NVAARLENLALLRTLV;<br>VAARLENLALLRTLVG; AARLENLALLRTLVGA; ARLENLALLRTLVGAI;<br>RLENLALLRTLVGAIG; LENLALLRTLVGAIGT; ENLALLRTLVGAIGTF;<br>NLALLRTLVGAIGTFE; LALLRTLVGAIGTFED; ALLRTLVGAIGTFEDL;<br>LLRTLVGAIGTFEDLD; LRTLVGAIGTFEDLDF; RTLVGAIGTFEDLDFD; | |

Fig. 29 continued

| | | |
|---|---|---|
| | TLVGAIGTFEDLDFDA; LVGAIGTFEDLDFDAV; VGAIGTFEDLDFDAVA; GAIGTFEDLDFDAVAD; AIGTFEDLDFDAVADL; IGTFEDLDFDAVADLR; GTFEDLDFDAVADLRL; TFEDLDFDAVADLRLA; FEDLDFDAVADLRLAV; EDLDFDAVADLRLAVD; DLDFDAVADLRLAVDE; LDFDAVADLRLAVDEV; DFDAVADLRLAVDEVC; FDAVADLRLAVDEVCT; DAVADLRLAVDEVCTR; AVADLRLAVDEVCTRL; VADLRLAVDEVCTRLI; ADLRLAVDEVCTRLIR; DLRLAVDEVCTRLIRS; LRLAVDEVCTRLIRSA; RLAVDEVCTRLIRSAL; LAVDEVCTRLIRSALP; AVDEVCTRLIRSALPD; VDEVCTRLIRSALPDA; DEVCTRLIRSALPDAT; EVCTRLIRSALPDATL; VCTRLIRSALPDATLR; CTRLIRSALPDATLRL; TRLIRSALPDATLRLV; RLIRSALPDATLRLVV; LIRSALPDATLRLVVD; IRSALPDATLRLVVDP; RSALPDATLRLVVDPR; SALPDATLRLVVDPRK; ALPDATLRLVVDPRKD; LPDATLRLVVDPRKDE; PDATLRLVVDPRKDEV; DATLRLVVDPRKDEVV; ATLRLVVDPRKDEVVV; TLRLVVDPRKDEVVVE; LRLVVDPRKDEVVVEA; RLVVDPRKDEVVVEAS; LVVDPRKDEVVVEASA; VVDPRKDEVVVEASAA; VDPRKDEVVVEASAAC; DPRKDEVVVEASAACD; PRKDEVVVEASAACDT; RKDEVVVEASAACDTH; KDEVVVEASAACDTHD; DEVVVEASAACDTHDV; EVVVEASAACDTHDVV; VVVEASAACDTHDVVA; VVEASAACDTHDVVAP; VEASAACDTHDVVAPG; EASAACDTHDVVAPGS; ASAACDTHDVVAPGSF; SAACDTHDVVAPGSFS; AACDTHDVVAPGSFSW; ACDTHDVVAPGSFSWH; CDTHDVVAPGSFSWHV; DTHDVVAPGSFSWHVL; THDVVAPGSFSWHVLT; HDVVAPGSFSWHVLTA; DVVAPGSFSWHVLTAL; VVAPGSFSWHVLTALA; VAPGSFSWHVLTALAD; APGSFSWHVLTALADD; PGSFSWHVLTALADDV; GSFSWHVLTALADDVQ; SFSWHVLTALADDVQT; FSWHVLTALADDVQTF; SWHVLTALADDVQTFH; WHVLTALADDVQTFHD; HVLTALADDVQTFHDG; VLTALADDVQTFHDGR; LTALADDVQTFHDGRQ; TALADDVQTFHDGRQP; ALADDVQTFHDGRQPD; LADDVQTFHDGRQPDV; ADDVQTFHDGRQPDVA; DDVQTFHDGRQPDVAG; DVQTFHDGRQPDVAGS; VQTFHDGRQPDVAGSV; QTFHDGRQPDVAGSVF; TFHDGRQPDVAGSVFG; FHDGRQPDVAGSVFGI; HDGRQPDVAGSVFGIT; DGRQPDVAGSVFGITL; GRQPDVAGSVFGITLT; RQPDVAGSVFGITLTA; QPDVAGSVFGITLTAR; PDVAGSVFGITLTARR; DVAGSVFGITLTARRA; VAGSVFGITLTARRAA; AGSVFGITLTARRAAS; GSVFGITLTARRAASS; SVFGITLTARRAASSR | |
| 59) Rv3288c | 13 mers: MGQIPPQPVRRVL; GQIPPQPVRRVLP; QIPPQPVRRVLPL; IPPQPVRRVLPLM; PPQPVRRVLPLMV; PQPVRRVLPLMVV; QPVRRVLPLMVVP; PVRRVLPLMVVPG; VRRVLPLMVVPGN; RRVLPLMVVPGNG; RVLPLMVVPGNGQ; VLPLMVVPGNGQK; LPLMVVPGNGQKW; PLMVVPGNGQKWR; LMVVPGNGQKWRN; MVVPGNGQKWRNR; VVPGNGQKWRNRT; VPGNGQKWRNRTE; PGNGQKWRNRTET; GNGQKWRNRTETE; NGQKWRNRTETEE; GQKWRNRTETEEA; QKWRNRTETEEAM; KWRNRTETEEAMG; WRNRTETEEAMGD; RNRTETEEAMGDT; NRTETEEAMGDTY; RTETEEAMGDTYR; TETEEAMGDTYRD; ETEEAMGDTYRDP; TEEAMGDTYRDPV; EEAMGDTYRDPVD; EAMGDTYRDPVDH; AMGDTYRDPVDHL; MGDTYRDPVDHLR; GDTYRDPVDHLRT; DTYRDPVDHLRTT; TYRDPVDHLRTTR; YRDPVDHLRTTRP; RDPVDHLRTTRPL; DPVDHLRTTRPLA; PVDHLRTTRPLAG; VDHLRTTRPLAGE; DHLRTTRPLAGES; HLRTTRPLAGESL; LRTTRPLAGESLI; RTTRPLAGESLID; TTRPLAGESLIDV; TRPLAGESLIDVV; RPLAGESLIDVVH; PLAGESLIDVVHW; LAGESLIDVVHWP; AGESLIDVVHWPG; GESLIDVVHWPGY; ESLIDVVHWPGYL; SLIDVVHWPGYLL; LIDVVHWPGYLLI; IDVVHWPGYLLIV; DVVHWPGYLLIVA; VVHWPGYLLIVAG; VHWPGYLLIVAGV; HWPGYLLIVAGVV; WPGYLLIVAGVVG; PGYLLIVAGVVGG; GYLLIVAGVVGGV; YLLIVAGVVGGVG; LLIVAGVVGGVGA; | 100312-100805 |

Fig. 29 continued

| | | |
|---|---|---|
| | LIVAGVVGGVGAL; IVAGVVGGVGALA; VAGVVGGVGALAA; AGVVGGVGALAAF;<br>GVVGGVGALAAFG; VVGGVGALAAFGT; VGGVGALAAFGTG;<br>GGVGALAAFGTGH; GVGALAAFGTGHH; VGALAAFGTGHHA;<br>GALAAFGTGHHAE; ALAAFGTGHHAEG; LAAFGTGHHAEGM;<br>AAFGTGHHAEGMT; AFGTGHHAEGMTF; FGTGHHAEGMTFG;<br>GTGHHAEGMTFGV; TGHHAEGMTFGVV; GHHAEGMTFGVVA;<br>HHAEGMTFGVVAI; HAEGMTFGVVAIV; AEGMTFGVVAIVV; EGMTFGVVAIVVT;<br>GMTFGVVAIVVTV; MTFGVVAIVVTVV; TFGVVAIVVTVVG; FGVVAIVVTVVGL;<br>GVVAIVVTVVGLA; VVAIVVTVVGLAW; VAIVVTVVGLAWL; AIVVTVVGLAWLA;<br>IVVTVVGLAWLAF; VVTVVGLAWLAFE; VTVVGLAWLAFEH; TVVGLAWLAFEHR;<br>VVGLAWLAFEHRR; VGLAWLAFEHRRI; GLAWLAFEHRRIR; LAWLAFEHRRIRK;<br>AWLAFEHRRIRKI; WLAFEHRRIRKIA; LAFEHRRIRKIAD; AFEHRRIRKIADR;<br>FEHRRIRKIADRW; EHRRIRKIADRWY; HRRIRKIADRWYT; RRIRKIADRWYTE;<br>RIRKIADRWYTEH; IRKIADRWYTEHP; RKIADRWYTEHPE; KIADRWYTEHPEV;<br>IADRWYTEHPEVR; ADRWYTEHPEVRR; DRWYTEHPEVRRQ;<br>RWYTEHPEVRRQR; WYTEHPEVRRQRL; YTEHPEVRRQRLA;<br>TEHPEVRRQRLAG<br><br>14 mers:<br>MGQIPPQPVRRVLP; GQIPPQPVRRVLPL; QIPPQPVRRVLPLM;<br>IPPQPVRRVLPLMV; PPQPVRRVLPLMVV; PQPVRRVLPLMVVP;<br>QPVRRVLPLMVVPG; PVRRVLPLMVVPGN; VRRVLPLMVVPGNG;<br>RRVLPLMVVPGNGQ; RVLPLMVVPGNGQK; VLPLMVVPGNGQKW;<br>LPLMVVPGNGQKWR; PLMVVPGNGQKWRN; LMVVPGNGQKWRNR;<br>MVVPGNGQKWRNRT; VVPGNGQKWRNRTE; VPGNGQKWRNRTET;<br>PGNGQKWRNRTETE; GNGQKWRNRTETEE; NGQKWRNRTETEEA;<br>GQKWRNRTETEEAM; QKWRNRTETEEAMG; KWRNRTETEEAMGD;<br>WRNRTETEEAMGDT; RNRTETEEAMGDTY; NRTETEEAMGDTYR;<br>RTETEEAMGDTYRD; TETEEAMGDTYRDP; ETEEAMGDTYRDPV;<br>TEEAMGDTYRDPVD; EEAMGDTYRDPVDH; EAMGDTYRDPVDHL;<br>AMGDTYRDPVDHLR; MGDTYRDPVDHLRT; GDTYRDPVDHLRTT;<br>DTYRDPVDHLRTTR; TYRDPVDHLRTTRP; YRDPVDHLRTTRPL;<br>RDPVDHLRTTRPLA; DPVDHLRTTRPLAG; PVDHLRTTRPLAGE;<br>VDHLRTTRPLAGES; DHLRTTRPLAGESL; HLRTTRPLAGESLI;<br>LRTTRPLAGESLID; RTTRPLAGESLIDV; TTRPLAGESLIDVV;<br>TRPLAGESLIDVVH; RPLAGESLIDVVHW; PLAGESLIDVVHWP;<br>LAGESLIDVVHWPG; AGESLIDVVHWPGY; GESLIDVVHWPGYL;<br>ESLIDVVHWPGYLL; SLIDVVHWPGYLLI; LIDVVHWPGYLLIV; IDVVHWPGYLLIVA;<br>DVVHWPGYLLIVAG; VVHWPGYLLIVAGV; VHWPGYLLIVAGVV;<br>HWPGYLLIVAGVVG; WPGYLLIVAGVVGG; PGYLLIVAGVVGGV;<br>GYLLIVAGVVGGVG; YLLIVAGVVGGVGA; LLIVAGVVGGVGAL;<br>LIVAGVVGGVGALA; IVAGVVGGVGALAA; VAGVVGGVGALAAF;<br>AGVVGGVGALAAFG; GVVGGVGALAAFGT; VVGGVGALAAFGTG;<br>VGGVGALAAFGTGH; GGVGALAAFGTGHH; GVGALAAFGTGHHA;<br>VGALAAFGTGHHAE; GALAAFGTGHHAEG; ALAAFGTGHHAEGM;<br>LAAFGTGHHAEGMT; AAFGTGHHAEGMTF; AFGTGHHAEGMTFG;<br>FGTGHHAEGMTFGV; GTGHHAEGMTFGVV; TGHHAEGMTFGVVA;<br>GHHAEGMTFGVVAI; HHAEGMTFGVVAIV; HAEGMTFGVVAIVV;<br>AEGMTFGVVAIVVT; EGMTFGVVAIVVTV; GMTFGVVAIVVTVV;<br>MTFGVVAIVVTVVG; TFGVVAIVVTVVGL; FGVVAIVVTVVGLA;<br>GVVAIVVTVVGLAW; VVAIVVTVVGLAWL; VAIVVTVVGLAWLA;<br>AIVVTVVGLAWLAF; IVVTVVGLAWLAFE; VVTVVGLAWLAFEH;<br>VTVVGLAWLAFEHR; TVVGLAWLAFEHRR; VVGLAWLAFEHRRI; | |

Fig. 29 continued

| | | |
|---|---|---|
| | VGLAWLAFEHRRIR; GLAWLAFEHRRIRK; LAWLAFEHRRIRKI; AWLAFEHRRIRKIA; WLAFEHRRIRKIAD; LAFEHRRIRKIADR; AFEHRRIRKIADRW; FEHRRIRKIADRWY; EHRRIRKIADRWYT; HRRIRKIADRWYTE; RRIRKIADRWYTEH; RIRKIADRWYTEHP; IRKIADRWYTEHPE; RKIADRWYTEHPEV; KIADRWYTEHPEVR; IADRWYTEHPEVRR; ADRWYTEHPEVRRQ; DRWYTEHPEVRRQR; RWYTEHPEVRRQRL; WYTEHPEVRRQRLA; YTEHPEVRRQRLAG<br><br>15 mers:<br>MGQIPPQPVRRVLPL; GQIPPQPVRRVLPLM; QIPPQPVRRVLPLMV; IPPQPVRRVLPLMVV; PPQPVRRVLPLMVVP; PQPVRRVLPLMVVPG; QPVRRVLPLMVVPGN; PVRRVLPLMVVPGNG; VRRVLPLMVVPGNGQ; RRVLPLMVVPGNGQK; RVLPLMVVPGNGQKW; VLPLMVVPGNGQKWR; LPLMVVPGNGQKWRN; PLMVVPGNGQKWRNR; LMVVPGNGQKWRNRT; MVVPGNGQKWRNRTE; VVPGNGQKWRNRTET; VPGNGQKWRNRTETE; PGNGQKWRNRTETEE; GNGQKWRNRTETEEA; NGQKWRNRTETEEAM; GQKWRNRTETEEAMG; QKWRNRTETEEAMGD; KWRNRTETEEAMGDT; WRNRTETEEAMGDTY; RNRTETEEAMGDTYR; NRTETEEAMGDTYRD; RTETEEAMGDTYRDP; TETEEAMGDTYRDPV; ETEEAMGDTYRDPVD; TEEAMGDTYRDPVDH; EEAMGDTYRDPVDHL; EAMGDTYRDPVDHLR; AMGDTYRDPVDHLRT; MGDTYRDPVDHLRTT; GDTYRDPVDHLRTTR; DTYRDPVDHLRTTRP; TYRDPVDHLRTTRPL; YRDPVDHLRTTRPLA; RDPVDHLRTTRPLAG; DPVDHLRTTRPLAGE; PVDHLRTTRPLAGES; VDHLRTTRPLAGESL; DHLRTTRPLAGESLI; HLRTTRPLAGESLID; LRTTRPLAGESLIDV; RTTRPLAGESLIDVV; TTRPLAGESLIDVVH; TRPLAGESLIDVVHW; RPLAGESLIDVVHWP; PLAGESLIDVVHWPG; LAGESLIDVVHWPGY; AGESLIDVVHWPGYL; GESLIDVVHWPGYLL; ESLIDVVHWPGYLLI; SLIDVVHWPGYLLIV; LIDVVHWPGYLLIVA; IDVVHWPGYLLIVAG; DVVHWPGYLLIVAGV; VVHWPGYLLIVAGVV; VHWPGYLLIVAGVVG; HWPGYLLIVAGVVGG; WPGYLLIVAGVVGGV; PGYLLIVAGVVGGVG; GYLLIVAGVVGGVGA; YLLIVAGVVGGVGAL; LLIVAGVVGGVGALA; LIVAGVVGGVGALAA; IVAGVVGGVGALAAF; VAGVVGGVGALAAFG; AGVVGGVGALAAFGT; GVVGGVGALAAFGTG; VVGGVGALAAFGTGH; VGGVGALAAFGTGHH; GGVGALAAFGTGHHA; GVGALAAFGTGHHAE; VGALAAFGTGHHAEG; GALAAFGTGHHAEGM; ALAAFGTGHHAEGMT; LAAFGTGHHAEGMTF; AAFGTGHHAEGMTFG; AFGTGHHAEGMTFGV; FGTGHHAEGMTFGVV; GTGHHAEGMTFGVVA; TGHHAEGMTFGVVAI; GHHAEGMTFGVVAIV; HHAEGMTFGVVAIVV; HAEGMTFGVVAIVVT; AEGMTFGVVAIVVTV; EGMTFGVVAIVVTVV; GMTFGVVAIVVTVVG; MTFGVVAIVVTVVGL; TFGVVAIVVTVVGLA; FGVVAIVVTVVGLAW; GVVAIVVTVVGLAWL; VVAIVVTVVGLAWLA; VAIVVTVVGLAWLAF; AIVVTVVGLAWLAFE; IVVTVVGLAWLAFEH; VVTVVGLAWLAFEHR; VTVVGLAWLAFEHRR; TVVGLAWLAFEHRRI; VVGLAWLAFEHRRIR; VGLAWLAFEHRRIRK; GLAWLAFEHRRIRKI; LAWLAFEHRRIRKIA; AWLAFEHRRIRKIAD; WLAFEHRRIRKIADR; LAFEHRRIRKIADRW; AFEHRRIRKIADRWY; FEHRRIRKIADRWYT; EHRRIRKIADRWYTE; HRRIRKIADRWYTEH; RRIRKIADRWYTEHP; RIRKIADRWYTEHPE; IRKIADRWYTEHPEV; RKIADRWYTEHPEVR; KIADRWYTEHPEVRR; IADRWYTEHPEVRRQ; ADRWYTEHPEVRRQR; DRWYTEHPEVRRQRL; RWYTEHPEVRRQRLA; WYTEHPEVRRQRLAG<br><br>16 mers:<br>MGQIPPQPVRRVLPLM; GQIPPQPVRRVLPLMV; QIPPQPVRRVLPLMVV; | |

Fig. 29 continued

| | | |
|---|---|---|
| | IPPQPVRRVLPLMVVP; PPQPVRRVLPLMVVPG; PQPVRRVLPLMVVPGN; QPVRRVLPLMVVPGNG; PVRRVLPLMVVPGNGQ; VRRVLPLMVVPGNGQK; RRVLPLMVVPGNGQKW; RVLPLMVVPGNGQKWR; VLPLMVVPGNGQKWRN; LPLMVVPGNGQKWRNR; PLMVVPGNGQKWRNRT; LMVVPGNGQKWRNRTE; MVVPGNGQKWRNRTET; VVPGNGQKWRNRTETE; VPGNGQKWRNRTETEE; PGNGQKWRNRTETEEA; GNGQKWRNRTETEEAM; NGQKWRNRTETEEAMG; GQKWRNRTETEEAMGD; QKWRNRTETEEAMGDT; KWRNRTETEEAMGDTY; WRNRTETEEAMGDTYR; RNRTETEEAMGDTYRD; NRTETEEAMGDTYRDP; RTETEEAMGDTYRDPV; TETEEAMGDTYRDPVD; ETEEAMGDTYRDPVDH; TEEAMGDTYRDPVDHL; EEAMGDTYRDPVDHLR; EAMGDTYRDPVDHLRT; AMGDTYRDPVDHLRTT; MGDTYRDPVDHLRTTR; GDTYRDPVDHLRTTRP; DTYRDPVDHLRTTRPL; TYRDPVDHLRTTRPLA; YRDPVDHLRTTRPLAG; RDPVDHLRTTRPLAGE; DPVDHLRTTRPLAGES; PVDHLRTTRPLAGESL; VDHLRTTRPLAGESLI; DHLRTTRPLAGESLID; HLRTTRPLAGESLIDV; LRTTRPLAGESLIDVV; RTTRPLAGESLIDVVH; TTRPLAGESLIDVVHW; TRPLAGESLIDVVHWP; RPLAGESLIDVVHWPG; PLAGESLIDVVHWPGY; LAGESLIDVVHWPGYL; AGESLIDVVHWPGYLL; GESLIDVVHWPGYLLI; ESLIDVVHWPGYLLIV; SLIDVVHWPGYLLIVA; LIDVVHWPGYLLIVAG; IDVVHWPGYLLIVAGV; DVVHWPGYLLIVAGVV; VVHWPGYLLIVAGVVG; VHWPGYLLIVAGVVGG; HWPGYLLIVAGVVGGV; WPGYLLIVAGVVGGVG; PGYLLIVAGVVGGVGA; GYLLIVAGVVGGVGAL; YLLIVAGVVGGVGALA; LLIVAGVVGGVGALAA; LIVAGVVGGVGALAAF; IVAGVVGGVGALAAFG; VAGVVGGVGALAAFGT; AGVVGGVGALAAFGTG; GVVGGVGALAAFGTGH; VVGGVGALAAFGTGHH; VGGVGALAAFGTGHHA; GGVGALAAFGTGHHAE; GVGALAAFGTGHHAEG; VGALAAFGTGHHAEGM; GALAAFGTGHHAEGMT; ALAAFGTGHHAEGMTF; LAAFGTGHHAEGMTFG; AAFGTGHHAEGMTFGV; AFGTGHHAEGMTFGVV; FGTGHHAEGMTFGVVA; GTGHHAEGMTFGVVAI; TGHHAEGMTFGVVAIV; GHHAEGMTFGVVAIVV; HHAEGMTFGVVAIVVT; HAEGMTFGVVAIVVTV; AEGMTFGVVAIVVTVV; EGMTFGVVAIVVTVVG; GMTFGVVAIVVTVVGL; MTFGVVAIVVTVVGLA; TFGVVAIVVTVVGLAW; FGVVAIVVTVVGLAWL; GVVAIVVTVVGLAWLA; VVAIVVTVVGLAWLAF; VAIVVTVVGLAWLAFE; AIVVTVVGLAWLAFEH; IVVTVVGLAWLAFEHR; VVTVVGLAWLAFEHRR; VTVVGLAWLAFEHRRI; TVVGLAWLAFEHRRIR; VVGLAWLAFEHRRIRK; VGLAWLAFEHRRIRKI; GLAWLAFEHRRIRKIA; LAWLAFEHRRIRKIAD; AWLAFEHRRIRKIADR; WLAFEHRRIRKIADRW; LAFEHRRIRKIADRWY; AFEHRRIRKIADRWYT; FEHRRIRKIADRWYTE; EHRRIRKIADRWYTEH; HRRIRKIADRWYTEHP; RRIRKIADRWYTEHPE; RIRKIADRWYTEHPEV; IRKIADRWYTEHPEVR; RKIADRWYTEHPEVRR; KIADRWYTEHPEVRRQ; IADRWYTEHPEVRRQR; ADRWYTEHPEVRRQRL; DRWYTEHPEVRRQRLA; RWYTEHPEVRRQRLAG | |
| 60) Rv3289c | 13 mers: MHEVGGPSRGDRL; HEVGGPSRGDRLG; EVGGPSRGDRLGR; VGGPSRGDRLGRD; GGPSRGDRLGRDD; GPSRGDRLGRDDS; PSRGDRLGRDDSE; SRGDRLGRDDSEV; RGDRLGRDDSEVH; GDRLGRDDSEVHS; DRLGRDDSEVHSA; RLGRDDSEVHSAI; LGRDDSEVHSAIR; GRDDSEVHSAIRF; RDDSEVHSAIRFA; DDSEVHSAIRFAV; DSEVHSAIRFAVV; SEVHSAIRFAVVA; EVHSAIRFAVVAA; VHSAIRFAVVAAV; HSAIRFAVVAAVV; SAIRFAVVAAVVG; AIRFAVVAAVVGV; IRFAVVAAVVGVG; RFAVVAAVVGVGF; FAVVAAVVGVGFL; AVVAAVVGVGFLI; VVAAVVGVGFLIM; VAAVVGVGFLIMG; AAVVGVGFLIMGA; AVVGVGFLIMGAL; VVGVGFLIMGALL; VGVGFLIMGALLV; GVGFLIMGALLVS; VGFLIMGALLVST; GFLIMGALLVSTC; FLIMGALLVSTCS; LIMGALLVSTCSG; IMGALLVSTCSGV; MGALLVSTCSGVD; GALLVSTCSGVDT; ALLVSTCSGVDTA; LLVSTCSGVDTAA; LVSTCSGVDTAAC; VSTCSGVDTAACG; | 100806-101251 |

Fig. 29 continued

| | | |
|---|---|---|
| | STCSGVDTAACGP; TCSGVDTAACGPP; CSGVDTAACGPPQ;<br>SGVDTAACGPPQR; GVDTAACGPPQRI; VDTAACGPPQRIL; DTAACGPPQRILL;<br>TAACGPPQRILLA; AACGPPQRILLAL; ACGPPQRILLALG; CGPPQRILLALGG;<br>GPPQRILLALGGP; PPQRILLALGGPL; PQRILLALGGPLI; QRILLALGGPLIL;<br>RILLALGGPLILC; ILLALGGPLILCA; LLALGGPLILCAA; LALGGPLILCAAG;<br>ALGGPLILCAAGL; LGGPLILCAAGLW; GGPLILCAAGLWA; GPLILCAAGLWAF;<br>PLILCAAGLWAFL; LILCAAGLWAFLR; ILCAAGLWAFLRT; LCAAGLWAFLRTY;<br>CAAGLWAFLRTYR; AAGLWAFLRTYRV; AGLWAFLRTYRVW;<br>GLWAFLRTYRVWR; LWAFLRTYRVWRA; WAFLRTYRVWRAE;<br>AFLRTYRVWRAEG; FLRTYRVWRAEGT; LRTYRVWRAEGTW;<br>RTYRVWRAEGTWW; TYRVWRAEGTWWG; YRVWRAEGTWWGW;<br>RVWRAEGTWWGWH; VWRAEGTWWGWHG; WRAEGTWWGWHGA;<br>RAEGTWWGWHGAG; AEGTWWGWHGAGW; EGTWWGWHGAGWF;<br>GTWWGWHGAGWFL; TWWGWHGAGWFLL; WWGWHGAGWFLLT;<br>WGWHGAGWFLLTL; GWHGAGWFLLTLM; WHGAGWFLLTLMV;<br>HGAGWFLLTLMVL; GAGWFLLTLMVLT; AGWFLLTLMVLTL; GWFLLTLMVLTLC;<br>WFLLTLMVLTLCI; FLLTLMVLTLCIG; LLTLMVLTLCIGV; LTLMVLTLCIGVP;<br>TLMVLTLCIGVPP; LMVLTLCIGVPPI; MVLTLCIGVPPIA; VLTLCIGVPPIAG;<br>LTLCIGVPPIAGP; TLCIGVPPIAGPV; LCIGVPPIAGPVM; CIGVPPIAGPVMA;<br>IGVPPIAGPVMAP<br><br>14 mers:<br>MHEVGGPSRGDRLG; HEVGGPSRGDRLGR; EVGGPSRGDRLGRD;<br>VGGPSRGDRLGRDD; GGPSRGDRLGRDDS; GPSRGDRLGRDDSE;<br>PSRGDRLGRDDSEV; SRGDRLGRDDSEVH; RGDRLGRDDSEVHS;<br>GDRLGRDDSEVHSA; DRLGRDDSEVHSAI; RLGRDDSEVHSAIR;<br>LGRDDSEVHSAIRF; GRDDSEVHSAIRFA; RDDSEVHSAIRFAV;<br>DDSEVHSAIRFAVV; DSEVHSAIRFAVVA; SEVHSAIRFAVVAA;<br>EVHSAIRFAVVAAV; VHSAIRFAVVAAVV; HSAIRFAVVAAVVG;<br>SAIRFAVVAAVVGV; AIRFAVVAAVVGVG; IRFAVVAAVVGVGF;<br>RFAVVAAVVGVGFL; FAVVAAVVGVGFLI; AVVAAVVGVGFLIM;<br>VVAAVVGVGFLIMG; VAAVVGVGFLIMGA; AAVVGVGFLIMGAL;<br>AVVGVGFLIMGALL; VVGVGFLIMGALLV; VGVGFLIMGALLVS;<br>GVGFLIMGALLVST; VGFLIMGALLVSTC; GFLIMGALLVSTCS;<br>FLIMGALLVSTCSG; LIMGALLVSTCSGV; IMGALLVSTCSGVD;<br>MGALLVSTCSGVDT; GALLVSTCSGVDTA; ALLVSTCSGVDTAA;<br>LLVSTCSGVDTAAC; LVSTCSGVDTAACG; VSTCSGVDTAACGP;<br>STCSGVDTAACGPP; TCSGVDTAACGPPQ; CSGVDTAACGPPQR;<br>SGVDTAACGPPQRI; GVDTAACGPPQRIL; VDTAACGPPQRILL;<br>DTAACGPPQRILLA; TAACGPPQRILLAL; AACGPPQRILLALG;<br>ACGPPQRILLALGG; CGPPQRILLALGGP; GPPQRILLALGGPL;<br>PPQRILLALGGPLI; PQRILLALGGPLIL; QRILLALGGPLILC; RILLALGGPLILCA;<br>ILLALGGPLILCAA; LLALGGPLILCAAG; LALGGPLILCAAGL; ALGGPLILCAAGLW;<br>LGGPLILCAAGLWA; GGPLILCAAGLWAF; GPLILCAAGLWAFL;<br>PLILCAAGLWAFLR; LILCAAGLWAFLRT; ILCAAGLWAFLRTY;<br>LCAAGLWAFLRTYR; CAAGLWAFLRTYRV; AAGLWAFLRTYRVW;<br>AGLWAFLRTYRVWR; GLWAFLRTYRVWRA; LWAFLRTYRVWRAE;<br>WAFLRTYRVWRAEG; AFLRTYRVWRAEGT; FLRTYRVWRAEGTW;<br>LRTYRVWRAEGTWW; RTYRVWRAEGTWWG; TYRVWRAEGTWWGW;<br>YRVWRAEGTWWGWH; RVWRAEGTWWGWHG; VWRAEGTWWGWHGA;<br>WRAEGTWWGWHGAG; RAEGTWWGWHGAGW; AEGTWWGWHGAGWF;<br>EGTWWGWHGAGWFL; GTWWGWHGAGWFLL; TWWGWHGAGWFLLT;<br>WWGWHGAGWFLLTL; WGWHGAGWFLLTLM; GWHGAGWFLLTLMV; | |

Fig. 29 continued

| | | |
|---|---|---|
| | WHGAGWFLLTLMVL; HGAGWFLLTLMVLT; GAGWFLLTLMVLTL; AGWFLLTLMVLTLC; GWFLLTLMVLTLCI; WFLLTLMVLTLCIG; FLLTLMVLTLCIGV; LLTLMVLTLCIGVP; LTLMVLTLCIGVPP; TLMVLTLCIGVPPI; LMVLTLCIGVPPIA; MVLTLCIGVPPIAG; VLTLCIGVPPIAGP; LTLCIGVPPIAGPV; TLCIGVPPIAGPVM; LCIGVPPIAGPVMA; CIGVPPIAGPVMAP<br><br>15 mers:<br>MHEVGGPSRGDRLGR; HEVGGPSRGDRLGRD; EVGGPSRGDRLGRDD; VGGPSRGDRLGRDDS; GGPSRGDRLGRDDSE; GPSRGDRLGRDDSEV; PSRGDRLGRDDSEVH; SRGDRLGRDDSEVHS; RGDRLGRDDSEVHSA; GDRLGRDDSEVHSAI; DRLGRDDSEVHSAIR; RLGRDDSEVHSAIRF; LGRDDSEVHSAIRFA; GRDDSEVHSAIRFAV; RDDSEVHSAIRFAVV; DDSEVHSAIRFAVVA; DSEVHSAIRFAVVAA; SEVHSAIRFAVVAAV; EVHSAIRFAVVAAVV; VHSAIRFAVVAAVVG; HSAIRFAVVAAVVGV; SAIRFAVVAAVVGVG; AIRFAVVAAVVGVGF; IRFAVVAAVVGVGFL; RFAVVAAVVGVGFLI; FAVVAAVVGVGFLIM; AVVAAVVGVGFLIMG; VVAAVVGVGFLIMGA; VAAVVGVGFLIMGAL; AAVVGVGFLIMGALL; AVVGVGFLIMGALLV; VVGVGFLIMGALLVS; VGVGFLIMGALLVST; GVGFLIMGALLVSTC; VGFLIMGALLVSTCS; GFLIMGALLVSTCSG; FLIMGALLVSTCSGV; LIMGALLVSTCSGVD; IMGALLVSTCSGVDT; MGALLVSTCSGVDTA; GALLVSTCSGVDTAA; ALLVSTCSGVDTAAC; LLVSTCSGVDTAACG; LVSTCSGVDTAACGP; VSTCSGVDTAACGPP; STCSGVDTAACGPPQ; TCSGVDTAACGPPQR; CSGVDTAACGPPQRI; SGVDTAACGPPQRIL; GVDTAACGPPQRILL; VDTAACGPPQRILLA; DTAACGPPQRILLAL; TAACGPPQRILLALG; AACGPPQRILLALGG; ACGPPQRILLALGGP; CGPPQRILLALGGPL; GPPQRILLALGGPLI; PPQRILLALGGPLIL; PQRILLALGGPLILC; QRILLALGGPLILCA; RILLALGGPLILCAA; ILLALGGPLILCAAG; LLALGGPLILCAAGL; LALGGPLILCAAGLW; ALGGPLILCAAGLWA; LGGPLILCAAGLWAF; GGPLILCAAGLWAFL; GPLILCAAGLWAFLR; PLILCAAGLWAFLRT; LILCAAGLWAFLRTY; ILCAAGLWAFLRTYR; LCAAGLWAFLRTYRV; CAAGLWAFLRTYRVW; AAGLWAFLRTYRVWR; AGLWAFLRTYRVWRA; GLWAFLRTYRVWRAE; LWAFLRTYRVWRAEG; WAFLRTYRVWRAEGT; AFLRTYRVWRAEGTW; FLRTYRVWRAEGTWW; LRTYRVWRAEGTWWG; RTYRVWRAEGTWWGW; TYRVWRAEGTWWGWH; YRVWRAEGTWWGWHG; RVWRAEGTWWGWHGA; VWRAEGTWWGWHGAG; WRAEGTWWGWHGAGW; RAEGTWWGWHGAGWF; AEGTWWGWHGAGWFL; EGTWWGWHGAGWFLL; GTWWGWHGAGWFLLT; TWWGWHGAGWFLLTL; WWGWHGAGWFLLTLM; WGWHGAGWFLLTLMV; GWHGAGWFLLTLMVL; WHGAGWFLLTLMVLT; HGAGWFLLTLMVLTL; GAGWFLLTLMVLTLC; AGWFLLTLMVLTLCI; GWFLLTLMVLTLCIG; WFLLTLMVLTLCIGV; FLLTLMVLTLCIGVP; LLTLMVLTLCIGVPP; LTLMVLTLCIGVPPI; TLMVLTLCIGVPPIA; LMVLTLCIGVPPIAG; MVLTLCIGVPPIAGP; VLTLCIGVPPIAGPV; LTLCIGVPPIAGPVM; TLCIGVPPIAGPVMA; LCIGVPPIAGPVMAP<br><br>16 mers:<br>MHEVGGPSRGDRLGRD; HEVGGPSRGDRLGRDD; EVGGPSRGDRLGRDDS; VGGPSRGDRLGRDDSE; GGPSRGDRLGRDDSEV; GPSRGDRLGRDDSEVH; PSRGDRLGRDDSEVHS; SRGDRLGRDDSEVHSA; RGDRLGRDDSEVHSAI; GDRLGRDDSEVHSAIR; DRLGRDDSEVHSAIRF; RLGRDDSEVHSAIRFA; LGRDDSEVHSAIRFAV; GRDDSEVHSAIRFAVV; RDDSEVHSAIRFAVVA; DDSEVHSAIRFAVVAA; DSEVHSAIRFAVVAAV; SEVHSAIRFAVVAAVV; EVHSAIRFAVVAAVVG; VHSAIRFAVVAAVVGV; HSAIRFAVVAAVVGVG; | |

Fig. 29 continued

| | | |
|---|---|---|
| | SAIRFAVVAAVVGVGF; AIRFAVVAAVVGVGFL; IRFAVVAAVVGVGFLI; RFAVVAAVVGVGFLIM; FAVVAAVVGVGFLIMG; AVVAAVVGVGFLIMGA; VVAAVVGVGFLIMGAL; VAAVVGVGFLIMGALL; AAVVGVGFLIMGALLV; AVVGVGFLIMGALLVS; VVGVGFLIMGALLVST; VGVGFLIMGALLVSTC; GVGFLIMGALLVSTCS; VGFLIMGALLVSTCSG; GFLIMGALLVSTCSGV; FLIMGALLVSTCSGVD; LIMGALLVSTCSGVDT; IMGALLVSTCSGVDTA; MGALLVSTCSGVDTAA; GALLVSTCSGVDTAAC; ALLVSTCSGVDTAACG; LLVSTCSGVDTAACGP; LVSTCSGVDTAACGPP; VSTCSGVDTAACGPPQ; STCSGVDTAACGPPQR; TCSGVDTAACGPPQRI; CSGVDTAACGPPQRIL; SGVDTAACGPPQRILL; GVDTAACGPPQRILLA; VDTAACGPPQRILLAL; DTAACGPPQRILLALG; TAACGPPQRILLALGG; AACGPPQRILLALGGP; ACGPPQRILLALGGPL; CGPPQRILLALGGPLI; GPPQRILLALGGPLIL; PPQRILLALGGPLILC; PQRILLALGGPLILCA; QRILLALGGPLILCAA; RILLALGGPLILCAAG; ILLALGGPLILCAAGL; LLALGGPLILCAAGLW; LALGGPLILCAAGLWA; ALGGPLILCAAGLWAF; LGGPLILCAAGLWAFL; GGPLILCAAGLWAFLR; GPLILCAAGLWAFLRT; PLILCAAGLWAFLRTY; LILCAAGLWAFLRTYR; ILCAAGLWAFLRTYRV; LCAAGLWAFLRTYRVW; CAAGLWAFLRTYRVWR; AAGLWAFLRTYRVWRA; AGLWAFLRTYRVWRAE; GLWAFLRTYRVWRAEG; LWAFLRTYRVWRAEGT; WAFLRTYRVWRAEGTW; AFLRTYRVWRAEGTWW; FLRTYRVWRAEGTWWG; LRTYRVWRAEGTWWGW; RTYRVWRAEGTWWGWH; TYRVWRAEGTWWGWHG; YRVWRAEGTWWGWHGA; RVWRAEGTWWGWHGAG; VWRAEGTWWGWHGAGW; WRAEGTWWGWHGAGWF; RAEGTWWGWHGAGWFL; AEGTWWGWHGAGWFLL; EGTWWGWHGAGWFLLT; GTWWGWHGAGWFLLTL; TWWGWHGAGWFLLTLM; WWGWHGAGWFLLTLMV; WGWHGAGWFLLTLMVL; GWHGAGWFLLTLMVLT; WHGAGWFLLTLMVLTL; HGAGWFLLTLMVLTLC; GAGWFLLTLMVLTLCI; AGWFLLTLMVLTLCIG; GWFLLTLMVLTLCIGV; WFLLTLMVLTLCIGVP; FLLTLMVLTLCIGVPP; LLTLMVLTLCIGVPPI; LTLMVLTLCIGVPPIA; TLMVLTLCIGVPPIAG; LMVLTLCIGVPPIAGP; MVLTLCIGVPPIAGPV; VLTLCIGVPPIAGPVM; LTLCIGVPPIAGPVMA; TLCIGVPPIAGPVMAP | |
| 61) Rv3290c | 13 mers: MAAVVKSVALAGR; AAVVKSVALAGRP; AVVKSVALAGRPT; VVKSVALAGRPTT; VKSVALAGRPTTP; KSVALAGRPTTPD; SVALAGRPTTPDR; VALAGRPTTPDRV; ALAGRPTTPDRVH; LAGRPTTPDRVHE; AGRPTTPDRVHEV; GRPTTPDRVHEVL; RPTTPDRVHEVLG; PTTPDRVHEVLGR; TTPDRVHEVLGRS; TPDRVHEVLGRSM; PDRVHEVLGRSML; DRVHEVLGRSMLV; RVHEVLGRSMLVD; VHEVLGRSMLVDG; HEVLGRSMLVDGL; EVLGRSMLVDGLD; VLGRSMLVDGLDI; LGRSMLVDGLDIV; GRSMLVDGLDIVL; RSMLVDGLDIVLD; SMLVDGLDIVLDL; MLVDGLDIVLDLT; LVDGLDIVLDLTR; VDGLDIVLDLTRS; DGLDIVLDLTRSG; GLDIVLDLTRSGG; LDIVLDLTRSGGS; DIVLDLTRSGGSY; IVLDLTRSGGSYL; VLDLTRSGGSYLV; LDLTRSGGSYLVD; DLTRSGGSYLVDA; LTRSGGSYLVDAI; TRSGGSYLVDAIT; RSGGSYLVDAITG; SGGSYLVDAITGR; GGSYLVDAITGRR; GSYLVDAITGRRY; SYLVDAITGRRYL; YLVDAITGRRYLD; LVDAITGRRYLDM; VDAITGRRYLDMF; DAITGRRYLDMFT; AITGRRYLDMFTF; ITGRRYLDMFTFV; TGRRYLDMFTFVA; GRRYLDMFTFVAS; RRYLDMFTFVASS; RYLDMFTFVASSA; YLDMFTFVASSAL; LDMFTFVASSALG; DMFTFVASSALGM; MFTFVASSALGMN; FTFVASSALGMNP; TFVASSALGMNPP; FVASSALGMNPPA; VASSALGMNPPAL; ASSALGMNPPALV; SSALGMNPPALVD; SALGMNPPALVDD; ALGMNPPALVDDR; LGMNPPALVDDRE; GMNPPALVDDREF; MNPPALVDDREFH; NPPALVDDREFHA; PPALVDDREFHAE; PALVDDREFHAEL; ALVDDREFHAELM; LVDDREFHAELMQ; VDDREFHAELMQA; DDREFHAELMQAA; DREFHAELMQAAL; REFHAELMQAALN; | 101252-102993 |

Fig. 29 continued

| | | |
|---|---|---|
| | EFHAELMQAALNK; FHAELMQAALNKP; HAELMQAALNKPS; AELMQAALNKPSN; ELMQAALNKPSNS; LMQAALNKPSNSD; MQAALNKPSNSDV; QAALNKPSNSDVY; AALNKPSNSDVYS; ALNKPSNSDVYSV; LNKPSNSDVYSVA; NKPSNSDVYSVAM; KPSNSDVYSVAMA; PSNSDVYSVAMAR; SNSDVYSVAMARF; NSDVYSVAMARFV; SDVYSVAMARFVE; DVYSVAMARFVET; VYSVAMARFVETF; YSVAMARFVETFA; SVAMARFVETFAR; VAMARFVETFARV; AMARFVETFARVL; MARFVETFARVLG; ARFVETFARVLGD; RFVETFARVLGDP; FVETFARVLGDPA; VETFARVLGDPAL; ETFARVLGDPALP; TFARVLGDPALPH; FARVLGDPALPHL; ARVLGDPALPHLF; RVLGDPALPHLFF; VLGDPALPHLFFV; LGDPALPHLFFVE; GDPALPHLFFVEG; DPALPHLFFVEGG; PALPHLFFVEGGA; ALPHLFFVEGGAL; LPHLFFVEGGALA; PHLFFVEGGALAV; HLFFVEGGALAVE; LFFVEGGALAVEN; FFVEGGALAVENA; FVEGGALAVENAL; VEGGALAVENALK; EGGALAVENALKA; GGALAVENALKAA; GALAVENALKAAF; ALAVENALKAAFD; LAVENALKAAFDW; AVENALKAAFDWK; VENALKAAFDWKS; ENALKAAFDWKSR; NALKAAFDWKSRH; ALKAAFDWKSRHN; LKAAFDWKSRHNQ; KAAFDWKSRHNQA; AAFDWKSRHNQAH; AFDWKSRHNQAHG; FDWKSRHNQAHGI; DWKSRHNQAHGID; WKSRHNQAHGIDP; KSRHNQAHGIDPA; SRHNQAHGIDPAL; RHNQAHGIDPALG; HNQAHGIDPALGT; NQAHGIDPALGTQ; QAHGIDPALGTQV; AHGIDPALGTQVL; HGIDPALGTQVLH; GIDPALGTQVLHL; IDPALGTQVLHLR; DPALGTQVLHLRG; PALGTQVLHLRGA; ALGTQVLHLRGAF; LGTQVLHLRGAFH; GTQVLHLRGAFHG; TQVLHLRGAFHGR; QVLHLRGAFHGRS; VLHLRGAFHGRSG; LHLRGAFHGRSGY; HLRGAFHGRSGYT; LRGAFHGRSGYTL; RGAFHGRSGYTLS; GAFHGRSGYTLSL; AFHGRSGYTLSLT; FHGRSGYTLSLTN; HGRSGYTLSLTNT; GRSGYTLSLTNTK; RSGYTLSLTNTKP; SGYTLSLTNTKPT; GYTLSLTNTKPTI; YTLSLTNTKPTIT; TLSLTNTKPTITA; LSLTNTKPTITAR; SLTNTKPTITARF; LTNTKPTITARFP; TNTKPTITARFPK; NTKPTITARFPKF; TKPTITARFPKFD; KPTITARFPKFDW; PTITARFPKFDWP; TITARFPKFDWPR; ITARFPKFDWPRI; TARFPKFDWPRID; ARFPKFDWPRIDA; RFPKFDWPRIDAP; FPKFDWPRIDAPY; PKFDWPRIDAPYM; KFDWPRIDAPYMR; FDWPRIDAPYMRP; DWPRIDAPYMRPG; WPRIDAPYMRPGL; PRIDAPYMRPGLD; RIDAPYMRPGLDE; IDAPYMRPGLDEP; DAPYMRPGLDEPA; APYMRPGLDEPAM; PYMRPGLDEPAMA; YMRPGLDEPAMAA; MRPGLDEPAMAAL; RPGLDEPAMAALE; PGLDEPAMAALEA; GLDEPAMAALEAE; LDEPAMAALEAEA; DEPAMAALEAEAL; EPAMAALEAEALR; PAMAALEAEALRQ; AMAALEAEALRQA; MAALEAEALRQAR; AALEAEALRQARA; ALEAEALRQARAA; LEAEALRQARAAF; EAEALRQARAAFE; AEALRQARAAFET; EALRQARAAFETR; ALRQARAAFETRP; LRQARAAFETRPH; RQARAAFETRPHD; QARAAFETRPHDI; ARAAFETRPHDIA; RAAFETRPHDIAC; AAFETRPHDIACF; AFETRPHDIACFV; FETRPHDIACFVA; ETRPHDIACFVAE; TRPHDIACFVAEP; RPHDIACFVAEPI; PHDIACFVAEPIQ; HDIACFVAEPIQG; DIACFVAEPIQGE; IACFVAEPIQGEG; ACFVAEPIQGEGG; CFVAEPIQGEGGD; FVAEPIQGEGGDR; VAEPIQGEGGDRH; AEPIQGEGGDRHF; EPIQGEGGDRHFR; PIQGEGGDRHFRP; IQGEGGDRHFRPE; QGEGGDRHFRPEF; GEGGDRHFRPEFF; EGGDRHFRPEFFA; GGDRHFRPEFFAA; GDRHFRPEFFAAM; DRHFRPEFFAAMR; RHFRPEFFAAMRE; HFRPEFFAAMREL; FRPEFFAAMRELC; RPEFFAAMRELCD; PEFFAAMRELCDE; EFFAAMRELCDEF; FFAAMRELCDEFD; FAAMRELCDEFDA; AAMRELCDEFDAL; AMRELCDEFDALL; MRELCDEFDALLI; RELCDEFDALLIF; ELCDEFDALLIFD; LCDEFDALLIFDE; CDEFDALLIFDEV; DEFDALLIFDEVQ; EFDALLIFDEVQT; FDALLIFDEVQTG; DALLIFDEVQTGC; ALLIFDEVQTGCG; LLIFDEVQTGCGL; LIFDEVQTGCGLT; IFDEVQTGCGLTG; FDEVQTGCGLTGT; DEVQTGCGLTGTA; EVQTGCGLTGTAW; VQTGCGLTGTAWA; QTGCGLTGTAWAY; TGCGLTGTAWAYQ; GCGLTGTAWAYQQ; | |

Fig. 29 continued

| | | |
|---|---|---|
| | CGLTGTAWAYQQL; GLTGTAWAYQQLD; LTGTAWAYQQLDV;<br>TGTAWAYQQLDVA; GTAWAYQQLDVAP; TAWAYQQLDVAPD;<br>AWAYQQLDVAPDI; WAYQQLDVAPDIV; AYQQLDVAPDIVA; YQQLDVAPDIVAF;<br>QQLDVAPDIVAFG; QLDVAPDIVAFGK; LDVAPDIVAFGKK; DVAPDIVAFGKKT;<br>VAPDIVAFGKKTQ; APDIVAFGKKTQV; PDIVAFGKKTQVC; DIVAFGKKTQVCG;<br>IVAFGKKTQVCGV; VAFGKKTQVCGVM; AFGKKTQVCGVMA;<br>FGKKTQVCGVMAG; GKKTQVCGVMAGR; KKTQVCGVMAGRR;<br>KTQVCGVMAGRRV; TQVCGVMAGRRVD; QVCGVMAGRRVDE;<br>VCGVMAGRRVDEV; CGVMAGRRVDEVA; GVMAGRRVDEVAD;<br>VMAGRRVDEVADN; MAGRRVDEVADNV; AGRRVDEVADNVF;<br>GRRVDEVADNVFA; RRVDEVADNVFAV; RVDEVADNVFAVP;<br>VDEVADNVFAVPS; DEVADNVFAVPSR; EVADNVFAVPSRL; VADNVFAVPSRLN;<br>ADNVFAVPSRLNS; DNVFAVPSRLNST; NVFAVPSRLNSTW; VFAVPSRLNSTWG;<br>FAVPSRLNSTWGG; AVPSRLNSTWGGN; VPSRLNSTWGGNL;<br>PSRLNSTWGGNLT; SRLNSTWGGNLTD; RLNSTWGGNLTDM;<br>LNSTWGGNLTDMV; NSTWGGNLTDMVR; STWGGNLTDMVRA;<br>TWGGNLTDMVRAR; WGGNLTDMVRARR; GGNLTDMVRARRI;<br>GNLTDMVRARRIL; NLTDMVRARRILE; LTDMVRARRILEV; TDMVRARRILEVI;<br>DMVRARRILEVIE; MVRARRILEVIEA; VRARRILEVIEAE; RARRILEVIEAEG;<br>ARRILEVIEAEGL; RRILEVIEAEGLF; RILEVIEAEGLFE; ILEVIEAEGLFER;<br>LEVIEAEGLFERA; EVIEAEGLFERAV; VIEAEGLFERAVQ; IEAEGLFERAVQH;<br>EAEGLFERAVQHG; AEGLFERAVQHGK; EGLFERAVQHGKY;<br>GLFERAVQHGKYL; LFERAVQHGKYLR; FERAVQHGKYLRA;<br>ERAVQHGKYLRAR; RAVQHGKYLRARL; AVQHGKYLRARLD;<br>VQHGKYLRARLDE; QHGKYLRARLDEL; HGKYLRARLDELA; GKYLRARLDELAA;<br>KYLRARLDELAAD; YLRARLDELAADF; LRARLDELAADFP; RARLDELAADFPA;<br>ARLDELAADFPAV; RLDELAADFPAVV; LDELAADFPAVVL; DELAADFPAVVLD;<br>ELAADFPAVVLDP; LAADFPAVVLDPR; AADFPAVVLDPRG; ADFPAVVLDPRGR;<br>DFPAVVLDPRGRG; FPAVVLDPRGRGL; PAVVLDPRGRGLM;<br>AVVLDPRGRGLMC; VVLDPRGRGLMCA; VLDPRGRGLMCAF;<br>LDPRGRGLMCAFS; DPRGRGLMCAFSL; PRGRGLMCAFSLP;<br>RGRGLMCAFSLPT; GRGLMCAFSLPTT; RGLMCAFSLPTTA; GLMCAFSLPTTAD;<br>LMCAFSLPTTADR; MCAFSLPTTADRD; CAFSLPTTADRDE; AFSLPTTADRDEL;<br>FSLPTTADRDELI; SLPTTADRDELIR; LPTTADRDELIRQ; PTTADRDELIRQL;<br>TTADRDELIRQLW; TADRDELIRQLWQ; ADRDELIRQLWQR; DRDELIRQLWQRA;<br>RDELIRQLWQRAV; DELIRQLWQRAVI; ELIRQLWQRAVIV; LIRQLWQRAVIVL;<br>IRQLWQRAVIVLP; RQLWQRAVIVLPA; QLWQRAVIVLPAG; LWQRAVIVLPAGA;<br>WQRAVIVLPAGAD; QRAVIVLPAGADT; RAVIVLPAGADTV; AVIVLPAGADTVR;<br>VIVLPAGADTVRF; IVLPAGADTVRFR; VLPAGADTVRFRP; LPAGADTVRFRPP;<br>PAGADTVRFRPPL; AGADTVRFRPPLT; GADTVRFRPPLTV; ADTVRFRPPLTVS;<br>DTVRFRPPLTVST; TVRFRPPLTVSTA; VRFRPPLTVSTAE; RFRPPLTVSTAEI;<br>FRPPLTVSTAEID; RPPLTVSTAEIDA; PPLTVSTAEIDAA; PLTVSTAEIDAAI;<br>LTVSTAEIDAAIA; TVSTAEIDAAIAA; VSTAEIDAAIAAV; STAEIDAAIAAVR;<br>TAEIDAAIAAVRS; AEIDAAIAAVRSA; EIDAAIAAVRSAL; IDAAIAAVRSALP;<br>DAAIAAVRSALPV; AAIAAVRSALPVV; AIAAVRSALPVVT<br><br>14 mers:<br>MAAVVKSVALAGRP; AAVVKSVALAGRPT; AVVKSVALAGRPTT;<br>VVKSVALAGRPTTP; VKSVALAGRPTTPD; KSVALAGRPTTPDR;<br>SVALAGRPTTPDRV; VALAGRPTTPDRVH; ALAGRPTTPDRVHE;<br>LAGRPTTPDRVHEV; AGRPTTPDRVHEVL; GRPTTPDRVHEVLG;<br>RPTTPDRVHEVLGR; PTTPDRVHEVLGRS; TTPDRVHEVLGRSM;<br>TPDRVHEVLGRSML; PDRVHEVLGRSMLV; DRVHEVLGRSMLVD; | |

Fig. 29 continued

| | | |
|---|---|---|
| | RVHEVLGRSMLVDG; VHEVLGRSMLVDGL; HEVLGRSMLVDGLD;<br>EVLGRSMLVDGLDI; VLGRSMLVDGLDIV; LGRSMLVDGLDIVL;<br>GRSMLVDGLDIVLD; RSMLVDGLDIVLDL; SMLVDGLDIVLDLT;<br>MLVDGLDIVLDLTR; LVDGLDIVLDLTRS; VDGLDIVLDLTRSG;<br>DGLDIVLDLTRSGG; GLDIVLDLTRSGGS; LDIVLDLTRSGGSY;<br>DIVLDLTRSGGSYL; IVLDLTRSGGSYLV; VLDLTRSGGSYLVD;<br>LDLTRSGGSYLVDA; DLTRSGGSYLVDAI; LTRSGGSYLVDAIT;<br>TRSGGSYLVDAITG; RSGGSYLVDAITGR; SGGSYLVDAITGRR;<br>GGSYLVDAITGRRY; GSYLVDAITGRRYL; SYLVDAITGRRYLD;<br>YLVDAITGRRYLDM; LVDAITGRRYLDMF; VDAITGRRYLDMFT;<br>DAITGRRYLDMFTF; AITGRRYLDMFTFV; ITGRRYLDMFTFVA;<br>TGRRYLDMFTFVAS; GRRYLDMFTFVASS; RRYLDMFTFVASSA;<br>RYLDMFTFVASSAL; YLDMFTFVASSALG; LDMFTFVASSALGM;<br>DMFTFVASSALGMN; MFTFVASSALGMNP; FTFVASSALGMNPP;<br>TFVASSALGMNPPA; FVASSALGMNPPAL; VASSALGMNPPALV;<br>ASSALGMNPPALVD; SSALGMNPPALVDD; SALGMNPPALVDDR;<br>ALGMNPPALVDDRE; LGMNPPALVDDREF; GMNPPALVDDREFH;<br>MNPPALVDDREFHA; NPPALVDDREFHAE; PPALVDDREFHAEL;<br>PALVDDREFHAELM; ALVDDREFHAELMQ; LVDDREFHAELMQA;<br>VDDREFHAELMQAA; DDREFHAELMQAAL; DREFHAELMQAALN;<br>REFHAELMQAALNK; EFHAELMQAALNKP; FHAELMQAALNKPS;<br>HAELMQAALNKPSN; AELMQAALNKPSNS; ELMQAALNKPSNSD;<br>LMQAALNKPSNSDV; MQAALNKPSNSDVY; QAALNKPSNSDVYS;<br>AALNKPSNSDVYSV; ALNKPSNSDVYSVA; LNKPSNSDVYSVAM;<br>NKPSNSDVYSVAMA; KPSNSDVYSVAMAR; PSNSDVYSVAMARF;<br>SNSDVYSVAMARFV; NSDVYSVAMARFVE; SDVYSVAMARFVET;<br>DVYSVAMARFVETF; VYSVAMARFVETFA; YSVAMARFVETFAR;<br>SVAMARFVETFARV; VAMARFVETFARVL; AMARFVETFARVLG;<br>MARFVETFARVLGD; ARFVETFARVLGDP; RFVETFARVLGDPA;<br>FVETFARVLGDPAL; VETFARVLGDPALP; ETFARVLGDPALPH;<br>TFARVLGDPALPHL; FARVLGDPALPHLF; ARVLGDPALPHLFF;<br>RVLGDPALPHLFFV; VLGDPALPHLFFVE; LGDPALPHLFFVEG;<br>GDPALPHLFFVEGG; DPALPHLFFVEGGA; PALPHLFFVEGGAL;<br>ALPHLFFVEGGALA; LPHLFFVEGGALAV; PHLFFVEGGALAVE;<br>HLFFVEGGALAVEN; LFFVEGGALAVENA; FFVEGGALAVENAL;<br>FVEGGALAVENALK; VEGGALAVENALKA; EGGALAVENALKAA;<br>GGALAVENALKAAF; GALAVENALKAAFD; ALAVENALKAAFDW;<br>LAVENALKAAFDWK; AVENALKAAFDWKS; VENALKAAFDWKSR;<br>ENALKAAFDWKSRH; NALKAAFDWKSRHN; ALKAAFDWKSRHNQ;<br>LKAAFDWKSRHNQA; KAAFDWKSRHNQAH; AAFDWKSRHNQAHG;<br>AFDWKSRHNQAHGI; FDWKSRHNQAHGID; DWKSRHNQAHGIDP;<br>WKSRHNQAHGIDPA; KSRHNQAHGIDPAL; SRHNQAHGIDPALG;<br>RHNQAHGIDPALGT; HNQAHGIDPALGTQ; NQAHGIDPALGTQV;<br>QAHGIDPALGTQVL; AHGIDPALGTQVLH; HGIDPALGTQVLHL;<br>GIDPALGTQVLHLR; IDPALGTQVLHLRG; DPALGTQVLHLRGA;<br>PALGTQVLHLRGAF; ALGTQVLHLRGAFH; LGTQVLHLRGAFHG;<br>GTQVLHLRGAFHGR; TQVLHLRGAFHGRS; QVLHLRGAFHGRSG;<br>VLHLRGAFHGRSGY; LHLRGAFHGRSGYT; HLRGAFHGRSGYTL;<br>LRGAFHGRSGYTLS; RGAFHGRSGYTLSL; GAFHGRSGYTLSLT;<br>AFHGRSGYTLSLTN; FHGRSGYTLSLTNT; HGRSGYTLSLTNTK;<br>GRSGYTLSLTNTKP; RSGYTLSLTNTKPT; SGYTLSLTNTKPTI;<br>GYTLSLTNTKPTIT; YTLSLTNTKPTITA; TLSLTNTKPTITAR; LSLTNTKPTITARF;<br>SLTNTKPTITARFP; LTNTKPTITARFPK; TNTKPTITARFPKF; NTKPTITARFPKFD; | |

Fig. 29 continued

| | | |
|---|---|---|
| | TKPTITARFPKFDW; KPTITARFPKFDWP; PTITARFPKFDWPR; TITARFPKFDWPRI; ITARFPKFDWPRID; TARFPKFDWPRIDA; ARFPKFDWPRIDAP; RFPKFDWPRIDAPY; FPKFDWPRIDAPYM; PKFDWPRIDAPYMR; KFDWPRIDAPYMRP; FDWPRIDAPYMRPG; DWPRIDAPYMRPGL; WPRIDAPYMRPGLD; PRIDAPYMRPGLDE; RIDAPYMRPGLDEP; IDAPYMRPGLDEPA; DAPYMRPGLDEPAM; APYMRPGLDEPAMA; PYMRPGLDEPAMAA; YMRPGLDEPAMAAL; MRPGLDEPAMAALE; RPGLDEPAMAALEA; PGLDEPAMAALEAE; GLDEPAMAALEAEA; LDEPAMAALEAEAL; DEPAMAALEAEALR; EPAMAALEAEALRQ; PAMAALEAEALRQA; AMAALEAEALRQAR; MAALEAEALRQARA; AALEAEALRQARAA; ALEAEALRQARAAF; LEAEALRQARAAFE; EAEALRQARAAFET; AEALRQARAAFETR; EALRQARAAFETRP; ALRQARAAFETRPH; LRQARAAFETRPHD; RQARAAFETRPHDI; QARAAFETRPHDIA; ARAAFETRPHDIAC; RAAFETRPHDIACF; AAFETRPHDIACFV; AFETRPHDIACFVA; FETRPHDIACFVAE; ETRPHDIACFVAEP; TRPHDIACFVAEPI; RPHDIACFVAEPIQ; PHDIACFVAEPIQG; HDIACFVAEPIQGE; DIACFVAEPIQGEG; IACFVAEPIQGEGG; ACFVAEPIQGEGGD; CFVAEPIQGEGGDR; FVAEPIQGEGGDRH; VAEPIQGEGGDRHF; AEPIQGEGGDRHFR; EPIQGEGGDRHFRP; PIQGEGGDRHFRPE; IQGEGGDRHFRPEF; QGEGGDRHFRPEFF; GEGGDRHFRPEFFA; EGGDRHFRPEFFAA; GGDRHFRPEFFAAM; GDRHFRPEFFAAMR; DRHFRPEFFAAMRE; RHFRPEFFAAMREL; HFRPEFFAAMRELC; FRPEFFAAMRELCD; RPEFFAAMRELCDE; PEFFAAMRELCDEF; EFFAAMRELCDEFD; FFAAMRELCDEFDA; FAAMRELCDEFDAL; AAMRELCDEFDALL; AMRELCDEFDALLI; MRELCDEFDALLIF; RELCDEFDALLIFD; ELCDEFDALLIFDE; LCDEFDALLIFDEV; CDEFDALLIFDEVQ; DEFDALLIFDEVQT; EFDALLIFDEVQTG; FDALLIFDEVQTGC; DALLIFDEVQTGCG; ALLIFDEVQTGCGL; LLIFDEVQTGCGLT; LIFDEVQTGCGLTG; IFDEVQTGCGLTGT; FDEVQTGCGLTGTA; DEVQTGCGLTGTAW; EVQTGCGLTGTAWA; VQTGCGLTGTAWAY; QTGCGLTGTAWAYQ; TGCGLTGTAWAYQQ; GCGLTGTAWAYQQL; CGLTGTAWAYQQLD; GLTGTAWAYQQLDV; LTGTAWAYQQLDVA; TGTAWAYQQLDVAP; GTAWAYQQLDVAPD; TAWAYQQLDVAPDI; AWAYQQLDVAPDIV; WAYQQLDVAPDIVA; AYQQLDVAPDIVAF; YQQLDVAPDIVAFG; QQLDVAPDIVAFGK; QLDVAPDIVAFGKK; LDVAPDIVAFGKKT; DVAPDIVAFGKKTQ; VAPDIVAFGKKTQV; APDIVAFGKKTQVC; PDIVAFGKKTQVCG; DIVAFGKKTQVCGV; IVAFGKKTQVCGVM; VAFGKKTQVCGVMA; AFGKKTQVCGVMAG; FGKKTQVCGVMAGR; GKKTQVCGVMAGRR; KKTQVCGVMAGRRV; KTQVCGVMAGRRVD; TQVCGVMAGRRVDE; QVCGVMAGRRVDEV; VCGVMAGRRVDEVA; CGVMAGRRVDEVAD; GVMAGRRVDEVADN; VMAGRRVDEVADNV; MAGRRVDEVADNVF; AGRRVDEVADNVFA; GRRVDEVADNVFAV; RRVDEVADNVFAVP; RVDEVADNVFAVPS; VDEVADNVFAVPSR; DEVADNVFAVPSRL; EVADNVFAVPSRLN; VADNVFAVPSRLNS; ADNVFAVPSRLNST; DNVFAVPSRLNSTW; NVFAVPSRLNSTWG; VFAVPSRLNSTWGG; FAVPSRLNSTWGGN; AVPSRLNSTWGGNL; VPSRLNSTWGGNLT; PSRLNSTWGGNLTD; SRLNSTWGGNLTDM; RLNSTWGGNLTDMV; LNSTWGGNLTDMVR; NSTWGGNLTDMVRA; STWGGNLTDMVRAR; TWGGNLTDMVRARR; WGGNLTDMVRARRI; GGNLTDMVRARRIL; GNLTDMVRARRILE; NLTDMVRARRILEV; LTDMVRARRILEVI; TDMVRARRILEVIE; DMVRARRILEVIEA; MVRARRILEVIEAE; VRARRILEVIEAEG; RARRILEVIEAEGL; ARRILEVIEAEGLF; | |

Fig. 29 continued

| | | | |
|---|---|---|---|
| | RRILEVIEAEGLFE; RILEVIEAEGLFER; ILEVIEAEGLFERA; LEVIEAEGLFERAV;<br>EVIEAEGLFERAVQ; VIEAEGLFERAVQH; IEAEGLFERAVQHG;<br>EAEGLFERAVQHGK; AEGLFERAVQHGKY; EGLFERAVQHGKYL;<br>GLFERAVQHGKYLR; LFERAVQHGKYLRA; FERAVQHGKYLRAR;<br>ERAVQHGKYLRARL; RAVQHGKYLRARLD; AVQHGKYLRARLDE;<br>VQHGKYLRARLDEL; QHGKYLRARLDELA; HGKYLRARLDELAA;<br>GKYLRARLDELAAD; KYLRARLDELAADF; YLRARLDELAADFP;<br>LRARLDELAADFPA; RARLDELAADFPAV; ARLDELAADFPAVV;<br>RLDELAADFPAVVL; LDELAADFPAVVLD; DELAADFPAVVLDP;<br>ELAADFPAVVLDPR; LAADFPAVVLDPRG; AADFPAVVLDPRGR;<br>ADFPAVVLDPRGRG; DFPAVVLDPRGRGL; FPAVVLDPRGRGLM;<br>PAVVLDPRGRGLMC; AVVLDPRGRGLMCA; VVLDPRGRGLMCAF;<br>VLDPRGRGLMCAFS; LDPRGRGLMCAFSL; DPRGRGLMCAFSLP;<br>PRGRGLMCAFSLPT; RGRGLMCAFSLPTT; GRGLMCAFSLPTTA;<br>RGLMCAFSLPTTAD; GLMCAFSLPTTADR; LMCAFSLPTTADRD;<br>MCAFSLPTTADRDE; CAFSLPTTADRDEL; AFSLPTTADRDELI;<br>FSLPTTADRDELIR; SLPTTADRDELIRQ; LPTTADRDELIRQL;<br>PTTADRDELIRQLW; TTADRDELIRQLWQ; TADRDELIRQLWQR;<br>ADRDELIRQLWQRA; DRDELIRQLWQRAV; RDELIRQLWQRAVI;<br>DELIRQLWQRAVIV; ELIRQLWQRAVIVL; LIRQLWQRAVIVLP;<br>IRQLWQRAVIVLPA; RQLWQRAVIVLPAG; QLWQRAVIVLPAGA;<br>LWQRAVIVLPAGAD; WQRAVIVLPAGADT; QRAVIVLPAGADTV;<br>RAVIVLPAGADTVR; AVIVLPAGADTVRF; VIVLPAGADTVRFR;<br>IVLPAGADTVRFRP; VLPAGADTVRFRPP; LPAGADTVRFRPPL;<br>PAGADTVRFRPPLT; AGADTVRFRPPLTV; GADTVRFRPPLTVS;<br>ADTVRFRPPLTVST; DTVRFRPPLTVSTA; TVRFRPPLTVSTAE;<br>VRFRPPLTVSTAEI; RFRPPLTVSTAEID; FRPPLTVSTAEIDA; RPPLTVSTAEIDAA;<br>PPLTVSTAEIDAAI; PLTVSTAEIDAAIA; LTVSTAEIDAAIAA; TVSTAEIDAAIAAV;<br>VSTAEIDAAIAAVR; STAEIDAAIAAVRS; TAEIDAAIAAVRSA; AEIDAAIAAVRSAL;<br>EIDAAIAAVRSALP; IDAAIAAVRSALPV; DAAIAAVRSALPVV; AAIAAVRSALPVVT<br><br>15 mers:<br>MAAVVKSVALAGRPT; AAVVKSVALAGRPTT; AVVKSVALAGRPTTP;<br>VVKSVALAGRPTTPD; VKSVALAGRPTTPDR; KSVALAGRPTTPDRV;<br>SVALAGRPTTPDRVH; VALAGRPTTPDRVHE; ALAGRPTTPDRVHEV;<br>LAGRPTTPDRVHEVL; AGRPTTPDRVHEVLG; GRPTTPDRVHEVLGR;<br>RPTTPDRVHEVLGRS; PTTPDRVHEVLGRSM; TTPDRVHEVLGRSML;<br>TPDRVHEVLGRSMLV; PDRVHEVLGRSMLVD; DRVHEVLGRSMLVDG;<br>RVHEVLGRSMLVDGL; VHEVLGRSMLVDGLD; HEVLGRSMLVDGLDI;<br>EVLGRSMLVDGLDIV; VLGRSMLVDGLDIVL; LGRSMLVDGLDIVLD;<br>GRSMLVDGLDIVLDL; RSMLVDGLDIVLDLT; SMLVDGLDIVLDLTR;<br>MLVDGLDIVLDLTRS; LVDGLDIVLDLTRSG; VDGLDIVLDLTRSGG;<br>DGLDIVLDLTRSGGS; GLDIVLDLTRSGGSY; LDIVLDLTRSGGSYL;<br>DIVLDLTRSGGSYLV; IVLDLTRSGGSYLVD; VLDLTRSGGSYLVDA;<br>LDLTRSGGSYLVDAI; DLTRSGGSYLVDAIT; LTRSGGSYLVDAITG;<br>TRSGGSYLVDAITGR; RSGGSYLVDAITGRR; SGGSYLVDAITGRRY;<br>GGSYLVDAITGRRYL; GSYLVDAITGRRYLD; SYLVDAITGRRYLDM;<br>YLVDAITGRRYLDMF; LVDAITGRRYLDMFT; VDAITGRRYLDMFTF;<br>DAITGRRYLDMFTFV; AITGRRYLDMFTFVA; ITGRRYLDMFTFVAS;<br>TGRRYLDMFTFVASS; GRRYLDMFTFVASSA; RRYLDMFTFVASSAL;<br>RYLDMFTFVASSALG; YLDMFTFVASSALGM; LDMFTFVASSALGMN;<br>DMFTFVASSALGMNP; MFTFVASSALGMNPP; FTFVASSALGMNPPA;<br>TFVASSALGMNPPAL; FVASSALGMNPPALV; VASSALGMNPPALVD; | |

Fig. 29 continued

| | | | |
|---|---|---|---|
| | ASSALGMNPPALVDD; SSALGMNPPALVDDR; SALGMNPPALVDDRE; ALGMNPPALVDDREF; LGMNPPALVDDREFH; GMNPPALVDDREFHA; MNPPALVDDREFHAE; NPPALVDDREFHAEL; PPALVDDREFHAELM; PALVDDREFHAELMQ; ALVDDREFHAELMQA; LVDDREFHAELMQAA; VDDREFHAELMQAAL; DDREFHAELMQAALN; DREFHAELMQAALNK; REFHAELMQAALNKP; EFHAELMQAALNKPS; FHAELMQAALNKPSN; HAELMQAALNKPSNS; AELMQAALNKPSNSD; ELMQAALNKPSNSDV; LMQAALNKPSNSDVY; MQAALNKPSNSDVYS; QAALNKPSNSDVYSV; AALNKPSNSDVYSVA; ALNKPSNSDVYSVAM; LNKPSNSDVYSVAMA; NKPSNSDVYSVAMAR; KPSNSDVYSVAMARF; PSNSDVYSVAMARFV; SNSDVYSVAMARFVE; NSDVYSVAMARFVET; SDVYSVAMARFVETF; DVYSVAMARFVETFA; VYSVAMARFVETFAR; YSVAMARFVETFARV; SVAMARFVETFARVL; VAMARFVETFARVLG; AMARFVETFARVLGD; MARFVETFARVLGDP; ARFVETFARVLGDPA; RFVETFARVLGDPAL; FVETFARVLGDPALP; VETFARVLGDPALPH; ETFARVLGDPALPHL; TFARVLGDPALPHLF; FARVLGDPALPHLFF; ARVLGDPALPHLFFV; RVLGDPALPHLFFVE; VLGDPALPHLFFVEG; LGDPALPHLFFVEGG; GDPALPHLFFVEGGA; DPALPHLFFVEGGAL; PALPHLFFVEGGALA; ALPHLFFVEGGALAV; LPHLFFVEGGALAVE; PHLFFVEGGALAVEN; HLFFVEGGALAVENA; LFFVEGGALAVENAL; FFVEGGALAVENALK; FVEGGALAVENALKA; VEGGALAVENALKAA; EGGALAVENALKAAF; GGALAVENALKAAFD; GALAVENALKAAFDW; ALAVENALKAAFDWK; LAVENALKAAFDWKS; AVENALKAAFDWKSR; VENALKAAFDWKSRH; ENALKAAFDWKSRHN; NALKAAFDWKSRHNQ; ALKAAFDWKSRHNQA; LKAAFDWKSRHNQAH; KAAFDWKSRHNQAHG; AAFDWKSRHNQAHGI; AFDWKSRHNQAHGID; FDWKSRHNQAHGIDP; DWKSRHNQAHGIDPA; WKSRHNQAHGIDPAL; KSRHNQAHGIDPALG; SRHNQAHGIDPALGT; RHNQAHGIDPALGTQ; HNQAHGIDPALGTQV; NQAHGIDPALGTQVL; QAHGIDPALGTQVLH; AHGIDPALGTQVLHL; HGIDPALGTQVLHLR; GIDPALGTQVLHLRG; IDPALGTQVLHLRGA; DPALGTQVLHLRGAF; PALGTQVLHLRGAFH; ALGTQVLHLRGAFHG; LGTQVLHLRGAFHGR; GTQVLHLRGAFHGRS; TQVLHLRGAFHGRSG; QVLHLRGAFHGRSGY; VLHLRGAFHGRSGYT; LHLRGAFHGRSGYTL; HLRGAFHGRSGYTLS; LRGAFHGRSGYTLSL; RGAFHGRSGYTLSLT; GAFHGRSGYTLSLTN; AFHGRSGYTLSLTNT; FHGRSGYTLSLTNTK; HGRSGYTLSLTNTKP; GRSGYTLSLTNTKPT; RSGYTLSLTNTKPTI; SGYTLSLTNTKPTIT; GYTLSLTNTKPTITA; YTLSLTNTKPTITAR; TLSLTNTKPTITARF; LSLTNTKPTITARFP; SLTNTKPTITARFPK; LTNTKPTITARFPKF; TNTKPTITARFPKFD; NTKPTITARFPKFDW; TKPTITARFPKFDWP; KPTITARFPKFDWPR; PTITARFPKFDWPRI; TITARFPKFDWPRID; ITARFPKFDWPRIDA; TARFPKFDWPRIDAP; ARFPKFDWPRIDAPY; RFPKFDWPRIDAPYM; FPKFDWPRIDAPYMR; PKFDWPRIDAPYMRP; KFDWPRIDAPYMRPG; FDWPRIDAPYMRPGL; DWPRIDAPYMRPGLD; WPRIDAPYMRPGLDE; PRIDAPYMRPGLDEP; RIDAPYMRPGLDEPA; IDAPYMRPGLDEPAM; DAPYMRPGLDEPAMA; APYMRPGLDEPAMAA; PYMRPGLDEPAMAAL; YMRPGLDEPAMAALE; MRPGLDEPAMAALEA; RPGLDEPAMAALEAE; PGLDEPAMAALEAEA; GLDEPAMAALEAEAL; LDEPAMAALEAEALR; DEPAMAALEAEALRQ; EPAMAALEAEALRQA; PAMAALEAEALRQAR; AMAALEAEALRQARA; MAALEAEALRQARAA; AALEAEALRQARAAF; ALEAEALRQARAAFE; LEAEALRQARAAFET; EAEALRQARAAFETR; AEALRQARAAFETRP; EALRQARAAFETRPH; ALRQARAAFETRPHD; LRQARAAFETRPHDI; RQARAAFETRPHDIA; QARAAFETRPHDIAC; ARAAFETRPHDIACF; RAAFETRPHDIACFV; | |

Fig. 29 continued

| | | |
|---|---|---|
| | AAFETRPHDIACFVA; AFETRPHDIACFVAE; FETRPHDIACFVAEP;<br>ETRPHDIACFVAEPI; TRPHDIACFVAEPIQ; RPHDIACFVAEPIQG;<br>PHDIACFVAEPIQGE; HDIACFVAEPIQGEG; DIACFVAEPIQGEGG;<br>IACFVAEPIQGEGGD; ACFVAEPIQGEGGDR; CFVAEPIQGEGGDRH;<br>FVAEPIQGEGGDRHF; VAEPIQGEGGDRHFR; AEPIQGEGGDRHFRP;<br>EPIQGEGGDRHFRPE; PIQGEGGDRHFRPEF; IQGEGGDRHFRPEFF;<br>QGEGGDRHFRPEFFA; GEGGDRHFRPEFFAA; EGGDRHFRPEFFAAM;<br>GGDRHFRPEFFAAMR; GDRHFRPEFFAAMRE; DRHFRPEFFAAMREL;<br>RHFRPEFFAAMRELC; HFRPEFFAAMRELCD; FRPEFFAAMRELCDE;<br>RPEFFAAMRELCDEF; PEFFAAMRELCDEFD; EFFAAMRELCDEFDA;<br>FFAAMRELCDEFDAL; FAAMRELCDEFDALL; AAMRELCDEFDALLI;<br>AMRELCDEFDALLIF; MRELCDEFDALLIFD; RELCDEFDALLIFDE;<br>ELCDEFDALLIFDEV; LCDEFDALLIFDEVQ; CDEFDALLIFDEVQT;<br>DEFDALLIFDEVQTG; EFDALLIFDEVQTGC; FDALLIFDEVQTGCG;<br>DALLIFDEVQTGCGL; ALLIFDEVQTGCGLT; LLIFDEVQTGCGLTG;<br>LIFDEVQTGCGLTGT; IFDEVQTGCGLTGTA; FDEVQTGCGLTGTAW;<br>DEVQTGCGLTGTAWA; EVQTGCGLTGTAWAY; VQTGCGLTGTAWAYQ;<br>QTGCGLTGTAWAYQQ; TGCGLTGTAWAYQQL; GCGLTGTAWAYQQLD;<br>CGLTGTAWAYQQLDV; GLTGTAWAYQQLDVA; LTGTAWAYQQLDVAP;<br>TGTAWAYQQLDVAPD; GTAWAYQQLDVAPDI; TAWAYQQLDVAPDIV;<br>AWAYQQLDVAPDIVA; WAYQQLDVAPDIVAF; AYQQLDVAPDIVAFG;<br>YQQLDVAPDIVAFGK; QQLDVAPDIVAFGKK; QLDVAPDIVAFGKKT;<br>LDVAPDIVAFGKKTQ; DVAPDIVAFGKKTQV; VAPDIVAFGKKTQVC;<br>APDIVAFGKKTQVCG; PDIVAFGKKTQVCGV; DIVAFGKKTQVCGVM;<br>IVAFGKKTQVCGVMA; VAFGKKTQVCGVMAG; AFGKKTQVCGVMAGR;<br>FGKKTQVCGVMAGRR; GKKTQVCGVMAGRRV; KKTQVCGVMAGRRVD;<br>KTQVCGVMAGRRVDE; TQVCGVMAGRRVDEV; QVCGVMAGRRVDEVA;<br>VCGVMAGRRVDEVAD; CGVMAGRRVDEVADN; GVMAGRRVDEVADNV;<br>VMAGRRVDEVADNVF; MAGRRVDEVADNVFA; AGRRVDEVADNVFAV;<br>GRRVDEVADNVFAVP; RRVDEVADNVFAVPS; RVDEVADNVFAVPSR;<br>VDEVADNVFAVPSRL; DEVADNVFAVPSRLN; EVADNVFAVPSRLNS;<br>VADNVFAVPSRLNST; ADNVFAVPSRLNSTW; DNVFAVPSRLNSTWG;<br>NVFAVPSRLNSTWGG; VFAVPSRLNSTWGGN; FAVPSRLNSTWGGNL;<br>AVPSRLNSTWGGNLT; VPSRLNSTWGGNLTD; PSRLNSTWGGNLTDM;<br>SRLNSTWGGNLTDMV; RLNSTWGGNLTDMVR; LNSTWGGNLTDMVRA;<br>NSTWGGNLTDMVRAR; STWGGNLTDMVRARR; TWGGNLTDMVRARRI;<br>WGGNLTDMVRARRIL; GGNLTDMVRARRILE; GNLTDMVRARRILEV;<br>NLTDMVRARRILEVI; LTDMVRARRILEVIE; TDMVRARRILEVIEA;<br>DMVRARRILEVIEAE; MVRARRILEVIEAEG; VRARRILEVIEAEGL;<br>RARRILEVIEAEGLF; ARRILEVIEAEGLFE; RRILEVIEAEGLFER;<br>RILEVIEAEGLFERA; ILEVIEAEGLFERAV; LEVIEAEGLFERAVQ;<br>EVIEAEGLFERAVQH; VIEAEGLFERAVQHG; IEAEGLFERAVQHGK;<br>EAEGLFERAVQHGKY; AEGLFERAVQHGKYL; EGLFERAVQHGKYLR;<br>GLFERAVQHGKYLRA; LFERAVQHGKYLRAR; FERAVQHGKYLRARL;<br>ERAVQHGKYLRARLD; RAVQHGKYLRARLDE; AVQHGKYLRARLDEL;<br>VQHGKYLRARLDELA; QHGKYLRARLDELAA; HGKYLRARLDELAAD;<br>GKYLRARLDELAADF; KYLRARLDELAADFP; YLRARLDELAADFPA;<br>LRARLDELAADFPAV; RARLDELAADFPAVV; ARLDELAADFPAVVL;<br>RLDELAADFPAVVLD; LDELAADFPAVVLDP; DELAADFPAVVLDPR;<br>ELAADFPAVVLDPRG; LAADFPAVVLDPRGR; AADFPAVVLDPRGRG;<br>ADFPAVVLDPRGRGL; DFPAVVLDPRGRGLM; FPAVVLDPRGRGLMC;<br>PAVVLDPRGRGLMCA; AVVLDPRGRGLMCAF; VVLDPRGRGLMCAFS;<br>VLDPRGRGLMCAFSL; LDPRGRGLMCAFSLP; DPRGRGLMCAFSLPT; | |

Fig. 29 continued

| | | | |
|---|---|---|---|
| | PRGRGLMCAFSLPTT; RGRGLMCAFSLPTTA; GRGLMCAFSLPTTAD; RGLMCAFSLPTTADR; GLMCAFSLPTTADRD; LMCAFSLPTTADRDE; MCAFSLPTTADRDEL; CAFSLPTTADRDELI; AFSLPTTADRDELIR; FSLPTTADRDELIRQ; SLPTTADRDELIRQL; LPTTADRDELIRQLW; PTTADRDELIRQLWQ; TTADRDELIRQLWQR; TADRDELIRQLWQRA; ADRDELIRQLWQRAV; DRDELIRQLWQRAVI; RDELIRQLWQRAVIV; DELIRQLWQRAVIVL; ELIRQLWQRAVIVLP; LIRQLWQRAVIVLPA; IRQLWQRAVIVLPAG; RQLWQRAVIVLPAGA; QLWQRAVIVLPAGAD; LWQRAVIVLPAGADT; WQRAVIVLPAGADTV; QRAVIVLPAGADTVR; RAVIVLPAGADTVRF; AVIVLPAGADTVRFR; VIVLPAGADTVRFRP; IVLPAGADTVRFRPP; VLPAGADTVRFRPPL; LPAGADTVRFRPPLT; PAGADTVRFRPPLTV; AGADTVRFRPPLTVS; GADTVRFRPPLTVST; ADTVRFRPPLTVSTA; DTVRFRPPLTVSTAE; TVRFRPPLTVSTAEI; VRFRPPLTVSTAEID; RFRPPLTVSTAEIDA; FRPPLTVSTAEIDAA; RPPLTVSTAEIDAAI; PPLTVSTAEIDAAIA; PLTVSTAEIDAAIAA; LTVSTAEIDAAIAAV; TVSTAEIDAAIAAVR; VSTAEIDAAIAAVRS; STAEIDAAIAAVRSA; TAEIDAAIAAVRSAL; AEIDAAIAAVRSALP; EIDAAIAAVRSALPV; IDAAIAAVRSALPVV; DAAIAAVRSALPVVT<br><br>16 mers:<br>MAAVVKSVALAGRPTT; AAVVKSVALAGRPTTP; AVVKSVALAGRPTTPD; VVKSVALAGRPTTPDR; VKSVALAGRPTTPDRV; KSVALAGRPTTPDRVH; SVALAGRPTTPDRVHE; VALAGRPTTPDRVHEV; ALAGRPTTPDRVHEVL; LAGRPTTPDRVHEVLG; AGRPTTPDRVHEVLGR; GRPTTPDRVHEVLGRS; RPTTPDRVHEVLGRSM; PTTPDRVHEVLGRSML; TTPDRVHEVLGRSMLV; TPDRVHEVLGRSMLVD; PDRVHEVLGRSMLVDG; DRVHEVLGRSMLVDGL; RVHEVLGRSMLVDGLD; VHEVLGRSMLVDGLDI; HEVLGRSMLVDGLDIV; EVLGRSMLVDGLDIVL; VLGRSMLVDGLDIVLD; LGRSMLVDGLDIVLDL; GRSMLVDGLDIVLDLT; RSMLVDGLDIVLDLTR; SMLVDGLDIVLDLTRS; MLVDGLDIVLDLTRSG; LVDGLDIVLDLTRSGG; VDGLDIVLDLTRSGGS; DGLDIVLDLTRSGGSY; GLDIVLDLTRSGGSYL; LDIVLDLTRSGGSYLV; DIVLDLTRSGGSYLVD; IVLDLTRSGGSYLVDA; VLDLTRSGGSYLVDAI; LDLTRSGGSYLVDAIT; DLTRSGGSYLVDAITG; LTRSGGSYLVDAITGR; TRSGGSYLVDAITGRR; RSGGSYLVDAITGRRY; SGGSYLVDAITGRRYL; GGSYLVDAITGRRYLD; GSYLVDAITGRRYLDM; SYLVDAITGRRYLDMF; YLVDAITGRRYLDMFT; LVDAITGRRYLDMFTF; VDAITGRRYLDMFTFV; DAITGRRYLDMFTFVA; AITGRRYLDMFTFVAS; ITGRRYLDMFTFVASS; TGRRYLDMFTFVASSA; GRRYLDMFTFVASSAL; RRYLDMFTFVASSALG; RYLDMFTFVASSALGM; YLDMFTFVASSALGMN; LDMFTFVASSALGMNP; DMFTFVASSALGMNPP; MFTFVASSALGMNPPA; FTFVASSALGMNPPAL; TFVASSALGMNPPALV; FVASSALGMNPPALVD; VASSALGMNPPALVDD; ASSALGMNPPALVDDR; SSALGMNPPALVDDRE; SALGMNPPALVDDREF; ALGMNPPALVDDREFH; LGMNPPALVDDREFHA; GMNPPALVDDREFHAE; MNPPALVDDREFHAEL; NPPALVDDREFHAELM; PPALVDDREFHAELMQ; PALVDDREFHAELMQA; ALVDDREFHAELMQAA; LVDDREFHAELMQAAL; VDDREFHAELMQAALN; DDREFHAELMQAALNK; DREFHAELMQAALNKP; REFHAELMQAALNKPS; EFHAELMQAALNKPSN; FHAELMQAALNKPSNS; HAELMQAALNKPSNSD; AELMQAALNKPSNSDV; ELMQAALNKPSNSDVY; LMQAALNKPSNSDVYS; MQAALNKPSNSDVYSV; QAALNKPSNSDVYSVA; AALNKPSNSDVYSVAM; ALNKPSNSDVYSVAMA; LNKPSNSDVYSVAMAR; NKPSNSDVYSVAMARF; KPSNSDVYSVAMARFV; PSNSDVYSVAMARFVE; SNSDVYSVAMARFVET; NSDVYSVAMARFVETF; SDVYSVAMARFVETFA; DVYSVAMARFVETFAR; VYSVAMARFVETFARV; YSVAMARFVETFARVL; | |

Fig. 29 continued

| | | |
|---|---|---|
| | SVAMARFVETFARVLG; VAMARFVETFARVLGD; AMARFVETFARVLGDP;<br>MARFVETFARVLGDPA; ARFVETFARVLGDPAL; RFVETFARVLGDPALP;<br>FVETFARVLGDPALPH; VETFARVLGDPALPHL; ETFARVLGDPALPHLF;<br>TFARVLGDPALPHLFF; FARVLGDPALPHLFFV; ARVLGDPALPHLFFVE;<br>RVLGDPALPHLFFVEG; VLGDPALPHLFFVEGG; LGDPALPHLFFVEGGA;<br>GDPALPHLFFVEGGAL; DPALPHLFFVEGGALA; PALPHLFFVEGGALAV;<br>ALPHLFFVEGGALAVE; LPHLFFVEGGALAVEN; PHLFFVEGGALAVENA;<br>HLFFVEGGALAVENAL; LFFVEGGALAVENALK; FFVEGGALAVENALKA;<br>FVEGGALAVENALKAA; VEGGALAVENALKAAF; EGGALAVENALKAAFD;<br>GGALAVENALKAAFDW; GALAVENALKAAFDWK; ALAVENALKAAFDWKS;<br>LAVENALKAAFDWKSR; AVENALKAAFDWKSRH; VENALKAAFDWKSRHN;<br>ENALKAAFDWKSRHNQ; NALKAAFDWKSRHNQA; ALKAAFDWKSRHNQAH;<br>LKAAFDWKSRHNQAHG; KAAFDWKSRHNQAHGI; AAFDWKSRHNQAHGID;<br>AFDWKSRHNQAHGIDP; FDWKSRHNQAHGIDPA; DWKSRHNQAHGIDPAL;<br>WKSRHNQAHGIDPALG; KSRHNQAHGIDPALGT; SRHNQAHGIDPALGTQ;<br>RHNQAHGIDPALGTQV; HNQAHGIDPALGTQVL; NQAHGIDPALGTQVLH;<br>QAHGIDPALGTQVLHL; AHGIDPALGTQVLHLR; HGIDPALGTQVLHLRG;<br>GIDPALGTQVLHLRGA; IDPALGTQVLHLRGAF; DPALGTQVLHLRGAFH;<br>PALGTQVLHLRGAFHG; ALGTQVLHLRGAFHGR; LGTQVLHLRGAFHGRS;<br>GTQVLHLRGAFHGRSG; TQVLHLRGAFHGRSGY; QVLHLRGAFHGRSGYT;<br>VLHLRGAFHGRSGYTL; LHLRGAFHGRSGYTLS; HLRGAFHGRSGYTLSL;<br>LRGAFHGRSGYTLSLT; RGAFHGRSGYTLSLTN; GAFHGRSGYTLSLTNT;<br>AFHGRSGYTLSLTNTK; FHGRSGYTLSLTNTKP; HGRSGYTLSLTNTKPT;<br>GRSGYTLSLTNTKPTI; RSGYTLSLTNTKPTIT; SGYTLSLTNTKPTITA;<br>GYTLSLTNTKPTITAR; YTLSLTNTKPTITARF; TLSLTNTKPTITARFP;<br>LSLTNTKPTITARFPK; SLTNTKPTITARFPKF; LTNTKPTITARFPKFD;<br>TNTKPTITARFPKFDW; NTKPTITARFPKFDWP; TKPTITARFPKFDWPR;<br>KPTITARFPKFDWPRI; PTITARFPKFDWPRID; TITARFPKFDWPRIDA;<br>ITARFPKFDWPRIDAP; TARFPKFDWPRIDAPY; ARFPKFDWPRIDAPYM;<br>RFPKFDWPRIDAPYMR; FPKFDWPRIDAPYMRP; PKFDWPRIDAPYMRPG;<br>KFDWPRIDAPYMRPGL; FDWPRIDAPYMRPGLD; DWPRIDAPYMRPGLDE;<br>WPRIDAPYMRPGLDEP; PRIDAPYMRPGLDEPA; RIDAPYMRPGLDEPAM;<br>IDAPYMRPGLDEPAMA; DAPYMRPGLDEPAMAA; APYMRPGLDEPAMAAL;<br>PYMRPGLDEPAMAALE; YMRPGLDEPAMAALEA; MRPGLDEPAMAALEAE;<br>RPGLDEPAMAALEAEA; PGLDEPAMAALEAEAL; GLDEPAMAALEAEALR;<br>LDEPAMAALEAEALRQ; DEPAMAALEAEALRQA; EPAMAALEAEALRQAR;<br>PAMAALEAEALRQARA; AMAALEAEALRQARAA; MAALEAEALRQARAAF;<br>AALEAEALRQARAAFE; ALEAEALRQARAAFET; LEAEALRQARAAFETR;<br>EAEALRQARAAFETRP; AEALRQARAAFETRPH; EALRQARAAFETRPHD;<br>ALRQARAAFETRPHDI; LRQARAAFETRPHDIA; RQARAAFETRPHDIAC;<br>QARAAFETRPHDIACF; ARAAFETRPHDIACFV; RAAFETRPHDIACFVA;<br>AAFETRPHDIACFVAE; AFETRPHDIACFVAEP; FETRPHDIACFVAEPI;<br>ETRPHDIACFVAEPIQ; TRPHDIACFVAEPIQG; RPHDIACFVAEPIQGE;<br>PHDIACFVAEPIQGEG; HDIACFVAEPIQGEGG; DIACFVAEPIQGEGGD;<br>IACFVAEPIQGEGGDR; ACFVAEPIQGEGGDRH; CFVAEPIQGEGGDRHF;<br>FVAEPIQGEGGDRHFR; VAEPIQGEGGDRHFRP; AEPIQGEGGDRHFRPE;<br>EPIQGEGGDRHFRPEF; PIQGEGGDRHFRPEFF; IQGEGGDRHFRPEFFA;<br>QGEGGDRHFRPEFFAA; GEGGDRHFRPEFFAAM; EGGDRHFRPEFFAAMR;<br>GGDRHFRPEFFAAMRE; GDRHFRPEFFAAMREL; DRHFRPEFFAAMRELC;<br>RHFRPEFFAAMRELCD; HFRPEFFAAMRELCDE; FRPEFFAAMRELCDEF;<br>RPEFFAAMRELCDEFD; PEFFAAMRELCDEFDA; EFFAAMRELCDEFDAL;<br>FFAAMRELCDEFDALL; FAAMRELCDEFDALLI; AAMRELCDEFDALLIF;<br>AMRELCDEFDALLIFD; MRELCDEFDALLIFDE; RELCDEFDALLIFDEV; | |

Fig. 29 continued

| | | |
|---|---|---|
| | ELCDEFDALLIFDEVQ; LCDEFDALLIFDEVQT; CDEFDALLIFDEVQTG; DEFDALLIFDEVQTGC; EFDALLIFDEVQTGCG; FDALLIFDEVQTGCGL; DALLIFDEVQTGCGLT; ALLIFDEVQTGCGLTG; LLIFDEVQTGCGLTGT; LIFDEVQTGCGLTGTA; IFDEVQTGCGLTGTAW; FDEVQTGCGLTGTAWA; DEVQTGCGLTGTAWAY; EVQTGCGLTGTAWAYQ; VQTGCGLTGTAWAYQQ; QTGCGLTGTAWAYQQL; TGCGLTGTAWAYQQLD; GCGLTGTAWAYQQLDV; CGLTGTAWAYQQLDVA; GLTGTAWAYQQLDVAP; LTGTAWAYQQLDVAPD; TGTAWAYQQLDVAPDI; GTAWAYQQLDVAPDIV; TAWAYQQLDVAPDIVA; AWAYQQLDVAPDIVAF; WAYQQLDVAPDIVAFG; AYQQLDVAPDIVAFGK; YQQLDVAPDIVAFGKK; QQLDVAPDIVAFGKKT; QLDVAPDIVAFGKKTQ; LDVAPDIVAFGKKTQV; DVAPDIVAFGKKTQVC; VAPDIVAFGKKTQVCG; APDIVAFGKKTQVCGV; PDIVAFGKKTQVCGVM; DIVAFGKKTQVCGVMA; IVAFGKKTQVCGVMAG; VAFGKKTQVCGVMAGR; AFGKKTQVCGVMAGRR; FGKKTQVCGVMAGRRV; GKKTQVCGVMAGRRVD; KKTQVCGVMAGRRVDE; KTQVCGVMAGRRVDEV; TQVCGVMAGRRVDEVA; QVCGVMAGRRVDEVAD; VCGVMAGRRVDEVADN; CGVMAGRRVDEVADNV; GVMAGRRVDEVADNVF; VMAGRRVDEVADNVFA; MAGRRVDEVADNVFAV; AGRRVDEVADNVFAVP; GRRVDEVADNVFAVPS; RRVDEVADNVFAVPSR; RVDEVADNVFAVPSRL; VDEVADNVFAVPSRLN; DEVADNVFAVPSRLNS; EVADNVFAVPSRLNST; VADNVFAVPSRLNSTW; ADNVFAVPSRLNSTWG; DNVFAVPSRLNSTWGG; NVFAVPSRLNSTWGGN; VFAVPSRLNSTWGGNL; FAVPSRLNSTWGGNLT; AVPSRLNSTWGGNLTD; VPSRLNSTWGGNLTDM; PSRLNSTWGGNLTDMV; SRLNSTWGGNLTDMVR; RLNSTWGGNLTDMVRA; LNSTWGGNLTDMVRAR; NSTWGGNLTDMVRARR; STWGGNLTDMVRARRI; TWGGNLTDMVRARRIL; WGGNLTDMVRARRILE; GGNLTDMVRARRILEV; GNLTDMVRARRILEVI; NLTDMVRARRILEVIE; LTDMVRARRILEVIEA; TDMVRARRILEVIEAE; DMVRARRILEVIEAEG; MVRARRILEVIEAEGL; VRARRILEVIEAEGLF; RARRILEVIEAEGLFE; ARRILEVIEAEGLFER; RRILEVIEAEGLFERA; RILEVIEAEGLFERAV; ILEVIEAEGLFERAVQ; LEVIEAEGLFERAVQH; EVIEAEGLFERAVQHG; VIEAEGLFERAVQHGK; IEAEGLFERAVQHGKY; EAEGLFERAVQHGKYL; AEGLFERAVQHGKYLR; EGLFERAVQHGKYLRA; GLFERAVQHGKYLRAR; LFERAVQHGKYLRARL; FERAVQHGKYLRARLD; ERAVQHGKYLRARLDE; RAVQHGKYLRARLDEL; AVQHGKYLRARLDELA; VQHGKYLRARLDELAA; QHGKYLRARLDELAAD; HGKYLRARLDELAADF; GKYLRARLDELAADFP; KYLRARLDELAADFPA; YLRARLDELAADFPAV; LRARLDELAADFPAVV; RARLDELAADFPAVVL; ARLDELAADFPAVVLD; RLDELAADFPAVVLDP; LDELAADFPAVVLDPR; DELAADFPAVVLDPRG; ELAADFPAVVLDPRGR; LAADFPAVVLDPRGRG; AADFPAVVLDPRGRGL; ADFPAVVLDPRGRGLM; DFPAVVLDPRGRGLMC; FPAVVLDPRGRGLMCA; PAVVLDPRGRGLMCAF; AVVLDPRGRGLMCAFS; VVLDPRGRGLMCAFSL; VLDPRGRGLMCAFSLP; LDPRGRGLMCAFSLPT; DPRGRGLMCAFSLPTT; PRGRGLMCAFSLPTTA; RGRGLMCAFSLPTTAD; GRGLMCAFSLPTTADR; RGLMCAFSLPTTADRD; GLMCAFSLPTTADRDE; LMCAFSLPTTADRDEL; MCAFSLPTTADRDELI; CAFSLPTTADRDELIR; AFSLPTTADRDELIRQ; FSLPTTADRDELIRQL; SLPTTADRDELIRQLW; LPTTADRDELIRQLWQ; PTTADRDELIRQLWQR; TTADRDELIRQLWQRA; TADRDELIRQLWQRAV; ADRDELIRQLWQRAVI; DRDELIRQLWQRAVIV; RDELIRQLWQRAVIVL; DELIRQLWQRAVIVLP; ELIRQLWQRAVIVLPA; LIRQLWQRAVIVLPAG; IRQLWQRAVIVLPAGA; RQLWQRAVIVLPAGAD; QLWQRAVIVLPAGADT; LWQRAVIVLPAGADTV; WQRAVIVLPAGADTVR; QRAVIVLPAGADTVRF; RAVIVLPAGADTVRFR; AVIVLPAGADTVRFRP; VIVLPAGADTVRFRPP; IVLPAGADTVRFRPPL; VLPAGADTVRFRPPLT; LPAGADTVRFRPPLTV; PAGADTVRFRPPLTVS; AGADTVRFRPPLTVST; GADTVRFRPPLTVSTA; | |

Fig. 29 continued

| | | |
|---|---|---|
| | ADTVRFRPPLTVSTAE; DTVRFRPPLTVSTAEI; TVRFRPPLTVSTAEID; VRFRPPLTVSTAEIDA; RFRPPLTVSTAEIDAA; FRPPLTVSTAEIDAAI; RPPLTVSTAEIDAAIA; PPLTVSTAEIDAAIAA; PLTVSTAEIDAAIAAV; LTVSTAEIDAAIAAVR; TVSTAEIDAAIAAVRS; VSTAEIDAAIAAVRSA; STAEIDAAIAAVRSAL; TAEIDAAIAAVRSALP; AEIDAAIAAVRSALPV; EIDAAIAAVRSALPVV; IDAAIAAVRSALPVVT | |
| 62) Rv3291c | 13 mers:<br>MNEALDDIDRILV; NEALDDIDRILVR; EALDDIDRILVRE; ALDDIDRILVREL; LDDIDRILVRELA; DDIDRILVRELAA; DIDRILVRELAAD; IDRILVRELAADG; DRILVRELAADGR; RILVRELAADGRA; ILVRELAADGRAT; LVRELAADGRATL; VRELAADGRATLS; RELAADGRATLSE; ELAADGRATLSEL; LAADGRATLSELA; AADGRATLSELAT; ADGRATLSELATR; DGRATLSELATRA; GRATLSELATRAG; RATLSELATRAGL; ATLSELATRAGLS; TLSELATRAGLSV; LSELATRAGLSVS; SELATRAGLSVSA; ELATRAGLSVSAV; LATRAGLSVSAVQ; ATRAGLSVSAVQS; TRAGLSVSAVQSR; RAGLSVSAVQSRV; AGLSVSAVQSRVR; GLSVSAVQSRVRR; LSVSAVQSRVRRL; SVSAVQSRVRRLE; VSAVQSRVRRLES; SAVQSRVRRLESR; AVQSRVRRLESRG; VQSRVRRLESRGV; QSRVRRLESRGVV; SRVRRLESRGVVQ; RVRRLESRGVVQG; VRRLESRGVVQGY; RRLESRGVVQGYS; RLESRGVVQGYSA; LESRGVVQGYSAR; ESRGVVQGYSARI; SRGVVQGYSARIN; RGVVQGYSARINP; GVVQGYSARINPE; VVQGYSARINPEA; VQGYSARINPEAV; QGYSARINPEAVG; GYSARINPEAVGH; YSARINPEAVGHL; SARINPEAVGHLL; ARINPEAVGHLLS; RINPEAVGHLLSA; INPEAVGHLLSAF; NPEAVGHLLSAFV; PEAVGHLLSAFVA; EAVGHLLSAFVAI; AVGHLLSAFVAIT; VGHLLSAFVAITP; GHLLSAFVAITPL; HLLSAFVAITPLD; LLSAFVAITPLDP; LSAFVAITPLDPS; SAFVAITPLDPSQ; AFVAITPLDPSQP; FVAITPLDPSQPD; VAITPLDPSQPDD; AITPLDPSQPDDA; ITPLDPSQPDDAP; TPLDPSQPDDAPA; PLDPSQPDDAPAR; LDPSQPDDAPARL; DPSQPDDAPARLE; PSQPDDAPARLEH; SQPDDAPARLEHI; QPDDAPARLEHIE; PDDAPARLEHIEE; DDAPARLEHIEEV; DAPARLEHIEEVE; APARLEHIEEVES; PARLEHIEEVESC; ARLEHIEEVESCY; RLEHIEEVESCYS; LEHIEEVESCYSV; EHIEEVESCYSVA; HIEEVESCYSVAG; IEEVESCYSVAGE; EEVESCYSVAGEE; EVESCYSVAGEES; VESCYSVAGEESY; ESCYSVAGEESYV; SCYSVAGEESYVL; CYSVAGEESYVLL; YSVAGEESYVLLV; SVAGEESYVLLVR; VAGEESYVLLVRV; AGEESYVLLVRVA; GEESYVLLVRVAS; EESYVLLVRVASA; ESYVLLVRVASAR; SYVLLVRVASARA; YVLLVRVASARAL; VLLVRVASARALE; LLVRVASARALED; LVRVASARALEDL; VRVASARALEDLL; RVASARALEDLLQ; VASARALEDLLQR; ASARALEDLLQRI; SARALEDLLQRIR; ARALEDLLQRIRT; RALEDLLQRIRTT; ALEDLLQRIRTTA; LEDLLQRIRTTAN; EDLLQRIRTTANV; DLLQRIRTTANVR; LLQRIRTTANVRT; LQRIRTTANVRTR; QRIRTTANVRTRS; RIRTTANVRTRST; IRTTANVRTRSTI; RTTANVRTRSTII; TTANVRTRSTIIL; TANVRTRSTIILN; ANVRTRSTIILNT; NVRTRSTIILNTF; VRTRSTIILNTFY; RTRSTIILNTFYS; TRSTIILNTFYSD; RSTIILNTFYSDR; STIILNTFYSDRQ; TIILNTFYSDRQH; IILNTFYSDRQHI; ILNTFYSDRQHIP<br><br>14 mers:<br>MNEALDDIDRILVR; NEALDDIDRILVRE; EALDDIDRILVREL; ALDDIDRILVRELA; LDDIDRILVRELAA; DDIDRILVRELAAD; DIDRILVRELAADG; IDRILVRELAADGR; DRILVRELAADGRA; RILVRELAADGRAT; ILVRELAADGRATL; LVRELAADGRATLS; VRELAADGRATLSE; RELAADGRATLSEL; ELAADGRATLSELA; LAADGRATLSELAT; AADGRATLSELATR; ADGRATLSELATRA; DGRATLSELATRAG; GRATLSELATRAGL; RATLSELATRAGLS; ATLSELATRAGLSV; TLSELATRAGLSVS; LSELATRAGLSVSA; SELATRAGLSVSAV; ELATRAGLSVSAVQ; | 102994-103539 |

Fig. 29 continued

LATRAGLSVSAVQS; ATRAGLSVSAVQSR; TRAGLSVSAVQSRV;
RAGLSVSAVQSRVR; AGLSVSAVQSRVRR; GLSVSAVQSRVRRL;
LSVSAVQSRVRRLE; SVSAVQSRVRRLES; VSAVQSRVRRLESR;
SAVQSRVRRLESRG; AVQSRVRRLESRGV; VQSRVRRLESRGVV;
QSRVRRLESRGVVQ; SRVRRLESRGVVQG; RVRRLESRGVVQGY;
VRRLESRGVVQGYS; RRLESRGVVQGYSA; RLESRGVVQGYSAR;
LESRGVVQGYSARI; ESRGVVQGYSARIN; SRGVVQGYSARINP;
RGVVQGYSARINPE; GVVQGYSARINPEA; VVQGYSARINPEAV;
VQGYSARINPEAVG; QGYSARINPEAVGH; GYSARINPEAVGHL;
YSARINPEAVGHLL; SARINPEAVGHLLS; ARINPEAVGHLLSA;
RINPEAVGHLLSAF; INPEAVGHLLSAFV; NPEAVGHLLSAFVA;
PEAVGHLLSAFVAI; EAVGHLLSAFVAIT; AVGHLLSAFVAITP; VGHLLSAFVAITPL;
GHLLSAFVAITPLD; HLLSAFVAITPLDP; LLSAFVAITPLDPS; LSAFVAITPLDPSQ;
SAFVAITPLDPSQP; AFVAITPLDPSQPD; FVAITPLDPSQPDD;
VAITPLDPSQPDDA; AITPLDPSQPDDAP; ITPLDPSQPDDAPA;
TPLDPSQPDDAPAR; PLDPSQPDDAPARL; LDPSQPDDAPARLE;
DPSQPDDAPARLEH; PSQPDDAPARLEHI; SQPDDAPARLEHIE;
QPDDAPARLEHIEE; PDDAPARLEHIEEV; DDAPARLEHIEEVE;
DAPARLEHIEEVES; APARLEHIEEVESC; PARLEHIEEVESCY;
ARLEHIEEVESCYS; RLEHIEEVESCYSV; LEHIEEVESCYSVA;
EHIEEVESCYSVAG; HIEEVESCYSVAGE; IEEVESCYSVAGEE;
EEVESCYSVAGEES; EVESCYSVAGEESY; VESCYSVAGEESYV;
ESCYSVAGEESYVL; SCYSVAGEESYVLL; CYSVAGEESYVLLV;
YSVAGEESYVLLVR; SVAGEESYVLLVRV; VAGEESYVLLVRVA;
AGEESYVLLVRVAS; GEESYVLLVRVASA; EESYVLLVRVASAR;
ESYVLLVRVASARA; SYVLLVRVASARAL; YVLLVRVASARALE;
VLLVRVASARALED; LLVRVASARALEDL; LVRVASARALEDLL;
VRVASARALEDLLQ; RVASARALEDLLQR; VASARALEDLLQRI;
ASARALEDLLQRIR; SARALEDLLQRIRT; ARALEDLLQRIRTT;
RALEDLLQRIRTTA; ALEDLLQRIRTTAN; LEDLLQRIRTTANV;
EDLLQRIRTTANVR; DLLQRIRTTANVRT; LLQRIRTTANVRTR;
LQRIRTTANVRTRS; QRIRTTANVRTRST; RIRTTANVRTRSTI; IRTTANVRTRSTII;
RTTANVRTRSTIIL; TTANVRTRSTIILN; TANVRTRSTIILNT; ANVRTRSTIILNTF;
NVRTRSTIILNTFY; VRTRSTIILNTFYS; RTRSTIILNTFYSD; TRSTIILNTFYSDR;
RSTIILNTFYSDRQ; STIILNTFYSDRQH; TIILNTFYSDRQHI; IILNTFYSDRQHIP 15 mers:
MNEALDDIDRILVRE; NEALDDIDRILVREL; EALDDIDRILVRELA;
ALDDIDRILVRELAA; LDDIDRILVRELAAD; DDIDRILVRELAADG;
DIDRILVRELAADGR; IDRILVRELAADGRA; DRILVRELAADGRAT;
RILVRELAADGRATL; ILVRELAADGRATLS; LVRELAADGRATLSE;
VRELAADGRATLSEL; RELAADGRATLSELA; ELAADGRATLSELAT;
LAADGRATLSELATR; AADGRATLSELATRA; ADGRATLSELATRAG;
DGRATLSELATRAGL; GRATLSELATRAGLS; RATLSELATRAGLSV;
ATLSELATRAGLSVS; TLSELATRAGLSVSA; LSELATRAGLSVSAV;
SELATRAGLSVSAVQ; ELATRAGLSVSAVQS; LATRAGLSVSAVQSR;
ATRAGLSVSAVQSRV; TRAGLSVSAVQSRVR; RAGLSVSAVQSRVRR;
AGLSVSAVQSRVRRL; GLSVSAVQSRVRRLE; LSVSAVQSRVRRLES;
SVSAVQSRVRRLESR; VSAVQSRVRRLESRG; SAVQSRVRRLESRGV;
AVQSRVRRLESRGVV; VQSRVRRLESRGVVQ; QSRVRRLESRGVVQG;
SRVRRLESRGVVQGY; RVRRLESRGVVQGYS; VRRLESRGVVQGYSA;
RRLESRGVVQGYSAR; RLESRGVVQGYSARI; LESRGVVQGYSARIN;
ESRGVVQGYSARINP; SRGVVQGYSARINPE; RGVVQGYSARINPEA;

Fig. 29 continued

| | | | |
|---|---|---|---|
| | GVVQGYSARINPEAV; VVQGYSARINPEAVG; VQGYSARINPEAVGH; QGYSARINPEAVGHL; GYSARINPEAVGHLL; YSARINPEAVGHLLS; SARINPEAVGHLLSA; ARINPEAVGHLLSAF; RINPEAVGHLLSAFV; INPEAVGHLLSAFVA; NPEAVGHLLSAFVAI; PEAVGHLLSAFVAIT; EAVGHLLSAFVAITP; AVGHLLSAFVAITPL; VGHLLSAFVAITPLD; GHLLSAFVAITPLDP; HLLSAFVAITPLDPS; LLSAFVAITPLDPSQ; LSAFVAITPLDPSQP; SAFVAITPLDPSQPD; AFVAITPLDPSQPDD; FVAITPLDPSQPDDA; VAITPLDPSQPDDAP; AITPLDPSQPDDAPA; ITPLDPSQPDDAPAR; TPLDPSQPDDAPARL; PLDPSQPDDAPARLE; LDPSQPDDAPARLEH; DPSQPDDAPARLEHI; PSQPDDAPARLEHIE; SQPDDAPARLEHIEE; QPDDAPARLEHIEEV; PDDAPARLEHIEEVE; DDAPARLEHIEEVES; DAPARLEHIEEVESC; APARLEHIEEVESCY; PARLEHIEEVESCYS; ARLEHIEEVESCYSV; RLEHIEEVESCYSVA; LEHIEEVESCYSVAG; EHIEEVESCYSVAGE; HIEEVESCYSVAGEE; IEEVESCYSVAGEES; EEVESCYSVAGEESY; EVESCYSVAGEESYV; VESCYSVAGEESYVL; ESCYSVAGEESYVLL; SCYSVAGEESYVLLV; CYSVAGEESYVLLVR; YSVAGEESYVLLVRV; SVAGEESYVLLVRVA; VAGEESYVLLVRVAS; AGEESYVLLVRVASA; GEESYVLLVRVASAR; EESYVLLVRVASARA; ESYVLLVRVASARAL; SYVLLVRVASARALE; YVLLVRVASARALED; VLLVRVASARALEDL; LLVRVASARALEDLL; LVRVASARALEDLLQ; VRVASARALEDLLQR; RVASARALEDLLQRI; VASARALEDLLQRIR; ASARALEDLLQRIRT; SARALEDLLQRIRTT; ARALEDLLQRIRTTA; RALEDLLQRIRTTAN; ALEDLLQRIRTTANV; LEDLLQRIRTTANVR; EDLLQRIRTTANVRT; DLLQRIRTTANVRTR; LLQRIRTTANVRTRS; LQRIRTTANVRTRST; QRIRTTANVRTRSTI; RIRTTANVRTRSTII; IRTTANVRTRSTIIL; RTTANVRTRSTIILN; TTANVRTRSTIILNT; TANVRTRSTIILNTF; ANVRTRSTIILNTFY; NVRTRSTIILNTFYS; VRTRSTIILNTFYSD; RTRSTIILNTFYSDR; TRSTIILNTFYSDRQ; RSTIILNTFYSDRQH; STIILNTFYSDRQHI; TIILNTFYSDRQHIP<br><br>16 mers:<br>MNEALDDIDRILVREL; NEALDDIDRILVRELA; EALDDIDRILVRELAA; ALDDIDRILVRELAAD; LDDIDRILVRELAADG; DDIDRILVRELAADGR; DIDRILVRELAADGRA; IDRILVRELAADGRAT; DRILVRELAADGRATL; RILVRELAADGRATLS; ILVRELAADGRATLSE; LVRELAADGRATLSEL; VRELAADGRATLSELA; RELAADGRATLSELAT; ELAADGRATLSELATR; LAADGRATLSELATRA; AADGRATLSELATRAG; ADGRATLSELATRAGL; DGRATLSELATRAGLS; GRATLSELATRAGLSV; RATLSELATRAGLSVS; ATLSELATRAGLSVSA; TLSELATRAGLSVSAV; LSELATRAGLSVSAVQ; SELATRAGLSVSAVQS; ELATRAGLSVSAVQSR; LATRAGLSVSAVQSRV; ATRAGLSVSAVQSRVR; TRAGLSVSAVQSRVRR; RAGLSVSAVQSRVRRL; AGLSVSAVQSRVRRLE; GLSVSAVQSRVRRLES; LSVSAVQSRVRRLESR; SVSAVQSRVRRLESRG; VSAVQSRVRRLESRGV; SAVQSRVRRLESRGVV; AVQSRVRRLESRGVVQ; VQSRVRRLESRGVVQG; QSRVRRLESRGVVQGY; SRVRRLESRGVVQGYS; RVRRLESRGVVQGYSA; VRRLESRGVVQGYSAR; RRLESRGVVQGYSARI; RLESRGVVQGYSARIN; LESRGVVQGYSARINP; ESRGVVQGYSARINPE; SRGVVQGYSARINPEA; RGVVQGYSARINPEAV; GVVQGYSARINPEAVG; VVQGYSARINPEAVGH; VQGYSARINPEAVGHL; QGYSARINPEAVGHLL; GYSARINPEAVGHLLS; YSARINPEAVGHLLSA; SARINPEAVGHLLSAF; ARINPEAVGHLLSAFV; RINPEAVGHLLSAFVA; INPEAVGHLLSAFVAI; NPEAVGHLLSAFVAIT; PEAVGHLLSAFVAITP; EAVGHLLSAFVAITPL; AVGHLLSAFVAITPLD; VGHLLSAFVAITPLDP; | |

Fig. 29 continued

| | | |
|---|---|---|
| | GHLLSAFVAITPLDPS; HLLSAFVAITPLDPSQ; LLSAFVAITPLDPSQP; LSAFVAITPLDPSQPD; SAFVAITPLDPSQPDD; AFVAITPLDPSQPDDA; FVAITPLDPSQPDDAP; VAITPLDPSQPDDAPA; AITPLDPSQPDDAPAR; ITPLDPSQPDDAPARL; TPLDPSQPDDAPARLE; PLDPSQPDDAPARLEH; LDPSQPDDAPARLEHI; DPSQPDDAPARLEHIE; PSQPDDAPARLEHIEE; SQPDDAPARLEHIEEV; QPDDAPARLEHIEEVE; PDDAPARLEHIEEVES; DDAPARLEHIEEVESC; DAPARLEHIEEVESCY; APARLEHIEEVESCYS; PARLEHIEEVESCYSV; ARLEHIEEVESCYSVA; RLEHIEEVESCYSVAG; LEHIEEVESCYSVAGE; EHIEEVESCYSVAGEE; HIEEVESCYSVAGEES; IEEVESCYSVAGEESY; EEVESCYSVAGEESYV; EVESCYSVAGEESYVL; VESCYSVAGEESYVLL; ESCYSVAGEESYVLLV; SCYSVAGEESYVLLVR; CYSVAGEESYVLLVRV; YSVAGEESYVLLVRVA; SVAGEESYVLLVRVAS; VAGEESYVLLVRVASA; AGEESYVLLVRVASAR; GEESYVLLVRVASARA; EESYVLLVRVASARAL; ESYVLLVRVASARALE; SYVLLVRVASARALED; YVLLVRVASARALEDL; VLLVRVASARALEDLL; LLVRVASARALEDLLQ; LVRVASARALEDLLQR; VRVASARALEDLLQRI; RVASARALEDLLQRIR; VASARALEDLLQRIRT; ASARALEDLLQRIRTT; SARALEDLLQRIRTTA; ARALEDLLQRIRTTAN; RALEDLLQRIRTTANV; ALEDLLQRIRTTANVR; LEDLLQRIRTTANVRT; EDLLQRIRTTANVRTR; DLLQRIRTTANVRTRS; LLQRIRTTANVRTRST; LQRIRTTANVRTRSTI; QRIRTTANVRTRSTII; RIRTTANVRTRSTIIL; IRTTANVRTRSTIILN; RTTANVRTRSTIILNT; TTANVRTRSTIILNTF; TANVRTRSTIILNTFY; ANVRTRSTIILNTFYS; NVRTRSTIILNTFYSD; VRTRSTIILNTFYSDR; RTRSTIILNTFYSDRQ; TRSTIILNTFYSDRQH; RSTIILNTFYSDRQHI; STIILNTFYSDRQHIP | |
| 63) Rv3444c | 13 mers:<br>MNADPVLSYNFDA; NADPVLSYNFDAI; ADPVLSYNFDAIE; DPVLSYNFDAIEY; PVLSYNFDAIEYS; VLSYNFDAIEYSV; LSYNFDAIEYSVR; SYNFDAIEYSVRQ; YNFDAIEYSVRQE; NFDAIEYSVRQEI; FDAIEYSVRQEIH; DAIEYSVRQEIHT; AIEYSVRQEIHTT; IEYSVRQEIHTTA; EYSVRQEIHTTAA; YSVRQEIHTTAAR; SVRQEIHTTAARF; VRQEIHTTAARFN; RQEIHTTAARFNA; QEIHTTAARFNAA; EIHTTAARFNAAL; IHTTAARFNAALQ; HTTAARFNAALQE; TTAARFNAALQEL; TAARFNAALQELR; AARFNAALQELRS; ARFNAALQELRSQ; RFNAALQELRSQI; FNAALQELRSQIA; NAALQELRSQIAP; AALQELRSQIAPL; ALQELRSQIAPLQ; LQELRSQIAPLQQ; QELRSQIAPLQQL; ELRSQIAPLQQLW; LRSQIAPLQQLWT; RSQIAPLQQLWTR; SQIAPLQQLWTRE; QIAPLQQLWTREA; IAPLQQLWTREAA; APLQQLWTREAAA; PLQQLWTREAAAA; LQQLWTREAAAAY; QQLWTREAAAAYH; QLWTREAAAAYHA; LWTREAAAAYHAE; WTREAAAAYHAEQ; TREAAAAYHAEQL; REAAAAYHAEQLK; EAAAAYHAEQLKW; AAAAYHAEQLKWH; AAAYHAEQLKWHQ; AAYHAEQLKWHQA; AYHAEQLKWHQAA; YHAEQLKWHQAAS; HAEQLKWHQAASA; AEQLKWHQAASAL; EQLKWHQAASALN; QLKWHQAASALNE; LKWHQAASALNEI; KWHQAASALNEIL; WHQAASALNEILI; HQAASALNEILID; QAASALNEILIDL; AASALNEILIDLG; ASALNEILIDLGN; SALNEILIDLGNA; ALNEILIDLGNAV; LNEILIDLGNAVR; NEILIDLGNAVRH; EILIDLGNAVRHG; ILIDLGNAVRHGA; LIDLGNAVRHGAD; IDLGNAVRHGADD; DLGNAVRHGADDV; LGNAVRHGADDVA; GNAVRHGADDVAH; NAVRHGADDVAHA; AVRHGADDVAHAD; VRHGADDVAHADR; RHGADDVAHADRR; HGADDVAHADRRA; GADDVAHADRRAA; ADDVAHADRRAAG; DDVAHADRRAAGA; DVAHADRRAAGAW; VAHADRRAAGAWA; AHADRRAAGAWAR;<br><br>14 mers:<br>MNADPVLSYNFDAI; NADPVLSYNFDAIE; ADPVLSYNFDAIEY; | 103540-103885 |

Fig. 29 continued

| | | | |
|---|---|---|---|
| | DPVLSYNFDAIEYS; PVLSYNFDAIEYSV; VLSYNFDAIEYSVR; LSYNFDAIEYSVRQ; SYNFDAIEYSVRQE; YNFDAIEYSVRQEI; NFDAIEYSVRQEIH; FDAIEYSVRQEIHT; DAIEYSVRQEIHTT; AIEYSVRQEIHTTA; IEYSVRQEIHTTAA; EYSVRQEIHTTAAR; YSVRQEIHTTAARF; SVRQEIHTTAARFN; VRQEIHTTAARFNA; RQEIHTTAARFNAA; QEIHTTAARFNAAL; EIHTTAARFNAALQ; IHTTAARFNAALQE; HTTAARFNAALQEL; TTAARFNAALQELR; TAARFNAALQELRS; AARFNAALQELRSQ; ARFNAALQELRSQI; RFNAALQELRSQIA; FNAALQELRSQIAP; NAALQELRSQIAPL; AALQELRSQIAPLQ; ALQELRSQIAPLQQ; LQELRSQIAPLQQL; QELRSQIAPLQQLW; ELRSQIAPLQQLWT; LRSQIAPLQQLWTR; RSQIAPLQQLWTRE; SQIAPLQQLWTREA; QIAPLQQLWTREAA; IAPLQQLWTREAAA; APLQQLWTREAAAA; PLQQLWTREAAAAY; LQQLWTREAAAAYH; QQLWTREAAAAYHA; QLWTREAAAAYHAE; LWTREAAAAYHAEQ; WTREAAAAYHAEQL; TREAAAAYHAEQLK; REAAAAYHAEQLKW; EAAAAYHAEQLKWH; AAAAYHAEQLKWHQ; AAAYHAEQLKWHQA; AAYHAEQLKWHQAA; AYHAEQLKWHQAAS; YHAEQLKWHQAASA; HAEQLKWHQAASAL; AEQLKWHQAASALN; EQLKWHQAASALNE; QLKWHQAASALNEI; LKWHQAASALNEIL; KWHQAASALNEILI; WHQAASALNEILID; HQAASALNEILIDL; QAASALNEILIDLG; AASALNEILIDLGN; ASALNEILIDLGNA; SALNEILIDLGNAV; ALNEILIDLGNAVR; LNEILIDLGNAVRH; NEILIDLGNAVRHG; EILIDLGNAVRHGA; ILIDLGNAVRHGAD; LIDLGNAVRHGADD; IDLGNAVRHGADDV; DLGNAVRHGADDVA; LGNAVRHGADDVAH; GNAVRHGADDVAHA; NAVRHGADDVAHAD; AVRHGADDVAHADR; VRHGADDVAHADRR; RHGADDVAHADRRA; HGADDVAHADRRAA; GADDVAHADRRAAG; ADDVAHADRRAAGA; DDVAHADRRAAGAW; DVAHADRRAAGAWA; VAHADRRAAGAWAR;<br><br>15 mers:<br>MNADPVLSYNFDAIE; NADPVLSYNFDAIEY; ADPVLSYNFDAIEYS; DPVLSYNFDAIEYSV; PVLSYNFDAIEYSVR; VLSYNFDAIEYSVRQ; LSYNFDAIEYSVRQE; SYNFDAIEYSVRQEI; YNFDAIEYSVRQEIH; NFDAIEYSVRQEIHT; FDAIEYSVRQEIHTT; DAIEYSVRQEIHTTA; AIEYSVRQEIHTTAA; IEYSVRQEIHTTAAR; EYSVRQEIHTTAARF; YSVRQEIHTTAARFN; SVRQEIHTTAARFNA; VRQEIHTTAARFNAA; RQEIHTTAARFNAAL; QEIHTTAARFNAALQ; EIHTTAARFNAALQE; IHTTAARFNAALQEL; HTTAARFNAALQELR; TTAARFNAALQELRS; TAARFNAALQELRSQ; AARFNAALQELRSQI; ARFNAALQELRSQIA; RFNAALQELRSQIAP; FNAALQELRSQIAPL; NAALQELRSQIAPLQ; AALQELRSQIAPLQQ; ALQELRSQIAPLQQL; LQELRSQIAPLQQLW; QELRSQIAPLQQLWT; ELRSQIAPLQQLWTR; LRSQIAPLQQLWTRE; RSQIAPLQQLWTREA; SQIAPLQQLWTREAA; QIAPLQQLWTREAAA; IAPLQQLWTREAAAA; APLQQLWTREAAAAY; PLQQLWTREAAAAYH; LQQLWTREAAAAYHA; QQLWTREAAAAYHAE; QLWTREAAAAYHAEQ; LWTREAAAAYHAEQL; WTREAAAAYHAEQLK; TREAAAAYHAEQLKW; REAAAAYHAEQLKWH; EAAAAYHAEQLKWHQ; AAAAYHAEQLKWHQA; AAAYHAEQLKWHQAA; AAYHAEQLKWHQAAS; AYHAEQLKWHQAASA; YHAEQLKWHQAASAL; HAEQLKWHQAASALN; AEQLKWHQAASALNE; EQLKWHQAASALNEI; QLKWHQAASALNEIL; LKWHQAASALNEILI; KWHQAASALNEILID; WHQAASALNEILIDL; HQAASALNEILIDLG; QAASALNEILIDLGN; AASALNEILIDLGNA; ASALNEILIDLGNAV; SALNEILIDLGNAVR; ALNEILIDLGNAVRH; LNEILIDLGNAVRHG; NEILIDLGNAVRHGA; EILIDLGNAVRHGAD; ILIDLGNAVRHGADD; | |

Fig. 29 continued

| | | |
|---|---|---|
| | LIDLGNAVRHGADDV; IDLGNAVRHGADDVA; DLGNAVRHGADDVAH; LGNAVRHGADDVAHA; GNAVRHGADDVAHAD; NAVRHGADDVAHADR; AVRHGADDVAHADRR; VRHGADDVAHADRRA; RHGADDVAHADRRAA; HGADDVAHADRRAAG; GADDVAHADRRAAGA; ADDVAHADRRAAGAW; DDVAHADRRAAGAWA; DVAHADRRAAGAWAR;<br><br>16 mers:<br>MNADPVLSYNFDAIEY; NADPVLSYNFDAIEYS; ADPVLSYNFDAIEYSV; DPVLSYNFDAIEYSVR; PVLSYNFDAIEYSVRQ; VLSYNFDAIEYSVRQE; LSYNFDAIEYSVRQEI; SYNFDAIEYSVRQEIH; YNFDAIEYSVRQEIHT; NFDAIEYSVRQEIHTT; FDAIEYSVRQEIHTTA; DAIEYSVRQEIHTTAA; AIEYSVRQEIHTTAAR; IEYSVRQEIHTTAARF; EYSVRQEIHTTAARFN; YSVRQEIHTTAARFNA; SVRQEIHTTAARFNAA; VRQEIHTTAARFNAAL; RQEIHTTAARFNAALQ; QEIHTTAARFNAALQE; EIHTTAARFNAALQEL; IHTTAARFNAALQELR; HTTAARFNAALQELRS; TTAARFNAALQELRSQ; TAARFNAALQELRSQI; AARFNAALQELRSQIA; ARFNAALQELRSQIAP; RFNAALQELRSQIAPL; FNAALQELRSQIAPLQ; NAALQELRSQIAPLQQ; AALQELRSQIAPLQQL; ALQELRSQIAPLQQLW; LQELRSQIAPLQQLWT; QELRSQIAPLQQLWTR; ELRSQIAPLQQLWTRE; LRSQIAPLQQLWTREA; RSQIAPLQQLWTREAA; SQIAPLQQLWTREAAA; QIAPLQQLWTREAAAA; IAPLQQLWTREAAAAY; APLQQLWTREAAAAYH; PLQQLWTREAAAAYHA; LQQLWTREAAAAYHAE; QQLWTREAAAAYHAEQ; QLWTREAAAAYHAEQL; LWTREAAAAYHAEQLK; WTREAAAAYHAEQLKW; TREAAAAYHAEQLKWH; REAAAAYHAEQLKWHQ; EAAAAYHAEQLKWHQA; AAAAYHAEQLKWHQAA; AAAYHAEQLKWHQAAS; AAYHAEQLKWHQAASA; AYHAEQLKWHQAASAL; YHAEQLKWHQAASALN; HAEQLKWHQAASALNE; AEQLKWHQAASALNEI; EQLKWHQAASALNEIL; QLKWHQAASALNEILI; LKWHQAASALNEILID; KWHQAASALNEILIDL; WHQAASALNEILIDLG; HQAASALNEILIDLGN; QAASALNEILIDLGNA; AASALNEILIDLGNAV; ASALNEILIDLGNAVR; SALNEILIDLGNAVRH; ALNEILIDLGNAVRHG; LNEILIDLGNAVRHGA; NEILIDLGNAVRHGAD; EILIDLGNAVRHGADD; ILIDLGNAVRHGADDV; LIDLGNAVRHGADDVA; IDLGNAVRHGADDVAH; DLGNAVRHGADDVAHA; LGNAVRHGADDVAHAD; GNAVRHGADDVAHADR; NAVRHGADDVAHADRR; AVRHGADDVAHADRRA; VRHGADDVAHADRRAA; RHGADDVAHADRRAAG; HGADDVAHADRRAAGA; GADDVAHADRRAAGAW; ADDVAHADRRAAGAWA; DDVAHADRRAAGAWAR; | |
| 64) Rv3445c | 13 mers:<br>MVEPGRIGGNQTR; VEPGRIGGNQTRL; EPGRIGGNQTRLA; PGRIGGNQTRLAA; GRIGGNQTRLAAV; RIGGNQTRLAAVL; IGGNQTRLAAVLL; GGNQTRLAAVLLD; GNQTRLAAVLLDV; NQTRLAAVLLDVS; QTRLAAVLLDVST; TRLAAVLLDVSTP; RLAAVLLDVSTPN; LAAVLLDVSTPNT; AAVLLDVSTPNTL; AVLLDVSTPNTLN; VLLDVSTPNTLNA; LLDVSTPNTLNAD; LDVSTPNTLNADF; DVSTPNTLNADFD; VSTPNTLNADFDL; STPNTLNADFDLM; TPNTLNADFDLMR; PNTLNADFDLMRS; NTLNADFDLMRSV; TLNADFDLMRSVA; LNADFDLMRSVAG; NADFDLMRSVAGI; ADFDLMRSVAGIT; DFDLMRSVAGITD; FDLMRSVAGITDA; DLMRSVAGITDAR; LMRSVAGITDARN; MRSVAGITDARNE; RSVAGITDARNEE; SVAGITDARNEEI; VAGITDARNEEIR; AGITDARNEEIRA; GITDARNEEIRAM; ITDARNEEIRAML; TDARNEEIRAMLQ; DARNEEIRAMLQA; ARNEEIRAMLQAF; RNEEIRAMLQAFI; NEEIRAMLQAFIG; EEIRAMLQAFIGR; EIRAMLQAFIGRM; IRAMLQAFIGRMS; RAMLQAFIGRMSG; AMLQAFIGRMSGV; MLQAFIGRMSGVP; LQAFIGRMSGVPP; QAFIGRMSGVPPS; AFIGRMSGVPPSV; FIGRMSGVPPSVW; IGRMSGVPPSVWG; GRMSGVPPSVWGG; RMSGVPPSVWGGL; MSGVPPSVWGGLA; SGVPPSVWGGLAA; GVPPSVWGGLAAA; | 103886-104331 |

Fig. 29 continued

| | | | |
|---|---|---|---|
| | VPPSVWGGLAAAR; PPSVWGGLAAARF; PSVWGGLAAARFQ; SVWGGLAAARFQD; VWGGLAAARFQDV; WGGLAAARFQDVV; GGLAAARFQDVVD; GLAAARFQDVVDR; LAAARFQDVVDRW; AAARFQDVVDRWN; AARFQDVVDRWNA; ARFQDVVDRWNAE; RFQDVVDRWNAES; FQDVVDRWNAEST; QDVVDRWNAESTR; DVVDRWNAESTRL; VVDRWNAESTRLY; VDRWNAESTRLYH; DRWNAESTRLYHV; RWNAESTRLYHVL; WNAESTRLYHVLH; NAESTRLYHVLHA; AESTRLYHVLHAI; ESTRLYHVLHAIA; STRLYHVLHAIAD; TRLYHVLHAIADT; RLYHVLHAIADTI; LYHVLHAIADTIR; YHVLHAIADTIRH; HVLHAIADTIRHN; VLHAIADTIRHNE; LHAIADTIRHNEA; HAIADTIRHNEAA; AIADTIRHNEAAL; IADTIRHNEAALR; ADTIRHNEAALRE; DTIRHNEAALREA; TIRHNEAALREAG; IRHNEAALREAGQ; RHNEAALREAGQI; HNEAALREAGQIH; NEAALREAGQIHA; EAALREAGQIHAR; AALREAGQIHARH; ALREAGQIHARHI; LREAGQIHARHIA; REAGQIHARHIAA; EAGQIHARHIAAA; AGQIHARHIAAAG; GQIHARHIAAAGG; QIHARHIAAAGGD; IHARHIAAAGGDL;<br><br>14 mers:<br>MVEPGRIGGNQTRL; VEPGRIGGNQTRLA; EPGRIGGNQTRLAA; PGRIGGNQTRLAAV; GRIGGNQTRLAAVL; RIGGNQTRLAAVLL; IGGNQTRLAAVLLD; GGNQTRLAAVLLDV; GNQTRLAAVLLDVS; NQTRLAAVLLDVST; QTRLAAVLLDVSTP; TRLAAVLLDVSTPN; RLAAVLLDVSTPNT; LAAVLLDVSTPNTL; AAVLLDVSTPNTLN; AVLLDVSTPNTLNA; VLLDVSTPNTLNAD; LLDVSTPNTLNADF; LDVSTPNTLNADFD; DVSTPNTLNADFDL; VSTPNTLNADFDLM; STPNTLNADFDLMR; TPNTLNADFDLMRS; PNTLNADFDLMRSV; NTLNADFDLMRSVA; TLNADFDLMRSVAG; LNADFDLMRSVAGI; NADFDLMRSVAGIT; ADFDLMRSVAGITD; DFDLMRSVAGITDA; FDLMRSVAGITDAR; DLMRSVAGITDARN; LMRSVAGITDARNE; MRSVAGITDARNEE; RSVAGITDARNEEI; SVAGITDARNEEIR; VAGITDARNEEIRA; AGITDARNEEIRAM; GITDARNEEIRAML; ITDARNEEIRAMLQ; TDARNEEIRAMLQA; DARNEEIRAMLQAF; ARNEEIRAMLQAFI; RNEEIRAMLQAFIG; NEEIRAMLQAFIGR; EEIRAMLQAFIGRM; EIRAMLQAFIGRMS; IRAMLQAFIGRMSG; RAMLQAFIGRMSGV; AMLQAFIGRMSGVP; MLQAFIGRMSGVPP; LQAFIGRMSGVPPS; QAFIGRMSGVPPSV; AFIGRMSGVPPSVW; FIGRMSGVPPSVWG; IGRMSGVPPSVWGG; GRMSGVPPSVWGGL; RMSGVPPSVWGGLA; MSGVPPSVWGGLAA; SGVPPSVWGGLAAA; GVPPSVWGGLAAAR; VPPSVWGGLAAARF; PPSVWGGLAAARFQ; PSVWGGLAAARFQD; SVWGGLAAARFQDV; VWGGLAAARFQDVV; WGGLAAARFQDVVD; GGLAAARFQDVVDR; GLAAARFQDVVDRW; LAAARFQDVVDRWN; AAARFQDVVDRWNA; AARFQDVVDRWNAE; ARFQDVVDRWNAES; RFQDVVDRWNAEST; FQDVVDRWNAESTR; QDVVDRWNAESTRL; DVVDRWNAESTRLY; VVDRWNAESTRLYH; VDRWNAESTRLYHV; DRWNAESTRLYHVL; RWNAESTRLYHVLH; WNAESTRLYHVLHA; NAESTRLYHVLHAI; AESTRLYHVLHAIA; ESTRLYHVLHAIAD; STRLYHVLHAIADT; TRLYHVLHAIADTI; RLYHVLHAIADTIR; LYHVLHAIADTIRH; YHVLHAIADTIRHN; HVLHAIADTIRHNE; VLHAIADTIRHNEA; LHAIADTIRHNEAA; HAIADTIRHNEAAL; AIADTIRHNEAALR; IADTIRHNEAALRE; ADTIRHNEAALREA; DTIRHNEAALREAG; TIRHNEAALREAGQ; IRHNEAALREAGQI; RHNEAALREAGQIH; HNEAALREAGQIHA; NEAALREAGQIHAR; EAALREAGQIHARH; AALREAGQIHARHI; ALREAGQIHARHIA; LREAGQIHARHIAA; REAGQIHARHIAAA; EAGQIHARHIAAAG; AGQIHARHIAAAGG; GQIHARHIAAAGGD; | |

Fig. 29 continued

QIHARHIAAAGGDL;

15 mers:
MVEPGRIGGNQTRLA; VEPGRIGGNQTRLAA; EPGRIGGNQTRLAAV;
PGRIGGNQTRLAAVL; GRIGGNQTRLAAVLL; RIGGNQTRLAAVLLD;
IGGNQTRLAAVLLDV; GGNQTRLAAVLLDVS; GNQTRLAAVLLDVST;
NQTRLAAVLLDVSTP; QTRLAAVLLDVSTPN; TRLAAVLLDVSTPNT;
RLAAVLLDVSTPNTL; LAAVLLDVSTPNTLN; AAVLLDVSTPNTLNA;
AVLLDVSTPNTLNAD; VLLDVSTPNTLNADF; LLDVSTPNTLNADFD;
LDVSTPNTLNADFDL; DVSTPNTLNADFDLM; VSTPNTLNADFDLMR;
STPNTLNADFDLMRS; TPNTLNADFDLMRSV; PNTLNADFDLMRSVA;
NTLNADFDLMRSVAG; TLNADFDLMRSVAGI; LNADFDLMRSVAGIT;
NADFDLMRSVAGITD; ADFDLMRSVAGITDA; DFDLMRSVAGITDAR;
FDLMRSVAGITDARN; DLMRSVAGITDARNE; LMRSVAGITDARNEE;
MRSVAGITDARNEEI; RSVAGITDARNEEIR; SVAGITDARNEEIRA;
VAGITDARNEEIRAM; AGITDARNEEIRAML; GITDARNEEIRAMLQ;
ITDARNEEIRAMLQA; TDARNEEIRAMLQAF; DARNEEIRAMLQAFI;
ARNEEIRAMLQAFIG; RNEEIRAMLQAFIGR; NEEIRAMLQAFIGRM;
EEIRAMLQAFIGRMS; EIRAMLQAFIGRMSG; IRAMLQAFIGRMSGV;
RAMLQAFIGRMSGVP; AMLQAFIGRMSGVPP; MLQAFIGRMSGVPPS;
LQAFIGRMSGVPPSV; QAFIGRMSGVPPSVW; AFIGRMSGVPPSVWG;
FIGRMSGVPPSVWGG; IGRMSGVPPSVWGGL; GRMSGVPPSVWGGLA;
RMSGVPPSVWGGLAA; MSGVPPSVWGGLAAA; SGVPPSVWGGLAAAR;
GVPPSVWGGLAAARF; VPPSVWGGLAAARFQ; PPSVWGGLAAARFQD;
PSVWGGLAAARFQDV; SVWGGLAAARFQDVV; VWGGLAAARFQDVVD;
WGGLAAARFQDVVDR; GGLAAARFQDVVDRW; GLAAARFQDVVDRWN;
LAAARFQDVVDRWNA; AAARFQDVVDRWNAE; AARFQDVVDRWNAES;
ARFQDVVDRWNAEST; RFQDVVDRWNAESTR; FQDVVDRWNAESTRL;
QDVVDRWNAESTRLY; DVVDRWNAESTRLYH; VVDRWNAESTRLYHV;
VDRWNAESTRLYHVL; DRWNAESTRLYHVLH; RWNAESTRLYHVLHA;
WNAESTRLYHVLHAI; NAESTRLYHVLHAIA; AESTRLYHVLHAIAD;
ESTRLYHVLHAIADT; STRLYHVLHAIADTI; TRLYHVLHAIADTIR;
RLYHVLHAIADTIRH; LYHVLHAIADTIRHN; YHVLHAIADTIRHNE;
HVLHAIADTIRHNEA; VLHAIADTIRHNEAA; LHAIADTIRHNEAAL;
HAIADTIRHNEAALR; AIADTIRHNEAALRE; IADTIRHNEAALREA;
ADTIRHNEAALREAG; DTIRHNEAALREAGQ; TIRHNEAALREAGQI;
IRHNEAALREAGQIH; RHNEAALREAGQIHA; HNEAALREAGQIHAR;
NEAALREAGQIHARH; EAALREAGQIHARHI; AALREAGQIHARHIA;
ALREAGQIHARHIAA; LREAGQIHARHIAAA; REAGQIHARHIAAAG;
EAGQIHARHIAAAGG; AGQIHARHIAAAGGD; GQIHARHIAAAGGDL;

16 mers:
MVEPGRIGGNQTRLAA; VEPGRIGGNQTRLAAV; EPGRIGGNQTRLAAVL;
PGRIGGNQTRLAAVLL; GRIGGNQTRLAAVLLD; RIGGNQTRLAAVLLDV;
IGGNQTRLAAVLLDVS; GGNQTRLAAVLLDVST; GNQTRLAAVLLDVSTP;
NQTRLAAVLLDVSTPN; QTRLAAVLLDVSTPNT; TRLAAVLLDVSTPNTL;
RLAAVLLDVSTPNTLN; LAAVLLDVSTPNTLNA; AAVLLDVSTPNTLNAD;
AVLLDVSTPNTLNADF; VLLDVSTPNTLNADFD; LLDVSTPNTLNADFDL;
LDVSTPNTLNADFDLM; DVSTPNTLNADFDLMR; VSTPNTLNADFDLMRS;
STPNTLNADFDLMRSV; TPNTLNADFDLMRSVA; PNTLNADFDLMRSVAG;
NTLNADFDLMRSVAGI; TLNADFDLMRSVAGIT; LNADFDLMRSVAGITD;
NADFDLMRSVAGITDA; ADFDLMRSVAGITDAR; DFDLMRSVAGITDARN;
FDLMRSVAGITDARNE; DLMRSVAGITDARNEE; LMRSVAGITDARNEEI;

Fig. 29 continued

| | | |
|---|---|---|
| | MRSVAGITDARNEEIR; RSVAGITDARNEEIRA; SVAGITDARNEEIRAM; VAGITDARNEEIRAML; AGITDARNEEIRAMLQ; GITDARNEEIRAMLQA; ITDARNEEIRAMLQAF; TDARNEEIRAMLQAFI; DARNEEIRAMLQAFIG; ARNEEIRAMLQAFIGR; RNEEIRAMLQAFIGRM; NEEIRAMLQAFIGRMS; EEIRAMLQAFIGRMSG; EIRAMLQAFIGRMSGV; IRAMLQAFIGRMSGVP; RAMLQAFIGRMSGVPP; AMLQAFIGRMSGVPPS; MLQAFIGRMSGVPPSV; LQAFIGRMSGVPPSVW; QAFIGRMSGVPPSVWG; AFIGRMSGVPPSVWGG; FIGRMSGVPPSVWGGL; IGRMSGVPPSVWGGLA; GRMSGVPPSVWGGLAA; RMSGVPPSVWGGLAAA; MSGVPPSVWGGLAAAR; SGVPPSVWGGLAAARF; GVPPSVWGGLAAARFQ; VPPSVWGGLAAARFQD; PPSVWGGLAAARFQDV; PSVWGGLAAARFQDVV; SVWGGLAAARFQDVVD; VWGGLAAARFQDVVDR; WGGLAAARFQDVVDRW; GGLAAARFQDVVDRWN; GLAAARFQDVVDRWNA; LAAARFQDVVDRWNAE; AAARFQDVVDRWNAES; AARFQDVVDRWNAEST; ARFQDVVDRWNAESTR; RFQDVVDRWNAESTRL; FQDVVDRWNAESTRLY; QDVVDRWNAESTRLYH; DVVDRWNAESTRLYHV; VVDRWNAESTRLYHVL; VDRWNAESTRLYHVLH; DRWNAESTRLYHVLHA; RWNAESTRLYHVLHAI; WNAESTRLYHVLHAIA; NAESTRLYHVLHAIAD; AESTRLYHVLHAIADT; ESTRLYHVLHAIADTI; STRLYHVLHAIADTIR; TRLYHVLHAIADTIRH; RLYHVLHAIADTIRHN; LYHVLHAIADTIRHNE; YHVLHAIADTIRHNEA; HVLHAIADTIRHNEAA; VLHAIADTIRHNEAAL; LHAIADTIRHNEAALR; HAIADTIRHNEAALRE; AIADTIRHNEAALREA; IADTIRHNEAALREAG; ADTIRHNEAALREAGQ; DTIRHNEAALREAGQI; TIRHNEAALREAGQIH; IRHNEAALREAGQIHA; RHNEAALREAGQIHAR; HNEAALREAGQIHARH; NEAALREAGQIHARHI; EAALREAGQIHARHIA; AALREAGQIHARHIAA; ALREAGQIHARHIAAA; LREAGQIHARHIAAAG; REAGQIHARHIAAAGG; EAGQIHARHIAAAGGD; AGQIHARHIAAAGGDL | |
| 65) Rv3477 | 13 mers:<br>MSFTAQPEMLAAA; SFTAQPEMLAAAA; FTAQPEMLAAAAG; TAQPEMLAAAAGE; AQPEMLAAAAGEL; QPEMLAAAAGELR; PEMLAAAAGELRS; EMLAAAAGELRSL; MLAAAAGELRSLG; LAAAAGELRSLGA; AAAAGELRSLGAT; AAAGELRSLGATL; AAGELRSLGATLK; AGELRSLGATLKA; GELRSLGATLKAS; ELRSLGATLKASN; LRSLGATLKASNA; RSLGATLKASNAA; SLGATLKASNAAA; LGATLKASNAAAA; GATLKASNAAAAV; ATLKASNAAAAVP; TLKASNAAAAVPT; LKASNAAAAVPTT; KASNAAAAVPTTG; ASNAAAAVPTTGV; SNAAAAVPTTGVV; NAAAAVPTTGVVP; AAAAVPTTGVVPP; AAAVPTTGVVPPA; AAVPTTGVVPPAA; AVPTTGVVPPAAD; VPTTGVVPPAADE; PTTGVVPPAADEV; TTGVVPPAADEVS; TGVVPPAADEVSL; GVVPPAADEVSLL; VVPPAADEVSLLL; VPPAADEVSLLLA; PPAADEVSLLLAT; PAADEVSLLLATQ; AADEVSLLLATQF; ADEVSLLLATQFR; DEVSLLLATQFRT; EVSLLLATQFRTH; VSLLLATQFRTHA; SLLLATQFRTHAA; LLLATQFRTHAAT; LLATQFRTHAATY; LATQFRTHAATYQ; ATQFRTHAATYQT; TQFRTHAATYQTA; QFRTHAATYQTAS; FRTHAATYQTASA; RTHAATYQTASAK; THAATYQTASAKA; HAATYQTASAKAA; AATYQTASAKAAV; ATYQTASAKAAVI; TYQTASAKAAVIH; YQTASAKAAVIHE; QTASAKAAVIHEQ; TASAKAAVIHEQF; ASAKAAVIHEQFV; SAKAAVIHEQFVT; AKAAVIHEQFVTT; KAAVIHEQFVTTL; AAVIHEQFVTTLA; AVIHEQFVTTLAT; VIHEQFVTTLATS; IHEQFVTTLATSA; HEQFVTTLATSAS; EQFVTTLATSASS; QFVTTLATSASSY; FVTTLATSASSYA; VTTLATSASSYAD; TTLATSASSYADT; TLATSASSYADTE; LATSASSYADTEA; ATSASSYADTEAA; TSASSYADTEAAN; SASSYADTEAANA; ASSYADTEAANAV; SSYADTEAANAVV; SYADTEAANAVVT; YADTEAANAVVTG;<br><br>14 mers:<br>MSFTAQPEMLAAAA; SFTAQPEMLAAAAG; FTAQPEMLAAAAGE; TAQPEMLAAAAGEL; AQPEMLAAAAGELR; QPEMLAAAAGELRS; | 104332-104669 |

Fig. 29 continued

| | | |
|---|---|---|
| | PEMLAAAAGELRSL; EMLAAAAGELRSLG; MLAAAAGELRSLGA; LAAAAGELRSLGAT; AAAAGELRSLGATL; AAAGELRSLGATLK; AAGELRSLGATLKA; AGELRSLGATLKAS; GELRSLGATLKASN; ELRSLGATLKASNA; LRSLGATLKASNAA; RSLGATLKASNAAA; SLGATLKASNAAAA; LGATLKASNAAAAV; GATLKASNAAAAVP; ATLKASNAAAAVPT; TLKASNAAAAVPTT; LKASNAAAAVPTTG; KASNAAAAVPTTGV; ASNAAAAVPTTGVV; SNAAAAVPTTGVVP; NAAAAVPTTGVVPP; AAAAVPTTGVVPPA; AAAVPTTGVVPPAA; AAVPTTGVVPPAAD; AVPTTGVVPPAADE; VPTTGVVPPAADEV; PTTGVVPPAADEVS; TTGVVPPAADEVSL; TGVVPPAADEVSLL; GVVPPAADEVSLLL; VVPPAADEVSLLLA; VPPAADEVSLLLAT; PPAADEVSLLLATQ; PAADEVSLLLATQF; AADEVSLLLATQFR; ADEVSLLLATQFRT; DEVSLLLATQFRTH; EVSLLLATQFRTHA; VSLLLATQFRTHAA; SLLLATQFRTHAAT; LLLATQFRTHAATY; LLATQFRTHAATYQ; LATQFRTHAATYQT; ATQFRTHAATYQTA; TQFRTHAATYQTAS; QFRTHAATYQTASA; FRTHAATYQTASAK; RTHAATYQTASAKA; THAATYQTASAKAA; HAATYQTASAKAAV; AATYQTASAKAAVI; ATYQTASAKAAVIH; TYQTASAKAAVIHE; YQTASAKAAVIHEQ; QTASAKAAVIHEQF; TASAKAAVIHEQFV; ASAKAAVIHEQFVT; SAKAAVIHEQFVTT; AKAAVIHEQFVTTL; KAAVIHEQFVTTLA; AAVIHEQFVTTLAT; AVIHEQFVTTLATS; VIHEQFVTTLATSA; IHEQFVTTLATSAS; HEQFVTTLATSASS; EQFVTTLATSASSY; QFVTTLATSASSYA; FVTTLATSASSYAD; VTTLATSASSYADT; TTLATSASSYADTE; TLATSASSYADTEA; LATSASSYADTEAA; ATSASSYADTEAAN; TSASSYADTEAANA; SASSYADTEAANAV; ASSYADTEAANAVV; SSYADTEAANAVVT; SYADTEAANAVVTG;<br><br>15 mers:<br>MSFTAQPEMLAAAAG; SFTAQPEMLAAAAGE; FTAQPEMLAAAAGEL; TAQPEMLAAAAGELR; AQPEMLAAAAGELRS; QPEMLAAAAGELRSL; PEMLAAAAGELRSLG; EMLAAAAGELRSLGA; MLAAAAGELRSLGAT; LAAAAGELRSLGATL; AAAAGELRSLGATLK; AAAGELRSLGATLKA; AAGELRSLGATLKAS; AGELRSLGATLKASN; GELRSLGATLKASNA; ELRSLGATLKASNAA; LRSLGATLKASNAAA; RSLGATLKASNAAAA; SLGATLKASNAAAAV; LGATLKASNAAAAVP; GATLKASNAAAAVPT; ATLKASNAAAAVPTT; TLKASNAAAAVPTTG; LKASNAAAAVPTTGV; KASNAAAAVPTTGVV; ASNAAAAVPTTGVVP; SNAAAAVPTTGVVPP; NAAAAVPTTGVVPPA; AAAAVPTTGVVPPAA; AAAVPTTGVVPPAAD; AAVPTTGVVPPAADE; AVPTTGVVPPAADEV; VPTTGVVPPAADEVS; PTTGVVPPAADEVSL; TTGVVPPAADEVSLL; TGVVPPAADEVSLLL; GVVPPAADEVSLLLA; VVPPAADEVSLLLAT; VPPAADEVSLLLATQ; PPAADEVSLLLATQF; PAADEVSLLLATQFR; AADEVSLLLATQFRT; ADEVSLLLATQFRTH; DEVSLLLATQFRTHA; EVSLLLATQFRTHAA; VSLLLATQFRTHAAT; SLLLATQFRTHAATY; LLLATQFRTHAATYQ; LLATQFRTHAATYQT; LATQFRTHAATYQTA; ATQFRTHAATYQTAS; TQFRTHAATYQTASA; QFRTHAATYQTASAK; FRTHAATYQTASAKA; RTHAATYQTASAKAA; THAATYQTASAKAAV; HAATYQTASAKAAVI; AATYQTASAKAAVIH; ATYQTASAKAAVIHE; TYQTASAKAAVIHEQ; YQTASAKAAVIHEQF; QTASAKAAVIHEQFV; TASAKAAVIHEQFVT; ASAKAAVIHEQFVTT; SAKAAVIHEQFVTTL; AKAAVIHEQFVTTLA; KAAVIHEQFVTTLAT; AAVIHEQFVTTLATS; AVIHEQFVTTLATSA; VIHEQFVTTLATSAS; IHEQFVTTLATSASS; HEQFVTTLATSASSY; EQFVTTLATSASSYA; QFVTTLATSASSYAD; FVTTLATSASSYADT; | |

Fig. 29 continued

| | | |
|---|---|---|
| | VTTLATSASSYADTE; TTLATSASSYADTEA; TLATSASSYADTEAA; LATSASSYADTEAAN; ATSASSYADTEAANA; TSASSYADTEAANAV; SASSYADTEAANAVV; ASSYADTEAANAVVT; SSYADTEAANAVVTG;<br><br>16 mers:<br>MSFTAQPEMLAAAAGE; SFTAQPEMLAAAAGEL; FTAQPEMLAAAAGELR; TAQPEMLAAAAGELRS; AQPEMLAAAAGELRSL; QPEMLAAAAGELRSLG; PEMLAAAAGELRSLGA; EMLAAAAGELRSLGAT; MLAAAAGELRSLGATL; LAAAAGELRSLGATLK; AAAAGELRSLGATLKA; AAAGELRSLGATLKAS; AAGELRSLGATLKASN; AGELRSLGATLKASNA; GELRSLGATLKASNAA; ELRSLGATLKASNAAA; LRSLGATLKASNAAAA; RSLGATLKASNAAAAV; SLGATLKASNAAAAVP; LGATLKASNAAAAVPT; GATLKASNAAAAVPTT; ATLKASNAAAAVPTTG; TLKASNAAAAVPTTGV; LKASNAAAAVPTTGVV; KASNAAAAVPTTGVVP; ASNAAAAVPTTGVVPP; SNAAAAVPTTGVVPPA; NAAAAVPTTGVVPPAA; AAAAVPTTGVVPPAAD; AAAVPTTGVVPPAADE; AAVPTTGVVPPAADEV; AVPTTGVVPPAADEVS; VPTTGVVPPAADEVSL; PTTGVVPPAADEVSLL; TTGVVPPAADEVSLLL; TGVVPPAADEVSLLLA; GVVPPAADEVSLLLAT; VVPPAADEVSLLLATQ; VPPAADEVSLLLATQF; PPAADEVSLLLATQFR; PAADEVSLLLATQFRT; AADEVSLLLATQFRTH; ADEVSLLLATQFRTHA; DEVSLLLATQFRTHAA; EVSLLLATQFRTHAAT; VSLLLATQFRTHAATY; SLLLATQFRTHAATYQ; LLLATQFRTHAATYQT; LLATQFRTHAATYQTA; LATQFRTHAATYQTAS; ATQFRTHAATYQTASA; TQFRTHAATYQTASAK; QFRTHAATYQTASAKA; FRTHAATYQTASAKAA; RTHAATYQTASAKAAV; THAATYQTASAKAAVI; HAATYQTASAKAAVIH; AATYQTASAKAAVIHE; ATYQTASAKAAVIHEQ; TYQTASAKAAVIHEQF; YQTASAKAAVIHEQFV; QTASAKAAVIHEQFVT; TASAKAAVIHEQFVTT; ASAKAAVIHEQFVTTL; SAKAAVIHEQFVTTLA; AKAAVIHEQFVTTLAT; KAAVIHEQFVTTLATS; AAVIHEQFVTTLATSA; AVIHEQFVTTLATSAS; VIHEQFVTTLATSASS; IHEQFVTTLATSASSY; HEQFVTTLATSASSYA; EQFVTTLATSASSYAD; QFVTTLATSASSYADT; FVTTLATSASSYADTE; VTTLATSASSYADTEA; TTLATSASSYADTEAA; TLATSASSYADTEAAN; LATSASSYADTEAANA; ATSASSYADTEAANAV; TSASSYADTEAANAVV; SASSYADTEAANAVVT; ASSYADTEAANAVVTG | |
| 66) Rv3619c | 13 mers:<br>MTINYQFGDVDAH; TINYQFGDVDAHG; INYQFGDVDAHGA; NYQFGDVDAHGAM; YQFGDVDAHGAMI; QFGDVDAHGAMIR; FGDVDAHGAMIRA; GDVDAHGAMIRAQ; DVDAHGAMIRAQA; VDAHGAMIRAQAG; DAHGAMIRAQAGS; AHGAMIRAQAGSL; HGAMIRAQAGSLE; GAMIRAQAGSLEA; AMIRAQAGSLEAE; MIRAQAGSLEAEH; IRAQAGSLEAEHQ; RAQAGSLEAEHQA; AQAGSLEAEHQAI; QAGSLEAEHQAII; AGSLEAEHQAIIS; GSLEAEHQAIISD; SLEAEHQAIISDV; LEAEHQAIISDVL; EAEHQAIISDVLT; AEHQAIISDVLTA; EHQAIISDVLTAS; HQAIISDVLTASD; QAIISDVLTASDF; AIISDVLTASDFW; IISDVLTASDFWG; ISDVLTASDFWGG; SDVLTASDFWGGA; DVLTASDFWGGAG; VLTASDFWGGAGS; LTASDFWGGAGSA; TASDFWGGAGSAA; ASDFWGGAGSAAC; SDFWGGAGSAACQ; DFWGGAGSAACQG; FWGGAGSAACQGF; WGGAGSAACQGFI; GGAGSAACQGFIT; GAGSAACQGFITQ; AGSAACQGFITQL; GSAACQGFITQLG; SAACQGFITQLGR; AACQGFITQLGRN; ACQGFITQLGRNF; CQGFITQLGRNFQ; QGFITQLGRNFQV; GFITQLGRNFQVI; FITQLGRNFQVIY; ITQLGRNFQVIYE; TQLGRNFQVIYEQ; QLGRNFQVIYEQA; LGRNFQVIYEQAN; GRNFQVIYEQANA; RNFQVIYEQANAH; NFQVIYEQANAHG; FQVIYEQANAHGQ; QVIYEQANAHGQK; VIYEQANAHGQKV; IYEQANAHGQKVQ; YEQANAHGQKVQA; EQANAHGQKVQAA; QANAHGQKVQAAG; | 104670-104991 |

Fig. 29 continued

| | | | |
|---|---|---|---|
| | ANAHGQKVQAAGN; NAHGQKVQAAGNN; AHGQKVQAAGNNM;<br>HGQKVQAAGNNMA; GQKVQAAGNNMAQ; QKVQAAGNNMAQT;<br>KVQAAGNNMAQTD; VQAAGNNMAQTDS; QAAGNNMAQTDSA;<br>AAGNNMAQTDSAV; AGNNMAQTDSAVG; GNNMAQTDSAVGS;<br>NNMAQTDSAVGSS; NMAQTDSAVGSSW; MAQTDSAVGSSWA;<br><br>14 mers:<br>MTINYQFGDVDAHG; TINYQFGDVDAHGA; INYQFGDVDAHGAM;<br>NYQFGDVDAHGAMI; YQFGDVDAHGAMIR; QFGDVDAHGAMIRA;<br>FGDVDAHGAMIRAQ; GDVDAHGAMIRAQA; DVDAHGAMIRAQAG;<br>VDAHGAMIRAQAGS; DAHGAMIRAQAGSL; AHGAMIRAQAGSLE;<br>HGAMIRAQAGSLEA; GAMIRAQAGSLEAE; AMIRAQAGSLEAEH;<br>MIRAQAGSLEAEHQ; IRAQAGSLEAEHQA; RAQAGSLEAEHQAI;<br>AQAGSLEAEHQAII; QAGSLEAEHQAIIS; AGSLEAEHQAIISD; GSLEAEHQAIISDV;<br>SLEAEHQAIISDVL; LEAEHQAIISDVLT; EAEHQAIISDVLTA; AEHQAIISDVLTAS;<br>EHQAIISDVLTASD; HQAIISDVLTASDF; QAIISDVLTASDFW; AIISDVLTASDFWG;<br>IISDVLTASDFWGG; ISDVLTASDFWGGA; SDVLTASDFWGGAG;<br>DVLTASDFWGGAGS; VLTASDFWGGAGSA; LTASDFWGGAGSAA;<br>TASDFWGGAGSAAC; ASDFWGGAGSAACQ; SDFWGGAGSAACQG;<br>DFWGGAGSAACQGF; FWGGAGSAACQGFI; WGGAGSAACQGFIT;<br>GGAGSAACQGFITQ; GAGSAACQGFITQL; AGSAACQGFITQLG;<br>GSAACQGFITQLGR; SAACQGFITQLGRN; AACQGFITQLGRNF;<br>ACQGFITQLGRNFQ; CQGFITQLGRNFQV; QGFITQLGRNFQVI;<br>GFITQLGRNFQVIY; FITQLGRNFQVIYE; ITQLGRNFQVIYEQ;<br>TQLGRNFQVIYEQA; QLGRNFQVIYEQAN; LGRNFQVIYEQANA;<br>GRNFQVIYEQANAH; RNFQVIYEQANAHG; NFQVIYEQANAHGQ;<br>FQVIYEQANAHGQK; QVIYEQANAHGQKV; VIYEQANAHGQKVQ;<br>IYEQANAHGQKVQA; YEQANAHGQKVQAA; EQANAHGQKVQAAG;<br>QANAHGQKVQAAGN; ANAHGQKVQAAGNN; NAHGQKVQAAGNNM;<br>AHGQKVQAAGNNMA; HGQKVQAAGNNMAQ; GQKVQAAGNNMAQT;<br>QKVQAAGNNMAQTD; KVQAAGNNMAQTDS; VQAAGNNMAQTDSA;<br>QAAGNNMAQTDSAV; AAGNNMAQTDSAVG; AGNNMAQTDSAVGS;<br>GNNMAQTDSAVGSS; NNMAQTDSAVGSSW; NMAQTDSAVGSSWA;<br><br>15 mers:<br>MTINYQFGDVDAHGA; TINYQFGDVDAHGAM; INYQFGDVDAHGAMI;<br>NYQFGDVDAHGAMIR; YQFGDVDAHGAMIRA; QFGDVDAHGAMIRAQ;<br>FGDVDAHGAMIRAQA; GDVDAHGAMIRAQAG; DVDAHGAMIRAQAGS;<br>VDAHGAMIRAQAGSL; DAHGAMIRAQAGSLE; AHGAMIRAQAGSLEA;<br>HGAMIRAQAGSLEAE; GAMIRAQAGSLEAEH; AMIRAQAGSLEAEHQ;<br>MIRAQAGSLEAEHQA; IRAQAGSLEAEHQAI; RAQAGSLEAEHQAII;<br>AQAGSLEAEHQAIIS; QAGSLEAEHQAIISD; AGSLEAEHQAIISDV;<br>GSLEAEHQAIISDVL; SLEAEHQAIISDVLT; LEAEHQAIISDVLTA;<br>EAEHQAIISDVLTAS; AEHQAIISDVLTASD; EHQAIISDVLTASDF;<br>HQAIISDVLTASDFW; QAIISDVLTASDFWG; AIISDVLTASDFWGG;<br>IISDVLTASDFWGGA; ISDVLTASDFWGGAG; SDVLTASDFWGGAGS;<br>DVLTASDFWGGAGSA; VLTASDFWGGAGSAA; LTASDFWGGAGSAAC;<br>TASDFWGGAGSAACQ; ASDFWGGAGSAACQG; SDFWGGAGSAACQGF;<br>DFWGGAGSAACQGFI; FWGGAGSAACQGFIT; WGGAGSAACQGFITQ;<br>GGAGSAACQGFITQL; GAGSAACQGFITQLG; AGSAACQGFITQLGR;<br>GSAACQGFITQLGRN; SAACQGFITQLGRNF; AACQGFITQLGRNFQ;<br>ACQGFITQLGRNFQV; CQGFITQLGRNFQVI; QGFITQLGRNFQVIY;<br>GFITQLGRNFQVIYE; FITQLGRNFQVIYEQ; ITQLGRNFQVIYEQA; | | |

Fig. 29 continued

| | | |
|---|---|---|
| | TQLGRNFQVIYEQAN; QLGRNFQVIYEQANA; LGRNFQVIYEQANAH; GRNFQVIYEQANAHG; RNFQVIYEQANAHGQ; NFQVIYEQANAHGQK; FQVIYEQANAHGQKV; QVIYEQANAHGQKVQ; VIYEQANAHGQKVQA; IYEQANAHGQKVQAA; YEQANAHGQKVQAAG; EQANAHGQKVQAAGN; QANAHGQKVQAAGNN; ANAHGQKVQAAGNNM; NAHGQKVQAAGNNMA; AHGQKVQAAGNNMAQ; HGQKVQAAGNNMAQT; GQKVQAAGNNMAQTD; QKVQAAGNNMAQTDS; KVQAAGNNMAQTDSA; VQAAGNNMAQTDSAV; QAAGNNMAQTDSAVG; AAGNNMAQTDSAVGS; AGNNMAQTDSAVGSS; GNNMAQTDSAVGSSW; NNMAQTDSAVGSSWA;<br><br>16 mers:<br>MTINYQFGDVDAHGAM; TINYQFGDVDAHGAMI; INYQFGDVDAHGAMIR; NYQFGDVDAHGAMIRA; YQFGDVDAHGAMIRAQ; QFGDVDAHGAMIRAQA; FGDVDAHGAMIRAQAG; GDVDAHGAMIRAQAGS; DVDAHGAMIRAQAGSL; VDAHGAMIRAQAGSLE; DAHGAMIRAQAGSLEA; AHGAMIRAQAGSLEAE; HGAMIRAQAGSLEAEH; GAMIRAQAGSLEAEHQ; AMIRAQAGSLEAEHQA; MIRAQAGSLEAEHQAI; IRAQAGSLEAEHQAII; RAQAGSLEAEHQAIIS; AQAGSLEAEHQAIISD; QAGSLEAEHQAIISDV; AGSLEAEHQAIISDVL; GSLEAEHQAIISDVLT; SLEAEHQAIISDVLTA; LEAEHQAIISDVLTAS; EAEHQAIISDVLTASD; AEHQAIISDVLTASDF; EHQAIISDVLTASDFW; HQAIISDVLTASDFWG; QAIISDVLTASDFWGG; AIISDVLTASDFWGGA; IISDVLTASDFWGGAG; ISDVLTASDFWGGAGS; SDVLTASDFWGGAGSA; DVLTASDFWGGAGSAA; VLTASDFWGGAGSAAC; LTASDFWGGAGSAACQ; TASDFWGGAGSAACQG; ASDFWGGAGSAACQGF; SDFWGGAGSAACQGFI; DFWGGAGSAACQGFIT; FWGGAGSAACQGFITQ; WGGAGSAACQGFITQL; GGAGSAACQGFITQLG; GAGSAACQGFITQLGR; AGSAACQGFITQLGRN; GSAACQGFITQLGRNF; SAACQGFITQLGRNFQ; AACQGFITQLGRNFQV; ACQGFITQLGRNFQVI; CQGFITQLGRNFQVIY; QGFITQLGRNFQVIYE; GFITQLGRNFQVIYEQ; FITQLGRNFQVIYEQA; ITQLGRNFQVIYEQAN; TQLGRNFQVIYEQANA; QLGRNFQVIYEQANAH; LGRNFQVIYEQANAHG; GRNFQVIYEQANAHGQ; RNFQVIYEQANAHGQK; NFQVIYEQANAHGQKV; FQVIYEQANAHGQKVQ; QVIYEQANAHGQKVQA; VIYEQANAHGQKVQAA; IYEQANAHGQKVQAAG; YEQANAHGQKVQAAGN; EQANAHGQKVQAAGNN; QANAHGQKVQAAGNNM; ANAHGQKVQAAGNNMA; NAHGQKVQAAGNNMAQ; AHGQKVQAAGNNMAQT; HGQKVQAAGNNMAQTD; GQKVQAAGNNMAQTDS; QKVQAAGNNMAQTDSA; KVQAAGNNMAQTDSAV; VQAAGNNMAQTDSAVG; QAAGNNMAQTDSAVGS; AAGNNMAQTDSAVGSS; AGNNMAQTDSAVGSSW; GNNMAQTDSAVGSSWA | |
| 67) Rv3620c | 13 mers:<br>MTSRFMTDPHAMR; TSRFMTDPHAMRD; SRFMTDPHAMRDM; RFMTDPHAMRDMA; FMTDPHAMRDMAG; MTDPHAMRDMAGR; TDPHAMRDMAGRF; DPHAMRDMAGRFE; PHAMRDMAGRFEV; HAMRDMAGRFEVH; AMRDMAGRFEVHA; MRDMAGRFEVHAQ; RDMAGRFEVHAQT; DMAGRFEVHAQTV; MAGRFEVHAQTVE; AGRFEVHAQTVED; GRFEVHAQTVEDE; RFEVHAQTVEDEA; FEVHAQTVEDEAR; EVHAQTVEDEARR; VHAQTVEDEARRM; HAQTVEDEARRMW; AQTVEDEARRMWA; QTVEDEARRMWAS; TVEDEARRMWASA; VEDEARRMWASAQ; EDEARRMWASAQN; DEARRMWASAQNI; EARRMWASAQNIS; ARRMWASAQNISG; RRMWASAQNISGA; RMWASAQNISGAG; MWASAQNISGAGW; WASAQNISGAGWS; ASAQNISGAGWSG; SAQNISGAGWSGM; AQNISGAGWSGMA; QNISGAGWSGMAE; NISGAGWSGMAEA; ISGAGWSGMAEAT; SGAGWSGMAEATS; GAGWSGMAEATSL; | 104992-105329 |

Fig. 29 continued

| | | |
|---|---|---|
| | AGWSGMAEATSLD; GWSGMAEATSLDT; WSGMAEATSLDTM; SGMAEATSLDTMT; GMAEATSLDTMTQ; MAEATSLDTMTQM; AEATSLDTMTQMN; EATSLDTMTQMNQ; ATSLDTMTQMNQA; TSLDTMTQMNQAF; SLDTMTQMNQAFR; LDTMTQMNQAFRN; DTMTQMNQAFRNI; TMTQMNQAFRNIV; MTQMNQAFRNIVN; TQMNQAFRNIVNM; QMNQAFRNIVNML; MNQAFRNIVNMLH; NQAFRNIVNMLHG; QAFRNIVNMLHGV; AFRNIVNMLHGVR; FRNIVNMLHGVRD; RNIVNMLHGVRDG; NIVNMLHGVRDGL; IVNMLHGVRDGLV; VNMLHGVRDGLVR; NMLHGVRDGLVRD; MLHGVRDGLVRDA; LHGVRDGLVRDAN; HGVRDGLVRDANN; GVRDGLVRDANNY; VRDGLVRDANNYE; RDGLVRDANNYEQ; DGLVRDANNYEQQ; GLVRDANNYEQQE; LVRDANNYEQQEQ; VRDANNYEQQEQA; RDANNYEQQEQAS; DANNYEQQEQASQ; ANNYEQQEQASQQ; NNYEQQEQASQQI; NYEQQEQASQQIL; YEQQEQASQQILS; EQQEQASQQILSS;<br><br>14 mers:<br>MTSRFMTDPHAMRD; TSRFMTDPHAMRDM; SRFMTDPHAMRDMA; RFMTDPHAMRDMAG; FMTDPHAMRDMAGR; MTDPHAMRDMAGRF; TDPHAMRDMAGRFE; DPHAMRDMAGRFEV; PHAMRDMAGRFEVH; HAMRDMAGRFEVHA; AMRDMAGRFEVHAQ; MRDMAGRFEVHAQT; RDMAGRFEVHAQTV; DMAGRFEVHAQTVE; MAGRFEVHAQTVED; AGRFEVHAQTVEDE; GRFEVHAQTVEDEA; RFEVHAQTVEDEAR; FEVHAQTVEDEARR; EVHAQTVEDEARRM; VHAQTVEDEARRMW; HAQTVEDEARRMWA; AQTVEDEARRMWAS; QTVEDEARRMWASA; TVEDEARRMWASAQ; VEDEARRMWASAQN; EDEARRMWASAQNI; DEARRMWASAQNIS; EARRMWASAQNISG; ARRMWASAQNISGA; RRMWASAQNISGAG; RMWASAQNISGAGW; MWASAQNISGAGWS; WASAQNISGAGWSG; ASAQNISGAGWSGM; SAQNISGAGWSGMA; AQNISGAGWSGMAE; QNISGAGWSGMAEA; NISGAGWSGMAEAT; ISGAGWSGMAEATS; SGAGWSGMAEATSL; GAGWSGMAEATSLD; AGWSGMAEATSLDT; GWSGMAEATSLDTM; WSGMAEATSLDTMT; SGMAEATSLDTMTQ; GMAEATSLDTMTQM; MAEATSLDTMTQMN; AEATSLDTMTQMNQ; EATSLDTMTQMNQA; ATSLDTMTQMNQAF; TSLDTMTQMNQAFR; SLDTMTQMNQAFRN; LDTMTQMNQAFRNI; DTMTQMNQAFRNIV; TMTQMNQAFRNIVN; MTQMNQAFRNIVNM; TQMNQAFRNIVNML; QMNQAFRNIVNMLH; MNQAFRNIVNMLHG; NQAFRNIVNMLHGV; QAFRNIVNMLHGVR; AFRNIVNMLHGVRD; FRNIVNMLHGVRDG; RNIVNMLHGVRDGL; NIVNMLHGVRDGLV; IVNMLHGVRDGLVR; VNMLHGVRDGLVRD; NMLHGVRDGLVRDA; MLHGVRDGLVRDAN; LHGVRDGLVRDANN; HGVRDGLVRDANNY; GVRDGLVRDANNYE; VRDGLVRDANNYEQ; RDGLVRDANNYEQQ; DGLVRDANNYEQQE; GLVRDANNYEQQEQ; LVRDANNYEQQEQA; VRDANNYEQQEQAS; RDANNYEQQEQASQ; DANNYEQQEQASQQ; ANNYEQQEQASQQI; NNYEQQEQASQQIL; NYEQQEQASQQILS; YEQQEQASQQILSS;<br><br>15 mers:<br>MTSRFMTDPHAMRDM; TSRFMTDPHAMRDMA; SRFMTDPHAMRDMAG; RFMTDPHAMRDMAGR; FMTDPHAMRDMAGRF; MTDPHAMRDMAGRFE; TDPHAMRDMAGRFEV; DPHAMRDMAGRFEVH; PHAMRDMAGRFEVHA; HAMRDMAGRFEVHAQ; AMRDMAGRFEVHAQT; MRDMAGRFEVHAQTV; RDMAGRFEVHAQTVE; DMAGRFEVHAQTVED; MAGRFEVHAQTVEDE; AGRFEVHAQTVEDEA; GRFEVHAQTVEDEAR; RFEVHAQTVEDEARR; | |

Fig. 29 continued

| | | |
|---|---|---|
| | FEVHAQTVEDEARRM; EVHAQTVEDEARRMW; VHAQTVEDEARRMWA; HAQTVEDEARRMWAS; AQTVEDEARRMWASA; QTVEDEARRMWASAQ; TVEDEARRMWASAQN; VEDEARRMWASAQNI; EDEARRMWASAQNIS; DEARRMWASAQNISG; EARRMWASAQNISGA; ARRMWASAQNISGAG; RRMWASAQNISGAGW; RMWASAQNISGAGWS; MWASAQNISGAGWSG; WASAQNISGAGWSGM; ASAQNISGAGWSGMA; SAQNISGAGWSGMAE; AQNISGAGWSGMAEA; QNISGAGWSGMAEAT; NISGAGWSGMAEATS; ISGAGWSGMAEATSL; SGAGWSGMAEATSLD; GAGWSGMAEATSLDT; AGWSGMAEATSLDTM; GWSGMAEATSLDTMT; WSGMAEATSLDTMTQ; SGMAEATSLDTMTQM; GMAEATSLDTMTQMN; MAEATSLDTMTQMNQ; AEATSLDTMTQMNQA; EATSLDTMTQMNQAF; ATSLDTMTQMNQAFR; TSLDTMTQMNQAFRN; SLDTMTQMNQAFRNI; LDTMTQMNQAFRNIV; DTMTQMNQAFRNIVN; TMTQMNQAFRNIVNM; MTQMNQAFRNIVNML; TQMNQAFRNIVNMLH; QMNQAFRNIVNMLHG; MNQAFRNIVNMLHGV; NQAFRNIVNMLHGVR; QAFRNIVNMLHGVRD; AFRNIVNMLHGVRDG; FRNIVNMLHGVRDGL; RNIVNMLHGVRDGLV; NIVNMLHGVRDGLVR; IVNMLHGVRDGLVRD; VNMLHGVRDGLVRDA; NMLHGVRDGLVRDAN; MLHGVRDGLVRDANN; LHGVRDGLVRDANNY; HGVRDGLVRDANNYE; GVRDGLVRDANNYEQ; VRDGLVRDANNYEQQ; RDGLVRDANNYEQQE; DGLVRDANNYEQQEQ; GLVRDANNYEQQEQA; LVRDANNYEQQEQAS; VRDANNYEQQEQASQ; RDANNYEQQEQASQQ; DANNYEQQEQASQQI; ANNYEQQEQASQQIL; NNYEQQEQASQQILS; NYEQQEQASQQILSS;<br><br>16 mers:<br>MTSRFMTDPHAMRDMA; TSRFMTDPHAMRDMAG; SRFMTDPHAMRDMAGR; RFMTDPHAMRDMAGRF; FMTDPHAMRDMAGRFE; MTDPHAMRDMAGRFEV; TDPHAMRDMAGRFEVH; DPHAMRDMAGRFEVHA; PHAMRDMAGRFEVHAQ; HAMRDMAGRFEVHAQT; AMRDMAGRFEVHAQTV; MRDMAGRFEVHAQTVE; RDMAGRFEVHAQTVED; DMAGRFEVHAQTVEDE; MAGRFEVHAQTVEDEA; AGRFEVHAQTVEDEAR; GRFEVHAQTVEDEARR; RFEVHAQTVEDEARRM; FEVHAQTVEDEARRMW; EVHAQTVEDEARRMWA; VHAQTVEDEARRMWAS; HAQTVEDEARRMWASA; AQTVEDEARRMWASAQ; QTVEDEARRMWASAQN; TVEDEARRMWASAQNI; VEDEARRMWASAQNIS; EDEARRMWASAQNISG; DEARRMWASAQNISGA; EARRMWASAQNISGAG; ARRMWASAQNISGAGW; RRMWASAQNISGAGWS; RMWASAQNISGAGWSG; MWASAQNISGAGWSGM; WASAQNISGAGWSGMA; ASAQNISGAGWSGMAE; SAQNISGAGWSGMAEA; AQNISGAGWSGMAEAT; QNISGAGWSGMAEATS; NISGAGWSGMAEATSL; ISGAGWSGMAEATSLD; SGAGWSGMAEATSLDT; GAGWSGMAEATSLDTM; AGWSGMAEATSLDTMT; GWSGMAEATSLDTMTQ; WSGMAEATSLDTMTQM; SGMAEATSLDTMTQMN; GMAEATSLDTMTQMNQ; MAEATSLDTMTQMNQA; AEATSLDTMTQMNQAF; EATSLDTMTQMNQAFR; ATSLDTMTQMNQAFRN; TSLDTMTQMNQAFRNI; SLDTMTQMNQAFRNIV; LDTMTQMNQAFRNIVN; DTMTQMNQAFRNIVNM; TMTQMNQAFRNIVNML; MTQMNQAFRNIVNMLH; TQMNQAFRNIVNMLHG; QMNQAFRNIVNMLHGV; MNQAFRNIVNMLHGVR; NQAFRNIVNMLHGVRD; QAFRNIVNMLHGVRDG; AFRNIVNMLHGVRDGL; FRNIVNMLHGVRDGLV; RNIVNMLHGVRDGLVR; NIVNMLHGVRDGLVRD; IVNMLHGVRDGLVRDA; VNMLHGVRDGLVRDAN; NMLHGVRDGLVRDANN; MLHGVRDGLVRDANNY; LHGVRDGLVRDANNYE; HGVRDGLVRDANNYEQ; GVRDGLVRDANNYEQQ; VRDGLVRDANNYEQQE; RDGLVRDANNYEQQEQ; DGLVRDANNYEQQEQA; GLVRDANNYEQQEQAS; LVRDANNYEQQEQASQ; VRDANNYEQQEQASQQ; RDANNYEQQEQASQQI; DANNYEQQEQASQQIL; ANNYEQQEQASQQILS; NNYEQQEQASQQILSS | |
| 68) | 13 mers: | 105330- |

Fig. 29 continued

| | | |
|---|---|---|
| Rv3675 | MFTLLVSWLLVAC; FTLLVSWLLVACV; TLLVSWLLVACVP; LLVSWLLVACVPG; LVSWLLVACVPGL; VSWLLVACVPGLL; SWLLVACVPGLLM; WLLVACVPGLLML; LLVACVPGLLMLA; LVACVPGLLMLAT; VACVPGLLMLATL; ACVPGLLMLATLG; CVPGLLMLATLGL; VPGLLMLATLGLG; PGLLMLATLGLGR; GLLMLATLGLGRL; LLMLATLGLGRLE; LMLATLGLGRLER; MLATLGLGRLERF; LATLGLGRLERFL; ATLGLGRLERFLA; TLGLGRLERFLAR; LGLGRLERFLARD; GLGRLERFLARDT; LGRLERFLARDTV; GRLERFLARDTVT; RLERFLARDTVTA; LERFLARDTVTAT; ERFLARDTVTATD; RFLARDTVTATDV; FLARDTVTATDVA; LARDTVTATDVAE; ARDTVTATDVAEF; RDTVTATDVAEFL; DTVTATDVAEFLE; TVTATDVAEFLEQ; VTATDVAEFLEQA; TATDVAEFLEQAE; ATDVAEFLEQAEA; TDVAEFLEQAEAV; DVAEFLEQAEAVD; VAEFLEQAEAVDV; AEFLEQAEAVDVH; EFLEQAEAVDVHT; FLEQAEAVDVHTL; LEQAEAVDVHTLA; EQAEAVDVHTLAR; QAEAVDVHTLARN; AEAVDVHTLARNG; EAVDVHTLARNGM; AVDVHTLARNGMP; VDVHTLARNGMPE; DVHTLARNGMPEA; VHTLARNGMPEAL; HTLARNGMPEALD; TLARNGMPEALDY; LARNGMPEALDYL; ARNGMPEALDYLH; RNGMPEALDYLHR; NGMPEALDYLHRR; GMPEALDYLHRRQ; MPEALDYLHRRQA; PEALDYLHRRQAR; EALDYLHRRQARR; ALDYLHRRQARRI; LDYLHRRQARRIT; DYLHRRQARRITD; YLHRRQARRITDS; LHRRQARRITDSP; HRRQARRITDSPP; RRQARRITDSPPL; RQARRITDSPPLG; QARRITDSPPLGS; ARRITDSPPLGSG; RRITDSPPLGSGA; RITDSPPLGSGAG; ITDSPPLGSGAGP; TDSPPLGSGAGPR; DSPPLGSGAGPRY; SPPLGSGAGPRYA; PPLGSGAGPRYAG; PLGSGAGPRYAGP; LGSGAGPRYAGPL; GSGAGPRYAGPLF; SGAGPRYAGPLFV; GAGPRYAGPLFVT; AGPRYAGPLFVTD; GPRYAGPLFVTDL; PRYAGPLFVTDLD; RYAGPLFVTDLDS; YAGPLFVTDLDSP; AGPLFVTDLDSPV; GPLFVTDLDSPVE; PLFVTDLDSPVEP; LFVTDLDSPVEPP; FVTDLDSPVEPPR; VTDLDSPVEPPRH; TDLDSPVEPPRHG; DLDSPVEPPRHGQ; LDSPVEPPRHGQP; DSPVEPPRHGQPN; SPVEPPRHGQPNP; PVEPPRHGQPNPQ; VEPPRHGQPNPQF; EPPRHGQPNPQFR; PPRHGQPNPQFRT; PRHGQPNPQFRTA; RHGQPNPQFRTAR; HGQPNPQFRTARH; GQPNPQFRTARHA; QPNPQFRTARHAN; PNPQFRTARHANH; NPQFRTARHANHV<br><br>14 mers:<br>MFTLLVSWLLVACV; FTLLVSWLLVACVP; TLLVSWLLVACVPG; LLVSWLLVACVPGL; LVSWLLVACVPGLL; VSWLLVACVPGLLM; SWLLVACVPGLLML; WLLVACVPGLLMLA; LLVACVPGLLMLAT; LVACVPGLLMLATL; VACVPGLLMLATLG; ACVPGLLMLATLGL; CVPGLLMLATLGLG; VPGLLMLATLGLGR; PGLLMLATLGLGRL; GLLMLATLGLGRLE; LLMLATLGLGRLER; LMLATLGLGRLERF; MLATLGLGRLERFL; LATLGLGRLERFLA; ATLGLGRLERFLAR; TLGLGRLERFLARD; LGLGRLERFLARDT; GLGRLERFLARDTV; LGRLERFLARDTVT; GRLERFLARDTVTA; RLERFLARDTVTAT; LERFLARDTVTATD; ERFLARDTVTATDV; RFLARDTVTATDVA; FLARDTVTATDVAE; LARDTVTATDVAEF; ARDTVTATDVAEFL; RDTVTATDVAEFLE; DTVTATDVAEFLEQ; TVTATDVAEFLEQA; VTATDVAEFLEQAE; TATDVAEFLEQAEA; ATDVAEFLEQAEAV; TDVAEFLEQAEAVD; DVAEFLEQAEAVDV; VAEFLEQAEAVDVH; AEFLEQAEAVDVHT; EFLEQAEAVDVHTL; FLEQAEAVDVHTLA; LEQAEAVDVHTLAR; EQAEAVDVHTLARN; QAEAVDVHTLARNG; AEAVDVHTLARNGM; EAVDVHTLARNGMP; AVDVHTLARNGMPE; VDVHTLARNGMPEA; DVHTLARNGMPEAL; VHTLARNGMPEALD; HTLARNGMPEALDY; TLARNGMPEALDYL; LARNGMPEALDYLH; | 105775 |

Fig. 29 continued

| | | | |
|---|---|---|---|
| | ARNGMPEALDYLHR; RNGMPEALDYLHRR; NGMPEALDYLHRRQ; GMPEALDYLHRRQA; MPEALDYLHRRQAR; PEALDYLHRRQARR; EALDYLHRRQARRI; ALDYLHRRQARRIT; LDYLHRRQARRITD; DYLHRRQARRITDS; YLHRRQARRITDSP; LHRRQARRITDSPP; HRRQARRITDSPPL; RRQARRITDSPPLG; RQARRITDSPPLGS; QARRITDSPPLGSG; ARRITDSPPLGSGA; RRITDSPPLGSGAG; RITDSPPLGSGAGP; ITDSPPLGSGAGPR; TDSPPLGSGAGPRY; DSPPLGSGAGPRYA; SPPLGSGAGPRYAG; PPLGSGAGPRYAGP; PLGSGAGPRYAGPL; LGSGAGPRYAGPLF; GSGAGPRYAGPLFV; SGAGPRYAGPLFVT; GAGPRYAGPLFVTD; AGPRYAGPLFVTDL; GPRYAGPLFVTDLD; PRYAGPLFVTDLDS; RYAGPLFVTDLDSP; YAGPLFVTDLDSPV; AGPLFVTDLDSPVE; GPLFVTDLDSPVEP; PLFVTDLDSPVEPP; LFVTDLDSPVEPPR; FVTDLDSPVEPPRH; VTDLDSPVEPPRHG; TDLDSPVEPPRHGQ; DLDSPVEPPRHGQP; LDSPVEPPRHGQPN; DSPVEPPRHGQPNP; SPVEPPRHGQPNPQ; PVEPPRHGQPNPQF; VEPPRHGQPNPQFR; EPPRHGQPNPQFRT; PPRHGQPNPQFRTA; PRHGQPNPQFRTAR; RHGQPNPQFRTARH; HGQPNPQFRTARHA; GQPNPQFRTARHAN; QPNPQFRTARHANH; PNPQFRTARHANHV<br><br>15 mers:<br>MFTLLVSWLLVACVP; FTLLVSWLLVACVPG; TLLVSWLLVACVPGL; LLVSWLLVACVPGLL; LVSWLLVACVPGLLM; VSWLLVACVPGLLML; SWLLVACVPGLLMLA; WLLVACVPGLLMLAT; LLVACVPGLLMLATL; LVACVPGLLMLATLG; VACVPGLLMLATLGL; ACVPGLLMLATLGLG; CVPGLLMLATLGLGR; VPGLLMLATLGLGRL; PGLLMLATLGLGRLE; GLLMLATLGLGRLER; LLMLATLGLGRLERF; LMLATLGLGRLERFL; MLATLGLGRLERFLA; LATLGLGRLERFLAR; ATLGLGRLERFLARD; TLGLGRLERFLARDT; LGLGRLERFLARDTV; GLGRLERFLARDTVT; LGRLERFLARDTVTA; GRLERFLARDTVTAT; RLERFLARDTVTATD; LERFLARDTVTATDV; ERFLARDTVTATDVA; RFLARDTVTATDVAE; FLARDTVTATDVAEF; LARDTVTATDVAEFL; ARDTVTATDVAEFLE; RDTVTATDVAEFLEQ; DTVTATDVAEFLEQA; TVTATDVAEFLEQAE; VTATDVAEFLEQAEA; TATDVAEFLEQAEAV; ATDVAEFLEQAEAVD; TDVAEFLEQAEAVDV; DVAEFLEQAEAVDVH; VAEFLEQAEAVDVHT; AEFLEQAEAVDVHTL; EFLEQAEAVDVHTLA; FLEQAEAVDVHTLAR; LEQAEAVDVHTLARN; EQAEAVDVHTLARNG; QAEAVDVHTLARNGM; AEAVDVHTLARNGMP; EAVDVHTLARNGMPE; AVDVHTLARNGMPEA; VDVHTLARNGMPEAL; DVHTLARNGMPEALD; VHTLARNGMPEALDY; HTLARNGMPEALDYL; TLARNGMPEALDYLH; LARNGMPEALDYLHR; ARNGMPEALDYLHRR; RNGMPEALDYLHRRQ; NGMPEALDYLHRRQA; GMPEALDYLHRRQAR; MPEALDYLHRRQARR; PEALDYLHRRQARRI; EALDYLHRRQARRIT; ALDYLHRRQARRITD; LDYLHRRQARRITDS; DYLHRRQARRITDSP; YLHRRQARRITDSPP; LHRRQARRITDSPPL; HRRQARRITDSPPLG; RRQARRITDSPPLGS; RQARRITDSPPLGSG; QARRITDSPPLGSGA; ARRITDSPPLGSGAG; RRITDSPPLGSGAGP; RITDSPPLGSGAGPR; ITDSPPLGSGAGPRY; TDSPPLGSGAGPRYA; DSPPLGSGAGPRYAG; SPPLGSGAGPRYAGP; PPLGSGAGPRYAGPL; PLGSGAGPRYAGPLF; LGSGAGPRYAGPLFV; GSGAGPRYAGPLFVT; SGAGPRYAGPLFVTD; GAGPRYAGPLFVTDL; AGPRYAGPLFVTDLD; GPRYAGPLFVTDLDS; PRYAGPLFVTDLDSP; RYAGPLFVTDLDSPV; YAGPLFVTDLDSPVE; AGPLFVTDLDSPVEP; GPLFVTDLDSPVEPP; PLFVTDLDSPVEPPR; LFVTDLDSPVEPPRH; FVTDLDSPVEPPRHG; | |

Fig. 29 continued

| | | |
|---|---|---|
| | VTDLDSPVEPPRHGQ; TDLDSPVEPPRHGQP; DLDSPVEPPRHGQPN; LDSPVEPPRHGQPNP; DSPVEPPRHGQPNPQ; SPVEPPRHGQPNPQF; PVEPPRHGQPNPQFR; VEPPRHGQPNPQFRT; EPPRHGQPNPQFRTA; PPRHGQPNPQFRTAR; PRHGQPNPQFRTARH; RHGQPNPQFRTARHA; HGQPNPQFRTARHAN; GQPNPQFRTARHANH; QPNPQFRTARHANHV<br><br>16 mers:<br>MFTLLVSWLLVACVPG; FTLLVSWLLVACVPGL; TLLVSWLLVACVPGLL; LLVSWLLVACVPGLLM; LVSWLLVACVPGLLML; VSWLLVACVPGLLMLA; SWLLVACVPGLLMLAT; WLLVACVPGLLMLATL; LLVACVPGLLMLATLG; LVACVPGLLMLATLGL; VACVPGLLMLATLGLG; ACVPGLLMLATLGLGR; CVPGLLMLATLGLGRL; VPGLLMLATLGLGRLE; PGLLMLATLGLGRLER; GLLMLATLGLGRLERF; LLMLATLGLGRLERFL; LMLATLGLGRLERFLA; MLATLGLGRLERFLAR; LATLGLGRLERFLARD; ATLGLGRLERFLARDT; TLGLGRLERFLARDTV; LGLGRLERFLARDTVT; GLGRLERFLARDTVTA; LGRLERFLARDTVTAT; GRLERFLARDTVTATD; RLERFLARDTVTATDV; LERFLARDTVTATDVA; ERFLARDTVTATDVAE; RFLARDTVTATDVAEF; FLARDTVTATDVAEFL; LARDTVTATDVAEFLE; ARDTVTATDVAEFLEQ; RDTVTATDVAEFLEQA; DTVTATDVAEFLEQAE; TVTATDVAEFLEQAEA; VTATDVAEFLEQAEAV; TATDVAEFLEQAEAVD; ATDVAEFLEQAEAVDV; TDVAEFLEQAEAVDVH; DVAEFLEQAEAVDVHT; VAEFLEQAEAVDVHTL; AEFLEQAEAVDVHTLA; EFLEQAEAVDVHTLAR; FLEQAEAVDVHTLARN; LEQAEAVDVHTLARNG; EQAEAVDVHTLARNGM; QAEAVDVHTLARNGMP; AEAVDVHTLARNGMPE; EAVDVHTLARNGMPEA; AVDVHTLARNGMPEAL; VDVHTLARNGMPEALD; DVHTLARNGMPEALDY; VHTLARNGMPEALDYL; HTLARNGMPEALDYLH; TLARNGMPEALDYLHR; LARNGMPEALDYLHRR; ARNGMPEALDYLHRRQ; RNGMPEALDYLHRRQA; NGMPEALDYLHRRQAR; GMPEALDYLHRRQARR; MPEALDYLHRRQARRI; PEALDYLHRRQARRIT; EALDYLHRRQARRITD; ALDYLHRRQARRITDS; LDYLHRRQARRITDSP; DYLHRRQARRITDSPP; YLHRRQARRITDSPPL; LHRRQARRITDSPPLG; HRRQARRITDSPPLGS; RRQARRITDSPPLGSG; RQARRITDSPPLGSGA; QARRITDSPPLGSGAG; ARRITDSPPLGSGAGP; RRITDSPPLGSGAGPR; RITDSPPLGSGAGPRY; ITDSPPLGSGAGPRYA; TDSPPLGSGAGPRYAG; DSPPLGSGAGPRYAGP; SPPLGSGAGPRYAGPL; PPLGSGAGPRYAGPLF; PLGSGAGPRYAGPLFV; LGSGAGPRYAGPLFVT; GSGAGPRYAGPLFVTD; SGAGPRYAGPLFVTDL; GAGPRYAGPLFVTDLD; AGPRYAGPLFVTDLDS; GPRYAGPLFVTDLDSP; PRYAGPLFVTDLDSPV; RYAGPLFVTDLDSPVE; YAGPLFVTDLDSPVEP; AGPLFVTDLDSPVEPP; GPLFVTDLDSPVEPPR; PLFVTDLDSPVEPPRH; LFVTDLDSPVEPPRHG; FVTDLDSPVEPPRHGQ; VTDLDSPVEPPRHGQP; TDLDSPVEPPRHGQPN; DLDSPVEPPRHGQPNP; LDSPVEPPRHGQPNPQ; DSPVEPPRHGQPNPQF; SPVEPPRHGQPNPQFR; PVEPPRHGQPNPQFRT; VEPPRHGQPNPQFRTA; EPPRHGQPNPQFRTAR; PPRHGQPNPQFRTARH; PRHGQPNPQFRTARHA; RHGQPNPQFRTARHAN; HGQPNPQFRTARHANH; GQPNPQFRTARHANHV | |
| 69)<br>Rv3735 | 13 mers:<br>MSLAWDVVSVDKP; SLAWDVVSVDKPD; LAWDVVSVDKPDD; AWDVVSVDKPDDV; WDVVSVDKPDDVN; DVVSVDKPDDVNV; VVSVDKPDDVNVV; VSVDKPDDVNVVI; SVDKPDDVNVVIG; VDKPDDVNVVIGQ; DKPDDVNVVIGQA; KPDDVNVVIGQAH; PDDVNVVIGQAHF; DDVNVVIGQAHFI; DVNVVIGQAHFIK; VNVVIGQAHFIKA; NVVIGQAHFIKAV; VVIGQAHFIKAVE; VIGQAHFIKAVED; IGQAHFIKAVEDL; GQAHFIKAVEDLH; QAHFIKAVEDLHE; AHFIKAVEDLHEA; HFIKAVEDLHEAM; FIKAVEDLHEAMV; IKAVEDLHEAMVG; KAVEDLHEAMVGV; AVEDLHEAMVGVS; VEDLHEAMVGVSP; | 105776-<br>106369 |

Fig. 29 continued

| | | |
|---|---|---|
| | EDLHEAMVGVSPS; DLHEAMVGVSPSL; LHEAMVGVSPSLR;<br>HEAMVGVSPSLRF; EAMVGVSPSLRFG; AMVGVSPSLRFGL;<br>MVGVSPSLRFGLA; VGVSPSLRFGLAF; GVSPSLRFGLAFC; VSPSLRFGLAFCE;<br>SPSLRFGLAFCEA; PSLRFGLAFCEAS; SLRFGLAFCEASG; LRFGLAFCEASGP;<br>RFGLAFCEASGPR; FGLAFCEASGPRL; GLAFCEASGPRLV; LAFCEASGPRLVR;<br>AFCEASGPRLVRH; FCEASGPRLVRHT; CEASGPRLVRHTG;<br>EASGPRLVRHTGN; ASGPRLVRHTGND; SGPRLVRHTGNDG;<br>GPRLVRHTGNDGD; PRLVRHTGNDGDL; RLVRHTGNDGDLV;<br>LVRHTGNDGDLVE; VRHTGNDGDLVEL; RHTGNDGDLVELA;<br>HTGNDGDLVELAT; TGNDGDLVELATR; GNDGDLVELATRT; NDGDLVELATRTA;<br>DGDLVELATRTAL; GDLVELATRTALA; DLVELATRTALAI; LVELATRTALAIA;<br>VELATRTALAIAA; ELATRTALAIAAG; LATRTALAIAAGH; ATRTALAIAAGHS;<br>TRTALAIAAGHSF; RTALAIAAGHSFV; TALAIAAGHSFVI; ALAIAAGHSFVIF;<br>LAIAAGHSFVIFL; AIAAGHSFVIFLR; IAAGHSFVIFLRE; AAGHSFVIFLREG;<br>AGHSFVIFLREGF; GHSFVIFLREGFP; HSFVIFLREGFPI; SFVIFLREGFPIN;<br>FVIFLREGFPINI; VIFLREGFPINIL; IFLREGFPINILN; FLREGFPINILNP;<br>LREGFPINILNPV; REGFPINILNPVQ; EGFPINILNPVQA; GFPINILNPVQAV;<br>FPINILNPVQAVP; PINILNPVQAVPE; INILNPVQAVPEV; NILNPVQAVPEVC;<br>ILNPVQAVPEVCT; LNPVQAVPEVCTI; NPVQAVPEVCTIY; PVQAVPEVCTIYC;<br>VQAVPEVCTIYCA; QAVPEVCTIYCAT; AVPEVCTIYCATA; VPEVCTIYCATAN;<br>PEVCTIYCATANP; EVCTIYCATANPV; VCTIYCATANPVD; CTIYCATANPVDV;<br>TIYCATANPVDVV; IYCATANPVDVVV; YCATANPVDVVVA; CATANPVDVVVAV;<br>ATANPVDVVVAVT; TANPVDVVVAVTP; ANPVDVVVAVTPH; NPVDVVVAVTPHG;<br>PVDVVVAVTPHGR; VDVVVAVTPHGRG; DVVVAVTPHGRGI; VVVAVTPHGRGIV;<br>VVAVTPHGRGIVG; VAVTPHGRGIVGV; AVTPHGRGIVGVV; VTPHGRGIVGVVD;<br>TPHGRGIVGVVDG; PHGRGIVGVVDGQ; HGRGIVGVVDGQT;<br>GRGIVGVVDGQTP; RGIVGVVDGQTPL; GIVGVVDGQTPLG; IVGVVDGQTPLGV;<br>VGVVDGQTPLGVE; GVVDGQTPLGVET; VVDGQTPLGVETD;<br>VDGQTPLGVETDR; DGQTPLGVETDRD; GQTPLGVETDRDI; QTPLGVETDRDIA;<br>TPLGVETDRDIAQ; PLGVETDRDIAQR; LGVETDRDIAQRR; GVETDRDIAQRRD;<br>VETDRDIAQRRDL; ETDRDIAQRRDLL; TDRDIAQRRDLLR; DRDIAQRRDLLRA;<br>RDIAQRRDLLRAI; DIAQRRDLLRAIG; IAQRRDLLRAIGY; AQRRDLLRAIGYK;<br>QRRDLLRAIGYKL<br><br>14 mers:<br>MSLAWDVVSVDKPD; SLAWDVVSVDKPDD; LAWDVVSVDKPDDV;<br>AWDVVSVDKPDDVN; WDVVSVDKPDDVNV; DVVSVDKPDDVNVV;<br>VVSVDKPDDVNVVI; VSVDKPDDVNVVIG; SVDKPDDVNVVIGQ;<br>VDKPDDVNVVIGQA; DKPDDVNVVIGQAH; KPDDVNVVIGQAHF;<br>PDDVNVVIGQAHFI; DDVNVVIGQAHFIK; DVNVVIGQAHFIKA;<br>VNVVIGQAHFIKAV; NVVIGQAHFIKAVE; VVIGQAHFIKAVED; VIGQAHFIKAVEDL;<br>IGQAHFIKAVEDLH; GQAHFIKAVEDLHE; QAHFIKAVEDLHEA;<br>AHFIKAVEDLHEAM; HFIKAVEDLHEAMV; FIKAVEDLHEAMVG;<br>IKAVEDLHEAMVGV; KAVEDLHEAMVGVS; AVEDLHEAMVGVSP;<br>VEDLHEAMVGVSPS; EDLHEAMVGVSPSL; DLHEAMVGVSPSLR;<br>LHEAMVGVSPSLRF; HEAMVGVSPSLRFG; EAMVGVSPSLRFGL;<br>AMVGVSPSLRFGLA; MVGVSPSLRFGLAF; VGVSPSLRFGLAFC;<br>GVSPSLRFGLAFCE; VSPSLRFGLAFCEA; SPSLRFGLAFCEAS;<br>PSLRFGLAFCEASG; SLRFGLAFCEASGP; LRFGLAFCEASGPR;<br>RFGLAFCEASGPRL; FGLAFCEASGPRLV; GLAFCEASGPRLVR;<br>LAFCEASGPRLVRH; AFCEASGPRLVRHT; FCEASGPRLVRHTG;<br>CEASGPRLVRHTGN; EASGPRLVRHTGND; ASGPRLVRHTGNDG;<br>SGPRLVRHTGNDGD; GPRLVRHTGNDGDL; PRLVRHTGNDGDLV; | |

Fig. 29 continued

| | | |
|---|---|---|
| | RLVRHTGNDGDLVE; LVRHTGNDGDLVEL; VRHTGNDGDLVELA; RHTGNDGDLVELAT; HTGNDGDLVELATR; TGNDGDLVELATRT; GNDGDLVELATRTA; NDGDLVELATRTAL; DGDLVELATRTALA; GDLVELATRTALAI; DLVELATRTALAIA; LVELATRTALAIAA; VELATRTALAIAAG; ELATRTALAIAAGH; LATRTALAIAAGHS; ATRTALAIAAGHSF; TRTALAIAAGHSFV; RTALAIAAGHSFVI; TALAIAAGHSFVIF; ALAIAAGHSFVIFL; LAIAAGHSFVIFLR; AIAAGHSFVIFLRE; IAAGHSFVIFLREG; AAGHSFVIFLREGF; AGHSFVIFLREGFP; GHSFVIFLREGFPI; HSFVIFLREGFPIN; SFVIFLREGFPINI; FVIFLREGFPINIL; VIFLREGFPINILN; IFLREGFPINILNP; FLREGFPINILNPV; LREGFPINILNPVQ; REGFPINILNPVQA; EGFPINILNPVQAV; GFPINILNPVQAVP; FPINILNPVQAVPE; PINILNPVQAVPEV; INILNPVQAVPEVC; NILNPVQAVPEVCT; ILNPVQAVPEVCTI; LNPVQAVPEVCTIY; NPVQAVPEVCTIYC; PVQAVPEVCTIYCA; VQAVPEVCTIYCAT; QAVPEVCTIYCATA; AVPEVCTIYCATAN; VPEVCTIYCATANP; PEVCTIYCATANPV; EVCTIYCATANPVD; VCTIYCATANPVDV; CTIYCATANPVDVV; TIYCATANPVDVVV; IYCATANPVDVVVA; YCATANPVDVVVAV; CATANPVDVVVAVT; ATANPVDVVVAVTP; TANPVDVVVAVTPH; ANPVDVVVAVTPHG; NPVDVVVAVTPHGR; PVDVVVAVTPHGRG; VDVVVAVTPHGRGI; DVVVAVTPHGRGIV; VVVAVTPHGRGIVG; VVAVTPHGRGIVGV; VAVTPHGRGIVGVV; AVTPHGRGIVGVVD; VTPHGRGIVGVVDG; TPHGRGIVGVVDGQ; PHGRGIVGVVDGQT; HGRGIVGVVDGQTP; GRGIVGVVDGQTPL; RGIVGVVDGQTPLG; GIVGVVDGQTPLGV; IVGVVDGQTPLGVE; VGVVDGQTPLGVET; GVVDGQTPLGVETD; VVDGQTPLGVETDR; VDGQTPLGVETDRD; DGQTPLGVETDRDI; GQTPLGVETDRDIA; QTPLGVETDRDIAQ; TPLGVETDRDIAQR; PLGVETDRDIAQRR; LGVETDRDIAQRRD; GVETDRDIAQRRDL; VETDRDIAQRRDLL; ETDRDIAQRRDLLR; TDRDIAQRRDLLRA; DRDIAQRRDLLRAI; RDIAQRRDLLRAIG; DIAQRRDLLRAIGY; IAQRRDLLRAIGYK; AQRRDLLRAIGYKL<br><br>15 mers:<br>MSLAWDVVSVDKPDD; SLAWDVVSVDKPDDV; LAWDVVSVDKPDDVN; AWDVVSVDKPDDVNV; WDVVSVDKPDDVNVV; DVVSVDKPDDVNVVI; VVSVDKPDDVNVVIG; VSVDKPDDVNVVIGQ; SVDKPDDVNVVIGQA; VDKPDDVNVVIGQAH; DKPDDVNVVIGQAHF; KPDDVNVVIGQAHFI; PDDVNVVIGQAHFIK; DDVNVVIGQAHFIKA; DVNVVIGQAHFIKAV; VNVVIGQAHFIKAVE; NVVIGQAHFIKAVED; VVIGQAHFIKAVEDL; VIGQAHFIKAVEDLH; IGQAHFIKAVEDLHE; GQAHFIKAVEDLHEA; QAHFIKAVEDLHEAM; AHFIKAVEDLHEAMV; HFIKAVEDLHEAMVG; FIKAVEDLHEAMVGV; IKAVEDLHEAMVGVS; KAVEDLHEAMVGVSP; AVEDLHEAMVGVSPS; VEDLHEAMVGVSPSL; EDLHEAMVGVSPSLR; DLHEAMVGVSPSLRF; LHEAMVGVSPSLRFG; HEAMVGVSPSLRFGL; EAMVGVSPSLRFGLA; AMVGVSPSLRFGLAF; MVGVSPSLRFGLAFC; VGVSPSLRFGLAFCE; GVSPSLRFGLAFCEA; VSPSLRFGLAFCEAS; SPSLRFGLAFCEASG; PSLRFGLAFCEASGP; SLRFGLAFCEASGPR; LRFGLAFCEASGPRL; RFGLAFCEASGPRLV; FGLAFCEASGPRLVR; GLAFCEASGPRLVRH; LAFCEASGPRLVRHT; AFCEASGPRLVRHTG; FCEASGPRLVRHTGN; CEASGPRLVRHTGND; EASGPRLVRHTGNDG; ASGPRLVRHTGNDGD; SGPRLVRHTGNDGDL; GPRLVRHTGNDGDLV; PRLVRHTGNDGDLVE; RLVRHTGNDGDLVEL; LVRHTGNDGDLVELA; VRHTGNDGDLVELAT; RHTGNDGDLVELATR; HTGNDGDLVELATRT; TGNDGDLVELATRTA; GNDGDLVELATRTAL; NDGDLVELATRTALA; DGDLVELATRTALAI; GDLVELATRTALAIA; DLVELATRTALAIAA; | |

Fig. 29 continued

| | | |
|---|---|---|
| | LVELATRTALAIAAG; VELATRTALAIAAGH; ELATRTALAIAAGHS; LATRTALAIAAGHSF; ATRTALAIAAGHSFV; TRTALAIAAGHSFVI; RTALAIAAGHSFVIF; TALAIAAGHSFVIFL; ALAIAAGHSFVIFLR; LAIAAGHSFVIFLRE; AIAAGHSFVIFLREG; IAAGHSFVIFLREGF; AAGHSFVIFLREGFP; AGHSFVIFLREGFPI; GHSFVIFLREGFPIN; HSFVIFLREGFPINI; SFVIFLREGFPINIL; FVIFLREGFPINILN; VIFLREGFPINILNP; IFLREGFPINILNPV; FLREGFPINILNPVQ; LREGFPINILNPVQA; REGFPINILNPVQAV; EGFPINILNPVQAVP; GFPINILNPVQAVPE; FPINILNPVQAVPEV; PINILNPVQAVPEVC; INILNPVQAVPEVCT; NILNPVQAVPEVCTI; ILNPVQAVPEVCTIY; LNPVQAVPEVCTIYC; NPVQAVPEVCTIYCA; PVQAVPEVCTIYCAT; VQAVPEVCTIYCATA; QAVPEVCTIYCATAN; AVPEVCTIYCATANP; VPEVCTIYCATANPV; PEVCTIYCATANPVD; EVCTIYCATANPVDV; VCTIYCATANPVDVV; CTIYCATANPVDVVV; TIYCATANPVDVVVA; IYCATANPVDVVVAV; YCATANPVDVVVAVT; CATANPVDVVVAVTP; ATANPVDVVVAVTPH; TANPVDVVVAVTPHG; ANPVDVVVAVTPHGR; NPVDVVVAVTPHGRG; PVDVVVAVTPHGRGI; VDVVVAVTPHGRGIV; DVVVAVTPHGRGIVG; VVVAVTPHGRGIVGV; VVAVTPHGRGIVGVV; VAVTPHGRGIVGVVD; AVTPHGRGIVGVVDG; VTPHGRGIVGVVDGQ; TPHGRGIVGVVDGQT; PHGRGIVGVVDGQTP; HGRGIVGVVDGQTPL; GRGIVGVVDGQTPLG; RGIVGVVDGQTPLGV; GIVGVVDGQTPLGVE; IVGVVDGQTPLGVET; VGVVDGQTPLGVETD; GVVDGQTPLGVETDR; VVDGQTPLGVETDRD; VDGQTPLGVETDRDI; DGQTPLGVETDRDIA; GQTPLGVETDRDIAQ; QTPLGVETDRDIAQR; TPLGVETDRDIAQRR; PLGVETDRDIAQRRD; LGVETDRDIAQRRDL; GVETDRDIAQRRDLL; VETDRDIAQRRDLLR; ETDRDIAQRRDLLRA; TDRDIAQRRDLLRAI; DRDIAQRRDLLRAIG; RDIAQRRDLLRAIGY; DIAQRRDLLRAIGYK; IAQRRDLLRAIGYKL<br><br>16 mers:<br>MSLAWDVVSVDKPDDV; SLAWDVVSVDKPDDVN; LAWDVVSVDKPDDVNV; AWDVVSVDKPDDVNVV; WDVVSVDKPDDVNVVI; DVVSVDKPDDVNVVIG; VVSVDKPDDVNVVIGQ; VSVDKPDDVNVVIGQA; SVDKPDDVNVVIGQAH; VDKPDDVNVVIGQAHF; DKPDDVNVVIGQAHFI; KPDDVNVVIGQAHFIK; PDDVNVVIGQAHFIKA; DDVNVVIGQAHFIKAV; DVNVVIGQAHFIKAVE; VNVVIGQAHFIKAVED; NVVIGQAHFIKAVEDL; VVIGQAHFIKAVEDLH; VIGQAHFIKAVEDLHE; IGQAHFIKAVEDLHEA; GQAHFIKAVEDLHEAM; QAHFIKAVEDLHEAMV; AHFIKAVEDLHEAMVG; HFIKAVEDLHEAMVGV; FIKAVEDLHEAMVGVS; IKAVEDLHEAMVGVSP; KAVEDLHEAMVGVSPS; AVEDLHEAMVGVSPSL; VEDLHEAMVGVSPSLR; EDLHEAMVGVSPSLRF; DLHEAMVGVSPSLRFG; LHEAMVGVSPSLRFGL; HEAMVGVSPSLRFGLA; EAMVGVSPSLRFGLAF; AMVGVSPSLRFGLAFC; MVGVSPSLRFGLAFCE; VGVSPSLRFGLAFCEA; GVSPSLRFGLAFCEAS; VSPSLRFGLAFCEASG; SPSLRFGLAFCEASGP; PSLRFGLAFCEASGPR; SLRFGLAFCEASGPRL; LRFGLAFCEASGPRLV; RFGLAFCEASGPRLVR; FGLAFCEASGPRLVRH; GLAFCEASGPRLVRHT; LAFCEASGPRLVRHTG; AFCEASGPRLVRHTGN; FCEASGPRLVRHTGND; CEASGPRLVRHTGNDG; EASGPRLVRHTGNDGD; ASGPRLVRHTGNDGDL; SGPRLVRHTGNDGDLV; GPRLVRHTGNDGDLVE; PRLVRHTGNDGDLVEL; RLVRHTGNDGDLVELA; LVRHTGNDGDLVELAT; VRHTGNDGDLVELATR; RHTGNDGDLVELATRT; HTGNDGDLVELATRTA; TGNDGDLVELATRTAL; GNDGDLVELATRTALA; NDGDLVELATRTALAI; DGDLVELATRTALAIA; GDLVELATRTALAIAA; DLVELATRTALAIAAG; LVELATRTALAIAAGH; VELATRTALAIAAGHS; ELATRTALAIAAGHSF; LATRTALAIAAGHSFV; ATRTALAIAAGHSFVI; TRTALAIAAGHSFVIF; | |

Fig. 29 continued

| | | |
|---|---|---|
| | RTALAIAAGHSFVIFL; TALAIAAGHSFVIFLR; ALAIAAGHSFVIFLRE; LAIAAGHSFVIFLREG; AIAAGHSFVIFLREGF; IAAGHSFVIFLREGFP; AAGHSFVIFLREGFPI; AGHSFVIFLREGFPIN; GHSFVIFLREGFPINI; HSFVIFLREGFPINIL; SFVIFLREGFPINILN; FVIFLREGFPINILNP; VIFLREGFPINILNPV; IFLREGFPINILNPVQ; FLREGFPINILNPVQA; LREGFPINILNPVQAV; REGFPINILNPVQAVP; EGFPINILNPVQAVPE; GFPINILNPVQAVPEV; FPINILNPVQAVPEVC; PINILNPVQAVPEVCT; INILNPVQAVPEVCTI; NILNPVQAVPEVCTIY; ILNPVQAVPEVCTIYC; LNPVQAVPEVCTIYCA; NPVQAVPEVCTIYCAT; PVQAVPEVCTIYCATA; VQAVPEVCTIYCATAN; QAVPEVCTIYCATANP; AVPEVCTIYCATANPV; VPEVCTIYCATANPVD; PEVCTIYCATANPVDV; EVCTIYCATANPVDVV; VCTIYCATANPVDVVV; CTIYCATANPVDVVVA; TIYCATANPVDVVVAV; IYCATANPVDVVVAVT; YCATANPVDVVVAVTP; CATANPVDVVVAVTPH; ATANPVDVVVAVTPHG; TANPVDVVVAVTPHGR; ANPVDVVVAVTPHGRG; NPVDVVVAVTPHGRGI; PVDVVVAVTPHGRGIV; VDVVVAVTPHGRGIVG; DVVVAVTPHGRGIVGV; VVVAVTPHGRGIVGVV; VVAVTPHGRGIVGVVD; VAVTPHGRGIVGVVDG; AVTPHGRGIVGVVDGQ; VTPHGRGIVGVVDGQT; TPHGRGIVGVVDGQTP; PHGRGIVGVVDGQTPL; HGRGIVGVVDGQTPLG; GRGIVGVVDGQTPLGV; RGIVGVVDGQTPLGVE; GIVGVVDGQTPLGVET; IVGVVDGQTPLGVETD; VGVVDGQTPLGVETDR; GVVDGQTPLGVETDRD; VVDGQTPLGVETDRDI; VDGQTPLGVETDRDIA; DGQTPLGVETDRDIAQ; GQTPLGVETDRDIAQR; QTPLGVETDRDIAQRR; TPLGVETDRDIAQRRD; PLGVETDRDIAQRRDL; LGVETDRDIAQRRDLL; GVETDRDIAQRRDLLR; VETDRDIAQRRDLLRA; ETDRDIAQRRDLLRAI; TDRDIAQRRDLLRAIG; DRDIAQRRDLLRAIGY; RDIAQRRDLLRAIGYK; DIAQRRDLLRAIGYKL | |
| 70) Rv3810 | 13 mers: MPNRRRRKLSTAM; PNRRRRKLSTAMS; NRRRRKLSTAMSA; RRRRKLSTAMSAV; RRRKLSTAMSAVA; RRKLSTAMSAVAA; RKLSTAMSAVAAL; KLSTAMSAVAALA; LSTAMSAVAALAV; STAMSAVAALAVA; TAMSAVAALAVAS; AMSAVAALAVASP; MSAVAALAVASPC; SAVAALAVASPCA; AVAALAVASPCAY; VAALAVASPCAYF; AALAVASPCAYFL; ALAVASPCAYFLV; LAVASPCAYFLVY; AVASPCAYFLVYE; VASPCAYFLVYES; ASPCAYFLVYEST; SPCAYFLVYESTE; PCAYFLVYESTET; CAYFLVYESTETT; AYFLVYESTETTE; YFLVYESTETTER; FLVYESTETTERP; LVYESTETTERPE; VYESTETTERPEH; YESTETTERPEHH; ESTETTERPEHHE; STETTERPEHHEF; TETTERPEHHEFK; ETTERPEHHEFKQ; TTERPEHHEFKQA; TERPEHHEFKQAA; ERPEHHEFKQAAV; RPEHHEFKQAAVL; PEHHEFKQAAVLT; EHHEFKQAAVLTD; HHEFKQAAVLTDL; HEFKQAAVLTDLP; EFKQAAVLTDLPG; FKQAAVLTDLPGE; KQAAVLTDLPGEL; QAAVLTDLPGELM; AAVLTDLPGELMS; AVLTDLPGELMSA; VLTDLPGELMSAL; LTDLPGELMSALS; TDLPGELMSALSQ; DLPGELMSALSQG; LPGELMSALSQGL; PGELMSALSQGLS; GELMSALSQGLSQ; ELMSALSQGLSQF; LMSALSQGLSQFG; MSALSQGLSQFGI; SALSQGLSQFGIN; ALSQGLSQFGINI; LSQGLSQFGINIP; SQGLSQFGINIPP; QGLSQFGINIPPV; GLSQFGINIPPVP; LSQFGINIPPVPS; SQFGINIPPVPSL; QFGINIPPVPSLT; FGINIPPVPSLTG; GINIPPVPSLTGS; INIPPVPSLTGSG; NIPPVPSLTGSGD; IPPVPSLTGSGDA; PPVPSLTGSGDAS; PVPSLTGSGDAST; VPSLTGSGDASTG; PSLTGSGDASTGL; SLTGSGDASTGLT; LTGSGDASTGLTG; TGSGDASTGLTGP; GSGDASTGLTGPG; SGDASTGLTGPGL; GDASTGLTGPGLT; DASTGLTGPGLTS; ASTGLTGPGLTSP; STGLTGPGLTSPG; TGLTGPGLTSPGL; GLTGPGLTSPGLT; LTGPGLTSPGLTS; TGPGLTSPGLTSP; GPGLTSPGLTSPG; PGLTSPGLTSPGL; GLTSPGLTSPGLT; LTSPGLTSPGLTS; TSPGLTSPGLTSP; SPGLTSPGLTSPG; PGLTSPGLTSPGL; GLTSPGLTSPGLT; LTSPGLTSPGLTD; TSPGLTSPGLTDP; SPGLTSPGLTDPA; PGLTSPGLTDPAL; GLTSPGLTDPALT; LTSPGLTDPALTS; TSPGLTDPALTSP; SPGLTDPALTSPG; | 106370-107451 |

Fig. 29 continued

| | | |
|---|---|---|
| | PGLTDPALTSPGL; GLTDPALTSPGLT; LTDPALTSPGLTP; TDPALTSPGLTPT; DPALTSPGLTPTL; PALTSPGLTPTLP; ALTSPGLTPTLPG; LTSPGLTPTLPGS; TSPGLTPTLPGSL; SPGLTPTLPGSLA; PGLTPTLPGSLAA; GLTPTLPGSLAAP; LTPTLPGSLAAPG; TPTLPGSLAAPGT; PTLPGSLAAPGTT; TLPGSLAAPGTTL; LPGSLAAPGTTLA; PGSLAAPGTTLAP; GSLAAPGTTLAPT; SLAAPGTTLAPTP; LAAPGTTLAPTPG; AAPGTTLAPTPGV; APGTTLAPTPGVG; PGTTLAPTPGVGA; GTTLAPTPGVGAN; TTLAPTPGVGANP; TLAPTPGVGANPA; LAPTPGVGANPAL; APTPGVGANPALT; PTPGVGANPALTN; TPGVGANPALTNP; PGVGANPALTNPA; GVGANPALTNPAL; VGANPALTNPALT; GANPALTNPALTS; ANPALTNPALTSP; NPALTNPALTSPT; PALTNPALTSPTG; ALTNPALTSPTGA; LTNPALTSPTGAT; TNPALTSPTGATP; NPALTSPTGATPG; PALTSPTGATPGL; ALTSPTGATPGLT; LTSPTGATPGLTS; TSPTGATPGLTSP; SPTGATPGLTSPT; PTGATPGLTSPTG; TGATPGLTSPTGL; GATPGLTSPTGLD; ATPGLTSPTGLDP; TPGLTSPTGLDPA; PGLTSPTGLDPAL; GLTSPTGLDPALG; LTSPTGLDPALGG; TSPTGLDPALGGA; SPTGLDPALGGAN; PTGLDPALGGANE; TGLDPALGGANEI; GLDPALGGANEIP; LDPALGGANEIPI; DPALGGANEIPIT; PALGGANEIPITT; ALGGANEIPITTP; LGGANEIPITTPV; GGANEIPITTPVG; GANEIPITTPVGL; ANEIPITTPVGLD; NEIPITTPVGLDP; EIPITTPVGLDPG; IPITTPVGLDPGA; PITTPVGLDPGAD; ITTPVGLDPGADG; TTPVGLDPGADGT; TPVGLDPGADGTY; PVGLDPGADGTYP; VGLDPGADGTYPI; GLDPGADGTYPIL; LDPGADGTYPILG; DPGADGTYPILGD; PGADGTYPILGDP; GADGTYPILGDPT; ADGTYPILGDPTL; DGTYPILGDPTLG; GTYPILGDPTLGT; TYPILGDPTLGTI; YPILGDPTLGTIP; PILGDPTLGTIPS; ILGDPTLGTIPSS; LGDPTLGTIPSSP; GDPTLGTIPSSPA; DPTLGTIPSSPAT; PTLGTIPSSPATT; TLGTIPSSPATTS; LGTIPSSPATTST; GTIPSSPATTSTG; TIPSSPATTSTGG; IPSSPATTSTGGG; PSSPATTSTGGGG; SSPATTSTGGGGL; SPATTSTGGGGLV; PATTSTGGGGLVN; ATTSTGGGGLVND; TTSTGGGGLVNDV; TSTGGGGLVNDVM; STGGGGLVNDVMQ; TGGGGLVNDVMQV; GGGGLVNDVMQVA; GGGLVNDVMQVAN; GGLVNDVMQVANE; GLVNDVMQVANEL; LVNDVMQVANELG; VNDVMQVANELGA; NDVMQVANELGAS; DVMQVANELGASQ; VMQVANELGASQA; MQVANELGASQAI; QVANELGASQAID; VANELGASQAIDL; ANELGASQAIDLL; NELGASQAIDLLK; ELGASQAIDLLKG; LGASQAIDLLKGV; GASQAIDLLKGVL; ASQAIDLLKGVLM; SQAIDLLKGVLMP; QAIDLLKGVLMPS; AIDLLKGVLMPSI; IDLLKGVLMPSIM; DLLKGVLMPSIMQ; LLKGVLMPSIMQA; LKGVLMPSIMQAV; KGVLMPSIMQAVQ; GVLMPSIMQAVQN; VLMPSIMQAVQNG; LMPSIMQAVQNGG; MPSIMQAVQNGGA; PSIMQAVQNGGAA; SIMQAVQNGGAAA; IMQAVQNGGAAAP; MQAVQNGGAAAPA; QAVQNGGAAAPAA; AVQNGGAAAPAAS; VQNGGAAAPAASP; QNGGAAAPAASPP; NGGAAAPAASPPV; GGAAAPAASPPVP; GAAAPAASPPVPP; AAAPAASPPVPPI; AAPAASPPVPPIP; APAASPPVPPIPA; PAASPPVPPIPAA; AASPPVPPIPAAA; ASPPVPPIPAAAA; SPPVPPIPAAAAV; PPVPPIPAAAAVP; PVPPIPAAAAVPP; VPPIPAAAAVPPT; PPIPAAAAVPPTD; PIPAAAAVPPTDP; IPAAAAVPPTDPI; PAAAAVPPTDPIT; AAAAVPPTDPITV; AAAVPPTDPITVP; AAVPPTDPITVPV; AVPPTDPITVPVA<br><br>14 mers:<br>MPNRRRRKLSTAMS; PNRRRRKLSTAMSA; NRRRRKLSTAMSAV; RRRRKLSTAMSAVA; RRRKLSTAMSAVAA; RRKLSTAMSAVAAL; RKLSTAMSAVAALA; KLSTAMSAVAALAV; LSTAMSAVAALAVA; STAMSAVAALAVAS; TAMSAVAALAVASP; AMSAVAALAVASPC; MSAVAALAVASPCA; SAVAALAVASPCAY; AVAALAVASPCAYF; VAALAVASPCAYFL; AALAVASPCAYFLV; ALAVASPCAYFLVY; LAVASPCAYFLVYE; AVASPCAYFLVYES; VASPCAYFLVYEST; | |

Fig. 29 continued

| | | |
|---|---|---|
| | ASPCAYFLVYESTE; SPCAYFLVYESTET; PCAYFLVYESTETT; CAYFLVYESTETTE; AYFLVYESTETTER; YFLVYESTETTERP; FLVYESTETTERPE; LVYESTETTERPEH; VYESTETTERPEHH; YESTETTERPEHHE; ESTETTERPEHHEF; STETTERPEHHEFK; TETTERPEHHEFKQ; ETTERPEHHEFKQA; TTERPEHHEFKQAA; TERPEHHEFKQAAV; ERPEHHEFKQAAVL; RPEHHEFKQAAVLT; PEHHEFKQAAVLTD; EHHEFKQAAVLTDL; HHEFKQAAVLTDLP; HEFKQAAVLTDLPG; EFKQAAVLTDLPGE; FKQAAVLTDLPGEL; KQAAVLTDLPGELM; QAAVLTDLPGELMS; AAVLTDLPGELMSA; AVLTDLPGELMSAL; VLTDLPGELMSALS; LTDLPGELMSALSQ; TDLPGELMSALSQG; DLPGELMSALSQGL; LPGELMSALSQGLS; PGELMSALSQGLSQ; GELMSALSQGLSQF; ELMSALSQGLSQFG; LMSALSQGLSQFGI; MSALSQGLSQFGIN; SALSQGLSQFGINI; ALSQGLSQFGINIP; LSQGLSQFGINIPP; SQGLSQFGINIPPV; QGLSQFGINIPPVP; GLSQFGINIPPVPS; LSQFGINIPPVPSL; SQFGINIPPVPSLT; QFGINIPPVPSLTG; FGINIPPVPSLTGS; GINIPPVPSLTGSG; INIPPVPSLTGSGD; NIPPVPSLTGSGDA; IPPVPSLTGSGDAS; PPVPSLTGSGDAST; PVPSLTGSGDASTG; VPSLTGSGDASTGL; PSLTGSGDASTGLT; SLTGSGDASTGLTG; LTGSGDASTGLTGP; TGSGDASTGLTGPG; GSGDASTGLTGPGL; SGDASTGLTGPGLT; GDASTGLTGPGLTS; DASTGLTGPGLTSP; ASTGLTGPGLTSPG; STGLTGPGLTSPGL; TGLTGPGLTSPGLT; GLTGPGLTSPGLTS; LTGPGLTSPGLTSP; TGPGLTSPGLTSPG; GPGLTSPGLTSPGL; PGLTSPGLTSPGLT; GLTSPGLTSPGLTS; LTSPGLTSPGLTSP; TSPGLTSPGLTSPG; SPGLTSPGLTSPGL; PGLTSPGLTSPGLT; GLTSPGLTSPGLTD; LTSPGLTSPGLTDP; TSPGLTSPGLTDPA; SPGLTSPGLTDPAL; PGLTSPGLTDPALT; GLTSPGLTDPALTS; LTSPGLTDPALTSP; TSPGLTDPALTSPG; SPGLTDPALTSPGL; PGLTDPALTSPGLT; GLTDPALTSPGLTP; LTDPALTSPGLTPT; TDPALTSPGLTPTL; DPALTSPGLTPTLP; PALTSPGLTPTLPG; ALTSPGLTPTLPGS; LTSPGLTPTLPGSL; TSPGLTPTLPGSLA; SPGLTPTLPGSLAA; PGLTPTLPGSLAAP; GLTPTLPGSLAAPG; LTPTLPGSLAAPGT; TPTLPGSLAAPGTT; PTLPGSLAAPGTTL; TLPGSLAAPGTTLA; LPGSLAAPGTTLAP; PGSLAAPGTTLAPT; GSLAAPGTTLAPTP; SLAAPGTTLAPTPG; LAAPGTTLAPTPGV; AAPGTTLAPTPGVG; APGTTLAPTPGVGA; PGTTLAPTPGVGAN; GTTLAPTPGVGANP; TTLAPTPGVGANPA; TLAPTPGVGANPAL; LAPTPGVGANPALT; APTPGVGANPALTN; PTPGVGANPALTNP; TPGVGANPALTNPA; PGVGANPALTNPAL; GVGANPALTNPALT; VGANPALTNPALTS; GANPALTNPALTSP; ANPALTNPALTSPT; NPALTNPALTSPTG; PALTNPALTSPTGA; ALTNPALTSPTGAT; LTNPALTSPTGATP; TNPALTSPTGATPG; NPALTSPTGATPGL; PALTSPTGATPGLT; ALTSPTGATPGLTS; LTSPTGATPGLTSP; TSPTGATPGLTSPT; SPTGATPGLTSPTG; PTGATPGLTSPTGL; TGATPGLTSPTGLD; GATPGLTSPTGLDP; ATPGLTSPTGLDPA; TPGLTSPTGLDPAL; PGLTSPTGLDPALG; GLTSPTGLDPALGG; LTSPTGLDPALGGA; TSPTGLDPALGGAN; SPTGLDPALGGANE; PTGLDPALGGANEI; TGLDPALGGANEIP; GLDPALGGANEIPI; LDPALGGANEIPIT; DPALGGANEIPITT; PALGGANEIPITTP; ALGGANEIPITTPV; LGGANEIPITTPVG; GGANEIPITTPVGL; GANEIPITTPVGLD; ANEIPITTPVGLDP; NEIPITTPVGLDPG; EIPITTPVGLDPGA; IPITTPVGLDPGAD; PITTPVGLDPGADG; ITTPVGLDPGADGT; TTPVGLDPGADGTY; TPVGLDPGADGTYP; PVGLDPGADGTYPI; VGLDPGADGTYPIL; GLDPGADGTYPILG; LDPGADGTYPILGD; DPGADGTYPILGDP; | |

Fig. 29 continued

| | | |
|---|---|---|
| | PGADGTYPILGDPT; GADGTYPILGDPTL; ADGTYPILGDPTLG;<br>DGTYPILGDPTLGT; GTYPILGDPTLGTI; TYPILGDPTLGTIP; YPILGDPTLGTIPS;<br>PILGDPTLGTIPSS; ILGDPTLGTIPSSP; LGDPTLGTIPSSPA; GDPTLGTIPSSPAT;<br>DPTLGTIPSSPATT; PTLGTIPSSPATTS; TLGTIPSSPATTST; LGTIPSSPATTSTG;<br>GTIPSSPATTSTGG; TIPSSPATTSTGGG; IPSSPATTSTGGGG;<br>PSSPATTSTGGGGL; SSPATTSTGGGGLV; SPATTSTGGGGLVN;<br>PATTSTGGGGLVND; ATTSTGGGGLVNDV; TTSTGGGGLVNDVM;<br>TSTGGGGLVNDVMQ; STGGGGLVNDVMQV; TGGGGLVNDVMQVA;<br>GGGGLVNDVMQVAN; GGGLVNDVMQVANE; GGLVNDVMQVANEL;<br>GLVNDVMQVANELG; LVNDVMQVANELGA; VNDVMQVANELGAS;<br>NDVMQVANELGASQ; DVMQVANELGASQA; VMQVANELGASQAI;<br>MQVANELGASQAID; QVANELGASQAIDL; VANELGASQAIDLL;<br>ANELGASQAIDLLK; NELGASQAIDLLKG; ELGASQAIDLLKGV;<br>LGASQAIDLLKGVL; GASQAIDLLKGVLM; ASQAIDLLKGVLMP;<br>SQAIDLLKGVLMPS; QAIDLLKGVLMPSI; AIDLLKGVLMPSIM; IDLLKGVLMPSIMQ;<br>DLLKGVLMPSIMQA; LLKGVLMPSIMQAV; LKGVLMPSIMQAVQ;<br>KGVLMPSIMQAVQN; GVLMPSIMQAVQNG; VLMPSIMQAVQNGG;<br>LMPSIMQAVQNGGA; MPSIMQAVQNGGAA; PSIMQAVQNGGAAA;<br>SIMQAVQNGGAAAP; IMQAVQNGGAAAPA; MQAVQNGGAAAPAA;<br>QAVQNGGAAAPAAS; AVQNGGAAAPAASP; VQNGGAAAPAASPP;<br>QNGGAAAPAASPPV; NGGAAAPAASPPVP; GGAAAPAASPPVPP;<br>GAAAPAASPPVPPI; AAAPAASPPVPPIP; AAPAASPPVPPIPA;<br>APAASPPVPPIPAA; PAASPPVPPIPAAA; AASPPVPPIPAAAA;<br>ASPPVPPIPAAAAV; SPPVPPIPAAAAVP; PPVPPIPAAAAVPP;<br>PVPPIPAAAAVPPT; VPPIPAAAAVPPTD; PPIPAAAAVPPTDP; PIPAAAAVPPTDPI;<br>IPAAAAVPPTDPIT; PAAAAVPPTDPITV; AAAAVPPTDPITVP; AAAVPPTDPITVPV;<br>AAVPPTDPITVPVA<br><br>15 mers:<br>MPNRRRRKLSTAMSA; PNRRRRKLSTAMSAV; NRRRRKLSTAMSAVA;<br>RRRRKLSTAMSAVAA; RRRKLSTAMSAVAAL; RRKLSTAMSAVAALA;<br>RKLSTAMSAVAALAV; KLSTAMSAVAALAVA; LSTAMSAVAALAVAS;<br>STAMSAVAALAVASP; TAMSAVAALAVASPC; AMSAVAALAVASPCA;<br>MSAVAALAVASPCAY; SAVAALAVASPCAYF; AVAALAVASPCAYFL;<br>VAALAVASPCAYFLV; AALAVASPCAYFLVY; ALAVASPCAYFLVYE;<br>LAVASPCAYFLVYES; AVASPCAYFLVYEST; VASPCAYFLVYESTE;<br>ASPCAYFLVYESTET; SPCAYFLVYESTETT; PCAYFLVYESTETTE;<br>CAYFLVYESTETTER; AYFLVYESTETTERP; YFLVYESTETTERPE;<br>FLVYESTETTERPEH; LVYESTETTERPEHH; VYESTETTERPEHHE;<br>YESTETTERPEHHEF; ESTETTERPEHHEFK; STETTERPEHHEFKQ;<br>TETTERPEHHEFKQA; ETTERPEHHEFKQAA; TTERPEHHEFKQAAV;<br>TERPEHHEFKQAAVL; ERPEHHEFKQAAVLT; RPEHHEFKQAAVLTD;<br>PEHHEFKQAAVLTDL; EHHEFKQAAVLTDLP; HHEFKQAAVLTDLPG;<br>HEFKQAAVLTDLPGE; EFKQAAVLTDLPGEL; FKQAAVLTDLPGELM;<br>KQAAVLTDLPGELMS; QAAVLTDLPGELMSA; AAVLTDLPGELMSAL;<br>AVLTDLPGELMSALS; VLTDLPGELMSALSQ; LTDLPGELMSALSQG;<br>TDLPGELMSALSQGL; DLPGELMSALSQGLS; LPGELMSALSQGLSQ;<br>PGELMSALSQGLSQF; GELMSALSQGLSQFG; ELMSALSQGLSQFGI;<br>LMSALSQGLSQFGIN; MSALSQGLSQFGINI; SALSQGLSQFGINIP;<br>ALSQGLSQFGINIPP; LSQGLSQFGINIPPV; SQGLSQFGINIPPVP;<br>QGLSQFGINIPPVPS; GLSQFGINIPPVPSL; LSQFGINIPPVPSLT;<br>SQFGINIPPVPSLTG; QFGINIPPVPSLTGS; FGINIPPVPSLTGSG;<br>GINIPPVPSLTGSGD; INIPPVPSLTGSGDA; NIPPVPSLTGSGDAS; | |

Fig. 29 continued

| | | |
|---|---|---|
| | IPPVPSLTGSGDAST; PPVPSLTGSGDASTG; PVPSLTGSGDASTGL; VPSLTGSGDASTGLT; PSLTGSGDASTGLTG; SLTGSGDASTGLTGP; LTGSGDASTGLTGPG; TGSGDASTGLTGPGL; GSGDASTGLTGPGLT; SGDASTGLTGPGLTS; GDASTGLTGPGLTSP; DASTGLTGPGLTSPG; ASTGLTGPGLTSPGL; STGLTGPGLTSPGLT; TGLTGPGLTSPGLTS; GLTGPGLTSPGLTSP; LTGPGLTSPGLTSPG; TGPGLTSPGLTSPGL; GPGLTSPGLTSPGLT; PGLTSPGLTSPGLTS; GLTSPGLTSPGLTSP; LTSPGLTSPGLTSPG; TSPGLTSPGLTSPGL; SPGLTSPGLTSPGLT; PGLTSPGLTSPGLTD; GLTSPGLTSPGLTDP; LTSPGLTSPGLTDPA; TSPGLTSPGLTDPAL; SPGLTSPGLTDPALT; PGLTSPGLTDPALTS; GLTSPGLTDPALTSP; LTSPGLTDPALTSPG; TSPGLTDPALTSPGL; SPGLTDPALTSPGLT; PGLTDPALTSPGLTP; GLTDPALTSPGLTPT; LTDPALTSPGLTPTL; TDPALTSPGLTPTLP; DPALTSPGLTPTLPG; PALTSPGLTPTLPGS; ALTSPGLTPTLPGSL; LTSPGLTPTLPGSLA; TSPGLTPTLPGSLAA; SPGLTPTLPGSLAAP; PGLTPTLPGSLAAPG; GLTPTLPGSLAAPGT; LTPTLPGSLAAPGTT; TPTLPGSLAAPGTTL; PTLPGSLAAPGTTLA; TLPGSLAAPGTTLAP; LPGSLAAPGTTLAPT; PGSLAAPGTTLAPTP; GSLAAPGTTLAPTPG; SLAAPGTTLAPTPGV; LAAPGTTLAPTPGVG; AAPGTTLAPTPGVGA; APGTTLAPTPGVGAN; PGTTLAPTPGVGANP; GTTLAPTPGVGANPA; TTLAPTPGVGANPAL; TLAPTPGVGANPALT; LAPTPGVGANPALTN; APTPGVGANPALTNP; PTPGVGANPALTNPA; TPGVGANPALTNPAL; PGVGANPALTNPALT; GVGANPALTNPALTS; VGANPALTNPALTSP; GANPALTNPALTSPT; ANPALTNPALTSPTG; NPALTNPALTSPTGA; PALTNPALTSPTGAT; ALTNPALTSPTGATP; LTNPALTSPTGATPG; TNPALTSPTGATPGL; NPALTSPTGATPGLT; PALTSPTGATPGLTS; ALTSPTGATPGLTSP; LTSPTGATPGLTSPT; TSPTGATPGLTSPTG; SPTGATPGLTSPTGL; PTGATPGLTSPTGLD; TGATPGLTSPTGLDP; GATPGLTSPTGLDPA; ATPGLTSPTGLDPAL; TPGLTSPTGLDPALG; PGLTSPTGLDPALGG; GLTSPTGLDPALGGA; LTSPTGLDPALGGAN; TSPTGLDPALGGANE; SPTGLDPALGGANEI; PTGLDPALGGANEIP; TGLDPALGGANEIPI; GLDPALGGANEIPIT; LDPALGGANEIPITT; DPALGGANEIPITTP; PALGGANEIPITTPV; ALGGANEIPITTPVG; LGGANEIPITTPVGL; GGANEIPITTPVGLD; GANEIPITTPVGLDP; ANEIPITTPVGLDPG; NEIPITTPVGLDPGA; EIPITTPVGLDPGAD; IPITTPVGLDPGADG; PITTPVGLDPGADGT; ITTPVGLDPGADGTY; TTPVGLDPGADGTYP; TPVGLDPGADGTYPI; PVGLDPGADGTYPIL; VGLDPGADGTYPILG; GLDPGADGTYPILGD; LDPGADGTYPILGDP; DPGADGTYPILGDPT; PGADGTYPILGDPTL; GADGTYPILGDPTLG; ADGTYPILGDPTLGT; DGTYPILGDPTLGTI; GTYPILGDPTLGTIP; TYPILGDPTLGTIPS; YPILGDPTLGTIPSS; PILGDPTLGTIPSSP; ILGDPTLGTIPSSPA; LGDPTLGTIPSSPAT; GDPTLGTIPSSPATT; DPTLGTIPSSPATTS; PTLGTIPSSPATTST; TLGTIPSSPATTSTG; LGTIPSSPATTSTGG; GTIPSSPATTSTGGG; TIPSSPATTSTGGGG; IPSSPATTSTGGGGL; PSSPATTSTGGGGLV; SSPATTSTGGGGLVN; SPATTSTGGGGLVND; PATTSTGGGGLVNDV; ATTSTGGGGLVNDVM; TTSTGGGGLVNDVMQ; TSTGGGGLVNDVMQV; STGGGGLVNDVMQVA; TGGGGLVNDVMQVAN; GGGGLVNDVMQVANE; GGGLVNDVMQVANEL; GGLVNDVMQVANELG; GLVNDVMQVANELGA; LVNDVMQVANELGAS; VNDVMQVANELGASQ; NDVMQVANELGASQA; DVMQVANELGASQAI; VMQVANELGASQAID; MQVANELGASQAIDL; QVANELGASQAIDLL; VANELGASQAIDLLK; ANELGASQAIDLLKG; NELGASQAIDLLKGV; ELGASQAIDLLKGVL; LGASQAIDLLKGVLM; GASQAIDLLKGVLMP; ASQAIDLLKGVLMPS; | |

Fig. 29 continued

SQAIDLLKGVLMPSI; QAIDLLKGVLMPSIM; AIDLLKGVLMPSIMQ; IDLLKGVLMPSIMQA; DLLKGVLMPSIMQAV; LLKGVLMPSIMQAVQ; LKGVLMPSIMQAVQN; KGVLMPSIMQAVQNG; GVLMPSIMQAVQNGG; VLMPSIMQAVQNGGA; LMPSIMQAVQNGGAA; MPSIMQAVQNGGAAA; PSIMQAVQNGGAAAP; SIMQAVQNGGAAAPA; IMQAVQNGGAAAPAA; MQAVQNGGAAAPAAS; QAVQNGGAAAPAASP; AVQNGGAAAPAASPP; VQNGGAAAPAASPPV; QNGGAAAPAASPPVP; NGGAAAPAASPPVPP; GGAAAPAASPPVPPI; GAAAPAASPPVPPIP; AAAPAASPPVPPIPA; AAPAASPPVPPIPAA; APAASPPVPPIPAAA; PAASPPVPPIPAAAA; AASPPVPPIPAAAAV; ASPPVPPIPAAAAVP; SPPVPPIPAAAAVPP; PPVPPIPAAAAVPPT; PVPPIPAAAAVPPTD; VPPIPAAAAVPPTDP; PPIPAAAAVPPTDPI; PIPAAAAVPPTDPIT; IPAAAAVPPTDPITV; PAAAAVPPTDPITVP; AAAAVPPTDPITVPV; AAAVPPTDPITVPVA 16 mers:
MPNRRRRKLSTAMSAV; PNRRRRKLSTAMSAVA; NRRRRKLSTAMSAVAA; RRRRKLSTAMSAVAAL; RRRKLSTAMSAVAALA; RRKLSTAMSAVAALAV; RKLSTAMSAVAALAVA; KLSTAMSAVAALAVAS; LSTAMSAVAALAVASP; STAMSAVAALAVASPC; TAMSAVAALAVASPCA; AMSAVAALAVASPCAY; MSAVAALAVASPCAYF; SAVAALAVASPCAYFL; AVAALAVASPCAYFLV; VAALAVASPCAYFLVY; AALAVASPCAYFLVYE; ALAVASPCAYFLVYES; LAVASPCAYFLVYEST; AVASPCAYFLVYESTE; VASPCAYFLVYESTET; ASPCAYFLVYESTETT; SPCAYFLVYESTETTE; PCAYFLVYESTETTER; CAYFLVYESTETTERP; AYFLVYESTETTERPE; YFLVYESTETTERPEH; FLVYESTETTERPEHH; LVYESTETTERPEHHE; VYESTETTERPEHHEF; YESTETTERPEHHEFK; ESTETTERPEHHEFKQ; STETTERPEHHEFKQA; TETTERPEHHEFKQAA; ETTERPEHHEFKQAAV; TTERPEHHEFKQAAVL; TERPEHHEFKQAAVLT; ERPEHHEFKQAAVLTD; RPEHHEFKQAAVLTDL; PEHHEFKQAAVLTDLP; EHHEFKQAAVLTDLPG; HHEFKQAAVLTDLPGE; HEFKQAAVLTDLPGEL; EFKQAAVLTDLPGELM; FKQAAVLTDLPGELMS; KQAAVLTDLPGELMSA; QAAVLTDLPGELMSAL; AAVLTDLPGELMSALS; AVLTDLPGELMSALSQ; VLTDLPGELMSALSQG; LTDLPGELMSALSQGL; TDLPGELMSALSQGLS; DLPGELMSALSQGLSQ; LPGELMSALSQGLSQF; PGELMSALSQGLSQFG; GELMSALSQGLSQFGI; ELMSALSQGLSQFGIN; LMSALSQGLSQFGINI; MSALSQGLSQFGINIP; SALSQGLSQFGINIPP; ALSQGLSQFGINIPPV; LSQGLSQFGINIPPVP; SQGLSQFGINIPPVPS; QGLSQFGINIPPVPSL; GLSQFGINIPPVPSLT; LSQFGINIPPVPSLTG; SQFGINIPPVPSLTGS; QFGINIPPVPSLTGSG; FGINIPPVPSLTGSGD; GINIPPVPSLTGSGDA; INIPPVPSLTGSGDAS; NIPPVPSLTGSGDAST; IPPVPSLTGSGDASTG; PPVPSLTGSGDASTGL; PVPSLTGSGDASTGLT; VPSLTGSGDASTGLTG; PSLTGSGDASTGLTGP; SLTGSGDASTGLTGPG; LTGSGDASTGLTGPGL; TGSGDASTGLTGPGLT; GSGDASTGLTGPGLTS; SGDASTGLTGPGLTSP; GDASTGLTGPGLTSPG; DASTGLTGPGLTSPGL; ASTGLTGPGLTSPGLT; STGLTGPGLTSPGLTS; TGLTGPGLTSPGLTSP; GLTGPGLTSPGLTSPG; LTGPGLTSPGLTSPGL; TGPGLTSPGLTSPGLT; GPGLTSPGLTSPGLTS; PGLTSPGLTSPGLTSP; GLTSPGLTSPGLTSPG; LTSPGLTSPGLTSPGL; TSPGLTSPGLTSPGLT; SPGLTSPGLTSPGLTD; PGLTSPGLTSPGLTDP; GLTSPGLTSPGLTDPA; LTSPGLTSPGLTDPAL; TSPGLTSPGLTDPALT; SPGLTSPGLTDPALTS; PGLTSPGLTDPALTSP; GLTSPGLTDPALTSPG; LTSPGLTDPALTSPGL; TSPGLTDPALTSPGLT; SPGLTDPALTSPGLTP; PGLTDPALTSPGLTPT; GLTDPALTSPGLTPTL; LTDPALTSPGLTPTLP; TDPALTSPGLTPTLPG; DPALTSPGLTPTLPGS; PALTSPGLTPTLPGSL; ALTSPGLTPTLPGSLA; LTSPGLTPTLPGSLAA;

Fig. 29 continued

| | | |
|---|---|---|
| | TSPGLTPTLPGSLAAP; SPGLTPTLPGSLAAPG; PGLTPTLPGSLAAPGT; GLTPTLPGSLAAPGTT; LTPTLPGSLAAPGTTL; TPTLPGSLAAPGTTLA; PTLPGSLAAPGTTLAP; TLPGSLAAPGTTLAPT; LPGSLAAPGTTLAPTP; PGSLAAPGTTLAPTPG; GSLAAPGTTLAPTPGV; SLAAPGTTLAPTPGVG; LAAPGTTLAPTPGVGA; AAPGTTLAPTPGVGAN; APGTTLAPTPGVGANP; PGTTLAPTPGVGANPA; GTTLAPTPGVGANPAL; TTLAPTPGVGANPALT; TLAPTPGVGANPALTN; LAPTPGVGANPALTNP; APTPGVGANPALTNPA; PTPGVGANPALTNPAL; TPGVGANPALTNPALT; PGVGANPALTNPALTS; GVGANPALTNPALTSP; VGANPALTNPALTSPT; GANPALTNPALTSPTG; ANPALTNPALTSPTGA; NPALTNPALTSPTGAT; PALTNPALTSPTGATP; ALTNPALTSPTGATPG; LTNPALTSPTGATPGL; TNPALTSPTGATPGLT; NPALTSPTGATPGLTS; PALTSPTGATPGLTSP; ALTSPTGATPGLTSPT; LTSPTGATPGLTSPTG; TSPTGATPGLTSPTGL; SPTGATPGLTSPTGLD; PTGATPGLTSPTGLDP; TGATPGLTSPTGLDPA; GATPGLTSPTGLDPAL; ATPGLTSPTGLDPALG; TPGLTSPTGLDPALGG; PGLTSPTGLDPALGGA; GLTSPTGLDPALGGAN; LTSPTGLDPALGGANE; TSPTGLDPALGGANEI; SPTGLDPALGGANEIP; PTGLDPALGGANEIPI; TGLDPALGGANEIPIT; GLDPALGGANEIPITT; LDPALGGANEIPITTP; DPALGGANEIPITTPV; PALGGANEIPITTPVG; ALGGANEIPITTPVGL; LGGANEIPITTPVGLD; GGANEIPITTPVGLDP; GANEIPITTPVGLDPG; ANEIPITTPVGLDPGA; NEIPITTPVGLDPGAD; EIPITTPVGLDPGADG; IPITTPVGLDPGADGT; PITTPVGLDPGADGTY; ITTPVGLDPGADGTYP; TTPVGLDPGADGTYPI; TPVGLDPGADGTYPIL; PVGLDPGADGTYPILG; VGLDPGADGTYPILGD; GLDPGADGTYPILGDP; LDPGADGTYPILGDPT; DPGADGTYPILGDPTL; PGADGTYPILGDPTLG; GADGTYPILGDPTLGT; ADGTYPILGDPTLGTI; DGTYPILGDPTLGTIP; GTYPILGDPTLGTIPS; TYPILGDPTLGTIPSS; YPILGDPTLGTIPSSP; PILGDPTLGTIPSSPA; ILGDPTLGTIPSSPAT; LGDPTLGTIPSSPATT; GDPTLGTIPSSPATTS; DPTLGTIPSSPATTST; PTLGTIPSSPATTSTG; TLGTIPSSPATTSTGG; LGTIPSSPATTSTGGG; GTIPSSPATTSTGGGG; TIPSSPATTSTGGGGL; IPSSPATTSTGGGGLV; PSSPATTSTGGGGLVN; SSPATTSTGGGGLVND; SPATTSTGGGGLVNDV; PATTSTGGGGLVNDVM; ATTSTGGGGLVNDVMQ; TTSTGGGGLVNDVMQV; TSTGGGGLVNDVMQVA; STGGGGLVNDVMQVAN; TGGGGLVNDVMQVANE; GGGGLVNDVMQVANEL; GGGLVNDVMQVANELG; GGLVNDVMQVANELGA; GLVNDVMQVANELGAS; LVNDVMQVANELGASQ; VNDVMQVANELGASQA; NDVMQVANELGASQAI; DVMQVANELGASQAID; VMQVANELGASQAIDL; MQVANELGASQAIDLL; QVANELGASQAIDLLK; VANELGASQAIDLLKG; ANELGASQAIDLLKGV; NELGASQAIDLLKGVL; ELGASQAIDLLKGVLM; LGASQAIDLLKGVLMP; GASQAIDLLKGVLMPS; ASQAIDLLKGVLMPSI; SQAIDLLKGVLMPSIM; QAIDLLKGVLMPSIMQ; AIDLLKGVLMPSIMQA; IDLLKGVLMPSIMQAV; DLLKGVLMPSIMQAVQ; LLKGVLMPSIMQAVQN; LKGVLMPSIMQAVQNG; KGVLMPSIMQAVQNGG; GVLMPSIMQAVQNGGA; VLMPSIMQAVQNGGAA; LMPSIMQAVQNGGAAA; MPSIMQAVQNGGAAAP; PSIMQAVQNGGAAAPA; SIMQAVQNGGAAAPAA; IMQAVQNGGAAAPAAS; MQAVQNGGAAAPAASP; QAVQNGGAAAPAASPP; AVQNGGAAAPAASPPV; VQNGGAAAPAASPPVP; QNGGAAAPAASPPVPP; NGGAAAPAASPPVPPI; GGAAAPAASPPVPPIP; GAAAPAASPPVPPIPA; AAAPAASPPVPPIPAA; AAPAASPPVPPIPAAA; APAASPPVPPIPAAAA; PAASPPVPPIPAAAAV; AASPPVPPIPAAAAVP; ASPPVPPIPAAAAVPP; SPPVPPIPAAAAVPPT; PPVPPIPAAAAVPPTD; PVPPIPAAAAVPPTDP; VPPIPAAAAVPPTDPI; PPIPAAAAVPPTDPIT; PIPAAAAVPPTDPITV; IPAAAAVPPTDPITVP; PAAAAVPPTDPITVPV; AAAAVPPTDPITVPVA | |
| 71) | 13 mers: | 107452- |

Fig. 29 continued

| | | |
|---|---|---|
| Rv3873 | MLWHAMPPELNTA; LWHAMPPELNTAR; WHAMPPELNTARL; HAMPPELNTARLM; AMPPELNTARLMA; MPPELNTARLMAG; PPELNTARLMAGA; PELNTARLMAGAG; ELNTARLMAGAGP; LNTARLMAGAGPA; NTARLMAGAGPAP; TARLMAGAGPAPM; ARLMAGAGPAPML; RLMAGAGPAPMLA; LMAGAGPAPMLAA; MAGAGPAPMLAAA; AGAGPAPMLAAAA; GAGPAPMLAAAAG; AGPAPMLAAAAGW; GPAPMLAAAAGWQ; PAPMLAAAAGWQT; APMLAAAAGWQTL; PMLAAAAGWQTLS; MLAAAAGWQTLSA; LAAAAGWQTLSAA; AAAAGWQTLSAAL; AAAGWQTLSAALD; AAGWQTLSAALDA; AGWQTLSAALDAQ; GWQTLSAALDAQA; WQTLSAALDAQAV; QTLSAALDAQAVE; TLSAALDAQAVEL; LSAALDAQAVELT; SAALDAQAVELTA; AALDAQAVELTAR; ALDAQAVELTARL; LDAQAVELTARLN; DAQAVELTARLNS; AQAVELTARLNSL; QAVELTARLNSLG; AVELTARLNSLGE; VELTARLNSLGEA; ELTARLNSLGEAW; LTARLNSLGEAWT; TARLNSLGEAWTG; ARLNSLGEAWTGG; RLNSLGEAWTGGG; LNSLGEAWTGGGS; NSLGEAWTGGGSD; SLGEAWTGGGSDK; LGEAWTGGGSDKA; GEAWTGGGSDKAL; EAWTGGGSDKALA; AWTGGGSDKALAA; WTGGGSDKALAAA; TGGGSDKALAAAT; GGGSDKALAAATP; GGSDKALAAATPM; GSDKALAAATPMV; SDKALAAATPMVV; DKALAAATPMVVW; KALAAATPMVVWL; ALAAATPMVVWLQ; LAAATPMVVWLQT; AAATPMVVWLQTA; AATPMVVWLQTAS; ATPMVVWLQTAST; TPMVVWLQTASTQ; PMVVWLQTASTQA; MVVWLQTASTQAK; VVWLQTASTQAKT; VWLQTASTQAKTR; WLQTASTQAKTRA; LQTASTQAKTRAM; QTASTQAKTRAMQ; TASTQAKTRAMQA; ASTQAKTRAMQAT; STQAKTRAMQATA; TQAKTRAMQATAQ; QAKTRAMQATAQA; AKTRAMQATAQAA; KTRAMQATAQAAA; TRAMQATAQAAAY; RAMQATAQAAAYT; AMQATAQAAAYTQ; MQATAQAAAYTQA; QATAQAAAYTQAM; ATAQAAAYTQAMA; TAQAAAYTQAMAT; AQAAAYTQAMATT; QAAAYTQAMATTP; AAAYTQAMATTPS; AAYTQAMATTPSL; AYTQAMATTPSLP; YTQAMATTPSLPE; TQAMATTPSLPEI; QAMATTPSLPEIA; AMATTPSLPEIAA; MATTPSLPEIAAN; ATTPSLPEIAANH; TTPSLPEIAANHI; TPSLPEIAANHIT; PSLPEIAANHITQ; SLPEIAANHITQA; LPEIAANHITQAV; PEIAANHITQAVL; EIAANHITQAVLT; IAANHITQAVLTA; AANHITQAVLTAT; ANHITQAVLTATN; NHITQAVLTATNF; HITQAVLTATNFF; ITQAVLTATNFFG; TQAVLTATNFFGI; QAVLTATNFFGIN; AVLTATNFFGINT; VLTATNFFGINTI; LTATNFFGINTIP; TATNFFGINTIPI; ATNFFGINTIPIA; TNFFGINTIPIAL; NFFGINTIPIALT; FFGINTIPIALTE; FGINTIPIALTEM; GINTIPIALTEMD; INTIPIALTEMDY; NTIPIALTEMDYF; TIPIALTEMDYFI; IPIALTEMDYFIR; PIALTEMDYFIRM; IALTEMDYFIRMW; ALTEMDYFIRMWN; LTEMDYFIRMWNQ; TEMDYFIRMWNQA; EMDYFIRMWNQAA; MDYFIRMWNQAAL; DYFIRMWNQAALA; YFIRMWNQAALAM; FIRMWNQAALAME; IRMWNQAALAMEV; RMWNQAALAMEVY; MWNQAALAMEVYQ; WNQAALAMEVYQA; NQAALAMEVYQAE; QAALAMEVYQAET; AALAMEVYQAETA; ALAMEVYQAETAV; LAMEVYQAETAVN; AMEVYQAETAVNT; MEVYQAETAVNTL; EVYQAETAVNTLF; VYQAETAVNTLFE; YQAETAVNTLFEK; QAETAVNTLFEKL; AETAVNTLFEKLE; ETAVNTLFEKLEP; TAVNTLFEKLEPM; AVNTLFEKLEPMA; VNTLFEKLEPMAS; NTLFEKLEPMASI; TLFEKLEPMASIL; LFEKLEPMASILD; FEKLEPMASILDP; EKLEPMASILDPG; KLEPMASILDPGA; LEPMASILDPGAS; EPMASILDPGASQ; PMASILDPGASQS; MASILDPGASQST; ASILDPGASQSTT; SILDPGASQSTTN; ILDPGASQSTTNP; LDPGASQSTTNPI; DPGASQSTTNPIF; PGASQSTTNPIFG; GASQSTTNPIFGM; ASQSTTNPIFGMP; SQSTTNPIFGMPS; QSTTNPIFGMPSP; STTNPIFGMPSPG; TTNPIFGMPSPGS; TNPIFGMPSPGSS; | 108869 |

Fig. 29 continued

| | | |
|---|---|---|
| | NPIFGMPSPGSST; PIFGMPSPGSSTP; IFGMPSPGSSTPV; FGMPSPGSSTPVG; GMPSPGSSTPVGQ; MPSPGSSTPVGQL; PSPGSSTPVGQLP; SPGSSTPVGQLPP; PGSSTPVGQLPPA; GSSTPVGQLPPAA; SSTPVGQLPPAAT; STPVGQLPPAATQ; TPVGQLPPAATQT; PVGQLPPAATQTL; VGQLPPAATQTLG; GQLPPAATQTLGQ; QLPPAATQTLGQL; LPPAATQTLGQLG; PPAATQTLGQLGE; PAATQTLGQLGEM; AATQTLGQLGEMS; ATQTLGQLGEMSG; TQTLGQLGEMSGP; QTLGQLGEMSGPM; TLGQLGEMSGPMQ; LGQLGEMSGPMQQ; GQLGEMSGPMQQL; QLGEMSGPMQQLT; LGEMSGPMQQLTQ; GEMSGPMQQLTQP; EMSGPMQQLTQPL; MSGPMQQLTQPLQ; SGPMQQLTQPLQQ; GPMQQLTQPLQQV; PMQQLTQPLQQVT; MQQLTQPLQQVTS; QQLTQPLQQVTSL; QLTQPLQQVTSLF; LTQPLQQVTSLFS; TQPLQQVTSLFSQ; QPLQQVTSLFSQV; PLQQVTSLFSQVG; LQQVTSLFSQVGG; QQVTSLFSQVGGT; QVTSLFSQVGGTG; VTSLFSQVGGTGG; TSLFSQVGGTGGG; SLFSQVGGTGGGN; LFSQVGGTGGGNP; FSQVGGTGGGNPA; SQVGGTGGGNPAD; QVGGTGGGNPADE; VGGTGGGNPADEE; GGTGGGNPADEEA; GTGGGNPADEEAA; TGGGNPADEEAAQ; GGGNPADEEAAQM; GGNPADEEAAQMG; GNPADEEAAQMGL; NPADEEAAQMGLL; PADEEAAQMGLLG; ADEEAAQMGLLGT; DEEAAQMGLLGTS; EEAAQMGLLGTSP; EAAQMGLLGTSPL; AAQMGLLGTSPLS; AQMGLLGTSPLSN; QMGLLGTSPLSNH; MGLLGTSPLSNHP; GLLGTSPLSNHPL; LLGTSPLSNHPLA; LGTSPLSNHPLAG; GTSPLSNHPLAGG; TSPLSNHPLAGGS; SPLSNHPLAGGSG; PLSNHPLAGGSGP; LSNHPLAGGSGPS; SNHPLAGGSGPSA; NHPLAGGSGPSAG; HPLAGGSGPSAGA; PLAGGSGPSAGAG; LAGGSGPSAGAGL; AGGSGPSAGAGLL; GGSGPSAGAGLLR; GSGPSAGAGLLRA; SGPSAGAGLLRAE; GPSAGAGLLRAES; PSAGAGLLRAESL; SAGAGLLRAESLP; AGAGLLRAESLPG; GAGLLRAESLPGA; AGLLRAESLPGAG; GLLRAESLPGAGG; LLRAESLPGAGGS; LRAESLPGAGGSL; RAESLPGAGGSLT; AESLPGAGGSLTR; ESLPGAGGSLTRT; SLPGAGGSLTRTP; LPGAGGSLTRTPL; PGAGGSLTRTPLM; GAGGSLTRTPLMS; AGGSLTRTPLMSQ; GGSLTRTPLMSQL; GSLTRTPLMSQLI; SLTRTPLMSQLIE; LTRTPLMSQLIEK; TRTPLMSQLIEKP; RTPLMSQLIEKPV; TPLMSQLIEKPVA; PLMSQLIEKPVAP; LMSQLIEKPVAPS; MSQLIEKPVAPSV; SQLIEKPVAPSVM; QLIEKPVAPSVMP; LIEKPVAPSVMPA; IEKPVAPSVMPAA; EKPVAPSVMPAAA; KPVAPSVMPAAAA; PVAPSVMPAAAAG; VAPSVMPAAAAGS; APSVMPAAAAGSS; PSVMPAAAAGSSA; SVMPAAAAGSSAT; VMPAAAAGSSATG; MPAAAAGSSATGG; PAAAAGSSATGGA; AAAAGSSATGGAA; AAAGSSATGGAAP; AAGSSATGGAAPV; AGSSATGGAAPVG; GSSATGGAAPVGA; SSATGGAAPVGAG; SATGGAAPVGAGA; ATGGAAPVGAGAM; TGGAAPVGAGAMG; GGAAPVGAGAMGQ; GAAPVGAGAMGQG; AAPVGAGAMGQGA; APVGAGAMGQGAQ; PVGAGAMGQGAQS; VGAGAMGQGAQSG; GAGAMGQGAQSGG; AGAMGQGAQSGGS; GAMGQGAQSGGST; AMGQGAQSGGSTR; MGQGAQSGGSTRP; GQGAQSGGSTRPG; QGAQSGGSTRPGL; GAQSGGSTRPGLV; AQSGGSTRPGLVA; QSGGSTRPGLVAP; SGGSTRPGLVAPA; GGSTRPGLVAPAP; GSTRPGLVAPAPL; STRPGLVAPAPLA; TRPGLVAPAPLAQ; RPGLVAPAPLAQE; PGLVAPAPLAQER; GLVAPAPLAQERE; LVAPAPLAQEREE; VAPAPLAQEREED; APAPLAQEREEDD; PAPLAQEREEDDE; APLAQEREEDDED; PLAQEREEDDEDD; LAQEREEDDEDDW; AQEREEDDEDDWD; QEREEDDEDDWDE; EREEDDEDDWDEE; REEDDEDDWDEED; EEDDEDDWDEEDD; EDDEDDWDEEDDW; | |

Fig. 29 continued

| | | |
|---|---|---|
| | 14 mers:<br>MLWHAMPPELNTAR; LWHAMPPELNTARL; WHAMPPELNTARLM;<br>HAMPPELNTARLMA; AMPPELNTARLMAG; MPPELNTARLMAGA;<br>PPELNTARLMAGAG; PELNTARLMAGAGP; ELNTARLMAGAGPA;<br>LNTARLMAGAGPAP; NTARLMAGAGPAPM; TARLMAGAGPAPML;<br>ARLMAGAGPAPMLA; RLMAGAGPAPMLAA; LMAGAGPAPMLAAA;<br>MAGAGPAPMLAAAA; AGAGPAPMLAAAAG; GAGPAPMLAAAAGW;<br>AGPAPMLAAAAGWQ; GPAPMLAAAAGWQT; PAPMLAAAAGWQTL;<br>APMLAAAAGWQTLS; PMLAAAAGWQTLSA; MLAAAAGWQTLSAA;<br>LAAAAGWQTLSAAL; AAAAGWQTLSAALD; AAAGWQTLSAALDA;<br>AAGWQTLSAALDAQ; AGWQTLSAALDAQA; GWQTLSAALDAQAV;<br>WQTLSAALDAQAVE; QTLSAALDAQAVEL; TLSAALDAQAVELT;<br>LSAALDAQAVELTA; SAALDAQAVELTAR; AALDAQAVELTARL;<br>ALDAQAVELTARLN; LDAQAVELTARLNS; DAQAVELTARLNSL;<br>AQAVELTARLNSLG; QAVELTARLNSLGE; AVELTARLNSLGEA;<br>VELTARLNSLGEAW; ELTARLNSLGEAWT; LTARLNSLGEAWTG;<br>TARLNSLGEAWTGG; ARLNSLGEAWTGGG; RLNSLGEAWTGGGS;<br>LNSLGEAWTGGGSD; NSLGEAWTGGGSDK; SLGEAWTGGGSDKA;<br>LGEAWTGGGSDKAL; GEAWTGGGSDKALA; EAWTGGGSDKALAA;<br>AWTGGGSDKALAAA; WTGGGSDKALAAAT; TGGGSDKALAAATP;<br>GGGSDKALAAATPM; GGSDKALAAATPMV; GSDKALAAATPMVV;<br>SDKALAAATPMVVW; DKALAAATPMVVWL; KALAAATPMVVWLQ;<br>ALAAATPMVVWLQT; LAAATPMVVWLQTA; AAATPMVVWLQTAS;<br>AATPMVVWLQTAST; ATPMVVWLQTASTQ; TPMVVWLQTASTQA;<br>PMVVWLQTASTQAK; MVVWLQTASTQAKT; VVWLQTASTQAKTR;<br>VWLQTASTQAKTRA; WLQTASTQAKTRAM; LQTASTQAKTRAMQ;<br>QTASTQAKTRAMQA; TASTQAKTRAMQAT; ASTQAKTRAMQATA;<br>STQAKTRAMQATAQ; TQAKTRAMQATAQA; QAKTRAMQATAQAA;<br>AKTRAMQATAQAAA; KTRAMQATAQAAAY; TRAMQATAQAAAYT;<br>RAMQATAQAAAYTQ; AMQATAQAAAYTQA; MQATAQAAAYTQAM;<br>QATAQAAAYTQAMA; ATAQAAAYTQAMAT; TAQAAAYTQAMATT;<br>AQAAAYTQAMATTP; QAAAYTQAMATTPS; AAAYTQAMATTPSL;<br>AAYTQAMATTPSLP; AYTQAMATTPSLPE; YTQAMATTPSLPEI;<br>TQAMATTPSLPEIA; QAMATTPSLPEIAA; AMATTPSLPEIAAN;<br>MATTPSLPEIAANH; ATTPSLPEIAANHI; TTPSLPEIAANHIT; TPSLPEIAANHITQ;<br>PSLPEIAANHITQA; SLPEIAANHITQAV; LPEIAANHITQAVL; PEIAANHITQAVLT;<br>EIAANHITQAVLTA; IAANHITQAVLTAT; AANHITQAVLTATN; ANHITQAVLTATNF;<br>NHITQAVLTATNFF; HITQAVLTATNFFG; ITQAVLTATNFFGI; TQAVLTATNFFGIN;<br>QAVLTATNFFGINT; AVLTATNFFGINTI; VLTATNFFGINTIP; LTATNFFGINTIPI;<br>TATNFFGINTIPIA; ATNFFGINTIPIAL; TNFFGINTIPIALT; NFFGINTIPIALTE;<br>FFGINTIPIALTEM; FGINTIPIALTEMD; GINTIPIALTEMDY; INTIPIALTEMDYF;<br>NTIPIALTEMDYFI; TIPIALTEMDYFIR; IPIALTEMDYFIRM; PIALTEMDYFIRMW;<br>IALTEMDYFIRMWN; ALTEMDYFIRMWNQ; LTEMDYFIRMWNQA;<br>TEMDYFIRMWNQAA; EMDYFIRMWNQAAL; MDYFIRMWNQAALA;<br>DYFIRMWNQAALAM; YFIRMWNQAALAME; FIRMWNQAALAMEV;<br>IRMWNQAALAMEVY; RMWNQAALAMEVYQ; MWNQAALAMEVYQA;<br>WNQAALAMEVYQAE; NQAALAMEVYQAET; QAALAMEVYQAETA;<br>AALAMEVYQAETAV; ALAMEVYQAETAVN; LAMEVYQAETAVNT;<br>AMEVYQAETAVNTL; MEVYQAETAVNTLF; EVYQAETAVNTLFE;<br>VYQAETAVNTLFEK; YQAETAVNTLFEKL; QAETAVNTLFEKLE;<br>AETAVNTLFEKLEP; ETAVNTLFEKLEPM; TAVNTLFEKLEPMA;<br>AVNTLFEKLEPMAS; VNTLFEKLEPMASI; NTLFEKLEPMASIL;<br>TLFEKLEPMASILD; LFEKLEPMASILDP; FEKLEPMASILDPG; | |

Fig. 29 continued

| | | |
|---|---|---|
| | EKLEPMASILDPGA; KLEPMASILDPGAS; LEPMASILDPGASQ; EPMASILDPGASQS; PMASILDPGASQST; MASILDPGASQSTT; ASILDPGASQSTTN; SILDPGASQSTTNP; ILDPGASQSTTNPI; LDPGASQSTTNPIF; DPGASQSTTNPIFG; PGASQSTTNPIFGM; GASQSTTNPIFGMP; ASQSTTNPIFGMPS; SQSTTNPIFGMPSP; QSTTNPIFGMPSPG; STTNPIFGMPSPGS; TTNPIFGMPSPGSS; TNPIFGMPSPGSST; NPIFGMPSPGSSTP; PIFGMPSPGSSTPV; IFGMPSPGSSTPVG; FGMPSPGSSTPVGQ; GMPSPGSSTPVGQL; MPSPGSSTPVGQLP; PSPGSSTPVGQLPP; SPGSSTPVGQLPPA; PGSSTPVGQLPPAA; GSSTPVGQLPPAAT; SSTPVGQLPPAATQ; STPVGQLPPAATQT; TPVGQLPPAATQTL; PVGQLPPAATQTLG; VGQLPPAATQTLGQ; GQLPPAATQTLGQL; QLPPAATQTLGQLG; LPPAATQTLGQLGE; PPAATQTLGQLGEM; PAATQTLGQLGEMS; AATQTLGQLGEMSG; ATQTLGQLGEMSGP; TQTLGQLGEMSGPM; QTLGQLGEMSGPMQ; TLGQLGEMSGPMQQ; LGQLGEMSGPMQQL; GQLGEMSGPMQQLT; QLGEMSGPMQQLTQ; LGEMSGPMQQLTQP; GEMSGPMQQLTQPL; EMSGPMQQLTQPLQ; MSGPMQQLTQPLQQ; SGPMQQLTQPLQQV; GPMQQLTQPLQQVT; PMQQLTQPLQQVTS; MQQLTQPLQQVTSL; QQLTQPLQQVTSLF; QLTQPLQQVTSLFS; LTQPLQQVTSLFSQ; TQPLQQVTSLFSQV; QPLQQVTSLFSQVG; PLQQVTSLFSQVGG; LQQVTSLFSQVGGT; QQVTSLFSQVGGTG; QVTSLFSQVGGTGG; VTSLFSQVGGTGGG; TSLFSQVGGTGGGN; SLFSQVGGTGGGNP; LFSQVGGTGGGNPA; FSQVGGTGGGNPAD; SQVGGTGGGNPADE; QVGGTGGGNPADEE; VGGTGGGNPADEEA; GGTGGGNPADEEAA; GTGGGNPADEEAAQ; TGGGNPADEEAAQM; GGGNPADEEAAQMG; GGNPADEEAAQMGL; GNPADEEAAQMGLL; NPADEEAAQMGLLG; PADEEAAQMGLLGT; ADEEAAQMGLLGTS; DEEAAQMGLLGTSP; EEAAQMGLLGTSPL; EAAQMGLLGTSPLS; AAQMGLLGTSPLSN; AQMGLLGTSPLSNH; QMGLLGTSPLSNHP; MGLLGTSPLSNHPL; GLLGTSPLSNHPLA; LLGTSPLSNHPLAG; LGTSPLSNHPLAGG; GTSPLSNHPLAGGS; TSPLSNHPLAGGSG; SPLSNHPLAGGSGP; PLSNHPLAGGSGPS; LSNHPLAGGSGPSA; SNHPLAGGSGPSAG; NHPLAGGSGPSAGA; HPLAGGSGPSAGAG; PLAGGSGPSAGAGL; LAGGSGPSAGAGLL; AGGSGPSAGAGLLR; GGSGPSAGAGLLRA; GSGPSAGAGLLRAE; SGPSAGAGLLRAES; GPSAGAGLLRAESL; PSAGAGLLRAESLP; SAGAGLLRAESLPG; AGAGLLRAESLPGA; GAGLLRAESLPGAG; AGLLRAESLPGAGG; GLLRAESLPGAGGS; LLRAESLPGAGGSL; LRAESLPGAGGSLT; RAESLPGAGGSLTR; AESLPGAGGSLTRT; ESLPGAGGSLTRTP; SLPGAGGSLTRTPL; LPGAGGSLTRTPLM; PGAGGSLTRTPLMS; GAGGSLTRTPLMSQ; AGGSLTRTPLMSQL; GGSLTRTPLMSQLI; GSLTRTPLMSQLIE; SLTRTPLMSQLIEK; LTRTPLMSQLIEKP; TRTPLMSQLIEKPV; RTPLMSQLIEKPVA; TPLMSQLIEKPVAP; PLMSQLIEKPVAPS; LMSQLIEKPVAPSV; MSQLIEKPVAPSVM; SQLIEKPVAPSVMP; QLIEKPVAPSVMPA; LIEKPVAPSVMPAA; IEKPVAPSVMPAAA; EKPVAPSVMPAAAA; KPVAPSVMPAAAAG; PVAPSVMPAAAAGS; VAPSVMPAAAAGSS; APSVMPAAAAGSSA; PSVMPAAAAGSSAT; SVMPAAAAGSSATG; VMPAAAAGSSATGG; MPAAAAGSSATGGA; PAAAAGSSATGGAA; AAAAGSSATGGAAP; AAAGSSATGGAAPV; AAGSSATGGAAPVG; AGSSATGGAAPVGA; GSSATGGAAPVGAG; SSATGGAAPVGAGA; SATGGAAPVGAGAM; ATGGAAPVGAGAMG; TGGAAPVGAGAMGQ; GGAAPVGAGAMGQG; GAAPVGAGAMGQGA; AAPVGAGAMGQGAQ; APVGAGAMGQGAQS; | |

Fig. 29 continued

| | | |
|---|---|---|
| | PVGAGAMGQGAQSG; VGAGAMGQGAQSGG; GAGAMGQGAQSGGS; AGAMGQGAQSGGST; GAMGQGAQSGGSTR; AMGQGAQSGGSTRP; MGQGAQSGGSTRPG; GQGAQSGGSTRPGL; QGAQSGGSTRPGLV; GAQSGGSTRPGLVA; AQSGGSTRPGLVAP; QSGGSTRPGLVAPA; SGGSTRPGLVAPAP; GGSTRPGLVAPAPL; GSTRPGLVAPAPLA; STRPGLVAPAPLAQ; TRPGLVAPAPLAQE; RPGLVAPAPLAQER; PGLVAPAPLAQERE; GLVAPAPLAQEREE; LVAPAPLAQEREED; VAPAPLAQEREEDD; APAPLAQEREEDDE; PAPLAQEREEDDED; APLAQEREEDDEDD; PLAQEREEDDEDDW; LAQEREEDDEDDWD; AQEREEDDEDDWDE; QEREEDDEDDWDEE; EREEDDEDDWDEED; REEDDEDDWDEEDD; EEDDEDDWDEEDDW;<br><br>15 mers:<br>MLWHAMPPELNTARL; LWHAMPPELNTARLM; WHAMPPELNTARLMA; HAMPPELNTARLMAG; AMPPELNTARLMAGA; MPPELNTARLMAGAG; PPELNTARLMAGAGP; PELNTARLMAGAGPA; ELNTARLMAGAGPAP; LNTARLMAGAGPAPM; NTARLMAGAGPAPML; TARLMAGAGPAPMLA; ARLMAGAGPAPMLAA; RLMAGAGPAPMLAAA; LMAGAGPAPMLAAAA; MAGAGPAPMLAAAAG; AGAGPAPMLAAAAGW; GAGPAPMLAAAAGWQ; AGPAPMLAAAAGWQT; GPAPMLAAAAGWQTL; PAPMLAAAAGWQTLS; APMLAAAAGWQTLSA; PMLAAAAGWQTLSAA; MLAAAAGWQTLSAAL; LAAAAGWQTLSAALD; AAAAGWQTLSAALDA; AAAGWQTLSAALDAQ; AAGWQTLSAALDAQA; AGWQTLSAALDAQAV; GWQTLSAALDAQAVE; WQTLSAALDAQAVEL; QTLSAALDAQAVELT; TLSAALDAQAVELTA; LSAALDAQAVELTAR; SAALDAQAVELTARL; AALDAQAVELTARLN; ALDAQAVELTARLNS; LDAQAVELTARLNSL; DAQAVELTARLNSLG; AQAVELTARLNSLGE; QAVELTARLNSLGEA; AVELTARLNSLGEAW; VELTARLNSLGEAWT; ELTARLNSLGEAWTG; LTARLNSLGEAWTGG; TARLNSLGEAWTGGG; ARLNSLGEAWTGGGS; RLNSLGEAWTGGGSD; LNSLGEAWTGGGSDK; NSLGEAWTGGGSDKA; SLGEAWTGGGSDKAL; LGEAWTGGGSDKALA; GEAWTGGGSDKALAA; EAWTGGGSDKALAAA; AWTGGGSDKALAAAT; WTGGGSDKALAAATP; TGGGSDKALAAATPM; GGGSDKALAAATPMV; GGSDKALAAATPMVV; GSDKALAAATPMVVW; SDKALAAATPMVVWL; DKALAAATPMVVWLQ; KALAAATPMVVWLQT; ALAAATPMVVWLQTA; LAAATPMVVWLQTAS; AAATPMVVWLQTAST; AATPMVVWLQTASTQ; ATPMVVWLQTASTQA; TPMVVWLQTASTQAK; PMVVWLQTASTQAKT; MVVWLQTASTQAKTR; VVWLQTASTQAKTRA; VWLQTASTQAKTRAM; WLQTASTQAKTRAMQ; LQTASTQAKTRAMQA; QTASTQAKTRAMQAT; TASTQAKTRAMQATA; ASTQAKTRAMQATAQ; STQAKTRAMQATAQA; TQAKTRAMQATAQAA; QAKTRAMQATAQAAA; AKTRAMQATAQAAAY; KTRAMQATAQAAAYT; TRAMQATAQAAAYTQ; RAMQATAQAAAYTQA; AMQATAQAAAYTQAM; MQATAQAAAYTQAMA; QATAQAAAYTQAMAT; ATAQAAAYTQAMATT; TAQAAAYTQAMATTP; AQAAAYTQAMATTPS; QAAAYTQAMATTPSL; AAAYTQAMATTPSLP; AAYTQAMATTPSLPE; AYTQAMATTPSLPEI; YTQAMATTPSLPEIA; TQAMATTPSLPEIAA; QAMATTPSLPEIAAN; AMATTPSLPEIAANH; MATTPSLPEIAANHI; ATTPSLPEIAANHIT; TTPSLPEIAANHITQ; TPSLPEIAANHITQA; PSLPEIAANHITQAV; SLPEIAANHITQAVL; LPEIAANHITQAVLT; PEIAANHITQAVLTA; EIAANHITQAVLTAT; IAANHITQAVLTATN; AANHITQAVLTATNF; ANHITQAVLTATNFF; NHITQAVLTATNFFG; HITQAVLTATNFFGI; ITQAVLTATNFFGIN; TQAVLTATNFFGINT; QAVLTATNFFGINTI; AVLTATNFFGINTIP; VLTATNFFGINTIPI; LTATNFFGINTIPIA; TATNFFGINTIPIAL; ATNFFGINTIPIALT; | |

Fig. 29 continued

| | | |
|---|---|---|
| | TNFFGINTIPIALTE; NFFGINTIPIALTEM; FFGINTIPIALTEMD; FGINTIPIALTEMDY;<br>GINTIPIALTEMDYF; INTIPIALTEMDYFI; NTIPIALTEMDYFIR; TIPIALTEMDYFIRM;<br>IPIALTEMDYFIRMW; PIALTEMDYFIRMWN; IALTEMDYFIRMWNQ;<br>ALTEMDYFIRMWNQA; LTEMDYFIRMWNQAA; TEMDYFIRMWNQAAL;<br>EMDYFIRMWNQAALA; MDYFIRMWNQAALAM; DYFIRMWNQAALAME;<br>YFIRMWNQAALAMEV; FIRMWNQAALAMEVY; IRMWNQAALAMEVYQ;<br>RMWNQAALAMEVYQA; MWNQAALAMEVYQAE; WNQAALAMEVYQAET;<br>NQAALAMEVYQAETA; QAALAMEVYQAETAV; AALAMEVYQAETAVN;<br>ALAMEVYQAETAVNT; LAMEVYQAETAVNTL; AMEVYQAETAVNTLF;<br>MEVYQAETAVNTLFE; EVYQAETAVNTLFEK; VYQAETAVNTLFEKL;<br>YQAETAVNTLFEKLE; QAETAVNTLFEKLEP; AETAVNTLFEKLEPM;<br>ETAVNTLFEKLEPMA; TAVNTLFEKLEPMAS; AVNTLFEKLEPMASI;<br>VNTLFEKLEPMASIL; NTLFEKLEPMASILD; TLFEKLEPMASILDP;<br>LFEKLEPMASILDPG; FEKLEPMASILDPGA; EKLEPMASILDPGAS;<br>KLEPMASILDPGASQ; LEPMASILDPGASQS; EPMASILDPGASQST;<br>PMASILDPGASQSTT; MASILDPGASQSTTN; ASILDPGASQSTTNP;<br>SILDPGASQSTTNPI; ILDPGASQSTTNPIF; LDPGASQSTTNPIFG;<br>DPGASQSTTNPIFGM; PGASQSTTNPIFGMP; GASQSTTNPIFGMPS;<br>ASQSTTNPIFGMPSP; SQSTTNPIFGMPSPG; QSTTNPIFGMPSPGS;<br>STTNPIFGMPSPGSS; TTNPIFGMPSPGSST; TNPIFGMPSPGSSTP;<br>NPIFGMPSPGSSTPV; PIFGMPSPGSSTPVG; IFGMPSPGSSTPVGQ;<br>FGMPSPGSSTPVGQL; GMPSPGSSTPVGQLP; MPSPGSSTPVGQLPP;<br>PSPGSSTPVGQLPPA; SPGSSTPVGQLPPAA; PGSSTPVGQLPPAAT;<br>GSSTPVGQLPPAATQ; SSTPVGQLPPAATQT; STPVGQLPPAATQTL;<br>TPVGQLPPAATQTLG; PVGQLPPAATQTLGQ; VGQLPPAATQTLGQL;<br>GQLPPAATQTLGQLG; QLPPAATQTLGQLGE; LPPAATQTLGQLGEM;<br>PPAATQTLGQLGEMS; PAATQTLGQLGEMSG; AATQTLGQLGEMSGP;<br>ATQTLGQLGEMSGPM; TQTLGQLGEMSGPMQ; QTLGQLGEMSGPMQQ;<br>TLGQLGEMSGPMQQL; LGQLGEMSGPMQQLT; GQLGEMSGPMQQLTQ;<br>QLGEMSGPMQQLTQP; LGEMSGPMQQLTQPL; GEMSGPMQQLTQPLQ;<br>EMSGPMQQLTQPLQQ; MSGPMQQLTQPLQQV; SGPMQQLTQPLQQVT;<br>GPMQQLTQPLQQVTS; PMQQLTQPLQQVTSL; MQQLTQPLQQVTSLF;<br>QQLTQPLQQVTSLFS; QLTQPLQQVTSLFSQ; LTQPLQQVTSLFSQV;<br>TQPLQQVTSLFSQVG; QPLQQVTSLFSQVGG; PLQQVTSLFSQVGGT;<br>LQQVTSLFSQVGGTG; QQVTSLFSQVGGTGG; QVTSLFSQVGGTGGG;<br>VTSLFSQVGGTGGGN; TSLFSQVGGTGGGNP; SLFSQVGGTGGGNPA;<br>LFSQVGGTGGGNPAD; FSQVGGTGGGNPADE; SQVGGTGGGNPADEE;<br>QVGGTGGGNPADEEA; VGGTGGGNPADEEAA; GGTGGGNPADEEAAQ;<br>GTGGGNPADEEAAQM; TGGGNPADEEAAQMG; GGGNPADEEAAQMGL;<br>GGNPADEEAAQMGLL; GNPADEEAAQMGLLG; NPADEEAAQMGLLGT;<br>PADEEAAQMGLLGTS; ADEEAAQMGLLGTSP; DEEAAQMGLLGTSPL;<br>EEAAQMGLLGTSPLS; EAAQMGLLGTSPLSN; AAQMGLLGTSPLSNH;<br>AQMGLLGTSPLSNHP; QMGLLGTSPLSNHPL; MGLLGTSPLSNHPLA;<br>GLLGTSPLSNHPLAG; LLGTSPLSNHPLAGG; LGTSPLSNHPLAGGS;<br>GTSPLSNHPLAGGSG; TSPLSNHPLAGGSGP; SPLSNHPLAGGSGPS;<br>PLSNHPLAGGSGPSA; LSNHPLAGGSGPSAG; SNHPLAGGSGPSAGA;<br>NHPLAGGSGPSAGAG; HPLAGGSGPSAGAGL; PLAGGSGPSAGAGLL;<br>LAGGSGPSAGAGLLR; AGGSGPSAGAGLLRA; GGSGPSAGAGLLRAE;<br>GSGPSAGAGLLRAES; SGPSAGAGLLRAESL; GPSAGAGLLRAESLP;<br>PSAGAGLLRAESLPG; SAGAGLLRAESLPGA; AGAGLLRAESLPGAG;<br>GAGLLRAESLPGAGG; AGLLRAESLPGAGGS; GLLRAESLPGAGGSL;<br>LLRAESLPGAGGSLT; LRAESLPGAGGSLTR; RAESLPGAGGSLTRT;<br>AESLPGAGGSLTRTP; ESLPGAGGSLTRTPL; SLPGAGGSLTRTPLM; | |

Fig. 29 continued

| | | |
|---|---|---|
| | LPGAGGSLTRTPLMS; PGAGGSLTRTPLMSQ; GAGGSLTRTPLMSQL; AGGSLTRTPLMSQLI; GGSLTRTPLMSQLIE; GSLTRTPLMSQLIEK; SLTRTPLMSQLIEKP; LTRTPLMSQLIEKPV; TRTPLMSQLIEKPVA; RTPLMSQLIEKPVAP; TPLMSQLIEKPVAPS; PLMSQLIEKPVAPSV; LMSQLIEKPVAPSVM; MSQLIEKPVAPSVMP; SQLIEKPVAPSVMPA; QLIEKPVAPSVMPAA; LIEKPVAPSVMPAAA; IEKPVAPSVMPAAAA; EKPVAPSVMPAAAAG; KPVAPSVMPAAAAGS; PVAPSVMPAAAAGSS; VAPSVMPAAAAGSSA; APSVMPAAAAGSSAT; PSVMPAAAAGSSATG; SVMPAAAAGSSATGG; VMPAAAAGSSATGGA; MPAAAAGSSATGGAA; PAAAAGSSATGGAAP; AAAAGSSATGGAAPV; AAAGSSATGGAAPVG; AAGSSATGGAAPVGA; AGSSATGGAAPVGAG; GSSATGGAAPVGAGA; SSATGGAAPVGAGAM; SATGGAAPVGAGAMG; ATGGAAPVGAGAMGQ; TGGAAPVGAGAMGQG; GGAAPVGAGAMGQGA; GAAPVGAGAMGQGAQ; AAPVGAGAMGQGAQS; APVGAGAMGQGAQSG; PVGAGAMGQGAQSGG; VGAGAMGQGAQSGGS; GAGAMGQGAQSGGST; AGAMGQGAQSGGSTR; GAMGQGAQSGGSTRP; AMGQGAQSGGSTRPG; MGQGAQSGGSTRPGL; GQGAQSGGSTRPGLV; QGAQSGGSTRPGLVA; GAQSGGSTRPGLVAP; AQSGGSTRPGLVAPA; QSGGSTRPGLVAPAP; SGGSTRPGLVAPAPL; GGSTRPGLVAPAPLA; GSTRPGLVAPAPLAQ; STRPGLVAPAPLAQE; TRPGLVAPAPLAQER; RPGLVAPAPLAQERE; PGLVAPAPLAQEREE; GLVAPAPLAQEREED; LVAPAPLAQEREEDD; VAPAPLAQEREEDDE; APAPLAQEREEDDED; PAPLAQEREEDDEDD; APLAQEREEDDEDDW; PLAQEREEDDEDDWD; LAQEREEDDEDDWDE; AQEREEDDEDDWDEE; QEREEDDEDDWDEED; EREEDDEDDWDEEDD; REEDDEDDWDEEDDW;<br><br>16 mers:<br>MLWHAMPPELNTARLM; LWHAMPPELNTARLMA; WHAMPPELNTARLMAG; HAMPPELNTARLMAGA; AMPPELNTARLMAGAG; MPPELNTARLMAGAGP; PPELNTARLMAGAGPA; PELNTARLMAGAGPAP; ELNTARLMAGAGPAPM; LNTARLMAGAGPAPML; NTARLMAGAGPAPMLA; TARLMAGAGPAPMLAA; ARLMAGAGPAPMLAAA; RLMAGAGPAPMLAAAA; LMAGAGPAPMLAAAAG; MAGAGPAPMLAAAAGW; AGAGPAPMLAAAAGWQ; GAGPAPMLAAAAGWQT; AGPAPMLAAAAGWQTL; GPAPMLAAAAGWQTLS; PAPMLAAAAGWQTLSA; APMLAAAAGWQTLSAA; PMLAAAAGWQTLSAAL; MLAAAAGWQTLSAALD; LAAAAGWQTLSAALDA; AAAAGWQTLSAALDAQ; AAAGWQTLSAALDAQA; AAGWQTLSAALDAQAV; AGWQTLSAALDAQAVE; GWQTLSAALDAQAVEL; WQTLSAALDAQAVELT; QTLSAALDAQAVELTA; TLSAALDAQAVELTAR; LSAALDAQAVELTARL; SAALDAQAVELTARLN; AALDAQAVELTARLNS; ALDAQAVELTARLNSL; LDAQAVELTARLNSLG; DAQAVELTARLNSLGE; AQAVELTARLNSLGEA; QAVELTARLNSLGEAW; AVELTARLNSLGEAWT; VELTARLNSLGEAWTG; ELTARLNSLGEAWTGG; LTARLNSLGEAWTGGG; TARLNSLGEAWTGGGS; ARLNSLGEAWTGGGSD; RLNSLGEAWTGGGSDK; LNSLGEAWTGGGSDKA; NSLGEAWTGGGSDKAL; SLGEAWTGGGSDKALA; LGEAWTGGGSDKALAA; GEAWTGGGSDKALAAA; EAWTGGGSDKALAAAT; AWTGGGSDKALAAATP; WTGGGSDKALAAATPM; TGGGSDKALAAATPMV; GGGSDKALAAATPMVV; GGSDKALAAATPMVVW; GSDKALAAATPMVVWL; SDKALAAATPMVVWLQ; DKALAAATPMVVWLQT; KALAAATPMVVWLQTA; ALAAATPMVVWLQTAS; LAAATPMVVWLQTAST; AAATPMVVWLQTASTQ; AATPMVVWLQTASTQA; ATPMVVWLQTASTQAK; TPMVVWLQTASTQAKT; PMVVWLQTASTQAKTR; MVVWLQTASTQAKTRA; VVWLQTASTQAKTRAM; VWLQTASTQAKTRAMQ; WLQTASTQAKTRAMQA; LQTASTQAKTRAMQAT; QTASTQAKTRAMQATA; TASTQAKTRAMQATAQ; ASTQAKTRAMQATAQA; STQAKTRAMQATAQAA; TQAKTRAMQATAQAAA; QAKTRAMQATAQAAAY; | |

Fig. 29 continued

| | | |
|---|---|---|
| | AKTRAMQATAQAAAYT; KTRAMQATAQAAAYTQ; TRAMQATAQAAAYTQA;<br>RAMQATAQAAAYTQAM; AMQATAQAAAYTQAMA; MQATAQAAAYTQAMAT;<br>QATAQAAAYTQAMATT; ATAQAAAYTQAMATTP; TAQAAAYTQAMATTPS;<br>AQAAAYTQAMATTPSL; QAAAYTQAMATTPSLP; AAAYTQAMATTPSLPE;<br>AAYTQAMATTPSLPEI; AYTQAMATTPSLPEIA; YTQAMATTPSLPEIAA;<br>TQAMATTPSLPEIAAN; QAMATTPSLPEIAANH; AMATTPSLPEIAANHI;<br>MATTPSLPEIAANHIT; ATTPSLPEIAANHITQ; TTPSLPEIAANHITQA;<br>TPSLPEIAANHITQAV; PSLPEIAANHITQAVL; SLPEIAANHITQAVLT;<br>LPEIAANHITQAVLTA; PEIAANHITQAVLTAT; EIAANHITQAVLTATN;<br>IAANHITQAVLTATNF; AANHITQAVLTATNFF; ANHITQAVLTATNFFG;<br>NHITQAVLTATNFFGI; HITQAVLTATNFFGIN; ITQAVLTATNFFGINT;<br>TQAVLTATNFFGINTI; QAVLTATNFFGINTIP; AVLTATNFFGINTIPI;<br>VLTATNFFGINTIPIA; LTATNFFGINTIPIAL; TATNFFGINTIPIALT;<br>ATNFFGINTIPIALTE; TNFFGINTIPIALTEM; NFFGINTIPIALTEMD;<br>FFGINTIPIALTEMDY; FGINTIPIALTEMDYF; GINTIPIALTEMDYFI;<br>INTIPIALTEMDYFIR; NTIPIALTEMDYFIRM; TIPIALTEMDYFIRMW;<br>IPIALTEMDYFIRMWN; PIALTEMDYFIRMWNQ; IALTEMDYFIRMWNQA;<br>ALTEMDYFIRMWNQAA; LTEMDYFIRMWNQAAL; TEMDYFIRMWNQAALA;<br>EMDYFIRMWNQAALAM; MDYFIRMWNQAALAME; DYFIRMWNQAALAMEV;<br>YFIRMWNQAALAMEVY; FIRMWNQAALAMEVYQ; IRMWNQAALAMEVYQA;<br>RMWNQAALAMEVYQAE; MWNQAALAMEVYQAET; WNQAALAMEVYQAETA;<br>NQAALAMEVYQAETAV; QAALAMEVYQAETAVN; AALAMEVYQAETAVNT;<br>ALAMEVYQAETAVNTL; LAMEVYQAETAVNTLF; AMEVYQAETAVNTLFE;<br>MEVYQAETAVNTLFEK; EVYQAETAVNTLFEKL; VYQAETAVNTLFEKLE;<br>YQAETAVNTLFEKLEP; QAETAVNTLFEKLEPM; AETAVNTLFEKLEPMA;<br>ETAVNTLFEKLEPMAS; TAVNTLFEKLEPMASI; AVNTLFEKLEPMASIL;<br>VNTLFEKLEPMASILD; NTLFEKLEPMASILDP; TLFEKLEPMASILDPG;<br>LFEKLEPMASILDPGA; FEKLEPMASILDPGAS; EKLEPMASILDPGASQ;<br>KLEPMASILDPGASQS; LEPMASILDPGASQST; EPMASILDPGASQSTT;<br>PMASILDPGASQSTTN; MASILDPGASQSTTNP; ASILDPGASQSTTNPI;<br>SILDPGASQSTTNPIF; ILDPGASQSTTNPIFG; LDPGASQSTTNPIFGM;<br>DPGASQSTTNPIFGMP; PGASQSTTNPIFGMPS; GASQSTTNPIFGMPSP;<br>ASQSTTNPIFGMPSPG; SQSTTNPIFGMPSPGS; QSTTNPIFGMPSPGSS;<br>STTNPIFGMPSPGSST; TTNPIFGMPSPGSSTP; TNPIFGMPSPGSSTPV;<br>NPIFGMPSPGSSTPVG; PIFGMPSPGSSTPVGQ; IFGMPSPGSSTPVGQL;<br>FGMPSPGSSTPVGQLP; GMPSPGSSTPVGQLPP; MPSPGSSTPVGQLPPA;<br>PSPGSSTPVGQLPPAA; SPGSSTPVGQLPPAAT; PGSSTPVGQLPPAATQ;<br>GSSTPVGQLPPAATQT; SSTPVGQLPPAATQTL; STPVGQLPPAATQTLG;<br>TPVGQLPPAATQTLGQ; PVGQLPPAATQTLGQL; VGQLPPAATQTLGQLG;<br>GQLPPAATQTLGQLGE; QLPPAATQTLGQLGEM; LPPAATQTLGQLGEMS;<br>PPAATQTLGQLGEMSG; PAATQTLGQLGEMSGP; AATQTLGQLGEMSGPM;<br>ATQTLGQLGEMSGPMQ; TQTLGQLGEMSGPMQQ; QTLGQLGEMSGPMQQL;<br>TLGQLGEMSGPMQQLT; LGQLGEMSGPMQQLTQ; GQLGEMSGPMQQLTQP;<br>QLGEMSGPMQQLTQPL; LGEMSGPMQQLTQPLQ; GEMSGPMQQLTQPLQQ;<br>EMSGPMQQLTQPLQQV; MSGPMQQLTQPLQQVT; SGPMQQLTQPLQQVTS;<br>GPMQQLTQPLQQVTSL; PMQQLTQPLQQVTSLF; MQQLTQPLQQVTSLFS;<br>QQLTQPLQQVTSLFSQ; QLTQPLQQVTSLFSQV; LTQPLQQVTSLFSQVG;<br>TQPLQQVTSLFSQVGG; QPLQQVTSLFSQVGGT; PLQQVTSLFSQVGGTG;<br>LQQVTSLFSQVGGTGG; QQVTSLFSQVGGTGGG; QVTSLFSQVGGTGGGN;<br>VTSLFSQVGGTGGGNP; TSLFSQVGGTGGGNPA; SLFSQVGGTGGGNPAD;<br>LFSQVGGTGGGNPADE; FSQVGGTGGGNPADEE; SQVGGTGGGNPADEEA;<br>QVGGTGGGNPADEEAA; VGGTGGGNPADEEAAQ; GGTGGGNPADEEAAQM;<br>GTGGGNPADEEAAQMG; TGGGNPADEEAAQMGL; GGGNPADEEAAQMGLL; | |

Fig. 29 continued

| | | |
|---|---|---|
| | GGNPADEEAAQMGLLG; GNPADEEAAQMGLLGT; NPADEEAAQMGLLGTS; PADEEAAQMGLLGTSP; ADEEAAQMGLLGTSPL; DEEAAQMGLLGTSPLS; EEAAQMGLLGTSPLSN; EAAQMGLLGTSPLSNH; AAQMGLLGTSPLSNHP; AQMGLLGTSPLSNHPL; QMGLLGTSPLSNHPLA; MGLLGTSPLSNHPLAG; GLLGTSPLSNHPLAGG; LLGTSPLSNHPLAGGS; LGTSPLSNHPLAGGSG; GTSPLSNHPLAGGSGP; TSPLSNHPLAGGSGPS; SPLSNHPLAGGSGPSA; PLSNHPLAGGSGPSAG; LSNHPLAGGSGPSAGA; SNHPLAGGSGPSAGAG; NHPLAGGSGPSAGAGL; HPLAGGSGPSAGAGLL; PLAGGSGPSAGAGLLR; LAGGSGPSAGAGLLRA; AGGSGPSAGAGLLRAE; GGSGPSAGAGLLRAES; GSGPSAGAGLLRAESL; SGPSAGAGLLRAESLP; GPSAGAGLLRAESLPG; PSAGAGLLRAESLPGA; SAGAGLLRAESLPGAG; AGAGLLRAESLPGAGG; GAGLLRAESLPGAGGS; AGLLRAESLPGAGGSL; GLLRAESLPGAGGSLT; LLRAESLPGAGGSLTR; LRAESLPGAGGSLTRT; RAESLPGAGGSLTRTP; AESLPGAGGSLTRTPL; ESLPGAGGSLTRTPLM; SLPGAGGSLTRTPLMS; LPGAGGSLTRTPLMSQ; PGAGGSLTRTPLMSQL; GAGGSLTRTPLMSQLI; AGGSLTRTPLMSQLIE; GGSLTRTPLMSQLIEK; GSLTRTPLMSQLIEKP; SLTRTPLMSQLIEKPV; LTRTPLMSQLIEKPVA; TRTPLMSQLIEKPVAP; RTPLMSQLIEKPVAPS; TPLMSQLIEKPVAPSV; PLMSQLIEKPVAPSVM; LMSQLIEKPVAPSVMP; MSQLIEKPVAPSVMPA; SQLIEKPVAPSVMPAA; QLIEKPVAPSVMPAAA; LIEKPVAPSVMPAAAA; IEKPVAPSVMPAAAAG; EKPVAPSVMPAAAAGS; KPVAPSVMPAAAAGSS; PVAPSVMPAAAAGSSA; VAPSVMPAAAAGSSAT; APSVMPAAAAGSSATG; PSVMPAAAAGSSATGG; SVMPAAAAGSSATGGA; VMPAAAAGSSATGGAA; MPAAAAGSSATGGAAP; PAAAAGSSATGGAAPV; AAAAGSSATGGAAPVG; AAAGSSATGGAAPVGA; AAGSSATGGAAPVGAG; AGSSATGGAAPVGAGA; GSSATGGAAPVGAGAM; SSATGGAAPVGAGAMG; SATGGAAPVGAGAMGQ; ATGGAAPVGAGAMGQG; TGGAAPVGAGAMGQGA; GGAAPVGAGAMGQGAQ; GAAPVGAGAMGQGAQS; AAPVGAGAMGQGAQSG; APVGAGAMGQGAQSGG; PVGAGAMGQGAQSGGS; VGAGAMGQGAQSGGST; GAGAMGQGAQSGGSTR; AGAMGQGAQSGGSTRP; GAMGQGAQSGGSTRPG; AMGQGAQSGGSTRPGL; MGQGAQSGGSTRPGLV; GQGAQSGGSTRPGLVA; QGAQSGGSTRPGLVAP; GAQSGGSTRPGLVAPA; AQSGGSTRPGLVAPAP; QSGGSTRPGLVAPAPL; SGGSTRPGLVAPAPLA; GGSTRPGLVAPAPLAQ; GSTRPGLVAPAPLAQE; STRPGLVAPAPLAQER; TRPGLVAPAPLAQERE; RPGLVAPAPLAQEREE; PGLVAPAPLAQEREED; GLVAPAPLAQEREEDD; LVAPAPLAQEREEDDE; VAPAPLAQEREEDDED; APAPLAQEREEDDEDD; PAPLAQEREEDDEDDW; APLAQEREEDDEDDWD; PLAQEREEDDEDDWDE; LAQEREEDDEDDWDEE; AQEREEDDEDDWDEED; QEREEDDEDDWDEEDD; EREEDDEDDWDEEDDW | |
| 72) Rv3874/CFP10 | 13 mers: MAEMKTDAATLAQ; AEMKTDAATLAQE; EMKTDAATLAQEA; MKTDAATLAQEAG; KTDAATLAQEAGN; TDAATLAQEAGNF; DAATLAQEAGNFE; AATLAQEAGNFER; ATLAQEAGNFERI; TLAQEAGNFERIS; LAQEAGNFERISG; AQEAGNFERISGD; QEAGNFERISGDL; EAGNFERISGDLK; AGNFERISGDLKT; GNFERISGDLKTQ; NFERISGDLKTQI; FERISGDLKTQID; ERISGDLKTQIDQ; RISGDLKTQIDQV; ISGDLKTQIDQVE; SGDLKTQIDQVES; GDLKTQIDQVEST; DLKTQIDQVESTA; LKTQIDQVESTAG; KTQIDQVESTAGS; TQIDQVESTAGSL; QIDQVESTAGSLQ; IDQVESTAGSLQG; DQVESTAGSLQGQ; QVESTAGSLQGQW; VESTAGSLQGQWR; ESTAGSLQGQWRG; STAGSLQGQWRGA; TAGSLQGQWRGAA; AGSLQGQWRGAAG; GSLQGQWRGAAGT; SLQGQWRGAAGTA; LQGQWRGAAGTAA; QGQWRGAAGTAAQ; GQWRGAAGTAAQA; QWRGAAGTAAQAA; WRGAAGTAAQAAV; RGAAGTAAQAAVV; GAAGTAAQAAVVR; AAGTAAQAAVVRF; AGTAAQAAVVRFQ; GTAAQAAVVRFQE; TAAQAAVVRFQEA; | 108870-109215 |

Fig. 29 continued

| | | |
|---|---|---|
| | AAQAAVVRFQEAA; AQAAVVRFQEAAN; QAAVVRFQEAANK; AAVVRFQEAANKQ; AVVRFQEAANKQK; VVRFQEAANKQKQ; VRFQEAANKQKQE; RFQEAANKQKQEL; FQEAANKQKQELD; QEAANKQKQELDE; EAANKQKQELDEI; AANKQKQELDEIS; ANKQKQELDEIST; NKQKQELDEISTN; KQKQELDEISTNI; QKQELDEISTNIR; KQELDEISTNIRQ; QELDEISTNIRQA; ELDEISTNIRQAG; LDEISTNIRQAGV; DEISTNIRQAGVQ; EISTNIRQAGVQY; ISTNIRQAGVQYS; STNIRQAGVQYSR; TNIRQAGVQYSRA; NIRQAGVQYSRAD; IRQAGVQYSRADE; RQAGVQYSRADEE; QAGVQYSRADEEQ; AGVQYSRADEEQQ; GVQYSRADEEQQQ; VQYSRADEEQQQA; QYSRADEEQQQAL; YSRADEEQQQALS; SRADEEQQQALSS; RADEEQQQALSSQ; ADEEQQQALSSQM; DEEQQQALSSQMG; EEQQQALSSQMGF;<br><br>14 mers:<br>MAEMKTDAATLAQE; AEMKTDAATLAQEA; EMKTDAATLAQEAG; MKTDAATLAQEAGN; KTDAATLAQEAGNF; TDAATLAQEAGNFE; DAATLAQEAGNFER; AATLAQEAGNFERI; ATLAQEAGNFERIS; TLAQEAGNFERISG; LAQEAGNFERISGD; AQEAGNFERISGDL; QEAGNFERISGDLK; EAGNFERISGDLKT; AGNFERISGDLKTQ; GNFERISGDLKTQI; NFERISGDLKTQID; FERISGDLKTQIDQ; ERISGDLKTQIDQV; RISGDLKTQIDQVE; ISGDLKTQIDQVES; SGDLKTQIDQVEST; GDLKTQIDQVESTA; DLKTQIDQVESTAG; LKTQIDQVESTAGS; KTQIDQVESTAGSL; TQIDQVESTAGSLQ; QIDQVESTAGSLQG; IDQVESTAGSLQGQ; DQVESTAGSLQGQW; QVESTAGSLQGQWR; VESTAGSLQGQWRG; ESTAGSLQGQWRGA; STAGSLQGQWRGAA; TAGSLQGQWRGAAG; AGSLQGQWRGAAGT; GSLQGQWRGAAGTA; SLQGQWRGAAGTAA; LQGQWRGAAGTAAQ; QGQWRGAAGTAAQA; GQWRGAAGTAAQAA; QWRGAAGTAAQAAV; WRGAAGTAAQAAVV; RGAAGTAAQAAVVR; GAAGTAAQAAVVRF; AAGTAAQAAVVRFQ; AGTAAQAAVVRFQE; GTAAQAAVVRFQEA; TAAQAAVVRFQEAA; AAQAAVVRFQEAAN; AQAAVVRFQEAANK; QAAVVRFQEAANKQ; AAVVRFQEAANKQK; AVVRFQEAANKQKQ; VVRFQEAANKQKQE; VRFQEAANKQKQEL; RFQEAANKQKQELD; FQEAANKQKQELDE; QEAANKQKQELDEI; EAANKQKQELDEIS; AANKQKQELDEIST; ANKQKQELDEISTN; NKQKQELDEISTNI; KQKQELDEISTNIR; QKQELDEISTNIRQ; KQELDEISTNIRQA; QELDEISTNIRQAG; ELDEISTNIRQAGV; LDEISTNIRQAGVQ; DEISTNIRQAGVQY; EISTNIRQAGVQYS; ISTNIRQAGVQYSR; STNIRQAGVQYSRA; TNIRQAGVQYSRAD; NIRQAGVQYSRADE; IRQAGVQYSRADEE; RQAGVQYSRADEEQ; QAGVQYSRADEEQQ; AGVQYSRADEEQQQ; GVQYSRADEEQQQA; VQYSRADEEQQQAL; QYSRADEEQQQALS; YSRADEEQQQALSS; SRADEEQQQALSSQ; RADEEQQQALSSQM; ADEEQQQALSSQMG; DEEQQQALSSQMGF;<br><br>15 mers:<br>MAEMKTDAATLAQEA; AEMKTDAATLAQEAG; EMKTDAATLAQEAGN; MKTDAATLAQEAGNF; KTDAATLAQEAGNFE; TDAATLAQEAGNFER; DAATLAQEAGNFERI; AATLAQEAGNFERIS; ATLAQEAGNFERISG; TLAQEAGNFERISGD; LAQEAGNFERISGDL; AQEAGNFERISGDLK; QEAGNFERISGDLKT; EAGNFERISGDLKTQ; AGNFERISGDLKTQI; GNFERISGDLKTQID; NFERISGDLKTQIDQ; FERISGDLKTQIDQV; ERISGDLKTQIDQVE; RISGDLKTQIDQVES; ISGDLKTQIDQVEST; SGDLKTQIDQVESTA; GDLKTQIDQVESTAG; DLKTQIDQVESTAGS; | |

Fig. 29 continued

| | | |
|---|---|---|
| | LKTQIDQVESTAGSL; KTQIDQVESTAGSLQ; TQIDQVESTAGSLQG; QIDQVESTAGSLQGQ; IDQVESTAGSLQGQW; DQVESTAGSLQGQWR; QVESTAGSLQGQWRG; VESTAGSLQGQWRGA; ESTAGSLQGQWRGAA; STAGSLQGQWRGAAG; TAGSLQGQWRGAAGT; AGSLQGQWRGAAGTA; GSLQGQWRGAAGTAA; SLQGQWRGAAGTAAQ; LQGQWRGAAGTAAQA; QGQWRGAAGTAAQAA; GQWRGAAGTAAQAAV; QWRGAAGTAAQAAVV; WRGAAGTAAQAAVVR; RGAAGTAAQAAVVRF; GAAGTAAQAAVVRFQ; AAGTAAQAAVVRFQE; AGTAAQAAVVRFQEA; GTAAQAAVVRFQEAA; TAAQAAVVRFQEAAN; AAQAAVVRFQEAANK; AQAAVVRFQEAANKQ; QAAVVRFQEAANKQK; AAVVRFQEAANKQKQ; AVVRFQEAANKQKQE; VVRFQEAANKQKQEL; VRFQEAANKQKQELD; RFQEAANKQKQELDE; FQEAANKQKQELDEI; QEAANKQKQELDEIS; EAANKQKQELDEIST; AANKQKQELDEISTN; ANKQKQELDEISTNI; NKQKQELDEISTNIR; KQKQELDEISTNIRQ; QKQELDEISTNIRQA; KQELDEISTNIRQAG; QELDEISTNIRQAGV; ELDEISTNIRQAGVQ; LDEISTNIRQAGVQY; DEISTNIRQAGVQYS; EISTNIRQAGVQYSR; ISTNIRQAGVQYSRA; STNIRQAGVQYSRAD; TNIRQAGVQYSRADE; NIRQAGVQYSRADEE; IRQAGVQYSRADEEQ; RQAGVQYSRADEEQQ; QAGVQYSRADEEQQQ; AGVQYSRADEEQQQA; GVQYSRADEEQQQAL; VQYSRADEEQQQALS; QYSRADEEQQQALSS; YSRADEEQQQALSSQ; SRADEEQQQALSSQM; RADEEQQQALSSQMG; ADEEQQQALSSQMGF;<br><br>16 mers:<br>MAEMKTDAATLAQEAG; AEMKTDAATLAQEAGN; EMKTDAATLAQEAGNF; MKTDAATLAQEAGNFE; KTDAATLAQEAGNFER; TDAATLAQEAGNFERI; DAATLAQEAGNFERIS; AATLAQEAGNFERISG; ATLAQEAGNFERISGD; TLAQEAGNFERISGDL; LAQEAGNFERISGDLK; AQEAGNFERISGDLKT; QEAGNFERISGDLKTQ; EAGNFERISGDLKTQI; AGNFERISGDLKTQID; GNFERISGDLKTQIDQ; NFERISGDLKTQIDQV; FERISGDLKTQIDQVE; ERISGDLKTQIDQVES; RISGDLKTQIDQVEST; ISGDLKTQIDQVESTA; SGDLKTQIDQVESTAG; GDLKTQIDQVESTAGS; DLKTQIDQVESTAGSL; LKTQIDQVESTAGSLQ; KTQIDQVESTAGSLQG; TQIDQVESTAGSLQGQ; QIDQVESTAGSLQGQW; IDQVESTAGSLQGQWR; DQVESTAGSLQGQWRG; QVESTAGSLQGQWRGA; VESTAGSLQGQWRGAA; ESTAGSLQGQWRGAAG; STAGSLQGQWRGAAGT; TAGSLQGQWRGAAGTA; AGSLQGQWRGAAGTAA; GSLQGQWRGAAGTAAQ; SLQGQWRGAAGTAAQA; LQGQWRGAAGTAAQAA; QGQWRGAAGTAAQAAV; GQWRGAAGTAAQAAVV; QWRGAAGTAAQAAVVR; WRGAAGTAAQAAVVRF; RGAAGTAAQAAVVRFQ; GAAGTAAQAAVVRFQE; AAGTAAQAAVVRFQEA; AGTAAQAAVVRFQEAA; GTAAQAAVVRFQEAAN; TAAQAAVVRFQEAANK; AAQAAVVRFQEAANKQ; AQAAVVRFQEAANKQK; QAAVVRFQEAANKQKQ; AAVVRFQEAANKQKQE; AVVRFQEAANKQKQEL; VVRFQEAANKQKQELD; VRFQEAANKQKQELDE; RFQEAANKQKQELDEI; FQEAANKQKQELDEIS; QEAANKQKQELDEIST; EAANKQKQELDEISTN; AANKQKQELDEISTNI; ANKQKQELDEISTNIR; NKQKQELDEISTNIRQ; KQKQELDEISTNIRQA; QKQELDEISTNIRQAG; KQELDEISTNIRQAGV; QELDEISTNIRQAGVQ; ELDEISTNIRQAGVQY; LDEISTNIRQAGVQYS; DEISTNIRQAGVQYSR; EISTNIRQAGVQYSRA; ISTNIRQAGVQYSRAD; STNIRQAGVQYSRADE; TNIRQAGVQYSRADEE; NIRQAGVQYSRADEEQ; IRQAGVQYSRADEEQQ; RQAGVQYSRADEEQQQ; QAGVQYSRADEEQQQA; AGVQYSRADEEQQQAL; GVQYSRADEEQQQALS; VQYSRADEEQQQALSS; QYSRADEEQQQALSSQ; YSRADEEQQQALSSQM; SRADEEQQQALSSQMG; RADEEQQQALSSQMGF | |
| 73) | 13 mers: | 109216- |

Fig. 29 continued

| | | |
|---|---|---|
| Rv3875/E SAT-6 | MTEQQWNFAGIEA; TEQQWNFAGIEAA; EQQWNFAGIEAAA; QQWNFAGIEAAAS; QWNFAGIEAAASA; WNFAGIEAAASAI; NFAGIEAAASAIQ; FAGIEAAASAIQG; AGIEAAASAIQGN; GIEAAASAIQGNV; IEAAASAIQGNVT; EAAASAIQGNVTS; AAASAIQGNVTSI; AASAIQGNVTSIH; ASAIQGNVTSIHS; SAIQGNVTSIHSL; AIQGNVTSIHSLL; IQGNVTSIHSLLD; QGNVTSIHSLLDE; GNVTSIHSLLDEG; NVTSIHSLLDEGK; VTSIHSLLDEGKQ; TSIHSLLDEGKQS; SIHSLLDEGKQSL; IHSLLDEGKQSLT; HSLLDEGKQSLTK; SLLDEGKQSLTKL; LLDEGKQSLTKLA; LDEGKQSLTKLAA; DEGKQSLTKLAAA; EGKQSLTKLAAAW; GKQSLTKLAAAWG; KQSLTKLAAAWGG; QSLTKLAAAWGGS; SLTKLAAAWGGSG; LTKLAAAWGGSGS; TKLAAAWGGSGSE; KLAAAWGGSGSEA; LAAAWGGSGSEAY; AAAWGGSGSEAYQ; AAWGGSGSEAYQG; AWGGSGSEAYQGV; WGGSGSEAYQGVQ; GGSGSEAYQGVQQ; GSGSEAYQGVQQK; SGSEAYQGVQQKW; GSEAYQGVQQKWD; SEAYQGVQQKWDA; EAYQGVQQKWDAT; AYQGVQQKWDATA; YQGVQQKWDATAT; QGVQQKWDATATE; GVQQKWDATATEL; VQQKWDATATELN; QQKWDATATELNN; QKWDATATELNNA; KWDATATELNNAL; WDATATELNNALQ; DATATELNNALQN; ATATELNNALQNL; TATELNNALQNLA; ATELNNALQNLAR; TELNNALQNLART; ELNNALQNLARTI; LNNALQNLARTIS; NNALQNLARTISE; NALQNLARTISEA; ALQNLARTISEAG; LQNLARTISEAGQ; QNLARTISEAGQA; NLARTISEAGQAM; LARTISEAGQAMA; ARTISEAGQAMAS; RTISEAGQAMAST; TISEAGQAMASTE; ISEAGQAMASTEG; SEAGQAMASTEGN; EAGQAMASTEGNV; AGQAMASTEGNVT; GQAMASTEGNVTG; QAMASTEGNVTGM; AMASTEGNVTGMF; MASTEGNVTGMFA;<br><br>14 mers:<br>MTEQQWNFAGIEAA; TEQQWNFAGIEAAA; EQQWNFAGIEAAAS; QQWNFAGIEAAASA; QWNFAGIEAAASAI; WNFAGIEAAASAIQ; NFAGIEAAASAIQG; FAGIEAAASAIQGN; AGIEAAASAIQGNV; GIEAAASAIQGNVT; IEAAASAIQGNVTS; EAAASAIQGNVTSI; AAASAIQGNVTSIH; AASAIQGNVTSIHS; ASAIQGNVTSIHSL; SAIQGNVTSIHSLL; AIQGNVTSIHSLLD; IQGNVTSIHSLLDE; QGNVTSIHSLLDEG; GNVTSIHSLLDEGK; NVTSIHSLLDEGKQ; VTSIHSLLDEGKQS; TSIHSLLDEGKQSL; SIHSLLDEGKQSLT; IHSLLDEGKQSLTK; HSLLDEGKQSLTKL; SLLDEGKQSLTKLA; LLDEGKQSLTKLAA; LDEGKQSLTKLAAA; DEGKQSLTKLAAAW; EGKQSLTKLAAAWG; GKQSLTKLAAAWGG; KQSLTKLAAAWGGS; QSLTKLAAAWGGSG; SLTKLAAAWGGSGS; LTKLAAAWGGSGSE; TKLAAAWGGSGSEA; KLAAAWGGSGSEAY; LAAAWGGSGSEAYQ; AAAWGGSGSEAYQG; AAWGGSGSEAYQGV; AWGGSGSEAYQGVQ; WGGSGSEAYQGVQQ; GGSGSEAYQGVQQK; GSGSEAYQGVQQKW; SGSEAYQGVQQKWD; GSEAYQGVQQKWDA; SEAYQGVQQKWDAT; EAYQGVQQKWDATA; AYQGVQQKWDATAT; YQGVQQKWDATATE; QGVQQKWDATATEL; GVQQKWDATATELN; VQQKWDATATELNN; QQKWDATATELNNA; QKWDATATELNNAL; KWDATATELNNALQ; WDATATELNNALQN; DATATELNNALQNL; ATATELNNALQNLA; TATELNNALQNLAR; ATELNNALQNLART; TELNNALQNLARTI; ELNNALQNLARTIS; LNNALQNLARTISE; NNALQNLARTISEA; NALQNLARTISEAG; ALQNLARTISEAGQ; LQNLARTISEAGQA; QNLARTISEAGQAM; NLARTISEAGQAMA; LARTISEAGQAMAS; ARTISEAGQAMAST; RTISEAGQAMASTE; TISEAGQAMASTEG; ISEAGQAMASTEGN; SEAGQAMASTEGNV; EAGQAMASTEGNVT; AGQAMASTEGNVTG; GQAMASTEGNVTGM; QAMASTEGNVTGMF; AMASTEGNVTGMFA; | 109541 |

Fig. 29 continued 15 mers:
MTEQQWNFAGIEAAA; TEQQWNFAGIEAAAS; EQQWNFAGIEAAASA;
QQWNFAGIEAAASAI; QWNFAGIEAAASAIQ; WNFAGIEAAASAIQG;
NFAGIEAAASAIQGN; FAGIEAAASAIQGNV; AGIEAAASAIQGNVT;
GIEAAASAIQGNVTS; IEAAASAIQGNVTSI; EAAASAIQGNVTSIH;
AAASAIQGNVTSIHS; AASAIQGNVTSIHSL; ASAIQGNVTSIHSLL;
SAIQGNVTSIHSLLD; AIQGNVTSIHSLLDE; IQGNVTSIHSLLDEG;
QGNVTSIHSLLDEGK; GNVTSIHSLLDEGKQ; NVTSIHSLLDEGKQS;
VTSIHSLLDEGKQSL; TSIHSLLDEGKQSLT; SIHSLLDEGKQSLTK;
IHSLLDEGKQSLTKL; HSLLDEGKQSLTKLA; SLLDEGKQSLTKLAA;
LLDEGKQSLTKLAAA; LDEGKQSLTKLAAAW; DEGKQSLTKLAAAWG;
EGKQSLTKLAAAWGG; GKQSLTKLAAAWGGS; KQSLTKLAAAWGGSG;
QSLTKLAAAWGGSGS; SLTKLAAAWGGSGSE; LTKLAAAWGGSGSEA;
TKLAAAWGGSGSEAY; KLAAAWGGSGSEAYQ; LAAAWGGSGSEAYQG;
AAAWGGSGSEAYQGV; AAWGGSGSEAYQGVQ; AWGGSGSEAYQGVQQ;
WGGSGSEAYQGVQQK; GGSGSEAYQGVQQKW; GSGSEAYQGVQQKWD;
SGSEAYQGVQQKWDA; GSEAYQGVQQKWDAT; SEAYQGVQQKWDATA;
EAYQGVQQKWDATAT; AYQGVQQKWDATATE; YQGVQQKWDATATEL;
QGVQQKWDATATELN; GVQQKWDATATELNN; VQQKWDATATELNNA;
QQKWDATATELNNAL; QKWDATATELNNALQ; KWDATATELNNALQN;
WDATATELNNALQNL; DATATELNNALQNLA; ATATELNNALQNLAR;
TATELNNALQNLART; ATELNNALQNLARTI; TELNNALQNLARTIS;
ELNNALQNLARTISE; LNNALQNLARTISEA; NNALQNLARTISEAG;
NALQNLARTISEAGQ; ALQNLARTISEAGQA; LQNLARTISEAGQAM;
QNLARTISEAGQAMA; NLARTISEAGQAMAS; LARTISEAGQAMAST;
ARTISEAGQAMASTE; RTISEAGQAMASTEG; TISEAGQAMASTEGN;
ISEAGQAMASTEGNV; SEAGQAMASTEGNVT; EAGQAMASTEGNVTG;
AGQAMASTEGNVTGM; GQAMASTEGNVTGMF; QAMASTEGNVTGMFA;

16 mers:
MTEQQWNFAGIEAAAS; TEQQWNFAGIEAAASA; EQQWNFAGIEAAASAI;
QQWNFAGIEAAASAIQ; QWNFAGIEAAASAIQG; WNFAGIEAAASAIQGN;
NFAGIEAAASAIQGNV; FAGIEAAASAIQGNVT; AGIEAAASAIQGNVTS;
GIEAAASAIQGNVTSI; IEAAASAIQGNVTSIH; EAAASAIQGNVTSIHS;
AAASAIQGNVTSIHSL; AASAIQGNVTSIHSLL; ASAIQGNVTSIHSLLD;
SAIQGNVTSIHSLLDE; AIQGNVTSIHSLLDEG; IQGNVTSIHSLLDEGK;
QGNVTSIHSLLDEGKQ; GNVTSIHSLLDEGKQS; NVTSIHSLLDEGKQSL;
VTSIHSLLDEGKQSLT; TSIHSLLDEGKQSLTK; SIHSLLDEGKQSLTKL;
IHSLLDEGKQSLTKLA; HSLLDEGKQSLTKLAA; SLLDEGKQSLTKLAAA;
LLDEGKQSLTKLAAAW; LDEGKQSLTKLAAAWG; DEGKQSLTKLAAAWGG;
EGKQSLTKLAAAWGGS; GKQSLTKLAAAWGGSG; KQSLTKLAAAWGGSGS;
QSLTKLAAAWGGSGSE; SLTKLAAAWGGSGSEA; LTKLAAAWGGSGSEAY;
TKLAAAWGGSGSEAYQ; KLAAAWGGSGSEAYQG; LAAAWGGSGSEAYQGV;
AAAWGGSGSEAYQGVQ; AAWGGSGSEAYQGVQQ; AWGGSGSEAYQGVQQK;
WGGSGSEAYQGVQQKW; GGSGSEAYQGVQQKWD; GSGSEAYQGVQQKWDA;
SGSEAYQGVQQKWDAT; GSEAYQGVQQKWDATA; SEAYQGVQQKWDATAT;
EAYQGVQQKWDATATE; AYQGVQQKWDATATEL; YQGVQQKWDATATELN;
QGVQQKWDATATELNN; GVQQKWDATATELNNA; VQQKWDATATELNNAL;
QQKWDATATELNNALQ; QKWDATATELNNALQN; KWDATATELNNALQNL;
WDATATELNNALQNLA; DATATELNNALQNLAR; ATATELNNALQNLART;
TATELNNALQNLARTI; ATELNNALQNLARTIS; TELNNALQNLARTISE;
ELNNALQNLARTISEA; LNNALQNLARTISEAG; NNALQNLARTISEAGQ;

Fig. 29 continued

| | | |
|---|---|---|
| | NALQNLARTISEAGQA; ALQNLARTISEAGQAM; LQNLARTISEAGQAMA; QNLARTISEAGQAMAS; NLARTISEAGQAMAST; LARTISEAGQAMASTE; ARTISEAGQAMASTEG; RTISEAGQAMASTEGN; TISEAGQAMASTEGNV; ISEAGQAMASTEGNVT; SEAGQAMASTEGNVTG; EAGQAMASTEGNVTGM; AGQAMASTEGNVTGMF; GQAMASTEGNVTGMFA | |
| 74) Rv3878 | 13 mers: MAEPLAVDPTGLS; AEPLAVDPTGLSA; EPLAVDPTGLSAA; PLAVDPTGLSAAA; LAVDPTGLSAAAA; AVDPTGLSAAAAK; VDPTGLSAAAAKL; DPTGLSAAAAKLA; PTGLSAAAAKLAG; TGLSAAAAKLAGL; GLSAAAAKLAGLV; LSAAAAKLAGLVF; SAAAAKLAGLVFP; AAAAKLAGLVFPQ; AAAKLAGLVFPQP; AAKLAGLVFPQPP; AKLAGLVFPQPPA; KLAGLVFPQPPAP; LAGLVFPQPPAPI; AGLVFPQPPAPIA; GLVFPQPPAPIAV; LVFPQPPAPIAVS; VFPQPPAPIAVSG; FPQPPAPIAVSGT; PQPPAPIAVSGTD; QPPAPIAVSGTDS; PPAPIAVSGTDSV; PAPIAVSGTDSVV; APIAVSGTDSVVA; PIAVSGTDSVVAA; IAVSGTDSVVAAI; AVSGTDSVVAAIN; VSGTDSVVAAINE; SGTDSVVAAINET; GTDSVVAAINETM; TDSVVAAINETMP; DSVVAAINETMPS; SVVAAINETMPSI; VVAAINETMPSIE; VAAINETMPSIES; AAINETMPSIESL; AINETMPSIESLV; INETMPSIESLVS; NETMPSIESLVSD; ETMPSIESLVSDG; TMPSIESLVSDGL; MPSIESLVSDGLP; PSIESLVSDGLPG; SIESLVSDGLPGV; IESLVSDGLPGVK; ESLVSDGLPGVKA; SLVSDGLPGVKAA; LVSDGLPGVKAAL; VSDGLPGVKAALT; SDGLPGVKAALTR; DGLPGVKAALTRT; GLPGVKAALTRTA; LPGVKAALTRTAS; PGVKAALTRTASN; GVKAALTRTASNM; VKAALTRTASNMN; KAALTRTASNMNA; AALTRTASNMNAA; ALTRTASNMNAAA; LTRTASNMNAAAD; TRTASNMNAAADV; RTASNMNAAADVY; TASNMNAAADVYA; ASNMNAAADVYAK; SNMNAAADVYAKT; NMNAAADVYAKTD; MNAAADVYAKTDQ; NAAADVYAKTDQS; AAADVYAKTDQSL; AADVYAKTDQSLG; ADVYAKTDQSLGT; DVYAKTDQSLGTS; VYAKTDQSLGTSL; YAKTDQSLGTSLS; AKTDQSLGTSLSQ; KTDQSLGTSLSQY; TDQSLGTSLSQYA; DQSLGTSLSQYAF; QSLGTSLSQYAFG; SLGTSLSQYAFGS; LGTSLSQYAFGSS; GTSLSQYAFGSSG; TSLSQYAFGSSGE; SLSQYAFGSSGEG; LSQYAFGSSGEGL; SQYAFGSSGEGLA; QYAFGSSGEGLAG; YAFGSSGEGLAGV; AFGSSGEGLAGVA; FGSSGEGLAGVAS; GSSGEGLAGVASV; SSGEGLAGVASVG; SGEGLAGVASVGG; GEGLAGVASVGGQ; EGLAGVASVGGQP; GLAGVASVGGQPS; LAGVASVGGQPSQ; AGVASVGGQPSQA; GVASVGGQPSQAT; VASVGGQPSQATQ; ASVGGQPSQATQL; SVGGQPSQATQLL; VGGQPSQATQLLS; GGQPSQATQLLST; GQPSQATQLLSTP; QPSQATQLLSTPV; PSQATQLLSTPVS; SQATQLLSTPVSQ; QATQLLSTPVSQV; ATQLLSTPVSQVT; TQLLSTPVSQVTT; QLLSTPVSQVTTQ; LLSTPVSQVTTQL; LSTPVSQVTTQLG; STPVSQVTTQLGE; TPVSQVTTQLGET; PVSQVTTQLGETA; VSQVTTQLGETAA; SQVTTQLGETAAE; QVTTQLGETAAEL; VTTQLGETAAELA; TTQLGETAAELAP; TQLGETAAELAPR; QLGETAAELAPRV; LGETAAELAPRVV; GETAAELAPRVVA; ETAAELAPRVVAT; TAAELAPRVVATV; AAELAPRVVATVP; AELAPRVVATVPQ; ELAPRVVATVPQL; LAPRVVATVPQLV; APRVVATVPQLVQ; PRVVATVPQLVQL; RVVATVPQLVQLA; VVATVPQLVQLAP; VATVPQLVQLAPH; ATVPQLVQLAPHA; TVPQLVQLAPHAV; VPQLVQLAPHAVQ; PQLVQLAPHAVQM; QLVQLAPHAVQMS; LVQLAPHAVQMSQ; VQLAPHAVQMSQN; QLAPHAVQMSQNA; LAPHAVQMSQNAS; APHAVQMSQNASP; PHAVQMSQNASPI; HAVQMSQNASPIA; AVQMSQNASPIAQ; VQMSQNASPIAQT; QMSQNASPIAQTI; MSQNASPIAQTIS; SQNASPIAQTISQ; QNASPIAQTISQT; NASPIAQTISQTA; ASPIAQTISQTAQ; SPIAQTISQTAQQ; PIAQTISQTAQQA; IAQTISQTAQQAA; AQTISQTAQQAAQ; QTISQTAQQAAQS; TISQTAQQAAQSA; ISQTAQQAAQSAQ; SQTAQQAAQSAQG; QTAQQAAQSAQGG; TAQQAAQSAQGGS; AQQAAQSAQGGSG; QQAAQSAQGGSGP; | 109542-110607 |

Fig. 29 continued

QAAQSAQGGSGPM; AAQSAQGGSGPMP; AQSAQGGSGPMPA; QSAQGGSGPMPAQ; SAQGGSGPMPAQL; AQGGSGPMPAQLA; QGGSGPMPAQLAS; GGSGPMPAQLASA; GSGPMPAQLASAE; SGPMPAQLASAEK; GPMPAQLASAEKP; PMPAQLASAEKPA; MPAQLASAEKPAT; PAQLASAEKPATE; AQLASAEKPATEQ; QLASAEKPATEQA; LASAEKPATEQAE; ASAEKPATEQAEP; SAEKPATEQAEPV; AEKPATEQAEPVH; EKPATEQAEPVHE; KPATEQAEPVHEV; PATEQAEPVHEVT; ATEQAEPVHEVTN; TEQAEPVHEVTND; EQAEPVHEVTNDD; QAEPVHEVTNDDQ; AEPVHEVTNDDQG; EPVHEVTNDDQGD; PVHEVTNDDQGDQ; VHEVTNDDQGDQG; HEVTNDDQGDQGD; EVTNDDQGDQGDV; VTNDDQGDQGDVQ; TNDDQGDQGDVQP; NDDQGDQGDVQPA; DDQGDQGDVQPAE; DQGDQGDVQPAEV; QGDQGDVQPAEVV; GDQGDVQPAEVVA; DQGDVQPAEVVAA; QGDVQPAEVVAAA; GDVQPAEVVAAAR; DVQPAEVVAAARD; VQPAEVVAAARDE; QPAEVVAAARDEG; PAEVVAAARDEGA; AEVVAAARDEGAG; EVVAAARDEGAGA; VVAAARDEGAGAS; VAAARDEGAGASP; AAARDEGAGASPG; AARDEGAGASPGQ; ARDEGAGASPGQQ; RDEGAGASPGQQP; DEGAGASPGQQPG; EGAGASPGQQPGG; GAGASPGQQPGGG; AGASPGQQPGGGV; GASPGQQPGGGVP; ASPGQQPGGGVPA; SPGQQPGGGVPAQ; PGQQPGGGVPAQA; GQQPGGGVPAQAM; QQPGGGVPAQAMD; QPGGGVPAQAMDT; PGGGVPAQAMDTG; GGGVPAQAMDTGA; GGVPAQAMDTGAG; GVPAQAMDTGAGA; VPAQAMDTGAGAR; PAQAMDTGAGARP; AQAMDTGAGARPA; QAMDTGAGARPAA; AMDTGAGARPAAS; MDTGAGARPAASP; DTGAGARPAASPL; TGAGARPAASPLA; GAGARPAASPLAA; AGARPAASPLAAP; GARPAASPLAAPV; ARPAASPLAAPVD; RPAASPLAAPVDP; PAASPLAAPVDPS; AASPLAAPVDPST; ASPLAAPVDPSTP; SPLAAPVDPSTPA; PLAAPVDPSTPAP; LAAPVDPSTPAPS; AAPVDPSTPAPST; APVDPSTPAPSTT; PVDPSTPAPSTTT; VDPSTPAPSTTTT; DPSTPAPSTTTTL;

14 mers:
MAEPLAVDPTGLSA; AEPLAVDPTGLSAA; EPLAVDPTGLSAAA; PLAVDPTGLSAAAA; LAVDPTGLSAAAAK; AVDPTGLSAAAAKL; VDPTGLSAAAAKLA; DPTGLSAAAAKLAG; PTGLSAAAAKLAGL; TGLSAAAAKLAGLV; GLSAAAAKLAGLVF; LSAAAAKLAGLVFP; SAAAAKLAGLVFPQ; AAAAKLAGLVFPQP; AAAKLAGLVFPQPP; AAKLAGLVFPQPPA; AKLAGLVFPQPPAP; KLAGLVFPQPPAPI; LAGLVFPQPPAPIA; AGLVFPQPPAPIAV; GLVFPQPPAPIAVS; LVFPQPPAPIAVSG; VFPQPPAPIAVSGT; FPQPPAPIAVSGTD; PQPPAPIAVSGTDS; QPPAPIAVSGTDSV; PPAPIAVSGTDSVV; PAPIAVSGTDSVVA; APIAVSGTDSVVAA; PIAVSGTDSVVAAI; IAVSGTDSVVAAIN; AVSGTDSVVAAINE; VSGTDSVVAAINET; SGTDSVVAAINETM; GTDSVVAAINETMP; TDSVVAAINETMPS; DSVVAAINETMPSI; SVVAAINETMPSIE; VVAAINETMPSIES; VAAINETMPSIESL; AAINETMPSIESLV; AINETMPSIESLVS; INETMPSIESLVSD; NETMPSIESLVSDG; ETMPSIESLVSDGL; TMPSIESLVSDGLP; MPSIESLVSDGLPG; PSIESLVSDGLPGV; SIESLVSDGLPGVK; IESLVSDGLPGVKA; ESLVSDGLPGVKAA; SLVSDGLPGVKAAL; LVSDGLPGVKAALT; VSDGLPGVKAALTR; SDGLPGVKAALTRT; DGLPGVKAALTRTA; GLPGVKAALTRTAS; LPGVKAALTRTASN; PGVKAALTRTASNM; GVKAALTRTASNMN; VKAALTRTASNMNA; KAALTRTASNMNAA; AALTRTASNMNAAA; ALTRTASNMNAAAD; LTRTASNMNAAADV; TRTASNMNAAADVY; RTASNMNAAADVYA; TASNMNAAADVYAK;

Fig. 29 continued

| | | |
|---|---|---|
| | ASNMNAAADVYAKT; SNMNAAADVYAKTD; NMNAAADVYAKTDQ;<br>MNAAADVYAKTDQS; NAAADVYAKTDQSL; AAADVYAKTDQSLG;<br>AADVYAKTDQSLGT; ADVYAKTDQSLGTS; DVYAKTDQSLGTSL;<br>VYAKTDQSLGTSLS; YAKTDQSLGTSLSQ; AKTDQSLGTSLSQY;<br>KTDQSLGTSLSQYA; TDQSLGTSLSQYAF; DQSLGTSLSQYAFG;<br>QSLGTSLSQYAFGS; SLGTSLSQYAFGSS; LGTSLSQYAFGSSG;<br>GTSLSQYAFGSSGE; TSLSQYAFGSSGEG; SLSQYAFGSSGEGL;<br>LSQYAFGSSGEGLA; SQYAFGSSGEGLAG; QYAFGSSGEGLAGV;<br>YAFGSSGEGLAGVA; AFGSSGEGLAGVAS; FGSSGEGLAGVASV;<br>GSSGEGLAGVASVG; SSGEGLAGVASVGG; SGEGLAGVASVGGQ;<br>GEGLAGVASVGGQP; EGLAGVASVGGQPS; GLAGVASVGGQPSQ;<br>LAGVASVGGQPSQA; AGVASVGGQPSQAT; GVASVGGQPSQATQ;<br>VASVGGQPSQATQL; ASVGGQPSQATQLL; SVGGQPSQATQLLS;<br>VGGQPSQATQLLST; GGQPSQATQLLSTP; GQPSQATQLLSTPV;<br>QPSQATQLLSTPVS; PSQATQLLSTPVSQ; SQATQLLSTPVSQV;<br>QATQLLSTPVSQVT; ATQLLSTPVSQVTT; TQLLSTPVSQVTTQ;<br>QLLSTPVSQVTTQL; LLSTPVSQVTTQLG; LSTPVSQVTTQLGE;<br>STPVSQVTTQLGET; TPVSQVTTQLGETA; PVSQVTTQLGETAA;<br>VSQVTTQLGETAAE; SQVTTQLGETAAEL; QVTTQLGETAAELA;<br>VTTQLGETAAELAP; TTQLGETAAELAPR; TQLGETAAELAPRV;<br>QLGETAAELAPRVV; LGETAAELAPRVVA; GETAAELAPRVVAT;<br>ETAAELAPRVVATV; TAAELAPRVVATVP; AAELAPRVVATVPQ;<br>AELAPRVVATVPQL; ELAPRVVATVPQLV; LAPRVVATVPQLVQ;<br>APRVVATVPQLVQL; PRVVATVPQLVQLA; RVVATVPQLVQLAP;<br>VVATVPQLVQLAPH; VATVPQLVQLAPHA; ATVPQLVQLAPHAV;<br>TVPQLVQLAPHAVQ; VPQLVQLAPHAVQM; PQLVQLAPHAVQMS;<br>QLVQLAPHAVQMSQ; LVQLAPHAVQMSQN; VQLAPHAVQMSQNA;<br>QLAPHAVQMSQNAS; LAPHAVQMSQNASP; APHAVQMSQNASPI;<br>PHAVQMSQNASPIA; HAVQMSQNASPIAQ; AVQMSQNASPIAQT;<br>VQMSQNASPIAQTI; QMSQNASPIAQTIS; MSQNASPIAQTISQ;<br>SQNASPIAQTISQT; QNASPIAQTISQTA; NASPIAQTISQTAQ; ASPIAQTISQTAQQ;<br>SPIAQTISQTAQQA; PIAQTISQTAQQAA; IAQTISQTAQQAAQ;<br>AQTISQTAQQAAQS; QTISQTAQQAAQSA; TISQTAQQAAQSAQ;<br>ISQTAQQAAQSAQG; SQTAQQAAQSAQGG; QTAQQAAQSAQGGS;<br>TAQQAAQSAQGGSG; AQQAAQSAQGGSGP; QQAAQSAQGGSGPM;<br>QAAQSAQGGSGPMP; AAQSAQGGSGPMPA; AQSAQGGSGPMPAQ;<br>QSAQGGSGPMPAQL; SAQGGSGPMPAQLA; AQGGSGPMPAQLAS;<br>QGGSGPMPAQLASA; GGSGPMPAQLASAE; GSGPMPAQLASAEK;<br>SGPMPAQLASAEKP; GPMPAQLASAEKPA; PMPAQLASAEKPAT;<br>MPAQLASAEKPATE; PAQLASAEKPATEQ; AQLASAEKPATEQA;<br>QLASAEKPATEQAE; LASAEKPATEQAEP; ASAEKPATEQAEPV;<br>SAEKPATEQAEPVH; AEKPATEQAEPVHE; EKPATEQAEPVHEV;<br>KPATEQAEPVHEVT; PATEQAEPVHEVTN; ATEQAEPVHEVTND;<br>TEQAEPVHEVTNDD; EQAEPVHEVTNDDQ; QAEPVHEVTNDDQG;<br>AEPVHEVTNDDQGD; EPVHEVTNDDQGDQ; PVHEVTNDDQGDQG;<br>VHEVTNDDQGDQGD; HEVTNDDQGDQGDV; EVTNDDQGDQGDVQ;<br>VTNDDQGDQGDVQP; TNDDQGDQGDVQPA; NDDQGDQGDVQPAE;<br>DDQGDQGDVQPAEV; DQGDQGDVQPAEVV; QGDQGDVQPAEVVA;<br>GDQGDVQPAEVVAA; DQGDVQPAEVVAAA; QGDVQPAEVVAAAR;<br>GDVQPAEVVAAARD; DVQPAEVVAAARDE; VQPAEVVAAARDEG;<br>QPAEVVAAARDEGA; PAEVVAAARDEGAG; AEVVAAARDEGAGA;<br>EVVAAARDEGAGAS; VVAAARDEGAGASP; VAAARDEGAGASPG;<br>AAARDEGAGASPGQ; AARDEGAGASPGQQ; ARDEGAGASPGQQP; | |

Fig. 29 continued

| | | | |
|---|---|---|---|
| | RDEGAGASPGQQPG; DEGAGASPGQQPGG; EGAGASPGQQPGGG; GAGASPGQQPGGGV; AGASPGQQPGGGVP; GASPGQQPGGGVPA; ASPGQQPGGGVPAQ; SPGQQPGGGVPAQA; PGQQPGGGVPAQAM; GQQPGGGVPAQAMD; QQPGGGVPAQAMDT; QPGGGVPAQAMDTG; PGGGVPAQAMDTGA; GGGVPAQAMDTGAG; GGVPAQAMDTGAGA; GVPAQAMDTGAGAR; VPAQAMDTGAGARP; PAQAMDTGAGARPA; AQAMDTGAGARPAA; QAMDTGAGARPAAS; AMDTGAGARPAASP; MDTGAGARPAASPL; DTGAGARPAASPLA; TGAGARPAASPLAA; GAGARPAASPLAAP; AGARPAASPLAAPV; GARPAASPLAAPVD; ARPAASPLAAPVDP; RPAASPLAAPVDPS; PAASPLAAPVDPST; AASPLAAPVDPSTP; ASPLAAPVDPSTPA; SPLAAPVDPSTPAP; PLAAPVDPSTPAPS; LAAPVDPSTPAPST; AAPVDPSTPAPSTT; APVDPSTPAPSTTT; PVDPSTPAPSTTTT; VDPSTPAPSTTTTL;<br><br>15 mers:<br>MAEPLAVDPTGLSAA; AEPLAVDPTGLSAAA; EPLAVDPTGLSAAAA; PLAVDPTGLSAAAAK; LAVDPTGLSAAAAKL; AVDPTGLSAAAAKLA; VDPTGLSAAAAKLAG; DPTGLSAAAAKLAGL; PTGLSAAAAKLAGLV; TGLSAAAAKLAGLVF; GLSAAAAKLAGLVFP; LSAAAAKLAGLVFPQ; SAAAAKLAGLVFPQP; AAAAKLAGLVFPQPP; AAAKLAGLVFPQPPA; AAKLAGLVFPQPPAP; AKLAGLVFPQPPAPI; KLAGLVFPQPPAPIA; LAGLVFPQPPAPIAV; AGLVFPQPPAPIAVS; GLVFPQPPAPIAVSG; LVFPQPPAPIAVSGT; VFPQPPAPIAVSGTD; FPQPPAPIAVSGTDS; PQPPAPIAVSGTDSV; QPPAPIAVSGTDSVV; PPAPIAVSGTDSVVA; PAPIAVSGTDSVVAA; APIAVSGTDSVVAAI; PIAVSGTDSVVAAIN; IAVSGTDSVVAAINE; AVSGTDSVVAAINET; VSGTDSVVAAINETM; SGTDSVVAAINETMP; GTDSVVAAINETMPS; TDSVVAAINETMPSI; DSVVAAINETMPSIE; SVVAAINETMPSIES; VVAAINETMPSIESL; VAAINETMPSIESLV; AAINETMPSIESLVS; AINETMPSIESLVSD; INETMPSIESLVSDG; NETMPSIESLVSDGL; ETMPSIESLVSDGLP; TMPSIESLVSDGLPG; MPSIESLVSDGLPGV; PSIESLVSDGLPGVK; SIESLVSDGLPGVKA; IESLVSDGLPGVKAA; ESLVSDGLPGVKAAL; SLVSDGLPGVKAALT; LVSDGLPGVKAALTR; VSDGLPGVKAALTRT; SDGLPGVKAALTRTA; DGLPGVKAALTRTAS; GLPGVKAALTRTASN; LPGVKAALTRTASNM; PGVKAALTRTASNMN; GVKAALTRTASNMNA; VKAALTRTASNMNAA; KAALTRTASNMNAAA; AALTRTASNMNAAAD; ALTRTASNMNAAADV; LTRTASNMNAAADVY; TRTASNMNAAADVYA; RTASNMNAAADVYAK; TASNMNAAADVYAKT; ASNMNAAADVYAKTD; SNMNAAADVYAKTDQ; NMNAAADVYAKTDQS; MNAAADVYAKTDQSL; NAAADVYAKTDQSLG; AAADVYAKTDQSLGT; AADVYAKTDQSLGTS; ADVYAKTDQSLGTSL; DVYAKTDQSLGTSLS; VYAKTDQSLGTSLSQ; YAKTDQSLGTSLSQY; AKTDQSLGTSLSQYA; KTDQSLGTSLSQYAF; TDQSLGTSLSQYAFG; DQSLGTSLSQYAFGS; QSLGTSLSQYAFGSS; SLGTSLSQYAFGSSG; LGTSLSQYAFGSSGE; GTSLSQYAFGSSGEG; TSLSQYAFGSSGEGL; SLSQYAFGSSGEGLA; LSQYAFGSSGEGLAG; SQYAFGSSGEGLAGV; QYAFGSSGEGLAGVA; YAFGSSGEGLAGVAS; AFGSSGEGLAGVASV; FGSSGEGLAGVASVG; GSSGEGLAGVASVGG; SSGEGLAGVASVGGQ; SGEGLAGVASVGGQP; GEGLAGVASVGGQPS; EGLAGVASVGGQPSQ; GLAGVASVGGQPSQA; LAGVASVGGQPSQAT; AGVASVGGQPSQATQ; GVASVGGQPSQATQL; VASVGGQPSQATQLL; ASVGGQPSQATQLLS; SVGGQPSQATQLLST; VGGQPSQATQLLSTP; GGQPSQATQLLSTPV; GQPSQATQLLSTPVS; QPSQATQLLSTPVSQ; PSQATQLLSTPVSQV; SQATQLLSTPVSQVT; QATQLLSTPVSQVTT; | | |

Fig. 29 continued

| | | | |
|---|---|---|---|
| | ATQLLSTPVSQVTTQ; TQLLSTPVSQVTTQL; QLLSTPVSQVTTQLG; LLSTPVSQVTTQLGE; LSTPVSQVTTQLGET; STPVSQVTTQLGETA; TPVSQVTTQLGETAA; PVSQVTTQLGETAAE; VSQVTTQLGETAAEL; SQVTTQLGETAAELA; QVTTQLGETAAELAP; VTTQLGETAAELAPR; TTQLGETAAELAPRV; TQLGETAAELAPRVV; QLGETAAELAPRVVA; LGETAAELAPRVVAT; GETAAELAPRVVATV; ETAAELAPRVVATVP; TAAELAPRVVATVPQ; AAELAPRVVATVPQL; AELAPRVVATVPQLV; ELAPRVVATVPQLVQ; LAPRVVATVPQLVQL; APRVVATVPQLVQLA; PRVVATVPQLVQLAP; RVVATVPQLVQLAPH; VVATVPQLVQLAPHA; VATVPQLVQLAPHAV; ATVPQLVQLAPHAVQ; TVPQLVQLAPHAVQM; VPQLVQLAPHAVQMS; PQLVQLAPHAVQMSQ; QLVQLAPHAVQMSQN; LVQLAPHAVQMSQNA; VQLAPHAVQMSQNAS; QLAPHAVQMSQNASP; LAPHAVQMSQNASPI; APHAVQMSQNASPIA; PHAVQMSQNASPIAQ; HAVQMSQNASPIAQT; AVQMSQNASPIAQTI; VQMSQNASPIAQTIS; QMSQNASPIAQTISQ; MSQNASPIAQTISQT; SQNASPIAQTISQTA; QNASPIAQTISQTAQ; NASPIAQTISQTAQQ; ASPIAQTISQTAQQA; SPIAQTISQTAQQAA; PIAQTISQTAQQAAQ; IAQTISQTAQQAAQS; AQTISQTAQQAAQSA; QTISQTAQQAAQSAQ; TISQTAQQAAQSAQG; ISQTAQQAAQSAQGG; SQTAQQAAQSAQGGS; QTAQQAAQSAQGGSG; TAQQAAQSAQGGSGP; AQQAAQSAQGGSGPM; QQAAQSAQGGSGPMP; QAAQSAQGGSGPMPA; AAQSAQGGSGPMPAQ; AQSAQGGSGPMPAQL; QSAQGGSGPMPAQLA; SAQGGSGPMPAQLAS; AQGGSGPMPAQLASA; QGGSGPMPAQLASAE; GGSGPMPAQLASAEK; GSGPMPAQLASAEKP; SGPMPAQLASAEKPA; GPMPAQLASAEKPAT; PMPAQLASAEKPATE; MPAQLASAEKPATEQ; PAQLASAEKPATEQA; AQLASAEKPATEQAE; QLASAEKPATEQAEP; LASAEKPATEQAEPV; ASAEKPATEQAEPVH; SAEKPATEQAEPVHE; AEKPATEQAEPVHEV; EKPATEQAEPVHEVT; KPATEQAEPVHEVTN; PATEQAEPVHEVTND; ATEQAEPVHEVTNDD; TEQAEPVHEVTNDDQ; EQAEPVHEVTNDDQG; QAEPVHEVTNDDQGD; AEPVHEVTNDDQGDQ; EPVHEVTNDDQGDQG; PVHEVTNDDQGDQGD; VHEVTNDDQGDQGDV; HEVTNDDQGDQGDVQ; EVTNDDQGDQGDVQP; VTNDDQGDQGDVQPA; TNDDQGDQGDVQPAE; NDDQGDQGDVQPAEV; DDQGDQGDVQPAEVV; DQGDQGDVQPAEVVA; QGDQGDVQPAEVVAA; GDQGDVQPAEVVAAA; DQGDVQPAEVVAAAR; QGDVQPAEVVAAARD; GDVQPAEVVAAARDE; DVQPAEVVAAARDEG; VQPAEVVAAARDEGA; QPAEVVAAARDEGAG; PAEVVAAARDEGAGA; AEVVAAARDEGAGAS; EVVAAARDEGAGASP; VVAAARDEGAGASPG; VAAARDEGAGASPGQ; AAARDEGAGASPGQQ; AARDEGAGASPGQQP; ARDEGAGASPGQQPG; RDEGAGASPGQQPGG; DEGAGASPGQQPGGG; EGAGASPGQQPGGGV; GAGASPGQQPGGGVP; AGASPGQQPGGGVPA; GASPGQQPGGGVPAQ; ASPGQQPGGGVPAQA; SPGQQPGGGVPAQAM; PGQQPGGGVPAQAMD; GQQPGGGVPAQAMDT; QQPGGGVPAQAMDTG; QPGGGVPAQAMDTGA; PGGGVPAQAMDTGAG; GGGVPAQAMDTGAGA; GGVPAQAMDTGAGAR; GVPAQAMDTGAGARP; VPAQAMDTGAGARPA; PAQAMDTGAGARPAA; AQAMDTGAGARPAAS; QAMDTGAGARPAASP; AMDTGAGARPAASPL; MDTGAGARPAASPLA; DTGAGARPAASPLAA; TGAGARPAASPLAAP; GAGARPAASPLAAPV; AGARPAASPLAAPVD; GARPAASPLAAPVDP; ARPAASPLAAPVDPS; RPAASPLAAPVDPST; PAASPLAAPVDPSTP; AASPLAAPVDPSTPA; ASPLAAPVDPSTPAP; SPLAAPVDPSTPAPS; PLAAPVDPSTPAPST; LAAPVDPSTPAPSTT; AAPVDPSTPAPSTTT; APVDPSTPAPSTTTT; PVDPSTPAPSTTTTL;<br><br>16 mers: | | |

Fig. 29 continued

| | | |
|---|---|---|
| | MAEPLAVDPTGLSAAA; AEPLAVDPTGLSAAAA; EPLAVDPTGLSAAAAK; PLAVDPTGLSAAAAKL; LAVDPTGLSAAAAKLA; AVDPTGLSAAAAKLAG; VDPTGLSAAAAKLAGL; DPTGLSAAAAKLAGLV; PTGLSAAAAKLAGLVF; TGLSAAAAKLAGLVFP; GLSAAAAKLAGLVFPQ; LSAAAAKLAGLVFPQP; SAAAAKLAGLVFPQPP; AAAAKLAGLVFPQPPA; AAAKLAGLVFPQPPAP; AAKLAGLVFPQPPAPI; AKLAGLVFPQPPAPIA; KLAGLVFPQPPAPIAV; LAGLVFPQPPAPIAVS; AGLVFPQPPAPIAVSG; GLVFPQPPAPIAVSGT; LVFPQPPAPIAVSGTD; VFPQPPAPIAVSGTDS; FPQPPAPIAVSGTDSV; PQPPAPIAVSGTDSVV; QPPAPIAVSGTDSVVA; PPAPIAVSGTDSVVAA; PAPIAVSGTDSVVAAI; APIAVSGTDSVVAAIN; PIAVSGTDSVVAAINE; IAVSGTDSVVAAINET; AVSGTDSVVAAINETM; VSGTDSVVAAINETMP; SGTDSVVAAINETMPS; GTDSVVAAINETMPSI; TDSVVAAINETMPSIE; DSVVAAINETMPSIES; SVVAAINETMPSIESL; VVAAINETMPSIESLV; VAAINETMPSIESLVS; AAINETMPSIESLVSD; AINETMPSIESLVSDG; INETMPSIESLVSDGL; NETMPSIESLVSDGLP; ETMPSIESLVSDGLPG; TMPSIESLVSDGLPGV; MPSIESLVSDGLPGVK; PSIESLVSDGLPGVKA; SIESLVSDGLPGVKAA; IESLVSDGLPGVKAAL; ESLVSDGLPGVKAALT; SLVSDGLPGVKAALTR; LVSDGLPGVKAALTRT; VSDGLPGVKAALTRTA; SDGLPGVKAALTRTAS; DGLPGVKAALTRTASN; GLPGVKAALTRTASNM; LPGVKAALTRTASNMN; PGVKAALTRTASNMNA; GVKAALTRTASNMNAA; VKAALTRTASNMNAAA; KAALTRTASNMNAAAD; AALTRTASNMNAAADV; ALTRTASNMNAAADVY; LTRTASNMNAAADVYA; TRTASNMNAAADVYAK; RTASNMNAAADVYAKT; TASNMNAAADVYAKTD; ASNMNAAADVYAKTDQ; SNMNAAADVYAKTDQS; NMNAAADVYAKTDQSL; MNAAADVYAKTDQSLG; NAAADVYAKTDQSLGT; AAADVYAKTDQSLGTS; AADVYAKTDQSLGTSL; ADVYAKTDQSLGTSLS; DVYAKTDQSLGTSLSQ; VYAKTDQSLGTSLSQY; YAKTDQSLGTSLSQYA; AKTDQSLGTSLSQYAF; KTDQSLGTSLSQYAFG; TDQSLGTSLSQYAFGS; DQSLGTSLSQYAFGSS; QSLGTSLSQYAFGSSG; SLGTSLSQYAFGSSGE; LGTSLSQYAFGSSGEG; GTSLSQYAFGSSGEGL; TSLSQYAFGSSGEGLA; SLSQYAFGSSGEGLAG; LSQYAFGSSGEGLAGV; SQYAFGSSGEGLAGVA; QYAFGSSGEGLAGVAS; YAFGSSGEGLAGVASV; AFGSSGEGLAGVASVG; FGSSGEGLAGVASVGG; GSSGEGLAGVASVGGQ; SSGEGLAGVASVGGQP; SGEGLAGVASVGGQPS; GEGLAGVASVGGQPSQ; EGLAGVASVGGQPSQA; GLAGVASVGGQPSQAT; LAGVASVGGQPSQATQ; AGVASVGGQPSQATQL; GVASVGGQPSQATQLL; VASVGGQPSQATQLLS; ASVGGQPSQATQLLST; SVGGQPSQATQLLSTP; VGGQPSQATQLLSTPV; GGQPSQATQLLSTPVS; GQPSQATQLLSTPVSQ; QPSQATQLLSTPVSQV; PSQATQLLSTPVSQVT; SQATQLLSTPVSQVTT; QATQLLSTPVSQVTTQ; ATQLLSTPVSQVTTQL; TQLLSTPVSQVTTQLG; QLLSTPVSQVTTQLGE; LLSTPVSQVTTQLGET; LSTPVSQVTTQLGETA; STPVSQVTTQLGETAA; TPVSQVTTQLGETAAE; PVSQVTTQLGETAAEL; VSQVTTQLGETAAELA; SQVTTQLGETAAELAP; QVTTQLGETAAELAPR; VTTQLGETAAELAPRV; TTQLGETAAELAPRVV; TQLGETAAELAPRVVA; QLGETAAELAPRVVAT; LGETAAELAPRVVATV; GETAAELAPRVVATVP; ETAAELAPRVVATVPQ; TAAELAPRVVATVPQL; AAELAPRVVATVPQLV; AELAPRVVATVPQLVQ; ELAPRVVATVPQLVQL; LAPRVVATVPQLVQLA; APRVVATVPQLVQLAP; PRVVATVPQLVQLAPH; RVVATVPQLVQLAPHA; VVATVPQLVQLAPHAV; VATVPQLVQLAPHAVQ; ATVPQLVQLAPHAVQM; TVPQLVQLAPHAVQMS; VPQLVQLAPHAVQMSQ; PQLVQLAPHAVQMSQN; QLVQLAPHAVQMSQNA; LVQLAPHAVQMSQNAS; VQLAPHAVQMSQNASP; QLAPHAVQMSQNASPI; LAPHAVQMSQNASPIA; APHAVQMSQNASPIAQ; PHAVQMSQNASPIAQT; HAVQMSQNASPIAQTI; AVQMSQNASPIAQTIS; VQMSQNASPIAQTISQ; QMSQNASPIAQTISQT; MSQNASPIAQTISQTA; SQNASPIAQTISQTAQ; | |

Fig. 29 continued

| | | |
|---|---|---|
| | QNASPIAQTISQTAQQ; NASPIAQTISQTAQQA; ASPIAQTISQTAQQAA; SPIAQTISQTAQQAAQ; PIAQTISQTAQQAAQS; IAQTISQTAQQAAQSA; AQTISQTAQQAAQSAQ; QTISQTAQQAAQSAQG; TISQTAQQAAQSAQGG; ISQTAQQAAQSAQGGS; SQTAQQAAQSAQGGSG; QTAQQAAQSAQGGSGP; TAQQAAQSAQGGSGPM; AQQAAQSAQGGSGPMP; QQAAQSAQGGSGPMPA; QAAQSAQGGSGPMPAQ; AAQSAQGGSGPMPAQL; AQSAQGGSGPMPAQLA; QSAQGGSGPMPAQLAS; SAQGGSGPMPAQLASA; AQGGSGPMPAQLASAE; QGGSGPMPAQLASAEK; GGSGPMPAQLASAEKP; GSGPMPAQLASAEKPA; SGPMPAQLASAEKPAT; GPMPAQLASAEKPATE; PMPAQLASAEKPATEQ; MPAQLASAEKPATEQA; PAQLASAEKPATEQAE; AQLASAEKPATEQAEP; QLASAEKPATEQAEPV; LASAEKPATEQAEPVH; ASAEKPATEQAEPVHE; SAEKPATEQAEPVHEV; AEKPATEQAEPVHEVT; EKPATEQAEPVHEVTN; KPATEQAEPVHEVTND; PATEQAEPVHEVTNDD; ATEQAEPVHEVTNDDQ; TEQAEPVHEVTNDDQG; EQAEPVHEVTNDDQGD; QAEPVHEVTNDDQGDQ; AEPVHEVTNDDQGDQG; EPVHEVTNDDQGDQGD; PVHEVTNDDQGDQGDV; VHEVTNDDQGDQGDVQ; HEVTNDDQGDQGDVQP; EVTNDDQGDQGDVQPA; VTNDDQGDQGDVQPAE; TNDDQGDQGDVQPAEV; NDDQGDQGDVQPAEVV; DDQGDQGDVQPAEVVA; DQGDQGDVQPAEVVAA; QGDQGDVQPAEVVAAA; GDQGDVQPAEVVAAAR; DQGDVQPAEVVAAARD; QGDVQPAEVVAAARDE; GDVQPAEVVAAARDEG; DVQPAEVVAAARDEGA; VQPAEVVAAARDEGAG; QPAEVVAAARDEGAGA; PAEVVAAARDEGAGAS; AEVVAAARDEGAGASP; EVVAAARDEGAGASPG; VVAAARDEGAGASPGQ; VAAARDEGAGASPGQQ; AAARDEGAGASPGQQP; AARDEGAGASPGQQPG; ARDEGAGASPGQQPGG; RDEGAGASPGQQPGGG; DEGAGASPGQQPGGGV; EGAGASPGQQPGGGVP; GAGASPGQQPGGGVPA; AGASPGQQPGGGVPAQ; GASPGQQPGGGVPAQA; ASPGQQPGGGVPAQAM; SPGQQPGGGVPAQAMD; PGQQPGGGVPAQAMDT; GQQPGGGVPAQAMDTG; QQPGGGVPAQAMDTGA; QPGGGVPAQAMDTGAG; PGGGVPAQAMDTGAGA; GGGVPAQAMDTGAGAR; GGVPAQAMDTGAGARP; GVPAQAMDTGAGARPA; VPAQAMDTGAGARPAA; PAQAMDTGAGARPAAS; AQAMDTGAGARPAASP; QAMDTGAGARPAASPL; AMDTGAGARPAASPLA; MDTGAGARPAASPLAA; DTGAGARPAASPLAAP; TGAGARPAASPLAAPV; GAGARPAASPLAAPVD; AGARPAASPLAAPVDP; GARPAASPLAAPVDPS; ARPAASPLAAPVDPST; RPAASPLAAPVDPSTP; PAASPLAAPVDPSTPA; AASPLAAPVDPSTPAP; ASPLAAPVDPSTPAPS; SPLAAPVDPSTPAPST; PLAAPVDPSTPAPSTT; LAAPVDPSTPAPSTTT; AAPVDPSTPAPSTTTT; APVDPSTPAPSTTTTL | |
| 75) Rv3879c | 13 mers: MSITRPTGSYARQ; SITRPTGSYARQM; ITRPTGSYARQML; TRPTGSYARQMLD; RPTGSYARQMLDP; PTGSYARQMLDPG; TGSYARQMLDPGG; GSYARQMLDPGGW; SYARQMLDPGGWV; YARQMLDPGGWVE; ARQMLDPGGWVEA; RQMLDPGGWVEAD; QMLDPGGWVEADE; MLDPGGWVEADED; LDPGGWVEADEDT; DPGGWVEADEDTF; PGGWVEADEDTFY; GGWVEADEDTFYD; GWVEADEDTFYDR; WVEADEDTFYDRA; VEADEDTFYDRAQ; EADEDTFYDRAQE; ADEDTFYDRAQEY; DEDTFYDRAQEYS; EDTFYDRAQEYSQ; DTFYDRAQEYSQV; TFYDRAQEYSQVL; FYDRAQEYSQVLQ; YDRAQEYSQVLQR; DRAQEYSQVLQRV; RAQEYSQVLQRVT; AQEYSQVLQRVTD; QEYSQVLQRVTDV; EYSQVLQRVTDVL; YSQVLQRVTDVLD; SQVLQRVTDVLDT; QVLQRVTDVLDTC; VLQRVTDVLDTCR; LQRVTDVLDTCRQ; QRVTDVLDTCRQQ; RVTDVLDTCRQQK; VTDVLDTCRQQKG; TDVLDTCRQQKGH; DVLDTCRQQKGHV; VLDTCRQQKGHVF; LDTCRQQKGHVFE; DTCRQQKGHVFEG; TCRQQKGHVFEGG; CRQQKGHVFEGGL; RQQKGHVFEGGLW; QQKGHVFEGGLWS; | 110608-113469 |

Fig. 29 continued

| | | |
|---|---|---|
| | QKGHVFEGGLWSG; KGHVFEGGLWSGG; GHVFEGGLWSGGA;<br>HVFEGGLWSGGAA; VFEGGLWSGGAAN; FEGGLWSGGAANA;<br>EGGLWSGGAANAA; GGLWSGGAANAAN; GLWSGGAANAANG;<br>LWSGGAANAANGA; WSGGAANAANGAL; SGGAANAANGALG;<br>GGAANAANGALGA; GAANAANGALGAN; AANAANGALGANI; ANAANGALGANIN;<br>NAANGALGANINQ; AANGALGANINQL; ANGALGANINQLM; NGALGANINQLMT;<br>GALGANINQLMTL; ALGANINQLMTLQ; LGANINQLMTLQD; GANINQLMTLQDY;<br>ANINQLMTLQDYL; NINQLMTLQDYLA; INQLMTLQDYLAT; NQLMTLQDYLATV;<br>QLMTLQDYLATVI; LMTLQDYLATVIT; MTLQDYLATVITW; TLQDYLATVITWH;<br>LQDYLATVITWHR; QDYLATVITWHRH; DYLATVITWHRHI; YLATVITWHRHIA;<br>LATVITWHRHIAG; ATVITWHRHIAGL; TVITWHRHIAGLI; VITWHRHIAGLIE;<br>ITWHRHIAGLIEQ; TWHRHIAGLIEQA; WHRHIAGLIEQAK; HRHIAGLIEQAKS;<br>RHIAGLIEQAKSD; HIAGLIEQAKSDI; IAGLIEQAKSDIG; AGLIEQAKSDIGN;<br>GLIEQAKSDIGNN; LIEQAKSDIGNNV; IEQAKSDIGNNVD; EQAKSDIGNNVDG;<br>QAKSDIGNNVDGA; AKSDIGNNVDGAQ; KSDIGNNVDGAQR;<br>SDIGNNVDGAQRE; DIGNNVDGAQREI; IGNNVDGAQREID; GNNVDGAQREIDI;<br>NNVDGAQREIDIL; NVDGAQREIDILE; VDGAQREIDILEN; DGAQREIDILEND;<br>GAQREIDILENDP; AQREIDILENDPS; QREIDILENDPSL; REIDILENDPSLD;<br>EIDILENDPSLDA; IDILENDPSLDAD; DILENDPSLDADE; ILENDPSLDADER;<br>LENDPSLDADERH; ENDPSLDADERHT; NDPSLDADERHTA; DPSLDADERHTAI;<br>PSLDADERHTAIN; SLDADERHTAINS; LDADERHTAINSL; DADERHTAINSLV;<br>ADERHTAINSLVT; DERHTAINSLVTA; ERHTAINSLVTAT; RHTAINSLVTATH;<br>HTAINSLVTATHG; TAINSLVTATHGA; AINSLVTATHGAN; INSLVTATHGANV;<br>NSLVTATHGANVS; SLVTATHGANVSL; LVTATHGANVSLV; VTATHGANVSLVA;<br>TATHGANVSLVAE; ATHGANVSLVAET; THGANVSLVAETA; HGANVSLVAETAE;<br>GANVSLVAETAER; ANVSLVAETAERV; NVSLVAETAERVL; VSLVAETAERVLE;<br>SLVAETAERVLES; LVAETAERVLESK; VAETAERVLESKN; AETAERVLESKNW;<br>ETAERVLESKNWK; TAERVLESKNWKP; AERVLESKNWKPP;<br>ERVLESKNWKPPK; RVLESKNWKPPKN; VLESKNWKPPKNA;<br>LESKNWKPPKNAL; ESKNWKPPKNALE; SKNWKPPKNALED;<br>KNWKPPKNALEDL; NWKPPKNALEDLL; WKPPKNALEDLLQ; KPPKNALEDLLQQ;<br>PPKNALEDLLQQK; PKNALEDLLQQKS; KNALEDLLQQKSP; NALEDLLQQKSPP;<br>ALEDLLQQKSPPP; LEDLLQQKSPPPP; EDLLQQKSPPPPD; DLLQQKSPPPPDV;<br>LLQQKSPPPPDVP; LQQKSPPPPDVPT; QQKSPPPPDVPTL; QKSPPPPDVPTLV;<br>KSPPPPDVPTLVV; SPPPPDVPTLVVP; PPPPDVPTLVVPS; PPPDVPTLVVPSP;<br>PPDVPTLVVPSPG; PDVPTLVVPSPGT; DVPTLVVPSPGTP; VPTLVVPSPGTPG;<br>PTLVVPSPGTPGT; TLVVPSPGTPGTP; LVVPSPGTPGTPG; VVPSPGTPGTPGT;<br>VPSPGTPGTPGTP; PSPGTPGTPGTPI; SPGTPGTPGTPIT; PGTPGTPGTPITP;<br>GTPGTPGTPITPG; TPGTPGTPITPGT; PGTPGTPITPGTP; GTPGTPITPGTPI;<br>TPGTPITPGTPIT; PGTPITPGTPITP; GTPITPGTPITPG; TPITPGTPITPGT;<br>PITPGTPITPGTP; ITPGTPITPGTPI; TPGTPITPGTPIT; PGTPITPGTPITP;<br>GTPITPGTPITPI; TPITPGTPITPIP; PITPGTPITPIPG; ITPGTPITPIPGA;<br>TPGTPITPIPGAP; PGTPITPIPGAPV; GTPITPIPGAPVT; TPITPIPGAPVTP;<br>PITPIPGAPVTPI; ITPIPGAPVTPIT; TPIPGAPVTPITP; PIPGAPVTPITPT;<br>IPGAPVTPITPTP; PGAPVTPITPTPG; GAPVTPITPTPGT; APVTPITPTPGTP;<br>PVTPITPTPGTPV; VTPITPTPGTPVT; TPITPTPGTPVTP; PITPTPGTPVTPV;<br>ITPTPGTPVTPVT; TPTPGTPVTPVTP; PTPGTPVTPVTPG; TPGTPVTPVTPGK;<br>PGTPVTPVTPGKP; GTPVTPVTPGKPV; TPVTPVTPGKPVT; PVTPVTPGKPVTP;<br>VTPVTPGKPVTPV; TPVTPGKPVTPVT; PVTPGKPVTPVTP; VTPGKPVTPVTPV;<br>TPGKPVTPVTPVK; PGKPVTPVTPVKP; GKPVTPVTPVKPG; KPVTPVTPVKPGT;<br>PVTPVTPVKPGTP; VTPVTPVKPGTPG; TPVTPVKPGTPGE; PVTPVKPGTPGEP;<br>VTPVKPGTPGEPT; TPVKPGTPGEPTP; PVKPGTPGEPTPI; VKPGTPGEPTPIT;<br>KPGTPGEPTPITP; PGTPGEPTPITPV; GTPGEPTPITPVT; TPGEPTPITPVTP; | |

Fig. 29 continued

| | | |
|---|---|---|
| | PGEPTPITPVTPP; GEPTPITPVTPPV; EPTPITPVTPPVA; PTPITPVTPPVAP;<br>TPITPVTPPVAPA; PITPVTPPVAPAT; ITPVTPPVAPATP; TPVTPPVAPATPA;<br>PVTPPVAPATPAT; VTPPVAPATPATP; TPPVAPATPATPA; PPVAPATPATPAT;<br>PVAPATPATPATP; VAPATPATPATPV; APATPATPATPVT; PATPATPATPVTP;<br>ATPATPATPVTPA; TPATPATPVTPAP; PATPATPVTPAPA; ATPATPVTPAPAP;<br>TPATPVTPAPAPH; PATPVTPAPAPHP; ATPVTPAPAPHPQ; TPVTPAPAPHPQP;<br>PVTPAPAPHPQPA; VTPAPAPHPQPAP; TPAPAPHPQPAPA; PAPAPHPQPAPAP;<br>APAPHPQPAPAPA; PAPHPQPAPAPAP; APHPQPAPAPAPS; PHPQPAPAPAPSP;<br>HPQPAPAPAPSPG; PQPAPAPAPSPGP; QPAPAPAPSPGPQ;<br>PAPAPAPSPGPQP; APAPAPSPGPQPV; PAPAPSPGPQPVT;<br>APAPSPGPQPVTP; PAPSPGPQPVTPA; APSPGPQPVTPAT; PSPGPQPVTPATP;<br>SPGPQPVTPATPG; PGPQPVTPATPGP; GPQPVTPATPGPS;<br>PQPVTPATPGPSG; QPVTPATPGPSGP; PVTPATPGPSGPA; VTPATPGPSGPAT;<br>TPATPGPSGPATP; PATPGPSGPATPG; ATPGPSGPATPGT; TPGPSGPATPGTP;<br>PGPSGPATPGTPG; GPSGPATPGTPGG; PSGPATPGTPGGE;<br>SGPATPGTPGGEP; GPATPGTPGGEPA; PATPGTPGGEPAP;<br>ATPGTPGGEPAPH; TPGTPGGEPAPHV; PGTPGGEPAPHVK;<br>GTPGGEPAPHVKP; TPGGEPAPHVKPA; PGGEPAPHVKPAA;<br>GGEPAPHVKPAAL; GEPAPHVKPAALA; EPAPHVKPAALAE; PAPHVKPAALAEQ;<br>APHVKPAALAEQP; PHVKPAALAEQPG; HVKPAALAEQPGV; VKPAALAEQPGVP;<br>KPAALAEQPGVPG; PAALAEQPGVPGQ; AALAEQPGVPGQH;<br>ALAEQPGVPGQHA; LAEQPGVPGQHAG; AEQPGVPGQHAGG;<br>EQPGVPGQHAGGG; QPGVPGQHAGGGT; PGVPGQHAGGGTQ;<br>GVPGQHAGGGTQS; VPGQHAGGGTQSG; PGQHAGGGTQSGP;<br>GQHAGGGTQSGPA; QHAGGGTQSGPAH; HAGGGTQSGPAHA;<br>AGGGTQSGPAHAD; GGGTQSGPAHADE; GGTQSGPAHADES;<br>GTQSGPAHADESA; TQSGPAHADESAA; QSGPAHADESAAS;<br>SGPAHADESAASV; GPAHADESAASVT; PAHADESAASVTP; AHADESAASVTPA;<br>HADESAASVTPAA; ADESAASVTPAAA; DESAASVTPAAAS; ESAASVTPAAASG;<br>SAASVTPAAASGV; AASVTPAAASGVP; ASVTPAAASGVPG; SVTPAAASGVPGA;<br>VTPAAASGVPGAR; TPAAASGVPGARA; PAAASGVPGARAA;<br>AAASGVPGARAAA; AASGVPGARAAAA; ASGVPGARAAAAA;<br>SGVPGARAAAAAP; GVPGARAAAAAPS; VPGARAAAAAPSG;<br>PGARAAAAAPSGT; GARAAAAAPSGTA; ARAAAAAPSGTAV;<br>RAAAAAPSGTAVG; AAAAAPSGTAVGA; AAAAPSGTAVGAG;<br>AAAPSGTAVGAGA; AAPSGTAVGAGAR; APSGTAVGAGARS;<br>PSGTAVGAGARSS; SGTAVGAGARSSV; GTAVGAGARSSVG;<br>TAVGAGARSSVGT; AVGAGARSSVGTA; VGAGARSSVGTAA;<br>GAGARSSVGTAAA; AGARSSVGTAAAS; GARSSVGTAAASG;<br>ARSSVGTAAASGA; RSSVGTAAASGAG; SSVGTAAASGAGS;<br>SVGTAAASGAGSH; VGTAAASGAGSHA; GTAAASGAGSHAA;<br>TAAASGAGSHAAT; AAASGAGSHAATG; AASGAGSHAATGR;<br>ASGAGSHAATGRA; SGAGSHAATGRAP; GAGSHAATGRAPV;<br>AGSHAATGRAPVA; GSHAATGRAPVAT; SHAATGRAPVATS;<br>HAATGRAPVATSD; AATGRAPVATSDK; ATGRAPVATSDKA; TGRAPVATSDKAA;<br>GRAPVATSDKAAA; RAPVATSDKAAAP; APVATSDKAAAPS; PVATSDKAAAPST;<br>VATSDKAAAPSTR; ATSDKAAAPSTRA; TSDKAAAPSTRAA; SDKAAAPSTRAAS;<br>DKAAAPSTRAASA; KAAAPSTRAASAR; AAAPSTRAASART; AAPSTRAASARTA;<br>APSTRAASARTAP; PSTRAASARTAPP; STRAASARTAPPA; TRAASARTAPPAR;<br>RAASARTAPPARP; AASARTAPPARPP; ASARTAPPARPPS; SARTAPPARPPST;<br>ARTAPPARPPSTD; RTAPPARPPSTDH; TAPPARPPSTDHI; APPARPPSTDHID;<br>PPARPPSTDHIDK; PARPPSTDHIDKP; ARPPSTDHIDKPD; RPPSTDHIDKPDR;<br>PPSTDHIDKPDRS; PSTDHIDKPDRSE; STDHIDKPDRSES; TDHIDKPDRSESA; | |

Fig. 29 continued

| | | |
|---|---|---|
| | DHIDKPDRSESAD; HIDKPDRSESADD; IDKPDRSESADDG; DKPDRSESADDGT; KPDRSESADDGTP; PDRSESADDGTPV; DRSESADDGTPVS; RSESADDGTPVSM; SESADDGTPVSMI; ESADDGTPVSMIP; SADDGTPVSMIPV; ADDGTPVSMIPVS; DDGTPVSMIPVSA; DGTPVSMIPVSAA; GTPVSMIPVSAAR; TPVSMIPVSAARA; PVSMIPVSAARAA; VSMIPVSAARAAR; SMIPVSAARAARD; MIPVSAARAARDA; IPVSAARAARDAA; PVSAARAARDAAT; VSAARAARDAATA; SAARAARDAATAA; AARAARDAATAAA; ARAARDAATAAAS; RAARDAATAAASA; AARDAATAAASAR; ARDAATAAASARQ; RDAATAAASARQR; DAATAAASARQRG; AATAAASARQRGR; ATAAASARQRGRG; TAAASARQRGRGD; AAASARQRGRGDA; AASARQRGRGDAL; ASARQRGRGDALR; SARQRGRGDALRL; ARQRGRGDALRLA; RQRGRGDALRLAR; QRGRGDALRLARR; RGRGDALRLARRI; GRGDALRLARRIA; RGDALRLARRIAA; GDALRLARRIAAA; DALRLARRIAAAL; ALRLARRIAAALN; LRLARRIAAALNA; RLARRIAAALNAS; LARRIAAALNASD; ARRIAAALNASDN; RRIAAALNASDNN; RIAAALNASDNNA; IAAALNASDNNAG; AAALNASDNNAGD; AALNASDNNAGDY; ALNASDNNAGDYG; LNASDNNAGDYGF; NASDNNAGDYGFF; ASDNNAGDYGFFW; SDNNAGDYGFFWI; DNNAGDYGFFWIT; NNAGDYGFFWITA; NAGDYGFFWITAV; AGDYGFFWITAVT; GDYGFFWITAVTT; DYGFFWITAVTTD; YGFFWITAVTTDG; GFFWITAVTTDGS; FFWITAVTTDGSI; FWITAVTTDGSIV; WITAVTTDGSIVV; ITAVTTDGSIVVA; TAVTTDGSIVVAN; AVTTDGSIVVANS; VTTDGSIVVANSY; TTDGSIVVANSYG; TDGSIVVANSYGL; DGSIVVANSYGLA; GSIVVANSYGLAY; SIVVANSYGLAYI; IVVANSYGLAYIP; VVANSYGLAYIPD; VANSYGLAYIPDG; ANSYGLAYIPDGM; NSYGLAYIPDGME; SYGLAYIPDGMEL; YGLAYIPDGMELP; GLAYIPDGMELPN; LAYIPDGMELPNK; AYIPDGMELPNKV; YIPDGMELPNKVY; IPDGMELPNKVYL; PDGMELPNKVYLA; DGMELPNKVYLAS; GMELPNKVYLASA; MELPNKVYLASAD; ELPNKVYLASADH; LPNKVYLASADHA; PNKVYLASADHAI; NKVYLASADHAIP; KVYLASADHAIPV; VYLASADHAIPVD; YLASADHAIPVDE; LASADHAIPVDEI; ASADHAIPVDEIA; SADHAIPVDEIAR; ADHAIPVDEIARC; DHAIPVDEIARCA; HAIPVDEIARCAT; AIPVDEIARCATY; IPVDEIARCATYP; PVDEIARCATYPV; VDEIARCATYPVL; DEIARCATYPVLA; EIARCATYPVLAV; IARCATYPVLAVQ; ARCATYPVLAVQA; RCATYPVLAVQAW; CATYPVLAVQAWA; ATYPVLAVQAWAA; TYPVLAVQAWAAF; YPVLAVQAWAAFH; PVLAVQAWAAFHD; VLAVQAWAAFHDM; LAVQAWAAFHDMT; AVQAWAAFHDMTL; VQAWAAFHDMTLR; QAWAAFHDMTLRA; AWAAFHDMTLRAV; WAAFHDMTLRAVI; AAFHDMTLRAVIG; AFHDMTLRAVIGT; FHDMTLRAVIGTA; HDMTLRAVIGTAE; DMTLRAVIGTAEQ; MTLRAVIGTAEQL; TLRAVIGTAEQLA; LRAVIGTAEQLAS; RAVIGTAEQLASS; AVIGTAEQLASSD; VIGTAEQLASSDP; IGTAEQLASSDPG; GTAEQLASSDPGV; TAEQLASSDPGVA; AEQLASSDPGVAK; EQLASSDPGVAKI; QLASSDPGVAKIV; LASSDPGVAKIVL; ASSDPGVAKIVLE; SSDPGVAKIVLEP; SDPGVAKIVLEPD; DPGVAKIVLEPDD; PGVAKIVLEPDDI; GVAKIVLEPDDIP; VAKIVLEPDDIPE; AKIVLEPDDIPES; KIVLEPDDIPESG; IVLEPDDIPESGK; VLEPDDIPESGKM; LEPDDIPESGKMT; EPDDIPESGKMTG; PDDIPESGKMTGR; DDIPESGKMTGRS; DIPESGKMTGRSR; IPESGKMTGRSRL; PESGKMTGRSRLE; ESGKMTGRSRLEV; SGKMTGRSRLEVV; GKMTGRSRLEVVD; KMTGRSRLEVVDP; MTGRSRLEVVDPS; TGRSRLEVVDPSA; GRSRLEVVDPSAA; RSRLEVVDPSAAA; SRLEVVDPSAAAQ; RLEVVDPSAAAQL; LEVVDPSAAAQLA; EVVDPSAAAQLAD; VVDPSAAAQLADT; VDPSAAAQLADTT; DPSAAAQLADTTD; PSAAAQLADTTDQ; SAAAQLADTTDQR; AAAQLADTTDQRL; AAQLADTTDQRLL; AQLADTTDQRLLD; QLADTTDQRLLDL; LADTTDQRLLDLL; ADTTDQRLLDLLP; DTTDQRLLDLLPP; TTDQRLLDLLPPA; TDQRLLDLLPPAP; DQRLLDLLPPAPV; QRLLDLLPPAPVD; RLLDLLPPAPVDV; LLDLLPPAPVDVN; LDLLPPAPVDVNP; DLLPPAPVDVNPP; | |

Fig. 29 continued

| | | | |
|---|---|---|---|
| | LLPPAPVDVNPPG; LPPAPVDVNPPGD; PPAPVDVNPPGDE; PAPVDVNPPGDER; APVDVNPPGDERH; PVDVNPPGDERHM; VDVNPPGDERHML; DVNPPGDERHMLW; VNPPGDERHMLWF; NPPGDERHMLWFE; PPGDERHMLWFEL; PGDERHMLWFELM; GDERHMLWFELMK; DERHMLWFELMKP; ERHMLWFELMKPM; RHMLWFELMKPMT; HMLWFELMKPMTS; MLWFELMKPMTST; LWFELMKPMTSTA; WFELMKPMTSTAT; FELMKPMTSTATG; ELMKPMTSTATGR; LMKPMTSTATGRE; MKPMTSTATGREA; KPMTSTATGREAA; PMTSTATGREAAH; MTSTATGREAAHL; TSTATGREAAHLR; STATGREAAHLRA; TATGREAAHLRAF; ATGREAAHLRAFR; TGREAAHLRAFRA; GREAAHLRAFRAY; REAAHLRAFRAYA; EAAHLRAFRAYAA; AAHLRAFRAYAAH; AHLRAFRAYAAHS; HLRAFRAYAAHSQ; LRAFRAYAAHSQE; RAFRAYAAHSQEI; AFRAYAAHSQEIA; FRAYAAHSQEIAL; RAYAAHSQEIALH; AYAAHSQEIALHQ; YAAHSQEIALHQA; AAHSQEIALHQAH; AHSQEIALHQAHT; HSQEIALHQAHTA; SQEIALHQAHTAT; QEIALHQAHTATD; EIALHQAHTATDA; IALHQAHTATDAA; ALHQAHTATDAAV; LHQAHTATDAAVQ; HQAHTATDAAVQR; QAHTATDAAVQRV; AHTATDAAVQRVA; HTATDAAVQRVAV; TATDAAVQRVAVA; ATDAAVQRVAVAD; TDAAVQRVAVADW; DAAVQRVAVADWL; AAVQRVAVADWLY; AVQRVAVADWLYW; VQRVAVADWLYWQ; QRVAVADWLYWQY; RVAVADWLYWQYV; VAVADWLYWQYVT; AVADWLYWQYVTG; VADWLYWQYVTGL; ADWLYWQYVTGLL; DWLYWQYVTGLLD; WLYWQYVTGLLDR; LYWQYVTGLLDRA; YWQYVTGLLDRAL; WQYVTGLLDRALA; QYVTGLLDRALAA; YVTGLLDRALAAA; VTGLLDRALAAAC;<br><br>14 mers:<br>MSITRPTGSYARQM; SITRPTGSYARQML; ITRPTGSYARQMLD; TRPTGSYARQMLDP; RPTGSYARQMLDPG; PTGSYARQMLDPGG; TGSYARQMLDPGGW; GSYARQMLDPGGWV; SYARQMLDPGGWVE; YARQMLDPGGWVEA; ARQMLDPGGWVEAD; RQMLDPGGWVEADE; QMLDPGGWVEADED; MLDPGGWVEADEDT; LDPGGWVEADEDTF; DPGGWVEADEDTFY; PGGWVEADEDTFYD; GGWVEADEDTFYDR; GWVEADEDTFYDRA; WVEADEDTFYDRAQ; VEADEDTFYDRAQE; EADEDTFYDRAQEY; ADEDTFYDRAQEYS; DEDTFYDRAQEYSQ; EDTFYDRAQEYSQV; DTFYDRAQEYSQVL; TFYDRAQEYSQVLQ; FYDRAQEYSQVLQR; YDRAQEYSQVLQRV; DRAQEYSQVLQRVT; RAQEYSQVLQRVTD; AQEYSQVLQRVTDV; QEYSQVLQRVTDVL; EYSQVLQRVTDVLD; YSQVLQRVTDVLDT; SQVLQRVTDVLDTC; QVLQRVTDVLDTCR; VLQRVTDVLDTCRQ; LQRVTDVLDTCRQQ; QRVTDVLDTCRQQK; RVTDVLDTCRQQKG; VTDVLDTCRQQKGH; TDVLDTCRQQKGHV; DVLDTCRQQKGHVF; VLDTCRQQKGHVFE; LDTCRQQKGHVFEG; DTCRQQKGHVFEGG; TCRQQKGHVFEGGL; CRQQKGHVFEGGLW; RQQKGHVFEGGLWS; QQKGHVFEGGLWSG; QKGHVFEGGLWSGG; KGHVFEGGLWSGGA; GHVFEGGLWSGGAA; HVFEGGLWSGGAAN; VFEGGLWSGGAANA; FEGGLWSGGAANAA; EGGLWSGGAANAAN; GGLWSGGAANAANG; GLWSGGAANAANGA; LWSGGAANAANGAL; WSGGAANAANGALG; SGGAANAANGALGA; GGAANAANGALGAN; GAANAANGALGANI; AANAANGALGANIN; ANAANGALGANINQ; NAANGALGANINQL; AANGALGANINQLM; ANGALGANINQLMT; NGALGANINQLMTL; GALGANINQLMTLQ; ALGANINQLMTLQD; LGANINQLMTLQDY; GANINQLMTLQDYL; ANINQLMTLQDYLA; NINQLMTLQDYLAT; INQLMTLQDYLATV; NQLMTLQDYLATVI; QLMTLQDYLATVIT; LMTLQDYLATVITW; | | |

Fig. 29 continued

| | | | |
|---|---|---|---|
| | MTLQDYLATVITWH; TLQDYLATVITWHR; LQDYLATVITWHRH;<br>QDYLATVITWHRHI; DYLATVITWHRHIA; YLATVITWHRHIAG;<br>LATVITWHRHIAGL; ATVITWHRHIAGLI; TVITWHRHIAGLIE; VITWHRHIAGLIEQ;<br>ITWHRHIAGLIEQA; TWHRHIAGLIEQAK; WHRHIAGLIEQAKS;<br>HRHIAGLIEQAKSD; RHIAGLIEQAKSDI; HIAGLIEQAKSDIG; IAGLIEQAKSDIGN;<br>AGLIEQAKSDIGNN; GLIEQAKSDIGNNV; LIEQAKSDIGNNVD;<br>IEQAKSDIGNNVDG; EQAKSDIGNNVDGA; QAKSDIGNNVDGAQ;<br>AKSDIGNNVDGAQR; KSDIGNNVDGAQRE; SDIGNNVDGAQREI;<br>DIGNNVDGAQREID; IGNNVDGAQREIDI; GNNVDGAQREIDIL;<br>NNVDGAQREIDILE; NVDGAQREIDILEN; VDGAQREIDILEND;<br>DGAQREIDILENDP; GAQREIDILENDPS; AQREIDILENDPSL; QREIDILENDPSLD;<br>REIDILENDPSLDA; EIDILENDPSLDAD; IDILENDPSLDADE; DILENDPSLDADER;<br>ILENDPSLDADERH; LENDPSLDADERHT; ENDPSLDADERHTA;<br>NDPSLDADERHTAI; DPSLDADERHTAIN; PSLDADERHTAINS;<br>SLDADERHTAINSL; LDADERHTAINSLV; DADERHTAINSLVT;<br>ADERHTAINSLVTA; DERHTAINSLVTAT; ERHTAINSLVTATH;<br>RHTAINSLVTATHG; HTAINSLVTATHGA; TAINSLVTATHGAN;<br>AINSLVTATHGANV; INSLVTATHGANVS; NSLVTATHGANVSL;<br>SLVTATHGANVSLV; LVTATHGANVSLVA; VTATHGANVSLVAE;<br>TATHGANVSLVAET; ATHGANVSLVAETA; THGANVSLVAETAE;<br>HGANVSLVAETAER; GANVSLVAETAERV; ANVSLVAETAERVL;<br>NVSLVAETAERVLE; VSLVAETAERVLES; SLVAETAERVLESK;<br>LVAETAERVLESKN; VAETAERVLESKNW; AETAERVLESKNWK;<br>ETAERVLESKNWKP; TAERVLESKNWKPP; AERVLESKNWKPPK;<br>ERVLESKNWKPPKN; RVLESKNWKPPKNA; VLESKNWKPPKNAL;<br>LESKNWKPPKNALE; ESKNWKPPKNALED; SKNWKPPKNALEDL;<br>KNWKPPKNALEDLL; NWKPPKNALEDLLQ; WKPPKNALEDLLQQ;<br>KPPKNALEDLLQQK; PPKNALEDLLQQKS; PKNALEDLLQQKSP;<br>KNALEDLLQQKSPP; NALEDLLQQKSPPP; ALEDLLQQKSPPPP;<br>LEDLLQQKSPPPPD; EDLLQQKSPPPPDV; DLLQQKSPPPPDVP;<br>LLQQKSPPPPDVPT; LQQKSPPPPDVPTL; QQKSPPPPDVPTLV;<br>QKSPPPPDVPTLVV; KSPPPPDVPTLVVP; SPPPPDVPTLVVPS;<br>PPPPDVPTLVVPSP; PPPDVPTLVVPSPG; PPDVPTLVVPSPGT;<br>PDVPTLVVPSPGTP; DVPTLVVPSPGTPG; VPTLVVPSPGTPGT;<br>PTLVVPSPGTPGTP; TLVVPSPGTPGTPG; LVVPSPGTPGTPGT;<br>VVPSPGTPGTPGTP; VPSPGTPGTPGTPI; PSPGTPGTPGTPIT;<br>SPGTPGTPGTPITP; PGTPGTPGTPITPG; GTPGTPGTPITPGT;<br>TPGTPGTPITPGTP; PGTPGTPITPGTPI; GTPGTPITPGTPIT; TPGTPITPGTPITP;<br>PGTPITPGTPITPG; GTPITPGTPITPGT; TPITPGTPITPGTP; PITPGTPITPGTPI;<br>ITPGTPITPGTPIT; TPGTPITPGTPITP; PGTPITPGTPITPI; GTPITPGTPITPIP;<br>TPITPGTPITPIPG; PITPGTPITPIPGA; ITPGTPITPIPGAP; TPGTPITPIPGAPV;<br>PGTPITPIPGAPVT; GTPITPIPGAPVTP; TPITPIPGAPVTPI; PITPIPGAPVTPIT;<br>ITPIPGAPVTPITP; TPIPGAPVTPITPT; PIPGAPVTPITPTP; IPGAPVTPITPTPG;<br>PGAPVTPITPTPGT; GAPVTPITPTPGTP; APVTPITPTPGTPV;<br>PVTPITPTPGTPVT; VTPITPTPGTPVTP; TPITPTPGTPVTPV; PITPTPGTPVTPVT;<br>ITPTPGTPVTPVTP; TPTPGTPVTPVTPG; PTPGTPVTPVTPGK;<br>TPGTPVTPVTPGKP; PGTPVTPVTPGKPV; GTPVTPVTPGKPVT;<br>TPVTPVTPGKPVTP; PVTPVTPGKPVTPV; VTPVTPGKPVTPVT;<br>TPVTPGKPVTPVTP; PVTPGKPVTPVTPV; VTPGKPVTPVTPVK;<br>TPGKPVTPVTPVKP; PGKPVTPVTPVKPG; GKPVTPVTPVKPGT;<br>KPVTPVTPVKPGTP; PVTPVTPVKPGTPG; VTPVTPVKPGTPGE;<br>TPVTPVKPGTPGEP; PVTPVKPGTPGEPT; VTPVKPGTPGEPTP;<br>TPVKPGTPGEPTPI; PVKPGTPGEPTPIT; VKPGTPGEPTPITP; | |

Fig. 29 continued

| | | |
|---|---|---|
| | KPGTPGEPTPITPV; PGTPGEPTPITPVT; GTPGEPTPITPVTP;<br>TPGEPTPITPVTPP; PGEPTPITPVTPPV; GEPTPITPVTPPVA; EPTPITPVTPPVAP;<br>PTPITPVTPPVAPA; TPITPVTPPVAPAT; PITPVTPPVAPATP; ITPVTPPVAPATPA;<br>TPVTPPVAPATPAT; PVTPPVAPATPATP; VTPPVAPATPATPA;<br>TPPVAPATPATPAT; PPVAPATPATPATP; PVAPATPATPATPV;<br>VAPATPATPATPVT; APATPATPATPVTP; PATPATPATPVTPA;<br>ATPATPATPVTPAP; TPATPATPVTPAPA; PATPATPVTPAPAP;<br>ATPATPVTPAPAPH; TPATPVTPAPAPHP; PATPVTPAPAPHPQ;<br>ATPVTPAPAPHPQP; TPVTPAPAPHPQPA; PVTPAPAPHPQPAP;<br>VTPAPAPHPQPAPA; TPAPAPHPQPAPAP; PAPAPHPQPAPAPA;<br>APAPHPQPAPAPAP; PAPHPQPAPAPAPS; APHPQPAPAPAPSP;<br>PHPQPAPAPAPSPG; HPQPAPAPAPSPGP; PQPAPAPAPSPGPQ;<br>QPAPAPAPSPGPQP; PAPAPAPSPGPQPV; APAPAPSPGPQPVT;<br>PAPAPSPGPQPVTP; APAPSPGPQPVTPA; PAPSPGPQPVTPAT;<br>APSPGPQPVTPATP; PSPGPQPVTPATPG; SPGPQPVTPATPGP;<br>PGPQPVTPATPGPS; GPQPVTPATPGPSG; PQPVTPATPGPSGP;<br>QPVTPATPGPSGPA; PVTPATPGPSGPAT; VTPATPGPSGPATP;<br>TPATPGPSGPATPG; PATPGPSGPATPGT; ATPGPSGPATPGTP;<br>TPGPSGPATPGTPG; PGPSGPATPGTPGG; GPSGPATPGTPGGE;<br>PSGPATPGTPGGEP; SGPATPGTPGGEPA; GPATPGTPGGEPAP;<br>PATPGTPGGEPAPH; ATPGTPGGEPAPHV; TPGTPGGEPAPHVK;<br>PGTPGGEPAPHVKP; GTPGGEPAPHVKPA; TPGGEPAPHVKPAA;<br>PGGEPAPHVKPAAL; GGEPAPHVKPAALA; GEPAPHVKPAALAE;<br>EPAPHVKPAALAEQ; PAPHVKPAALAEQP; APHVKPAALAEQPG;<br>PHVKPAALAEQPGV; HVKPAALAEQPGVP; VKPAALAEQPGVPG;<br>KPAALAEQPGVPGQ; PAALAEQPGVPGQH; AALAEQPGVPGQHA;<br>ALAEQPGVPGQHAG; LAEQPGVPGQHAGG; AEQPGVPGQHAGGG;<br>EQPGVPGQHAGGGT; QPGVPGQHAGGGTQ; PGVPGQHAGGGTQS;<br>GVPGQHAGGGTQSG; VPGQHAGGGTQSGP; PGQHAGGGTQSGPA;<br>GQHAGGGTQSGPAH; QHAGGGTQSGPAHA; HAGGGTQSGPAHAD;<br>AGGGTQSGPAHADE; GGGTQSGPAHADES; GGTQSGPAHADESA;<br>GTQSGPAHADESAA; TQSGPAHADESAAS; QSGPAHADESAASV;<br>SGPAHADESAASVT; GPAHADESAASVTP; PAHADESAASVTPA;<br>AHADESAASVTPAA; HADESAASVTPAAA; ADESAASVTPAAAS;<br>DESAASVTPAAASG; ESAASVTPAAASGV; SAASVTPAAASGVP;<br>AASVTPAAASGVPG; ASVTPAAASGVPGA; SVTPAAASGVPGAR;<br>VTPAAASGVPGARA; TPAAASGVPGARAA; PAAASGVPGARAAA;<br>AAASGVPGARAAAA; AASGVPGARAAAAA; ASGVPGARAAAAAP;<br>SGVPGARAAAAAPS; GVPGARAAAAAPSG; VPGARAAAAAPSGT;<br>PGARAAAAAPSGTA; GARAAAAAPSGTAV; ARAAAAAPSGTAVG;<br>RAAAAAPSGTAVGA; AAAAAPSGTAVGAG; AAAAPSGTAVGAGA;<br>AAAPSGTAVGAGAR; AAPSGTAVGAGARS; APSGTAVGAGARSS;<br>PSGTAVGAGARSSV; SGTAVGAGARSSVG; GTAVGAGARSSVGT;<br>TAVGAGARSSVGTA; AVGAGARSSVGTAA; VGAGARSSVGTAAA;<br>GAGARSSVGTAAAS; AGARSSVGTAAASG; GARSSVGTAAASGA;<br>ARSSVGTAAASGAG; RSSVGTAAASGAGS; SSVGTAAASGAGSH;<br>SVGTAAASGAGSHA; VGTAAASGAGSHAA; GTAAASGAGSHAAT;<br>TAAASGAGSHAATG; AAASGAGSHAATGR; AASGAGSHAATGRA;<br>ASGAGSHAATGRAP; SGAGSHAATGRAPV; GAGSHAATGRAPVA;<br>AGSHAATGRAPVAT; GSHAATGRAPVATS; SHAATGRAPVATSD;<br>HAATGRAPVATSDK; AATGRAPVATSDKA; ATGRAPVATSDKAA;<br>TGRAPVATSDKAAA; GRAPVATSDKAAAP; RAPVATSDKAAAPS;<br>APVATSDKAAAPST; PVATSDKAAAPSTR; VATSDKAAAPSTRA; | |

Fig. 29 continued

| | | | |
|---|---|---|---|
| | ATSDKAAAPSTRAA; TSDKAAAPSTRAAS; SDKAAAPSTRAASA; DKAAAPSTRAASAR; KAAAPSTRAASART; AAAPSTRAASARTA; AAPSTRAASARTAP; APSTRAASARTAPP; PSTRAASARTAPPA; STRAASARTAPPAR; TRAASARTAPPARP; RAASARTAPPARPP; AASARTAPPARPPS; ASARTAPPARPPST; SARTAPPARPPSTD; ARTAPPARPPSTDH; RTAPPARPPSTDHI; TAPPARPPSTDHID; APPARPPSTDHIDK; PPARPPSTDHIDKP; PARPPSTDHIDKPD; ARPPSTDHIDKPDR; RPPSTDHIDKPDRS; PPSTDHIDKPDRSE; PSTDHIDKPDRSES; STDHIDKPDRSESA; TDHIDKPDRSESAD; DHIDKPDRSESADD; HIDKPDRSESADDG; IDKPDRSESADDGT; DKPDRSESADDGTP; KPDRSESADDGTPV; PDRSESADDGTPVS; DRSESADDGTPVSM; RSESADDGTPVSMI; SESADDGTPVSMIP; ESADDGTPVSMIPV; SADDGTPVSMIPVS; ADDGTPVSMIPVSA; DDGTPVSMIPVSAA; DGTPVSMIPVSAAR; GTPVSMIPVSAARA; TPVSMIPVSAARAA; PVSMIPVSAARAAR; VSMIPVSAARAARD; SMIPVSAARAARDA; MIPVSAARAARDAA; IPVSAARAARDAAT; PVSAARAARDAATA; VSAARAARDAATAA; SAARAARDAATAAA; AARAARDAATAAAS; ARAARDAATAAASA; RAARDAATAAASAR; AARDAATAAASARQ; ARDAATAAASARQR; RDAATAAASARQRG; DAATAAASARQRGR; AATAAASARQRGRG; ATAAASARQRGRGD; TAAASARQRGRGDA; AAASARQRGRGDAL; AASARQRGRGDALR; ASARQRGRGDALRL; SARQRGRGDALRLA; ARQRGRGDALRLAR; RQRGRGDALRLARR; QRGRGDALRLARRI; RGRGDALRLARRIA; GRGDALRLARRIAA; RGDALRLARRIAAA; GDALRLARRIAAAL; DALRLARRIAAALN; ALRLARRIAAALNA; LRLARRIAAALNAS; RLARRIAAALNASD; LARRIAAALNASDN; ARRIAAALNASDNN; RRIAAALNASDNNA; RIAAALNASDNNAG; IAAALNASDNNAGD; AAALNASDNNAGDY; AALNASDNNAGDYG; ALNASDNNAGDYGF; LNASDNNAGDYGFF; NASDNNAGDYGFFW; ASDNNAGDYGFFWI; SDNNAGDYGFFWIT; DNNAGDYGFFWITA; NNAGDYGFFWITAV; NAGDYGFFWITAVT; AGDYGFFWITAVTT; GDYGFFWITAVTTD; DYGFFWITAVTTDG; YGFFWITAVTTDGS; GFFWITAVTTDGSI; FFWITAVTTDGSIV; FWITAVTTDGSIVV; WITAVTTDGSIVVA; ITAVTTDGSIVVAN; TAVTTDGSIVVANS; AVTTDGSIVVANSY; VTTDGSIVVANSYG; TTDGSIVVANSYGL; TDGSIVVANSYGLA; DGSIVVANSYGLAY; GSIVVANSYGLAYI; SIVVANSYGLAYIP; IVVANSYGLAYIPD; VVANSYGLAYIPDG; VANSYGLAYIPDGM; ANSYGLAYIPDGME; NSYGLAYIPDGMEL; SYGLAYIPDGMELP; YGLAYIPDGMELPN; GLAYIPDGMELPNK; LAYIPDGMELPNKV; AYIPDGMELPNKVY; YIPDGMELPNKVYL; IPDGMELPNKVYLA; PDGMELPNKVYLAS; DGMELPNKVYLASA; GMELPNKVYLASAD; MELPNKVYLASADH; ELPNKVYLASADHA; LPNKVYLASADHAI; PNKVYLASADHAIP; NKVYLASADHAIPV; KVYLASADHAIPVD; VYLASADHAIPVDE; YLASADHAIPVDEI; LASADHAIPVDEIA; ASADHAIPVDEIAR; SADHAIPVDEIARC; ADHAIPVDEIARCA; DHAIPVDEIARCAT; HAIPVDEIARCATY; AIPVDEIARCATYP; IPVDEIARCATYPV; PVDEIARCATYPVL; VDEIARCATYPVLA; DEIARCATYPVLAV; EIARCATYPVLAVQ; IARCATYPVLAVQA; ARCATYPVLAVQAW; RCATYPVLAVQAWA; CATYPVLAVQAWAA; ATYPVLAVQAWAAF; TYPVLAVQAWAAFH; YPVLAVQAWAAFHD; PVLAVQAWAAFHDM; VLAVQAWAAFHDMT; LAVQAWAAFHDMTL; AVQAWAAFHDMTLR; VQAWAAFHDMTLRA; QAWAAFHDMTLRAV; AWAAFHDMTLRAVI; WAAFHDMTLRAVIG; AAFHDMTLRAVIGT; AFHDMTLRAVIGTA; FHDMTLRAVIGTAE; HDMTLRAVIGTAEQ; DMTLRAVIGTAEQL; MTLRAVIGTAEQLA; | |

Fig. 29 continued

| | | |
|---|---|---|
| | TLRAVIGTAEQLAS; LRAVIGTAEQLASS; RAVIGTAEQLASSD; AVIGTAEQLASSDP; VIGTAEQLASSDPG; IGTAEQLASSDPGV; GTAEQLASSDPGVA; TAEQLASSDPGVAK; AEQLASSDPGVAKI; EQLASSDPGVAKIV; QLASSDPGVAKIVL; LASSDPGVAKIVLE; ASSDPGVAKIVLEP; SSDPGVAKIVLEPD; SDPGVAKIVLEPDD; DPGVAKIVLEPDDI; PGVAKIVLEPDDIP; GVAKIVLEPDDIPE; VAKIVLEPDDIPES; AKIVLEPDDIPESG; KIVLEPDDIPESGK; IVLEPDDIPESGKM; VLEPDDIPESGKMT; LEPDDIPESGKMTG; EPDDIPESGKMTGR; PDDIPESGKMTGRS; DDIPESGKMTGRSR; DIPESGKMTGRSRL; IPESGKMTGRSRLE; PESGKMTGRSRLEV; ESGKMTGRSRLEVV; SGKMTGRSRLEVVD; GKMTGRSRLEVVDP; KMTGRSRLEVVDPS; MTGRSRLEVVDPSA; TGRSRLEVVDPSAA; GRSRLEVVDPSAAA; RSRLEVVDPSAAAQ; SRLEVVDPSAAAQL; RLEVVDPSAAAQLA; LEVVDPSAAAQLAD; EVVDPSAAAQLADT; VVDPSAAAQLADTT; VDPSAAAQLADTTD; DPSAAAQLADTTDQ; PSAAAQLADTTDQR; SAAAQLADTTDQRL; AAAQLADTTDQRLL; AAQLADTTDQRLLD; AQLADTTDQRLLDL; QLADTTDQRLLDLL; LADTTDQRLLDLLP; ADTTDQRLLDLLPP; DTTDQRLLDLLPPA; TTDQRLLDLLPPAP; TDQRLLDLLPPAPV; DQRLLDLLPPAPVD; QRLLDLLPPAPVDV; RLLDLLPPAPVDVN; LLDLLPPAPVDVNP; LDLLPPAPVDVNPP; DLLPPAPVDVNPPG; LLPPAPVDVNPPGD; LPPAPVDVNPPGDE; PPAPVDVNPPGDER; PAPVDVNPPGDERH; APVDVNPPGDERHM; PVDVNPPGDERHML; VDVNPPGDERHMLW; DVNPPGDERHMLWF; VNPPGDERHMLWFE; NPPGDERHMLWFEL; PPGDERHMLWFELM; PGDERHMLWFELMK; GDERHMLWFELMKP; DERHMLWFELMKPM; ERHMLWFELMKPMT; RHMLWFELMKPMTS; HMLWFELMKPMTST; MLWFELMKPMTSTA; LWFELMKPMTSTAT; WFELMKPMTSTATG; FELMKPMTSTATGR; ELMKPMTSTATGRE; LMKPMTSTATGREA; MKPMTSTATGREAA; KPMTSTATGREAAH; PMTSTATGREAAHL; MTSTATGREAAHLR; TSTATGREAAHLRA; STATGREAAHLRAF; TATGREAAHLRAFR; ATGREAAHLRAFRA; TGREAAHLRAFRAY; GREAAHLRAFRAYA; REAAHLRAFRAYAA; EAAHLRAFRAYAAH; AAHLRAFRAYAAHS; AHLRAFRAYAAHSQ; HLRAFRAYAAHSQE; LRAFRAYAAHSQEI; RAFRAYAAHSQEIA; AFRAYAAHSQEIAL; FRAYAAHSQEIALH; RAYAAHSQEIALHQ; AYAAHSQEIALHQA; YAAHSQEIALHQAH; AAHSQEIALHQAHT; AHSQEIALHQAHTA; HSQEIALHQAHTAT; SQEIALHQAHTATD; QEIALHQAHTATDA; EIALHQAHTATDAA; IALHQAHTATDAAV; ALHQAHTATDAAVQ; LHQAHTATDAAVQR; HQAHTATDAAVQRV; QAHTATDAAVQRVA; AHTATDAAVQRVAV; HTATDAAVQRVAVA; TATDAAVQRVAVAD; ATDAAVQRVAVADW; TDAAVQRVAVADWL; DAAVQRVAVADWLY; AAVQRVAVADWLYW; AVQRVAVADWLYWQ; VQRVAVADWLYWQY; QRVAVADWLYWQYV; RVAVADWLYWQYVT; VAVADWLYWQYVTG; AVADWLYWQYVTGL; VADWLYWQYVTGLL; ADWLYWQYVTGLLD; DWLYWQYVTGLLDR; WLYWQYVTGLLDRA; LYWQYVTGLLDRAL; YWQYVTGLLDRALA; WQYVTGLLDRALAA; QYVTGLLDRALAAA; YVTGLLDRALAAAC;<br><br>15 mers:<br>MSITRPTGSYARQML; SITRPTGSYARQMLD; ITRPTGSYARQMLDP; TRPTGSYARQMLDPG; RPTGSYARQMLDPGG; PTGSYARQMLDPGGW; TGSYARQMLDPGGWV; GSYARQMLDPGGWVE; SYARQMLDPGGWVEA; YARQMLDPGGWVEAD; ARQMLDPGGWVEADE; RQMLDPGGWVEADED; QMLDPGGWVEADEDT; MLDPGGWVEADEDTF; LDPGGWVEADEDTFY; | |

Fig. 29 continued

| | | | |
|---|---|---|---|
| | DPGGWVEADEDTFYD; PGGWVEADEDTFYDR; GGWVEADEDTFYDRA; GWVEADEDTFYDRAQ; WVEADEDTFYDRAQE; VEADEDTFYDRAQEY; EADEDTFYDRAQEYS; ADEDTFYDRAQEYSQ; DEDTFYDRAQEYSQV; EDTFYDRAQEYSQVL; DTFYDRAQEYSQVLQ; TFYDRAQEYSQVLQR; FYDRAQEYSQVLQRV; YDRAQEYSQVLQRVT; DRAQEYSQVLQRVTD; RAQEYSQVLQRVTDV; AQEYSQVLQRVTDVL; QEYSQVLQRVTDVLD; EYSQVLQRVTDVLDT; YSQVLQRVTDVLDTC; SQVLQRVTDVLDTCR; QVLQRVTDVLDTCRQ; VLQRVTDVLDTCRQQ; LQRVTDVLDTCRQQK; QRVTDVLDTCRQQKG; RVTDVLDTCRQQKGH; VTDVLDTCRQQKGHV; TDVLDTCRQQKGHVF; DVLDTCRQQKGHVFE; VLDTCRQQKGHVFEG; LDTCRQQKGHVFEGG; DTCRQQKGHVFEGGL; TCRQQKGHVFEGGLW; CRQQKGHVFEGGLWS; RQQKGHVFEGGLWSG; QQKGHVFEGGLWSGG; QKGHVFEGGLWSGGA; KGHVFEGGLWSGGAA; GHVFEGGLWSGGAAN; HVFEGGLWSGGAANA; VFEGGLWSGGAANAA; FEGGLWSGGAANAAN; EGGLWSGGAANAANG; GGLWSGGAANAANGA; GLWSGGAANAANGAL; LWSGGAANAANGALG; WSGGAANAANGALGA; SGGAANAANGALGAN; GGAANAANGALGANI; GAANAANGALGANIN; AANAANGALGANINQ; ANAANGALGANINQL; NAANGALGANINQLM; AANGALGANINQLMT; ANGALGANINQLMTL; NGALGANINQLMTLQ; GALGANINQLMTLQD; ALGANINQLMTLQDY; LGANINQLMTLQDYL; GANINQLMTLQDYLA; ANINQLMTLQDYLAT; NINQLMTLQDYLATV; INQLMTLQDYLATVI; NQLMTLQDYLATVIT; QLMTLQDYLATVITW; LMTLQDYLATVITWH; MTLQDYLATVITWHR; TLQDYLATVITWHRH; LQDYLATVITWHRHI; QDYLATVITWHRHIA; DYLATVITWHRHIAG; YLATVITWHRHIAGL; LATVITWHRHIAGLI; ATVITWHRHIAGLIE; TVITWHRHIAGLIEQ; VITWHRHIAGLIEQA; ITWHRHIAGLIEQAK; TWHRHIAGLIEQAKS; WHRHIAGLIEQAKSD; HRHIAGLIEQAKSDI; RHIAGLIEQAKSDIG; HIAGLIEQAKSDIGN; IAGLIEQAKSDIGNN; AGLIEQAKSDIGNNV; GLIEQAKSDIGNNVD; LIEQAKSDIGNNVDG; IEQAKSDIGNNVDGA; EQAKSDIGNNVDGAQ; QAKSDIGNNVDGAQR; AKSDIGNNVDGAQRE; KSDIGNNVDGAQREI; SDIGNNVDGAQREID; DIGNNVDGAQREIDI; IGNNVDGAQREIDIL; GNNVDGAQREIDILE; NNVDGAQREIDILEN; NVDGAQREIDILEND; VDGAQREIDILENDP; DGAQREIDILENDPS; GAQREIDILENDPSL; AQREIDILENDPSLD; QREIDILENDPSLDA; REIDILENDPSLDAD; EIDILENDPSLDADE; IDILENDPSLDADER; DILENDPSLDADERH; ILENDPSLDADERHT; LENDPSLDADERHTA; ENDPSLDADERHTAI; NDPSLDADERHTAIN; DPSLDADERHTAINS; PSLDADERHTAINSL; SLDADERHTAINSLV; LDADERHTAINSLVT; DADERHTAINSLVTA; ADERHTAINSLVTAT; DERHTAINSLVTATH; ERHTAINSLVTATHG; RHTAINSLVTATHGA; HTAINSLVTATHGAN; TAINSLVTATHGANV; AINSLVTATHGANVS; INSLVTATHGANVSL; NSLVTATHGANVSLV; SLVTATHGANVSLVA; LVTATHGANVSLVAE; VTATHGANVSLVAET; TATHGANVSLVAETA; ATHGANVSLVAETAE; THGANVSLVAETAER; HGANVSLVAETAERV; GANVSLVAETAERVL; ANVSLVAETAERVLE; NVSLVAETAERVLES; VSLVAETAERVLESK; SLVAETAERVLESKN; LVAETAERVLESKNW; VAETAERVLESKNWK; AETAERVLESKNWKP; ETAERVLESKNWKPP; TAERVLESKNWKPPK; AERVLESKNWKPPKN; ERVLESKNWKPPKNA; RVLESKNWKPPKNAL; VLESKNWKPPKNALE; LESKNWKPPKNALED; ESKNWKPPKNALEDL; SKNWKPPKNALEDLL; KNWKPPKNALEDLLQ; NWKPPKNALEDLLQQ; WKPPKNALEDLLQQK; KPPKNALEDLLQQKS; PPKNALEDLLQQKSP; PKNALEDLLQQKSPP; KNALEDLLQQKSPPP; NALEDLLQQKSPPPP; ALEDLLQQKSPPPPD; LEDLLQQKSPPPPDV; EDLLQQKSPPPPDVP; | | |

Fig. 29 continued

| | | |
|---|---|---|
| | DLLQQKSPPPPDVPT; LLQQKSPPPPDVPTL; LQQKSPPPPDVPTLV; QQKSPPPPDVPTLVV; QKSPPPPDVPTLVVP; KSPPPPDVPTLVVPS; SPPPPDVPTLVVPSP; PPPPDVPTLVVPSPG; PPPDVPTLVVPSPGT; PPDVPTLVVPSPGTP; PDVPTLVVPSPGTPG; DVPTLVVPSPGTPGT; VPTLVVPSPGTPGTP; PTLVVPSPGTPGTPG; TLVVPSPGTPGTPGT; LVVPSPGTPGTPGTP; VVPSPGTPGTPGTPI; VPSPGTPGTPGTPIT; PSPGTPGTPGTPITP; SPGTPGTPGTPITPG; PGTPGTPGTPITPGT; GTPGTPGTPITPGTP; TPGTPGTPITPGTPI; PGTPGTPITPGTPIT; GTPGTPITPGTPITP; TPGTPITPGTPITPG; PGTPITPGTPITPGT; GTPITPGTPITPGTP; TPITPGTPITPGTPI; PITPGTPITPGTPIT; ITPGTPITPGTPITP; TPGTPITPGTPITPI; PGTPITPGTPITPIP; GTPITPGTPITPIPG; TPITPGTPITPIPGA; PITPGTPITPIPGAP; ITPGTPITPIPGAPV; TPGTPITPIPGAPVT; PGTPITPIPGAPVTP; GTPITPIPGAPVTPI; TPITPIPGAPVTPIT; PITPIPGAPVTPITP; ITPIPGAPVTPITPT; TPIPGAPVTPITPTP; PIPGAPVTPITPTPG; IPGAPVTPITPTPGT; PGAPVTPITPTPGTP; GAPVTPITPTPGTPV; APVTPITPTPGTPVT; PVTPITPTPGTPVTP; VTPITPTPGTPVTPV; TPITPTPGTPVTPVT; PITPTPGTPVTPVTP; ITPTPGTPVTPVTPG; TPTPGTPVTPVTPGK; PTPGTPVTPVTPGKP; TPGTPVTPVTPGKPV; PGTPVTPVTPGKPVT; GTPVTPVTPGKPVTP; TPVTPVTPGKPVTPV; PVTPVTPGKPVTPVT; VTPVTPGKPVTPVTP; TPVTPGKPVTPVTPV; PVTPGKPVTPVTPVK; VTPGKPVTPVTPVKP; TPGKPVTPVTPVKPG; PGKPVTPVTPVKPGT; GKPVTPVTPVKPGTP; KPVTPVTPVKPGTPG; PVTPVTPVKPGTPGE; VTPVTPVKPGTPGEP; TPVTPVKPGTPGEPT; PVTPVKPGTPGEPTP; VTPVKPGTPGEPTPI; TPVKPGTPGEPTPIT; PVKPGTPGEPTPITP; VKPGTPGEPTPITPV; KPGTPGEPTPITPVT; PGTPGEPTPITPVTP; GTPGEPTPITPVTPP; TPGEPTPITPVTPPV; PGEPTPITPVTPPVA; GEPTPITPVTPPVAP; EPTPITPVTPPVAPA; PTPITPVTPPVAPAT; TPITPVTPPVAPATP; PITPVTPPVAPATPA; ITPVTPPVAPATPAT; TPVTPPVAPATPATP; PVTPPVAPATPATPA; VTPPVAPATPATPAT; TPPVAPATPATPATP; PPVAPATPATPATPV; PVAPATPATPATPVT; VAPATPATPATPVTP; APATPATPATPVTPA; PATPATPATPVTPAP; ATPATPATPVTPAPA; TPATPATPVTPAPAP; PATPATPVTPAPAPH; ATPATPVTPAPAPHP; TPATPVTPAPAPHPQ; PATPVTPAPAPHPQP; ATPVTPAPAPHPQPA; TPVTPAPAPHPQPAP; PVTPAPAPHPQPAPA; VTPAPAPHPQPAPAP; TPAPAPHPQPAPAPA; PAPAPHPQPAPAPAP; APAPHPQPAPAPAPS; PAPHPQPAPAPAPSP; APHPQPAPAPAPSPG; PHPQPAPAPAPSPGP; HPQPAPAPAPSPGPQ; PQPAPAPAPSPGPQP; QPAPAPAPSPGPQPV; PAPAPAPSPGPQPVT; APAPAPSPGPQPVTP; PAPAPSPGPQPVTPA; APAPSPGPQPVTPAT; PAPSPGPQPVTPATP; APSPGPQPVTPATPG; PSPGPQPVTPATPGP; SPGPQPVTPATPGPS; PGPQPVTPATPGPSG; GPQPVTPATPGPSGP; PQPVTPATPGPSGPA; QPVTPATPGPSGPAT; PVTPATPGPSGPATP; VTPATPGPSGPATPG; TPATPGPSGPATPGT; PATPGPSGPATPGTP; ATPGPSGPATPGTPG; TPGPSGPATPGTPGG; PGPSGPATPGTPGGE; GPSGPATPGTPGGEP; PSGPATPGTPGGEPA; SGPATPGTPGGEPAP; GPATPGTPGGEPAPH; PATPGTPGGEPAPHV; ATPGTPGGEPAPHVK; TPGTPGGEPAPHVKP; PGTPGGEPAPHVKPA; GTPGGEPAPHVKPAA; TPGGEPAPHVKPAAL; PGGEPAPHVKPAALA; GGEPAPHVKPAALAE; GEPAPHVKPAALAEQ; EPAPHVKPAALAEQP; PAPHVKPAALAEQPG; APHVKPAALAEQPGV; PHVKPAALAEQPGVP; HVKPAALAEQPGVPG; VKPAALAEQPGVPGQ; KPAALAEQPGVPGQH; PAALAEQPGVPGQHA; AALAEQPGVPGQHAG; ALAEQPGVPGQHAGG; LAEQPGVPGQHAGGG; AEQPGVPGQHAGGGT; EQPGVPGQHAGGGTQ; | |

Fig. 29 continued

| | | |
|---|---|---|
| | QPGVPGQHAGGGTQS; PGVPGQHAGGGTQSG; GVPGQHAGGGTQSGP;<br>VPGQHAGGGTQSGPA; PGQHAGGGTQSGPAH; GQHAGGGTQSGPAHA;<br>QHAGGGTQSGPAHAD; HAGGGTQSGPAHADE; AGGGTQSGPAHADES;<br>GGGTQSGPAHADESA; GGTQSGPAHADESAA; GTQSGPAHADESAAS;<br>TQSGPAHADESAASV; QSGPAHADESAASVT; SGPAHADESAASVTP;<br>GPAHADESAASVTPA; PAHADESAASVTPAA; AHADESAASVTPAAA;<br>HADESAASVTPAAAS; ADESAASVTPAAASG; DESAASVTPAAASGV;<br>ESAASVTPAAASGVP; SAASVTPAAASGVPG; AASVTPAAASGVPGA;<br>ASVTPAAASGVPGAR; SVTPAAASGVPGARA; VTPAAASGVPGARAA;<br>TPAAASGVPGARAAA; PAAASGVPGARAAAA; AAASGVPGARAAAAA;<br>AASGVPGARAAAAAP; ASGVPGARAAAAAPS; SGVPGARAAAAAPSG;<br>GVPGARAAAAAPSGT; VPGARAAAAAPSGTA; PGARAAAAAPSGTAV;<br>GARAAAAAPSGTAVG; ARAAAAAPSGTAVGA; RAAAAAPSGTAVGAG;<br>AAAAAPSGTAVGAGA; AAAAPSGTAVGAGAR; AAAPSGTAVGAGARS;<br>AAPSGTAVGAGARSS; APSGTAVGAGARSSV; PSGTAVGAGARSSVG;<br>SGTAVGAGARSSVGT; GTAVGAGARSSVGTA; TAVGAGARSSVGTAA;<br>AVGAGARSSVGTAAA; VGAGARSSVGTAAAS; GAGARSSVGTAAASG;<br>AGARSSVGTAAASGA; GARSSVGTAAASGAG; ARSSVGTAAASGAGS;<br>RSSVGTAAASGAGSH; SSVGTAAASGAGSHA; SVGTAAASGAGSHAA;<br>VGTAAASGAGSHAAT; GTAAASGAGSHAATG; TAAASGAGSHAATGR;<br>AAASGAGSHAATGRA; AASGAGSHAATGRAP; ASGAGSHAATGRAPV;<br>SGAGSHAATGRAPVA; GAGSHAATGRAPVAT; AGSHAATGRAPVATS;<br>GSHAATGRAPVATSD; SHAATGRAPVATSDK; HAATGRAPVATSDKA;<br>AATGRAPVATSDKAA; ATGRAPVATSDKAAA; TGRAPVATSDKAAAP;<br>GRAPVATSDKAAAPS; RAPVATSDKAAAPST; APVATSDKAAAPSTR;<br>PVATSDKAAAPSTRA; VATSDKAAAPSTRAA; ATSDKAAAPSTRAAS;<br>TSDKAAAPSTRAASA; SDKAAAPSTRAASAR; DKAAAPSTRAASART;<br>KAAAPSTRAASARTA; AAAPSTRAASARTAP; AAPSTRAASARTAPP;<br>APSTRAASARTAPPA; PSTRAASARTAPPAR; STRAASARTAPPARP;<br>TRAASARTAPPARPP; RAASARTAPPARPPS; AASARTAPPARPPST;<br>ASARTAPPARPPSTD; SARTAPPARPPSTDH; ARTAPPARPPSTDHI;<br>RTAPPARPPSTDHID; TAPPARPPSTDHIDK; APPARPPSTDHIDKP;<br>PPARPPSTDHIDKPD; PARPPSTDHIDKPDR; ARPPSTDHIDKPDRS;<br>RPPSTDHIDKPDRSE; PPSTDHIDKPDRSES; PSTDHIDKPDRSESA;<br>STDHIDKPDRSESAD; TDHIDKPDRSESADD; DHIDKPDRSESADDG;<br>HIDKPDRSESADDGT; IDKPDRSESADDGTP; DKPDRSESADDGTPV;<br>KPDRSESADDGTPVS; PDRSESADDGTPVSM; DRSESADDGTPVSMI;<br>RSESADDGTPVSMIP; SESADDGTPVSMIPV; ESADDGTPVSMIPVS;<br>SADDGTPVSMIPVSA; ADDGTPVSMIPVSAA; DDGTPVSMIPVSAAR;<br>DGTPVSMIPVSAARA; GTPVSMIPVSAARAA; TPVSMIPVSAARAAR;<br>PVSMIPVSAARAARD; VSMIPVSAARAARDA; SMIPVSAARAARDAA;<br>MIPVSAARAARDAAT; IPVSAARAARDAATA; PVSAARAARDAATAA;<br>VSAARAARDAATAAA; SAARAARDAATAAAS; AARAARDAATAAASA;<br>ARAARDAATAAASAR; RAARDAATAAASARQ; AARDAATAAASARQR;<br>ARDAATAAASARQRG; RDAATAAASARQRGR; DAATAAASARQRGRG;<br>AATAAASARQRGRGD; ATAAASARQRGRGDA; TAAASARQRGRGDAL;<br>AAASARQRGRGDALR; AASARQRGRGDALRL; ASARQRGRGDALRLA;<br>SARQRGRGDALRLAR; ARQRGRGDALRLARR; RQRGRGDALRLARRI;<br>QRGRGDALRLARRIA; RGRGDALRLARRIAA; GRGDALRLARRIAAA;<br>RGDALRLARRIAAAL; GDALRLARRIAAALN; DALRLARRIAAALNA;<br>ALRLARRIAAALNAS; LRLARRIAAALNASD; RLARRIAAALNASDN;<br>LARRIAAALNASDNN; ARRIAAALNASDNNA; RRIAAALNASDNNAG;<br>RIAAALNASDNNAGD; IAAALNASDNNAGDY; AAALNASDNNAGDYG; | |

Fig. 29 continued

| | | | |
|---|---|---|---|
| | AALNASDNNAGDYGF; ALNASDNNAGDYGFF; LNASDNNAGDYGFFW; NASDNNAGDYGFFWI; ASDNNAGDYGFFWIT; SDNNAGDYGFFWITA; DNNAGDYGFFWITAV; NNAGDYGFFWITAVT; NAGDYGFFWITAVTT; AGDYGFFWITAVTTD; GDYGFFWITAVTTDG; DYGFFWITAVTTDGS; YGFFWITAVTTDGSI; GFFWITAVTTDGSIV; FFWITAVTTDGSIVV; FWITAVTTDGSIVVA; WITAVTTDGSIVVAN; ITAVTTDGSIVVANS; TAVTTDGSIVVANSY; AVTTDGSIVVANSYG; VTTDGSIVVANSYGL; TTDGSIVVANSYGLA; TDGSIVVANSYGLAY; DGSIVVANSYGLAYI; GSIVVANSYGLAYIP; SIVVANSYGLAYIPD; IVVANSYGLAYIPDG; VVANSYGLAYIPDGM; VANSYGLAYIPDGME; ANSYGLAYIPDGMEL; NSYGLAYIPDGMELP; SYGLAYIPDGMELPN; YGLAYIPDGMELPNK; GLAYIPDGMELPNKV; LAYIPDGMELPNKVY; AYIPDGMELPNKVYL; YIPDGMELPNKVYLA; IPDGMELPNKVYLAS; PDGMELPNKVYLASA; DGMELPNKVYLASAD; GMELPNKVYLASADH; MELPNKVYLASADHA; ELPNKVYLASADHAI; LPNKVYLASADHAIP; PNKVYLASADHAIPV; NKVYLASADHAIPVD; KVYLASADHAIPVDE; VYLASADHAIPVDEI; YLASADHAIPVDEIA; LASADHAIPVDEIAR; ASADHAIPVDEIARC; SADHAIPVDEIARCA; ADHAIPVDEIARCAT; DHAIPVDEIARCATY; HAIPVDEIARCATYP; AIPVDEIARCATYPV; IPVDEIARCATYPVL; PVDEIARCATYPVLA; VDEIARCATYPVLAV; DEIARCATYPVLAVQ; EIARCATYPVLAVQA; IARCATYPVLAVQAW; ARCATYPVLAVQAWA; RCATYPVLAVQAWAA; CATYPVLAVQAWAAF; ATYPVLAVQAWAAFH; TYPVLAVQAWAAFHD; YPVLAVQAWAAFHDM; PVLAVQAWAAFHDMT; VLAVQAWAAFHDMTL; LAVQAWAAFHDMTLR; AVQAWAAFHDMTLRA; VQAWAAFHDMTLRAV; QAWAAFHDMTLRAVI; AWAAFHDMTLRAVIG; WAAFHDMTLRAVIGT; AAFHDMTLRAVIGTA; AFHDMTLRAVIGTAE; FHDMTLRAVIGTAEQ; HDMTLRAVIGTAEQL; DMTLRAVIGTAEQLA; MTLRAVIGTAEQLAS; TLRAVIGTAEQLASS; LRAVIGTAEQLASSD; RAVIGTAEQLASSDP; AVIGTAEQLASSDPG; VIGTAEQLASSDPGV; IGTAEQLASSDPGVA; GTAEQLASSDPGVAK; TAEQLASSDPGVAKI; AEQLASSDPGVAKIV; EQLASSDPGVAKIVL; QLASSDPGVAKIVLE; LASSDPGVAKIVLEP; ASSDPGVAKIVLEPD; SSDPGVAKIVLEPDD; SDPGVAKIVLEPDDI; DPGVAKIVLEPDDIP; PGVAKIVLEPDDIPE; GVAKIVLEPDDIPES; VAKIVLEPDDIPESG; AKIVLEPDDIPESGK; KIVLEPDDIPESGKM; IVLEPDDIPESGKMT; VLEPDDIPESGKMTG; LEPDDIPESGKMTGR; EPDDIPESGKMTGRS; PDDIPESGKMTGRSR; DDIPESGKMTGRSRL; DIPESGKMTGRSRLE; IPESGKMTGRSRLEV; PESGKMTGRSRLEVV; ESGKMTGRSRLEVVD; SGKMTGRSRLEVVDP; GKMTGRSRLEVVDPS; KMTGRSRLEVVDPSA; MTGRSRLEVVDPSAA; TGRSRLEVVDPSAAA; GRSRLEVVDPSAAAQ; RSRLEVVDPSAAAQL; SRLEVVDPSAAAQLA; RLEVVDPSAAAQLAD; LEVVDPSAAAQLADT; EVVDPSAAAQLADTT; VVDPSAAAQLADTTD; VDPSAAAQLADTTDQ; DPSAAAQLADTTDQR; PSAAAQLADTTDQRL; SAAAQLADTTDQRLL; AAAQLADTTDQRLLD; AAQLADTTDQRLLDL; AQLADTTDQRLLDLL; QLADTTDQRLLDLLP; LADTTDQRLLDLLPP; ADTTDQRLLDLLPPA; DTTDQRLLDLLPPAP; TTDQRLLDLLPPAPV; TDQRLLDLLPPAPVD; DQRLLDLLPPAPVDV; QRLLDLLPPAPVDVN; RLLDLLPPAPVDVNP; LLDLLPPAPVDVNPP; LDLLPPAPVDVNPPG; DLLPPAPVDVNPPGD; LLPPAPVDVNPPGDE; LPPAPVDVNPPGDER; PPAPVDVNPPGDERH; PAPVDVNPPGDERHM; APVDVNPPGDERHML; PVDVNPPGDERHMLW; VDVNPPGDERHMLWF; DVNPPGDERHMLWFE; VNPPGDERHMLWFEL; NPPGDERHMLWFELM; PPGDERHMLWFELMK; PGDERHMLWFELMKP; GDERHMLWFELMKPM; DERHMLWFELMKPMT; ERHMLWFELMKPMTS; | |

Fig. 29 continued

| | | |
|---|---|---|
| | RHMLWFELMKPMTST; HMLWFELMKPMTSTA; MLWFELMKPMTSTAT; LWFELMKPMTSTATG; WFELMKPMTSTATGR; FELMKPMTSTATGRE; ELMKPMTSTATGREA; LMKPMTSTATGREAA; MKPMTSTATGREAAH; KPMTSTATGREAAHL; PMTSTATGREAAHLR; MTSTATGREAAHLRA; TSTATGREAAHLRAF; STATGREAAHLRAFR; TATGREAAHLRAFRA; ATGREAAHLRAFRAY; TGREAAHLRAFRAYA; GREAAHLRAFRAYAA; REAAHLRAFRAYAAH; EAAHLRAFRAYAAHS; AAHLRAFRAYAAHSQ; AHLRAFRAYAAHSQE; HLRAFRAYAAHSQEI; LRAFRAYAAHSQEIA; RAFRAYAAHSQEIAL; AFRAYAAHSQEIALH; FRAYAAHSQEIALHQ; RAYAAHSQEIALHQA; AYAAHSQEIALHQAH; YAAHSQEIALHQAHT; AAHSQEIALHQAHTA; AHSQEIALHQAHTAT; HSQEIALHQAHTATD; SQEIALHQAHTATDA; QEIALHQAHTATDAA; EIALHQAHTATDAAV; IALHQAHTATDAAVQ; ALHQAHTATDAAVQR; LHQAHTATDAAVQRV; HQAHTATDAAVQRVA; QAHTATDAAVQRVAV; AHTATDAAVQRVAVA; HTATDAAVQRVAVAD; TATDAAVQRVAVADW; ATDAAVQRVAVADWL; TDAAVQRVAVADWLY; DAAVQRVAVADWLYW; AAVQRVAVADWLYWQ; AVQRVAVADWLYWQY; VQRVAVADWLYWQYV; QRVAVADWLYWQYVT; RVAVADWLYWQYVTG; VAVADWLYWQYVTGL; AVADWLYWQYVTGLL; VADWLYWQYVTGLLD; ADWLYWQYVTGLLDR; DWLYWQYVTGLLDRA; WLYWQYVTGLLDRAL; LYWQYVTGLLDRALA; YWQYVTGLLDRALAA; WQYVTGLLDRALAAA; QYVTGLLDRALAAAC;<br><br>16 mers:<br>MSITRPTGSYARQMLD; SITRPTGSYARQMLDP; ITRPTGSYARQMLDPG; TRPTGSYARQMLDPGG; RPTGSYARQMLDPGGW; PTGSYARQMLDPGGWV; TGSYARQMLDPGGWVE; GSYARQMLDPGGWVEA; SYARQMLDPGGWVEAD; YARQMLDPGGWVEADE; ARQMLDPGGWVEADED; RQMLDPGGWVEADEDT; QMLDPGGWVEADEDTF; MLDPGGWVEADEDTFY; LDPGGWVEADEDTFYD; DPGGWVEADEDTFYDR; PGGWVEADEDTFYDRA; GGWVEADEDTFYDRAQ; GWVEADEDTFYDRAQE; WVEADEDTFYDRAQEY; VEADEDTFYDRAQEYS; EADEDTFYDRAQEYSQ; ADEDTFYDRAQEYSQV; DEDTFYDRAQEYSQVL; EDTFYDRAQEYSQVLQ; DTFYDRAQEYSQVLQR; TFYDRAQEYSQVLQRV; FYDRAQEYSQVLQRVT; YDRAQEYSQVLQRVTD; DRAQEYSQVLQRVTDV; RAQEYSQVLQRVTDVL; AQEYSQVLQRVTDVLD; QEYSQVLQRVTDVLDT; EYSQVLQRVTDVLDTC; YSQVLQRVTDVLDTCR; SQVLQRVTDVLDTCRQ; QVLQRVTDVLDTCRQQ; VLQRVTDVLDTCRQQK; LQRVTDVLDTCRQQKG; QRVTDVLDTCRQQKGH; RVTDVLDTCRQQKGHV; VTDVLDTCRQQKGHVF; TDVLDTCRQQKGHVFE; DVLDTCRQQKGHVFEG; VLDTCRQQKGHVFEGG; LDTCRQQKGHVFEGGL; DTCRQQKGHVFEGGLW; TCRQQKGHVFEGGLWS; CRQQKGHVFEGGLWSG; RQQKGHVFEGGLWSGG; QQKGHVFEGGLWSGGA; QKGHVFEGGLWSGGAA; KGHVFEGGLWSGGAAN; GHVFEGGLWSGGAANA; HVFEGGLWSGGAANAA; VFEGGLWSGGAANAAN; FEGGLWSGGAANAANG; EGGLWSGGAANAANGA; GGLWSGGAANAANGAL; GLWSGGAANAANGALG; LWSGGAANAANGALGA; WSGGAANAANGALGAN; SGGAANAANGALGANI; GGAANAANGALGANIN; GAANAANGALGANINQ; AANAANGALGANINQL; ANAANGALGANINQLM; NAANGALGANINQLMT; AANGALGANINQLMTL; ANGALGANINQLMTLQ; NGALGANINQLMTLQD; GALGANINQLMTLQDY; ALGANINQLMTLQDYL; LGANINQLMTLQDYLA; GANINQLMTLQDYLAT; ANINQLMTLQDYLATV; NINQLMTLQDYLATVI; INQLMTLQDYLATVIT; NQLMTLQDYLATVITW; QLMTLQDYLATVITWH; LMTLQDYLATVITWHR; MTLQDYLATVITWHRH; TLQDYLATVITWHRHI; LQDYLATVITWHRHIA; QDYLATVITWHRHIAG; DYLATVITWHRHIAGL; YLATVITWHRHIAGLI; LATVITWHRHIAGLIE; ATVITWHRHIAGLIEQ; TVITWHRHIAGLIEQA; | |

Fig. 29 continued

VITWHRHIAGLIEQAK; ITWHRHIAGLIEQAKS; TWHRHIAGLIEQAKSD;
WHRHIAGLIEQAKSDI; HRHIAGLIEQAKSDIG; RHIAGLIEQAKSDIGN;
HIAGLIEQAKSDIGNN; IAGLIEQAKSDIGNNV; AGLIEQAKSDIGNNVD;
GLIEQAKSDIGNNVDG; LIEQAKSDIGNNVDGA; IEQAKSDIGNNVDGAQ;
EQAKSDIGNNVDGAQR; QAKSDIGNNVDGAQRE; AKSDIGNNVDGAQREI;
KSDIGNNVDGAQREID; SDIGNNVDGAQREIDI; DIGNNVDGAQREIDIL;
IGNNVDGAQREIDILE; GNNVDGAQREIDILEN; NNVDGAQREIDILEND;
NVDGAQREIDILENDP; VDGAQREIDILENDPS; DGAQREIDILENDPSL;
GAQREIDILENDPSLD; AQREIDILENDPSLDA; QREIDILENDPSLDAD;
REIDILENDPSLDADE; EIDILENDPSLDADER; IDILENDPSLDADERH;
DILENDPSLDADERHT; ILENDPSLDADERHTA; LENDPSLDADERHTAI;
ENDPSLDADERHTAIN; NDPSLDADERHTAINS; DPSLDADERHTAINSL;
PSLDADERHTAINSLV; SLDADERHTAINSLVT; LDADERHTAINSLVTA;
DADERHTAINSLVTAT; ADERHTAINSLVTATH; DERHTAINSLVTATHG;
ERHTAINSLVTATHGA; RHTAINSLVTATHGAN; HTAINSLVTATHGANV;
TAINSLVTATHGANVS; AINSLVTATHGANVSL; INSLVTATHGANVSLV;
NSLVTATHGANVSLVA; SLVTATHGANVSLVAE; LVTATHGANVSLVAET;
VTATHGANVSLVAETA; TATHGANVSLVAETAE; ATHGANVSLVAETAER;
THGANVSLVAETAERV; HGANVSLVAETAERVL; GANVSLVAETAERVLE;
ANVSLVAETAERVLES; NVSLVAETAERVLESK; VSLVAETAERVLESKN;
SLVAETAERVLESKNW; LVAETAERVLESKNWK; VAETAERVLESKNWKP;
AETAERVLESKNWKPP; ETAERVLESKNWKPPK; TAERVLESKNWKPPKN;
AERVLESKNWKPPKNA; ERVLESKNWKPPKNAL; RVLESKNWKPPKNALE;
VLESKNWKPPKNALED; LESKNWKPPKNALEDL; ESKNWKPPKNALEDLL;
SKNWKPPKNALEDLLQ; KNWKPPKNALEDLLQQ; NWKPPKNALEDLLQQK;
WKPPKNALEDLLQQKS; KPPKNALEDLLQQKSP; PPKNALEDLLQQKSPP;
PKNALEDLLQQKSPPP; KNALEDLLQQKSPPPP; NALEDLLQQKSPPPPD;
ALEDLLQQKSPPPPDV; LEDLLQQKSPPPPDVP; EDLLQQKSPPPPDVPT;
DLLQQKSPPPPDVPTL; LLQQKSPPPPDVPTLV; LQQKSPPPPDVPTLVV;
QQKSPPPPDVPTLVVP; QKSPPPPDVPTLVVPS; KSPPPPDVPTLVVPSP;
SPPPPDVPTLVVPSPG; PPPPDVPTLVVPSPGT; PPPDVPTLVVPSPGTP;
PPDVPTLVVPSPGTPG; PDVPTLVVPSPGTPGT; DVPTLVVPSPGTPGTP;
VPTLVVPSPGTPGTPG; PTLVVPSPGTPGTPGT; TLVVPSPGTPGTPGTP;
LVVPSPGTPGTPGTPI; VVPSPGTPGTPGTPIT; VPSPGTPGTPGTPITP;
PSPGTPGTPGTPITPG; SPGTPGTPGTPITPGT; PGTPGTPGTPITPGTP;
GTPGTPGTPITPGTPI; TPGTPGTPITPGTPIT; PGTPGTPITPGTPITP;
GTPGTPITPGTPITPG; TPGTPITPGTPITPGT; PGTPITPGTPITPGTP;
GTPITPGTPITPGTPI; TPITPGTPITPGTPIT; PITPGTPITPGTPITP;
ITPGTPITPGTPITPI; TPGTPITPGTPITPIP; PGTPITPGTPITPIPG;
GTPITPGTPITPIPGA; TPITPGTPITPIPGAP; PITPGTPITPIPGAPV;
ITPGTPITPIPGAPVT; TPGTPITPIPGAPVTP; PGTPITPIPGAPVTPI;
GTPITPIPGAPVTPIT; TPITPIPGAPVTPITP; PITPIPGAPVTPITPT;
ITPIPGAPVTPITPTP; TPIPGAPVTPITPTPG; PIPGAPVTPITPTPGT;
IPGAPVTPITPTPGTP; PGAPVTPITPTPGTPV; GAPVTPITPTPGTPVT;
APVTPITPTPGTPVTP; PVTPITPTPGTPVTPV; VTPITPTPGTPVTPVT;
TPITPTPGTPVTPVTP; PITPTPGTPVTPVTPG; ITPTPGTPVTPVTPGK;
TPTPGTPVTPVTPGKP; PTPGTPVTPVTPGKPV; TPGTPVTPVTPGKPVT;
PGTPVTPVTPGKPVTP; GTPVTPVTPGKPVTPV; TPVTPVTPGKPVTPVT;
PVTPVTPGKPVTPVTP; VTPVTPGKPVTPVTPV; TPVTPGKPVTPVTPVK;
PVTPGKPVTPVTPVKP; VTPGKPVTPVTPVKPG; TPGKPVTPVTPVKPGT;
PGKPVTPVTPVKPGTP; GKPVTPVTPVKPGTPG; KPVTPVTPVKPGTPGE;
PVTPVTPVKPGTPGEP; VTPVTPVKPGTPGEPT; TPVTPVKPGTPGEPTP;
PVTPVKPGTPGEPTPI; VTPVKPGTPGEPTPIT; TPVKPGTPGEPTPITP;

Fig. 29 continued

| | | |
|---|---|---|
| | PVKPGTPGEPTPITPV; VKPGTPGEPTPITPVT; KPGTPGEPTPITPVTP;<br>PGTPGEPTPITPVTPP; GTPGEPTPITPVTPPV; TPGEPTPITPVTPPVA;<br>PGEPTPITPVTPPVAP; GEPTPITPVTPPVAPA; EPTPITPVTPPVAPAT;<br>PTPITPVTPPVAPATP; TPITPVTPPVAPATPA; PITPVTPPVAPATPAT;<br>ITPVTPPVAPATPATP; TPVTPPVAPATPATPA; PVTPPVAPATPATPAT;<br>VTPPVAPATPATPATP; TPPVAPATPATPATPV; PPVAPATPATPATPVT;<br>PVAPATPATPATPVTP; VAPATPATPATPVTPA; APATPATPATPVTPAP;<br>PATPATPATPVTPAPA; ATPATPATPVTPAPAP; TPATPATPVTPAPAPH;<br>PATPATPVTPAPAPHP; ATPATPVTPAPAPHPQ; TPATPVTPAPAPHPQP;<br>PATPVTPAPAPHPQPA; ATPVTPAPAPHPQPAP; TPVTPAPAPHPQPAPA;<br>PVTPAPAPHPQPAPAP; VTPAPAPHPQPAPAPA; TPAPAPHPQPAPAPAP;<br>PAPAPHPQPAPAPAPS; APAPHPQPAPAPAPSP; PAPHPQPAPAPAPSPG;<br>APHPQPAPAPAPSPGP; PHPQPAPAPAPSPGPQ; HPQPAPAPAPSPGPQP;<br>PQPAPAPAPSPGPQPV; QPAPAPAPSPGPQPVT; PAPAPAPSPGPQPVTP;<br>APAPAPSPGPQPVTPA; PAPAPSPGPQPVTPAT; APAPSPGPQPVTPATP;<br>PAPSPGPQPVTPATPG; APSPGPQPVTPATPGP; PSPGPQPVTPATPGPS;<br>SPGPQPVTPATPGPSG; PGPQPVTPATPGPSGP; GPQPVTPATPGPSGPA;<br>PQPVTPATPGPSGPAT; QPVTPATPGPSGPATP; PVTPATPGPSGPATPG;<br>VTPATPGPSGPATPGT; TPATPGPSGPATPGTP; PATPGPSGPATPGTPG;<br>ATPGPSGPATPGTPGG; TPGPSGPATPGTPGGE; PGPSGPATPGTPGGEP;<br>GPSGPATPGTPGGEPA; PSGPATPGTPGGEPAP; SGPATPGTPGGEPAPH;<br>GPATPGTPGGEPAPHV; PATPGTPGGEPAPHVK; ATPGTPGGEPAPHVKP;<br>TPGTPGGEPAPHVKPA; PGTPGGEPAPHVKPAA; GTPGGEPAPHVKPAAL;<br>TPGGEPAPHVKPAALA; PGGEPAPHVKPAALAE; GGEPAPHVKPAALAEQ;<br>GEPAPHVKPAALAEQP; EPAPHVKPAALAEQPG; PAPHVKPAALAEQPGV;<br>APHVKPAALAEQPGVP; PHVKPAALAEQPGVPG; HVKPAALAEQPGVPGQ;<br>VKPAALAEQPGVPGQH; KPAALAEQPGVPGQHA; PAALAEQPGVPGQHAG;<br>AALAEQPGVPGQHAGG; ALAEQPGVPGQHAGGG; LAEQPGVPGQHAGGGT;<br>AEQPGVPGQHAGGGTQ; EQPGVPGQHAGGGTQS; QPGVPGQHAGGGTQSG;<br>PGVPGQHAGGGTQSGP; GVPGQHAGGGTQSGPA; VPGQHAGGGTQSGPAH;<br>PGQHAGGGTQSGPAHA; GQHAGGGTQSGPAHAD; QHAGGGTQSGPAHADE;<br>HAGGGTQSGPAHADES; AGGGTQSGPAHADESA; GGGTQSGPAHADESAA;<br>GGTQSGPAHADESAAS; GTQSGPAHADESAASV; TQSGPAHADESAASVT;<br>QSGPAHADESAASVTP; SGPAHADESAASVTPA; GPAHADESAASVTPAA;<br>PAHADESAASVTPAAA; AHADESAASVTPAAAS; HADESAASVTPAAASG;<br>ADESAASVTPAAASGV; DESAASVTPAAASGVP; ESAASVTPAAASGVPG;<br>SAASVTPAAASGVPGA; AASVTPAAASGVPGAR; ASVTPAAASGVPGARA;<br>SVTPAAASGVPGARAA; VTPAAASGVPGARAAA; TPAAASGVPGARAAAA;<br>PAAASGVPGARAAAAA; AAASGVPGARAAAAAP; AASGVPGARAAAAAPS;<br>ASGVPGARAAAAAPSG; SGVPGARAAAAAPSGT; GVPGARAAAAAPSGTA;<br>VPGARAAAAAPSGTAV; PGARAAAAAPSGTAVG; GARAAAAAPSGTAVGA;<br>ARAAAAAPSGTAVGAG; RAAAAAPSGTAVGAGA; AAAAAPSGTAVGAGAR;<br>AAAAPSGTAVGAGARS; AAAPSGTAVGAGARSS; AAPSGTAVGAGARSSV;<br>APSGTAVGAGARSSVG; PSGTAVGAGARSSVGT; SGTAVGAGARSSVGTA;<br>GTAVGAGARSSVGTAA; TAVGAGARSSVGTAAA; AVGAGARSSVGTAAAS;<br>VGAGARSSVGTAAASG; GAGARSSVGTAAASGA; AGARSSVGTAAASGAG;<br>GARSSVGTAAASGAGS; ARSSVGTAAASGAGSH; RSSVGTAAASGAGSHA;<br>SSVGTAAASGAGSHAA; SVGTAAASGAGSHAAT; VGTAAASGAGSHAATG;<br>GTAAASGAGSHAATGR; TAAASGAGSHAATGRA; AAASGAGSHAATGRAP;<br>AASGAGSHAATGRAPV; ASGAGSHAATGRAPVA; SGAGSHAATGRAPVAT;<br>GAGSHAATGRAPVATS; AGSHAATGRAPVATSD; GSHAATGRAPVATSDK;<br>SHAATGRAPVATSDKA; HAATGRAPVATSDKAA; AATGRAPVATSDKAAA;<br>ATGRAPVATSDKAAAP; TGRAPVATSDKAAAPS; GRAPVATSDKAAAPST; | |

Fig. 29 continued

| | | | |
|---|---|---|---|
| | RAPVATSDKAAAPSTR; APVATSDKAAAPSTRA; PVATSDKAAAPSTRAA;<br>VATSDKAAAPSTRAAS; ATSDKAAAPSTRAASA; TSDKAAAPSTRAASAR;<br>SDKAAAPSTRAASART; DKAAAPSTRAASARTA; KAAAPSTRAASARTAP;<br>AAAPSTRAASARTAPP; AAPSTRAASARTAPPA; APSTRAASARTAPPAR;<br>PSTRAASARTAPPARP; STRAASARTAPPARPP; TRAASARTAPPARPPS;<br>RAASARTAPPARPPST; AASARTAPPARPPSTD; ASARTAPPARPPSTDH;<br>SARTAPPARPPSTDHI; ARTAPPARPPSTDHID; RTAPPARPPSTDHIDK;<br>TAPPARPPSTDHIDKP; APPARPPSTDHIDKPD; PPARPPSTDHIDKPDR;<br>PARPPSTDHIDKPDRS; ARPPSTDHIDKPDRSE; RPPSTDHIDKPDRSES;<br>PPSTDHIDKPDRSESA; PSTDHIDKPDRSESAD; STDHIDKPDRSESADD;<br>TDHIDKPDRSESADDG; DHIDKPDRSESADDGT; HIDKPDRSESADDGTP;<br>IDKPDRSESADDGTPV; DKPDRSESADDGTPVS; KPDRSESADDGTPVSM;<br>PDRSESADDGTPVSMI; DRSESADDGTPVSMIP; RSESADDGTPVSMIPV;<br>SESADDGTPVSMIPVS; ESADDGTPVSMIPVSA; SADDGTPVSMIPVSAA;<br>ADDGTPVSMIPVSAAR; DDGTPVSMIPVSAARA; DGTPVSMIPVSAARAA;<br>GTPVSMIPVSAARAAR; TPVSMIPVSAARAARD; PVSMIPVSAARAARDA;<br>VSMIPVSAARAARDAA; SMIPVSAARAARDAAT; MIPVSAARAARDAATA;<br>IPVSAARAARDAATAA; PVSAARAARDAATAAA; VSAARAARDAATAAAS;<br>SAARAARDAATAAASA; AARAARDAATAAASAR; ARAARDAATAAASARQ;<br>RAARDAATAAASARQR; AARDAATAAASARQRG; ARDAATAAASARQRGR;<br>RDAATAAASARQRGRG; DAATAAASARQRGRGD; AATAAASARQRGRGDA;<br>ATAAASARQRGRGDAL; TAAASARQRGRGDALR; AAASARQRGRGDALRL;<br>AASARQRGRGDALRLA; ASARQRGRGDALRLAR; SARQRGRGDALRLARR;<br>ARQRGRGDALRLARRI; RQRGRGDALRLARRIA; QRGRGDALRLARRIAA;<br>RGRGDALRLARRIAAA; GRGDALRLARRIAAAL; RGDALRLARRIAAALN;<br>GDALRLARRIAAALNA; DALRLARRIAAALNAS; ALRLARRIAAALNASD;<br>LRLARRIAAALNASDN; RLARRIAAALNASDNN; LARRIAAALNASDNNA;<br>ARRIAAALNASDNNAG; RRIAAALNASDNNAGD; RIAAALNASDNNAGDY;<br>IAAALNASDNNAGDYG; AAALNASDNNAGDYGF; AALNASDNNAGDYGFF;<br>ALNASDNNAGDYGFFW; LNASDNNAGDYGFFWI; NASDNNAGDYGFFWIT;<br>ASDNNAGDYGFFWITA; SDNNAGDYGFFWITAV; DNNAGDYGFFWITAVT;<br>NNAGDYGFFWITAVTT; NAGDYGFFWITAVTTD; AGDYGFFWITAVTTDG;<br>GDYGFFWITAVTTDGS; DYGFFWITAVTTDGSI; YGFFWITAVTTDGSIV;<br>GFFWITAVTTDGSIVV; FFWITAVTTDGSIVVA; FWITAVTTDGSIVVAN;<br>WITAVTTDGSIVVANS; ITAVTTDGSIVVANSY; TAVTTDGSIVVANSYG;<br>AVTTDGSIVVANSYGL; VTTDGSIVVANSYGLA; TTDGSIVVANSYGLAY;<br>TDGSIVVANSYGLAYI; DGSIVVANSYGLAYIP; GSIVVANSYGLAYIPD;<br>SIVVANSYGLAYIPDG; IVVANSYGLAYIPDGM; VVANSYGLAYIPDGME;<br>VANSYGLAYIPDGMEL; ANSYGLAYIPDGMELP; NSYGLAYIPDGMELPN;<br>SYGLAYIPDGMELPNK; YGLAYIPDGMELPNKV; GLAYIPDGMELPNKVY;<br>LAYIPDGMELPNKVYL; AYIPDGMELPNKVYLA; YIPDGMELPNKVYLAS;<br>IPDGMELPNKVYLASA; PDGMELPNKVYLASAD; DGMELPNKVYLASADH;<br>GMELPNKVYLASADHA; MELPNKVYLASADHAI; ELPNKVYLASADHAIP;<br>LPNKVYLASADHAIPV; PNKVYLASADHAIPVD; NKVYLASADHAIPVDE;<br>KVYLASADHAIPVDEI; VYLASADHAIPVDEIA; YLASADHAIPVDEIAR;<br>LASADHAIPVDEIARC; ASADHAIPVDEIARCA; SADHAIPVDEIARCAT;<br>ADHAIPVDEIARCATY; DHAIPVDEIARCATYP; HAIPVDEIARCATYPV;<br>AIPVDEIARCATYPVL; IPVDEIARCATYPVLA; PVDEIARCATYPVLAV;<br>VDEIARCATYPVLAVQ; DEIARCATYPVLAVQA; EIARCATYPVLAVQAW;<br>IARCATYPVLAVQAWA; ARCATYPVLAVQAWAA; RCATYPVLAVQAWAAF;<br>CATYPVLAVQAWAAFH; ATYPVLAVQAWAAFHD; TYPVLAVQAWAAFHDM;<br>YPVLAVQAWAAFHDMT; PVLAVQAWAAFHDMTL; VLAVQAWAAFHDMTLR;<br>LAVQAWAAFHDMTLRA; AVQAWAAFHDMTLRAV; VQAWAAFHDMTLRAVI; | | |

Fig. 29 continued

| | | |
|---|---|---|
| | QAWAAFHDMTLRAVIG; AWAAFHDMTLRAVIGT; WAAFHDMTLRAVIGTA; AAFHDMTLRAVIGTAE; AFHDMTLRAVIGTAEQ; FHDMTLRAVIGTAEQL; HDMTLRAVIGTAEQLA; DMTLRAVIGTAEQLAS; MTLRAVIGTAEQLASS; TLRAVIGTAEQLASSD; LRAVIGTAEQLASSDP; RAVIGTAEQLASSDPG; AVIGTAEQLASSDPGV; VIGTAEQLASSDPGVA; IGTAEQLASSDPGVAK; GTAEQLASSDPGVAKI; TAEQLASSDPGVAKIV; AEQLASSDPGVAKIVL; EQLASSDPGVAKIVLE; QLASSDPGVAKIVLEP; LASSDPGVAKIVLEPD; ASSDPGVAKIVLEPDD; SSDPGVAKIVLEPDDI; SDPGVAKIVLEPDDIP; DPGVAKIVLEPDDIPE; PGVAKIVLEPDDIPES; GVAKIVLEPDDIPESG; VAKIVLEPDDIPESGK; AKIVLEPDDIPESGKM; KIVLEPDDIPESGKMT; IVLEPDDIPESGKMTG; VLEPDDIPESGKMTGR; LEPDDIPESGKMTGRS; EPDDIPESGKMTGRSR; PDDIPESGKMTGRSRL; DDIPESGKMTGRSRLE; DIPESGKMTGRSRLEV; IPESGKMTGRSRLEVV; PESGKMTGRSRLEVVD; ESGKMTGRSRLEVVDP; SGKMTGRSRLEVVDPS; GKMTGRSRLEVVDPSA; KMTGRSRLEVVDPSAA; MTGRSRLEVVDPSAAA; TGRSRLEVVDPSAAAQ; GRSRLEVVDPSAAAQL; RSRLEVVDPSAAAQLA; SRLEVVDPSAAAQLAD; RLEVVDPSAAAQLADT; LEVVDPSAAAQLADTT; EVVDPSAAAQLADTTD; VVDPSAAAQLADTTDQ; VDPSAAAQLADTTDQR; DPSAAAQLADTTDQRL; PSAAAQLADTTDQRLL; SAAAQLADTTDQRLLD; AAAQLADTTDQRLLDL; AAQLADTTDQRLLDLL; AQLADTTDQRLLDLLP; QLADTTDQRLLDLLPP; LADTTDQRLLDLLPPA; ADTTDQRLLDLLPPAP; DTTDQRLLDLLPPAPV; TTDQRLLDLLPPAPVD; TDQRLLDLLPPAPVDV; DQRLLDLLPPAPVDVN; QRLLDLLPPAPVDVNP; RLLDLLPPAPVDVNPP; LLDLLPPAPVDVNPPG; LDLLPPAPVDVNPPGD; DLLPPAPVDVNPPGDE; LLPPAPVDVNPPGDER; LPPAPVDVNPPGDERH; PPAPVDVNPPGDERHM; PAPVDVNPPGDERHML; APVDVNPPGDERHMLW; PVDVNPPGDERHMLWF; VDVNPPGDERHMLWFE; DVNPPGDERHMLWFEL; VNPPGDERHMLWFELM; NPPGDERHMLWFELMK; PPGDERHMLWFELMKP; PGDERHMLWFELMKPM; GDERHMLWFELMKPMT; DERHMLWFELMKPMTS; ERHMLWFELMKPMTST; RHMLWFELMKPMTSTA; HMLWFELMKPMTSTAT; MLWFELMKPMTSTATG; LWFELMKPMTSTATGR; WFELMKPMTSTATGRE; FELMKPMTSTATGREA; ELMKPMTSTATGREAA; LMKPMTSTATGREAAH; MKPMTSTATGREAAHL; KPMTSTATGREAAHLR; PMTSTATGREAAHLRA; MTSTATGREAAHLRAF; TSTATGREAAHLRAFR; STATGREAAHLRAFRA; TATGREAAHLRAFRAY; ATGREAAHLRAFRAYA; TGREAAHLRAFRAYAA; GREAAHLRAFRAYAAH; REAAHLRAFRAYAAHS; EAAHLRAFRAYAAHSQ; AAHLRAFRAYAAHSQE; AHLRAFRAYAAHSQEI; HLRAFRAYAAHSQEIA; LRAFRAYAAHSQEIAL; RAFRAYAAHSQEIALH; AFRAYAAHSQEIALHQ; FRAYAAHSQEIALHQA; RAYAAHSQEIALHQAH; AYAAHSQEIALHQAHT; YAAHSQEIALHQAHTA; AAHSQEIALHQAHTAT; AHSQEIALHQAHTATD; HSQEIALHQAHTATDA; SQEIALHQAHTATDAA; QEIALHQAHTATDAAV; EIALHQAHTATDAAVQ; IALHQAHTATDAAVQR; ALHQAHTATDAAVQRV; LHQAHTATDAAVQRVA; HQAHTATDAAVQRVAV; QAHTATDAAVQRVAVA; AHTATDAAVQRVAVAD; HTATDAAVQRVAVADW; TATDAAVQRVAVADWL; ATDAAVQRVAVADWLY; TDAAVQRVAVADWLYW; DAAVQRVAVADWLYWQ; AAVQRVAVADWLYWQY; AVQRVAVADWLYWQYV; VQRVAVADWLYWQYVT; QRVAVADWLYWQYVTG; RVAVADWLYWQYVTGL; VAVADWLYWQYVTGLL; AVADWLYWQYVTGLLD; VADWLYWQYVTGLLDR; ADWLYWQYVTGLLDRA; DWLYWQYVTGLLDRAL; WLYWQYVTGLLDRALA; LYWQYVTGLLDRALAA; YWQYVTGLLDRALAAA; WQYVTGLLDRALAAAC | |
| 76) Rv3890c | 13 mers:<br>MSDQITYNPGAVS; SDQITYNPGAVSD; DQITYNPGAVSDF; QITYNPGAVSDFA; ITYNPGAVSDFAS; TYNPGAVSDFASD; YNPGAVSDFASDV; NPGAVSDFASDVG; PGAVSDFASDVGS; GAVSDFASDVGSR; AVSDFASDVGSRA; | 113470-113795 |

Fig. 29 continued

| | | | |
|---|---|---|---|
| | VSDFASDVGSRAG; SDFASDVGSRAGQ; DFASDVGSRAGQL; FASDVGSRAGQLH; ASDVGSRAGQLHM; SDVGSRAGQLHMI; DVGSRAGQLHMIY; VGSRAGQLHMIYE; GSRAGQLHMIYED; SRAGQLHMIYEDT; RAGQLHMIYEDTA; AGQLHMIYEDTAS; GQLHMIYEDTASK; QLHMIYEDTASKT; LHMIYEDTASKTN; HMIYEDTASKTNA; MIYEDTASKTNAL; IYEDTASKTNALQ; YEDTASKTNALQE; EDTASKTNALQEF; DTASKTNALQEFF; TASKTNALQEFFA; ASKTNALQEFFAG; SKTNALQEFFAGH; KTNALQEFFAGHG; TNALQEFFAGHGA; NALQEFFAGHGAQ; ALQEFFAGHGAQG; LQEFFAGHGAQGF; QEFFAGHGAQGFF; EFFAGHGAQGFFD; FFAGHGAQGFFDA; FAGHGAQGFFDAQ; AGHGAQGFFDAQA; GHGAQGFFDAQAQ; HGAQGFFDAQAQM; GAQGFFDAQAQML; AQGFFDAQAQMLS; QGFFDAQAQMLSG; GFFDAQAQMLSGL; FFDAQAQMLSGLQ; FDAQAQMLSGLQG; DAQAQMLSGLQGL; AQAQMLSGLQGLI; QAQMLSGLQGLIE; AQMLSGLQGLIET; QMLSGLQGLIETV; MLSGLQGLIETVG; LSGLQGLIETVGQ; SGLQGLIETVGQH; GLQGLIETVGQHG; LQGLIETVGQHGT; QGLIETVGQHGTT; GLIETVGQHGTTT; LIETVGQHGTTTG; IETVGQHGTTTGH; ETVGQHGTTTGHV; TVGQHGTTTGHVL; VGQHGTTTGHVLD; GQHGTTTGHVLDN; QHGTTTGHVLDNA; HGTTTGHVLDNAI; GTTTGHVLDNAIG; TTTGHVLDNAIGT; TTGHVLDNAIGTD; TGHVLDNAIGTDQ; GHVLDNAIGTDQA; HVLDNAIGTDQAI; VLDNAIGTDQAIA; LDNAIGTDQAIAG; DNAIGTDQAIAGL; NAIGTDQAIAGLF;<br><br>14 mers:<br>MSDQITYNPGAVSD; SDQITYNPGAVSDF; DQITYNPGAVSDFA; QITYNPGAVSDFAS; ITYNPGAVSDFASD; TYNPGAVSDFASDV; YNPGAVSDFASDVG; NPGAVSDFASDVGS; PGAVSDFASDVGSR; GAVSDFASDVGSRA; AVSDFASDVGSRAG; VSDFASDVGSRAGQ; SDFASDVGSRAGQL; DFASDVGSRAGQLH; FASDVGSRAGQLHM; ASDVGSRAGQLHMI; SDVGSRAGQLHMIY; DVGSRAGQLHMIYE; VGSRAGQLHMIYED; GSRAGQLHMIYEDT; SRAGQLHMIYEDTA; RAGQLHMIYEDTAS; AGQLHMIYEDTASK; GQLHMIYEDTASKT; QLHMIYEDTASKTN; LHMIYEDTASKTNA; HMIYEDTASKTNAL; MIYEDTASKTNALQ; IYEDTASKTNALQE; YEDTASKTNALQEF; EDTASKTNALQEFF; DTASKTNALQEFFA; TASKTNALQEFFAG; ASKTNALQEFFAGH; SKTNALQEFFAGHG; KTNALQEFFAGHGA; TNALQEFFAGHGAQ; NALQEFFAGHGAQG; ALQEFFAGHGAQGF; LQEFFAGHGAQGFF; QEFFAGHGAQGFFD; EFFAGHGAQGFFDA; FFAGHGAQGFFDAQ; FAGHGAQGFFDAQA; AGHGAQGFFDAQAQ; GHGAQGFFDAQAQM; HGAQGFFDAQAQML; GAQGFFDAQAQMLS; AQGFFDAQAQMLSG; QGFFDAQAQMLSGL; GFFDAQAQMLSGLQ; FFDAQAQMLSGLQG; FDAQAQMLSGLQGL; DAQAQMLSGLQGLI; AQAQMLSGLQGLIE; QAQMLSGLQGLIET; AQMLSGLQGLIETV; QMLSGLQGLIETVG; MLSGLQGLIETVGQ; LSGLQGLIETVGQH; SGLQGLIETVGQHG; GLQGLIETVGQHGT; LQGLIETVGQHGTT; QGLIETVGQHGTTT; GLIETVGQHGTTTG; LIETVGQHGTTTGH; IETVGQHGTTTGHV; ETVGQHGTTTGHVL; TVGQHGTTTGHVLD; VGQHGTTTGHVLDN; GQHGTTTGHVLDNA; QHGTTTGHVLDNAI; HGTTTGHVLDNAIG; GTTTGHVLDNAIGT; TTTGHVLDNAIGTD; TTGHVLDNAIGTDQ; TGHVLDNAIGTDQA; GHVLDNAIGTDQAI; HVLDNAIGTDQAIA; VLDNAIGTDQAIAG; LDNAIGTDQAIAGL; DNAIGTDQAIAGLF;<br><br>15 mers:<br>MSDQITYNPGAVSDF; SDQITYNPGAVSDFA; DQITYNPGAVSDFAS; | |

Fig. 29 continued

| | | |
|---|---|---|
| | QITYNPGAVSDFASD; ITYNPGAVSDFASDV; TYNPGAVSDFASDVG;<br>YNPGAVSDFASDVGS; NPGAVSDFASDVGSR; PGAVSDFASDVGSRA;<br>GAVSDFASDVGSRAG; AVSDFASDVGSRAGQ; VSDFASDVGSRAGQL;<br>SDFASDVGSRAGQLH; DFASDVGSRAGQLHM; FASDVGSRAGQLHMI;<br>ASDVGSRAGQLHMIY; SDVGSRAGQLHMIYE; DVGSRAGQLHMIYED;<br>VGSRAGQLHMIYEDT; GSRAGQLHMIYEDTA; SRAGQLHMIYEDTAS;<br>RAGQLHMIYEDTASK; AGQLHMIYEDTASKT; GQLHMIYEDTASKTN;<br>QLHMIYEDTASKTNA; LHMIYEDTASKTNAL; HMIYEDTASKTNALQ;<br>MIYEDTASKTNALQE; IYEDTASKTNALQEF; YEDTASKTNALQEFF;<br>EDTASKTNALQEFFA; DTASKTNALQEFFAG; TASKTNALQEFFAGH;<br>ASKTNALQEFFAGHG; SKTNALQEFFAGHGA; KTNALQEFFAGHGAQ;<br>TNALQEFFAGHGAQG; NALQEFFAGHGAQGF; ALQEFFAGHGAQGFF;<br>LQEFFAGHGAQGFFD; QEFFAGHGAQGFFDA; EFFAGHGAQGFFDAQ;<br>FFAGHGAQGFFDAQA; FAGHGAQGFFDAQAQ; AGHGAQGFFDAQAQM;<br>GHGAQGFFDAQAQML; HGAQGFFDAQAQMLS; GAQGFFDAQAQMLSG;<br>AQGFFDAQAQMLSGL; QGFFDAQAQMLSGLQ; GFFDAQAQMLSGLQG;<br>FFDAQAQMLSGLQGL; FDAQAQMLSGLQGLI; DAQAQMLSGLQGLIE;<br>AQAQMLSGLQGLIET; QAQMLSGLQGLIETV; AQMLSGLQGLIETVG;<br>QMLSGLQGLIETVGQ; MLSGLQGLIETVGQH; LSGLQGLIETVGQHG;<br>SGLQGLIETVGQHGT; GLQGLIETVGQHGTT; LQGLIETVGQHGTTT;<br>QGLIETVGQHGTTTG; GLIETVGQHGTTTGH; LIETVGQHGTTTGHV;<br>IETVGQHGTTTGHVL; ETVGQHGTTTGHVLD; TVGQHGTTTGHVLDN;<br>VGQHGTTTGHVLDNA; GQHGTTTGHVLDNAI; QHGTTTGHVLDNAIG;<br>HGTTTGHVLDNAIGT; GTTTGHVLDNAIGTD; TTTGHVLDNAIGTDQ;<br>TTGHVLDNAIGTDQA; TGHVLDNAIGTDQAI; GHVLDNAIGTDQAIA;<br>HVLDNAIGTDQAIAG; VLDNAIGTDQAIAGL; LDNAIGTDQAIAGLF;<br><br>16 mers:<br>MSDQITYNPGAVSDFA; SDQITYNPGAVSDFAS; DQITYNPGAVSDFASD;<br>QITYNPGAVSDFASDV; ITYNPGAVSDFASDVG; TYNPGAVSDFASDVGS;<br>YNPGAVSDFASDVGSR; NPGAVSDFASDVGSRA; PGAVSDFASDVGSRAG;<br>GAVSDFASDVGSRAGQ; AVSDFASDVGSRAGQL; VSDFASDVGSRAGQLH;<br>SDFASDVGSRAGQLHM; DFASDVGSRAGQLHMI; FASDVGSRAGQLHMIY;<br>ASDVGSRAGQLHMIYE; SDVGSRAGQLHMIYED; DVGSRAGQLHMIYEDT;<br>VGSRAGQLHMIYEDTA; GSRAGQLHMIYEDTAS; SRAGQLHMIYEDTASK;<br>RAGQLHMIYEDTASKT; AGQLHMIYEDTASKTN; GQLHMIYEDTASKTNA;<br>QLHMIYEDTASKTNAL; LHMIYEDTASKTNALQ; HMIYEDTASKTNALQE;<br>MIYEDTASKTNALQEF; IYEDTASKTNALQEFF; YEDTASKTNALQEFFA;<br>EDTASKTNALQEFFAG; DTASKTNALQEFFAGH; TASKTNALQEFFAGHG;<br>ASKTNALQEFFAGHGA; SKTNALQEFFAGHGAQ; KTNALQEFFAGHGAQG;<br>TNALQEFFAGHGAQGF; NALQEFFAGHGAQGFF; ALQEFFAGHGAQGFFD;<br>LQEFFAGHGAQGFFDA; QEFFAGHGAQGFFDAQ; EFFAGHGAQGFFDAQA;<br>FFAGHGAQGFFDAQAQ; FAGHGAQGFFDAQAQM; AGHGAQGFFDAQAQML;<br>GHGAQGFFDAQAQMLS; HGAQGFFDAQAQMLSG; GAQGFFDAQAQMLSGL;<br>AQGFFDAQAQMLSGLQ; QGFFDAQAQMLSGLQG; GFFDAQAQMLSGLQGL;<br>FFDAQAQMLSGLQGLI; FDAQAQMLSGLQGLIE; DAQAQMLSGLQGLIET;<br>AQAQMLSGLQGLIETV; QAQMLSGLQGLIETVG; AQMLSGLQGLIETVGQ;<br>QMLSGLQGLIETVGQH; MLSGLQGLIETVGQHG; LSGLQGLIETVGQHGT;<br>SGLQGLIETVGQHGTT; GLQGLIETVGQHGTTT; LQGLIETVGQHGTTTG;<br>QGLIETVGQHGTTTGH; GLIETVGQHGTTTGHV; LIETVGQHGTTTGHVL;<br>IETVGQHGTTTGHVLD; ETVGQHGTTTGHVLDN; TVGQHGTTTGHVLDNA;<br>VGQHGTTTGHVLDNAI; GQHGTTTGHVLDNAIG; QHGTTTGHVLDNAIGT;<br>HGTTTGHVLDNAIGTD; GTTTGHVLDNAIGTDQ; TTTGHVLDNAIGTDQA; | |

Fig. 29 continued

| | | |
|---|---|---|
| | TTGHVLDNAIGTDQAI; TGHVLDNAIGTDQAIA; GHVLDNAIGTDQAIAG; HVLDNAIGTDQAIAGL; VLDNAIGTDQAIAGLF | |
| 77) Rv3891c | 13 mers:<br>MADTIQVTPQMLR; ADTIQVTPQMLRS; DTIQVTPQMLRST; TIQVTPQMLRSTA; IQVTPQMLRSTAN; QVTPQMLRSTAND; VTPQMLRSTANDI; TPQMLRSTANDIQ; PQMLRSTANDIQA; QMLRSTANDIQAN; MLRSTANDIQANM; LRSTANDIQANME; RSTANDIQANMEQ; STANDIQANMEQA; TANDIQANMEQAM; ANDIQANMEQAMG; NDIQANMEQAMGI; DIQANMEQAMGIA; IQANMEQAMGIAK; QANMEQAMGIAKG; ANMEQAMGIAKGY; NMEQAMGIAKGYL; MEQAMGIAKGYLA; EQAMGIAKGYLAN; QAMGIAKGYLANQ; AMGIAKGYLANQE; MGIAKGYLANQEN; GIAKGYLANQENV; IAKGYLANQENVM; AKGYLANQENVMN; KGYLANQENVMNP; GYLANQENVMNPA; YLANQENVMNPAT; LANQENVMNPATW; ANQENVMNPATWS; NQENVMNPATWSG; QENVMNPATWSGT; ENVMNPATWSGTG; NVMNPATWSGTGV; VMNPATWSGTGVV; MNPATWSGTGVVA; NPATWSGTGVVAS; PATWSGTGVVASH; ATWSGTGVVASHM; TWSGTGVVASHMT; WSGTGVVASHMTA; SGTGVVASHMTAT; GTGVVASHMTATE; TGVVASHMTATEI; GVVASHMTATEIT; VVASHMTATEITN; VASHMTATEITNE; ASHMTATEITNEL; SHMTATEITNELN; HMTATEITNELNK; MTATEITNELNKV; TATEITNELNKVL; ATEITNELNKVLT; TEITNELNKVLTG; EITNELNKVLTGG; ITNELNKVLTGGT; TNELNKVLTGGTR; NELNKVLTGGTRL; ELNKVLTGGTRLA; LNKVLTGGTRLAE; NKVLTGGTRLAEG; KVLTGGTRLAEGL; VLTGGTRLAEGLV; LTGGTRLAEGLVQ; TGGTRLAEGLVQA; GGTRLAEGLVQAA; GTRLAEGLVQAAA; TRLAEGLVQAAAL; RLAEGLVQAAALM; LAEGLVQAAALME; AEGLVQAAALMEG; EGLVQAAALMEGH; GLVQAAALMEGHE; LVQAAALMEGHEA; VQAAALMEGHEAD; QAAALMEGHEADS; AAALMEGHEADSQ; AALMEGHEADSQT; ALMEGHEADSQTA; LMEGHEADSQTAF; MEGHEADSQTAFQ; EGHEADSQTAFQA; GHEADSQTAFQAL; HEADSQTAFQALF; EADSQTAFQALFG; ADSQTAFQALFGA; DSQTAFQALFGAS; SQTAFQALFGASH; QTAFQALFGASHG; TAFQALFGASHGS;<br><br>14 mers:<br>MADTIQVTPQMLRS; ADTIQVTPQMLRST; DTIQVTPQMLRSTA; TIQVTPQMLRSTAN; IQVTPQMLRSTAND; QVTPQMLRSTANDI; VTPQMLRSTANDIQ; TPQMLRSTANDIQA; PQMLRSTANDIQAN; QMLRSTANDIQANM; MLRSTANDIQANME; LRSTANDIQANMEQ; RSTANDIQANMEQA; STANDIQANMEQAM; TANDIQANMEQAMG; ANDIQANMEQAMGI; NDIQANMEQAMGIA; DIQANMEQAMGIAK; IQANMEQAMGIAKG; QANMEQAMGIAKGY; ANMEQAMGIAKGYL; NMEQAMGIAKGYLA; MEQAMGIAKGYLAN; EQAMGIAKGYLANQ; QAMGIAKGYLANQE; AMGIAKGYLANQEN; MGIAKGYLANQENV; GIAKGYLANQENVM; IAKGYLANQENVMN; AKGYLANQENVMNP; KGYLANQENVMNPA; GYLANQENVMNPAT; YLANQENVMNPATW; LANQENVMNPATWS; ANQENVMNPATWSG; NQENVMNPATWSGT; QENVMNPATWSGTG; ENVMNPATWSGTGV; NVMNPATWSGTGVV; VMNPATWSGTGVVA; MNPATWSGTGVVAS; NPATWSGTGVVASH; PATWSGTGVVASHM; ATWSGTGVVASHMT; TWSGTGVVASHMTA; WSGTGVVASHMTAT; SGTGVVASHMTATE; GTGVVASHMTATEI; TGVVASHMTATEIT; GVVASHMTATEITN; VVASHMTATEITNE; VASHMTATEITNEL; ASHMTATEITNELN; SHMTATEITNELNK; HMTATEITNELNKV; MTATEITNELNKVL; TATEITNELNKVLT; ATEITNELNKVLTG; TEITNELNKVLTGG; EITNELNKVLTGGT; ITNELNKVLTGGTR; TNELNKVLTGGTRL; NELNKVLTGGTRLA; ELNKVLTGGTRLAE; | 113796-114169 |

Fig. 29 continued

| | | |
|---|---|---|
| | LNKVLTGGTRLAEG; NKVLTGGTRLAEGL; KVLTGGTRLAEGLV; VLTGGTRLAEGLVQ; LTGGTRLAEGLVQA; TGGTRLAEGLVQAA; GGTRLAEGLVQAAA; GTRLAEGLVQAAAL; TRLAEGLVQAAALM; RLAEGLVQAAALME; LAEGLVQAAALMEG; AEGLVQAAALMEGH; EGLVQAAALMEGHE; GLVQAAALMEGHEA; LVQAAALMEGHEAD; VQAAALMEGHEADS; QAAALMEGHEADSQ; AAALMEGHEADSQT; AALMEGHEADSQTA; ALMEGHEADSQTAF; LMEGHEADSQTAFQ; MEGHEADSQTAFQA; EGHEADSQTAFQAL; GHEADSQTAFQALF; HEADSQTAFQALFG; EADSQTAFQALFGA; ADSQTAFQALFGAS; DSQTAFQALFGASH; SQTAFQALFGASHG; QTAFQALFGASHGS;<br><br>15 mers:<br>MADTIQVTPQMLRST; ADTIQVTPQMLRSTA; DTIQVTPQMLRSTAN; TIQVTPQMLRSTAND; IQVTPQMLRSTANDI; QVTPQMLRSTANDIQ; VTPQMLRSTANDIQA; TPQMLRSTANDIQAN; PQMLRSTANDIQANM; QMLRSTANDIQANME; MLRSTANDIQANMEQ; LRSTANDIQANMEQA; RSTANDIQANMEQAM; STANDIQANMEQAMG; TANDIQANMEQAMGI; ANDIQANMEQAMGIA; NDIQANMEQAMGIAK; DIQANMEQAMGIAKG; IQANMEQAMGIAKGY; QANMEQAMGIAKGYL; ANMEQAMGIAKGYLA; NMEQAMGIAKGYLAN; MEQAMGIAKGYLANQ; EQAMGIAKGYLANQE; QAMGIAKGYLANQEN; AMGIAKGYLANQENV; MGIAKGYLANQENVM; GIAKGYLANQENVMN; IAKGYLANQENVMNP; AKGYLANQENVMNPA; KGYLANQENVMNPAT; GYLANQENVMNPATW; YLANQENVMNPATWS; LANQENVMNPATWSG; ANQENVMNPATWSGT; NQENVMNPATWSGTG; QENVMNPATWSGTGV; ENVMNPATWSGTGVV; NVMNPATWSGTGVVA; VMNPATWSGTGVVAS; MNPATWSGTGVVASH; NPATWSGTGVVASHM; PATWSGTGVVASHMT; ATWSGTGVVASHMTA; TWSGTGVVASHMTAT; WSGTGVVASHMTATE; SGTGVVASHMTATEI; GTGVVASHMTATEIT; TGVVASHMTATEITN; GVVASHMTATEITNE; VVASHMTATEITNEL; VASHMTATEITNELN; ASHMTATEITNELNK; SHMTATEITNELNKV; HMTATEITNELNKVL; MTATEITNELNKVLT; TATEITNELNKVLTG; ATEITNELNKVLTGG; TEITNELNKVLTGGT; EITNELNKVLTGGTR; ITNELNKVLTGGTRL; TNELNKVLTGGTRLA; NELNKVLTGGTRLAE; ELNKVLTGGTRLAEG; LNKVLTGGTRLAEGL; NKVLTGGTRLAEGLV; KVLTGGTRLAEGLVQ; VLTGGTRLAEGLVQA; LTGGTRLAEGLVQAA; TGGTRLAEGLVQAAA; GGTRLAEGLVQAAAL; GTRLAEGLVQAAALM; TRLAEGLVQAAALME; RLAEGLVQAAALMEG; LAEGLVQAAALMEGH; AEGLVQAAALMEGHE; EGLVQAAALMEGHEA; GLVQAAALMEGHEAD; LVQAAALMEGHEADS; VQAAALMEGHEADSQ; QAAALMEGHEADSQT; AAALMEGHEADSQTA; AALMEGHEADSQTAF; ALMEGHEADSQTAFQ; LMEGHEADSQTAFQA; MEGHEADSQTAFQAL; EGHEADSQTAFQALF; GHEADSQTAFQALFG; HEADSQTAFQALFGA; EADSQTAFQALFGAS; ADSQTAFQALFGASH; DSQTAFQALFGASHG; SQTAFQALFGASHGS;<br><br>16 mers:<br>MADTIQVTPQMLRSTA; ADTIQVTPQMLRSTAN; DTIQVTPQMLRSTAND; TIQVTPQMLRSTANDI; IQVTPQMLRSTANDIQ; QVTPQMLRSTANDIQA; VTPQMLRSTANDIQAN; TPQMLRSTANDIQANM; PQMLRSTANDIQANME; QMLRSTANDIQANMEQ; MLRSTANDIQANMEQA; LRSTANDIQANMEQAM; RSTANDIQANMEQAMG; STANDIQANMEQAMGI; TANDIQANMEQAMGIA; ANDIQANMEQAMGIAK; NDIQANMEQAMGIAKG; DIQANMEQAMGIAKGY; IQANMEQAMGIAKGYL; QANMEQAMGIAKGYLA; ANMEQAMGIAKGYLAN; NMEQAMGIAKGYLANQ; MEQAMGIAKGYLANQE; EQAMGIAKGYLANQEN; | |

Fig. 29 continued

| | | |
|---|---|---|
| | QAMGIAKGYLANQENV; AMGIAKGYLANQENVM; MGIAKGYLANQENVMN; GIAKGYLANQENVMNP; IAKGYLANQENVMNPA; AKGYLANQENVMNPAT; KGYLANQENVMNPATW; GYLANQENVMNPATWS; YLANQENVMNPATWSG; LANQENVMNPATWSGT; ANQENVMNPATWSGTG; NQENVMNPATWSGTGV; QENVMNPATWSGTGVV; ENVMNPATWSGTGVVA; NVMNPATWSGTGVVAS; VMNPATWSGTGVVASH; MNPATWSGTGVVASHM; NPATWSGTGVVASHMT; PATWSGTGVVASHMTA; ATWSGTGVVASHMTAT; TWSGTGVVASHMTATE; WSGTGVVASHMTATEI; SGTGVVASHMTATEIT; GTGVVASHMTATEITN; TGVVASHMTATEITNE; GVVASHMTATEITNEL; VVASHMTATEITNELN; VASHMTATEITNELNK; ASHMTATEITNELNKV; SHMTATEITNELNKVL; HMTATEITNELNKVLT; MTATEITNELNKVLTG; TATEITNELNKVLTGG; ATEITNELNKVLTGGT; TEITNELNKVLTGGTR; EITNELNKVLTGGTRL; ITNELNKVLTGGTRLA; TNELNKVLTGGTRLAE; NELNKVLTGGTRLAEG; ELNKVLTGGTRLAEGL; LNKVLTGGTRLAEGLV; NKVLTGGTRLAEGLVQ; KVLTGGTRLAEGLVQA; VLTGGTRLAEGLVQAA; LTGGTRLAEGLVQAAA; TGGTRLAEGLVQAAAL; GGTRLAEGLVQAAALM; GTRLAEGLVQAAALME; TRLAEGLVQAAALMEG; RLAEGLVQAAALMEGH; LAEGLVQAAALMEGHE; AEGLVQAAALMEGHEA; EGLVQAAALMEGHEAD; GLVQAAALMEGHEADS; LVQAAALMEGHEADSQ; VQAAALMEGHEADSQT; QAAALMEGHEADSQTA; AAALMEGHEADSQTAF; AALMEGHEADSQTAFQ; ALMEGHEADSQTAFQA; LMEGHEADSQTAFQAL; MEGHEADSQTAFQALF; EGHEADSQTAFQALFG; GHEADSQTAFQALFGA; HEADSQTAFQALFGAS; EADSQTAFQALFGASH; ADSQTAFQALFGASHG; DSQTAFQALFGASHGS | |
| 78) Rv3904c | 13 mers:<br>MDPTVLADAVARM; DPTVLADAVARMA; PTVLADAVARMAE; TVLADAVARMAEF; VLADAVARMAEFG; LADAVARMAEFGR; ADAVARMAEFGRH; DAVARMAEFGRHV; AVARMAEFGRHVE; VARMAEFGRHVEE; ARMAEFGRHVEEL; RMAEFGRHVEELV; MAEFGRHVEELVA; AEFGRHVEELVAE; EFGRHVEELVAEI; FGRHVEELVAEIE; GRHVEELVAEIES; RHVEELVAEIESL; HVEELVAEIESLV; VEELVAEIESLVT; EELVAEIESLVTR; ELVAEIESLVTRL; LVAEIESLVTRLH; VAEIESLVTRLHV; AEIESLVTRLHVT; EIESLVTRLHVTW; IESLVTRLHVTWT; ESLVTRLHVTWTG; SLVTRLHVTWTGE; LVTRLHVTWTGEG; VTRLHVTWTGEGA; TRLHVTWTGEGAA; RLHVTWTGEGAAA; LHVTWTGEGAAAH; HVTWTGEGAAAHA; VTWTGEGAAAHAE; TWTGEGAAAHAEA; WTGEGAAAHAEAQ; TGEGAAAHAEAQR; GEGAAAHAEAQRH; EGAAAHAEAQRHW; GAAAHAEAQRHWA; AAAHAEAQRHWAA; AAHAEAQRHWAAG; AHAEAQRHWAAGE; HAEAQRHWAAGEA; AEAQRHWAAGEAM; EAQRHWAAGEAMM; AQRHWAAGEAMMR; QRHWAAGEAMMRQ; RHWAAGEAMMRQA; HWAAGEAMMRQAL; WAAGEAMMRQALA; AAGEAMMRQALAQ; AGEAMMRQALAQL; GEAMMRQALAQLT; EAMMRQALAQLTA; AMMRQALAQLTAA; MMRQALAQLTAAG; MRQALAQLTAAGQ; RQALAQLTAAGQS; QALAQLTAAGQSA; ALAQLTAAGQSAH; LAQLTAAGQSAHA; AQLTAAGQSAHAN; QLTAAGQSAHANY; LTAAGQSAHANYT; TAAGQSAHANYTG; AAGQSAHANYTGA; AGQSAHANYTGAM; GQSAHANYTGAMA; QSAHANYTGAMAT; SAHANYTGAMATN; AHANYTGAMATNL; HANYTGAMATNLG; ANYTGAMATNLGM; NYTGAMATNLGMW; YTGAMATNLGMWS;<br><br>14 mers:<br>MDPTVLADAVARMA; DPTVLADAVARMAE; PTVLADAVARMAEF; TVLADAVARMAEFG; VLADAVARMAEFGR; LADAVARMAEFGRH; | 114170-114475 |

Fig. 29 continued

| | | |
|---|---|---|
| | ADAVARMAEFGRHV; DAVARMAEFGRHVE; AVARMAEFGRHVEE; VARMAEFGRHVEEL; ARMAEFGRHVEELV; RMAEFGRHVEELVA; MAEFGRHVEELVAE; AEFGRHVEELVAEI; EFGRHVEELVAEIE; FGRHVEELVAEIES; GRHVEELVAEIESL; RHVEELVAEIESLV; HVEELVAEIESLVT; VEELVAEIESLVTR; EELVAEIESLVTRL; ELVAEIESLVTRLH; LVAEIESLVTRLHV; VAEIESLVTRLHVT; AEIESLVTRLHVTW; EIESLVTRLHVTWT; IESLVTRLHVTWTG; ESLVTRLHVTWTGE; SLVTRLHVTWTGEG; LVTRLHVTWTGEGA; VTRLHVTWTGEGAA; TRLHVTWTGEGAAA; RLHVTWTGEGAAAH; LHVTWTGEGAAAHA; HVTWTGEGAAAHAE; VTWTGEGAAAHAEA; TWTGEGAAAHAEAQ; WTGEGAAAHAEAQR; TGEGAAAHAEAQRH; GEGAAAHAEAQRHW; EGAAAHAEAQRHWA; GAAAHAEAQRHWAA; AAAHAEAQRHWAAG; AAHAEAQRHWAAGE; AHAEAQRHWAAGEA; HAEAQRHWAAGEAM; AEAQRHWAAGEAMM; EAQRHWAAGEAMMR; AQRHWAAGEAMMRQ; QRHWAAGEAMMRQA; RHWAAGEAMMRQAL; HWAAGEAMMRQALA; WAAGEAMMRQALAQ; AAGEAMMRQALAQL; AGEAMMRQALAQLT; GEAMMRQALAQLTA; EAMMRQALAQLTAA; AMMRQALAQLTAAG; MMRQALAQLTAAGQ; MRQALAQLTAAGQS; RQALAQLTAAGQSA; QALAQLTAAGQSAH; ALAQLTAAGQSAHA; LAQLTAAGQSAHAN; AQLTAAGQSAHANY; QLTAAGQSAHANYT; LTAAGQSAHANYTG; TAAGQSAHANYTGA; AAGQSAHANYTGAM; AGQSAHANYTGAMA; GQSAHANYTGAMAT; QSAHANYTGAMATN; SAHANYTGAMATNL; AHANYTGAMATNLG; HANYTGAMATNLGM; ANYTGAMATNLGMW; NYTGAMATNLGMWS;<br><br>15 mers:<br>MDPTVLADAVARMAE; DPTVLADAVARMAEF; PTVLADAVARMAEFG; TVLADAVARMAEFGR; VLADAVARMAEFGRH; LADAVARMAEFGRHV; ADAVARMAEFGRHVE; DAVARMAEFGRHVEE; AVARMAEFGRHVEEL; VARMAEFGRHVEELV; ARMAEFGRHVEELVA; RMAEFGRHVEELVAE; MAEFGRHVEELVAEI; AEFGRHVEELVAEIE; EFGRHVEELVAEIES; FGRHVEELVAEIESL; GRHVEELVAEIESLV; RHVEELVAEIESLVT; HVEELVAEIESLVTR; VEELVAEIESLVTRL; EELVAEIESLVTRLH; ELVAEIESLVTRLHV; LVAEIESLVTRLHVT; VAEIESLVTRLHVTW; AEIESLVTRLHVTWT; EIESLVTRLHVTWTG; IESLVTRLHVTWTGE; ESLVTRLHVTWTGEG; SLVTRLHVTWTGEGA; LVTRLHVTWTGEGAA; VTRLHVTWTGEGAAA; TRLHVTWTGEGAAAH; RLHVTWTGEGAAAHA; LHVTWTGEGAAAHAE; HVTWTGEGAAAHAEA; VTWTGEGAAAHAEAQ; TWTGEGAAAHAEAQR; WTGEGAAAHAEAQRH; TGEGAAAHAEAQRHW; GEGAAAHAEAQRHWA; EGAAAHAEAQRHWAA; GAAAHAEAQRHWAAG; AAAHAEAQRHWAAGE; AAHAEAQRHWAAGEA; AHAEAQRHWAAGEAM; HAEAQRHWAAGEAMM; AEAQRHWAAGEAMMR; EAQRHWAAGEAMMRQ; AQRHWAAGEAMMRQA; QRHWAAGEAMMRQAL; RHWAAGEAMMRQALA; HWAAGEAMMRQALAQ; WAAGEAMMRQALAQL; AAGEAMMRQALAQLT; AGEAMMRQALAQLTA; GEAMMRQALAQLTAA; EAMMRQALAQLTAAG; AMMRQALAQLTAAGQ; MMRQALAQLTAAGQS; MRQALAQLTAAGQSA; RQALAQLTAAGQSAH; QALAQLTAAGQSAHA; ALAQLTAAGQSAHAN; LAQLTAAGQSAHANY; AQLTAAGQSAHANYT; QLTAAGQSAHANYTG; LTAAGQSAHANYTGA; TAAGQSAHANYTGAM; AAGQSAHANYTGAMA; AGQSAHANYTGAMAT; GQSAHANYTGAMATN; QSAHANYTGAMATNL; SAHANYTGAMATNLG; AHANYTGAMATNLGM; HANYTGAMATNLGMW; ANYTGAMATNLGMWS;<br><br>16 mers: | |

Fig. 29 continued

| | | |
|---|---|---|
| | MDPTVLADAVARMAEF; DPTVLADAVARMAEFG; PTVLADAVARMAEFGR; TVLADAVARMAEFGRH; VLADAVARMAEFGRHV; LADAVARMAEFGRHVE; ADAVARMAEFGRHVEE; DAVARMAEFGRHVEEL; AVARMAEFGRHVEELV; VARMAEFGRHVEELVA; ARMAEFGRHVEELVAE; RMAEFGRHVEELVAEI; MAEFGRHVEELVAEIE; AEFGRHVEELVAEIES; EFGRHVEELVAEIESL; FGRHVEELVAEIESLV; GRHVEELVAEIESLVT; RHVEELVAEIESLVTR; HVEELVAEIESLVTRL; VEELVAEIESLVTRLH; EELVAEIESLVTRLHV; ELVAEIESLVTRLHVT; LVAEIESLVTRLHVTW; VAEIESLVTRLHVTWT; AEIESLVTRLHVTWTG; EIESLVTRLHVTWTGE; IESLVTRLHVTWTGEG; ESLVTRLHVTWTGEGA; SLVTRLHVTWTGEGAA; LVTRLHVTWTGEGAAA; VTRLHVTWTGEGAAAH; TRLHVTWTGEGAAAHA; RLHVTWTGEGAAAHAE; LHVTWTGEGAAAHAEA; HVTWTGEGAAAHAEAQ; VTWTGEGAAAHAEAQR; TWTGEGAAAHAEAQRH; WTGEGAAAHAEAQRHW; TGEGAAAHAEAQRHWA; GEGAAAHAEAQRHWAA; EGAAAHAEAQRHWAAG; GAAAHAEAQRHWAAGE; AAAHAEAQRHWAAGEA; AAHAEAQRHWAAGEAM; AHAEAQRHWAAGEAMM; HAEAQRHWAAGEAMMR; AEAQRHWAAGEAMMRQ; EAQRHWAAGEAMMRQA; AQRHWAAGEAMMRQAL; QRHWAAGEAMMRQALA; RHWAAGEAMMRQALAQ; HWAAGEAMMRQALAQL; WAAGEAMMRQALAQLT; AAGEAMMRQALAQLTA; AGEAMMRQALAQLTAA; GEAMMRQALAQLTAAG; EAMMRQALAQLTAAGQ; AMMRQALAQLTAAGQS; MMRQALAQLTAAGQSA; MRQALAQLTAAGQSAH; RQALAQLTAAGQSAHA; QALAQLTAAGQSAHAN; ALAQLTAAGQSAHANY; LAQLTAAGQSAHANYT; AQLTAAGQSAHANYTG; QLTAAGQSAHANYTGA; LTAAGQSAHANYTGAM; TAAGQSAHANYTGAMA; AAGQSAHANYTGAMAT; AGQSAHANYTGAMATN; GQSAHANYTGAMATNL; QSAHANYTGAMATNLG; SAHANYTGAMATNLGM; AHANYTGAMATNLGMW; HANYTGAMATNLGMWS | |
| 79) Rv3905c | 13 mers: MGADDTLRVEPAV; GADDTLRVEPAVM; ADDTLRVEPAVMQ; DDTLRVEPAVMQG; DTLRVEPAVMQGF; TLRVEPAVMQGFA; LRVEPAVMQGFAA; RVEPAVMQGFAAS; VEPAVMQGFAASL; EPAVMQGFAASLD; PAVMQGFAASLDG; AVMQGFAASLDGA; VMQGFAASLDGAA; MQGFAASLDGAAE; QGFAASLDGAAEH; GFAASLDGAAEHL; FAASLDGAAEHLA; AASLDGAAEHLAV; ASLDGAAEHLAVQ; SLDGAAEHLAVQL; LDGAAEHLAVQLA; DGAAEHLAVQLAE; GAAEHLAVQLAEL; AAEHLAVQLAELD; AEHLAVQLAELDA; EHLAVQLAELDAQ; HLAVQLAELDAQV; LAVQLAELDAQVG; AVQLAELDAQVGQ; VQLAELDAQVGQM; QLAELDAQVGQML; LAELDAQVGQMLG; AELDAQVGQMLGG; ELDAQVGQMLGGW; LDAQVGQMLGGWR; DAQVGQMLGGWRG; AQVGQMLGGWRGA; QVGQMLGGWRGAS; VGQMLGGWRGASG; GQMLGGWRGASGS; QMLGGWRGASGSA; MLGGWRGASGSAY; LGGWRGASGSAYG; GGWRGASGSAYGS; GWRGASGSAYGSA; WRGASGSAYGSAW; RGASGSAYGSAWE; GASGSAYGSAWEL; ASGSAYGSAWELW; SGSAYGSAWELWH; GSAYGSAWELWHR; SAYGSAWELWHRG; AYGSAWELWHRGA; YGSAWELWHRGAG; GSAWELWHRGAGE; SAWELWHRGAGEV; AWELWHRGAGEVQ; WELWHRGAGEVQL; ELWHRGAGEVQLG; LWHRGAGEVQLGL; WHRGAGEVQLGLS; HRGAGEVQLGLSM; RGAGEVQLGLSML; GAGEVQLGLSMLA; AGEVQLGLSMLAA; GEVQLGLSMLAAA; EVQLGLSMLAAAI; VQLGLSMLAAAIA; QLGLSMLAAAIAH; LGLSMLAAAIAHA; GLSMLAAAIAHAG; LSMLAAAIAHAGA; SMLAAAIAHAGAG; MLAAAIAHAGAGY; LAAAIAHAGAGYQ; AAAIAHAGAGYQH; AAIAHAGAGYQHN; AIAHAGAGYQHNE; IAHAGAGYQHNET; AHAGAGYQHNETA; HAGAGYQHNETAS; AGAGYQHNETASA; GAGYQHNETASAQ; AGYQHNETASAQV; GYQHNETASAQVL; YQHNETASAQVLR; QHNETASAQVLRE; HNETASAQVLREV; NETASAQVLREVG; | 114476-114833 |

Fig. 29 continued

ETASAQVLREVGG; TASAQVLREVGGG;

14 mers:
MGADDTLRVEPAVM; GADDTLRVEPAVMQ; ADDTLRVEPAVMQG;
DDTLRVEPAVMQGF; DTLRVEPAVMQGFA; TLRVEPAVMQGFAA;
LRVEPAVMQGFAAS; RVEPAVMQGFAASL; VEPAVMQGFAASLD;
EPAVMQGFAASLDG; PAVMQGFAASLDGA; AVMQGFAASLDGAA;
VMQGFAASLDGAAE; MQGFAASLDGAAEH; QGFAASLDGAAEHL;
GFAASLDGAAEHLA; FAASLDGAAEHLAV; AASLDGAAEHLAVQ;
ASLDGAAEHLAVQL; SLDGAAEHLAVQLA; LDGAAEHLAVQLAE;
DGAAEHLAVQLAEL; GAAEHLAVQLAELD; AAEHLAVQLAELDA;
AEHLAVQLAELDAQ; EHLAVQLAELDAQV; HLAVQLAELDAQVG;
LAVQLAELDAQVGQ; AVQLAELDAQVGQM; VQLAELDAQVGQML;
QLAELDAQVGQMLG; LAELDAQVGQMLGG; AELDAQVGQMLGGW;
ELDAQVGQMLGGWR; LDAQVGQMLGGWRG; DAQVGQMLGGWRGA;
AQVGQMLGGWRGAS; QVGQMLGGWRGASG; VGQMLGGWRGASGS;
GQMLGGWRGASGSA; QMLGGWRGASGSAY; MLGGWRGASGSAYG;
LGGWRGASGSAYGS; GGWRGASGSAYGSA; GWRGASGSAYGSAW;
WRGASGSAYGSAWE; RGASGSAYGSAWEL; GASGSAYGSAWELW;
ASGSAYGSAWELWH; SGSAYGSAWELWHR; GSAYGSAWELWHRG;
SAYGSAWELWHRGA; AYGSAWELWHRGAG; YGSAWELWHRGAGE;
GSAWELWHRGAGEV; SAWELWHRGAGEVQ; AWELWHRGAGEVQL;
WELWHRGAGEVQLG; ELWHRGAGEVQLGL; LWHRGAGEVQLGLS;
WHRGAGEVQLGLSM; HRGAGEVQLGLSML; RGAGEVQLGLSMLA;
GAGEVQLGLSMLAA; AGEVQLGLSMLAAA; GEVQLGLSMLAAAI;
EVQLGLSMLAAAIA; VQLGLSMLAAAIAH; QLGLSMLAAAIAHA;
LGLSMLAAAIAHAG; GLSMLAAAIAHAGA; LSMLAAAIAHAGAG;
SMLAAAIAHAGAGY; MLAAAIAHAGAGYQ; LAAAIAHAGAGYQH;
AAAIAHAGAGYQHN; AAIAHAGAGYQHNE; AIAHAGAGYQHNET;
IAHAGAGYQHNETA; AHAGAGYQHNETAS; HAGAGYQHNETASA;
AGAGYQHNETASAQ; GAGYQHNETASAQV; AGYQHNETASAQVL;
GYQHNETASAQVLR; YQHNETASAQVLRE; QHNETASAQVLREV;
HNETASAQVLREVG; NETASAQVLREVGG; ETASAQVLREVGGG;

15 mers:
MGADDTLRVEPAVMQ; GADDTLRVEPAVMQG; ADDTLRVEPAVMQGF;
DDTLRVEPAVMQGFA; DTLRVEPAVMQGFAA; TLRVEPAVMQGFAAS;
LRVEPAVMQGFAASL; RVEPAVMQGFAASLD; VEPAVMQGFAASLDG;
EPAVMQGFAASLDGA; PAVMQGFAASLDGAA; AVMQGFAASLDGAAE;
VMQGFAASLDGAAEH; MQGFAASLDGAAEHL; QGFAASLDGAAEHLA;
GFAASLDGAAEHLAV; FAASLDGAAEHLAVQ; AASLDGAAEHLAVQL;
ASLDGAAEHLAVQLA; SLDGAAEHLAVQLAE; LDGAAEHLAVQLAEL;
DGAAEHLAVQLAELD; GAAEHLAVQLAELDA; AAEHLAVQLAELDAQ;
AEHLAVQLAELDAQV; EHLAVQLAELDAQVG; HLAVQLAELDAQVGQ;
LAVQLAELDAQVGQM; AVQLAELDAQVGQML; VQLAELDAQVGQMLG;
QLAELDAQVGQMLGG; LAELDAQVGQMLGGW; AELDAQVGQMLGGWR;
ELDAQVGQMLGGWRG; LDAQVGQMLGGWRGA; DAQVGQMLGGWRGAS;
AQVGQMLGGWRGASG; QVGQMLGGWRGASGS; VGQMLGGWRGASGSA;
GQMLGGWRGASGSAY; QMLGGWRGASGSAYG; MLGGWRGASGSAYGS;
LGGWRGASGSAYGSA; GGWRGASGSAYGSAW; GWRGASGSAYGSAWE;
WRGASGSAYGSAWEL; RGASGSAYGSAWELW; GASGSAYGSAWELWH;
ASGSAYGSAWELWHR; SGSAYGSAWELWHRG; GSAYGSAWELWHRGA;
SAYGSAWELWHRGAG; AYGSAWELWHRGAGE; YGSAWELWHRGAGEV;

Fig. 29 continued

| | | |
|---|---|---|
| | GSAWELWHRGAGEVQ; SAWELWHRGAGEVQL; AWELWHRGAGEVQLG; WELWHRGAGEVQLGL; ELWHRGAGEVQLGLS; LWHRGAGEVQLGLSM; WHRGAGEVQLGLSML; HRGAGEVQLGLSMLA; RGAGEVQLGLSMLAA; GAGEVQLGLSMLAAA; AGEVQLGLSMLAAAI; GEVQLGLSMLAAAIA; EVQLGLSMLAAAIAH; VQLGLSMLAAAIAHA; QLGLSMLAAAIAHAG; LGLSMLAAAIAHAGA; GLSMLAAAIAHAGAG; LSMLAAAIAHAGAGY; SMLAAAIAHAGAGYQ; MLAAAIAHAGAGYQH; LAAAIAHAGAGYQHN; AAAIAHAGAGYQHNE; AAIAHAGAGYQHNET; AIAHAGAGYQHNETA; IAHAGAGYQHNETAS; AHAGAGYQHNETASA; HAGAGYQHNETASAQ; AGAGYQHNETASAQV; GAGYQHNETASAQVL; AGYQHNETASAQVLR; GYQHNETASAQVLRE; YQHNETASAQVLREV; QHNETASAQVLREVG; HNETASAQVLREVGG; NETASAQVLREVGGG;<br><br>16 mers:<br>MGADDTLRVEPAVMQG; GADDTLRVEPAVMQGF; ADDTLRVEPAVMQGFA; DDTLRVEPAVMQGFAA; DTLRVEPAVMQGFAAS; TLRVEPAVMQGFAASL; LRVEPAVMQGFAASLD; RVEPAVMQGFAASLDG; VEPAVMQGFAASLDGA; EPAVMQGFAASLDGAA; PAVMQGFAASLDGAAE; AVMQGFAASLDGAAEH; VMQGFAASLDGAAEHL; MQGFAASLDGAAEHLA; QGFAASLDGAAEHLAV; GFAASLDGAAEHLAVQ; FAASLDGAAEHLAVQL; AASLDGAAEHLAVQLA; ASLDGAAEHLAVQLAE; SLDGAAEHLAVQLAEL; LDGAAEHLAVQLAELD; DGAAEHLAVQLAELDA; GAAEHLAVQLAELDAQ; AAEHLAVQLAELDAQV; AEHLAVQLAELDAQVG; EHLAVQLAELDAQVGQ; HLAVQLAELDAQVGQM; LAVQLAELDAQVGQML; AVQLAELDAQVGQMLG; VQLAELDAQVGQMLGG; QLAELDAQVGQMLGGW; LAELDAQVGQMLGGWR; AELDAQVGQMLGGWRG; ELDAQVGQMLGGWRGA; LDAQVGQMLGGWRGAS; DAQVGQMLGGWRGASG; AQVGQMLGGWRGASGS; QVGQMLGGWRGASGSA; VGQMLGGWRGASGSAY; GQMLGGWRGASGSAYG; QMLGGWRGASGSAYGS; MLGGWRGASGSAYGSA; LGGWRGASGSAYGSAW; GGWRGASGSAYGSAWE; GWRGASGSAYGSAWEL; WRGASGSAYGSAWELW; RGASGSAYGSAWELWH; GASGSAYGSAWELWHR; ASGSAYGSAWELWHRG; SGSAYGSAWELWHRGA; GSAYGSAWELWHRGAG; SAYGSAWELWHRGAGE; AYGSAWELWHRGAGEV; YGSAWELWHRGAGEVQ; GSAWELWHRGAGEVQL; SAWELWHRGAGEVQLG; AWELWHRGAGEVQLGL; WELWHRGAGEVQLGLS; ELWHRGAGEVQLGLSM; LWHRGAGEVQLGLSML; WHRGAGEVQLGLSMLA; HRGAGEVQLGLSMLAA; RGAGEVQLGLSMLAAA; GAGEVQLGLSMLAAAI; AGEVQLGLSMLAAAIA; GEVQLGLSMLAAAIAH; EVQLGLSMLAAAIAHA; VQLGLSMLAAAIAHAG; QLGLSMLAAAIAHAGA; LGLSMLAAAIAHAGAG; GLSMLAAAIAHAGAGY; LSMLAAAIAHAGAGYQ; SMLAAAIAHAGAGYQH; MLAAAIAHAGAGYQHN; LAAAIAHAGAGYQHNE; AAAIAHAGAGYQHNET; AAIAHAGAGYQHNETA; AIAHAGAGYQHNETAS; IAHAGAGYQHNETASA; AHAGAGYQHNETASAQ; HAGAGYQHNETASAQV; AGAGYQHNETASAQVL; GAGYQHNETASAQVLR; AGYQHNETASAQVLRE; GYQHNETASAQVLREV; YQHNETASAQVLREVG; QHNETASAQVLREVGG; HNETASAQVLREVGGG | |
| 80) MT3106.1 | 13 mers:<br>MSRQASRQVSIIR; SRQASRQVSIIRS; RQASRQVSIIRSA; QASRQVSIIRSAG; ASRQVSIIRSAGD; SRQVSIIRSAGDG; RQVSIIRSAGDGN; QVSIIRSAGDGNR; VSIIRSAGDGNRS; SIIRSAGDGNRSC; IIRSAGDGNRSCG; IRSAGDGNRSCGC; RSAGDGNRSCGCV; SAGDGNRSCGCVT; AGDGNRSCGCVTP; GDGNRSCGCVTPK; DGNRSCGCVTPKE; GNRSCGCVTPKEG; NRSCGCVTPKEGV; RSCGCVTPKEGVW; SCGCVTPKEGVWV; CGCVTPKEGVWVV; GCVTPKEGVWVVT; CVTPKEGVWVVTL; VTPKEGVWVVTLR; TPKEGVWVVTLRV; PKEGVWVVTLRVV; | 114834-115327 |

Fig. 29 continued

| | | | |
|---|---|---|---|
| | KEGVWVVTLRVVP; EGVWVVTLRVVPE; GVWVVTLRVVPEG; VWVVTLRVVPEGL; WVVTLRVVPEGLA; VVTLRVVPEGLAA; VTLRVVPEGLAAA; TLRVVPEGLAAAS; LRVVPEGLAAASA; RVVPEGLAAASAA; VVPEGLAAASAAV; VPEGLAAASAAVE; PEGLAAASAAVEA; EGLAAASAAVEAL; GLAAASAAVEALT; LAAASAAVEALTA; AAASAAVEALTAR; AASAAVEALTARL; ASAAVEALTARLA; SAAVEALTARLAA; AAVEALTARLAAA; AVEALTARLAAAH; VEALTARLAAAHA; EALTARLAAAHAG; ALTARLAAAHAGA; LTARLAAAHAGAA; TARLAAAHAGAAP; ARLAAAHAGAAPA; RLAAAHAGAAPAI; LAAAHAGAAPAIT; AAAHAGAAPAITA; AAHAGAAPAITAV; AHAGAAPAITAVV; HAGAAPAITAVVA; AGAAPAITAVVAP; GAAPAITAVVAPA; AAPAITAVVAPAA; APAITAVVAPAAD; PAITAVVAPAADP; AITAVVAPAADPV; ITAVVAPAADPVS; TAVVAPAADPVSL; AVVAPAADPVSLQ; VVAPAADPVSLQS; VAPAADPVSLQSA; APAADPVSLQSAV; PAADPVSLQSAVG; AADPVSLQSAVGF; ADPVSLQSAVGFS; DPVSLQSAVGFSA; PVSLQSAVGFSAL; VSLQSAVGFSALG; SLQSAVGFSALGS; LQSAVGFSALGSE; QSAVGFSALGSEH; SAVGFSALGSEHA; AVGFSALGSEHAA; VGFSALGSEHAAI; GFSALGSEHAAIA; FSALGSEHAAIAG; SALGSEHAAIAGE; ALGSEHAAIAGEG; LGSEHAAIAGEGV; GSEHAAIAGEGVE; SEHAAIAGEGVEE; EHAAIAGEGVEEL; HAAIAGEGVEELG; AAIAGEGVEELGR; AIAGEGVEELGRS; IAGEGVEELGRSG; AGEGVEELGRSGV; GEGVEELGRSGVA; EGVEELGRSGVAV; GVEELGRSGVAVG; VEELGRSGVAVGE; EELGRSGVAVGES; ELGRSGVAVGESG; LGRSGVAVGESGI; GRSGVAVGESGIG; RSGVAVGESGIGY; SGVAVGESGIGYA; GVAVGESGIGYAA; VAVGESGIGYAAG; AVGESGIGYAAGD; VGESGIGYAAGDA; GESGIGYAAGDAV; ESGIGYAAGDAVA; SGIGYAAGDAVAA; GIGYAAGDAVAAA; IGYAAGDAVAAAT; GYAAGDAVAAATY; YAAGDAVAAATYL; AAGDAVAAATYLV; AGDAVAAATYLVS; GDAVAAATYLVSG; DAVAAATYLVSGG; AVAAATYLVSGGS; VAAATYLVSGGSL;<br><br>14 mers:<br>MSRQASRQVSIIRS; SRQASRQVSIIRSA; RQASRQVSIIRSAG; QASRQVSIIRSAGD; ASRQVSIIRSAGDG; SRQVSIIRSAGDGN; RQVSIIRSAGDGNR; QVSIIRSAGDGNRS; VSIIRSAGDGNRSC; SIIRSAGDGNRSCG; IIRSAGDGNRSCGC; IRSAGDGNRSCGCV; RSAGDGNRSCGCVT; SAGDGNRSCGCVTP; AGDGNRSCGCVTPK; GDGNRSCGCVTPKE; DGNRSCGCVTPKEG; GNRSCGCVTPKEGV; NRSCGCVTPKEGVW; RSCGCVTPKEGVWV; SCGCVTPKEGVWVV; CGCVTPKEGVWVVT; GCVTPKEGVWVVTL; CVTPKEGVWVVTLR; VTPKEGVWVVTLRV; TPKEGVWVVTLRVV; PKEGVWVVTLRVVP; KEGVWVVTLRVVPE; EGVWVVTLRVVPEG; GVWVVTLRVVPEGL; VWVVTLRVVPEGLA; WVVTLRVVPEGLAA; VVTLRVVPEGLAAA; VTLRVVPEGLAAAS; TLRVVPEGLAAASA; LRVVPEGLAAASAA; RVVPEGLAAASAAV; VVPEGLAAASAAVE; VPEGLAAASAAVEA; PEGLAAASAAVEAL; EGLAAASAAVEALT; GLAAASAAVEALTA; LAAASAAVEALTAR; AAASAAVEALTARL; AASAAVEALTARLA; ASAAVEALTARLAA; SAAVEALTARLAAA; AAVEALTARLAAAH; AVEALTARLAAAHA; VEALTARLAAAHAG; EALTARLAAAHAGA; ALTARLAAAHAGAA; LTARLAAAHAGAAP; TARLAAAHAGAAPA; ARLAAAHAGAAPAI; RLAAAHAGAAPAIT; LAAAHAGAAPAITA; AAAHAGAAPAITAV; AAHAGAAPAITAVV; AHAGAAPAITAVVA; HAGAAPAITAVVAP; AGAAPAITAVVAPA; GAAPAITAVVAPAA; AAPAITAVVAPAAD; APAITAVVAPAADP; PAITAVVAPAADPV; AITAVVAPAADPVS; ITAVVAPAADPVSL; TAVVAPAADPVSLQ; AVVAPAADPVSLQS; VVAPAADPVSLQSA; VAPAADPVSLQSAV; APAADPVSLQSAVG; PAADPVSLQSAVGF; AADPVSLQSAVGFS; | |

Fig. 29 continued

| | | | |
|---|---|---|---|
| | ADPVSLQSAVGFSA; DPVSLQSAVGFSAL; PVSLQSAVGFSALG; VSLQSAVGFSALGS; SLQSAVGFSALGSE; LQSAVGFSALGSEH; QSAVGFSALGSEHA; SAVGFSALGSEHAA; AVGFSALGSEHAAI; VGFSALGSEHAAIA; GFSALGSEHAAIAG; FSALGSEHAAIAGE; SALGSEHAAIAGEG; ALGSEHAAIAGEGV; LGSEHAAIAGEGVE; GSEHAAIAGEGVEE; SEHAAIAGEGVEEL; EHAAIAGEGVEELG; HAAIAGEGVEELGR; AAIAGEGVEELGRS; AIAGEGVEELGRSG; IAGEGVEELGRSGV; AGEGVEELGRSGVA; GEGVEELGRSGVAV; EGVEELGRSGVAVG; GVEELGRSGVAVGE; VEELGRSGVAVGES; EELGRSGVAVGESG; ELGRSGVAVGESGI; LGRSGVAVGESGIG; GRSGVAVGESGIGY; RSGVAVGESGIGYA; SGVAVGESGIGYAA; GVAVGESGIGYAAG; VAVGESGIGYAAGD; AVGESGIGYAAGDA; VGESGIGYAAGDAV; GESGIGYAAGDAVA; ESGIGYAAGDAVAA; SGIGYAAGDAVAAA; GIGYAAGDAVAAAT; IGYAAGDAVAAATY; GYAAGDAVAAATYL; YAAGDAVAAATYLV; AAGDAVAAATYLVS; AGDAVAAATYLVSG; GDAVAAATYLVSGG; DAVAAATYLVSGGS; AVAAATYLVSGGSL;<br><br>15 mers:<br>MSRQASRQVSIIRSA; SRQASRQVSIIRSAG; RQASRQVSIIRSAGD; QASRQVSIIRSAGDG; ASRQVSIIRSAGDGN; SRQVSIIRSAGDGNR; RQVSIIRSAGDGNRS; QVSIIRSAGDGNRSC; VSIIRSAGDGNRSCG; SIIRSAGDGNRSCGC; IIRSAGDGNRSCGCV; IRSAGDGNRSCGCVT; RSAGDGNRSCGCVTP; SAGDGNRSCGCVTPK; AGDGNRSCGCVTPKE; GDGNRSCGCVTPKEG; DGNRSCGCVTPKEGV; GNRSCGCVTPKEGVW; NRSCGCVTPKEGVWV; RSCGCVTPKEGVWVV; SCGCVTPKEGVWVVT; CGCVTPKEGVWVVTL; GCVTPKEGVWVVTLR; CVTPKEGVWVVTLRV; VTPKEGVWVVTLRVV; TPKEGVWVVTLRVVP; PKEGVWVVTLRVVPE; KEGVWVVTLRVVPEG; EGVWVVTLRVVPEGL; GVWVVTLRVVPEGLA; VWVVTLRVVPEGLAA; WVVTLRVVPEGLAAA; VVTLRVVPEGLAAAS; VTLRVVPEGLAAASA; TLRVVPEGLAAASAA; LRVVPEGLAAASAAV; RVVPEGLAAASAAVE; VVPEGLAAASAAVEA; VPEGLAAASAAVEAL; PEGLAAASAAVEALT; EGLAAASAAVEALTA; GLAAASAAVEALTAR; LAAASAAVEALTARL; AAASAAVEALTARLA; AASAAVEALTARLAA; ASAAVEALTARLAAA; SAAVEALTARLAAAH; AAVEALTARLAAAHA; AVEALTARLAAAHAG; VEALTARLAAAHAGA; EALTARLAAAHAGAA; ALTARLAAAHAGAAP; LTARLAAAHAGAAPA; TARLAAAHAGAAPAI; ARLAAAHAGAAPAIT; RLAAAHAGAAPAITA; LAAAHAGAAPAITAV; AAAHAGAAPAITAVV; AAHAGAAPAITAVVA; AHAGAAPAITAVVAP; HAGAAPAITAVVAPA; AGAAPAITAVVAPAA; GAAPAITAVVAPAAD; AAPAITAVVAPAADP; APAITAVVAPAADPV; PAITAVVAPAADPVS; AITAVVAPAADPVSL; ITAVVAPAADPVSLQ; TAVVAPAADPVSLQS; AVVAPAADPVSLQSA; VVAPAADPVSLQSAV; VAPAADPVSLQSAVG; APAADPVSLQSAVGF; PAADPVSLQSAVGFS; AADPVSLQSAVGFSA; ADPVSLQSAVGFSAL; DPVSLQSAVGFSALG; PVSLQSAVGFSALGS; VSLQSAVGFSALGSE; SLQSAVGFSALGSEH; LQSAVGFSALGSEHA; QSAVGFSALGSEHAA; SAVGFSALGSEHAAI; AVGFSALGSEHAAIA; VGFSALGSEHAAIAG; GFSALGSEHAAIAGE; FSALGSEHAAIAGEG; SALGSEHAAIAGEGV; ALGSEHAAIAGEGVE; LGSEHAAIAGEGVEE; GSEHAAIAGEGVEEL; SEHAAIAGEGVEELG; EHAAIAGEGVEELGR; HAAIAGEGVEELGRS; AAIAGEGVEELGRSG; AIAGEGVEELGRSGV; IAGEGVEELGRSGVA; AGEGVEELGRSGVAV; GEGVEELGRSGVAVG; EGVEELGRSGVAVGE; GVEELGRSGVAVGES; VEELGRSGVAVGESG; | | |

Fig. 29 continued

| | | |
|---|---|---|
| | EELGRSGVAVGESGI; ELGRSGVAVGESGIG; LGRSGVAVGESGIGY; GRSGVAVGESGIGYA; RSGVAVGESGIGYAA; SGVAVGESGIGYAAG; GVAVGESGIGYAAGD; VAVGESGIGYAAGDA; AVGESGIGYAAGDAV; VGESGIGYAAGDAVA; GESGIGYAAGDAVAA; ESGIGYAAGDAVAAA; SGIGYAAGDAVAAAT; GIGYAAGDAVAAATY; IGYAAGDAVAAATYL; GYAAGDAVAAATYLV; YAAGDAVAAATYLVS; AAGDAVAAATYLVSG; AGDAVAAATYLVSGG; GDAVAAATYLVSGGS; DAVAAATYLVSGGSL;<br><br>16 mers:<br>MSRQASRQVSIIRSAG; SRQASRQVSIIRSAGD; RQASRQVSIIRSAGDG; QASRQVSIIRSAGDGN; ASRQVSIIRSAGDGNR; SRQVSIIRSAGDGNRS; RQVSIIRSAGDGNRSC; QVSIIRSAGDGNRSCG; VSIIRSAGDGNRSCGC; SIIRSAGDGNRSCGCV; IIRSAGDGNRSCGCVT; IRSAGDGNRSCGCVTP; RSAGDGNRSCGCVTPK; SAGDGNRSCGCVTPKE; AGDGNRSCGCVTPKEG; GDGNRSCGCVTPKEGV; DGNRSCGCVTPKEGVW; GNRSCGCVTPKEGVWV; NRSCGCVTPKEGVWVV; RSCGCVTPKEGVWVVT; SCGCVTPKEGVWVVTL; CGCVTPKEGVWVVTLR; GCVTPKEGVWVVTLRV; CVTPKEGVWVVTLRVV; VTPKEGVWVVTLRVVP; TPKEGVWVVTLRVVPE; PKEGVWVVTLRVVPEG; KEGVWVVTLRVVPEGL; EGVWVVTLRVVPEGLA; GVWVVTLRVVPEGLAA; VWVVTLRVVPEGLAAA; WVVTLRVVPEGLAAAS; VVTLRVVPEGLAAASA; VTLRVVPEGLAAASAA; TLRVVPEGLAAASAAV; LRVVPEGLAAASAAVE; RVVPEGLAAASAAVEA; VVPEGLAAASAAVEAL; VPEGLAAASAAVEALT; PEGLAAASAAVEALTA; EGLAAASAAVEALTAR; GLAAASAAVEALTARL; LAAASAAVEALTARLA; AAASAAVEALTARLAA; AASAAVEALTARLAAA; ASAAVEALTARLAAAH; SAAVEALTARLAAAHA; AAVEALTARLAAAHAG; AVEALTARLAAAHAGA; VEALTARLAAAHAGAA; EALTARLAAAHAGAAP; ALTARLAAAHAGAAPA; LTARLAAAHAGAAPAI; TARLAAAHAGAAPAIT; ARLAAAHAGAAPAITA; RLAAAHAGAAPAITAV; LAAAHAGAAPAITAVV; AAAHAGAAPAITAVVA; AAHAGAAPAITAVVAP; AHAGAAPAITAVVAPA; HAGAAPAITAVVAPAA; AGAAPAITAVVAPAAD; GAAPAITAVVAPAADP; AAPAITAVVAPAADPV; APAITAVVAPAADPVS; PAITAVVAPAADPVSL; AITAVVAPAADPVSLQ; ITAVVAPAADPVSLQS; TAVVAPAADPVSLQSA; AVVAPAADPVSLQSAV; VVAPAADPVSLQSAVG; VAPAADPVSLQSAVGF; APAADPVSLQSAVGFS; PAADPVSLQSAVGFSA; AADPVSLQSAVGFSAL; ADPVSLQSAVGFSALG; DPVSLQSAVGFSALGS; PVSLQSAVGFSALGSE; VSLQSAVGFSALGSEH; SLQSAVGFSALGSEHA; LQSAVGFSALGSEHAA; QSAVGFSALGSEHAAI; SAVGFSALGSEHAAIA; AVGFSALGSEHAAIAG; VGFSALGSEHAAIAGE; GFSALGSEHAAIAGEG; FSALGSEHAAIAGEGV; SALGSEHAAIAGEGVE; ALGSEHAAIAGEGVEE; LGSEHAAIAGEGVEEL; GSEHAAIAGEGVEELG; SEHAAIAGEGVEELGR; EHAAIAGEGVEELGRS; HAAIAGEGVEELGRSG; AAIAGEGVEELGRSGV; AIAGEGVEELGRSGVA; IAGEGVEELGRSGVAV; AGEGVEELGRSGVAVG; GEGVEELGRSGVAVGE; EGVEELGRSGVAVGES; GVEELGRSGVAVGESG; VEELGRSGVAVGESGI; EELGRSGVAVGESGIG; ELGRSGVAVGESGIGY; LGRSGVAVGESGIGYA; GRSGVAVGESGIGYAA; RSGVAVGESGIGYAAG; SGVAVGESGIGYAAGD; GVAVGESGIGYAAGDA; VAVGESGIGYAAGDAV; AVGESGIGYAAGDAVA; VGESGIGYAAGDAVAA; GESGIGYAAGDAVAAA; ESGIGYAAGDAVAAAT; SGIGYAAGDAVAAATY; GIGYAAGDAVAAATYL; IGYAAGDAVAAATYLV; GYAAGDAVAAATYLVS; YAAGDAVAAATYLVSG; AAGDAVAAATYLVSGG; AGDAVAAATYLVSGGS; GDAVAAATYLVSGGSL | |
| 81) Rv3804c/ Ag85A | 13 mers:<br>MQLVDRVRGAVTG; QLVDRVRGAVTGM; LVDRVRGAVTGMS; VDRVRGAVTGMSR; DRVRGAVTGMSRR; RVRGAVTGMSRRL; | 115328-116625 |

Fig. 29 continued

| | | |
|---|---|---|
| | VRGAVTGMSRRLV; RGAVTGMSRRLVV; GAVTGMSRRLVVG; AVTGMSRRLVVGA; VTGMSRRLVVGAV; TGMSRRLVVGAVG; GMSRRLVVGAVGA; MSRRLVVGAVGAA; SRRLVVGAVGAAL; RRLVVGAVGAALV; RLVVGAVGAALVS; LVVGAVGAALVSG; VVGAVGAALVSGL; VGAVGAALVSGLV; GAVGAALVSGLVG; AVGAALVSGLVGA; VGAALVSGLVGAV; GAALVSGLVGAVG; AALVSGLVGAVGG; ALVSGLVGAVGGT; LVSGLVGAVGGTA; VSGLVGAVGGTAT; SGLVGAVGGTATA; GLVGAVGGTATAG; LVGAVGGTATAGA; VGAVGGTATAGAF; GAVGGTATAGAFS; AVGGTATAGAFSR; VGGTATAGAFSRP; GGTATAGAFSRPG; GTATAGAFSRPGL; TATAGAFSRPGLP; ATAGAFSRPGLPV; TAGAFSRPGLPVE; AGAFSRPGLPVEY; GAFSRPGLPVEYL; AFSRPGLPVEYLQ; FSRPGLPVEYLQV; SRPGLPVEYLQVP; RPGLPVEYLQVPS; PGLPVEYLQVPSP; GLPVEYLQVPSPS; LPVEYLQVPSPSM; PVEYLQVPSPSMG; VEYLQVPSPSMGR; EYLQVPSPSMGRD; YLQVPSPSMGRDI; LQVPSPSMGRDIK; QVPSPSMGRDIKV; VPSPSMGRDIKVQ; PSPSMGRDIKVQF; SPSMGRDIKVQFQ; PSMGRDIKVQFQS; SMGRDIKVQFQSG; MGRDIKVQFQSGG; GRDIKVQFQSGGA; RDIKVQFQSGGAN; DIKVQFQSGGANS; IKVQFQSGGANSP; KVQFQSGGANSPA; VQFQSGGANSPAL; QFQSGGANSPALY; FQSGGANSPALYL; QSGGANSPALYLL; SGGANSPALYLLD; GGANSPALYLLDG; GANSPALYLLDGL; ANSPALYLLDGLR; NSPALYLLDGLRA; SPALYLLDGLRAQ; PALYLLDGLRAQD; ALYLLDGLRAQDD; LYLLDGLRAQDDF; YLLDGLRAQDDFS; LLDGLRAQDDFSG; LDGLRAQDDFSGW; DGLRAQDDFSGWD; GLRAQDDFSGWDI; LRAQDDFSGWDIN; RAQDDFSGWDINT; AQDDFSGWDINTP; QDDFSGWDINTPA; DDFSGWDINTPAF; DFSGWDINTPAFE; FSGWDINTPAFEW; SGWDINTPAFEWY; GWDINTPAFEWYD; WDINTPAFEWYDQ; DINTPAFEWYDQS; INTPAFEWYDQSG; NTPAFEWYDQSGL; TPAFEWYDQSGLS; PAFEWYDQSGLSV; AFEWYDQSGLSVV; FEWYDQSGLSVVM; EWYDQSGLSVVMP; WYDQSGLSVVMPV; YDQSGLSVVMPVG; DQSGLSVVMPVGG; QSGLSVVMPVGGQ; SGLSVVMPVGGQS; GLSVVMPVGGQSS; LSVVMPVGGQSSF; SVVMPVGGQSSFY; VVMPVGGQSSFYS; VMPVGGQSSFYSD; MPVGGQSSFYSDW; PVGGQSSFYSDWY; VGGQSSFYSDWYQ; GGQSSFYSDWYQP; GQSSFYSDWYQPA; QSSFYSDWYQPAC; SSFYSDWYQPACG; SFYSDWYQPACGK; FYSDWYQPACGKA; YSDWYQPACGKAG; SDWYQPACGKAGC; DWYQPACGKAGCQ; WYQPACGKAGCQT; YQPACGKAGCQTY; QPACGKAGCQTYK; PACGKAGCQTYKW; ACGKAGCQTYKWE; CGKAGCQTYKWET; GKAGCQTYKWETF; KAGCQTYKWETFL; AGCQTYKWETFLT; GCQTYKWETFLTS; CQTYKWETFLTSE; QTYKWETFLTSEL; TYKWETFLTSELP; YKWETFLTSELPG; KWETFLTSELPGW; WETFLTSELPGWL; ETFLTSELPGWLQ; TFLTSELPGWLQA; FLTSELPGWLQAN; LTSELPGWLQANR; TSELPGWLQANRH; SELPGWLQANRHV; ELPGWLQANRHVK; LPGWLQANRHVKP; PGWLQANRHVKPT; GWLQANRHVKPTG; WLQANRHVKPTGS; LQANRHVKPTGSA; QANRHVKPTGSAV; ANRHVKPTGSAVV; NRHVKPTGSAVVG; RHVKPTGSAVVGL; HVKPTGSAVVGLS; VKPTGSAVVGLSM; KPTGSAVVGLSMA; PTGSAVVGLSMAA; TGSAVVGLSMAAS; GSAVVGLSMAASS; SAVVGLSMAASSA; AVVGLSMAASSAL; VVGLSMAASSALT; VGLSMAASSALTL; GLSMAASSALTLA; LSMAASSALTLAI; SMAASSALTLAIY; MAASSALTLAIYH; AASSALTLAIYHP; ASSALTLAIYHPQ; SSALTLAIYHPQQ; SALTLAIYHPQQF; ALTLAIYHPQQFV; LTLAIYHPQQFVY; TLAIYHPQQFVYA; LAIYHPQQFVYAG; AIYHPQQFVYAGA; IYHPQQFVYAGAM; YHPQQFVYAGAMS; HPQQFVYAGAMSG; PQQFVYAGAMSGL; QQFVYAGAMSGLL; | |

Fig. 29 continued

| | | |
|---|---|---|
| | QFVYAGAMSGLLD; FVYAGAMSGLLDP; VYAGAMSGLLDPS; YAGAMSGLLDPSQ; AGAMSGLLDPSQA; GAMSGLLDPSQAM; AMSGLLDPSQAMG; MSGLLDPSQAMGP; SGLLDPSQAMGPT; GLLDPSQAMGPTL; LLDPSQAMGPTLI; LDPSQAMGPTLIG; DPSQAMGPTLIGL; PSQAMGPTLIGLA; SQAMGPTLIGLAM; QAMGPTLIGLAMG; AMGPTLIGLAMGD; MGPTLIGLAMGDA; GPTLIGLAMGDAG; PTLIGLAMGDAGG; TLIGLAMGDAGGY; LIGLAMGDAGGYK; IGLAMGDAGGYKA; GLAMGDAGGYKAS; LAMGDAGGYKASD; AMGDAGGYKASDM; MGDAGGYKASDMW; GDAGGYKASDMWG; DAGGYKASDMWGP; AGGYKASDMWGPK; GGYKASDMWGPKE; GYKASDMWGPKED; YKASDMWGPKEDP; KASDMWGPKEDPA; ASDMWGPKEDPAW; SDMWGPKEDPAWQ; DMWGPKEDPAWQR; MWGPKEDPAWQRN; WGPKEDPAWQRND; GPKEDPAWQRNDP; PKEDPAWQRNDPL; KEDPAWQRNDPLL; EDPAWQRNDPLLN; DPAWQRNDPLLNV; PAWQRNDPLLNVG; AWQRNDPLLNVGK; WQRNDPLLNVGKL; QRNDPLLNVGKLI; RNDPLLNVGKLIA; NDPLLNVGKLIAN; DPLLNVGKLIANN; PLLNVGKLIANNT; LLNVGKLIANNTR; LNVGKLIANNTRV; NVGKLIANNTRVW; VGKLIANNTRVWV; GKLIANNTRVWVY; KLIANNTRVWVYC; LIANNTRVWVYCG; IANNTRVWVYCGN; ANNTRVWVYCGNG; NNTRVWVYCGNGK; NTRVWVYCGNGKP; TRVWVYCGNGKPS; RVWVYCGNGKPSD; VWVYCGNGKPSDL; WVYCGNGKPSDLG; VYCGNGKPSDLGG; YCGNGKPSDLGGN; CGNGKPSDLGGNN; GNGKPSDLGGNNL; NGKPSDLGGNNLP; GKPSDLGGNNLPA; KPSDLGGNNLPAK; PSDLGGNNLPAKF; SDLGGNNLPAKFL; DLGGNNLPAKFLE; LGGNNLPAKFLEG; GGNNLPAKFLEGF; GNNLPAKFLEGFV; NNLPAKFLEGFVR; NLPAKFLEGFVRT; LPAKFLEGFVRTS; PAKFLEGFVRTSN; AKFLEGFVRTSNI; KFLEGFVRTSNIK; FLEGFVRTSNIKF; LEGFVRTSNIKFQ; EGFVRTSNIKFQD; GFVRTSNIKFQDA; FVRTSNIKFQDAY; VRTSNIKFQDAYN; RTSNIKFQDAYNA; TSNIKFQDAYNAG; SNIKFQDAYNAGG; NIKFQDAYNAGGG; IKFQDAYNAGGGH; KFQDAYNAGGGHN; FQDAYNAGGGHNG; QDAYNAGGGHNGV; DAYNAGGGHNGVF; AYNAGGGHNGVFD; YNAGGGHNGVFDF; NAGGGHNGVFDFP; AGGGHNGVFDFPD; GGGHNGVFDFPDS; GGHNGVFDFPDSG; GHNGVFDFPDSGT; HNGVFDFPDSGTH; NGVFDFPDSGTHS; GVFDFPDSGTHSW; VFDFPDSGTHSWE; FDFPDSGTHSWEY; DFPDSGTHSWEYW; FPDSGTHSWEYWG; PDSGTHSWEYWGA; DSGTHSWEYWGAQ; SGTHSWEYWGAQL; GTHSWEYWGAQLN; THSWEYWGAQLNA; HSWEYWGAQLNAM; SWEYWGAQLNAMK; WEYWGAQLNAMKP; EYWGAQLNAMKPD; YWGAQLNAMKPDL; WGAQLNAMKPDLQ; GAQLNAMKPDLQR; AQLNAMKPDLQRA; QLNAMKPDLQRAL; LNAMKPDLQRALG; NAMKPDLQRALGA; AMKPDLQRALGAT; MKPDLQRALGATP; KPDLQRALGATPN; PDLQRALGATPNT; DLQRALGATPNTG; LQRALGATPNTGP; QRALGATPNTGPA; RALGATPNTGPAP; ALGATPNTGPAPQ; LGATPNTGPAPQG; GATPNTGPAPQGA;<br><br>14 mers:<br>MQLVDRVRGAVTGM; QLVDRVRGAVTGMS; LVDRVRGAVTGMSR; VDRVRGAVTGMSRR; DRVRGAVTGMSRRL; RVRGAVTGMSRRLV; VRGAVTGMSRRLVV; RGAVTGMSRRLVVG; GAVTGMSRRLVVGA; AVTGMSRRLVVGAV; VTGMSRRLVVGAVG; TGMSRRLVVGAVGA; GMSRRLVVGAVGAA; MSRRLVVGAVGAAL; SRRLVVGAVGAALV; RRLVVGAVGAALVS; RLVVGAVGAALVSG; LVVGAVGAALVSGL; VVGAVGAALVSGLV; VGAVGAALVSGLVG; GAVGAALVSGLVGA; AVGAALVSGLVGAV; VGAALVSGLVGAVG; GAALVSGLVGAVGG; | |

Fig. 29 continued

| | | |
|---|---|---|
| | AALVSGLVGAVGGT; ALVSGLVGAVGGTA; LVSGLVGAVGGTAT; VSGLVGAVGGTATA; SGLVGAVGGTATAG; GLVGAVGGTATAGA; LVGAVGGTATAGAF; VGAVGGTATAGAFS; GAVGGTATAGAFSR; AVGGTATAGAFSRP; VGGTATAGAFSRPG; GGTATAGAFSRPGL; GTATAGAFSRPGLP; TATAGAFSRPGLPV; ATAGAFSRPGLPVE; TAGAFSRPGLPVEY; AGAFSRPGLPVEYL; GAFSRPGLPVEYLQ; AFSRPGLPVEYLQV; FSRPGLPVEYLQVP; SRPGLPVEYLQVPS; RPGLPVEYLQVPSP; PGLPVEYLQVPSPS; GLPVEYLQVPSPSM; LPVEYLQVPSPSMG; PVEYLQVPSPSMGR; VEYLQVPSPSMGRD; EYLQVPSPSMGRDI; YLQVPSPSMGRDIK; LQVPSPSMGRDIKV; QVPSPSMGRDIKVQ; VPSPSMGRDIKVQF; PSPSMGRDIKVQFQ; SPSMGRDIKVQFQS; PSMGRDIKVQFQSG; SMGRDIKVQFQSGG; MGRDIKVQFQSGGA; GRDIKVQFQSGGAN; RDIKVQFQSGGANS; DIKVQFQSGGANSP; IKVQFQSGGANSPA; KVQFQSGGANSPAL; VQFQSGGANSPALY; QFQSGGANSPALYL; FQSGGANSPALYLL; QSGGANSPALYLLD; SGGANSPALYLLDG; GGANSPALYLLDGL; GANSPALYLLDGLR; ANSPALYLLDGLRA; NSPALYLLDGLRAQ; SPALYLLDGLRAQD; PALYLLDGLRAQDD; ALYLLDGLRAQDDF; LYLLDGLRAQDDFS; YLLDGLRAQDDFSG; LLDGLRAQDDFSGW; LDGLRAQDDFSGWD; DGLRAQDDFSGWDI; GLRAQDDFSGWDIN; LRAQDDFSGWDINT; RAQDDFSGWDINTP; AQDDFSGWDINTPA; QDDFSGWDINTPAF; DDFSGWDINTPAFE; DFSGWDINTPAFEW; FSGWDINTPAFEWY; SGWDINTPAFEWYD; GWDINTPAFEWYDQ; WDINTPAFEWYDQS; DINTPAFEWYDQSG; INTPAFEWYDQSGL; NTPAFEWYDQSGLS; TPAFEWYDQSGLSV; PAFEWYDQSGLSVV; AFEWYDQSGLSVVM; FEWYDQSGLSVVMP; EWYDQSGLSVVMPV; WYDQSGLSVVMPVG; YDQSGLSVVMPVGG; DQSGLSVVMPVGGQ; QSGLSVVMPVGGQS; SGLSVVMPVGGQSS; GLSVVMPVGGQSSF; LSVVMPVGGQSSFY; SVVMPVGGQSSFYS; VVMPVGGQSSFYSD; VMPVGGQSSFYSDW; MPVGGQSSFYSDWY; PVGGQSSFYSDWYQ; VGGQSSFYSDWYQP; GGQSSFYSDWYQPA; GQSSFYSDWYQPAC; QSSFYSDWYQPACG; SSFYSDWYQPACGK; SFYSDWYQPACGKA; FYSDWYQPACGKAG; YSDWYQPACGKAGC; SDWYQPACGKAGCQ; DWYQPACGKAGCQT; WYQPACGKAGCQTY; YQPACGKAGCQTYK; QPACGKAGCQTYKW; PACGKAGCQTYKWE; ACGKAGCQTYKWET; CGKAGCQTYKWETF; GKAGCQTYKWETFL; KAGCQTYKWETFLT; AGCQTYKWETFLTS; GCQTYKWETFLTSE; CQTYKWETFLTSEL; QTYKWETFLTSELP; TYKWETFLTSELPG; YKWETFLTSELPGW; KWETFLTSELPGWL; WETFLTSELPGWLQ; ETFLTSELPGWLQA; TFLTSELPGWLQAN; FLTSELPGWLQANR; LTSELPGWLQANRH; TSELPGWLQANRHV; SELPGWLQANRHVK; ELPGWLQANRHVKP; LPGWLQANRHVKPT; PGWLQANRHVKPTG; GWLQANRHVKPTGS; WLQANRHVKPTGSA; LQANRHVKPTGSAV; QANRHVKPTGSAVV; ANRHVKPTGSAVVG; NRHVKPTGSAVVGL; RHVKPTGSAVVGLS; HVKPTGSAVVGLSM; VKPTGSAVVGLSMA; KPTGSAVVGLSMAA; PTGSAVVGLSMAAS; TGSAVVGLSMAASS; GSAVVGLSMAASSA; SAVVGLSMAASSAL; AVVGLSMAASSALT; VVGLSMAASSALTL; VGLSMAASSALTLA; GLSMAASSALTLAI; LSMAASSALTLAIY; SMAASSALTLAIYH; MAASSALTLAIYHP; AASSALTLAIYHPQ; ASSALTLAIYHPQQ; SSALTLAIYHPQQF; SALTLAIYHPQQFV; ALTLAIYHPQQFVY; LTLAIYHPQQFVYA; TLAIYHPQQFVYAG; LAIYHPQQFVYAGA; AIYHPQQFVYAGAM; IYHPQQFVYAGAMS; YHPQQFVYAGAMSG; HPQQFVYAGAMSGL; PQQFVYAGAMSGLL; | |

Fig. 29 continued

| | | |
|---|---|---|
| | QQFVYAGAMSGLLD; QFVYAGAMSGLLDP; FVYAGAMSGLLDPS; VYAGAMSGLLDPSQ; YAGAMSGLLDPSQA; AGAMSGLLDPSQAM; GAMSGLLDPSQAMG; AMSGLLDPSQAMGP; MSGLLDPSQAMGPT; SGLLDPSQAMGPTL; GLLDPSQAMGPTLI; LLDPSQAMGPTLIG; LDPSQAMGPTLIGL; DPSQAMGPTLIGLA; PSQAMGPTLIGLAM; SQAMGPTLIGLAMG; QAMGPTLIGLAMGD; AMGPTLIGLAMGDA; MGPTLIGLAMGDAG; GPTLIGLAMGDAGG; PTLIGLAMGDAGGY; TLIGLAMGDAGGYK; LIGLAMGDAGGYKA; IGLAMGDAGGYKAS; GLAMGDAGGYKASD; LAMGDAGGYKASDM; AMGDAGGYKASDMW; MGDAGGYKASDMWG; GDAGGYKASDMWGP; DAGGYKASDMWGPK; AGGYKASDMWGPKE; GGYKASDMWGPKED; GYKASDMWGPKEDP; YKASDMWGPKEDPA; KASDMWGPKEDPAW; ASDMWGPKEDPAWQ; SDMWGPKEDPAWQR; DMWGPKEDPAWQRN; MWGPKEDPAWQRND; WGPKEDPAWQRNDP; GPKEDPAWQRNDPL; PKEDPAWQRNDPLL; KEDPAWQRNDPLLN; EDPAWQRNDPLLNV; DPAWQRNDPLLNVG; PAWQRNDPLLNVGK; AWQRNDPLLNVGKL; WQRNDPLLNVGKLI; QRNDPLLNVGKLIA; RNDPLLNVGKLIAN; NDPLLNVGKLIANN; DPLLNVGKLIANNT; PLLNVGKLIANNTR; LLNVGKLIANNTRV; LNVGKLIANNTRVW; NVGKLIANNTRVWV; VGKLIANNTRVWVY; GKLIANNTRVWVYC; KLIANNTRVWVYCG; LIANNTRVWVYCGN; IANNTRVWVYCGNG; ANNTRVWVYCGNGK; NNTRVWVYCGNGKP; NTRVWVYCGNGKPS; TRVWVYCGNGKPSD; RVWVYCGNGKPSDL; VWVYCGNGKPSDLG; WVYCGNGKPSDLGG; VYCGNGKPSDLGGN; YCGNGKPSDLGGNN; CGNGKPSDLGGNNL; GNGKPSDLGGNNLP; NGKPSDLGGNNLPA; GKPSDLGGNNLPAK; KPSDLGGNNLPAKF; PSDLGGNNLPAKFL; SDLGGNNLPAKFLE; DLGGNNLPAKFLEG; LGGNNLPAKFLEGF; GGNNLPAKFLEGFV; GNNLPAKFLEGFVR; NNLPAKFLEGFVRT; NLPAKFLEGFVRTS; LPAKFLEGFVRTSN; PAKFLEGFVRTSNI; AKFLEGFVRTSNIK; KFLEGFVRTSNIKF; FLEGFVRTSNIKFQ; LEGFVRTSNIKFQD; EGFVRTSNIKFQDA; GFVRTSNIKFQDAY; FVRTSNIKFQDAYN; VRTSNIKFQDAYNA; RTSNIKFQDAYNAG; TSNIKFQDAYNAGG; SNIKFQDAYNAGGG; NIKFQDAYNAGGGH; IKFQDAYNAGGGHN; KFQDAYNAGGGHNG; FQDAYNAGGGHNGV; QDAYNAGGGHNGVF; DAYNAGGGHNGVFD; AYNAGGGHNGVFDF; YNAGGGHNGVFDFP; NAGGGHNGVFDFPD; AGGGHNGVFDFPDS; GGGHNGVFDFPDSG; GGHNGVFDFPDSGT; GHNGVFDFPDSGTH; HNGVFDFPDSGTHS; NGVFDFPDSGTHSW; GVFDFPDSGTHSWE; VFDFPDSGTHSWEY; FDFPDSGTHSWEYW; DFPDSGTHSWEYWG; FPDSGTHSWEYWGA; PDSGTHSWEYWGAQ; DSGTHSWEYWGAQL; SGTHSWEYWGAQLN; GTHSWEYWGAQLNA; THSWEYWGAQLNAM; HSWEYWGAQLNAMK; SWEYWGAQLNAMKP; WEYWGAQLNAMKPD; EYWGAQLNAMKPDL; YWGAQLNAMKPDLQ; WGAQLNAMKPDLQR; GAQLNAMKPDLQRA; AQLNAMKPDLQRAL; QLNAMKPDLQRALG; LNAMKPDLQRALGA; NAMKPDLQRALGAT; AMKPDLQRALGATP; MKPDLQRALGATPN; KPDLQRALGATPNT; PDLQRALGATPNTG; DLQRALGATPNTGP; LQRALGATPNTGPA; QRALGATPNTGPAP; RALGATPNTGPAPQ; ALGATPNTGPAPQG; LGATPNTGPAPQGA;<br><br>15 mers:<br>MQLVDRVRGAVTGMS; QLVDRVRGAVTGMSR; LVDRVRGAVTGMSRR; VDRVRGAVTGMSRRL; DRVRGAVTGMSRRLV; RVRGAVTGMSRRLVV; VRGAVTGMSRRLVVG; RGAVTGMSRRLVVGA; GAVTGMSRRLVVGAV; | |

Fig. 29 continued

| | | | |
|---|---|---|---|
| | AVTGMSRRLVVGAVG; VTGMSRRLVVGAVGA; TGMSRRLVVGAVGAA; GMSRRLVVGAVGAAL; MSRRLVVGAVGAALV; SRRLVVGAVGAALVS; RRLVVGAVGAALVSG; RLVVGAVGAALVSGL; LVVGAVGAALVSGLV; VVGAVGAALVSGLVG; VGAVGAALVSGLVGA; GAVGAALVSGLVGAV; AVGAALVSGLVGAVG; VGAALVSGLVGAVGG; GAALVSGLVGAVGGT; AALVSGLVGAVGGTA; ALVSGLVGAVGGTAT; LVSGLVGAVGGTATA; VSGLVGAVGGTATAG; SGLVGAVGGTATAGA; GLVGAVGGTATAGAF; LVGAVGGTATAGAFS; VGAVGGTATAGAFSR; GAVGGTATAGAFSRP; AVGGTATAGAFSRPG; VGGTATAGAFSRPGL; GGTATAGAFSRPGLP; GTATAGAFSRPGLPV; TATAGAFSRPGLPVE; ATAGAFSRPGLPVEY; TAGAFSRPGLPVEYL; AGAFSRPGLPVEYLQ; GAFSRPGLPVEYLQV; AFSRPGLPVEYLQVP; FSRPGLPVEYLQVPS; SRPGLPVEYLQVPSP; RPGLPVEYLQVPSPS; PGLPVEYLQVPSPSM; GLPVEYLQVPSPSMG; LPVEYLQVPSPSMGR; PVEYLQVPSPSMGRD; VEYLQVPSPSMGRDI; EYLQVPSPSMGRDIK; YLQVPSPSMGRDIKV; LQVPSPSMGRDIKVQ; QVPSPSMGRDIKVQF; VPSPSMGRDIKVQFQ; PSPSMGRDIKVQFQS; SPSMGRDIKVQFQSG; PSMGRDIKVQFQSGG; SMGRDIKVQFQSGGA; MGRDIKVQFQSGGAN; GRDIKVQFQSGGANS; RDIKVQFQSGGANSP; DIKVQFQSGGANSPA; IKVQFQSGGANSPAL; KVQFQSGGANSPALY; VQFQSGGANSPALYL; QFQSGGANSPALYLL; FQSGGANSPALYLLD; QSGGANSPALYLLDG; SGGANSPALYLLDGL; GGANSPALYLLDGLR; GANSPALYLLDGLRA; ANSPALYLLDGLRAQ; NSPALYLLDGLRAQD; SPALYLLDGLRAQDD; PALYLLDGLRAQDDF; ALYLLDGLRAQDDFS; LYLLDGLRAQDDFSG; YLLDGLRAQDDFSGW; LLDGLRAQDDFSGWD; LDGLRAQDDFSGWDI; DGLRAQDDFSGWDIN; GLRAQDDFSGWDINT; LRAQDDFSGWDINTP; RAQDDFSGWDINTPA; AQDDFSGWDINTPAF; QDDFSGWDINTPAFE; DDFSGWDINTPAFEW; DFSGWDINTPAFEWY; FSGWDINTPAFEWYD; SGWDINTPAFEWYDQ; GWDINTPAFEWYDQS; WDINTPAFEWYDQSG; DINTPAFEWYDQSGL; INTPAFEWYDQSGLS; NTPAFEWYDQSGLSV; TPAFEWYDQSGLSVV; PAFEWYDQSGLSVVM; AFEWYDQSGLSVVMP; FEWYDQSGLSVVMPV; EWYDQSGLSVVMPVG; WYDQSGLSVVMPVGG; YDQSGLSVVMPVGGQ; DQSGLSVVMPVGGQS; QSGLSVVMPVGGQSS; SGLSVVMPVGGQSSF; GLSVVMPVGGQSSFY; LSVVMPVGGQSSFYS; SVVMPVGGQSSFYSD; VVMPVGGQSSFYSDW; VMPVGGQSSFYSDWY; MPVGGQSSFYSDWYQ; PVGGQSSFYSDWYQP; VGGQSSFYSDWYQPA; GGQSSFYSDWYQPAC; GQSSFYSDWYQPACG; QSSFYSDWYQPACGK; SSFYSDWYQPACGKA; SFYSDWYQPACGKAG; FYSDWYQPACGKAGC; YSDWYQPACGKAGCQ; SDWYQPACGKAGCQT; DWYQPACGKAGCQTY; WYQPACGKAGCQTYK; YQPACGKAGCQTYKW; QPACGKAGCQTYKWE; PACGKAGCQTYKWET; ACGKAGCQTYKWETF; CGKAGCQTYKWETFL; GKAGCQTYKWETFLT; KAGCQTYKWETFLTS; AGCQTYKWETFLTSE; GCQTYKWETFLTSEL; CQTYKWETFLTSELP; QTYKWETFLTSELPG; TYKWETFLTSELPGW; YKWETFLTSELPGWL; KWETFLTSELPGWLQ; WETFLTSELPGWLQA; ETFLTSELPGWLQAN; TFLTSELPGWLQANR; FLTSELPGWLQANRH; LTSELPGWLQANRHV; TSELPGWLQANRHVK; SELPGWLQANRHVKP; ELPGWLQANRHVKPT; LPGWLQANRHVKPTG; PGWLQANRHVKPTGS; GWLQANRHVKPTGSA; WLQANRHVKPTGSAV; LQANRHVKPTGSAVV; QANRHVKPTGSAVVG; ANRHVKPTGSAVVGL; NRHVKPTGSAVVGLS; RHVKPTGSAVVGLSM; HVKPTGSAVVGLSMA; VKPTGSAVVGLSMAA; KPTGSAVVGLSMAAS; PTGSAVVGLSMAASS; TGSAVVGLSMAASSA; GSAVVGLSMAASSAL; SAVVGLSMAASSALT; AVVGLSMAASSALTL; VVGLSMAASSALTLA; VGLSMAASSALTLAI; GLSMAASSALTLAIY; LSMAASSALTLAIYH; | | |

Fig. 29 continued

| | | |
|---|---|---|
| | SMAASSALTLAIYHP; MAASSALTLAIYHPQ; AASSALTLAIYHPQQ; ASSALTLAIYHPQQF; SSALTLAIYHPQQFV; SALTLAIYHPQQFVY; ALTLAIYHPQQFVYA; LTLAIYHPQQFVYAG; TLAIYHPQQFVYAGA; LAIYHPQQFVYAGAM; AIYHPQQFVYAGAMS; IYHPQQFVYAGAMSG; YHPQQFVYAGAMSGL; HPQQFVYAGAMSGLL; PQQFVYAGAMSGLLD; QQFVYAGAMSGLLDP; QFVYAGAMSGLLDPS; FVYAGAMSGLLDPSQ; VYAGAMSGLLDPSQA; YAGAMSGLLDPSQAM; AGAMSGLLDPSQAMG; GAMSGLLDPSQAMGP; AMSGLLDPSQAMGPT; MSGLLDPSQAMGPTL; SGLLDPSQAMGPTLI; GLLDPSQAMGPTLIG; LLDPSQAMGPTLIGL; LDPSQAMGPTLIGLA; DPSQAMGPTLIGLAM; PSQAMGPTLIGLAMG; SQAMGPTLIGLAMGD; QAMGPTLIGLAMGDA; AMGPTLIGLAMGDAG; MGPTLIGLAMGDAGG; GPTLIGLAMGDAGGY; PTLIGLAMGDAGGYK; TLIGLAMGDAGGYKA; LIGLAMGDAGGYKAS; IGLAMGDAGGYKASD; GLAMGDAGGYKASDM; LAMGDAGGYKASDMW; AMGDAGGYKASDMWG; MGDAGGYKASDMWGP; GDAGGYKASDMWGPK; DAGGYKASDMWGPKE; AGGYKASDMWGPKED; GGYKASDMWGPKEDP; GYKASDMWGPKEDPA; YKASDMWGPKEDPAW; KASDMWGPKEDPAWQ; ASDMWGPKEDPAWQR; SDMWGPKEDPAWQRN; DMWGPKEDPAWQRND; MWGPKEDPAWQRNDP; WGPKEDPAWQRNDPL; GPKEDPAWQRNDPLL; PKEDPAWQRNDPLLN; KEDPAWQRNDPLLNV; EDPAWQRNDPLLNVG; DPAWQRNDPLLNVGK; PAWQRNDPLLNVGKL; AWQRNDPLLNVGKLI; WQRNDPLLNVGKLIA; QRNDPLLNVGKLIAN; RNDPLLNVGKLIANN; NDPLLNVGKLIANNT; DPLLNVGKLIANNTR; PLLNVGKLIANNTRV; LLNVGKLIANNTRVW; LNVGKLIANNTRVWV; NVGKLIANNTRVWVY; VGKLIANNTRVWVYC; GKLIANNTRVWVYCG; KLIANNTRVWVYCGN; LIANNTRVWVYCGNG; IANNTRVWVYCGNGK; ANNTRVWVYCGNGKP; NNTRVWVYCGNGKPS; NTRVWVYCGNGKPSD; TRVWVYCGNGKPSDL; RVWVYCGNGKPSDLG; VWVYCGNGKPSDLGG; WVYCGNGKPSDLGGN; VYCGNGKPSDLGGNN; YCGNGKPSDLGGNNL; CGNGKPSDLGGNNLP; GNGKPSDLGGNNLPA; NGKPSDLGGNNLPAK; GKPSDLGGNNLPAKF; KPSDLGGNNLPAKFL; PSDLGGNNLPAKFLE; SDLGGNNLPAKFLEG; DLGGNNLPAKFLEGF; LGGNNLPAKFLEGFV; GGNNLPAKFLEGFVR; GNNLPAKFLEGFVRT; NNLPAKFLEGFVRTS; NLPAKFLEGFVRTSN; LPAKFLEGFVRTSNI; PAKFLEGFVRTSNIK; AKFLEGFVRTSNIKF; KFLEGFVRTSNIKFQ; FLEGFVRTSNIKFQD; LEGFVRTSNIKFQDA; EGFVRTSNIKFQDAY; GFVRTSNIKFQDAYN; FVRTSNIKFQDAYNA; VRTSNIKFQDAYNAG; RTSNIKFQDAYNAGG; TSNIKFQDAYNAGGG; SNIKFQDAYNAGGGH; NIKFQDAYNAGGGHN; IKFQDAYNAGGGHNG; KFQDAYNAGGGHNGV; FQDAYNAGGGHNGVF; QDAYNAGGGHNGVFD; DAYNAGGGHNGVFDF; AYNAGGGHNGVFDFP; YNAGGGHNGVFDFPD; NAGGGHNGVFDFPDS; AGGGHNGVFDFPDSG; GGGHNGVFDFPDSGT; GGHNGVFDFPDSGTH; GHNGVFDFPDSGTHS; HNGVFDFPDSGTHSW; NGVFDFPDSGTHSWE; GVFDFPDSGTHSWEY; VFDFPDSGTHSWEYW; FDFPDSGTHSWEYWG; DFPDSGTHSWEYWGA; FPDSGTHSWEYWGAQ; PDSGTHSWEYWGAQL; DSGTHSWEYWGAQLN; SGTHSWEYWGAQLNA; GTHSWEYWGAQLNAM; THSWEYWGAQLNAMK; HSWEYWGAQLNAMKP; SWEYWGAQLNAMKPD; WEYWGAQLNAMKPDL; EYWGAQLNAMKPDLQ; YWGAQLNAMKPDLQR; WGAQLNAMKPDLQRA; GAQLNAMKPDLQRAL; AQLNAMKPDLQRALG; QLNAMKPDLQRALGA; LNAMKPDLQRALGAT; NAMKPDLQRALGATP; AMKPDLQRALGATPN; MKPDLQRALGATPNT; KPDLQRALGATPNTG; PDLQRALGATPNTGP; DLQRALGATPNTGPA; LQRALGATPNTGPAP; QRALGATPNTGPAPQ; RALGATPNTGPAPQG; ALGATPNTGPAPQGA; | |

Fig. 29 continued

| | | |
|---|---|---|
| | 16 mers:<br>MQLVDRVRGAVTGMSR; QLVDRVRGAVTGMSRR; LVDRVRGAVTGMSRRL;<br>VDRVRGAVTGMSRRLV; DRVRGAVTGMSRRLVV; RVRGAVTGMSRRLVVG;<br>VRGAVTGMSRRLVVGA; RGAVTGMSRRLVVGAV; GAVTGMSRRLVVGAVG;<br>AVTGMSRRLVVGAVGA; VTGMSRRLVVGAVGAA; TGMSRRLVVGAVGAAL;<br>GMSRRLVVGAVGAALV; MSRRLVVGAVGAALVS; SRRLVVGAVGAALVSG;<br>RRLVVGAVGAALVSGL; RLVVGAVGAALVSGLV; LVVGAVGAALVSGLVG;<br>VVGAVGAALVSGLVGA; VGAVGAALVSGLVGAV; GAVGAALVSGLVGAVG;<br>AVGAALVSGLVGAVGG; VGAALVSGLVGAVGGT; GAALVSGLVGAVGGTA;<br>AALVSGLVGAVGGTAT; ALVSGLVGAVGGTATA; LVSGLVGAVGGTATAG;<br>VSGLVGAVGGTATAGA; SGLVGAVGGTATAGAF; GLVGAVGGTATAGAFS;<br>LVGAVGGTATAGAFSR; VGAVGGTATAGAFSRP; GAVGGTATAGAFSRPG;<br>AVGGTATAGAFSRPGL; VGGTATAGAFSRPGLP; GGTATAGAFSRPGLPV;<br>GTATAGAFSRPGLPVE; TATAGAFSRPGLPVEY; ATAGAFSRPGLPVEYL;<br>TAGAFSRPGLPVEYLQ; AGAFSRPGLPVEYLQV; GAFSRPGLPVEYLQVP;<br>AFSRPGLPVEYLQVPS; FSRPGLPVEYLQVPSP; SRPGLPVEYLQVPSPS;<br>RPGLPVEYLQVPSPSM; PGLPVEYLQVPSPSMG; GLPVEYLQVPSPSMGR;<br>LPVEYLQVPSPSMGRD; PVEYLQVPSPSMGRDI; VEYLQVPSPSMGRDIK;<br>EYLQVPSPSMGRDIKV; YLQVPSPSMGRDIKVQ; LQVPSPSMGRDIKVQF;<br>QVPSPSMGRDIKVQFQ; VPSPSMGRDIKVQFQS; PSPSMGRDIKVQFQSG;<br>SPSMGRDIKVQFQSGG; PSMGRDIKVQFQSGGA; SMGRDIKVQFQSGGAN;<br>MGRDIKVQFQSGGANS; GRDIKVQFQSGGANSP; RDIKVQFQSGGANSPA;<br>DIKVQFQSGGANSPAL; IKVQFQSGGANSPALY; KVQFQSGGANSPALYL;<br>VQFQSGGANSPALYLL; QFQSGGANSPALYLLD; FQSGGANSPALYLLDG;<br>QSGGANSPALYLLDGL; SGGANSPALYLLDGLR; GGANSPALYLLDGLRA;<br>GANSPALYLLDGLRAQ; ANSPALYLLDGLRAQD; NSPALYLLDGLRAQDD;<br>SPALYLLDGLRAQDDF; PALYLLDGLRAQDDFS; ALYLLDGLRAQDDFSG;<br>LYLLDGLRAQDDFSGW; YLLDGLRAQDDFSGWD; LLDGLRAQDDFSGWDI;<br>LDGLRAQDDFSGWDIN; DGLRAQDDFSGWDINT; GLRAQDDFSGWDINTP;<br>LRAQDDFSGWDINTPA; RAQDDFSGWDINTPAF; AQDDFSGWDINTPAFE;<br>QDDFSGWDINTPAFEW; DDFSGWDINTPAFEWY; DFSGWDINTPAFEWYD;<br>FSGWDINTPAFEWYDQ; SGWDINTPAFEWYDQS; GWDINTPAFEWYDQSG;<br>WDINTPAFEWYDQSGL; DINTPAFEWYDQSGLS; INTPAFEWYDQSGLSV;<br>NTPAFEWYDQSGLSVV; TPAFEWYDQSGLSVVM; PAFEWYDQSGLSVVMP;<br>AFEWYDQSGLSVVMPV; FEWYDQSGLSVVMPVG; EWYDQSGLSVVMPVGG;<br>WYDQSGLSVVMPVGGQ; YDQSGLSVVMPVGGQS; DQSGLSVVMPVGGQSS;<br>QSGLSVVMPVGGQSSF; SGLSVVMPVGGQSSFY; GLSVVMPVGGQSSFYS;<br>LSVVMPVGGQSSFYSD; SVVMPVGGQSSFYSDW; VVMPVGGQSSFYSDWY;<br>VMPVGGQSSFYSDWYQ; MPVGGQSSFYSDWYQP; PVGGQSSFYSDWYQPA;<br>VGGQSSFYSDWYQPAC; GGQSSFYSDWYQPACG; GQSSFYSDWYQPACGK;<br>QSSFYSDWYQPACGKA; SSFYSDWYQPACGKAG; SFYSDWYQPACGKAGC;<br>FYSDWYQPACGKAGCQ; YSDWYQPACGKAGCQT; SDWYQPACGKAGCQTY;<br>DWYQPACGKAGCQTYK; WYQPACGKAGCQTYKW; YQPACGKAGCQTYKWE;<br>QPACGKAGCQTYKWET; PACGKAGCQTYKWETF; ACGKAGCQTYKWETFL;<br>CGKAGCQTYKWETFLT; GKAGCQTYKWETFLTS; KAGCQTYKWETFLTSE;<br>AGCQTYKWETFLTSEL; GCQTYKWETFLTSELP; CQTYKWETFLTSELPG;<br>QTYKWETFLTSELPGW; TYKWETFLTSELPGWL; YKWETFLTSELPGWLQ;<br>KWETFLTSELPGWLQA; WETFLTSELPGWLQAN; ETFLTSELPGWLQANR;<br>TFLTSELPGWLQANRH; FLTSELPGWLQANRHV; LTSELPGWLQANRHVK;<br>TSELPGWLQANRHVKP; SELPGWLQANRHVKPT; ELPGWLQANRHVKPTG;<br>LPGWLQANRHVKPTGS; PGWLQANRHVKPTGSA; GWLQANRHVKPTGSAV;<br>WLQANRHVKPTGSAVV; LQANRHVKPTGSAVVG; QANRHVKPTGSAVVGL;<br>ANRHVKPTGSAVVGLS; NRHVKPTGSAVVGLSM; RHVKPTGSAVVGLSMA; | |

Fig. 29 continued

| | | |
|---|---|---|
| | HVKPTGSAVVGLSMAA; VKPTGSAVVGLSMAAS; KPTGSAVVGLSMAASS;<br>PTGSAVVGLSMAASSA; TGSAVVGLSMAASSAL; GSAVVGLSMAASSALT;<br>SAVVGLSMAASSALTL; AVVGLSMAASSALTLA; VVGLSMAASSALTLAI;<br>VGLSMAASSALTLAIY; GLSMAASSALTLAIYH; LSMAASSALTLAIYHP;<br>SMAASSALTLAIYHPQ; MAASSALTLAIYHPQQ; AASSALTLAIYHPQQF;<br>ASSALTLAIYHPQQFV; SSALTLAIYHPQQFVY; SALTLAIYHPQQFVYA;<br>ALTLAIYHPQQFVYAG; LTLAIYHPQQFVYAGA; TLAIYHPQQFVYAGAM;<br>LAIYHPQQFVYAGAMS; AIYHPQQFVYAGAMSG; IYHPQQFVYAGAMSGL;<br>YHPQQFVYAGAMSGLL; HPQQFVYAGAMSGLLD; PQQFVYAGAMSGLLDP;<br>QQFVYAGAMSGLLDPS; QFVYAGAMSGLLDPSQ; FVYAGAMSGLLDPSQA;<br>VYAGAMSGLLDPSQAM; YAGAMSGLLDPSQAMG; AGAMSGLLDPSQAMGP;<br>GAMSGLLDPSQAMGPT; AMSGLLDPSQAMGPTL; MSGLLDPSQAMGPTLI;<br>SGLLDPSQAMGPTLIG; GLLDPSQAMGPTLIGL; LLDPSQAMGPTLIGLA;<br>LDPSQAMGPTLIGLAM; DPSQAMGPTLIGLAMG; PSQAMGPTLIGLAMGD;<br>SQAMGPTLIGLAMGDA; QAMGPTLIGLAMGDAG; AMGPTLIGLAMGDAGG;<br>MGPTLIGLAMGDAGGY; GPTLIGLAMGDAGGYK; PTLIGLAMGDAGGYKA;<br>TLIGLAMGDAGGYKAS; LIGLAMGDAGGYKASD; IGLAMGDAGGYKASDM;<br>GLAMGDAGGYKASDMW; LAMGDAGGYKASDMWG; AMGDAGGYKASDMWGP;<br>MGDAGGYKASDMWGPK; GDAGGYKASDMWGPKE; DAGGYKASDMWGPKED;<br>AGGYKASDMWGPKEDP; GGYKASDMWGPKEDPA; GYKASDMWGPKEDPAW;<br>YKASDMWGPKEDPAWQ; KASDMWGPKEDPAWQR; ASDMWGPKEDPAWQRN;<br>SDMWGPKEDPAWQRND; DMWGPKEDPAWQRNDP; MWGPKEDPAWQRNDPL;<br>WGPKEDPAWQRNDPLL; GPKEDPAWQRNDPLLN; PKEDPAWQRNDPLLNV;<br>KEDPAWQRNDPLLNVG; EDPAWQRNDPLLNVGK; DPAWQRNDPLLNVGKL;<br>PAWQRNDPLLNVGKLI; AWQRNDPLLNVGKLIA; WQRNDPLLNVGKLIAN;<br>QRNDPLLNVGKLIANN; RNDPLLNVGKLIANNT; NDPLLNVGKLIANNTR;<br>DPLLNVGKLIANNTRV; PLLNVGKLIANNTRVW; LLNVGKLIANNTRVWV;<br>LNVGKLIANNTRVWVY; NVGKLIANNTRVWVYC; VGKLIANNTRVWVYCG;<br>GKLIANNTRVWVYCGN; KLIANNTRVWVYCGNG; LIANNTRVWVYCGNGK;<br>IANNTRVWVYCGNGKP; ANNTRVWVYCGNGKPS; NNTRVWVYCGNGKPSD;<br>NTRVWVYCGNGKPSDL; TRVWVYCGNGKPSDLG; RVWVYCGNGKPSDLGG;<br>VWVYCGNGKPSDLGGN; WVYCGNGKPSDLGGNN; VYCGNGKPSDLGGNNL;<br>YCGNGKPSDLGGNNLP; CGNGKPSDLGGNNLPA; GNGKPSDLGGNNLPAK;<br>NGKPSDLGGNNLPAKF; GKPSDLGGNNLPAKFL; KPSDLGGNNLPAKFLE;<br>PSDLGGNNLPAKFLEG; SDLGGNNLPAKFLEGF; DLGGNNLPAKFLEGFV;<br>LGGNNLPAKFLEGFVR; GGNNLPAKFLEGFVRT; GNNLPAKFLEGFVRTS;<br>NNLPAKFLEGFVRTSN; NLPAKFLEGFVRTSNI; LPAKFLEGFVRTSNIK;<br>PAKFLEGFVRTSNIKF; AKFLEGFVRTSNIKFQ; KFLEGFVRTSNIKFQD;<br>FLEGFVRTSNIKFQDA; LEGFVRTSNIKFQDAY; EGFVRTSNIKFQDAYN;<br>GFVRTSNIKFQDAYNA; FVRTSNIKFQDAYNAG; VRTSNIKFQDAYNAGG;<br>RTSNIKFQDAYNAGGG; TSNIKFQDAYNAGGGH; SNIKFQDAYNAGGGHN;<br>NIKFQDAYNAGGGHNG; IKFQDAYNAGGGHNGV; KFQDAYNAGGGHNGVF;<br>FQDAYNAGGGHNGVFD; QDAYNAGGGHNGVFDF; DAYNAGGGHNGVFDFP;<br>AYNAGGGHNGVFDFPD; YNAGGGHNGVFDFPDS; NAGGGHNGVFDFPDSG;<br>AGGGHNGVFDFPDSGT; GGGHNGVFDFPDSGTH; GGHNGVFDFPDSGTHS;<br>GHNGVFDFPDSGTHSW; HNGVFDFPDSGTHSWE; NGVFDFPDSGTHSWEY;<br>GVFDFPDSGTHSWEYW; VFDFPDSGTHSWEYWG; FDFPDSGTHSWEYWGA;<br>DFPDSGTHSWEYWGAQ; FPDSGTHSWEYWGAQL; PDSGTHSWEYWGAQLN;<br>DSGTHSWEYWGAQLNA; SGTHSWEYWGAQLNAM; GTHSWEYWGAQLNAMK;<br>THSWEYWGAQLNAMKP; HSWEYWGAQLNAMKPD; SWEYWGAQLNAMKPDL;<br>WEYWGAQLNAMKPDLQ; EYWGAQLNAMKPDLQR; YWGAQLNAMKPDLQRA;<br>WGAQLNAMKPDLQRAL; GAQLNAMKPDLQRALG; AQLNAMKPDLQRALGA;<br>QLNAMKPDLQRALGAT; LNAMKPDLQRALGATP; NAMKPDLQRALGATPN; | |

Fig. 29 continued

| | | |
|---|---|---|
| | AMKPDLQRALGATPNT; MKPDLQRALGATPNTG; KPDLQRALGATPNTGP; PDLQRALGATPNTGPA; DLQRALGATPNTGPAP; LQRALGATPNTGPAPQ; QRALGATPNTGPAPQG; RALGATPNTGPAPQGA | |
| 82) Rv1886c/ Ag85B | 13 mers: MTDVSRKIRAWGR; TDVSRKIRAWGRR; DVSRKIRAWGRRL; VSRKIRAWGRRLM; SRKIRAWGRRLMI; RKIRAWGRRLMIG; KIRAWGRRLMIGT; IRAWGRRLMIGTA; RAWGRRLMIGTAA; AWGRRLMIGTAAA; WGRRLMIGTAAAV; GRRLMIGTAAAVV; RRLMIGTAAAVVL; RLMIGTAAAVVLP; LMIGTAAAVVLPG; MIGTAAAVVLPGL; IGTAAAVVLPGLV; GTAAAVVLPGLVG; TAAAVVLPGLVGL; AAAVVLPGLVGLA; AAVVLPGLVGLAG; AVVLPGLVGLAGG; VVLPGLVGLAGGA; VLPGLVGLAGGAA; LPGLVGLAGGAAT; PGLVGLAGGAATA; GLVGLAGGAATAG; LVGLAGGAATAGA; VGLAGGAATAGAF; GLAGGAATAGAFS; LAGGAATAGAFSR; AGGAATAGAFSRP; GGAATAGAFSRPG; GAATAGAFSRPGL; AATAGAFSRPGLP; ATAGAFSRPGLPV; TAGAFSRPGLPVE; AGAFSRPGLPVEY; GAFSRPGLPVEYL; AFSRPGLPVEYLQ; FSRPGLPVEYLQV; SRPGLPVEYLQVP; RPGLPVEYLQVPS; PGLPVEYLQVPSP; GLPVEYLQVPSPS; LPVEYLQVPSPSM; PVEYLQVPSPSMG; VEYLQVPSPSMGR; EYLQVPSPSMGRD; YLQVPSPSMGRDI; LQVPSPSMGRDIK; QVPSPSMGRDIKV; VPSPSMGRDIKVQ; PSPSMGRDIKVQF; SPSMGRDIKVQFQ; PSMGRDIKVQFQS; SMGRDIKVQFQSG; MGRDIKVQFQSGG; GRDIKVQFQSGGN; RDIKVQFQSGGNN; DIKVQFQSGGNNS; IKVQFQSGGNNSP; KVQFQSGGNNSPA; VQFQSGGNNSPAV; QFQSGGNNSPAVY; FQSGGNNSPAVYL; QSGGNNSPAVYLL; SGGNNSPAVYLLD; GGNNSPAVYLLDG; GNNSPAVYLLDGL; NNSPAVYLLDGLR; NSPAVYLLDGLRA; SPAVYLLDGLRAQ; PAVYLLDGLRAQD; AVYLLDGLRAQDD; VYLLDGLRAQDDY; YLLDGLRAQDDYN; LLDGLRAQDDYNG; LDGLRAQDDYNGW; DGLRAQDDYNGWD; GLRAQDDYNGWDI; LRAQDDYNGWDIN; RAQDDYNGWDINT; AQDDYNGWDINTP; QDDYNGWDINTPA; DDYNGWDINTPAF; DYNGWDINTPAFE; YNGWDINTPAFEW; NGWDINTPAFEWY; GWDINTPAFEWYY; WDINTPAFEWYYQ; DINTPAFEWYYQS; INTPAFEWYYQSG; NTPAFEWYYQSGL; TPAFEWYYQSGLS; PAFEWYYQSGLSI; AFEWYYQSGLSIV; FEWYYQSGLSIVM; EWYYQSGLSIVMP; WYYQSGLSIVMPV; YYQSGLSIVMPVG; YQSGLSIVMPVGG; QSGLSIVMPVGGQ; SGLSIVMPVGGQS; GLSIVMPVGGQSS; LSIVMPVGGQSSF; SIVMPVGGQSSFY; IVMPVGGQSSFYS; VMPVGGQSSFYSD; MPVGGQSSFYSDW; PVGGQSSFYSDWY; VGGQSSFYSDWYS; GGQSSFYSDWYSP; GQSSFYSDWYSPA; QSSFYSDWYSPAC; SSFYSDWYSPACG; SFYSDWYSPACGK; FYSDWYSPACGKA; YSDWYSPACGKAG; SDWYSPACGKAGC; DWYSPACGKAGCQ; WYSPACGKAGCQT; YSPACGKAGCQTY; SPACGKAGCQTYK; PACGKAGCQTYKW; ACGKAGCQTYKWE; CGKAGCQTYKWET; GKAGCQTYKWETF; KAGCQTYKWETFL; AGCQTYKWETFLT; GCQTYKWETFLTS; CQTYKWETFLTSE; QTYKWETFLTSEL; TYKWETFLTSELP; YKWETFLTSELPQ; KWETFLTSELPQW; WETFLTSELPQWL; ETFLTSELPQWLS; TFLTSELPQWLSA; FLTSELPQWLSAN; LTSELPQWLSANR; TSELPQWLSANRA; SELPQWLSANRAV; ELPQWLSANRAVK; LPQWLSANRAVKP; PQWLSANRAVKPT; QWLSANRAVKPTG; WLSANRAVKPTGS; LSANRAVKPTGSA; SANRAVKPTGSAA; ANRAVKPTGSAAI; NRAVKPTGSAAIG; RAVKPTGSAAIGL; AVKPTGSAAIGLS; VKPTGSAAIGLSM; KPTGSAAIGLSMA; PTGSAAIGLSMAG; TGSAAIGLSMAGS; GSAAIGLSMAGSS; SAAIGLSMAGSSA; AAIGLSMAGSSAM; AIGLSMAGSSAMI; IGLSMAGSSAMIL; GLSMAGSSAMILA; LSMAGSSAMILAA; SMAGSSAMILAAY; MAGSSAMILAAYH; AGSSAMILAAYHP; GSSAMILAAYHPQ; SSAMILAAYHPQQ; SAMILAAYHPQQF; AMILAAYHPQQFI; MILAAYHPQQFIY; | 116626-117871 |

Fig. 29 continued

| | | |
|---|---|---|
| | ILAAYHPQQFIYA; LAAYHPQQFIYAG; AAYHPQQFIYAGS; AYHPQQFIYAGSL; YHPQQFIYAGSLS; HPQQFIYAGSLSA; PQQFIYAGSLSAL; QQFIYAGSLSALL; QFIYAGSLSALLD; FIYAGSLSALLDP; IYAGSLSALLDPS; YAGSLSALLDPSQ; AGSLSALLDPSQG; GSLSALLDPSQGM; SLSALLDPSQGMG; LSALLDPSQGMGP; SALLDPSQGMGPS; ALLDPSQGMGPSL; LLDPSQGMGPSLI; LDPSQGMGPSLIG; DPSQGMGPSLIGL; PSQGMGPSLIGLA; SQGMGPSLIGLAM; QGMGPSLIGLAMG; GMGPSLIGLAMGD; MGPSLIGLAMGDA; GPSLIGLAMGDAG; PSLIGLAMGDAGG; SLIGLAMGDAGGY; LIGLAMGDAGGYK; IGLAMGDAGGYKA; GLAMGDAGGYKAA; LAMGDAGGYKAAD; AMGDAGGYKAADM; MGDAGGYKAADMW; GDAGGYKAADMWG; DAGGYKAADMWGP; AGGYKAADMWGPS; GGYKAADMWGPSS; GYKAADMWGPSSD; YKAADMWGPSSDP; KAADMWGPSSDPA; AADMWGPSSDPAW; ADMWGPSSDPAWE; DMWGPSSDPAWER; MWGPSSDPAWERN; WGPSSDPAWERND; GPSSDPAWERNDP; PSSDPAWERNDPT; SSDPAWERNDPTQ; SDPAWERNDPTQQ; DPAWERNDPTQQI; PAWERNDPTQQIP; AWERNDPTQQIPK; WERNDPTQQIPKL; ERNDPTQQIPKLV; RNDPTQQIPKLVA; NDPTQQIPKLVAN; DPTQQIPKLVANN; PTQQIPKLVANNT; TQQIPKLVANNTR; QQIPKLVANNTRL; QIPKLVANNTRLW; IPKLVANNTRLWV; PKLVANNTRLWVY; KLVANNTRLWVYC; LVANNTRLWVYCG; VANNTRLWVYCGN; ANNTRLWVYCGNG; NNTRLWVYCGNGT; NTRLWVYCGNGTP; TRLWVYCGNGTPN; RLWVYCGNGTPNE; LWVYCGNGTPNEL; WVYCGNGTPNELG; VYCGNGTPNELGG; YCGNGTPNELGGA; CGNGTPNELGGAN; GNGTPNELGGANI; NGTPNELGGANIP; GTPNELGGANIPA; TPNELGGANIPAE; PNELGGANIPAEF; NELGGANIPAEFL; ELGGANIPAEFLE; LGGANIPAEFLEN; GGANIPAEFLENF; GANIPAEFLENFV; ANIPAEFLENFVR; NIPAEFLENFVRS; IPAEFLENFVRSS; PAEFLENFVRSSN; AEFLENFVRSSNL; EFLENFVRSSNLK; FLENFVRSSNLKF; LENFVRSSNLKFQ; ENFVRSSNLKFQD; NFVRSSNLKFQDA; FVRSSNLKFQDAY; VRSSNLKFQDAYN; RSSNLKFQDAYNA; SSNLKFQDAYNAA; SNLKFQDAYNAAG; NLKFQDAYNAAGG; LKFQDAYNAAGGH; KFQDAYNAAGGHN; FQDAYNAAGGHNA; QDAYNAAGGHNAV; DAYNAAGGHNAVF; AYNAAGGHNAVFN; YNAAGGHNAVFNF; NAAGGHNAVFNFP; AAGGHNAVFNFPP; AGGHNAVFNFPPN; GGHNAVFNFPPNG; GHNAVFNFPPNGT; HNAVFNFPPNGTH; NAVFNFPPNGTHS; AVFNFPPNGTHSW; VFNFPPNGTHSWE; FNFPPNGTHSWEY; NFPPNGTHSWEYW; FPPNGTHSWEYWG; PPNGTHSWEYWGA; PNGTHSWEYWGAQ; NGTHSWEYWGAQL; GTHSWEYWGAQLN; THSWEYWGAQLNA; HSWEYWGAQLNAM; SWEYWGAQLNAMK; WEYWGAQLNAMKG; EYWGAQLNAMKGD; YWGAQLNAMKGDL; WGAQLNAMKGDLQ; GAQLNAMKGDLQS; AQLNAMKGDLQSS; QLNAMKGDLQSSL; LNAMKGDLQSSLG; NAMKGDLQSSLGA; AMKGDLQSSLGAG<br><br>14 mers:<br>MTDVSRKIRAWGRR; TDVSRKIRAWGRRL; DVSRKIRAWGRRLM; VSRKIRAWGRRLMI; SRKIRAWGRRLMIG; RKIRAWGRRLMIGT; KIRAWGRRLMIGTA; IRAWGRRLMIGTAA; RAWGRRLMIGTAAA; AWGRRLMIGTAAAV; WGRRLMIGTAAAVV; GRRLMIGTAAAVVL; RRLMIGTAAAVVLP; RLMIGTAAAVVLPG; LMIGTAAAVVLPGL; MIGTAAAVVLPGLV; IGTAAAVVLPGLVG; GTAAAVVLPGLVGL; TAAAVVLPGLVGLA; AAAVVLPGLVGLAG; AAVVLPGLVGLAGG; AVVLPGLVGLAGGA; VVLPGLVGLAGGAA; VLPGLVGLAGGAAT; LPGLVGLAGGAATA; PGLVGLAGGAATAG; GLVGLAGGAATAGA; | |

Fig. 29 continued

| | | |
|---|---|---|
| | LVGLAGGAATAGAF; VGLAGGAATAGAFS; GLAGGAATAGAFSR; | |
| | LAGGAATAGAFSRP; AGGAATAGAFSRPG; GGAATAGAFSRPGL; | |
| | GAATAGAFSRPGLP; AATAGAFSRPGLPV; ATAGAFSRPGLPVE; | |
| | TAGAFSRPGLPVEY; AGAFSRPGLPVEYL; GAFSRPGLPVEYLQ; | |
| | AFSRPGLPVEYLQV; FSRPGLPVEYLQVP; SRPGLPVEYLQVPS; | |
| | RPGLPVEYLQVPSP; PGLPVEYLQVPSPS; GLPVEYLQVPSPSM; | |
| | LPVEYLQVPSPSMG; PVEYLQVPSPSMGR; VEYLQVPSPSMGRD; | |
| | EYLQVPSPSMGRDI; YLQVPSPSMGRDIK; LQVPSPSMGRDIKV; | |
| | QVPSPSMGRDIKVQ; VPSPSMGRDIKVQF; PSPSMGRDIKVQFQ; | |
| | SPSMGRDIKVQFQS; PSMGRDIKVQFQSG; SMGRDIKVQFQSGG; | |
| | MGRDIKVQFQSGGN; GRDIKVQFQSGGNN; RDIKVQFQSGGNNS; | |
| | DIKVQFQSGGNNSP; IKVQFQSGGNNSPA; KVQFQSGGNNSPAV; | |
| | VQFQSGGNNSPAVY; QFQSGGNNSPAVYL; FQSGGNNSPAVYLL; | |
| | QSGGNNSPAVYLLD; SGGNNSPAVYLLDG; GGNNSPAVYLLDGL; | |
| | GNNSPAVYLLDGLR; NNSPAVYLLDGLRA; NSPAVYLLDGLRAQ; | |
| | SPAVYLLDGLRAQD; PAVYLLDGLRAQDD; AVYLLDGLRAQDDY; | |
| | VYLLDGLRAQDDYN; YLLDGLRAQDDYNG; LLDGLRAQDDYNGW; | |
| | LDGLRAQDDYNGWD; DGLRAQDDYNGWDI; GLRAQDDYNGWDIN; | |
| | LRAQDDYNGWDINT; RAQDDYNGWDINTP; AQDDYNGWDINTPA; | |
| | QDDYNGWDINTPAF; DDYNGWDINTPAFE; DYNGWDINTPAFEW; | |
| | YNGWDINTPAFEWY; NGWDINTPAFEWYY; GWDINTPAFEWYYQ; | |
| | WDINTPAFEWYYQS; DINTPAFEWYYQSG; INTPAFEWYYQSGL; | |
| | NTPAFEWYYQSGLS; TPAFEWYYQSGLSI; PAFEWYYQSGLSIV; | |
| | AFEWYYQSGLSIVM; FEWYYQSGLSIVMP; EWYYQSGLSIVMPV; | |
| | WYYQSGLSIVMPVG; YYQSGLSIVMPVGG; YQSGLSIVMPVGGQ; | |
| | QSGLSIVMPVGGQS; SGLSIVMPVGGQSS; GLSIVMPVGGQSSF; | |
| | LSIVMPVGGQSSFY; SIVMPVGGQSSFYS; IVMPVGGQSSFYSD; | |
| | VMPVGGQSSFYSDW; MPVGGQSSFYSDWY; PVGGQSSFYSDWYS; | |
| | VGGQSSFYSDWYSP; GGQSSFYSDWYSPA; GQSSFYSDWYSPAC; | |
| | QSSFYSDWYSPACG; SSFYSDWYSPACGK; SFYSDWYSPACGKA; | |
| | FYSDWYSPACGKAG; YSDWYSPACGKAGC; SDWYSPACGKAGCQ; | |
| | DWYSPACGKAGCQT; WYSPACGKAGCQTY; YSPACGKAGCQTYK; | |
| | SPACGKAGCQTYKW; PACGKAGCQTYKWE; ACGKAGCQTYKWET; | |
| | CGKAGCQTYKWETF; GKAGCQTYKWETFL; KAGCQTYKWETFLT; | |
| | AGCQTYKWETFLTS; GCQTYKWETFLTSE; CQTYKWETFLTSEL; | |
| | QTYKWETFLTSELP; TYKWETFLTSELPQ; YKWETFLTSELPQW; | |
| | KWETFLTSELPQWL; WETFLTSELPQWLS; ETFLTSELPQWLSA; | |
| | TFLTSELPQWLSAN; FLTSELPQWLSANR; LTSELPQWLSANRA; | |
| | TSELPQWLSANRAV; SELPQWLSANRAVK; ELPQWLSANRAVKP; | |
| | LPQWLSANRAVKPT; PQWLSANRAVKPTG; QWLSANRAVKPTGS; | |
| | WLSANRAVKPTGSA; LSANRAVKPTGSAA; SANRAVKPTGSAAI; | |
| | ANRAVKPTGSAAIG; NRAVKPTGSAAIGL; RAVKPTGSAAIGLS; | |
| | AVKPTGSAAIGLSM; VKPTGSAAIGLSMA; KPTGSAAIGLSMAG; | |
| | PTGSAAIGLSMAGS; TGSAAIGLSMAGSS; GSAAIGLSMAGSSA; | |
| | SAAIGLSMAGSSAM; AAIGLSMAGSSAMI; AIGLSMAGSSAMIL; | |
| | IGLSMAGSSAMILA; GLSMAGSSAMILAA; LSMAGSSAMILAAY; | |
| | SMAGSSAMILAAYH; MAGSSAMILAAYHP; AGSSAMILAAYHPQ; | |
| | GSSAMILAAYHPQQ; SSAMILAAYHPQQF; SAMILAAYHPQQFI; | |
| | AMILAAYHPQQFIY; MILAAYHPQQFIYA; ILAAYHPQQFIYAG; | |
| | LAAYHPQQFIYAGS; AAYHPQQFIYAGSL; AYHPQQFIYAGSLS; | |
| | YHPQQFIYAGSLSA; HPQQFIYAGSLSAL; PQQFIYAGSLSALL; | |
| | QQFIYAGSLSALLD; QFIYAGSLSALLDP; FIYAGSLSALLDPS; IYAGSLSALLDPSQ; | |
| | YAGSLSALLDPSQG; AGSLSALLDPSQGM; GSLSALLDPSQGMG; | |

Fig. 29 continued

SLSALLDPSQGMGP; LSALLDPSQGMGPS; SALLDPSQGMGPSL; ALLDPSQGMGPSLI; LLDPSQGMGPSLIG; LDPSQGMGPSLIGL; DPSQGMGPSLIGLA; PSQGMGPSLIGLAM; SQGMGPSLIGLAMG; QGMGPSLIGLAMGD; GMGPSLIGLAMGDA; MGPSLIGLAMGDAG; GPSLIGLAMGDAGG; PSLIGLAMGDAGGY; SLIGLAMGDAGGYK; LIGLAMGDAGGYKA; IGLAMGDAGGYKAA; GLAMGDAGGYKAAD; LAMGDAGGYKAADM; AMGDAGGYKAADMW; MGDAGGYKAADMWG; GDAGGYKAADMWGP; DAGGYKAADMWGPS; AGGYKAADMWGPSS; GGYKAADMWGPSSD; GYKAADMWGPSSDP; YKAADMWGPSSDPA; KAADMWGPSSDPAW; AADMWGPSSDPAWE; ADMWGPSSDPAWER; DMWGPSSDPAWERN; MWGPSSDPAWERND; WGPSSDPAWERNDP; GPSSDPAWERNDPT; PSSDPAWERNDPTQ; SSDPAWERNDPTQQ; SDPAWERNDPTQQI; DPAWERNDPTQQIP; PAWERNDPTQQIPK; AWERNDPTQQIPKL; WERNDPTQQIPKLV; ERNDPTQQIPKLVA; RNDPTQQIPKLVAN; NDPTQQIPKLVANN; DPTQQIPKLVANNT; PTQQIPKLVANNTR; TQQIPKLVANNTRL; QQIPKLVANNTRLW; QIPKLVANNTRLWV; IPKLVANNTRLWVY; PKLVANNTRLWVYC; KLVANNTRLWVYCG; LVANNTRLWVYCGN; VANNTRLWVYCGNG; ANNTRLWVYCGNGT; NNTRLWVYCGNGTP; NTRLWVYCGNGTPN; TRLWVYCGNGTPNE; RLWVYCGNGTPNEL; LWVYCGNGTPNELG; WVYCGNGTPNELGG; VYCGNGTPNELGGA; YCGNGTPNELGGAN; CGNGTPNELGGANI; GNGTPNELGGANIP; NGTPNELGGANIPA; GTPNELGGANIPAE; TPNELGGANIPAEF; PNELGGANIPAEFL; NELGGANIPAEFLE; ELGGANIPAEFLEN; LGGANIPAEFLENF; GGANIPAEFLENFV; GANIPAEFLENFVR; ANIPAEFLENFVRS; NIPAEFLENFVRSS; IPAEFLENFVRSSN; PAEFLENFVRSSNL; AEFLENFVRSSNLK; EFLENFVRSSNLKF; FLENFVRSSNLKFQ; LENFVRSSNLKFQD; ENFVRSSNLKFQDA; NFVRSSNLKFQDAY; FVRSSNLKFQDAYN; VRSSNLKFQDAYNA; RSSNLKFQDAYNAA; SSNLKFQDAYNAAG; SNLKFQDAYNAAGG; NLKFQDAYNAAGGH; LKFQDAYNAAGGHN; KFQDAYNAAGGHNA; FQDAYNAAGGHNAV; QDAYNAAGGHNAVF; DAYNAAGGHNAVFN; AYNAAGGHNAVFNF; YNAAGGHNAVFNFP; NAAGGHNAVFNFPP; AAGGHNAVFNFPPN; AGGHNAVFNFPPNG; GGHNAVFNFPPNGT; GHNAVFNFPPNGTH; HNAVFNFPPNGTHS; NAVFNFPPNGTHSW; AVFNFPPNGTHSWE; VFNFPPNGTHSWEY; FNFPPNGTHSWEYW; NFPPNGTHSWEYWG; FPPNGTHSWEYWGA; PPNGTHSWEYWGAQ; PNGTHSWEYWGAQL; NGTHSWEYWGAQLN; GTHSWEYWGAQLNA; THSWEYWGAQLNAM; HSWEYWGAQLNAMK; SWEYWGAQLNAMKG; WEYWGAQLNAMKGD; EYWGAQLNAMKGDL; YWGAQLNAMKGDLQ; WGAQLNAMKGDLQS; GAQLNAMKGDLQSS; AQLNAMKGDLQSSL; QLNAMKGDLQSSLG; LNAMKGDLQSSLGA; NAMKGDLQSSLGAG 15 mers:

MTDVSRKIRAWGRRL; TDVSRKIRAWGRRLM; DVSRKIRAWGRRLMI; VSRKIRAWGRRLMIG; SRKIRAWGRRLMIGT; RKIRAWGRRLMIGTA; KIRAWGRRLMIGTAA; IRAWGRRLMIGTAAA; RAWGRRLMIGTAAAV; AWGRRLMIGTAAAVV; WGRRLMIGTAAAVVL; GRRLMIGTAAAVVLP; RRLMIGTAAAVVLPG; RLMIGTAAAVVLPGL; LMIGTAAAVVLPGLV; MIGTAAAVVLPGLVG; IGTAAAVVLPGLVGL; GTAAAVVLPGLVGLA; TAAAVVLPGLVGLAG; AAAVVLPGLVGLAGG; AAVVLPGLVGLAGGA; AVVLPGLVGLAGGAA; VVLPGLVGLAGGAAT; VLPGLVGLAGGAATA; LPGLVGLAGGAATAG; PGLVGLAGGAATAGA; GLVGLAGGAATAGAF;

Fig. 29 continued

| | | |
|---|---|---|
| | LVGLAGGAATAGAFS; VGLAGGAATAGAFSR; GLAGGAATAGAFSRP;<br>LAGGAATAGAFSRPG; AGGAATAGAFSRPGL; GGAATAGAFSRPGLP;<br>GAATAGAFSRPGLPV; AATAGAFSRPGLPVE; ATAGAFSRPGLPVEY;<br>TAGAFSRPGLPVEYL; AGAFSRPGLPVEYLQ; GAFSRPGLPVEYLQV;<br>AFSRPGLPVEYLQVP; FSRPGLPVEYLQVPS; SRPGLPVEYLQVPSP;<br>RPGLPVEYLQVPSPS; PGLPVEYLQVPSPSM; GLPVEYLQVPSPSMG;<br>LPVEYLQVPSPSMGR; PVEYLQVPSPSMGRD; VEYLQVPSPSMGRDI;<br>EYLQVPSPSMGRDIK; YLQVPSPSMGRDIKV; LQVPSPSMGRDIKVQ;<br>QVPSPSMGRDIKVQF; VPSPSMGRDIKVQFQ; PSPSMGRDIKVQFQS;<br>SPSMGRDIKVQFQSG; PSMGRDIKVQFQSGG; SMGRDIKVQFQSGGN;<br>MGRDIKVQFQSGGNN; GRDIKVQFQSGGNNS; RDIKVQFQSGGNNSP;<br>DIKVQFQSGGNNSPA; IKVQFQSGGNNSPAV; KVQFQSGGNNSPAVY;<br>VQFQSGGNNSPAVYL; QFQSGGNNSPAVYLL; FQSGGNNSPAVYLLD;<br>QSGGNNSPAVYLLDG; SGGNNSPAVYLLDGL; GGNNSPAVYLLDGLR;<br>GNNSPAVYLLDGLRA; NNSPAVYLLDGLRAQ; NSPAVYLLDGLRAQD;<br>SPAVYLLDGLRAQDD; PAVYLLDGLRAQDDY; AVYLLDGLRAQDDYN;<br>VYLLDGLRAQDDYNG; YLLDGLRAQDDYNGW; LLDGLRAQDDYNGWD;<br>LDGLRAQDDYNGWDI; DGLRAQDDYNGWDIN; GLRAQDDYNGWDINT;<br>LRAQDDYNGWDINTP; RAQDDYNGWDINTPA; AQDDYNGWDINTPAF;<br>QDDYNGWDINTPAFE; DDYNGWDINTPAFEW; DYNGWDINTPAFEWY;<br>YNGWDINTPAFEWYY; NGWDINTPAFEWYYQ; GWDINTPAFEWYYQS;<br>WDINTPAFEWYYQSG; DINTPAFEWYYQSGL; INTPAFEWYYQSGLS;<br>NTPAFEWYYQSGLSI; TPAFEWYYQSGLSIV; PAFEWYYQSGLSIVM;<br>AFEWYYQSGLSIVMP; FEWYYQSGLSIVMPV; EWYYQSGLSIVMPVG;<br>WYYQSGLSIVMPVGG; YYQSGLSIVMPVGGQ; YQSGLSIVMPVGGQS;<br>QSGLSIVMPVGGQSS; SGLSIVMPVGGQSSF; GLSIVMPVGGQSSFY;<br>LSIVMPVGGQSSFYS; SIVMPVGGQSSFYSD; IVMPVGGQSSFYSDW;<br>VMPVGGQSSFYSDWY; MPVGGQSSFYSDWYS; PVGGQSSFYSDWYSP;<br>VGGQSSFYSDWYSPA; GGQSSFYSDWYSPAC; GQSSFYSDWYSPACG;<br>QSSFYSDWYSPACGK; SSFYSDWYSPACGKA; SFYSDWYSPACGKAG;<br>FYSDWYSPACGKAGC; YSDWYSPACGKAGCQ; SDWYSPACGKAGCQT;<br>DWYSPACGKAGCQTY; WYSPACGKAGCQTYK; YSPACGKAGCQTYKW;<br>SPACGKAGCQTYKWE; PACGKAGCQTYKWET; ACGKAGCQTYKWETF;<br>CGKAGCQTYKWETFL; GKAGCQTYKWETFLT; KAGCQTYKWETFLTS;<br>AGCQTYKWETFLTSE; GCQTYKWETFLTSEL; CQTYKWETFLTSELP;<br>QTYKWETFLTSELPQ; TYKWETFLTSELPQW; YKWETFLTSELPQWL;<br>KWETFLTSELPQWLS; WETFLTSELPQWLSA; ETFLTSELPQWLSAN;<br>TFLTSELPQWLSANR; FLTSELPQWLSANRA; LTSELPQWLSANRAV;<br>TSELPQWLSANRAVK; SELPQWLSANRAVKP; ELPQWLSANRAVKPT;<br>LPQWLSANRAVKPTG; PQWLSANRAVKPTGS; QWLSANRAVKPTGSA;<br>WLSANRAVKPTGSAA; LSANRAVKPTGSAAI; SANRAVKPTGSAAIG;<br>ANRAVKPTGSAAIGL; NRAVKPTGSAAIGLS; RAVKPTGSAAIGLSM;<br>AVKPTGSAAIGLSMA; VKPTGSAAIGLSMAG; KPTGSAAIGLSMAGS;<br>PTGSAAIGLSMAGSS; TGSAAIGLSMAGSSA; GSAAIGLSMAGSSAM;<br>SAAIGLSMAGSSAMI; AAIGLSMAGSSAMIL; AIGLSMAGSSAMILA;<br>IGLSMAGSSAMILAA; GLSMAGSSAMILAAY; LSMAGSSAMILAAYH;<br>SMAGSSAMILAAYHP; MAGSSAMILAAYHPQ; AGSSAMILAAYHPQQ;<br>GSSAMILAAYHPQQF; SSAMILAAYHPQQFI; SAMILAAYHPQQFIY;<br>AMILAAYHPQQFIYA; MILAAYHPQQFIYAG; ILAAYHPQQFIYAGS;<br>LAAYHPQQFIYAGSL; AAYHPQQFIYAGSLS; AYHPQQFIYAGSLSA;<br>YHPQQFIYAGSLSAL; HPQQFIYAGSLSALL; PQQFIYAGSLSALLD;<br>QQFIYAGSLSALLDP; QFIYAGSLSALLDPS; FIYAGSLSALLDPSQ;<br>IYAGSLSALLDPSQG; YAGSLSALLDPSQGM; AGSLSALLDPSQGMG; | |

Fig. 29 continued

GSLSALLDPSQGMGP; SLSALLDPSQGMGPS; LSALLDPSQGMGPSL;
SALLDPSQGMGPSLI; ALLDPSQGMGPSLIG; LLDPSQGMGPSLIGL;
LDPSQGMGPSLIGLA; DPSQGMGPSLIGLAM; PSQGMGPSLIGLAMG;
SQGMGPSLIGLAMGD; QGMGPSLIGLAMGDA; GMGPSLIGLAMGDAG;
MGPSLIGLAMGDAGG; GPSLIGLAMGDAGGY; PSLIGLAMGDAGGYK;
SLIGLAMGDAGGYKA; LIGLAMGDAGGYKAA; IGLAMGDAGGYKAAD;
GLAMGDAGGYKAADM; LAMGDAGGYKAADMW; AMGDAGGYKAADMWG;
MGDAGGYKAADMWGP; GDAGGYKAADMWGPS; DAGGYKAADMWGPSS;
AGGYKAADMWGPSSD; GGYKAADMWGPSSDP; GYKAADMWGPSSDPA;
YKAADMWGPSSDPAW; KAADMWGPSSDPAWE; AADMWGPSSDPAWER;
ADMWGPSSDPAWERN; DMWGPSSDPAWERND; MWGPSSDPAWERNDP;
WGPSSDPAWERNDPT; GPSSDPAWERNDPTQ; PSSDPAWERNDPTQQ;
SSDPAWERNDPTQQI; SDPAWERNDPTQQIP; DPAWERNDPTQQIPK;
PAWERNDPTQQIPKL; AWERNDPTQQIPKLV; WERNDPTQQIPKLVA;
ERNDPTQQIPKLVAN; RNDPTQQIPKLVANN; NDPTQQIPKLVANNT;
DPTQQIPKLVANNTR; PTQQIPKLVANNTRL; TQQIPKLVANNTRLW;
QQIPKLVANNTRLWV; QIPKLVANNTRLWVY; IPKLVANNTRLWVYC;
PKLVANNTRLWVYCG; KLVANNTRLWVYCGN; LVANNTRLWVYCGNG;
VANNTRLWVYCGNGT; ANNTRLWVYCGNGTP; NNTRLWVYCGNGTPN;
NTRLWVYCGNGTPNE; TRLWVYCGNGTPNEL; RLWVYCGNGTPNELG;
LWVYCGNGTPNELGG; WVYCGNGTPNELGGA; VYCGNGTPNELGGAN;
YCGNGTPNELGGANI; CGNGTPNELGGANIP; GNGTPNELGGANIPA;
NGTPNELGGANIPAE; GTPNELGGANIPAEF; TPNELGGANIPAEFL;
PNELGGANIPAEFLE; NELGGANIPAEFLEN; ELGGANIPAEFLENF;
LGGANIPAEFLENFV; GGANIPAEFLENFVR; GANIPAEFLENFVRS;
ANIPAEFLENFVRSS; NIPAEFLENFVRSSN; IPAEFLENFVRSSNL;
PAEFLENFVRSSNLK; AEFLENFVRSSNLKF; EFLENFVRSSNLKFQ;
FLENFVRSSNLKFQD; LENFVRSSNLKFQDA; ENFVRSSNLKFQDAY;
NFVRSSNLKFQDAYN; FVRSSNLKFQDAYNA; VRSSNLKFQDAYNAA;
RSSNLKFQDAYNAAG; SSNLKFQDAYNAAGG; SNLKFQDAYNAAGGH;
NLKFQDAYNAAGGHN; LKFQDAYNAAGGHNA; KFQDAYNAAGGHNAV;
FQDAYNAAGGHNAVF; QDAYNAAGGHNAVFN; DAYNAAGGHNAVFNF;
AYNAAGGHNAVFNFP; YNAAGGHNAVFNFPP; NAAGGHNAVFNFPPN;
AAGGHNAVFNFPPNG; AGGHNAVFNFPPNGT; GGHNAVFNFPPNGTH;
GHNAVFNFPPNGTHS; HNAVFNFPPNGTHSW; NAVFNFPPNGTHSWE;
AVFNFPPNGTHSWEY; VFNFPPNGTHSWEYW; FNFPPNGTHSWEYWG;
NFPPNGTHSWEYWGA; FPPNGTHSWEYWGAQ; PPNGTHSWEYWGAQL;
PNGTHSWEYWGAQLN; NGTHSWEYWGAQLNA; GTHSWEYWGAQLNAM;
THSWEYWGAQLNAMK; HSWEYWGAQLNAMKG; SWEYWGAQLNAMKGD;
WEYWGAQLNAMKGDL; EYWGAQLNAMKGDLQ; YWGAQLNAMKGDLQS;
WGAQLNAMKGDLQSS; GAQLNAMKGDLQSSL; AQLNAMKGDLQSSLG;
QLNAMKGDLQSSLGA; LNAMKGDLQSSLGAG 16 mers:
MTDVSRKIRAWGRRLM; TDVSRKIRAWGRRLMI; DVSRKIRAWGRRLMIG;
VSRKIRAWGRRLMIGT; SRKIRAWGRRLMIGTA; RKIRAWGRRLMIGTAA;
KIRAWGRRLMIGTAAA; IRAWGRRLMIGTAAAV; RAWGRRLMIGTAAAVV;
AWGRRLMIGTAAAVVL; WGRRLMIGTAAAVVLP; GRRLMIGTAAAVVLPG;
RRLMIGTAAAVVLPGL; RLMIGTAAAVVLPGLV; LMIGTAAAVVLPGLVG;
MIGTAAAVVLPGLVGL; IGTAAAVVLPGLVGLA; GTAAAVVLPGLVGLAG;
TAAAVVLPGLVGLAGG; AAAVVLPGLVGLAGGA; AAVVLPGLVGLAGGAA;
AVVLPGLVGLAGGAAT; VVLPGLVGLAGGAATA; VLPGLVGLAGGAATAG;
LPGLVGLAGGAATAGA; PGLVGLAGGAATAGAF; GLVGLAGGAATAGAFS;

Fig. 29 continued

| | | | |
|---|---|---|---|
| | LVGLAGGAATAGAFSR; VGLAGGAATAGAFSRP; GLAGGAATAGAFSRPG; LAGGAATAGAFSRPGL; AGGAATAGAFSRPGLP; GGAATAGAFSRPGLPV; GAATAGAFSRPGLPVE; AATAGAFSRPGLPVEY; ATAGAFSRPGLPVEYL; TAGAFSRPGLPVEYLQ; AGAFSRPGLPVEYLQV; GAFSRPGLPVEYLQVP; AFSRPGLPVEYLQVPS; FSRPGLPVEYLQVPSP; SRPGLPVEYLQVPSPS; RPGLPVEYLQVPSPSM; PGLPVEYLQVPSPSMG; GLPVEYLQVPSPSMGR; LPVEYLQVPSPSMGRD; PVEYLQVPSPSMGRDI; VEYLQVPSPSMGRDIK; EYLQVPSPSMGRDIKV; YLQVPSPSMGRDIKVQ; LQVPSPSMGRDIKVQF; QVPSPSMGRDIKVQFQ; VPSPSMGRDIKVQFQS; PSPSMGRDIKVQFQSG; SPSMGRDIKVQFQSGG; PSMGRDIKVQFQSGGN; SMGRDIKVQFQSGGNN; MGRDIKVQFQSGGNNS; GRDIKVQFQSGGNNSP; RDIKVQFQSGGNNSPA; DIKVQFQSGGNNSPAV; IKVQFQSGGNNSPAVY; KVQFQSGGNNSPAVYL; VQFQSGGNNSPAVYLL; QFQSGGNNSPAVYLLD; FQSGGNNSPAVYLLDG; QSGGNNSPAVYLLDGL; SGGNNSPAVYLLDGLR; GGNNSPAVYLLDGLRA; GNNSPAVYLLDGLRAQ; NNSPAVYLLDGLRAQD; NSPAVYLLDGLRAQDD; SPAVYLLDGLRAQDDY; PAVYLLDGLRAQDDYN; AVYLLDGLRAQDDYNG; VYLLDGLRAQDDYNGW; YLLDGLRAQDDYNGWD; LLDGLRAQDDYNGWDI; LDGLRAQDDYNGWDIN; DGLRAQDDYNGWDINT; GLRAQDDYNGWDINTP; LRAQDDYNGWDINTPA; RAQDDYNGWDINTPAF; AQDDYNGWDINTPAFE; QDDYNGWDINTPAFEW; DDYNGWDINTPAFEWY; DYNGWDINTPAFEWYY; YNGWDINTPAFEWYYQ; NGWDINTPAFEWYYQS; GWDINTPAFEWYYQSG; WDINTPAFEWYYQSGL; DINTPAFEWYYQSGLS; INTPAFEWYYQSGLSI; NTPAFEWYYQSGLSIV; TPAFEWYYQSGLSIVM; PAFEWYYQSGLSIVMP; AFEWYYQSGLSIVMPV; FEWYYQSGLSIVMPVG; EWYYQSGLSIVMPVGG; WYYQSGLSIVMPVGGQ; YYQSGLSIVMPVGGQS; YQSGLSIVMPVGGQSS; QSGLSIVMPVGGQSSF; SGLSIVMPVGGQSSFY; GLSIVMPVGGQSSFYS; LSIVMPVGGQSSFYSD; SIVMPVGGQSSFYSDW; IVMPVGGQSSFYSDWY; VMPVGGQSSFYSDWYS; MPVGGQSSFYSDWYSP; PVGGQSSFYSDWYSPA; VGGQSSFYSDWYSPAC; GGQSSFYSDWYSPACG; GQSSFYSDWYSPACGK; QSSFYSDWYSPACGKA; SSFYSDWYSPACGKAG; SFYSDWYSPACGKAGC; FYSDWYSPACGKAGCQ; YSDWYSPACGKAGCQT; SDWYSPACGKAGCQTY; DWYSPACGKAGCQTYK; WYSPACGKAGCQTYKW; YSPACGKAGCQTYKWE; SPACGKAGCQTYKWET; PACGKAGCQTYKWETF; ACGKAGCQTYKWETFL; CGKAGCQTYKWETFLT; GKAGCQTYKWETFLTS; KAGCQTYKWETFLTSE; AGCQTYKWETFLTSEL; GCQTYKWETFLTSELP; CQTYKWETFLTSELPQ; QTYKWETFLTSELPQW; TYKWETFLTSELPQWL; YKWETFLTSELPQWLS; KWETFLTSELPQWLSA; WETFLTSELPQWLSAN; ETFLTSELPQWLSANR; TFLTSELPQWLSANRA; FLTSELPQWLSANRAV; LTSELPQWLSANRAVK; TSELPQWLSANRAVKP; SELPQWLSANRAVKPT; ELPQWLSANRAVKPTG; LPQWLSANRAVKPTGS; PQWLSANRAVKPTGSA; QWLSANRAVKPTGSAA; WLSANRAVKPTGSAAI; LSANRAVKPTGSAAIG; SANRAVKPTGSAAIGL; ANRAVKPTGSAAIGLS; NRAVKPTGSAAIGLSM; RAVKPTGSAAIGLSMA; AVKPTGSAAIGLSMAG; VKPTGSAAIGLSMAGS; KPTGSAAIGLSMAGSS; PTGSAAIGLSMAGSSA; TGSAAIGLSMAGSSAM; GSAAIGLSMAGSSAMI; SAAIGLSMAGSSAMIL; AAIGLSMAGSSAMILA; AIGLSMAGSSAMILAA; IGLSMAGSSAMILAAY; GLSMAGSSAMILAAYH; LSMAGSSAMILAAYHP; SMAGSSAMILAAYHPQ; MAGSSAMILAAYHPQQ; AGSSAMILAAYHPQQF; GSSAMILAAYHPQQFI; SSAMILAAYHPQQFIY; SAMILAAYHPQQFIYA; AMILAAYHPQQFIYAG; MILAAYHPQQFIYAGS; ILAAYHPQQFIYAGSL; LAAYHPQQFIYAGSLS; AAYHPQQFIYAGSLSA; AYHPQQFIYAGSLSAL; YHPQQFIYAGSLSALL; HPQQFIYAGSLSALLD; PQQFIYAGSLSALLDP; QQFIYAGSLSALLDPS; QFIYAGSLSALLDPSQ; FIYAGSLSALLDPSQG; IYAGSLSALLDPSQGM; YAGSLSALLDPSQGMG; AGSLSALLDPSQGMGP; | |

Fig. 29 continued

| | | |
|---|---|---|
| | GSLSALLDPSQGMGPS; SLSALLDPSQGMGPSL; LSALLDPSQGMGPSLI; SALLDPSQGMGPSLIG; ALLDPSQGMGPSLIGL; LLDPSQGMGPSLIGLA; LDPSQGMGPSLIGLAM; DPSQGMGPSLIGLAMG; PSQGMGPSLIGLAMGD; SQGMGPSLIGLAMGDA; QGMGPSLIGLAMGDAG; GMGPSLIGLAMGDAGG; MGPSLIGLAMGDAGGY; GPSLIGLAMGDAGGYK; PSLIGLAMGDAGGYKA; SLIGLAMGDAGGYKAA; LIGLAMGDAGGYKAAD; IGLAMGDAGGYKAADM; GLAMGDAGGYKAADMW; LAMGDAGGYKAADMWG; AMGDAGGYKAADMWGP; MGDAGGYKAADMWGPS; GDAGGYKAADMWGPSS; DAGGYKAADMWGPSSD; AGGYKAADMWGPSSDP; GGYKAADMWGPSSDPA; GYKAADMWGPSSDPAW; YKAADMWGPSSDPAWE; KAADMWGPSSDPAWER; AADMWGPSSDPAWERN; ADMWGPSSDPAWERND; DMWGPSSDPAWERNDP; MWGPSSDPAWERNDPT; WGPSSDPAWERNDPTQ; GPSSDPAWERNDPTQQ; PSSDPAWERNDPTQQI; SSDPAWERNDPTQQIP; SDPAWERNDPTQQIPK; DPAWERNDPTQQIPKL; PAWERNDPTQQIPKLV; AWERNDPTQQIPKLVA; WERNDPTQQIPKLVAN; ERNDPTQQIPKLVANN; RNDPTQQIPKLVANNT; NDPTQQIPKLVANNTR; DPTQQIPKLVANNTRL; PTQQIPKLVANNTRLW; TQQIPKLVANNTRLWV; QQIPKLVANNTRLWVY; QIPKLVANNTRLWVYC; IPKLVANNTRLWVYCG; PKLVANNTRLWVYCGN; KLVANNTRLWVYCGNG; LVANNTRLWVYCGNGT; VANNTRLWVYCGNGTP; ANNTRLWVYCGNGTPN; NNTRLWVYCGNGTPNE; NTRLWVYCGNGTPNEL; TRLWVYCGNGTPNELG; RLWVYCGNGTPNELGG; LWVYCGNGTPNELGGA; WVYCGNGTPNELGGAN; VYCGNGTPNELGGANI; YCGNGTPNELGGANIP; CGNGTPNELGGANIPA; GNGTPNELGGANIPAE; NGTPNELGGANIPAEF; GTPNELGGANIPAEFL; TPNELGGANIPAEFLE; PNELGGANIPAEFLEN; NELGGANIPAEFLENF; ELGGANIPAEFLENFV; LGGANIPAEFLENFVR; GGANIPAEFLENFVRS; GANIPAEFLENFVRSS; ANIPAEFLENFVRSSN; NIPAEFLENFVRSSNL; IPAEFLENFVRSSNLK; PAEFLENFVRSSNLKF; AEFLENFVRSSNLKFQ; EFLENFVRSSNLKFQD; FLENFVRSSNLKFQDA; LENFVRSSNLKFQDAY; ENFVRSSNLKFQDAYN; NFVRSSNLKFQDAYNA; FVRSSNLKFQDAYNAA; VRSSNLKFQDAYNAAG; RSSNLKFQDAYNAAGG; SSNLKFQDAYNAAGGH; SNLKFQDAYNAAGGHN; NLKFQDAYNAAGGHNA; LKFQDAYNAAGGHNAV; KFQDAYNAAGGHNAVF; FQDAYNAAGGHNAVFN; QDAYNAAGGHNAVFNF; DAYNAAGGHNAVFNFP; AYNAAGGHNAVFNFPP; YNAAGGHNAVFNFPPN; NAAGGHNAVFNFPPNG; AAGGHNAVFNFPPNGT; AGGHNAVFNFPPNGTH; GGHNAVFNFPPNGTHS; GHNAVFNFPPNGTHSW; HNAVFNFPPNGTHSWE; NAVFNFPPNGTHSWEY; AVFNFPPNGTHSWEYW; VFNFPPNGTHSWEYWG; FNFPPNGTHSWEYWGA; NFPPNGTHSWEYWGAQ; FPPNGTHSWEYWGAQL; PPNGTHSWEYWGAQLN; PNGTHSWEYWGAQLNA; NGTHSWEYWGAQLNAM; GTHSWEYWGAQLNAMK; THSWEYWGAQLNAMKG; HSWEYWGAQLNAMKGD; SWEYWGAQLNAMKGDL; WEYWGAQLNAMKGDLQ; EYWGAQLNAMKGDLQS; YWGAQLNAMKGDLQSS; WGAQLNAMKGDLQSSL; GAQLNAMKGDLQSSLG; AQLNAMKGDLQSSLGA; QLNAMKGDLQSSLGAG | |

Fig. 29 continued

Figure 30

| | Protein and peptide sequences | SEQ ID NO |
|---|---|---|
| 1 | **<NP_216254.1 hypothetical protein Rv1738;Mycobacterium tuberculosis H37Rv>**<br>MCGDQSDHVLQHWTVDISIDEHEGLTRAKARLRWREKELVGVGLARLNPADRNVPEIGDELSVARALSDLGKRMLKVSTHDIEAVTHQPARLLY<br><br>8mer<br>HVLQHWTV;LQHWTVDI;SIDEHEGL;GLTRAKAR;RAKARLRW;ARLRWREK;REKELVGV;KELVGVGL;ELVGVGLA;LVGVGLAR;GLARLNPA;VPEIGDEL;EIGDELSV;ELSVARAL;RALSDLGK;DLGKRMLK;KRMLKVST;RMLKVSTH;STHDIEAV;EAVTHQPA;AVTHQPAR;THQPARLL;HQPARLLY<br>9mer<br>MCGDQSDHV;QSDHVLQHW;VLQHWTVDI;SIDEHEGLT;GLTRAKARL;LTRAKARLR;RAKARLRWR;KARLRWREK;RLRWREKEL;ELVGVGLAR;LVGVGLARL;RLNPADRNV;NVPEIGDEL;PEIGDELSV;DELSVARAL;SVARALSDL;ARALSDLGK;RALSDLGKR;ALSDLGKRM;DLGKRMLKV;KRMLKVSTH;MLKVSTHDI;KVSTHDIEA;EAVTHQPAR;AVTHQPARL<br>10mer<br>HVLQHWTVDI;LQHWTVDISI;DISIDEHEGL;GLTRAKARLR;LTRAKARLRW;TRAKARLRWR;RLRWREKELV;REKELVGVGL;ELVGVGLARL;NPADRNVPEI;EIGDELSVAR;VARALSDLGK;ALSDLGKRML;LSDLGKRMLK;RMLKVSTHDI;KVSTHDIEAV;EAVTHQPARL;VTHQPARLLY<br>11mer<br>QSDHVLQHWTV;VLQHWTVDISI;ISIDEHEGLTR;SIDEHEGLTRA;GLTRAKARLRW;LTRAKARLRWR;RAKARLRWREK;KARLRWREKEL;KELVGVGLARL;NVPEIGDELSV;ELSVARALSDL;SVARALSDLGK;VARALSDLGKR;ALSDLGKRMLK;MLKVSTHDIEA;DIEAVTHQPAR;IEAVTHQPARL;EAVTHQPARLL;AVTHQPARLLY<br><br>13 mers:<br>MCGDQSDHVLQHW;CGDQSDHVLQHWT;GDQSDHVLQHWTV;DQSDHVLQHWTVD;QSDHVLQHWTVDI;SDHVLQHWTVDIS;DHVLQHWTVDISI;HVLQHWTVDISID;VLQHWTVDISIDE;LQHWTVDISIDEH;QHWTVDISIDEHE;HWTVDISIDEHEG;WTVDISIDEHEGL;TVDISIDEHEGLT;VDISIDEHEGLTR;DISIDEHEGLTRA;ISIDEHEGLTRAK;SIDEHEGLTRAKA;IDEHEGLTRAKAR;DEHEGLTRAKARL;EHEGLTRAKARLR;HEGLTRAKARLRW;EGLTRAKARLRWR;GLTRAKARLRWRE;LTRAKARLRWREK;TRAKARLRWREKE;RAKARLRWREKEL;AKARLRWREKELV;KARLRWREKELVG;ARLRWREKELVGV;RLRWREKELVGVG;LRWREKELVGVGL;RWREKELVGVGLA;WREKELVGVGLAR;REKELVGVGLARL;EKELVGVGLARLN;KELVGVGLARLNP;ELVGVGLARLNPA;LVGVGLARLNPAD;VGVGLARLNPADR;GVGLARLNPADRN;VGLARLNPADRNV;GLARLNPADRNVP;LARLNPADRNVPE;ARLNPADRNVPEI;RLNPADRNVPEIG;LNPADRNVPEIGD;NPADRNVPEIGDE;PADRNVPEIGDEL;ADRNVPEIGDELS;DRNVPEIGDELSV;RNVPEIGDELSVA;NVPEIGDELSVAR;VPEIGDELSVARA;PEIGDELSVARAL;EIGDELSVARALS;IGDELSVARALSD;GDELSVARALSDL;DELSVARALSDLG;ELSVARALSDLGK;LSVARALSDLGKR;SVARALSDLGKRM;VARALSDLGKRML;ARALSDLGKRMLK;RALSDLGKRMLKV;ALSDLGKRMLKVS;LSDLGKRMLKVST;SDLGKRMLKVSTH;DLGKRMLKVSTHD;LGKRMLKVSTHDI;GKRMLKVSTHDIE;KRMLKVSTHDIEA;RMLKVSTHDIEAV;MLKVSTHDIEAVT;LKVSTHDIEAVTH;KVSTHD | 117872-118279 |

| | | |
|---|---|---|
| | IEAVTHQ;VSTHDIEAVTHQP;STHDIEAVTHQPA;THDIEAVTHQPAR;HDIEAVTHQPARL;DIEAVTHQPARLL;IEAVTHQPARLLY;<br>14 mers:<br>MCGDQSDHVLQHWT;CGDQSDHVLQHWTV;GDQSDHVLQHWTVD;DQSDHVLQHWTVDI;QSDHVLQHWTVDIS;SDHVLQHWTVDISI;DHVLQHWTVDISID;HVLQHWTVDISIDE;VLQHWTVDISIDEH;LQHWTVDISIDEHE;QHWTVDISIDEHEG;HWTVDISIDEHEGL;WTVDISIDEHEGLT;TVDISIDEHEGLTR;VDISIDEHEGLTRA;DISIDEHEGLTRAK;ISIDEHEGLTRAKA;SIDEHEGLTRAKAR;IDEHEGLTRAKARL;DEHEGLTRAKARLR;EHEGLTRAKARLRW;HEGLTRAKARLRWR;EGLTRAKARLRWRE;GLTRAKARLRWREK;LTRAKARLRWREKE;TRAKARLRWREKEL;RAKARLRWREKELV;AKARLRWREKELVG;KARLRWREKELVGV;ARLRWREKELVGVG;RLRWREKELVGVGL;LRWREKELVGVGLA;RWREKELVGVGLAR;WREKELVGVGLARL;REKELVGVGLARLN;EKELVGVGLARLNP;KELVGVGLARLNPA;ELVGVGLARLNPAD;LVGVGLARLNPADR;VGVGLARLNPADRN;GVGLARLNPADRNV;VGLARLNPADRNVP;GLARLNPADRNVPE;LARLNPADRNVPEI;ARLNPADRNVPEIG;RLNPADRNVPEIGD;LNPADRNVPEIGDE;NPADRNVPEIGDEL;PADRNVPEIGDELS;ADRNVPEIGDELSV;DRNVPEIGDELSVA;RNVPEIGDELSVAR;NVPEIGDELSVARA;VPEIGDELSVARAL;PEIGDELSVARALS;EIGDELSVARALSD;IGDELSVARALSDL;GDELSVARALSDLG;DELSVARALSDLGK;ELSVARALSDLGKR;LSVARALSDLGKRM;SVARALSDLGKRML;VARALSDLGKRMLK;ARALSDLGKRMLKV;RALSDLGKRMLKVS;ALSDLGKRMLKVST;LSDLGKRMLKVSTH;SDLGKRMLKVSTHD;DLGKRMLKVSTHDI;LGKRMLKVSTHDIE;GKRMLKVSTHDIEA;KRMLKVSTHDIEAV;RMLKVSTHDIEAVT;MLKVSTHDIEAVTH;LKVSTHDIEAVTHQ;KVSTHDIEAVTHQP;VSTHDIEAVTHQPA;STHDIEAVTHQPAR;THDIEAVTHQPARL;HDIEAVTHQPARLL;DIEAVTHQPARLLY;<br>15 mers:<br>MCGDQSDHVLQHWTV;CGDQSDHVLQHWTVD;GDQSDHVLQHWTVDI;DQSDHVLQHWTVDIS;QSDHVLQHWTVDISI;SDHVLQHWTVDISID;DHVLQHWTVDISIDE;HVLQHWTVDISIDEH;VLQHWTVDISIDEHE;LQHWTVDISIDEHEG;QHWTVDISIDEHEGL;HWTVDISIDEHEGLT;WTVDISIDEHEGLTR;TVDISIDEHEGLTRA;VDISIDEHEGLTRAK;DISIDEHEGLTRAKA;ISIDEHEGLTRAKAR;SIDEHEGLTRAKARL;IDEHEGLTRAKARLR;DEHEGLTRAKARLRW;EHEGLTRAKARLRWR;HEGLTRAKARLRWRE;EGLTRAKARLRWREK;GLTRAKARLRWREKE;LTRAKARLRWREKEL;TRAKARLRWREKELV;RAKARLRWREKELVG;AKARLRWREKELVGV;KARLRWREKELVGVG;ARLRWREKELVGVGL;RLRWREKELVGVGLA;LRWREKELVGVGLAR;RWREKELVGVGLARL;WREKELVGVGLARLN;REKELVGVGLARLNP;EKELVGVGLARLNPA;KELVGVGLARLNPAD;ELVGVGLARLNPADR;LVGVGLARLNPADRN;VGVGLARLNPADRNV;GVGLARLNPADRNVP;VGLARLNPADRNVPE;GLARLNPADRNVPEI;LARLNPADRNVPEIG;ARLNPADRNVPEIGD;RLNPADRNVPEIGDE;LNPADRNVPEIGDEL;NPADRNVPEIGDELS;PADRNVPEIGDELSV;ADRNVPEIGDELSVA;DRNVPEIGDELSVAR;RNVPEIGDELSVARA;NVPEIGDELSVARAL;VPEIGDELSVARALS;PEIGDELSVARALSD;EIGDELSVARALSDL;IGDELSVARALSDLG;GDELSVARALSDLGK;DELSVARALSDLGKR;ELSVARALSDLGKRM;LSVARALSDLGKRML;SVARALSDLGKRMLK;VARALSDLGKRMLKV;ARALSDLGKRMLKVS;RALSDLGKRMLKVST;ALSDLGKRMLKVSTH;LSDLGKRMLKVSTHD;SDLGKRMLKVSTHDI;DLGKRMLKVSTHDIE;LGKRMLKVSTHDIEA;GKRMLKVSTHDIEAV;KRMLKVSTHDIEAVT;RMLKVSTHDIEAVTH;MLKVSTHDIEAVTHQ;LKVSTHDIEAVTHQP;KVSTHDIEAVTHQPA;VSTHDIEAVTHQPAR;STHDIEAVTHQPARL;THDIEAVTHQPARLL;HDIEAVTHQPARLLY;<br>16 mers: | |

Fig. 30 continued

| | | |
|---|---|---|
| | MCGDQSDHVLQHWTVD;CGDQSDHVLQHWTVDI;GDQSDHVLQHWTVDIS;DQSDHVLQHWTVDISI;QSDHVLQHWTVDISID;SDHVLQHWTVDISIDE;DHVLQHWTVDISIDEH;HVLQHWTVDISIDEHE;VLQHWTVDISIDEHEG;LQHWTVDISIDEHEGL;QHWTVDISIDEHEGLT;HWTVDISIDEHEGLTR;WTVDISIDEHEGLTRA;TVDISIDEHEGLTRAK;VDISIDEHEGLTRAKA;DISIDEHEGLTRAKAR;ISIDEHEGLTRAKARL;SIDEHEGLTRAKARLR;IDEHEGLTRAKARLRW;DEHEGLTRAKARLRWR;EHEGLTRAKARLRWRE;HEGLTRAKARLRWREK;EGLTRAKARLRWREKE;GLTRAKARLRWREKEL;LTRAKARLRWREKELV;TRAKARLRWREKELVG;RAKARLRWREKELVGV;AKARLRWREKELVGVG;KARLRWREKELVGVGL;ARLRWREKELVGVGLA;RLRWREKELVGVGLAR;LRWREKELVGVGLARL;RWREKELVGVGLARLN;WREKELVGVGLARLNP;REKELVGVGLARLNPA;EKELVGVGLARLNPAD;KELVGVGLARLNPADR;ELVGVGLARLNPADRN;LVGVGLARLNPADRNV;VGVGLARLNPADRNVP;GVGLARLNPADRNVPE;VGLARLNPADRNVPEI;GLARLNPADRNVPEIG;LARLNPADRNVPEIGD;ARLNPADRNVPEIGDE;RLNPADRNVPEIGDEL;LNPADRNVPEIGDELS;NPADRNVPEIGDELSV;PADRNVPEIGDELSVA;ADRNVPEIGDELSVAR;DRNVPEIGDELSVARA;RNVPEIGDELSVARAL;NVPEIGDELSVARALS;VPEIGDELSVARALSD;PEIGDELSVARALSDL;EIGDELSVARALSDLG;IGDELSVARALSDLGK;GDELSVARALSDLGKR;DELSVARALSDLGKRM;ELSVARALSDLGKRML;LSVARALSDLGKRMLK;SVARALSDLGKRMLKV;VARALSDLGKRMLKVS;ARALSDLGKRMLKVST;RALSDLGKRMLKVSTH;ALSDLGKRMLKVSTHD;LSDLGKRMLKVSTHDI;SDLGKRMLKVSTHDIE;DLGKRMLKVSTHDIEA;LGKRMLKVSTHDIEAV;GKRMLKVSTHDIEAVT;KRMLKVSTHDIEAVTH;RMLKVSTHDIEAVTHQ;MLKVSTHDIEAVTHQP;LKVSTHDIEAVTHQPA;KVSTHDIEAVTHQPAR;VSTHDIEAVTHQPARL;STHDIEAVTHQPARLL;THDIEAVTHQPARLLY; | |
| 2 | **<NP_216966.1 resuscitation-promoting factor RpfE Rv2450c;Mycobacterium tuberculosis H37Rv>**<br>MKNARTTLIAAAIAGTLVTTSPAGIANADDAGLDPNAAAGPDAVGFDPNLPPAPDAAPVDTPPAPEDAGFDPNLPPPLAPDFLSPPAEEAPPVPVAYSVNWDAIAQCESGGNWSINTGNGYYGGLRFTAGTWRANGGSGSAANASREEQIRVAENVLRSQGIRAWPVCGRRG<br><br>8mer<br>RTTLIAAA;TTLIAAAI;TLIAAAIA;AAAIAGTL;AAIAGTLV;TLVTTSPA;TTSPAGIA;SPAGIANA;GLDPNAAA;AAAGPDAV;NLPPAPDA;LPPAPDAA;PAPDAAPV;APVDTPPA;DPNLPPPL;LPPPLAPD;PLAPDFLS;FLSPPAEE;EEAPPVPV;EAPPVPVA;APPVPVAY;PVPVAYSV;YSVNWDAI;SVNWDAIA;ESGGNWSI;SINTGNGY;NGYYGGLR;GYYGGLRF;GLRFTAGT;RFTAGTWR;FTAGTWRA;GSAANASR;RVAENVLR;AENVLRSQ;NVLRSQGI;VLRSQGIR;RSQGIRAW;QGIRAWPV;RAWPVCGR<br>9mer<br>MKNARTTLI;RTTLIAAAI;LIAAAIAGT;IAAAIAGTL;AAAIAGTLV;AIAGTLVTT;LVTTSPAGI;TSPAGIANA;IANADDAGL;GLDPNAAAG;NAAAGPDAV;AAGPDAVGF;NLPPAPDAA;PPAPDAAPV;PPAPEDAGF;LPPPLAPDF;APDFLSPPA;FLSPPAEEA;PPAEEAPPV;AEEAPPVPV;EAPPVPVAY;PPVPVAYSV;VPVAYSVNW;AYSVNWDAI;CESGGNWSI;WSINTGNGY;SINTGNGYY;TGNGYYGGL;YYGGLRFTA;RFTAGTWRA;RANGGSGSA;NASREEQIR;EQIRVAENV;AENVLRSQG;NVLRSQGIR;VLRSQGIRA;SQGIRAWPV;RAWPVCGRR<br>10mer<br>TLIAAAIAGT;LIAAAIAGTL;IAAAIAGTLV;AAIAGTLVTT;TLVTTSPAGI;TTSPAGIANA;GIANADDAGL;GLDPNAAAGP;AAAGPDAVGF;LPPAPDAAPV;DA | 118280-119056 |

Fig. 30 continued

| | | |
|---|---|---|
| | APVDTPPA;APVDTPPAPE;TPPAPEDAGF;PEDAGFDPNL;GFDPNLPPPL;<br>NLPPPLAPDF;LPPPLAPDFL;LAPDFLSPPA;FLSPPAEEAP;PAEEAPPVPV;<br>AEEAPPVPVA;EEAPPVPVAY;EAPPVPVAYS;APPVPVAYSV;IAQCESGGN<br>W;WSINTGNGYY;NTGNGYYGGL;TGNGYYGGLR;GYYGGLRFTA;GGLRF<br>TAGTW;GLRFTAGTWR;RANGGSGSAA;EEQIRVAENV;QIRVAENVLR;AE<br>NVLRSQGI;ENVLRSQGIR;RSQGIRAWPV;GIRAWPVCGR<br>11mer<br>NARTTLIAAAI;TLIAAAIAGTL;LIAAAIAGTLV;SPAGIANADDA;DPNAAAGPD<br>AV;NAAAGPDAVGF;DPNLPPAPDAA;NLPPAPDAAPV;DTPPAPEDAGF;NL<br>PPPLAPDFL;LPPPLAPDFLS;PLAPDFLSPPA;FLSPPAEEAPP;PPAEEAPP<br>VPV;AEEAPPVPVAY;EAPPVPVAYSV;PPVPVAYSVNW;VPVAYSVNWDA;<br>AQCESGGNWSI;NWSINTGNGYY;NTGNGYYGGLR;GLRFTAGTWRA;AAN<br>ASREEQIR;REEQIRVAENV;EEQIRVAENVL;EQIRVAENVLR;GIRAWPVCG<br>RR<br><br>13 mers:<br>MKNARTTLIAAAI;KNARTTLIAAAIA;NARTTLIAAAIAG;ARTTLIAAAIAGT;RT<br>TLIAAAIAGTL;TTLIAAAIAGTLV;TLIAAAIAGTLVT;LIAAAIAGTLVTT;IAAAIA<br>GTLVTTS;AAAIAGTLVTTSP;AAIAGTLVTTSPA;AIAGTLVTTSPAG;IAGTLV<br>TTSPAGI;AGTLVTTSPAGIA;GTLVTTSPAGIAN;TLVTTSPAGIANA;LVTTSP<br>AGIANAD;VTTSPAGIANADD;TTSPAGIANADDA;TSPAGIANADDAG;SPAG<br>IANADDAGL;PAGIANADDAGLD;AGIANADDAGLDP;GIANADDAGLDPN;IA<br>NADDAGLDPNA;ANADDAGLDPNAA;NADDAGLDPNAAA;ADDAGLDPNAA<br>AG;DDAGLDPNAAAGP;DAGLDPNAAAGPD;AGLDPNAAAGPDA;GLDPNA<br>AAGPDAV;LDPNAAAGPDAVG;DPNAAAGPDAVGF;PNAAAGPDAVGFD;N<br>AAAGPDAVGFDP;AAAGPDAVGFDPN;AAGPDAVGFDPNL;AGPDAVGFDP<br>NLP;GPDAVGFDPNLPP;PDAVGFDPNLPPA;DAVGFDPNLPPAP;AVGFDP<br>NLPPAPD;VGFDPNLPPAPDA;GFDPNLPPAPDAA;FDPNLPPAPDAAP;DP<br>NLPPAPDAAPV;PNLPPAPDAAPVD;NLPPAPDAAPVDT;LPPAPDAAPVDT<br>P;PPAPDAAPVDTPP;PAPDAAPVDTPPA;APDAAPVDTPPAP;PDAAPVDTP<br>PAPE;DAAPVDTPPAPED;AAPVDTPPAPEDA;APVDTPPAPEDAG;PVDTP<br>PAPEDAGF;VDTPPAPEDAGFD;DTPPAPEDAGFDP;TPPAPEDAGFDPN;P<br>PAPEDAGFDPNL;PAPEDAGFDPNLP;APEDAGFDPNLPP;PEDAGFDPNLP<br>PP;EDAGFDPNLPPPL;DAGFDPNLPPPLA;AGFDPNLPPPLAP;GFDPNLPP<br>PLAPD;FDPNLPPPLAPDF;DPNLPPPLAPDFL;PNLPPPLAPDFLS;NLPPPL<br>APDFLSP;LPPPLAPDFLSPP;PPPLAPDFLSPPA;PPLAPDFLSPPAE;PLAP<br>DFLSPPAEE;LAPDFLSPPAEEA;APDFLSPPAEEAP;PDFLSPPAEEAPP;DF<br>LSPPAEEAPPV;FLSPPAEEAPPVP;LSPPAEEAPPVPV;SPPAEEAPPVPVA<br>;PPAEEAPPVPVAY;PAEEAPPVPVAYS;AEEAPPVPVAYSV;EEAPPVPVAY<br>SVN;EAPPVPVAYSVNW;APPVPVAYSVNWD;PPVPVAYSVNWDA;PVPVA<br>YSVNWDAI;VPVAYSVNWDAIA;PVAYSVNWDAIAQ;VAYSVNWDAIAQC;A<br>YSVNWDAIAQCE;YSVNWDAIAQCES;SVNWDAIAQCESG;VNWDAIAQCE<br>SGG;NWDAIAQCESGGN;WDAIAQCESGGNW;DAIAQCESGGNWS;AIAQC<br>ESGGNWSI;IAQCESGGNWSIN;AQCESGGNWSINT;QCESGGNWSINTG;<br>CESGGNWSINTGN;ESGGNWSINTGNG;SGGNWSINTGNGY;GGNWSINT<br>GNGYY;GNWSINTGNGYYG;NWSINTGNGYYGG;WSINTGNGYYGGL;SIN<br>TGNGYYGGLR;INTGNGYYGGLRF;NTGNGYYGGLRFT;TGNGYYGGLRFT<br>A;GNGYYGGLRFTAG;NGYYGGLRFTAGT;GYYGGLRFTAGTW;YYGGLRF<br>TAGTWR;YGGLRFTAGTWRA;GGLRFTAGTWRAN;GLRFTAGTWRANG;L<br>RFTAGTWRANGG;RFTAGTWRANGGS;FTAGTWRANGGSG;TAGTWRAN<br>GGSGS;AGTWRANGGSGSA;GTWRANGGSGSAA;TWRANGGSGSAAN;W<br>RANGGSGSAANA;RANGGSGSAANAS;ANGGSGSAANASR;NGGSGSAA<br>NASRE;GGSGSAANASREE;GSGSAANASREEQ;SGSAANASREEQI;GSA | |

Fig. 30 continued

| | | |
|---|---|---|
| | ANASREEQIR;SAANASREEQIRV;AANASREEQIRVA;ANASREEQIRVAE;NASREEQIRVAEN;ASREEQIRVAENV;SREEQIRVAENVL;REEQIRVAENVLR;EEQIRVAENVLRS;EQIRVAENVLRSQ;QIRVAENVLRSQG;IRVAENVLRSQGI;RVAENVLRSQGIR;VAENVLRSQGIRA;AENVLRSQGIRAW;ENVLRSQGIRAWP;NVLRSQGIRAWPV;VLRSQGIRAWPVC;LRSQGIRAWPVCG;RSQGIRAWPVCGR;SQGIRAWPVCGRR;QGIRAWPVCGRRG;<br>14 mers:<br>MKNARTTLIAAAIA;KNARTTLIAAAIAG;NARTTLIAAAIAGT;ARTTLIAAAIAGTL;RTTLIAAAIAGTLV;TTLIAAAIAGTLVT;TLIAAAIAGTLVTT;LIAAAIAGTLVTTS;IAAAIAGTLVTTSP;AAAIAGTLVTTSPA;AAIAGTLVTTSPAG;AIAGTLVTTSPAGI;IAGTLVTTSPAGIA;AGTLVTTSPAGIAN;GTLVTTSPAGIANA;TLVTTSPAGIANAD;LVTTSPAGIANADD;VTTSPAGIANADDA;TTSPAGIANADDAG;TSPAGIANADDAGL;SPAGIANADDAGLD;PAGIANADDAGLDP;AGIANADDAGLDPN;GIANADDAGLDPNA;IANADDAGLDPNAA;ANADDAGLDPNAAA;NADDAGLDPNAAAG;ADDAGLDPNAAAGP;DDAGLDPNAAAGPD;DAGLDPNAAAGPDA;AGLDPNAAAGPDAV;GLDPNAAAGPDAVG;LDPNAAAGPDAVGF;DPNAAAGPDAVGFD;PNAAAGPDAVGFDP;NAAAGPDAVGFDPN;AAAGPDAVGFDPNL;AAGPDAVGFDPNLP;AGPDAVGFDPNLPP;GPDAVGFDPNLPPA;PDAVGFDPNLPPAP;DAVGFDPNLPPAPD;AVGFDPNLPPAPDA;VGFDPNLPPAPDAA;GFDPNLPPAPDAAP;FDPNLPPAPDAAPV;DPNLPPAPDAAPVD;PNLPPAPDAAPVDT;NLPPAPDAAPVDTP;LPPAPDAAPVDTPP;PPAPDAAPVDTPPA;PAPDAAPVDTPPAP;APDAAPVDTPPAPE;PDAAPVDTPPAPED;DAAPVDTPPAPEDA;AAPVDTPPAPEDAG;APVDTPPAPEDAGF;PVDTPPAPEDAGFD;VDTPPAPEDAGFDP;DTPPAPEDAGFDPN;TPPAPEDAGFDPNL;PPAPEDAGFDPNLP;PAPEDAGFDPNLPP;APEDAGFDPNLPPP;PEDAGFDPNLPPPL;EDAGFDPNLPPPLA;DAGFDPNLPPPLAP;AGFDPNLPPPLAPD;GFDPNLPPPLAPDF;FDPNLPPPLAPDFL;DPNLPPPLAPDFLS;PNLPPPLAPDFLSP;NLPPPLAPDFLSPP;LPPPLAPDFLSPPA;PPPLAPDFLSPPAE;PPLAPDFLSPPAEE;PLAPDFLSPPAEEA;LAPDFLSPPAEEAP;APDFLSPPAEEAPP;PDFLSPPAEEAPPV;DFLSPPAEEAPPVP;FLSPPAEEAPPVPV;LSPPAEEAPPVPVA;SPPAEEAPPVPVAY;PPAEEAPPVPVAYS;PAEEAPPVPVAYSV;AEEAPPVPVAYSVN;EEAPPVPVAYSVNW;EAPPVPVAYSVNWD;APPVPVAYSVNWDA;PPVPVAYSVNWDAI;PVPVAYSVNWDAIA;VPVAYSVNWDAIAQ;PVAYSVNWDAIAQC;VAYSVNWDAIAQCE;AYSVNWDAIAQCES;YSVNWDAIAQCESG;SVNWDAIAQCESGG;VNWDAIAQCESGGN;NWDAIAQCESGGNW;WDAIAQCESGGNWS;DAIAQCESGGNWSI;AIAQCESGGNWSIN;IAQCESGGNWSINT;AQCESGGNWSINTG;QCESGGNWSINTGN;CESGGNWSINTGNG;ESGGNWSINTGNGY;SGGNWSINTGNGYY;GGNWSINTGNGYYG;GNWSINTGNGYYGG;NWSINTGNGYYGGL;WSINTGNGYYGGLR;SINTGNGYYGGLRF;INTGNGYYGGLRFT;NTGNGYYGGLRFTA;TGNGYYGGLRFTAG;GNGYYGGLRFTAGT;NGYYGGLRFTAGTW;GYYGGLRFTAGTWR;YYGGLRFTAGTWRA;YGGLRFTAGTWRAN;GGLRFTAGTWRANG;GLRFTAGTWRANGG;LRFTAGTWRANGGS;RFTAGTWRANGGSG;FTAGTWRANGGSGS;TAGTWRANGGSGSA;AGTWRANGGSGSAA;GTWRANGGSGSAAN;TWRANGGSGSAANA;WRANGGSGSAANAS;RANGGSGSAANASR;ANGGSGSAANASRE;NGGSGSAANASREE;GGSGSAANASREEQ;GSGSAANASREEQI;SGSAANASREEQIR;GSAANASREEQIRV;SAANASREEQIRVA;AANASREEQIRVAE;ANASREEQIRVAEN;NASREEQIRVAENV;ASREEQIRVAENVL;SREEQIRVAENVLR;REEQIRVAENVLRS;EEQIRVAENVLRSQ;EQIRVAENVLRSQG;QIRVAENVLRSQGI;IRVAENVLRSQGIR;RVAENVLRSQGIRA;VAENVLRSQGIRAW;AENVLRSQGIRAWP;ENVLRSQGIRAWPV;NVLRSQGIRAWPVC;VLRSQGIRAWPVCG;LRSQGIRAWPVCGR;RSQGIRAWPVCGRR;SQGIRAWPVCGRRG; | |

Fig. 30 continued

| | | |
|---|---|---|
| | 15 mers:<br>MKNARTTLIAAAIAG;KNARTTLIAAAIAGT;NARTTLIAAAIAGTL;ARTTLIAAAIAGTLV;RTTLIAAAIAGTLVT;TTLIAAAIAGTLVTT;TLIAAAIAGTLVTTS;LIAAAIAGTLVTTSP;IAAAIAGTLVTTSPA;AAAIAGTLVTTSPAG;AAIAGTLVTTSPAGI;AIAGTLVTTSPAGIA;IAGTLVTTSPAGIAN;AGTLVTTSPAGIANA;GTLVTTSPAGIANAD;TLVTTSPAGIANADD;LVTTSPAGIANADDA;VTTSPAGIANADDAG;TTSPAGIANADDAGL;TSPAGIANADDAGLD;SPAGIANADDAGLDP;PAGIANADDAGLDPN;AGIANADDAGLDPNA;GIANADDAGLDPNAA;IANADDAGLDPNAAA;ANADDAGLDPNAAAG;NADDAGLDPNAAAGP;ADDAGLDPNAAAGPD;DDAGLDPNAAAGPDA;DAGLDPNAAAGPDAV;AGLDPNAAAGPDAVG;GLDPNAAAGPDAVGF;LDPNAAAGPDAVGFD;DPNAAAGPDAVGFDP;PNAAAGPDAVGFDPN;NAAAGPDAVGFDPNL;AAAGPDAVGFDPNLP;AAGPDAVGFDPNLPP;AGPDAVGFDPNLPPA;GPDAVGFDPNLPPAP;PDAVGFDPNLPPAPD;DAVGFDPNLPPAPDA;AVGFDPNLPPAPDAA;VGFDPNLPPAPDAAP;GFDPNLPPAPDAAPV;FDPNLPPAPDAAPVD;DPNLPPAPDAAPVDT;PNLPPAPDAAPVDTP;NLPPAPDAAPVDTPP;LPPAPDAAPVDTPPA;PPAPDAAPVDTPPAP;PAPDAAPVDTPPAPE;APDAAPVDTPPAPED;PDAAPVDTPPAPEDA;DAAPVDTPPAPEDAG;AAPVDTPPAPEDAGF;APVDTPPAPEDAGFD;PVDTPPAPEDAGFDP;VDTPPAPEDAGFDPN;DTPPAPEDAGFDPNL;TPPAPEDAGFDPNLP;PPAPEDAGFDPNLPP;PAPEDAGFDPNLPPP;APEDAGFDPNLPPPL;PEDAGFDPNLPPPLA;EDAGFDPNLPPPLAP;DAGFDPNLPPPLAPD;AGFDPNLPPPLAPDF;GFDPNLPPPLAPDFL;FDPNLPPPLAPDFLS;DPNLPPPLAPDFLSP;PNLPPPLAPDFLSPP;NLPPPLAPDFLSPPA;LPPPLAPDFLSPPAE;PPPLAPDFLSPPAEE;PPLAPDFLSPPAEEA;PLAPDFLSPPAEEAP;LAPDFLSPPAEEAPP;APDFLSPPAEEAPPV;PDFLSPPAEEAPPVP;DFLSPPAEEAPPVPV;FLSPPAEEAPPVPVA;LSPPAEEAPPVPVAY;SPPAEEAPPVPVAYS;PPAEEAPPVPVAYSV;PAEEAPPVPVAYSVN;AEEAPPVPVAYSVNW;EEAPPVPVAYSVNWD;EAPPVPVAYSVNWDA;APPVPVAYSVNWDAI;PPVPVAYSVNWDAIA;PVPVAYSVNWDAIAQ;VPVAYSVNWDAIAQC;PVAYSVNWDAIAQCE;VAYSVNWDAIAQCES;AYSVNWDAIAQCESG;YSVNWDAIAQCESGG;SVNWDAIAQCESGGN;VNWDAIAQCESGGNW;NWDAIAQCESGGNWS;WDAIAQCESGGNWSI;DAIAQCESGGNWSIN;AIAQCESGGNWSINT;IAQCESGGNWSINTG;AQCESGGNWSINTGN;QCESGGNWSINTGNG;CESGGNWSINTGNGY;ESGGNWSINTGNGYY;SGGNWSINTGNGYYG;GGNWSINTGNGYYGG;GNWSINTGNGYYGGL;NWSINTGNGYYGGLR;WSINTGNGYYGGLRF;SINTGNGYYGGLRFT;INTGNGYYGGLRFTA;NTGNGYYGGLRFTAG;TGNGYYGGLRFTAGT;GNGYYGGLRFTAGTW;NGYYGGLRFTAGTWR;GYYGGLRFTAGTWRA;YYGGLRFTAGTWRAN;YGGLRFTAGTWRANG;GGLRFTAGTWRANGG;GLRFTAGTWRANGGS;LRFTAGTWRANGGSG;RFTAGTWRANGGSGS;FTAGTWRANGGSGSA;TAGTWRANGGSGSAA;AGTWRANGGSGSAAN;GTWRANGGSGSAANA;TWRANGGSGSAANAS;WRANGGSGSAANASR;RANGGSGSAANASRE;ANGGSGSAANASREE;NGGSGSAANASREEQ;GGSGSAANASREEQI;GSGSAANASREEQIR;SGSAANASREEQIRV;GSAANASREEQIRVA;SAANASREEQIRVAE;AANASREEQIRVAEN;ANASREEQIRVAENV;NASREEQIRVAENVL;ASREEQIRVAENVLR;SREEQIRVAENVLRS;REEQIRVAENVLRSQ;EEQIRVAENVLRSQG;EQIRVAENVLRSQGI;QIRVAENVLRSQGIR;IRVAENVLRSQGIRA;RVAENVLRSQGIRAW;VAENVLRSQGIRAWP;AENVLRSQGIRAWPV;ENVLRSQGIRAWPVC;NVLRSQGIRAWPVCG;VLRSQGIRAWPVCGR;LRSQGIRAWPVCGRR;RSQGIRAWPVCGRRG;<br>16 mers:<br>MKNARTTLIAAAIAGT;KNARTTLIAAAIAGTL;NARTTLIAAAIAGTLV;ARTTLIAAAIAGTLVT;RTTLIAAAIAGTLVTT;TTLIAAAIAGTLVTTS;TLIAAAIAGTLVT | |

Fig. 30 continued

| | | |
|---|---|---|
| | TSP;LIAAAIAGTLVTTSPA;IAAAIAGTLVTTSPAG;AAAIAGTLVTTSPAGI;AAIAGTLVTTSPAGIA;AIAGTLVTTSPAGIAN;IAGTLVTTSPAGIANA;AGTLVTTSPAGIANAD;GTLVTTSPAGIANADD;TLVTTSPAGIANADDA;LVTTSPAGIANADDAG;VTTSPAGIANADDAGL;TTSPAGIANADDAGLD;TSPAGIANADDAGLDP;SPAGIANADDAGLDPN;PAGIANADDAGLDPNA;AGIANADDAGLDPNAA;GIANADDAGLDPNAAA;IANADDAGLDPNAAAG;ANADDAGLDPNAAAGP;NADDAGLDPNAAAGPD;ADDAGLDPNAAAGPDA;DDAGLDPNAAAGPDAV;DAGLDPNAAAGPDAVG;AGLDPNAAAGPDAVGF;GLDPNAAAGPDAVGFD;LDPNAAAGPDAVGFDP;DPNAAAGPDAVGFDPN;PNAAAGPDAVGFDPNL;NAAAGPDAVGFDPNLP;AAAGPDAVGFDPNLPP;AAGPDAVGFDPNLPPA;AGPDAVGFDPNLPPAP;GPDAVGFDPNLPPAPD;PDAVGFDPNLPPAPDA;DAVGFDPNLPPAPDAA;AVGFDPNLPPAPDAAP;VGFDPNLPPAPDAAPV;GFDPNLPPAPDAAPVD;FDPNLPPAPDAAPVDT;DPNLPPAPDAAPVDTP;PNLPPAPDAAPVDTPP;NLPPAPDAAPVDTPPA;LPPAPDAAPVDTPPAP;PPAPDAAPVDTPPAPE;PAPDAAPVDTPPAPED;APDAAPVDTPPAPEDA;PDAAPVDTPPAPEDAG;DAAPVDTPPAPEDAGF;AAPVDTPPAPEDAGFD;APVDTPPAPEDAGFDP;PVDTPPAPEDAGFDPN;VDTPPAPEDAGFDPNL;DTPPAPEDAGFDPNLP;TPPAPEDAGFDPNLPP;PPAPEDAGFDPNLPPP;PAPEDAGFDPNLPPPL;APEDAGFDPNLPPPLA;PEDAGFDPNLPPPLAP;EDAGFDPNLPPPLAPD;DAGFDPNLPPPLAPDF;AGFDPNLPPPLAPDFL;GFDPNLPPPLAPDFLS;FDPNLPPPLAPDFLSP;DPNLPPPLAPDFLSPP;PNLPPPLAPDFLSPPA;NLPPPLAPDFLSPPAE;LPPPLAPDFLSPPAEE;PPPLAPDFLSPPAEEA;PPLAPDFLSPPAEEAP;PLAPDFLSPPAEEAPP;LAPDFLSPPAEEAPPV;APDFLSPPAEEAPPVP;PDFLSPPAEEAPPVPV;DFLSPPAEEAPPVPVA;FLSPPAEEAPPVPVAY;LSPPAEEAPPVPVAYS;SPPAEEAPPVPVAYSV;PPAEEAPPVPVAYSVN;PAEEAPPVPVAYSVNW;AEEAPPVPVAYSVNWD;EEAPPVPVAYSVNWDA;EAPPVPVAYSVNWDAI;APPVPVAYSVNWDAIA;PPVPVAYSVNWDAIAQ;PVPVAYSVNWDAIAQC;VPVAYSVNWDAIAQCE;PVAYSVNWDAIAQCES;VAYSVNWDAIAQCESG;AYSVNWDAIAQCESGG;YSVNWDAIAQCESGGN;SVNWDAIAQCESGGNW;VNWDAIAQCESGGNWS;NWDAIAQCESGGNWSI;WDAIAQCESGGNWSIN;DAIAQCESGGNWSINT;AIAQCESGGNWSINTG;IAQCESGGNWSINTGN;AQCESGGNWSINTGNG;QCESGGNWSINTGNGY;CESGGNWSINTGNGYY;ESGGNWSINTGNGYYG;SGGNWSINTGNGYYGG;GGNWSINTGNGYYGGL;GNWSINTGNGYYGGLR;NWSINTGNGYYGGLRF;WSINTGNGYYGGLRFT;SINTGNGYYGGLRFTA;INTGNGYYGGLRFTAG;NTGNGYYGGLRFTAGT;TGNGYYGGLRFTAGTW;GNGYYGGLRFTAGTWR;NGYYGGLRFTAGTWRA;GYYGGLRFTAGTWRAN;YYGGLRFTAGTWRANG;YGGLRFTAGTWRANGG;GGLRFTAGTWRANGGS;GLRFTAGTWRANGGSG;LRFTAGTWRANGGSGS;RFTAGTWRANGGSGSA;FTAGTWRANGGSGSAA;TAGTWRANGGSGSAAN;AGTWRANGGSGSAANA;GTWRANGGSGSAANAS;TWRANGGSGSAANASR;WRANGGSGSAANASRE;RANGGSGSAANASREE;ANGGSGSAANASREEQ;NGGSGSAANASREEQI;GGSGSAANASREEQIR;GSGSAANASREEQIRV;SGSAANASREEQIRVA;GSAANASREEQIRVAE;SAANASREEQIRVAEN;AANASREEQIRVAENV;ANASREEQIRVAENVL;NASREEQIRVAENVLR;ASREEQIRVAENVLRS;SREEQIRVAENVLRSQ;REEQIRVAENVLRSQG;EEQIRVAENVLRSQGI;EQIRVAENVLRSQGIR;QIRVAENVLRSQGIRA;IRVAENVLRSQGIRAW;RVAENVLRSQGIRAWP;VAENVLRSQGIRAWPV;AENVLRSQGIRAWPVC;ENVLRSQGIRAWPVCG;NVLRSQGIRAWPVCGR;VLRSQGIRAWPVCGRR;LRSQGIRAWPVCGRRG; | |
| 3 | **<NP_217139.1 hypothetical protein Rv2623;Mycobacterium tuberculosis H37Rv>** MSSGNSSLGIIVGIDDSPAAQVAVRWAARDAELRKIPLTLVHAVSPEVATW | 119057-120545 |

Fig. 30 continued

| | | |
|---|---|---|
| | LEVPLPPGVLRWQQDHGRHLIDDALKVVEQASLRAGPPTVHSEIVPAAAVPTLVDMSKDAVLMVVGCLGSGRWPGRLLGSVSSGLLRHAHCPVVIIHDEDSVMPHPQQAPVLVGVDGSSASELATAIAFDEASRRNVDLVALHAWSDVDVSEWPGIDWPATQSMAEQVLAERLAGWQERYPNVAITRVVVRDQPARQLVQRSEEAQLVVVGSRGRGGYAGMLVGSVGETVAQLARTPVIVARESLT<br><br>8mer<br>MSSGNSSL;SLGIIVGI;GIDDSPAA;SPAAQVAV;PAAQVAVR;AAQVAVRW;AQVAVRWA;QVAVRWAA;VAVRWAAR;WAARDAEL;AARDAELR;AELRKIPL;RKIPLTLV;IPLTLVHA;PLTLVHAV;VSPEVATW;SPEVATWL;EVATWLEV;EVPLPPGV;VPLPPGVL;LPPGVLRW;RWQQDHGR;HLIDDALK;LIDDALKV;ALKVVEQA;KVVEQASL;VVEQASLR;SLRAGPPT;EIVPAAAV;VPAAAVPT;AAAVPTLV;AVPTLVDM;VPTLVDMS;PTLVDMSK;DMSKDAVL;SKDAVLMV;VLMVVGCL;GSGRWPGR;GRWPGRLL;RLLGSVSS;SVSSGLLR;GLLRHAHC;HAHCPVVI;IIHDEDSV;IHDEDSVM;VMPHPQQA;HPQQAPVL;QAPVLVGV;SASELATA;ELATAIAF;TAIAFDEA;IAFDEASR;ALHAWSDV;HAWSDVDV;DVSEWPGI;SEWPGIDW;WPGIDWPA;GIDWPATQ;WPATQSMA;TQSMAEQV;SMAEQVLA;VLAERLAG;RLAGWQER;LAGWQERY;WQERYPNV;ERYPNVAI;RYPNVAIT;YPNVAITR;NVAITRVV;VAITRVVV;AITRVVVR;VVRDQPAR;SEEAQLVV;EEAQLVVV;QLVVVGSR;VVVGSRGR;GSRGRGGY;GRGGYAGM;GGYAGMLV;ETVAQLAR;TVAQLART;AQLARTPV;QLARTPVI;RTPVIVAR;VIVARESL<br>9mer<br>SSLGIIVGI;GIDDSPAAQ;DSPAAQVAV;SPAAQVAVR;PAAQVAVRW;AQVAVRWAA;QVAVRWAAR;RWAARDAEL;WAARDAELR;AARDAELRK;ELRKIPLTL;KIPLTLVHA;IPLTLVHAV;LVHAVSPEV;AVSPEVATW;VATWLEVPL;LEVPLPPGV;EVPLPPGVL;PLPPGVLRW;WQQDHGRHL;QQDHGRHLI;HLIDDALKV;LIDDALKVV;KVVEQASLR;SLRAGPPTV;GPPTVHSEI;TVHSEIVPA;SEIVPAAAV;VPAAAVPTL;PAAAVPTLV;TLVDMSKDA;LVDMSKDAV;MSKDAVLMV;SKDAVLMVV;WPGRLLGSV;LLGSVSSGL;GSVSSGLLR;SVSSGLLRH;LLRHAHCPV;HAHCPVVII;VIIHDEDSV;IIHDEDSVM;SVMPHPQQA;MPHPQQAPV;HPQQAPVLV;QQAPVLVGV;SASELATAI;SELATAIAF;ATAIAFDEA;TAIAFDEAS;AIAFDEASR;IAFDEASRR;RRNVDLVAL;WSDVDVSEW;EWPGIDWPA;WPGIDWPAT;IDWPATQSM;WPATQSMAE;ATQSMAEQV;QSMAEQVLA;SMAEQVLAE;MAEQVLAER;AEQVLAERL;VLAERLAGW;RLAGWQERY;QERYPNVAI;RYPNVAITR;YPNVAITRV;NVAITRVVV;VAITRVVVR;VVVRDQPAR;QPARQLVQR;QLVQRSEEA;SEEAQLVVV;AQLVVVGSR;LVVVGSRGR;YAGMLVGSV;MLVGSVGET;LVGSVGETV;SVGETVAQL;ETVAQLART;VAQLARTPV;AQLARTPVI;QLARTPVIV<br>10mer<br>MSSGNSSLGI;NSSLGIIVGI;IIVGIDDSPA;GIDDSPAAQV;DSPAAQVAVR;SPAAQVAVRW;AQVAVRWAAR;VRWAARDAEL;RWAARDAELR;WAARDAELRK;AELRKIPLTL;ELRKIPLTLV;KIPLTLVHAV;IPLTLVHAVS;TLVHAVSPEV;HAVSPEVATW;AVSPEVATWL;SPEVATWLEV;EVATWLEVPL;WLEVPLPPGV;LEVPLPPGVL;EVPLPPGVLR;VPLPPGVLRW;PLPPGVLRWQ;VLRWQQDHGR;WQQDHGRHLI;HLIDDALKVV;ALKVVEQASL;KVVEQASLRA;GPPTVHSEIV;TVHSEIVPAA;HSEIVPAAAV;EIVPAAAVPT;IVPAAAVPTL;VPAAAVPTLV;AVPTLVDMSK;TLVDMSKDAV;DMSKDAVLMV;MSKDAVLMVV;MVVGCLGSGR;GRWPGRLLGS;WPGRLLGSVS;RLLGSVSSGL;LLGSVSSGLL;SVSSGLLRHA;GLLRHAHCPV;LLRHAHCPVV;VVIIHDEDSV;VIIHDEDSVM;VMPHPQQAPV;MPHPQQAPVL;APVLVGVDGS;VLVGVDGSSA;GVDGSSASEL;SSASELATAI;LATAIAFDEA;TAIAFDEASR;AIAFDEASRR;AFDEASRRNV;EASRRNVDLV;RRNVDLVALH;LVALHAWSDV;ALHAWSDVDV;SEWP | |

Fig. 30 continued

| | | |
|---|---|---|
| | GIDWPA;GIDWPATQSM;WPATQSMAEQ;SMAEQVLAER;MAEQVLAERL;A<br>EQVLAERLA;QVLAERLAGW;VLAERLAGWQ;RLAGWQERYP;WQERYPN<br>VAI;ERYPNVAITR;RYPNVAITRV;YPNVAITRVV;NVAITRVVVR;RVVVRDQ<br>PAR;VVRDQPARQL;VRDQPARQLV;RQLVQRSEEA;EAQLVVVGSR;QLVV<br>VGSRGR;GYAGMLVGSV;GMLVGSVGET;MLVGSVGETV;SVGETVAQLA;T<br>VAQLARTPV;AQLARTPVIV;QLARTPVIVA;LARTPVIVAR;TPVIVARESL<br>11mer<br>MSSGNSSLGII;GIIVGIDDSPA;IIVGIDDSPAA;VGIDDSPAAQV;GIDDSPAA<br>QVA;DSPAAQVAVRW;AAQVAVRWAAR;AVRWAARDAEL;RWAARDAELR<br>K;AELRKIPLTLV;RKIPLTLVHAV;IPLTLVHAVSP;LTLVHAVSPEV;TLVHAVS<br>PEVA;VHAVSPEVATW;HAVSPEVATWL;VSPEVATWLEV;PEVATWLEVPL;<br>TWLEVPLPPGV;WLEVPLPPGVL;EVPLPPGVLRW;PLPPGVLRWQQ;GVLR<br>WQQDHGR;RWQQDHGRHLI;LIDDALKVVEQ;ALKVVEQASLR;PPTVHSEI<br>VPA;TVHSEIVPAAA;EIVPAAAVPTL;IVPAAAVPTLV;AAVPTLVDMSK;VPTL<br>VDMSKDA;PTLVDMSKDAV;TLVDMSKDAVL;DMSKDAVLMVV;LMVVGCL<br>GSGR;CLGSGRWPGRL;GRWPGRLLGSV;WPGRLLGSVSS;GRLLGSVSS<br>GL;RLLGSVSSGLL;LLGSVSSGLLR;SVSSGLLRHAH;GLLRHAHCPVV;LLR<br>HAHCPVVI;PVVIIHDEDSV;VVIIHDEDSVM;SVMPHPQQAPV;VMPHPQQA<br>PVL;MPHPQQAPVLV;HPQQAPVLVGV;APVLVGVDGSS;VLVGVDGSSAS;<br>GVDGSSASELA;SASELATAIAF;ELATAIAFDEA;ATAIAFDEASR;TAIAFDEA<br>SRR;IAFDEASRRNV;ASRRNVDLVAL;RNVDLVALHAW;DLVALHAWSDV;H<br>AWSDVDVSEW;GIDWPATQSMA;WPATQSMAEQV;QSMAEQVLAER;SMA<br>EQVLAERL;AEQVLAERLAG;VLAERLAGWQE;LAERLAGWQER;AERLAG<br>WQERY;RLAGWQERYPN;ERYPNVAITRV;RYPNVAITRVV;YPNVAITRVVV<br>;ITRVVVRDQPA;VVRDQPARQLV;QLVQRSEEAQL;LVQRSEEAQLV;EEAQ<br>LVVVGSR;AQLVVVGSRGR;VVVGSRGRGGY;RGRGGYAGMLV;GGYAGM<br>LVGSV;GMLVGSVGETV;MLVGSVGETVA;SVGETVAQLAR;ETVAQLARTP<br>V;TVAQLARTPVI;AQLARTPVIVA;QLARTPVIVAR;RTPVIVARESL;TPVIVA<br>RESLT<br><br>13 mers:<br>MSSGNSSLGIIVG;SSGNSSLGIIVGI;SGNSSLGIIVGID;GNSSLGIIVGIDD;N<br>SSLGIIVGIDDS;SSLGIIVGIDDSP;SLGIIVGIDDSPA;LGIIVGIDDSPAA;GIIV<br>GIDDSPAAQ;IIVGIDDSPAAQV;IVGIDDSPAAQVA;VGIDDSPAAQVAV;GID<br>DSPAAQVAVR;IDDSPAAQVAVRW;DDSPAAQVAVRWA;DSPAAQVAVRW<br>AA;SPAAQVAVRWAAR;PAAQVAVRWAARD;AAQVAVRWAARDA;AQVAV<br>RWAARDAE;QVAVRWAARDAEL;VAVRWAARDAELR;AVRWAARDAELRK<br>;VRWAARDAELRKI;RWAARDAELRKIP;WAARDAELRKIPL;AARDAELRKIP<br>LT;ARDAELRKIPLTL;RDAELRKIPLTLV;DAELRKIPLTLVH;AELRKIPLTLVH<br>A;ELRKIPLTLVHAV;LRKIPLTLVHAVS;RKIPLTLVHAVSP;KIPLTLVHAVSPE<br>;IPLTLVHAVSPEV;PLTLVHAVSPEVA;LTLVHAVSPEVAT;TLVHAVSPEVAT<br>W;LVHAVSPEVATWL;VHAVSPEVATWLE;HAVSPEVATWLEV;AVSPEVAT<br>WLEVP;VSPEVATWLEVPL;SPEVATWLEVPLP;PEVATWLEVPLPP;EVAT<br>WLEVPLPPG;VATWLEVPLPPGV;ATWLEVPLPPGVL;TWLEVPLPPGVLR;<br>WLEVPLPPGVLRW;LEVPLPPGVLRWQ;EVPLPPGVLRWQQ;VPLPPGVLR<br>WQQD;PLPPGVLRWQQDH;LPPGVLRWQQDHG;PPGVLRWQQDHGR;PG<br>VLRWQQDHGRH;GVLRWQQDHGRHL;VLRWQQDHGRHLI;LRWQQDHG<br>RHLID;RWQQDHGRHLIDD;WQQDHGRHLIDDA;QQDHGRHLIDDAL;QDH<br>GRHLIDDALK;DHGRHLIDDALKV;HGRHLIDDALKVV;GRHLIDDALKVVE;R<br>HLIDDALKVVEQ;HLIDDALKVVEQA;LIDDALKVVEQAS;IDDALKVVEQASL;<br>DDALKVVEQASLR;DALKVVEQASLRA;ALKVVEQASLRAG;LKVVEQASLR<br>AGP;KVVEQASLRAGPP;VVEQASLRAGPPT;VEQASLRAGPPTV;EQASLR<br>AGPPTVH;QASLRAGPPTVHS;ASLRAGPPTVHSE;SLRAGPPTVHSEI;LRA | |

Fig. 30 continued

| | | |
|---|---|---|
| | GPPTVHSEIV;RAGPPTVHSEIVP;AGPPTVHSEIVPA;GPPTVHSEIVPAA;PPTVHSEIVPAAA;PTVHSEIVPAAAV;TVHSEIVPAAAVP;VHSEIVPAAAVPT;HSEIVPAAAVPTL;SEIVPAAAVPTLV;EIVPAAAVPTLVD;IVPAAAVPTLVDM;VPAAAVPTLVDMS;PAAAVPTLVDMSK;AAAVPTLVDMSKD;AAVPTLVDMSKDA;AVPTLVDMSKDAV;VPTLVDMSKDAVL;PTLVDMSKDAVLM;TLVDMSKDAVLMV;LVDMSKDAVLMVV;VDMSKDAVLMVVG;DMSKDAVLMVVGC;MSKDAVLMVVGCL;SKDAVLMVVGCLG;KDAVLMVVGCLGS;DAVLMVVGCLGSG;AVLMVVGCLGSGR;VLMVVGCLGSGRW;LMVVGCLGSGRWP;MVVGCLGSGRWPG;VVGCLGSGRWPGR;VGCLGSGRWPGRL;GCLGSGRWPGRLL;CLGSGRWPGRLLG;LGSGRWPGRLLGS;GSGRWPGRLLGSV;SGRWPGRLLGSVS;GRWPGRLLGSVSS;RWPGRLLGSVSSG;WPGRLLGSVSSGL;PGRLLGSVSSGLL;GRLLGSVSSGLLR;RLLGSVSSGLLRH;LLGSVSSGLLRHA;LGSVSSGLLRHAH;GSVSSGLLRHAHC;SVSSGLLRHAHCP;VSSGLLRHAHCPV;SSGLLRHAHCPVV;SGLLRHAHCPVVI;GLLRHAHCPVVII;LLRHAHCPVVIIH;LRHAHCPVVIIHD;RHAHCPVVIIHDE;HAHCPVVIIHDED;AHCPVVIIHDEDS;HCPVVIIHDEDSV;CPVVIIHDEDSVM;PVVIIHDEDSVMP;VVIIHDEDSVMPH;VIIHDEDSVMPHP;IIHDEDSVMPHPQ;IHDEDSVMPHPQQ;HDEDSVMPHPQQA;DEDSVMPHPQQAP;EDSVMPHPQQAPV;DSVMPHPQQAPVL;SVMPHPQQAPVLV;VMPHPQQAPVLVG;MPHPQQAPVLVGV;PHPQQAPVLVGVD;HPQQAPVLVGVDG;PQQAPVLVGVDGS;QQAPVLVGVDGSS;QAPVLVGVDGSSA;APVLVGVDGSSAS;PVLVGVDGSSASE;VLVGVDGSSASEL;LVGVDGSSASELA;VGVDGSSASELAT;GVDGSSASELATA;VDGSSASELATAI;DGSSASELATAIA;GSSASELATAIAF;SSASELATAIAFD;SASELATAIAFDE;ASELATAIAFDEA;SELATAIAFDEAS;ELATAIAFDEASR;LATAIAFDEASRR;ATAIAFDEASRRN;TAIAFDEASRRNV;AIAFDEASRRNVD;IAFDEASRRNVDL;AFDEASRRNVDLV;FDEASRRNVDLVA;DEASRRNVDLVAL;EASRRNVDLVALH;ASRRNVDLVALHA;SRRNVDLVALHAW;RRNVDLVALHAWS;RNVDLVALHAWSD;NVDLVALHAWSDV;VDLVALHAWSDVD;DLVALHAWSDVDV;LVALHAWSDVDVS;VALHAWSDVDVSE;ALHAWSDVDVSEW;LHAWSDVDVSEWP;HAWSDVDVSEWPG;AWSDVDVSEWPGI;WSDVDVSEWPGID;SDVDVSEWPGIDW;DVDVSEWPGIDWP;VDVSEWPGIDWPA;DVSEWPGIDWPAT;VSEWPGIDWPATQ;SEWPGIDWPATQS;EWPGIDWPATQSM;WPGIDWPATQSMA;PGIDWPATQSMAE;GIDWPATQSMAEQ;IDWPATQSMAEQV;DWPATQSMAEQVL;WPATQSMAEQVLA;PATQSMAEQVLAE;ATQSMAEQVLAER;TQSMAEQVLAERL;QSMAEQVLAERLA;SMAEQVLAERLAG;MAEQVLAERLAGW;AEQVLAERLAGWQ;EQVLAERLAGWQE;QVLAERLAGWQER;VLAERLAGWQERY;LAERLAGWQERYP;AERLAGWQERYPN;ERLAGWQERYPNV;RLAGWQERYPNVA;LAGWQERYPNVAI;AGWQERYPNVAIT;GWQERYPNVAITR;WQERYPNVAITRV;QERYPNVAITRVV;ERYPNVAITRVVV;RYPNVAITRVVVR;YPNVAITRVVVRD;PNVAITRVVVRDQ;NVAITRVVVRDQP;VAITRVVVRDQPA;AITRVVVRDQPAR;ITRVVVRDQPARQ;TRVVVRDQPARQL;RVVVRDQPARQLV;VVVRDQPARQLVQ;VVRDQPARQLVQR;VRDQPARQLVQRS;RDQPARQLVQRSE;DQPARQLVQRSEE;QPARQLVQRSEEA;PARQLVQRSEEAQ;ARQLVQRSEEAQL;RQLVQRSEEAQLV;QLVQRSEEAQLVV;LVQRSEEAQLVVV;VQRSEEAQLVVVG;QRSEEAQLVVVGS;RSEEAQLVVVGSR;SEEAQLVVVGSRG;EEAQLVVVGSRGR;EAQLVVVGSRGRG;AQLVVVGSRGRGG;QLVVVGSRGRGGY;LVVVGSRGRGGYA;VVVGSRGRGGYAG;VVGSRGRGGYAGM;VGSRGRGGYAGML;GSRGRGGYAGMLV;SRGRGGYAGMLVG;RGRGGYAGMLVGS;GRGGYAGMLVGSV;RGGYAGMLVGSVG;GGYAGMLVGSVGE;GYAGMLVGSVGET;YAGMLVGSVGETV;AGMLVGSVGETVA;GMLVGSVGETVAQ;MLVGSVGETVAQL;LVGSVGETVAQLA;VGSVGETVAQLAR;GSVGETVAQLART;SVGETVAQLARTP;VGETVAQLARTPV;GETVAQLARTPVI;ETVAQLARTPVIV;TVA | |

Fig. 30 continued

| | | |
|---|---|---|
| | QLARTPVIVA;VAQLARTPVIVAR;AQLARTPVIVARE;QLARTPVIVARES;LARTPVIVARESL;ARTPVIVARESLT;<br>14 mers:<br>MSSGNSSLGIIVGI;SSGNSSLGIIVGID;SGNSSLGIIVGIDD;GNSSLGIIVGIDDS;NSSLGIIVGIDDSP;SSLGIIVGIDDSPA;SLGIIVGIDDSPAA;LGIIVGIDDSPAAQ;GIIVGIDDSPAAQV;IIVGIDDSPAAQVA;IVGIDDSPAAQVAV;VGIDDSPAAQVAVR;GIDDSPAAQVAVRW;IDDSPAAQVAVRWA;DDSPAAQVAVRWAA;DSPAAQVAVRWAAR;SPAAQVAVRWAARD;PAAQVAVRWAARDA;AAQVAVRWAARDAE;AQVAVRWAARDAEL;QVAVRWAARDAELR;VAVRWAARDAELRK;AVRWAARDAELRKI;VRWAARDAELRKIP;RWAARDAELRKIPL;WAARDAELRKIPLT;AARDAELRKIPLTL;ARDAELRKIPLTLV;RDAELRKIPLTLVH;DAELRKIPLTLVHA;AELRKIPLTLVHAV;ELRKIPLTLVHAVS;LRKIPLTLVHAVSP;RKIPLTLVHAVSPE;KIPLTLVHAVSPEV;IPLTLVHAVSPEVA;PLTLVHAVSPEVAT;LTLVHAVSPEVATW;TLVHAVSPEVATWL;LVHAVSPEVATWLE;VHAVSPEVATWLEV;HAVSPEVATWLEVP;AVSPEVATWLEVPL;VSPEVATWLEVPLP;SPEVATWLEVPLPP;PEVATWLEVPLPPG;EVATWLEVPLPPGV;VATWLEVPLPPGVL;ATWLEVPLPPGVLR;TWLEVPLPPGVLRW;WLEVPLPPGVLRWQ;LEVPLPPGVLRWQQ;EVPLPPGVLRWQQD;VPLPPGVLRWQQDH;PLPPGVLRWQQDHG;LPPGVLRWQQDHGR;PPGVLRWQQDHGRH;PGVLRWQQDHGRHL;GVLRWQQDHGRHLI;VLRWQQDHGRHLID;LRWQQDHGRHLIDD;RWQQDHGRHLIDDA;WQQDHGRHLIDDAL;QQDHGRHLIDDALK;QDHGRHLIDDALKV;DHGRHLIDDALKVV;HGRHLIDDALKVVE;GRHLIDDALKVVEQ;RHLIDDALKVVEQA;HLIDDALKVVEQAS;LIDDALKVVEQASL;IDDALKVVEQASLR;DDALKVVEQASLRA;DALKVVEQASLRAG;ALKVVEQASLRAGP;LKVVEQASLRAGPP;KVVEQASLRAGPPT;VVEQASLRAGPPTV;VEQASLRAGPPTVH;EQASLRAGPPTVHS;QASLRAGPPTVHSE;ASLRAGPPTVHSEI;SLRAGPPTVHSEIV;LRAGPPTVHSEIVP;RAGPPTVHSEIVPA;AGPPTVHSEIVPAA;GPPTVHSEIVPAAA;PPTVHSEIVPAAAV;PTVHSEIVPAAAVP;TVHSEIVPAAAVPT;VHSEIVPAAAVPTL;HSEIVPAAAVPTLV;SEIVPAAAVPTLVD;EIVPAAAVPTLVDM;IVPAAAVPTLVDMS;VPAAAVPTLVDMSK;PAAAVPTLVDMSKD;AAAVPTLVDMSKDA;AAVPTLVDMSKDAV;AVPTLVDMSKDAVL;VPTLVDMSKDAVLM;PTLVDMSKDAVLMV;TLVDMSKDAVLMVV;LVDMSKDAVLMVVG;VDMSKDAVLMVVGC;DMSKDAVLMVVGCL;MSKDAVLMVVGCLG;SKDAVLMVVGCLGS;KDAVLMVVGCLGSG;DAVLMVVGCLGSGR;AVLMVVGCLGSGRW;VLMVVGCLGSGRWP;LMVVGCLGSGRWPG;MVVGCLGSGRWPGR;VVGCLGSGRWPGRL;VGCLGSGRWPGRLL;GCLGSGRWPGRLLG;CLGSGRWPGRLLGS;LGSGRWPGRLLGSV;GSGRWPGRLLGSVS;SGRWPGRLLGSVSS;GRWPGRLLGSVSSG;RWPGRLLGSVSSGL;WPGRLLGSVSSGLL;PGRLLGSVSSGLLR;GRLLGSVSSGLLRH;RLLGSVSSGLLRHA;LLGSVSSGLLRHAH;LGSVSSGLLRHAHC;GSVSSGLLRHAHCP;SVSSGLLRHAHCPV;VSSGLLRHAHCPVV;SSGLLRHAHCPVVI;SGLLRHAHCPVVII;GLLRHAHCPVVIIH;LLRHAHCPVVIIHD;LRHAHCPVVIIHDE;RHAHCPVVIIHDED;HAHCPVVIIHDEDS;AHCPVVIIHDEDSV;HCPVVIIHDEDSVM;CPVVIIHDEDSVMP;PVVIIHDEDSVMPH;VVIIHDEDSVMPHP;VIIHDEDSVMPHPQ;IIHDEDSVMPHPQQ;IHDEDSVMPHPQQA;HDEDSVMPHPQQAP;DEDSVMPHPQQAPV;EDSVMPHPQQAPVL;DSVMPHPQQAPVLV;SVMPHPQQAPVLVG;VMPHPQQAPVLVGV;MPHPQQAPVLVGVD;PHPQQAPVLVGVDG;HPQQAPVLVGVDGS;PQQAPVLVGVDGSS;QQAPVLVGVDGSSA;QAPVLVGVDGSSAS;APVLVGVDGSSASE;PVLVGVDGSSASEL;VLVGVDGSSASELA;LVGVDGSSASELAT;VGVDGSSASELATA;GVDGSSASELATAI;VDGSSASELATAIA;DGSSASELATAIAF;GSSASELATAIAFD;SSASELATAIAFDE;SASELATAIAFDEA;ASELATAIAFDEAS;SELATAIAFDEASR;ELATAIAFDEASRR;LATAIAFDEASRRN;ATAIAFDEASRRNV;TAIAFDEAS | |

Fig. 30 continued

| | | |
|---|---|---|
| | RRNVD;AIAFDEASRRNVDL;IAFDEASRRNVDLV;AFDEASRRNVDLVA;FD<br>EASRRNVDLVAL;DEASRRNVDLVALH;EASRRNVDLVALHA;ASRRNVDLV<br>ALHAW;SRRNVDLVALHAWS;RRNVDLVALHAWSD;RNVDLVALHAWSDV;<br>NVDLVALHAWSDVD;VDLVALHAWSDVDV;DLVALHAWSDVDVS;LVALHA<br>WSDVDVSE;VALHAWSDVDVSEW;ALHAWSDVDVSEWP;LHAWSDVDVS<br>EWPG;HAWSDVDVSEWPGI;AWSDVDVSEWPGID;WSDVDVSEWPGIDW;<br>SDVDVSEWPGIDWP;DVDVSEWPGIDWPA;VDVSEWPGIDWPAT;DVSEW<br>PGIDWPATQ;VSEWPGIDWPATQS;SEWPGIDWPATQSM;EWPGIDWPAT<br>QSMA;WPGIDWPATQSMAE;PGIDWPATQSMAEQ;GIDWPATQSMAEQV;I<br>DWPATQSMAEQVL;DWPATQSMAEQVLA;WPATQSMAEQVLAE;PATQSM<br>AEQVLAER;ATQSMAEQVLAERL;TQSMAEQVLAERLA;QSMAEQVLAERL<br>AG;SMAEQVLAERLAGW;MAEQVLAERLAGWQ;AEQVLAERLAGWQE;EQ<br>VLAERLAGWQER;QVLAERLAGWQERY;VLAERLAGWQERYP;LAERLAG<br>WQERYPN;AERLAGWQERYPNV;ERLAGWQERYPNVA;RLAGWQERYPN<br>VAI;LAGWQERYPNVAIT;AGWQERYPNVAITR;GWQERYPNVAITRV;WQE<br>RYPNVAITRVV;QERYPNVAITRVVV;ERYPNVAITRVVVR;RYPNVAITRVVV<br>RD;YPNVAITRVVVRDQ;PNVAITRVVVRDQP;NVAITRVVVRDQPA;VAITRV<br>VVRDQPAR;AITRVVVRDQPARQ;ITRVVVRDQPARQL;TRVVVRDQPARQL<br>V;RVVVRDQPARQLVQ;VVVRDQPARQLVQR;VVRDQPARQLVQRS;VRDQ<br>PARQLVQRSE;RDQPARQLVQRSEE;DQPARQLVQRSEEA;QPARQLVQR<br>SEEAQ;PARQLVQRSEEAQL;ARQLVQRSEEAQLV;RQLVQRSEEAQLVV;Q<br>LVQRSEEAQLVVV;LVQRSEEAQLVVVG;VQRSEEAQLVVVGS;QRSEEAQ<br>LVVVGSR;RSEEAQLVVVGSRG;SEEAQLVVVGSRGR;EEAQLVVVGSRGR<br>G;EAQLVVVGSRGRGG;AQLVVVGSRGRGGY;QLVVVGSRGRGGYA;LVV<br>VGSRGRGGYAG;VVVGSRGRGGYAGM;VVGSRGRGGYAGML;VGSRGR<br>GGYAGMLV;GSRGRGGYAGMLVG;SRGRGGYAGMLVGS;RGRGGYAGM<br>LVGSV;GRGGYAGMLVGSVG;RGGYAGMLVGSVGE;GGYAGMLVGSVGE<br>T;GYAGMLVGSVGETV;YAGMLVGSVGETVA;AGMLVGSVGETVAQ;GMLV<br>GSVGETVAQL;MLVGSVGETVAQLA;LVGSVGETVAQLAR;VGSVGETVAQ<br>LART;GSVGETVAQLARTP;SVGETVAQLARTPV;VGETVAQLARTPVI;GET<br>VAQLARTPVIV;ETVAQLARTPVIVA;TVAQLARTPVIVAR;VAQLARTPVIVAR<br>E;AQLARTPVIVARES;QLARTPVIVARESL;LARTPVIVARESLT;<br>15 mers:<br>MSSGNSSLGIIVGID;SSGNSSLGIIVGIDD;SGNSSLGIIVGIDDS;GNSSLGIIV<br>GIDDSP;NSSLGIIVGIDDSPA;SSLGIIVGIDDSPAA;SLGIIVGIDDSPAAQ;LGI<br>IVGIDDSPAAQV;GIIVGIDDSPAAQVA;IIVGIDDSPAAQVAV;IVGIDDSPAAQ<br>VAVR;VGIDDSPAAQVAVRW;GIDDSPAAQVAVRWA;IDDSPAAQVAVRWA<br>A;DDSPAAQVAVRWAAR;DSPAAQVAVRWAARD;SPAAQVAVRWAARDA;<br>PAAQVAVRWAARDAE;AAQVAVRWAARDAEL;AQVAVRWAARDAELR;QV<br>AVRWAARDAELRK;VAVRWAARDAELRKI;AVRWAARDAELRKIP;VRWAA<br>RDAELRKIPL;RWAARDAELRKIPLT;WAARDAELRKIPLTL;AARDAELRKIP<br>LTLV;ARDAELRKIPLTLVH;RDAELRKIPLTLVHA;DAELRKIPLTLVHAV;AEL<br>RKIPLTLVHAVS;ELRKIPLTLVHAVSP;LRKIPLTLVHAVSPE;RKIPLTLVHAV<br>SPEV;KIPLTLVHAVSPEVA;IPLTLVHAVSPEVAT;PLTLVHAVSPEVATW;LT<br>LVHAVSPEVATWL;TLVHAVSPEVATWLE;LVHAVSPEVATWLEV;VHAVSP<br>EVATWLEVP;HAVSPEVATWLEVPL;AVSPEVATWLEVPLP;VSPEVATWLE<br>VPLPP;SPEVATWLEVPLPPG;PEVATWLEVPLPPGV;EVATWLEVPLPPGV<br>L;VATWLEVPLPPGVLR;ATWLEVPLPPGVLRW;TWLEVPLPPGVLRWQ;WL<br>EVPLPPGVLRWQQ;LEVPLPPGVLRWQQD;EVPLPPGVLRWQQDH;VPLP<br>PGVLRWQQDHG;PLPPGVLRWQQDHGR;LPPGVLRWQQDHGRH;PPGVL<br>RWQQDHGRHL;PGVLRWQQDHGRHLI;GVLRWQQDHGRHLID;VLRWQQ<br>DHGRHLIDD;LRWQQDHGRHLIDDA;RWQQDHGRHLIDDAL;WQQDHGRH<br>LIDDALK;QQDHGRHLIDDALKV;QDHGRHLIDDALKVV;DHGRHLIDDALKV | |

Fig. 30 continued

| | | |
|---|---|---|
| | VE;HGRHLIDDALKVVEQ;GRHLIDDALKVVEQA;RHLIDDALKVVEQAS;HLIDDALKVVEQASL;LIDDALKVVEQASLR;IDDALKVVEQASLRA;DDALKVVEQASLRAG;DALKVVEQASLRAGP;ALKVVEQASLRAGPP;LKVVEQASLRAGPPT;KVVEQASLRAGPPTV;VVEQASLRAGPPTVH;VEQASLRAGPPTVHS;EQASLRAGPPTVHSE;QASLRAGPPTVHSEI;ASLRAGPPTVHSEIV;SLRAGPPTVHSEIVP;LRAGPPTVHSEIVPA;RAGPPTVHSEIVPAA;AGPPTVHSEIVPAAA;GPPTVHSEIVPAAAV;PPTVHSEIVPAAAVP;PTVHSEIVPAAAVPT;TVHSEIVPAAAVPTL;VHSEIVPAAAVPTLV;HSEIVPAAAVPTLVD;SEIVPAAAVPTLVDM;EIVPAAAVPTLVDMS;IVPAAAVPTLVDMSK;VPAAAVPTLVDMSKD;PAAAVPTLVDMSKDA;AAAVPTLVDMSKDAV;AAVPTLVDMSKDAVL;AVPTLVDMSKDAVLM;VPTLVDMSKDAVLMV;PTLVDMSKDAVLMVV;TLVDMSKDAVLMVVG;LVDMSKDAVLMVVGC;VDMSKDAVLMVVGCL;DMSKDAVLMVVGCLG;MSKDAVLMVVGCLGS;SKDAVLMVVGCLGSG;KDAVLMVVGCLGSGR;DAVLMVVGCLGSGRW;AVLMVVGCLGSGRWP;VLMVVGCLGSGRWPG;LMVVGCLGSGRWPGR;MVVGCLGSGRWPGRL;VVGCLGSGRWPGRLL;VGCLGSGRWPGRLLG;GCLGSGRWPGRLLGS;CLGSGRWPGRLLGSV;LGSGRWPGRLLGSVS;GSGRWPGRLLGSVSS;SGRWPGRLLGSVSSG;GRWPGRLLGSVSSGL;RWPGRLLGSVSSGLL;WPGRLLGSVSSGLLR;PGRLLGSVSSGLLRH;GRLLGSVSSGLLRHA;RLLGSVSSGLLRHAH;LLGSVSSGLLRHAHC;LGSVSSGLLRHAHCP;GSVSSGLLRHAHCPV;SVSSGLLRHAHCPVV;VSSGLLRHAHCPVVI;SSGLLRHAHCPVVII;SGLLRHAHCPVVIIH;GLLRHAHCPVVIIHD;LLRHAHCPVVIIHDE;LRHAHCPVVIIHDED;RHAHCPVVIIHDEDS;HAHCPVVIIHDEDSV;AHCPVVIIHDEDSVM;HCPVVIIHDEDSVMP;CPVVIIHDEDSVMPH;PVVIIHDEDSVMPHP;VVIIHDEDSVMPHPQ;VIIHDEDSVMPHPQQ;IIHDEDSVMPHPQQA;IHDEDSVMPHPQQAP;HDEDSVMPHPQQAPV;DEDSVMPHPQQAPVL;EDSVMPHPQQAPVLV;DSVMPHPQQAPVLVG;SVMPHPQQAPVLVGV;VMPHPQQAPVLVGVD;MPHPQQAPVLVGVDG;PHPQQAPVLVGVDGS;HPQQAPVLVGVDGSS;PQQAPVLVGVDGSSA;QQAPVLVGVDGSSAS;QAPVLVGVDGSSASE;APVLVGVDGSSASEL;PVLVGVDGSSASELA;VLVGVDGSSASELAT;LVGVDGSSASELATA;VGVDGSSASELATAI;GVDGSSASELATAIA;VDGSSASELATAIAF;DGSSASELATAIAFD;GSSASELATAIAFDE;SSASELATAIAFDEA;SASELATAIAFDEAS;ASELATAIAFDEASR;SELATAIAFDEASRR;ELATAIAFDEASRRN;LATAIAFDEASRRNV;ATAIAFDEASRRNVD;TAIAFDEASRRNVDL;AIAFDEASRRNVDLV;IAFDEASRRNVDLVA;AFDEASRRNVDLVAL;FDEASRRNVDLVALH;DEASRRNVDLVALHA;EASRRNVDLVALHAW;ASRRNVDLVALHAWS;SRRNVDLVALHAWSD;RRNVDLVALHAWSDV;RNVDLVALHAWSDVD;NVDLVALHAWSDVDV;VDLVALHAWSDVDVS;DLVALHAWSDVDVSE;LVALHAWSDVDVSEW;VALHAWSDVDVSEWP;ALHAWSDVDVSEWPG;LHAWSDVDVSEWPGI;HAWSDVDVSEWPGID;AWSDVDVSEWPGIDW;WSDVDVSEWPGIDWP;SDVDVSEWPGIDWPA;DVDVSEWPGIDWPAT;VDVSEWPGIDWPATQ;DVSEWPGIDWPATQS;VSEWPGIDWPATQSM;SEWPGIDWPATQSMA;EWPGIDWPATQSMAE;WPGIDWPATQSMAEQ;PGIDWPATQSMAEQV;GIDWPATQSMAEQVL;IDWPATQSMAEQVLA;DWPATQSMAEQVLAE;WPATQSMAEQVLAER;PATQSMAEQVLAERL;ATQSMAEQVLAERLA;TQSMAEQVLAERLAG;QSMAEQVLAERLAGW;SMAEQVLAERLAGWQ;MAEQVLAERLAGWQE;AEQVLAERLAGWQER;EQVLAERLAGWQERY;QVLAERLAGWQERYP;VLAERLAGWQERYPN;LAERLAGWQERYPNV;AERLAGWQERYPNVA;ERLAGWQERYPNVAI;RLAGWQERYPNVAIT;LAGWQERYPNVAITR;AGWQERYPNVAITRV;GWQERYPNVAITRVV;WQERYPNVAITRVVV;QERYPNVAITRVVVR;ERYPNVAITRVVVRD;RYPNVAITRVVVRDQ;YPNVAITRVVVRDQP;PNVAITRVVVRDQPA;NVAITRVVVRDQPAR;VAITRVVVRDQPARQ;AITRVVVRDQPARQL;ITRVVVRDQPARQLV;TRVVVRDQPARQLVQ;RVVVRDQPA | |

Fig. 30 continued

| | | |
|---|---|---|
| | RQLVQR;VVVRDQPARQLVQRS;VVRDQPARQLVQRSE;VRDQPARQLVQRSEE;RDQPARQLVQRSEEA;DQPARQLVQRSEEAQ;QPARQLVQRSEEAQL;PARQLVQRSEEAQLV;ARQLVQRSEEAQLVV;RQLVQRSEEAQLVVV;QLVQRSEEAQLVVVG;LVQRSEEAQLVVVGS;VQRSEEAQLVVVGSR;QRSEEAQLVVVGSRG;RSEEAQLVVVGSRGR;SEEAQLVVVGSRGRG;EEAQLVVVGSRGRGG;EAQLVVVGSRGRGGY;AQLVVVGSRGRGGYA;QLVVVGSRGRGGYAG;LVVVGSRGRGGYAGM;VVVGSRGRGGYAGML;VVGSRGRGGYAGMLV;VGSRGRGGYAGMLVG;GSRGRGGYAGMLVGS;SRGRGGYAGMLVGSV;RGRGGYAGMLVGSVG;GRGGYAGMLVGSVGE;RGGYAGMLVGSVGET;GGYAGMLVGSVGETV;GYAGMLVGSVGETVA;YAGMLVGSVGETVAQ;AGMLVGSVGETVAQL;GMLVGSVGETVAQLA;MLVGSVGETVAQLAR;LVGSVGETVAQLART;VGSVGETVAQLARTP;GSVGETVAQLARTPV;SVGETVAQLARTPVI;VGETVAQLARTPVIV;GETVAQLARTPVIVA;ETVAQLARTPVIVAR;TVAQLARTPVIVARE;VAQLARTPVIVARES;AQLARTPVIVARESL;QLARTPVIVARESLT;<br>16 mers:<br>MSSGNSSLGIIVGIDD;SSGNSSLGIIVGIDDS;SGNSSLGIIVGIDDSP;GNSSLGIIVGIDDSPA;NSSLGIIVGIDDSPAA;SSLGIIVGIDDSPAAQ;SLGIIVGIDDSPAAQV;LGIIVGIDDSPAAQVA;GIIVGIDDSPAAQVAV;IIVGIDDSPAAQVAVR;IVGIDDSPAAQVAVRW;VGIDDSPAAQVAVRWA;GIDDSPAAQVAVRWAA;IDDSPAAQVAVRWAAR;DDSPAAQVAVRWAARD;DSPAAQVAVRWAARDA;SPAAQVAVRWAARDAE;PAAQVAVRWAARDAEL;AAQVAVRWAARDAELR;AQVAVRWAARDAELRK;QVAVRWAARDAELRKI;VAVRWAARDAELRKIP;AVRWAARDAELRKIPL;VRWAARDAELRKIPLT;RWAARDAELRKIPLTL;WAARDAELRKIPLTLV;AARDAELRKIPLTLVH;ARDAELRKIPLTLVHA;RDAELRKIPLTLVHAV;DAELRKIPLTLVHAVS;AELRKIPLTLVHAVSP;ELRKIPLTLVHAVSPE;LRKIPLTLVHAVSPEV;RKIPLTLVHAVSPEVA;KIPLTLVHAVSPEVAT;IPLTLVHAVSPEVATW;PLTLVHAVSPEVATWL;LTLVHAVSPEVATWLE;TLVHAVSPEVATWLEV;LVHAVSPEVATWLEVP;VHAVSPEVATWLEVPL;HAVSPEVATWLEVPLP;AVSPEVATWLEVPLPP;VSPEVATWLEVPLPPG;SPEVATWLEVPLPPGV;PEVATWLEVPLPPGVL;EVATWLEVPLPPGVLR;VATWLEVPLPPGVLRW;ATWLEVPLPPGVLRWQ;TWLEVPLPPGVLRWQQ;WLEVPLPPGVLRWQQD;LEVPLPPGVLRWQQDH;EVPLPPGVLRWQQDHG;VPLPPGVLRWQQDHGR;PLPPGVLRWQQDHGRH;LPPGVLRWQQDHGRHL;PPGVLRWQQDHGRHLI;PGVLRWQQDHGRHLID;GVLRWQQDHGRHLIDD;VLRWQQDHGRHLIDDA;LRWQQDHGRHLIDDAL;RWQQDHGRHLIDDALK;WQQDHGRHLIDDALKV;QQDHGRHLIDDALKVV;QDHGRHLIDDALKVVE;DHGRHLIDDALKVVEQ;HGRHLIDDALKVVEQA;GRHLIDDALKVVEQAS;RHLIDDALKVVEQASL;HLIDDALKVVEQASLR;LIDDALKVVEQASLRA;IDDALKVVEQASLRAG;DDALKVVEQASLRAGP;DALKVVEQASLRAGPP;ALKVVEQASLRAGPPT;LKVVEQASLRAGPPTV;KVVEQASLRAGPPTVH;VVEQASLRAGPPTVHS;VEQASLRAGPPTVHSE;EQASLRAGPPTVHSEI;QASLRAGPPTVHSEIV;ASLRAGPPTVHSEIVP;SLRAGPPTVHSEIVPA;LRAGPPTVHSEIVPAA;RAGPPTVHSEIVPAAA;AGPPTVHSEIVPAAAV;GPPTVHSEIVPAAAVP;PPTVHSEIVPAAAVPT;PTVHSEIVPAAAVPTL;TVHSEIVPAAAVPTLV;VHSEIVPAAAVPTLVD;HSEIVPAAAVPTLVDM;SEIVPAAAVPTLVDMS;EIVPAAAVPTLVDMSK;IVPAAAVPTLVDMSKD;VPAAAVPTLVDMSKDA;PAAAVPTLVDMSKDAV;AAAVPTLVDMSKDAVL;AAVPTLVDMSKDAVLM;AVPTLVDMSKDAVLMV;VPTLVDMSKDAVLMVV;PTLVDMSKDAVLMVVG;TLVDMSKDAVLMVVGC;LVDMSKDAVLMVVGCL;VDMSKDAVLMVVGCLG;DMSKDAVLMVVGCLGS;MSKDAVLMVVGCLGSG;SKDAVLMVVGCLGSGR;KDAVLMVVGCLGSGRW;DAVLMVVGCLGSGRWP;AVLMVVGCLGSGRWPG;VLMVVGCLGSGRWPGR;LMVVGCLGSGRWPGRL;MVVGCLGSGRWPGR | |

Fig. 30 continued

| | | |
|---|---|---|
| | LL;VVGCLGSGRWPGRLLG;VGCLGSGRWPGRLLGS;GCLGSGRWPGRLLGSV;CLGSGRWPGRLLGSVS;LGSGRWPGRLLGSVSS;GSGRWPGRLLGSVSSG;SGRWPGRLLGSVSSGL;GRWPGRLLGSVSSGLL;RWPGRLLGSVSSGLLR;WPGRLLGSVSSGLLRH;PGRLLGSVSSGLLRHA;GRLLGSVSSGLLRHAH;RLLGSVSSGLLRHAHC;LLGSVSSGLLRHAHCP;LGSVSSGLLRHAHCPV;GSVSSGLLRHAHCPVV;SVSSGLLRHAHCPVVI;VSSGLLRHAHCPVVII;SSGLLRHAHCPVVIIH;SGLLRHAHCPVVIIHD;GLLRHAHCPVVIIHDE;LLRHAHCPVVIIHDED;LRHAHCPVVIIHDEDS;RHAHCPVVIIHDEDSV;HAHCPVVIIHDEDSVM;AHCPVVIIHDEDSVMP;HCPVVIIHDEDSVMPH;CPVVIIHDEDSVMPHP;PVVIIHDEDSVMPHPQ;VVIIHDEDSVMPHPQQ;VIIHDEDSVMPHPQQA;IIHDEDSVMPHPQQAP;IHDEDSVMPHPQQAPV;HDEDSVMPHPQQAPVL;DEDSVMPHPQQAPVLV;EDSVMPHPQQAPVLVG;DSVMPHPQQAPVLVGV;SVMPHPQQAPVLVGVD;VMPHPQQAPVLVGVDG;MPHPQQAPVLVGVDGS;PHPQQAPVLVGVDGSS;HPQQAPVLVGVDGSSA;PQQAPVLVGVDGSSAS;QQAPVLVGVDGSSASE;QAPVLVGVDGSSASEL;APVLVGVDGSSASELA;PVLVGVDGSSASELAT;VLVGVDGSSASELATA;LVGVDGSSASELATAI;VGVDGSSASELATAIA;GVDGSSASELATAIAF;VDGSSASELATAIAFD;DGSSASELATAIAFDE;GSSASELATAIAFDEA;SSASELATAIAFDEAS;SASELATAIAFDEASR;ASELATAIAFDEASRR;SELATAIAFDEASRRN;ELATAIAFDEASRRNV;LATAIAFDEASRRNVD;ATAIAFDEASRRNVDL;TAIAFDEASRRNVDLV;AIAFDEASRRNVDLVA;IAFDEASRRNVDLVAL;AFDEASRRNVDLVALH;FDEASRRNVDLVALHA;DEASRRNVDLVALHAW;EASRRNVDLVALHAWS;ASRRNVDLVALHAWSD;SRRNVDLVALHAWSDV;RRNVDLVALHAWSDVD;RNVDLVALHAWSDVDV;NVDLVALHAWSDVDVS;VDLVALHAWSDVDVSE;DLVALHAWSDVDVSEW;LVALHAWSDVDVSEWP;VALHAWSDVDVSEWPG;ALHAWSDVDVSEWPGI;LHAWSDVDVSEWPGID;HAWSDVDVSEWPGIDW;AWSDVDVSEWPGIDWP;WSDVDVSEWPGIDWPA;SDVDVSEWPGIDWPAT;DVDVSEWPGIDWPATQ;VDVSEWPGIDWPATQS;DVSEWPGIDWPATQSM;VSEWPGIDWPATQSMA;SEWPGIDWPATQSMAE;EWPGIDWPATQSMAEQ;WPGIDWPATQSMAEQV;PGIDWPATQSMAEQVL;GIDWPATQSMAEQVLA;IDWPATQSMAEQVLAE;DWPATQSMAEQVLAER;WPATQSMAEQVLAERL;PATQSMAEQVLAERLA;ATQSMAEQVLAERLAG;TQSMAEQVLAERLAGW;QSMAEQVLAERLAGWQ;SMAEQVLAERLAGWQE;MAEQVLAERLAGWQER;AEQVLAERLAGWQERY;EQVLAERLAGWQERYP;QVLAERLAGWQERYPN;VLAERLAGWQERYPNV;LAERLAGWQERYPNVA;AERLAGWQERYPNVAI;ERLAGWQERYPNVAIT;RLAGWQERYPNVAITR;LAGWQERYPNVAITRV;AGWQERYPNVAITRVV;GWQERYPNVAITRVVV;WQERYPNVAITRVVVR;QERYPNVAITRVVVRD;ERYPNVAITRVVVRDQ;RYPNVAITRVVVRDQP;YPNVAITRVVVRDQPA;PNVAITRVVVRDQPAR;NVAITRVVVRDQPARQ;VAITRVVVRDQPARQL;AITRVVVRDQPARQLV;ITRVVVRDQPARQLVQ;TRVVVRDQPARQLVQR;RVVVRDQPARQLVQRS;VVVRDQPARQLVQRSE;VVRDQPARQLVQRSEE;VRDQPARQLVQRSEEA;RDQPARQLVQRSEEAQ;DQPARQLVQRSEEAQL;QPARQLVQRSEEAQLV;PARQLVQRSEEAQLVV;ARQLVQRSEEAQLVVV;RQLVQRSEEAQLVVVG;QLVQRSEEAQLVVVGS;LVQRSEEAQLVVVGSR;VQRSEEAQLVVVGSRG;QRSEEAQLVVVGSRGR;RSEEAQLVVVGSRGRG;SEEAQLVVVGSRGRGG;EEAQLVVVGSRGRGGY;EAQLVVVGSRGRGGYA;AQLVVVGSRGRGGYAG;QLVVVGSRGRGGYAGM;LVVVGSRGRGGYAGML;VVVGSRGRGGYAGMLV;VVGSRGRGGYAGMLVG;VGSRGRGGYAGMLVGS;GSRGRGGYAGMLVGSV;SRGRGGYAGMLVGSVG;RGRGGYAGMLVGSVGE;GRGGYAGMLVGSVGET;RGGYAGMLVGSVGETV;GGYAGMLVGSVGETVA;GYAGMLVGSVGETVAQ;YAGMLVGSVGETVAQL;AGMLVGSVGETVAQLA;GMLVGSVGETVAQLAR;MLVGSVGETVAQLART;LVGSVGETVAQLARTP;VGSVGETVA | |

Fig. 30 continued

| | | |
|---|---|---|
| | QLARTPV;GSVGETVAQLARTPVI;SVGETVAQLARTPVIV;VGETVAQLART PVIVA;GETVAQLARTPVIVAR;ETVAQLARTPVIVARE;TVAQLARTPVIVAR ES;VAQLARTPVIVARESL;AQLARTPVIVARESLT | |
| 4 | **<NP_215525.1 resuscitation-promoting factor rpfB Rv1009;Mycobacterium tuberculosis H37Rv>** MLRLVVGALLLVLAFAGGYAVAACKTVTLTVDGTAMRVTTMKSRVIDIVEE NGFSVDDRDDLYPAAGVQVHDADTIVLRRSRPLQISLDGHDAKQVWTTAS TVDEALAQLAMTDTAPAAASRASRVPLSGMALPVVSAKTVQLNDGGLVRT VHLPAPNVAGLLSAAGVPLLQSDHVVPAATAPIVEGMQIQVTRNRIKKVTE RLPLPPNARRVEDPEMNMSREVVEDPGVPGTQDVTFAVAEVNGVETGRL PVANVVVTPAHEAVVRVGTKPGTEVPPVIDGSIWDAIAGCEAGGNWAINTG NGYYGGVQFDQGTWEANGGLRYAPRADLATREEQIAVAEVTRLRQGWG AWPVCAARAGAR<br><br>8mer<br>MLRLVVGA;RLVVGALL;LVVGALLL;VVGALLLV;ALLLVLAF;LLLVLAFA;VLA FAGGY;LAFAGGYA;AFAGGYAV;FAGGYAVA;GYAVAACK;AVAACKTV;TL TVDGTA;LTVDGTAM;TVDGTAMR;TAMRVTTM;AMRVTTMK;RVTTMKSR; TTMKSRVI;DIVEENGF;VEENGFSV;NGFSVDDR;SVDDRDDL;DLYPAAGV; YPAAGVQV;HDADTIVL;DADTIVLR;TIVLRRSR;VLRRSRPL;RSRPLQIS;SL DGHDAK;KQVWTTAS;TASTVDEA;EALAQLAM;ALAQLAMT;AQLAMTDT;Q LAMTDTA;AMTDTAPA;MTDTAPAA;DTAPAAAS;TAPAAASR;APAAASRA;A AASRASR;AASRASRV;SRASRVPL;VPLSGMAL;SGMALPVV;MALPVVSA; ALPVVSAK;LPVVSAKT;PVVSAKTV;VQLNDGGL;QLNDGGLV;GLVRTVHL; HLPAPNVA;LPAPNVAG;APNVAGLL;NVAGLLSA;GLLSAAGV;LSAAGVPL; SAAGVPLL;PLLQSDHV;LLQSDHVV;HVVPAATA;VPAATAPI;PIVEGMQI;G MQIQVTR;QIQVTRNR;IQVTRNRI;QVTRNRIK;VTRNRIKK;RIKKVTER;KVT ERLPL;RLPLPPNA;LPLPPNAR;LPPNARRV;RRVEDPEM;DPEMNMSR;EM NMSREV;MNMSREVV;EVVEDPGV;GVPGTQDV;TQDVTFAV;VTFAVAEV; AVAEVNGV;AEVNGVET;ETGRLPVA;RLPVANVV;LPVANVVV;VVTPAHEA; VTPAHEAV;TPAHEAVV;AVVRVGTK;GTKPGTEV;PPVIDGSI;SIWDAIAG;E AGGNWAI;AINTGNGY;GYYGGVQF;VQFDQGTW;EANGGLRY;GGLRYAP R;GLRYAPRA;RYAPRADL;APRADLAT;EQIAVAEV;IAVAEVTR;AVAEVTRL; VAEVTRLR;AEVTRLRQ;VTRLRQGW;RLRQGWGA;QGWGAWPV;WGAWP VCA;GAWPVCAA;WPVCAARA;CAARAGAR<br>9mer<br>MLRLVVGAL;RLVVGALLL;LVVGALLLV;VVGALLLVL;GALLLVLAF;ALLLVL AFA;LVLAFAGGY;VLAFAGGYA;LAFAGGYAV;FAGGYAVAA;GGYAVAACK ;YAVAACKTV;VAACKTVTL;TLTVDGTAM;LTVDGTAMR;TVDGTAMRV;GT AMRVTTM;TAMRVTTMK;AMRVTTMKS;RVTTMKSRV;TMKSRVIDI;MKSRV IDIV;IVEENGFSV;SVDDRDDLY;LYPAAGVQV;YPAAGVQVH;VQVHDADTI; QVHDADTIV;VHDADTIVL;HDADTIVLR;DADTIVLRR;DTIVLRRSR;IVLRRS RPL;VLRRSRPLQ;RSRPLQISL;ISLDGHDAK;SLDGHDAKQ;KQVWTTAST; QVWTTASTV;TTASTVDEA;TASTVDEAL;TVDEALAQL;DEALAQLAM;EALA QLAMT;AQLAMTDTA;LAMTDTAPA;AMTDTAPAA;MTDTAPAAA;DTAPAAA SR;TAPAAASRA;APAAASRAS;PAAASRASR;AAASRASRV;ASRASRVPL; RVPLSGMAL;PLSGMALPV;GMALPVVSA;MALPVVSAK;ALPVVSAKT;LPV VSAKTV;VVSAKTVQL;TVQLNDGGL;VQLNDGGLV;QLNDGGLVR;LVRTVH LPA;TVHLPAPNV;LPAPNVAGL;NVAGLLSAA;LLSAAGVPL;VPLLQSDHV;P LLQSDHVV;LQSDHVVPA;VVPAATAPI;VPAATAPIV;ATAPIVEGM;APIVEG MQI;IVEGMQIQV;EGMQIQVTR;MQIQVTRNR;QVTRNRIKK;VTRNRIKKV;R IKKVTERL;RLPLPPNAR;PLPPNARRV;RVEDPEMNM;EMNMSREVV;REVV EDPGV;VPGTQDVTF;GTQDVTFAV;TQDVTFAVA;DVTFAVAEV;FAVAEVN | 120546-122154 |

Fig. 30 continued

| | | |
|---|---|---|
| | GV;EVNGVETGR;GVETGRLPV;RLPVANVVV;LPVANVVVT;VANVVVTPA;<br>VVTPAHEAV;VTPAHEAVV;TPAHEAVVR;PAHEAVVRV;EAVVRVGTK;EVP<br>PVIDGS;VPPVIDGSI;PPVIDGSIW;VIDGSIWDA;SIWDAIAGC;CEAGGNWAI<br>;WAINTGNGY;AINTGNGYY;TGNGYYGGV;VQFDQGTWE;QFDQGTWEA;<br>GTWEANGGL;WEANGGLRY;LRYAPRADL;YAPRADLAT;DLATREEQI;ATR<br>EEQIAV;EEQIAVAEV;QIAVAEVTR;AVAEVTRLR;RLRQGWGAW;RQGWG<br>AWPV;WGAWPVCAA;GAWPVCAAR;WPVCAARAG<br>10mer<br>MLRLVVGALL;RLVVGALLLV;LVVGALLLVL;VVGALLLVLA;LLLVLAFAGG;L<br>LVLAFAGGY;LVLAFAGGYA;VLAFAGGYAV;LAFAGGYAVA;FAGGYAVAAC<br>;YAVAACKTVT;AVAACKTVTL;AACKTVTLTV;VTLTVDGTAM;TLTVDGTAM<br>R;LTVDGTAMRV;GTAMRVTTMK;TAMRVTTMKS;AMRVTTMKSR;MRVTT<br>MKSRV;TTMKSRVIDI;TMKSRVIDIV;DIVEENGFSV;EENGFSVDDR;FSVDD<br>RDDLY;DLYPAAGVQV;VQVHDADTIV;QVHDADTIVL;HDADTIVLRR;VLRR<br>SRPLQI;RRSRPLQISL;QISLDGHDAK;SLDGHDAKQV;KQVWTTASTV;WTT<br>ASTVDEA;TTASTVDEAL;TASTVDEALA;STVDEALAQL;TVDEALAQLA;ALA<br>QLAMTDT;AQLAMTDTAP;QLAMTDTAPA;LAMTDTAPAA;AMTDTAPAAA;T<br>DTAPAAASR;DTAPAAASRA;APAAASRASR;AASRASRVPL;ASRASRVPLS<br>;RASRVPLSGM;VPLSGMALPV;PLSGMALPVV;SGMALPVVSA;GMALPVV<br>SAK;ALPVVSAKTV;LPVVSAKTVQ;TVQLNDGGLV;QLNDGGLVRT;LNDGG<br>LVRTV;GLVRTVHLPA;RTVHLPAPNV;HLPAPNVAGL;LPAPNVAGLL;APNV<br>AGLLSA;GLLSAAGVPL;LLSAAGVPLL;GVPLLQSDHV;VPLLQSDHVV;LLQ<br>SDHVVPA;LQSDHVVPAA;HVVPAATAPI;VVPAATAPIV;PIVEGMQIQV;GM<br>QIQVTRNR;MQIQVTRNRI;QIQVTRNRIK;IQVTRNRIKK;QVTRNRIKKV;RN<br>RIKKVTER;RLPLPPNARR;LPLPPNARRV;NARRVEDPEM;RRVEDPEMNM;<br>GVPGTQDVTF;VPGTQDVTFA;EVNGVETGRL;ETGRLPVANV;LPVANVVV<br>TP;VANVVVTPAH;NVVVTPAHEA;VVVTPAHEAV;VVTPAHEAVV;VTPAHE<br>AVVR;TPAHEAVVRV;RVGTKPGTEV;EVPPVIDGSI;VPPVIDGSIW;PVIDGS<br>IWDA;VIDGSIWDAI;IAGCEAGGNW;WAINTGNGYY;NTGNGYYGGV;GGVQ<br>FDQGTW;VQFDQGTWEA;GTWEANGGLR;TWEANGGLRY;ANGGLRYAP<br>R;GLRYAPRADL;YAPRADLATR;LATREEQIAV;REEQIAVAEV;EQIAVAEVT<br>R;QIAVAEVTRL;IAVAEVTRLR;AEVTRLRQGW;LRQGWGAWPV;RQGWGA<br>WPVC;WGAWPVCAAR;WPVCAARAGA<br>11mer<br>MLRLVVGALLL;RLVVGALLLVL;LVVGALLLVLA;VVGALLLVLAF;LLLVLAFA<br>GGY;LLVLAFAGGYA;LVLAFAGGYAV;VLAFAGGYAVA;LAFAGGYAVAA;F<br>AGGYAVAACK;YAVAACKTVTL;VAACKTVTLTV;TVTLTVDGTAM;VTLTVD<br>GTAMR;TLTVDGTAMRV;TVDGTAMRVTT;DGTAMRVTTMK;TAMRVTTMK<br>SR;AMRVTTMKSRV;TTMKSRVIDIV;RVIDIVEENGF;SVDDRDDLYPA;YPA<br>AGVQVHDA;GVQVHDADTIV;VQVHDADTIVL;QVHDADTIVLR;DADTIVLRR<br>SR;DTIVLRRSRPL;LQISLDGHDAK;ISLDGHDAKQV;SLDGHDAKQVW;WT<br>TASTVDEAL;TTASTVDEALA;STVDEALAQLA;TVDEALAQLAM;ALAQLAMT<br>DTA;AQLAMTDTAPA;QLAMTDTAPAA;LAMTDTAPAAA;AMTDTAPAAAS;M<br>TDTAPAAASR;TAPAAASRASR;APAAASRASRV;AAASRASRVPL;ASRVPL<br>SGMAL;RVPLSGMALPV;VPLSGMALPVV;SGMALPVVSAK;MALPVVSAKT<br>V;LPVVSAKTVQL;KTVQLNDGGLV;TVQLNDGGLVR;VQLNDGGLVRT;QLN<br>DGGLVRTV;HLPAPNVAGLL;LPAPNVAGLLS;APNVAGLLSAA;NVAGLLSA<br>AGV;GLLSAAGVPLL;LLSAAGVPLLQ;GVPLLQSDHVV;PLLQSDHVVPA;LL<br>QSDHVVPAA;LQSDHVVPAAT;HVVPAATAPIV;ATAPIVEGMQI;APIVEGMQ<br>IQV;IVEGMQIQVTR;EGMQIQVTRNR;GMQIQVTRNRI;MQIQVTRNRIK;QIQ<br>VTRNRIKK;IQVTRNRIKKV;RIKKVTERLPL;RLPLPPNARRV;RVEDPEMNM<br>SR;MSREVVEDPGV;EVVEDPGVPGT;GVPGTQDVTFA;VPGTQDVTFAV;T<br>QDVTFAVAEV;VTFAVAEVNGV;FAVAEVNGVET;AEVNGVETGRL;ETGRL | |

Fig. 30 continued

| | | |
|---|---|---|
| | PVANVV;LPVANVVVTPA;NVVVTPAHEAV;VVVTPAHEAVV;VVTPAHEAVV<br>R;VTPAHEAVVRV;GTKPGTEVPPV;TEVPPVIDGSI;EVPPVIDGSIW;PVIDG<br>SIWDAI;VIDGSIWDAIA;SIWDAIAGCEA;NWAINTGNGYY;EANGGLRYAPR;<br>GLRYAPRADLA;RYAPRADLATR;APRADLATREE;DLATREEQIAV;EQIAVA<br>EVTRL;QIAVAEVTRLR;VAEVTRLRQGW;EVTRLRQGWGA;RLRQGWGAW<br>PV;RQGWGAWPVCA;GWGAWPVCAAR;WGAWPVCAARA;WPVCAARAG<br>AR<br>13 mers:<br>MSSGNSSLGIIVG;SSGNSSLGIIVGI;SGNSSLGIIVGID;GNSSLGIIVGIDD;N<br>SSLGIIVGIDDS;SSLGIIVGIDDSP;SLGIIVGIDDSPA;LGIIVGIDDSPAA;GIIV<br>GIDDSPAAQ;IIVGIDDSPAAQV;IVGIDDSPAAQVA;VGIDDSPAAQVAV;GID<br>DSPAAQVAVR;IDDSPAAQVAVRW;DDSPAAQVAVRWA;DSPAAQVAVRW<br>AA;SPAAQVAVRWAAR;PAAQVAVRWAARD;AAQVAVRWAARDA;AQVAV<br>RWAARDAE;QVAVRWAARDAEL;VAVRWAARDAELR;AVRWAARDAELRK<br>;VRWAARDAELRKI;RWAARDAELRKIP;WAARDAELRKIPL;AARDAELRKIP<br>LT;ARDAELRKIPLTL;RDAELRKIPLTLV;DAELRKIPLTLVH;AELRKIPLTLVH<br>A;ELRKIPLTLVHAV;LRKIPLTLVHAVS;RKIPLTLVHAVSP;KIPLTLVHAVSPE<br>;IPLTLVHAVSPEV;PLTLVHAVSPEVA;LTLVHAVSPEVAT;TLVHAVSPEVAT<br>W;LVHAVSPEVATWL;VHAVSPEVATWLE;HAVSPEVATWLEV;AVSPEVAT<br>WLEVP;VSPEVATWLEVPL;SPEVATWLEVPLP;PEVATWLEVPLPP;EVAT<br>WLEVPLPPG;VATWLEVPLPPGV;ATWLEVPLPPGVL;TWLEVPLPPGVLR;<br>WLEVPLPPGVLRW;LEVPLPPGVLRWQ;EVPLPPGVLRWQQ;VPLPPGVLR<br>WQQD;PLPPGVLRWQQDH;LPPGVLRWQQDHG;PPGVLRWQQDHGR;PG<br>VLRWQQDHGRH;GVLRWQQDHGRHL;VLRWQQDHGRHLI;LRWQQDHG<br>RHLID;RWQQDHGRHLIDD;WQQDHGRHLIDDA;QQDHGRHLIDDAL;QDH<br>GRHLIDDALK;DHGRHLIDDALKV;HGRHLIDDALKVV;GRHLIDDALKVVE;R<br>HLIDDALKVVEQ;HLIDDALKVVEQA;LIDDALKVVEQAS;IDDALKVVEQASL;<br>DDALKVVEQASLR;DALKVVEQASLRA;ALKVVEQASLRAG;LKVVEQASLR<br>AGP;KVVEQASLRAGPP;VVEQASLRAGPPT;VEQASLRAGPPTV;EQASLR<br>AGPPTVH;QASLRAGPPTVHS;ASLRAGPPTVHSE;SLRAGPPTVHSEI;LRA<br>GPPTVHSEIV;RAGPPTVHSEIVP;AGPPTVHSEIVPA;GPPTVHSEIVPAA;P<br>PTVHSEIVPAAA;PTVHSEIVPAAAV;TVHSEIVPAAAVP;VHSEIVPAAAVPT;<br>HSEIVPAAAVPTL;SEIVPAAAVPTLV;EIVPAAAVPTLVD;IVPAAAVPTLVDM;<br>VPAAAVPTLVDMS;PAAAVPTLVDMSK;AAAVPTLVDMSKD;AAVPTLVDMS<br>KDA;AVPTLVDMSKDAV;VPTLVDMSKDAVL;PTLVDMSKDAVLM;TLVDMS<br>KDAVLMV;LVDMSKDAVLMVV;VDMSKDAVLMVVG;DMSKDAVLMVVGC;M<br>SKDAVLMVVGCL;SKDAVLMVVGCLG;KDAVLMVVGCLGS;DAVLMVVGCL<br>GSG;AVLMVVGCLGSGR;VLMVVGCLGSGRW;LMVVGCLGSGRWP;MVVG<br>CLGSGRWPG;VVGCLGSGRWPGR;VGCLGSGRWPGRL;GCLGSGRWPG<br>RLL;CLGSGRWPGRLLG;LGSGRWPGRLLGS;GSGRWPGRLLGSV;SGRW<br>PGRLLGSVS;GRWPGRLLGSVSS;RWPGRLLGSVSSG;WPGRLLGSVSSG<br>L;PGRLLGSVSSGLL;GRLLGSVSSGLLR;RLLGSVSSGLLRH;LLGSVSSGLL<br>RHA;LGSVSSGLLRHAH;GSVSSGLLRHAHC;SVSSGLLRHAHCP;VSSGLL<br>RHAHCPV;SSGLLRHAHCPVV;SGLLRHAHCPVVI;GLLRHAHCPVVII;LLRH<br>AHCPVVIIH;LRHAHCPVVIIHD;RHAHCPVVIIHDE;HAHCPVVIIHDED;AHCP<br>VVIIHDEDS;HCPVVIIHDEDSV;CPVVIIHDEDSVM;PVVIIHDEDSVMP;VVIIH<br>DEDSVMPH;VIIHDEDSVMPHP;IIHDEDSVMPHPQ;IHDEDSVMPHPQQ;HD<br>EDSVMPHPQQA;DEDSVMPHPQQAP;EDSVMPHPQQAPV;DSVMPHPQQ<br>APVL;SVMPHPQQAPVLV;VMPHPQQAPVLVG;MPHPQQAPVLVGV;PHPQ<br>QAPVLVGVD;HPQQAPVLVGVDG;PQQAPVLVGVDGS;QQAPVLVGVDGS<br>S;QAPVLVGVDGSSA;APVLVGVDGSSAS;PVLVGVDGSSASE;VLVGVDGS<br>SASEL;LVGVDGSSASELA;VGVDGSSASELAT;GVDGSSASELATA;VDGS<br>SASELATAI;DGSSASELATAIA;GSSASELATAIAF;SSASELATAIAFD;SASE | |

Fig. 30 continued

| | | |
|---|---|---|
| | LATAIAFDE;ASELATAIAFDEA;SELATAIAFDEAS;ELATAIAFDEASR;LATAIAFDEASRR;ATAIAFDEASRRN;TAIAFDEASRRNV;AIAFDEASRRNVD;IAFDEASRRNVDL;AFDEASRRNVDLV;FDEASRRNVDLVA;DEASRRNVDLVAL;EASRRNVDLVALH;ASRRNVDLVALHA;SRRNVDLVALHAW;RRNVDLVALHAWS;RNVDLVALHAWSD;NVDLVALHAWSDV;VDLVALHAWSDVD;DLVALHAWSDVDV;LVALHAWSDVDVS;VALHAWSDVDVSE;ALHAWSDVDVSEW;LHAWSDVDVSEWP;HAWSDVDVSEWPG;AWSDVDVSEWPGI;WSDVDVSEWPGID;SDVDVSEWPGIDW;DVDVSEWPGIDWP;VDVSEWPGIDWPA;DVSEWPGIDWPAT;VSEWPGIDWPATQ;SEWPGIDWPATQS;EWPGIDWPATQSM;WPGIDWPATQSMA;PGIDWPATQSMAE;GIDWPATQSMAEQ;IDWPATQSMAEQV;DWPATQSMAEQVL;WPATQSMAEQVLA;PATQSMAEQVLAE;ATQSMAEQVLAER;TQSMAEQVLAERL;QSMAEQVLAERLA;SMAEQVLAERLAG;MAEQVLAERLAGW;AEQVLAERLAGWQ;EQVLAERLAGWQE;QVLAERLAGWQER;VLAERLAGWQERY;LAERLAGWQERYP;AERLAGWQERYPN;ERLAGWQERYPNV;RLAGWQERYPNVA;LAGWQERYPNVAI;AGWQERYPNVAIT;GWQERYPNVAITR;WQERYPNVAITRV;QERYPNVAITRVV;ERYPNVAITRVVV;RYPNVAITRVVVR;YPNVAITRVVVRD;PNVAITRVVVRDQ;NVAITRVVVRDQP;VAITRVVVRDQPA;AITRVVVRDQPAR;ITRVVVRDQPARQ;TRVVVRDQPARQL;RVVVRDQPARQLV;VVVRDQPARQLVQ;VVRDQPARQLVQR;VRDQPARQLVQRS;RDQPARQLVQRSE;DQPARQLVQRSEE;QPARQLVQRSEEA;PARQLVQRSEEAQ;ARQLVQRSEEAQL;RQLVQRSEEAQLV;QLVQRSEEAQLVV;LVQRSEEAQLVVV;VQRSEEAQLVVVG;QRSEEAQLVVVGS;RSEEAQLVVVGSR;SEEAQLVVVGSRG;EEAQLVVVGSRGR;EAQLVVVGSRGRG;AQLVVVGSRGRGG;QLVVVGSRGRGGY;LVVVGSRGRGGYA;VVVGSRGRGGYAG;VVGSRGRGGYAGM;VGSRGRGGYAGML;GSRGRGGYAGMLV;SRGRGGYAGMLVG;RGRGGYAGMLVGS;GRGGYAGMLVGSV;RGGYAGMLVGSVG;GGYAGMLVGSVGE;GYAGMLVGSVGET;YAGMLVGSVGETV;AGMLVGSVGETVA;GMLVGSVGETVAQ;MLVGSVGETVAQL;LVGSVGETVAQLA;VGSVGETVAQLAR;GSVGETVAQLART;SVGETVAQLARTP;VGETVAQLARTPV;GETVAQLARTPVI;ETVAQLARTPVIV;TVAQLARTPVIVA;VAQLARTPVIVAR;AQLARTPVIVARE;QLARTPVIVARES;LARTPVIVARESL;ARTPVIVARESLT;<br><br>14 mers:<br>MSSGNSSLGIIVGI;SSGNSSLGIIVGID;SGNSSLGIIVGIDD;GNSSLGIIVGIDDS;NSSLGIIVGIDDSP;SSLGIIVGIDDSPA;SLGIIVGIDDSPAA;LGIIVGIDDSPAAQ;GIIVGIDDSPAAQV;IIVGIDDSPAAQVA;IVGIDDSPAAQVAV;VGIDDSPAAQVAVR;GIDDSPAAQVAVRW;IDDSPAAQVAVRWA;DDSPAAQVAVRWAA;DSPAAQVAVRWAAR;SPAAQVAVRWAARD;PAAQVAVRWAARDA;AAQVAVRWAARDAE;AQVAVRWAARDAEL;QVAVRWAARDAELR;VAVRWAARDAELRK;AVRWAARDAELRKI;VRWAARDAELRKIP;RWAARDAELRKIPL;WAARDAELRKIPLT;AARDAELRKIPLTL;ARDAELRKIPLTLV;RDAELRKIPLTLVH;DAELRKIPLTLVHA;AELRKIPLTLVHAV;ELRKIPLTLVHAVS;LRKIPLTLVHAVSP;RKIPLTLVHAVSPE;KIPLTLVHAVSPEV;IPLTLVHAVSPEVA;PLTLVHAVSPEVAT;LTLVHAVSPEVATW;TLVHAVSPEVATWL;LVHAVSPEVATWLE;VHAVSPEVATWLEV;HAVSPEVATWLEVP;AVSPEVATWLEVPL;VSPEVATWLEVPLP;SPEVATWLEVPLPP;PEVATWLEVPLPPG;EVATWLEVPLPPGV;VATWLEVPLPPGVL;ATWLEVPLPPGVLR;TWLEVPLPPGVLRW;WLEVPLPPGVLRWQ;LEVPLPPGVLRWQQ;EVPLPPGVLRWQQD;VPLPPGVLRWQQDH;PLPPGVLRWQQDHG;LPPGVLRWQQDHGR;PPGVLRWQQDHGRH;PGVLRWQQDHGRHL;GVLRWQQDHGRHLI;VLRWQQDHGRHLID;LRWQQDHGRHLIDD;RWQQDHGRHLIDDA;WQQDHGRHLIDDAL;QQDHGRHLIDDALK;QDHGRHLIDDALKV;DHGRHLIDDALKVV;HGRHLIDDALKVVE; | |

Fig. 30 continued

| | | |
|---|---|---|
| | GRHLIDDALKVVEQ;RHLIDDALKVVEQA;HLIDDALKVVEQAS;LIDDALKVVEQASL;IDDALKVVEQASLR;DDALKVVEQASLRA;DALKVVEQASLRAG;ALKVVEQASLRAGP;LKVVEQASLRAGPP;KVVEQASLRAGPPT;VVEQASLRAGPPTV;VEQASLRAGPPTVH;EQASLRAGPPTVHS;QASLRAGPPTVHSE;ASLRAGPPTVHSEI;SLRAGPPTVHSEIV;LRAGPPTVHSEIVP;RAGPPTVHSEIVPA;AGPPTVHSEIVPAA;GPPTVHSEIVPAAA;PPTVHSEIVPAAAV;PTVHSEIVPAAAVP;TVHSEIVPAAAVPT;VHSEIVPAAAVPTL;HSEIVPAAAVPTLV;SEIVPAAAVPTLVD;EIVPAAAVPTLVDM;IVPAAAVPTLVDMS;VPAAAVPTLVDMSK;PAAAVPTLVDMSKD;AAAVPTLVDMSKDA;AAVPTLVDMSKDAV;AVPTLVDMSKDAVL;VPTLVDMSKDAVLM;PTLVDMSKDAVLMV;TLVDMSKDAVLMVV;LVDMSKDAVLMVVG;VDMSKDAVLMVVGC;DMSKDAVLMVVGCL;MSKDAVLMVVGCLG;SKDAVLMVVGCLGS;KDAVLMVVGCLGSG;DAVLMVVGCLGSGR;AVLMVVGCLGSGRW;VLMVVGCLGSGRWP;LMVVGCLGSGRWPG;MVVGCLGSGRWPGR;VVGCLGSGRWPGRL;VGCLGSGRWPGRLL;GCLGSGRWPGRLLG;CLGSGRWPGRLLGS;LGSGRWPGRLLGSV;GSGRWPGRLLGSVS;SGRWPGRLLGSVSS;GRWPGRLLGSVSSG;RWPGRLLGSVSSGL;WPGRLLGSVSSGLL;PGRLLGSVSSGLLR;GRLLGSVSSGLLRH;RLLGSVSSGLLRHA;LLGSVSSGLLRHAH;LGSVSSGLLRHAHC;GSVSSGLLRHAHCP;SVSSGLLRHAHCPV;VSSGLLRHAHCPVV;SSGLLRHAHCPVVI;SGLLRHAHCPVVII;GLLRHAHCPVVIIH;LLRHAHCPVVIIHD;LRHAHCPVVIIHDE;RHAHCPVVIIHDED;HAHCPVVIIHDEDS;AHCPVVIIHDEDSV;HCPVVIIHDEDSVM;CPVVIIHDEDSVMP;PVVIIHDEDSVMPH;VVIIHDEDSVMPHP;VIIHDEDSVMPHPQ;IIHDEDSVMPHPQQ;IHDEDSVMPHPQQA;HDEDSVMPHPQQAP;DEDSVMPHPQQAPV;EDSVMPHPQQAPVL;DSVMPHPQQAPVLV;SVMPHPQQAPVLVG;VMPHPQQAPVLVGV;MPHPQQAPVLVGVD;PHPQQAPVLVGVDG;HPQQAPVLVGVDGS;PQQAPVLVGVDGSS;QQAPVLVGVDGSSA;QAPVLVGVDGSSAS;APVLVGVDGSSASE;PVLVGVDGSSASEL;VLVGVDGSSASELA;LVGVDGSSASELAT;VGVDGSSASELATA;GVDGSSASELATAI;VDGSSASELATAIA;DGSSASELATAIAF;GSSASELATAIAFD;SSASELATAIAFDE;SASELATAIAFDEA;ASELATAIAFDEAS;SELATAIAFDEASR;ELATAIAFDEASRR;LATAIAFDEASRRN;ATAIAFDEASRRNV;TAIAFDEASRRNVD;AIAFDEASRRNVDL;IAFDEASRRNVDLV;AFDEASRRNVDLVA;FDEASRRNVDLVAL;DEASRRNVDLVALH;EASRRNVDLVALHA;ASRRNVDLVALHAW;SRRNVDLVALHAWS;RRNVDLVALHAWSD;RNVDLVALHAWSDV;NVDLVALHAWSDVD;VDLVALHAWSDVDV;DLVALHAWSDVDVS;LVALHAWSDVDVSE;VALHAWSDVDVSEW;ALHAWSDVDVSEWP;LHAWSDVDVSEWPG;HAWSDVDVSEWPGI;AWSDVDVSEWPGID;WSDVDVSEWPGIDW;SDVDVSEWPGIDWP;DVDVSEWPGIDWPA;VDVSEWPGIDWPAT;DVSEWPGIDWPATQ;VSEWPGIDWPATQS;SEWPGIDWPATQSM;EWPGIDWPATQSMA;WPGIDWPATQSMAE;PGIDWPATQSMAEQ;GIDWPATQSMAEQV;IDWPATQSMAEQVL;DWPATQSMAEQVLA;WPATQSMAEQVLAE;PATQSMAEQVLAER;ATQSMAEQVLAERL;TQSMAEQVLAERLA;QSMAEQVLAERLAG;SMAEQVLAERLAGW;MAEQVLAERLAGWQ;AEQVLAERLAGWQE;EQVLAERLAGWQER;QVLAERLAGWQERY;VLAERLAGWQERYP;LAERLAGWQERYPN;AERLAGWQERYPNV;ERLAGWQERYPNVA;RLAGWQERYPNVAI;LAGWQERYPNVAIT;AGWQERYPNVAITR;GWQERYPNVAITRV;WQERYPNVAITRVV;QERYPNVAITRVVV;ERYPNVAITRVVVR;RYPNVAITRVVVRD;YPNVAITRVVVRDQ;PNVAITRVVVRDQP;NVAITRVVVRDQPA;VAITRVVVRDQPAR;AITRVVVRDQPARQ;ITRVVVRDQPARQL;TRVVVRDQPARQLV;RVVVRDQPARQLVQ;VVVRDQPARQLVQR;VVRDQPARQLVQRS;VRDQPARQLVQRSE;RDQPARQLVQRSEE;DQPARQLVQRSEEA;QPARQLVQRSEEAQ;PARQLVQRSEEAQL;ARQLVQRSEEAQLV;RQLVQRSEEAQLVV;QLVQRSEEAQLVVV;LVQRSEEAQLVVVG;VQRSEEAQLVVVGS;QRSEEAQ | |

Fig. 30 continued

| | | |
|---|---|---|
| | LVVVGSR;RSEEAQLVVVGSRG;SEEAQLVVVGSRGR;EEAQLVVVGSRGR<br>G;EAQLVVVGSRGRGG;AQLVVVGSRGRGGY;QLVVVGSRGRGGYA;LVV<br>VGSRGRGGYAG;VVVGSRGRGGYAGM;VVGSRGRGGYAGML;VGSRGR<br>GGYAGMLV;GSRGRGGYAGMLVG;SRGRGGYAGMLVGS;RGRGGYAGM<br>LVGSV;GRGGYAGMLVGSVG;RGGYAGMLVGSVGE;GGYAGMLVGSVGE<br>T;GYAGMLVGSVGETV;YAGMLVGSVGETVA;AGMLVGSVGETVAQ;GMLV<br>GSVGETVAQL;MLVGSVGETVAQLA;LVGSVGETVAQLAR;VGSVGETVAQ<br>LART;GSVGETVAQLARTP;SVGETVAQLARTPV;VGETVAQLARTPVI;GET<br>VAQLARTPVIV;ETVAQLARTPVIVA;TVAQLARTPVIVAR;VAQLARTPVIVAR<br>E;AQLARTPVIVARES;QLARTPVIVARESL;LARTPVIVARESLT;<br>15 mers:<br>MSSGNSSLGIIVGID;SSGNSSLGIIVGIDD;SGNSSLGIIVGIDDS;GNSSLGIIV<br>GIDDSP;NSSLGIIVGIDDSPA;SSLGIIVGIDDSPAA;SLGIIVGIDDSPAAQ;LGI<br>IVGIDDSPAAQV;GIIVGIDDSPAAQVA;IIVGIDDSPAAQVAV;IVGIDDSPAAQ<br>VAVR;VGIDDSPAAQVAVRW;GIDDSPAAQVAVRWA;IDDSPAAQVAVRWA<br>A;DDSPAAQVAVRWAAR;DSPAAQVAVRWAARD;SPAAQVAVRWAARDA;<br>PAAQVAVRWAARDAE;AAQVAVRWAARDAEL;AQVAVRWAARDAELR;QV<br>AVRWAARDAELRK;VAVRWAARDAELRKI;AVRWAARDAELRKIP;VRWAA<br>RDAELRKIPL;RWAARDAELRKIPLT;WAARDAELRKIPLTL;AARDAELRKIP<br>LTLV;ARDAELRKIPLTLVH;RDAELRKIPLTLVHA;DAELRKIPLTLVHAV;AEL<br>RKIPLTLVHAVS;ELRKIPLTLVHAVSP;LRKIPLTLVHAVSPE;RKIPLTLVHAV<br>SPEV;KIPLTLVHAVSPEVA;IPLTLVHAVSPEVAT;PLTLVHAVSPEVATW;LT<br>LVHAVSPEVATWL;TLVHAVSPEVATWLE;LVHAVSPEVATWLEV;VHAVSP<br>EVATWLEVP;HAVSPEVATWLEVPL;AVSPEVATWLEVPLP;VSPEVATWLE<br>VPLPP;SPEVATWLEVPLPPG;PEVATWLEVPLPPGV;EVATWLEVPLPPGV<br>L;VATWLEVPLPPGVLR;ATWLEVPLPPGVLRW;TWLEVPLPPGVLRWQ;WL<br>EVPLPPGVLRWQQ;LEVPLPPGVLRWQQD;EVPLPPGVLRWQQDH;VPLP<br>PGVLRWQQDHG;PLPPGVLRWQQDHGR;LPPGVLRWQQDHGRH;PPGVL<br>RWQQDHGRHL;PGVLRWQQDHGRHLI;GVLRWQQDHGRHLID;VLRWQQ<br>DHGRHLIDD;LRWQQDHGRHLIDDA;RWQQDHGRHLIDDAL;WQQDHGRH<br>LIDDALK;QQDHGRHLIDDALKV;QDHGRHLIDDALKVV;DHGRHLIDDALKV<br>VE;HGRHLIDDALKVVEQ;GRHLIDDALKVVEQA;RHLIDDALKVVEQAS;HLI<br>DDALKVVEQASL;LIDDALKVVEQASLR;IDDALKVVEQASLRA;DDALKVVE<br>QASLRAG;DALKVVEQASLRAGP;ALKVVEQASLRAGPP;LKVVEQASLRAG<br>PPT;KVVEQASLRAGPPTV;VVEQASLRAGPPTVH;VEQASLRAGPPTVHS;<br>EQASLRAGPPTVHSE;QASLRAGPPTVHSEI;ASLRAGPPTVHSEIV;SLRAG<br>PPTVHSEIVP;LRAGPPTVHSEIVPA;RAGPPTVHSEIVPAA;AGPPTVHSEIV<br>PAAA;GPPTVHSEIVPAAAV;PPTVHSEIVPAAAVP;PTVHSEIVPAAAVPT;TV<br>HSEIVPAAAVPTL;VHSEIVPAAAVPTLV;HSEIVPAAAVPTLVD;SEIVPAAAV<br>PTLVDM;EIVPAAAVPTLVDMS;IVPAAAVPTLVDMSK;VPAAAVPTLVDMSK<br>D;PAAAVPTLVDMSKDA;AAAVPTLVDMSKDAV;AAVPTLVDMSKDAVL;AV<br>PTLVDMSKDAVLM;VPTLVDMSKDAVLMV;PTLVDMSKDAVLMVV;TLVDM<br>SKDAVLMVVG;LVDMSKDAVLMVVGC;VDMSKDAVLMVVGCL;DMSKDAVL<br>MVVGCLG;MSKDAVLMVVGCLGS;SKDAVLMVVGCLGSG;KDAVLMVVGC<br>LGSGR;DAVLMVVGCLGSGRW;AVLMVVGCLGSGRWP;VLMVVGCLGSG<br>RWPG;LMVVGCLGSGRWPGR;MVVGCLGSGRWPGRL;VVGCLGSGRWP<br>GRLL;VGCLGSGRWPGRLLG;GCLGSGRWPGRLLGS;CLGSGRWPGRLLG<br>SV;LGSGRWPGRLLGSVS;GSGRWPGRLLGSVSS;SGRWPGRLLGSVSSG<br>;GRWPGRLLGSVSSGL;RWPGRLLGSVSSGLL;WPGRLLGSVSSGLLR;PG<br>RLLGSVSSGLLRH;GRLLGSVSSGLLRHA;RLLGSVSSGLLRHAH;LLGSVS<br>SGLLRHAHC;LGSVSSGLLRHAHCP;GSVSSGLLRHAHCPV;SVSSGLLRHA<br>HCPVV;VSSGLLRHAHCPVVI;SSGLLRHAHCPVVII;SGLLRHAHCPVVIIH;G<br>LLRHAHCPVVIIHD;LLRHAHCPVVIIHDE;LRHAHCPVVIIHDED;RHAHCPVV | |

Fig. 30 continued

| | | |
|---|---|---|
| | IIHDEDS;HAHCPVVIIHDEDSV;AHCPVVIIHDEDSVM;HCPVVIIHDEDSVMP;CPVVIIHDEDSVMPH;PVVIIHDEDSVMPHP;VVIIHDEDSVMPHPQ;VIIHDEDSVMPHPQQ;IIHDEDSVMPHPQQA;IHDEDSVMPHPQQAP;HDEDSVMPHPQQAPV;DEDSVMPHPQQAPVL;EDSVMPHPQQAPVLV;DSVMPHPQQAPVLVG;SVMPHPQQAPVLVGV;VMPHPQQAPVLVGVD;MPHPQQAPVLVGVDG;PHPQQAPVLVGVDGS;HPQQAPVLVGVDGSS;PQQAPVLVGVDGSSA;QQAPVLVGVDGSSAS;QAPVLVGVDGSSASE;APVLVGVDGSSASEL;PVLVGVDGSSASELA;VLVGVDGSSASELAT;LVGVDGSSASELATA;VGVDGSSASELATAI;GVDGSSASELATAIA;VDGSSASELATAIAF;DGSSASELATAIAFD;GSSASELATAIAFDE;SSASELATAIAFDEA;SASELATAIAFDEAS;ASELATAIAFDEASR;SELATAIAFDEASRR;ELATAIAFDEASRRN;LATAIAFDEASRRNV;ATAIAFDEASRRNVD;TAIAFDEASRRNVDL;AIAFDEASRRNVDLV;IAFDEASRRNVDLVA;AFDEASRRNVDLVAL;FDEASRRNVDLVALH;DEASRRNVDLVALHA;EASRRNVDLVALHAW;ASRRNVDLVALHAWS;SRRNVDLVALHAWSD;RRNVDLVALHAWSDV;RNVDLVALHAWSDVD;NVDLVALHAWSDVDV;VDLVALHAWSDVDVS;DLVALHAWSDVDVSE;LVALHAWSDVDVSEW;VALHAWSDVDVSEWP;ALHAWSDVDVSEWPG;LHAWSDVDVSEWPGI;HAWSDVDVSEWPGID;AWSDVDVSEWPGIDW;WSDVDVSEWPGIDWP;SDVDVSEWPGIDWPA;DVDVSEWPGIDWPAT;VDVSEWPGIDWPATQ;DVSEWPGIDWPATQS;VSEWPGIDWPATQSM;SEWPGIDWPATQSMA;EWPGIDWPATQSMAE;WPGIDWPATQSMAEQ;PGIDWPATQSMAEQV;GIDWPATQSMAEQVL;IDWPATQSMAEQVLA;DWPATQSMAEQVLAE;WPATQSMAEQVLAER;PATQSMAEQVLAERL;ATQSMAEQVLAERLA;TQSMAEQVLAERLAG;QSMAEQVLAERLAGW;SMAEQVLAERLAGWQ;MAEQVLAERLAGWQE;AEQVLAERLAGWQER;EQVLAERLAGWQERY;QVLAERLAGWQERYP;VLAERLAGWQERYPN;LAERLAGWQERYPNV;AERLAGWQERYPNVA;ERLAGWQERYPNVAI;RLAGWQERYPNVAIT;LAGWQERYPNVAITR;AGWQERYPNVAITRV;GWQERYPNVAITRVV;WQERYPNVAITRVVV;QERYPNVAITRVVVR;ERYPNVAITRVVVRD;RYPNVAITRVVVRDQ;YPNVAITRVVVRDQP;PNVAITRVVVRDQPA;NVAITRVVVRDQPAR;VAITRVVVRDQPARQ;AITRVVVRDQPARQL;ITRVVVRDQPARQLV;TRVVVRDQPARQLVQ;RVVVRDQPARQLVQR;VVVRDQPARQLVQRS;VVRDQPARQLVQRSE;VRDQPARQLVQRSEE;RDQPARQLVQRSEEA;DQPARQLVQRSEEAQ;QPARQLVQRSEEAQL;PARQLVQRSEEAQLV;ARQLVQRSEEAQLVV;RQLVQRSEEAQLVVV;QLVQRSEEAQLVVVG;LVQRSEEAQLVVVGS;VQRSEEAQLVVVGSR;QRSEEAQLVVVGSRG;RSEEAQLVVVGSRGR;SEEAQLVVVGSRGRG;EEAQLVVVGSRGRGG;EAQLVVVGSRGRGGY;AQLVVVGSRGRGGYA;QLVVVGSRGRGGYAG;LVVVGSRGRGGYAGM;VVVGSRGRGGYAGML;VVGSRGRGGYAGMLV;VGSRGRGGYAGMLVG;GSRGRGGYAGMLVGS;SRGRGGYAGMLVGSV;RGRGGYAGMLVGSVG;GRGGYAGMLVGSVGE;RGGYAGMLVGSVGET;GGYAGMLVGSVGETV;GYAGMLVGSVGETVA;YAGMLVGSVGETVAQ;AGMLVGSVGETVAQL;GMLVGSVGETVAQLA;MLVGSVGETVAQLAR;LVGSVGETVAQLART;VGSVGETVAQLARTP;GSVGETVAQLARTPV;SVGETVAQLARTPVI;VGETVAQLARTPVIV;GETVAQLARTPVIVA;ETVAQLARTPVIVAR;TVAQLARTPVIVARE;VAQLARTPVIVARES;AQLARTPVIVARESL;QLARTPVIVARESLT;<br>16 mers:<br>MSSGNSSLGIIVGIDD;SSGNSSLGIIVGIDDS;SGNSSLGIIVGIDDSP;GNSSLGIIVGIDDSPA;NSSLGIIVGIDDSPAA;SSLGIIVGIDDSPAAQ;SLGIIVGIDDSPAAQV;LGIIVGIDDSPAAQVA;GIIVGIDDSPAAQVAV;IIVGIDDSPAAQVAVR;IVGIDDSPAAQVAVRW;VGIDDSPAAQVAVRWA;GIDDSPAAQVAVRWAA;IDDSPAAQVAVRWAAR;DDSPAAQVAVRWAARD;DSPAAQVAVRWAARDA;SPAAQVAVRWAARDAE;PAAQVAVRWAARDAEL;AAQVAVRWAARDAEL | |

Fig. 30 continued

| | | |
|---|---|---|
| | R;AQVAVRWAARDAELRK;QVAVRWAARDAELRKI;VAVRWAARDAELRKIP;AVRWAARDAELRKIPL;VRWAARDAELRKIPLT;RWAARDAELRKIPLTL;WAARDAELRKIPLTLV;AARDAELRKIPLTLVH;ARDAELRKIPLTLVHA;RDAELRKIPLTLVHAV;DAELRKIPLTLVHAVS;AELRKIPLTLVHAVSP;ELRKIPLTLVHAVSPE;LRKIPLTLVHAVSPEV;RKIPLTLVHAVSPEVA;KIPLTLVHAVSPEVAT;IPLTLVHAVSPEVATW;PLTLVHAVSPEVATWL;LTLVHAVSPEVATWLE;TLVHAVSPEVATWLEV;LVHAVSPEVATWLEVP;VHAVSPEVATWLEVPL;HAVSPEVATWLEVPLP;AVSPEVATWLEVPLPP;VSPEVATWLEVPLPPG;SPEVATWLEVPLPPGV;PEVATWLEVPLPPGVL;EVATWLEVPLPPGVLR;VATWLEVPLPPGVLRW;ATWLEVPLPPGVLRWQ;TWLEVPLPPGVLRWQQ;WLEVPLPPGVLRWQQD;LEVPLPPGVLRWQQDH;EVPLPPGVLRWQQDHG;VPLPPGVLRWQQDHGR;PLPPGVLRWQQDHGRH;LPPGVLRWQQDHGRHL;PPGVLRWQQDHGRHLI;PGVLRWQQDHGRHLID;GVLRWQQDHGRHLIDD;VLRWQQDHGRHLIDDA;LRWQQDHGRHLIDDAL;RWQQDHGRHLIDDALK;WQQDHGRHLIDDALKV;QQDHGRHLIDDALKVV;QDHGRHLIDDALKVVE;DHGRHLIDDALKVVEQ;HGRHLIDDALKVVEQA;GRHLIDDALKVVEQAS;RHLIDDALKVVEQASL;HLIDDALKVVEQASLR;LIDDALKVVEQASLRA;IDDALKVVEQASLRAG;DDALKVVEQASLRAGP;DALKVVEQASLRAGPP;ALKVVEQASLRAGPPT;LKVVEQASLRAGPPTV;KVVEQASLRAGPPTVH;VVEQASLRAGPPTVHS;VEQASLRAGPPTVHSE;EQASLRAGPPTVHSEI;QASLRAGPPTVHSEIV;ASLRAGPPTVHSEIVP;SLRAGPPTVHSEIVPA;LRAGPPTVHSEIVPAA;RAGPPTVHSEIVPAAA;AGPPTVHSEIVPAAAV;GPPTVHSEIVPAAAVP;PPTVHSEIVPAAAVPT;PTVHSEIVPAAAVPTL;TVHSEIVPAAAVPTLV;VHSEIVPAAAVPTLVD;HSEIVPAAAVPTLVDM;SEIVPAAAVPTLVDMS;EIVPAAAVPTLVDMSK;IVPAAAVPTLVDMSKD;VPAAAVPTLVDMSKDA;PAAAVPTLVDMSKDAV;AAAVPTLVDMSKDAVL;AAVPTLVDMSKDAVLM;AVPTLVDMSKDAVLMV;VPTLVDMSKDAVLMVV;PTLVDMSKDAVLMVVG;TLVDMSKDAVLMVVGC;LVDMSKDAVLMVVGCL;VDMSKDAVLMVVGCLG;DMSKDAVLMVVGCLGS;MSKDAVLMVVGCLGSG;SKDAVLMVVGCLGSGR;KDAVLMVVGCLGSGRW;DAVLMVVGCLGSGRWP;AVLMVVGCLGSGRWPG;VLMVVGCLGSGRWPGR;LMVVGCLGSGRWPGRL;MVVGCLGSGRWPGRLL;VVGCLGSGRWPGRLLG;VGCLGSGRWPGRLLGS;GCLGSGRWPGRLLGSV;CLGSGRWPGRLLGSVS;LGSGRWPGRLLGSVSS;GSGRWPGRLLGSVSSG;SGRWPGRLLGSVSSGL;GRWPGRLLGSVSSGLL;RWPGRLLGSVSSGLLR;WPGRLLGSVSSGLLRH;PGRLLGSVSSGLLRHA;GRLLGSVSSGLLRHAH;RLLGSVSSGLLRHAHC;LLGSVSSGLLRHAHCP;LGSVSSGLLRHAHCPV;GSVSSGLLRHAHCPVV;SVSSGLLRHAHCPVVI;VSSGLLRHAHCPVVII;SSGLLRHAHCPVVIIH;SGLLRHAHCPVVIIHD;GLLRHAHCPVVIIHDE;LLRHAHCPVVIIHDED;LRHAHCPVVIIHDEDS;RHAHCPVVIIHDEDSV;HAHCPVVIIHDEDSVM;AHCPVVIIHDEDSVMP;HCPVVIIHDEDSVMPH;CPVVIIHDEDSVMPHP;PVVIIHDEDSVMPHPQ;VVIIHDEDSVMPHPQQ;VIIHDEDSVMPHPQQA;IIHDEDSVMPHPQQAP;IHDEDSVMPHPQQAPV;HDEDSVMPHPQQAPVL;DEDSVMPHPQQAPVLV;EDSVMPHPQQAPVLVG;DSVMPHPQQAPVLVGV;SVMPHPQQAPVLVGVD;VMPHPQQAPVLVGVDG;MPHPQQAPVLVGVDGS;PHPQQAPVLVGVDGSS;HPQQAPVLVGVDGSSA;PQQAPVLVGVDGSSAS;QQAPVLVGVDGSSASE;QAPVLVGVDGSSASEL;APVLVGVDGSSASELA;PVLVGVDGSSASELAT;VLVGVDGSSASELATA;LVGVDGSSASELATAI;VGVDGSSASELATAIA;GVDGSSASELATAIAF;VDGSSASELATAIAFD;DGSSASELATAIAFDE;GSSASELATAIAFDEA;SSASELATAIAFDEAS;SASELATAIAFDEASR;ASELATAIAFDEASRR;SELATAIAFDEASRRN;ELATAIAFDEASRRNV;LATAIAFDEASRRNVD;ATAIAFDEASRRNVDL;TAIAFDEASRRNVDLV;AIAFDEASRRNVDLVA;IAFDEASRRNVDLVAL;AFDEASRRNVDLVALH;FDEASRRNVDLVALHA;DEASRRNVDLVALHAW;EASRRNVDLVA | |

Fig. 30 continued

| | | |
|---|---|---|
| | LHAWS;ASRRNVDLVALHAWSD;SRRNVDLVALHAWSDV;RRNVDLVALHAWSDVD;RNVDLVALHAWSDVDV;NVDLVALHAWSDVDVS;VDLVALHAWSDVDVSE;DLVALHAWSDVDVSEW;LVALHAWSDVDVSEWP;VALHAWSDVDVSEWPG;ALHAWSDVDVSEWPGI;LHAWSDVDVSEWPGID;HAWSDVDVSEWPGIDW;AWSDVDVSEWPGIDWP;WSDVDVSEWPGIDWPA;SDVDVSEWPGIDWPAT;DVDVSEWPGIDWPATQ;VDVSEWPGIDWPATQS;DVSEWPGIDWPATQSM;VSEWPGIDWPATQSMA;SEWPGIDWPATQSMAE;EWPGIDWPATQSMAEQ;WPGIDWPATQSMAEQV;PGIDWPATQSMAEQVL;GIDWPATQSMAEQVLA;IDWPATQSMAEQVLAE;DWPATQSMAEQVLAER;WPATQSMAEQVLAERL;PATQSMAEQVLAERLA;ATQSMAEQVLAERLAG;TQSMAEQVLAERLAGW;QSMAEQVLAERLAGWQ;SMAEQVLAERLAGWQE;MAEQVLAERLAGWQER;AEQVLAERLAGWQERY;EQVLAERLAGWQERYP;QVLAERLAGWQERYPN;VLAERLAGWQERYPNV;LAERLAGWQERYPNVA;AERLAGWQERYPNVAI;ERLAGWQERYPNVAIT;RLAGWQERYPNVAITR;LAGWQERYPNVAITRV;AGWQERYPNVAITRVV;GWQERYPNVAITRVVV;WQERYPNVAITRVVVR;QERYPNVAITRVVVRD;ERYPNVAITRVVVRDQ;RYPNVAITRVVVRDQP;YPNVAITRVVVRDQPA;PNVAITRVVVRDQPAR;NVAITRVVVRDQPARQ;VAITRVVVRDQPARQL;AITRVVVRDQPARQLV;ITRVVVRDQPARQLVQ;TRVVVRDQPARQLVQR;RVVVRDQPARQLVQRS;VVVRDQPARQLVQRSE;VVRDQPARQLVQRSEE;VRDQPARQLVQRSEEA;RDQPARQLVQRSEEAQ;DQPARQLVQRSEEAQL;QPARQLVQRSEEAQLV;PARQLVQRSEEAQLVV;ARQLVQRSEEAQLVVV;RQLVQRSEEAQLVVVG;QLVQRSEEAQLVVVGS;LVQRSEEAQLVVVGSR;VQRSEEAQLVVVGSRG;QRSEEAQLVVVGSRGR;RSEEAQLVVVGSRGRG;SEEAQLVVVGSRGRGG;EEAQLVVVGSRGRGGY;EAQLVVVGSRGRGGYA;AQLVVVGSRGRGGYAG;QLVVVGSRGRGGYAGM;LVVVGSRGRGGYAGML;VVVGSRGRGGYAGMLV;VVGSRGRGGYAGMLVG;VGSRGRGGYAGMLVGS;GSRGRGGYAGMLVGSV;SRGRGGYAGMLVGSVG;RGRGGYAGMLVGSVGE;GRGGYAGMLVGSVGET;RGGYAGMLVGSVGETV;GGYAGMLVGSVGETVA;GYAGMLVGSVGETVAQ;YAGMLVGSVGETVAQL;AGMLVGSVGETVAQLA;GMLVGSVGETVAQLAR;MLVGSVGETVAQLART;LVGSVGETVAQLARTP;VGSVGETVAQLARTPV;GSVGETVAQLARTPVI;SVGETVAQLARTPVIV;VGETVAQLARTPVIVA;GETVAQLARTPVIVAR;ETVAQLARTPVIVARE;TVAQLARTPVIVARES;VAQLARTPVIVARESL;AQLARTPVIVARESLT | |
| 5 | **<NP_215382.1 resuscitation-promoting factor RpfA Rv0867c;Mycobacterium tuberculosis H37Rv>**<br>MSGRHRKPTTSNVSVAKIAFTGAVLGGGGIAMAAQATAATDGEWDQVARCESGGNWSINTGNGYLGGLQFTQSTWAAHGGGEFAPSAQLASREQQIAVGERVLATQGRGAWPVCGRGLSNATPREVLPASAAMDAPLDAAAVNGEPAPLAPPPADPAPPVELAANDLPAPLGEPLPAAPADPAPPADLAPPAPADVAPPVELAVNDLPAPLGEPLPAAPADPAPPADLAPPAPADLAPPAPADLAPPAPADLAPPVELAVNDLPAPLGEPLPAAPAELAPPADLAPASADLAPPAPADLAPPAPAELAPPAPADLAPPAAVNEQTAPGDQPATAPGGPVGLATDLELPEPDPQPADAPPPGDVTEAPAETPQVSNIAYTKKLWQAIRAQDVCGNDALDSLAQPYVIG<br><br>8mer<br>PTTSNVSV;TTSNVSVA;TSNVSVAK;VSVAKIAF;SVAKIAFT;AKIAFTGA;KIAFTGAV;IAFTGAVL;AVLGGGGI;VLGGGGIA;GIAMAAQA;AMAAQATA;MAAQATAA;TAATDGEW;ESGGNWSI;SINTGNGY;GYLGGLQF;YLGGLQFT;GLQFTQST;LQFTQSTW;FTQSTWAA;TQSTWAAH;AAHGGGEF;EFAPSAQL;FAPSAQLA;APSAQLAS;QQIAVGER;QIAVGERV;RVLATQGR;QGRGAWPV;GAWPVCGR;WPVCGRGL;GLSNATPR;TPREVLPA;EVLPASAA;VLPASA | 122155-124121 |

Fig. 30 continued

| | | |
|---|---|---|
| | AM;SAAMDAPL;AMDAPLDA;MDAPLDAA;APLDAAAV;AAVNGEPA;APLAPPPA;APPPADPA;PADPAPPV;DPAPPVEL;VELAANDL;LPAPLGEP;PLGEPLPA;EPLPAAPA;DLAPPAPA;APPAPADV;PADVAPPV;DVAPPVEL;APPVELAV;VELAVNDL;LAVNDLPA;LPAPLGEP;PLGEPLPA;EPLPAAPA;DLAPPAPA;APPAPADL;DLAPPAPA;APPAPADL;DLAPPAPA;APPAPADL;DLAPPVEL;APPVELAV;VELAVNDL;LAVNDLPA;LPAPLGEP;PLGEPLPA;EPLPAAPA;LPAAPAEL;ELAPPADL;PPADLAPA;APASADLA;DLAPPAPA;APPAPADL;DLAPPAPA;APPAPAEL;ELAPPAPA;APPAPADL;DLAPPAAV;ATAPGGPV;APGGPVGL;GLATDLEL;APAETPQV;ETPQVSNI;TPQVSNIA;PQVSNIAY;QVSNIAYT;VSNIAYTK;IAYTKKLW;YTKKLWQA;KLWQAIRA;DVCGNDAL;ALDSLAQP;LDSLAQPY;DSLAQPYV;SLAQPYVI<br>9mer<br>KPTTSNVSV;TTSNVSVAK;NVSVAKIAF;VAKIAFTGA;AKIAFTGAV;KIAFTGAVL;VLGGGGIAM;IAMAAQATA;AMAAQATAA;MAAQATAAT;ATAATDGEW;ATDGEWDQV;CESGGNWSI;WSINTGNGY;SINTGNGYL;YLGGLQFTQ;LQFTQSTWA;FTQSTWAAH;WAAHGGGEF;GEFAPSAQL;QLASREQQI;EQQIAVGER;QQIAVGERV;VLATQGRGA;LATQGRGAW;TQGRGAWPV;WPVCGRGLS;RGLSNATPR;TPREVLPAS;EVLPASAAM;LPASAAMDA;ASAAMDAPL;AMDAPLDAA;MDAPLDAAA;DAPLDAAAV;AVNGEPAPL;PPADPAPPV;DPAPPVELA;ELAANDLPA;AANDLPAPL;LPAPLGEPL;APLGEPLPA;PLGEPLPAA;EPLPAAPAD;LPAAPADPA;APADPAPPA;PPADLAPPA;APPAPADVA;APADVAPPV;DVAPPVELA;VAPPVELAV;ELAVNDLPA;AVNDLPAPL;LPAPLGEPL;APLGEPLPA;PLGEPLPAA;EPLPAAPAD;LPAAPADPA;APADPAPPA;PPADLAPPA;APPAPADLA;APADLAPPA;APPAPADLA;APADLAPPA;APPAPADLA;APADLAPPV;DLAPPVELA;LAPPVELAV;ELAVNDLPA;AVNDLPAPL;LPAPLGEPL;APLGEPLPA;PLGEPLPAA;EPLPAAPAE;PLPAAPAEL;LPAAPAELA;APAELAPPA;AELAPPADL;ELAPPADLA;APPADLAPA;DLAPASADL;APPAPADLA;APADLAPPA;LAPPAPAEL;APAELAPPA;AELAPPAPA;APPAPADLA;APADLAPPA;QTAPGDQPA;TAPGGPVGL;APGGPVGLA;GPVGLATDL;LPEPDPQPA;EAPAETPQV;AETPQVSNI;ETPQVSNIA;TPQVSNIAY;QVSNIAYTK;VSNIAYTKK;YTKKLWQAI;TKKLWQAIR;KLWQAIRAQ;WQAIRAQDV;CGNDALDSL;ALDSLAQPY<br>10mer<br>KPTTSNVSVA;PTTSNVSVAK;TTSNVSVAKI;SVAKIAFTGA;VAKIAFTGAV;AVLGGGGIAM;VLGGGGIAMA;GIAMAAQATA;IAMAAQATAA;AMAAQATAAT;AQATAATDGE;QATAATDGEW;AATDGEWDQV;NTGNGYLGGL;YLGGLQFTQS;GGLQFTQSTW;GLQFTQSTWA;LQFTQSTWAA;TWAAHGGGEF;WAAHGGGEFA;GEFAPSAQLA;FAPSAQLASR;AQLASREQQI;QLASREQQIA;LASREQQIAV;QQIAVGERVL;ATQGRGAWPV;GLSNATPREV;TPREVLPASA;REVLPASAAM;VLPASAAMDA;LPASAAMDAP;AAMDAPLDAA;AMDAPLDAAA;MDAPLDAAAV;DAAAVNGEPA;AAVNGEPAPL;EPAPLAPPPA;PLAPPPADPA;PPPADPAPPV;PADPAPPVEL;LAANDLPAPL;DLPAPLGEPL;LPAPLGEPLP;APLGEPLPAA;LPAAPADPAP;APPADLAPPA;DLAPPAPADV;DVAPPVELAV;LAVNDLPAPL;DLPAPLGEPL;LPAPLGEPLP;APLGEPLPAA;LPAAPADPAP;APPADLAPPA;DLAPPAPADL;DLAPPAPADL;DLAPPAPADL;DLAPPVELAV;LAVNDLPAPL;DLPAPLGEPL;LPAPLGEPLP;APLGEPLPAA;EPLPAAPAEL;PLPAAPAELA;LPAAPAELAP;AAPAELAPPA;AELAPPADLA;LAPPADLAPA;PPADLAPASA;DLAPASADLA;DLAPPAPADL;DLAPPAPAEL;ELAPPAPADL;APADLAPPAA;PADLAPPAAV;QPATAPGGPV;ATAPGGPVGL;APGGPVGLAT;ELPEPDPQPA;TEAPAETPQV;ETPQVSNIAY;QVSNIAYTKK;AYTKKLWQAI;YTKKLWQAIR;AQDVCGNDAL;DALDSLAQPY;ALDSLAQPYV<br>11mer | |

Fig. 30 continued

| | | |
|---|---|---|
| | TTSNVSVAKIA;TSNVSVAKIAF;SVAKIAFTGAV;FTGAVLGGGGI;GAVLGGGGIAM;AVLGGGGIAMA;VLGGGGIAMAA;GIAMAAQATAA;IAMAAQATAAT;TAATDGEWDQV;AATDGEWDQVA;QVARCESGGNW;YLGGLQFTQST;GLQFTQSTWAA;LQFTQSTWAAH;STWAAHGGGEF;GEFAPSAQLAS;EFAPSAQLASR;AQLASREQQIA;QLASREQQIAV;REQQIAVGERV;QQIAVGERVLA;RVLATQGRGAW;LATQGRGAWPV;QGRGAWPVCGR;WPVCGRGLSNA;GLSNATPREVL;TPREVLPASAA;EVLPASAAMDA;LPASAAMDAPL;AAMDAPLDAAA;AMDAPLDAAAV;AAAVNGEPAPL;AAVNGEPAPLA;APLAPPPADPA;APPPADPAPPV;PPADPAPPVEL;APPVELAANDL;ELAANDLPAPL;LPAPLGEPLPA;PLGEPLPAAPA;EPLPAAPADPA;LPAAPADPAPP;APADPAPPADL;PPADLAPPAPA;DLAPPAPADVA;PPAPADVAPPV;APADVAPPVEL;ELAVNDLPAPL;LPAPLGEPLPA;PLGEPLPAAPA;EPLPAAPADPA;LPAAPADPAPP;APADPAPPADL;PPADLAPPAPA;DLAPPAPADLA;APADLAPPAPA;DLAPPAPADLA;APADLAPPAPA;DLAPPAPADLA;APADLAPPVEL;ELAVNDLPAPL;LPAPLGEPLPA;PLGEPLPAAPA;GEPLPAAPAEL;EPLPAAPAELA;LPAAPAELAPP;APAELAPPADL;ELAPPADLAPA;APPADLAPASA;APASADLAPPA;ASADLAPPAPA;DLAPPAPADLA;APADLAPPAPA;DLAPPAPAELA;PPAPAELAPPA;APAELAPPAPA;AELAPPAPADL;ELAPPAPADLA;APADLAPPAAV;DLAPPAAVNEQ;QTAPGDQPATA;ATAPGGPVGLA;GPVGLATDLEL;QPADAPPPGDV;VTEAPAETPQV;APAETPQVSNI;AETPQVSNIAY;ETPQVSNIAYT;TPQVSNIAYTK;QVSNIAYTKKL;VSNIAYTKKLW;AYTKKLWQAIR;KLWQAIRAQDV;RAQDVCGNDAL;DVCGNDALDSL;NDALDSLAQPY;DALDSLAQPYV;ALDSLAQPYVI<br>13 mers:<br>MSGRHRKPTTSNV;SGRHRKPTTSNVS;GRHRKPTTSNVSV;RHRKPTTSNVSVA;HRKPTTSNVSVAK;RKPTTSNVSVAKI;KPTTSNVSVAKIA;PTTSNVSVAKIAF;TTSNVSVAKIAFT;TSNVSVAKIAFTG;SNVSVAKIAFTGA;NVSVAKIAFTGAV;VSVAKIAFTGAVL;SVAKIAFTGAVLG;VAKIAFTGAVLGG;AKIAFTGAVLGGG;KIAFTGAVLGGGG;IAFTGAVLGGGGI;AFTGAVLGGGGIA;FTGAVLGGGGIAM;TGAVLGGGGIAMA;GAVLGGGGIAMAA;AVLGGGGIAMAAQ;VLGGGGIAMAAQA;LGGGGIAMAAQAT;GGGGIAMAAQATA;GGGIAMAAQATAA;GGIAMAAQATAAT;GIAMAAQATAATD;IAMAAQATAATDG;AMAAQATAATDGE;MAAQATAATDGEW;AAQATAATDGEWD;AQATAATDGEWDQ;QATAATDGEWDQV;ATAATDGEWDQVA;TAATDGEWDQVAR;AATDGEWDQVARC;ATDGEWDQVARCE;TDGEWDQVARCES;DGEWDQVARCESG;GEWDQVARCESGG;EWDQVARCESGGN;WDQVARCESGGNW;DQVARCESGGNWS;QVARCESGGNWSI;VARCESGGNWSIN;ARCESGGNWSINT;RCESGGNWSINTG;CESGGNWSINTGN;ESGGNWSINTGNG;SGGNWSINTGNGY;GGNWSINTGNGYL;GNWSINTGNGYLG;NWSINTGNGYLGG;WSINTGNGYLGGL;SINTGNGYLGGLQ;INTGNGYLGGLQF;NTGNGYLGGLQFT;TGNGYLGGLQFTQ;GNGYLGGLQFTQS;NGYLGGLQFTQST;GYLGGLQFTQSTW;YLGGLQFTQSTWA;LGGLQFTQSTWAA;GGLQFTQSTWAAH;GLQFTQSTWAAHG;LQFTQSTWAAHGG;QFTQSTWAAHGGG;FTQSTWAAHGGGE;TQSTWAAHGGGEF;QSTWAAHGGGEFA;STWAAHGGGEFAP;TWAAHGGGEFAPS;WAAHGGGEFAPSA;AAHGGGEFAPSAQ;AHGGGEFAPSAQL;HGGGEFAPSAQLA;GGGEFAPSAQLAS;GGEFAPSAQLASR;GEFAPSAQLASRE;EFAPSAQLASREQ;FAPSAQLASREQQ;APSAQLASREQQI;PSAQLASREQQIA;SAQLASREQQIAV;AQLASREQQIAVG;QLASREQQIAVGE;LASREQQIAVGER;ASREQQIAVGERV;SREQQIAVGERVL;REQQIAVGERVLA;EQQIAVGERVLAT;QQIAVGERVLATQ;QIAVGERVLATQG;IAVGERVLATQGR;AVGERVLATQGRG;VGERVLATQGRGA;GERVLATQGRGAW;ERVLATQGRGAWP;RVLATQGRGAWPV;VLATQGRGAWPVC;LATQGRGAWPVCG;ATQGRGAWPVCGR;TQGRGAWPVCGRG;QGRGAWPVCGRGL;G | |

Fig. 30 continued

| | | |
|---|---|---|
| | RGAWPVCGRGLS;RGAWPVCGRGLSN;GAWPVCGRGLSNA;AWPVCGRGLSNAT;WPVCGRGLSNATP;PVCGRGLSNATPR;VCGRGLSNATPRE;CGRGLSNATPREV;GRGLSNATPREVL;RGLSNATPREVLP;GLSNATPREVLPA;LSNATPREVLPAS;SNATPREVLPASA;NATPREVLPASAA;ATPREVLPASAAM;TPREVLPASAAMD;PREVLPASAAMDA;REVLPASAAMDAP;EVLPASAAMDAPL;VLPASAAMDAPLD;LPASAAMDAPLDA;PASAAMDAPLDAA;ASAAMDAPLDAAA;SAAMDAPLDAAAV;AAMDAPLDAAAVN;AMDAPLDAAAVNG;MDAPLDAAAVNGE;DAPLDAAAVNGEP;APLDAAAVNGEPA;PLDAAAVNGEPAP;LDAAAVNGEPAPL;DAAAVNGEPAPLA;AAAVNGEPAPLAP;AAVNGEPAPLAPP;AVNGEPAPLAPPP;VNGEPAPLAPPPA;NGEPAPLAPPPAD;GEPAPLAPPPADP;EPAPLAPPPADPA;PAPLAPPPADPAP;APLAPPPADPAPP;PLAPPPADPAPPV;LAPPPADPAPPVE;APPPADPAPPVEL;PPPADPAPPVELA;PPADPAPPVELAA;PADPAPPVELAAN;ADPAPPVELAAND;DPAPPVELAANDL;PAPPVELAANDLP;APPVELAANDLPA;PPVELAANDLPAP;PVELAANDLPAPL;VELAANDLPAPLG;ELAANDLPAPLGE;LAANDLPAPLGEP;AANDLPAPLGEPL;ANDLPAPLGEPLP;NDLPAPLGEPLPA;DLPAPLGEPLPAA;LPAPLGEPLPAAP;PAPLGEPLPAAPA;APLGEPLPAAPAD;PLGEPLPAAPADP;LGEPLPAAPADPA;GEPLPAAPADPAP;EPLPAAPADPAPP;PLPAAPADPAPPA;LPAAPADPAPPAD;PAAPADPAPPADL;AAPADPAPPADLA;APADPAPPADLAP;PADPAPPADLAPP;ADPAPPADLAPPA;DPAPPADLAPPAP;PAPPADLAPPAPA;APPADLAPPAPAD;PPADLAPPAPADV;PADLAPPAPADVA;ADLAPPAPADVAP;DLAPPAPADVAPP;LAPPAPADVAPPV;APPAPADVAPPVE;PPAPADVAPPVEL;PAPADVAPPVELA;APADVAPPVELAV;PADVAPPVELAVN;ADVAPPVELAVND;DVAPPVELAVNDL;VAPPVELAVNDLP;APPVELAVNDLPA;PPVELAVNDLPAP;PVELAVNDLPAPL;VELAVNDLPAPLG;ELAVNDLPAPLGE;LAVNDLPAPLGEP;AVNDLPAPLGEPL;VNDLPAPLGEPLP;NDLPAPLGEPLPA;DLPAPLGEPLPAA;LPAPLGEPLPAAP;PAPLGEPLPAAPA;APLGEPLPAAPAD;PLGEPLPAAPADP;LGEPLPAAPADPA;GEPLPAAPADPAP;EPLPAAPADPAPP;PLPAAPADPAPPA;LPAAPADPAPPAD;PAAPADPAPPADL;AAPADPAPPADLA;APADPAPPADLAP;PADPAPPADLAPP;ADPAPPADLAPPA;DPAPPADLAPPAP;PAPPADLAPPAPA;APPADLAPPAPAD;PPADLAPPAPADL;PADLAPPAPADLA;ADLAPPAPADLAP;DLAPPAPADLAPP;LAPPAPADLAPPA;APPAPADLAPPAP;PPAPADLAPPAPA;PAPADLAPPAPAD;APADLAPPAPADL;PADLAPPAPADLA;ADLAPPAPADLAP;DLAPPAPADLAPP;LAPPAPADLAPPA;APPAPADLAPPAP;PPAPADLAPPAPA;PAPADLAPPAPAD;APADLAPPAPADL;PADLAPPAPADLA;ADLAPPAPADLAP;DLAPPAPADLAPP;LAPPAPADLAPPV;APPAPADLAPPVE;PPAPADLAPPVEL;PAPADLAPPVELA;APADLAPPVELAV;PADLAPPVELAVN;ADLAPPVELAVND;DLAPPVELAVNDL;LAPPVELAVNDLP;APPVELAVNDLPA;PPVELAVNDLPAP;PVELAVNDLPAPL;VELAVNDLPAPLG;ELAVNDLPAPLGE;LAVNDLPAPLGEP;AVNDLPAPLGEPL;VNDLPAPLGEPLP;NDLPAPLGEPLPA;DLPAPLGEPLPAA;LPAPLGEPLPAAP;PAPLGEPLPAAPA;APLGEPLPAAPAE;PLGEPLPAAPAEL;LGEPLPAAPAELA;GEPLPAAPAELAP;EPLPAAPAELAPP;PLPAAPAELAPPA;LPAAPAELAPPAD;PAAPAELAPPADL;AAPAELAPPADLA;APAELAPPADLAP;PAELAPPADLAPA;AELAPPADLAPAS;ELAPPADLAPASA;LAPPADLAPASAD;APPADLAPASADL;PPADLAPASADLA;PADLAPASADLAP;ADLAPASADLAPP;DLAPASADLAPPA;LAPASADLAPPAP;APASADLAPPAPA;PASADLAPPAPAD;ASADLAPPAPADL;SADLAPPAPADLA;ADLAPPAPADLAP;DLAPPAPADLAPP;LAPPAPADLAPPA;APPAPADLAPPAP;PPAPADLAPPAPA;PAPADLAPPAPAE;APADLAPPAPAEL;PADLAPPAPAELA;ADLAPPAPAELAP;DLAPPAPAELAPP;LAPPAPAELAPPA;APPAPAELAPPAP;PPAPAELAPPAPA;PAPAELAPPAPAD;APAELAPPAPADL;PAELAPPAPADLA;AELAPPAPADLAP;ELAPPAPADLAPP;LAPPAP | |

Fig. 30 continued

| | | |
|---|---|---|
| | ADLAPPA;APPAPADLAPPAA;PPAPADLAPPAAV;PAPADLAPPAAVN;APADLAPPAAVNE;PADLAPPAAVNEQ;ADLAPPAAVNEQT;DLAPPAAVNEQTA;LAPPAAVNEQTAP;APPAAVNEQTAPG;PPAAVNEQTAPGD;PAAVNEQTAPGDQ;AAVNEQTAPGDQP;AVNEQTAPGDQPA;VNEQTAPGDQPAT;NEQTAPGDQPATA;EQTAPGDQPATAP;QTAPGDQPATAPG;TAPGDQPATAPGG;APGDQPATAPGGP;PGDQPATAPGGPV;GDQPATAPGGPVG;DQPATAPGGPVGL;QPATAPGGPVGLA;PATAPGGPVGLAT;ATAPGGPVGLATD;TAPGGPVGLATDL;APGGPVGLATDLE;PGGPVGLATDLEL;GGPVGLATDLELP;GPVGLATDLELPE;PVGLATDLELPEP;VGLATDLELPEPD;GLATDLELPEPDP;LATDLELPEPDPQ;ATDLELPEPDPQP;TDLELPEPDPQPA;DLELPEPDPQPAD;LELPEPDPQPADA;ELPEPDPQPADAP;LPEPDPQPADAPP;PEPDPQPADAPPP;EPDPQPADAPPPG;PDPQPADAPPPGD;DPQPADAPPPGDV;PQPADAPPPGDVT;QPADAPPPGDVTE;PADAPPPGDVTEA;ADAPPPGDVTEAP;DAPPPGDVTEAPA;APPPGDVTEAPAE;PPPGDVTEAPAET;PPGDVTEAPAETP;PGDVTEAPAETPQ;GDVTEAPAETPQV;DVTEAPAETPQVS;VTEAPAETPQVSN;TEAPAETPQVSNI;EAPAETPQVSNIA;APAETPQVSNIAY;PAETPQVSNIAYT;AETPQVSNIAYTK;ETPQVSNIAYTKK;TPQVSNIAYTKKL;PQVSNIAYTKKLW;QVSNIAYTKKLWQ;VSNIAYTKKLWQA;SNIAYTKKLWQAI;NIAYTKKLWQAIR;IAYTKKLWQAIRA;AYTKKLWQAIRAQ;YTKKLWQAIRAQD;TKKLWQAIRAQDV;KKLWQAIRAQDVC;KLWQAIRAQDVCG;LWQAIRAQDVCGN;WQAIRAQDVCGND;QAIRAQDVCGNDA;AIRAQDVCGNDAL;IRAQDVCGNDALD;RAQDVCGNDALDS;AQDVCGNDALDSL;QDVCGNDALDSLA;DVCGNDALDSLAQ;VCGNDALDSLAQP;CGNDALDSLAQPY;GNDALDSLAQPYV;NDALDSLAQPYVI;DALDSLAQPYVIG;<br><br>14 mers:<br>MSGRHRKPTTSNVS;SGRHRKPTTSNVSV;GRHRKPTTSNVSVA;RHRKPTTSNVSVAK;HRKPTTSNVSVAKI;RKPTTSNVSVAKIA;KPTTSNVSVAKIAF;PTTSNVSVAKIAFT;TTSNVSVAKIAFTG;TSNVSVAKIAFTGA;SNVSVAKIAFTGAV;NVSVAKIAFTGAVL;VSVAKIAFTGAVLG;SVAKIAFTGAVLGG;VAKIAFTGAVLGGG;AKIAFTGAVLGGGG;KIAFTGAVLGGGGI;IAFTGAVLGGGGIA;AFTGAVLGGGGIAM;FTGAVLGGGGIAMA;TGAVLGGGGIAMAA;GAVLGGGGIAMAAQ;AVLGGGGIAMAAQA;VLGGGGIAMAAQAT;LGGGGIAMAAQATA;GGGGIAMAAQATAA;GGGIAMAAQATAAT;GGIAMAAQATAATD;GIAMAAQATAATDG;IAMAAQATAATDGE;AMAAQATAATDGEW;MAAQATAATDGEWD;AAQATAATDGEWDQ;AQATAATDGEWDQV;QATAATDGEWDQVA;ATAATDGEWDQVAR;TAATDGEWDQVARC;AATDGEWDQVARCE;ATDGEWDQVARCES;TDGEWDQVARCESG;DGEWDQVARCESGG;GEWDQVARCESGGN;EWDQVARCESGGNW;WDQVARCESGGNWS;DQVARCESGGNWSI;QVARCESGGNWSIN;VARCESGGNWSINT;ARCESGGNWSINTG;RCESGGNWSINTGN;CESGGNWSINTGNG;ESGGNWSINTGNGY;SGGNWSINTGNGYL;GGNWSINTGNGYLG;GNWSINTGNGYLGG;NWSINTGNGYLGGL;WSINTGNGYLGGLQ;SINTGNGYLGGLQF;INTGNGYLGGLQFT;NTGNGYLGGLQFTQ;TGNGYLGGLQFTQS;GNGYLGGLQFTQST;NGYLGGLQFTQSTW;GYLGGLQFTQSTWA;YLGGLQFTQSTWAA;LGGLQFTQSTWAAH;GGLQFTQSTWAAHG;GLQFTQSTWAAHGG;LQFTQSTWAAHGGG;QFTQSTWAAHGGGE;FTQSTWAAHGGGEF;TQSTWAAHGGGEFA;QSTWAAHGGGEFAP;STWAAHGGGEFAPS;TWAAHGGGEFAPSA;WAAHGGGEFAPSAQ;AAHGGGEFAPSAQL;AHGGGEFAPSAQLA;HGGGEFAPSAQLAS;GGGEFAPSAQLASR;GGEFAPSAQLASRE;GEFAPSAQLASREQ;EFAPSAQLASREQQ;FAPSAQLASREQQI;APSAQLASREQQIA;PSAQLASREQQIAV;SAQLASREQQIAVG;AQLASREQQIAVGE;QLASREQQIAVGER;LASREQQIAVGERV;ASREQQIAVGERVL;SREQQIAVGERVLA;REQQIAVGERVLAT;EQQI | |

Fig. 30 continued

| | | |
|---|---|---|
| | AVGERVLATQ;QQIAVGERVLATQG;QIAVGERVLATQGR;IAVGERVLATQ<br>GRG;AVGERVLATQGRGA;VGERVLATQGRGAW;GERVLATQGRGAWP;E<br>RVLATQGRGAWPV;RVLATQGRGAWPVC;VLATQGRGAWPVCG;LATQG<br>RGAWPVCGR;ATQGRGAWPVCGRG;TQGRGAWPVCGRGL;QGRGAWPV<br>CGRGLS;GRGAWPVCGRGLSN;RGAWPVCGRGLSNA;GAWPVCGRGLSN<br>AT;AWPVCGRGLSNATP;WPVCGRGLSNATPR;PVCGRGLSNATPRE;VCG<br>RGLSNATPREV;CGRGLSNATPREVL;GRGLSNATPREVLP;RGLSNATPRE<br>VLPA;GLSNATPREVLPAS;LSNATPREVLPASA;SNATPREVLPASAA;NAT<br>PREVLPASAAM;ATPREVLPASAAMD;TPREVLPASAAMDA;PREVLPASAA<br>MDAP;REVLPASAAMDAPL;EVLPASAAMDAPLD;VLPASAAMDAPLDA;LP<br>ASAAMDAPLDAA;PASAAMDAPLDAAA;ASAAMDAPLDAAAV;SAAMDAPL<br>DAAAVN;AAMDAPLDAAAVNG;AMDAPLDAAAVNGE;MDAPLDAAAVNGEP<br>;DAPLDAAAVNGEPA;APLDAAAVNGEPAP;PLDAAAVNGEPAPL;LDAAAV<br>NGEPAPLA;DAAAVNGEPAPLAP;AAAVNGEPAPLAPP;AAVNGEPAPLAPP<br>P;AVNGEPAPLAPPPA;VNGEPAPLAPPPAD;NGEPAPLAPPPADP;GEPAP<br>LAPPPADPA;EPAPLAPPPADPAP;PAPLAPPPADPAPP;APLAPPPADPAPP<br>V;PLAPPPADPAPPVE;LAPPPADPAPPVEL;APPPADPAPPVELA;PPPADP<br>APPVELAA;PPADPAPPVELAAN;PADPAPPVELAAND;ADPAPPVELAAND<br>L;DPAPPVELAANDLP;PAPPVELAANDLPA;APPVELAANDLPAP;PPVELAA<br>NDLPAPL;PVELAANDLPAPLG;VELAANDLPAPLGE;ELAANDLPAPLGEP;L<br>AANDLPAPLGEPL;AANDLPAPLGEPLP;ANDLPAPLGEPLPA;NDLPAPLGE<br>PLPAA;DLPAPLGEPLPAAP;LPAPLGEPLPAAPA;PAPLGEPLPAAPAD;APL<br>GEPLPAAPADP;PLGEPLPAAPADPA;LGEPLPAAPADPAP;GEPLPAAPAD<br>PAPP;EPLPAAPADPAPPA;PLPAAPADPAPPAD;LPAAPADPAPPADL;PAA<br>PADPAPPADLA;AAPADPAPPADLAP;APADPAPPADLAPP;PADPAPPADL<br>APPA;ADPAPPADLAPPAP;DPAPPADLAPPAPA;PAPPADLAPPAPAD;APP<br>ADLAPPAPADV;PPADLAPPAPADVA;PADLAPPAPADVAP;ADLAPPAPAD<br>VAPP;DLAPPAPADVAPPV;LAPPAPADVAPPVE;APPAPADVAPPVEL;PPA<br>PADVAPPVELA;PAPADVAPPVELAV;APADVAPPVELAVN;PADVAPPVELA<br>VND;ADVAPPVELAVNDL;DVAPPVELAVNDLP;VAPPVELAVNDLPA;APPV<br>ELAVNDLPAP;PPVELAVNDLPAPL;PVELAVNDLPAPLG;VELAVNDLPAPL<br>GE;ELAVNDLPAPLGEP;LAVNDLPAPLGEPL;AVNDLPAPLGEPLP;VNDLP<br>APLGEPLPA;NDLPAPLGEPLPAA;DLPAPLGEPLPAAP;LPAPLGEPLPAAP<br>A;PAPLGEPLPAAPAD;APLGEPLPAAPADP;PLGEPLPAAPADPA;LGEPLP<br>AAPADPAP;GEPLPAAPADPAPP;EPLPAAPADPAPPA;PLPAAPADPAPPA<br>D;LPAAPADPAPPADL;PAAPADPAPPADLA;AAPADPAPPADLAP;APADPA<br>PPADLAPP;PADPAPPADLAPPA;ADPAPPADLAPPAP;DPAPPADLAPPAP<br>A;PAPPADLAPPAPAD;APPADLAPPAPADL;PPADLAPPAPADLA;PADLAP<br>PAPADLAP;ADLAPPAPADLAPP;DLAPPAPADLAPPA;LAPPAPADLAPPAP;<br>APPAPADLAPPAPA;PPAPADLAPPAPAD;PAPADLAPPAPADL;APADLAPP<br>APADLA;PADLAPPAPADLAP;ADLAPPAPADLAPP;DLAPPAPADLAPPA;LA<br>PPAPADLAPPAP;APPAPADLAPPAPA;PPAPADLAPPAPAD;PAPADLAPPA<br>PADL;APADLAPPAPADLA;PADLAPPAPADLAP;ADLAPPAPADLAPP;DLAP<br>PAPADLAPPV;LAPPAPADLAPPVE;APPAPADLAPPVEL;PPAPADLAPPVE<br>LA;PAPADLAPPVELAV;APADLAPPVELAVN;PADLAPPVELAVND;ADLAPP<br>VELAVNDL;DLAPPVELAVNDLP;LAPPVELAVNDLPA;APPVELAVNDLPAP;<br>PPVELAVNDLPAPL;PVELAVNDLPAPLG;VELAVNDLPAPLGE;ELAVNDLP<br>APLGEP;LAVNDLPAPLGEPL;AVNDLPAPLGEPLP;VNDLPAPLGEPLPA;N<br>DLPAPLGEPLPAA;DLPAPLGEPLPAAP;LPAPLGEPLPAAPA;PAPLGEPLP<br>AAPAE;APLGEPLPAAPAEL;PLGEPLPAAPAELA;LGEPLPAAPAELAP;GEP<br>LPAAPAELAPP;EPLPAAPAELAPPA;PLPAAPAELAPPAD;LPAAPAELAPPA<br>DL;PAAPAELAPPADLA;AAPAELAPPADLAP;APAELAPPADLAPA;PAELAP<br>PADLAPAS;AELAPPADLAPASA;ELAPPADLAPASAD;LAPPADLAPASADL; | |

Fig. 30 continued

| | | |
|---|---|---|
| | APPADLAPASADLA;PPADLAPASADLAP;PADLAPASADLAPP;ADLAPASADLAPPA;DLAPASADLAPPAP;LAPASADLAPPAPA;APASADLAPPAPAD;PASADLAPPAPADL;ASADLAPPAPADLA;SADLAPPAPADLAP;ADLAPPAPADLAPP;DLAPPAPADLAPPA;LAPPAPADLAPPAP;APPAPADLAPPAPA;PPAPADLAPPAPAE;PAPADLAPPAPAEL;APADLAPPAPAELA;PADLAPPAPAELAP;ADLAPPAPAELAPP;DLAPPAPAELAPPA;LAPPAPAELAPPAP;APPAPAELAPPAPA;PPAPAELAPPAPAD;PAPAELAPPAPADL;APAELAPPAPADLA;PAELAPPAPADLAP;AELAPPAPADLAPP;ELAPPAPADLAPPA;LAPPAPADLAPPAA;APPAPADLAPPAAV;PPAPADLAPPAAVN;PAPADLAPPAAVNE;APADLAPPAAVNEQ;PADLAPPAAVNEQT;ADLAPPAAVNEQTA;DLAPPAAVNEQTAP;LAPPAAVNEQTAPG;APPAAVNEQTAPGD;PPAAVNEQTAPGDQ;PAAVNEQTAPGDQP;AAVNEQTAPGDQPA;AVNEQTAPGDQPAT;VNEQTAPGDQPATA;NEQTAPGDQPATAP;EQTAPGDQPATAPG;QTAPGDQPATAPGG;TAPGDQPATAPGGP;APGDQPATAPGGPV;PGDQPATAPGGPVG;GDQPATAPGGPVGL;DQPATAPGGPVGLA;QPATAPGGPVGLAT;PATAPGGPVGLATD;ATAPGGPVGLATDL;TAPGGPVGLATDLE;APGGPVGLATDLEL;PGGPVGLATDLELP;GGPVGLATDLELPE;GPVGLATDLELPEP;PVGLATDLELPEPD;VGLATDLELPEPDP;GLATDLELPEPDPQ;LATDLELPEPDPQP;ATDLELPEPDPQPA;TDLELPEPDPQPAD;DLELPEPDPQPADA;LELPEPDPQPADAP;ELPEPDPQPADAPP;LPEPDPQPADAPPP;PEPDPQPADAPPPG;EPDPQPADAPPPGD;PDPQPADAPPPGDV;DPQPADAPPPGDVT;PQPADAPPPGDVTE;QPADAPPPGDVTEA;PADAPPPGDVTEAP;ADAPPPGDVTEAPA;DAPPPGDVTEAPAE;APPPGDVTEAPAET;PPPGDVTEAPAETP;PPGDVTEAPAETPQ;PGDVTEAPAETPQV;GDVTEAPAETPQVS;DVTEAPAETPQVSN;VTEAPAETPQVSNI;TEAPAETPQVSNIA;EAPAETPQVSNIAY;APAETPQVSNIAYT;PAETPQVSNIAYTK;AETPQVSNIAYTKK;ETPQVSNIAYTKKL;TPQVSNIAYTKKLW;PQVSNIAYTKKLWQ;QVSNIAYTKKLWQA;VSNIAYTKKLWQAI;SNIAYTKKLWQAIR;NIAYTKKLWQAIRA;IAYTKKLWQAIRAQ;AYTKKLWQAIRAQD;YTKKLWQAIRAQDV;TKKLWQAIRAQDVC;KKLWQAIRAQDVCG;KLWQAIRAQDVCGN;LWQAIRAQDVCGND;WQAIRAQDVCGNDA;QAIRAQDVCGNDAL;AIRAQDVCGNDALD;IRAQDVCGNDALDS;RAQDVCGNDALDSL;AQDVCGNDALDSLA;QDVCGNDALDSLAQ;DVCGNDALDSLAQP;VCGNDALDSLAQPY;CGNDALDSLAQPYV;GNDALDSLAQPYVI;NDALDSLAQPYVIG;<br>15 mers:<br>MSGRHRKPTTSNVSV;SGRHRKPTTSNVSVA;GRHRKPTTSNVSVAK;RHRKPTTSNVSVAKI;HRKPTTSNVSVAKIA;RKPTTSNVSVAKIAF;KPTTSNVSVAKIAFT;PTTSNVSVAKIAFTG;TTSNVSVAKIAFTGA;TSNVSVAKIAFTGAV;SNVSVAKIAFTGAVL;NVSVAKIAFTGAVLG;VSVAKIAFTGAVLGG;SVAKIAFTGAVLGGG;VAKIAFTGAVLGGGG;AKIAFTGAVLGGGGI;KIAFTGAVLGGGGIA;IAFTGAVLGGGGIAM;AFTGAVLGGGGIAMA;FTGAVLGGGGIAMAA;TGAVLGGGGIAMAAQ;GAVLGGGGIAMAAQA;AVLGGGGIAMAAQAT;VLGGGGIAMAAQATA;LGGGGIAMAAQATAA;GGGGIAMAAQATAAT;GGGIAMAAQATAATD;GGIAMAAQATAATDG;GIAMAAQATAATDGE;IAMAAQATAATDGEW;AMAAQATAATDGEWD;MAAQATAATDGEWDQ;AAQATAATDGEWDQV;AQATAATDGEWDQVA;QATAATDGEWDQVAR;ATAATDGEWDQVARC;TAATDGEWDQVARCE;AATDGEWDQVARCES;ATDGEWDQVARCESG;TDGEWDQVARCESGG;DGEWDQVARCESGGN;GEWDQVARCESGGNW;EWDQVARCESGGNWS;WDQVARCESGGNWSI;DQVARCESGGNWSIN;QVARCESGGNWSINT;VARCESGGNWSINTG;ARCESGGNWSINTGN;RCESGGNWSINTGNG;CESGGNWSINTGNGY;ESGGNWSINTGNGYL;SGGNWSINTGNGYLG;GGNWSINTGNGYLGG;GNWSINTGNGYLGGL;NWSINTGNGYLGGLQ;WSINTGNGYLGGLQF;SINTGNGYLGGLQFT;INTGNGYLGGLQ | |

Fig. 30 continued

| | | |
|---|---|---|
| | FTQ;NTGNGYLGGLQFTQS;TGNGYLGGLQFTQST;GNGYLGGLQFTQSTW;NGYLGGLQFTQSTWA;GYLGGLQFTQSTWAA;YLGGLQFTQSTWAAH;LGGLQFTQSTWAAHG;GGLQFTQSTWAAHGG;GLQFTQSTWAAHGGG;LQFTQSTWAAHGGGE;QFTQSTWAAHGGGEF;FTQSTWAAHGGGEFA;TQSTWAAHGGGEFAP;QSTWAAHGGGEFAPS;STWAAHGGGEFAPSA;TWAAHGGGEFAPSAQ;WAAHGGGEFAPSAQL;AAHGGGEFAPSAQLA;AHGGGEFAPSAQLAS;HGGGEFAPSAQLASR;GGGEFAPSAQLASRE;GGEFAPSAQLASREQ;GEFAPSAQLASREQQ;EFAPSAQLASREQQI;FAPSAQLASREQQIA;APSAQLASREQQIAV;PSAQLASREQQIAVG;SAQLASREQQIAVGE;AQLASREQQIAVGER;QLASREQQIAVGERV;LASREQQIAVGERVL;ASREQQIAVGERVLA;SREQQIAVGERVLAT;REQQIAVGERVLATQ;EQQIAVGERVLATQG;QQIAVGERVLATQGR;QIAVGERVLATQGRG;IAVGERVLATQGRGA;AVGERVLATQGRGAW;VGERVLATQGRGAWP;GERVLATQGRGAWPV;ERVLATQGRGAWPVC;RVLATQGRGAWPVCG;VLATQGRGAWPVCGR;LATQGRGAWPVCGRG;ATQGRGAWPVCGRGL;TQGRGAWPVCGRGLS;QGRGAWPVCGRGLSN;GRGAWPVCGRGLSNA;RGAWPVCGRGLSNAT;GAWPVCGRGLSNATP;AWPVCGRGLSNATPR;WPVCGRGLSNATPRE;PVCGRGLSNATPREV;VCGRGLSNATPREVL;CGRGLSNATPREVLP;GRGLSNATPREVLPA;RGLSNATPREVLPAS;GLSNATPREVLPASA;LSNATPREVLPASAA;SNATPREVLPASAAM;NATPREVLPASAAMD;ATPREVLPASAAMDA;TPREVLPASAAMDAP;PREVLPASAAMDAPL;REVLPASAAMDAPLD;EVLPASAAMDAPLDA;VLPASAAMDAPLDAA;LPASAAMDAPLDAAA;PASAAMDAPLDAAAV;ASAAMDAPLDAAAVN;SAAMDAPLDAAAVNG;AAMDAPLDAAAVNGE;AMDAPLDAAAVNGEP;MDAPLDAAAVNGEPA;DAPLDAAAVNGEPAP;APLDAAAVNGEPAPL;PLDAAAVNGEPAPLA;LDAAAVNGEPAPLAP;DAAAVNGEPAPLAPP;AAAVNGEPAPLAPPP;AAVNGEPAPLAPPPA;AVNGEPAPLAPPPAD;VNGEPAPLAPPPADP;NGEPAPLAPPPADPA;GEPAPLAPPPADPAP;EPAPLAPPPADPAPP;PAPLAPPPADPAPPV;APLAPPPADPAPPVE;PLAPPPADPAPPVEL;LAPPPADPAPPVELA;APPPADPAPPVELAA;PPPADPAPPVELAAN;PPADPAPPVELAAND;PADPAPPVELAANDL;ADPAPPVELAANDLP;DPAPPVELAANDLPA;PAPPVELAANDLPAP;APPVELAANDLPAPL;PPVELAANDLPAPLG;PVELAANDLPAPLGE;VELAANDLPAPLGEP;ELAANDLPAPLGEPL;LAANDLPAPLGEPLP;AANDLPAPLGEPLPA;ANDLPAPLGEPLPAA;NDLPAPLGEPLPAAP;DLPAPLGEPLPAAPA;LPAPLGEPLPAAPAD;PAPLGEPLPAAPADP;APLGEPLPAAPADPA;PLGEPLPAAPADPAP;LGEPLPAAPADPAPP;GEPLPAAPADPAPPA;EPLPAAPADPAPPAD;PLPAAPADPAPPADL;LPAAPADPAPPADLA;PAAPADPAPPADLAP;AAPADPAPPADLAPP;APADPAPPADLAPPA;PADPAPPADLAPPAP;ADPAPPADLAPPAPA;DPAPPADLAPPAPAD;PAPPADLAPPAPADV;APPADLAPPAPADVA;PPADLAPPAPADVAP;PADLAPPAPADVAPP;ADLAPPAPADVAPPV;DLAPPAPADVAPPVE;LAPPAPADVAPPVEL;APPAPADVAPPVELA;PPAPADVAPPVELAV;PAPADVAPPVELAVN;APADVAPPVELAVND;PADVAPPVELAVNDL;ADVAPPVELAVNDLP;DVAPPVELAVNDLPA;VAPPVELAVNDLPAP;APPVELAVNDLPAPL;PPVELAVNDLPAPLG;PVELAVNDLPAPLGE;VELAVNDLPAPLGEP;ELAVNDLPAPLGEPL;LAVNDLPAPLGEPLP;AVNDLPAPLGEPLPA;VNDLPAPLGEPLPAA;NDLPAPLGEPLPAAP;DLPAPLGEPLPAAPA;LPAPLGEPLPAAPAD;PAPLGEPLPAAPADP;APLGEPLPAAPADPA;PLGEPLPAAPADPAP;LGEPLPAAPADPAPP;GEPLPAAPADPAPPA;EPLPAAPADPAPPAD;PLPAAPADPAPPADL;LPAAPADPAPPADLA;PAAPADPAPPADLAP;AAPADPAPPADLAPP;APADPAPPADLAPPA;PADPAPPADLAPPAP;ADPAPPADLAPPAPA;DPAPPADLAPPAPAD;PAPPADLAPPAPADL;APPADLAPPAPADLA;PPADLAPPAPADLAP;PADLAPPAPADLAPP;ADLAPPAPADLAPPA;DLAPPAPADLAPPAP;LAPPAPADLAPPAPA;APPAPADLAPPAPAD;PPAPADLA | |

Fig. 30 continued

| | | |
|---|---|---|
| | PPAPADL;PAPADLAPPAPADLA;APADLAPPAPADLAP;PADLAPPAPADLA<br>PP;ADLAPPAPADLAPPA;DLAPPAPADLAPPAP;LAPPAPADLAPPAPA;AP<br>PAPADLAPPAPAD;PPAPADLAPPAPADL;PAPADLAPPAPADLA;APADLAP<br>PAPADLAP;PADLAPPAPADLAPP;ADLAPPAPADLAPPV;DLAPPAPADLAP<br>PVE;LAPPAPADLAPPVEL;APPAPADLAPPVELA;PPAPADLAPPVELAV;PA<br>PADLAPPVELAVN;APADLAPPVELAVND;PADLAPPVELAVNDL;ADLAPPV<br>ELAVNDLP;DLAPPVELAVNDLPA;LAPPVELAVNDLPAP;APPVELAVNDLP<br>APL;PPVELAVNDLPAPLG;PVELAVNDLPAPLGE;VELAVNDLPAPLGEP;EL<br>AVNDLPAPLGEPL;LAVNDLPAPLGEPLP;AVNDLPAPLGEPLPA;VNDLPAP<br>LGEPLPAA;NDLPAPLGEPLPAAP;DLPAPLGEPLPAAPA;LPAPLGEPLPAA<br>PAE;PAPLGEPLPAAPAEL;APLGEPLPAAPAELA;PLGEPLPAAPAELAP;LG<br>EPLPAAPAELAPP;GEPLPAAPAELAPPA;EPLPAAPAELAPPAD;PLPAAPA<br>ELAPPADL;LPAAPAELAPPADLA;PAAPAELAPPADLAP;AAPAELAPPADL<br>APA;APAELAPPADLAPAS;PAELAPPADLAPASA;AELAPPADLAPASAD;EL<br>APPADLAPASADL;LAPPADLAPASADLA;APPADLAPASADLAP;PPADLAP<br>ASADLAPP;PADLAPASADLAPPA;ADLAPASADLAPPAP;DLAPASADLAPP<br>APA;LAPASADLAPPAPAD;APASADLAPPAPADL;PASADLAPPAPADLA;A<br>SADLAPPAPADLAP;SADLAPPAPADLAPP;ADLAPPAPADLAPPA;DLAPPA<br>PADLAPPAP;LAPPAPADLAPPAPA;APPAPADLAPPAPAE;PPAPADLAPPA<br>PAEL;PAPADLAPPAPAELA;APADLAPPAPAELAP;PADLAPPAPAELAPP;A<br>DLAPPAPAELAPPA;DLAPPAPAELAPPAP;LAPPAPAELAPPAPA;APPAPA<br>ELAPPAPAD;PPAPAELAPPAPADL;PAPAELAPPAPADLA;APAELAPPAPA<br>DLAP;PAELAPPAPADLAPP;AELAPPAPADLAPPA;ELAPPAPADLAPPAA;L<br>APPAPADLAPPAAV;APPAPADLAPPAAVN;PPAPADLAPPAAVNE;PAPAD<br>LAPPAAVNEQ;APADLAPPAAVNEQT;PADLAPPAAVNEQTA;ADLAPPAAV<br>NEQTAP;DLAPPAAVNEQTAPG;LAPPAAVNEQTAPGD;APPAAVNEQTAP<br>GDQ;PPAAVNEQTAPGDQP;PAAVNEQTAPGDQPA;AAVNEQTAPGDQPA<br>T;AVNEQTAPGDQPATA;VNEQTAPGDQPATAP;NEQTAPGDQPATAPG;E<br>QTAPGDQPATAPGG;QTAPGDQPATAPGGP;TAPGDQPATAPGGPV;APG<br>DQPATAPGGPVG;PGDQPATAPGGPVGL;GDQPATAPGGPVGLA;DQPAT<br>APGGPVGLAT;QPATAPGGPVGLATD;PATAPGGPVGLATDL;ATAPGGPV<br>GLATDLE;TAPGGPVGLATDLEL;APGGPVGLATDLELP;PGGPVGLATDLEL<br>PE;GGPVGLATDLELPEP;GPVGLATDLELPEPD;PVGLATDLELPEPDP;VG<br>LATDLELPEPDPQ;GLATDLELPEPDPQP;LATDLELPEPDPQPA;ATDLELP<br>EPDPQPAD;TDLELPEPDPQPADA;DLELPEPDPQPADAP;LELPEPDPQPA<br>DAPP;ELPEPDPQPADAPPP;LPEPDPQPADAPPPG;PEPDPQPADAPPPG<br>D;EPDPQPADAPPPGDV;PDPQPADAPPPGDVT;DPQPADAPPPGDVTE;P<br>QPADAPPPGDVTEA;QPADAPPPGDVTEAP;PADAPPPGDVTEAPA;ADAP<br>PPGDVTEAPAE;DAPPPGDVTEAPAET;APPPGDVTEAPAETP;PPPGDVTE<br>APAETPQ;PPGDVTEAPAETPQV;PGDVTEAPAETPQVS;GDVTEAPAETP<br>QVSN;DVTEAPAETPQVSNI;VTEAPAETPQVSNIA;TEAPAETPQVSNIAY;E<br>APAETPQVSNIAYT;APAETPQVSNIAYTK;PAETPQVSNIAYTKK;AETPQVS<br>NIAYTKKL;ETPQVSNIAYTKKLW;TPQVSNIAYTKKLWQ;PQVSNIAYTKKLW<br>QA;QVSNIAYTKKLWQAI;VSNIAYTKKLWQAIR;SNIAYTKKLWQAIRA;NIAY<br>TKKLWQAIRAQ;IAYTKKLWQAIRAQD;AYTKKLWQAIRAQDV;YTKKLWQAI<br>RAQDVC;TKKLWQAIRAQDVCG;KKLWQAIRAQDVCGN;KLWQAIRAQDVC<br>GND;LWQAIRAQDVCGNDA;WQAIRAQDVCGNDAL;QAIRAQDVCGNDALD<br>;AIRAQDVCGNDALDS;IRAQDVCGNDALDSL;RAQDVCGNDALDSLA;AQD<br>VCGNDALDSLAQ;QDVCGNDALDSLAQP;DVCGNDALDSLAQPY;VCGNDA<br>LDSLAQPYV;CGNDALDSLAQPYVI;GNDALDSLAQPYVIG;<br>16 mers:<br>MSGRHRKPTTSNVSVA;SGRHRKPTTSNVSVAK;GRHRKPTTSNVSVAKI;R<br>HRKPTTSNVSVAKIA;HRKPTTSNVSVAKIAF;RKPTTSNVSVAKIAFT;KPTT | |

Fig. 30 continued

| | | |
|---|---|---|
| | SNVSVAKIAFTG;PTTSNVSVAKIAFTGA;TTSNVSVAKIAFTGAV;TSNVSVAKIAFTGAVL;SNVSVAKIAFTGAVLG;NVSVAKIAFTGAVLGG;VSVAKIAFTGAVLGGG;SVAKIAFTGAVLGGGG;VAKIAFTGAVLGGGGI;AKIAFTGAVLGGGGIA;KIAFTGAVLGGGGIAM;IAFTGAVLGGGGIAMA;AFTGAVLGGGGIAMAA;FTGAVLGGGGIAMAAQ;TGAVLGGGGIAMAAQA;GAVLGGGGIAMAAQAT;AVLGGGGIAMAAQATA;VLGGGGIAMAAQATAA;LGGGGIAMAAQATAAT;GGGGIAMAAQATAATD;GGGIAMAAQATAATDG;GGIAMAAQATAATDGE;GIAMAAQATAATDGEW;IAMAAQATAATDGEWD;AMAAQATAATDGEWDQ;MAAQATAATDGEWDQV;AAQATAATDGEWDQVA;AQATAATDGEWDQVAR;QATAATDGEWDQVARC;ATAATDGEWDQVARCE;TAATDGEWDQVARCES;AATDGEWDQVARCESG;ATDGEWDQVARCESGG;TDGEWDQVARCESGGN;DGEWDQVARCESGGNW;GEWDQVARCESGGNWS;EWDQVARCESGGNWSI;WDQVARCESGGNWSIN;DQVARCESGGNWSINT;QVARCESGGNWSINTG;VARCESGGNWSINTGN;ARCESGGNWSINTGNG;RCESGGNWSINTGNGY;CESGGNWSINTGNGYL;ESGGNWSINTGNGYLG;SGGNWSINTGNGYLGG;GGNWSINTGNGYLGGL;GNWSINTGNGYLGGLQ;NWSINTGNGYLGGLQF;WSINTGNGYLGGLQFT;SINTGNGYLGGLQFTQ;INTGNGYLGGLQFTQS;NTGNGYLGGLQFTQST;TGNGYLGGLQFTQSTW;GNGYLGGLQFTQSTWA;NGYLGGLQFTQSTWAA;GYLGGLQFTQSTWAAH;YLGGLQFTQSTWAAHG;LGGLQFTQSTWAAHGG;GGLQFTQSTWAAHGGG;GLQFTQSTWAAHGGGE;LQFTQSTWAAHGGGEF;QFTQSTWAAHGGGEFA;FTQSTWAAHGGGEFAP;TQSTWAAHGGGEFAPS;QSTWAAHGGGEFAPSA;STWAAHGGGEFAPSAQ;TWAAHGGGEFAPSAQL;WAAHGGGEFAPSAQLA;AAHGGGEFAPSAQLAS;AHGGGEFAPSAQLASR;HGGGEFAPSAQLASRE;GGGEFAPSAQLASREQ;GGEFAPSAQLASREQQ;GEFAPSAQLASREQQI;EFAPSAQLASREQQIA;FAPSAQLASREQQIAV;APSAQLASREQQIAVG;PSAQLASREQQIAVGE;SAQLASREQQIAVGER;AQLASREQQIAVGERV;QLASREQQIAVGERVL;LASREQQIAVGERVLA;ASREQQIAVGERVLAT;SREQQIAVGERVLATQ;REQQIAVGERVLATQG;EQQIAVGERVLATQGR;QQIAVGERVLATQGRG;QIAVGERVLATQGRGA;IAVGERVLATQGRGAW;AVGERVLATQGRGAWP;VGERVLATQGRGAWPV;GERVLATQGRGAWPVC;ERVLATQGRGAWPVCG;RVLATQGRGAWPVCGR;VLATQGRGAWPVCGRG;LATQGRGAWPVCGRGL;ATQGRGAWPVCGRGLS;TQGRGAWPVCGRGLSN;QGRGAWPVCGRGLSNA;GRGAWPVCGRGLSNAT;RGAWPVCGRGLSNATP;GAWPVCGRGLSNATPR;AWPVCGRGLSNATPRE;WPVCGRGLSNATPREV;PVCGRGLSNATPREVL;VCGRGLSNATPREVLP;CGRGLSNATPREVLPA;GRGLSNATPREVLPAS;RGLSNATPREVLPASA;GLSNATPREVLPASAA;LSNATPREVLPASAAM;SNATPREVLPASAAMD;NATPREVLPASAAMDA;ATPREVLPASAAMDAP;TPREVLPASAAMDAPL;PREVLPASAAMDAPLD;REVLPASAAMDAPLDA;EVLPASAAMDAPLDAA;VLPASAAMDAPLDAAA;LPASAAMDAPLDAAAV;PASAAMDAPLDAAAVN;ASAAMDAPLDAAAVNG;SAAMDAPLDAAAVNGE;AAMDAPLDAAAVNGEP;AMDAPLDAAAVNGEPA;MDAPLDAAAVNGEPAP;DAPLDAAAVNGEPAPL;APLDAAAVNGEPAPLA;PLDAAAVNGEPAPLAP;LDAAAVNGEPAPLAPP;DAAAVNGEPAPLAPPP;AAAVNGEPAPLAPPPA;AAVNGEPAPLAPPPAD;AVNGEPAPLAPPPADP;VNGEPAPLAPPPADPA;NGEPAPLAPPPADPAP;GEPAPLAPPPADPAPP;EPAPLAPPPADPAPPV;PAPLAPPPADPAPPVE;APLAPPPADPAPPVEL;PLAPPPADPAPPVELA;LAPPPADPAPPVELAA;APPPADPAPPVELAAN;PPPADPAPPVELAAND;PPADPAPPVELAANDL;PADPAPPVELAANDLP;ADPAPPVELAANDLPA;DPAPPVELAANDLPAP;PAPPVELAANDLPAPL;APPVELAANDLPAPLG;PPVELAANDLPAPLGE;PVELAANDLPAPLGEP;VELAANDLPAPLGEPL;ELAANDLPAPLGEPLP;LAANDLPAPLGEPLPA;AANDLPAPLGEPLPAA;ANDLPAPLGEPLPAAP;NDLPAPLGEPLPAAPA;DLPAPLGEPL | |

Fig. 30 continued

| | | |
|---|---|---|
| | PAAPAD;LPAPLGEPLPAAPADP;PAPLGEPLPAAPADPA;APLGEPLPAAPA<br>DPAP;PLGEPLPAAPADPAPP;LGEPLPAAPADPAPPA;GEPLPAAPADPAP<br>PAD;EPLPAAPADPAPPADL;PLPAAPADPAPPADLA;LPAAPADPAPPADLA<br>P;PAAPADPAPPADLAPP;AAPADPAPPADLAPPA;APADPAPPADLAPPAP;<br>PADPAPPADLAPPAPA;ADPAPPADLAPPAPAD;DPAPPADLAPPAPADV;P<br>APPADLAPPAPADVA;APPADLAPPAPADVAP;PPADLAPPAPADVAPP;PA<br>DLAPPAPADVAPPV;ADLAPPAPADVAPPVE;DLAPPAPADVAPPVEL;LAPP<br>APADVAPPVELA;APPAPADVAPPVELAV;PPAPADVAPPVELAVN;PAPAD<br>VAPPVELAVND;APADVAPPVELAVNDL;PADVAPPVELAVNDLP;ADVAPP<br>VELAVNDLPA;DVAPPVELAVNDLPAP;VAPPVELAVNDLPAPL;APPVELAV<br>NDLPAPLG;PPVELAVNDLPAPLGE;PVELAVNDLPAPLGEP;VELAVNDLPA<br>PLGEPL;ELAVNDLPAPLGEPLP;LAVNDLPAPLGEPLPA;AVNDLPAPLGEP<br>LPAA;VNDLPAPLGEPLPAAP;NDLPAPLGEPLPAAPA;DLPAPLGEPLPAAP<br>AD;LPAPLGEPLPAAPADP;PAPLGEPLPAAPADPA;APLGEPLPAAPADPAP<br>;PLGEPLPAAPADPAPP;LGEPLPAAPADPAPPA;GEPLPAAPADPAPPAD;E<br>PLPAAPADPAPPADL;PLPAAPADPAPPADLA;LPAAPADPAPPADLAP;PAA<br>PADPAPPADLAPP;AAPADPAPPADLAPPA;APADPAPPADLAPPAP;PADP<br>APPADLAPPAPA;ADPAPPADLAPPAPAD;DPAPPADLAPPAPADL;PAPPA<br>DLAPPAPADLA;APPADLAPPAPADLAP;PPADLAPPAPADLAPP;PADLAPP<br>APADLAPPA;ADLAPPAPADLAPPAP;DLAPPAPADLAPPAPA;LAPPAPADL<br>APPAPAD;APPAPADLAPPAPADL;PPAPADLAPPAPADLA;PAPADLAPPAP<br>ADLAP;APADLAPPAPADLAPP;PADLAPPAPADLAPPA;ADLAPPAPADLAP<br>PAP;DLAPPAPADLAPPAPA;LAPPAPADLAPPAPAD;APPAPADLAPPAPAD<br>L;PPAPADLAPPAPADLA;PAPADLAPPAPADLAP;APADLAPPAPADLAPP;P<br>ADLAPPAPADLAPPV;ADLAPPAPADLAPPVE;DLAPPAPADLAPPVEL;LAP<br>PAPADLAPPVELA;APPAPADLAPPVELAV;PPAPADLAPPVELAVN;PAPAD<br>LAPPVELAVND;APADLAPPVELAVNDL;PADLAPPVELAVNDLP;ADLAPPV<br>ELAVNDLPA;DLAPPVELAVNDLPAP;LAPPVELAVNDLPAPL;APPVELAVN<br>DLPAPLG;PPVELAVNDLPAPLGE;PVELAVNDLPAPLGEP;VELAVNDLPAP<br>LGEPL;ELAVNDLPAPLGEPLP;LAVNDLPAPLGEPLPA;AVNDLPAPLGEPL<br>PAA;VNDLPAPLGEPLPAAP;NDLPAPLGEPLPAAPA;DLPAPLGEPLPAAPA<br>E;LPAPLGEPLPAAPAEL;PAPLGEPLPAAPAELA;APLGEPLPAAPAELAP;P<br>LGEPLPAAPAELAPP;LGEPLPAAPAELAPPA;GEPLPAAPAELAPPAD;EPL<br>PAAPAELAPPADL;PLPAAPAELAPPADLA;LPAAPAELAPPADLAP;PAAPA<br>ELAPPADLAPA;AAPAELAPPADLAPAS;APAELAPPADLAPASA;PAELAPP<br>ADLAPASAD;AELAPPADLAPASADL;ELAPPADLAPASADLA;LAPPADLAP<br>ASADLAP;APPADLAPASADLAPP;PPADLAPASADLAPPA;PADLAPASADL<br>APPAP;ADLAPASADLAPPAPA;DLAPASADLAPPAPAD;LAPASADLAPPAP<br>ADL;APASADLAPPAPADLA;PASADLAPPAPADLAP;ASADLAPPAPADLAP<br>P;SADLAPPAPADLAPPA;ADLAPPAPADLAPPAP;DLAPPAPADLAPPAPA;L<br>APPAPADLAPPAPAE;APPAPADLAPPAPAEL;PPAPADLAPPAPAELA;PAP<br>ADLAPPAPAELAP;APADLAPPAPAELAPP;PADLAPPAPAELAPPA;ADLAP<br>PAPAELAPPAP;DLAPPAPAELAPPAPA;LAPPAPAELAPPAPAD;APPAPAE<br>LAPPAPADL;PPAPAELAPPAPADLA;PAPAELAPPAPADLAP;APAELAPPA<br>PADLAPP;PAELAPPAPADLAPPA;AELAPPAPADLAPPAA;ELAPPAPADLA<br>PPAAV;LAPPAPADLAPPAAVN;APPAPADLAPPAAVNE;PPAPADLAPPAAV<br>NEQ;PAPADLAPPAAVNEQT;APADLAPPAAVNEQTA;PADLAPPAAVNEQT<br>AP;ADLAPPAAVNEQTAPG;DLAPPAAVNEQTAPGD;LAPPAAVNEQTAPG<br>DQ;APPAAVNEQTAPGDQP;PPAAVNEQTAPGDQPA;PAAVNEQTAPGDQ<br>PAT;AAVNEQTAPGDQPATA;AVNEQTAPGDQPATAP;VNEQTAPGDQPAT<br>APG;NEQTAPGDQPATAPGG;EQTAPGDQPATAPGGP;QTAPGDQPATAP<br>GGPV;TAPGDQPATAPGGPVG;APGDQPATAPGGPVGL;PGDQPATAPGG<br>PVGLA;GDQPATAPGGPVGLAT;DQPATAPGGPVGLATD;QPATAPGGPVG | |

Fig. 30 continued

| | | |
|---|---|---|
| | LATDL;PATAPGGPVGLATDLE;ATAPGGPVGLATDLEL;TAPGGPVGLATDLELP;APGGPVGLATDLELPE;PGGPVGLATDLELPEP;GGPVGLATDLELPEPD;GPVGLATDLELPEPDP;PVGLATDLELPEPDPQ;VGLATDLELPEPDPQP;GLATDLELPEPDPQPA;LATDLELPEPDPQPAD;ATDLELPEPDPQPADA;TDLELPEPDPQPADAP;DLELPEPDPQPADAPP;LELPEPDPQPADAPPP;ELPEPDPQPADAPPPG;LPEPDPQPADAPPPGD;PEPDPQPADAPPPGDV;EPDPQPADAPPPGDVT;PDPQPADAPPPGDVTE;DPQPADAPPPGDVTEA;PQPADAPPPGDVTEAP;QPADAPPPGDVTEAPA;PADAPPPGDVTEAPAE;ADAPPPGDVTEAPAET;DAPPPGDVTEAPAETP;APPPGDVTEAPAETPQ;PPPGDVTEAPAETPQV;PPGDVTEAPAETPQVS;PGDVTEAPAETPQVSN;GDVTEAPAETPQVSNI;DVTEAPAETPQVSNIA;VTEAPAETPQVSNIAY;TEAPAETPQVSNIAYT;EAPAETPQVSNIAYTK;APAETPQVSNIAYTKK;PAETPQVSNIAYTKKL;AETPQVSNIAYTKKLW;ETPQVSNIAYTKKLWQ;TPQVSNIAYTKKLWQA;PQVSNIAYTKKLWQAI;QVSNIAYTKKLWQAIR;VSNIAYTKKLWQAIRA;SNIAYTKKLWQAIRAQ;NIAYTKKLWQAIRAQD;IAYTKKLWQAIRAQDV;AYTKKLWQAIRAQDVC;YTKKLWQAIRAQDVCG;TKKLWQAIRAQDVCGN;KKLWQAIRAQDVCGND;KLWQAIRAQDVCGNDA;LWQAIRAQDVCGNDAL;WQAIRAQDVCGNDALD;QAIRAQDVCGNDALDS;AIRAQDVCGNDALDSL;IRAQDVCGNDALDSLA;RAQDVCGNDALDSLAQ;AQDVCGNDALDSLAQP;QDVCGNDALDSLAQPY;DVCGNDALDSLAQPYV;VCGNDALDSLAQPYVI;CGNDALDSLAQPYVIG | |
| 6 | **<NP_216547.1 heat shock protein hspX Rv2031c[Mycobacterium tuberculosis H37Rv>**<br>MATTLPVQRHPRSLFPEFSELFAAFPSFAGLRPTFDTRLMRLEDEMKEGRYEVRAELPGVDPDKDVDIMVRDGQLTIKAERTEQKDFDGRSEFAYGSFVRTVSLPVGADEDDIKATYDKGILTVSVAVSEGKPTEKHIQIRSTN<br><br>8mer<br>ATTLPVQR;LPVQRHPR;VQRHPRSL;HPRSLFPE;SLFPEFSE;LFPEFSEL;FPEFSELF;FSELFAAF;ELFAAFPS;LFAAFPSF;FAAFPSFA;AFPSFAGL;FPSFAGLR;FAGLRPTF;RPTFDTRL;PTFDTRLM;TFDTRLMR;DEMKEGRY;RYEVRAEL;GVDPDKDV;IMVRDGQL;QLTIKAER;KAERTEQK;EQKDFDGR;DFDGRSEF;SEFAYGSF;EFAYGSFV;FAYGSFVR;YGSFVRTV;SFVRTVSL;TVSLPVGA;DIKATYDK;ILTVSVAV;SVAVSEGK<br>9mer<br>MATTLPVQR;TLPVQRHPR;LPVQRHPRS;VQRHPRSLF;HPRSLFPEF;SLFPEFSEL;LFPEFSELF;FPEFSELFA;EFSELFAAF;SELFAAFPS;ELFAAFPSF;AAFPSFAGL;AFPSFAGLR;SFAGLRPTF;GLRPTFDTR;RPTFDTRLM;PTFDTRLMR;RLMRLEDEM;EMKEGRYEV;GRYEVRAEL;EVRAELPGV;ELPGVDPDK;DPDKDVDIM;MVRDGQLTI;GQLTIKAER;AERTEQKDF;SEFAYGSFV;EFAYGSFVR;FAYGSFVRT;AYGSFVRTV;FVRTVSLPV;RTVSLPVGA;DEDDIKATY;TYDKGILTV;GILTVSVAV;VSVAVSEGK;VSEGKPTEK;KPTEKHIQI<br>10mer<br>TTLPVQRHPR;LPVQRHPRSL;PVQRHPRSLF;RHPRSLFPEF;SLFPEFSELF;FPEFSELFAA;PEFSELFAAF;SELFAAFPSF;ELFAAFPSFA;FAAFPSFAGL;AAFPSFAGLR;FPSFAGLRPT;GLRPTFDTRL;RPTFDTRLMR;PTFDTRLMRL;RLMRLEDEMK;DEMKEGRYEV;EMKEGRYEVR;YEVRAELPGV;LPGVDPDKDV;GVDPDKDVDI;IMVRDGQLTI;MVRDGQLTIK;DGQLTIKAER;TIKAERTEQK;RTEQKDFDGR;DFDGRSEFAY;GRSEFAYGSF;SEFAYGSFVR;FAYGSFVRTV;YGSFVRTVSL;SFVRTVSLPV;LPVGADEDDI;ATYDKGILTV;TVSVAVSEGK;AVSEGKPTEK<br>11mer<br>ATTLPVQRHPR;TLPVQRHPRSL;LPVQRHPRSLF;RSLFPEFSELF;SLFPEF | 124122-124784 |

Fig. 30 continued

| | | |
|---|---|---|
| | SELFA;FPEFSELFAAF;FSELFAAFPSF;FAAFPSFAGLR;FPSFAGLRPTF;FAGLRPTFDTR;GLRPTFDTRLM;RPTFDTRLMRL;DTRLMRLEDEM;EMKEGRYEVRA;KEGRYEVRAEL;RAELPGVDPDK;ELPGVDPDKDV;IMVRDGQLTIK;MVRDGQLTIKA;LTIKAERTEQK;EQKDFDGRSEF;RSEFAYGSFVR;FAYGSFVRTVS;AYGSFVRTVSL;FVRTVSLPVGA;SLPVGADEDDI;GADEDDIKATY;DIKATYDKGIL;KATYDKGILTV;TYDKGILTVSV;LTVSVAVSEGK;VAVSEGKPTEK<br><br>13 mers:<br>MATTLPVQRHPRS;ATTLPVQRHPRSL;TTLPVQRHPRSLF;TLPVQRHPRSLFP;LPVQRHPRSLFPE;PVQRHPRSLFPEF;VQRHPRSLFPEFS;QRHPRSLFPEFSE;RHPRSLFPEFSEL;HPRSLFPEFSELF;PRSLFPEFSELFA;RSLFPEFSELFAA;SLFPEFSELFAAF;LFPEFSELFAAFP;FPEFSELFAAFPS;PEFSELFAAFPSF;EFSELFAAFPSFA;FSELFAAFPSFAG;SELFAAFPSFAGL;ELFAAFPSFAGLR;LFAAFPSFAGLRP;FAAFPSFAGLRPT;AAFPSFAGLRPTF;AFPSFAGLRPTFD;FPSFAGLRPTFDT;PSFAGLRPTFDTR;SFAGLRPTFDTRL;FAGLRPTFDTRLM;AGLRPTFDTRLMR;GLRPTFDTRLMRL;LRPTFDTRLMRLE;RPTFDTRLMRLED;PTFDTRLMRLEDE;TFDTRLMRLEDEM;FDTRLMRLEDEMK;DTRLMRLEDEMKE;TRLMRLEDEMKEG;RLMRLEDEMKEGR;LMRLEDEMKEGRY;MRLEDEMKEGRYE;RLEDEMKEGRYEV;LEDEMKEGRYEVR;EDEMKEGRYEVRA;DEMKEGRYEVRAE;EMKEGRYEVRAEL;MKEGRYEVRAELP;KEGRYEVRAELPG;EGRYEVRAELPGV;GRYEVRAELPGVD;RYEVRAELPGVDP;YEVRAELPGVDPD;EVRAELPGVDPDK;VRAELPGVDPDKD;RAELPGVDPDKDV;AELPGVDPDKDVD;ELPGVDPDKDVDI;LPGVDPDKDVDIM;PGVDPDKDVDIMV;GVDPDKDVDIMVR;VDPDKDVDIMVRD;DPDKDVDIMVRDG;PDKDVDIMVRDGQ;DKDVDIMVRDGQL;KDVDIMVRDGQLT;DVDIMVRDGQLTI;VDIMVRDGQLTIK;DIMVRDGQLTIKA;IMVRDGQLTIKAE;MVRDGQLTIKAER;VRDGQLTIKAERT;RDGQLTIKAERTE;DGQLTIKAERTEQ;GQLTIKAERTEQK;QLTIKAERTEQKD;LTIKAERTEQKDF;TIKAERTEQKDFD;IKAERTEQKDFDG;KAERTEQKDFDGR;AERTEQKDFDGRS;ERTEQKDFDGRSE;RTEQKDFDGRSEF;TEQKDFDGRSEFA;EQKDFDGRSEFAY;QKDFDGRSEFAYG;KDFDGRSEFAYGS;DFDGRSEFAYGSF;FDGRSEFAYGSFV;DGRSEFAYGSFVR;GRSEFAYGSFVRT;RSEFAYGSFVRTV;SEFAYGSFVRTVS;EFAYGSFVRTVSL;FAYGSFVRTVSLP;AYGSFVRTVSLPV;YGSFVRTVSLPVG;GSFVRTVSLPVGA;SFVRTVSLPVGAD;FVRTVSLPVGADE;VRTVSLPVGADED;RTVSLPVGADEDD;TVSLPVGADEDDI;VSLPVGADEDDIK;SLPVGADEDDIKA;LPVGADEDDIKAT;PVGADEDDIKATY;VGADEDDIKATYD;GADEDDIKATYDK;ADEDDIKATYDKG;DEDDIKATYDKGI;EDDIKATYDKGIL;DDIKATYDKGILT;DIKATYDKGILTV;IKATYDKGILTVS;KATYDKGILTVSV;ATYDKGILTVSVA;TYDKGILTVSVAV;YDKGILTVSVAVS;DKGILTVSVAVSE;KGILTVSVAVSEG;GILTVSVAVSEGK;ILTVSVAVSEGKP;LTVSVAVSEGKPT;TVSVAVSEGKPTE;VSVAVSEGKPTEK;SVAVSEGKPTEKH;VAVSEGKPTEKHI;AVSEGKPTEKHIQ;VSEGKPTEKHIQI;SEGKPTEKHIQIR;EGKPTEKHIQIRS;GKPTEKHIQIRST;KPTEKHIQIRSTN;<br>14 mers:<br>MATTLPVQRHPRSL;ATTLPVQRHPRSLF;TTLPVQRHPRSLFP;TLPVQRHPRSLFPE;LPVQRHPRSLFPEF;PVQRHPRSLFPEFS;VQRHPRSLFPEFSE;QRHPRSLFPEFSEL;RHPRSLFPEFSELF;HPRSLFPEFSELFA;PRSLFPEFSELFAA;RSLFPEFSELFAAF;SLFPEFSELFAAFP;LFPEFSELFAAFPS;FPEFSELFAAFPSF;PEFSELFAAFPSFA;EFSELFAAFPSFAG;FSELFAAFPSFAGL;SELFAAFPSFAGLR;ELFAAFPSFAGLRP;LFAAFPSFAGLRPT;FAAFPSFAGLRPTF;AAFPSFAGLRPTFD;AFPSFAGLRPTFDT;FPSFAGLRPTFDTR;PSFAGLRPTFDTRL;SFAGLRPTFDTRLM;FAGLRPTFDTRLMR;AGLRPTF | |

Fig. 30 continued

| | | |
|---|---|---|
| | DTRLMRL;GLRPTFDTRLMRLE;LRPTFDTRLMRLED;RPTFDTRLMRLEDE;PTFDTRLMRLEDEM;TFDTRLMRLEDEMK;FDTRLMRLEDEMKE;DTRLMRLEDEMKEG;TRLMRLEDEMKEGR;RLMRLEDEMKEGRY;LMRLEDEMKEGRYE;MRLEDEMKEGRYEV;RLEDEMKEGRYEVR;LEDEMKEGRYEVRA;EDEMKEGRYEVRAE;DEMKEGRYEVRAEL;EMKEGRYEVRAELP;MKEGRYEVRAELPG;KEGRYEVRAELPGV;EGRYEVRAELPGVD;GRYEVRAELPGVDP;RYEVRAELPGVDPD;YEVRAELPGVDPDK;EVRAELPGVDPDKD;VRAELPGVDPDKDV;RAELPGVDPDKDVD;AELPGVDPDKDVDI;ELPGVDPDKDVDIM;LPGVDPDKDVDIMV;PGVDPDKDVDIMVR;GVDPDKDVDIMVRD;VDPDKDVDIMVRDG;DPDKDVDIMVRDGQ;PDKDVDIMVRDGQL;DKDVDIMVRDGQLT;KDVDIMVRDGQLTI;DVDIMVRDGQLTIK;VDIMVRDGQLTIKA;DIMVRDGQLTIKAE;IMVRDGQLTIKAER;MVRDGQLTIKAERT;VRDGQLTIKAERTE;RDGQLTIKAERTEQ;DGQLTIKAERTEQK;GQLTIKAERTEQKD;QLTIKAERTEQKDF;LTIKAERTEQKDFD;TIKAERTEQKDFDG;IKAERTEQKDFDGR;KAERTEQKDFDGRS;AERTEQKDFDGRSE;ERTEQKDFDGRSEF;RTEQKDFDGRSEFA;TEQKDFDGRSEFAY;EQKDFDGRSEFAYG;QKDFDGRSEFAYGS;KDFDGRSEFAYGSF;DFDGRSEFAYGSFV;FDGRSEFAYGSFVR;DGRSEFAYGSFVRT;GRSEFAYGSFVRTV;RSEFAYGSFVRTVS;SEFAYGSFVRTVSL;EFAYGSFVRTVSLP;FAYGSFVRTVSLPV;AYGSFVRTVSLPVG;YGSFVRTVSLPVGA;GSFVRTVSLPVGAD;SFVRTVSLPVGADE;FVRTVSLPVGADED;VRTVSLPVGADEDD;RTVSLPVGADEDDI;TVSLPVGADEDDIK;VSLPVGADEDDIKA;SLPVGADEDDIKAT;LPVGADEDDIKATY;PVGADEDDIKATYD;VGADEDDIKATYDK;GADEDDIKATYDKG;ADEDDIKATYDKGI;DEDDIKATYDKGIL;EDDIKATYDKGILT;DDIKATYDKGILTV;DIKATYDKGILTVS;IKATYDKGILTVSV;KATYDKGILTVSVA;ATYDKGILTVSVAV;TYDKGILTVSVAVS;YDKGILTVSVAVSE;DKGILTVSVAVSEG;KGILTVSVAVSEGK;GILTVSVAVSEGKP;ILTVSVAVSEGKPT;LTVSVAVSEGKPTE;TVSVAVSEGKPTEK;VSVAVSEGKPTEKH;SVAVSEGKPTEKHI;VAVSEGKPTEKHIQ;AVSEGKPTEKHIQI;VSEGKPTEKHIQIR;SEGKPTEKHIQIRS;EGKPTEKHIQIRST;GKPTEKHIQIRSTN;<br>15 mers:<br>MATTLPVQRHPRSLF;ATTLPVQRHPRSLFP;TTLPVQRHPRSLFPE;TLPVQRHPRSLFPEF;LPVQRHPRSLFPEFS;PVQRHPRSLFPEFSE;VQRHPRSLFPEFSEL;QRHPRSLFPEFSELF;RHPRSLFPEFSELFA;HPRSLFPEFSELFAA;PRSLFPEFSELFAAF;RSLFPEFSELFAAFP;SLFPEFSELFAAFPS;LFPEFSELFAAFPSF;FPEFSELFAAFPSFA;PEFSELFAAFPSFAG;EFSELFAAFPSFAGL;FSELFAAFPSFAGLR;SELFAAFPSFAGLRP;ELFAAFPSFAGLRPT;LFAAFPSFAGLRPTF;FAAFPSFAGLRPTFD;AAFPSFAGLRPTFDT;AFPSFAGLRPTFDTR;FPSFAGLRPTFDTRL;PSFAGLRPTFDTRLM;SFAGLRPTFDTRLMR;FAGLRPTFDTRLMRL;AGLRPTFDTRLMRLE;GLRPTFDTRLMRLED;LRPTFDTRLMRLEDE;RPTFDTRLMRLEDEM;PTFDTRLMRLEDEMK;TFDTRLMRLEDEMKE;FDTRLMRLEDEMKEG;DTRLMRLEDEMKEGR;TRLMRLEDEMKEGRY;RLMRLEDEMKEGRYE;LMRLEDEMKEGRYEV;MRLEDEMKEGRYEVR;RLEDEMKEGRYEVRA;LEDEMKEGRYEVRAE;EDEMKEGRYEVRAEL;DEMKEGRYEVRAELP;EMKEGRYEVRAELPG;MKEGRYEVRAELPGV;KEGRYEVRAELPGVD;EGRYEVRAELPGVDP;GRYEVRAELPGVDPD;RYEVRAELPGVDPDK;YEVRAELPGVDPDKD;EVRAELPGVDPDKDV;VRAELPGVDPDKDVD;RAELPGVDPDKDVDI;AELPGVDPDKDVDIM;ELPGVDPDKDVDIMV;LPGVDPDKDVDIMVR;PGVDPDKDVDIMVRD;GVDPDKDVDIMVRDG;VDPDKDVDIMVRDGQ;DPDKDVDIMVRDGQL;PDKDVDIMVRDGQLT;DKDVDIMVRDGQLTI;KDVDIMVRDGQLTIK;DVDIMVRDGQLTIKA;VDIMVRDGQLTIKAE;DIMVRDGQLTIKAER;IMVRDGQLTIKAERT;MVRDGQLTIKAERTE;VRDGQLTIKAERTEQ;RDGQLTIKAERTEQK;DGQLTIKAERTEQKD;G | |

Fig. 30 continued

| | | |
|---|---|---|
| | QLTIKAERTEQKDF;QLTIKAERTEQKDFD;LTIKAERTEQKDFDG;TIKAERTEQKDFDGR;IKAERTEQKDFDGRS;KAERTEQKDFDGRSE;AERTEQKDFDGRSEF;ERTEQKDFDGRSEFA;RTEQKDFDGRSEFAY;TEQKDFDGRSEFAYG;EQKDFDGRSEFAYGS;QKDFDGRSEFAYGSF;KDFDGRSEFAYGSFV;DFDGRSEFAYGSFVR;FDGRSEFAYGSFVRT;DGRSEFAYGSFVRTV;GRSEFAYGSFVRTVS;RSEFAYGSFVRTVSL;SEFAYGSFVRTVSLP;EFAYGSFVRTVSLPV;FAYGSFVRTVSLPVG;AYGSFVRTVSLPVGA;YGSFVRTVSLPVGAD;GSFVRTVSLPVGADE;SFVRTVSLPVGADED;FVRTVSLPVGADEDD;VRTVSLPVGADEDDI;RTVSLPVGADEDDIK;TVSLPVGADEDDIKA;VSLPVGADEDDIKAT;SLPVGADEDDIKATY;LPVGADEDDIKATYD;PVGADEDDIKATYDK;VGADEDDIKATYDKG;GADEDDIKATYDKGI;ADEDDIKATYDKGIL;DEDDIKATYDKGILT;EDDIKATYDKGILTV;DDIKATYDKGILTVS;DIKATYDKGILTVSV;IKATYDKGILTVSVA;KATYDKGILTVSVAV;ATYDKGILTVSVAVS;TYDKGILTVSVAVSE;YDKGILTVSVAVSEG;DKGILTVSVAVSEGK;KGILTVSVAVSEGKP;GILTVSVAVSEGKPT;ILTVSVAVSEGKPTE;LTVSVAVSEGKPTEK;TVSVAVSEGKPTEKH;VSVAVSEGKPTEKHI;SVAVSEGKPTEKHIQ;VAVSEGKPTEKHIQI;AVSEGKPTEKHIQIR;VSEGKPTEKHIQIRS;SEGKPTEKHIQIRST;EGKPTEKHIQIRSTN;<br>16 mers:<br>MATTLPVQRHPRSLFP;ATTLPVQRHPRSLFPE;TTLPVQRHPRSLFPEF;TLPVQRHPRSLFPEFS;LPVQRHPRSLFPEFSE;PVQRHPRSLFPEFSEL;VQRHPRSLFPEFSELF;QRHPRSLFPEFSELFA;RHPRSLFPEFSELFAA;HPRSLFPEFSELFAAF;PRSLFPEFSELFAAFP;RSLFPEFSELFAAFPS;SLFPEFSELFAAFPSF;LFPEFSELFAAFPSFA;FPEFSELFAAFPSFAG;PEFSELFAAFPSFAGL;EFSELFAAFPSFAGLR;FSELFAAFPSFAGLRP;SELFAAFPSFAGLRPT;ELFAAFPSFAGLRPTF;LFAAFPSFAGLRPTFD;FAAFPSFAGLRPTFDT;AAFPSFAGLRPTFDTR;AFPSFAGLRPTFDTRL;FPSFAGLRPTFDTRLM;PSFAGLRPTFDTRLMR;SFAGLRPTFDTRLMRL;FAGLRPTFDTRLMRLE;AGLRPTFDTRLMRLED;GLRPTFDTRLMRLEDE;LRPTFDTRLMRLEDEM;RPTFDTRLMRLEDEMK;PTFDTRLMRLEDEMKE;TFDTRLMRLEDEMKEG;FDTRLMRLEDEMKEGR;DTRLMRLEDEMKEGRY;TRLMRLEDEMKEGRYE;RLMRLEDEMKEGRYEV;LMRLEDEMKEGRYEVR;MRLEDEMKEGRYEVRA;RLEDEMKEGRYEVRAE;LEDEMKEGRYEVRAEL;EDEMKEGRYEVRAELP;DEMKEGRYEVRAELPG;EMKEGRYEVRAELPGV;MKEGRYEVRAELPGVD;KEGRYEVRAELPGVDP;EGRYEVRAELPGVDPD;GRYEVRAELPGVDPDK;RYEVRAELPGVDPDKD;YEVRAELPGVDPDKDV;EVRAELPGVDPDKDVD;VRAELPGVDPDKDVDI;RAELPGVDPDKDVDIM;AELPGVDPDKDVDIMV;ELPGVDPDKDVDIMVR;LPGVDPDKDVDIMVRD;PGVDPDKDVDIMVRDG;GVDPDKDVDIMVRDGQ;VDPDKDVDIMVRDGQL;DPDKDVDIMVRDGQLT;PDKDVDIMVRDGQLTI;DKDVDIMVRDGQLTIK;KDVDIMVRDGQLTIKA;DVDIMVRDGQLTIKAE;VDIMVRDGQLTIKAER;DIMVRDGQLTIKAERT;IMVRDGQLTIKAERTE;MVRDGQLTIKAERTEQ;VRDGQLTIKAERTEQK;RDGQLTIKAERTEQKD;DGQLTIKAERTEQKDF;GQLTIKAERTEQKDFD;QLTIKAERTEQKDFDG;LTIKAERTEQKDFDGR;TIKAERTEQKDFDGRS;IKAERTEQKDFDGRSE;KAERTEQKDFDGRSEF;AERTEQKDFDGRSEFA;ERTEQKDFDGRSEFAY;RTEQKDFDGRSEFAYG;TEQKDFDGRSEFAYGS;EQKDFDGRSEFAYGSF;QKDFDGRSEFAYGSFV;KDFDGRSEFAYGSFVR;DFDGRSEFAYGSFVRT;FDGRSEFAYGSFVRTV;DGRSEFAYGSFVRTVS;GRSEFAYGSFVRTVSL;RSEFAYGSFVRTVSLP;SEFAYGSFVRTVSLPV;EFAYGSFVRTVSLPVG;FAYGSFVRTVSLPVGA;AYGSFVRTVSLPVGAD;YGSFVRTVSLPVGADE;GSFVRTVSLPVGADED;SFVRTVSLPVGADEDD;FVRTVSLPVGADEDDI;VRTVSLPVGADEDDIK;RTVSLPVGADEDDIKA;TVSLPVGADEDDIKAT;VSLPVGADEDDIKATY;SLPVGADEDDIKATYD;LPVGADEDDIKATYDK;PVGADED | |

Fig. 30 continued

| | | |
|---|---|---|
| | DIKATYDKG;VGADEDDIKATYDKGI;GADEDDIKATYDKGIL;ADEDDIKATYDKGILT;DEDDIKATYDKGILTV;EDDIKATYDKGILTVS;DDIKATYDKGILTVSV;DIKATYDKGILTVSVA;IKATYDKGILTVSVAV;KATYDKGILTVSVAVS;ATYDKGILTVSVAVSE;TYDKGILTVSVAVSEG;YDKGILTVSVAVSEGK;DKGILTVSVAVSEGKP;KGILTVSVAVSEGKPT;GILTVSVAVSEGKPTE;ILTVSVAVSEGKPTEK;LTVSVAVSEGKPTEKH;TVSVAVSEGKPTEKHI;VSVAVSEGKPTEKHIQ;SVAVSEGKPTEKHIQI;VAVSEGKPTEKHIQIR;AVSEGKPTEKHIQIRS;VSEGKPTEKHIQIRST;SEGKPTEKHIQIRSTN | |
| 7 | **<NP_216548.1 hypothetical protein Rv2032;Mycobacterium tuberculosis H37Rv>**<br>MPDTMVTTDVIKSAVQLACRAPSLHNSQPWRWIAEDHTVALFLDKDRVLYATDHSGREALLGCGAVLDHFRVAMAAAGTTANVERFPNPNDPLHLASIDFSPADFVTEGHRLRADAILLRRTDRLPFAEPPDWDLVESQLRTTVTADTVRIDVIADDMRPELAAASKLTESLRLYDSSYHAELFWWTGAFETSEGIPHSSLVSAAESDRVTFGRDFPVVANTDRRPEFGHDRSKVLVLSTYDNERASLLRCGEMLSAVLLDATMAGLATCTLTHITELHASRDLVAALIGQPATPQALVRVGLAPEMEEPPPATPRRPIDEVFHVRAKDHR<br><br>8mer<br>MPDTMVTT;DTMVTTDV;TMVTTDVI;MVTTDVIK;VIKSAVQL;SAVQLACR;APSLHNSQ;HNSQPWRW;SQPWRWIA;QPWRWIAE;WIAEDHTV;AEDHTVAL;TVALFLDK;LFLDKDRV;FLDKDRVL;VLYATDHS;YATDHSGR;DHSGREAL;EALLGCGA;ALLGCGAV;LLGCGAVL;GAVLDHFR;AVLDHFRV;VLDHFRVA;AMAAAGTT;MAAAGTTA;GTTANVER;TTANVERF;FPNPNDPL;NPNDPLHL;DPLHLASI;LHLASIDF;HLASIDFS;ASIDFSPA;DFVTEGHR;FVTEGHRL;VTEGHRLR;RLRADAIL;RADAILLR;ILLRRTDR;LLRRTDRL;RRTDRLPF;LPFAEPPD;AEPPDWDL;EPPDWDLV;DLVESQLR;ESQLRTTV;SQLRTTVT;QLRTTVTA;TTVTADTV;TVTADTVR;VTADTVRI;DTVRIDVI;DVIADDMR;DMRPELAA;RPELAAAS;ELAAASKL;KLTESLRL;LTESLRLY;RLYDSSYH;SSYHAELF;SYHAELFW;YHAELFWW;ELFWWTGA;LFWWTGAF;ETSEGIPH;EGIPHSSL;GIPHSSLV;HSSLVSAA;VSAAESDR;SAAESDRV;AESDRVTF;FGRDFPVV;FPVVANTD;PVVANTDR;VVANTDRR;NTDRRPEF;GHDRSKVL;KVLVLSTY;LSTYDNER;STYDNERA;SLLRCGEM;LLRCGEML;GEMLSAVL;EMLSAVLL;AVLLDATM;VLLDATMA;LLDATMAG;ATMAGLAT;TMAGLATC;GLATCTLT;TLTHITEL;ITELHASR;SRDLVAAL;ALIGQPAT;GQPATPQA;QPATPQAL;PATPQALV;ATPQALVR;ALVRVGLA;GLAPEMEE;EMEEPPPA;EPPPATPR;PIDEVFHV;EVFHVRAK;HVRAKDHR<br>9mer<br>MPDTMVTTD;DTMVTTDVI;TMVTTDVIK;VTTDVIKSA;TTDVIKSAV;DVIKSAVQL;VIKSAVQLA;KSAVQLACR;QLACRAPSL;SLHNSQPWR;LHNSQPWRW;SQPWRWIAE;WIAEDHTVA;IAEDHTVAL;HTVALFLDK;ALFLDKDRV;FLDKDRVLY;VLYATDHSG;LYATDHSGR;REALLGCGA;EALLGCGAV;ALLGCGAVL;CGAVLDHFR;GAVLDHFRV;AVLDHFRVA;VLDHFRVAM;AMAAAGTTA;MAAAGTTAN;AAAGTTANV;RFPNPNDPL;FPNPNDPLH;NPNDPLHLA;LASIDFSPA;SIDFSPADF;FVTEGHRLR;HRLRADAIL;RLRADAILL;RADAILLRR;AILLRRTDR;ILLRRTDRL;LRRTDRLPF;LPFAEPPDW;VESQLRTTV;SQLRTTVTA;RTTVTADTV;TTVTADTVR;TVTADTVRI;TADTVRIDV;DTVRIDVIA;IADDMRPEL;DMRPELAAA;PELAAASKL;AASKLTESL;ASKLTESLR;KLTESLRLY;SLRLYDSSY;RLYDSSYHA;YDSSYHAEL;SSYHAELFW;SYHAELFWW;AELFWWTGA;ELFWWTGAF;GAFETSEGI;ETSEGIPHS;SEGIPHSSL;EGIPHSSLV;IPHSSLVSA;LVSAAESDR;VSAAESDRV;ESDRVTFGR;VTFGRDFPV;FPVVANTDR;PVVANTDRR;FGHDRSKVL;VLSTYDNER;TYDNERASL;SLLRCGEML;RCGEMLSAV;GEMLSAVLL;MLSAVLLDA;SAVLLDATM;VLLDA | 124785-126474 |

Fig. 30 continued

| | | |
|---|---|---|
| | TMAG;LLDATMAGL;ATMAGLATC;TMAGLATCT;MAGLATCTL;GLATCTLTH;LATCTLTHI;CTLTHITEL;HITELHASR;TELHASRDL;ELHASRDLV;ASRDLVAAL;VAALIGQPA;GQPATPQAL;QPATPQALV;ATPQALVRV;EMEEPPPAT;EPPPATPRR;PPATPRRPI;TPRRPIDEV;RPIDEVFHV<br>10mer<br>MPDTMVTTDV;DTMVTTDVIK;MVTTDVIKSA;VTTDVIKSAV;IKSAVQLACR;VQLACRAPSL;APSLHNSQPW;SLHNSQPWRW;QPWRWIAEDH;WRWIAEDHTV;WIAEDHTVAL;IAEDHTVALF;AEDHTVALFL;TVALFLDKDR;ALFLDKDRVL;LFLDKDRVLY;FLDKDRVLYA;VLYATDHSGR;REALLGCGAV;EALLGCGAVL;CGAVLDHFRV;AVLDHFRVAM;VLDHFRVAMA;VAMAAAGTTA;MAAAGTTANV;ERFPNPNDPL;FPNPNDPLHL;NPNDPLHLAS;DPLHLASIDF;HLASIDFSPA;SIDFSPADFV;SPADFVTEGH;DFVTEGHRLR;FVTEGHRLRA;RLRADAILLR;DAILLRRTDR;AILLRRTDRL;LLRRTDRLPF;RLPFAEPPDW;FAEPPDWDLV;EPPDWDLVES;LVESQLRTTV;RTTVTADTVR;TTVTADTVRI;VTADTVRIDV;DVIADDMRPE;VIADDMRPEL;MRPELAAASK;RPELAAASKL;AAASKLTESL;AASKLTESLR;ESLRLYDSSY;RLYDSSYHAE;LYDSSYHAEL;DSSYHAELFW;SSYHAELFWW;AELFWWTGAF;ELFWWTGAFE;TGAFETSEGI;ETSEGIPHSS;TSEGIPHSSL;GIPHSSLVSA;IPHSSLVSAA;SLVSAAESDR;LVSAAESDRV;SAAESDRVTF;AESDRVTFGR;RVTFGRDFPV;VTFGRDFPVV;DFPVVANTDR;FPVVANTDRR;VANTDRRPEF;FGHDRSKVLV;GHDRSKVLVL;RSKVLVLSTY;LVLSTYDNER;VLSTYDNERA;STYDNERASL;TYDNERASLL;RASLLRCGEM;SLLRCGEMLS;LLRCGEMLSA;EMLSAVLLDA;MLSAVLLDAT;LSAVLLDATM;VLLDATMAGL;LLDATMAGLA;ATMAGLATCT;TMAGLATCTL;GLATCTLTHI;TLTHITELHA;ELHASRDLVA;HASRDLVAAL;ASRDLVAALI;LVAALIGQPA;ALIGQPATPQ;LIGQPATPQA;GQPATPQALV;PATPQALVRV;TPQALVRVGL;LVRVGLAPEM;ATPRRPIDEV;TPRRPIDEVF;RPIDEVFHVR;PIDEVFHVRA;VFHVRAKDHR<br>11mer<br>MPDTMVTTDVI;TMVTTDVIKSA;MVTTDVIKSAV;VIKSAVQLACR;RAPSLHNSQPW;PSLHNSQPWRW;SLHNSQPWRWI;RWIAEDHTVAL;WIAEDHTVALF;IAEDHTVALFL;HTVALFLDKDR;TVALFLDKDRV;ALFLDKDRVLY;FLDKDRVLYAT;RVLYATDHSGR;VLYATDHSGRE;YATDHSGREAL;REALLGCGAVL;LLGCGAVLDHF;LGCGAVLDHFR;GCGAVLDHFRV;AVLDHFRVAMA;VLDHFRVAMAA;RVAMAAAGTTA;AMAAAGTTANV;MAAAGTTANVE;AAAGTTANVER;VERFPNPNDPL;RFPNPNDPLHL;FPNPNDPLHLA;NPNDPLHLASI;LASIDFSPADF;ASIDFSPADFV;SPADFVTEGHR;HRLRADAILLR;RLRADAILLRR;ILLRRTDRLPF;LLRRTDRLPFA;LPFAEPPDWDL;DLVESQLRTTV;QLRTTVTADTV;TVTADTVRIDV;DVIADDMRPEL;VIADDMRPELA;IADDMRPELAA;DMRPELAAASK;RPELAAASKLT;LAAASKLTESL;AAASKLTESLR;TESLRLYDSSY;SLRLYDSSYHA;RLYDSSYHAEL;LYDSSYHAELF;DSSYHAELFWW;HAELFWWTGAF;ELFWWTGAFET;WTGAFETSEGI;ETSEGIPHSSL;TSEGIPHSSLV;EGIPHSSLVSA;SSLVSAAESDR;SLVSAAESDRV;VSAAESDRVTF;AAESDRVTFGR;RVTFGRDFPVV;VTFGRDFPVVA;DFPVVANTDRR;FPVVANTDRRP;VVANTDRRPEF;RRPEFGHDRSK;RPEFGHDRSKV;PEFGHDRSKVL;FGHDRSKVLVL;VLVLSTYDNER;STYDNERASLL;TYDNERASLLR;RASLLRCGEML;SLLRCGEMLSA;LLRCGEMLSAV;MLSAVLLDATM;AVLLDATMAGL;VLLDATMAGLA;LLDATMAGLAT;ATMAGLATCTL;TMAGLATCTLT;MAGLATCTLTH;GLATCTLTHIT;ATCTLTHITEL;TLTHITELHAS;LTHITELHASR;ELHASRDLVAA;LHASRDLVAAL;HASRDLVAALI;DLVAALIGQPA;ALIGQPATPQA;LIGQPATPQAL;QPATPQALVRV;ATPQALVRVGL;TPQALVRVGLA;ALVRVGLAPEM;EMEEPPPATPR;EPPPATPRRPI;PATPRRPIDEV;ATPRRPIDEVF;EVFHVRAKDHR | |

Fig. 30 continued

| | | |
|---|---|---|
| | 13 mers:<br>MPDTMVTTDVIKS;PDTMVTTDVIKSA;DTMVTTDVIKSAV;TMVTTDVIKSAVQ;MVTTDVIKSAVQL;VTTDVIKSAVQLA;TTDVIKSAVQLAC;TDVIKSAVQLACR;DVIKSAVQLACRA;VIKSAVQLACRAP;IKSAVQLACRAPS;KSAVQLACRAPSL;SAVQLACRAPSLH;AVQLACRAPSLHN;VQLACRAPSLHNS;QLACRAPSLHNSQ;LACRAPSLHNSQP;ACRAPSLHNSQPW;CRAPSLHNSQPWR;RAPSLHNSQPWRW;APSLHNSQPWRWI;PSLHNSQPWRWIA;SLHNSQPWRWIAE;LHNSQPWRWIAED;HNSQPWRWIAEDH;NSQPWRWIAEDHT;SQPWRWIAEDHTV;QPWRWIAEDHTVA;PWRWIAEDHTVAL;WRWIAEDHTVALF;RWIAEDHTVALFL;WIAEDHTVALFLD;IAEDHTVALFLDK;AEDHTVALFLDKD;EDHTVALFLDKDR;DHTVALFLDKDRV;HTVALFLDKDRVL;TVALFLDKDRVLY;VALFLDKDRVLYA;ALFLDKDRVLYAT;LFLDKDRVLYATD;FLDKDRVLYATDH;LDKDRVLYATDHS;DKDRVLYATDHSG;KDRVLYATDHSGR;DRVLYATDHSGRE;RVLYATDHSGREA;VLYATDHSGREAL;LYATDHSGREALL;YATDHSGREALLG;ATDHSGREALLGC;TDHSGREALLGCG;DHSGREALLGCGA;HSGREALLGCGAV;SGREALLGCGAVL;GREALLGCGAVLD;REALLGCGAVLDH;EALLGCGAVLDHF;ALLGCGAVLDHFR;LLGCGAVLDHFRV;LGCGAVLDHFRVA;GCGAVLDHFRVAM;CGAVLDHFRVAMA;GAVLDHFRVAMAA;AVLDHFRVAMAAA;VLDHFRVAMAAAG;LDHFRVAMAAAGT;DHFRVAMAAAGTT;HFRVAMAAAGTTA;FRVAMAAAGTTAN;RVAMAAAGTTANV;VAMAAAGTTANVE;AMAAAGTTANVER;MAAAGTTANVERF;AAAGTTANVERFP;AAGTTANVERFPN;AGTTANVERFPNP;GTTANVERFPNPN;TTANVERFPNPND;TANVERFPNPNDP;ANVERFPNPNDPL;NVERFPNPNDPLH;VERFPNPNDPLHL;ERFPNPNDPLHLA;RFPNPNDPLHLAS;FPNPNDPLHLASI;PNPNDPLHLASID;NPNDPLHLASIDF;PNDPLHLASIDFS;NDPLHLASIDFSP;DPLHLASIDFSPA;PLHLASIDFSPAD;LHLASIDFSPADF;HLASIDFSPADFV;LASIDFSPADFVT;ASIDFSPADFVTE;SIDFSPADFVTEG;IDFSPADFVTEGH;DFSPADFVTEGHR;FSPADFVTEGHRL;SPADFVTEGHRLR;PADFVTEGHRLRA;ADFVTEGHRLRAD;DFVTEGHRLRADA;FVTEGHRLRADAI;VTEGHRLRADAIL;TEGHRLRADAILL;EGHRLRADAILLR;GHRLRADAILLRR;HRLRADAILLRRT;RLRADAILLRRTD;LRADAILLRRTDR;RADAILLRRTDRL;ADAILLRRTDRLP;DAILLRRTDRLPF;AILLRRTDRLPFA;ILLRRTDRLPFAE;LLRRTDRLPFAEP;LRRTDRLPFAEPP;RRTDRLPFAEPPD;RTDRLPFAEPPDW;TDRLPFAEPPDWD;DRLPFAEPPDWDL;RLPFAEPPDWDLV;LPFAEPPDWDLVE;PFAEPPDWDLVES;FAEPPDWDLVESQ;AEPPDWDLVESQL;EPPDWDLVESQLR;PPDWDLVESQLRT;PDWDLVESQLRTT;DWDLVESQLRTTV;WDLVESQLRTTVT;DLVESQLRTTVTA;LVESQLRTTVTAD;VESQLRTTVTADT;ESQLRTTVTADTV;SQLRTTVTADTVR;QLRTTVTADTVRI;LRTTVTADTVRID;RTTVTADTVRIDV;TTVTADTVRIDVI;TVTADTVRIDVIA;VTADTVRIDVIAD;TADTVRIDVIADD;ADTVRIDVIADDM;DTVRIDVIADDMR;TVRIDVIADDMRP;VRIDVIADDMRPE;RIDVIADDMRPEL;IDVIADDMRPELA;DVIADDMRPELAA;VIADDMRPELAAA;IADDMRPELAAAS;ADDMRPELAAASK;DDMRPELAAASKL;DMRPELAAASKLT;MRPELAAASKLTE;RPELAAASKLTES;PELAAASKLTESL;ELAAASKLTESLR;LAAASKLTESLRL;AAASKLTESLRLY;AASKLTESLRLYD;ASKLTESLRLYDS;SKLTESLRLYDSS;KLTESLRLYDSSY;LTESLRLYDSSYH;TESLRLYDSSYHA;ESLRLYDSSYHAE;SLRLYDSSYHAEL;LRLYDSSYHAELF;RLYDSSYHAELFW;LYDSSYHAELFWW;YDSSYHAELFWWT;DSSYHAELFWWTG;SSYHAELFWWTGA;SYHAELFWWTGAF;YHAELFWWTGAFE;HAELFWWTGAFET;AELFWWTGAFETS;ELFWWTGAFETSE;LFWWTGAFETSEG;FWWTGAFETSEGI;WWTGAFETSEGIP;WTGAFETSEGIPH;TGAFETSEGIPHS;GAFETSEGIPHSS;AFETSEGIPHSSL;FETSEGIPHSSLV;ETSEGIPHSSLVS;TSEGIPHSSLVSA;SEGIPHSSLVSAA;EGIPHSSLVSAAE;GIPHSSLVSAAES;IPHSSLVSAAESD;PHSSLVSAAESDR;HS | |

Fig. 30 continued

| | | |
|---|---|---|
| | SLVSAAESDRV;SSLVSAAESDRVT;SLVSAAESDRVTF;LVSAAESDRVTFG<br>;VSAAESDRVTFGR;SAAESDRVTFGRD;AAESDRVTFGRDF;AESDRVTFG<br>RDFP;ESDRVTFGRDFPV;SDRVTFGRDFPVV;DRVTFGRDFPVVA;RVTFG<br>RDFPVVAN;VTFGRDFPVVANT;TFGRDFPVVANTD;FGRDFPVVANTDR;G<br>RDFPVVANTDRR;RDFPVVANTDRRP;DFPVVANTDRRPE;FPVVANTDRR<br>PEF;PVVANTDRRPEFG;VVANTDRRPEFGH;VANTDRRPEFGHD;ANTDR<br>RPEFGHDR;NTDRRPEFGHDRS;TDRRPEFGHDRSK;DRRPEFGHDRSKV;<br>RRPEFGHDRSKVL;RPEFGHDRSKVLV;PEFGHDRSKVLVL;EFGHDRSKVL<br>VLS;FGHDRSKVLVLST;GHDRSKVLVLSTY;HDRSKVLVLSTYD;DRSKVLV<br>LSTYDN;RSKVLVLSTYDNE;SKVLVLSTYDNER;KVLVLSTYDNERA;VLVLS<br>TYDNERAS;LVLSTYDNERASL;VLSTYDNERASLL;LSTYDNERASLLR;STY<br>DNERASLLRC;TYDNERASLLRCG;YDNERASLLRCGE;DNERASLLRCGE<br>M;NERASLLRCGEML;ERASLLRCGEMLS;RASLLRCGEMLSA;ASLLRCGE<br>MLSAV;SLLRCGEMLSAVL;LLRCGEMLSAVLL;LRCGEMLSAVLLD;RCGEM<br>LSAVLLDA;CGEMLSAVLLDAT;GEMLSAVLLDATM;EMLSAVLLDATMA;ML<br>SAVLLDATMAG;LSAVLLDATMAGL;SAVLLDATMAGLA;AVLLDATMAGLAT<br>;VLLDATMAGLATC;LLDATMAGLATCT;LDATMAGLATCTL;DATMAGLATC<br>TLT;ATMAGLATCTLTH;TMAGLATCTLTHI;MAGLATCTLTHIT;AGLATCTLT<br>HITE;GLATCTLTHITEL;LATCTLTHITELH;ATCTLTHITELHA;TCTLTHITELH<br>AS;CTLTHITELHASR;TLTHITELHASRD;LTHITELHASRDL;THITELHASRD<br>LV;HITELHASRDLVA;ITELHASRDLVAA;TELHASRDLVAAL;ELHASRDLVA<br>ALI;LHASRDLVAALIG;HASRDLVAALIGQ;ASRDLVAALIGQP;SRDLVAALIG<br>QPA;RDLVAALIGQPAT;DLVAALIGQPATP;LVAALIGQPATPQ;VAALIGQPA<br>TPQA;AALIGQPATPQAL;ALIGQPATPQALV;LIGQPATPQALVR;IGQPATP<br>QALVRV;GQPATPQALVRVG;QPATPQALVRVGL;PATPQALVRVGLA;ATP<br>QALVRVGLAP;TPQALVRVGLAPE;PQALVRVGLAPEM;QALVRVGLAPEME<br>;ALVRVGLAPEMEE;LVRVGLAPEMEEP;VRVGLAPEMEEPP;RVGLAPEME<br>EPPP;VGLAPEMEEPPPA;GLAPEMEEPPPAT;LAPEMEEPPPATP;APEME<br>EPPPATPR;PEMEEPPPATPRR;EMEEPPPATPRRP;MEEPPPATPRRPI;E<br>EPPPATPRRPID;EPPPATPRRPIDE;PPPATPRRPIDEV;PPATPRRPIDEVF;<br>PATPRRPIDEVFH;ATPRRPIDEVFHV;TPRRPIDEVFHVR;PRRPIDEVFHVR<br>A;RRPIDEVFHVRAK;RPIDEVFHVRAKD;PIDEVFHVRAKDH;IDEVFHVRAK<br>DHR;<br>14 mers:<br>MPDTMVTTDVIKSA;PDTMVTTDVIKSAV;DTMVTTDVIKSAVQ;TMVTTDVIK<br>SAVQL;MVTTDVIKSAVQLA;VTTDVIKSAVQLAC;TTDVIKSAVQLACR;TDVI<br>KSAVQLACRA;DVIKSAVQLACRAP;VIKSAVQLACRAPS;IKSAVQLACRAP<br>SL;KSAVQLACRAPSLH;SAVQLACRAPSLHN;AVQLACRAPSLHNS;VQLAC<br>RAPSLHNSQ;QLACRAPSLHNSQP;LACRAPSLHNSQPW;ACRAPSLHNSQ<br>PWR;CRAPSLHNSQPWRW;RAPSLHNSQPWRWI;APSLHNSQPWRWIA;P<br>SLHNSQPWRWIAE;SLHNSQPWRWIAED;LHNSQPWRWIAEDH;HNSQPW<br>RWIAEDHT;NSQPWRWIAEDHTV;SQPWRWIAEDHTVA;QPWRWIAEDHT<br>VAL;PWRWIAEDHTVALF;WRWIAEDHTVALFL;RWIAEDHTVALFLD;WIAE<br>DHTVALFLDK;IAEDHTVALFLDKD;AEDHTVALFLDKDR;EDHTVALFLDKD<br>RV;DHTVALFLDKDRVL;HTVALFLDKDRVLY;TVALFLDKDRVLYA;VALFLD<br>KDRVLYAT;ALFLDKDRVLYATD;LFLDKDRVLYATDH;FLDKDRVLYATDHS;<br>LDKDRVLYATDHSG;DKDRVLYATDHSGR;KDRVLYATDHSGRE;DRVLYA<br>TDHSGREA;RVLYATDHSGREAL;VLYATDHSGREALL;LYATDHSGREALL<br>G;YATDHSGREALLGC;ATDHSGREALLGCG;TDHSGREALLGCGA;DHSG<br>REALLGCGAV;HSGREALLGCGAVL;SGREALLGCGAVLD;GREALLGCGA<br>VLDH;REALLGCGAVLDHF;EALLGCGAVLDHFR;ALLGCGAVLDHFRV;LLG<br>CGAVLDHFRVA;LGCGAVLDHFRVAM;GCGAVLDHFRVAMA;CGAVLDHFR<br>VAMAA;GAVLDHFRVAMAAA;AVLDHFRVAMAAAG;VLDHFRVAMAAAGT;L | |

Fig. 30 continued

| | | |
|---|---|---|
| | DHFRVAMAAAGTT;DHFRVAMAAAGTTA;HFRVAMAAAGTTAN;FRVAMAAAGTTANV;RVAMAAAGTTANVE;VAMAAAGTTANVER;AMAAAGTTANVERF;MAAAGTTANVERFP;AAAGTTANVERFPN;AAGTTANVERFPNP;AGTTANVERFPNPN;GTTANVERFPNPND;TTANVERFPNPNDP;TANVERFPNPNDPL;ANVERFPNPNDPLH;NVERFPNPNDPLHL;VERFPNPNDPLHLA;ERFPNPNDPLHLAS;RFPNPNDPLHLASI;FPNPNDPLHLASID;PNPNDPLHLASIDF;NPNDPLHLASIDFS;PNDPLHLASIDFSP;NDPLHLASIDFSPA;DPLHLASIDFSPAD;PLHLASIDFSPADF;LHLASIDFSPADFV;HLASIDFSPADFVT;LASIDFSPADFVTE;ASIDFSPADFVTEG;SIDFSPADFVTEGH;IDFSPADFVTEGHR;DFSPADFVTEGHRL;FSPADFVTEGHRLR;SPADFVTEGHRLRA;PADFVTEGHRLRAD;ADFVTEGHRLRADA;DFVTEGHRLRADAI;FVTEGHRLRADAIL;VTEGHRLRADAILL;TEGHRLRADAILLR;EGHRLRADAILLRR;GHRLRADAILLRRT;HRLRADAILLRRTD;RLRADAILLRRTDR;LRADAILLRRTDRL;RADAILLRRTDRLP;ADAILLRRTDRLPF;DAILLRRTDRLPFA;AILLRRTDRLPFAE;ILLRRTDRLPFAEP;LLRRTDRLPFAEPP;LRRTDRLPFAEPPD;RRTDRLPFAEPPDW;RTDRLPFAEPPDWD;TDRLPFAEPPDWDL;DRLPFAEPPDWDLV;RLPFAEPPDWDLVE;LPFAEPPDWDLVES;PFAEPPDWDLVESQ;FAEPPDWDLVESQL;AEPPDWDLVESQLR;EPPDWDLVESQLRT;PPDWDLVESQLRTT;PDWDLVESQLRTTV;DWDLVESQLRTTVT;WDLVESQLRTTVTA;DLVESQLRTTVTAD;LVESQLRTTVTADT;VESQLRTTVTADTV;ESQLRTTVTADTVR;SQLRTTVTADTVRI;QLRTTVTADTVRID;LRTTVTADTVRIDV;RTTVTADTVRIDVI;TTVTADTVRIDVIA;TVTADTVRIDVIAD;VTADTVRIDVIADD;TADTVRIDVIADDM;ADTVRIDVIADDMR;DTVRIDVIADDMRP;TVRIDVIADDMRPE;VRIDVIADDMRPEL;RIDVIADDMRPELA;IDVIADDMRPELAA;DVIADDMRPELAAA;VIADDMRPELAAAS;IADDMRPELAAASK;ADDMRPELAAASKL;DDMRPELAAASKLT;DMRPELAAASKLTE;MRPELAAASKLTES;RPELAAASKLTESL;PELAAASKLTESLR;ELAAASKLTESLRL;LAAASKLTESLRLY;AAASKLTESLRLYD;AASKLTESLRLYDS;ASKLTESLRLYDSS;SKLTESLRLYDSSY;KLTESLRLYDSSYH;LTESLRLYDSSYHA;TESLRLYDSSYHAE;ESLRLYDSSYHAEL;SLRLYDSSYHAELF;LRLYDSSYHAELFW;RLYDSSYHAELFWW;LYDSSYHAELFWWT;YDSSYHAELFWWTG;DSSYHAELFWWTGA;SSYHAELFWWTGAF;SYHAELFWWTGAFE;YHAELFWWTGAFET;HAELFWWTGAFETS;AELFWWTGAFETSE;ELFWWTGAFETSEG;LFWWTGAFETSEGI;FWWTGAFETSEGIP;WWTGAFETSEGIPH;WTGAFETSEGIPHS;TGAFETSEGIPHSS;GAFETSEGIPHSSL;AFETSEGIPHSSLV;FETSEGIPHSSLVS;ETSEGIPHSSLVSA;TSEGIPHSSLVSAA;SEGIPHSSLVSAAE;EGIPHSSLVSAAES;GIPHSSLVSAAESD;IPHSSLVSAAESDR;PHSSLVSAAESDRV;HSSLVSAAESDRVT;SSLVSAAESDRVTF;SLVSAAESDRVTFG;LVSAAESDRVTFGR;VSAAESDRVTFGRD;SAAESDRVTFGRDF;AAESDRVTFGRDFP;AESDRVTFGRDFPV;ESDRVTFGRDFPVV;SDRVTFGRDFPVVA;DRVTFGRDFPVVAN;RVTFGRDFPVVANT;VTFGRDFPVVANTD;TFGRDFPVVANTDR;FGRDFPVVANTDRR;GRDFPVVANTDRRP;RDFPVVANTDRRPE;DFPVVANTDRRPEF;FPVVANTDRRPEFG;PVVANTDRRPEFGH;VVANTDRRPEFGHD;VANTDRRPEFGHDR;ANTDRRPEFGHDRS;NTDRRPEFGHDRSK;TDRRPEFGHDRSKV;DRRPEFGHDRSKVL;RRPEFGHDRSKVLV;RPEFGHDRSKVLVL;PEFGHDRSKVLVLS;EFGHDRSKVLVLST;FGHDRSKVLVLSTY;GHDRSKVLVLSTYD;HDRSKVLVLSTYDN;DRSKVLVLSTYDNE;RSKVLVLSTYDNER;SKVLVLSTYDNERA;KVLVLSTYDNERAS;VLVLSTYDNERASL;LVLSTYDNERASLL;VLSTYDNERASLLR;LSTYDNERASLLRC;STYDNERASLLRCG;TYDNERASLLRCGE;YDNERASLLRCGEM;DNERASLLRCGEML;NERASLLRCGEMLS;ERASLLRCGEMLSA;RASLLRCGEMLSAV;ASLLRCGEMLSAVL;SLLRCGEMLSAVLL;LLRCGEMLSAVLLD;LRCGEMLSAVLLDA;RCGEMLSAVLLDAT;CGEMLSAVLLDATM;GEMLSAVLLDATMA;EMLSAVLLDATMA | |

Fig. 30 continued

| | | |
|---|---|---|
| | G;MLSAVLLDATMAGL;LSAVLLDATMAGLA;SAVLLDATMAGLAT;AVLLDATMAGLATC;VLLDATMAGLATCT;LLDATMAGLATCTL;LDATMAGLATCTLT;DATMAGLATCTLTH;ATMAGLATCTLTHI;TMAGLATCTLTHIT;MAGLATCTLTHITE;AGLATCTLTHITEL;GLATCTLTHITELH;LATCTLTHITELHA;ATCTLTHITELHAS;TCTLTHITELHASR;CTLTHITELHASRD;TLTHITELHASRDL;LTHITELHASRDLV;THITELHASRDLVA;HITELHASRDLVAA;ITELHASRDLVAAL;TELHASRDLVAALI;ELHASRDLVAALIG;LHASRDLVAALIGQ;HASRDLVAALIGQP;ASRDLVAALIGQPA;SRDLVAALIGQPAT;RDLVAALIGQPATP;DLVAALIGQPATPQ;LVAALIGQPATPQA;VAALIGQPATPQAL;AALIGQPATPQALV;ALIGQPATPQALVR;LIGQPATPQALVRV;IGQPATPQALVRVG;GQPATPQALVRVGL;QPATPQALVRVGLA;PATPQALVRVGLAP;ATPQALVRVGLAPE;TPQALVRVGLAPEM;PQALVRVGLAPEME;QALVRVGLAPEMEE;ALVRVGLAPEMEEP;LVRVGLAPEMEEPP;VRVGLAPEMEEPPP;RVGLAPEMEEPPPA;VGLAPEMEEPPPAT;GLAPEMEEPPPATP;LAPEMEEPPPATPR;APEMEEPPPATPRR;PEMEEPPPATPRRP;EMEEPPPATPRRPI;MEEPPPATPRRPID;EEPPPATPRRPIDE;EPPPATPRRPIDEV;PPPATPRRPIDEVF;PPATPRRPIDEVFH;PATPRRPIDEVFHV;ATPRRPIDEVFHVR;TPRRPIDEVFHVRA;PRRPIDEVFHVRAK;RRPIDEVFHVRAKD;RPIDEVFHVRAKDH;PIDEVFHVRAKDHR;<br>15 mers:<br>MPDTMVTTDVIKSAV;PDTMVTTDVIKSAVQ;DTMVTTDVIKSAVQL;TMVTTDVIKSAVQLA;MVTTDVIKSAVQLAC;VTTDVIKSAVQLACR;TTDVIKSAVQLACRA;TDVIKSAVQLACRAP;DVIKSAVQLACRAPS;VIKSAVQLACRAPSL;IKSAVQLACRAPSLH;KSAVQLACRAPSLHN;SAVQLACRAPSLHNS;AVQLACRAPSLHNSQ;VQLACRAPSLHNSQP;QLACRAPSLHNSQPW;LACRAPSLHNSQPWR;ACRAPSLHNSQPWRW;CRAPSLHNSQPWRWI;RAPSLHNSQPWRWIA;APSLHNSQPWRWIAE;PSLHNSQPWRWIAED;SLHNSQPWRWIAEDH;LHNSQPWRWIAEDHT;HNSQPWRWIAEDHTV;NSQPWRWIAEDHTVA;SQPWRWIAEDHTVAL;QPWRWIAEDHTVALF;PWRWIAEDHTVALFL;WRWIAEDHTVALFLD;RWIAEDHTVALFLDK;WIAEDHTVALFLDKD;IAEDHTVALFLDKDR;AEDHTVALFLDKDRV;EDHTVALFLDKDRVL;DHTVALFLDKDRVLY;HTVALFLDKDRVLYA;TVALFLDKDRVLYAT;VALFLDKDRVLYATD;ALFLDKDRVLYATDH;LFLDKDRVLYATDHS;FLDKDRVLYATDHSG;LDKDRVLYATDHSGR;DKDRVLYATDHSGRE;KDRVLYATDHSGREA;DRVLYATDHSGREAL;RVLYATDHSGREALL;VLYATDHSGREALLG;LYATDHSGREALLGC;YATDHSGREALLGCG;ATDHSGREALLGCGA;TDHSGREALLGCGAV;DHSGREALLGCGAVL;HSGREALLGCGAVLD;SGREALLGCGAVLDH;GREALLGCGAVLDHF;REALLGCGAVLDHFR;EALLGCGAVLDHFRV;ALLGCGAVLDHFRVA;LLGCGAVLDHFRVAM;LGCGAVLDHFRVAMA;GCGAVLDHFRVAMAA;CGAVLDHFRVAMAAA;GAVLDHFRVAMAAAG;AVLDHFRVAMAAAGT;VLDHFRVAMAAAGTT;LDHFRVAMAAAGTTA;DHFRVAMAAAGTTAN;HFRVAMAAAGTTANV;FRVAMAAAGTTANVE;RVAMAAAGTTANVER;VAMAAAGTTANVERF;AMAAAGTTANVERFP;MAAAGTTANVERFPN;AAAGTTANVERFPNP;AAGTTANVERFPNPN;AGTTANVERFPNPND;GTTANVERFPNPNDP;TTANVERFPNPNDPL;TANVERFPNPNDPLH;ANVERFPNPNDPLHL;NVERFPNPNDPLHLA;VERFPNPNDPLHLAS;ERFPNPNDPLHLASI;RFPNPNDPLHLASID;FPNPNDPLHLASIDF;PNPNDPLHLASIDFS;NPNDPLHLASIDFSP;PNDPLHLASIDFSPA;NDPLHLASIDFSPAD;DPLHLASIDFSPADF;PLHLASIDFSPADFV;LHLASIDFSPADFVT;HLASIDFSPADFVTE;LASIDFSPADFVTEG;ASIDFSPADFVTEGH;SIDFSPADFVTEGHR;IDFSPADFVTEGHRL;DFSPADFVTEGHRLR;FSPADFVTEGHRLRA;SPADFVTEGHRLRAD;PADFVTEGHRLRADA;ADFVTEGHRLRADAI;DFVTEGHRLRADAIL;FVTEGHRLRADAILL;VTEGHRLRADAILLR;TEGHRLRADAILLRR;EGHRLRADAILLRRT; | |

Fig. 30 continued

| | | |
|---|---|---|
| | GHRLRADAILLRRTD;HRLRADAILLRRTDR;RLRADAILLRRTDRL;LRADAILLRRTDRLP;RADAILLRRTDRLPF;ADAILLRRTDRLPFA;DAILLRRTDRLPFAE;AILLRRTDRLPFAEP;ILLRRTDRLPFAEPP;LLRRTDRLPFAEPPD;LRRTDRLPFAEPPDW;RRTDRLPFAEPPDWD;RTDRLPFAEPPDWDL;TDRLPFAEPPDWDLV;DRLPFAEPPDWDLVE;RLPFAEPPDWDLVES;LPFAEPPDWDLVESQ;PFAEPPDWDLVESQL;FAEPPDWDLVESQLR;AEPPDWDLVESQLRT;EPPDWDLVESQLRTT;PPDWDLVESQLRTTV;PDWDLVESQLRTTVT;DWDLVESQLRTTVTA;WDLVESQLRTTVTAD;DLVESQLRTTVTADT;LVESQLRTTVTADTV;VESQLRTTVTADTVR;ESQLRTTVTADTVRI;SQLRTTVTADTVRID;QLRTTVTADTVRIDV;LRTTVTADTVRIDVI;RTTVTADTVRIDVIA;TTVTADTVRIDVIAD;TVTADTVRIDVIADD;VTADTVRIDVIADDM;TADTVRIDVIADDMR;ADTVRIDVIADDMRP;DTVRIDVIADDMRPE;TVRIDVIADDMRPEL;VRIDVIADDMRPELA;RIDVIADDMRPELAA;IDVIADDMRPELAAA;DVIADDMRPELAAAS;VIADDMRPELAAASK;IADDMRPELAAASKL;ADDMRPELAAASKLT;DDMRPELAAASKLTE;DMRPELAAASKLTES;MRPELAAASKLTESL;RPELAAASKLTESLR;PELAAASKLTESLRL;ELAAASKLTESLRLY;LAAASKLTESLRLYD;AAASKLTESLRLYDS;AASKLTESLRLYDSS;ASKLTESLRLYDSSY;SKLTESLRLYDSSYH;KLTESLRLYDSSYHA;LTESLRLYDSSYHAE;TESLRLYDSSYHAEL;ESLRLYDSSYHAELF;SLRLYDSSYHAELFW;LRLYDSSYHAELFWW;RLYDSSYHAELFWWT;LYDSSYHAELFWWTG;YDSSYHAELFWWTGA;DSSYHAELFWWTGAF;SSYHAELFWWTGAFE;SYHAELFWWTGAFET;YHAELFWWTGAFETS;HAELFWWTGAFETSE;AELFWWTGAFETSEG;ELFWWTGAFETSEGI;LFWWTGAFETSEGIP;FWWTGAFETSEGIPH;WWTGAFETSEGIPHS;WTGAFETSEGIPHSS;TGAFETSEGIPHSSL;GAFETSEGIPHSSLV;AFETSEGIPHSSLVS;FETSEGIPHSSLVSA;ETSEGIPHSSLVSAA;TSEGIPHSSLVSAAE;SEGIPHSSLVSAAES;EGIPHSSLVSAAESD;GIPHSSLVSAAESDR;IPHSSLVSAAESDRV;PHSSLVSAAESDRVT;HSSLVSAAESDRVTF;SSLVSAAESDRVTFG;SLVSAAESDRVTFGR;LVSAAESDRVTFGRD;VSAAESDRVTFGRDF;SAAESDRVTFGRDFP;AAESDRVTFGRDFPV;AESDRVTFGRDFPVV;ESDRVTFGRDFPVVA;SDRVTFGRDFPVVAN;DRVTFGRDFPVVANT;RVTFGRDFPVVANTD;VTFGRDFPVVANTDR;TFGRDFPVVANTDRR;FGRDFPVVANTDRRP;GRDFPVVANTDRRPE;RDFPVVANTDRRPEF;DFPVVANTDRRPEFG;FPVVANTDRRPEFGH;PVVANTDRRPEFGHD;VVANTDRRPEFGHDR;VANTDRRPEFGHDRS;ANTDRRPEFGHDRSK;NTDRRPEFGHDRSKV;TDRRPEFGHDRSKVL;DRRPEFGHDRSKVLV;RRPEFGHDRSKVLVL;RPEFGHDRSKVLVLS;PEFGHDRSKVLVLST;EFGHDRSKVLVLSTY;FGHDRSKVLVLSTYD;GHDRSKVLVLSTYDN;HDRSKVLVLSTYDNE;DRSKVLVLSTYDNER;RSKVLVLSTYDNERA;SKVLVLSTYDNERAS;KVLVLSTYDNERASL;VLVLSTYDNERASLL;LVLSTYDNERASLLR;VLSTYDNERASLLRC;LSTYDNERASLLRCG;STYDNERASLLRCGE;TYDNERASLLRCGEM;YDNERASLLRCGEML;DNERASLLRCGEMLS;NERASLLRCGEMLSA;ERASLLRCGEMLSAV;RASLLRCGEMLSAVL;ASLLRCGEMLSAVLL;SLLRCGEMLSAVLLD;LLRCGEMLSAVLLDA;LRCGEMLSAVLLDAT;RCGEMLSAVLLDATM;CGEMLSAVLLDATMA;GEMLSAVLLDATMAG;EMLSAVLLDATMAGL;MLSAVLLDATMAGLA;LSAVLLDATMAGLAT;SAVLLDATMAGLATC;AVLLDATMAGLATCT;VLLDATMAGLATCTL;LLDATMAGLATCTLT;LDATMAGLATCTLTH;DATMAGLATCTLTHI;ATMAGLATCTLTHIT;TMAGLATCTLTHITE;MAGLATCTLTHITEL;AGLATCTLTHITELH;GLATCTLTHITELHA;LATCTLTHITELHAS;ATCTLTHITELHASR;TCTLTHITELHASRD;CTLTHITELHASRDL;TLTHITELHASRDLV;LTHITELHASRDLVA;THITELHASRDLVAA;HITELHASRDLVAAL;ITELHASRDLVAALI;TELHASRDLVAALIG;ELHASRDLVAALIGQ;LHASRDLVAALIGQP;HASRDLVAALIGQPA;ASRDLVAALIGQPAT;SRDLVAALIGQPATP;RDLVAALIGQPATPQ;DLVAALIGQPATPQA;LVAALIGQPATP | |

Fig. 30 continued

QAL;VAALIGQPATPQALV;AALIGQPATPQALVR;ALIGQPATPQALVRV;LIG
QPATPQALVRVG;IGQPATPQALVRVGL;GQPATPQALVRVGLA;QPATPQA
LVRVGLAP;PATPQALVRVGLAPE;ATPQALVRVGLAPEM;TPQALVRVGLA
PEME;PQALVRVGLAPEMEE;QALVRVGLAPEMEEP;ALVRVGLAPEMEEP
P;LVRVGLAPEMEEPPP;VRVGLAPEMEEPPPA;RVGLAPEMEEPPPAT;VG
LAPEMEEPPPATP;GLAPEMEEPPPATPR;LAPEMEEPPPATPRR;APEMEE
PPPATPRRP;PEMEEPPPATPRRPI;EMEEPPPATPRRPID;MEEPPPATPR
RPIDE;EEPPPATPRRPIDEV;EPPPATPRRPIDEVF;PPPATPRRPIDEVFH;P
PATPRRPIDEVFHV;PATPRRPIDEVFHVR;ATPRRPIDEVFHVRA;TPRRPID
EVFHVRAK;PRRPIDEVFHVRAKD;RRPIDEVFHVRAKDH;RPIDEVFHVRAK
DHR;
16 mers:
MPDTMVTTDVIKSAVQ;PDTMVTTDVIKSAVQL;DTMVTTDVIKSAVQLA;TM
VTTDVIKSAVQLAC;MVTTDVIKSAVQLACR;VTTDVIKSAVQLACRA;TTDVI
KSAVQLACRAP;TDVIKSAVQLACRAPS;DVIKSAVQLACRAPSL;VIKSAVQL
ACRAPSLH;IKSAVQLACRAPSLHN;KSAVQLACRAPSLHNS;SAVQLACRA
PSLHNSQ;AVQLACRAPSLHNSQP;VQLACRAPSLHNSQPW;QLACRAPSL
HNSQPWR;LACRAPSLHNSQPWRW;ACRAPSLHNSQPWRWI;CRAPSLHN
SQPWRWIA;RAPSLHNSQPWRWIAE;APSLHNSQPWRWIAED;PSLHNSQ
PWRWIAEDH;SLHNSQPWRWIAEDHT;LHNSQPWRWIAEDHTV;HNSQPW
RWIAEDHTVA;NSQPWRWIAEDHTVAL;SQPWRWIAEDHTVALF;QPWRWI
AEDHTVALFL;PWRWIAEDHTVALFLD;WRWIAEDHTVALFLDK;RWIAEDH
TVALFLDKD;WIAEDHTVALFLDKDR;IAEDHTVALFLDKDRV;AEDHTVALFL
DKDRVL;EDHTVALFLDKDRVLY;DHTVALFLDKDRVLYA;HTVALFLDKDRV
LYAT;TVALFLDKDRVLYATD;VALFLDKDRVLYATDH;ALFLDKDRVLYATD
HS;LFLDKDRVLYATDHSG;FLDKDRVLYATDHSGR;LDKDRVLYATDHSGR
E;DKDRVLYATDHSGREA;KDRVLYATDHSGREAL;DRVLYATDHSGREALL
;RVLYATDHSGREALLG;VLYATDHSGREALLGC;LYATDHSGREALLGCG;
YATDHSGREALLGCGA;ATDHSGREALLGCGAV;TDHSGREALLGCGAVL;
DHSGREALLGCGAVLD;HSGREALLGCGAVLDH;SGREALLGCGAVLDHF;
GREALLGCGAVLDHFR;REALLGCGAVLDHFRV;EALLGCGAVLDHFRVA;A
LLGCGAVLDHFRVAM;LLGCGAVLDHFRVAMA;LGCGAVLDHFRVAMAA;G
CGAVLDHFRVAMAAA;CGAVLDHFRVAMAAAG;GAVLDHFRVAMAAAGT;A
VLDHFRVAMAAAGTT;VLDHFRVAMAAAGTTA;LDHFRVAMAAAGTTAN;D
HFRVAMAAAGTTANV;HFRVAMAAAGTTANVE;FRVAMAAAGTTANVER;R
VAMAAAGTTANVERF;VAMAAAGTTANVERFP;AMAAAGTTANVERFPN;M
AAAGTTANVERFPNP;AAAGTTANVERFPNPN;AAGTTANVERFPNPND;A
GTTANVERFPNPNDP;GTTANVERFPNPNDPL;TTANVERFPNPNDPLH;TA
NVERFPNPNDPLHL;ANVERFPNPNDPLHLA;NVERFPNPNDPLHLAS;VER
FPNPNDPLHLASI;ERFPNPNDPLHLASID;RFPNPNDPLHLASIDF;FPNPND
PLHLASIDFS;PNPNDPLHLASIDFSP;NPNDPLHLASIDFSPA;PNDPLHLASI
DFSPAD;NDPLHLASIDFSPADF;DPLHLASIDFSPADFV;PLHLASIDFSPAD
FVT;LHLASIDFSPADFVTE;HLASIDFSPADFVTEG;LASIDFSPADFVTEGH;
ASIDFSPADFVTEGHR;SIDFSPADFVTEGHRL;IDFSPADFVTEGHRLR;DFS
PADFVTEGHRLRA;FSPADFVTEGHRLRAD;SPADFVTEGHRLRADA;PADF
VTEGHRLRADAI;ADFVTEGHRLRADAIL;DFVTEGHRLRADAILL;FVTEGHR
LRADAILLR;VTEGHRLRADAILLRR;TEGHRLRADAILLRRT;EGHRLRADAIL
LRRTD;GHRLRADAILLRRTDR;HRLRADAILLRRTDRL;RLRADAILLRRTDR
LP;LRADAILLRRTDRLPF;RADAILLRRTDRLPFA;ADAILLRRTDRLPFAE;D
AILLRRTDRLPFAEP;AILLRRTDRLPFAEPP;ILLRRTDRLPFAEPPD;LLRRT
DRLPFAEPPDW;LRRTDRLPFAEPPDWD;RRTDRLPFAEPPDWDL;RTDRL
PFAEPPDWDLV;TDRLPFAEPPDWDLVE;DRLPFAEPPDWDLVES;RLPFAE
PPDWDLVESQ;LPFAEPPDWDLVESQL;PFAEPPDWDLVESQLR;FAEPPD

Fig. 30 continued

| | | |
|---|---|---|
| | WDLVESQLRT;AEPPDWDLVESQLRTT;EPPDWDLVESQLRTTV;PPDWDLVESQLRTTVT;PDWDLVESQLRTTVTA;DWDLVESQLRTTVTAD;WDLVESQLRTTVTADT;DLVESQLRTTVTADTV;LVESQLRTTVTADTVR;VESQLRTTVTADTVRI;ESQLRTTVTADTVRID;SQLRTTVTADTVRIDV;QLRTTVTADTVRIDVI;LRTTVTADTVRIDVIA;RTTVTADTVRIDVIAD;TTVTADTVRIDVIADD;TVTADTVRIDVIADDM;VTADTVRIDVIADDMR;TADTVRIDVIADDMRP;ADTVRIDVIADDMRPE;DTVRIDVIADDMRPEL;TVRIDVIADDMRPELA;VRIDVIADDMRPELAA;RIDVIADDMRPELAAA;IDVIADDMRPELAAAS;DVIADDMRPELAAASK;VIADDMRPELAAASKL;IADDMRPELAAASKLT;ADDMRPELAAASKLTE;DDMRPELAAASKLTES;DMRPELAAASKLTESL;MRPELAAASKLTESLR;RPELAAASKLTESLRL;PELAAASKLTESLRLY;ELAAASKLTESLRLYD;LAAASKLTESLRLYDS;AAASKLTESLRLYDSS;AASKLTESLRLYDSSY;ASKLTESLRLYDSSYH;SKLTESLRLYDSSYHA;KLTESLRLYDSSYHAE;LTESLRLYDSSYHAEL;TESLRLYDSSYHAELF;ESLRLYDSSYHAELFW;SLRLYDSSYHAELFWW;LRLYDSSYHAELFWWT;RLYDSSYHAELFWWTG;LYDSSYHAELFWWTGA;YDSSYHAELFWWTGAF;DSSYHAELFWWTGAFE;SSYHAELFWWTGAFET;SYHAELFWWTGAFETS;YHAELFWWTGAFETSE;HAELFWWTGAFETSEG;AELFWWTGAFETSEGI;ELFWWTGAFETSEGIP;LFWWTGAFETSEGIPH;FWWTGAFETSEGIPHS;WWTGAFETSEGIPHSS;WTGAFETSEGIPHSSL;TGAFETSEGIPHSSLV;GAFETSEGIPHSSLVS;AFETSEGIPHSSLVSA;FETSEGIPHSSLVSAA;ETSEGIPHSSLVSAAE;TSEGIPHSSLVSAAES;SEGIPHSSLVSAAESD;EGIPHSSLVSAAESDR;GIPHSSLVSAAESDRV;IPHSSLVSAAESDRVT;PHSSLVSAAESDRVTF;HSSLVSAAESDRVTFG;SSLVSAAESDRVTFGR;SLVSAAESDRVTFGRD;LVSAAESDRVTFGRDF;VSAAESDRVTFGRDFP;SAAESDRVTFGRDFPV;AAESDRVTFGRDFPVV;AESDRVTFGRDFPVVA;ESDRVTFGRDFPVVAN;SDRVTFGRDFPVVANT;DRVTFGRDFPVVANTD;RVTFGRDFPVVANTDR;VTFGRDFPVVANTDRR;TFGRDFPVVANTDRRP;FGRDFPVVANTDRRPE;GRDFPVVANTDRRPEF;RDFPVVANTDRRPEFG;DFPVVANTDRRPEFGH;FPVVANTDRRPEFGHD;PVVANTDRRPEFGHDR;VVANTDRRPEFGHDRS;VANTDRRPEFGHDRSK;ANTDRRPEFGHDRSKV;NTDRRPEFGHDRSKVL;TDRRPEFGHDRSKVLV;DRRPEFGHDRSKVLVL;RRPEFGHDRSKVLVLS;RPEFGHDRSKVLVLST;PEFGHDRSKVLVLSTY;EFGHDRSKVLVLSTYD;FGHDRSKVLVLSTYDN;GHDRSKVLVLSTYDNE;HDRSKVLVLSTYDNER;DRSKVLVLSTYDNERA;RSKVLVLSTYDNERAS;SKVLVLSTYDNERASL;KVLVLSTYDNERASLL;VLVLSTYDNERASLLR;LVLSTYDNERASLLRC;VLSTYDNERASLLRCG;LSTYDNERASLLRCGE;STYDNERASLLRCGEM;TYDNERASLLRCGEML;YDNERASLLRCGEMLS;DNERASLLRCGEMLSA;NERASLLRCGEMLSAV;ERASLLRCGEMLSAVL;RASLLRCGEMLSAVLL;ASLLRCGEMLSAVLLD;SLLRCGEMLSAVLLDA;LLRCGEMLSAVLLDAT;LRCGEMLSAVLLDATM;RCGEMLSAVLLDATMA;CGEMLSAVLLDATMAG;GEMLSAVLLDATMAGL;EMLSAVLLDATMAGLA;MLSAVLLDATMAGLAT;LSAVLLDATMAGLATC;SAVLLDATMAGLATCT;AVLLDATMAGLATCTL;VLLDATMAGLATCTLT;LLDATMAGLATCTLTH;LDATMAGLATCTLTHI;DATMAGLATCTLTHIT;ATMAGLATCTLTHITE;TMAGLATCTLTHITEL;MAGLATCTLTHITELH;AGLATCTLTHITELHA;GLATCTLTHITELHAS;LATCTLTHITELHASR;ATCTLTHITELHASRD;TCTLTHITELHASRDL;CTLTHITELHASRDLV;TLTHITELHASRDLVA;LTHITELHASRDLVAA;THITELHASRDLVAAL;HITELHASRDLVAALI;ITELHASRDLVAALIG;TELHASRDLVAALIGQ;ELHASRDLVAALIGQP;LHASRDLVAALIGQPA;HASRDLVAALIGQPAT;ASRDLVAALIGQPATP;SRDLVAALIGQPATPQ;RDLVAALIGQPATPQA;DLVAALIGQPATPQAL;LVAALIGQPATPQALV;VAALIGQPATPQALVR;AALIGQPATPQALVRV;ALIGQPATPQALVRVG;LIGQPATPQALVRVGL;IGQPATPQALVRVGLA;GQPATPQALVRVGLAP;QPATPQALVRVGLAPE;PAT | |

Fig. 30 continued

| | | |
|---|---|---|
| | PQALVRVGLAPEM;ATPQALVRVGLAPEME;TPQALVRVGLAPEMEE;PQALVRVGLAPEMEEP;QALVRVGLAPEMEEPP;ALVRVGLAPEMEEPPP;LVRVGLAPEMEEPPPA;VRVGLAPEMEEPPPAT;RVGLAPEMEEPPPATP;VGLAPEMEEPPPATPR;GLAPEMEEPPPATPRR;LAPEMEEPPPATPRRP;APEMEEPPPATPRRPI;PEMEEPPPATPRRPID;EMEEPPPATPRRPIDE;MEEPPPATPRRPIDEV;EEPPPATPRRPIDEVF;EPPPATPRRPIDEVFH;PPPATPRRPIDEVFHV;PPATPRRPIDEVFHVR;PATPRRPIDEVFHVRA;ATPRRPIDEVFHVRAK;TPRRPIDEVFHVRAKD;PRRPIDEVFHVRAKDH;RRPIDEVFHVRAKDHR | |
| 8 | **<NP_217142.1 hypothetical protein Rv2626c;Mycobacterium tuberculosis H37Rv>**<br>MTTARDIMNAGVTCVGEHETLTAAAQYMREHDIGALPICGDDDRLHGMLTDRDIVIKGLAAGLDPNTATAGELARDSIYYVDANASIQEMLNVMEEHQVRRVPVISEHRLVGIVTEADIARHLPEHAIVQFVKAICSPMALAS<br><br>8mer<br>IMNAGVTC;MNAGVTCV;CVGEHETL;TLTAAAQY;LTAAAQYM;TAAAQYMR;QYMREHDI;REHDIGAL;MLTDRDIV;IVIKGLAA;GLDPNTAT;DPNTATAG;NTATAGEL;ATAGELAR;ELARDSIY;LARDSIYY;ARDSIYYV;YVDANASI;SIQEMLNV;NVMEEHQV;VMEEHQVR;EEHQVRRV;HQVRRVPV;VPVISEHR;VISEHRLV;SEHRLVGI;RLVGIVTE;VTEADIAR;DIARHLPE;HLPEHAIV;EHAIVQFV;HAIVQFVK;AIVQFVKA;KAICSPMA;AICSPMAL<br>9mer<br>TTARDIMNA;IMNAGVTCV;GEHETLTAA;ETLTAAAQY;TLTAAAQYM;LTAAAQYMR;YMREHDIGA;RLHGMLTDR;GMLTDRDIV;MLTDRDIVI;LTDRDIVIK;VIKGLAAGL;GLDPNTATA;NTATAGELA;TATAGELAR;ELARDSIYY;LARDSIYYV;SIYYVDANA;YYVDANASI;DANASIQEM;ANASIQEML;SIQEMLNVM;NVMEEHQVR;VMEEHQVRR;HQVRRVPVI;RRVPVISEH;RVPVISEHR;VPVISEHRL;SEHRLVGIV;RLVGIVTEA;IVTEADIAR;TEADIARHL;DIARHLPEH;HLPEHAIVQ;LPEHAIVQF;EHAIVQFVK;HAIVQFVKA;AIVQFVKAI;FVKAICSPM;KAICSPMAL<br>10mer<br>MTTARDIMNA;TARDIMNAGV;DIMNAGVTCV;HETLTAAAQY;ETLTAAAQYM;TLTAAAQYMR;YMREHDIGAL;REHDIGALPI;LPICGDDDRL;GMLTDRDIVI;MLTDRDIVIK;IVIKGLAAGL;GLAAGLDPNT;GLDPNTATAG;DPNTATAGEL;NTATAGELAR;GELARDSIYY;ELARDSIYYV;DSIYYVDANA;IYYVDANASI;DANASIQEML;NASIQEMLNV;ASIQEMLNVM;MLNVMEEHQV;NVMEEHQVRR;VMEEHQVRRV;EEHQVRRVPV;RRVPVISEHR;RVPVISEHRL;VPVISEHRLV;VISEHRLVGI;IARHLPEHAI;HLPEHAIVQF;LPEHAIVQFV;HAIVQFVKAI;FVKAICSPMA;KAICSPMALA<br>11mer<br>TTARDIMNAGV;CVGEHETLTAA;ETLTAAAQYMR;AQYMREHDIGA;QYMREHDIGAL;YMREHDIGALP;ALPICGDDDRL;LPICGDDDRLH;RLHGMLTDRDI;GMLTDRDIVIK;MLTDRDIVIKG;DIVIKGLAAGL;GLAAGLDPNTA;LAAGLDPNTAT;GLDPNTATAGE;DPNTATAGELA;ATAGELARDSI;TAGELARDSIY;GELARDSIYYV;SIYYVDANASI;YVDANASIQEM;NASIQEMLNVM;EMLNVMEEHQV;MLNVMEEHQVR;NVMEEHQVRRV;MEEHQVRRVPV;EEHQVRRVPVI;RRVPVISEHRL;RVPVISEHRLV;VISEHRLVGIV;RLVGIVTEADI;IVTEADIARHL;DIARHLPEHAI;RHLPEHAIVQF;HLPEHAIVQFV;VQFVKAICSPM;FVKAICSPMAL<br><br>13 mers:<br>MTTARDIMNAGVT;TTARDIMNAGVTC;TARDIMNAGVTCV;ARDIMNAGVT | 126475-127142 |

Fig. 30 continued

| | | |
|---|---|---|
| | CVG;RDIMNAGVTCVGE;DIMNAGVTCVGEH;IMNAGVTCVGEHE;MNAGVT<br>CVGEHET;NAGVTCVGEHETL;AGVTCVGEHETLT;GVTCVGEHETLTA;VT<br>CVGEHETLTAA;TCVGEHETLTAAA;CVGEHETLTAAAQ;VGEHETLTAAAQ<br>Y;GEHETLTAAAQYM;EHETLTAAAQYMR;HETLTAAAQYMRE;ETLTAAAQ<br>YMREH;TLTAAAQYMREHD;LTAAAQYMREHDI;TAAAQYMREHDIG;AAAQ<br>YMREHDIGA;AAQYMREHDIGAL;AQYMREHDIGALP;QYMREHDIGALPI;Y<br>MREHDIGALPIC;MREHDIGALPICG;REHDIGALPICGD;EHDIGALPICGDD;<br>HDIGALPICGDDD;DIGALPICGDDDR;IGALPICGDDDRL;GALPICGDDDRL<br>H;ALPICGDDDRLHG;LPICGDDDRLHGM;PICGDDDRLHGML;ICGDDDRLH<br>GMLT;CGDDDRLHGMLTD;GDDDRLHGMLTDR;DDDRLHGMLTDRD;DDR<br>LHGMLTDRDI;DRLHGMLTDRDIV;RLHGMLTDRDIVI;LHGMLTDRDIVIK;HG<br>MLTDRDIVIKG;GMLTDRDIVIKGL;MLTDRDIVIKGLA;LTDRDIVIKGLAA;TD<br>RDIVIKGLAAG;DRDIVIKGLAAGL;RDIVIKGLAAGLD;DIVIKGLAAGLDP;IVIK<br>GLAAGLDPN;VIKGLAAGLDPNT;IKGLAAGLDPNTA;KGLAAGLDPNTAT;GL<br>AAGLDPNTATA;LAAGLDPNTATAG;AAGLDPNTATAGE;AGLDPNTATAGE<br>L;GLDPNTATAGELA;LDPNTATAGELAR;DPNTATAGELARD;PNTATAGEL<br>ARDS;NTATAGELARDSI;TATAGELARDSIY;ATAGELARDSIYY;TAGELAR<br>DSIYYV;AGELARDSIYYVD;GELARDSIYYVDA;ELARDSIYYVDAN;LARDSI<br>YYVDANA;ARDSIYYVDANAS;RDSIYYVDANASI;DSIYYVDANASIQ;SIYYV<br>DANASIQE;IYYVDANASIQEM;YYVDANASIQEML;YVDANASIQEMLN;VDA<br>NASIQEMLNV;DANASIQEMLNVM;ANASIQEMLNVME;NASIQEMLNVMEE;<br>ASIQEMLNVMEEH;SIQEMLNVMEEHQ;IQEMLNVMEEHQV;QEMLNVMEE<br>HQVR;EMLNVMEEHQVRR;MLNVMEEHQVRRV;LNVMEEHQVRRVP;NVM<br>EEHQVRRVPV;VMEEHQVRRVPVI;MEEHQVRRVPVIS;EEHQVRRVPVISE<br>;EHQVRRVPVISEH;HQVRRVPVISEHR;QVRRVPVISEHRL;VRRVPVISEH<br>RLV;RRVPVISEHRLVG;RVPVISEHRLVGI;VPVISEHRLVGIV;PVISEHRLVG<br>IVT;VISEHRLVGIVTE;ISEHRLVGIVTEA;SEHRLVGIVTEAD;EHRLVGIVTEA<br>DI;HRLVGIVTEADIA;RLVGIVTEADIAR;LVGIVTEADIARH;VGIVTEADIARH<br>L;GIVTEADIARHLP;IVTEADIARHLPE;VTEADIARHLPEH;TEADIARHLPEH<br>A;EADIARHLPEHAI;ADIARHLPEHAIV;DIARHLPEHAIVQ;IARHLPEHAIVQF<br>;ARHLPEHAIVQFV;RHLPEHAIVQFVK;HLPEHAIVQFVKA;LPEHAIVQFVKA<br>I;PEHAIVQFVKAIC;EHAIVQFVKAICS;HAIVQFVKAICSP;AIVQFVKAICSPM;<br>IVQFVKAICSPMA;VQFVKAICSPMAL;QFVKAICSPMALA;FVKAICSPMALA<br>S;<br>14 mers:<br>MTTARDIMNAGVTC;TTARDIMNAGVTCV;TARDIMNAGVTCVG;ARDIMNA<br>GVTCVGE;RDIMNAGVTCVGEH;DIMNAGVTCVGEHE;IMNAGVTCVGEHE<br>T;MNAGVTCVGEHETL;NAGVTCVGEHETLT;AGVTCVGEHETLTA;GVTCV<br>GEHETLTAA;VTCVGEHETLTAAA;TCVGEHETLTAAAQ;CVGEHETLTAAA<br>QY;VGEHETLTAAAQYM;GEHETLTAAAQYMR;EHETLTAAAQYMRE;HETL<br>TAAAQYMREH;ETLTAAAQYMREHD;TLTAAAQYMREHDI;LTAAAQYMRE<br>HDIG;TAAAQYMREHDIGA;AAAQYMREHDIGAL;AAQYMREHDIGALP;AQY<br>MREHDIGALPI;QYMREHDIGALPIC;YMREHDIGALPICG;MREHDIGALPIC<br>GD;REHDIGALPICGDD;EHDIGALPICGDDD;HDIGALPICGDDDR;DIGALPI<br>CGDDDRL;IGALPICGDDDRLH;GALPICGDDDRLHG;ALPICGDDDRLHGM;<br>LPICGDDDRLHGML;PICGDDDRLHGMLT;ICGDDDRLHGMLTD;CGDDDRL<br>HGMLTDR;GDDDRLHGMLTDRD;DDDRLHGMLTDRDI;DDRLHGMLTDRDI<br>V;DRLHGMLTDRDIVI;RLHGMLTDRDIVIK;LHGMLTDRDIVIKG;HGMLTDR<br>DIVIKGL;GMLTDRDIVIKGLA;MLTDRDIVIKGLAA;LTDRDIVIKGLAAG;TDR<br>DIVIKGLAAGL;DRDIVIKGLAAGLD;RDIVIKGLAAGLDP;DIVIKGLAAGLDPN;<br>IVIKGLAAGLDPNT;VIKGLAAGLDPNTA;IKGLAAGLDPNTAT;KGLAAGLDP<br>NTATA;GLAAGLDPNTATAG;LAAGLDPNTATAGE;AAGLDPNTATAGEL;AG<br>LDPNTATAGELA;GLDPNTATAGELAR;LDPNTATAGELARD;DPNTATAGE | |

Fig. 30 continued

| | | |
|---|---|---|
| | LARDS;PNTATAGELARDSI;NTATAGELARDSIY;TATAGELARDSIYY;ATAGELARDSIYYV;TAGELARDSIYYVD;AGELARDSIYYVDA;GELARDSIYYVDAN;ELARDSIYYVDANA;LARDSIYYVDANAS;ARDSIYYVDANASI;RDSIYYVDANASIQ;DSIYYVDANASIQE;SIYYVDANASIQEM;IYYVDANASIQEML;YYVDANASIQEMLN;YVDANASIQEMLNV;VDANASIQEMLNVM;DANASIQEMLNVME;ANASIQEMLNVMEE;NASIQEMLNVMEEH;ASIQEMLNVMEEHQ;SIQEMLNVMEEHQV;IQEMLNVMEEHQVR;QEMLNVMEEHQVRR;EMLNVMEEHQVRRV;MLNVMEEHQVRRVP;LNVMEEHQVRRVPV;NVMEEHQVRRVPVI;VMEEHQVRRVPVIS;MEEHQVRRVPVISE;EEHQVRRVPVISEH;EHQVRRVPVISEHR;HQVRRVPVISEHRL;QVRRVPVISEHRLV;VRRVPVISEHRLVG;RRVPVISEHRLVGI;RVPVISEHRLVGIV;VPVISEHRLVGIVT;PVISEHRLVGIVTE;VISEHRLVGIVTEA;ISEHRLVGIVTEAD;SEHRLVGIVTEADI;EHRLVGIVTEADIA;HRLVGIVTEADIAR;RLVGIVTEADIARH;LVGIVTEADIARHL;VGIVTEADIARHLP;GIVTEADIARHLPE;IVTEADIARHLPEH;VTEADIARHLPEHA;TEADIARHLPEHAI;EADIARHLPEHAIV;ADIARHLPEHAIVQ;DIARHLPEHAIVQF;IARHLPEHAIVQFV;ARHLPEHAIVQFVK;RHLPEHAIVQFVKA;HLPEHAIVQFVKAI;LPEHAIVQFVKAIC;PEHAIVQFVKAICS;EHAIVQFVKAICSP;HAIVQFVKAICSPM;AIVQFVKAICSPMA;IVQFVKAICSPMAL;VQFVKAICSPMALA;QFVKAICSPMALAS;<br>15 mers:<br>MTTARDIMNAGVTCV;TTARDIMNAGVTCVG;TARDIMNAGVTCVGE;ARDIMNAGVTCVGEH;RDIMNAGVTCVGEHE;DIMNAGVTCVGEHET;IMNAGVTCVGEHETL;MNAGVTCVGEHETLT;NAGVTCVGEHETLTA;AGVTCVGEHETLTAA;GVTCVGEHETLTAAA;VTCVGEHETLTAAAQ;TCVGEHETLTAAAQY;CVGEHETLTAAAQYM;VGEHETLTAAAQYMR;GEHETLTAAAQYMRE;EHETLTAAAQYMREH;HETLTAAAQYMREHD;ETLTAAAQYMREHDI;TLTAAAQYMREHDIG;LTAAAQYMREHDIGA;TAAAQYMREHDIGAL;AAAQYMREHDIGALP;AAQYMREHDIGALPI;AQYMREHDIGALPIC;QYMREHDIGALPICG;YMREHDIGALPICGD;MREHDIGALPICGDD;REHDIGALPICGDDD;EHDIGALPICGDDDR;HDIGALPICGDDDRL;DIGALPICGDDDRLH;IGALPICGDDDRLHG;GALPICGDDDRLHGM;ALPICGDDDRLHGML;LPICGDDDRLHGMLT;PICGDDDRLHGMLTD;ICGDDDRLHGMLTDR;CGDDDRLHGMLTDRD;GDDDRLHGMLTDRDI;DDDRLHGMLTDRDIV;DDRLHGMLTDRDIVI;DRLHGMLTDRDIVIK;RLHGMLTDRDIVIKG;LHGMLTDRDIVIKGL;HGMLTDRDIVIKGLA;GMLTDRDIVIKGLAA;MLTDRDIVIKGLAAG;LTDRDIVIKGLAAGL;TDRDIVIKGLAAGLD;DRDIVIKGLAAGLDP;RDIVIKGLAAGLDPN;DIVIKGLAAGLDPNT;IVIKGLAAGLDPNTA;VIKGLAAGLDPNTAT;IKGLAAGLDPNTATA;KGLAAGLDPNTATAG;GLAAGLDPNTATAGE;LAAGLDPNTATAGEL;AAGLDPNTATAGELA;AGLDPNTATAGELAR;GLDPNTATAGELARD;LDPNTATAGELARDS;DPNTATAGELARDSI;PNTATAGELARDSIY;NTATAGELARDSIYY;TATAGELARDSIYYV;ATAGELARDSIYYVD;TAGELARDSIYYVDA;AGELARDSIYYVDAN;GELARDSIYYVDANA;ELARDSIYYVDANAS;LARDSIYYVDANASI;ARDSIYYVDANASIQ;RDSIYYVDANASIQE;DSIYYVDANASIQEM;SIYYVDANASIQEML;IYYVDANASIQEMLN;YYVDANASIQEMLNV;YVDANASIQEMLNVM;VDANASIQEMLNVME;DANASIQEMLNVMEE;ANASIQEMLNVMEEH;NASIQEMLNVMEEHQ;ASIQEMLNVMEEHQV;SIQEMLNVMEEHQVR;IQEMLNVMEEHQVRR;QEMLNVMEEHQVRRV;EMLNVMEEHQVRRVP;MLNVMEEHQVRRVPV;LNVMEEHQVRRVPVI;NVMEEHQVRRVPVIS;VMEEHQVRRVPVISE;MEEHQVRRVPVISEH;EEHQVRRVPVISEHR;EHQVRRVPVISEHRL;HQVRRVPVISEHRLV;QVRRVPVISEHRLVG;VRRVPVISEHRLVGI;RRVPVISEHRLVGIV;RVPVISEHRLVGIVT;VPVISEHRLVGIVTE;PVISEHRLVGIVTEA;VISEHRLVGIVTEAD;ISEHRLVGIVTEADI;SEHRLVGIVTEADIA;EHRLVGIVTEADIAR;HRLVGIVTEADIARH;RLVGIVTEADIARHL;LVGIVTEADIARH | |

Fig. 30 continued

| | | |
|---|---|---|
| | LP;VGIVTEADIARHLPE;GIVTEADIARHLPEH;IVTEADIARHLPEHA;VTEADIARHLPEHAI;TEADIARHLPEHAIV;EADIARHLPEHAIVQ;ADIARHLPEHAIVQF;DIARHLPEHAIVQFV;IARHLPEHAIVQFVK;ARHLPEHAIVQFVKA;RHLPEHAIVQFVKAI;HLPEHAIVQFVKAIC;LPEHAIVQFVKAICS;PEHAIVQFVKAICSP;EHAIVQFVKAICSPM;HAIVQFVKAICSPMA;AIVQFVKAICSPMAL;IVQFVKAICSPMALA;VQFVKAICSPMALAS;<br>16 mers:<br>MTTARDIMNAGVTCVG;TTARDIMNAGVTCVGE;TARDIMNAGVTCVGEH;ARDIMNAGVTCVGEHE;RDIMNAGVTCVGEHET;DIMNAGVTCVGEHETL;IMNAGVTCVGEHETLT;MNAGVTCVGEHETLTA;NAGVTCVGEHETLTAA;AGVTCVGEHETLTAAA;GVTCVGEHETLTAAAQ;VTCVGEHETLTAAAQY;TCVGEHETLTAAAQYM;CVGEHETLTAAAQYMR;VGEHETLTAAAQYMRE;GEHETLTAAAQYMREH;EHETLTAAAQYMREHD;HETLTAAAQYMREHDI;ETLTAAAQYMREHDIG;TLTAAAQYMREHDIGA;LTAAAQYMREHDIGAL;TAAAQYMREHDIGALP;AAAQYMREHDIGALPI;AAQYMREHDIGALPIC;AQYMREHDIGALPICG;QYMREHDIGALPICGD;YMREHDIGALPICGDD;MREHDIGALPICGDDD;REHDIGALPICGDDDR;EHDIGALPICGDDDRL;HDIGALPICGDDDRLH;DIGALPICGDDDRLHG;IGALPICGDDDRLHGM;GALPICGDDDRLHGML;ALPICGDDDRLHGMLT;LPICGDDDRLHGMLTD;PICGDDDRLHGMLTDR;ICGDDDRLHGMLTDRD;CGDDDRLHGMLTDRDI;GDDDRLHGMLTDRDIV;DDDRLHGMLTDRDIVI;DDRLHGMLTDRDIVIK;DRLHGMLTDRDIVIKG;RLHGMLTDRDIVIKGL;LHGMLTDRDIVIKGLA;HGMLTDRDIVIKGLAA;GMLTDRDIVIKGLAAG;MLTDRDIVIKGLAAGL;LTDRDIVIKGLAAGLD;TDRDIVIKGLAAGLDP;DRDIVIKGLAAGLDPN;RDIVIKGLAAGLDPNT;DIVIKGLAAGLDPNTA;IVIKGLAAGLDPNTAT;VIKGLAAGLDPNTATA;IKGLAAGLDPNTATAG;KGLAAGLDPNTATAGE;GLAAGLDPNTATAGEL;LAAGLDPNTATAGELA;AAGLDPNTATAGELAR;AGLDPNTATAGELARD;GLDPNTATAGELARDS;LDPNTATAGELARDSI;DPNTATAGELARDSIY;PNTATAGELARDSIYY;NTATAGELARDSIYYV;TATAGELARDSIYYVD;ATAGELARDSIYYVDA;TAGELARDSIYYVDAN;AGELARDSIYYVDANA;GELARDSIYYVDANAS;ELARDSIYYVDANASI;LARDSIYYVDANASIQ;ARDSIYYVDANASIQE;RDSIYYVDANASIQEM;DSIYYVDANASIQEML;SIYYVDANASIQEMLN;IYYVDANASIQEMLNV;YYVDANASIQEMLNVM;YVDANASIQEMLNVME;VDANASIQEMLNVMEE;DANASIQEMLNVMEEH;ANASIQEMLNVMEEHQ;NASIQEMLNVMEEHQV;ASIQEMLNVMEEHQVR;SIQEMLNVMEEHQVRR;IQEMLNVMEEHQVRRV;QEMLNVMEEHQVRRVP;EMLNVMEEHQVRRVPV;MLNVMEEHQVRRVPVI;LNVMEEHQVRRVPVIS;NVMEEHQVRRVPVISE;VMEEHQVRRVPVISEH;MEEHQVRRVPVISEHR;EEHQVRRVPVISEHRL;EHQVRRVPVISEHRLV;HQVRRVPVISEHRLVG;QVRRVPVISEHRLVGI;VRRVPVISEHRLVGIV;RRVPVISEHRLVGIVT;RVPVISEHRLVGIVTE;VPVISEHRLVGIVTEA;PVISEHRLVGIVTEAD;VISEHRLVGIVTEADI;ISEHRLVGIVTEADIA;SEHRLVGIVTEADIAR;EHRLVGIVTEADIARH;HRLVGIVTEADIARHL;RLVGIVTEADIARHLP;LVGIVTEADIARHLPE;VGIVTEADIARHLPEH;GIVTEADIARHLPEHA;IVTEADIARHLPEHAI;VTEADIARHLPEHAIV;TEADIARHLPEHAIVQ;EADIARHLPEHAIVQF;ADIARHLPEHAIVQFV;DIARHLPEHAIVQFVK;IARHLPEHAIVQFVKA;ARHLPEHAIVQFVKAI;RHLPEHAIVQFVKAIC;HLPEHAIVQFVKAICS;LPEHAIVQFVKAICSP;PEHAIVQFVKAICSPM;EHAIVQFVKAICSPMA;HAIVQFVKAICSPMAL;AIVQFVKAICSPMALA;IVQFVKAICSPMALAS | |
| 9 | **<NP_216521.1 hypothetical protein Rv2005c;Mycobacterium tuberculosis H37Rv>**<br>MSKPRKQHGVVVGVDGSLESDAAACWGATDAAMRNIPLTVVHVVNADVATWPPMPYPETWGVWQEDEGRQIVANAVKLAKEAVGADRKLSVKSELVFSTPVPTMVEISNEAEMVVLGSSGRGALARGLLGSVSSSLVRRAGCPVAVIHS | 127143-128625 |

Fig. 30 continued

| | | |
|---|---|---|
| | DDAVIPDPQHAPVLVGIDGSPVSELATAVAFDEASRRGVELIAVHAWSDVEVVELPGLDFSAVQQEAELSLAERLAGWQERYPDVPVSRVVVCDRPARKLVQKSASAQLVVVGSHGRGGLTGMLLGSVSNAVLHAARVPVIVARQS<br><br>8mer<br>KPRKQHGV;SLESDAAA;ESDAAACW;DAAACWGA;WGATDAAM;GATDAAMR;AAMRNIPL;AMRNIPLT;IPLTVVHV;PLTVVHVV;TVVHVVNA;VNADVATW;DVATWPPM;ATWPPMPY;MPYPETWG;PYPETWGV;YPETWGVW;RQIVANAV;QIVANAVK;IVANAVKL;EAVGADRK;GADRKLSV;KLSVKSEL;SVKSELVF;ELVFSTPV;FSTPVPTM;STPVPTMV;VPTMVEIS;EISNEAEM;NEAEMVVL;AEMVVLGS;VVLGSSGR;SGRGALAR;GLLGSVSS;LLGSVSSS;SVSSSLVR;VSSSLVRR;RAGCPVAV;CPVAVIHS;VIHSDDAV;VIPDPQHA;DPQHAPVL;HAPVLVGI;VGIDGSPV;DGSPVSEL;SPVSELAT;ELATAVAF;TAVAFDEA;VAFDEASR;RGVELIAV;ELIAVHAW;AVHAWSDV;HAWSDVEV;EVVELPGL;VELPGLDF;ELPGLDFS;LPGLDFSA;PGLDFSAV;GLDFSAVQ;FSAVQQEA;AVQQEAEL;ELSLAERL;SLAERLAG;RLAGWQER;LAGWQERY;ERYPDVPV;DVPVSRVV;VPVSRVVV;VVCDRPAR;RPARKLVQ;PARKLVQK;KSASAQLV;SASAQLVV;VVVGSHGR;GRGGLTGM;GLTGMLLG;TGMLLGSV;MLLGSVSN;LLGSVSNA;SVSNAVLH;NAVLHAAR;AVLHAARV;HAARVPVI;RVPVIVAR<br>9mer<br>SKPRKQHGV;KPRKQHGVV;KQHGVVVGV;VVVGVDGSL;LESDAAACW;DAAACWGAT;WGATDAAMR;DAAMRNIPL;AMRNIPLTV;NIPLTVVHV;IPLTVVHVV;VVHVVNADV;HVVNADVAT;VVNADVATW;VATWPPMPY;WPPMPYPET;PPMPYPETW;MPYPETWGV;PYPETWGVW;QEDEGRQIV;RQIVANAVK;QIVANAVKL;IVANAVKLA;VANAVKLAK;KLAKEAVGA;VGADRKLSV;KLSVKSELV;LSVKSELVF;SELVFSTPV;LVFSTPVPT;FSTPVPTMV;TPVPTMVEI;TMVEISNEA;EISNEAEMV;AEMVVLGSS;MVVLGSSGR;VLGSSGRGA;SSGRGALAR;ALARGLLGS;LARGLLGSV;GLLGSVSSS;LLGSVSSSL;GSVSSSLVR;SVSSSLVRR;LVRRAGCPV;RRAGCPVAV;CPVAVIHSD;AVIHSDDAV;VIPDPQHAP;IPDPQHAPV;LVGIDGSPV;DGSPVSELA;SPVSELATA;PVSELATAV;SELATAVAF;ATAVAFDEA;TAVAFDEAS;AVAFDEASR;VAFDEASRR;VELIAVHAW;ELIAVHAWS;HAWSDVEVV;VEVVELPGL;ELPGLDFSA;LPGLDFSAV;GLDFSAVQQ;SAVQQEAEL;VQQEAELSL;QQEAELSLA;EAELSLAER;AELSLAERL;SLAERLAGW;RLAGWQERY;RYPDVPVSR;YPDVPVSRV;DVPVSRVVV;VPVSRVVVC;VSRVVVCDR;VVVCDRPAR;VVCDRPARK;KLVQKSASA;VQKSASAQL;KSASAQLVV;SASAQLVVV;LVVVGSHGR;GLTGMLLGS;LTGMLLGSV;MLLGSVSNA;LLGSVSNAV;SNAVLHAAR;NAVLHAARV;VLHAARVPV;HAARVPVIV;VPVIVARQS<br>10mer<br>KPRKQHGVVV;ACWGATDAAM;TDAAMRNIPL;AAMRNIPLTV;AMRNIPLTVV;NIPLTVVHVV;IPLTVVHVVN;PLTVVHVVNA;TVVHVVNADV;HVVNADVATW;NADVATWPPM;DVATWPPMPY;WPPMPYPETW;PMPYPETWGV;MPYPETWGVW;WQEDEGRQIV;EGRQIVANAV;GRQIVANAVK;RQIVANAVKL;IVANAVKLAK;NAVKLAKEAV;LAKEAVGADR;KEAVGADRKL;AVGADRKLSV;KLSVKSELVF;LVFSTPVPTM;STPVPTMVEI;TPVPTMVEIS;MVEISNEAEM;VEISNEAEMV;EISNEAEMVV;ISNEAEMVVL;EMVVLGSSGR;VLGSSGRGAL;GSSGRGALAR;ALARGLLGSV;GLLGSVSSSL;LLGSVSSSLV;GSVSSSLVRR;SVSSSLVRRA;SLVRRAGCPV;RRAGCPVAVI;AVIHSDDAVI;VIPDPQHAPV;IPDPQHAPVL;APVLVGIDGS;VLVGIDGSPV;GIDGSPVSEL;SPVSELATAV;VSELATAVAF;LATAVAFDEA;TAVAFDEASR;AVAFDEASRR;AFDEASRRGV;EASRRGVELI;LIAVHAWSDV;AVHAWSDVEV;EVVELPGLDF;VELPGLDFSA;ELPGLDFSAV;FSAVQQEAEL;AVQQEAELSL;VQQEAELSLA;AEL | |

Fig. 30 continued

| | | |
|---|---|---|
| | SLAERLA;LSLAERLAGW;SLAERLAGWQ;RLAGWQERYP;WQERYPDVPV;ERYPDVPVSR;RYPDVPVSRV;YPDVPVSRVV;PVSRVVVCDR;RVVVCDRPAR;VVVCDRPARK;VVCDRPARKL;LVQKSASAQL;VQKSASAQLV;KSASAQLVVV;QLVVVGSHGR;GLTGMLLGSV;GMLLGSVSNA;MLLGSVSNAV;LLGSVSNAVL;SVSNAVLHAA;VSNAVLHAAR;AVLHAARVPV;VLHAARVPVI;HAARVPVIVA;AARVPVIVAR<br>11mer<br>KPRKQHGVVVG;GVDGSLESDAA;GSLESDAAACW;AAACWGATDAA;AACWGATDAAM;DAAMRNIPLTV;AAMRNIPLTVV;AMRNIPLTVVH;IPLTVVHVVNA;LTVVHVVNADV;TVVHVVNADVA;ATWPPMPYPET;TWPPMPYPETW;PPMPYPETWGV;MPYPETWGVWQ;RQIVANAVKLA;QIVANAVKLAK;KLAKEAVGADR;LAKEAVGADRK;EAVGADRKLSV;AVGADRKLSVK;RKLSVKSELVF;KLSVKSELVFS;VKSELVFSTPV;SELVFSTPVPT;ELVFSTPVPTM;LVFSTPVPTMV;FSTPVPTMVEI;VPTMVEISNEA;TMVEISNEAEM;MVEISNEAEMV;VEISNEAEMVV;EISNEAEMVVL;MVVLGSSGRGA;VVLGSSGRGAL;VLGSSGRGALA;GALARGLLGSV;GLLGSVSSSLV;LLGSVSSSLVR;SLVRRAGCPVA;LVRRAGCPVAV;RRAGCPVAVIH;CPVAVIHSDDA;PVAVIHSDDAV;AVIPDPQHAPV;VIPDPQHAPVL;IPDPQHAPVLV;PVLVGIDGSPV;GIDGSPVSELA;SPVSELATAVA;PVSELATAVAF;ELATAVAFDEA;ATAVAFDEASR;TAVAFDEASRR;VAFDEASRRGV;RGVELIAVHAW;ELIAVHAWSDV;IAVHAWSDVEV;AVHAWSDVEVV;HAWSDVEVVEL;VEVVELPGLDF;VELPGLDFSAV;ELPGLDFSAVQ;GLDFSAVQQEA;SAVQQEAELSL;QEAELSLAERL;AELSLAERLAG;SLAERLAGWQE;LAERLAGWQER;AERLAGWQERY;RLAGWQERYPD;ERYPDVPVSRV;RYPDVPVSRVV;YPDVPVSRVVV;RVVVCDRPARK;VVCDRPARKLV;RPARKLVQKSA;KLVQKSASAQL;LVQKSASAQLV;VQKSASAQLVV;AQLVVVGSHGR;SHGRGGLTGML;GMLLGSVSNAV;MLLGSVSNAVL;SVSNAVLHAAR;VSNAVLHAARV;NAVLHAARVPV;VLHAARVPVIV;HAARVPVIVAR<br><br>13 mers:<br>MSKPRKQHGVVVG;SKPRKQHGVVVGV;KPRKQHGVVVGVD;PRKQHGVVVGVDG;RKQHGVVVGVDGS;KQHGVVVGVDGSL;QHGVVVGVDGSLE;HGVVVGVDGSLES;GVVVGVDGSLESD;VVVGVDGSLESDA;VVGVDGSLESDAA;VGVDGSLESDAAA;GVDGSLESDAAAC;VDGSLESDAAACW;DGSLESDAAACWG;GSLESDAAACWGA;SLESDAAACWGAT;LESDAAACWGATD;ESDAAACWGATDA;SDAAACWGATDAA;DAAACWGATDAAM;AAACWGATDAAMR;AACWGATDAAMRN;ACWGATDAAMRNI;CWGATDAAMRNIP;WGATDAAMRNIPL;GATDAAMRNIPLT;ATDAAMRNIPLTV;TDAAMRNIPLTVV;DAAMRNIPLTVVH;AAMRNIPLTVVHV;AMRNIPLTVVHVV;MRNIPLTVVHVVN;RNIPLTVVHVVNA;NIPLTVVHVVNAD;IPLTVVHVVNADV;PLTVVHVVNADVA;LTVVHVVNADVAT;TVVHVVNADVATW;VVHVVNADVATWP;VHVVNADVATWPP;HVVNADVATWPPM;VVNADVATWPPMP;VNADVATWPPMPY;NADVATWPPMPYP;ADVATWPPMPYPE;DVATWPPMPYPET;VATWPPMPYPETW;ATWPPMPYPETWG;TWPPMPYPETWGV;WPPMPYPETWGVW;PPMPYPETWGVWQ;PMPYPETWGVWQE;MPYPETWGVWQED;PYPETWGVWQEDE;YPETWGVWQEDEG;PETWGVWQEDEGR;ETWGVWQEDEGRQ;TWGVWQEDEGRQI;WGVWQEDEGRQIV;GVWQEDEGRQIVA;VWQEDEGRQIVAN;WQEDEGRQIVANA;QEDEGRQIVANAV;EDEGRQIVANAVK;DEGRQIVANAVKL;EGRQIVANAVKLA;GRQIVANAVKLAK;RQIVANAVKLAKE;QIVANAVKLAKEA;IVANAVKLAKEAV;VANAVKLAKEAVG;ANAVKLAKEAVGA;NAVKLAKEAVGAD;AVKLAKEAVGADR;VKLAKEAVGADRK;KLAKEAVGADRKL;LAKEAVGADRKLS;AKEAVGADRKLSV;KEAVGADRKLSVK;EAVGADRKLSVKS;AVGADRKLSVKSE;VGADRKLSVKSEL;GADRKLSVKSE | |

Fig. 30 continued

| | | |
|---|---|---|
| | LV;ADRKLSVKSELVF;DRKLSVKSELVFS;RKLSVKSELVFST;KLSVKSELVFSTP;LSVKSELVFSTPV;SVKSELVFSTPVP;VKSELVFSTPVPT;KSELVFSTPVPTM;SELVFSTPVPTMV;ELVFSTPVPTMVE;LVFSTPVPTMVEI;VFSTPVPTMVEIS;FSTPVPTMVEISN;STPVPTMVEISNE;TPVPTMVEISNEA;PVPTMVEISNEAE;VPTMVEISNEAEM;PTMVEISNEAEMV;TMVEISNEAEMVV;MVEISNEAEMVVL;VEISNEAEMVVLG;EISNEAEMVVLGS;ISNEAEMVVLGSS;SNEAEMVVLGSSG;NEAEMVVLGSSGR;EAEMVVLGSSGRG;AEMVVLGSSGRGA;EMVVLGSSGRGAL;MVVLGSSGRGALA;VVLGSSGRGALAR;VLGSSGRGALARG;LGSSGRGALARGL;GSSGRGALARGLL;SSGRGALARGLLG;SGRGALARGLLGS;GRGALARGLLGSV;RGALARGLLGSVS;GALARGLLGSVSS;ALARGLLGSVSSS;LARGLLGSVSSSL;ARGLLGSVSSSLV;RGLLGSVSSSLVR;GLLGSVSSSLVRR;LLGSVSSSLVRRA;LGSVSSSLVRRAG;GSVSSSLVRRAGC;SVSSSLVRRAGCP;VSSSLVRRAGCPV;SSSLVRRAGCPVA;SSLVRRAGCPVAV;SLVRRAGCPVAVI;LVRRAGCPVAVIH;VRRAGCPVAVIHS;RRAGCPVAVIHSD;RAGCPVAVIHSDD;AGCPVAVIHSDDA;GCPVAVIHSDDAV;CPVAVIHSDDAVI;PVAVIHSDDAVIP;VAVIHSDDAVIPD;AVIHSDDAVIPDP;VIHSDDAVIPDPQ;IHSDDAVIPDPQH;HSDDAVIPDPQHA;SDDAVIPDPQHAP;DDAVIPDPQHAPV;DAVIPDPQHAPVL;AVIPDPQHAPVLV;VIPDPQHAPVLVG;IPDPQHAPVLVGI;PDPQHAPVLVGID;DPQHAPVLVGIDG;PQHAPVLVGIDGS;QHAPVLVGIDGSP;HAPVLVGIDGSPV;APVLVGIDGSPVS;PVLVGIDGSPVSE;VLVGIDGSPVSEL;LVGIDGSPVSELA;VGIDGSPVSELAT;GIDGSPVSELATA;IDGSPVSELATAV;DGSPVSELATAVA;GSPVSELATAVAF;SPVSELATAVAFD;PVSELATAVAFDE;VSELATAVAFDEA;SELATAVAFDEAS;ELATAVAFDEASR;LATAVAFDEASRR;ATAVAFDEASRRG;TAVAFDEASRRGV;AVAFDEASRRGVE;VAFDEASRRGVEL;AFDEASRRGVELI;FDEASRRGVELIA;DEASRRGVELIAV;EASRRGVELIAVH;ASRRGVELIAVHA;SRRGVELIAVHAW;RRGVELIAVHAWS;RGVELIAVHAWSD;GVELIAVHAWSDV;VELIAVHAWSDVE;ELIAVHAWSDVEV;LIAVHAWSDVEVV;IAVHAWSDVEVVE;AVHAWSDVEVVEL;VHAWSDVEVVELP;HAWSDVEVVELPG;AWSDVEVVELPGL;WSDVEVVELPGLD;SDVEVVELPGLDF;DVEVVELPGLDFS;VEVVELPGLDFSA;EVVELPGLDFSAV;VVELPGLDFSAVQ;VELPGLDFSAVQQ;ELPGLDFSAVQQE;LPGLDFSAVQQEA;PGLDFSAVQQEAE;GLDFSAVQQEAEL;LDFSAVQQEAELS;DFSAVQQEAELSL;FSAVQQEAELSLA;SAVQQEAELSLAE;AVQQEAELSLAER;VQQEAELSLAERL;QQEAELSLAERLA;QEAELSLAERLAG;EAELSLAERLAGW;AELSLAERLAGWQ;ELSLAERLAGWQE;LSLAERLAGWQER;SLAERLAGWQERY;LAERLAGWQERYP;AERLAGWQERYPD;ERLAGWQERYPDV;RLAGWQERYPDVP;LAGWQERYPDVPV;AGWQERYPDVPVS;GWQERYPDVPVSR;WQERYPDVPVSRV;QERYPDVPVSRVV;ERYPDVPVSRVVV;RYPDVPVSRVVVC;YPDVPVSRVVVCD;PDVPVSRVVVCDR;DVPVSRVVVCDRP;VPVSRVVVCDRPA;PVSRVVVCDRPAR;VSRVVVCDRPARK;SRVVVCDRPARKL;RVVVCDRPARKLV;VVVCDRPARKLVQ;VVCDRPARKLVQK;VCDRPARKLVQKS;CDRPARKLVQKSA;DRPARKLVQKSAS;RPARKLVQKSASA;PARKLVQKSASAQ;ARKLVQKSASAQL;RKLVQKSASAQLV;KLVQKSASAQLVV;LVQKSASAQLVVV;VQKSASAQLVVVG;QKSASAQLVVVGS;KSASAQLVVVGSH;SASAQLVVVGSHG;ASAQLVVVGSHGR;SAQLVVVGSHGRG;AQLVVVGSHGRGG;QLVVVGSHGRGGL;LVVVGSHGRGGLT;VVVGSHGRGGLTG;VVGSHGRGGLTGM;VGSHGRGGLTGML;GSHGRGGLTGMLL;SHGRGGLTGMLLG;HGRGGLTGMLLGS;GRGGLTGMLLGSV;RGGLTGMLLGSVS;GGLTGMLLGSVSN;GLTGMLLGSVSNA;LTGMLLGSVSNAV;TGMLLGSVSNAVL;GMLLGSVSNAVLH;MLLGSVSNAVLHA;LLGSVSNAVLHAA;LGSVSNAVLHAAR;GSVSNAVLHAARV;SVSNAVLHAARVP;VSNAVLHAARVPV;SNAVLHAARVPVI;NAVLHAARVPVIV;AVLHAARVPVIVA;VLHAARVPVIVAR;LHAARVPVIVARQ;HAAR | |

Fig. 30 continued

VPVIVARQS;
14 mers:
MSKPRKQHGVVVGV;SKPRKQHGVVVGVD;KPRKQHGVVVGVDG;PRKQ
HGVVVGVDGS;RKQHGVVVGVDGSL;KQHGVVVGVDGSLE;QHGVVVGVD
GSLES;HGVVVGVDGSLESD;GVVVGVDGSLESDA;VVVGVDGSLESDAA;
VVGVDGSLESDAAA;VGVDGSLESDAAAC;GVDGSLESDAAACW;VDGSLE
SDAAACWG;DGSLESDAAACWGA;GSLESDAAACWGAT;SLESDAAACW
GATD;LESDAAACWGATDA;ESDAAACWGATDAA;SDAAACWGATDAAM;
DAAACWGATDAAMR;AAACWGATDAAMRN;AACWGATDAAMRNI;ACWG
ATDAAMRNIP;CWGATDAAMRNIPL;WGATDAAMRNIPLT;GATDAAMRNIP
LTV;ATDAAMRNIPLTVV;TDAAMRNIPLTVVH;DAAMRNIPLTVVHV;AAMRN
IPLTVVHVV;AMRNIPLTVVHVVN;MRNIPLTVVHVVNA;RNIPLTVVHVVNAD;
NIPLTVVHVVNADV;IPLTVVHVVNADVA;PLTVVHVVNADVAT;LTVVHVVNA
DVATW;TVVHVVNADVATWP;VVHVVNADVATWPP;VHVVNADVATWPPM;
HVVNADVATWPPMP;VVNADVATWPPMPY;VNADVATWPPMPYP;NADVA
TWPPMPYPE;ADVATWPPMPYPET;DVATWPPMPYPETW;VATWPPMPYP
ETWG;ATWPPMPYPETWGV;TWPPMPYPETWGVW;WPPMPYPETWGVW
Q;PPMPYPETWGVWQE;PMPYPETWGVWQED;MPYPETWGVWQEDE;PY
PETWGVWQEDEG;YPETWGVWQEDEGR;PETWGVWQEDEGRQ;ETWG
VWQEDEGRQI;TWGVWQEDEGRQIV;WGVWQEDEGRQIVA;GVWQEDEG
RQIVAN;VWQEDEGRQIVANA;WQEDEGRQIVANAV;QEDEGRQIVANAVK;
EDEGRQIVANAVKL;DEGRQIVANAVKLA;EGRQIVANAVKLAK;GRQIVANA
VKLAKE;RQIVANAVKLAKEA;QIVANAVKLAKEAV;IVANAVKLAKEAVG;VA
NAVKLAKEAVGA;ANAVKLAKEAVGAD;NAVKLAKEAVGADR;AVKLAKEAV
GADRK;VKLAKEAVGADRKL;KLAKEAVGADRKLS;LAKEAVGADRKLSV;AK
EAVGADRKLSVK;KEAVGADRKLSVKS;EAVGADRKLSVKSE;AVGADRKLS
VKSEL;VGADRKLSVKSELV;GADRKLSVKSELVF;ADRKLSVKSELVFS;DR
KLSVKSELVFST;RKLSVKSELVFSTP;KLSVKSELVFSTPV;LSVKSELVFST
PVP;SVKSELVFSTPVPT;VKSELVFSTPVPTM;KSELVFSTPVPTMV;SELVF
STPVPTMVE;ELVFSTPVPTMVEI;LVFSTPVPTMVEIS;VFSTPVPTMVEISN;
FSTPVPTMVEISNE;STPVPTMVEISNEA;TPVPTMVEISNEAE;PVPTMVEIS
NEAEM;VPTMVEISNEAEMV;PTMVEISNEAEMVV;TMVEISNEAEMVVL;MV
EISNEAEMVVLG;VEISNEAEMVVLGS;EISNEAEMVVLGSS;ISNEAEMVVL
GSSG;SNEAEMVVLGSSGR;NEAEMVVLGSSGRG;EAEMVVLGSSGRGA;A
EMVVLGSSGRGAL;EMVVLGSSGRGALA;MVVLGSSGRGALAR;VVLGSSG
RGALARG;VLGSSGRGALARGL;LGSSGRGALARGLL;GSSGRGALARGLL
G;SSGRGALARGLLGS;SGRGALARGLLGSV;GRGALARGLLGSVS;RGALA
RGLLGSVSS;GALARGLLGSVSSS;ALARGLLGSVSSSL;LARGLLGSVSSSL
V;ARGLLGSVSSSLVR;RGLLGSVSSSLVRR;GLLGSVSSSLVRRA;LLGSVS
SSLVRRAG;LGSVSSSLVRRAGC;GSVSSSLVRRAGCP;SVSSSLVRRAGC
PV;VSSSLVRRAGCPVA;SSSLVRRAGCPVAV;SSLVRRAGCPVAVI;SLVRR
AGCPVAVIH;LVRRAGCPVAVIHS;VRRAGCPVAVIHSD;RRAGCPVAVIHSD
D;RAGCPVAVIHSDDA;AGCPVAVIHSDDAV;GCPVAVIHSDDAVI;CPVAVIH
SDDAVIP;PVAVIHSDDAVIPD;VAVIHSDDAVIPDP;AVIHSDDAVIPDPQ;VIH
SDDAVIPDPQH;IHSDDAVIPDPQHA;HSDDAVIPDPQHAP;SDDAVIPDPQH
APV;DDAVIPDPQHAPVL;DAVIPDPQHAPVLV;AVIPDPQHAPVLVG;VIPDP
QHAPVLVGI;IPDPQHAPVLVGID;PDPQHAPVLVGIDG;DPQHAPVLVGIDG
S;PQHAPVLVGIDGSP;QHAPVLVGIDGSPV;HAPVLVGIDGSPVS;APVLVGI
DGSPVSE;PVLVGIDGSPVSEL;VLVGIDGSPVSELA;LVGIDGSPVSELAT;V
GIDGSPVSELATA;GIDGSPVSELATAV;IDGSPVSELATAVA;DGSPVSELAT
AVAF;GSPVSELATAVAFD;SPVSELATAVAFDE;PVSELATAVAFDEA;VSEL
ATAVAFDEAS;SELATAVAFDEASR;ELATAVAFDEASRR;LATAVAFDEASR
RG;ATAVAFDEASRRGV;TAVAFDEASRRGVE;AVAFDEASRRGVEL;VAFD

Fig. 30 continued

| | | |
|---|---|---|
| | EASRRGVELI;AFDEASRRGVELIA;FDEASRRGVELIAV;DEASRRGVELIAVH;EASRRGVELIAVHA;ASRRGVELIAVHAW;SRRGVELIAVHAWS;RRGVELIAVHAWSD;RGVELIAVHAWSDV;GVELIAVHAWSDVE;VELIAVHAWSDVEV;ELIAVHAWSDVEVV;LIAVHAWSDVEVVE;IAVHAWSDVEVVEL;AVHAWSDVEVVELP;VHAWSDVEVVELPG;HAWSDVEVVELPGL;AWSDVEVVELPGLD;WSDVEVVELPGLDF;SDVEVVELPGLDFS;DVEVVELPGLDFSA;VEVVELPGLDFSAV;EVVELPGLDFSAVQ;VVELPGLDFSAVQQ;VELPGLDFSAVQQE;ELPGLDFSAVQQEA;LPGLDFSAVQQEAE;PGLDFSAVQQEAEL;GLDFSAVQQEAELS;LDFSAVQQEAELSL;DFSAVQQEAELSLA;FSAVQQEAELSLAE;SAVQQEAELSLAER;AVQQEAELSLAERL;VQQEAELSLAERLA;QQEAELSLAERLAG;QEAELSLAERLAGW;EAELSLAERLAGWQ;AELSLAERLAGWQE;ELSLAERLAGWQER;LSLAERLAGWQERY;SLAERLAGWQERYP;LAERLAGWQERYPD;AERLAGWQERYPDV;ERLAGWQERYPDVP;RLAGWQERYPDVPV;LAGWQERYPDVPVS;AGWQERYPDVPVSR;GWQERYPDVPVSRV;WQERYPDVPVSRVV;QERYPDVPVSRVVV;ERYPDVPVSRVVVC;RYPDVPVSRVVVCD;YPDVPVSRVVVCDR;PDVPVSRVVVCDRP;DVPVSRVVVCDRPA;VPVSRVVVCDRPAR;PVSRVVVCDRPARK;VSRVVVCDRPARKL;SRVVVCDRPARKLV;RVVVCDRPARKLVQ;VVVCDRPARKLVQK;VVCDRPARKLVQKS;VCDRPARKLVQKSA;CDRPARKLVQKSAS;DRPARKLVQKSASA;RPARKLVQKSASAQ;PARKLVQKSASAQL;ARKLVQKSASAQLV;RKLVQKSASAQLVV;KLVQKSASAQLVVV;LVQKSASAQLVVVG;VQKSASAQLVVVGS;QKSASAQLVVVGSH;KSASAQLVVVGSHG;SASAQLVVVGSHGR;ASAQLVVVGSHGRG;SAQLVVVGSHGRGG;AQLVVVGSHGRGGL;QLVVVGSHGRGGLT;LVVVGSHGRGGLTG;VVVGSHGRGGLTGM;VVGSHGRGGLTGML;VGSHGRGGLTGMLL;GSHGRGGLTGMLLG;SHGRGGLTGMLLGS;HGRGGLTGMLLGSV;GRGGLTGMLLGSVS;RGGLTGMLLGSVSN;GGLTGMLLGSVSNA;GLTGMLLGSVSNAV;LTGMLLGSVSNAVL;TGMLLGSVSNAVLH;GMLLGSVSNAVLHA;MLLGSVSNAVLHAA;LLGSVSNAVLHAAR;LGSVSNAVLHAARV;GSVSNAVLHAARVP;SVSNAVLHAARVPV;VSNAVLHAARVPVI;SNAVLHAARVPVIV;NAVLHAARVPVIVA;AVLHAARVPVIVAR;VLHAARVPVIVARQ;LHAARVPVIVARQS;<br>15 mers:<br>MSKPRKQHGVVVGVD;SKPRKQHGVVVGVDG;KPRKQHGVVVGVDGS;PRKQHGVVVGVDGSL;RKQHGVVVGVDGSLE;KQHGVVVGVDGSLES;QHGVVVGVDGSLESD;HGVVVGVDGSLESDA;GVVVGVDGSLESDAA;VVVGVDGSLESDAAA;VVGVDGSLESDAAAC;VGVDGSLESDAAACW;GVDGSLESDAAACWG;VDGSLESDAAACWGA;DGSLESDAAACWGAT;GSLESDAAACWGATD;SLESDAAACWGATDA;LESDAAACWGATDAA;ESDAAACWGATDAAM;SDAAACWGATDAAMR;DAAACWGATDAAMRN;AAACWGATDAAMRNI;AACWGATDAAMRNIP;ACWGATDAAMRNIPL;CWGATDAAMRNIPLT;WGATDAAMRNIPLTV;GATDAAMRNIPLTVV;ATDAAMRNIPLTVVH;TDAAMRNIPLTVVHV;DAAMRNIPLTVVHVV;AAMRNIPLTVVHVVN;AMRNIPLTVVHVVNA;MRNIPLTVVHVVNAD;RNIPLTVVHVVNADV;NIPLTVVHVVNADVA;IPLTVVHVVNADVAT;PLTVVHVVNADVATW;LTVVHVVNADVATWP;TVVHVVNADVATWPP;VVHVVNADVATWPPM;VHVVNADVATWPPMP;HVVNADVATWPPMPY;VVNADVATWPPMPYP;VNADVATWPPMPYPE;NADVATWPPMPYPET;ADVATWPPMPYPETW;DVATWPPMPYPETWG;VATWPPMPYPETWGV;ATWPPMPYPETWGVW;TWPPMPYPETWGVWQ;WPPMPYPETWGVWQE;PPMPYPETWGVWQED;PMPYPETWGVWQEDE;MPYPETWGVWQEDEG;PYPETWGVWQEDEGR;YPETWGVWQEDEGRQ;PETWGVWQEDEGRQI;ETWGVWQEDEGRQIV;TWGVWQEDEGRQIVA;WGVWQEDEGRQIVAN;GVWQEDEGRQIVANA;VWQEDEGRQIVANAV;WQEDEGRQIVANAVK;QEDEGRQIVANAVKL;EDEGRQIVANAVKLA;DEGRQIVANAVKLAK;EGR | |

Fig. 30 continued

| | | |
|---|---|---|
| | QIVANAVKLAKE;GRQIVANAVKLAKEA;RQIVANAVKLAKEAV;QIVANAVKLAKEAVG;IVANAVKLAKEAVGA;VANAVKLAKEAVGAD;ANAVKLAKEAVGADR;NAVKLAKEAVGADRK;AVKLAKEAVGADRKL;VKLAKEAVGADRKLS;KLAKEAVGADRKLSV;LAKEAVGADRKLSVK;AKEAVGADRKLSVKS;KEAVGADRKLSVKSE;EAVGADRKLSVKSEL;AVGADRKLSVKSELV;VGADRKLSVKSELVF;GADRKLSVKSELVFS;ADRKLSVKSELVFST;DRKLSVKSELVFSTP;RKLSVKSELVFSTPV;KLSVKSELVFSTPVP;LSVKSELVFSTPVPT;SVKSELVFSTPVPTM;VKSELVFSTPVPTMV;KSELVFSTPVPTMVE;SELVFSTPVPTMVEI;ELVFSTPVPTMVEIS;LVFSTPVPTMVEISN;VFSTPVPTMVEISNE;FSTPVPTMVEISNEA;STPVPTMVEISNEAE;TPVPTMVEISNEAEM;PVPTMVEISNEAEMV;VPTMVEISNEAEMVV;PTMVEISNEAEMVVL;TMVEISNEAEMVVLG;MVEISNEAEMVVLGS;VEISNEAEMVVLGSS;EISNEAEMVVLGSSG;ISNEAEMVVLGSSGR;SNEAEMVVLGSSGRG;NEAEMVVLGSSGRGA;EAEMVVLGSSGRGAL;AEMVVLGSSGRGALA;EMVVLGSSGRGALAR;MVVLGSSGRGALARG;VVLGSSGRGALARGL;VLGSSGRGALARGLL;LGSSGRGALARGLLG;GSSGRGALARGLLGS;SSGRGALARGLLGSV;SGRGALARGLLGSVS;GRGALARGLLGSVSS;RGALARGLLGSVSSS;GALARGLLGSVSSSL;ALARGLLGSVSSSLV;LARGLLGSVSSSLVR;ARGLLGSVSSSLVRR;RGLLGSVSSSLVRRA;GLLGSVSSSLVRRAG;LLGSVSSSLVRRAGC;LGSVSSSLVRRAGCP;GSVSSSLVRRAGCPV;SVSSSLVRRAGCPVA;VSSSLVRRAGCPVAV;SSSLVRRAGCPVAVI;SSLVRRAGCPVAVIH;SLVRRAGCPVAVIHS;LVRRAGCPVAVIHSD;VRRAGCPVAVIHSDD;RRAGCPVAVIHSDDA;RAGCPVAVIHSDDAV;AGCPVAVIHSDDAVI;GCPVAVIHSDDAVIP;CPVAVIHSDDAVIPD;PVAVIHSDDAVIPDP;VAVIHSDDAVIPDPQ;AVIHSDDAVIPDPQH;VIHSDDAVIPDPQHA;IHSDDAVIPDPQHAP;HSDDAVIPDPQHAPV;SDDAVIPDPQHAPVL;DDAVIPDPQHAPVLV;DAVIPDPQHAPVLVG;AVIPDPQHAPVLVGI;VIPDPQHAPVLVGID;IPDPQHAPVLVGIDG;PDPQHAPVLVGIDGS;DPQHAPVLVGIDGSP;PQHAPVLVGIDGSPV;QHAPVLVGIDGSPVS;HAPVLVGIDGSPVSE;APVLVGIDGSPVSEL;PVLVGIDGSPVSELA;VLVGIDGSPVSELAT;LVGIDGSPVSELATA;VGIDGSPVSELATAV;GIDGSPVSELATAVA;IDGSPVSELATAVAF;DGSPVSELATAVAFD;GSPVSELATAVAFDE;SPVSELATAVAFDEA;PVSELATAVAFDEAS;VSELATAVAFDEASR;SELATAVAFDEASRR;ELATAVAFDEASRRG;LATAVAFDEASRRGV;ATAVAFDEASRRGVE;TAVAFDEASRRGVEL;AVAFDEASRRGVELI;VAFDEASRRGVELIA;AFDEASRRGVELIAV;FDEASRRGVELIAVH;DEASRRGVELIAVHA;EASRRGVELIAVHAW;ASRRGVELIAVHAWS;SRRGVELIAVHAWSD;RRGVELIAVHAWSDV;RGVELIAVHAWSDVE;GVELIAVHAWSDVEV;VELIAVHAWSDVEVV;ELIAVHAWSDVEVVE;LIAVHAWSDVEVVEL;IAVHAWSDVEVVELP;AVHAWSDVEVVELPG;VHAWSDVEVVELPGL;HAWSDVEVVELPGLD;AWSDVEVVELPGLDF;WSDVEVVELPGLDFS;SDVEVVELPGLDFSA;DVEVVELPGLDFSAV;VEVVELPGLDFSAVQ;EVVELPGLDFSAVQQ;VVELPGLDFSAVQQE;VELPGLDFSAVQQEA;ELPGLDFSAVQQEAE;LPGLDFSAVQQEAEL;PGLDFSAVQQEAELS;GLDFSAVQQEAELSL;LDFSAVQQEAELSLA;DFSAVQQEAELSLAE;FSAVQQEAELSLAER;SAVQQEAELSLAERL;AVQQEAELSLAERLA;VQQEAELSLAERLAG;QQEAELSLAERLAGW;QEAELSLAERLAGWQ;EAELSLAERLAGWQE;AELSLAERLAGWQER;ELSLAERLAGWQERY;LSLAERLAGWQERYP;SLAERLAGWQERYPD;LAERLAGWQERYPDV;AERLAGWQERYPDVP;ERLAGWQERYPDVPV;RLAGWQERYPDVPVS;LAGWQERYPDVPVSR;AGWQERYPDVPVSRV;GWQERYPDVPVSRVV;WQERYPDVPVSRVVV;QERYPDVPVSRVVVC;ERYPDVPVSRVVVCD;RYPDVPVSRVVVCDR;YPDVPVSRVVVCDRP;PDVPVSRVVVCDRPA;DVPVSRVVVCDRPAR;VPVSRVVVCDRPARK;PVSRVVVCDRPARKL;VSRVVVCDRPARKLV;SRVVVCDRPARKLVQ;RVVVCDRPARKLVQK;VVVCDRPARKLVQKS;VVCDRPARKLVQ | |

Fig. 30 continued

| | | |
|---|---|---|
| | KSA;VCDRPARKLVQKSAS;CDRPARKLVQKSASA;DRPARKLVQKSASAQ;RPARKLVQKSASAQL;PARKLVQKSASAQLV;ARKLVQKSASAQLVV;RKLVQKSASAQLVVV;KLVQKSASAQLVVVG;LVQKSASAQLVVVGS;VQKSASAQLVVVGSH;QKSASAQLVVVGSHG;KSASAQLVVVGSHGR;SASAQLVVVGSHGRG;ASAQLVVVGSHGRGG;SAQLVVVGSHGRGGL;AQLVVVGSHGRGGLT;QLVVVGSHGRGGLTG;LVVVGSHGRGGLTGM;VVVGSHGRGGLTGML;VVGSHGRGGLTGMLL;VGSHGRGGLTGMLLG;GSHGRGGLTGMLLGS;SHGRGGLTGMLLGSV;HGRGGLTGMLLGSVS;GRGGLTGMLLGSVSN;RGGLTGMLLGSVSNA;GGLTGMLLGSVSNAV;GLTGMLLGSVSNAVL;LTGMLLGSVSNAVLH;TGMLLGSVSNAVLHA;GMLLGSVSNAVLHAA;MLLGSVSNAVLHAAR;LLGSVSNAVLHAARV;LGSVSNAVLHAARVP;GSVSNAVLHAARVPV;SVSNAVLHAARVPVI;VSNAVLHAARVPVIV;SNAVLHAARVPVIVA;NAVLHAARVPVIVAR;AVLHAARVPVIVARQ;VLHAARVPVIVARQS;<br>16 mers:<br>MSKPRKQHGVVVGVDG;SKPRKQHGVVVGVDGS;KPRKQHGVVVGVDGSL;PRKQHGVVVGVDGSLE;RKQHGVVVGVDGSLES;KQHGVVVGVDGSLESD;QHGVVVGVDGSLESDA;HGVVVGVDGSLESDAA;GVVVGVDGSLESDAAA;VVVGVDGSLESDAAAC;VVGVDGSLESDAAACW;VGVDGSLESDAAACWG;GVDGSLESDAAACWGA;VDGSLESDAAACWGAT;DGSLESDAAACWGATD;GSLESDAAACWGATDA;SLESDAAACWGATDAA;LESDAAACWGATDAAM;ESDAAACWGATDAAMR;SDAAACWGATDAAMRN;DAAACWGATDAAMRNI;AAACWGATDAAMRNIP;AACWGATDAAMRNIPL;ACWGATDAAMRNIPLT;CWGATDAAMRNIPLTV;WGATDAAMRNIPLTVV;GATDAAMRNIPLTVVH;ATDAAMRNIPLTVVHV;TDAAMRNIPLTVVHVV;DAAMRNIPLTVVHVVN;AAMRNIPLTVVHVVNA;AMRNIPLTVVHVVNAD;MRNIPLTVVHVVNADV;RNIPLTVVHVVNADVA;NIPLTVVHVVNADVAT;IPLTVVHVVNADVATW;PLTVVHVVNADVATWP;LTVVHVVNADVATWPP;TVVHVVNADVATWPPM;VVHVVNADVATWPPMP;VHVVNADVATWPPMPY;HVVNADVATWPPMPYP;VVNADVATWPPMPYPE;VNADVATWPPMPYPET;NADVATWPPMPYPETW;ADVATWPPMPYPETWG;DVATWPPMPYPETWGV;VATWPPMPYPETWGVW;ATWPPMPYPETWGVWQ;TWPPMPYPETWGVWQE;WPPMPYPETWGVWQED;PPMPYPETWGVWQEDE;PMPYPETWGVWQEDEG;MPYPETWGVWQEDEGR;PYPETWGVWQEDEGRQ;YPETWGVWQEDEGRQI;PETWGVWQEDEGRQIV;ETWGVWQEDEGRQIVA;TWGVWQEDEGRQIVAN;WGVWQEDEGRQIVANA;GVWQEDEGRQIVANAV;VWQEDEGRQIVANAVK;WQEDEGRQIVANAVKL;QEDEGRQIVANAVKLA;EDEGRQIVANAVKLAK;DEGRQIVANAVKLAKE;EGRQIVANAVKLAKEA;GRQIVANAVKLAKEAV;RQIVANAVKLAKEAVG;QIVANAVKLAKEAVGA;IVANAVKLAKEAVGAD;VANAVKLAKEAVGADR;ANAVKLAKEAVGADRK;NAVKLAKEAVGADRKL;AVKLAKEAVGADRKLS;VKLAKEAVGADRKLSV;KLAKEAVGADRKLSVK;LAKEAVGADRKLSVKS;AKEAVGADRKLSVKSE;KEAVGADRKLSVKSEL;EAVGADRKLSVKSELV;AVGADRKLSVKSELVF;VGADRKLSVKSELVFS;GADRKLSVKSELVFST;ADRKLSVKSELVFSTP;DRKLSVKSELVFSTPV;RKLSVKSELVFSTPVP;KLSVKSELVFSTPVPT;LSVKSELVFSTPVPTM;SVKSELVFSTPVPTMV;VKSELVFSTPVPTMVE;KSELVFSTPVPTMVEI;SELVFSTPVPTMVEIS;ELVFSTPVPTMVEISN;LVFSTPVPTMVEISNE;VFSTPVPTMVEISNEA;FSTPVPTMVEISNEAE;STPVPTMVEISNEAEM;TPVPTMVEISNEAEMV;PVPTMVEISNEAEMVV;VPTMVEISNEAEMVVL;PTMVEISNEAEMVVLG;TMVEISNEAEMVVLGS;MVEISNEAEMVVLGSS;VEISNEAEMVVLGSSG;EISNEAEMVVLGSSGR;ISNEAEMVVLGSSGRG;SNEAEMVVLGSSGRGA;NEAEMVVLGSSGRGAL;EAEMVVLGSSGRGALA;AEMVVLGSSGRGALAR;EMVVLGSSGRGALARG;MVVLGSSGRGALARGL;VVLGSSGRGALARGLL;VLGSSGRGALARGLLG;LGSSGRGALARGLLGS;GSSGRGALARGLLGSV;SSGRGALA | |

Fig. 30 continued

| | | |
|---|---|---|
| | RGLLGSVS;SGRGALARGLLGSVSS;GRGALARGLLGSVSSS;RGALARGLLGSVSSSL;GALARGLLGSVSSSLV;ALARGLLGSVSSSLVR;LARGLLGSVSSSLVRR;ARGLLGSVSSSLVRRA;RGLLGSVSSSLVRRAG;GLLGSVSSSLVRRAGC;LLGSVSSSLVRRAGCP;LGSVSSSLVRRAGCPV;GSVSSSLVRRAGCPVA;SVSSSLVRRAGCPVAV;VSSSLVRRAGCPVAVI;SSSLVRRAGCPVAVIH;SSLVRRAGCPVAVIHS;SLVRRAGCPVAVIHSD;LVRRAGCPVAVIHSDD;VRRAGCPVAVIHSDDA;RRAGCPVAVIHSDDAV;RAGCPVAVIHSDDAVI;AGCPVAVIHSDDAVIP;GCPVAVIHSDDAVIPD;CPVAVIHSDDAVIPDP;PVAVIHSDDAVIPDPQ;VAVIHSDDAVIPDPQH;AVIHSDDAVIPDPQHA;VIHSDDAVIPDPQHAP;IHSDDAVIPDPQHAPV;HSDDAVIPDPQHAPVL;SDDAVIPDPQHAPVLV;DDAVIPDPQHAPVLVG;DAVIPDPQHAPVLVGI;AVIPDPQHAPVLVGID;VIPDPQHAPVLVGIDG;IPDPQHAPVLVGIDGS;PDPQHAPVLVGIDGSP;DPQHAPVLVGIDGSPV;PQHAPVLVGIDGSPVS;QHAPVLVGIDGSPVSE;HAPVLVGIDGSPVSEL;APVLVGIDGSPVSELA;PVLVGIDGSPVSELAT;VLVGIDGSPVSELATA;LVGIDGSPVSELATAV;VGIDGSPVSELATAVA;GIDGSPVSELATAVAF;IDGSPVSELATAVAFD;DGSPVSELATAVAFDE;GSPVSELATAVAFDEA;SPVSELATAVAFDEAS;PVSELATAVAFDEASR;VSELATAVAFDEASRR;SELATAVAFDEASRRG;ELATAVAFDEASRRGV;LATAVAFDEASRRGVE;ATAVAFDEASRRGVEL;TAVAFDEASRRGVELI;AVAFDEASRRGVELIA;VAFDEASRRGVELIAV;AFDEASRRGVELIAVH;FDEASRRGVELIAVHA;DEASRRGVELIAVHAW;EASRRGVELIAVHAWS;ASRRGVELIAVHAWSD;SRRGVELIAVHAWSDV;RRGVELIAVHAWSDVE;RGVELIAVHAWSDVEV;GVELIAVHAWSDVEVV;VELIAVHAWSDVEVVE;ELIAVHAWSDVEVVEL;LIAVHAWSDVEVVELP;IAVHAWSDVEVVELPG;AVHAWSDVEVVELPGL;VHAWSDVEVVELPGLD;HAWSDVEVVELPGLDF;AWSDVEVVELPGLDFS;WSDVEVVELPGLDFSA;SDVEVVELPGLDFSAV;DVEVVELPGLDFSAVQ;VEVVELPGLDFSAVQQ;EVVELPGLDFSAVQQE;VVELPGLDFSAVQQEA;VELPGLDFSAVQQEAE;ELPGLDFSAVQQEAEL;LPGLDFSAVQQEAELS;PGLDFSAVQQEAELSL;GLDFSAVQQEAELSLA;LDFSAVQQEAELSLAE;DFSAVQQEAELSLAER;FSAVQQEAELSLAERL;SAVQQEAELSLAERLA;AVQQEAELSLAERLAG;VQQEAELSLAERLAGW;QQEAELSLAERLAGWQ;QEAELSLAERLAGWQE;EAELSLAERLAGWQER;AELSLAERLAGWQERY;ELSLAERLAGWQERYP;LSLAERLAGWQERYPD;SLAERLAGWQERYPDV;LAERLAGWQERYPDVP;AERLAGWQERYPDVPV;ERLAGWQERYPDVPVS;RLAGWQERYPDVPVSR;LAGWQERYPDVPVSRV;AGWQERYPDVPVSRVV;GWQERYPDVPVSRVVV;WQERYPDVPVSRVVVC;QERYPDVPVSRVVVCD;ERYPDVPVSRVVVCDR;RYPDVPVSRVVVCDRP;YPDVPVSRVVVCDRPA;PDVPVSRVVVCDRPAR;DVPVSRVVVCDRPARK;VPVSRVVVCDRPARKL;PVSRVVVCDRPARKLV;VSRVVVCDRPARKLVQ;SRVVVCDRPARKLVQK;RVVVCDRPARKLVQKS;VVVCDRPARKLVQKSA;VVCDRPARKLVQKSAS;VCDRPARKLVQKSASA;CDRPARKLVQKSASAQ;DRPARKLVQKSASAQL;RPARKLVQKSASAQLV;PARKLVQKSASAQLVV;ARKLVQKSASAQLVVV;RKLVQKSASAQLVVVG;KLVQKSASAQLVVVGS;LVQKSASAQLVVVGSH;VQKSASAQLVVVGSHG;QKSASAQLVVVGSHGR;KSASAQLVVVGSHGRG;SASAQLVVVGSHGRGG;ASAQLVVVGSHGRGGL;SAQLVVVGSHGRGGLT;AQLVVVGSHGRGGLTG;QLVVVGSHGRGGLTGM;LVVVGSHGRGGLTGML;VVVGSHGRGGLTGMLL;VVGSHGRGGLTGMLLG;VGSHGRGGLTGMLLGS;GSHGRGGLTGMLLGSV;SHGRGGLTGMLLGSVS;HGRGGLTGMLLGSVSN;GRGGLTGMLLGSVSNA;RGGLTGMLLGSVSNAV;GGLTGMLLGSVSNAVL;GLTGMLLGSVSNAVLH;LTGMLLGSVSNAVLHA;TGMLLGSVSNAVLHAA;GMLLGSVSNAVLHAAR;MLLGSVSNAVLHAARV;LLGSVSNAVLHAARVP;LGSVSNAVLHAARVPV;GSVSNAVLHAARVPVI;SVSNAVLHAARVPVIV;VSNAVLHAARVPVIVA;SNAVLHAARVPVIVAR;NAVLHAARVPVIVARQ;AVLHAA | |

Fig. 30 continued

| | | |
|---|---|---|
| | RVPVIVARQS | |
| 10 | **<NP_217643.1 hypothetical protein Rv3127;Mycobacterium tuberculosis H37Rv>**<br>MLKNAVLLACRAPSVHNSQPWRWVAESGSEHTTVHLFVNRHRTVPATDHSGRQAIISCGAVLDHLRIAMTAAHWQANITRFPQPNQPDQLATVEFSPIDHVTAGQRNRAQAILQRRTDRLPFDSPMYWHLFEPALRDAVDKDVAMLDVVSDDQRTRLVVASQLSEVLRRDDPYYHAELEWWTSPFVLAHGVPPDTLASDAERLRVDLGRDFPVRSYQNRRAELADDRSKVLVLSTPSDTRADALRCGEVLSTILLECTMAGMATCTLTHLIESSDSRDIVRGLTRQRGEPQALIRVGIAPPLAAVPAPTPRRPLDSVLQIRQTPEKGRNASDRNARETGWFSPP<br><br>8mer<br>MLKNAVLL;NAVLLACR;LLACRAPS;APSVHNSQ;HNSQPWRW;SQPWRWVA;QPWRWVAE;AESGSEHT;SGSEHTTV;SEHTTVHL;HTTVHLFV;TVHLFVNR;HLFVNRHR;FVNRHRTV;AIISCGAV;IISCGAVL;GAVLDHLR;AVLDHLRI;VLDHLRIA;HLRIAMTA;RIAMTAAH;IAMTAAHW;AMTAAHWQ;MTAAHWQA;HWQANITR;WQANITRF;ITRFPQPN;QPNQPDQL;NQPDQLAT;QPDQLATV;DQLATVEF;QLATVEFS;ATVEFSPI;EFSPIDHV;SPIDHVTA;VTAGQRNR;RAQAILQR;AQAILQRR;ILQRRTDR;RRTDRLPF;RLPFDSPM;LPFDSPMY;SPMYWHLF;HLFEPALR;EPALRDAV;ALRDAVDK;AVDKDVAM;DVAMLDVV;AMLDVVSD;DVVSDDQR;RTRLVVAS;RLVVASQL;VASQLSEV;SQLSEVLR;QLSEVLRR;VLRRDDPY;DPYYHAEL;YYHAELEW;AELEWWTS;LEWWTSPF;EWWTSPFV;WWTSPFVL;WTSPFVLA;GVPPDTLA;TLASDAER;LASDAERL;AERLRVDL;RLRVDLGR;DLGRDFPV;LGRDFPVR;FPVRSYQN;PVRSYQNR;YQNRRAEL;ELADDRSK;LADDRSKV;LSTPSDTR;DTRADALR;ALRCGEVL;GEVLSTIL;EVLSTILL;ILLECTMA;CTMAGMAT;TMAGMATC;GMATCTLT;MATCTLTH;TLTHLIES;LIESSDSR;DIVRGLTR;EPQALIRV;ALIRVGIA;GIAPPLAA;IAPPLAAV;PPLAAVPA;AVPAPTPR;APTPRRPL;RRPLDSVL;PLDSVLQI;LQIRQTPE;QIRQTPEK;RQTPEKGR;KGRNASDR;NASDRNAR;RNARETGW<br>9mer<br>MLKNAVLLA;KNAVLLACR;LLACRAPSV;SVHNSQPWR;VHNSQPWRW;SQPWRWVAE;QPWRWVAES;WVAESGSEH;AESGSEHTT;SEHTTVHLF;TTVHLFVNR;HLFVNRHRT;RQAIISCGA;QAIISCGAV;AIISCGAVL;SCGAVLDHL;CGAVLDHLR;AVLDHLRIA;VLDHLRIAM;HLRIAMTAA;RIAMTAAHW;AMTAAHWQA;TAAHWQANI;HWQANITRF;ITRFPQPNQ;NQPDQLATV;LATVEFSPI;SPIDHVTAG;HVTAGQRNR;VTAGQRNRA;GQRNRAQAI;QRNRAQAIL;RAQAILQRR;AILQRRTDR;ILQRRTDRL;QRRTDRLPF;RLPFDSPMY;LPFDSPMYW;FDSPMYWHL;DSPMYWHLF;PMYWHLFEP;MYWHLFEPA;YWHLFEPAL;FEPALRDAV;DAVDKDVAM;AVDKDVAML;VVSDDQRTR;RTRLVVASQ;VVASQLSEV;VASQLSEVL;ASQLSEVLR;SQLSEVLRR;EVLRRDDPY;VLRRDDPYY;PYYHAELEW;YYHAELEWW;ELEWWTSPF;LEWWTSPFV;EWWTSPFVL;SPFVLAHGV;AHGVPPDTL;DTLASDAER;TLASDAERL;LASDAERLR;FPVRSYQNR;PVRSYQNRR;SYQNRRAEL;YQNRRAELA;RRAELADDR;ELADDRSKV;GEVLSTILL;VLSTILLEC;STILLECTM;ILLECTMAG;LLECTMAGM;TMAGMATCT;MAGMATCTL;GMATCTLTH;MATCTLTHL;ATCTLTHLI;HLIESSDSR;ESSDSRDIV;IVRGLTRQR;RQRGEPQAL;GEPQALIRV;IRVGIAPPL;GIAPPLAAV;APPLAAVPA;AAVPAPTPR;AVPAPTPRR;TPRRPLDSV;RPLDSVLQI;LQIRQTPEK;TPEKGRNAS;RNASDRNAR<br>10mer<br>MLKNAVLLAC;LKNAVLLACR;VLLACRAPSV;APSVHNSQPW;SVHNSQPWRW;SQPWRWVAES;WVAESGSEHT;AESGSEHTTV;GSEHTTVHLF;SEHTTVHLFV;HTTVHLFVNR;TVHLFVNRHR;HLFVNRHRTV;FVNRHRTVPA;TVP | 128626-130356 |

Fig. 30 continued

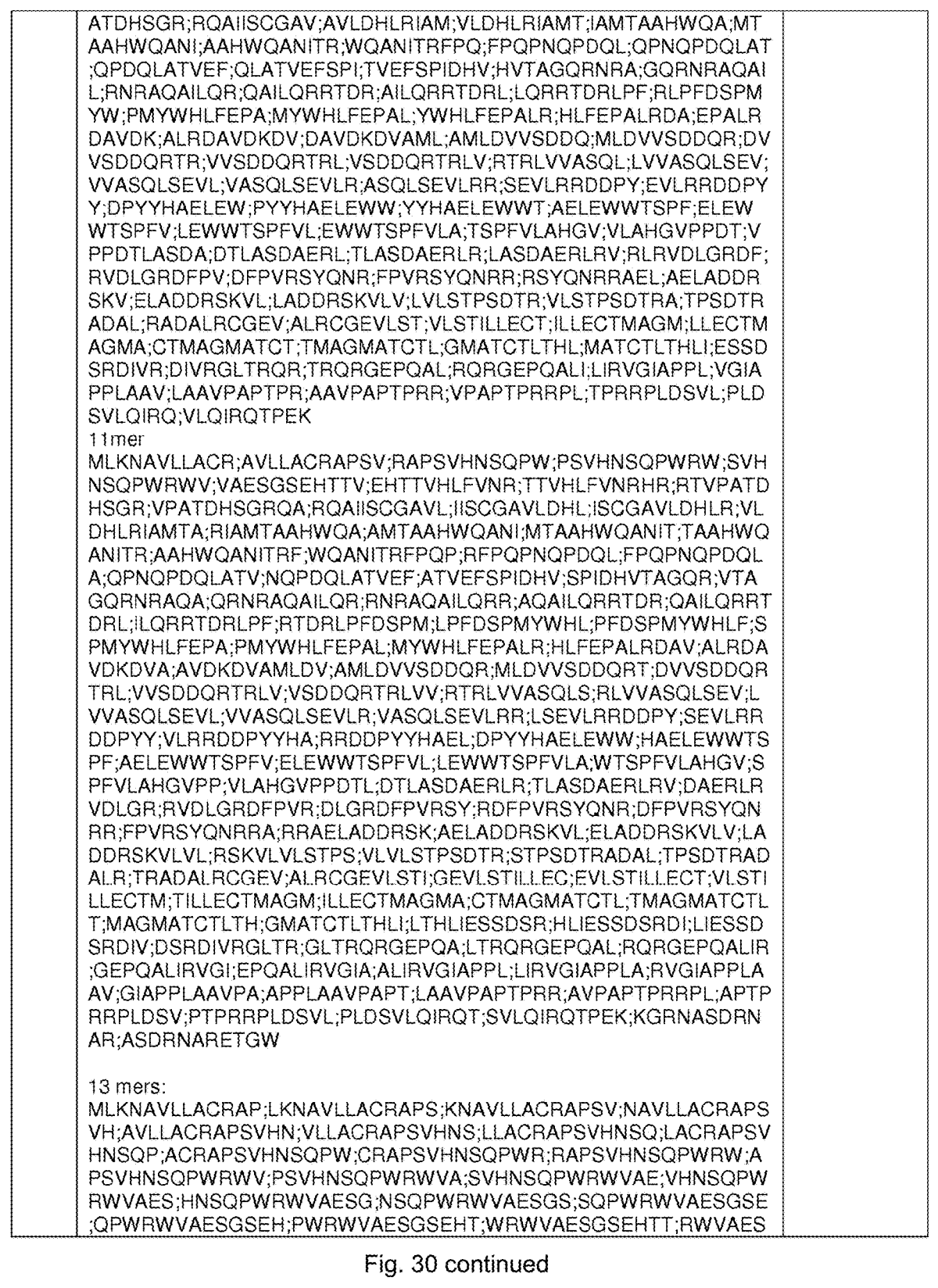

| | | |
|---|---|---|
| | ATDHSGR;RQAIISCGAV;AVLDHLRIAM;VLDHLRIAMT;IAMTAAHWQA;MTAAHWQANI;AAHWQANITR;WQANITRFPQ;FPQPNQPDQL;QPNQPDQLAT;QPDQLATVEF;QLATVEFSPI;TVEFSPIDHV;HVTAGQRNRA;GQRNRAQAIL;RNRAQAILQR;QAILQRRTDR;AILQRRTDRL;LQRRTDRLPF;RLPFDSPMYW;PMYWHLFEPA;MYWHLFEPAL;YWHLFEPALR;HLFEPALRDA;EPALRDAVDK;ALRDAVDKDV;DAVDKDVAML;AMLDVVSDDQ;MLDVVSDDQR;DVVSDDQRTR;VVSDDQRTRL;VSDDQRTRLV;RTRLVVASQL;LVVASQLSEV;VVASQLSEVL;VASQLSEVLR;ASQLSEVLRR;SEVLRRDDPY;EVLRRDDPYY;DPYYHAELEW;PYYHAELEWW;YYHAELEWWT;AELEWWTSPF;ELEWWTSPFV;LEWWTSPFVL;EWWTSPFVLA;TSPFVLAHGV;VLAHGVPPDT;VPPDTLASDA;DTLASDAERL;TLASDAERLR;LASDAERLRV;RLRVDLGRDF;RVDLGRDFPV;DFPVRSYQNR;FPVRSYQNRR;RSYQNRRAEL;AELADDRSKV;ELADDRSKVL;LADDRSKVLV;LVLSTPSDTR;VLSTPSDTRA;TPSDTRADAL;RADALRCGEV;ALRCGEVLST;VLSTILLECT;ILLECTMAGM;LLECTMAGMA;CTMAGMATCT;TMAGMATCTL;GMATCTLTHL;MATCTLTHLI;ESSDSRDIVR;DIVRGLTRQR;TRQRGEPQAL;RQRGEPQALI;LIRVGIAPPL;VGIAPPLAAV;LAAVPAPTPR;AAVPAPTPRR;VPAPTPRRPL;TPRRPLDSVL;PLDSVLQIRQ;VLQIRQTPEK<br>11mer<br>MLKNAVLLACR;AVLLACRAPSV;RAPSVHNSQPW;PSVHNSQPWRW;SVHNSQPWRWV;VAESGSEHTTV;EHTTVHLFVNR;TTVHLFVNRHR;RTVPATDHSGR;VPATDHSGRQA;RQAIISCGAVL;IISCGAVLDHL;ISCGAVLDHLR;VLDHLRIAMTA;RIAMTAAHWQA;AMTAAHWQANI;MTAAHWQANIT;TAAHWQANITR;AAHWQANITRF;WQANITRFPQP;RFPQPNQPDQL;FPQPNQPDQLA;QPNQPDQLATV;NQPDQLATVEF;ATVEFSPIDHV;SPIDHVTAGQR;VTAGQRNRAQA;QRNRAQAILQR;RNRAQAILQRR;AQAILQRRTDR;QAILQRRTDRL;ILQRRTDRLPF;RTDRLPFDSPM;LPFDSPMYWHL;PFDSPMYWHLF;SPMYWHLFEPA;PMYWHLFEPAL;MYWHLFEPALR;HLFEPALRDAV;ALRDAVDKDVA;AVDKDVAMLDV;AMLDVVSDDQR;MLDVVSDDQRT;DVVSDDQRTRL;VVSDDQRTRLV;VSDDQRTRLVV;RTRLVVASQLS;RLVVASQLSEV;LVVASQLSEVL;VVASQLSEVLR;VASQLSEVLRR;LSEVLRRDDPY;SEVLRRDDPYY;VLRRDDPYYHA;RRDDPYYHAEL;DPYYHAELEWW;HAELEWWTSPF;AELEWWTSPFV;ELEWWTSPFVL;LEWWTSPFVLA;WTSPFVLAHGV;SPFVLAHGVPP;VLAHGVPPDTL;DTLASDAERLR;TLASDAERLRV;DAERLRVDLGR;RVDLGRDFPVR;DLGRDFPVRSY;RDFPVRSYQNR;DFPVRSYQNRR;FPVRSYQNRRA;RRAELADDRSK;AELADDRSKVL;ELADDRSKVLV;LADDRSKVLVL;RSKVLVLSTPS;VLVLSTPSDTR;STPSDTRADAL;TPSDTRADALR;TRADALRCGEV;ALRCGEVLSTI;GEVLSTILLEC;EVLSTILLECT;VLSTILLECTM;TILLECTMAGM;ILLECTMAGMA;CTMAGMATCTL;TMAGMATCTLT;MAGMATCTLTH;GMATCTLTHLI;LTHLIESSDSR;HLIESSDSRDI;LIESSDSRDIV;DSRDIVRGLTR;GLTRQRGEPQA;LTRQRGEPQAL;RQRGEPQALIR;GEPQALIRVGI;EPQALIRVGIA;ALIRVGIAPPL;LIRVGIAPPLA;RVGIAPPLAAV;GIAPPLAAVPA;APPLAAVPAPT;LAAVPAPTPRR;AVPAPTPRRPL;APTPRRPLDSV;PTPRRPLDSVL;PLDSVLQIRQT;SVLQIRQTPEK;KGRNASDRNAR;ASDRNARETGW<br><br>13 mers:<br>MLKNAVLLACRAP;LKNAVLLACRAPS;KNAVLLACRAPSV;NAVLLACRAPSVH;AVLLACRAPSVHN;VLLACRAPSVHNS;LLACRAPSVHNSQ;LACRAPSVHNSQP;ACRAPSVHNSQPW;CRAPSVHNSQPWR;RAPSVHNSQPWRW;APSVHNSQPWRWV;PSVHNSQPWRWVA;SVHNSQPWRWVAE;VHNSQPWRWVAES;HNSQPWRWVAESG;NSQPWRWVAESGS;SQPWRWVAESGSE;QPWRWVAESGSEH;PWRWVAESGSEHT;WRWVAESGSEHTT;RWVAES | |

Fig. 30 continued

| | | |
|---|---|---|
| | GSEHTTV;WVAESGSEHTTVH;VAESGSEHTTVHL;AESGSEHTTVHLF;ESGSEHTTVHLFV;SGSEHTTVHLFVN;GSEHTTVHLFVNR;SEHTTVHLFVNRH;EHTTVHLFVNRHR;HTTVHLFVNRHRT;TTVHLFVNRHRTV;TVHLFVNRHRTVP;VHLFVNRHRTVPA;HLFVNRHRTVPAT;LFVNRHRTVPATD;FVNRHRTVPATDH;VNRHRTVPATDHS;NRHRTVPATDHSG;RHRTVPATDHSGR;HRTVPATDHSGRQ;RTVPATDHSGRQA;TVPATDHSGRQAI;VPATDHSGRQAII;PATDHSGRQAIIS;ATDHSGRQAIISC;TDHSGRQAIISCG;DHSGRQAIISCGA;HSGRQAIISCGAV;SGRQAIISCGAVL;GRQAIISCGAVLD;RQAIISCGAVLDH;QAIISCGAVLDHL;AIISCGAVLDHLR;IISCGAVLDHLRI;ISCGAVLDHLRIA;SCGAVLDHLRIAM;CGAVLDHLRIAMT;GAVLDHLRIAMTA;AVLDHLRIAMTAA;VLDHLRIAMTAAH;LDHLRIAMTAAHW;DHLRIAMTAAHWQ;HLRIAMTAAHWQA;LRIAMTAAHWQAN;RIAMTAAHWQANI;IAMTAAHWQANIT;AMTAAHWQANITR;MTAAHWQANITRF;TAAHWQANITRFP;AAHWQANITRFPQ;AHWQANITRFPQP;HWQANITRFPQPN;WQANITRFPQPNQ;QANITRFPQPNQP;ANITRFPQPNQPD;NITRFPQPNQPDQ;ITRFPQPNQPDQL;TRFPQPNQPDQLA;RFPQPNQPDQLAT;FPQPNQPDQLATV;PQPNQPDQLATVE;QPNQPDQLATVEF;PNQPDQLATVEFS;NQPDQLATVEFSP;QPDQLATVEFSPI;PDQLATVEFSPID;DQLATVEFSPIDH;QLATVEFSPIDHV;LATVEFSPIDHVT;ATVEFSPIDHVTA;TVEFSPIDHVTAG;VEFSPIDHVTAGQ;EFSPIDHVTAGQR;FSPIDHVTAGQRN;SPIDHVTAGQRNR;PIDHVTAGQRNRA;IDHVTAGQRNRAQ;DHVTAGQRNRAQA;HVTAGQRNRAQAI;VTAGQRNRAQAIL;TAGQRNRAQAILQ;AGQRNRAQAILQR;GQRNRAQAILQRR;QRNRAQAILQRRT;RNRAQAILQRRTD;NRAQAILQRRTDR;RAQAILQRRTDRL;AQAILQRRTDRLP;QAILQRRTDRLPF;AILQRRTDRLPFD;ILQRRTDRLPFDS;LQRRTDRLPFDSP;QRRTDRLPFDSPM;RRTDRLPFDSPMY;RTDRLPFDSPMYW;TDRLPFDSPMYWH;DRLPFDSPMYWHL;RLPFDSPMYWHLF;LPFDSPMYWHLFE;PFDSPMYWHLFEP;FDSPMYWHLFEPA;DSPMYWHLFEPAL;SPMYWHLFEPALR;PMYWHLFEPALRD;MYWHLFEPALRDA;YWHLFEPALRDAV;WHLFEPALRDAVD;HLFEPALRDAVDK;LFEPALRDAVDKD;FEPALRDAVDKDV;EPALRDAVDKDVA;PALRDAVDKDVAM;ALRDAVDKDVAML;LRDAVDKDVAMLD;RDAVDKDVAMLDV;DAVDKDVAMLDVV;AVDKDVAMLDVVS;VDKDVAMLDVVSD;DKDVAMLDVVSDD;KDVAMLDVVSDDQ;DVAMLDVVSDDQR;VAMLDVVSDDQRT;AMLDVVSDDQRTR;MLDVVSDDQRTRL;LDVVSDDQRTRLV;DVVSDDQRTRLVV;VVSDDQRTRLVVA;VSDDQRTRLVVAS;SDDQRTRLVVASQ;DDQRTRLVVASQL;DQRTRLVVASQLS;QRTRLVVASQLSE;RTRLVVASQLSEV;TRLVVASQLSEVL;RLVVASQLSEVLR;LVVASQLSEVLRR;VVASQLSEVLRRD;VASQLSEVLRRDD;ASQLSEVLRRDDP;SQLSEVLRRDDPY;QLSEVLRRDDPYY;LSEVLRRDDPYYH;SEVLRRDDPYYHA;EVLRRDDPYYHAE;VLRRDDPYYHAEL;LRRDDPYYHAELE;RRDDPYYHAELEW;RDDPYYHAELEWW;DDPYYHAELEWWT;DPYYHAELEWWTS;PYYHAELEWWTSP;YYHAELEWWTSPF;YHAELEWWTSPFV;HAELEWWTSPFVL;AELEWWTSPFVLA;ELEWWTSPFVLAH;LEWWTSPFVLAHG;EWWTSPFVLAHGV;WWTSPFVLAHGVP;WTSPFVLAHGVPP;TSPFVLAHGVPPD;SPFVLAHGVPPDT;PFVLAHGVPPDTL;FVLAHGVPPDTLA;VLAHGVPPDTLAS;LAHGVPPDTLASD;AHGVPPDTLASDA;HGVPPDTLASDAE;GVPPDTLASDAER;VPPDTLASDAERL;PPDTLASDAERLR;PDTLASDAERLRV;DTLASDAERLRVD;TLASDAERLRVDL;LASDAERLRVDLG;ASDAERLRVDLGR;SDAERLRVDLGRD;DAERLRVDLGRDF;AERLRVDLGRDFP;ERLRVDLGRDFPV;RLRVDLGRDFPVR;LRVDLGRDFPVRS;RVDLGRDFPVRSY;VDLGRDFPVRSYQ;DLGRDFPVRSYQN;LGRDFPVRSYQNR;GRDFPVRSYQNRR;RDFPVRSYQNRRA;DFPVRSYQNRRAE;FPVRSYQNRRAEL;PVRSYQNRRAELA;VRSYQNRRAELAD;RSYQNRRAELADD;SYQNRRAELADDR;YQNRRAELADDRS;QNRRAELADDRSK;NRRAELADDRSKV;RRAELADDRSKVL;RAE | |

Fig. 30 continued

| | | |
|---|---|---|
| | LADDRSKVLV;AELADDRSKVLVL;ELADDRSKVLVLS;LADDRSKVLVLST;A<br>DDRSKVLVLSTP;DDRSKVLVLSTPS;DRSKVLVLSTPSD;RSKVLVLSTPSD<br>T;SKVLVLSTPSDTR;KVLVLSTPSDTRA;VLVLSTPSDTRAD;LVLSTPSDTR<br>ADA;VLSTPSDTRADAL;LSTPSDTRADALR;STPSDTRADALRC;TPSDTRA<br>DALRCG;PSDTRADALRCGE;SDTRADALRCGEV;DTRADALRCGEVL;TRA<br>DALRCGEVLS;RADALRCGEVLST;ADALRCGEVLSTI;DALRCGEVLSTIL;A<br>LRCGEVLSTILL;LRCGEVLSTILLE;RCGEVLSTILLEC;CGEVLSTILLECT;G<br>EVLSTILLECTM;EVLSTILLECTMA;VLSTILLECTMAG;LSTILLECTMAGM;S<br>TILLECTMAGMA;TILLECTMAGMAT;ILLECTMAGMATC;LLECTMAGMATC<br>T;LECTMAGMATCTL;ECTMAGMATCTLT;CTMAGMATCTLTH;TMAGMAT<br>CTLTHL;MAGMATCTLTHLI;AGMATCTLTHLIE;GMATCTLTHLIES;MATCTL<br>THLIESS;ATCTLTHLIESSD;TCTLTHLIESSDS;CTLTHLIESSDSR;TLTHLIE<br>SSDSRD;LTHLIESSDSRDI;THLIESSDSRDIV;HLIESSDSRDIVR;LIESSDS<br>RDIVRG;IESSDSRDIVRGL;ESSDSRDIVRGLT;SSDSRDIVRGLTR;SDSRDI<br>VRGLTRQ;DSRDIVRGLTRQR;SRDIVRGLTRQRG;RDIVRGLTRQRGE;DIV<br>RGLTRQRGEP;IVRGLTRQRGEPQ;VRGLTRQRGEPQA;RGLTRQRGEPQ<br>AL;GLTRQRGEPQALI;LTRQRGEPQALIR;TRQRGEPQALIRV;RQRGEPQA<br>LIRVG;QRGEPQALIRVGI;RGEPQALIRVGIA;GEPQALIRVGIAP;EPQALIRV<br>GIAPP;PQALIRVGIAPPL;QALIRVGIAPPLA;ALIRVGIAPPLAA;LIRVGIAPPL<br>AAV;IRVGIAPPLAAVP;RVGIAPPLAAVPA;VGIAPPLAAVPAP;GIAPPLAAVP<br>APT;IAPPLAAVPAPTP;APPLAAVPAPTPR;PPLAAVPAPTPRR;PLAAVPAP<br>TPRRP;LAAVPAPTPRRPL;AAVPAPTPRRPLD;AVPAPTPRRPLDS;VPAPT<br>PRRPLDSV;PAPTPRRPLDSVL;APTPRRPLDSVLQ;PTPRRPLDSVLQI;TPR<br>RPLDSVLQIR;PRRPLDSVLQIRQ;RRPLDSVLQIRQT;RPLDSVLQIRQTP;PL<br>DSVLQIRQTPE;LDSVLQIRQTPEK;DSVLQIRQTPEKG;SVLQIRQTPEKGR;<br>VLQIRQTPEKGRN;LQIRQTPEKGRNA;QIRQTPEKGRNAS;IRQTPEKGRN<br>ASD;RQTPEKGRNASDR;QTPEKGRNASDRN;TPEKGRNASDRNA;PEKGR<br>NASDRNAR;EKGRNASDRNARE;KGRNASDRNARET;GRNASDRNARETG<br>;RNASDRNARETGW;NASDRNARETGWF;ASDRNARETGWFS;SDRNARE<br>TGWFSP;DRNARETGWFSPP;<br>14 mers:<br>MLKNAVLLACRAPS;LKNAVLLACRAPSV;KNAVLLACRAPSVH;NAVLLACR<br>APSVHN;AVLLACRAPSVHNS;VLLACRAPSVHNSQ;LLACRAPSVHNSQP;L<br>ACRAPSVHNSQPW;ACRAPSVHNSQPWR;CRAPSVHNSQPWRW;RAPSV<br>HNSQPWRWV;APSVHNSQPWRWVA;PSVHNSQPWRWVAE;SVHNSQPW<br>RWVAES;VHNSQPWRWVAESG;HNSQPWRWVAESGS;NSQPWRWVAES<br>GSE;SQPWRWVAESGSEH;QPWRWVAESGSEHT;PWRWVAESGSEHTT;<br>WRWVAESGSEHTTV;RWVAESGSEHTTVH;WVAESGSEHTTVHL;VAESG<br>SEHTTVHLF;AESGSEHTTVHLFV;ESGSEHTTVHLFVN;SGSEHTTVHLFVN<br>R;GSEHTTVHLFVNRH;SEHTTVHLFVNRHR;EHTTVHLFVNRHRT;HTTVHL<br>FVNRHRTV;TTVHLFVNRHRTVP;TVHLFVNRHRTVPA;VHLFVNRHRTVPA<br>T;HLFVNRHRTVPATD;LFVNRHRTVPATDH;FVNRHRTVPATDHS;VNRHR<br>TVPATDHSG;NRHRTVPATDHSGR;RHRTVPATDHSGRQ;HRTVPATDHSG<br>RQA;RTVPATDHSGRQAI;TVPATDHSGRQAII;VPATDHSGRQAIIS;PATDH<br>SGRQAIISC;ATDHSGRQAIISCG;TDHSGRQAIISCGA;DHSGRQAIISCGAV;<br>HSGRQAIISCGAVL;SGRQAIISCGAVLD;GRQAIISCGAVLDH;RQAIISCGAV<br>LDHL;QAIISCGAVLDHLR;AIISCGAVLDHLRI;IISCGAVLDHLRIA;ISCGAVL<br>DHLRIAM;SCGAVLDHLRIAMT;CGAVLDHLRIAMTA;GAVLDHLRIAMTAA;A<br>VLDHLRIAMTAAH;VLDHLRIAMTAAHW;LDHLRIAMTAAHWQ;DHLRIAMTA<br>AHWQA;HLRIAMTAAHWQAN;LRIAMTAAHWQANI;RIAMTAAHWQANIT;IA<br>MTAAHWQANITR;AMTAAHWQANITRF;MTAAHWQANITRFP;TAAHWQAN<br>ITRFPQ;AAHWQANITRFPQP;AHWQANITRFPQPN;HWQANITRFPQPNQ;<br>WQANITRFPQPNQP;QANITRFPQPNQPD;ANITRFPQPNQPDQ;NITRFPQ | |

Fig. 30 continued

| | | |
|---|---|---|
| | PNQPDQL;ITRFPQPNQPDQLA;TRFPQPNQPDQLAT;RFPQPNQPDQLATV;FPQPNQPDQLATVE;PQPNQPDQLATVEF;QPNQPDQLATVEFS;PNQPDQLATVEFSP;NQPDQLATVEFSPI;QPDQLATVEFSPID;PDQLATVEFSPIDH;DQLATVEFSPIDHV;QLATVEFSPIDHVT;LATVEFSPIDHVTA;ATVEFSPIDHVTAG;TVEFSPIDHVTAGQ;VEFSPIDHVTAGQR;EFSPIDHVTAGQRN;FSPIDHVTAGQRNR;SPIDHVTAGQRNRA;PIDHVTAGQRNRAQ;IDHVTAGQRNRAQA;DHVTAGQRNRAQAI;HVTAGQRNRAQAIL;VTAGQRNRAQAILQ;TAGQRNRAQAILQR;AGQRNRAQAILQRR;GQRNRAQAILQRRT;QRNRAQAILQRRTD;RNRAQAILQRRTDR;NRAQAILQRRTDRL;RAQAILQRRTDRLP;AQAILQRRTDRLPF;QAILQRRTDRLPFD;AILQRRTDRLPFDS;ILQRRTDRLPFDSP;LQRRTDRLPFDSPM;QRRTDRLPFDSPMY;RRTDRLPFDSPMYW;RTDRLPFDSPMYWH;TDRLPFDSPMYWHL;DRLPFDSPMYWHLF;RLPFDSPMYWHLFE;LPFDSPMYWHLFEP;PFDSPMYWHLFEPA;FDSPMYWHLFEPAL;DSPMYWHLFEPALR;SPMYWHLFEPALRD;PMYWHLFEPALRDA;MYWHLFEPALRDAV;YWHLFEPALRDAVD;WHLFEPALRDAVDK;HLFEPALRDAVDKD;LFEPALRDAVDKDV;FEPALRDAVDKDVA;EPALRDAVDKDVAM;PALRDAVDKDVAML;ALRDAVDKDVAMLD;LRDAVDKDVAMLDV;RDAVDKDVAMLDVV;DAVDKDVAMLDVVS;AVDKDVAMLDVVSD;VDKDVAMLDVVSDD;DKDVAMLDVVSDDQ;KDVAMLDVVSDDQR;DVAMLDVVSDDQRT;VAMLDVVSDDQRTR;AMLDVVSDDQRTRL;MLDVVSDDQRTRLV;LDVVSDDQRTRLVV;DVVSDDQRTRLVVA;VVSDDQRTRLVVAS;VSDDQRTRLVVASQ;SDDQRTRLVVASQL;DDQRTRLVVASQLS;DQRTRLVVASQLSE;QRTRLVVASQLSEV;RTRLVVASQLSEVL;TRLVVASQLSEVLR;RLVVASQLSEVLRR;LVVASQLSEVLRRD;VVASQLSEVLRRDD;VASQLSEVLRRDDP;ASQLSEVLRRDDPY;SQLSEVLRRDDPYY;QLSEVLRRDDPYYH;LSEVLRRDDPYYHA;SEVLRRDDPYYHAE;EVLRRDDPYYHAEL;VLRRDDPYYHAELE;LRRDDPYYHAELEW;RRDDPYYHAELEWW;RDDPYYHAELEWWT;DDPYYHAELEWWTS;DPYYHAELEWWTSP;PYYHAELEWWTSPF;YYHAELEWWTSPFV;YHAELEWWTSPFVL;HAELEWWTSPFVLA;AELEWWTSPFVLAH;ELEWWTSPFVLAHG;LEWWTSPFVLAHGV;EWWTSPFVLAHGVP;WWTSPFVLAHGVPP;WTSPFVLAHGVPPD;TSPFVLAHGVPPDT;SPFVLAHGVPPDTL;PFVLAHGVPPDTLA;FVLAHGVPPDTLAS;VLAHGVPPDTLASD;LAHGVPPDTLASDA;AHGVPPDTLASDAE;HGVPPDTLASDAER;GVPPDTLASDAERL;VPPDTLASDAERLR;PPDTLASDAERLRV;PDTLASDAERLRVD;DTLASDAERLRVDL;TLASDAERLRVDLG;LASDAERLRVDLGR;ASDAERLRVDLGRD;SDAERLRVDLGRDF;DAERLRVDLGRDFP;AERLRVDLGRDFPV;ERLRVDLGRDFPVR;RLRVDLGRDFPVRS;LRVDLGRDFPVRSY;RVDLGRDFPVRSYQ;VDLGRDFPVRSYQN;DLGRDFPVRSYQNR;LGRDFPVRSYQNRR;GRDFPVRSYQNRRA;RDFPVRSYQNRRAE;DFPVRSYQNRRAEL;FPVRSYQNRRAELA;PVRSYQNRRAELAD;VRSYQNRRAELADD;RSYQNRRAELADDR;SYQNRRAELADDRS;YQNRRAELADDRSK;QNRRAELADDRSKV;NRRAELADDRSKVL;RRAELADDRSKVLV;RAELADDRSKVLVL;AELADDRSKVLVLS;ELADDRSKVLVLST;LADDRSKVLVLSTP;ADDRSKVLVLSTPS;DDRSKVLVLSTPSD;DRSKVLVLSTPSDT;RSKVLVLSTPSDTR;SKVLVLSTPSDTRA;KVLVLSTPSDTRAD;VLVLSTPSDTRADA;LVLSTPSDTRADAL;VLSTPSDTRADALR;LSTPSDTRADALRC;STPSDTRADALRCG;TPSDTRADALRCGE;PSDTRADALRCGEV;SDTRADALRCGEVL;DTRADALRCGEVLS;TRADALRCGEVLST;RADALRCGEVLSTI;ADALRCGEVLSTIL;DALRCGEVLSTILL;ALRCGEVLSTILLE;LRCGEVLSTILLEC;RCGEVLSTILLECT;CGEVLSTILLECTM;GEVLSTILLECTMA;EVLSTILLECTMAG;VLSTILLECTMAGM;LSTILLECTMAGMA;STILLECTMAGMAT;TILLECTMAGMATC;ILLECTMAGMATCT;LLECTMAGMATCTL;LECTMAGMATCTLT;ECTMAGMATCTLTH;CTMAGMATCTLTHL;TMAGMATCTLTHLI;MAGMATCTLTHLIE;AGMATCTLTHLIES;GMATCTLTHLIESS;M | |

Fig. 30 continued

| | | |
|---|---|---|
| | ATCTLTHLIESSD;ATCTLTHLIESSDS;TCTLTHLIESSDSR;CTLTHLIESSDSRD;TLTHLIESSDSRDI;LTHLIESSDSRDIV;THLIESSDSRDIVR;HLIESSDSRDIVRG;LIESSDSRDIVRGL;IESSDSRDIVRGLT;ESSDSRDIVRGLTR;SSDSRDIVRGLTRQ;SDSRDIVRGLTRQR;DSRDIVRGLTRQRG;SRDIVRGLTRQRGE;RDIVRGLTRQRGEP;DIVRGLTRQRGEPQ;IVRGLTRQRGEPQA;VRGLTRQRGEPQAL;RGLTRQRGEPQALI;GLTRQRGEPQALIR;LTRQRGEPQALIRV;TRQRGEPQALIRVG;RQRGEPQALIRVGI;QRGEPQALIRVGIA;RGEPQALIRVGIAP;GEPQALIRVGIAPP;EPQALIRVGIAPPL;PQALIRVGIAPPLA;QALIRVGIAPPLAA;ALIRVGIAPPLAAV;LIRVGIAPPLAAVP;IRVGIAPPLAAVPA;RVGIAPPLAAVPAP;VGIAPPLAAVPAPT;GIAPPLAAVPAPTP;IAPPLAAVPAPTPR;APPLAAVPAPTPRR;PPLAAVPAPTPRRP;PLAAVPAPTPRRPL;LAAVPAPTPRRPLD;AAVPAPTPRRPLDS;AVPAPTPRRPLDSV;VPAPTPRRPLDSVL;PAPTPRRPLDSVLQ;APTPRRPLDSVLQI;PTPRRPLDSVLQIR;TPRRPLDSVLQIRQ;PRRPLDSVLQIRQT;RRPLDSVLQIRQTP;RPLDSVLQIRQTPE;PLDSVLQIRQTPEK;LDSVLQIRQTPEKG;DSVLQIRQTPEKGR;SVLQIRQTPEKGRN;VLQIRQTPEKGRNA;LQIRQTPEKGRNAS;QIRQTPEKGRNASD;IRQTPEKGRNASDR;RQTPEKGRNASDRN;QTPEKGRNASDRNA;TPEKGRNASDRNAR;PEKGRNASDRNARE;EKGRNASDRNARET;KGRNASDRNARETG;GRNASDRNARETGW;RNASDRNARETGWF;NASDRNARETGWFS;ASDRNARETGWFSP;SDRNARETGWFSPP;<br>15 mers:<br>MLKNAVLLACRAPSV;LKNAVLLACRAPSVH;KNAVLLACRAPSVHN;NAVLLACRAPSVHNS;AVLLACRAPSVHNSQ;VLLACRAPSVHNSQP;LLACRAPSVHNSQPW;LACRAPSVHNSQPWR;ACRAPSVHNSQPWRW;CRAPSVHNSQPWRWV;RAPSVHNSQPWRWVA;APSVHNSQPWRWVAE;PSVHNSQPWRWVAES;SVHNSQPWRWVAESG;VHNSQPWRWVAESGS;HNSQPWRWVAESGSE;NSQPWRWVAESGSEH;SQPWRWVAESGSEHT;QPWRWVAESGSEHTT;PWRWVAESGSEHTTV;WRWVAESGSEHTTVH;RWVAESGSEHTTVHL;WVAESGSEHTTVHLF;VAESGSEHTTVHLFV;AESGSEHTTVHLFVN;ESGSEHTTVHLFVNR;SGSEHTTVHLFVNRH;GSEHTTVHLFVNRHR;SEHTTVHLFVNRHRT;EHTTVHLFVNRHRTV;HTTVHLFVNRHRTVP;TTVHLFVNRHRTVPA;TVHLFVNRHRTVPAT;VHLFVNRHRTVPATD;HLFVNRHRTVPATDH;LFVNRHRTVPATDHS;FVNRHRTVPATDHSG;VNRHRTVPATDHSGR;NRHRTVPATDHSGRQ;RHRTVPATDHSGRQA;HRTVPATDHSGRQAI;RTVPATDHSGRQAII;TVPATDHSGRQAIIS;VPATDHSGRQAIISC;PATDHSGRQAIISCG;ATDHSGRQAIISCGA;TDHSGRQAIISCGAV;DHSGRQAIISCGAVL;HSGRQAIISCGAVLD;SGRQAIISCGAVLDH;GRQAIISCGAVLDHL;RQAIISCGAVLDHLR;QAIISCGAVLDHLRI;AIISCGAVLDHLRIA;IISCGAVLDHLRIAM;ISCGAVLDHLRIAMT;SCGAVLDHLRIAMTA;CGAVLDHLRIAMTAA;GAVLDHLRIAMTAAH;AVLDHLRIAMTAAHW;VLDHLRIAMTAAHWQ;LDHLRIAMTAAHWQA;DHLRIAMTAAHWQAN;HLRIAMTAAHWQANI;LRIAMTAAHWQANIT;RIAMTAAHWQANITR;IAMTAAHWQANITRF;AMTAAHWQANITRFP;MTAAHWQANITRFPQ;TAAHWQANITRFPQP;AAHWQANITRFPQPN;AHWQANITRFPQPNQ;HWQANITRFPQPNQP;WQANITRFPQPNQPD;QANITRFPQPNQPDQ;ANITRFPQPNQPDQL;NITRFPQPNQPDQLA;ITRFPQPNQPDQLAT;TRFPQPNQPDQLATV;RFPQPNQPDQLATVE;FPQPNQPDQLATVEF;PQPNQPDQLATVEFS;QPNQPDQLATVEFSP;PNQPDQLATVEFSPI;NQPDQLATVEFSPID;QPDQLATVEFSPIDH;PDQLATVEFSPIDHV;DQLATVEFSPIDHVT;QLATVEFSPIDHVTA;LATVEFSPIDHVTAG;ATVEFSPIDHVTAGQ;TVEFSPIDHVTAGQR;VEFSPIDHVTAGQRN;EFSPIDHVTAGQRNR;FSPIDHVTAGQRNRA;SPIDHVTAGQRNRAQ;PIDHVTAGQRNRAQA;IDHVTAGQRNRAQAI;DHVTAGQRNRAQAIL;HVTAGQRNRAQAILQ;VTAGQRNRAQAILQR;TAGQRNRAQAILQRR;AGQRNRAQAILQRRT;GQRNRAQAILQRRTD;QRN | |

Fig. 30 continued

| | | |
|---|---|---|
| | RAQAILQRRTDR;RNRAQAILQRRTDRL;NRAQAILQRRTDRLP;RAQAILQRRTDRLPF;AQAILQRRTDRLPFD;QAILQRRTDRLPFDS;AILQRRTDRLPFDSP;ILQRRTDRLPFDSPM;LQRRTDRLPFDSPMY;QRRTDRLPFDSPMYW;RRTDRLPFDSPMYWH;RTDRLPFDSPMYWHL;TDRLPFDSPMYWHLF;DRLPFDSPMYWHLFE;RLPFDSPMYWHLFEP;LPFDSPMYWHLFEPA;PFDSPMYWHLFEPAL;FDSPMYWHLFEPALR;DSPMYWHLFEPALRD;SPMYWHLFEPALRDA;PMYWHLFEPALRDAV;MYWHLFEPALRDAVD;YWHLFEPALRDAVDK;WHLFEPALRDAVDKD;HLFEPALRDAVDKDV;LFEPALRDAVDKDVA;FEPALRDAVDKDVAM;EPALRDAVDKDVAML;PALRDAVDKDVAMLD;ALRDAVDKDVAMLDV;LRDAVDKDVAMLDVV;RDAVDKDVAMLDVVS;DAVDKDVAMLDVVSD;AVDKDVAMLDVVSDD;VDKDVAMLDVVSDDQ;DKDVAMLDVVSDDQR;KDVAMLDVVSDDQRT;DVAMLDVVSDDQRTR;VAMLDVVSDDQRTRL;AMLDVVSDDQRTRLV;MLDVVSDDQRTRLVV;LDVVSDDQRTRLVVA;DVVSDDQRTRLVVAS;VVSDDQRTRLVVASQ;VSDDQRTRLVVASQL;SDDQRTRLVVASQLS;DDQRTRLVVASQLSE;DQRTRLVVASQLSEV;QRTRLVVASQLSEVL;RTRLVVASQLSEVLR;TRLVVASQLSEVLRR;RLVVASQLSEVLRRD;LVVASQLSEVLRRDD;VVASQLSEVLRRDDP;VASQLSEVLRRDDPY;ASQLSEVLRRDDPYY;SQLSEVLRRDDPYYH;QLSEVLRRDDPYYHA;LSEVLRRDDPYYHAE;SEVLRRDDPYYHAEL;EVLRRDDPYYHAELE;VLRRDDPYYHAELEW;LRRDDPYYHAELEWW;RRDDPYYHAELEWWT;RDDPYYHAELEWWTS;DDPYYHAELEWWTSP;DPYYHAELEWWTSPF;PYYHAELEWWTSPFV;YYHAELEWWTSPFVL;YHAELEWWTSPFVLA;HAELEWWTSPFVLAH;AELEWWTSPFVLAHG;ELEWWTSPFVLAHGV;LEWWTSPFVLAHGVP;EWWTSPFVLAHGVPP;WWTSPFVLAHGVPPD;WTSPFVLAHGVPPDT;TSPFVLAHGVPPDTL;SPFVLAHGVPPDTLA;PFVLAHGVPPDTLAS;FVLAHGVPPDTLASD;VLAHGVPPDTLASDA;LAHGVPPDTLASDAE;AHGVPPDTLASDAER;HGVPPDTLASDAERL;GVPPDTLASDAERLR;VPPDTLASDAERLRV;PPDTLASDAERLRVD;PDTLASDAERLRVDL;DTLASDAERLRVDLG;TLASDAERLRVDLGR;LASDAERLRVDLGRD;ASDAERLRVDLGRDF;SDAERLRVDLGRDFP;DAERLRVDLGRDFPV;AERLRVDLGRDFPVR;ERLRVDLGRDFPVRS;RLRVDLGRDFPVRSY;LRVDLGRDFPVRSYQ;RVDLGRDFPVRSYQN;VDLGRDFPVRSYQNR;DLGRDFPVRSYQNRR;LGRDFPVRSYQNRRA;GRDFPVRSYQNRRAE;RDFPVRSYQNRRAEL;DFPVRSYQNRRAELA;FPVRSYQNRRAELAD;PVRSYQNRRAELADD;VRSYQNRRAELADDR;RSYQNRRAELADDRS;SYQNRRAELADDRSK;YQNRRAELADDRSKV;QNRRAELADDRSKVL;NRRAELADDRSKVLV;RRAELADDRSKVLVL;RAELADDRSKVLVLS;AELADDRSKVLVLST;ELADDRSKVLVLSTP;LADDRSKVLVLSTPS;ADDRSKVLVLSTPSD;DDRSKVLVLSTPSDT;DRSKVLVLSTPSDTR;RSKVLVLSTPSDTRA;SKVLVLSTPSDTRAD;KVLVLSTPSDTRADA;VLVLSTPSDTRADAL;LVLSTPSDTRADALR;VLSTPSDTRADALRC;LSTPSDTRADALRCG;STPSDTRADALRCGE;TPSDTRADALRCGEV;PSDTRADALRCGEVL;SDTRADALRCGEVLS;DTRADALRCGEVLST;TRADALRCGEVLSTI;RADALRCGEVLSTIL;ADALRCGEVLSTILL;DALRCGEVLSTILLE;ALRCGEVLSTILLEC;LRCGEVLSTILLECT;RCGEVLSTILLECTM;CGEVLSTILLECTMA;GEVLSTILLECTMAG;EVLSTILLECTMAGM;VLSTILLECTMAGMA;LSTILLECTMAGMAT;STILLECTMAGMATC;TILLECTMAGMATCT;ILLECTMAGMATCTL;LLECTMAGMATCTLT;LECTMAGMATCTLTH;ECTMAGMATCTLTHL;CTMAGMATCTLTHLI;TMAGMATCTLTHLIE;MAGMATCTLTHLIES;AGMATCTLTHLIESS;GMATCTLTHLIESSD;MATCTLTHLIESSDS;ATCTLTHLIESSDSR;TCTLTHLIESSDSRD;CTLTHLIESSDSRDI;TLTHLIESSDSRDIV;LTHLIESSDSRDIVR;THLIESSDSRDIVRG;HLIESSDSRDIVRGL;LIESSDSRDIVRGLT;IESSDSRDIVRGLTR;ESSDSRDIVRGLTRQ;SSDSRDIVRGLTRQR;SDSRDIVRGLTRQRG;DSRDIVRGLTRQRGE;SRDIVRGLTRQRGEP;RDIVRGLTRQRGEPQ;DIVRG | |

Fig. 30 continued

| | | |
|---|---|---|
| | LTRQRGEPQA;IVRGLTRQRGEPQAL;VRGLTRQRGEPQALI;RGLTRQRGEPQALIR;GLTRQRGEPQALIRV;LTRQRGEPQALIRVG;TRQRGEPQALIRVGI;RQRGEPQALIRVGIA;QRGEPQALIRVGIAP;RGEPQALIRVGIAPP;GEPQALIRVGIAPPL;EPQALIRVGIAPPLA;PQALIRVGIAPPLAA;QALIRVGIAPPLAAV;ALIRVGIAPPLAAVP;LIRVGIAPPLAAVPA;IRVGIAPPLAAVPAP;RVGIAPPLAAVPAPT;VGIAPPLAAVPAPTP;GIAPPLAAVPAPTPR;IAPPLAAVPAPTPRR;APPLAAVPAPTPRRP;PPLAAVPAPTPRRPL;PLAAVPAPTPRRPLD;LAAVPAPTPRRPLDS;AAVPAPTPRRPLDSV;AVPAPTPRRPLDSVL;VPAPTPRRPLDSVLQ;PAPTPRRPLDSVLQI;APTPRRPLDSVLQIR;PTPRRPLDSVLQIRQ;TPRRPLDSVLQIRQT;PRRPLDSVLQIRQTP;RRPLDSVLQIRQTPE;RPLDSVLQIRQTPEK;PLDSVLQIRQTPEKG;LDSVLQIRQTPEKGR;DSVLQIRQTPEKGRN;SVLQIRQTPEKGRNA;VLQIRQTPEKGRNAS;LQIRQTPEKGRNASD;QIRQTPEKGRNASDR;IRQTPEKGRNASDRN;RQTPEKGRNASDRNA;QTPEKGRNASDRNAR;TPEKGRNASDRNARE;PEKGRNASDRNARET;EKGRNASDRNARETG;KGRNASDRNARETGW;GRNASDRNARETGWF;RNASDRNARETGWFS;NASDRNARETGWFSP;ASDRNARETGWFSPP;<br>16 mers:<br>MLKNAVLLACRAPSVH;LKNAVLLACRAPSVHN;KNAVLLACRAPSVHNS;NAVLLACRAPSVHNSQ;AVLLACRAPSVHNSQP;VLLACRAPSVHNSQPW;LLACRAPSVHNSQPWR;LACRAPSVHNSQPWRW;ACRAPSVHNSQPWRWV;CRAPSVHNSQPWRWVA;RAPSVHNSQPWRWVAE;APSVHNSQPWRWVAES;PSVHNSQPWRWVAESG;SVHNSQPWRWVAESGS;VHNSQPWRWVAESGSE;HNSQPWRWVAESGSEH;NSQPWRWVAESGSEHT;SQPWRWVAESGSEHTT;QPWRWVAESGSEHTTV;PWRWVAESGSEHTTVH;WRWVAESGSEHTTVHL;RWVAESGSEHTTVHLF;WVAESGSEHTTVHLFV;VAESGSEHTTVHLFVN;AESGSEHTTVHLFVNR;ESGSEHTTVHLFVNRH;SGSEHTTVHLFVNRHR;GSEHTTVHLFVNRHRT;SEHTTVHLFVNRHRTV;EHTTVHLFVNRHRTVP;HTTVHLFVNRHRTVPA;TTVHLFVNRHRTVPAT;TVHLFVNRHRTVPATD;VHLFVNRHRTVPATDH;HLFVNRHRTVPATDHS;LFVNRHRTVPATDHSG;FVNRHRTVPATDHSGR;VNRHRTVPATDHSGRQ;NRHRTVPATDHSGRQA;RHRTVPATDHSGRQAI;HRTVPATDHSGRQAII;RTVPATDHSGRQAIIS;TVPATDHSGRQAIISC;VPATDHSGRQAIISCG;PATDHSGRQAIISCGA;ATDHSGRQAIISCGAV;TDHSGRQAIISCGAVL;DHSGRQAIISCGAVLD;HSGRQAIISCGAVLDH;SGRQAIISCGAVLDHL;GRQAIISCGAVLDHLR;RQAIISCGAVLDHLRI;QAIISCGAVLDHLRIA;AIISCGAVLDHLRIAM;IISCGAVLDHLRIAMT;ISCGAVLDHLRIAMTA;SCGAVLDHLRIAMTAA;CGAVLDHLRIAMTAAH;GAVLDHLRIAMTAAHW;AVLDHLRIAMTAAHWQ;VLDHLRIAMTAAHWQA;LDHLRIAMTAAHWQAN;DHLRIAMTAAHWQANI;HLRIAMTAAHWQANIT;LRIAMTAAHWQANITR;RIAMTAAHWQANITRF;IAMTAAHWQANITRFP;AMTAAHWQANITRFPQ;MTAAHWQANITRFPQP;TAAHWQANITRFPQPN;AAHWQANITRFPQPNQ;AHWQANITRFPQPNQP;HWQANITRFPQPNQPD;WQANITRFPQPNQPDQ;QANITRFPQPNQPDQL;ANITRFPQPNQPDQLA;NITRFPQPNQPDQLAT;ITRFPQPNQPDQLATV;TRFPQPNQPDQLATVE;RFPQPNQPDQLATVEF;FPQPNQPDQLATVEFS;PQPNQPDQLATVEFSP;QPNQPDQLATVEFSPI;PNQPDQLATVEFSPID;NQPDQLATVEFSPIDH;QPDQLATVEFSPIDHV;PDQLATVEFSPIDHVT;DQLATVEFSPIDHVTA;QLATVEFSPIDHVTAG;LATVEFSPIDHVTAGQ;ATVEFSPIDHVTAGQR;TVEFSPIDHVTAGQRN;VEFSPIDHVTAGQRNR;EFSPIDHVTAGQRNRA;FSPIDHVTAGQRNRAQ;SPIDHVTAGQRNRAQA;PIDHVTAGQRNRAQAI;IDHVTAGQRNRAQAIL;DHVTAGQRNRAQAILQ;HVTAGQRNRAQAILQR;VTAGQRNRAQAILQRR;TAGQRNRAQAILQRRT;AGQRNRAQAILQRRTD;GQRNRAQAILQRRTDR;QRNRAQAILQRRTDRL;RNRAQAILQRRTDRLP;NRAQAILQRRTDRLPF;RAQAILQRRTDRLPFD;AQAILQRRTDRLPFDS;QAILQRRTDRLPFDSP;AIL | |

Fig. 30 continued

| | | |
|---|---|---|
| | QRRTDRLPFDSPM;ILQRRTDRLPFDSPMY;LQRRTDRLPFDSPMYW;QRRTDRLPFDSPMYWH;RRTDRLPFDSPMYWHL;RTDRLPFDSPMYWHLF;TDRLPFDSPMYWHLFE;DRLPFDSPMYWHLFEP;RLPFDSPMYWHLFEPA;LPFDSPMYWHLFEPAL;PFDSPMYWHLFEPALR;FDSPMYWHLFEPALRD;DSPMYWHLFEPALRDA;SPMYWHLFEPALRDAV;PMYWHLFEPALRDAVD;MYWHLFEPALRDAVDK;YWHLFEPALRDAVDKD;WHLFEPALRDAVDKDV;HLFEPALRDAVDKDVA;LFEPALRDAVDKDVAM;FEPALRDAVDKDVAML;EPALRDAVDKDVAMLD;PALRDAVDKDVAMLDV;ALRDAVDKDVAMLDVV;LRDAVDKDVAMLDVVS;RDAVDKDVAMLDVVSD;DAVDKDVAMLDVVSDD;AVDKDVAMLDVVSDDQ;VDKDVAMLDVVSDDQR;DKDVAMLDVVSDDQRT;KDVAMLDVVSDDQRTR;DVAMLDVVSDDQRTRL;VAMLDVVSDDQRTRLV;AMLDVVSDDQRTRLVV;MLDVVSDDQRTRLVVA;LDVVSDDQRTRLVVAS;DVVSDDQRTRLVVASQ;VVSDDQRTRLVVASQL;VSDDQRTRLVVASQLS;SDDQRTRLVVASQLSE;DDQRTRLVVASQLSEV;DQRTRLVVASQLSEVL;QRTRLVVASQLSEVLR;RTRLVVASQLSEVLRR;TRLVVASQLSEVLRRD;RLVVASQLSEVLRRDD;LVVASQLSEVLRRDDP;VVASQLSEVLRRDDPY;VASQLSEVLRRDDPYY;ASQLSEVLRRDDPYYH;SQLSEVLRRDDPYYHA;QLSEVLRRDDPYYHAE;LSEVLRRDDPYYHAEL;SEVLRRDDPYYHAELE;EVLRRDDPYYHAELEW;VLRRDDPYYHAELEWW;LRRDDPYYHAELEWWT;RRDDPYYHAELEWWTS;RDDPYYHAELEWWTSP;DDPYYHAELEWWTSPF;DPYYHAELEWWTSPFV;PYYHAELEWWTSPFVL;YYHAELEWWTSPFVLA;YHAELEWWTSPFVLAH;HAELEWWTSPFVLAHG;AELEWWTSPFVLAHGV;ELEWWTSPFVLAHGVP;LEWWTSPFVLAHGVPP;EWWTSPFVLAHGVPPD;WWTSPFVLAHGVPPDT;WTSPFVLAHGVPPDTL;TSPFVLAHGVPPDTLA;SPFVLAHGVPPDTLAS;PFVLAHGVPPDTLASD;FVLAHGVPPDTLASDA;VLAHGVPPDTLASDAE;LAHGVPPDTLASDAER;AHGVPPDTLASDAERL;HGVPPDTLASDAERLR;GVPPDTLASDAERLRV;VPPDTLASDAERLRVD;PPDTLASDAERLRVDL;PDTLASDAERLRVDLG;DTLASDAERLRVDLGR;TLASDAERLRVDLGRD;LASDAERLRVDLGRDF;ASDAERLRVDLGRDFP;SDAERLRVDLGRDFPV;DAERLRVDLGRDFPVR;AERLRVDLGRDFPVRS;ERLRVDLGRDFPVRSY;RLRVDLGRDFPVRSYQ;LRVDLGRDFPVRSYQN;RVDLGRDFPVRSYQNR;VDLGRDFPVRSYQNRR;DLGRDFPVRSYQNRRA;LGRDFPVRSYQNRRAE;GRDFPVRSYQNRRAEL;RDFPVRSYQNRRAELA;DFPVRSYQNRRAELAD;FPVRSYQNRRAELADD;PVRSYQNRRAELADDR;VRSYQNRRAELADDRS;RSYQNRRAELADDRSK;SYQNRRAELADDRSKV;YQNRRAELADDRSKVL;QNRRAELADDRSKVLV;NRRAELADDRSKVLVL;RRAELADDRSKVLVLS;RAELADDRSKVLVLST;AELADDRSKVLVLSTP;ELADDRSKVLVLSTPS;LADDRSKVLVLSTPSD;ADDRSKVLVLSTPSDT;DDRSKVLVLSTPSDTR;DRSKVLVLSTPSDTRA;RSKVLVLSTPSDTRAD;SKVLVLSTPSDTRADA;KVLVLSTPSDTRADAL;VLVLSTPSDTRADALR;LVLSTPSDTRADALRC;VLSTPSDTRADALRCG;LSTPSDTRADALRCGE;STPSDTRADALRCGEV;TPSDTRADALRCGEVL;PSDTRADALRCGEVLS;SDTRADALRCGEVLST;DTRADALRCGEVLSTI;TRADALRCGEVLSTIL;RADALRCGEVLSTILL;ADALRCGEVLSTILLE;DALRCGEVLSTILLEC;ALRCGEVLSTILLECT;LRCGEVLSTILLECTM;RCGEVLSTILLECTMA;CGEVLSTILLECTMAG;GEVLSTILLECTMAGM;EVLSTILLECTMAGMA;VLSTILLECTMAGMAT;LSTILLECTMAGMATC;STILLECTMAGMATCT;TILLECTMAGMATCTL;ILLECTMAGMATCTLT;LLECTMAGMATCTLTH;LECTMAGMATCTLTHL;ECTMAGMATCTLTHLI;CTMAGMATCTLTHLIE;TMAGMATCTLTHLIES;MAGMATCTLTHLIESS;AGMATCTLTHLIESSD;GMATCTLTHLIESSDS;MATCTLTHLIESSDSR;ATCTLTHLIESSDSRD;TCTLTHLIESSDSRDI;CTLTHLIESSDSRDIV;TLTHLIESSDSRDIVR;LTHLIESSDSRDIVRG;THLIESSDSRDIVRGL;HLIESSDSRDIVRGLT;LIESSDSRDIVRGLTR;IESSDSRDIVRGLTRQ;ESSDSRDIVRGLTRQR;SSDSRDIVR | |

Fig. 30 continued

| | | |
|---|---|---|
| | GLTRQRG;SDSRDIVRGLTRQRGE;DSRDIVRGLTRQRGEP;SRDIVRGLTRQRGEPQ;RDIVRGLTRQRGEPQA;DIVRGLTRQRGEPQAL;IVRGLTRQRGEPQALI;VRGLTRQRGEPQALIR;RGLTRQRGEPQALIRV;GLTRQRGEPQALIRVG;LTRQRGEPQALIRVGI;TRQRGEPQALIRVGIA;RQRGEPQALIRVGIAP;QRGEPQALIRVGIAPP;RGEPQALIRVGIAPPL;GEPQALIRVGIAPPLA;EPQALIRVGIAPPLAA;PQALIRVGIAPPLAAV;QALIRVGIAPPLAAVP;ALIRVGIAPPLAAVPA;LIRVGIAPPLAAVPAP;IRVGIAPPLAAVPAPT;RVGIAPPLAAVPAPTP;VGIAPPLAAVPAPTPR;GIAPPLAAVPAPTPRR;IAPPLAAVPAPTPRRP;APPLAAVPAPTPRRPL;PPLAAVPAPTPRRPLD;PLAAVPAPTPRRPLDS;LAAVPAPTPRRPLDSV;AAVPAPTPRRPLDSVL;AVPAPTPRRPLDSVLQ;VPAPTPRRPLDSVLQI;PAPTPRRPLDSVLQIR;APTPRRPLDSVLQIRQ;PTPRRPLDSVLQIRQT;TPRRPLDSVLQIRQTP;PRRPLDSVLQIRQTPE;RRPLDSVLQIRQTPEK;RPLDSVLQIRQTPEKG;PLDSVLQIRQTPEKGR;LDSVLQIRQTPEKGRN;DSVLQIRQTPEKGRNA;SVLQIRQTPEKGRNAS;VLQIRQTPEKGRNASD;LQIRQTPEKGRNASDR;QIRQTPEKGRNASDRN;IRQTPEKGRNASDRNA;RQTPEKGRNASDRNAR;QTPEKGRNASDRNARE;TPEKGRNASDRNARET;PEKGRNASDRNARETG;EKGRNASDRNARETGW;KGRNASDRNARETGWF;GRNASDRNARETGWFS;RNASDRNARETGWFSP;NASDRNARETGWFSPP | |
| 11 | **<NP_216249.1 transmembrane protein Rv1733c;Mycobacterium tuberculosis H37Rv>**<br>MIATTRDREGATMITFRLRLPCRTILRVFSRNPLVRGTDRLEAVVMLLAVTVSLLTIPFAAAAGTAVQDSRSHVYAHQAQTRHPATATVIDHEGVIDSNTTATSAPPRTKITVPARWVVNGIERSGEVNAKPGTKSGDRVGIWVDSAGQLVDEPAPPARAIADAALAALGLWLSVAAVAGALLALTRAILIRVRNASWQHDIDSLFCTQR<br><br>8mer<br>MIATTRDR;EGATMITF;GATMITFR;ATMITFRL;TMITFRLR;MITFRLRL;RLPCRTIL;LPCRTILR;TILRVFSR;RVFSRNPL;FSRNPLVR;GTDRLEAV;RLEAVVML;LEAVVMLL;EAVVMLLA;AVVMLLAV;VMLLAVTV;MLLAVTVS;LLAVTVSL;LAVTVSLL;VTVSLLTI;VSLLTIPF;SLLTIPFA;LLTIPFAA;LTIPFAAA;TIPFAAAA;IPFAAAAG;FAAAAGTA;AAAAGTAV;GTAVQDSR;VQDSRSHV;RSHVYAHQ;YAHQAQTR;HPATATVI;TVIDHEGV;VIDSNTTA;TATSAPPR;TSAPPRTK;PPRTKITV;RTKITVPA;TKITVPAR;KITVPARW;ITVPARWV;TVPARWVV;WVVNGIER;GIERSGEV;RSGEVNAK;WVDSAGQL;GQLVDEPA;EPAPPARA;APPARAIA;RAIADAAL;AIADAALA;IADAALAA;AALAALGL;LAALGLWL;ALGLWLSV;GLWLSVAA;WLSVAAVA;SVAAVAGA;VAAVAGAL;AAVAGALL;AVAGALLA;GALLALTR;ALLALTRA;LLALTRAI;ALTRAILI;LTRAILIR;TRAILIRV;RAILIRVR;ILIRVRNA;RVRNASWQ;WQHDIDSL;DSLFCTQR<br>9mer<br>REGATMITF;EGATMITFR;GATMITFRL;ATMITFRLR;TMITFRLRL;TFRLRLPCR;RLPCRTILR;LPCRTILRV;RTILRVFSR;RVFSRNPLV;VFSRNPLVR;PLVRGTDRL;RGTDRLEAV;GTDRLEAVV;RLEAVVMLL;EAVVMLLAV;VVMLLAVTV;MLLAVTVSL;LLAVTVSLL;AVTVSLLTI;TVSLLTIPF;SLLTIPFAA;LLTIPFAAA;LTIPFAAAA;IPFAAAAGT;FAAAAGTAV;AVQDSRSHV;VQDSRSHVY;RSHVYAHQA;YAHQAQTRH;HQAQTRHPA;AQTRHPATA;TRHPATATV;ATVIDHEGV;TVIDHEGVI;GVIDSNTTA;TTATSAPPR;ATSAPPRTK;TSAPPRTKI;APPRTKITV;RTKITVPAR;TKITVPARW;KITVPARWV;ITVPARWVV;RWVVNGIER;NGIERSGEV;EVNAKPGTK;KSGDRVGIW;SGDRVGIWV;RVGIWVDSA;WVDSAGQLV;LVDEPAPPA;EPAPPARAI;RAIADAALA;AIADAALAA;IADAALAAL;AALAALGLW;ALAALGLWL;AALGLWLSV;ALGLWLSVA;GLWLSVAAV;LSVAAVAGA;SVAAVAGAL;VAAVAGALL;AAVAGALLA;AVAGALLAL; | 130357-131444 |

Fig. 30 continued

| | | |
|---|---|---|
| | ALLALTRAI;LLALTRAIL;LALTRAILI;ALTRAILIR;LTRAILIRV;RVRNASWQH;SWQHDIDSL;WQHDIDSLF<br>10mer<br>TTRDREGATM;REGATMITFR;EGATMITFRL;GATMITFRLR;ATMITFRLRL;ITFRLRLPCR;RLRLPCRTIL;LRLPCRTILR;RLPCRTILRV;LPCRTILRVF;CRTILRVFSR;ILRVFSRNPL;RVFSRNPLVR;NPLVRGTDRL;RLEAVVMLLA;LEAVVMLLAV;EAVVMLLAVT;AVVMLLAVTV;VMLLAVTVSL;MLLAVTVSLL;LLAVTVSLLT;LAVTVSLLTI;VTVSLLTIPF;TVSLLTIPFA;SLLTIPFAAA;LLTIPFAAAA;IPFAAAAGTA;FAAAAGTAVQ;TAVQDSRSHV;AVQDSRSHVY;VQDSRSHVYA;RSHVYAHQAQ;HVYAHQAQTR;HQAQTRHPAT;QTRHPATATV;HPATATVIDH;TATVIDHEGV;GVIDSNTTAT;NTTATSAPPR;TATSAPPRTK;SAPPRTKITV;PPRTKITVPA;RTKITVPARW;TKITVPARWV;KITVPARWVV;VPARWVVNGI;KPGTKSGDRV;KSGDRVGIWV;GIWVDSAGQL;QLVDEPAPPA;EPAPPARAIA;PPARAIADAA;RAIADAALAA;AIADAALAAL;DAALAALGLW;AALAALGLWL;ALAALGLWLS;LAALGLWLSV;AALGLWLSVA;ALGLWLSVAA;LGLWLSVAAV;GLWLSVAAVA;WLSVAAVAGA;LSVAAVAGAL;SVAAVAGALL;AAVAGALLAL;AVAGALLALT;ALLALTRAIL;LLALTRAILI;LALTRAILIR;ALTRAILIRV;LTRAILIRVR;ILIRVRNASW;RVRNASWQHD;SWQHDIDSLF;WQHDIDSLFC;DIDSLFCTQR<br>11mer<br>MIATTRDREGA;ATTRDREGATM;RDREGATMITF;DREGATMITFR;REGATMITFRL;EGATMITFRLR;TMITFRLRLPC;MITFRLRLPCR;FRLRLPCRTIL;RLRLPCRTILR;LPCRTILRVFS;TILRVFSRNPL;ILRVFSRNPLV;PLVRGTDRLEA;LVRGTDRLEAV;GTDRLEAVVML;RLEAVVMLLAV;EAVVMLLAVTV;VVMLLAVTVSL;VMLLAVTVSLL;MLLAVTVSLLT;LLAVTVSLLTI;AVTVSLLTIPF;VTVSLLTIPFA;TVSLLTIPFAA;SLLTIPFAAAA;LTIPFAAAAGT;IPFAAAAGTAV;AAAGTAVQDSR;GTAVQDSRSHV;TAVQDSRSHVY;AVQDSRSHVYA;HVYAHQAQTRH;YAHQAQTRHPA;HQAQTRHPATA;AQTRHPATATV;ATATVIDHEGV;TATVIDHEGVI;VIDSNTTATSA;SNTTATSAPPR;TTATSAPPRTK;TSAPPRTKITV;APPRTKITVPA;RTKITVPARWV;TKITVPARWVV;TVPARWVVNGI;VVNGIERSGEV;NAKPGTKSGDR;TKSGDRVGIWV;GIWVDSAGQLV;DSAGQLVDEPA;GQLVDEPAPPA;QLVDEPAPPAR;LVDEPAPPARA;APPARAIADAA;PPARAIADAAL;RAIADAALAAL;IADAALAALGL;ALAALGLWLSV;LAALGLWLSVA;AALGLWLSVAA;ALGLWLSVAAV;WLSVAAVAGAL;SVAAVAGALLA;VAAVAGALLAL;AVAGALLALTR;ALLALTRAILI;LLALTRAILIR;LALTRAILIRV;ALTRAILIRVR;ILIRVRNASWQ;RVRNASWQHDI;NASWQHDIDSL;ASWQHDIDSLF;WQHDIDSLFCT;HDIDSLFCTQR<br><br>13 mers:<br>MIATTRDREGATM;IATTRDREGATMI;ATTRDREGATMIT;TTRDREGATMITF;TRDREGATMITFR;RDREGATMITFRL;DREGATMITFRLR;REGATMITFRLRL;EGATMITFRLRLP;GATMITFRLRLPC;ATMITFRLRLPCR;TMITFRLRLPCRT;MITFRLRLPCRTI;ITFRLRLPCRTIL;TFRLRLPCRTILR;FRLRLPCRTILRV;RLRLPCRTILRVF;LRLPCRTILRVFS;RLPCRTILRVFSR;LPCRTILRVFSRN;PCRTILRVFSRNP;CRTILRVFSRNPL;RTILRVFSRNPLV;TILRVFSRNPLVR;ILRVFSRNPLVRG;LRVFSRNPLVRGT;RVFSRNPLVRGTD;VFSRNPLVRGTDR;FSRNPLVRGTDRL;SRNPLVRGTDRLE;RNPLVRGTDRLEA;NPLVRGTDRLEAV;PLVRGTDRLEAVV;LVRGTDRLEAVVM;VRGTDRLEAVVML;RGTDRLEAVVMLL;GTDRLEAVVMLLA;TDRLEAVVMLLAV;DRLEAVVMLLAVT;RLEAVVMLLAVTV;LEAVVMLLAVTVS;EAVVMLLAVTVSL;AVVMLLAVTVSLL;VVMLLAVTVSLLT;VMLLAVTVSLLTI;MLLAVTVSLLTIP;LLAVTVSLLTIPF;LAVTVSLLTIPFA;AVTVSLLTIPFAA;VTVSLLTIPFAAA;TVSLLTIPFAAAA;VSLLTIPFAAAAG;SLLTIPFAAAAGT;LLTIPFAAAAGTA;LTIPFAAAAGTA | |

Fig. 30 continued

| | | |
|---|---|---|
| | V;TIPFAAAAGTAVQ;IPFAAAAGTAVQD;PFAAAAGTAVQDS;FAAAAGTAV<br>QDSR;AAAAGTAVQDSRS;AAAGTAVQDSRSH;AAGTAVQDSRSHV;AGTA<br>VQDSRSHVY;GTAVQDSRSHVYA;TAVQDSRSHVYAH;AVQDSRSHVYAH<br>Q;VQDSRSHVYAHQA;QDSRSHVYAHQAQ;DSRSHVYAHQAQT;SRSHVY<br>AHQAQTR;RSHVYAHQAQTRH;SHVYAHQAQTRHP;HVYAHQAQTRHPA;V<br>YAHQAQTRHPAT;YAHQAQTRHPATA;AHQAQTRHPATAT;HQAQTRHPAT<br>ATV;QAQTRHPATATVI;AQTRHPATATVID;QTRHPATATVIDH;TRHPATAT<br>VIDHE;RHPATATVIDHEG;HPATATVIDHEGV;PATATVIDHEGVI;ATATVID<br>HEGVID;TATVIDHEGVIDS;ATVIDHEGVIDSN;TVIDHEGVIDSNT;VIDHEGV<br>IDSNTT;IDHEGVIDSNTTA;DHEGVIDSNTTAT;HEGVIDSNTTATS;EGVIDS<br>NTTATSA;GVIDSNTTATSAP;VIDSNTTATSAPP;IDSNTTATSAPPR;DSNTT<br>ATSAPPRT;SNTTATSAPPRTK;NTTATSAPPRTKI;TTATSAPPRTKIT;TATS<br>APPRTKITV;ATSAPPRTKITVP;TSAPPRTKITVPA;SAPPRTKITVPAR;APPR<br>TKITVPARW;PPRTKITVPARWV;PRTKITVPARWVV;RTKITVPARWVVN;TK<br>ITVPARWVVNG;KITVPARWVVNGI;ITVPARWVVNGIE;TVPARWVVNGIER;<br>VPARWVVNGIERS;PARWVVNGIERSG;ARWVVNGIERSGE;RWVVNGIER<br>SGEV;WVVNGIERSGEVN;VVNGIERSGEVNA;VNGIERSGEVNAK;NGIERS<br>GEVNAKP;GIERSGEVNAKPG;IERSGEVNAKPGT;ERSGEVNAKPGTK;RS<br>GEVNAKPGTKS;SGEVNAKPGTKSG;GEVNAKPGTKSGD;EVNAKPGTKSG<br>DR;VNAKPGTKSGDRV;NAKPGTKSGDRVG;AKPGTKSGDRVGI;KPGTKS<br>GDRVGIW;PGTKSGDRVGIWV;GTKSGDRVGIWVD;TKSGDRVGIWVDS;K<br>SGDRVGIWVDSA;SGDRVGIWVDSAG;GDRVGIWVDSAGQ;DRVGIWVDS<br>AGQL;RVGIWVDSAGQLV;VGIWVDSAGQLVD;GIWVDSAGQLVDE;IWVDS<br>AGQLVDEP;WVDSAGQLVDEPA;VDSAGQLVDEPAP;DSAGQLVDEPAPP;<br>SAGQLVDEPAPPA;AGQLVDEPAPPAR;GQLVDEPAPPARA;QLVDEPAPP<br>ARAI;LVDEPAPPARAIA;VDEPAPPARAIAD;DEPAPPARAIADA;EPAPPARA<br>IADAA;PAPPARAIADAAL;APPARAIADAALA;PPARAIADAALAA;PARAIADA<br>ALAAL;ARAIADAALAALG;RAIADAALAALGL;AIADAALAALGLW;IADAALAA<br>LGLWL;ADAALAALGLWLS;DAALAALGLWLSV;AALAALGLWLSVA;ALAAL<br>GLWLSVAA;LAALGLWLSVAAV;AALGLWLSVAAVA;ALGLWLSVAAVAG;L<br>GLWLSVAAVAGA;GLWLSVAAVAGAL;LWLSVAAVAGALL;WLSVAAVAGA<br>LLA;LSVAAVAGALLAL;SVAAVAGALLALT;VAAVAGALLALTR;AAVAGALLA<br>LTRA;AVAGALLALTRAI;VAGALLALTRAIL;AGALLALTRAILI;GALLALTRAIL<br>IR;ALLALTRAILIRV;LLALTRAILIRVR;LALTRAILIRVRN;ALTRAILIRVRNA;L<br>TRAILIRVRNAS;TRAILIRVRNASW;RAILIRVRNASWQ;AILIRVRNASWQH;I<br>LIRVRNASWQHD;LIRVRNASWQHDI;IRVRNASWQHDID;RVRNASWQHDI<br>DS;VRNASWQHDIDSL;RNASWQHDIDSLF;NASWQHDIDSLFC;ASWQHDI<br>DSLFCT;SWQHDIDSLFCTQ;WQHDIDSLFCTQR;<br>14 mers:<br>MIATTRDREGATMI;IATTRDREGATMIT;ATTRDREGATMITF;TTRDREGAT<br>MITFR;TRDREGATMITFRL;RDREGATMITFRLR;DREGATMITFRLRL;REG<br>ATMITFRLRLP;EGATMITFRLRLPC;GATMITFRLRLPCR;ATMITFRLRLPCR<br>T;TMITFRLRLPCRTI;MITFRLRLPCRTIL;ITFRLRLPCRTILR;TFRLRLPCRTI<br>LRV;FRLRLPCRTILRVF;RLRLPCRTILRVFS;LRLPCRTILRVFSR;RLPCRTI<br>LRVFSRN;LPCRTILRVFSRNP;PCRTILRVFSRNPL;CRTILRVFSRNPLV;RT<br>ILRVFSRNPLVR;TILRVFSRNPLVRG;ILRVFSRNPLVRGT;LRVFSRNPLVR<br>GTD;RVFSRNPLVRGTDR;VFSRNPLVRGTDRL;FSRNPLVRGTDRLE;SRN<br>PLVRGTDRLEA;RNPLVRGTDRLEAV;NPLVRGTDRLEAVV;PLVRGTDRLE<br>AVVM;LVRGTDRLEAVVML;VRGTDRLEAVVMLL;RGTDRLEAVVMLLA;GT<br>DRLEAVVMLLAV;TDRLEAVVMLLAVT;DRLEAVVMLLAVTV;RLEAVVMLLA<br>VTVS;LEAVVMLLAVTVSL;EAVVMLLAVTVSLL;AVVMLLAVTVSLLT;VVMLL<br>AVTVSLLTI;VMLLAVTVSLLTIP;MLLAVTVSLLTIPF;LLAVTVSLLTIPFA;LAV<br>TVSLLTIPFAA;AVTVSLLTIPFAAA;VTVSLLTIPFAAAA;TVSLLTIPFAAAAG; | |

Fig. 30 continued

| | | |
|---|---|---|
| | VSLLTIPFAAAAGT;SLLTIPFAAAAGTA;LLTIPFAAAAGTAV;LTIPFAAAAGTAVQ;TIPFAAAAGTAVQD;IPFAAAAGTAVQDS;PFAAAAGTAVQDSR;FAAAAGTAVQDSRS;AAAAGTAVQDSRSH;AAAGTAVQDSRSHV;AAGTAVQDSRSHVY;AGTAVQDSRSHVYA;GTAVQDSRSHVYAH;TAVQDSRSHVYAHQ;AVQDSRSHVYAHQA;VQDSRSHVYAHQAQ;QDSRSHVYAHQAQT;DSRSHVYAHQAQTR;SRSHVYAHQAQTRH;RSHVYAHQAQTRHP;SHVYAHQAQTRHPA;HVYAHQAQTRHPAT;VYAHQAQTRHPATA;YAHQAQTRHPATAT;AHQAQTRHPATATV;HQAQTRHPATATVI;QAQTRHPATATVID;AQTRHPATATVIDH;QTRHPATATVIDHE;TRHPATATVIDHEG;RHPATATVIDHEGV;HPATATVIDHEGVI;PATATVIDHEGVID;ATATVIDHEGVIDS;TATVIDHEGVIDSN;ATVIDHEGVIDSNT;TVIDHEGVIDSNTT;VIDHEGVIDSNTTA;IDHEGVIDSNTTAT;DHEGVIDSNTTATS;HEGVIDSNTTATSA;EGVIDSNTTATSAP;GVIDSNTTATSAPP;VIDSNTTATSAPPR;IDSNTTATSAPPRT;DSNTTATSAPPRTK;SNTTATSAPPRTKI;NTTATSAPPRTKIT;TTATSAPPRTKITV;TATSAPPRTKITVP;ATSAPPRTKITVPA;TSAPPRTKITVPAR;SAPPRTKITVPARW;APPRTKITVPARWV;PPRTKITVPARWVV;PRTKITVPARWVVN;RTKITVPARWVVNG;TKITVPARWVVNGI;KITVPARWVVNGIE;ITVPARWVVNGIER;TVPARWVVNGIERS;VPARWVVNGIERSG;PARWVVNGIERSGE;ARWVVNGIERSGEV;RWVVNGIERSGEVN;WVVNGIERSGEVNA;VVNGIERSGEVNAK;VNGIERSGEVNAKP;NGIERSGEVNAKPG;GIERSGEVNAKPGT;IERSGEVNAKPGTK;ERSGEVNAKPGTKS;RSGEVNAKPGTKSG;SGEVNAKPGTKSGD;GEVNAKPGTKSGDR;EVNAKPGTKSGDRV;VNAKPGTKSGDRVG;NAKPGTKSGDRVGI;AKPGTKSGDRVGIW;KPGTKSGDRVGIWV;PGTKSGDRVGIWVD;GTKSGDRVGIWVDS;TKSGDRVGIWVDSA;KSGDRVGIWVDSAG;SGDRVGIWVDSAGQ;GDRVGIWVDSAGQL;DRVGIWVDSAGQLV;RVGIWVDSAGQLVD;VGIWVDSAGQLVDE;GIWVDSAGQLVDEP;IWVDSAGQLVDEPA;WVDSAGQLVDEPAP;VDSAGQLVDEPAPP;DSAGQLVDEPAPPA;SAGQLVDEPAPPAR;AGQLVDEPAPPARA;GQLVDEPAPPARAI;QLVDEPAPPARAIA;LVDEPAPPARAIAD;VDEPAPPARAIADA;DEPAPPARAIADAA;EPAPPARAIADAAL;PAPPARAIADAALA;APPARAIADAALAA;PPARAIADAALAAL;PARAIADAALAALG;ARAIADAALAALGL;RAIADAALAALGLW;AIADAALAALGLWL;IADAALAALGLWLS;ADAALAALGLWLSV;DAALAALGLWLSVA;AALAALGLWLSVAA;ALAALGLWLSVAAV;LAALGLWLSVAAVA;AALGLWLSVAAVAG;ALGLWLSVAAVAGA;LGLWLSVAAVAGAL;GLWLSVAAVAGALL;LWLSVAAVAGALLA;WLSVAAVAGALLAL;LSVAAVAGALLALT;SVAAVAGALLALTR;VAAVAGALLALTRA;AAVAGALLALTRAI;AVAGALLALTRAIL;VAGALLALTRAILI;AGALLALTRAILIR;GALLALTRAILIRV;ALLALTRAILIRVR;LLALTRAILIRVRN;LALTRAILIRVRNA;ALTRAILIRVRNAS;LTRAILIRVRNASW;TRAILIRVRNASWQ;RAILIRVRNASWQH;AILIRVRNASWQHD;ILIRVRNASWQHDI;LIRVRNASWQHDID;IRVRNASWQHDIDS;RVRNASWQHDIDSL;VRNASWQHDIDSLF;RNASWQHDIDSLFC;NASWQHDIDSLFCT;ASWQHDIDSLFCTQ;SWQHDIDSLFCTQR;<br>15 mers:<br>MIATTRDREGATMIT;IATTRDREGATMITF;ATTRDREGATMITFR;TTRDREGATMITFRL;TRDREGATMITFRLR;RDREGATMITFRLRL;DREGATMITFRLRLP;REGATMITFRLRLPC;EGATMITFRLRLPCR;GATMITFRLRLPCRT;ATMITFRLRLPCRTI;TMITFRLRLPCRTIL;MITFRLRLPCRTILR;ITFRLRLPCRTILRV;TFRLRLPCRTILRVF;FRLRLPCRTILRVFS;RLRLPCRTILRVFSR;LRLPCRTILRVFSRN;RLPCRTILRVFSRNP;LPCRTILRVFSRNPL;PCRTILRVFSRNPLV;CRTILRVFSRNPLVR;RTILRVFSRNPLVRG;TILRVFSRNPLVRGT;ILRVFSRNPLVRGTD;LRVFSRNPLVRGTDR;RVFSRNPLVRGTDRL;VFSRNPLVRGTDRLE;FSRNPLVRGTDRLEA;SRNPLVRGTDRLEAV;RNPLVRGTDRLEAVV;NPLVRGTDRLEAVVM;PLVRGTDRLEAVVML;LVRGTDRLEAVVML | |

Fig. 30 continued

| | | |
|---|---|---|
| | L;VRGTDRLEAVVMLLA;RGTDRLEAVVMLLAV;GTDRLEAVVMLLAVT;TDRLEAVVMLLAVTV;DRLEAVVMLLAVTVS;RLEAVVMLLAVTVSL;LEAVVMLLAVTVSLL;EAVVMLLAVTVSLLT;AVVMLLAVTVSLLTI;VVMLLAVTVSLLTIP;VMLLAVTVSLLTIPF;MLLAVTVSLLTIPFA;LLAVTVSLLTIPFAA;LAVTVSLLTIPFAAA;AVTVSLLTIPFAAAA;VTVSLLTIPFAAAAG;TVSLLTIPFAAAAGT;VSLLTIPFAAAAGTA;SLLTIPFAAAAGTAV;LLTIPFAAAAGTAVQ;LTIPFAAAAGTAVQD;TIPFAAAAGTAVQDS;IPFAAAAGTAVQDSR;PFAAAAGTAVQDSRS;FAAAAGTAVQDSRSH;AAAAGTAVQDSRSHV;AAAGTAVQDSRSHVY;AAGTAVQDSRSHVYA;AGTAVQDSRSHVYAH;GTAVQDSRSHVYAHQ;TAVQDSRSHVYAHQA;AVQDSRSHVYAHQAQ;VQDSRSHVYAHQAQT;QDSRSHVYAHQAQTR;DSRSHVYAHQAQTRH;SRSHVYAHQAQTRHP;RSHVYAHQAQTRHPA;SHVYAHQAQTRHPAT;HVYAHQAQTRHPATA;VYAHQAQTRHPATAT;YAHQAQTRHPATATV;AHQAQTRHPATATVI;HQAQTRHPATATVID;QAQTRHPATATVIDH;AQTRHPATATVIDHE;QTRHPATATVIDHEG;TRHPATATVIDHEGV;RHPATATVIDHEGVI;HPATATVIDHEGVID;PATATVIDHEGVIDS;ATATVIDHEGVIDSN;TATVIDHEGVIDSNT;ATVIDHEGVIDSNTT;TVIDHEGVIDSNTTA;VIDHEGVIDSNTTAT;IDHEGVIDSNTTATS;DHEGVIDSNTTATSA;HEGVIDSNTTATSAP;EGVIDSNTTATSAPP;GVIDSNTTATSAPPR;VIDSNTTATSAPPRT;IDSNTTATSAPPRTK;DSNTTATSAPPRTKI;SNTTATSAPPRTKIT;NTTATSAPPRTKITV;TTATSAPPRTKITVP;TATSAPPRTKITVPA;ATSAPPRTKITVPAR;TSAPPRTKITVPARW;SAPPRTKITVPARWV;APPRTKITVPARWVV;PPRTKITVPARWVVN;PRTKITVPARWVVNG;RTKITVPARWVVNGI;TKITVPARWVVNGIE;KITVPARWVVNGIER;ITVPARWVVNGIERS;TVPARWVVNGIERSG;VPARWVVNGIERSGE;PARWVVNGIERSGEV;ARWVVNGIERSGEVN;RWVVNGIERSGEVNA;WVVNGIERSGEVNAK;VVNGIERSGEVNAKP;VNGIERSGEVNAKPG;NGIERSGEVNAKPGT;GIERSGEVNAKPGTK;IERSGEVNAKPGTKS;ERSGEVNAKPGTKSG;RSGEVNAKPGTKSGD;SGEVNAKPGTKSGDR;GEVNAKPGTKSGDRV;EVNAKPGTKSGDRVG;VNAKPGTKSGDRVGI;NAKPGTKSGDRVGIW;AKPGTKSGDRVGIWV;KPGTKSGDRVGIWVD;PGTKSGDRVGIWVDS;GTKSGDRVGIWVDSA;TKSGDRVGIWVDSAG;KSGDRVGIWVDSAGQ;SGDRVGIWVDSAGQL;GDRVGIWVDSAGQLV;DRVGIWVDSAGQLVD;RVGIWVDSAGQLVDE;VGIWVDSAGQLVDEP;GIWVDSAGQLVDEPA;IWVDSAGQLVDEPAP;WVDSAGQLVDEPAPP;VDSAGQLVDEPAPPA;DSAGQLVDEPAPPAR;SAGQLVDEPAPPARA;AGQLVDEPAPPARAI;GQLVDEPAPPARAIA;QLVDEPAPPARAIAD;LVDEPAPPARAIADA;VDEPAPPARAIADAA;DEPAPPARAIADAAL;EPAPPARAIADAALA;PAPPARAIADAALAA;APPARAIADAALAAL;PPARAIADAALAALG;PARAIADAALAALGL;ARAIADAALAALGLW;RAIADAALAALGLWL;AIADAALAALGLWLS;IADAALAALGLWLSV;ADAALAALGLWLSVA;DAALAALGLWLSVAA;AALAALGLWLSVAAV;ALAALGLWLSVAAVA;LAALGLWLSVAAVAG;AALGLWLSVAAVAGA;ALGLWLSVAAVAGAL;LGLWLSVAAVAGALL;GLWLSVAAVAGALLA;LWLSVAAVAGALLAL;WLSVAAVAGALLALT;LSVAAVAGALLALTR;SVAAVAGALLALTRA;VAAVAGALLALTRAI;AAVAGALLALTRAIL;AVAGALLALTRAILI;VAGALLALTRAILIR;AGALLALTRAILIRV;GALLALTRAILIRVR;ALLALTRAILIRVRN;LLALTRAILIRVRNA;LALTRAILIRVRNAS;ALTRAILIRVRNASW;LTRAILIRVRNASWQ;TRAILIRVRNASWQH;RAILIRVRNASWQHD;AILIRVRNASWQHDI;ILIRVRNASWQHDID;LIRVRNASWQHDIDS;IRVRNASWQHDIDSL;RVRNASWQHDIDSLF;VRNASWQHDIDSLFC;RNASWQHDIDSLFCT;NASWQHDIDSLFCTQ;ASWQHDIDSLFCTQR;<br>16 mers:<br>MIATTRDREGATMITF;IATTRDREGATMITFR;ATTRDREGATMITFRL;TTRDREGATMITFRLR;TRDREGATMITFRLRL;RDREGATMITFRLRLP;DREGATMITFRLRLPC;REGATMITFRLRLPCR;EGATMITFRLRLPCRT;GATMITFR | |

Fig. 30 continued

| | | |
|---|---|---|
| | LRLPCRTI;ATMITFRLRLPCRTIL;TMITFRLRLPCRTILR;MITFRLRLPCRTILRV;ITFRLRLPCRTILRVF;TFRLRLPCRTILRVFS;FRLRLPCRTILRVFSR;RLRLPCRTILRVFSRN;LRLPCRTILRVFSRNP;RLPCRTILRVFSRNPL;LPCRTILRVFSRNPLV;PCRTILRVFSRNPLVR;CRTILRVFSRNPLVRG;RTILRVFSRNPLVRGT;TILRVFSRNPLVRGTD;ILRVFSRNPLVRGTDR;LRVFSRNPLVRGTDRL;RVFSRNPLVRGTDRLE;VFSRNPLVRGTDRLEA;FSRNPLVRGTDRLEAV;SRNPLVRGTDRLEAVV;RNPLVRGTDRLEAVVM;NPLVRGTDRLEAVVML;PLVRGTDRLEAVVMLL;LVRGTDRLEAVVMLLA;VRGTDRLEAVVMLLAV;RGTDRLEAVVMLLAVT;GTDRLEAVVMLLAVTV;TDRLEAVVMLLAVTVS;DRLEAVVMLLAVTVSL;RLEAVVMLLAVTVSLL;LEAVVMLLAVTVSLLT;EAVVMLLAVTVSLLTI;AVVMLLAVTVSLLTIP;VVMLLAVTVSLLTIPF;VMLLAVTVSLLTIPFA;MLLAVTVSLLTIPFAA;LLAVTVSLLTIPFAAA;LAVTVSLLTIPFAAAA;AVTVSLLTIPFAAAAG;VTVSLLTIPFAAAAGT;TVSLLTIPFAAAAGTA;VSLLTIPFAAAAGTAV;SLLTIPFAAAAGTAVQ;LLTIPFAAAAGTAVQD;LTIPFAAAAGTAVQDS;TIPFAAAAGTAVQDSR;IPFAAAAGTAVQDSRS;PFAAAAGTAVQDSRSH;FAAAAGTAVQDSRSHV;AAAAGTAVQDSRSHVY;AAAGTAVQDSRSHVYA;AAGTAVQDSRSHVYAH;AGTAVQDSRSHVYAHQ;GTAVQDSRSHVYAHQA;TAVQDSRSHVYAHQAQ;AVQDSRSHVYAHQAQT;VQDSRSHVYAHQAQTR;QDSRSHVYAHQAQTRH;DSRSHVYAHQAQTRHP;SRSHVYAHQAQTRHPA;RSHVYAHQAQTRHPAT;SHVYAHQAQTRHPATA;HVYAHQAQTRHPATAT;VYAHQAQTRHPATATV;YAHQAQTRHPATATVI;AHQAQTRHPATATVID;HQAQTRHPATATVIDH;QAQTRHPATATVIDHE;AQTRHPATATVIDHEG;QTRHPATATVIDHEGV;TRHPATATVIDHEGVI;RHPATATVIDHEGVID;HPATATVIDHEGVIDS;PATATVIDHEGVIDSN;ATATVIDHEGVIDSNT;TATVIDHEGVIDSNTT;ATVIDHEGVIDSNTTA;TVIDHEGVIDSNTTAT;VIDHEGVIDSNTTATS;IDHEGVIDSNTTATSA;DHEGVIDSNTTATSAP;HEGVIDSNTTATSAPP;EGVIDSNTTATSAPPR;GVIDSNTTATSAPPRT;VIDSNTTATSAPPRTK;IDSNTTATSAPPRTKI;DSNTTATSAPPRTKIT;SNTTATSAPPRTKITV;NTTATSAPPRTKITVP;TTATSAPPRTKITVPA;TATSAPPRTKITVPAR;ATSAPPRTKITVPARW;TSAPPRTKITVPARWV;SAPPRTKITVPARWVV;APPRTKITVPARWVVN;PPRTKITVPARWVVNG;PRTKITVPARWVVNGI;RTKITVPARWVVNGIE;TKITVPARWVVNGIER;KITVPARWVVNGIERS;ITVPARWVVNGIERSG;TVPARWVVNGIERSGE;VPARWVVNGIERSGEV;PARWVVNGIERSGEVN;ARWVVNGIERSGEVNA;RWVVNGIERSGEVNAK;WVVNGIERSGEVNAKP;VVNGIERSGEVNAKPG;VNGIERSGEVNAKPGT;NGIERSGEVNAKPGTK;GIERSGEVNAKPGTKS;IERSGEVNAKPGTKSG;ERSGEVNAKPGTKSGD;RSGEVNAKPGTKSGDR;SGEVNAKPGTKSGDRV;GEVNAKPGTKSGDRVG;EVNAKPGTKSGDRVGI;VNAKPGTKSGDRVGIW;NAKPGTKSGDRVGIWV;AKPGTKSGDRVGIWVD;KPGTKSGDRVGIWVDS;PGTKSGDRVGIWVDSA;GTKSGDRVGIWVDSAG;TKSGDRVGIWVDSAGQ;KSGDRVGIWVDSAGQL;SGDRVGIWVDSAGQLV;GDRVGIWVDSAGQLVD;DRVGIWVDSAGQLVDE;RVGIWVDSAGQLVDEP;VGIWVDSAGQLVDEPA;GIWVDSAGQLVDEPAP;IWVDSAGQLVDEPAPP;WVDSAGQLVDEPAPPA;VDSAGQLVDEPAPPAR;DSAGQLVDEPAPPARA;SAGQLVDEPAPPARAI;AGQLVDEPAPPARAIA;GQLVDEPAPPARAIAD;QLVDEPAPPARAIADA;LVDEPAPPARAIADAA;VDEPAPPARAIADAAL;DEPAPPARAIADAALA;EPAPPARAIADAALAA;PAPPARAIADAALAAL;APPARAIADAALAALG;PPARAIADAALAALGL;PARAIADAALAALGLW;ARAIADAALAALGLWL;RAIADAALAALGLWLS;AIADAALAALGLWLSV;IADAALAALGLWLSVA;ADAALAALGLWLSVAA;DAALAALGLWLSVAAV;AALAALGLWLSVAAVA;ALAALGLWLSVAAVAG;LAALGLWLSVAAVAGA;AALGLWLSVAAVAGAL;ALGLWLSVAAVAGALL;LGLWLSVAAVAGALLA;GLWLSVAAVAGALLAL;LWLSVAAVAGALLALT;WLSVAAVAGALLALTR;LSVAAVAGALLALTRA;SVAAVAGALLALTRAI;VAAVAGALLAL | |

Fig. 30 continued

| | | |
|---|---|---|
| | TRAIL;AAVAGALLALTRAILI;AVAGALLALTRAILIR;VAGALLALTRAILIRV;AGALLALTRAILIRVR;GALLALTRAILIRVRN;ALLALTRAILIRVRNA;LLALTRAILIRVRNAS;LALTRAILIRVRNASW;ALTRAILIRVRNASWQ;LTRAILIRVRNASWQH;TRAILIRVRNASWQHD;RAILIRVRNASWQHDI;AILIRVRNASWQHDID;ILIRVRNASWQHDIDS;LIRVRNASWQHDIDSL;IRVRNASWQHDIDSLF;RVRNASWQHDIDSLFC;VRNASWQHDIDSLFCT;RNASWQHDIDSLFCTQ;NASWQHDIDSLFCTQR | |
| 12 | **<NP_216512.1 hypothetical protein Rv1996;Mycobacterium tuberculosis H37Rv>**<br>MSAQQTNLGIVVGVDGSPCSHTAVEWAARDAQMRNVALRVVQVVPPVITAPEGWAFEYSRFQEAQKREIVEHSYLVAQAHQIVEQAHKVALEASSSGRAAQITGEVLHGQIVPTLANISRQVAMVVLGYRGQGAVAGALLGSVSSSLVRHAHGPVAVIPEEPRPARPPHAPVVVGIDGSPTSGLAAEIAFDEASRRGVDLVALHAWSDMGPLDFPRLNWAPIEWRNLEDEQEKMLARRLSGWQDRYPDVVVHKVVVCDRPAPRLLELAQTAQLVVVGSHGRGGFPGMHLGSVSRAVVNSGQAPVIVARIPQDPAVPA<br><br>8mer<br>MSAQQTNL;AQQTNLGI;QQTNLGIV;QTNLGIVV;NLGIVVGV;SPCSHTAV;CSHTAVEW;HTAVEWAA;TAVEWAAR;WAARDAQM;AARDAQMR;AQMRNVAL;QMRNVALR;VALRVVQV;ALRVVQVV;VVQVVPPV;VQVVPPVI;VVPPVITA;VITAPEGW;TAPEGWAF;WAFEYSRF;SRFQEAQK;RFQEAQKR;REIVEHSY;EIVEHSYL;IVEHSYLV;YLVAQAHQ;LVAQAHQI;VAQAHQIV;HQIVEQAH;QIVEQAHK;IVEQAHKV;EQAHKVAL;AQITGEVL;GEVLHGQI;EVLHGQIV;GQIVPTLA;IVPTLANI;VPTLANIS;TLANISRQ;NISRQVAM;RQVAMVVL;VAMVVLGY;AMVVLGYR;GQGAVAGA;GAVAGALL;ALLGSVSS;LLGSVSSS;SVSSSLVR;HAHGPVAV;AVIPEEPR;IPEEPRPA;RPARPPHA;RPPHAPVV;HAPVVVGI;SPTSGLAA;GLAAEIAF;AEIAFDEA;EIAFDEAS;IAFDEASR;ALHAWSDM;FPRLNWAP;LNWAPIEW;NWAPIEWR;APIEWRNL;LARRLSGW;RLSGWQDR;WQDRYPDV;VVVHKVVV;RPAPRLLE;APRLLELA;RLLELAQT;LLELAQTA;ELAQTAQL;LAQTAQLV;AQTAQLVV;QTAQLVVV;VVVGSHGR;FPGMHLGS;HLGSVSRA;GQAPVIVA;QAPVIVAR;APVIVARI;RIPQDPAV<br>9mer<br>AQQTNLGIV;QQTNLGIVV;TNLGIVVGV;HTAVEWAAR;WAARDAQMR;DAQMRNVAL;AQMRNVALR;QMRNVALRV;NVALRVVQV;VALRVVQVV;RVVQVVPPV;QVVPPVITA;ITAPEGWAF;APEGWAFEY;EGWAFEYSR;GWAFEYSRF;FEYSRFQEA;YSRFQEAQK;AQKREIVEH;REIVEHSYL;EIVEHSYLV;YLVAQAHQI;LVAQAHQIV;QIVEQAHKV;VEQAHKVAL;RAAQITGEV;AAQITGEVL;GEVLHGQIV;VLHGQIVPT;LHGQIVPTL;QIVPTLANI;TLANISRQV;NISRQVAMV;SRQVAMVVL;QVAMVVLGY;VAMVVLGYR;VLGYRGQGA;GQGAVAGAL;VAGALLGSV;ALLGSVSSS;LLGSVSSSL;GSVSSSLVR;SVSSSLVRH;LVRHAHGPV;HAHGPVAVI;VAVIPEEPR;EPRPARPPH;RPARPPHAP;RPPHAPVVV;SPTSGLAAE;AEIAFDEAS;EIAFDEASR;IAFDEASRR;RRGVDLVAL;HAWSDMGPL;WSDMGPLDF;DMGPLDFPR;FPRLNWAPI;RLNWAPIEW;LNWAPIEWR;NLEDEQEKM;LEDEQEKML;DEQEKMLAR;MLARRLSGW;RRLSGWQDR;RLSGWQDRY;WQDRYPDVV;RYPDVVVHK;YPDVVVHKV;DVVVHKVVV;VVCDRPAPR;RPAPRLLEL;APRLLELAQ;RLLELAQTA;LELAQTAQL;ELAQTAQLV;LAQTAQLVV;AQTAQLVVV;LVVVGSHGR;FPGMHLGSV;GMHLGSVSR;HLGSVSRAV;VVNSGQAPV;GQAPVIVAR;QAPVIVARI;IPQDPAVPA<br>10mer<br>MSAQQTNLGI;AQQTNLGIVV;QTNLGIVVGV;DGSPCSHTAV;SPCSHTAVEW;EWAARDAQMR;AARDAQMRNV;RDAQMRNVAL;DAQMRNVALR;AQMR | 131445-133013 |

Fig. 30 continued

NVALRV;QMRNVALRVV;NVALRVVQVV;RVVQVVPPVI;VQVVPPVITA;PPV
ITAPEGW;TAPEGWAFEY;EYSRFQEAQK;YSRFQEAQKR;RFQEAQKREI;F
QEAQKREIV;REIVEHSYLV;EIVEHSYLVA;SYLVAQAHQI;YLVAQAHQIV;A
QAHQIVEQA;HQIVEQAHKV;IVEQAHKVAL;VALEASSSGR;RAAQITGEVL;I
TGEVLHGQI;EVLHGQIVPT;VLHGQIVPTL;GQIVPTLANI;IVPTLANISR;PTL
ANISRQV;TLANISRQVA;LANISRQVAM;NISRQVAMVV;RQVAMVVLGY;QV
AMVVLGYR;VVLGYRGQGA;VLGYRGQGAV;GQGAVAGALL;AVAGALLGS
V;ALLGSVSSSL;LLGSVSSSLV;SVSSSLVRHA;SLVRHAHGPV;LVRHAHGP
VA;EPRPARPPHA;RPARPPHAPV;PPHAPVVVGI;GIDGSPTSGL;SPTSGLA
AEI;TSGLAAEIAF;LAAEIAFDEA;AEIAFDEASR;EIAFDEASRR;AFDEASRR
GV;EASRRGVDLV;LVALHAWSDM;AWSDMGPLDF;DMGPLDFPRL;GPLDF
PRLNW;PLDFPRLNWA;DFPRLNWAPI;RLNWAPIEWR;NLEDEQEKML;KM
LARRLSGW;MLARRLSGWQ;RRLSGWQDRY;SGWQDRYPDV;WQDRYPD
VVV;RYPDVVVHKV;YPDVVVHKVV;VVHKVVVCDR;VVVCDRPAPR;VVCD
RPAPRL;RPAPRLLELA;APRLLELAQT;RLLELAQTAQ;LLELAQTAQL;ELAQ
TAQLVV;QTAQLVVVGS;QLVVVGSHGR;GFPGMHLGSV;FPGMHLGSVS;G
MHLGSVSRA;HLGSVSRAVV;AVVNSGQAPV;GQAPVIVARI;APVIVARIPQ;I
VARIPQDPA;RIPQDPAVPA
11mer
MSAQQTNLGIV;SAQQTNLGIVV;QQTNLGIVVGV;GVDGSPCSHTA;CSHTA
VEWAAR;WAARDAQMRNV;AARDAQMRNVA;ARDAQMRNVAL;AQMRNV
ALRVV;ALRVVQVVPPV;VPPVITAPEGW;PPVITAPEGWA;PVITAPEGWAF;
ITAPEGWAFEY;WAFEYSRFQEA;EYSRFQEAQKR;AQKREIVEHSY;REIVE
HSYLVA;EIVEHSYLVAQ;HSYLVAQAHQI;SYLVAQAHQIV;YLVAQAHQIVE;
AQAHQIVEQAH;QAHQIVEQAHK;QIVEQAHKVAL;KVALEASSSGR;AQITG
EVLHGQ;ITGEVLHGQIV;EVLHGQIVPTL;VLHGQIVPTLA;QIVPTLANISR;V
PTLANISRQV;TLANISRQVAM;LANISRQVAMV;NISRQVAMVVL;SRQVAM
VVLGY;RQVAMVVLGYR;MVVLGYRGQGA;VVLGYRGQGAV;VLGYRGQG
AVA;YRGQGAVAGAL;GAVAGALLGSV;GALLGSVSSSL;ALLGSVSSSLV;LL
GSVSSSLVR;SVSSSLVRHAH;SLVRHAHGPVA;LVRHAHGPVAV;AVIPEEP
RPAR;RPARPPHAPVV;RPPHAPVVVGI;GIDGSPTSGLA;SPTSGLAAEIA;G
LAAEIAFDEA;AEIAFDEASRR;IAFDEASRRGV;RGVDLVALHAW;DLVALHA
WSDM;ALHAWSDMGPL;HAWSDMGPLDF;GPLDFPRLNWA;FPRLNWAPI
EW;NLEDEQEKMLA;DEQEKMLARRL;KMLARRLSGWQ;LARRLSGWQDR;
SGWQDRYPDVV;RYPDVVVHKVV;YPDVVVHKVVV;VVVHKVVVCDR;KVV
VCDRPAPR;VVVCDRPAPRL;VVCDRPAPRLL;RPAPRLLELAQ;APRLLELA
QTA;RLLELAQTAQL;LLELAQTAQLV;LELAQTAQLVV;ELAQTAQLVVV;AQ
LVVVGSHGR;VVVGSHGRGGF;GGFPGMHLGSV;FPGMHLGSVSR;GMHL
GSVSRAV;RAVVNSGQAPV;AVVNSGQAPVI;VVNSGQAPVIV;NSGQAPVIV
AR;VIVARIPQDPA;IVARIPQDPAV 13 mers:
MSAQQTNLGIVVG;SAQQTNLGIVVGV;AQQTNLGIVVGVD;QQTNLGIVVG
VDG;QTNLGIVVGVDGS;TNLGIVVGVDGSP;NLGIVVGVDGSPC;LGIVVGV
DGSPCS;GIVVGVDGSPCSH;IVVGVDGSPCSHT;VVGVDGSPCSHTA;VGV
DGSPCSHTAV;GVDGSPCSHTAVE;VDGSPCSHTAVEW;DGSPCSHTAVE
WA;GSPCSHTAVEWAA;SPCSHTAVEWAAR;PCSHTAVEWAARD;CSHTA
VEWAARDA;SHTAVEWAARDAQ;HTAVEWAARDAQM;TAVEWAARDAQM
R;AVEWAARDAQMRN;VEWAARDAQMRNV;EWAARDAQMRNVA;WAARD
AQMRNVAL;AARDAQMRNVALR;ARDAQMRNVALRV;RDAQMRNVALRVV
;DAQMRNVALRVVQ;AQMRNVALRVVQV;QMRNVALRVVQVV;MRNVALR
VVQVVP;RNVALRVVQVVPP;NVALRVVQVVPPV;VALRVVQVVPPVI;ALRV
VQVVPPVIT;LRVVQVVPPVITA;RVVQVVPPVITAP;VVQVVPPVITAPE;VQV

Fig. 30 continued

| | | |
|---|---|---|
| | VPPVITAPEG;QVVPPVITAPEGW;VVPPVITAPEGWA;VPPVITAPEGWAF;PPVITAPEGWAFE;PVITAPEGWAFEY;VITAPEGWAFEYS;ITAPEGWAFEYSR;TAPEGWAFEYSRF;APEGWAFEYSRFQ;PEGWAFEYSRFQE;EGWAFEYSRFQEA;GWAFEYSRFQEAQ;WAFEYSRFQEAQK;AFEYSRFQEAQKR;FEYSRFQEAQKRE;EYSRFQEAQKREI;YSRFQEAQKREIV;SRFQEAQKREIVE;RFQEAQKREIVEH;FQEAQKREIVEHS;QEAQKREIVEHSY;EAQKREIVEHSYL;AQKREIVEHSYLV;QKREIVEHSYLVA;KREIVEHSYLVAQ;REIVEHSYLVAQA;EIVEHSYLVAQAH;IVEHSYLVAQAHQ;VEHSYLVAQAHQI;EHSYLVAQAHQIV;HSYLVAQAHQIVE;SYLVAQAHQIVEQ;YLVAQAHQIVEQA;LVAQAHQIVEQAH;VAQAHQIVEQAHK;AQAHQIVEQAHKV;QAHQIVEQAHKVA;AHQIVEQAHKVAL;HQIVEQAHKVALE;QIVEQAHKVALEA;IVEQAHKVALEAS;VEQAHKVALEASS;EQAHKVALEASSS;QAHKVALEASSSG;AHKVALEASSSGR;HKVALEASSSGRA;KVALEASSSGRAA;VALEASSSGRAAQ;ALEASSSGRAAQI;LEASSSGRAAQIT;EASSSGRAAQITG;ASSSGRAAQITGE;SSSGRAAQITGEV;SSGRAAQITGEVL;SGRAAQITGEVLH;GRAAQITGEVLHG;RAAQITGEVLHGQ;AAQITGEVLHGQI;AQITGEVLHGQIV;QITGEVLHGQIVP;ITGEVLHGQIVPT;TGEVLHGQIVPTL;GEVLHGQIVPTLA;EVLHGQIVPTLAN;VLHGQIVPTLANI;LHGQIVPTLANIS;HGQIVPTLANISR;GQIVPTLANISRQ;QIVPTLANISRQV;IVPTLANISRQVA;VPTLANISRQVAM;PTLANISRQVAMV;TLANISRQVAMVV;LANISRQVAMVVL;ANISRQVAMVVLG;NISRQVAMVVLGY;ISRQVAMVVLGYR;SRQVAMVVLGYRG;RQVAMVVLGYRGQ;QVAMVVLGYRGQG;VAMVVLGYRGQGA;AMVVLGYRGQGAV;MVVLGYRGQGAVA;VVLGYRGQGAVAG;VLGYRGQGAVAGA;LGYRGQGAVAGAL;GYRGQGAVAGALL;YRGQGAVAGALLG;RGQGAVAGALLGS;GQGAVAGALLGSV;QGAVAGALLGSVS;GAVAGALLGSVSS;AVAGALLGSVSSS;VAGALLGSVSSSL;AGALLGSVSSSLV;GALLGSVSSSLVR;ALLGSVSSSLVRH;LLGSVSSSLVRHA;LGSVSSSLVRHAH;GSVSSSLVRHAHG;SVSSSLVRHAHGP;VSSSLVRHAHGPV;SSSLVRHAHGPVA;SSLVRHAHGPVAV;SLVRHAHGPVAVI;LVRHAHGPVAVIP;VRHAHGPVAVIPE;RHAHGPVAVIPEE;HAHGPVAVIPEEP;AHGPVAVIPEEPR;HGPVAVIPEEPRP;GPVAVIPEEPRPA;PVAVIPEEPRPAR;VAVIPEEPRPARP;AVIPEEPRPARPP;VIPEEPRPARPPH;IPEEPRPARPPHA;PEEPRPARPPHAP;EEPRPARPPHAPV;EPRPARPPHAPVV;PRPARPPHAPVVV;RPARPPHAPVVVG;PARPPHAPVVVGI;ARPPHAPVVVGID;RPPHAPVVVGIDG;PPHAPVVVGIDGS;PHAPVVVGIDGSP;HAPVVVGIDGSPT;APVVVGIDGSPTS;PVVVGIDGSPTSG;VVVGIDGSPTSGL;VVGIDGSPTSGLA;VGIDGSPTSGLAA;GIDGSPTSGLAAE;IDGSPTSGLAAEI;DGSPTSGLAAEIA;GSPTSGLAAEIAF;SPTSGLAAEIAFD;PTSGLAAEIAFDE;TSGLAAEIAFDEA;SGLAAEIAFDEAS;GLAAEIAFDEASR;LAAEIAFDEASRR;AAEIAFDEASRRG;AEIAFDEASRRGV;EIAFDEASRRGVD;IAFDEASRRGVDL;AFDEASRRGVDLV;FDEASRRGVDLVA;DEASRRGVDLVAL;EASRRGVDLVALH;ASRRGVDLVALHA;SRRGVDLVALHAW;RRGVDLVALHAWS;RGVDLVALHAWSD;GVDLVALHAWSDM;VDLVALHAWSDMG;DLVALHAWSDMGP;LVALHAWSDMGPL;VALHAWSDMGPLD;ALHAWSDMGPLDF;LHAWSDMGPLDFP;HAWSDMGPLDFPR;AWSDMGPLDFPRL;WSDMGPLDFPRLN;SDMGPLDFPRLNW;DMGPLDFPRLNWA;MGPLDFPRLNWAP;GPLDFPRLNWAPI;PLDFPRLNWAPIE;LDFPRLNWAPIEW;DFPRLNWAPIEWR;FPRLNWAPIEWRN;PRLNWAPIEWRNL;RLNWAPIEWRNLE;LNWAPIEWRNLED;NWAPIEWRNLEDE;WAPIEWRNLEDEQ;APIEWRNLEDEQE;PIEWRNLEDEQEK;IEWRNLEDEQEKM;EWRNLEDEQEKML;WRNLEDEQEKMLA;RNLEDEQEKMLAR;NLEDEQEKMLARR;LEDEQEKMLARRL;EDEQEKMLARRLS;DEQEKMLARRLSG;EQEKMLARRLSGW;QEKMLARRLSGWQ;EKMLARRLSGWQD;KMLARRLSGWQDR;MLARRLSGWQDRY;LARRLSGWQDRYP;ARRLSGWQDRYPD;RRLSGWQDRYPDV;RLSGWQDRYPDVV;LSGWQDRYPDVV | |

Fig. 30 continued

| | | |
|---|---|---|
| | V;SGWQDRYPDVVVH;GWQDRYPDVVVHK;WQDRYPDVVVHKV;QDRYPDVVVHKVV;DRYPDVVVHKVVV;RYPDVVVHKVVVC;YPDVVVHKVVVCD;PDVVVHKVVVCDR;DVVVHKVVVCDRP;VVVHKVVVCDRPA;VVHKVVVCDRPAP;VHKVVVCDRPAPR;HKVVVCDRPAPRL;KVVVCDRPAPRLL;VVVCDRPAPRLLE;VVCDRPAPRLLEL;VCDRPAPRLLELA;CDRPAPRLLELAQ;DRPAPRLLELAQT;RPAPRLLELAQTA;PAPRLLELAQTAQ;APRLLELAQTAQL;PRLLELAQTAQLV;RLLELAQTAQLVV;LLELAQTAQLVVV;LELAQTAQLVVVG;ELAQTAQLVVVGS;LAQTAQLVVVGSH;AQTAQLVVVGSHG;QTAQLVVVGSHGR;TAQLVVVGSHGRG;AQLVVVGSHGRGG;QLVVVGSHGRGGF;LVVVGSHGRGGFP;VVVGSHGRGGFPG;VVGSHGRGGFPGM;VGSHGRGGFPGMH;GSHGRGGFPGMHL;SHGRGGFPGMHLG;HGRGGFPGMHLGS;GRGGFPGMHLGSV;RGGFPGMHLGSVS;GGFPGMHLGSVSR;GFPGMHLGSVSRA;FPGMHLGSVSRAV;PGMHLGSVSRAVV;GMHLGSVSRAVVN;MHLGSVSRAVVNS;HLGSVSRAVVNSG;LGSVSRAVVNSGQ;GSVSRAVVNSGQA;SVSRAVVNSGQAP;VSRAVVNSGQAPV;SRAVVNSGQAPVI;RAVVNSGQAPVIV;AVVNSGQAPVIVA;VVNSGQAPVIVAR;VNSGQAPVIVARI;NSGQAPVIVARIP;SGQAPVIVARIPQ;GQAPVIVARIPQD;QAPVIVARIPQDP;APVIVARIPQDPA;PVIVARIPQDPAV;VIVARIPQDPAVP;IVARIPQDPAVPA;<br>14 mers:<br>MSAQQTNLGIVVGV;SAQQTNLGIVVGVD;AQQTNLGIVVGVDG;QQTNLGIVVGVDGS;QTNLGIVVGVDGSP;TNLGIVVGVDGSPC;NLGIVVGVDGSPCS;LGIVVGVDGSPCSH;GIVVGVDGSPCSHT;IVVGVDGSPCSHTA;VVGVDGSPCSHTAV;VGVDGSPCSHTAVE;GVDGSPCSHTAVEW;VDGSPCSHTAVEWA;DGSPCSHTAVEWAA;GSPCSHTAVEWAAR;SPCSHTAVEWAARD;PCSHTAVEWAARDA;CSHTAVEWAARDAQ;SHTAVEWAARDAQM;HTAVEWAARDAQMR;TAVEWAARDAQMRN;AVEWAARDAQMRNV;VEWAARDAQMRNVA;EWAARDAQMRNVAL;WAARDAQMRNVALR;AARDAQMRNVALRV;ARDAQMRNVALRVV;RDAQMRNVALRVVQ;DAQMRNVALRVVQV;AQMRNVALRVVQVV;QMRNVALRVVQVVP;MRNVALRVVQVVPP;RNVALRVVQVVPPV;NVALRVVQVVPPVI;VALRVVQVVPPVIT;ALRVVQVVPPVITA;LRVVQVVPPVITAP;RVVQVVPPVITAPE;VVQVVPPVITAPEG;VQVVPPVITAPEGW;QVVPPVITAPEGWA;VVPPVITAPEGWAF;VPPVITAPEGWAFE;PPVITAPEGWAFEY;PVITAPEGWAFEYS;VITAPEGWAFEYSR;ITAPEGWAFEYSRF;TAPEGWAFEYSRFQ;APEGWAFEYSRFQE;PEGWAFEYSRFQEA;EGWAFEYSRFQEAQ;GWAFEYSRFQEAQK;WAFEYSRFQEAQKR;AFEYSRFQEAQKRE;FEYSRFQEAQKREI;EYSRFQEAQKREIV;YSRFQEAQKREIVE;SRFQEAQKREIVEH;RFQEAQKREIVEHS;FQEAQKREIVEHSY;QEAQKREIVEHSYL;EAQKREIVEHSYLV;AQKREIVEHSYLVA;QKREIVEHSYLVAQ;KREIVEHSYLVAQA;REIVEHSYLVAQAH;EIVEHSYLVAQAHQ;IVEHSYLVAQAHQI;VEHSYLVAQAHQIV;EHSYLVAQAHQIVE;HSYLVAQAHQIVEQ;SYLVAQAHQIVEQA;YLVAQAHQIVEQAH;LVAQAHQIVEQAHK;VAQAHQIVEQAHKV;AQAHQIVEQAHKVA;QAHQIVEQAHKVAL;AHQIVEQAHKVALE;HQIVEQAHKVALEA;QIVEQAHKVALEAS;IVEQAHKVALEASS;VEQAHKVALEASSS;EQAHKVALEASSSG;QAHKVALEASSSGR;AHKVALEASSSGRA;HKVALEASSSGRAA;KVALEASSSGRAAQ;VALEASSSGRAAQI;ALEASSSGRAAQIT;LEASSSGRAAQITG;EASSSGRAAQITGE;ASSSGRAAQITGEV;SSSGRAAQITGEVL;SSGRAAQITGEVLH;SGRAAQITGEVLHG;GRAAQITGEVLHGQ;RAAQITGEVLHGQI;AAQITGEVLHGQIV;AQITGEVLHGQIVP;QITGEVLHGQIVPT;ITGEVLHGQIVPTL;TGEVLHGQIVPTLA;GEVLHGQIVPTLAN;EVLHGQIVPTLANI;VLHGQIVPTLANIS;LHGQIVPTLANISR;HGQIVPTLANISRQ;GQIVPTLANISRQV;QIVPTLANISRQVA;IVPTLANISRQVAM;VPTLANISRQVAMV;PTLANISRQVAMVV;TLANISRQVAMVVL;LANISRQVAMVVLG;ANISRQVAMVVLGY;NISRQVAMVVLGYR;ISRQVAMVVLGYRG;SRQVAMVVLGYRGQ | |

Fig. 30 continued

| | | |
|---|---|---|
| | ;RQVAMVVLGYRGQG;QVAMVVLGYRGQGA;VAMVVLGYRGQGAV;AMVVLGYRGQGAVA;MVVLGYRGQGAVAG;VVLGYRGQGAVAGA;VLGYRGQGAVAGAL;LGYRGQGAVAGALL;GYRGQGAVAGALLG;YRGQGAVAGALLGS;RGQGAVAGALLGSV;GQGAVAGALLGSVS;QGAVAGALLGSVSS;GAVAGALLGSVSSS;AVAGALLGSVSSSL;VAGALLGSVSSSLV;AGALLGSVSSSLVR;GALLGSVSSSLVRH;ALLGSVSSSLVRHA;LLGSVSSSLVRHAH;LGSVSSSLVRHAHG;GSVSSSLVRHAHGP;SVSSSLVRHAHGPV;VSSSLVRHAHGPVA;SSSLVRHAHGPVAV;SSLVRHAHGPVAVI;SLVRHAHGPVAVIP;LVRHAHGPVAVIPE;VRHAHGPVAVIPEE;RHAHGPVAVIPEEP;HAHGPVAVIPEEPR;AHGPVAVIPEEPRP;HGPVAVIPEEPRPA;GPVAVIPEEPRPAR;PVAVIPEEPRPARP;VAVIPEEPRPARPP;AVIPEEPRPARPPH;VIPEEPRPARPPHA;IPEEPRPARPPHAP;PEEPRPARPPHAPV;EEPRPARPPHAPVV;EPRPARPPHAPVVV;PRPARPPHAPVVVG;RPARPPHAPVVVGI;PARPPHAPVVVGID;ARPPHAPVVVGIDG;RPPHAPVVVGIDGS;PPHAPVVVGIDGSP;PHAPVVVGIDGSPT;HAPVVVGIDGSPTS;APVVVGIDGSPTSG;PVVVGIDGSPTSGL;VVVGIDGSPTSGLA;VVGIDGSPTSGLAA;VGIDGSPTSGLAAE;GIDGSPTSGLAAEI;IDGSPTSGLAAEIA;DGSPTSGLAAEIAF;GSPTSGLAAEIAFD;SPTSGLAAEIAFDE;PTSGLAAEIAFDEA;TSGLAAEIAFDEAS;SGLAAEIAFDEASR;GLAAEIAFDEASRR;LAAEIAFDEASRRG;AAEIAFDEASRRGV;AEIAFDEASRRGVD;EIAFDEASRRGVDL;IAFDEASRRGVDLV;AFDEASRRGVDLVA;FDEASRRGVDLVAL;DEASRRGVDLVALH;EASRRGVDLVALHA;ASRRGVDLVALHAW;SRRGVDLVALHAWS;RRGVDLVALHAWSD;RGVDLVALHAWSDM;GVDLVALHAWSDMG;VDLVALHAWSDMGP;DLVALHAWSDMGPL;LVALHAWSDMGPLD;VALHAWSDMGPLDF;ALHAWSDMGPLDFP;LHAWSDMGPLDFPR;HAWSDMGPLDFPRL;AWSDMGPLDFPRLN;WSDMGPLDFPRLNW;SDMGPLDFPRLNWA;DMGPLDFPRLNWAP;MGPLDFPRLNWAPI;GPLDFPRLNWAPIE;PLDFPRLNWAPIEW;LDFPRLNWAPIEWR;DFPRLNWAPIEWRN;FPRLNWAPIEWRNL;PRLNWAPIEWRNLE;RLNWAPIEWRNLED;LNWAPIEWRNLEDE;NWAPIEWRNLEDEQ;WAPIEWRNLEDEQE;APIEWRNLEDEQEK;PIEWRNLEDEQEKM;IEWRNLEDEQEKML;EWRNLEDEQEKMLA;WRNLEDEQEKMLAR;RNLEDEQEKMLARR;NLEDEQEKMLARRL;LEDEQEKMLARRLS;EDEQEKMLARRLSG;DEQEKMLARRLSGW;EQEKMLARRLSGWQ;QEKMLARRLSGWQD;EKMLARRLSGWQDR;KMLARRLSGWQDRY;MLARRLSGWQDRYP;LARRLSGWQDRYPD;ARRLSGWQDRYPDV;RRLSGWQDRYPDVV;RLSGWQDRYPDVVV;LSGWQDRYPDVVVH;SGWQDRYPDVVVHK;GWQDRYPDVVVHKV;WQDRYPDVVVHKVV;QDRYPDVVVHKVVV;DRYPDVVVHKVVVC;RYPDVVVHKVVVCD;YPDVVVHKVVVCDR;PDVVVHKVVVCDRP;DVVVHKVVVCDRPA;VVVHKVVVCDRPAP;VVHKVVVCDRPAPR;VHKVVVCDRPAPRL;HKVVVCDRPAPRLL;KVVVCDRPAPRLLE;VVVCDRPAPRLLEL;VVCDRPAPRLLELA;VCDRPAPRLLELAQ;CDRPAPRLLELAQT;DRPAPRLLELAQTA;RPAPRLLELAQTAQ;PAPRLLELAQTAQL;APRLLELAQTAQLV;PRLLELAQTAQLVV;RLLELAQTAQLVVV;LLELAQTAQLVVVG;LELAQTAQLVVVGS;ELAQTAQLVVVGSH;LAQTAQLVVVGSHG;AQTAQLVVVGSHGR;QTAQLVVVGSHGRG;TAQLVVVGSHGRGG;AQLVVVGSHGRGGF;QLVVVGSHGRGGFP;LVVVGSHGRGGFPG;VVVGSHGRGGFPGM;VVGSHGRGGFPGMH;VGSHGRGGFPGMHL;GSHGRGGFPGMHLG;SHGRGGFPGMHLGS;HGRGGFPGMHLGSV;GRGGFPGMHLGSVS;RGGFPGMHLGSVSR;GGFPGMHLGSVSRA;GFPGMHLGSVSRAV;FPGMHLGSVSRAVV;PGMHLGSVSRAVVN;GMHLGSVSRAVVNS;MHLGSVSRAVVNSG;HLGSVSRAVVNSGQ;LGSVSRAVVNSGQA;GSVSRAVVNSGQAP;SVSRAVVNSGQAPV;VSRAVVNSGQAPVI;SRAVVNSGQAPVIV;RAVVNSGQAPVIVA;AVVNSGQAPVIVAR;VVNSGQAPVIVARI;VNSGQAPVIVARIP;NSGQAPVIVARIPQ;SGQAPVIVARIPQD;GQAPVIVARIPQDP;QAPVIVARIPQDPA;APVIV | |

Fig. 30 continued

| | | |
|---|---|---|
| | ARIPQDPAV;PVIVARIPQDPAVP;VIVARIPQDPAVPA;<br>15 mers:<br>MSAQQTNLGIVVGVD;SAQQTNLGIVVGVDG;AQQTNLGIVVGVDGS;QQTNLGIVVGVDGSP;QTNLGIVVGVDGSPC;TNLGIVVGVDGSPCS;NLGIVVGVDGSPCSH;LGIVVGVDGSPCSHT;GIVVGVDGSPCSHTA;IVVGVDGSPCSHTAV;VVGVDGSPCSHTAVE;VGVDGSPCSHTAVEW;GVDGSPCSHTAVEWA;VDGSPCSHTAVEWAA;DGSPCSHTAVEWAAR;GSPCSHTAVEWAARD;SPCSHTAVEWAARDA;PCSHTAVEWAARDAQ;CSHTAVEWAARDAQM;SHTAVEWAARDAQMR;HTAVEWAARDAQMRN;TAVEWAARDAQMRNV;AVEWAARDAQMRNVA;VEWAARDAQMRNVAL;EWAARDAQMRNVALR;WAARDAQMRNVALRV;AARDAQMRNVALRVV;ARDAQMRNVALRVVQ;RDAQMRNVALRVVQV;DAQMRNVALRVVQVV;AQMRNVALRVVQVVP;QMRNVALRVVQVVPP;MRNVALRVVQVVPPV;RNVALRVVQVVPPVI;NVALRVVQVVPPVIT;VALRVVQVVPPVITA;ALRVVQVVPPVITAP;LRVVQVVPPVITAPE;RVVQVVPPVITAPEG;VVQVVPPVITAPEGW;VQVVPPVITAPEGWA;QVVPPVITAPEGWAF;VVPPVITAPEGWAFE;VPPVITAPEGWAFEY;PPVITAPEGWAFEYS;PVITAPEGWAFEYSR;VITAPEGWAFEYSRF;ITAPEGWAFEYSRFQ;TAPEGWAFEYSRFQE;APEGWAFEYSRFQEA;PEGWAFEYSRFQEAQ;EGWAFEYSRFQEAQK;GWAFEYSRFQEAQKR;WAFEYSRFQEAQKRE;AFEYSRFQEAQKREI;FEYSRFQEAQKREIV;EYSRFQEAQKREIVE;YSRFQEAQKREIVEH;SRFQEAQKREIVEHS;RFQEAQKREIVEHSY;FQEAQKREIVEHSYL;QEAQKREIVEHSYLV;EAQKREIVEHSYLVA;AQKREIVEHSYLVAQ;QKREIVEHSYLVAQA;KREIVEHSYLVAQAH;REIVEHSYLVAQAHQ;EIVEHSYLVAQAHQI;IVEHSYLVAQAHQIV;VEHSYLVAQAHQIVE;EHSYLVAQAHQIVEQ;HSYLVAQAHQIVEQA;SYLVAQAHQIVEQAH;YLVAQAHQIVEQAHK;LVAQAHQIVEQAHKV;VAQAHQIVEQAHKVA;AQAHQIVEQAHKVAL;QAHQIVEQAHKVALE;AHQIVEQAHKVALEA;HQIVEQAHKVALEAS;QIVEQAHKVALEASS;IVEQAHKVALEASSS;VEQAHKVALEASSSG;EQAHKVALEASSSGR;QAHKVALEASSSGRA;AHKVALEASSSGRAA;HKVALEASSSGRAAQ;KVALEASSSGRAAQI;VALEASSSGRAAQIT;ALEASSSGRAAQITG;LEASSSGRAAQITGE;EASSSGRAAQITGEV;ASSSGRAAQITGEVL;SSSGRAAQITGEVLH;SSGRAAQITGEVLHG;SGRAAQITGEVLHGQ;GRAAQITGEVLHGQI;RAAQITGEVLHGQIV;AAQITGEVLHGQIVP;AQITGEVLHGQIVPT;QITGEVLHGQIVPTL;ITGEVLHGQIVPTLA;TGEVLHGQIVPTLAN;GEVLHGQIVPTLANI;EVLHGQIVPTLANIS;VLHGQIVPTLANISR;LHGQIVPTLANISRQ;HGQIVPTLANISRQV;GQIVPTLANISRQVA;QIVPTLANISRQVAM;IVPTLANISRQVAMV;VPTLANISRQVAMVV;PTLANISRQVAMVVL;TLANISRQVAMVVLG;LANISRQVAMVVLGY;ANISRQVAMVVLGYR;NISRQVAMVVLGYRG;ISRQVAMVVLGYRGQ;SRQVAMVVLGYRGQG;RQVAMVVLGYRGQGA;QVAMVVLGYRGQGAV;VAMVVLGYRGQGAVA;AMVVLGYRGQGAVAG;MVVLGYRGQGAVAGA;VVLGYRGQGAVAGAL;VLGYRGQGAVAGALL;LGYRGQGAVAGALLG;GYRGQGAVAGALLGS;YRGQGAVAGALLGSV;RGQGAVAGALLGSVS;GQGAVAGALLGSVSS;QGAVAGALLGSVSSS;GAVAGALLGSVSSSL;AVAGALLGSVSSSLV;VAGALLGSVSSSLVR;AGALLGSVSSSLVRH;GALLGSVSSSLVRHA;ALLGSVSSSLVRHAH;LLGSVSSSLVRHAHG;LGSVSSSLVRHAHGP;GSVSSSLVRHAHGPV;SVSSSLVRHAHGPVA;VSSSLVRHAHGPVAV;SSSLVRHAHGPVAVI;SSLVRHAHGPVAVIP;SLVRHAHGPVAVIPE;LVRHAHGPVAVIPEE;VRHAHGPVAVIPEEP;RHAHGPVAVIPEEPR;HAHGPVAVIPEEPRP;AHGPVAVIPEEPRPA;HGPVAVIPEEPRPAR;GPVAVIPEEPRPARP;PVAVIPEEPRPARPP;VAVIPEEPRPARPPH;AVIPEEPRPARPPHA;VIPEEPRPARPPHAP;IPEEPRPARPPHAPV;PEEPRPARPPHAPVV;EEPRPARPPHAPVVV;EPRPARPPHAPVVVG;PRPARPPHAPVVVGI;RPARPPHAPVVVGID;PARPPHAPVVVGIDG;ARPPHAPVVVGIDGS;RPPHAPVVVGIDGSP;PPHAPVVV | |

Fig. 30 continued

| | | |
|---|---|---|
| | GIDGSPT;PHAPVVVGIDGSPTS;HAPVVVGIDGSPTSG;APVVVGIDGSPTSGL;PVVVGIDGSPTSGLA;VVVGIDGSPTSGLAA;VVGIDGSPTSGLAAE;VGIDGSPTSGLAAEI;GIDGSPTSGLAAEIA;IDGSPTSGLAAEIAF;DGSPTSGLAAEIAFD;GSPTSGLAAEIAFDE;SPTSGLAAEIAFDEA;PTSGLAAEIAFDEAS;TSGLAAEIAFDEASR;SGLAAEIAFDEASRR;GLAAEIAFDEASRRG;LAAEIAFDEASRRGV;AAEIAFDEASRRGVD;AEIAFDEASRRGVDL;EIAFDEASRRGVDLV;IAFDEASRRGVDLVA;AFDEASRRGVDLVAL;FDEASRRGVDLVALH;DEASRRGVDLVALHA;EASRRGVDLVALHAW;ASRRGVDLVALHAWS;SRRGVDLVALHAWSD;RRGVDLVALHAWSDM;RGVDLVALHAWSDMG;GVDLVALHAWSDMGP;VDLVALHAWSDMGPL;DLVALHAWSDMGPLD;LVALHAWSDMGPLDF;VALHAWSDMGPLDFP;ALHAWSDMGPLDFPR;LHAWSDMGPLDFPRL;HAWSDMGPLDFPRLN;AWSDMGPLDFPRLNW;WSDMGPLDFPRLNWA;SDMGPLDFPRLNWAP;DMGPLDFPRLNWAPI;MGPLDFPRLNWAPIE;GPLDFPRLNWAPIEW;PLDFPRLNWAPIEWR;LDFPRLNWAPIEWRN;DFPRLNWAPIEWRNL;FPRLNWAPIEWRNLE;PRLNWAPIEWRNLED;RLNWAPIEWRNLEDE;LNWAPIEWRNLEDEQ;NWAPIEWRNLEDEQE;WAPIEWRNLEDEQEK;APIEWRNLEDEQEKM;PIEWRNLEDEQEKML;IEWRNLEDEQEKMLA;EWRNLEDEQEKMLAR;WRNLEDEQEKMLARR;RNLEDEQEKMLARRL;NLEDEQEKMLARRLS;LEDEQEKMLARRLSG;EDEQEKMLARRLSGW;DEQEKMLARRLSGWQ;EQEKMLARRLSGWQD;QEKMLARRLSGWQDR;EKMLARRLSGWQDRY;KMLARRLSGWQDRYP;MLARRLSGWQDRYPD;LARRLSGWQDRYPDV;ARRLSGWQDRYPDVV;RRLSGWQDRYPDVVV;RLSGWQDRYPDVVVH;LSGWQDRYPDVVVHK;SGWQDRYPDVVVHKV;GWQDRYPDVVVHKVV;WQDRYPDVVVHKVVV;QDRYPDVVVHKVVVC;DRYPDVVVHKVVVCD;RYPDVVVHKVVVCDR;YPDVVVHKVVVCDRP;PDVVVHKVVVCDRPA;DVVVHKVVVCDRPAP;VVVHKVVVCDRPAPR;VVHKVVVCDRPAPRL;VHKVVVCDRPAPRLL;HKVVVCDRPAPRLLE;KVVVCDRPAPRLLEL;VVVCDRPAPRLLELA;VVCDRPAPRLLELAQ;VCDRPAPRLLELAQT;CDRPAPRLLELAQTA;DRPAPRLLELAQTAQ;RPAPRLLELAQTAQL;PAPRLLELAQTAQLV;APRLLELAQTAQLVV;PRLLELAQTAQLVVV;RLLELAQTAQLVVVG;LLELAQTAQLVVVGS;LELAQTAQLVVVGSH;ELAQTAQLVVVGSHG;LAQTAQLVVVGSHGR;AQTAQLVVVGSHGRG;QTAQLVVVGSHGRGG;TAQLVVVGSHGRGGF;AQLVVVGSHGRGGFP;QLVVVGSHGRGGFPG;LVVVGSHGRGGFPGM;VVVGSHGRGGFPGMH;VVGSHGRGGFPGMHL;VGSHGRGGFPGMHLG;GSHGRGGFPGMHLGS;SHGRGGFPGMHLGSV;HGRGGFPGMHLGSVS;GRGGFPGMHLGSVSR;RGGFPGMHLGSVSRA;GGFPGMHLGSVSRAV;GFPGMHLGSVSRAVV;FPGMHLGSVSRAVVN;PGMHLGSVSRAVVNS;GMHLGSVSRAVVNSG;MHLGSVSRAVVNSGQ;HLGSVSRAVVNSGQA;LGSVSRAVVNSGQAP;GSVSRAVVNSGQAPV;SVSRAVVNSGQAPVI;VSRAVVNSGQAPVIV;SRAVVNSGQAPVIVA;RAVVNSGQAPVIVAR;AVVNSGQAPVIVARI;VVNSGQAPVIVARIP;VNSGQAPVIVARIPQ;NSGQAPVIVARIPQD;SGQAPVIVARIPQDP;GQAPVIVARIPQDPA;QAPVIVARIPQDPAV;APVIVARIPQDPAVP;PVIVARIPQDPAVPA;<br>16 mers:<br>MSAQQTNLGIVVGVDG;SAQQTNLGIVVGVDGS;AQQTNLGIVVGVDGSP;QQTNLGIVVGVDGSPC;QTNLGIVVGVDGSPCS;TNLGIVVGVDGSPCSH;NLGIVVGVDGSPCSHT;LGIVVGVDGSPCSHTA;GIVVGVDGSPCSHTAV;IVVGVDGSPCSHTAVE;VVGVDGSPCSHTAVEW;VGVDGSPCSHTAVEWA;GVDGSPCSHTAVEWAA;VDGSPCSHTAVEWAAR;DGSPCSHTAVEWAARD;GSPCSHTAVEWAARDA;SPCSHTAVEWAARDAQ;PCSHTAVEWAARDAQM;CSHTAVEWAARDAQMR;SHTAVEWAARDAQMRN;HTAVEWAARDAQMRNV;TAVEWAARDAQMRNVA;AVEWAARDAQMRNVAL;VEWAARDAQMRNVALR;EWAARDAQMRNVALRV;WAARDAQMRNVALRVV;AARDAQMRNV | |

Fig. 30 continued

| | | |
|---|---|---|
| | ALRVVQ;ARDAQMRNVALRVVQV;RDAQMRNVALRVVQVV;DAQMRNVALRVVQVVP;AQMRNVALRVVQVVPP;QMRNVALRVVQVVPPV;MRNVALRVVQVVPPVI;RNVALRVVQVVPPVIT;NVALRVVQVVPPVITA;VALRVVQVVPPVITAP;ALRVVQVVPPVITAPE;LRVVQVVPPVITAPEG;RVVQVVPPVITAPEGW;VVQVVPPVITAPEGWA;VQVVPPVITAPEGWAF;QVVPPVITAPEGWAFE;VVPPVITAPEGWAFEY;VPPVITAPEGWAFEYS;PPVITAPEGWAFEYSR;PVITAPEGWAFEYSRF;VITAPEGWAFEYSRFQ;ITAPEGWAFEYSRFQE;TAPEGWAFEYSRFQEA;APEGWAFEYSRFQEAQ;PEGWAFEYSRFQEAQK;EGWAFEYSRFQEAQKR;GWAFEYSRFQEAQKRE;WAFEYSRFQEAQKREI;AFEYSRFQEAQKREIV;FEYSRFQEAQKREIVE;EYSRFQEAQKREIVEH;YSRFQEAQKREIVEHS;SRFQEAQKREIVEHSY;RFQEAQKREIVEHSYL;FQEAQKREIVEHSYLV;QEAQKREIVEHSYLVA;EAQKREIVEHSYLVAQ;AQKREIVEHSYLVAQA;QKREIVEHSYLVAQAH;KREIVEHSYLVAQAHQ;REIVEHSYLVAQAHQI;EIVEHSYLVAQAHQIV;IVEHSYLVAQAHQIVE;VEHSYLVAQAHQIVEQ;EHSYLVAQAHQIVEQA;HSYLVAQAHQIVEQAH;SYLVAQAHQIVEQAHK;YLVAQAHQIVEQAHKV;LVAQAHQIVEQAHKVA;VAQAHQIVEQAHKVAL;AQAHQIVEQAHKVALE;QAHQIVEQAHKVALEA;AHQIVEQAHKVALEAS;HQIVEQAHKVALEASS;QIVEQAHKVALEASSS;IVEQAHKVALEASSSG;VEQAHKVALEASSSGR;EQAHKVALEASSSGRA;QAHKVALEASSSGRAA;AHKVALEASSSGRAAQ;HKVALEASSSGRAAQI;KVALEASSSGRAAQIT;VALEASSSGRAAQITG;ALEASSSGRAAQITGE;LEASSSGRAAQITGEV;EASSSGRAAQITGEVL;ASSSGRAAQITGEVLH;SSSGRAAQITGEVLHG;SSGRAAQITGEVLHGQ;SGRAAQITGEVLHGQI;GRAAQITGEVLHGQIV;RAAQITGEVLHGQIVP;AAQITGEVLHGQIVPT;AQITGEVLHGQIVPTL;QITGEVLHGQIVPTLA;ITGEVLHGQIVPTLAN;TGEVLHGQIVPTLANI;GEVLHGQIVPTLANIS;EVLHGQIVPTLANISR;VLHGQIVPTLANISRQ;LHGQIVPTLANISRQV;HGQIVPTLANISRQVA;GQIVPTLANISRQVAM;QIVPTLANISRQVAMV;IVPTLANISRQVAMVV;VPTLANISRQVAMVVL;PTLANISRQVAMVVLG;TLANISRQVAMVVLGY;LANISRQVAMVVLGYR;ANISRQVAMVVLGYRG;NISRQVAMVVLGYRGQ;ISRQVAMVVLGYRGQG;SRQVAMVVLGYRGQGA;RQVAMVVLGYRGQGAV;QVAMVVLGYRGQGAVA;VAMVVLGYRGQGAVAG;AMVVLGYRGQGAVAGA;MVVLGYRGQGAVAGAL;VVLGYRGQGAVAGALL;VLGYRGQGAVAGALLG;LGYRGQGAVAGALLGS;GYRGQGAVAGALLGSV;YRGQGAVAGALLGSVS;RGQGAVAGALLGSVSS;GQGAVAGALLGSVSSS;QGAVAGALLGSVSSSL;GAVAGALLGSVSSSLV;AVAGALLGSVSSSLVR;VAGALLGSVSSSLVRH;AGALLGSVSSSLVRHA;GALLGSVSSSLVRHAH;ALLGSVSSSLVRHAHG;LLGSVSSSLVRHAHGP;LGSVSSSLVRHAHGPV;GSVSSSLVRHAHGPVA;SVSSSLVRHAHGPVAV;VSSSLVRHAHGPVAVI;SSSLVRHAHGPVAVIP;SSLVRHAHGPVAVIPE;SLVRHAHGPVAVIPEE;LVRHAHGPVAVIPEEP;VRHAHGPVAVIPEEPR;RHAHGPVAVIPEEPRP;HAHGPVAVIPEEPRPA;AHGPVAVIPEEPRPAR;HGPVAVIPEEPRPARP;GPVAVIPEEPRPARPP;PVAVIPEEPRPARPPH;VAVIPEEPRPARPPHA;AVIPEEPRPARPPHAP;VIPEEPRPARPPHAPV;IPEEPRPARPPHAPVV;PEEPRPARPPHAPVVV;EEPRPARPPHAPVVVG;EPRPARPPHAPVVVGI;PRPARPPHAPVVVGID;RPARPPHAPVVVGIDG;PARPPHAPVVVGIDGS;ARPPHAPVVVGIDGSP;RPPHAPVVVGIDGSPT;PPHAPVVVGIDGSPTS;PHAPVVVGIDGSPTSG;HAPVVVGIDGSPTSGL;APVVVGIDGSPTSGLA;PVVVGIDGSPTSGLAA;VVVGIDGSPTSGLAAE;VVGIDGSPTSGLAAEI;VGIDGSPTSGLAAEIA;GIDGSPTSGLAAEIAF;IDGSPTSGLAAEIAFD;DGSPTSGLAAEIAFDE;GSPTSGLAAEIAFDEA;SPTSGLAAEIAFDEAS;PTSGLAAEIAFDEASR;TSGLAAEIAFDEASRR;SGLAAEIAFDEASRRG;GLAAEIAFDEASRRGV;LAAEIAFDEASRRGVD;AAEIAFDEASRRGVDL;AEIAFDEASRRGVDLV;EIAFDEASRRGVDLVA;IAFDEASRRGVDLVAL;AFDEASRRGVDLVALH;FDEASRRGVDLVALHA;DEASRRGVDLVA | |

Fig. 30 continued

| | | |
|---|---|---|
| | LHAW;EASRRGVDLVALHAWS;ASRRGVDLVALHAWSD;SRRGVDLVALHAWSDM;RRGVDLVALHAWSDMG;RGVDLVALHAWSDMGP;GVDLVALHAWSDMGPL;VDLVALHAWSDMGPLD;DLVALHAWSDMGPLDF;LVALHAWSDMGPLDFP;VALHAWSDMGPLDFPR;ALHAWSDMGPLDFPRL;LHAWSDMGPLDFPRLN;HAWSDMGPLDFPRLNW;AWSDMGPLDFPRLNWA;WSDMGPLDFPRLNWAP;SDMGPLDFPRLNWAPI;DMGPLDFPRLNWAPIE;MGPLDFPRLNWAPIEW;GPLDFPRLNWAPIEWR;PLDFPRLNWAPIEWRN;LDFPRLNWAPIEWRNL;DFPRLNWAPIEWRNLE;FPRLNWAPIEWRNLED;PRLNWAPIEWRNLEDE;RLNWAPIEWRNLEDEQ;LNWAPIEWRNLEDEQE;NWAPIEWRNLEDEQEK;WAPIEWRNLEDEQEKM;APIEWRNLEDEQEKML;PIEWRNLEDEQEKMLA;IEWRNLEDEQEKMLAR;EWRNLEDEQEKMLARR;WRNLEDEQEKMLARRL;RNLEDEQEKMLARRLS;NLEDEQEKMLARRLSG;LEDEQEKMLARRLSGW;EDEQEKMLARRLSGWQ;DEQEKMLARRLSGWQD;EQEKMLARRLSGWQDR;QEKMLARRLSGWQDRY;EKMLARRLSGWQDRYP;KMLARRLSGWQDRYPD;MLARRLSGWQDRYPDV;LARRLSGWQDRYPDVV;ARRLSGWQDRYPDVVV;RRLSGWQDRYPDVVVH;RLSGWQDRYPDVVVHK;LSGWQDRYPDVVVHKV;SGWQDRYPDVVVHKVV;GWQDRYPDVVVHKVVV;WQDRYPDVVVHKVVVC;QDRYPDVVVHKVVVCD;DRYPDVVVHKVVVCDR;RYPDVVVHKVVVCDRP;YPDVVVHKVVVCDRPA;PDVVVHKVVVCDRPAP;DVVVHKVVVCDRPAPR;VVVHKVVVCDRPAPRL;VVHKVVVCDRPAPRLL;VHKVVVCDRPAPRLLE;HKVVVCDRPAPRLLEL;KVVVCDRPAPRLLELA;VVVCDRPAPRLLELAQ;VVCDRPAPRLLELAQT;VCDRPAPRLLELAQTA;CDRPAPRLLELAQTAQ;DRPAPRLLELAQTAQL;RPAPRLLELAQTAQLV;PAPRLLELAQTAQLVV;APRLLELAQTAQLVVV;PRLLELAQTAQLVVVG;RLLELAQTAQLVVVGS;LLELAQTAQLVVVGSH;LELAQTAQLVVVGSHG;ELAQTAQLVVVGSHGR;LAQTAQLVVVGSHGRG;AQTAQLVVVGSHGRGG;QTAQLVVVGSHGRGGF;TAQLVVVGSHGRGGFP;AQLVVVGSHGRGGFPG;QLVVVGSHGRGGFPGM;LVVVGSHGRGGFPGMH;VVVGSHGRGGFPGMHL;VVGSHGRGGFPGMHLG;VGSHGRGGFPGMHLGS;GSHGRGGFPGMHLGSV;SHGRGGFPGMHLGSVS;HGRGGFPGMHLGSVSR;GRGGFPGMHLGSVSRA;RGGFPGMHLGSVSRAV;GGFPGMHLGSVSRAVV;GFPGMHLGSVSRAVVN;FPGMHLGSVSRAVVNS;PGMHLGSVSRAVVNSG;GMHLGSVSRAVVNSGQ;MHLGSVSRAVVNSGQA;HLGSVSRAVVNSGQAP;LGSVSRAVVNSGQAPV;GSVSRAVVNSGQAPVI;SVSRAVVNSGQAPVIV;VSRAVVNSGQAPVIVA;SRAVVNSGQAPVIVAR;RAVVNSGQAPVIVARI;AVVNSGQAPVIVARIP;VVNSGQAPVIVARIPQ;VNSGQAPVIVARIPQD;NSGQAPVIVARIPQDP;SGQAPVIVARIPQDPA;GQAPVIVARIPQDPAV;QAPVIVARIPQDPAVP;APVIVARIPQDPAVPA | |
| 13 | **<NP_216905.1 resuscitation-promoting factor RpfD Rv2389c;Mycobacterium tuberculosis H37Rv>**<br>MTPGLLTTAGAGRPRDRCARIVCTVFIETAVVATMFVALLGLSTISSKADDIDWDAIAQCESGGNWAANTGNGLYGGLQISQATWDSNGGVGSPAAASPQQQIEVADNIMKTQGPGAWPKCSSCSQGDAPLGSLTHILTFLAAETGGCSGSRDD<br><br>8mer<br>TPGLLTTA;GLLTTAGA;LTTAGAGR;TAGAGRPR;RPRDRCAR;RIVCTVFI;CTVFIETA;TVFIETAV;VFIETAVV;ETAVVATM;TAVVATMF;AVVATMFV;VVATMFVA;ATMFVALL;ALLGLSTI;GLSTISSK;GLYGGLQI;LQISQATW;SPAAASPQ;IEVADNIM;EVADNIMK;KTQGPGAW;QGPGAWPK;PLGSLTHI;SLTHILTF;LTHILTFL;HILTFLAA;FLAAETGG<br>9mer<br>MTPGLLTTA;LLTTAGAGR;TTAGAGRPR;RPRDRCARI;RCARIVCTV;CTVF | 133014-133713 |

Fig. 30 continued

| | | |
|---|---|---|
| | IETAV;TVFIETAVV;ETAVVATMF;TAVVATMFV;AVVATMFVA;VVATMFVAL;TMFVALLGL;VALLGLSTI;ALLGLSTIS;GLSTISSKA;SSKADDIDW;KADDIDWDA;WAANTGNGL;AANTGNGLY;TGNGLYGGL;GLYGGLQIS;ATWDSNGGV;QQIEVADNI;QIEVADNIM;EVADNIMKT;IMKTQGPGA;TQGPGAWPK;APLGSLTHI;PLGSLTHIL;GSLTHILTF;SLTHILTFL;LTHILTFLA;ILTFLAAET;FLAAETGGC;ETGGCSGSR<br>10mer<br>TPGLLTTAGA;GLLTTAGAGR;LTTAGAGRPR;AGRPRDRCAR;RPRDRCARIV;RIVCTVFIET;CTVFIETAVV;TVFIETAVVA;FIETAVVATM;IETAVVATMF;ETAVVATMFV;TAVVATMFVA;AVVATMFVAL;VVATMFVALL;ATMFVALLGL;FVALLGLSTI;ALLGLSTISS;LLGLSTISSK;ISSKADDIDW;KADDIDWDAI;IAQCESGGNW;AQCESGGNWA;NWAANTGNGL;WAANTGNGLY;NTGNGLYGGL;GLYGGLQISQ;GGLQISQATW;LQISQATWDS;QATWDSNGGV;AASPQQQIEV;QQIEVADNIM;EVADNIMKTQ;NIMKTQGPGA;IMKTQGPGAW;KTQGPGAWPK;SQGDAPLGSL;APLGSLTHIL;PLGSLTHILT;GSLTHILTFL;SLTHILTFLA;FLAAETGGCS<br>11mer<br>MTPGLLTTAGA;LLTTAGAGRPR;TTAGAGRPRDR;GAGRPRDRCAR;RPRDRCARIVC;RCARIVCTVFI;RIVCTVFIETA;IVCTVFIETAV;CTVFIETAVVA;TVFIETAVVAT;VFIETAVVATM;FIETAVVATMF;IETAVVATMFV;ETAVVATMFVA;TAVVATMFVAL;AVVATMFVALL;TMFVALLGLST;MFVALLGLSTI;ALLGLSTISSK;LLGLSTISSKA;KADDIDWDAIA;AQCESGGNWAA;NWAANTGNGLY;GLYGGLQISQA;SQATWDSNGGV;SPAAASPQQQI;AAASPQQQIEV;QQQIEVADNIM;QQIEVADNIMK;CSSCSQGDAPL;LGSLTHILTFL;SLTHILTFLAA;FLAAETGGCSG<br><br>13 mers:<br>MTPGLLTTAGAGR;TPGLLTTAGAGRP;PGLLTTAGAGRPR;GLLTTAGAGRPRD;LLTTAGAGRPRDR;LTTAGAGRPRDRC;TTAGAGRPRDRCA;TAGAGRPRDRCAR;AGAGRPRDRCARI;GAGRPRDRCARIV;AGRPRDRCARIVC;GRPRDRCARIVCT;RPRDRCARIVCTV;PRDRCARIVCTVF;RDRCARIVCTVFI;DRCARIVCTVFIE;RCARIVCTVFIET;CARIVCTVFIETA;ARIVCTVFIETAV;RIVCTVFIETAVV;IVCTVFIETAVVA;VCTVFIETAVVAT;CTVFIETAVVATM;TVFIETAVVATMF;VFIETAVVATMFV;FIETAVVATMFVA;IETAVVATMFVAL;ETAVVATMFVALL;TAVVATMFVALLG;AVVATMFVALLGL;VVATMFVALLGLS;VATMFVALLGLST;ATMFVALLGLSTI;TMFVALLGLSTIS;MFVALLGLSTISS;FVALLGLSTISSK;VALLGLSTISSKA;ALLGLSTISSKAD;LLGLSTISSKADD;LGLSTISSKADDI;GLSTISSKADDID;LSTISSKADDIDW;STISSKADDIDWD;TISSKADDIDWDA;ISSKADDIDWDAI;SSKADDIDWDAIA;SKADDIDWDAIAQ;KADDIDWDAIAQC;ADDIDWDAIAQCE;DDIDWDAIAQCES;DIDWDAIAQCESG;IDWDAIAQCESGG;DWDAIAQCESGGN;WDAIAQCESGGNW;DAIAQCESGGNWA;AIAQCESGGNWAA;IAQCESGGNWAAN;AQCESGGNWAANT;QCESGGNWAANTG;CESGGNWAANTGN;ESGGNWAANTGNG;SGGNWAANTGNGL;GGNWAANTGNGLY;GNWAANTGNGLYG;NWAANTGNGLYGG;WAANTGNGLYGGL;AANTGNGLYGGLQ;ANTGNGLYGGLQI;NTGNGLYGGLQIS;TGNGLYGGLQISQ;GNGLYGGLQISQA;NGLYGGLQISQAT;GLYGGLQISQATW;LYGGLQISQATWD;YGGLQISQATWDS;GGLQISQATWDSN;GLQISQATWDSNG;LQISQATWDSNGG;QISQATWDSNGGV;ISQATWDSNGGVG;SQATWDSNGGVGS;QATWDSNGGVGSP;ATWDSNGGVGSPA;TWDSNGGVGSPAA;WDSNGGVGSPAAA;DSNGGVGSPAAAS;SNGGVGSPAAASP;NGGVGSPAAASPQ;GGVGSPAAASPQQ;GVGSPAAASPQQQ;VGSPAAASPQQQI;GSPAAASPQQQIE;SPAAASPQQQIEV;PAAASPQQQIEVA;AAASPQQQIEVAD;AASPQQQIEVADN;ASPQQQIEVADNI;SPQQQIEVADNI | |

Fig. 30 continued

| | | |
|---|---|---|
| | M;PQQQIEVADNIMK;QQQIEVADNIMKT;QQIEVADNIMKTQ;QIEVADNIMKTQG;IEVADNIMKTQGP;EVADNIMKTQGPG;VADNIMKTQGPGA;ADNIMKTQGPGAW;DNIMKTQGPGAWP;NIMKTQGPGAWPK;IMKTQGPGAWPKC;MKTQGPGAWPKCS;KTQGPGAWPKCSS;TQGPGAWPKCSSC;QGPGAWPKCSSCS;GPGAWPKCSSCSQ;PGAWPKCSSCSQG;GAWPKCSSCSQGD;AWPKCSSCSQGDA;WPKCSSCSQGDAP;PKCSSCSQGDAPL;KCSSCSQGDAPLG;CSSCSQGDAPLGS;SSCSQGDAPLGSL;SCSQGDAPLGSLT;CSQGDAPLGSLTH;SQGDAPLGSLTHI;QGDAPLGSLTHIL;GDAPLGSLTHILT;DAPLGSLTHILTF;APLGSLTHILTFL;PLGSLTHILTFLA;LGSLTHILTFLAA;GSLTHILTFLAAE;SLTHILTFLAAET;LTHILTFLAAETG;THILTFLAAETGG;HILTFLAAETGGC;ILTFLAAETGGCS;LTFLAAETGGCSG;TFLAAETGGCSGS;FLAAETGGCSGSR;LAAETGGCSGSRD;AAETGGCSGSRDD;<br>14 mers:<br>MTPGLLTTAGAGRP;TPGLLTTAGAGRPR;PGLLTTAGAGRPRD;GLLTTAGAGRPRDR;LLTTAGAGRPRDRC;LTTAGAGRPRDRCA;TTAGAGRPRDRCAR;TAGAGRPRDRCARI;AGAGRPRDRCARIV;GAGRPRDRCARIVC;AGRPRDRCARIVCT;GRPRDRCARIVCTV;RPRDRCARIVCTVF;PRDRCARIVCTVFI;RDRCARIVCTVFIE;DRCARIVCTVFIET;RCARIVCTVFIETA;CARIVCTVFIETAV;ARIVCTVFIETAVV;RIVCTVFIETAVVA;IVCTVFIETAVVAT;VCTVFIETAVVATM;CTVFIETAVVATMF;TVFIETAVVATMFV;VFIETAVVATMFVA;FIETAVVATMFVAL;IETAVVATMFVALL;ETAVVATMFVALLG;TAVVATMFVALLGL;AVVATMFVALLGLS;VVATMFVALLGLST;VATMFVALLGLSTI;ATMFVALLGLSTIS;TMFVALLGLSTISS;MFVALLGLSTISSK;FVALLGLSTISSKA;VALLGLSTISSKAD;ALLGLSTISSKADD;LLGLSTISSKADDI;LGLSTISSKADDID;GLSTISSKADDIDW;LSTISSKADDIDWD;STISSKADDIDWDA;TISSKADDIDWDAI;ISSKADDIDWDAIA;SSKADDIDWDAIAQ;SKADDIDWDAIAQC;KADDIDWDAIAQCE;ADDIDWDAIAQCES;DDIDWDAIAQCESG;DIDWDAIAQCESGG;IDWDAIAQCESGGN;DWDAIAQCESGGNW;WDAIAQCESGGNWA;DAIAQCESGGNWAA;AIAQCESGGNWAAN;IAQCESGGNWAANT;AQCESGGNWAANTG;QCESGGNWAANTGN;CESGGNWAANTGNG;ESGGNWAANTGNGL;SGGNWAANTGNGLY;GGNWAANTGNGLYG;GNWAANTGNGLYGG;NWAANTGNGLYGGL;WAANTGNGLYGGLQ;AANTGNGLYGGLQI;ANTGNGLYGGLQIS;NTGNGLYGGLQISQ;TGNGLYGGLQISQA;GNGLYGGLQISQAT;NGLYGGLQISQATW;GLYGGLQISQATWD;LYGGLQISQATWDS;YGGLQISQATWDSN;GGLQISQATWDSNG;GLQISQATWDSNGG;LQISQATWDSNGGV;QISQATWDSNGGVG;ISQATWDSNGGVGS;SQATWDSNGGVGSP;QATWDSNGGVGSPA;ATWDSNGGVGSPAA;TWDSNGGVGSPAAA;WDSNGGVGSPAAAS;DSNGGVGSPAAASP;SNGGVGSPAAASPQ;NGGVGSPAAASPQQ;GGVGSPAAASPQQQ;GVGSPAAASPQQQI;VGSPAAASPQQQIE;GSPAAASPQQQIEV;SPAAASPQQQIEVA;PAAASPQQQIEVAD;AAASPQQQIEVADN;AASPQQQIEVADNI;ASPQQQIEVADNIM;SPQQQIEVADNIMK;PQQQIEVADNIMKT;QQQIEVADNIMKTQ;QQIEVADNIMKTQG;QIEVADNIMKTQGP;IEVADNIMKTQGPG;EVADNIMKTQGPGA;VADNIMKTQGPGAW;ADNIMKTQGPGAWP;DNIMKTQGPGAWPK;NIMKTQGPGAWPKC;IMKTQGPGAWPKCS;MKTQGPGAWPKCSS;KTQGPGAWPKCSSC;TQGPGAWPKCSSCS;QGPGAWPKCSSCSQ;GPGAWPKCSSCSQG;PGAWPKCSSCSQGD;GAWPKCSSCSQGDA;AWPKCSSCSQGDAP;WPKCSSCSQGDAPL;PKCSSCSQGDAPLG;KCSSCSQGDAPLGS;CSSCSQGDAPLGSL;SSCSQGDAPLGSLT;SCSQGDAPLGSLTH;CSQGDAPLGSLTHI;SQGDAPLGSLTHIL;QGDAPLGSLTHILT;GDAPLGSLTHILTF;DAPLGSLTHILTFL;APLGSLTHILTFLA;PLGSLTHILTFLAA;LGSLTHILTFLAAE;GSLTHILTFLAAET;SLTHILTFLAAETG;LTHILTFLAAETGG;THILTFLAAETGGC;HILTFLAAETGGCS;ILTFLAAETGGCSG;LTFLAAETGGCSGS;TFLAAETGGCSGSR;FLAAETGGCSGSRD;L | |

Fig. 30 continued

| | | | |
|---|---|---|---|
| | AAETGGCSGSRDD;<br>15 mers:<br>MTPGLLTTAGAGRPR;TPGLLTTAGAGRPRD;PGLLTTAGAGRPRDR;GLLTTAGAGRPRDRC;LLTTAGAGRPRDRCA;LTTAGAGRPRDRCAR;TTAGAGRPRDRCARI;TAGAGRPRDRCARIV;AGAGRPRDRCARIVC;GAGRPRDRCARIVCT;AGRPRDRCARIVCTV;GRPRDRCARIVCTVF;RPRDRCARIVCTVFI;PRDRCARIVCTVFIE;RDRCARIVCTVFIET;DRCARIVCTVFIETA;RCARIVCTVFIETAV;CARIVCTVFIETAVV;ARIVCTVFIETAVVA;RIVCTVFIETAVVAT;IVCTVFIETAVVATM;VCTVFIETAVVATMF;CTVFIETAVVATMFV;TVFIETAVVATMFVA;VFIETAVVATMFVAL;FIETAVVATMFVALL;IETAVVATMFVALLG;ETAVVATMFVALLGL;TAVVATMFVALLGLS;AVVATMFVALLGLST;VVATMFVALLGLSTI;VATMFVALLGLSTIS;ATMFVALLGLSTISS;TMFVALLGLSTISSK;MFVALLGLSTISSKA;FVALLGLSTISSKAD;VALLGLSTISSKADD;ALLGLSTISSKADDI;LLGLSTISSKADDID;LGLSTISSKADDIDW;GLSTISSKADDIDWD;LSTISSKADDIDWDA;STISSKADDIDWDAI;TISSKADDIDWDAIA;ISSKADDIDWDAIAQ;SSKADDIDWDAIAQC;SKADDIDWDAIAQCE;KADDIDWDAIAQCES;ADDIDWDAIAQCESG;DDIDWDAIAQCESGG;DIDWDAIAQCESGGN;IDWDAIAQCESGGNW;DWDAIAQCESGGNWA;WDAIAQCESGGNWAA;DAIAQCESGGNWAAN;AIAQCESGGNWAANT;IAQCESGGNWAANTG;AQCESGGNWAANTGN;QCESGGNWAANTGNG;CESGGNWAANTGNGL;ESGGNWAANTGNGLY;SGGNWAANTGNGLYG;GGNWAANTGNGLYGG;GNWAANTGNGLYGGL;NWAANTGNGLYGGLQ;WAANTGNGLYGGLQI;AANTGNGLYGGLQIS;ANTGNGLYGGLQISQ;NTGNGLYGGLQISQA;TGNGLYGGLQISQAT;GNGLYGGLQISQATW;NGLYGGLQISQATWD;GLYGGLQISQATWDS;LYGGLQISQATWDSN;YGGLQISQATWDSNG;GGLQISQATWDSNGG;GLQISQATWDSNGGV;LQISQATWDSNGGVG;QISQATWDSNGGVGS;ISQATWDSNGGVGSP;SQATWDSNGGVGSPA;QATWDSNGGVGSPAA;ATWDSNGGVGSPAAA;TWDSNGGVGSPAAAS;WDSNGGVGSPAAASP;DSNGGVGSPAAASPQ;SNGGVGSPAAASPQQ;NGGVGSPAAASPQQQ;GGVGSPAAASPQQQI;GVGSPAAASPQQQIE;VGSPAAASPQQQIEV;GSPAAASPQQQIEVA;SPAAASPQQQIEVAD;PAAASPQQQIEVADN;AAASPQQQIEVADNI;AASPQQQIEVADNIM;ASPQQQIEVADNIMK;SPQQQIEVADNIMKT;PQQQIEVADNIMKTQ;QQQIEVADNIMKTQG;QQIEVADNIMKTQGP;QIEVADNIMKTQGPG;IEVADNIMKTQGPGA;EVADNIMKTQGPGAW;VADNIMKTQGPGAWP;ADNIMKTQGPGAWPK;DNIMKTQGPGAWPKC;NIMKTQGPGAWPKCS;IMKTQGPGAWPKCSS;MKTQGPGAWPKCSSC;KTQGPGAWPKCSSCS;TQGPGAWPKCSSCSQ;QGPGAWPKCSSCSQG;GPGAWPKCSSCSQGD;PGAWPKCSSCSQGDA;GAWPKCSSCSQGDAP;AWPKCSSCSQGDAPL;WPKCSSCSQGDAPLG;PKCSSCSQGDAPLGS;KCSSCSQGDAPLGSL;CSSCSQGDAPLGSLT;SSCSQGDAPLGSLTH;SCSQGDAPLGSLTHI;CSQGDAPLGSLTHIL;SQGDAPLGSLTHILT;QGDAPLGSLTHILTF;GDAPLGSLTHILTFL;DAPLGSLTHILTFLA;APLGSLTHILTFLAA;PLGSLTHILTFLAAE;LGSLTHILTFLAAET;GSLTHILTFLAAETG;SLTHILTFLAAETGG;LTHILTFLAAETGGC;THILTFLAAETGGCS;HILTFLAAETGGCSG;ILTFLAAETGGCSGS;LTFLAAETGGCSGSR;TFLAAETGGCSGSRD;FLAAETGGCSGSRDD;<br>16 mers:<br>MTPGLLTTAGAGRPRD;TPGLLTTAGAGRPRDR;PGLLTTAGAGRPRDRC;GLLTTAGAGRPRDRCA;LLTTAGAGRPRDRCAR;LTTAGAGRPRDRCARI;TTAGAGRPRDRCARIV;TAGAGRPRDRCARIVC;AGAGRPRDRCARIVCT;GAGRPRDRCARIVCTV;AGRPRDRCARIVCTVF;GRPRDRCARIVCTVFI;RPRDRCARIVCTVFIE;PRDRCARIVCTVFIET;RDRCARIVCTVFIETA;DRCARIVCTVFIETAV;RCARIVCTVFIETAVV;CARIVCTVFIETAVVA;ARIVCTVFIETAVVAT;RIVCTVFIETAVVATM;IVCTVFIETAVVATMF;VCTVFIETAVVATMFV;C | |

Fig. 30 continued

| | | |
|---|---|---|
| | TVFIETAVVATMFVA;TVFIETAVVATMFVAL;VFIETAVVATMFVALL;FIETAVVATMFVALLG;IETAVVATMFVALLGL;ETAVVATMFVALLGLS;TAVVATMFVALLGLST;AVVATMFVALLGLSTI;VVATMFVALLGLSTIS;VATMFVALLGLSTISS;ATMFVALLGLSTISSK;TMFVALLGLSTISSKA;MFVALLGLSTISSKAD;FVALLGLSTISSKADD;VALLGLSTISSKADDI;ALLGLSTISSKADDID;LLGLSTISSKADDIDW;LGLSTISSKADDIDWD;GLSTISSKADDIDWDA;LSTISSKADDIDWDAI;STISSKADDIDWDAIA;TISSKADDIDWDAIAQ;ISSKADDIDWDAIAQC;SSKADDIDWDAIAQCE;SKADDIDWDAIAQCES;KADDIDWDAIAQCESG;ADDIDWDAIAQCESGG;DDIDWDAIAQCESGGN;DIDWDAIAQCESGGNW;IDWDAIAQCESGGNWA;DWDAIAQCESGGNWAA;WDAIAQCESGGNWAAN;DAIAQCESGGNWAANT;AIAQCESGGNWAANTG;IAQCESGGNWAANTGN;AQCESGGNWAANTGNG;QCESGGNWAANTGNGL;CESGGNWAANTGNGLY;ESGGNWAANTGNGLYG;SGGNWAANTGNGLYGG;GGNWAANTGNGLYGGL;GNWAANTGNGLYGGLQ;NWAANTGNGLYGGLQI;WAANTGNGLYGGLQIS;AANTGNGLYGGLQISQ;ANTGNGLYGGLQISQA;NTGNGLYGGLQISQAT;TGNGLYGGLQISQATW;GNGLYGGLQISQATWD;NGLYGGLQISQATWDS;GLYGGLQISQATWDSN;LYGGLQISQATWDSNG;YGGLQISQATWDSNGG;GGLQISQATWDSNGGV;GLQISQATWDSNGGVG;LQISQATWDSNGGVGS;QISQATWDSNGGVGSP;ISQATWDSNGGVGSPA;SQATWDSNGGVGSPAA;QATWDSNGGVGSPAAA;ATWDSNGGVGSPAAAS;TWDSNGGVGSPAAASP;WDSNGGVGSPAAASPQ;DSNGGVGSPAAASPQQ;SNGGVGSPAAASPQQQ;NGGVGSPAAASPQQQI;GGVGSPAAASPQQQIE;GVGSPAAASPQQQIEV;VGSPAAASPQQQIEVA;GSPAAASPQQQIEVAD;SPAAASPQQQIEVADN;PAAASPQQQIEVADNI;AAASPQQQIEVADNIM;AASPQQQIEVADNIMK;ASPQQQIEVADNIMKT;SPQQQIEVADNIMKTQ;PQQQIEVADNIMKTQG;QQQIEVADNIMKTQGP;QQIEVADNIMKTQGPG;QIEVADNIMKTQGPGA;IEVADNIMKTQGPGAW;EVADNIMKTQGPGAWP;VADNIMKTQGPGAWPK;ADNIMKTQGPGAWPKC;DNIMKTQGPGAWPKCS;NIMKTQGPGAWPKCSS;IMKTQGPGAWPKCSSC;MKTQGPGAWPKCSSCS;KTQGPGAWPKCSSCSQ;TQGPGAWPKCSSCSQG;QGPGAWPKCSSCSQGD;GPGAWPKCSSCSQGDA;PGAWPKCSSCSQGDAP;GAWPKCSSCSQGDAPL;AWPKCSSCSQGDAPLG;WPKCSSCSQGDAPLGS;PKCSSCSQGDAPLGSL;KCSSCSQGDAPLGSLT;CSSCSQGDAPLGSLTH;SSCSQGDAPLGSLTHI;SCSQGDAPLGSLTHIL;CSQGDAPLGSLTHILT;SQGDAPLGSLTHILTF;QGDAPLGSLTHILTFL;GDAPLGSLTHILTFLA;DAPLGSLTHILTFLAA;APLGSLTHILTFLAAE;PLGSLTHILTFLAAET;LGSLTHILTFLAAETG;GSLTHILTFLAAETGG;SLTHILTFLAAETGGC;LTHILTFLAAETGGCS;THILTFLAAETGGCSG;HILTFLAAETGGCSGS;ILTFLAAETGGCSGSR;LTFLAAETGGCSGSRD;TFLAAETGGCSGSRDD | |
| 14 | **<CAB06471.1 PROBABLE IRON-REGULATED ELONGATION FACTOR TU TUF (EF-TU)Rv0685:Mycobacterium tuberculosis H37Rv>**<br>MAKAKFQRTKPHVNIGTIGHVDHGKTTLTAAITKVLHDKFPDLNETKAFDQIDNAPEERQRGITINIAHVEYQTDKRHYAHVDAPGHADYIKNMITGAAQMDGAILVVAATDGPMPQTREHVLLARQVGVPYILVALNKADAVDDEELLELVEMEVRELLAAQEFDEDAPVVRVSALKALEGDAKWVASVEELMNAVDESIPDPVRETDKPFLMPVEDVFTITGRGTVVTGRVERGVINVNEEVEIVGIRPSTTKTTVTGVEMFRKLLDQGQAGDNVGLLLRGVKREDVERGQVVTKPGTTTPHTEFEGQVYILSKDEGGRHTPFFNNYRPQFYFRTTDVTGVVTLPEGTEMVMPGDNTNISVKLIQPVAMDEGLRFAIREGGRTVGAGRVTKIIK<br><br>8mer<br>MAKAKFQR;KAKFQRTK;FQRTKPHV;RTKPHVNI;NIGTIGHV;IGHVDHGK;TLTAAITK;LTAAITKV;ITKVLHDK;LHDKFPDL;ETKAFDQI;NAPEERQR;ITINIA | 133714-135679 |

Fig. 30 continued

| | | |
|---|---|---|
| | HV;INIAHVEY;HVEYQTDK;YQTDKRHY;HVDAPGHA;DAPGHADY;MITGAAQM;AQMDGAIL;QMDGAILV;VAATDGPM;MPQTREHV;QTREHVLL;REHVLLAR;HVLLARQV;LLARQVGV;RQVGVPYI;VGVPYILV;VPYILVAL;YILVALNK;ILVALNKA;ALNKADAV;DAVDDEEL;AVDDEELL;ELLELVEM;LELVEMEV;ELVEMEVR;VEMEVREL;ELLAAQEF;EFDEDAPV;EDAPVVRV;APVVRVSA;PVVRVSAL;VVRVSALK;RVSALKAL;KALEGDAK;DAKWVASV;WVASVEEL;VASVEELM;LMNAVDES;ESIPDPVR;RETDKPFL;ETDKPFLM;DKPFLMPV;FLMPVEDV;MPVEDVFT;PVEDVFTI;DVFTITGR;TITGRGTV;ITGRGTVV;RGTVVTGR;VVTGRVER;VERGVINV;VINVNEEV;EEVEIVGI;EVEIVGIR;GIRPSTTK;RPSTTKTT;TKTTVTGV;TTVTGVEM;VTGVEMFR;TGVEMFRK;VEMFRKLL;KLLDQGQA;LLDQGQAG;DNVGLLLR;GLLLRGVK;LLLRGVKR;DVERGQVV;VERGQVVT;TTTPHTEF;TEFEGQVY;FEGQVYIL;GQVYILSK;EGGRHTPF;HTPFFNNY;TPFFNNYR;NYRPQFYF;YRPQFYFR;FYFRTTDV;RTTDVTGV;TTDVTGVV;DVTGVVTL;TLPEGTEM;LPEGTEMV;MVMPGDNT;MPGDNTNI;DNTNISVK;NTNISVKL;SVKLIQPV;KLIQPVAM;VAMDEGLR;AMDEGLRF;FAIREGGR;RTVGAGRV;GRVTKIIK<br>9mer<br>KFQRTKPHV;KPHVNIGTI;TIGHVDHGK;HVDHGKTTL;TTLTAAITK;TLTAAITKV;LTAAITKVL;AITKVLHDK;VLHDKFPDL;KFPDLNETK;FPDLNETKA;KAFDQIDNA;QIDNAPEER;APEERQRGI;EERQRGITI;RQRGITINI;GITINIAHV;ITINIAHVE;TINIAHVEY;HVEYQTDKR;EYQTDKRHY;YQTDKRHYA;YIKNMITGA;NMITGAAQM;TGAAQMDGA;AQMDGAILV;QMDGAILVV;VVAATDGPM;PMPQTREHV;MPQTREHVL;QTREHVLLA;VLLARQVGV;LARQVGVPY;RQVGVPYIL;QVGVPYILV;GVPYILVAL;VPYILVALN;PYILVALNK;YILVALNKA;VALNKADAV;EELLELVEM;LLELVEMEV;VEMEVRELL;MEVRELLAA;EVRELLAAQ;RELLAAQEF;QEFDEDAPV;EFDEDAPVV;DAPVVRVSA;APVVRVSAL;PVVRVSALK;KALEGDAKW;ALEGDAKWV;GDAKWVASV;KWVASVEEL;WVASVEELM;SVEELMNAV;LMNAVDESI;SIPDPVRET;PVRETDKPF;RETDKPFLM;TDKPFLMPV;FLMPVEDVF;MPVEDVFTI;EDVFTITGR;FTITGRGTV;TITGRGTVV;GRGTVVTGR;RGTVVTGRV;TVVTGRVER;VTGRVERGV;RVERGVINV;GVINVNEEV;NVNEEVEIV;EEVEIVGIR;EIVGIRPST;RPSTTKTTV;TTKTTVTGV;KTTVTGVEM;TTVTGVEMF;TVTGVEMFR;VTGVEMFRK;KLLDQGQAG;LLDQGQAGD;GQAGDNVGL;NVGLLLRGV;GLLLRGVKR;GVKREDVER;TTTPHTEFE;HTEFEGQVY;TEFEGQVYI;EGGRHTPFF;RHTPFFNNY;HTPFFNNYR;FFNNYRPQF;NYRPQFYFR;RPQFYFRTT;RTTDVTGVV;TLPEGTEMV;LPEGTEMVM;VMPGDNTNI;MPGDNTNIS;ISVKLIQPV;QPVAMDEGL;PVAMDEGLR;VAMDEGLRF;AMDEGLRFA;DEGLRFAIR;RFAIREGGR;AIREGGRTV;TVGAGRVTK;AGRVTKIIK<br>10mer<br>MAKAKFQRTK;FQRTKPHVNI;HVNIGTIGHV;GTIGHVDHGK;KTTLTAAITK;TTLTAAITKV;TLTAAITKVL;AAITKVLHDK;KVLHDKFPDL;FPDLNETKAF;DQIDNAPEER;APEERQRGIT;RQRGITINIA;RGITINIAHV;ITINIAHVEY;IAHVEYQTDK;VEYQTDKRHY;YQTDKRHYAH;QTDKRHYAHV;HVDAPGHADY;DAPGHADYIK;YIKNMITGAA;TGAAQMDGAI;AAQMDGAILV;AQMDGAILVV;QMDGAILVVA;LVVAATDGPM;ATDGPMPQTR;GPMPQTREHV;PMPQTREHVL;MPQTREHVLL;QTREHVLLAR;REHVLLARQV;HVLLARQVGV;LLARQVGVPY;RQVGVPYILV;VPYILVALNK;LVALNKADAV;AVDDEELLEL;VDDEELLELV;ELLELVEMEV;LLELVEMEVR;ELVEMEVREL;AQEFDEDAPV;QEFDEDAPVV;EDAPVVRVSA;DAPVVRVSAL;APVVRVSALK;VVRVSALKAL;ALKALEGDAK;KALEGDAKWV;ALEGDAKWVA;ASVEELMNAV;ELMNAVDESI;AVDESIPDPV;DPVRETDKPF;ETDKPFLMPV;KPFLMPVEDV;PFLMPVEDVF;FLMPVEDVFT;LMPVEDVFTI;MPVEDVFTIT;FTITGRGTVV;GTVVTGRVER;VVTGRVERGV;IVGIRPSTTK;RPSTTKTTVT;STTKTTVTGV;KTTVTGVEMF;TT | |

Fig. 30 continued

| | | |
|---|---|---|
| | VTGVEMFR;TVTGVEMFRK;KLLDQGQAGD;GQAGDNVGLL;NVGLLLRGV<br>K;VGLLLRGVKR;LLRGVKREDV;DVERGQVVTK;TEFEGQVYIL;YILSKDEG<br>GR;RHTPFFNNYR;PFFNNYRPQF;FFNNYRPQFY;NNYRPQFYFR;RPQFY<br>FRTTD;YFRTTDVTGV;TTDVTGVVTL;VTLPEGTEMV;TLPEGTEMVM;MVM<br>PGDNTNI;MPGDNTNISV;NISVKLIQPV;SVKLIQPVAM;IQPVAMDEGL;QPV<br>AMDEGLR;VAMDEGLRFA;AMDEGLRFAI;LRFAIREGGR;FAIREGGRTV;R<br>TVGAGRVTK;GAGRVTKIIK<br>11mer<br>KAKFQRTKPHV;KFQRTKPHVNI;RTKPHVNIGTI;HVDHGKTTLTA;KTTLTA<br>AITKV;TAAITKVLHDK;KFPDLNETKAF;DLNETKAFDQI;ETKAFDQIDNA;AP<br>EERQRGITI;EERQRGITINI;RQRGITINIAH;ITINIAHVEYQ;NIAHVEYQTDK;I<br>AHVEYQTDKR;HVEYQTDKRHY;YQTDKRHYAHV;HVDAPGHADYI;MITGA<br>AQMDGA;TGAAQMDGAIL;GAAQMDGAILV;AQMDGAILVVA;QMDGAILVV<br>AA;ILVVAATDGPM;AATDGPMPQTR;GPMPQTREHVL;PMPQTREHVLL;M<br>PQTREHVLLA;VLLARQVGVPY;LLARQVGVPYI;LARQVGVPYIL;RQVGVP<br>YILVA;QVGVPYILVAL;GVPYILVALNK;VPYILVALNKA;ILVALNKADAV;KAD<br>AVDDEELL;DAVDDEELLEL;AVDDEELLELV;EELLELVEMEV;ELLELVEME<br>VR;LELVEMEVREL;ELVEMEVRELL;VEMEVRELLAA;EVRELLAAQEF;LLA<br>AQEFDEDA;AAQEFDEDAPV;AQEFDEDAPVV;EFDEDAPVVRV;EDAPVVR<br>VSAL;DAPVVRVSALK;APVVRVSALKA;PVVRVSALKAL;SALKALEGDAK;K<br>ALEGDAKWVA;LEGDAKWVASV;WVASVEELMNA;EELMNAVDESI;NAVD<br>ESIPDPV;SIPDPVRETDK;DPVRETDKPFL;RETDKPFLMPV;ETDKPFLMPV<br>E;KPFLMPVEDVF;FLMPVEDVFTI;MPVEDVFTITG;DVFTITGRGTV;FTITG<br>RGTVVT;ITGRGTVVTGR;RGTVVTGRVER;TVVTGRVERGV;ERGVINVNE<br>EV;GVINVNEEVEI;VINVNEEVEIV;NVNEEVEIVGI;EEVEIVGIRPS;EIVGIRP<br>STTK;GIRPSTTKTTV;RPSTTKTTVTG;TTKTTVTGVEM;KTTVTGVEMFR;T<br>TVTGVEMFRK;TVTGVEMFRKL;EMFRKLLDQGQ;LLDQGQAGDNV;GQAG<br>DNVGLLL;QAGDNVGLLLR;NVGLLLRGVKR;LLLRGVKREDV;KPGTTTPHT<br>EF;TTPHTEFEGQV;TPHTEFEGQVY;TEFEGQVYILS;EFEGQVYILSK;TPFF<br>NNYRPQF;PFFNNYRPQFY;FFNNYRPQFYF;FNNYRPQFYFR;RPQFYFRT<br>TDV;FYFRTTDVTGV;RTTDVTGVVTL;VVTLPEGTEMV;TLPEGTEMVMP;E<br>MVMPGDNTNI;MVMPGDNTNIS;VMPGDNTNISV;TNISVKLIQPV;ISVKLIQP<br>VAM;LIQPVAMDEGL;QPVAMDEGLRF;VAMDEGLRFAI;AMDEGLRFAIR;G<br>LRFAIREGGR;AIREGGRTVGA;GRTVGAGRVTK;RTVGAGRVTKI<br><br>13 mers:<br>MAKAKFQRTKPHV;AKAKFQRTKPHVN;KAKFQRTKPHVNI;AKFQRTKPHV<br>NIG;KFQRTKPHVNIGT;FQRTKPHVNIGTI;QRTKPHVNIGTIG;RTKPHVNIG<br>TIGH;TKPHVNIGTIGHV;KPHVNIGTIGHVD;PHVNIGTIGHVDH;HVNIGTIGH<br>VDHG;VNIGTIGHVDHGK;NIGTIGHVDHGKT;IGTIGHVDHGKTT;GTIGHVD<br>HGKTTL;TIGHVDHGKTTLT;IGHVDHGKTTLTA;GHVDHGKTTLTAA;HVDH<br>GKTTLTAAI;VDHGKTTLTAAIT;DHGKTTLTAAITK;HGKTTLTAAITKV;GKTT<br>LTAAITKVL;KTTLTAAITKVLH;TTLTAAITKVLHD;TLTAAITKVLHDK;LTAAIT<br>KVLHDKF;TAAITKVLHDKFP;AAITKVLHDKFPD;AITKVLHDKFPDL;ITKVLH<br>DKFPDLN;TKVLHDKFPDLNE;KVLHDKFPDLNET;VLHDKFPDLNETK;LHD<br>KFPDLNETKA;HDKFPDLNETKAF;DKFPDLNETKAFD;KFPDLNETKAFDQ;<br>FPDLNETKAFDQI;PDLNETKAFDQID;DLNETKAFDQIDN;LNETKAFDQIDN<br>A;NETKAFDQIDNAP;ETKAFDQIDNAPE;TKAFDQIDNAPEE;KAFDQIDNAP<br>EER;AFDQIDNAPEERQ;FDQIDNAPEERQR;DQIDNAPEERQRG;QIDNAPE<br>ERQRGI;IDNAPEERQRGIT;DNAPEERQRGITI;NAPEERQRGITIN;APEER<br>QRGITINI;PEERQRGITINIA;EERQRGITINIAH;ERQRGITINIAHV;RQRGITI<br>NIAHVE;QRGITINIAHVEY;RGITINIAHVEYQ;GITINIAHVEYQT;ITINIAHVEY<br>QTD;TINIAHVEYQTDK;INIAHVEYQTDKR;NIAHVEYQTDKRH;IAHVEYQTD | |

Fig. 30 continued

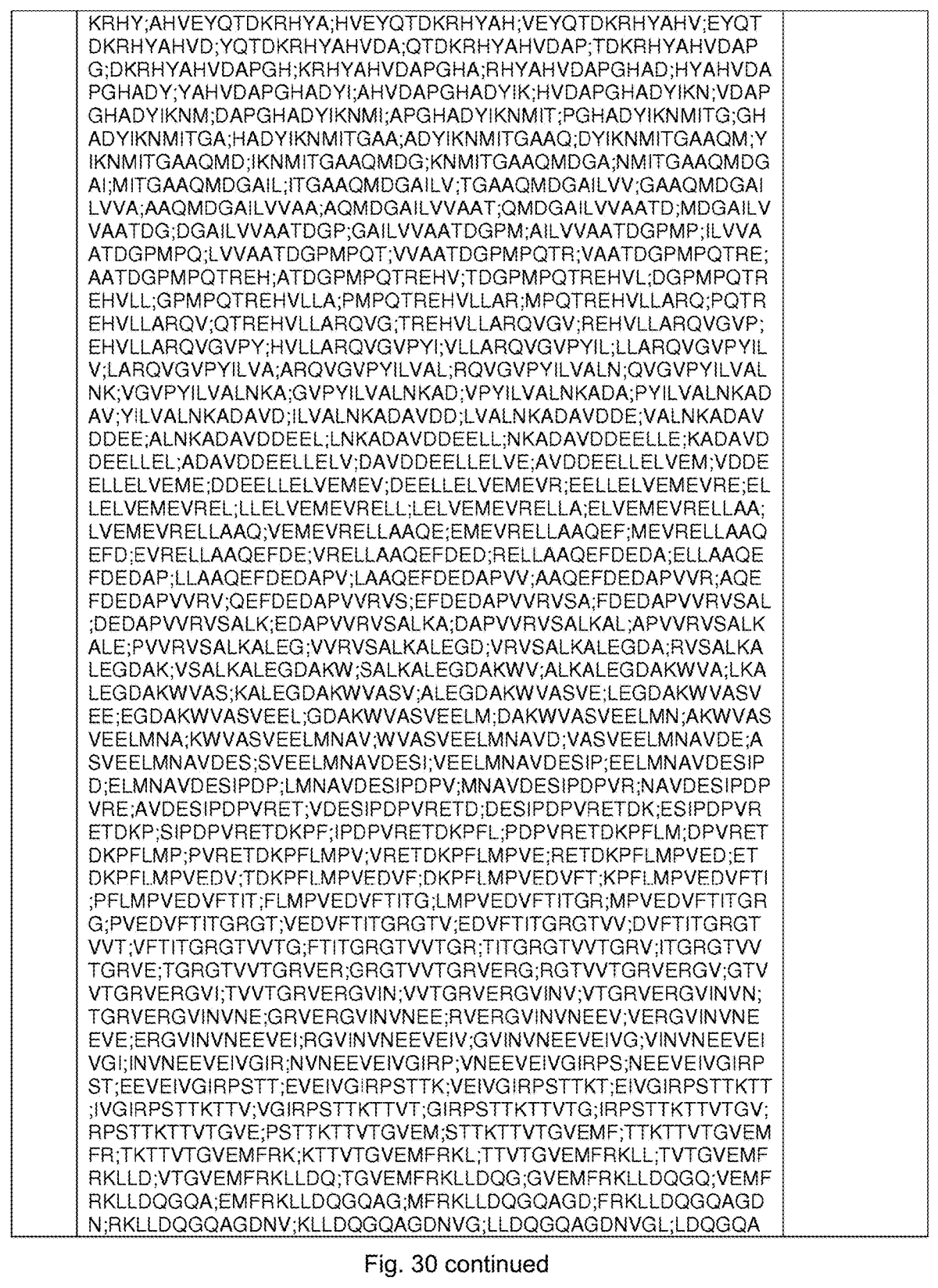

| | | |
|---|---|---|
| | KRHY;AHVEYQTDKRHYA;HVEYQTDKRHYAH;VEYQTDKRHYAHV;EYQTDKRHYAHVD;YQTDKRHYAHVDA;QTDKRHYAHVDAP;TDKRHYAHVDAPG;DKRHYAHVDAPGH;KRHYAHVDAPGHA;RHYAHVDAPGHAD;HYAHVDAPGHADY;YAHVDAPGHADYI;AHVDAPGHADYIK;HVDAPGHADYIKN;VDAPGHADYIKNM;DAPGHADYIKNMI;APGHADYIKNMIT;PGHADYIKNMITG;GHADYIKNMITGA;HADYIKNMITGAA;ADYIKNMITGAAQ;DYIKNMITGAAQM;YIKNMITGAAQMD;IKNMITGAAQMDG;KNMITGAAQMDGA;NMITGAAQMDGAI;MITGAAQMDGAIL;ITGAAQMDGAILV;TGAAQMDGAILVV;GAAQMDGAILVVA;AAQMDGAILVVAA;AQMDGAILVVAAT;QMDGAILVVAATD;MDGAILVVAATDG;DGAILVVAATDGP;GAILVVAATDGPM;AILVVAATDGPMP;ILVVAATDGPMPQ;LVVAATDGPMPQT;VVAATDGPMPQTR;VAATDGPMPQTRE;AATDGPMPQTREH;ATDGPMPQTREHV;TDGPMPQTREHVL;DGPMPQTREHVLL;GPMPQTREHVLLA;PMPQTREHVLLAR;MPQTREHVLLARQ;PQTREHVLLARQV;QTREHVLLARQVG;TREHVLLARQVGV;REHVLLARQVGVP;EHVLLARQVGVPY;HVLLARQVGVPYI;VLLARQVGVPYIL;LLARQVGVPYILV;LARQVGVPYILVA;ARQVGVPYILVAL;RQVGVPYILVALN;QVGVPYILVALNK;VGVPYILVALNKA;GVPYILVALNKAD;VPYILVALNKADA;PYILVALNKADAV;YILVALNKADAVD;ILVALNKADAVDD;LVALNKADAVDDE;VALNKADAVDDEE;ALNKADAVDDEEL;LNKADAVDDEELL;NKADAVDDEELLE;KADAVDDEELLEL;ADAVDDEELLELV;DAVDDEELLELVE;AVDDEELLELVEM;VDDEELLELVEME;DDEELLELVEMEV;DEELLELVEMEVR;EELLELVEMEVRE;ELLELVEMEVREL;LLELVEMEVRELL;LELVEMEVRELLA;ELVEMEVRELLAA;LVEMEVRELLAAQ;VEMEVRELLAAQE;EMEVRELLAAQEF;MEVRELLAAQEFD;EVRELLAAQEFDE;VRELLAAQEFDED;RELLAAQEFDEDA;ELLAAQEFDEDAP;LLAAQEFDEDAPV;LAAQEFDEDAPVV;AAQEFDEDAPVVR;AQEFDEDAPVVRV;QEFDEDAPVVRVS;EFDEDAPVVRVSA;FDEDAPVVRVSAL;DEDAPVVRVSALK;EDAPVVRVSALKA;DAPVVRVSALKAL;APVVRVSALKALE;PVVRVSALKALEG;VVRVSALKALEGD;VRVSALKALEGDA;RVSALKALEGDAK;VSALKALEGDAKW;SALKALEGDAKWV;ALKALEGDAKWVA;LKALEGDAKWVAS;KALEGDAKWVASV;ALEGDAKWVASVE;LEGDAKWVASVEE;EGDAKWVASVEEL;GDAKWVASVEELM;DAKWVASVEELMN;AKWVASVEELMNA;KWVASVEELMNAV;WVASVEELMNAVD;VASVEELMNAVDE;ASVEELMNAVDES;SVEELMNAVDESI;VEELMNAVDESIP;EELMNAVDESIPD;ELMNAVDESIPDP;LMNAVDESIPDPV;MNAVDESIPDPVR;NAVDESIPDPVRE;AVDESIPDPVRET;VDESIPDPVRETD;DESIPDPVRETDK;ESIPDPVRETDKP;SIPDPVRETDKPF;IPDPVRETDKPFL;PDPVRETDKPFLM;DPVRETDKPFLMP;PVRETDKPFLMPV;VRETDKPFLMPVE;RETDKPFLMPVED;ETDKPFLMPVEDV;TDKPFLMPVEDVF;DKPFLMPVEDVFT;KPFLMPVEDVFTI;PFLMPVEDVFTIT;FLMPVEDVFTITG;LMPVEDVFTITGR;MPVEDVFTITGRG;PVEDVFTITGRGT;VEDVFTITGRGTV;EDVFTITGRGTVV;DVFTITGRGTVVT;VFTITGRGTVVTG;FTITGRGTVVTGR;TITGRGTVVTGRV;ITGRGTVVTGRVE;TGRGTVVTGRVER;GRGTVVTGRVERG;RGTVVTGRVERGV;GTVVTGRVERGVI;TVVTGRVERGVIN;VVTGRVERGVINV;VTGRVERGVINVN;TGRVERGVINVNE;GRVERGVINVNEE;RVERGVINVNEEV;VERGVINVNEEVE;ERGVINVNEEVEI;RGVINVNEEVEIV;GVINVNEEVEIVG;VINVNEEVEIVGI;INVNEEVEIVGIR;NVNEEVEIVGIRP;VNEEVEIVGIRPS;NEEVEIVGIRPST;EEVEIVGIRPSTT;EVEIVGIRPSTTK;VEIVGIRPSTTKT;EIVGIRPSTTKTT;IVGIRPSTTKTTV;VGIRPSTTKTTVT;GIRPSTTKTTVTG;IRPSTTKTTVTGV;RPSTTKTTVTGVE;PSTTKTTVTGVEM;STTKTTVTGVEMF;TTKTTVTGVEMFR;TKTTVTGVEMFRK;KTTVTGVEMFRKL;TTVTGVEMFRKLL;TVTGVEMFRKLLD;VTGVEMFRKLLDQ;TGVEMFRKLLDQG;GVEMFRKLLDQGQ;VEMFRKLLDQGQA;EMFRKLLDQGQAG;MFRKLLDQGQAGD;FRKLLDQGQAGDN;RKLLDQGQAGDNV;KLLDQGQAGDNVG;LLDQGQAGDNVGL;LDQGQA | |

Fig. 30 continued

| | | |
|---|---|---|
| | GDNVGLL;DQGQAGDNVGLLL;QGQAGDNVGLLLR;GQAGDNVGLLLRG;QAGDNVGLLLRGV;AGDNVGLLLRGVK;GDNVGLLLRGVKR;DNVGLLLRGVKRE;NVGLLLRGVKRED;VGLLLRGVKREDV;GLLLRGVKREDVE;LLLRGVKREDVER;LLRGVKREDVERG;LRGVKREDVERGQ;RGVKREDVERGQV;GVKREDVERGQVV;VKREDVERGQVVT;KREDVERGQVVTK;REDVERGQVVTKP;EDVERGQVVTKPG;DVERGQVVTKPGT;VERGQVVTKPGTT;ERGQVVTKPGTTT;RGQVVTKPGTTTP;GQVVTKPGTTTPH;QVVTKPGTTTPHT;VVTKPGTTTPHTE;VTKPGTTTPHTEF;TKPGTTTPHTEFE;KPGTTTPHTEFEG;PGTTTPHTEFEGQ;GTTTPHTEFEGQV;TTTPHTEFEGQVY;TTPHTEFEGQVYI;TPHTEFEGQVYIL;PHTEFEGQVYILS;HTEFEGQVYILSK;TEFEGQVYILSKD;EFEGQVYILSKDE;FEGQVYILSKDEG;EGQVYILSKDEGG;GQVYILSKDEGGR;QVYILSKDEGGRH;VYILSKDEGGRHT;YILSKDEGGRHTP;ILSKDEGGRHTPF;LSKDEGGRHTPFF;SKDEGGRHTPFFN;KDEGGRHTPFFNN;DEGGRHTPFFNNY;EGGRHTPFFNNYR;GGRHTPFFNNYRP;GRHTPFFNNYRPQ;RHTPFFNNYRPQF;HTPFFNNYRPQFY;TPFFNNYRPQFYF;PFFNNYRPQFYFR;FFNNYRPQFYFRT;FNNYRPQFYFRTT;NNYRPQFYFRTTD;NYRPQFYFRTTDV;YRPQFYFRTTDVT;RPQFYFRTTDVTG;PQFYFRTTDVTGV;QFYFRTTDVTGVV;FYFRTTDVTGVVT;YFRTTDVTGVVTL;FRTTDVTGVVTLP;RTTDVTGVVTLPE;TTDVTGVVTLPEG;TDVTGVVTLPEGT;DVTGVVTLPEGTE;VTGVVTLPEGTEM;TGVVTLPEGTEMV;GVVTLPEGTEMVM;VVTLPEGTEMVMP;VTLPEGTEMVMPG;TLPEGTEMVMPGD;LPEGTEMVMPGDN;PEGTEMVMPGDNT;EGTEMVMPGDNTN;GTEMVMPGDNTNI;TEMVMPGDNTNIS;EMVMPGDNTNISV;MVMPGDNTNISVK;VMPGDNTNISVKL;MPGDNTNISVKLI;PGDNTNISVKLIQ;GDNTNISVKLIQP;DNTNISVKLIQPV;NTNISVKLIQPVA;TNISVKLIQPVAM;NISVKLIQPVAMD;ISVKLIQPVAMDE;SVKLIQPVAMDEG;VKLIQPVAMDEGL;KLIQPVAMDEGLR;LIQPVAMDEGLRF;IQPVAMDEGLRFA;QPVAMDEGLRFAI;PVAMDEGLRFAIR;VAMDEGLRFAIRE;AMDEGLRFAIREG;MDEGLRFAIREGG;DEGLRFAIREGGR;EGLRFAIREGGRT;GLRFAIREGGRTV;LRFAIREGGRTVG;RFAIREGGRTVGA;FAIREGGRTVGAG;AIREGGRTVGAGR;IREGGRTVGAGRV;REGGRTVGAGRVT;EGGRTVGAGRVTK;GGRTVGAGRVTKI;GRTVGAGRVTKII;RTVGAGRVTKIIK;<br>14 mers:<br>MAKAKFQRTKPHVN;AKAKFQRTKPHVNI;KAKFQRTKPHVNIG;AKFQRTKPHVNIGT;KFQRTKPHVNIGTI;FQRTKPHVNIGTIG;QRTKPHVNIGTIGH;RTKPHVNIGTIGHV;TKPHVNIGTIGHVD;KPHVNIGTIGHVDH;PHVNIGTIGHVDHG;HVNIGTIGHVDHGK;VNIGTIGHVDHGKT;NIGTIGHVDHGKTT;IGTIGHVDHGKTTL;GTIGHVDHGKTTLT;TIGHVDHGKTTLTA;IGHVDHGKTTLTAA;GHVDHGKTTLTAAI;HVDHGKTTLTAAIT;VDHGKTTLTAAITK;DHGKTTLTAAITKV;HGKTTLTAAITKVL;GKTTLTAAITKVLH;KTTLTAAITKVLHD;TTLTAAITKVLHDK;TLTAAITKVLHDKF;LTAAITKVLHDKFP;TAAITKVLHDKFPD;AAITKVLHDKFPDL;AITKVLHDKFPDLN;ITKVLHDKFPDLNE;TKVLHDKFPDLNET;KVLHDKFPDLNETK;VLHDKFPDLNETKA;LHDKFPDLNETKAF;HDKFPDLNETKAFD;DKFPDLNETKAFDQ;KFPDLNETKAFDQI;FPDLNETKAFDQID;PDLNETKAFDQIDN;DLNETKAFDQIDNA;LNETKAFDQIDNAP;NETKAFDQIDNAPE;ETKAFDQIDNAPEE;TKAFDQIDNAPEER;KAFDQIDNAPEERQ;AFDQIDNAPEERQR;FDQIDNAPEERQRG;DQIDNAPEERQRGI;QIDNAPEERQRGIT;IDNAPEERQRGITI;DNAPEERQRGITIN;NAPEERQRGITINI;APEERQRGITINIA;PEERQRGITINIAH;EERQRGITINIAHV;ERQRGITINIAHVE;RQRGITINIAHVEY;QRGITINIAHVEYQ;RGITINIAHVEYQT;GITINIAHVEYQTD;ITINIAHVEYQTDK;TINIAHVEYQTDKR;INIAHVEYQTDKRH;NIAHVEYQTDKRHY;IAHVEYQTDKRHYA;AHVEYQTDKRHYAH;HVEYQTDKRHYAHV;VEYQTDKRHYAHVD;EYQTDKRHYAHVDA;YQTDKRHYAHVDAP;QTDKRHYAHV | |

Fig. 30 continued

| | | |
|---|---|---|
| | DAPG;TDKRHYAHVDAPGH;DKRHYAHVDAPGHA;KRHYAHVDAPGHAD;RHYAHVDAPGHADY;HYAHVDAPGHADYI;YAHVDAPGHADYIK;AHVDAPGHADYIKN;HVDAPGHADYIKNM;VDAPGHADYIKNMI;DAPGHADYIKNMIT;APGHADYIKNMITG;PGHADYIKNMITGA;GHADYIKNMITGAA;HADYIKNMITGAAQ;ADYIKNMITGAAQM;DYIKNMITGAAQMD;YIKNMITGAAQMDG;IKNMITGAAQMDGA;KNMITGAAQMDGAI;NMITGAAQMDGAIL;MITGAAQMDGAILV;ITGAAQMDGAILVV;TGAAQMDGAILVVA;GAAQMDGAILVVAA;AAQMDGAILVVAAT;AQMDGAILVVAATD;QMDGAILVVAATDG;MDGAILVVAATDGP;DGAILVVAATDGPM;GAILVVAATDGPMP;AILVVAATDGPMPQ;ILVVAATDGPMPQT;LVVAATDGPMPQTR;VVAATDGPMPQTRE;VAATDGPMPQTREH;AATDGPMPQTREHV;ATDGPMPQTREHVL;TDGPMPQTREHVLL;DGPMPQTREHVLLA;GPMPQTREHVLLAR;PMPQTREHVLLARQ;MPQTREHVLLARQV;PQTREHVLLARQVG;QTREHVLLARQVGV;TREHVLLARQVGVP;REHVLLARQVGVPY;EHVLLARQVGVPYI;HVLLARQVGVPYIL;VLLARQVGVPYILV;LLARQVGVPYILVA;LARQVGVPYILVAL;ARQVGVPYILVALN;RQVGVPYILVALNK;QVGVPYILVALNKA;VGVPYILVALNKAD;GVPYILVALNKADA;VPYILVALNKADAV;PYILVALNKADAVD;YILVALNKADAVDD;ILVALNKADAVDDE;LVALNKADAVDDEE;VALNKADAVDDEEL;ALNKADAVDDEELL;LNKADAVDDEELLE;NKADAVDDEELLEL;KADAVDDEELLELV;ADAVDDEELLELVE;DAVDDEELLELVEM;AVDDEELLELVEME;VDDEELLELVEMEV;DDEELLELVEMEVR;DEELLELVEMEVRE;EELLELVEMEVREL;ELLELVEMEVRELL;LLELVEMEVRELLA;LELVEMEVRELLAA;ELVEMEVRELLAAQ;LVEMEVRELLAAQE;VEMEVRELLAAQEF;EMEVRELLAAQEFD;MEVRELLAAQEFDE;EVRELLAAQEFDED;VRELLAAQEFDEDA;RELLAAQEFDEDAP;ELLAAQEFDEDAPV;LLAAQEFDEDAPVV;LAAQEFDEDAPVVR;AAQEFDEDAPVVRV;AQEFDEDAPVVRVS;QEFDEDAPVVRVSA;EFDEDAPVVRVSAL;FDEDAPVVRVSALK;DEDAPVVRVSALKA;EDAPVVRVSALKAL;DAPVVRVSALKALE;APVVRVSALKALEG;PVVRVSALKALEGD;VVRVSALKALEGDA;VRVSALKALEGDAK;RVSALKALEGDAKW;VSALKALEGDAKWV;SALKALEGDAKWVA;ALKALEGDAKWVAS;LKALEGDAKWVASV;KALEGDAKWVASVE;ALEGDAKWVASVEE;LEGDAKWVASVEEL;EGDAKWVASVEELM;GDAKWVASVEELMN;DAKWVASVEELMNA;AKWVASVEELMNAV;KWVASVEELMNAVD;WVASVEELMNAVDE;VASVEELMNAVDES;ASVEELMNAVDESI;SVEELMNAVDESIP;VEELMNAVDESIPD;EELMNAVDESIPDP;ELMNAVDESIPDPV;LMNAVDESIPDPVR;MNAVDESIPDPVRE;NAVDESIPDPVRET;AVDESIPDPVRETD;VDESIPDPVRETDK;DESIPDPVRETDKP;ESIPDPVRETDKPF;SIPDPVRETDKPFL;IPDPVRETDKPFLM;PDPVRETDKPFLMP;DPVRETDKPFLMPV;PVRETDKPFLMPVE;VRETDKPFLMPVED;RETDKPFLMPVEDV;ETDKPFLMPVEDVF;TDKPFLMPVEDVFT;DKPFLMPVEDVFTI;KPFLMPVEDVFTIT;PFLMPVEDVFTITG;FLMPVEDVFTITGR;LMPVEDVFTITGRG;MPVEDVFTITGRGT;PVEDVFTITGRGTV;VEDVFTITGRGTVV;EDVFTITGRGTVVT;DVFTITGRGTVVTG;VFTITGRGTVVTGR;FTITGRGTVVTGRV;TITGRGTVVTGRVE;ITGRGTVVTGRVER;TGRGTVVTGRVERG;GRGTVVTGRVERGV;RGTVVTGRVERGVI;GTVVTGRVERGVIN;TVVTGRVERGVINV;VVTGRVERGVINVN;VTGRVERGVINVNE;TGRVERGVINVNEE;GRVERGVINVNEEV;RVERGVINVNEEVE;VERGVINVNEEVEI;ERGVINVNEEVEIV;RGVINVNEEVEIVG;GVINVNEEVEIVGI;VINVNEEVEIVGIR;INVNEEVEIVGIRP;NVNEEVEIVGIRPS;VNEEVEIVGIRPST;NEEVEIVGIRPSTT;EEVEIVGIRPSTTK;EVEIVGIRPSTTKT;VEIVGIRPSTTKTT;EIVGIRPSTTKTTV;IVGIRPSTTKTTVT;VGIRPSTTKTTVTG;GIRPSTTKTTVTGV;IRPSTTKTTVTGVE;RPSTTKTTVTGVEM;PSTTKTTVTGVEMF;STTKTTVTGVEMFR;TTKTTVTGVEMFRK;TKTTVTGVEMFRKL;KTTVTGVEMFRKLL;TTVTGVEMFRKLLD;TVTGVEMFRKLLDQ;VTGVEMFRKLLDQG;TGVEMFRKLLDQGQ;GVEMFRKLLDQGQA | |

Fig. 30 continued

| | | |
|---|---|---|
| | ;VEMFRKLLDQGQAG;EMFRKLLDQGQAGD;MFRKLLDQGQAGDN;FRKLL<br>DQGQAGDNV;RKLLDQGQAGDNVG;KLLDQGQAGDNVGL;LLDQGQAGD<br>NVGLL;LDQGQAGDNVGLLL;DQGQAGDNVGLLLR;QGQAGDNVGLLLRG;<br>GQAGDNVGLLLRGV;QAGDNVGLLLRGVK;AGDNVGLLLRGVKR;GDNVGL<br>LLRGVKRE;DNVGLLLRGVKRED;NVGLLLRGVKREDV;VGLLLRGVKREDV<br>E;GLLLRGVKREDVER;LLLRGVKREDVERG;LLRGVKREDVERGQ;LRGVK<br>REDVERGQV;RGVKREDVERGQVV;GVKREDVERGQVVT;VKREDVERGQ<br>VVTK;KREDVERGQVVTKP;REDVERGQVVTKPG;EDVERGQVVTKPGT;D<br>VERGQVVTKPGTT;VERGQVVTKPGTTT;ERGQVVTKPGTTTP;RGQVVTK<br>PGTTTPH;GQVVTKPGTTTPHT;QVVTKPGTTTPHTE;VVTKPGTTTPHTEF;<br>VTKPGTTTPHTEFE;TKPGTTTPHTEFEG;KPGTTTPHTEFEGQ;PGTTTPHT<br>EFEGQV;GTTTPHTEFEGQVY;TTTPHTEFEGQVYI;TTPHTEFEGQVYIL;TP<br>HTEFEGQVYILS;PHTEFEGQVYILSK;HTEFEGQVYILSKD;TEFEGQVYILS<br>KDE;EFEGQVYILSKDEG;FEGQVYILSKDEGG;EGQVYILSKDEGGR;GQVY<br>ILSKDEGGRH;QVYILSKDEGGRHT;VYILSKDEGGRHTP;YILSKDEGGRHT<br>PF;ILSKDEGGRHTPFF;LSKDEGGRHTPFFN;SKDEGGRHTPFFNN;KDEG<br>GRHTPFFNNY;DEGGRHTPFFNNYR;EGGRHTPFFNNYRP;GGRHTPFFNN<br>YRPQ;GRHTPFFNNYRPQF;RHTPFFNNYRPQFY;HTPFFNNYRPQFYF;TP<br>FFNNYRPQFYFR;PFFNNYRPQFYFRT;FFNNYRPQFYFRTT;FNNYRPQFY<br>FRTTD;NNYRPQFYFRTTDV;NYRPQFYFRTTDVT;YRPQFYFRTTDVTG;R<br>PQFYFRTTDVTGV;PQFYFRTTDVTGVV;QFYFRTTDVTGVVT;FYFRTTDV<br>TGVVTL;YFRTTDVTGVVTLP;FRTTDVTGVVTLPE;RTTDVTGVVTLPEG;TT<br>DVTGVVTLPEGT;TDVTGVVTLPEGTE;DVTGVVTLPEGTEM;VTGVVTLPE<br>GTEMV;TGVVTLPEGTEMVM;GVVTLPEGTEMVMP;VVTLPEGTEMVMPG;<br>VTLPEGTEMVMPGD;TLPEGTEMVMPGDN;LPEGTEMVMPGDNT;PEGTE<br>MVMPGDNTN;EGTEMVMPGDNTNI;GTEMVMPGDNTNIS;TEMVMPGDNT<br>NISV;EMVMPGDNTNISVK;MVMPGDNTNISVKL;VMPGDNTNISVKLI;MPG<br>DNTNISVKLIQ;PGDNTNISVKLIQP;GDNTNISVKLIQPV;DNTNISVKLIQPVA;<br>NTNISVKLIQPVAM;TNISVKLIQPVAMD;NISVKLIQPVAMDE;ISVKLIQPVAM<br>DEG;SVKLIQPVAMDEGL;VKLIQPVAMDEGLR;KLIQPVAMDEGLRF;LIQPV<br>AMDEGLRFA;IQPVAMDEGLRFAI;QPVAMDEGLRFAIR;PVAMDEGLRFAIR<br>E;VAMDEGLRFAIREG;AMDEGLRFAIREGG;MDEGLRFAIREGGR;DEGLR<br>FAIREGGRT;EGLRFAIREGGRTV;GLRFAIREGGRTVG;LRFAIREGGRTVG<br>A;RFAIREGGRTVGAG;FAIREGGRTVGAGR;AIREGGRTVGAGRV;IREGG<br>RTVGAGRVT;REGGRTVGAGRVTK;EGGRTVGAGRVTKI;GGRTVGAGRV<br>TKII;GRTVGAGRVTKIIK;<br>15 mers:<br>MAKAKFQRTKPHVNI;AKAKFQRTKPHVNIG;KAKFQRTKPHVNIGT;AKFQR<br>TKPHVNIGTI;KFQRTKPHVNIGTIG;FQRTKPHVNIGTIGH;QRTKPHVNIGTI<br>GHV;RTKPHVNIGTIGHVD;TKPHVNIGTIGHVDH;KPHVNIGTIGHVDHG;PH<br>VNIGTIGHVDHGK;HVNIGTIGHVDHGKT;VNIGTIGHVDHGKTT;NIGTIGHV<br>DHGKTTL;IGTIGHVDHGKTTLT;GTIGHVDHGKTTLTA;TIGHVDHGKTTLTA<br>A;IGHVDHGKTTLTAAI;GHVDHGKTTLTAAIT;HVDHGKTTLTAAITK;VDHGK<br>TTLTAAITKV;DHGKTTLTAAITKVL;HGKTTLTAAITKVLH;GKTTLTAAITKVL<br>HD;KTTLTAAITKVLHDK;TTLTAAITKVLHDKF;TLTAAITKVLHDKFP;LTAAIT<br>KVLHDKFPD;TAAITKVLHDKFPDL;AAITKVLHDKFPDLN;AITKVLHDKFPDL<br>NE;ITKVLHDKFPDLNET;TKVLHDKFPDLNETK;KVLHDKFPDLNETKA;VLH<br>DKFPDLNETKAF;LHDKFPDLNETKAFD;HDKFPDLNETKAFDQ;DKFPDLN<br>ETKAFDQI;KFPDLNETKAFDQID;FPDLNETKAFDQIDN;PDLNETKAFDQID<br>NA;DLNETKAFDQIDNAP;LNETKAFDQIDNAPE;NETKAFDQIDNAPEE;ETK<br>AFDQIDNAPEER;TKAFDQIDNAPEERQ;KAFDQIDNAPEERQR;AFDQIDNA<br>PEERQRG;FDQIDNAPEERQRGI;DQIDNAPEERQRGIT;QIDNAPEERQRGI<br>TI;IDNAPEERQRGITIN;DNAPEERQRGITINI;NAPEERQRGITINIA;APEERQ | |

Fig. 30 continued

| | | |
|---|---|---|
| | RGITINIAH;PEERQRGITINIAHV;EERQRGITINIAHVE;ERQRGITINIAHVEY;RQRGITINIAHVEYQ;QRGITINIAHVEYQT;RGITINIAHVEYQTD;GITINIAHVEYQTDK;ITINIAHVEYQTDKR;TINIAHVEYQTDKRH;INIAHVEYQTDKRHY;NIAHVEYQTDKRHYA;IAHVEYQTDKRHYAH;AHVEYQTDKRHYAHV;HVEYQTDKRHYAHVD;VEYQTDKRHYAHVDA;EYQTDKRHYAHVDAP;YQTDKRHYAHVDAPG;QTDKRHYAHVDAPGH;TDKRHYAHVDAPGHA;DKRHYAHVDAPGHAD;KRHYAHVDAPGHADY;RHYAHVDAPGHADYI;HYAHVDAPGHADYIK;YAHVDAPGHADYIKN;AHVDAPGHADYIKNM;HVDAPGHADYIKNMI;VDAPGHADYIKNMIT;DAPGHADYIKNMITG;APGHADYIKNMITGA;PGHADYIKNMITGAA;GHADYIKNMITGAAQ;HADYIKNMITGAAQM;ADYIKNMITGAAQMD;DYIKNMITGAAQMDG;YIKNMITGAAQMDGA;IKNMITGAAQMDGAI;KNMITGAAQMDGAIL;NMITGAAQMDGAILV;MITGAAQMDGAILVV;ITGAAQMDGAILVVA;TGAAQMDGAILVVAA;GAAQMDGAILVVAAT;AAQMDGAILVVAATD;AQMDGAILVVAATDG;QMDGAILVVAATDGP;MDGAILVVAATDGPM;DGAILVVAATDGPMP;GAILVVAATDGPMPQ;AILVVAATDGPMPQT;ILVVAATDGPMPQTR;LVVAATDGPMPQTRE;VVAATDGPMPQTREH;VAATDGPMPQTREHV;AATDGPMPQTREHVL;ATDGPMPQTREHVLL;TDGPMPQTREHVLLA;DGPMPQTREHVLLAR;GPMPQTREHVLLARQ;PMPQTREHVLLARQV;MPQTREHVLLARQVG;PQTREHVLLARQVGV;QTREHVLLARQVGVP;TREHVLLARQVGVPY;REHVLLARQVGVPYI;EHVLLARQVGVPYIL;HVLLARQVGVPYILV;VLLARQVGVPYILVA;LLARQVGVPYILVAL;LARQVGVPYILVALN;ARQVGVPYILVALNK;RQVGVPYILVALNKA;QVGVPYILVALNKAD;VGVPYILVALNKADA;GVPYILVALNKADAV;VPYILVALNKADAVD;PYILVALNKADAVDD;YILVALNKADAVDDE;ILVALNKADAVDDEE;LVALNKADAVDDEEL;VALNKADAVDDEELL;ALNKADAVDDEELLE;LNKADAVDDEELLEL;NKADAVDDEELLELV;KADAVDDEELLELVE;ADAVDDEELLELVEM;DAVDDEELLELVEME;AVDDEELLELVEMEV;VDDEELLELVEMEVR;DDEELLELVEMEVRE;DEELLELVEMEVREL;EELLELVEMEVRELL;ELLELVEMEVRELLA;LLELVEMEVRELLAA;LELVEMEVRELLAAQ;ELVEMEVRELLAAQE;LVEMEVRELLAAQEF;VEMEVRELLAAQEFD;EMEVRELLAAQEFDE;MEVRELLAAQEFDED;EVRELLAAQEFDEDA;VRELLAAQEFDEDAP;RELLAAQEFDEDAPV;ELLAAQEFDEDAPVV;LLAAQEFDEDAPVVR;LAAQEFDEDAPVVRV;AAQEFDEDAPVVRVS;AQEFDEDAPVVRVSA;QEFDEDAPVVRVSAL;EFDEDAPVVRVSALK;FDEDAPVVRVSALKA;DEDAPVVRVSALKAL;EDAPVVRVSALKALE;DAPVVRVSALKALEG;APVVRVSALKALEGD;PVVRVSALKALEGDA;VVRVSALKALEGDAK;VRVSALKALEGDAKW;RVSALKALEGDAKWV;VSALKALEGDAKWVA;SALKALEGDAKWVAS;ALKALEGDAKWVASV;LKALEGDAKWVASVE;KALEGDAKWVASVEE;ALEGDAKWVASVEEL;LEGDAKWVASVEELM;EGDAKWVASVEELMN;GDAKWVASVEELMNA;DAKWVASVEELMNAV;AKWVASVEELMNAVD;KWVASVEELMNAVDE;WVASVEELMNAVDES;VASVEELMNAVDESI;ASVEELMNAVDESIP;SVEELMNAVDESIPD;VEELMNAVDESIPDP;EELMNAVDESIPDPV;ELMNAVDESIPDPVR;LMNAVDESIPDPVRE;MNAVDESIPDPVRET;NAVDESIPDPVRETD;AVDESIPDPVRETDK;VDESIPDPVRETDKP;DESIPDPVRETDKPF;ESIPDPVRETDKPFL;SIPDPVRETDKPFLM;IPDPVRETDKPFLMP;PDPVRETDKPFLMPV;DPVRETDKPFLMPVE;PVRETDKPFLMPVED;VRETDKPFLMPVEDV;RETDKPFLMPVEDVF;ETDKPFLMPVEDVFT;TDKPFLMPVEDVFTI;DKPFLMPVEDVFTIT;KPFLMPVEDVFTITG;PFLMPVEDVFTITGR;FLMPVEDVFTITGRG;LMPVEDVFTITGRGT;MPVEDVFTITGRGTV;PVEDVFTITGRGTVV;VEDVFTITGRGTVVT;EDVFTITGRGTVVTG;DVFTITGRGTVVTGR;VFTITGRGTVVTGRV;FTITGRGTVVTGRVE;TITGRGTVVTGRVER;ITGRGTVVTGRVERG;TGRGTVVTGRVERGV;GRGTVVTGRVERGVI;RGTVVTGRVERGVIN;GTVVTGRVERGVINV;TVVTGRVERGVINVN;VVTGRVERGVINVNE;VTGRVERGVINVNEE;TGR | |

Fig. 30 continued

| | | |
|---|---|---|
| | VERGVINVNEEV;GRVERGVINVNEEVE;RVERGVINVNEEVEI;VERGVINVNEEVEIV;ERGVINVNEEVEIVG;RGVINVNEEVEIVGI;GVINVNEEVEIVGIR;VINVNEEVEIVGIRP;INVNEEVEIVGIRPS;NVNEEVEIVGIRPST;VNEEVEIVGIRPSTT;NEEVEIVGIRPSTTK;EEVEIVGIRPSTTKT;EVEIVGIRPSTTKTT;VEIVGIRPSTTKTTV;EIVGIRPSTTKTTVT;IVGIRPSTTKTTVTG;VGIRPSTTKTTVTGV;GIRPSTTKTTVTGVE;IRPSTTKTTVTGVEM;RPSTTKTTVTGVEMF;PSTTKTTVTGVEMFR;STTKTTVTGVEMFRK;TTKTTVTGVEMFRKL;TKTTVTGVEMFRKLL;KTTVTGVEMFRKLLD;TTVTGVEMFRKLLDQ;TVTGVEMFRKLLDQG;VTGVEMFRKLLDQGQ;TGVEMFRKLLDQGQA;GVEMFRKLLDQGQAG;VEMFRKLLDQGQAGD;EMFRKLLDQGQAGDN;MFRKLLDQGQAGDNV;FRKLLDQGQAGDNVG;RKLLDQGQAGDNVGL;KLLDQGQAGDNVGLL;LLDQGQAGDNVGLLL;LDQGQAGDNVGLLLR;DQGQAGDNVGLLLRG;QGQAGDNVGLLLRGV;GQAGDNVGLLLRGVK;QAGDNVGLLLRGVKR;AGDNVGLLLRGVKRE;GDNVGLLLRGVKRED;DNVGLLLRGVKREDV;NVGLLLRGVKREDVE;VGLLLRGVKREDVER;GLLLRGVKREDVERG;LLLRGVKREDVERGQ;LLRGVKREDVERGQV;LRGVKREDVERGQVV;RGVKREDVERGQVVT;GVKREDVERGQVVTK;VKREDVERGQVVTKP;KREDVERGQVVTKPG;REDVERGQVVTKPGT;EDVERGQVVTKPGTT;DVERGQVVTKPGTTT;VERGQVVTKPGTTTP;ERGQVVTKPGTTTPH;RGQVVTKPGTTTPHT;GQVVTKPGTTTPHTE;QVVTKPGTTTPHTEF;VVTKPGTTTPHTEFE;VTKPGTTTPHTEFEG;TKPGTTTPHTEFEGQ;KPGTTTPHTEFEGQV;PGTTTPHTEFEGQVY;GTTTPHTEFEGQVYI;TTTPHTEFEGQVYIL;TTPHTEFEGQVYILS;TPHTEFEGQVYILSK;PHTEFEGQVYILSKD;HTEFEGQVYILSKDE;TEFEGQVYILSKDEG;EFEGQVYILSKDEGG;FEGQVYILSKDEGGR;EGQVYILSKDEGGRH;GQVYILSKDEGGRHT;QVYILSKDEGGRHTP;VYILSKDEGGRHTPF;YILSKDEGGRHTPFF;ILSKDEGGRHTPFFN;LSKDEGGRHTPFFNN;SKDEGGRHTPFFNNY;KDEGGRHTPFFNNYR;DEGGRHTPFFNNYRP;EGGRHTPFFNNYRPQ;GGRHTPFFNNYRPQF;GRHTPFFNNYRPQFY;RHTPFFNNYRPQFYF;HTPFFNNYRPQFYFR;TPFFNNYRPQFYFRT;PFFNNYRPQFYFRTT;FFNNYRPQFYFRTTD;FNNYRPQFYFRTTDV;NNYRPQFYFRTTDVT;NYRPQFYFRTTDVTG;YRPQFYFRTTDVTGV;RPQFYFRTTDVTGVV;PQFYFRTTDVTGVVT;QFYFRTTDVTGVVTL;FYFRTTDVTGVVTLP;YFRTTDVTGVVTLPE;FRTTDVTGVVTLPEG;RTTDVTGVVTLPEGT;TTDVTGVVTLPEGTE;TDVTGVVTLPEGTEM;DVTGVVTLPEGTEMV;VTGVVTLPEGTEMVM;TGVVTLPEGTEMVMP;GVVTLPEGTEMVMPG;VVTLPEGTEMVMPGD;VTLPEGTEMVMPGDN;TLPEGTEMVMPGDNT;LPEGTEMVMPGDNTN;PEGTEMVMPGDNTNI;EGTEMVMPGDNTNIS;GTEMVMPGDNTNISV;TEMVMPGDNTNISVK;EMVMPGDNTNISVKL;MVMPGDNTNISVKLI;VMPGDNTNISVKLIQ;MPGDNTNISVKLIQP;PGDNTNISVKLIQPV;GDNTNISVKLIQPVA;DNTNISVKLIQPVAM;NTNISVKLIQPVAMD;TNISVKLIQPVAMDE;NISVKLIQPVAMDEG;ISVKLIQPVAMDEGL;SVKLIQPVAMDEGLR;VKLIQPVAMDEGLRF;KLIQPVAMDEGLRFA;LIQPVAMDEGLRFAI;IQPVAMDEGLRFAIR;QPVAMDEGLRFAIRE;PVAMDEGLRFAIREG;VAMDEGLRFAIREGG;AMDEGLRFAIREGGR;MDEGLRFAIREGGRT;DEGLRFAIREGGRTV;EGLRFAIREGGRTVG;GLRFAIREGGRTVGA;LRFAIREGGRTVGAG;RFAIREGGRTVGAGR;FAIREGGRTVGAGRV;AIREGGRTVGAGRVT;IREGGRTVGAGRVTK;REGGRTVGAGRVTKI;EGGRTVGAGRVTKII;GGRTVGAGRVTKIIK;<br>16 mers:<br>MAKAKFQRTKPHVNIG;AKAKFQRTKPHVNIGT;KAKFQRTKPHVNIGTI;AKFQRTKPHVNIGTIG;KFQRTKPHVNIGTIGH;FQRTKPHVNIGTIGHV;QRTKPHVNIGTIGHVD;RTKPHVNIGTIGHVDH;TKPHVNIGTIGHVDHG;KPHVNIGTIGHVDHGK;PHVNIGTIGHVDHGKT;HVNIGTIGHVDHGKTT;VNIGTIGHVDHGKTTL;NIGTIGHVDHGKTTLT;IGTIGHVDHGKTTLTA;GTIGHVDHGKTTLTA | |

Fig. 30 continued

| | | |
|---|---|---|
| | A;TIGHVDHGKTTLTAAI;IGHVDHGKTTLTAAIT;GHVDHGKTTLTAAITK;HVDHGKTTLTAAITKV;VDHGKTTLTAAITKVL;DHGKTTLTAAITKVLH;HGKTTLTAAITKVLHD;GKTTLTAAITKVLHDK;KTTLTAAITKVLHDKF;TTLTAAITKVLHDKFP;TLTAAITKVLHDKFPD;LTAAITKVLHDKFPDL;TAAITKVLHDKFPDLN;AAITKVLHDKFPDLNE;AITKVLHDKFPDLNET;ITKVLHDKFPDLNETK;TKVLHDKFPDLNETKA;KVLHDKFPDLNETKAF;VLHDKFPDLNETKAFD;LHDKFPDLNETKAFDQ;HDKFPDLNETKAFDQI;DKFPDLNETKAFDQID;KFPDLNETKAFDQIDN;FPDLNETKAFDQIDNA;PDLNETKAFDQIDNAP;DLNETKAFDQIDNAPE;LNETKAFDQIDNAPEE;NETKAFDQIDNAPEER;ETKAFDQIDNAPEERQ;TKAFDQIDNAPEERQR;KAFDQIDNAPEERQRG;AFDQIDNAPEERQRGI;FDQIDNAPEERQRGIT;DQIDNAPEERQRGITI;QIDNAPEERQRGITIN;IDNAPEERQRGITINI;DNAPEERQRGITINIA;NAPEERQRGITINIAH;APEERQRGITINIAHV;PEERQRGITINIAHVE;EERQRGITINIAHVEY;ERQRGITINIAHVEYQ;RQRGITINIAHVEYQT;QRGITINIAHVEYQTD;RGITINIAHVEYQTDK;GITINIAHVEYQTDKR;ITINIAHVEYQTDKRH;TINIAHVEYQTDKRHY;INIAHVEYQTDKRHYA;NIAHVEYQTDKRHYAH;IAHVEYQTDKRHYAHV;AHVEYQTDKRHYAHVD;HVEYQTDKRHYAHVDA;VEYQTDKRHYAHVDAP;EYQTDKRHYAHVDAPG;YQTDKRHYAHVDAPGH;QTDKRHYAHVDAPGHA;TDKRHYAHVDAPGHAD;DKRHYAHVDAPGHADY;KRHYAHVDAPGHADYI;RHYAHVDAPGHADYIK;HYAHVDAPGHADYIKN;YAHVDAPGHADYIKNM;AHVDAPGHADYIKNMI;HVDAPGHADYIKNMIT;VDAPGHADYIKNMITG;DAPGHADYIKNMITGA;APGHADYIKNMITGAA;PGHADYIKNMITGAAQ;GHADYIKNMITGAAQM;HADYIKNMITGAAQMD;ADYIKNMITGAAQMDG;DYIKNMITGAAQMDGA;YIKNMITGAAQMDGAI;IKNMITGAAQMDGAIL;KNMITGAAQMDGAILV;NMITGAAQMDGAILVV;MITGAAQMDGAILVVA;ITGAAQMDGAILVVAA;TGAAQMDGAILVVAAT;GAAQMDGAILVVAATD;AAQMDGAILVVAATDG;AQMDGAILVVAATDGP;QMDGAILVVAATDGPM;MDGAILVVAATDGPMP;DGAILVVAATDGPMPQ;GAILVVAATDGPMPQT;AILVVAATDGPMPQTR;ILVVAATDGPMPQTRE;LVVAATDGPMPQTREH;VVAATDGPMPQTREHV;VAATDGPMPQTREHVL;AATDGPMPQTREHVLL;ATDGPMPQTREHVLLA;TDGPMPQTREHVLLAR;DGPMPQTREHVLLARQ;GPMPQTREHVLLARQV;PMPQTREHVLLARQVG;MPQTREHVLLARQVGV;PQTREHVLLARQVGVP;QTREHVLLARQVGVPY;TREHVLLARQVGVPYI;REHVLLARQVGVPYIL;EHVLLARQVGVPYILV;HVLLARQVGVPYILVA;VLLARQVGVPYILVAL;LLARQVGVPYILVALN;LARQVGVPYILVALNK;ARQVGVPYILVALNKA;RQVGVPYILVALNKAD;QVGVPYILVALNKADA;VGVPYILVALNKADAV;GVPYILVALNKADAVD;VPYILVALNKADAVDD;PYILVALNKADAVDDE;YILVALNKADAVDDEE;ILVALNKADAVDDEEL;LVALNKADAVDDEELL;VALNKADAVDDEELLE;ALNKADAVDDEELLEL;LNKADAVDDEELLELV;NKADAVDDEELLELVE;KADAVDDEELLELVEM;ADAVDDEELLELVEME;DAVDDEELLELVEMEV;AVDDEELLELVEMEVR;VDDEELLELVEMEVRE;DDEELLELVEMEVREL;DEELLELVEMEVRELL;EELLELVEMEVRELLA;ELLELVEMEVRELLAA;LLELVEMEVRELLAAQ;LELVEMEVRELLAAQE;ELVEMEVRELLAAQEF;LVEMEVRELLAAQEFD;VEMEVRELLAAQEFDE;EMEVRELLAAQEFDED;MEVRELLAAQEFDEDA;EVRELLAAQEFDEDAP;VRELLAAQEFDEDAPV;RELLAAQEFDEDAPVV;ELLAAQEFDEDAPVVR;LLAAQEFDEDAPVVRV;LAAQEFDEDAPVVRVS;AAQEFDEDAPVVRVSA;AQEFDEDAPVVRVSAL;QEFDEDAPVVRVSALK;EFDEDAPVVRVSALKA;FDEDAPVVRVSALKAL;DEDAPVVRVSALKALE;EDAPVVRVSALKALEG;DAPVVRVSALKALEGD;APVVRVSALKALEGDA;PVVRVSALKALEGDAK;VVRVSALKALEGDAKW;VRVSALKALEGDAKWV;RVSALKALEGDAKWVA;VSALKALEGDAKWVAS;SALKALEGDAKWVASV;ALKALEGDAKWVASVE;LKALEGDAKWVASVEE;KALEGDAKWVASVEEL;ALEGDAKWVASVEELM;LEGDAKWVASVEELMN;EGDAKWVASVEELMNA;GDAK | |

Fig. 30 continued

| | | |
|---|---|---|
| | WVASVEELMNAV;DAKWVASVEELMNAVD;AKWVASVEELMNAVDE;KWVASVEELMNAVDES;WVASVEELMNAVDESI;VASVEELMNAVDESIP;ASVEELMNAVDESIPD;SVEELMNAVDESIPDP;VEELMNAVDESIPDPV;EELMNAVDESIPDPVR;ELMNAVDESIPDPVRE;LMNAVDESIPDPVRET;MNAVDESIPDPVRETD;NAVDESIPDPVRETDK;AVDESIPDPVRETDKP;VDESIPDPVRETDKPF;DESIPDPVRETDKPFL;ESIPDPVRETDKPFLM;SIPDPVRETDKPFLMP;IPDPVRETDKPFLMPV;PDPVRETDKPFLMPVE;DPVRETDKPFLMPVED;PVRETDKPFLMPVEDV;VRETDKPFLMPVEDVF;RETDKPFLMPVEDVFT;ETDKPFLMPVEDVFTI;TDKPFLMPVEDVFTIT;DKPFLMPVEDVFTITG;KPFLMPVEDVFTITGR;PFLMPVEDVFTITGRG;FLMPVEDVFTITGRGT;LMPVEDVFTITGRGTV;MPVEDVFTITGRGTVV;PVEDVFTITGRGTVVT;VEDVFTITGRGTVVTG;EDVFTITGRGTVVTGR;DVFTITGRGTVVTGRV;VFTITGRGTVVTGRVE;FTITGRGTVVTGRVER;TITGRGTVVTGRVERG;ITGRGTVVTGRVERGV;TGRGTVVTGRVERGVI;GRGTVVTGRVERGVIN;RGTVVTGRVERGVINV;GTVVTGRVERGVINVN;TVVTGRVERGVINVNE;VVTGRVERGVINVNEE;VTGRVERGVINVNEEV;TGRVERGVINVNEEVE;GRVERGVINVNEEVEI;RVERGVINVNEEVEIV;VERGVINVNEEVEIVG;ERGVINVNEEVEIVGI;RGVINVNEEVEIVGIR;GVINVNEEVEIVGIRP;VINVNEEVEIVGIRPS;INVNEEVEIVGIRPST;NVNEEVEIVGIRPSTT;VNEEVEIVGIRPSTTK;NEEVEIVGIRPSTTKT;EEVEIVGIRPSTTKTT;EVEIVGIRPSTTKTTV;VEIVGIRPSTTKTTVT;EIVGIRPSTTKTTVTG;IVGIRPSTTKTTVTGV;VGIRPSTTKTTVTGVE;GIRPSTTKTTVTGVEM;IRPSTTKTTVTGVEMF;RPSTTKTTVTGVEMFR;PSTTKTTVTGVEMFRK;STTKTTVTGVEMFRKL;TTKTTVTGVEMFRKLL;TKTTVTGVEMFRKLLD;KTTVTGVEMFRKLLDQ;TTVTGVEMFRKLLDQG;TVTGVEMFRKLLDQGQ;VTGVEMFRKLLDQGQA;TGVEMFRKLLDQGQAG;GVEMFRKLLDQGQAGD;VEMFRKLLDQGQAGDN;EMFRKLLDQGQAGDNV;MFRKLLDQGQAGDNVG;FRKLLDQGQAGDNVGL;RKLLDQGQAGDNVGLL;KLLDQGQAGDNVGLLL;LLDQGQAGDNVGLLLR;LDQGQAGDNVGLLLRG;DQGQAGDNVGLLLRGV;QGQAGDNVGLLLRGVK;GQAGDNVGLLLRGVKR;QAGDNVGLLLRGVKRE;AGDNVGLLLRGVKRED;GDNVGLLLRGVKREDV;DNVGLLLRGVKREDVE;NVGLLLRGVKREDVER;VGLLLRGVKREDVERG;GLLLRGVKREDVERGQ;LLLRGVKREDVERGQV;LLRGVKREDVERGQVV;LRGVKREDVERGQVVT;RGVKREDVERGQVVTK;GVKREDVERGQVVTKP;VKREDVERGQVVTKPG;KREDVERGQVVTKPGT;REDVERGQVVTKPGTT;EDVERGQVVTKPGTTT;DVERGQVVTKPGTTTP;VERGQVVTKPGTTTPH;ERGQVVTKPGTTTPHT;RGQVVTKPGTTTPHTE;GQVVTKPGTTTPHTEF;QVVTKPGTTTPHTEFE;VVTKPGTTTPHTEFEG;VTKPGTTTPHTEFEGQ;TKPGTTTPHTEFEGQV;KPGTTTPHTEFEGQVY;PGTTTPHTEFEGQVYI;GTTTPHTEFEGQVYIL;TTTPHTEFEGQVYILS;TTPHTEFEGQVYILSK;TPHTEFEGQVYILSKD;PHTEFEGQVYILSKDE;HTEFEGQVYILSKDEG;TEFEGQVYILSKDEGG;EFEGQVYILSKDEGGR;FEGQVYILSKDEGGRH;EGQVYILSKDEGGRHT;GQVYILSKDEGGRHTP;QVYILSKDEGGRHTPF;VYILSKDEGGRHTPFF;YILSKDEGGRHTPFFN;ILSKDEGGRHTPFFNN;LSKDEGGRHTPFFNNY;SKDEGGRHTPFFNNYR;KDEGGRHTPFFNNYRP;DEGGRHTPFFNNYRPQ;EGGRHTPFFNNYRPQF;GGRHTPFFNNYRPQFY;GRHTPFFNNYRPQFYF;RHTPFFNNYRPQFYFR;HTPFFNNYRPQFYFRT;TPFFNNYRPQFYFRTT;PFFNNYRPQFYFRTTD;FFNNYRPQFYFRTTDV;FNNYRPQFYFRTTDVT;NNYRPQFYFRTTDVTG;NYRPQFYFRTTDVTGV;YRPQFYFRTTDVTGVV;RPQFYFRTTDVTGVVT;PQFYFRTTDVTGVVTL;QFYFRTTDVTGVVTLP;FYFRTTDVTGVVTLPE;YFRTTDVTGVVTLPEG;FRTTDVTGVVTLPEGT;RTTDVTGVVTLPEGTE;TTDVTGVVTLPEGTEM;TDVTGVVTLPEGTEMV;DVTGVVTLPEGTEMVM;VTGVVTLPEGTEMVMP;TGVVTLPEGTEMVMPG;GVVTLPEGTEMVMPGD;VVTLPEGTEMVMPGDN;VTLPEGTEMVMPGDNT;TLPEGTEMVM | |

Fig. 30 continued

| | | |
|---|---|---|
| | PGDNTN;LPEGTEMVMPGDNTNI;PEGTEMVMPGDNTNIS;EGTEMVMPGDNTNISV;GTEMVMPGDNTNISVK;TEMVMPGDNTNISVKL;EMVMPGDNTNISVKLI;MVMPGDNTNISVKLIQ;VMPGDNTNISVKLIQP;MPGDNTNISVKLIQPV;PGDNTNISVKLIQPVA;GDNTNISVKLIQPVAM;DNTNISVKLIQPVAMD;NTNISVKLIQPVAMDE;TNISVKLIQPVAMDEG;NISVKLIQPVAMDEGL;ISVKLIQPVAMDEGLR;SVKLIQPVAMDEGLRF;VKLIQPVAMDEGLRFA;KLIQPVAMDEGLRFAI;LIQPVAMDEGLRFAIR;IQPVAMDEGLRFAIRE;QPVAMDEGLRFAIREG;PVAMDEGLRFAIREGG;VAMDEGLRFAIREGGR;AMDEGLRFAIREGGRT;MDEGLRFAIREGGRTV;DEGLRFAIREGGRTVG;EGLRFAIREGGRTVGA;GLRFAIREGGRTVGAG;LRFAIREGGRTVGAGR;RFAIREGGRTVGAGRV;FAIREGGRTVGAGRVT;AIREGGRTVGAGRVTK;IREGGRTVGAGRVTKI;REGGRTVGAGRVTKII;EGGRTVGAGRVTKIIK | |
| 15 | **<NP_217144.1 hypothetical protein Rv2628;Mycobacterium tuberculosis H37Rv>**<br>MSTQRPRHSGIRAVGPYAWAGRCGRIGRWGVHQEAMMNLAIWHPRKVQSATIYQVTDRSHDGRTARVPGDEITSTVSGWLSELGTQSPLADELARAVRIGDWPAAYAIGEHLSVEIAVAV<br><br>8mer<br>RPRHSGIR;GIRAVGPY;RAVGPYAW;AVGPYAWA;GRCGRIGR;WGVHQEAM;HQEAMMNL;EAMMNLAI;AMMNLAIW;MMNLAIWH;NLAIWHPR;LAIWHPRK;AIWHPRKV;HPRKVQSA;KVQSATIY;QSATIYQV;TIYQVTDR;YQVTDRSH;RSHDGRTA;ITSTVSGW;WLSELGTQ;ELGTQSPL;DELARAVR;ELARAVRI;RAVRIGDW;RIGDWPAA;IGDWPAAY;DWPAAYAI;WPAAYAIG;AYAIGEHL;AIGEHLSV;GEHLSVEI;HLSVEIAV;SVEIAVAV<br>9mer<br>TQRPRHSGI;RPRHSGIRA;SGIRAVGPY;YAWAGRCGR;AGRCGRIGR;GRWGVHQEA;WGVHQEAMM;VHQEAMMNL;HQEAMMNLA;QEAMMNLAI;EAMMNLAIW;AMMNLAIWH;MNLAIWHPR;NLAIWHPRK;LAIWHPRKV;HPRKVQSAT;KVQSATIYQ;VQSATIYQV;QSATIYQVT;ATIYQVTDR;RSHDGRTAR;SHDGRTARV;PGDEITSTV;EITSTVSGW;ITSTVSGWL;TVSGWLSEL;WLSELGTQS;SELGTQSPL;ELGTQSPLA;TQSPLADEL;PLADELARA;LADELARAV;AVRIGDWPA;RIGDWPAAY;AAYAIGEHL;YAIGEHLSV;HLSVEIAVA;LSVEIAVAV<br>10mer<br>STQRPRHSGI;TQRPRHSGIR;RPRHSGIRAV;AVGPYAWAGR;PYAWAGRCGR;YAWAGRCGRI;RCGRIGRWGV;GRWGVHQEAM;GVHQEAMMNL;HQEAMMNLAI;MMNLAIWHPR;MNLAIWHPRK;NLAIWHPRKV;HPRKVQSATI;KVQSATIYQV;SATIYQVTDR;QVTDRSHDGR;RSHDGRTARV;RTARVPGDEI;VPGDEITSTV;DEITSTVSGW;EITSTVSGWL;STVSGWLSEL;WLSELGTQSP;TQSPLADELA;QSPLADELAR;PLADELARAV;LARAVRIGDW;RAVRIGDWPA;AVRIGDWPAA;VRIGDWPAAY;RIGDWPAAYA;WPAAYAIGEH;AYAIGEHLSV;AIGEHLSVEI;GEHLSVEIAV;HLSVEIAVAV<br>11mer<br>MSTQRPRHSGI;STQRPRHSGIR;RPRHSGIRAVG;SGIRAVGPYAW;GIRAVGPYAWA;RAVGPYAWAGR;PYAWAGRCGRI;RIGRWGVHQEA;GRWGVHQEAMM;AMMNLAIWHPR;MMNLAIWHPRK;AIWHPRKVQSA;HPRKVQSATIY;RKVQSATIYQV;QSATIYQVTDR;YQVTDRSHDGR;RVPGDEITSTV;DEITSTVSGWL;WLSELGTQSPL;SPLADELARAV;RAVRIGDWPAA;AVRIGDWPAAY;RIGDWPAAYAI;WPAAYAIGEHL;AAYAIGEHLSV;YAIGEHLSVEI;AIGEHLSVEIA<br><br>13 mers: | 135680-136242 |

Fig. 30 continued

| | | |
|---|---|---|
| | MSTQRPRHSGIRA;STQRPRHSGIRAV;TQRPRHSGIRAVG;QRPRHSGIRAVGP;RPRHSGIRAVGPY;PRHSGIRAVGPYA;RHSGIRAVGPYAW;HSGIRAVGPYAWA;SGIRAVGPYAWAG;GIRAVGPYAWAGR;IRAVGPYAWAGRC;RAVGPYAWAGRCG;AVGPYAWAGRCGR;VGPYAWAGRCGRI;GPYAWAGRCGRIG;PYAWAGRCGRIGR;YAWAGRCGRIGRW;AWAGRCGRIGRWG;WAGRCGRIGRWGV;AGRCGRIGRWGVH;GRCGRIGRWGVHQ;RCGRIGRWGVHQE;CGRIGRWGVHQEA;GRIGRWGVHQEAM;RIGRWGVHQEAMM;IGRWGVHQEAMMN;GRWGVHQEAMMNL;RWGVHQEAMMNLA;WGVHQEAMMNLAI;GVHQEAMMNLAIW;VHQEAMMNLAIWH;HQEAMMNLAIWHP;QEAMMNLAIWHPR;EAMMNLAIWHPRK;AMMNLAIWHPRKV;MMNLAIWHPRKVQ;MNLAIWHPRKVQS;NLAIWHPRKVQSA;LAIWHPRKVQSAT;AIWHPRKVQSATI;IWHPRKVQSATIY;WHPRKVQSATIYQ;HPRKVQSATIYQV;PRKVQSATIYQVT;RKVQSATIYQVTD;KVQSATIYQVTDR;VQSATIYQVTDRS;QSATIYQVTDRSH;SATIYQVTDRSHD;ATIYQVTDRSHDG;TIYQVTDRSHDGR;IYQVTDRSHDGRT;YQVTDRSHDGRTA;QVTDRSHDGRTAR;VTDRSHDGRTARV;TDRSHDGRTARVP;DRSHDGRTARVPG;RSHDGRTARVPGD;SHDGRTARVPGDE;HDGRTARVPGDEI;DGRTARVPGDEIT;GRTARVPGDEITS;RTARVPGDEITST;TARVPGDEITSTV;ARVPGDEITSTVS;RVPGDEITSTVSG;VPGDEITSTVSGW;PGDEITSTVSGWL;GDEITSTVSGWLS;DEITSTVSGWLSE;EITSTVSGWLSEL;ITSTVSGWLSELG;TSTVSGWLSELGT;STVSGWLSELGTQ;TVSGWLSELGTQS;VSGWLSELGTQSP;SGWLSELGTQSPL;GWLSELGTQSPLA;WLSELGTQSPLAD;LSELGTQSPLADE;SELGTQSPLADEL;ELGTQSPLADELA;LGTQSPLADELAR;GTQSPLADELARA;TQSPLADELARAV;QSPLADELARAVR;SPLADELARAVRI;PLADELARAVRIG;LADELARAVRIGD;ADELARAVRIGDW;DELARAVRIGDWP;ELARAVRIGDWPA;LARAVRIGDWPAA;ARAVRIGDWPAAY;RAVRIGDWPAAYA;AVRIGDWPAAYAI;VRIGDWPAAYAIG;RIGDWPAAYAIGE;IGDWPAAYAIGEH;GDWPAAYAIGEHL;DWPAAYAIGEHLS;WPAAYAIGEHLSV;PAAYAIGEHLSVE;AAYAIGEHLSVEI;AYAIGEHLSVEIA;YAIGEHLSVEIAV;AIGEHLSVEIAVA;IGEHLSVEIAVAV;<br>14 mers:<br>MSTQRPRHSGIRAV;STQRPRHSGIRAVG;TQRPRHSGIRAVGP;QRPRHSGIRAVGPY;RPRHSGIRAVGPYA;PRHSGIRAVGPYAW;RHSGIRAVGPYAWA;HSGIRAVGPYAWAG;SGIRAVGPYAWAGR;GIRAVGPYAWAGRC;IRAVGPYAWAGRCG;RAVGPYAWAGRCGR;AVGPYAWAGRCGRI;VGPYAWAGRCGRIG;GPYAWAGRCGRIGR;PYAWAGRCGRIGRW;YAWAGRCGRIGRWG;AWAGRCGRIGRWGV;WAGRCGRIGRWGVH;AGRCGRIGRWGVHQ;GRCGRIGRWGVHQE;RCGRIGRWGVHQEA;CGRIGRWGVHQEAM;GRIGRWGVHQEAMM;RIGRWGVHQEAMMN;IGRWGVHQEAMMNL;GRWGVHQEAMMNLA;RWGVHQEAMMNLAI;WGVHQEAMMNLAIW;GVHQEAMMNLAIWH;VHQEAMMNLAIWHP;HQEAMMNLAIWHPR;QEAMMNLAIWHPRK;EAMMNLAIWHPRKV;AMMNLAIWHPRKVQ;MMNLAIWHPRKVQS;MNLAIWHPRKVQSA;NLAIWHPRKVQSAT;LAIWHPRKVQSATI;AIWHPRKVQSATIY;IWHPRKVQSATIYQ;WHPRKVQSATIYQV;HPRKVQSATIYQVT;PRKVQSATIYQVTD;RKVQSATIYQVTDR;KVQSATIYQVTDRS;VQSATIYQVTDRSH;QSATIYQVTDRSHD;SATIYQVTDRSHDG;ATIYQVTDRSHDGR;TIYQVTDRSHDGRT;IYQVTDRSHDGRTA;YQVTDRSHDGRTAR;QVTDRSHDGRTARV;VTDRSHDGRTARVP;TDRSHDGRTARVPG;DRSHDGRTARVPGD;RSHDGRTARVPGDE;SHDGRTARVPGDEI;HDGRTARVPGDEIT;DGRTARVPGDEITS;GRTARVPGDEITST;RTARVPGDEITSTV;TARVPGDEITSTVS;ARVPGDEITSTVSG;RVPGDEITSTVSGW;VPGDEITSTVSGWL;PGDEITSTVSGWLS;GDEITSTVSGWLSE;DEITSTVSGWLSEL;EITSTVSGWLSELG;ITSTVSGWLSELGT;TSTVSGWLSELGTQ;STVSGWLSELGTQS;TVSGWLSELGTQSP;VSG | |

Fig. 30 continued

WLSELGTQSPL;SGWLSELGTQSPLA;GWLSELGTQSPLAD;WLSELGTQS
PLADE;LSELGTQSPLADEL;SELGTQSPLADELA;ELGTQSPLADELAR;LGT
QSPLADELARA;GTQSPLADELARAV;TQSPLADELARAVR;QSPLADELAR
AVRI;SPLADELARAVRIG;PLADELARAVRIGD;LADELARAVRIGDW;ADEL
ARAVRIGDWP;DELARAVRIGDWPA;ELARAVRIGDWPAA;LARAVRIGDWP
AAY;ARAVRIGDWPAAYA;RAVRIGDWPAAYAI;AVRIGDWPAAYAIG;VRIG
DWPAAYAIGE;RIGDWPAAYAIGEH;IGDWPAAYAIGEHL;GDWPAAYAIGE
HLS;DWPAAYAIGEHLSV;WPAAYAIGEHLSVE;PAAYAIGEHLSVEI;AAYAIG
EHLSVEIA;AYAIGEHLSVEIAV;YAIGEHLSVEIAVA;AIGEHLSVEIAVAV;
15 mers:
MSTQRPRHSGIRAVG;STQRPRHSGIRAVGP;TQRPRHSGIRAVGPY;QRP
RHSGIRAVGPYA;RPRHSGIRAVGPYAW;PRHSGIRAVGPYAWA;RHSGIRA
VGPYAWAG;HSGIRAVGPYAWAGR;SGIRAVGPYAWAGRC;GIRAVGPYA
WAGRCG;IRAVGPYAWAGRCGR;RAVGPYAWAGRCGRI;AVGPYAWAGR
CGRIG;VGPYAWAGRCGRIGR;GPYAWAGRCGRIGRW;PYAWAGRCGRIG
RWG;YAWAGRCGRIGRWGV;AWAGRCGRIGRWGVH;WAGRCGRIGRWG
VHQ;AGRCGRIGRWGVHQE;GRCGRIGRWGVHQEA;RCGRIGRWGVHQE
AM;CGRIGRWGVHQEAMM;GRIGRWGVHQEAMMN;RIGRWGVHQEAMM
NL;IGRWGVHQEAMMNLA;GRWGVHQEAMMNLAI;RWGVHQEAMMNLAI
W;WGVHQEAMMNLAIWH;GVHQEAMMNLAIWHP;VHQEAMMNLAIWHPR;
HQEAMMNLAIWHPRK;QEAMMNLAIWHPRKV;EAMMNLAIWHPRKVQ;AM
MNLAIWHPRKVQS;MMNLAIWHPRKVQSA;MNLAIWHPRKVQSAT;NLAIW
HPRKVQSATI;LAIWHPRKVQSATIY;AIWHPRKVQSATIYQ;IWHPRKVQSAT
IYQV;WHPRKVQSATIYQVT;HPRKVQSATIYQVTD;PRKVQSATIYQVTDR;
RKVQSATIYQVTDRS;KVQSATIYQVTDRSH;VQSATIYQVTDRSHD;QSATI
YQVTDRSHDG;SATIYQVTDRSHDGR;ATIYQVTDRSHDGRT;TIYQVTDRS
HDGRTA;IYQVTDRSHDGRTAR;YQVTDRSHDGRTARV;QVTDRSHDGRTA
RVP;VTDRSHDGRTARVPG;TDRSHDGRTARVPGD;DRSHDGRTARVPGD
E;RSHDGRTARVPGDEI;SHDGRTARVPGDEIT;HDGRTARVPGDEITS;DG
RTARVPGDEITST;GRTARVPGDEITSTV;RTARVPGDEITSTVS;TARVPGD
EITSTVSG;ARVPGDEITSTVSGW;RVPGDEITSTVSGWL;VPGDEITSTVSG
WLS;PGDEITSTVSGWLSE;GDEITSTVSGWLSEL;DEITSTVSGWLSELG;EI
TSTVSGWLSELGT;ITSTVSGWLSELGTQ;TSTVSGWLSELGTQS;STVSGW
LSELGTQSP;TVSGWLSELGTQSPL;VSGWLSELGTQSPLA;SGWLSELGT
QSPLAD;GWLSELGTQSPLADE;WLSELGTQSPLADEL;LSELGTQSPLADE
LA;SELGTQSPLADELAR;ELGTQSPLADELARA;LGTQSPLADELARAV;GT
QSPLADELARAVR;TQSPLADELARAVRI;QSPLADELARAVRIG;SPLADEL
ARAVRIGD;PLADELARAVRIGDW;LADELARAVRIGDWP;ADELARAVRIGD
WPA;DELARAVRIGDWPAA;ELARAVRIGDWPAAY;LARAVRIGDWPAAYA;
ARAVRIGDWPAAYAI;RAVRIGDWPAAYAIG;AVRIGDWPAAYAIGE;VRIGD
WPAAYAIGEH;RIGDWPAAYAIGEHL;IGDWPAAYAIGEHLS;GDWPAAYAIG
EHLSV;DWPAAYAIGEHLSVE;WPAAYAIGEHLSVEI;PAAYAIGEHLSVEIA;A
AYAIGEHLSVEIAV;AYAIGEHLSVEIAVA;YAIGEHLSVEIAVAV;
16 mers:
MSTQRPRHSGIRAVGP;STQRPRHSGIRAVGPY;TQRPRHSGIRAVGPYA;
QRPRHSGIRAVGPYAW;RPRHSGIRAVGPYAWA;PRHSGIRAVGPYAWAG;
RHSGIRAVGPYAWAGR;HSGIRAVGPYAWAGRC;SGIRAVGPYAWAGRCG
;GIRAVGPYAWAGRCGR;IRAVGPYAWAGRCGRI;RAVGPYAWAGRCGRIG
;AVGPYAWAGRCGRIGR;VGPYAWAGRCGRIGRW;GPYAWAGRCGRIGR
WG;PYAWAGRCGRIGRWGV;YAWAGRCGRIGRWGVH;AWAGRCGRIGR
WGVHQ;WAGRCGRIGRWGVHQE;AGRCGRIGRWGVHQEA;GRCGRIGR
WGVHQEAM;RCGRIGRWGVHQEAMM;CGRIGRWGVHQEAMMN;GRIGR
WGVHQEAMMNL;RIGRWGVHQEAMMNLA;IGRWGVHQEAMMNLAI;GRW

Fig. 30 continued

| | | |
|---|---|---|
| | GVHQEAMMNLAIW;RWGVHQEAMMNLAIWH;WGVHQEAMMNLAIWHP;GVHQEAMMNLAIWHPR;VHQEAMMNLAIWHPRK;HQEAMMNLAIWHPRKV;QEAMMNLAIWHPRKVQ;EAMMNLAIWHPRKVQS;AMMNLAIWHPRKVQSA;MMNLAIWHPRKVQSAT;MNLAIWHPRKVQSATI;NLAIWHPRKVQSATIY;LAIWHPRKVQSATIYQ;AIWHPRKVQSATIYQV;IWHPRKVQSATIYQVT;WHPRKVQSATIYQVTD;HPRKVQSATIYQVTDR;PRKVQSATIYQVTDRS;RKVQSATIYQVTDRSH;KVQSATIYQVTDRSHD;VQSATIYQVTDRSHDG;QSATIYQVTDRSHDGR;SATIYQVTDRSHDGRT;ATIYQVTDRSHDGRTA;TIYQVTDRSHDGRTAR;IYQVTDRSHDGRTARV;YQVTDRSHDGRTARVP;QVTDRSHDGRTARVPG;VTDRSHDGRTARVPGD;TDRSHDGRTARVPGDE;DRSHDGRTARVPGDEI;RSHDGRTARVPGDEIT;SHDGRTARVPGDEITS;HDGRTARVPGDEITST;DGRTARVPGDEITSTV;GRTARVPGDEITSTVS;RTARVPGDEITSTVSG;TARVPGDEITSTVSGW;ARVPGDEITSTVSGWL;RVPGDEITSTVSGWLS;VPGDEITSTVSGWLSE;PGDEITSTVSGWLSEL;GDEITSTVSGWLSELG;DEITSTVSGWLSELGT;EITSTVSGWLSELGTQ;ITSTVSGWLSELGTQS;TSTVSGWLSELGTQSP;STVSGWLSELGTQSPL;TVSGWLSELGTQSPLA;VSGWLSELGTQSPLAD;SGWLSELGTQSPLADE;GWLSELGTQSPLADEL;WLSELGTQSPLADELA;LSELGTQSPLADELAR;SELGTQSPLADELARA;ELGTQSPLADELARAV;LGTQSPLADELARAVR;GTQSPLADELARAVRI;TQSPLADELARAVRIG;QSPLADELARAVRIGD;SPLADELARAVRIGDW;PLADELARAVRIGDWP;LADELARAVRIGDWPA;ADELARAVRIGDWPAA;DELARAVRIGDWPAAY;ELARAVRIGDWPAAYA;LARAVRIGDWPAAYAI;ARAVRIGDWPAAYAIG;RAVRIGDWPAAYAIGE;AVRIGDWPAAYAIGEH;VRIGDWPAAYAIGEHL;RIGDWPAAYAIGEHLS;IGDWPAAYAIGEHLSV;GDWPAAYAIGEHLSVE;DWPAAYAIGEHLSVEI;WPAAYAIGEHLSVEIA;PAAYAIGEHLSVEIAV;AAYAIGEHLSVEIAVA;AYAIGEHLSVEIAVAV | |
| 16 | **<NP_216496.1 immunogenic protein MPT64 (antigen MPT64/MPB64)Rv1980c;Mycobacterium tuberculosis H37Rv>**<br>MRIKIFMLVTAVVLLCCSGVATAAPKTYCEELKGTDTGQACQIQMSDPAYNINISLPSYYPDQKSLENYIAQTRDKFLSAATSSTPREAPYELNITSATYQSAIPPRGTQAVVLKVYQNAGGTHPTTTYKAFDWDQAYRKPITYDTLWQADTDPLPVVFPIVQGELSKQTGQQVSIAPNAGLDPVNYQNFAVTNDGVIFFFNPGELLPEAAGPTQVLVPRSAIDSMLA<br><br>8mer<br>MRIKIFML;RIKIFMLV;KIFMLVTA;FMLVTAVV;MLVTAVVL;LVTAVVLL;VLLCCSGV;LLCCSGVA;GVATAAPK;ATAAPKTY;KTYCEELK;GQACQIQM;IQMSDPAY;MSDPAYNI;DPAYNINI;AYNINISL;NISLPSYY;PSYYPDQK;YYPDQKSL;SLENYIAQ;ENYIAQTR;YIAQTRDK;IAQTRDKF;FLSAATSS;AATSSTPR;STPREAPY;APYELNIT;YELNITSA;TSATYQSA;SATYQSAI;YQSAIPPR;IPPRGTQA;PPRGTQAV;GTQAVVLK;TQAVVLKV;QAVVLKVY;VLKVYQNA;YQNAGGTH;GTHPTTTY;HPTTTYKA;PTTTYKAF;TTYKAFDW;KAFDWDQA;AFDWDQAY;AYRKPITY;KPITYDTL;ITYDTLWQ;WQADTDPL;DTDPLPVV;PLPVVFPI;LPVVFPIV;FPIVQGEL;IVQGELSK;SIAPNAGL;GLDPVNYQ;DPVNYQNF;VNYQNFAV;FAVTNDGV;VTNDGVIF;FFFNPGEL;FFNPGELL;LPEAAGPT;EAAGPTQV;PTQVLVPR;VLVPRSAI;SAIDSMLA<br>9mer<br>MRIKIFMLV;KIFMLVTAV;IFMLVTAVV;FMLVTAVVL;MLVTAVVLL;VVLLCCSGV;VLLCCSGVA;SGVATAAPK;VATAAPKTY;APKTYCEEL;CQIQMSDPA;QIQMSDPAY;QMSDPAYNI;DPAYNINIS;NINISLPSY;INISLPSYY;SLPSYYPDQ;LPSYYPDQK;SYYPDQKSL;SLENYIAQT;NYIAQTRDK;YIAQTRDKF;QTRDKFLSA;FLSAATSST;SAATSSTPR;SSTPREAPY;TPREAPYEL;REAPYELNI;YELNITSAT;ELNITSATY;ITSATYQSA;TSATYQSAI;TYQSAIPPR;AIPP | 136243-137389 |

Fig. 30 continued

| | | |
|---|---|---|
| | RGTQA;IPPRGTQAV;PPRGTQAVV;RGTQAVVLK;GTQAVVLKV;TQAVVLK<br>VY;VVLKVYQNA;YQNAGGTHP;GTHPTTTYK;HPTTTYKAF;TTTYKAFDW;K<br>AFDWDQAY;AFDWDQAYR;QAYRKPITY;KPITYDTLW;ITYDTLWQA;WQA<br>DTDPLP;QADTDPLPV;DTDPLPVVF;DPLPVVFPI;PLPVVFPIV;LPVVFPIVQ<br>;VFPIVQGEL;FPIVQGELS;KQTGQQVSI;QQVSIAPNA;VSIAPNAGL;APNA<br>GLDPV;GLDPVNYQN;DPVNYQNFA;PVNYQNFAV;FAVTNDGVI;VTNDGVI<br>FF;IFFFNPGEL;FFFNPGELL;NPGELLPEA;LLPEAAGPT;LPEAAGPTQ;EAA<br>GPTQVL;AAGPTQVLV;QVLVPRSAI;VPRSAIDSM<br>10mer<br>RIKIFMLVTA;IKIFMLVTAV;KIFMLVTAVV;IFMLVTAVVL;FMLVTAVVLL;MLV<br>TAVVLLC;AVVLLCCSGV;LLCCSGVATA;CSGVATAAPK;GVATAAPKTY;GT<br>DTGQACQI;CQIQMSDPAY;IQMSDPAYNI;MSDPAYNINI;DPAYNINISL;YNI<br>NISLPSY;NINISLPSYY;SLPSYYPDQK;YPDQKSLENY;SLENYIAQTR;ENYI<br>AQTRDK;NYIAQTRDKF;YIAQTRDKFL;AQTRDKFLSA;QTRDKFLSAA;FLS<br>AATSSTP;LSAATSSTPR;TSSTPREAPY;STPREAPYEL;APYELNITSA;YEL<br>NITSATY;NITSATYQSA;ITSATYQSAI;ATYQSAIPPR;AIPPRGTQAV;IPPRG<br>TQAVV;PPRGTQAVVL;GTQAVVLKVY;YQNAGGTHPT;GGTHPTTTYK;GT<br>HPTTTYKA;THPTTTYKAF;TTYKAFDWDQ;YKAFDWDQAY;KAFDWDQAY<br>R;AFDWDQAYRK;YRKPITYDTL;TLWQADTDPL;WQADTDPLPV;QADTDPL<br>PVV;TDPLPVVFPI;DPLPVVFPIV;LPVVFPIVQG;VVFPIVQGEL;FPIVQGELS<br>K;ELSKQTGQQV;KQTGQQVSIA;QVSIAPNAGL;IAPNAGLDPV;GLDPVNY<br>QNF;DPVNYQNFAV;QNFAVTNDGV;FAVTNDGVIF;AVTNDGVIFF;VTNDG<br>VIFFF;VIFFFNPGEL;IFFFNPGELL;NPGELLPEAA;ELLPEAAGPT;LLPEAA<br>GPTQ;LPEAAGPTQV;PEAAGPTQVL;EAAGPTQVLV;TQVLVPRSAI;LVPRS<br>AIDSM;VPRSAIDSML<br>11mer<br>MRIKIFMLVTA;RIKIFMLVTAV;KIFMLVTAVVL;IFMLVTAVVLL;FMLVTAVVL<br>LC;MLVTAVVLLCC;TAVVLLCCSGV;VLLCCSGVATA;LLCCSGVATAA;TAA<br>PKTYCEEL;AAPKTYCEELK;QACQIQMSDPA;QMSDPAYNINI;AYNINISLPS<br>Y;YNINISLPSYY;ISLPSYYPDQK;LPSYYPDQKSL;YYPDQKSLENY;YPDQK<br>SLENYI;KSLENYIAQTR;NYIAQTRDKFL;AQTRDKFLSAA;FLSAATSSTPR;<br>ATSSTPREAPY;TPREAPYELNI;REAPYELNITS;EAPYELNITSA;APYELNIT<br>SAT;NITSATYQSAI;SATYQSAIPPR;SAIPPRGTQAV;AIPPRGTQAVV;IPPR<br>GTQAVVL;YQNAGGTHPTT;NAGGTHPTTTY;AGGTHPTTTYK;GTHPTTTY<br>KAF;HPTTTYKAFDW;TTTYKAFDWDQ;TTYKAFDWDQA;TYKAFDWDQAY;<br>YKAFDWDQAYR;KAFDWDQAYRK;WDQAYRKPITY;AYRKPITYDTL;KPITY<br>DTLWQA;DTLWQADTDPL;WQADTDPLPVV;QADTDPLPVVF;DTDPLPVVF<br>PI;LPVVFPIVQGE;QQVSIAPNAGL;SIAPNAGLDPV;APNAGLDPVNY;GLDP<br>VNYQNFA;DPVNYQNFAVT;YQNFAVTNDGV;NFAVTNDGVIF;FAVTNDGVI<br>FF;AVTNDGVIFFF;GVIFFFNPGEL;VIFFFNPGELL;FFNPGELLPEA;ELLPE<br>AAGPTQ;LLPEAAGPTQV;LPEAAGPTQVL;AAGPTQVLVPR;GPTQVLVPR<br>SA;VLVPRSAIDSM;LVPRSAIDSML;VPRSAIDSMLA<br><br>13 mers:<br>MRIKIFMLVTAVV;RIKIFMLVTAVVL;IKIFMLVTAVVLL;KIFMLVTAVVLLC;IF<br>MLVTAVVLLCC;FMLVTAVVLLCCS;MLVTAVVLLCCSG;LVTAVVLLCCSGV;<br>VTAVVLLCCSGVA;TAVVLLCCSGVAT;AVVLLCCSGVATA;VVLLCCSGVAT<br>AA;VLLCCSGVATAAP;LLCCSGVATAAPK;LCCSGVATAAPKT;CCSGVATA<br>APKTY;CSGVATAAPKTYC;SGVATAAPKTYCE;GVATAAPKTYCEE;VATAA<br>PKTYCEEL;ATAAPKTYCEELK;TAAPKTYCEELKG;AAPKTYCEELKGT;AP<br>KTYCEELKGTD;PKTYCEELKGTDT;KTYCEELKGTDTG;TYCEELKGTDTG<br>Q;YCEELKGTDTGQA;CEELKGTDTGQAC;EELKGTDTGQACQ;ELKGTDT<br>GQACQI;LKGTDTGQACQIQ;KGTDTGQACQIQM;GTDTGQACQIQMS;TDT | |

Fig. 30 continued

| | | |
|---|---|---|
| | GQACQIQMSD;DTGQACQIQMSDP;TGQACQIQMSDPA;GQACQIQMSDPAY;QACQIQMSDPAYN;ACQIQMSDPAYNI;CQIQMSDPAYNIN;QIQMSDPAYNINI;IQMSDPAYNINIS;QMSDPAYNINISL;MSDPAYNINISLP;SDPAYNINISLPS;DPAYNINISLPSY;PAYNINISLPSYY;AYNINISLPSYYP;YNINISLPSYYPD;NINISLPSYYPDQ;INISLPSYYPDQK;NISLPSYYPDQKS;ISLPSYYPDQKSL;SLPSYYPDQKSLE;LPSYYPDQKSLEN;PSYYPDQKSLENY;SYYPDQKSLENYI;YYPDQKSLENYIA;YPDQKSLENYIAQ;PDQKSLENYIAQT;DQKSLENYIAQTR;QKSLENYIAQTRD;KSLENYIAQTRDK;SLENYIAQTRDKF;LENYIAQTRDKFL;ENYIAQTRDKFLS;NYIAQTRDKFLSA;YIAQTRDKFLSAA;IAQTRDKFLSAAT;AQTRDKFLSAATS;QTRDKFLSAATSS;TRDKFLSAATSST;RDKFLSAATSSTP;DKFLSAATSSTPR;KFLSAATSSTPRE;FLSAATSSTPREA;LSAATSSTPREAP;SAATSSTPREAPY;AATSSTPREAPYE;ATSSTPREAPYEL;TSSTPREAPYELN;SSTPREAPYELNI;STPREAPYELNIT;TPREAPYELNITS;PREAPYELNITSA;REAPYELNITSAT;EAPYELNITSATY;APYELNITSATYQ;PYELNITSATYQS;YELNITSATYQSA;ELNITSATYQSAI;LNITSATYQSAIP;NITSATYQSAIPP;ITSATYQSAIPPR;TSATYQSAIPPRG;SATYQSAIPPRGT;ATYQSAIPPRGTQ;TYQSAIPPRGTQA;YQSAIPPRGTQAV;QSAIPPRGTQAVV;SAIPPRGTQAVVL;AIPPRGTQAVVLK;IPPRGTQAVVLKV;PPRGTQAVVLKVY;PRGTQAVVLKVYQ;RGTQAVVLKVYQN;GTQAVVLKVYQNA;TQAVVLKVYQNAG;QAVVLKVYQNAGG;AVVLKVYQNAGGT;VVLKVYQNAGGTH;VLKVYQNAGGTHP;LKVYQNAGGTHPT;KVYQNAGGTHPTT;VYQNAGGTHPTTT;YQNAGGTHPTTTY;QNAGGTHPTTTYK;NAGGTHPTTTYKA;AGGTHPTTTYKAF;GGTHPTTTYKAFD;GTHPTTTYKAFDW;THPTTTYKAFDWD;HPTTTYKAFDWDQ;PTTTYKAFDWDQA;TTTYKAFDWDQAY;TTYKAFDWDQAYR;TYKAFDWDQAYRK;YKAFDWDQAYRKP;KAFDWDQAYRKPI;AFDWDQAYRKPIT;FDWDQAYRKPITY;DWDQAYRKPITYD;WDQAYRKPITYDT;DQAYRKPITYDTL;QAYRKPITYDTLW;AYRKPITYDTLWQ;YRKPITYDTLWQA;RKPITYDTLWQAD;KPITYDTLWQADT;PITYDTLWQADTD;ITYDTLWQADTDP;TYDTLWQADTDPL;YDTLWQADTDPLP;DTLWQADTDPLPV;TLWQADTDPLPVV;LWQADTDPLPVVF;WQADTDPLPVVFP;QADTDPLPVVFPI;ADTDPLPVVFPIV;DTDPLPVVFPIVQ;TDPLPVVFPIVQG;DPLPVVFPIVQGE;PLPVVFPIVQGEL;LPVVFPIVQGELS;PVVFPIVQGELSK;VVFPIVQGELSKQ;VFPIVQGELSKQT;FPIVQGELSKQTG;PIVQGELSKQTGQ;IVQGELSKQTGQQ;VQGELSKQTGQQV;QGELSKQTGQQVS;GELSKQTGQQVSI;ELSKQTGQQVSIA;LSKQTGQQVSIAP;SKQTGQQVSIAPN;KQTGQQVSIAPNA;QTGQQVSIAPNAG;TGQQVSIAPNAGL;GQQVSIAPNAGLD;QQVSIAPNAGLDP;QVSIAPNAGLDPV;VSIAPNAGLDPVN;SIAPNAGLDPVNY;IAPNAGLDPVNYQ;APNAGLDPVNYQN;PNAGLDPVNYQNF;NAGLDPVNYQNFA;AGLDPVNYQNFAV;GLDPVNYQNFAVT;LDPVNYQNFAVTN;DPVNYQNFAVTND;PVNYQNFAVTNDG;VNYQNFAVTNDGV;NYQNFAVTNDGVI;YQNFAVTNDGVIF;QNFAVTNDGVIFF;NFAVTNDGVIFFF;FAVTNDGVIFFFN;AVTNDGVIFFFNP;VTNDGVIFFFNPG;TNDGVIFFFNPGE;NDGVIFFFNPGEL;DGVIFFFNPGELL;GVIFFFNPGELLP;VIFFFNPGELLPE;IFFFNPGELLPEA;FFFNPGELLPEAA;FFNPGELLPEAAG;FNPGELLPEAAGP;NPGELLPEAAGPT;PGELLPEAAGPTQ;GELLPEAAGPTQV;ELLPEAAGPTQVL;LLPEAAGPTQVLV;LPEAAGPTQVLVP;PEAAGPTQVLVPR;EAAGPTQVLVPRS;AAGPTQVLVPRSA;AGPTQVLVPRSAI;GPTQVLVPRSAID;PTQVLVPRSAIDS;TQVLVPRSAIDSM;QVLVPRSAIDSML;VLVPRSAIDSMLA;<br>14 mers:<br>MRIKIFMLVTAVVL;RIKIFMLVTAVVLL;IKIFMLVTAVVLLC;KIFMLVTAVVLLCC;IFMLVTAVVLLCCS;FMLVTAVVLLCCSG;MLVTAVVLLCCSGV;LVTAVVLLCCSGVA;VTAVVLLCCSGVAT;TAVVLLCCSGVATA;AVVLLCCSGVATAA;VVLLCCSGVATAAP;VLLCCSGVATAAPK;LLCCSGVATAAPKT;LCCSGVA | |

Fig. 30 continued

| | | |
|---|---|---|
| | TAAPKTY;CCSGVATAAPKTYC;CSGVATAAPKTYCE;SGVATAAPKTYCEE;GVATAAPKTYCEEL;VATAAPKTYCEELK;ATAAPKTYCEELKG;TAAPKTYCEELKGT;AAPKTYCEELKGTD;APKTYCEELKGTDT;PKTYCEELKGTDTG;KTYCEELKGTDTGQ;TYCEELKGTDTGQA;YCEELKGTDTGQAC;CEELKGTDTGQACQ;EELKGTDTGQACQI;ELKGTDTGQACQIQ;LKGTDTGQACQIQM;KGTDTGQACQIQMS;GTDTGQACQIQMSD;TDTGQACQIQMSDP;DTGQACQIQMSDPA;TGQACQIQMSDPAY;GQACQIQMSDPAYN;QACQIQMSDPAYNI;ACQIQMSDPAYNIN;CQIQMSDPAYNINI;QIQMSDPAYNINIS;IQMSDPAYNINISL;QMSDPAYNINISLP;MSDPAYNINISLPS;SDPAYNINISLPSY;DPAYNINISLPSYY;PAYNINISLPSYYP;AYNINISLPSYYPD;YNINISLPSYYPDQ;NINISLPSYYPDQK;INISLPSYYPDQKS;NISLPSYYPDQKSL;ISLPSYYPDQKSLE;SLPSYYPDQKSLEN;LPSYYPDQKSLENY;PSYYPDQKSLENYI;SYYPDQKSLENYIA;YYPDQKSLENYIAQ;YPDQKSLENYIAQT;PDQKSLENYIAQTR;DQKSLENYIAQTRD;QKSLENYIAQTRDK;KSLENYIAQTRDKF;SLENYIAQTRDKFL;LENYIAQTRDKFLS;ENYIAQTRDKFLSA;NYIAQTRDKFLSAA;YIAQTRDKFLSAAT;IAQTRDKFLSAATS;AQTRDKFLSAATSS;QTRDKFLSAATSST;TRDKFLSAATSSTP;RDKFLSAATSSTPR;DKFLSAATSSTPRE;KFLSAATSSTPREA;FLSAATSSTPREAP;LSAATSSTPREAPY;SAATSSTPREAPYE;AATSSTPREAPYEL;ATSSTPREAPYELN;TSSTPREAPYELNI;SSTPREAPYELNIT;STPREAPYELNITS;TPREAPYELNITSA;PREAPYELNITSAT;REAPYELNITSATY;EAPYELNITSATYQ;APYELNITSATYQS;PYELNITSATYQSA;YELNITSATYQSAI;ELNITSATYQSAIP;LNITSATYQSAIPP;NITSATYQSAIPPR;ITSATYQSAIPPRG;TSATYQSAIPPRGT;SATYQSAIPPRGTQ;ATYQSAIPPRGTQA;TYQSAIPPRGTQAV;YQSAIPPRGTQAVV;QSAIPPRGTQAVVL;SAIPPRGTQAVVLK;AIPPRGTQAVVLKV;IPPRGTQAVVLKVY;PPRGTQAVVLKVYQ;PRGTQAVVLKVYQN;RGTQAVVLKVYQNA;GTQAVVLKVYQNAG;TQAVVLKVYQNAGG;QAVVLKVYQNAGGT;AVVLKVYQNAGGTH;VVLKVYQNAGGTHP;VLKVYQNAGGTHPT;LKVYQNAGGTHPTT;KVYQNAGGTHPTTT;VYQNAGGTHPTTTY;YQNAGGTHPTTTYK;QNAGGTHPTTTYKA;NAGGTHPTTTYKAF;AGGTHPTTTYKAFD;GGTHPTTTYKAFDW;GTHPTTTYKAFDWD;THPTTTYKAFDWDQ;HPTTTYKAFDWDQA;PTTTYKAFDWDQAY;TTTYKAFDWDQAYR;TTYKAFDWDQAYRK;TYKAFDWDQAYRKP;YKAFDWDQAYRKPI;KAFDWDQAYRKPIT;AFDWDQAYRKPITY;FDWDQAYRKPITYD;DWDQAYRKPITYDT;WDQAYRKPITYDTL;DQAYRKPITYDTLW;QAYRKPITYDTLWQ;AYRKPITYDTLWQA;YRKPITYDTLWQAD;RKPITYDTLWQADT;KPITYDTLWQADTD;PITYDTLWQADTDP;ITYDTLWQADTDPL;TYDTLWQADTDPLP;YDTLWQADTDPLPV;DTLWQADTDPLPVV;TLWQADTDPLPVVF;LWQADTDPLPVVFP;WQADTDPLPVVFPI;QADTDPLPVVFPIV;ADTDPLPVVFPIVQ;DTDPLPVVFPIVQG;TDPLPVVFPIVQGE;DPLPVVFPIVQGEL;PLPVVFPIVQGELS;LPVVFPIVQGELSK;PVVFPIVQGELSKQ;VVFPIVQGELSKQT;VFPIVQGELSKQTG;FPIVQGELSKQTGQ;PIVQGELSKQTGQQ;IVQGELSKQTGQQV;VQGELSKQTGQQVS;QGELSKQTGQQVSI;GELSKQTGQQVSIA;ELSKQTGQQVSIAP;LSKQTGQQVSIAPN;SKQTGQQVSIAPNA;KQTGQQVSIAPNAG;QTGQQVSIAPNAGL;TGQQVSIAPNAGLD;GQQVSIAPNAGLDP;QQVSIAPNAGLDPV;QVSIAPNAGLDPVN;VSIAPNAGLDPVNY;SIAPNAGLDPVNYQ;IAPNAGLDPVNYQN;APNAGLDPVNYQNF;PNAGLDPVNYQNFA;NAGLDPVNYQNFAV;AGLDPVNYQNFAVT;GLDPVNYQNFAVTN;LDPVNYQNFAVTND;DPVNYQNFAVTNDG;PVNYQNFAVTNDGV;VNYQNFAVTNDGVI;NYQNFAVTNDGVIF;YQNFAVTNDGVIFF;QNFAVTNDGVIFFF;NFAVTNDGVIFFFN;FAVTNDGVIFFFNP;AVTNDGVIFFFNPG;VTNDGVIFFFNPGE;TNDGVIFFFNPGEL;NDGVIFFFNPGELL;DGVIFFFNPGELLP;GVIFFFNPGELLPE;VIFFFNPGELLPEA;IFFFNPGELLPEAA;FFFNPGELLPEAAG;FFNPGELLPEAAGP;FNPGELLPEAAGPT;NPGELLPEAAGPTQ;PGEL | |

Fig. 30 continued

| | | |
|---|---|---|
| | LPEAAGPTQV;GELLPEAAGPTQVL;ELLPEAAGPTQVLV;LLPEAAGPTQVLVP;LPEAAGPTQVLVPR;PEAAGPTQVLVPRS;EAAGPTQVLVPRSA;AAGPTQVLVPRSAI;AGPTQVLVPRSAID;GPTQVLVPRSAIDS;PTQVLVPRSAIDSM;TQVLVPRSAIDSML;QVLVPRSAIDSMLA;<br>15 mers:<br>MRIKIFMLVTAVVLL;RIKIFMLVTAVVLLC;IKIFMLVTAVVLLCC;KIFMLVTAVVLLCCS;IFMLVTAVVLLCCSG;FMLVTAVVLLCCSGV;MLVTAVVLLCCSGVA;LVTAVVLLCCSGVAT;VTAVVLLCCSGVATA;TAVVLLCCSGVATAA;AVVLLCCSGVATAAP;VVLLCCSGVATAAPK;VLLCCSGVATAAPKT;LLCCSGVATAAPKTY;LCCSGVATAAPKTYC;CCSGVATAAPKTYCE;CSGVATAAPKTYCEE;SGVATAAPKTYCEEL;GVATAAPKTYCEELK;VATAAPKTYCEELKG;ATAAPKTYCEELKGT;TAAPKTYCEELKGTD;AAPKTYCEELKGTDT;APKTYCEELKGTDTG;PKTYCEELKGTDTGQ;KTYCEELKGTDTGQA;TYCEELKGTDTGQAC;YCEELKGTDTGQACQ;CEELKGTDTGQACQI;EELKGTDTGQACQIQ;ELKGTDTGQACQIQM;LKGTDTGQACQIQMS;KGTDTGQACQIQMSD;GTDTGQACQIQMSDP;TDTGQACQIQMSDPA;DTGQACQIQMSDPAY;TGQACQIQMSDPAYN;GQACQIQMSDPAYNI;QACQIQMSDPAYNIN;ACQIQMSDPAYNINI;CQIQMSDPAYNINIS;QIQMSDPAYNINISL;IQMSDPAYNINISLP;QMSDPAYNINISLPS;MSDPAYNINISLPSY;SDPAYNINISLPSYY;DPAYNINISLPSYYP;PAYNINISLPSYYPD;AYNINISLPSYYPDQ;YNINISLPSYYPDQK;NINISLPSYYPDQKS;INISLPSYYPDQKSL;NISLPSYYPDQKSLE;ISLPSYYPDQKSLEN;SLPSYYPDQKSLENY;LPSYYPDQKSLENYI;PSYYPDQKSLENYIA;SYYPDQKSLENYIAQ;YYPDQKSLENYIAQT;YPDQKSLENYIAQTR;PDQKSLENYIAQTRD;DQKSLENYIAQTRDK;QKSLENYIAQTRDKF;KSLENYIAQTRDKFL;SLENYIAQTRDKFLS;LENYIAQTRDKFLSA;ENYIAQTRDKFLSAA;NYIAQTRDKFLSAAT;YIAQTRDKFLSAATS;IAQTRDKFLSAATSS;AQTRDKFLSAATSST;QTRDKFLSAATSSTP;TRDKFLSAATSSTPR;RDKFLSAATSSTPRE;DKFLSAATSSTPREA;KFLSAATSSTPREAP;FLSAATSSTPREAPY;LSAATSSTPREAPYE;SAATSSTPREAPYEL;AATSSTPREAPYELN;ATSSTPREAPYELNI;TSSTPREAPYELNIT;SSTPREAPYELNITS;STPREAPYELNITSA;TPREAPYELNITSAT;PREAPYELNITSATY;REAPYELNITSATYQ;EAPYELNITSATYQS;APYELNITSATYQSA;PYELNITSATYQSAI;YELNITSATYQSAIP;ELNITSATYQSAIPP;LNITSATYQSAIPPR;NITSATYQSAIPPRG;ITSATYQSAIPPRGT;TSATYQSAIPPRGTQ;SATYQSAIPPRGTQA;ATYQSAIPPRGTQAV;TYQSAIPPRGTQAVV;YQSAIPPRGTQAVVL;QSAIPPRGTQAVVLK;SAIPPRGTQAVVLKV;AIPPRGTQAVVLKVY;IPPRGTQAVVLKVYQ;PPRGTQAVVLKVYQN;PRGTQAVVLKVYQNA;RGTQAVVLKVYQNAG;GTQAVVLKVYQNAGG;TQAVVLKVYQNAGGT;QAVVLKVYQNAGGTH;AVVLKVYQNAGGTHP;VVLKVYQNAGGTHPT;VLKVYQNAGGTHPTT;LKVYQNAGGTHPTTT;KVYQNAGGTHPTTTY;VYQNAGGTHPTTTYK;YQNAGGTHPTTTYKA;QNAGGTHPTTTYKAF;NAGGTHPTTTYKAFD;AGGTHPTTTYKAFDW;GGTHPTTTYKAFDWD;GTHPTTTYKAFDWDQ;THPTTTYKAFDWDQA;HPTTTYKAFDWDQAY;PTTTYKAFDWDQAYR;TTTYKAFDWDQAYRK;TTYKAFDWDQAYRKP;TYKAFDWDQAYRKPI;YKAFDWDQAYRKPIT;KAFDWDQAYRKPITY;AFDWDQAYRKPITYD;FDWDQAYRKPITYDT;DWDQAYRKPITYDTL;WDQAYRKPITYDTLW;DQAYRKPITYDTLWQ;QAYRKPITYDTLWQA;AYRKPITYDTLWQAD;YRKPITYDTLWQADT;RKPITYDTLWQADTD;KPITYDTLWQADTDP;PITYDTLWQADTDPL;ITYDTLWQADTDPLP;TYDTLWQADTDPLPV;YDTLWQADTDPLPVV;DTLWQADTDPLPVVF;TLWQADTDPLPVVFP;LWQADTDPLPVVFPI;WQADTDPLPVVFPIV;QADTDPLPVVFPIVQ;ADTDPLPVVFPIVQG;DTDPLPVVFPIVQGE;TDPLPVVFPIVQGEL;DPLPVVFPIVQGELS;PLPVVFPIVQGELSK;LPVVFPIVQGELSKQ;PVVFPIVQGELSKQT;VVFPIVQGELSKQTG;VFPIVQGELSKQTGQ;FPIVQGELSKQTGQQ;PIVQGELSKQ | |

Fig. 30 continued

| | | |
|---|---|---|
| | TGQQV;IVQGELSKQTGQQVS;VQGELSKQTGQQVSI;QGELSKQTGQQVSIA;GELSKQTGQQVSIAP;ELSKQTGQQVSIAPN;LSKQTGQQVSIAPNA;SKQTGQQVSIAPNAG;KQTGQQVSIAPNAGL;QTGQQVSIAPNAGLD;TGQQVSIAPNAGLDP;GQQVSIAPNAGLDPV;QQVSIAPNAGLDPVN;QVSIAPNAGLDPVNY;VSIAPNAGLDPVNYQ;SIAPNAGLDPVNYQN;IAPNAGLDPVNYQNF;APNAGLDPVNYQNFA;PNAGLDPVNYQNFAV;NAGLDPVNYQNFAVT;AGLDPVNYQNFAVTN;GLDPVNYQNFAVTND;LDPVNYQNFAVTNDG;DPVNYQNFAVTNDGV;PVNYQNFAVTNDGVI;VNYQNFAVTNDGVIF;NYQNFAVTNDGVIFF;YQNFAVTNDGVIFFF;QNFAVTNDGVIFFFN;NFAVTNDGVIFFFNP;FAVTNDGVIFFFNPG;AVTNDGVIFFFNPGE;VTNDGVIFFFNPGEL;TNDGVIFFFNPGELL;NDGVIFFFNPGELLP;DGVIFFFNPGELLPE;GVIFFFNPGELLPEA;VIFFFNPGELLPEAA;IFFFNPGELLPEAAG;FFFNPGELLPEAAGP;FFNPGELLPEAAGPT;FNPGELLPEAAGPTQ;NPGELLPEAAGPTQV;PGELLPEAAGPTQVL;GELLPEAAGPTQVLV;ELLPEAAGPTQVLVP;LLPEAAGPTQVLVPR;LPEAAGPTQVLVPRS;PEAAGPTQVLVPRSA;EAAGPTQVLVPRSAI;AAGPTQVLVPRSAID;AGPTQVLVPRSAIDS;GPTQVLVPRSAIDSM;PTQVLVPRSAIDSML;TQVLVPRSAIDSMLA;<br>16 mers:<br>MRIKIFMLVTAVVLLC;RIKIFMLVTAVVLLCC;IKIFMLVTAVVLLCCS;KIFMLVTAVVLLCCSG;IFMLVTAVVLLCCSGV;FMLVTAVVLLCCSGVA;MLVTAVVLLCCSGVAT;LVTAVVLLCCSGVATA;VTAVVLLCCSGVATAA;TAVVLLCCSGVATAAP;AVVLLCCSGVATAAPK;VVLLCCSGVATAAPKT;VLLCCSGVATAAPKTY;LLCCSGVATAAPKTYC;LCCSGVATAAPKTYCE;CCSGVATAAPKTYCEE;CSGVATAAPKTYCEEL;SGVATAAPKTYCEELK;GVATAAPKTYCEELKG;VATAAPKTYCEELKGT;ATAAPKTYCEELKGTD;TAAPKTYCEELKGTDT;AAPKTYCEELKGTDTG;APKTYCEELKGTDTGQ;PKTYCEELKGTDTGQA;KTYCEELKGTDTGQAC;TYCEELKGTDTGQACQ;YCEELKGTDTGQACQI;CEELKGTDTGQACQIQ;EELKGTDTGQACQIQM;ELKGTDTGQACQIQMS;LKGTDTGQACQIQMSD;KGTDTGQACQIQMSDP;GTDTGQACQIQMSDPA;TDTGQACQIQMSDPAY;DTGQACQIQMSDPAYN;TGQACQIQMSDPAYNI;GQACQIQMSDPAYNIN;QACQIQMSDPAYNINI;ACQIQMSDPAYNINIS;CQIQMSDPAYNINISL;QIQMSDPAYNINISLP;IQMSDPAYNINISLPS;QMSDPAYNINISLPSY;MSDPAYNINISLPSYY;SDPAYNINISLPSYYP;DPAYNINISLPSYYPD;PAYNINISLPSYYPDQ;AYNINISLPSYYPDQK;YNINISLPSYYPDQKS;NINISLPSYYPDQKSL;INISLPSYYPDQKSLE;NISLPSYYPDQKSLEN;ISLPSYYPDQKSLENY;SLPSYYPDQKSLENYI;LPSYYPDQKSLENYIA;PSYYPDQKSLENYIAQ;SYYPDQKSLENYIAQT;YYPDQKSLENYIAQTR;YPDQKSLENYIAQTRD;PDQKSLENYIAQTRDK;DQKSLENYIAQTRDKF;QKSLENYIAQTRDKFL;KSLENYIAQTRDKFLS;SLENYIAQTRDKFLSA;LENYIAQTRDKFLSAA;ENYIAQTRDKFLSAAT;NYIAQTRDKFLSAATS;YIAQTRDKFLSAATSS;IAQTRDKFLSAATSST;AQTRDKFLSAATSSTP;QTRDKFLSAATSSTPR;TRDKFLSAATSSTPRE;RDKFLSAATSSTPREA;DKFLSAATSSTPREAP;KFLSAATSSTPREAPY;FLSAATSSTPREAPYE;LSAATSSTPREAPYEL;SAATSSTPREAPYELN;AATSSTPREAPYELNI;ATSSTPREAPYELNIT;TSSTPREAPYELNITS;SSTPREAPYELNITSA;STPREAPYELNITSAT;TPREAPYELNITSATY;PREAPYELNITSATYQ;REAPYELNITSATYQS;EAPYELNITSATYQSA;APYELNITSATYQSAI;PYELNITSATYQSAIP;YELNITSATYQSAIPP;ELNITSATYQSAIPPR;LNITSATYQSAIPPRG;NITSATYQSAIPPRGT;ITSATYQSAIPPRGTQ;TSATYQSAIPPRGTQA;SATYQSAIPPRGTQAV;ATYQSAIPPRGTQAVV;TYQSAIPPRGTQAVVL;YQSAIPPRGTQAVVLK;QSAIPPRGTQAVVLKV;SAIPPRGTQAVVLKVY;AIPPRGTQAVVLKVYQ;IPPRGTQAVVLKVYQN;PPRGTQAVVLKVYQNA;PRGTQAVVLKVYQNAG;RGTQAVVLKVYQNAGG;GTQAVVLKVYQNAGGT;TQAVVLKVYQNAGGTH;QAVVLKVYQNAGGTHP;AVVL | |

Fig. 30 continued

| | | |
|---|---|---|
| | KVYQNAGGTHPT;VVLKVYQNAGGTHPTT;VLKVYQNAGGTHPTTT;LKVYQNAGGTHPTTTY;KVYQNAGGTHPTTTYK;VYQNAGGTHPTTTYKA;YQNAGGTHPTTTYKAF;QNAGGTHPTTTYKAFD;NAGGTHPTTTYKAFDW;AGGTHPTTTYKAFDWD;GGTHPTTTYKAFDWDQ;GTHPTTTYKAFDWDQA;THPTTTYKAFDWDQAY;HPTTTYKAFDWDQAYR;PTTTYKAFDWDQAYRK;TTTYKAFDWDQAYRKP;TTYKAFDWDQAYRKPI;TYKAFDWDQAYRKPIT;YKAFDWDQAYRKPITY;KAFDWDQAYRKPITYD;AFDWDQAYRKPITYDT;FDWDQAYRKPITYDTL;DWDQAYRKPITYDTLW;WDQAYRKPITYDTLWQ;DQAYRKPITYDTLWQA;QAYRKPITYDTLWQAD;AYRKPITYDTLWQADT;YRKPITYDTLWQADTD;RKPITYDTLWQADTDP;KPITYDTLWQADTDPL;PITYDTLWQADTDPLP;ITYDTLWQADTDPLPV;TYDTLWQADTDPLPVV;YDTLWQADTDPLPVVF;DTLWQADTDPLPVVFP;TLWQADTDPLPVVFPI;LWQADTDPLPVVFPIV;WQADTDPLPVVFPIVQ;QADTDPLPVVFPIVQG;ADTDPLPVVFPIVQGE;DTDPLPVVFPIVQGEL;TDPLPVVFPIVQGELS;DPLPVVFPIVQGELSK;PLPVVFPIVQGELSKQ;LPVVFPIVQGELSKQT;PVVFPIVQGELSKQTG;VVFPIVQGELSKQTGQ;VFPIVQGELSKQTGQQ;FPIVQGELSKQTGQQV;PIVQGELSKQTGQQVS;IVQGELSKQTGQQVSI;VQGELSKQTGQQVSIA;QGELSKQTGQQVSIAP;GELSKQTGQQVSIAPN;ELSKQTGQQVSIAPNA;LSKQTGQQVSIAPNAG;SKQTGQQVSIAPNAGL;KQTGQQVSIAPNAGLD;QTGQQVSIAPNAGLDP;TGQQVSIAPNAGLDPV;GQQVSIAPNAGLDPVN;QQVSIAPNAGLDPVNY;QVSIAPNAGLDPVNYQ;VSIAPNAGLDPVNYQN;SIAPNAGLDPVNYQNF;IAPNAGLDPVNYQNFA;APNAGLDPVNYQNFAV;PNAGLDPVNYQNFAVT;NAGLDPVNYQNFAVTN;AGLDPVNYQNFAVTND;GLDPVNYQNFAVTNDG;LDPVNYQNFAVTNDGV;DPVNYQNFAVTNDGVI;PVNYQNFAVTNDGVIF;VNYQNFAVTNDGVIFF;NYQNFAVTNDGVIFFF;YQNFAVTNDGVIFFFN;QNFAVTNDGVIFFFNP;NFAVTNDGVIFFFNPG;FAVTNDGVIFFFNPGE;AVTNDGVIFFFNPGEL;VTNDGVIFFFNPGELL;TNDGVIFFFNPGELLP;NDGVIFFFNPGELLPE;DGVIFFFNPGELLPEA;GVIFFFNPGELLPEAA;VIFFFNPGELLPEAAG;IFFFNPGELLPEAAGP;FFFNPGELLPEAAGPT;FFNPGELLPEAAGPTQ;FNPGELLPEAAGPTQV;NPGELLPEAAGPTQVL;PGELLPEAAGPTQVLV;GELLPEAAGPTQVLVP;ELLPEAAGPTQVLVPR;LLPEAAGPTQVLVPRS;LPEAAGPTQVLVPRSA;PEAAGPTQVLVPRSAI;EAAGPTQVLVPRSAID;AAGPTQVLVPRSAIDS;AGPTQVLVPRSAIDSM;GPTQVLVPRSAIDSML;PTQVLVPRSAIDSMLA | |
| 17 | **<NP_214593.1 hypothetical protein Rv0079;Mycobacterium tuberculosis H37Rv>**<br>MEPKRSRLVVCAPEPSHAREFPDVAVFSGGRANASQAERLARAVGRVLADRGVTGGARVRLTMANCADGPTLVQINLQVGDTPLRAQAATAGIDDLRPALIRLDRQIVRASAQWCPRPWPDRPRRRLTTPAEALVTRRKPVVLRRATPLQAIAAMDAMDYDVHLFTDAETGEDAVVYRAGPSGLRLARQHHVFPPGWSRCRAPAGPPVPLIVNSRPTPVLTEAAAVDRAREHGLPFLFFTDQATGRGQLLYSRYDGNLGLITPTGDGVADGLA<br><br>8mer<br>RSRLVVCA;EPSHAREF;REFPDVAV;EFPDVAVF;FPDVAVFS;VAVFSGGR;SQAERLAR;AERLARAV;RLARAVGR;LARAVGRV;ARAVGRVL;RAVGRVLA;RVLADRGV;VLADRGVT;GVTGGARV;VTGGARVR;GARVRLTM;RVRLTMAN;RLTMANCA;NCADGPTL;CADGPTLV;TLVQINLQ;LVQINLQV;LQVGDTPL;QVGDTPLR;TPLRAQAA;AQAATAGI;ATAGIDDL;TAGIDDLR;GIDDLRPA;DLRPALIR;RLDRQIVR;RQIVRASA;IVRASAQW;ASAQWCPR;RPWPDRPR;RPRRRLTT;RRRLTTPA;RRLTTPAE;RLTTPAEA;LTTPAEAL;TTPAEALV;TPAEALVT;EALVTRRK;LVTRRKPV;RRKPVVLR;KPVVLRRA;VLRRATPL;RATPLQAI;TPLQAIAA;PLQAIAAM;AIAAMDAM;AAMDAMDY;DAMDYDVH;AM | 137390-138743 |

Fig. 30 continued

| | | |
|---|---|---|
| | DYDVHL;HLFTDAET;AETGEDAV;ETGEDAVV;TGEDAVVY;EDAVVYRA;YRAGPSGL;RAGPSGLR;RLARQHHV;LARQHHVF;VFPPGWSR;FPPGWSRC;RAPAGPPV;GPPVPLIV;TPVLTEAA;VLTEAAAV;TEAAAVDR;EAAAVDRA;REHGLPFL;GLPFLFFT;LPFLFFTD;FLFFTDQA;FTDQATGR;RGQLLYSR;GQLLYSRY;RYDGNLGL;NLGLITPT;ITPTGDGV;TPTGDGVA<br>9mer<br>EPKRSRLVV;CAPEPSHAR;REFPDVAVF;FPDVAVFSG;DVAVFSGGR;RANASQAER;ASQAERLAR;SQAERLARA;RLARAVGRV;LARAVGRVL;AVGRVLADR;VLADRGVTG;GVTGGARVR;VTGGARVRL;GARVRLTMA;MANCADGPT;NCADGPTLV;TLVQINLQV;NLQVGDTPL;LQVGDTPLR;QVGDTPLRA;TPLRAQAAT;RAQAATAGI;ATAGIDDLR;GIDDLRPAL;DLRPALIRL;ALIRLDRQI;LIRLDRQIV;RLDRQIVRA;RQIVRASAQ;QIVRASAQW;RASAQWCPR;SAQWCPRPW;RPWPDRPRR;WPDRPRRRL;RPRRRLTTP;RRRLTTPAE;RRLTTPAEA;RLTTPAEAL;LTTPAEALV;TPAEALVTR;ALVTRRKPV;LVTRRKPVV;VTRRKPVVL;RRKPVVLRR;KPVVLRRAT;VVLRRATPL;VLRRATPLQ;TPLQAIAAM;QAIAAMDAM;IAAMDAMDY;AMDAMDYDV;DAMDYDVHL;AMDYDVHLF;AETGEDAVV;ETGEDAVVY;TGEDAVVYR;VYRAGPSGL;YRAGPSGLR;RAGPSGLRL;RLARQHHVF;HVFPPGWSR;APAGPPVPL;IVNSRPTPV;RPTPVLTEA;TPVLTEAAA;PVLTEAAAV;LTEAAAVDR;EAAAVDRAR;RAREHGLPF;REHGLPFLF;LPFLFFTDQ;FLFFTDQAT;FFTDQATGR;ATGRGQLLY;GRGQLLYSR;LYSRYDGNL;SRYDGNLGL;RYDGNLGLI;LITPTGDGV<br>10mer<br>RSRLVVCAPE;APEPSHAREF;HAREFPDVAV;REFPDVAVFS;FPDVAVFSGG;DVAVFSGGRA;GRANASQAER;RANASQAERL;NASQAERLAR;SQAERLARAV;AERLARAVGR;RLARAVGRVL;RAVGRVLADR;VLADRGVTGG;GVTGGARVRL;RVRLTMANCA;TMANCADGPT;MANCADGPTL;CADGPTLVQI;PTLVQINLQV;NLQVGDTPLR;LQVGDTPLRA;TPLRAQAATA;AATAGIDDLR;GIDDLRPALI;ALIRLDRQIV;LIRLDRQIVR;RLDRQIVRAS;RQIVRASAQW;ASAQWCPRPW;WPDRPRRRLT;RPRRRLTTPA;RRLTTPAEAL;RLTTPAEALV;TTPAEALVTR;TPAEALVTRR;EALVTRRKPV;ALVTRRKPVV;VTRRKPVVLR;TRRKPVVLRR;KPVVLRRATP;VLRRATPLQA;ATPLQAIAAM;LQAIAAMDAM;AIAAMDAMDY;AAMDAMDYDV;DAMDYDVHLF;AMDYDVHLFT;AETGEDAVVY;ETGEDAVVYR;VVYRAGPSGL;YRAGPSGLRL;GLRLARQHHV;RQHHVFPPGW;FPPGWSRCRA;RCRAPAGPPV;RAPAGPPVPL;APAGPPVPLI;PAGPPVPLIV;VPLIVNSRPT;LIVNSRPTPV;IVNSRPTPVL;RPTPVLTEAA;TPVLTEAAAV;VLTEAAAVDR;AVDRAREHGL;RAREHGLPFL;REHGLPFLFF;LPFLFFTDQA;FLFFTDQATG;LFFTDQATGR;GRGQLLYSRY;LLYSRYDGNL;GLITPTGDGV<br>11mer<br>RSRLVVCAPEP;LVVCAPEPSHA;VVCAPEPSHAR;HAREFPDVAVF;QAERLARAVGR;AERLARAVGRV;RLARAVGRVLA;AVGRVLADRGV;VLADRGVTGGA;LTMANCADGPT;TMANCADGPTL;MANCADGPTLV;NCADGPTLVQI;QINLQVGDTPL;NLQVGDTPLRA;QVGDTPLRAQA;TPLRAQAATAG;PLRAQAATAGI;AQAATAGIDDL;QAATAGIDDLR;ATAGIDDLRPA;TAGIDDLRPAL;DLRPALIRLDR;RPALIRLDRQI;ALIRLDRQIVR;RLDRQIVRASA;RQIVRASAQWC;IVRASAQWCPR;RASAQWCPRPW;AQWCPRPWPDR;RPWPDRPRRRL;WPDRPRRRLTT;RPRRRLTTPAE;RRRLTTPAEAL;RRLTTPAEALV;LTTPAEALVTR;TTPAEALVTRR;TPAEALVTRRK;AEALVTRRKPV;EALVTRRKPVV;ALVTRRKPVVL;LVTRRKPVVLR;VTRRKPVVLRR;KPVVLRRATPL;VLRRATPLQAI;RATPLQAIAAM;TPLQAIAAMDA;QAIAAMDAMDY;AMDAMDYDVHL;FTDAETGEDAV;DAETGEDAVVY;ETGEDAVVYRA;AVVYRAGPSGL;VVYRAGPSGLR;VYRAGPSGLRL;RAGPSGLRLAR;GLRLARQHHVF;HVFPPGWSRCR;FPPGWSRCRAP;PPGWSRCRAPA;APAGPPVPLIV;PLIVNSRPT | |

Fig. 30 continued

| | | |
|---|---|---|
| | PV;LIVNSRPTPVL;RPTPVLTEAAA;VLTEAAAVDRA;LTEAAAVDRAR;AAVDRAREHGL;RAREHGLPFLF;REHGLPFLFFT;GLPFLFFTDQA;LPFLFFTDQAT;FLFFTDQATGR;FTDQATGRGQL;ATGRGQLLYSR;QLLYSRYDGNL;LYSRYDGNLGL;GLITPTGDGVA;TPTGDGVADGL<br><br>13 mers:<br>MEPKRSRLVVCAP;EPKRSRLVVCAPE;PKRSRLVVCAPEP;KRSRLVVCAPEPS;RSRLVVCAPEPSH;SRLVVCAPEPSHA;RLVVCAPEPSHAR;LVVCAPEPSHARE;VVCAPEPSHAREF;VCAPEPSHAREFP;CAPEPSHAREFPD;APEPSHAREFPDV;PEPSHAREFPDVA;EPSHAREFPDVAV;PSHAREFPDVAVF;SHAREFPDVAVFS;HAREFPDVAVFSG;AREFPDVAVFSGG;REFPDVAVFSGGR;EFPDVAVFSGGRA;FPDVAVFSGGRAN;PDVAVFSGGRANA;DVAVFSGGRANAS;VAVFSGGRANASQ;AVFSGGRANASQA;VFSGGRANASQAE;FSGGRANASQAER;SGGRANASQAERL;GGRANASQAERLA;GRANASQAERLAR;RANASQAERLARA;ANASQAERLARAV;NASQAERLARAVG;ASQAERLARAVGR;SQAERLARAVGRV;QAERLARAVGRVL;AERLARAVGRVLA;ERLARAVGRVLAD;RLARAVGRVLADR;LARAVGRVLADRG;ARAVGRVLADRGV;RAVGRVLADRGVT;AVGRVLADRGVTG;VGRVLADRGVTGG;GRVLADRGVTGGA;RVLADRGVTGGAR;VLADRGVTGGARV;LADRGVTGGARVR;ADRGVTGGARVRL;DRGVTGGARVRLT;RGVTGGARVRLTM;GVTGGARVRLTMA;VTGGARVRLTMAN;TGGARVRLTMANC;GGARVRLTMANCA;GARVRLTMANCAD;ARVRLTMANCADG;RVRLTMANCADGP;VRLTMANCADGPT;RLTMANCADGPTL;LTMANCADGPTLV;TMANCADGPTLVQ;MANCADGPTLVQI;ANCADGPTLVQIN;NCADGPTLVQINL;CADGPTLVQINLQ;ADGPTLVQINLQV;DGPTLVQINLQVG;GPTLVQINLQVGD;PTLVQINLQVGDT;TLVQINLQVGDTP;LVQINLQVGDTPL;VQINLQVGDTPLR;QINLQVGDTPLRA;INLQVGDTPLRAQ;NLQVGDTPLRAQA;LQVGDTPLRAQAA;QVGDTPLRAQAAT;VGDTPLRAQAATA;GDTPLRAQAATAG;DTPLRAQAATAGI;TPLRAQAATAGID;PLRAQAATAGIDD;LRAQAATAGIDDL;RAQAATAGIDDLR;AQAATAGIDDLRP;QAATAGIDDLRPA;AATAGIDDLRPAL;ATAGIDDLRPALI;TAGIDDLRPALIR;AGIDDLRPALIRL;GIDDLRPALIRLD;IDDLRPALIRLDR;DDLRPALIRLDRQ;DLRPALIRLDRQI;LRPALIRLDRQIV;RPALIRLDRQIVR;PALIRLDRQIVRA;ALIRLDRQIVRAS;LIRLDRQIVRASA;IRLDRQIVRASAQ;RLDRQIVRASAQW;LDRQIVRASAQWC;DRQIVRASAQWCP;RQIVRASAQWCPR;QIVRASAQWCPRP;IVRASAQWCPRPW;VRASAQWCPRPWP;RASAQWCPRPWPD;ASAQWCPRPWPDR;SAQWCPRPWPDRP;AQWCPRPWPDRPR;QWCPRPWPDRPRR;WCPRPWPDRPRRR;CPRPWPDRPRRRL;PRPWPDRPRRRLT;RPWPDRPRRRLTT;PWPDRPRRRLTTP;WPDRPRRRLTTPA;PDRPRRRLTTPAE;DRPRRRLTTPAEA;RPRRRLTTPAEAL;PRRRLTTPAEALV;RRRLTTPAEALVT;RRLTTPAEALVTR;RLTTPAEALVTRR;LTTPAEALVTRRK;TTPAEALVTRRKP;TPAEALVTRRKPV;PAEALVTRRKPVV;AEALVTRRKPVVL;EALVTRRKPVVLR;ALVTRRKPVVLRR;LVTRRKPVVLRRA;VTRRKPVVLRRAT;TRRKPVVLRRATP;RRKPVVLRRATPL;RKPVVLRRATPLQ;KPVVLRRATPLQA;PVVLRRATPLQAI;VVLRRATPLQAIA;VLRRATPLQAIAA;LRRATPLQAIAAM;RRATPLQAIAAMD;RATPLQAIAAMDA;ATPLQAIAAMDAM;TPLQAIAAMDAMD;PLQAIAAMDAMDY;LQAIAAMDAMDYD;QAIAAMDAMDYDV;AIAAMDAMDYDVH;IAAMDAMDYDVHL;AAMDAMDYDVHLF;AMDAMDYDVHLFT;MDAMDYDVHLFTD;DAMDYDVHLFTDA;AMDYDVHLFTDAE;MDYDVHLFTDAET;DYDVHLFTDAETG;YDVHLFTDAETGE;DVHLFTDAETGED;VHLFTDAETGEDA;HLFTDAETGEDAV;LFTDAETGEDAVV;FTDAETGEDAVVY;TDAETGEDAVVYR;DAETGEDAVVYRA;AETGEDAVVYRAG;ETGEDAVVYRAGP;TGEDAVVYRAGPS;GEDAVVYRAGPSG;EDAVVYRAGPSGL;DAVVYRAGPSGLR;AVVYRAGPSGLRL;VVYRAGPSGLRLA;VYRAG | |

Fig. 30 continued

| | | |
|---|---|---|
| | PSGLRLAR;YRAGPSGLRLARQ;RAGPSGLRLARQH;AGPSGLRLARQHH;GPSGLRLARQHHV;PSGLRLARQHHVF;SGLRLARQHHVFP;GLRLARQHHVFPP;LRLARQHHVFPPG;RLARQHHVFPPGW;LARQHHVFPPGWS;ARQHHVFPPGWSR;RQHHVFPPGWSRC;QHHVFPPGWSRCR;HHVFPPGWSRCRA;HVFPPGWSRCRAP;VFPPGWSRCRAPA;FPPGWSRCRAPAG;PPGWSRCRAPAGP;PGWSRCRAPAGPP;GWSRCRAPAGPPV;WSRCRAPAGPPVP;SRCRAPAGPPVPL;RCRAPAGPPVPLI;CRAPAGPPVPLIV;RAPAGPPVPLIVN;APAGPPVPLIVNS;PAGPPVPLIVNSR;AGPPVPLIVNSRP;GPPVPLIVNSRPT;PPVPLIVNSRPTP;PVPLIVNSRPTPV;VPLIVNSRPTPVL;PLIVNSRPTPVLT;LIVNSRPTPVLTE;IVNSRPTPVLTEA;VNSRPTPVLTEAA;NSRPTPVLTEAAA;SRPTPVLTEAAAV;RPTPVLTEAAAVD;PTPVLTEAAAVDR;TPVLTEAAAVDRA;PVLTEAAAVDRAR;VLTEAAAVDRARE;LTEAAAVDRAREH;TEAAAVDRAREHG;EAAAVDRAREHGL;AAAVDRAREHGLP;AAVDRAREHGLPF;AVDRAREHGLPFL;VDRAREHGLPFLF;DRAREHGLPFLFF;RAREHGLPFLFFT;AREHGLPFLFFTD;REHGLPFLFFTDQ;EHGLPFLFFTDQA;HGLPFLFFTDQAT;GLPFLFFTDQATG;LPFLFFTDQATGR;PFLFFTDQATGRG;FLFFTDQATGRGQ;LFFTDQATGRGQL;FFTDQATGRGQLL;FTDQATGRGQLLY;TDQATGRGQLLYS;DQATGRGQLLYSR;QATGRGQLLYSRY;ATGRGQLLYSRYD;TGRGQLLYSRYDG;GRGQLLYSRYDGN;RGQLLYSRYDGNL;GQLLYSRYDGNLG;QLLYSRYDGNLGL;LLYSRYDGNLGLI;LYSRYDGNLGLIT;YSRYDGNLGLITP;SRYDGNLGLITPT;RYDGNLGLITPTG;YDGNLGLITPTGD;DGNLGLITPTGDG;GNLGLITPTGDGV;NLGLITPTGDGVA;LGLITPTGDGVAD;GLITPTGDGVADG;LITPTGDGVADGL;ITPTGDGVADGLA;<br>14 mers:<br>MEPKRSRLVVCAPE;EPKRSRLVVCAPEP;PKRSRLVVCAPEPS;KRSRLVVCAPEPSH;RSRLVVCAPEPSHA;SRLVVCAPEPSHAR;RLVVCAPEPSHARE;LVVCAPEPSHAREF;VVCAPEPSHAREFP;VCAPEPSHAREFPD;CAPEPSHAREFPDV;APEPSHAREFPDVA;PEPSHAREFPDVAV;EPSHAREFPDVAVF;PSHAREFPDVAVFS;SHAREFPDVAVFSG;HAREFPDVAVFSGG;AREFPDVAVFSGGR;REFPDVAVFSGGRA;EFPDVAVFSGGRAN;FPDVAVFSGGRANA;PDVAVFSGGRANAS;DVAVFSGGRANASQ;VAVFSGGRANASQA;AVFSGGRANASQAE;VFSGGRANASQAER;FSGGRANASQAERL;SGGRANASQAERLA;GGRANASQAERLAR;GRANASQAERLARA;RANASQAERLARAV;ANASQAERLARAVG;NASQAERLARAVGR;ASQAERLARAVGRV;SQAERLARAVGRVL;QAERLARAVGRVLA;AERLARAVGRVLAD;ERLARAVGRVLADR;RLARAVGRVLADRG;LARAVGRVLADRGV;ARAVGRVLADRGVT;RAVGRVLADRGVTG;AVGRVLADRGVTGG;VGRVLADRGVTGGA;GRVLADRGVTGGAR;RVLADRGVTGGARV;VLADRGVTGGARVR;LADRGVTGGARVRL;ADRGVTGGARVRLT;DRGVTGGARVRLTM;RGVTGGARVRLTMA;GVTGGARVRLTMAN;VTGGARVRLTMANC;TGGARVRLTMANCA;GGARVRLTMANCAD;GARVRLTMANCADG;ARVRLTMANCADGP;RVRLTMANCADGPT;VRLTMANCADGPTL;RLTMANCADGPTLV;LTMANCADGPTLVQ;TMANCADGPTLVQI;MANCADGPTLVQIN;ANCADGPTLVQINL;NCADGPTLVQINLQ;CADGPTLVQINLQV;ADGPTLVQINLQVG;DGPTLVQINLQVGD;GPTLVQINLQVGDT;PTLVQINLQVGDTP;TLVQINLQVGDTPL;LVQINLQVGDTPLR;VQINLQVGDTPLRA;QINLQVGDTPLRAQ;INLQVGDTPLRAQA;NLQVGDTPLRAQAA;LQVGDTPLRAQAAT;QVGDTPLRAQAATA;VGDTPLRAQAATAG;GDTPLRAQAATAGI;DTPLRAQAATAGID;TPLRAQAATAGIDD;PLRAQAATAGIDDL;LRAQAATAGIDDLR;RAQAATAGIDDLRP;AQAATAGIDDLRPA;QAATAGIDDLRPAL;AATAGIDDLRPALI;ATAGIDDLRPALIR;TAGIDDLRPALIRL;AGIDDLRPALIRLD;GIDDLRPALIRLDR;IDDLRPALIRLDRQ;DDLRPALIRLDRQI;DLRPALIRLDRQIV;LRPALIRLDRQIVR;RPALIRLDRQIVRA;PALIRLDRQIVRAS;ALIRLDRQIVRASA;LIRLDRQIVRASAQ;IRLDRQIVRASAQW;RLD | |

Fig. 30 continued

| | | |
|---|---|---|
| | RQIVRASAQWC;LDRQIVRASAQWCP;DRQIVRASAQWCPR;RQIVRASAQWCPRP;QIVRASAQWCPRPW;IVRASAQWCPRPWP;VRASAQWCPRPWPD;RASAQWCPRPWPDR;ASAQWCPRPWPDRP;SAQWCPRPWPDRPR;AQWCPRPWPDRPRR;QWCPRPWPDRPRRR;WCPRPWPDRPRRRL;CPRPWPDRPRRRLT;PRPWPDRPRRRLTT;RPWPDRPRRRLTTP;PWPDRPRRRLTTPA;WPDRPRRRLTTPAE;PDRPRRRLTTPAEA;DRPRRRLTTPAEAL;RPRRRLTTPAEALV;PRRRLTTPAEALVT;RRRLTTPAEALVTR;RRLTTPAEALVTRR;RLTTPAEALVTRRK;LTTPAEALVTRRKP;TTPAEALVTRRKPV;TPAEALVTRRKPVV;PAEALVTRRKPVVL;AEALVTRRKPVVLR;EALVTRRKPVVLRR;ALVTRRKPVVLRRA;LVTRRKPVVLRRAT;VTRRKPVVLRRATP;TRRKPVVLRRATPL;RRKPVVLRRATPLQ;RKPVVLRRATPLQA;KPVVLRRATPLQAI;PVVLRRATPLQAIA;VVLRRATPLQAIAA;VLRRATPLQAIAAM;LRRATPLQAIAAMD;RRATPLQAIAAMDA;RATPLQAIAAMDAM;ATPLQAIAAMDAMD;TPLQAIAAMDAMDY;PLQAIAAMDAMDYD;LQAIAAMDAMDYDV;QAIAAMDAMDYDVH;AIAAMDAMDYDVHL;IAAMDAMDYDVHLF;AAMDAMDYDVHLFT;AMDAMDYDVHLFTD;MDAMDYDVHLFTDA;DAMDYDVHLFTDAE;AMDYDVHLFTDAET;MDYDVHLFTDAETG;DYDVHLFTDAETGE;YDVHLFTDAETGED;DVHLFTDAETGEDA;VHLFTDAETGEDAV;HLFTDAETGEDAVV;LFTDAETGEDAVVY;FTDAETGEDAVVYR;TDAETGEDAVVYRA;DAETGEDAVVYRAG;AETGEDAVVYRAGP;ETGEDAVVYRAGPS;TGEDAVVYRAGPSG;GEDAVVYRAGPSGL;EDAVVYRAGPSGLR;DAVVYRAGPSGLRL;AVVYRAGPSGLRLA;VVYRAGPSGLRLAR;VYRAGPSGLRLARQ;YRAGPSGLRLARQH;RAGPSGLRLARQHH;AGPSGLRLARQHHV;GPSGLRLARQHHVF;PSGLRLARQHHVFP;SGLRLARQHHVFPP;GLRLARQHHVFPPG;LRLARQHHVFPPGW;RLARQHHVFPPGWS;LARQHHVFPPGWSR;ARQHHVFPPGWSRC;RQHHVFPPGWSRCR;QHHVFPPGWSRCRA;HHVFPPGWSRCRAP;HVFPPGWSRCRAPA;VFPPGWSRCRAPAG;FPPGWSRCRAPAGP;PPGWSRCRAPAGPP;PGWSRCRAPAGPPV;GWSRCRAPAGPPVP;WSRCRAPAGPPVPL;SRCRAPAGPPVPLI;RCRAPAGPPVPLIV;CRAPAGPPVPLIVN;RAPAGPPVPLIVNS;APAGPPVPLIVNSR;PAGPPVPLIVNSRP;AGPPVPLIVNSRPT;GPPVPLIVNSRPTP;PPVPLIVNSRPTPV;PVPLIVNSRPTPVL;VPLIVNSRPTPVLT;PLIVNSRPTPVLTE;LIVNSRPTPVLTEA;IVNSRPTPVLTEAA;VNSRPTPVLTEAAA;NSRPTPVLTEAAAV;SRPTPVLTEAAAVD;RPTPVLTEAAAVDR;PTPVLTEAAAVDRA;TPVLTEAAAVDRAR;PVLTEAAAVDRARE;VLTEAAAVDRAREH;LTEAAAVDRAREHG;TEAAAVDRAREHGL;EAAAVDRAREHGLP;AAAVDRAREHGLPF;AAVDRAREHGLPFL;AVDRAREHGLPFLF;VDRAREHGLPFLFF;DRAREHGLPFLFFT;RAREHGLPFLFFTD;AREHGLPFLFFTDQ;REHGLPFLFFTDQA;EHGLPFLFFTDQAT;HGLPFLFFTDQATG;GLPFLFFTDQATGR;LPFLFFTDQATGRG;PFLFFTDQATGRGQ;FLFFTDQATGRGQL;LFFTDQATGRGQLL;FFTDQATGRGQLLY;FTDQATGRGQLLYS;TDQATGRGQLLYSR;DQATGRGQLLYSRY;QATGRGQLLYSRYD;ATGRGQLLYSRYDG;TGRGQLLYSRYDGN;GRGQLLYSRYDGNL;RGQLLYSRYDGNLG;GQLLYSRYDGNLGL;QLLYSRYDGNLGLI;LLYSRYDGNLGLIT;LYSRYDGNLGLITP;YSRYDGNLGLITPT;SRYDGNLGLITPTG;RYDGNLGLITPTGD;YDGNLGLITPTGDG;DGNLGLITPTGDGV;GNLGLITPTGDGVA;NLGLITPTGDGVAD;LGLITPTGDGVADG;GLITPTGDGVADGL;LITPTGDGVADGLA;<br>15 mers:<br>MEPKRSRLVVCAPEP;EPKRSRLVVCAPEPS;PKRSRLVVCAPEPSH;KRSRLVVCAPEPSHA;RSRLVVCAPEPSHAR;SRLVVCAPEPSHARE;RLVVCAPEPSHAREF;LVVCAPEPSHAREFP;VVCAPEPSHAREFPD;VCAPEPSHAREFPDV;CAPEPSHAREFPDVA;APEPSHAREFPDVAV;PEPSHAREFPDVAVF;EPSHAREFPDVAVFS;PSHAREFPDVAVFSG;SHAREFPDVAVFSGG;HAREFPDVAVFSGGR;AREFPDVAVFSGGRA;REFPDVAVFSGGRAN;EFPDVA | |

Fig. 30 continued

| | | |
|---|---|---|
| | VFSGGRANA;FPDVAVFSGGRANAS;PDVAVFSGGRANASQ;DVAVFSGGRANASQA;VAVFSGGRANASQAE;AVFSGGRANASQAER;VFSGGRANASQAERL;FSGGRANASQAERLA;SGGRANASQAERLAR;GGRANASQAERLARA;GRANASQAERLARAV;RANASQAERLARAVG;ANASQAERLARAVGR;NASQAERLARAVGRV;ASQAERLARAVGRVL;SQAERLARAVGRVLA;QAERLARAVGRVLAD;AERLARAVGRVLADR;ERLARAVGRVLADRG;RLARAVGRVLADRGV;LARAVGRVLADRGVT;ARAVGRVLADRGVTG;RAVGRVLADRGVTGG;AVGRVLADRGVTGGA;VGRVLADRGVTGGAR;GRVLADRGVTGGARV;RVLADRGVTGGARVR;VLADRGVTGGARVRL;LADRGVTGGARVRLT;ADRGVTGGARVRLTM;DRGVTGGARVRLTMA;RGVTGGARVRLTMAN;GVTGGARVRLTMANC;VTGGARVRLTMANCA;TGGARVRLTMANCAD;GGARVRLTMANCADG;GARVRLTMANCADGP;ARVRLTMANCADGPT;RVRLTMANCADGPTL;VRLTMANCADGPTLV;RLTMANCADGPTLVQ;LTMANCADGPTLVQI;TMANCADGPTLVQIN;MANCADGPTLVQINL;ANCADGPTLVQINLQ;NCADGPTLVQINLQV;CADGPTLVQINLQVG;ADGPTLVQINLQVGD;DGPTLVQINLQVGDT;GPTLVQINLQVGDTP;PTLVQINLQVGDTPL;TLVQINLQVGDTPLR;LVQINLQVGDTPLRA;VQINLQVGDTPLRAQ;QINLQVGDTPLRAQA;INLQVGDTPLRAQAA;NLQVGDTPLRAQAAT;LQVGDTPLRAQAATA;QVGDTPLRAQAATAG;VGDTPLRAQAATAGI;GDTPLRAQAATAGID;DTPLRAQAATAGIDD;TPLRAQAATAGIDDL;PLRAQAATAGIDDLR;LRAQAATAGIDDLRP;RAQAATAGIDDLRPA;AQAATAGIDDLRPAL;QAATAGIDDLRPALI;AATAGIDDLRPALIR;ATAGIDDLRPALIRL;TAGIDDLRPALIRLD;AGIDDLRPALIRLDR;GIDDLRPALIRLDRQ;IDDLRPALIRLDRQI;DDLRPALIRLDRQIV;DLRPALIRLDRQIVR;LRPALIRLDRQIVRA;RPALIRLDRQIVRAS;PALIRLDRQIVRASA;ALIRLDRQIVRASAQ;LIRLDRQIVRASAQW;IRLDRQIVRASAQWC;RLDRQIVRASAQWCP;LDRQIVRASAQWCPR;DRQIVRASAQWCPRP;RQIVRASAQWCPRPW;QIVRASAQWCPRPWP;IVRASAQWCPRPWPD;VRASAQWCPRPWPDR;RASAQWCPRPWPDRP;ASAQWCPRPWPDRPR;SAQWCPRPWPDRPRR;AQWCPRPWPDRPRRR;QWCPRPWPDRPRRRL;WCPRPWPDRPRRRLT;CPRPWPDRPRRRLTT;PRPWPDRPRRRLTTP;RPWPDRPRRRLTTPA;PWPDRPRRRLTTPAE;WPDRPRRRLTTPAEA;PDRPRRRLTTPAEAL;DRPRRRLTTPAEALV;RPRRRLTTPAEALVT;PRRRLTTPAEALVTR;RRRLTTPAEALVTRR;RRLTTPAEALVTRRK;RLTTPAEALVTRRKP;LTTPAEALVTRRKPV;TTPAEALVTRRKPVV;TPAEALVTRRKPVVL;PAEALVTRRKPVVLR;AEALVTRRKPVVLRR;EALVTRRKPVVLRRA;ALVTRRKPVVLRRAT;LVTRRKPVVLRRATP;VTRRKPVVLRRATPL;TRRKPVVLRRATPLQ;RRKPVVLRRATPLQA;RKPVVLRRATPLQAI;KPVVLRRATPLQAIA;PVVLRRATPLQAIAA;VVLRRATPLQAIAAM;VLRRATPLQAIAAMD;LRRATPLQAIAAMDA;RRATPLQAIAAMDAM;RATPLQAIAAMDAMD;ATPLQAIAAMDAMDY;TPLQAIAAMDAMDYD;PLQAIAAMDAMDYDV;LQAIAAMDAMDYDVH;QAIAAMDAMDYDVHL;AIAAMDAMDYDVHLF;IAAMDAMDYDVHLFT;AAMDAMDYDVHLFTD;AMDAMDYDVHLFTDA;MDAMDYDVHLFTDAE;DAMDYDVHLFTDAET;AMDYDVHLFTDAETG;MDYDVHLFTDAETGE;DYDVHLFTDAETGED;YDVHLFTDAETGEDA;DVHLFTDAETGEDAV;VHLFTDAETGEDAVV;HLFTDAETGEDAVVY;LFTDAETGEDAVVYR;FTDAETGEDAVVYRA;TDAETGEDAVVYRAG;DAETGEDAVVYRAGP;AETGEDAVVYRAGPS;ETGEDAVVYRAGPSG;TGEDAVVYRAGPSGL;GEDAVVYRAGPSGLR;EDAVVYRAGPSGLRL;DAVVYRAGPSGLRLA;AVVYRAGPSGLRLAR;VVYRAGPSGLRLARQ;VYRAGPSGLRLARQH;YRAGPSGLRLARQHH;RAGPSGLRLARQHHV;AGPSGLRLARQHHVF;GPSGLRLARQHHVFP;PSGLRLARQHHVFPP;SGLRLARQHHVFPPG;GLRLARQHHVFPPGW;LRLARQHHVFPPGWS;RLARQHHVFPPGWSR;LARQHHVFPPGWSRC;ARQHHVFPPGWSRCR;RQHHVFPPGWSRCRA;QHHVFPPGWSRCRAP;HHVFPPGWSRCRAPA;HVFPPGWSRCRAP | |

Fig. 30 continued

| | | |
|---|---|---|
| | AG;VFPPGWSRCRAPAGP;FPPGWSRCRAPAGPP;PPGWSRCRAPAGPPV;PGWSRCRAPAGPPVP;GWSRCRAPAGPPVPL;WSRCRAPAGPPVPLI;SRCRAPAGPPVPLIV;RCRAPAGPPVPLIVN;CRAPAGPPVPLIVNS;RAPAGPPVPLIVNSR;APAGPPVPLIVNSRP;PAGPPVPLIVNSRPT;AGPPVPLIVNSRPTP;GPPVPLIVNSRPTPV;PPVPLIVNSRPTPVL;PVPLIVNSRPTPVLT;VPLIVNSRPTPVLTE;PLIVNSRPTPVLTEA;LIVNSRPTPVLTEAA;IVNSRPTPVLTEAAA;VNSRPTPVLTEAAAV;NSRPTPVLTEAAAVD;SRPTPVLTEAAAVDR;RPTPVLTEAAAVDRA;PTPVLTEAAAVDRAR;TPVLTEAAAVDRARE;PVLTEAAAVDRAREH;VLTEAAAVDRAREHG;LTEAAAVDRAREHGL;TEAAAVDRAREHGLP;EAAAVDRAREHGLPF;AAAVDRAREHGLPFL;AAVDRAREHGLPFLF;AVDRAREHGLPFLFF;VDRAREHGLPFLFFT;DRAREHGLPFLFFTD;RAREHGLPFLFFTDQ;AREHGLPFLFFTDQA;REHGLPFLFFTDQAT;EHGLPFLFFTDQATG;HGLPFLFFTDQATGR;GLPFLFFTDQATGRG;LPFLFFTDQATGRGQ;PFLFFTDQATGRGQL;FLFFTDQATGRGQLL;LFFTDQATGRGQLLY;FFTDQATGRGQLLYS;FTDQATGRGQLLYSR;TDQATGRGQLLYSRY;DQATGRGQLLYSRYD;QATGRGQLLYSRYDG;ATGRGQLLYSRYDGN;TGRGQLLYSRYDGNL;GRGQLLYSRYDGNLG;RGQLLYSRYDGNLGL;GQLLYSRYDGNLGLI;QLLYSRYDGNLGLIT;LLYSRYDGNLGLITP;LYSRYDGNLGLITPT;YSRYDGNLGLITPTG;SRYDGNLGLITPTGD;RYDGNLGLITPTGDG;YDGNLGLITPTGDGV;DGNLGLITPTGDGVA;GNLGLITPTGDGVAD;NLGLITPTGDGVADG;LGLITPTGDGVADGL;GLITPTGDGVADGLA;<br>16 mers:<br>MEPKRSRLVVCAPEPS;EPKRSRLVVCAPEPSH;PKRSRLVVCAPEPSHA;KRSRLVVCAPEPSHAR;RSRLVVCAPEPSHARE;SRLVVCAPEPSHAREF;RLVVCAPEPSHAREFP;LVVCAPEPSHAREFPD;VVCAPEPSHAREFPDV;VCAPEPSHAREFPDVA;CAPEPSHAREFPDVAV;APEPSHAREFPDVAVF;PEPSHAREFPDVAVFS;EPSHAREFPDVAVFSG;PSHAREFPDVAVFSGG;SHAREFPDVAVFSGGR;HAREFPDVAVFSGGRA;AREFPDVAVFSGGRAN;REFPDVAVFSGGRANA;EFPDVAVFSGGRANAS;FPDVAVFSGGRANASQ;PDVAVFSGGRANASQA;DVAVFSGGRANASQAE;VAVFSGGRANASQAER;AVFSGGRANASQAERL;VFSGGRANASQAERLA;FSGGRANASQAERLAR;SGGRANASQAERLARA;GGRANASQAERLARAV;GRANASQAERLARAVG;RANASQAERLARAVGR;ANASQAERLARAVGRV;NASQAERLARAVGRVL;ASQAERLARAVGRVLA;SQAERLARAVGRVLAD;QAERLARAVGRVLADR;AERLARAVGRVLADRG;ERLARAVGRVLADRGV;RLARAVGRVLADRGVT;LARAVGRVLADRGVTG;ARAVGRVLADRGVTGG;RAVGRVLADRGVTGGA;AVGRVLADRGVTGGAR;VGRVLADRGVTGGARV;GRVLADRGVTGGARVR;RVLADRGVTGGARVRL;VLADRGVTGGARVRLT;LADRGVTGGARVRLTM;ADRGVTGGARVRLTMA;DRGVTGGARVRLTMAN;RGVTGGARVRLTMANC;GVTGGARVRLTMANCA;VTGGARVRLTMANCAD;TGGARVRLTMANCADG;GGARVRLTMANCADGP;GARVRLTMANCADGPT;ARVRLTMANCADGPTL;RVRLTMANCADGPTLV;VRLTMANCADGPTLVQ;RLTMANCADGPTLVQI;LTMANCADGPTLVQIN;TMANCADGPTLVQINL;MANCADGPTLVQINLQ;ANCADGPTLVQINLQV;NCADGPTLVQINLQVG;CADGPTLVQINLQVGD;ADGPTLVQINLQVGDT;DGPTLVQINLQVGDTP;GPTLVQINLQVGDTPL;PTLVQINLQVGDTPLR;TLVQINLQVGDTPLRA;LVQINLQVGDTPLRAQ;VQINLQVGDTPLRAQA;QINLQVGDTPLRAQAA;INLQVGDTPLRAQAAT;NLQVGDTPLRAQAATA;LQVGDTPLRAQAATAG;QVGDTPLRAQAATAGI;VGDTPLRAQAATAGID;GDTPLRAQAATAGIDD;DTPLRAQAATAGIDDL;TPLRAQAATAGIDDLR;PLRAQAATAGIDDLRP;LRAQAATAGIDDLRPA;RAQAATAGIDDLRPAL;AQAATAGIDDLRPALI;QAATAGIDDLRPALIR;AATAGIDDLRPALIRL;ATAGIDDLRPALIRLD;TAGIDDLRPALIRLDR;AGIDDLRPALIRLDRQ;GIDDLRPALIRLDRQI;IDDLRPALIRLDRQIV;DDLRPALIRLDRQIVR;DLRPALI | |

Fig. 30 continued

| | | |
|---|---|---|
| | RLDRQIVRA;LRPALIRLDRQIVRAS;RPALIRLDRQIVRASA;PALIRLDRQIVRASAQ;ALIRLDRQIVRASAQW;LIRLDRQIVRASAQWC;IRLDRQIVRASAQWCP;RLDRQIVRASAQWCPR;LDRQIVRASAQWCPRP;DRQIVRASAQWCPRPW;RQIVRASAQWCPRPWP;QIVRASAQWCPRPWPD;IVRASAQWCPRPWPDR;VRASAQWCPRPWPDRP;RASAQWCPRPWPDRPR;ASAQWCPRPWPDRPRR;SAQWCPRPWPDRPRRR;AQWCPRPWPDRPRRRL;QWCPRPWPDRPRRRLT;WCPRPWPDRPRRRLTT;CPRPWPDRPRRRLTTP;PRPWPDRPRRRLTTPA;RPWPDRPRRRLTTPAE;PWPDRPRRRLTTPAEA;WPDRPRRRLTTPAEAL;PDRPRRRLTTPAEALV;DRPRRRLTTPAEALVT;RPRRRLTTPAEALVTR;PRRRLTTPAEALVTRR;RRRLTTPAEALVTRRK;RRLTTPAEALVTRRKP;RLTTPAEALVTRRKPV;LTTPAEALVTRRKPVV;TTPAEALVTRRKPVVL;TPAEALVTRRKPVVLR;PAEALVTRRKPVVLRR;AEALVTRRKPVVLRRA;EALVTRRKPVVLRRAT;ALVTRRKPVVLRRATP;LVTRRKPVVLRRATPL;VTRRKPVVLRRATPLQ;TRRKPVVLRRATPLQA;RRKPVVLRRATPLQAI;RKPVVLRRATPLQAIA;KPVVLRRATPLQAIAA;PVVLRRATPLQAIAAM;VVLRRATPLQAIAAMD;VLRRATPLQAIAAMDA;LRRATPLQAIAAMDAM;RRATPLQAIAAMDAMD;RATPLQAIAAMDAMDY;ATPLQAIAAMDAMDYD;TPLQAIAAMDAMDYDV;PLQAIAAMDAMDYDVH;LQAIAAMDAMDYDVHL;QAIAAMDAMDYDVHLF;AIAAMDAMDYDVHLFT;IAAMDAMDYDVHLFTD;AAMDAMDYDVHLFTDA;AMDAMDYDVHLFTDAE;MDAMDYDVHLFTDAET;DAMDYDVHLFTDAETG;AMDYDVHLFTDAETGE;MDYDVHLFTDAETGED;DYDVHLFTDAETGEDA;YDVHLFTDAETGEDAV;DVHLFTDAETGEDAVV;VHLFTDAETGEDAVVY;HLFTDAETGEDAVVYR;LFTDAETGEDAVVYRA;FTDAETGEDAVVYRAG;TDAETGEDAVVYRAGP;DAETGEDAVVYRAGPS;AETGEDAVVYRAGPSG;ETGEDAVVYRAGPSGL;TGEDAVVYRAGPSGLR;GEDAVVYRAGPSGLRL;EDAVVYRAGPSGLRLA;DAVVYRAGPSGLRLAR;AVVYRAGPSGLRLARQ;VVYRAGPSGLRLARQH;VYRAGPSGLRLARQHH;YRAGPSGLRLARQHHV;RAGPSGLRLARQHHVF;AGPSGLRLARQHHVFP;GPSGLRLARQHHVFPP;PSGLRLARQHHVFPPG;SGLRLARQHHVFPPGW;GLRLARQHHVFPPGWS;LRLARQHHVFPPGWSR;RLARQHHVFPPGWSRC;LARQHHVFPPGWSRCR;ARQHHVFPPGWSRCRA;RQHHVFPPGWSRCRAP;QHHVFPPGWSRCRAPA;HHVFPPGWSRCRAPAG;HVFPPGWSRCRAPAGP;VFPPGWSRCRAPAGPP;FPPGWSRCRAPAGPPV;PPGWSRCRAPAGPPVP;PGWSRCRAPAGPPVPL;GWSRCRAPAGPPVPLI;WSRCRAPAGPPVPLIV;SRCRAPAGPPVPLIVN;RCRAPAGPPVPLIVNS;CRAPAGPPVPLIVNSR;RAPAGPPVPLIVNSRP;APAGPPVPLIVNSRPT;PAGPPVPLIVNSRPTP;AGPPVPLIVNSRPTPV;GPPVPLIVNSRPTPVL;PPVPLIVNSRPTPVLT;PVPLIVNSRPTPVLTE;VPLIVNSRPTPVLTEA;PLIVNSRPTPVLTEAA;LIVNSRPTPVLTEAAA;IVNSRPTPVLTEAAAV;VNSRPTPVLTEAAAVD;NSRPTPVLTEAAAVDR;SRPTPVLTEAAAVDRA;RPTPVLTEAAAVDRAR;PTPVLTEAAAVDRARE;TPVLTEAAAVDRAREH;PVLTEAAAVDRAREHG;VLTEAAAVDRAREHGL;LTEAAAVDRAREHGLP;TEAAAVDRAREHGLPF;EAAAVDRAREHGLPFL;AAAVDRAREHGLPFLF;AAVDRAREHGLPFLFF;AVDRAREHGLPFLFFT;VDRAREHGLPFLFFTD;DRAREHGLPFLFFTDQ;RAREHGLPFLFFTDQA;AREHGLPFLFFTDQAT;REHGLPFLFFTDQATG;EHGLPFLFFTDQATGR;HGLPFLFFTDQATGRG;GLPFLFFTDQATGRGQ;LPFLFFTDQATGRGQL;PFLFFTDQATGRGQLL;FLFFTDQATGRGQLLY;LFFTDQATGRGQLLYS;FFTDQATGRGQLLYSR;FTDQATGRGQLLYSRY;TDQATGRGQLLYSRYD;DQATGRGQLLYSRYDG;QATGRGQLLYSRYDGN;ATGRGQLLYSRYDGNL;TGRGQLLYSRYDGNLG;GRGQLLYSRYDGNLGL;RGQLLYSRYDGNLGLI;GQLLYSRYDGNLGLIT;QLLYSRYDGNLGLITP;LLYSRYDGNLGLITPT;LYSRYDGNLGLITPTG;YSRYDGNLGLITPTGD;SRYDGNLGLITPTGDG;RYDGNLGLITPTGDGV;YDGNLGLITPTGDGVA;DGNLGLITPTGDGVAD;GNLGLITPTGDGVADG;N | |

Fig. 30 continued

| | | |
|---|---|---|
| | LGLITPTGDGVADGL;LGLITPTGDGVADGLA | |
| 18 | **<NP_217646.1 hypothetical protein Rv3130c;Mycobacterium tuberculosis H37Rv>**<br>MNHLTTLDAGFLKAEDVDRHVSLAIGALAVIEGPAPDQEAFLSSLAQRLRPCTRFGQRLRLRPFDLGAPKWVDDPDFDLGRHVWRIALPRPGNEDQLFELIADLMARRLDRGRPLWEVWVIEGLADSKWAILTKLHHCMADGIAATHLLAGLSDESMSDSFASNIHTTMQSQSASVRRGGFRVNPSEALTASTAVMAGIVRAAKGASEIAAGVLSPAASSLNGPISDLRRYSAAKVPLADVEQVCRKFDVTINDVALAAITESYRNVLIQRGERPRFDSLRTLVPVSTRSNSALSKTDNRVSLMLPNLPVDQENPLQRLRIVHSRLTRAKAGGQRQFGNTLMAIANRLPFPMTAWAVGLLMRLPQRGVVTVATNVPGPRRPLQIMGRRVLDLYPVSPIAMQLRTSVAMLSYADDLYFGILADYDVVADAGGQLARGIEDAVARLVAISKRRKVTRRRGALSLVV<br><br>8mer<br>TTLDAGFL;TLDAGFLK;AEDVDRHV;DVDRHVSL;HVSLAIGA;SLAIGALA;LAIGALAV;AIGALAVI;LAVIEGPA;APDQEAFL;QEAFLSSL;EAFLSSLA;FLSSLAQR;SSLAQRLR;RLRPCTRF;TRFGQRLR;QRLRLRPF;RLRLRPFD;DLGAPKWV;KWVDDPDF;DLGRHVWR;RHVWRIAL;VWRIALPR;RPGNEDQL;NEDQLFEL;FELIADLM;ELIADLMA;LIADLMAR;IADLMARR;LMARRLDR;RLDRGRPL;RGRPLWEV;RPLWEVWV;PLWEVWVI;WEVWVIEG;EVWVIEGL;GLADSKWA;KWAILTKL;ILTKLHHC;LTKLHHCM;CMADGIAA;MADGIAAT;GIAATHLL;ATHLLAGL;GLSDESMS;DESMSDSF;ESMSDSFA;SMSDSFAS;FASNIHTT;TTMQSQSA;MQSQSASV;QSQSASVR;SQSASVRR;SVRRGGFR;RVNPSEAL;NPSEALTA;EALTASTA;ALTASTAV;LTASTAVM;STAVMAGI;TAVMAGIV;AVMAGIVR;VMAGIVRA;MAGIVRAA;AGIVRAAK;SEIAAGVL;VLSPAASS;PISDLRRY;LRRYSAAK;RRYSAAKV;YSAAKVPL;PLADVEQV;DVEQVCRK;VEQVCRKF;QVCRKFDV;VTINDVAL;TINDVALA;ALAAITES;LAAITESY;AAITESYR;TESYRNVL;ESYRNVLI;YRNVLIQR;VLIQRGER;IQRGERPR;RPRFDSLR;FDSLRTLV;SLRTLVPV;TLVPVSTR;VPVSTRSN;STRSNSAL;RSNSALSK;KTDNRVSL;LMLPNLPV;QENPLQRL;NPLQRLRI;PLQRLRIV;LQRLRIVH;RLRIVHSR;IVHSRLTR;HSRLTRAK;RAKAGGQR;RQFGNTLM;FGNTLMAI;TLMAIANR;LMAIANRL;AIANRLPF;RLPFPMTA;LPFPMTAW;FPMTAWAV;MTAWAVGL;TAWAVGLL;WAVGLLMR;AVGLLMRL;GLLMRLPQ;LLMRLPQR;RLPQRGVV;LPQRGVVT;VVTVATNV;ATNVPGPR;VPGPRRPL;GPRRPLQI;LQIMGRRV;QIMGRRVL;RVLDLYPV;DLYPVSPI;YPVSPIAM;SPIAMQLR;AMQLRTSV;MQLRTSVA;QLRTSVAM;TSVAMLSY;SVAMLSYA;MLSYADDL;LSYADDLY;SYADDLYF;DLYFGILA;YFGILADY;GILADYDV;ILADYDVV;VVADAGQL;IEDAVARL;AVARLVAI;ARLVAISK;RLVAISKR;LVAISKRR;VAISKRRK;AISKRRKV;KRRKVTRR;RRKVTRRR;VTRRRGAL;RRRGALSL<br>9mer<br>TTLDAGFLK;TLDAGFLKA;HVSLAIGAL;SLAIGALAV;LAIGALAVI;ALAVIEGPA;EGPAPDQEA;GPAPDQEAF;AFLSSLAQR;FLSSLAQRL;LSSLAQRLR;SLAQRLRPC;AQRLRPCTR;RLRPCTRFG;RPCTRFGQR;CTRFGQRLR;TRFGQRLRL;RFGQRLRLR;GQRLRLRPF;RLRLRPFDL;RLRPFDLGA;RPFDLGAPK;WVDDPDFDL;DLGRHVWRI;GRHVWRIAL;HVWRIALPR;RPGNEDQLF;NEDQLFELI;QLFELIADL;ELIADLMAR;LIADLMARR;DLMARRLDR;MARRLDRGR;RRLDRGRPL;RLDRGRPLW;RGRPLWEVW;RPLWEVWVI;PLWEVWVIE;WEVWVIEGL;EVWVIEGLA;WVIEGLADS;VIEGLADSK;GLADSKWAI;DSKWAILTK;SKWAILTKL;ILTKLHHCM;CMADGIAAT;MADGIAATH;DGIAATHLL;GIAATHLLA;AATHLLAGL;LLAGLSDES;LAGLSDESM;GLSDESMSD;ESMSDSFAS;FASNIHTTM;HTTMQSQSA;TTMQSQSAS;TMQSQSASV;MQSQSASVR;QSQSASVRR;ASVRRGGFR;SVRRGGFRV;RRGGFRVNP;FRV | 138744-141182 |

Fig. 30 continued

| | | |
|---|---|---|
| | NPSEAL;NPSEALTAS;EALTASTAV;ALTASTAVM;LTASTAVMA;ASTAVMAGI;STAVMAGIV;TAVMAGIVR;AVMAGIVRA;VMAGIVRAA;MAGIVRAAK;RAAKGASEI;GASEIAAGV;SEIAAGVLS;IAAGVLSPA;VLSPAASSL;SLNGPISDL;DLRRYSAAK;RRYSAAKVP;RYSAAKVPL;VPLADVEQV;PLADVEQVC;DVTINDVAL;VTINDVALA;TINDVALAA;ALAAITESY;LAAITESYR;AITESYRNV;SYRNVLIQR;NVLIQRGER;LIQRGERPR;IQRGERPRF;GERPRFDSL;RPRFDSLRT;RFDSLRTLV;DSLRTLVPV;RTLVPVSTR;TLVPVSTRS;STRSNSALS;TRSNSALSK;SALSKTDNR;ALSKTDNRV;SKTDNRVSL;KTDNRVSLM;RVSLMLPNL;SLMLPNLPV;MLPNLPVDQ;LPVDQENPL;NPLQRLRIV;QRLRIVHSR;RLRIVHSRL;RIVHSRLTR;IVHSRLTRA;GQRQFGNTL;RQFGNTLMA;QFGNTLMAI;NTLMAIANR;TLMAIANRL;MAIANRLPF;IANRLPFPM;LPFPMTAWA;FPMTAWAVG;PMTAWAVGL;MTAWAVGLL;TAWAVGLLM;WAVGLLMRL;GLLMRLPQR;LMRLPQRGV;LPQRGVVTV;GVVTVATNV;VATNVPGPR;ATNVPGPRR;NVPGPRRPL;GPRRPLQIM;RRPLQIMGR;RPLQIMGRR;PLQIMGRRV;LQIMGRRVL;IMGRRVLDL;RRVLDLYPV;VLDLYPVSP;DLYPVSPIA;LYPVSPIAM;YPVSPIAMQ;PVSPIAMQL;VSPIAMQLR;IAMQLRTSV;AMQLRTSVA;MQLRTSVAM;QLRTSVAML;RTSVAMLSY;TSVAMLSYA;AMLSYADDL;MLSYADDLY;LSYADDLYF;YADDLYFGI;LYFGILADY;FGILADYDV;GILADYDVV;ILADYDVVA;DVVADAGQL;VVADAGQLA;QLARGIEDA;LARGIEDAV;GIEDAVARL;DAVARLVAI;VARLVAISK;RLVAISKRR;LVAISKRRK;ISKRRKVTR;KRRKVTRRR;KVTRRRGAL;RRRGALSLV;RRGALSLVV<br>10mer<br>NHLTTLDAGF;HLTTLDAGFL;LTTLDAGFLK;TTLDAGFLKA;TLDAGFLKAE;AEDVDRHVSL;DVDRHVSLAI;HVSLAIGALA;SLAIGALAVI;EGPAPDQEAF;EAFLSSLAQR;AFLSSLAQRL;FLSSLAQRLR;SLAQRLRPCT;LAQRLRPCTR;AQRLRPCTRF;RLRPCTRFGQ;RPCTRFGQRL;TRFGQRLRLR;FGQRLRLRPF;QRLRLRPFDL;RPFDLGAPKW;APKWVDDPDF;KWVDDPDFDL;DFDLGRHVWR;DLGRHVWRIA;LGRHVWRIAL;RHVWRIALPR;LPRPGNEDQL;QLFELIADLM;ELIADLMARR;LIADLMARRL;LMARRLDRGR;RRLDRGRPLW;RLDRGRPLWE;PLWEVWVIEG;WEVWVIEGLA;WVIEGLADSK;GLADSKWAIL;AILTKLHHCM;ILTKLHHCMA;KLHHCMADGI;CMADGIAATH;MADGIAATHL;IAATHLLAGL;HLLAGLSDES;LLAGLSDESM;LSDESMSDSF;SMSDSFASNI;MSDSFASNIH;TTMQSQSASV;TMQSQSASVR;MQSQSASVRR;SASVRRGGFR;RRGGFRVNPS;RVNPSEALTA;NPSEALTAST;SEALTASTAV;EALTASTAVM;ALTASTAVMA;TASTAVMAGI;STAVMAGIVR;AVMAGIVRAA;VMAGIVRAAK;EIAAGVLSPA;IAAGVLSPAA;GVLSPAASSL;SLNGPISDLR;PISDLRRYSA;DLRRYSAAKV;RRYSAAKVPL;SAAKVPLADV;KVPLADVEQV;FDVTINDVAL;VTINDVALAA;TINDVALAAI;VALAAITESY;ALAAITESYR;AITESYRNVL;ESYRNVLIQR;RNVLIQRGER;RPRFDSLRTL;SLRTLVPVST;VPVSTRSNSA;STRSNSALSK;NSALSKTDNR;SALSKTDNRV;KTDNRVSLML;LMLPNLPVDQ;NLPVDQENPL;LPVDQENPLQ;NPLQRLRIVH;LQRLRIVHSR;QRLRIVHSRL;RLRIVHSRLT;LRIVHSRLTR;RIVHSRLTRA;IVHSRLTRAK;LTRAKAGGQR;RAKAGGQRQF;GQRQFGNTLM;RQFGNTLMAI;NTLMAIANRL;LMAIANRLPF;AIANRLPFPM;RLPFPMTAWA;LPFPMTAWAV;FPMTAWAVGL;PMTAWAVGLL;MTAWAVGLLM;TAWAVGLLMR;LLMRLPQRGV;LMRLPQRGVV;RLPQRGVVTV;LPQRGVVTVA;TVATNVPGPR;VATNVPGPRR;VPGPRRPLQI;RRPLQIMGRR;RPLQIMGRRV;RRVLDLYPVS;VLDLYPVSPI;DLYPVSPIAM;YPVSPIAMQL;PVSPIAMQLR;PIAMQLRTSV;AMQLRTSVAM;MQLRTSVAML;LRTSVAMLSY;RTSVAMLSYA;AMLSYADDLY;MLSYADDLYF;SYADDLYFGI;YADDLYFGIL;DLYFGILADY;FGILADYDVV;GILADYDVVA;ILADYDVVAD;VVADAGQLAR;GQLARGIEDA;QLARGIEDAV;GIEDAVARLV;AVARLVAISK;VARLVAISKR;RLVAISKRRK;AISKRRKVTR;ISKRRKVTRR;SKRRKVTRRR;RKVTRRRGAL;VTRRRGALSL;RRRGALSLVV | |

Fig. 30 continued

| | | | |
|---|---|---|---|
| | 11mer<br>HLTTLDAGFLK;TLDAGFLKAED;FLKAEDVDRHV;HVSLAIGALAV;IEGPAPDQEAF;EGPAPDQEAFL;APDQEAFLSSL;QEAFLSSLAQR;EAFLSSLAQRL;AFLSSLAQRLR;SLAQRLRPCTR;RLRPCTRFGQR;RPCTRFGQRLR;CTRFGQRLRLR;RFGQRLRLRPF;RLRLRPFDLGA;RLRPFDLGAPK;RPFDLGAPKWV;WVDDPDFDLGR;DPDFDLGRHVW;DLGRHVWRIAL;GRHVWRIALPR;ALPRPGNEDQL;LPRPGNEDQLF;RPGNEDQLFEL;QLFELIADLMA;LFELIADLMAR;ELIADLMARRL;DLMARRLDRGR;MARRLDRGRPL;RRLDRGRPLWE;RLDRGRPLWEV;RGRPLWEVWVI;PLWEVWVIEGL;WEVWVIEGLAD;WVIEGLADSKW;GLADSKWAILT;LADSKWAILTK;WAILTKLHHCM;AILTKLHHCMA;KLHHCMADGIA;CMADGIAATHL;MADGIAATHLL;GIAATHLLAGL;HLLAGLSDESM;LLAGLSDESMS;GLSDESMSDSF;ESMSDSFASNI;NIHTTMQSQSA;HTTMQSQSASV;TTMQSQSASVR;TMQSQSASVRR;SQSASVRRGGF;QSASVRRGGFR;SASVRRGGFRV;RRGGFRVNPSE;NPSEALTASTA;EALTASTAVMA;LTASTAVMAGI;TASTAVMAGIV;ASTAVMAGIVR;STAVMAGIVRA;AVMAGIVRAAK;IVRAAKGASEI;SEIAAGVLSPA;EIAAGVLSPAA;SPAASSLNGPI;SSLNGPISDLR;SLNGPISDLRR;GPISDLRRYSA;ISDLRRYSAAK;RRYSAAKVPLA;YSAAKVPLADV;PLADVEQVCRK;VTINDVALAAI;DVALAAITESY;VALAAITESYR;AITESYRNVLI;TESYRNVLIQR;NVLIQRGERPR;VLIQRGERPRF;RGERPRFDSLR;RPRFDSLRTLV;RFDSLRTLVPV;SLRTLVPVSTR;VPVSTRSNSAL;VSTRSNSALSK;NSALSKTDNRV;ALSKTDNRVSL;SKTDNRVSLML;RVSLMLPNLPV;PVDQENPLQRL;QENPLQRLRIV;PLQRLRIVHSR;LQRLRIVHSRL;RLRIVHSRLTR;RIVHSRLTRAK;IVHSRLTRAKA;RLTRAKAGGQR;RQFGNTLMAIA;FGNTLMAIANR;TLMAIANRLPF;MAIANRLPFPM;RLPFPMTAWAV;LPFPMTAWAVG;PFPMTAWAVGL;FPMTAWAVGLL;PMTAWAVGLLM;MTAWAVGLLMR;TAWAVGLLMRL;AVGLLMRLPQR;GLLMRLPQRGV;LLMRLPQRGVV;MRLPQRGVVTV;RLPQRGVVTVA;LPQRGVVTVAT;VTVATNVPGPR;TVATNVPGPRR;VPGPRRPLQIM;RPLQIMGRRVL;LQIMGRRVLDL;QIMGRRVLDLY;MGRRVLDLYPV;RRVLDLYPVSP;RVLDLYPVSPI;VLDLYPVSPIA;DLYPVSPIAMQ;LYPVSPIAMQL;YPVSPIAMQLR;SPIAMQLRTSV;IAMQLRTSVAM;AMQLRTSVAML;MQLRTSVAMLS;QLRTSVAMLSY;SVAMLSYADDL;VAMLSYADDLY;AMLSYADDLYF;MLSYADDLYFG;LSYADDLYFGI;SYADDLYFGIL;YADDLYFGILA;LYFGILADYDV;ILADYDVVADA;DYDVVADAGQL;DVVADAGQLAR;GQLARGIEDAV;QLARGIEDAVA;LARGIEDAVAR;DAVARLVAISK;AVARLVAISKR;VARLVAISKRR;ARLVAISKRRK;RLVAISKRRKV;VAISKRRKVTR;AISKRRKVTRR;ISKRRKVTRRR;RRKVTRRRGAL;KVTRRRGALSL;VTRRRGALSLV<br><br>13 mers:<br>MNHLTTLDAGFLK;NHLTTLDAGFLKA;HLTTLDAGFLKAE;LTTLDAGFLKAED;TTLDAGFLKAEDV;TLDAGFLKAEDVD;LDAGFLKAEDVDR;DAGFLKAEDVDRH;AGFLKAEDVDRHV;GFLKAEDVDRHVS;FLKAEDVDRHVSL;LKAEDVDRHVSLA;KAEDVDRHVSLAI;AEDVDRHVSLAIG;EDVDRHVSLAIGA;DVDRHVSLAIGAL;VDRHVSLAIGALA;DRHVSLAIGALAV;RHVSLAIGALAVI;HVSLAIGALAVIE;VSLAIGALAVIEG;SLAIGALAVIEGP;LAIGALAVIEGPA;AIGALAVIEGPAP;IGALAVIEGPAPD;GALAVIEGPAPDQ;ALAVIEGPAPDQE;LAVIEGPAPDQEA;AVIEGPAPDQEAF;VIEGPAPDQEAFL;IEGPAPDQEAFLS;EGPAPDQEAFLSS;GPAPDQEAFLSSL;PAPDQEAFLSSLA;APDQEAFLSSLAQ;PDQEAFLSSLAQR;DQEAFLSSLAQRL;QEAFLSSLAQRLR;EAFLSSLAQRLRP;AFLSSLAQRLRPC;FLSSLAQRLRPCT;LSSLAQRLRPCTR;SSLAQRLRPCTRF;SLAQRLRPCTRFG;LAQRLRPCTRFGQ;AQRLRPCTRFGQR;QRLRPCTRFGQRL;RLRPCTRFGQRLR;LRPCTRFGQRLRL;RPCTRFGQRL | |

Fig. 30 continued

| | | |
|---|---|---|
| | RLR;PCTRFGQRLRLRP;CTRFGQRLRLRPF;TRFGQRLRLRPFD;RFGQRLRLRPFDL;FGQRLRLRPFDLG;GQRLRLRPFDLGA;QRLRLRPFDLGAP;RLRLRPFDLGAPK;LRLRPFDLGAPKW;RLRPFDLGAPKWV;LRPFDLGAPKWVD;RPFDLGAPKWVDD;PFDLGAPKWVDDP;FDLGAPKWVDDPD;DLGAPKWVDDPDF;LGAPKWVDDPDFD;GAPKWVDDPDFDL;APKWVDDPDFDLG;PKWVDDPDFDLGR;KWVDDPDFDLGRH;WVDDPDFDLGRHV;VDDPDFDLGRHVW;DDPDFDLGRHVWR;DPDFDLGRHVWRI;PDFDLGRHVWRIA;DFDLGRHVWRIAL;FDLGRHVWRIALP;DLGRHVWRIALPR;LGRHVWRIALPRP;GRHVWRIALPRPG;RHVWRIALPRPGN;HVWRIALPRPGNE;VWRIALPRPGNED;WRIALPRPGNEDQ;RIALPRPGNEDQL;IALPRPGNEDQLF;ALPRPGNEDQLFE;LPRPGNEDQLFEL;PRPGNEDQLFELI;RPGNEDQLFELIA;PGNEDQLFELIAD;GNEDQLFELIADL;NEDQLFELIADLM;EDQLFELIADLMA;DQLFELIADLMAR;QLFELIADLMARR;LFELIADLMARRL;FELIADLMARRLD;ELIADLMARRLDR;LIADLMARRLDRG;IADLMARRLDRGR;ADLMARRLDRGRP;DLMARRLDRGRPL;LMARRLDRGRPLW;MARRLDRGRPLWE;ARRLDRGRPLWEV;RRLDRGRPLWEVW;RLDRGRPLWEVWV;LDRGRPLWEVWVI;DRGRPLWEVWVIE;RGRPLWEVWVIEG;GRPLWEVWVIEGL;RPLWEVWVIEGLA;PLWEVWVIEGLAD;LWEVWVIEGLADS;WEVWVIEGLADSK;EVWVIEGLADSKW;VWVIEGLADSKWA;WVIEGLADSKWAI;VIEGLADSKWAIL;IEGLADSKWAILT;EGLADSKWAILTK;GLADSKWAILTKL;LADSKWAILTKLH;ADSKWAILTKLHH;DSKWAILTKLHHC;SKWAILTKLHHCM;KWAILTKLHHCMA;WAILTKLHHCMAD;AILTKLHHCMADG;ILTKLHHCMADGI;LTKLHHCMADGIA;TKLHHCMADGIAA;KLHHCMADGIAAT;LHHCMADGIAATH;HHCMADGIAATHL;HCMADGIAATHLL;CMADGIAATHLLA;MADGIAATHLLAG;ADGIAATHLLAGL;DGIAATHLLAGLS;GIAATHLLAGLSD;IAATHLLAGLSDE;AATHLLAGLSDES;ATHLLAGLSDESM;THLLAGLSDESMS;HLLAGLSDESMSD;LLAGLSDESMSDS;LAGLSDESMSDSF;AGLSDESMSDSFA;GLSDESMSDSFAS;LSDESMSDSFASN;SDESMSDSFASNI;DESMSDSFASNIH;ESMSDSFASNIHT;SMSDSFASNIHTT;MSDSFASNIHTTM;SDSFASNIHTTMQ;DSFASNIHTTMQS;SFASNIHTTMQSQ;FASNIHTTMQSQS;ASNIHTTMQSQSA;SNIHTTMQSQSAS;NIHTTMQSQSASV;IHTTMQSQSASVR;HTTMQSQSASVRR;TTMQSQSASVRRG;TMQSQSASVRRGG;MQSQSASVRRGGF;QSQSASVRRGGFR;SQSASVRRGGFRV;QSASVRRGGFRVN;SASVRRGGFRVNP;ASVRRGGFRVNPS;SVRRGGFRVNPSE;VRRGGFRVNPSEA;RRGGFRVNPSEAL;RGGFRVNPSEALT;GGFRVNPSEALTA;GFRVNPSEALTAS;FRVNPSEALTAST;RVNPSEALTASTA;VNPSEALTASTAV;NPSEALTASTAVM;PSEALTASTAVMA;SEALTASTAVMAG;EALTASTAVMAGI;ALTASTAVMAGIV;LTASTAVMAGIVR;TASTAVMAGIVRA;ASTAVMAGIVRAA;STAVMAGIVRAAK;TAVMAGIVRAAKG;AVMAGIVRAAKGA;VMAGIVRAAKGAS;MAGIVRAAKGASE;AGIVRAAKGASEI;GIVRAAKGASEIA;IVRAAKGASEIAA;VRAAKGASEIAAG;RAAKGASEIAAGV;AAKGASEIAAGVL;AKGASEIAAGVLS;KGASEIAAGVLSP;GASEIAAGVLSPA;ASEIAAGVLSPAA;SEIAAGVLSPAAS;EIAAGVLSPAASS;IAAGVLSPAASSL;AAGVLSPAASSLN;AGVLSPAASSLNG;GVLSPAASSLNGP;VLSPAASSLNGPI;LSPAASSLNGPIS;SPAASSLNGPISD;PAASSLNGPISDL;AASSLNGPISDLR;ASSLNGPISDLRR;SSLNGPISDLRRY;SLNGPISDLRRYS;LNGPISDLRRYSA;NGPISDLRRYSAA;GPISDLRRYSAAK;PISDLRRYSAAKV;ISDLRRYSAAKVP;SDLRRYSAAKVPL;DLRRYSAAKVPLA;LRRYSAAKVPLAD;RRYSAAKVPLADV;RYSAAKVPLADVE;YSAAKVPLADVEQ;SAAKVPLADVEQV;AAKVPLADVEQVC;AKVPLADVEQVCR;KVPLADVEQVCRK;VPLADVEQVCRKF;PLADVEQVCRKFD;LADVEQVCRKFDV;ADVEQVCRKFDVT;DVEQVCRKFDVTI;VEQVCRKFDVTIN;EQVCRKFDVTIND;QVCRKFDVTINDV;VCRKFDVTINDVA;CRKFDVTINDVAL;RKFDVTINDVALA;KFDVTINDVALAA;FDVTINDVALAAI;DVTINDVALAAIT;VTINDVALAAITE;TI | |

Fig. 30 continued

| | | |
|---|---|---|
| | NDVALAAITES;INDVALAAITESY;NDVALAAITESYR;DVALAAITESYRN;VALAAITESYRNV;ALAAITESYRNVL;LAAITESYRNVLI;AAITESYRNVLIQ;AITESYRNVLIQR;ITESYRNVLIQRG;TESYRNVLIQRGE;ESYRNVLIQRGER;SYRNVLIQRGERP;YRNVLIQRGERPR;RNVLIQRGERPRF;NVLIQRGERPRFD;VLIQRGERPRFDS;LIQRGERPRFDSL;IQRGERPRFDSLR;QRGERPRFDSLRT;RGERPRFDSLRTL;GERPRFDSLRTLV;ERPRFDSLRTLVP;RPRFDSLRTLVPV;PRFDSLRTLVPVS;RFDSLRTLVPVST;FDSLRTLVPVSTR;DSLRTLVPVSTRS;SLRTLVPVSTRSN;LRTLVPVSTRSNS;RTLVPVSTRSNSA;TLVPVSTRSNSAL;LVPVSTRSNSALS;VPVSTRSNSALSK;PVSTRSNSALSKT;VSTRSNSALSKTD;STRSNSALSKTDN;TRSNSALSKTDNR;RSNSALSKTDNRV;SNSALSKTDNRVS;NSALSKTDNRVSL;SALSKTDNRVSLM;ALSKTDNRVSLML;LSKTDNRVSLMLP;SKTDNRVSLMLPN;KTDNRVSLMLPNL;TDNRVSLMLPNLP;DNRVSLMLPNLPV;NRVSLMLPNLPVD;RVSLMLPNLPVDQ;VSLMLPNLPVDQE;SLMLPNLPVDQEN;LMLPNLPVDQENP;MLPNLPVDQENPL;LPNLPVDQENPLQ;PNLPVDQENPLQR;NLPVDQENPLQRL;LPVDQENPLQRLR;PVDQENPLQRLRI;VDQENPLQRLRIV;DQENPLQRLRIVH;QENPLQRLRIVHS;ENPLQRLRIVHSR;NPLQRLRIVHSRL;PLQRLRIVHSRLT;LQRLRIVHSRLTR;QRLRIVHSRLTRA;RLRIVHSRLTRAK;LRIVHSRLTRAKA;RIVHSRLTRAKAG;IVHSRLTRAKAGG;VHSRLTRAKAGGQ;HSRLTRAKAGGQR;SRLTRAKAGGQRQ;RLTRAKAGGQRQF;LTRAKAGGQRQFG;TRAKAGGQRQFGN;RAKAGGQRQFGNT;AKAGGQRQFGNTL;KAGGQRQFGNTLM;AGGQRQFGNTLMA;GGQRQFGNTLMAI;GQRQFGNTLMAIA;QRQFGNTLMAIAN;RQFGNTLMAIANR;QFGNTLMAIANRL;FGNTLMAIANRLP;GNTLMAIANRLPF;NTLMAIANRLPFP;TLMAIANRLPFPM;LMAIANRLPFPMT;MAIANRLPFPMTA;AIANRLPFPMTAW;IANRLPFPMTAWA;ANRLPFPMTAWAV;NRLPFPMTAWAVG;RLPFPMTAWAVGL;LPFPMTAWAVGLL;PFPMTAWAVGLLM;FPMTAWAVGLLMR;PMTAWAVGLLMRL;MTAWAVGLLMRLP;TAWAVGLLMRLPQ;AWAVGLLMRLPQR;WAVGLLMRLPQRG;AVGLLMRLPQRGV;VGLLMRLPQRGVV;GLLMRLPQRGVVT;LLMRLPQRGVVTV;LMRLPQRGVVTVA;MRLPQRGVVTVAT;RLPQRGVVTVATN;LPQRGVVTVATNV;PQRGVVTVATNVP;QRGVVTVATNVPG;RGVVTVATNVPGP;GVVTVATNVPGPR;VVTVATNVPGPRR;VTVATNVPGPRRP;TVATNVPGPRRPL;VATNVPGPRRPLQ;ATNVPGPRRPLQI;TNVPGPRRPLQIM;NVPGPRRPLQIMG;VPGPRRPLQIMGR;PGPRRPLQIMGRR;GPRRPLQIMGRRV;PRRPLQIMGRRVL;RRPLQIMGRRVLD;RPLQIMGRRVLDL;PLQIMGRRVLDLY;LQIMGRRVLDLYP;QIMGRRVLDLYPV;IMGRRVLDLYPVS;MGRRVLDLYPVSP;GRRVLDLYPVSPI;RRVLDLYPVSPIA;RVLDLYPVSPIAM;VLDLYPVSPIAMQ;LDLYPVSPIAMQL;DLYPVSPIAMQLR;LYPVSPIAMQLRT;YPVSPIAMQLRTS;PVSPIAMQLRTSV;VSPIAMQLRTSVA;SPIAMQLRTSVAM;PIAMQLRTSVAML;IAMQLRTSVAMLS;AMQLRTSVAMLSY;MQLRTSVAMLSYA;QLRTSVAMLSYAD;LRTSVAMLSYADD;RTSVAMLSYADDL;TSVAMLSYADDLY;SVAMLSYADDLYF;VAMLSYADDLYFG;AMLSYADDLYFGI;MLSYADDLYFGIL;LSYADDLYFGILA;SYADDLYFGILAD;YADDLYFGILADY;ADDLYFGILADYD;DDLYFGILADYDV;DLYFGILADYDVV;LYFGILADYDVVA;YFGILADYDVVAD;FGILADYDVVADA;GILADYDVVADAG;ILADYDVVADAGQ;LADYDVVADAGQL;ADYDVVADAGQLA;DYDVVADAGQLAR;YDVVADAGQLARG;DVVADAGQLARGI;VVADAGQLARGIE;VADAGQLARGIED;ADAGQLARGIEDA;DAGQLARGIEDAV;AGQLARGIEDAVA;GQLARGIEDAVAR;QLARGIEDAVARL;LARGIEDAVARLV;ARGIEDAVARLVA;RGIEDAVARLVAI;GIEDAVARLVAIS;IEDAVARLVAISK;EDAVARLVAISKR;DAVARLVAISKRR;AVARLVAISKRRK;VARLVAISKRRKV;ARLVAISKRRKVT;RLVAISKRRKVTR;LVAISKRRKVTRR;VAISKRRKVTRRR;AISKRRKVTRRRG;ISKRRKVTRRRGA;SKRRKVTRRRGAL;KRRKVTRRRGALS;RRKVTRRRGALSL;RKVTRRRGALSLV;KVTRRRGALSLVV; | |

Fig. 30 continued 14 mers:
MNHLTTLDAGFLKA;NHLTTLDAGFLKAE;HLTTLDAGFLKAED;LTTLDAGFL
KAEDV;TTLDAGFLKAEDVD;TLDAGFLKAEDVDR;LDAGFLKAEDVDRH;DA
GFLKAEDVDRHV;AGFLKAEDVDRHVS;GFLKAEDVDRHVSL;FLKAEDVDR
HVSLA;LKAEDVDRHVSLAI;KAEDVDRHVSLAIG;AEDVDRHVSLAIGA;EDV
DRHVSLAIGAL;DVDRHVSLAIGALA;VDRHVSLAIGALAV;DRHVSLAIGALA
VI;RHVSLAIGALAVIE;HVSLAIGALAVIEG;VSLAIGALAVIEGP;SLAIGALAVI
EGPA;LAIGALAVIEGPAP;AIGALAVIEGPAPD;IGALAVIEGPAPDQ;GALAVI
EGPAPDQE;ALAVIEGPAPDQEA;LAVIEGPAPDQEAF;AVIEGPAPDQEAFL;
VIEGPAPDQEAFLS;IEGPAPDQEAFLSS;EGPAPDQEAFLSSL;GPAPDQEA
FLSSLA;PAPDQEAFLSSLAQ;APDQEAFLSSLAQR;PDQEAFLSSLAQRL;D
QEAFLSSLAQRLR;QEAFLSSLAQRLRP;EAFLSSLAQRLRPC;AFLSSLAQR
LRPCT;FLSSLAQRLRPCTR;LSSLAQRLRPCTRF;SSLAQRLRPCTRFG;SL
AQRLRPCTRFGQ;LAQRLRPCTRFGQR;AQRLRPCTRFGQRL;QRLRPCTR
FGQRLR;RLRPCTRFGQRLRL;LRPCTRFGQRLRLR;RPCTRFGQRLRLRP;
PCTRFGQRLRLRPF;CTRFGQRLRLRPFD;TRFGQRLRLRPFDL;RFGQRLR
LRPFDLG;FGQRLRLRPFDLGA;GQRLRLRPFDLGAP;QRLRLRPFDLGAPK
;RLRLRPFDLGAPKW;LRLRPFDLGAPKWV;RLRPFDLGAPKWVD;LRPFDL
GAPKWVDD;RPFDLGAPKWVDDP;PFDLGAPKWVDDPD;FDLGAPKWVDD
PDF;DLGAPKWVDDPDFD;LGAPKWVDDPDFDL;GAPKWVDDPDFDLG;AP
KWVDDPDFDLGR;PKWVDDPDFDLGRH;KWVDDPDFDLGRHV;WVDDPD
FDLGRHVW;VDDPDFDLGRHVWR;DDPDFDLGRHVWRI;DPDFDLGRHVW
RIA;PDFDLGRHVWRIAL;DFDLGRHVWRIALP;FDLGRHVWRIALPR;DLGR
HVWRIALPRP;LGRHVWRIALPRPG;GRHVWRIALPRPGN;RHVWRIALPRP
GNE;HVWRIALPRPGNED;VWRIALPRPGNEDQ;WRIALPRPGNEDQL;RIAL
PRPGNEDQLF;IALPRPGNEDQLFE;ALPRPGNEDQLFEL;LPRPGNEDQLF
ELI;PRPGNEDQLFELIA;RPGNEDQLFELIAD;PGNEDQLFELIADL;GNEDQL
FELIADLM;NEDQLFELIADLMA;EDQLFELIADLMAR;DQLFELIADLMARR;Q
LFELIADLMARRL;LFELIADLMARRLD;FELIADLMARRLDR;ELIADLMARRL
DRG;LIADLMARRLDRGR;IADLMARRLDRGRP;ADLMARRLDRGRPL;DLM
ARRLDRGRPLW;LMARRLDRGRPLWE;MARRLDRGRPLWEV;ARRLDRGR
PLWEVW;RRLDRGRPLWEVWV;RLDRGRPLWEVWVI;LDRGRPLWEVWVI
E;DRGRPLWEVWVIEG;RGRPLWEVWVIEGL;GRPLWEVWVIEGLA;RPLW
EVWVIEGLAD;PLWEVWVIEGLADS;LWEVWVIEGLADSK;WEVWVIEGLAD
SKW;EVWVIEGLADSKWA;VWVIEGLADSKWAI;WVIEGLADSKWAIL;VIEG
LADSKWAILT;IEGLADSKWAILTK;EGLADSKWAILTKL;GLADSKWAILTKLH
;LADSKWAILTKLHH;ADSKWAILTKLHHC;DSKWAILTKLHHCM;SKWAILTK
LHHCMA;KWAILTKLHHCMAD;WAILTKLHHCMADG;AILTKLHHCMADGI;IL
TKLHHCMADGIA;LTKLHHCMADGIAA;TKLHHCMADGIAAT;KLHHCMADGI
AATH;LHHCMADGIAATHL;HHCMADGIAATHLL;HCMADGIAATHLLA;CMA
DGIAATHLLAG;MADGIAATHLLAGL;ADGIAATHLLAGLS;DGIAATHLLAGLS
D;GIAATHLLAGLSDE;IAATHLLAGLSDES;AATHLLAGLSDESM;ATHLLAGL
SDESMS;THLLAGLSDESMSD;HLLAGLSDESMSDS;LLAGLSDESMSDSF;
LAGLSDESMSDSFA;AGLSDESMSDSFAS;GLSDESMSDSFASN;LSDESM
SDSFASNI;SDESMSDSFASNIH;DESMSDSFASNIHT;ESMSDSFASNIHTT;
SMSDSFASNIHTTM;MSDSFASNIHTTMQ;SDSFASNIHTTMQS;DSFASNIH
TTMQSQ;SFASNIHTTMQSQS;FASNIHTTMQSQSA;ASNIHTTMQSQSAS;S
NIHTTMQSQSASV;NIHTTMQSQSASVR;IHTTMQSQSASVRR;HTTMQSQS
ASVRRG;TTMQSQSASVRRGG;TMQSQSASVRRGGF;MQSQSASVRRGG
FR;QSQSASVRRGGFRV;SQSASVRRGGFRVN;QSASVRRGGFRVNP;SAS
VRRGGFRVNPS;ASVRRGGFRVNPSE;SVRRGGFRVNPSEA;VRRGGFRV
NPSEAL;RRGGFRVNPSEALT;RGGFRVNPSEALTA;GGFRVNPSEALTAS;

Fig. 30 continued

| | | |
|---|---|---|
| | GFRVNPSEALTAST;FRVNPSEALTASTA;RVNPSEALTASTAV;VNPSEALTASTAVM;NPSEALTASTAVMA;PSEALTASTAVMAG;SEALTASTAVMAGI;EALTASTAVMAGIV;ALTASTAVMAGIVR;LTASTAVMAGIVRA;TASTAVMAGIVRAA;ASTAVMAGIVRAAK;STAVMAGIVRAAKG;TAVMAGIVRAAKGA;AVMAGIVRAAKGAS;VMAGIVRAAKGASE;MAGIVRAAKGASEI;AGIVRAAKGASEIA;GIVRAAKGASEIAA;IVRAAKGASEIAAG;VRAAKGASEIAAGV;RAAKGASEIAAGVL;AAKGASEIAAGVLS;AKGASEIAAGVLSP;KGASEIAAGVLSPA;GASEIAAGVLSPAA;ASEIAAGVLSPAAS;SEIAAGVLSPAASS;EIAAGVLSPAASSL;IAAGVLSPAASSLN;AAGVLSPAASSLNG;AGVLSPAASSLNGP;GVLSPAASSLNGPI;VLSPAASSLNGPIS;LSPAASSLNGPISD;SPAASSLNGPISDL;PAASSLNGPISDLR;AASSLNGPISDLRR;ASSLNGPISDLRRY;SSLNGPISDLRRYS;SLNGPISDLRRYSA;LNGPISDLRRYSAA;NGPISDLRRYSAAK;GPISDLRRYSAAKV;PISDLRRYSAAKVP;ISDLRRYSAAKVPL;SDLRRYSAAKVPLA;DLRRYSAAKVPLAD;LRRYSAAKVPLADV;RRYSAAKVPLADVE;RYSAAKVPLADVEQ;YSAAKVPLADVEQV;SAAKVPLADVEQVC;AAKVPLADVEQVCR;AKVPLADVEQVCRK;KVPLADVEQVCRKF;VPLADVEQVCRKFD;PLADVEQVCRKFDV;LADVEQVCRKFDVT;ADVEQVCRKFDVTI;DVEQVCRKFDVTIN;VEQVCRKFDVTIND;EQVCRKFDVTINDV;QVCRKFDVTINDVA;VCRKFDVTINDVAL;CRKFDVTINDVALA;RKFDVTINDVALAA;KFDVTINDVALAAI;FDVTINDVALAAIT;DVTINDVALAAITE;VTINDVALAAITES;TINDVALAAITESY;INDVALAAITESYR;NDVALAAITESYRN;DVALAAITESYRNV;VALAAITESYRNVL;ALAAITESYRNVLI;LAAITESYRNVLIQ;AAITESYRNVLIQR;AITESYRNVLIQRG;ITESYRNVLIQRGE;TESYRNVLIQRGER;ESYRNVLIQRGERP;SYRNVLIQRGERPR;YRNVLIQRGERPRF;RNVLIQRGERPRFD;NVLIQRGERPRFDS;VLIQRGERPRFDSL;LIQRGERPRFDSLR;IQRGERPRFDSLRT;QRGERPRFDSLRTL;RGERPRFDSLRTLV;GERPRFDSLRTLVP;ERPRFDSLRTLVPV;RPRFDSLRTLVPVS;PRFDSLRTLVPVST;RFDSLRTLVPVSTR;FDSLRTLVPVSTRS;DSLRTLVPVSTRSN;SLRTLVPVSTRSNS;LRTLVPVSTRSNSA;RTLVPVSTRSNSAL;TLVPVSTRSNSALS;LVPVSTRSNSALSK;VPVSTRSNSALSKT;PVSTRSNSALSKTD;VSTRSNSALSKTDN;STRSNSALSKTDNR;TRSNSALSKTDNRV;RSNSALSKTDNRVS;SNSALSKTDNRVSL;NSALSKTDNRVSLM;SALSKTDNRVSLML;ALSKTDNRVSLMLP;LSKTDNRVSLMLPN;SKTDNRVSLMLPNL;KTDNRVSLMLPNLP;TDNRVSLMLPNLPV;DNRVSLMLPNLPVD;NRVSLMLPNLPVDQ;RVSLMLPNLPVDQE;VSLMLPNLPVDQEN;SLMLPNLPVDQENP;LMLPNLPVDQENPL;MLPNLPVDQENPLQ;LPNLPVDQENPLQR;PNLPVDQENPLQRL;NLPVDQENPLQRLR;LPVDQENPLQRLRI;PVDQENPLQRLRIV;VDQENPLQRLRIVH;DQENPLQRLRIVHS;QENPLQRLRIVHSR;ENPLQRLRIVHSRL;NPLQRLRIVHSRLT;PLQRLRIVHSRLTR;LQRLRIVHSRLTRA;QRLRIVHSRLTRAK;RLRIVHSRLTRAKA;LRIVHSRLTRAKAG;RIVHSRLTRAKAGG;IVHSRLTRAKAGGQ;VHSRLTRAKAGGQR;HSRLTRAKAGGQRQ;SRLTRAKAGGQRQF;RLTRAKAGGQRQFG;LTRAKAGGQRQFGN;TRAKAGGQRQFGNT;RAKAGGQRQFGNTL;AKAGGQRQFGNTLM;KAGGQRQFGNTLMA;AGGQRQFGNTLMAI;GGQRQFGNTLMAIA;GQRQFGNTLMAIAN;QRQFGNTLMAIANR;RQFGNTLMAIANRL;QFGNTLMAIANRLP;FGNTLMAIANRLPF;GNTLMAIANRLPFP;NTLMAIANRLPFPM;TLMAIANRLPFPMT;LMAIANRLPFPMTA;MAIANRLPFPMTAW;AIANRLPFPMTAWA;IANRLPFPMTAWAV;ANRLPFPMTAWAVG;NRLPFPMTAWAVGL;RLPFPMTAWAVGLL;LPFPMTAWAVGLLM;PFPMTAWAVGLLMR;FPMTAWAVGLLMRL;PMTAWAVGLLMRLP;MTAWAVGLLMRLPQ;TAWAVGLLMRLPQR;AWAVGLLMRLPQRG;WAVGLLMRLPQRGV;AVGLLMRLPQRGVV;VGLLMRLPQRGVVT;GLLMRLPQRGVVTV;LLMRLPQRGVVTVA;LMRLPQRGVVTVAT;MRLPQRGVVTVATN;RLPQRGVVTVATNV;LPQRGVVTVATNVP;PQRGVVTVATNVPG;QRGVVTVATNVPGP;RGVVTVATNVPGPR;GVVTVATNVP | |

Fig. 30 continued

| | | |
|---|---|---|
| | GPRR;VVTVATNVPGPRRP;VTVATNVPGPRRPL;TVATNVPGPRRPLQ;VATNVPGPRRPLQI;ATNVPGPRRPLQIM;TNVPGPRRPLQIMG;NVPGPRRPLQIMGR;VPGPRRPLQIMGRR;PGPRRPLQIMGRRV;GPRRPLQIMGRRVL;PRRPLQIMGRRVLD;RRPLQIMGRRVLDL;RPLQIMGRRVLDLY;PLQIMGRRVLDLYP;LQIMGRRVLDLYPV;QIMGRRVLDLYPVS;IMGRRVLDLYPVSP;MGRRVLDLYPVSPI;GRRVLDLYPVSPIA;RRVLDLYPVSPIAM;RVLDLYPVSPIAMQ;VLDLYPVSPIAMQL;LDLYPVSPIAMQLR;DLYPVSPIAMQLRT;LYPVSPIAMQLRTS;YPVSPIAMQLRTSV;PVSPIAMQLRTSVA;VSPIAMQLRTSVAM;SPIAMQLRTSVAML;PIAMQLRTSVAMLS;IAMQLRTSVAMLSY;AMQLRTSVAMLSYA;MQLRTSVAMLSYAD;QLRTSVAMLSYADD;LRTSVAMLSYADDL;RTSVAMLSYADDLY;TSVAMLSYADDLYF;SVAMLSYADDLYFG;VAMLSYADDLYFGI;AMLSYADDLYFGIL;MLSYADDLYFGILA;LSYADDLYFGILAD;SYADDLYFGILADY;YADDLYFGILADYD;ADDLYFGILADYDV;DDLYFGILADYDVV;DLYFGILADYDVVA;LYFGILADYDVVAD;YFGILADYDVVADA;FGILADYDVVADAG;GILADYDVVADAGQ;ILADYDVVADAGQL;LADYDVVADAGQLA;ADYDVVADAGQLAR;DYDVVADAGQLARG;YDVVADAGQLARGI;DVVADAGQLARGIE;VVADAGQLARGIED;VADAGQLARGIEDA;ADAGQLARGIEDAV;DAGQLARGIEDAVA;AGQLARGIEDAVAR;GQLARGIEDAVARL;QLARGIEDAVARLV;LARGIEDAVARLVA;ARGIEDAVARLVAI;RGIEDAVARLVAIS;GIEDAVARLVAISK;IEDAVARLVAISKR;EDAVARLVAISKRR;DAVARLVAISKRRK;AVARLVAISKRRKV;VARLVAISKRRKVT;ARLVAISKRRKVTR;RLVAISKRRKVTRR;LVAISKRRKVTRRR;VAISKRRKVTRRRG;AISKRRKVTRRRGA;ISKRRKVTRRRGAL;SKRRKVTRRRGALS;KRRKVTRRRGALSL;RRKVTRRRGALSLV;RKVTRRRGALSLVV;<br><br>15 mers:<br>MNHLTTLDAGFLKAE;NHLTTLDAGFLKAED;HLTTLDAGFLKAEDV;LTTLDAGFLKAEDVD;TTLDAGFLKAEDVDR;TLDAGFLKAEDVDRH;LDAGFLKAEDVDRHV;DAGFLKAEDVDRHVS;AGFLKAEDVDRHVSL;GFLKAEDVDRHVSLA;FLKAEDVDRHVSLAI;LKAEDVDRHVSLAIG;KAEDVDRHVSLAIGA;AEDVDRHVSLAIGAL;EDVDRHVSLAIGALA;DVDRHVSLAIGALAV;VDRHVSLAIGALAVI;DRHVSLAIGALAVIE;RHVSLAIGALAVIEG;HVSLAIGALAVIEGP;VSLAIGALAVIEGPA;SLAIGALAVIEGPAP;LAIGALAVIEGPAPD;AIGALAVIEGPAPDQ;IGALAVIEGPAPDQE;GALAVIEGPAPDQEA;ALAVIEGPAPDQEAF;LAVIEGPAPDQEAFL;AVIEGPAPDQEAFLS;VIEGPAPDQEAFLSS;IEGPAPDQEAFLSSL;EGPAPDQEAFLSSLA;GPAPDQEAFLSSLAQ;PAPDQEAFLSSLAQR;APDQEAFLSSLAQRL;PDQEAFLSSLAQRLR;DQEAFLSSLAQRLRP;QEAFLSSLAQRLRPC;EAFLSSLAQRLRPCT;AFLSSLAQRLRPCTR;FLSSLAQRLRPCTRF;LSSLAQRLRPCTRFG;SSLAQRLRPCTRFGQ;SLAQRLRPCTRFGQR;LAQRLRPCTRFGQRL;AQRLRPCTRFGQRLR;QRLRPCTRFGQRLRL;RLRPCTRFGQRLRLR;LRPCTRFGQRLRLRP;RPCTRFGQRLRLRPF;PCTRFGQRLRLRPFD;CTRFGQRLRLRPFDL;TRFGQRLRLRPFDLG;RFGQRLRLRPFDLGA;FGQRLRLRPFDLGAP;GQRLRLRPFDLGAPK;QRLRLRPFDLGAPKW;RLRLRPFDLGAPKWV;LRLRPFDLGAPKWVD;RLRPFDLGAPKWVDD;LRPFDLGAPKWVDDP;RPFDLGAPKWVDDPD;PFDLGAPKWVDDPDF;FDLGAPKWVDDPDFD;DLGAPKWVDDPDFDL;LGAPKWVDDPDFDLG;GAPKWVDDPDFDLGR;APKWVDDPDFDLGRH;PKWVDDPDFDLGRHV;KWVDDPDFDLGRHVW;WVDDPDFDLGRHVWR;VDDPDFDLGRHVWRI;DDPDFDLGRHVWRIA;DPDFDLGRHVWRIAL;PDFDLGRHVWRIALP;DFDLGRHVWRIALPR;FDLGRHVWRIALPRP;DLGRHVWRIALPRPG;LGRHVWRIALPRPGN;GRHVWRIALPRPGNE;RHVWRIALPRPGNED;HVWRIALPRPGNEDQ;VWRIALPRPGNEDQL;WRIALPRPGNEDQLF;RIALPRPGNEDQLFE;IALPRPGNEDQLFEL;ALPRPGNEDQLFELI;LPRPGNEDQLFELIA;PRP | |

Fig. 30 continued

| | | |
|---|---|---|
| | GNEDQLFELIAD;RPGNEDQLFELIADL;PGNEDQLFELIADLM;GNEDQLFELIADLMA;NEDQLFELIADLMAR;EDQLFELIADLMARR;DQLFELIADLMARRL;QLFELIADLMARRLD;LFELIADLMARRLDR;FELIADLMARRLDRG;ELIADLMARRLDRGR;LIADLMARRLDRGRP;IADLMARRLDRGRPL;ADLMARRLDRGRPLW;DLMARRLDRGRPLWE;LMARRLDRGRPLWEV;MARRLDRGRPLWEVW;ARRLDRGRPLWEVWV;RRLDRGRPLWEVWVI;RLDRGRPLWEVWVIE;LDRGRPLWEVWVIEG;DRGRPLWEVWVIEGL;RGRPLWEVWVIEGLA;GRPLWEVWVIEGLAD;RPLWEVWVIEGLADS;PLWEVWVIEGLADSK;LWEVWVIEGLADSKW;WEVWVIEGLADSKWA;EVWVIEGLADSKWAI;VWVIEGLADSKWAIL;WVIEGLADSKWAILT;VIEGLADSKWAILTK;IEGLADSKWAILTKL;EGLADSKWAILTKLH;GLADSKWAILTKLHH;LADSKWAILTKLHHC;ADSKWAILTKLHHCM;DSKWAILTKLHHCMA;SKWAILTKLHHCMAD;KWAILTKLHHCMADG;WAILTKLHHCMADGI;AILTKLHHCMADGIA;ILTKLHHCMADGIAA;LTKLHHCMADGIAAT;TKLHHCMADGIAATH;KLHHCMADGIAATHL;LHHCMADGIAATHLL;HHCMADGIAATHLLA;HCMADGIAATHLLAG;CMADGIAATHLLAGL;MADGIAATHLLAGLS;ADGIAATHLLAGLSD;DGIAATHLLAGLSDE;GIAATHLLAGLSDES;IAATHLLAGLSDESM;AATHLLAGLSDESMS;ATHLLAGLSDESMSD;THLLAGLSDESMSDS;HLLAGLSDESMSDSF;LLAGLSDESMSDSFA;LAGLSDESMSDSFAS;AGLSDESMSDSFASN;GLSDESMSDSFASNI;LSDESMSDSFASNIH;SDESMSDSFASNIHT;DESMSDSFASNIHTT;ESMSDSFASNIHTTM;SMSDSFASNIHTTMQ;MSDSFASNIHTTMQS;SDSFASNIHTTMQSQ;DSFASNIHTTMQSQS;SFASNIHTTMQSQSA;FASNIHTTMQSQSAS;ASNIHTTMQSQSASV;SNIHTTMQSQSASVR;NIHTTMQSQSASVRR;IHTTMQSQSASVRRG;HTTMQSQSASVRRGG;TTMQSQSASVRRGGF;TMQSQSASVRRGGFR;MQSQSASVRRGGFRV;QSQSASVRRGGFRVN;SQSASVRRGGFRVNP;QSASVRRGGFRVNPS;SASVRRGGFRVNPSE;ASVRRGGFRVNPSEA;SVRRGGFRVNPSEAL;VRRGGFRVNPSEALT;RRGGFRVNPSEALTA;RGGFRVNPSEALTAS;GGFRVNPSEALTAST;GFRVNPSEALTASTA;FRVNPSEALTASTAV;RVNPSEALTASTAVM;VNPSEALTASTAVMA;NPSEALTASTAVMAG;PSEALTASTAVMAGI;SEALTASTAVMAGIV;EALTASTAVMAGIVR;ALTASTAVMAGIVRA;LTASTAVMAGIVRAA;TASTAVMAGIVRAAK;ASTAVMAGIVRAAKG;STAVMAGIVRAAKGA;TAVMAGIVRAAKGAS;AVMAGIVRAAKGASE;VMAGIVRAAKGASEI;MAGIVRAAKGASEIA;AGIVRAAKGASEIAA;GIVRAAKGASEIAAG;IVRAAKGASEIAAGV;VRAAKGASEIAAGVL;RAAKGASEIAAGVLS;AAKGASEIAAGVLSP;AKGASEIAAGVLSPA;KGASEIAAGVLSPAA;GASEIAAGVLSPAAS;ASEIAAGVLSPAASS;SEIAAGVLSPAASSL;EIAAGVLSPAASSLN;IAAGVLSPAASSLNG;AAGVLSPAASSLNGP;AGVLSPAASSLNGPI;GVLSPAASSLNGPIS;VLSPAASSLNGPISD;LSPAASSLNGPISDL;SPAASSLNGPISDLR;PAASSLNGPISDLRR;AASSLNGPISDLRRY;ASSLNGPISDLRRYS;SSLNGPISDLRRYSA;SLNGPISDLRRYSAA;LNGPISDLRRYSAAK;NGPISDLRRYSAAKV;GPISDLRRYSAAKVP;PISDLRRYSAAKVPL;ISDLRRYSAAKVPLA;SDLRRYSAAKVPLAD;DLRRYSAAKVPLADV;LRRYSAAKVPLADVE;RRYSAAKVPLADVEQ;RYSAAKVPLADVEQV;YSAAKVPLADVEQVC;SAAKVPLADVEQVCR;AAKVPLADVEQVCRK;AKVPLADVEQVCRKF;KVPLADVEQVCRKFD;VPLADVEQVCRKFDV;PLADVEQVCRKFDVT;LADVEQVCRKFDVTI;ADVEQVCRKFDVTIN;DVEQVCRKFDVTIND;VEQVCRKFDVTINDV;EQVCRKFDVTINDVA;QVCRKFDVTINDVAL;VCRKFDVTINDVALA;CRKFDVTINDVALAA;RKFDVTINDVALAAI;KFDVTINDVALAAIT;FDVTINDVALAAITE;DVTINDVALAAITES;VTINDVALAAITESY;TINDVALAAITESYR;INDVALAAITESYRN;NDVALAAITESYRNV;DVALAAITESYRNVL;VALAAITESYRNVLI;ALAAITESYRNVLIQ;LAAITESYRNVLIQR;AAITESYRNVLIQRG;AITESYRNVLIQRGE;ITESYRNVLIQRGER;TESYRNVLIQRGERP;ESYRNVLIQRGERPR;SYRNVLIQRGERPRF;YRNVLIQRGERPRF | |

Fig. 30 continued

| | | |
|---|---|---|
| | D;RNVLIQRGERPRFDS;NVLIQRGERPRFDSL;VLIQRGERPRFDSLR;LIQRGERPRFDSLRT;IQRGERPRFDSLRTL;QRGERPRFDSLRTLV;RGERPRFDSLRTLVP;GERPRFDSLRTLVPV;ERPRFDSLRTLVPVS;RPRFDSLRTLVPVST;PRFDSLRTLVPVSTR;RFDSLRTLVPVSTRS;FDSLRTLVPVSTRSN;DSLRTLVPVSTRSNS;SLRTLVPVSTRSNSA;LRTLVPVSTRSNSAL;RTLVPVSTRSNSALS;TLVPVSTRSNSALSK;LVPVSTRSNSALSKT;VPVSTRSNSALSKTD;PVSTRSNSALSKTDN;VSTRSNSALSKTDNR;STRSNSALSKTDNRV;TRSNSALSKTDNRVS;RSNSALSKTDNRVSL;SNSALSKTDNRVSLM;NSALSKTDNRVSLML;SALSKTDNRVSLMLP;ALSKTDNRVSLMLPN;LSKTDNRVSLMLPNL;SKTDNRVSLMLPNLP;KTDNRVSLMLPNLPV;TDNRVSLMLPNLPVD;DNRVSLMLPNLPVDQ;NRVSLMLPNLPVDQE;RVSLMLPNLPVDQEN;VSLMLPNLPVDQENP;SLMLPNLPVDQENPL;LMLPNLPVDQENPLQ;MLPNLPVDQENPLQR;LPNLPVDQENPLQRL;PNLPVDQENPLQRLR;NLPVDQENPLQRLRI;LPVDQENPLQRLRIV;PVDQENPLQRLRIVH;VDQENPLQRLRIVHS;DQENPLQRLRIVHSR;QENPLQRLRIVHSRL;ENPLQRLRIVHSRLT;NPLQRLRIVHSRLTR;PLQRLRIVHSRLTRA;LQRLRIVHSRLTRAK;QRLRIVHSRLTRAKA;RLRIVHSRLTRAKAG;LRIVHSRLTRAKAGG;RIVHSRLTRAKAGGQ;IVHSRLTRAKAGGQR;VHSRLTRAKAGGQRQ;HSRLTRAKAGGQRQF;SRLTRAKAGGQRQFG;RLTRAKAGGQRQFGN;LTRAKAGGQRQFGNT;TRAKAGGQRQFGNTL;RAKAGGQRQFGNTLM;AKAGGQRQFGNTLMA;KAGGQRQFGNTLMAI;AGGQRQFGNTLMAIA;GGQRQFGNTLMAIAN;GQRQFGNTLMAIANR;QRQFGNTLMAIANRL;RQFGNTLMAIANRLP;QFGNTLMAIANRLPF;FGNTLMAIANRLPFP;GNTLMAIANRLPFPM;NTLMAIANRLPFPMT;TLMAIANRLPFPMTA;LMAIANRLPFPMTAW;MAIANRLPFPMTAWA;AIANRLPFPMTAWAV;IANRLPFPMTAWAVG;ANRLPFPMTAWAVGL;NRLPFPMTAWAVGLL;RLPFPMTAWAVGLLM;LPFPMTAWAVGLLMR;PFPMTAWAVGLLMRL;FPMTAWAVGLLMRLP;PMTAWAVGLLMRLPQ;MTAWAVGLLMRLPQR;TAWAVGLLMRLPQRG;AWAVGLLMRLPQRGV;WAVGLLMRLPQRGVV;AVGLLMRLPQRGVVT;VGLLMRLPQRGVVTV;GLLMRLPQRGVVTVA;LLMRLPQRGVVTVAT;LMRLPQRGVVTVATN;MRLPQRGVVTVATNV;RLPQRGVVTVATNVP;LPQRGVVTVATNVPG;PQRGVVTVATNVPGP;QRGVVTVATNVPGPR;RGVVTVATNVPGPRR;GVVTVATNVPGPRRP;VVTVATNVPGPRRPL;VTVATNVPGPRRPLQ;TVATNVPGPRRPLQI;VATNVPGPRRPLQIM;ATNVPGPRRPLQIMG;TNVPGPRRPLQIMGR;NVPGPRRPLQIMGRR;VPGPRRPLQIMGRRV;PGPRRPLQIMGRRVL;GPRRPLQIMGRRVLD;PRRPLQIMGRRVLDL;RRPLQIMGRRVLDLY;RPLQIMGRRVLDLYP;PLQIMGRRVLDLYPV;LQIMGRRVLDLYPVS;QIMGRRVLDLYPVSP;IMGRRVLDLYPVSPI;MGRRVLDLYPVSPIA;GRRVLDLYPVSPIAM;RRVLDLYPVSPIAMQ;RVLDLYPVSPIAMQL;VLDLYPVSPIAMQLR;LDLYPVSPIAMQLRT;DLYPVSPIAMQLRTS;LYPVSPIAMQLRTSV;YPVSPIAMQLRTSVA;PVSPIAMQLRTSVAM;VSPIAMQLRTSVAML;SPIAMQLRTSVAMLS;PIAMQLRTSVAMLSY;IAMQLRTSVAMLSYA;AMQLRTSVAMLSYAD;MQLRTSVAMLSYADD;QLRTSVAMLSYADDL;LRTSVAMLSYADDLY;RTSVAMLSYADDLYF;TSVAMLSYADDLYFG;SVAMLSYADDLYFGI;VAMLSYADDLYFGIL;AMLSYADDLYFGILA;MLSYADDLYFGILAD;LSYADDLYFGILADY;SYADDLYFGILADYD;YADDLYFGILADYDV;ADDLYFGILADYDVV;DDLYFGILADYDVVA;DLYFGILADYDVVAD;LYFGILADYDVVADA;YFGILADYDVVADAG;FGILADYDVVADAGQ;GILADYDVVADAGQL;ILADYDVVADAGQLA;LADYDVVADAGQLAR;ADYDVVADAGQLARG;DYDVVADAGQLARGI;YDVVADAGQLARGIE;DVVADAGQLARGIED;VVADAGQLARGIEDA;VADAGQLARGIEDAV;ADAGQLARGIEDAVA;DAGQLARGIEDAVAR;AGQLARGIEDAVARL;GQLARGIEDAVARLV;QLARGIEDAVARLVA;LARGIEDAVARLVAI;ARGIEDAVARLVAIS;RGIEDAVARLVAISK;GIEDAVARLVAISKR;IEDAVARLVAISKRR;EDAVARLVAISKRRK;DAVARLVAISKRRKV;AV | |

Fig. 30 continued

| | | |
|---|---|---|
| | ARLVAISKRRKVT;VARLVAISKRRKVTR;ARLVAISKRRKVTRR;RLVAISKRRKVTRRR;LVAISKRRKVTRRRG;VAISKRRKVTRRRGA;AISKRRKVTRRRGAL;ISKRRKVTRRRGALS;SKRRKVTRRRGALSL;KRRKVTRRRGALSLV;RRKVTRRRGALSLVV;<br><br>16 mers:<br>MNHLTTLDAGFLKAED;NHLTTLDAGFLKAEDV;HLTTLDAGFLKAEDVD;LTTLDAGFLKAEDVDR;TTLDAGFLKAEDVDRH;TLDAGFLKAEDVDRHV;LDAGFLKAEDVDRHVS;DAGFLKAEDVDRHVSL;AGFLKAEDVDRHVSLA;GFLKAEDVDRHVSLAI;FLKAEDVDRHVSLAIG;LKAEDVDRHVSLAIGA;KAEDVDRHVSLAIGAL;AEDVDRHVSLAIGALA;EDVDRHVSLAIGALAV;DVDRHVSLAIGALAVI;VDRHVSLAIGALAVIE;DRHVSLAIGALAVIEG;RHVSLAIGALAVIEGP;HVSLAIGALAVIEGPA;VSLAIGALAVIEGPAP;SLAIGALAVIEGPAPD;LAIGALAVIEGPAPDQ;AIGALAVIEGPAPDQE;IGALAVIEGPAPDQEA;GALAVIEGPAPDQEAF;ALAVIEGPAPDQEAFL;LAVIEGPAPDQEAFLS;AVIEGPAPDQEAFLSS;VIEGPAPDQEAFLSSL;IEGPAPDQEAFLSSLA;EGPAPDQEAFLSSLAQ;GPAPDQEAFLSSLAQR;PAPDQEAFLSSLAQRL;APDQEAFLSSLAQRLR;PDQEAFLSSLAQRLRP;DQEAFLSSLAQRLRPC;QEAFLSSLAQRLRPCT;EAFLSSLAQRLRPCTR;AFLSSLAQRLRPCTRF;FLSSLAQRLRPCTRFG;LSSLAQRLRPCTRFGQ;SSLAQRLRPCTRFGQR;SLAQRLRPCTRFGQRL;LAQRLRPCTRFGQRLR;AQRLRPCTRFGQRLRL;QRLRPCTRFGQRLRLR;RLRPCTRFGQRLRLRP;LRPCTRFGQRLRLRPF;RPCTRFGQRLRLRPFD;PCTRFGQRLRLRPFDL;CTRFGQRLRLRPFDLG;TRFGQRLRLRPFDLGA;RFGQRLRLRPFDLGAP;FGQRLRLRPFDLGAPK;GQRLRLRPFDLGAPKW;QRLRLRPFDLGAPKWV;RLRLRPFDLGAPKWVD;LRLRPFDLGAPKWVDD;RLRPFDLGAPKWVDDP;LRPFDLGAPKWVDDPD;RPFDLGAPKWVDDPDF;PFDLGAPKWVDDPDFD;FDLGAPKWVDDPDFDL;DLGAPKWVDDPDFDLG;LGAPKWVDDPDFDLGR;GAPKWVDDPDFDLGRH;APKWVDDPDFDLGRHV;PKWVDDPDFDLGRHVW;KWVDDPDFDLGRHVWR;WVDDPDFDLGRHVWRI;VDDPDFDLGRHVWRIA;DDPDFDLGRHVWRIAL;DPDFDLGRHVWRIALP;PDFDLGRHVWRIALPR;DFDLGRHVWRIALPRP;FDLGRHVWRIALPRPG;DLGRHVWRIALPRPGN;LGRHVWRIALPRPGNE;GRHVWRIALPRPGNED;RHVWRIALPRPGNEDQ;HVWRIALPRPGNEDQL;VWRIALPRPGNEDQLF;WRIALPRPGNEDQLFE;RIALPRPGNEDQLFEL;IALPRPGNEDQLFELI;ALPRPGNEDQLFELIA;LPRPGNEDQLFELIAD;PRPGNEDQLFELIADL;RPGNEDQLFELIADLM;PGNEDQLFELIADLMA;GNEDQLFELIADLMAR;NEDQLFELIADLMARR;EDQLFELIADLMARRL;DQLFELIADLMARRLD;QLFELIADLMARRLDR;LFELIADLMARRLDRG;FELIADLMARRLDRGR;ELIADLMARRLDRGRP;LIADLMARRLDRGRPL;IADLMARRLDRGRPLW;ADLMARRLDRGRPLWE;DLMARRLDRGRPLWEV;LMARRLDRGRPLWEVW;MARRLDRGRPLWEVWV;ARRLDRGRPLWEVWVI;RRLDRGRPLWEVWVIE;RLDRGRPLWEVWVIEG;LDRGRPLWEVWVIEGL;DRGRPLWEVWVIEGLA;RGRPLWEVWVIEGLAD;GRPLWEVWVIEGLADS;RPLWEVWVIEGLADSK;PLWEVWVIEGLADSKW;LWEVWVIEGLADSKWA;WEVWVIEGLADSKWAI;EVWVIEGLADSKWAIL;VWVIEGLADSKWAILT;WVIEGLADSKWAILTK;VIEGLADSKWAILTKL;IEGLADSKWAILTKLH;EGLADSKWAILTKLHH;GLADSKWAILTKLHHC;LADSKWAILTKLHHCM;ADSKWAILTKLHHCMA;DSKWAILTKLHHCMAD;SKWAILTKLHHCMADG;KWAILTKLHHCMADGI;WAILTKLHHCMADGIA;AILTKLHHCMADGIAA;ILTKLHHCMADGIAAT;LTKLHHCMADGIAATH;TKLHHCMADGIAATHL;KLHHCMADGIAATHLL;LHHCMADGIAATHLLA;HHCMADGIAATHLLAG;HCMADGIAATHLLAGL;CMADGIAATHLLAGLS;MADGIAATHLLAGLSD;ADGIAATHLLAGLSDE;DGIAATHLLAGLSDES;GIAATHLLAGLSDESM;IAATHLLAGLSDESMS;AATHLLAGLSDESMSD;ATHLLAGLSDESMS | |

Fig. 30 continued

| | | |
|---|---|---|
| | DS;THLLAGLSDESMSDSF;HLLAGLSDESMSDSFA;LLAGLSDESMSDSFA<br>S;LAGLSDESMSDSFASN;AGLSDESMSDSFASNI;GLSDESMSDSFASNIH;<br>LSDESMSDSFASNIHT;SDESMSDSFASNIHTT;DESMSDSFASNIHTTM;ES<br>MSDSFASNIHTTMQ;SMSDSFASNIHTTMQS;MSDSFASNIHTTMQSQ;SDS<br>FASNIHTTMQSQS;DSFASNIHTTMQSQSA;SFASNIHTTMQSQSAS;FASNI<br>HTTMQSQSASV;ASNIHTTMQSQSASVR;SNIHTTMQSQSASVRR;NIHTTM<br>QSQSASVRRG;IHTTMQSQSASVRRGG;HTTMQSQSASVRRGGF;TTMQS<br>QSASVRRGGFR;TMQSQSASVRRGGFRV;MQSQSASVRRGGFRVN;QSQ<br>SASVRRGGFRVNP;SQSASVRRGGFRVNPS;QSASVRRGGFRVNPSE;SA<br>SVRRGGFRVNPSEA;ASVRRGGFRVNPSEAL;SVRRGGFRVNPSEALT;VR<br>RGGFRVNPSEALTA;RRGGFRVNPSEALTAS;RGGFRVNPSEALTAST;GG<br>FRVNPSEALTASTA;GFRVNPSEALTASTAV;FRVNPSEALTASTAVM;RVN<br>PSEALTASTAVMA;VNPSEALTASTAVMAG;NPSEALTASTAVMAGI;PSEAL<br>TASTAVMAGIV;SEALTASTAVMAGIVR;EALTASTAVMAGIVRA;ALTASTAV<br>MAGIVRAA;LTASTAVMAGIVRAAK;TASTAVMAGIVRAAKG;ASTAVMAGIV<br>RAAKGA;STAVMAGIVRAAKGAS;TAVMAGIVRAAKGASE;AVMAGIVRAAK<br>GASEI;VMAGIVRAAKGASEIA;MAGIVRAAKGASEIAA;AGIVRAAKGASEIA<br>AG;GIVRAAKGASEIAAGV;IVRAAKGASEIAAGVL;VRAAKGASEIAAGVLS;<br>RAAKGASEIAAGVLSP;AAKGASEIAAGVLSPA;AKGASEIAAGVLSPAA;KG<br>ASEIAAGVLSPAAS;GASEIAAGVLSPAASS;ASEIAAGVLSPAASSL;SEIAA<br>GVLSPAASSLN;EIAAGVLSPAASSLNG;IAAGVLSPAASSLNGP;AAGVLSP<br>AASSLNGPI;AGVLSPAASSLNGPIS;GVLSPAASSLNGPISD;VLSPAASSLN<br>GPISDL;LSPAASSLNGPISDLR;SPAASSLNGPISDLRR;PAASSLNGPISDL<br>RRY;AASSLNGPISDLRRYS;ASSLNGPISDLRRYSA;SSLNGPISDLRRYSA<br>A;SLNGPISDLRRYSAAK;LNGPISDLRRYSAAKV;NGPISDLRRYSAAKVP;G<br>PISDLRRYSAAKVPL;PISDLRRYSAAKVPLA;ISDLRRYSAAKVPLAD;SDLR<br>RYSAAKVPLADV;DLRRYSAAKVPLADVE;LRRYSAAKVPLADVEQ;RRYSA<br>AKVPLADVEQV;RYSAAKVPLADVEQVC;YSAAKVPLADVEQVCR;SAAKVP<br>LADVEQVCRK;AAKVPLADVEQVCRKF;AKVPLADVEQVCRKFD;KVPLADV<br>EQVCRKFDV;VPLADVEQVCRKFDVT;PLADVEQVCRKFDVTI;LADVEQVC<br>RKFDVTIN;ADVEQVCRKFDVTIND;DVEQVCRKFDVTINDV;VEQVCRKFDV<br>TINDVA;EQVCRKFDVTINDVAL;QVCRKFDVTINDVALA;VCRKFDVTINDVA<br>LAA;CRKFDVTINDVALAAI;RKFDVTINDVALAAIT;KFDVTINDVALAAITE;FD<br>VTINDVALAAITES;DVTINDVALAAITESY;VTINDVALAAITESYR;TINDVALA<br>AITESYRN;INDVALAAITESYRNV;NDVALAAITESYRNVL;DVALAAITESYR<br>NVLI;VALAAITESYRNVLIQ;ALAAITESYRNVLIQR;LAAITESYRNVLIQRG;A<br>AITESYRNVLIQRGE;AITESYRNVLIQRGER;ITESYRNVLIQRGERP;TESYR<br>NVLIQRGERPR;ESYRNVLIQRGERPRF;SYRNVLIQRGERPRFD;YRNVLIQ<br>RGERPRFDS;RNVLIQRGERPRFDSL;NVLIQRGERPRFDSLR;VLIQRGER<br>PRFDSLRT;LIQRGERPRFDSLRTL;IQRGERPRFDSLRTLV;QRGERPRFDS<br>LRTLVP;RGERPRFDSLRTLVPV;GERPRFDSLRTLVPVS;ERPRFDSLRTLV<br>PVST;RPRFDSLRTLVPVSTR;PRFDSLRTLVPVSTRS;RFDSLRTLVPVSTR<br>SN;FDSLRTLVPVSTRSNS;DSLRTLVPVSTRSNSA;SLRTLVPVSTRSNSAL;<br>LRTLVPVSTRSNSALS;RTLVPVSTRSNSALSK;TLVPVSTRSNSALSKT;LVP<br>VSTRSNSALSKTD;VPVSTRSNSALSKTDN;PVSTRSNSALSKTDNR;VSTR<br>SNSALSKTDNRV;STRSNSALSKTDNRVS;TRSNSALSKTDNRVSL;RSNSA<br>LSKTDNRVSLM;SNSALSKTDNRVSLML;NSALSKTDNRVSLMLP;SALSKT<br>DNRVSLMLPN;ALSKTDNRVSLMLPNL;LSKTDNRVSLMLPNLP;SKTDNRV<br>SLMLPNLPV;KTDNRVSLMLPNLPVD;TDNRVSLMLPNLPVDQ;DNRVSLML<br>PNLPVDQE;NRVSLMLPNLPVDQEN;RVSLMLPNLPVDQENP;VSLMLPNLP<br>VDQENPL;SLMLPNLPVDQENPLQ;LMLPNLPVDQENPLQR;MLPNLPVDQ<br>ENPLQRL;LPNLPVDQENPLQRLR;PNLPVDQENPLQRLRI;NLPVDQENPL<br>QRLRIV;LPVDQENPLQRLRIVH;PVDQENPLQRLRIVHS;VDQENPLQRLRI | |

Fig. 30 continued

| | | |
|---|---|---|
| | VHSR;DQENPLQRLRIVHSRL;QENPLQRLRIVHSRLT;ENPLQRLRIVHSRLTR;NPLQRLRIVHSRLTRA;PLQRLRIVHSRLTRAK;LQRLRIVHSRLTRAKA;QRLRIVHSRLTRAKAG;RLRIVHSRLTRAKAGG;LRIVHSRLTRAKAGGQ;RIVHSRLTRAKAGGQR;IVHSRLTRAKAGGQRQ;VHSRLTRAKAGGQRQF;HSRLTRAKAGGQRQFG;SRLTRAKAGGQRQFGN;RLTRAKAGGQRQFGNT;LTRAKAGGQRQFGNTL;TRAKAGGQRQFGNTLM;RAKAGGQRQFGNTLMA;AKAGGQRQFGNTLMAI;KAGGQRQFGNTLMAIA;AGGQRQFGNTLMAIAN;GGQRQFGNTLMAIANR;GQRQFGNTLMAIANRL;QRQFGNTLMAIANRLP;RQFGNTLMAIANRLPF;QFGNTLMAIANRLPFP;FGNTLMAIANRLPFPM;GNTLMAIANRLPFPMT;NTLMAIANRLPFPMTA;TLMAIANRLPFPMTAW;LMAIANRLPFPMTAWA;MAIANRLPFPMTAWAV;AIANRLPFPMTAWAVG;IANRLPFPMTAWAVGL;ANRLPFPMTAWAVGLL;NRLPFPMTAWAVGLLM;RLPFPMTAWAVGLLMR;LPFPMTAWAVGLLMRL;PFPMTAWAVGLLMRLP;FPMTAWAVGLLMRLPQ;PMTAWAVGLLMRLPQR;MTAWAVGLLMRLPQRG;TAWAVGLLMRLPQRGV;AWAVGLLMRLPQRGVV;WAVGLLMRLPQRGVVT;AVGLLMRLPQRGVVTV;VGLLMRLPQRGVVTVA;GLLMRLPQRGVVTVAT;LLMRLPQRGVVTVATN;LMRLPQRGVVTVATNV;MRLPQRGVVTVATNVP;RLPQRGVVTVATNVPG;LPQRGVVTVATNVPGP;PQRGVVTVATNVPGPR;QRGVVTVATNVPGPRR;RGVVTVATNVPGPRRP;GVVTVATNVPGPRRPL;VVTVATNVPGPRRPLQ;VTVATNVPGPRRPLQI;TVATNVPGPRRPLQIM;VATNVPGPRRPLQIMG;ATNVPGPRRPLQIMGR;TNVPGPRRPLQIMGRR;NVPGPRRPLQIMGRRV;VPGPRRPLQIMGRRVL;PGPRRPLQIMGRRVLD;GPRRPLQIMGRRVLDL;PRRPLQIMGRRVLDLY;RRPLQIMGRRVLDLYP;RPLQIMGRRVLDLYPV;PLQIMGRRVLDLYPVS;LQIMGRRVLDLYPVSP;QIMGRRVLDLYPVSPI;IMGRRVLDLYPVSPIA;MGRRVLDLYPVSPIAM;GRRVLDLYPVSPIAMQ;RRVLDLYPVSPIAMQL;RVLDLYPVSPIAMQLR;VLDLYPVSPIAMQLRT;LDLYPVSPIAMQLRTS;DLYPVSPIAMQLRTSV;LYPVSPIAMQLRTSVA;YPVSPIAMQLRTSVAM;PVSPIAMQLRTSVAML;VSPIAMQLRTSVAMLS;SPIAMQLRTSVAMLSY;PIAMQLRTSVAMLSYA;IAMQLRTSVAMLSYAD;AMQLRTSVAMLSYADD;MQLRTSVAMLSYADDL;QLRTSVAMLSYADDLY;LRTSVAMLSYADDLYF;RTSVAMLSYADDLYFG;TSVAMLSYADDLYFGI;SVAMLSYADDLYFGIL;VAMLSYADDLYFGILA;AMLSYADDLYFGILAD;MLSYADDLYFGILADY;LSYADDLYFGILADYD;SYADDLYFGILADYDV;YADDLYFGILADYDVV;ADDLYFGILADYDVVA;DDLYFGILADYDVVAD;DLYFGILADYDVVADA;LYFGILADYDVVADAG;YFGILADYDVVADAGQ;FGILADYDVVADAGQL;GILADYDVVADAGQLA;ILADYDVVADAGQLAR;LADYDVVADAGQLARG;ADYDVVADAGQLARGI;DYDVVADAGQLARGIE;YDVVADAGQLARGIED;DVVADAGQLARGIEDA;VVADAGQLARGIEDAV;VADAGQLARGIEDAVA;ADAGQLARGIEDAVAR;DAGQLARGIEDAVARL;AGQLARGIEDAVARLV;GQLARGIEDAVARLVA;QLARGIEDAVARLVAI;LARGIEDAVARLVAIS;ARGIEDAVARLVAISK;RGIEDAVARLVAISKR;GIEDAVARLVAISKRR;IEDAVARLVAISKRRK;EDAVARLVAISKRRKV;DAVARLVAISKRRKVT;AVARLVAISKRRKVTR;VARLVAISKRRKVTRR;ARLVAISKRRKVTRRR;RLVAISKRRKVTRRRG;LVAISKRRKVTRRRGA;VAISKRRKVTRRRGAL;AISKRRKVTRRRGALS;ISKRRKVTRRRGALSL;SKRRKVTRRRGALSLV;KRRKVTRRRGALSLVV | |
| 19 | **<NP_217647.1 hypothetical protein Rv3131;Mycobacterium tuberculosis H37Rv>**<br>MNTHFPDAETVRTVLTLAVRAPSIHNTQPWRWRVCPTSLELFSRPDMQLRSTDPDGRELILSCGVALHHCVVALASLGWQAKVNRFPDPKDRCHLATIGVQPLVPDQADVALAAAIPRRRTDRRAYSCWPVPGGDIALMAARAARGGVMLRQVSALDRMKAIVAQAVLDHVTDEEYLRELTIWSGRYGSVAGVPARNEPPSDPSAPIPGRLFAGPGLSQPSDVLPADDGAAILALGTETDDRLARLRAGEAASIVLLTATAMGLACCPITEPLEIAKTRDAVRAEVFGAGGYPQMLLRVGWA | 141183-142876 |

Fig. 30 continued

| | | |
|---|---|---|
| | PINADPLPPTPRRELSQVVEWPEELLRQRC<br><br>8mer<br>HFPDAETV;AETVRTVL;ETVRTVLT;TVRTVLTL;RTVLTLAV;TVLTLAVR;VLTLAVRA;LAVRAPSI;NTQPWRWR;TQPWRWRV;CPTSLELF;TSLELFSR;ELFSRPDM;RSTDPDGR;ELILSCGV;ILSCGVAL;GVALHHCV;VALHHCVV;ALHHCVVA;LHHCVVAL;CVVALASL;VALASLGW;ALASLGWQ;ASLGWQAK;SLGWQAKV;GWQAKVNR;WQAKVNRF;VNRFPDPK;ATIGVQPL;TIGVQPLV;LVPDQADV;VPDQADVA;DVALAAAI;ALAAAIPR;LAAAIPRR;AAAIPRRR;IPRRRTDR;RRTDRRAY;RAYSCWPV;WPVPGGDI;VPGGDIAL;DIALMAAR;ALMAARAA;LMAARAAR;RAARGGVM;AARGGVML;VMLRQVSA;MLRQVSAL;RQVSALDR;QVSALDRM;VSALDRMK;ALDRMKAI;RMKAIVAQ;MKAIVAQA;KAIVAQAV;AIVAQAVL;AQAVLDHV;HVTDEEYL;VTDEEYLR;DEEYLREL;EEYLRELT;EYLRELTI;ELTIWSGR;LTIWSGRY;RYGSVAGV;SVAGVPAR;APIPGRLF;PIPGRLFA;IPGRLFAG;RLFAGPGL;GLSQPSDV;QPSDVLPA;VLPADDGA;LPADDGAA;PADDGAAI;DGAAILAL;ILALGTET;ETDDRLAR;RLRAGEAA;RAGEAASI;GEAASIVL;EAASIVLL;IVLLTATA;VLLTATAM;LTATAMGL;MGLACCPI;GLACCPIT;PITEPLEI;KTRDAVRA;DAVRAEVF;AEVFGAGG;EVFGAGGY;YPQMLLRV;MLLRVGWA;LRVGWAPI;APINADPL;DPLPPTPR;PPTPRREL;TPRRELSQ;SQVVEWPE;VEWPEELL<br>9mer<br>NTHFPDAET;HFPDAETVR;FPDAETVRT;AETVRTVLT;ETVRTVLTL;TVRTVLTLA;RTVLTLAVR;TLAVRAPSI;AVRAPSIHN;SIHNTQPWR;IHNTQPWRW;NTQPWRWRV;RWRVCPTSL;RVCPTSLEL;PTSLELFSR;LFSRPDMQL;FSRPDMQLR;RPDMQLRST;STDPDGREL;RELILSCGV;LILSCGVAL;CGVALHHCV;GVALHHCVV;ALHHCVVAL;HCVVALASL;VVALASLGW;ALASLGWQA;LASLGWQAK;ASLGWQAKV;LGWQAKVNR;GWQAKVNRF;KVNRFPDPK;RCHLATIGV;LATIGVQPL;ATIGVQPLV;PLVPDQADV;VPDQADVAL;VALAAAIPR;ALAAAIPRR;LAAAIPRRR;AIPRRRTDR;RRRTDRRAY;RRTDRRAYS;RRAYSCWPV;WPVPGGDIA;PVPGGDIAL;VPGGDIALM;DIALMAARA;ALMAARAAR;AARAARGGV;RAARGGVML;AARGGVMLR;GVMLRQVSA;VMLRQVSAL;RQVSALDRM;QVSALDRMK;SALDRMKAI;ALDRMKAIV;RMKAIVAQA;MKAIVAQAV;KAIVAQAVL;VAQAVLDHV;HVTDEEYLR;EEYLRELTI;EYLRELTIW;YLRELTIWS;RELTIWSGR;ELTIWSGRY;TIWSGRYGS;GRYGSVAGV;GSVAGVPAR;PPSDPSAPI;DPSAPIPGR;APIPGRLFA;IPGRLFAGP;GRLFAGPGL;RLFAGPGLS;GLSQPSDVL;SQPSDVLPA;VLPADDGAA;LPADDGAAI;PADDGAAIL;ETDDRLARL;RLRAGEAAS;RAGEAASIV;GEAASIVLL;EAASIVLLT;SIVLLTATA;IVLLTATAM;LLTATAMGL;LTATAMGLA;AMGLACCPI;ACCPITEPL;CPITEPLEI;ITEPLEIAK;EPLEIAKTR;EIAKTRDAV;IAKTRDAVR;KTRDAVRAE;TRDAVRAEV;AVRAEVFGA;AEVFGAGGY;GAGGYPQML;GYPQMLLRV;YPQMLLRVG;QMLLRVGWA;MLLRVGWAP;LLRVGWAPI;RVGWAPINA;WAPINADPL;LPPTPRREL;TPRRELSQV;RELSQVVEW;SQVVEWPEE;QVVEWPEEL<br>10mer<br>NTHFPDAETV;THFPDAETVR;FPDAETVRTV;AETVRTVLTL;ETVRTVLTLA;TVRTVLTLAV;VRTVLTLAVR;LTLAVRAPSI;APSIHNTQPW;SIHNTQPWRW;QPWRWRVCPT;WRWRVCPTSL;RVCPTSLELF;CPTSLELFSR;ELFSRPDMQL;LFSRPDMQLR;STDPDGRELI;RELILSCGVA;ELILSCGVAL;SCGVALHHCV;CGVALHHCVV;ALHHCVVALA;HHCVVALASL;CVVALASLGW;ALASLGWQAK;LASLGWQAKV;SLGWQAKVNR;FPDPKDRCHL;HLATIGVQPL;LATIGVQPLV;PLVPDQADVA;LVPDQADVAL;VPDQADVALA;QADVALAAAI;DVALAAAIPR;VALAAAIPRR;ALAAAIPRRR;AAIPRRRTDR;AIPRRRTDRR;IPRRRTDRRA;RRTDRRAYSC;RTDRRAYSCW;WPVPGGDIAL;PVPGGDIAL | |

Fig. 30 continued

| | | |
|---|---|---|
| | M;VPGGDIALMA;IALMAARAAR;MAARAARGGV;AARAARGGVM;RAARGG<br>VMLR;GVMLRQVSAL;MLRQVSALDR;RQVSALDRMK;QVSALDRMKA;SAL<br>DRMKAIV;ALDRMKAIVA;RMKAIVAQAV;MKAIVAQAVL;IVAQAVLDHV;VLD<br>HVTDEEY;VTDEEYLREL;EEYLRELTIW;YLRELTIWSG;RELTIWSGRY;TIW<br>SGRYGSV;EPPSDPSAPI;APIPGRLFAG;IPGRLFAGPG;RLFAGPGLSQ;VL<br>PADDGAAI;LPADDGAAIL;PADDGAAILA;ALGTETDDRL;ETDDRLARLR;RL<br>ARLRAGEA;RLRAGEAASI;RAGEAASIVL;EAASIVLLTA;SIVLLTATAM;VLL<br>TATAMGL;LLTATAMGLA;TAMGLACCPI;LACCPITEPL;CPITEPLEIA;EIAKT<br>RDAVR;KTRDAVRAEV;RAEVFGAGGY;EVFGAGGYPQ;FGAGGYPQML;G<br>AGGYPQMLL;GGYPQMLLRV;YPQMLLRVGW;MLLRVGWAPI;PLPPTPRR<br>EL;PTPRRELSQV;TPRRELSQVV;SQVVEWPEEL;QVVEWPEELL;VVEWP<br>EELLR<br>11mer<br>NTHFPDAETVR;HFPDAETVRTV;FPDAETVRTVL;AETVRTVLTLA;ETVRTV<br>LTLAV;TVRTVLTLAVR;VLTLAVRAPSI;AVRAPSIHNTQ;RAPSIHNTQPW;P<br>SIHNTQPWRW;SIHNTQPWRWR;TQPWRWRVCPT;RWRVCPTSLEL;LELF<br>SRPDMQL;ELFSRPDMQLR;MQLRSTDPDGR;STDPDGRELIL;RELILSCGV<br>AL;ILSCGVALHHC;GVALHHCVVAL;HCVVALASLGW;VVALASLGWQA;VA<br>LASLGWQAK;ALASLGWQAKV;ASLGWQAKVNR;QAKVNRFPDPK;KVNRF<br>PDPKDR;RFPDPKDRCHL;FPDPKDRCHLA;DPKDRCHLATI;HLATIGVQPL<br>V;PLVPDQADVAL;LVPDQADVALA;VPDQADVALAA;DVALAAAIPRR;VALA<br>AAIPRRR;ALAAAIPRRRT;AAAIPRRRTDR;AAIPRRRTDRR;IPRRRTDRRA<br>Y;RRTDRRAYSCW;WPVPGGDIALM;PVPGGDIALMA;VPGGDIALMAA;DIA<br>LMAARAAR;LMAARAARGGV;MAARAARGGVM;AARAARGGVML;AARGG<br>VMLRQV;VMLRQVSALDR;MLRQVSALDRM;RQVSALDRMKA;QVSALDRM<br>KAI;ALDRMKAIVAQ;DRMKAIVAQAV;RMKAIVAQAVL;AIVAQAVLDHV;AVL<br>DHVTDEEY;VLDHVTDEEYL;HVTDEEYLREL;EEYLRELTIWS;YLRELTIWS<br>GR;LTIWSGRYGSV;TIWSGRYGSVA;GRYGSVAGVPA;RYGSVAGVPAR;D<br>PSAPIPGRLF;IPGRLFAGPGL;RLFAGPGLSQP;GPGLSQPSDVL;GLSQPS<br>DVLPA;DVLPADDGAAI;VLPADDGAAIL;LPADDGAAILA;PADDGAAILAL;IL<br>ALGTETDDR;ETDDRLARLRA;RLARLRAGEAA;RLRAGEAASIV;LRAGEAA<br>SIVL;RAGEAASIVLL;EAASIVLLTAT;AASIVLLTATA;IVLLTATAMGL;VLLTA<br>TAMGLA;LLTATAMGLAC;ATAMGLACCPI;GLACCPITEPL;ITEPLEIAKTR;E<br>PLEIAKTRDA;PLEIAKTRDAV;EIAKTRDAVRA;KTRDAVRAEVF;AEVFGAG<br>GYPQ;EVFGAGGYPQM;FGAGGYPQMLL;GYPQMLLRVGW;YPQMLLRVG<br>WA;QMLLRVGWAPI;LLRVGWAPINA;APINADPLPPT;NADPLPPTPRR;DPL<br>PPTPRREL;SQVVEWPEELL;QVVEWPEELLR<br><br>13 mers:<br>MNTHFPDAETVRT;NTHFPDAETVRTV;THFPDAETVRTVL;HFPDAETVRT<br>VLT;FPDAETVRTVLTL;PDAETVRTVLTLA;DAETVRTVLTLAV;AETVRTVLT<br>LAVR;ETVRTVLTLAVRA;TVRTVLTLAVRAP;VRTVLTLAVRAPS;RTVLTLAV<br>RAPSI;TVLTLAVRAPSIH;VLTLAVRAPSIHN;LTLAVRAPSIHNT;TLAVRAPSI<br>HNTQ;LAVRAPSIHNTQP;AVRAPSIHNTQPW;VRAPSIHNTQPWR;RAPSIH<br>NTQPWRW;APSIHNTQPWRWR;PSIHNTQPWRWRV;SIHNTQPWRWRVC;<br>IHNTQPWRWRVCP;HNTQPWRWRVCPT;NTQPWRWRVCPTS;TQPWRW<br>RVCPTSL;QPWRWRVCPTSLE;PWRWRVCPTSLEL;WRWRVCPTSLELF;R<br>WRVCPTSLELFS;WRVCPTSLELFSR;RVCPTSLELFSRP;VCPTSLELFSRP<br>D;CPTSLELFSRPDM;PTSLELFSRPDMQ;TSLELFSRPDMQL;SLELFSRPD<br>MQLR;LELFSRPDMQLRS;ELFSRPDMQLRST;LFSRPDMQLRSTD;FSRPD<br>MQLRSTDP;SRPDMQLRSTDPD;RPDMQLRSTDPDG;PDMQLRSTDPDGR<br>;DMQLRSTDPDGRE;MQLRSTDPDGREL;QLRSTDPDGRELI;LRSTDPDGR<br>ELIL;RSTDPDGRELILS;STDPDGRELILSC;TDPDGRELILSCG;DPDGRELIL | |

Fig. 30 continued

| | | |
|---|---|---|
| | SCGV;PDGRELILSCGVA;DGRELILSCGVAL;GRELILSCGVALH;RELILSCGVALHH;ELILSCGVALHHC;LILSCGVALHHCV;ILSCGVALHHCVV;LSCGVALHHCVVA;SCGVALHHCVVAL;CGVALHHCVVALA;GVALHHCVVALAS;VALHHCVVALASL;ALHHCVVALASLG;LHHCVVALASLGW;HHCVVALASLGWQ;HCVVALASLGWQA;CVVALASLGWQAK;VVALASLGWQAKV;VALASLGWQAKVN;ALASLGWQAKVNR;LASLGWQAKVNRF;ASLGWQAKVNRFP;SLGWQAKVNRFPD;LGWQAKVNRFPDP;GWQAKVNRFPDPK;WQAKVNRFPDPKD;QAKVNRFPDPKDR;AKVNRFPDPKDRC;KVNRFPDPKDRCH;VNRFPDPKDRCHL;NRFPDPKDRCHLA;RFPDPKDRCHLAT;FPDPKDRCHLATI;PDPKDRCHLATIG;DPKDRCHLATIGV;PKDRCHLATIGVQ;KDRCHLATIGVQP;DRCHLATIGVQPL;RCHLATIGVQPLV;CHLATIGVQPLVP;HLATIGVQPLVPD;LATIGVQPLVPDQ;ATIGVQPLVPDQA;TIGVQPLVPDQAD;IGVQPLVPDQADV;GVQPLVPDQADVA;VQPLVPDQADVAL;QPLVPDQADVALA;PLVPDQADVALAA;LVPDQADVALAAA;VPDQADVALAAAI;PDQADVALAAAIP;DQADVALAAAIPR;QADVALAAAIPRR;ADVALAAAIPRRR;DVALAAAIPRRRT;VALAAAIPRRRTD;ALAAAIPRRRTDR;LAAAIPRRRTDRR;AAAIPRRRTDRRA;AAIPRRRTDRRAY;AIPRRRTDRRAYS;IPRRRTDRRAYSC;PRRRTDRRAYSCW;RRRTDRRAYSCWP;RRTDRRAYSCWPV;RTDRRAYSCWPVP;TDRRAYSCWPVPG;DRRAYSCWPVPGG;RRAYSCWPVPGGD;RAYSCWPVPGGDI;AYSCWPVPGGDIA;YSCWPVPGGDIAL;SCWPVPGGDIALM;CWPVPGGDIALMA;WPVPGGDIALMAA;PVPGGDIALMAAR;VPGGDIALMAARA;PGGDIALMAARAA;GGDIALMAARAAR;GDIALMAARAARG;DIALMAARAARGG;IALMAARAARGGV;ALMAARAARGGVM;LMAARAARGGVML;MAARAARGGVMLR;AARAARGGVMLRQ;ARAARGGVMLRQV;RAARGGVMLRQVS;AARGGVMLRQVSA;ARGGVMLRQVSAL;RGGVMLRQVSALD;GGVMLRQVSALDR;GVMLRQVSALDRM;VMLRQVSALDRMK;MLRQVSALDRMKA;LRQVSALDRMKAI;RQVSALDRMKAIV;QVSALDRMKAIVA;VSALDRMKAIVAQ;SALDRMKAIVAQA;ALDRMKAIVAQAV;LDRMKAIVAQAVL;DRMKAIVAQAVLD;RMKAIVAQAVLDH;MKAIVAQAVLDHV;KAIVAQAVLDHVT;AIVAQAVLDHVTD;IVAQAVLDHVTDE;VAQAVLDHVTDEE;AQAVLDHVTDEEY;QAVLDHVTDEEYL;AVLDHVTDEEYLR;VLDHVTDEEYLRE;LDHVTDEEYLREL;DHVTDEEYLRELT;HVTDEEYLRELTI;VTDEEYLRELTIW;TDEEYLRELTIWS;DEEYLRELTIWSG;EEYLRELTIWSGR;EYLRELTIWSGRY;YLRELTIWSGRYG;LRELTIWSGRYGS;RELTIWSGRYGSV;ELTIWSGRYGSVA;LTIWSGRYGSVAG;TIWSGRYGSVAGV;IWSGRYGSVAGVP;WSGRYGSVAGVPA;SGRYGSVAGVPAR;GRYGSVAGVPARN;RYGSVAGVPARNE;YGSVAGVPARNEP;GSVAGVPARNEPP;SVAGVPARNEPPS;VAGVPARNEPPSD;AGVPARNEPPSDP;GVPARNEPPSDPS;VPARNEPPSDPSA;PARNEPPSDPSAP;ARNEPPSDPSAPI;RNEPPSDPSAPIP;NEPPSDPSAPIPG;EPPSDPSAPIPGR;PPSDPSAPIPGRL;PSDPSAPIPGRLF;SDPSAPIPGRLFA;DPSAPIPGRLFAG;PSAPIPGRLFAGP;SAPIPGRLFAGPG;APIPGRLFAGPGL;PIPGRLFAGPGLS;IPGRLFAGPGLSQ;PGRLFAGPGLSQP;GRLFAGPGLSQPS;RLFAGPGLSQPSD;LFAGPGLSQPSDV;FAGPGLSQPSDVL;AGPGLSQPSDVLP;GPGLSQPSDVLPA;PGLSQPSDVLPAD;GLSQPSDVLPADD;LSQPSDVLPADDG;SQPSDVLPADDGA;QPSDVLPADDGAA;PSDVLPADDGAAI;SDVLPADDGAAIL;DVLPADDGAAILA;VLPADDGAAILAL;LPADDGAAILALG;PADDGAAILALGT;ADDGAAILALGTE;DDGAAILALGTET;DGAAILALGTETD;GAAILALGTETDD;AAILALGTETDDR;AILALGTETDDRL;ILALGTETDDRLA;LALGTETDDRLAR;ALGTETDDRLARL;LGTETDDRLARLR;GTETDDRLARLRA;TETDDRLARLRAG;ETDDRLARLRAGE;TDDRLARLRAGEA;DDRLARLRAGEAA;DRLARLRAGEAAS;RLARLRAGEAASI;LARLRAGEAASIV;ARLRAGEAASIVL;RLRAGEAASIVLL;LRAGEAASIVLLT;RAGEAASIVLLTA;AGEAASIVLLTAT;GEAASIVLLTATA;EAASIVLLTATAM;AASIVLLTATAMG;ASIVLLTATAMGL;SIVLL | |

Fig. 30 continued

| | | |
|---|---|---|
| | TATAMGLA;IVLLTATAMGLAC;VLLTATAMGLACC;LLTATAMGLACCP;LTATAMGLACCPI;TATAMGLACCPIT;ATAMGLACCPITE;TAMGLACCPITEP;AMGLACCPITEPL;MGLACCPITEPLE;GLACCPITEPLEI;LACCPITEPLEIA;ACCPITEPLEIAK;CCPITEPLEIAKT;CPITEPLEIAKTR;PITEPLEIAKTRD;ITEPLEIAKTRDA;TEPLEIAKTRDAV;EPLEIAKTRDAVR;PLEIAKTRDAVRA;LEIAKTRDAVRAE;EIAKTRDAVRAEV;IAKTRDAVRAEVF;AKTRDAVRAEVFG;KTRDAVRAEVFGA;TRDAVRAEVFGAG;RDAVRAEVFGAGG;DAVRAEVFGAGGY;AVRAEVFGAGGYP;VRAEVFGAGGYPQ;RAEVFGAGGYPQM;AEVFGAGGYPQML;EVFGAGGYPQMLL;VFGAGGYPQMLLR;FGAGGYPQMLLRV;GAGGYPQMLLRVG;AGGYPQMLLRVGW;GGYPQMLLRVGWA;GYPQMLLRVGWAP;YPQMLLRVGWAPI;PQMLLRVGWAPIN;QMLLRVGWAPINA;MLLRVGWAPINAD;LLRVGWAPINADP;LRVGWAPINADPL;RVGWAPINADPLP;VGWAPINADPLPP;GWAPINADPLPPT;WAPINADPLPPTP;APINADPLPPTPR;PINADPLPPTPRR;INADPLPPTPRRE;NADPLPPTPRREL;ADPLPPTPRRELS;DPLPPTPRRELSQ;PLPPTPRRELSQV;LPPTPRRELSQVV;PPTPRRELSQVVE;PTPRRELSQVVEW;TPRRELSQVVEWP;PRRELSQVVEWPE;RRELSQVVEWPEE;RELSQVVEWPEEL;ELSQVVEWPEELL;LSQVVEWPEELLR;SQVVEWPEELLRQ;QVVEWPEELLRQR;VVEWPEELLRQRC;<br><br>14 mers:<br>MNTHFPDAETVRTV;NTHFPDAETVRTVL;THFPDAETVRTVLT;HFPDAETVRTVLTL;FPDAETVRTVLTLA;PDAETVRTVLTLAV;DAETVRTVLTLAVR;AETVRTVLTLAVRA;ETVRTVLTLAVRAP;TVRTVLTLAVRAPS;VRTVLTLAVRAPSI;RTVLTLAVRAPSIH;TVLTLAVRAPSIHN;VLTLAVRAPSIHNT;LTLAVRAPSIHNTQ;TLAVRAPSIHNTQP;LAVRAPSIHNTQPW;AVRAPSIHNTQPWR;VRAPSIHNTQPWRW;RAPSIHNTQPWRWR;APSIHNTQPWRWRV;PSIHNTQPWRWRVC;SIHNTQPWRWRVCP;IHNTQPWRWRVCPT;HNTQPWRWRVCPTS;NTQPWRWRVCPTSL;TQPWRWRVCPTSLE;QPWRWRVCPTSLEL;PWRWRVCPTSLELF;WRWRVCPTSLELFS;RWRVCPTSLELFSR;WRVCPTSLELFSRP;RVCPTSLELFSRPD;VCPTSLELFSRPDM;CPTSLELFSRPDMQ;PTSLELFSRPDMQL;TSLELFSRPDMQLR;SLELFSRPDMQLRS;LELFSRPDMQLRST;ELFSRPDMQLRSTD;LFSRPDMQLRSTDP;FSRPDMQLRSTDPD;SRPDMQLRSTDPDG;RPDMQLRSTDPDGR;PDMQLRSTDPDGRE;DMQLRSTDPDGREL;MQLRSTDPDGRELI;QLRSTDPDGRELIL;LRSTDPDGRELILS;RSTDPDGRELILSC;STDPDGRELILSCG;TDPDGRELILSCGV;DPDGRELILSCGVA;PDGRELILSCGVAL;DGRELILSCGVALH;GRELILSCGVALHH;RELILSCGVALHHC;ELILSCGVALHHCV;LILSCGVALHHCVV;ILSCGVALHHCVVA;LSCGVALHHCVVAL;SCGVALHHCVVALA;CGVALHHCVVALAS;GVALHHCVVALASL;VALHHCVVALASLG;ALHHCVVALASLGW;LHHCVVALASLGWQ;HHCVVALASLGWQA;HCVVALASLGWQAK;CVVALASLGWQAKV;VVALASLGWQAKVN;VALASLGWQAKVNR;ALASLGWQAKVNRF;LASLGWQAKVNRFP;ASLGWQAKVNRFPD;SLGWQAKVNRFPDP;LGWQAKVNRFPDPK;GWQAKVNRFPDPKD;WQAKVNRFPDPKDR;QAKVNRFPDPKDRC;AKVNRFPDPKDRCH;KVNRFPDPKDRCHL;VNRFPDPKDRCHLA;NRFPDPKDRCHLAT;RFPDPKDRCHLATI;FPDPKDRCHLATIG;PDPKDRCHLATIGV;DPKDRCHLATIGVQ;PKDRCHLATIGVQP;KDRCHLATIGVQPL;DRCHLATIGVQPLV;RCHLATIGVQPLVP;CHLATIGVQPLVPD;HLATIGVQPLVPDQ;LATIGVQPLVPDQA;ATIGVQPLVPDQAD;TIGVQPLVPDQADV;IGVQPLVPDQADVA;GVQPLVPDQADVAL;VQPLVPDQADVALA;QPLVPDQADVALAA;PLVPDQADVALAAA;LVPDQADVALAAAI;VPDQADVALAAAIP;PDQADVALAAAIPR;DQADVALAAAIPRR;QADVALAAAIPRRR;ADVALAAAIPRRRT;DVALAAAIPRRRTD;VALAAAIPRRRTDR;ALAAAIPRRRTDRR;LAAAIPRRRTDRRA;AAAIPRRRTDRRAY;AAIPRRRTDRRAYS;AIPRRRTDRRAYSC;IPRR | |

Fig. 30 continued

| | | |
|---|---|---|
| | RTDRRAYSCW;PRRRTDRRAYSCWP;RRRTDRRAYSCWPV;RRTDRRAYSCWPVP;RTDRRAYSCWPVPG;TDRRAYSCWPVPGG;DRRAYSCWPVPGGD;RRAYSCWPVPGGDI;RAYSCWPVPGGDIA;AYSCWPVPGGDIAL;YSCWPVPGGDIALM;SCWPVPGGDIALMA;CWPVPGGDIALMAA;WPVPGGDIALMAAR;PVPGGDIALMAARA;VPGGDIALMAARAA;PGGDIALMAARAAR;GGDIALMAARAARG;GDIALMAARAARGG;DIALMAARAARGGV;IALMAARAARGGVM;ALMAARAARGGVML;LMAARAARGGVMLR;MAARAARGGVMLRQ;AARAARGGVMLRQV;ARAARGGVMLRQVS;RAARGGVMLRQVSA;AARGGVMLRQVSAL;ARGGVMLRQVSALD;RGGVMLRQVSALDR;GGVMLRQVSALDRM;GVMLRQVSALDRMK;VMLRQVSALDRMKA;MLRQVSALDRMKAI;LRQVSALDRMKAIV;RQVSALDRMKAIVA;QVSALDRMKAIVAQ;VSALDRMKAIVAQA;SALDRMKAIVAQAV;ALDRMKAIVAQAVL;LDRMKAIVAQAVLD;DRMKAIVAQAVLDH;RMKAIVAQAVLDHV;MKAIVAQAVLDHVT;KAIVAQAVLDHVTD;AIVAQAVLDHVTDE;IVAQAVLDHVTDEE;VAQAVLDHVTDEEY;AQAVLDHVTDEEYL;QAVLDHVTDEEYLR;AVLDHVTDEEYLRE;VLDHVTDEEYLREL;LDHVTDEEYLRELT;DHVTDEEYLRELTI;HVTDEEYLRELTIW;VTDEEYLRELTIWS;TDEEYLRELTIWSG;DEEYLRELTIWSGR;EEYLRELTIWSGRY;EYLRELTIWSGRYG;YLRELTIWSGRYGS;LRELTIWSGRYGSV;RELTIWSGRYGSVA;ELTIWSGRYGSVAG;LTIWSGRYGSVAGV;TIWSGRYGSVAGVP;IWSGRYGSVAGVPA;WSGRYGSVAGVPAR;SGRYGSVAGVPARN;GRYGSVAGVPARNE;RYGSVAGVPARNEP;YGSVAGVPARNEPP;GSVAGVPARNEPPS;SVAGVPARNEPPSD;VAGVPARNEPPSDP;AGVPARNEPPSDPS;GVPARNEPPSDPSA;VPARNEPPSDPSAP;PARNEPPSDPSAPI;ARNEPPSDPSAPIP;RNEPPSDPSAPIPG;NEPPSDPSAPIPGR;EPPSDPSAPIPGRL;PPSDPSAPIPGRLF;PSDPSAPIPGRLFA;SDPSAPIPGRLFAG;DPSAPIPGRLFAGP;PSAPIPGRLFAGPG;SAPIPGRLFAGPGL;APIPGRLFAGPGLS;PIPGRLFAGPGLSQ;IPGRLFAGPGLSQP;PGRLFAGPGLSQPS;GRLFAGPGLSQPSD;RLFAGPGLSQPSDV;LFAGPGLSQPSDVL;FAGPGLSQPSDVLP;AGPGLSQPSDVLPA;GPGLSQPSDVLPAD;PGLSQPSDVLPADD;GLSQPSDVLPADDG;LSQPSDVLPADDGA;SQPSDVLPADDGAA;QPSDVLPADDGAAI;PSDVLPADDGAAIL;SDVLPADDGAAILA;DVLPADDGAAILAL;VLPADDGAAILALG;LPADDGAAILALGT;PADDGAAILALGTE;ADDGAAILALGTET;DDGAAILALGTETD;DGAAILALGTETDD;GAAILALGTETDDR;AAILALGTETDDRL;AILALGTETDDRLA;ILALGTETDDRLAR;LALGTETDDRLARL;ALGTETDDRLARLR;LGTETDDRLARLRA;GTETDDRLARLRAG;TETDDRLARLRAGE;ETDDRLARLRAGEA;TDDRLARLRAGEAA;DDRLARLRAGEAAS;DRLARLRAGEAASI;RLARLRAGEAASIV;LARLRAGEAASIVL;ARLRAGEAASIVLL;RLRAGEAASIVLLT;LRAGEAASIVLLTA;RAGEAASIVLLTAT;AGEAASIVLLTATA;GEAASIVLLTATAM;EAASIVLLTATAMG;AASIVLLTATAMGL;ASIVLLTATAMGLA;SIVLLTATAMGLAC;IVLLTATAMGLACC;VLLTATAMGLACCP;LLTATAMGLACCPI;LTATAMGLACCPIT;TATAMGLACCPITE;ATAMGLACCPITEP;TAMGLACCPITEPL;AMGLACCPITEPLE;MGLACCPITEPLEI;GLACCPITEPLEIA;LACCPITEPLEIAK;ACCPITEPLEIAKT;CCPITEPLEIAKTR;CPITEPLEIAKTRD;PITEPLEIAKTRDA;ITEPLEIAKTRDAV;TEPLEIAKTRDAVR;EPLEIAKTRDAVRA;PLEIAKTRDAVRAE;LEIAKTRDAVRAEV;EIAKTRDAVRAEVF;IAKTRDAVRAEVFG;AKTRDAVRAEVFGA;KTRDAVRAEVFGAG;TRDAVRAEVFGAGG;RDAVRAEVFGAGGY;DAVRAEVFGAGGYP;AVRAEVFGAGGYPQ;VRAEVFGAGGYPQM;RAEVFGAGGYPQML;AEVFGAGGYPQMLL;EVFGAGGYPQMLLR;VFGAGGYPQMLLRV;FGAGGYPQMLLRVG;GAGGYPQMLLRVGW;AGGYPQMLLRVGWA;GGYPQMLLRVGWAP;GYPQMLLRVGWAPI;YPQMLLRVGWAPIN;PQMLLRVGWAPINA;QMLLRVGWAPINAD;MLLRVGWAPINADP;LLRVGWAPINADPL;LRVGWAPINADPLP;RVGWAPINADPLPP;VGWAPINADPLPPT;GWAPINADPLPPTP;WAPINADPLPPTPR;API | |

Fig. 30 continued

| | | |
|---|---|---|
| | NADPLPPTPRR;PINADPLPPTPRRE;INADPLPPTPRREL;NADPLPPTPRR<br>ELS;ADPLPPTPRRELSQ;DPLPPTPRRELSQV;PLPPTPRRELSQVV;LPPT<br>PRRELSQVVE;PPTPRRELSQVVEW;PTPRRELSQVVEWP;TPRRELSQVV<br>EWPE;PRRELSQVVEWPEE;RRELSQVVEWPEEL;RELSQVVEWPEELL;E<br>LSQVVEWPEELLR;LSQVVEWPEELLRQ;SQVVEWPEELLRQR;QVVEWPE<br>ELLRQRC;<br><br>15 mers:<br>MNTHFPDAETVRTVL;NTHFPDAETVRTVLT;THFPDAETVRTVLTL;HFPDA<br>ETVRTVLTLA;FPDAETVRTVLTLAV;PDAETVRTVLTLAVR;DAETVRTVLTL<br>AVRA;AETVRTVLTLAVRAP;ETVRTVLTLAVRAPS;TVRTVLTLAVRAPSI;VR<br>TVLTLAVRAPSIH;RTVLTLAVRAPSIHN;TVLTLAVRAPSIHNT;VLTLAVRAP<br>SIHNTQ;LTLAVRAPSIHNTQP;TLAVRAPSIHNTQPW;LAVRAPSIHNTQPW<br>R;AVRAPSIHNTQPWRW;VRAPSIHNTQPWRWR;RAPSIHNTQPWRWRV;A<br>PSIHNTQPWRWRVC;PSIHNTQPWRWRVCP;SIHNTQPWRWRVCPT;IHNT<br>QPWRWRVCPTS;HNTQPWRWRVCPTSL;NTQPWRWRVCPTSLE;TQPW<br>RWRVCPTSLEL;QPWRWRVCPTSLELF;PWRWRVCPTSLELFS;WRWRVC<br>PTSLELFSR;RWRVCPTSLELFSRP;WRVCPTSLELFSRPD;RVCPTSLELFS<br>RPDM;VCPTSLELFSRPDMQ;CPTSLELFSRPDMQL;PTSLELFSRPDMQLR<br>;TSLELFSRPDMQLRS;SLELFSRPDMQLRST;LELFSRPDMQLRSTD;ELFS<br>RPDMQLRSTDP;LFSRPDMQLRSTDPD;FSRPDMQLRSTDPDG;SRPDMQ<br>LRSTDPDGR;RPDMQLRSTDPDGRE;PDMQLRSTDPDGREL;DMQLRSTD<br>PDGRELI;MQLRSTDPDGRELIL;QLRSTDPDGRELILS;LRSTDPDGRELILS<br>C;RSTDPDGRELILSCG;STDPDGRELILSCGV;TDPDGRELILSCGVA;DPD<br>GRELILSCGVAL;PDGRELILSCGVALH;DGRELILSCGVALHH;GRELILSCG<br>VALHHC;RELILSCGVALHHCV;ELILSCGVALHHCVV;LILSCGVALHHCVVA<br>;ILSCGVALHHCVVAL;LSCGVALHHCVVALA;SCGVALHHCVVALAS;CGVA<br>LHHCVVALASL;GVALHHCVVALASLG;VALHHCVVALASLGW;ALHHCVVA<br>LASLGWQ;LHHCVVALASLGWQA;HHCVVALASLGWQAK;HCVVALASLG<br>WQAKV;CVVALASLGWQAKVN;VVALASLGWQAKVNR;VALASLGWQAKV<br>NRF;ALASLGWQAKVNRFP;LASLGWQAKVNRFPD;ASLGWQAKVNRFPD<br>P;SLGWQAKVNRFPDPK;LGWQAKVNRFPDPKD;GWQAKVNRFPDPKDR;<br>WQAKVNRFPDPKDRC;QAKVNRFPDPKDRCH;AKVNRFPDPKDRCHL;KV<br>NRFPDPKDRCHLA;VNRFPDPKDRCHLAT;NRFPDPKDRCHLATI;RFPDPK<br>DRCHLATIG;FPDPKDRCHLATIGV;PDPKDRCHLATIGVQ;DPKDRCHLATI<br>GVQP;PKDRCHLATIGVQPL;KDRCHLATIGVQPLV;DRCHLATIGVQPLVP;<br>RCHLATIGVQPLVPD;CHLATIGVQPLVPDQ;HLATIGVQPLVPDQA;LATIGV<br>QPLVPDQAD;ATIGVQPLVPDQADV;TIGVQPLVPDQADVA;IGVQPLVPDQ<br>ADVAL;GVQPLVPDQADVALA;VQPLVPDQADVALAA;QPLVPDQADVALAA<br>A;PLVPDQADVALAAAI;LVPDQADVALAAAIP;VPDQADVALAAAIPR;PDQA<br>DVALAAAIPRR;DQADVALAAAIPRRR;QADVALAAAIPRRRT;ADVALAAAIP<br>RRRTD;DVALAAAIPRRRTDR;VALAAAIPRRRTDRR;ALAAAIPRRRTDRRA;<br>LAAAIPRRRTDRRAY;AAAIPRRRTDRRAYS;AAIPRRRTDRRAYSC;AIPRR<br>RTDRRAYSCW;IPRRRTDRRAYSCWP;PRRRTDRRAYSCWPV;RRRTDRR<br>AYSCWPVP;RRTDRRAYSCWPVPG;RTDRRAYSCWPVPGG;TDRRAYSC<br>WPVPGGD;DRRAYSCWPVPGGDI;RRAYSCWPVPGGDIA;RAYSCWPVPG<br>GDIAL;AYSCWPVPGGDIALM;YSCWPVPGGDIALMA;SCWPVPGGDIALMA<br>A;CWPVPGGDIALMAAR;WPVPGGDIALMAARA;PVPGGDIALMAARAA;VP<br>GGDIALMAARAAR;PGGDIALMAARAARG;GGDIALMAARAARGG;GDIALM<br>AARAARGGV;DIALMAARAARGGVM;IALMAARAARGGVML;ALMAARAAR<br>GGVMLR;LMAARAARGGVMLRQ;MAARAARGGVMLRQV;AARAARGGVM<br>LRQVS;ARAARGGVMLRQVSA;RAARGGVMLRQVSAL;AARGGVMLRQVS<br>ALD;ARGGVMLRQVSALDR;RGGVMLRQVSALDRM;GGVMLRQVSALDRM | |

Fig. 30 continued

| | | |
|---|---|---|
| | K;GVMLRQVSALDRMKA;VMLRQVSALDRMKAI;MLRQVSALDRMKAIV;LRQVSALDRMKAIVA;RQVSALDRMKAIVAQ;QVSALDRMKAIVAQA;VSALDRMKAIVAQAV;SALDRMKAIVAQAVL;ALDRMKAIVAQAVLD;LDRMKAIVAQAVLDH;DRMKAIVAQAVLDHV;RMKAIVAQAVLDHVT;MKAIVAQAVLDHVTD;KAIVAQAVLDHVTDE;AIVAQAVLDHVTDEE;IVAQAVLDHVTDEEY;VAQAVLDHVTDEEYL;AQAVLDHVTDEEYLR;QAVLDHVTDEEYLRE;AVLDHVTDEEYLREL;VLDHVTDEEYLRELT;LDHVTDEEYLRELTI;DHVTDEEYLRELTIW;HVTDEEYLRELTIWS;VTDEEYLRELTIWSG;TDEEYLRELTIWSGR;DEEYLRELTIWSGRY;EEYLRELTIWSGRYG;EYLRELTIWSGRYGS;YLRELTIWSGRYGSV;LRELTIWSGRYGSVA;RELTIWSGRYGSVAG;ELTIWSGRYGSVAGV;LTIWSGRYGSVAGVP;TIWSGRYGSVAGVPA;IWSGRYGSVAGVPAR;WSGRYGSVAGVPARN;SGRYGSVAGVPARNE;GRYGSVAGVPARNEP;RYGSVAGVPARNEPP;YGSVAGVPARNEPPS;GSVAGVPARNEPPSD;SVAGVPARNEPPSDP;VAGVPARNEPPSDPS;AGVPARNEPPSDPSA;GVPARNEPPSDPSAP;VPARNEPPSDPSAPI;PARNEPPSDPSAPIP;ARNEPPSDPSAPIPG;RNEPPSDPSAPIPGR;NEPPSDPSAPIPGRL;EPPSDPSAPIPGRLF;PPSDPSAPIPGRLFA;PSDPSAPIPGRLFAG;SDPSAPIPGRLFAGP;DPSAPIPGRLFAGPG;PSAPIPGRLFAGPGL;SAPIPGRLFAGPGLS;APIPGRLFAGPGLSQ;PIPGRLFAGPGLSQP;IPGRLFAGPGLSQPS;PGRLFAGPGLSQPSD;GRLFAGPGLSQPSDV;RLFAGPGLSQPSDVL;LFAGPGLSQPSDVLP;FAGPGLSQPSDVLPA;AGPGLSQPSDVLPAD;GPGLSQPSDVLPADD;PGLSQPSDVLPADDG;GLSQPSDVLPADDGA;LSQPSDVLPADDGAA;SQPSDVLPADDGAAI;QPSDVLPADDGAAIL;PSDVLPADDGAAILA;SDVLPADDGAAILAL;DVLPADDGAAILALG;VLPADDGAAILALGT;LPADDGAAILALGTE;PADDGAAILALGTET;ADDGAAILALGTETD;DDGAAILALGTETDD;DGAAILALGTETDDR;GAAILALGTETDDRL;AAILALGTETDDRLA;AILALGTETDDRLAR;ILALGTETDDRLARL;LALGTETDDRLARLR;ALGTETDDRLARLRA;LGTETDDRLARLRAG;GTETDDRLARLRAGE;TETDDRLARLRAGEA;ETDDRLARLRAGEAA;TDDRLARLRAGEAAS;DDRLARLRAGEAASI;DRLARLRAGEAASIV;RLARLRAGEAASIVL;LARLRAGEAASIVLL;ARLRAGEAASIVLLT;RLRAGEAASIVLLTA;LRAGEAASIVLLTAT;RAGEAASIVLLTATA;AGEAASIVLLTATAM;GEAASIVLLTATAMG;EAASIVLLTATAMGL;AASIVLLTATAMGLA;ASIVLLTATAMGLAC;SIVLLTATAMGLACC;IVLLTATAMGLACCP;VLLTATAMGLACCPI;LLTATAMGLACCPIT;LTATAMGLACCPITE;TATAMGLACCPITEP;ATAMGLACCPITEPL;TAMGLACCPITEPLE;AMGLACCPITEPLEI;MGLACCPITEPLEIA;GLACCPITEPLEIAK;LACCPITEPLEIAKT;ACCPITEPLEIAKTR;CCPITEPLEIAKTRD;CPITEPLEIAKTRDA;PITEPLEIAKTRDAV;ITEPLEIAKTRDAVR;TEPLEIAKTRDAVRA;EPLEIAKTRDAVRAE;PLEIAKTRDAVRAEV;LEIAKTRDAVRAEVF;EIAKTRDAVRAEVFG;IAKTRDAVRAEVFGA;AKTRDAVRAEVFGAG;KTRDAVRAEVFGAGG;TRDAVRAEVFGAGGY;RDAVRAEVFGAGGYP;DAVRAEVFGAGGYPQ;AVRAEVFGAGGYPQM;VRAEVFGAGGYPQML;RAEVFGAGGYPQMLL;AEVFGAGGYPQMLLR;EVFGAGGYPQMLLRV;VFGAGGYPQMLLRVG;FGAGGYPQMLLRVGW;GAGGYPQMLLRVGWA;AGGYPQMLLRVGWAP;GGYPQMLLRVGWAPI;GYPQMLLRVGWAPIN;YPQMLLRVGWAPINA;PQMLLRVGWAPINAD;QMLLRVGWAPINADP;MLLRVGWAPINADPL;LLRVGWAPINADPLP;LRVGWAPINADPLPP;RVGWAPINADPLPPT;VGWAPINADPLPPTP;GWAPINADPLPPTPR;WAPINADPLPPTPRR;APINADPLPPTPRRE;PINADPLPPTPRREL;INADPLPPTPRRELS;NADPLPPTPRRELSQ;ADPLPPTPRRELSQV;DPLPPTPRRELSQVV;PLPPTPRRELSQVVE;LPPTPRRELSQVVEW;PPTPRRELSQVVEWP;PTPRRELSQVVEWPE;TPRRELSQVVEWPEE;PRRELSQVVEWPEEL;RRELSQVVEWPEELL;RELSQVVEWPEELLR;ELSQVVEWPEELLRQ;LSQVVEWPEELLRQR;SQVVEWPEELLRQRC; | |

Fig. 30 continued

| | | |
|---|---|---|
| | 16 mers:<br>MNTHFPDAETVRTVLT;NTHFPDAETVRTVLTL;THFPDAETVRTVLTLA;HFPDAETVRTVLTLAV;FPDAETVRTVLTLAVR;PDAETVRTVLTLAVRA;DAETVRTVLTLAVRAP;AETVRTVLTLAVRAPS;ETVRTVLTLAVRAPSI;TVRTVLTLAVRAPSIH;VRTVLTLAVRAPSIHN;RTVLTLAVRAPSIHNT;TVLTLAVRAPSIHNTQ;VLTLAVRAPSIHNTQP;LTLAVRAPSIHNTQPW;TLAVRAPSIHNTQPWR;LAVRAPSIHNTQPWRW;AVRAPSIHNTQPWRWR;VRAPSIHNTQPWRWRV;RAPSIHNTQPWRWRVC;APSIHNTQPWRWRVCP;PSIHNTQPWRWRVCPT;SIHNTQPWRWRVCPTS;IHNTQPWRWRVCPTSL;HNTQPWRWRVCPTSLE;NTQPWRWRVCPTSLEL;TQPWRWRVCPTSLELF;QPWRWRVCPTSLELFS;PWRWRVCPTSLELFSR;WRWRVCPTSLELFSRP;RWRVCPTSLELFSRPD;WRVCPTSLELFSRPDM;RVCPTSLELFSRPDMQ;VCPTSLELFSRPDMQL;CPTSLELFSRPDMQLR;PTSLELFSRPDMQLRS;TSLELFSRPDMQLRST;SLELFSRPDMQLRSTD;LELFSRPDMQLRSTDP;ELFSRPDMQLRSTDPD;LFSRPDMQLRSTDPDG;FSRPDMQLRSTDPDGR;SRPDMQLRSTDPDGRE;RPDMQLRSTDPDGREL;PDMQLRSTDPDGRELI;DMQLRSTDPDGRELIL;MQLRSTDPDGRELILS;QLRSTDPDGRELILSC;LRSTDPDGRELILSCG;RSTDPDGRELILSCGV;STDPDGRELILSCGVA;TDPDGRELILSCGVAL;DPDGRELILSCGVALH;PDGRELILSCGVALHH;DGRELILSCGVALHHC;GRELILSCGVALHHCV;RELILSCGVALHHCVV;ELILSCGVALHHCVVA;LILSCGVALHHCVVAL;ILSCGVALHHCVVALA;LSCGVALHHCVVALAS;SCGVALHHCVVALASL;CGVALHHCVVALASLG;GVALHHCVVALASLGW;VALHHCVVALASLGWQ;ALHHCVVALASLGWQA;LHHCVVALASLGWQAK;HHCVVALASLGWQAKV;HCVVALASLGWQAKVN;CVVALASLGWQAKVNR;VVALASLGWQAKVNRF;VALASLGWQAKVNRFP;ALASLGWQAKVNRFPD;LASLGWQAKVNRFPDP;ASLGWQAKVNRFPDPK;SLGWQAKVNRFPDPKD;LGWQAKVNRFPDPKDR;GWQAKVNRFPDPKDRC;WQAKVNRFPDPKDRCH;QAKVNRFPDPKDRCHL;AKVNRFPDPKDRCHLA;KVNRFPDPKDRCHLAT;VNRFPDPKDRCHLATI;NRFPDPKDRCHLATIG;RFPDPKDRCHLATIGV;FPDPKDRCHLATIGVQ;PDPKDRCHLATIGVQP;DPKDRCHLATIGVQPL;PKDRCHLATIGVQPLV;KDRCHLATIGVQPLVP;DRCHLATIGVQPLVPD;RCHLATIGVQPLVPDQ;CHLATIGVQPLVPDQA;HLATIGVQPLVPDQAD;LATIGVQPLVPDQADV;ATIGVQPLVPDQADVA;TIGVQPLVPDQADVAL;IGVQPLVPDQADVALA;GVQPLVPDQADVALAA;VQPLVPDQADVALAAA;QPLVPDQADVALAAAI;PLVPDQADVALAAAIP;LVPDQADVALAAAIPR;VPDQADVALAAAIPRR;PDQADVALAAAIPRRR;DQADVALAAAIPRRRT;QADVALAAAIPRRRTD;ADVALAAAIPRRRTDR;DVALAAAIPRRRTDRR;VALAAAIPRRRTDRRA;ALAAAIPRRRTDRRAY;LAAAIPRRRTDRRAYS;AAAIPRRRTDRRAYSC;AAIPRRRTDRRAYSCW;AIPRRRTDRRAYSCWP;IPRRRTDRRAYSCWPV;PRRRTDRRAYSCWPVP;RRRTDRRAYSCWPVPG;RRTDRRAYSCWPVPGG;RTDRRAYSCWPVPGGD;TDRRAYSCWPVPGGDI;DRRAYSCWPVPGGDIA;RRAYSCWPVPGGDIAL;RAYSCWPVPGGDIALM;AYSCWPVPGGDIALMA;YSCWPVPGGDIALMAA;SCWPVPGGDIALMAAR;CWPVPGGDIALMAARA;WPVPGGDIALMAARAA;PVPGGDIALMAARAAR;VPGGDIALMAARAARG;PGGDIALMAARAARGG;GGDIALMAARAARGGV;GDIALMAARAARGGVM;DIALMAARAARGGVML;IALMAARAARGGVMLR;ALMAARAARGGVMLRQ;LMAARAARGGVMLRQV;MAARAARGGVMLRQVS;AARAARGGVMLRQVSA;ARAARGGVMLRQVSAL;RAARGGVMLRQVSALD;AARGGVMLRQVSALDR;ARGGVMLRQVSALDRM;RGGVMLRQVSALDRMK;GGVMLRQVSALDRMKA;GVMLRQVSALDRMKAI;VMLRQVSALDRMKAIV;MLRQVSALDRMKAIVA;LRQVSALDRMKAIVAQ;RQVSALDRMKAIVAQA;QVSALDRMKAIVAQAV;VSALDRMKAIVAQAVL;SALDRMKAIVAQAVLD;ALDRMKAIVAQAVLDH;LDRMKA | |

Fig. 30 continued

| | | |
|---|---|---|
| | IVAQAVLDHV;DRMKAIVAQAVLDHVT;RMKAIVAQAVLDHVTD;MKAIVAQAVLDHVTDE;KAIVAQAVLDHVTDEE;AIVAQAVLDHVTDEEY;IVAQAVLDHVTDEEYL;VAQAVLDHVTDEEYLR;AQAVLDHVTDEEYLRE;QAVLDHVTDEEYLREL;AVLDHVTDEEYLRELT;VLDHVTDEEYLRELTI;LDHVTDEEYLRELTIW;DHVTDEEYLRELTIWS;HVTDEEYLRELTIWSG;VTDEEYLRELTIWSGR;TDEEYLRELTIWSGRY;DEEYLRELTIWSGRYG;EEYLRELTIWSGRYGS;EYLRELTIWSGRYGSV;YLRELTIWSGRYGSVA;LRELTIWSGRYGSVAG;RELTIWSGRYGSVAGV;ELTIWSGRYGSVAGVP;LTIWSGRYGSVAGVPA;TIWSGRYGSVAGVPAR;IWSGRYGSVAGVPARN;WSGRYGSVAGVPARNE;SGRYGSVAGVPARNEP;GRYGSVAGVPARNEPP;RYGSVAGVPARNEPPS;YGSVAGVPARNEPPSD;GSVAGVPARNEPPSDP;SVAGVPARNEPPSDPS;VAGVPARNEPPSDPSA;AGVPARNEPPSDPSAP;GVPARNEPPSDPSAPI;VPARNEPPSDPSAPIP;PARNEPPSDPSAPIPG;ARNEPPSDPSAPIPGR;RNEPPSDPSAPIPGRL;NEPPSDPSAPIPGRLF;EPPSDPSAPIPGRLFA;PPSDPSAPIPGRLFAG;PSDPSAPIPGRLFAGP;SDPSAPIPGRLFAGPG;DPSAPIPGRLFAGPGL;PSAPIPGRLFAGPGLS;SAPIPGRLFAGPGLSQ;APIPGRLFAGPGLSQP;PIPGRLFAGPGLSQPS;IPGRLFAGPGLSQPSD;PGRLFAGPGLSQPSDV;GRLFAGPGLSQPSDVL;RLFAGPGLSQPSDVLP;LFAGPGLSQPSDVLPA;FAGPGLSQPSDVLPAD;AGPGLSQPSDVLPADD;GPGLSQPSDVLPADDG;PGLSQPSDVLPADDGA;GLSQPSDVLPADDGAA;LSQPSDVLPADDGAAI;SQPSDVLPADDGAAIL;QPSDVLPADDGAAILA;PSDVLPADDGAAILAL;SDVLPADDGAAILALG;DVLPADDGAAILALGT;VLPADDGAAILALGTE;LPADDGAAILALGTET;PADDGAAILALGTETD;ADDGAAILALGTETDD;DDGAAILALGTETDDR;DGAAILALGTETDDRL;GAAILALGTETDDRLA;AAILALGTETDDRLAR;AILALGTETDDRLARL;ILALGTETDDRLARLR;LALGTETDDRLARLRA;ALGTETDDRLARLRAG;LGTETDDRLARLRAGE;GTETDDRLARLRAGEA;TETDDRLARLRAGEAA;ETDDRLARLRAGEAAS;TDDRLARLRAGEAASI;DDRLARLRAGEAASIV;DRLARLRAGEAASIVL;RLARLRAGEAASIVLL;LARLRAGEAASIVLLT;ARLRAGEAASIVLLTA;RLRAGEAASIVLLTAT;LRAGEAASIVLLTATA;RAGEAASIVLLTATAM;AGEAASIVLLTATAMG;GEAASIVLLTATAMGL;EAASIVLLTATAMGLA;AASIVLLTATAMGLAC;ASIVLLTATAMGLACC;SIVLLTATAMGLACCP;IVLLTATAMGLACCPI;VLLTATAMGLACCPIT;LLTATAMGLACCPITE;LTATAMGLACCPITEP;TATAMGLACCPITEPL;ATAMGLACCPITEPLE;TAMGLACCPITEPLEI;AMGLACCPITEPLEIA;MGLACCPITEPLEIAK;GLACCPITEPLEIAKT;LACCPITEPLEIAKTR;ACCPITEPLEIAKTRD;CCPITEPLEIAKTRDA;CPITEPLEIAKTRDAV;PITEPLEIAKTRDAVR;ITEPLEIAKTRDAVRA;TEPLEIAKTRDAVRAE;EPLEIAKTRDAVRAEV;PLEIAKTRDAVRAEVF;LEIAKTRDAVRAEVFG;EIAKTRDAVRAEVFGA;IAKTRDAVRAEVFGAG;AKTRDAVRAEVFGAGG;KTRDAVRAEVFGAGGY;TRDAVRAEVFGAGGYP;RDAVRAEVFGAGGYPQ;DAVRAEVFGAGGYPQM;AVRAEVFGAGGYPQML;VRAEVFGAGGYPQMLL;RAEVFGAGGYPQMLLR;AEVFGAGGYPQMLLRV;EVFGAGGYPQMLLRVG;VFGAGGYPQMLLRVGW;FGAGGYPQMLLRVGWA;GAGGYPQMLLRVGWAP;AGGYPQMLLRVGWAPI;GGYPQMLLRVGWAPIN;GYPQMLLRVGWAPINA;YPQMLLRVGWAPINAD;PQMLLRVGWAPINADP;QMLLRVGWAPINADPL;MLLRVGWAPINADPLP;LLRVGWAPINADPLPP;LRVGWAPINADPLPPT;RVGWAPINADPLPPTP;VGWAPINADPLPPTPR;GWAPINADPLPPTPRR;WAPINADPLPPTPRRE;APINADPLPPTPRREL;PINADPLPPTPRRELS;INADPLPPTPRRELSQ;NADPLPPTPRRELSQV;ADPLPPTPRRELSQVV;DPLPPTPRRELSQVVE;PLPPTPRRELSQVVEW;LPPTPRRELSQVVEWP;PPTPRRELSQVVEWPE;PTPRRELSQVVEWPEE;TPRRELSQVVEWPEEL;PRRELSQVVEWPEELL;RRELSQVVEWPEELLR;RELSQVVEWPEELLRQ;ELSQVVEWPEELLRQR;LSQVVEWPEELLRQRC | |

Fig. 30 continued

| | | |
|---|---|---|
| 20 | **<YP_177758.1 acyl-[acyl-carrier protein] desaturase Rv0824c;Mycobacterium tuberculosis H37Rv>**<br>MSAKLTDLQLLHELEPVVEKYLNRHLSMHKPWNPHDYIPWSDGKNYYALGGQDWDPDQSKLSDVAQVAMVQNLVTEDNLPSYHREIAMNMGMDGAWGQWVNRWTAEENRHGIALRDYLVVTRSVDPVELEKLRLEVVNRGFSPGQNHQGHYFAESLTDSVLYVSFQELATRISHRNTGKACNDPVADQLMAKISADENLHMIFYRDVSEAAFDLVPNQAMKSLHLILSHFQMPGFQVPEFRRKAVVIAVGGVYDPRIHLDEVVMPVLKKWRIFEREDFTGEGAKLRDELALVIKDLELACDKFEVSKQRQLDREARTGKKVSAHELHKTAGKLAMSRR<br><br>8mer<br>MSAKLTDL;KLTDLQLL;LTDLQLLH;DLQLLHEL;LLHELEPV;ELEPVVEK;LEPVVEKY;EPVVEKYL;VVEKYLNR;YLNRHLSM;NRHLSMHK;HLSMHKPW;KPWNPHDY;NPHDYIPW;YIPWSDGK;WSDGKNYY;YALGGQDW;KLSDVAQV;DVAQVAMV;QVAMVQNL;VAMVQNLV;NLVTEDNL;TEDNLPSY;DNLPSYHR;LPSYHREI;SYHREIAM;EIAMNMGM;MNMGMDGA;GMDGAWGQ;DGAWGQWV;RWTAEENR;AEENRHGI;EENRHGIA;NRHGIALR;GIALRDYL;IALRDYLV;ALRDYLVV;RDYLVVTR;YLVVTRSV;VTRSVDPV;DPVELEKL;VELEKLRL;LEVVNRGF;GQNHQGHY;GHYFAESL;AESLTDSV;SLTDSVLY;LTDSVLYV;SVLYVSFQ;LYVSFQEL;YVSFQELA;SFQELATR;FQELATRI;LATRISHR;ISHRNTGK;DPVADQLM;PVADQLMA;VADQLMAK;QLMAKISA;KISADENL;DENLHMIF;ENLHMIFY;NLHMIFYR;HMIFYRDV;SEAAFDLV;DLVPNQAM;LVPNQAMK;AMKSLHLI;SLHLILSH;HLILSHFQ;LILSHFQM;FQMPGFQV;MPGFQVPE;GFQVPEFR;FQVPEFRR;QVPEFRRK;VPEFRRKA;RKAVVIAV;VVIAVGGV;VIAVGGVY;VYDPRIHL;RIHLDEVV;HLDEVVMP;DEVVMPVL;EVVMPVLK;VVMPVLKK;MPVLKKWR;VLKKWRIF;KKWRIFER;DFTGEGAK;FTGEGAKL;KLRDELAL;LRDELALV;LVIKDLEL;VIKDLELA;LACDKFEV;KFEVSKQR;EVSKQRQL;RQLDREAR;QLDREART;VSAHELHK;ELHKTAGK;KTAGKLAM<br>9mer<br>MSAKLTDLQ;KLTDLQLLH;QLLHELEPV;LLHELEPVV;ELEPVVEKY;LEPVVEKYL;KYLNRHLSM;YLNRHLSMH;LNRHLSMHK;SMHKPWNPH;KPWNPHDYI;DYIPWSDGK;IPWSDGKNY;PWSDGKNYY;YYALGGQDW;SKLSDVAQV;KLSDVAQVA;LSDVAQVAM;DVAQVAMVQ;AQVAMVQNL;QVAMVQNLV;VTEDNLPSY;EDNLPSYHR;NLPSYHREI;LPSYHREIA;REIAMNMGM;AMNMGMDGA;GAWGQWVNR;AWGQWVNRW;GQWVNRWTA;AEENRHGIA;EENRHGIAL;ENRHGIALR;HGIALRDYL;GIALRDYLV;IALRDYLVV;ALRDYLVVT;DYLVVTRSV;VVTRSVDPV;TRSVDPVEL;SVDPVELEK;DPVELEKLR;ELEKLRLEV;KLRLEVVNR;GQNHQGHYF;HQGHYFAES;FAESLTDSV;AESLTDSVL;ESLTDSVLY;SLTDSVLYV;DSVLYVSFQ;VLYVSFQEL;YVSFQELAT;VSFQELATR;ELATRISHR;RISHRNTGK;TGKACNDPV;PVADQLMAK;ISADENLHM;SADENLHMI;DENLHMIFY;ENLHMIFYR;FYRDVSEAA;YRDVSEAAF;DVSEAAFDL;DLVPNQAMK;VPNQAMKSL;NQAMKSLHL;QAMKSLHLI;AMKSLHLIL;KSLHLILSH;SLHLILSHF;HLILSHFQM;FQMPGFQVP;QMPGFQVPE;MPGFQVPEF;GFQVPEFRR;VPEFRRKAV;EFRRKAVVI;RRKAVVIAV;AVVIAVGGV;VVIAVGGVY;AVGGVYDPR;GVYDPRIHL;HLDEVVMPV;EVVMPVLKK;VVMPVLKKW;VMPVLKKWR;MPVLKKWRI;PVLKKWRIF;LKKWRIFER;FTGEGAKLR;EGAKLRDEL;KLRDELALV;ELALVIKDL;ALVIKDLEL;LVIKDLELA;VIKDLELAC;ELACDKFEV;DKFEVSKQR;RQLDREART;LDREARTGK;KVSAHELHK;ELHKTAGKL;TAGKLAMSR<br>10mer<br>MSAKLTDLQL;KLTDLQLLHE;LTDLQLLHEL;LQLLHELEPV;QLLHELEPVV;HELEPVVEKY;ELEPVVEKYL;EPVVEKYLNR;YLNRHLSMHK;YIPWSDGKN | 142877-144586 |

Fig. 30 continued

| | | |
|---|---|---|
| | Y;IPWSDGKNYY;NYYALGGQDW;KLSDVAQVAM;AQVAMVQNLV;LVTEDNLPSY;NLPSYHREIA;LPSYHREIAM;SYHREIAMNM;IAMNMGMDGA;NMGMDGAWGQ;MGMDGAWGQW;GMDGAWGQWV;DGAWGQWVNR;GAWGQWVNRW;GQWVNRWTAE;WTAEENRHGI;AEENRHGIAL;HGIALRDYLV;GIALRDYLVV;ALRDYLVVTR;LVVTRSVDPV;RSVDPVELEK;SVDPVELEKL;DPVELEKLRL;VELEKLRLEV;ELEKLRLEVV;LRLEVVNRGF;SPGQNHQGHY;GQNHQGHYFA;HQGHYFAESL;YFAESLTDSV;FAESLTDSVL;AESLTDSVLY;ESLTDSVLYV;SLTDSVLYVS;LTDSVLYVSF;SVLYVSFQEL;VLYVSFQELA;YVSFQELATR;TRISHRNTGK;RISHRNTGKA;NTGKACNDPV;PVADQLMAKI;KISADENLHM;SADENLHMIF;DENLHMIFYR;NLHMIFYRDV;MIFYRDVSEA;FYRDVSEAAF;DVSEAAFDLV;LVPNQAMKSL;VPNQAMKSLH;NQAMKSLHLI;KSLHLILSHF;SLHLILSHFQ;ILSHFQMPGF;FQMPGFQVPE;QMPGFQVPEF;MPGFQVPEFR;FQVPEFRRKA;QVPEFRRKAV;VPEFRRKAVV;KAVVIAVGGV;AVVIAVGGVY;IAVGGVYDPR;AVGGVYDPRI;IHLDEVVMPV;HLDEVVMPVL;EVVMPVLKKW;VVMPVLKKWR;VMPVLKKWRI;MPVLKKWRIF;VLKKWRIFER;KWRIFEREDF;DFTGEGAKLR;GEGAKLRDEL;EGAKLRDELA;KLRDELALVI;DELALVIKDL;ALVIKDLELA;LELACDKFEV;LACDKFEVSK;EVSKQRQLDR;KQRQLDREAR;LDREARTGKK;KKVSAHELHK;HELHKTAGKL;KTAGKLAMSR;TAGKLAMSRR<br>11mer<br>MSAKLTDLQLL;KLTDLQLLHEL;DLQLLHELEPV;LQLLHELEPVV;LLHELEPVVEK;HELEPVVEKYL;EPVVEKYLNRH;KYLNRHLSMHK;YLNRHLSMHKP;SMHKPWNPHDY;KPWNPHDYIPW;DYIPWSDGKNY;YIPWSDGKNYY;IPWSDGKNYYA;KNYYALGGQDW;ALGGQDWDPDQ;KLSDVAQVAMV;DVAQVAMVQNL;AQVAMVQNLVT;MVQNLVTEDNL;NLVTEDNLPSY;VTEDNLPSYHR;NLPSYHREIAM;REIAMNMGMDG;EIAMNMGMDGA;IAMNMGMDGAW;MGMDGAWGQWV;GMDGAWGQWVN;DGAWGQWVNRW;WVNRWTAEENR;WTAEENRHGIA;TAEENRHGIAL;HGIALRDYLVV;IALRDYLVVTR;ALRDYLVVTRS;YLVVTRSVDPV;SVDPVELEKLR;VELEKLRLEVV;KLRLEVVNRGF;FSPGQNHQGHY;SPGQNHQGHYF;NHQGHYFAESL;HYFAESLTDSV;YFAESLTDSVL;FAESLTDSVLY;AESLTDSVLYV;SLTDSVLYVSF;DSVLYVSFQEL;SVLYVSFQELA;VLYVSFQELAT;LYVSFQELATR;YVSFQELATRI;ATRISHRNTGK;DPVADQLMAKI;LMAKISADENL;KISADENLHMI;ISADENLHMIF;SADENLHMIFY;HMIFYRDVSEA;MIFYRDVSEAA;IFYRDVSEAAF;YRDVSEAAFDL;EAAFDLVPNQA;AAFDLVPNQAM;DLVPNQAMKSL;VPNQAMKSLHL;AMKSLHLILSH;SLHLILSHFQM;LILSHFQMPGF;ILSHFQMPGFQ;FQMPGFQVPEF;QMPGFQVPEFR;MPGFQVPEFRR;FQVPEFRRKAV;QVPEFRRKAVV;VPEFRRKAVVI;RKAVVIAVGGV;KAVVIAVGGVY;VIAVGGVYDPR;VYDPRIHLDEV;DPRIHLDEVVM;RIHLDEVVMPV;IHLDEVVMPVL;HLDEVVMPVLK;DEVVMPVLKKW;EVVMPVLKKWR;VVMPVLKKWRI;MPVLKKWRIFE;PVLKKWRIFER;RIFEREDFTGE;FEREDFTGEGA;REDFTGEGAKL;EDFTGEGAKLR;GAKLRDELALV;KLRDELALVIK;ELALVIKDLEL;DLELACDKFEV;ELACDKFEVSK;RQLDREARTGK;QLDREARTGKK;GKKVSAHELHK;SAHELHKTAGK;ELHKTAGKLAM;KTAGKLAMSRR<br><br>13 mers:<br>MSAKLTDLQLLHE;SAKLTDLQLLHEL;AKLTDLQLLHELE;KLTDLQLLHELEP;LTDLQLLHELEPV;TDLQLLHELEPVV;DLQLLHELEPVVE;LQLLHELEPVVEK;QLLHELEPVVEKY;LLHELEPVVEKYL;LHELEPVVEKYLN;HELEPVVEKYLNR;ELEPVVEKYLNRH;LEPVVEKYLNRHL;EPVVEKYLNRHLS;PVVEKYLNRHLSM;VVEKYLNRHLSMH;VEKYLNRHLSMHK;EKYLNRHLSMHKP;KYLNRHLSMHKPW;YLNRHLSMHKPWN;LNRHLSMHKPWNP;NRHLSMHKPWNPH;RHLSMHKPWNPHD;HLSMHKPWNPHDY;LSMHKPWNPHDYI;SMH | |

Fig. 30 continued

| | | |
|---|---|---|
| | KPWNPHDYIP;MHKPWNPHDYIPW;HKPWNPHDYIPWS;KPWNPHDYIPW<br>SD;PWNPHDYIPWSDG;WNPHDYIPWSDGK;NPHDYIPWSDGKN;PHDYIP<br>WSDGKNY;HDYIPWSDGKNYY;DYIPWSDGKNYYA;YIPWSDGKNYYAL;IP<br>WSDGKNYYALG;PWSDGKNYYALGG;WSDGKNYYALGGQ;SDGKNYYAL<br>GGQD;DGKNYYALGGQDW;GKNYYALGGQDWD;KNYYALGGQDWDP;NY<br>YALGGQDWDPD;YYALGGQDWDPDQ;YALGGQDWDPDQS;ALGGQDWD<br>PDQSK;LGGQDWDPDQSKL;GGQDWDPDQSKLS;GQDWDPDQSKLSD;Q<br>DWDPDQSKLSDV;DWDPDQSKLSDVA;WDPDQSKLSDVAQ;DPDQSKLSD<br>VAQV;PDQSKLSDVAQVA;DQSKLSDVAQVAM;QSKLSDVAQVAMV;SKLS<br>DVAQVAMVQ;KLSDVAQVAMVQN;LSDVAQVAMVQNL;SDVAQVAMVQNL<br>V;DVAQVAMVQNLVT;VAQVAMVQNLVTE;AQVAMVQNLVTED;QVAMVQN<br>LVTEDN;VAMVQNLVTEDNL;AMVQNLVTEDNLP;MVQNLVTEDNLPS;VQN<br>LVTEDNLPSY;QNLVTEDNLPSYH;NLVTEDNLPSYHR;LVTEDNLPSYHRE;<br>VTEDNLPSYHREI;TEDNLPSYHREIA;EDNLPSYHREIAM;DNLPSYHREIAM<br>N;NLPSYHREIAMNM;LPSYHREIAMNMG;PSYHREIAMNMGM;SYHREIAM<br>NMGMD;YHREIAMNMGMDG;HREIAMNMGMDGA;REIAMNMGMDGAW;EI<br>AMNMGMDGAWG;IAMNMGMDGAWGQ;AMNMGMDGAWGQW;MNMGMD<br>GAWGQWV;NMGMDGAWGQWVN;MGMDGAWGQWVNR;GMDGAWGQW<br>VNRW;MDGAWGQWVNRWT;DGAWGQWVNRWTA;GAWGQWVNRWTAE<br>;AWGQWVNRWTAEE;WGQWVNRWTAEEN;GQWVNRWTAEENR;QWVN<br>RWTAEENRH;WVNRWTAEENRHG;VNRWTAEENRHGI;NRWTAEENRHGI<br>A;RWTAEENRHGIAL;WTAEENRHGIALR;TAEENRHGIALRD;AEENRHGIA<br>LRDY;EENRHGIALRDYL;ENRHGIALRDYLV;NRHGIALRDYLVV;RHGIALR<br>DYLVVT;HGIALRDYLVVTR;GIALRDYLVVTRS;IALRDYLVVTRSV;ALRDYL<br>VVTRSVD;LRDYLVVTRSVDP;RDYLVVTRSVDPV;DYLVVTRSVDPVE;YLV<br>VTRSVDPVEL;LVVTRSVDPVELE;VVTRSVDPVELEK;VTRSVDPVELEKL;T<br>RSVDPVELEKLR;RSVDPVELEKLRL;SVDPVELEKLRLE;VDPVELEKLRLE<br>V;DPVELEKLRLEVV;PVELEKLRLEVVN;VELEKLRLEVVNR;ELEKLRLEVV<br>NRG;LEKLRLEVVNRGF;EKLRLEVVNRGFS;KLRLEVVNRGFSP;LRLEVVN<br>RGFSPG;RLEVVNRGFSPGQ;LEVVNRGFSPGQN;EVVNRGFSPGQNH;VV<br>NRGFSPGQNHQ;VNRGFSPGQNHQG;NRGFSPGQNHQGH;RGFSPGQN<br>HQGHY;GFSPGQNHQGHYF;FSPGQNHQGHYFA;SPGQNHQGHYFAE;PG<br>QNHQGHYFAES;GQNHQGHYFAESL;QNHQGHYFAESLT;NHQGHYFAES<br>LTD;HQGHYFAESLTDS;QGHYFAESLTDSV;GHYFAESLTDSVL;HYFAESL<br>TDSVLY;YFAESLTDSVLYV;FAESLTDSVLYVS;AESLTDSVLYVSF;ESLTD<br>SVLYVSFQ;SLTDSVLYVSFQE;LTDSVLYVSFQEL;TDSVLYVSFQELA;DSV<br>LYVSFQELAT;SVLYVSFQELATR;VLYVSFQELATRI;LYVSFQELATRIS;YV<br>SFQELATRISH;VSFQELATRISHR;SFQELATRISHRN;FQELATRISHRNT;Q<br>ELATRISHRNTG;ELATRISHRNTGK;LATRISHRNTGKA;ATRISHRNTGKAC<br>;TRISHRNTGKACN;RISHRNTGKACND;ISHRNTGKACNDP;SHRNTGKAC<br>NDPV;HRNTGKACNDPVA;RNTGKACNDPVAD;NTGKACNDPVADQ;TGKA<br>CNDPVADQL;GKACNDPVADQLM;KACNDPVADQLMA;ACNDPVADQLMA<br>K;CNDPVADQLMAKI;NDPVADQLMAKIS;DPVADQLMAKISA;PVADQLMAK<br>ISAD;VADQLMAKISADE;ADQLMAKISADEN;DQLMAKISADENL;QLMAKIS<br>ADENLH;LMAKISADENLHM;MAKISADENLHMI;AKISADENLHMIF;KISADE<br>NLHMIFY;ISADENLHMIFYR;SADENLHMIFYRD;ADENLHMIFYRDV;DENL<br>HMIFYRDVS;ENLHMIFYRDVSE;NLHMIFYRDVSEA;LHMIFYRDVSEAA;HM<br>IFYRDVSEAAF;MIFYRDVSEAAFD;IFYRDVSEAAFDL;FYRDVSEAAFDLV;<br>YRDVSEAAFDLVP;RDVSEAAFDLVPN;DVSEAAFDLVPNQ;VSEAAFDLVP<br>NQA;SEAAFDLVPNQAM;EAAFDLVPNQAMK;AAFDLVPNQAMKS;AFDLVP<br>NQAMKSL;FDLVPNQAMKSLH;DLVPNQAMKSLHL;LVPNQAMKSLHLI;VPN<br>QAMKSLHLIL;PNQAMKSLHLILS;NQAMKSLHLILSH;QAMKSLHLILSHF;AM<br>KSLHLILSHFQ;MKSLHLILSHFQM;KSLHLILSHFQMP;SLHLILSHFQMPG;L | |

Fig. 30 continued

| | | |
|---|---|---|
| | HLILSHFQMPGF;HLILSHFQMPGFQ;LILSHFQMPGFQV;ILSHFQMPGFQVP;LSHFQMPGFQVPE;SHFQMPGFQVPEF;HFQMPGFQVPEFR;FQMPGFQVPEFRR;QMPGFQVPEFRRK;MPGFQVPEFRRKA;PGFQVPEFRRKAV;GFQVPEFRRKAVV;FQVPEFRRKAVVI;QVPEFRRKAVVIA;VPEFRRKAVVIAV;PEFRRKAVVIAVG;EFRRKAVVIAVGG;FRRKAVVIAVGGV;RRKAVVIAVGGVY;RKAVVIAVGGVYD;KAVVIAVGGVYDP;AVVIAVGGVYDPR;VVIAVGGVYDPRI;VIAVGGVYDPRIH;IAVGGVYDPRIHL;AVGGVYDPRIHLD;VGGVYDPRIHLDE;GGVYDPRIHLDEV;GVYDPRIHLDEVV;VYDPRIHLDEVVM;YDPRIHLDEVVMP;DPRIHLDEVVMPV;PRIHLDEVVMPVL;RIHLDEVVMPVLK;IHLDEVVMPVLKK;HLDEVVMPVLKKW;LDEVVMPVLKKWR;DEVVMPVLKKWRI;EVVMPVLKKWRIF;VVMPVLKKWRIFE;VMPVLKKWRIFER;MPVLKKWRIFERE;PVLKKWRIFERED;VLKKWRIFEREDF;LKKWRIFEREDFT;KKWRIFEREDFTG;KWRIFEREDFTGE;WRIFEREDFTGEG;RIFEREDFTGEGA;IFEREDFTGEGAK;FEREDFTGEGAKL;EREDFTGEGAKLR;REDFTGEGAKLRD;EDFTGEGAKLRDE;DFTGEGAKLRDEL;FTGEGAKLRDELA;TGEGAKLRDELAL;GEGAKLRDELALV;EGAKLRDELALVI;GAKLRDELALVIK;AKLRDELALVIKD;KLRDELALVIKDL;LRDELALVIKDLE;RDELALVIKDLEL;DELALVIKDLELA;ELALVIKDLELAC;LALVIKDLELACD;ALVIKDLELACDK;LVIKDLELACDKF;VIKDLELACDKFE;IKDLELACDKFEV;KDLELACDKFEVS;DLELACDKFEVSK;LELACDKFEVSKQ;ELACDKFEVSKQR;LACDKFEVSKQRQ;ACDKFEVSKQRQL;CDKFEVSKQRQLD;DKFEVSKQRQLDR;KFEVSKQRQLDRE;FEVSKQRQLDREA;EVSKQRQLDREAR;VSKQRQLDREART;SKQRQLDREARTG;KQRQLDREARTGK;QRQLDREARTGKK;RQLDREARTGKKV;QLDREARTGKKVS;LDREARTGKKVSA;DREARTGKKVSAH;REARTGKKVSAHE;EARTGKKVSAHEL;ARTGKKVSAHELH;RTGKKVSAHELHK;TGKKVSAHELHKT;GKKVSAHELHKTA;KKVSAHELHKTAG;KVSAHELHKTAGK;VSAHELHKTAGKL;SAHELHKTAGKLA;AHELHKTAGKLAM;HELHKTAGKLAMS;ELHKTAGKLAMSR;LHKTAGKLAMSRR;<br><br>14 mers:<br>MSAKLTDLQLLHEL;SAKLTDLQLLHELE;AKLTDLQLLHELEP;KLTDLQLLHELEPV;LTDLQLLHELEPVV;TDLQLLHELEPVVE;DLQLLHELEPVVEK;LQLLHELEPVVEKY;QLLHELEPVVEKYL;LLHELEPVVEKYLN;LHELEPVVEKYLNR;HELEPVVEKYLNRH;ELEPVVEKYLNRHL;LEPVVEKYLNRHLS;EPVVEKYLNRHLSM;PVVEKYLNRHLSMH;VVEKYLNRHLSMHK;VEKYLNRHLSMHKP;EKYLNRHLSMHKPW;KYLNRHLSMHKPWN;YLNRHLSMHKPWNP;LNRHLSMHKPWNPH;NRHLSMHKPWNPHD;RHLSMHKPWNPHDY;HLSMHKPWNPHDYI;LSMHKPWNPHDYIP;SMHKPWNPHDYIPW;MHKPWNPHDYIPWS;HKPWNPHDYIPWSD;KPWNPHDYIPWSDG;PWNPHDYIPWSDGK;WNPHDYIPWSDGKN;NPHDYIPWSDGKNY;PHDYIPWSDGKNYY;HDYIPWSDGKNYYA;DYIPWSDGKNYYAL;YIPWSDGKNYYALG;IPWSDGKNYYALGG;PWSDGKNYYALGGQ;WSDGKNYYALGGQD;SDGKNYYALGGQDW;DGKNYYALGGQDWD;GKNYYALGGQDWDP;KNYYALGGQDWDPD;NYYALGGQDWDPDQ;YYALGGQDWDPDQS;YALGGQDWDPDQSK;ALGGQDWDPDQSKL;LGGQDWDPDQSKLS;GGQDWDPDQSKLSD;GQDWDPDQSKLSDV;QDWDPDQSKLSDVA;DWDPDQSKLSDVAQ;WDPDQSKLSDVAQV;DPDQSKLSDVAQVA;PDQSKLSDVAQVAM;DQSKLSDVAQVAMV;QSKLSDVAQVAMVQ;SKLSDVAQVAMVQN;KLSDVAQVAMVQNL;LSDVAQVAMVQNLV;SDVAQVAMVQNLVT;DVAQVAMVQNLVTE;VAQVAMVQNLVTED;AQVAMVQNLVTEDN;QVAMVQNLVTEDNL;VAMVQNLVTEDNLP;AMVQNLVTEDNLPS;MVQNLVTEDNLPSY;VQNLVTEDNLPSYH;QNLVTEDNLPSYHR;NLVTEDNLPSYHRE;LVTEDNLPSYHREI;VTEDNLPSYHREIA;TEDNLPSYHREIAM;EDNLPSYHREIAMN;DNLPSYHREIAMNM;NLPSYHREIAMNMG;LPSYHRE | |

Fig. 30 continued

| | | |
|---|---|---|
| | IAMNMGM;PSYHREIAMNMGMD;SYHREIAMNMGMDG;YHREIAMNMGMDGA;HREIAMNMGMDGAW;REIAMNMGMDGAWG;EIAMNMGMDGAWGQ;IAMNMGMDGAWGQW;AMNMGMDGAWGQWV;MNMGMDGAWGQWVN;NMGMDGAWGQWVNR;MGMDGAWGQWVNRW;GMDGAWGQWVNRWT;MDGAWGQWVNRWTA;DGAWGQWVNRWTAE;GAWGQWVNRWTAEE;AWGQWVNRWTAEEN;WGQWVNRWTAEENR;GQWVNRWTAEENRH;QWVNRWTAEENRHG;WVNRWTAEENRHGI;VNRWTAEENRHGIA;NRWTAEENRHGIAL;RWTAEENRHGIALR;WTAEENRHGIALRD;TAEENRHGIALRDY;AEENRHGIALRDYL;EENRHGIALRDYLV;ENRHGIALRDYLVV;NRHGIALRDYLVVT;RHGIALRDYLVVTR;HGIALRDYLVVTRS;GIALRDYLVVTRSV;IALRDYLVVTRSVD;ALRDYLVVTRSVDP;LRDYLVVTRSVDPV;RDYLVVTRSVDPVE;DYLVVTRSVDPVEL;YLVVTRSVDPVELE;LVVTRSVDPVELEK;VVTRSVDPVELEKL;VTRSVDPVELEKLR;TRSVDPVELEKLRL;RSVDPVELEKLRLE;SVDPVELEKLRLEV;VDPVELEKLRLEVV;DPVELEKLRLEVVN;PVELEKLRLEVVNR;VELEKLRLEVVNRG;ELEKLRLEVVNRGF;LEKLRLEVVNRGFS;EKLRLEVVNRGFSP;KLRLEVVNRGFSPG;LRLEVVNRGFSPGQ;RLEVVNRGFSPGQN;LEVVNRGFSPGQNH;EVVNRGFSPGQNHQ;VVNRGFSPGQNHQG;VNRGFSPGQNHQGH;NRGFSPGQNHQGHY;RGFSPGQNHQGHYF;GFSPGQNHQGHYFA;FSPGQNHQGHYFAE;SPGQNHQGHYFAES;PGQNHQGHYFAESL;GQNHQGHYFAESLT;QNHQGHYFAESLTD;NHQGHYFAESLTDS;HQGHYFAESLTDSV;QGHYFAESLTDSVL;GHYFAESLTDSVLY;HYFAESLTDSVLYV;YFAESLTDSVLYVS;FAESLTDSVLYVSF;AESLTDSVLYVSFQ;ESLTDSVLYVSFQE;SLTDSVLYVSFQEL;LTDSVLYVSFQELA;TDSVLYVSFQELAT;DSVLYVSFQELATR;SVLYVSFQELATRI;VLYVSFQELATRIS;LYVSFQELATRISH;YVSFQELATRISHR;VSFQELATRISHRN;SFQELATRISHRNT;FQELATRISHRNTG;QELATRISHRNTGK;ELATRISHRNTGKA;LATRISHRNTGKAC;ATRISHRNTGKACN;TRISHRNTGKACND;RISHRNTGKACNDP;ISHRNTGKACNDPV;SHRNTGKACNDPVA;HRNTGKACNDPVAD;RNTGKACNDPVADQ;NTGKACNDPVADQL;TGKACNDPVADQLM;GKACNDPVADQLMA;KACNDPVADQLMAK;ACNDPVADQLMAKI;CNDPVADQLMAKIS;NDPVADQLMAKISA;DPVADQLMAKISAD;PVADQLMAKISADE;VADQLMAKISADEN;ADQLMAKISADENL;DQLMAKISADENLH;QLMAKISADENLHM;LMAKISADENLHMI;MAKISADENLHMIF;AKISADENLHMIFY;KISADENLHMIFYR;ISADENLHMIFYRD;SADENLHMIFYRDV;ADENLHMIFYRDVS;DENLHMIFYRDVSE;ENLHMIFYRDVSEA;NLHMIFYRDVSEAA;LHMIFYRDVSEAAF;HMIFYRDVSEAAFD;MIFYRDVSEAAFDL;IFYRDVSEAAFDLV;FYRDVSEAAFDLVP;YRDVSEAAFDLVPN;RDVSEAAFDLVPNQ;DVSEAAFDLVPNQA;VSEAAFDLVPNQAM;SEAAFDLVPNQAMK;EAAFDLVPNQAMKS;AAFDLVPNQAMKSL;AFDLVPNQAMKSLH;FDLVPNQAMKSLHL;DLVPNQAMKSLHLI;LVPNQAMKSLHLIL;VPNQAMKSLHLILS;PNQAMKSLHLILSH;NQAMKSLHLILSHF;QAMKSLHLILSHFQ;AMKSLHLILSHFQM;MKSLHLILSHFQMP;KSLHLILSHFQMPG;SLHLILSHFQMPGF;LHLILSHFQMPGFQ;HLILSHFQMPGFQV;LILSHFQMPGFQVP;ILSHFQMPGFQVPE;LSHFQMPGFQVPEF;SHFQMPGFQVPEFR;HFQMPGFQVPEFRR;FQMPGFQVPEFRRK;QMPGFQVPEFRRKA;MPGFQVPEFRRKAV;PGFQVPEFRRKAVV;GFQVPEFRRKAVVI;FQVPEFRRKAVVIA;QVPEFRRKAVVIAV;VPEFRRKAVVIAVG;PEFRRKAVVIAVGG;EFRRKAVVIAVGGV;FRRKAVVIAVGGVY;RRKAVVIAVGGVYD;RKAVVIAVGGVYDP;KAVVIAVGGVYDPR;AVVIAVGGVYDPRI;VVIAVGGVYDPRIH;VIAVGGVYDPRIHL;IAVGGVYDPRIHLD;AVGGVYDPRIHLDE;VGGVYDPRIHLDEV;GGVYDPRIHLDEVV;GVYDPRIHLDEVVM;VYDPRIHLDEVVMP;YDPRIHLDEVVMPV;DPRIHLDEVVMPVL;PRIHLDEVVMPVLK;RIHLDEVVMPVLKK;IHLDEVVMPVLKKW;HLDEVVMPVLKKWR;LDEVVMPVLKKWRI;DEVVMPVLKKWRIF;EVVMPVLKKWRIFE;VVMPVLKKWRIFER;VMPVLKKWRIFE | |

Fig. 30 continued

RE;MPVLKKWRIFERED;PVLKKWRIFEREDF;VLKKWRIFEREDFT;LKKWRI
FEREDFTG;KKWRIFEREDFTGE;KWRIFEREDFTGEG;WRIFEREDFTGEG
A;RIFEREDFTGEGAK;IFEREDFTGEGAKL;FEREDFTGEGAKLR;EREDFT
GEGAKLRD;REDFTGEGAKLRDE;EDFTGEGAKLRDEL;DFTGEGAKLRDE
LA;FTGEGAKLRDELAL;TGEGAKLRDELALV;GEGAKLRDELALVI;EGAKLR
DELALVIK;GAKLRDELALVIKD;AKLRDELALVIKDL;KLRDELALVIKDLE;LR
DELALVIKDLEL;RDELALVIKDLELA;DELALVIKDLELAC;ELALVIKDLELAC
D;LALVIKDLELACDK;ALVIKDLELACDKF;LVIKDLELACDKFE;VIKDLELAC
DKFEV;IKDLELACDKFEVS;KDLELACDKFEVSK;DLELACDKFEVSKQ;LEL
ACDKFEVSKQR;ELACDKFEVSKQRQ;LACDKFEVSKQRQL;ACDKFEVSK
QRQLD;CDKFEVSKQRQLDR;DKFEVSKQRQLDRE;KFEVSKQRQLDREA;
FEVSKQRQLDREAR;EVSKQRQLDREART;VSKQRQLDREARTG;SKQRQL
DREARTGK;KQRQLDREARTGKK;QRQLDREARTGKKV;RQLDREARTGK
KVS;QLDREARTGKKVSA;LDREARTGKKVSAH;DREARTGKKVSAHE;REA
RTGKKVSAHEL;EARTGKKVSAHELH;ARTGKKVSAHELHK;RTGKKVSAHE
LHKT;TGKKVSAHELHKTA;GKKVSAHELHKTAG;KKVSAHELHKTAGK;KVS
AHELHKTAGKL;VSAHELHKTAGKLA;SAHELHKTAGKLAM;AHELHKTAGK
LAMS;HELHKTAGKLAMSR;ELHKTAGKLAMSRR;

15 mers:
MSAKLTDLQLLHELE;SAKLTDLQLLHELEP;AKLTDLQLLHELEPV;KLTDLQ
LLHELEPVV;LTDLQLLHELEPVVE;TDLQLLHELEPVVEK;DLQLLHELEPVV
EKY;LQLLHELEPVVEKYL;QLLHELEPVVEKYLN;LLHELEPVVEKYLNR;LH
ELEPVVEKYLNRH;HELEPVVEKYLNRHL;ELEPVVEKYLNRHLS;LEPVVEK
YLNRHLSM;EPVVEKYLNRHLSMH;PVVEKYLNRHLSMHK;VVEKYLNRHLS
MHKP;VEKYLNRHLSMHKPW;EKYLNRHLSMHKPWN;KYLNRHLSMHKPW
NP;YLNRHLSMHKPWNPH;LNRHLSMHKPWNPHD;NRHLSMHKPWNPHD
Y;RHLSMHKPWNPHDYI;HLSMHKPWNPHDYIP;LSMHKPWNPHDYIPW;S
MHKPWNPHDYIPWS;MHKPWNPHDYIPWSD;HKPWNPHDYIPWSDG;KP
WNPHDYIPWSDGK;PWNPHDYIPWSDGKN;WNPHDYIPWSDGKNY;NPHD
YIPWSDGKNYY;PHDYIPWSDGKNYYA;HDYIPWSDGKNYYAL;DYIPWSD
GKNYYALG;YIPWSDGKNYYALGG;IPWSDGKNYYALGGQ;PWSDGKNYY
ALGGQD;WSDGKNYYALGGQDW;SDGKNYYALGGQDWD;DGKNYYALGG
QDWDP;GKNYYALGGQDWDPD;KNYYALGGQDWDPDQ;NYYALGGQDW
DPDQS;YYALGGQDWDPDQSK;YALGGQDWDPDQSKL;ALGGQDWDPDQ
SKLS;LGGQDWDPDQSKLSD;GGQDWDPDQSKLSDV;GQDWDPDQSKLS
DVA;QDWDPDQSKLSDVAQ;DWDPDQSKLSDVAQV;WDPDQSKLSDVAQ
VA;DPDQSKLSDVAQVAM;PDQSKLSDVAQVAMV;DQSKLSDVAQVAMVQ;
QSKLSDVAQVAMVQN;SKLSDVAQVAMVQNL;KLSDVAQVAMVQNLV;LSD
VAQVAMVQNLVT;SDVAQVAMVQNLVTE;DVAQVAMVQNLVTED;VAQVA
MVQNLVTEDN;AQVAMVQNLVTEDNL;QVAMVQNLVTEDNLP;VAMVQNLV
TEDNLPS;AMVQNLVTEDNLPSY;MVQNLVTEDNLPSYH;VQNLVTEDNLPS
YHR;QNLVTEDNLPSYHRE;NLVTEDNLPSYHREI;LVTEDNLPSYHREIA;VT
EDNLPSYHREIAM;TEDNLPSYHREIAMN;EDNLPSYHREIAMNM;DNLPSY
HREIAMNMG;NLPSYHREIAMNMGM;LPSYHREIAMNMGMD;PSYHREIAM
NMGMDG;SYHREIAMNMGMDGA;YHREIAMNMGMDGAW;HREIAMNMGM
DGAWG;REIAMNMGMDGAWGQ;EIAMNMGMDGAWGQW;IAMNMGMDG
AWGQWV;AMNMGMDGAWGQWVN;MNMGMDGAWGQWVNR;NMGMDG
AWGQWVNRW;MGMDGAWGQWVNRWT;GMDGAWGQWVNRWTA;MDG
AWGQWVNRWTAE;DGAWGQWVNRWTAEE;GAWGQWVNRWTAEEN;A
WGQWVNRWTAEENR;WGQWVNRWTAEENRH;GQWVNRWTAEENRHG;
QWVNRWTAEENRHGI;WVNRWTAEENRHGIA;VNRWTAEENRHGIAL;NR
WTAEENRHGIALR;RWTAEENRHGIALRD;WTAEENRHGIALRDY;TAEENR

Fig. 30 continued

| | | |
|---|---|---|
| | HGIALRDYL;AEENRHGIALRDYLV;EENRHGIALRDYLVV;ENRHGIALRDYLVVT;NRHGIALRDYLVVTR;RHGIALRDYLVVTRS;HGIALRDYLVVTRSV;GIALRDYLVVTRSVD;IALRDYLVVTRSVDP;ALRDYLVVTRSVDPV;LRDYLVVTRSVDPVE;RDYLVVTRSVDPVEL;DYLVVTRSVDPVELE;YLVVTRSVDPVELEK;LVVTRSVDPVELEKL;VVTRSVDPVELEKLR;VTRSVDPVELEKLRL;TRSVDPVELEKLRLE;RSVDPVELEKLRLEV;SVDPVELEKLRLEVV;VDPVELEKLRLEVVN;DPVELEKLRLEVVNR;PVELEKLRLEVVNRG;VELEKLRLEVVNRGF;ELEKLRLEVVNRGFS;LEKLRLEVVNRGFSP;EKLRLEVVNRGFSPG;KLRLEVVNRGFSPGQ;LRLEVVNRGFSPGQN;RLEVVNRGFSPGQNH;LEVVNRGFSPGQNHQ;EVVNRGFSPGQNHQG;VVNRGFSPGQNHQGH;VNRGFSPGQNHQGHY;NRGFSPGQNHQGHYF;RGFSPGQNHQGHYFA;GFSPGQNHQGHYFAE;FSPGQNHQGHYFAES;SPGQNHQGHYFAESL;PGQNHQGHYFAESLT;GQNHQGHYFAESLTD;QNHQGHYFAESLTDS;NHQGHYFAESLTDSV;HQGHYFAESLTDSVL;QGHYFAESLTDSVLY;GHYFAESLTDSVLYV;HYFAESLTDSVLYVS;YFAESLTDSVLYVSF;FAESLTDSVLYVSFQ;AESLTDSVLYVSFQE;ESLTDSVLYVSFQEL;SLTDSVLYVSFQELA;LTDSVLYVSFQELAT;TDSVLYVSFQELATR;DSVLYVSFQELATRI;SVLYVSFQELATRIS;VLYVSFQELATRISH;LYVSFQELATRISHR;YVSFQELATRISHRN;VSFQELATRISHRNT;SFQELATRISHRNTG;FQELATRISHRNTGK;QELATRISHRNTGKA;ELATRISHRNTGKAC;LATRISHRNTGKACN;ATRISHRNTGKACND;TRISHRNTGKACNDP;RISHRNTGKACNDPV;ISHRNTGKACNDPVA;SHRNTGKACNDPVAD;HRNTGKACNDPVADQ;RNTGKACNDPVADQL;NTGKACNDPVADQLM;TGKACNDPVADQLMA;GKACNDPVADQLMAK;KACNDPVADQLMAKI;ACNDPVADQLMAKIS;CNDPVADQLMAKISA;NDPVADQLMAKISAD;DPVADQLMAKISADE;PVADQLMAKISADEN;VADQLMAKISADENL;ADQLMAKISADENLH;DQLMAKISADENLHM;QLMAKISADENLHMI;LMAKISADENLHMIF;MAKISADENLHMIFY;AKISADENLHMIFYR;KISADENLHMIFYRD;ISADENLHMIFYRDV;SADENLHMIFYRDVS;ADENLHMIFYRDVSE;DENLHMIFYRDVSEA;ENLHMIFYRDVSEAA;NLHMIFYRDVSEAAF;LHMIFYRDVSEAAFD;HMIFYRDVSEAAFDL;MIFYRDVSEAAFDLV;IFYRDVSEAAFDLVP;FYRDVSEAAFDLVPN;YRDVSEAAFDLVPNQ;RDVSEAAFDLVPNQA;DVSEAAFDLVPNQAM;VSEAAFDLVPNQAMK;SEAAFDLVPNQAMKS;EAAFDLVPNQAMKSL;AAFDLVPNQAMKSLH;AFDLVPNQAMKSLHL;FDLVPNQAMKSLHLI;DLVPNQAMKSLHLIL;LVPNQAMKSLHLILS;VPNQAMKSLHLILSH;PNQAMKSLHLILSHF;NQAMKSLHLILSHFQ;QAMKSLHLILSHFQM;AMKSLHLILSHFQMP;MKSLHLILSHFQMPG;KSLHLILSHFQMPGF;SLHLILSHFQMPGFQ;LHLILSHFQMPGFQV;HLILSHFQMPGFQVP;LILSHFQMPGFQVPE;ILSHFQMPGFQVPEF;LSHFQMPGFQVPEFR;SHFQMPGFQVPEFRR;HFQMPGFQVPEFRRK;FQMPGFQVPEFRRKA;QMPGFQVPEFRRKAV;MPGFQVPEFRRKAVV;PGFQVPEFRRKAVVI;GFQVPEFRRKAVVIA;FQVPEFRRKAVVIAV;QVPEFRRKAVVIAVG;VPEFRRKAVVIAVGG;PEFRRKAVVIAVGGV;EFRRKAVVIAVGGVY;FRRKAVVIAVGGVYD;RRKAVVIAVGGVYDP;RKAVVIAVGGVYDPR;KAVVIAVGGVYDPRI;AVVIAVGGVYDPRIH;VVIAVGGVYDPRIHL;VIAVGGVYDPRIHLD;IAVGGVYDPRIHLDE;AVGGVYDPRIHLDEV;VGGVYDPRIHLDEVV;GGVYDPRIHLDEVVM;GVYDPRIHLDEVVMP;VYDPRIHLDEVVMPV;YDPRIHLDEVVMPVL;DPRIHLDEVVMPVLK;PRIHLDEVVMPVLKK;RIHLDEVVMPVLKKW;IHLDEVVMPVLKKWR;HLDEVVMPVLKKWRI;LDEVVMPVLKKWRIF;DEVVMPVLKKWRIFE;EVVMPVLKKWRIFER;VVMPVLKKWRIFERE;VMPVLKKWRIFERED;MPVLKKWRIFEREDF;PVLKKWRIFEREDFT;VLKKWRIFEREDFTG;LKKWRIFEREDFTGE;KKWRIFEREDFTGEG;KWRIFEREDFTGEGA;WRIFEREDFTGEGAK;RIFEREDFTGEGAKL;IFEREDFTGEGAKLR;FEREDFTGEGAKLRD;EREDFTGEGAKLRDE;REDFTGEGAKLRDEL;EDFTGEGAKLRDELA;DFTGEGAKLRDELAL;FTGEGAKLRDELALV;TG | |

Fig. 30 continued

| | | |
|---|---|---|
| | EGAKLRDELALVI;GEGAKLRDELALVIK;EGAKLRDELALVIKD;GAKLRDELALVIKDL;AKLRDELALVIKDLE;KLRDELALVIKDLEL;LRDELALVIKDLELA;RDELALVIKDLELAC;DELALVIKDLELACD;ELALVIKDLELACDK;LALVIKDLELACDKF;ALVIKDLELACDKFE;LVIKDLELACDKFEV;VIKDLELACDKFEVS;IKDLELACDKFEVSK;KDLELACDKFEVSKQ;DLELACDKFEVSKQR;LELACDKFEVSKQRQ;ELACDKFEVSKQRQL;LACDKFEVSKQRQLD;ACDKFEVSKQRQLDR;CDKFEVSKQRQLDRE;DKFEVSKQRQLDREA;KFEVSKQRQLDREAR;FEVSKQRQLDREART;EVSKQRQLDREARTG;VSKQRQLDREARTGK;SKQRQLDREARTGKK;KQRQLDREARTGKKV;QRQLDREARTGKKVS;RQLDREARTGKKVSA;QLDREARTGKKVSAH;LDREARTGKKVSAHE;DREARTGKKVSAHEL;REARTGKKVSAHELH;EARTGKKVSAHELHK;ARTGKKVSAHELHKT;RTGKKVSAHELHKTA;TGKKVSAHELHKTAG;GKKVSAHELHKTAGK;KKVSAHELHKTAGKL;KVSAHELHKTAGKLA;VSAHELHKTAGKLAM;SAHELHKTAGKLAMS;AHELHKTAGKLAMSR;HELHKTAGKLAMSRR;<br><br>16 mers:<br>MSAKLTDLQLLHELEP;SAKLTDLQLLHELEPV;AKLTDLQLLHELEPVV;KLTDLQLLHELEPVVE;LTDLQLLHELEPVVEK;TDLQLLHELEPVVEKY;DLQLLHELEPVVEKYL;LQLLHELEPVVEKYLN;QLLHELEPVVEKYLNR;LLHELEPVVEKYLNRH;LHELEPVVEKYLNRHL;HELEPVVEKYLNRHLS;ELEPVVEKYLNRHLSM;LEPVVEKYLNRHLSMH;EPVVEKYLNRHLSMHK;PVVEKYLNRHLSMHKP;VVEKYLNRHLSMHKPW;VEKYLNRHLSMHKPWN;EKYLNRHLSMHKPWNP;KYLNRHLSMHKPWNPH;YLNRHLSMHKPWNPHD;LNRHLSMHKPWNPHDY;NRHLSMHKPWNPHDYI;RHLSMHKPWNPHDYIP;HLSMHKPWNPHDYIPW;LSMHKPWNPHDYIPWS;SMHKPWNPHDYIPWSD;MHKPWNPHDYIPWSDG;HKPWNPHDYIPWSDGK;KPWNPHDYIPWSDGKN;PWNPHDYIPWSDGKNY;WNPHDYIPWSDGKNYY;NPHDYIPWSDGKNYYA;PHDYIPWSDGKNYYAL;HDYIPWSDGKNYYALG;DYIPWSDGKNYYALGG;YIPWSDGKNYYALGGQ;IPWSDGKNYYALGGQD;PWSDGKNYYALGGQDW;WSDGKNYYALGGQDWD;SDGKNYYALGGQDWDP;DGKNYYALGGQDWDPD;GKNYYALGGQDWDPDQ;KNYYALGGQDWDPDQS;NYYALGGQDWDPDQSK;YYALGGQDWDPDQSKL;YALGGQDWDPDQSKLS;ALGGQDWDPDQSKLSD;LGGQDWDPDQSKLSDV;GGQDWDPDQSKLSDVA;GQDWDPDQSKLSDVAQ;QDWDPDQSKLSDVAQV;DWDPDQSKLSDVAQVA;WDPDQSKLSDVAQVAM;DPDQSKLSDVAQVAMV;PDQSKLSDVAQVAMVQ;DQSKLSDVAQVAMVQN;QSKLSDVAQVAMVQNL;SKLSDVAQVAMVQNLV;KLSDVAQVAMVQNLVT;LSDVAQVAMVQNLVTE;SDVAQVAMVQNLVTED;DVAQVAMVQNLVTEDN;VAQVAMVQNLVTEDNL;AQVAMVQNLVTEDNLP;QVAMVQNLVTEDNLPS;VAMVQNLVTEDNLPSY;AMVQNLVTEDNLPSYH;MVQNLVTEDNLPSYHR;VQNLVTEDNLPSYHRE;QNLVTEDNLPSYHREI;NLVTEDNLPSYHREIA;LVTEDNLPSYHREIAM;VTEDNLPSYHREIAMN;TEDNLPSYHREIAMNM;EDNLPSYHREIAMNMG;DNLPSYHREIAMNMGM;NLPSYHREIAMNMGMD;LPSYHREIAMNMGMDG;PSYHREIAMNMGMDGA;SYHREIAMNMGMDGAW;YHREIAMNMGMDGAWG;HREIAMNMGMDGAWGQ;REIAMNMGMDGAWGQW;EIAMNMGMDGAWGQWV;IAMNMGMDGAWGQWVN;AMNMGMDGAWGQWVNR;MNMGMDGAWGQWVNRW;NMGMDGAWGQWVNRWT;MGMDGAWGQWVNRWTA;GMDGAWGQWVNRWTAE;MDGAWGQWVNRWTAEE;DGAWGQWVNRWTAEEN;GAWGQWVNRWTAEENR;AWGQWVNRWTAEENRH;WGQWVNRWTAEENRHG;GQWVNRWTAEENRHGI;QWVNRWTAEENRHGIA;WVNRWTAEENRHGIAL;VNRWTAEENRHGIALR;NRWTAEENRHGIALRD;RWTAEENRHGIALRDY;WTAEENRHGIALRDYL;TAEENRHGIALRDYLV;AEENRHGIALRDYLVV;EENRHGIALRDYLVVT;ENRHGIALRDYLVVTR;NRHGIALRDYLVVTRS;RHGIALRDYLVVTRSV;HGIALRD | |

Fig. 30 continued

| | | |
|---|---|---|
| | YLVVTRSVD;GIALRDYLVVTRSVDP;IALRDYLVVTRSVDPV;ALRDYLVVTRSVDPVE;LRDYLVVTRSVDPVEL;RDYLVVTRSVDPVELE;DYLVVTRSVDPVELEK;YLVVTRSVDPVELEKL;LVVTRSVDPVELEKLR;VVTRSVDPVELEKLRL;VTRSVDPVELEKLRLE;TRSVDPVELEKLRLEV;RSVDPVELEKLRLEVV;SVDPVELEKLRLEVVN;VDPVELEKLRLEVVNR;DPVELEKLRLEVVNRG;PVELEKLRLEVVNRGF;VELEKLRLEVVNRGFS;ELEKLRLEVVNRGFSP;LEKLRLEVVNRGFSPG;EKLRLEVVNRGFSPGQ;KLRLEVVNRGFSPGQN;LRLEVVNRGFSPGQNH;RLEVVNRGFSPGQNHQ;LEVVNRGFSPGQNHQG;EVVNRGFSPGQNHQGH;VVNRGFSPGQNHQGHY;VNRGFSPGQNHQGHYF;NRGFSPGQNHQGHYFA;RGFSPGQNHQGHYFAE;GFSPGQNHQGHYFAES;FSPGQNHQGHYFAESL;SPGQNHQGHYFAESLT;PGQNHQGHYFAESLTD;GQNHQGHYFAESLTDS;QNHQGHYFAESLTDSV;NHQGHYFAESLTDSVL;HQGHYFAESLTDSVLY;QGHYFAESLTDSVLYV;GHYFAESLTDSVLYVS;HYFAESLTDSVLYVSF;YFAESLTDSVLYVSFQ;FAESLTDSVLYVSFQE;AESLTDSVLYVSFQEL;ESLTDSVLYVSFQELA;SLTDSVLYVSFQELAT;LTDSVLYVSFQELATR;TDSVLYVSFQELATRI;DSVLYVSFQELATRIS;SVLYVSFQELATRISH;VLYVSFQELATRISHR;LYVSFQELATRISHRN;YVSFQELATRISHRNT;VSFQELATRISHRNTG;SFQELATRISHRNTGK;FQELATRISHRNTGKA;QELATRISHRNTGKAC;ELATRISHRNTGKACN;LATRISHRNTGKACND;ATRISHRNTGKACNDP;TRISHRNTGKACNDPV;RISHRNTGKACNDPVA;ISHRNTGKACNDPVAD;SHRNTGKACNDPVADQ;HRNTGKACNDPVADQL;RNTGKACNDPVADQLM;NTGKACNDPVADQLMA;TGKACNDPVADQLMAK;GKACNDPVADQLMAKI;KACNDPVADQLMAKIS;ACNDPVADQLMAKISA;CNDPVADQLMAKISAD;NDPVADQLMAKISADE;DPVADQLMAKISADEN;PVADQLMAKISADENL;VADQLMAKISADENLH;ADQLMAKISADENLHM;DQLMAKISADENLHMI;QLMAKISADENLHMIF;LMAKISADENLHMIFY;MAKISADENLHMIFYR;AKISADENLHMIFYRD;KISADENLHMIFYRDV;ISADENLHMIFYRDVS;SADENLHMIFYRDVSE;ADENLHMIFYRDVSEA;DENLHMIFYRDVSEAA;ENLHMIFYRDVSEAAF;NLHMIFYRDVSEAAFD;LHMIFYRDVSEAAFDL;HMIFYRDVSEAAFDLV;MIFYRDVSEAAFDLVP;IFYRDVSEAAFDLVPN;FYRDVSEAAFDLVPNQ;YRDVSEAAFDLVPNQA;RDVSEAAFDLVPNQAM;DVSEAAFDLVPNQAMK;VSEAAFDLVPNQAMKS;SEAAFDLVPNQAMKSL;EAAFDLVPNQAMKSLH;AAFDLVPNQAMKSLHL;AFDLVPNQAMKSLHLI;FDLVPNQAMKSLHLIL;DLVPNQAMKSLHLILS;LVPNQAMKSLHLILSH;VPNQAMKSLHLILSHF;PNQAMKSLHLILSHFQ;NQAMKSLHLILSHFQM;QAMKSLHLILSHFQMP;AMKSLHLILSHFQMPG;MKSLHLILSHFQMPGF;KSLHLILSHFQMPGFQ;SLHLILSHFQMPGFQV;LHLILSHFQMPGFQVP;HLILSHFQMPGFQVPE;LILSHFQMPGFQVPEF;ILSHFQMPGFQVPEFR;LSHFQMPGFQVPEFRR;SHFQMPGFQVPEFRRK;HFQMPGFQVPEFRRKA;FQMPGFQVPEFRRKAV;QMPGFQVPEFRRKAVV;MPGFQVPEFRRKAVVI;PGFQVPEFRRKAVVIA;GFQVPEFRRKAVVIAV;FQVPEFRRKAVVIAVG;QVPEFRRKAVVIAVGG;VPEFRRKAVVIAVGGV;PEFRRKAVVIAVGGVY;EFRRKAVVIAVGGVYD;FRRKAVVIAVGGVYDP;RRKAVVIAVGGVYDPR;RKAVVIAVGGVYDPRI;KAVVIAVGGVYDPRIH;AVVIAVGGVYDPRIHL;VVIAVGGVYDPRIHLD;VIAVGGVYDPRIHLDE;IAVGGVYDPRIHLDEV;AVGGVYDPRIHLDEVV;VGGVYDPRIHLDEVVM;GGVYDPRIHLDEVVMP;GVYDPRIHLDEVVMPV;VYDPRIHLDEVVMPVL;YDPRIHLDEVVMPVLK;DPRIHLDEVVMPVLKK;PRIHLDEVVMPVLKKW;RIHLDEVVMPVLKKWR;IHLDEVVMPVLKKWRI;HLDEVVMPVLKKWRIF;LDEVVMPVLKKWRIFE;DEVVMPVLKKWRIFER;EVVMPVLKKWRIFERE;VVMPVLKKWRIFERED;VMPVLKKWRIFEREDF;MPVLKKWRIFEREDFT;PVLKKWRIFEREDFTG;VLKKWRIFEREDFTGE;LKKWRIFEREDFTGEG;KKWRIFEREDFTGEGA;KWRIFEREDFTGEGAK;WRIFEREDFTGEGAKL;RIFEREDFTGEGAKLR;IFEREDFTGEGAKLRD;FEREDFTGEGAKLRDE;EREDF | |

Fig. 30 continued

| | | |
|---|---|---|
| | TGEGAKLRDEL;REDFTGEGAKLRDELA;EDFTGEGAKLRDELAL;DFTGEGAKLRDELALV;FTGEGAKLRDELALVI;TGEGAKLRDELALVIK;GEGAKLRDELALVIKD;EGAKLRDELALVIKDL;GAKLRDELALVIKDLE;AKLRDELALVIKDLEL;KLRDELALVIKDLELA;LRDELALVIKDLELAC;RDELALVIKDLELACD;DELALVIKDLELACDK;ELALVIKDLELACDKF;LALVIKDLELACDKFE;ALVIKDLELACDKFEV;LVIKDLELACDKFEVS;VIKDLELACDKFEVSK;IKDLELACDKFEVSKQ;KDLELACDKFEVSKQR;DLELACDKFEVSKQRQ;LELACDKFEVSKQRQL;ELACDKFEVSKQRQLD;LACDKFEVSKQRQLDR;ACDKFEVSKQRQLDRE;CDKFEVSKQRQLDREA;DKFEVSKQRQLDREAR;KFEVSKQRQLDREART;FEVSKQRQLDREARTG;EVSKQRQLDREARTGK;VSKQRQLDREARTGKK;SKQRQLDREARTGKKV;KQRQLDREARTGKKVS;QRQLDREARTGKKVSA;RQLDREARTGKKVSAH;QLDREARTGKKVSAHE;LDREARTGKKVSAHEL;DREARTGKKVSAHELH;REARTGKKVSAHELHK;EARTGKKVSAHELHKT;ARTGKKVSAHELHKTA;RTGKKVSAHELHKTAG;TGKKVSAHELHKTAGK;GKKVSAHELHKTAGKL;KKVSAHELHKTAGKLA;KVSAHELHKTAGKLAM;VSAHELHKTAGKLAMS;SAHELHKTAGKLAMSR;AHELHKTAGKLAMSRR | |
| 21 | **<NP_216424.1 catalase-peroxidase-peroxynitritase T KATG Rv1908c;Mycobacterium tuberculosis H37Rv>**<br>MPEQHPPITETTTGAASNGCPVVGHMKYPVEGGGNQDWWPNRLNLKVLHQNPAVADPMGAAFDYAAEVATIDVDALTRDIEEVMTTSQPWWPADYGHYGPLFIRMAWHAAGTYRIHDGRGGAGGGMQRFAPLNSWPDNASLDKARRLLWPVKKKYGKKLSWADLIVFAGNCALESMGFKTFGFGFGRVDQWEPDEVYWGKEATWLGDERYSGKRDLENPLAAVQMGLIYVNPEGPNGNPDPMAAAVDIRETFRRMAMNDVETAALIVGGHTFGKTHGAGPADLVGPEPEAAPLEQMGLGWKSSYGTGTGKDAITSGIEVVWTNTPTKWDNSFLEILYGYEWELTKSPAGAWQYTAKDGAGAGTIPDPFGGPGRSPTMLATDLSLRVDPIYERITRRWLEHPEELADEFAKAWYKLIHRDMGPVARYLGPLVPKQTLLWQDPVPAVSHDLVGEAEIASLKSQIRASGLTVSQLVSTAWAAASSFRGSDKRGGANGGRIRLQPQVGWEVNDPDGDLRKVIRTLEEIQESFNSAAPGNIKVSFADLVVLGGCAAIEKAAKAAGHNITVPFTPGRTDASQEQTDVESFAVLEPKADGFRNYLGKGNPLPAEYMLLDKANLLTLSAPEMTVLVGGLRVLGANYKRLPLGVFTEASESLTNDFFVNLLDMGITWEPSPADDGTYQGKDGSGKVKWTGSRVDLVFGSNSELRALVEVYGADDAQPKFVQDFVAAWDKVMNLDRFDVR<br><br>8mer<br>MPEQHPPI;AASNGCPV;CPVVGHMK;PVVGHMKY;YPVEGGGN;WWPNRLNL;RLNLKVLH;KVLHQNPA;VLHQNPAV;NPAVADPM;AVADPMGA;MGAAFDYA;AFDYAAEV;YAAEVATI;AEVATIDV;ATIDVDAL;LTRDIEEV;VMTTSQPW;MTTSQPWW;TSQPWWPA;QPWWPADY;WPADYGHY;HYGPLFIR;GPLFIRMA;FIRMAWHA;MAWHAAGT;HAAGTYRI;TYRIHDGR;GMQRFAPL;RFAPLNSW;SWPDNASL;NASLDKAR;ASLDKARR;SLDKARRL;RRLLWPVK;RLLWPVKK;LLWPVKKK;PVKKKYGK;KYGKKLSW;KLSWADLI;LSWADLIV;SWADLIVF;CALESMGF;ALESMGFK;TFGFGFGR;FGFGFGRV;GFGRVDQW;DQWEPDEV;QWEPDEVY;WEPDEVYW;EVYWGKEA;YWGKEATW;ATWLGDER;WLGDERYS;DERYSGKR;RYSGKRDL;LENPLAAV;NPLAAVQM;LAAVQMGL;AVQMGLIY;VQMGLIYV;NPDPMAAA;MAAAVDIR;DIRETFRR;ETFRRMAM;RRMAMNDV;MAMNDVET;AMNDVETA;VETAALIV;LIVGGHTF;KTHGAGPA;GAGPADLV;PEPEAAPL;EAAPLEQM;APLEQMGL;EQMGLGWK;SYGTGTGK;AITSGIEV;ITSGIEVV;TSGIEVVW;VWTNTPTK;WTNTPTKW;TKWDNSFL;NSFLEILY;FLEILYGY;ILYGYEWE;LYGYEWEL;GYEWELTK;SPAGAWQY;GAWQYTAK;DPFGGPGR;GPGRSPTM;MLATDLSL;LATDLSLR;ATDLSLRV;SLRVDPIY;RVDPIYER;PIYERITR;IYERITRR;YERITRRW;RRW | 144587-148335 |

Fig. 30 continued

LEHPE;WLEHPEEL;EELADEFA;ELADEFAK;DEFAKAWY;EFAKAWYK;FAK
AWYKL;AWYKLIHR;VARYLGPL;YLGPLVPK;PLVPKQTL;LVPKQTLL;VPKQ
TLLW;TLLWQDPV;WQDPVPAV;DPVPAVSH;VPAVSHDL;DLVGEAEI;GEA
EIASL;EAEIASLK;AEIASLKS;ASLKSQIR;SLKSQIRA;SQIRASGL;GLTVSQL
V;SQLVSTAW;QLVSTAWA;LVSTAWAA;STAWAAAS;AWAAASSF;WAAAS
SFR;SSFRGSDK;SFRGSDKR;GANGGRIR;RIRLQPQV;RLQPQVGW;VIRT
LEEI;IQESFNSA;NSAAPGNI;SAAPGNIK;AAPGNIKV;KVSFADLV;SFADLV
VL;VVLGGCAA;VLGGCAAI;AAIEKAAK;AAGHNITV;TVPFTPGR;VPFTPGR
T;EQTDVESF;TDVESFAV;DVESFAVL;SFAVLEPK;EPKADGFR;GFRNYLG
K;YLGKGNPL;NPLPAEYM;PLPAEYML;LPAEYMLL;AEYMLLDK;MLLDKAN
L;LLDKANLL;LTLSAPEM;LSAPEMTV;SAPEMTVL;APEMTVLV;MTVLVGGL
;TVLVGGLR;VLVGGLRV;LVGGLRVL;RVLGANYK;VLGANYKR;KRLPLGVF
;RLPLGVFT;LPLGVFTE;PLGVFTEA;FTEASESL;ESLTNDFF;SLTNDFFV;F
FVNLLDM;NLLDMGIT;LLDMGITW;ITWEPSPA;SPADDGTY;QGKDGSGK;K
VKWTGSR;VKWTGSRV;TGSRVDLV;VFGSNSEL;FGSNSELR;ELRALVEV;
ALVEVYGA;GADDAQPK;FVQDFVAA;DFVAAWDK;FVAAWDKV;VAAWDK
VM;KVMNLDRF
9mer
MPEQHPPIT;GAASNGCPV;AASNGCPVV;CPVVGHMKY;VVGHMKYPV;N
QDWWPNRL;DWWPNRLNL;WWPNRLNLK;WPNRLNLKV;KVLHQNPAV;V
LHQNPAVA;NPAVADPMG;AVADPMGAA;VADPMGAAF;DPMGAAFDY;PM
GAAFDYA;MGAAFDYAA;AAFDYAAEV;DYAAEVATI;EVATIDVDA;ATIDVD
ALT;TIDVDALTR;ALTRDIEEV;EVMTTSQPW;VMTTSQPWW;TTSQPWWP
A;SQPWWPADY;WWPADYGHY;WPADYGHYG;DYGHYGPLF;HYGPLFIR
M;GPLFIRMAW;FIRMAWHAA;RMAWHAAGT;MAWHAAGTY;AWHAAGTYR
;WHAAGTYRI;GTYRIHDGR;RIHDGRGGA;GGMQRFAPL;PLNSWPDNA;NS
WPDNASL;NASLDKARR;SLDKARRLL;KARRLLWPV;ARRLLWPVK;RRLL
WPVKK;RLLWPVKKK;LLWPVKKKY;WPVKKKYGK;PVKKKYGKK;KKYGKK
LSW;KLSWADLIV;LSWADLIVF;SWADLIVFA;IVFAGNCAL;CALESMGFK;L
ESMGFKTF;SMGFKTFGF;GFKTFGFGF;KTFGFGFGR;FGFGRVDQW;DQ
WEPDEVY;QWEPDEVYW;EVYWGKEAT;VYWGKEATW;YWGKEATWL;EA
TWLGDER;ATWLGDERY;WLGDERYSG;DLENPLAAV;PLAAVQMGL;LAAV
QMGLI;AAVQMGLIY;AVQMGLIYV;GPNGNPDPM;NPDPMAAAV;DPMAAA
VDI;AAVDIRETF;AVDIRETFR;DIRETFRRM;RETFRRMAM;ETFRRMAMN;R
MAMNDVET;MAMNDVETA;AMNDVETAA;MNDVETAAL;ETAALIVGG;ALIV
GGHTF;IVGGHTFGK;HTFGKTHGA;KTHGAGPAD;HGAGPADLV;DLVGPE
PEA;GPEPEAAPL;SSYGTGTGK;DAITSGIEV;AITSGIEVV;ITSGIEVVW;EV
VWTNTPT;VVWTNTPTK;VWTNTPTKW;TPTKWDNSF;KWDNSFLEI;SFLEI
LYGY;LEILYGYEW;ILYGYEWEL;KSPAGAWQY;WQYTAKDGA;YTAKDGA
GA;GPGRSPTML;SPTMLATDL;TMLATDLSL;MLATDLSLR;LATDLSLRV;LS
LRVDPIY;RVDPIYERI;DPIYERITR;PIYERITRR;IYERITRRW;YERITRRWL;
RITRRWLEH;RRWLEHPEE;RWLEHPEEL;WLEHPEELA;HPEELADEF;ELA
DEFAKA;LADEFAKAW;DEFAKAWYK;EFAKAWYKL;FAKAWYKLI;KAWYKL
IHR;LIHRDMGPV;DMGPVARYL;PVARYLGPL;RYLGPLVPK;YLGPLVPKQ;
GPLVPKQTL;PLVPKQTLL;QTLLWQDPV;LLWQDPVPA;LWQDPVPAV;WQ
DPVPAVS;VPAVSHDLV;AEIASLKSQ;EIASLKSQI;IASLKSQIR;SQIRASGLT
;QIRASGLTV;SGLTVSQLV;TVSQLVSTA;VSQLVSTAW;SQLVSTAWA;QLV
STAWAA;LVSTAWAAA;STAWAAASS;TAWAAASSF;AWAAASSFR;ASSFR
GSDK;SSFRGSDKR;KRGGANGGR;GANGGRIRL;LQPQVGWEV;EVNDPD
GDL;DLRKVIRTL;KVIRTLEEI;TLEEIQESF;EEIQESFNS;EIQESFNSA;NSAA
PGNIK;SAAPGNIKV;APGNIKVSF;NIKVSFADL;KVSFADLVV;LVVLGGCAA;
VVLGGCAAI;LGGCAAIEK;CAAIEKAAK;KAAGHNITV;ITVPFTPGR;QEQTD
VESF;QTDVESFAV;ESFAVLEPK;KADGFRNYL;NYLGKGNPL;YLGKGNPL

Fig. 30 continued

| | | |
|---|---|---|
| | P;KGNPLPAEY;NPLPAEYML;PLPAEYMLL;AEYMLLDKA;YMLLDKANL;MLLDKANLL;LLDKANLLT;KANLLTLSA;LLTLSAPEM;LTLSAPEMT;TLSAPEMTV;LSAPEMTVL;SAPEMTVLV;EMTVLVGGL;MTVLVGGLR;TVLVGGLRV;VLVGGLRVL;GLRVLGANY;RVLGANYKR;VLGANYKRL;GANYKRLPL;RLPLGVFTE;LPLGVFTEA;SESLTNDFF;ESLTNDFFV;LTNDFFVNL;FVNLLDMGI;NLLDMGITW;LLDMGITWE;GITWEPSPA;EPSPADDGT;KVKWTGSRV;WTGSRVDLV;TGSRVDLVF;LVFGSNSEL;VFGSNSELR;SNSELRALV;SELRALVEV;ELRALVEVY;AQPKFVQDF;FVQDFVAAW;FVAAWDKVM;AAWDKVMNL;VMNLDRFDV;MNLDRFDVR<br>10mer<br>MPEQHPPITE;TGAASNGCPV;GAASNGCPVV;PVVGHMKYPV;YPVEGGGNQD;DWWPNRLNLK;WPNRLNLKVL;NLKVLHQNPA;HQNPAVADPM;AVADPMGAAF;DPMGAAFDYA;PMGAAFDYAA;GAAFDYAAEV;AAFDYAAEVA;FDYAAEVATI;YAAEVATIDV;AEVATIDVDA;EVATIDVDAL;ATIDVDALTR;ALTRDIEEVM;EEVMTTSQPW;EVMTTSQPWW;MTTSQPWWPA;TSQPWWPADY;QPWWPADYGH;PWWPADYGHY;WPADYGHYGP;DYGHYGPLFI;PLFIRMAWHA;RMAWHAAGTY;MAWHAAGTYR;AWHAAGTYRI;MQRFAPLNSW;SWPDNASLDK;WPDNASLDKA;DNASLDKARR;SLDKARRLLW;DKARRLLWPV;KARRLLWPVK;ARRLLWPVKK;RRLLWPVKKK;RLLWPVKKKY;LLWPVKKKYG;KLSWADLIVF;LSWADLIVFA;LIVFAGNCAL;FAGNCALESM;ESMGFKTFGF;FKTFGFGFGR;KTFGFGFGRV;GFGFGRVDQW;RVDQWEPDEV;EVYWGKEATW;VYWGKEATWL;EATWLGDERY;WLGDERYSGK;LENPLAAVQM;NPLAAVQMGL;PLAAVQMGLI;LAAVQMGLIY;AAVQMGLIYV;EGPNGNPDPM;DPMAAAVDIR;MAAAVDIRET;AAAVDIRETF;AAVDIRETFR;AVDIRETFRR;RMAMNDVETA;MAMNDVETAA;AMNDVETAAL;ETAALIVGGH;AALIVGGHTF;LIVGGHTFGK;DLVGPEPEAA;EPEAAPLEQM;EAAPLEQMGL;APLEQMGLGW;QMGLGWKSSY;GLGWKSSYGT;KSSYGTGTGK;TGKDAITSGI;DAITSGIEVV;EVVWTNTPTK;VVWTNTPTKW;NTPTKWDNSF;TPTKWDNSFL;TKWDNSFLEI;NSFLEILYGY;EILYGYEWEL;ILYGYEWELT;LYGYEWELTK;SPAGAWQYTA;TMLATDLSLR;MLATDLSLRV;DLSLRVDPIY;SLRVDPIYER;LRVDPIYERI;DPIYERITRR;IYERITRRWL;RRWLEHPEEL;HPEELADEFA;ELADEFAKAW;LADEFAKAWY;ADEFAKAWYK;DEFAKAWYKL;EFAKAWYKLI;AKAWYKLIHR;KLIHRDMGPV;GPVARYLGPL;PVARYLGPLV;ARYLGPLVPK;YLGPLVPKQT;GPLVPKQTLL;KQTLLWQDPV;TLLWQDPVPA;LLWQDPVPAV;DPVPAVSHDL;PVPAVSHDLV;AVSHDLVGEA;LVGEAEIASL;AEIASLKSQI;EIASLKSQIR;SQIRASGLTV;RASGLTVSQL;LTVSQLVSTA;TVSQLVSTAW;SQLVSTAWAA;QLVSTAWAAA;STAWAAASSF;TAWAAASSFR;AASSFRGSDK;ASSFRGSDKR;RLQPQVGWEV;WEVNDPDGDL;EVNDPDGDLR;RTLEEIQESF;EEIQESFNSA;EIQESFNSAA;NSAAPGNIKV;APGNIKVSFA;NIKVSFADLV;KVSFADLVVL;LVVLGGCAAI;VLGGCAAIEK;KAAKAAGHNI;AKAAGHNITV;AAGHNITVPF;NITVPFTPGR;VPFTPGRTDA;SQEQTDVESF;EQTDVESFAV;QTDVESFAVL;ESFAVLEPKA;AVLEPKADGF;EPKADGFRNY;YLGKGNPLPA;NPLPAEYMLL;EYMLLDKANL;YMLLDKANLL;MLLDKANLLT;LLDKANLLTL;NLLTLSAPEM;LTLSAPEMTV;TLSAPEMTVL;LSAPEMTVLV;PEMTVLVGGL;EMTVLVGGLR;MTVLVGGLRV;TVLVGGLRVL;VLVGGLRVLG;GLRVLGANYK;RVLGANYKRL;NYKRLPLGVF;RLPLGVFTEA;LPLGVFTEAS;GVFTEASESL;EASESLTNDF;SESLTNDFFV;SLTNDFFVNL;LTNDFFVNLL;FFVNLLDMGI;NLLDMGITWE;LLDMGITWEP;EPSPADDGTY;TYQGKDGSGK;YQGKDGSGKV;QGKDGSGKVK;SGKVKWTGSR;DLVFGSNSEL;LVFGSNSELR;SELRALVEVY;VYGADDAQPK;YGADDAQPKF;GADDAQPKFV;AQPKFVQDFV;KFVQDFVAAW;VQDFVAAWDK;DFVAAWDKVM;AWDKVMNLDR;KVMNLDRFDV;VMNLDRFDVR<br>11mer | |

Fig. 30 continued

| | | |
|---|---|---|
| | MPEQHPPITET;HPPITETTTGA;PPITETTTGAA;TTGAASNGCPV;TGAASNGCPVV;CPVVGHMKYPV;YPVEGGGNQDW;NQDWWPNRLNL;WWPNRLNLKVL;WPNRLNLKVLH;NLKVLHQNPAV;NPAVADPMGAA;PAVADPMGAAF;VADPMGAAFDY;DPMGAAFDYAA;MGAAFDYAAEV;AEVATIDVDAL;EVATIDVDALT;VATIDVDALTR;DALTRDIEEVM;ALTRDIEEVMT;IEEVMTTSQPW;EEVMTTSQPWW;VMTTSQPWWPA;TTSQPWWPADY;QPWWPADYGHY;WPADYGHYGPL;DYGHYGPLFIR;HYGPLFIRMAW;GPLFIRMAWHA;PLFIRMAWHAA;FIRMAWHAAGT;IRMAWHAAGTY;RMAWHAAGTYR;MAWHAAGTYRI;AAGTYRIHDGR;FAPLNSWPDNA;PLNSWPDNASL;WPDNASLDKAR;ASLDKARRLLW;SLDKARRLLWP;KARRLLWPVKK;ARRLLWPVKKK;RRLLWPVKKKY;LLWPVKKKYGK;WPVKKKYGKKL;KYGKKLSWADL;KLSWADLIVFA;DLIVFAGNCAL;GNCALESMGFK;CALESMGFKTF;LESMGFKTFGF;SMGFKTFGFGF;GFKTFGFGFGR;FKTFGFGFGRV;FGFGFGRVDQW;RVDQWEPDEVY;EPDEVYWGKEA;DEVYWGKEATW;EVYWGKEATWL;TWLGDERYSGK;DLENPLAAVQM;NPLAAVQMGLI;PLAAVQMGLIY;LAAVQMGLIYV;VQMGLIYVNPE;NGNPDPMAAAV;NPDPMAAAVDI;MAAAVDIRETF;AAAVDIRETFR;AAVDIRETFRR;AVDIRETFRRM;DIRETFRRMAM;ETFRRMAMNDV;RRMAMNDVETA;RMAMNDVETAA;MAMNDVETAAL;AMNDVETAALI;ETAALIVGGHT;TAALIVGGHTF;ALIVGGHTFGK;KTHGAGPADLV;LVGPEPEAAPL;PEAAPLEQMGL;EQMGLGWKSSY;SYGTGTGKDAI;GKDAITSGIEV;DAITSGIEVVW;EVVWTNTPTKW;NTPTKWDNSFL;TKWDNSFLEIL;KWDNSFLEILY;SFLEILYGYEW;LEILYGYEWEL;ILYGYEWELTK;WELTKSPAGAW;LTKSPAGAWQY;WQYTAKDGAGA;TIPDPFGGPGR;GPGRSPTMLAT;SPTMLATDLSL;PTMLATDLSLR;TMLATDLSLRV;LSLRVDPIYER;SLRVDPIYERI;RVDPIYERITR;DPIYERITRRW;PIYERITRRWL;LEHPEELADEF;EELADEFAKAW;ELADEFAKAWY;LADEFAKAWYK;FAKAWYKLIHR;KLIHRDMGPVA;LIHRDMGPVAR;HRDMGPVARYL;MGPVARYLGPL;GPVARYLGPLV;VARYLGPLVPK;YLGPLVPKQTL;GPLVPKQTLLW;PLVPKQTLLWQ;QTLLWQDPVPA;TLLWQDPVPAV;LLWQDPVPAVS;DPVPAVSHDLV;DLVGEAEIASL;LVGEAEIASLK;EIASLKSQIRA;SLKSQIRASGL;SQIRASGLTVS;RASGLTVSQLV;GLTVSQLVSTA;LTVSQLVSTAW;TVSQLVSTAWA;SQLVSTAWAAA;VSTAWAAASSF;STAWAAASSFR;AAASSFRGSDK;AASSFRGSDKR;IRLQPQVGWEV;EVNDPDGDLRK;EEIQESFNSAA;ESFNSAAPGNI;SFNSAAPGNIK;SAAPGNIKVSF;NIKVSFADLVV;DLVVLGGCAAI;VVLGGCAAIEK;VLGGCAAIEKA;EKAAKAAGHNI;AAKAAGHNITV;KAAGHNITVPF;HNITVPFTPGR;VPFTPGRTDAS;RTDASQEQTDV;ASQEQTDVESF;SQEQTDVESFA;DVESFAVLEPK;FAVLEPKADGF;AVLEPKADGFR;EPKADGFRNYL;KADGFRNYLGK;YLGKGNPLPAE;LPAEYMLLDKA;AEYMLLDKANL;EYMLLDKANLL;YMLLDKANLLT;MLLDKANLLTL;LLDKANLLTLS;LLTLSAPEMTV;LTLSAPEMTVL;TLSAPEMTVLV;APEMTVLVGGL;EMTVLVGGLRV;MTVLVGGLRVL;VLVGGLRVLGA;GLRVLGANYKR;VLGANYKRLPL;GANYKRLPLGV;RLPLGVFTEAS;LPLGVFTEASE;EASESLTNDFF;ESLTNDFFVNL;SLTNDFFVNLL;FVNLLDMGITW;NLLDMGITWEP;LLDMGITWEPS;WEPSPADDGTY;GTYQGKDGSGK;GSGKVKWTGSR;VKWTGSRVDLV;KWTGSRVDLVF;DLVFGSNSELR;LVFGSNSELRA;FGSNSELRALV;SNSELRALVEV;NSELRALVEVY;ELRALVEVYGA;ALVEVYGADDA;EVYGADDAQPK;VYGADDAQPKF;YGADDAQPKFV;DAQPKFVQDFV;AQPKFVQDFVA;QPKFVQDFVAA;FVQDFVAAWDK;VQDFVAAWDKV;FVAAWDKVMNL;AAWDKVMNLDR;AWDKVMNLDRF;KVMNLDRFDVR<br><br>13 mers:<br>MPEQHPPITETTT;PEQHPPITETTTG;EQHPPITETTTGA;QHPPITETTTGAA;HPPITETTTGAAS;PPITETTTGAASN;PITETTTGAASNG;ITETTTGAASN | |

Fig. 30 continued

| | | |
|---|---|---|
| | GC;TETTTGAASNGCP;ETTTGAASNGCPV;TTTGAASNGCPVV;TTGAASNGCPVVG;TGAASNGCPVVGH;GAASNGCPVVGHM;AASNGCPVVGHMK;ASNGCPVVGHMKY;SNGCPVVGHMKYP;NGCPVVGHMKYPV;GCPVVGHMKYPVE;CPVVGHMKYPVEG;PVVGHMKYPVEGG;VVGHMKYPVEGGG;VGHMKYPVEGGGN;GHMKYPVEGGGNQ;HMKYPVEGGGNQD;MKYPVEGGGNQDW;KYPVEGGGNQDWW;YPVEGGGNQDWWP;PVEGGGNQDWWPN;VEGGGNQDWWPNR;EGGGNQDWWPNRL;GGGNQDWWPNRLN;GGNQDWWPNRLNL;GNQDWWPNRLNLK;NQDWWPNRLNLKV;QDWWPNRLNLKVL;DWWPNRLNLKVLH;WWPNRLNLKVLHQ;WPNRLNLKVLHQN;PNRLNLKVLHQNP;NRLNLKVLHQNPA;RLNLKVLHQNPAV;LNLKVLHQNPAVA;NLKVLHQNPAVAD;LKVLHQNPAVADP;KVLHQNPAVADPM;VLHQNPAVADPMG;LHQNPAVADPMGA;HQNPAVADPMGAA;QNPAVADPMGAAF;NPAVADPMGAAFD;PAVADPMGAAFDY;AVADPMGAAFDYA;VADPMGAAFDYAA;ADPMGAAFDYAAE;DPMGAAFDYAAEV;PMGAAFDYAAEVA;MGAAFDYAAEVAT;GAAFDYAAEVATI;AAFDYAAEVATID;AFDYAAEVATIDV;FDYAAEVATIDVD;DYAAEVATIDVDA;YAAEVATIDVDAL;AAEVATIDVDALT;AEVATIDVDALTR;EVATIDVDALTRD;VATIDVDALTRDI;ATIDVDALTRDIE;TIDVDALTRDIEE;IDVDALTRDIEEV;DVDALTRDIEEVM;VDALTRDIEEVMT;DALTRDIEEVMTT;ALTRDIEEVMTTS;LTRDIEEVMTTSQ;TRDIEEVMTTSQP;RDIEEVMTTSQPW;DIEEVMTTSQPWW;IEEVMTTSQPWWP;EEVMTTSQPWWPA;EVMTTSQPWWPAD;VMTTSQPWWPADY;MTTSQPWWPADYG;TTSQPWWPADYGH;TSQPWWPADYGHY;SQPWWPADYGHYG;QPWWPADYGHYGP;PWWPADYGHYGPL;WWPADYGHYGPLF;WPADYGHYGPLFI;PADYGHYGPLFIR;ADYGHYGPLFIRM;DYGHYGPLFIRMA;YGHYGPLFIRMAW;GHYGPLFIRMAWH;HYGPLFIRMAWHA;YGPLFIRMAWHAA;GPLFIRMAWHAAG;PLFIRMAWHAAGT;LFIRMAWHAAGTY;FIRMAWHAAGTYR;IRMAWHAAGTYRI;RMAWHAAGTYRIH;MAWHAAGTYRIHD;AWHAAGTYRIHDG;WHAAGTYRIHDGR;HAAGTYRIHDGRG;AAGTYRIHDGRGG;AGTYRIHDGRGGA;GTYRIHDGRGGAG;TYRIHDGRGGAGG;YRIHDGRGGAGGG;RIHDGRGGAGGGM;IHDGRGGAGGGMQ;HDGRGGAGGGMQR;DGRGGAGGGMQRF;GRGGAGGGMQRFA;RGGAGGGMQRFAP;GGAGGGMQRFAPL;GAGGGMQRFAPLN;AGGGMQRFAPLNS;GGGMQRFAPLNSW;GGMQRFAPLNSWP;GMQRFAPLNSWPD;MQRFAPLNSWPDN;QRFAPLNSWPDNA;RFAPLNSWPDNAS;FAPLNSWPDNASL;APLNSWPDNASLD;PLNSWPDNASLDK;LNSWPDNASLDKA;NSWPDNASLDKAR;SWPDNASLDKARR;WPDNASLDKARRL;PDNASLDKARRLL;DNASLDKARRLLW;NASLDKARRLLWP;ASLDKARRLLWPV;SLDKARRLLWPVK;LDKARRLLWPVKK;DKARRLLWPVKKK;KARRLLWPVKKKY;ARRLLWPVKKKYG;RRLLWPVKKKYGK;RLLWPVKKKYGKK;LLWPVKKKYGKKL;LWPVKKKYGKKLS;WPVKKKYGKKLSW;PVKKKYGKKLSWA;VKKKYGKKLSWAD;KKKYGKKLSWADL;KKYGKKLSWADLI;KYGKKLSWADLIV;YGKKLSWADLIVF;GKKLSWADLIVFA;KKLSWADLIVFAG;KLSWADLIVFAGN;LSWADLIVFAGNC;SWADLIVFAGNCA;WADLIVFAGNCAL;ADLIVFAGNCALE;DLIVFAGNCALES;LIVFAGNCALESM;IVFAGNCALESMG;VFAGNCALESMGF;FAGNCALESMGFK;AGNCALESMGFKT;GNCALESMGFKTF;NCALESMGFKTFG;CALESMGFKTFGF;ALESMGFKTFGFG;LESMGFKTFGFGF;ESMGFKTFGFGFG;SMGFKTFGFGFGR;MGFKTFGFGFGRV;GFKTFGFGFGRVD;FKTFGFGFGRVDQ;KTFGFGFGRVDQW;TFGFGFGRVDQWE;FGFGFGRVDQWEP;GFGFGRVDQWEPD;FGFGRVDQWEPDE;GFGRVDQWEPDEV;FGRVDQWEPDEVY;GRVDQWEPDEVYW;RVDQWEPDEVYWG;VDQWEPDEVYWGK;DQWEPDEVYWGKE;QWEPDEVYWGKEA;WEPDEVYWGKEAT;EPDEVYWGKEATW;PDEVYWGKEATWL;DEVYWGKEATWLG;EVYWGKEATWLGD;VYWGKEATWLGDE;YWGKEATWLGDER;WGKEATWLGDERY;GKEATWLGDERYS;KEATWLGDERYSG;E | |

Fig. 30 continued

| | | | |
|---|---|---|---|
| | ATWLGDERYSGK;ATWLGDERYSGKR;TWLGDERYSGKRD;WLGDERYSGKRDL;LGDERYSGKRDLE;GDERYSGKRDLEN;DERYSGKRDLENP;ERYSGKRDLENPL;RYSGKRDLENPLA;YSGKRDLENPLAA;SGKRDLENPLAAV;GKRDLENPLAAVQ;KRDLENPLAAVQM;RDLENPLAAVQMG;DLENPLAAVQMGL;LENPLAAVQMGLI;ENPLAAVQMGLIY;NPLAAVQMGLIYV;PLAAVQMGLIYVN;LAAVQMGLIYVNP;AAVQMGLIYVNPE;AVQMGLIYVNPEG;VQMGLIYVNPEGP;QMGLIYVNPEGPN;MGLIYVNPEGPNG;GLIYVNPEGPNGN;LIYVNPEGPNGNP;IYVNPEGPNGNPD;YVNPEGPNGNPDP;VNPEGPNGNPDPM;NPEGPNGNPDPMA;PEGPNGNPDPMAA;EGPNGNPDPMAAA;GPNGNPDPMAAAV;PNGNPDPMAAAVD;NGNPDPMAAAVDI;GNPDPMAAAVDIR;NPDPMAAAVDIRE;PDPMAAAVDIRET;DPMAAAVDIRETF;PMAAAVDIRETFR;MAAAVDIRETFRR;AAAVDIRETFRRM;AAVDIRETFRRMA;AVDIRETFRRMAM;VDIRETFRRMAMN;DIRETFRRMAMND;IRETFRRMAMNDV;RETFRRMAMNDVE;ETFRRMAMNDVET;TFRRMAMNDVETA;FRRMAMNDVETAA;RRMAMNDVETAAL;RMAMNDVETAALI;MAMNDVETAALIV;AMNDVETAALIVG;MNDVETAALIVGG;NDVETAALIVGGH;DVETAALIVGGHT;VETAALIVGGHTF;ETAALIVGGHTFG;TAALIVGGHTFGK;AALIVGGHTFGKT;ALIVGGHTFGKTH;LIVGGHTFGKTHG;IVGGHTFGKTHGA;VGGHTFGKTHGAG;GGHTFGKTHGAGP;GHTFGKTHGAGPA;HTFGKTHGAGPAD;TFGKTHGAGPADL;FGKTHGAGPADLV;GKTHGAGPADLVG;KTHGAGPADLVGP;THGAGPADLVGPE;HGAGPADLVGPEP;GAGPADLVGPEPE;AGPADLVGPEPEA;GPADLVGPEPEAA;PADLVGPEPEAAP;ADLVGPEPEAAPL;DLVGPEPEAAPLE;LVGPEPEAAPLEQ;VGPEPEAAPLEQM;GPEPEAAPLEQMG;PEPEAAPLEQMGL;EPEAAPLEQMGLG;PEAAPLEQMGLGW;EAAPLEQMGLGWK;AAPLEQMGLGWKS;APLEQMGLGWKSS;PLEQMGLGWKSSY;LEQMGLGWKSSYG;EQMGLGWKSSYGT;QMGLGWKSSYGTG;MGLGWKSSYGTGT;GLGWKSSYGTGTG;LGWKSSYGTGTGK;GWKSSYGTGTGKD;WKSSYGTGTGKDA;KSSYGTGTGKDAI;SSYGTGTGKDAIT;SYGTGTGKDAITS;YGTGTGKDAITSG;GTGTGKDAITSGI;TGTGKDAITSGIE;GTGKDAITSGIEV;TGKDAITSGIEVV;GKDAITSGIEVVW;KDAITSGIEVVWT;DAITSGIEVVWTN;AITSGIEVVWTNT;ITSGIEVVWTNTP;TSGIEVVWTNTPT;SGIEVVWTNTPTK;GIEVVWTNTPTKW;IEVVWTNTPTKWD;EVVWTNTPTKWDN;VVWTNTPTKWDNS;VWTNTPTKWDNSF;WTNTPTKWDNSFL;TNTPTKWDNSFLE;NTPTKWDNSFLEI;TPTKWDNSFLEIL;PTKWDNSFLEILY;TKWDNSFLEILYG;KWDNSFLEILYGY;WDNSFLEILYGYE;DNSFLEILYGYEW;NSFLEILYGYEWE;SFLEILYGYEWEL;FLEILYGYEWELT;LEILYGYEWELTK;EILYGYEWELTKS;ILYGYEWELTKSP;LYGYEWELTKSPA;YGYEWELTKSPAG;GYEWELTKSPAGA;YEWELTKSPAGAW;EWELTKSPAGAWQ;WELTKSPAGAWQY;ELTKSPAGAWQYT;LTKSPAGAWQYTA;TKSPAGAWQYTAK;KSPAGAWQYTAKD;SPAGAWQYTAKDG;PAGAWQYTAKDGA;AGAWQYTAKDGAG;GAWQYTAKDGAGA;AWQYTAKDGAGAG;WQYTAKDGAGAGT;QYTAKDGAGAGTI;YTAKDGAGAGTIP;TAKDGAGAGTIPD;AKDGAGAGTIPDP;KDGAGAGTIPDPF;DGAGAGTIPDPFG;GAGAGTIPDPFGG;AGAGTIPDPFGGP;GAGTIPDPFGGPG;AGTIPDPFGGPGR;GTIPDPFGGPGRS;TIPDPFGGPGRSP;IPDPFGGPGRSPT;PDPFGGPGRSPTM;DPFGGPGRSPTML;PFGGPGRSPTMLA;FGGPGRSPTMLAT;GGPGRSPTMLATD;GPGRSPTMLATDL;PGRSPTMLATDLS;GRSPTMLATDLSL;RSPTMLATDLSLR;SPTMLATDLSLRV;PTMLATDLSLRVD;TMLATDLSLRVDP;MLATDLSLRVDPI;LATDLSLRVDPIY;ATDLSLRVDPIYE;TDLSLRVDPIYER;DLSLRVDPIYERI;LSLRVDPIYERIT;SLRVDPIYERITR;LRVDPIYERITRR;RVDPIYERITRRW;VDPIYERITRRWL;DPIYERITRRWLE;PIYERITRRWLEH;IYERITRRWLEHP;YERITRRWLEHPE;ERITRRWLEHPEE;RITRRWLEHPEEL;ITRRWLEHPEELA;TRRWLEHPEELAD;RRWLEHPEELADE;RWLEHPEELADEF;WLEHPEELADEFA;LEHPEELADEFA | |

Fig. 30 continued

| | | |
|---|---|---|
| | K;EHPEELADEFAKA;HPEELADEFAKAW;PEELADEFAKAWY;EELADEFAKAWYK;ELADEFAKAWYKL;LADEFAKAWYKLI;ADEFAKAWYKLIH;DEFAKAWYKLIHR;EFAKAWYKLIHRD;FAKAWYKLIHRDM;AKAWYKLIHRDMG;KAWYKLIHRDMGP;AWYKLIHRDMGPV;WYKLIHRDMGPVA;YKLIHRDMGPVAR;KLIHRDMGPVARY;LIHRDMGPVARYL;IHRDMGPVARYLG;HRDMGPVARYLGP;RDMGPVARYLGPL;DMGPVARYLGPLV;MGPVARYLGPLVP;GPVARYLGPLVPK;PVARYLGPLVPKQ;VARYLGPLVPKQT;ARYLGPLVPKQTL;RYLGPLVPKQTLL;YLGPLVPKQTLLW;LGPLVPKQTLLWQ;GPLVPKQTLLWQD;PLVPKQTLLWQDP;LVPKQTLLWQDPV;VPKQTLLWQDPVP;PKQTLLWQDPVPA;KQTLLWQDPVPAV;QTLLWQDPVPAVS;TLLWQDPVPAVSH;LLWQDPVPAVSHD;LWQDPVPAVSHDL;WQDPVPAVSHDLV;QDPVPAVSHDLVG;DPVPAVSHDLVGE;PVPAVSHDLVGEA;VPAVSHDLVGEAE;PAVSHDLVGEAEI;AVSHDLVGEAEIA;VSHDLVGEAEIAS;SHDLVGEAEIASL;HDLVGEAEIASLK;DLVGEAEIASLKS;LVGEAEIASLKSQ;VGEAEIASLKSQI;GEAEIASLKSQIR;EAEIASLKSQIRA;AEIASLKSQIRAS;EIASLKSQIRASG;IASLKSQIRASGL;ASLKSQIRASGLT;SLKSQIRASGLTV;LKSQIRASGLTVS;KSQIRASGLTVSQ;SQIRASGLTVSQL;QIRASGLTVSQLV;IRASGLTVSQLVS;RASGLTVSQLVST;ASGLTVSQLVSTA;SGLTVSQLVSTAW;GLTVSQLVSTAWA;LTVSQLVSTAWAA;TVSQLVSTAWAAA;VSQLVSTAWAAAS;SQLVSTAWAAASS;QLVSTAWAAASSF;LVSTAWAAASSFR;VSTAWAAASSFRG;STAWAAASSFRGS;TAWAAASSFRGSD;AWAAASSFRGSDK;WAAASSFRGSDKR;AAASSFRGSDKRG;AASSFRGSDKRGG;ASSFRGSDKRGGA;SSFRGSDKRGGAN;SFRGSDKRGGANG;FRGSDKRGGANGG;RGSDKRGGANGGR;GSDKRGGANGGRI;SDKRGGANGGRIR;DKRGGANGGRIRL;KRGGANGGRIRLQ;RGGANGGRIRLQP;GGANGGRIRLQPQ;GANGGRIRLQPQV;ANGGRIRLQPQVG;NGGRIRLQPQVGW;GGRIRLQPQVGWE;GRIRLQPQVGWEV;RIRLQPQVGWEVN;IRLQPQVGWEVND;RLQPQVGWEVNDP;LQPQVGWEVNDPD;QPQVGWEVNDPDG;PQVGWEVNDPDGD;QVGWEVNDPDGDL;VGWEVNDPDGDLR;GWEVNDPDGDLRK;WEVNDPDGDLRKV;EVNDPDGDLRKVI;VNDPDGDLRKVIR;NDPDGDLRKVIRT;DPDGDLRKVIRTL;PDGDLRKVIRTLE;DGDLRKVIRTLEE;GDLRKVIRTLEEI;DLRKVIRTLEEIQ;LRKVIRTLEEIQE;RKVIRTLEEIQES;KVIRTLEEIQESF;VIRTLEEIQESFN;IRTLEEIQESFNS;RTLEEIQESFNSA;TLEEIQESFNSAA;LEEIQESFNSAAP;EEIQESFNSAAPG;EIQESFNSAAPGN;IQESFNSAAPGNI;QESFNSAAPGNIK;ESFNSAAPGNIKV;SFNSAAPGNIKVS;FNSAAPGNIKVSF;NSAAPGNIKVSFA;SAAPGNIKVSFAD;AAPGNIKVSFADL;APGNIKVSFADLV;PGNIKVSFADLVV;GNIKVSFADLVVL;NIKVSFADLVVLG;IKVSFADLVVLGG;KVSFADLVVLGGC;VSFADLVVLGGCA;SFADLVVLGGCAA;FADLVVLGGCAAI;ADLVVLGGCAAIE;DLVVLGGCAAIEK;LVVLGGCAAIEKA;VVLGGCAAIEKAA;VLGGCAAIEKAAK;LGGCAAIEKAAKA;GGCAAIEKAAKAA;GCAAIEKAAKAAG;CAAIEKAAKAAGH;AAIEKAAKAAGHN;AIEKAAKAAGHNI;IEKAAKAAGHNIT;EKAAKAAGHNITV;KAAKAAGHNITVP;AAKAAGHNITVPF;AKAAGHNITVPFT;KAAGHNITVPFTP;AAGHNITVPFTPG;AGHNITVPFTPGR;GHNITVPFTPGRT;HNITVPFTPGRTD;NITVPFTPGRTDA;ITVPFTPGRTDAS;TVPFTPGRTDASQ;VPFTPGRTDASQE;PFTPGRTDASQEQ;FTPGRTDASQEQT;TPGRTDASQEQTD;PGRTDASQEQTDV;GRTDASQEQTDVE;RTDASQEQTDVES;TDASQEQTDVESF;DASQEQTDVESFA;ASQEQTDVESFAV;SQEQTDVESFAVL;QEQTDVESFAVLE;EQTDVESFAVLEP;QTDVESFAVLEPK;TDVESFAVLEPKA;DVESFAVLEPKAD;VESFAVLEPKADG;ESFAVLEPKADGF;SFAVLEPKADGFR;FAVLEPKADGFRN;AVLEPKADGFRNY;VLEPKADGFRNYL;LEPKADGFRNYLG;EPKADGFRNYLGK;PKADGFRNYLGKG;KADGFRNYLGKGN;ADGFRNYLGKGNP;DGFRNYLGKGNPL;GFRNYLGKGNPLP;FRNYLGKGNPLPA;RNYLGKGNPLPAE;NYLGKGNPLPAEY;YLGKGNPLPAEYM;LGKGN | |

Fig. 30 continued

| | | |
|---|---|---|
| | PLPAEYML;GKGNPLPAEYMLL;KGNPLPAEYMLLD;GNPLPAEYMLLDK;NPLPAEYMLLDKA;PLPAEYMLLDKAN;LPAEYMLLDKANL;PAEYMLLDKANLL;AEYMLLDKANLLT;EYMLLDKANLLTL;YMLLDKANLLTLS;MLLDKANLLTLSA;LLDKANLLTLSAP;LDKANLLTLSAPE;DKANLLTLSAPEM;KANLLTLSAPEMT;ANLLTLSAPEMTV;NLLTLSAPEMTVL;LLTLSAPEMTVLV;LTLSAPEMTVLVG;TLSAPEMTVLVGG;LSAPEMTVLVGGL;SAPEMTVLVGGLR;APEMTVLVGGLRV;PEMTVLVGGLRVL;EMTVLVGGLRVLG;MTVLVGGLRVLGA;TVLVGGLRVLGAN;VLVGGLRVLGANY;LVGGLRVLGANYK;VGGLRVLGANYKR;GGLRVLGANYKRL;GLRVLGANYKRLP;LRVLGANYKRLPL;RVLGANYKRLPLG;VLGANYKRLPLGV;LGANYKRLPLGVF;GANYKRLPLGVFT;ANYKRLPLGVFTE;NYKRLPLGVFTEA;YKRLPLGVFTEAS;KRLPLGVFTEASE;RLPLGVFTEASES;LPLGVFTEASESL;PLGVFTEASESLT;LGVFTEASESLTN;GVFTEASESLTND;VFTEASESLTNDF;FTEASESLTNDFF;TEASESLTNDFFV;EASESLTNDFFVN;ASESLTNDFFVNL;SESLTNDFFVNLL;ESLTNDFFVNLLD;SLTNDFFVNLLDM;LTNDFFVNLLDMG;TNDFFVNLLDMGI;NDFFVNLLDMGIT;DFFVNLLDMGITW;FFVNLLDMGITWE;FVNLLDMGITWEP;VNLLDMGITWEPS;NLLDMGITWEPSP;LLDMGITWEPSPA;LDMGITWEPSPAD;DMGITWEPSPADD;MGITWEPSPADDG;GITWEPSPADDGT;ITWEPSPADDGTY;TWEPSPADDGTYQ;WEPSPADDGTYQG;EPSPADDGTYQGK;PSPADDGTYQGKD;SPADDGTYQGKDG;PADDGTYQGKDGS;ADDGTYQGKDGSG;DDGTYQGKDGSGK;DGTYQGKDGSGKV;GTYQGKDGSGKVK;TYQGKDGSGKVKW;YQGKDGSGKVKWT;QGKDGSGKVKWTG;GKDGSGKVKWTGS;KDGSGKVKWTGSR;DGSGKVKWTGSRV;GSGKVKWTGSRVD;SGKVKWTGSRVDL;GKVKWTGSRVDLV;KVKWTGSRVDLVF;VKWTGSRVDLVFG;KWTGSRVDLVFGS;WTGSRVDLVFGSN;TGSRVDLVFGSNS;GSRVDLVFGSNSE;SRVDLVFGSNSEL;RVDLVFGSNSELR;VDLVFGSNSELRA;DLVFGSNSELRAL;LVFGSNSELRALV;VFGSNSELRALVE;FGSNSELRALVEV;GSNSELRALVEVY;SNSELRALVEVYG;NSELRALVEVYGA;SELRALVEVYGAD;ELRALVEVYGADD;LRALVEVYGADDA;RALVEVYGADDAQ;ALVEVYGADDAQP;LVEVYGADDAQPK;VEVYGADDAQPKF;EVYGADDAQPKFV;VYGADDAQPKFVQ;YGADDAQPKFVQD;GADDAQPKFVQDF;ADDAQPKFVQDFV;DDAQPKFVQDFVA;DAQPKFVQDFVAA;AQPKFVQDFVAAW;QPKFVQDFVAAWD;PKFVQDFVAAWDK;KFVQDFVAAWDKV;FVQDFVAAWDKVM;VQDFVAAWDKVMN;QDFVAAWDKVMNL;DFVAAWDKVMNLD;FVAAWDKVMNLDR;VAAWDKVMNLDRF;AAWDKVMNLDRFD;AWDKVMNLDRFDV;WDKVMNLDRFDVR;<br><br>14 mers:<br>MPEQHPPITETTTG;PEQHPPITETTTGA;EQHPPITETTTGAA;QHPPITETTTGAAS;HPPITETTTGAASN;PPITETTTGAASNG;PITETTTGAASNGC;ITETTTGAASNGCP;TETTTGAASNGCPV;ETTTGAASNGCPVV;TTTGAASNGCPVVG;TTGAASNGCPVVGH;TGAASNGCPVVGHM;GAASNGCPVVGHMK;AASNGCPVVGHMKY;ASNGCPVVGHMKYP;SNGCPVVGHMKYPV;NGCPVVGHMKYPVE;GCPVVGHMKYPVEG;CPVVGHMKYPVEGG;PVVGHMKYPVEGGG;VVGHMKYPVEGGGN;VGHMKYPVEGGGNQ;GHMKYPVEGGGNQD;HMKYPVEGGGNQDW;MKYPVEGGGNQDWW;KYPVEGGGNQDWWP;YPVEGGGNQDWWPN;PVEGGGNQDWWPNR;VEGGGNQDWWPNRL;EGGGNQDWWPNRLN;GGGNQDWWPNRLNL;GGNQDWWPNRLNLK;GNQDWWPNRLNLKV;NQDWWPNRLNLKVL;QDWWPNRLNLKVLH;DWWPNRLNLKVLHQ;WWPNRLNLKVLHQN;WPNRLNLKVLHQNP;PNRLNLKVLHQNPA;NRLNLKVLHQNPAV;RLNLKVLHQNPAVA;LNLKVLHQNPAVAD;NLKVLHQNPAVADP;LKVLHQNPAVADPM;KVLHQNPAVADPMG;VLHQNPAVADPMGA;LHQNPAVADPMGAA;HQNPAVADPMGAAF;QNPAVADPMGAAFD;N | |

Fig. 30 continued

| | | |
|---|---|---|
| | PAVADPMGAAFDY;PAVADPMGAAFDYA;AVADPMGAAFDYAA;VADPMGAAFDYAAE;ADPMGAAFDYAAEV;DPMGAAFDYAAEVA;PMGAAFDYAAEVAT;MGAAFDYAAEVATI;GAAFDYAAEVATID;AAFDYAAEVATIDV;AFDYAAEVATIDVD;FDYAAEVATIDVDA;DYAAEVATIDVDAL;YAAEVATIDVDALT;AAEVATIDVDALTR;AEVATIDVDALTRD;EVATIDVDALTRDI;VATIDVDALTRDIE;ATIDVDALTRDIEE;TIDVDALTRDIEEV;IDVDALTRDIEEVM;DVDALTRDIEEVMT;VDALTRDIEEVMTT;DALTRDIEEVMTTS;ALTRDIEEVMTTSQ;LTRDIEEVMTTSQP;TRDIEEVMTTSQPW;RDIEEVMTTSQPWW;DIEEVMTTSQPWWP;IEEVMTTSQPWWPA;EEVMTTSQPWWPAD;EVMTTSQPWWPADY;VMTTSQPWWPADYG;MTTSQPWWPADYGH;TTSQPWWPADYGHY;TSQPWWPADYGHYG;SQPWWPADYGHYGP;QPWWPADYGHYGPL;PWWPADYGHYGPLF;WWPADYGHYGPLFI;WPADYGHYGPLFIR;PADYGHYGPLFIRM;ADYGHYGPLFIRMA;DYGHYGPLFIRMAW;YGHYGPLFIRMAWH;GHYGPLFIRMAWHA;HYGPLFIRMAWHAA;YGPLFIRMAWHAAG;GPLFIRMAWHAAGT;PLFIRMAWHAAGTY;LFIRMAWHAAGTYR;FIRMAWHAAGTYRI;IRMAWHAAGTYRIH;RMAWHAAGTYRIHD;MAWHAAGTYRIHDG;AWHAAGTYRIHDGR;WHAAGTYRIHDGRG;HAAGTYRIHDGRGG;AAGTYRIHDGRGGA;AGTYRIHDGRGGAG;GTYRIHDGRGGAGG;TYRIHDGRGGAGGG;YRIHDGRGGAGGGM;RIHDGRGGAGGGMQ;IHDGRGGAGGGMQR;HDGRGGAGGGMQRF;DGRGGAGGGMQRFA;GRGGAGGGMQRFAP;RGGAGGGMQRFAPL;GGAGGGMQRFAPLN;GAGGGMQRFAPLNS;AGGGMQRFAPLNSW;GGGMQRFAPLNSWP;GGMQRFAPLNSWPD;GMQRFAPLNSWPDN;MQRFAPLNSWPDNA;QRFAPLNSWPDNAS;RFAPLNSWPDNASL;FAPLNSWPDNASLD;APLNSWPDNASLDK;PLNSWPDNASLDKA;LNSWPDNASLDKAR;NSWPDNASLDKARR;SWPDNASLDKARRL;WPDNASLDKARRLL;PDNASLDKARRLLW;DNASLDKARRLLWP;NASLDKARRLLWPV;ASLDKARRLLWPVK;SLDKARRLLWPVKK;LDKARRLLWPVKKK;DKARRLLWPVKKKY;KARRLLWPVKKKYG;ARRLLWPVKKKYGK;RRLLWPVKKKYGKK;RLLWPVKKKYGKKL;LLWPVKKKYGKKLS;LWPVKKKYGKKLSW;WPVKKKYGKKLSWA;PVKKKYGKKLSWAD;VKKKYGKKLSWADL;KKKYGKKLSWADLI;KKYGKKLSWADLIV;KYGKKLSWADLIVF;YGKKLSWADLIVFA;GKKLSWADLIVFAG;KKLSWADLIVFAGN;KLSWADLIVFAGNC;LSWADLIVFAGNCA;SWADLIVFAGNCAL;WADLIVFAGNCALE;ADLIVFAGNCALES;DLIVFAGNCALESM;LIVFAGNCALESMG;IVFAGNCALESMGF;VFAGNCALESMGFK;FAGNCALESMGFKT;AGNCALESMGFKTF;GNCALESMGFKTFG;NCALESMGFKTFGF;CALESMGFKTFGFG;ALESMGFKTFGFGF;LESMGFKTFGFGFG;ESMGFKTFGFGFGR;SMGFKTFGFGFGRV;MGFKTFGFGFGRVD;GFKTFGFGFGRVDQ;FKTFGFGFGRVDQW;KTFGFGFGRVDQWE;TFGFGFGRVDQWEP;FGFGFGRVDQWEPD;GFGFGRVDQWEPDE;FGFGRVDQWEPDEV;GFGRVDQWEPDEVY;FGRVDQWEPDEVYW;GRVDQWEPDEVYWG;RVDQWEPDEVYWGK;VDQWEPDEVYWGKE;DQWEPDEVYWGKEA;QWEPDEVYWGKEAT;WEPDEVYWGKEATW;EPDEVYWGKEATWL;PDEVYWGKEATWLG;DEVYWGKEATWLGD;EVYWGKEATWLGDE;VYWGKEATWLGDER;YWGKEATWLGDERY;WGKEATWLGDERYS;GKEATWLGDERYSG;KEATWLGDERYSGK;EATWLGDERYSGKR;ATWLGDERYSGKRD;TWLGDERYSGKRDL;WLGDERYSGKRDLE;LGDERYSGKRDLEN;GDERYSGKRDLENP;DERYSGKRDLENPL;ERYSGKRDLENPLA;RYSGKRDLENPLAA;YSGKRDLENPLAAV;SGKRDLENPLAAVQ;GKRDLENPLAAVQM;KRDLENPLAAVQMG;RDLENPLAAVQMGL;DLENPLAAVQMGLI;LENPLAAVQMGLIY;ENPLAAVQMGLIYV;NPLAAVQMGLIYVN;PLAAVQMGLIYVNP;LAAVQMGLIYVNPE;AAVQMGLIYVNPEG;AVQMGLIYVNPEGP;VQMGLIYVNPEGPN;QMGLIYVNPEGPNG;MGLIYVNPEGPNGN;GLIYVNPEGPNGNP;LIYVNPEGPNGNPD;IYVNPEGPNGNPDP;YVNPEGPNGNPDPM;VNPEGPNGNPDPMA;NPEGPNGNP | |

Fig. 30 continued

| | | |
|---|---|---|
| | DPMAA;PEGPNGNPDPMAAA;EGPNGNPDPMAAAV;GPNGNPDPMAAAVD;PNGNPDPMAAAVDI;NGNPDPMAAAVDIR;GNPDPMAAAVDIRE;NPDPMAAAVDIRET;PDPMAAAVDIRETF;DPMAAAVDIRETFR;PMAAAVDIRETFRR;MAAAVDIRETFRRM;AAAVDIRETFRRMA;AAVDIRETFRRMAM;AVDIRETFRRMAMN;VDIRETFRRMAMND;DIRETFRRMAMNDV;IRETFRRMAMNDVE;RETFRRMAMNDVET;ETFRRMAMNDVETA;TFRRMAMNDVETAA;FRRMAMNDVETAAL;RRMAMNDVETAALI;RMAMNDVETAALIV;MAMNDVETAALIVG;AMNDVETAALIVGG;MNDVETAALIVGGH;NDVETAALIVGGHT;DVETAALIVGGHTF;VETAALIVGGHTFG;ETAALIVGGHTFGK;TAALIVGGHTFGKT;AALIVGGHTFGKTH;ALIVGGHTFGKTHG;LIVGGHTFGKTHGA;IVGGHTFGKTHGAG;VGGHTFGKTHGAGP;GGHTFGKTHGAGPA;GHTFGKTHGAGPAD;HTFGKTHGAGPADL;TFGKTHGAGPADLV;FGKTHGAGPADLVG;GKTHGAGPADLVGP;KTHGAGPADLVGPE;THGAGPADLVGPEP;HGAGPADLVGPEPE;GAGPADLVGPEPEA;AGPADLVGPEPEAA;GPADLVGPEPEAAP;PADLVGPEPEAAPL;ADLVGPEPEAAPLE;DLVGPEPEAAPLEQ;LVGPEPEAAPLEQM;VGPEPEAAPLEQMG;GPEPEAAPLEQMGL;PEPEAAPLEQMGLG;EPEAAPLEQMGLGW;PEAAPLEQMGLGWK;EAAPLEQMGLGWKS;AAPLEQMGLGWKSS;APLEQMGLGWKSSY;PLEQMGLGWKSSYG;LEQMGLGWKSSYGT;EQMGLGWKSSYGTG;QMGLGWKSSYGTGT;MGLGWKSSYGTGTG;GLGWKSSYGTGTGK;LGWKSSYGTGTGKD;GWKSSYGTGTGKDA;WKSSYGTGTGKDAI;KSSYGTGTGKDAIT;SSYGTGTGKDAITS;SYGTGTGKDAITSG;YGTGTGKDAITSGI;GTGTGKDAITSGIE;TGTGKDAITSGIEV;GTGKDAITSGIEVV;TGKDAITSGIEVVW;GKDAITSGIEVVWT;KDAITSGIEVVWTN;DAITSGIEVVWTNT;AITSGIEVVWTNTP;ITSGIEVVWTNTPT;TSGIEVVWTNTPTK;SGIEVVWTNTPTKW;GIEVVWTNTPTKWD;IEVVWTNTPTKWDN;EVVWTNTPTKWDNS;VVWTNTPTKWDNSF;VWTNTPTKWDNSFL;WTNTPTKWDNSFLE;TNTPTKWDNSFLEI;NTPTKWDNSFLEIL;TPTKWDNSFLEILY;PTKWDNSFLEILYG;TKWDNSFLEILYGY;KWDNSFLEILYGYE;WDNSFLEILYGYEW;DNSFLEILYGYEWE;NSFLEILYGYEWEL;SFLEILYGYEWELT;FLEILYGYEWELTK;LEILYGYEWELTKS;EILYGYEWELTKSP;ILYGYEWELTKSPA;LYGYEWELTKSPAG;YGYEWELTKSPAGA;GYEWELTKSPAGAW;YEWELTKSPAGAWQ;EWELTKSPAGAWQY;WELTKSPAGAWQYT;ELTKSPAGAWQYTA;LTKSPAGAWQYTAK;TKSPAGAWQYTAKD;KSPAGAWQYTAKDG;SPAGAWQYTAKDGA;PAGAWQYTAKDGAG;AGAWQYTAKDGAGA;GAWQYTAKDGAGAG;AWQYTAKDGAGAGT;WQYTAKDGAGAGTI;QYTAKDGAGAGTIP;YTAKDGAGAGTIPD;TAKDGAGAGTIPDP;AKDGAGAGTIPDPF;KDGAGAGTIPDPFG;DGAGAGTIPDPFGG;GAGAGTIPDPFGGP;AGAGTIPDPFGGPG;GAGTIPDPFGGPGR;AGTIPDPFGGPGRS;GTIPDPFGGPGRSP;TIPDPFGGPGRSPT;IPDPFGGPGRSPTM;PDPFGGPGRSPTML;DPFGGPGRSPTMLA;PFGGPGRSPTMLAT;FGGPGRSPTMLATD;GGPGRSPTMLATDL;GPGRSPTMLATDLS;PGRSPTMLATDLSL;GRSPTMLATDLSLR;RSPTMLATDLSLRV;SPTMLATDLSLRVD;PTMLATDLSLRVDP;TMLATDLSLRVDPI;MLATDLSLRVDPIY;LATDLSLRVDPIYE;ATDLSLRVDPIYER;TDLSLRVDPIYERI;DLSLRVDPIYERIT;LSLRVDPIYERITR;SLRVDPIYERITRR;LRVDPIYERITRRW;RVDPIYERITRRWL;VDPIYERITRRWLE;DPIYERITRRWLEH;PIYERITRRWLEHP;IYERITRRWLEHPE;YERITRRWLEHPEE;ERITRRWLEHPEEL;RITRRWLEHPEELA;ITRRWLEHPEELAD;TRRWLEHPEELADE;RRWLEHPEELADEF;RWLEHPEELADEFA;WLEHPEELADEFAK;LEHPEELADEFAKA;EHPEELADEFAKAW;HPEELADEFAKAWY;PEELADEFAKAWYK;EELADEFAKAWYKL;ELADEFAKAWYKLI;LADEFAKAWYKLIH;ADEFAKAWYKLIHR;DEFAKAWYKLIHRD;EFAKAWYKLIHRDM;FAKAWYKLIHRDMG;AKAWYKLIHRDMGP;KAWYKLIHRDMGPV;AWYKLIHRDMGPVA;WYKLIHRDMGPVAR;YKLIHRDMGPVARY;KLIHRDMGPVARYL;LIHRDMGPVARYLG;IH | |

Fig. 30 continued

| | | |
|---|---|---|
| | RDMGPVARYLGP;HRDMGPVARYLGPL;RDMGPVARYLGPLV;DMGPVARYLGPLVP;MGPVARYLGPLVPK;GPVARYLGPLVPKQ;PVARYLGPLVPKQT;VARYLGPLVPKQTL;ARYLGPLVPKQTLL;RYLGPLVPKQTLLW;YLGPLVPKQTLLWQ;LGPLVPKQTLLWQD;GPLVPKQTLLWQDP;PLVPKQTLLWQDPV;LVPKQTLLWQDPVP;VPKQTLLWQDPVPA;PKQTLLWQDPVPAV;KQTLLWQDPVPAVS;QTLLWQDPVPAVSH;TLLWQDPVPAVSHD;LLWQDPVPAVSHDL;LWQDPVPAVSHDLV;WQDPVPAVSHDLVG;QDPVPAVSHDLVGE;DPVPAVSHDLVGEA;PVPAVSHDLVGEAE;VPAVSHDLVGEAEI;PAVSHDLVGEAEIA;AVSHDLVGEAEIAS;VSHDLVGEAEIASL;SHDLVGEAEIASLK;HDLVGEAEIASLKS;DLVGEAEIASLKSQ;LVGEAEIASLKSQI;VGEAEIASLKSQIR;GEAEIASLKSQIRA;EAEIASLKSQIRAS;AEIASLKSQIRASG;EIASLKSQIRASGL;IASLKSQIRASGLT;ASLKSQIRASGLTV;SLKSQIRASGLTVS;LKSQIRASGLTVSQ;KSQIRASGLTVSQL;SQIRASGLTVSQLV;QIRASGLTVSQLVS;IRASGLTVSQLVST;RASGLTVSQLVSTA;ASGLTVSQLVSTAW;SGLTVSQLVSTAWA;GLTVSQLVSTAWAA;LTVSQLVSTAWAAA;TVSQLVSTAWAAAS;VSQLVSTAWAAASS;SQLVSTAWAAASSF;QLVSTAWAAASSFR;LVSTAWAAASSFRG;VSTAWAAASSFRGS;STAWAAASSFRGSD;TAWAAASSFRGSDK;AWAAASSFRGSDKR;WAAASSFRGSDKRG;AAASSFRGSDKRGG;AASSFRGSDKRGGA;ASSFRGSDKRGGAN;SSFRGSDKRGGANG;SFRGSDKRGGANGG;FRGSDKRGGANGGR;RGSDKRGGANGGRI;GSDKRGGANGGRIR;SDKRGGANGGRIRL;DKRGGANGGRIRLQ;KRGGANGGRIRLQP;RGGANGGRIRLQPQ;GGANGGRIRLQPQV;GANGGRIRLQPQVG;ANGGRIRLQPQVGW;NGGRIRLQPQVGWE;GGRIRLQPQVGWEV;GRIRLQPQVGWEVN;RIRLQPQVGWEVND;IRLQPQVGWEVNDP;RLQPQVGWEVNDPD;LQPQVGWEVNDPDG;QPQVGWEVNDPDGD;PQVGWEVNDPDGDL;QVGWEVNDPDGDLR;VGWEVNDPDGDLRK;GWEVNDPDGDLRKV;WEVNDPDGDLRKVI;EVNDPDGDLRKVIR;VNDPDGDLRKVIRT;NDPDGDLRKVIRTL;DPDGDLRKVIRTLE;PDGDLRKVIRTLEE;DGDLRKVIRTLEEI;GDLRKVIRTLEEIQ;DLRKVIRTLEEIQE;LRKVIRTLEEIQES;RKVIRTLEEIQESF;KVIRTLEEIQESFN;VIRTLEEIQESFNS;IRTLEEIQESFNSA;RTLEEIQESFNSAA;TLEEIQESFNSAAP;LEEIQESFNSAAPG;EEIQESFNSAAPGN;EIQESFNSAAPGNI;IQESFNSAAPGNIK;QESFNSAAPGNIKV;ESFNSAAPGNIKVS;SFNSAAPGNIKVSF;FNSAAPGNIKVSFA;NSAAPGNIKVSFAD;SAAPGNIKVSFADL;AAPGNIKVSFADLV;APGNIKVSFADLVV;PGNIKVSFADLVVL;GNIKVSFADLVVLG;NIKVSFADLVVLGG;IKVSFADLVVLGGC;KVSFADLVVLGGCA;VSFADLVVLGGCAA;SFADLVVLGGCAAI;FADLVVLGGCAAIE;ADLVVLGGCAAIEK;DLVVLGGCAAIEKA;LVVLGGCAAIEKAA;VVLGGCAAIEKAAK;VLGGCAAIEKAAKA;LGGCAAIEKAAKAA;GGCAAIEKAAKAAG;GCAAIEKAAKAAGH;CAAIEKAAKAAGHN;AAIEKAAKAAGHNI;AIEKAAKAAGHNIT;IEKAAKAAGHNITV;EKAAKAAGHNITVP;KAAKAAGHNITVPF;AAKAAGHNITVPFT;AKAAGHNITVPFTP;KAAGHNITVPFTPG;AAGHNITVPFTPGR;AGHNITVPFTPGRT;GHNITVPFTPGRTD;HNITVPFTPGRTDA;NITVPFTPGRTDAS;ITVPFTPGRTDASQ;TVPFTPGRTDASQE;VPFTPGRTDASQEQ;PFTPGRTDASQEQT;FTPGRTDASQEQTD;TPGRTDASQEQTDV;PGRTDASQEQTDVE;GRTDASQEQTDVES;RTDASQEQTDVESF;TDASQEQTDVESFA;DASQEQTDVESFAV;ASQEQTDVESFAVL;SQEQTDVESFAVLE;QEQTDVESFAVLEP;EQTDVESFAVLEPK;QTDVESFAVLEPKA;TDVESFAVLEPKAD;DVESFAVLEPKADG;VESFAVLEPKADGF;ESFAVLEPKADGFR;SFAVLEPKADGFRN;FAVLEPKADGFRNY;AVLEPKADGFRNYL;VLEPKADGFRNYLG;LEPKADGFRNYLGK;EPKADGFRNYLGKG;PKADGFRNYLGKGN;KADGFRNYLGKGNP;ADGFRNYLGKGNPL;DGFRNYLGKGNPLP;GFRNYLGKGNPLPA;FRNYLGKGNPLPAE;RNYLGKGNPLPAEY;NYLGKGNPLPAEYM;YLGKGNPLPAEYML;LGKGNPLPAEYMLL;GKGNPLPAEYMLLD;KGNPLPAEYMLLDK;GNPLPAEYMLLDK | |

Fig. 30 continued

| | | |
|---|---|---|
| | A;NPLPAEYMLLDKAN;PLPAEYMLLDKANL;LPAEYMLLDKANLL;PAEYMLLDKANLLT;AEYMLLDKANLLTL;EYMLLDKANLLTLS;YMLLDKANLLTLSA;MLLDKANLLTLSAP;LLDKANLLTLSAPE;LDKANLLTLSAPEM;DKANLLTLSAPEMT;KANLLTLSAPEMTV;ANLLTLSAPEMTVL;NLLTLSAPEMTVLV;LLTLSAPEMTVLVG;LTLSAPEMTVLVGG;TLSAPEMTVLVGGL;LSAPEMTVLVGGLR;SAPEMTVLVGGLRV;APEMTVLVGGLRVL;PEMTVLVGGLRVLG;EMTVLVGGLRVLGA;MTVLVGGLRVLGAN;TVLVGGLRVLGANY;VLVGGLRVLGANYK;LVGGLRVLGANYKR;VGGLRVLGANYKRL;GGLRVLGANYKRLP;GLRVLGANYKRLPL;LRVLGANYKRLPLG;RVLGANYKRLPLGV;VLGANYKRLPLGVF;LGANYKRLPLGVFT;GANYKRLPLGVFTE;ANYKRLPLGVFTEA;NYKRLPLGVFTEAS;YKRLPLGVFTEASE;KRLPLGVFTEASES;RLPLGVFTEASESL;LPLGVFTEASESLT;PLGVFTEASESLTN;LGVFTEASESLTND;GVFTEASESLTNDF;VFTEASESLTNDFF;FTEASESLTNDFFV;TEASESLTNDFFVN;EASESLTNDFFVNL;ASESLTNDFFVNLL;SESLTNDFFVNLLD;ESLTNDFFVNLLDM;SLTNDFFVNLLDMG;LTNDFFVNLLDMGI;TNDFFVNLLDMGIT;NDFFVNLLDMGITW;DFFVNLLDMGITWE;FFVNLLDMGITWEP;FVNLLDMGITWEPS;VNLLDMGITWEPSP;NLLDMGITWEPSPA;LLDMGITWEPSPAD;LDMGITWEPSPADD;DMGITWEPSPADDG;MGITWEPSPADDGT;GITWEPSPADDGTY;ITWEPSPADDGTYQ;TWEPSPADDGTYQG;WEPSPADDGTYQGK;EPSPADDGTYQGKD;PSPADDGTYQGKDG;SPADDGTYQGKDGS;PADDGTYQGKDGSG;ADDGTYQGKDGSGK;DDGTYQGKDGSGKV;DGTYQGKDGSGKVK;GTYQGKDGSGKVKW;TYQGKDGSGKVKWT;YQGKDGSGKVKWTG;QGKDGSGKVKWTGS;GKDGSGKVKWTGSR;KDGSGKVKWTGSRV;DGSGKVKWTGSRVD;GSGKVKWTGSRVDL;SGKVKWTGSRVDLV;GKVKWTGSRVDLVF;KVKWTGSRVDLVFG;VKWTGSRVDLVFGS;KWTGSRVDLVFGSN;WTGSRVDLVFGSNS;TGSRVDLVFGSNSE;GSRVDLVFGSNSEL;SRVDLVFGSNSELR;RVDLVFGSNSELRA;VDLVFGSNSELRAL;DLVFGSNSELRALV;LVFGSNSELRALVE;VFGSNSELRALVEV;FGSNSELRALVEVY;GSNSELRALVEVYG;SNSELRALVEVYGA;NSELRALVEVYGAD;SELRALVEVYGADD;ELRALVEVYGADDA;LRALVEVYGADDAQ;RALVEVYGADDAQP;ALVEVYGADDAQPK;LVEVYGADDAQPKF;VEVYGADDAQPKFV;EVYGADDAQPKFVQ;VYGADDAQPKFVQD;YGADDAQPKFVQDF;GADDAQPKFVQDFV;ADDAQPKFVQDFVA;DDAQPKFVQDFVAA;DAQPKFVQDFVAAW;AQPKFVQDFVAAWD;QPKFVQDFVAAWDK;PKFVQDFVAAWDKV;KFVQDFVAAWDKVM;FVQDFVAAWDKVMN;VQDFVAAWDKVMNL;QDFVAAWDKVMNLD;DFVAAWDKVMNLDR;FVAAWDKVMNLDRF;VAAWDKVMNLDRFD;AAWDKVMNLDRFDV;AWDKVMNLDRFDVR;<br><br>15 mers:<br>MPEQHPPITETTTGA;PEQHPPITETTTGAA;EQHPPITETTTGAAS;QHPPITETTTGAASN;HPPITETTTGAASNG;PPITETTTGAASNGC;PITETTTGAASNGCP;ITETTTGAASNGCPV;TETTTGAASNGCPVV;ETTTGAASNGCPVVG;TTTGAASNGCPVVGH;TTGAASNGCPVVGHM;TGAASNGCPVVGHMK;GAASNGCPVVGHMKY;AASNGCPVVGHMKYP;ASNGCPVVGHMKYPV;SNGCPVVGHMKYPVE;NGCPVVGHMKYPVEG;GCPVVGHMKYPVEGG;CPVVGHMKYPVEGGG;PVVGHMKYPVEGGGN;VVGHMKYPVEGGGNQ;VGHMKYPVEGGGNQD;GHMKYPVEGGGNQDW;HMKYPVEGGGNQDWW;MKYPVEGGGNQDWWP;KYPVEGGGNQDWWPN;YPVEGGGNQDWWPNR;PVEGGGNQDWWPNRL;VEGGGNQDWWPNRLN;EGGGNQDWWPNRLNL;GGGNQDWWPNRLNLK;GGNQDWWPNRLNLKV;GNQDWWPNRLNLKVL;NQDWWPNRLNLKVLH;QDWWPNRLNLKVLHQ;DWWPNRLNLKVLHQN;WWPNRLNLKVLHQNP;WPNRLNLKVLHQNPA;PNRLNLKVLHQNPAV;NRLNLKVLHQNPAVA;RLNLKVLHQNPAVAD;LNLKVLHQNPAVADP;NLKVLHQNPAVA | |

Fig. 30 continued

| | | |
|---|---|---|
| | DPM;LKVLHQNPAVADPMG;KVLHQNPAVADPMGA;VLHQNPAVADPMGAA;LHQNPAVADPMGAAF;HQNPAVADPMGAAFD;QNPAVADPMGAAFDY;NPAVADPMGAAFDYA;PAVADPMGAAFDYAA;AVADPMGAAFDYAAE;VADPMGAAFDYAAEV;ADPMGAAFDYAAEVA;DPMGAAFDYAAEVAT;PMGAAFDYAAEVATI;MGAAFDYAAEVATID;GAAFDYAAEVATIDV;AAFDYAAEVATIDVD;AFDYAAEVATIDVDA;FDYAAEVATIDVDAL;DYAAEVATIDVDALT;YAAEVATIDVDALTR;AAEVATIDVDALTRD;AEVATIDVDALTRDI;EVATIDVDALTRDIE;VATIDVDALTRDIEE;ATIDVDALTRDIEEV;TIDVDALTRDIEEVM;IDVDALTRDIEEVMT;DVDALTRDIEEVMTT;VDALTRDIEEVMTTS;DALTRDIEEVMTTSQ;ALTRDIEEVMTTSQP;LTRDIEEVMTTSQPW;TRDIEEVMTTSQPWW;RDIEEVMTTSQPWWP;DIEEVMTTSQPWWPA;IEEVMTTSQPWWPAD;EEVMTTSQPWWPADY;EVMTTSQPWWPADYG;VMTTSQPWWPADYGH;MTTSQPWWPADYGHY;TTSQPWWPADYGHYG;TSQPWWPADYGHYGP;SQPWWPADYGHYGPL;QPWWPADYGHYGPLF;PWWPADYGHYGPLFI;WWPADYGHYGPLFIR;WPADYGHYGPLFIRM;PADYGHYGPLFIRMA;ADYGHYGPLFIRMAW;DYGHYGPLFIRMAWH;YGHYGPLFIRMAWHA;GHYGPLFIRMAWHAA;HYGPLFIRMAWHAAG;YGPLFIRMAWHAAGT;GPLFIRMAWHAAGTY;PLFIRMAWHAAGTYR;LFIRMAWHAAGTYRI;FIRMAWHAAGTYRIH;IRMAWHAAGTYRIHD;RMAWHAAGTYRIHDG;MAWHAAGTYRIHDGR;AWHAAGTYRIHDGRG;WHAAGTYRIHDGRGG;HAAGTYRIHDGRGGA;AAGTYRIHDGRGGAG;AGTYRIHDGRGGAGG;GTYRIHDGRGGAGGG;TYRIHDGRGGAGGGM;YRIHDGRGGAGGGMQ;RIHDGRGGAGGGMQR;IHDGRGGAGGGMQRF;HDGRGGAGGGMQRFA;DGRGGAGGGMQRFAP;GRGGAGGGMQRFAPL;RGGAGGGMQRFAPLN;GGAGGGMQRFAPLNS;GAGGGMQRFAPLNSW;AGGGMQRFAPLNSWP;GGGMQRFAPLNSWPD;GGMQRFAPLNSWPDN;GMQRFAPLNSWPDNA;MQRFAPLNSWPDNAS;QRFAPLNSWPDNASL;RFAPLNSWPDNASLD;FAPLNSWPDNASLDK;APLNSWPDNASLDKA;PLNSWPDNASLDKAR;LNSWPDNASLDKARR;NSWPDNASLDKARRL;SWPDNASLDKARRLL;WPDNASLDKARRLLW;PDNASLDKARRLLWP;DNASLDKARRLLWPV;NASLDKARRLLWPVK;ASLDKARRLLWPVKK;SLDKARRLLWPVKKK;LDKARRLLWPVKKKY;DKARRLLWPVKKKYG;KARRLLWPVKKKYGK;ARRLLWPVKKKYGKK;RRLLWPVKKKYGKKL;RLLWPVKKKYGKKLS;LLWPVKKKYGKKLSW;LWPVKKKYGKKLSWA;WPVKKKYGKKLSWAD;PVKKKYGKKLSWADL;VKKKYGKKLSWADLI;KKKYGKKLSWADLIV;KKYGKKLSWADLIVF;KYGKKLSWADLIVFA;YGKKLSWADLIVFAG;GKKLSWADLIVFAGN;KKLSWADLIVFAGNC;KLSWADLIVFAGNCA;LSWADLIVFAGNCAL;SWADLIVFAGNCALE;WADLIVFAGNCALES;ADLIVFAGNCALESM;DLIVFAGNCALESMG;LIVFAGNCALESMGF;IVFAGNCALESMGFK;VFAGNCALESMGFKT;FAGNCALESMGFKTF;AGNCALESMGFKTFG;GNCALESMGFKTFGF;NCALESMGFKTFGFG;CALESMGFKTFGFGF;ALESMGFKTFGFGFG;LESMGFKTFGFGFGR;ESMGFKTFGFGFGRV;SMGFKTFGFGFGRVD;MGFKTFGFGFGRVDQ;GFKTFGFGFGRVDQW;FKTFGFGFGRVDQWE;KTFGFGFGRVDQWEP;TFGFGFGRVDQWEPD;FGFGFGRVDQWEPDE;GFGFGRVDQWEPDEV;FGFGRVDQWEPDEVY;GFGRVDQWEPDEVYW;FGRVDQWEPDEVYWG;GRVDQWEPDEVYWGK;RVDQWEPDEVYWGKE;VDQWEPDEVYWGKEA;DQWEPDEVYWGKEAT;QWEPDEVYWGKEATW;WEPDEVYWGKEATWL;EPDEVYWGKEATWLG;PDEVYWGKEATWLGD;DEVYWGKEATWLGDE;EVYWGKEATWLGDER;VYWGKEATWLGDERY;YWGKEATWLGDERYS;WGKEATWLGDERYSG;GKEATWLGDERYSGK;KEATWLGDERYSGKR;EATWLGDERYSGKRD;ATWLGDERYSGKRDL;TWLGDERYSGKRDLE;WLGDERYSGKRDLEN;LGDERYSGKRDLENP;GDERYSGKRDLENPL;DERYSGKRDLENPLA;ERYSGKRDLENPLAA;RYSGKRDLENPLAAV;YSGKRDLENPLAAVQ;SGKRDLENPLAAVQM;GKRDLENPLAAVQMG;KR | |

Fig. 30 continued

| | | |
|---|---|---|
| | DLENPLAAVQMGL;RDLENPLAAVQMGLI;DLENPLAAVQMGLIY;LENPLAAVQMGLIYV;ENPLAAVQMGLIYVN;NPLAAVQMGLIYVNP;PLAAVQMGLIYVNPE;LAAVQMGLIYVNPEG;AAVQMGLIYVNPEGP;AVQMGLIYVNPEGPN;VQMGLIYVNPEGPNG;QMGLIYVNPEGPNGN;MGLIYVNPEGPNGNP;GLIYVNPEGPNGNPD;LIYVNPEGPNGNPDP;IYVNPEGPNGNPDPM;YVNPEGPNGNPDPMA;VNPEGPNGNPDPMAA;NPEGPNGNPDPMAAA;PEGPNGNPDPMAAAV;EGPNGNPDPMAAAVD;GPNGNPDPMAAAVDI;PNGNPDPMAAAVDIR;NGNPDPMAAAVDIRE;GNPDPMAAAVDIRET;NPDPMAAAVDIRETF;PDPMAAAVDIRETFR;DPMAAAVDIRETFRR;PMAAAVDIRETFRRM;MAAAVDIRETFRRMA;AAAVDIRETFRRMAM;AAVDIRETFRRMAMN;AVDIRETFRRMAMND;VDIRETFRRMAMNDV;DIRETFRRMAMNDVE;IRETFRRMAMNDVET;RETFRRMAMNDVETA;ETFRRMAMNDVETAA;TFRRMAMNDVETAAL;FRRMAMNDVETAALI;RRMAMNDVETAALIV;RMAMNDVETAALIVG;MAMNDVETAALIVGG;AMNDVETAALIVGGH;MNDVETAALIVGGHT;NDVETAALIVGGHTF;DVETAALIVGGHTFG;VETAALIVGGHTFGK;ETAALIVGGHTFGKT;TAALIVGGHTFGKTH;AALIVGGHTFGKTHG;ALIVGGHTFGKTHGA;LIVGGHTFGKTHGAG;IVGGHTFGKTHGAGP;VGGHTFGKTHGAGPA;GGHTFGKTHGAGPAD;GHTFGKTHGAGPADL;HTFGKTHGAGPADLV;TFGKTHGAGPADLVG;FGKTHGAGPADLVGP;GKTHGAGPADLVGPE;KTHGAGPADLVGPEP;THGAGPADLVGPEPE;HGAGPADLVGPEPEA;GAGPADLVGPEPEAA;AGPADLVGPEPEAAP;GPADLVGPEPEAAPL;PADLVGPEPEAAPLE;ADLVGPEPEAAPLEQ;DLVGPEPEAAPLEQM;LVGPEPEAAPLEQMG;VGPEPEAAPLEQMGL;GPEPEAAPLEQMGLG;PEPEAAPLEQMGLGW;EPEAAPLEQMGLGWK;PEAAPLEQMGLGWKS;EAAPLEQMGLGWKSS;AAPLEQMGLGWKSSY;APLEQMGLGWKSSYG;PLEQMGLGWKSSYGT;LEQMGLGWKSSYGTG;EQMGLGWKSSYGTGT;QMGLGWKSSYGTGTG;MGLGWKSSYGTGTGK;GLGWKSSYGTGTGKD;LGWKSSYGTGTGKDA;GWKSSYGTGTGKDAI;WKSSYGTGTGKDAIT;KSSYGTGTGKDAITS;SSYGTGTGKDAITSG;SYGTGTGKDAITSGI;YGTGTGKDAITSGIE;GTGTGKDAITSGIEV;TGTGKDAITSGIEVV;GTGKDAITSGIEVVW;TGKDAITSGIEVVWT;GKDAITSGIEVVWTN;KDAITSGIEVVWTNT;DAITSGIEVVWTNTP;AITSGIEVVWTNTPT;ITSGIEVVWTNTPTK;TSGIEVVWTNTPTKW;SGIEVVWTNTPTKWD;GIEVVWTNTPTKWDN;IEVVWTNTPTKWDNS;EVVWTNTPTKWDNSF;VVWTNTPTKWDNSFL;VWTNTPTKWDNSFLE;WTNTPTKWDNSFLEI;TNTPTKWDNSFLEIL;NTPTKWDNSFLEILY;TPTKWDNSFLEILYG;PTKWDNSFLEILYGY;TKWDNSFLEILYGYE;KWDNSFLEILYGYEW;WDNSFLEILYGYEWE;DNSFLEILYGYEWEL;NSFLEILYGYEWELT;SFLEILYGYEWELTK;FLEILYGYEWELTKS;LEILYGYEWELTKSP;EILYGYEWELTKSPA;ILYGYEWELTKSPAG;LYGYEWELTKSPAGA;YGYEWELTKSPAGAW;GYEWELTKSPAGAWQ;YEWELTKSPAGAWQY;EWELTKSPAGAWQYT;WELTKSPAGAWQYTA;ELTKSPAGAWQYTAK;LTKSPAGAWQYTAKD;TKSPAGAWQYTAKDG;KSPAGAWQYTAKDGA;SPAGAWQYTAKDGAG;PAGAWQYTAKDGAGA;AGAWQYTAKDGAGAG;GAWQYTAKDGAGAGT;AWQYTAKDGAGAGTI;WQYTAKDGAGAGTIP;QYTAKDGAGAGTIPD;YTAKDGAGAGTIPDP;TAKDGAGAGTIPDPF;AKDGAGAGTIPDPFG;KDGAGAGTIPDPFGG;DGAGAGTIPDPFGGP;GAGAGTIPDPFGGPG;AGAGTIPDPFGGPGR;GAGTIPDPFGGPGRS;AGTIPDPFGGPGRSP;GTIPDPFGGPGRSPT;TIPDPFGGPGRSPTM;IPDPFGGPGRSPTML;PDPFGGPGRSPTMLA;DPFGGPGRSPTMLAT;PFGGPGRSPTMLATD;FGGPGRSPTMLATDL;GGPGRSPTMLATDLS;GPGRSPTMLATDLSL;PGRSPTMLATDLSLR;GRSPTMLATDLSLRV;RSPTMLATDLSLRVD;SPTMLATDLSLRVDP;PTMLATDLSLRVDPI;TMLATDLSLRVDPIY;MLATDLSLRVDPIYE;LATDLSLRVDPIYER;ATDLSLRVDPIYERI;TDLSLRVDPIYERIT;DLSLRVDPIYERITR;LSLRVDPIYERITRR;SLRVDPIYERITRRW;LRVDPIYERITRRWL;RVDPIY | |

Fig. 30 continued

| | | |
|---|---|---|
| | ERITRRWLE;VDPIYERITRRWLEH;DPIYERITRRWLEHP;PIYERITRRWLE HPE;IYERITRRWLEHPEE;YERITRRWLEHPEEL;ERITRRWLEHPEELA;RIT RRWLEHPEELAD;ITRRWLEHPEELADE;TRRWLEHPEELADEF;RRWLEH PEELADEFA;RWLEHPEELADEFAK;WLEHPEELADEFAKA;LEHPEELADE FAKAW;EHPEELADEFAKAWY;HPEELADEFAKAWYK;PEELADEFAKAWY KL;EELADEFAKAWYKLI;ELADEFAKAWYKLIH;LADEFAKAWYKLIHR;ADE FAKAWYKLIHRD;DEFAKAWYKLIHRDM;EFAKAWYKLIHRDMG;FAKAWYK LIHRDMGP;AKAWYKLIHRDMGPV;KAWYKLIHRDMGPVA;AWYKLIHRDM GPVAR;WYKLIHRDMGPVARY;YKLIHRDMGPVARYL;KLIHRDMGPVARYL G;LIHRDMGPVARYLGP;IHRDMGPVARYLGPL;HRDMGPVARYLGPLV;RD MGPVARYLGPLVP;DMGPVARYLGPLVPK;MGPVARYLGPLVPKQ;GPVAR YLGPLVPKQT;PVARYLGPLVPKQTL;VARYLGPLVPKQTLL;ARYLGPLVPK QTLLW;RYLGPLVPKQTLLWQ;YLGPLVPKQTLLWQD;LGPLVPKQTLLWQ DP;GPLVPKQTLLWQDPV;PLVPKQTLLWQDPVP;LVPKQTLLWQDPVPA;V PKQTLLWQDPVPAV;PKQTLLWQDPVPAVS;KQTLLWQDPVPAVSH;QTLL WQDPVPAVSHD;TLLWQDPVPAVSHDL;LLWQDPVPAVSHDLV;LWQDPV PAVSHDLVG;WQDPVPAVSHDLVGE;QDPVPAVSHDLVGEA;DPVPAVSHD LVGEAE;PVPAVSHDLVGEAEI;VPAVSHDLVGEAEIA;PAVSHDLVGEAEIAS ;AVSHDLVGEAEIASL;VSHDLVGEAEIASLK;SHDLVGEAEIASLKS;HDLVG EAEIASLKSQ;DLVGEAEIASLKSQI;LVGEAEIASLKSQIR;VGEAEIASLKSQI RA;GEAEIASLKSQIRAS;EAEIASLKSQIRASG;AEIASLKSQIRASGL;EIASL KSQIRASGLT;IASLKSQIRASGLTV;ASLKSQIRASGLTVS;SLKSQIRASGLT VSQ;LKSQIRASGLTVSQL;KSQIRASGLTVSQLV;SQIRASGLTVSQLVS;QI RASGLTVSQLVST;IRASGLTVSQLVSTA;RASGLTVSQLVSTAW;ASGLTVS QLVSTAWA;SGLTVSQLVSTAWAA;GLTVSQLVSTAWAAA;LTVSQLVSTA WAAAS;TVSQLVSTAWAAASS;VSQLVSTAWAAASSF;SQLVSTAWAAASS FR;QLVSTAWAAASSFRG;LVSTAWAAASSFRGS;VSTAWAAASSFRGSD; STAWAAASSFRGSDK;TAWAAASSFRGSDKR;AWAAASSFRGSDKRG;WA AASSFRGSDKRGG;AAASSFRGSDKRGGA;AASSFRGSDKRGGAN;ASSF RGSDKRGGANG;SSFRGSDKRGGANGG;SFRGSDKRGGANGGR;FRGSD KRGGANGGRI;RGSDKRGGANGGRIR;GSDKRGGANGGRIRL;SDKRGGA NGGRIRLQ;DKRGGANGGRIRLQP;KRGGANGGRIRLQPQ;RGGANGGRIR LQPQV;GGANGGRIRLQPQVG;GANGGRIRLQPQVGW;ANGGRIRLQPQV GWE;NGGRIRLQPQVGWEV;GGRIRLQPQVGWEVN;GRIRLQPQVGWEVN D;RIRLQPQVGWEVNDP;IRLQPQVGWEVNDPD;RLQPQVGWEVNDPDG;L QPQVGWEVNDPDGD;QPQVGWEVNDPDGDL;PQVGWEVNDPDGDLR;Q VGWEVNDPDGDLRK;VGWEVNDPDGDLRKV;GWEVNDPDGDLRKVI;WE VNDPDGDLRKVIR;EVNDPDGDLRKVIRT;VNDPDGDLRKVIRTL;NDPDGDL RKVIRTLE;DPDGDLRKVIRTLEE;PDGDLRKVIRTLEEI;DGDLRKVIRTLEEI Q;GDLRKVIRTLEEIQE;DLRKVIRTLEEIQES;LRKVIRTLEEIQESF;RKVIRTL EEIQESFN;KVIRTLEEIQESFNS;VIRTLEEIQESFNSA;IRTLEEIQESFNSAA; RTLEEIQESFNSAAP;TLEEIQESFNSAAPG;LEEIQESFNSAAPGN;EEIQES FNSAAPGNI;EIQESFNSAAPGNIK;IQESFNSAAPGNIKV;QESFNSAAPGNI KVS;ESFNSAAPGNIKVSF;SFNSAAPGNIKVSFA;FNSAAPGNIKVSFAD;NS AAPGNIKVSFADL;SAAPGNIKVSFADLV;AAPGNIKVSFADLVV;APGNIKVS FADLVVL;PGNIKVSFADLVVLG;GNIKVSFADLVVLGG;NIKVSFADLVVLGG C;IKVSFADLVVLGGCA;KVSFADLVVLGGCAA;VSFADLVVLGGCAAI;SFAD LVVLGGCAAIE;FADLVVLGGCAAIEK;ADLVVLGGCAAIEKA;DLVVLGGCAA IEKAA;LVVLGGCAAIEKAAK;VVLGGCAAIEKAAKA;VLGGCAAIEKAAKAA;L GGCAAIEKAAKAAG;GGCAAIEKAAKAAGH;GCAAIEKAAKAAGHN;CAAIEK AAKAAGHNI;AAIEKAAKAAGHNIT;AIEKAAKAAGHNITV;IEKAAKAAGHNIT VP;EKAAKAAGHNITVPF;KAAKAAGHNITVPFT;AAKAAGHNITVPFTP;AKA AGHNITVPFTPG;KAAGHNITVPFTPGR;AAGHNITVPFTPGRT;AGHNITVPF | |

Fig. 30 continued

| | | |
|---|---|---|
| | TPGRTD;GHNITVPFTPGRTDA;HNITVPFTPGRTDAS;NITVPFTPGRTDASQ;ITVPFTPGRTDASQE;TVPFTPGRTDASQEQ;VPFTPGRTDASQEQT;PFTPGRTDASQEQTD;FTPGRTDASQEQTDV;TPGRTDASQEQTDVE;PGRTDASQEQTDVES;GRTDASQEQTDVESF;RTDASQEQTDVESFA;TDASQEQTDVESFAV;DASQEQTDVESFAVL;ASQEQTDVESFAVLE;SQEQTDVESFAVLEP;QEQTDVESFAVLEPK;EQTDVESFAVLEPKA;QTDVESFAVLEPKAD;TDVESFAVLEPKADG;DVESFAVLEPKADGF;VESFAVLEPKADGFR;ESFAVLEPKADGFRN;SFAVLEPKADGFRNY;FAVLEPKADGFRNYL;AVLEPKADGFRNYLG;VLEPKADGFRNYLGK;LEPKADGFRNYLGKG;EPKADGFRNYLGKGN;PKADGFRNYLGKGNP;KADGFRNYLGKGNPL;ADGFRNYLGKGNPLP;DGFRNYLGKGNPLPA;GFRNYLGKGNPLPAE;FRNYLGKGNPLPAEY;RNYLGKGNPLPAEYM;NYLGKGNPLPAEYML;YLGKGNPLPAEYMLL;LGKGNPLPAEYMLLD;GKGNPLPAEYMLLDK;KGNPLPAEYMLLDKA;GNPLPAEYMLLDKAN;NPLPAEYMLLDKANL;PLPAEYMLLDKANLL;LPAEYMLLDKANLLT;PAEYMLLDKANLLTL;AEYMLLDKANLLTLS;EYMLLDKANLLTLSA;YMLLDKANLLTLSAP;MLLDKANLLTLSAPE;LLDKANLLTLSAPEM;LDKANLLTLSAPEMT;DKANLLTLSAPEMTV;KANLLTLSAPEMTVL;ANLLTLSAPEMTVLV;NLLTLSAPEMTVLVG;LLTLSAPEMTVLVGG;LTLSAPEMTVLVGGL;TLSAPEMTVLVGGLR;LSAPEMTVLVGGLRV;SAPEMTVLVGGLRVL;APEMTVLVGGLRVLG;PEMTVLVGGLRVLGA;EMTVLVGGLRVLGAN;MTVLVGGLRVLGANY;TVLVGGLRVLGANYK;VLVGGLRVLGANYKR;LVGGLRVLGANYKRL;VGGLRVLGANYKRLP;GGLRVLGANYKRLPL;GLRVLGANYKRLPLG;LRVLGANYKRLPLGV;RVLGANYKRLPLGVF;VLGANYKRLPLGVFT;LGANYKRLPLGVFTE;GANYKRLPLGVFTEA;ANYKRLPLGVFTEAS;NYKRLPLGVFTEASE;YKRLPLGVFTEASES;KRLPLGVFTEASESL;RLPLGVFTEASESLT;LPLGVFTEASESLTN;PLGVFTEASESLTND;LGVFTEASESLTNDF;GVFTEASESLTNDFF;VFTEASESLTNDFFV;FTEASESLTNDFFVN;TEASESLTNDFFVNL;EASESLTNDFFVNLL;ASESLTNDFFVNLLD;SESLTNDFFVNLLDM;ESLTNDFFVNLLDMG;SLTNDFFVNLLDMGI;LTNDFFVNLLDMGIT;TNDFFVNLLDMGITW;NDFFVNLLDMGITWE;DFFVNLLDMGITWEP;FFVNLLDMGITWEPS;FVNLLDMGITWEPSP;VNLLDMGITWEPSPA;NLLDMGITWEPSPAD;LLDMGITWEPSPADD;LDMGITWEPSPADDG;DMGITWEPSPADDGT;MGITWEPSPADDGTY;GITWEPSPADDGTYQ;ITWEPSPADDGTYQG;TWEPSPADDGTYQGK;WEPSPADDGTYQGKD;EPSPADDGTYQGKDG;PSPADDGTYQGKDGS;SPADDGTYQGKDGSG;PADDGTYQGKDGSGK;ADDGTYQGKDGSGKV;DDGTYQGKDGSGKVK;DGTYQGKDGSGKVKW;GTYQGKDGSGKVKWT;TYQGKDGSGKVKWTG;YQGKDGSGKVKWTGS;QGKDGSGKVKWTGSR;GKDGSGKVKWTGSRV;KDGSGKVKWTGSRVD;DGSGKVKWTGSRVDL;GSGKVKWTGSRVDLV;SGKVKWTGSRVDLVF;GKVKWTGSRVDLVFG;KVKWTGSRVDLVFGS;VKWTGSRVDLVFGSN;KWTGSRVDLVFGSNS;WTGSRVDLVFGSNSE;TGSRVDLVFGSNSEL;GSRVDLVFGSNSELR;SRVDLVFGSNSELRA;RVDLVFGSNSELRAL;VDLVFGSNSELRALV;DLVFGSNSELRALVE;LVFGSNSELRALVEV;VFGSNSELRALVEVY;FGSNSELRALVEVYG;GSNSELRALVEVYGA;SNSELRALVEVYGAD;NSELRALVEVYGADD;SELRALVEVYGADDA;ELRALVEVYGADDAQ;LRALVEVYGADDAQP;RALVEVYGADDAQPK;ALVEVYGADDAQPKF;LVEVYGADDAQPKFV;VEVYGADDAQPKFVQ;EVYGADDAQPKFVQD;VYGADDAQPKFVQDF;YGADDAQPKFVQDFV;GADDAQPKFVQDFVA;ADDAQPKFVQDFVAA;DDAQPKFVQDFVAAW;DAQPKFVQDFVAAWD;AQPKFVQDFVAAWDK;QPKFVQDFVAAWDKV;PKFVQDFVAAWDKVM;KFVQDFVAAWDKVMN;FVQDFVAAWDKVMNL;VQDFVAAWDKVMNLD;QDFVAAWDKVMNLDR;DFVAAWDKVMNLDRF;FVAAWDKVMNLDRFD;VAAWDKVMNLDRFDV;AAWDKVMNLDRFDVR; | |

Fig. 30 continued

| | | |
|---|---|---|
| | 16 mers:<br>MPEQHPPITETTTGAA;PEQHPPITETTTGAAS;EQHPPITETTTGAASN;QHPPITETTTGAASNG;HPPITETTTGAASNGC;PPITETTTGAASNGCP;PITETTTGAASNGCPV;ITETTTGAASNGCPVV;TETTTGAASNGCPVVG;ETTTGAASNGCPVVGH;TTTGAASNGCPVVGHM;TTGAASNGCPVVGHMK;TGAASNGCPVVGHMKY;GAASNGCPVVGHMKYP;AASNGCPVVGHMKYPV;ASNGCPVVGHMKYPVE;SNGCPVVGHMKYPVEG;NGCPVVGHMKYPVEGG;GCPVVGHMKYPVEGGG;CPVVGHMKYPVEGGGN;PVVGHMKYPVEGGGNQ;VVGHMKYPVEGGGNQD;VGHMKYPVEGGGNQDW;GHMKYPVEGGGNQDWW;HMKYPVEGGGNQDWWP;MKYPVEGGGNQDWWPN;KYPVEGGGNQDWWPNR;YPVEGGGNQDWWPNRL;PVEGGGNQDWWPNRLN;VEGGGNQDWWPNRLNL;EGGGNQDWWPNRLNLK;GGGNQDWWPNRLNLKV;GGNQDWWPNRLNLKVL;GNQDWWPNRLNLKVLH;NQDWWPNRLNLKVLHQ;QDWWPNRLNLKVLHQN;DWWPNRLNLKVLHQNP;WWPNRLNLKVLHQNPA;WPNRLNLKVLHQNPAV;PNRLNLKVLHQNPAVA;NRLNLKVLHQNPAVAD;RLNLKVLHQNPAVADP;LNLKVLHQNPAVADPM;NLKVLHQNPAVADPMG;LKVLHQNPAVADPMGA;KVLHQNPAVADPMGAA;VLHQNPAVADPMGAAF;LHQNPAVADPMGAAFD;HQNPAVADPMGAAFDY;QNPAVADPMGAAFDYA;NPAVADPMGAAFDYAA;PAVADPMGAAFDYAAE;AVADPMGAAFDYAAEV;VADPMGAAFDYAAEVA;ADPMGAAFDYAAEVAT;DPMGAAFDYAAEVATI;PMGAAFDYAAEVATID;MGAAFDYAAEVATIDV;GAAFDYAAEVATIDVD;AAFDYAAEVATIDVDA;AFDYAAEVATIDVDAL;FDYAAEVATIDVDALT;DYAAEVATIDVDALTR;YAAEVATIDVDALTRD;AAEVATIDVDALTRDI;AEVATIDVDALTRDIE;EVATIDVDALTRDIEE;VATIDVDALTRDIEEV;ATIDVDALTRDIEEVM;TIDVDALTRDIEEVMT;IDVDALTRDIEEVMTT;DVDALTRDIEEVMTTS;VDALTRDIEEVMTTSQ;DALTRDIEEVMTTSQP;ALTRDIEEVMTTSQPW;LTRDIEEVMTTSQPWW;TRDIEEVMTTSQPWWP;RDIEEVMTTSQPWWPA;DIEEVMTTSQPWWPAD;IEEVMTTSQPWWPADY;EEVMTTSQPWWPADYG;EVMTTSQPWWPADYGH;VMTTSQPWWPADYGHY;MTTSQPWWPADYGHYG;TTSQPWWPADYGHYGP;TSQPWWPADYGHYGPL;SQPWWPADYGHYGPLF;QPWWPADYGHYGPLFI;PWWPADYGHYGPLFIR;WWPADYGHYGPLFIRM;WPADYGHYGPLFIRMA;PADYGHYGPLFIRMAW;ADYGHYGPLFIRMAWH;DYGHYGPLFIRMAWHA;YGHYGPLFIRMAWHAA;GHYGPLFIRMAWHAAG;HYGPLFIRMAWHAAGT;YGPLFIRMAWHAAGTY;GPLFIRMAWHAAGTYR;PLFIRMAWHAAGTYRI;LFIRMAWHAAGTYRIH;FIRMAWHAAGTYRIHD;IRMAWHAAGTYRIHDG;RMAWHAAGTYRIHDGR;MAWHAAGTYRIHDGRG;AWHAAGTYRIHDGRGG;WHAAGTYRIHDGRGGA;HAAGTYRIHDGRGGAG;AAGTYRIHDGRGGAGG;AGTYRIHDGRGGAGGG;GTYRIHDGRGGAGGGM;TYRIHDGRGGAGGGMQ;YRIHDGRGGAGGGMQR;RIHDGRGGAGGGMQRF;IHDGRGGAGGGMQRFA;HDGRGGAGGGMQRFAP;DGRGGAGGGMQRFAPL;GRGGAGGGMQRFAPLN;RGGAGGGMQRFAPLNS;GGAGGGMQRFAPLNSW;GAGGGMQRFAPLNSWP;AGGGMQRFAPLNSWPD;GGGMQRFAPLNSWPDN;GGMQRFAPLNSWPDNA;GMQRFAPLNSWPDNAS;MQRFAPLNSWPDNASL;QRFAPLNSWPDNASLD;RFAPLNSWPDNASLDK;FAPLNSWPDNASLDKA;APLNSWPDNASLDKAR;PLNSWPDNASLDKARR;LNSWPDNASLDKARRL;NSWPDNASLDKARRLL;SWPDNASLDKARRLLW;WPDNASLDKARRLLWP;PDNASLDKARRLLWPV;DNASLDKARRLLWPVK;NASLDKARRLLWPVKK;ASLDKARRLLWPVKKK;SLDKARRLLWPVKKKY;LDKARRLLWPVKKKYG;DKARRLLWPVKKKYGK;KARRLLWPVKKKYGKK;ARRLLWPVKKKYGKKL;RRLLWPVKKKYGKKLS;RLLWPVKKKYGKKLSW;LLWPVKKKYGKKLSWA;LWPVKKKYGKKLSWAD;WPVKKKYGKKLSWADL;PVKKKYGKKLSWADLI;VKKKYGKKLSWADLIV;KKKYGKKLSWADLIVF;KKYGKKLSWADLIVFA;KYGKKLSWADLIVFAG;YGKKLSWADLIVFAG | |

Fig. 30 continued

| | | |
|---|---|---|
| | N;GKKLSWADLIVFAGNC;KKLSWADLIVFAGNCA;KLSWADLIVFAGNCAL;LSWADLIVFAGNCALE;SWADLIVFAGNCALES;WADLIVFAGNCALESM;ADLIVFAGNCALESMG;DLIVFAGNCALESMGF;LIVFAGNCALESMGFK;IVFAGNCALESMGFKT;VFAGNCALESMGFKTF;FAGNCALESMGFKTFG;AGNCALESMGFKTFGF;GNCALESMGFKTFGFG;NCALESMGFKTFGFGF;CALESMGFKTFGFGFG;ALESMGFKTFGFGFGR;LESMGFKTFGFGFGRV;ESMGFKTFGFGFGRVD;SMGFKTFGFGFGRVDQ;MGFKTFGFGFGRVDQW;GFKTFGFGFGRVDQWE;FKTFGFGFGRVDQWEP;KTFGFGFGRVDQWEPD;TFGFGFGRVDQWEPDE;FGFGFGRVDQWEPDEV;GFGFGRVDQWEPDEVY;FGFGRVDQWEPDEVYW;GFGRVDQWEPDEVYWG;FGRVDQWEPDEVYWGK;GRVDQWEPDEVYWGKE;RVDQWEPDEVYWGKEA;VDQWEPDEVYWGKEAT;DQWEPDEVYWGKEATW;QWEPDEVYWGKEATWL;WEPDEVYWGKEATWLG;EPDEVYWGKEATWLGD;PDEVYWGKEATWLGDE;DEVYWGKEATWLGDER;EVYWGKEATWLGDERY;VYWGKEATWLGDERYS;YWGKEATWLGDERYSG;WGKEATWLGDERYSGK;GKEATWLGDERYSGKR;KEATWLGDERYSGKRD;EATWLGDERYSGKRDL;ATWLGDERYSGKRDLE;TWLGDERYSGKRDLEN;WLGDERYSGKRDLENP;LGDERYSGKRDLENPL;GDERYSGKRDLENPLA;DERYSGKRDLENPLAA;ERYSGKRDLENPLAAV;RYSGKRDLENPLAAVQ;YSGKRDLENPLAAVQM;SGKRDLENPLAAVQMG;GKRDLENPLAAVQMGL;KRDLENPLAAVQMGLI;RDLENPLAAVQMGLIY;DLENPLAAVQMGLIYV;LENPLAAVQMGLIYVN;ENPLAAVQMGLIYVNP;NPLAAVQMGLIYVNPE;PLAAVQMGLIYVNPEG;LAAVQMGLIYVNPEGP;AAVQMGLIYVNPEGPN;AVQMGLIYVNPEGPNG;VQMGLIYVNPEGPNGN;QMGLIYVNPEGPNGNP;MGLIYVNPEGPNGNPD;GLIYVNPEGPNGNPDP;LIYVNPEGPNGNPDPM;IYVNPEGPNGNPDPMA;YVNPEGPNGNPDPMAA;VNPEGPNGNPDPMAAA;NPEGPNGNPDPMAAAV;PEGPNGNPDPMAAAVD;EGPNGNPDPMAAAVDI;GPNGNPDPMAAAVDIR;PNGNPDPMAAAVDIRE;NGNPDPMAAAVDIRET;GNPDPMAAAVDIRETF;NPDPMAAAVDIRETFR;PDPMAAAVDIRETFRR;DPMAAAVDIRETFRRM;PMAAAVDIRETFRRMA;MAAAVDIRETFRRMAM;AAAVDIRETFRRMAMN;AAVDIRETFRRMAMND;AVDIRETFRRMAMNDV;VDIRETFRRMAMNDVE;DIRETFRRMAMNDVET;IRETFRRMAMNDVETA;RETFRRMAMNDVETAA;ETFRRMAMNDVETAAL;TFRRMAMNDVETAALI;FRRMAMNDVETAALIV;RRMAMNDVETAALIVG;RMAMNDVETAALIVGG;MAMNDVETAALIVGGH;AMNDVETAALIVGGHT;MNDVETAALIVGGHTF;NDVETAALIVGGHTFG;DVETAALIVGGHTFGK;VETAALIVGGHTFGKT;ETAALIVGGHTFGKTH;TAALIVGGHTFGKTHG;AALIVGGHTFGKTHGA;ALIVGGHTFGKTHGAG;LIVGGHTFGKTHGAGP;IVGGHTFGKTHGAGPA;VGGHTFGKTHGAGPAD;GGHTFGKTHGAGPADL;GHTFGKTHGAGPADLV;HTFGKTHGAGPADLVG;TFGKTHGAGPADLVGP;FGKTHGAGPADLVGPE;GKTHGAGPADLVGPEP;KTHGAGPADLVGPEPE;THGAGPADLVGPEPEA;HGAGPADLVGPEPEAA;GAGPADLVGPEPEAAP;AGPADLVGPEPEAAPL;GPADLVGPEPEAAPLE;PADLVGPEPEAAPLEQ;ADLVGPEPEAAPLEQM;DLVGPEPEAAPLEQMG;LVGPEPEAAPLEQMGL;VGPEPEAAPLEQMGLG;GPEPEAAPLEQMGLGW;PEPEAAPLEQMGLGWK;EPEAAPLEQMGLGWKS;PEAAPLEQMGLGWKSS;EAAPLEQMGLGWKSSY;AAPLEQMGLGWKSSYG;APLEQMGLGWKSSYGT;PLEQMGLGWKSSYGTG;LEQMGLGWKSSYGTGT;EQMGLGWKSSYGTGTG;QMGLGWKSSYGTGTGK;MGLGWKSSYGTGTGKD;GLGWKSSYGTGTGKDA;LGWKSSYGTGTGKDAI;GWKSSYGTGTGKDAIT;WKSSYGTGTGKDAITS;KSSYGTGTGKDAITSG;SSYGTGTGKDAITSGI;SYGTGTGKDAITSGIE;YGTGTGKDAITSGIEV;GTGTGKDAITSGIEVV;TGTGKDAITSGIEVVW;GTGKDAITSGIEVVWT;TGKDAITSGIEVVWTN;GKDAITSGIEVVWTNT;KDAITSGIEVVWTNTP;DAITSGIEVVWTNTPT;AITSGIEVVWTNTPTK;ITSGIEVVWTNTPTKW;TSGIEVVWTNTPTKWD;SGIE | |

Fig. 30 continued

| | | |
|---|---|---|
| | VVWTNTPTKWDN;GIEVVWTNTPTKWDNS;IEVVWTNTPTKWDNSF;EVVWTNTPTKWDNSFL;VVWTNTPTKWDNSFLE;VWTNTPTKWDNSFLEI;WTNTPTKWDNSFLEIL;TNTPTKWDNSFLEILY;NTPTKWDNSFLEILYG;TPTKWDNSFLEILYGY;PTKWDNSFLEILYGYE;TKWDNSFLEILYGYEW;KWDNSFLEILYGYEWE;WDNSFLEILYGYEWEL;DNSFLEILYGYEWELT;NSFLEILYGYEWELTK;SFLEILYGYEWELTKS;FLEILYGYEWELTKSP;LEILYGYEWELTKSPA;EILYGYEWELTKSPAG;ILYGYEWELTKSPAGA;LYGYEWELTKSPAGAW;YGYEWELTKSPAGAWQ;GYEWELTKSPAGAWQY;YEWELTKSPAGAWQYT;EWELTKSPAGAWQYTA;WELTKSPAGAWQYTAK;ELTKSPAGAWQYTAKD;LTKSPAGAWQYTAKDG;TKSPAGAWQYTAKDGA;KSPAGAWQYTAKDGAG;SPAGAWQYTAKDGAGA;PAGAWQYTAKDGAGAG;AGAWQYTAKDGAGAGT;GAWQYTAKDGAGAGTI;AWQYTAKDGAGAGTIP;WQYTAKDGAGAGTIPD;QYTAKDGAGAGTIPDP;YTAKDGAGAGTIPDPF;TAKDGAGAGTIPDPFG;AKDGAGAGTIPDPFGG;KDGAGAGTIPDPFGGP;DGAGAGTIPDPFGGPG;GAGAGTIPDPFGGPGR;AGAGTIPDPFGGPGRS;GAGTIPDPFGGPGRSP;AGTIPDPFGGPGRSPT;GTIPDPFGGPGRSPTM;TIPDPFGGPGRSPTML;IPDPFGGPGRSPTMLA;PDPFGGPGRSPTMLAT;DPFGGPGRSPTMLATD;PFGGPGRSPTMLATDL;FGGPGRSPTMLATDLS;GGPGRSPTMLATDLSL;GPGRSPTMLATDLSLR;PGRSPTMLATDLSLRV;GRSPTMLATDLSLRVD;RSPTMLATDLSLRVDP;SPTMLATDLSLRVDPI;PTMLATDLSLRVDPIY;TMLATDLSLRVDPIYE;MLATDLSLRVDPIYER;LATDLSLRVDPIYERI;ATDLSLRVDPIYERIT;TDLSLRVDPIYERITR;DLSLRVDPIYERITRR;LSLRVDPIYERITRRW;SLRVDPIYERITRRWL;LRVDPIYERITRRWLE;RVDPIYERITRRWLEH;VDPIYERITRRWLEHP;DPIYERITRRWLEHPE;PIYERITRRWLEHPEE;IYERITRRWLEHPEEL;YERITRRWLEHPEELA;ERITRRWLEHPEELAD;RITRRWLEHPEELADE;ITRRWLEHPEELADEF;TRRWLEHPEELADEFA;RRWLEHPEELADEFAK;RWLEHPEELADEFAKA;WLEHPEELADEFAKAW;LEHPEELADEFAKAWY;EHPEELADEFAKAWYK;HPEELADEFAKAWYKL;PEELADEFAKAWYKLI;EELADEFAKAWYKLIH;ELADEFAKAWYKLIHR;LADEFAKAWYKLIHRD;ADEFAKAWYKLIHRDM;DEFAKAWYKLIHRDMG;EFAKAWYKLIHRDMGP;FAKAWYKLIHRDMGPV;AKAWYKLIHRDMGPVA;KAWYKLIHRDMGPVAR;AWYKLIHRDMGPVARY;WYKLIHRDMGPVARYL;YKLIHRDMGPVARYLG;KLIHRDMGPVARYLGP;LIHRDMGPVARYLGPL;IHRDMGPVARYLGPLV;HRDMGPVARYLGPLVP;RDMGPVARYLGPLVPK;DMGPVARYLGPLVPKQ;MGPVARYLGPLVPKQT;GPVARYLGPLVPKQTL;PVARYLGPLVPKQTLL;VARYLGPLVPKQTLLW;ARYLGPLVPKQTLLWQ;RYLGPLVPKQTLLWQD;YLGPLVPKQTLLWQDP;LGPLVPKQTLLWQDPV;GPLVPKQTLLWQDPVP;PLVPKQTLLWQDPVPA;LVPKQTLLWQDPVPAV;VPKQTLLWQDPVPAVS;PKQTLLWQDPVPAVSH;KQTLLWQDPVPAVSHD;QTLLWQDPVPAVSHDL;TLLWQDPVPAVSHDLV;LLWQDPVPAVSHDLVG;LWQDPVPAVSHDLVGE;WQDPVPAVSHDLVGEA;QDPVPAVSHDLVGEAE;DPVPAVSHDLVGEAEI;PVPAVSHDLVGEAEIA;VPAVSHDLVGEAEIAS;PAVSHDLVGEAEIASL;AVSHDLVGEAEIASLK;VSHDLVGEAEIASLKS;SHDLVGEAEIASLKSQ;HDLVGEAEIASLKSQI;DLVGEAEIASLKSQIR;LVGEAEIASLKSQIRA;VGEAEIASLKSQIRAS;GEAEIASLKSQIRASG;EAEIASLKSQIRASGL;AEIASLKSQIRASGLT;EIASLKSQIRASGLTV;IASLKSQIRASGLTVS;ASLKSQIRASGLTVSQ;SLKSQIRASGLTVSQL;LKSQIRASGLTVSQLV;KSQIRASGLTVSQLVS;SQIRASGLTVSQLVST;QIRASGLTVSQLVSTA;IRASGLTVSQLVSTAW;RASGLTVSQLVSTAWA;ASGLTVSQLVSTAWAA;SGLTVSQLVSTAWAAA;GLTVSQLVSTAWAAAS;LTVSQLVSTAWAAASS;TVSQLVSTAWAAASSF;VSQLVSTAWAAASSFR;SQLVSTAWAAASSFRG;QLVSTAWAAASSFRGS;LVSTAWAAASSFRGSD;VSTAWAAASSFRGSDK;STAWAAASSFRGSDKR;TAWAAASSFRGSDKRG;AWAAASSFRGSDKRGG;WAAASSFRGSDKRGGA;AA | |

Fig. 30 continued

| | | |
|---|---|---|
| | ASSFRGSDKRGGAN;AASSFRGSDKRGGANG;ASSFRGSDKRGGANGG;SSFRGSDKRGGANGGR;SFRGSDKRGGANGGRI;FRGSDKRGGANGGRIR;RGSDKRGGANGGRIRL;GSDKRGGANGGRIRLQ;SDKRGGANGGRIRLQP;DKRGGANGGRIRLQPQ;KRGGANGGRIRLQPQV;RGGANGGRIRLQPQVG;GGANGGRIRLQPQVGW;GANGGRIRLQPQVGWE;ANGGRIRLQPQVGWEV;NGGRIRLQPQVGWEVN;GGRIRLQPQVGWEVND;GRIRLQPQVGWEVNDP;RIRLQPQVGWEVNDPD;IRLQPQVGWEVNDPDG;RLQPQVGWEVNDPDGD;LQPQVGWEVNDPDGDL;QPQVGWEVNDPDGDLR;PQVGWEVNDPDGDLRK;QVGWEVNDPDGDLRKV;VGWEVNDPDGDLRKVI;GWEVNDPDGDLRKVIR;WEVNDPDGDLRKVIRT;EVNDPDGDLRKVIRTL;VNDPDGDLRKVIRTLE;NDPDGDLRKVIRTLEE;DPDGDLRKVIRTLEEI;PDGDLRKVIRTLEEIQ;DGDLRKVIRTLEEIQE;GDLRKVIRTLEEIQES;DLRKVIRTLEEIQESF;LRKVIRTLEEIQESFN;RKVIRTLEEIQESFNS;KVIRTLEEIQESFNSA;VIRTLEEIQESFNSAA;IRTLEEIQESFNSAAP;RTLEEIQESFNSAAPG;TLEEIQESFNSAAPGN;LEEIQESFNSAAPGNI;EEIQESFNSAAPGNIK;EIQESFNSAAPGNIKV;IQESFNSAAPGNIKVS;QESFNSAAPGNIKVSF;ESFNSAAPGNIKVSFA;SFNSAAPGNIKVSFAD;FNSAAPGNIKVSFADL;NSAAPGNIKVSFADLV;SAAPGNIKVSFADLVV;AAPGNIKVSFADLVVL;APGNIKVSFADLVVLG;PGNIKVSFADLVVLGG;GNIKVSFADLVVLGGC;NIKVSFADLVVLGGCA;IKVSFADLVVLGGCAA;KVSFADLVVLGGCAAI;VSFADLVVLGGCAAIE;SFADLVVLGGCAAIEK;FADLVVLGGCAAIEKA;ADLVVLGGCAAIEKAA;DLVVLGGCAAIEKAAK;LVVLGGCAAIEKAAKA;VVLGGCAAIEKAAKAA;VLGGCAAIEKAAKAAG;LGGCAAIEKAAKAAGH;GGCAAIEKAAKAAGHN;GCAAIEKAAKAAGHNI;CAAIEKAAKAAGHNIT;AAIEKAAKAAGHNITV;AIEKAAKAAGHNITVP;IEKAAKAAGHNITVPF;EKAAKAAGHNITVPFT;KAAKAAGHNITVPFTP;AAKAAGHNITVPFTPG;AKAAGHNITVPFTPGR;KAAGHNITVPFTPGRT;AAGHNITVPFTPGRTD;AGHNITVPFTPGRTDA;GHNITVPFTPGRTDAS;HNITVPFTPGRTDASQ;NITVPFTPGRTDASQE;ITVPFTPGRTDASQEQ;TVPFTPGRTDASQEQT;VPFTPGRTDASQEQTD;PFTPGRTDASQEQTDV;FTPGRTDASQEQTDVE;TPGRTDASQEQTDVES;PGRTDASQEQTDVESF;GRTDASQEQTDVESFA;RTDASQEQTDVESFAV;TDASQEQTDVESFAVL;DASQEQTDVESFAVLE;ASQEQTDVESFAVLEP;SQEQTDVESFAVLEPK;QEQTDVESFAVLEPKA;EQTDVESFAVLEPKAD;QTDVESFAVLEPKADG;TDVESFAVLEPKADGF;DVESFAVLEPKADGFR;VESFAVLEPKADGFRN;ESFAVLEPKADGFRNY;SFAVLEPKADGFRNYL;FAVLEPKADGFRNYLG;AVLEPKADGFRNYLGK;VLEPKADGFRNYLGKG;LEPKADGFRNYLGKGN;EPKADGFRNYLGKGNP;PKADGFRNYLGKGNPL;KADGFRNYLGKGNPLP;ADGFRNYLGKGNPLPA;DGFRNYLGKGNPLPAE;GFRNYLGKGNPLPAEY;FRNYLGKGNPLPAEYM;RNYLGKGNPLPAEYML;NYLGKGNPLPAEYMLL;YLGKGNPLPAEYMLLD;LGKGNPLPAEYMLLDK;GKGNPLPAEYMLLDKA;KGNPLPAEYMLLDKAN;GNPLPAEYMLLDKANL;NPLPAEYMLLDKANLL;PLPAEYMLLDKANLLT;LPAEYMLLDKANLLTL;PAEYMLLDKANLLTLS;AEYMLLDKANLLTLSA;EYMLLDKANLLTLSAP;YMLLDKANLLTLSAPE;MLLDKANLLTLSAPEM;LLDKANLLTLSAPEMT;LDKANLLTLSAPEMTV;DKANLLTLSAPEMTVL;KANLLTLSAPEMTVLV;ANLLTLSAPEMTVLVG;NLLTLSAPEMTVLVGG;LLTLSAPEMTVLVGGL;LTLSAPEMTVLVGGLR;TLSAPEMTVLVGGLRV;LSAPEMTVLVGGLRVL;SAPEMTVLVGGLRVLG;APEMTVLVGGLRVLGA;PEMTVLVGGLRVLGAN;EMTVLVGGLRVLGANY;MTVLVGGLRVLGANYK;TVLVGGLRVLGANYKR;VLVGGLRVLGANYKRL;LVGGLRVLGANYKRLP;VGGLRVLGANYKRLPL;GGLRVLGANYKRLPLG;GLRVLGANYKRLPLGV;LRVLGANYKRLPLGVF;RVLGANYKRLPLGVFT;VLGANYKRLPLGVFTE;LGANYKRLPLGVFTEA;GANYKRLPLGVFTEAS;ANYKRLPLGVFTEASE;NYKRLPLGVFTEASES;YKRLPLGVFTEASESL;KRLPLGVFTEASESLT;RLPLGVFTEASESLTN;LPLGVFTEASESLTND; | |

Fig. 30 continued

| | | |
|---|---|---|
| | PLGVFTEASESLTNDF;LGVFTEASESLTNDFF;GVFTEASESLTNDFFV;VFTEASESLTNDFFVN;FTEASESLTNDFFVNL;TEASESLTNDFFVNLL;EASESLTNDFFVNLLD;ASESLTNDFFVNLLDM;SESLTNDFFVNLLDMG;ESLTNDFFVNLLDMGI;SLTNDFFVNLLDMGIT;LTNDFFVNLLDMGITW;TNDFFVNLLDMGITWE;NDFFVNLLDMGITWEP;DFFVNLLDMGITWEPS;FFVNLLDMGITWEPSP;FVNLLDMGITWEPSPA;VNLLDMGITWEPSPAD;NLLDMGITWEPSPADD;LLDMGITWEPSPADDG;LDMGITWEPSPADDGT;DMGITWEPSPADDGTY;MGITWEPSPADDGTYQ;GITWEPSPADDGTYQG;ITWEPSPADDGTYQGK;TWEPSPADDGTYQGKD;WEPSPADDGTYQGKDG;EPSPADDGTYQGKDGS;PSPADDGTYQGKDGSG;SPADDGTYQGKDGSGK;PADDGTYQGKDGSGKV;ADDGTYQGKDGSGKVK;DDGTYQGKDGSGKVKW;DGTYQGKDGSGKVKWT;GTYQGKDGSGKVKWTG;TYQGKDGSGKVKWTGS;YQGKDGSGKVKWTGSR;QGKDGSGKVKWTGSRV;GKDGSGKVKWTGSRVD;KDGSGKVKWTGSRVDL;DGSGKVKWTGSRVDLV;GSGKVKWTGSRVDLVF;SGKVKWTGSRVDLVFG;GKVKWTGSRVDLVFGS;KVKWTGSRVDLVFGSN;VKWTGSRVDLVFGSNS;KWTGSRVDLVFGSNSE;WTGSRVDLVFGSNSEL;TGSRVDLVFGSNSELR;GSRVDLVFGSNSELRA;SRVDLVFGSNSELRAL;RVDLVFGSNSELRALV;VDLVFGSNSELRALVE;DLVFGSNSELRALVEV;LVFGSNSELRALVEVY;VFGSNSELRALVEVYG;FGSNSELRALVEVYGA;GSNSELRALVEVYGAD;SNSELRALVEVYGADD;NSELRALVEVYGADDA;SELRALVEVYGADDAQ;ELRALVEVYGADDAQP;LRALVEVYGADDAQPK;RALVEVYGADDAQPKF;ALVEVYGADDAQPKFV;LVEVYGADDAQPKFVQ;VEVYGADDAQPKFVQD;EVYGADDAQPKFVQDF;VYGADDAQPKFVQDFV;YGADDAQPKFVQDFVA;GADDAQPKFVQDFVAA;ADDAQPKFVQDFVAAW;DDAQPKFVQDFVAAWD;DAQPKFVQDFVAAWDK;AQPKFVQDFVAAWDKV;QPKFVQDFVAAWDKVM;PKFVQDFVAAWDKVMN;KFVQDFVAAWDKVMNL;FVQDFVAAWDKVMNLD;VQDFVAAWDKVMNLDR;QDFVAAWDKVMNLDRF;DFVAAWDKVMNLDRFD;FVAAWDKVMNLDRFDV;VAAWDKVMNLDRFDVR | |
| 22 | **<NP_215690.1 low molecular weight T-cell antigen TB8.4 Rv1174c;Mycobacterium tuberculosis H37Rv>**<br>MRLSLTALSAGVGAVAMSLTVGAGVASADPVDAVINTTCNYGQVVAALNATDPGAAAQFNASPVAQSYLRNFLAAPPPQRAAMAAQLQAVPGAAQYIGLVESVAGSCNNY<br><br>8mer<br>MRLSLTAL;LTALSAGV;ALSAGVGA;LSAGVGAV;AVAMSLTV;AMSLTVGA;SLTVGAGV;GVASADPV;SADPVDAV;VINTTCNY;TTCNYGQV;YGQVVAAL;QVVAALNA;ATDPGAAA;DPGAAAQF;AQFNASPV;SPVAQSYL;PVAQSYLR;AQSYLRNF;QSYLRNFL;SYLRNFLA;YLRNFLAA;FLAAPPPQ;LAAPPPQR;APPPQRAA;PPPQRAAM;RAAMAAQL;AMAAQLQA;MAAQLQAV;QLQAVPGA;LQAVPGAA;AVPGAAQY;VPGAAQYI;GAAQYIGL;YIGLVESV<br>9mer<br>RLSLTALSA;SLTALSAGV;ALSAGVGAV;SAGVGAVAM;GVGAVAMSL;GAVAMSLTV;VAMSLTVGA;MSLTVGAGV;SLTVGAGVA;TVGAGVASA;ASADPVDAV;SADPVDAVI;AVINTTCNY;NTTCNYGQV;TTCNYGQVV;NYGQVVAAL;GQVVAALNA;QVVAALNAT;ALNATDPGA;NATDPGAAA;ATDPGAAAQ;AQFNASPVA;NASPVAQSY;SPVAQSYLR;AQSYLRNFL;QSYLRNFLA;SYLRNFLAA;YLRNFLAAP;FLAAPPPQR;LAAPPPQRA;APPPQRAAM;QRAAMAAQL;AMAAQLQAV;AQLQAVPGA;QLQAVPGAA;LQAVPGAAQ;QAVPGAAQY;AVPGAAQYI;GAAQYIGLV;AQYIGLVES;QYIGLVESV;GLVESVAGS;SVAGSCNNY<br>10mer | 148336-148875 |

Fig. 30 continued

| | | |
|---|---|---|
| | LSLTALSAGV;LTALSAGVGA;TALSAGVGAV;ALSAGVGAVA;LSAGVGAVAM;AVAMSLTVGA;AMSLTVGAGV;LTVGAGVASA;ASADPVDAVI;DPVDAVINTT;DAVINTTCNY;NTTCNYGQVV;GQVVAALNAT;AALNATDPGA;ALNATDPGAA;ATDPGAAAQF;AAAQFNASPV;AQFNASPVAQ;FNASPVAQSY;NASPVAQSYL;ASPVAQSYLR;PVAQSYLRNF;AQSYLRNFLA;YLRNFLAAPP;RNFLAAPPPQ;FLAAPPPQRA;AAPPPQRAAM;APPPQRAAMA;AAMAAQLQAV;AQLQAVPGAA;LQAVPGAAQY;QAVPGAAQYI;AQYIGLVESV;GLVESVAGSC;ESVAGSCNNY<br>11mer<br>RLSLTALSAGV;SLTALSAGVGA;LTALSAGVGAV;ALSAGVGAVAM;GVGAVAMSLTV;GAVAMSLTVGA;VAMSLTVGAGV;AMSLTVGAGVA;SLTVGAGVASA;VGAGVASADPV;GVASADPVDAV;DPVDAVINTTC;VINTTCNYGQV;NTTCNYGQVVA;TTCNYGQVVAA;TCNYGQVVAAL;ALNATDPGAAA;NATDPGAAAQF;DPGAAAQFNAS;GAAAQFNASPV;QFNASPVAQSY;FNASPVAQSYL;NASPVAQSYLR;SPVAQSYLRNF;PVAQSYLRNFL;AQSYLRNFLAA;RNFLAAPPPQR;FLAAPPPQRAA;LAAPPPQRAAM;APPPQRAAMAA;RAAMAAQLQAV;MAAQLQAVPGA;AQLQAVPGAAQ;QLQAVPGAAQY;LQAVPGAAQYI;AVPGAAQYIGL;VPGAAQYIGLV;AAQYIGLVESV;AQYIGLVESVA;VESVAGSCNNY<br><br>13 mers:<br>MRLSLTALSAGVG;RLSLTALSAGVGA;LSLTALSAGVGAV;SLTALSAGVGAVA;LTALSAGVGAVAM;TALSAGVGAVAMS;ALSAGVGAVAMSL;LSAGVGAVAMSLT;SAGVGAVAMSLTV;AGVGAVAMSLTVG;GVGAVAMSLTVGA;VGAVAMSLTVGAG;GAVAMSLTVGAGV;AVAMSLTVGAGVA;VAMSLTVGAGVAS;AMSLTVGAGVASA;MSLTVGAGVASAD;SLTVGAGVASADP;LTVGAGVASADPV;TVGAGVASADPVD;VGAGVASADPVDA;GAGVASADPVDAV;AGVASADPVDAVI;GVASADPVDAVIN;VASADPVDAVINT;ASADPVDAVINTT;SADPVDAVINTTC;ADPVDAVINTTCN;DPVDAVINTTCNY;PVDAVINTTCNYG;VDAVINTTCNYGQ;DAVINTTCNYGQV;AVINTTCNYGQVV;VINTTCNYGQVVA;INTTCNYGQVVAA;NTTCNYGQVVAAL;TTCNYGQVVAALN;TCNYGQVVAALNA;CNYGQVVAALNAT;NYGQVVAALNATD;YGQVVAALNATDP;GQVVAALNATDPG;QVVAALNATDPGA;VVAALNATDPGAA;VAALNATDPGAAA;AALNATDPGAAAQ;ALNATDPGAAAQF;LNATDPGAAAQFN;NATDPGAAAQFNA;ATDPGAAAQFNAS;TDPGAAAQFNASP;DPGAAAQFNASPV;PGAAAQFNASPVA;GAAAQFNASPVAQ;AAAQFNASPVAQS;AAQFNASPVAQSY;AQFNASPVAQSYL;QFNASPVAQSYLR;FNASPVAQSYLRN;NASPVAQSYLRNF;ASPVAQSYLRNFL;SPVAQSYLRNFLA;PVAQSYLRNFLAA;VAQSYLRNFLAAP;AQSYLRNFLAAPP;QSYLRNFLAAPPP;SYLRNFLAAPPPQ;YLRNFLAAPPPQR;LRNFLAAPPPQRA;RNFLAAPPPQRAA;NFLAAPPPQRAAM;FLAAPPPQRAAMA;LAAPPPQRAAMAA;AAPPPQRAAMAAQ;APPPQRAAMAAQL;PPPQRAAMAAQLQ;PPQRAAMAAQLQA;PQRAAMAAQLQAV;QRAAMAAQLQAVP;RAAMAAQLQAVPG;AAMAAQLQAVPGA;AMAAQLQAVPGAA;MAAQLQAVPGAAQ;AAQLQAVPGAAQY;AQLQAVPGAAQYI;QLQAVPGAAQYIG;LQAVPGAAQYIGL;QAVPGAAQYIGLV;AVPGAAQYIGLVE;VPGAAQYIGLVES;PGAAQYIGLVESV;GAAQYIGLVESVA;AAQYIGLVESVAG;AQYIGLVESVAGS;QYIGLVESVAGSC;YIGLVESVAGSCN;IGLVESVAGSCNN;GLVESVAGSCNNY;<br><br>14 mers:<br>MRLSLTALSAGVGA;RLSLTALSAGVGAV;LSLTALSAGVGAVA;SLTALSAGVGAVAM;LTALSAGVGAVAMS;TALSAGVGAVAMSL;ALSAGVGAVAMSLT;LSAGVGAVAMSLTV;SAGVGAVAMSLTVG;AGVGAVAMSLTVGA;GVGAVA | |

Fig. 30 continued

MSLTVGAG;VGAVAMSLTVGAGV;GAVAMSLTVGAGVA;AVAMSLTVGAGV
AS;VAMSLTVGAGVASA;AMSLTVGAGVASAD;MSLTVGAGVASADP;SLTV
GAGVASADPV;LTVGAGVASADPVD;TVGAGVASADPVDA;VGAGVASADP
VDAV;GAGVASADPVDAVI;AGVASADPVDAVIN;GVASADPVDAVINT;VAS
ADPVDAVINTT;ASADPVDAVINTTC;SADPVDAVINTTCN;ADPVDAVINTTC
NY;DPVDAVINTTCNYG;PVDAVINTTCNYGQ;VDAVINTTCNYGQV;DAVINT
TCNYGQVV;AVINTTCNYGQVVA;VINTTCNYGQVVAA;INTTCNYGQVVAAL
;NTTCNYGQVVAALN;TTCNYGQVVAALNA;TCNYGQVVAALNAT;CNYGQV
VAALNATD;NYGQVVAALNATDP;YGQVVAALNATDPG;GQVVAALNATDP
GA;QVVAALNATDPGAA;VVAALNATDPGAAA;VAALNATDPGAAAQ;AALN
ATDPGAAAQF;ALNATDPGAAAQFN;LNATDPGAAAQFNA;NATDPGAAAQ
FNAS;ATDPGAAAQFNASP;TDPGAAAQFNASPV;DPGAAAQFNASPVA;PG
AAAQFNASPVAQ;GAAAQFNASPVAQS;AAAQFNASPVAQSY;AAQFNASP
VAQSYL;AQFNASPVAQSYLR;QFNASPVAQSYLRN;FNASPVAQSYLRNF;
NASPVAQSYLRNFL;ASPVAQSYLRNFLA;SPVAQSYLRNFLAA;PVAQSYL
RNFLAAP;VAQSYLRNFLAAPP;AQSYLRNFLAAPPP;QSYLRNFLAAPPPQ;
SYLRNFLAAPPPQR;YLRNFLAAPPPQRA;LRNFLAAPPPQRAA;RNFLAAP
PPQRAAM;NFLAAPPPQRAAMA;FLAAPPPQRAAMAA;LAAPPPQRAAMAA
Q;AAPPPQRAAMAAQL;APPPQRAAMAAQLQ;PPPQRAAMAAQLQA;PPQR
AAMAAQLQAV;PQRAAMAAQLQAVP;QRAAMAAQLQAVPG;RAAMAAQLQ
AVPGA;AAMAAQLQAVPGAA;AMAAQLQAVPGAAQ;MAAQLQAVPGAAQY;
AAQLQAVPGAAQYI;AQLQAVPGAAQYIG;QLQAVPGAAQYIGL;LQAVPGA
AQYIGLV;QAVPGAAQYIGLVE;AVPGAAQYIGLVES;VPGAAQYIGLVESV;P
GAAQYIGLVESVA;GAAQYIGLVESVAG;AAQYIGLVESVAGS;AQYIGLVES
VAGSC;QYIGLVESVAGSCN;YIGLVESVAGSCNN;IGLVESVAGSCNNY;

15 mers:
MRLSLTALSAGVGAV;RLSLTALSAGVGAVA;LSLTALSAGVGAVAM;SLTAL
SAGVGAVAMS;LTALSAGVGAVAMSL;TALSAGVGAVAMSLT;ALSAGVGA
VAMSLTV;LSAGVGAVAMSLTVG;SAGVGAVAMSLTVGA;AGVGAVAMSLT
VGAG;GVGAVAMSLTVGAGV;VGAVAMSLTVGAGVA;GAVAMSLTVGAGV
AS;AVAMSLTVGAGVASA;VAMSLTVGAGVASAD;AMSLTVGAGVASADP;
MSLTVGAGVASADPV;SLTVGAGVASADPVD;LTVGAGVASADPVDA;TVG
AGVASADPVDAV;VGAGVASADPVDAVI;GAGVASADPVDAVIN;AGVASAD
PVDAVINT;GVASADPVDAVINTT;VASADPVDAVINTTC;ASADPVDAVINTT
CN;SADPVDAVINTTCNY;ADPVDAVINTTCNYG;DPVDAVINTTCNYGQ;PV
DAVINTTCNYGQV;VDAVINTTCNYGQVV;DAVINTTCNYGQVVA;AVINTTC
NYGQVVAA;VINTTCNYGQVVAAL;INTTCNYGQVVAALN;NTTCNYGQVVA
ALNA;TTCNYGQVVAALNAT;TCNYGQVVAALNATD;CNYGQVVAALNATD
P;NYGQVVAALNATDPG;YGQVVAALNATDPGA;GQVVAALNATDPGAA;Q
VVAALNATDPGAAA;VVAALNATDPGAAAQ;VAALNATDPGAAAQF;AALNA
TDPGAAAQFN;ALNATDPGAAAQFNA;LNATDPGAAAQFNAS;NATDPGAA
AQFNASP;ATDPGAAAQFNASPV;TDPGAAAQFNASPVA;DPGAAAQFNAS
PVAQ;PGAAAQFNASPVAQS;GAAAQFNASPVAQSY;AAAQFNASPVAQSY
L;AAQFNASPVAQSYLR;AQFNASPVAQSYLRN;QFNASPVAQSYLRNF;FN
ASPVAQSYLRNFL;NASPVAQSYLRNFLA;ASPVAQSYLRNFLAA;SPVAQS
YLRNFLAAP;PVAQSYLRNFLAAPP;VAQSYLRNFLAAPPP;AQSYLRNFLAA
PPPQ;QSYLRNFLAAPPPQR;SYLRNFLAAPPPQRA;YLRNFLAAPPPQRAA;
LRNFLAAPPPQRAAM;RNFLAAPPPQRAAMA;NFLAAPPPQRAAMAA;FLAA
PPPQRAAMAAQ;LAAPPPQRAAMAAQL;AAPPPQRAAMAAQLQ;APPPQR
AAMAAQLQA;PPPQRAAMAAQLQAV;PPQRAAMAAQLQAVP;PQRAAMAA
QLQAVPG;QRAAMAAQLQAVPGA;RAAMAAQLQAVPGAA;AAMAAQLQAV
PGAAQ;AMAAQLQAVPGAAQY;MAAQLQAVPGAAQYI;AAQLQAVPGAAQY

Fig. 30 continued

| | | |
|---|---|---|
| | IG;AQLQAVPGAAQYIGL;QLQAVPGAAQYIGLV;LQAVPGAAQYIGLVE;QAVPGAAQYIGLVES;AVPGAAQYIGLVESV;VPGAAQYIGLVESVA;PGAAQYIGLVESVAG;GAAQYIGLVESVAGS;AAQYIGLVESVAGSC;AQYIGLVESVAGSCN;QYIGLVESVAGSCNN;YIGLVESVAGSCNNY;<br>16 mers:<br>MRLSLTALSAGVGAVA;RLSLTALSAGVGAVAM;LSLTALSAGVGAVAMS;SLTALSAGVGAVAMSL;LTALSAGVGAVAMSLT;TALSAGVGAVAMSLTV;ALSAGVGAVAMSLTVG;LSAGVGAVAMSLTVGA;SAGVGAVAMSLTVGAG;AGVGAVAMSLTVGAGV;GVGAVAMSLTVGAGVA;VGAVAMSLTVGAGVAS;GAVAMSLTVGAGVASA;AVAMSLTVGAGVASAD;VAMSLTVGAGVASADP;AMSLTVGAGVASADPV;MSLTVGAGVASADPVD;SLTVGAGVASADPVDA;LTVGAGVASADPVDAV;TVGAGVASADPVDAVI;VGAGVASADPVDAVIN;GAGVASADPVDAVINT;AGVASADPVDAVINTT;GVASADPVDAVINTTC;VASADPVDAVINTTCN;ASADPVDAVINTTCNY;SADPVDAVINTTCNYG;ADPVDAVINTTCNYGQ;DPVDAVINTTCNYGQV;PVDAVINTTCNYGQVV;VDAVINTTCNYGQVVA;DAVINTTCNYGQVVAA;AVINTTCNYGQVVAAL;VINTTCNYGQVVAALN;INTTCNYGQVVAALNA;NTTCNYGQVVAALNAT;TTCNYGQVVAALNATD;TCNYGQVVAALNATDP;CNYGQVVAALNATDPG;NYGQVVAALNATDPGA;YGQVVAALNATDPGAA;GQVVAALNATDPGAAA;QVVAALNATDPGAAAQ;VVAALNATDPGAAAQF;VAALNATDPGAAAQFN;AALNATDPGAAAQFNA;ALNATDPGAAAQFNAS;LNATDPGAAAQFNASP;NATDPGAAAQFNASPV;ATDPGAAAQFNASPVA;TDPGAAAQFNASPVAQ;DPGAAAQFNASPVAQS;PGAAAQFNASPVAQSY;GAAAQFNASPVAQSYL;AAAQFNASPVAQSYLR;AAQFNASPVAQSYLRN;AQFNASPVAQSYLRNF;QFNASPVAQSYLRNFL;FNASPVAQSYLRNFLA;NASPVAQSYLRNFLAA;ASPVAQSYLRNFLAAP;SPVAQSYLRNFLAAPP;PVAQSYLRNFLAAPPP;VAQSYLRNFLAAPPPQ;AQSYLRNFLAAPPPQR;QSYLRNFLAAPPPQRA;SYLRNFLAAPPPQRAA;YLRNFLAAPPPQRAAM;LRNFLAAPPPQRAAMA;RNFLAAPPPQRAAMAA;NFLAAPPPQRAAMAAQ;FLAAPPPQRAAMAAQL;LAAPPPQRAAMAAQLQ;AAPPPQRAAMAAQLQA;APPPQRAAMAAQLQAV;PPPQRAAMAAQLQAVP;PPQRAAMAAQLQAVPG;PQRAAMAAQLQAVPGA;QRAAMAAQLQAVPGAA;RAAMAAQLQAVPGAAQ;AAMAAQLQAVPGAAQY;AMAAQLQAVPGAAQYI;MAAQLQAVPGAAQYIG;AAQLQAVPGAAQYIGL;AQLQAVPGAAQYIGLV;QLQAVPGAAQYIGLVE;LQAVPGAAQYIGLVES;QAVPGAAQYIGLVESV;AVPGAAQYIGLVESVA;VPGAAQYIGLVESVAG;PGAAQYIGLVESVAGS;GAAQYIGLVESVAGSC;AAQYIGLVESVAGSCN;AQYIGLVESVAGSCNN;QYIGLVESVAGSCNNY | |
| 23 | **<NP_215865.1 drugs-transport transmembrane ATP-binding protein ABC transporter Rv1349;Mycobacterium tuberculosis H37Rv>**<br>MIRTWIALVPNDHRARLIGFALLAFCSVVARAVGTVLLVPLMAALFGEAPQRAWLWLGWLSAATVAGWVLDAVTARIGIELGFAVLNHTQHDVADRLPVVRLDWFTAENTATARQAIAATGPELVGLVVNLVTPLTSAILLPAVIALALLPISWQLGVAALAGVPLLLGALWASAAFARRADTAADKANTALTERIIEFARTQQALRAARRVEPARSLVGNALASQHTATMRLLGMQIPGQLLFSIASQLALIVLAGTTAALTITGTLTVPEAIALIVVMVRYLEPFTAVSELAPALESTRATLGRIGSVLTAPVMVAGSGTWRDGAVVPRIEFDDVAFGYDGGSGPVLDGVSFCLQPGTTTAIVGPSGCGKSTILALIAGLHQPTRGRVLIDGTDVATLDARAQQAVCSVVFQHPYLFHGTIRDNVFAADPGASDDQFAQAVRLARVDELIARLPDGANTIVGEAGSALSGGERQRVSIARALLKAAPVLLVDEATSALDAENEAAVVDALAADPRSRTRVIVAHRLASIRHADRVLFVDDGRVVEDGSISELLTAGGRFSQFWRQQHEAAEWQILAE<br><br>8mer | 148876-152021 |

Fig. 30 continued

| | | |
|---|---|---|
| | MIRTWIAL;HRARLIGF;RARLIGFA;RLIGFALL;LIGFALLA;IGFALLAF;ALLAFCSV;LLAFCSVV;LAFCSVVA;AFCSVVAR;CSVVARAV;VARAVGTV;ARAVGTVL;RAVGTVLL;AVGTVLLV;GTVLLVPL;VLLVPLMA;LLVPLMAA;LVPLMAAL;VPLMAALF;LMAALFGE;MAALFGEA;ALFGEAPQ;EAPQRAWL;APQRAWLW;RAWLWLGW;AWLWLGWL;WLWLGWLS;WLGWLSAA;WLSAATVA;SAATVAGW;ATVAGWVL;WVLDAVTA;VLDAVTAR;AVTARIGI;GIELGFAV;IELGFAVL;TQHDVADR;QHDVADRL;DVADRLPV;VADRLPVV;LPVVRLDW;PVVRLDWF;RLDWFTAE;FTAENTAT;AENTATAR;NTATARQA;TATARQAI;IAATGPEL;AATGPELV;PELVGLVV;LVGLVVNL;VVNLVTPL;LVTPLTSA;TPLTSAIL;PLTSAILL;TSAILLPA;SAILLPAV;ILLPAVIA;LLPAVIAL;LPAVIALA;AVIALALL;IALALLPI;LALLPISW;ALLPISWQ;LLPISWQL;PISWQLGV;WQLGVAAL;QLGVAALA;GVAALAGV;AALAGVPL;ALAGVPLL;VPLLLGAL;LLLGALWA;LLGALWAS;GALWASAA;ALWASAAF;WASAAFAR;ASAAFARR;NTALTERI;LTERIIEF;ERIIEFAR;RIIEFART;FARTQQAL;QQALRAAR;QALRAARR;ALRAARRV;AARRVEPA;RVEPARSL;SLVGNALA;ALASQHTA;LASQHTAT;SQHTATMR;QHTATMRL;HTATMRLL;ATMRLLGM;RLLGMQIP;GMQIPGQL;MQIPGQLL;QIPGQLLF;GQLLFSIA;LLFSIASQ;FSIASQLA;SIASQLAL;SQLALIVL;QLALIVLA;ALIVLAGT;IVLAGTTA;VLAGTTAA;LAGTTAAL;TTAALTIT;ALTITGTL;TITGTLTV;TLTVPEAI;TVPEAIAL;VPEAIALI;EAIALIVV;AIALIVVM;IALIVVMV;ALIVVMVR;LIVVMVRY;IVVMVRYL;MVRYLEPF;YLEPFTAV;FTAVSELA;AVSELAPA;ELAPALES;LESTRATL;STRATLGR;TLGRIGSV;RIGSVLTA;SVLTAPVM;VLTAPVMV;LTAPVMVA;APVMVAGS;VMVAGSGT;MVAGSGTW;VAGSGTWR;GTWRDGAV;AVVPRIEF;IEFDDVAF;VLDGVSFC;CLQPGTTT;LQPGTTTA;QPGTTTAI;TTAIVGPS;ILALIAGL;ALIAGLHQ;QPTRGRVL;VLIDGTDV;LIDGTDVA;DVATLDAR;TLDARAQQ;AQQAVCSV;QQAVCSVV;QAVCSVVF;AVCSVVFQ;SVVFQHPY;VVFQHPYL;VFQHPYLF;FQHPYLFH;HPYLFHGT;PYLFHGTI;YLFHGTIR;GTIRDNVF;TIRDNVFA;DQFAQAVR;AQAVRLAR;QAVRLARV;RLARVDEL;RVDELIAR;RLPDGANT;LPDGANTI;SALSGGER;ALSGGERQ;RQRVSIAR;RVSIARAL;SIARALLK;ALLKAAPV;LLKAAPVL;KAAPVLLV;VLLVDEAT;LLVDEATS;LVDEATSA;ALDAENEA;AENEAAVV;EAAVVDAL;AVVDALAA;DALAADPR;LAADPRSR;DPRSRTRV;RSRTRVIV;RTRVIVAH;TRVIVAHR;RVIVAHRL;VAHRLASI;RLASIRHA;ASIRHADR;SIRHADRV;HADRVLFV;VLFVDDGR;FVDDGRVV;RVVEDGSI;SISELLTA;ELLTAGGR;LLTAGGRF;GRFSQFWR;SQFWRQQH;QQHEAAEW;HEAAEWQI;EAAEWQIL<br>9mer<br>MIRTWIALV;IALVPNDHR;ALVPNDHRA;LVPNDHRAR;VPNDHRARL;RARLIGFAL;RLIGFALLA;LIGFALLAF;FALLAFCSV;ALLAFCSVV;LLAFCSVVA;LAFCSVVAR;FCSVVARAV;VVARAVGTV;VARAVGTVL;ARAVGTVLL;RAVGTVLLV;VLLVPLMAA;LLVPLMAAL;LVPLMAALF;LMAALFGEA;ALFGEAPQR;GEAPQRAWL;APQRAWLWL;RAWLWLGWL;WLWLGWLSA;WLGWLSAAT;LSAATVAGW;SAATVAGWV;TVAGWVLDA;VAGWVLDAV;WVLDAVTAR;VLDAVTARI;DAVTARIGI;VTARIGIEL;ARIGIELGF;RIGIELGFA;IGIELGFAV;VLNHTQHDV;HTQHDVADR;TQHDVADRL;DVADRLPVV;RLPVVRLDW;LPVVRLDWF;RLDWFTAEN;FTAENTATA;TAENTATAR;AENTATARQ;NTATARQAI;TARQAIAAT;AIAATGPEL;IAATGPELV;ATGPELVGL;TGPELVGLV;GPELVGLVV;ELVGLVVNL;LVGLVVNLV;LVVNLVTPL;NLVTPLTSA;LVTPLTSAI;VTPLTSAIL;TPLTSAILL;LTSAILLPA;TSAILLPAV;SAILLPAVI;ILLPAVIAL;LLPAVIALA;LPAVIALAL;VIALALLPI;ALLPISWQL;LPISWQLGV;ISWQLGVAA;WQLGVAALA;LGVAALAGV;VAALAGVPL;AALAGVPLL;ALAGVPLLL;GVPLLLGAL;VPLLLGALW;PLLLGALWA;LLLGALWAS;LLGALWASA;GALWASAAF;ALWASAAFA;LWASAAFAR;WASAAFARR;FARRADTAA;RRADTAADK;DTAADKANT;AADKANTAL;KANTALTER;ALTERIIEF;LTERIIEFA;TERIIEFAR; | |

Fig. 30 continued

| | | |
|---|---|---|
| | EFARTQQAL;FARTQQALR;TQQALRAAR;QQALRAARR;RAARRVEPA;AA<br>RRVEPAR;RRVEPARSL;RVEPARSLV;SLVGNALAS;NALASQHTA;ALASQ<br>HTAT;LASQHTATM;ASQHTATMR;SQHTATMRL;TMRLLGMQI;RLLGMQIP<br>G;GMQIPGQLL;MQIPGQLLF;IPGQLLFSI;QLLFSIASQ;LLFSIASQL;FSIASQ<br>LAL;SIASQLALI;IASQLALIV;SQLALIVLA;LIVLAGTTA;IVLAGTTAA;VLAGTT<br>AAL;TAALTITGT;AALTITGTL;LTITGTLTV;LTVPEAIAL;TVPEAIALI;EAIALIV<br>VM;AIALIVVMV;IALIVVMVR;ALIVVMVRY;LIVVMVRYL;VMVRYLEPF;MVR<br>YLEPFT;RYLEPFTAV;YLEPFTAVS;EPFTAVSEL;TAVSELAPA;AVSELAPA<br>L;ELAPALEST;LAPALESTR;APALESTRA;ALESTRATL;ESTRATLGR;STRA<br>TLGRI;ATLGRIGSV;TLGRIGSVL;GRIGSVLTA;IGSVLTAPV;SVLTAPVMV;V<br>LTAPVMVA;APVMVAGSG;VMVAGSGTW;MVAGSGTWR;GTWRDGAVV;W<br>RDGAVVPR;RIEFDDVAF;EFDDVAFGY;GYDGGSGPV;YDGGSGPVL;GSG<br>PVLDGV;GPVLDGVSF;PVLDGVSFC;VLDGVSFCL;CLQPGTTTA;LQPGTT<br>TAI;QPGTTTAIV;TTTAIVGPS;IVGPSGCGK;TILALIAGL;ILALIAGLH;ALIAGL<br>HQP;LIAGLHQPT;IAGLHQPTR;GLHQPTRGR;QPTRGRVLI;VLIDGTDVA;LI<br>DGTDVAT;DVATLDARA;TLDARAQQA;RAQQAVCSV;AQQAVCSVV;QQAV<br>CSVVF;AVCSVVFQH;CSVVFQHPY;SVVFQHPYL;VVFQHPYLF;FQHPYLF<br>HG;HPYLFHGTI;PYLFHGTIR;YLFHGTIRD;TIRDNVFAA;NVFAADPGA;DP<br>GASDDQF;SDDQFAQAV;FAQAVRLAR;AQAVRLARV;RLARVDELI;RVDELI<br>ARL;LIARLPDGA;RLPDGANTI;LPDGANTIV;GANTIVGEA;IVGEAGSAL;RQ<br>RVSIARA;QRVSIARAL;RVSIARALL;VSIARALLK;SIARALLKA;RALLKAAPV;<br>ALLKAAPVL;LLKAAPVLL;APVLLVDEA;LLVDEATSA;LVDEATSAL;ALDAEN<br>EAA;AENEAAVVD;NEAAVVDAL;EAAVVDALA;DPRSRTRVI;RTRVIVAHR;I<br>VAHRLASI;VAHRLASIR;LASIRHADR;SIRHADRVL;RHADRVLFV;RVLFVD<br>DGR;VLFVDDGRV;FVDDGRVVE;VEDGSISEL;LTAGGRFSQ;GGRFSQFW<br>R;SQFWRQQHE;RQQHEAAEW;HEAAEWQIL;EAAEWQILA<br>10mer<br>WIALVPNDHR;ALVPNDHRAR;LVPNDHRARL;VPNDHRARLI;HRARLIGFA<br>L;RARLIGFALL;RLIGFALLAF;FALLAFCSVV;ALLAFCSVVA;LLAFCSVVAR;<br>LAFCSVVARA;SVVARAVGTV;VVARAVGTVL;VARAVGTVLL;AVGTVLLVP<br>L;TVLLVPLMAA;VLLVPLMAAL;LLVPLMAALF;PLMAALFGEA;MAALFGEAP<br>Q;AALFGEAPQR;ALFGEAPQRA;GEAPQRAWLW;EAPQRAWLWL;QRAWL<br>WLGWL;WLWLGWLSAA;WLGWLSAATV;WLSAATVAGW;LSAATVAGWV;<br>SAATVAGWVL;TVAGWVLDAV;WVLDAVTARI;AVTARIGIEL;RIGIELGFAV;I<br>ELGFAVLNH;AVLNHTQHDV;VLNHTQHDVA;HTQHDVADRL;DVADRLPVV<br>R;RLPVVRLDWF;LPVVRLDWFT;RLDWFTAENT;FTAENTATAR;AENTATA<br>RQA;NTATARQAIA;RQAIAATGPE;QAIAATGPEL;AIAATGPELV;ATGPELV<br>GLV;PELVGLVVNL;ELVGLVVNLV;GLVVNLVTPL;NLVTPLTSAI;LVTPLTSA<br>IL;PLTSAILLPA;LTSAILLPAV;TSAILLPAVI;AILLPAVIAL;ILLPAVIALA;LLPA<br>VIALAL;LPAVIALALL;AVIALALLPI;IALALLPISW;ALALLPISWQ;LALLPISWQ<br>L;ALLPISWQLG;LLPISWQLGV;LPISWQLGVA;ISWQLGVAAL;QLGVAALA<br>GV;GVAALAGVPL;AALAGVPLLL;ALAGVPLLLG;VPLLLGALWA;PLLLGAL<br>WAS;LLLGALWASA;LLGALWASAA;LGALWASAAF;GALWASAAFA;ALWA<br>SAAFAR;LWASAAFARR;WASAAFARRA;ARRADTAADK;DTAADKANTA;T<br>AADKANTAL;DKANTALTER;KANTALTERI;TALTERIIEF;ALTERIIEFA;LTE<br>RIIEFAR;IEFARTQQAL;EFARTQQALR;RTQQALRAAR;TQQALRAARR;QQ<br>ALRAARRV;RAARRVEPAR;RRVEPARSLV;EPARSLVGNA;SLVGNALASQ;<br>ALASQHTATM;LASQHTATMR;SQHTATMRLL;HTATMRLLGM;ATMRLLGM<br>QI;RLLGMQIPGQ;LLGMQIPGQL;GMQIPGQLLF;MQIPGQLLFS;QIPGQLLF<br>SI;IPGQLLFSIA;QLLFSIASQL;LLFSIASQLA;FSIASQLALI;SIASQLALIV;IAS<br>QLALIVL;QLALIVLAGT;ALIVLAGTTA;LIVLAGTTAA;IVLAGTTAAL;VLAGTT<br>AALT;LAGTTAALTI;TTAALTITGT;TAALTITGTL;ALTITGTLTV;TLTVPEAIAL;<br>LTVPEAIALI;TVPEAIALIV;VPEAIALIVV;EAIALIVVMV;AIALIVVMVR;IALIVV | |

Fig. 30 continued

| | | |
|---|---|---|
| | MVRY;ALIVVMVRYL;VVMVRYLEPF;VMVRYLEPFT;MVRYLEPFTA;YLEPFTAVSE;LEPFTAVSEL;EPFTAVSELA;FTAVSELAPA;TAVSELAPAL;ELAPALESTR;APALESTRAT;ESTRATLGRI;RATLGRIGSV;TLGRIGSVLT;RIGSVLTAPV;SVLTAPVMVA;LTAPVMVAGS;APVMVAGSGT;VMVAGSGTWR;TWRDGAVVPR;VVPRIEFDDV;VPRIEFDDVA;IEFDDVAFGY;FGYDGGSGPV;PVLDGVSFCL;VLDGVSFCLQ;CLQPGTTTAI;LQPGTTTAIV;AIVGPSGCGK;GPSGCGKSTI;STILALIAGL;ALIAGLHQPT;LIAGLHQPTR;GLHQPTRGRV;LHQPTRGRVL;VLIDGTDVAT;LIDGTDVATL;ATLDARAQQA;TLDARAQQAV;RAQQAVCSVV;AQQAVCSVVF;VCSVVFQHPY;CSVVFQHPYL;SVVFQHPYLF;VVFQHPYLFH;FQHPYLFHGT;HPYLFHGTIR;FHGTIRDNVF;GTIRDNVFAA;ASDDQFAQAV;QFAQAVRLAR;FAQAVRLARV;AVRLARVDEL;RLARVDELIA;LARVDELIAR;ELIARLPDGA;RLPDGANTIV;NTIVGEAGSA;TIVGEAGSAL;ALSGGERQRV;RQRVSIARAL;QRVSIARALL;RVSIARALLK;SIARALLKAA;ALLKAAPVLL;LLKAAPVLLV;APVLLVDEAT;VLLVDEATSA;LLVDEATSAL;TSALDAENEA;SALDAENEAA;ALDAENEAAV;AENEAAVVDA;EAAVVDALAA;VVDALAADPR;DALAADPRSR;ALAADPRSRT;LAADPRSRTR;AADPRSRTRV;DPRSRTRVIV;SRTRVIVAHR;RTRVIVAHRL;VIVAHRLASI;IVAHRLASIR;RLASIRHADR;RVLFVDDGRV;VLFVDDGRVV;FVDDGRVVED;VVEDGSISEL;VEDGSISELL;ISELLTAGGR;SELLTAGGRF;LLTAGGRFSQ;LTAGGRFSQF;TAGGRFSQFW;AGGRFSQFWR;SQFWRQQHEA;QQHEAAEWQI;QHEAAEWQIL<br>11mer<br>TWIALVPNDHR;WIALVPNDHRA;IALVPNDHRAR;ALVPNDHRARL;HRARLIGFALL;RARLIGFALLA;ARLIGFALLAF;RLIGFALLAFC;IGFALLAFCSV;FALLAFCSVVA;ALLAFCSVVAR;LLAFCSVVARA;LAFCSVVARAV;CSVVARAVGTV;SVVARAVGTVL;VVARAVGTVLL;VARAVGTVLLV;RAVGTVLLVPL;TVLLVPLMAAL;VLLVPLMAALF;VPLMAALFGEA;LMAALFGEAPQ;MAALFGEAPQR;GEAPQRAWLWL;PQRAWLWLGWL;RAWLWLGWLSA;WLWLGWLSAAT;LWLGWLSAATV;WLGWLSAATVA;GWLSAATVAGW;WLSAATVAGWV;LSAATVAGWVL;ATVAGWVLDAV;TVAGWVLDAVT;AGWVLDAVTAR;VLDAVTARIGI;DAVTARIGIEL;VTARIGIELGF;RIGIELGFAVL;ELGFAVLNHTQ;FAVLNHTQHDV;TQHDVADRLPV;DVADRLPVVRL;RLPVVRLDWFT;LPVVRLDWFTA;RLDWFTAENTA;WFTAENTATAR;FTAENTATARQ;AENTATARQAI;NTATARQAIAA;RQAIAATGPEL;QAIAATGPELV;IAATGPELVGL;AATGPELVGLV;ATGPELVGLVV;ELVGLVVNLVT;VVNLVTPLTSA;NLVTPLTSAIL;LVTPLTSAILL;TPLTSAILLPA;PLTSAILLPAV;LTSAILLPAVI;SAILLPAVIAL;AILLPAVIALA;ILLPAVIALAL;LLPAVIALALL;LPAVIALALLP;VIALALLPISW;ALALLPISWQL;ALLPISWQLGV;LLPISWQLGVA;LPISWQLGVAA;PISWQLGVAAL;WQLGVAALAGV;GVAALAGVPLL;ALAGVPLLLGA;VPLLLGALWAS;PLLLGALWASA;LLLGALWASAA;LLGALWASAAF;GALWASAAFAR;ALWASAAFARR;FARRADTAADK;DTAADKANTAL;TAADKANTALT;NTALTERIIEF;ALTERIIEFAR;RIIEFARTQQA;IEFARTQQALR;FARTQQALRAA;RTQQALRAARR;ALRAARRVEPA;AARRVEPARSL;EPARSLVGNAL;NALASQHTATM;ALASQHTATMR;LASQHTATMRL;HTATMRLLGMQ;RLLGMQIPGQL;LLGMQIPGQLL;LGMQIPGQLLF;MQIPGQLLFSI;IPGQLLFSIAS;GQLLFSIASQL;QLLFSIASQLA;LLFSIASQLAL;LFSIASQLALI;FSIASQLALIV;SIASQLALIVL;SQLALIVLAGT;LALIVLAGTTA;ALIVLAGTTAA;LIVLAGTTAAL;IVLAGTTAALT;VLAGTTAALTI;TTAALTITGTL;AALTITGTLTV;TITGTLTVPEA;ITGTLTVPEAI;TLTVPEAIALI;LTVPEAIALIV;TVPEAIALIVV;VPEAIALIVVM;EAIALIVVMVR;AIALIVVMVRY;IVVMVRYLEPF;VMVRYLEPFTA;MVRYLEPFTAV;YLEPFTAVSEL;FTAVSELAPAL;ELAPALESTRA;APALESTRATL;ALESTRATLGR;TRATLGRIGSV;RATLGRIGSVL;TLGRIGSVLTA;GRIGSVLTAPV;APVMVAGSGTW;GTWRDGAVVPR;AVVPRIEFDDV;VPRIEFDDVAF;RIEFDDVAFGY;FG | |

Fig. 30 continued

| | | |
|---|---|---|
| | YDGGSGPVL;GPVLDGVSFCL;VLDGVSFCLQP;FCLQPGTTTAI;CLQPGTTTAIV;TAIVGPSGCGK;GPSGCGKSTIL;STILALIAGLH;ALIAGLHQPTR;GLHQPTRGRVL;VLIDGTDVATL;DGTDVATLDAR;ATLDARAQQAV;TLDARAQQAVC;RAQQAVCSVVF;AVCSVVFQHPY;CSVVFQHPYLF;SVVFQHPYLFH;FQHPYLFHGTI;YLFHGTIRDNV;LFHGTIRDNVF;GASDDQFAQAV;ASDDQFAQAVR;DQFAQAVRLAR;AVRLARVDELI;RLARVDELIAR;RLPDGANTIVG;NTIVGEAGSAL;EAGSALSGGER;SALSGGERQRV;RQRVSIARALL;QRVSIARALLK;IARALLKAAPV;ALLKAAPVLLV;KAAPVLLVDEA;VLLVDEATSAL;TSALDAENEAA;SALDAENEAAV;ALDAENEAAVV;AENEAAVVDAL;AVVDALAADPR;LAADPRSRTRV;DPRSRTRVIVA;RSRTRVIVAHR;RTRVIVAHRLA;RVIVAHRLASI;VIVAHRLASIR;IVAHRLASIRH;HRLASIRHADR;RLASIRHADRV;SIRHADRVLFV;RVLFVDDGRVV;RVVEDGSISEL;VVEDGSISELL;SISELLTAGGR;ELLTAGGRFSQ;LLTAGGRFSQF;LTAGGRFSQFW;TAGGRFSQFWR;GRFSQFWRQQH;SQFWRQQHEAA;FWRQQHEAAEW;RQQHEAAEWQI;QQHEAAEWQIL<br><br>13 mers:<br>MIRTWIALVPNDH;IRTWIALVPNDHR;RTWIALVPNDHRA;TWIALVPNDHRAR;WIALVPNDHRARL;IALVPNDHRARLI;ALVPNDHRARLIG;LVPNDHRARLIGF;VPNDHRARLIGFA;PNDHRARLIGFAL;NDHRARLIGFALL;DHRARLIGFALLA;HRARLIGFALLAF;RARLIGFALLAFC;ARLIGFALLAFCS;RLIGFALLAFCSV;LIGFALLAFCSVV;IGFALLAFCSVVA;GFALLAFCSVVAR;FALLAFCSVVARA;ALLAFCSVVARAV;LLAFCSVVARAVG;LAFCSVVARAVGT;AFCSVVARAVGTV;FCSVVARAVGTVL;CSVVARAVGTVLL;SVVARAVGTVLLV;VVARAVGTVLLVP;VARAVGTVLLVPL;ARAVGTVLLVPLM;RAVGTVLLVPLMA;AVGTVLLVPLMAA;VGTVLLVPLMAAL;GTVLLVPLMAALF;TVLLVPLMAALFG;VLLVPLMAALFGE;LLVPLMAALFGEA;LVPLMAALFGEAP;VPLMAALFGEAPQ;PLMAALFGEAPQR;LMAALFGEAPQRA;MAALFGEAPQRAW;AALFGEAPQRAWL;ALFGEAPQRAWLW;LFGEAPQRAWLWL;FGEAPQRAWLWLG;GEAPQRAWLWLGW;EAPQRAWLWLGWL;APQRAWLWLGWLS;PQRAWLWLGWLSA;QRAWLWLGWLSAA;RAWLWLGWLSAAT;AWLWLGWLSAATV;WLWLGWLSAATVA;LWLGWLSAATVAG;WLGWLSAATVAGW;LGWLSAATVAGWV;GWLSAATVAGWVL;WLSAATVAGWVLD;LSAATVAGWVLDA;SAATVAGWVLDAV;AATVAGWVLDAVT;ATVAGWVLDAVTA;TVAGWVLDAVTAR;VAGWVLDAVTARI;AGWVLDAVTARIG;GWVLDAVTARIGI;WVLDAVTARIGIE;VLDAVTARIGIEL;LDAVTARIGIELG;DAVTARIGIELGF;AVTARIGIELGFA;VTARIGIELGFAV;TARIGIELGFAVL;ARIGIELGFAVLN;RIGIELGFAVLNH;IGIELGFAVLNHT;GIELGFAVLNHTQ;IELGFAVLNHTQH;ELGFAVLNHTQHD;LGFAVLNHTQHDV;GFAVLNHTQHDVA;FAVLNHTQHDVAD;AVLNHTQHDVADR;VLNHTQHDVADRL;LNHTQHDVADRLP;NHTQHDVADRLPV;HTQHDVADRLPVV;TQHDVADRLPVVR;QHDVADRLPVVRL;HDVADRLPVVRLD;DVADRLPVVRLDW;VADRLPVVRLDWF;ADRLPVVRLDWFT;DRLPVVRLDWFTA;RLPVVRLDWFTAE;LPVVRLDWFTAEN;PVVRLDWFTAENT;VVRLDWFTAENTA;VRLDWFTAENTAT;RLDWFTAENTATA;LDWFTAENTATAR;DWFTAENTATARQ;WFTAENTATARQA;FTAENTATARQAI;TAENTATARQAIA;AENTATARQAIAA;ENTATARQAIAAT;NTATARQAIAATG;TATARQAIAATGP;ATARQAIAATGPE;TARQAIAATGPEL;ARQAIAATGPELV;RQAIAATGPELVG;QAIAATGPELVGL;AIAATGPELVGLV;IAATGPELVGLVV;AATGPELVGLVVN;ATGPELVGLVVNL;TGPELVGLVVNLV;GPELVGLVVNLVT;PELVGLVVNLVTP;ELVGLVVNLVTPL;LVGLVVNLVTPLT;VGLVVNLVTPLTS;GLVVNLVTPLTSA;LVVNLVTPLTSAI;VVNLVTPLTSAIL;VNLVTPLTSAILL;NLVTPLTSAILLP;LVTPLTSAILLPA;VTPLTSAILLPAV;TPLTSAILLPAVI;PLTSAILLPAVIA;LTSAILLPAVIAL;TSAILLPAVIALA;SAILLPAVIALAL;AILLPAVI | |

Fig. 30 continued

| | | |
|---|---|---|
| | ALALL;ILLPAVIALALLP;LLPAVIALALLPI;LPAVIALALLPIS;PAVIALALLPISW;AVIALALLPISWQ;VIALALLPISWQL;IALALLPISWQLG;ALALLPISWQLGV;LALLPISWQLGVA;ALLPISWQLGVAA;LLPISWQLGVAAL;LPISWQLGVAALA;PISWQLGVAALAG;ISWQLGVAALAGV;SWQLGVAALAGVP;WQLGVAALAGVPL;QLGVAALAGVPLL;LGVAALAGVPLLL;GVAALAGVPLLLG;VAALAGVPLLLGA;AALAGVPLLLGAL;ALAGVPLLLGALW;LAGVPLLLGALWA;AGVPLLLGALWAS;GVPLLLGALWASA;VPLLLGALWASAA;PLLLGALWASAAF;LLLGALWASAAFA;LLGALWASAAFAR;LGALWASAAFARR;GALWASAAFARRA;ALWASAAFARRAD;LWASAAFARRADT;WASAAFARRADTA;ASAAFARRADTAA;SAAFARRADTAAD;AAFARRADTAADK;AFARRADTAADKA;FARRADTAADKAN;ARRADTAADKANT;RRADTAADKANTA;RADTAADKANTAL;ADTAADKANTALT;DTAADKANTALTE;TAADKANTALTER;AADKANTALTERI;ADKANTALTERII;DKANTALTERIIE;KANTALTERIIEF;ANTALTERIIEFA;NTALTERIIEFAR;TALTERIIEFART;ALTERIIEFARTQ;LTERIIEFARTQQ;TERIIEFARTQQA;ERIIEFARTQQAL;RIIEFARTQQALR;IIEFARTQQALRA;IEFARTQQALRAA;EFARTQQALRAAR;FARTQQALRAARR;ARTQQALRAARRV;RTQQALRAARRVE;TQQALRAARRVEP;QQALRAARRVEPA;QALRAARRVEPAR;ALRAARRVEPARS;LRAARRVEPARSL;RAARRVEPARSLV;AARRVEPARSLVG;ARRVEPARSLVGN;RRVEPARSLVGNA;RVEPARSLVGNAL;VEPARSLVGNALA;EPARSLVGNALAS;PARSLVGNALASQ;ARSLVGNALASQH;RSLVGNALASQHT;SLVGNALASQHTA;LVGNALASQHTAT;VGNALASQHTATM;GNALASQHTATMR;NALASQHTATMRL;ALASQHTATMRLL;LASQHTATMRLLG;ASQHTATMRLLGM;SQHTATMRLLGMQ;QHTATMRLLGMQI;HTATMRLLGMQIP;TATMRLLGMQIPG;ATMRLLGMQIPGQ;TMRLLGMQIPGQL;MRLLGMQIPGQLL;RLLGMQIPGQLLF;LLGMQIPGQLLFS;LGMQIPGQLLFSI;GMQIPGQLLFSIA;MQIPGQLLFSIAS;QIPGQLLFSIASQ;IPGQLLFSIASQL;PGQLLFSIASQLA;GQLLFSIASQLAL;QLLFSIASQLALI;LLFSIASQLALIV;LFSIASQLALIVL;FSIASQLALIVLA;SIASQLALIVLAG;IASQLALIVLAGT;ASQLALIVLAGTT;SQLALIVLAGTTA;QLALIVLAGTTAA;LALIVLAGTTAAL;ALIVLAGTTAALT;LIVLAGTTAALTI;IVLAGTTAALTIT;VLAGTTAALTITG;LAGTTAALTITGT;AGTTAALTITGTL;GTTAALTITGTLT;TTAALTITGTLTV;TAALTITGTLTVP;AALTITGTLTVPE;ALTITGTLTVPEA;LTITGTLTVPEAI;TITGTLTVPEAIA;ITGTLTVPEAIAL;TGTLTVPEAIALI;GTLTVPEAIALIV;TLTVPEAIALIVV;LTVPEAIALIVVM;TVPEAIALIVVMV;VPEAIALIVVMVR;PEAIALIVVMVRY;EAIALIVVMVRYL;AIALIVVMVRYLE;IALIVVMVRYLEP;ALIVVMVRYLEPF;LIVVMVRYLEPFT;IVVMVRYLEPFTA;VVMVRYLEPFTAV;VMVRYLEPFTAVS;MVRYLEPFTAVSE;VRYLEPFTAVSEL;RYLEPFTAVSELA;YLEPFTAVSELAP;LEPFTAVSELAPA;EPFTAVSELAPAL;PFTAVSELAPALE;FTAVSELAPALES;TAVSELAPALEST;AVSELAPALESTR;VSELAPALESTRA;SELAPALESTRAT;ELAPALESTRATL;LAPALESTRATLG;APALESTRATLGR;PALESTRATLGRI;ALESTRATLGRIG;LESTRATLGRIGS;ESTRATLGRIGSV;STRATLGRIGSVL;TRATLGRIGSVLT;RATLGRIGSVLTA;ATLGRIGSVLTAP;TLGRIGSVLTAPV;LGRIGSVLTAPVM;GRIGSVLTAPVMV;RIGSVLTAPVMVA;IGSVLTAPVMVAG;GSVLTAPVMVAGS;SVLTAPVMVAGSG;VLTAPVMVAGSGT;LTAPVMVAGSGTW;TAPVMVAGSGTWR;APVMVAGSGTWRD;PVMVAGSGTWRDG;VMVAGSGTWRDGA;MVAGSGTWRDGAV;VAGSGTWRDGAVV;AGSGTWRDGAVVP;GSGTWRDGAVVPR;SGTWRDGAVVPRI;GTWRDGAVVPRIE;TWRDGAVVPRIEF;WRDGAVVPRIEFD;RDGAVVPRIEFDD;DGAVVPRIEFDDV;GAVVPRIEFDDVA;AVVPRIEFDDVAF;VVPRIEFDDVAFG;VPRIEFDDVAFGY;PRIEFDDVAFGYD;RIEFDDVAFGYDG;IEFDDVAFGYDGG;EFDDVAFGYDGGS;FDDVAFGYDGGSG;DDVAFGYDGGSGP;DVAFGYDGGSGPV;VAFGYDGGSGPVL;AFGYDGGSGPVLD;FGYDGGSGPVLDG;GYDGGSGPVLDGV;YDGGSGPVLDGVS;DGGSGPVLDGVSF;GGSG | |

Fig. 30 continued

| | | |
|---|---|---|
| | PVLDGVSFC;GSGPVLDGVSFCL;SGPVLDGVSFCLQ;GPVLDGVSFCLQP;PVLDGVSFCLQPG;VLDGVSFCLQPGT;LDGVSFCLQPGTT;DGVSFCLQPGTTT;GVSFCLQPGTTTA;VSFCLQPGTTTAI;SFCLQPGTTTAIV;FCLQPGTTTAIVG;CLQPGTTTAIVGP;LQPGTTTAIVGPS;QPGTTTAIVGPSG;PGTTTAIVGPSGC;GTTTAIVGPSGCG;TTTAIVGPSGCGK;TTAIVGPSGCGKS;TAIVGPSGCGKST;AIVGPSGCGKSTI;IVGPSGCGKSTIL;VGPSGCGKSTILA;GPSGCGKSTILAL;PSGCGKSTILALI;SGCGKSTILALIA;GCGKSTILALIAG;CGKSTILALIAGL;GKSTILALIAGLH;KSTILALIAGLHQ;STILALIAGLHQP;TILALIAGLHQPT;ILALIAGLHQPTR;LALIAGLHQPTRG;ALIAGLHQPTRGR;LIAGLHQPTRGRV;IAGLHQPTRGRVL;AGLHQPTRGRVLI;GLHQPTRGRVLID;LHQPTRGRVLIDG;HQPTRGRVLIDGT;QPTRGRVLIDGTD;PTRGRVLIDGTDV;TRGRVLIDGTDVA;RGRVLIDGTDVAT;GRVLIDGTDVATL;RVLIDGTDVATLD;VLIDGTDVATLDA;LIDGTDVATLDAR;IDGTDVATLDARA;DGTDVATLDARAQ;GTDVATLDARAQQ;TDVATLDARAQQA;DVATLDARAQQAV;VATLDARAQQAVC;ATLDARAQQAVCS;TLDARAQQAVCSV;LDARAQQAVCSVV;DARAQQAVCSVVF;ARAQQAVCSVVFQ;RAQQAVCSVVFQH;AQQAVCSVVFQHP;QQAVCSVVFQHPY;QAVCSVVFQHPYL;AVCSVVFQHPYLF;VCSVVFQHPYLFH;CSVVFQHPYLFHG;SVVFQHPYLFHGT;VVFQHPYLFHGTI;VFQHPYLFHGTIR;FQHPYLFHGTIRD;QHPYLFHGTIRDN;HPYLFHGTIRDNV;PYLFHGTIRDNVF;YLFHGTIRDNVFA;LFHGTIRDNVFAA;FHGTIRDNVFAAD;HGTIRDNVFAADP;GTIRDNVFAADPG;TIRDNVFAADPGA;IRDNVFAADPGAS;RDNVFAADPGASD;DNVFAADPGASDD;NVFAADPGASDDQ;VFAADPGASDDQF;FAADPGASDDQFA;AADPGASDDQFAQ;ADPGASDDQFAQA;DPGASDDQFAQAV;PGASDDQFAQAVR;GASDDQFAQAVRL;ASDDQFAQAVRLA;SDDQFAQAVRLAR;DDQFAQAVRLARV;DQFAQAVRLARVD;QFAQAVRLARVDE;FAQAVRLARVDEL;AQAVRLARVDELI;QAVRLARVDELIA;AVRLARVDELIAR;VRLARVDELIARL;RLARVDELIARLP;LARVDELIARLPD;ARVDELIARLPDG;RVDELIARLPDGA;VDELIARLPDGAN;DELIARLPDGANT;ELIARLPDGANTI;LIARLPDGANTIV;IARLPDGANTIVG;ARLPDGANTIVGE;RLPDGANTIVGEA;LPDGANTIVGEAG;PDGANTIVGEAGS;DGANTIVGEAGSA;GANTIVGEAGSAL;ANTIVGEAGSALS;NTIVGEAGSALSG;TIVGEAGSALSGG;IVGEAGSALSGGE;VGEAGSALSGGER;GEAGSALSGGERQ;EAGSALSGGERQR;AGSALSGGERQRV;GSALSGGERQRVS;SALSGGERQRVSI;ALSGGERQRVSIA;LSGGERQRVSIAR;SGGERQRVSIARA;GGERQRVSIARAL;GERQRVSIARALL;ERQRVSIARALLK;RQRVSIARALLKA;QRVSIARALLKAA;RVSIARALLKAAP;VSIARALLKAAPV;SIARALLKAAPVL;IARALLKAAPVLL;ARALLKAAPVLLV;RALLKAAPVLLVD;ALLKAAPVLLVDE;LLKAAPVLLVDEA;LKAAPVLLVDEAT;KAAPVLLVDEATS;AAPVLLVDEATSA;APVLLVDEATSAL;PVLLVDEATSALD;VLLVDEATSALDA;LLVDEATSALDAE;LVDEATSALDAEN;VDEATSALDAENE;DEATSALDAENEA;EATSALDAENEAA;ATSALDAENEAAV;TSALDAENEAAVV;SALDAENEAAVVD;ALDAENEAAVVDA;LDAENEAAVVDAL;DAENEAAVVDALA;AENEAAVVDALAA;ENEAAVVDALAAD;NEAAVVDALAADP;EAAVVDALAADPR;AAVVDALAADPRS;AVVDALAADPRSR;VVDALAADPRSRT;VDALAADPRSRTR;DALAADPRSRTRV;ALAADPRSRTRVI;LAADPRSRTRVIV;AADPRSRTRVIVA;ADPRSRTRVIVAH;DPRSRTRVIVAHR;PRSRTRVIVAHRL;RSRTRVIVAHRLA;SRTRVIVAHRLAS;RTRVIVAHRLASI;TRVIVAHRLASIR;RVIVAHRLASIRH;VIVAHRLASIRHA;IVAHRLASIRHAD;VAHRLASIRHADR;AHRLASIRHADRV;HRLASIRHADRVL;RLASIRHADRVLF;LASIRHADRVLFV;ASIRHADRVLFVD;SIRHADRVLFVDD;IRHADRVLFVDDG;RHADRVLFVDDGR;HADRVLFVDDGRV;ADRVLFVDDGRVV;DRVLFVDDGRVVE;RVLFVDDGRVVED;VLFVDDGRVVEDG;LFVDDGRVVEDGS;FVDDGRVVEDGSI;VDDGRVVEDGSIS;DDGRVVEDGSISE;DGRVVEDGSISEL;GRVVEDGSISELL;RVVEDGSISELLT;VVEDGSISELL | |

Fig. 30 continued

| | | |
|---|---|---|
| | TA;VEDGSISELLTAG;EDGSISELLTAGG;DGSISELLTAGGR;GSISELLTAGGRF;SISELLTAGGRFS;ISELLTAGGRFSQ;SELLTAGGRFSQF;ELLTAGGRFSQFW;LLTAGGRFSQFWR;LTAGGRFSQFWRQ;TAGGRFSQFWRQQ;AGGRFSQFWRQQH;GGRFSQFWRQQHE;GRFSQFWRQQHEA;RFSQFWRQQHEAA;FSQFWRQQHEAAE;SQFWRQQHEAAEW;QFWRQQHEAAEWQ;FWRQQHEAAEWQI;WRQQHEAAEWQIL;RQQHEAAEWQILA;QQHEAAEWQILAE;<br><br>14 mers:<br>MIRTWIALVPNDHR;IRTWIALVPNDHRA;RTWIALVPNDHRAR;TWIALVPNDHRARL;WIALVPNDHRARLI;IALVPNDHRARLIG;ALVPNDHRARLIGF;LVPNDHRARLIGFA;VPNDHRARLIGFAL;PNDHRARLIGFALL;NDHRARLIGFALLA;DHRARLIGFALLAF;HRARLIGFALLAFC;RARLIGFALLAFCS;ARLIGFALLAFCSV;RLIGFALLAFCSVV;LIGFALLAFCSVVA;IGFALLAFCSVVAR;GFALLAFCSVVARA;FALLAFCSVVARAV;ALLAFCSVVARAVG;LLAFCSVVARAVGT;LAFCSVVARAVGTV;AFCSVVARAVGTVL;FCSVVARAVGTVLL;CSVVARAVGTVLLV;SVVARAVGTVLLVP;VVARAVGTVLLVPL;VARAVGTVLLVPLM;ARAVGTVLLVPLMA;RAVGTVLLVPLMAA;AVGTVLLVPLMAAL;VGTVLLVPLMAALF;GTVLLVPLMAALFG;TVLLVPLMAALFGE;VLLVPLMAALFGEA;LLVPLMAALFGEAP;LVPLMAALFGEAPQ;VPLMAALFGEAPQR;PLMAALFGEAPQRA;LMAALFGEAPQRAW;MAALFGEAPQRAWL;AALFGEAPQRAWLW;ALFGEAPQRAWLWL;LFGEAPQRAWLWLG;FGEAPQRAWLWLGW;GEAPQRAWLWLGWL;EAPQRAWLWLGWLS;APQRAWLWLGWLSA;PQRAWLWLGWLSAA;QRAWLWLGWLSAAT;RAWLWLGWLSAATV;AWLWLGWLSAATVA;WLWLGWLSAATVAG;LWLGWLSAATVAGW;WLGWLSAATVAGWV;LGWLSAATVAGWVL;GWLSAATVAGWVLD;WLSAATVAGWVLDA;LSAATVAGWVLDAV;SAATVAGWVLDAVT;AATVAGWVLDAVTA;ATVAGWVLDAVTAR;TVAGWVLDAVTARI;VAGWVLDAVTARIG;AGWVLDAVTARIGI;GWVLDAVTARIGIE;WVLDAVTARIGIEL;VLDAVTARIGIELG;LDAVTARIGIELGF;DAVTARIGIELGFA;AVTARIGIELGFAV;VTARIGIELGFAVL;TARIGIELGFAVLN;ARIGIELGFAVLNH;RIGIELGFAVLNHT;IGIELGFAVLNHTQ;GIELGFAVLNHTQH;IELGFAVLNHTQHD;ELGFAVLNHTQHDV;LGFAVLNHTQHDVA;GFAVLNHTQHDVAD;FAVLNHTQHDVADR;AVLNHTQHDVADRL;VLNHTQHDVADRLP;LNHTQHDVADRLPV;NHTQHDVADRLPVV;HTQHDVADRLPVVR;TQHDVADRLPVVRL;QHDVADRLPVVRLD;HDVADRLPVVRLDW;DVADRLPVVRLDWF;VADRLPVVRLDWFT;ADRLPVVRLDWFTA;DRLPVVRLDWFTAE;RLPVVRLDWFTAEN;LPVVRLDWFTAENT;PVVRLDWFTAENTA;VVRLDWFTAENTAT;VRLDWFTAENTATA;RLDWFTAENTATAR;LDWFTAENTATARQ;DWFTAENTATARQA;WFTAENTATARQAI;FTAENTATARQAIA;TAENTATARQAIAA;AENTATARQAIAAT;ENTATARQAIAATG;NTATARQAIAATGP;TATARQAIAATGPE;ATARQAIAATGPEL;TARQAIAATGPELV;ARQAIAATGPELVG;RQAIAATGPELVGL;QAIAATGPELVGLV;AIAATGPELVGLVV;IAATGPELVGLVVN;AATGPELVGLVVNL;ATGPELVGLVVNLV;TGPELVGLVVNLVT;GPELVGLVVNLVTP;PELVGLVVNLVTPL;ELVGLVVNLVTPLT;LVGLVVNLVTPLTS;VGLVVNLVTPLTSA;GLVVNLVTPLTSAI;LVVNLVTPLTSAIL;VVNLVTPLTSAILL;VNLVTPLTSAILLP;NLVTPLTSAILLPA;LVTPLTSAILLPAV;VTPLTSAILLPAVI;TPLTSAILLPAVIA;PLTSAILLPAVIAL;LTSAILLPAVIALA;TSAILLPAVIALAL;SAILLPAVIALALL;AILLPAVIALALLP;ILLPAVIALALLPI;LLPAVIALALLPIS;LPAVIALALLPISW;PAVIALALLPISWQ;AVIALALLPISWQL;VIALALLPISWQLG;IALALLPISWQLGV;ALALLPISWQLGVA;LALLPISWQLGVAA;ALLPISWQLGVAAL;LLPISWQLGVAALA;LPISWQLGVAALAG;PISWQLGVAALAGV;ISWQLGVAALAGVP;SWQLGVAALAGVPL;WQLGVAALAGVPLL;QLGVAALAGVPLLL;LGVAALAGVPLLLG;GVAALAGVPLLLGA;VAAL | |

Fig. 30 continued

| | | |
|---|---|---|
| | AGVPLLLGAL;AALAGVPLLLGALW;ALAGVPLLLGALWA;LAGVPLLLGALWAS;AGVPLLLGALWASA;GVPLLLGALWASAA;VPLLLGALWASAAF;PLLLGALWASAAFA;LLLGALWASAAFAR;LLGALWASAAFARR;LGALWASAAFARRA;GALWASAAFARRAD;ALWASAAFARRADT;LWASAAFARRADTA;WASAAFARRADTAA;ASAAFARRADTAAD;SAAFARRADTAADK;AAFARRADTAADKA;AFARRADTAADKAN;FARRADTAADKANT;ARRADTAADKANTA;RRADTAADKANTAL;RADTAADKANTALT;ADTAADKANTALTE;DTAADKANTALTER;TAADKANTALTERI;AADKANTALTERII;ADKANTALTERIIE;DKANTALTERIIEF;KANTALTERIIEFA;ANTALTERIIEFAR;NTALTERIIEFART;TALTERIIEFARTQ;ALTERIIEFARTQQ;LTERIIEFARTQQA;TERIIEFARTQQAL;ERIIEFARTQQALR;RIIEFARTQQALRA;IIEFARTQQALRAA;IEFARTQQALRAAR;EFARTQQALRAARR;FARTQQALRAARRV;ARTQQALRAARRVE;RTQQALRAARRVEP;TQQALRAARRVEPA;QQALRAARRVEPAR;QALRAARRVEPARS;ALRAARRVEPARSL;LRAARRVEPARSLV;RAARRVEPARSLVG;AARRVEPARSLVGN;ARRVEPARSLVGNA;RRVEPARSLVGNAL;RVEPARSLVGNALA;VEPARSLVGNALAS;EPARSLVGNALASQ;PARSLVGNALASQH;ARSLVGNALASQHT;RSLVGNALASQHTA;SLVGNALASQHTAT;LVGNALASQHTATM;VGNALASQHTATMR;GNALASQHTATMRL;NALASQHTATMRLL;ALASQHTATMRLLG;LASQHTATMRLLGM;ASQHTATMRLLGMQ;SQHTATMRLLGMQI;QHTATMRLLGMQIP;HTATMRLLGMQIPG;TATMRLLGMQIPGQ;ATMRLLGMQIPGQL;TMRLLGMQIPGQLL;MRLLGMQIPGQLLF;RLLGMQIPGQLLFS;LLGMQIPGQLLFSI;LGMQIPGQLLFSIA;GMQIPGQLLFSIAS;MQIPGQLLFSIASQ;QIPGQLLFSIASQL;IPGQLLFSIASQLA;PGQLLFSIASQLAL;GQLLFSIASQLALI;QLLFSIASQLALIV;LLFSIASQLALIVL;LFSIASQLALIVLA;FSIASQLALIVLAG;SIASQLALIVLAGT;IASQLALIVLAGTT;ASQLALIVLAGTTA;SQLALIVLAGTTAA;QLALIVLAGTTAAL;LALIVLAGTTAALT;ALIVLAGTTAALTI;LIVLAGTTAALTIT;IVLAGTTAALTITG;VLAGTTAALTITGT;LAGTTAALTITGTL;AGTTAALTITGTLT;GTTAALTITGTLTV;TTAALTITGTLTVP;TAALTITGTLTVPE;AALTITGTLTVPEA;ALTITGTLTVPEAI;LTITGTLTVPEAIA;TITGTLTVPEAIAL;ITGTLTVPEAIALI;TGTLTVPEAIALIV;GTLTVPEAIALIVV;TLTVPEAIALIVVM;LTVPEAIALIVVMV;TVPEAIALIVVMVR;VPEAIALIVVMVRY;PEAIALIVVMVRYL;EAIALIVVMVRYLE;AIALIVVMVRYLEP;IALIVVMVRYLEPF;ALIVVMVRYLEPFT;LIVVMVRYLEPFTA;IVVMVRYLEPFTAV;VVMVRYLEPFTAVS;VMVRYLEPFTAVSE;MVRYLEPFTAVSEL;VRYLEPFTAVSELA;RYLEPFTAVSELAP;YLEPFTAVSELAPA;LEPFTAVSELAPAL;EPFTAVSELAPALE;PFTAVSELAPALES;FTAVSELAPALEST;TAVSELAPALESTR;AVSELAPALESTRA;VSELAPALESTRAT;SELAPALESTRATL;ELAPALESTRATLG;LAPALESTRATLGR;APALESTRATLGRI;PALESTRATLGRIG;ALESTRATLGRIGS;LESTRATLGRIGSV;ESTRATLGRIGSVL;STRATLGRIGSVLT;TRATLGRIGSVLTA;RATLGRIGSVLTAP;ATLGRIGSVLTAPV;TLGRIGSVLTAPVM;LGRIGSVLTAPVMV;GRIGSVLTAPVMVA;RIGSVLTAPVMVAG;IGSVLTAPVMVAGS;GSVLTAPVMVAGSG;SVLTAPVMVAGSGT;VLTAPVMVAGSGTW;LTAPVMVAGSGTWR;TAPVMVAGSGTWRD;APVMVAGSGTWRDG;PVMVAGSGTWRDGA;VMVAGSGTWRDGAV;MVAGSGTWRDGAVV;VAGSGTWRDGAVVP;AGSGTWRDGAVVPR;GSGTWRDGAVVPRI;SGTWRDGAVVPRIE;GTWRDGAVVPRIEF;TWRDGAVVPRIEFD;WRDGAVVPRIEFDD;RDGAVVPRIEFDDV;DGAVVPRIEFDDVA;GAVVPRIEFDDVAF;AVVPRIEFDDVAFG;VVPRIEFDDVAFGY;VPRIEFDDVAFGYD;PRIEFDDVAFGYDG;RIEFDDVAFGYDGG;IEFDDVAFGYDGGS;EFDDVAFGYDGGSG;FDDVAFGYDGGSGP;DDVAFGYDGGSGPV;DVAFGYDGGSGPVL;VAFGYDGGSGPVLD;AFGYDGGSGPVLDG;FGYDGGSGPVLDGV;GYDGGSGPVLDGVS;YDGGSGPVLDGVSF;DGGSGPVLDGVSFC;GGSGPVLDGVSFCL;GSGPVLDGVSFCLQ;SGPVLDGVSFCLQP;GPVLDGVSFCLQPG;PVLDGVSFCLQPGT; | |

Fig. 30 continued

| | | |
|---|---|---|
| | VLDGVSFCLQPGTT;LDGVSFCLQPGTTT;DGVSFCLQPGTTTA;GVSFCLQPGTTTAI;VSFCLQPGTTTAIV;SFCLQPGTTTAIVG;FCLQPGTTTAIVGP;CLQPGTTTAIVGPS;LQPGTTTAIVGPSG;QPGTTTAIVGPSGC;PGTTTAIVGPSGCG;GTTTAIVGPSGCGK;TTTAIVGPSGCGKS;TTAIVGPSGCGKST;TAIVGPSGCGKSTI;AIVGPSGCGKSTIL;IVGPSGCGKSTILA;VGPSGCGKSTILAL;GPSGCGKSTILALI;PSGCGKSTILALIA;SGCGKSTILALIAG;GCGKSTILALIAGL;CGKSTILALIAGLH;GKSTILALIAGLHQ;KSTILALIAGLHQP;STILALIAGLHQPT;TILALIAGLHQPTR;ILALIAGLHQPTRG;LALIAGLHQPTRGR;ALIAGLHQPTRGRV;LIAGLHQPTRGRVL;IAGLHQPTRGRVLI;AGLHQPTRGRVLID;GLHQPTRGRVLIDG;LHQPTRGRVLIDGT;HQPTRGRVLIDGTD;QPTRGRVLIDGTDV;PTRGRVLIDGTDVA;TRGRVLIDGTDVAT;RGRVLIDGTDVATL;GRVLIDGTDVATLD;RVLIDGTDVATLDA;VLIDGTDVATLDAR;LIDGTDVATLDARA;IDGTDVATLDARAQ;DGTDVATLDARAQQ;GTDVATLDARAQQA;TDVATLDARAQQAV;DVATLDARAQQAVC;VATLDARAQQAVCS;ATLDARAQQAVCSV;TLDARAQQAVCSVV;LDARAQQAVCSVVF;DARAQQAVCSVVFQ;ARAQQAVCSVVFQH;RAQQAVCSVVFQHP;AQQAVCSVVFQHPY;QQAVCSVVFQHPYL;QAVCSVVFQHPYLF;AVCSVVFQHPYLFH;VCSVVFQHPYLFHG;CSVVFQHPYLFHGT;SVVFQHPYLFHGTI;VVFQHPYLFHGTIR;VFQHPYLFHGTIRD;FQHPYLFHGTIRDN;QHPYLFHGTIRDNV;HPYLFHGTIRDNVF;PYLFHGTIRDNVFA;YLFHGTIRDNVFAA;LFHGTIRDNVFAAD;FHGTIRDNVFAADP;HGTIRDNVFAADPG;GTIRDNVFAADPGA;TIRDNVFAADPGAS;IRDNVFAADPGASD;RDNVFAADPGASDD;DNVFAADPGASDDQ;NVFAADPGASDDQF;VFAADPGASDDQFA;FAADPGASDDQFAQ;AADPGASDDQFAQA;ADPGASDDQFAQAV;DPGASDDQFAQAVR;PGASDDQFAQAVRL;GASDDQFAQAVRLA;ASDDQFAQAVRLAR;SDDQFAQAVRLARV;DDQFAQAVRLARVD;DQFAQAVRLARVDE;QFAQAVRLARVDEL;FAQAVRLARVDELI;AQAVRLARVDELIA;QAVRLARVDELIAR;AVRLARVDELIARL;VRLARVDELIARLP;RLARVDELIARLPD;LARVDELIARLPDG;ARVDELIARLPDGA;RVDELIARLPDGAN;VDELIARLPDGANT;DELIARLPDGANTI;ELIARLPDGANTIV;LIARLPDGANTIVG;IARLPDGANTIVGE;ARLPDGANTIVGEA;RLPDGANTIVGEAG;LPDGANTIVGEAGS;PDGANTIVGEAGSA;DGANTIVGEAGSAL;GANTIVGEAGSALS;ANTIVGEAGSALSG;NTIVGEAGSALSGG;TIVGEAGSALSGGE;IVGEAGSALSGGER;VGEAGSALSGGERQ;GEAGSALSGGERQR;EAGSALSGGERQRV;AGSALSGGERQRVS;GSALSGGERQRVSI;SALSGGERQRVSIA;ALSGGERQRVSIAR;LSGGERQRVSIARA;SGGERQRVSIARAL;GGERQRVSIARALL;GERQRVSIARALLK;ERQRVSIARALLKA;RQRVSIARALLKAA;QRVSIARALLKAAP;RVSIARALLKAAPV;VSIARALLKAAPVL;SIARALLKAAPVLL;IARALLKAAPVLLV;ARALLKAAPVLLVD;RALLKAAPVLLVDE;ALLKAAPVLLVDEA;LLKAAPVLLVDEAT;LKAAPVLLVDEATS;KAAPVLLVDEATSA;AAPVLLVDEATSAL;APVLLVDEATSALD;PVLLVDEATSALDA;VLLVDEATSALDAE;LLVDEATSALDAEN;LVDEATSALDAENE;VDEATSALDAENEA;DEATSALDAENEAA;EATSALDAENEAAV;ATSALDAENEAAVV;TSALDAENEAAVVD;SALDAENEAAVVDA;ALDAENEAAVVDAL;LDAENEAAVVDALA;DAENEAAVVDALAA;AENEAAVVDALAAD;ENEAAVVDALAADP;NEAAVVDALAADPR;EAAVVDALAADPRS;AAVVDALAADPRSR;AVVDALAADPRSRT;VVDALAADPRSRTR;VDALAADPRSRTRV;DALAADPRSRTRVI;ALAADPRSRTRVIV;LAADPRSRTRVIVA;AADPRSRTRVIVAH;ADPRSRTRVIVAHR;DPRSRTRVIVAHRL;PRSRTRVIVAHRLA;RSRTRVIVAHRLAS;SRTRVIVAHRLASI;RTRVIVAHRLASIR;TRVIVAHRLASIRH;RVIVAHRLASIRHA;VIVAHRLASIRHAD;IVAHRLASIRHADR;VAHRLASIRHADRV;AHRLASIRHADRVL;HRLASIRHADRVLF;RLASIRHADRVLFV;LASIRHADRVLFVD;ASIRHADRVLFVDD;SIRHADRVLFVDDG;IRHADRVLFVDDGR;RHADRVLFVDDGRV;HADRVLFVDDGRVV;ADRVLFVDDGRVVE;DRVLFVDDGRVVED;RVLFVDDGRVV | |

Fig. 30 continued

EDG;VLFVDDGRVVEDGS;LFVDDGRVVEDGSI;FVDDGRVVEDGSIS;VDDGRVVEDGSISE;DDGRVVEDGSISEL;DGRVVEDGSISELL;GRVVEDGSISELLT;RVVEDGSISELLTA;VVEDGSISELLTAG;VEDGSISELLTAGG;EDGSISELLTAGGR;DGSISELLTAGGRF;GSISELLTAGGRFS;SISELLTAGGRFSQ;ISELLTAGGRFSQF;SELLTAGGRFSQFW;ELLTAGGRFSQFWR;LLTAGGRFSQFWRQ;LTAGGRFSQFWRQQ;TAGGRFSQFWRQQH;AGGRFSQFWRQQHE;GGRFSQFWRQQHEA;GRFSQFWRQQHEAA;RFSQFWRQQHEAAE;FSQFWRQQHEAAEW;SQFWRQQHEAAEWQ;QFWRQQHEAAEWQI;FWRQQHEAAEWQIL;WRQQHEAAEWQILA;RQQHEAAEWQILAE;

15 mers:
MIRTWIALVPNDHRA;IRTWIALVPNDHRAR;RTWIALVPNDHRARL;TWIALVPNDHRARLI;WIALVPNDHRARLIG;IALVPNDHRARLIGF;ALVPNDHRARLIGFA;LVPNDHRARLIGFAL;VPNDHRARLIGFALL;PNDHRARLIGFALLA;NDHRARLIGFALLAF;DHRARLIGFALLAFC;HRARLIGFALLAFCS;RARLIGFALLAFCSV;ARLIGFALLAFCSVV;RLIGFALLAFCSVVA;LIGFALLAFCSVVAR;IGFALLAFCSVVARA;GFALLAFCSVVARAV;FALLAFCSVVARAVG;ALLAFCSVVARAVGT;LLAFCSVVARAVGTV;LAFCSVVARAVGTVL;AFCSVVARAVGTVLL;FCSVVARAVGTVLLV;CSVVARAVGTVLLVP;SVVARAVGTVLLVPL;VVARAVGTVLLVPLM;VARAVGTVLLVPLMA;ARAVGTVLLVPLMAA;RAVGTVLLVPLMAAL;AVGTVLLVPLMAALF;VGTVLLVPLMAALFG;GTVLLVPLMAALFGE;TVLLVPLMAALFGEA;VLLVPLMAALFGEAP;LLVPLMAALFGEAPQ;LVPLMAALFGEAPQR;VPLMAALFGEAPQRA;PLMAALFGEAPQRAW;LMAALFGEAPQRAWL;MAALFGEAPQRAWLW;AALFGEAPQRAWLWL;ALFGEAPQRAWLWLG;LFGEAPQRAWLWLGW;FGEAPQRAWLWLGWL;GEAPQRAWLWLGWLS;EAPQRAWLWLGWLSA;APQRAWLWLGWLSAA;PQRAWLWLGWLSAAT;QRAWLWLGWLSAATV;RAWLWLGWLSAATVA;AWLWLGWLSAATVAG;WLWLGWLSAATVAGW;LWLGWLSAATVAGWV;WLGWLSAATVAGWVL;LGWLSAATVAGWVLD;GWLSAATVAGWVLDA;WLSAATVAGWVLDAV;LSAATVAGWVLDAVT;SAATVAGWVLDAVTA;AATVAGWVLDAVTAR;ATVAGWVLDAVTARI;TVAGWVLDAVTARIG;VAGWVLDAVTARIGI;AGWVLDAVTARIGIE;GWVLDAVTARIGIEL;WVLDAVTARIGIELG;VLDAVTARIGIELGF;LDAVTARIGIELGFA;DAVTARIGIELGFAV;AVTARIGIELGFAVL;VTARIGIELGFAVLN;TARIGIELGFAVLNH;ARIGIELGFAVLNHT;RIGIELGFAVLNHTQ;IGIELGFAVLNHTQH;GIELGFAVLNHTQHD;IELGFAVLNHTQHDV;ELGFAVLNHTQHDVA;LGFAVLNHTQHDVAD;GFAVLNHTQHDVADR;FAVLNHTQHDVADRL;AVLNHTQHDVADRLP;VLNHTQHDVADRLPV;LNHTQHDVADRLPVV;NHTQHDVADRLPVVR;HTQHDVADRLPVVRL;TQHDVADRLPVVRLD;QHDVADRLPVVRLDW;HDVADRLPVVRLDWF;DVADRLPVVRLDWFT;VADRLPVVRLDWFTA;ADRLPVVRLDWFTAE;DRLPVVRLDWFTAEN;RLPVVRLDWFTAENT;LPVVRLDWFTAENTA;PVVRLDWFTAENTAT;VVRLDWFTAENTATA;VRLDWFTAENTATAR;RLDWFTAENTATARQ;LDWFTAENTATARQA;DWFTAENTATARQAI;WFTAENTATARQAIA;FTAENTATARQAIAA;TAENTATARQAIAAT;AENTATARQAIAATG;ENTATARQAIAATGP;NTATARQAIAATGPE;TATARQAIAATGPEL;ATARQAIAATGPELV;TARQAIAATGPELVG;ARQAIAATGPELVGL;RQAIAATGPELVGLV;QAIAATGPELVGLVV;AIAATGPELVGLVVN;IAATGPELVGLVVNL;AATGPELVGLVVNLV;ATGPELVGLVVNLVT;TGPELVGLVVNLVTP;GPELVGLVVNLVTPL;PELVGLVVNLVTPLT;ELVGLVVNLVTPLTS;LVGLVVNLVTPLTSA;VGLVVNLVTPLTSAI;GLVVNLVTPLTSAIL;LVVNLVTPLTSAILL;VVNLVTPLTSAILLP;VNLVTPLTSAILLPA;NLVTPLTSAILLPAV;LVTPLTSAILLPAVI;VTPLTSAILLPAVIA;TPLTSAILLPAVIAL;PLTSAILLPAVIALA;LTSAILLPAVIALAL;TSAILLPAVIALALL;SAILLPAVIALALLP;AILLPAVIALALLPI;ILLPAVIALALLPIS;LLPAVIALALLPIS

Fig. 30 continued

| | | |
|---|---|---|
| | W;LPAVIALALLPISWQ;PAVIALALLPISWQL;AVIALALLPISWQLG;VIALALLPISWQLGV;IALALLPISWQLGVA;ALALLPISWQLGVAA;LALLPISWQLGVAAL;ALLPISWQLGVAALA;LLPISWQLGVAALAG;LPISWQLGVAALAGV;PISWQLGVAALAGVP;ISWQLGVAALAGVPL;SWQLGVAALAGVPLL;WQLGVAALAGVPLLL;QLGVAALAGVPLLLG;LGVAALAGVPLLLGA;GVAALAGVPLLLGAL;VAALAGVPLLLGALW;AALAGVPLLLGALWA;ALAGVPLLLGALWAS;LAGVPLLLGALWASA;AGVPLLLGALWASAA;GVPLLLGALWASAAF;VPLLLGALWASAAFA;PLLLGALWASAAFAR;LLLGALWASAAFARR;LLGALWASAAFARRA;LGALWASAAFARRAD;GALWASAAFARRADT;ALWASAAFARRADTA;LWASAAFARRADTAA;WASAAFARRADTAAD;ASAAFARRADTAADK;SAAFARRADTAADKA;AAFARRADTAADKAN;AFARRADTAADKANT;FARRADTAADKANTA;ARRADTAADKANTAL;RRADTAADKANTALT;RADTAADKANTALTE;ADTAADKANTALTER;DTAADKANTALTERI;TAADKANTALTERII;AADKANTALTERIIE;ADKANTALTERIIEF;DKANTALTERIIEFA;KANTALTERIIEFAR;ANTALTERIIEFART;NTALTERIIEFARTQ;TALTERIIEFARTQQ;ALTERIIEFARTQQA;LTERIIEFARTQQAL;TERIIEFARTQQALR;ERIIEFARTQQALRA;RIIEFARTQQALRAA;IIEFARTQQALRAAR;IEFARTQQALRAARR;EFARTQQALRAARRV;FARTQQALRAARRVE;ARTQQALRAARRVEP;RTQQALRAARRVEPA;TQQALRAARRVEPAR;QQALRAARRVEPARS;QALRAARRVEPARSL;ALRAARRVEPARSLV;LRAARRVEPARSLVG;RAARRVEPARSLVGN;AARRVEPARSLVGNA;ARRVEPARSLVGNAL;RRVEPARSLVGNALA;RVEPARSLVGNALAS;VEPARSLVGNALASQ;EPARSLVGNALASQH;PARSLVGNALASQHT;ARSLVGNALASQHTA;RSLVGNALASQHTAT;SLVGNALASQHTATM;LVGNALASQHTATMR;VGNALASQHTATMRL;GNALASQHTATMRLL;NALASQHTATMRLLG;ALASQHTATMRLLGM;LASQHTATMRLLGMQ;ASQHTATMRLLGMQI;SQHTATMRLLGMQIP;QHTATMRLLGMQIPG;HTATMRLLGMQIPGQ;TATMRLLGMQIPGQL;ATMRLLGMQIPGQLL;TMRLLGMQIPGQLLF;MRLLGMQIPGQLLFS;RLLGMQIPGQLLFSI;LLGMQIPGQLLFSIA;LGMQIPGQLLFSIAS;GMQIPGQLLFSIASQ;MQIPGQLLFSIASQL;QIPGQLLFSIASQLA;IPGQLLFSIASQLAL;PGQLLFSIASQLALI;GQLLFSIASQLALIV;QLLFSIASQLALIVL;LLFSIASQLALIVLA;LFSIASQLALIVLAG;FSIASQLALIVLAGT;SIASQLALIVLAGTT;IASQLALIVLAGTTA;ASQLALIVLAGTTAA;SQLALIVLAGTTAAL;QLALIVLAGTTAALT;LALIVLAGTTAALTI;ALIVLAGTTAALTIT;LIVLAGTTAALTITG;IVLAGTTAALTITGT;VLAGTTAALTITGTL;LAGTTAALTITGTLT;AGTTAALTITGTLTV;GTTAALTITGTLTVP;TTAALTITGTLTVPE;TAALTITGTLTVPEA;AALTITGTLTVPEAI;ALTITGTLTVPEAIA;LTITGTLTVPEAIAL;TITGTLTVPEAIALI;ITGTLTVPEAIALIV;TGTLTVPEAIALIVV;GTLTVPEAIALIVVM;TLTVPEAIALIVVMV;LTVPEAIALIVVMVR;TVPEAIALIVVMVRY;VPEAIALIVVMVRYL;PEAIALIVVMVRYLE;EAIALIVVMVRYLEP;AIALIVVMVRYLEPF;IALIVVMVRYLEPFT;ALIVVMVRYLEPFTA;LIVVMVRYLEPFTAV;IVVMVRYLEPFTAVS;VVMVRYLEPFTAVSE;VMVRYLEPFTAVSEL;MVRYLEPFTAVSELA;VRYLEPFTAVSELAP;RYLEPFTAVSELAPA;YLEPFTAVSELAPAL;LEPFTAVSELAPALE;EPFTAVSELAPALES;PFTAVSELAPALEST;FTAVSELAPALESTR;TAVSELAPALESTRA;AVSELAPALESTRAT;VSELAPALESTRATL;SELAPALESTRATLG;ELAPALESTRATLGR;LAPALESTRATLGRI;APALESTRATLGRIG;PALESTRATLGRIGS;ALESTRATLGRIGSV;LESTRATLGRIGSVL;ESTRATLGRIGSVLT;STRATLGRIGSVLTA;TRATLGRIGSVLTAP;RATLGRIGSVLTAPV;ATLGRIGSVLTAPVM;TLGRIGSVLTAPVMV;LGRIGSVLTAPVMVA;GRIGSVLTAPVMVAG;RIGSVLTAPVMVAGS;IGSVLTAPVMVAGSG;GSVLTAPVMVAGSGT;SVLTAPVMVAGSGTW;VLTAPVMVAGSGTWR;LTAPVMVAGSGTWRD;TAPVMVAGSGTWRDG;APVMVAGSGTWRDGA;PVMVAGSGTWRDGAV;VMVAGSGTWRDGAVV;MVAGSGTWRDGAVVP;VAGSGTWRDGAVVPR;AGSGTWRDGAVVPRI;GSGTWRDGAVVP | |

Fig. 30 continued

| | | |
|---|---|---|
| | RIE;SGTWRDGAVVPRIEF;GTWRDGAVVPRIEFD;TWRDGAVVPRIEFDD;WRDGAVVPRIEFDDV;RDGAVVPRIEFDDVA;DGAVVPRIEFDDVAF;GAVVPRIEFDDVAFG;AVVPRIEFDDVAFGY;VVPRIEFDDVAFGYD;VPRIEFDDVAFGYDG;PRIEFDDVAFGYDGG;RIEFDDVAFGYDGGS;IEFDDVAFGYDGGSG;EFDDVAFGYDGGSGP;FDDVAFGYDGGSGPV;DDVAFGYDGGSGPVL;DVAFGYDGGSGPVLD;VAFGYDGGSGPVLDG;AFGYDGGSGPVLDGV;FGYDGGSGPVLDGVS;GYDGGSGPVLDGVSF;YDGGSGPVLDGVSFC;DGGSGPVLDGVSFCL;GGSGPVLDGVSFCLQ;GSGPVLDGVSFCLQP;SGPVLDGVSFCLQPG;GPVLDGVSFCLQPGT;PVLDGVSFCLQPGTT;VLDGVSFCLQPGTTT;LDGVSFCLQPGTTTA;DGVSFCLQPGTTTAI;GVSFCLQPGTTTAIV;VSFCLQPGTTTAIVG;SFCLQPGTTTAIVGP;FCLQPGTTTAIVGPS;CLQPGTTTAIVGPSG;LQPGTTTAIVGPSGC;QPGTTTAIVGPSGCG;PGTTTAIVGPSGCGK;GTTTAIVGPSGCGKS;TTTAIVGPSGCGKST;TTAIVGPSGCGKSTI;TAIVGPSGCGKSTIL;AIVGPSGCGKSTILA;IVGPSGCGKSTILAL;VGPSGCGKSTILALI;GPSGCGKSTILALIA;PSGCGKSTILALIAG;SGCGKSTILALIAGL;GCGKSTILALIAGLH;CGKSTILALIAGLHQ;GKSTILALIAGLHQP;KSTILALIAGLHQPT;STILALIAGLHQPTR;TILALIAGLHQPTRG;ILALIAGLHQPTRGR;LALIAGLHQPTRGRV;ALIAGLHQPTRGRVL;LIAGLHQPTRGRVLI;IAGLHQPTRGRVLID;AGLHQPTRGRVLIDG;GLHQPTRGRVLIDGT;LHQPTRGRVLIDGTD;HQPTRGRVLIDGTDV;QPTRGRVLIDGTDVA;PTRGRVLIDGTDVAT;TRGRVLIDGTDVATL;RGRVLIDGTDVATLD;GRVLIDGTDVATLDA;RVLIDGTDVATLDAR;VLIDGTDVATLDARA;LIDGTDVATLDARAQ;IDGTDVATLDARAQQ;DGTDVATLDARAQQA;GTDVATLDARAQQAV;TDVATLDARAQQAVC;DVATLDARAQQAVCS;VATLDARAQQAVCSV;ATLDARAQQAVCSVV;TLDARAQQAVCSVVF;LDARAQQAVCSVVFQ;DARAQQAVCSVVFQH;ARAQQAVCSVVFQHP;RAQQAVCSVVFQHPY;AQQAVCSVVFQHPYL;QQAVCSVVFQHPYLF;QAVCSVVFQHPYLFH;AVCSVVFQHPYLFHG;VCSVVFQHPYLFHGT;CSVVFQHPYLFHGTI;SVVFQHPYLFHGTIR;VVFQHPYLFHGTIRD;VFQHPYLFHGTIRDN;FQHPYLFHGTIRDNV;QHPYLFHGTIRDNVF;HPYLFHGTIRDNVFA;PYLFHGTIRDNVFAA;YLFHGTIRDNVFAAD;LFHGTIRDNVFAADP;FHGTIRDNVFAADPG;HGTIRDNVFAADPGA;GTIRDNVFAADPGAS;TIRDNVFAADPGASD;IRDNVFAADPGASDD;RDNVFAADPGASDDQ;DNVFAADPGASDDQF;NVFAADPGASDDQFA;VFAADPGASDDQFAQ;FAADPGASDDQFAQA;AADPGASDDQFAQAV;ADPGASDDQFAQAVR;DPGASDDQFAQAVRL;PGASDDQFAQAVRLA;GASDDQFAQAVRLAR;ASDDQFAQAVRLARV;SDDQFAQAVRLARVD;DDQFAQAVRLARVDE;DQFAQAVRLARVDEL;QFAQAVRLARVDELI;FAQAVRLARVDELIA;AQAVRLARVDELIAR;QAVRLARVDELIARL;AVRLARVDELIARLP;VRLARVDELIARLPD;RLARVDELIARLPDG;LARVDELIARLPDGA;ARVDELIARLPDGAN;RVDELIARLPDGANT;VDELIARLPDGANTI;DELIARLPDGANTIV;ELIARLPDGANTIVG;LIARLPDGANTIVGE;IARLPDGANTIVGEA;ARLPDGANTIVGEAG;RLPDGANTIVGEAGS;LPDGANTIVGEAGSA;PDGANTIVGEAGSAL;DGANTIVGEAGSALS;GANTIVGEAGSALSG;ANTIVGEAGSALSGG;NTIVGEAGSALSGGE;TIVGEAGSALSGGER;IVGEAGSALSGGERQ;VGEAGSALSGGERQR;GEAGSALSGGERQRV;EAGSALSGGERQRVS;AGSALSGGERQRVSI;GSALSGGERQRVSIA;SALSGGERQRVSIAR;ALSGGERQRVSIARA;LSGGERQRVSIARAL;SGGERQRVSIARALL;GGERQRVSIARALLK;GERQRVSIARALLKA;ERQRVSIARALLKAA;RQRVSIARALLKAAP;QRVSIARALLKAAPV;RVSIARALLKAAPVL;VSIARALLKAAPVLL;SIARALLKAAPVLLV;IARALLKAAPVLLVD;ARALLKAAPVLLVDE;RALLKAAPVLLVDEA;ALLKAAPVLLVDEAT;LLKAAPVLLVDEATS;LKAAPVLLVDEATSA;KAAPVLLVDEATSAL;AAPVLLVDEATSALD;APVLLVDEATSALDA;PVLLVDEATSALDAE;VLLVDEATSALDAEN;LLVDEATSALDAENE;LVDEATSALDAENEA;VDEATSALDAENEAA;DEATSALDAENEAAV;EATSA | |

Fig. 30 continued

| | | |
|---|---|---|
| | LDAENEAAVV;ATSALDAENEAAVVD;TSALDAENEAAVVDA;SALDAENEAAVVDAL;ALDAENEAAVVDALA;LDAENEAAVVDALAA;DAENEAAVVDALAAD;AENEAAVVDALAADP;ENEAAVVDALAADPR;NEAAVVDALAADPRS;EAAVVDALAADPRSR;AAVVDALAADPRSRT;AVVDALAADPRSRTR;VVDALAADPRSRTRV;VDALAADPRSRTRVI;DALAADPRSRTRVIV;ALAADPRSRTRVIVA;LAADPRSRTRVIVAH;AADPRSRTRVIVAHR;ADPRSRTRVIVAHRL;DPRSRTRVIVAHRLA;PRSRTRVIVAHRLAS;RSRTRVIVAHRLASI;SRTRVIVAHRLASIR;RTRVIVAHRLASIRH;TRVIVAHRLASIRHA;RVIVAHRLASIRHAD;VIVAHRLASIRHADR;IVAHRLASIRHADRV;VAHRLASIRHADRVL;AHRLASIRHADRVLF;HRLASIRHADRVLFV;RLASIRHADRVLFVD;LASIRHADRVLFVDD;ASIRHADRVLFVDDG;SIRHADRVLFVDDGR;IRHADRVLFVDDGRV;RHADRVLFVDDGRVV;HADRVLFVDDGRVVE;ADRVLFVDDGRVVED;DRVLFVDDGRVVEDG;RVLFVDDGRVVEDGS;VLFVDDGRVVEDGSI;LFVDDGRVVEDGSIS;FVDDGRVVEDGSISE;VDDGRVVEDGSISEL;DDGRVVEDGSISELL;DGRVVEDGSISELLT;GRVVEDGSISELLTA;RVVEDGSISELLTAG;VVEDGSISELLTAGG;VEDGSISELLTAGGR;EDGSISELLTAGGRF;DGSISELLTAGGRFS;GSISELLTAGGRFSQ;SISELLTAGGRFSQF;ISELLTAGGRFSQFW;SELLTAGGRFSQFWR;ELLTAGGRFSQFWRQ;LLTAGGRFSQFWRQQ;LTAGGRFSQFWRQQH;TAGGRFSQFWRQQHE;AGGRFSQFWRQQHEA;GGRFSQFWRQQHEAA;GRFSQFWRQQHEAAE;RFSQFWRQQHEAAEW;FSQFWRQQHEAAEWQ;SQFWRQQHEAAEWQI;QFWRQQHEAAEWQIL;FWRQQHEAAEWQILA;WRQQHEAAEWQILAE;<br><br>16 mers:<br>MIRTWIALVPNDHRAR;IRTWIALVPNDHRARL;RTWIALVPNDHRARLI;TWIALVPNDHRARLIG;WIALVPNDHRARLIGF;IALVPNDHRARLIGFA;ALVPNDHRARLIGFAL;LVPNDHRARLIGFALL;VPNDHRARLIGFALLA;PNDHRARLIGFALLAF;NDHRARLIGFALLAFC;DHRARLIGFALLAFCS;HRARLIGFALLAFCSV;RARLIGFALLAFCSVV;ARLIGFALLAFCSVVA;RLIGFALLAFCSVVAR;LIGFALLAFCSVVARA;IGFALLAFCSVVARAV;GFALLAFCSVVARAVG;FALLAFCSVVARAVGT;ALLAFCSVVARAVGTV;LLAFCSVVARAVGTVL;LAFCSVVARAVGTVLL;AFCSVVARAVGTVLLV;FCSVVARAVGTVLLVP;CSVVARAVGTVLLVPL;SVVARAVGTVLLVPLM;VVARAVGTVLLVPLMA;VARAVGTVLLVPLMAA;ARAVGTVLLVPLMAAL;RAVGTVLLVPLMAALF;AVGTVLLVPLMAALFG;VGTVLLVPLMAALFGE;GTVLLVPLMAALFGEA;TVLLVPLMAALFGEAP;VLLVPLMAALFGEAPQ;LLVPLMAALFGEAPQR;LVPLMAALFGEAPQRA;VPLMAALFGEAPQRAW;PLMAALFGEAPQRAWL;LMAALFGEAPQRAWLW;MAALFGEAPQRAWLWL;AALFGEAPQRAWLWLG;ALFGEAPQRAWLWLGW;LFGEAPQRAWLWLGWL;FGEAPQRAWLWLGWLS;GEAPQRAWLWLGWLSA;EAPQRAWLWLGWLSAA;APQRAWLWLGWLSAAT;PQRAWLWLGWLSAATV;QRAWLWLGWLSAATVA;RAWLWLGWLSAATVAG;AWLWLGWLSAATVAGW;WLWLGWLSAATVAGWV;LWLGWLSAATVAGWVL;WLGWLSAATVAGWVLD;LGWLSAATVAGWVLDA;GWLSAATVAGWVLDAV;WLSAATVAGWVLDAVT;LSAATVAGWVLDAVTA;SAATVAGWVLDAVTAR;AATVAGWVLDAVTARI;ATVAGWVLDAVTARIG;TVAGWVLDAVTARIGI;VAGWVLDAVTARIGIE;AGWVLDAVTARIGIEL;GWVLDAVTARIGIELG;WVLDAVTARIGIELGF;VLDAVTARIGIELGFA;LDAVTARIGIELGFAV;DAVTARIGIELGFAVL;AVTARIGIELGFAVLN;VTARIGIELGFAVLNH;TARIGIELGFAVLNHT;ARIGIELGFAVLNHTQ;RIGIELGFAVLNHTQH;IGIELGFAVLNHTQHD;GIELGFAVLNHTQHDV;IELGFAVLNHTQHDVA;ELGFAVLNHTQHDVAD;LGFAVLNHTQHDVADR;GFAVLNHTQHDVADRL;FAVLNHTQHDVADRLP;AVLNHTQHDVADRLPV;VLNHTQHDVADRLPVV;LNHTQHDVADRLPVVR;NHTQHDVADRLPVVRL;HTQHDVADRLPVVRLD;TQHDVADRLPVVRLDW;QHDVADRLP | |

Fig. 30 continued

| | | |
|---|---|---|
| | VVRLDWF;HDVADRLPVVRLDWFT;DVADRLPVVRLDWFTA;VADRLPVVRLDWFTAE;ADRLPVVRLDWFTAEN;DRLPVVRLDWFTAENT;RLPVVRLDWFTAENTA;LPVVRLDWFTAENTAT;PVVRLDWFTAENTATA;VVRLDWFTAENTATAR;VRLDWFTAENTATARQ;RLDWFTAENTATARQA;LDWFTAENTATARQAI;DWFTAENTATARQAIA;WFTAENTATARQAIAA;FTAENTATARQAIAAT;TAENTATARQAIAATG;AENTATARQAIAATGP;ENTATARQAIAATGPE;NTATARQAIAATGPEL;TATARQAIAATGPELV;ATARQAIAATGPELVG;TARQAIAATGPELVGL;ARQAIAATGPELVGLV;RQAIAATGPELVGLVV;QAIAATGPELVGLVVN;AIAATGPELVGLVVNL;IAATGPELVGLVVNLV;AATGPELVGLVVNLVT;ATGPELVGLVVNLVTP;TGPELVGLVVNLVTPL;GPELVGLVVNLVTPLT;PELVGLVVNLVTPLTS;ELVGLVVNLVTPLTSA;LVGLVVNLVTPLTSAI;VGLVVNLVTPLTSAIL;GLVVNLVTPLTSAILL;LVVNLVTPLTSAILLP;VVNLVTPLTSAILLPA;VNLVTPLTSAILLPAV;NLVTPLTSAILLPAVI;LVTPLTSAILLPAVIA;VTPLTSAILLPAVIAL;TPLTSAILLPAVIALA;PLTSAILLPAVIALAL;LTSAILLPAVIALALL;TSAILLPAVIALALLP;SAILLPAVIALALLPI;AILLPAVIALALLPIS;ILLPAVIALALLPISW;LLPAVIALALLPISWQ;LPAVIALALLPISWQL;PAVIALALLPISWQLG;AVIALALLPISWQLGV;VIALALLPISWQLGVA;IALALLPISWQLGVAA;ALALLPISWQLGVAAL;LALLPISWQLGVAALA;ALLPISWQLGVAALAG;LLPISWQLGVAALAGV;LPISWQLGVAALAGVP;PISWQLGVAALAGVPL;ISWQLGVAALAGVPLL;SWQLGVAALAGVPLLL;WQLGVAALAGVPLLLG;QLGVAALAGVPLLLGA;LGVAALAGVPLLLGAL;GVAALAGVPLLLGALW;VAALAGVPLLLGALWA;AALAGVPLLLGALWAS;ALAGVPLLLGALWASA;LAGVPLLLGALWASAA;AGVPLLLGALWASAAF;GVPLLLGALWASAAFA;VPLLLGALWASAAFAR;PLLLGALWASAAFARR;LLLGALWASAAFARRA;LLGALWASAAFARRAD;LGALWASAAFARRADT;GALWASAAFARRADTA;ALWASAAFARRADTAA;LWASAAFARRADTAAD;WASAAFARRADTAADK;ASAAFARRADTAADKA;SAAFARRADTAADKAN;AAFARRADTAADKANT;AFARRADTAADKANTA;FARRADTAADKANTAL;ARRADTAADKANTALT;RRADTAADKANTALTE;RADTAADKANTALTER;ADTAADKANTALTERI;DTAADKANTALTERII;TAADKANTALTERIIE;AADKANTALTERIIEF;ADKANTALTERIIEFA;DKANTALTERIIEFAR;KANTALTERIIEFART;ANTALTERIIEFARTQ;NTALTERIIEFARTQQ;TALTERIIEFARTQQA;ALTERIIEFARTQQAL;LTERIIEFARTQQALR;TERIIEFARTQQALRA;ERIIEFARTQQALRAA;RIIEFARTQQALRAAR;IIEFARTQQALRAARR;IEFARTQQALRAARRV;EFARTQQALRAARRVE;FARTQQALRAARRVEP;ARTQQALRAARRVEPA;RTQQALRAARRVEPAR;TQQALRAARRVEPARS;QQALRAARRVEPARSL;QALRAARRVEPARSLV;ALRAARRVEPARSLVG;LRAARRVEPARSLVGN;RAARRVEPARSLVGNA;AARRVEPARSLVGNAL;ARRVEPARSLVGNALA;RRVEPARSLVGNALAS;RVEPARSLVGNALASQ;VEPARSLVGNALASQH;EPARSLVGNALASQHT;PARSLVGNALASQHTA;ARSLVGNALASQHTAT;RSLVGNALASQHTATM;SLVGNALASQHTATMR;LVGNALASQHTATMRL;VGNALASQHTATMRLL;GNALASQHTATMRLLG;NALASQHTATMRLLGM;ALASQHTATMRLLGMQ;LASQHTATMRLLGMQI;ASQHTATMRLLGMQIP;SQHTATMRLLGMQIPG;QHTATMRLLGMQIPGQ;HTATMRLLGMQIPGQL;TATMRLLGMQIPGQLL;ATMRLLGMQIPGQLLF;TMRLLGMQIPGQLLFS;MRLLGMQIPGQLLFSI;RLLGMQIPGQLLFSIA;LLGMQIPGQLLFSIAS;LGMQIPGQLLFSIASQ;GMQIPGQLLFSIASQL;MQIPGQLLFSIASQLA;QIPGQLLFSIASQLAL;IPGQLLFSIASQLALI;PGQLLFSIASQLALIV;GQLLFSIASQLALIVL;QLLFSIASQLALIVLA;LLFSIASQLALIVLAG;LFSIASQLALIVLAGT;FSIASQLALIVLAGTT;SIASQLALIVLAGTTA;IASQLALIVLAGTTAA;ASQLALIVLAGTTAAL;SQLALIVLAGTTAALT;QLALIVLAGTTAALTI;LALIVLAGTTAALTIT;ALIVLAGTTAALTITG;LIVLAGTTAALTITGT;IVLAGTTAALTITGTL;VLAGTTAALTITGTLT;LAGTTAALTITGTLTV;AGTTAALTITGTLTVP;GTTAALTITGTLTVPE;TTAALTITGTLTVPEA;TA | |

Fig. 30 continued

| | | |
|---|---|---|
| | ALTITGTLTVPEAI;AALTITGTLTVPEAIA;ALTITGTLTVPEAIAL;LTITGTLTVPEAIALI;TITGTLTVPEAIALIV;ITGTLTVPEAIALIVV;TGTLTVPEAIALIVVM;GTLTVPEAIALIVVMV;TLTVPEAIALIVVMVR;LTVPEAIALIVVMVRY;TVPEAIALIVVMVRYL;VPEAIALIVVMVRYLE;PEAIALIVVMVRYLEP;EAIALIVVMVRYLEPF;AIALIVVMVRYLEPFT;IALIVVMVRYLEPFTA;ALIVVMVRYLEPFTAV;LIVVMVRYLEPFTAVS;IVVMVRYLEPFTAVSE;VVMVRYLEPFTAVSEL;VMVRYLEPFTAVSELA;MVRYLEPFTAVSELAP;VRYLEPFTAVSELAPA;RYLEPFTAVSELAPAL;YLEPFTAVSELAPALE;LEPFTAVSELAPALES;EPFTAVSELAPALEST;PFTAVSELAPALESTR;FTAVSELAPALESTRA;TAVSELAPALESTRAT;AVSELAPALESTRATL;VSELAPALESTRATLG;SELAPALESTRATLGR;ELAPALESTRATLGRI;LAPALESTRATLGRIG;APALESTRATLGRIGS;PALESTRATLGRIGSV;ALESTRATLGRIGSVL;LESTRATLGRIGSVLT;ESTRATLGRIGSVLTA;STRATLGRIGSVLTAP;TRATLGRIGSVLTAPV;RATLGRIGSVLTAPVM;ATLGRIGSVLTAPVMV;TLGRIGSVLTAPVMVA;LGRIGSVLTAPVMVAG;GRIGSVLTAPVMVAGS;RIGSVLTAPVMVAGSG;IGSVLTAPVMVAGSGT;GSVLTAPVMVAGSGTW;SVLTAPVMVAGSGTWR;VLTAPVMVAGSGTWRD;LTAPVMVAGSGTWRDG;TAPVMVAGSGTWRDGA;APVMVAGSGTWRDGAV;PVMVAGSGTWRDGAVV;VMVAGSGTWRDGAVVP;MVAGSGTWRDGAVVPR;VAGSGTWRDGAVVPRI;AGSGTWRDGAVVPRIE;GSGTWRDGAVVPRIEF;SGTWRDGAVVPRIEFD;GTWRDGAVVPRIEFDD;TWRDGAVVPRIEFDDV;WRDGAVVPRIEFDDVA;RDGAVVPRIEFDDVAF;DGAVVPRIEFDDVAFG;GAVVPRIEFDDVAFGY;AVVPRIEFDDVAFGYD;VVPRIEFDDVAFGYDG;VPRIEFDDVAFGYDGG;PRIEFDDVAFGYDGGS;RIEFDDVAFGYDGGSG;IEFDDVAFGYDGGSGP;EFDDVAFGYDGGSGPV;FDDVAFGYDGGSGPVL;DDVAFGYDGGSGPVLD;DVAFGYDGGSGPVLDG;VAFGYDGGSGPVLDGV;AFGYDGGSGPVLDGVS;FGYDGGSGPVLDGVSF;GYDGGSGPVLDGVSFC;YDGGSGPVLDGVSFCL;DGGSGPVLDGVSFCLQ;GGSGPVLDGVSFCLQP;GSGPVLDGVSFCLQPG;SGPVLDGVSFCLQPGT;GPVLDGVSFCLQPGTT;PVLDGVSFCLQPGTTT;VLDGVSFCLQPGTTTA;LDGVSFCLQPGTTTAI;DGVSFCLQPGTTTAIV;GVSFCLQPGTTTAIVG;VSFCLQPGTTTAIVGP;SFCLQPGTTTAIVGPS;FCLQPGTTTAIVGPSG;CLQPGTTTAIVGPSGC;LQPGTTTAIVGPSGCG;QPGTTTAIVGPSGCGK;PGTTTAIVGPSGCGKS;GTTTAIVGPSGCGKST;TTTAIVGPSGCGKSTI;TTAIVGPSGCGKSTIL;TAIVGPSGCGKSTILA;AIVGPSGCGKSTILAL;IVGPSGCGKSTILALI;VGPSGCGKSTILALIA;GPSGCGKSTILALIAG;PSGCGKSTILALIAGL;SGCGKSTILALIAGLH;GCGKSTILALIAGLHQ;CGKSTILALIAGLHQP;GKSTILALIAGLHQPT;KSTILALIAGLHQPTR;STILALIAGLHQPTRG;TILALIAGLHQPTRGR;ILALIAGLHQPTRGRV;LALIAGLHQPTRGRVL;ALIAGLHQPTRGRVLI;LIAGLHQPTRGRVLID;IAGLHQPTRGRVLIDG;AGLHQPTRGRVLIDGT;GLHQPTRGRVLIDGTD;LHQPTRGRVLIDGTDV;HQPTRGRVLIDGTDVA;QPTRGRVLIDGTDVAT;PTRGRVLIDGTDVATL;TRGRVLIDGTDVATLD;RGRVLIDGTDVATLDA;GRVLIDGTDVATLDAR;RVLIDGTDVATLDARA;VLIDGTDVATLDARAQ;LIDGTDVATLDARAQQ;IDGTDVATLDARAQQA;DGTDVATLDARAQQAV;GTDVATLDARAQQAVC;TDVATLDARAQQAVCS;DVATLDARAQQAVCSV;VATLDARAQQAVCSVV;ATLDARAQQAVCSVVF;TLDARAQQAVCSVVFQ;LDARAQQAVCSVVFQH;DARAQQAVCSVVFQHP;ARAQQAVCSVVFQHPY;RAQQAVCSVVFQHPYL;AQQAVCSVVFQHPYLF;QQAVCSVVFQHPYLFH;QAVCSVVFQHPYLFHG;AVCSVVFQHPYLFHGT;VCSVVFQHPYLFHGTI;CSVVFQHPYLFHGTIR;SVVFQHPYLFHGTIRD;VVFQHPYLFHGTIRDN;VFQHPYLFHGTIRDNV;FQHPYLFHGTIRDNVF;QHPYLFHGTIRDNVFA;HPYLFHGTIRDNVFAA;PYLFHGTIRDNVFAAD;YLFHGTIRDNVFAADP;LFHGTIRDNVFAADPG;FHGTIRDNVFAADPGA;HGTIRDNVFAADPGAS;GTIRDNVFAADPGASD;TIRDNVFAADPGASDD;IRDNVFAADPGASDDQ;RDNVFAADPGASDD | |

Fig. 30 continued

| | | |
|---|---|---|
| | QF;DNVFAADPGASDDQFA;NVFAADPGASDDQFAQ;VFAADPGASDDQFAQA;FAADPGASDDQFAQAV;AADPGASDDQFAQAVR;ADPGASDDQFAQAVRL;DPGASDDQFAQAVRLA;PGASDDQFAQAVRLAR;GASDDQFAQAVRLARV;ASDDQFAQAVRLARVD;SDDQFAQAVRLARVDE;DDQFAQAVRLARVDEL;DQFAQAVRLARVDELI;QFAQAVRLARVDELIA;FAQAVRLARVDELIAR;AQAVRLARVDELIARL;QAVRLARVDELIARLP;AVRLARVDELIARLPD;VRLARVDELIARLPDG;RLARVDELIARLPDGA;LARVDELIARLPDGAN;ARVDELIARLPDGANT;RVDELIARLPDGANTI;VDELIARLPDGANTIV;DELIARLPDGANTIVG;ELIARLPDGANTIVGE;LIARLPDGANTIVGEA;IARLPDGANTIVGEAG;ARLPDGANTIVGEAGS;RLPDGANTIVGEAGSA;LPDGANTIVGEAGSAL;PDGANTIVGEAGSALS;DGANTIVGEAGSALSG;GANTIVGEAGSALSGG;ANTIVGEAGSALSGGE;NTIVGEAGSALSGGER;TIVGEAGSALSGGERQ;IVGEAGSALSGGERQR;VGEAGSALSGGERQRV;GEAGSALSGGERQRVS;EAGSALSGGERQRVSI;AGSALSGGERQRVSIA;GSALSGGERQRVSIAR;SALSGGERQRVSIARA;ALSGGERQRVSIARAL;LSGGERQRVSIARALL;SGGERQRVSIARALLK;GGERQRVSIARALLKA;GERQRVSIARALLKAA;ERQRVSIARALLKAAP;RQRVSIARALLKAAPV;QRVSIARALLKAAPVL;RVSIARALLKAAPVLL;VSIARALLKAAPVLLV;SIARALLKAAPVLLVD;IARALLKAAPVLLVDE;ARALLKAAPVLLVDEA;RALLKAAPVLLVDEAT;ALLKAAPVLLVDEATS;LLKAAPVLLVDEATSA;LKAAPVLLVDEATSAL;KAAPVLLVDEATSALD;AAPVLLVDEATSALDA;APVLLVDEATSALDAE;PVLLVDEATSALDAEN;VLLVDEATSALDAENE;LLVDEATSALDAENEA;LVDEATSALDAENEAA;VDEATSALDAENEAAV;DEATSALDAENEAAVV;EATSALDAENEAAVVD;ATSALDAENEAAVVDA;TSALDAENEAAVVDAL;SALDAENEAAVVDALA;ALDAENEAAVVDALAA;LDAENEAAVVDALAAD;DAENEAAVVDALAADP;AENEAAVVDALAADPR;ENEAAVVDALAADPRS;NEAAVVDALAADPRSR;EAAVVDALAADPRSRT;AAVVDALAADPRSRTR;AVVDALAADPRSRTRV;VVDALAADPRSRTRVI;VDALAADPRSRTRVIV;DALAADPRSRTRVIVA;ALAADPRSRTRVIVAH;LAADPRSRTRVIVAHR;AADPRSRTRVIVAHRL;ADPRSRTRVIVAHRLA;DPRSRTRVIVAHRLAS;PRSRTRVIVAHRLASI;RSRTRVIVAHRLASIR;SRTRVIVAHRLASIRH;RTRVIVAHRLASIRHA;TRVIVAHRLASIRHAD;RVIVAHRLASIRHADR;VIVAHRLASIRHADRV;IVAHRLASIRHADRVL;VAHRLASIRHADRVLF;AHRLASIRHADRVLFV;HRLASIRHADRVLFVD;RLASIRHADRVLFVDD;LASIRHADRVLFVDDG;ASIRHADRVLFVDDGR;SIRHADRVLFVDDGRV;IRHADRVLFVDDGRVV;RHADRVLFVDDGRVVE;HADRVLFVDDGRVVED;ADRVLFVDDGRVVEDG;DRVLFVDDGRVVEDGS;RVLFVDDGRVVEDGSI;VLFVDDGRVVEDGSIS;LFVDDGRVVEDGSISE;FVDDGRVVEDGSISEL;VDDGRVVEDGSISELL;DDGRVVEDGSISELLT;DGRVVEDGSISELLTA;GRVVEDGSISELLTAG;RVVEDGSISELLTAGG;VVEDGSISELLTAGGR;VEDGSISELLTAGGRF;EDGSISELLTAGGRFS;DGSISELLTAGGRFSQ;GSISELLTAGGRFSQF;SISELLTAGGRFSQFW;ISELLTAGGRFSQFWR;SELLTAGGRFSQFWRQ;ELLTAGGRFSQFWRQQ;LLTAGGRFSQFWRQQH;LTAGGRFSQFWRQQHE;TAGGRFSQFWRQQHEA;AGGRFSQFWRQQHEAA;GGRFSQFWRQQHEAAE;GRFSQFWRQQHEAAEW;RFSQFWRQQHEAAEWQ;FSQFWRQQHEAAEWQI;SQFWRQQHEAAEWQIL;QFWRQQHEAAEWQILA;FWRQQHEAAEWQILAE | |
| 24 | **<NP_216329.1 hypothetical protein Rv1813c;Mycobacterium tuberculosis H37Rv>**<br>MITNLRRRTAMAAAGLGAALGLGILLVPTVDAHLANGSMSEVMMSEIAGLPIPPIIHYGAIAYAPSGASGKAWHQRTPARAEQVALEKCGDKTCKVVSRFTRCGAVAYNGSKYQGGTGLTRRAAEDDAVNRLEGGRIVNWACN<br><br>8mer | 152022-152696 |

Fig. 30 continued

| | | |
|---|---|---|
| | MITNLRRR;NLRRRTAM;RRRTAMAA;RRTAMAAA;TAMAAAGL;MAAAGLGA;AAAGLGAA;GLGAALGL;ALGLGILL;LGLGILLV;GILLVPTV;LLVPTVDA;VPTVDAHL;SMSEVMMS;SEVMMSEI;EVMMSEIA;MMSEIAGL;SEIAGLPI;GLPIPPII;LPIPPIIH;PIPPIIHY;PPIIHYGA;IHYGAIAY;IAYAPSGA;SGKAWHQR;ARAEQVAL;KCGDKTCK;KTCKVVSR;KVVSRFTR;FTRCGAVA;TRCGAVAY;AVAYNGSK;VAYNGSKY;KYQGGTGL;YQGGTGLT;RAAEDDAV;RLEGGRIV<br>9mer<br>NLRRRTAMA;RRRTAMAAA;RTAMAAAGL;AMAAAGLGA;MAAAGLGAA;AAAGLGAAL;AALGLGILL;ALGLGILLV;GLGILLVPT;ILLVPTVDA;LVPTVDAHL;VPTVDAHLA;DAHLANGSM;HLANGSMSE;LANGSMSEV;SMSEVMMSE;MSEVMMSEI;VMMSEIAGL;MMSEIAGLP;LPIPPIIHY;IPPIIHYGA;PPIIHYGAI;IIHYGAIAY;AIAYAPSGA;YAPSGASGK;APSGASGKA;ASGKAWHQR;KAWHQRTPA;AWHQRTPAR;RTPARAEQV;TPARAEQVA;RAEQVALEK;KCGDKTCKV;KTCKVVSRF;CKVVSRFTR;KVVSRFTRC;FTRCGAVAY;GAVAYNGSK;AVAYNGSKY;AEDDAVNRL;AVNRLEGGR<br>10mer<br>ITNLRRRTAM;NLRRRTAMAA;RRTAMAAAGL;TAMAAAGLGA;AMAAAGLGAA;MAAAGLGAAL;GLGAALGLGI;AALGLGILLV;GLGILLVPTV;LLVPTVDAHL;HLANGSMSEV;LANGSMSEVM;SMSEVMMSEI;EVMMSEIAGL;MMSEIAGLPI;EIAGLPIPPI;GLPIPPIIHY;LPIPPIIHYG;PIPPIIHYGA;IPPIIHYGAI;PPIIHYGAIA;PIIHYGAIAY;IIHYGAIAYA;AYAPSGASGK;APSGASGKAW;GASGKAWHQR;KAWHQRTPAR;TPARAEQVAL;ARAEQVALEK;QVALEKCGDK;TCKVVSRFTR;RFTRCGAVAY;KYQGGTGLTR;RAAEDDAVNR;DAVNRLEGGR<br>11mer<br>MITNLRRRTAM;NLRRRTAMAAA;RRRTAMAAAGL;RTAMAAAGLGA;TAMAAAGLGAA;AMAAAGLGAAL;AAAGLGAALGL;GLGAALGLGIL;GAALGLGILLV;ALGLGILLVPT;LGLGILLVPTV;ILLVPTVDAHL;LLVPTVDAHLA;TVDAHLANGSM;HLANGSMSEVM;LANGSMSEVMM;SMSEVMMSEIA;SEVMMSEIAGL;VMMSEIAGLPI;SEIAGLPIPPI;EIAGLPIPPII;LPIPPIIHYGA;PIPPIIHYGAI;IPPIIHYGAIA;PPIIHYGAIAY;PIIHYGAIAYA;YGAIAYAPSGA;IAYAPSGASGK;YAPSGASGKAW;SGASGKAWHQR;RTPARAEQVAL;PARAEQVALEK;KTCKVVSRFTR;KVVSRFTRCGA;VVSRFTRCGAV;SRFTRCGAVAY;RCGAVAYNGSK;KYQGGTGLTRR;YQGGTGLTRRA;RRAAEDDAVNR;RAAEDDAVNRL;AVNRLEGGRIV;RLEGGRIVNWA<br><br>13 mers:<br>MITNLRRRTAMAA;ITNLRRRTAMAAA;TNLRRRTAMAAAG;NLRRRTAMAAAGL;LRRRTAMAAAGLG;RRRTAMAAAGLGA;RRTAMAAAGLGAA;RTAMAAAGLGAAL;TAMAAAGLGAALG;AMAAAGLGAALGL;MAAAGLGAALGLG;AAAGLGAALGLGI;AAGLGAALGLGIL;AGLGAALGLGILL;GLGAALGLGILLV;LGAALGLGILLVP;GAALGLGILLVPT;AALGLGILLVPTV;ALGLGILLVPTVD;LGLGILLVPTVDA;GLGILLVPTVDAH;LGILLVPTVDAHL;GILLVPTVDAHLA;ILLVPTVDAHLAN;LLVPTVDAHLANG;LVPTVDAHLANGS;VPTVDAHLANGSM;PTVDAHLANGSMS;TVDAHLANGSMSE;VDAHLANGSMSEV;DAHLANGSMSEVM;AHLANGSMSEVMM;HLANGSMSEVMMS;LANGSMSEVMMSE;ANGSMSEVMMSEI;NGSMSEVMMSEIA;GSMSEVMMSEIAG;SMSEVMMSEIAGL;MSEVMMSEIAGLP;SEVMMSEIAGLPI;EVMMSEIAGLPIP;VMMSEIAGLPIPP;MMSEIAGLPIPPI;MSEIAGLPIPPII;SEIAGLPIPPIIH;EIAGLPIPPIIHY;IAGLPIPPIIHYG;AGLPIPPIIHYGA;GLPIPPIIHYGAI;LPIPPIIHYGAIA;PIPPIIHYGAIAY;IPPIIHYGAIAYA;PPIIHYGAIAYAP;PIIHYGAIAYAPS;IIHYGAIAYAPSG;IHYGAIAYAPSGA;HYGAIAYAPSGAS;YGAIAYAPSGASG;GAIAYAPSG | |

Fig. 30 continued

| | | |
|---|---|---|
| | ASGK;AIAYAPSGASGKA;IAYAPSGASGKAW;AYAPSGASGKAWH;YAPSG<br>ASGKAWHQ;APSGASGKAWHQR;PSGASGKAWHQRT;SGASGKAWHQR<br>TP;GASGKAWHQRTPA;ASGKAWHQRTPAR;SGKAWHQRTPARA;GKAW<br>HQRTPARAE;KAWHQRTPARAEQ;AWHQRTPARAEQV;WHQRTPARAEQ<br>VA;HQRTPARAEQVAL;QRTPARAEQVALE;RTPARAEQVALEK;TPARAEQ<br>VALEKC;PARAEQVALEKCG;ARAEQVALEKCGD;RAEQVALEKCGDK;AEQ<br>VALEKCGDKT;EQVALEKCGDKTC;QVALEKCGDKTCK;VALEKCGDKTCK<br>V;ALEKCGDKTCKVV;LEKCGDKTCKVVS;EKCGDKTCKVVSR;KCGDKTCK<br>VVSRF;CGDKTCKVVSRFT;GDKTCKVVSRFTR;DKTCKVVSRFTRC;KTCK<br>VVSRFTRCG;TCKVVSRFTRCGA;CKVVSRFTRCGAV;KVVSRFTRCGAVA;<br>VVSRFTRCGAVAY;VSRFTRCGAVAYN;SRFTRCGAVAYNG;RFTRCGAVA<br>YNGS;FTRCGAVAYNGSK;TRCGAVAYNGSKY;RCGAVAYNGSKYQ;CGAV<br>AYNGSKYQG;GAVAYNGSKYQGG;AVAYNGSKYQGGT;VAYNGSKYQGG<br>TG;AYNGSKYQGGTGL;YNGSKYQGGTGLT;NGSKYQGGTGLTR;GSKYQ<br>GGTGLTRR;SKYQGGTGLTRRA;KYQGGTGLTRRAA;YQGGTGLTRRAAE;<br>QGGTGLTRRAAED;GGTGLTRRAAEDD;GTGLTRRAAEDDA;TGLTRRAAE<br>DDAV;GLTRRAAEDDAVN;LTRRAAEDDAVNR;TRRAAEDDAVNRL;RRAAE<br>DDAVNRLE;RAAEDDAVNRLEG;AAEDDAVNRLEGG;AEDDAVNRLEGGR;<br>EDDAVNRLEGGRI;DDAVNRLEGGRIV;DAVNRLEGGRIVN;AVNRLEGGRI<br>VNW;VNRLEGGRIVNWA;NRLEGGRIVNWAC;RLEGGRIVNWACN;<br><br>14 mers:<br>MITNLRRRTAMAAA;ITNLRRRTAMAAAG;TNLRRRTAMAAAGL;NLRRRTA<br>MAAAGLG;LRRRTAMAAAGLGA;RRRTAMAAAGLGAA;RRTAMAAAGLGA<br>AL;RTAMAAAGLGAALG;TAMAAAGLGAALGL;AMAAAGLGAALGLG;MAAA<br>GLGAALGLGI;AAAGLGAALGLGIL;AAGLGAALGLGILL;AGLGAALGLGILLV<br>;GLGAALGLGILLVP;LGAALGLGILLVPT;GAALGLGILLVPTV;AALGLGILLV<br>PTVD;ALGLGILLVPTVDA;LGLGILLVPTVDAH;GLGILLVPTVDAHL;LGILLV<br>PTVDAHLA;GILLVPTVDAHLAN;ILLVPTVDAHLANG;LLVPTVDAHLANGS;L<br>VPTVDAHLANGSM;VPTVDAHLANGSMS;PTVDAHLANGSMSE;TVDAHLA<br>NGSMSEV;VDAHLANGSMSEVM;DAHLANGSMSEVMM;AHLANGSMSEV<br>MMS;HLANGSMSEVMMSE;LANGSMSEVMMSEI;ANGSMSEVMMSEIA;NG<br>SMSEVMMSEIAG;GSMSEVMMSEIAGL;SMSEVMMSEIAGLP;MSEVMMSE<br>IAGLPI;SEVMMSEIAGLPIP;EVMMSEIAGLPIPP;VMMSEIAGLPIPPI;MMSEI<br>AGLPIPPII;MSEIAGLPIPPIIH;SEIAGLPIPPIIHY;EIAGLPIPPIIHYG;IAGLPIP<br>PIIHYGA;AGLPIPPIIHYGAI;GLPIPPIIHYGAIA;LPIPPIIHYGAIAY;PIPPIIHYG<br>AIAYA;IPPIIHYGAIAYAP;PPIIHYGAIAYAPS;PIIHYGAIAYAPSG;IIHYGAIAY<br>APSGA;IHYGAIAYAPSGAS;HYGAIAYAPSGASG;YGAIAYAPSGASGK;GAI<br>AYAPSGASGKA;AIAYAPSGASGKAW;IAYAPSGASGKAWH;AYAPSGASG<br>KAWHQ;YAPSGASGKAWHQR;APSGASGKAWHQRT;PSGASGKAWHQRT<br>P;SGASGKAWHQRTPA;GASGKAWHQRTPAR;ASGKAWHQRTPARA;SGK<br>AWHQRTPARAE;GKAWHQRTPARAEQ;KAWHQRTPARAEQV;AWHQRTP<br>ARAEQVA;WHQRTPARAEQVAL;HQRTPARAEQVALE;QRTPARAEQVALE<br>K;RTPARAEQVALEKC;TPARAEQVALEKCG;PARAEQVALEKCGD;ARAEQ<br>VALEKCGDK;RAEQVALEKCGDKT;AEQVALEKCGDKTC;EQVALEKCGDK<br>TCK;QVALEKCGDKTCKV;VALEKCGDKTCKVV;ALEKCGDKTCKVVS;LEK<br>CGDKTCKVVSR;EKCGDKTCKVVSRF;KCGDKTCKVVSRFT;CGDKTCKVV<br>SRFTR;GDKTCKVVSRFTRC;DKTCKVVSRFTRCG;KTCKVVSRFTRCGA;T<br>CKVVSRFTRCGAV;CKVVSRFTRCGAVA;KVVSRFTRCGAVAY;VVSRFTR<br>CGAVAYN;VSRFTRCGAVAYNG;SRFTRCGAVAYNGS;RFTRCGAVAYNG<br>SK;FTRCGAVAYNGSKY;TRCGAVAYNGSKYQ;RCGAVAYNGSKYQG;CGA<br>VAYNGSKYQGG;GAVAYNGSKYQGGT;AVAYNGSKYQGGTG;VAYNGSKY<br>QGGTGL;AYNGSKYQGGTGLT;YNGSKYQGGTGLTR;NGSKYQGGTGLTR | |

Fig. 30 continued

| | | |
|---|---|---|
| | R;GSKYQGGTGLTRRA;SKYQGGTGLTRRAA;KYQGGTGLTRRAAE;YQGGTGLTRRAAED;QGGTGLTRRAAEDD;GGTGLTRRAAEDDA;GTGLTRRAAEDDAV;TGLTRRAAEDDAVN;GLTRRAAEDDAVNR;LTRRAAEDDAVNRL;TRRAAEDDAVNRLE;RRAAEDDAVNRLEG;RAAEDDAVNRLEGG;AAEDDAVNRLEGGR;AEDDAVNRLEGGRI;EDDAVNRLEGGRIV;DDAVNRLEGGRIVN;DAVNRLEGGRIVNW;AVNRLEGGRIVNWA;VNRLEGGRIVNWAC;NRLEGGRIVNWACN;<br><br>15 mers:<br>MITNLRRRTAMAAAG;ITNLRRRTAMAAAGL;TNLRRRTAMAAAGLG;NLRRRTAMAAAGLGA;LRRRTAMAAAGLGAA;RRRTAMAAAGLGAAL;RRTAMAAAGLGAALG;RTAMAAAGLGAALGL;TAMAAAGLGAALGLG;AMAAAGLGAALGLGI;MAAAGLGAALGLGIL;AAAGLGAALGLGILL;AAGLGAALGLGILLV;AGLGAALGLGILLVP;GLGAALGLGILLVPT;LGAALGLGILLVPTV;GAALGLGILLVPTVD;AALGLGILLVPTVDA;ALGLGILLVPTVDAH;LGLGILLVPTVDAHL;GLGILLVPTVDAHLA;LGILLVPTVDAHLAN;GILLVPTVDAHLANG;ILLVPTVDAHLANGS;LLVPTVDAHLANGSM;LVPTVDAHLANGSMS;VPTVDAHLANGSMSE;PTVDAHLANGSMSEV;TVDAHLANGSMSEVM;VDAHLANGSMSEVMM;DAHLANGSMSEVMMS;AHLANGSMSEVMMSE;HLANGSMSEVMMSEI;LANGSMSEVMMSEIA;ANGSMSEVMMSEIAG;NGSMSEVMMSEIAGL;GSMSEVMMSEIAGLP;SMSEVMMSEIAGLPI;MSEVMMSEIAGLPIP;SEVMMSEIAGLPIPP;EVMMSEIAGLPIPPI;VMMSEIAGLPIPPII;MMSEIAGLPIPPIIH;MSEIAGLPIPPIIHY;SEIAGLPIPPIIHYG;EIAGLPIPPIIHYGA;IAGLPIPPIIHYGAI;AGLPIPPIIHYGAIA;GLPIPPIIHYGAIAY;LPIPPIIHYGAIAYA;PIPPIIHYGAIAYAP;IPPIIHYGAIAYAPS;PPIIHYGAIAYAPSG;PIIHYGAIAYAPSGA;IIHYGAIAYAPSGAS;IHYGAIAYAPSGASG;HYGAIAYAPSGASGK;YGAIAYAPSGASGKA;GAIAYAPSGASGKAW;AIAYAPSGASGKAWH;IAYAPSGASGKAWHQ;AYAPSGASGKAWHQR;YAPSGASGKAWHQRT;APSGASGKAWHQRTP;PSGASGKAWHQRTPA;SGASGKAWHQRTPAR;GASGKAWHQRTPARA;ASGKAWHQRTPARAE;SGKAWHQRTPARAEQ;GKAWHQRTPARAEQV;KAWHQRTPARAEQVA;AWHQRTPARAEQVAL;WHQRTPARAEQVALE;HQRTPARAEQVALEK;QRTPARAEQVALEKC;RTPARAEQVALEKCG;TPARAEQVALEKCGD;PARAEQVALEKCGDK;ARAEQVALEKCGDKT;RAEQVALEKCGDKTC;AEQVALEKCGDKTCK;EQVALEKCGDKTCKV;QVALEKCGDKTCKVV;VALEKCGDKTCKVVS;ALEKCGDKTCKVVSR;LEKCGDKTCKVVSRF;EKCGDKTCKVVSRFT;KCGDKTCKVVSRFTR;CGDKTCKVVSRFTRC;GDKTCKVVSRFTRCG;DKTCKVVSRFTRCGA;KTCKVVSRFTRCGAV;TCKVVSRFTRCGAVA;CKVVSRFTRCGAVAY;KVVSRFTRCGAVAYN;VVSRFTRCGAVAYNG;VSRFTRCGAVAYNGS;SRFTRCGAVAYNGSK;RFTRCGAVAYNGSKY;FTRCGAVAYNGSKYQ;TRCGAVAYNGSKYQG;RCGAVAYNGSKYQGG;CGAVAYNGSKYQGGT;GAVAYNGSKYQGGTG;AVAYNGSKYQGGTGL;VAYNGSKYQGGTGLT;AYNGSKYQGGTGLTR;YNGSKYQGGTGLTRR;NGSKYQGGTGLTRRA;GSKYQGGTGLTRRAA;SKYQGGTGLTRRAAE;KYQGGTGLTRRAAED;YQGGTGLTRRAAEDD;QGGTGLTRRAAEDDA;GGTGLTRRAAEDDAV;GTGLTRRAAEDDAVN;TGLTRRAAEDDAVNR;GLTRRAAEDDAVNRL;LTRRAAEDDAVNRLE;TRRAAEDDAVNRLEG;RRAAEDDAVNRLEGG;RAAEDDAVNRLEGGR;AAEDDAVNRLEGGRI;AEDDAVNRLEGGRIV;EDDAVNRLEGGRIVN;DDAVNRLEGGRIVNW;DAVNRLEGGRIVNWA;AVNRLEGGRIVNWAC;VNRLEGGRIVNWACN;<br><br>16 mers:<br>MITNLRRRTAMAAAGL;ITNLRRRTAMAAAGLG;TNLRRRTAMAAAGLGA;NLRRRTAMAAAGLGAA;LRRRTAMAAAGLGAAL;RRRTAMAAAGLGAALG;R | |

Fig. 30 continued

| | | |
|---|---|---|
| | RTAMAAAGLGAALGL;RTAMAAAGLGAALGLG;TAMAAAGLGAALGLGI;AMAAAGLGAALGLGIL;MAAAGLGAALGLGILL;AAAGLGAALGLGILLV;AAGLGAALGLGILLVP;AGLGAALGLGILLVPT;GLGAALGLGILLVPTV;LGAALGLGILLVPTVD;GAALGLGILLVPTVDA;AALGLGILLVPTVDAH;ALGLGILLVPTVDAHL;LGLGILLVPTVDAHLA;GLGILLVPTVDAHLAN;LGILLVPTVDAHLANG;GILLVPTVDAHLANGS;ILLVPTVDAHLANGSM;LLVPTVDAHLANGSMS;LVPTVDAHLANGSMSE;VPTVDAHLANGSMSEV;PTVDAHLANGSMSEVM;TVDAHLANGSMSEVMM;VDAHLANGSMSEVMMS;DAHLANGSMSEVMMSE;AHLANGSMSEVMMSEI;HLANGSMSEVMMSEIA;LANGSMSEVMMSEIAG;ANGSMSEVMMSEIAGL;NGSMSEVMMSEIAGLP;GSMSEVMMSEIAGLPI;SMSEVMMSEIAGLPIP;MSEVMMSEIAGLPIPP;SEVMMSEIAGLPIPPI;EVMMSEIAGLPIPPII;VMMSEIAGLPIPPIIH;MMSEIAGLPIPPIIHY;MSEIAGLPIPPIIHYG;SEIAGLPIPPIIHYGA;EIAGLPIPPIIHYGAI;IAGLPIPPIIHYGAIA;AGLPIPPIIHYGAIAY;GLPIPPIIHYGAIAYA;LPIPPIIHYGAIAYAP;PIPPIIHYGAIAYAPS;IPPIIHYGAIAYAPSG;PPIIHYGAIAYAPSGA;PIIHYGAIAYAPSGAS;IIHYGAIAYAPSGASG;IHYGAIAYAPSGASGK;HYGAIAYAPSGASGKA;YGAIAYAPSGASGKAW;GAIAYAPSGASGKAWH;AIAYAPSGASGKAWHQ;IAYAPSGASGKAWHQR;AYAPSGASGKAWHQRT;YAPSGASGKAWHQRTP;APSGASGKAWHQRTPA;PSGASGKAWHQRTPAR;SGASGKAWHQRTPARA;GASGKAWHQRTPARAE;ASGKAWHQRTPARAEQ;SGKAWHQRTPARAEQV;GKAWHQRTPARAEQVA;KAWHQRTPARAEQVAL;AWHQRTPARAEQVALE;WHQRTPARAEQVALEK;HQRTPARAEQVALEKC;QRTPARAEQVALEKCG;RTPARAEQVALEKCGD;TPARAEQVALEKCGDK;PARAEQVALEKCGDKT;ARAEQVALEKCGDKTC;RAEQVALEKCGDKTCK;AEQVALEKCGDKTCKV;EQVALEKCGDKTCKVV;QVALEKCGDKTCKVVS;VALEKCGDKTCKVVSR;ALEKCGDKTCKVVSRF;LEKCGDKTCKVVSRFT;EKCGDKTCKVVSRFTR;KCGDKTCKVVSRFTRC;CGDKTCKVVSRFTRCG;GDKTCKVVSRFTRCGA;DKTCKVVSRFTRCGAV;KTCKVVSRFTRCGAVA;TCKVVSRFTRCGAVAY;CKVVSRFTRCGAVAYN;KVVSRFTRCGAVAYNG;VVSRFTRCGAVAYNGS;VSRFTRCGAVAYNGSK;SRFTRCGAVAYNGSKY;RFTRCGAVAYNGSKYQ;FTRCGAVAYNGSKYQG;TRCGAVAYNGSKYQGG;RCGAVAYNGSKYQGGT;CGAVAYNGSKYQGGTG;GAVAYNGSKYQGGTGL;AVAYNGSKYQGGTGLT;VAYNGSKYQGGTGLTR;AYNGSKYQGGTGLTRR;YNGSKYQGGTGLTRRA;NGSKYQGGTGLTRRAA;GSKYQGGTGLTRRAAE;SKYQGGTGLTRRAAED;KYQGGTGLTRRAAEDD;YQGGTGLTRRAAEDDA;QGGTGLTRRAAEDDAV;GGTGLTRRAAEDDAVN;GTGLTRRAAEDDAVNR;TGLTRRAAEDDAVNRL;GLTRRAAEDDAVNRLE;LTRRAAEDDAVNRLEG;TRRAAEDDAVNRLEGG;RRAAEDDAVNRLEGGR;RAAEDDAVNRLEGGRI;AAEDDAVNRLEGGRIV;AEDDAVNRLEGGRIVN;EDDAVNRLEGGRIVNW;DDAVNRLEGGRIVNWA;DAVNRLEGGRIVNWAC;AVNRLEGGRIVNWACN | |
| 25 | **<YP_177855.1 trehalose-6-phosphate phosphatase OtsB1 Rv2006;Mycobacterium tuberculosis H37Rv>** MRCGIVVNVTGPPPTIDRRYHDAVIVGLDNVVDKATRVHAAAWTKFLDDYLTRRPQRTGEDHCPLTHDDYRRFLAGKPDGVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVG | 152697-159620 |

Fig. 30 continued

NGYLGSRGCAPESAESEAHYPGTYVAGVYNQLTDHIEGCTVDNESLVNLP
NWLSLTFRIDGGAWFNVDTVELLSYRQTFDLRRATLTRSLRFRDAGGRVT
TMTQERFASMNRPNLVALQTRIESENWSGTVDFRSLVDGGVHNTLVDRY
RQLSSQHLTTAEIEVLADSVLLRTQTSQSGIAIAVAARSTLWRDGQRVDAQ
YRVARDTNRGGHDIQVTLSAGQSVTLEKVATIFTSRDAATLTAAISAQRCLG
EAGRYAELCQQHVRAWARLWERCAIDLTGNTEELRLVRLHLLHLLQTISPH
TAELDAGVPARGLNGEAYRGHVFWDALFVAPVLSLRMPKVARSLLDYRYR
RLPAARRAAHRAGHLGAMYPWQSGSDGSEVSQQLHLNPRSGRWTPDPS
DRAHHVGLAVAYNAWHYYQVTGDRQYLVDCGAELLVEIARFWVGLAKLD
DSRGRYLIRGVIGPDEFHSGYPGNEYDGIDNNAYTNVMAVWVILRAMEAL
DLLPLTDRRHLIEKLGLTTQERDQWDDVSRRMFVPFHDGVISQFEGYSELA
ELDWDHYRHRYGNIQRLDRILEAEGDSVNNYQASKQADALMLLYLLSSDE
LIGLLARLGYRFAPTQIPGTVDYYLARTSDGSTLSAVVHAWVLARANRSNA
MEYFRQVLRSDIADVQGGTTQEGIHLAAMAGSIDLLQRCYSGLELRDDRLV
LSPQWPEALGPLEFPFVYRRHQLSLRISGRSATLTAESGDAEPIEVECRGH
VQRLRCGHTIEVGCSR

8mer
VTGPPPTI;RRYHDAVI;RYHDAVIV;HDAVIVGL;VIVGLDNV;IVGLDNVV;NV
VDKATR;VVDKATRV;ATRVHAAA;HAAAWTKF;WTKFLDDY;FLDDYLTR;YL
TRRPQR;CPLTHDDY;LTHDDYRR;THDDYRRF;YRRFLAGK;RRFLAGKP;K
PDGVADF;GVADFLAA;FLAARGIR;RLPPGSPT;DLTDDTVY;TVYGLQNL;N
LERQTFL;RQTFLQLL;LQLLNTGV;NTGVPEGK;GVPEGKSI;VPEGKSIA;EG
KSIASF;KSIASFAR;SIASFARR;SFARRLQV;FARRLQVA;RRLQVAGV;RLQ
VAGVR;LQVAGVRV;QVAGVRVA;RVAAHTSH;VAAHTSHR;HRNYGHTL;HT
LDATGL;TLDATGLA;DATGLAEV;GLAEVFAV;LAEVFAVF;AEVFAVFV;FAV
FVDGA;AVFVDGAV;FVDGAVTA;DGAVTAEL;AVTAELGL;LPAEPNPA;AEP
NPAGL;EPNPAGLI;NPAGLIET;ETAKRLGA;RLGANPGR;GANPGRCV;NPG
RCVVI;DSCQTGLR;QTGLRAGR;GRNGGFAL;GFALVIAV;ALVIAVDA;AHG
DAENL;AENLLSSG;LLSSGADA;LSSGADAV;AVVADLAA;VVADLAAV;TIPD
ALQV;IPDALQVY;ALQVYSQL;LQVYSQLK;QVYSQLKR;VYSQLKRL;SQLK
RLLT;KRLLTGRR;LLTGRRPA;LTGRRPAV;RPAVFLDF;FLDFDGTL;TLSDIV
ER;RPEAATLV;TLVDGAAE;LVDGAAEA;DGAAEALR;AAEALRAL;AEALRA
LA;EALRALAA;ALAAQCPV;AAQCPVAV;AQCPVAVI;CPVAVISG;PVAVISG
R;VISGRDLA;DLADVRNR;RVKVDGLW;KVDGLWLA;WLAGSHGF;HQNAA
ATA;NAAATAAI;ATAAIDGL;AIDGLAEA;GLAEAAAQ;AEAAAQLA;AQLADAL
R;ALREIAGA;REIAGAVV;GAVVEHKR;AVVEHKRF;KRFAVAVH;RFAVAVH
Y;FAVAVHYR;SVDNLIAA;NLIAAVRR;LIAAVRRL;AVRRLGHA;RRLGHAAG;
RLGHAAGL;GLRVTTGR;RVTTGRKV;VTTGRKVV;DIAWDKGK;EVGPDLRL
;GPDLRLPI;DLRLPIYI;LPIYIGDD;DLTDEDAF;EDAFDAVR;DAFDAVRF;DA
VRFTGV;FTGVGIVV;TGVGIVVR;RRSAATFR;RSAATFRL;TFRLECPY;RLE
CPYTV;CPYTVCQF;PYTVCQFL;YTVCQFLS;CQFLSQLA;QHDDPWTL;HD
DPWTLV;DDPWTLVF;DPWTLVFH;WTLVFHGY;QERLREAL;RLREALCA;Y
LGSRGCA;SAESEAHY;EAHYPGTY;AHYPGTYV;YPGTYVAG;GTYVAGVY;
YVAGVYNQ;QLTDHIEG;CTVDNESL;TVDNESLV;SLVNLPNW;LVNLPNWL;
NLPNWLSL;LPNWLSLT;NWLSLTFR;WLSLTFRI;RIDGGAWF;DGGAWFNV
;FNVDTVEL;NVDTVELL;DTVELLSY;TVELLSYR;ELLSYRQT;LLSYRQTF;S
YRQTFDL;RQTFDLRR;QTFDLRRA;FDLRRATL;RRATLTRS;RATLTRSL;AT
LTRSLR;LTRSLRFR;RFRDAGGR;VTTMTQER;TTMTQERF;TMTQERFA;E
RFASMNR;SMNRPNLV;NLVALQTR;LVALQTRI;SENWSGTV;NWSGTVDF;
WSGTVDFR;GTVDFRSL;TVDFRSLV;NTLVDRYR;TLVDRYRQ;LVDRYRQL
;RQLSSQHL;QLSSQHLT;LTTAEIEV;TTAEIEVL;AEIEVLAD;EVLADSVL;VL
ADSVLL;LADSVLLR;VLLRTQTS;LLRTQTSQ;SQSGIAIA;SGIAIAVA;GIAIAV

Fig. 30 continued

| | | |
|---|---|---|
| | AA;IAIAVAAR;AVAARSTL;VAARSTLW;AARSTLWR;TLWRDGQR;GQRVD<br>AQY;RVDAQYRV;DAQYRVAR;RVARDTNR;GHDIQVTL;TLSAGQSV;GQSV<br>TLEK;QSVTLEKV;TLEKVATI;LEKVATIF;VATIFTSR;DAATLTAA;TLTAAISA;<br>LTAAISAQ;TAAISAQR;AQRCLGEA;AELCQQHV;ELCQQHVR;HVRAWARL;<br>AWARLWER;RLWERCAI;WERCAIDL;TGNTEELR;NTEELRLV;EELRLVRL;<br>RLVRLHLL;RLHLLHLL;HLLHLLQT;LLHLLQTI;QTISPHTA;ELDAGVPA;GLN<br>GEAYR;EAYRGHVF;AYRGHVFW;HVFWDALF;VFWDALFV;FWDALFVA;D<br>ALFVAPV;ALFVAPVL;FVAPVLSL;VAPVLSLR;APVLSLRM;VLSLRMPK;MP<br>KVARSL;SLLDYRYR;LLDYRYRR;YRYRRLPA;RYRRLPAA;YRRLPAAR;RR<br>LPAARR;RLPAARRA;LPAARRAA;AARRAAHR;RAGHLGAM;HLGAMYPW;<br>AMYPWQSG;YPWQSGSD;SGSDGSEV;EVSQQLHL;QQLHLNPR;HLNPRS<br>GR;NPRSGRWT;WTPDPSDR;HVGLAVAY;GLAVAYNA;LAVAYNAW;VAYN<br>AWHY;AYNAWHYY;NAWHYYQV;YYQVTGDR;QVTGDRQY;VTGDRQYL;T<br>GDRQYLV;YLVDCGAE;LVDCGAEL;AELLVEIA;ELLVEIAR;LLVEIARF;VEIA<br>RFWV;RFWVGLAK;LAKLDDSR;KLDDSRGR;GRYLIRGV;RYLIRGVI;GVIG<br>PDEF;SGYPGNEY;DGIDNNAY;NAYTNVMA;AYTNVMAV;YTNVMAVW;NV<br>MAVWVI;VMAVWVIL;MAVWVILR;AVWVILRA;VILRAMEA;ILRAMEAL;RAM<br>EALDL;AMEALDLL;EALDLLPL;ALDLLPLT;DLLPLTDR;PLTDRRHL;RRHLIE<br>KL;HLIEKLGL;TTQERDQW;DQWDDVSR;DVSRRMFV;SRRMFVPF;RRMF<br>VPFH;FVPFHDGV;VPFHDGVI;VISQFEGY;SQFEGYSE;GYSELAEL;SELAE<br>LDW;AELDWDHY;ELDWDHYR;DWDHYRHR;HRYGNIQR;RYGNIQRL;IQR<br>LDRIL;RLDRILEA;KQADALML;QADALMLL;DALMLLYL;ALMLLYLL;MLLYLL<br>SS;YLLSSDEL;LLSSDELI;SSDELIGL;ELIGLLAR;LIGLLARL;GLLARLGY;LL<br>ARLGYR;YRFAPTQI;APTQIPGT;QIPGTVDY;IPGTVDYY;GTVDYYLA;TVD<br>YYLAR;RTSDGSTL;DGSTLSAV;TLSAVVHA;LSAVVHAW;SAVVHAWV;AV<br>VHAWVL;VVHAWVLA;HAWVLARA;WVLARANR;RANRSNAM;RSNAMEYF;<br>SNAMEYFR;AMEYFRQV;MEYFRQVL;EYFRQVLR;RQVLRSDI;TTQEGIHL;<br>TQEGIHLA;EGIHLAAM;HLAAMAGS;LAAMAGSI;AMAGSIDL;MAGSIDLL;G<br>SIDLLQR;SIDLLQRC;LQRCYSGL;RCYSGLEL;CYSGLELR;ELRDDRLV;LR<br>DDRLVL;RLVLSPQW;VLSPQWPE;SPQWPEAL;WPEALGPL;EALGPLEF;G<br>PLEFPFV;PLEFPFVY;LEFPFVYR;EFPFVYRR;FPFVYRRH;FVYRRHQL;YR<br>RHQLSL;RRHQLSLR;LSLRISGR;EPIEVECR;EVECRGHV;ECRGHVQR;RG<br>HVQRLR;RLRCGHTI;RCGHTIEV;TIEVGCSR<br>9mer<br>MRCGIVVNV;NVTGPPPTI;RRYHDAVIV;YHDAVIVGL;AVIVGLDNV;VIVGL<br>DNVV;GLDNVVDKA;NVVDKATRV;ATRVHAAAW;RVHAAAWTK;HAAAWT<br>KFL;WTKFLDDYL;KFLDDYLTR;FLDDYLTRR;DYLTRRPQR;YLTRRPQRT;<br>RTGEDHCPL;LTHDDYRRF;THDDYRRFL;DYRRFLAGK;FLAGKPDGV;GVA<br>DFLAAR;DFLAARGIR;FLAARGIRL;AARGIRLPP;RLPPGSPTD;LPPGSPTD<br>L;TDLTDDTVY;DLTDDTVYG;LTDDTVYGL;DTVYGLQNL;TVYGLQNLE;VY<br>GLQNLER;LQNLERQTF;LERQTFLQL;FLQLLNTGV;KSIASFARR;SIASFAR<br>RL;RRLQVAGVR;RLQVAGVRV;LQVAGVRVA;QVAGVRVAA;RVAAHTSHR<br>;SHRNYGHTL;HTLDATGLA;LDATGLAEV;DATGLAEVF;TGLAEVFAV;GLA<br>EVFAVF;LAEVFAVFV;FAVFVDGAV;VFVDGAVTA;VTAELGLPA;GLPAEPN<br>PA;LPAEPNPAG;EPNPAGLIE;NPAGLIETA;GLIETAKRL;ETAKRLGAN;KRL<br>GANPGR;GANPGRCVV;VIDSCQTGL;CQTGLRAGR;LRAGRNGGF;AGRN<br>GGFAL;GRNGGFALV;GGFALVIAV;FALVIAVDA;AHGDAENLL;AENLLSSG<br>A;LLSSGADAV;LSSGADAVV;DAVVADLAA;AVVADLAAV;VADLAAVTV;DL<br>AAVTVGS;AISTIPDAL;STIPDALQV;TIPDALQVY;ALQVYSQLK;LQVYSQLK<br>R;QVYSQLKRL;VYSQLKRLL;QLKRLLTGR;RLLTGRRPA;LLTGRRPAV;LT<br>GRRPAVF;RRPAVFLDF;VFLDFDGTL;FLDFDGTLS;GTLSDIVER;TLSDIVE<br>RP;VERPEAATL;EAATLVDGA;TLVDGAAEA;LVDGAAEAL;GAAEALRAL;A<br>EALRALAA;RALAAQCPV;ALAAQCPVA;LAAQCPVAV;CPVAVISGR;AVISG | |

Fig. 30 continued

| | | |
|---|---|---|
| | RDLA;DLADVRNRV;VKVDGLWLA;LWLAGSHGF;LAGSHGFEL;AGSHGFE<br>LV;VAPDGSHHQ;HQNAAATAA;QNAAATAAI;AATAAIDGL;ATAAIDGLA;AAI<br>DGLAEA;AIDGLAEAA;GLAEAAAQL;AEAAAQLAD;EAAAQLADA;AAAQLAD<br>AL;AAQLADALR;QLADALREI;ALREIAGAV;EIAGAVVEH;IAGAVVEHK;VVE<br>HKRFAV;KRFAVAVHY;RFAVAVHYR;AVAVHYRNV;VADDSVDNL;SVDNLI<br>AAV;NLIAAVRRL;AVRRLGHAA;RRLGHAAGL;RLGHAAGLR;GLRVTTGRK;<br>RVTTGRKVV;VELRPDIAW;IAWDKGKAL;KALDWIGER;ALDWIGERL;WIGE<br>RLGPA;GERLGPAEV;RLGPAEVGP;GPAEVGPDL;AEVGPDLRL;LPIYIGDD<br>L;FDAVRFTGV;AVRFTGVGI;RFTGVGIVV;FTGVGIVVR;DRRSAATFR;RRS<br>AATFRL;ATFRLECPY;FRLECPYTV;ECPYTVCQF;CPYTVCQFL;YTVCQFL<br>SQ;TVCQFLSQL;FLSQLACDL;QLACDLQEA;LACDLQEAV;EAVQHDDPW;<br>VQHDDPWTL;QHDDPWTLV;HDDPWTLVF;PWTLVFHGY;GYDPGQERL;R<br>LREALCAV;ALCAVGNGY;ESAESEAHY;AESEAHYPG;SEAHYPGTY;EAHY<br>PGTYV;YPGTYVAGV;YVAGVYNQL;VYNQLTDHI;QLTDHIEGC;CTVDNESL<br>V;ESLVNLPNW;SLVNLPNWL;NLPNWLSLT;LPNWLSLTF;NWLSLTFRI;LTF<br>RIDGGA;FRIDGGAWF;RIDGGAWFN;GAWFNVDTV;WFNVDTVEL;FNVDT<br>VELL;DTVELLSYR;ELLSYRQTF;LSYRQTFDL;SYRQTFDLR;YRQTFDLRR;<br>RQTFDLRRA;DLRRATLTR;RRATLTRSL;RATLTRSLR;ATLTRSLRF;TLTRS<br>LRFR;RFRDAGGRV;RVTTMTQER;TTMTQERFA;MTQERFASM;ASMNRP<br>NLV;SMNRPNLVA;RPNLVALQT;NLVALQTRI;QTRIESENW;ESENWSGTV;<br>NWSGTVDFR;GTVDFRSLV;FRSLVDGGV;SLVDGGVHN;LVDGGVHNT;GV<br>HNTLVDR;HNTLVDRYR;TLVDRYRQL;YRQLSSQHL;RQLSSQHLT;QLSSQ<br>HLTT;SQHLTTAEI;HLTTAEIEV;LTTAEIEVL;TTAEIEVLA;AEIEVLADS;IEVL<br>ADSVL;EVLADSVLL;VLADSVLLR;VLLRTQTSQ;QTSQSGIAI;SQSGIAIAV;S<br>GIAIAVAA;GIAIAVAAR;IAVAARSTL;AVAARSTLW;VAARSTLWR;STLWRD<br>GQR;TLWRDGQRV;GQRVDAQYR;QRVDAQYRV;YRVARDTNR;VTLSAGQ<br>SV;TLSAGQSVT;AGQSVTLEK;GQSVTLEKV;VTLEKVATI;KVATIFTSR;TIF<br>TSRDAA;FTSRDAATL;DAATLTAAI;ATLTAAISA;TLTAAISAQ;LTAAISAQR;<br>CLGEAGRYA;GEAGRYAEL;ELCQQHVRA;QQHVRAWAR;QHVRAWARL;R<br>AWARLWER;DLTGNTEEL;LTGNTEELR;NTEELRLVR;ELRLVRLHL;RLVRL<br>HLLH;LVRLHLLHL;RLHLLHLLQ;HLLHLLQTI;QTISPHTAE;TISPHTAEL;HTA<br>ELDAGV;AELDAGVPA;ELDAGVPAR;RGLNGEAYR;GEAYRGHVF;EAYRG<br>HVFW;HVFWDALFV;VFWDALFVA;WDALFVAPV;DALFVAPVL;FVAPVLSL<br>R;PVLSLRMPK;VLSLRMPKV;SLRMPKVAR;RMPKVARSL;MPKVARSLL;K<br>VARSLLDY;VARSLLDYR;RSLLDYRYR;SLLDYRYRR;LLDYRYRRL;DYRYR<br>RLPA;RYRRLPAAR;RLPAARRAA;LPAARRAAH;RRAAHRAGH;RAAHRAG<br>HL;HRAGHLGAM;RAGHLGAMY;HLGAMYPWQ;AMYPWQSGS;YPWQSGS<br>DG;SEVSQQLHL;SQQLHLNPR;HLNPRSGRW;WTPDPSDRA;TPDPSDRA<br>H;DPSDRAHHV;RAHHVGLAV;HHVGLAVAY;GLAVAYNAW;AVAYNAWHY;<br>VAYNAWHYY;AYNAWHYYQ;YNAWHYYQV;NAWHYYQVT;HYYQVTGDR;<br>YQVTGDRQY;QVTGDRQYL;VTGDRQYLV;RQYLVDCGA;YLVDCGAEL;LV<br>DCGAELL;CGAELLVEI;AELLVEIAR;ELLVEIARF;LVEIARFWV;EIARFWVG<br>L;IARFWVGLA;ARFWVGLAK;KLDDSRGRY;DSRGRYLIR;GRYLIRGVI;YLI<br>RGVIGP;HSGYPGNEY;YPGNEYDGI;YDGIDNNAY;NAYTNVMAV;AYTNVM<br>AVW;YTNVMAVWV;NVMAVWVIL;VMAVWVILR;MAVWVILRA;AVWVILRA<br>M;WVILRAMEA;VILRAMEAL;RAMEALDLL;MEALDLLPL;EALDLLPLT;DLLP<br>LTDRR;LPLTDRRHL;PLTDRRHLI;TDRRHLIEK;HLIEKLGLT;KLGLTTQER;L<br>TTQERDQW;DQWDDVSRR;VSRRMFVPF;MFVPFHDGV;FVPFHDGVI;VPF<br>HDGVIS;FHDGVISQF;GVISQFEGY;SQFEGYSEL;EGYSELAEL;YSELAEL<br>DW;LAELDWDHY;AELDWDHYR;ELDWDHYRH;HYRHRYGNI;RHRYGNIQ<br>R;HRYGNIQRL;RLDRILEAE;ILEAEGDSV;AEGDSVNNY;SVNNYQASK;YQ<br>ASKQADA;QASKQADAL;KQADALMLL;QADALMLLY;DALMLLYLL;ALMLLY<br>LLS;LMLLYLLSS;LYLLSSDEL;YLLSSDELI;LSSDELIGL;SSDELIGLL;DELIG | |

Fig. 30 continued

LLAR;ELIGLLARL;GLLARLGYR;LLARLGYRF;RLGYRFAPT;GYRFAPTQI;APTQIPGTV;TQIPGTVDY;QIPGTVDYY;IPGTVDYYL;GTVDYYLAR;YYLARTSDG;YLARTSDGS;DGSTLSAVV;STLSAVVHA;TLSAVVHAW;LSAVVHAWV;SAVVHAWVL;AVVHAWVLA;VVHAWVLAR;AWVLARANR;RSNAMEYFR;NAMEYFRQV;AMEYFRQVL;MEYFRQVLR;RQVLRSDIA;VLRSDIADV;TTQEGIHLA;TQEGIHLAA;HLAAMAGSI;AAMAGSIDL;AMAGSIDLL;SIDLLQRCY;LLQRCYSGL;RCYSGLELR;GLELRDDRL;ELRDDRLVL;VLSPQWPEA;PEALGPLEF;ALGPLEFPF;GPLEFPFVY;PLEFPFVYR;LEFPFVYRR;PFVYRRHQL;VYRRHQLSL;RRHQLSLRI;QLSLRISGR;SLRISGRSA;RISGRSATL;SGRSATLTA;AESGDAEPI;SGDAEPIEV;IEVECRGHV;HTIEVGCSR

10mer

TIDRRYHDAV;RYHDAVIVGL;DAVIVGLDNV;AVIVGLDNVV;IVGLDNVVDK;GLDNVVDKAT;KATRVHAAAW;RVHAAAWTKF;AAWTKFLDDY;TKFLDDYLTR;KFLDDYLTRR;FLDDYLTRRP;DDYLTRRPQR;LTHDDYRRFL;FLAGKPDGVA;DGVADFLAAR;RLPPGSPTDL;LPPGSPTDLT;PTDLTDDTVY;DLTDDTVYGL;TVYGLQNLER;LQNLERQTFL;NLERQTFLQL;LERQTFLQLL;TFLQLLNTGV;LLNTGVPEGK;VPEGKSIASF;EGKSIASFAR;GKSIASFARR;KSIASFARRL;FARRLQVAGV;RRLQVAGVRV;RLQVAGVRVA;LQVAGVRVAA;VAAHTSHRNY;TLDATGLAEV;ATGLAEVFAV;GLAEVFAVFV;AEVFAVFVDG;EVFAVFVDGA;FAVFVDGAVT;AVFVDGAVTA;FVDGAVTAEL;LPAEPNPAGL;EPNPAGLIET;NPAGLIETAK;RLGANPGRCV;VVIDSCQTGL;SCQTGLRAGR;GLRAGRNGGF;RAGRNGGFAL;GRNGGFALVI;FALVIAVDAH;AENLLSSGAD;NLLSSGADAV;LLSSGADAVV;DAVVADLAAV;VVADLAAVTV;AAISTIPDAL;STIPDALQVY;DALQVYSQLK;ALQVYSQLKR;LQVYSQLKRL;QVYSQLKRLL;SQLKRLLTGR;QLKRLLTGRR;KRLLTGRRPA;RLLTGRRPAV;LLTGRRPAVF;LTGRRPAVFL;AVFLDFDGTL;FLDFDGTLSD;DGTLSDIVER;VERPEAATLV;EAATLVDGAA;TLVDGAAEAL;LVDGAAEALR;AEALRALAAQ;LRALAAQCPV;ALAAQCPVAV;LAAQCPVAVI;VISGRDLADV;DLADVRNRVK;GLWLAGSHGF;WLAGSHGFEL;LAGSHGFELV;HQNAAATAAI;AAATAAIDGL;AAIDGLAEAA;AIDGLAEAAA;GLAEAAAQLA;AEAAAQLADA;EAAAQLADAL;AAAQLADALR;AQLADALREI;QLADALREIA;DALREIAGAV;ALREIAGAVV;EIAGAVVEHK;IAGAVVEHKR;AVVEHKRFAV;VEHKRFAVAV;KRFAVAVHYR;FAVAVHYRNV;NVADDSVDNL;DSVDNLIAAV;SVDNLIAAVR;RRLGHAAGLR;RLGHAAGLRV;AAGLRVTTGR;AGLRVTTGRK;GLRVTTGRKV;TTGRKVVELR;DIAWDKGKAL;KALDWIGERL;EVGPDLRLPI;GPDLRLPIYI;RLPIYIGDDL;LPIYIGDDLT;DLTDEDAFDA;LTDEDAFDAV;AFDAVRFTGV;DAVRFTGVGI;AVRFTGVGIV;RFTGVGIVVR;LECPYTVCQF;ECPYTVCQFL;CPYTVCQFLS;YTVCQFLSQL;TVCQFLSQLA;QFLSQLACDL;FLSQLACDLQ;SQLACDLQEA;QLACDLQEAV;AVQHDDPWTL;VQHDDPWTLV;QHDDPWTLVF;DPWTLVFHGY;EALCAVGNGY;ALCAVGNGYL;AVGNGYLGSR;APESAESEAH;AESEAHYPGT;ESEAHYPGTY;SEAHYPGTYV;EAHYPGTYVA;HYPGTYVAGV;YPGTYVAGVY;TYVAGVYNQL;YVAGVYNQLT;GVYNQLTDHI;QLTDHIEGCT;LTDHIEGCTV;EGCTVDNESL;TVDNESLVNL;NESLVNLPNW;ESLVNLPNWL;SLVNLPNWLS;LVNLPNWLSL;NLPNWLSLTF;LPNWLSLTFR;SLTFRIDGGA;LTFRIDGGAW;TFRIDGGAWF;RIDGGAWFNV;AWFNVDTVEL;NVDTVELLSY;DTVELLSYRQ;VELLSYRQTF;LLSYRQTFDL;LSYRQTFDLR;SYRQTFDLRR;QTFDLRRATL;RRATLTRSLR;RATLTRSLRF;ATLTRSLRFR;SLRFRDAGGR;TTMTQERFAS;TMTQERFASM;TQERFASMNR;FASMNRPNLV;SMNRPNLVAL;RPNLVALQTR;IESENWSGTV;SENWSGTVDF;ENWSGTVDFR;SGTVDFRSLV;SLVDGGVHNT;LVDGGVHNTL;GVHNTLVDRY;VHNTLVDRYR;TLVDRYRQLS;RYRQLSSQHL;RQLSSQHLTT;QLSSQHLTTA;HLTTAEIEVL;AEIEVLADSV;EIEVLADSVL;IEVLADSVLL;EVLADSVLLR;VLADSVLLRT;TQTSQSGIAI;TSQSGIAIAV;SQSGIAIAVA;SGIAIAVAAR;AIAVA

Fig. 30 continued

| | | |
|---|---|---|
| | ARSTL;IAVAARSTLW;AVAARSTLWR;RSTLWRDGQR;STLWRDGQRV;GQRVDAQYRV;RVDAQYRVAR;QYRVARDTNR;QVTLSAGQSV;TLSAGQSVTL;SAGQSVTLEK;VTLEKVATIF;TLEKVATIFT;EKVATIFTSR;TSRDAATLTA;TLTAAISAQR;AQRCLGEAGR;RYAELCQQHV;YAELCQQHVR;AELCQQHVRA;CQQHVRAWAR;QQHVRAWARL;VRAWARLWER;WARLWERCAI;RLWERCAIDL;DLTGNTEELR;EELRLVRLHL;ELRLVRLHLL;RLVRLHLLHL;LVRLHLLHLL;RLHLLHLLQT;HLLQTISPHT;LLQTISPHTA;QTISPHTAEL;VPARGLNGEA;GEAYRGHVFW;YRGHVFWDAL;HVFWDALFVA;FWDALFVAPV;ALFVAPVLSL;LFVAPVLSLR;FVAPVLSLRM;APVLSLRMPK;PVLSLRMPKV;VLSLRMPKVA;LSLRMPKVAR;LRMPKVARSL;RMPKVARSLL;KVARSLLDYR;ARSLLDYRYR;RSLLDYRYRR;SLLDYRYRRL;YRYRRLPAAR;RYRRLPAARR;RRLPAARRAA;LPAARRAAHR;RRAAHRAGHL;HRAGHLGAMY;HLGAMYPWQS;AMYPWQSGSD;YPWQSGSDGS;WQSGSDGSEV;VSQQLHLNPR;QLHLNPRSGR;HLNPRSGRWT;NPRSGRWTPD;VGLAVAYNAW;LAVAYNAWHY;AVAYNAWHYY;AYNAWHYYQV;YYQVTGDRQY;YQVTGDRQYL;QVTGDRQYLV;QYLVDCGAEL;YLVDCGAELL;LVDCGAELLV;AELLVEIARF;LLVEIARFWV;VEIARFWVGL;EIARFWVGLA;IARFWVGLAK;ARFWVGLAKL;LAKLDDSRGR;KLDDSRGRYL;RGRYLIRGVI;FHSGYPGNEY;GYPGNEYDGI;EYDGIDNNAY;GIDNNAYTNV;NNAYTNVMAV;NAYTNVMAVW;AYTNVMAVWV;YTNVMAVWVI;NVMAVWVILR;VMAVWVILRA;MAVWVILRAM;WVILRAMEAL;ILRAMEALDL;AMEALDLLPL;LLPLTDRRHL;LPLTDRRHLI;LTDRRHLIEK;RRHLIEKLGL;HLIEKLGLTT;QWDDVSRRMF;DVSRRMFVPF;RMFVPFHDGV;PFHDGVISQF;SQFEGYSELA;FEGYSELAEL;GYSELAELDW;ELAELDWDHY;LAELDWDHYR;ELDWDHYRHR;RYGNIQRLDR;RLDRILEAEG;RILEAEGDSV;EAEGDSVNNY;DSVNNYQASK;YQASKQADAL;QASKQADALM;KQADALMLLY;QADALMLLYL;ALMLLYLLSS;LLYLLSSDEL;LYLLSSDELI;YLLSSDELIG;LLSSDELIGL;LSSDELIGLL;DELIGLLARL;IGLLARLGYR;GLLARLGYRF;LLARLGYRFA;FAPTQIPGTV;TQIPGTVDYY;QIPGTVDYYL;IPGTVDYYLA;YYLARTSDGS;YLARTSDGST;LARTSDGSTL;RTSDGSTLSA;TSDGSTLSAV;STLSAVVHAW;TLSAVVHAWV;LSAVVHAWVL;AVVHAWVLAR;VVHAWVLARA;HAWVLARANR;VLARANRSNA;LARANRSNAM;RANRSNAMEY;NRSNAMEYFR;NAMEYFRQVL;AMEYFRQVLR;YFRQVLRSDI;QVLRSDIADV;VQGGTTQEGI;TTQEGIHLAA;TQEGIHLAAM;LAAMAGSIDL;AAMAGSIDLL;AMAGSIDLLQ;MAGSIDLLQR;GSIDLLQRCY;DLLQRCYSGL;LQRCYSGLEL;GLELRDDRLV;LELRDDRLVL;LVLSPQWPEA;VLSPQWPEAL;WPEALGPLEF;EALGPLEFPF;ALGPLEFPFV;PLEFPFVYRR;FPFVYRRHQL;FVYRRHQLSL;VYRRHQLSLR;HQLSLRISGR;LRISGRSATL;ESGDAEPIEV;DAEPIEVECR;EVECRGHVQR;VECRGHVQRL;ECRGHVQRLR;VQRLRCGHTI;RLRCGHTIEV<br>11mer<br>NVTGPPPTIDR;VTGPPPTIDRR;PTIDRRYHDAV;TIDRRYHDAVI;RRYHDAVIVGL;HDAVIVGLDNV;DAVIVGLDNVV;VIVGLDNVVDK;VVDKATRVHAA;ATRVHAAAWTK;RVHAAAWTKFL;AAAWTKFLDDY;AAWTKFLDDYL;WTKFLDDYLTR;TKFLDDYLTRR;FLDDYLTRRPQ;YLTRRPQRTGE;CPLTHDDYRRF;PLTHDDYRRFL;RRFLAGKPDGV;FLAGKPDGVAD;KPDGVADFLAA;GVADFLAARGI;RLPPGSPTDLT;SPTDLTDDTVY;DLTDDTVYGLQ;DTVYGLQNLER;TVYGLQNLERQ;GLQNLERQTFL;NLERQTFLQLL;QTFLQLLNTGV;QLLNTGVPEGK;GVPEGKSIASF;VPEGKSIASFA;EGKSIASFARR;SIASFARRLQV;SFARRLQVAGV;FARRLQVAGVR;RRLQVAGVRVA;RLQVAGVRVAA;LQVAGVRVAAH;QVAGVRVAAHT;GVRVAAHTSHR;RVAAHTSHRNY;HTSHRNYGHTL;NYGHTLDATGL;HTLDATGLAEV;TLDATGLAEVF;DATGLAEVFAV;TGLAEVFAVFV;AEVFAVFVDGA;EVFAVFVDGAV;FAVFVDGAVTA;VFVDGAVTAEL;GLPAEPNPAGL;LPAEPNPAGLI;AEPNPAGLIET;EPNPAGLIET | |

Fig. 30 continued

| | | |
|---|---|---|
| | A;NPAGLIETAKR;GLIETAKRLGA;TAKRLGANPGR;KRLGANPGRCV;RLGANPGRCVV;CVVIDSCQTGL;VVIDSCQTGLR;VIDSCQTGLRA;DSCQTGLRAGR;GLRAGRNGGFA;LRAGRNGGFAL;RAGRNGGFALV;AVDAHGDAENL;AENLLSSGADA;NLLSSGADAVV;LLSSGADAVVA;SGADAVVADLA;DAVVADLAAVT;AVVADLAAVTV;DAAISTIPDAL;AISTIPDALQV;ISTIPDALQVY;TIPDALQVYSQ;IPDALQVYSQL;DALQVYSQLKR;ALQVYSQLKRL;LQVYSQLKRLL;YSQLKRLLTGR;SQLKRLLTGRR;KRLLTGRRPAV;RLLTGRRPAVF;LLTGRRPAVFL;FLDFDGTLSDI;TLSDIVERPEA;DIVERPEAATL;IVERPEAATLV;TLVDGAAEALR;LVDGAAEALRA;GAAEALRALAA;AEALRALAAQC;ALRALAAQCPV;RALAAQCPVAV;ALAAQCPVAVI;AQCPVAVISGR;CPVAVISGRDL;AVISGRDLADV;VISGRDLADVR;DLADVRNRVKV;DVRNRVKVDGL;LWLAGSHGFEL;WLAGSHGFELV;ELVAPDGSHHQ;VAPDGSHHQNA;APDGSHHQNAA;HHQNAAATAAI;NAAATAAIDGL;ATAAIDGLAEA;TAAIDGLAEAA;AAIDGLAEAAA;AIDGLAEAAAQ;AEAAAQLADAL;EAAAQLADALR;AQLADALREIA;DALREIAGAVV;EIAGAVVEHKR;IAGAVVEHKRF;GAVVEHKRFAV;AVVEHKRFAVA;VVEHKRFAVAV;HKRFAVAVHYR;KRFAVAVHYRN;FAVAVHYRNVA;NVADDSVDNLI;DSVDNLIAAVR;SVDNLIAAVRR;LIAAVRRLGHA;AVRRLGHAAGL;RRLGHAAGLRV;HAAGLRVTTGR;AAGLRVTTGRK;GLRVTTGRKVV;RVTTGRKVVEL;VTTGRKVVELR;KVVELRPDIAW;IAWDKGKALDW;KGKALDWIGER;ALDWIGERLGP;WIGERLGPAEV;RLGPAEVGPDL;GPAEVGPDLRL;AEVGPDLRLPI;EVGPDLRLPIY;YIGDDLTDEDA;DLTDEDAFDAV;LTDEDAFDAVR;DAFDAVRFTGV;DAVRFTGVGIV;AVRFTGVGIVV;IVVRHNEHGDR;VVRHNEHGDRR;SAATFRLECPY;ATFRLECPYTV;LECPYTVCQFL;CPYTVCQFLSQ;PYTVCQFLSQL;YTVCQFLSQLA;SQLACDLQEAV;EAVQHDDPWTL;AVQHDDPWTLV;VQHDDPWTLVF;VFHGYDPGQER;FHGYDPGQERL;DPGQERLREAL;QERLREALCAV;REALCAVGNGY;EALCAVGNGYL;CAVGNGYLGSR;YLGSRGCAPES;APESAESEAHY;AESEAHYPGTY;AHYPGTYVAGV;HYPGTYVAGVY;GTYVAGVYNQL;QLTDHIEGCTV;EGCTVDNESLV;CTVDNESLVNL;NESLVNLPNWL;SLVNLPNWLSL;VNLPNWLSLTF;NLPNWLSLTFR;LPNWLSLTFRI;LTFRIDGGAWF;FRIDGGAWFNV;AWFNVDTVELL;NVDTVELLSYR;TVELLSYRQTF;ELLSYRQTFDL;LLSYRQTFDLR;LSYRQTFDLRR;RQTFDLRRATL;TFDLRRATLTR;DLRRATLTRSL;RRATLTRSLRF;RATLTRSLRFR;TLTRSLRFRDA;RSLRFRDAGGR;SLRFRDAGGRV;RFRDAGGRVTT;FRDAGGRVTTM;GGRVTTMTQER;GRVTTMTQERF;TTMTQERFASM;MTQERFASMNR;ASMNRPNLVAL;SMNRPNLVALQ;RPNLVALQTRI;RIESENWSGTV;SENWSGTVDFR;WSGTVDFRSLV;SLVDGGVHNTL;LVDGGVHNTLV;GVHNTLVDRYR;RQLSSQHLTTA;SQHLTTAEIEV;QHLTTAEIEVL;HLTTAEIEVLA;TTAEIEVLADS;AEIEVLADSVL;EIEVLADSVLL;EVLADSVLLRT;VLADSVLLRTQ;VLLRTQTSQSG;LLRTQTSQSGI;QTSQSGIAIAV;SQSGIAIAVAA;QSGIAIAVAAR;IAIAVAARSTL;AIAVAARSTLW;IAVAARSTLWR;TLWRDGQRVDA;WRDGQRVDAQY;DGQRVDAQYRV;QRVDAQYRVAR;AQYRVARDTNR;DTNRGGHDIQV;IQVTLSAGQSV;VTLSAGQSVTL;LSAGQSVTLEK;SAGQSVTLEKV;TIFTSRDAATL;FTSRDAATLTA;DAATLTAAISA;ATLTAAISAQR;TLTAAISAQRC;LTAAISAQRCL;AISAQRCLGEA;SAQRCLGEAGR;AQRCLGEAGRY;CLGEAGRYAEL;RYAELCQQHVR;AELCQQHVRAW;ELCQQHVRAWA;HVRAWARLWER;AWARLWERCAI;RLWERCAIDLT;AIDLTGNTEEL;DLTGNTEELRL;LTGNTEELRLV;TEELRLVRLHL;EELRLVRLHLL;RLVRLHLLHLL;LVRLHLLHLLQ;RLHLLHLLQTI;HLLQTISPHTA;LQTISPHTAEL;HTAELDAGVPA;TAELDAGVPAR;ELDAGVPARGL;VPARGLNGEAY;PARGLNGEAYR;GLNGEAYRGHV;EAYRGHVFWDA;AYRGHVFWDAL;RGHVFWDALFV;VFWDALFVAPV;DALFVAPVLSL;ALFVAPVLSLR;VAPVLSLRMPK;APVLSLRMPKV;VLSLRMPKVAR;SLRMPKVARSL;MPKVARSLLDY;KVARSLLDYRY;VARSLLDYRYR;SLLDYRYRRLP;LL | |

Fig. 30 continued

| | | |
|---|---|---|
| | DYRYRRLPA;DYRYRRLPAAR;YRYRRLPAARR;RYRRLPAARRA;RRLPAARRAAH;RLPAARRAAHR;LPAARRAAHRA;RAAHRAGHLGA;AAHRAGHLGAM;RAGHLGAMYPW;YPWQSGSDGSE;EVSQQLHLNPR;QQLHLNPRSGR;HLNPRSGRWTP;RAHHVGLAVAY;GLAVAYNAWHY;LAVAYNAWHYY;VAYNAWHYYQV;AWHYYQVTGDR;HYYQVTGDRQY;YYQVTGDRQYL;YQVTGDRQYLV;RQYLVDCGAEL;QYLVDCGAELL;YLVDCGAELLV;AELLVEIARFW;ELLVEIARFWV;VEIARFWVGLA;EIARFWVGLAK;IARFWVGLAKL;WVGLAKLDDSR;KLDDSRGRYLI;GRYLIRGVIGP;YLIRGVIGPDE;VIGPDEFHSGY;EFHSGYPGNEY;NEYDGIDNNAY;DGIDNNAYTNV;GIDNNAYTNVM;NAYTNVMAVWV;AYTNVMAVWVI;YTNVMAVWVIL;TNVMAVWVILR;NVMAVWVILRA;VMAVWVILRAM;MAVWVILRAME;AVWVILRAMEA;VILRAMEALDL;ILRAMEALDLL;RAMEALDLLPL;EALDLLPLTDR;DLLPLTDRRHL;LLPLTDRRHLI;PLTDRRHLIEK;HLIEKLGLTTQ;LGLTTQERDQW;TTQERDQWDDV;QWDDVSRRMFV;DVSRRMFVPFH;RRMFVPFHDGV;RMFVPFHDGVI;VPFHDGVISQF;VISQFEGYSEL;SQFEGYSELAE;SELAELDWDHY;ELAELDWDHYR;ELDWDHYRHRY;HYRHRYGNIQR;YRHRYGNIQRL;HRYGNIQRLDR;RYGNIQRLDRI;LEAEGDSVNNY;AEGDSVNNYQA;SVNNYQASKQA;NYQASKQADAL;YQASKQADALM;KQADALMLLYL;QADALMLLYLL;MLLYLLSSDEL;LLYLLSSDELI;YLLSSDELIGL;LLSSDELIGLL;SSDELIGLLAR;ELIGLLARLGY;LIGLLARLGYR;GLLARLGYRFA;RLGYRFAPTQI;RFAPTQIPGTV;APTQIPGTVDY;PTQIPGTVDYY;TQIPGTVDYYL;QIPGTVDYYLA;YYLARTSDGST;YLARTSDGSTL;RTSDGSTLSAV;TSDGSTLSAVV;GSTLSAVVHAW;STLSAVVHAWV;TLSAVVHAWVL;LSAVVHAWVLA;SAVVHAWVLAR;AVVHAWVLARA;WVLARANRSNA;VLARANRSNAM;RANRSNAMEYF;ANRSNAMEYFR;NAMEYFRQVLR;EYFRQVLRSDI;RQVLRSDIADV;DVQGGTTQEGI;TTQEGIHLAAM;GIHLAAMAGSI;HLAAMAGSIDL;LAAMAGSIDLL;AMAGSIDLLQR;LLQRCYSGLEL;LQRCYSGLELR;CYSGLELRDDR;GLELRDDRLVL;RLVLSPQWPEA;LVLSPQWPEAL;SPQWPEALGPL;QWPEALGPLEF;PEALGPLEFPF;EALGPLEFPFV;ALGPLEFPFVY;FPFVYRRHQLS;FVYRRHQLSLR;VYRRHQLSLRI;QLSLRISGRSA;SLRISGRSATL;RISGRSATLTA;LTAESGDAEPI;AESGDAEPIEV;EPIEVECRGHV;EVECRGHVQRL<br><br>13 mers:<br>MRCGIVVNVTGPP;RCGIVVNVTGPPP;CGIVVNVTGPPPT;GIVVNVTGPPPTI;IVVNVTGPPPTID;VVNVTGPPPTIDR;VNVTGPPPTIDRR;NVTGPPPTIDRRY;VTGPPPTIDRRYH;TGPPPTIDRRYHD;GPPPTIDRRYHDA;PPPTIDRRYHDAV;PPTIDRRYHDAVI;PTIDRRYHDAVIV;TIDRRYHDAVIVG;IDRRYHDAVIVGL;DRRYHDAVIVGLD;RRYHDAVIVGLDN;RYHDAVIVGLDNV;YHDAVIVGLDNVV;HDAVIVGLDNVVD;DAVIVGLDNVVDK;AVIVGLDNVVDKA;VIVGLDNVVDKAT;IVGLDNVVDKATR;VGLDNVVDKATRV;GLDNVVDKATRVH;LDNVVDKATRVHA;DNVVDKATRVHAA;NVVDKATRVHAAA;VVDKATRVHAAAW;VDKATRVHAAAWT;DKATRVHAAAWTK;KATRVHAAAWTKF;ATRVHAAAWTKFL;TRVHAAAWTKFLD;RVHAAAWTKFLDD;VHAAAWTKFLDDY;HAAAWTKFLDDYL;AAAWTKFLDDYLT;AAWTKFLDDYLTR;AWTKFLDDYLTRR;WTKFLDDYLTRRP;TKFLDDYLTRRPQ;KFLDDYLTRRPQR;FLDDYLTRRPQRT;LDDYLTRRPQRTG;DDYLTRRPQRTGE;DYLTRRPQRTGED;YLTRRPQRTGEDH;LTRRPQRTGEDHC;TRRPQRTGEDHCP;RRPQRTGEDHCPL;RPQRTGEDHCPLT;PQRTGEDHCPLTH;QRTGEDHCPLTHD;RTGEDHCPLTHDD;TGEDHCPLTHDDY;GEDHCPLTHDDYR;EDHCPLTHDDYRR;DHCPLTHDDYRRF;HCPLTHDDYRRFL;CPLTHDDYRRFLA;PLTHDDYRRFLAG;LTHDDYRRFLAGK;THDDYRRFLAGKP;HDDYRRFLAGKPD;DDYRRFLAGKPDG;DYRRFLAGKPDGV;YRRFLAGKPDGVA;RRFLAGKPDGVAD;RFLAGKPDGVADF;FLAGKPDGVADFL;LAGKPDGVADFLA;AGKPDGVADFLA | |

Fig. 30 continued

| | | |
|---|---|---|
| | A;GKPDGVADFLAAR;KPDGVADFLAARG;PDGVADFLAARGI;DGVADFLAARGIR;GVADFLAARGIRL;VADFLAARGIRLP;ADFLAARGIRLPP;DFLAARGIRLPPG;FLAARGIRLPPGS;LAARGIRLPPGSP;AARGIRLPPGSPT;ARGIRLPPGSPTD;RGIRLPPGSPTDL;GIRLPPGSPTDLT;IRLPPGSPTDLTD;RLPPGSPTDLTDD;LPPGSPTDLTDDT;PPGSPTDLTDDTV;PGSPTDLTDDTVY;GSPTDLTDDTVYG;SPTDLTDDTVYGL;PTDLTDDTVYGLQ;TDLTDDTVYGLQN;DLTDDTVYGLQNL;LTDDTVYGLQNLE;TDDTVYGLQNLER;DDTVYGLQNLERQ;DTVYGLQNLERQT;TVYGLQNLERQTF;VYGLQNLERQTFL;YGLQNLERQTFLQ;GLQNLERQTFLQL;LQNLERQTFLQLL;QNLERQTFLQLLN;NLERQTFLQLLNT;LERQTFLQLLNTG;ERQTFLQLLNTGV;RQTFLQLLNTGVP;QTFLQLLNTGVPE;TFLQLLNTGVPEG;FLQLLNTGVPEGK;LQLLNTGVPEGKS;QLLNTGVPEGKSI;LLNTGVPEGKSIA;LNTGVPEGKSIAS;NTGVPEGKSIASF;TGVPEGKSIASFA;GVPEGKSIASFAR;VPEGKSIASFARR;PEGKSIASFARRL;EGKSIASFARRLQ;GKSIASFARRLQV;KSIASFARRLQVA;SIASFARRLQVAG;IASFARRLQVAGV;ASFARRLQVAGVR;SFARRLQVAGVRV;FARRLQVAGVRVA;ARRLQVAGVRVAA;RRLQVAGVRVAAH;RLQVAGVRVAAHT;LQVAGVRVAAHTS;QVAGVRVAAHTSH;VAGVRVAAHTSHR;AGVRVAAHTSHRN;GVRVAAHTSHRNY;VRVAAHTSHRNYG;RVAAHTSHRNYGH;VAAHTSHRNYGHT;AAHTSHRNYGHTL;AHTSHRNYGHTLD;HTSHRNYGHTLDA;TSHRNYGHTLDAT;SHRNYGHTLDATG;HRNYGHTLDATGL;RNYGHTLDATGLA;NYGHTLDATGLAE;YGHTLDATGLAEV;GHTLDATGLAEVF;HTLDATGLAEVFA;TLDATGLAEVFAV;LDATGLAEVFAVF;DATGLAEVFAVFV;ATGLAEVFAVFVD;TGLAEVFAVFVDG;GLAEVFAVFVDGA;LAEVFAVFVDGAV;AEVFAVFVDGAVT;EVFAVFVDGAVTA;VFAVFVDGAVTAE;FAVFVDGAVTAEL;AVFVDGAVTAELG;VFVDGAVTAELGL;FVDGAVTAELGLP;VDGAVTAELGLPA;DGAVTAELGLPAE;GAVTAELGLPAEP;AVTAELGLPAEPN;VTAELGLPAEPNP;TAELGLPAEPNPA;AELGLPAEPNPAG;ELGLPAEPNPAGL;LGLPAEPNPAGLI;GLPAEPNPAGLIE;LPAEPNPAGLIET;PAEPNPAGLIETA;AEPNPAGLIETAK;EPNPAGLIETAKR;PNPAGLIETAKRL;NPAGLIETAKRLG;PAGLIETAKRLGA;AGLIETAKRLGAN;GLIETAKRLGANP;LIETAKRLGANPG;IETAKRLGANPGR;ETAKRLGANPGRC;TAKRLGANPGRCV;AKRLGANPGRCVV;KRLGANPGRCVVI;RLGANPGRCVVID;LGANPGRCVVIDS;GANPGRCVVIDSC;ANPGRCVVIDSCQ;NPGRCVVIDSCQT;PGRCVVIDSCQTG;GRCVVIDSCQTGL;RCVVIDSCQTGLR;CVVIDSCQTGLRA;VVIDSCQTGLRAG;VIDSCQTGLRAGR;IDSCQTGLRAGRN;DSCQTGLRAGRNG;SCQTGLRAGRNGG;CQTGLRAGRNGGF;QTGLRAGRNGGFA;TGLRAGRNGGFAL;GLRAGRNGGFALV;LRAGRNGGFALVI;RAGRNGGFALVIA;AGRNGGFALVIAV;GRNGGFALVIAVD;RNGGFALVIAVDA;NGGFALVIAVDAH;GGFALVIAVDAHG;GFALVIAVDAHGD;FALVIAVDAHGDA;ALVIAVDAHGDAE;LVIAVDAHGDAEN;VIAVDAHGDAENL;IAVDAHGDAENLL;AVDAHGDAENLLS;VDAHGDAENLLSS;DAHGDAENLLSSG;AHGDAENLLSSGA;HGDAENLLSSGAD;GDAENLLSSGADA;DAENLLSSGADAV;AENLLSSGADAVV;ENLLSSGADAVVA;NLLSSGADAVVAD;LLSSGADAVVADL;LSSGADAVVADLA;SSGADAVVADLAA;SGADAVVADLAAV;GADAVVADLAAVT;ADAVVADLAAVTV;DAVVADLAAVTVG;AVVADLAAVTVGS;VVADLAAVTVGSG;VADLAAVTVGSGD;ADLAAVTVGSGDA;DLAAVTVGSGDAA;LAAVTVGSGDAAI;AAVTVGSGDAAIS;AVTVGSGDAAIST;VTVGSGDAAISTI;TVGSGDAAISTIP;VGSGDAAISTIPD;GSGDAAISTIPDA;SGDAAISTIPDAL;GDAAISTIPDALQ;DAAISTIPDALQV;AAISTIPDALQVY;AISTIPDALQVYS;ISTIPDALQVYSQ;STIPDALQVYSQL;TIPDALQVYSQLK;IPDALQVYSQLKR;PDALQVYSQLKRL;DALQVYSQLKRLL;ALQVYSQLKRLLT;LQVYSQLKRLLTG;QVYSQLKRLLTGR;VYSQLKRLLTGRR;YSQLKRLLTGRRP;SQLKRLLTGRRPA;QLKRLLTGRRPAV;LKRLLTGRRPAVF;KRLLTGRRPAVFL;RLLTGRRPAVFLD;LLTGRRPAVFL | |

Fig. 30 continued

| | | |
|---|---|---|
| | DF;LTGRRPAVFLDFD;TGRRPAVFLDFDG;GRRPAVFLDFDGT;RRPAVFLDFDGTL;RPAVFLDFDGTLS;PAVFLDFDGTLSD;AVFLDFDGTLSDI;VFLDFDGTLSDIV;FLDFDGTLSDIVE;LDFDGTLSDIVER;DFDGTLSDIVERP;FDGTLSDIVERPE;DGTLSDIVERPEA;GTLSDIVERPEAA;TLSDIVERPEAAT;LSDIVERPEAATL;SDIVERPEAATLV;DIVERPEAATLVD;IVERPEAATLVDG;VERPEAATLVDGA;ERPEAATLVDGAA;RPEAATLVDGAAE;PEAATLVDGAAEA;EAATLVDGAAEAL;AATLVDGAAEALR;ATLVDGAAEALRA;TLVDGAAEALRAL;LVDGAAEALRALA;VDGAAEALRALAA;DGAAEALRALAAQ;GAAEALRALAAQC;AAEALRALAAQCP;AEALRALAAQCPV;EALRALAAQCPVA;ALRALAAQCPVAV;LRALAAQCPVAVI;RALAAQCPVAVIS;ALAAQCPVAVISG;LAAQCPVAVISGR;AAQCPVAVISGRD;AQCPVAVISGRDL;QCPVAVISGRDLA;CPVAVISGRDLAD;PVAVISGRDLADV;VAVISGRDLADVR;AVISGRDLADVRN;VISGRDLADVRNR;ISGRDLADVRNRV;SGRDLADVRNRVK;GRDLADVRNRVKV;RDLADVRNRVKVD;DLADVRNRVKVDG;LADVRNRVKVDGL;ADVRNRVKVDGLW;DVRNRVKVDGLWL;VRNRVKVDGLWLA;RNRVKVDGLWLAG;NRVKVDGLWLAGS;RVKVDGLWLAGSH;VKVDGLWLAGSHG;KVDGLWLAGSHGF;VDGLWLAGSHGFE;DGLWLAGSHGFEL;GLWLAGSHGFELV;LWLAGSHGFELVA;WLAGSHGFELVAP;LAGSHGFELVAPD;AGSHGFELVAPDG;GSHGFELVAPDGS;SHGFELVAPDGSH;HGFELVAPDGSHH;GFELVAPDGSHHQ;FELVAPDGSHHQN;ELVAPDGSHHQNA;LVAPDGSHHQNAA;VAPDGSHHQNAAA;APDGSHHQNAAAT;PDGSHHQNAAATA;DGSHHQNAAATAA;GSHHQNAAATAAI;SHHQNAAATAAID;HHQNAAATAAIDG;HQNAAATAAIDGL;QNAAATAAIDGLA;NAAATAAIDGLAE;AAATAAIDGLAEA;AATAAIDGLAEAA;ATAAIDGLAEAAA;TAAIDGLAEAAAQ;AAIDGLAEAAAQL;AIDGLAEAAAQLA;IDGLAEAAAQLAD;DGLAEAAAQLADA;GLAEAAAQLADAL;LAEAAAQLADALR;AEAAAQLADALRE;EAAAQLADALREI;AAAQLADALREIA;AAQLADALREIAG;AQLADALREIAGA;QLADALREIAGAV;LADALREIAGAVV;ADALREIAGAVVE;DALREIAGAVVEH;ALREIAGAVVEHK;LREIAGAVVEHKR;REIAGAVVEHKRF;EIAGAVVEHKRFA;IAGAVVEHKRFAV;AGAVVEHKRFAVA;GAVVEHKRFAVAV;AVVEHKRFAVAVH;VVEHKRFAVAVHY;VEHKRFAVAVHYR;EHKRFAVAVHYRN;HKRFAVAVHYRNV;KRFAVAVHYRNVA;RFAVAVHYRNVAD;FAVAVHYRNVADD;AVAVHYRNVADDS;VAVHYRNVADDSV;AVHYRNVADDSVD;VHYRNVADDSVDN;HYRNVADDSVDNL;YRNVADDSVDNLI;RNVADDSVDNLIA;NVADDSVDNLIAA;VADDSVDNLIAAV;ADDSVDNLIAAVR;DDSVDNLIAAVRR;DSVDNLIAAVRRL;SVDNLIAAVRRLG;VDNLIAAVRRLGH;DNLIAAVRRLGHA;NLIAAVRRLGHAA;LIAAVRRLGHAAG;IAAVRRLGHAAGL;AAVRRLGHAAGLR;AVRRLGHAAGLRV;VRRLGHAAGLRVT;RRLGHAAGLRVTT;RLGHAAGLRVTTG;LGHAAGLRVTTGR;GHAAGLRVTTGRK;HAAGLRVTTGRKV;AAGLRVTTGRKVV;AGLRVTTGRKVVE;GLRVTTGRKVVEL;LRVTTGRKVVELR;RVTTGRKVVELRP;VTTGRKVVELRPD;TTGRKVVELRPDI;TGRKVVELRPDIA;GRKVVELRPDIAW;RKVVELRPDIAWD;KVVELRPDIAWDK;VVELRPDIAWDKG;VELRPDIAWDKGK;ELRPDIAWDKGKA;LRPDIAWDKGKAL;RPDIAWDKGKALD;PDIAWDKGKALDW;DIAWDKGKALDWI;IAWDKGKALDWIG;AWDKGKALDWIGE;WDKGKALDWIGER;DKGKALDWIGERL;KGKALDWIGERLG;GKALDWIGERLGP;KALDWIGERLGPA;ALDWIGERLGPAE;LDWIGERLGPAEV;DWIGERLGPAEVG;WIGERLGPAEVGP;IGERLGPAEVGPD;GERLGPAEVGPDL;ERLGPAEVGPDLR;RLGPAEVGPDLRL;LGPAEVGPDLRLP;GPAEVGPDLRLPI;PAEVGPDLRLPIY;AEVGPDLRLPIYI;EVGPDLRLPIYIG;VGPDLRLPIYIGD;GPDLRLPIYIGDD;PDLRLPIYIGDDL;DLRLPIYIGDDLT;LRLPIYIGDDLTD;RLPIYIGDDLTDE;LPIYIGDDLTDED;PIYIGDDLTDEDA;IYIGDDLTDEDAF;YIGDDLTDEDAFD;IGDDLTDEDAFDA;GDDLTDEDAFDAV;DDLTDEDAFDAVR;DLTDEDAFDAVRF;LTDEDAFDAVRFT;TDEDAFDAVRFTG;DEDAFDAVRFTGV;EDAFDA | |

Fig. 30 continued

| | | |
|---|---|---|
| | VRFTGVG;DAFDAVRFTGVGI;AFDAVRFTGVGIV;FDAVRFTGVGIVV;DAVRFTGVGIVVR;AVRFTGVGIVVRH;VRFTGVGIVVRHN;RFTGVGIVVRHNE;FTGVGIVVRHNEH;TGVGIVVRHNEHG;GVGIVVRHNEHGD;VGIVVRHNEHGDR;GIVVRHNEHGDRR;IVVRHNEHGDRRS;VVRHNEHGDRRSA;VRHNEHGDRRSAA;RHNEHGDRRSAAT;HNEHGDRRSAATF;NEHGDRRSAATFR;EHGDRRSAATFRL;HGDRRSAATFRLE;GDRRSAATFRLEC;DRRSAATFRLECP;RRSAATFRLECPY;RSAATFRLECPYT;SAATFRLECPYTV;AATFRLECPYTVC;ATFRLECPYTVCQ;TFRLECPYTVCQF;FRLECPYTVCQFL;RLECPYTVCQFLS;LECPYTVCQFLSQ;ECPYTVCQFLSQL;CPYTVCQFLSQLA;PYTVCQFLSQLAC;YTVCQFLSQLACD;TVCQFLSQLACDL;VCQFLSQLACDLQ;CQFLSQLACDLQE;QFLSQLACDLQEA;FLSQLACDLQEAV;LSQLACDLQEAVQ;SQLACDLQEAVQH;QLACDLQEAVQHD;LACDLQEAVQHDD;ACDLQEAVQHDDP;CDLQEAVQHDDPW;DLQEAVQHDDPWT;LQEAVQHDDPWTL;QEAVQHDDPWTLV;EAVQHDDPWTLVF;AVQHDDPWTLVFH;VQHDDPWTLVFHG;QHDDPWTLVFHGY;HDDPWTLVFHGYD;DDPWTLVFHGYDP;DPWTLVFHGYDPG;PWTLVFHGYDPGQ;WTLVFHGYDPGQE;TLVFHGYDPGQER;LVFHGYDPGQERL;VFHGYDPGQERLR;FHGYDPGQERLRE;HGYDPGQERLREA;GYDPGQERLREAL;YDPGQERLREALC;DPGQERLREALCA;PGQERLREALCAV;GQERLREALCAVG;QERLREALCAVGN;ERLREALCAVGNG;RLREALCAVGNGY;LREALCAVGNGYL;REALCAVGNGYLG;EALCAVGNGYLGS;ALCAVGNGYLGSR;LCAVGNGYLGSRG;CAVGNGYLGSRGC;AVGNGYLGSRGCA;VGNGYLGSRGCAP;GNGYLGSRGCAPE;NGYLGSRGCAPES;GYLGSRGCAPESA;YLGSRGCAPESAE;LGSRGCAPESAES;GSRGCAPESAESE;SRGCAPESAESEA;RGCAPESAESEAH;GCAPESAESEAHY;CAPESAESEAHYP;APESAESEAHYPG;PESAESEAHYPGT;ESAESEAHYPGTY;SAESEAHYPGTYV;AESEAHYPGTYVA;ESEAHYPGTYVAG;SEAHYPGTYVAGV;EAHYPGTYVAGVY;AHYPGTYVAGVYN;HYPGTYVAGVYNQ;YPGTYVAGVYNQL;PGTYVAGVYNQLT;GTYVAGVYNQLTD;TYVAGVYNQLTDH;YVAGVYNQLTDHI;VAGVYNQLTDHIE;AGVYNQLTDHIEG;GVYNQLTDHIEGC;VYNQLTDHIEGCT;YNQLTDHIEGCTV;NQLTDHIEGCTVD;QLTDHIEGCTVDN;LTDHIEGCTVDNE;TDHIEGCTVDNES;DHIEGCTVDNESL;HIEGCTVDNESLV;IEGCTVDNESLVN;EGCTVDNESLVNL;GCTVDNESLVNLP;CTVDNESLVNLPN;TVDNESLVNLPNW;VDNESLVNLPNWL;DNESLVNLPNWLS;NESLVNLPNWLSL;ESLVNLPNWLSLT;SLVNLPNWLSLTF;LVNLPNWLSLTFR;VNLPNWLSLTFRI;NLPNWLSLTFRID;LPNWLSLTFRIDG;PNWLSLTFRIDGG;NWLSLTFRIDGGA;WLSLTFRIDGGAW;LSLTFRIDGGAWF;SLTFRIDGGAWFN;LTFRIDGGAWFNV;TFRIDGGAWFNVD;FRIDGGAWFNVDT;RIDGGAWFNVDTV;IDGGAWFNVDTVE;DGGAWFNVDTVEL;GGAWFNVDTVELL;GAWFNVDTVELLS;AWFNVDTVELLSY;WFNVDTVELLSYR;FNVDTVELLSYRQ;NVDTVELLSYRQT;VDTVELLSYRQTF;DTVELLSYRQTFD;TVELLSYRQTFDL;VELLSYRQTFDLR;ELLSYRQTFDLRR;LLSYRQTFDLRRA;LSYRQTFDLRRAT;SYRQTFDLRRATL;YRQTFDLRRATLT;RQTFDLRRATLTR;QTFDLRRATLTRS;TFDLRRATLTRSL;FDLRRATLTRSLR;DLRRATLTRSLRF;LRRATLTRSLRFR;RRATLTRSLRFRD;RATLTRSLRFRDA;ATLTRSLRFRDAG;TLTRSLRFRDAGG;LTRSLRFRDAGGR;TRSLRFRDAGGRV;RSLRFRDAGGRVT;SLRFRDAGGRVTT;LRFRDAGGRVTTM;RFRDAGGRVTTMT;FRDAGGRVTTMTQ;RDAGGRVTTMTQE;DAGGRVTTMTQER;AGGRVTTMTQERF;GGRVTTMTQERFA;GRVTTMTQERFAS;RVTTMTQERFASM;VTTMTQERFASMN;TTMTQERFASMNR;TMTQERFASMNRP;MTQERFASMNRPN;TQERFASMNRPNL;QERFASMNRPNLV;ERFASMNRPNLVA;RFASMNRPNLVAL;FASMNRPNLVALQ;ASMNRPNLVALQT;SMNRPNLVALQTR;MNRPNLVALQTRI;NRPNLVALQTRIE;RPNLVALQTRIES;PNLVALQTRIESE;NLVALQTRIESEN;LVALQTRIESENW;VALQTRIESENWS;ALQTRIESE | |

Fig. 30 continued

| | | |
|---|---|---|
| | NWSG;LQTRIESENWSGT;QTRIESENWSGTV;TRIESENWSGTVD;RIESENWSGTVDF;IESENWSGTVDFR;ESENWSGTVDFRS;SENWSGTVDFRSL;ENWSGTVDFRSLV;NWSGTVDFRSLVD;WSGTVDFRSLVDG;SGTVDFRSLVDGG;GTVDFRSLVDGGV;TVDFRSLVDGGVH;VDFRSLVDGGVHN;DFRSLVDGGVHNT;FRSLVDGGVHNTL;RSLVDGGVHNTLV;SLVDGGVHNTLVD;LVDGGVHNTLVDR;VDGGVHNTLVDRY;DGGVHNTLVDRYR;GGVHNTLVDRYRQ;GVHNTLVDRYRQL;VHNTLVDRYRQLS;HNTLVDRYRQLSS;NTLVDRYRQLSSQ;TLVDRYRQLSSQH;LVDRYRQLSSQHL;VDRYRQLSSQHLT;DRYRQLSSQHLTT;RYRQLSSQHLTTA;YRQLSSQHLTTAE;RQLSSQHLTTAEI;QLSSQHLTTAEIE;LSSQHLTTAEIEV;SSQHLTTAEIEVL;SQHLTTAEIEVLA;QHLTTAEIEVLAD;HLTTAEIEVLADS;LTTAEIEVLADSV;TTAEIEVLADSVL;TAEIEVLADSVLL;AEIEVLADSVLLR;EIEVLADSVLLRT;IEVLADSVLLRTQ;EVLADSVLLRTQT;VLADSVLLRTQTS;LADSVLLRTQTSQ;ADSVLLRTQTSQS;DSVLLRTQTSQSG;SVLLRTQTSQSGI;VLLRTQTSQSGIA;LLRTQTSQSGIAI;LRTQTSQSGIAIA;RTQTSQSGIAIAV;TQTSQSGIAIAVA;QTSQSGIAIAVAA;TSQSGIAIAVAAR;SQSGIAIAVAARS;QSGIAIAVAARST;SGIAIAVAARSTL;GIAIAVAARSTLW;IAIAVAARSTLWR;AIAVAARSTLWRD;IAVAARSTLWRDG;AVAARSTLWRDGQ;VAARSTLWRDGQR;AARSTLWRDGQRV;ARSTLWRDGQRVD;RSTLWRDGQRVDA;STLWRDGQRVDAQ;TLWRDGQRVDAQY;LWRDGQRVDAQYR;WRDGQRVDAQYRV;RDGQRVDAQYRVA;DGQRVDAQYRVAR;GQRVDAQYRVARD;QRVDAQYRVARDT;RVDAQYRVARDTN;VDAQYRVARDTNR;DAQYRVARDTNRG;AQYRVARDTNRGG;QYRVARDTNRGGH;YRVARDTNRGGHD;RVARDTNRGGHDI;VARDTNRGGHDIQ;ARDTNRGGHDIQV;RDTNRGGHDIQVT;DTNRGGHDIQVTL;TNRGGHDIQVTLS;NRGGHDIQVTLSA;RGGHDIQVTLSAG;GGHDIQVTLSAGQ;GHDIQVTLSAGQS;HDIQVTLSAGQSV;DIQVTLSAGQSVT;IQVTLSAGQSVTL;QVTLSAGQSVTLE;VTLSAGQSVTLEK;TLSAGQSVTLEKV;LSAGQSVTLEKVA;SAGQSVTLEKVAT;AGQSVTLEKVATI;GQSVTLEKVATIF;QSVTLEKVATIFT;SVTLEKVATIFTS;VTLEKVATIFTSR;TLEKVATIFTSRD;LEKVATIFTSRDA;EKVATIFTSRDAA;KVATIFTSRDAAT;VATIFTSRDAATL;ATIFTSRDAATLT;TIFTSRDAATLTA;IFTSRDAATLTAA;FTSRDAATLTAAI;TSRDAATLTAAIS;SRDAATLTAAISA;RDAATLTAAISAQ;DAATLTAAISAQR;AATLTAAISAQRC;ATLTAAISAQRCL;TLTAAISAQRCLG;LTAAISAQRCLGE;TAAISAQRCLGEA;AAISAQRCLGEAG;AISAQRCLGEAGR;ISAQRCLGEAGRY;SAQRCLGEAGRYA;AQRCLGEAGRYAE;QRCLGEAGRYAEL;RCLGEAGRYAELC;CLGEAGRYAELCQ;LGEAGRYAELCQQ;GEAGRYAELCQQH;EAGRYAELCQQHV;AGRYAELCQQHVR;GRYAELCQQHVRA;RYAELCQQHVRAW;YAELCQQHVRAWA;AELCQQHVRAWAR;ELCQQHVRAWARL;LCQQHVRAWARLW;CQQHVRAWARLWE;QQHVRAWARLWER;QHVRAWARLWERC;HVRAWARLWERCA;VRAWARLWERCAI;RAWARLWERCAID;AWARLWERCAIDL;WARLWERCAIDLT;ARLWERCAIDLTG;RLWERCAIDLTGN;LWERCAIDLTGNT;WERCAIDLTGNTE;ERCAIDLTGNTEE;RCAIDLTGNTEEL;CAIDLTGNTEELR;AIDLTGNTEELRL;IDLTGNTEELRLV;DLTGNTEELRLVR;LTGNTEELRLVRL;TGNTEELRLVRLH;GNTEELRLVRLHL;NTEELRLVRLHLL;TEELRLVRLHLLH;EELRLVRLHLLHL;ELRLVRLHLLHLL;LRLVRLHLLHLLQ;RLVRLHLLHLLQT;LVRLHLLHLLQTI;VRLHLLHLLQTIS;RLHLLHLLQTISP;LHLLHLLQTISPH;HLLHLLQTISPHT;LLHLLQTISPHTA;LHLLQTISPHTAE;HLLQTISPHTAEL;LLQTISPHTAELD;LQTISPHTAELDA;QTISPHTAELDAG;TISPHTAELDAGV;ISPHTAELDAGVP;SPHTAELDAGVPA;PHTAELDAGVPAR;HTAELDAGVPARG;TAELDAGVPARGL;AELDAGVPARGLN;ELDAGVPARGLNG;LDAGVPARGLNGE;DAGVPARGLNGEA;AGVPARGLNGEAY;GVPARGLNGEAYR;VPARGLNGEAYRG;PARGLNGEAYRGH;ARGLNGEAYRGHV;RGLNGEAYRGHVF;GLNGEAYRGHVFW;LNGEAYRGHVFWD;NGEAYRGHVFWDA;GEA | |

Fig. 30 continued

| | | |
|---|---|---|
| | YRGHVFWDAL;EAYRGHVFWDALF;AYRGHVFWDALFV;YRGHVFWDALFVA;RGHVFWDALFVAP;GHVFWDALFVAPV;HVFWDALFVAPVL;VFWDALFVAPVLS;FWDALFVAPVLSL;WDALFVAPVLSLR;DALFVAPVLSLRM;ALFVAPVLSLRMP;LFVAPVLSLRMPK;FVAPVLSLRMPKV;VAPVLSLRMPKVA;APVLSLRMPKVAR;PVLSLRMPKVARS;VLSLRMPKVARSL;LSLRMPKVARSLL;SLRMPKVARSLLD;LRMPKVARSLLDY;RMPKVARSLLDYR;MPKVARSLLDYRY;PKVARSLLDYRYR;KVARSLLDYRYRR;VARSLLDYRYRRL;ARSLLDYRYRRLP;RSLLDYRYRRLPA;SLLDYRYRRLPAA;LLDYRYRRLPAAR;LDYRYRRLPAARR;DYRYRRLPAARRA;YRYRRLPAARRAA;RYRRLPAARRAAH;YRRLPAARRAAHR;RRLPAARRAAHRA;RLPAARRAAHRAG;LPAARRAAHRAGH;PAARRAAHRAGHL;AARRAAHRAGHLG;ARRAAHRAGHLGA;RRAAHRAGHLGAM;RAAHRAGHLGAMY;AAHRAGHLGAMYP;AHRAGHLGAMYPW;HRAGHLGAMYPWQ;RAGHLGAMYPWQS;AGHLGAMYPWQSG;GHLGAMYPWQSGS;HLGAMYPWQSGSD;LGAMYPWQSGSDG;GAMYPWQSGSDGS;AMYPWQSGSDGSE;MYPWQSGSDGSEV;YPWQSGSDGSEVS;PWQSGSDGSEVSQ;WQSGSDGSEVSQQ;QSGSDGSEVSQQL;SGSDGSEVSQQLH;GSDGSEVSQQLHL;SDGSEVSQQLHLN;DGSEVSQQLHLNP;GSEVSQQLHLNPR;SEVSQQLHLNPRS;EVSQQLHLNPRSG;VSQQLHLNPRSGR;SQQLHLNPRSGRW;QQLHLNPRSGRWT;QLHLNPRSGRWTP;LHLNPRSGRWTPD;HLNPRSGRWTPDP;LNPRSGRWTPDPS;NPRSGRWTPDPSD;PRSGRWTPDPSDR;RSGRWTPDPSDRA;SGRWTPDPSDRAH;GRWTPDPSDRAHH;RWTPDPSDRAHHV;WTPDPSDRAHHVG;TPDPSDRAHHVGL;PDPSDRAHHVGLA;DPSDRAHHVGLAV;PSDRAHHVGLAVA;SDRAHHVGLAVAY;DRAHHVGLAVAYN;RAHHVGLAVAYNA;AHHVGLAVAYNAW;HHVGLAVAYNAWH;HVGLAVAYNAWHY;VGLAVAYNAWHYY;GLAVAYNAWHYYQ;LAVAYNAWHYYQV;AVAYNAWHYYQVT;VAYNAWHYYQVTG;AYNAWHYYQVTGD;YNAWHYYQVTGDR;NAWHYYQVTGDRQ;AWHYYQVTGDRQY;WHYYQVTGDRQYL;HYYQVTGDRQYLV;YYQVTGDRQYLVD;YQVTGDRQYLVDC;QVTGDRQYLVDCG;VTGDRQYLVDCGA;TGDRQYLVDCGAE;GDRQYLVDCGAEL;DRQYLVDCGAELL;RQYLVDCGAELLV;QYLVDCGAELLVE;YLVDCGAELLVEI;LVDCGAELLVEIA;VDCGAELLVEIAR;DCGAELLVEIARF;CGAELLVEIARFW;GAELLVEIARFWV;AELLVEIARFWVG;ELLVEIARFWVGL;LLVEIARFWVGLA;LVEIARFWVGLAK;VEIARFWVGLAKL;EIARFWVGLAKLD;IARFWVGLAKLDD;ARFWVGLAKLDDS;RFWVGLAKLDDSR;FWVGLAKLDDSRG;WVGLAKLDDSRGR;VGLAKLDDSRGRY;GLAKLDDSRGRYL;LAKLDDSRGRYLI;AKLDDSRGRYLIR;KLDDSRGRYLIRG;LDDSRGRYLIRGV;DDSRGRYLIRGVI;DSRGRYLIRGVIG;SRGRYLIRGVIGP;RGRYLIRGVIGPD;GRYLIRGVIGPDE;RYLIRGVIGPDEF;YLIRGVIGPDEFH;LIRGVIGPDEFHS;IRGVIGPDEFHSG;RGVIGPDEFHSGY;GVIGPDEFHSGYP;VIGPDEFHSGYPG;IGPDEFHSGYPGN;GPDEFHSGYPGNE;PDEFHSGYPGNEY;DEFHSGYPGNEYD;EFHSGYPGNEYDG;FHSGYPGNEYDGI;HSGYPGNEYDGID;SGYPGNEYDGIDN;GYPGNEYDGIDNN;YPGNEYDGIDNNA;PGNEYDGIDNNAY;GNEYDGIDNNAYT;NEYDGIDNNAYTN;EYDGIDNNAYTNV;YDGIDNNAYTNVM;DGIDNNAYTNVMA;GIDNNAYTNVMAV;IDNNAYTNVMAVW;DNNAYTNVMAVWV;NNAYTNVMAVWVI;NAYTNVMAVWVIL;AYTNVMAVWVILR;YTNVMAVWVILRA;TNVMAVWVILRAM;NVMAVWVILRAME;VMAVWVILRAMEA;MAVWVILRAMEAL;AVWVILRAMEALD;VWVILRAMEALDL;WVILRAMEALDLL;VILRAMEALDLLP;ILRAMEALDLLPL;LRAMEALDLLPLT;RAMEALDLLPLTD;AMEALDLLPLTDR;MEALDLLPLTDRR;EALDLLPLTDRRH;ALDLLPLTDRRHL;LDLLPLTDRRHLI;DLLPLTDRRHLIE;LLPLTDRRHLIEK;LPLTDRRHLIEKL;PLTDRRHLIEKLG;LTDRRHLIEKLGL;TDRRHLIEKLGLT;DRRHLIEKLGLTT;RRHLIEKLGLTTQ;RHLIEKLGLTTQE;HLIEKLGLTTQER;LIEKLGLTTQERD;IEKLGLTTQERDQ;EKLGLTTQERDQW;KLGLTTQERDQW | |

Fig. 30 continued

| | | |
|---|---|---|
| | D;LGLTTQERDQWDD;GLTTQERDQWDDV;LTTQERDQWDDVS;TTQERDQWDDVSR;TQERDQWDDVSRR;QERDQWDDVSRRM;ERDQWDDVSRRMF;RDQWDDVSRRMFV;DQWDDVSRRMFVP;QWDDVSRRMFVPF;WDDVSRRMFVPFH;DDVSRRMFVPFHD;DVSRRMFVPFHDG;VSRRMFVPFHDGV;SRRMFVPFHDGVI;RRMFVPFHDGVIS;RMFVPFHDGVISQ;MFVPFHDGVISQF;FVPFHDGVISQFE;VPFHDGVISQFEG;PFHDGVISQFEGY;FHDGVISQFEGYS;HDGVISQFEGYSE;DGVISQFEGYSEL;GVISQFEGYSELA;VISQFEGYSELAE;ISQFEGYSELAEL;SQFEGYSELAELD;QFEGYSELAELDW;FEGYSELAELDWD;EGYSELAELDWDH;GYSELAELDWDHY;YSELAELDWDHYR;SELAELDWDHYRH;ELAELDWDHYRHR;LAELDWDHYRHRY;AELDWDHYRHRYG;ELDWDHYRHRYGN;LDWDHYRHRYGNI;DWDHYRHRYGNIQ;WDHYRHRYGNIQR;DHYRHRYGNIQRL;HYRHRYGNIQRLD;YRHRYGNIQRLDR;RHRYGNIQRLDRI;HRYGNIQRLDRIL;RYGNIQRLDRILE;YGNIQRLDRILEA;GNIQRLDRILEAE;NIQRLDRILEAEG;IQRLDRILEAEGD;QRLDRILEAEGDS;RLDRILEAEGDSV;LDRILEAEGDSVN;DRILEAEGDSVNN;RILEAEGDSVNNY;ILEAEGDSVNNYQ;LEAEGDSVNNYQA;EAEGDSVNNYQAS;AEGDSVNNYQASK;EGDSVNNYQASKQ;GDSVNNYQASKQA;DSVNNYQASKQAD;SVNNYQASKQADA;VNNYQASKQADAL;NNYQASKQADALM;NYQASKQADALML;YQASKQADALMLL;QASKQADALMLLY;ASKQADALMLLYL;SKQADALMLLYLL;KQADALMLLYLLS;QADALMLLYLLSS;ADALMLLYLLSSD;DALMLLYLLSSDE;ALMLLYLLSSDEL;LMLLYLLSSDELI;MLLYLLSSDELIG;LLYLLSSDELIGL;LYLLSSDELIGLL;YLLSSDELIGLLA;LLSSDELIGLLAR;LSSDELIGLLARL;SSDELIGLLARLG;SDELIGLLARLGY;DELIGLLARLGYR;ELIGLLARLGYRF;LIGLLARLGYRFA;IGLLARLGYRFAP;GLLARLGYRFAPT;LLARLGYRFAPTQ;LARLGYRFAPTQI;ARLGYRFAPTQIP;RLGYRFAPTQIPG;LGYRFAPTQIPGT;GYRFAPTQIPGTV;YRFAPTQIPGTVD;RFAPTQIPGTVDY;FAPTQIPGTVDYY;APTQIPGTVDYYL;PTQIPGTVDYYLA;TQIPGTVDYYLAR;QIPGTVDYYLART;IPGTVDYYLARTS;PGTVDYYLARTSD;GTVDYYLARTSDG;TVDYYLARTSDGS;VDYYLARTSDGST;DYYLARTSDGSTL;YYLARTSDGSTLS;YLARTSDGSTLSA;LARTSDGSTLSAV;ARTSDGSTLSAVV;RTSDGSTLSAVVH;TSDGSTLSAVVHA;SDGSTLSAVVHAW;DGSTLSAVVHAWV;GSTLSAVVHAWVL;STLSAVVHAWVLA;TLSAVVHAWVLAR;LSAVVHAWVLARA;SAVVHAWVLARAN;AVVHAWVLARANR;VVHAWVLARANRS;VHAWVLARANRSN;HAWVLARANRSNA;AWVLARANRSNAM;WVLARANRSNAME;VLARANRSNAMEY;LARANRSNAMEYF;ARANRSNAMEYFR;RANRSNAMEYFRQ;ANRSNAMEYFRQV;NRSNAMEYFRQVL;RSNAMEYFRQVLR;SNAMEYFRQVLRS;NAMEYFRQVLRSD;AMEYFRQVLRSDI;MEYFRQVLRSDIA;EYFRQVLRSDIAD;YFRQVLRSDIADV;FRQVLRSDIADVQ;RQVLRSDIADVQG;QVLRSDIADVQGG;VLRSDIADVQGGT;LRSDIADVQGGTT;RSDIADVQGGTTQ;SDIADVQGGTTQE;DIADVQGGTTQEG;IADVQGGTTQEGI;ADVQGGTTQEGIH;DVQGGTTQEGIHL;VQGGTTQEGIHLA;QGGTTQEGIHLAA;GGTTQEGIHLAAM;GTTQEGIHLAAMA;TTQEGIHLAAMAG;TQEGIHLAAMAGS;QEGIHLAAMAGSI;EGIHLAAMAGSID;GIHLAAMAGSIDL;IHLAAMAGSIDLL;HLAAMAGSIDLLQ;LAAMAGSIDLLQR;AAMAGSIDLLQRC;AMAGSIDLLQRCY;MAGSIDLLQRCYS;AGSIDLLQRCYSG;GSIDLLQRCYSGL;SIDLLQRCYSGLE;IDLLQRCYSGLEL;DLLQRCYSGLELR;LLQRCYSGLELRD;LQRCYSGLELRDD;QRCYSGLELRDDR;RCYSGLELRDDRL;CYSGLELRDDRLV;YSGLELRDDRLVL;SGLELRDDRLVLS;GLELRDDRLVLSP;LELRDDRLVLSPQ;ELRDDRLVLSPQW;LRDDRLVLSPQWP;RDDRLVLSPQWPE;DDRLVLSPQWPEA;DRLVLSPQWPEAL;RLVLSPQWPEALG;LVLSPQWPEALGP;VLSPQWPEALGPL;LSPQWPEALGPLE;SPQWPEALGPLEF;PQWPEALGPLEFP;QWPEALGPLEFPF;WPEALGPLEFPFV;PEALGPLEFPFVY;EALGPLEFPFVYR;ALGPLEFPFVYRR;LGPLEFPFVYRRH;GPLEFPFVYRRHQ;PLE | |

Fig. 30 continued

| | | |
|---|---|---|
| | FPFVYRRHQL;LEFPFVYRRHQLS;EFPFVYRRHQLSL;FPFVYRRHQLSLR;PFVYRRHQLSLRI;FVYRRHQLSLRIS;VYRRHQLSLRISG;YRRHQLSLRISGR;RRHQLSLRISGRS;RHQLSLRISGRSA;HQLSLRISGRSAT;QLSLRISGRSATL;LSLRISGRSATLT;SLRISGRSATLTA;LRISGRSATLTAE;RISGRSATLTAES;ISGRSATLTAESG;SGRSATLTAESGD;GRSATLTAESGDA;RSATLTAESGDAE;SATLTAESGDAEP;ATLTAESGDAEPI;TLTAESGDAEPIE;LTAESGDAEPIEV;TAESGDAEPIEVE;AESGDAEPIEVEC;ESGDAEPIEVECR;SGDAEPIEVECRG;GDAEPIEVECRGH;DAEPIEVECRGHV;AEPIEVECRGHVQ;EPIEVECRGHVQR;PIEVECRGHVQRL;IEVECRGHVQRLR;EVECRGHVQRLRC;VECRGHVQRLRCG;ECRGHVQRLRCGH;CRGHVQRLRCGHT;RGHVQRLRCGHTI;GHVQRLRCGHTIE;HVQRLRCGHTIEV;VQRLRCGHTIEVG;QRLRCGHTIEVGC;RLRCGHTIEVGCS;LRCGHTIEVGCSR;<br><br>14 mers:<br>MRCGIVVNVTGPPP;RCGIVVNVTGPPPT;CGIVVNVTGPPPTI;GIVVNVTGPPPTID;IVVNVTGPPPTIDR;VVNVTGPPPTIDRR;VNVTGPPPTIDRRY;NVTGPPPTIDRRYH;VTGPPPTIDRRYHD;TGPPPTIDRRYHDA;GPPPTIDRRYHDAV;PPPTIDRRYHDAVI;PPTIDRRYHDAVIV;PTIDRRYHDAVIVG;TIDRRYHDAVIVGL;IDRRYHDAVIVGLD;DRRYHDAVIVGLDN;RRYHDAVIVGLDNV;RYHDAVIVGLDNVV;YHDAVIVGLDNVVD;HDAVIVGLDNVVDK;DAVIVGLDNVVDKA;AVIVGLDNVVDKAT;VIVGLDNVVDKATR;IVGLDNVVDKATRV;VGLDNVVDKATRVH;GLDNVVDKATRVHA;LDNVVDKATRVHAA;DNVVDKATRVHAAA;NVVDKATRVHAAAW;VVDKATRVHAAAWT;VDKATRVHAAAWTK;DKATRVHAAAWTKF;KATRVHAAAWTKFL;ATRVHAAAWTKFLD;TRVHAAAWTKFLDD;RVHAAAWTKFLDDY;VHAAAWTKFLDDYL;HAAAWTKFLDDYLT;AAAWTKFLDDYLTR;AAWTKFLDDYLTRR;AWTKFLDDYLTRRP;WTKFLDDYLTRRPQ;TKFLDDYLTRRPQR;KFLDDYLTRRPQRT;FLDDYLTRRPQRTG;LDDYLTRRPQRTGE;DDYLTRRPQRTGED;DYLTRRPQRTGEDH;YLTRRPQRTGEDHC;LTRRPQRTGEDHCP;TRRPQRTGEDHCPL;RRPQRTGEDHCPLT;RPQRTGEDHCPLTH;PQRTGEDHCPLTHD;QRTGEDHCPLTHDD;RTGEDHCPLTHDDY;TGEDHCPLTHDDYR;GEDHCPLTHDDYRR;EDHCPLTHDDYRRF;DHCPLTHDDYRRFL;HCPLTHDDYRRFLA;CPLTHDDYRRFLAG;PLTHDDYRRFLAGK;LTHDDYRRFLAGKP;THDDYRRFLAGKPD;HDDYRRFLAGKPDG;DDYRRFLAGKPDGV;DYRRFLAGKPDGVA;YRRFLAGKPDGVAD;RRFLAGKPDGVADF;RFLAGKPDGVADFL;FLAGKPDGVADFLA;LAGKPDGVADFLAA;AGKPDGVADFLAAR;GKPDGVADFLAARG;KPDGVADFLAARGI;PDGVADFLAARGIR;DGVADFLAARGIRL;GVADFLAARGIRLP;VADFLAARGIRLPP;ADFLAARGIRLPPG;DFLAARGIRLPPGS;FLAARGIRLPPGSP;LAARGIRLPPGSPT;AARGIRLPPGSPTD;ARGIRLPPGSPTDL;RGIRLPPGSPTDLT;GIRLPPGSPTDLTD;IRLPPGSPTDLTDD;RLPPGSPTDLTDDT;LPPGSPTDLTDDTV;PPGSPTDLTDDTVY;PGSPTDLTDDTVYG;GSPTDLTDDTVYGL;SPTDLTDDTVYGLQ;PTDLTDDTVYGLQN;TDLTDDTVYGLQNL;DLTDDTVYGLQNLE;LTDDTVYGLQNLER;TDDTVYGLQNLERQ;DDTVYGLQNLERQT;DTVYGLQNLERQTF;TVYGLQNLERQTFL;VYGLQNLERQTFLQ;YGLQNLERQTFLQL;GLQNLERQTFLQLL;LQNLERQTFLQLLN;QNLERQTFLQLLNT;NLERQTFLQLLNTG;LERQTFLQLLNTGV;ERQTFLQLLNTGVP;RQTFLQLLNTGVPE;QTFLQLLNTGVPEG;TFLQLLNTGVPEGK;FLQLLNTGVPEGKS;LQLLNTGVPEGKSI;QLLNTGVPEGKSIA;LLNTGVPEGKSIAS;LNTGVPEGKSIASF;NTGVPEGKSIASFA;TGVPEGKSIASFAR;GVPEGKSIASFARR;VPEGKSIASFARRL;PEGKSIASFARRLQ;EGKSIASFARRLQV;GKSIASFARRLQVA;KSIASFARRLQVAG;SIASFARRLQVAGV;IASFARRLQVAGVR;ASFARRLQVAGVRV;SFARRLQVAGVRVA;FARRLQVAGVRVAA;ARRLQVAGVRVAAH;RRLQVAGVRVAAHT;RLQVAGVRVAAHTS;LQVAGVRVAA | |

Fig. 30 continued

| | | |
|---|---|---|
| | HTSH;QVAGVRVAAHTSHR;VAGVRVAAHTSHRN;AGVRVAAHTSHRNY;GVRVAAHTSHRNYG;VRVAAHTSHRNYGH;RVAAHTSHRNYGHT;VAAHTSHRNYGHTL;AAHTSHRNYGHTLD;AHTSHRNYGHTLDA;HTSHRNYGHTLDAT;TSHRNYGHTLDATG;SHRNYGHTLDATGL;HRNYGHTLDATGLA;RNYGHTLDATGLAE;NYGHTLDATGLAEV;YGHTLDATGLAEVF;GHTLDATGLAEVFA;HTLDATGLAEVFAV;TLDATGLAEVFAVF;LDATGLAEVFAVFV;DATGLAEVFAVFVD;ATGLAEVFAVFVDG;TGLAEVFAVFVDGA;GLAEVFAVFVDGAV;LAEVFAVFVDGAVT;AEVFAVFVDGAVTA;EVFAVFVDGAVTAE;VFAVFVDGAVTAEL;FAVFVDGAVTAELG;AVFVDGAVTAELGL;VFVDGAVTAELGLP;FVDGAVTAELGLPA;VDGAVTAELGLPAE;DGAVTAELGLPAEP;GAVTAELGLPAEPN;AVTAELGLPAEPNP;VTAELGLPAEPNPA;TAELGLPAEPNPAG;AELGLPAEPNPAGL;ELGLPAEPNPAGLI;LGLPAEPNPAGLIE;GLPAEPNPAGLIET;LPAEPNPAGLIETA;PAEPNPAGLIETAK;AEPNPAGLIETAKR;EPNPAGLIETAKRL;PNPAGLIETAKRLG;NPAGLIETAKRLGA;PAGLIETAKRLGAN;AGLIETAKRLGANP;GLIETAKRLGANPG;LIETAKRLGANPGR;IETAKRLGANPGRC;ETAKRLGANPGRCV;TAKRLGANPGRCVV;AKRLGANPGRCVVI;KRLGANPGRCVVID;RLGANPGRCVVIDS;LGANPGRCVVIDSC;GANPGRCVVIDSCQ;ANPGRCVVIDSCQT;NPGRCVVIDSCQTG;PGRCVVIDSCQTGL;GRCVVIDSCQTGLR;RCVVIDSCQTGLRA;CVVIDSCQTGLRAG;VVIDSCQTGLRAGR;VIDSCQTGLRAGRN;IDSCQTGLRAGRNG;DSCQTGLRAGRNGG;SCQTGLRAGRNGGF;CQTGLRAGRNGGFA;QTGLRAGRNGGFAL;TGLRAGRNGGFALV;GLRAGRNGGFALVI;LRAGRNGGFALVIA;RAGRNGGFALVIAV;AGRNGGFALVIAVD;GRNGGFALVIAVDA;RNGGFALVIAVDAH;NGGFALVIAVDAHG;GGFALVIAVDAHGD;GFALVIAVDAHGDA;FALVIAVDAHGDAE;ALVIAVDAHGDAEN;LVIAVDAHGDAENL;VIAVDAHGDAENLL;IAVDAHGDAENLLS;AVDAHGDAENLLSS;VDAHGDAENLLSSG;DAHGDAENLLSSGA;AHGDAENLLSSGAD;HGDAENLLSSGADA;GDAENLLSSGADAV;DAENLLSSGADAVV;AENLLSSGADAVVA;ENLLSSGADAVVAD;NLLSSGADAVVADL;LLSSGADAVVADLA;LSSGADAVVADLAA;SSGADAVVADLAAV;SGADAVVADLAAVT;GADAVVADLAAVTV;ADAVVADLAAVTVG;DAVVADLAAVTVGS;AVVADLAAVTVGSG;VVADLAAVTVGSGD;VADLAAVTVGSGDA;ADLAAVTVGSGDAA;DLAAVTVGSGDAAI;LAAVTVGSGDAAIS;AAVTVGSGDAAIST;AVTVGSGDAAISTI;VTVGSGDAAISTIP;TVGSGDAAISTIPD;VGSGDAAISTIPDA;GSGDAAISTIPDAL;SGDAAISTIPDALQ;GDAAISTIPDALQV;DAAISTIPDALQVY;AAISTIPDALQVYS;AISTIPDALQVYSQ;ISTIPDALQVYSQL;STIPDALQVYSQLK;TIPDALQVYSQLKR;IPDALQVYSQLKRL;PDALQVYSQLKRLL;DALQVYSQLKRLLT;ALQVYSQLKRLLTG;LQVYSQLKRLLTGR;QVYSQLKRLLTGRR;VYSQLKRLLTGRRP;YSQLKRLLTGRRPA;SQLKRLLTGRRPAV;QLKRLLTGRRPAVF;LKRLLTGRRPAVFL;KRLLTGRRPAVFLD;RLLTGRRPAVFLDF;LLTGRRPAVFLDFD;LTGRRPAVFLDFDG;TGRRPAVFLDFDGT;GRRPAVFLDFDGTL;RRPAVFLDFDGTLS;RPAVFLDFDGTLSD;PAVFLDFDGTLSDI;AVFLDFDGTLSDIV;VFLDFDGTLSDIVE;FLDFDGTLSDIVER;LDFDGTLSDIVERP;DFDGTLSDIVERPE;FDGTLSDIVERPEA;DGTLSDIVERPEAA;GTLSDIVERPEAAT;TLSDIVERPEAATL;LSDIVERPEAATLV;SDIVERPEAATLVD;DIVERPEAATLVDG;IVERPEAATLVDGA;VERPEAATLVDGAA;ERPEAATLVDGAAE;RPEAATLVDGAAEA;PEAATLVDGAAEAL;EAATLVDGAAEALR;AATLVDGAAEALRA;ATLVDGAAEALRAL;TLVDGAAEALRALA;LVDGAAEALRALAA;VDGAAEALRALAAQ;DGAAEALRALAAQC;GAAEALRALAAQCP;AAEALRALAAQCPV;AEALRALAAQCPVA;EALRALAAQCPVAV;ALRALAAQCPVAVI;LRALAAQCPVAVIS;RALAAQCPVAVISG;ALAAQCPVAVISGR;LAAQCPVAVISGRD;AAQCPVAVISGRDL;AQCPVAVISGRDLA;QCPVAVISGRDLAD;CPVAVISGRDLADV;PVAVISGRDLADVR;VAVISGRDLADVRN;AVISGRDLADVRNR;VISGRDLADVRNRV;ISGRDLADVRNRVK;SGRD | |

Fig. 30 continued

| | | |
|---|---|---|
| | LADVRNRVKV;GRDLADVRNRVKVD;RDLADVRNRVKVDG;DLADVRNRVKVDGL;LADVRNRVKVDGLW;ADVRNRVKVDGLWL;DVRNRVKVDGLWLA;VRNRVKVDGLWLAG;RNRVKVDGLWLAGS;NRVKVDGLWLAGSH;RVKVDGLWLAGSHG;VKVDGLWLAGSHGF;KVDGLWLAGSHGFE;VDGLWLAGSHGFEL;DGLWLAGSHGFELV;GLWLAGSHGFELVA;LWLAGSHGFELVAP;WLAGSHGFELVAPD;LAGSHGFELVAPDG;AGSHGFELVAPDGS;GSHGFELVAPDGSH;SHGFELVAPDGSHH;HGFELVAPDGSHHQ;GFELVAPDGSHHQN;FELVAPDGSHHQNA;ELVAPDGSHHQNAA;LVAPDGSHHQNAAA;VAPDGSHHQNAAAT;APDGSHHQNAAATA;PDGSHHQNAAATAA;DGSHHQNAAATAAI;GSHHQNAAATAAID;SHHQNAAATAAIDG;HHQNAAATAAIDGL;HQNAAATAAIDGLA;QNAAATAAIDGLAE;NAAATAAIDGLAEA;AAATAAIDGLAEAA;AATAAIDGLAEAAA;ATAAIDGLAEAAAQ;TAAIDGLAEAAAQL;AAIDGLAEAAAQLA;AIDGLAEAAAQLAD;IDGLAEAAAQLADA;DGLAEAAAQLADAL;GLAEAAAQLADALR;LAEAAAQLADALRE;AEAAAQLADALREI;EAAAQLADALREIA;AAAQLADALREIAG;AAQLADALREIAGA;AQLADALREIAGAV;QLADALREIAGAVV;LADALREIAGAVVE;ADALREIAGAVVEH;DALREIAGAVVEHK;ALREIAGAVVEHKR;LREIAGAVVEHKRF;REIAGAVVEHKRFA;EIAGAVVEHKRFAV;IAGAVVEHKRFAVA;AGAVVEHKRFAVAV;GAVVEHKRFAVAVH;AVVEHKRFAVAVHY;VVEHKRFAVAVHYR;VEHKRFAVAVHYRN;EHKRFAVAVHYRNV;HKRFAVAVHYRNVA;KRFAVAVHYRNVAD;RFAVAVHYRNVADD;FAVAVHYRNVADDS;AVAVHYRNVADDSV;VAVHYRNVADDSVD;AVHYRNVADDSVDN;VHYRNVADDSVDNL;HYRNVADDSVDNLI;YRNVADDSVDNLIA;RNVADDSVDNLIAA;NVADDSVDNLIAAV;VADDSVDNLIAAVR;ADDSVDNLIAAVRR;DDSVDNLIAAVRRL;DSVDNLIAAVRRLG;SVDNLIAAVRRLGH;VDNLIAAVRRLGHA;DNLIAAVRRLGHAA;NLIAAVRRLGHAAG;LIAAVRRLGHAAGL;IAAVRRLGHAAGLR;AAVRRLGHAAGLRV;AVRRLGHAAGLRVT;VRRLGHAAGLRVTT;RRLGHAAGLRVTTG;RLGHAAGLRVTTGR;LGHAAGLRVTTGRK;GHAAGLRVTTGRKV;HAAGLRVTTGRKVV;AAGLRVTTGRKVVE;AGLRVTTGRKVVEL;GLRVTTGRKVVELR;LRVTTGRKVVELRP;RVTTGRKVVELRPD;VTTGRKVVELRPDI;TTGRKVVELRPDIA;TGRKVVELRPDIAW;GRKVVELRPDIAWD;RKVVELRPDIAWDK;KVVELRPDIAWDKG;VVELRPDIAWDKGK;VELRPDIAWDKGKA;ELRPDIAWDKGKAL;LRPDIAWDKGKALD;RPDIAWDKGKALDW;PDIAWDKGKALDWI;DIAWDKGKALDWIG;IAWDKGKALDWIGE;AWDKGKALDWIGER;WDKGKALDWIGERL;DKGKALDWIGERLG;KGKALDWIGERLGP;GKALDWIGERLGPA;KALDWIGERLGPAE;ALDWIGERLGPAEV;LDWIGERLGPAEVG;DWIGERLGPAEVGP;WIGERLGPAEVGPD;IGERLGPAEVGPDL;GERLGPAEVGPDLR;ERLGPAEVGPDLRL;RLGPAEVGPDLRLP;LGPAEVGPDLRLPI;GPAEVGPDLRLPIY;PAEVGPDLRLPIYI;AEVGPDLRLPIYIG;EVGPDLRLPIYIGD;VGPDLRLPIYIGDD;GPDLRLPIYIGDDL;PDLRLPIYIGDDLT;DLRLPIYIGDDLTD;LRLPIYIGDDLTDE;RLPIYIGDDLTDED;LPIYIGDDLTDEDA;PIYIGDDLTDEDAF;IYIGDDLTDEDAFD;YIGDDLTDEDAFDA;IGDDLTDEDAFDAV;GDDLTDEDAFDAVR;DDLTDEDAFDAVRF;DLTDEDAFDAVRFT;LTDEDAFDAVRFTG;TDEDAFDAVRFTGV;DEDAFDAVRFTGVG;EDAFDAVRFTGVGI;DAFDAVRFTGVGIV;AFDAVRFTGVGIVV;FDAVRFTGVGIVVR;DAVRFTGVGIVVRH;AVRFTGVGIVVRHN;VRFTGVGIVVRHNE;RFTGVGIVVRHNEH;FTGVGIVVRHNEHG;TGVGIVVRHNEHGD;GVGIVVRHNEHGDR;VGIVVRHNEHGDRR;GIVVRHNEHGDRRS;IVVRHNEHGDRRSA;VVRHNEHGDRRSAA;VRHNEHGDRRSAAT;RHNEHGDRRSAATF;HNEHGDRRSAATFR;NEHGDRRSAATFRL;EHGDRRSAATFRLE;HGDRRSAATFRLEC;GDRRSAATFRLECP;DRRSAATFRLECPY;RRSAATFRLECPYT;RSAATFRLECPYTV;SAATFRLECPYTVC;AATFRLECPYTVCQ;ATFRLECPYTVCQF;TFRLECPYTVCQFL;FRLECPYTVCQFLS;RLECPYTVCQFLSQ;LECPYTVCQFLSQL;ECPYTVCQFLSQLA;CPYTVCQFLSQLA | |

Fig. 30 continued

| | | |
|---|---|---|
| | C;PYTVCQFLSQLACD;YTVCQFLSQLACDL;TVCQFLSQLACDLQ;VCQFLSQLACDLQE;CQFLSQLACDLQEA;QFLSQLACDLQEAV;FLSQLACDLQEAVQ;LSQLACDLQEAVQH;SQLACDLQEAVQHD;QLACDLQEAVQHDD;LACDLQEAVQHDDP;ACDLQEAVQHDDPW;CDLQEAVQHDDPWT;DLQEAVQHDDPWTL;LQEAVQHDDPWTLV;QEAVQHDDPWTLVF;EAVQHDDPWTLVFH;AVQHDDPWTLVFHG;VQHDDPWTLVFHGY;QHDDPWTLVFHGYD;HDDPWTLVFHGYDP;DDPWTLVFHGYDPG;DPWTLVFHGYDPGQ;PWTLVFHGYDPGQE;WTLVFHGYDPGQER;TLVFHGYDPGQERL;LVFHGYDPGQERLR;VFHGYDPGQERLRE;FHGYDPGQERLREA;HGYDPGQERLREAL;GYDPGQERLREALC;YDPGQERLREALCA;DPGQERLREALCAV;PGQERLREALCAVG;GQERLREALCAVGN;QERLREALCAVGNG;ERLREALCAVGNGY;RLREALCAVGNGYL;LREALCAVGNGYLG;REALCAVGNGYLGS;EALCAVGNGYLGSR;ALCAVGNGYLGSRG;LCAVGNGYLGSRGC;CAVGNGYLGSRGCA;AVGNGYLGSRGCAP;VGNGYLGSRGCAPE;GNGYLGSRGCAPES;NGYLGSRGCAPESA;GYLGSRGCAPESAE;YLGSRGCAPESAES;LGSRGCAPESAESE;GSRGCAPESAESEA;SRGCAPESAESEAH;RGCAPESAESEAHY;GCAPESAESEAHYP;CAPESAESEAHYPG;APESAESEAHYPGT;PESAESEAHYPGTY;ESAESEAHYPGTYV;SAESEAHYPGTYVA;AESEAHYPGTYVAG;ESEAHYPGTYVAGV;SEAHYPGTYVAGVY;EAHYPGTYVAGVYN;AHYPGTYVAGVYNQ;HYPGTYVAGVYNQL;YPGTYVAGVYNQLT;PGTYVAGVYNQLTD;GTYVAGVYNQLTDH;TYVAGVYNQLTDHI;YVAGVYNQLTDHIE;VAGVYNQLTDHIEG;AGVYNQLTDHIEGC;GVYNQLTDHIEGCT;VYNQLTDHIEGCTV;YNQLTDHIEGCTVD;NQLTDHIEGCTVDN;QLTDHIEGCTVDNE;LTDHIEGCTVDNES;TDHIEGCTVDNESL;DHIEGCTVDNESLV;HIEGCTVDNESLVN;IEGCTVDNESLVNL;EGCTVDNESLVNLP;GCTVDNESLVNLPN;CTVDNESLVNLPNW;TVDNESLVNLPNWL;VDNESLVNLPNWLS;DNESLVNLPNWLSL;NESLVNLPNWLSLT;ESLVNLPNWLSLTF;SLVNLPNWLSLTFR;LVNLPNWLSLTFRI;VNLPNWLSLTFRID;NLPNWLSLTFRIDG;LPNWLSLTFRIDGG;PNWLSLTFRIDGGA;NWLSLTFRIDGGAW;WLSLTFRIDGGAWF;LSLTFRIDGGAWFN;SLTFRIDGGAWFNV;LTFRIDGGAWFNVD;TFRIDGGAWFNVDT;FRIDGGAWFNVDTV;RIDGGAWFNVDTVE;IDGGAWFNVDTVEL;DGGAWFNVDTVELL;GGAWFNVDTVELLS;GAWFNVDTVELLSY;AWFNVDTVELLSYR;WFNVDTVELLSYRQ;FNVDTVELLSYRQT;NVDTVELLSYRQTF;VDTVELLSYRQTFD;DTVELLSYRQTFDL;TVELLSYRQTFDLR;VELLSYRQTFDLRR;ELLSYRQTFDLRRA;LLSYRQTFDLRRAT;LSYRQTFDLRRATL;SYRQTFDLRRATLT;YRQTFDLRRATLTR;RQTFDLRRATLTRS;QTFDLRRATLTRSL;TFDLRRATLTRSLR;FDLRRATLTRSLRF;DLRRATLTRSLRFR;LRRATLTRSLRFRD;RRATLTRSLRFRDA;RATLTRSLRFRDAG;ATLTRSLRFRDAGG;TLTRSLRFRDAGGR;LTRSLRFRDAGGRV;TRSLRFRDAGGRVT;RSLRFRDAGGRVTT;SLRFRDAGGRVTTM;LRFRDAGGRVTTMT;RFRDAGGRVTTMTQ;FRDAGGRVTTMTQE;RDAGGRVTTMTQER;DAGGRVTTMTQERF;AGGRVTTMTQERFA;GGRVTTMTQERFAS;GRVTTMTQERFASM;RVTTMTQERFASMN;VTTMTQERFASMNR;TTMTQERFASMNRP;TMTQERFASMNRPN;MTQERFASMNRPNL;TQERFASMNRPNLV;QERFASMNRPNLVA;ERFASMNRPNLVAL;RFASMNRPNLVALQ;FASMNRPNLVALQT;ASMNRPNLVALQTR;SMNRPNLVALQTRI;MNRPNLVALQTRIE;NRPNLVALQTRIES;RPNLVALQTRIESE;PNLVALQTRIESEN;NLVALQTRIESENW;LVALQTRIESENWS;VALQTRIESENWSG;ALQTRIESENWSGT;LQTRIESENWSGTV;QTRIESENWSGTVD;TRIESENWSGTVDF;RIESENWSGTVDFR;IESENWSGTVDFRS;ESENWSGTVDFRSL;SENWSGTVDFRSLV;ENWSGTVDFRSLVD;NWSGTVDFRSLVDG;WSGTVDFRSLVDGG;SGTVDFRSLVDGGV;GTVDFRSLVDGGVH;TVDFRSLVDGGVHN;VDFRSLVDGGVHNT;DFRSLVDGGVHNTL;FRSLVDGGVHNTLV;RSLVDGGVHNTLVD;SLVDGGVHNTLVDR;LVDGGVHNTLV | |

Fig. 30 continued

| | | |
|---|---|---|
| | DRY;VDGGVHNTLVDRYR;DGGVHNTLVDRYRQ;GGVHNTLVDRYRQL;GVHNTLVDRYRQLS;VHNTLVDRYRQLSS;HNTLVDRYRQLSSQ;NTLVDRYRQLSSQH;TLVDRYRQLSSQHL;LVDRYRQLSSQHLT;VDRYRQLSSQHLTT;DRYRQLSSQHLTTA;RYRQLSSQHLTTAE;YRQLSSQHLTTAEI;RQLSSQHLTTAEIE;QLSSQHLTTAEIEV;LSSQHLTTAEIEVL;SSQHLTTAEIEVLA;SQHLTTAEIEVLAD;QHLTTAEIEVLADS;HLTTAEIEVLADSV;LTTAEIEVLADSVL;TTAEIEVLADSVLL;TAEIEVLADSVLLR;AEIEVLADSVLLRT;EIEVLADSVLLRTQ;IEVLADSVLLRTQT;EVLADSVLLRTQTS;VLADSVLLRTQTSQ;LADSVLLRTQTSQS;ADSVLLRTQTSQSG;DSVLLRTQTSQSGI;SVLLRTQTSQSGIA;VLLRTQTSQSGIAI;LLRTQTSQSGIAIA;LRTQTSQSGIAIAV;RTQTSQSGIAIAVA;TQTSQSGIAIAVAA;QTSQSGIAIAVAAR;TSQSGIAIAVAARS;SQSGIAIAVAARST;QSGIAIAVAARSTL;SGIAIAVAARSTLW;GIAIAVAARSTLWR;IAIAVAARSTLWRD;AIAVAARSTLWRDG;IAVAARSTLWRDGQ;AVAARSTLWRDGQR;VAARSTLWRDGQRV;AARSTLWRDGQRVD;ARSTLWRDGQRVDA;RSTLWRDGQRVDAQ;STLWRDGQRVDAQY;TLWRDGQRVDAQYR;LWRDGQRVDAQYRV;WRDGQRVDAQYRVA;RDGQRVDAQYRVAR;DGQRVDAQYRVARD;GQRVDAQYRVARDT;QRVDAQYRVARDTN;RVDAQYRVARDTNR;VDAQYRVARDTNRG;DAQYRVARDTNRGG;AQYRVARDTNRGGH;QYRVARDTNRGGHD;YRVARDTNRGGHDI;RVARDTNRGGHDIQ;VARDTNRGGHDIQV;ARDTNRGGHDIQVT;RDTNRGGHDIQVTL;DTNRGGHDIQVTLS;TNRGGHDIQVTLSA;NRGGHDIQVTLSAG;RGGHDIQVTLSAGQ;GGHDIQVTLSAGQS;GHDIQVTLSAGQSV;HDIQVTLSAGQSVT;DIQVTLSAGQSVTL;IQVTLSAGQSVTLE;QVTLSAGQSVTLEK;VTLSAGQSVTLEKV;TLSAGQSVTLEKVA;LSAGQSVTLEKVAT;SAGQSVTLEKVATI;AGQSVTLEKVATIF;GQSVTLEKVATIFT;QSVTLEKVATIFTS;SVTLEKVATIFTSR;VTLEKVATIFTSRD;TLEKVATIFTSRDA;LEKVATIFTSRDAA;EKVATIFTSRDAAT;KVATIFTSRDAATL;VATIFTSRDAATLT;ATIFTSRDAATLTA;TIFTSRDAATLTAA;IFTSRDAATLTAAI;FTSRDAATLTAAIS;TSRDAATLTAAISA;SRDAATLTAAISAQ;RDAATLTAAISAQR;DAATLTAAISAQRC;AATLTAAISAQRCL;ATLTAAISAQRCLG;TLTAAISAQRCLGE;LTAAISAQRCLGEA;TAAISAQRCLGEAG;AAISAQRCLGEAGR;AISAQRCLGEAGRY;ISAQRCLGEAGRYA;SAQRCLGEAGRYAE;AQRCLGEAGRYAEL;QRCLGEAGRYAELC;RCLGEAGRYAELCQ;CLGEAGRYAELCQQ;LGEAGRYAELCQQH;GEAGRYAELCQQHV;EAGRYAELCQQHVR;AGRYAELCQQHVRA;GRYAELCQQHVRAW;RYAELCQQHVRAWA;YAELCQQHVRAWAR;AELCQQHVRAWARL;ELCQQHVRAWARLW;LCQQHVRAWARLWE;CQQHVRAWARLWER;QQHVRAWARLWERC;QHVRAWARLWERCA;HVRAWARLWERCAI;VRAWARLWERCAID;RAWARLWERCAIDL;AWARLWERCAIDLT;WARLWERCAIDLTG;ARLWERCAIDLTGN;RLWERCAIDLTGNT;LWERCAIDLTGNTE;WERCAIDLTGNTEE;ERCAIDLTGNTEEL;RCAIDLTGNTEELR;CAIDLTGNTEELRL;AIDLTGNTEELRLV;IDLTGNTEELRLVR;DLTGNTEELRLVRL;LTGNTEELRLVRLH;TGNTEELRLVRLHL;GNTEELRLVRLHLL;NTEELRLVRLHLLH;TEELRLVRLHLLHL;EELRLVRLHLLHLL;ELRLVRLHLLHLLQ;LRLVRLHLLHLLQT;RLVRLHLLHLLQTI;LVRLHLLHLLQTIS;VRLHLLHLLQTISP;RLHLLHLLQTISPH;LHLLHLLQTISPHT;HLLHLLQTISPHTA;LLHLLQTISPHTAE;LHLLQTISPHTAEL;HLLQTISPHTAELD;LLQTISPHTAELDA;LQTISPHTAELDAG;QTISPHTAELDAGV;TISPHTAELDAGVP;ISPHTAELDAGVPA;SPHTAELDAGVPAR;PHTAELDAGVPARG;HTAELDAGVPARGL;TAELDAGVPARGLN;AELDAGVPARGLNG;ELDAGVPARGLNGE;LDAGVPARGLNGEA;DAGVPARGLNGEAY;AGVPARGLNGEAYR;GVPARGLNGEAYRG;VPARGLNGEAYRGH;PARGLNGEAYRGHV;ARGLNGEAYRGHVF;RGLNGEAYRGHVFW;GLNGEAYRGHVFWD;LNGEAYRGHVFWDA;NGEAYRGHVFWDAL;GEAYRGHVFWDALF;EAYRGHVFWDALFV;AYRGHVFWDALFVA;YRGHVFWDALFVAP;RGHVFWDALFVAPV;GHVF | |

Fig. 30 continued

| | | |
|---|---|---|
| | WDALFVAPVL;HVFWDALFVAPVLS;VFWDALFVAPVLSL;FWDALFVAPVLSLR;WDALFVAPVLSLRM;DALFVAPVLSLRMP;ALFVAPVLSLRMPK;LFVAPVLSLRMPKV;FVAPVLSLRMPKVA;VAPVLSLRMPKVAR;APVLSLRMPKVARS;PVLSLRMPKVARSL;VLSLRMPKVARSLL;LSLRMPKVARSLLD;SLRMPKVARSLLDY;LRMPKVARSLLDYR;RMPKVARSLLDYRY;MPKVARSLLDYRYR;PKVARSLLDYRYRR;KVARSLLDYRYRRL;VARSLLDYRYRRLP;ARSLLDYRYRRLPA;RSLLDYRYRRLPAA;SLLDYRYRRLPAAR;LLDYRYRRLPAARR;LDYRYRRLPAARRA;DYRYRRLPAARRAA;YRYRRLPAARRAAH;RYRRLPAARRAAHR;YRRLPAARRAAHRA;RRLPAARRAAHRAG;RLPAARRAAHRAGH;LPAARRAAHRAGHL;PAARRAAHRAGHLG;AARRAAHRAGHLGA;ARRAAHRAGHLGAM;RRAAHRAGHLGAMY;RAAHRAGHLGAMYP;AAHRAGHLGAMYPW;AHRAGHLGAMYPWQ;HRAGHLGAMYPWQS;RAGHLGAMYPWQSG;AGHLGAMYPWQSGS;GHLGAMYPWQSGSD;HLGAMYPWQSGSDG;LGAMYPWQSGSDGS;GAMYPWQSGSDGSE;AMYPWQSGSDGSEV;MYPWQSGSDGSEVS;YPWQSGSDGSEVSQ;PWQSGSDGSEVSQQ;WQSGSDGSEVSQQL;QSGSDGSEVSQQLH;SGSDGSEVSQQLHL;GSDGSEVSQQLHLN;SDGSEVSQQLHLNP;DGSEVSQQLHLNPR;GSEVSQQLHLNPRS;SEVSQQLHLNPRSG;EVSQQLHLNPRSGR;VSQQLHLNPRSGRW;SQQLHLNPRSGRWT;QQLHLNPRSGRWTP;QLHLNPRSGRWTPD;LHLNPRSGRWTPDP;HLNPRSGRWTPDPS;LNPRSGRWTPDPSD;NPRSGRWTPDPSDR;PRSGRWTPDPSDRA;RSGRWTPDPSDRAH;SGRWTPDPSDRAHH;GRWTPDPSDRAHHV;RWTPDPSDRAHHVG;WTPDPSDRAHHVGL;TPDPSDRAHHVGLA;PDPSDRAHHVGLAV;DPSDRAHHVGLAVA;PSDRAHHVGLAVAY;SDRAHHVGLAVAYN;DRAHHVGLAVAYNA;RAHHVGLAVAYNAW;AHHVGLAVAYNAWH;HHVGLAVAYNAWHY;HVGLAVAYNAWHYY;VGLAVAYNAWHYYQ;GLAVAYNAWHYYQV;LAVAYNAWHYYQVT;AVAYNAWHYYQVTG;VAYNAWHYYQVTGD;AYNAWHYYQVTGDR;YNAWHYYQVTGDRQ;NAWHYYQVTGDRQY;AWHYYQVTGDRQYL;WHYYQVTGDRQYLV;HYYQVTGDRQYLVD;YYQVTGDRQYLVDC;YQVTGDRQYLVDCG;QVTGDRQYLVDCGA;VTGDRQYLVDCGAE;TGDRQYLVDCGAEL;GDRQYLVDCGAELL;DRQYLVDCGAELLV;RQYLVDCGAELLVE;QYLVDCGAELLVEI;YLVDCGAELLVEIA;LVDCGAELLVEIAR;VDCGAELLVEIARF;DCGAELLVEIARFW;CGAELLVEIARFWV;GAELLVEIARFWVG;AELLVEIARFWVGL;ELLVEIARFWVGLA;LLVEIARFWVGLAK;LVEIARFWVGLAKL;VEIARFWVGLAKLD;EIARFWVGLAKLDD;IARFWVGLAKLDDS;ARFWVGLAKLDDSR;RFWVGLAKLDDSRG;FWVGLAKLDDSRGR;WVGLAKLDDSRGRY;VGLAKLDDSRGRYL;GLAKLDDSRGRYLI;LAKLDDSRGRYLIR;AKLDDSRGRYLIRG;KLDDSRGRYLIRGV;LDDSRGRYLIRGVI;DDSRGRYLIRGVIG;DSRGRYLIRGVIGP;SRGRYLIRGVIGPD;RGRYLIRGVIGPDE;GRYLIRGVIGPDEF;RYLIRGVIGPDEFH;YLIRGVIGPDEFHS;LIRGVIGPDEFHSG;IRGVIGPDEFHSGY;RGVIGPDEFHSGYP;GVIGPDEFHSGYPG;VIGPDEFHSGYPGN;IGPDEFHSGYPGNE;GPDEFHSGYPGNEY;PDEFHSGYPGNEYD;DEFHSGYPGNEYDG;EFHSGYPGNEYDGI;FHSGYPGNEYDGID;HSGYPGNEYDGIDN;SGYPGNEYDGIDNN;GYPGNEYDGIDNNA;YPGNEYDGIDNNAY;PGNEYDGIDNNAYT;GNEYDGIDNNAYTN;NEYDGIDNNAYTNV;EYDGIDNNAYTNVM;YDGIDNNAYTNVMA;DGIDNNAYTNVMAV;GIDNNAYTNVMAVW;IDNNAYTNVMAVWV;DNNAYTNVMAVWVI;NNAYTNVMAVWVIL;NAYTNVMAVWVILR;AYTNVMAVWVILRA;YTNVMAVWVILRAM;TNVMAVWVILRAME;NVMAVWVILRAMEA;VMAVWVILRAMEAL;MAVWVILRAMEALD;AVWVILRAMEALDL;VWVILRAMEALDLL;WVILRAMEALDLLP;VILRAMEALDLLPL;ILRAMEALDLLPLT;LRAMEALDLLPLTD;RAMEALDLLPLTDR;AMEALDLLPLTDRR;MEALDLLPLTDRRH;EALDLLPLTDRRHL;ALDLLPLTDRRHLI;LDLLPLTDRRHLIE;DLLPLTDRRHLIEK;LLPLTDRRHLIEKL;LPLTDRRHLIEKLG;PLTDRRHLIEKLGL;LTDRRHLIEKLGLT; | |

Fig. 30 continued

| | | |
|---|---|---|
| | TDRRHLIEKLGLTT;DRRHLIEKLGLTTQ;RRHLIEKLGLTTQE;RHLIEKLGLTTQER;HLIEKLGLTTQERD;LIEKLGLTTQERDQ;IEKLGLTTQERDQW;EKLGLTTQERDQWD;KLGLTTQERDQWDD;LGLTTQERDQWDDV;GLTTQERDQWDDVS;LTTQERDQWDDVSR;TTQERDQWDDVSRR;TQERDQWDDVSRRM;QERDQWDDVSRRMF;ERDQWDDVSRRMFV;RDQWDDVSRRMFVP;DQWDDVSRRMFVPF;QWDDVSRRMFVPFH;WDDVSRRMFVPFHD;DDVSRRMFVPFHDG;DVSRRMFVPFHDGV;VSRRMFVPFHDGVI;SRRMFVPFHDGVIS;RRMFVPFHDGVISQ;RMFVPFHDGVISQF;MFVPFHDGVISQFE;FVPFHDGVISQFEG;VPFHDGVISQFEGY;PFHDGVISQFEGYS;FHDGVISQFEGYSE;HDGVISQFEGYSEL;DGVISQFEGYSELA;GVISQFEGYSELAE;VISQFEGYSELAEL;ISQFEGYSELAELD;SQFEGYSELAELDW;QFEGYSELAELDWD;FEGYSELAELDWDH;EGYSELAELDWDHY;GYSELAELDWDHYR;YSELAELDWDHYRH;SELAELDWDHYRHR;ELAELDWDHYRHRY;LAELDWDHYRHRYG;AELDWDHYRHRYGN;ELDWDHYRHRYGNI;LDWDHYRHRYGNIQ;DWDHYRHRYGNIQR;WDHYRHRYGNIQRL;DHYRHRYGNIQRLD;HYRHRYGNIQRLDR;YRHRYGNIQRLDRI;RHRYGNIQRLDRIL;HRYGNIQRLDRILE;RYGNIQRLDRILEA;YGNIQRLDRILEAE;GNIQRLDRILEAEG;NIQRLDRILEAEGD;IQRLDRILEAEGDS;QRLDRILEAEGDSV;RLDRILEAEGDSVN;LDRILEAEGDSVNN;DRILEAEGDSVNNY;RILEAEGDSVNNYQ;ILEAEGDSVNNYQA;LEAEGDSVNNYQAS;EAEGDSVNNYQASK;AEGDSVNNYQASKQ;EGDSVNNYQASKQA;GDSVNNYQASKQAD;DSVNNYQASKQADA;SVNNYQASKQADAL;VNNYQASKQADALM;NNYQASKQADALML;NYQASKQADALMLL;YQASKQADALMLLY;QASKQADALMLLYL;ASKQADALMLLYLL;SKQADALMLLYLLS;KQADALMLLYLLSS;QADALMLLYLLSSD;ADALMLLYLLSSDE;DALMLLYLLSSDEL;ALMLLYLLSSDELI;LMLLYLLSSDELIG;MLLYLLSSDELIGL;LLYLLSSDELIGLL;LYLLSSDELIGLLA;YLLSSDELIGLLAR;LLSSDELIGLLARL;LSSDELIGLLARLG;SSDELIGLLARLGY;SDELIGLLARLGYR;DELIGLLARLGYRF;ELIGLLARLGYRFA;LIGLLARLGYRFAP;IGLLARLGYRFAPT;GLLARLGYRFAPTQ;LLARLGYRFAPTQI;LARLGYRFAPTQIP;ARLGYRFAPTQIPG;RLGYRFAPTQIPGT;LGYRFAPTQIPGTV;GYRFAPTQIPGTVD;YRFAPTQIPGTVDY;RFAPTQIPGTVDYY;FAPTQIPGTVDYYL;APTQIPGTVDYYLA;PTQIPGTVDYYLAR;TQIPGTVDYYLART;QIPGTVDYYLARTS;IPGTVDYYLARTSD;PGTVDYYLARTSDG;GTVDYYLARTSDGS;TVDYYLARTSDGST;VDYYLARTSDGSTL;DYYLARTSDGSTLS;YYLARTSDGSTLSA;YLARTSDGSTLSAV;LARTSDGSTLSAVV;ARTSDGSTLSAVVH;RTSDGSTLSAVVHA;TSDGSTLSAVVHAW;SDGSTLSAVVHAWV;DGSTLSAVVHAWVL;GSTLSAVVHAWVLA;STLSAVVHAWVLAR;TLSAVVHAWVLARA;LSAVVHAWVLARAN;SAVVHAWVLARANR;AVVHAWVLARANRS;VVHAWVLARANRSN;VHAWVLARANRSNA;HAWVLARANRSNAM;AWVLARANRSNAME;WVLARANRSNAMEY;VLARANRSNAMEYF;LARANRSNAMEYFR;ARANRSNAMEYFRQ;RANRSNAMEYFRQV;ANRSNAMEYFRQVL;NRSNAMEYFRQVLR;RSNAMEYFRQVLRS;SNAMEYFRQVLRSD;NAMEYFRQVLRSDI;AMEYFRQVLRSDIA;MEYFRQVLRSDIAD;EYFRQVLRSDIADV;YFRQVLRSDIADVQ;FRQVLRSDIADVQG;RQVLRSDIADVQGG;QVLRSDIADVQGGT;VLRSDIADVQGGTT;LRSDIADVQGGTTQ;RSDIADVQGGTTQE;SDIADVQGGTTQEG;DIADVQGGTTQEGI;IADVQGGTTQEGIH;ADVQGGTTQEGIHL;DVQGGTTQEGIHLA;VQGGTTQEGIHLAA;QGGTTQEGIHLAAM;GGTTQEGIHLAAMA;GTTQEGIHLAAMAG;TTQEGIHLAAMAGS;TQEGIHLAAMAGSI;QEGIHLAAMAGSID;EGIHLAAMAGSIDL;GIHLAAMAGSIDLL;IHLAAMAGSIDLLQ;HLAAMAGSIDLLQR;LAAMAGSIDLLQRC;AAMAGSIDLLQRCY;AMAGSIDLLQRCYS;MAGSIDLLQRCYSG;AGSIDLLQRCYSGL;GSIDLLQRCYSGLE;SIDLLQRCYSGLEL;IDLLQRCYSGLELR;DLLQRCYSGLELRD;LLQRCYSGLELRDD;LQRCYSGLELRDDR;QRCYSGLELRDDRL;RCYSGLELRDDRLV;CYSGLELRD | |

Fig. 30 continued

| | | |
|---|---|---|
| | DRLVL;YSGLELRDDRLVLS;SGLELRDDRLVLSP;GLELRDDRLVLSPQ;LELRDDRLVLSPQW;ELRDDRLVLSPQWP;LRDDRLVLSPQWPE;RDDRLVLSPQWPEA;DDRLVLSPQWPEAL;DRLVLSPQWPEALG;RLVLSPQWPEALGP;LVLSPQWPEALGPL;VLSPQWPEALGPLE;LSPQWPEALGPLEF;SPQWPEALGPLEFP;PQWPEALGPLEFPF;QWPEALGPLEFPFV;WPEALGPLEFPFVY;PEALGPLEFPFVYR;EALGPLEFPFVYRR;ALGPLEFPFVYRRH;LGPLEFPFVYRRHQ;GPLEFPFVYRRHQL;PLEFPFVYRRHQLS;LEFPFVYRRHQLSL;EFPFVYRRHQLSLR;FPFVYRRHQLSLRI;PFVYRRHQLSLRIS;FVYRRHQLSLRISG;VYRRHQLSLRISGR;YRRHQLSLRISGRS;RRHQLSLRISGRSA;RHQLSLRISGRSAT;HQLSLRISGRSATL;QLSLRISGRSATLT;LSLRISGRSATLTA;SLRISGRSATLTAE;LRISGRSATLTAES;RISGRSATLTAESG;ISGRSATLTAESGD;SGRSATLTAESGDA;GRSATLTAESGDAE;RSATLTAESGDAEP;SATLTAESGDAEPI;ATLTAESGDAEPIE;TLTAESGDAEPIEV;LTAESGDAEPIEVE;TAESGDAEPIEVEC;AESGDAEPIEVECR;ESGDAEPIEVECRG;SGDAEPIEVECRGH;GDAEPIEVECRGHV;DAEPIEVECRGHVQ;AEPIEVECRGHVQR;EPIEVECRGHVQRL;PIEVECRGHVQRLR;IEVECRGHVQRLRC;EVECRGHVQRLRCG;VECRGHVQRLRCGH;ECRGHVQRLRCGHT;CRGHVQRLRCGHTI;RGHVQRLRCGHTIE;GHVQRLRCGHTIEV;HVQRLRCGHTIEVG;VQRLRCGHTIEVGC;QRLRCGHTIEVGCS;RLRCGHTIEVGCSR;<br><br>15 mers:<br>MRCGIVVNVTGPPPT;RCGIVVNVTGPPPTI;CGIVVNVTGPPPTID;GIVVNVTGPPPTIDR;IVVNVTGPPPTIDRR;VVNVTGPPPTIDRRY;VNVTGPPPTIDRRYH;NVTGPPPTIDRRYHD;VTGPPPTIDRRYHDA;TGPPPTIDRRYHDAV;GPPPTIDRRYHDAVI;PPPTIDRRYHDAVIV;PPTIDRRYHDAVIVG;PTIDRRYHDAVIVGL;TIDRRYHDAVIVGLD;IDRRYHDAVIVGLDN;DRRYHDAVIVGLDNV;RRYHDAVIVGLDNVV;RYHDAVIVGLDNVVD;YHDAVIVGLDNVVDK;HDAVIVGLDNVVDKA;DAVIVGLDNVVDKAT;AVIVGLDNVVDKATR;VIVGLDNVVDKATRV;IVGLDNVVDKATRVH;VGLDNVVDKATRVHA;GLDNVVDKATRVHAA;LDNVVDKATRVHAAA;DNVVDKATRVHAAAW;NVVDKATRVHAAAWT;VVDKATRVHAAAWTK;VDKATRVHAAAWTKF;DKATRVHAAAWTKFL;KATRVHAAAWTKFLD;ATRVHAAAWTKFLDD;TRVHAAAWTKFLDDY;RVHAAAWTKFLDDYL;VHAAAWTKFLDDYLT;HAAAWTKFLDDYLTR;AAAWTKFLDDYLTRR;AAWTKFLDDYLTRRP;AWTKFLDDYLTRRPQ;WTKFLDDYLTRRPQR;TKFLDDYLTRRPQRT;KFLDDYLTRRPQRTG;FLDDYLTRRPQRTGE;LDDYLTRRPQRTGED;DDYLTRRPQRTGEDH;DYLTRRPQRTGEDHC;YLTRRPQRTGEDHCP;LTRRPQRTGEDHCPL;TRRPQRTGEDHCPLT;RRPQRTGEDHCPLTH;RPQRTGEDHCPLTHD;PQRTGEDHCPLTHDD;QRTGEDHCPLTHDDY;RTGEDHCPLTHDDYR;TGEDHCPLTHDDYRR;GEDHCPLTHDDYRRF;EDHCPLTHDDYRRFL;DHCPLTHDDYRRFLA;HCPLTHDDYRRFLAG;CPLTHDDYRRFLAGK;PLTHDDYRRFLAGKP;LTHDDYRRFLAGKPD;THDDYRRFLAGKPDG;HDDYRRFLAGKPDGV;DDYRRFLAGKPDGVA;DYRRFLAGKPDGVAD;YRRFLAGKPDGVADF;RRFLAGKPDGVADFL;RFLAGKPDGVADFLA;FLAGKPDGVADFLAA;LAGKPDGVADFLAAR;AGKPDGVADFLAARG;GKPDGVADFLAARGI;KPDGVADFLAARGIR;PDGVADFLAARGIRL;DGVADFLAARGIRLP;GVADFLAARGIRLPP;VADFLAARGIRLPPG;ADFLAARGIRLPPGS;DFLAARGIRLPPGSP;FLAARGIRLPPGSPT;LAARGIRLPPGSPTD;AARGIRLPPGSPTDL;ARGIRLPPGSPTDLT;RGIRLPPGSPTDLTD;GIRLPPGSPTDLTDD;IRLPPGSPTDLTDDT;RLPPGSPTDLTDDTV;LPPGSPTDLTDDTVY;PPGSPTDLTDDTVYG;PGSPTDLTDDTVYGL;GSPTDLTDDTVYGLQ;SPTDLTDDTVYGLQN;PTDLTDDTVYGLQNL;TDLTDDTVYGLQNLE;DLTDDTVYGLQNLER;LTDDTVYGLQNLERQ;TDDTVYGLQNLERQT;DDTVYGLQNLERQTF;DTVYGLQNLERQTFL;TVYGLQNLERQTFLQ;VYGLQNLERQT | |

Fig. 30 continued

| | | |
|---|---|---|
| | FLQL;YGLQNLERQTFLQLL;GLQNLERQTFLQLLN;LQNLERQTFLQLLNT;QNLERQTFLQLLNTG;NLERQTFLQLLNTGV;LERQTFLQLLNTGVP;ERQTFLQLLNTGVPE;RQTFLQLLNTGVPEG;QTFLQLLNTGVPEGK;TFLQLLNTGVPEGKS;FLQLLNTGVPEGKSI;LQLLNTGVPEGKSIA;QLLNTGVPEGKSIAS;LLNTGVPEGKSIASF;LNTGVPEGKSIASFA;NTGVPEGKSIASFAR;TGVPEGKSIASFARR;GVPEGKSIASFARRL;VPEGKSIASFARRLQ;PEGKSIASFARRLQV;EGKSIASFARRLQVA;GKSIASFARRLQVAG;KSIASFARRLQVAGV;SIASFARRLQVAGVR;IASFARRLQVAGVRV;ASFARRLQVAGVRVA;SFARRLQVAGVRVAA;FARRLQVAGVRVAAH;ARRLQVAGVRVAAHT;RRLQVAGVRVAAHTS;RLQVAGVRVAAHTSH;LQVAGVRVAAHTSHR;QVAGVRVAAHTSHRN;VAGVRVAAHTSHRNY;AGVRVAAHTSHRNYG;GVRVAAHTSHRNYGH;VRVAAHTSHRNYGHT;RVAAHTSHRNYGHTL;VAAHTSHRNYGHTLD;AAHTSHRNYGHTLDA;AHTSHRNYGHTLDAT;HTSHRNYGHTLDATG;TSHRNYGHTLDATGL;SHRNYGHTLDATGLA;HRNYGHTLDATGLAE;RNYGHTLDATGLAEV;NYGHTLDATGLAEVF;YGHTLDATGLAEVFA;GHTLDATGLAEVFAV;HTLDATGLAEVFAVF;TLDATGLAEVFAVFV;LDATGLAEVFAVFVD;DATGLAEVFAVFVDG;ATGLAEVFAVFVDGA;TGLAEVFAVFVDGAV;GLAEVFAVFVDGAVT;LAEVFAVFVDGAVTA;AEVFAVFVDGAVTAE;EVFAVFVDGAVTAEL;VFAVFVDGAVTAELG;FAVFVDGAVTAELGL;AVFVDGAVTAELGLP;VFVDGAVTAELGLPA;FVDGAVTAELGLPAE;VDGAVTAELGLPAEP;DGAVTAELGLPAEPN;GAVTAELGLPAEPNP;AVTAELGLPAEPNPA;VTAELGLPAEPNPAG;TAELGLPAEPNPAGL;AELGLPAEPNPAGLI;ELGLPAEPNPAGLIE;LGLPAEPNPAGLIET;GLPAEPNPAGLIETA;LPAEPNPAGLIETAK;PAEPNPAGLIETAKR;AEPNPAGLIETAKRL;EPNPAGLIETAKRLG;PNPAGLIETAKRLGA;NPAGLIETAKRLGAN;PAGLIETAKRLGANP;AGLIETAKRLGANPG;GLIETAKRLGANPGR;LIETAKRLGANPGRC;IETAKRLGANPGRCV;ETAKRLGANPGRCVV;TAKRLGANPGRCVVI;AKRLGANPGRCVVID;KRLGANPGRCVVIDS;RLGANPGRCVVIDSC;LGANPGRCVVIDSCQ;GANPGRCVVIDSCQT;ANPGRCVVIDSCQTG;NPGRCVVIDSCQTGL;PGRCVVIDSCQTGLR;GRCVVIDSCQTGLRA;RCVVIDSCQTGLRAG;CVVIDSCQTGLRAGR;VVIDSCQTGLRAGRN;VIDSCQTGLRAGRNG;IDSCQTGLRAGRNGG;DSCQTGLRAGRNGGF;SCQTGLRAGRNGGFA;CQTGLRAGRNGGFAL;QTGLRAGRNGGFALV;TGLRAGRNGGFALVI;GLRAGRNGGFALVIA;LRAGRNGGFALVIAV;RAGRNGGFALVIAVD;AGRNGGFALVIAVDA;GRNGGFALVIAVDAH;RNGGFALVIAVDAHG;NGGFALVIAVDAHGD;GGFALVIAVDAHGDA;GFALVIAVDAHGDAE;FALVIAVDAHGDAEN;ALVIAVDAHGDAENL;LVIAVDAHGDAENLL;VIAVDAHGDAENLLS;IAVDAHGDAENLLSS;AVDAHGDAENLLSSG;VDAHGDAENLLSSGA;DAHGDAENLLSSGAD;AHGDAENLLSSGADA;HGDAENLLSSGADAV;GDAENLLSSGADAVV;DAENLLSSGADAVVA;AENLLSSGADAVVAD;ENLLSSGADAVVADL;NLLSSGADAVVADLA;LLSSGADAVVADLAA;LSSGADAVVADLAAV;SSGADAVVADLAAVT;SGADAVVADLAAVTV;GADAVVADLAAVTVG;ADAVVADLAAVTVGS;DAVVADLAAVTVGSG;AVVADLAAVTVGSGD;VVADLAAVTVGSGDA;VADLAAVTVGSGDAA;ADLAAVTVGSGDAAI;DLAAVTVGSGDAAIS;LAAVTVGSGDAAIST;AAVTVGSGDAAISTI;AVTVGSGDAAISTIP;VTVGSGDAAISTIPD;TVGSGDAAISTIPDA;VGSGDAAISTIPDAL;GSGDAAISTIPDALQ;SGDAAISTIPDALQV;GDAAISTIPDALQVY;DAAISTIPDALQVYS;AAISTIPDALQVYSQ;AISTIPDALQVYSQL;ISTIPDALQVYSQLK;STIPDALQVYSQLKR;TIPDALQVYSQLKRL;IPDALQVYSQLKRLL;PDALQVYSQLKRLLT;DALQVYSQLKRLLTG;ALQVYSQLKRLLTGR;LQVYSQLKRLLTGRR;QVYSQLKRLLTGRRP;VYSQLKRLLTGRRPA;YSQLKRLLTGRRPAV;SQLKRLLTGRRPAVF;QLKRLLTGRRPAVFL;LKRLLTGRRPAVFLD;KRLLTGRRPAVFLDF;RLLTGRRPAVFLDFD;LLTGRRPAVFLDFDG;LTGRRPAVFLDFDGT;TGRRPAVFLDFDGTL;GRRPAVFLDFDGTLS;RRPAVFLDFDGTLS | |

Fig. 30 continued

| | | |
|---|---|---|
| | D;RPAVFLDFDGTLSDI;PAVFLDFDGTLSDIV;AVFLDFDGTLSDIVE;VFLDFDGTLSDIVER;FLDFDGTLSDIVERP;LDFDGTLSDIVERPE;DFDGTLSDIVERPEA;FDGTLSDIVERPEAA;DGTLSDIVERPEAAT;GTLSDIVERPEAATL;TLSDIVERPEAATLV;LSDIVERPEAATLVD;SDIVERPEAATLVDG;DIVERPEAATLVDGA;IVERPEAATLVDGAA;VERPEAATLVDGAAE;ERPEAATLVDGAAEA;RPEAATLVDGAAEAL;PEAATLVDGAAEALR;EAATLVDGAAEALRA;AATLVDGAAEALRAL;ATLVDGAAEALRALA;TLVDGAAEALRALAA;LVDGAAEALRALAAQ;VDGAAEALRALAAQC;DGAAEALRALAAQCP;GAAEALRALAAQCPV;AAEALRALAAQCPVA;AEALRALAAQCPVAV;EALRALAAQCPVAVI;ALRALAAQCPVAVIS;LRALAAQCPVAVISG;RALAAQCPVAVISGR;ALAAQCPVAVISGRD;LAAQCPVAVISGRDL;AAQCPVAVISGRDLA;AQCPVAVISGRDLAD;QCPVAVISGRDLADV;CPVAVISGRDLADVR;PVAVISGRDLADVRN;VAVISGRDLADVRNR;AVISGRDLADVRNRV;VISGRDLADVRNRVK;ISGRDLADVRNRVKV;SGRDLADVRNRVKVD;GRDLADVRNRVKVDG;RDLADVRNRVKVDGL;DLADVRNRVKVDGLW;LADVRNRVKVDGLWL;ADVRNRVKVDGLWLA;DVRNRVKVDGLWLAG;VRNRVKVDGLWLAGS;RNRVKVDGLWLAGSH;NRVKVDGLWLAGSHG;RVKVDGLWLAGSHGF;VKVDGLWLAGSHGFE;KVDGLWLAGSHGFEL;VDGLWLAGSHGFELV;DGLWLAGSHGFELVA;GLWLAGSHGFELVAP;LWLAGSHGFELVAPD;WLAGSHGFELVAPDG;LAGSHGFELVAPDGS;AGSHGFELVAPDGSH;GSHGFELVAPDGSHH;SHGFELVAPDGSHHQ;HGFELVAPDGSHHQN;GFELVAPDGSHHQNA;FELVAPDGSHHQNAA;ELVAPDGSHHQNAAA;LVAPDGSHHQNAAAT;VAPDGSHHQNAAATA;APDGSHHQNAAATAA;PDGSHHQNAAATAAI;DGSHHQNAAATAAID;GSHHQNAAATAAIDG;SHHQNAAATAAIDGL;HHQNAAATAAIDGLA;HQNAAATAAIDGLAE;QNAAATAAIDGLAEA;NAAATAAIDGLAEAA;AAATAAIDGLAEAAA;AATAAIDGLAEAAAQ;ATAAIDGLAEAAAQL;TAAIDGLAEAAAQLA;AAIDGLAEAAAQLAD;AIDGLAEAAAQLADA;IDGLAEAAAQLADAL;DGLAEAAAQLADALR;GLAEAAAQLADALRE;LAEAAAQLADALREI;AEAAAQLADALREIA;EAAAQLADALREIAG;AAAQLADALREIAGA;AAQLADALREIAGAV;AQLADALREIAGAVV;QLADALREIAGAVVE;LADALREIAGAVVEH;ADALREIAGAVVEHK;DALREIAGAVVEHKR;ALREIAGAVVEHKRF;LREIAGAVVEHKRFA;REIAGAVVEHKRFAV;EIAGAVVEHKRFAVA;IAGAVVEHKRFAVAV;AGAVVEHKRFAVAVH;GAVVEHKRFAVAVHY;AVVEHKRFAVAVHYR;VVEHKRFAVAVHYRN;VEHKRFAVAVHYRNV;EHKRFAVAVHYRNVA;HKRFAVAVHYRNVAD;KRFAVAVHYRNVADD;RFAVAVHYRNVADDS;FAVAVHYRNVADDSV;AVAVHYRNVADDSVD;VAVHYRNVADDSVDN;AVHYRNVADDSVDNL;VHYRNVADDSVDNLI;HYRNVADDSVDNLIA;YRNVADDSVDNLIAA;RNVADDSVDNLIAAV;NVADDSVDNLIAAVR;VADDSVDNLIAAVRR;ADDSVDNLIAAVRRL;DDSVDNLIAAVRRLG;DSVDNLIAAVRRLGH;SVDNLIAAVRRLGHA;VDNLIAAVRRLGHAA;DNLIAAVRRLGHAAG;NLIAAVRRLGHAAGL;LIAAVRRLGHAAGLR;IAAVRRLGHAAGLRV;AAVRRLGHAAGLRVT;AVRRLGHAAGLRVTT;VRRLGHAAGLRVTTG;RRLGHAAGLRVTTGR;RLGHAAGLRVTTGRK;LGHAAGLRVTTGRKV;GHAAGLRVTTGRKVV;HAAGLRVTTGRKVVE;AAGLRVTTGRKVVEL;AGLRVTTGRKVVELR;GLRVTTGRKVVELRP;LRVTTGRKVVELRPD;RVTTGRKVVELRPDI;VTTGRKVVELRPDIA;TTGRKVVELRPDIAW;TGRKVVELRPDIAWD;GRKVVELRPDIAWDK;RKVVELRPDIAWDKG;KVVELRPDIAWDKGK;VVELRPDIAWDKGKA;VELRPDIAWDKGKAL;ELRPDIAWDKGKALD;LRPDIAWDKGKALDW;RPDIAWDKGKALDWI;PDIAWDKGKALDWIG;DIAWDKGKALDWIGE;IAWDKGKALDWIGER;AWDKGKALDWIGERL;WDKGKALDWIGERLG;DKGKALDWIGERLGP;KGKALDWIGERLGPA;GKALDWIGERLGPAE;KALDWIGERLGPAEV;ALDWIGERLGPAEVG;LDWIGERLGPAEVGP;DWIGERLGPAEVGPD;WIGERLGPAEVGPDL;IGERLGPAEVGPDLR;GERLGPAEVGPDLRL;ERLGPAEVGPDLRLP;RLGPAE | |

Fig. 30 continued

| | | |
|---|---|---|
| | VGPDLRLPI;LGPAEVGPDLRLPIY;GPAEVGPDLRLPIYI;PAEVGPDLRLPIYIG;AEVGPDLRLPIYIGD;EVGPDLRLPIYIGDD;VGPDLRLPIYIGDDL;GPDLRLPIYIGDDLT;PDLRLPIYIGDDLTD;DLRLPIYIGDDLTDE;LRLPIYIGDDLTDED;RLPIYIGDDLTDEDA;LPIYIGDDLTDEDAF;PIYIGDDLTDEDAFD;IYIGDDLTDEDAFDA;YIGDDLTDEDAFDAV;IGDDLTDEDAFDAVR;GDDLTDEDAFDAVRF;DDLTDEDAFDAVRFT;DLTDEDAFDAVRFTG;LTDEDAFDAVRFTGV;TDEDAFDAVRFTGVG;DEDAFDAVRFTGVGI;EDAFDAVRFTGVGIV;DAFDAVRFTGVGIVV;AFDAVRFTGVGIVVR;FDAVRFTGVGIVVRH;DAVRFTGVGIVVRHN;AVRFTGVGIVVRHNE;VRFTGVGIVVRHNEH;RFTGVGIVVRHNEHG;FTGVGIVVRHNEHGD;TGVGIVVRHNEHGDR;GVGIVVRHNEHGDRR;VGIVVRHNEHGDRRS;GIVVRHNEHGDRRSA;IVVRHNEHGDRRSAA;VVRHNEHGDRRSAAT;VRHNEHGDRRSAATF;RHNEHGDRRSAATFR;HNEHGDRRSAATFRL;NEHGDRRSAATFRLE;EHGDRRSAATFRLEC;HGDRRSAATFRLECP;GDRRSAATFRLECPY;DRRSAATFRLECPYT;RRSAATFRLECPYTV;RSAATFRLECPYTVC;SAATFRLECPYTVCQ;AATFRLECPYTVCQF;ATFRLECPYTVCQFL;TFRLECPYTVCQFLS;FRLECPYTVCQFLSQ;RLECPYTVCQFLSQL;LECPYTVCQFLSQLA;ECPYTVCQFLSQLAC;CPYTVCQFLSQLACD;PYTVCQFLSQLACDL;YTVCQFLSQLACDLQ;TVCQFLSQLACDLQE;VCQFLSQLACDLQEA;CQFLSQLACDLQEAV;QFLSQLACDLQEAVQ;FLSQLACDLQEAVQH;LSQLACDLQEAVQHD;SQLACDLQEAVQHDD;QLACDLQEAVQHDDP;LACDLQEAVQHDDPW;ACDLQEAVQHDDPWT;CDLQEAVQHDDPWTL;DLQEAVQHDDPWTLV;LQEAVQHDDPWTLVF;QEAVQHDDPWTLVFH;EAVQHDDPWTLVFHG;AVQHDDPWTLVFHGY;VQHDDPWTLVFHGYD;QHDDPWTLVFHGYDP;HDDPWTLVFHGYDPG;DDPWTLVFHGYDPGQ;DPWTLVFHGYDPGQE;PWTLVFHGYDPGQER;WTLVFHGYDPGQERL;TLVFHGYDPGQERLR;LVFHGYDPGQERLRE;VFHGYDPGQERLREA;FHGYDPGQERLREAL;HGYDPGQERLREALC;GYDPGQERLREALCA;YDPGQERLREALCAV;DPGQERLREALCAVG;PGQERLREALCAVGN;GQERLREALCAVGNG;QERLREALCAVGNGY;ERLREALCAVGNGYL;RLREALCAVGNGYLG;LREALCAVGNGYLGS;REALCAVGNGYLGSR;EALCAVGNGYLGSRG;ALCAVGNGYLGSRGC;LCAVGNGYLGSRGCA;CAVGNGYLGSRGCAP;AVGNGYLGSRGCAPE;VGNGYLGSRGCAPES;GNGYLGSRGCAPESA;NGYLGSRGCAPESAE;GYLGSRGCAPESAES;YLGSRGCAPESAESE;LGSRGCAPESAESEA;GSRGCAPESAESEAH;SRGCAPESAESEAHY;RGCAPESAESEAHYP;GCAPESAESEAHYPG;CAPESAESEAHYPGT;APESAESEAHYPGTY;PESAESEAHYPGTYV;ESAESEAHYPGTYVA;SAESEAHYPGTYVAG;AESEAHYPGTYVAGV;ESEAHYPGTYVAGVY;SEAHYPGTYVAGVYN;EAHYPGTYVAGVYNQ;AHYPGTYVAGVYNQL;HYPGTYVAGVYNQLT;YPGTYVAGVYNQLTD;PGTYVAGVYNQLTDH;GTYVAGVYNQLTDHI;TYVAGVYNQLTDHIE;YVAGVYNQLTDHIEG;VAGVYNQLTDHIEGC;AGVYNQLTDHIEGCT;GVYNQLTDHIEGCTV;VYNQLTDHIEGCTVD;YNQLTDHIEGCTVDN;NQLTDHIEGCTVDNE;QLTDHIEGCTVDNES;LTDHIEGCTVDNESL;TDHIEGCTVDNESLV;DHIEGCTVDNESLVN;HIEGCTVDNESLVNL;IEGCTVDNESLVNLP;EGCTVDNESLVNLPN;GCTVDNESLVNLPNW;CTVDNESLVNLPNWL;TVDNESLVNLPNWLS;VDNESLVNLPNWLSL;DNESLVNLPNWLSLT;NESLVNLPNWLSLTF;ESLVNLPNWLSLTFR;SLVNLPNWLSLTFRI;LVNLPNWLSLTFRID;VNLPNWLSLTFRIDG;NLPNWLSLTFRIDGG;LPNWLSLTFRIDGGA;PNWLSLTFRIDGGAW;NWLSLTFRIDGGAWF;WLSLTFRIDGGAWFN;LSLTFRIDGGAWFNV;SLTFRIDGGAWFNVD;LTFRIDGGAWFNVDT;TFRIDGGAWFNVDTV;FRIDGGAWFNVDTVE;RIDGGAWFNVDTVEL;IDGGAWFNVDTVELL;DGGAWFNVDTVELLS;GGAWFNVDTVELLSY;GAWFNVDTVELLSYR;AWFNVDTVELLSYRQ;WFNVDTVELLSYRQT;FNVDTVELLSYRQTF;NVDTVELLSYRQTFD;VDTVELLSYRQTFDL;DTVELLSYRQTFDLR;TVELLSYRQT | |

Fig. 30 continued

| | | |
|---|---|---|
| | FDLRR;VELLSYRQTFDLRRA;ELLSYRQTFDLRRAT;LLSYRQTFDLRRATL;LSYRQTFDLRRATLT;SYRQTFDLRRATLTR;YRQTFDLRRATLTRS;RQTFDLRRATLTRSL;QTFDLRRATLTRSLR;TFDLRRATLTRSLRF;FDLRRATLTRSLRFR;DLRRATLTRSLRFRD;LRRATLTRSLRFRDA;RRATLTRSLRFRDAG;RATLTRSLRFRDAGG;ATLTRSLRFRDAGGR;TLTRSLRFRDAGGRV;LTRSLRFRDAGGRVT;TRSLRFRDAGGRVTT;RSLRFRDAGGRVTTM;SLRFRDAGGRVTTMT;LRFRDAGGRVTTMTQ;RFRDAGGRVTTMTQE;FRDAGGRVTTMTQER;RDAGGRVTTMTQERF;DAGGRVTTMTQERFA;AGGRVTTMTQERFAS;GGRVTTMTQERFASM;GRVTTMTQERFASMN;RVTTMTQERFASMNR;VTTMTQERFASMNRP;TTMTQERFASMNRPN;TMTQERFASMNRPNL;MTQERFASMNRPNLV;TQERFASMNRPNLVA;QERFASMNRPNLVAL;ERFASMNRPNLVALQ;RFASMNRPNLVALQT;FASMNRPNLVALQTR;ASMNRPNLVALQTRI;SMNRPNLVALQTRIE;MNRPNLVALQTRIES;NRPNLVALQTRIESE;RPNLVALQTRIESEN;PNLVALQTRIESENW;NLVALQTRIESENWS;LVALQTRIESENWSG;VALQTRIESENWSGT;ALQTRIESENWSGTV;LQTRIESENWSGTVD;QTRIESENWSGTVDF;TRIESENWSGTVDFR;RIESENWSGTVDFRS;IESENWSGTVDFRSL;ESENWSGTVDFRSLV;SENWSGTVDFRSLVD;ENWSGTVDFRSLVDG;NWSGTVDFRSLVDGG;WSGTVDFRSLVDGGV;SGTVDFRSLVDGGVH;GTVDFRSLVDGGVHN;TVDFRSLVDGGVHNT;VDFRSLVDGGVHNTL;DFRSLVDGGVHNTLV;FRSLVDGGVHNTLVD;RSLVDGGVHNTLVDR;SLVDGGVHNTLVDRY;LVDGGVHNTLVDRYR;VDGGVHNTLVDRYRQ;DGGVHNTLVDRYRQL;GGVHNTLVDRYRQLS;GVHNTLVDRYRQLSS;VHNTLVDRYRQLSSQ;HNTLVDRYRQLSSQH;NTLVDRYRQLSSQHL;TLVDRYRQLSSQHLT;LVDRYRQLSSQHLTT;VDRYRQLSSQHLTTA;DRYRQLSSQHLTTAE;RYRQLSSQHLTTAEI;YRQLSSQHLTTAEIE;RQLSSQHLTTAEIEV;QLSSQHLTTAEIEVL;LSSQHLTTAEIEVLA;SSQHLTTAEIEVLAD;SQHLTTAEIEVLADS;QHLTTAEIEVLADSV;HLTTAEIEVLADSVL;LTTAEIEVLADSVLL;TTAEIEVLADSVLLR;TAEIEVLADSVLLRT;AEIEVLADSVLLRTQ;EIEVLADSVLLRTQT;IEVLADSVLLRTQTS;EVLADSVLLRTQTSQ;VLADSVLLRTQTSQS;LADSVLLRTQTSQSG;ADSVLLRTQTSQSGI;DSVLLRTQTSQSGIA;SVLLRTQTSQSGIAI;VLLRTQTSQSGIAIA;LLRTQTSQSGIAIAV;LRTQTSQSGIAIAVA;RTQTSQSGIAIAVAA;TQTSQSGIAIAVAAR;QTSQSGIAIAVAARS;TSQSGIAIAVAARST;SQSGIAIAVAARSTL;QSGIAIAVAARSTLW;SGIAIAVAARSTLWR;GIAIAVAARSTLWRD;IAIAVAARSTLWRDG;AIAVAARSTLWRDGQ;IAVAARSTLWRDGQR;AVAARSTLWRDGQRV;VAARSTLWRDGQRVD;AARSTLWRDGQRVDA;ARSTLWRDGQRVDAQ;RSTLWRDGQRVDAQY;STLWRDGQRVDAQYR;TLWRDGQRVDAQYRV;LWRDGQRVDAQYRVA;WRDGQRVDAQYRVAR;RDGQRVDAQYRVARD;DGQRVDAQYRVARDT;GQRVDAQYRVARDTN;QRVDAQYRVARDTNR;RVDAQYRVARDTNRG;VDAQYRVARDTNRGG;DAQYRVARDTNRGGH;AQYRVARDTNRGGHD;QYRVARDTNRGGHDI;YRVARDTNRGGHDIQ;RVARDTNRGGHDIQV;VARDTNRGGHDIQVT;ARDTNRGGHDIQVTL;RDTNRGGHDIQVTLS;DTNRGGHDIQVTLSA;TNRGGHDIQVTLSAG;NRGGHDIQVTLSAGQ;RGGHDIQVTLSAGQS;GGHDIQVTLSAGQSV;GHDIQVTLSAGQSVT;HDIQVTLSAGQSVTL;DIQVTLSAGQSVTLE;IQVTLSAGQSVTLEK;QVTLSAGQSVTLEKV;VTLSAGQSVTLEKVA;TLSAGQSVTLEKVAT;LSAGQSVTLEKVATI;SAGQSVTLEKVATIF;AGQSVTLEKVATIFT;GQSVTLEKVATIFTS;QSVTLEKVATIFTSR;SVTLEKVATIFTSRD;VTLEKVATIFTSRDA;TLEKVATIFTSRDAA;LEKVATIFTSRDAAT;EKVATIFTSRDAATL;KVATIFTSRDAATLT;VATIFTSRDAATLTA;ATIFTSRDAATLTAA;TIFTSRDAATLTAAI;IFTSRDAATLTAAIS;FTSRDAATLTAAISA;TSRDAATLTAAISAQ;SRDAATLTAAISAQR;RDAATLTAAISAQRC;DAATLTAAISAQRCL;AATLTAAISAQRCLG;ATLTAAISAQRCLGE;TLTAAISAQRCLGEA;LTAAISAQRCLGEAG;TAAISAQRCLGEAGR;AAISAQRCLGEAGRY;AI | |

Fig. 30 continued

| | | |
|---|---|---|
| | SAQRCLGEAGRYA;ISAQRCLGEAGRYAE;SAQRCLGEAGRYAEL;AQRCLGEAGRYAELC;QRCLGEAGRYAELCQ;RCLGEAGRYAELCQQ;CLGEAGRYAELCQQH;LGEAGRYAELCQQHV;GEAGRYAELCQQHVR;EAGRYAELCQQHVRA;AGRYAELCQQHVRAW;GRYAELCQQHVRAWA;RYAELCQQHVRAWAR;YAELCQQHVRAWARL;AELCQQHVRAWARLW;ELCQQHVRAWARLWE;LCQQHVRAWARLWER;CQQHVRAWARLWERC;QQHVRAWARLWERCA;QHVRAWARLWERCAI;HVRAWARLWERCAID;VRAWARLWERCAIDL;RAWARLWERCAIDLT;AWARLWERCAIDLTG;WARLWERCAIDLTGN;ARLWERCAIDLTGNT;RLWERCAIDLTGNTE;LWERCAIDLTGNTEE;WERCAIDLTGNTEEL;ERCAIDLTGNTEELR;RCAIDLTGNTEELRL;CAIDLTGNTEELRLV;AIDLTGNTEELRLVR;IDLTGNTEELRLVRL;DLTGNTEELRLVRLH;LTGNTEELRLVRLHL;TGNTEELRLVRLHLL;GNTEELRLVRLHLLH;NTEELRLVRLHLLHL;TEELRLVRLHLLHLL;EELRLVRLHLLHLLQ;ELRLVRLHLLHLLQT;LRLVRLHLLHLLQTI;RLVRLHLLHLLQTIS;LVRLHLLHLLQTISP;VRLHLLHLLQTISPH;RLHLLHLLQTISPHT;LHLLHLLQTISPHTA;HLLHLLQTISPHTAE;LLHLLQTISPHTAEL;LHLLQTISPHTAELD;HLLQTISPHTAELDA;LLQTISPHTAELDAG;LQTISPHTAELDAGV;QTISPHTAELDAGVP;TISPHTAELDAGVPA;ISPHTAELDAGVPAR;SPHTAELDAGVPARG;PHTAELDAGVPARGL;HTAELDAGVPARGLN;TAELDAGVPARGLNG;AELDAGVPARGLNGE;ELDAGVPARGLNGEA;LDAGVPARGLNGEAY;DAGVPARGLNGEAYR;AGVPARGLNGEAYRG;GVPARGLNGEAYRGH;VPARGLNGEAYRGHV;PARGLNGEAYRGHVF;ARGLNGEAYRGHVFW;RGLNGEAYRGHVFWD;GLNGEAYRGHVFWDA;LNGEAYRGHVFWDAL;NGEAYRGHVFWDALF;GEAYRGHVFWDALFV;EAYRGHVFWDALFVA;AYRGHVFWDALFVAP;YRGHVFWDALFVAPV;RGHVFWDALFVAPVL;GHVFWDALFVAPVLS;HVFWDALFVAPVLSL;VFWDALFVAPVLSLR;FWDALFVAPVLSLRM;WDALFVAPVLSLRMP;DALFVAPVLSLRMPK;ALFVAPVLSLRMPKV;LFVAPVLSLRMPKVA;FVAPVLSLRMPKVAR;VAPVLSLRMPKVARS;APVLSLRMPKVARSL;PVLSLRMPKVARSLL;VLSLRMPKVARSLLD;LSLRMPKVARSLLDY;SLRMPKVARSLLDYR;LRMPKVARSLLDYRY;RMPKVARSLLDYRYR;MPKVARSLLDYRYRR;PKVARSLLDYRYRRL;KVARSLLDYRYRRLP;VARSLLDYRYRRLPA;ARSLLDYRYRRLPAA;RSLLDYRYRRLPAAR;SLLDYRYRRLPAARR;LLDYRYRRLPAARRA;LDYRYRRLPAARRAA;DYRYRRLPAARRAAH;YRYRRLPAARRAAHR;RYRRLPAARRAAHRA;YRRLPAARRAAHRAG;RRLPAARRAAHRAGH;RLPAARRAAHRAGHL;LPAARRAAHRAGHLG;PAARRAAHRAGHLGA;AARRAAHRAGHLGAM;ARRAAHRAGHLGAMY;RRAAHRAGHLGAMYP;RAAHRAGHLGAMYPW;AAHRAGHLGAMYPWQ;AHRAGHLGAMYPWQS;HRAGHLGAMYPWQSG;RAGHLGAMYPWQSGS;AGHLGAMYPWQSGSD;GHLGAMYPWQSGSDG;HLGAMYPWQSGSDGS;LGAMYPWQSGSDGSE;GAMYPWQSGSDGSEV;AMYPWQSGSDGSEVS;MYPWQSGSDGSEVSQ;YPWQSGSDGSEVSQQ;PWQSGSDGSEVSQQL;WQSGSDGSEVSQQLH;QSGSDGSEVSQQLHL;SGSDGSEVSQQLHLN;GSDGSEVSQQLHLNP;SDGSEVSQQLHLNPR;DGSEVSQQLHLNPRS;GSEVSQQLHLNPRSG;SEVSQQLHLNPRSGR;EVSQQLHLNPRSGRW;VSQQLHLNPRSGRWT;SQQLHLNPRSGRWTP;QQLHLNPRSGRWTPD;QLHLNPRSGRWTPDP;LHLNPRSGRWTPDPS;HLNPRSGRWTPDPSD;LNPRSGRWTPDPSDR;NPRSGRWTPDPSDRA;PRSGRWTPDPSDRAH;RSGRWTPDPSDRAHH;SGRWTPDPSDRAHHV;GRWTPDPSDRAHHVG;RWTPDPSDRAHHVGL;WTPDPSDRAHHVGLA;TPDPSDRAHHVGLAV;PDPSDRAHHVGLAVA;DPSDRAHHVGLAVAY;PSDRAHHVGLAVAYN;SDRAHHVGLAVAYNA;DRAHHVGLAVAYNAW;RAHHVGLAVAYNAWH;AHHVGLAVAYNAWHY;HHVGLAVAYNAWHYY;HVGLAVAYNAWHYYQ;VGLAVAYNAWHYYQV;GLAVAYNAWHYYQVT;LAVAYNAWHYYQVTG;AVAYNAWHYYQVTGD;VAYNAWHYYQVTGDR;AYNAWHYYQVTGDRQ;YNAWHYYQV | |

Fig. 30 continued

| | | |
|---|---|---|
| | TGDRQY;NAWHYYQVTGDRQYL;AWHYYQVTGDRQYLV;WHYYQVTGDRQYLVD;HYYQVTGDRQYLVDC;YYQVTGDRQYLVDCG;YQVTGDRQYLVDCGA;QVTGDRQYLVDCGAE;VTGDRQYLVDCGAEL;TGDRQYLVDCGAELL;GDRQYLVDCGAELLV;DRQYLVDCGAELLVE;RQYLVDCGAELLVEI;QYLVDCGAELLVEIA;YLVDCGAELLVEIAR;LVDCGAELLVEIARF;VDCGAELLVEIARFW;DCGAELLVEIARFWV;CGAELLVEIARFWVG;GAELLVEIARFWVGL;AELLVEIARFWVGLA;ELLVEIARFWVGLAK;LLVEIARFWVGLAKL;LVEIARFWVGLAKLD;VEIARFWVGLAKLDD;EIARFWVGLAKLDDS;IARFWVGLAKLDDSR;ARFWVGLAKLDDSRG;RFWVGLAKLDDSRGR;FWVGLAKLDDSRGRY;WVGLAKLDDSRGRYL;VGLAKLDDSRGRYLI;GLAKLDDSRGRYLIR;LAKLDDSRGRYLIRG;AKLDDSRGRYLIRGV;KLDDSRGRYLIRGVI;LDDSRGRYLIRGVIG;DDSRGRYLIRGVIGP;DSRGRYLIRGVIGPD;SRGRYLIRGVIGPDE;RGRYLIRGVIGPDEF;GRYLIRGVIGPDEFH;RYLIRGVIGPDEFHS;YLIRGVIGPDEFHSG;LIRGVIGPDEFHSGY;IRGVIGPDEFHSGYP;RGVIGPDEFHSGYPG;GVIGPDEFHSGYPGN;VIGPDEFHSGYPGNE;IGPDEFHSGYPGNEY;GPDEFHSGYPGNEYD;PDEFHSGYPGNEYDG;DEFHSGYPGNEYDGI;EFHSGYPGNEYDGID;FHSGYPGNEYDGIDN;HSGYPGNEYDGIDNN;SGYPGNEYDGIDNNA;GYPGNEYDGIDNNAY;YPGNEYDGIDNNAYT;PGNEYDGIDNNAYTN;GNEYDGIDNNAYTNV;NEYDGIDNNAYTNVM;EYDGIDNNAYTNVMA;YDGIDNNAYTNVMAV;DGIDNNAYTNVMAVW;GIDNNAYTNVMAVWV;IDNNAYTNVMAVWVI;DNNAYTNVMAVWVIL;NNAYTNVMAVWVILR;NAYTNVMAVWVILRA;AYTNVMAVWVILRAM;YTNVMAVWVILRAME;TNVMAVWVILRAMEA;NVMAVWVILRAMEAL;VMAVWVILRAMEALD;MAVWVILRAMEALDL;AVWVILRAMEALDLL;VWVILRAMEALDLLP;WVILRAMEALDLLPL;VILRAMEALDLLPLT;ILRAMEALDLLPLTD;LRAMEALDLLPLTDR;RAMEALDLLPLTDRR;AMEALDLLPLTDRRH;MEALDLLPLTDRRHL;EALDLLPLTDRRHLI;ALDLLPLTDRRHLIE;LDLLPLTDRRHLIEK;DLLPLTDRRHLIEKL;LLPLTDRRHLIEKLG;LPLTDRRHLIEKLGL;PLTDRRHLIEKLGLT;LTDRRHLIEKLGLTT;TDRRHLIEKLGLTTQ;DRRHLIEKLGLTTQE;RRHLIEKLGLTTQER;RHLIEKLGLTTQERD;HLIEKLGLTTQERDQ;LIEKLGLTTQERDQW;IEKLGLTTQERDQWD;EKLGLTTQERDQWDD;KLGLTTQERDQWDDV;LGLTTQERDQWDDVS;GLTTQERDQWDDVSR;LTTQERDQWDDVSRR;TTQERDQWDDVSRRM;TQERDQWDDVSRRMF;QERDQWDDVSRRMFV;ERDQWDDVSRRMFVP;RDQWDDVSRRMFVPF;DQWDDVSRRMFVPFH;QWDDVSRRMFVPFHD;WDDVSRRMFVPFHDG;DDVSRRMFVPFHDGV;DVSRRMFVPFHDGVI;VSRRMFVPFHDGVIS;SRRMFVPFHDGVISQ;RRMFVPFHDGVISQF;RMFVPFHDGVISQFE;MFVPFHDGVISQFEG;FVPFHDGVISQFEGY;VPFHDGVISQFEGYS;PFHDGVISQFEGYSE;FHDGVISQFEGYSEL;HDGVISQFEGYSELA;DGVISQFEGYSELAE;GVISQFEGYSELAEL;VISQFEGYSELAELD;ISQFEGYSELAELDW;SQFEGYSELAELDWD;QFEGYSELAELDWDH;FEGYSELAELDWDHY;EGYSELAELDWDHYR;GYSELAELDWDHYRH;YSELAELDWDHYRHR;SELAELDWDHYRHRY;ELAELDWDHYRHRYG;LAELDWDHYRHRYGN;AELDWDHYRHRYGNI;ELDWDHYRHRYGNIQ;LDWDHYRHRYGNIQR;DWDHYRHRYGNIQRL;WDHYRHRYGNIQRLD;DHYRHRYGNIQRLDR;HYRHRYGNIQRLDRI;YRHRYGNIQRLDRIL;RHRYGNIQRLDRILE;HRYGNIQRLDRILEA;RYGNIQRLDRILEAE;YGNIQRLDRILEAEG;GNIQRLDRILEAEGD;NIQRLDRILEAEGDS;IQRLDRILEAEGDSV;QRLDRILEAEGDSVN;RLDRILEAEGDSVNN;LDRILEAEGDSVNNY;DRILEAEGDSVNNYQ;RILEAEGDSVNNYQA;ILEAEGDSVNNYQAS;LEAEGDSVNNYQASK;EAEGDSVNNYQASKQ;AEGDSVNNYQASKQA;EGDSVNNYQASKQAD;GDSVNNYQASKQADA;DSVNNYQASKQADAL;SVNNYQASKQADALM;VNNYQASKQADALML;NNYQASKQADALMLL;NYQASKQADALMLLY;YQASKQADALMLLYL;QASKQADALMLLYLL;ASKQADALMLLYLLS;SKQADALMLLYLLSS;KQADALMLLYLLSSD | |

Fig. 30 continued

| | | |
|---|---|---|
| | ;QADALMLLYLLSSDE;ADALMLLYLLSSDEL;DALMLLYLLSSDELI;ALMLLYLLSSDELIG;LMLLYLLSSDELIGL;MLLYLLSSDELIGLL;LLYLLSSDELIGLLA;LYLLSSDELIGLLAR;YLLSSDELIGLLARL;LLSSDELIGLLARLG;LSSDELIGLLARLGY;SSDELIGLLARLGYR;SDELIGLLARLGYRF;DELIGLLARLGYRFA;ELIGLLARLGYRFAP;LIGLLARLGYRFAPT;IGLLARLGYRFAPTQ;GLLARLGYRFAPTQI;LLARLGYRFAPTQIP;LARLGYRFAPTQIPG;ARLGYRFAPTQIPGT;RLGYRFAPTQIPGTV;LGYRFAPTQIPGTVD;GYRFAPTQIPGTVDY;YRFAPTQIPGTVDYY;RFAPTQIPGTVDYYL;FAPTQIPGTVDYYLA;APTQIPGTVDYYLAR;PTQIPGTVDYYLART;TQIPGTVDYYLARTS;QIPGTVDYYLARTSD;IPGTVDYYLARTSDG;PGTVDYYLARTSDGS;GTVDYYLARTSDGST;TVDYYLARTSDGSTL;VDYYLARTSDGSTLS;DYYLARTSDGSTLSA;YYLARTSDGSTLSAV;YLARTSDGSTLSAVV;LARTSDGSTLSAVVH;ARTSDGSTLSAVVHA;RTSDGSTLSAVVHAW;TSDGSTLSAVVHAWV;SDGSTLSAVVHAWVL;DGSTLSAVVHAWVLA;GSTLSAVVHAWVLAR;STLSAVVHAWVLARA;TLSAVVHAWVLARAN;LSAVVHAWVLARANR;SAVVHAWVLARANRS;AVVHAWVLARANRSN;VVHAWVLARANRSNA;VHAWVLARANRSNAM;HAWVLARANRSNAME;AWVLARANRSNAMEY;WVLARANRSNAMEYF;VLARANRSNAMEYFR;LARANRSNAMEYFRQ;ARANRSNAMEYFRQV;RANRSNAMEYFRQVL;ANRSNAMEYFRQVLR;NRSNAMEYFRQVLRS;RSNAMEYFRQVLRSD;SNAMEYFRQVLRSDI;NAMEYFRQVLRSDIA;AMEYFRQVLRSDIAD;MEYFRQVLRSDIADV;EYFRQVLRSDIADVQ;YFRQVLRSDIADVQG;FRQVLRSDIADVQGG;RQVLRSDIADVQGGT;QVLRSDIADVQGGTT;VLRSDIADVQGGTTQ;LRSDIADVQGGTTQE;RSDIADVQGGTTQEG;SDIADVQGGTTQEGI;DIADVQGGTTQEGIH;IADVQGGTTQEGIHL;ADVQGGTTQEGIHLA;DVQGGTTQEGIHLAA;VQGGTTQEGIHLAAM;QGGTTQEGIHLAAMA;GGTTQEGIHLAAMAG;GTTQEGIHLAAMAGS;TTQEGIHLAAMAGSI;TQEGIHLAAMAGSID;QEGIHLAAMAGSIDL;EGIHLAAMAGSIDLL;GIHLAAMAGSIDLLQ;IHLAAMAGSIDLLQR;HLAAMAGSIDLLQRC;LAAMAGSIDLLQRCY;AAMAGSIDLLQRCYS;AMAGSIDLLQRCYSG;MAGSIDLLQRCYSGL;AGSIDLLQRCYSGLE;GSIDLLQRCYSGLEL;SIDLLQRCYSGLELR;IDLLQRCYSGLELRD;DLLQRCYSGLELRDD;LLQRCYSGLELRDDR;LQRCYSGLELRDDRL;QRCYSGLELRDDRLV;RCYSGLELRDDRLVL;CYSGLELRDDRLVLS;YSGLELRDDRLVLSP;SGLELRDDRLVLSPQ;GLELRDDRLVLSPQW;LELRDDRLVLSPQWP;ELRDDRLVLSPQWPE;LRDDRLVLSPQWPEA;RDDRLVLSPQWPEAL;DDRLVLSPQWPEALG;DRLVLSPQWPEALGP;RLVLSPQWPEALGPL;LVLSPQWPEALGPLE;VLSPQWPEALGPLEF;LSPQWPEALGPLEFP;SPQWPEALGPLEFPF;PQWPEALGPLEFPFV;QWPEALGPLEFPFVY;WPEALGPLEFPFVYR;PEALGPLEFPFVYRR;EALGPLEFPFVYRRH;ALGPLEFPFVYRRHQ;LGPLEFPFVYRRHQL;GPLEFPFVYRRHQLS;PLEFPFVYRRHQLSL;LEFPFVYRRHQLSLR;EFPFVYRRHQLSLRI;FPFVYRRHQLSLRIS;PFVYRRHQLSLRISG;FVYRRHQLSLRISGR;VYRRHQLSLRISGRS;YRRHQLSLRISGRSA;RRHQLSLRISGRSAT;RHQLSLRISGRSATL;HQLSLRISGRSATLT;QLSLRISGRSATLTA;LSLRISGRSATLTAE;SLRISGRSATLTAES;LRISGRSATLTAESG;RISGRSATLTAESGD;ISGRSATLTAESGDA;SGRSATLTAESGDAE;GRSATLTAESGDAEP;RSATLTAESGDAEPI;SATLTAESGDAEPIE;ATLTAESGDAEPIEV;TLTAESGDAEPIEVE;LTAESGDAEPIEVEC;TAESGDAEPIEVECR;AESGDAEPIEVECRG;ESGDAEPIEVECRGH;SGDAEPIEVECRGHV;GDAEPIEVECRGHVQ;DAEPIEVECRGHVQR;AEPIEVECRGHVQRL;EPIEVECRGHVQRLR;PIEVECRGHVQRLRC;IEVECRGHVQRLRCG;EVECRGHVQRLRCGH;VECRGHVQRLRCGHT;ECRGHVQRLRCGHTI;CRGHVQRLRCGHTIE;RGHVQRLRCGHTIEV;GHVQRLRCGHTIEVG;HVQRLRCGHTIEVGC;VQRLRCGHTIEVGCS;QRLRCGHTIEVGCSR; | |

Fig. 30 continued

| | | |
|---|---|---|
| | 16 mers:<br>MRCGIVVNVTGPPPTI;RCGIVVNVTGPPPTID;CGIVVNVTGPPPTIDR;GIVVNVTGPPPTIDRR;IVVNVTGPPPTIDRRY;VVNVTGPPPTIDRRYH;VNVTGPPPTIDRRYHD;NVTGPPPTIDRRYHDA;VTGPPPTIDRRYHDAV;TGPPPTIDRRYHDAVI;GPPPTIDRRYHDAVIV;PPPTIDRRYHDAVIVG;PPTIDRRYHDAVIVGL;PTIDRRYHDAVIVGLD;TIDRRYHDAVIVGLDN;IDRRYHDAVIVGLDNV;DRRYHDAVIVGLDNVV;RRYHDAVIVGLDNVVD;RYHDAVIVGLDNVVDK;YHDAVIVGLDNVVDKA;HDAVIVGLDNVVDKAT;DAVIVGLDNVVDKATR;AVIVGLDNVVDKATRV;VIVGLDNVVDKATRVH;IVGLDNVVDKATRVHA;VGLDNVVDKATRVHAA;GLDNVVDKATRVHAAA;LDNVVDKATRVHAAAW;DNVVDKATRVHAAAWT;NVVDKATRVHAAAWTK;VVDKATRVHAAAWTKF;VDKATRVHAAAWTKFL;DKATRVHAAAWTKFLD;KATRVHAAAWTKFLDD;ATRVHAAAWTKFLDDY;TRVHAAAWTKFLDDYL;RVHAAAWTKFLDDYLT;VHAAAWTKFLDDYLTR;HAAAWTKFLDDYLTRR;AAAWTKFLDDYLTRRP;AAWTKFLDDYLTRRPQ;AWTKFLDDYLTRRPQR;WTKFLDDYLTRRPQRT;TKFLDDYLTRRPQRTG;KFLDDYLTRRPQRTGE;FLDDYLTRRPQRTGED;LDDYLTRRPQRTGEDH;DDYLTRRPQRTGEDHC;DYLTRRPQRTGEDHCP;YLTRRPQRTGEDHCPL;LTRRPQRTGEDHCPLT;TRRPQRTGEDHCPLTH;RRPQRTGEDHCPLTHD;RPQRTGEDHCPLTHDD;PQRTGEDHCPLTHDDY;QRTGEDHCPLTHDDYR;RTGEDHCPLTHDDYRR;TGEDHCPLTHDDYRRF;GEDHCPLTHDDYRRFL;EDHCPLTHDDYRRFLA;DHCPLTHDDYRRFLAG;HCPLTHDDYRRFLAGK;CPLTHDDYRRFLAGKP;PLTHDDYRRFLAGKPD;LTHDDYRRFLAGKPDG;THDDYRRFLAGKPDGV;HDDYRRFLAGKPDGVA;DDYRRFLAGKPDGVAD;DYRRFLAGKPDGVADF;YRRFLAGKPDGVADFL;RRFLAGKPDGVADFLA;RFLAGKPDGVADFLAA;FLAGKPDGVADFLAAR;LAGKPDGVADFLAARG;AGKPDGVADFLAARGI;GKPDGVADFLAARGIR;KPDGVADFLAARGIRL;PDGVADFLAARGIRLP;DGVADFLAARGIRLPP;GVADFLAARGIRLPPG;VADFLAARGIRLPPGS;ADFLAARGIRLPPGSP;DFLAARGIRLPPGSPT;FLAARGIRLPPGSPTD;LAARGIRLPPGSPTDL;AARGIRLPPGSPTDLT;ARGIRLPPGSPTDLTD;RGIRLPPGSPTDLTDD;GIRLPPGSPTDLTDDT;IRLPPGSPTDLTDDTV;RLPPGSPTDLTDDTVY;LPPGSPTDLTDDTVYG;PPGSPTDLTDDTVYGL;PGSPTDLTDDTVYGLQ;GSPTDLTDDTVYGLQN;SPTDLTDDTVYGLQNL;PTDLTDDTVYGLQNLE;TDLTDDTVYGLQNLER;DLTDDTVYGLQNLERQ;LTDDTVYGLQNLERQT;TDDTVYGLQNLERQTF;DDTVYGLQNLERQTFL;DTVYGLQNLERQTFLQ;TVYGLQNLERQTFLQL;VYGLQNLERQTFLQLL;YGLQNLERQTFLQLLN;GLQNLERQTFLQLLNT;LQNLERQTFLQLLNTG;QNLERQTFLQLLNTGV;NLERQTFLQLLNTGVP;LERQTFLQLLNTGVPE;ERQTFLQLLNTGVPEG;RQTFLQLLNTGVPEGK;QTFLQLLNTGVPEGKS;TFLQLLNTGVPEGKSI;FLQLLNTGVPEGKSIA;LQLLNTGVPEGKSIAS;QLLNTGVPEGKSIASF;LLNTGVPEGKSIASFA;LNTGVPEGKSIASFAR;NTGVPEGKSIASFARR;TGVPEGKSIASFARRL;GVPEGKSIASFARRLQ;VPEGKSIASFARRLQV;PEGKSIASFARRLQVA;EGKSIASFARRLQVAG;GKSIASFARRLQVAGV;KSIASFARRLQVAGVR;SIASFARRLQVAGVRV;IASFARRLQVAGVRVA;ASFARRLQVAGVRVAA;SFARRLQVAGVRVAAH;FARRLQVAGVRVAAHT;ARRLQVAGVRVAAHTS;RRLQVAGVRVAAHTSH;RLQVAGVRVAAHTSHR;LQVAGVRVAAHTSHRN;QVAGVRVAAHTSHRNY;VAGVRVAAHTSHRNYG;AGVRVAAHTSHRNYGH;GVRVAAHTSHRNYGHT;VRVAAHTSHRNYGHTL;RVAAHTSHRNYGHTLD;VAAHTSHRNYGHTLDA;AAHTSHRNYGHTLDAT;AHTSHRNYGHTLDATG;HTSHRNYGHTLDATGL;TSHRNYGHTLDATGLA;SHRNYGHTLDATGLAE;HRNYGHTLDATGLAEV;RNYGHTLDATGLAEVF;NYGHTLDATGLAEVFA;YGHTLDATGLAEVFAV;GHTLDATGLAEVFAVF;HTLDATGLAEVFAVFV;TLDATGLAEVFAVFVD;LDATGLAEVFAVFVDG;DATGLAEVFAVFVDGA;ATGLAEVFAVFVDGAV;TGLAEVFAVFVDGA | |

Fig. 30 continued

| | | |
|---|---|---|
| | VT;GLAEVFAVFVDGAVTA;LAEVFAVFVDGAVTAE;AEVFAVFVDGAVTAEL;EVFAVFVDGAVTAELG;VFAVFVDGAVTAELGL;FAVFVDGAVTAELGLP;AVFVDGAVTAELGLPA;VFVDGAVTAELGLPAE;FVDGAVTAELGLPAEP;VDGAVTAELGLPAEPN;DGAVTAELGLPAEPNP;GAVTAELGLPAEPNPA;AVTAELGLPAEPNPAG;VTAELGLPAEPNPAGL;TAELGLPAEPNPAGLI;AELGLPAEPNPAGLIE;ELGLPAEPNPAGLIET;LGLPAEPNPAGLIETA;GLPAEPNPAGLIETAK;LPAEPNPAGLIETAKR;PAEPNPAGLIETAKRL;AEPNPAGLIETAKRLG;EPNPAGLIETAKRLGA;PNPAGLIETAKRLGAN;NPAGLIETAKRLGANP;PAGLIETAKRLGANPG;AGLIETAKRLGANPGR;GLIETAKRLGANPGRC;LIETAKRLGANPGRCV;IETAKRLGANPGRCVV;ETAKRLGANPGRCVVI;TAKRLGANPGRCVVID;AKRLGANPGRCVVIDS;KRLGANPGRCVVIDSC;RLGANPGRCVVIDSCQ;LGANPGRCVVIDSCQT;GANPGRCVVIDSCQTG;ANPGRCVVIDSCQTGL;NPGRCVVIDSCQTGLR;PGRCVVIDSCQTGLRA;GRCVVIDSCQTGLRAG;RCVVIDSCQTGLRAGR;CVVIDSCQTGLRAGRN;VVIDSCQTGLRAGRNG;VIDSCQTGLRAGRNGG;IDSCQTGLRAGRNGGF;DSCQTGLRAGRNGGFA;SCQTGLRAGRNGGFAL;CQTGLRAGRNGGFALV;QTGLRAGRNGGFALVI;TGLRAGRNGGFALVIA;GLRAGRNGGFALVIAV;LRAGRNGGFALVIAVD;RAGRNGGFALVIAVDA;AGRNGGFALVIAVDAH;GRNGGFALVIAVDAHG;RNGGFALVIAVDAHGD;NGGFALVIAVDAHGDA;GGFALVIAVDAHGDAE;GFALVIAVDAHGDAEN;FALVIAVDAHGDAENL;ALVIAVDAHGDAENLL;LVIAVDAHGDAENLLS;VIAVDAHGDAENLLSS;IAVDAHGDAENLLSSG;AVDAHGDAENLLSSGA;VDAHGDAENLLSSGAD;DAHGDAENLLSSGADA;AHGDAENLLSSGADAV;HGDAENLLSSGADAVV;GDAENLLSSGADAVVA;DAENLLSSGADAVVAD;AENLLSSGADAVVADL;ENLLSSGADAVVADLA;NLLSSGADAVVADLAA;LLSSGADAVVADLAAV;LSSGADAVVADLAAVT;SSGADAVVADLAAVTV;SGADAVVADLAAVTVG;GADAVVADLAAVTVGS;ADAVVADLAAVTVGSG;DAVVADLAAVTVGSGD;AVVADLAAVTVGSGDA;VVADLAAVTVGSGDAA;VADLAAVTVGSGDAAI;ADLAAVTVGSGDAAIS;DLAAVTVGSGDAAIST;LAAVTVGSGDAAISTI;AAVTVGSGDAAISTIP;AVTVGSGDAAISTIPD;VTVGSGDAAISTIPDA;TVGSGDAAISTIPDAL;VGSGDAAISTIPDALQ;GSGDAAISTIPDALQV;SGDAAISTIPDALQVY;GDAAISTIPDALQVYS;DAAISTIPDALQVYSQ;AAISTIPDALQVYSQL;AISTIPDALQVYSQLK;ISTIPDALQVYSQLKR;STIPDALQVYSQLKRL;TIPDALQVYSQLKRLL;IPDALQVYSQLKRLLT;PDALQVYSQLKRLLTG;DALQVYSQLKRLLTGR;ALQVYSQLKRLLTGRR;LQVYSQLKRLLTGRRP;QVYSQLKRLLTGRRPA;VYSQLKRLLTGRRPAV;YSQLKRLLTGRRPAVF;SQLKRLLTGRRPAVFL;QLKRLLTGRRPAVFLD;LKRLLTGRRPAVFLDF;KRLLTGRRPAVFLDFD;RLLTGRRPAVFLDFDG;LLTGRRPAVFLDFDGT;LTGRRPAVFLDFDGTL;TGRRPAVFLDFDGTLS;GRRPAVFLDFDGTLSD;RRPAVFLDFDGTLSDI;RPAVFLDFDGTLSDIV;PAVFLDFDGTLSDIVE;AVFLDFDGTLSDIVER;VFLDFDGTLSDIVERP;FLDFDGTLSDIVERPE;LDFDGTLSDIVERPEA;DFDGTLSDIVERPEAA;FDGTLSDIVERPEAAT;DGTLSDIVERPEAATL;GTLSDIVERPEAATLV;TLSDIVERPEAATLVD;LSDIVERPEAATLVDG;SDIVERPEAATLVDGA;DIVERPEAATLVDGAA;IVERPEAATLVDGAAE;VERPEAATLVDGAAEA;ERPEAATLVDGAAEAL;RPEAATLVDGAAEALR;PEAATLVDGAAEALRA;EAATLVDGAAEALRAL;AATLVDGAAEALRALA;ATLVDGAAEALRALAA;TLVDGAAEALRALAAQ;LVDGAAEALRALAAQC;VDGAAEALRALAAQCP;DGAAEALRALAAQCPV;GAAEALRALAAQCPVA;AAEALRALAAQCPVAV;AEALRALAAQCPVAVI;EALRALAAQCPVAVIS;ALRALAAQCPVAVISG;LRALAAQCPVAVISGR;RALAAQCPVAVISGRD;ALAAQCPVAVISGRDL;LAAQCPVAVISGRDLA;AAQCPVAVISGRDLAD;AQCPVAVISGRDLADV;QCPVAVISGRDLADVR;CPVAVISGRDLADVRN;PVAVISGRDLADVRNR;VAVISGRDLADVRNRV;AVISGRDLADVRNRVK;VISGRDLADVRNRVKV;ISGRDLADVRNRVKVD;SGRDLADVRNRVK | |

Fig. 30 continued

| | | |
|---|---|---|
| | VDG;GRDLADVRNRVKVDGL;RDLADVRNRVKVDGLW;DLADVRNRVKVDGLWL;LADVRNRVKVDGLWLA;ADVRNRVKVDGLWLAG;DVRNRVKVDGLWLAGS;VRNRVKVDGLWLAGSH;RNRVKVDGLWLAGSHG;NRVKVDGLWLAGSHGF;RVKVDGLWLAGSHGFE;VKVDGLWLAGSHGFEL;KVDGLWLAGSHGFELV;VDGLWLAGSHGFELVA;DGLWLAGSHGFELVAP;GLWLAGSHGFELVAPD;LWLAGSHGFELVAPDG;WLAGSHGFELVAPDGS;LAGSHGFELVAPDGSH;AGSHGFELVAPDGSHH;GSHGFELVAPDGSHHQ;SHGFELVAPDGSHHQN;HGFELVAPDGSHHQNA;GFELVAPDGSHHQNAA;FELVAPDGSHHQNAAA;ELVAPDGSHHQNAAAT;LVAPDGSHHQNAAATA;VAPDGSHHQNAAATAA;APDGSHHQNAAATAAI;PDGSHHQNAAATAAID;DGSHHQNAAATAAIDG;GSHHQNAAATAAIDGL;SHHQNAAATAAIDGLA;HHQNAAATAAIDGLAE;HQNAAATAAIDGLAEA;QNAAATAAIDGLAEAA;NAAATAAIDGLAEAAA;AAATAAIDGLAEAAAQ;AATAAIDGLAEAAAQL;ATAAIDGLAEAAAQLA;TAAIDGLAEAAAQLAD;AAIDGLAEAAAQLADA;AIDGLAEAAAQLADAL;IDGLAEAAAQLADALR;DGLAEAAAQLADALRE;GLAEAAAQLADALREI;LAEAAAQLADALREIA;AEAAAQLADALREIAG;EAAAQLADALREIAGA;AAAQLADALREIAGAV;AAQLADALREIAGAVV;AQLADALREIAGAVVE;QLADALREIAGAVVEH;LADALREIAGAVVEHK;ADALREIAGAVVEHKR;DALREIAGAVVEHKRF;ALREIAGAVVEHKRFA;LREIAGAVVEHKRFAV;REIAGAVVEHKRFAVA;EIAGAVVEHKRFAVAV;IAGAVVEHKRFAVAVH;AGAVVEHKRFAVAVHY;GAVVEHKRFAVAVHYR;AVVEHKRFAVAVHYRN;VVEHKRFAVAVHYRNV;VEHKRFAVAVHYRNVA;EHKRFAVAVHYRNVAD;HKRFAVAVHYRNVADD;KRFAVAVHYRNVADDS;RFAVAVHYRNVADDSV;FAVAVHYRNVADDSVD;AVAVHYRNVADDSVDN;VAVHYRNVADDSVDNL;AVHYRNVADDSVDNLI;VHYRNVADDSVDNLIA;HYRNVADDSVDNLIAA;YRNVADDSVDNLIAAV;RNVADDSVDNLIAAVR;NVADDSVDNLIAAVRR;VADDSVDNLIAAVRRL;ADDSVDNLIAAVRRLG;DDSVDNLIAAVRRLGH;DSVDNLIAAVRRLGHA;SVDNLIAAVRRLGHAA;VDNLIAAVRRLGHAAG;DNLIAAVRRLGHAAGL;NLIAAVRRLGHAAGLR;LIAAVRRLGHAAGLRV;IAAVRRLGHAAGLRVT;AAVRRLGHAAGLRVTT;AVRRLGHAAGLRVTTG;VRRLGHAAGLRVTTGR;RRLGHAAGLRVTTGRK;RLGHAAGLRVTTGRKV;LGHAAGLRVTTGRKVV;GHAAGLRVTTGRKVVE;HAAGLRVTTGRKVVEL;AAGLRVTTGRKVVELR;AGLRVTTGRKVVELRP;GLRVTTGRKVVELRPD;LRVTTGRKVVELRPDI;RVTTGRKVVELRPDIA;VTTGRKVVELRPDIAW;TTGRKVVELRPDIAWD;TGRKVVELRPDIAWDK;GRKVVELRPDIAWDKG;RKVVELRPDIAWDKGK;KVVELRPDIAWDKGKA;VVELRPDIAWDKGKAL;VELRPDIAWDKGKALD;ELRPDIAWDKGKALDW;LRPDIAWDKGKALDWI;RPDIAWDKGKALDWIG;PDIAWDKGKALDWIGE;DIAWDKGKALDWIGER;IAWDKGKALDWIGERL;AWDKGKALDWIGERLG;WDKGKALDWIGERLGP;DKGKALDWIGERLGPA;KGKALDWIGERLGPAE;GKALDWIGERLGPAEV;KALDWIGERLGPAEVG;ALDWIGERLGPAEVGP;LDWIGERLGPAEVGPD;DWIGERLGPAEVGPDL;WIGERLGPAEVGPDLR;IGERLGPAEVGPDLRL;GERLGPAEVGPDLRLP;ERLGPAEVGPDLRLPI;RLGPAEVGPDLRLPIY;LGPAEVGPDLRLPIYI;GPAEVGPDLRLPIYIG;PAEVGPDLRLPIYIGD;AEVGPDLRLPIYIGDD;EVGPDLRLPIYIGDDL;VGPDLRLPIYIGDDLT;GPDLRLPIYIGDDLTD;PDLRLPIYIGDDLTDE;DLRLPIYIGDDLTDED;LRLPIYIGDDLTDEDA;RLPIYIGDDLTDEDAF;LPIYIGDDLTDEDAFD;PIYIGDDLTDEDAFDA;IYIGDDLTDEDAFDAV;YIGDDLTDEDAFDAVR;IGDDLTDEDAFDAVRF;GDDLTDEDAFDAVRFT;DDLTDEDAFDAVRFTG;DLTDEDAFDAVRFTGV;LTDEDAFDAVRFTGVG;TDEDAFDAVRFTGVGI;DEDAFDAVRFTGVGIV;EDAFDAVRFTGVGIVV;DAFDAVRFTGVGIVVR;AFDAVRFTGVGIVVRH;FDAVRFTGVGIVVRHN;DAVRFTGVGIVVRHNE;AVRFTGVGIVVRHNEH;VRFTGVGIVVRHNEHG;RFTGVGIVVRHNEHGD;FTGVGIVVRHNEHGDR;TGVGIVVRHNEHGDRR;GVGIVVRHNEHGDRRS;VGIVVRHNEHGDRRSA;GIVV | |

Fig. 30 continued

| | | |
|---|---|---|
| | RHNEHGDRRSAA;IVVRHNEHGDRRSAAT;VVRHNEHGDRRSAATF;VRHNEHGDRRSAATFR;RHNEHGDRRSAATFRL;HNEHGDRRSAATFRLE;NEHGDRRSAATFRLEC;EHGDRRSAATFRLECP;HGDRRSAATFRLECPY;GDRRSAATFRLECPYT;DRRSAATFRLECPYTV;RRSAATFRLECPYTVC;RSAATFRLECPYTVCQ;SAATFRLECPYTVCQF;AATFRLECPYTVCQFL;ATFRLECPYTVCQFLS;TFRLECPYTVCQFLSQ;FRLECPYTVCQFLSQL;RLECPYTVCQFLSQLA;LECPYTVCQFLSQLAC;ECPYTVCQFLSQLACD;CPYTVCQFLSQLACDL;PYTVCQFLSQLACDLQ;YTVCQFLSQLACDLQE;TVCQFLSQLACDLQEA;VCQFLSQLACDLQEAV;CQFLSQLACDLQEAVQ;QFLSQLACDLQEAVQH;FLSQLACDLQEAVQHD;LSQLACDLQEAVQHDD;SQLACDLQEAVQHDDP;QLACDLQEAVQHDDPW;LACDLQEAVQHDDPWT;ACDLQEAVQHDDPWTL;CDLQEAVQHDDPWTLV;DLQEAVQHDDPWTLVF;LQEAVQHDDPWTLVFH;QEAVQHDDPWTLVFHG;EAVQHDDPWTLVFHGY;AVQHDDPWTLVFHGYD;VQHDDPWTLVFHGYDP;QHDDPWTLVFHGYDPG;HDDPWTLVFHGYDPGQ;DDPWTLVFHGYDPGQE;DPWTLVFHGYDPGQER;PWTLVFHGYDPGQERL;WTLVFHGYDPGQERLR;TLVFHGYDPGQERLRE;LVFHGYDPGQERLREA;VFHGYDPGQERLREAL;FHGYDPGQERLREALC;HGYDPGQERLREALCA;GYDPGQERLREALCAV;YDPGQERLREALCAVG;DPGQERLREALCAVGN;PGQERLREALCAVGNG;GQERLREALCAVGNGY;QERLREALCAVGNGYL;ERLREALCAVGNGYLG;RLREALCAVGNGYLGS;LREALCAVGNGYLGSR;REALCAVGNGYLGSRG;EALCAVGNGYLGSRGC;ALCAVGNGYLGSRGCA;LCAVGNGYLGSRGCAP;CAVGNGYLGSRGCAPE;AVGNGYLGSRGCAPES;VGNGYLGSRGCAPESA;GNGYLGSRGCAPESAE;NGYLGSRGCAPESAES;GYLGSRGCAPESAESE;YLGSRGCAPESAESEA;LGSRGCAPESAESEAH;GSRGCAPESAESEAHY;SRGCAPESAESEAHYP;RGCAPESAESEAHYPG;GCAPESAESEAHYPGT;CAPESAESEAHYPGTY;APESAESEAHYPGTYV;PESAESEAHYPGTYVA;ESAESEAHYPGTYVAG;SAESEAHYPGTYVAGV;AESEAHYPGTYVAGVY;ESEAHYPGTYVAGVYN;SEAHYPGTYVAGVYNQ;EAHYPGTYVAGVYNQL;AHYPGTYVAGVYNQLT;HYPGTYVAGVYNQLTD;YPGTYVAGVYNQLTDH;PGTYVAGVYNQLTDHI;GTYVAGVYNQLTDHIE;TYVAGVYNQLTDHIEG;YVAGVYNQLTDHIEGC;VAGVYNQLTDHIEGCT;AGVYNQLTDHIEGCTV;GVYNQLTDHIEGCTVD;VYNQLTDHIEGCTVDN;YNQLTDHIEGCTVDNE;NQLTDHIEGCTVDNES;QLTDHIEGCTVDNESL;LTDHIEGCTVDNESLV;TDHIEGCTVDNESLVN;DHIEGCTVDNESLVNL;HIEGCTVDNESLVNLP;IEGCTVDNESLVNLPN;EGCTVDNESLVNLPNW;GCTVDNESLVNLPNWL;CTVDNESLVNLPNWLS;TVDNESLVNLPNWLSL;VDNESLVNLPNWLSLT;DNESLVNLPNWLSLTF;NESLVNLPNWLSLTFR;ESLVNLPNWLSLTFRI;SLVNLPNWLSLTFRID;LVNLPNWLSLTFRIDG;VNLPNWLSLTFRIDGG;NLPNWLSLTFRIDGGA;LPNWLSLTFRIDGGAW;PNWLSLTFRIDGGAWF;NWLSLTFRIDGGAWFN;WLSLTFRIDGGAWFNV;LSLTFRIDGGAWFNVD;SLTFRIDGGAWFNVDT;LTFRIDGGAWFNVDTV;TFRIDGGAWFNVDTVE;FRIDGGAWFNVDTVEL;RIDGGAWFNVDTVELL;IDGGAWFNVDTVELLS;DGGAWFNVDTVELLSY;GGAWFNVDTVELLSYR;GAWFNVDTVELLSYRQ;AWFNVDTVELLSYRQT;WFNVDTVELLSYRQTF;FNVDTVELLSYRQTFD;NVDTVELLSYRQTFDL;VDTVELLSYRQTFDLR;DTVELLSYRQTFDLRR;TVELLSYRQTFDLRRA;VELLSYRQTFDLRRAT;ELLSYRQTFDLRRATL;LLSYRQTFDLRRATLT;LSYRQTFDLRRATLTR;SYRQTFDLRRATLTRS;YRQTFDLRRATLTRSL;RQTFDLRRATLTRSLR;QTFDLRRATLTRSLRF;TFDLRRATLTRSLRFR;FDLRRATLTRSLRFRD;DLRRATLTRSLRFRDA;LRRATLTRSLRFRDAG;RRATLTRSLRFRDAGG;RATLTRSLRFRDAGGR;ATLTRSLRFRDAGGRV;TLTRSLRFRDAGGRVT;LTRSLRFRDAGGRVTT;TRSLRFRDAGGRVTTM;RSLRFRDAGGRVTTMT;SLRFRDAGGRVTTMTQ;LRFRDAGGRVTTMTQE;RFRDAGGRVTTMTQER;FRDAGGRVTTMTQERF;RD | |

Fig. 30 continued

| | | |
|---|---|---|
| | AGGRVTTMTQERFA;DAGGRVTTMTQERFAS;AGGRVTTMTQERFASM;GGRVTTMTQERFASMN;GRVTTMTQERFASMNR;RVTTMTQERFASMNRP;VTTMTQERFASMNRPN;TTMTQERFASMNRPNL;TMTQERFASMNRPNLV;MTQERFASMNRPNLVA;TQERFASMNRPNLVAL;QERFASMNRPNLVALQ;ERFASMNRPNLVALQT;RFASMNRPNLVALQTR;FASMNRPNLVALQTRI;ASMNRPNLVALQTRIE;SMNRPNLVALQTRIES;MNRPNLVALQTRIESE;NRPNLVALQTRIESEN;RPNLVALQTRIESENW;PNLVALQTRIESENWS;NLVALQTRIESENWSG;LVALQTRIESENWSGT;VALQTRIESENWSGTV;ALQTRIESENWSGTVD;LQTRIESENWSGTVDF;QTRIESENWSGTVDFR;TRIESENWSGTVDFRS;RIESENWSGTVDFRSL;IESENWSGTVDFRSLV;ESENWSGTVDFRSLVD;SENWSGTVDFRSLVDG;ENWSGTVDFRSLVDGG;NWSGTVDFRSLVDGGV;WSGTVDFRSLVDGGVH;SGTVDFRSLVDGGVHN;GTVDFRSLVDGGVHNT;TVDFRSLVDGGVHNTL;VDFRSLVDGGVHNTLV;DFRSLVDGGVHNTLVD;FRSLVDGGVHNTLVDR;RSLVDGGVHNTLVDRY;SLVDGGVHNTLVDRYR;LVDGGVHNTLVDRYRQ;VDGGVHNTLVDRYRQL;DGGVHNTLVDRYRQLS;GGVHNTLVDRYRQLSS;GVHNTLVDRYRQLSSQ;VHNTLVDRYRQLSSQH;HNTLVDRYRQLSSQHL;NTLVDRYRQLSSQHLT;TLVDRYRQLSSQHLTT;LVDRYRQLSSQHLTTA;VDRYRQLSSQHLTTAE;DRYRQLSSQHLTTAEI;RYRQLSSQHLTTAEIE;YRQLSSQHLTTAEIEV;RQLSSQHLTTAEIEVL;QLSSQHLTTAEIEVLA;LSSQHLTTAEIEVLAD;SSQHLTTAEIEVLADS;SQHLTTAEIEVLADSV;QHLTTAEIEVLADSVL;HLTTAEIEVLADSVLL;LTTAEIEVLADSVLLR;TTAEIEVLADSVLLRT;TAEIEVLADSVLLRTQ;AEIEVLADSVLLRTQT;EIEVLADSVLLRTQTS;IEVLADSVLLRTQTSQ;EVLADSVLLRTQTSQS;VLADSVLLRTQTSQSG;LADSVLLRTQTSQSGI;ADSVLLRTQTSQSGIA;DSVLLRTQTSQSGIAI;SVLLRTQTSQSGIAIA;VLLRTQTSQSGIAIAV;LLRTQTSQSGIAIAVA;LRTQTSQSGIAIAVAA;RTQTSQSGIAIAVAAR;TQTSQSGIAIAVAARS;QTSQSGIAIAVAARST;TSQSGIAIAVAARSTL;SQSGIAIAVAARSTLW;QSGIAIAVAARSTLWR;SGIAIAVAARSTLWRD;GIAIAVAARSTLWRDG;IAIAVAARSTLWRDGQ;AIAVAARSTLWRDGQR;IAVAARSTLWRDGQRV;AVAARSTLWRDGQRVD;VAARSTLWRDGQRVDA;AARSTLWRDGQRVDAQ;ARSTLWRDGQRVDAQY;RSTLWRDGQRVDAQYR;STLWRDGQRVDAQYRV;TLWRDGQRVDAQYRVA;LWRDGQRVDAQYRVAR;WRDGQRVDAQYRVARD;RDGQRVDAQYRVARDT;DGQRVDAQYRVARDTN;GQRVDAQYRVARDTNR;QRVDAQYRVARDTNRG;RVDAQYRVARDTNRGG;VDAQYRVARDTNRGGH;DAQYRVARDTNRGGHD;AQYRVARDTNRGGHDI;QYRVARDTNRGGHDIQ;YRVARDTNRGGHDIQV;RVARDTNRGGHDIQVT;VARDTNRGGHDIQVTL;ARDTNRGGHDIQVTLS;RDTNRGGHDIQVTLSA;DTNRGGHDIQVTLSAG;TNRGGHDIQVTLSAGQ;NRGGHDIQVTLSAGQS;RGGHDIQVTLSAGQSV;GGHDIQVTLSAGQSVT;GHDIQVTLSAGQSVTL;HDIQVTLSAGQSVTLE;DIQVTLSAGQSVTLEK;IQVTLSAGQSVTLEKV;QVTLSAGQSVTLEKVA;VTLSAGQSVTLEKVAT;TLSAGQSVTLEKVATI;LSAGQSVTLEKVATIF;SAGQSVTLEKVATIFT;AGQSVTLEKVATIFTS;GQSVTLEKVATIFTSR;QSVTLEKVATIFTSRD;SVTLEKVATIFTSRDA;VTLEKVATIFTSRDAA;TLEKVATIFTSRDAAT;LEKVATIFTSRDAATL;EKVATIFTSRDAATLT;KVATIFTSRDAATLTA;VATIFTSRDAATLTAA;ATIFTSRDAATLTAAI;TIFTSRDAATLTAAIS;IFTSRDAATLTAAISA;FTSRDAATLTAAISAQ;TSRDAATLTAAISAQR;SRDAATLTAAISAQRC;RDAATLTAAISAQRCL;DAATLTAAISAQRCLG;AATLTAAISAQRCLGE;ATLTAAISAQRCLGEA;TLTAAISAQRCLGEAG;LTAAISAQRCLGEAGR;TAAISAQRCLGEAGRY;AAISAQRCLGEAGRYA;AISAQRCLGEAGRYAE;ISAQRCLGEAGRYAEL;SAQRCLGEAGRYAELC;AQRCLGEAGRYAELCQ;QRCLGEAGRYAELCQQ;RCLGEAGRYAELCQQH;CLGEAGRYAELCQQHV;LGEAGRYAELCQQHVR;GEAGRYAELCQQHVRA;EAGRYAELCQQHVRAW;AGRYAELCQQHVRAWA;GRYAELCQQHVRAWAR;RYAELCQQ | |

Fig. 30 continued

| | | |
|---|---|---|
| | HVRAWARL;YAELCQQHVRAWARLW;AELCQQHVRAWARLWE;ELCQQHVRAWARLWER;LCQQHVRAWARLWERC;CQQHVRAWARLWERCA;QQHVRAWARLWERCAI;QHVRAWARLWERCAID;HVRAWARLWERCAIDL;VRAWARLWERCAIDLT;RAWARLWERCAIDLTG;AWARLWERCAIDLTGN;WARLWERCAIDLTGNT;ARLWERCAIDLTGNTE;RLWERCAIDLTGNTEE;LWERCAIDLTGNTEEL;WERCAIDLTGNTEELR;ERCAIDLTGNTEELRL;RCAIDLTGNTEELRLV;CAIDLTGNTEELRLVR;AIDLTGNTEELRLVRL;IDLTGNTEELRLVRLH;DLTGNTEELRLVRLHL;LTGNTEELRLVRLHLL;TGNTEELRLVRLHLLH;GNTEELRLVRLHLLHL;NTEELRLVRLHLLHLL;TEELRLVRLHLLHLLQ;EELRLVRLHLLHLLQT;ELRLVRLHLLHLLQTI;LRLVRLHLLHLLQTIS;RLVRLHLLHLLQTISP;LVRLHLLHLLQTISPH;VRLHLLHLLQTISPHT;RLHLLHLLQTISPHTA;LHLLHLLQTISPHTAE;HLLHLLQTISPHTAEL;LLHLLQTISPHTAELD;LHLLQTISPHTAELDA;HLLQTISPHTAELDAG;LLQTISPHTAELDAGV;LQTISPHTAELDAGVP;QTISPHTAELDAGVPA;TISPHTAELDAGVPAR;ISPHTAELDAGVPARG;SPHTAELDAGVPARGL;PHTAELDAGVPARGLN;HTAELDAGVPARGLNG;TAELDAGVPARGLNGE;AELDAGVPARGLNGEA;ELDAGVPARGLNGEAY;LDAGVPARGLNGEAYR;DAGVPARGLNGEAYRG;AGVPARGLNGEAYRGH;GVPARGLNGEAYRGHV;VPARGLNGEAYRGHVF;PARGLNGEAYRGHVFW;ARGLNGEAYRGHVFWD;RGLNGEAYRGHVFWDA;GLNGEAYRGHVFWDAL;LNGEAYRGHVFWDALF;NGEAYRGHVFWDALFV;GEAYRGHVFWDALFVA;EAYRGHVFWDALFVAP;AYRGHVFWDALFVAPV;YRGHVFWDALFVAPVL;RGHVFWDALFVAPVLS;GHVFWDALFVAPVLSL;HVFWDALFVAPVLSLR;VFWDALFVAPVLSLRM;FWDALFVAPVLSLRMP;WDALFVAPVLSLRMPK;DALFVAPVLSLRMPKV;ALFVAPVLSLRMPKVA;LFVAPVLSLRMPKVAR;FVAPVLSLRMPKVARS;VAPVLSLRMPKVARSL;APVLSLRMPKVARSLL;PVLSLRMPKVARSLLD;VLSLRMPKVARSLLDY;LSLRMPKVARSLLDYR;SLRMPKVARSLLDYRY;LRMPKVARSLLDYRYR;RMPKVARSLLDYRYRR;MPKVARSLLDYRYRRL;PKVARSLLDYRYRRLP;KVARSLLDYRYRRLPA;VARSLLDYRYRRLPAA;ARSLLDYRYRRLPAAR;RSLLDYRYRRLPAARR;SLLDYRYRRLPAARRA;LLDYRYRRLPAARRAA;LDYRYRRLPAARRAAH;DYRYRRLPAARRAAHR;YRYRRLPAARRAAHRA;RYRRLPAARRAAHRAG;YRRLPAARRAAHRAGH;RRLPAARRAAHRAGHL;RLPAARRAAHRAGHLG;LPAARRAAHRAGHLGA;PAARRAAHRAGHLGAM;AARRAAHRAGHLGAMY;ARRAAHRAGHLGAMYP;RRAAHRAGHLGAMYPW;RAAHRAGHLGAMYPWQ;AAHRAGHLGAMYPWQS;AHRAGHLGAMYPWQSG;HRAGHLGAMYPWQSGS;RAGHLGAMYPWQSGSD;AGHLGAMYPWQSGSDG;GHLGAMYPWQSGSDGS;HLGAMYPWQSGSDGSE;LGAMYPWQSGSDGSEV;GAMYPWQSGSDGSEVS;AMYPWQSGSDGSEVSQ;MYPWQSGSDGSEVSQQ;YPWQSGSDGSEVSQQL;PWQSGSDGSEVSQQLH;WQSGSDGSEVSQQLHL;QSGSDGSEVSQQLHLN;SGSDGSEVSQQLHLNP;GSDGSEVSQQLHLNPR;SDGSEVSQQLHLNPRS;DGSEVSQQLHLNPRSG;GSEVSQQLHLNPRSGR;SEVSQQLHLNPRSGRW;EVSQQLHLNPRSGRWT;VSQQLHLNPRSGRWTP;SQQLHLNPRSGRWTPD;QQLHLNPRSGRWTPDP;QLHLNPRSGRWTPDPS;LHLNPRSGRWTPDPSD;HLNPRSGRWTPDPSDR;LNPRSGRWTPDPSDRA;NPRSGRWTPDPSDRAH;PRSGRWTPDPSDRAHH;RSGRWTPDPSDRAHHV;SGRWTPDPSDRAHHVG;GRWTPDPSDRAHHVGL;RWTPDPSDRAHHVGLA;WTPDPSDRAHHVGLAV;TPDPSDRAHHVGLAVA;PDPSDRAHHVGLAVAY;DPSDRAHHVGLAVAYN;PSDRAHHVGLAVAYNA;SDRAHHVGLAVAYNAW;DRAHHVGLAVAYNAWH;RAHHVGLAVAYNAWHY;AHHVGLAVAYNAWHYY;HHVGLAVAYNAWHYYQ;HVGLAVAYNAWHYYQV;VGLAVAYNAWHYYQVT;GLAVAYNAWHYYQVTG;LAVAYNAWHYYQVTGD;AVAYNAWHYYQVTGDR;VAYNAWHYYQVTGDRQ;AYNAWHYYQVTGDRQY;YNAWHYYQVTGDRQYL;NAWHYYQVTGDRQYLV;AWHYYQVTGDRQY | |

Fig. 30 continued

| | | |
|---|---|---|
| | LVD;WHYYQVTGDRQYLVDC;HYYQVTGDRQYLVDCG;YYQVTGDRQYLVDCGA;YQVTGDRQYLVDCGAE;QVTGDRQYLVDCGAEL;VTGDRQYLVDCGAELL;TGDRQYLVDCGAELLV;GDRQYLVDCGAELLVE;DRQYLVDCGAELLVEI;RQYLVDCGAELLVEIA;QYLVDCGAELLVEIAR;YLVDCGAELLVEIARF;LVDCGAELLVEIARFW;VDCGAELLVEIARFWV;DCGAELLVEIARFWVG;CGAELLVEIARFWVGL;GAELLVEIARFWVGLA;AELLVEIARFWVGLAK;ELLVEIARFWVGLAKL;LLVEIARFWVGLAKLD;LVEIARFWVGLAKLDD;VEIARFWVGLAKLDDS;EIARFWVGLAKLDDSR;IARFWVGLAKLDDSRG;ARFWVGLAKLDDSRGR;RFWVGLAKLDDSRGRY;FWVGLAKLDDSRGRYL;WVGLAKLDDSRGRYLI;VGLAKLDDSRGRYLIR;GLAKLDDSRGRYLIRG;LAKLDDSRGRYLIRGV;AKLDDSRGRYLIRGVI;KLDDSRGRYLIRGVIG;LDDSRGRYLIRGVIGP;DDSRGRYLIRGVIGPD;DSRGRYLIRGVIGPDE;SRGRYLIRGVIGPDEF;RGRYLIRGVIGPDEFH;GRYLIRGVIGPDEFHS;RYLIRGVIGPDEFHSG;YLIRGVIGPDEFHSGY;LIRGVIGPDEFHSGYP;IRGVIGPDEFHSGYPG;RGVIGPDEFHSGYPGN;GVIGPDEFHSGYPGNE;VIGPDEFHSGYPGNEY;IGPDEFHSGYPGNEYD;GPDEFHSGYPGNEYDG;PDEFHSGYPGNEYDGI;DEFHSGYPGNEYDGID;EFHSGYPGNEYDGIDN;FHSGYPGNEYDGIDNN;HSGYPGNEYDGIDNNA;SGYPGNEYDGIDNNAY;GYPGNEYDGIDNNAYT;YPGNEYDGIDNNAYTN;PGNEYDGIDNNAYTNV;GNEYDGIDNNAYTNVM;NEYDGIDNNAYTNVMA;EYDGIDNNAYTNVMAV;YDGIDNNAYTNVMAVW;DGIDNNAYTNVMAVWV;GIDNNAYTNVMAVWVI;IDNNAYTNVMAVWVIL;DNNAYTNVMAVWVILR;NNAYTNVMAVWVILRA;NAYTNVMAVWVILRAM;AYTNVMAVWVILRAME;YTNVMAVWVILRAMEA;TNVMAVWVILRAMEAL;NVMAVWVILRAMEALD;VMAVWVILRAMEALDL;MAVWVILRAMEALDLL;AVWVILRAMEALDLLP;VWVILRAMEALDLLPL;WVILRAMEALDLLPLT;VILRAMEALDLLPLTD;ILRAMEALDLLPLTDR;LRAMEALDLLPLTDRR;RAMEALDLLPLTDRRH;AMEALDLLPLTDRRHL;MEALDLLPLTDRRHLI;EALDLLPLTDRRHLIE;ALDLLPLTDRRHLIEK;LDLLPLTDRRHLIEKL;DLLPLTDRRHLIEKLG;LLPLTDRRHLIEKLGL;LPLTDRRHLIEKLGLT;PLTDRRHLIEKLGLTT;LTDRRHLIEKLGLTTQ;TDRRHLIEKLGLTTQE;DRRHLIEKLGLTTQER;RRHLIEKLGLTTQERD;RHLIEKLGLTTQERDQ;HLIEKLGLTTQERDQW;LIEKLGLTTQERDQWD;IEKLGLTTQERDQWDD;EKLGLTTQERDQWDDV;KLGLTTQERDQWDDVS;LGLTTQERDQWDDVSR;GLTTQERDQWDDVSRR;LTTQERDQWDDVSRRM;TTQERDQWDDVSRRMF;TQERDQWDDVSRRMFV;QERDQWDDVSRRMFVP;ERDQWDDVSRRMFVPF;RDQWDDVSRRMFVPFH;DQWDDVSRRMFVPFHD;QWDDVSRRMFVPFHDG;WDDVSRRMFVPFHDGV;DDVSRRMFVPFHDGVI;DVSRRMFVPFHDGVIS;VSRRMFVPFHDGVISQ;SRRMFVPFHDGVISQF;RRMFVPFHDGVISQFE;RMFVPFHDGVISQFEG;MFVPFHDGVISQFEGY;FVPFHDGVISQFEGYS;VPFHDGVISQFEGYSE;PFHDGVISQFEGYSEL;FHDGVISQFEGYSELA;HDGVISQFEGYSELAE;DGVISQFEGYSELAEL;GVISQFEGYSELAELD;VISQFEGYSELAELDW;ISQFEGYSELAELDWD;SQFEGYSELAELDWDH;QFEGYSELAELDWDHY;FEGYSELAELDWDHYR;EGYSELAELDWDHYRH;GYSELAELDWDHYRHR;YSELAELDWDHYRHRY;SELAELDWDHYRHRYG;ELAELDWDHYRHRYGN;LAELDWDHYRHRYGNI;AELDWDHYRHRYGNIQ;ELDWDHYRHRYGNIQR;LDWDHYRHRYGNIQRL;DWDHYRHRYGNIQRLD;WDHYRHRYGNIQRLDR;DHYRHRYGNIQRLDRI;HYRHRYGNIQRLDRIL;YRHRYGNIQRLDRILE;RHRYGNIQRLDRILEA;HRYGNIQRLDRILEAE;RYGNIQRLDRILEAEG;YGNIQRLDRILEAEGD;GNIQRLDRILEAEGDS;NIQRLDRILEAEGDSV;IQRLDRILEAEGDSVN;QRLDRILEAEGDSVNN;RLDRILEAEGDSVNNY;LDRILEAEGDSVNNYQ;DRILEAEGDSVNNYQA;RILEAEGDSVNNYQAS;ILEAEGDSVNNYQASK;LEAEGDSVNNYQASKQ;EAEGDSVNNYQASKQA;AEGDSVNNYQASKQAD;EGDSVNNYQASKQADA;GDSVNNYQASKQADAL;DSVNNYQASKQADALM;SVNNYQAS | |

Fig. 30 continued

| | | |
|---|---|---|
| | KQADALML;VNNYQASKQADALMLL;NNYQASKQADALMLLY;NYQASKQADALMLLYL;YQASKQADALMLLYLL;QASKQADALMLLYLLS;ASKQADALMLLYLLSS;SKQADALMLLYLLSSD;KQADALMLLYLLSSDE;QADALMLLYLLSSDEL;ADALMLLYLLSSDELI;DALMLLYLLSSDELIG;ALMLLYLLSSDELIGL;LMLLYLLSSDELIGLL;MLLYLLSSDELIGLLA;LLYLLSSDELIGLLAR;LYLLSSDELIGLLARL;YLLSSDELIGLLARLG;LLSSDELIGLLARLGY;LSSDELIGLLARLGYR;SSDELIGLLARLGYRF;SDELIGLLARLGYRFA;DELIGLLARLGYRFAP;ELIGLLARLGYRFAPT;LIGLLARLGYRFAPTQ;IGLLARLGYRFAPTQI;GLLARLGYRFAPTQIP;LLARLGYRFAPTQIPG;LARLGYRFAPTQIPGT;ARLGYRFAPTQIPGTV;RLGYRFAPTQIPGTVD;LGYRFAPTQIPGTVDY;GYRFAPTQIPGTVDYY;YRFAPTQIPGTVDYYL;RFAPTQIPGTVDYYLA;FAPTQIPGTVDYYLAR;APTQIPGTVDYYLART;PTQIPGTVDYYLARTS;TQIPGTVDYYLARTSD;QIPGTVDYYLARTSDG;IPGTVDYYLARTSDGS;PGTVDYYLARTSDGST;GTVDYYLARTSDGSTL;TVDYYLARTSDGSTLS;VDYYLARTSDGSTLSA;DYYLARTSDGSTLSAV;YYLARTSDGSTLSAVV;YLARTSDGSTLSAVVH;LARTSDGSTLSAVVHA;ARTSDGSTLSAVVHAW;RTSDGSTLSAVVHAWV;TSDGSTLSAVVHAWVL;SDGSTLSAVVHAWVLA;DGSTLSAVVHAWVLAR;GSTLSAVVHAWVLARA;STLSAVVHAWVLARAN;TLSAVVHAWVLARANR;LSAVVHAWVLARANRS;SAVVHAWVLARANRSN;AVVHAWVLARANRSNA;VVHAWVLARANRSNAM;VHAWVLARANRSNAME;HAWVLARANRSNAMEY;AWVLARANRSNAMEYF;WVLARANRSNAMEYFR;VLARANRSNAMEYFRQ;LARANRSNAMEYFRQV;ARANRSNAMEYFRQVL;RANRSNAMEYFRQVLR;ANRSNAMEYFRQVLRS;NRSNAMEYFRQVLRSD;RSNAMEYFRQVLRSDI;SNAMEYFRQVLRSDIA;NAMEYFRQVLRSDIAD;AMEYFRQVLRSDIADV;MEYFRQVLRSDIADVQ;EYFRQVLRSDIADVQG;YFRQVLRSDIADVQGG;FRQVLRSDIADVQGGT;RQVLRSDIADVQGGTT;QVLRSDIADVQGGTTQ;VLRSDIADVQGGTTQE;LRSDIADVQGGTTQEG;RSDIADVQGGTTQEGI;SDIADVQGGTTQEGIH;DIADVQGGTTQEGIHL;IADVQGGTTQEGIHLA;ADVQGGTTQEGIHLAA;DVQGGTTQEGIHLAAM;VQGGTTQEGIHLAAMA;QGGTTQEGIHLAAMAG;GGTTQEGIHLAAMAGS;GTTQEGIHLAAMAGSI;TTQEGIHLAAMAGSID;TQEGIHLAAMAGSIDL;QEGIHLAAMAGSIDLL;EGIHLAAMAGSIDLLQ;GIHLAAMAGSIDLLQR;IHLAAMAGSIDLLQRC;HLAAMAGSIDLLQRCY;LAAMAGSIDLLQRCYS;AAMAGSIDLLQRCYSG;AMAGSIDLLQRCYSGL;MAGSIDLLQRCYSGLE;AGSIDLLQRCYSGLEL;GSIDLLQRCYSGLELR;SIDLLQRCYSGLELRD;IDLLQRCYSGLELRDD;DLLQRCYSGLELRDDR;LLQRCYSGLELRDDRL;LQRCYSGLELRDDRLV;QRCYSGLELRDDRLVL;RCYSGLELRDDRLVLS;CYSGLELRDDRLVLSP;YSGLELRDDRLVLSPQ;SGLELRDDRLVLSPQW;GLELRDDRLVLSPQWP;LELRDDRLVLSPQWPE;ELRDDRLVLSPQWPEA;LRDDRLVLSPQWPEAL;RDDRLVLSPQWPEALG;DDRLVLSPQWPEALGP;DRLVLSPQWPEALGPL;RLVLSPQWPEALGPLE;LVLSPQWPEALGPLEF;VLSPQWPEALGPLEFP;LSPQWPEALGPLEFPF;SPQWPEALGPLEFPFV;PQWPEALGPLEFPFVY;QWPEALGPLEFPFVYR;WPEALGPLEFPFVYRR;PEALGPLEFPFVYRRH;EALGPLEFPFVYRRHQ;ALGPLEFPFVYRRHQL;LGPLEFPFVYRRHQLS;GPLEFPFVYRRHQLSL;PLEFPFVYRRHQLSLR;LEFPFVYRRHQLSLRI;EFPFVYRRHQLSLRIS;FPFVYRRHQLSLRISG;PFVYRRHQLSLRISGR;FVYRRHQLSLRISGRS;VYRRHQLSLRISGRSA;YRRHQLSLRISGRSAT;RRHQLSLRISGRSATL;RHQLSLRISGRSATLT;HQLSLRISGRSATLTA;QLSLRISGRSATLTAE;LSLRISGRSATLTAES;SLRISGRSATLTAESG;LRISGRSATLTAESGD;RISGRSATLTAESGDA;ISGRSATLTAESGDAE;SGRSATLTAESGDAEP;GRSATLTAESGDAEPI;RSATLTAESGDAEPIE;SATLTAESGDAEPIEV;ATLTAESGDAEPIEVE;TLTAESGDAEPIEVEC;LTAESGDAEPIEVECR;TAESGDAEPIEVECRG;AESGDAEPIEVECRGH;ESGDAEPIEVECRGHV;SGDAEPIEVECRGHVQ;GDAEPIEVECRGHVQR;DAEPIEV | |

Fig. 30 continued

| | | |
|---|---|---|
| | ECRGHVQRL;AEPIEVECRGHVQRLR;EPIEVECRGHVQRLRC;PIEVECRGHVQRLRCG;IEVECRGHVQRLRCGH;EVECRGHVQRLRCGHT;VECRGHVQRLRCGHTI;ECRGHVQRLRCGHTIE;CRGHVQRLRCGHTIEV;RGHVQRLRCGHTIEVG;GHVQRLRCGHTIEVGC;HVQRLRCGHTIEVGCS;VQRLRCGHTIEVGCSR | |
| 26 | **<NP_216545.1\| phosphofructokinase PfkB (phosphohexokinase)Rv2029c;Mycobacterium tuberculosis H37Rv>** MTEPAAWDEGKPRIITLTMNPALDITTSVDVVRPTEKMRCGAPRYDPGGGGINVARIVHVLGGCSTALFPAGGSTGSLLMALLGDAGVPFRVIPIAASTRESFTVNESRTAKQYRFVLPGPSLTVAEQEQCLDELRGAAASAAFVVASGSLPPGVAADYYQRVADICRRSSTPLILDTSGGGLQHISSGVFLLKASVRELRECVGSELLTEPEQLAAAHELIDRGRAEVVVVSLGSQGALLATRHASHRFSSIPMTAVSGVGAGDAMVAAITVGLSRGWSLIKSVRLGNAAGAAMLLTPGTAACNRDDVERFFELAAEPTEVGQDQYVWHPIVNPEASP<br><br>8mer<br>KPRIITLT;ITLTMNPA;TLTMNPAL;TMNPALDI;NPALDITT;ALDITTSV;ITTSVDVV;TTSVDVVR;DVVRPTEK;RPTEKMRC;KMRCGAPR;GINVARIV;NVARIVHV;VARIVHVL;VLGGCSTA;CSTALFPA;FPAGGSTG;TGSLLMAL;LMALLGDA;ALLGDAGV;DAGVPFRV;VPFRVIPI;IPIAASTR;STRESFTV;ESFTVNES;SFTVNESR;RTAKQYRF;TAKQYRFV;FVLPGPSL;VLPGPSLT;LPGPSLTV;AEQEQCLD;QEQCLDEL;EQCLDELR;CLDELRGA;GAAASAAF;AAASAAFV;AASAAFVV;FVVASGSL;SLPPGVAA;LPPGVAAD;VAADYYQR;AADYYQRV;YYQRVADI;RVADICRR;RSSTPLIL;LQHISSGV;HISSGVFL;ISSGVFLL;SSGVFLLK;FLLKASVR;KASVRELR;RECVGSEL;ECVGSELL;LLTEPEQL;EPEQLAAA;QLAAAHEL;LAAAHELI;ELIDRGRA;AEVVVVSL;SLGSQGAL;SQGALLAT;ALLATRHA;ATRHASHR;HRFSSIPM;FSSIPMTA;SSIPMTAV;IPMTAVSG;PMTAVSGV;AMVAAITV;MVAAITVG;VAAITVGL;AITVGLSR;GLSRGWSL;WSLIKSVR;SLIKSVRL;RLGNAAGA;NAAGAAML;MLLTPGTA;LLTPGTAA;DVERFFEL;LAAEPTEV;TEVGQDQY;EVGQDQYV;DQYVWHPI;QYVWHPIV;HPIVNPEA<br>9mer<br>EPAAWDEGK;KPRIITLTM;IITLTMNPA;ITLTMNPAL;LTMNPALDI;TMNPALDIT;NPALDITTS;PALDITTSV;ITTSVDVVR;DVVRPTEKM;KMRCGAPRY;APRYDPGGG;RYDPGGGGI;DPGGGGINV;NVARIVHVL;HVLGGCSTA;VLGGCSTAL;ALFPAGGST;FPAGGSTGS;STGSLLMAL;TGSLLMALL;LLMALLGDA;MALLGDAGV;LLGDAGVPF;GVPFRVIPI;VPFRVIPIA;RVIPIAAST;VIPIAASTR;IAASTRESF;ESFTVNESR;FTVNESRTA;TVNESRTAK;NESRTAKQY;ESRTAKQYR;SRTAKQYRF;RTAKQYRFV;FVLPGPSLT;VLPGPSLTV;LPGPSLTVA;SLTVAEQEQ;TVAEQEQCL;AEQEQCLDE;CLDELRGAA;ELRGAAASA;RGAAASAAF;GAAASAAFV;AAASAAFVV;AASAAFVVA;SLPPGVAAD;LPPGVAADY;PPGVAADYY;GVAADYYQR;VAADYYQRV;DYYQRVADI;YYQRVADIC;YQRVADICR;ICRRSSTPL;RRSSTPLIL;ILDTSGGGL;GLQHISSGV;LQHISSGVF;HISSGVFLL;ISSGVFLLK;GVFLLKASV;VFLLKASVR;FLLKASVRE;LLKASVREL;LKASVRELR;SVRELRECV;RECVGSELL;ELLTEPEQL;LLTEPEQLA;EPEQLAAAH;EQLAAAHEL;QLAAAHELI;LIDRGRAEV;RAEVVVVSL;VVSLGSQGA;SLGSQGALL;SQGALLATR;ALLATRHAS;LATRHASHR;ATRHASHRF;HASHRFSSI;SHRFSSIPM;FSSIPMTAV;IPMTAVSGV;MTAVSGVGA;SGVGAGDAM;GVGAGDAMV;GAGDAMVAA;DAMVAAITV;MVAAITVGL;AAITVGLSR;ITVGLSRGW;GLSRGWSLI;LSRGWSLIK;RGWSLIKSV;GWSLIKSVR;RLGNAAGAA;LGNAAGAAM;NAAGAAMLL;AMLLTPGTA;MLLTPGTAA;LLTPGTAAC;TPGTAACNR;TAACNRDDV;DVERFFELA;ELAAEPTEV;PTEVGQDQY;TEVGQDQYV;GQDQYVWHP;DQYVWHPIV;HPIVNPEAS | 159621-161324 |

Fig. 30 continued

| | | | |
|---|---|---|---|
| | 10mer<br>AAWDEGKPRI;DEGKPRIITL;KPRIITLTMN;RIITLTMNPA;TLTMNPALDI;TMNPALDITT;NPALDITTSV;ALDITTSVDV;DITTSVDVVR;SVDVVRPTEK;DVVRPTEKMR;RPTEKMRCGA;TEKMRCGAPR;APRYDPGGGG;GINVARIVHV;HVLGGCSTAL;VLGGCSTALF;STALFPAGGS;FPAGGSTGSL;STGSLLMALL;SLLMALLGDA;LLMALLGDAG;LMALLGDAGV;ALLGDAGVPF;LLGDAGVPFR;LGDAGVPFRV;VPFRVIPIAA;RVIPIAASTR;AASTRESFTV;RESFTVNESR;ESFTVNESRT;FTVNESRTAK;RTAKQYRFVL;KQYRFVLPGP;YRFVLPGPSL;FVLPGPSLTV;VLPGPSLTVA;SLTVAEQEQC;AEQEQCLDEL;EQEQCLDELR;CLDELRGAAA;ELRGAAASAA;RGAAASAAFV;GAAASAAFVV;AAASAAFVVA;SAAFVVASGS;VASGSLPPGV;SLPPGVAADY;LPPGVAADYY;GVAADYYQRV;YYQRVADICR;YQRVADICRR;DICRRSSTPL;ICRRSSTPLI;LILDTSGGGL;ILDTSGGGLQ;DTSGGGLQHI;GLQHISSGVF;LQHISSGVFL;HISSGVFLLK;SGVFLLKASV;GVFLLKASVR;FLLKASVREL;LLKASVRELR;ELRECVGSEL;SELLTEPEQL;ELLTEPEQLA;LLTEPEQLAA;PEQLAAAHEL;EQLAAAHELI;LAAAHELIDR;AAHELIDRGR;ELIDRGRAEV;LIDRGRAEVV;GRAEVVVVSL;AEVVVVSLGS;VVSLGSQGAL;SLGSQGALLA;GSQGALLATR;LLATRHASHR;LATRHASHRF;ATRHASHRFS;ASHRFSSIPM;SIPMTAVSGV;SGVGAGDAMV;GAGDAMVAAI;AMVAAITVGL;MVAAITVGLS;VAAITVGLSR;GLSRGWSLIK;RGWSLIKSVR;LIKSVRLGNA;RLGNAAGAAM;GNAAGAAMLL;AMLLTPGTAA;MLLTPGTAAC;LLTPGTAACN;LTPGTAACNR;AACNRDDVER;FELAAEPTEV;EPTEVGQDQY;TEVGQDQYVW;GQDQYVWHPI<br>11mer<br>MTEPAAWDEGK;EPAAWDEGKPR;EGKPRIITLTM;RIITLTMNPAL;TMNPALDITTS;MNPALDITTSV;PALDITTSVDV;ALDITTSVDVV;TSVDVVRPTEK;RPTEKMRCGAP;PTEKMRCGAPR;KMRCGAPRYDP;APRYDPGGGGI;RYDPGGGGINV;DPGGGGINVAR;GINVARIVHVL;RIVHVLGGCST;VHVLGGCSTAL;HVLGGCSTALF;STALFPAGGST;ALFPAGGSTGS;LFPAGGSTGSL;FPAGGSTGSLL;LLMALLGDAGV;MALLGDAGVPF;ALLGDAGVPFR;LLGDAGVPFRV;VPFRVIPIAAS;IPIAASTRESF;IAASTRESFTV;ESFTVNESRTA;TVNESRTAKQY;VNESRTAKQYR;SRTAKQYRFVL;QYRFVLPGPSL;FVLPGPSLTVA;VLPGPSLTVAE;SLTVAEQEQCL;CLDELRGAAAS;ELRGAAASAAF;RGAAASAAFVV;SAAFVVASGSL;VVASGSLPPGV;SLPPGVAADYY;DYYQRVADICR;YYQRVADICRR;RVADICRRSST;ICRRSSTPLIL;GLQHISSGVFL;LQHISSGVFLL;HISSGVFLLKA;VFLLKASVREL;FLLKASVRELR;RELRECVGSEL;ELRECVGSELL;ELLTEPEQLAA;LLTEPEQLAAA;EPEQLAAAHEL;QLAAAHELIDR;ELIDRGRAEVV;LIDRGRAEVVV;RGRAEVVVVSL;VVVVSLGSQGA;VVVSLGSQGAL;VVSLGSQGALL;SLGSQGALLAT;SQGALLATRHA;ALLATRHASHR;LLATRHASHRF;ATRHASHRFSS;HASHRFSSIPM;HRFSSIPMTAV;SSIPMTAVSGV;IPMTAVSGVGA;AVSGVGAGDAM;AGDAMVAAITV;DAMVAAITVGL;AMVAAITVGLS;MVAAITVGLSR;AAITVGLSRGW;ITVGLSRGWSL;SLIKSVRLGNA;LIKSVRLGNAA;SVRLGNAAGAA;VRLGNAAGAAM;RLGNAAGAAML;GAAMLLTPGTA;AAMLLTPGTAA;AMLLTPGTAAC;LLTPGTAACNR;TAACNRDDVER;NRDDVERFFEL;AEPTEVGQDQY;EPTEVGQDQYV;PTEVGQDQYVW;GQDQYVWHPIV;YVWHPIVNPEA<br><br>13 mers:<br>MTEPAAWDEGKPR;TEPAAWDEGKPRI;EPAAWDEGKPRII;PAAWDEGKPRIIT;AAWDEGKPRIITL;AWDEGKPRIITLT;WDEGKPRIITLTM;DEGKPRIITLTMN;EGKPRIITLTMNP;GKPRIITLTMNPA;KPRIITLTMNPAL;PRIITLTMNPALD;RIITLTMNPALDI;IITLTMNPALDIT;ITLTMNPALDITT;TLTMNPALDITTS;LTMNPALDITTSV;TMNPALDITTSVD;MNPALDITTSVDV;NPALDITTSVDVV;PALDITTSVDVVR;ALDITTSVDVVRP;LDITTSVDVVRPT;DITTSVDVVRPTE; | |

Fig. 30 continued

| | | |
|---|---|---|
| | ITTSVDVVRPTEK;TTSVDVVRPTEKM;TSVDVVRPTEKMR;SVDVVRPTEKMRC;VDVVRPTEKMRCG;DVVRPTEKMRCGA;VVRPTEKMRCGAP;VRPTEKMRCGAPR;RPTEKMRCGAPRY;PTEKMRCGAPRYD;TEKMRCGAPRYDP;EKMRCGAPRYDPG;KMRCGAPRYDPGG;MRCGAPRYDPGGG;RCGAPRYDPGGGG;CGAPRYDPGGGGI;GAPRYDPGGGGIN;APRYDPGGGGINV;PRYDPGGGGINVA;RYDPGGGGINVAR;YDPGGGGINVARI;DPGGGGINVARIV;PGGGGINVARIVH;GGGGINVARIVHV;GGGINVARIVHVL;GGINVARIVHVLG;GINVARIVHVLGG;INVARIVHVLGGC;NVARIVHVLGGCS;VARIVHVLGGCST;ARIVHVLGGCSTA;RIVHVLGGCSTAL;IVHVLGGCSTALF;VHVLGGCSTALFP;HVLGGCSTALFPA;VLGGCSTALFPAG;LGGCSTALFPAGG;GGCSTALFPAGGS;GCSTALFPAGGST;CSTALFPAGGSTG;STALFPAGGSTGS;TALFPAGGSTGSL;ALFPAGGSTGSLL;LFPAGGSTGSLLM;FPAGGSTGSLLMA;PAGGSTGSLLMAL;AGGSTGSLLMALL;GGSTGSLLMALLG;GSTGSLLMALLGD;STGSLLMALLGDA;TGSLLMALLGDAG;GSLLMALLGDAGV;SLLMALLGDAGVP;LLMALLGDAGVPF;LMALLGDAGVPFR;MALLGDAGVPFRV;ALLGDAGVPFRVI;LLGDAGVPFRVIP;LGDAGVPFRVIPI;GDAGVPFRVIPIA;DAGVPFRVIPIAA;AGVPFRVIPIAAS;GVPFRVIPIAAST;VPFRVIPIAASTR;PFRVIPIAASTRE;FRVIPIAASTRES;RVIPIAASTRESF;VIPIAASTRESFT;IPIAASTRESFTV;PIAASTRESFTVN;IAASTRESFTVNE;AASTRESFTVNES;ASTRESFTVNESR;STRESFTVNESRT;TRESFTVNESRTA;RESFTVNESRTAK;ESFTVNESRTAKQ;SFTVNESRTAKQY;FTVNESRTAKQYR;TVNESRTAKQYRF;VNESRTAKQYRFV;NESRTAKQYRFVL;ESRTAKQYRFVLP;SRTAKQYRFVLPG;RTAKQYRFVLPGP;TAKQYRFVLPGPS;AKQYRFVLPGPSL;KQYRFVLPGPSLT;QYRFVLPGPSLTV;YRFVLPGPSLTVA;RFVLPGPSLTVAE;FVLPGPSLTVAEQ;VLPGPSLTVAEQE;LPGPSLTVAEQEQ;PGPSLTVAEQEQC;GPSLTVAEQEQCL;PSLTVAEQEQCLD;SLTVAEQEQCLDE;LTVAEQEQCLDEL;TVAEQEQCLDELR;VAEQEQCLDELRG;AEQEQCLDELRGA;EQEQCLDELRGAA;QEQCLDELRGAAA;EQCLDELRGAAAS;QCLDELRGAAASA;CLDELRGAAASAA;LDELRGAAASAAF;DELRGAAASAAFV;ELRGAAASAAFVV;LRGAAASAAFVVA;RGAAASAAFVVAS;GAAASAAFVVASG;AAASAAFVVASGS;AASAAFVVASGSL;ASAAFVVASGSLP;SAAFVVASGSLPP;AAFVVASGSLPPG;AFVVASGSLPPGV;FVVASGSLPPGVA;VVASGSLPPGVAA;VASGSLPPGVAAD;ASGSLPPGVAADY;SGSLPPGVAADYY;GSLPPGVAADYYQ;SLPPGVAADYYQR;LPPGVAADYYQRV;PPGVAADYYQRVA;PGVAADYYQRVAD;GVAADYYQRVADI;VAADYYQRVADIC;AADYYQRVADICR;ADYYQRVADICRR;DYYQRVADICRRS;YYQRVADICRRSS;YQRVADICRRSST;QRVADICRRSSTP;RVADICRRSSTPL;VADICRRSSTPLI;ADICRRSSTPLIL;DICRRSSTPLILD;ICRRSSTPLILDT;CRRSSTPLILDTS;RRSSTPLILDTSG;RSSTPLILDTSGG;SSTPLILDTSGGG;STPLILDTSGGGL;TPLILDTSGGGLQ;PLILDTSGGGLQH;LILDTSGGGLQHI;ILDTSGGGLQHIS;LDTSGGGLQHISS;DTSGGGLQHISSG;TSGGGLQHISSGV;SGGGLQHISSGVF;GGGLQHISSGVFL;GGLQHISSGVFLL;GLQHISSGVFLLK;LQHISSGVFLLKA;QHISSGVFLLKAS;HISSGVFLLKASV;ISSGVFLLKASVR;SSGVFLLKASVRE;SGVFLLKASVREL;GVFLLKASVRELR;VFLLKASVRELRE;FLLKASVRELREC;LLKASVRELRECV;LKASVRELRECVG;KASVRELRECVGS;ASVRELRECVGSE;SVRELRECVGSEL;VRELRECVGSELL;RELRECVGSELLT;ELRECVGSELLTE;LRECVGSELLTEP;RECVGSELLTEPE;ECVGSELLTEPEQ;CVGSELLTEPEQL;VGSELLTEPEQLA;GSELLTEPEQLAA;SELLTEPEQLAAA;ELLTEPEQLAAAH;LLTEPEQLAAAHE;LTEPEQLAAAHEL;TEPEQLAAAHELI;EPEQLAAAHELID;PEQLAAAHELIDR;EQLAAAHELIDRG;QLAAAHELIDRGR;LAAAHELIDRGRA;AAAHELIDRGRAE;AAHELIDRGRAEV;AHELIDRGRAEVV;HELIDRGRAEVVV;ELIDRGRAEVVVV;LIDRGRAEVVVVS;IDRGRAEVVVVSL;DRGRAEVVVVSLG;RGRAEVVVVSLGS;GRAEVVVVSLGSQ;RAEVVV | |

Fig. 30 continued

| | | |
|---|---|---|
| | VSLGSQG;AEVVVVSLGSQGA;EVVVVSLGSQGAL;VVVVSLGSQGALL;VVVSLGSQGALLA;VVSLGSQGALLAT;VSLGSQGALLATR;SLGSQGALLATRH;LGSQGALLATRHA;GSQGALLATRHAS;SQGALLATRHASH;QGALLATRHASHR;GALLATRHASHRF;ALLATRHASHRFS;LLATRHASHRFSS;LATRHASHRFSSI;ATRHASHRFSSIP;TRHASHRFSSIPM;RHASHRFSSIPMT;HASHRFSSIPMTA;ASHRFSSIPMTAV;SHRFSSIPMTAVS;HRFSSIPMTAVSG;RFSSIPMTAVSGV;FSSIPMTAVSGVG;SSIPMTAVSGVGA;SIPMTAVSGVGAG;IPMTAVSGVGAGD;PMTAVSGVGAGDA;MTAVSGVGAGDAM;TAVSGVGAGDAMV;AVSGVGAGDAMVA;VSGVGAGDAMVAA;SGVGAGDAMVAAI;GVGAGDAMVAAIT;VGAGDAMVAAITV;GAGDAMVAAITVG;AGDAMVAAITVGL;GDAMVAAITVGLS;DAMVAAITVGLSR;AMVAAITVGLSRG;MVAAITVGLSRGW;VAAITVGLSRGWS;AAITVGLSRGWSL;AITVGLSRGWSLI;ITVGLSRGWSLIK;TVGLSRGWSLIKS;VGLSRGWSLIKSV;GLSRGWSLIKSVR;LSRGWSLIKSVRL;SRGWSLIKSVRLG;RGWSLIKSVRLGN;GWSLIKSVRLGNA;WSLIKSVRLGNAA;SLIKSVRLGNAAG;LIKSVRLGNAAGA;IKSVRLGNAAGAA;KSVRLGNAAGAAM;SVRLGNAAGAAML;VRLGNAAGAAMLL;RLGNAAGAAMLLT;LGNAAGAAMLLTP;GNAAGAAMLLTPG;NAAGAAMLLTPGT;AAGAAMLLTPGTA;AGAAMLLTPGTAA;GAAMLLTPGTAAC;AAMLLTPGTAACN;AMLLTPGTAACNR;MLLTPGTAACNRD;LLTPGTAACNRDD;LTPGTAACNRDDV;TPGTAACNRDDVE;PGTAACNRDDVER;GTAACNRDDVERF;TAACNRDDVERFF;AACNRDDVERFFE;ACNRDDVERFFEL;CNRDDVERFFELA;NRDDVERFFELAA;RDDVERFFELAAE;DDVERFFELAAEP;DVERFFELAAEPT;VERFFELAAEPTE;ERFFELAAEPTEV;RFFELAAEPTEVG;FFELAAEPTEVGQ;FELAAEPTEVGQD;ELAAEPTEVGQDQ;LAAEPTEVGQDQY;AAEPTEVGQDQYV;AEPTEVGQDQYVW;EPTEVGQDQYVWH;PTEVGQDQYVWHP;TEVGQDQYVWHPI;EVGQDQYVWHPIV;VGQDQYVWHPIVN;GQDQYVWHPIVNP;QDQYVWHPIVNPE;DQYVWHPIVNPEA;QYVWHPIVNPEAS;YVWHPIVNPEASP;<br><br>14 mers:<br>MTEPAAWDEGKPRI;TEPAAWDEGKPRII;EPAAWDEGKPRIIT;PAAWDEGKPRIITL;AAWDEGKPRIITLT;AWDEGKPRIITLTM;WDEGKPRIITLTMN;DEGKPRIITLTMNP;EGKPRIITLTMNPA;GKPRIITLTMNPAL;KPRIITLTMNPALD;PRIITLTMNPALDI;RIITLTMNPALDIT;IITLTMNPALDITT;ITLTMNPALDITTS;TLTMNPALDITTSV;LTMNPALDITTSVD;TMNPALDITTSVDV;MNPALDITTSVDVV;NPALDITTSVDVVR;PALDITTSVDVVRP;ALDITTSVDVVRPT;LDITTSVDVVRPTE;DITTSVDVVRPTEK;ITTSVDVVRPTEKM;TTSVDVVRPTEKMR;TSVDVVRPTEKMRC;SVDVVRPTEKMRCG;VDVVRPTEKMRCGA;DVVRPTEKMRCGAP;VVRPTEKMRCGAPR;VRPTEKMRCGAPRY;RPTEKMRCGAPRYD;PTEKMRCGAPRYDP;TEKMRCGAPRYDPG;EKMRCGAPRYDPGG;KMRCGAPRYDPGGG;MRCGAPRYDPGGGG;RCGAPRYDPGGGGI;CGAPRYDPGGGGIN;GAPRYDPGGGGINV;APRYDPGGGGINVA;PRYDPGGGGINVAR;RYDPGGGGINVARI;YDPGGGGINVARIV;DPGGGGINVARIVH;PGGGGINVARIVHV;GGGGINVARIVHVL;GGGINVARIVHVLG;GGINVARIVHVLGG;GINVARIVHVLGGC;INVARIVHVLGGCS;NVARIVHVLGGCST;VARIVHVLGGCSTA;ARIVHVLGGCSTAL;RIVHVLGGCSTALF;IVHVLGGCSTALFP;VHVLGGCSTALFPA;HVLGGCSTALFPAG;VLGGCSTALFPAGG;LGGCSTALFPAGGS;GGCSTALFPAGGST;GCSTALFPAGGSTG;CSTALFPAGGSTGS;STALFPAGGSTGSL;TALFPAGGSTGSLL;ALFPAGGSTGSLLM;LFPAGGSTGSLLMA;FPAGGSTGSLLMAL;PAGGSTGSLLMALL;AGGSTGSLLMALLG;GGSTGSLLMALLGD;GSTGSLLMALLGDA;STGSLLMALLGDAG;TGSLLMALLGDAGV;GSLLMALLGDAGVP;SLLMALLGDAGVPF;LLMALLGDAGVPFR;LMALLGDAGVPFRV;MALLGDAGVPFRVI;ALLGDAGVPFRVIP;LLGDA | |

Fig. 30 continued

| | | |
|---|---|---|
| | GVPFRVIPI;LGDAGVPFRVIPIA;GDAGVPFRVIPIAA;DAGVPFRVIPIAAS;AGVPFRVIPIAAST;GVPFRVIPIAASTR;VPFRVIPIAASTRE;PFRVIPIAASTRES;FRVIPIAASTRESF;RVIPIAASTRESFT;VIPIAASTRESFTV;IPIAASTRESFTVN;PIAASTRESFTVNE;IAASTRESFTVNES;AASTRESFTVNESR;ASTRESFTVNESRT;STRESFTVNESRTA;TRESFTVNESRTAK;RESFTVNESRTAKQ;ESFTVNESRTAKQY;SFTVNESRTAKQYR;FTVNESRTAKQYRF;TVNESRTAKQYRFV;VNESRTAKQYRFVL;NESRTAKQYRFVLP;ESRTAKQYRFVLPG;SRTAKQYRFVLPGP;RTAKQYRFVLPGPS;TAKQYRFVLPGPSL;AKQYRFVLPGPSLT;KQYRFVLPGPSLTV;QYRFVLPGPSLTVA;YRFVLPGPSLTVAE;RFVLPGPSLTVAEQ;FVLPGPSLTVAEQE;VLPGPSLTVAEQEQ;LPGPSLTVAEQEQC;PGPSLTVAEQEQCL;GPSLTVAEQEQCLD;PSLTVAEQEQCLDE;SLTVAEQEQCLDEL;LTVAEQEQCLDELR;TVAEQEQCLDELRG;VAEQEQCLDELRGA;AEQEQCLDELRGAA;EQEQCLDELRGAAA;QEQCLDELRGAAAS;EQCLDELRGAAASA;QCLDELRGAAASAA;CLDELRGAAASAAF;LDELRGAAASAAFV;DELRGAAASAAFVV;ELRGAAASAAFVVA;LRGAAASAAFVVAS;RGAAASAAFVVASG;GAAASAAFVVASGS;AAASAAFVVASGSL;AASAAFVVASGSLP;ASAAFVVASGSLPP;SAAFVVASGSLPPG;AAFVVASGSLPPGV;AFVVASGSLPPGVA;FVVASGSLPPGVAA;VVASGSLPPGVAAD;VASGSLPPGVAADY;ASGSLPPGVAADYY;SGSLPPGVAADYYQ;GSLPPGVAADYYQR;SLPPGVAADYYQRV;LPPGVAADYYQRVA;PPGVAADYYQRVAD;PGVAADYYQRVADI;GVAADYYQRVADIC;VAADYYQRVADICR;AADYYQRVADICRR;ADYYQRVADICRRS;DYYQRVADICRRSS;YYQRVADICRRSST;YQRVADICRRSSTP;QRVADICRRSSTPL;RVADICRRSSTPLI;VADICRRSSTPLIL;ADICRRSSTPLILD;DICRRSSTPLILDT;ICRRSSTPLILDTS;CRRSSTPLILDTSG;RRSSTPLILDTSGG;RSSTPLILDTSGGG;SSTPLILDTSGGGL;STPLILDTSGGGLQ;TPLILDTSGGGLQH;PLILDTSGGGLQHI;LILDTSGGGLQHIS;ILDTSGGGLQHISS;LDTSGGGLQHISSG;DTSGGGLQHISSGV;TSGGGLQHISSGVF;SGGGLQHISSGVFL;GGGLQHISSGVFLL;GGLQHISSGVFLLK;GLQHISSGVFLLKA;LQHISSGVFLLKAS;QHISSGVFLLKASV;HISSGVFLLKASVR;ISSGVFLLKASVRE;SSGVFLLKASVREL;SGVFLLKASVRELR;GVFLLKASVRELRE;VFLLKASVRELREC;FLLKASVRELRECV;LLKASVRELRECVG;LKASVRELRECVGS;KASVRELRECVGSE;ASVRELRECVGSEL;SVRELRECVGSELL;VRELRECVGSELLT;RELRECVGSELLTE;ELRECVGSELLTEP;LRECVGSELLTEPE;RECVGSELLTEPEQ;ECVGSELLTEPEQL;CVGSELLTEPEQLA;VGSELLTEPEQLAA;GSELLTEPEQLAAA;SELLTEPEQLAAAH;ELLTEPEQLAAAHE;LLTEPEQLAAAHEL;LTEPEQLAAAHELI;TEPEQLAAAHELID;EPEQLAAAHELIDR;PEQLAAAHELIDRG;EQLAAAHELIDRGR;QLAAAHELIDRGRA;LAAAHELIDRGRAE;AAAHELIDRGRAEV;AAHELIDRGRAEVV;AHELIDRGRAEVVV;HELIDRGRAEVVVV;ELIDRGRAEVVVVS;LIDRGRAEVVVVSL;IDRGRAEVVVVSLG;DRGRAEVVVVSLGS;RGRAEVVVVSLGSQ;GRAEVVVVSLGSQG;RAEVVVVSLGSQGA;AEVVVVSLGSQGAL;EVVVVSLGSQGALL;VVVVSLGSQGALLA;VVVSLGSQGALLAT;VVSLGSQGALLATR;VSLGSQGALLATRH;SLGSQGALLATRHA;LGSQGALLATRHAS;GSQGALLATRHASH;SQGALLATRHASHR;QGALLATRHASHRF;GALLATRHASHRFS;ALLATRHASHRFSS;LLATRHASHRFSSI;LATRHASHRFSSIP;ATRHASHRFSSIPM;TRHASHRFSSIPMT;RHASHRFSSIPMTA;HASHRFSSIPMTAV;ASHRFSSIPMTAVS;SHRFSSIPMTAVSG;HRFSSIPMTAVSGV;RFSSIPMTAVSGVG;FSSIPMTAVSGVGA;SSIPMTAVSGVGAG;SIPMTAVSGVGAGD;IPMTAVSGVGAGDA;PMTAVSGVGAGDAM;MTAVSGVGAGDAMV;TAVSGVGAGDAMVA;AVSGVGAGDAMVAA;VSGVGAGDAMVAAI;SGVGAGDAMVAAIT;GVGAGDAMVAAITV;VGAGDAMVAAITVG;GAGDAMVAAITVGL;AGDAMVAAITVGLS;GDAMVAAITVGLSR;DAMVAAITVGLSRG;AMVAAITVGLSRGW;MVAAITVGLSRGWS;VAAITVGLSRGWSL;AAITVGLSRGWSLI;AIT | |

Fig. 30 continued

| | | |
|---|---|---|
| | VGLSRGWSLIK;ITVGLSRGWSLIKS;TVGLSRGWSLIKSV;VGLSRGWSLIKSVR;GLSRGWSLIKSVRL;LSRGWSLIKSVRLG;SRGWSLIKSVRLGN;RGWSLIKSVRLGNA;GWSLIKSVRLGNAA;WSLIKSVRLGNAAG;SLIKSVRLGNAAGA;LIKSVRLGNAAGAA;IKSVRLGNAAGAAM;KSVRLGNAAGAAML;SVRLGNAAGAAMLL;VRLGNAAGAAMLLT;RLGNAAGAAMLLTP;LGNAAGAAMLLTPG;GNAAGAAMLLTPGT;NAAGAAMLLTPGTA;AAGAAMLLTPGTAA;AGAAMLLTPGTAAC;GAAMLLTPGTAACN;AAMLLTPGTAACNR;AMLLTPGTAACNRD;MLLTPGTAACNRDD;LLTPGTAACNRDDV;LTPGTAACNRDDVE;TPGTAACNRDDVER;PGTAACNRDDVERF;GTAACNRDDVERFF;TAACNRDDVERFFE;AACNRDDVERFFEL;ACNRDDVERFFELA;CNRDDVERFFELAA;NRDDVERFFELAAE;RDDVERFFELAAEP;DDVERFFELAAEPT;DVERFFELAAEPTE;VERFFELAAEPTEV;ERFFELAAEPTEVG;RFFELAAEPTEVGQ;FFELAAEPTEVGQD;FELAAEPTEVGQDQ;ELAAEPTEVGQDQY;LAAEPTEVGQDQYV;AAEPTEVGQDQYVW;AEPTEVGQDQYVWH;EPTEVGQDQYVWHP;PTEVGQDQYVWHPI;TEVGQDQYVWHPIV;EVGQDQYVWHPIVN;VGQDQYVWHPIVNP;GQDQYVWHPIVNPE;QDQYVWHPIVNPEA;DQYVWHPIVNPEAS;QYVWHPIVNPEASP;<br><br>15 mers:<br>MTEPAAWDEGKPRII;TEPAAWDEGKPRIIT;EPAAWDEGKPRIITL;PAAWDEGKPRIITLT;AAWDEGKPRIITLTM;AWDEGKPRIITLTMN;WDEGKPRIITLTMNP;DEGKPRIITLTMNPA;EGKPRIITLTMNPAL;GKPRIITLTMNPALD;KPRIITLTMNPALDI;PRIITLTMNPALDIT;RIITLTMNPALDITT;IITLTMNPALDITTS;ITLTMNPALDITTSV;TLTMNPALDITTSVD;LTMNPALDITTSVDV;TMNPALDITTSVDVV;MNPALDITTSVDVVR;NPALDITTSVDVVRP;PALDITTSVDVVRPT;ALDITTSVDVVRPTE;LDITTSVDVVRPTEK;DITTSVDVVRPTEKM;ITTSVDVVRPTEKMR;TTSVDVVRPTEKMRC;TSVDVVRPTEKMRCG;SVDVVRPTEKMRCGA;VDVVRPTEKMRCGAP;DVVRPTEKMRCGAPR;VVRPTEKMRCGAPRY;VRPTEKMRCGAPRYD;RPTEKMRCGAPRYDP;PTEKMRCGAPRYDPG;TEKMRCGAPRYDPGG;EKMRCGAPRYDPGGG;KMRCGAPRYDPGGGG;MRCGAPRYDPGGGGI;RCGAPRYDPGGGGIN;CGAPRYDPGGGGINV;GAPRYDPGGGGINVA;APRYDPGGGGINVAR;PRYDPGGGGINVARI;RYDPGGGGINVARIV;YDPGGGGINVARIVH;DPGGGGINVARIVHV;PGGGGINVARIVHVL;GGGGINVARIVHVLG;GGGINVARIVHVLGG;GGINVARIVHVLGGC;GINVARIVHVLGGCS;INVARIVHVLGGCST;NVARIVHVLGGCSTA;VARIVHVLGGCSTAL;ARIVHVLGGCSTALF;RIVHVLGGCSTALFP;IVHVLGGCSTALFPA;VHVLGGCSTALFPAG;HVLGGCSTALFPAGG;VLGGCSTALFPAGGS;LGGCSTALFPAGGST;GGCSTALFPAGGSTG;GCSTALFPAGGSTGS;CSTALFPAGGSTGSL;STALFPAGGSTGSLL;TALFPAGGSTGSLLM;ALFPAGGSTGSLLMA;LFPAGGSTGSLLMAL;FPAGGSTGSLLMALL;PAGGSTGSLLMALLG;AGGSTGSLLMALLGD;GGSTGSLLMALLGDA;GSTGSLLMALLGDAG;STGSLLMALLGDAGV;TGSLLMALLGDAGVP;GSLLMALLGDAGVPF;SLLMALLGDAGVPFR;LLMALLGDAGVPFRV;LMALLGDAGVPFRVI;MALLGDAGVPFRVIP;ALLGDAGVPFRVIPI;LLGDAGVPFRVIPIA;LGDAGVPFRVIPIAA;GDAGVPFRVIPIAAS;DAGVPFRVIPIAAST;AGVPFRVIPIAASTR;GVPFRVIPIAASTRE;VPFRVIPIAASTRES;PFRVIPIAASTRESF;FRVIPIAASTRESFT;RVIPIAASTRESFTV;VIPIAASTRESFTVN;IPIAASTRESFTVNE;PIAASTRESFTVNES;IAASTRESFTVNESR;AASTRESFTVNESRT;ASTRESFTVNESRTA;STRESFTVNESRTAK;TRESFTVNESRTAKQ;RESFTVNESRTAKQY;ESFTVNESRTAKQYR;SFTVNESRTAKQYRF;FTVNESRTAKQYRFV;TVNESRTAKQYRFVL;VNESRTAKQYRFVLP;NESRTAKQYRFVLPG;ESRTAKQYRFVLPGP;SRTAKQYRFVLPGPS;RTAKQYRFVLPGPSL;TAKQYRFVLPGPSLT;AKQYRFVLPGPSLTV;KQYRFVLPGPSLTVA;QYRFVLPGPSLTVAE;YRFVL | |

Fig. 30 continued

| | | |
|---|---|---|
| | PGPSLTVAEQ;RFVLPGPSLTVAEQE;FVLPGPSLTVAEQEQ;VLPGPSLTVAEQEQC;LPGPSLTVAEQEQCL;PGPSLTVAEQEQCLD;GPSLTVAEQEQCLDE;PSLTVAEQEQCLDEL;SLTVAEQEQCLDELR;LTVAEQEQCLDELRG;TVAEQEQCLDELRGA;VAEQEQCLDELRGAA;AEQEQCLDELRGAAA;EQEQCLDELRGAAAS;QEQCLDELRGAAASA;EQCLDELRGAAASAA;QCLDELRGAAASAAF;CLDELRGAAASAAFV;LDELRGAAASAAFVV;DELRGAAASAAFVVA;ELRGAAASAAFVVAS;LRGAAASAAFVVASG;RGAAASAAFVVASGS;GAAASAAFVVASGSL;AAASAAFVVASGSLP;AASAAFVVASGSLPP;ASAAFVVASGSLPPG;SAAFVVASGSLPPGV;AAFVVASGSLPPGVA;AFVVASGSLPPGVAA;FVVASGSLPPGVAAD;VVASGSLPPGVAADY;VASGSLPPGVAADYY;ASGSLPPGVAADYYQ;SGSLPPGVAADYYQR;GSLPPGVAADYYQRV;SLPPGVAADYYQRVA;LPPGVAADYYQRVAD;PPGVAADYYQRVADI;PGVAADYYQRVADIC;GVAADYYQRVADICR;VAADYYQRVADICRR;AADYYQRVADICRRS;ADYYQRVADICRRSS;DYYQRVADICRRSST;YYQRVADICRRSSTP;YQRVADICRRSSTPL;QRVADICRRSSTPLI;RVADICRRSSTPLIL;VADICRRSSTPLILD;ADICRRSSTPLILDT;DICRRSSTPLILDTS;ICRRSSTPLILDTSG;CRRSSTPLILDTSGG;RRSSTPLILDTSGGG;RSSTPLILDTSGGGL;SSTPLILDTSGGGLQ;STPLILDTSGGGLQH;TPLILDTSGGGLQHI;PLILDTSGGGLQHIS;LILDTSGGGLQHISS;ILDTSGGGLQHISSG;LDTSGGGLQHISSGV;DTSGGGLQHISSGVF;TSGGGLQHISSGVFL;SGGGLQHISSGVFLL;GGGLQHISSGVFLLK;GGLQHISSGVFLLKA;GLQHISSGVFLLKAS;LQHISSGVFLLKASV;QHISSGVFLLKASVR;HISSGVFLLKASVRE;ISSGVFLLKASVREL;SSGVFLLKASVRELR;SGVFLLKASVRELRE;GVFLLKASVRELREC;VFLLKASVRELRECV;FLLKASVRELRECVG;LLKASVRELRECVGS;LKASVRELRECVGSE;KASVRELRECVGSEL;ASVRELRECVGSELL;SVRELRECVGSELLT;VRELRECVGSELLTE;RELRECVGSELLTEP;ELRECVGSELLTEPE;LRECVGSELLTEPEQ;RECVGSELLTEPEQL;ECVGSELLTEPEQLA;CVGSELLTEPEQLAA;VGSELLTEPEQLAAA;GSELLTEPEQLAAAH;SELLTEPEQLAAAHE;ELLTEPEQLAAAHEL;LLTEPEQLAAAHELI;LTEPEQLAAAHELID;TEPEQLAAAHELIDR;EPEQLAAAHELIDRG;PEQLAAAHELIDRGR;EQLAAAHELIDRGRA;QLAAAHELIDRGRAE;LAAAHELIDRGRAEV;AAAHELIDRGRAEVV;AAHELIDRGRAEVVV;AHELIDRGRAEVVVV;HELIDRGRAEVVVVS;ELIDRGRAEVVVVSL;LIDRGRAEVVVVSLG;IDRGRAEVVVVSLGS;DRGRAEVVVVSLGSQ;RGRAEVVVVSLGSQG;GRAEVVVVSLGSQGA;RAEVVVVSLGSQGAL;AEVVVVSLGSQGALL;EVVVVSLGSQGALLA;VVVVSLGSQGALLAT;VVVSLGSQGALLATR;VVSLGSQGALLATRH;VSLGSQGALLATRHA;SLGSQGALLATRHAS;LGSQGALLATRHASH;GSQGALLATRHASHR;SQGALLATRHASHRF;QGALLATRHASHRFS;GALLATRHASHRFSS;ALLATRHASHRFSSI;LLATRHASHRFSSIP;LATRHASHRFSSIPM;ATRHASHRFSSIPMT;TRHASHRFSSIPMTA;RHASHRFSSIPMTAV;HASHRFSSIPMTAVS;ASHRFSSIPMTAVSG;SHRFSSIPMTAVSGV;HRFSSIPMTAVSGVG;RFSSIPMTAVSGVGA;FSSIPMTAVSGVGAG;SSIPMTAVSGVGAGD;SIPMTAVSGVGAGDA;IPMTAVSGVGAGDAM;PMTAVSGVGAGDAMV;MTAVSGVGAGDAMVA;TAVSGVGAGDAMVAA;AVSGVGAGDAMVAAI;VSGVGAGDAMVAAIT;SGVGAGDAMVAAITV;GVGAGDAMVAAITVG;VGAGDAMVAAITVGL;GAGDAMVAAITVGLS;AGDAMVAAITVGLSR;GDAMVAAITVGLSRG;DAMVAAITVGLSRGW;AMVAAITVGLSRGWS;MVAAITVGLSRGWSL;VAAITVGLSRGWSLI;AAITVGLSRGWSLIK;AITVGLSRGWSLIKS;ITVGLSRGWSLIKSV;TVGLSRGWSLIKSVR;VGLSRGWSLIKSVRL;GLSRGWSLIKSVRLG;LSRGWSLIKSVRLGN;SRGWSLIKSVRLGNA;RGWSLIKSVRLGNAA;GWSLIKSVRLGNAAG;WSLIKSVRLGNAAGA;SLIKSVRLGNAAGAA;LIKSVRLGNAAGAAM;IKSVRLGNAAGAAML;KSVRLGNAAGAAMLL;SVRLGNAAGAAMLLT;VRLGNAAGAAMLLTP;RLGNAAGAAMLLTPG;LGNAAGAAMLLTPGT;GNAAGAAMLLTPGTA;NAAG | |

Fig. 30 continued

| | | |
|---|---|---|
| | AAMLLTPGTAA;AAGAAMLLTPGTAAC;AGAAMLLTPGTAACN;GAAMLLTPGTAACNR;AAMLLTPGTAACNRD;AMLLTPGTAACNRDD;MLLTPGTAACNRDDV;LLTPGTAACNRDDVE;LTPGTAACNRDDVER;TPGTAACNRDDVERF;PGTAACNRDDVERFF;GTAACNRDDVERFFE;TAACNRDDVERFFEL;AACNRDDVERFFELA;ACNRDDVERFFELAA;CNRDDVERFFELAAE;NRDDVERFFELAAEP;RDDVERFFELAAEPT;DDVERFFELAAEPTE;DVERFFELAAEPTEV;VERFFELAAEPTEVG;ERFFELAAEPTEVGQ;RFFELAAEPTEVGQD;FFELAAEPTEVGQDQ;FELAAEPTEVGQDQY;ELAAEPTEVGQDQYV;LAAEPTEVGQDQYVW;AAEPTEVGQDQYVWH;AEPTEVGQDQYVWHP;EPTEVGQDQYVWHPI;PTEVGQDQYVWHPIV;TEVGQDQYVWHPIVN;EVGQDQYVWHPIVNP;VGQDQYVWHPIVNPE;GQDQYVWHPIVNPEA;QDQYVWHPIVNPEAS;DQYVWHPIVNPEASP;<br><br>16 mers:<br>MTEPAAWDEGKPRIIT;TEPAAWDEGKPRIITL;EPAAWDEGKPRIITLT;PAAWDEGKPRIITLTM;AAWDEGKPRIITLTMN;AWDEGKPRIITLTMNP;WDEGKPRIITLTMNPA;DEGKPRIITLTMNPAL;EGKPRIITLTMNPALD;GKPRIITLTMNPALDI;KPRIITLTMNPALDIT;PRIITLTMNPALDITT;RIITLTMNPALDITTS;IITLTMNPALDITTSV;ITLTMNPALDITTSVD;TLTMNPALDITTSVDV;LTMNPALDITTSVDVV;TMNPALDITTSVDVVR;MNPALDITTSVDVVRP;NPALDITTSVDVVRPT;PALDITTSVDVVRPTE;ALDITTSVDVVRPTEK;LDITTSVDVVRPTEKM;DITTSVDVVRPTEKMR;ITTSVDVVRPTEKMRC;TTSVDVVRPTEKMRCG;TSVDVVRPTEKMRCGA;SVDVVRPTEKMRCGAP;VDVVRPTEKMRCGAPR;DVVRPTEKMRCGAPRY;VVRPTEKMRCGAPRYD;VRPTEKMRCGAPRYDP;RPTEKMRCGAPRYDPG;PTEKMRCGAPRYDPGG;TEKMRCGAPRYDPGGG;EKMRCGAPRYDPGGGG;KMRCGAPRYDPGGGGI;MRCGAPRYDPGGGGIN;RCGAPRYDPGGGGINV;CGAPRYDPGGGGINVA;GAPRYDPGGGGINVAR;APRYDPGGGGINVARI;PRYDPGGGGINVARIV;RYDPGGGGINVARIVH;YDPGGGGINVARIVHV;DPGGGGINVARIVHVL;PGGGGINVARIVHVLG;GGGGINVARIVHVLGG;GGGINVARIVHVLGGC;GGINVARIVHVLGGCS;GINVARIVHVLGGCST;INVARIVHVLGGCSTA;NVARIVHVLGGCSTAL;VARIVHVLGGCSTALF;ARIVHVLGGCSTALFP;RIVHVLGGCSTALFPA;IVHVLGGCSTALFPAG;VHVLGGCSTALFPAGG;HVLGGCSTALFPAGGS;VLGGCSTALFPAGGST;LGGCSTALFPAGGSTG;GGCSTALFPAGGSTGS;GCSTALFPAGGSTGSL;CSTALFPAGGSTGSLL;STALFPAGGSTGSLLM;TALFPAGGSTGSLLMA;ALFPAGGSTGSLLMAL;LFPAGGSTGSLLMALL;FPAGGSTGSLLMALLG;PAGGSTGSLLMALLGD;AGGSTGSLLMALLGDA;GGSTGSLLMALLGDAG;GSTGSLLMALLGDAGV;STGSLLMALLGDAGVP;TGSLLMALLGDAGVPF;GSLLMALLGDAGVPFR;SLLMALLGDAGVPFRV;LLMALLGDAGVPFRVI;LMALLGDAGVPFRVIP;MALLGDAGVPFRVIPI;ALLGDAGVPFRVIPIA;LLGDAGVPFRVIPIAA;LGDAGVPFRVIPIAAS;GDAGVPFRVIPIAAST;DAGVPFRVIPIAASTR;AGVPFRVIPIAASTRE;GVPFRVIPIAASTRES;VPFRVIPIAASTRESF;PFRVIPIAASTRESFT;FRVIPIAASTRESFTV;RVIPIAASTRESFTVN;VIPIAASTRESFTVNE;IPIAASTRESFTVNES;PIAASTRESFTVNESR;IAASTRESFTVNESRT;AASTRESFTVNESRTA;ASTRESFTVNESRTAK;STRESFTVNESRTAKQ;TRESFTVNESRTAKQY;RESFTVNESRTAKQYR;ESFTVNESRTAKQYRF;SFTVNESRTAKQYRFV;FTVNESRTAKQYRFVL;TVNESRTAKQYRFVLP;VNESRTAKQYRFVLPG;NESRTAKQYRFVLPGP;ESRTAKQYRFVLPGPS;SRTAKQYRFVLPGPSL;RTAKQYRFVLPGPSLT;TAKQYRFVLPGPSLTV;AKQYRFVLPGPSLTVA;KQYRFVLPGPSLTVAE;QYRFVLPGPSLTVAEQ;YRFVLPGPSLTVAEQE;RFVLPGPSLTVAEQEQ;FVLPGPSLTVAEQEQC;VLPGPSLTVAEQEQCL;LPGPSLTVAEQEQCLD;PGPSLTVAEQEQCLDE;GPSLTVAEQEQCLDEL;PSLTVAEQEQCLDELR;SLTVAEQEQCLDE | |

Fig. 30 continued

| | | |
|---|---|---|
| | LRG;LTVAEQEQCLDELRGA;TVAEQEQCLDELRGAA;VAEQEQCLDELRGAAA;AEQEQCLDELRGAAAS;EQEQCLDELRGAAASA;QEQCLDELRGAAASAA;EQCLDELRGAAASAAF;QCLDELRGAAASAAFV;CLDELRGAAASAAFVV;LDELRGAAASAAFVVA;DELRGAAASAAFVVAS;ELRGAAASAAFVVASG;LRGAAASAAFVVASGS;RGAAASAAFVVASGSL;GAAASAAFVVASGSLP;AAASAAFVVASGSLPP;AASAAFVVASGSLPPG;ASAAFVVASGSLPPGV;SAAFVVASGSLPPGVA;AAFVVASGSLPPGVAA;AFVVASGSLPPGVAAD;FVVASGSLPPGVAADY;VVASGSLPPGVAADYY;VASGSLPPGVAADYYQ;ASGSLPPGVAADYYQR;SGSLPPGVAADYYQRV;GSLPPGVAADYYQRVA;SLPPGVAADYYQRVAD;LPPGVAADYYQRVADI;PPGVAADYYQRVADIC;PGVAADYYQRVADICR;GVAADYYQRVADICRR;VAADYYQRVADICRRS;AADYYQRVADICRRSS;ADYYQRVADICRRSST;DYYQRVADICRRSSTP;YYQRVADICRRSSTPL;YQRVADICRRSSTPLI;QRVADICRRSSTPLIL;RVADICRRSSTPLILD;VADICRRSSTPLILDT;ADICRRSSTPLILDTS;DICRRSSTPLILDTSG;ICRRSSTPLILDTSGG;CRRSSTPLILDTSGGG;RRSSTPLILDTSGGGL;RSSTPLILDTSGGGLQ;SSTPLILDTSGGGLQH;STPLILDTSGGGLQHI;TPLILDTSGGGLQHIS;PLILDTSGGGLQHISS;LILDTSGGGLQHISSG;ILDTSGGGLQHISSGV;LDTSGGGLQHISSGVF;DTSGGGLQHISSGVFL;TSGGGLQHISSGVFLL;SGGGLQHISSGVFLLK;GGGLQHISSGVFLLKA;GGLQHISSGVFLLKAS;GLQHISSGVFLLKASV;LQHISSGVFLLKASVR;QHISSGVFLLKASVRE;HISSGVFLLKASVREL;ISSGVFLLKASVRELR;SSGVFLLKASVRELRE;SGVFLLKASVRELREC;GVFLLKASVRELRECV;VFLLKASVRELRECVG;FLLKASVRELRECVGS;LLKASVRELRECVGSE;LKASVRELRECVGSEL;KASVRELRECVGSELL;ASVRELRECVGSELLT;SVRELRECVGSELLTE;VRELRECVGSELLTEP;RELRECVGSELLTEPE;ELRECVGSELLTEPEQ;LRECVGSELLTEPEQL;RECVGSELLTEPEQLA;ECVGSELLTEPEQLAA;CVGSELLTEPEQLAAA;VGSELLTEPEQLAAAH;GSELLTEPEQLAAAHE;SELLTEPEQLAAAHEL;ELLTEPEQLAAAHELI;LLTEPEQLAAAHELID;LTEPEQLAAAHELIDR;TEPEQLAAAHELIDRG;EPEQLAAAHELIDRGR;PEQLAAAHELIDRGRA;EQLAAAHELIDRGRAE;QLAAAHELIDRGRAEV;LAAAHELIDRGRAEVV;AAAHELIDRGRAEVVV;AAHELIDRGRAEVVVV;AHELIDRGRAEVVVVS;HELIDRGRAEVVVVSL;ELIDRGRAEVVVVSLG;LIDRGRAEVVVVSLGS;IDRGRAEVVVVSLGSQ;DRGRAEVVVVSLGSQG;RGRAEVVVVSLGSQGA;GRAEVVVVSLGSQGAL;RAEVVVVSLGSQGALL;AEVVVVSLGSQGALLA;EVVVVSLGSQGALLAT;VVVVSLGSQGALLATR;VVVSLGSQGALLATRH;VVSLGSQGALLATRHA;VSLGSQGALLATRHAS;SLGSQGALLATRHASH;LGSQGALLATRHASHR;GSQGALLATRHASHRF;SQGALLATRHASHRFS;QGALLATRHASHRFSS;GALLATRHASHRFSSI;ALLATRHASHRFSSIP;LLATRHASHRFSSIPM;LATRHASHRFSSIPMT;ATRHASHRFSSIPMTA;TRHASHRFSSIPMTAV;RHASHRFSSIPMTAVS;HASHRFSSIPMTAVSG;ASHRFSSIPMTAVSGV;SHRFSSIPMTAVSGVG;HRFSSIPMTAVSGVGA;RFSSIPMTAVSGVGAG;FSSIPMTAVSGVGAGD;SSIPMTAVSGVGAGDA;SIPMTAVSGVGAGDAM;IPMTAVSGVGAGDAMV;PMTAVSGVGAGDAMVA;MTAVSGVGAGDAMVAA;TAVSGVGAGDAMVAAI;AVSGVGAGDAMVAAIT;VSGVGAGDAMVAAITV;SGVGAGDAMVAAITVG;GVGAGDAMVAAITVGL;VGAGDAMVAAITVGLS;GAGDAMVAAITVGLSR;AGDAMVAAITVGLSRG;GDAMVAAITVGLSRGW;DAMVAAITVGLSRGWS;AMVAAITVGLSRGWSL;MVAAITVGLSRGWSLI;VAAITVGLSRGWSLIK;AAITVGLSRGWSLIKS;AITVGLSRGWSLIKSV;ITVGLSRGWSLIKSVR;TVGLSRGWSLIKSVRL;VGLSRGWSLIKSVRLG;GLSRGWSLIKSVRLGN;LSRGWSLIKSVRLGNA;SRGWSLIKSVRLGNAA;RGWSLIKSVRLGNAAG;GWSLIKSVRLGNAAGA;WSLIKSVRLGNAAGAA;SLIKSVRLGNAAGAAM;LIKSVRLGNAAGAAML;IKSVRLGNAAGAAMLL;KSVRLGNAAGAAMLLT;SVRLGNAAGAAMLLTP;VRLGNAAGAAMLLTPG;RLGNAAGAAMLLTPGT; | |

Fig. 30 continued

| | | |
|---|---|---|
| | LGNAAGAAMLLTPGTA;GNAAGAAMLLTPGTAA;NAAGAAMLLTPGTAAC;AAGAAMLLTPGTAACN;AGAAMLLTPGTAACNR;GAAMLLTPGTAACNRD;AAMLLTPGTAACNRDD;AMLLTPGTAACNRDDV;MLLTPGTAACNRDDVE;LLTPGTAACNRDDVER;LTPGTAACNRDDVERF;TPGTAACNRDDVERFF;PGTAACNRDDVERFFE;GTAACNRDDVERFFEL;TAACNRDDVERFFELA;AACNRDDVERFFELAA;ACNRDDVERFFELAAE;CNRDDVERFFELAAEP;NRDDVERFFELAAEPT;RDDVERFFELAAEPTE;DDVERFFELAAEPTEV;DVERFFELAAEPTEVG;VERFFELAAEPTEVGQ;ERFFELAAEPTEVGQD;RFFELAAEPTEVGQDQ;FFELAAEPTEVGQDQY;FELAAEPTEVGQDQYV;ELAAEPTEVGQDQYVW;LAAEPTEVGQDQYVWH;AAEPTEVGQDQYVWHP;AEPTEVGQDQYVWHPI;EPTEVGQDQYVWHPIV;PTEVGQDQYVWHPIVN;TEVGQDQYVWHPIVNP;EVGQDQYVWHPIVNPE;VGQDQYVWHPIVNPEA;GQDQYVWHPIVNPEAS;QDQYVWHPIVNPEASP | |
| 27 | **<NP_217143.1 hypothetical protein Rv2627c;Mycobacterium tuberculosis H37Rv>**<br>MASSASDGTHERSAFRLSPPVLSGAMGPFMHTGLYVAQSWRDYLGQQPDKLPIARPTIALAAQAFRDEIVLLGLKARRPVSNHRVFERISQEVAAGLEFYGNRRWLEKPSGFFAQPPPLTEVAVRKVKDRRRSFYRIFFDSGFTPHPGEPGSQRWLSYTANNREYALLLRHPEPRPWLVCVHGTEMGRAPLDLAVFRAWKLHDELGLNIVMPVLPMHGPRGQGLPKGAVFPGEDVLDDVHGTAQAVWDIRRLLSWIRSQEEESLIGLNGLSLGGYIASLVASLEEGLACAILGVPVADLIELLGRHCGLRHKDPRRHTVKMAEPIGRMISPLSLTPLVPMPGRFIYAGIADRLVHPREQVTRLWEHWGKPEIVWYPGGHTGFFQSRPVRRFVQAALEQSGLLDAPRTQRDRSA<br><br>8mer<br>GTHERSAF;HERSAFRL;AFRLSPPV;FRLSPPVL;RLSPPVLS;SPPVLSGA;PPVLSGAM;VLSGAMGP;LSGAMGPF;AMGPFMHT;GPFMHTGL;PFMHTGLY;FMHTGLYV;MHTGLYVA;GLYVAQSW;LYVAQSWR;AQSWRDYL;QQPDKLPI;LPIARPTI;IARPTIAL;RPTIALAA;TIALAAQA;IALAAQAF;ALAAQAFR;AQAFRDEI;QAFRDEIV;FRDEIVLL;DEIVLLGL;EIVLLGLK;VLLGLKAR;LLGLKARR;GLKARRPV;RPVSNHRV;PVSNHRVF;SNHRVFER;FERISQEV;RISQEVAA;SQEVAAGL;EVAAGLEF;VAAGLEFY;GLEFYGNR;FYGNRRWL;GNRRWLEK;RRWLEKPS;LEKPSGFF;FFAQPPPL;QPPPLTEV;LTEVAVRK;EVAVRKVK;AVRKVKDR;KDRRRSFY;DRRRSFYR;RRRSFYRI;RRSFYRIF;RSFYRIFF;RIFFDSGF;GSQRWLSY;SQRWLSYT;QRWLSYTA;LSYTANNR;YTANNREY;REYALLLR;LLRHPEPR;HPEPRPWL;RPWLVCVH;WLVCVHGT;TEMGRAPL;RAPLDLAV;APLDLAVF;LAVFRAWK;AVFRAWKL;KLHDELGL;DELGLNIV;ELGLNIVM;GLNIVMPV;IVMPVLPM;MPVLPMHG;VLPMHGPR;AVFPGEDV;VFPGEDVL;VLDDVHGT;HGTAQAVW;QAVWDIRR;AVWDIRRL;RRLLSWIR;RLLSWIRS;LLSWIRSQ;SQEEESLI;EEESLIGL;SLIGLNGL;GLSLGGYI;SLGGYIAS;YIASLVAS;IASLVASL;SLEEGLAC;EEGLACAI;LACAILGV;CAILGVPV;AILGVPVA;PVADLIEL;DLIELLGR;LLGRHCGL;GLRHKDPR;KMAEPIGR;MAEPIGRM;RMISPLSL;MISPLSLT;SPLSLTPL;PLSLTPLV;SLTPLVPM;LVPMPGRF;VPMPGRFI;PMPGRFIY;MPGRFIYA;GRFIYAGI;IYAGIADR;ADRLVHPR;LVHPREQV;HPREQVTR;VTRLWEHW;RLWEHWGK;YPGGHTGF;HTGFFQSR;FFQSRPVR;FQSRPVRR;RPVRRFVQ;RRFVQAAL;AALEQSGL;ALEQSGLL;GLLDAPRT;LLDAPRTQ<br>9mer<br>MASSASDGT;SASDGTHER;GTHERSAFR;THERSAFRL;SAFRLSPPV;RLSPPVLSG;LSPPVLSGA;SPPVLSGAM;VLSGAMGPF;AMGPFMHTG;MGPFMHTGL;GPFMHTGLY;FMHTGLYVA;TGLYVAQSW;GLYVAQSWR;YVAQSWRDY;DYLGQQPDK;YLGQQPDKL;QQPDKLPIA;KLPIARPTI;LPIARPTIA;PIA | 161325-163469 |

Fig. 30 continued

| | | |
|---|---|---|
| | RPTIAL;IARPTIALA;RPTIALAAQ;TIALAAQAF;IALAAQAFR;AQAFRDEIV;IVLLGLKAR;VLLGLKARR;ARRPVSNHR;RPVSNHRVF;VSNHRVFER;VFERISQEV;QEVAAGLEF;EVAAGLEFY;EFYGNRRWL;YGNRRWLEK;RRWLEKPSG;RWLEKPSGF;AQPPPLTEV;AVRKVKDRR;KVKDRRRSF;KDRRRSFYR;RRRSFYRIF;RRSFYRIFF;RSFYRIFFD;YRIFFDSGF;FFDSGFTPH;GEPGSQRWL;SQRWLSYTA;QRWLSYTAN;WLSYTANNR;SYTANNREY;YTANNREYA;TANNREYAL;LLLRHPEPR;HPEPRPWLV;EPRPWLVCV;LVCVHGTEM;CVHGTEMGR;EMGRAPLDL;RAPLDLAVF;APLDLAVFR;PLDLAVFRA;DLAVFRAWK;LAVFRAWKL;RAWKLHDEL;WKLHDELGL;DELGLNIVM;LGLNIVMPV;GLNIVMPVL;NIVMPVLPM;IVMPVLPMH;MPVLPMHGP;PVLPMHGPR;GPRGQGLPK;GLPKGAVFP;LPKGAVFPG;AVFPGEDVL;DVLDDVHGT;VLDDVHGTA;DVHGTAQAV;TAQAVWDIR;AQAVWDIRR;AVWDIRRLL;DIRRLLSWI;RRLLSWIRS;RLLSWIRSQ;QEEESLIGL;ESLIGLNGL;SLIGLNGLS;GLSLGGYIA;SLGGYIASL;YIASLVASL;LVASLEEGL;SLEEGLACA;LEEGLACAI;EEGLACAIL;GLACAILGV;ILGVPVADL;VPVADLIEL;PVADLIELL;DLIELLGRH;ELLGRHCGL;LLGRHCGLR;GRHCGLRHK;GLRHKDPRR;HKDPRRHTV;DPRRHTVKM;RRHTVKMAE;HTVKMAEPI;KMAEPIGRM;PIGRMISPL;GRMISPLSL;RMISPLSLT;SPLSLTPLV;SLTPLVPMP;VPMPGRFIY;PMPGRFIYA;MPGRFIYAG;FIYAGIADR;IYAGIADRL;IADRLVHPR;RLVHPREQV;HPREQVTRL;QVTRLWEHW;WEHWGKPEI;WYPGGHTGF;YPGGHTGFF;TGFFQSRPV;GFFQSRPVR;FFQSRPVRR;FQSRPVRRF;QSRPVRRFV;RPVRRFVQA;RRFVQAALE;QAALEQSGL;AALEQSGLL;QSGLLDAPR;GLLDAPRTQ;LLDAPRTQR;APRTQRDRS<br>10mer<br>MASSASDGTH;SSASDGTHER;DGTHERSAFR;RSAFRLSPPV;RLSPPVLSGA;PVLSGAMGPF;VLSGAMGPFM;AMGPFMHTGL;FMHTGLYVAQ;HTGLYVAQSW;TGLYVAQSWR;YVAQSWRDYL;RDYLGQQPDK;DYLGQQPDKL;GQQPDKLPIA;KLPIARPTIA;LPIARPTIAL;RPTIALAAQA;PTIALAAQAF;TIALAAQAFR;LAAQAFRDEI;AQAFRDEIVL;QAFRDEIVLL;FRDEIVLLGL;EIVLLGLKAR;IVLLGLKARR;LLGLKARRPV;KARRPVSNHR;RRPVSNHRVF;RPVSNHRVFE;PVSNHRVFER;RVFERISQEV;RISQEVAAGL;SQEVAAGLEF;QEVAAGLEFY;AGLEFYGNRR;LEFYGNRRWL;EFYGNRRWLE;FYGNRRWLEK;RRWLEKPSGF;RWLEKPSGFF;WLEKPSGFFA;FAQPPPLTEV;AQPPPLTEVA;QPPPLTEVAV;PLTEVAVRKV;LTEVAVRKVK;EVAVRKVKDR;AVRKVKDRRR;KVKDRRRSFY;VKDRRRSFYR;RRRSFYRIFF;FYRIFFDSGF;EPGSQRWLSY;QRWLSYTANN;RWLSYTANNR;LSYTANNREY;YTANNREYAL;NNREYALLLR;ALLLRHPEPR;RHPEPRPWLV;EPRPWLVCVH;RPWLVCVHGT;WLVCVHGTEM;TEMGRAPLDL;MGRAPLDLAV;GRAPLDLAVF;RAPLDLAVFR;APLDLAVFRA;LDLAVFRAWK;DLAVFRAWKL;FRAWKLHDEL;KLHDELGLNI;ELGLNIVMPV;MPVLPMHGPR;VLPMHGPRGQ;PMHGPRGQGL;GQGLPKGAVF;FPGEDVLDDV;DVLDDVHGTA;VLDDVHGTAQ;GTAQAVWDIR;TAQAVWDIRR;AQAVWDIRRL;DIRRLLSWIR;RRLLSWIRSQ;WIRSQEEESL;SQEEESLIGL;EESLIGLNGL;SLIGLNGLSL;GLNGLSLGGY;GLSLGGYIAS;LSLGGYIASL;SLGGYIASLV;GYIASLVASL;SLVASLEEGL;LVASLEEGLA;SLEEGLACAI;LEEGLACAIL;EGLACAILGV;LACAILGVPV;AILGVPVADL;ILGVPVADLI;VPVADLIELL;IELLGRHCGL;ELLGRHCGLR;LGRHCGLRHK;RRHTVKMAEP;TVKMAEPIGR;KMAEPIGRMI;EPIGRMISPL;MISPLSLTPL;SLTPLVPMPG;LTPLVPMPGR;TPLVPMPGRF;PLVPMPGRFI;LVPMPGRFIY;VPMPGRFIYA;MPGRFIYAGI;RFIYAGIADR;FIYAGIADRL;IYAGIADRLV;GIADRLVHPR;LVHPREQVTR;HPREQVTRLW;VTRLWEHWGK;RLWEHWGKPE;WEHWGKPEIV;HWGKPEIVWY;VWYPGGHTGF;WYPGGHTGFF;HTGFFQSRPV;TGFFQSRPVR;GFFQSRPVRR;FFQSRPVRRF;FQSRPVRRFV;QSRPVRRFVQ;RPVRRFVQAA;RRFVQAALEQ;VQAALEQSGL;QAALEQSGLL;AL | |

Fig. 30 continued

| | | |
|---|---|---|
| | EQSGLLDA;EQSGLLDAPR;APRTQRDRSA<br>11mer<br>ASSASDGTHER;SASDGTHERSA;ERSAFRLSPPV;RSAFRLSPPVL;RLSPPVLSGAM;PPVLSGAMGPF;PVLSGAMGPFM;GAMGPFMHTGL;AMGPFMHTGLY;MGPFMHTGLYV;GPFMHTGLYVA;FMHTGLYVAQS;HTGLYVAQSWR;GLYVAQSWRDY;LYVAQSWRDYL;YLGQQPDKLPI;GQQPDKLPIAR;KLPIARPTIAL;LPIARPTIALA;RPTIALAAQAF;PTIALAAQAFR;ALAAQAFRDEI;LAAQAFRDEIV;AQAFRDEIVLL;DEIVLLGLKAR;EIVLLGLKARR;VLLGLKARRPV;KARRPVSNHRV;RPVSNHRVFER;HRVFERISQEV;RVFERISQEVA;ISQEVAAGLEF;SQEVAAGLEFY;EVAAGLEFYGN;VAAGLEFYGNR;GLEFYGNRRWL;EFYGNRRWLEK;RRWLEKPSGFF;WLEKPSGFFAQ;FFAQPPPLTEV;FAQPPPLTEVA;AQPPPLTEVAV;EVAVRKVKDRR;KVKDRRRSFYR;SFYRIFFDSGF;RIFFDSGFTPH;TPHPGEPGSQR;HPGEPGSQRWL;GEPGSQRWLSY;QRWLSYTANNR;WLSYTANNREY;SYTANNREYAL;YTANNREYALL;YALLLRHPEPR;LLLRHPEPRPW;LLRHPEPRPWL;HPEPRPWLVCV;LVCVHGTEMGR;EMGRAPLDLAV;APLDLAVFRAW;VFRAWKLHDEL;RAWKLHDELGL;WKLHDELGLNI;KLHDELGLNIV;LHDELGLNIVM;DELGLNIVMPV;ELGLNIVMPVL;GLNIVMPVLPM;VMPVLPMHGPR;MPVLPMHGPRG;LPMHGPRGQGL;VFPGEDVLDDV;FPGEDVLDDVH;VLDDVHGTAQA;HGTAQAVWDIR;GTAQAVWDIRR;AQAVWDIRRLL;VWDIRRLLSWI;RRLLSWIRSQE;RLLSWIRSQEE;EEESLIGLNGL;EESLIGLNGLS;GLNGLSLGGYI;GLSLGGYIASL;LSLGGYIASLV;SLGGYIASLVA;SLVASLEEGLA;SLEEGLACAIL;EEGLACAILGV;GLACAILGVPV;LACAILGVPVA;AILGVPVADLI;LLGRHCGLRHK;RHCGLRHKDPR;RHKDPRRHTVK;RRHTVKMAEPI;HTVKMAEPIGR;TVKMAEPIGRM;KMAEPIGRMIS;AEPIGRMISPL;EPIGRMISPLS;PIGRMISPLSL;RMISPLSLTPL;MISPLSLTPLV;SPLSLTPLVPM;SLTPLVPMPGR;TPLVPMPGRFI;PLVPMPGRFIY;VPMPGRFIYAG;PMPGRFIYAGI;MPGRFIYAGIA;GRFIYAGIADR;RFIYAGIADRL;FIYAGIADRLV;RLVHPREQVTR;LVHPREQVTRL;QVTRLWEHWGK;RLWEHWGKPEI;WEHWGKPEIVW;IVWYPGGHTGF;VWYPGGHTGFF;YPGGHTGFFQS;HTGFFQSRPVR;TGFFQSRPVRR;GFFQSRPVRRF;FFQSRPVRRFV;RPVRRFVQAAL;FVQAALEQSGL;VQAALEQSGLL<br><br>13 mers:<br>MASSASDGTHERS;ASSASDGTHERSA;SSASDGTHERSAF;SASDGTHERSAFR;ASDGTHERSAFRL;SDGTHERSAFRLS;DGTHERSAFRLSP;GTHERSAFRLSPP;THERSAFRLSPPV;HERSAFRLSPPVL;ERSAFRLSPPVLS;RSAFRLSPPVLSG;SAFRLSPPVLSGA;AFRLSPPVLSGAM;FRLSPPVLSGAMG;RLSPPVLSGAMGP;LSPPVLSGAMGPF;SPPVLSGAMGPFM;PPVLSGAMGPFMH;PVLSGAMGPFMHT;VLSGAMGPFMHTG;LSGAMGPFMHTGL;SGAMGPFMHTGLY;GAMGPFMHTGLYV;AMGPFMHTGLYVA;MGPFMHTGLYVAQ;GPFMHTGLYVAQS;PFMHTGLYVAQSW;FMHTGLYVAQSWR;MHTGLYVAQSWRD;HTGLYVAQSWRDY;TGLYVAQSWRDYL;GLYVAQSWRDYLG;LYVAQSWRDYLGQ;YVAQSWRDYLGQQ;VAQSWRDYLGQQP;AQSWRDYLGQQPD;QSWRDYLGQQPDK;SWRDYLGQQPDKL;WRDYLGQQPDKLP;RDYLGQQPDKLPI;DYLGQQPDKLPIA;YLGQQPDKLPIAR;LGQQPDKLPIARP;GQQPDKLPIARPT;QQPDKLPIARPTI;QPDKLPIARPTIA;PDKLPIARPTIAL;DKLPIARPTIALA;KLPIARPTIALAA;LPIARPTIALAAQ;PIARPTIALAAQA;IARPTIALAAQAF;ARPTIALAAQAFR;RPTIALAAQAFRD;PTIALAAQAFRDE;TIALAAQAFRDEI;IALAAQAFRDEIV;ALAAQAFRDEIVL;LAAQAFRDEIVLL;AAQAFRDEIVLLG;AQAFRDEIVLLGL;QAFRDEIVLLGLK;AFRDEIVLLGLKA;FRDEIVLLGLKAR;RDEIVLLGLKARR;DEIVLLGLKARRP;EIVLLGLKARRPV;IVLLGLKARRPVS;VLLGLKARRPVSN;LLGLKARRPVSNH;LGLKARRPV | |

Fig. 30 continued

| | | |
|---|---|---|
| | SNHR;GLKARRPVSNHRV;LKARRPVSNHRVF;KARRPVSNHRVFE;ARRPVSNHRVFER;RRPVSNHRVFERI;RPVSNHRVFERIS;PVSNHRVFERISQ;VSNHRVFERISQE;SNHRVFERISQEV;NHRVFERISQEVA;HRVFERISQEVAA;RVFERISQEVAAG;VFERISQEVAAGL;FERISQEVAAGLE;ERISQEVAAGLEF;RISQEVAAGLEFY;ISQEVAAGLEFYG;SQEVAAGLEFYGN;QEVAAGLEFYGNR;EVAAGLEFYGNRR;VAAGLEFYGNRRW;AAGLEFYGNRRWL;AGLEFYGNRRWLE;GLEFYGNRRWLEK;LEFYGNRRWLEKP;EFYGNRRWLEKPS;FYGNRRWLEKPSG;YGNRRWLEKPSGF;GNRRWLEKPSGFF;NRRWLEKPSGFFA;RRWLEKPSGFFAQ;RWLEKPSGFFAQP;WLEKPSGFFAQPP;LEKPSGFFAQPPP;EKPSGFFAQPPPL;KPSGFFAQPPPLT;PSGFFAQPPPLTE;SGFFAQPPPLTEV;GFFAQPPPLTEVA;FFAQPPPLTEVAV;FAQPPPLTEVAVR;AQPPPLTEVAVRK;QPPPLTEVAVRKV;PPPLTEVAVRKVK;PPLTEVAVRKVKD;PLTEVAVRKVKDR;LTEVAVRKVKDRR;TEVAVRKVKDRRR;EVAVRKVKDRRRS;VAVRKVKDRRRSF;AVRKVKDRRRSFY;VRKVKDRRRSFYR;RKVKDRRRSFYRI;KVKDRRRSFYRIF;VKDRRRSFYRIFF;KDRRRSFYRIFFD;DRRRSFYRIFFDS;RRRSFYRIFFDSG;RRSFYRIFFDSGF;RSFYRIFFDSGFT;SFYRIFFDSGFTP;FYRIFFDSGFTPH;YRIFFDSGFTPHP;RIFFDSGFTPHPG;IFFDSGFTPHPGE;FFDSGFTPHPGEP;FDSGFTPHPGEPG;DSGFTPHPGEPGS;SGFTPHPGEPGSQ;GFTPHPGEPGSQR;FTPHPGEPGSQRW;TPHPGEPGSQRWL;PHPGEPGSQRWLS;HPGEPGSQRWLSY;PGEPGSQRWLSYT;GEPGSQRWLSYTA;EPGSQRWLSYTAN;PGSQRWLSYTANN;GSQRWLSYTANNR;SQRWLSYTANNRE;QRWLSYTANNREY;RWLSYTANNREYA;WLSYTANNREYAL;LSYTANNREYALL;SYTANNREYALLL;YTANNREYALLLR;TANNREYALLLRH;ANNREYALLLRHP;NNREYALLLRHPE;NREYALLLRHPEP;REYALLLRHPEPR;EYALLLRHPEPRP;YALLLRHPEPRPW;ALLLRHPEPRPWL;LLLRHPEPRPWLV;LLRHPEPRPWLVC;LRHPEPRPWLVCV;RHPEPRPWLVCVH;HPEPRPWLVCVHG;PEPRPWLVCVHGT;EPRPWLVCVHGTE;PRPWLVCVHGTEM;RPWLVCVHGTEMG;PWLVCVHGTEMGR;WLVCVHGTEMGRA;LVCVHGTEMGRAP;VCVHGTEMGRAPL;CVHGTEMGRAPLD;VHGTEMGRAPLDL;HGTEMGRAPLDLA;GTEMGRAPLDLAV;TEMGRAPLDLAVF;EMGRAPLDLAVFR;MGRAPLDLAVFRA;GRAPLDLAVFRAW;RAPLDLAVFRAWK;APLDLAVFRAWKL;PLDLAVFRAWKLH;LDLAVFRAWKLHD;DLAVFRAWKLHDE;LAVFRAWKLHDEL;AVFRAWKLHDELG;VFRAWKLHDELGL;FRAWKLHDELGLN;RAWKLHDELGLNI;AWKLHDELGLNIV;WKLHDELGLNIVM;KLHDELGLNIVMP;LHDELGLNIVMPV;HDELGLNIVMPVL;DELGLNIVMPVLP;ELGLNIVMPVLPM;LGLNIVMPVLPMH;GLNIVMPVLPMHG;LNIVMPVLPMHGP;NIVMPVLPMHGPR;IVMPVLPMHGPRG;VMPVLPMHGPRGQ;MPVLPMHGPRGQG;PVLPMHGPRGQGL;VLPMHGPRGQGLP;LPMHGPRGQGLPK;PMHGPRGQGLPKG;MHGPRGQGLPKGA;HGPRGQGLPKGAV;GPRGQGLPKGAVF;PRGQGLPKGAVFP;RGQGLPKGAVFPG;GQGLPKGAVFPGE;QGLPKGAVFPGED;GLPKGAVFPGEDV;LPKGAVFPGEDVL;PKGAVFPGEDVLD;KGAVFPGEDVLDD;GAVFPGEDVLDDV;AVFPGEDVLDDVH;VFPGEDVLDDVHG;FPGEDVLDDVHGT;PGEDVLDDVHGTA;GEDVLDDVHGTAQ;EDVLDDVHGTAQA;DVLDDVHGTAQAV;VLDDVHGTAQAVW;LDDVHGTAQAVWD;DDVHGTAQAVWDI;DVHGTAQAVWDIR;VHGTAQAVWDIRR;HGTAQAVWDIRRL;GTAQAVWDIRRLL;TAQAVWDIRRLLS;AQAVWDIRRLLSW;QAVWDIRRLLSWI;AVWDIRRLLSWIR;VWDIRRLLSWIRS;WDIRRLLSWIRSQ;DIRRLLSWIRSQE;IRRLLSWIRSQEE;RRLLSWIRSQEEE;RLLSWIRSQEEES;LLSWIRSQEEESL;LSWIRSQEEESLI;SWIRSQEEESLIG;WIRSQEEESLIGL;IRSQEEESLIGLN;RSQEEESLIGLNG;SQEEESLIGLNGL;QEEESLIGLNGLS;EEESLIGLNGLSL;EESLIGLNGLSLG;ESLIGLNGLSLGG;SLIGLNGLSLGGY;LIGLNGLSLGGYI;IGLNGLSLGGYIA;GLNGLSLGGYIAS;LNGLSLGGYIASL;NGLSLGGYIASLV;GLSLGGYIASLVA;LSL | |

Fig. 30 continued

| | | |
|---|---|---|
| | GGYIASLVAS;SLGGYIASLVASL;LGGYIASLVASLE;GGYIASLVASLEE;GYIASLVASLEEG;YIASLVASLEEGL;IASLVASLEEGLA;ASLVASLEEGLAC;SLVASLEEGLACA;LVASLEEGLACAI;VASLEEGLACAIL;ASLEEGLACAILG;SLEEGLACAILGV;LEEGLACAILGVP;EEGLACAILGVPV;EGLACAILGVPVA;GLACAILGVPVAD;LACAILGVPVADL;ACAILGVPVADLI;CAILGVPVADLIE;AILGVPVADLIEL;ILGVPVADLIELL;LGVPVADLIELLG;GVPVADLIELLGR;VPVADLIELLGRH;PVADLIELLGRHC;VADLIELLGRHCG;ADLIELLGRHCGL;DLIELLGRHCGLR;LIELLGRHCGLRH;IELLGRHCGLRHK;ELLGRHCGLRHKD;LLGRHCGLRHKDP;LGRHCGLRHKDPR;GRHCGLRHKDPRR;RHCGLRHKDPRRH;HCGLRHKDPRRHT;CGLRHKDPRRHTV;GLRHKDPRRHTVK;LRHKDPRRHTVKM;RHKDPRRHTVKMA;HKDPRRHTVKMAE;KDPRRHTVKMAEP;DPRRHTVKMAEPI;PRRHTVKMAEPIG;RRHTVKMAEPIGR;RHTVKMAEPIGRM;HTVKMAEPIGRMI;TVKMAEPIGRMIS;VKMAEPIGRMISP;KMAEPIGRMISPL;MAEPIGRMISPLS;AEPIGRMISPLSL;EPIGRMISPLSLT;PIGRMISPLSLTP;IGRMISPLSLTPL;GRMISPLSLTPLV;RMISPLSLTPLVP;MISPLSLTPLVPM;ISPLSLTPLVPMP;SPLSLTPLVPMPG;PLSLTPLVPMPGR;LSLTPLVPMPGRF;SLTPLVPMPGRFI;LTPLVPMPGRFIY;TPLVPMPGRFIYA;PLVPMPGRFIYAG;LVPMPGRFIYAGI;VPMPGRFIYAGIA;PMPGRFIYAGIAD;MPGRFIYAGIADR;PGRFIYAGIADRL;GRFIYAGIADRLV;RFIYAGIADRLVH;FIYAGIADRLVHP;IYAGIADRLVHPR;YAGIADRLVHPRE;AGIADRLVHPREQ;GIADRLVHPREQV;IADRLVHPREQVT;ADRLVHPREQVTR;DRLVHPREQVTRL;RLVHPREQVTRLW;LVHPREQVTRLWE;VHPREQVTRLWEH;HPREQVTRLWEHW;PREQVTRLWEHWG;REQVTRLWEHWGK;EQVTRLWEHWGKP;QVTRLWEHWGKPE;VTRLWEHWGKPEI;TRLWEHWGKPEIV;RLWEHWGKPEIVW;LWEHWGKPEIVWY;WEHWGKPEIVWYP;EHWGKPEIVWYPG;HWGKPEIVWYPGG;WGKPEIVWYPGGH;GKPEIVWYPGGHT;KPEIVWYPGGHTG;PEIVWYPGGHTGF;EIVWYPGGHTGFF;IVWYPGGHTGFFQ;VWYPGGHTGFFQS;WYPGGHTGFFQSR;YPGGHTGFFQSRP;PGGHTGFFQSRPV;GGHTGFFQSRPVR;GHTGFFQSRPVRR;HTGFFQSRPVRRF;TGFFQSRPVRRFV;GFFQSRPVRRFVQ;FFQSRPVRRFVQA;FQSRPVRRFVQAA;QSRPVRRFVQAAL;SRPVRRFVQAALE;RPVRRFVQAALEQ;PVRRFVQAALEQS;VRRFVQAALEQSG;RRFVQAALEQSGL;RFVQAALEQSGLL;FVQAALEQSGLLD;VQAALEQSGLLDA;QAALEQSGLLDAP;AALEQSGLLDAPR;ALEQSGLLDAPRT;LEQSGLLDAPRTQ;EQSGLLDAPRTQR;QSGLLDAPRTQRD;SGLLDAPRTQRDR;GLLDAPRTQRDRS;LLDAPRTQRDRSA;<br>14 mers:<br>MASSASDGTHERSA;ASSASDGTHERSAF;SSASDGTHERSAFR;SASDGTHERSAFRL;ASDGTHERSAFRLS;SDGTHERSAFRLSP;DGTHERSAFRLSPP;GTHERSAFRLSPPV;THERSAFRLSPPVL;HERSAFRLSPPVLS;ERSAFRLSPPVLSG;RSAFRLSPPVLSGA;SAFRLSPPVLSGAM;AFRLSPPVLSGAMG;FRLSPPVLSGAMGP;RLSPPVLSGAMGPF;LSPPVLSGAMGPFM;SPPVLSGAMGPFMH;PPVLSGAMGPFMHT;PVLSGAMGPFMHTG;VLSGAMGPFMHTGL;LSGAMGPFMHTGLY;SGAMGPFMHTGLYV;GAMGPFMHTGLYVA;AMGPFMHTGLYVAQ;MGPFMHTGLYVAQS;GPFMHTGLYVAQSW;PFMHTGLYVAQSWR;FMHTGLYVAQSWRD;MHTGLYVAQSWRDY;HTGLYVAQSWRDYL;TGLYVAQSWRDYLG;GLYVAQSWRDYLGQ;LYVAQSWRDYLGQQ;YVAQSWRDYLGQQP;VAQSWRDYLGQQPD;AQSWRDYLGQQPDK;QSWRDYLGQQPDKL;SWRDYLGQQPDKLP;WRDYLGQQPDKLPI;RDYLGQQPDKLPIA;DYLGQQPDKLPIAR;YLGQQPDKLPIARP;LGQQPDKLPIARPT;GQQPDKLPIARPTI;QQPDKLPIARPTIA;QPDKLPIARPTIAL;PDKLPIARPTIALA;DKLPIARPTIALAA;KLPIARPTIALAAQ;LPIARPTIALAAQA;PIARPTIALAAQAF;IARPTIALAAQAFR;ARPTIALAAQAFRD;RPTIALAAQAFRDE;PTIALAAQAFRDEI;TIALAAQAFRDEIV;IALAAQAFRDEIVL;ALAAQAFRDEIVLL;LAAQAF | |

Fig. 30 continued

| | | |
|---|---|---|
| | RDEIVLLG;AAQAFRDEIVLLGL;AQAFRDEIVLLGLK;QAFRDEIVLLGLKA;AFRDEIVLLGLKAR;FRDEIVLLGLKARR;RDEIVLLGLKARRP;DEIVLLGLKARRPV;EIVLLGLKARRPVS;IVLLGLKARRPVSN;VLLGLKARRPVSNH;LLGLKARRPVSNHR;LGLKARRPVSNHRV;GLKARRPVSNHRVF;LKARRPVSNHRVFE;KARRPVSNHRVFER;ARRPVSNHRVFERI;RRPVSNHRVFERIS;RPVSNHRVFERISQ;PVSNHRVFERISQE;VSNHRVFERISQEV;SNHRVFERISQEVA;NHRVFERISQEVAA;HRVFERISQEVAAG;RVFERISQEVAAGL;VFERISQEVAAGLE;FERISQEVAAGLEF;ERISQEVAAGLEFY;RISQEVAAGLEFYG;ISQEVAAGLEFYGN;SQEVAAGLEFYGNR;QEVAAGLEFYGNRR;EVAAGLEFYGNRRW;VAAGLEFYGNRRWL;AAGLEFYGNRRWLE;AGLEFYGNRRWLEK;GLEFYGNRRWLEKP;LEFYGNRRWLEKPS;EFYGNRRWLEKPSG;FYGNRRWLEKPSGF;YGNRRWLEKPSGFF;GNRRWLEKPSGFFA;NRRWLEKPSGFFAQ;RRWLEKPSGFFAQP;RWLEKPSGFFAQPP;WLEKPSGFFAQPPP;LEKPSGFFAQPPPL;EKPSGFFAQPPPLT;KPSGFFAQPPPLTE;PSGFFAQPPPLTEV;SGFFAQPPPLTEVA;GFFAQPPPLTEVAV;FFAQPPPLTEVAVR;FAQPPPLTEVAVRK;AQPPPLTEVAVRKV;QPPPLTEVAVRKVK;PPPLTEVAVRKVKD;PPLTEVAVRKVKDR;PLTEVAVRKVKDRR;LTEVAVRKVKDRRR;TEVAVRKVKDRRRS;EVAVRKVKDRRRSF;VAVRKVKDRRRSFY;AVRKVKDRRRSFYR;VRKVKDRRRSFYRI;RKVKDRRRSFYRIF;KVKDRRRSFYRIFF;VKDRRRSFYRIFFD;KDRRRSFYRIFFDS;DRRRSFYRIFFDSG;RRRSFYRIFFDSGF;RRSFYRIFFDSGFT;RSFYRIFFDSGFTP;SFYRIFFDSGFTPH;FYRIFFDSGFTPHP;YRIFFDSGFTPHPG;RIFFDSGFTPHPGE;IFFDSGFTPHPGEP;FFDSGFTPHPGEPG;FDSGFTPHPGEPGS;DSGFTPHPGEPGSQ;SGFTPHPGEPGSQR;GFTPHPGEPGSQRW;FTPHPGEPGSQRWL;TPHPGEPGSQRWLS;PHPGEPGSQRWLSY;HPGEPGSQRWLSYT;PGEPGSQRWLSYTA;GEPGSQRWLSYTAN;EPGSQRWLSYTANN;PGSQRWLSYTANNR;GSQRWLSYTANNRE;SQRWLSYTANNREY;QRWLSYTANNREYA;RWLSYTANNREYAL;WLSYTANNREYALL;LSYTANNREYALLL;SYTANNREYALLLR;YTANNREYALLLRH;TANNREYALLLRHP;ANNREYALLLRHPE;NNREYALLLRHPEP;NREYALLLRHPEPR;REYALLLRHPEPRP;EYALLLRHPEPRPW;YALLLRHPEPRPWL;ALLLRHPEPRPWLV;LLLRHPEPRPWLVC;LLRHPEPRPWLVCV;LRHPEPRPWLVCVH;RHPEPRPWLVCVHG;HPEPRPWLVCVHGT;PEPRPWLVCVHGTE;EPRPWLVCVHGTEM;PRPWLVCVHGTEMG;RPWLVCVHGTEMGR;PWLVCVHGTEMGRA;WLVCVHGTEMGRAP;LVCVHGTEMGRAPL;VCVHGTEMGRAPLD;CVHGTEMGRAPLDL;VHGTEMGRAPLDLA;HGTEMGRAPLDLAV;GTEMGRAPLDLAVF;TEMGRAPLDLAVFR;EMGRAPLDLAVFRA;MGRAPLDLAVFRAW;GRAPLDLAVFRAWK;RAPLDLAVFRAWKL;APLDLAVFRAWKLH;PLDLAVFRAWKLHD;LDLAVFRAWKLHDE;DLAVFRAWKLHDEL;LAVFRAWKLHDELG;AVFRAWKLHDELGL;VFRAWKLHDELGLN;FRAWKLHDELGLNI;RAWKLHDELGLNIV;AWKLHDELGLNIVM;WKLHDELGLNIVMP;KLHDELGLNIVMPV;LHDELGLNIVMPVL;HDELGLNIVMPVLP;DELGLNIVMPVLPM;ELGLNIVMPVLPMH;LGLNIVMPVLPMHG;GLNIVMPVLPMHGP;LNIVMPVLPMHGPR;NIVMPVLPMHGPRG;IVMPVLPMHGPRGQ;VMPVLPMHGPRGQG;MPVLPMHGPRGQGL;PVLPMHGPRGQGLP;VLPMHGPRGQGLPK;LPMHGPRGQGLPKG;PMHGPRGQGLPKGA;MHGPRGQGLPKGAV;HGPRGQGLPKGAVF;GPRGQGLPKGAVFP;PRGQGLPKGAVFPG;RGQGLPKGAVFPGE;GQGLPKGAVFPGED;QGLPKGAVFPGEDV;GLPKGAVFPGEDVL;LPKGAVFPGEDVLD;PKGAVFPGEDVLDD;KGAVFPGEDVLDDV;GAVFPGEDVLDDVH;AVFPGEDVLDDVHG;VFPGEDVLDDVHGT;FPGEDVLDDVHGTA;PGEDVLDDVHGTAQ;GEDVLDDVHGTAQA;EDVLDDVHGTAQAV;DVLDDVHGTAQAVW;VLDDVHGTAQAVWD;LDDVHGTAQAVWDI;DDVHGTAQAVWDIR;DVHGTAQAVWDIRR;VHGTAQAVWDIRRL;HGTAQAVWDIRRLL;GTAQAVWDIRRLLS;TAQAVWDIRRLLSW;AQAVWDIRRLLS | |

Fig. 30 continued

| | | |
|---|---|---|
| | WI;QAVWDIRRLLSWIR;AVWDIRRLLSWIRS;VWDIRRLLSWIRSQ;WDIRRLLSWIRSQE;DIRRLLSWIRSQEE;IRRLLSWIRSQEEE;RRLLSWIRSQEEES;RLLSWIRSQEEESL;LLSWIRSQEEESLI;LSWIRSQEEESLIG;SWIRSQEEESLIGL;WIRSQEEESLIGLN;IRSQEEESLIGLNG;RSQEEESLIGLNGL;SQEEESLIGLNGLS;QEEESLIGLNGLSL;EEESLIGLNGLSLG;EESLIGLNGLSLGG;ESLIGLNGLSLGGY;SLIGLNGLSLGGYI;LIGLNGLSLGGYIA;IGLNGLSLGGYIAS;GLNGLSLGGYIASL;LNGLSLGGYIASLV;NGLSLGGYIASLVA;GLSLGGYIASLVAS;LSLGGYIASLVASL;SLGGYIASLVASLE;LGGYIASLVASLEE;GGYIASLVASLEEG;GYIASLVASLEEGL;YIASLVASLEEGLA;IASLVASLEEGLAC;ASLVASLEEGLACA;SLVASLEEGLACAI;LVASLEEGLACAIL;VASLEEGLACAILG;ASLEEGLACAILGV;SLEEGLACAILGVP;LEEGLACAILGVPV;EEGLACAILGVPVA;EGLACAILGVPVAD;GLACAILGVPVADL;LACAILGVPVADLI;ACAILGVPVADLIE;CAILGVPVADLIEL;AILGVPVADLIELL;ILGVPVADLIELLG;LGVPVADLIELLGR;GVPVADLIELLGRH;VPVADLIELLGRHC;PVADLIELLGRHCG;VADLIELLGRHCGL;ADLIELLGRHCGLR;DLIELLGRHCGLRH;LIELLGRHCGLRHK;IELLGRHCGLRHKD;ELLGRHCGLRHKDP;LLGRHCGLRHKDPR;LGRHCGLRHKDPRR;GRHCGLRHKDPRRH;RHCGLRHKDPRRHT;HCGLRHKDPRRHTV;CGLRHKDPRRHTVK;GLRHKDPRRHTVKM;LRHKDPRRHTVKMA;RHKDPRRHTVKMAE;HKDPRRHTVKMAEP;KDPRRHTVKMAEPI;DPRRHTVKMAEPIG;PRRHTVKMAEPIGR;RRHTVKMAEPIGRM;RHTVKMAEPIGRMI;HTVKMAEPIGRMIS;TVKMAEPIGRMISP;VKMAEPIGRMISPL;KMAEPIGRMISPLS;MAEPIGRMISPLSL;AEPIGRMISPLSLT;EPIGRMISPLSLTP;PIGRMISPLSLTPL;IGRMISPLSLTPLV;GRMISPLSLTPLVP;RMISPLSLTPLVPM;MISPLSLTPLVPMP;ISPLSLTPLVPMPG;SPLSLTPLVPMPGR;PLSLTPLVPMPGRF;LSLTPLVPMPGRFI;SLTPLVPMPGRFIY;LTPLVPMPGRFIYA;TPLVPMPGRFIYAG;PLVPMPGRFIYAGI;LVPMPGRFIYAGIA;VPMPGRFIYAGIAD;PMPGRFIYAGIADR;MPGRFIYAGIADRL;PGRFIYAGIADRLV;GRFIYAGIADRLVH;RFIYAGIADRLVHP;FIYAGIADRLVHPR;IYAGIADRLVHPRE;YAGIADRLVHPREQ;AGIADRLVHPREQV;GIADRLVHPREQVT;IADRLVHPREQVTR;ADRLVHPREQVTRL;DRLVHPREQVTRLW;RLVHPREQVTRLWE;LVHPREQVTRLWEH;VHPREQVTRLWEHW;HPREQVTRLWEHWG;PREQVTRLWEHWGK;REQVTRLWEHWGKP;EQVTRLWEHWGKPE;QVTRLWEHWGKPEI;VTRLWEHWGKPEIV;TRLWEHWGKPEIVW;RLWEHWGKPEIVWY;LWEHWGKPEIVWYP;WEHWGKPEIVWYPG;EHWGKPEIVWYPGG;HWGKPEIVWYPGGH;WGKPEIVWYPGGHT;GKPEIVWYPGGHTG;KPEIVWYPGGHTGF;PEIVWYPGGHTGFF;EIVWYPGGHTGFFQ;IVWYPGGHTGFFQS;VWYPGGHTGFFQSR;WYPGGHTGFFQSRP;YPGGHTGFFQSRPV;PGGHTGFFQSRPVR;GGHTGFFQSRPVRR;GHTGFFQSRPVRRF;HTGFFQSRPVRRFV;TGFFQSRPVRRFVQ;GFFQSRPVRRFVQA;FFQSRPVRRFVQAA;FQSRPVRRFVQAAL;QSRPVRRFVQAALE;SRPVRRFVQAALEQ;RPVRRFVQAALEQS;PVRRFVQAALEQSG;VRRFVQAALEQSGL;RRFVQAALEQSGLL;RFVQAALEQSGLLD;FVQAALEQSGLLDA;VQAALEQSGLLDAP;QAALEQSGLLDAPR;AALEQSGLLDAPRT;ALEQSGLLDAPRTQ;LEQSGLLDAPRTQR;EQSGLLDAPRTQRD;QSGLLDAPRTQRDR;SGLLDAPRTQRDRS;GLLDAPRTQRDRSA;<br>15 mers:<br>MASSASDGTHERSAF;ASSASDGTHERSAFR;SSASDGTHERSAFRL;SASDGTHERSAFRLS;ASDGTHERSAFRLSP;SDGTHERSAFRLSPP;DGTHERSAFRLSPPV;GTHERSAFRLSPPVL;THERSAFRLSPPVLS;HERSAFRLSPPVLSG;ERSAFRLSPPVLSGA;RSAFRLSPPVLSGAM;SAFRLSPPVLSGAMG;AFRLSPPVLSGAMGP;FRLSPPVLSGAMGPF;RLSPPVLSGAMGPFM;LSPPVLSGAMGPFMH;SPPVLSGAMGPFMHT;PPVLSGAMGPFMHTG;PVLSGAMGPFMHTGL;VLSGAMGPFMHTGLY;LSGAMGPFMHTGLYV;SGAMGPFM | |

Fig. 30 continued

| | | |
|---|---|---|
| | HTGLYVA;GAMGPFMHTGLYVAQ;AMGPFMHTGLYVAQS;MGPFMHTGLYVAQSW;GPFMHTGLYVAQSWR;PFMHTGLYVAQSWRD;FMHTGLYVAQSWRDY;MHTGLYVAQSWRDYL;HTGLYVAQSWRDYLG;TGLYVAQSWRDYLGQ;GLYVAQSWRDYLGQQ;LYVAQSWRDYLGQQP;YVAQSWRDYLGQQPD;VAQSWRDYLGQQPDK;AQSWRDYLGQQPDKL;QSWRDYLGQQPDKLP;SWRDYLGQQPDKLPI;WRDYLGQQPDKLPIA;RDYLGQQPDKLPIAR;DYLGQQPDKLPIARP;YLGQQPDKLPIARPT;LGQQPDKLPIARPTI;GQQPDKLPIARPTIA;QQPDKLPIARPTIAL;QPDKLPIARPTIALA;PDKLPIARPTIALAA;DKLPIARPTIALAAQ;KLPIARPTIALAAQA;LPIARPTIALAAQAF;PIARPTIALAAQAFR;IARPTIALAAQAFRD;ARPTIALAAQAFRDE;RPTIALAAQAFRDEI;PTIALAAQAFRDEIV;TIALAAQAFRDEIVL;IALAAQAFRDEIVLL;ALAAQAFRDEIVLLG;LAAQAFRDEIVLLGL;AAQAFRDEIVLLGLK;AQAFRDEIVLLGLKA;QAFRDEIVLLGLKAR;AFRDEIVLLGLKARR;FRDEIVLLGLKARRP;RDEIVLLGLKARRPV;DEIVLLGLKARRPVS;EIVLLGLKARRPVSN;IVLLGLKARRPVSNH;VLLGLKARRPVSNHR;LLGLKARRPVSNHRV;LGLKARRPVSNHRVF;GLKARRPVSNHRVFE;LKARRPVSNHRVFER;KARRPVSNHRVFERI;ARRPVSNHRVFERIS;RRPVSNHRVFERISQ;RPVSNHRVFERISQE;PVSNHRVFERISQEV;VSNHRVFERISQEVA;SNHRVFERISQEVAA;NHRVFERISQEVAAG;HRVFERISQEVAAGL;RVFERISQEVAAGLE;VFERISQEVAAGLEF;FERISQEVAAGLEFY;ERISQEVAAGLEFYG;RISQEVAAGLEFYGN;ISQEVAAGLEFYGNR;SQEVAAGLEFYGNRR;QEVAAGLEFYGNRRW;EVAAGLEFYGNRRWL;VAAGLEFYGNRRWLE;AAGLEFYGNRRWLEK;AGLEFYGNRRWLEKP;GLEFYGNRRWLEKPS;LEFYGNRRWLEKPSG;EFYGNRRWLEKPSGF;FYGNRRWLEKPSGFF;YGNRRWLEKPSGFFA;GNRRWLEKPSGFFAQ;NRRWLEKPSGFFAQP;RRWLEKPSGFFAQPP;RWLEKPSGFFAQPPP;WLEKPSGFFAQPPPL;LEKPSGFFAQPPPLT;EKPSGFFAQPPPLTE;KPSGFFAQPPPLTEV;PSGFFAQPPPLTEVA;SGFFAQPPPLTEVAV;GFFAQPPPLTEVAVR;FFAQPPPLTEVAVRK;FAQPPPLTEVAVRKV;AQPPPLTEVAVRKVK;QPPPLTEVAVRKVKD;PPPLTEVAVRKVKDR;PPLTEVAVRKVKDRR;PLTEVAVRKVKDRRR;LTEVAVRKVKDRRRS;TEVAVRKVKDRRRSF;EVAVRKVKDRRRSFY;VAVRKVKDRRRSFYR;AVRKVKDRRRSFYRI;VRKVKDRRRSFYRIF;RKVKDRRRSFYRIFF;KVKDRRRSFYRIFFD;VKDRRRSFYRIFFDS;KDRRRSFYRIFFDSG;DRRRSFYRIFFDSGF;RRRSFYRIFFDSGFT;RRSFYRIFFDSGFTP;RSFYRIFFDSGFTPH;SFYRIFFDSGFTPHP;FYRIFFDSGFTPHPG;YRIFFDSGFTPHPGE;RIFFDSGFTPHPGEP;IFFDSGFTPHPGEPG;FFDSGFTPHPGEPGS;FDSGFTPHPGEPGSQ;DSGFTPHPGEPGSQR;SGFTPHPGEPGSQRW;GFTPHPGEPGSQRWL;FTPHPGEPGSQRWLS;TPHPGEPGSQRWLSY;PHPGEPGSQRWLSYT;HPGEPGSQRWLSYTA;PGEPGSQRWLSYTAN;GEPGSQRWLSYTANN;EPGSQRWLSYTANNR;PGSQRWLSYTANNRE;GSQRWLSYTANNREY;SQRWLSYTANNREYA;QRWLSYTANNREYAL;RWLSYTANNREYALL;WLSYTANNREYALLL;LSYTANNREYALLLR;SYTANNREYALLLRH;YTANNREYALLLRHP;TANNREYALLLRHPE;ANNREYALLLRHPEP;NNREYALLLRHPEPR;NREYALLLRHPEPRP;REYALLLRHPEPRPW;EYALLLRHPEPRPWL;YALLLRHPEPRPWLV;ALLLRHPEPRPWLVC;LLLRHPEPRPWLVCV;LLRHPEPRPWLVCVH;LRHPEPRPWLVCVHG;RHPEPRPWLVCVHGT;HPEPRPWLVCVHGTE;PEPRPWLVCVHGTEM;EPRPWLVCVHGTEMG;PRPWLVCVHGTEMGR;RPWLVCVHGTEMGRA;PWLVCVHGTEMGRAP;WLVCVHGTEMGRAPL;LVCVHGTEMGRAPLD;VCVHGTEMGRAPLDL;CVHGTEMGRAPLDLA;VHGTEMGRAPLDLAV;HGTEMGRAPLDLAVF;GTEMGRAPLDLAVFR;TEMGRAPLDLAVFRA;EMGRAPLDLAVFRAW;MGRAPLDLAVFRAWK;GRAPLDLAVFRAWKL;RAPLDLAVFRAWKLH;APLDLAVFRAWKLHD;PLDLAVFRAWKLHDE;LDLAVFRAWKLHDEL;DLAVFRAWKLHDELG;LAVFRAWKLHDELGL;AVFRAWKLHDELGLN;VFRAWKLHDELGLNI;FRA | |

Fig. 30 continued

| | | |
|---|---|---|
| | WKLHDELGLNIV;RAWKLHDELGLNIVM;AWKLHDELGLNIVMP;WKLHDELGLNIVMPV;KLHDELGLNIVMPVL;LHDELGLNIVMPVLP;HDELGLNIVMPVLPM;DELGLNIVMPVLPMH;ELGLNIVMPVLPMHG;LGLNIVMPVLPMHGP;GLNIVMPVLPMHGPR;LNIVMPVLPMHGPRG;NIVMPVLPMHGPRGQ;IVMPVLPMHGPRGQG;VMPVLPMHGPRGQGL;MPVLPMHGPRGQGLP;PVLPMHGPRGQGLPK;VLPMHGPRGQGLPKG;LPMHGPRGQGLPKGA;PMHGPRGQGLPKGAV;MHGPRGQGLPKGAVF;HGPRGQGLPKGAVFP;GPRGQGLPKGAVFPG;PRGQGLPKGAVFPGE;RGQGLPKGAVFPGED;GQGLPKGAVFPGEDV;QGLPKGAVFPGEDVL;GLPKGAVFPGEDVLD;LPKGAVFPGEDVLDD;PKGAVFPGEDVLDDV;KGAVFPGEDVLDDVH;GAVFPGEDVLDDVHG;AVFPGEDVLDDVHGT;VFPGEDVLDDVHGTA;FPGEDVLDDVHGTAQ;PGEDVLDDVHGTAQA;GEDVLDDVHGTAQAV;EDVLDDVHGTAQAVW;DVLDDVHGTAQAVWD;VLDDVHGTAQAVWDI;LDDVHGTAQAVWDIR;DDVHGTAQAVWDIRR;DVHGTAQAVWDIRRL;VHGTAQAVWDIRRLL;HGTAQAVWDIRRLLS;GTAQAVWDIRRLLSW;TAQAVWDIRRLLSWI;AQAVWDIRRLLSWIR;QAVWDIRRLLSWIRS;AVWDIRRLLSWIRSQ;VWDIRRLLSWIRSQE;WDIRRLLSWIRSQEE;DIRRLLSWIRSQEEE;IRRLLSWIRSQEEES;RRLLSWIRSQEEESL;RLLSWIRSQEEESLI;LLSWIRSQEEESLIG;LSWIRSQEEESLIGL;SWIRSQEEESLIGLN;WIRSQEEESLIGLNG;IRSQEEESLIGLNGL;RSQEEESLIGLNGLS;SQEEESLIGLNGLSL;QEEESLIGLNGLSLG;EEESLIGLNGLSLGG;EESLIGLNGLSLGGY;ESLIGLNGLSLGGYI;SLIGLNGLSLGGYIA;LIGLNGLSLGGYIAS;IGLNGLSLGGYIASL;GLNGLSLGGYIASLV;LNGLSLGGYIASLVA;NGLSLGGYIASLVAS;GLSLGGYIASLVASL;LSLGGYIASLVASLE;SLGGYIASLVASLEE;LGGYIASLVASLEEG;GGYIASLVASLEEGL;GYIASLVASLEEGLA;YIASLVASLEEGLAC;IASLVASLEEGLACA;ASLVASLEEGLACAI;SLVASLEEGLACAIL;LVASLEEGLACAILG;VASLEEGLACAILGV;ASLEEGLACAILGVP;SLEEGLACAILGVPV;LEEGLACAILGVPVA;EEGLACAILGVPVAD;EGLACAILGVPVADL;GLACAILGVPVADLI;LACAILGVPVADLIE;ACAILGVPVADLIEL;CAILGVPVADLIELL;AILGVPVADLIELLG;ILGVPVADLIELLGR;LGVPVADLIELLGRH;GVPVADLIELLGRHC;VPVADLIELLGRHCG;PVADLIELLGRHCGL;VADLIELLGRHCGLR;ADLIELLGRHCGLRH;DLIELLGRHCGLRHK;LIELLGRHCGLRHKD;IELLGRHCGLRHKDP;ELLGRHCGLRHKDPR;LLGRHCGLRHKDPRR;LGRHCGLRHKDPRRH;GRHCGLRHKDPRRHT;RHCGLRHKDPRRHTV;HCGLRHKDPRRHTVK;CGLRHKDPRRHTVKM;GLRHKDPRRHTVKMA;LRHKDPRRHTVKMAE;RHKDPRRHTVKMAEP;HKDPRRHTVKMAEPI;KDPRRHTVKMAEPIG;DPRRHTVKMAEPIGR;PRRHTVKMAEPIGRM;RRHTVKMAEPIGRMI;RHTVKMAEPIGRMIS;HTVKMAEPIGRMISP;TVKMAEPIGRMISPL;VKMAEPIGRMISPLS;KMAEPIGRMISPLSL;MAEPIGRMISPLSLT;AEPIGRMISPLSLTP;EPIGRMISPLSLTPL;PIGRMISPLSLTPLV;IGRMISPLSLTPLVP;GRMISPLSLTPLVPM;RMISPLSLTPLVPMP;MISPLSLTPLVPMPG;ISPLSLTPLVPMPGR;SPLSLTPLVPMPGRF;PLSLTPLVPMPGRFI;LSLTPLVPMPGRFIY;SLTPLVPMPGRFIYA;LTPLVPMPGRFIYAG;TPLVPMPGRFIYAGI;PLVPMPGRFIYAGIA;LVPMPGRFIYAGIAD;VPMPGRFIYAGIADR;PMPGRFIYAGIADRL;MPGRFIYAGIADRLV;PGRFIYAGIADRLVH;GRFIYAGIADRLVHP;RFIYAGIADRLVHPR;FIYAGIADRLVHPRE;IYAGIADRLVHPREQ;YAGIADRLVHPREQV;AGIADRLVHPREQVT;GIADRLVHPREQVTR;IADRLVHPREQVTRL;ADRLVHPREQVTRLW;DRLVHPREQVTRLWE;RLVHPREQVTRLWEH;LVHPREQVTRLWEHW;VHPREQVTRLWEHWG;HPREQVTRLWEHWGK;PREQVTRLWEHWGKP;REQVTRLWEHWGKPE;EQVTRLWEHWGKPEI;QVTRLWEHWGKPEIV;VTRLWEHWGKPEIVW;TRLWEHWGKPEIVWY;RLWEHWGKPEIVWYP;LWEHWGKPEIVWYPG;WEHWGKPEIVWYPGG;EHWGKPEIVWYPGGH;HWGKPEIVWYPGGHT;WGKPEIVWYPGGHTG;GKPEIVWYPGGHTGF;KPEIVWYPGGHTGFF;PEIVWYPGGHTGFFQ;EIVWYPGGH | |

Fig. 30 continued

| | | |
|---|---|---|
| | TGFFQS;IVWYPGGHTGFFQSR;VWYPGGHTGFFQSRP;WYPGGHTGFFQSRPV;YPGGHTGFFQSRPVR;PGGHTGFFQSRPVRR;GGHTGFFQSRPVRRF;GHTGFFQSRPVRRFV;HTGFFQSRPVRRFVQ;TGFFQSRPVRRFVQA;GFFQSRPVRRFVQAA;FFQSRPVRRFVQAAL;FQSRPVRRFVQAALE;QSRPVRRFVQAALEQ;SRPVRRFVQAALEQS;RPVRRFVQAALEQSG;PVRRFVQAALEQSGL;VRRFVQAALEQSGLL;RRFVQAALEQSGLLD;RFVQAALEQSGLLDA;FVQAALEQSGLLDAP;VQAALEQSGLLDAPR;QAALEQSGLLDAPRT;AALEQSGLLDAPRTQ;ALEQSGLLDAPRTQR;LEQSGLLDAPRTQRD;EQSGLLDAPRTQRDR;QSGLLDAPRTQRDRS;SGLLDAPRTQRDRSA;<br>16 mers:<br>MASSASDGTHERSAFR;ASSASDGTHERSAFRL;SSASDGTHERSAFRLS;SASDGTHERSAFRLSP;ASDGTHERSAFRLSPP;SDGTHERSAFRLSPPV;DGTHERSAFRLSPPVL;GTHERSAFRLSPPVLS;THERSAFRLSPPVLSG;HERSAFRLSPPVLSGA;ERSAFRLSPPVLSGAM;RSAFRLSPPVLSGAMG;SAFRLSPPVLSGAMGP;AFRLSPPVLSGAMGPF;FRLSPPVLSGAMGPFM;RLSPPVLSGAMGPFMH;LSPPVLSGAMGPFMHT;SPPVLSGAMGPFMHTG;PPVLSGAMGPFMHTGL;PVLSGAMGPFMHTGLY;VLSGAMGPFMHTGLYV;LSGAMGPFMHTGLYVA;SGAMGPFMHTGLYVAQ;GAMGPFMHTGLYVAQS;AMGPFMHTGLYVAQSW;MGPFMHTGLYVAQSWR;GPFMHTGLYVAQSWRD;PFMHTGLYVAQSWRDY;FMHTGLYVAQSWRDYL;MHTGLYVAQSWRDYLG;HTGLYVAQSWRDYLGQ;TGLYVAQSWRDYLGQQ;GLYVAQSWRDYLGQQP;LYVAQSWRDYLGQQPD;YVAQSWRDYLGQQPDK;VAQSWRDYLGQQPDKL;AQSWRDYLGQQPDKLP;QSWRDYLGQQPDKLPI;SWRDYLGQQPDKLPIA;WRDYLGQQPDKLPIAR;RDYLGQQPDKLPIARP;DYLGQQPDKLPIARPT;YLGQQPDKLPIARPTI;LGQQPDKLPIARPTIA;GQQPDKLPIARPTIAL;QQPDKLPIARPTIALA;QPDKLPIARPTIALAA;PDKLPIARPTIALAAQ;DKLPIARPTIALAAQA;KLPIARPTIALAAQAF;LPIARPTIALAAQAFR;PIARPTIALAAQAFRD;IARPTIALAAQAFRDE;ARPTIALAAQAFRDEI;RPTIALAAQAFRDEIV;PTIALAAQAFRDEIVL;TIALAAQAFRDEIVLL;IALAAQAFRDEIVLLG;ALAAQAFRDEIVLLGL;LAAQAFRDEIVLLGLK;AAQAFRDEIVLLGLKA;AQAFRDEIVLLGLKAR;QAFRDEIVLLGLKARR;AFRDEIVLLGLKARRP;FRDEIVLLGLKARRPV;RDEIVLLGLKARRPVS;DEIVLLGLKARRPVSN;EIVLLGLKARRPVSNH;IVLLGLKARRPVSNHR;VLLGLKARRPVSNHRV;LLGLKARRPVSNHRVF;LGLKARRPVSNHRVFE;GLKARRPVSNHRVFER;LKARRPVSNHRVFERI;KARRPVSNHRVFERIS;ARRPVSNHRVFERISQ;RRPVSNHRVFERISQE;RPVSNHRVFERISQEV;PVSNHRVFERISQEVA;VSNHRVFERISQEVAA;SNHRVFERISQEVAAG;NHRVFERISQEVAAGL;HRVFERISQEVAAGLE;RVFERISQEVAAGLEF;VFERISQEVAAGLEFY;FERISQEVAAGLEFYG;ERISQEVAAGLEFYGN;RISQEVAAGLEFYGNR;ISQEVAAGLEFYGNRR;SQEVAAGLEFYGNRRW;QEVAAGLEFYGNRRWL;EVAAGLEFYGNRRWLE;VAAGLEFYGNRRWLEK;AAGLEFYGNRRWLEKP;AGLEFYGNRRWLEKPS;GLEFYGNRRWLEKPSG;LEFYGNRRWLEKPSGF;EFYGNRRWLEKPSGFF;FYGNRRWLEKPSGFFA;YGNRRWLEKPSGFFAQ;GNRRWLEKPSGFFAQP;NRRWLEKPSGFFAQPP;RRWLEKPSGFFAQPPP;RWLEKPSGFFAQPPPL;WLEKPSGFFAQPPPLT;LEKPSGFFAQPPPLTE;EKPSGFFAQPPPLTEV;KPSGFFAQPPPLTEVA;PSGFFAQPPPLTEVAV;SGFFAQPPPLTEVAVR;GFFAQPPPLTEVAVRK;FFAQPPPLTEVAVRKV;FAQPPPLTEVAVRKVK;AQPPPLTEVAVRKVKD;QPPPLTEVAVRKVKDR;PPPLTEVAVRKVKDRR;PPLTEVAVRKVKDRRR;PLTEVAVRKVKDRRRS;LTEVAVRKVKDRRRSF;TEVAVRKVKDRRRSFY;EVAVRKVKDRRRSFYR;VAVRKVKDRRRSFYRI;AVRKVKDRRRSFYRIF;VRKVKDRRRSFYRIFF;RKVKDRRRSFYRIFFD;KVKDRRRSFYRIFFDS;VKDRRRSFYRIFFDSG;KDRRRSFYRIFFDSGF;DRRRSFYRIFFDSGFT;RRRSFYRIFFDSGFTP;RRSFYRIFFDSGFTPH;RSFYRIFFDSGFTPHP;SFYR | |

Fig. 30 continued

| | | |
|---|---|---|
| | IFFDSGFTPHPG;FYRIFFDSGFTPHPGE;YRIFFDSGFTPHPGEP;RIFFDSGFTPHPGEPG;IFFDSGFTPHPGEPGS;FFDSGFTPHPGEPGSQ;FDSGFTPHPGEPGSQR;DSGFTPHPGEPGSQRW;SGFTPHPGEPGSQRWL;GFTPHPGEPGSQRWLS;FTPHPGEPGSQRWLSY;TPHPGEPGSQRWLSYT;PHPGEPGSQRWLSYTA;HPGEPGSQRWLSYTAN;PGEPGSQRWLSYTANN;GEPGSQRWLSYTANNR;EPGSQRWLSYTANNRE;PGSQRWLSYTANNREY;GSQRWLSYTANNREYA;SQRWLSYTANNREYAL;QRWLSYTANNREYALL;RWLSYTANNREYALLL;WLSYTANNREYALLLR;LSYTANNREYALLLRH;SYTANNREYALLLRHP;YTANNREYALLLRHPE;TANNREYALLLRHPEP;ANNREYALLLRHPEPR;NNREYALLLRHPEPRP;NREYALLLRHPEPRPW;REYALLLRHPEPRPWL;EYALLLRHPEPRPWLV;YALLLRHPEPRPWLVC;ALLLRHPEPRPWLVCV;LLLRHPEPRPWLVCVH;LLRHPEPRPWLVCVHG;LRHPEPRPWLVCVHGT;RHPEPRPWLVCVHGTE;HPEPRPWLVCVHGTEM;PEPRPWLVCVHGTEMG;EPRPWLVCVHGTEMGR;PRPWLVCVHGTEMGRA;RPWLVCVHGTEMGRAP;PWLVCVHGTEMGRAPL;WLVCVHGTEMGRAPLD;LVCVHGTEMGRAPLDL;VCVHGTEMGRAPLDLA;CVHGTEMGRAPLDLAV;VHGTEMGRAPLDLAVF;HGTEMGRAPLDLAVFR;GTEMGRAPLDLAVFRA;TEMGRAPLDLAVFRAW;EMGRAPLDLAVFRAWK;MGRAPLDLAVFRAWKL;GRAPLDLAVFRAWKLH;RAPLDLAVFRAWKLHD;APLDLAVFRAWKLHDE;PLDLAVFRAWKLHDEL;LDLAVFRAWKLHDELG;DLAVFRAWKLHDELGL;LAVFRAWKLHDELGLN;AVFRAWKLHDELGLNI;VFRAWKLHDELGLNIV;FRAWKLHDELGLNIVM;RAWKLHDELGLNIVMP;AWKLHDELGLNIVMPV;WKLHDELGLNIVMPVL;KLHDELGLNIVMPVLP;LHDELGLNIVMPVLPM;HDELGLNIVMPVLPMH;DELGLNIVMPVLPMHG;ELGLNIVMPVLPMHGP;LGLNIVMPVLPMHGPR;GLNIVMPVLPMHGPRG;LNIVMPVLPMHGPRGQ;NIVMPVLPMHGPRGQG;IVMPVLPMHGPRGQGL;VMPVLPMHGPRGQGLP;MPVLPMHGPRGQGLPK;PVLPMHGPRGQGLPKG;VLPMHGPRGQGLPKGA;LPMHGPRGQGLPKGAV;PMHGPRGQGLPKGAVF;MHGPRGQGLPKGAVFP;HGPRGQGLPKGAVFPG;GPRGQGLPKGAVFPGE;PRGQGLPKGAVFPGED;RGQGLPKGAVFPGEDV;GQGLPKGAVFPGEDVL;QGLPKGAVFPGEDVLD;GLPKGAVFPGEDVLDD;LPKGAVFPGEDVLDDV;PKGAVFPGEDVLDDVH;KGAVFPGEDVLDDVHG;GAVFPGEDVLDDVHGT;AVFPGEDVLDDVHGTA;VFPGEDVLDDVHGTAQ;FPGEDVLDDVHGTAQA;PGEDVLDDVHGTAQAV;GEDVLDDVHGTAQAVW;EDVLDDVHGTAQAVWD;DVLDDVHGTAQAVWDI;VLDDVHGTAQAVWDIR;LDDVHGTAQAVWDIRR;DDVHGTAQAVWDIRRL;DVHGTAQAVWDIRRLL;VHGTAQAVWDIRRLLS;HGTAQAVWDIRRLLSW;GTAQAVWDIRRLLSWI;TAQAVWDIRRLLSWIR;AQAVWDIRRLLSWIRS;QAVWDIRRLLSWIRSQ;AVWDIRRLLSWIRSQE;VWDIRRLLSWIRSQEE;WDIRRLLSWIRSQEEE;DIRRLLSWIRSQEEES;IRRLLSWIRSQEEESL;RRLLSWIRSQEEESLI;RLLSWIRSQEEESLIG;LLSWIRSQEEESLIGL;LSWIRSQEEESLIGLN;SWIRSQEEESLIGLNG;WIRSQEEESLIGLNGL;IRSQEEESLIGLNGLS;RSQEEESLIGLNGLSL;SQEEESLIGLNGLSLG;QEEESLIGLNGLSLGG;EEESLIGLNGLSLGGY;EESLIGLNGLSLGGYI;ESLIGLNGLSLGGYIA;SLIGLNGLSLGGYIAS;LIGLNGLSLGGYIASL;IGLNGLSLGGYIASLV;GLNGLSLGGYIASLVA;LNGLSLGGYIASLVAS;NGLSLGGYIASLVASL;GLSLGGYIASLVASLE;LSLGGYIASLVASLEE;SLGGYIASLVASLEEG;LGGYIASLVASLEEGL;GGYIASLVASLEEGLA;GYIASLVASLEEGLAC;YIASLVASLEEGLACA;IASLVASLEEGLACAI;ASLVASLEEGLACAIL;SLVASLEEGLACAILG;LVASLEEGLACAILGV;VASLEEGLACAILGVP;ASLEEGLACAILGVPV;SLEEGLACAILGVPVA;LEEGLACAILGVPVAD;EEGLACAILGVPVADL;EGLACAILGVPVADLI;GLACAILGVPVADLIE;LACAILGVPVADLIEL;ACAILGVPVADLIELL;CAILGVPVADLIELLG;AILGVPVADLIELLGR;ILGVPVADLIELLGRH;LGVPVADLIELLGRHC;GVPVADLIELLGRHCG;VPVADLIELLGRHCGL;PVADLIELLGRHCGLR;VADL | |

Fig. 30 continued

| | | |
|---|---|---|
| | IELLGRHCGLRH;ADLIELLGRHCGLRHK;DLIELLGRHCGLRHKD;LIELLGRHCGLRHKDP;IELLGRHCGLRHKDPR;ELLGRHCGLRHKDPRR;LLGRHCGLRHKDPRRH;LGRHCGLRHKDPRRHT;GRHCGLRHKDPRRHTV;RHCGLRHKDPRRHTVK;HCGLRHKDPRRHTVKM;CGLRHKDPRRHTVKMA;GLRHKDPRRHTVKMAE;LRHKDPRRHTVKMAEP;RHKDPRRHTVKMAEPI;HKDPRRHTVKMAEPIG;KDPRRHTVKMAEPIGR;DPRRHTVKMAEPIGRM;PRRHTVKMAEPIGRMI;RRHTVKMAEPIGRMIS;RHTVKMAEPIGRMISP;HTVKMAEPIGRMISPL;TVKMAEPIGRMISPLS;VKMAEPIGRMISPLSL;KMAEPIGRMISPLSLT;MAEPIGRMISPLSLTP;AEPIGRMISPLSLTPL;EPIGRMISPLSLTPLV;PIGRMISPLSLTPLVP;IGRMISPLSLTPLVPM;GRMISPLSLTPLVPMP;RMISPLSLTPLVPMPG;MISPLSLTPLVPMPGR;ISPLSLTPLVPMPGRF;SPLSLTPLVPMPGRFI;PLSLTPLVPMPGRFIY;LSLTPLVPMPGRFIYA;SLTPLVPMPGRFIYAG;LTPLVPMPGRFIYAGI;TPLVPMPGRFIYAGIA;PLVPMPGRFIYAGIAD;LVPMPGRFIYAGIADR;VPMPGRFIYAGIADRL;PMPGRFIYAGIADRLV;MPGRFIYAGIADRLVH;PGRFIYAGIADRLVHP;GRFIYAGIADRLVHPR;RFIYAGIADRLVHPRE;FIYAGIADRLVHPREQ;IYAGIADRLVHPREQV;YAGIADRLVHPREQVT;AGIADRLVHPREQVTR;GIADRLVHPREQVTRL;IADRLVHPREQVTRLW;ADRLVHPREQVTRLWE;DRLVHPREQVTRLWEH;RLVHPREQVTRLWEHW;LVHPREQVTRLWEHWG;VHPREQVTRLWEHWGK;HPREQVTRLWEHWGKP;PREQVTRLWEHWGKPE;REQVTRLWEHWGKPEI;EQVTRLWEHWGKPEIV;QVTRLWEHWGKPEIVW;VTRLWEHWGKPEIVWY;TRLWEHWGKPEIVWYP;RLWEHWGKPEIVWYPG;LWEHWGKPEIVWYPGG;WEHWGKPEIVWYPGGH;EHWGKPEIVWYPGGHT;HWGKPEIVWYPGGHTG;WGKPEIVWYPGGHTGF;GKPEIVWYPGGHTGFF;KPEIVWYPGGHTGFFQ;PEIVWYPGGHTGFFQS;EIVWYPGGHTGFFQSR;IVWYPGGHTGFFQSRP;VWYPGGHTGFFQSRPV;WYPGGHTGFFQSRPVR;YPGGHTGFFQSRPVRR;PGGHTGFFQSRPVRRF;GGHTGFFQSRPVRRFV;GHTGFFQSRPVRRFVQ;HTGFFQSRPVRRFVQA;TGFFQSRPVRRFVQAA;GFFQSRPVRRFVQAAL;FFQSRPVRRFVQAALE;FQSRPVRRFVQAALEQ;QSRPVRRFVQAALEQS;SRPVRRFVQAALEQSG;RPVRRFVQAALEQSGL;PVRRFVQAALEQSGLL;VRRFVQAALEQSGLLD;RRFVQAALEQSGLLDA;RFVQAALEQSGLLDAP;FVQAALEQSGLLDAPR;VQAALEQSGLLDAPRT;QAALEQSGLLDAPRTQ;AALEQSGLLDAPRTQR;ALEQSGLLDAPRTQRD;LEQSGLLDAPRTQRDR;EQSGLLDAPRTQRDRS;QSGLLDAPRTQRDRSA | |
| 28 | **<NP_217296.1 secreted L-alanine dehydrogenase ALD (40 kDa antigen) (TB43)Rv2780;Mycobacterium tuberculosis H37Rv>**<br>MRVGIPTETKNNEFRVAITPAGVAELTRRGHEVLIQAGAGEGSAITDADFKAAGAQLVGTADQVWADADLLLKVKEPIAAEYGRLRHGQILFTFLHLAASRACTDALLDSGTTSIAYETVQTADGALPLLAPMSEVAGRLAAQVGAYHLMRTQGGRGVLMGGVPGVEPADVVVIGAGTAGYNAARIANGMGATVTVLDINIDKLRQLDAEFCGRIHTRYSSAYELEGAVKRADLVIGAVLVPGAKAPKLVSNSLVAHMKPGAVLVDIAIDQGGCFEGSRPTTYDHPTFAVHDTLFYCVANMPASVPKTSTYALTNATMPYVLELADHGWRAACRSNPALAKGLSTHEGALLSERVATDLGVPFTEPASVLA<br><br>8mer<br>TETKNNEF;ETKNNEFR;FRVAITPA;VAITPAGV;TPAGVAEL;GVAELTRR;LTRRGHEV;EVLIQAGA;EGSAITDA;SAITDADF;AITDADFK;FKAAGAQL;KAAGAQLV;LVGTADQV;VGTADQVW;GTADQVWA;VWADADLL;WADADLLL;LLKVKEPI;AAEYGRLR;RLRHGQIL;GQILFTFL;ILFTFLHL;FTFLHLAA;FLHLAASR;SRACTDAL;ALLDSGTT;LLDSGTTS;TTSIAYET;TSIAYETV;VQTADGAL;TADGALPL;ALPLLAPM;LPLLAPMS;LLAPMSEV;EVAGRLAA;RLAAQVGA;LAAQVGAY;AQVGAYHL;QVGAYHLM;LMRTQGGR;RTQGGRGV;VLMGG | 163470-165365 |

Fig. 30 continued

| | | |
|---|---|---|
| | VPG;LMGGVPGV;GVEPADVV;EPADVVVI;VVIGAGTA;IGAGTAGY;GTAGYNAA;TAGYNAAR;AARIANGM;RIANGMGA;GMGATVTV;MGATVTVL;DINIDKLR;NIDKLRQL;RQLDAEFC;HTRYSSAY;RYSSAYEL;SAYELEGA;ELEGAVKR;AVKRADLV;DLVIGAVL;LVIGAVLV;AVLVPGAK;VLVPGAKA;KLVSNSLV;NSLVAHMK;HMKPGAVL;MKPGAVLV;AVLVDIAI;EGSRPTTY;TTYDHPTF;YDHPTFAV;FAVHDTLF;AVHDTLFY;HDTLFYCV;DTLFYCVA;YCVANMPA;VANMPASV;NMPASVPK;MPASVPKT;SVPKTSTY;VPKTSTYA;STYALTNA;YALTNATM;LTNATMPY;TNATMPYV;NATMPYVL;TMPYVLEL;MPYVLELA;ELADHGWR;HGWRAACR;ACRSNPAL;RSNPALAK;NPALAKGL;ALAKGLST;GLSTHEGA;STHEGALL;EGALLSER;ALLSERVA;LLSERVAT;SERVATDL;RVATDLGV;VPFTEPAS;FTEPASVL<br>9mer<br>RVGIPTETK;TETKNNEFR;ETKNNEFRV;RVAITPAGV;ITPAGVAEL;TPAGVAELT;ELTRRGHEV;SAITDADFK;AITDADFKA;FKAAGAQLV;QLVGTADQV;LVGTADQVW;QVWADADLL;VWADADLLL;WADADLLLK;ADADLLLKV;LLLKVKEPI;EPIAAEYGR;IAAEYGRLR;YGRLRHGQI;RLRHGQILF;RHGQILFTF;QILFTFLHL;ILFTFLHLA;FTFLHLAAS;TFLHLAASR;FLHLAASRA;ASRACTDAL;ALLDSGTTS;LLDSGTTSI;DSGTTSIAY;TTSIAYETV;IAYETVQTA;ETVQTADGA;TVQTADGAL;QTADGALPL;TADGALPLL;GALPLLAPM;LPLLAPMSE;PLLAPMSEV;LLAPMSEVA;PMSEVAGRL;EVAGRLAAQ;VAGRLAAQV;RLAAQVGAY;LAAQVGAYH;AQVGAYHLM;QVGAYHLMR;HLMRTQGGR;RTQGGRGVL;VLMGGVPGV;GVEPADVVV;VIGAGTAGY;GTAGYNAAR;NAARIANGM;RIANGMGAT;IANGMGATV;NGMGATVTV;GMGATVTVL;TVTVLDINI;TVLDINIDK;VLDINIDKL;KLRQLDAEF;AEFCGRIHT;EFCGRIHTR;FCGRIHTRY;GRIHTRYSS;RIHTRYSSA;TRYSSAYEL;SSAYELEGA;SAYELEGAV;AYELEGAVK;ELEGAVKRA;GAVKRADLV;RADLVIGAV;DLVIGAVLV;GAVLVPGAK;LVPGAKAPK;VPGAKAPKL;APKLVSNSL;KLVSNSLVA;SNSLVAHMK;VAHMKPGAV;AHMKPGAVL;HMKPGAVLV;KPGAVLVDI;VLVDIAIDQ;IAIDQGGCF;RPTTYDHPT;PTTYDHPTF;TTYDHPTFA;TYDHPTFAV;HPTFAVHDT;TFAVHDTLF;FAVHDTLFY;AVHDTLFYC;TLFYCVANM;CVANMPASV;ANMPASVPK;MPASVPKTS;ASVPKTSTY;SVPKTSTYA;VPKTSTYAL;TSTYALTNA;STYALTNAT;TYALTNATM;ALTNATMPY;LTNATMPYV;ATMPYVLEL;TMPYVLELA;MPYVLELAD;ELADHGWRA;DHGWRAACR;RAACRSNPA;GLSTHEGAL;EGALLSERV;ALLSERVAT;ERVATDLGV;VATDLGVPF;LGVPFTEPA;VPFTEPASV;FTEPASVLA<br>10mer<br>MRVGIPTETK;IPTETKNNEF;FRVAITPAGV;AITPAGVAEL;TPAGVAELTR;AELTRRGHEV;ELTRRGHEVL;IQAGAGEGSA;GSAITDADFK;AITDADFKAA;AQLVGTADQV;QLVGTADQVW;QVWADADLLL;VWADADLLLK;WADADLLLKV;LLLKVKEPIA;LLKVKEPIAA;KVKEPIAAEY;EPIAAEYGRL;EYGRLRHGQI;YGRLRHGQIL;GRLRHGQILF;RLRHGQILFT;LRHGQILFTF;GQILFTFLHL;QILFTFLHLA;ILFTFLHLAA;FTFLHLAASR;FLHLAASRAC;AASRACTDAL;ALLDSGTTSI;LLDSGTTSIA;LDSGTTSIAY;GTTSIAYETV;SIAYETVQTA;ETVQTADGAL;VQTADGALPL;QTADGALPLL;DGALPLLAPM;LPLLAPMSEV;PLLAPMSEVA;LAPMSEVAGR;APMSEVAGRL;PMSEVAGRLA;EVAGRLAAQV;GRLAAQVGAY;RLAAQVGAYH;LAAQVGAYHL;AQVGAYHLMR;LMRTQGGRGV;GVLMGGVPGV;GVPGVEPADV;VPGVEPADVV;EPADVVVIGA;VVIGAGTAGY;GTAGYNAARI;RIANGMGATV;IANGMGATVT;NGMGATVTVL;MGATVTVLDI;ATVTVLDINI;VTVLDINIDK;TVLDINIDKL;RQLDAEFCGR;QLDAEFCGRI;AEFCGRIHTR;EFCGRIHTRY;RIHTRYSSAY;HTRYSSAYEL;YSSAYELEGA;SSAYELEGAV;SAYELEGAVK;YELEGAVKRA;EGAVKRADLV;KRADLVIGAV;VIGAVLVPGA;VLVPGAKAPK;LVPGAKAPKL;VPGAKAPKLV;APKLVSNSLV;LVSNSLVAHM;VSNSLVAHMK;SLVAHMKPGA;LVAHMKPG | |

Fig. 30 continued

| | | |
|---|---|---|
| | AV;KPGAVLVDIA;DIAIDQGGCF;RPTTYDHPTF;TTYDHPTFAV;HPTFAVHDTL;PTFAVHDTLF;TFAVHDTLFY;FAVHDTLFYC;AVHDTLFYCV;DTLFYCVANM;YCVANMPASV;VANMPASVPK;MPASVPKTST;SVPKTSTYAL;VPKTSTYALT;KTSTYALTNA;STYALTNATM;YALTNATMPY;ALTNATMPYV;LTNATMPYVL;ATMPYVLELA;MPYVLELADH;YVLELADHGW;ELADHGWRAA;ADHGWRAACR;WRAACRSNPA;RAACRSNPAL;ACRSNPALAK;NPALAKGLST;GLSTHEGALL;LLSERVATDL;SERVATDLGV;RVATDLGVPF;GVPFTEPASV;VPFTEPASVL<br>11mer<br>GIPTETKNNEF;IPTETKNNEFR;ETKNNEFRVAI;ITPAGVAELTR;TPAGVAELTRR;AELTRRGHEVL;ELTRRGHEVLI;LIQAGAGEGSA;IQAGAGEGSAI;EGSAITDADFK;AQLVGTADQVW;QLVGTADQVWA;QVWADADLLLK;VWADADLLLKV;LLLKVKEPIAA;KEPIAAEYGRL;EPIAAEYGRLR;EYGRLRHGQIL;RLRHGQILFTF;GQILFTFLHLA;QILFTFLHLAA;ILFTFLHLAAS;LFTFLHLAASR;FTFLHLAASRA;FLHLAASRACT;HLAASRACTDA;LAASRACTDAL;ALLDSGTTSIA;LLDSGTTSIAY;YETVQTADGAL;TVQTADGALPL;VQTADGALPLL;QTADGALPLLA;ALPLLAPMSEV;LPLLAPMSEVA;LLAPMSEVAGR;APMSEVAGRLA;PMSEVAGRLAA;SEVAGRLAAQV;AGRLAAQVGAY;GRLAAQVGAYH;RLAAQVGAYHL;LAAQVGAYHLM;AAQVGAYHLMR;AQVGAYHLMRT;AYHLMRTQGGR;HLMRTQGGRGV;LMRTQGGRGVL;VLMGGVPGVEP;LMGGVPGVEPA;GVPGVEPADVV;VPGVEPADVVV;VVVIGAGTAGY;VIGAGTAGYNA;GAGTAGYNAAR;GYNAARIANGM;NAARIANGMGA;AARIANGMGAT;IANGMGATVTV;GMGATVTVLDI;TVTVLDINIDK;TVLDINIDKLR;VLDINIDKLRQ;RQLDAEFCGRI;DAEFCGRIHTR;AEFCGRIHTRY;GRIHTRYSSAY;IHTRYSSAYEL;YSSAYELEGAV;SSAYELEGAVK;SAYELEGAVKR;ELEGAVKRADL;KRADLVIGAVL;RADLVIGAVLV;LVIGAVLVPGA;VIGAVLVPGAK;AVLVPGAKAPK;VLVPGAKAPKL;LVPGAKAPKLV;AKAPKLVSNSL;KAPKLVSNSLV;APKLVSNSLVA;KLVSNSLVAHM;LVSNSLVAHMK;SLVAHMKPGAV;VAHMKPGAVLV;HMKPGAVLVDI;KPGAVLVDIAI;RPTTYDHPTFA;PTTYDHPTFAV;TTYDHPTFAVH;HPTFAVHDTLF;PTFAVHDTLFY;FAVHDTLFYCV;AVHDTLFYCVA;TLFYCVANMPA;CVANMPASVPK;MPASVPKTSTY;ASVPKTSTYAL;TYALTNATMPY;YALTNATMPYV;ALTNATMPYVL;NATMPYVLELA;MPYVLELADHG;PYVLELADHGW;YVLELADHGWR;VLELADHGWRA;ELADHGWRAAC;WRAACRSNPAL;RAACRSNPALA;AACRSNPALAK;NPALAKGLSTH;ALAKGLSTHEG;STHEGALLSER;ALLSERVATDL;LLSERVATDLG;LGVPFTEPASV;VPFTEPASVLA<br><br>13 mers:<br>MRVGIPTETKNNE;RVGIPTETKNNEF;VGIPTETKNNEFR;GIPTETKNNEFRV;IPTETKNNEFRVA;PTETKNNEFRVAI;TETKNNEFRVAIT;ETKNNEFRVAITP;TKNNEFRVAITPA;KNNEFRVAITPAG;NNEFRVAITPAGV;NEFRVAITPAGVA;EFRVAITPAGVAE;FRVAITPAGVAEL;RVAITPAGVAELT;VAITPAGVAELTR;AITPAGVAELTRR;ITPAGVAELTRRG;TPAGVAELTRRGH;PAGVAELTRRGHE;AGVAELTRRGHEV;GVAELTRRGHEVL;VAELTRRGHEVLI;AELTRRGHEVLIQ;ELTRRGHEVLIQA;LTRRGHEVLIQAG;TRRGHEVLIQAGA;RRGHEVLIQAGAG;RGHEVLIQAGAGE;GHEVLIQAGAGEG;HEVLIQAGAGEGS;EVLIQAGAGEGSA;VLIQAGAGEGSAI;LIQAGAGEGSAIT;IQAGAGEGSAITD;QAGAGEGSAITDA;AGAGEGSAITDAD;GAGEGSAITDADF;AGEGSAITDADFK;GEGSAITDADFKA;EGSAITDADFKAA;GSAITDADFKAAG;SAITDADFKAAGA;AITDADFKAAGAQ;ITDADFKAAGAQL;TDADFKAAGAQLV;DADFKAAGAQLVG;ADFKAAGAQLVGT;DFKAAGAQLVGTA;FKAAGAQLVGTAD;KAAGAQLVGTADQ;AAGAQLVGTADQV;AGAQLVGTADQVW;GAQLVGTADQVWA;AQLVGTADQVWAD;QLVGTADQVWADA;LVGTADQVWADAD;V | |

Fig. 30 continued

| | | |
|---|---|---|
| | GTADQVWADADL;GTADQVWADADLL;TADQVWADADLLL;ADQVWADADLLLK;DQVWADADLLLKV;QVWADADLLLKVK;VWADADLLLKVKE;WADADLLLKVKEP;ADADLLLKVKEPI;DADLLLKVKEPIA;ADLLLKVKEPIAA;DLLLKVKEPIAAE;LLLKVKEPIAAEY;LLKVKEPIAAEYG;LKVKEPIAAEYGR;KVKEPIAAEYGRL;VKEPIAAEYGRLR;KEPIAAEYGRLRH;EPIAAEYGRLRHG;PIAAEYGRLRHGQ;IAAEYGRLRHGQI;AAEYGRLRHGQIL;AEYGRLRHGQILF;EYGRLRHGQILFT;YGRLRHGQILFTF;GRLRHGQILFTFL;RLRHGQILFTFLH;LRHGQILFTFLHL;RHGQILFTFLHLA;HGQILFTFLHLAA;GQILFTFLHLAAS;QILFTFLHLAASR;ILFTFLHLAASRA;LFTFLHLAASRAC;FTFLHLAASRACT;TFLHLAASRACTD;FLHLAASRACTDA;LHLAASRACTDAL;HLAASRACTDALL;LAASRACTDALLD;AASRACTDALLDS;ASRACTDALLDSG;SRACTDALLDSGT;RACTDALLDSGTT;ACTDALLDSGTTS;CTDALLDSGTTSI;TDALLDSGTTSIA;DALLDSGTTSIAY;ALLDSGTTSIAYE;LLDSGTTSIAYET;LDSGTTSIAYETV;DSGTTSIAYETVQ;SGTTSIAYETVQT;GTTSIAYETVQTA;TTSIAYETVQTAD;TSIAYETVQTADG;SIAYETVQTADGA;IAYETVQTADGAL;AYETVQTADGALP;YETVQTADGALPL;ETVQTADGALPLL;TVQTADGALPLLA;VQTADGALPLLAP;QTADGALPLLAPM;TADGALPLLAPMS;ADGALPLLAPMSE;DGALPLLAPMSEV;GALPLLAPMSEVA;ALPLLAPMSEVAG;LPLLAPMSEVAGR;PLLAPMSEVAGRL;LLAPMSEVAGRLA;LAPMSEVAGRLAA;APMSEVAGRLAAQ;PMSEVAGRLAAQV;MSEVAGRLAAQVG;SEVAGRLAAQVGA;EVAGRLAAQVGAY;VAGRLAAQVGAYH;AGRLAAQVGAYHL;GRLAAQVGAYHLM;RLAAQVGAYHLMR;LAAQVGAYHLMRT;AAQVGAYHLMRTQ;AQVGAYHLMRTQG;QVGAYHLMRTQGG;VGAYHLMRTQGGR;GAYHLMRTQGGRG;AYHLMRTQGGRGV;YHLMRTQGGRGVL;HLMRTQGGRGVLM;LMRTQGGRGVLMG;MRTQGGRGVLMGG;RTQGGRGVLMGGV;TQGGRGVLMGGVP;QGGRGVLMGGVPG;GGRGVLMGGVPGV;GRGVLMGGVPGVE;RGVLMGGVPGVEP;GVLMGGVPGVEPA;VLMGGVPGVEPAD;LMGGVPGVEPADV;MGGVPGVEPADVV;GGVPGVEPADVVV;GVPGVEPADVVVI;VPGVEPADVVVIG;PGVEPADVVVIGA;GVEPADVVVIGAG;VEPADVVVIGAGT;EPADVVVIGAGTA;PADVVVIGAGTAG;ADVVVIGAGTAGY;DVVVIGAGTAGYN;VVVIGAGTAGYNA;VVIGAGTAGYNAA;VIGAGTAGYNAAR;IGAGTAGYNAARI;GAGTAGYNAARIA;AGTAGYNAARIAN;GTAGYNAARIANG;TAGYNAARIANGM;AGYNAARIANGMG;GYNAARIANGMGA;YNAARIANGMGAT;NAARIANGMGATV;AARIANGMGATVT;ARIANGMGATVTV;RIANGMGATVTVL;IANGMGATVTVLD;ANGMGATVTVLDI;NGMGATVTVLDIN;GMGATVTVLDINI;MGATVTVLDINID;GATVTVLDINIDK;ATVTVLDINIDKL;TVTVLDINIDKLR;VTVLDINIDKLRQ;TVLDINIDKLRQL;VLDINIDKLRQLD;LDINIDKLRQLDA;DINIDKLRQLDAE;INIDKLRQLDAEF;NIDKLRQLDAEFC;IDKLRQLDAEFCG;DKLRQLDAEFCGR;KLRQLDAEFCGRI;LRQLDAEFCGRIH;RQLDAEFCGRIHT;QLDAEFCGRIHTR;LDAEFCGRIHTRY;DAEFCGRIHTRYS;AEFCGRIHTRYSS;EFCGRIHTRYSSA;FCGRIHTRYSSAY;CGRIHTRYSSAYE;GRIHTRYSSAYEL;RIHTRYSSAYELE;IHTRYSSAYELEG;HTRYSSAYELEGA;TRYSSAYELEGAV;RYSSAYELEGAVK;YSSAYELEGAVKR;SSAYELEGAVKRA;SAYELEGAVKRAD;AYELEGAVKRADL;YELEGAVKRADLV;ELEGAVKRADLVI;LEGAVKRADLVIG;EGAVKRADLVIGA;GAVKRADLVIGAV;AVKRADLVIGAVL;VKRADLVIGAVLV;KRADLVIGAVLVP;RADLVIGAVLVPG;ADLVIGAVLVPGA;DLVIGAVLVPGAK;LVIGAVLVPGAKA;VIGAVLVPGAKAP;IGAVLVPGAKAPK;GAVLVPGAKAPKL;AVLVPGAKAPKLV;VLVPGAKAPKLVS;LVPGAKAPKLVSN;VPGAKAPKLVSNS;PGAKAPKLVSNSL;GAKAPKLVSNSLV;AKAPKLVSNSLVA;KAPKLVSNSLVAH;APKLVSNSLVAHM;PKLVSNSLVAHMK;KLVSNSLVAHMKP;LVSNSLVAHMKPG;VSNSLVAHMKPGA;SNSLVAHMKPGAV;NSLVAHMKPGAVL;SLVAHMKPGAVLV;LVAHMKPGAVLVD;VAHMKPGAVLVDI;AHMKPGAVLVDIA;HMKPGAVLVDIAI;MKPGAVLVDIAID;KPGAVLVDIAI | |

Fig. 30 continued

DQ;PGAVLVDIAIDQG;GAVLVDIAIDQGG;AVLVDIAIDQGGC;VLVDIAIDQG
GCF;LVDIAIDQGGCFE;VDIAIDQGGCFEG;DIAIDQGGCFEGS;IAIDQGGCF
EGSR;AIDQGGCFEGSRP;IDQGGCFEGSRPT;DQGGCFEGSRPTT;QGGC
FEGSRPTTY;GGCFEGSRPTTYD;GCFEGSRPTTYDH;CFEGSRPTTYDHP;
FEGSRPTTYDHPT;EGSRPTTYDHPTF;GSRPTTYDHPTFA;SRPTTYDHPT
FAV;RPTTYDHPTFAVH;PTTYDHPTFAVHD;TTYDHPTFAVHDT;TYDHPTF
AVHDTL;YDHPTFAVHDTLF;DHPTFAVHDTLFY;HPTFAVHDTLFYC;PTFAV
HDTLFYCV;TFAVHDTLFYCVA;FAVHDTLFYCVAN;AVHDTLFYCVANM;VH
DTLFYCVANMP;HDTLFYCVANMPA;DTLFYCVANMPAS;TLFYCVANMPAS
V;LFYCVANMPASVP;FYCVANMPASVPK;YCVANMPASVPKT;CVANMPAS
VPKTS;VANMPASVPKTST;ANMPASVPKTSTY;NMPASVPKTSTYA;MPAS
VPKTSTYAL;PASVPKTSTYALT;ASVPKTSTYALTN;SVPKTSTYALTNA;VP
KTSTYALTNAT;PKTSTYALTNATM;KTSTYALTNATMP;TSTYALTNATMPY;
STYALTNATMPYV;TYALTNATMPYVL;YALTNATMPYVLE;ALTNATMPYVL
EL;LTNATMPYVLELA;TNATMPYVLELAD;NATMPYVLELADH;ATMPYVLEL
ADHG;TMPYVLELADHGW;MPYVLELADHGWR;PYVLELADHGWRA;YVLE
LADHGWRAA;VLELADHGWRAAC;LELADHGWRAACR;ELADHGWRAACR
S;LADHGWRAACRSN;ADHGWRAACRSNP;DHGWRAACRSNPA;HGWRA
ACRSNPAL;GWRAACRSNPALA;WRAACRSNPALAK;RAACRSNPALAKG;
AACRSNPALAKGL;ACRSNPALAKGLS;CRSNPALAKGLST;RSNPALAKGL
STH;SNPALAKGLSTHE;NPALAKGLSTHEG;PALAKGLSTHEGA;ALAKGLS
THEGAL;LAKGLSTHEGALL;AKGLSTHEGALLS;KGLSTHEGALLSE;GLSTH
EGALLSER;LSTHEGALLSERV;STHEGALLSERVA;THEGALLSERVAT;HE
GALLSERVATD;EGALLSERVATDL;GALLSERVATDLG;ALLSERVATDLGV;
LLSERVATDLGVP;LSERVATDLGVPF;SERVATDLGVPFT;ERVATDLGVPF
TE;RVATDLGVPFTEP;VATDLGVPFTEPA;ATDLGVPFTEPAS;TDLGVPFTE
PASV;DLGVPFTEPASVL;LGVPFTEPASVLA;
14 mers:
MRVGIPTETKNNEF;RVGIPTETKNNEFR;VGIPTETKNNEFRV;GIPTETKNN
EFRVA;IPTETKNNEFRVAI;PTETKNNEFRVAIT;TETKNNEFRVAITP;ETKN
NEFRVAITPA;TKNNEFRVAITPAG;KNNEFRVAITPAGV;NNEFRVAITPAGV
A;NEFRVAITPAGVAE;EFRVAITPAGVAEL;FRVAITPAGVAELT;RVAITPAG
VAELTR;VAITPAGVAELTRR;AITPAGVAELTRRG;ITPAGVAELTRRGH;TP
AGVAELTRRGHE;PAGVAELTRRGHEV;AGVAELTRRGHEVL;GVAELTRR
GHEVLI;VAELTRRGHEVLIQ;AELTRRGHEVLIQA;ELTRRGHEVLIQAG;LTR
RGHEVLIQAGA;TRRGHEVLIQAGAG;RRGHEVLIQAGAGE;RGHEVLIQAG
AGEG;GHEVLIQAGAGEGS;HEVLIQAGAGEGSA;EVLIQAGAGEGSAI;VLIQ
AGAGEGSAIT;LIQAGAGEGSAITD;IQAGAGEGSAITDA;QAGAGEGSAITDA
D;AGAGEGSAITDADF;GAGEGSAITDADFK;AGEGSAITDADFKA;GEGSAIT
DADFKAA;EGSAITDADFKAAG;GSAITDADFKAAGA;SAITDADFKAAGAQ;A
ITDADFKAAGAQL;ITDADFKAAGAQLV;TDADFKAAGAQLVG;DADFKAAGA
QLVGT;ADFKAAGAQLVGTA;DFKAAGAQLVGTAD;FKAAGAQLVGTADQ;K
AAGAQLVGTADQV;AAGAQLVGTADQVW;AGAQLVGTADQVWA;GAQLVG
TADQVWAD;AQLVGTADQVWADA;QLVGTADQVWADAD;LVGTADQVWA
DADL;VGTADQVWADADLL;GTADQVWADADLLL;TADQVWADADLLLK;AD
QVWADADLLLKV;DQVWADADLLLKVK;QVWADADLLLKVKE;VWADADLL
LKVKEP;WADADLLLKVKEPI;ADADLLLKVKEPIA;DADLLLKVKEPIAA;ADLL
LKVKEPIAAE;DLLLKVKEPIAAEY;LLLKVKEPIAAEYG;LLKVKEPIAAEYGR;
LKVKEPIAAEYGRL;KVKEPIAAEYGRLR;VKEPIAAEYGRLRH;KEPIAAEYG
RLRHG;EPIAAEYGRLRHGQ;PIAAEYGRLRHGQI;IAAEYGRLRHGQIL;AAE
YGRLRHGQILF;AEYGRLRHGQILFT;EYGRLRHGQILFTF;YGRLRHGQILFT
FL;GRLRHGQILFTFLH;RLRHGQILFTFLHL;LRHGQILFTFLHLA;RHGQILFT
FLHLAA;HGQILFTFLHLAAS;GQILFTFLHLAASR;QILFTFLHLAASRA;ILFTF

Fig. 30 continued

| | | |
|---|---|---|
| | LHLAASRAC;LFTFLHLAASRACT;FTFLHLAASRACTD;TFLHLAASRACTDA;FLHLAASRACTDAL;LHLAASRACTDALL;HLAASRACTDALLD;LAASRACTDALLDS;AASRACTDALLDSG;ASRACTDALLDSGT;SRACTDALLDSGTT;RACTDALLDSGTTS;ACTDALLDSGTTSI;CTDALLDSGTTSIA;TDALLDSGTTSIAY;DALLDSGTTSIAYE;ALLDSGTTSIAYET;LLDSGTTSIAYETV;LDSGTTSIAYETVQ;DSGTTSIAYETVQT;SGTTSIAYETVQTA;GTTSIAYETVQTAD;TTSIAYETVQTADG;TSIAYETVQTADGA;SIAYETVQTADGAL;IAYETVQTADGALP;AYETVQTADGALPL;YETVQTADGALPLL;ETVQTADGALPLLA;TVQTADGALPLLAP;VQTADGALPLLAPM;QTADGALPLLAPMS;TADGALPLLAPMSE;ADGALPLLAPMSEV;DGALPLLAPMSEVA;GALPLLAPMSEVAG;ALPLLAPMSEVAGR;LPLLAPMSEVAGRL;PLLAPMSEVAGRLA;LLAPMSEVAGRLAA;LAPMSEVAGRLAAQ;APMSEVAGRLAAQV;PMSEVAGRLAAQVG;MSEVAGRLAAQVGA;SEVAGRLAAQVGAY;EVAGRLAAQVGAYH;VAGRLAAQVGAYHL;AGRLAAQVGAYHLM;GRLAAQVGAYHLMR;RLAAQVGAYHLMRT;LAAQVGAYHLMRTQ;AAQVGAYHLMRTQG;AQVGAYHLMRTQGG;QVGAYHLMRTQGGR;VGAYHLMRTQGGRG;GAYHLMRTQGGRGV;AYHLMRTQGGRGVL;YHLMRTQGGRGVLM;HLMRTQGGRGVLMG;LMRTQGGRGVLMGG;MRTQGGRGVLMGGV;RTQGGRGVLMGGVP;TQGGRGVLMGGVPG;QGGRGVLMGGVPGV;GGRGVLMGGVPGVE;GRGVLMGGVPGVEP;RGVLMGGVPGVEPA;GVLMGGVPGVEPAD;VLMGGVPGVEPADV;LMGGVPGVEPADVV;MGGVPGVEPADVVV;GGVPGVEPADVVVI;GVPGVEPADVVVIG;VPGVEPADVVVIGA;PGVEPADVVVIGAG;GVEPADVVVIGAGT;VEPADVVVIGAGTA;EPADVVVIGAGTAG;PADVVVIGAGTAGY;ADVVVIGAGTAGYN;DVVVIGAGTAGYNA;VVVIGAGTAGYNAA;VVIGAGTAGYNAAR;VIGAGTAGYNAARI;IGAGTAGYNAARIA;GAGTAGYNAARIAN;AGTAGYNAARIANG;GTAGYNAARIANGM;TAGYNAARIANGMG;AGYNAARIANGMGA;GYNAARIANGMGAT;YNAARIANGMGATV;NAARIANGMGATVT;AARIANGMGATVTV;ARIANGMGATVTVL;RIANGMGATVTVLD;IANGMGATVTVLDI;ANGMGATVTVLDIN;NGMGATVTVLDINI;GMGATVTVLDINID;MGATVTVLDINIDK;GATVTVLDINIDKL;ATVTVLDINIDKLR;TVTVLDINIDKLRQ;VTVLDINIDKLRQL;TVLDINIDKLRQLD;VLDINIDKLRQLDA;LDINIDKLRQLDAE;DINIDKLRQLDAEF;INIDKLRQLDAEFC;NIDKLRQLDAEFCG;IDKLRQLDAEFCGR;DKLRQLDAEFCGRI;KLRQLDAEFCGRIH;LRQLDAEFCGRIHT;RQLDAEFCGRIHTR;QLDAEFCGRIHTRY;LDAEFCGRIHTRYS;DAEFCGRIHTRYSS;AEFCGRIHTRYSSA;EFCGRIHTRYSSAY;FCGRIHTRYSSAYE;CGRIHTRYSSAYEL;GRIHTRYSSAYELE;RIHTRYSSAYELEG;IHTRYSSAYELEGA;HTRYSSAYELEGAV;TRYSSAYELEGAVK;RYSSAYELEGAVKR;YSSAYELEGAVKRA;SSAYELEGAVKRAD;SAYELEGAVKRADL;AYELEGAVKRADLV;YELEGAVKRADLVI;ELEGAVKRADLVIG;LEGAVKRADLVIGA;EGAVKRADLVIGAV;GAVKRADLVIGAVL;AVKRADLVIGAVLV;VKRADLVIGAVLVP;KRADLVIGAVLVPG;RADLVIGAVLVPGA;ADLVIGAVLVPGAK;DLVIGAVLVPGAKA;LVIGAVLVPGAKAP;VIGAVLVPGAKAPK;IGAVLVPGAKAPKL;GAVLVPGAKAPKLV;AVLVPGAKAPKLVS;VLVPGAKAPKLVSN;LVPGAKAPKLVSNS;VPGAKAPKLVSNSL;PGAKAPKLVSNSLV;GAKAPKLVSNSLVA;AKAPKLVSNSLVAH;KAPKLVSNSLVAHM;APKLVSNSLVAHMK;PKLVSNSLVAHMKP;KLVSNSLVAHMKPG;LVSNSLVAHMKPGA;VSNSLVAHMKPGAV;SNSLVAHMKPGAVL;NSLVAHMKPGAVLV;SLVAHMKPGAVLVD;LVAHMKPGAVLVDI;VAHMKPGAVLVDIA;AHMKPGAVLVDIAI;HMKPGAVLVDIAID;MKPGAVLVDIAIDQ;KPGAVLVDIAIDQG;PGAVLVDIAIDQGG;GAVLVDIAIDQGGC;AVLVDIAIDQGGCF;VLVDIAIDQGGCFE;LVDIAIDQGGCFEG;VDIAIDQGGCFEGS;DIAIDQGGCFEGSR;IAIDQGGCFEGSRP;AIDQGGCFEGSRPT;IDQGGCFEGSRPTT;DQGGCFEGSRPTTY;QGGCFEGSRPTTYD;GGCFEGSRPTTYDH;GCFEGSRPTTYDHP;CFEGSRPTTYDHPT;FEGSRPTTYDHPTF;EGSRPTTYDHPTFA;GS | |

Fig. 30 continued

| | | |
|---|---|---|
| | RPTTYDHPTFAV;SRPTTYDHPTFAVH;RPTTYDHPTFAVHD;PTTYDHPTFAVHDT;TTYDHPTFAVHDTL;TYDHPTFAVHDTLF;YDHPTFAVHDTLFY;DHPTFAVHDTLFYC;HPTFAVHDTLFYCV;PTFAVHDTLFYCVA;TFAVHDTLFYCVAN;FAVHDTLFYCVANM;AVHDTLFYCVANMP;VHDTLFYCVANMPA;HDTLFYCVANMPAS;DTLFYCVANMPASV;TLFYCVANMPASVP;LFYCVANMPASVPK;FYCVANMPASVPKT;YCVANMPASVPKTS;CVANMPASVPKTST;VANMPASVPKTSTY;ANMPASVPKTSTYA;NMPASVPKTSTYAL;MPASVPKTSTYALT;PASVPKTSTYALTN;ASVPKTSTYALTNA;SVPKTSTYALTNAT;VPKTSTYALTNATM;PKTSTYALTNATMP;KTSTYALTNATMPY;TSTYALTNATMPYV;STYALTNATMPYVL;TYALTNATMPYVLE;YALTNATMPYVLEL;ALTNATMPYVLELA;LTNATMPYVLELAD;TNATMPYVLELADH;NATMPYVLELADHG;ATMPYVLELADHGW;TMPYVLELADHGWR;MPYVLELADHGWRA;PYVLELADHGWRAA;YVLELADHGWRAAC;VLELADHGWRAACR;LELADHGWRAACRS;ELADHGWRAACRSN;LADHGWRAACRSNP;ADHGWRAACRSNPA;DHGWRAACRSNPAL;HGWRAACRSNPALA;GWRAACRSNPALAK;WRAACRSNPALAKG;RAACRSNPALAKGL;AACRSNPALAKGLS;ACRSNPALAKGLST;CRSNPALAKGLSTH;RSNPALAKGLSTHE;SNPALAKGLSTHEG;NPALAKGLSTHEGA;PALAKGLSTHEGAL;ALAKGLSTHEGALL;LAKGLSTHEGALLS;AKGLSTHEGALLSE;KGLSTHEGALLSER;GLSTHEGALLSERV;LSTHEGALLSERVA;STHEGALLSERVAT;THEGALLSERVATD;HEGALLSERVATDL;EGALLSERVATDLG;GALLSERVATDLGV;ALLSERVATDLGVP;LLSERVATDLGVPF;LSERVATDLGVPFT;SERVATDLGVPFTE;ERVATDLGVPFTEP;RVATDLGVPFTEPA;VATDLGVPFTEPAS;ATDLGVPFTEPASV;TDLGVPFTEPASVL;DLGVPFTEPASVLA;<br>15 mers:<br>MRVGIPTETKNNEFR;RVGIPTETKNNEFRV;VGIPTETKNNEFRVA;GIPTETKNNEFRVAI;IPTETKNNEFRVAIT;PTETKNNEFRVAITP;TETKNNEFRVAITPA;ETKNNEFRVAITPAG;TKNNEFRVAITPAGV;KNNEFRVAITPAGVA;NNEFRVAITPAGVAE;NEFRVAITPAGVAEL;EFRVAITPAGVAELT;FRVAITPAGVAELTR;RVAITPAGVAELTRR;VAITPAGVAELTRRG;AITPAGVAELTRRGH;ITPAGVAELTRRGHE;TPAGVAELTRRGHEV;PAGVAELTRRGHEVL;AGVAELTRRGHEVLI;GVAELTRRGHEVLIQ;VAELTRRGHEVLIQA;AELTRRGHEVLIQAG;ELTRRGHEVLIQAGA;LTRRGHEVLIQAGAG;TRRGHEVLIQAGAGE;RRGHEVLIQAGAGEG;RGHEVLIQAGAGEGS;GHEVLIQAGAGEGSA;HEVLIQAGAGEGSAI;EVLIQAGAGEGSAIT;VLIQAGAGEGSAITD;LIQAGAGEGSAITDA;IQAGAGEGSAITDAD;QAGAGEGSAITDADF;AGAGEGSAITDADFK;GAGEGSAITDADFKA;AGEGSAITDADFKAA;GEGSAITDADFKAAG;EGSAITDADFKAAGA;GSAITDADFKAAGAQ;SAITDADFKAAGAQL;AITDADFKAAGAQLV;ITDADFKAAGAQLVG;TDADFKAAGAQLVGT;DADFKAAGAQLVGTA;ADFKAAGAQLVGTAD;DFKAAGAQLVGTADQ;FKAAGAQLVGTADQV;KAAGAQLVGTADQVW;AAGAQLVGTADQVWA;AGAQLVGTADQVWAD;GAQLVGTADQVWADA;AQLVGTADQVWADAD;QLVGTADQVWADADL;LVGTADQVWADADLL;VGTADQVWADADLLL;GTADQVWADADLLLK;TADQVWADADLLLKV;ADQVWADADLLLKVK;DQVWADADLLLKVKE;QVWADADLLLKVKEP;VWADADLLLKVKEPI;WADADLLLKVKEPIA;ADADLLLKVKEPIAA;DADLLLKVKEPIAAE;ADLLLKVKEPIAAEY;DLLLKVKEPIAAEYG;LLLKVKEPIAAEYGR;LLKVKEPIAAEYGRL;LKVKEPIAAEYGRLR;KVKEPIAAEYGRLRH;VKEPIAAEYGRLRHG;KEPIAAEYGRLRHGQ;EPIAAEYGRLRHGQI;PIAAEYGRLRHGQIL;IAAEYGRLRHGQILF;AAEYGRLRHGQILFT;AEYGRLRHGQILFTF;EYGRLRHGQILFTFL;YGRLRHGQILFTFLH;GRLRHGQILFTFLHL;RLRHGQILFTFLHLA;LRHGQILFTFLHLAA;RHGQILFTFLHLAAS;HGQILFTFLHLAASR;GQILFTFLHLAASRA;QILFTFLHLAASRAC;ILFTFLHLAASRACT;LFTFLHLAASRACTD;FTFLHLAASRACTDA;TFLHLAASRACTDAL;FLHLA | |

Fig. 30 continued

| | | |
|---|---|---|
| | ASRACTDALL;LHLAASRACTDALLD;HLAASRACTDALLDS;LAASRACTDALLDSG;AASRACTDALLDSGT;ASRACTDALLDSGTT;SRACTDALLDSGTTS;RACTDALLDSGTTSI;ACTDALLDSGTTSIA;CTDALLDSGTTSIAY;TDALLDSGTTSIAYE;DALLDSGTTSIAYET;ALLDSGTTSIAYETV;LLDSGTTSIAYETVQ;LDSGTTSIAYETVQT;DSGTTSIAYETVQTA;SGTTSIAYETVQTAD;GTTSIAYETVQTADG;TTSIAYETVQTADGA;TSIAYETVQTADGAL;SIAYETVQTADGALP;IAYETVQTADGALPL;AYETVQTADGALPLL;YETVQTADGALPLLA;ETVQTADGALPLLAP;TVQTADGALPLLAPM;VQTADGALPLLAPMS;QTADGALPLLAPMSE;TADGALPLLAPMSEV;ADGALPLLAPMSEVA;DGALPLLAPMSEVAG;GALPLLAPMSEVAGR;ALPLLAPMSEVAGRL;LPLLAPMSEVAGRLA;PLLAPMSEVAGRLAA;LLAPMSEVAGRLAAQ;LAPMSEVAGRLAAQV;APMSEVAGRLAAQVG;PMSEVAGRLAAQVGA;MSEVAGRLAAQVGAY;SEVAGRLAAQVGAYH;EVAGRLAAQVGAYHL;VAGRLAAQVGAYHLM;AGRLAAQVGAYHLMR;GRLAAQVGAYHLMRT;RLAAQVGAYHLMRTQ;LAAQVGAYHLMRTQG;AAQVGAYHLMRTQGG;AQVGAYHLMRTQGGR;QVGAYHLMRTQGGRG;VGAYHLMRTQGGRGV;GAYHLMRTQGGRGVL;AYHLMRTQGGRGVLM;YHLMRTQGGRGVLMG;HLMRTQGGRGVLMGG;LMRTQGGRGVLMGGV;MRTQGGRGVLMGGVP;RTQGGRGVLMGGVPG;TQGGRGVLMGGVPGV;QGGRGVLMGGVPGVE;GGRGVLMGGVPGVEP;GRGVLMGGVPGVEPA;RGVLMGGVPGVEPAD;GVLMGGVPGVEPADV;VLMGGVPGVEPADVV;LMGGVPGVEPADVVV;MGGVPGVEPADVVVI;GGVPGVEPADVVVIG;GVPGVEPADVVVIGA;VPGVEPADVVVIGAG;PGVEPADVVVIGAGT;GVEPADVVVIGAGTA;VEPADVVVIGAGTAG;EPADVVVIGAGTAGY;PADVVVIGAGTAGYN;ADVVVIGAGTAGYNA;DVVVIGAGTAGYNAA;VVVIGAGTAGYNAAR;VVIGAGTAGYNAARI;VIGAGTAGYNAARIA;IGAGTAGYNAARIAN;GAGTAGYNAARIANG;AGTAGYNAARIANGM;GTAGYNAARIANGMG;TAGYNAARIANGMGA;AGYNAARIANGMGAT;GYNAARIANGMGATV;YNAARIANGMGATVT;NAARIANGMGATVTV;AARIANGMGATVTVL;ARIANGMGATVTVLD;RIANGMGATVTVLDI;IANGMGATVTVLDIN;ANGMGATVTVLDINI;NGMGATVTVLDINID;GMGATVTVLDINIDK;MGATVTVLDINIDKL;GATVTVLDINIDKLR;ATVTVLDINIDKLRQ;TVTVLDINIDKLRQL;VTVLDINIDKLRQLD;TVLDINIDKLRQLDA;VLDINIDKLRQLDAE;LDINIDKLRQLDAEF;DINIDKLRQLDAEFC;INIDKLRQLDAEFCG;NIDKLRQLDAEFCGR;IDKLRQLDAEFCGRI;DKLRQLDAEFCGRIH;KLRQLDAEFCGRIHT;LRQLDAEFCGRIHTR;RQLDAEFCGRIHTRY;QLDAEFCGRIHTRYS;LDAEFCGRIHTRYSS;DAEFCGRIHTRYSSA;AEFCGRIHTRYSSAY;EFCGRIHTRYSSAYE;FCGRIHTRYSSAYEL;CGRIHTRYSSAYELE;GRIHTRYSSAYELEG;RIHTRYSSAYELEGA;IHTRYSSAYELEGAV;HTRYSSAYELEGAVK;TRYSSAYELEGAVKR;RYSSAYELEGAVKRA;YSSAYELEGAVKRAD;SSAYELEGAVKRADL;SAYELEGAVKRADLV;AYELEGAVKRADLVI;YELEGAVKRADLVIG;ELEGAVKRADLVIGA;LEGAVKRADLVIGAV;EGAVKRADLVIGAVL;GAVKRADLVIGAVLV;AVKRADLVIGAVLVP;VKRADLVIGAVLVPG;KRADLVIGAVLVPGA;RADLVIGAVLVPGAK;ADLVIGAVLVPGAKA;DLVIGAVLVPGAKAP;LVIGAVLVPGAKAPK;VIGAVLVPGAKAPKL;IGAVLVPGAKAPKLV;GAVLVPGAKAPKLVS;AVLVPGAKAPKLVSN;VLVPGAKAPKLVSNS;LVPGAKAPKLVSNSL;VPGAKAPKLVSNSLV;PGAKAPKLVSNSLVA;GAKAPKLVSNSLVAH;AKAPKLVSNSLVAHM;KAPKLVSNSLVAHMK;APKLVSNSLVAHMKP;PKLVSNSLVAHMKPG;KLVSNSLVAHMKPGA;LVSNSLVAHMKPGAV;VSNSLVAHMKPGAVL;SNSLVAHMKPGAVLV;NSLVAHMKPGAVLVD;SLVAHMKPGAVLVDI;LVAHMKPGAVLVDIA;VAHMKPGAVLVDIAI;AHMKPGAVLVDIAID;HMKPGAVLVDIAIDQ;MKPGAVLVDIAIDQG;KPGAVLVDIAIDQGG;PGAVLVDIAIDQGGC;GAVLVDIAIDQGGCF;AVLVDIAIDQGGCFE;VLVDIAIDQGGCFEG;LVDIAIDQGGCFEGS;VDIAIDQGGCFEGSR;DIAIDQGGCFEGSRP;IAIDQGGCFEGSRPT;AIDQGGCFEGSRPTT;IDQGGCF | |

Fig. 30 continued

EGSRPTTY;DQGGCFEGSRPTTYD;QGGCFEGSRPTTYDH;GGCFEGSRP
TTYDHP;GCFEGSRPTTYDHPT;CFEGSRPTTYDHPTF;FEGSRPTTYDHPT
FA;EGSRPTTYDHPTFAV;GSRPTTYDHPTFAVH;SRPTTYDHPTFAVHD;RP
TTYDHPTFAVHDT;PTTYDHPTFAVHDTL;TTYDHPTFAVHDTLF;TYDHPTF
AVHDTLFY;YDHPTFAVHDTLFYC;DHPTFAVHDTLFYCV;HPTFAVHDTLFY
CVA;PTFAVHDTLFYCVAN;TFAVHDTLFYCVANM;FAVHDTLFYCVANMP;A
VHDTLFYCVANMPA;VHDTLFYCVANMPAS;HDTLFYCVANMPASV;DTLFY
CVANMPASVP;TLFYCVANMPASVPK;LFYCVANMPASVPKT;FYCVANMP
ASVPKTS;YCVANMPASVPKTST;CVANMPASVPKTSTY;VANMPASVPKTS
TYA;ANMPASVPKTSTYAL;NMPASVPKTSTYALT;MPASVPKTSTYALTN;P
ASVPKTSTYALTNA;ASVPKTSTYALTNAT;SVPKTSTYALTNATM;VPKTST
YALTNATMP;PKTSTYALTNATMPY;KTSTYALTNATMPYV;TSTYALTNATM
PYVL;STYALTNATMPYVLE;TYALTNATMPYVLEL;YALTNATMPYVLELA;A
LTNATMPYVLELAD;LTNATMPYVLELADH;TNATMPYVLELADHG;NATMP
YVLELADHGW;ATMPYVLELADHGWR;TMPYVLELADHGWRA;MPYVLELA
DHGWRAA;PYVLELADHGWRAAC;YVLELADHGWRAACR;VLELADHGWR
AACRS;LELADHGWRAACRSN;ELADHGWRAACRSNP;LADHGWRAACRS
NPA;ADHGWRAACRSNPAL;DHGWRAACRSNPALA;HGWRAACRSNPALA
K;GWRAACRSNPALAKG;WRAACRSNPALAKGL;RAACRSNPALAKGLS;A
ACRSNPALAKGLST;ACRSNPALAKGLSTH;CRSNPALAKGLSTHE;RSNPA
LAKGLSTHEG;SNPALAKGLSTHEGA;NPALAKGLSTHEGAL;PALAKGLST
HEGALL;ALAKGLSTHEGALLS;LAKGLSTHEGALLSE;AKGLSTHEGALLSE
R;KGLSTHEGALLSERV;GLSTHEGALLSERVA;LSTHEGALLSERVAT;STH
EGALLSERVATD;THEGALLSERVATDL;HEGALLSERVATDLG;EGALLSER
VATDLGV;GALLSERVATDLGVP;ALLSERVATDLGVPF;LLSERVATDLGVP
FT;LSERVATDLGVPFTE;SERVATDLGVPFTEP;ERVATDLGVPFTEPA;RV
ATDLGVPFTEPAS;VATDLGVPFTEPASV;ATDLGVPFTEPASVL;TDLGVPF
TEPASVLA;
16 mers:
MRVGIPTETKNNEFRV;RVGIPTETKNNEFRVA;VGIPTETKNNEFRVAI;GIP
TETKNNEFRVAIT;IPTETKNNEFRVAITP;PTETKNNEFRVAITPA;TETKNNE
FRVAITPAG;ETKNNEFRVAITPAGV;TKNNEFRVAITPAGVA;KNNEFRVAIT
PAGVAE;NNEFRVAITPAGVAEL;NEFRVAITPAGVAELT;EFRVAITPAGVAE
LTR;FRVAITPAGVAELTRR;RVAITPAGVAELTRRG;VAITPAGVAELTRRGH
;AITPAGVAELTRRGHE;ITPAGVAELTRRGHEV;TPAGVAELTRRGHEVL;P
AGVAELTRRGHEVLI;AGVAELTRRGHEVLIQ;GVAELTRRGHEVLIQA;VAE
LTRRGHEVLIQAG;AELTRRGHEVLIQAGA;ELTRRGHEVLIQAGAG;LTRRG
HEVLIQAGAGE;TRRGHEVLIQAGAGEG;RRGHEVLIQAGAGEGS;RGHEVL
IQAGAGEGSA;GHEVLIQAGAGEGSAI;HEVLIQAGAGEGSAIT;EVLIQAGAG
EGSAITD;VLIQAGAGEGSAITDA;LIQAGAGEGSAITDAD;IQAGAGEGSAIT
DADF;QAGAGEGSAITDADFK;AGAGEGSAITDADFKA;GAGEGSAITDADF
KAA;AGEGSAITDADFKAAG;GEGSAITDADFKAAGA;EGSAITDADFKAAGA
Q;GSAITDADFKAAGAQL;SAITDADFKAAGAQLV;AITDADFKAAGAQLVG;I
TDADFKAAGAQLVGT;TDADFKAAGAQLVGTA;DADFKAAGAQLVGTAD;A
DFKAAGAQLVGTADQ;DFKAAGAQLVGTADQV;FKAAGAQLVGTADQVW;
KAAGAQLVGTADQVWA;AAGAQLVGTADQVWAD;AGAQLVGTADQVWAD
A;GAQLVGTADQVWADAD;AQLVGTADQVWADADL;QLVGTADQVWADAD
LL;LVGTADQVWADADLLL;VGTADQVWADADLLLK;GTADQVWADADLLLK
V;TADQVWADADLLLKVK;ADQVWADADLLLKVKE;DQVWADADLLLKVKE
P;QVWADADLLLKVKEPI;VWADADLLLKVKEPIA;WADADLLLKVKEPIAA;A
DADLLLKVKEPIAAE;DADLLLKVKEPIAAEY;ADLLLKVKEPIAAEYG;DLLLK
VKEPIAAEYGR;LLLKVKEPIAAEYGRL;LLKVKEPIAAEYGRLR;LKVKEPIAA
EYGRLRH;KVKEPIAAEYGRLRHG;VKEPIAAEYGRLRHGQ;KEPIAAEYGRL

Fig. 30 continued

| | | |
|---|---|---|
| | RHGQI;EPIAAEYGRLRHGQIL;PIAAEYGRLRHGQILF;IAAEYGRLRHGQILFT;AAEYGRLRHGQILFTF;AEYGRLRHGQILFTFL;EYGRLRHGQILFTFLH;YGRLRHGQILFTFLHL;GRLRHGQILFTFLHLA;RLRHGQILFTFLHLAA;LRHGQILFTFLHLAAS;RHGQILFTFLHLAASR;HGQILFTFLHLAASRA;GQILFTFLHLAASRAC;QILFTFLHLAASRACT;ILFTFLHLAASRACTD;LFTFLHLAASRACTDA;FTFLHLAASRACTDAL;TFLHLAASRACTDALL;FLHLAASRACTDALLD;LHLAASRACTDALLDS;HLAASRACTDALLDSG;LAASRACTDALLDSGT;AASRACTDALLDSGTT;ASRACTDALLDSGTTS;SRACTDALLDSGTTSI;RACTDALLDSGTTSIA;ACTDALLDSGTTSIAY;CTDALLDSGTTSIAYE;TDALLDSGTTSIAYET;DALLDSGTTSIAYETV;ALLDSGTTSIAYETVQ;LLDSGTTSIAYETVQT;LDSGTTSIAYETVQTA;DSGTTSIAYETVQTAD;SGTTSIAYETVQTADG;GTTSIAYETVQTADGA;TTSIAYETVQTADGAL;TSIAYETVQTADGALP;SIAYETVQTADGALPL;IAYETVQTADGALPLL;AYETVQTADGALPLLA;YETVQTADGALPLLAP;ETVQTADGALPLLAPM;TVQTADGALPLLAPMS;VQTADGALPLLAPMSE;QTADGALPLLAPMSEV;TADGALPLLAPMSEVA;ADGALPLLAPMSEVAG;DGALPLLAPMSEVAGR;GALPLLAPMSEVAGRL;ALPLLAPMSEVAGRLA;LPLLAPMSEVAGRLAA;PLLAPMSEVAGRLAAQ;LLAPMSEVAGRLAAQV;LAPMSEVAGRLAAQVG;APMSEVAGRLAAQVGA;PMSEVAGRLAAQVGAY;MSEVAGRLAAQVGAYH;SEVAGRLAAQVGAYHL;EVAGRLAAQVGAYHLM;VAGRLAAQVGAYHLMR;AGRLAAQVGAYHLMRT;GRLAAQVGAYHLMRTQ;RLAAQVGAYHLMRTQG;LAAQVGAYHLMRTQGG;AAQVGAYHLMRTQGGR;AQVGAYHLMRTQGGRG;QVGAYHLMRTQGGRGV;VGAYHLMRTQGGRGVL;GAYHLMRTQGGRGVLM;AYHLMRTQGGRGVLMG;YHLMRTQGGRGVLMGG;HLMRTQGGRGVLMGGV;LMRTQGGRGVLMGGVP;MRTQGGRGVLMGGVPG;RTQGGRGVLMGGVPGV;TQGGRGVLMGGVPGVE;QGGRGVLMGGVPGVEP;GGRGVLMGGVPGVEPA;GRGVLMGGVPGVEPAD;RGVLMGGVPGVEPADV;GVLMGGVPGVEPADVV;VLMGGVPGVEPADVVV;LMGGVPGVEPADVVVI;MGGVPGVEPADVVVIG;GGVPGVEPADVVVIGA;GVPGVEPADVVVIGAG;VPGVEPADVVVIGAGT;PGVEPADVVVIGAGTA;GVEPADVVVIGAGTAG;VEPADVVVIGAGTAGY;EPADVVVIGAGTAGYN;PADVVVIGAGTAGYNA;ADVVVIGAGTAGYNAA;DVVVIGAGTAGYNAAR;VVVIGAGTAGYNAARI;VVIGAGTAGYNAARIA;VIGAGTAGYNAARIAN;IGAGTAGYNAARIANG;GAGTAGYNAARIANGM;AGTAGYNAARIANGMG;GTAGYNAARIANGMGA;TAGYNAARIANGMGAT;AGYNAARIANGMGATV;GYNAARIANGMGATVT;YNAARIANGMGATVTV;NAARIANGMGATVTVL;AARIANGMGATVTVLD;ARIANGMGATVTVLDI;RIANGMGATVTVLDIN;IANGMGATVTVLDINI;ANGMGATVTVLDINID;NGMGATVTVLDINIDK;GMGATVTVLDINIDKL;MGATVTVLDINIDKLR;GATVTVLDINIDKLRQ;ATVTVLDINIDKLRQL;TVTVLDINIDKLRQLD;VTVLDINIDKLRQLDA;TVLDINIDKLRQLDAE;VLDINIDKLRQLDAEF;LDINIDKLRQLDAEFC;DINIDKLRQLDAEFCG;INIDKLRQLDAEFCGR;NIDKLRQLDAEFCGRI;IDKLRQLDAEFCGRIH;DKLRQLDAEFCGRIHT;KLRQLDAEFCGRIHTR;LRQLDAEFCGRIHTRY;RQLDAEFCGRIHTRYS;QLDAEFCGRIHTRYSS;LDAEFCGRIHTRYSSA;DAEFCGRIHTRYSSAY;AEFCGRIHTRYSSAYE;EFCGRIHTRYSSAYEL;FCGRIHTRYSSAYELE;CGRIHTRYSSAYELEG;GRIHTRYSSAYELEGA;RIHTRYSSAYELEGAV;IHTRYSSAYELEGAVK;HTRYSSAYELEGAVKR;TRYSSAYELEGAVKRA;RYSSAYELEGAVKRAD;YSSAYELEGAVKRADL;SSAYELEGAVKRADLV;SAYELEGAVKRADLVI;AYELEGAVKRADLVIG;YELEGAVKRADLVIGA;ELEGAVKRADLVIGAV;LEGAVKRADLVIGAVL;EGAVKRADLVIGAVLV;GAVKRADLVIGAVLVP;AVKRADLVIGAVLVPG;VKRADLVIGAVLVPGA;KRADLVIGAVLVPGAK;RADLVIGAVLVPGAKA;ADLVIGAVLVPGAKAP;DLVIGAVLVPGAKAPK;LVIGAVLVPGAKAPKL;VIGAVLVPGAKAPKLV;IGAVLVPGAKAPKLVS;GAVLVPGAKAPKLVSN;AVLVPGAKAPKLVSNS;VLVPGAKAPKLVSNSL;LVPG | |

Fig. 30 continued

| | | |
|---|---|---|
| | AKAPKLVSNSLV;VPGAKAPKLVSNSLVA;PGAKAPKLVSNSLVAH;GAKAPKLVSNSLVAHM;AKAPKLVSNSLVAHMK;KAPKLVSNSLVAHMKP;APKLVSNSLVAHMKPG;PKLVSNSLVAHMKPGA;KLVSNSLVAHMKPGAV;LVSNSLVAHMKPGAVL;VSNSLVAHMKPGAVLV;SNSLVAHMKPGAVLVD;NSLVAHMKPGAVLVDI;SLVAHMKPGAVLVDIA;LVAHMKPGAVLVDIAI;VAHMKPGAVLVDIAID;AHMKPGAVLVDIAIDQ;HMKPGAVLVDIAIDQG;MKPGAVLVDIAIDQGG;KPGAVLVDIAIDQGGC;PGAVLVDIAIDQGGCF;GAVLVDIAIDQGGCFE;AVLVDIAIDQGGCFEG;VLVDIAIDQGGCFEGS;LVDIAIDQGGCFEGSR;VDIAIDQGGCFEGSRP;DIAIDQGGCFEGSRPT;IAIDQGGCFEGSRPTT;AIDQGGCFEGSRPTTY;IDQGGCFEGSRPTTYD;DQGGCFEGSRPTTYDH;QGGCFEGSRPTTYDHP;GGCFEGSRPTTYDHPT;GCFEGSRPTTYDHPTF;CFEGSRPTTYDHPTFA;FEGSRPTTYDHPTFAV;EGSRPTTYDHPTFAVH;GSRPTTYDHPTFAVHD;SRPTTYDHPTFAVHDT;RPTTYDHPTFAVHDTL;PTTYDHPTFAVHDTLF;TTYDHPTFAVHDTLFY;TYDHPTFAVHDTLFYC;YDHPTFAVHDTLFYCV;DHPTFAVHDTLFYCVA;HPTFAVHDTLFYCVAN;PTFAVHDTLFYCVANM;TFAVHDTLFYCVANMP;FAVHDTLFYCVANMPA;AVHDTLFYCVANMPAS;VHDTLFYCVANMPASV;HDTLFYCVANMPASVP;DTLFYCVANMPASVPK;TLFYCVANMPASVPKT;LFYCVANMPASVPKTS;FYCVANMPASVPKTST;YCVANMPASVPKTSTY;CVANMPASVPKTSTYA;VANMPASVPKTSTYAL;ANMPASVPKTSTYALT;NMPASVPKTSTYALTN;MPASVPKTSTYALTNA;PASVPKTSTYALTNAT;ASVPKTSTYALTNATM;SVPKTSTYALTNATMP;VPKTSTYALTNATMPY;PKTSTYALTNATMPYV;KTSTYALTNATMPYVL;TSTYALTNATMPYVLE;STYALTNATMPYVLEL;TYALTNATMPYVLELA;YALTNATMPYVLELAD;ALTNATMPYVLELADH;LTNATMPYVLELADHG;TNATMPYVLELADHGW;NATMPYVLELADHGWR;ATMPYVLELADHGWRA;TMPYVLELADHGWRAA;MPYVLELADHGWRAAC;PYVLELADHGWRAACR;YVLELADHGWRAACRS;VLELADHGWRAACRSN;LELADHGWRAACRSNP;ELADHGWRAACRSNPA;LADHGWRAACRSNPAL;ADHGWRAACRSNPALA;DHGWRAACRSNPALAK;HGWRAACRSNPALAKG;GWRAACRSNPALAKGL;WRAACRSNPALAKGLS;RAACRSNPALAKGLST;AACRSNPALAKGLSTH;ACRSNPALAKGLSTHE;CRSNPALAKGLSTHEG;RSNPALAKGLSTHEGA;SNPALAKGLSTHEGAL;NPALAKGLSTHEGALL;PALAKGLSTHEGALLS;ALAKGLSTHEGALLSE;LAKGLSTHEGALLSER;AKGLSTHEGALLSERV;KGLSTHEGALLSERVA;GLSTHEGALLSERVAT;LSTHEGALLSERVATD;STHEGALLSERVATDL;THEGALLSERVATDLG;HEGALLSERVATDLGV;EGALLSERVATDLGVP;GALLSERVATDLGVPF;ALLSERVATDLGVPFT;LLSERVATDLGVPFTE;LSERVATDLGVPFTEP;SERVATDLGVPFTEPA;ERVATDLGVPFTEPAS;RVATDLGVPFTEPASV;VATDLGVPFTEPASVL;ATDLGVPFTEPASVLA | |
| 29 | **<NP_216400.1 resuscitation-promoting factor RpfC Rv1884c;Mycobacterium tuberculosis H37Rv>**<br>MHPLPADHGRSRCNRHPISPLSLIGNASATSGDMSSMTRIAKPLIKSAMAAGLVTASMSLSTAVAHAGPSPNWDAVAQCESGGNWAANTGNGKYGGLQFKPATWAAFGGVGNPAAASREQQIAVANRVLAEQGLDAWPTCGAASGLPIALWSKPAQGIKQIINEIIWAGIQASIPR<br><br>8mer<br>HGRSRCNR;RSRCNRHP;HPISPLSL;PISPLSLI;SLIGNASA;DMSSMTRI;SSMTRIAK;MTRIAKPL;RIAKPLIK;KPLIKSAM;PLIKSAMA;LIKSAMAA;SAMAAGLV;AMAAGLVT;MAAGLVTA;LVTASMSL;SMSLSTAV;HAGPSPNW;SPNWDAVA;AANTGNGK;KYGGLQFK;LQFKPATW;FKPATWAA;KPATWAAF;TWAAFGGV;QQIAVANR;QIAVANRV;IAVANRVL;AVANRVLA;RVLAEQGL;AEQGLDAW;GLDAWPTC;DAWPTCGA;WPTCGAAS;GAASGLPI;SGLPIALW;LPIALWSK;ALWSKPAQ;KQIINEII;QIINEIIW;IINEIIWA;IIWAGIQA;GIQASIPR | 165366-166193 |

Fig. 30 continued

| | | | |
|---|---|---|---|
| | 9mer<br>DHGRSRCNR;RSRCNRHPI;HPISPLSLI;SPLSLIGNA;SLIGNASAT;ATSGD<br>MSSM;MSSMTRIAK;SMTRIAKPL;MTRIAKPLI;IAKPLIKSA;KPLIKSAMA;PLI<br>KSAMAA;AMAAGLVTA;MAAGLVTAS;AAGLVTASM;GLVTASMSL;TASMSL<br>STA;ASMSLSTAV;SMSLSTAVA;SLSTAVAHA;GPSPNWDAV;SPNWDAVA<br>Q;WAANTGNGK;LQFKPATWA;FKPATWAAF;ATWAAFGGV;EQQIAVANR;<br>QQIAVANRV;VLAEQGLDA;LAEQGLDAW;DAWPTCGAA;AASGLPIAL;GLPI<br>ALWSK;LPIALWSKP;WSKPAQGIK;KPAQGIKQI;GIKQIINEI;KQIINEIIW;QII<br>NEIIWA;EIIWAGIQA;IIWAGIQAS;IWAGIQASI<br>10mer<br>LPADHGRSRC;ADHGRSRCNR;RSRCNRHPIS;SPLSLIGNAS;PLSLIGNAS<br>A;SLIGNASATS;SATSGDMSSM;TSGDMSSMTR;DMSSMTRIAK;SSMTRIA<br>KPL;SMTRIAKPLI;MTRIAKPLIK;RIAKPLIKSA;IAKPLIKSAM;KPLIKSAMAA;<br>LIKSAMAAGL;SAMAAGLVTA;AMAAGLVTAS;MAAGLVTASM;GLVTASMSL<br>S;VTASMSLSTA;TASMSLSTAV;SMSLSTAVAH;STAVAHAGPS;VAHAGPS<br>PNW;AQCESGGNWA;NWAANTGNGK;WAANTGNGKY;GGLQFKPATW;GL<br>QFKPATWA;LQFKPATWAA;QFKPATWAAF;AAFGGVGNPA;AASREQQIAV<br>;QQIAVANRVL;QIAVANRVLA;VLAEQGLDAW;AEQGLDAWPT;GLDAWPTC<br>GA;DAWPTCGAAS;WPTCGAASGL;GAASGLPIAL;AASGLPIALW;SGLPIAL<br>WSK;LPIALWSKPA;ALWSKPAQGI;KPAQGIKQII;QGIKQIINEI;GIKQIINEII;K<br>QIINEIIWA;IINEIIWAGI;NEIIWAGIQA;IIWAGIQASI<br>11mer<br>RSRCNRHPISP;SPLSLIGNASA;ATSGDMSSMTR;MSSMTRIAKPL;SMTRIA<br>KPLIK;RIAKPLIKSAM;PLIKSAMAAGL;LIKSAMAAGLV;AMAAGLVTASM;AA<br>GLVTASMSL;GLVTASMSLST;LVTASMSLSTA;VTASMSLSTAV;ASMSLST<br>AVAH;SMSLSTAVAHA;AVAHAGPSPNW;HAGPSPNWDAV;AQCESGGNW<br>AA;NWAANTGNGKY;GLQFKPATWAA;LQFKPATWAAF;KPATWAAFGGV;<br>WAAFGGVGNPA;AAFGGVGNPAA;AAASREQQIAV;REQQIAVANRV;QQIA<br>VANRVLA;RVLAEQGLDAW;LAEQGLDAWPT;GLDAWPTCGAA;GAASGLPI<br>ALW;ASGLPIALWSK;GLPIALWSKPA;LPIALWSKPAQ;ALWSKPAQGIK;AQ<br>GIKQIINEI;QIINEIIWAGI;EIIWAGIQASI;IWAGIQASIPR<br><br>13 mers:<br>MHPLPADHGRSRC;HPLPADHGRSRCN;PLPADHGRSRCNR;LPADHGRS<br>RCNRH;PADHGRSRCNRHP;ADHGRSRCNRHPI;DHGRSRCNRHPIS;HGR<br>SRCNRHPISP;GRSRCNRHPISPL;RSRCNRHPISPLS;SRCNRHPISPLSL;R<br>CNRHPISPLSLI;CNRHPISPLSLIG;NRHPISPLSLIGN;RHPISPLSLIGNA;HPI<br>SPLSLIGNAS;PISPLSLIGNASA;ISPLSLIGNASAT;SPLSLIGNASATS;PLSLI<br>GNASATSG;LSLIGNASATSGD;SLIGNASATSGDM;LIGNASATSGDMS;IGN<br>ASATSGDMSS;GNASATSGDMSSM;NASATSGDMSSMT;ASATSGDMSSM<br>TR;SATSGDMSSMTRI;ATSGDMSSMTRIA;TSGDMSSMTRIAK;SGDMSSM<br>TRIAKP;GDMSSMTRIAKPL;DMSSMTRIAKPLI;MSSMTRIAKPLIK;SSMTRI<br>AKPLIKS;SMTRIAKPLIKSA;MTRIAKPLIKSAM;TRIAKPLIKSAMA;RIAKPLIK<br>SAMAA;IAKPLIKSAMAAG;AKPLIKSAMAAGL;KPLIKSAMAAGLV;PLIKSAM<br>AAGLVT;LIKSAMAAGLVTA;IKSAMAAGLVTAS;KSAMAAGLVTASM;SAMA<br>AGLVTASMS;AMAAGLVTASMSL;MAAGLVTASMSLS;AAGLVTASMSLST;<br>AGLVTASMSLSTA;GLVTASMSLSTAV;LVTASMSLSTAVA;VTASMSLSTAV<br>AH;TASMSLSTAVAHA;ASMSLSTAVAHAG;SMSLSTAVAHAGP;MSLSTAV<br>AHAGPS;SLSTAVAHAGPSP;LSTAVAHAGPSPN;STAVAHAGPSPNW;TAV<br>AHAGPSPNWD;AVAHAGPSPNWDA;VAHAGPSPNWDAV;AHAGPSPNWD<br>AVA;HAGPSPNWDAVAQ;AGPSPNWDAVAQC;GPSPNWDAVAQCE;PSPN<br>WDAVAQCES;SPNWDAVAQCESG;PNWDAVAQCESGG;NWDAVAQCES<br>GGN;WDAVAQCESGGNW;DAVAQCESGGNWA;AVAQCESGGNWAA;VA | |

Fig. 30 continued

| | | |
|---|---|---|
| | QCESGGNWAAN;AQCESGGNWAANT;QCESGGNWAANTG;CESGGNWAANTGN;ESGGNWAANTGNG;SGGNWAANTGNGK;GGNWAANTGNGKY;GNWAANTGNGKYG;NWAANTGNGKYGG;WAANTGNGKYGGL;AANTGNGKYGGLQ;ANTGNGKYGGLQF;NTGNGKYGGLQFK;TGNGKYGGLQFKP;GNGKYGGLQFKPA;NGKYGGLQFKPAT;GKYGGLQFKPATW;KYGGLQFKPATWA;YGGLQFKPATWAA;GGLQFKPATWAAF;GLQFKPATWAAFG;LQFKPATWAAFGG;QFKPATWAAFGGV;FKPATWAAFGGVG;KPATWAAFGGVGN;PATWAAFGGVGNP;ATWAAFGGVGNPA;TWAAFGGVGNPAA;WAAFGGVGNPAAA;AAFGGVGNPAAAS;AFGGVGNPAAASR;FGGVGNPAAASRE;GGVGNPAAASREQ;GVGNPAAASREQQ;VGNPAAASREQQI;GNPAAASREQQIA;NPAAASREQQIAV;PAAASREQQIAVA;AAASREQQIAVAN;AASREQQIAVANR;ASREQQIAVANRV;SREQQIAVANRVL;REQQIAVANRVLA;EQQIAVANRVLAE;QQIAVANRVLAEQ;QIAVANRVLAEQG;IAVANRVLAEQGL;AVANRVLAEQGLD;VANRVLAEQGLDA;ANRVLAEQGLDAW;NRVLAEQGLDAWP;RVLAEQGLDAWPT;VLAEQGLDAWPTC;LAEQGLDAWPTCG;AEQGLDAWPTCGA;EQGLDAWPTCGAA;QGLDAWPTCGAAS;GLDAWPTCGAASG;LDAWPTCGAASGL;DAWPTCGAASGLP;AWPTCGAASGLPI;WPTCGAASGLPIA;PTCGAASGLPIAL;TCGAASGLPIALW;CGAASGLPIALWS;GAASGLPIALWSK;AASGLPIALWSKP;ASGLPIALWSKPA;SGLPIALWSKPAQ;GLPIALWSKPAQG;LPIALWSKPAQGI;PIALWSKPAQGIK;IALWSKPAQGIKQ;ALWSKPAQGIKQI;LWSKPAQGIKQII;WSKPAQGIKQIIN;SKPAQGIKQIINE;KPAQGIKQIINEI;PAQGIKQIINEII;AQGIKQIINEIIW;QGIKQIINEIIWA;GIKQIINEIIWAG;IKQIINEIIWAGI;KQIINEIIWAGIQ;QIINEIIWAGIQA;IINEIIWAGIQAS;INEIIWAGIQASI;NEIIWAGIQASIP;EIIWAGIQASIPR;<br>14 mers:<br>MHPLPADHGRSRCN;HPLPADHGRSRCNR;PLPADHGRSRCNRH;LPADHGRSRCNRHP;PADHGRSRCNRHPI;ADHGRSRCNRHPIS;DHGRSRCNRHPISP;HGRSRCNRHPISPL;GRSRCNRHPISPLS;RSRCNRHPISPLSL;SRCNRHPISPLSLI;RCNRHPISPLSLIG;CNRHPISPLSLIGN;NRHPISPLSLIGNA;RHPISPLSLIGNAS;HPISPLSLIGNASA;PISPLSLIGNASAT;ISPLSLIGNASATS;SPLSLIGNASATSG;PLSLIGNASATSGD;LSLIGNASATSGDM;SLIGNASATSGDMS;LIGNASATSGDMSS;IGNASATSGDMSSM;GNASATSGDMSSMT;NASATSGDMSSMTR;ASATSGDMSSMTRI;SATSGDMSSMTRIA;ATSGDMSSMTRIAK;TSGDMSSMTRIAKP;SGDMSSMTRIAKPL;GDMSSMTRIAKPLI;DMSSMTRIAKPLIK;MSSMTRIAKPLIKS;SSMTRIAKPLIKSA;SMTRIAKPLIKSAM;MTRIAKPLIKSAMA;TRIAKPLIKSAMAA;RIAKPLIKSAMAAG;IAKPLIKSAMAAGL;AKPLIKSAMAAGLV;KPLIKSAMAAGLVT;PLIKSAMAAGLVTA;LIKSAMAAGLVTAS;IKSAMAAGLVTASM;KSAMAAGLVTASMS;SAMAAGLVTASMSL;AMAAGLVTASMSLS;MAAGLVTASMSLST;AAGLVTASMSLSTA;AGLVTASMSLSTAV;GLVTASMSLSTAVA;LVTASMSLSTAVAH;VTASMSLSTAVAHA;TASMSLSTAVAHAG;ASMSLSTAVAHAGP;SMSLSTAVAHAGPS;MSLSTAVAHAGPSP;SLSTAVAHAGPSPN;LSTAVAHAGPSPNW;STAVAHAGPSPNWD;TAVAHAGPSPNWDA;AVAHAGPSPNWDAV;VAHAGPSPNWDAVA;AHAGPSPNWDAVAQ;HAGPSPNWDAVAQC;AGPSPNWDAVAQCE;GPSPNWDAVAQCES;PSPNWDAVAQCESG;SPNWDAVAQCESGG;PNWDAVAQCESGGN;NWDAVAQCESGGNW;WDAVAQCESGGNWA;DAVAQCESGGNWAA;AVAQCESGGNWAAN;VAQCESGGNWAANT;AQCESGGNWAANTG;QCESGGNWAANTGN;CESGGNWAANTGNG;ESGGNWAANTGNGK;SGGNWAANTGNGKY;GGNWAANTGNGKYG;GNWAANTGNGKYGG;NWAANTGNGKYGGL;WAANTGNGKYGGLQ;AANTGNGKYGGLQF;ANTGNGKYGGLQFK;NTGNGKYGGLQFKP;TGNGKYGGLQFKPA;GNGKYGGLQFKPAT;NGKYGGLQFKPATW;GKYGGLQFKPATWA;KYGGLQFKPATWAA;YGGLQFKPATWAAF;GGLQFKPATWAAFG;GLQFKPATWAAFGG;LQFKPATWAAF | |

Fig. 30 continued

| | | |
|---|---|---|
| | GGV;QFKPATWAAFGGVG;FKPATWAAFGGVGN;KPATWAAFGGVGNP;PATWAAFGGVGNPA;ATWAAFGGVGNPAA;TWAAFGGVGNPAAA;WAAFGGVGNPAAAS;AAFGGVGNPAAASR;AFGGVGNPAAASRE;FGGVGNPAAASREQ;GGVGNPAAASREQQ;GVGNPAAASREQQI;VGNPAAASREQQIA;GNPAAASREQQIAV;NPAAASREQQIAVA;PAAASREQQIAVAN;AAASREQQIAVANR;AASREQQIAVANRV;ASREQQIAVANRVL;SREQQIAVANRVLA;REQQIAVANRVLAE;EQQIAVANRVLAEQ;QQIAVANRVLAEQG;QIAVANRVLAEQGL;IAVANRVLAEQGLD;AVANRVLAEQGLDA;VANRVLAEQGLDAW;ANRVLAEQGLDAWP;NRVLAEQGLDAWPT;RVLAEQGLDAWPTC;VLAEQGLDAWPTCG;LAEQGLDAWPTCGA;AEQGLDAWPTCGAA;EQGLDAWPTCGAAS;QGLDAWPTCGAASG;GLDAWPTCGAASGL;LDAWPTCGAASGLP;DAWPTCGAASGLPI;AWPTCGAASGLPIA;WPTCGAASGLPIAL;PTCGAASGLPIALW;TCGAASGLPIALWS;CGAASGLPIALWSK;GAASGLPIALWSKP;AASGLPIALWSKPA;ASGLPIALWSKPAQ;SGLPIALWSKPAQG;GLPIALWSKPAQGI;LPIALWSKPAQGIK;PIALWSKPAQGIKQ;IALWSKPAQGIKQI;ALWSKPAQGIKQII;LWSKPAQGIKQIIN;WSKPAQGIKQIINE;SKPAQGIKQIINEI;KPAQGIKQIINEII;PAQGIKQIINEIIW;AQGIKQIINEIIWA;QGIKQIINEIIWAG;GIKQIINEIIWAGI;IKQIINEIIWAGIQ;KQIINEIIWAGIQA;QIINEIIWAGIQAS;IINEIIWAGIQASI;INEIIWAGIQASIP;NEIIWAGIQASIPR;<br>15 mers:<br>MHPLPADHGRSRCNR;HPLPADHGRSRCNRH;PLPADHGRSRCNRHP;LPADHGRSRCNRHPI;PADHGRSRCNRHPIS;ADHGRSRCNRHPISP;DHGRSRCNRHPISPL;HGRSRCNRHPISPLS;GRSRCNRHPISPLSL;RSRCNRHPISPLSLI;SRCNRHPISPLSLIG;RCNRHPISPLSLIGN;CNRHPISPLSLIGNA;NRHPISPLSLIGNAS;RHPISPLSLIGNASA;HPISPLSLIGNASAT;PISPLSLIGNASATS;ISPLSLIGNASATSG;SPLSLIGNASATSGD;PLSLIGNASATSGDM;LSLIGNASATSGDMS;SLIGNASATSGDMSS;LIGNASATSGDMSSM;IGNASATSGDMSSMT;GNASATSGDMSSMTR;NASATSGDMSSMTRI;ASATSGDMSSMTRIA;SATSGDMSSMTRIAK;ATSGDMSSMTRIAKP;TSGDMSSMTRIAKPL;SGDMSSMTRIAKPLI;GDMSSMTRIAKPLIK;DMSSMTRIAKPLIKS;MSSMTRIAKPLIKSA;SSMTRIAKPLIKSAM;SMTRIAKPLIKSAMA;MTRIAKPLIKSAMAA;TRIAKPLIKSAMAAG;RIAKPLIKSAMAAGL;IAKPLIKSAMAAGLV;AKPLIKSAMAAGLVT;KPLIKSAMAAGLVTA;PLIKSAMAAGLVTAS;LIKSAMAAGLVTASM;IKSAMAAGLVTASMS;KSAMAAGLVTASMSL;SAMAAGLVTASMSLS;AMAAGLVTASMSLST;MAAGLVTASMSLSTA;AAGLVTASMSLSTAV;AGLVTASMSLSTAVA;GLVTASMSLSTAVAH;LVTASMSLSTAVAHA;VTASMSLSTAVAHAG;TASMSLSTAVAHAGP;ASMSLSTAVAHAGPS;SMSLSTAVAHAGPSP;MSLSTAVAHAGPSPN;SLSTAVAHAGPSPNW;LSTAVAHAGPSPNWD;STAVAHAGPSPNWDA;TAVAHAGPSPNWDAV;AVAHAGPSPNWDAVA;VAHAGPSPNWDAVAQ;AHAGPSPNWDAVAQC;HAGPSPNWDAVAQCE;AGPSPNWDAVAQCES;GPSPNWDAVAQCESG;PSPNWDAVAQCESGG;SPNWDAVAQCESGGN;PNWDAVAQCESGGNW;NWDAVAQCESGGNWA;WDAVAQCESGGNWAA;DAVAQCESGGNWAAN;AVAQCESGGNWAANT;VAQCESGGNWAANTG;AQCESGGNWAANTGN;QCESGGNWAANTGNG;CESGGNWAANTGNGK;ESGGNWAANTGNGKY;SGGNWAANTGNGKYG;GGNWAANTGNGKYGG;GNWAANTGNGKYGGL;NWAANTGNGKYGGLQ;WAANTGNGKYGGLQF;AANTGNGKYGGLQFK;ANTGNGKYGGLQFKP;NTGNGKYGGLQFKPA;TGNGKYGGLQFKPAT;GNGKYGGLQFKPATW;NGKYGGLQFKPATWA;GKYGGLQFKPATWAA;KYGGLQFKPATWAAF;YGGLQFKPATWAAFG;GGLQFKPATWAAFGG;GLQFKPATWAAFGGV;LQFKPATWAAFGGVG;QFKPATWAAFGGVGN;FKPATWAAFGGVGNP;KPATWAAFGGVGNPA;PATWAAFGGVGNPAA;ATWAAFGGVGNPAAA;TWAAFGGVGNPAAAS;WAAFGGVGNPAAASR;AAFGGVGNPAAASRE;AFGGVGNPAAASREQ;F | |

Fig. 30 continued

| | | |
|---|---|---|
| | GGVGNPAAASREQQ;GGVGNPAAASREQQI;GVGNPAAASREQQIA;VGNPAAASREQQIAV;GNPAAASREQQIAVA;NPAAASREQQIAVAN;PAAASREQQIAVANR;AAASREQQIAVANRV;AASREQQIAVANRVL;ASREQQIAVANRVLA;SREQQIAVANRVLAE;REQQIAVANRVLAEQ;EQQIAVANRVLAEQG;QQIAVANRVLAEQGL;QIAVANRVLAEQGLD;IAVANRVLAEQGLDA;AVANRVLAEQGLDAW;VANRVLAEQGLDAWP;ANRVLAEQGLDAWPT;NRVLAEQGLDAWPTC;RVLAEQGLDAWPTCG;VLAEQGLDAWPTCGA;LAEQGLDAWPTCGAA;AEQGLDAWPTCGAAS;EQGLDAWPTCGAASG;QGLDAWPTCGAASGL;GLDAWPTCGAASGLP;LDAWPTCGAASGLPI;DAWPTCGAASGLPIA;AWPTCGAASGLPIAL;WPTCGAASGLPIALW;PTCGAASGLPIALWS;TCGAASGLPIALWSK;CGAASGLPIALWSKP;GAASGLPIALWSKPA;AASGLPIALWSKPAQ;ASGLPIALWSKPAQG;SGLPIALWSKPAQGI;GLPIALWSKPAQGIK;LPIALWSKPAQGIKQ;PIALWSKPAQGIKQI;IALWSKPAQGIKQII;ALWSKPAQGIKQIIN;LWSKPAQGIKQIINE;WSKPAQGIKQIINEI;SKPAQGIKQIINEII;KPAQGIKQIINEIIW;PAQGIKQIINEIIWA;AQGIKQIINEIIWAG;QGIKQIINEIIWAGI;GIKQIINEIIWAGIQ;IKQIINEIIWAGIQA;KQIINEIIWAGIQAS;QIINEIIWAGIQASI;IINEIIWAGIQASIP;INEIIWAGIQASIPR;<br>16 mers:<br>MHPLPADHGRSRCNRH;HPLPADHGRSRCNRHP;PLPADHGRSRCNRHPI;LPADHGRSRCNRHPIS;PADHGRSRCNRHPISP;ADHGRSRCNRHPISPL;DHGRSRCNRHPISPLS;HGRSRCNRHPISPLSL;GRSRCNRHPISPLSLI;RSRCNRHPISPLSLIG;SRCNRHPISPLSLIGN;RCNRHPISPLSLIGNA;CNRHPISPLSLIGNAS;NRHPISPLSLIGNASA;RHPISPLSLIGNASAT;HPISPLSLIGNASATS;PISPLSLIGNASATSG;ISPLSLIGNASATSGD;SPLSLIGNASATSGDM;PLSLIGNASATSGDMS;LSLIGNASATSGDMSS;SLIGNASATSGDMSSM;LIGNASATSGDMSSMT;IGNASATSGDMSSMTR;GNASATSGDMSSMTRI;NASATSGDMSSMTRIA;ASATSGDMSSMTRIAK;SATSGDMSSMTRIAKP;ATSGDMSSMTRIAKPL;TSGDMSSMTRIAKPLI;SGDMSSMTRIAKPLIK;GDMSSMTRIAKPLIKS;DMSSMTRIAKPLIKSA;MSSMTRIAKPLIKSAM;SSMTRIAKPLIKSAMA;SMTRIAKPLIKSAMAA;MTRIAKPLIKSAMAAG;TRIAKPLIKSAMAAGL;RIAKPLIKSAMAAGLV;IAKPLIKSAMAAGLVT;AKPLIKSAMAAGLVTA;KPLIKSAMAAGLVTAS;PLIKSAMAAGLVTASM;LIKSAMAAGLVTASMS;IKSAMAAGLVTASMSL;KSAMAAGLVTASMSLS;SAMAAGLVTASMSLST;AMAAGLVTASMSLSTA;MAAGLVTASMSLSTAV;AAGLVTASMSLSTAVA;AGLVTASMSLSTAVAH;GLVTASMSLSTAVAHA;LVTASMSLSTAVAHAG;VTASMSLSTAVAHAGP;TASMSLSTAVAHAGPS;ASMSLSTAVAHAGPSP;SMSLSTAVAHAGPSPN;MSLSTAVAHAGPSPNW;SLSTAVAHAGPSPNWD;LSTAVAHAGPSPNWDA;STAVAHAGPSPNWDAV;TAVAHAGPSPNWDAVA;AVAHAGPSPNWDAVAQ;VAHAGPSPNWDAVAQC;AHAGPSPNWDAVAQCE;HAGPSPNWDAVAQCES;AGPSPNWDAVAQCESG;GPSPNWDAVAQCESGG;PSPNWDAVAQCESGGN;SPNWDAVAQCESGGNW;PNWDAVAQCESGGNWA;NWDAVAQCESGGNWAA;WDAVAQCESGGNWAAN;DAVAQCESGGNWAANT;AVAQCESGGNWAANTG;VAQCESGGNWAANTGN;AQCESGGNWAANTGNG;QCESGGNWAANTGNGK;CESGGNWAANTGNGKY;ESGGNWAANTGNGKYG;SGGNWAANTGNGKYGG;GGNWAANTGNGKYGGL;GNWAANTGNGKYGGLQ;NWAANTGNGKYGGLQF;WAANTGNGKYGGLQFK;AANTGNGKYGGLQFKP;ANTGNGKYGGLQFKPA;NTGNGKYGGLQFKPAT;TGNGKYGGLQFKPATW;GNGKYGGLQFKPATWA;NGKYGGLQFKPATWAA;GKYGGLQFKPATWAAF;KYGGLQFKPATWAAFG;YGGLQFKPATWAAFGG;GGLQFKPATWAAFGGV;GLQFKPATWAAFGGVG;LQFKPATWAAFGGVGN;QFKPATWAAFGGVGNP;FKPATWAAFGGVGNPA;KPATWAAFGGVGNPAA;PATWAAFGGVGNPAAA;ATWAAFGGVGNPAAAS;TWAAFGGVGNPAAASR;WAAFGGVGNPAAASRE;AAFGGVGNPAAASREQ;AFGGVGNPAA | |

Fig. 30 continued

| | | |
|---|---|---|
| | ASREQQ;FGGVGNPAAASREQQI;GGVGNPAAASREQQIA;GVGNPAAASR EQQIAV;VGNPAAASREQQIAVA;GNPAAASREQQIAVAN;NPAAASREQQI AVANR;PAAASREQQIAVANRV;AAASREQQIAVANRVL;AASREQQIAVAN RVLA;ASREQQIAVANRVLAE;SREQQIAVANRVLAEQ;REQQIAVANRVLAE QG;EQQIAVANRVLAEQGL;QQIAVANRVLAEQGLD;QIAVANRVLAEQGLD A;IAVANRVLAEQGLDAW;AVANRVLAEQGLDAWP;VANRVLAEQGLDAWP T;ANRVLAEQGLDAWPTC;NRVLAEQGLDAWPTCG;RVLAEQGLDAWPTC GA;VLAEQGLDAWPTCGAA;LAEQGLDAWPTCGAAS;AEQGLDAWPTCGA ASG;EQGLDAWPTCGAASGL;QGLDAWPTCGAASGLP;GLDAWPTCGAAS GLPI;LDAWPTCGAASGLPIA;DAWPTCGAASGLPIAL;AWPTCGAASGLPIA LW;WPTCGAASGLPIALWS;PTCGAASGLPIALWSK;TCGAASGLPIALWSK P;CGAASGLPIALWSKPA;GAASGLPIALWSKPAQ;AASGLPIALWSKPAQG; ASGLPIALWSKPAQGI;SGLPIALWSKPAQGIK;GLPIALWSKPAQGIKQ;LPIA LWSKPAQGIKQI;PIALWSKPAQGIKQII;IALWSKPAQGIKQIIN;ALWSKPAQ GIKQIINE;LWSKPAQGIKQIINEI;WSKPAQGIKQIINEII;SKPAQGIKQIINEIIW; KPAQGIKQIINEIIWA;PAQGIKQIINEIIWAG;AQGIKQIINEIIWAGI;QGIKQIIN EIIWAGIQ;GIKQIINEIIWAGIQA;IKQIINEIIWAGIQAS;KQIINEIIWAGIQASI;QI INEIIWAGIQASIP;IINEIIWAGIQASIPR | |
| 30 | **>NP_217136.1 transmembrane protein Rv2620c;Mycobacterium tuberculosis H37Rv>**<br>MSAGPAIEVAVAFVWLGMVVAISFLEAPLKFRAAGVTLQIGLGIGRLVFRAL NTVEVGFALVILAIVVVGSTPARIAAAFSVALAALAVQLIAVRPRLTRRSNQV LAGLQAPRSRGHHIYVGLEIVKVVALLVAGILLLNG<br><br>8mer<br>SAGPAIEV;GPAIEVAV;AIEVAVAF;IEVAVAFV;EVAVAFVW;VAVAFVWL;FV WLGMVV;WLGMVVAI;GMVVAISF;MVVAISFL;VAISFLEA;SFLEAPLK;EAPL KFRA;APLKFRAA;FRAAGVTL;TLQIGLGI;GLGIGRLV;GIGRLVFR;GRLVFR AL;RALNTVEV;NTVEVGFA;TVEVGFAL;VEVGFALV;EVGFALVI;FALVILAI; ALVILAIV;LVILAIVV;VILAIVVV;VVVGSTPA;VVGSTPAR;STPARIAA;TPARI AAA;RIAAAFSV;IAAAFSVA;AAAFSVAL;FSVALAAL;SVALAALA;VALAALAV ;ALAALAVQ;LAALAVQL;ALAVQLIA;LAVQLIAV;AVQLIAVR;QLIAVRPR;LIA VRPRL;AVRPRLTR;RPRLTRRS;LTRRSNQV;QVLAGLQA;VLAGLQAP;LAG LQAPR;GLQAPRSR;APRSRGHH;RSRGHHIY;SRGHHIYV;HIYVGLEI;YVG LEIVK;VGLEIVKV;GLEIVKVV;EIVKVVAL;KVVALLVA;ALLVAGIL;LLVAGILL; LVAGILLL<br>9mer<br>MSAGPAIEV;PAIEVAVAF;AIEVAVAFV;IEVAVAFVW;EVAVAFVWL;AVAFV WLGM;VAFVWLGMV;AFVWLGMVV;FVWLGMVVA;VWLGMVVAI;LGMVVA ISF;GMVVAISFL;MVVAISFLE;VVAISFLEA;AISFLEAPL;ISFLEAPLK;SFLEA PLKF;APLKFRAAG;PLKFRAAGV;KFRAAGVTL;RAAGVTLQI;LQIGLGIGR;L GIGRLVFR;GIGRLVFRA;IGRLVFRAL;RLVFRALNT;LVFRALNTV;FRALNTV EV;ALNTVEVGF;NTVEVGFAL;TVEVGFALV;VEVGFALVI;EVGFALVIL;FAL VILAIV;ALVILAIVV;LVILAIVVV;ILAIVVVGS;IVVVGSTPA;VVVGSTPAR;VVG STPARI;STPARIAAA;TPARIAAAF;ARIAAAFSV;RIAAAFSVA;IAAAFSVAL;A AAFSVALA;AAFSVALAA;FSVALAALA;SVALAALAV;ALAALAVQL;LAALAV QLI;ALAVQLIAV;LAVQLIAVR;VQLIAVRPR;QLIAVRPRL;IAVRPRLTR;AVRP RLTRR;RPRLTRRSN;RLTRRSNQV;RSNQVLAGL;NQVLAGLQA;VLAGLQA PR;LQAPRSRGH;APRSRGHHI;RSRGHHIYV;HIYVGLEIV;IYVGLEIVK;YVG LEIVKV;GLEIVKVVA;LEIVKVVAL;EIVKVVALL;IVKVVALLV;VVALLVAGI;AL LVAGILL;LLVAGILLL<br>10mer<br>MSAGPAIEVA;SAGPAIEVAV;GPAIEVAVAF;PAIEVAVAFV;IEVAVAFVWL;E | 166194-<br>166967 |

Fig. 30 continued

VAVAFVWLG;VAVAFVWLGM;AVAFVWLGMV;VAFVWLGMVV;FVWLGMV
VAI;WLGMVVAISF;LGMVVAISFL;MVVAISFLEA;VAISFLEAPL;AISFLEAPL
K;ISFLEAPLKF;SFLEAPLKFR;FLEAPLKFRA;APLKFRAAGV;KFRAAGVTL
Q;FRAAGVTLQI;TLQIGLGIGR;LQIGLGIGRL;QIGLGIGRLV;GLGIGRLVFR;
GIGRLVFRAL;RLVFRALNTV;RALNTVEVGF;ALNTVEVGFA;NTVEVGFALV
;VEVGFALVIL;EVGFALVILA;FALVILAIVV;ALVILAIVVV;ILAIVVVGST;AIVVV
GSTPA;IVVVGSTPAR;VVVGSTPARI;STPARIAAAF;RIAAAFSVAL;IAAAFS
VALA;AAFSVALAAL;FSVALAALAV;ALAALAVQLI;AALAVQLIAV;ALAVQLIA
VR;AVQLIAVRPR;VQLIAVRPRL;LIAVRPRLTR;IAVRPRLTRR;RPRLTRRS
NQ;RLTRRSNQVL;LTRRSNQVLA;RRSNQVLAGL;QVLAGLQAPR;VLAGLQ
APRS;LQAPRSRGHH;APRSRGHHIY;HIYVGLEIVK;IYVGLEIVKV;YVGLEIV
KVV;GLEIVKVVAL;LEIVKVVALL;EIVKVVALLV;KVVALLVAGI;ALLVAGILLL
11mer
MSAGPAIEVAV;PAIEVAVAFVW;AIEVAVAFVWL;EVAVAFVWLGM;VAVAF
VWLGMV;AVAFVWLGMVV;AFVWLGMVVAI;VWLGMVVAISF;WLGMVVAIS
FL;GMVVAISFLEA;VVAISFLEAPL;VAISFLEAPLK;ISFLEAPLKFR;FLEAPLK
FRAA;EAPLKFRAAGV;APLKFRAAGVT;PLKFRAAGVTL;KFRAAGVTLQI;R
AAGVTLQIGL;VTLQIGLGIGR;TLQIGLGIGRL;LQIGLGIGRLV;IGLGIGRLVF
R;GLGIGRLVFRA;LVFRALNTVEV;FRALNTVEVGF;ALNTVEVGFAL;NTVE
VGFALVI;TVEVGFALVIL;VEVGFALVILA;EVGFALVILAI;FALVILAIVVV;LAIV
VVGSTPA;AIVVVGSTPAR;IVVVGSTPARI;TPARIAAAFSV;ARIAAAFSVAL;
RIAAAFSVALA;IAAAFSVALAA;AAAFSVALAAL;SVALAALAVQL;ALAALAV
QLIA;LAALAVQLIAV;AALAVQLIAVR;LAVQLIAVRPR;QLIAVRPRLTR;LIAV
RPRLTRR;RPRLTRRSNQV;RLTRRSNQVLA;NQVLAGLQAPR;LQAPRSRG
HHI;QAPRSRGHHIY;APRSRGHHIYV;RSRGHHIYVGL;HIYVGLEIVKV;GLEI
VKVVALL;KVVALLVAGIL;VVALLVAGILL 13 mers:
MSAGPAIEVAVAF;SAGPAIEVAVAFV;AGPAIEVAVAFVW;GPAIEVAVAFV
WL;PAIEVAVAFVWLG;AIEVAVAFVWLGM;IEVAVAFVWLGMV;EVAVAFVW
LGMVV;VAVAFVWLGMVVA;AVAFVWLGMVVAI;VAFVWLGMVVAIS;AFVW
LGMVVAISF;FVWLGMVVAISFL;VWLGMVVAISFLE;WLGMVVAISFLEA;LG
MVVAISFLEAP;GMVVAISFLEAPL;MVVAISFLEAPLK;VVAISFLEAPLKF;VA
ISFLEAPLKFR;AISFLEAPLKFRA;ISFLEAPLKFRAA;SFLEAPLKFRAAG;FL
EAPLKFRAAGV;LEAPLKFRAAGVT;EAPLKFRAAGVTL;APLKFRAAGVTLQ
;PLKFRAAGVTLQI;LKFRAAGVTLQIG;KFRAAGVTLQIGL;FRAAGVTLQIGL
G;RAAGVTLQIGLGI;AAGVTLQIGLGIG;AGVTLQIGLGIGR;GVTLQIGLGIGR
L;VTLQIGLGIGRLV;TLQIGLGIGRLVF;LQIGLGIGRLVFR;QIGLGIGRLVFRA
;IGLGIGRLVFRAL;GLGIGRLVFRALN;LGIGRLVFRALNT;GIGRLVFRALNTV
;IGRLVFRALNTVE;GRLVFRALNTVEV;RLVFRALNTVEVG;LVFRALNTVEV
GF;VFRALNTVEVGFA;FRALNTVEVGFAL;RALNTVEVGFALV;ALNTVEVG
FALVI;LNTVEVGFALVIL;NTVEVGFALVILA;TVEVGFALVILAI;VEVGFALVIL
AIV;EVGFALVILAIVV;VGFALVILAIVVV;GFALVILAIVVVG;FALVILAIVVVGS;
ALVILAIVVVGST;LVILAIVVVGSTP;VILAIVVVGSTPA;ILAIVVVGSTPAR;LAI
VVVGSTPARI;AIVVVGSTPARIA;IVVVGSTPARIAA;VVVGSTPARIAAA;VVG
STPARIAAAF;VGSTPARIAAAFS;GSTPARIAAAFSV;STPARIAAAFSVA;TP
ARIAAAFSVAL;PARIAAAFSVALA;ARIAAAFSVALAA;RIAAAFSVALAAL;IAA
AFSVALAALA;AAAFSVALAALAV;AAFSVALAALAVQ;AFSVALAALAVQL;F
SVALAALAVQLI;SVALAALAVQLIA;VALAALAVQLIAV;ALAALAVQLIAVR;LA
ALAVQLIAVRP;AALAVQLIAVRPR;ALAVQLIAVRPRL;LAVQLIAVRPRLT;AV
QLIAVRPRLTR;VQLIAVRPRLTRR;QLIAVRPRLTRRS;LIAVRPRLTRRSN;IA
VRPRLTRRSNQ;AVRPRLTRRSNQV;VRPRLTRRSNQVL;RPRLTRRSNQV
LA;PRLTRRSNQVLAG;RLTRRSNQVLAGL;LTRRSNQVLAGLQ;TRRSNQV

Fig. 30 continued

| | | |
|---|---|---|
| | LAGLQA;RRSNQVLAGLQAP;RSNQVLAGLQAPR;SNQVLAGLQAPRS;NQ<br>VLAGLQAPRSR;QVLAGLQAPRSRG;VLAGLQAPRSRGH;LAGLQAPRSRG<br>HH;AGLQAPRSRGHHI;GLQAPRSRGHHIY;LQAPRSRGHHIYV;QAPRSRG<br>HHIYVG;APRSRGHHIYVGL;PRSRGHHIYVGLE;RSRGHHIYVGLEI;SRGHH<br>IYVGLEIV;RGHHIYVGLEIVK;GHHIYVGLEIVKV;HHIYVGLEIVKVV;HIYVGL<br>EIVKVVA;IYVGLEIVKVVAL;YVGLEIVKVVALL;VGLEIVKVVALLV;GLEIVKV<br>VALLVA;LEIVKVVALLVAG;EIVKVVALLVAGI;IVKVVALLVAGIL;VKVVALLV<br>AGILL;KVVALLVAGILLL;VVALLVAGILLLN;VALLVAGILLLNG;<br>14 mers:<br>MSAGPAIEVAVAFV;SAGPAIEVAVAFVW;AGPAIEVAVAFVWL;GPAIEVAV<br>AFVWLG;PAIEVAVAFVWLGM;AIEVAVAFVWLGMV;IEVAVAFVWLGMVV;E<br>VAVAFVWLGMVVA;VAVAFVWLGMVVAI;AVAFVWLGMVVAIS;VAFVWLG<br>MVVAISF;AFVWLGMVVAISFL;FVWLGMVVAISFLE;VWLGMVVAISFLEA;W<br>LGMVVAISFLEAP;LGMVVAISFLEAPL;GMVVAISFLEAPLK;MVVAISFLEAP<br>LKF;VVAISFLEAPLKFR;VAISFLEAPLKFRA;AISFLEAPLKFRAA;ISFLEAPL<br>KFRAAG;SFLEAPLKFRAAGV;FLEAPLKFRAAGVT;LEAPLKFRAAGVTL;EA<br>PLKFRAAGVTLQ;APLKFRAAGVTLQI;PLKFRAAGVTLQIG;LKFRAAGVTLQ<br>IGL;KFRAAGVTLQIGLG;FRAAGVTLQIGLGI;RAAGVTLQIGLGIG;AAGVTL<br>QIGLGIGR;AGVTLQIGLGIGRL;GVTLQIGLGIGRLV;VTLQIGLGIGRLVF;TL<br>QIGLGIGRLVFR;LQIGLGIGRLVFRA;QIGLGIGRLVFRAL;IGLGIGRLVFRAL<br>N;GLGIGRLVFRALNT;LGIGRLVFRALNTV;GIGRLVFRALNTVE;IGRLVFRA<br>LNTVEV;GRLVFRALNTVEVG;RLVFRALNTVEVGF;LVFRALNTVEVGFA;V<br>FRALNTVEVGFAL;FRALNTVEVGFALV;RALNTVEVGFALVI;ALNTVEVGFA<br>LVIL;LNTVEVGFALVILA;NTVEVGFALVILAI;TVEVGFALVILAIV;VEVGFALV<br>ILAIVV;EVGFALVILAIVVV;VGFALVILAIVVVG;GFALVILAIVVVGS;FALVILAI<br>VVVGST;ALVILAIVVVGSTP;LVILAIVVVGSTPA;VILAIVVVGSTPAR;ILAIVV<br>VGSTPARI;LAIVVVGSTPARIA;AIVVVGSTPARIAA;IVVVGSTPARIAAA;VV<br>VGSTPARIAAAF;VVGSTPARIAAAFS;VGSTPARIAAAFSV;GSTPARIAAAF<br>SVA;STPARIAAAFSVAL;TPARIAAAFSVALA;PARIAAAFSVALAA;ARIAAAF<br>SVALAAL;RIAAAFSVALAALA;IAAAFSVALAALAV;AAAFSVALAALAVQ;AA<br>FSVALAALAVQL;AFSVALAALAVQLI;FSVALAALAVQLIA;SVALAALAVQLIA<br>V;VALAALAVQLIAVR;ALAALAVQLIAVRP;LAALAVQLIAVRPR;AALAVQLIA<br>VRPRL;ALAVQLIAVRPRLT;LAVQLIAVRPRLTR;AVQLIAVRPRLTRR;VQLIA<br>VRPRLTRRS;QLIAVRPRLTRRSN;LIAVRPRLTRRSNQ;IAVRPRLTRRSNQ<br>V;AVRPRLTRRSNQVL;VRPRLTRRSNQVLA;RPRLTRRSNQVLAG;PRLTR<br>RSNQVLAGL;RLTRRSNQVLAGLQ;LTRRSNQVLAGLQA;TRRSNQVLAGL<br>QAP;RRSNQVLAGLQAPR;RSNQVLAGLQAPRS;SNQVLAGLQAPRSR;NQ<br>VLAGLQAPRSRG;QVLAGLQAPRSRGH;VLAGLQAPRSRGHH;LAGLQAPR<br>SRGHHI;AGLQAPRSRGHHIY;GLQAPRSRGHHIYV;LQAPRSRGHHIYVG;Q<br>APRSRGHHIYVGL;APRSRGHHIYVGLE;PRSRGHHIYVGLEI;RSRGHHIYV<br>GLEIV;SRGHHIYVGLEIVK;RGHHIYVGLEIVKV;GHHIYVGLEIVKVV;HHIYV<br>GLEIVKVVA;HIYVGLEIVKVVAL;IYVGLEIVKVVALL;YVGLEIVKVVALLV;VG<br>LEIVKVVALLVA;GLEIVKVVALLVAG;LEIVKVVALLVAGI;EIVKVVALLVAGIL;<br>IVKVVALLVAGILL;VKVVALLVAGILLL;KVVALLVAGILLLN;VVALLVAGILLL<br>NG;<br>15 mers:<br>MSAGPAIEVAVAFVW;SAGPAIEVAVAFVWL;AGPAIEVAVAFVWLG;GPAIE<br>VAVAFVWLGM;PAIEVAVAFVWLGMV;AIEVAVAFVWLGMVV;IEVAVAFVW<br>LGMVVA;EVAVAFVWLGMVVAI;VAVAFVWLGMVVAIS;AVAFVWLGMVVAI<br>SF;VAFVWLGMVVAISFL;AFVWLGMVVAISFLE;FVWLGMVVAISFLEA;VW<br>LGMVVAISFLEAP;WLGMVVAISFLEAPL;LGMVVAISFLEAPLK;GMVVAISF<br>LEAPLKF;MVVAISFLEAPLKFR;VVAISFLEAPLKFRA;VAISFLEAPLKFRAA;<br>AISFLEAPLKFRAAG;ISFLEAPLKFRAAGV;SFLEAPLKFRAAGVT;FLEAPLK | |

Fig. 30 continued

| | | |
|---|---|---|
| | FRAAGVTL;LEAPLKFRAAGVTLQ;EAPLKFRAAGVTLQI;APLKFRAAGVTLQIG;PLKFRAAGVTLQIGL;LKFRAAGVTLQIGLG;KFRAAGVTLQIGLGI;FRAAGVTLQIGLGIG;RAAGVTLQIGLGIGR;AAGVTLQIGLGIGRL;AGVTLQIGLGIGRLV;GVTLQIGLGIGRLVF;VTLQIGLGIGRLVFR;TLQIGLGIGRLVFRA;LQIGLGIGRLVFRAL;QIGLGIGRLVFRALN;IGLGIGRLVFRALNT;GLGIGRLVFRALNTV;LGIGRLVFRALNTVE;GIGRLVFRALNTVEV;IGRLVFRALNTVEVG;GRLVFRALNTVEVGF;RLVFRALNTVEVGFA;LVFRALNTVEVGFAL;VFRALNTVEVGFALV;FRALNTVEVGFALVI;RALNTVEVGFALVIL;ALNTVEVGFALVILA;LNTVEVGFALVILAI;NTVEVGFALVILAIV;TVEVGFALVILAIVV;VEVGFALVILAIVVV;EVGFALVILAIVVVG;VGFALVILAIVVVGS;GFALVILAIVVVGST;FALVILAIVVVGSTP;ALVILAIVVVGSTPA;LVILAIVVVGSTPAR;VILAIVVVGSTPARI;ILAIVVVGSTPARIA;LAIVVVGSTPARIAA;AIVVVGSTPARIAAA;IVVVGSTPARIAAAF;VVVGSTPARIAAAFS;VVGSTPARIAAAFSV;VGSTPARIAAAFSVA;GSTPARIAAAFSVAL;STPARIAAAFSVALA;TPARIAAAFSVALAA;PARIAAAFSVALAAL;ARIAAAFSVALAALA;RIAAAFSVALAALAV;IAAAFSVALAALAVQ;AAAFSVALAALAVQL;AAFSVALAALAVQLI;AFSVALAALAVQLIA;FSVALAALAVQLIAV;SVALAALAVQLIAVR;VALAALAVQLIAVRP;ALAALAVQLIAVRPR;LAALAVQLIAVRPRL;AALAVQLIAVRPRLT;ALAVQLIAVRPRLTR;LAVQLIAVRPRLTRR;AVQLIAVRPRLTRRS;VQLIAVRPRLTRRSN;QLIAVRPRLTRRSNQ;LIAVRPRLTRRSNQV;IAVRPRLTRRSNQVL;AVRPRLTRRSNQVLA;VRPRLTRRSNQVLAG;RPRLTRRSNQVLAGL;PRLTRRSNQVLAGLQ;RLTRRSNQVLAGLQA;LTRRSNQVLAGLQAP;TRRSNQVLAGLQAPR;RRSNQVLAGLQAPRS;RSNQVLAGLQAPRSR;SNQVLAGLQAPRSRG;NQVLAGLQAPRSRGH;QVLAGLQAPRSRGHH;VLAGLQAPRSRGHHI;LAGLQAPRSRGHHIY;AGLQAPRSRGHHIYV;GLQAPRSRGHHIYVG;LQAPRSRGHHIYVGL;QAPRSRGHHIYVGLE;APRSRGHHIYVGLEI;PRSRGHHIYVGLEIV;RSRGHHIYVGLEIVK;SRGHHIYVGLEIVKV;RGHHIYVGLEIVKVV;GHHIYVGLEIVKVVA;HHIYVGLEIVKVVAL;HIYVGLEIVKVVALL;IYVGLEIVKVVALLV;YVGLEIVKVVALLVA;VGLEIVKVVALLVAG;GLEIVKVVALLVAGI;LEIVKVVALLVAGIL;EIVKVVALLVAGILL;IVKVVALLVAGILLL;VKVVALLVAGILLLN;KVVALLVAGILLLNG;<br>16 mers:<br>MSAGPAIEVAVAFVWL;SAGPAIEVAVAFVWLG;AGPAIEVAVAFVWLGM;GPAIEVAVAFVWLGMV;PAIEVAVAFVWLGMVV;AIEVAVAFVWLGMVVA;IEVAVAFVWLGMVVAI;EVAVAFVWLGMVVAIS;VAVAFVWLGMVVAISF;AVAFVWLGMVVAISFL;VAFVWLGMVVAISFLE;AFVWLGMVVAISFLEA;FVWLGMVVAISFLEAP;VWLGMVVAISFLEAPL;WLGMVVAISFLEAPLK;LGMVVAISFLEAPLKF;GMVVAISFLEAPLKFR;MVVAISFLEAPLKFRA;VVAISFLEAPLKFRAA;VAISFLEAPLKFRAAG;AISFLEAPLKFRAAGV;ISFLEAPLKFRAAGVT;SFLEAPLKFRAAGVTL;FLEAPLKFRAAGVTLQ;LEAPLKFRAAGVTLQI;EAPLKFRAAGVTLQIG;APLKFRAAGVTLQIGL;PLKFRAAGVTLQIGLG;LKFRAAGVTLQIGLGI;KFRAAGVTLQIGLGIG;FRAAGVTLQIGLGIGR;RAAGVTLQIGLGIGRL;AAGVTLQIGLGIGRLV;AGVTLQIGLGIGRLVF;GVTLQIGLGIGRLVFR;VTLQIGLGIGRLVFRA;TLQIGLGIGRLVFRAL;LQIGLGIGRLVFRALN;QIGLGIGRLVFRALNT;IGLGIGRLVFRALNTV;GLGIGRLVFRALNTVE;LGIGRLVFRALNTVEV;GIGRLVFRALNTVEVG;IGRLVFRALNTVEVGF;GRLVFRALNTVEVGFA;RLVFRALNTVEVGFAL;LVFRALNTVEVGFALV;VFRALNTVEVGFALVI;FRALNTVEVGFALVIL;RALNTVEVGFALVILA;ALNTVEVGFALVILAI;LNTVEVGFALVILAIV;NTVEVGFALVILAIVV;TVEVGFALVILAIVVV;VEVGFALVILAIVVVG;EVGFALVILAIVVVGS;VGFALVILAIVVVGST;GFALVILAIVVVGSTP;FALVILAIVVVGSTPA;ALVILAIVVVGSTPAR;LVILAIVVVGSTPARI;VILAIVVVGSTPARIA;ILAIVVVGSTPARIAA;LAIVVVGSTPARIAAA;AIVVVGSTPARIAAAF;IVVVGSTPARIAAAFS;VVVGSTPARIAAAFSV;VVGSTPARIAAA | |

Fig. 30 continued

| | | |
|---|---|---|
| | FSVA;VGSTPARIAAAFSVAL;GSTPARIAAAFSVALA;STPARIAAAFSVALAA;TPARIAAAFSVALAAL;PARIAAAFSVALAALA;ARIAAAFSVALAALAV;RIAAAFSVALAALAVQ;IAAAFSVALAALAVQL;AAAFSVALAALAVQLI;AAFSVALAALAVQLIA;AFSVALAALAVQLIAV;FSVALAALAVQLIAVR;SVALAALAVQLIAVRP;VALAALAVQLIAVRPR;ALAALAVQLIAVRPRL;LAALAVQLIAVRPRLT;AALAVQLIAVRPRLTR;ALAVQLIAVRPRLTRR;LAVQLIAVRPRLTRRS;AVQLIAVRPRLTRRSN;VQLIAVRPRLTRRSNQ;QLIAVRPRLTRRSNQV;LIAVRPRLTRRSNQVL;IAVRPRLTRRSNQVLA;AVRPRLTRRSNQVLAG;VRPRLTRRSNQVLAGL;RPRLTRRSNQVLAGLQ;PRLTRRSNQVLAGLQA;RLTRRSNQVLAGLQAP;LTRRSNQVLAGLQAPR;TRRSNQVLAGLQAPRS;RRSNQVLAGLQAPRSR;RSNQVLAGLQAPRSRG;SNQVLAGLQAPRSRGH;NQVLAGLQAPRSRGHH;QVLAGLQAPRSRGHHI;VLAGLQAPRSRGHHIY;LAGLQAPRSRGHHIYV;AGLQAPRSRGHHIYVG;GLQAPRSRGHHIYVGL;LQAPRSRGHHIYVGLE;QAPRSRGHHIYVGLEI;APRSRGHHIYVGLEIV;PRSRGHHIYVGLEIVK;RSRGHHIYVGLEIVKV;SRGHHIYVGLEIVKVV;RGHHIYVGLEIVKVVA;GHHIYVGLEIVKVVAL;HHIYVGLEIVKVVALL;HIYVGLEIVKVVALLV;IYVGLEIVKVVALLVA;YVGLEIVKVVALLVAG;VGLEIVKVVALLVAGI;GLEIVKVVALLVAGIL;LEIVKVVALLVAGILL;EIVKVVALLVAGILLL;IVKVVALLVAGILLLN;VKVVALLVAGILLLNG | |
| 31 | **<YP_177903.1 hypothetical protein Rv2744c;Mycobacterium tuberculosis H37Rv>**<br>MANPFVKAWKYLMALFSSKIDEHADPKVQIQQAIEEAQRTHQALTQQAAQVIGNQRQLEMRLNRQLADIEKLQVNVRQALTLADQATAAGDAAKATEYNNAAEAFAAQLVTAEQSVEDLKTLHDQALSAAAQAKKAVERNAMVLQQKIAERTKLLSQLEQAKMQEQVSASLRSMSELAAPGNTPSLDEVRDKIERRYANAIGSAELAESSVQGRMLEVEQAGIQMAGHSRLEQIRASMRGEALPAGGTTATPRPATETSGGAIAEQPYGQ<br><br>8mer<br>MANPFVKA;NPFVKAWK;FVKAWKYL;KAWKYLMA;WKYLMALF;YLMALFSS;LMALFSSK;MALFSSKI;HADPKVQI;IQQAIEEA;QAIEEAQR;AQRTHQAL;RTHQALTQ;HQALTQQA;ALTQQAAQ;LTQQAAQV;AQVIGNQR;VIGNQRQL;QLEMRLNR;RQLADIEK;QLADIEKL;LQVNVRQA;QVNVRQAL;NVRQALTL;ALTLADQA;TLADQATA;LADQATAA;ATAAGDAA;TAAGDAAK;DAAKATEY;YNNAAEAF;NAAEAFAA;AEAFAAQL;EAFAAQLV;FAAQLVTA;LVTAEQSV;AEQSVEDL;SVEDLKTL;KTLHDQAL;TLHDQALS;ALSAAAQA;LSAAAQAK;SAAAQAKK;QAKKAVER;KAVERNAM;AVERNAMV;VERNAMVL;NAMVLQQK;AMVLQQKI;LQQKIAER;KIAERTKL;KLLSQLEQ;LLSQLEQA;LSQLEQAK;SQLEQAKM;KMQEQVSA;QEQVSASL;EQVSASLR;SLRSMSEL;APGNTPSL;NTPSLDEV;TPSLDEVR;SLDEVRDK;EVRDKIER;YANAIGSA;NAIGSAEL;AELAESSV;ELAESSVQ;VQGRMLEV;RMLEVEQA;LEVEQAGI;EQAGIQMA;IQMAGHSR;QMAGHSRL;HSRLEQIR;EQIRASMR;ALPAGGTT;LPAGGTTA;TTATPRPA;TPRPATET;RPATETSG;ETSGGAIA;GAIAEQPY<br>9mer<br>MANPFVKAW;NPFVKAWKY;FVKAWKYLM;KAWKYLMAL;AWKYLMALF;YLMALFSSK;LMALFSSKI;FSSKIDEHA;KIDEHADPK;VQIQQAIEE;EEAQRTHQA;EAQRTHQAL;HQALTQQAA;ALTQQAAQV;AAQVIGNQR;QVIGNQRQL;RQLEMRLNR;LEMRLNRQL;RLNRQLADI;RQLADIEKL;QLADIEKLQ;LADIEKLQV;DIEKLQVNV;KLQVNVRQA;LQVNVRQAL;NVRQALTLA;LTLADQATA;TLADQATAA;LADQATAAG;ATAAGDAAK;TAAGDAAKA;KATEYNNAA;EYNNAAEAF;NAAEAFAAQ;AEAFAAQLV;FAAQLVTAE;QLVTAEQSV;TLHDQALSA;ALSAAAQAK;LSAAAQAKK;AAAQAKKAV;AQAKKAVER;KAVERNAMV;NAMVLQQKI;VLQQKIAER;KIAERTKLL;RTKLLSQLE;KLLSQLEQA;LLSQ | 166968-168297 |

Fig. 30 continued

| | | |
|---|---|---|
| | LEQAK;MQEQVSASL;QVSASLRSM;SLRSMSELA;LAAPGNTPS;AAPGNTPSL;NTPSLDEVR;SLDEVRDKI;EVRDKIERR;IERRYANAI;RRYANAIGS;NAIGSAELA;LAESSVQGR;AESSVQGRM;SVQGRMLEV;RMLEVEQAG;MLEVEQAGI;EVEQAGIQM;GIQMAGHSR;IQMAGHSRL;RLEQIRASM;RASMRGEAL;SMRGEALPA;ALPAGGTTA;LPAGGTTAT;TTATPRPAT;TPRPATETS<br>10mer<br>MANPFVKAWK;FVKAWKYLMA;KAWKYLMALF;KYLMALFSSK;YLMALFSSKI;KIDEHADPKV;VQIQQAIEEA;EEAQRTHQAL;RTHQALTQQA;QALTQQAAQV;ALTQQAAQVI;QAAQVIGNQR;AQVIGNQRQL;QRQLEMRLNR;RQLEMRLNRQ;QLEMRLNRQL;QLADIEKLQV;DIEKLQVNVR;KLQVNVRQAL;LQVNVRQALT;QVNVRQALTL;RQALTLADQA;ALTLADQATA;LTLADQATAA;QATAAGDAAK;ATAAGDAAKA;TEYNNAAEAF;NAAEAFAAQL;AAEAFAAQLV;AEAFAAQLVT;EAFAAQLVTA;FAAQLVTAEQ;AQLVTAEQSV;TAEQSVEDLK;AEQSVEDLKT;DLKTLHDQAL;KTLHDQALSA;TLHDQALSAA;QALSAAAQAK;ALSAAAQAKK;SAAAQAKKAV;AAQAKKAVER;KAVERNAMVL;MVLQQKIAER;VLQQKIAERT;AERTKLLSQL;RTKLLSQLEQ;KLLSQLEQAK;LLSQLEQAKM;KMQEQVSASL;MQEQVSASLR;SASLRSMSEL;SLRSMSELAA;ELAAPGNTPS;LAAPGNTPSL;EVRDKIERRY;RRYANAIGSA;YANAIGSAEL;GSAELAESSV;ELAESSVQGR;AESSVQGRML;SSVQGRMLEV;RMLEVEQAGI;LEVEQAGIQM;GIQMAGHSRL;IQMAGHSRLE;QMAGHSRLEQ;SRLEQIRASM;RLEQIRASMR;EALPAGGTTA;ALPAGGTTAT;LPAGGTTATP;TPRPATETSG;RPATETSGGA;ETSGGAIAEQ<br>11mer<br>MANPFVKAWKY;NPFVKAWKYLM;FVKAWKYLMAL;KYLMALFSSKI;MALFSSKIDEH;ALFSSKIDEHA;SSKIDEHADPK;QIQQAIEEAQR;AIEEAQRTHQA;IEEAQRTHQAL;EEAQRTHQALT;RTHQALTQQAA;HQALTQQAAQV;QVIGNQRQLEM;NQRQLEMRLNR;RQLEMRLNRQL;RLNRQLADIEK;RQLADIEKLQV;LADIEKLQVNV;LQVNVRQALTL;QVNVRQALTLA;RQALTLADQAT;ALTLADQATAA;AAGDAAKATEY;DAAKATEYNNA;KATEYNNAAEA;ATEYNNAAEAF;NAAEAFAAQLV;AEAFAAQLVTA;AAQLVTAEQSV;VTAEQSVEDLK;AEQSVEDLKTL;KTLHDQALSAA;TLHDQALSAAA;QALSAAAQAKK;ALSAAAQAKKA;LSAAAQAKKAV;AAAQAKKAVER;QAKKAVERNAM;KKAVERNAMVL;AMVLQQKIAER;KLLSQLEQAKM;LLSQLEQAKMQ;QLEQAKMQEQV;KMQEQVSASLR;SMSELAAPGNT;ELAAPGNTPSL;APGNTPSLDEV;NTPSLDEVRDK;TPSLDEVRDKI;SLDEVRDKIER;DEVRDKIERRY;RRYANAIGSAE;RYANAIGSAEL;YANAIGSAELA;ELAESSVQGRM;ESSVQGRMLEV;RMLEVEQAGIQ;MLEVEQAGIQM;QAGIQMAGHSR;IQMAGHSRLEQ;QMAGHSRLEQI;MAGHSRLEQIR;QIRASMRGEAL;RASMRGEALPA;EALPAGGTTAT;LPAGGTTATPR;TTATPRPATET;RPATETSGGAI;TSGGAIAEQPY<br><br>13 mers:<br>MANPFVKAWKYLM;ANPFVKAWKYLMA;NPFVKAWKYLMAL;PFVKAWKYLMALF;FVKAWKYLMALFS;VKAWKYLMALFSS;KAWKYLMALFSSK;AWKYLMALFSSKI;WKYLMALFSSKID;KYLMALFSSKIDE;YLMALFSSKIDEH;LMALFSSKIDEHA;MALFSSKIDEHAD;ALFSSKIDEHADP;LFSSKIDEHADPK;FSSKIDEHADPKV;SSKIDEHADPKVQ;SKIDEHADPKVQI;KIDEHADPKVQIQ;IDEHADPKVQIQQ;DEHADPKVQIQQA;EHADPKVQIQQAI;HADPKVQIQQAIE;ADPKVQIQQAIEE;DPKVQIQQAIEEA;PKVQIQQAIEEAQ;KVQIQQAIEEAQR;VQIQQAIEEAQRT;QIQQAIEEAQRTH;IQQAIEEAQRTHQ;QQAIEEAQRTHQA;QAIEEAQRTHQAL;AIEEAQRTHQALT;IEEAQRTHQALTQ;EEAQRTHQALTQQ;EAQRTHQALTQQA;AQRTHQALTQQAA;QRTHQALTQQAAQ;RTHQALTQQAAQV;THQALTQQAAQVI;HQALTQQAAQVIG;QALTQQAAQVIGN;ALTQQAAQVIGNQ;LTQQAAQVIGNQR;TQQAAQVIGNQRQ;QQAAQVIG | |

Fig. 30 continued

| | | |
|---|---|---|
| | NQRQL;QAAQVIGNQRQLE;AAQVIGNQRQLEM;AQVIGNQRQLEMR;QVIGNQRQLEMRL;VIGNQRQLEMRLN;IGNQRQLEMRLNR;GNQRQLEMRLNRQ;NQRQLEMRLNRQL;QRQLEMRLNRQLA;RQLEMRLNRQLAD;QLEMRLNRQLADI;LEMRLNRQLADIE;EMRLNRQLADIEK;MRLNRQLADIEKL;RLNRQLADIEKLQ;LNRQLADIEKLQV;NRQLADIEKLQVN;RQLADIEKLQVNV;QLADIEKLQVNVR;LADIEKLQVNVRQ;ADIEKLQVNVRQA;DIEKLQVNVRQAL;IEKLQVNVRQALT;EKLQVNVRQALTL;KLQVNVRQALTLA;LQVNVRQALTLAD;QVNVRQALTLADQ;VNVRQALTLADQA;NVRQALTLADQAT;VRQALTLADQATA;RQALTLADQATAA;QALTLADQATAAG;ALTLADQATAAGD;LTLADQATAAGDA;TLADQATAAGDAA;LADQATAAGDAAK;ADQATAAGDAAKA;DQATAAGDAAKAT;QATAAGDAAKATE;ATAAGDAAKATEY;TAAGDAAKATEYN;AAGDAAKATEYNN;AGDAAKATEYNNA;GDAAKATEYNNAA;DAAKATEYNNAAE;AAKATEYNNAAEA;AKATEYNNAAEAF;KATEYNNAAEAFA;ATEYNNAAEAFAA;TEYNNAAEAFAAQ;EYNNAAEAFAAQL;YNNAAEAFAAQLV;NNAAEAFAAQLVT;NAAEAFAAQLVTA;AAEAFAAQLVTAE;AEAFAAQLVTAEQ;EAFAAQLVTAEQS;AFAAQLVTAEQSV;FAAQLVTAEQSVE;AAQLVTAEQSVED;AQLVTAEQSVEDL;QLVTAEQSVEDLK;LVTAEQSVEDLKT;VTAEQSVEDLKTL;TAEQSVEDLKTLH;AEQSVEDLKTLHD;EQSVEDLKTLHDQ;QSVEDLKTLHDQA;SVEDLKTLHDQAL;VEDLKTLHDQALS;EDLKTLHDQALSA;DLKTLHDQALSAA;LKTLHDQALSAAA;KTLHDQALSAAAQ;TLHDQALSAAAQA;LHDQALSAAAQAK;HDQALSAAAQAKK;DQALSAAAQAKKA;QALSAAAQAKKAV;ALSAAAQAKKAVE;LSAAAQAKKAVER;SAAAQAKKAVERN;AAAQAKKAVERNA;AAQAKKAVERNAM;AQAKKAVERNAMV;QAKKAVERNAMVL;AKKAVERNAMVLQ;KKAVERNAMVLQQ;KAVERNAMVLQQK;AVERNAMVLQQKI;VERNAMVLQQKIA;ERNAMVLQQKIAE;RNAMVLQQKIAER;NAMVLQQKIAERT;AMVLQQKIAERTK;MVLQQKIAERTKL;VLQQKIAERTKLL;LQQKIAERTKLLS;QQKIAERTKLLSQ;QKIAERTKLLSQL;KIAERTKLLSQLE;IAERTKLLSQLEQ;AERTKLLSQLEQA;ERTKLLSQLEQAK;RTKLLSQLEQAKM;TKLLSQLEQAKMQ;KLLSQLEQAKMQE;LLSQLEQAKMQEQ;LSQLEQAKMQEQV;SQLEQAKMQEQVS;QLEQAKMQEQVSA;LEQAKMQEQVSAS;EQAKMQEQVSASL;QAKMQEQVSASLR;AKMQEQVSASLRS;KMQEQVSASLRSM;MQEQVSASLRSMS;QEQVSASLRSMSE;EQVSASLRSMSEL;QVSASLRSMSELA;VSASLRSMSELAA;SASLRSMSELAAP;ASLRSMSELAAPG;SLRSMSELAAPGN;LRSMSELAAPGNT;RSMSELAAPGNTP;SMSELAAPGNTPS;MSELAAPGNTPSL;SELAAPGNTPSLD;ELAAPGNTPSLDE;LAAPGNTPSLDEV;AAPGNTPSLDEVR;APGNTPSLDEVRD;PGNTPSLDEVRDK;GNTPSLDEVRDKI;NTPSLDEVRDKIE;TPSLDEVRDKIER;PSLDEVRDKIERR;SLDEVRDKIERRY;LDEVRDKIERRYA;DEVRDKIERRYAN;EVRDKIERRYANA;VRDKIERRYANAI;RDKIERRYANAIG;DKIERRYANAIGS;KIERRYANAIGSA;IERRYANAIGSAE;ERRYANAIGSAEL;RRYANAIGSAELA;RYANAIGSAELAE;YANAIGSAELAES;ANAIGSAELAESS;NAIGSAELAESSV;AIGSAELAESSVQ;IGSAELAESSVQG;GSAELAESSVQGR;SAELAESSVQGRM;AELAESSVQGRML;ELAESSVQGRMLE;LAESSVQGRMLEV;AESSVQGRMLEVE;ESSVQGRMLEVEQ;SSVQGRMLEVEQA;SVQGRMLEVEQAG;VQGRMLEVEQAGI;QGRMLEVEQAGIQ;GRMLEVEQAGIQM;RMLEVEQAGIQMA;MLEVEQAGIQMAG;LEVEQAGIQMAGH;EVEQAGIQMAGHS;VEQAGIQMAGHSR;EQAGIQMAGHSRL;QAGIQMAGHSRLE;AGIQMAGHSRLEQ;GIQMAGHSRLEQI;IQMAGHSRLEQIR;QMAGHSRLEQIRA;MAGHSRLEQIRAS;AGHSRLEQIRASM;GHSRLEQIRASMR;HSRLEQIRASMRG;SRLEQIRASMRGE;RLEQIRASMRGEA;LEQIRASMRGEAL;EQIRASMRGEALP;QIRASMRGEALPA;IRASMRGEALPAG;RASMRGEALPAGG;ASMRGEALPAGGT;SMRGEALPAGGTT;MRGEALPAGGTTA;RGEALPAGGTTAT;GEALPAGGTTATP;EALPAGGTTATPR;ALPAGGTTATPRP;LPAGGTTATPRPA;PAGGTTATPRPAT;A | |

Fig. 30 continued

GGTTATPRPATE;GGTTATPRPATET;GTTATPRPATETS;TTATPRPATETS
G;TATPRPATETSGG;ATPRPATETSGGA;TPRPATETSGGAI;PRPATETSG
GAIA;RPATETSGGAIAE;PATETSGGAIAEQ;ATETSGGAIAEQP;TETSGGAI
AEQPY;ETSGGAIAEQPYG;TSGGAIAEQPYGQ;
14 mers:
MANPFVKAWKYLMA;ANPFVKAWKYLMAL;NPFVKAWKYLMALF;PFVKAW
KYLMALFS;FVKAWKYLMALFSS;VKAWKYLMALFSSK;KAWKYLMALFSSK
I;AWKYLMALFSSKID;WKYLMALFSSKIDE;KYLMALFSSKIDEH;YLMALFSS
KIDEHA;LMALFSSKIDEHAD;MALFSSKIDEHADP;ALFSSKIDEHADPK;LFS
SKIDEHADPKV;FSSKIDEHADPKVQ;SSKIDEHADPKVQI;SKIDEHADPKVQ
IQ;KIDEHADPKVQIQQ;IDEHADPKVQIQQA;DEHADPKVQIQQAI;EHADPK
VQIQQAIE;HADPKVQIQQAIEE;ADPKVQIQQAIEEA;DPKVQIQQAIEEAQ;P
KVQIQQAIEEAQR;KVQIQQAIEEAQRT;VQIQQAIEEAQRTH;QIQQAIEEAQ
RTHQ;IQQAIEEAQRTHQA;QQAIEEAQRTHQAL;QAIEEAQRTHQALT;AIEE
AQRTHQALTQ;IEEAQRTHQALTQQ;EEAQRTHQALTQQA;EAQRTHQALT
QQAA;AQRTHQALTQQAAQ;QRTHQALTQQAAQV;RTHQALTQQAAQVI;T
HQALTQQAAQVIG;HQALTQQAAQVIGN;QALTQQAAQVIGNQ;ALTQQAAQ
VIGNQR;LTQQAAQVIGNQRQ;TQQAAQVIGNQRQL;QQAAQVIGNQRQLE;
QAAQVIGNQRQLEM;AAQVIGNQRQLEMR;AQVIGNQRQLEMRL;QVIGNQ
RQLEMRLN;VIGNQRQLEMRLNR;IGNQRQLEMRLNRQ;GNQRQLEMRLN
RQL;NQRQLEMRLNRQLA;QRQLEMRLNRQLAD;RQLEMRLNRQLADI;QLE
MRLNRQLADIE;LEMRLNRQLADIEK;EMRLNRQLADIEKL;MRLNRQLADIE
KLQ;RLNRQLADIEKLQV;LNRQLADIEKLQVN;NRQLADIEKLQVNV;RQLAD
IEKLQVNVR;QLADIEKLQVNVRQ;LADIEKLQVNVRQA;ADIEKLQVNVRQAL
;DIEKLQVNVRQALT;IEKLQVNVRQALTL;EKLQVNVRQALTLA;KLQVNVRQ
ALTLAD;LQVNVRQALTLADQ;QVNVRQALTLADQA;VNVRQALTLADQAT;N
VRQALTLADQATA;VRQALTLADQATAA;RQALTLADQATAAG;QALTLADQ
ATAAGD;ALTLADQATAAGDA;LTLADQATAAGDAA;TLADQATAAGDAAK;L
ADQATAAGDAAKA;ADQATAAGDAAKAT;DQATAAGDAAKATE;QATAAGD
AAKATEY;ATAAGDAAKATEYN;TAAGDAAKATEYNN;AAGDAAKATEYNNA
;AGDAAKATEYNNAA;GDAAKATEYNNAAE;DAAKATEYNNAAEA;AAKATE
YNNAAEAF;AKATEYNNAAEAFA;KATEYNNAAEAFAA;ATEYNNAAEAFAA
Q;TEYNNAAEAFAAQL;EYNNAAEAFAAQLV;YNNAAEAFAAQLVT;NNAAE
AFAAQLVTA;NAAEAFAAQLVTAE;AAEAFAAQLVTAEQ;AEAFAAQLVTAEQ
S;EAFAAQLVTAEQSV;AFAAQLVTAEQSVE;FAAQLVTAEQSVED;AAQLVT
AEQSVEDL;AQLVTAEQSVEDLK;QLVTAEQSVEDLKT;LVTAEQSVEDLKTL
;VTAEQSVEDLKTLH;TAEQSVEDLKTLHD;AEQSVEDLKTLHDQ;EQSVEDL
KTLHDQA;QSVEDLKTLHDQAL;SVEDLKTLHDQALS;VEDLKTLHDQALSA;
EDLKTLHDQALSAA;DLKTLHDQALSAAA;LKTLHDQALSAAAQ;KTLHDQAL
SAAAQA;TLHDQALSAAAQAK;LHDQALSAAAQAKK;HDQALSAAAQAKKA;
DQALSAAAQAKKAV;QALSAAAQAKKAVE;ALSAAAQAKKAVER;LSAAAQA
KKAVERN;SAAAQAKKAVERNA;AAAQAKKAVERNAM;AAQAKKAVERNAM
V;AQAKKAVERNAMVL;QAKKAVERNAMVLQ;AKKAVERNAMVLQQ;KKAV
ERNAMVLQQK;KAVERNAMVLQQKI;AVERNAMVLQQKIA;VERNAMVLQQ
KIAE;ERNAMVLQQKIAER;RNAMVLQQKIAERT;NAMVLQQKIAERTK;AMV
LQQKIAERTKL;MVLQQKIAERTKLL;VLQQKIAERTKLLS;LQQKIAERTKLLS
Q;QQKIAERTKLLSQL;QKIAERTKLLSQLE;KIAERTKLLSQLEQ;IAERTKLLS
QLEQA;AERTKLLSQLEQAK;ERTKLLSQLEQAKM;RTKLLSQLEQAKMQ;TK
LLSQLEQAKMQE;KLLSQLEQAKMQEQ;LLSQLEQAKMQEQV;LSQLEQAK
MQEQVS;SQLEQAKMQEQVSA;QLEQAKMQEQVSAS;LEQAKMQEQVSAS
L;EQAKMQEQVSASLR;QAKMQEQVSASLRS;AKMQEQVSASLRSM;KMQE
QVSASLRSMS;MQEQVSASLRSMSE;QEQVSASLRSMSEL;EQVSASLRSM
SELA;QVSASLRSMSELAA;VSASLRSMSELAAP;SASLRSMSELAAPG;ASL

Fig. 30 continued

| | | |
|---|---|---|
| | RSMSELAAPGN;SLRSMSELAAPGNT;LRSMSELAAPGNTP;RSMSELAAPGNTPS;SMSELAAPGNTPSL;MSELAAPGNTPSLD;SELAAPGNTPSLDE;ELAAPGNTPSLDEV;LAAPGNTPSLDEVR;AAPGNTPSLDEVRD;APGNTPSLDEVRDK;PGNTPSLDEVRDKI;GNTPSLDEVRDKIE;NTPSLDEVRDKIER;TPSLDEVRDKIERR;PSLDEVRDKIERRY;SLDEVRDKIERRYA;LDEVRDKIERRYAN;DEVRDKIERRYANA;EVRDKIERRYANAI;VRDKIERRYANAIG;RDKIERRYANAIGS;DKIERRYANAIGSA;KIERRYANAIGSAE;IERRYANAIGSAEL;ERRYANAIGSAELA;RRYANAIGSAELAE;RYANAIGSAELAES;YANAIGSAELAESS;ANAIGSAELAESSV;NAIGSAELAESSVQ;AIGSAELAESSVQG;IGSAELAESSVQGR;GSAELAESSVQGRM;SAELAESSVQGRML;AELAESSVQGRMLE;ELAESSVQGRMLEV;LAESSVQGRMLEVE;AESSVQGRMLEVEQ;ESSVQGRMLEVEQA;SSVQGRMLEVEQAG;SVQGRMLEVEQAGI;VQGRMLEVEQAGIQ;QGRMLEVEQAGIQM;GRMLEVEQAGIQMA;RMLEVEQAGIQMAG;MLEVEQAGIQMAGH;LEVEQAGIQMAGHS;EVEQAGIQMAGHSR;VEQAGIQMAGHSRL;EQAGIQMAGHSRLE;QAGIQMAGHSRLEQ;AGIQMAGHSRLEQI;GIQMAGHSRLEQIR;IQMAGHSRLEQIRA;QMAGHSRLEQIRAS;MAGHSRLEQIRASM;AGHSRLEQIRASMR;GHSRLEQIRASMRG;HSRLEQIRASMRGE;SRLEQIRASMRGEA;RLEQIRASMRGEAL;LEQIRASMRGEALP;EQIRASMRGEALPA;QIRASMRGEALPAG;IRASMRGEALPAGG;RASMRGEALPAGGT;ASMRGEALPAGGTT;SMRGEALPAGGTTA;MRGEALPAGGTTAT;RGEALPAGGTTATP;GEALPAGGTTATPR;EALPAGGTTATPRP;ALPAGGTTATPRPA;LPAGGTTATPRPAT;PAGGTTATPRPATE;AGGTTATPRPATET;GGTTATPRPATETS;GTTATPRPATETSG;TTATPRPATETSGG;TATPRPATETSGGA;ATPRPATETSGGAI;TPRPATETSGGAIA;PRPATETSGGAIAE;RPATETSGGAIAEQ;PATETSGGAIAEQP;ATETSGGAIAEQPY;TETSGGAIAEQPYG;ETSGGAIAEQPYGQ;<br>15 mers:<br>MANPFVKAWKYLMAL;ANPFVKAWKYLMALF;NPFVKAWKYLMALFS;PFVKAWKYLMALFSS;FVKAWKYLMALFSSK;VKAWKYLMALFSSKI;KAWKYLMALFSSKID;AWKYLMALFSSKIDE;WKYLMALFSSKIDEH;KYLMALFSSKIDEHA;YLMALFSSKIDEHAD;LMALFSSKIDEHADP;MALFSSKIDEHADPK;ALFSSKIDEHADPKV;LFSSKIDEHADPKVQ;FSSKIDEHADPKVQI;SSKIDEHADPKVQIQ;SKIDEHADPKVQIQQ;KIDEHADPKVQIQQA;IDEHADPKVQIQQAI;DEHADPKVQIQQAIE;EHADPKVQIQQAIEE;HADPKVQIQQAIEEA;ADPKVQIQQAIEEAQ;DPKVQIQQAIEEAQR;PKVQIQQAIEEAQRT;KVQIQQAIEEAQRTH;VQIQQAIEEAQRTHQ;QIQQAIEEAQRTHQA;IQQAIEEAQRTHQAL;QQAIEEAQRTHQALT;QAIEEAQRTHQALTQ;AIEEAQRTHQALTQQ;IEEAQRTHQALTQQA;EEAQRTHQALTQQAA;EAQRTHQALTQQAAQ;AQRTHQALTQQAAQV;QRTHQALTQQAAQVI;RTHQALTQQAAQVIG;THQALTQQAAQVIGN;HQALTQQAAQVIGNQ;QALTQQAAQVIGNQR;ALTQQAAQVIGNQRQ;LTQQAAQVIGNQRQL;TQQAAQVIGNQRQLE;QQAAQVIGNQRQLEM;QAAQVIGNQRQLEMR;AAQVIGNQRQLEMRL;AQVIGNQRQLEMRLN;QVIGNQRQLEMRLNR;VIGNQRQLEMRLNRQ;IGNQRQLEMRLNRQL;GNQRQLEMRLNRQLA;NQRQLEMRLNRQLAD;QRQLEMRLNRQLADI;RQLEMRLNRQLADIE;QLEMRLNRQLADIEK;LEMRLNRQLADIEKL;EMRLNRQLADIEKLQ;MRLNRQLADIEKLQV;RLNRQLADIEKLQVN;LNRQLADIEKLQVNV;NRQLADIEKLQVNVR;RQLADIEKLQVNVRQ;QLADIEKLQVNVRQA;LADIEKLQVNVRQAL;ADIEKLQVNVRQALT;DIEKLQVNVRQALTL;IEKLQVNVRQALTLA;EKLQVNVRQALTLAD;KLQVNVRQALTLADQ;LQVNVRQALTLADQA;QVNVRQALTLADQAT;VNVRQALTLADQATA;NVRQALTLADQATAA;VRQALTLADQATAAG;RQALTLADQATAAGD;QALTLADQATAAGDA;ALTLADQATAAGDAA;LTLADQATAAGDAAK;TLADQATAAGDAAKA;LADQATAAGDAAKAT;ADQATAAGDAAKATE;DQATAAGDAAKATEY;QATAAGDAAKATEYN;ATAAGDAAK | |

Fig. 30 continued

| | | |
|---|---|---|
| | ATEYNN;TAAGDAAKATEYNNA;AAGDAAKATEYNNAA;AGDAAKATEYNNAAE;GDAAKATEYNNAAEA;DAAKATEYNNAAEAF;AAKATEYNNAAEAFA;AKATEYNNAAEAFAA;KATEYNNAAEAFAAQ;ATEYNNAAEAFAAQL;TEYNNAAEAFAAQLV;EYNNAAEAFAAQLVT;YNNAAEAFAAQLVTA;NNAAEAFAAQLVTAE;NAAEAFAAQLVTAEQ;AAEAFAAQLVTAEQS;AEAFAAQLVTAEQSV;EAFAAQLVTAEQSVE;AFAAQLVTAEQSVED;FAAQLVTAEQSVEDL;AAQLVTAEQSVEDLK;AQLVTAEQSVEDLKT;QLVTAEQSVEDLKTL;LVTAEQSVEDLKTLH;VTAEQSVEDLKTLHD;TAEQSVEDLKTLHDQ;AEQSVEDLKTLHDQA;EQSVEDLKTLHDQAL;QSVEDLKTLHDQALS;SVEDLKTLHDQALSA;VEDLKTLHDQALSAA;EDLKTLHDQALSAAA;DLKTLHDQALSAAAQ;LKTLHDQALSAAAQA;KTLHDQALSAAAQAK;TLHDQALSAAAQAKK;LHDQALSAAAQAKKA;HDQALSAAAQAKKAV;DQALSAAAQAKKAVE;QALSAAAQAKKAVER;ALSAAAQAKKAVERN;LSAAAQAKKAVERNA;SAAAQAKKAVERNAM;AAAQAKKAVERNAMV;AAQAKKAVERNAMVL;AQAKKAVERNAMVLQ;QAKKAVERNAMVLQQ;AKKAVERNAMVLQQK;KKAVERNAMVLQQKI;KAVERNAMVLQQKIA;AVERNAMVLQQKIAE;VERNAMVLQQKIAER;ERNAMVLQQKIAERT;RNAMVLQQKIAERTK;NAMVLQQKIAERTKL;AMVLQQKIAERTKLL;MVLQQKIAERTKLLS;VLQQKIAERTKLLSQ;LQQKIAERTKLLSQL;QQKIAERTKLLSQLE;QKIAERTKLLSQLEQ;KIAERTKLLSQLEQA;IAERTKLLSQLEQAK;AERTKLLSQLEQAKM;ERTKLLSQLEQAKMQ;RTKLLSQLEQAKMQE;TKLLSQLEQAKMQEQ;KLLSQLEQAKMQEQV;LLSQLEQAKMQEQVS;LSQLEQAKMQEQVSA;SQLEQAKMQEQVSAS;QLEQAKMQEQVSASL;LEQAKMQEQVSASLR;EQAKMQEQVSASLRS;QAKMQEQVSASLRSM;AKMQEQVSASLRSMS;KMQEQVSASLRSMSE;MQEQVSASLRSMSEL;QEQVSASLRSMSELA;EQVSASLRSMSELAA;QVSASLRSMSELAAP;VSASLRSMSELAAPG;SASLRSMSELAAPGN;ASLRSMSELAAPGNT;SLRSMSELAAPGNTP;LRSMSELAAPGNTPS;RSMSELAAPGNTPSL;SMSELAAPGNTPSLD;MSELAAPGNTPSLDE;SELAAPGNTPSLDEV;ELAAPGNTPSLDEVR;LAAPGNTPSLDEVRD;AAPGNTPSLDEVRDK;APGNTPSLDEVRDKI;PGNTPSLDEVRDKIE;GNTPSLDEVRDKIER;NTPSLDEVRDKIERR;TPSLDEVRDKIERRY;PSLDEVRDKIERRYA;SLDEVRDKIERRYAN;LDEVRDKIERRYANA;DEVRDKIERRYANAI;EVRDKIERRYANAIG;VRDKIERRYANAIGS;RDKIERRYANAIGSA;DKIERRYANAIGSAE;KIERRYANAIGSAEL;IERRYANAIGSAELA;ERRYANAIGSAELAE;RRYANAIGSAELAES;RYANAIGSAELAESS;YANAIGSAELAESSV;ANAIGSAELAESSVQ;NAIGSAELAESSVQG;AIGSAELAESSVQGR;IGSAELAESSVQGRM;GSAELAESSVQGRML;SAELAESSVQGRMLE;AELAESSVQGRMLEV;ELAESSVQGRMLEVE;LAESSVQGRMLEVEQ;AESSVQGRMLEVEQA;ESSVQGRMLEVEQAG;SSVQGRMLEVEQAGI;SVQGRMLEVEQAGIQ;VQGRMLEVEQAGIQM;QGRMLEVEQAGIQMA;GRMLEVEQAGIQMAG;RMLEVEQAGIQMAGH;MLEVEQAGIQMAGHS;LEVEQAGIQMAGHSR;EVEQAGIQMAGHSRL;VEQAGIQMAGHSRLE;EQAGIQMAGHSRLEQ;QAGIQMAGHSRLEQI;AGIQMAGHSRLEQIR;GIQMAGHSRLEQIRA;IQMAGHSRLEQIRAS;QMAGHSRLEQIRASM;MAGHSRLEQIRASMR;AGHSRLEQIRASMRG;GHSRLEQIRASMRGE;HSRLEQIRASMRGEA;SRLEQIRASMRGEAL;RLEQIRASMRGEALP;LEQIRASMRGEALPA;EQIRASMRGEALPAG;QIRASMRGEALPAGG;IRASMRGEALPAGGT;RASMRGEALPAGGTT;ASMRGEALPAGGTTA;SMRGEALPAGGTTAT;MRGEALPAGGTTATP;RGEALPAGGTTATPR;GEALPAGGTTATPRP;EALPAGGTTATPRPA;ALPAGGTTATPRPAT;LPAGGTTATPRPATE;PAGGTTATPRPATET;AGGTTATPRPATETS;GGTTATPRPATETSG;GTTATPRPATETSGG;TTATPRPATETSGGA;TATPRPATETSGGAI;ATPRPATETSGGAIA;TPRPATETSGGAIAE;PRPATETSGGAIAEQ;RPATETSGGAIAEQP;PATETSGGAIAEQPY;ATETSGGAIAEQPYG;TETSGGAIAEQPYGQ; | |

Fig. 30 continued

| | | |
|---|---|---|
| | 16 mers:<br>MANPFVKAWKYLMALF;ANPFVKAWKYLMALFS;NPFVKAWKYLMALFSS;PFVKAWKYLMALFSSK;FVKAWKYLMALFSSKI;VKAWKYLMALFSSKID;KAWKYLMALFSSKIDE;AWKYLMALFSSKIDEH;WKYLMALFSSKIDEHA;KYLMALFSSKIDEHAD;YLMALFSSKIDEHADP;LMALFSSKIDEHADPK;MALFSSKIDEHADPKV;ALFSSKIDEHADPKVQ;LFSSKIDEHADPKVQI;FSSKIDEHADPKVQIQ;SSKIDEHADPKVQIQQ;SKIDEHADPKVQIQQA;KIDEHADPKVQIQQAI;IDEHADPKVQIQQAIE;DEHADPKVQIQQAIEE;EHADPKVQIQQAIEEA;HADPKVQIQQAIEEAQ;ADPKVQIQQAIEEAQR;DPKVQIQQAIEEAQRT;PKVQIQQAIEEAQRTH;KVQIQQAIEEAQRTHQ;VQIQQAIEEAQRTHQA;QIQQAIEEAQRTHQAL;IQQAIEEAQRTHQALT;QQAIEEAQRTHQALTQ;QAIEEAQRTHQALTQQ;AIEEAQRTHQALTQQA;IEEAQRTHQALTQQAA;EEAQRTHQALTQQAAQ;EAQRTHQALTQQAAQV;AQRTHQALTQQAAQVI;QRTHQALTQQAAQVIG;RTHQALTQQAAQVIGN;THQALTQQAAQVIGNQ;HQALTQQAAQVIGNQR;QALTQQAAQVIGNQRQ;ALTQQAAQVIGNQRQL;LTQQAAQVIGNQRQLE;TQQAAQVIGNQRQLEM;QQAAQVIGNQRQLEMR;QAAQVIGNQRQLEMRL;AAQVIGNQRQLEMRLN;AQVIGNQRQLEMRLNR;QVIGNQRQLEMRLNRQ;VIGNQRQLEMRLNRQL;IGNQRQLEMRLNRQLA;GNQRQLEMRLNRQLAD;NQRQLEMRLNRQLADI;QRQLEMRLNRQLADIE;RQLEMRLNRQLADIEK;QLEMRLNRQLADIEKL;LEMRLNRQLADIEKLQ;EMRLNRQLADIEKLQV;MRLNRQLADIEKLQVN;RLNRQLADIEKLQVNV;LNRQLADIEKLQVNVR;NRQLADIEKLQVNVRQ;RQLADIEKLQVNVRQA;QLADIEKLQVNVRQAL;LADIEKLQVNVRQALT;ADIEKLQVNVRQALTL;DIEKLQVNVRQALTLA;IEKLQVNVRQALTLAD;EKLQVNVRQALTLADQ;KLQVNVRQALTLADQA;LQVNVRQALTLADQAT;QVNVRQALTLADQATA;VNVRQALTLADQATAA;NVRQALTLADQATAAG;VRQALTLADQATAAGD;RQALTLADQATAAGDA;QALTLADQATAAGDAA;ALTLADQATAAGDAAK;LTLADQATAAGDAAKA;TLADQATAAGDAAKAT;LADQATAAGDAAKATE;ADQATAAGDAAKATEY;DQATAAGDAAKATEYN;QATAAGDAAKATEYNN;ATAAGDAAKATEYNNA;TAAGDAAKATEYNNAA;AAGDAAKATEYNNAAE;AGDAAKATEYNNAAEA;GDAAKATEYNNAAEAF;DAAKATEYNNAAEAFA;AAKATEYNNAAEAFAA;AKATEYNNAAEAFAAQ;KATEYNNAAEAFAAQL;ATEYNNAAEAFAAQLV;TEYNNAAEAFAAQLVT;EYNNAAEAFAAQLVTA;YNNAAEAFAAQLVTAE;NNAAEAFAAQLVTAEQ;NAAEAFAAQLVTAEQS;AAEAFAAQLVTAEQSV;AEAFAAQLVTAEQSVE;EAFAAQLVTAEQSVED;AFAAQLVTAEQSVEDL;FAAQLVTAEQSVEDLK;AAQLVTAEQSVEDLKT;AQLVTAEQSVEDLKTL;QLVTAEQSVEDLKTLH;LVTAEQSVEDLKTLHD;VTAEQSVEDLKTLHDQ;TAEQSVEDLKTLHDQA;AEQSVEDLKTLHDQAL;EQSVEDLKTLHDQALS;QSVEDLKTLHDQALSA;SVEDLKTLHDQALSAA;VEDLKTLHDQALSAAA;EDLKTLHDQALSAAAQ;DLKTLHDQALSAAAQA;LKTLHDQALSAAAQAK;KTLHDQALSAAAQAKK;TLHDQALSAAAQAKKA;LHDQALSAAAQAKKAV;HDQALSAAAQAKKAVE;DQALSAAAQAKKAVER;QALSAAAQAKKAVERN;ALSAAAQAKKAVERNA;LSAAAQAKKAVERNAM;SAAAQAKKAVERNAMV;AAAQAKKAVERNAMVL;AAQAKKAVERNAMVLQ;AQAKKAVERNAMVLQQ;QAKKAVERNAMVLQQK;AKKAVERNAMVLQQKI;KKAVERNAMVLQQKIA;KAVERNAMVLQQKIAE;AVERNAMVLQQKIAER;VERNAMVLQQKIAERT;ERNAMVLQQKIAERTK;RNAMVLQQKIAERTKL;NAMVLQQKIAERTKLL;AMVLQQKIAERTKLLS;MVLQQKIAERTKLLSQ;VLQQKIAERTKLLSQL;LQQKIAERTKLLSQLE;QQKIAERTKLLSQLEQ;QKIAERTKLLSQLEQA;KIAERTKLLSQLEQAK;IAERTKLLSQLEQAKM;AERTKLLSQLEQAKMQ;ERTKLLSQLEQAKMQE;RTKLLSQLEQAKMQEQ;TKLLSQLEQAKMQEQV;KLLSQLEQAKMQEQVS;LLSQLEQAKMQEQVSA;LSQLEQAKMQEQVSAS;SQLEQAKMQEQVSASL;QLEQAKMQEQVSASLR;LEQAKMQEQVSASLRS;EQAKMQEQVSASLRSM;QAKMQEQVSASLRS | |

Fig. 30 continued

| | | |
|---|---|---|
| | MS;AKMQEQVSASLRSMSE;KMQEQVSASLRSMSEL;MQEQVSASLRSMSELA;QEQVSASLRSMSELAA;EQVSASLRSMSELAAP;QVSASLRSMSELAAPG;VSASLRSMSELAAPGN;SASLRSMSELAAPGNT;ASLRSMSELAAPGNTP;SLRSMSELAAPGNTPS;LRSMSELAAPGNTPSL;RSMSELAAPGNTPSLD;SMSELAAPGNTPSLDE;MSELAAPGNTPSLDEV;SELAAPGNTPSLDEVR;ELAAPGNTPSLDEVRD;LAAPGNTPSLDEVRDK;AAPGNTPSLDEVRDKI;APGNTPSLDEVRDKIE;PGNTPSLDEVRDKIER;GNTPSLDEVRDKIERR;NTPSLDEVRDKIERRY;TPSLDEVRDKIERRYA;PSLDEVRDKIERRYAN;SLDEVRDKIERRYANA;LDEVRDKIERRYANAI;DEVRDKIERRYANAIG;EVRDKIERRYANAIGS;VRDKIERRYANAIGSA;RDKIERRYANAIGSAE;DKIERRYANAIGSAEL;KIERRYANAIGSAELA;IERRYANAIGSAELAE;ERRYANAIGSAELAES;RRYANAIGSAELAESS;RYANAIGSAELAESSV;YANAIGSAELAESSVQ;ANAIGSAELAESSVQG;NAIGSAELAESSVQGR;AIGSAELAESSVQGRM;IGSAELAESSVQGRML;GSAELAESSVQGRMLE;SAELAESSVQGRMLEV;AELAESSVQGRMLEVE;ELAESSVQGRMLEVEQ;LAESSVQGRMLEVEQA;AESSVQGRMLEVEQAG;ESSVQGRMLEVEQAGI;SSVQGRMLEVEQAGIQ;SVQGRMLEVEQAGIQM;VQGRMLEVEQAGIQMA;QGRMLEVEQAGIQMAG;GRMLEVEQAGIQMAGH;RMLEVEQAGIQMAGHS;MLEVEQAGIQMAGHSR;LEVEQAGIQMAGHSRL;EVEQAGIQMAGHSRLE;VEQAGIQMAGHSRLEQ;EQAGIQMAGHSRLEQI;QAGIQMAGHSRLEQIR;AGIQMAGHSRLEQIRA;GIQMAGHSRLEQIRAS;IQMAGHSRLEQIRASM;QMAGHSRLEQIRASMR;MAGHSRLEQIRASMRG;AGHSRLEQIRASMRGE;GHSRLEQIRASMRGEA;HSRLEQIRASMRGEAL;SRLEQIRASMRGEALP;RLEQIRASMRGEALPA;LEQIRASMRGEALPAG;EQIRASMRGEALPAGG;QIRASMRGEALPAGGT;IRASMRGEALPAGGTT;RASMRGEALPAGGTTA;ASMRGEALPAGGTTAT;SMRGEALPAGGTTATP;MRGEALPAGGTTATPR;RGEALPAGGTTATPRP;GEALPAGGTTATPRPA;EALPAGGTTATPRPAT;ALPAGGTTATPRPATE;LPAGGTTATPRPATET;PAGGTTATPRPATETS;AGGTTATPRPATETSG;GGTTATPRPATETSGG;GTTATPRPATETSGGA;TTATPRPATETSGGAI;TATPRPATETSGGAIA;ATPRPATETSGGAIAE;TPRPATETSGGAIAEQ;PRPATETSGGAIAEQP;RPATETSGGAIAEQPY;PATETSGGAIAEQPYG;ATETSGGAIAEQPYGQ | |
| 32 | **<NP_216442.1 immunogenic protein MPT63(16 kDa immunoprotective extracellular protein)Rv1926c;Mycobacterium tuberculosis H37Rv>**<br>MKLTTMIKTAVAVVAMAAIATFAAPVALAAYPITGKLGSELTMTDTVGQVVLGWKVSDLKSSTAVIPGYPVAGQVWEATATVNAIRGSVTPAVSQFNARTADGINYRVLWQAAGPDTISGATIPQGEQSTGKIYFDVTGPSPTIVAMNNGMEDLLIWEP<br><br>8mer<br>KLTTMIKT;TTMIKTAV;TMIKTAVA;MIKTAVAV;TAVAVVAM;AVAVVAMA;AVVAMAAI;AMAAIATF;MAAIATFA;AAIATFAA;IATFAAPV;FAAPVALA;APVALAAY;VALAAYPI;ALAAYPIT;AAYPITGK;AYPITGKL;YPITGKLG;KLGSELTM;ELTMTDTV;TMTDTVGQ;MTDTVGQV;DTVGQVVL;VGQVVLGW;GQVVLGWK;QVVLGWKV;GWKVSDLK;DLKSSTAV;STAVIPGY;AVIPGYPV;VIPGYPVA;GYPVAGQV;YPVAGQVW;GQVWEATA;QVWEATAT;EATATVNA;ATATVNAI;TATVNAIR;VTPAVSQF;AVSQFNAR;SQFNARTA;RTADGINY;TADGINYR;QAAGPDTI;DTISGATI;EQSTGKIY;TGPSPTIV;IVAMNNGM<br>9mer<br>KLTTMIKTA;LTTMIKTAV;TTMIKTAVA;TMIKTAVAV;MIKTAVAVV;KTAVAVVAM;TAVAVVAMA;AVAVVAMAA;VAVVAMAAI;VAMAAIATF;AMAAIATFA;MAAIATFAA;AIATFAAPV;ATFAAPVAL;FAAPVALAA;AAPVALAAY;PVALAAYPI;LAAYPITGK;AAYPITGKL;YPITGKLGS;KLGSELTMT;SELTMTDTV;TMTDTVGQV;MTDTVGQVV;TVGQVVLGW;GQVVLGWKV;VLGWKVSDL;SSTA | 168298-169094 |

Fig. 30 continued

| | | |
|---|---|---|
| | VIPGY;TAVIPGYPV;AVIPGYPVA;GYPVAGQVW;PVAGQVWEA;GQVWEATAT;QVWEATATV;EATATVNAI;ATATVNAIR;TVNAIRGSV;AIRGSVTPA;SVTPAVSQF;TPAVSQFNA;RTADGINYR;TADGINYRV;WQAAGPDTI;TIPQGEQST;EQSTGKIYF;STGKIYFDV;DVTGPSPTI;VTGPSPTIV;GPSPTIVAM;TIVAMNNGM;AMNNGMEDL;GMEDLLIWE<br>10mer<br>KLTTMIKTAV;TTMIKTAVAV;TMIKTAVAVV;MIKTAVAVVA;KTAVAVVAMA;TAVAVVAMAA;AVAVVAMAAI;VVAMAAIATF;VAMAAIATFA;AMAAIATFAA;AAIATFAAPV;AIATFAAPVA;IATFAAPVAL;ATFAAPVALA;FAAPVALAAY;APVALAAYPI;ALAAYPITGK;LAAYPITGKL;YPITGKLGSE;PITGKLGSEL;LTMTDTVGQV;TMTDTVGQVV;MTDTVGQVVL;DTVGQVVLGW;TVGQVVLGWK;VVLGWKVSDL;VLGWKVSDLK;KVSDLKSSTA;KSSTAVIPGY;STAVIPGYPV;VIPGYPVAGQ;IPGYPVAGQV;YPVAGQVWEA;GQVWEATATV;WEATATVNAI;EATATVNAIR;ATVNAIRGSV;NAIRGSVTPA;AIRGSVTPAV;VTPAVSQFNA;TPAVSQFNAR;NARTADGINY;RTADGINYRV;TADGINYRVL;GINYRVLWQA;YRVLWQAAGP;VLWQAAGPDT;LWQAAGPDTI;AAGPDTISGA;GPDTISGATI;GEQSTGKIYF;QSTGKIYFDV;KIYFDVTGPS;DVTGPSPTIV;PTIVAMNNGM;AMNNGMEDLL;GMEDLLIWEP<br>11mer<br>KLTTMIKTAVA;LTTMIKTAVAV;TTMIKTAVAVV;TMIKTAVAVVA;MIKTAVAVVAM;KTAVAVVAMAA;TAVAVVAMAAI;VAVVAMAAIAT;AVVAMAAIATF;VVAMAAIATFA;VAMAAIATFAA;MAAIATFAAPV;AAIATFAAPVA;AIATFAAPVAL;ATFAAPVALAA;TFAAPVALAAY;AAPVALAAYPI;APVALAAYPIT;VALAAYPITGK;ALAAYPITGKL;YPITGKLGSEL;KLGSELTMTDT;LGSELTMTDTV;ELTMTDTVGQV;LTMTDTVGQVV;TMTDTVGQVVL;DTVGQVVLGWK;TVGQVVLGWKV;QVVLGWKVSDL;VVLGWKVSDLK;KVSDLKSSTAV;SSTAVIPGYPV;STAVIPGYPVA;VIPGYPVAGQV;IPGYPVAGQVW;YPVAGQVWEAT;PVAGQVWEATA;QVWEATATVNA;VWEATATVNAI;TATVNAIRGSV;NAIRGSVTPAV;RGSVTPAVSQF;SVTPAVSQFNA;VTPAVSQFNAR;SQFNARTADGI;NARTADGINYR;RTADGINYRVL;TADGINYRVLW;GINYRVLWQAA;VLWQAAGPDTI;QAAGPDTISGA;TIPQGEQSTGK;IPQGEQSTGKI;DVTGPSPTIVA;VTGPSPTIVAM;SPTIVAMNNGM;AMNNGMEDLLI<br><br>13 mers:<br>MKLTTMIKTAVAV;KLTTMIKTAVAVV;LTTMIKTAVAVVA;TTMIKTAVAVVAM;TMIKTAVAVVAMA;MIKTAVAVVAMAA;IKTAVAVVAMAAI;KTAVAVVAMAAIA;TAVAVVAMAAIAT;AVAVVAMAAIATF;VAVVAMAAIATFA;AVVAMAAIATFAA;VVAMAAIATFAAP;VAMAAIATFAAPV;AMAAIATFAAPVA;MAAIATFAAPVAL;AAIATFAAPVALA;AIATFAAPVALAA;IATFAAPVALAAY;ATFAAPVALAAYP;TFAAPVALAAYPI;FAAPVALAAYPIT;AAPVALAAYPITG;APVALAAYPITGK;PVALAAYPITGKL;VALAAYPITGKLG;ALAAYPITGKLGS;LAAYPITGKLGSE;AAYPITGKLGSEL;AYPITGKLGSELT;YPITGKLGSELTM;PITGKLGSELTMT;ITGKLGSELTMTD;TGKLGSELTMTDT;GKLGSELTMTDTV;KLGSELTMTDTVG;LGSELTMTDTVGQ;GSELTMTDTVGQV;SELTMTDTVGQVV;ELTMTDTVGQVVL;LTMTDTVGQVVLG;TMTDTVGQVVLGW;MTDTVGQVVLGWK;TDTVGQVVLGWKV;DTVGQVVLGWKVS;TVGQVVLGWKVSD;VGQVVLGWKVSDL;GQVVLGWKVSDLK;QVVLGWKVSDLKS;VVLGWKVSDLKSS;VLGWKVSDLKSST;LGWKVSDLKSSTA;GWKVSDLKSSTAV;WKVSDLKSSTAVI;KVSDLKSSTAVIP;VSDLKSSTAVIPG;SDLKSSTAVIPGY;DLKSSTAVIPGYP;LKSSTAVIPGYPV;KSSTAVIPGYPVA;SSTAVIPGYPVAG;STAVIPGYPVAGQ;TAVIPGYPVAGQV;AVIPGYPVAGQVW;VIPGYPVAGQVWE;IPGYPVAGQVWEA;PGYPVAGQVWEAT;GYPVAGQVWEATA;YPVAGQVWEATAT;PVAGQVWEATATV;VAGQVWEATATVN;AGQVWEATATVNA;GQVWE | |

Fig. 30 continued

| | | |
|---|---|---|
| | ATATVNAI;QVWEATATVNAIR;VWEATATVNAIRG;WEATATVNAIRGS;EATATVNAIRGSV;ATATVNAIRGSVT;TATVNAIRGSVTP;ATVNAIRGSVTPA;TVNAIRGSVTPAV;VNAIRGSVTPAVS;NAIRGSVTPAVSQ;AIRGSVTPAVSQF;IRGSVTPAVSQFN;RGSVTPAVSQFNA;GSVTPAVSQFNAR;SVTPAVSQFNART;VTPAVSQFNARTA;TPAVSQFNARTAD;PAVSQFNARTADG;AVSQFNARTADGI;VSQFNARTADGIN;SQFNARTADGINY;QFNARTADGINYR;FNARTADGINYRV;NARTADGINYRVL;ARTADGINYRVLW;RTADGINYRVLWQ;TADGINYRVLWQA;ADGINYRVLWQAA;DGINYRVLWQAAG;GINYRVLWQAAGP;INYRVLWQAAGPD;NYRVLWQAAGPDT;YRVLWQAAGPDTI;RVLWQAAGPDTIS;VLWQAAGPDTISG;LWQAAGPDTISGA;WQAAGPDTISGAT;QAAGPDTISGATI;AAGPDTISGATIP;AGPDTISGATIPQ;GPDTISGATIPQG;PDTISGATIPQGE;DTISGATIPQGEQ;TISGATIPQGEQS;ISGATIPQGEQST;SGATIPQGEQSTG;GATIPQGEQSTGK;ATIPQGEQSTGKI;TIPQGEQSTGKIY;IPQGEQSTGKIYF;PQGEQSTGKIYFD;QGEQSTGKIYFDV;GEQSTGKIYFDVT;EQSTGKIYFDVTG;QSTGKIYFDVTGP;STGKIYFDVTGPS;TGKIYFDVTGPSP;GKIYFDVTGPSPT;KIYFDVTGPSPTI;IYFDVTGPSPTIV;YFDVTGPSPTIVA;FDVTGPSPTIVAM;DVTGPSPTIVAMN;VTGPSPTIVAMNN;TGPSPTIVAMNNG;GPSPTIVAMNNGM;PSPTIVAMNNGME;SPTIVAMNNGMED;PTIVAMNNGMEDL;TIVAMNNGMEDLL;IVAMNNGMEDLLI;VAMNNGMEDLLIW;AMNNGMEDLLIWE;MNNGMEDLLIWEP;<br>14 mers:<br>MKLTTMIKTAVAVV;KLTTMIKTAVAVVA;LTTMIKTAVAVVAM;TTMIKTAVAVVAMA;TMIKTAVAVVAMAA;MIKTAVAVVAMAAI;IKTAVAVVAMAAIA;KTAVAVVAMAAIAT;TAVAVVAMAAIATF;AVAVVAMAAIATFA;VAVVAMAAIATFAA;AVVAMAAIATFAAP;VVAMAAIATFAAPV;VAMAAIATFAAPVA;AMAAIATFAAPVAL;MAAIATFAAPVALA;AAIATFAAPVALAA;AIATFAAPVALAAY;IATFAAPVALAAYP;ATFAAPVALAAYPI;TFAAPVALAAYPIT;FAAPVALAAYPITG;AAPVALAAYPITGK;APVALAAYPITGKL;PVALAAYPITGKLG;VALAAYPITGKLGS;ALAAYPITGKLGSE;LAAYPITGKLGSEL;AAYPITGKLGSELT;AYPITGKLGSELTM;YPITGKLGSELTMT;PITGKLGSELTMTD;ITGKLGSELTMTDT;TGKLGSELTMTDTV;GKLGSELTMTDTVG;KLGSELTMTDTVGQ;LGSELTMTDTVGQV;GSELTMTDTVGQVV;SELTMTDTVGQVVL;ELTMTDTVGQVVLG;LTMTDTVGQVVLGW;TMTDTVGQVVLGWK;MTDTVGQVVLGWKV;TDTVGQVVLGWKVS;DTVGQVVLGWKVSD;TVGQVVLGWKVSDL;VGQVVLGWKVSDLK;GQVVLGWKVSDLKS;QVVLGWKVSDLKSS;VVLGWKVSDLKSST;VLGWKVSDLKSSTA;LGWKVSDLKSSTAV;GWKVSDLKSSTAVI;WKVSDLKSSTAVIP;KVSDLKSSTAVIPG;VSDLKSSTAVIPGY;SDLKSSTAVIPGYP;DLKSSTAVIPGYPV;LKSSTAVIPGYPVA;KSSTAVIPGYPVAG;SSTAVIPGYPVAGQ;STAVIPGYPVAGQV;TAVIPGYPVAGQVW;AVIPGYPVAGQVWE;VIPGYPVAGQVWEA;IPGYPVAGQVWEAT;PGYPVAGQVWEATA;GYPVAGQVWEATAT;YPVAGQVWEATATV;PVAGQVWEATATVN;VAGQVWEATATVNA;AGQVWEATATVNAI;GQVWEATATVNAIR;QVWEATATVNAIRG;VWEATATVNAIRGS;WEATATVNAIRGSV;EATATVNAIRGSVT;ATATVNAIRGSVTP;TATVNAIRGSVTPA;ATVNAIRGSVTPAV;TVNAIRGSVTPAVS;VNAIRGSVTPAVSQ;NAIRGSVTPAVSQF;AIRGSVTPAVSQFN;IRGSVTPAVSQFNA;RGSVTPAVSQFNAR;GSVTPAVSQFNART;SVTPAVSQFNARTA;VTPAVSQFNARTAD;TPAVSQFNARTADG;PAVSQFNARTADGI;AVSQFNARTADGIN;VSQFNARTADGINY;SQFNARTADGINYR;QFNARTADGINYRV;FNARTADGINYRVL;NARTADGINYRVLW;ARTADGINYRVLWQ;RTADGINYRVLWQA;TADGINYRVLWQAA;ADGINYRVLWQAAG;DGINYRVLWQAAGP;GINYRVLWQAAGPD;INYRVLWQAAGPDT;NYRVLWQAAGPDTI;YRVLWQAAGPDTIS;RVLWQAAGPDTISG;VLWQAAGPDTISGA;LWQAAGPDTISGAT;WQAAGPDTISGATI;QAAGPDTISGATIP;AAGPDTISGATIPQ;AGPDTISGATIPQG;GPDTIS | |

Fig. 30 continued

| | | |
|---|---|---|
| | GATIPQGE;PDTISGATIPQGEQ;DTISGATIPQGEQS;TISGATIPQGEQST;ISGATIPQGEQSTG;SGATIPQGEQSTGK;GATIPQGEQSTGKI;ATIPQGEQSTGKIY;TIPQGEQSTGKIYF;IPQGEQSTGKIYFD;PQGEQSTGKIYFDV;QGEQSTGKIYFDVT;GEQSTGKIYFDVTG;EQSTGKIYFDVTGP;QSTGKIYFDVTGPS;STGKIYFDVTGPSP;TGKIYFDVTGPSPT;GKIYFDVTGPSPTI;KIYFDVTGPSPTIV;IYFDVTGPSPTIVA;YFDVTGPSPTIVAM;FDVTGPSPTIVAMN;DVTGPSPTIVAMNN;VTGPSPTIVAMNNG;TGPSPTIVAMNNGM;GPSPTIVAMNNGME;PSPTIVAMNNGMED;SPTIVAMNNGMEDL;PTIVAMNNGMEDLL;TIVAMNNGMEDLLI;IVAMNNGMEDLLIW;VAMNNGMEDLLIWE;AMNNGMEDLLIWEP;<br>15 mers:<br>MKLTTMIKTAVAVVA;KLTTMIKTAVAVVAM;LTTMIKTAVAVVAMA;TTMIKTAVAVVAMAA;TMIKTAVAVVAMAAI;MIKTAVAVVAMAAIA;IKTAVAVVAMAAIAT;KTAVAVVAMAAIATF;TAVAVVAMAAIATFA;AVAVVAMAAIATFAA;VAVVAMAAIATFAAP;AVVAMAAIATFAAPV;VVAMAAIATFAAPVA;VAMAAIATFAAPVAL;AMAAIATFAAPVALA;MAAIATFAAPVALAA;AAIATFAAPVALAAY;AIATFAAPVALAAYP;IATFAAPVALAAYPI;ATFAAPVALAAYPIT;TFAAPVALAAYPITG;FAAPVALAAYPITGK;AAPVALAAYPITGKL;APVALAAYPITGKLG;PVALAAYPITGKLGS;VALAAYPITGKLGSE;ALAAYPITGKLGSEL;LAAYPITGKLGSELT;AAYPITGKLGSELTM;AYPITGKLGSELTMT;YPITGKLGSELTMTD;PITGKLGSELTMTDT;ITGKLGSELTMTDTV;TGKLGSELTMTDTVG;GKLGSELTMTDTVGQ;KLGSELTMTDTVGQV;LGSELTMTDTVGQVV;GSELTMTDTVGQVVL;SELTMTDTVGQVVLG;ELTMTDTVGQVVLGW;LTMTDTVGQVVLGWK;TMTDTVGQVVLGWKV;MTDTVGQVVLGWKVS;TDTVGQVVLGWKVSD;DTVGQVVLGWKVSDL;TVGQVVLGWKVSDLK;VGQVVLGWKVSDLKS;GQVVLGWKVSDLKSS;QVVLGWKVSDLKSST;VVLGWKVSDLKSSTA;VLGWKVSDLKSSTAV;LGWKVSDLKSSTAVI;GWKVSDLKSSTAVIP;WKVSDLKSSTAVIPG;KVSDLKSSTAVIPGY;VSDLKSSTAVIPGYP;SDLKSSTAVIPGYPV;DLKSSTAVIPGYPVA;LKSSTAVIPGYPVAG;KSSTAVIPGYPVAGQ;SSTAVIPGYPVAGQV;STAVIPGYPVAGQVW;TAVIPGYPVAGQVWE;AVIPGYPVAGQVWEA;VIPGYPVAGQVWEAT;IPGYPVAGQVWEATA;PGYPVAGQVWEATAT;GYPVAGQVWEATATV;YPVAGQVWEATATVN;PVAGQVWEATATVNA;VAGQVWEATATVNAI;AGQVWEATATVNAIR;GQVWEATATVNAIRG;QVWEATATVNAIRGS;VWEATATVNAIRGSV;WEATATVNAIRGSVT;EATATVNAIRGSVTP;ATATVNAIRGSVTPA;TATVNAIRGSVTPAV;ATVNAIRGSVTPAVS;TVNAIRGSVTPAVSQ;VNAIRGSVTPAVSQF;NAIRGSVTPAVSQFN;AIRGSVTPAVSQFNA;IRGSVTPAVSQFNAR;RGSVTPAVSQFNART;GSVTPAVSQFNARTA;SVTPAVSQFNARTAD;VTPAVSQFNARTADG;TPAVSQFNARTADGI;PAVSQFNARTADGIN;AVSQFNARTADGINY;VSQFNARTADGINYR;SQFNARTADGINYRV;QFNARTADGINYRVL;FNARTADGINYRVLW;NARTADGINYRVLWQ;ARTADGINYRVLWQA;RTADGINYRVLWQAA;TADGINYRVLWQAAG;ADGINYRVLWQAAGP;DGINYRVLWQAAGPD;GINYRVLWQAAGPDT;INYRVLWQAAGPDTI;NYRVLWQAAGPDTIS;YRVLWQAAGPDTISG;RVLWQAAGPDTISGA;VLWQAAGPDTISGAT;LWQAAGPDTISGATI;WQAAGPDTISGATIP;QAAGPDTISGATIPQ;AAGPDTISGATIPQG;AGPDTISGATIPQGE;GPDTISGATIPQGEQ;PDTISGATIPQGEQS;DTISGATIPQGEQST;TISGATIPQGEQSTG;ISGATIPQGEQSTGK;SGATIPQGEQSTGKI;GATIPQGEQSTGKIY;ATIPQGEQSTGKIYF;TIPQGEQSTGKIYFD;IPQGEQSTGKIYFDV;PQGEQSTGKIYFDVT;QGEQSTGKIYFDVTG;GEQSTGKIYFDVTGP;EQSTGKIYFDVTGPS;QSTGKIYFDVTGPSP;STGKIYFDVTGPSPT;TGKIYFDVTGPSPTI;GKIYFDVTGPSPTIV;KIYFDVTGPSPTIVA;IYFDVTGPSPTIVAM;YFDVTGPSPTIVAMN;FDVTGPSPTIVAMNN;DVTGPSPTIVAMNNG;VTGPSPTIVAMNNGM;TGPSPTIVAMNNGME;GPSPTIVAMNNGMED;PSPTIVA | |

Fig. 30 continued

| | | |
|---|---|---|
| | MNNGMEDL;SPTIVAMNNGMEDLL;PTIVAMNNGMEDLLI;TIVAMNNGMEDLLIW;IVAMNNGMEDLLIWE;VAMNNGMEDLLIWEP;<br>16 mers:<br>MKLTTMIKTAVAVVAM;KLTTMIKTAVAVVAMA;LTTMIKTAVAVVAMAA;TTMIKTAVAVVAMAAI;TMIKTAVAVVAMAAIA;MIKTAVAVVAMAAIAT;IKTAVAVVAMAAIATF;KTAVAVVAMAAIATFA;TAVAVVAMAAIATFAA;AVAVVAMAAIATFAAP;VAVVAMAAIATFAAPV;AVVAMAAIATFAAPVA;VVAMAAIATFAAPVAL;VAMAAIATFAAPVALA;AMAAIATFAAPVALAA;MAAIATFAAPVALAAY;AAIATFAAPVALAAYP;AIATFAAPVALAAYPI;IATFAAPVALAAYPIT;ATFAAPVALAAYPITG;TFAAPVALAAYPITGK;FAAPVALAAYPITGKL;AAPVALAAYPITGKLG;APVALAAYPITGKLGS;PVALAAYPITGKLGSE;VALAAYPITGKLGSEL;ALAAYPITGKLGSELT;LAAYPITGKLGSELTM;AAYPITGKLGSELTMT;AYPITGKLGSELTMTD;YPITGKLGSELTMTDT;PITGKLGSELTMTDTV;ITGKLGSELTMTDTVG;TGKLGSELTMTDTVGQ;GKLGSELTMTDTVGQV;KLGSELTMTDTVGQVV;LGSELTMTDTVGQVVL;GSELTMTDTVGQVVLG;SELTMTDTVGQVVLGW;ELTMTDTVGQVVLGWK;LTMTDTVGQVVLGWKV;TMTDTVGQVVLGWKVS;MTDTVGQVVLGWKVSD;TDTVGQVVLGWKVSDL;DTVGQVVLGWKVSDLK;TVGQVVLGWKVSDLKS;VGQVVLGWKVSDLKSS;GQVVLGWKVSDLKSST;QVVLGWKVSDLKSSTA;VVLGWKVSDLKSSTAV;VLGWKVSDLKSSTAVI;LGWKVSDLKSSTAVIP;GWKVSDLKSSTAVIPG;WKVSDLKSSTAVIPGY;KVSDLKSSTAVIPGYP;VSDLKSSTAVIPGYPV;SDLKSSTAVIPGYPVA;DLKSSTAVIPGYPVAG;LKSSTAVIPGYPVAGQ;KSSTAVIPGYPVAGQV;SSTAVIPGYPVAGQVW;STAVIPGYPVAGQVWE;TAVIPGYPVAGQVWEA;AVIPGYPVAGQVWEAT;VIPGYPVAGQVWEATA;IPGYPVAGQVWEATAT;PGYPVAGQVWEATATV;GYPVAGQVWEATATVN;YPVAGQVWEATATVNA;PVAGQVWEATATVNAI;VAGQVWEATATVNAIR;AGQVWEATATVNAIRG;GQVWEATATVNAIRGS;QVWEATATVNAIRGSV;VWEATATVNAIRGSVT;WEATATVNAIRGSVTP;EATATVNAIRGSVTPA;ATATVNAIRGSVTPAV;TATVNAIRGSVTPAVS;ATVNAIRGSVTPAVSQ;TVNAIRGSVTPAVSQF;VNAIRGSVTPAVSQFN;NAIRGSVTPAVSQFNA;AIRGSVTPAVSQFNAR;IRGSVTPAVSQFNART;RGSVTPAVSQFNARTA;GSVTPAVSQFNARTAD;SVTPAVSQFNARTADG;VTPAVSQFNARTADGI;TPAVSQFNARTADGIN;PAVSQFNARTADGINY;AVSQFNARTADGINYR;VSQFNARTADGINYRV;SQFNARTADGINYRVL;QFNARTADGINYRVLW;FNARTADGINYRVLWQ;NARTADGINYRVLWQA;ARTADGINYRVLWQAA;RTADGINYRVLWQAAG;TADGINYRVLWQAAGP;ADGINYRVLWQAAGPD;DGINYRVLWQAAGPDT;GINYRVLWQAAGPDTI;INYRVLWQAAGPDTIS;NYRVLWQAAGPDTISG;YRVLWQAAGPDTISGA;RVLWQAAGPDTISGAT;VLWQAAGPDTISGATI;LWQAAGPDTISGATIP;WQAAGPDTISGATIPQ;QAAGPDTISGATIPQG;AAGPDTISGATIPQGE;AGPDTISGATIPQGEQ;GPDTISGATIPQGEQS;PDTISGATIPQGEQST;DTISGATIPQGEQSTG;TISGATIPQGEQSTGK;ISGATIPQGEQSTGKI;SGATIPQGEQSTGKIY;GATIPQGEQSTGKIYF;ATIPQGEQSTGKIYFD;TIPQGEQSTGKIYFDV;IPQGEQSTGKIYFDVT;PQGEQSTGKIYFDVTG;QGEQSTGKIYFDVTGP;GEQSTGKIYFDVTGPS;EQSTGKIYFDVTGPSP;QSTGKIYFDVTGPSPT;STGKIYFDVTGPSPTI;TGKIYFDVTGPSPTIV;GKIYFDVTGPSPTIVA;KIYFDVTGPSPTIVAM;IYFDVTGPSPTIVAMN;YFDVTGPSPTIVAMNN;FDVTGPSPTIVAMNNG;DVTGPSPTIVAMNNGM;VTGPSPTIVAMNNGME;TGPSPTIVAMNNGMED;GPSPTIVAMNNGMEDL;PSPTIVAMNNGMEDLL;SPTIVAMNNGMEDLLI;PTIVAMNNGMEDLLIW;TIVAMNNGMEDLLIWE;IVAMNNGMEDLLIWEP | |
| 33 | **<NP_216546.1 hypothetical protein Rv2030c;Mycobacterium tuberculosis H37Rv>**<br>MLMTAAADVTRRSPRRVFRDRREAGRVLAELLAAYRDQPDVIVLGLARGG | 169095-172630 |

Fig. 30 continued

| | | |
|---|---|---|
| | LPVAWEVAAALHAPLDAFVVRKLGAPGHDEFAVGALASGGRVVVNDDVV<br>RGLRITPQQLRDIAEREGRELLRRESAYRGERPPTDITGKTVIVVDDGLATG<br>ASMFAAVQALRDAQPAQIVIAVPAAPESTCREFAGLVDDVVCATMPTPFLA<br>VGESFWDFRQVTDEEVRRLLATPTAGPSLRRPAASTAADVLRRVAIDAPG<br>GVPTHEVLAELVGDARIVLIGESSHGTHEFYQARAAMTQWLIEEKGFGAVA<br>AEADWPDAYRVNRYVRGLGEDTNADEALSGFERFPAWMWRNTVVRDFV<br>EWLRTRNQRYESGALRQAGFYGLDLYSLHRSIQEVISYLDKVDPRAAARA<br>RARYACFDHACADDGQAYGFAAAFGAGPSCEREAVEQLVDVQRNALAYA<br>RQDGLLAEDELFYAQQNAQTVRDAEVYYRAMFSGRVTSWNLRDQHMAQ<br>TLGSLLTHLDRHLDAPPARIVVWAHNSHVGDARATEVWADGQLTLGQIVR<br>ERYGDESRSIGFSTYTGTVTAASEWGGIAQRKAVRPALHGSVEELFHQTA<br>DSFLVSARLSRDAEAPLDVVRLGRAIGVVYLPATERQSHYLHVRPADQFDA<br>MIHIDQTRALEPLEVTSRWIAGENPETYPTGL<br><br>8mer<br>LMTAAADV;MTAAADVT;TAAADVTR;AAADVTRR;DVTRRSPR;VTRRSPRR<br>;RRSPRRVF;RSPRRVFR;RRVFRDRR;RREAGRVL;RVLAELLA;VLAELLAA<br>;LAELLAAY;LARGGLPV;RGGLPVAW;GLPVAWEV;LPVAWEVA;VAWEVAA<br>A;EVAAALHA;AAALHAPL;ALHAPLDA;LHAPLDAF;HAPLDAFV;APLDAFVV;<br>FVVRKLGA;DEFAVGAL;FAVGALAS;ALASGGRV;LASGGRVV;RVVVNDDV<br>;VVVNDDVV;VVNDDVVR;RITPQQLR;QLRDIAER;DIAEREGR;AEREGREL;<br>ELLRRESA;LLRRESAY;ESAYRGER;ITGKTVIV;VVDDGLAT;GLATGASM;L<br>ATGASMF;TGASMFAA;GASMFAAV;SMFAAVQA;MFAAVQAL;FAAVQALR;<br>ALRDAQPA;AQPAQIVI;QPAQIVIA;QIVIAVPA;IVIAVPAA;ESTCREFA;GLVD<br>DVVC;LVDDVVCA;CATMPTPF;ATMPTPFL;TMPTPFLA;MPTPFLAV;FLAV<br>GESF;LAVGESFW;ESFWDFRQ;SFWDFRQV;RQVTDEEV;QVTDEEVR;EE<br>VRRLLA;RRLLATPT;RLLATPTA;TPTAGPSL;PTAGPSLR;TAGPSLRR;GPS<br>LRRPA;RPAASTAA;STAADVLR;TAADVLRR;AADVLRRV;DVLRRVAI;AIDA<br>PGGV;GGVPTHEV;GVPTHEVL;VPTHEVLA;THEVLAEL;HEVLAELV;ELVG<br>DARI;LVGDARIV;SSHGTHEF;FYQARAAM;YQARAAMT;RAAMTQWL;AAM<br>TQWLI;TQWLIEEK;WLIEEKGF;EEKGFGAV;FGAVAAEA;AVAAEADW;AEA<br>DWPDA;EADWPDAY;DAYRVNRY;YRVNRYVR;GLGEDTNA;DTNADEAL;E<br>ALSGFER;ALSGFERF;SGFERFPA;FERFPAWM;RFPAWMWR;FPAWMWR<br>N;AWMWRNTV;WMWRNTVV;MWRNTVVR;NTVVRDFV;FVEWLRTR;WLR<br>TRNQR;RTRNQRYE;QRYESGAL;RYESGALR;ALRQAGFY;RQAGFYGL;G<br>FYGLDLY;YGLDLYSL;LYSLHRSI;SIQEVISY;IQEVISYL;EVISYLDK;VISYLD<br>KV;YLDKVDPR;KVDPRAAA;AAARARAR;AARARARY;RARARYAC;CADDG<br>QAY;GQAYGFAA;QAYGFAAA;AYGFAAAF;REAVEQLV;AVEQLVDV;VQRN<br>ALAY;RNALAYAR;AYARQDGL;YARQDGLL;RQDGLLAE;GLLAEDEL;LLAE<br>DELF;LAEDELFY;AEDELFYA;AQQNAQTV;QQNAQTVR;QTVRDAEV;TVR<br>DAEVY;RDAEVYYR;AEVYYRAM;EVYYRAMF;YRAMFSGR;RAMFSGRV;A<br>MFSGRVT;FSGRVTSW;RVTSWNLR;NLRDQHMA;HMAQTLGS;MAQTLGS<br>L;AQTLGSLL;QTLGSLLT;SLLTHLDR;HLDRHLDA;APPARIVV;PPARIVVW;<br>VWAHNSHV;NSHVGDAR;EVWADGQL;WADGQLTL;GQLTLGQI;QLTLGQI<br>V;LTLGQIVR;GQIVRERY;ERYGDESR;DESRSIGF;RSIGFSTY;FSTYTGTV;<br>YTGTVTAA;TVTAASEW;AASEWGGI;EWGGIAQR;GIAQRKAV;IAQRKAVR;<br>RPALHGSV;EELFHQTA;FHQTADSF;HQTADSFL;QTADSFLV;DSFLVSAR;<br>LVSARLSR;RLSRDAEA;SRDAEAPL;AEAPLDVV;EAPLDVVR;APLDVVRL;<br>VVRLGRAI;RLGRAIGV;GRAIGVVY;RAIGVVYL;VYLPATER;YLPATERQ;AT<br>ERQSHY;TERQSHYL;RQSHYLHV;QSHYLHVR;HVRPADQF;PADQFDAM;<br>AMIHIDQT;MIHIDQTR;HIDQTRAL;QTRALEPL;RALEPLEV;ALEPLEVT;EPL<br>EVTSR;EVTSRWIA;PETYPTGL<br>9mer | |

Fig. 30 continued

| | | |
|---|---|---|
| | MLMTAAADV;MTAAADVTR;TAAADVTRR;DVTRRSPRR;RRSPRRVFR;EA<br>GRVLAEL;RVLAELLAA;VLAELLAAY;LAELLAAYR;AAYRDQPDV;AYRDQP<br>DVI;YRDQPDVIV;DVIVLGLAR;VLGLARGGL;GLARGGLPV;GGLPVAWEV;<br>GLPVAWEVA;LPVAWEVAA;VAWEVAAAL;VAAALHAPL;ALHAPLDAF;HAP<br>LDAFVV;PLDAFVVRK;LGAPGHDEF;APGHDEFAV;ALASGGRVV;LASGGR<br>VVV;RVVVNDDVV;VVVNDDVVR;GLRITPQQL;TPQQLRDIA;QQLRDIAER;<br>AEREGRELL;ELLRRESAY;LLRRESAYR;RESAYRGER;AYRGERPPT;DIT<br>GKTVIV;ITGKTVIVV;TVIVVDDGL;VVDDGLATG;GLATGASMF;LATGASMF<br>A;ATGASMFAA;TGASMFAAV;SMFAAVQAL;MFAAVQALR;ALRDAQPAQ;A<br>QPAQIVIA;QPAQIVIAV;AQIVIAVPA;APESTCREF;STCREFAGL;FAGLVDD<br>VV;GLVDDVVCA;LVDDVVCAT;DVVCATMPT;VCATMPTPF;ATMPTPFLA;T<br>MPTPFLAV;MPTPFLAVG;TPFLAVGES;PFLAVGESF;FLAVGESFW;AVGE<br>SFWDF;ESFWDFRQV;SFWDFRQVT;QVTDEEVRR;VTDEEVRRL;EEVRRL<br>LAT;RRLLATPTA;TPTAGPSLR;GPSLRRPAA;SLRRPAAST;RPAASTAAD;A<br>ASTAADVL;ASTAADVLR;STAADVLRR;TAADVLRRV;VLRRVAIDA;VAIDAP<br>GGV;VLAELVGDA;LAELVGDAR;AELVGDARI;ELVGDARIV;LVGDARIVL;E<br>SSHGTHEF;SSHGTHEFY;GTHEFYQAR;EFYQARAAM;YQARAAMTQ;QAR<br>AAMTQW;RAAMTQWLI;AMTQWLIEE;MTQWLIEEK;QWLIEEKGF;IEEKGF<br>GAV;EEKGFGAVA;GAVAAEADW;AEADWPDAY;EADWPDAYR;ADWPDAY<br>RV;DAYRVNRYV;AYRVNRYVR;RVNRYVRGL;NADEALSGF;DEALSGFER;<br>EALSGFERF;SGFERFPAW;FERFPAWMW;ERFPAWMWR;FPAWMWRNT;<br>PAWMWRNTV;AWMWRNTVV;WMWRNTVVR;WRNTVVRDF;TVVRDFVE<br>W;VVRDFVEWL;DFVEWLRTR;EWLRTRNQR;WLRTRNQRY;RTRNQRYES<br>;NQRYESGAL;QRYESGALR;FYGLDLYSL;DLYSLHRSI;SLHRSIQEV;RSIQ<br>EVISY;SIQEVISYL;EVISYLDKV;SYLDKVDPR;YLDKVDPRA;KVDPRAAAR;<br>DPRAAARAR;RAAARARAR;RARARYACF;ACADDGQAY;GQAYGFAAA;Q<br>AYGFAAAF;YGFAAAFGA;FGAGPSCER;GPSCEREAV;CEREAVEQL;EAV<br>EQLVDV;QLVDVQRNA;LVDVQRNAL;DVQRNALAY;VQRNALAYA;QRNAL<br>AYAR;LAYARQDGL;AYARQDGLL;GLLAEDELF;LLAEDELFY;LAEDELFYA;<br>AEDELFYAQ;ELFYAQQNA;YAQQNAQTV;AQQNAQTVR;AQTVRDAEV;QT<br>VRDAEVY;TVRDAEVYY;DAEVYYRAM;AEVYYRAMF;EVYYRAMFS;YYRA<br>MFSGR;YRAMFSGRV;RAMFSGRVT;AMFSGRVTS;NLRDQHMAQ;HMAQT<br>LGSL;MAQTLGSLL;AQTLGSLLT;TLGSLLTHL;GSLLTHLDR;LLTHLDRHL;H<br>LDAPPARI;DAPPARIVV;APPARIVVW;PPARIVVWA;VVWAHNSHV;TEVWA<br>DGQL;EVWADGQLT;VWADGQLTL;GQLTLGQIV;QLTLGQIVR;TLGQIVRE<br>R;RYGDESRSI;STYTGTVTA;GTVTAASEW;TAASEWGGI;SEWGGIAQR;GI<br>AQRKAVR;AQRKAVRPA;QRKAVRPAL;RPALHGSVE;ALHGSVEEL;SVEEL<br>FHQT;LFHQTADSF;HQTADSFLV;QTADSFLVS;TADSFLVSA;DSFLVSARL;<br>FLVSARLSR;EAPLDVVRL;RLGRAIGVV;LGRAIGVVY;GRAIGVVYL;VVYLP<br>ATER;YLPATERQS;LPATERQSH;ATERQSHYL;RQSHYLHVR;RPADQFDA<br>M;DQFDAMIHI;AMIHIDQTR;MIHIDQTRA;IHIDQTRAL;RALEPLEVT;ALEPL<br>EVTS;EPLEVTSRW;IAGENPETY;NPETYPTGL<br>10mer<br>MLMTAAADVT;LMTAAADVTR;MTAAADVTRR;AADVTRRSPR;VTRRSPRR<br>VF;TRRSPRRVFR;RSPRRVFRDR;SPRRVFRDRR;VFRDRREAGR;RDRRE<br>AGRVL;REAGRVLAEL;EAGRVLAELL;RVLAELLAAY;VLAELLAAYR;YRDQ<br>PDVIVL;QPDVIVLGLA;IVLGLARGGL;GLARGGLPVA;LARGGLPVAW;GLP<br>VAWEVAA;LPVAWEVAAA;PVAWEVAAAL;VAWEVAAALH;WEVAAALHAP;<br>EVAAALHAPL;AALHAPLDAF;ALHAPLDAFV;HAPLDAFVVR;APLDAFVVRK<br>;PLDAFVVRKL;KLGAPGHDEF;GAPGHDEFAV;GHDEFAVGAL;AVGALASG<br>GR;ALASGGRVVV;RVVVNDDVVR;VVNDDVVRGL;DIAEREGREL;RELLRR<br>ESAY;ELLRRESAYR;RRESAYRGER;DITGKTVIVV;KTVIVVDDGL;TVIVVD<br>DGLA;VVDDGLATGA;GLATGASMFA;LATGASMFAA;ATGASMFAAV;ASM | |

Fig. 30 continued

| | | |
|---|---|---|
| | FAAVQAL;SMFAAVQALR;VQALRDAQPA;ALRDAQPAQI;AQPAQIVIAV;AQIVIAVPAA;AAPESTCREF;ESTCREFAGL;STCREFAGLV;REFAGLVDDV;EFAGLVDDVV;GLVDDVVCAT;LVDDVVCATM;VVCATMPTPF;ATMPTPFLAV;MPTPFLAVGE;TPFLAVGESF;LAVGESFWDF;AVGESFWDFR;QVTDEEVRRL;VTDEEVRRLL;ATPTAGPSLR;TPTAGPSLRR;GPSLRRPAAS;SLRRPAASTA;RPAASTAADV;AASTAADVLR;ASTAADVLRR;STAADVLRRV;TAADVLRRVA;RVAIDAPGGV;APGGVPTHEV;VPTHEVLAEL;PTHEVLAELV;EVLAELVGDA;AELVGDARIV;ELVGDARIVL;LVGDARIVLI;VLIGESSHGT;GESSHGTHEF;ESSHGTHEFY;HEFYQARAAM;YQARAAMTQW;AMTQWLIEEK;TQWLIEEKGF;WLIEEKGFGA;LIEEKGFGAV;EEKGFGAVAA;FGAVAAEADW;AAEADWPDAY;EADWPDAYRV;DWPDAYRVNR;WPDAYRVNRY;DAYRVNRYVR;YRVNRYVRGL;GEDTNADEAL;DEALSGFERF;ALSGFERFPA;LSGFERFPAW;GFERFPAWMW;FPAWMWRNTV;PAWMWRNTVV;AWMWRNTVVR;MWRNTVVRDF;WRNTVVRDFV;NTVVRDFVEW;TVVRDFVEWL;VVRDFVEWLR;SGALRQAGFY;ALRQAGFYGL;RQAGFYGLDL;QAGFYGLDLY;GFYGLDLYSL;GLDLYSLHRS;YSLHRSIQEV;SLHRSIQEVI;HRSIQEVISY;RSIQEVISYL;IQEVISYLDK;QEVISYLDKV;ISYLDKVDPR;YLDKVDPRAA;KVDPRAAARA;RAAARARARY;AARARARYAC;ARARARYACF;HACADDGQAY;CADDGQAYGF;GQAYGFAAAF;FAAAFGAGPS;AFGAGPSCER;REAVEQLVDV;AVEQLVDVQR;QLVDVQRNAL;VQRNALAYAR;ALAYARQDGL;LAYARQDGLL;GLLAEDELFY;LLAEDELFYA;FYAQQNAQTV;YAQQNAQTVR;NAQTVRDAEV;AQTVRDAEVY;QTVRDAEVYY;TVRDAEVYYR;DAEVYYRAMF;AEVYYRAMFS;VYYRAMFSGR;YYRAMFSGRV;AMFSGRVTSW;SGRVTSWNLR;NLRDQHMAQT;HMAQTLGSLL;QTLGSLLTHL;SLLTHLDRHL;HLDAPPARIV;DAPPARIVVW;APPARIVVWA;IVVWAHNSHV;HVGDARATEV;VGDARATEVW;EVWADGQLTL;LTLGQIVRER;ESRSIGFSTY;FSTYTGTVTA;STYTGTVTAA;TGTVTAASEW;VTAASEWGGI;AQRKAVRPAL;AVRPALHGSV;RPALHGSVEE;ALHGSVEELF;SVEELFHQTA;EELFHQTADS;ELFHQTADSF;QTADSFLVSA;TADSFLVSAR;SFLVSARLSR;RLSRDAEAPL;DAEAPLDVVR;AEAPLDVVRL;APLDVVRLGR;PLDVVRLGRA;VVRLGRAIGV;RLGRAIGVVY;RAIGVVYLPA;GVVYLPATER;LPATERQSHY;TERQSHYLHV;YLHVRPADQF;RPADQFDAMI;DAMIHIDQTR;AMIHIDQTRA;MIHIDQTRAL;EPLEVTSRWI;EVTSRWIAGE;WIAGENPETY<br>11mer<br>MLMTAAADVTR;LMTAAADVTRR;MTAAADVTRRS;AAADVTRRSPR;DVTRRSPRRVF;VTRRSPRRVFR;RRSPRRVFRDR;RSPRRVFRDRR;RVFRDRREAGR;FRDRREAGRVL;RREAGRVLAEL;REAGRVLAELL;GRVLAELLAAY;RVLAELLAAYR;LLAAYRDQPDV;LAAYRDQPDVI;AAYRDQPDVIV;AYRDQPDVIVL;VIVLGLARGGL;VLGLARGGLPV;GLARGGLPVAW;ARGGLPVAWEV;GLPVAWEVAAA;LPVAWEVAAAL;VAWEVAAALHA;WEVAAALHAPL;AAALHAPLDAF;AALHAPLDAFV;ALHAPLDAFVV;HAPLDAFVVRK;APLDAFVVRKL;KLGAPGHDEFA;LGAPGHDEFAV;APGHDEFAVGA;FAVGALASGGR;AVGALASGGRV;GALASGGRVVV;VVNDDVVRGLR;RGLRITPQQLR;RITPQQLRDIA;TPQQLRDIAER;QLRDIAEREGR;DIAEREGRELL;GRELLRRESAY;RELLRRESAYR;AYRGERPPTDI;RPPTDITGKTV;PPTDITGKTVI;IVVDDGLATGA;GLATGASMFAA;LATGASMFAAV;TGASMFAAVQA;ASMFAAVQALR;QALRDAQPAQI;ALRDAQPAQIV;DAQPAQIVIAV;QPAQIVIAVPA;PESTCREFAGL;ESTCREFAGLV;REFAGLVDDVV;GLVDDVVCATM;DVVCATMPTPF;VVCATMPTPFL;CATMPTPFLAV;MPTPFLAVGES;TPFLAVGESFW;FLAVGESFWDF;LAVGESFWDFR;DFRQVTDEEVR;RQVTDEEVRRL;QVTDEEVRRLL;EEVRRLLATPT;RRLLATPTAGP;LLATPTAGPSL;LATPTAGPSLR;ATPTAGPSLRR;GPSLRRPAAST;SLRRPAASTAA;RPAASTAADVL;PAASTAADVLR;AASTAADVLRR;STAADVLRRVA;TAADVLRRVAI;RRVAIDAPGGV; | |

Fig. 30 continued

| | | |
|---|---|---|
| | DAPGGVPTHEV;APGGVPTHEVL;GVPTHEVLAEL;VPTHEVLAELV;EVLAELVGDAR;VLAELVGDARI;AELVGDARIVL;ELVGDARIVLI;GESSHGTHEFY;THEFYQARAAM;HEFYQARAAMT;FYQARAAMTQW;YQARAAMTQWL;AAMTQWLIEEK;MTQWLIEEKGF;WLIEEKGFGAV;GFGAVAAEADW;VAAEADWPDAY;AAEADWPDAYR;AEADWPDAYRV;WPDAYRVNRYV;AYRVNRYVRGL;GLGEDTNADEA;DTNADEALSGF;NADEALSGFER;EALSGFERFPA;SGFERFPAWMW;GFERFPAWMWR;RFPAWMWRNTV;FPAWMWRNTVV;PAWMWRNTVVR;WMWRNTVVRDF;RNTVVRDFVEW;NTVVRDFVEWL;TVVRDFVEWLR;FVEWLRTRNQR;RTRNQRYESGA;RNQRYESGALR;YESGALRQAGF;ESGALRQAGFY;RQAGFYGLDLY;AGFYGLDLYSL;FYGLDLYSLHR;GLDLYSLHRSI;HRSIQEVISYL;SIQEVISYLDK;IQEVISYLDKV;VISYLDKVDPR;YLDKVDPRAAA;KVDPRAAARAR;DPRAAARARAR;AARARARYACF;DHACADDGQAY;CADDGQAYGFA;QAYGFAAAFGA;AAFGAGPSCER;EAVEQLVDVQR;QLVDVQRNALA;LVDVQRNALAY;DVQRNALAYAR;ALAYARQDGLL;RQDGLLAEDEL;GLLAEDELFYA;LLAEDELFYAQ;ELFYAQQNAQT;LFYAQQNAQTV;FYAQQNAQTVR;NAQTVRDAEVY;AQTVRDAEVYY;QTVRDAEVYYR;TVRDAEVYYRA;AEVYYRAMFSG;EVYYRAMFSGR;VYYRAMFSGRV;RAMFSGRVTSW;MFSGRVTSWNL;FSGRVTSWNLR;NLRDQHMAQTL;HMAQTLGSLLT;MAQTLGSLLTH;AQTLGSLLTHL;LLTHLDRHLDA;HLDRHLDAPPA;HLDAPPARIVV;DAPPARIVVWA;RIVVWAHNSHV;WAHNSHVGDAR;HVGDARATEVW;TEVWADGQLTL;WADGQLTLGQI;QLTLGQIVRER;IVRERYGDESR;RYGDESRSIGF;DESRSIGFSTY;SIGFSTYTGTV;FSTYTGTVTAA;YTGTVTAASEW;TVTAASEWGGI;AASEWGGIAQR;ASEWGGIAQRK;GIAQRKAVRPA;IAQRKAVRPAL;KAVRPALHGSV;RPALHGSVEEL;EELFHQTADSF;ELFHQTADSFL;LFHQTADSFLV;HQTADSFLVSA;QTADSFLVSAR;TADSFLVSARL;DSFLVSARLSR;FLVSARLSRDA;ARLSRDAEAPL;EAPLDVVRLGR;APLDVVRLGRA;PLDVVRLGRAI;DVVRLGRAIGV;VVRLGRAIGVV;VRLGRAIGVVY;RLGRAIGVVYL;RAIGVVYLPAT;YLPATERQSHY;LPATERQSHYL;ATERQSHYLHV;TERQSHYLHVR;RQSHYLHVRPA;HYLHVRPADQF;HVRPADQFDAM;RPADQFDAMIH;FDAMIHIDQTR;AMIHIDQTRAL;HIDQTRALEPL;RALEPLEVTSR;EPLEVTSRWIA;RWIAGENPETY;GENPETYPTGL<br><br>13 mers:<br>MLMTAAADVTRRS;LMTAAADVTRRSP;MTAAADVTRRSPR;TAAADVTRRSPRR;AAADVTRRSPRRV;AADVTRRSPRRVF;ADVTRRSPRRVFR;DVTRRSPRRVFRD;VTRRSPRRVFRDR;TRRSPRRVFRDRR;RRSPRRVFRDRRE;RSPRRVFRDRREA;SPRRVFRDRREAG;PRRVFRDRREAGR;RRVFRDRREAGRV;RVFRDRREAGRVL;VFRDRREAGRVLA;FRDRREAGRVLAE;RDRREAGRVLAEL;DRREAGRVLAELL;RREAGRVLAELLA;REAGRVLAELLAA;EAGRVLAELLAAY;AGRVLAELLAAYR;GRVLAELLAAYRD;RVLAELLAAYRDQ;VLAELLAAYRDQP;LAELLAAYRDQPD;AELLAAYRDQPDV;ELLAAYRDQPDVI;LLAAYRDQPDVIV;LAAYRDQPDVIVL;AAYRDQPDVIVLG;AYRDQPDVIVLGL;YRDQPDVIVLGLA;RDQPDVIVLGLAR;DQPDVIVLGLARG;QPDVIVLGLARGG;PDVIVLGLARGGL;DVIVLGLARGGLP;VIVLGLARGGLPV;IVLGLARGGLPVA;VLGLARGGLPVAW;LGLARGGLPVAWE;GLARGGLPVAWEV;LARGGLPVAWEVA;ARGGLPVAWEVAA;RGGLPVAWEVAAA;GGLPVAWEVAAAL;GLPVAWEVAAALH;LPVAWEVAAALHA;PVAWEVAAALHAP;VAWEVAAALHAPL;AWEVAAALHAPLD;WEVAAALHAPLDA;EVAAALHAPLDAF;VAAALHAPLDAFV;AAALHAPLDAFVV;AALHAPLDAFVVR;ALHAPLDAFVVRK;LHAPLDAFVVRKL;HAPLDAFVVRKLG;APLDAFVVRKLGA;PLDAFVVRKLGAP;LDAFVVRKLGAPG;DAFVVRKLGAPGH;AFVVRKLGAPGHD;FVVRKLGAPGHDE;VVRKLGAPGHDEF;VRKLGAPGHDEFA;RKLGAPGHDEFAV; | |

Fig. 30 continued

| | | |
|---|---|---|
| | KLGAPGHDEFAVG;LGAPGHDEFAVGA;GAPGHDEFAVGAL;APGHDEFAVGALA;PGHDEFAVGALAS;GHDEFAVGALASG;HDEFAVGALASGG;DEFAVGALASGGR;EFAVGALASGGRV;FAVGALASGGRVV;AVGALASGGRVVV;VGALASGGRVVVN;GALASGGRVVVND;ALASGGRVVVNDD;LASGGRVVVNDDV;ASGGRVVVNDDVV;SGGRVVVNDDVVR;GGRVVVNDDVVRG;GRVVVNDDVVRGL;RVVVNDDVVRGLR;VVVNDDVVRGLRI;VVNDDVVRGLRIT;VNDDVVRGLRITP;NDDVVRGLRITPQ;DDVVRGLRITPQQ;DVVRGLRITPQQL;VVRGLRITPQQLR;VRGLRITPQQLRD;RGLRITPQQLRDI;GLRITPQQLRDIA;LRITPQQLRDIAE;RITPQQLRDIAER;ITPQQLRDIAERE;TPQQLRDIAEREG;PQQLRDIAEREGR;QQLRDIAEREGRE;QLRDIAEREGREL;LRDIAEREGRELL;RDIAEREGRELLR;DIAEREGRELLRR;IAEREGRELLRRE;AEREGRELLRRES;EREGRELLRRESA;REGRELLRRESAY;EGRELLRRESAYR;GRELLRRESAYRG;RELLRRESAYRGE;ELLRRESAYRGER;LLRRESAYRGERP;LRRESAYRGERPP;RRESAYRGERPPT;RESAYRGERPPTD;ESAYRGERPPTDI;SAYRGERPPTDIT;AYRGERPPTDITG;YRGERPPTDITGK;RGERPPTDITGKT;GERPPTDITGKTV;ERPPTDITGKTVI;RPPTDITGKTVIV;PPTDITGKTVIVV;PTDITGKTVIVVD;TDITGKTVIVVDD;DITGKTVIVVDDG;ITGKTVIVVDDGL;TGKTVIVVDDGLA;GKTVIVVDDGLAT;KTVIVVDDGLATG;TVIVVDDGLATGA;VIVVDDGLATGAS;IVVDDGLATGASM;VVDDGLATGASMF;VDDGLATGASMFA;DDGLATGASMFAA;DGLATGASMFAAV;GLATGASMFAAVQ;LATGASMFAAVQA;ATGASMFAAVQAL;TGASMFAAVQALR;GASMFAAVQALRD;ASMFAAVQALRDA;SMFAAVQALRDAQ;MFAAVQALRDAQP;FAAVQALRDAQPA;AAVQALRDAQPAQ;AVQALRDAQPAQI;VQALRDAQPAQIV;QALRDAQPAQIVI;ALRDAQPAQIVIA;LRDAQPAQIVIAV;RDAQPAQIVIAVP;DAQPAQIVIAVPA;AQPAQIVIAVPAA;QPAQIVIAVPAAP;PAQIVIAVPAAPE;AQIVIAVPAAPES;QIVIAVPAAPEST;IVIAVPAAPESTC;VIAVPAAPESTCR;IAVPAAPESTCRE;AVPAAPESTCREF;VPAAPESTCREFA;PAAPESTCREFAG;AAPESTCREFAGL;APESTCREFAGLV;PESTCREFAGLVD;ESTCREFAGLVDD;STCREFAGLVDDV;TCREFAGLVDDVV;CREFAGLVDDVVC;REFAGLVDDVVCA;EFAGLVDDVVCAT;FAGLVDDVVCATM;AGLVDDVVCATMP;GLVDDVVCATMPT;LVDDVVCATMPTP;VDDVVCATMPTPF;DDVVCATMPTPFL;DVVCATMPTPFLA;VVCATMPTPFLAV;VCATMPTPFLAVG;CATMPTPFLAVGE;ATMPTPFLAVGES;TMPTPFLAVGESF;MPTPFLAVGESFW;PTPFLAVGESFWD;TPFLAVGESFWDF;PFLAVGESFWDFR;FLAVGESFWDFRQ;LAVGESFWDFRQV;AVGESFWDFRQVT;VGESFWDFRQVTD;GESFWDFRQVTDE;ESFWDFRQVTDEE;SFWDFRQVTDEEV;FWDFRQVTDEEVR;WDFRQVTDEEVRR;DFRQVTDEEVRRL;FRQVTDEEVRRLL;RQVTDEEVRRLLA;QVTDEEVRRLLAT;VTDEEVRRLLATP;TDEEVRRLLATPT;DEEVRRLLATPTA;EEVRRLLATPTAG;EVRRLLATPTAGP;VRRLLATPTAGPS;RRLLATPTAGPSL;RLLATPTAGPSLR;LLATPTAGPSLRR;LATPTAGPSLRRP;ATPTAGPSLRRPA;TPTAGPSLRRPAA;PTAGPSLRRPAAS;TAGPSLRRPAAST;AGPSLRRPAASTA;GPSLRRPAASTAA;PSLRRPAASTAAD;SLRRPAASTAADV;LRRPAASTAADVL;RRPAASTAADVLR;RPAASTAADVLRR;PAASTAADVLRRV;AASTAADVLRRVA;ASTAADVLRRVAI;STAADVLRRVAID;TAADVLRRVAIDA;AADVLRRVAIDAP;ADVLRRVAIDAPG;DVLRRVAIDAPGG;VLRRVAIDAPGGV;LRRVAIDAPGGVP;RRVAIDAPGGVPT;RVAIDAPGGVPTH;VAIDAPGGVPTHE;AIDAPGGVPTHEV;IDAPGGVPTHEVL;DAPGGVPTHEVLA;APGGVPTHEVLAE;PGGVPTHEVLAEL;GGVPTHEVLAELV;GVPTHEVLAELVG;VPTHEVLAELVGD;PTHEVLAELVGDA;THEVLAELVGDAR;HEVLAELVGDARI;EVLAELVGDARIV;VLAELVGDARIVL;LAELVGDARIVLI;AELVGDARIVLIG;ELVGDARIVLIGE;LVGDARIVLIGES;VGDARIVLIGESS;GDARIVLIGESSH;DARIVLIGESSHG;ARIVLIGESSHGT;RIVLIGESSHGTH;IVLIGESSHGTHE;VLIGESSHGTHEF;LIGESSHGTHEFY;IGESSHGTHEFYQ;GE | |

Fig. 30 continued

| | | |
|---|---|---|
| | SSHGTHEFYQA;ESSHGTHEFYQAR;SSHGTHEFYQARA;SHGTHEFYQAR<br>AA;HGTHEFYQARAAM;GTHEFYQARAAMT;THEFYQARAAMTQ;HEFYQA<br>RAAMTQW;EFYQARAAMTQWL;FYQARAAMTQWLI;YQARAAMTQWLIE;Q<br>ARAAMTQWLIEE;ARAAMTQWLIEEK;RAAMTQWLIEEKG;AAMTQWLIEEK<br>GF;AMTQWLIEEKGFG;MTQWLIEEKGFGA;TQWLIEEKGFGAV;QWLIEEK<br>GFGAVA;WLIEEKGFGAVAA;LIEEKGFGAVAAE;IEEKGFGAVAAEA;EEKG<br>FGAVAAEAD;EKGFGAVAAEADW;KGFGAVAAEADWP;GFGAVAAEADWP<br>D;FGAVAAEADWPDA;GAVAAEADWPDAY;AVAAEADWPDAYR;VAAEAD<br>WPDAYRV;AAEADWPDAYRVN;AEADWPDAYRVNR;EADWPDAYRVNRY;<br>ADWPDAYRVNRYV;DWPDAYRVNRYVR;WPDAYRVNRYVRG;PDAYRVN<br>RYVRGL;DAYRVNRYVRGLG;AYRVNRYVRGLGE;YRVNRYVRGLGED;RV<br>NRYVRGLGEDT;VNRYVRGLGEDTN;NRYVRGLGEDTNA;RYVRGLGEDT<br>NAD;YVRGLGEDTNADE;VRGLGEDTNADEA;RGLGEDTNADEAL;GLGED<br>TNADEALS;LGEDTNADEALSG;GEDTNADEALSGF;EDTNADEALSGFE;D<br>TNADEALSGFER;TNADEALSGFERF;NADEALSGFERFP;ADEALSGFERF<br>PA;DEALSGFERFPAW;EALSGFERFPAWM;ALSGFERFPAWMW;LSGFER<br>FPAWMWR;SGFERFPAWMWRN;GFERFPAWMWRNT;FERFPAWMWRNT<br>V;ERFPAWMWRNTVV;RFPAWMWRNTVVR;FPAWMWRNTVVRD;PAWM<br>WRNTVVRDF;AWMWRNTVVRDFV;WMWRNTVVRDFVE;MWRNTVVRDF<br>VEW;WRNTVVRDFVEWL;RNTVVRDFVEWLR;NTVVRDFVEWLRT;TVVRD<br>FVEWLRTR;VVRDFVEWLRTRN;VRDFVEWLRTRNQ;RDFVEWLRTRNQR;<br>DFVEWLRTRNQRY;FVEWLRTRNQRYE;VEWLRTRNQRYES;EWLRTRNQ<br>RYESG;WLRTRNQRYESGA;LRTRNQRYESGAL;RTRNQRYESGALR;TRN<br>QRYESGALRQ;RNQRYESGALRQA;NQRYESGALRQAG;QRYESGALRQA<br>GF;RYESGALRQAGFY;YESGALRQAGFYG;ESGALRQAGFYGL;SGALRQ<br>AGFYGLD;GALRQAGFYGLDL;ALRQAGFYGLDLY;LRQAGFYGLDLYS;RQ<br>AGFYGLDLYSL;QAGFYGLDLYSLH;AGFYGLDLYSLHR;GFYGLDLYSLHR<br>S;FYGLDLYSLHRSI;YGLDLYSLHRSIQ;GLDLYSLHRSIQE;LDLYSLHRSIQ<br>EV;DLYSLHRSIQEVI;LYSLHRSIQEVIS;YSLHRSIQEVISY;SLHRSIQEVISY<br>L;LHRSIQEVISYLD;HRSIQEVISYLDK;RSIQEVISYLDKV;SIQEVISYLDKVD;<br>IQEVISYLDKVDP;QEVISYLDKVDPR;EVISYLDKVDPRA;VISYLDKVDPRAA<br>;ISYLDKVDPRAAA;SYLDKVDPRAAAR;YLDKVDPRAAARA;LDKVDPRAAA<br>RAR;DKVDPRAAARARA;KVDPRAAARARAR;VDPRAAARARARY;DPRAA<br>ARARARYA;PRAAARARARYAC;RAAARARARYACF;AAARARARYACFD;A<br>ARARARYACFDH;ARARARYACFDHA;RARARYACFDHAC;ARARYACFDH<br>ACA;RARYACFDHACAD;ARYACFDHACADD;RYACFDHACADDG;YACFD<br>HACADDGQ;ACFDHACADDGQA;CFDHACADDGQAY;FDHACADDGQAY<br>G;DHACADDGQAYGF;HACADDGQAYGFA;ACADDGQAYGFAA;CADDGQ<br>AYGFAAA;ADDGQAYGFAAAF;DDGQAYGFAAAFG;DGQAYGFAAAFGA;G<br>QAYGFAAAFGAG;QAYGFAAAFGAGP;AYGFAAAFGAGPS;YGFAAAFGAG<br>PSC;GFAAAFGAGPSCE;FAAAFGAGPSCER;AAAFGAGPSCERE;AAFGA<br>GPSCEREA;AFGAGPSCEREAV;FGAGPSCEREAVE;GAGPSCEREAVEQ;<br>AGPSCEREAVEQL;GPSCEREAVEQLV;PSCEREAVEQLVD;SCEREAVEQ<br>LVDV;CEREAVEQLVDVQ;EREAVEQLVDVQR;REAVEQLVDVQRN;EAVE<br>QLVDVQRNA;AVEQLVDVQRNAL;VEQLVDVQRNALA;EQLVDVQRNALAY;<br>QLVDVQRNALAYA;LVDVQRNALAYAR;VDVQRNALAYARQ;DVQRNALAY<br>ARQD;VQRNALAYARQDG;QRNALAYARQDGL;RNALAYARQDGLL;NALA<br>YARQDGLLA;ALAYARQDGLLAE;LAYARQDGLLAED;AYARQDGLLAEDE;<br>YARQDGLLAEDEL;ARQDGLLAEDELF;RQDGLLAEDELFY;QDGLLAEDEL<br>FYA;DGLLAEDELFYAQ;GLLAEDELFYAQQ;LLAEDELFYAQQN;LAEDELF<br>YAQQNA;AEDELFYAQQNAQ;EDELFYAQQNAQT;DELFYAQQNAQTV;ELF<br>YAQQNAQTVR;LFYAQQNAQTVRD;FYAQQNAQTVRDA;YAQQNAQTVRD<br>AE;AQQNAQTVRDAEV;QQNAQTVRDAEVY;QNAQTVRDAEVYY;NAQTVR | |

Fig. 30 continued

| | | |
|---|---|---|
| | DAEVYYR;AQTVRDAEVYYRA;QTVRDAEVYYRAM;TVRDAEVYYRAMF;VRDAEVYYRAMFS;RDAEVYYRAMFSG;DAEVYYRAMFSGR;AEVYYRAMFSGRV;EVYYRAMFSGRVT;VYYRAMFSGRVTS;YYRAMFSGRVTSW;YRAMFSGRVTSWN;RAMFSGRVTSWNL;AMFSGRVTSWNLR;MFSGRVTSWNLRD;FSGRVTSWNLRDQ;SGRVTSWNLRDQH;GRVTSWNLRDQHM;RVTSWNLRDQHMA;VTSWNLRDQHMAQ;TSWNLRDQHMAQT;SWNLRDQHMAQTL;WNLRDQHMAQTLG;NLRDQHMAQTLGS;LRDQHMAQTLGSL;RDQHMAQTLGSLL;DQHMAQTLGSLLT;QHMAQTLGSLLTH;HMAQTLGSLLTHL;MAQTLGSLLTHLD;AQTLGSLLTHLDR;QTLGSLLTHLDRH;TLGSLLTHLDRHL;LGSLLTHLDRHLD;GSLLTHLDRHLDA;SLLTHLDRHLDAP;LLTHLDRHLDAPP;LTHLDRHLDAPPA;THLDRHLDAPPAR;HLDRHLDAPPARI;LDRHLDAPPARIV;DRHLDAPPARIVV;RHLDAPPARIVVW;HLDAPPARIVVWA;LDAPPARIVVWAH;DAPPARIVVWAHN;APPARIVVWAHNS;PPARIVVWAHNSH;PARIVVWAHNSHV;ARIVVWAHNSHVG;RIVVWAHNSHVGD;IVVWAHNSHVGDA;VVWAHNSHVGDAR;VWAHNSHVGDARA;WAHNSHVGDARAT;AHNSHVGDARATE;HNSHVGDARATEV;NSHVGDARATEVW;SHVGDARATEVWA;HVGDARATEVWAD;VGDARATEVWADG;GDARATEVWADGQ;DARATEVWADGQL;ARATEVWADGQLT;RATEVWADGQLTL;ATEVWADGQLTLG;TEVWADGQLTLGQ;EVWADGQLTLGQI;VWADGQLTLGQIV;WADGQLTLGQIVR;ADGQLTLGQIVRE;DGQLTLGQIVRER;GQLTLGQIVRERY;QLTLGQIVRERYG;LTLGQIVRERYGD;TLGQIVRERYGDE;LGQIVRERYGDES;GQIVRERYGDESR;QIVRERYGDESRS;IVRERYGDESRSI;VRERYGDESRSIG;RERYGDESRSIGF;ERYGDESRSIGFS;RYGDESRSIGFST;YGDESRSIGFSTY;GDESRSIGFSTYT;DESRSIGFSTYTG;ESRSIGFSTYTGT;SRSIGFSTYTGTV;RSIGFSTYTGTVT;SIGFSTYTGTVTA;IGFSTYTGTVTAA;GFSTYTGTVTAAS;FSTYTGTVTAASE;STYTGTVTAASEW;TYTGTVTAASEWG;YTGTVTAASEWGG;TGTVTAASEWGGI;GTVTAASEWGGIA;TVTAASEWGGIAQ;VTAASEWGGIAQR;TAASEWGGIAQRK;AASEWGGIAQRKA;ASEWGGIAQRKAV;SEWGGIAQRKAVR;EWGGIAQRKAVRP;WGGIAQRKAVRPA;GGIAQRKAVRPAL;GIAQRKAVRPALH;IAQRKAVRPALHG;AQRKAVRPALHGS;QRKAVRPALHGSV;RKAVRPALHGSVE;KAVRPALHGSVEE;AVRPALHGSVEEL;VRPALHGSVEELF;RPALHGSVEELFH;PALHGSVEELFHQ;ALHGSVEELFHQT;LHGSVEELFHQTA;HGSVEELFHQTAD;GSVEELFHQTADS;SVEELFHQTADSF;VEELFHQTADSFL;EELFHQTADSFLV;ELFHQTADSFLVS;LFHQTADSFLVSA;FHQTADSFLVSAR;HQTADSFLVSARL;QTADSFLVSARLS;TADSFLVSARLSR;ADSFLVSARLSRD;DSFLVSARLSRDA;SFLVSARLSRDAE;FLVSARLSRDAEA;LVSARLSRDAEAP;VSARLSRDAEAPL;SARLSRDAEAPLD;ARLSRDAEAPLDV;RLSRDAEAPLDVV;LSRDAEAPLDVVR;SRDAEAPLDVVRL;RDAEAPLDVVRLG;DAEAPLDVVRLGR;AEAPLDVVRLGRA;EAPLDVVRLGRAI;APLDVVRLGRAIG;PLDVVRLGRAIGV;LDVVRLGRAIGVV;DVVRLGRAIGVVY;VVRLGRAIGVVYL;VRLGRAIGVVYLP;RLGRAIGVVYLPA;LGRAIGVVYLPAT;GRAIGVVYLPATE;RAIGVVYLPATER;AIGVVYLPATERQ;IGVVYLPATERQS;GVVYLPATERQSH;VVYLPATERQSHY;VYLPATERQSHYL;YLPATERQSHYLH;LPATERQSHYLHV;PATERQSHYLHVR;ATERQSHYLHVRP;TERQSHYLHVRPA;ERQSHYLHVRPAD;RQSHYLHVRPADQ;QSHYLHVRPADQF;SHYLHVRPADQFD;HYLHVRPADQFDA;YLHVRPADQFDAM;LHVRPADQFDAMI;HVRPADQFDAMIH;VRPADQFDAMIHI;RPADQFDAMIHID;PADQFDAMIHIDQ;ADQFDAMIHIDQT;DQFDAMIHIDQTR;QFDAMIHIDQTRA;FDAMIHIDQTRAL;DAMIHIDQTRALE;AMIHIDQTRALEP;MIHIDQTRALEPL;IHIDQTRALEPLE;HIDQTRALEPLEV;IDQTRALEPLEVT;DQTRALEPLEVTS;QTRALEPLEVTSR;TRALEPLEVTSRW;RALEPLEVTSRWI;ALEPLEVTSRWIA;LEPLEVTSRWIAG;EPLEVTSRWIAGE;PLEVTSRWIAGEN;LEVTSRWIAGENP;EVTSRWIAGENPE;VTSRWIAGENPET;TSRWIAGEN | |

Fig. 30 continued

| | | |
|---|---|---|
| | PETY;SRWIAGENPETYP;RWIAGENPETYPT;WIAGENPETYPTG;IAGENP<br>ETYPTGL;<br>14 mers:<br>MLMTAAADVTRRSP;LMTAAADVTRRSPR;MTAAADVTRRSPRR;TAAADV<br>TRRSPRRV;AAADVTRRSPRRVF;AADVTRRSPRRVFR;ADVTRRSPRRVF<br>RD;DVTRRSPRRVFRDR;VTRRSPRRVFRDRR;TRRSPRRVFRDRRE;RRS<br>PRRVFRDRREA;RSPRRVFRDRREAG;SPRRVFRDRREAGR;PRRVFRDR<br>REAGRV;RRVFRDRREAGRVL;RVFRDRREAGRVLA;VFRDRREAGRVLAE<br>;FRDRREAGRVLAEL;RDRREAGRVLAELL;DRREAGRVLAELLA;RREAGR<br>VLAELLAA;REAGRVLAELLAAY;EAGRVLAELLAAYR;AGRVLAELLAAYRD;<br>GRVLAELLAAYRDQ;RVLAELLAAYRDQP;VLAELLAAYRDQPD;LAELLAAY<br>RDQPDV;AELLAAYRDQPDVI;ELLAAYRDQPDVIV;LLAAYRDQPDVIVL;LA<br>AYRDQPDVIVLG;AAYRDQPDVIVLGL;AYRDQPDVIVLGLA;YRDQPDVIVL<br>GLAR;RDQPDVIVLGLARG;DQPDVIVLGLARGG;QPDVIVLGLARGGL;PDVI<br>VLGLARGGLP;DVIVLGLARGGLPV;VIVLGLARGGLPVA;IVLGLARGGLPVA<br>W;VLGLARGGLPVAWE;LGLARGGLPVAWEV;GLARGGLPVAWEVA;LARG<br>GLPVAWEVAA;ARGGLPVAWEVAAA;RGGLPVAWEVAAAL;GGLPVAWEV<br>AAALH;GLPVAWEVAAALHA;LPVAWEVAAALHAP;PVAWEVAAALHAPL;V<br>AWEVAAALHAPLD;AWEVAAALHAPLDA;WEVAAALHAPLDAF;EVAAALHA<br>PLDAFV;VAAALHAPLDAFVV;AAALHAPLDAFVVR;AALHAPLDAFVVRK;AL<br>HAPLDAFVVRKL;LHAPLDAFVVRKLG;HAPLDAFVVRKLGA;APLDAFVVRK<br>LGAP;PLDAFVVRKLGAPG;LDAFVVRKLGAPGH;DAFVVRKLGAPGHD;AF<br>VVRKLGAPGHDE;FVVRKLGAPGHDEF;VVRKLGAPGHDEFA;VRKLGAPG<br>HDEFAV;RKLGAPGHDEFAVG;KLGAPGHDEFAVGA;LGAPGHDEFAVGAL;<br>GAPGHDEFAVGALA;APGHDEFAVGALAS;PGHDEFAVGALASG;GHDEFA<br>VGALASGG;HDEFAVGALASGGR;DEFAVGALASGGRV;EFAVGALASGGR<br>VV;FAVGALASGGRVVV;AVGALASGGRVVVN;VGALASGGRVVVND;GAL<br>ASGGRVVVNDD;ALASGGRVVVNDDV;LASGGRVVVNDDVV;ASGGRVVV<br>NDDVVR;SGGRVVVNDDVVRG;GGRVVVNDDVVRGL;GRVVVNDDVVRGL<br>R;RVVVNDDVVRGLRI;VVVNDDVVRGLRIT;VVNDDVVRGLRITP;VNDDVV<br>RGLRITPQ;NDDVVRGLRITPQQ;DDVVRGLRITPQQL;DVVRGLRITPQQLR<br>;VVRGLRITPQQLRD;VRGLRITPQQLRDI;RGLRITPQQLRDIA;GLRITPQQL<br>RDIAE;LRITPQQLRDIAER;RITPQQLRDIAERE;ITPQQLRDIAEREG;TPQQL<br>RDIAEREGR;PQQLRDIAEREGRE;QQLRDIAEREGREL;QLRDIAEREGREL<br>L;LRDIAEREGRELLR;RDIAEREGRELLRR;DIAEREGRELLRRE;IAEREGR<br>ELLRRES;AEREGRELLRRESA;EREGRELLRRESAY;REGRELLRRESAYR<br>;EGRELLRRESAYRG;GRELLRRESAYRGE;RELLRRESAYRGER;ELLRRE<br>SAYRGERP;LLRRESAYRGERPP;LRRESAYRGERPPT;RRESAYRGERPP<br>TD;RESAYRGERPPTDI;ESAYRGERPPTDIT;SAYRGERPPTDITG;AYRGE<br>RPPTDITGK;YRGERPPTDITGKT;RGERPPTDITGKTV;GERPPTDITGKTVI;<br>ERPPTDITGKTVIV;RPPTDITGKTVIVV;PPTDITGKTVIVVD;PTDITGKTVIVV<br>DD;TDITGKTVIVVDDG;DITGKTVIVVDDGL;ITGKTVIVVDDGLA;TGKTVIVV<br>DDGLAT;GKTVIVVDDGLATG;KTVIVVDDGLATGA;TVIVVDDGLATGAS;VI<br>VVDDGLATGASM;IVVDDGLATGASMF;VVDDGLATGASMFA;VDDGLATG<br>ASMFAA;DDGLATGASMFAAV;DGLATGASMFAAVQ;GLATGASMFAAVQA<br>;LATGASMFAAVQAL;ATGASMFAAVQALR;TGASMFAAVQALRD;GASMFA<br>AVQALRDA;ASMFAAVQALRDAQ;SMFAAVQALRDAQP;MFAAVQALRDAQ<br>PA;FAAVQALRDAQPAQ;AAVQALRDAQPAQI;AVQALRDAQPAQIV;VQALR<br>DAQPAQIVI;QALRDAQPAQIVIA;ALRDAQPAQIVIAV;LRDAQPAQIVIAVP;R<br>DAQPAQIVIAVPA;DAQPAQIVIAVPAA;AQPAQIVIAVPAAP;QPAQIVIAVPA<br>APE;PAQIVIAVPAAPES;AQIVIAVPAAPEST;QIVIAVPAAPESTC;IVIAVPAA<br>PESTCR;VIAVPAAPESTCRE;IAVPAAPESTCREF;AVPAAPESTCREFA;VP<br>AAPESTCREFAG;PAAPESTCREFAGL;AAPESTCREFAGLV;APESTCREF | |

Fig. 30 continued

| | | |
|---|---|---|
| | AGLVD;PESTCREFAGLVDD;ESTCREFAGLVDDV;STCREFAGLVDDVV;T<br>CREFAGLVDDVVC;CREFAGLVDDVVCA;REFAGLVDDVVCAT;EFAGLVD<br>DVVCATM;FAGLVDDVVCATMP;AGLVDDVVCATMPT;GLVDDVVCATMPT<br>P;LVDDVVCATMPTPF;VDDVVCATMPTPFL;DDVVCATMPTPFLA;DVVCAT<br>MPTPFLAV;VVCATMPTPFLAVG;VCATMPTPFLAVGE;CATMPTPFLAVGE<br>S;ATMPTPFLAVGESF;TMPTPFLAVGESFW;MPTPFLAVGESFWD;PTPFL<br>AVGESFWDF;TPFLAVGESFWDFR;PFLAVGESFWDFRQ;FLAVGESFWDF<br>RQV;LAVGESFWDFRQVT;AVGESFWDFRQVTD;VGESFWDFRQVTDE;G<br>ESFWDFRQVTDEE;ESFWDFRQVTDEEV;SFWDFRQVTDEEVR;FWDFRQ<br>VTDEEVRR;WDFRQVTDEEVRRL;DFRQVTDEEVRRLL;FRQVTDEEVRRL<br>LA;RQVTDEEVRRLLAT;QVTDEEVRRLLATP;VTDEEVRRLLATPT;TDEEV<br>RRLLATPTA;DEEVRRLLATPTAG;EEVRRLLATPTAGP;EVRRLLATPTAGP<br>S;VRRLLATPTAGPSL;RRLLATPTAGPSLR;RLLATPTAGPSLRR;LLATPTA<br>GPSLRRP;LATPTAGPSLRRPA;ATPTAGPSLRRPAA;TPTAGPSLRRPAAS;<br>PTAGPSLRRPAAST;TAGPSLRRPAASTA;AGPSLRRPAASTAA;GPSLRRP<br>AASTAAD;PSLRRPAASTAADV;SLRRPAASTAADVL;LRRPAASTAADVLR;<br>RRPAASTAADVLRR;RPAASTAADVLRRV;PAASTAADVLRRVA;AASTAAD<br>VLRRVAI;ASTAADVLRRVAID;STAADVLRRVAIDA;TAADVLRRVAIDAP;AA<br>DVLRRVAIDAPG;ADVLRRVAIDAPGG;DVLRRVAIDAPGGV;VLRRVAIDAP<br>GGVP;LRRVAIDAPGGVPT;RRVAIDAPGGVPTH;RVAIDAPGGVPTHE;VAI<br>DAPGGVPTHEV;AIDAPGGVPTHEVL;IDAPGGVPTHEVLA;DAPGGVPTHE<br>VLAE;APGGVPTHEVLAEL;PGGVPTHEVLAELV;GGVPTHEVLAELVG;GVP<br>THEVLAELVGD;VPTHEVLAELVGDA;PTHEVLAELVGDAR;THEVLAELVGD<br>ARI;HEVLAELVGDARIV;EVLAELVGDARIVL;VLAELVGDARIVLI;LAELVGD<br>ARIVLIG;AELVGDARIVLIGE;ELVGDARIVLIGES;LVGDARIVLIGESS;VGDA<br>RIVLIGESSH;GDARIVLIGESSHG;DARIVLIGESSHGT;ARIVLIGESSHGTH;<br>RIVLIGESSHGTHE;IVLIGESSHGTHEF;VLIGESSHGTHEFY;LIGESSHGTH<br>EFYQ;IGESSHGTHEFYQA;GESSHGTHEFYQAR;ESSHGTHEFYQARA;SS<br>HGTHEFYQARAA;SHGTHEFYQARAAM;HGTHEFYQARAAMT;GTHEFYQ<br>ARAAMTQ;THEFYQARAAMTQW;HEFYQARAAMTQWL;EFYQARAAMTQ<br>WLI;FYQARAAMTQWLIE;YQARAAMTQWLIEE;QARAAMTQWLIEEK;ARA<br>AMTQWLIEEKG;RAAMTQWLIEEKGF;AAMTQWLIEEKGFG;AMTQWLIEEK<br>GFGA;MTQWLIEEKGFGAV;TQWLIEEKGFGAVA;QWLIEEKGFGAVAA;WLI<br>EEKGFGAVAAE;LIEEKGFGAVAAEA;IEEKGFGAVAAEAD;EEKGFGAVAAE<br>ADW;EKGFGAVAAEADWP;KGFGAVAAEADWPD;GFGAVAAEADWPDA;F<br>GAVAAEADWPDAY;GAVAAEADWPDAYR;AVAAEADWPDAYRV;VAAEAD<br>WPDAYRVN;AAEADWPDAYRVNR;AEADWPDAYRVNRY;EADWPDAYRV<br>NRYV;ADWPDAYRVNRYVR;DWPDAYRVNRYVRG;WPDAYRVNRYVRGL;<br>PDAYRVNRYVRGLG;DAYRVNRYVRGLGE;AYRVNRYVRGLGED;YRVNR<br>YVRGLGEDT;RVNRYVRGLGEDTN;VNRYVRGLGEDTNA;NRYVRGLGEDT<br>NAD;RYVRGLGEDTNADE;YVRGLGEDTNADEA;VRGLGEDTNADEAL;RG<br>LGEDTNADEALS;GLGEDTNADEALSG;LGEDTNADEALSGF;GEDTNADEA<br>LSGFE;EDTNADEALSGFER;DTNADEALSGFERF;TNADEALSGFERFP;NA<br>DEALSGFERFPA;ADEALSGFERFPAW;DEALSGFERFPAWM;EALSGFER<br>FPAWMW;ALSGFERFPAWMWR;LSGFERFPAWMWRN;SGFERFPAWMW<br>RNT;GFERFPAWMWRNTV;FERFPAWMWRNTVV;ERFPAWMWRNTVVR;<br>RFPAWMWRNTVVRD;FPAWMWRNTVVRDF;PAWMWRNTVVRDFV;AWM<br>WRNTVVRDFVE;WMWRNTVVRDFVEW;MWRNTVVRDFVEWL;WRNTVV<br>RDFVEWLR;RNTVVRDFVEWLRT;NTVVRDFVEWLRTR;TVVRDFVEWLRT<br>RN;VVRDFVEWLRTRNQ;VRDFVEWLRTRNQR;RDFVEWLRTRNQRY;DFV<br>EWLRTRNQRYE;FVEWLRTRNQRYES;VEWLRTRNQRYESG;EWLRTRNQ<br>RYESGA;WLRTRNQRYESGAL;LRTRNQRYESGALR;RTRNQRYESGALR<br>Q;TRNQRYESGALRQA;RNQRYESGALRQAG;NQRYESGALRQAGF;QRY | |

Fig. 30 continued

| | | |
|---|---|---|
| | ESGALRQAGFY;RYESGALRQAGFYG;YESGALRQAGFYGL;ESGALRQAGFYGLD;SGALRQAGFYGLDL;GALRQAGFYGLDLY;ALRQAGFYGLDLYS;LRQAGFYGLDLYSL;RQAGFYGLDLYSLH;QAGFYGLDLYSLHR;AGFYGLDLYSLHRS;GFYGLDLYSLHRSI;FYGLDLYSLHRSIQ;YGLDLYSLHRSIQE;GLDLYSLHRSIQEV;LDLYSLHRSIQEVI;DLYSLHRSIQEVIS;LYSLHRSIQEVISY;YSLHRSIQEVISYL;SLHRSIQEVISYLD;LHRSIQEVISYLDK;HRSIQEVISYLDKV;RSIQEVISYLDKVD;SIQEVISYLDKVDP;IQEVISYLDKVDPR;QEVISYLDKVDPRA;EVISYLDKVDPRAA;VISYLDKVDPRAAA;ISYLDKVDPRAAAR;SYLDKVDPRAAARA;YLDKVDPRAAARAR;LDKVDPRAAARARA;DKVDPRAAARARAR;KVDPRAAARARARY;VDPRAAARARARYA;DPRAAARARARYAC;PRAAARARARYACF;RAAARARARYACFD;AAARARARYACFDH;AARARARYACFDHA;ARARARYACFDHAC;RARARYACFDHACA;ARARYACFDHACAD;RARYACFDHACADD;ARYACFDHACADDG;RYACFDHACADDGQ;YACFDHACADDGQA;ACFDHACADDGQAY;CFDHACADDGQAYG;FDHACADDGQAYGF;DHACADDGQAYGFA;HACADDGQAYGFAA;ACADDGQAYGFAAA;CADDGQAYGFAAAF;ADDGQAYGFAAAFG;DDGQAYGFAAAFGA;DGQAYGFAAAFGAG;GQAYGFAAAFGAGP;QAYGFAAAFGAGPS;AYGFAAAFGAGPSC;YGFAAAFGAGPSCE;GFAAAFGAGPSCER;FAAAFGAGPSCERE;AAAFGAGPSCEREA;AAFGAGPSCEREAV;AFGAGPSCEREAVE;FGAGPSCEREAVEQ;GAGPSCEREAVEQL;AGPSCEREAVEQLV;GPSCEREAVEQLVD;PSCEREAVEQLVDV;SCEREAVEQLVDVQ;CEREAVEQLVDVQR;EREAVEQLVDVQRN;REAVEQLVDVQRNA;EAVEQLVDVQRNAL;AVEQLVDVQRNALA;VEQLVDVQRNALAY;EQLVDVQRNALAYA;QLVDVQRNALAYAR;LVDVQRNALAYARQ;VDVQRNALAYARQD;DVQRNALAYARQDG;VQRNALAYARQDGL;QRNALAYARQDGLL;RNALAYARQDGLLA;NALAYARQDGLLAE;ALAYARQDGLLAED;LAYARQDGLLAEDE;AYARQDGLLAEDEL;YARQDGLLAEDELF;ARQDGLLAEDELFY;RQDGLLAEDELFYA;QDGLLAEDELFYAQ;DGLLAEDELFYAQQ;GLLAEDELFYAQQN;LLAEDELFYAQQNA;LAEDELFYAQQNAQ;AEDELFYAQQNAQT;EDELFYAQQNAQTV;DELFYAQQNAQTVR;ELFYAQQNAQTVRD;LFYAQQNAQTVRDA;FYAQQNAQTVRDAE;YAQQNAQTVRDAEV;AQQNAQTVRDAEVY;QQNAQTVRDAEVYY;QNAQTVRDAEVYYR;NAQTVRDAEVYYRA;AQTVRDAEVYYRAM;QTVRDAEVYYRAMF;TVRDAEVYYRAMFS;VRDAEVYYRAMFSG;RDAEVYYRAMFSGR;DAEVYYRAMFSGRV;AEVYYRAMFSGRVT;EVYYRAMFSGRVTS;VYYRAMFSGRVTSW;YYRAMFSGRVTSWN;YRAMFSGRVTSWNL;RAMFSGRVTSWNLR;AMFSGRVTSWNLRD;MFSGRVTSWNLRDQ;FSGRVTSWNLRDQH;SGRVTSWNLRDQHM;GRVTSWNLRDQHMA;RVTSWNLRDQHMAQ;VTSWNLRDQHMAQT;TSWNLRDQHMAQTL;SWNLRDQHMAQTLG;WNLRDQHMAQTLGS;NLRDQHMAQTLGSL;LRDQHMAQTLGSLL;RDQHMAQTLGSLLT;DQHMAQTLGSLLTH;QHMAQTLGSLLTHL;HMAQTLGSLLTHLD;MAQTLGSLLTHLDR;AQTLGSLLTHLDRH;QTLGSLLTHLDRHL;TLGSLLTHLDRHLD;LGSLLTHLDRHLDA;GSLLTHLDRHLDAP;SLLTHLDRHLDAPP;LLTHLDRHLDAPPA;LTHLDRHLDAPPAR;THLDRHLDAPPARI;HLDRHLDAPPARIV;LDRHLDAPPARIVV;DRHLDAPPARIVVW;RHLDAPPARIVVWA;HLDAPPARIVVWAH;LDAPPARIVVWAHN;DAPPARIVVWAHNS;APPARIVVWAHNSH;PPARIVVWAHNSHV;PARIVVWAHNSHVG;ARIVVWAHNSHVGD;RIVVWAHNSHVGDA;IVVWAHNSHVGDAR;VVWAHNSHVGDARA;VWAHNSHVGDARAT;WAHNSHVGDARATE;AHNSHVGDARATEV;HNSHVGDARATEVW;NSHVGDARATEVWA;SHVGDARATEVWAD;HVGDARATEVWADG;VGDARATEVWADGQ;GDARATEVWADGQL;DARATEVWADGQLT;ARATEVWADGQLTL;RATEVWADGQLTLG;ATEVWADGQLTLGQ;TEVWADGQLTLGQI;EVWADGQLTLGQIV;VWADGQLTLGQIVR;WADGQLTLGQIVRE;ADGQLTLGQIVRER;DGQLTLGQIVRERY;GQLTLGQIVRERYG;QLTLGQIVRERYGD;LTLGQI | |

Fig. 30 continued

| | | |
|---|---|---|
| | VRERYGDE;TLGQIVRERYGDES;LGQIVRERYGDESR;GQIVRERYGDESRS;QIVRERYGDESRSI;IVRERYGDESRSIG;VRERYGDESRSIGF;RERYGDESRSIGFS;ERYGDESRSIGFST;RYGDESRSIGFSTY;YGDESRSIGFSTYT;GDESRSIGFSTYTG;DESRSIGFSTYTGT;ESRSIGFSTYTGTV;SRSIGFSTYTGTVT;RSIGFSTYTGTVTA;SIGFSTYTGTVTAA;IGFSTYTGTVTAAS;GFSTYTGTVTAASE;FSTYTGTVTAASEW;STYTGTVTAASEWG;TYTGTVTAASEWGG;YTGTVTAASEWGGI;TGTVTAASEWGGIA;GTVTAASEWGGIAQ;TVTAASEWGGIAQR;VTAASEWGGIAQRK;TAASEWGGIAQRKA;AASEWGGIAQRKAV;ASEWGGIAQRKAVR;SEWGGIAQRKAVRP;EWGGIAQRKAVRPA;WGGIAQRKAVRPAL;GGIAQRKAVRPALH;GIAQRKAVRPALHG;IAQRKAVRPALHGS;AQRKAVRPALHGSV;QRKAVRPALHGSVE;RKAVRPALHGSVEE;KAVRPALHGSVEEL;AVRPALHGSVEELF;VRPALHGSVEELFH;RPALHGSVEELFHQ;PALHGSVEELFHQT;ALHGSVEELFHQTA;LHGSVEELFHQTAD;HGSVEELFHQTADS;GSVEELFHQTADSF;SVEELFHQTADSFL;VEELFHQTADSFLV;EELFHQTADSFLVS;ELFHQTADSFLVSA;LFHQTADSFLVSAR;FHQTADSFLVSARL;HQTADSFLVSARLS;QTADSFLVSARLSR;TADSFLVSARLSRD;ADSFLVSARLSRDA;DSFLVSARLSRDAE;SFLVSARLSRDAEA;FLVSARLSRDAEAP;LVSARLSRDAEAPL;VSARLSRDAEAPLD;SARLSRDAEAPLDV;ARLSRDAEAPLDVV;RLSRDAEAPLDVVR;LSRDAEAPLDVVRL;SRDAEAPLDVVRLG;RDAEAPLDVVRLGR;DAEAPLDVVRLGRA;AEAPLDVVRLGRAI;EAPLDVVRLGRAIG;APLDVVRLGRAIGV;PLDVVRLGRAIGVV;LDVVRLGRAIGVVY;DVVRLGRAIGVVYL;VVRLGRAIGVVYLP;VRLGRAIGVVYLPA;RLGRAIGVVYLPAT;LGRAIGVVYLPATE;GRAIGVVYLPATER;RAIGVVYLPATERQ;AIGVVYLPATERQS;IGVVYLPATERQSH;GVVYLPATERQSHY;VVYLPATERQSHYL;VYLPATERQSHYLH;YLPATERQSHYLHV;LPATERQSHYLHVR;PATERQSHYLHVRP;ATERQSHYLHVRPA;TERQSHYLHVRPAD;ERQSHYLHVRPADQ;RQSHYLHVRPADQF;QSHYLHVRPADQFD;SHYLHVRPADQFDA;HYLHVRPADQFDAM;YLHVRPADQFDAMI;LHVRPADQFDAMIH;HVRPADQFDAMIHI;VRPADQFDAMIHID;RPADQFDAMIHIDQ;PADQFDAMIHIDQT;ADQFDAMIHIDQTR;DQFDAMIHIDQTRA;QFDAMIHIDQTRAL;FDAMIHIDQTRALE;DAMIHIDQTRALEP;AMIHIDQTRALEPL;MIHIDQTRALEPLE;IHIDQTRALEPLEV;HIDQTRALEPLEVT;IDQTRALEPLEVTS;DQTRALEPLEVTSR;QTRALEPLEVTSRW;TRALEPLEVTSRWI;RALEPLEVTSRWIA;ALEPLEVTSRWIAG;LEPLEVTSRWIAGE;EPLEVTSRWIAGEN;PLEVTSRWIAGENP;LEVTSRWIAGENPE;EVTSRWIAGENPET;VTSRWIAGENPETY;TSRWIAGENPETYP;SRWIAGENPETYPT;RWIAGENPETYPTG;WIAGENPETYPTGL;<br>15 mers:<br>MLMTAAADVTRRSPR;LMTAAADVTRRSPRR;MTAAADVTRRSPRRV;TAAADVTRRSPRRVF;AAADVTRRSPRRVFR;AADVTRRSPRRVFRD;ADVTRRSPRRVFRDR;DVTRRSPRRVFRDRR;VTRRSPRRVFRDRRE;TRRSPRRVFRDRREA;RRSPRRVFRDRREAG;RSPRRVFRDRREAGR;SPRRVFRDRREAGRV;PRRVFRDRREAGRVL;RRVFRDRREAGRVLA;RVFRDRREAGRVLAE;VFRDRREAGRVLAEL;FRDRREAGRVLAELL;RDRREAGRVLAELLA;DRREAGRVLAELLAA;RREAGRVLAELLAAY;REAGRVLAELLAAYR;EAGRVLAELLAAYRD;AGRVLAELLAAYRDQ;GRVLAELLAAYRDQP;RVLAELLAAYRDQPD;VLAELLAAYRDQPDV;LAELLAAYRDQPDVI;AELLAAYRDQPDVIV;ELLAAYRDQPDVIVL;LLAAYRDQPDVIVLG;LAAYRDQPDVIVLGL;AAYRDQPDVIVLGLA;AYRDQPDVIVLGLAR;YRDQPDVIVLGLARG;RDQPDVIVLGLARGG;DQPDVIVLGLARGGL;QPDVIVLGLARGGLP;PDVIVLGLARGGLPV;DVIVLGLARGGLPVA;VIVLGLARGGLPVAW;IVLGLARGGLPVAWE;VLGLARGGLPVAWEV;LGLARGGLPVAWEVA;GLARGGLPVAWEVAA;LARGGLPVAWEVAAA;ARGGLPVAWEVAAAL;RGGLPVAWEVAAALH;GGLPVAWEVAA | |

Fig. 30 continued

| | | |
|---|---|---|
| | ALHA;GLPVAWEVAAALHAP;LPVAWEVAAALHAPL;PVAWEVAAALHAPLD;VAWEVAAALHAPLDA;AWEVAAALHAPLDAF;WEVAAALHAPLDAFV;EVAAALHAPLDAFVV;VAAALHAPLDAFVVR;AAALHAPLDAFVVRK;AALHAPLDAFVVRKL;ALHAPLDAFVVRKLG;LHAPLDAFVVRKLGA;HAPLDAFVVRKLGAP;APLDAFVVRKLGAPG;PLDAFVVRKLGAPGH;LDAFVVRKLGAPGHD;DAFVVRKLGAPGHDE;AFVVRKLGAPGHDEF;FVVRKLGAPGHDEFA;VVRKLGAPGHDEFAV;VRKLGAPGHDEFAVG;RKLGAPGHDEFAVGA;KLGAPGHDEFAVGAL;LGAPGHDEFAVGALA;GAPGHDEFAVGALAS;APGHDEFAVGALASG;PGHDEFAVGALASGG;GHDEFAVGALASGGR;HDEFAVGALASGGRV;DEFAVGALASGGRVV;EFAVGALASGGRVVV;FAVGALASGGRVVVN;AVGALASGGRVVVND;VGALASGGRVVVNDD;GALASGGRVVVNDDV;ALASGGRVVVNDDVV;LASGGRVVVNDDVVR;ASGGRVVVNDDVVRG;SGGRVVVNDDVVRGL;GGRVVVNDDVVRGLR;GRVVVNDDVVRGLRI;RVVVNDDVVRGLRIT;VVVNDDVVRGLRITP;VVNDDVVRGLRITPQ;VNDDVVRGLRITPQQ;NDDVVRGLRITPQQL;DDVVRGLRITPQQLR;DVVRGLRITPQQLRD;VVRGLRITPQQLRDI;VRGLRITPQQLRDIA;RGLRITPQQLRDIAE;GLRITPQQLRDIAER;LRITPQQLRDIAERE;RITPQQLRDIAEREG;ITPQQLRDIAEREGR;TPQQLRDIAEREGRE;PQQLRDIAEREGREL;QQLRDIAEREGRELL;QLRDIAEREGRELLR;LRDIAEREGRELLRR;RDIAEREGRELLRRE;DIAEREGRELLRRES;IAEREGRELLRRESA;AEREGRELLRRESAY;EREGRELLRRESAYR;REGRELLRRESAYRG;EGRELLRRESAYRGE;GRELLRRESAYRGER;RELLRRESAYRGERP;ELLRRESAYRGERPP;LLRRESAYRGERPPT;LRRESAYRGERPPTD;RRESAYRGERPPTDI;RESAYRGERPPTDIT;ESAYRGERPPTDITG;SAYRGERPPTDITGK;AYRGERPPTDITGKT;YRGERPPTDITGKTV;RGERPPTDITGKTVI;GERPPTDITGKTVIV;ERPPTDITGKTVIVV;RPPTDITGKTVIVVD;PPTDITGKTVIVVDD;PTDITGKTVIVVDDG;TDITGKTVIVVDDGL;DITGKTVIVVDDGLA;ITGKTVIVVDDGLAT;TGKTVIVVDDGLATG;GKTVIVVDDGLATGA;KTVIVVDDGLATGAS;TVIVVDDGLATGASM;VIVVDDGLATGASMF;IVVDDGLATGASMFA;VVDDGLATGASMFAA;VDDGLATGASMFAAV;DDGLATGASMFAAVQ;DGLATGASMFAAVQA;GLATGASMFAAVQAL;LATGASMFAAVQALR;ATGASMFAAVQALRD;TGASMFAAVQALRDA;GASMFAAVQALRDAQ;ASMFAAVQALRDAQP;SMFAAVQALRDAQPA;MFAAVQALRDAQPAQ;FAAVQALRDAQPAQI;AAVQALRDAQPAQIV;AVQALRDAQPAQIVI;VQALRDAQPAQIVIA;QALRDAQPAQIVIAV;ALRDAQPAQIVIAVP;LRDAQPAQIVIAVPA;RDAQPAQIVIAVPAA;DAQPAQIVIAVPAAP;AQPAQIVIAVPAAPE;QPAQIVIAVPAAPES;PAQIVIAVPAAPEST;AQIVIAVPAAPESTC;QIVIAVPAAPESTCR;IVIAVPAAPESTCRE;VIAVPAAPESTCREF;IAVPAAPESTCREFA;AVPAAPESTCREFAG;VPAAPESTCREFAGL;PAAPESTCREFAGLV;AAPESTCREFAGLVD;APESTCREFAGLVDD;PESTCREFAGLVDDV;ESTCREFAGLVDDVV;STCREFAGLVDDVVC;TCREFAGLVDDVVCA;CREFAGLVDDVVCAT;REFAGLVDDVVCATM;EFAGLVDDVVCATMP;FAGLVDDVVCATMPT;AGLVDDVVCATMPTP;GLVDDVVCATMPTPF;LVDDVVCATMPTPFL;VDDVVCATMPTPFLA;DDVVCATMPTPFLAV;DVVCATMPTPFLAVG;VVCATMPTPFLAVGE;VCATMPTPFLAVGES;CATMPTPFLAVGESF;ATMPTPFLAVGESFW;TMPTPFLAVGESFWD;MPTPFLAVGESFWDF;PTPFLAVGESFWDFR;TPFLAVGESFWDFRQ;PFLAVGESFWDFRQV;FLAVGESFWDFRQVT;LAVGESFWDFRQVTD;AVGESFWDFRQVTDE;VGESFWDFRQVTDEE;GESFWDFRQVTDEEV;ESFWDFRQVTDEEVR;SFWDFRQVTDEEVRR;FWDFRQVTDEEVRRL;WDFRQVTDEEVRRLL;DFRQVTDEEVRRLLA;FRQVTDEEVRRLLAT;RQVTDEEVRRLLATP;QVTDEEVRRLLATPT;VTDEEVRRLLATPTA;TDEEVRRLLATPTAG;DEEVRRLLATPTAGP;EEVRRLLATPTAGPS;EVRRLLATPTAGPSL;VRRLLATPTAGPSLR;RRLLATPTAGPSLRR;RLLATPTAGPSLRRP;LLATPTAGPSLRRPA;LATPTAGPSLRRPAA;ATPTAGPSLR | |

Fig. 30 continued

| | | |
|---|---|---|
| | RPAAS;TPTAGPSLRRPAAST;PTAGPSLRRPAASTA;TAGPSLRRPAASTAA;AGPSLRRPAASTAAD;GPSLRRPAASTAADV;PSLRRPAASTAADVL;SLRRPAASTAADVLR;LRRPAASTAADVLRR;RRPAASTAADVLRRV;RPAASTAADVLRRVA;PAASTAADVLRRVAI;AASTAADVLRRVAID;ASTAADVLRRVAIDA;STAADVLRRVAIDAP;TAADVLRRVAIDAPG;AADVLRRVAIDAPGG;ADVLRRVAIDAPGGV;DVLRRVAIDAPGGVP;VLRRVAIDAPGGVPT;LRRVAIDAPGGVPTH;RRVAIDAPGGVPTHE;RVAIDAPGGVPTHEV;VAIDAPGGVPTHEVL;AIDAPGGVPTHEVLA;IDAPGGVPTHEVLAE;DAPGGVPTHEVLAEL;APGGVPTHEVLAELV;PGGVPTHEVLAELVG;GGVPTHEVLAELVGD;GVPTHEVLAELVGDA;VPTHEVLAELVGDAR;PTHEVLAELVGDARI;THEVLAELVGDARIV;HEVLAELVGDARIVL;EVLAELVGDARIVLI;VLAELVGDARIVLIG;LAELVGDARIVLIGE;AELVGDARIVLIGES;ELVGDARIVLIGESS;LVGDARIVLIGESSH;VGDARIVLIGESSHG;GDARIVLIGESSHGT;DARIVLIGESSHGTH;ARIVLIGESSHGTHE;RIVLIGESSHGTHEF;IVLIGESSHGTHEFY;VLIGESSHGTHEFYQ;LIGESSHGTHEFYQA;IGESSHGTHEFYQAR;GESSHGTHEFYQARA;ESSHGTHEFYQARAA;SSHGTHEFYQARAAM;SHGTHEFYQARAAMT;HGTHEFYQARAAMTQ;GTHEFYQARAAMTQW;THEFYQARAAMTQWL;HEFYQARAAMTQWLI;EFYQARAAMTQWLIE;FYQARAAMTQWLIEE;YQARAAMTQWLIEEK;QARAAMTQWLIEEKG;ARAAMTQWLIEEKGF;RAAMTQWLIEEKGFG;AAMTQWLIEEKGFGA;AMTQWLIEEKGFGAV;MTQWLIEEKGFGAVA;TQWLIEEKGFGAVAA;QWLIEEKGFGAVAAE;WLIEEKGFGAVAAEA;LIEEKGFGAVAAEAD;IEEKGFGAVAAEADW;EEKGFGAVAAEADWP;EKGFGAVAAEADWPD;KGFGAVAAEADWPDA;GFGAVAAEADWPDAY;FGAVAAEADWPDAYR;GAVAAEADWPDAYRV;AVAAEADWPDAYRVN;VAAEADWPDAYRVNR;AAEADWPDAYRVNRY;AEADWPDAYRVNRYV;EADWPDAYRVNRYVR;ADWPDAYRVNRYVRG;DWPDAYRVNRYVRGL;WPDAYRVNRYVRGLG;PDAYRVNRYVRGLGE;DAYRVNRYVRGLGED;AYRVNRYVRGLGEDT;YRVNRYVRGLGEDTN;RVNRYVRGLGEDTNA;VNRYVRGLGEDTNAD;NRYVRGLGEDTNADE;RYVRGLGEDTNADEA;YVRGLGEDTNADEAL;VRGLGEDTNADEALS;RGLGEDTNADEALSG;GLGEDTNADEALSGF;LGEDTNADEALSGFE;GEDTNADEALSGFER;EDTNADEALSGFERF;DTNADEALSGFERFP;TNADEALSGFERFPA;NADEALSGFERFPAW;ADEALSGFERFPAWM;DEALSGFERFPAWMW;EALSGFERFPAWMWR;ALSGFERFPAWMWRN;LSGFERFPAWMWRNT;SGFERFPAWMWRNTV;GFERFPAWMWRNTVV;FERFPAWMWRNTVVR;ERFPAWMWRNTVVRD;RFPAWMWRNTVVRDF;FPAWMWRNTVVRDFV;PAWMWRNTVVRDFVE;AWMWRNTVVRDFVEW;WMWRNTVVRDFVEWL;MWRNTVVRDFVEWLR;WRNTVVRDFVEWLRT;RNTVVRDFVEWLRTR;NTVVRDFVEWLRTRN;TVVRDFVEWLRTRNQ;VVRDFVEWLRTRNQR;VRDFVEWLRTRNQRY;RDFVEWLRTRNQRYE;DFVEWLRTRNQRYES;FVEWLRTRNQRYESG;VEWLRTRNQRYESGA;EWLRTRNQRYESGAL;WLRTRNQRYESGALR;LRTRNQRYESGALRQ;RTRNQRYESGALRQA;TRNQRYESGALRQAG;RNQRYESGALRQAGF;NQRYESGALRQAGFY;QRYESGALRQAGFYG;RYESGALRQAGFYGL;YESGALRQAGFYGLD;ESGALRQAGFYGLDL;SGALRQAGFYGLDLY;GALRQAGFYGLDLYS;ALRQAGFYGLDLYSL;LRQAGFYGLDLYSLH;RQAGFYGLDLYSLHR;QAGFYGLDLYSLHRS;AGFYGLDLYSLHRSI;GFYGLDLYSLHRSIQ;FYGLDLYSLHRSIQE;YGLDLYSLHRSIQEV;GLDLYSLHRSIQEVI;LDLYSLHRSIQEVIS;DLYSLHRSIQEVISY;LYSLHRSIQEVISYL;YSLHRSIQEVISYLD;SLHRSIQEVISYLDK;LHRSIQEVISYLDKV;HRSIQEVISYLDKVD;RSIQEVISYLDKVDP;SIQEVISYLDKVDPR;IQEVISYLDKVDPRA;QEVISYLDKVDPRAA;EVISYLDKVDPRAAA;VISYLDKVDPRAAAR;ISYLDKVDPRAAARA;SYLDKVDPRAAARAR;YLDKVDPRAAARARA;LDKVDPRAAARARAR;DKVDPRAAARARARY;KVDPRAAARARARYA;VDPRAAARARARYAC;DPRAAARARARYACF;PRAAARARAR | |

Fig. 30 continued

| | | |
|---|---|---|
| | YACFD;RAAARARARYACFDH;AAARARARYACFDHA;AARARARYACFDHAC;ARARARYACFDHACA;RARARYACFDHACAD;ARARYACFDHACADD;RARYACFDHACADDG;ARYACFDHACADDGQ;RYACFDHACADDGQA;YACFDHACADDGQAY;ACFDHACADDGQAYG;CFDHACADDGQAYGF;FDHACADDGQAYGFA;DHACADDGQAYGFAA;HACADDGQAYGFAAA;ACADDGQAYGFAAAF;CADDGQAYGFAAAFG;ADDGQAYGFAAAFGA;DDGQAYGFAAAFGAG;DGQAYGFAAAFGAGP;GQAYGFAAAFGAGPS;QAYGFAAAFGAGPSC;AYGFAAAFGAGPSCE;YGFAAAFGAGPSCER;GFAAAFGAGPSCERE;FAAAFGAGPSCEREA;AAAFGAGPSCEREAV;AAFGAGPSCEREAVE;AFGAGPSCEREAVEQ;FGAGPSCEREAVEQL;GAGPSCEREAVEQLV;AGPSCEREAVEQLVD;GPSCEREAVEQLVDV;PSCEREAVEQLVDVQ;SCEREAVEQLVDVQR;CEREAVEQLVDVQRN;EREAVEQLVDVQRNA;REAVEQLVDVQRNAL;EAVEQLVDVQRNALA;AVEQLVDVQRNALAY;VEQLVDVQRNALAYA;EQLVDVQRNALAYAR;QLVDVQRNALAYARQ;LVDVQRNALAYARQD;VDVQRNALAYARQDG;DVQRNALAYARQDGL;VQRNALAYARQDGLL;QRNALAYARQDGLLA;RNALAYARQDGLLAE;NALAYARQDGLLAED;ALAYARQDGLLAEDE;LAYARQDGLLAEDEL;AYARQDGLLAEDELF;YARQDGLLAEDELFY;ARQDGLLAEDELFYA;RQDGLLAEDELFYAQ;QDGLLAEDELFYAQQ;DGLLAEDELFYAQQN;GLLAEDELFYAQQNA;LLAEDELFYAQQNAQ;LAEDELFYAQQNAQT;AEDELFYAQQNAQTV;EDELFYAQQNAQTVR;DELFYAQQNAQTVRD;ELFYAQQNAQTVRDA;LFYAQQNAQTVRDAE;FYAQQNAQTVRDAEV;YAQQNAQTVRDAEVY;AQQNAQTVRDAEVYY;QQNAQTVRDAEVYYR;QNAQTVRDAEVYYRA;NAQTVRDAEVYYRAM;AQTVRDAEVYYRAMF;QTVRDAEVYYRAMFS;TVRDAEVYYRAMFSG;VRDAEVYYRAMFSGR;RDAEVYYRAMFSGRV;DAEVYYRAMFSGRVT;AEVYYRAMFSGRVTS;EVYYRAMFSGRVTSW;VYYRAMFSGRVTSWN;YYRAMFSGRVTSWNL;YRAMFSGRVTSWNLR;RAMFSGRVTSWNLRD;AMFSGRVTSWNLRDQ;MFSGRVTSWNLRDQH;FSGRVTSWNLRDQHM;SGRVTSWNLRDQHMA;GRVTSWNLRDQHMAQ;RVTSWNLRDQHMAQT;VTSWNLRDQHMAQTL;TSWNLRDQHMAQTLG;SWNLRDQHMAQTLGS;WNLRDQHMAQTLGSL;NLRDQHMAQTLGSLL;LRDQHMAQTLGSLLT;RDQHMAQTLGSLLTH;DQHMAQTLGSLLTHL;QHMAQTLGSLLTHLD;HMAQTLGSLLTHLDR;MAQTLGSLLTHLDRH;AQTLGSLLTHLDRHL;QTLGSLLTHLDRHLD;TLGSLLTHLDRHLDA;LGSLLTHLDRHLDAP;GSLLTHLDRHLDAPP;SLLTHLDRHLDAPPA;LLTHLDRHLDAPPAR;LTHLDRHLDAPPARI;THLDRHLDAPPARIV;HLDRHLDAPPARIVV;LDRHLDAPPARIVVW;DRHLDAPPARIVVWA;RHLDAPPARIVVWAH;HLDAPPARIVVWAHN;LDAPPARIVVWAHNS;DAPPARIVVWAHNSH;APPARIVVWAHNSHV;PPARIVVWAHNSHVG;PARIVVWAHNSHVGD;ARIVVWAHNSHVGDA;RIVVWAHNSHVGDAR;IVVWAHNSHVGDARA;VVWAHNSHVGDARAT;VWAHNSHVGDARATE;WAHNSHVGDARATEV;AHNSHVGDARATEVW;HNSHVGDARATEVWA;NSHVGDARATEVWAD;SHVGDARATEVWADG;HVGDARATEVWADGQ;VGDARATEVWADGQL;GDARATEVWADGQLT;DARATEVWADGQLTL;ARATEVWADGQLTLG;RATEVWADGQLTLGQ;ATEVWADGQLTLGQI;TEVWADGQLTLGQIV;EVWADGQLTLGQIVR;VWADGQLTLGQIVRE;WADGQLTLGQIVRER;ADGQLTLGQIVRERY;DGQLTLGQIVRERYG;GQLTLGQIVRERYGD;QLTLGQIVRERYGDE;LTLGQIVRERYGDES;TLGQIVRERYGDESR;LGQIVRERYGDESRS;GQIVRERYGDESRSI;QIVRERYGDESRSIG;IVRERYGDESRSIGF;VRERYGDESRSIGFS;RERYGDESRSIGFST;ERYGDESRSIGFSTY;RYGDESRSIGFSTYT;YGDESRSIGFSTYTG;GDESRSIGFSTYTGT;DESRSIGFSTYTGTV;ESRSIGFSTYTGTVT;SRSIGFSTYTGTVTA;RSIGFSTYTGTVTAA;SIGFSTYTGTVTAAS;IGFSTYTGTVTAASE;GFSTYTGTVTAASEW;FSTYTGTVTAASEWG;STYTGTVTAASEWGG;TYTGTVTAASEWGGI;YTGTVTAASEWGGIA;TGTVTAASEWGGIAQ;GTVTAASE | |

Fig. 30 continued

| | | |
|---|---|---|
| | WGGIAQR;TVTAASEWGGIAQRK;VTAASEWGGIAQRKA;TAASEWGGIAQRKAV;AASEWGGIAQRKAVR;ASEWGGIAQRKAVRP;SEWGGIAQRKAVRPA;EWGGIAQRKAVRPAL;WGGIAQRKAVRPALH;GGIAQRKAVRPALHG;GIAQRKAVRPALHGS;IAQRKAVRPALHGSV;AQRKAVRPALHGSVE;QRKAVRPALHGSVEE;RKAVRPALHGSVEEL;KAVRPALHGSVEELF;AVRPALHGSVEELFH;VRPALHGSVEELFHQ;RPALHGSVEELFHQT;PALHGSVEELFHQTA;ALHGSVEELFHQTAD;LHGSVEELFHQTADS;HGSVEELFHQTADSF;GSVEELFHQTADSFL;SVEELFHQTADSFLV;VEELFHQTADSFLVS;EELFHQTADSFLVSA;ELFHQTADSFLVSAR;LFHQTADSFLVSARL;FHQTADSFLVSARLS;HQTADSFLVSARLSR;QTADSFLVSARLSRD;TADSFLVSARLSRDA;ADSFLVSARLSRDAE;DSFLVSARLSRDAEA;SFLVSARLSRDAEAP;FLVSARLSRDAEAPL;LVSARLSRDAEAPLD;VSARLSRDAEAPLDV;SARLSRDAEAPLDVV;ARLSRDAEAPLDVVR;RLSRDAEAPLDVVRL;LSRDAEAPLDVVRLG;SRDAEAPLDVVRLGR;RDAEAPLDVVRLGRA;DAEAPLDVVRLGRAI;AEAPLDVVRLGRAIG;EAPLDVVRLGRAIGV;APLDVVRLGRAIGVV;PLDVVRLGRAIGVVY;LDVVRLGRAIGVVYL;DVVRLGRAIGVVYLP;VVRLGRAIGVVYLPA;VRLGRAIGVVYLPAT;RLGRAIGVVYLPATE;LGRAIGVVYLPATER;GRAIGVVYLPATERQ;RAIGVVYLPATERQS;AIGVVYLPATERQSH;IGVVYLPATERQSHY;GVVYLPATERQSHYL;VVYLPATERQSHYLH;VYLPATERQSHYLHV;YLPATERQSHYLHVR;LPATERQSHYLHVRP;PATERQSHYLHVRPA;ATERQSHYLHVRPAD;TERQSHYLHVRPADQ;ERQSHYLHVRPADQF;RQSHYLHVRPADQFD;QSHYLHVRPADQFDA;SHYLHVRPADQFDAM;HYLHVRPADQFDAMI;YLHVRPADQFDAMIH;LHVRPADQFDAMIHI;HVRPADQFDAMIHID;VRPADQFDAMIHIDQ;RPADQFDAMIHIDQT;PADQFDAMIHIDQTR;ADQFDAMIHIDQTRA;DQFDAMIHIDQTRAL;QFDAMIHIDQTRALE;FDAMIHIDQTRALEP;DAMIHIDQTRALEPL;AMIHIDQTRALEPLE;MIHIDQTRALEPLEV;IHIDQTRALEPLEVT;HIDQTRALEPLEVTS;IDQTRALEPLEVTSR;DQTRALEPLEVTSRW;QTRALEPLEVTSRWI;TRALEPLEVTSRWIA;RALEPLEVTSRWIAG;ALEPLEVTSRWIAGE;LEPLEVTSRWIAGEN;EPLEVTSRWIAGENP;PLEVTSRWIAGENPE;LEVTSRWIAGENPET;EVTSRWIAGENPETY;VTSRWIAGENPETYP;TSRWIAGENPETYPT;SRWIAGENPETYPTG;RWIAGENPETYPTGL;<br>16 mers:<br>MLMTAAADVTRRSPRR;LMTAAADVTRRSPRRV;MTAAADVTRRSPRRVF;TAAADVTRRSPRRVFR;AAADVTRRSPRRVFRD;AADVTRRSPRRVFRDR;ADVTRRSPRRVFRDRR;DVTRRSPRRVFRDRRE;VTRRSPRRVFRDRREA;TRRSPRRVFRDRREAG;RRSPRRVFRDRREAGR;RSPRRVFRDRREAGRV;SPRRVFRDRREAGRVL;PRRVFRDRREAGRVLA;RRVFRDRREAGRVLAE;RVFRDRREAGRVLAEL;VFRDRREAGRVLAELL;FRDRREAGRVLAELLA;RDRREAGRVLAELLAA;DRREAGRVLAELLAAY;RREAGRVLAELLAAYR;REAGRVLAELLAAYRD;EAGRVLAELLAAYRDQ;AGRVLAELLAAYRDQP;GRVLAELLAAYRDQPD;RVLAELLAAYRDQPDV;VLAELLAAYRDQPDVI;LAELLAAYRDQPDVIV;AELLAAYRDQPDVIVL;ELLAAYRDQPDVIVLG;LLAAYRDQPDVIVLGL;LAAYRDQPDVIVLGLA;AAYRDQPDVIVLGLAR;AYRDQPDVIVLGLARG;YRDQPDVIVLGLARGG;RDQPDVIVLGLARGGL;DQPDVIVLGLARGGLP;QPDVIVLGLARGGLPV;PDVIVLGLARGGLPVA;DVIVLGLARGGLPVAW;VIVLGLARGGLPVAWE;IVLGLARGGLPVAWEV;VLGLARGGLPVAWEVA;LGLARGGLPVAWEVAA;GLARGGLPVAWEVAAA;LARGGLPVAWEVAAAL;ARGGLPVAWEVAAALH;RGGLPVAWEVAAALHA;GGLPVAWEVAAALHAP;GLPVAWEVAAALHAPL;LPVAWEVAAALHAPLD;PVAWEVAAALHAPLDA;VAWEVAAALHAPLDAF;AWEVAAALHAPLDAFV;WEVAAALHAPLDAFVV;EVAAALHAPLDAFVVR;VAAALHAPLDAFVVRK;AAALHAPLDAFVVRKL;AALHAPLDAFVVRKLG;ALHAPLDAFVVRKLGA;LHAPLDAFVVRKLGAP;HAPL | |

Fig. 30 continued

| | | |
|---|---|---|
| | DAFVVRKLGAPG;APLDAFVVRKLGAPGH;PLDAFVVRKLGAPGHD;LDAFVVRKLGAPGHDE;DAFVVRKLGAPGHDEF;AFVVRKLGAPGHDEFA;FVVRKLGAPGHDEFAV;VVRKLGAPGHDEFAVG;VRKLGAPGHDEFAVGA;RKLGAPGHDEFAVGAL;KLGAPGHDEFAVGALA;LGAPGHDEFAVGALAS;GAPGHDEFAVGALASG;APGHDEFAVGALASGG;PGHDEFAVGALASGGR;GHDEFAVGALASGGRV;HDEFAVGALASGGRVV;DEFAVGALASGGRVVV;EFAVGALASGGRVVVN;FAVGALASGGRVVVND;AVGALASGGRVVVNDD;VGALASGGRVVVNDDV;GALASGGRVVVNDDVV;ALASGGRVVVNDDVVR;LASGGRVVVNDDVVRG;ASGGRVVVNDDVVRGL;SGGRVVVNDDVVRGLR;GGRVVVNDDVVRGLRI;GRVVVNDDVVRGLRIT;RVVVNDDVVRGLRITP;VVVNDDVVRGLRITPQ;VVNDDVVRGLRITPQQ;VNDDVVRGLRITPQQL;NDDVVRGLRITPQQLR;DDVVRGLRITPQQLRD;DVVRGLRITPQQLRDI;VVRGLRITPQQLRDIA;VRGLRITPQQLRDIAE;RGLRITPQQLRDIAER;GLRITPQQLRDIAERE;LRITPQQLRDIAEREG;RITPQQLRDIAEREGR;ITPQQLRDIAEREGRE;TPQQLRDIAEREGREL;PQQLRDIAEREGRELL;QQLRDIAEREGRELLR;QLRDIAEREGRELLRR;LRDIAEREGRELLRRE;RDIAEREGRELLRRES;DIAEREGRELLRRESA;IAEREGRELLRRESAY;AEREGRELLRRESAYR;EREGRELLRRESAYRG;REGRELLRRESAYRGE;EGRELLRRESAYRGER;GRELLRRESAYRGERP;RELLRRESAYRGERPP;ELLRRESAYRGERPPT;LLRRESAYRGERPPTD;LRRESAYRGERPPTDI;RRESAYRGERPPTDIT;RESAYRGERPPTDITG;ESAYRGERPPTDITGK;SAYRGERPPTDITGKT;AYRGERPPTDITGKTV;YRGERPPTDITGKTVI;RGERPPTDITGKTVIV;GERPPTDITGKTVIVV;ERPPTDITGKTVIVVD;RPPTDITGKTVIVVDD;PPTDITGKTVIVVDDG;PTDITGKTVIVVDDGL;TDITGKTVIVVDDGLA;DITGKTVIVVDDGLAT;ITGKTVIVVDDGLATG;TGKTVIVVDDGLATGA;GKTVIVVDDGLATGAS;KTVIVVDDGLATGASM;TVIVVDDGLATGASMF;VIVVDDGLATGASMFA;IVVDDGLATGASMFAA;VVDDGLATGASMFAAV;VDDGLATGASMFAAVQ;DDGLATGASMFAAVQA;DGLATGASMFAAVQAL;GLATGASMFAAVQALR;LATGASMFAAVQALRD;ATGASMFAAVQALRDA;TGASMFAAVQALRDAQ;GASMFAAVQALRDAQP;ASMFAAVQALRDAQPA;SMFAAVQALRDAQPAQ;MFAAVQALRDAQPAQI;FAAVQALRDAQPAQIV;AAVQALRDAQPAQIVI;AVQALRDAQPAQIVIA;VQALRDAQPAQIVIAV;QALRDAQPAQIVIAVP;ALRDAQPAQIVIAVPA;LRDAQPAQIVIAVPAA;RDAQPAQIVIAVPAAP;DAQPAQIVIAVPAAPE;AQPAQIVIAVPAAPES;QPAQIVIAVPAAPEST;PAQIVIAVPAAPESTC;AQIVIAVPAAPESTCR;QIVIAVPAAPESTCRE;IVIAVPAAPESTCREF;VIAVPAAPESTCREFA;IAVPAAPESTCREFAG;AVPAAPESTCREFAGL;VPAAPESTCREFAGLV;PAAPESTCREFAGLVD;AAPESTCREFAGLVDD;APESTCREFAGLVDDV;PESTCREFAGLVDDVV;ESTCREFAGLVDDVVC;STCREFAGLVDDVVCA;TCREFAGLVDDVVCAT;CREFAGLVDDVVCATM;REFAGLVDDVVCATMP;EFAGLVDDVVCATMPT;FAGLVDDVVCATMPTP;AGLVDDVVCATMPTPF;GLVDDVVCATMPTPFL;LVDDVVCATMPTPFLA;VDDVVCATMPTPFLAV;DDVVCATMPTPFLAVG;DVVCATMPTPFLAVGE;VVCATMPTPFLAVGES;VCATMPTPFLAVGESF;CATMPTPFLAVGESFW;ATMPTPFLAVGESFWD;TMPTPFLAVGESFWDF;MPTPFLAVGESFWDFR;PTPFLAVGESFWDFRQ;TPFLAVGESFWDFRQV;PFLAVGESFWDFRQVT;FLAVGESFWDFRQVTD;LAVGESFWDFRQVTDE;AVGESFWDFRQVTDEE;VGESFWDFRQVTDEEV;GESFWDFRQVTDEEVR;ESFWDFRQVTDEEVRR;SFWDFRQVTDEEVRRL;FWDFRQVTDEEVRRLL;WDFRQVTDEEVRRLLA;DFRQVTDEEVRRLLAT;FRQVTDEEVRRLLATP;RQVTDEEVRRLLATPT;QVTDEEVRRLLATPTA;VTDEEVRRLLATPTAG;TDEEVRRLLATPTAGP;DEEVRRLLATPTAGPS;EEVRRLLATPTAGPSL;EVRRLLATPTAGPSLR;VRRLLATPTAGPSLRR;RRLLATPTAGPSLRRP;RLLATPTAGPSLRRPA;LLATPTAGPSLRRPAA;LATPTAGPSLRRPAAS;ATPTAGPSLRRPAAST;TPTAGPSLRRPAASTA;PTAGPSLRR | |

Fig. 30 continued

| | | |
|---|---|---|
| | PAASTAA;TAGPSLRRPAASTAAD;AGPSLRRPAASTAADV;GPSLRRPAASTAADVL;PSLRRPAASTAADVLR;SLRRPAASTAADVLRR;LRRPAASTAADVLRRV;RRPAASTAADVLRRVA;RPAASTAADVLRRVAI;PAASTAADVLRRVAID;AASTAADVLRRVAIDA;ASTAADVLRRVAIDAP;STAADVLRRVAIDAPG;TAADVLRRVAIDAPGG;AADVLRRVAIDAPGGV;ADVLRRVAIDAPGGVP;DVLRRVAIDAPGGVPT;VLRRVAIDAPGGVPTH;LRRVAIDAPGGVPTHE;RRVAIDAPGGVPTHEV;RVAIDAPGGVPTHEVL;VAIDAPGGVPTHEVLA;AIDAPGGVPTHEVLAE;IDAPGGVPTHEVLAEL;DAPGGVPTHEVLAELV;APGGVPTHEVLAELVG;PGGVPTHEVLAELVGD;GGVPTHEVLAELVGDA;GVPTHEVLAELVGDAR;VPTHEVLAELVGDARI;PTHEVLAELVGDARIV;THEVLAELVGDARIVL;HEVLAELVGDARIVLI;EVLAELVGDARIVLIG;VLAELVGDARIVLIGE;LAELVGDARIVLIGES;AELVGDARIVLIGESS;ELVGDARIVLIGESSH;LVGDARIVLIGESSHG;VGDARIVLIGESSHGT;GDARIVLIGESSHGTH;DARIVLIGESSHGTHE;ARIVLIGESSHGTHEF;RIVLIGESSHGTHEFY;IVLIGESSHGTHEFYQ;VLIGESSHGTHEFYQA;LIGESSHGTHEFYQAR;IGESSHGTHEFYQARA;GESSHGTHEFYQARAA;ESSHGTHEFYQARAAM;SSHGTHEFYQARAAMT;SHGTHEFYQARAAMTQ;HGTHEFYQARAAMTQW;GTHEFYQARAAMTQWL;THEFYQARAAMTQWLI;HEFYQARAAMTQWLIE;EFYQARAAMTQWLIEE;FYQARAAMTQWLIEEK;YQARAAMTQWLIEEKG;QARAAMTQWLIEEKGF;ARAAMTQWLIEEKGFG;RAAMTQWLIEEKGFGA;AAMTQWLIEEKGFGAV;AMTQWLIEEKGFGAVA;MTQWLIEEKGFGAVAA;TQWLIEEKGFGAVAAE;QWLIEEKGFGAVAAEA;WLIEEKGFGAVAAEAD;LIEEKGFGAVAAEADW;IEEKGFGAVAAEADWP;EEKGFGAVAAEADWPD;EKGFGAVAAEADWPDA;KGFGAVAAEADWPDAY;GFGAVAAEADWPDAYR;FGAVAAEADWPDAYRV;GAVAAEADWPDAYRVN;AVAAEADWPDAYRVNR;VAAEADWPDAYRVNRY;AAEADWPDAYRVNRYV;AEADWPDAYRVNRYVR;EADWPDAYRVNRYVRG;ADWPDAYRVNRYVRGL;DWPDAYRVNRYVRGLG;WPDAYRVNRYVRGLGE;PDAYRVNRYVRGLGED;DAYRVNRYVRGLGEDT;AYRVNRYVRGLGEDTN;YRVNRYVRGLGEDTNA;RVNRYVRGLGEDTNAD;VNRYVRGLGEDTNADE;NRYVRGLGEDTNADEA;RYVRGLGEDTNADEAL;YVRGLGEDTNADEALS;VRGLGEDTNADEALSG;RGLGEDTNADEALSGF;GLGEDTNADEALSGFE;LGEDTNADEALSGFER;GEDTNADEALSGFERF;EDTNADEALSGFERFP;DTNADEALSGFERFPA;TNADEALSGFERFPAW;NADEALSGFERFPAWM;ADEALSGFERFPAWMW;DEALSGFERFPAWMWR;EALSGFERFPAWMWRN;ALSGFERFPAWMWRNT;LSGFERFPAWMWRNTV;SGFERFPAWMWRNTVV;GFERFPAWMWRNTVVR;FERFPAWMWRNTVVRD;ERFPAWMWRNTVVRDF;RFPAWMWRNTVVRDFV;FPAWMWRNTVVRDFVE;PAWMWRNTVVRDFVEW;AWMWRNTVVRDFVEWL;WMWRNTVVRDFVEWLR;MWRNTVVRDFVEWLRT;WRNTVVRDFVEWLRTR;RNTVVRDFVEWLRTRN;NTVVRDFVEWLRTRNQ;TVVRDFVEWLRTRNQR;VVRDFVEWLRTRNQRY;VRDFVEWLRTRNQRYE;RDFVEWLRTRNQRYES;DFVEWLRTRNQRYESG;FVEWLRTRNQRYESGA;VEWLRTRNQRYESGAL;EWLRTRNQRYESGALR;WLRTRNQRYESGALRQ;LRTRNQRYESGALRQA;RTRNQRYESGALRQAG;TRNQRYESGALRQAGF;RNQRYESGALRQAGFY;NQRYESGALRQAGFYG;QRYESGALRQAGFYGL;RYESGALRQAGFYGLD;YESGALRQAGFYGLDL;ESGALRQAGFYGLDLY;SGALRQAGFYGLDLYS;GALRQAGFYGLDLYSL;ALRQAGFYGLDLYSLH;LRQAGFYGLDLYSLHR;RQAGFYGLDLYSLHRS;QAGFYGLDLYSLHRSI;AGFYGLDLYSLHRSIQ;GFYGLDLYSLHRSIQE;FYGLDLYSLHRSIQEV;YGLDLYSLHRSIQEVI;GLDLYSLHRSIQEVIS;LDLYSLHRSIQEVISY;DLYSLHRSIQEVISYL;LYSLHRSIQEVISYLD;YSLHRSIQEVISYLDK;SLHRSIQEVISYLDKV;LHRSIQEVISYLDKVD;HRSIQEVISYLDKVDP;RSIQEVISYLDKVDPR;SIQEVISYLDKVDPRA;IQEVISYLDKVDPRAA;QEVISYLDKVDPRAAA;EVISYLDKVDPRAAAR;VISYLDKVDPRAAAR | |

Fig. 30 continued

| | | |
|---|---|---|
| | A;ISYLDKVDPRAAARAR;SYLDKVDPRAAARARA;YLDKVDPRAAARARAR;LDKVDPRAAARARARY;DKVDPRAAARARARYA;KVDPRAAARARARYAC;VDPRAAARARARYACF;DPRAAARARARYACFD;PRAAARARARYACFDH;RAAARARARYACFDHA;AAARARARYACFDHAC;AARARARYACFDHACA;ARARARYACFDHACAD;RARARYACFDHACADD;ARARYACFDHACADDG;RARYACFDHACADDGQ;ARYACFDHACADDGQA;RYACFDHACADDGQAY;YACFDHACADDGQAYG;ACFDHACADDGQAYGF;CFDHACADDGQAYGFA;FDHACADDGQAYGFAA;DHACADDGQAYGFAAA;HACADDGQAYGFAAAF;ACADDGQAYGFAAAFG;CADDGQAYGFAAAFGA;ADDGQAYGFAAAFGAG;DDGQAYGFAAAFGAGP;DGQAYGFAAAFGAGPS;GQAYGFAAAFGAGPSC;QAYGFAAAFGAGPSCE;AYGFAAAFGAGPSCER;YGFAAAFGAGPSCERE;GFAAAFGAGPSCEREA;FAAAFGAGPSCEREAV;AAAFGAGPSCEREAVE;AAFGAGPSCEREAVEQ;AFGAGPSCEREAVEQL;FGAGPSCEREAVEQLV;GAGPSCEREAVEQLVD;AGPSCEREAVEQLVDV;GPSCEREAVEQLVDVQ;PSCEREAVEQLVDVQR;SCEREAVEQLVDVQRN;CEREAVEQLVDVQRNA;EREAVEQLVDVQRNAL;REAVEQLVDVQRNALA;EAVEQLVDVQRNALAY;AVEQLVDVQRNALAYA;VEQLVDVQRNALAYAR;EQLVDVQRNALAYARQ;QLVDVQRNALAYARQD;LVDVQRNALAYARQDG;VDVQRNALAYARQDGL;DVQRNALAYARQDGLL;VQRNALAYARQDGLLA;QRNALAYARQDGLLAE;RNALAYARQDGLLAED;NALAYARQDGLLAEDE;ALAYARQDGLLAEDEL;LAYARQDGLLAEDELF;AYARQDGLLAEDELFY;YARQDGLLAEDELFYA;ARQDGLLAEDELFYAQ;RQDGLLAEDELFYAQQ;QDGLLAEDELFYAQQN;DGLLAEDELFYAQQNA;GLLAEDELFYAQQNAQ;LLAEDELFYAQQNAQT;LAEDELFYAQQNAQTV;AEDELFYAQQNAQTVR;EDELFYAQQNAQTVRD;DELFYAQQNAQTVRDA;ELFYAQQNAQTVRDAE;LFYAQQNAQTVRDAEV;FYAQQNAQTVRDAEVY;YAQQNAQTVRDAEVYY;AQQNAQTVRDAEVYYR;QQNAQTVRDAEVYYRA;QNAQTVRDAEVYYRAM;NAQTVRDAEVYYRAMF;AQTVRDAEVYYRAMFS;QTVRDAEVYYRAMFSG;TVRDAEVYYRAMFSGR;VRDAEVYYRAMFSGRV;RDAEVYYRAMFSGRVT;DAEVYYRAMFSGRVTS;AEVYYRAMFSGRVTSW;EVYYRAMFSGRVTSWN;VYYRAMFSGRVTSWNL;YYRAMFSGRVTSWNLR;YRAMFSGRVTSWNLRD;RAMFSGRVTSWNLRDQ;AMFSGRVTSWNLRDQH;MFSGRVTSWNLRDQHM;FSGRVTSWNLRDQHMA;SGRVTSWNLRDQHMAQ;GRVTSWNLRDQHMAQT;RVTSWNLRDQHMAQTL;VTSWNLRDQHMAQTLG;TSWNLRDQHMAQTLGS;SWNLRDQHMAQTLGSL;WNLRDQHMAQTLGSLL;NLRDQHMAQTLGSLLT;LRDQHMAQTLGSLLTH;RDQHMAQTLGSLLTHL;DQHMAQTLGSLLTHLD;QHMAQTLGSLLTHLDR;HMAQTLGSLLTHLDRH;MAQTLGSLLTHLDRHL;AQTLGSLLTHLDRHLD;QTLGSLLTHLDRHLDA;TLGSLLTHLDRHLDAP;LGSLLTHLDRHLDAPP;GSLLTHLDRHLDAPPA;SLLTHLDRHLDAPPAR;LLTHLDRHLDAPPARI;LTHLDRHLDAPPARIV;THLDRHLDAPPARIVV;HLDRHLDAPPARIVVW;LDRHLDAPPARIVVWA;DRHLDAPPARIVVWAH;RHLDAPPARIVVWAHN;HLDAPPARIVVWAHNS;LDAPPARIVVWAHNSH;DAPPARIVVWAHNSHV;APPARIVVWAHNSHVG;PPARIVVWAHNSHVGD;PARIVVWAHNSHVGDA;ARIVVWAHNSHVGDAR;RIVVWAHNSHVGDARA;IVVWAHNSHVGDARAT;VVWAHNSHVGDARATE;VWAHNSHVGDARATEV;WAHNSHVGDARATEVW;AHNSHVGDARATEVWA;HNSHVGDARATEVWAD;NSHVGDARATEVWADG;SHVGDARATEVWADGQ;HVGDARATEVWADGQL;VGDARATEVWADGQLT;GDARATEVWADGQLTL;DARATEVWADGQLTLG;ARATEVWADGQLTLGQ;RATEVWADGQLTLGQI;ATEVWADGQLTLGQIV;TEVWADGQLTLGQIVR;EVWADGQLTLGQIVRE;VWADGQLTLGQIVRER;WADGQLTLGQIVRERY;ADGQLTLGQIVRERYG;DGQLTLGQIVRERYGD;GQLTLGQIVRERYGDE;QLTLGQIVRERYGDES;LTLGQIVRERYGDESR;TLGQIVRERYGDESRS;LGQIVRERYGDESRSI;GQIVRERYGDESRSIG;QIVRERYGDESRSIGF; | |

Fig. 30 continued

| | | |
|---|---|---|
| | IVRERYGDESRSIGFS;VRERYGDESRSIGFST;RERYGDESRSIGFSTY;ERYGDESRSIGFSTYT;RYGDESRSIGFSTYTG;YGDESRSIGFSTYTGT;GDESRSIGFSTYTGTV;DESRSIGFSTYTGTVT;ESRSIGFSTYTGTVTA;SRSIGFSTYTGTVTAA;RSIGFSTYTGTVTAAS;SIGFSTYTGTVTAASE;IGFSTYTGTVTAASEW;GFSTYTGTVTAASEWG;FSTYTGTVTAASEWGG;STYTGTVTAASEWGGI;TYTGTVTAASEWGGIA;YTGTVTAASEWGGIAQ;TGTVTAASEWGGIAQR;GTVTAASEWGGIAQRK;TVTAASEWGGIAQRKA;VTAASEWGGIAQRKAV;TAASEWGGIAQRKAVR;AASEWGGIAQRKAVRP;ASEWGGIAQRKAVRPA;SEWGGIAQRKAVRPAL;EWGGIAQRKAVRPALH;WGGIAQRKAVRPALHG;GGIAQRKAVRPALHGS;GIAQRKAVRPALHGSV;IAQRKAVRPALHGSVE;AQRKAVRPALHGSVEE;QRKAVRPALHGSVEEL;RKAVRPALHGSVEELF;KAVRPALHGSVEELFH;AVRPALHGSVEELFHQ;VRPALHGSVEELFHQT;RPALHGSVEELFHQTA;PALHGSVEELFHQTAD;ALHGSVEELFHQTADS;LHGSVEELFHQTADSF;HGSVEELFHQTADSFL;GSVEELFHQTADSFLV;SVEELFHQTADSFLVS;VEELFHQTADSFLVSA;EELFHQTADSFLVSAR;ELFHQTADSFLVSARL;LFHQTADSFLVSARLS;FHQTADSFLVSARLSR;HQTADSFLVSARLSRD;QTADSFLVSARLSRDA;TADSFLVSARLSRDAE;ADSFLVSARLSRDAEA;DSFLVSARLSRDAEAP;SFLVSARLSRDAEAPL;FLVSARLSRDAEAPLD;LVSARLSRDAEAPLDV;VSARLSRDAEAPLDVV;SARLSRDAEAPLDVVR;ARLSRDAEAPLDVVRL;RLSRDAEAPLDVVRLG;LSRDAEAPLDVVRLGR;SRDAEAPLDVVRLGRA;RDAEAPLDVVRLGRAI;DAEAPLDVVRLGRAIG;AEAPLDVVRLGRAIGV;EAPLDVVRLGRAIGVV;APLDVVRLGRAIGVVY;PLDVVRLGRAIGVVYL;LDVVRLGRAIGVVYLP;DVVRLGRAIGVVYLPA;VVRLGRAIGVVYLPAT;VRLGRAIGVVYLPATE;RLGRAIGVVYLPATER;LGRAIGVVYLPATERQ;GRAIGVVYLPATERQS;RAIGVVYLPATERQSH;AIGVVYLPATERQSHY;IGVVYLPATERQSHYL;GVVYLPATERQSHYLH;VVYLPATERQSHYLHV;VYLPATERQSHYLHVR;YLPATERQSHYLHVRP;LPATERQSHYLHVRPA;PATERQSHYLHVRPAD;ATERQSHYLHVRPADQ;TERQSHYLHVRPADQF;ERQSHYLHVRPADQFD;RQSHYLHVRPADQFDA;QSHYLHVRPADQFDAM;SHYLHVRPADQFDAMI;HYLHVRPADQFDAMIH;YLHVRPADQFDAMIHI;LHVRPADQFDAMIHID;HVRPADQFDAMIHIDQ;VRPADQFDAMIHIDQT;RPADQFDAMIHIDQTR;PADQFDAMIHIDQTRA;ADQFDAMIHIDQTRAL;DQFDAMIHIDQTRALE;QFDAMIHIDQTRALEP;FDAMIHIDQTRALEPL;DAMIHIDQTRALEPLE;AMIHIDQTRALEPLEV;MIHIDQTRALEPLEVT;IHIDQTRALEPLEVTS;HIDQTRALEPLEVTSR;IDQTRALEPLEVTSRW;DQTRALEPLEVTSRWI;QTRALEPLEVTSRWIA;TRALEPLEVTSRWIAG;RALEPLEVTSRWIAGE;ALEPLEVTSRWIAGEN;LEPLEVTSRWIAGENP;EPLEVTSRWIAGENPE;PLEVTSRWIAGENPET;LEVTSRWIAGENPETY;EVTSRWIAGENPETYP;VTSRWIAGENPETYPT;TSRWIAGENPETYPTG;SRWIAGENPETYPTGL | |
| 34 | **<NP_217648.1 two component sensor histidine kinase DEVS Rv3132c;Mycobacterium tuberculosis H37Rv>** MTTGGLVDENDGAAMRPLRHTLSQLRLHELLVEVQDRVEQIVEGRDRLDGLVEAMLVVTAGLDLEATLRAIVHSATSLVDARYGAMEVHDRQHRVLHFVYEGIDEETVRRIGHLPKGLGVIGLLIEDPKPLRLDDVSAHPASIGFPPYHPPMRTFLGVPVRVRDESFGTLYLTDKTNGQPFSDDDEVLVQALAAAAGIAVANARLYQQAKARQSWIEATRDIATELLSGTEPATVFRLVAAEALKLTAADAALVAVPVDEDMPAADVGELLVIETVGSAVASIVGRTIPVAGAVLREVFVNGIPRRVDRVDLEGLDELADAGPALLLPLRARGTVAGVVVVLSQGGPGAFTDEQLEMMAAFADQAALAWQLATSQRRMRELDVLTDRDRIARDLHDHVIQRLFAIGLALQGAVPHERNPEVQQRLSDVVDDLQDVIQEIRTTIYDLHGASQGITRLRQRIDAAVAQFADSGLRTSVQFVGPLSVVDSALADQAEAVVREAVSNAVRHAKASTLTVRVKVDDDLCIEVTDNGRGLPDEFTGSGLTNLRQRAEQAGGEFTLASVPGASGTVLRWSAPLSQ | 172631-175640 |

Fig. 30 continued

8mer
LVDENDGA;DENDGAAM;ENDGAAMR;DGAAMRPL;GAAMRPLR;RPLRHTLS;HTLSQLRL;SQLRLHEL;QLRLHELL;LLVEVQDR;LVEVQDRV;VQDRVEQI;QIVEGRDR;RLDGLVEA;GLVEAMLV;LVEAMLVV;EAMLVVTA;MLVVTAGL;GLDLEATL;EATLRAIV;IVHSATSL;ATSLVDAR;SLVDARYG;LVDARYGA;ARYGAMEV;GAMEVHDR;EVHDRQHR;RQHRVLHF;HRVLHFVY;EGIDEETV;ETVRRIGH;TVRRIGHL;RRIGHLPK;HLPKGLGV;LPKGLGVI;GLGVIGLL;GLLIEDPK;LIEDPKPL;RLDDVSAH;AHPASIGF;ASIGFPPY;FPPYHPPM;YHPPMRTF;HPPMRTFL;PMRTFLGV;RTFLGVPV;TFLGVPVR;FLGVPVRV;DESFGTLY;ESFGTLYL;GTLYLTDK;YLTDKTNG;FSDDDEVL;SDDDEVLV;DEVLVQAL;EVLVQALA;VLVQALAA;LVQALAAA;VQALAAAA;ALAAAAGI;AAAAGIAV;GIAVANAR;AVANARLY;ARLYQQAK;RLYQQAKA;LYQQAKAR;QAKARQSW;RQSWIEAT;QSWIEATR;TRDIATEL;LLSGTEPA;SGTEPATV;TEPATVFR;EPATVFRL;TVFRLVAA;RLVAAEAL;LVAAEALK;AEALKLTA;EALKLTAA;KLTAADAA;LTAADAAL;TAADAALV;ADAALVAV;AALVAVPV;PVDEDMPA;ELLVIETV;ETVGSAVA;AVASIVGR;IVGRTIPV;RTIPVAGA;TIPVAGAV;IPVAGAVL;PVAGAVLR;AVLREVFV;REVFVNGI;VFVNGIPR;FVNGIPRR;IPRRVDRV;RRVDRVDL;DLEGLDEL;GLDELADA;ELADAGPA;LADAGPAL;GPALLLPL;ALLLPLRA;LLLPLRAR;LPLRARGT;PLRARGTV;GTVAGVVV;TVAGVVVV;SQGGPGAF;FTDEQLEM;EQLEMMAA;QLEMMAAF;MMAAFADQ;MAAFADQA;FADQAALA;QAALAWQL;AALAWQLA;ALAWQLAT;LAWQLATS;WQLATSQR;QLATSQRR;ATSQRRMR;SQRRMREL;RRMRELDV;RMRELDVL;DVLTDRDR;VLTDRDRI;DLHDHVIQ;HVIQRLFA;VIQRLFAI;QRLFAIGL;RLFAIGLA;GLALQGAV;VVDDLQDV;LQDVIQEI;IQEIRTTI;QEIRTTIY;TIYDLHGA;SQGITRLR;GITRLRQR;ITRLRQRI;RLRQRIDA;RQRIDAAV;DAAVAQFA;AQFADSGL;QFADSGLR;GLRTSVQF;SVQFVGPL;QFVGPLSV;FVGPLSVV;PLSVVDSA;SVVDSALA;ALADQAEA;LADQAEAV;DQAEAVVR;AEAVVREA;EAVVREAV;REAVSNAV;EAVSNAVR;RHAKASTL;AKASTLTV;KASTLTVR;STLTVRVK;TLTVRVKV;KVDDDLCI;GLPDEFTG;LPDEFTGS;DEFTGSGL;TGSGLTNL;GSGLTNLR;GLTNLRQR;AEQAGGEF;GEFTLASV;TLASVPGA;VPGASGTV;GASGTVLR;ASGTVLRW;GTVLRWSA;VLRWSAPL
9mer
GLVDENDGA;DENDGAAMR;DGAAMRPLR;AMRPLRHTL;RPLRHTLSQ;PLRHTLSQL;SQLRLHELL;QLRLHELLV;RLHELLVEV;LLVEVQDRV;EVQDRVEQI;VQDRVEQIV;RVEQIVEGR;QIVEGRDRL;RLDGLVEAM;GLVEAMLVV;AMLVVTAGL;TLRAIVHSA;AIVHSATSL;IVHSATSLV;SATSLVDAR;ATSLVDARY;SLVDARYGA;LVDARYGAM;MEVHDRQHR;EVHDRQHRV;VHDRQHRVL;RQHRVLHFV;QHRVLHFVY;VLHFVYEGI;FVYEGIDEE;EGIDEETVR;ETVRRIGHL;VRRIGHLPK;RIGHLPKGL;HLPKGLGVI;LPKGLGVIG;GLGVIGLLI;LLIEDPKPL;LIEDPKPLR;IEDPKPLRL;RLDDVSAHP;DVSAHPASI;SAHPASIGF;HPASIGFPP;PASIGFPPY;ASIGFPPYH;FPPYHPPMR;PYHPPMRTF;YHPPMRTFL;PPMRTFLGV;MRTFLGVPV;RTFLGVPVR;TFLGVPVRV;VPVRVRDES;RVRDESFGT;VRDESFGTL;DESFGTLYL;ESFGTLYLT;YLTDKTNGQ;FSDDDEVLV;EVLVQALAA;VLVQALAAA;QALAAAAGI;ALAAAAGIA;LAAAAGIAV;AAAAGIAVA;GIAVANARL;IAVANARLY;NARLYQQAK;RLYQQAKAR;QQAKARQSW;KARQSWIEA;RQSWIEATR;SWIEATRDI;ATRDIATEL;TRDIATELL;ELLSGTEPA;LLSGTEPAT;GTEPATVFR;EPATVFRLV;ATVFRLVAA;FRLVAAEAL;RLVAAEALK;LVAAEALKL;AEALKLTAA;KLTAADAAL;LTAADAALV;TAADAALVA;AADAALVAV;DAALVAVPV;VAVPVDEDM;VPVDEDMPA;PVDEDMPAA;MPAADVGEL;AADVGELLV;GELLVIETV;LLVIETVGS;LVIETVGSA;VIETVGSAV;ETVGSAVAS;TVGSAVASI;SAVASIVGR;AVASIVGRT;SIVGRTIPV;RTIPVAGAV;TIPVAGAVL;IPVAGAVLR;VAGAVLREV;GAVL

Fig. 30 continued

| | | |
|---|---|---|
| | REVFV;EVFVNGIPR;VFVNGIPRR;FVNGIPRRV;GIPRRVDRV;DLEGLDELA;ELADAGPAL;LADAGPALL;ALLLPLRAR;LLLPLRARG;LPLRARGTV;RARGTVAGV;GTVAGVVVV;TVAGVVVVL;VLSQGGPGA;LSQGGPGAF;FTDEQLEMM;EQLEMMAAF;QLEMMAAFA;MMAAFADQA;MAAFADQAA;AAFADQAAL;FADQAALAW;QAALAWQLA;AALAWQLAT;ALAWQLATS;AWQLATSQR;LATSQRRMR;RRMRELDVL;RMRELDVLT;VLTDRDRIA;LTDRDRIAR;IARDLHDHV;DLHDHVIQR;LHDHVIQRL;HVIQRLFAI;IQRLFAIGL;RLFAIGLAL;AIGLALQGA;LALQGAVPH;LQGAVPHER;EVQQRLSDV;VQQRLSDVV;RLSDVVDDL;DVVDDLQDV;VVDDLQDVI;DLQDVIQEI;VIQEIRTTI;IQEIRTTIY;EIRTTIYDL;TTIYDLHGA;DLHGASQGI;GASQGITRL;ASQGITRLR;GITRLRQRI;RLRQRIDAA;AQFADSGLR;GLRTSVQFV;TSVQFVGPL;VQFVGPLSV;GPLSVVDSA;PLSVVDSAL;ALADQAEAV;LADQAEAVV;AEAVVREAV;VVREAVSNA;VSNAVRHAK;AVRHAKAST;HAKASTLTV;KASTLTVRV;ASTLTVRVK;STLTVRVKV;VDDDLCIEV;CIEVTDNGR;EVTDNGRGL;GLPDEFTGS;FTGSGLTNL;TGSGLTNLR;GLTNLRQRA;NLRQRAEQA;RAEQAGGEF;AEQAGGEFT;EQAGGEFTL;FTLASVPGA;SVPGASGTV;VPGASGTVL;GASGTVLRW;TVLRWSAPL;LRWSAPLSQ<br>10mer<br>GLVDENDGAA;LVDENDGAAM;AAMRPLRHTL;AMRPLRHTLS;RPLRHTLSQL;TLSQLRLHEL;SQLRLHELLV;RLHELLVEVQ;ELLVEVQDRV;VEVQDRVEQI;EVQDRVEQIV;RLDGLVEAML;GLVEAMLVVT;EAMLVVTAGL;MLVVTAGLDL;VVTAGLDLEA;TAGLDLEATL;GLDLEATLRA;DLEATLRAIV;ATLRAIVHSA;TLRAIVHSAT;RAIVHSATSL;AIVHSATSLV;HSATSLVDAR;SATSLVDARY;SLVDARYGAM;RYGAMEVHDR;AMEVHDRQHR;MEVHDRQHRV;EVHDRQHRVL;RQHRVLHFVY;RVLHFVYEGI;FVYEGIDEET;EGIDEETVRR;GIDEETVRRI;TVRRIGHLPK;RRIGHLPKGL;LPKGLGVIGL;VIGLLIEDPK;GLLIEDPKPL;LLIEDPKPLR;LIEDPKPLRL;KPLRLDDVSA;RLDDVSAHPA;VSAHPASIGF;HPASIGFPPY;FPPYHPPMRT;PYHPPMRTFL;HPPMRTFLGV;PMRTFLGVPV;MRTFLGVPVR;RTFLGVPVRV;TFLGVPVRVR;VPVRVRDESF;RVRDESFGTL;YLTDKTNGQP;LTDKTNGQPF;GQPFSDDDEV;QPFSDDDEVL;PFSDDDEVLV;EVLVQALAAA;VLVQALAAAA;VQALAAAAGI;ALAAAAGIAV;LAAAAGIAVA;AAAGIAVANA;AAGIAVANAR;GIAVANARLY;RLYQQAKARQ;YQQAKARQSW;QQAKARQSWI;ARQSWIEATR;EATRDIATEL;ATRDIATELL;ELLSGTEPAT;LLSGTEPATV;LSGTEPATVF;SGTEPATVFR;EPATVFRLVA;TVFRLVAAEA;FRLVAAEALK;RLVAAEALKL;EALKLTAADA;ALKLTAADAA;KLTAADAALV;TAADAALVAV;VPVDEDMPAA;DMPAADVGEL;MPAADVGELL;PAADVGELLV;LLVIETVGSA;LVIETVGSAV;ETVGSAVASI;TVGSAVASIV;GSAVASIVGR;AVASIVGRTI;ASIVGRTIPV;SIVGRTIPVA;RTIPVAGAVL;TIPVAGAVLR;PVAGAVLREV;VAGAVLREVF;VLREVFVNGI;REVFVNGIPR;EVFVNGIPRR;VNGIPRRVDR;NGIPRRVDRV;IPRRVDRVDL;RVDRVDLEGL;RVDLEGLDEL;DELADAGPAL;ELADAGPALL;LADAGPALLL;DAGPALLLPL;GPALLLPLRA;LLLPLRARGT;LLPLRARGTV;LPLRARGTVA;LRARGTVAGV;RARGTVAGVV;TVAGVVVVLS;VLSQGGPGAF;FTDEQLEMMA;DEQLEMMAAF;EQLEMMAAFA;EMMAAFADQA;MMAAFADQAA;MAAFADQAAL;AFADQAALAW;ALAWQLATSQ;LAWQLATSQR;AWQLATSQRR;WQLATSQRRM;QLATSQRRMR;VLTDRDRIAR;RIARDLHDHV;DLHDHVIQRL;VIQRLFAIGL;QRLFAIGLAL;RLFAIGLALQ;FAIGLALQGA;AIGLALQGAV;ALQGAVPHER;AVPHERNPEV;EVQQRLSDVV;RLSDVVDDLQ;DVVDDLQDVI;DLQDVIQEIR;DVIQEIRTTI;VIQEIRTTIY;QEIRTTIYDL;TTIYDLHGAS;TIYDLHGASQ;GASQGITRLR;SQGITRLRQR;RLRQRIDAAV;QRIDAAVAQF;RIDAAVAQFA;AVAQFADSGL;VAQFADSGLR;AQFADSGLRT;FADSGLRTSV;SGLRTSVQFV;RTSVQFVGPL;SVQFVGPLSV;VQFVGPLSVV;GPLSVVDSAL;PLSVVDSALA;DSALADQAEA;SALADQAEAV;ALADQAEAVV;QAEAVVREAV;AE | |

Fig. 30 continued

| | | |
|---|---|---|
| | AVVREAVS;VVREAVSNAV;AVSNAVRHAK;AVRHAKASTL;HAKASTLTVR;KASTLTVRVK;KVDDDLCIEV;IEVTDNGRGL;LPDEFTGSGL;FTGSGLTNLR;AEQAGGEFTL;EQAGGEFTLA;AGGEFTLASV;ASVPGASGTV;SVPGASGTVL;GTVLRWSAPL<br>11mer<br>GLVDENDGAAM;LVDENDGAAMR;DENDGAAMRPL;ENDGAAMRPLR;GAAMRPLRHTL;AMRPLRHTLSQ;RPLRHTLSQLR;PLRHTLSQLRL;HTLSQLRLHEL;TLSQLRLHELL;QLRLHELLVEV;LLVEVQDRVEQ;VEVQDRVEQIV;RLDGLVEAMLV;GLVEAMLVVTA;VEAMLVVTAGL;AMLVVTAGLDL;VTAGLDLEATL;TAGLDLEATLR;GLDLEATLRAI;EATLRAIVHSA;TLRAIVHSATS;LRAIVHSATSL;RAIVHSATSLV;HSATSLVDARY;ATSLVDARYGA;SLVDARYGAME;LVDARYGAMEV;GAMEVHDRQHR;AMEVHDRQHRV;MEVHDRQHRVL;RQHRVLHFVYE;HRVLHFVYEGI;FVYEGIDEETV;ETVRRIGHLPK;RIGHLPKGLGV;HLPKGLGVIGL;LPKGLGVIGLL;GVIGLLIEDPK;LLIEDPKPLRL;KPLRLDDVSAH;RLDDVSAHPAS;DVSAHPASIGF;HPASIGFPPYH;IGFPPYHPPMR;FPPYHPPMRTF;PPYHPPMRTFL;YHPPMRTFLGV;PPMRTFLGVPV;PMRTFLGVPVR;MRTFLGVPVRV;RTFLGVPVRVR;RVRDESFGTLY;VRDESFGTLYL;ESFGTLYLTDK;YLTDKTNGQPF;FSDDDEVLVQA;EVLVQALAAAA;LVQALAAAAGI;VQALAAAAGIA;QALAAAAGIAV;ALAAAAGIAVA;AAAAGIAVANA;AAAGIAVANAR;AVANARLYQQA;VANARLYQQAK;NARLYQQAKAR;LYQQAKARQSW;YQQAKARQSWI;KARQSWIEATR;RQSWIEATRDI;IEATRDIATEL;EATRDIATELL;ELLSGTEPATV;LLSGTEPATVF;LSGTEPATVFR;GTEPATVFRLV;EPATVFRLVAA;ATVFRLVAAEA;TVFRLVAAEAL;VFRLVAAEALK;FRLVAAEALKL;RLVAAEALKLT;VAAEALKLTAA;AEALKLTAADA;EALKLTAADAA;ALKLTAADAAL;KLTAADAALVA;LTAADAALVAV;AADAALVAVPV;VPVDEDMPAAD;PVDEDMPAADV;DMPAADVGELL;MPAADVGELLV;DVGELLVIETV;ELLVIETVGSA;LLVIETVGSAV;LVIETVGSAVA;IETVGSAVASI;ETVGSAVASIV;RTIPVAGAVLR;IPVAGAVLREV;VAGAVLREVFV;AVLREVFVNGI;EVFVNGIPRRV;FVNGIPRRVDR;RRVDRVDLEGL;GLDELADAGPA;DELADAGPALL;ELADAGPALLL;DAGPALLLPLR;LLLPLRARGTV;LLPLRARGTVA;LPLRARGTVAG;PLRARGTVAGV;RARGTVAGVVV;TVAGVVVVLSQ;VVLSQGGPGAF;VLSQGGPGAFT;FTDEQLEMMAA;EMMAAFADQAA;MMAAFADQAAL;MAAFADQAALA;AAFADQAALAW;FADQAALAWQL;ALAWQLATSQR;LAWQLATSQRR;WQLATSQRRMR;RMRELDVLTDR;ELDVLTDRDRI;DVLTDRDRIAR;RIARDLHDHVI;DLHDHVIQRLF;HVIQRLFAIGL;VIQRLFAIGLA;IQRLFAIGLAL;RLFAIGLALQG;FAIGLALQGAV;LALQGAVPHER;GAVPHERNPEV;HERNPEVQQRL;DLQDVIQEIRT;DVIQEIRTTIY;IYDLHGASQGI;DLHGASQGITR;HGASQGITRLR;ASQGITRLRQR;RLRQRIDAAVA;RQRIDAAVAQF;AAVAQFADSGL;AVAQFADSGLR;AQFADSGLRTS;QFADSGLRTSV;TSVQFVGPLSV;SVQFVGPLSVV;FVGPLSVVDSA;GPLSVVDSALA;SVVDSALADQA;DSALADQAEAV;SALADQAEAVV;DQAEAVVREAV;AVVREAVSNAV;VVREAVSNAVR;EAVSNAVRHAK;AVRHAKASTLT;HAKASTLTVRV;KASTLTVRVKV;VKVDDDLCIEV;KVDDDLCIEVT;DLCIEVTDNGR;GLPDEFTGSGL;LPDEFTGSGLT;DEFTGSGLTNL;EFTGSGLTNLR;TGSGLTNLRQR;GLTNLRQRAEQ;RQRAEQAGGEF;AEQAGGEFTLA;QAGGEFTLASV;GEFTLASVPGA;TLASVPGASGT;LASVPGASGTV;SVPGASGTVLR;VPGASGTVLRW<br><br>13 mers:<br>MTTGGLVDENDGA;TTGGLVDENDGAA;TGGLVDENDGAAM;GGLVDENDGAAMR;GLVDENDGAAMRP;LVDENDGAAMRPL;VDENDGAAMRPLR;DENDGAAMRPLRH;ENDGAAMRPLRHT;NDGAAMRPLRHTL;DGAAMRPLRHTLS;GAAMRPLRHTLSQ;AAMRPLRHTLSQL;AMRPLRHTLSQLR;MRPLRH | |

Fig. 30 continued

| | | |
|---|---|---|
| | TLSQLRL;RPLRHTLSQLRLH;PLRHTLSQLRLHE;LRHTLSQLRLHEL;RHTL<br>SQLRLHELL;HTLSQLRLHELLV;TLSQLRLHELLVE;LSQLRLHELLVEV;SQL<br>RLHELLVEVQ;QLRLHELLVEVQD;LRLHELLVEVQDR;RLHELLVEVQDRV;<br>LHELLVEVQDRVE;HELLVEVQDRVEQ;ELLVEVQDRVEQI;LLVEVQDRVE<br>QIV;LVEVQDRVEQIVE;VEVQDRVEQIVEG;EVQDRVEQIVEGR;VQDRVEQ<br>IVEGRD;QDRVEQIVEGRDR;DRVEQIVEGRDRL;RVEQIVEGRDRLD;VEQI<br>VEGRDRLDG;EQIVEGRDRLDGL;QIVEGRDRLDGLV;IVEGRDRLDGLVE;V<br>EGRDRLDGLVEA;EGRDRLDGLVEAM;GRDRLDGLVEAML;RDRLDGLVEA<br>MLV;DRLDGLVEAMLVV;RLDGLVEAMLVVT;LDGLVEAMLVVTA;DGLVEA<br>MLVVTAG;GLVEAMLVVTAGL;LVEAMLVVTAGLD;VEAMLVVTAGLDL;EAM<br>LVVTAGLDLE;AMLVVTAGLDLEA;MLVVTAGLDLEAT;LVVTAGLDLEATL;V<br>VTAGLDLEATLR;VTAGLDLEATLRA;TAGLDLEATLRAI;AGLDLEATLRAIV;<br>GLDLEATLRAIVH;LDLEATLRAIVHS;DLEATLRAIVHSA;LEATLRAIVHSAT;<br>EATLRAIVHSATS;ATLRAIVHSATSL;TLRAIVHSATSLV;LRAIVHSATSLVD;<br>RAIVHSATSLVDA;AIVHSATSLVDAR;IVHSATSLVDARY;VHSATSLVDARY<br>G;HSATSLVDARYGA;SATSLVDARYGAM;ATSLVDARYGAME;TSLVDARY<br>GAMEV;SLVDARYGAMEVH;LVDARYGAMEVHD;VDARYGAMEVHDR;DA<br>RYGAMEVHDRQ;ARYGAMEVHDRQH;RYGAMEVHDRQHR;YGAMEVHDR<br>QHRV;GAMEVHDRQHRVL;AMEVHDRQHRVLH;MEVHDRQHRVLHF;EVH<br>DRQHRVLHFV;VHDRQHRVLHFVY;HDRQHRVLHFVYE;DRQHRVLHFVYE<br>G;RQHRVLHFVYEGI;QHRVLHFVYEGID;HRVLHFVYEGIDE;RVLHFVYEGI<br>DEE;VLHFVYEGIDEET;LHFVYEGIDEETV;HFVYEGIDEETVR;FVYEGIDEE<br>TVRR;VYEGIDEETVRRI;YEGIDEETVRRIG;EGIDEETVRRIGH;GIDEETVR<br>RIGHL;IDEETVRRIGHLP;DEETVRRIGHLPK;EETVRRIGHLPKG;ETVRRIG<br>HLPKGL;TVRRIGHLPKGLG;VRRIGHLPKGLGV;RRIGHLPKGLGVI;RIGHLP<br>KGLGVIG;IGHLPKGLGVIGL;GHLPKGLGVIGLL;HLPKGLGVIGLLI;LPKGLG<br>VIGLLIE;PKGLGVIGLLIED;KGLGVIGLLIEDP;GLGVIGLLIEDPK;LGVIGLLIE<br>DPKP;GVIGLLIEDPKPL;VIGLLIEDPKPLR;IGLLIEDPKPLRL;GLLIEDPKPLR<br>LD;LLIEDPKPLRLDD;LIEDPKPLRLDDV;IEDPKPLRLDDVS;EDPKPLRLDD<br>VSA;DPKPLRLDDVSAH;PKPLRLDDVSAHP;KPLRLDDVSAHPA;PLRLDDV<br>SAHPAS;LRLDDVSAHPASI;RLDDVSAHPASIG;LDDVSAHPASIGF;DDVSA<br>HPASIGFP;DVSAHPASIGFPP;VSAHPASIGFPPY;SAHPASIGFPPYH;AHP<br>ASIGFPPYHP;HPASIGFPPYHPP;PASIGFPPYHPPM;ASIGFPPYHPPMR;S<br>IGFPPYHPPMRT;IGFPPYHPPMRTF;GFPPYHPPMRTFL;FPPYHPPMRTFL<br>G;PPYHPPMRTFLGV;PYHPPMRTFLGVP;YHPPMRTFLGVPV;HPPMRTFL<br>GVPVR;PPMRTFLGVPVRV;PMRTFLGVPVRVR;MRTFLGVPVRVRD;RTFL<br>GVPVRVRDE;TFLGVPVRVRDES;FLGVPVRVRDESF;LGVPVRVRDESFG;<br>GVPVRVRDESFGT;VPVRVRDESFGTL;PVRVRDESFGTLY;VRVRDESFG<br>TLYL;RVRDESFGTLYLT;VRDESFGTLYLTD;RDESFGTLYLTDK;DESFGTL<br>YLTDKT;ESFGTLYLTDKTN;SFGTLYLTDKTNG;FGTLYLTDKTNGQ;GTLYL<br>TDKTNGQP;TLYLTDKTNGQPF;LYLTDKTNGQPFS;YLTDKTNGQPFSD;LT<br>DKTNGQPFSDD;TDKTNGQPFSDDD;DKTNGQPFSDDDE;KTNGQPFSDD<br>DEV;TNGQPFSDDDEVL;NGQPFSDDDEVLV;GQPFSDDDEVLVQ;QPFSD<br>DDEVLVQA;PFSDDDEVLVQAL;FSDDDEVLVQALA;SDDDEVLVQALAA;D<br>DDEVLVQALAAA;DDEVLVQALAAAA;DEVLVQALAAAAG;EVLVQALAAAA<br>GI;VLVQALAAAAGIA;LVQALAAAAGIAV;VQALAAAAGIAVA;QALAAAAGIA<br>VAN;ALAAAAGIAVANA;LAAAAGIAVANAR;AAAAGIAVANARL;AAAGIAVA<br>NARLY;AAGIAVANARLYQ;AGIAVANARLYQQ;GIAVANARLYQQA;IAVANA<br>RLYQQAK;AVANARLYQQAKA;VANARLYQQAKAR;ANARLYQQAKARQ;N<br>ARLYQQAKARQS;ARLYQQAKARQSW;RLYQQAKARQSWI;LYQQAKARQ<br>SWIE;YQQAKARQSWIEA;QQAKARQSWIEAT;QAKARQSWIEATR;AKARQ<br>SWIEATRD;KARQSWIEATRDI;ARQSWIEATRDIA;RQSWIEATRDIAT;QSW<br>IEATRDIATE;SWIEATRDIATEL;WIEATRDIATELL;IEATRDIATELLS;EATR | |

Fig. 30 continued

| | | |
|---|---|---|
| | DIATELLSG;ATRDIATELLSGT;TRDIATELLSGTE;RDIATELLSGTEP;DIATELLSGTEPA;IATELLSGTEPAT;ATELLSGTEPATV;TELLSGTEPATVF;ELLSGTEPATVFR;LLSGTEPATVFRL;LSGTEPATVFRLV;SGTEPATVFRLVA;GTEPATVFRLVAA;TEPATVFRLVAAE;EPATVFRLVAAEA;PATVFRLVAAEAL;ATVFRLVAAEALK;TVFRLVAAEALKL;VFRLVAAEALKLT;FRLVAAEALKLTA;RLVAAEALKLTAA;LVAAEALKLTAAD;VAAEALKLTAADA;AAEALKLTAADAA;AEALKLTAADAAL;EALKLTAADAALV;ALKLTAADAALVA;LKLTAADAALVAV;KLTAADAALVAVP;LTAADAALVAVPV;TAADAALVAVPVD;AADAALVAVPVDE;ADAALVAVPVDED;DAALVAVPVDEDM;AALVAVPVDEDMP;ALVAVPVDEDMPA;LVAVPVDEDMPAA;VAVPVDEDMPAAD;AVPVDEDMPAADV;VPVDEDMPAADVG;PVDEDMPAADVGE;VDEDMPAADVGEL;DEDMPAADVGELL;EDMPAADVGELLV;DMPAADVGELLVI;MPAADVGELLVIE;PAADVGELLVIET;AADVGELLVIETV;ADVGELLVIETVG;DVGELLVIETVGS;VGELLVIETVGSA;GELLVIETVGSAV;ELLVIETVGSAVA;LLVIETVGSAVAS;LVIETVGSAVASI;VIETVGSAVASIV;IETVGSAVASIVG;ETVGSAVASIVGR;TVGSAVASIVGRT;VGSAVASIVGRTI;GSAVASIVGRTIP;SAVASIVGRTIPV;AVASIVGRTIPVA;VASIVGRTIPVAG;ASIVGRTIPVAGA;SIVGRTIPVAGAV;IVGRTIPVAGAVL;VGRTIPVAGAVLR;GRTIPVAGAVLRE;RTIPVAGAVLREV;TIPVAGAVLREVF;IPVAGAVLREVFV;PVAGAVLREVFVN;VAGAVLREVFVNG;AGAVLREVFVNGI;GAVLREVFVNGIP;AVLREVFVNGIPR;VLREVFVNGIPRR;LREVFVNGIPRRV;REVFVNGIPRRVD;EVFVNGIPRRVDR;VFVNGIPRRVDRV;FVNGIPRRVDRVD;VNGIPRRVDRVDL;NGIPRRVDRVDLE;GIPRRVDRVDLEG;IPRRVDRVDLEGL;PRRVDRVDLEGLD;RRVDRVDLEGLDE;RVDRVDLEGLDEL;VDRVDLEGLDELA;DRVDLEGLDELAD;RVDLEGLDELADA;VDLEGLDELADAG;DLEGLDELADAGP;LEGLDELADAGPA;EGLDELADAGPAL;GLDELADAGPALL;LDELADAGPALLL;DELADAGPALLLP;ELADAGPALLLPL;LADAGPALLLPLR;ADAGPALLLPLRA;DAGPALLLPLRAR;AGPALLLPLRARG;GPALLLPLRARGT;PALLLPLRARGTV;ALLLPLRARGTVA;LLLPLRARGTVAG;LLPLRARGTVAGV;LPLRARGTVAGVV;PLRARGTVAGVVV;LRARGTVAGVVVV;RARGTVAGVVVVL;ARGTVAGVVVVLS;RGTVAGVVVVLSQ;GTVAGVVVVLSQG;TVAGVVVVLSQGG;VAGVVVVLSQGGP;AGVVVVLSQGGPG;GVVVVLSQGGPGA;VVVVLSQGGPGAF;VVVLSQGGPGAFT;VVLSQGGPGAFTD;VLSQGGPGAFTDE;LSQGGPGAFTDEQ;SQGGPGAFTDEQL;QGGPGAFTDEQLE;GGPGAFTDEQLEM;GPGAFTDEQLEMM;PGAFTDEQLEMMA;GAFTDEQLEMMAA;AFTDEQLEMMAAF;FTDEQLEMMAAFA;TDEQLEMMAAFAD;DEQLEMMAAFADQ;EQLEMMAAFADQA;QLEMMAAFADQAA;LEMMAAFADQAAL;EMMAAFADQAALA;MMAAFADQAALAW;MAAFADQAALAWQ;AAFADQAALAWQL;AFADQAALAWQLA;FADQAALAWQLAT;ADQAALAWQLATS;DQAALAWQLATSQ;QAALAWQLATSQR;AALAWQLATSQRR;ALAWQLATSQRRM;LAWQLATSQRRMR;AWQLATSQRRMRE;WQLATSQRRMREL;QLATSQRRMRELD;LATSQRRMRELDV;ATSQRRMRELDVL;TSQRRMRELDVLT;SQRRMRELDVLTD;QRRMRELDVLTDR;RRMRELDVLTDRD;RMRELDVLTDRDR;MRELDVLTDRDRI;RELDVLTDRDRIA;ELDVLTDRDRIAR;LDVLTDRDRIARD;DVLTDRDRIARDL;VLTDRDRIARDLH;LTDRDRIARDLHD;TDRDRIARDLHDH;DRDRIARDLHDHV;RDRIARDLHDHVI;DRIARDLHDHVIQ;RIARDLHDHVIQR;IARDLHDHVIQRL;ARDLHDHVIQRLF;RDLHDHVIQRLFA;DLHDHVIQRLFAI;LHDHVIQRLFAIG;HDHVIQRLFAIGL;DHVIQRLFAIGLA;HVIQRLFAIGLAL;VIQRLFAIGLALQ;IQRLFAIGLALQG;QRLFAIGLALQGA;RLFAIGLALQGAV;LFAIGLALQGAVP;FAIGLALQGAVPH;AIGLALQGAVPHE;IGLALQGAVPHER;GLALQGAVPHERN;LALQGAVPHERNP;ALQGAVPHERNPE;LQGAVPHERNPEV;QGAVPHERNPEVQ;GAVPHERNPEVQQ;AVPHERNPEVQQR;VPHERNPEVQQRL;PHERNPEVQQRLS;HERNPEVQQRLSD;ERNPEVQQRLSDV;RNPEVQQRLSDVV;NPEVQQRLSD | |

Fig. 30 continued

| | | |
|---|---|---|
| | VVD;PEVQQRLSDVVDD;EVQQRLSDVVDDL;VQQRLSDVVDDLQ;QQRLS<br>DVVDDLQD;QRLSDVVDDLQDV;RLSDVVDDLQDVI;LSDVVDDLQDVIQ;SD<br>VVDDLQDVIQE;DVVDDLQDVIQEI;VVDDLQDVIQEIR;VDDLQDVIQEIRT;D<br>DLQDVIQEIRTT;DLQDVIQEIRTTI;LQDVIQEIRTTIY;QDVIQEIRTTIYD;DVIQ<br>EIRTTIYDL;VIQEIRTTIYDLH;IQEIRTTIYDLHG;QEIRTTIYDLHGA;EIRTTIY<br>DLHGAS;IRTTIYDLHGASQ;RTTIYDLHGASQG;TTIYDLHGASQGI;TIYDLH<br>GASQGIT;IYDLHGASQGITR;YDLHGASQGITRL;DLHGASQGITRLR;LHGA<br>SQGITRLRQ;HGASQGITRLRQR;GASQGITRLRQRI;ASQGITRLRQRID;SQ<br>GITRLRQRIDA;QGITRLRQRIDAA;GITRLRQRIDAAV;ITRLRQRIDAAVA;TR<br>LRQRIDAAVAQ;RLRQRIDAAVAQF;LRQRIDAAVAQFA;RQRIDAAVAQFAD<br>;QRIDAAVAQFADS;RIDAAVAQFADSG;IDAAVAQFADSGL;DAAVAQFADS<br>GLR;AAVAQFADSGLRT;AVAQFADSGLRTS;VAQFADSGLRTSV;AQFADS<br>GLRTSVQ;QFADSGLRTSVQF;FADSGLRTSVQFV;ADSGLRTSVQFVG;DS<br>GLRTSVQFVGP;SGLRTSVQFVGPL;GLRTSVQFVGPLS;LRTSVQFVGPLS<br>V;RTSVQFVGPLSVV;TSVQFVGPLSVVD;SVQFVGPLSVVDS;VQFVGPLS<br>VVDSA;QFVGPLSVVDSAL;FVGPLSVVDSALA;VGPLSVVDSALAD;GPLSV<br>VDSALADQ;PLSVVDSALADQA;LSVVDSALADQAE;SVVDSALADQAEA;VV<br>DSALADQAEAV;VDSALADQAEAVV;DSALADQAEAVVR;SALADQAEAVVR<br>E;ALADQAEAVVREA;LADQAEAVVREAV;ADQAEAVVREAVS;DQAEAVVR<br>EAVSN;QAEAVVREAVSNA;AEAVVREAVSNAV;EAVVREAVSNAVR;AVVR<br>EAVSNAVRH;VVREAVSNAVRHA;VREAVSNAVRHAK;REAVSNAVRHAKA;<br>EAVSNAVRHAKAS;AVSNAVRHAKAST;VSNAVRHAKASTL;SNAVRHAKAS<br>TLT;NAVRHAKASTLTV;AVRHAKASTLTVR;VRHAKASTLTVRV;RHAKASTL<br>TVRVK;HAKASTLTVRVKV;AKASTLTVRVKVD;KASTLTVRVKVDD;ASTLTV<br>RVKVDDD;STLTVRVKVDDDL;TLTVRVKVDDDLC;LTVRVKVDDDLCI;TVR<br>VKVDDDLCIE;VRVKVDDDLCIEV;RVKVDDDLCIEVT;VKVDDDLCIEVTD;K<br>VDDDLCIEVTDN;VDDDLCIEVTDNG;DDDLCIEVTDNGR;DDLCIEVTDNGR<br>G;DLCIEVTDNGRGL;LCIEVTDNGRGLP;CIEVTDNGRGLPD;IEVTDNGRGL<br>PDE;EVTDNGRGLPDEF;VTDNGRGLPDEFT;TDNGRGLPDEFTG;DNGRG<br>LPDEFTGS;NGRGLPDEFTGSG;GRGLPDEFTGSGL;RGLPDEFTGSGLT;G<br>LPDEFTGSGLTN;LPDEFTGSGLTNL;PDEFTGSGLTNLR;DEFTGSGLTNLR<br>Q;EFTGSGLTNLRQR;FTGSGLTNLRQRA;TGSGLTNLRQRAE;GSGLTNLR<br>QRAEQ;SGLTNLRQRAEQA;GLTNLRQRAEQAG;LTNLRQRAEQAGG;TNL<br>RQRAEQAGGE;NLRQRAEQAGGEF;LRQRAEQAGGEFT;RQRAEQAGGEF<br>TL;QRAEQAGGEFTLA;RAEQAGGEFTLAS;AEQAGGEFTLASV;EQAGGEF<br>TLASVP;QAGGEFTLASVPG;AGGEFTLASVPGA;GGEFTLASVPGAS;GEF<br>TLASVPGASG;EFTLASVPGASGT;FTLASVPGASGTV;TLASVPGASGTVL;<br>LASVPGASGTVLR;ASVPGASGTVLRW;SVPGASGTVLRWS;VPGASGTVL<br>RWSA;PGASGTVLRWSAP;GASGTVLRWSAPL;ASGTVLRWSAPLS;SGTV<br>LRWSAPLSQ;<br>14 mers:<br>MTTGGLVDENDGAA;TTGGLVDENDGAAM;TGGLVDENDGAAMR;GGLVD<br>ENDGAAMRP;GLVDENDGAAMRPL;LVDENDGAAMRPLR;VDENDGAAMR<br>PLRH;DENDGAAMRPLRHT;ENDGAAMRPLRHTL;NDGAAMRPLRHTLS;D<br>GAAMRPLRHTLSQ;GAAMRPLRHTLSQL;AAMRPLRHTLSQLR;AMRPLRH<br>TLSQLRL;MRPLRHTLSQLRLH;RPLRHTLSQLRLHE;PLRHTLSQLRLHEL;L<br>RHTLSQLRLHELL;RHTLSQLRLHELLV;HTLSQLRLHELLVE;TLSQLRLHEL<br>LVEV;LSQLRLHELLVEVQ;SQLRLHELLVEVQD;QLRLHELLVEVQDR;LRLH<br>ELLVEVQDRV;RLHELLVEVQDRVE;LHELLVEVQDRVEQ;HELLVEVQDRV<br>EQI;ELLVEVQDRVEQIV;LLVEVQDRVEQIVE;LVEVQDRVEQIVEG;VEVQD<br>RVEQIVEGR;EVQDRVEQIVEGRD;VQDRVEQIVEGRDR;QDRVEQIVEGRD<br>RL;DRVEQIVEGRDRLD;RVEQIVEGRDRLDG;VEQIVEGRDRLDGL;EQIVE<br>GRDRLDGLV;QIVEGRDRLDGLVE;IVEGRDRLDGLVEA;VEGRDRLDGLVE | |

Fig. 30 continued

| | | |
|---|---|---|
| | AM;EGRDRLDGLVEAML;GRDRLDGLVEAMLV;RDRLDGLVEAMLVV;DRLDGLVEAMLVVT;RLDGLVEAMLVVTA;LDGLVEAMLVVTAG;DGLVEAMLVVTAGL;GLVEAMLVVTAGLD;LVEAMLVVTAGLDL;VEAMLVVTAGLDLE;EAMLVVTAGLDLEA;AMLVVTAGLDLEAT;MLVVTAGLDLEATL;LVVTAGLDLEATLR;VVTAGLDLEATLRA;VTAGLDLEATLRAI;TAGLDLEATLRAIV;AGLDLEATLRAIVH;GLDLEATLRAIVHS;LDLEATLRAIVHSA;DLEATLRAIVHSAT;LEATLRAIVHSATS;EATLRAIVHSATSL;ATLRAIVHSATSLV;TLRAIVHSATSLVD;LRAIVHSATSLVDA;RAIVHSATSLVDAR;AIVHSATSLVDARY;IVHSATSLVDARYG;VHSATSLVDARYGA;HSATSLVDARYGAM;SATSLVDARYGAME;ATSLVDARYGAMEV;TSLVDARYGAMEVH;SLVDARYGAMEVHD;LVDARYGAMEVHDR;VDARYGAMEVHDRQ;DARYGAMEVHDRQH;ARYGAMEVHDRQHR;RYGAMEVHDRQHRV;YGAMEVHDRQHRVL;GAMEVHDRQHRVLH;AMEVHDRQHRVLHF;MEVHDRQHRVLHFV;EVHDRQHRVLHFVY;VHDRQHRVLHFVYE;HDRQHRVLHFVYEG;DRQHRVLHFVYEGI;RQHRVLHFVYEGID;QHRVLHFVYEGIDE;HRVLHFVYEGIDEE;RVLHFVYEGIDEET;VLHFVYEGIDEETV;LHFVYEGIDEETVR;HFVYEGIDEETVRR;FVYEGIDEETVRRI;VYEGIDEETVRRIG;YEGIDEETVRRIGH;EGIDEETVRRIGHL;GIDEETVRRIGHLP;IDEETVRRIGHLPK;DEETVRRIGHLPKG;EETVRRIGHLPKGL;ETVRRIGHLPKGLG;TVRRIGHLPKGLGV;VRRIGHLPKGLGVI;RRIGHLPKGLGVIG;RIGHLPKGLGVIGL;IGHLPKGLGVIGLL;GHLPKGLGVIGLLI;HLPKGLGVIGLLIE;LPKGLGVIGLLIED;PKGLGVIGLLIEDP;KGLGVIGLLIEDPK;GLGVIGLLIEDPKP;LGVIGLLIEDPKPL;GVIGLLIEDPKPLR;VIGLLIEDPKPLRL;IGLLIEDPKPLRLD;GLLIEDPKPLRLDD;LLIEDPKPLRLDDV;LIEDPKPLRLDDVS;IEDPKPLRLDDVSA;EDPKPLRLDDVSAH;DPKPLRLDDVSAHP;PKPLRLDDVSAHPA;KPLRLDDVSAHPAS;PLRLDDVSAHPASI;LRLDDVSAHPASIG;RLDDVSAHPASIGF;LDDVSAHPASIGFP;DDVSAHPASIGFPP;DVSAHPASIGFPPY;VSAHPASIGFPPYH;SAHPASIGFPPYHP;AHPASIGFPPYHPP;HPASIGFPPYHPPM;PASIGFPPYHPPMR;ASIGFPPYHPPMRT;SIGFPPYHPPMRTF;IGFPPYHPPMRTFL;GFPPYHPPMRTFLG;FPPYHPPMRTFLGV;PPYHPPMRTFLGVP;PYHPPMRTFLGVPV;YHPPMRTFLGVPVR;HPPMRTFLGVPVRV;PPMRTFLGVPVRVR;PMRTFLGVPVRVRD;MRTFLGVPVRVRDE;RTFLGVPVRVRDES;TFLGVPVRVRDESF;FLGVPVRVRDESFG;LGVPVRVRDESFGT;GVPVRVRDESFGTL;VPVRVRDESFGTLY;PVRVRDESFGTLYL;VRVRDESFGTLYLT;RVRDESFGTLYLTD;VRDESFGTLYLTDK;RDESFGTLYLTDKT;DESFGTLYLTDKTN;ESFGTLYLTDKTNG;SFGTLYLTDKTNGQ;FGTLYLTDKTNGQP;GTLYLTDKTNGQPF;TLYLTDKTNGQPFS;LYLTDKTNGQPFSD;YLTDKTNGQPFSDD;LTDKTNGQPFSDDD;TDKTNGQPFSDDDE;DKTNGQPFSDDDEV;KTNGQPFSDDDEVL;TNGQPFSDDDEVLV;NGQPFSDDDEVLVQ;GQPFSDDDEVLVQA;QPFSDDDEVLVQAL;PFSDDDEVLVQALA;FSDDDEVLVQALAA;SDDDEVLVQALAAA;DDDEVLVQALAAAA;DDEVLVQALAAAAG;DEVLVQALAAAAGI;EVLVQALAAAAGIA;VLVQALAAAAGIAV;LVQALAAAAGIAVA;VQALAAAAGIAVAN;QALAAAAGIAVANA;ALAAAAGIAVANAR;LAAAAGIAVANARL;AAAAGIAVANARLY;AAAGIAVANARLYQ;AAGIAVANARLYQQ;AGIAVANARLYQQA;GIAVANARLYQQAK;IAVANARLYQQAKA;AVANARLYQQAKAR;VANARLYQQAKARQ;ANARLYQQAKARQS;NARLYQQAKARQSW;ARLYQQAKARQSWI;RLYQQAKARQSWIE;LYQQAKARQSWIEA;YQQAKARQSWIEAT;QQAKARQSWIEATR;QAKARQSWIEATRD;AKARQSWIEATRDI;KARQSWIEATRDIA;ARQSWIEATRDIAT;RQSWIEATRDIATE;QSWIEATRDIATEL;SWIEATRDIATELL;WIEATRDIATELLS;IEATRDIATELLSG;EATRDIATELLSGT;ATRDIATELLSGTE;TRDIATELLSGTEP;RDIATELLSGTEPA;DIATELLSGTEPAT;IATELLSGTEPATV;ATELLSGTEPATVF;TELLSGTEPATVFR;ELLSGTEPATVFRL;LLSGTEPATVFRLV;LSGTEPATVFRLVA;SGTEPATVFRLVAA;GTEPATVFRLVAAE;TEPATVFRLVAAEA;EP | |

Fig. 30 continued

| | | |
|---|---|---|
| | ATVFRLVAAEAL;PATVFRLVAAEALK;ATVFRLVAAEALKL;TVFRLVAAEALKLT;VFRLVAAEALKLTA;FRLVAAEALKLTAA;RLVAAEALKLTAAD;LVAAEALKLTAADA;VAAEALKLTAADAA;AAEALKLTAADAAL;AEALKLTAADAALV;EALKLTAADAALVA;ALKLTAADAALVAV;LKLTAADAALVAVP;KLTAADAALVAVPV;LTAADAALVAVPVD;TAADAALVAVPVDE;AADAALVAVPVDED;ADAALVAVPVDEDM;DAALVAVPVDEDMP;AALVAVPVDEDMPA;ALVAVPVDEDMPAA;LVAVPVDEDMPAAD;VAVPVDEDMPAADV;AVPVDEDMPAADVG;VPVDEDMPAADVGE;PVDEDMPAADVGEL;VDEDMPAADVGELL;DEDMPAADVGELLV;EDMPAADVGELLVI;DMPAADVGELLVIE;MPAADVGELLVIET;PAADVGELLVIETV;AADVGELLVIETVG;ADVGELLVIETVGS;DVGELLVIETVGSA;VGELLVIETVGSAV;GELLVIETVGSAVA;ELLVIETVGSAVAS;LLVIETVGSAVASI;LVIETVGSAVASIV;VIETVGSAVASIVG;IETVGSAVASIVGR;ETVGSAVASIVGRT;TVGSAVASIVGRTI;VGSAVASIVGRTIP;GSAVASIVGRTIPV;SAVASIVGRTIPVA;AVASIVGRTIPVAG;VASIVGRTIPVAGA;ASIVGRTIPVAGAV;SIVGRTIPVAGAVL;IVGRTIPVAGAVLR;VGRTIPVAGAVLRE;GRTIPVAGAVLREV;RTIPVAGAVLREVF;TIPVAGAVLREVFV;IPVAGAVLREVFVN;PVAGAVLREVFVNG;VAGAVLREVFVNGI;AGAVLREVFVNGIP;GAVLREVFVNGIPR;AVLREVFVNGIPRR;VLREVFVNGIPRRV;LREVFVNGIPRRVD;REVFVNGIPRRVDR;EVFVNGIPRRVDRV;VFVNGIPRRVDRVD;FVNGIPRRVDRVDL;VNGIPRRVDRVDLE;NGIPRRVDRVDLEG;GIPRRVDRVDLEGL;IPRRVDRVDLEGLD;PRRVDRVDLEGLDE;RRVDRVDLEGLDEL;RVDRVDLEGLDELA;VDRVDLEGLDELAD;DRVDLEGLDELADA;RVDLEGLDELADAG;VDLEGLDELADAGP;DLEGLDELADAGPA;LEGLDELADAGPAL;EGLDELADAGPALL;GLDELADAGPALLL;LDELADAGPALLLP;DELADAGPALLLPL;ELADAGPALLLPLR;LADAGPALLLPLRA;ADAGPALLLPLRAR;DAGPALLLPLRARG;AGPALLLPLRARGT;GPALLLPLRARGTV;PALLLPLRARGTVA;ALLLPLRARGTVAG;LLLPLRARGTVAGV;LLPLRARGTVAGVV;LPLRARGTVAGVVV;PLRARGTVAGVVVV;LRARGTVAGVVVVL;RARGTVAGVVVVLS;ARGTVAGVVVVLSQ;RGTVAGVVVVLSQG;GTVAGVVVVLSQGG;TVAGVVVVLSQGGP;VAGVVVVLSQGGPG;AGVVVVLSQGGPGA;GVVVVLSQGGPGAF;VVVVLSQGGPGAFT;VVVLSQGGPGAFTD;VVLSQGGPGAFTDE;VLSQGGPGAFTDEQ;LSQGGPGAFTDEQL;SQGGPGAFTDEQLE;QGGPGAFTDEQLEM;GGPGAFTDEQLEMM;GPGAFTDEQLEMMA;PGAFTDEQLEMMAA;GAFTDEQLEMMAAF;AFTDEQLEMMAAFA;FTDEQLEMMAAFAD;TDEQLEMMAAFADQ;DEQLEMMAAFADQA;EQLEMMAAFADQAA;QLEMMAAFADQAAL;LEMMAAFADQAALA;EMMAAFADQAALAW;MMAAFADQAALAWQ;MAAFADQAALAWQL;AAFADQAALAWQLA;AFADQAALAWQLAT;FADQAALAWQLATS;ADQAALAWQLATSQ;DQAALAWQLATSQR;QAALAWQLATSQRR;AALAWQLATSQRRM;ALAWQLATSQRRMR;LAWQLATSQRRMRE;AWQLATSQRRMREL;WQLATSQRRMRELD;QLATSQRRMRELDV;LATSQRRMRELDVL;ATSQRRMRELDVLT;TSQRRMRELDVLTD;SQRRMRELDVLTDR;QRRMRELDVLTDRD;RRMRELDVLTDRDR;RMRELDVLTDRDRI;MRELDVLTDRDRIA;RELDVLTDRDRIAR;ELDVLTDRDRIARD;LDVLTDRDRIARDL;DVLTDRDRIARDLH;VLTDRDRIARDLHD;LTDRDRIARDLHDH;TDRDRIARDLHDHV;DRDRIARDLHDHVI;RDRIARDLHDHVIQ;DRIARDLHDHVIQR;RIARDLHDHVIQRL;IARDLHDHVIQRLF;ARDLHDHVIQRLFA;RDLHDHVIQRLFAI;DLHDHVIQRLFAIG;LHDHVIQRLFAIGL;HDHVIQRLFAIGLA;DHVIQRLFAIGLAL;HVIQRLFAIGLALQ;VIQRLFAIGLALQG;IQRLFAIGLALQGA;QRLFAIGLALQGAV;RLFAIGLALQGAVP;LFAIGLALQGAVPH;FAIGLALQGAVPHE;AIGLALQGAVPHER;IGLALQGAVPHERN;GLALQGAVPHERNP;LALQGAVPHERNPE;ALQGAVPHERNPEV;LQGAVPHERNPEVQ;QGAVPHERNPEVQQ;GAVPHERNPEVQQR;AVPHERNPEVQQRL;VPHERNPEVQQRLS;PHERNPEVQQRLSD;HERNPEVQQRLSDV;ERNPEVQQRLSDVV;RNPEVQQRLSDVV | |

Fig. 30 continued

D;NPEVQQRLSDVVDD;PEVQQRLSDVVDDL;EVQQRLSDVVDDLQ;VQQR
LSDVVDDLQD;QQRLSDVVDDLQDV;QRLSDVVDDLQDVI;RLSDVVDDLQ
DVIQ;LSDVVDDLQDVIQE;SDVVDDLQDVIQEI;DVVDDLQDVIQEIR;VVDDL
QDVIQEIRT;VDDLQDVIQEIRTT;DDLQDVIQEIRTTI;DLQDVIQEIRTTIY;LQ
DVIQEIRTTIYD;QDVIQEIRTTIYDL;DVIQEIRTTIYDLH;VIQEIRTTIYDLHG;I
QEIRTTIYDLHGA;QEIRTTIYDLHGAS;EIRTTIYDLHGASQ;IRTTIYDLHGAS
QG;RTTIYDLHGASQGI;TTIYDLHGASQGIT;TIYDLHGASQGITR;IYDLHGA
SQGITRL;YDLHGASQGITRLR;DLHGASQGITRLRQ;LHGASQGITRLRQR;
HGASQGITRLRQRI;GASQGITRLRQRID;ASQGITRLRQRIDA;SQGITRLRQ
RIDAA;QGITRLRQRIDAAV;GITRLRQRIDAAVA;ITRLRQRIDAAVAQ;TRLR
QRIDAAVAQF;RLRQRIDAAVAQFA;LRQRIDAAVAQFAD;RQRIDAAVAQFA
DS;QRIDAAVAQFADSG;RIDAAVAQFADSGL;IDAAVAQFADSGLR;DAAVA
QFADSGLRT;AAVAQFADSGLRTS;AVAQFADSGLRTSV;VAQFADSGLRTS
VQ;AQFADSGLRTSVQF;QFADSGLRTSVQFV;FADSGLRTSVQFVG;ADSG
LRTSVQFVGP;DSGLRTSVQFVGPL;SGLRTSVQFVGPLS;GLRTSVQFVGP
LSV;LRTSVQFVGPLSVV;RTSVQFVGPLSVVD;TSVQFVGPLSVVDS;SVQF
VGPLSVVDSA;VQFVGPLSVVDSAL;QFVGPLSVVDSALA;FVGPLSVVDSA
LAD;VGPLSVVDSALADQ;GPLSVVDSALADQA;PLSVVDSALADQAE;LSVV
DSALADQAEA;SVVDSALADQAEAV;VVDSALADQAEAVV;VDSALADQAEA
VVR;DSALADQAEAVVRE;SALADQAEAVVREA;ALADQAEAVVREAV;LAD
QAEAVVREAVS;ADQAEAVVREAVSN;DQAEAVVREAVSNA;QAEAVVREA
VSNAV;AEAVVREAVSNAVR;EAVVREAVSNAVRH;AVVREAVSNAVRHA;V
VREAVSNAVRHAK;VREAVSNAVRHAKA;REAVSNAVRHAKAS;EAVSNAV
RHAKAST;AVSNAVRHAKASTL;VSNAVRHAKASTLT;SNAVRHAKASTLTV;
NAVRHAKASTLTVR;AVRHAKASTLTVRV;VRHAKASTLTVRVK;RHAKASTL
TVRVKV;HAKASTLTVRVKVD;AKASTLTVRVKVDD;KASTLTVRVKVDDD;A
STLTVRVKVDDDL;STLTVRVKVDDDLC;TLTVRVKVDDDLCI;LTVRVKVDD
DLCIE;TVRVKVDDDLCIEV;VRVKVDDDLCIEVT;RVKVDDDLCIEVTD;VKVD
DDLCIEVTDN;KVDDDLCIEVTDNG;VDDDLCIEVTDNGR;DDDLCIEVTDNG
RG;DDLCIEVTDNGRGL;DLCIEVTDNGRGLP;LCIEVTDNGRGLPD;CIEVTD
NGRGLPDE;IEVTDNGRGLPDEF;EVTDNGRGLPDEFT;VTDNGRGLPDEFT
G;TDNGRGLPDEFTGS;DNGRGLPDEFTGSG;NGRGLPDEFTGSGL;GRGL
PDEFTGSGLT;RGLPDEFTGSGLTN;GLPDEFTGSGLTNL;LPDEFTGSGLT
NLR;PDEFTGSGLTNLRQ;DEFTGSGLTNLRQR;EFTGSGLTNLRQRA;FTG
SGLTNLRQRAE;TGSGLTNLRQRAEQ;GSGLTNLRQRAEQA;SGLTNLRQR
AEQAG;GLTNLRQRAEQAGG;LTNLRQRAEQAGGE;TNLRQRAEQAGGEF;
NLRQRAEQAGGEFT;LRQRAEQAGGEFTL;RQRAEQAGGEFTLA;QRAEQ
AGGEFTLAS;RAEQAGGEFTLASV;AEQAGGEFTLASVP;EQAGGEFTLASV
PG;QAGGEFTLASVPGA;AGGEFTLASVPGAS;GGEFTLASVPGASG;GEFT
LASVPGASGT;EFTLASVPGASGTV;FTLASVPGASGTVL;TLASVPGASGTV
LR;LASVPGASGTVLRW;ASVPGASGTVLRWS;SVPGASGTVLRWSA;VPG
ASGTVLRWSAP;PGASGTVLRWSAPL;GASGTVLRWSAPLS;ASGTVLRWS
APLSQ;
15 mers:
MTTGGLVDENDGAAM;TTGGLVDENDGAAMR;TGGLVDENDGAAMRP;G
GLVDENDGAAMRPL;GLVDENDGAAMRPLR;LVDENDGAAMRPLRH;VDE
NDGAAMRPLRHT;DENDGAAMRPLRHTL;ENDGAAMRPLRHTLS;NDGAA
MRPLRHTLSQ;DGAAMRPLRHTLSQL;GAAMRPLRHTLSQLR;AAMRPLRH
TLSQLRL;AMRPLRHTLSQLRLH;MRPLRHTLSQLRLHE;RPLRHTLSQLRLH
EL;PLRHTLSQLRLHELL;LRHTLSQLRLHELLV;RHTLSQLRLHELLVE;HTLS
QLRLHELLVEV;TLSQLRLHELLVEVQ;LSQLRLHELLVEVQD;SQLRLHELLV
EVQDR;QLRLHELLVEVQDRV;LRLHELLVEVQDRVE;RLHELLVEVQDRVE
Q;LHELLVEVQDRVEQI;HELLVEVQDRVEQIV;ELLVEVQDRVEQIVE;LLVE

Fig. 30 continued

| | | |
|---|---|---|
| | VQDRVEQIVEG;LVEVQDRVEQIVEGR;VEVQDRVEQIVEGRD;EVQDRVEQIVEGRDR;VQDRVEQIVEGRDRL;QDRVEQIVEGRDRLD;DRVEQIVEGRDRLDG;RVEQIVEGRDRLDGL;VEQIVEGRDRLDGLV;EQIVEGRDRLDGLVE;QIVEGRDRLDGLVEA;IVEGRDRLDGLVEAM;VEGRDRLDGLVEAML;EGRDRLDGLVEAMLV;GRDRLDGLVEAMLVV;RDRLDGLVEAMLVVT;DRLDGLVEAMLVVTA;RLDGLVEAMLVVTAG;LDGLVEAMLVVTAGL;DGLVEAMLVVTAGLD;GLVEAMLVVTAGLDL;LVEAMLVVTAGLDLE;VEAMLVVTAGLDLEA;EAMLVVTAGLDLEAT;AMLVVTAGLDLEATL;MLVVTAGLDLEATLR;LVVTAGLDLEATLRA;VVTAGLDLEATLRAI;VTAGLDLEATLRAIV;TAGLDLEATLRAIVH;AGLDLEATLRAIVHS;GLDLEATLRAIVHSA;LDLEATLRAIVHSAT;DLEATLRAIVHSATS;LEATLRAIVHSATSL;EATLRAIVHSATSLV;ATLRAIVHSATSLVD;TLRAIVHSATSLVDA;LRAIVHSATSLVDAR;RAIVHSATSLVDARY;AIVHSATSLVDARYG;IVHSATSLVDARYGA;VHSATSLVDARYGAM;HSATSLVDARYGAME;SATSLVDARYGAMEV;ATSLVDARYGAMEVH;TSLVDARYGAMEVHD;SLVDARYGAMEVHDR;LVDARYGAMEVHDRQ;VDARYGAMEVHDRQH;DARYGAMEVHDRQHR;ARYGAMEVHDRQHRV;RYGAMEVHDRQHRVL;YGAMEVHDRQHRVLH;GAMEVHDRQHRVLHF;AMEVHDRQHRVLHFV;MEVHDRQHRVLHFVY;EVHDRQHRVLHFVYE;VHDRQHRVLHFVYEG;HDRQHRVLHFVYEGI;DRQHRVLHFVYEGID;RQHRVLHFVYEGIDE;QHRVLHFVYEGIDEE;HRVLHFVYEGIDEET;RVLHFVYEGIDEETV;VLHFVYEGIDEETVR;LHFVYEGIDEETVRR;HFVYEGIDEETVRRI;FVYEGIDEETVRRIG;VYEGIDEETVRRIGH;YEGIDEETVRRIGHL;EGIDEETVRRIGHLP;GIDEETVRRIGHLPK;IDEETVRRIGHLPKG;DEETVRRIGHLPKGL;EETVRRIGHLPKGLG;ETVRRIGHLPKGLGV;TVRRIGHLPKGLGVI;VRRIGHLPKGLGVIG;RRIGHLPKGLGVIGL;RIGHLPKGLGVIGLL;IGHLPKGLGVIGLLI;GHLPKGLGVIGLLIE;HLPKGLGVIGLLIED;LPKGLGVIGLLIEDP;PKGLGVIGLLIEDPK;KGLGVIGLLIEDPKP;GLGVIGLLIEDPKPL;LGVIGLLIEDPKPLR;GVIGLLIEDPKPLRL;VIGLLIEDPKPLRLD;IGLLIEDPKPLRLDD;GLLIEDPKPLRLDDV;LLIEDPKPLRLDDVS;LIEDPKPLRLDDVSA;IEDPKPLRLDDVSAH;EDPKPLRLDDVSAHP;DPKPLRLDDVSAHPA;PKPLRLDDVSAHPAS;KPLRLDDVSAHPASI;PLRLDDVSAHPASIG;LRLDDVSAHPASIGF;RLDDVSAHPASIGFP;LDDVSAHPASIGFPP;DDVSAHPASIGFPPY;DVSAHPASIGFPPYH;VSAHPASIGFPPYHP;SAHPASIGFPPYHPP;AHPASIGFPPYHPPM;HPASIGFPPYHPPMR;PASIGFPPYHPPMRT;ASIGFPPYHPPMRTF;SIGFPPYHPPMRTFL;IGFPPYHPPMRTFLG;GFPPYHPPMRTFLGV;FPPYHPPMRTFLGVP;PPYHPPMRTFLGVPV;PYHPPMRTFLGVPVR;YHPPMRTFLGVPVRV;HPPMRTFLGVPVRVR;PPMRTFLGVPVRVRD;PMRTFLGVPVRVRDE;MRTFLGVPVRVRDES;RTFLGVPVRVRDESF;TFLGVPVRVRDESFG;FLGVPVRVRDESFGT;LGVPVRVRDESFGTL;GVPVRVRDESFGTLY;VPVRVRDESFGTLYL;PVRVRDESFGTLYLT;VRVRDESFGTLYLTD;RVRDESFGTLYLTDK;VRDESFGTLYLTDKT;RDESFGTLYLTDKTN;DESFGTLYLTDKTNG;ESFGTLYLTDKTNGQ;SFGTLYLTDKTNGQP;FGTLYLTDKTNGQPF;GTLYLTDKTNGQPFS;TLYLTDKTNGQPFSD;LYLTDKTNGQPFSDD;YLTDKTNGQPFSDDD;LTDKTNGQPFSDDDE;TDKTNGQPFSDDDEV;DKTNGQPFSDDDEVL;KTNGQPFSDDDEVLV;TNGQPFSDDDEVLVQ;NGQPFSDDDEVLVQA;GQPFSDDDEVLVQAL;QPFSDDDEVLVQALA;PFSDDDEVLVQALAA;FSDDDEVLVQALAAA;SDDDEVLVQALAAAA;DDDEVLVQALAAAAG;DDEVLVQALAAAAGI;DEVLVQALAAAAGIA;EVLVQALAAAAGIAV;VLVQALAAAAGIAVA;LVQALAAAAGIAVAN;VQALAAAAGIAVANA;QALAAAAGIAVANAR;ALAAAAGIAVANARL;LAAAAGIAVANARLY;AAAAGIAVANARLYQ;AAAGIAVANARLYQQ;AAGIAVANARLYQQA;AGIAVANARLYQQAK;GIAVANARLYQQAKA;IAVANARLYQQAKAR;AVANARLYQQAKARQ;VANARLYQQAKARQS;ANARLYQQAKARQSW;NARLYQQAKARQSWI;ARLYQQAKARQSWIE;RLYQQAKARQSWIEA;LYQQAKARQS | |

Fig. 30 continued

| | | |
|---|---|---|
| | WIEAT;YQQAKARQSWIEATR;QQAKARQSWIEATRD;QAKARQSWIEATRDI;AKARQSWIEATRDIA;KARQSWIEATRDIAT;ARQSWIEATRDIATE;RQSWIEATRDIATEL;QSWIEATRDIATELL;SWIEATRDIATELLS;WIEATRDIATELLSG;IEATRDIATELLSGT;EATRDIATELLSGTE;ATRDIATELLSGTEP;TRDIATELLSGTEPA;RDIATELLSGTEPAT;DIATELLSGTEPATV;IATELLSGTEPATVF;ATELLSGTEPATVFR;TELLSGTEPATVFRL;ELLSGTEPATVFRLV;LLSGTEPATVFRLVA;LSGTEPATVFRLVAA;SGTEPATVFRLVAAE;GTEPATVFRLVAAEA;TEPATVFRLVAAEAL;EPATVFRLVAAEALK;PATVFRLVAAEALKL;ATVFRLVAAEALKLT;TVFRLVAAEALKLTA;VFRLVAAEALKLTAA;FRLVAAEALKLTAAD;RLVAAEALKLTAADA;LVAAEALKLTAADAA;VAAEALKLTAADAAL;AAEALKLTAADAALV;AEALKLTAADAALVA;EALKLTAADAALVAV;ALKLTAADAALVAVP;LKLTAADAALVAVPV;KLTAADAALVAVPVD;LTAADAALVAVPVDE;TAADAALVAVPVDED;AADAALVAVPVDEDM;ADAALVAVPVDEDMP;DAALVAVPVDEDMPA;AALVAVPVDEDMPAA;ALVAVPVDEDMPAAD;LVAVPVDEDMPAADV;VAVPVDEDMPAADVG;AVPVDEDMPAADVGE;VPVDEDMPAADVGEL;PVDEDMPAADVGELL;VDEDMPAADVGELLV;DEDMPAADVGELLVI;EDMPAADVGELLVIE;DMPAADVGELLVIET;MPAADVGELLVIETV;PAADVGELLVIETVG;AADVGELLVIETVGS;ADVGELLVIETVGSA;DVGELLVIETVGSAV;VGELLVIETVGSAVA;GELLVIETVGSAVAS;ELLVIETVGSAVASI;LLVIETVGSAVASIV;LVIETVGSAVASIVG;VIETVGSAVASIVGR;IETVGSAVASIVGRT;ETVGSAVASIVGRTI;TVGSAVASIVGRTIP;VGSAVASIVGRTIPV;GSAVASIVGRTIPVA;SAVASIVGRTIPVAG;AVASIVGRTIPVAGA;VASIVGRTIPVAGAV;ASIVGRTIPVAGAVL;SIVGRTIPVAGAVLR;IVGRTIPVAGAVLRE;VGRTIPVAGAVLREV;GRTIPVAGAVLREVF;RTIPVAGAVLREVFV;TIPVAGAVLREVFVN;IPVAGAVLREVFVNG;PVAGAVLREVFVNGI;VAGAVLREVFVNGIP;AGAVLREVFVNGIPR;GAVLREVFVNGIPRR;AVLREVFVNGIPRRV;VLREVFVNGIPRRVD;LREVFVNGIPRRVDR;REVFVNGIPRRVDRV;EVFVNGIPRRVDRVD;VFVNGIPRRVDRVDL;FVNGIPRRVDRVDLE;VNGIPRRVDRVDLEG;NGIPRRVDRVDLEGL;GIPRRVDRVDLEGLD;IPRRVDRVDLEGLDE;PRRVDRVDLEGLDEL;RRVDRVDLEGLDELA;RVDRVDLEGLDELAD;VDRVDLEGLDELADA;DRVDLEGLDELADAG;RVDLEGLDELADAGP;VDLEGLDELADAGPA;DLEGLDELADAGPAL;LEGLDELADAGPALL;EGLDELADAGPALLL;GLDELADAGPALLLP;LDELADAGPALLLPL;DELADAGPALLLPLR;ELADAGPALLLPLRA;LADAGPALLLPLRAR;ADAGPALLLPLRARG;DAGPALLLPLRARGT;AGPALLLPLRARGTV;GPALLLPLRARGTVA;PALLLPLRARGTVAG;ALLLPLRARGTVAGV;LLLPLRARGTVAGVV;LLPLRARGTVAGVVV;LPLRARGTVAGVVVV;PLRARGTVAGVVVVL;LRARGTVAGVVVVLS;RARGTVAGVVVVLSQ;ARGTVAGVVVVLSQG;RGTVAGVVVVLSQGG;GTVAGVVVVLSQGGP;TVAGVVVVLSQGGPG;VAGVVVVLSQGGPGA;AGVVVVLSQGGPGAF;GVVVVLSQGGPGAFT;VVVVLSQGGPGAFTD;VVVLSQGGPGAFTDE;VVLSQGGPGAFTDEQ;VLSQGGPGAFTDEQL;LSQGGPGAFTDEQLE;SQGGPGAFTDEQLEM;QGGPGAFTDEQLEMM;GGPGAFTDEQLEMMA;GPGAFTDEQLEMMAA;PGAFTDEQLEMMAAF;GAFTDEQLEMMAAFA;AFTDEQLEMMAAFAD;FTDEQLEMMAAFADQ;TDEQLEMMAAFADQA;DEQLEMMAAFADQAA;EQLEMMAAFADQAAL;QLEMMAAFADQAALA;LEMMAAFADQAALAW;EMMAAFADQAALAWQ;MMAAFADQAALAWQL;MAAFADQAALAWQLA;AAFADQAALAWQLAT;AFADQAALAWQLATS;FADQAALAWQLATSQ;ADQAALAWQLATSQR;DQAALAWQLATSQRR;QAALAWQLATSQRRM;AALAWQLATSQRRMR;ALAWQLATSQRRMRE;LAWQLATSQRRMREL;AWQLATSQRRMRELD;WQLATSQRRMRELDV;QLATSQRRMRELDVL;LATSQRRMRELDVLT;ATSQRRMRELDVLTD;TSQRRMRELDVLTDR;SQRRMRELDVLTDRD;QRRMRELDVLTDRDR;RRMRELDVLTDRDRI;RMRELDVLTDRDRIA;MRELDVLTDRDRIAR;RELDVLTDRDRIARD;ELDVLTDRD | |

Fig. 30 continued

| | | |
|---|---|---|
| | RIARDL;LDVLTDRDRIARDLH;DVLTDRDRIARDLHD;VLTDRDRIARDLHDH;LTDRDRIARDLHDHV;TDRDRIARDLHDHVI;DRDRIARDLHDHVIQ;RDRIARDLHDHVIQR;DRIARDLHDHVIQRL;RIARDLHDHVIQRLF;IARDLHDHVIQRLFA;ARDLHDHVIQRLFAI;RDLHDHVIQRLFAIG;DLHDHVIQRLFAIGL;LHDHVIQRLFAIGLA;HDHVIQRLFAIGLAL;DHVIQRLFAIGLALQ;HVIQRLFAIGLALQG;VIQRLFAIGLALQGA;IQRLFAIGLALQGAV;QRLFAIGLALQGAVP;RLFAIGLALQGAVPH;LFAIGLALQGAVPHE;FAIGLALQGAVPHER;AIGLALQGAVPHERN;IGLALQGAVPHERNP;GLALQGAVPHERNPE;LALQGAVPHERNPEV;ALQGAVPHERNPEVQ;LQGAVPHERNPEVQQ;QGAVPHERNPEVQQR;GAVPHERNPEVQQRL;AVPHERNPEVQQRLS;VPHERNPEVQQRLSD;PHERNPEVQQRLSDV;HERNPEVQQRLSDVV;ERNPEVQQRLSDVVD;RNPEVQQRLSDVVDD;NPEVQQRLSDVVDDL;PEVQQRLSDVVDDLQ;EVQQRLSDVVDDLQD;VQQRLSDVVDDLQDV;QQRLSDVVDDLQDVI;QRLSDVVDDLQDVIQ;RLSDVVDDLQDVIQE;LSDVVDDLQDVIQEI;SDVVDDLQDVIQEIR;DVVDDLQDVIQEIRT;VVDDLQDVIQEIRTT;VDDLQDVIQEIRTTI;DDLQDVIQEIRTTIY;DLQDVIQEIRTTIYD;LQDVIQEIRTTIYDL;QDVIQEIRTTIYDLH;DVIQEIRTTIYDLHG;VIQEIRTTIYDLHGA;IQEIRTTIYDLHGAS;QEIRTTIYDLHGASQ;EIRTTIYDLHGASQG;IRTTIYDLHGASQGI;RTTIYDLHGASQGIT;TTIYDLHGASQGITR;TIYDLHGASQGITRL;IYDLHGASQGITRLR;YDLHGASQGITRLRQ;DLHGASQGITRLRQR;LHGASQGITRLRQRI;HGASQGITRLRQRID;GASQGITRLRQRIDA;ASQGITRLRQRIDAA;SQGITRLRQRIDAAV;QGITRLRQRIDAAVA;GITRLRQRIDAAVAQ;ITRLRQRIDAAVAQF;TRLRQRIDAAVAQFA;RLRQRIDAAVAQFAD;LRQRIDAAVAQFADS;RQRIDAAVAQFADSG;QRIDAAVAQFADSGL;RIDAAVAQFADSGLR;IDAAVAQFADSGLRT;DAAVAQFADSGLRTS;AAVAQFADSGLRTSV;AVAQFADSGLRTSVQ;VAQFADSGLRTSVQF;AQFADSGLRTSVQFV;QFADSGLRTSVQFVG;FADSGLRTSVQFVGP;ADSGLRTSVQFVGPL;DSGLRTSVQFVGPLS;SGLRTSVQFVGPLSV;GLRTSVQFVGPLSVV;LRTSVQFVGPLSVVD;RTSVQFVGPLSVVDS;TSVQFVGPLSVVDSA;SVQFVGPLSVVDSAL;VQFVGPLSVVDSALA;QFVGPLSVVDSALAD;FVGPLSVVDSALADQ;VGPLSVVDSALADQA;GPLSVVDSALADQAE;PLSVVDSALADQAEA;LSVVDSALADQAEAV;SVVDSALADQAEAVV;VVDSALADQAEAVVR;VDSALADQAEAVVRE;DSALADQAEAVVREA;SALADQAEAVVREAV;ALADQAEAVVREAVS;LADQAEAVVREAVSN;ADQAEAVVREAVSNA;DQAEAVVREAVSNAV;QAEAVVREAVSNAVR;AEAVVREAVSNAVRH;EAVVREAVSNAVRHA;AVVREAVSNAVRHAK;VVREAVSNAVRHAKA;VREAVSNAVRHAKAS;REAVSNAVRHAKAST;EAVSNAVRHAKASTL;AVSNAVRHAKASTLT;VSNAVRHAKASTLTV;SNAVRHAKASTLTVR;NAVRHAKASTLTVRV;AVRHAKASTLTVRVK;VRHAKASTLTVRVKV;RHAKASTLTVRVKVD;HAKASTLTVRVKVDD;AKASTLTVRVKVDDD;KASTLTVRVKVDDDL;ASTLTVRVKVDDDLC;STLTVRVKVDDDLCI;TLTVRVKVDDDLCIE;LTVRVKVDDDLCIEV;TVRVKVDDDLCIEVT;VRVKVDDDLCIEVTD;RVKVDDDLCIEVTDN;VKVDDDLCIEVTDNG;KVDDDLCIEVTDNGR;VDDDLCIEVTDNGRG;DDDLCIEVTDNGRGL;DDLCIEVTDNGRGLP;DLCIEVTDNGRGLPD;LCIEVTDNGRGLPDE;CIEVTDNGRGLPDEF;IEVTDNGRGLPDEFT;EVTDNGRGLPDEFTG;VTDNGRGLPDEFTGS;TDNGRGLPDEFTGSG;DNGRGLPDEFTGSGL;NGRGLPDEFTGSGLT;GRGLPDEFTGSGLTN;RGLPDEFTGSGLTNL;GLPDEFTGSGLTNLR;LPDEFTGSGLTNLRQ;PDEFTGSGLTNLRQR;DEFTGSGLTNLRQRA;EFTGSGLTNLRQRAE;FTGSGLTNLRQRAEQ;TGSGLTNLRQRAEQA;GSGLTNLRQRAEQAG;SGLTNLRQRAEQAGG;GLTNLRQRAEQAGGE;LTNLRQRAEQAGGEF;TNLRQRAEQAGGEFT;NLRQRAEQAGGEFTL;LRQRAEQAGGEFTLA;RQRAEQAGGEFTLAS;QRAEQAGGEFTLASV;RAEQAGGEFTLASVP;AEQAGGEFTLASVPG;EQAGGEFTLASVPGA;QAGGEFTLASVPGAS;AGGEFTLASVPGASG;GGEFTLASVPGASGT;GEFTLASV | |

Fig. 30 continued

| | | |
|---|---|---|
| | PGASGTV;EFTLASVPGASGTVL;FTLASVPGASGTVLR;TLASVPGASGTVL<br>RW;LASVPGASGTVLRWS;ASVPGASGTVLRWSA;SVPGASGTVLRWSAP;<br>VPGASGTVLRWSAPL;PGASGTVLRWSAPLS;GASGTVLRWSAPLSQ;<br>16 mers:<br>MTTGGLVDENDGAAMR;TTGGLVDENDGAAMRP;TGGLVDENDGAAMRP<br>L;GGLVDENDGAAMRPLR;GLVDENDGAAMRPLRH;LVDENDGAAMRPLR<br>HT;VDENDGAAMRPLRHTL;DENDGAAMRPLRHTLS;ENDGAAMRPLRHTL<br>SQ;NDGAAMRPLRHTLSQL;DGAAMRPLRHTLSQLR;GAAMRPLRHTLSQL<br>RL;AAMRPLRHTLSQLRLH;AMRPLRHTLSQLRLHE;MRPLRHTLSQLRLHE<br>L;RPLRHTLSQLRLHELL;PLRHTLSQLRLHELLV;LRHTLSQLRLHELLVE;RH<br>TLSQLRLHELLVEV;HTLSQLRLHELLVEVQ;TLSQLRLHELLVEVQD;LSQLR<br>LHELLVEVQDR;SQLRLHELLVEVQDRV;QLRLHELLVEVQDRVE;LRLHELL<br>VEVQDRVEQ;RLHELLVEVQDRVEQI;LHELLVEVQDRVEQIV;HELLVEVQD<br>RVEQIVE;ELLVEVQDRVEQIVEG;LLVEVQDRVEQIVEGR;LVEVQDRVEQI<br>VEGRD;VEVQDRVEQIVEGRDR;EVQDRVEQIVEGRDRL;VQDRVEQIVEG<br>RDRLD;QDRVEQIVEGRDRLDG;DRVEQIVEGRDRLDGL;RVEQIVEGRDRL<br>DGLV;VEQIVEGRDRLDGLVE;EQIVEGRDRLDGLVEA;QIVEGRDRLDGLV<br>EAM;IVEGRDRLDGLVEAML;VEGRDRLDGLVEAMLV;EGRDRLDGLVEAM<br>LVV;GRDRLDGLVEAMLVVT;RDRLDGLVEAMLVVTA;DRLDGLVEAMLVVT<br>AG;RLDGLVEAMLVVTAGL;LDGLVEAMLVVTAGLD;DGLVEAMLVVTAGLD<br>L;GLVEAMLVVTAGLDLE;LVEAMLVVTAGLDLEA;VEAMLVVTAGLDLEAT;E<br>AMLVVTAGLDLEATL;AMLVVTAGLDLEATLR;MLVVTAGLDLEATLRA;LVV<br>TAGLDLEATLRAI;VVTAGLDLEATLRAIV;VTAGLDLEATLRAIVH;TAGLDLE<br>ATLRAIVHS;AGLDLEATLRAIVHSA;GLDLEATLRAIVHSAT;LDLEATLRAIV<br>HSATS;DLEATLRAIVHSATSL;LEATLRAIVHSATSLV;EATLRAIVHSATSLV<br>D;ATLRAIVHSATSLVDA;TLRAIVHSATSLVDAR;LRAIVHSATSLVDARY;RAI<br>VHSATSLVDARYG;AIVHSATSLVDARYGA;IVHSATSLVDARYGAM;VHSAT<br>SLVDARYGAME;HSATSLVDARYGAMEV;SATSLVDARYGAMEVH;ATSLV<br>DARYGAMEVHD;TSLVDARYGAMEVHDR;SLVDARYGAMEVHDRQ;LVDA<br>RYGAMEVHDRQH;VDARYGAMEVHDRQHR;DARYGAMEVHDRQHRV;AR<br>YGAMEVHDRQHRVL;RYGAMEVHDRQHRVLH;YGAMEVHDRQHRVLHF;<br>GAMEVHDRQHRVLHFV;AMEVHDRQHRVLHFVY;MEVHDRQHRVLHFVYE<br>;EVHDRQHRVLHFVYEG;VHDRQHRVLHFVYEGI;HDRQHRVLHFVYEGID;<br>DRQHRVLHFVYEGIDE;RQHRVLHFVYEGIDEE;QHRVLHFVYEGIDEET;H<br>RVLHFVYEGIDEETV;RVLHFVYEGIDEETVR;VLHFVYEGIDEETVRR;LHFV<br>YEGIDEETVRRI;HFVYEGIDEETVRRIG;FVYEGIDEETVRRIGH;VYEGIDEE<br>TVRRIGHL;YEGIDEETVRRIGHLP;EGIDEETVRRIGHLPK;GIDEETVRRIGH<br>LPKG;IDEETVRRIGHLPKGL;DEETVRRIGHLPKGLG;EETVRRIGHLPKGLG<br>V;ETVRRIGHLPKGLGVI;TVRRIGHLPKGLGVIG;VRRIGHLPKGLGVIGL;RRI<br>GHLPKGLGVIGLL;RIGHLPKGLGVIGLLI;IGHLPKGLGVIGLLIE;GHLPKGLG<br>VIGLLIED;HLPKGLGVIGLLIEDP;LPKGLGVIGLLIEDPK;PKGLGVIGLLIEDP<br>KP;KGLGVIGLLIEDPKPL;GLGVIGLLIEDPKPLR;LGVIGLLIEDPKPLRL;GVI<br>GLLIEDPKPLRLD;VIGLLIEDPKPLRLDD;IGLLIEDPKPLRLDDV;GLLIEDPK<br>PLRLDDVS;LLIEDPKPLRLDDVSA;LIEDPKPLRLDDVSAH;IEDPKPLRLDDV<br>SAHP;EDPKPLRLDDVSAHPA;DPKPLRLDDVSAHPAS;PKPLRLDDVSAHP<br>ASI;KPLRLDDVSAHPASIG;PLRLDDVSAHPASIGF;LRLDDVSAHPASIGFP;<br>RLDDVSAHPASIGFPP;LDDVSAHPASIGFPPY;DDVSAHPASIGFPPYH;DV<br>SAHPASIGFPPYHP;VSAHPASIGFPPYHPP;SAHPASIGFPPYHPPM;AHPA<br>SIGFPPYHPPMR;HPASIGFPPYHPPMRT;PASIGFPPYHPPMRTF;ASIGFP<br>PYHPPMRTFL;SIGFPPYHPPMRTFLG;IGFPPYHPPMRTFLGV;GFPPYHPP<br>MRTFLGVP;FPPYHPPMRTFLGVPV;PPYHPPMRTFLGVPVR;PYHPPMRT<br>FLGVPVRV;YHPPMRTFLGVPVRVR;HPPMRTFLGVPVRVRD;PPMRTFLG<br>VPVRVRDE;PMRTFLGVPVRVRDES;MRTFLGVPVRVRDESF;RTFLGVPV | |

Fig. 30 continued

| | | |
|---|---|---|
| | RVRDESFG;TFLGVPVRVRDESFGT;FLGVPVRVRDESFGTL;LGVPVRVRDESFGTLY;GVPVRVRDESFGTLYL;VPVRVRDESFGTLYLT;PVRVRDESFGTLYLTD;VRVRDESFGTLYLTDK;RVRDESFGTLYLTDKT;VRDESFGTLYLTDKTN;RDESFGTLYLTDKTNG;DESFGTLYLTDKTNGQ;ESFGTLYLTDKTNGQP;SFGTLYLTDKTNGQPF;FGTLYLTDKTNGQPFS;GTLYLTDKTNGQPFSD;TLYLTDKTNGQPFSDD;LYLTDKTNGQPFSDDD;YLTDKTNGQPFSDDDE;LTDKTNGQPFSDDDEV;TDKTNGQPFSDDDEVL;DKTNGQPFSDDDEVLV;KTNGQPFSDDDEVLVQ;TNGQPFSDDDEVLVQA;NGQPFSDDDEVLVQAL;GQPFSDDDEVLVQALA;QPFSDDDEVLVQALAA;PFSDDDEVLVQALAAA;FSDDDEVLVQALAAAA;SDDDEVLVQALAAAAG;DDDEVLVQALAAAAGI;DDEVLVQALAAAAGIA;DEVLVQALAAAAGIAV;EVLVQALAAAAGIAVA;VLVQALAAAAGIAVAN;LVQALAAAAGIAVANA;VQALAAAAGIAVANAR;QALAAAAGIAVANARL;ALAAAAGIAVANARLY;LAAAAGIAVANARLYQ;AAAAGIAVANARLYQQ;AAAGIAVANARLYQQA;AAGIAVANARLYQQAK;AGIAVANARLYQQAKA;GIAVANARLYQQAKAR;IAVANARLYQQAKARQ;AVANARLYQQAKARQS;VANARLYQQAKARQSW;ANARLYQQAKARQSWI;NARLYQQAKARQSWIE;ARLYQQAKARQSWIEA;RLYQQAKARQSWIEAT;LYQQAKARQSWIEATR;YQQAKARQSWIEATRD;QQAKARQSWIEATRDI;QAKARQSWIEATRDIA;AKARQSWIEATRDIAT;KARQSWIEATRDIATE;ARQSWIEATRDIATEL;RQSWIEATRDIATELL;QSWIEATRDIATELLS;SWIEATRDIATELLSG;WIEATRDIATELLSGT;IEATRDIATELLSGTE;EATRDIATELLSGTEP;ATRDIATELLSGTEPA;TRDIATELLSGTEPAT;RDIATELLSGTEPATV;DIATELLSGTEPATVF;IATELLSGTEPATVFR;ATELLSGTEPATVFRL;TELLSGTEPATVFRLV;ELLSGTEPATVFRLVA;LLSGTEPATVFRLVAA;LSGTEPATVFRLVAAE;SGTEPATVFRLVAAEA;GTEPATVFRLVAAEAL;TEPATVFRLVAAEALK;EPATVFRLVAAEALKL;PATVFRLVAAEALKLT;ATVFRLVAAEALKLTA;TVFRLVAAEALKLTAA;VFRLVAAEALKLTAAD;FRLVAAEALKLTAADA;RLVAAEALKLTAADAA;LVAAEALKLTAADAAL;VAAEALKLTAADAALV;AAEALKLTAADAALVA;AEALKLTAADAALVAV;EALKLTAADAALVAVP;ALKLTAADAALVAVPV;LKLTAADAALVAVPVD;KLTAADAALVAVPVDE;LTAADAALVAVPVDED;TAADAALVAVPVDEDM;AADAALVAVPVDEDMP;ADAALVAVPVDEDMPA;DAALVAVPVDEDMPAA;AALVAVPVDEDMPAAD;ALVAVPVDEDMPAADV;LVAVPVDEDMPAADVG;VAVPVDEDMPAADVGE;AVPVDEDMPAADVGEL;VPVDEDMPAADVGELL;PVDEDMPAADVGELLV;VDEDMPAADVGELLVI;DEDMPAADVGELLVIE;EDMPAADVGELLVIET;DMPAADVGELLVIETV;MPAADVGELLVIETVG;PAADVGELLVIETVGS;AADVGELLVIETVGSA;ADVGELLVIETVGSAV;DVGELLVIETVGSAVA;VGELLVIETVGSAVAS;GELLVIETVGSAVASI;ELLVIETVGSAVASIV;LLVIETVGSAVASIVG;LVIETVGSAVASIVGR;VIETVGSAVASIVGRT;IETVGSAVASIVGRTI;ETVGSAVASIVGRTIP;TVGSAVASIVGRTIPV;VGSAVASIVGRTIPVA;GSAVASIVGRTIPVAG;SAVASIVGRTIPVAGA;AVASIVGRTIPVAGAV;VASIVGRTIPVAGAVL;ASIVGRTIPVAGAVLR;SIVGRTIPVAGAVLRE;IVGRTIPVAGAVLREV;VGRTIPVAGAVLREVF;GRTIPVAGAVLREVFV;RTIPVAGAVLREVFVN;TIPVAGAVLREVFVNG;IPVAGAVLREVFVNGI;PVAGAVLREVFVNGIP;VAGAVLREVFVNGIPR;AGAVLREVFVNGIPRR;GAVLREVFVNGIPRRV;AVLREVFVNGIPRRVD;VLREVFVNGIPRRVDR;LREVFVNGIPRRVDRV;REVFVNGIPRRVDRVD;EVFVNGIPRRVDRVDL;VFVNGIPRRVDRVDLE;FVNGIPRRVDRVDLEG;VNGIPRRVDRVDLEGL;NGIPRRVDRVDLEGLD;GIPRRVDRVDLEGLDE;IPRRVDRVDLEGLDEL;PRRVDRVDLEGLDELA;RRVDRVDLEGLDELAD;RVDRVDLEGLDELADA;VDRVDLEGLDELADAG;DRVDLEGLDELADAGP;RVDLEGLDELADAGPA;VDLEGLDELADAGPAL;DLEGLDELADAGPALL;LEGLDELADAGPALLL;EGLDELADAGPALLLP;GLDELADAGPALLLPL;LDELADAGPALLLPLR;DELADAGPALLLPLRA;ELADAGPALLLPLRAR;LADAGPALLLPLRARG;ADAGPAL | |

Fig. 30 continued

| | | |
|---|---|---|
| | LLPLRARGT;DAGPALLLPLRARGTV;AGPALLLPLRARGTVA;GPALLLPLRARGTVAG;PALLLPLRARGTVAGV;ALLLPLRARGTVAGVV;LLLPLRARGTVAGVVV;LLPLRARGTVAGVVVV;LPLRARGTVAGVVVVL;PLRARGTVAGVVVVLS;LRARGTVAGVVVVLSQ;RARGTVAGVVVVLSQG;ARGTVAGVVVVLSQGG;RGTVAGVVVVLSQGGP;GTVAGVVVVLSQGGPG;TVAGVVVVLSQGGPGA;VAGVVVVLSQGGPGAF;AGVVVVLSQGGPGAFT;GVVVVLSQGGPGAFTD;VVVVLSQGGPGAFTDE;VVVLSQGGPGAFTDEQ;VVLSQGGPGAFTDEQL;VLSQGGPGAFTDEQLE;LSQGGPGAFTDEQLEM;SQGGPGAFTDEQLEMM;QGGPGAFTDEQLEMMA;GGPGAFTDEQLEMMAA;GPGAFTDEQLEMMAAF;PGAFTDEQLEMMAAFA;GAFTDEQLEMMAAFAD;AFTDEQLEMMAAFADQ;FTDEQLEMMAAFADQA;TDEQLEMMAAFADQAA;DEQLEMMAAFADQAAL;EQLEMMAAFADQAALA;QLEMMAAFADQAALAW;LEMMAAFADQAALAWQ;EMMAAFADQAALAWQL;MMAAFADQAALAWQLA;MAAFADQAALAWQLAT;AAFADQAALAWQLATS;AFADQAALAWQLATSQ;FADQAALAWQLATSQR;ADQAALAWQLATSQRR;DQAALAWQLATSQRRM;QAALAWQLATSQRRMR;AALAWQLATSQRRMRE;ALAWQLATSQRRMREL;LAWQLATSQRRMRELD;AWQLATSQRRMRELDV;WQLATSQRRMRELDVL;QLATSQRRMRELDVLT;LATSQRRMRELDVLTD;ATSQRRMRELDVLTDR;TSQRRMRELDVLTDRD;SQRRMRELDVLTDRDR;QRRMRELDVLTDRDRI;RRMRELDVLTDRDRIA;RMRELDVLTDRDRIAR;MRELDVLTDRDRIARD;RELDVLTDRDRIARDL;ELDVLTDRDRIARDLH;LDVLTDRDRIARDLHD;DVLTDRDRIARDLHDH;VLTDRDRIARDLHDHV;LTDRDRIARDLHDHVI;TDRDRIARDLHDHVIQ;DRDRIARDLHDHVIQR;RDRIARDLHDHVIQRL;DRIARDLHDHVIQRLF;RIARDLHDHVIQRLFA;IARDLHDHVIQRLFAI;ARDLHDHVIQRLFAIG;RDLHDHVIQRLFAIGL;DLHDHVIQRLFAIGLA;LHDHVIQRLFAIGLAL;HDHVIQRLFAIGLALQ;DHVIQRLFAIGLALQG;HVIQRLFAIGLALQGA;VIQRLFAIGLALQGAV;IQRLFAIGLALQGAVP;QRLFAIGLALQGAVPH;RLFAIGLALQGAVPHE;LFAIGLALQGAVPHER;FAIGLALQGAVPHERN;AIGLALQGAVPHERNP;IGLALQGAVPHERNPE;GLALQGAVPHERNPEV;LALQGAVPHERNPEVQ;ALQGAVPHERNPEVQQ;LQGAVPHERNPEVQQR;QGAVPHERNPEVQQRL;GAVPHERNPEVQQRLS;AVPHERNPEVQQRLSD;VPHERNPEVQQRLSDV;PHERNPEVQQRLSDVV;HERNPEVQQRLSDVVD;ERNPEVQQRLSDVVDD;RNPEVQQRLSDVVDDL;NPEVQQRLSDVVDDLQ;PEVQQRLSDVVDDLQD;EVQQRLSDVVDDLQDV;VQQRLSDVVDDLQDVI;QQRLSDVVDDLQDVIQ;QRLSDVVDDLQDVIQE;RLSDVVDDLQDVIQEI;LSDVVDDLQDVIQEIR;SDVVDDLQDVIQEIRT;DVVDDLQDVIQEIRTT;VVDDLQDVIQEIRTTI;VDDLQDVIQEIRTTIY;DDLQDVIQEIRTTIYD;DLQDVIQEIRTTIYDL;LQDVIQEIRTTIYDLH;QDVIQEIRTTIYDLHG;DVIQEIRTTIYDLHGA;VIQEIRTTIYDLHGAS;IQEIRTTIYDLHGASQ;QEIRTTIYDLHGASQG;EIRTTIYDLHGASQGI;IRTTIYDLHGASQGIT;RTTIYDLHGASQGITR;TTIYDLHGASQGITRL;TIYDLHGASQGITRLR;IYDLHGASQGITRLRQ;YDLHGASQGITRLRQR;DLHGASQGITRLRQRI;LHGASQGITRLRQRID;HGASQGITRLRQRIDA;GASQGITRLRQRIDAA;ASQGITRLRQRIDAAV;SQGITRLRQRIDAAVA;QGITRLRQRIDAAVAQ;GITRLRQRIDAAVAQF;ITRLRQRIDAAVAQFA;TRLRQRIDAAVAQFAD;RLRQRIDAAVAQFADS;LRQRIDAAVAQFADSG;RQRIDAAVAQFADSGL;QRIDAAVAQFADSGLR;RIDAAVAQFADSGLRT;IDAAVAQFADSGLRTS;DAAVAQFADSGLRTSV;AAVAQFADSGLRTSVQ;AVAQFADSGLRTSVQF;VAQFADSGLRTSVQFV;AQFADSGLRTSVQFVG;QFADSGLRTSVQFVGP;FADSGLRTSVQFVGPL;ADSGLRTSVQFVGPLS;DSGLRTSVQFVGPLSV;SGLRTSVQFVGPLSVV;GLRTSVQFVGPLSVVD;LRTSVQFVGPLSVVDS;RTSVQFVGPLSVVDSA;TSVQFVGPLSVVDSAL;SVQFVGPLSVVDSALA;VQFVGPLSVVDSALAD;QFVGPLSVVDSALADQ;FVGPLSVVDSALADQA;VGPLSVVDSALADQAE;GPLSVVDSALADQAEA;PLSVVDSALADQAEAV;LSVVDSALADQA | |

Fig. 30 continued

| | | |
|---|---|---|
| | EAVV;SVVDSALADQAEAVVR;VVDSALADQAEAVVRE;VDSALADQAEAVVREA;DSALADQAEAVVREAV;SALADQAEAVVREAVS;ALADQAEAVVREAVSN;LADQAEAVVREAVSNA;ADQAEAVVREAVSNAV;DQAEAVVREAVSNAVR;QAEAVVREAVSNAVRH;AEAVVREAVSNAVRHA;EAVVREAVSNAVRHAK;AVVREAVSNAVRHAKA;VVREAVSNAVRHAKAS;VREAVSNAVRHAKAST;REAVSNAVRHAKASTL;EAVSNAVRHAKASTLT;AVSNAVRHAKASTLTV;VSNAVRHAKASTLTVR;SNAVRHAKASTLTVRV;NAVRHAKASTLTVRVK;AVRHAKASTLTVRVKV;VRHAKASTLTVRVKVD;RHAKASTLTVRVKVDD;HAKASTLTVRVKVDDD;AKASTLTVRVKVDDDL;KASTLTVRVKVDDDLC;ASTLTVRVKVDDDLCI;STLTVRVKVDDDLCIE;TLTVRVKVDDDLCIEV;LTVRVKVDDDLCIEVT;TVRVKVDDDLCIEVTD;VRVKVDDDLCIEVTDN;RVKVDDDLCIEVTDNG;VKVDDDLCIEVTDNGR;KVDDDLCIEVTDNGRG;VDDDLCIEVTDNGRGL;DDDLCIEVTDNGRGLP;DDLCIEVTDNGRGLPD;DLCIEVTDNGRGLPDE;LCIEVTDNGRGLPDEF;CIEVTDNGRGLPDEFT;IEVTDNGRGLPDEFTG;EVTDNGRGLPDEFTGS;VTDNGRGLPDEFTGSG;TDNGRGLPDEFTGSGL;DNGRGLPDEFTGSGLT;NGRGLPDEFTGSGLTN;GRGLPDEFTGSGLTNL;RGLPDEFTGSGLTNLR;GLPDEFTGSGLTNLRQ;LPDEFTGSGLTNLRQR;PDEFTGSGLTNLRQRA;DEFTGSGLTNLRQRAE;EFTGSGLTNLRQRAEQ;FTGSGLTNLRQRAEQA;TGSGLTNLRQRAEQAG;GSGLTNLRQRAEQAGG;SGLTNLRQRAEQAGGE;GLTNLRQRAEQAGGEF;LTNLRQRAEQAGGEFT;TNLRQRAEQAGGEFTL;NLRQRAEQAGGEFTLA;LRQRAEQAGGEFTLAS;RQRAEQAGGEFTLASV;QRAEQAGGEFTLASVP;RAEQAGGEFTLASVPG;AEQAGGEFTLASVPGA;EQAGGEFTLASVPGAS;QAGGEFTLASVPGASG;AGGEFTLASVPGASGT;GGEFTLASVPGASGTV;GEFTLASVPGASGTVL;EFTLASVPGASGTVLR;FTLASVPGASGTVLRW;TLASVPGASGTVLRWS;LASVPGASGTVLRWSA;ASVPGASGTVLRWSAP;SVPGASGTVLRWSAPL;VPGASGTVLRWSAPLS;PGASGTVLRWSAPLSQ | |
| 35 | **<YP_177963.1 PPE family protein Rv3347c;Mycobacterium tuberculosis H37Rv>** MNFPVLPPEINSVLMYSGAGSSPLLAAAAAWDGLAEELGSAAVSFGQVTSGLTAGVWQGAAAAAMAAAAAPYAGWLGSVAAQAVAVAGQARAAVAAFEAALAATVDPAAVAVNRMAMRALAMSNLLGQNAAAIAAVEAEYELMWAADVAAMAGYHSGASAAAAALPAFSPPAQALGGGVGAFLNALFAGPAKMLRLNAGLGNVGNYNVGLGNVGIFNLGAANVGAQNLGAANAGSGNFGFGNIGNANFGFGNSGLGLPPGMGNIGLGNAGSSNYGLANLGVGNIGFANTGSNNIGIGLTGDNLTGIGGLNSGTGNLGLFNSGTGNIGFFNSGTGNFGVFNSGSYNTGVGNAGTASTGLFNVGGFNTGVANVGSYNTGSFNAGNTNTGGFNPGNVNTGWLNTGNTNTGIANSGNVNTGAFISGNFSNGVLWRGDYEGLWGLSGGSTIPAIPIGLELNGGVGPITVLPIQILPTIPLNIHQTFSLGPLVVPDIVIPAFGGGTAIPISVGPITISPITLFPAQNFNTTFPVGPFFGLGVVNISGIEIKDLAGNVTLQLGNLNIDTRINQSFPVTVNWSTPAVTIFPNGISIPNNPLALLASASIGTLGFTIPGFTIPAAPLPLTIDIDGQIDGFSTPPITIDRIPLNLGASVTVGPILINGVNIPATPGFGNTTTAPSSGFFNSGDGGVSGFGNFGAGSSGWWNQAQTEVAGAGSGFANFGSLGSGVLNFGSGVSGLYNTGGLPPGTPAVVSGIGNVGEQLSGLSSAGTALNQSLIINLGLADVGSVNVGFGNVGDFNLGAANIGDLNVGLGNVGGGNVGFGNIGDANFGLGNAGLAAGLAGVGNIGLGNAGSGNVGFGNMGVGNIGFGNTGTNNLGIGLTGDNQTGIGGLNSGAGNIGLFNSGTGNVGLFNSGTGNFGLFNSGSFNTGIGNGGTGSTGLFNAGNFNTGVANPGSYNTGSFNVGDTNTGGFNPGSINTGWFNTGNANTGVANSGNVDTGALMSGNFSNGILWRGNFEGLFGLNVGITIPEFPIHWTSTGGIGPIIIPDTTILPPIHLGLTGQANYGFAVPDIPIPAIHIDFDGAADAGFTAPATTLLSALGITGQFRFGPITVSNVQLNPFNVNLKLQFLHDAFPNEFPDPTISVQIQVAIPLTSATLGGLALPLQQTIDAIELPAISFSQSIPIDIPPIDIPASTINGISMSEVVPIDVSVDIPAVTITGTRIDPIPLNFDVLSS | 175641-190439 |

Fig. 30 continued

AGPINISIIDIPALPGFGNSTELPSSGFFNTGGGGGSGIANFGAGVSGLLNQ
ASSPMVGTLSGLGNAGSLASGVLNSGVDISGMFNVSTLGSAPAVISGFGN
LGNHVSGVSIDGLLAMLTSGGSGGSGQPSIIDAAIAELRHLNPLNIVNLGNV
GSYNLGFANVGDVNLGAGNLGNLNLGGGNLGGQNLGLGNLGDGNVGFG
NLGHGNVGFGNSGLGALPGIGNIGLGNAGSNNVGFGNMGLGNIGFGNTG
TNNLGIGLTGDNQTGFGGLNSGAGNLGLFNSGTGNIGFFNTGTGNWGLFN
SGSYNTGIGNSGTGSTGLFNAGSFNTGLANAGSYNTGSLNAGNTNTGGF
NPGNVNTGWFNAGHTNTGGFNTGNVNTGAFNSGSFNNGALWTGDHHGL
VGFSYSIEITGSTLVDINETLNLGPVHIDQIDIPGMSLFDIHELVNIGPFRIEPID
VPAVVLDIHETMVIPPIVFLPSMTIGGQTYTIPLDTPPAPAPPPFRLPLLFVNA
LGDNWIVGASNSTGMSGGFVTAPTQGILIHTGPSSATTGSLALTLPTVTIPTI
TTSPIPLKIDVSGGLPAFTLFPGGLNIPQNAIPLTIDASGVLDPITIFPGGFTID
PLPLSLALNISVPDSSVPIIIVPPTPGFGNATATPSSGFFNSGAGGVSGFGN
FGAGSSGWWNQAHAALAGAGSGVLNVGTLNSGVLNVGSGISGLYNTAIV
GLGTPALVSGAGNVGQQLSGVLAAGTALTQSPIINLGLADVGNYNLGLGNV
GDFNLGAANLGDLNLGLGNIGNANVGFGNIGHGNVGFGNSGLGAALGIGNI
GLGNAGSTNVGLANMGVGNIGFANTGTNNLGIGLTGDNQTGIGGLNSGAG
NIGLFNSGTGNIGFFNSGTGNWGLFNSGSFNTGIGNSGTGSTGLFNAGGF
TTGLANAGSYNTGSFNVGDTNTGGFNPGSINTGWFNTGNANTGIANSGNV
DTGALMSGNFSNGILWRGNYEGLFSYSYSLDVPRITILDAHFTGAFGPVVV
PPIPVLAINAHLTGNAAMGAFTIPQIDIPALNPNVTGSVGFGPIAVPSVTIPAL
TAARAVLDMAASVGATSEIEPFIVWTSSGAIGPTWYSVGRIYNAGDLFVGG
NIISGIPTLSTTGPVHAVFNAASQAFNTPALNIHQIPLGFQVPGSIDAITLFPG
GLTFPANSLLNLDVFVGTPGATIPAITFPEIPANADGELYVIAGDIPLINIPPTP
GIGNTTTVPSSGFFNTGAGGGSGFGNFGANMSGWWNQAHTALAGAGSGI
ANVGTLHSGVLNLGSGLSGIYNTSTLPLGTPALVSGLGNVGDHLSGLLASN
VGQNPITIVNIGLANVGNGNVGLGNIGNLNLGAANIGDVNLGFGNIGDVNLG
FGNIGGGNVGFGNIGDANFGFGNSGLAAGLAGMGNIGLGNAGSGNVGWA
NMGLGNIGFGNTGTNNLGIGLTGDNQSGIGGLNSGTGNIGLFNSGTGNIGF
FNSGTANFGLFNSGSYNTGIGNSGVASTGLVNAGGFNTGVANAGSYNTG
SFNAGDTNTGGFNPGSTNTGWFNTGNANTGVANAGNVNTGALITGNFSN
GILWRGNYEGLAGFSFGYPIPLFPAVGADVTGDIGPATIIPPIHIPSIPLGFAAI
GHIGPISIPNIAIPSIHLGIDPTFDVGPITVDPITLTIPGLSLDAAVSEIRMTSGS
SSGFKVRPSFSFFAVGPDGMPGGEVSILQPFTVAPINLNPTTLHFPGFTIPT
GPIHIGLPLSLTIPGFTIPGGTLIPQLPLGLGLSGGTPPFDLPTVVIDRIPVELH
ASTTIGPVSLPIFGFGGAPGFGNDTTAPSSGFFNTGGGGGSGFSNSGSGM
SGVLNAISDPLLGSASGFANFGTQLSGILNRGAGISGVYNTGTLGLVTSAFV
SGFMNVGQQLSGLLFAGTGP

8mer
FPVLPPEI;VLPPEINS;LPPEINSV;EINSVLMY;SVLMYSGA;LMYSGAGS;SG
AGSSPL;SPLLAAAA;PLLAAAAA;LLAAAAAW;AAAAWDGL;GLAEELGS;AE
ELGSAA;EELGSAAV;AAVSFGQV;TSGLTAGV;SGLTAGVW;GLTAGVWQ;
GVWQGAAA;WQGAAAAA;QGAAAAAM;AAAAAMAA;AAAAMAAA;AAMAA
AAA;MAAAAAPY;AAAAAPYA;AAAPYAGW;YAGWLGSV;WLGSVAAQ;SVA
AQAVA;VAAQAVAV;VAVAGQAR;GQARAAVA;ARAAVAAF;AAVAAFEA;AV
AAFEAA;VAAFEAAL;AAFEAALA;FEAALAAT;EAALAATV;LAATVDPA;ATV
DPAAV;TVDPAAVA;VAVNRMAM;AVNRMAMR;NRMAMRAL;RMAMRALA;
MAMRALAM;RALAMSNL;ALAMSNLL;AMSNLLGQ;NLLGQNAA;LLGQNAA
A;GQNAAAIA;NAAAIAAV;AAIAAVEA;IAAVEAEY;AVEAEYEL;VEAEYELM;E
AEYELMW;AEYELMWA;ELMWAADV;LMWAADVA;WAADVAAM;DVAAMA
GY;AMAGYHSG;MAGYHSGA;ASAAAAAL;AAAAALPA;AAAALPAF;LPAFS
PPA;FSPPAQAL;AQALGGGV;ALGGGVGA;FLNALFAG;NALFAGPA;ALFA

Fig. 30 continued

| | | |
|---|---|---|
| | GPAK;GPAKMLRL;MLRLNAGL;GIFNLGAA;IGNANFGF;FGFGNSGL;FGNSGLGL;LPPGMGNI;YGLANLGV;GLTGDNLT;NLTGIGGL;GTGNIGFF;SGTGNFGV;GVFNSGSY;SGSYNTGV;GTASTGLF;ASTGLFNV;GLFNVGGF;GVANVGSY;GSYNTGSF;GIANSGNV;NVNTGAFI;SGNFSNGV;FSNGVLWR;VLWRGDYE;RGDYEGLW;DYEGLWGL;GLWGLSGG;GLSGGSTI;STIPAIPI;IPAIPIGL;AIPIGLEL;GLELNGGV;GVGPITVL;GPITVLPI;ITVLPIQI;TVLPIQIL;LPIQILPT;QILPTIPL;LPTIPLNI;IPLNIHQT;NIHQTFSL;QTFSLGPL;FSLGPLVV;SLGPLVVP;GPLVVPDI;PLVVPDIV;LVVPDIVI;VPDIVIPA;IPAFGGGT;GTAIPISV;IPISVGPI;GPITISPI;ITISPITL;TISPITLF;SPITLFPA;TLFPAQNF;FPAQNFNT;AQNFNTTF;TTFPVGPF;TFPVGPFF;FPVGPFFG;PVGPFFGL;GPFFGLGV;GVVNISGI;NISGIEIK;DLAGNVTL;LQLGNLNI;NLNIDTRI;DTRINQSF;RINQSFPV;NQSFPVTV;SFPVTVNW;FPVTVNWS;TVNWSTPA;VNWSTPAV;STPAVTIF;VTIFPNGI;IFPNGISI;FPNGISIP;ISIPNNPL;SIPNNPLA;IPNNPLAL;NPLALLAS;PLALLASA;ALLASASI;ASIGTLGF;FTIPGFTI;IPGFTIPA;FTIPAAPL;IPAAPLPL;LPLTIDID;TIDIDGQI;GQIDGFST;FSTPPITI;PPITIDRI;ITIDRIPL;RIPLNLGA;IPLNLGAS;PLNLGASV;NLGASVTV;SVTVGPIL;VTVGPILI;GPILINGV;ILINGVNI;NIPATPGF;TPGFGNTT;TTAPSSGF;SGFGNFGA;FGAGSSGW;NQAQTEVA;AQTEVAGA;FGSLGSGV;VLNFGSGV;FGSGVSGL;GSGVSGLY;GLYNTGGL;GLPPGTPA;LPPGTPAV;PPGTPAVV;TPAVVSGI;VVSGIGNV;QLSGLSSA;GLSSAGTA;LSSAGTAL;GTALNQSL;ALNQSLII;NQSLIINL;SLIINLGL;LIINLGLA;GLADVGSV;GFGNVGDF;GLGNAGLA;LAAGLAGV;GLAGVGNI;VGFGNMGV;GLTGDNQT;SGAGNIGL;SGTGNFGL;GLFNSGSF;SGSFNTGI;GLFNAGNF;GVANPGSY;GSYNTGSF;GSINTGWF;TGNANTGV;GVANSGNV;NVDTGALM;ALMSGNFS;FSNGILWR;ILWRGNFE;EGLFGLNV;GLNVGITI;VGITIPEF;ITIPEFPI;IPEFPIHW;FPIHWTST;STGGIGPI;IIIPDTTI;IIPDTTIL;DTTILPPI;TILPPIHL;ILPPIHLG;LPPIHLGL;HLGLTGQA;GQANYGFA;QANYGFAV;FAVPDIPI;VPDIPIPA;IPIPAIHI;IPAIHIDF;AADAGFTA;FTAPATTL;TAPATTLL;TLLSALGI;LLSALGIT;GQFRFGPI;FRFGPITV;GPITVSNV;VQLNPFNV;NPFNVNLK;KLQFLHDA;LQFLHDAF;FLHDAFPN;FPNEFPDP;NEFPDPTI;FPDPTISV;TISVQIQV;SVQIQVAI;IQVAIPLT;VAIPLTSA;IPLTSATL;TSATLGGL;ATLGGLAL;GLALPLQQ;ALPLQQTI;LQQTIDAI;QTIDAIEL;DAIELPAI;IELPAISF;ELPAISFS;LPAISFSQ;AISFSQSI;IPIDIPPI;IPPIDIPA;STINGISM;NGISMSEV;GISMSEVV;SMSEVVPI;SEVVPIDV;EVVPIDVS;VVPIDVSV;DVSVDIPA;VSVDIPAV;AVTITGTR;TGTRIDPI;TRIDPIPL;PIPLNFDV;IPLNFDVL;VLSSAGPI;SSAGPINI;GPINISII;SIIDIPAL;DIPALPGF;LPGFGNST;GFGNSTEL;TELPSSGF;ELPSSGFF;SGIANFGA;IANFGAGV;FGAGVSGL;NQASSPMV;MVGTLSGL;TLSGLGNA;GLGNAGSL;SLASGVLN;SGVLNSGV;VLNSGVDI;DISGMFNV;GMFNVSTL;NVSTLGSA;STLGSAPA;TLGSAPAV;APAVISGF;VISGFGNL;SGVSIDGL;SIDGLLAM;GLLAMLTS;LLAMLTSG;QPSIIDAA;SIIDAAIA;DAAIAELR;AIAELRHL;ELRHLNPL;HLNPLNIV;NPLNIVNL;NIVNLGNV;YNLGFANV;GLGALPGI;ALPGIGNI;GLTGDNQT;NQTGFGGL;GTGNIGFF;TGTGNWGL;GLFNSGSY;SGSYNTGI;GLFNAGSF;GLANAGSY;GAFNSGSF;WTGDHHGL;GLVGFSYS;LVGFSYSI;IEITGSTL;EITGSTLV;TLVDINET;LVDINETL;DINETLNL;ETLNLGPV;DIPGMSLF;SLFDIHEL;LFDIHELV;DIHELVNI;ELVNIGPF;LVNIGPFR;GPFRIEPI;EPIDVPAV;PIDVPAVV;IDVPAVVL;VPAVVLDI;VVLDIHET;VLDIHETM;ETMVIPPI;TMVIPPIV;MVIPPIVF;VIPPIVFL;IPPIVFLP;PIVFLPSM;VFLPSMTI;SMTIGGQT;MTIGGQTY;TIGGQTYT;GQTYTIPL;IPLDTPPA;PPPFRLPL;PFRLPLLF;FRLPLLFV;LPLLFVNA;PLLFVNAL;ALGDNWIV;TGMSGGFV;GMSGGFVT;VTAPTQGI;APTQGILI;SSATTGSL;ATTGSLAL;SLALTLPT;LALTLPTV;LTLPTVTI;LPTVTIPT;VTIPTITT;ITTSPIPL;TTSPIPLK;IPLKIDVS;KIDVSGGL;GLPAFTLF;LPAFTLFP;FTLFPGGL;TLFPGGLN;FPGGLNIP;GLNIPQNA;IPQNAIPL;IPLTIDAS;LTIDASGV;TIDASGVL;GVLDPITI;VLDPITIF;ITIFPGGF;TIFPGGFT;IFP | |

Fig. 30 continued

| | | |
|---|---|---|
| | GGFTI;FPGGFTID;FTIDPLPL;DPLPLSLA;PLPLSLAL;LPLSLALN;PLSLALNI;SLALNISV;ISVPDSSV;VPDSSVPI;SSVPIIIV;VPIIIVPP;IVPPTPGF;TPGFGNAT;TATPSSGF;ATPSSGFF;SGFFNSGA;SGFGNFGA;FGAGSSGW;NQAHAALA;LAGAGSGV;GVLNVGTL;VLNVGSGI;GSGISGLY;GLYNTAIV;GLGTPALV;TPALVSGA;LVSGAGNV;GQQLSGVL;QQLSGVLA;QLSGVLAA;VLAAGTAL;TALTQSPI;ALTQSPII;TQSPIINL;SPIINLGL;GLADVGNY;GLGNIGNA;GLGAALGI;GLTGDNQT;SGAGNIGL;GTGNIGFF;GLFNSGSF;SGSFNTGI;GLFNAGGF;FTTGLANA;GLANAGSY;GSYNTGSF;GSINTGWF;TGNANTGI;GIANSGNV;NVDTGALM;ALMSGNFS;FSNGILWR;ILWRGNYE;NYEGLFSY;GLFSYSYS;SYSYSLDV;SYSLDVPR;YSLDVPRI;SLDVPRIT;DVPRITIL;ITILDAHF;TILDAHFT;ILDAHFTG;DAHFTGAF;FTGAFGPV;TGAFGPVV;GAFGPVVV;GPVVVPPI;VVVPPIPV;VVPPIPVL;VPPIPVLA;PPIPVLAI;IPVLAINA;VLAINAHL;HLTGNAAM;AAMGAFTI;FTIPQIDI;IPQIDIPA;PQIDIPAL;IPALNPNV;NPNVTGSV;VGFGPIAV;GPIAVPSV;IAVPSVTI;VPSVTIPA;VTIPALTA;TIPALTAA;IPALTAAR;ALTAARAV;LTAARAVL;AARAVLDM;RAVLDMAA;VLDMAASV;DMAASVGA;MAASVGAT;SVGATSEI;ATSEIEPF;SEIEPFIV;EIEPFIVW;IVWTSSGA;VWTSSGAI;SGAIGPTW;PTWYSVGR;TWYSVGRI;RIYNAGDL;IYNAGDLF;YNAGDLFV;DLFVGGNI;IISGIPTL;TLSTTGPV;TTGPVHAV;FNAASQAF;SQAFNTPA;QAFNTPAL;HQIPLGFQ;QIPLGFQV;FQVPGSID;VPGSIDAI;GSIDAITL;SIDAITLF;ITLFPGGL;TLFPGGLT;LFPGGLTF;FPGGLTFP;LTFPANSL;TFPANSLL;FPANSLLN;SLLNLDVF;LLNLDVFV;NLDVFVGT;TPGATIPA;ATIPAITF;IPAITFPE;ITFPEIPA;FPEIPANA;NADGELYV;LYVIAGDI;VIAGDIPL;IPLINIPP;NIPPTPGI;IPPTPGIG;TPGIGNTT;GIGNTTTV;TTVPSSGF;TVPSSGFF;SGFFNTGA;SGFGNFGA;FGANMSGW;GANMSGWW;NMSGWWNQ;NQAHTALA;GIANVGTL;LHSGVLNL;VLNLGSGL;GLSGIYNT;GIYNTSTL;TLPLGTPA;LPLGTPAL;PLGTPALV;TPALVSGL;LVSGLGNV;HLSGLLAS;LLASNVGQ;GQNPITIV;NPITIVNI;ITIVNIGL;TIVNIGLA;GLGNIGNL;FGFGNSGL;LAAGLAGM;GLAGMGNI;NQSGIGGL;GTGNIGFF;SGTANFGL;GTANFGLF;GLFNSGSY;SGSYNTGI;TGIGNSGV;GVASTGLV;GVANAGSY;GSYNTGSF;TGNANTGV;GVANAGNV;NVNTGALI;GALITGNF;TGNFSNGI;FSNGILWR;ILWRGNYE;NYEGLAGF;GLAGFSFG;LAGFSFGY;FGYPIPLF;YPIPLFPA;PIPLFPAV;PLFPAVGA;FPAVGADV;TIIPPIHI;PPIHIPSI;IHIPSIPL;IPSIPLGF;SIPLGFAA;IPLGFAAI;AIGHIGPI;GPISIPNI;ISIPNIAI;IPNIAIPS;IAIPSIHL;IPSIHLGI;GIDPTFDV;PTFDVGPI;FDVGPITV;GPITVDPI;ITVDPITL;TVDPITLT;ITLTIPGL;LTIPGLSL;IPGLSLDA;GLSLDAAV;SLDAAVSE;DAAVSEIR;SGSSSGFK;SSSGFKVR;GFKVRPSF;KVRPSFSF;RPSFSFFA;PSFSFFAV;FAVGPDGM;DGMPGGEV;MPGGEVSI;EVSILQPF;SILQPFTV;ILQPFTVA;QPFTVAPI;FTVAPINL;APINLNPT;TTLHFPGF;FPGFTIPT;FTIPTGPI;IPTGPIHI;HIGLPLSL;GLPLSLTI;LPLSLTIP;LSLTIPGF;SLTIPGFT;LTIPGFTI;FTIPGGTL;TIPGGTLI;TLIPQLPL;IPQLPLGL;QLPLGLGL;LPLGLGLS;LSGGTPPF;TPPFDLPT;PPFDLPTV;VVIDRIPV;IPVELHAS;VELHASTT;ELHASTTI;TTIGPVSL;GPVSLPIF;VSLPIFGF;LPIFGFGG;GFGGAPGF;TTAPSSGF;FSNSGSGM;SGSGMSGV;GMSGVLNA;MSGVLNAI;DPLLGSAS;SASGFANF;FANFGTQL;QLSGILNR;ILNRGAGI;RGAGISGV;GVYNTGTL;NTGTLGLV;TLGLVTSA;GLVTSAFV;TSAFVSGF;SAFVSGFM;FVSGFMNV;FMNVGQQL;QQLSGLLF;QLSGLLFA<br>9mer<br>NFPVLPPEI;FPVLPPEIN;VLPPEINSV;LPPEINSVL;PPEINSVLM;PEINSVLMY;NSVLMYSGA;LMYSGAGSS;YSGAGSSPL;SPLLAAAAA;AAAAAWDGL;AAWDGLAEE;GLAEELGSA;LAEELGSAA;AEELGSAAV;SAAVSFGQV;SFGQVTSGL;GQVTSGLTA;VTSGLTAGV;TSGLTAGVW;GLTAGVWQG;LTAGVWQGA;GVWQGAAAA;WQGAAAAAM;QGAAAAAMA;AAAAAMAAA;AAAAMAAAA;AAAMAAAAA;AMAAAAAPY;MAAAAAPYA;AAAAPYAGW;AAAPYAG | |

Fig. 30 continued

| | | |
|---|---|---|
| | WL;PYAGWLGSV;YAGWLGSVA;WLGSVAAQA;SVAAQAVAV;QAVAVAGQ<br>A;VAGQARAAV;GQARAAVAA;QARAAVAAF;RAAVAAFEA;AAVAAFEAA;A<br>VAAFEAAL;AAFEAALAA;FEAALAATV;ALAATVDPA;LAATVDPAA;ATVDPA<br>AVA;TVDPAAVAV;DPAAVAVNR;AVAVNRMAM;VAVNRMAMR;VNRMAMR<br>AL;NRMAMRALA;RMAMRALAM;MRALAMSNL;RALAMSNLL;NLLGQNAAA<br>;LLGQNAAAI;GQNAAAIAA;QNAAAIAAV;AIAAVEAEY;AAVEAEYEL;AVEAE<br>YELM;VEAEYELMW;AEYELMWAA;YELMWAADV;ELMWAADVA;LMWAAD<br>VAA;MWAADVAAM;WAADVAAMA;DVAAMAGYH;AMAGYHSGA;GASAAA<br>AAL;SAAAAALPA<br>10mer<br>MNFPVLPPEI;FPVLPPEINS;PVLPPEINSV;VLPPEINSVL;LPPEINSVLM;PP<br>EINSVLMY;MYSGAGSSPL;SPLLAAAAAW;LAAAAAWDGL;AAWDGLAEEL;<br>GLAEELGSAA;LAEELGSAAV;AEELGSAAVS;EELGSAAVSF;GSAAVSFGQ<br>V;VSFGQVTSGL;QVTSGLTAGV;VTSGLTAGVW;GLTAGVWQGA;LTAGVW<br>QGAA;GVWQGAAAAA;WQGAAAAAMA;QGAAAAAMAA;GAAAAAMAAA;A<br>AAAAMAAAA;AAAAMAAAAA;AAMAAAAAPY;AMAAAAAPYA;AAAAAPYAG<br>W;AAAAPYAGWL;APYAGWLGSV;YAGWLGSVAA;WLGSVAAQAV;SVAAQ<br>AVAVA;AQAVAVAGQA;QAVAVAGQAR;AVAGQARAAV;GQARAAVAAF;RA<br>AVAAFEAA;AAVAAFEAAL;AVAAFEAALA;AAFEAALAAT;AALAATVDPA;AL<br>AATVDPAA;LAATVDPAAV;ATVDPAAVAV;DPAAVAVNRM;AAVAVNRMAM<br>;AVAVNRMAMR;AVNRMAMRAL;NRMAMRALAM;RMAMRALAMS;AMRAL<br>AMSNL;MRALAMSNLL;ALAMSNLLGQ;AMSNLLGQNA;NLLGQNAAAI;LLG<br>QNAAAIA;GQNAAAIAAV;NAAAIAAVEA;AAIAAVEAEY;IAAVEAEYEL;AAVE<br>AEYELM;ELMWAADVAA;LMWAADVAAM;WAADVAAMAG;AADVAAMAGY;<br>AAMAGYHSGA;AMAGYHSGAS;SGASAAAAAL;SAAAAALPAF;AALPAFSP<br>PA;ALPAFSPPAQ;LPAFSPPAQA;AQALGGGVGA;QALGGGVGAF;ALGGG<br>VGAFL;FLNALFAGPA;NALFAGPAKM;ALFAGPAKML;LFAGPAKMLR;FAG<br>PAKMLRL;GLGNVGNYNV;GLGNVGIFNL;GIFNLGAANV;GFGNIGNANF;A<br>NFGFGNSGL;LPPGMGNIGL;GMGNIGLGNA;GLGNAGSSNY;SNYGLANLG<br>V;GLANLGVGNI;NLGVGNIGFA;GLTGDNLTGI;GLFNSGTGNI;FNSGTGNIG<br>F;GFFNSGTGNF;FNSGTGNFGV;NFGVFNSGSY;FNSGSYNTGV;NAGTAS<br>TGLF;GTASTGLFNV;GLFNVGGFNT;FNVGGFNTGV;NTGVANVGSY;NAG<br>NTNTGGF;NTGGFNPGNV;NPGNVNTGWL;NTGIANSGNV;TGAFISGNFS;<br>FISGNFSNGV;SGNFSNGVLW;VLWRGDYEGL;GLWGLSGGST;GLSGGSTI<br>PA;STIPAIPIGL;IPAIPIGLEL;IPIGLELNGG;LELNGGVGPI;ELNGGVGPIT;G<br>VGPITVLPI;GPITVLPIQI;VLPIQILPTI;LPIQILPTIP;QILPTIPLNI;TIPLNIHQTF<br>;PLNIHQTFSL;HQTFSLGPLV;QTFSLGPLVV;SLGPLVVPDI;GPLVVPDIVI;L<br>VVPDIVIPA;VVPDIVIPAF;IVIPAFGGGT;IPAFGGGTAI;TAIPISVGPI;IPISVG<br>PITI;SVGPITISPI;GPITISPITL;TISPITLFPA;TLFPAQNFNT;FPAQNFNTTF;A<br>QNFNTTFPV;NTTFPVGPFF;TFPVGPFFGL;FPVGPFFGLG;PVGPFFGLGV;<br>GLGVVNISGI;GVVNISGIEI;VVNISGIEIK;IKDLAGNVTL;DLAGNVTLQL;VTL<br>QLGNLNI;NIDTRINQSF;DTRINQSFPV;RINQSFPVTV;FPVTVNWSTP;VTV<br>NWSTPAV;NWSTPAVTIF;VTIFPNGISI;FPNGISIPNN;NGISIPNNPL;ISIPNN<br>PLAL;SIPNNPLALL;IPNNPLALLA;NPLALLASAS;PLALLASASI;ALLASASIG<br>T;LLASASIGTL;ASASIGTLGF;ASIGTLGFTI;GTLGFTIPGF;TLGFTIPGFT;L<br>GFTIPGFTI;FTIPGFTIPA;TIPGFTIPAA;FTIPAAPLPL;IPAAPLPLTI;PLTIDID<br>GQI;GQIDGFSTPP;QIDGFSTPPI;FSTPPITIDR;STPPITIDRI;ITIDRIPLNL;RI<br>PLNLGASV;IPLNLGASVT;PLNLGASVTV;LGASVTVGPI;TVGPILINGV;GPIL<br>INGVNI;ILINGVNIPA;GVNIPATPGF;IPATPGFGNT;TPGFGNTTTA;TTTAPS<br>SGFF;TTAPSSGFFN;GVSGFGNFGA;GWWNQAQTEV;NQAQTEVAGA;AQ<br>TEVAGAGS;TEVAGAGSGF;EVAGAGSGFA;SLGSGVLNFG;SGVLNFGSG<br>V;LNFGSGVSGL;GGLPPGTPAV;GLPPGTPAVV;LPPGTPAVVS;QLSGLSS<br>AGT;ALNQSLIINL;NQSLIINLGL;LIINLGLADV;NLGLADVGSV;GLADVGSVN | |

Fig. 30 continued

| | | |
|---|---|---|
| | V;GFGNVGDFNL;NVGDFNLGAA;NLGAANIGDL;GLGNVGGGNV;GFGNIGDANF;GNIGDANFGL;ANFGLGNAGL;GLAGVGNIGL;GLGNAGSGNV;GFGNTGTNNL;GLTGDNQTGI;TGIGGLNSGA;GLFNSGTGNV;FNSGTGNVGL;GLFNSGTGNF;FNSGTGNFGL;NFGLFNSGSF;GLFNSGSFNT;FNSGSFNTGI;GLFNAGNFNT;FNAGNFNTGV;NPGSYNTGSF;NTGGFNPGSI;NPGSINTGWF;NTGWFNTGNA;FNTGNANTGV;NTGVANSGNV;DTGALMSGNF;ALMSGNFSNG;LMSGNFSNGI;SGNFSNGILW;ILWRGNFEGL;LWRGNFEGLF;GLFGLNVGIT;VGITIPEFPI;ITIPEFPIHW;TIPEFPIHWT;FPIHWTSTGG;WTSTGGIGPI;GPIIIPDTTI;PIIIPDTTIL;IPDTTILPPI;DTTILPPIHL;TILPPIHLGL;ILPPIHLGLT;LPPIHLGLTG;HLGLTGQANY;GLTGQANYGF;TGQANYGFAV;YGFAVPDIPI;FAVPDIPIPA;AVPDIPIPAI;IPIPAIHIDF;DFDGAADAGF;AADAGFTAPA;FTAPATTLLS;APATTLLSAL;LLSALGITGQ;LSALGITGQF;SALGITGQFR;ITGQFRFGPI;GQFRFGPITV;FRFGPITVSN;RFGPITVSNV;GPITVSNVQL;TVSNVQLNPF;VQLNPFNVNL;QLNPFNVNLK;PFNVNLKLQF;FNVNLKLQFL;NLKLQFLHDA;FLHDAFPNEF;FPNEFPDPTI;NEFPDPTISV;FPDPTISVQI;TISVQIQVAI;SVQIQVAIPL;VQIQVAIPLT;IQVAIPLTSA;QVAIPLTSAT;VAIPLTSATL;PLTSATLGGL;LTSATLGGLA;ATLGGLALPL;TLGGLALPLQ;GLALPLQQTI;ALPLQQTIDA;LPLQQTIDAI;LQQTIDAIEL;QTIDAIELPA;TIDAIELPAI;DAIELPAISF;ELPAISFSQS;LPAISFSQSI;AISFSQSIPI;QSIPIDIPPI;IPIDIPPIDI;IPPIDIPAST;PPIDIPASTI;DIPASTINGI;IPASTINGIS;TINGISMSEV;GISMSEVVPI;SMSEVVPIDV;SEVVPIDVSV;VPIDVSVDIP;IPAVTITGTR;TITGTRIDPI;DPIPLNFDVL;PLNFDVLSSA;VLSSAGPINI;SSAGPINISI;GPINISIIDI;NISIIDIPAL;IIDIPALPGF;IPALPGFGNS;ALPGFGNSTE;LPGFGNSTEL;STELPSSGFF;LPSSGFFNTG;SGIANFGAGV;GLLNQASSPM;LLNQASSPMV;SPMVGTLSGL;SLASGVLNSG;LASGVLNSGV;GVDISGMFNV;NVSTLGSAPA;STLGSAPAVI;GSAPAVISGF;HVSGVSIDGL;GVSIDGLLAM;VSIDGLLAML;SIDGLLAMLT;LLAMLTSGGS;GQPSIIDAAI;QPSIIDAAIA;SIIDAAIAEL;IIDAAIAELR;HLNPLNIVNL;PLNIVNLGNV;IVNLGNVGSY;NLGNVGSYNL;GSYNLGFANV;NLGFANVGDV;NLGAGNLGNL;NLGGGNLGGQ;GLGNLGDGNV;ALPGIGNIGL;GIGNIGLGNA;GLGNAGSNNV;GLGNIGFGNT;GFGNTGTNNL;GLTGDNQTGF;TGFGGLNSGA;GLFNSGTGNI;FNSGTGNIGF;GFFNTGTGNW;NWGLFNSGSY;GLFNSGSYNT;FNSGSYNTGI;GLFNAGSFNT;FNAGSFNTGL;NTGLANAGSY;GLANAGSYNT;NAGNTNTGGF;NTGGFNPGNV;NPGNVNTGWF;NTGGFNTGNV;ALWTGDHHGL;YSIEITGSTL;SIEITGSTLV;STLVDINETL;LVDINETLNL;ETLNLGPVHI;NLGPVHIDQI;GPVHIDQIDI;HIDQIDIPGM;QIDIPGMSLF;GMSLFDIHEL;MSLFDIHELV;SLFDIHELVN;ELVNIGPFRI;NIGPFRIEPI;FRIEPIDVPA;RIEPIDVPAV;EPIDVPAVVL;AVVLDIHETM;VVLDIHETMV;VLDIHETMVI;ETMVIPPIVF;TMVIPPIVFL;IPPIVFLPSM;FLPSMTIGGQ;LPSMTIGGQT;SMTIGGQTYT;MTIGGQTYTI;YTIPLDTPPA;IPLDTPPAPA;TPPAPAPPPF;APPPFRLPLL;PPFRLPLLFV;RLPLLFVNAL;LPLLFVNALG;FVNALGDNWI;ALGDNWIVGA;NSTGMSGGFV;GMSGGFVTAP;MSGGFVTAPT;FVTAPTQGIL;VTAPTQGILI;ILIHTGPSSA;GPSSATTGSL;ATTGSLALTL;GSLALTLPTV;SLALTLPTVT;LALTLPTVTI;LTLPTVTIPT;TLPTVTIPTI;LPTVTIPTIT;TIPTITTSPI;IPTITTSPIP;PTITTSPIPL;TITTSPIPLK;KIDVSGGLPA;IDVSGGLPAF;GLPAFTLFPG;LPAFTLFPGG;FTLFPGGLNI;TLFPGGLNIP;FPGGLNIPQN;IPQNAIPLTI;IPLTIDASGV;PLTIDASGVL;VLDPITIFPG;DPITIFPGGF;ITIFPGGFTI;FPGGFTIDPL;FTIDPLPLSL;TIDPLPLSLA;PLPLSLALNI;LPLSLALNIS;PLSLALNISV;LNISVPDSSV;ISVPDSSVPI;SVPDSSVPII;VPDSSVPIII;SVPIIIVPPT;VPIIIVPPTP;IIIVPPTPGF;VPPTPGFGNA;PPTPGFGNAT;TPGFGNATAT;ATATPSSGFF;GVSGFGNFGA;NQAHAALAGA;AALAGAGSGV;ALAGAGSGVL;GTLNSGVLNV;NVGSGISGLY;GISGLYNTAI;GLYNTAIVGL;TAIVGLGTPA;AIVGLGTPAL;IVGLGTPALV;GQQLSGVLAA;QLSGVLAAGT;VLAAGTALTQ;ALTQSPIINL;TQSPIINLGL;PIINLGLADV;G | |

Fig. 30 continued

| | | |
|---|---|---|
| | LADVGNYNL;GLGNVGDFNL;NVGDFNLGAA;NLGAANLGDL;GAANLGDLNL;ANLGDLNLGL;NLGLGNIGNA;GLGNIGNANV;AALGIGNIGL;GIGNIGLGNA;GLGNAGSTNV;TNVGLANMGV;GLANMGVGNI;NMGVGNIGFA;GFANTGTNNL;GLTGDNQTGI;TGIGGLNSGA;GLFNSGTGNI;FNSGTGNIGF;GFFNSGTGNW;FNSGTGNWGL;NWGLFNSGSF;GLFNSGSFNT;FNSGSFNTGI;GLFNAGGFTT;FNAGGFTTGL;FTTGLANAGS;TTGLANAGSY;GLANAGSYNT;NAGSYNTGSF;NTGGFNPGSI;NPGSINTGWF;NTGWFNTGNA;NTGIANSGNV;DTGALMSGNF;ALMSGNFSNG;LMSGNFSNGI;SGNFSNGILW;ILWRGNYEGL;LWRGNYEGLF;RGNYEGLFSY;NYEGLFSYSY;EGLFSYSYSL;SYSYSLDVPR;YSYSLDVPRI;YSLDVPRITI;SLDVPRITIL;TILDAHFTGA;ILDAHFTGAF;FTGAFGPVVV;GPVVVPPIPV;VVVPPIPVLA;VVPPIPVLAI;PPIPVLAINA;IPVLAINAHL;AINAHLTGNA;NAHLTGNAAM;HLTGNAAMGA;LTGNAAMGAF;AMGAFTIPQI;FTIPQIDIPA;TIPQIDIPAL;ALNPNVTGSV;NPNVTGSVGF;GFGPIAVPSV;GPIAVPSVTI;IAVPSVTIPA;AVPSVTIPAL;VPSVTIPALT;VTIPALTAAR;TIPALTAARA;IPALTAARAV;LTAARAVLDM;TAARAVLDMA;RAVLDMAASV;VLDMAASVGA;ATSEIEPFIV;TSEIEPFIVW;SEIEPFIVWT;FIVWTSSGAI;WTSSGAIGPT;TSSGAIGPTW;GAIGPTWYSV;GPTWYSVGRI;PTWYSVGRIY;RIYNAGDLFV;FVGGNIISGI;IISGIPTLST;IPTLSTTGPV;TLSTTGPVHA;LSTTGPVHAV;STTGPVHAVF;GPVHAVFNAA;AVFNAASQAF;AASQAFNTPA;QAFNTPALNI;NTPALNIHQI;IPLGFQVPGS;FQVPGSIDAI;VPGSIDAITL;DAITLFPGGL;ITLFPGGLTF;TLFPGGLTFP;FPGGLTFPAN;GLTFPANSLL;TFPANSLLNL;FPANSLLNLD;NSLLNLDVFV;SLLNLDVFVG;LLNLDVFVGT;GTPGATIPAI;TPGATIPAIT;ATIPAITFPE;TIPAITFPEI;ITFPEIPANA;EIPANADGEL;IPANADGELY;GELYVIAGDI;LYVIAGDIPL;YVIAGDIPLI;LINIPPTPGI;IPPTPGIGNT;TPGIGNTTTV;TTTVPSSGFF;TVPSSGFFNT;NFGANMSGWW;NMSGWWNQAH;NQAHTALAGA;TALAGAGSGI;ALAGAGSGIA;GLSGIYNTST;GIYNTSTLPL;STLPLGTPAL;TLPLGTPALV;LPLGTPALVS;NVGDHLSGLL;HLSGLLASNV;NVGQNPITIV;GQNPITIVNI;NPITIVNIGL;TIVNIGLANV;GLANVGNGNV;GLGNIGNLNL;NLGAANIGDV;NLGFGNIGDV;GNIGGGNVGF;GFGNIGDANF;ANFGFGNSGL;GLAGMGNIGL;GMGNIGLGNA;GLGNAGSGNV;GLGNIGFGNT;GFGNTGTNNL;GLTGDNQSGI;GLFNSGTGNI;FNSGTGNIGF;GFFNSGTANF;FNSGTANFGL;NFGLFNSGSY;GLFNSGSYNT;FNSGSYNTGI;GVASTGLVNA;VNAGGFNTGV;NTGVANAGSY;NAGSYNTGSF;NAGDTNTGGF;NPGSTNTGWF;NTGWFNTGNA;FNTGNANTGV;NTGVANAGNV;NAGNVNTGAL;LITGNFSNGI;TGNFSNGILW;ILWRGNYEGL;NYEGLAGFSF;EGLAGFSFGY;LAGFSFGYPI;FSFGYPIPLF;FGYPIPLFPA;GYPIPLFPAV;YPIPLFPAVG;PLFPAVGADV;FPAVGADVTG;VTGDIGPATI;TIIPPIHIPS;IIPPIHIPSI;PPIHIPSIPL;IHIPSIPLGF;HIPSIPLGFA;IPSIPLGFAA;IPLGFAAIGH;FAAIGHIGPI;AIGHIGPISI;HIGPISIPNI;GPISIPNIAI;SIPNIAIPSI;IPNIAIPSIH;IAIPSIHLGI;HLGIDPTFDV;PTFDVGPITV;DVGPITVDPI;GPITVDPITL;ITVDPITLTI;DPITLTIPGL;LTIPGLSLDA;TIPGLSLDAA;IPGLSLDAAV;SEIRMTSGSS;RMTSGSSSGF;MTSGSSSGFK;GFKVRPSFSF;FKVRPSFSFF;KVRPSFSFFA;RPSFSFFAVG;GMPGGEVSIL;EVSILQPFTV;ILQPFTVAPI;QPFTVAPINL;TVAPINLNPT;APINLNPTTL;NLNPTTLHFP;NPTTLHFPGF;TTLHFPGFTI;FPGFTIPTGP;FTIPTGPIHI;IPTGPIHIGL;PIHIGLPLSL;LPLSLTIPGF;IPGFTIPGGT;FTIPGGTLIP;TIPGGTLIPQ;IPGGTLIPQL;TLIPQLPLGL;IPQLPLGLGL;LPLGLGLSGG;LGLSGGTPPF;GTPPFDLPTV;TPPFDLPTVV;PPFDLPTVVI;DLPTVVIDRI;LPTVVIDRIP;VVIDRIPVEL;IPVELHASTT;TTIGPVSLPI;TIGPVSLPIF;GPVSLPIFGF;SLPIFGFGGA;LPIFGFGGAP;IFGFGGAPGF;DTTAPSSGFF;TTAPSSGFFN;SGMSGVLNAI;GVLNAISDPL;VLNAISDPLL;AISDPLLGSA;DPLLGSASGF;PLLGSASGFA;GTQLSGILNR;QLSGILNRGA;GVYNTGTLGL;VYNTGTLGLV;GTLGLVTSAF;TLGLVTSAFV;VTSAFVSGFM;SAFVSGFMNV;FVSGFMNVGQ;FMNVGQQLSG;GQQLSGLLFA; | |

Fig. 30 continued

| | | |
|---|---|---|
| | QQLSGLLFAG;QLSGLLFAGT<br>11mer<br>FPVLPPEINSV;PVLPPEINSVL;VLPPEINSVLM;LPPEINSVLMY;EINSVLMYSGA;LMYSGAGSSPL;MYSGAGSSPLL;LLAAAAAWDGL;AAAWDGLAEEL;GLAEELGSAAV;AEELGSAAVSF;ELGSAAVSFGQ;LGSAAVSFGQV;AVSFGQVTSGL;GQVTSGLTAGV;QVTSGLTAGVW;GLTAGVWQGAA;LTAGVWQGAAA;GVWQGAAAAAM;WQGAAAAAMAA;QGAAAAAMAAA;AAAAAMAAAAA;AAAMAAAAAPY;AAMAAAAAPYA;MAAAAAPYAGW;AAAAAPYAGWL;AAPYAGWLGSV;APYAGWLGSVA;YAGWLGSVAAQ;WLGSVAAQAVA;AQAVAVAGQAR;QAVAVAGQARA;VAVAGQARAAV;AGQARAAVAAF;RAAVAAFEAAL;AAVAAFEAALA;AVAAFEAALAA;AAFEAALAATV;EAALAATVDPA;AALAATVDPAA;ALAATVDPAAV;TVDPAAVAVNR;PAAVAVNRMAM;AAVAVNRMAMR;AVAVNRMAMRA;VAVNRMAMRAL;AVNRMAMRALA;RMAMRALAMSN;MAMRALAMSNL;AMRALAMSNLL;AMSNLLGQNAA;MSNLLGQNAAA;NLLGQNAAAIA;LLGQNAAAIAA;AAAIAAVEAEY;AIAAVEAEYEL;IAAVEAEYELM;AAVEAEYELMW;VEAEYELMWAA;AEYELMWAADV;YELMWAADVAA;ELMWAADVAAM;LMWAADVAAMA;WAADVAAMAGY;AMAGYHSGASA;MAGYHSGASAA;ASAAAAALPAF;AAALPAFSPPA;ALPAFSPPAQA;LPAFSPPAQAL;AQALGGGVGAF;QALGGGVGAFL;ALGGGVGAFLN;FLNALFAGPAK;NALFAGPAKML;ALFAGPAKMLR;MLRLNAGLGNV;YNVGLGNVGIF;AANAGSGNFGF;NANFGFGNSGL;GLGLPPGMGNI;GLPPGMGNIGL;LPPGMGNIGLG;LGNAGSSNYGL;SSNYGLANLGV;LANLGVGNIGF;FANTGSNNIGI;NTGSNNIGIGL;GLNSGTGNLGL;LFNSGTGNIGF;FFNSGTGNFGV;FNSGTGNFGVF;GNFGVFNSGSY;VFNSGSYNTGV;TNTGGFNPGNV;GFNPGNVNTGW;WLNTGNTNTGI;TNTGIANSGNV;AFISGNFSNGV;FISGNFSNGVL;ISGNFSNGVLW;FSNGVLWRGDY;GVLWRGDYEGL;VLWRGDYEGLW;GLWGLSGGSTI;GLSGGSTIPAI;TIPAIPIGLEL;IPIGLELNGGV;GLELNGGVGPI;ELNGGVGPITV;GPITVLPIQIL;TVLPIQILPTI;LPIQILPTIPL;IQILPTIPLNI;ILPTIPLNIHQ;LPTIPLNIHQT;PTIPLNIHQTF;IPLNIHQTFSL;NIHQTFSLGPL;HQTFSLGPLVV;SLGPLVVPDIV;PLVVPDIVIPA;LVVPDIVIPAF;IVIPAFGGGTA;VIPAFGGGTAI;FGGGTAIPISV;GTAIPISVGPI;AIPISVGPITI;IPISVGPITIS;ISVGPITISPI;GPITISPITLF;ITISPITLFPA;SPITLFPAQNF;TLFPAQNFNTT;LFPAQNFNTTF;FPAQNFNTTFP;PAQNFNTTFPV;NFNTTFPVGPF;TTFPVGPFFGL;FPVGPFFGLGV;PVGPFFGLGVV;GPFFGLGVVNI;FGLGVVNISGI;GVVNISGIEIK;NISGIEIKDLA;EIKDLAGNVTL;LQLGNLNIDTR;QLGNLNIDTRI;LNIDTRINQSF;TRINQSFPVTV;QSFPVTVNWST;FPVTVNWSTPA;PVTVNWSTPAV;TVNWSTPAVTI;TPAVTIFPNGI;FPNGISIPNNP;SIPNNPLALLA;IPNNPLALLAS;NPLALLASASI;ALLASASIGTL;LLASASIGTLG;LASASIGTLGF;SASIGTLGFTI;TLGFTIPGFTI;FTIPGFTIPAA;IPGFTIPAAPL;FTIPAAPLPLT;TIPAAPLPLTI;LPLTIDIDGQI;TIDIDGQIDGF;GQIDGFSTPPI;GFSTPPITIDR;FSTPPITIDRI;TPPITIDRIPL;TIDRIPLNLGA;IPLNLGASVTV;NLGASVTVGPI;VTVGPILINGV;ILINGVNIPAT;IPATPGFGNTT;NTTTAPSSGFF;TTAPSSGFFNS;SGFFNSGDGGV;FGNFGAGSSGW;SGWWNQAQTEV;QTEVAGAGSGF;FANFGSLGSGV;SLGSGVLNFGS;VLNFGSGVSGL;LNFGSGVSGLY;GVSGLYNTGGL;NTGGLPPGTPA;GLPPGTPAVVS;LPPGTPAVVSG;PPGTPAVVSGI;TPAVVSGIGNV;QLSGLSSAGTA;SSAGTALNQSL;TALNQSLIINL;NQSLIINLGLA;SLIINLGLADV;LADVGSVNVGF;FGNIGDANFGL;GLGNAGLAAGL;NAGLAAGLAGV;LAAGLAGVGNI;SGNVGFGNMGV;NTGTNNLGIGL;GLNSGAGNIGL;LFNAGNFNTGV;GFNPGSINTGW;ALMSGNFSNGI;LMSGNFSNGIL;MSGNFSNGILW;FSNGILWRGNF;GILWRGNFEGL;ILWRGNFEGLF;GNFEGLFGLNV;FEGLFGLNVGI;GLFGLNVGITI;GLNVGITIPEF;NVGITIPEFPI;GITIPEFPIHW;TIPEFPIHWTS;FPIHWTSTGGI;WTSTGGIGPII;GPIIIPDTTIL;IIPDTTILPPI;IPDTTILPPIH;TTILPPIHLGL;TILPPIHLGLT;ILPPIHLGLT | |

Fig. 30 continued

| | | |
|---|---|---|
| | G;PPIHLGLTGQA;GLTGQANYGFA;LTGQANYGFAV;NYGFAVPDIPI;FAVPDIPIPAI;VPDIPIPAIHI;DIPIPAIHIDF;IPAIHIDFDGA;GAADAGFTAPA;AADAGFTAPAT;AGFTAPATTLL;FTAPATTLLSA;TAPATTLLSAL;TLLSALGITGQ;LLSALGITGQF;LSALGITGQFR;SALGITGQFRF;GITGQFRFGPI;TGQFRFGPITV;FRFGPITVSNV;ITVSNVQLNPF;NVQLNPFNVNL;VQLNPFNVNLK;QLNPFNVNLKL;NPFNVNLKLQF;NLKLQFLHDAF;LQFLHDAFPNE;QFLHDAFPNEF;FLHDAFPNEFP;AFPNEFPDPTI;FPNEFPDPTIS;FPDPTISVQIQ;PTISVQIQVAI;ISVQIQVAIPL;VQIQVAIPLTS;IQVAIPLTSAT;QVAIPLTSATL;IPLTSATLGGL;PLTSATLGGLA;LTSATLGGLAL;SATLGGLALPL;TLGGLALPLQQ;ALPLQQTIDAI;LPLQQTIDAIE;PLQQTIDAIEL;QTIDAIELPAI;ELPAISFSQSI;LPAISFSQSIP;SQSIPIDIPPI;IPIDIPPIDIP;DIPPIDIPAST;IPPIDIPASTI;IPASTINGISM;STINGISMSEV;TINGISMSEVV;NGISMSEVVPI;MSEVVPIDVSV;EVVPIDVSVDI;VPIDVSVDIPA;PIDVSVDIPAV;DVSVDIPAVTI;DIPAVTITGTR;IPAVTITGTRI;VTITGTRIDPI;RIDPIPLNFDV;IPLNFDVLSSA;DVLSSAGPINI;LSSAGPINISI;SSAGPINISII;SIIDIPALPGF;IPALPGFGNST;ALPGFGNSTEL;IANFGAGVSGL;GLLNQASSPMV;NQASSPMVGTL;MVGTLSGLGNA;TLSGLGNAGSL;SLASGVLNSGV;VLNSGVDISGM;SGVDISGMFNV;DISGMFNVSTL;GMFNVSTLGSA;NVSTLGSAPAV;APAVISGFGNL;FGNLGNHVSGV;NLGNHVSGVSI;HVSGVSIDGLL;GVSIDGLLAML;SIDGLLAMLTS;GQPSIIDAAIA;QPSIIDAAIAE;SIIDAAIAELR;AIAELRHLNPL;AELRHLNPLNI;ELRHLNPLNIV;RHLNPLNIVNL;NPLNIVNLGNV;NIVNLGNVGSY;FANVGDVNLGA;NLGDGNVGFGN;GLGALPGIGNI;GALPGIGNIGL;NTGTNNLGIGL;GLNSGAGNLGL;LFNSGTGNIGF;IGFFNTGTGNW;FFNTGTGNWGL;FNAGSFNTGLA;TNTGGFNPGNV;GFNPGNVNTGW;TNTGGFNTGNV;FNSGSFNNGAL;NSGSFNNGALW;ALWTGDHHGLV;WTGDHHGLVGF;GLVGFSYSIEI;SYSIEITGSTL;YSIEITGSTLV;IEITGSTLVDI;TLVDINETLNL;DINETLNLGPV;GMSLFDIHELV;SLFDIHELVNI;DIHELVNIGPF;HELVNIGPFRI;FRIEPIDVPAV;RIEPIDVPAVV;IEPIDVPAVVL;VPAVVLDIHET;AVVLDIHETMV;VVLDIHETMVI;DIHETMVIPPI;HETMVIPPIVF;ETMVIPPIVFL;MVIPPIVFLPS;VIPPIVFLPSM;IPPIVFLPSMT;PPIVFLPSMTI;FLPSMTIGGQT;LPSMTIGGQTY;SMTIGGQTYTI;TIGGQTYTIPL;TIPLDTPPAPA;IPLDTPPAPAP;DTPPAPAPPPF;TPPAPAPPPFR;APAPPPFRLPL;APPPFRLPLLF;PPPFRLPLLFV;FRLPLLFVNAL;LPLLFVNALGD;LLFVNALGDNW;FVNALGDNWIV;NALGDNWIVGA;ALGDNWIVGAS;WIVGASNSTGM;GMSGGFVTAPT;FVTAPTQGILI;GILIHTGPSSA;LIHTGPSSATT;GPSSATTGSLA;SATTGSLALTL;SLALTLPTVTI;ALTLPTVTIPT;LTLPTVTIPTI;TLPTVTIPTIT;LPTVTIPTITT;VTIPTITTSPI;IPTITTSPIPL;PTITTSPIPLK;TTSPIPLKIDV;IPLKIDVSGGL;KIDVSGGLPAF;DVSGGLPAFTL;LPAFTLFPGGL;TLFPGGLNIPQ;FPGGLNIPQNA;GLNIPQNAIPL;NIPQNAIPLTI;AIPLTIDASGV;IPLTIDASGVL;TIDASGVLDPI;DASGVLDPITI;VLDPITIFPGG;DPITIFPGGFT;FPGGFTIDPLP;FTIDPLPLSLA;TIDPLPLSLAL;DPLPLSLALNI;LPLSLALNISV;ALNISVPDSSV;NISVPDSSVPI;SVPDSSVPIII;VPDSSVPIIIV;SSVPIIIVPPT;VPIIIVPPTPG;PIIIVPPTPGF;IVPPTPGFGNA;VPPTPGFGNAT;TPSSGFFNSGA;SGFFNSGAGGV;FGNFGAGSSGW;HAALAGAGSGV;LAGAGSGVLNV;VLNVGTLNSGV;TLNSGVLNVGS;VLNVGSGISGL;GISGLYNTAIV;NTAIVGLGTPA;TAIVGLGTPAL;AIVGLGTPALV;GLGTPALVSGA;TPALVSGAGNV;ALVSGAGNVGQ;QQLSGVLAAGT;QLSGVLAAGTA;VLAAGTALTQS;TALTQSPIINL;LTQSPIINLGL;TQSPIINLGLA;SPIINLGLADV;GLADVGNYNLG;LADVGNYNLGL;GLGAALGIGNI;STNVGLANMGV;LANMGVGNIGF;FANTGTNNLGI;NTGTNNLGIGL;GLNSGAGNIGL;LFNSGTGNIGF;IGFFNSGTGNW;FFNSGTGNWGL;FTTGLANAGSY;ANAGSYNTGSF;GFNPGSINTGW;ALMSGNFSNGI;LMSGNFSNGIL;MSGNFSNGILW;FSNGILWRGNY;GILWRGNYEGL;ILWRGNYEGLF;YEGLFSYSYSL;GLFSYSYSLDV;FSYSYSLDVPR;SYSYSLDVPRI;SYSLDVPRITI;SLDVPRITILD;DVPRITILDA | |

Fig. 30 continued

| | | |
|---|---|---|
| | H;VPRITILDAHF;ITILDAHFTGA;TILDAHFTGAF;DAHFTGAFGPV;FGPVVV<br>PPIPV;GPVVVPPIPVL;VVVPPIPVLAI;VPPIPVLAINA;PPIPVLAINAH;IPVLAI<br>NAHLT;AINAHLTGNAA;HLTGNAAMGAF;TGNAAMGAFTI;AAMGAFTIPQI;<br>MGAFTIPQIDI;FTIPQIDIPAL;QIDIPALNPNV;IPALNPNVTGS;PALNPNVTG<br>SV;NVTGSVGFGPI;TGSVGFGPIAV;VGFGPIAVPSV;IAVPSVTIPAL;VPSVT<br>IPALTA;SVTIPALTAAR;VTIPALTAARA;TIPALTAARAV;IPALTAARAVL;ALT<br>AARAVLDM;LTAARAVLDMA;TAARAVLDMAA;AVLDMAASVGA;VLDMAAS<br>VGAT;MAASVGATSEI;SVGATSEIEPF;ATSEIEPFIVW;SEIEPFIVWTS;EPFI<br>VWTSSGA;WTSSGAIGPTW;TSSGAIGPTWY;SGAIGPTWYSV;AIGPTWYS<br>VGR;GPTWYSVGRIY;NAGDLFVGGNI;NIISGIPTLST;IISGIPTLSTT;GIPTLS<br>TTGPV;IPTLSTTGPVH;PTLSTTGPVHA;TLSTTGPVHAV;LSTTGPVHAVF;T<br>TGPVHAVFNA;HAVFNAASQAF;NAASQAFNTPA;AASQAFNTPAL;SQAFN<br>TPALNI;TPALNIHQIPL;NIHQIPLGFQV;IPLGFQVPGSI;FQVPGSIDAIT;QVP<br>GSIDAITL;VPGSIDAITLF;TLFPGGLTFPA;FPGGLTFPANS;LTFPANSLLNL;<br>FPANSLLNLDV;PANSLLNLDVF;SLLNLDVFVGT;NLDVFVGTPGA;DVFVGT<br>PGATI;FVGTPGATIPA;TPGATIPAITF;ATIPAITFPEI;IPAITFPEIPA;PEIPAN<br>ADGEL;EIPANADGELY;IPANADGELYV;ELYVIAGDIPL;LYVIAGDIPLI;VIAG<br>DIPLINI;PLINIPPTPGI;IPPTPGIGNTT;PTPGIGNTTTV;NTTTVPSSGFF;TTV<br>PSSGFFNT;VPSSGFFNTGA;NMSGWWNQAHT;HTALAGAGSGI;LAGAGS<br>GIANV;IANVGTLHSGV;VLNLGSGLSGI;GLSGIYNTSTL;SGIYNTSTLPL;NT<br>STLPLGTPA;STLPLGTPALV;LPLGTPALVSG;PLGTPALVSGL;TPALVSGL<br>GNV;LLASNVGQNPI;NPITIVNIGLA;ITIVNIGLANV;AANIGDVNLGF;DANFG<br>FGNSGL;LAAGLAGMGNI;LGNAGSGNVGW;WANMGLGNIGF;NTGTNNLGI<br>GL;GLNSGTGNIGL;LFNSGTGNIGF;FFNSGTANFGL;ANFGLFNSGSY;SYN<br>TGIGNSGV;LVNAGGFNTGV;ANAGSYNTGSF;GFNPGSTNTGW;ALITGNF<br>SNGI;ITGNFSNGILW;TGNFSNGILWR;FSNGILWRGNY;GILWRGNYEGL;IL<br>WRGNYEGLA;YEGLAGFSFGY;GLAGFSFGYPI;GFSFGYPIPLF;FGYPIPLF<br>PAV;YPIPLFPAVGA;IPLFPAVGADV;PLFPAVGADVT;FPAVGADVTGD;DV<br>TGDIGPATI;DIGPATIIPPI;GPATIIPPIHI;TIIPPIHIPSI;IPPIHIPSIPL;HIPSIPL<br>GFAA;IPSIPLGFAAI;IPLGFAAIGHI;AAIGHIGPISI;HIGPISIPNIA;ISIPNIAIPSI<br>;IPNIAIPSIHL;NIAIPSIHLGI;IPSIHLGIDPT;GIDPTFDVGPI;DPTFDVGPITV;F<br>DVGPITVDPI;TLTIPGLSLDA;LTIPGLSLDAA;TIPGLSLDAAV;GLSLDAAVSE<br>I;LSLDAAVSEIR;SLDAAVSEIRM;SEIRMTSGSSS;IRMTSGSSSGF;RMTSG<br>SSSGFK;MTSGSSSGFKV;TSGSSSGFKVR;SSSGFKVRPSF;SGFKVRPSF<br>SF;GFKVRPSFSFF;FKVRPSFSFFA;KVRPSFSFFAV;FSFFAVGPDGM;VG<br>PDGMPGGEV;GMPGGEVSILQ;GEVSILQPFTV;EVSILQPFTVA;SILQPFTV<br>API;LQPFTVAPINL;FTVAPINLNPT;TVAPINLNPTT;TLHFPGFTIPT;FPGFTI<br>PTGPI;TIPTGPIHIGL;IPTGPIHIGLP;GPIHIGLPLSL;LPLSLTIPGFT;PLSLTIP<br>GFTI;TIPGFTIPGGT;IPGFTIPGGTL;FTIPGGTLIPQ;TIPGGTLIPQL;LIPQLP<br>LGLGL;LPLGLGLSGGT;GLGLSGGTPPF;GLSGGTPPFDL;GTPPFDLPTVV;<br>TPPFDLPTVVI;LPTVVIDRIPV;TVVIDRIPVEL;VIDRIPVELHA;IPVELHASTTI<br>;ELHASTTIGPV;HASTTIGPVSL;STTIGPVSLPI;TTIGPVSLPIF;LPIFGFGGA<br>PG;TTAPSSGFFNT;FSNSGSGMSGV;SGVLNAISDPL;GVLNAISDPLL;FAN<br>FGTQLSGI;TQLSGILNRGA;ILNRGAGISGV;LNRGAGISGVY;GISGVYNTGT<br>L;GVYNTGTLGLV;GTLGLVTSAFV;GLVTSAFVSGF;LVTSAFVSGFM;TSAF<br>VSGFMNV;FMNVGQQLSGL;NVGQQLSGLLF;QQLSGLLFAGT<br>13 mers:<br>MNFPVLPPEINSV;NFPVLPPEINSVL;FPVLPPEINSVLM;PVLPPEINSVLMY<br>;VLPPEINSVLMYS;LPPEINSVLMYSG;PPEINSVLMYSGA;PEINSVLMYSG<br>AG;EINSVLMYSGAGS;INSVLMYSGAGSS;NSVLMYSGAGSSP;SVLMYSG<br>AGSSPL;VLMYSGAGSSPLL;LMYSGAGSSPLLA;MYSGAGSSPLLAA;YSG<br>AGSSPLLAAA;SGAGSSPLLAAAA;GAGSSPLLAAAAA;AGSSPLLAAAAAW;<br>GSSPLLAAAAAWD;SSPLLAAAAAWDG;SPLLAAAAAWDGL;PLLAAAAAW | |

Fig. 30 continued

| | | |
|---|---|---|
| | DGLA;LLAAAAAWDGLAE;LAAAAAWDGLAEE;AAAAAWDGLAEEL;AAAAWDGLAEELG;AAAWDGLAEELGS;AAWDGLAEELGSA;AWDGLAEELGSAA;WDGLAEELGSAAV;DGLAEELGSAAVS;GLAEELGSAAVSF;LAEELGSAAVSFG;AEELGSAAVSFGQ;EELGSAAVSFGQV;ELGSAAVSFGQVT;LGSAAVSFGQVTS;GSAAVSFGQVTSG;SAAVSFGQVTSGL;AAVSFGQVTSGLT;AVSFGQVTSGLTA;VSFGQVTSGLTAG;SFGQVTSGLTAGV;FGQVTSGLTAGVW;GQVTSGLTAGVWQ;QVTSGLTAGVWQG;VTSGLTAGVWQGA;TSGLTAGVWQGAA;SGLTAGVWQGAAA;GLTAGVWQGAAAA;LTAGVWQGAAAAA;TAGVWQGAAAAAM;AGVWQGAAAAAMA;GVWQGAAAAAMAA;VWQGAAAAAMAAA;WQGAAAAAMAAAA;QGAAAAAMAAAAA;GAAAAAMAAAAAP;AAAAAMAAAAAPY;AAAAMAAAAAPYA;AAAMAAAAAPYAG;AAMAAAAAPYAGW;AMAAAAAPYAGWL;MAAAAAPYAGWLG;AAAAAPYAGWLGS;AAAAPYAGWLGSV;AAAPYAGWLGSVA;AAPYAGWLGSVAA;APYAGWLGSVAAQ;PYAGWLGSVAAQA;YAGWLGSVAAQAV;AGWLGSVAAQAVA;GWLGSVAAQAVAV;WLGSVAAQAVAVA;LGSVAAQAVAVAG;GSVAAQAVAVAGQ;SVAAQAVAVAGQA;VAAQAVAVAGQAR;AAQAVAVAGQARA;AQAVAVAGQARAA;QAVAVAGQARAAV;AVAVAGQARAAVA;VAVAGQARAAVAA;AVAGQARAAVAAF;VAGQARAAVAAFE;AGQARAAVAAFEA;GQARAAVAAFEAA;QARAAVAAFEAAL;ARAAVAAFEAALA;RAAVAAFEAALAA;AAVAAFEAALAAT;AVAAFEAALAATV;VAAFEAALAATVD;AAFEAALAATVDP;AFEAALAATVDPA;FEAALAATVDPAA;EAALAATVDPAAV;AALAATVDPAAVA;ALAATVDPAAVAV;LAATVDPAAVAVN;AATVDPAAVAVNR;ATVDPAAVAVNRM;TVDPAAVAVNRMA;VDPAAVAVNRMAM;DPAAVAVNRMAMR;PAAVAVNRMAMRA;AAVAVNRMAMRAL;AVAVNRMAMRALA;VAVNRMAMRALAM;AVNRMAMRALAMS;VNRMAMRALAMSN;NRMAMRALAMSNL;RMAMRALAMSNLL;MAMRALAMSNLLG;AMRALAMSNLLGQ;MRALAMSNLLGQN;RALAMSNLLGQNA;ALAMSNLLGQNAA;LAMSNLLGQNAAA;AMSNLLGQNAAAI;MSNLLGQNAAAIA;SNLLGQNAAAIAA;NLLGQNAAAIAAV;LLGQNAAAIAAVE;LGQNAAAIAAVEA;GQNAAAIAAVEAE;QNAAAIAAVEAEY;NAAAIAAVEAEYE;AAAIAAVEAEYEL;AAIAAVEAEYELM;AIAAVEAEYELMW;IAAVEAEYELMWA;AAVEAEYELMWAA;AVEAEYELMWAAD;VEAEYELMWAADV;EAEYELMWAADVA;AEYELMWAADVAA;EYELMWAADVAAM;YELMWAADVAAMA;ELMWAADVAAMAG;LMWAADVAAMAGY;MWAADVAAMAGYH;WAADVAAMAGYHS;AADVAAMAGYHSG;ADVAAMAGYHSGA;DVAAMAGYHSGAS;VAAMAGYHSGASA;AAMAGYHSGASAA;AMAGYHSGASAAA;MAGYHSGASAAAA;AGYHSGASAAAAA;GYHSGASAAAAAL;YHSGASAAAAALP;HSGASAAAAALPA;SGASAAAAALPAF;GASAAAAALPAFS;ASAAAAALPAFSP;SAAAAALPAFSPP;AAAAALPAFSPPA;AAAALPAFSPPAQ;AAALPAFSPPAQA;AALPAFSPPAQAL;ALPAFSPPAQALG;LPAFSPPAQALGG;PAFSPPAQALGGG;AFSPPAQALGGGV;FSPPAQALGGGVG;SPPAQALGGGVGA;PPAQALGGGVGAF;PAQALGGGVGAFL;AQALGGGVGAFLN;QALGGGVGAFLNA;ALGGGVGAFLNAL;LGGGVGAFLNALF;GGGVGAFLNALFA;GGVGAFLNALFAG;GVGAFLNALFAGP;VGAFLNALFAGPA;GAFLNALFAGPAK;AFLNALFAGPAKM;FLNALFAGPAKML;LNALFAGPAKMLR;NALFAGPAKMLRL;ALFAGPAKMLRLN;LFAGPAKMLRLNA;FAGPAKMLRLNAG;AGPAKMLRLNAGL;GPAKMLRLNAGLG;PAKMLRLNAGLGN;AKMLRLNAGLGNV;KMLRLNAGLGNVG;MLRLNAGLGNVGN;LRLNAGLGNVGNY;RLNAGLGNVGNYN;LNAGLGNVGNYNV;NAGLGNVGNYNVG;AGLGNVGNYNVGL;GLGNVGNYNVGLG;LGNVGNYNVGLGN;GNVGNYNVGLGNV;NVGNYNVGLGNVG;VGNYNVGLGNVGI;GNYNVGLGNVGIF;NYNVGLGNVGIFN;YNVGLGNVGIFNL;NVGLGNVGIFNLG;VGLGNVGIFNLGA;GLGNVGIFNLGAA;LGNVGIFNLGAAN;GNVGIFNLGAANV;NVGIFNLGAANVG;VGIFNLGAANVGA;GIFNLGAANVGAQ;IFNLGAANVGAQN;FNLGAANVGAQNL;NLGAANVGAQNLG;LGAANVGA | |

Fig. 30 continued

| | | |
|---|---|---|
| | QNLGA;GAANVGAQNLGAA;AANVGAQNLGAAN;ANVGAQNLGAANA;NVGAQNLGAANAG;VGAQNLGAANAGS;GAQNLGAANAGSG;AQNLGAANAGSGN;QNLGAANAGSGNF;NLGAANAGSGNFG;LGAANAGSGNFGF;GAANAGSGNFGFG;AANAGSGNFGFGN;ANAGSGNFGFGNI;NAGSGNFGFGNIG;AGSGNFGFGNIGN;GSGNFGFGNIGNA;SGNFGFGNIGNAN;GNFGFGNIGNANF;NFGFGNIGNANFG;FGFGNIGNANFGF;GFGNIGNANFGFG;FGNIGNANFGFGN;GNIGNANFGFGNS;NIGNANFGFGNSG;IGNANFGFGNSGL;GNANFGFGNSGLG;NANFGFGNSGLGL;ANFGFGNSGLGLP;NFGFGNSGLGLPP;FGFGNSGLGLPPG;GFGNSGLGLPPGM;FGNSGLGLPPGMG;GNSGLGLPPGMGN;NSGLGLPPGMGNI;SGLGLPPGMGNIG;GLGLPPGMGNIGL;LGLPPGMGNIGLG;GLPPGMGNIGLGN;LPPGMGNIGLGNA;PPGMGNIGLGNAG;PGMGNIGLGNAGS;GMGNIGLGNAGSS;MGNIGLGNAGSSN;GNIGLGNAGSSNY;NIGLGNAGSSNYG;IGLGNAGSSNYGL;GLGNAGSSNYGLA;LGNAGSSNYGLAN;GNAGSSNYGLANL;NAGSSNYGLANLG;AGSSNYGLANLGV;GSSNYGLANLGVG;SSNYGLANLGVGN;SNYGLANLGVGNI;NYGLANLGVGNIG;YGLANLGVGNIGF;GLANLGVGNIGFA;LANLGVGNIGFAN;ANLGVGNIGFANT;NLGVGNIGFANTG;LGVGNIGFANTGS;GVGNIGFANTGSN;VGNIGFANTGSNN;GNIGFANTGSNNI;NIGFANTGSNNIG;IGFANTGSNNIGI;GFANTGSNNIGIG;FANTGSNNIGIGL;ANTGSNNIGIGLT;NTGSNNIGIGLTG;TGSNNIGIGLTGD;GSNNIGIGLTGDN;SNNIGIGLTGDNL;NNIGIGLTGDNLT;NIGIGLTGDNLTG;IGIGLTGDNLTGI;GIGLTGDNLTGIG;IGLTGDNLTGIGG;GLTGDNLTGIGGL;LTGDNLTGIGGLN;TGDNLTGIGGLNS;GDNLTGIGGLNSG;DNLTGIGGLNSGT;NLTGIGGLNSGTG;LTGIGGLNSGTGN;TGIGGLNSGTGNL;GIGGLNSGTGNLG;IGGLNSGTGNLGL;GGLNSGTGNLGLF;GLNSGTGNLGLFN;LNSGTGNLGLFNS;NSGTGNLGLFNSG;SGTGNLGLFNSGT;GTGNLGLFNSGTG;TGNLGLFNSGTGN;GNLGLFNSGTGNI;NLGLFNSGTGNIG;LGLFNSGTGNIGF;GLFNSGTGNIGFF;LFNSGTGNIGFFN;FNSGTGNIGFFNS;NSGTGNIGFFNSG;SGTGNIGFFNSGT;GTGNIGFFNSGTG;TGNIGFFNSGTGN;GNIGFFNSGTGNF;NIGFFNSGTGNFG;IGFFNSGTGNFGV;GFFNSGTGNFGVF;FFNSGTGNFGVFN;FNSGTGNFGVFNS;NSGTGNFGVFNSG;SGTGNFGVFNSGS;GTGNFGVFNSGSY;TGNFGVFNSGSYN;GNFGVFNSGSYNT;NFGVFNSGSYNTG;FGVFNSGSYNTGV;GVFNSGSYNTGVG;VFNSGSYNTGVGN;FNSGSYNTGVGNA;NSGSYNTGVGNAG;SGSYNTGVGNAGT;GSYNTGVGNAGTA;SYNTGVGNAGTAS;YNTGVGNAGTAST;NTGVGNAGTASTG;TGVGNAGTASTGL;GVGNAGTASTGLF;VGNAGTASTGLFN;GNAGTASTGLFNV;NAGTASTGLFNVG;AGTASTGLFNVGG;GTASTGLFNVGGF;TASTGLFNVGGFN;ASTGLFNVGGFNT;STGLFNVGGFNTG;TGLFNVGGFNTGV;GLFNVGGFNTGVA;LFNVGGFNTGVAN;FNVGGFNTGVANV;NVGGFNTGVANVG;VGGFNTGVANVGS;GGFNTGVANVGSY;GFNTGVANVGSYN;FNTGVANVGSYNT;NTGVANVGSYNTG;TGVANVGSYNTGS;GVANVGSYNTGSF;VANVGSYNTGSFN;ANVGSYNTGSFNA;NVGSYNTGSFNAG;VGSYNTGSFNAGN;GSYNTGSFNAGNT;SYNTGSFNAGNTN;YNTGSFNAGNTNT;NTGSFNAGNTNTG;TGSFNAGNTNTGG;GSFNAGNTNTGGF;SFNAGNTNTGGFN;FNAGNTNTGGFNP;NAGNTNTGGFNPG;AGNTNTGGFNPGN;GNTNTGGFNPGNV;NTNTGGFNPGNVN;TNTGGFNPGNVNT;NTGGFNPGNVNTG;TGGFNPGNVNTGW;GGFNPGNVNTGWL;GFNPGNVNTGWLN;FNPGNVNTGWLNT;NPGNVNTGWLNTG;PGNVNTGWLNTGN;GNVNTGWLNTGNT;NVNTGWLNTGNTN;VNTGWLNTGNTNT;NTGWLNTGNTNTG;TGWLNTGNTNTGI;GWLNTGNTNTGIA;WLNTGNTNTGIAN;LNTGNTNTGIANS;NTGNTNTGIANSG;TGNTNTGIANSGN;GNTNTGIANSGNV;NTNTGIANSGNVN;TNTGIANSGNVNT;NTGIANSGNVNTG;TGIANSGNVNTGA;GIANSGNVNTGAF;IANSGNVNTGAFI;ANSGNVNTGAFIS;NSGNVNTGAFISG;SGNVNTGAFISGN;GNVNTGAFISGNF;NVNTGAFISGNFS;VNTGAFISGNF | |

Fig. 30 continued

| | | |
|---|---|---|
| | SN;NTGAFISGNFSNG;TGAFISGNFSNGV;GAFISGNFSNGVL;AFISGNFSN<br>GVLW;FISGNFSNGVLWR;ISGNFSNGVLWRG;SGNFSNGVLWRGD;GNFS<br>NGVLWRGDY;NFSNGVLWRGDYE;FSNGVLWRGDYEG;SNGVLWRGDYE<br>GL;NGVLWRGDYEGLW;GVLWRGDYEGLWG;VLWRGDYEGLWGL;LWRG<br>DYEGLWGLS;WRGDYEGLWGLSG;RGDYEGLWGLSGG;GDYEGLWGLSG<br>GS;DYEGLWGLSGGST;YEGLWGLSGGSTI;EGLWGLSGGSTIP;GLWGLS<br>GGSTIPA;LWGLSGGSTIPAI;WGLSGGSTIPAIP;GLSGGSTIPAIPI;LSGGST<br>IPAIPIG;SGGSTIPAIPIGL;GGSTIPAIPIGLE;GSTIPAIPIGLEL;STIPAIPIGLE<br>LN;TIPAIPIGLELNG;IPAIPIGLELNGG;PAIPIGLELNGGV;AIPIGLELNGGVG<br>;IPIGLELNGGVGP;PIGLELNGGVGPI;IGLELNGGVGPIT;GLELNGGVGPIT<br>V;LELNGGVGPITVL;ELNGGVGPITVLP;LNGGVGPITVLPI;NGGVGPITVLPI<br>Q;GGVGPITVLPIQI;GVGPITVLPIQIL;VGPITVLPIQILP;GPITVLPIQILPT;PIT<br>VLPIQILPTI;ITVLPIQILPTIP;TVLPIQILPTIPL;VLPIQILPTIPLN;LPIQILPTIPL<br>NI;PIQILPTIPLNIH;IQILPTIPLNIHQ;QILPTIPLNIHQT;ILPTIPLNIHQTF;LPTI<br>PLNIHQTFS;PTIPLNIHQTFSL;TIPLNIHQTFSLG;IPLNIHQTFSLGP;PLNIHQ<br>TFSLGPL;LNIHQTFSLGPLV;NIHQTFSLGPLVV;IHQTFSLGPLVVP;HQTFS<br>LGPLVVPD;QTFSLGPLVVPDI;TFSLGPLVVPDIV;FSLGPLVVPDIVI;SLGPL<br>VVPDIVIP;LGPLVVPDIVIPA;GPLVVPDIVIPAF;PLVVPDIVIPAFG;LVVPDIVI<br>PAFGG;VVPDIVIPAFGGG;VPDIVIPAFGGGT;PDIVIPAFGGGTA;DIVIPAFG<br>GGTAI;IVIPAFGGGTAIP;VIPAFGGGTAIPI;IPAFGGGTAIPIS;PAFGGGTAIP<br>ISV;AFGGGTAIPISVG;FGGGTAIPISVGP;GGGTAIPISVGPI;GGTAIPISVGP<br>IT;GTAIPISVGPITI;TAIPISVGPITIS;AIPISVGPITISP;IPISVGPITISPI;PISVG<br>PITISPIT;ISVGPITISPITL;SVGPITISPITLF;VGPITISPITLFP;GPITISPITLFP<br>A;PITISPITLFPAQ;ITISPITLFPAQN;TISPITLFPAQNF;ISPITLFPAQNFN;SPI<br>TLFPAQNFNT;PITLFPAQNFNTT;ITLFPAQNFNTTF;TLFPAQNFNTTFP;LF<br>PAQNFNTTFPV;FPAQNFNTTFPVG;PAQNFNTTFPVGP;AQNFNTTFPVGP<br>F;QNFNTTFPVGPFF;NFNTTFPVGPFFG;FNTTFPVGPFFGL;NTTFPVGPF<br>FGLG;TTFPVGPFFGLGV;TFPVGPFFGLGVV;FPVGPFFGLGVVN;PVGPFF<br>GLGVVNI;VGPFFGLGVVNIS;GPFFGLGVVNISG;PFFGLGVVNISGI;FFGLG<br>VVNISGIE;FGLGVVNISGIEI;GLGVVNISGIEIK;LGVVNISGIEIKD;GVVNISGI<br>EIKDL;VVNISGIEIKDLA;VNISGIEIKDLAG;NISGIEIKDLAGN;ISGIEIKDLAG<br>NV;SGIEIKDLAGNVT;GIEIKDLAGNVTL;IEIKDLAGNVTLQ;EIKDLAGNVTL<br>QL;IKDLAGNVTLQLG;KDLAGNVTLQLGN;DLAGNVTLQLGNL;LAGNVTLQ<br>LGNLN;AGNVTLQLGNLNI;GNVTLQLGNLNID;NVTLQLGNLNIDT;VTLQLG<br>NLNIDTR;TLQLGNLNIDTRI;LQLGNLNIDTRIN;QLGNLNIDTRINQ;LGNLNID<br>TRINQS;GNLNIDTRINQSF;NLNIDTRINQSFP;LNIDTRINQSFPV;NIDTRINQ<br>SFPVT;IDTRINQSFPVTV;DTRINQSFPVTVN;TRINQSFPVTVNW;RINQSFP<br>VTVNWS;INQSFPVTVNWST;NQSFPVTVNWSTP;QSFPVTVNWSTPA;SFP<br>VTVNWSTPAV;FPVTVNWSTPAVT;PVTVNWSTPAVTI;VTVNWSTPAVTIF;<br>TVNWSTPAVTIFP;VNWSTPAVTIFPN;NWSTPAVTIFPNG;WSTPAVTIFPN<br>GI;STPAVTIFPNGIS;TPAVTIFPNGISI;PAVTIFPNGISIP;AVTIFPNGISIPN;V<br>TIFPNGISIPNN;TIFPNGISIPNNP;IFPNGISIPNNPL;FPNGISIPNNPLA;PNGI<br>SIPNNPLAL;NGISIPNNPLALL;GISIPNNPLALLA;ISIPNNPLALLAS;SIPNNP<br>LALLASA;IPNNPLALLASAS;PNNPLALLASASI;NNPLALLASASIG;NPLALL<br>ASASIGT;PLALLASASIGTL;LALLASASIGTLG;ALLASASIGTLGF;LLASASI<br>GTLGFT;LASASIGTLGFTI;ASASIGTLGFTIP;SASIGTLGFTIPG;ASIGTLGF<br>TIPGF;SIGTLGFTIPGFT;IGTLGFTIPGFTI;GTLGFTIPGFTIP;TLGFTIPGFTI<br>PA;LGFTIPGFTIPAA;GFTIPGFTIPAAP;FTIPGFTIPAAPL;TIPGFTIPAAPLP;<br>IPGFTIPAAPLPL;PGFTIPAAPLPLT;GFTIPAAPLPLTI;FTIPAAPLPLTID;TIP<br>AAPLPLTIDI;IPAAPLPLTIDID;PAAPLPLTIDIDG;AAPLPLTIDIDGQ;APLPLTI<br>DIDGQI;PLPLTIDIDGQID;LPLTIDIDGQIDG;PLTIDIDGQIDGF;LTIDIDGQID<br>GFS;TIDIDGQIDGFST;IDIDGQIDGFSTP;DIDGQIDGFSTPP;IDGQIDGFST<br>PPI;DGQIDGFSTPPIT;GQIDGFSTPPITI;QIDGFSTPPITID;IDGFSTPPITIDR | |

Fig. 30 continued

| | | |
|---|---|---|
| | ;DGFSTPPITIDRI;GFSTPPITIDRIP;FSTPPITIDRIPL;STPPITIDRIPLN;TPPITIDRIPLNL;PPITIDRIPLNLG;PITIDRIPLNLGA;ITIDRIPLNLGAS;TIDRIPLNLGASV;IDRIPLNLGASVT;DRIPLNLGASVTV;RIPLNLGASVTVG;IPLNLGASVTVGP;PLNLGASVTVGPI;LNLGASVTVGPIL;NLGASVTVGPILI;LGASVTVGPILIN;GASVTVGPILING;ASVTVGPILINGV;SVTVGPILINGVN;VTVGPILINGVNI;TVGPILINGVNIP;VGPILINGVNIPA;GPILINGVNIPAT;PILINGVNIPATP;ILINGVNIPATPG;LINGVNIPATPGF;INGVNIPATPGFG;NGVNIPATPGFGN;GVNIPATPGFGNT;VNIPATPGFGNTT;NIPATPGFGNTTT;IPATPGFGNTTTA;PATPGFGNTTTAP;ATPGFGNTTTAPS;TPGFGNTTTAPSS;PGFGNTTTAPSSG;GFGNTTTAPSSGF;FGNTTTAPSSGFF;GNTTTAPSSGFFN;NTTTAPSSGFFNS;TTTAPSSGFFNSG;TTAPSSGFFNSGD;TAPSSGFFNSGDG;APSSGFFNSGDGG;PSSGFFNSGDGGV;SSGFFNSGDGGVS;SGFFNSGDGGVSG;GFFNSGDGGVSGF;FFNSGDGGVSGFG;FNSGDGGVSGFGN;NSGDGGVSGFGNF;SGDGGVSGFGNFG;GDGGVSGFGNFGA;DGGVSGFGNFGAG;GGVSGFGNFGAGS;GVSGFGNFGAGSS;VSGFGNFGAGSSG;SGFGNFGAGSSGW;GFGNFGAGSSGWW;FGNFGAGSSGWWN;GNFGAGSSGWWNQ;NFGAGSSGWWNQA;FGAGSSGWWNQAQ;GAGSSGWWNQAQT;AGSSGWWNQAQTE;GSSGWWNQAQTEV;SSGWWNQAQTEVA;SGWWNQAQTEVAG;GWWNQAQTEVAGA;WWNQAQTEVAGAG;WNQAQTEVAGAGS;NQAQTEVAGAGSG;QAQTEVAGAGSGF;AQTEVAGAGSGFA;QTEVAGAGSGFAN;TEVAGAGSGFANF;EVAGAGSGFANFG;VAGAGSGFANFGS;AGAGSGFANFGSL;GAGSGFANFGSLG;AGSGFANFGSLGS;GSGFANFGSLGSG;SGFANFGSLGSGV;GFANFGSLGSGVL;FANFGSLGSGVLN;ANFGSLGSGVLNF;NFGSLGSGVLNFG;FGSLGSGVLNFGS;GSLGSGVLNFGSG;SLGSGVLNFGSGV;LGSGVLNFGSGVS;GSGVLNFGSGVSG;SGVLNFGSGVSGL;GVLNFGSGVSGLY;VLNFGSGVSGLYN;LNFGSGVSGLYNT;NFGSGVSGLYNTG;FGSGVSGLYNTGG;GSGVSGLYNTGGL;SGVSGLYNTGGLP;GVSGLYNTGGLPP;VSGLYNTGGLPPG;SGLYNTGGLPPGT;GLYNTGGLPPGTP;LYNTGGLPPGTPA;YNTGGLPPGTPAV;NTGGLPPGTPAVV;TGGLPPGTPAVVS;GGLPPGTPAVVSG;GLPPGTPAVVSGI;LPPGTPAVVSGIG;PPGTPAVVSGIGN;PGTPAVVSGIGNV;GTPAVVSGIGNVG;TPAVVSGIGNVGE;PAVVSGIGNVGEQ;AVVSGIGNVGEQL;VVSGIGNVGEQLS;VSGIGNVGEQLSG;SGIGNVGEQLSGL;GIGNVGEQLSGLS;IGNVGEQLSGLSS;GNVGEQLSGLSSA;NVGEQLSGLSSAG;VGEQLSGLSSAGT;GEQLSGLSSAGTA;EQLSGLSSAGTAL;QLSGLSSAGTALN;LSGLSSAGTALNQ;SGLSSAGTALNQS;GLSSAGTALNQSL;LSSAGTALNQSLI;SSAGTALNQSLII;SAGTALNQSLIIN;AGTALNQSLIINL;GTALNQSLIINLG;TALNQSLIINLGL;ALNQSLIINLGLA;LNQSLIINLGLAD;NQSLIINLGLADV;QSLIINLGLADVG;SLIINLGLADVGS;LIINLGLADVGSV;IINLGLADVGSVN;INLGLADVGSVNV;NLGLADVGSVNVG;LGLADVGSVNVGF;GLADVGSVNVGFG;LADVGSVNVGFGN;ADVGSVNVGFGNV;DVGSVNVGFGNVG;VGSVNVGFGNVGD;GSVNVGFGNVGDF;SVNVGFGNVGDFN;VNVGFGNVGDFNL;NVGFGNVGDFNLG;VGFGNVGDFNLGA;GFGNVGDFNLGAA;FGNVGDFNLGAAN;GNVGDFNLGAANI;NVGDFNLGAANIG;VGDFNLGAANIGD;GDFNLGAANIGDL;DFNLGAANIGDLN;FNLGAANIGDLNV;NLGAANIGDLNVG;LGAANIGDLNVGL;GAANIGDLNVGLG;AANIGDLNVGLGN;ANIGDLNVGLGNV;NIGDLNVGLGNVG;IGDLNVGLGNVGG;GDLNVGLGNVGGG;DLNVGLGNVGGGN;LNVGLGNVGGGNV;NVGLGNVGGGNVG;VGLGNVGGGNVGF;GLGNVGGGNVGFG;LGNVGGGNVGFGN;GNVGGGNVGFGNI;NVGGGNVGFGNIG;VGGGNVGFGNIGD;GGGNVGFGNIGDA;GGNVGFGNIGDAN;GNVGFGNIGDANF;NVGFGNIGDANFG;VGFGNIGDANFGL;GFGNIGDANFGLG;FGNIGDANFGLGN;GNIGDANFGLGNA;NIGDANFGLGNAG;IGDANFGLGNAGL;GDANFGLGNAGLA;DANFGLGNAGLAA;ANFGLGNAGLAAG;NFGLGNAGLAAGL;FGLGNAGLAAGLA;GLGNAGL | |

Fig. 30 continued

| | | |
|---|---|---|
| | AAGLAG;LGNAGLAAGLAGV;GNAGLAAGLAGVG;NAGLAAGLAGVGN;AGLAAGLAGVGNI;GLAAGLAGVGNIG;LAAGLAGVGNIGL;AAGLAGVGNIGLG;AGLAGVGNIGLGN;GLAGVGNIGLGNA;LAGVGNIGLGNAG;AGVGNIGLGNAGS;GVGNIGLGNAGSG;VGNIGLGNAGSGN;GNIGLGNAGSGNV;NIGLGNAGSGNVG;IGLGNAGSGNVGF;GLGNAGSGNVGFG;LGNAGSGNVGFGN;GNAGSGNVGFGNM;NAGSGNVGFGNMG;AGSGNVGFGNMGV;GSGNVGFGNMGVG;SGNVGFGNMGVGN;GNVGFGNMGVGNI;NVGFGNMGVGNIG;VGFGNMGVGNIGF;GFGNMGVGNIGFG;FGNMGVGNIGFGN;GNMGVGNIGFGNT;NMGVGNIGFGNTG;MGVGNIGFGNTGT;GVGNIGFGNTGTN;VGNIGFGNTGTNN;GNIGFGNTGTNNL;NIGFGNTGTNNLG;IGFGNTGTNNLGI;GFGNTGTNNLGIG;FGNTGTNNLGIGL;GNTGTNNLGIGLT;NTGTNNLGIGLTG;TGTNNLGIGLTGD;GTNNLGIGLTGDN;TNNLGIGLTGDNQ;NNLGIGLTGDNQT;NLGIGLTGDNQTG;LGIGLTGDNQTGI;GIGLTGDNQTGIG;IGLTGDNQTGIGG;GLTGDNQTGIGGL;LTGDNQTGIGGLN;TGDNQTGIGGLNS;GDNQTGIGGLNSG;DNQTGIGGLNSGA;NQTGIGGLNSGAG;QTGIGGLNSGAGN;TGIGGLNSGAGNI;GIGGLNSGAGNIG;IGGLNSGAGNIGL;GGLNSGAGNIGLF;GLNSGAGNIGLFN;LNSGAGNIGLFNS;NSGAGNIGLFNSG;SGAGNIGLFNSGT;GAGNIGLFNSGTG;AGNIGLFNSGTGN;GNIGLFNSGTGNV;NIGLFNSGTGNVG;IGLFNSGTGNVGL;GLFNSGTGNVGLF;LFNSGTGNVGLFN;FNSGTGNVGLFNS;NSGTGNVGLFNSG;SGTGNVGLFNSGT;GTGNVGLFNSGTG;TGNVGLFNSGTGN;GNVGLFNSGTGNF;NVGLFNSGTGNFG;VGLFNSGTGNFGL;GLFNSGTGNFGLF;LFNSGTGNFGLFN;FNSGTGNFGLFNS;NSGTGNFGLFNSG;SGTGNFGLFNSGS;GTGNFGLFNSGSF;TGNFGLFNSGSFN;GNFGLFNSGSFNT;NFGLFNSGSFNTG;FGLFNSGSFNTGI;GLFNSGSFNTGIG;LFNSGSFNTGIGN;FNSGSFNTGIGNG;NSGSFNTGIGNGG;SGSFNTGIGNGGT;GSFNTGIGNGGTG;SFNTGIGNGGTGS;FNTGIGNGGTGST;NTGIGNGGTGSTG;TGIGNGGTGSTGL;GIGNGGTGSTGLF;IGNGGTGSTGLFN;GNGGTGSTGLFNA;NGGTGSTGLFNAG;GGTGSTGLFNAGN;GTGSTGLFNAGNF;TGSTGLFNAGNFN;GSTGLFNAGNFNT;STGLFNAGNFNTG;TGLFNAGNFNTGV;GLFNAGNFNTGVA;LFNAGNFNTGVAN;FNAGNFNTGVANP;NAGNFNTGVANPG;AGNFNTGVANPGS;GNFNTGVANPGSY;NFNTGVANPGSYN;FNTGVANPGSYNT;NTGVANPGSYNTG;TGVANPGSYNTGS;GVANPGSYNTGSF;VANPGSYNTGSFN;ANPGSYNTGSFNV;NPGSYNTGSFNVG;PGSYNTGSFNVGD;GSYNTGSFNVGDT;SYNTGSFNVGDTN;YNTGSFNVGDTNT;NTGSFNVGDTNTG;TGSFNVGDTNTGG;GSFNVGDTNTGGF;SFNVGDTNTGGFN;FNVGDTNTGGFNP;NVGDTNTGGFNPG;VGDTNTGGFNPGS;GDTNTGGFNPGSI;DTNTGGFNPGSIN;TNTGGFNPGSINT;NTGGFNPGSINTG;TGGFNPGSINTGW;GGFNPGSINTGWF;GFNPGSINTGWFN;FNPGSINTGWFNT;NPGSINTGWFNTG;PGSINTGWFNTGN;GSINTGWFNTGNA;SINTGWFNTGNAN;INTGWFNTGNANT;NTGWFNTGNANTG;TGWFNTGNANTGV;GWFNTGNANTGVA;WFNTGNANTGVAN;FNTGNANTGVANS;NTGNANTGVANSG;TGNANTGVANSGN;GNANTGVANSGNV;NANTGVANSGNVD;ANTGVANSGNVDT;NTGVANSGNVDTG;TGVANSGNVDTGA;GVANSGNVDTGAL;VANSGNVDTGALM;ANSGNVDTGALMS;NSGNVDTGALMSG;SGNVDTGALMSGN;GNVDTGALMSGNF;NVDTGALMSGNFS;VDTGALMSGNFSN;DTGALMSGNFSNG;TGALMSGNFSNGI;GALMSGNFSNGIL;ALMSGNFSNGILW;LMSGNFSNGILWR;MSGNFSNGILWRG;SGNFSNGILWRGN;GNFSNGILWRGNF;NFSNGILWRGNFE;FSNGILWRGNFEG;SNGILWRGNFEGL;NGILWRGNFEGLF;GILWRGNFEGLFG;ILWRGNFEGLFGL;LWRGNFEGLFGLN;WRGNFEGLFGLNV;RGNFEGLFGLNVG;GNFEGLFGLNVGI;NFEGLFGLNVGIT;FEGLFGLNVGITI;EGLFGLNVGITIP;GLFGLNVGITIPE;LFGLNVGITIPEF;FGLNVGITIPEFP;GLNVGITIPEFPI;LNVGITIPEFPIH;NVGITIPEFPIHW;VGITIPEFPIHWT;GITIPEFPIHWTS;ITIPEFPIHWTST | |

Fig. 30 continued

| | | |
|---|---|---|
| | ;TIPEFPIHWTSTG;IPEFPIHWTSTGG;PEFPIHWTSTGGI;EFPIHWTSTGGIG;FPIHWTSTGGIGP;PIHWTSTGGIGPI;IHWTSTGGIGPII;HWTSTGGIGPIII;WTSTGGIGPIIIP;TSTGGIGPIIIPD;STGGIGPIIIPDT;TGGIGPIIIPDTT;GGIGPIIIPDTTI;GIGPIIIPDTTIL;IGPIIIPDTTILP;GPIIIPDTTILPP;PIIIPDTTILPPI;IIIPDTTILPPIH;IIPDTTILPPIHL;IPDTTILPPIHLG;PDTTILPPIHLGL;DTTILPPIHLGLT;TTILPPIHLGLTG;TILPPIHLGLTGQ;ILPPIHLGLTGQA;LPPIHLGLTGQAN;PPIHLGLTGQANY;PIHLGLTGQANYG;IHLGLTGQANYGF;HLGLTGQANYGFA;LGLTGQANYGFAV;GLTGQANYGFAVP;LTGQANYGFAVPD;TGQANYGFAVPDI;GQANYGFAVPDIP;QANYGFAVPDIPI;ANYGFAVPDIPIP;NYGFAVPDIPIPA;YGFAVPDIPIPAI;GFAVPDIPIPAIH;FAVPDIPIPAIHI;AVPDIPIPAIHID;VPDIPIPAIHIDF;PDIPIPAIHIDFD;DIPIPAIHIDFDG;IPIPAIHIDFDGA;PIPAIHIDFDGAA;IPAIHIDFDGAAD;PAIHIDFDGAADA;AIHIDFDGAADAG;IHIDFDGAADAGF;HIDFDGAADAGFT;IDFDGAADAGFTA;DFDGAADAGFTAP;FDGAADAGFTAPA;DGAADAGFTAPAT;GAADAGFTAPATT;AADAGFTAPATTL;ADAGFTAPATTLL;DAGFTAPATTLLS;AGFTAPATTLLSA;GFTAPATTLLSAL;FTAPATTLLSALG;TAPATTLLSALGI;APATTLLSALGIT;PATTLLSALGITG;ATTLLSALGITGQ;TTLLSALGITGQF;TLLSALGITGQFR;LLSALGITGQFRF;LSALGITGQFRFG;SALGITGQFRFGP;ALGITGQFRFGPI;LGITGQFRFGPIT;GITGQFRFGPITV;ITGQFRFGPITVS;TGQFRFGPITVSN;GQFRFGPITVSNV;QFRFGPITVSNVQ;FRFGPITVSNVQL;RFGPITVSNVQLN;FGPITVSNVQLNP;GPITVSNVQLNPF;PITVSNVQLNPFN;ITVSNVQLNPFNV;TVSNVQLNPFNVN;VSNVQLNPFNVNL;SNVQLNPFNVNLK;NVQLNPFNVNLKL;VQLNPFNVNLKLQ;QLNPFNVNLKLQF;LNPFNVNLKLQFL;NPFNVNLKLQFLH;PFNVNLKLQFLHD;FNVNLKLQFLHDA;NVNLKLQFLHDAF;VNLKLQFLHDAFP;NLKLQFLHDAFPN;LKLQFLHDAFPNE;KLQFLHDAFPNEF;LQFLHDAFPNEFP;QFLHDAFPNEFPD;FLHDAFPNEFPDP;LHDAFPNEFPDPT;HDAFPNEFPDPTI;DAFPNEFPDPTIS;AFPNEFPDPTISV;FPNEFPDPTISVQ;PNEFPDPTISVQI;NEFPDPTISVQIQ;EFPDPTISVQIQV;FPDPTISVQIQVA;PDPTISVQIQVAI;DPTISVQIQVAIP;PTISVQIQVAIPL;TISVQIQVAIPLT;ISVQIQVAIPLTS;SVQIQVAIPLTSA;VQIQVAIPLTSAT;QIQVAIPLTSATL;IQVAIPLTSATLG;QVAIPLTSATLGG;VAIPLTSATLGGL;AIPLTSATLGGLA;IPLTSATLGGLAL;PLTSATLGGLALP;LTSATLGGLALPL;TSATLGGLALPLQ;SATLGGLALPLQQ;ATLGGLALPLQQT;TLGGLALPLQQTI;LGGLALPLQQTID;GGLALPLQQTIDA;GLALPLQQTIDAI;LALPLQQTIDAIE;ALPLQQTIDAIEL;LPLQQTIDAIELP;PLQQTIDAIELPA;LQQTIDAIELPAI;QQTIDAIELPAIS;QTIDAIELPAISF;TIDAIELPAISFS;IDAIELPAISFSQ;DAIELPAISFSQS;AIELPAISFSQSI;IELPAISFSQSIP;ELPAISFSQSIPI;LPAISFSQSIPID;PAISFSQSIPIDI;AISFSQSIPIDIP;ISFSQSIPIDIPP;SFSQSIPIDIPPI;FSQSIPIDIPPID;SQSIPIDIPPIDI;QSIPIDIPPIDIP;SIPIDIPPIDIPA;IPIDIPPIDIPAS;PIDIPPIDIPAST;IDIPPIDIPASTI;DIPPIDIPASTIN;IPPIDIPASTING;PPIDIPASTINGI;PIDIPASTINGIS;IDIPASTINGISM;DIPASTINGISMS;IPASTINGISMSE;PASTINGISMSEV;ASTINGISMSEVV;STINGISMSEVVP;TINGISMSEVVPI;INGISMSEVVPID;NGISMSEVVPIDV;GISMSEVVPIDVS;ISMSEVVPIDVSV;SMSEVVPIDVSVD;MSEVVPIDVSVDI;SEVVPIDVSVDIP;EVVPIDVSVDIPA;VVPIDVSVDIPAV;VPIDVSVDIPAVT;PIDVSVDIPAVTI;IDVSVDIPAVTIT;DVSVDIPAVTITG;VSVDIPAVTITGT;SVDIPAVTITGTR;VDIPAVTITGTRI;DIPAVTITGTRID;IPAVTITGTRIDP;PAVTITGTRIDPI;AVTITGTRIDPIP;VTITGTRIDPIPL;TITGTRIDPIPLN;ITGTRIDPIPLNF;TGTRIDPIPLNFD;GTRIDPIPLNFDV;TRIDPIPLNFDVL;RIDPIPLNFDVLS;IDPIPLNFDVLSS;DPIPLNFDVLSSA;PIPLNFDVLSSAG;IPLNFDVLSSAGP;PLNFDVLSSAGPI;LNFDVLSSAGPIN;NFDVLSSAGPINI;FDVLSSAGPINIS;DVLSSAGPINISI;VLSSAGPINISII;LSSAGPINISIID;SSAGPINISIIDI;SAGPINISIIDIP;AGPINISIIDIPA;GPINISIIDIPAL;PINISIIDIPALP;INISIIDIPALPG;NISIIDIPALPGF;ISIIDIPALPGFG;SIIDIPALPGFGN;IIDIPALPGFGNS;IDI | |

Fig. 30 continued

| | | |
|---|---|---|
| | PALPGFGNST;DIPALPGFGNSTE;IPALPGFGNSTEL;PALPGFGNSTELP;ALPGFGNSTELPS;LPGFGNSTELPSS;PGFGNSTELPSSG;GFGNSTELPSSGF;FGNSTELPSSGFF;GNSTELPSSGFFN;NSTELPSSGFFNT;STELPSSGFFNTG;TELPSSGFFNTGG;ELPSSGFFNTGGG;LPSSGFFNTGGGG;PSSGFFNTGGGGG;SSGFFNTGGGGGS;SGFFNTGGGGGSG;GFFNTGGGGGSGI;FFNTGGGGGSGIA;FNTGGGGGSGIAN;NTGGGGGSGIANF;TGGGGGSGIANFG;GGGGGSGIANFGA;GGGGSGIANFGAG;GGGSGIANFGAGV;GGSGIANFGAGVS;GSGIANFGAGVSG;SGIANFGAGVSGL;GIANFGAGVSGLL;IANFGAGVSGLLN;ANFGAGVSGLLNQ;NFGAGVSGLLNQA;FGAGVSGLLNQAS;GAGVSGLLNQASS;AGVSGLLNQASSP;GVSGLLNQASSPM;VSGLLNQASSPMV;SGLLNQASSPMVG;GLLNQASSPMVGT;LLNQASSPMVGTL;LNQASSPMVGTLS;NQASSPMVGTLSG;QASSPMVGTLSGL;ASSPMVGTLSGLG;SSPMVGTLSGLGN;SPMVGTLSGLGNA;PMVGTLSGLGNAG;MVGTLSGLGNAGS;VGTLSGLGNAGSL;GTLSGLGNAGSLA;TLSGLGNAGSLAS;LSGLGNAGSLASG;SGLGNAGSLASGV;GLGNAGSLASGVL;LGNAGSLASGVLN;GNAGSLASGVLNS;NAGSLASGVLNSG;AGSLASGVLNSGV;GSLASGVLNSGVD;SLASGVLNSGVDI;LASGVLNSGVDIS;ASGVLNSGVDISG;SGVLNSGVDISGM;GVLNSGVDISGMF;VLNSGVDISGMFN;LNSGVDISGMFNV;NSGVDISGMFNVS;SGVDISGMFNVST;GVDISGMFNVSTL;VDISGMFNVSTLG;DISGMFNVSTLGS;ISGMFNVSTLGSA;SGMFNVSTLGSAP;GMFNVSTLGSAPA;MFNVSTLGSAPAV;FNVSTLGSAPAVI;NVSTLGSAPAVIS;VSTLGSAPAVISG;STLGSAPAVISGF;TLGSAPAVISGFG;LGSAPAVISGFGN;GSAPAVISGFGNL;SAPAVISGFGNLG;APAVISGFGNLGN;PAVISGFGNLGNH;AVISGFGNLGNHV;VISGFGNLGNHVS;ISGFGNLGNHVSG;SGFGNLGNHVSGV;GFGNLGNHVSGVS;FGNLGNHVSGVSI;GNLGNHVSGVSID;NLGNHVSGVSIDG;LGNHVSGVSIDGL;GNHVSGVSIDGLL;NHVSGVSIDGLLA;HVSGVSIDGLLAM;VSGVSIDGLLAML;SGVSIDGLLAMLT;GVSIDGLLAMLTS;VSIDGLLAMLTSG;SIDGLLAMLTSGG;IDGLLAMLTSGGS;DGLLAMLTSGGSG;GLLAMLTSGGSGG;LLAMLTSGGSGGS;LAMLTSGGSGGSG;AMLTSGGSGGSGQ;MLTSGGSGGSGQP;LTSGGSGGSGQPS;TSGGSGGSGQPSI;SGGSGGSGQPSII;GGSGGSGQPSIID;GSGGSGQPSIIDA;SGGSGQPSIIDAA;GGSGQPSIIDAAI;GSGQPSIIDAAIA;SGQPSIIDAAIAE;GQPSIIDAAIAEL;QPSIIDAAIAELR;PSIIDAAIAELRH;SIIDAAIAELRHL;IIDAAIAELRHLN;IDAAIAELRHLNP;DAAIAELRHLNPL;AAIAELRHLNPLN;AIAELRHLNPLNI;IAELRHLNPLNIV;AELRHLNPLNIVN;ELRHLNPLNIVNL;LRHLNPLNIVNLG;RHLNPLNIVNLGN;HLNPLNIVNLGNV;LNPLNIVNLGNVG;NPLNIVNLGNVGS;PLNIVNLGNVGSY;LNIVNLGNVGSYN;NIVNLGNVGSYNL;IVNLGNVGSYNLG;VNLGNVGSYNLGF;NLGNVGSYNLGFA;LGNVGSYNLGFAN;GNVGSYNLGFANV;NVGSYNLGFANVG;VGSYNLGFANVGD;GSYNLGFANVGDV;SYNLGFANVGDVN;YNLGFANVGDVNL;NLGFANVGDVNLG;LGFANVGDVNLGA;GFANVGDVNLGAG;FANVGDVNLGAGN;ANVGDVNLGAGNL;NVGDVNLGAGNLG;VGDVNLGAGNLGN;GDVNLGAGNLGNL;DVNLGAGNLGNLN;VNLGAGNLGNLNL;NLGAGNLGNLNLG;LGAGNLGNLNLGG;GAGNLGNLNLGGG;AGNLGNLNLGGGN;GNLGNLNLGGGNL;NLGNLNLGGGNLG;LGNLNLGGGNLGG;GNLNLGGGNLGGQ;NLNLGGGNLGGQN;LNLGGGNLGGQNL;NLGGGNLGGQNLG;LGGGNLGGQNLGL;GGGNLGGQNLGLG;GGNLGGQNLGLGN;GNLGGQNLGLGNL;NLGGQNLGLGNLG;LGGQNLGLGNLGD;GGQNLGLGNLGDG;GQNLGLGNLGDGN;QNLGLGNLGDGNV;NLGLGNLGDGNVG;LGLGNLGDGNVGF;GLGNLGDGNVGFG;LGNLGDGNVGFGN;GNLGDGNVGFGNL;NLGDGNVGFGNLG;LGDGNVGFGNLGH;GDGNVGFGNLGHG;DGNVGFGNLGHGN;GNVGFGNLGHGNV;NVGFGNLGHGNVG;VGFGNLGHGNVGF;GFGNLGHGNVGFG;FGNLGHGNVGFGN;GNLGHGNVGFGNS;NLGHGNVGFGNSG;LGHGNVGFGNSGL;GHGNVGFGNSGLG;HGNVGFG | |

Fig. 30 continued

| | | |
|---|---|---|
| | NSGLGA;GNVGFGNSGLGAL;NVGFGNSGLGALP;VGFGNSGLGALPG;GFGNSGLGALPGI;FGNSGLGALPGIG;GNSGLGALPGIGN;NSGLGALPGIGNI;SGLGALPGIGNIG;GLGALPGIGNIGL;LGALPGIGNIGLG;GALPGIGNIGLGN;ALPGIGNIGLGNA;LPGIGNIGLGNAG;PGIGNIGLGNAGS;GIGNIGLGNAGSN;IGNIGLGNAGSNN;GNIGLGNAGSNNV;NIGLGNAGSNNVG;IGLGNAGSNNVGF;GLGNAGSNNVGFG;LGNAGSNNVGFGN;GNAGSNNVGFGNM;NAGSNNVGFGNMG;AGSNNVGFGNMGL;GSNNVGFGNMGLG;SNNVGFGNMGLGN;NNVGFGNMGLGNI;NVGFGNMGLGNIG;VGFGNMGLGNIGF;GFGNMGLGNIGFG;FGNMGLGNIGFGN;GNMGLGNIGFGNT;NMGLGNIGFGNTG;MGLGNIGFGNTGT;GLGNIGFGNTGTN;LGNIGFGNTGTNN;GNIGFGNTGTNNL;NIGFGNTGTNNLG;IGFGNTGTNNLGI;GFGNTGTNNLGIG;FGNTGTNNLGIGL;GNTGTNNLGIGLT;NTGTNNLGIGLTG;TGTNNLGIGLTGD;GTNNLGIGLTGDN;TNNLGIGLTGDNQ;NNLGIGLTGDNQT;NLGIGLTGDNQTG;LGIGLTGDNQTGF;GIGLTGDNQTGFG;IGLTGDNQTGFGG;GLTGDNQTGFGGL;LTGDNQTGFGGLN;TGDNQTGFGGLNS;GDNQTGFGGLNSG;DNQTGFGGLNSGA;NQTGFGGLNSGAG;QTGFGGLNSGAGN;TGFGGLNSGAGNL;GFGGLNSGAGNLG;FGGLNSGAGNLGL;GGLNSGAGNLGLF;GLNSGAGNLGLFN;LNSGAGNLGLFNS;NSGAGNLGLFNSG;SGAGNLGLFNSGT;GAGNLGLFNSGTG;AGNLGLFNSGTGN;GNLGLFNSGTGNI;NLGLFNSGTGNIG;LGLFNSGTGNIGF;GLFNSGTGNIGFF;LFNSGTGNIGFFN;FNSGTGNIGFFNT;NSGTGNIGFFNTG;SGTGNIGFFNTGT;GTGNIGFFNTGTG;TGNIGFFNTGTGN;GNIGFFNTGTGNW;NIGFFNTGTGNWG;IGFFNTGTGNWGL;GFFNTGTGNWGLF;FFNTGTGNWGLFN;FNTGTGNWGLFNS;NTGTGNWGLFNSG;TGTGNWGLFNSGS;GTGNWGLFNSGSY;TGNWGLFNSGSYN;GNWGLFNSGSYNT;NWGLFNSGSYNTG;WGLFNSGSYNTGI;GLFNSGSYNTGIG;LFNSGSYNTGIGN;FNSGSYNTGIGNS;NSGSYNTGIGNSG;SGSYNTGIGNSGT;GSYNTGIGNSGTG;SYNTGIGNSGTGS;YNTGIGNSGTGST;NTGIGNSGTGSTG;TGIGNSGTGSTGL;GIGNSGTGSTGLF;IGNSGTGSTGLFN;GNSGTGSTGLFNA;NSGTGSTGLFNAG;SGTGSTGLFNAGS;GTGSTGLFNAGSF;TGSTGLFNAGSFN;GSTGLFNAGSFNT;STGLFNAGSFNTG;TGLFNAGSFNTGL;GLFNAGSFNTGLA;LFNAGSFNTGLAN;FNAGSFNTGLANA;NAGSFNTGLANAG;AGSFNTGLANAGS;GSFNTGLANAGSY;SFNTGLANAGSYN;FNTGLANAGSYNT;NTGLANAGSYNTG;TGLANAGSYNTGS;GLANAGSYNTGSL;LANAGSYNTGSLN;ANAGSYNTGSLNA;NAGSYNTGSLNAG;AGSYNTGSLNAGN;GSYNTGSLNAGNT;SYNTGSLNAGNTN;YNTGSLNAGNTNT;NTGSLNAGNTNTG;TGSLNAGNTNTGG;GSLNAGNTNTGGF;SLNAGNTNTGGFN;LNAGNTNTGGFNP;NAGNTNTGGFNPG;AGNTNTGGFNPGN;GNTNTGGFNPGNV;NTNTGGFNPGNVN;TNTGGFNPGNVNT;NTGGFNPGNVNTG;TGGFNPGNVNTGW;GGFNPGNVNTGWF;GFNPGNVNTGWFN;FNPGNVNTGWFNA;NPGNVNTGWFNAG;PGNVNTGWFNAGH;GNVNTGWFNAGHT;NVNTGWFNAGHTN;VNTGWFNAGHTNT;NTGWFNAGHTNTG;TGWFNAGHTNTGG;GWFNAGHTNTGGF;WFNAGHTNTGGFN;FNAGHTNTGGFNT;NAGHTNTGGFNTG;AGHTNTGGFNTGN;GHTNTGGFNTGNV;HTNTGGFNTGNVN;TNTGGFNTGNVNT;NTGGFNTGNVNTG;TGGFNTGNVNTGA;GGFNTGNVNTGAF;GFNTGNVNTGAFN;FNTGNVNTGAFNS;NTGNVNTGAFNSG;TGNVNTGAFNSGS;GNVNTGAFNSGSF;NVNTGAFNSGSFN;VNTGAFNSGSFNN;NTGAFNSGSFNNG;TGAFNSGSFNNGA;GAFNSGSFNNGAL;AFNSGSFNNGALW;FNSGSFNNGALWT;NSGSFNNGALWTG;SGSFNNGALWTGD;GSFNNGALWTGDH;SFNNGALWTGDHH;FNNGALWTGDHHG;NNGALWTGDHHGL;NGALWTGDHHGLV;GALWTGDHHGLVG;ALWTGDHHGLVGF;LWTGDHHGLVGFS;WTGDHHGLVGFSY;TGDHHGLVGFSYS;GDHHGLVGFSYSI;DHHGLVGFSYSIE;HHGLVGFSYSIEI;HGLVGFSYSIEIT;GLVGFSYSIEITG;LVGFSYSIEITGS;VGFSYSIEITGST;GFSYSIEITGSTL;FSYSIEITGS | |

Fig. 30 continued

| | | |
|---|---|---|
| | TLV;SYSIEITGSTLVD;YSIEITGSTLVDI;SIEITGSTLVDIN;IEITGSTLVDINE;EITGSTLVDINET;ITGSTLVDINETL;TGSTLVDINETLN;GSTLVDINETLNL;STLVDINETLNLG;TLVDINETLNLGP;LVDINETLNLGPV;VDINETLNLGPVH;DINETLNLGPVHI;INETLNLGPVHID;NETLNLGPVHIDQ;ETLNLGPVHIDQI;TLNLGPVHIDQID;LNLGPVHIDQIDI;NLGPVHIDQIDIP;LGPVHIDQIDIPG;GPVHIDQIDIPGM;PVHIDQIDIPGMS;VHIDQIDIPGMSL;HIDQIDIPGMSLF;IDQIDIPGMSLFD;DQIDIPGMSLFDI;QIDIPGMSLFDIH;IDIPGMSLFDIHE;DIPGMSLFDIHEL;IPGMSLFDIHELV;PGMSLFDIHELVN;GMSLFDIHELVNI;MSLFDIHELVNIG;SLFDIHELVNIGP;LFDIHELVNIGPF;FDIHELVNIGPFR;DIHELVNIGPFRI;IHELVNIGPFRIE;HELVNIGPFRIEP;ELVNIGPFRIEPI;LVNIGPFRIEPID;VNIGPFRIEPIDV;NIGPFRIEPIDVP;IGPFRIEPIDVPA;GPFRIEPIDVPAV;PFRIEPIDVPAVV;FRIEPIDVPAVVL;RIEPIDVPAVVLD;IEPIDVPAVVLDI;EPIDVPAVVLDIH;PIDVPAVVLDIHE;IDVPAVVLDIHET;DVPAVVLDIHETM;VPAVVLDIHETMV;PAVVLDIHETMVI;AVVLDIHETMVIP;VVLDIHETMVIPP;VLDIHETMVIPPI;LDIHETMVIPPIV;DIHETMVIPPIVF;IHETMVIPPIVFL;HETMVIPPIVFLP;ETMVIPPIVFLPS;TMVIPPIVFLPSM;MVIPPIVFLPSMT;VIPPIVFLPSMTI;IPPIVFLPSMTIG;PPIVFLPSMTIGG;PIVFLPSMTIGGQ;IVFLPSMTIGGQT;VFLPSMTIGGQTY;FLPSMTIGGQTYT;LPSMTIGGQTYTI;PSMTIGGQTYTIP;SMTIGGQTYTIPL;MTIGGQTYTIPLD;TIGGQTYTIPLDT;IGGQTYTIPLDTP;GGQTYTIPLDTPP;GQTYTIPLDTPPA;QTYTIPLDTPPAP;TYTIPLDTPPAPA;YTIPLDTPPAPAP;TIPLDTPPAPAPP;IPLDTPPAPAPPP;PLDTPPAPAPPPF;LDTPPAPAPPPFR;DTPPAPAPPPFRL;TPPAPAPPPFRLP;PPAPAPPPFRLPL;PAPAPPPFRLPLL;APAPPPFRLPLLF;PAPPPFRLPLLFV;APPPFRLPLLFVN;PPPFRLPLLFVNA;PPFRLPLLFVNAL;PFRLPLLFVNALG;FRLPLLFVNALGD;RLPLLFVNALGDN;LPLLFVNALGDNW;PLLFVNALGDNWI;LLFVNALGDNWIV;LFVNALGDNWIVG;FVNALGDNWIVGA;VNALGDNWIVGAS;NALGDNWIVGASN;ALGDNWIVGASNS;LGDNWIVGASNST;GDNWIVGASNSTG;DNWIVGASNSTGM;NWIVGASNSTGMS;WIVGASNSTGMSG;IVGASNSTGMSGG;VGASNSTGMSGGF;GASNSTGMSGGFV;ASNSTGMSGGFVT;SNSTGMSGGFVTA;NSTGMSGGFVTAP;STGMSGGFVTAPT;TGMSGGFVTAPTQ;GMSGGFVTAPTQG;MSGGFVTAPTQGI;SGGFVTAPTQGIL;GGFVTAPTQGILI;GFVTAPTQGILIH;FVTAPTQGILIHT;VTAPTQGILIHTG;TAPTQGILIHTGP;APTQGILIHTGPS;PTQGILIHTGPSS;TQGILIHTGPSSA;QGILIHTGPSSAT;GILIHTGPSSATT;ILIHTGPSSATTG;LIHTGPSSATTGS;IHTGPSSATTGSL;HTGPSSATTGSLA;TGPSSATTGSLAL;GPSSATTGSLALT;PSSATTGSLALTL;SSATTGSLALTLP;SATTGSLALTLPT;ATTGSLALTLPTV;TTGSLALTLPTVT;TGSLALTLPTVTI;GSLALTLPTVTIP;SLALTLPTVTIPT;LALTLPTVTIPTI;ALTLPTVTIPTIT;LTLPTVTIPTITT;TLPTVTIPTITTS;LPTVTIPTITTSP;PTVTIPTITTSPI;TVTIPTITTSPIP;VTIPTITTSPIPL;TIPTITTSPIPLK;IPTITTSPIPLKI;PTITTSPIPLKID;TITTSPIPLKIDV;ITTSPIPLKIDVS;TTSPIPLKIDVSG;TSPIPLKIDVSGG;SPIPLKIDVSGGL;PIPLKIDVSGGLP;IPLKIDVSGGLPA;PLKIDVSGGLPAF;LKIDVSGGLPAFT;KIDVSGGLPAFTL;IDVSGGLPAFTLF;DVSGGLPAFTLFP;VSGGLPAFTLFPG;SGGLPAFTLFPGG;GGLPAFTLFPGGL;GLPAFTLFPGGLN;LPAFTLFPGGLNI;PAFTLFPGGLNIP;AFTLFPGGLNIPQ;FTLFPGGLNIPQN;TLFPGGLNIPQNA;LFPGGLNIPQNAI;FPGGLNIPQNAIP;PGGLNIPQNAIPL;GGLNIPQNAIPLT;GLNIPQNAIPLTI;LNIPQNAIPLTID;NIPQNAIPLTIDA;IPQNAIPLTIDAS;PQNAIPLTIDASG;QNAIPLTIDASGV;NAIPLTIDASGVL;AIPLTIDASGVLD;IPLTIDASGVLDP;PLTIDASGVLDPI;LTIDASGVLDPIT;TIDASGVLDPITI;IDASGVLDPITIF;DASGVLDPITIFP;ASGVLDPITIFPG;SGVLDPITIFPGG;GVLDPITIFPGGF;VLDPITIFPGGFT;LDPITIFPGGFTI;DPITIFPGGFTID;PITIFPGGFTIDP;ITIFPGGFTIDPL;TIFPGGFTIDPLP;IFPGGFTIDPLPL;FPGGFTIDPLPLS;PGGFTIDPLPLSL;GGFTIDPLPLSLA;GFTIDPLPLSLAL;FTIDPLPLSLALN;TIDPLPLSLALNI;IDPLPLSLALNI | |

Fig. 30 continued

| | | |
|---|---|---|
| | S;DPLPLSLALNISV;PLPLSLALNISVP;LPLSLALNISVPD;PLSLALNISVPDS;LSLALNISVPDSS;SLALNISVPDSSV;LALNISVPDSSVP;ALNISVPDSSVPI;LNISVPDSSVPII;NISVPDSSVPIII;ISVPDSSVPIIIV;SVPDSSVPIIIVP;VPDSSVPIIIVPP;PDSSVPIIIVPPT;DSSVPIIIVPPTP;SSVPIIIVPPTPG;SVPIIIVPPTPGF;VPIIIVPPTPGFG;PIIIVPPTPGFGN;IIIVPPTPGFGNA;IIVPPTPGFGNAT;IVPPTPGFGNATA;VPPTPGFGNATAT;PPTPGFGNATATP;PTPGFGNATATPS;TPGFGNATATPSS;PGFGNATATPSSG;GFGNATATPSSGF;FGNATATPSSGFF;GNATATPSSGFFN;NATATPSSGFFNS;ATATPSSGFFNSG;TATPSSGFFNSGA;ATPSSGFFNSGAG;TPSSGFFNSGAGG;PSSGFFNSGAGGV;SSGFFNSGAGGVS;SGFFNSGAGGVSG;GFFNSGAGGVSGF;FFNSGAGGVSGFG;FNSGAGGVSGFGN;NSGAGGVSGFGNF;SGAGGVSGFGNFG;GAGGVSGFGNFGA;AGGVSGFGNFGAG;GGVSGFGNFGAGS;GVSGFGNFGAGSS;VSGFGNFGAGSSG;SGFGNFGAGSSGW;GFGNFGAGSSGWW;FGNFGAGSSGWWN;GNFGAGSSGWWNQ;NFGAGSSGWWNQA;FGAGSSGWWNQAH;GAGSSGWWNQAHA;AGSSGWWNQAHAA;GSSGWWNQAHAAL;SSGWWNQAHAALA;SGWWNQAHAALAG;GWWNQAHAALAGA;WWNQAHAALAGAG;WNQAHAALAGAGS;NQAHAALAGAGSG;QAHAALAGAGSGV;AHAALAGAGSGVL;HAALAGAGSGVLN;AALAGAGSGVLNV;ALAGAGSGVLNVG;LAGAGSGVLNVGT;AGAGSGVLNVGTL;GAGSGVLNVGTLN;AGSGVLNVGTLNS;GSGVLNVGTLNSG;SGVLNVGTLNSGV;GVLNVGTLNSGVL;VLNVGTLNSGVLN;LNVGTLNSGVLNV;NVGTLNSGVLNVG;VGTLNSGVLNVGS;GTLNSGVLNVGSG;TLNSGVLNVGSGI;LNSGVLNVGSGIS;NSGVLNVGSGISG;SGVLNVGSGISGL;GVLNVGSGISGLY;VLNVGSGISGLYN;LNVGSGISGLYNT;NVGSGISGLYNTA;VGSGISGLYNTAI;GSGISGLYNTAIV;SGISGLYNTAIVG;GISGLYNTAIVGL;ISGLYNTAIVGLG;SGLYNTAIVGLGT;GLYNTAIVGLGTP;LYNTAIVGLGTPA;YNTAIVGLGTPAL;NTAIVGLGTPALV;TAIVGLGTPALVS;AIVGLGTPALVSG;IVGLGTPALVSGA;VGLGTPALVSGAG;GLGTPALVSGAGN;LGTPALVSGAGNV;GTPALVSGAGNVG;TPALVSGAGNVGQ;PALVSGAGNVGQQ;ALVSGAGNVGQQL;LVSGAGNVGQQLS;VSGAGNVGQQLSG;SGAGNVGQQLSGV;GAGNVGQQLSGVL;AGNVGQQLSGVLA;GNVGQQLSGVLAA;NVGQQLSGVLAAG;VGQQLSGVLAAGT;GQQLSGVLAAGTA;QQLSGVLAAGTAL;QLSGVLAAGTALT;LSGVLAAGTALTQ;SGVLAAGTALTQS;GVLAAGTALTQSP;VLAAGTALTQSPI;LAAGTALTQSPII;AAGTALTQSPIIN;AGTALTQSPIINL;GTALTQSPIINLG;TALTQSPIINLGL;ALTQSPIINLGLA;LTQSPIINLGLAD;TQSPIINLGLADV;QSPIINLGLADVG;SPIINLGLADVGN;PIINLGLADVGNY;IINLGLADVGNYN;INLGLADVGNYNL;NLGLADVGNYNLG;LGLADVGNYNLGL;GLADVGNYNLGLG;LADVGNYNLGLGN;ADVGNYNLGLGNV;DVGNYNLGLGNVG;VGNYNLGLGNVGD;GNYNLGLGNVGDF;NYNLGLGNVGDFN;YNLGLGNVGDFNL;NLGLGNVGDFNLG;LGLGNVGDFNLGA;GLGNVGDFNLGAA;LGNVGDFNLGAAN;GNVGDFNLGAANL;NVGDFNLGAANLG;VGDFNLGAANLGD;GDFNLGAANLGDL;DFNLGAANLGDLN;FNLGAANLGDLNL;NLGAANLGDLNLG;LGAANLGDLNLGL;GAANLGDLNLGLG;AANLGDLNLGLGN;ANLGDLNLGLGNI;NLGDLNLGLGNIG;LGDLNLGLGNIGN;GDLNLGLGNIGNA;DLNLGLGNIGNAN;LNLGLGNIGNANV;NLGLGNIGNANVG;LGLGNIGNANVGF;GLGNIGNANVGFG;LGNIGNANVGFGN;GNIGNANVGFGNI;NIGNANVGFGNIG;IGNANVGFGNIGH;GNANVGFGNIGHG;NANVGFGNIGHGN;ANVGFGNIGHGNV;NVGFGNIGHGNVG;VGFGNIGHGNVGF;GFGNIGHGNVGFG;FGNIGHGNVGFGN;GNIGHGNVGFGNS;NIGHGNVGFGNSG;IGHGNVGFGNSGL;GHGNVGFGNSGLG;HGNVGFGNSGLGA;GNVGFGNSGLGAA;NVGFGNSGLGAAL;VGFGNSGLGAALG;GFGNSGLGAALGI;FGNSGLGAALGIG;GNSGLGAALGIGN;NSGLGAALGIGNI;SGLGAALGIGNIG;GLGAALGIGNIGL;LGAALGIGNIGLG;GAALGIGNIGLGN;AALGIGNIGLGNA;ALGIGNIGLGNAG;LGIGNIGLGNAGS;GIGNIGLG | |

Fig. 30 continued

| | | |
|---|---|---|
| | NAGST;IGNIGLGNAGSTN;GNIGLGNAGSTNV;NIGLGNAGSTNVG;IGLGNAGSTNVGL;GLGNAGSTNVGLA;LGNAGSTNVGLAN;GNAGSTNVGLANM;NAGSTNVGLANMG;AGSTNVGLANMGV;GSTNVGLANMGVG;STNVGLANMGVGN;TNVGLANMGVGNI;NVGLANMGVGNIG;VGLANMGVGNIGF;GLANMGVGNIGFA;LANMGVGNIGFAN;ANMGVGNIGFANT;NMGVGNIGFANTG;MGVGNIGFANTGT;GVGNIGFANTGTN;VGNIGFANTGTNN;GNIGFANTGTNNL;NIGFANTGTNNLG;IGFANTGTNNLGI;GFANTGTNNLGIG;FANTGTNNLGIGL;ANTGTNNLGIGLT;NTGTNNLGIGLTG;TGTNNLGIGLTGD;GTNNLGIGLTGDN;TNNLGIGLTGDNQ;NNLGIGLTGDNQT;NLGIGLTGDNQTG;LGIGLTGDNQTGI;GIGLTGDNQTGIG;IGLTGDNQTGIGG;GLTGDNQTGIGGL;LTGDNQTGIGGLN;TGDNQTGIGGLNS;GDNQTGIGGLNSG;DNQTGIGGLNSGA;NQTGIGGLNSGAG;QTGIGGLNSGAGN;TGIGGLNSGAGNI;GIGGLNSGAGNIG;IGGLNSGAGNIGL;GGLNSGAGNIGLF;GLNSGAGNIGLFN;LNSGAGNIGLFNS;NSGAGNIGLFNSG;SGAGNIGLFNSGT;GAGNIGLFNSGTG;AGNIGLFNSGTGN;GNIGLFNSGTGNI;NIGLFNSGTGNIG;IGLFNSGTGNIGF;GLFNSGTGNIGFF;LFNSGTGNIGFFN;FNSGTGNIGFFNS;NSGTGNIGFFNSG;SGTGNIGFFNSGT;GTGNIGFFNSGTG;TGNIGFFNSGTGN;GNIGFFNSGTGNW;NIGFFNSGTGNWG;IGFFNSGTGNWGL;GFFNSGTGNWGLF;FFNSGTGNWGLFN;FNSGTGNWGLFNS;NSGTGNWGLFNSG;SGTGNWGLFNSGS;GTGNWGLFNSGSF;TGNWGLFNSGSFN;GNWGLFNSGSFNT;NWGLFNSGSFNTG;WGLFNSGSFNTGI;GLFNSGSFNTGIG;LFNSGSFNTGIGN;FNSGSFNTGIGNS;NSGSFNTGIGNSG;SGSFNTGIGNSGT;GSFNTGIGNSGTG;SFNTGIGNSGTGS;FNTGIGNSGTGST;NTGIGNSGTGSTG;TGIGNSGTGSTGL;GIGNSGTGSTGLF;IGNSGTGSTGLFN;GNSGTGSTGLFNA;NSGTGSTGLFNAG;SGTGSTGLFNAGG;GTGSTGLFNAGGF;TGSTGLFNAGGFT;GSTGLFNAGGFTT;STGLFNAGGFTTG;TGLFNAGGFTTGL;GLFNAGGFTTGLA;LFNAGGFTTGLAN;FNAGGFTTGLANA;NAGGFTTGLANAG;AGGFTTGLANAGS;GGFTTGLANAGSY;GFTTGLANAGSYN;FTTGLANAGSYNT;TTGLANAGSYNTG;TGLANAGSYNTGS;GLANAGSYNTGSF;LANAGSYNTGSFN;ANAGSYNTGSFNV;NAGSYNTGSFNVG;AGSYNTGSFNVGD;GSYNTGSFNVGDT;SYNTGSFNVGDTN;YNTGSFNVGDTNT;NTGSFNVGDTNTG;TGSFNVGDTNTGG;GSFNVGDTNTGGF;SFNVGDTNTGGFN;FNVGDTNTGGFNP;NVGDTNTGGFNPG;VGDTNTGGFNPGS;GDTNTGGFNPGSI;DTNTGGFNPGSIN;TNTGGFNPGSINT;NTGGFNPGSINTG;TGGFNPGSINTGW;GGFNPGSINTGWF;GFNPGSINTGWFN;FNPGSINTGWFNT;NPGSINTGWFNTG;PGSINTGWFNTGN;GSINTGWFNTGNA;SINTGWFNTGNAN;INTGWFNTGNANT;NTGWFNTGNANTG;TGWFNTGNANTGI;GWFNTGNANTGIA;WFNTGNANTGIAN;FNTGNANTGIANS;NTGNANTGIANSG;TGNANTGIANSGN;GNANTGIANSGNV;NANTGIANSGNVD;ANTGIANSGNVDT;NTGIANSGNVDTG;TGIANSGNVDTGA;GIANSGNVDTGAL;IANSGNVDTGALM;ANSGNVDTGALMS;NSGNVDTGALMSG;SGNVDTGALMSGN;GNVDTGALMSGNF;NVDTGALMSGNFS;VDTGALMSGNFSN;DTGALMSGNFSNG;TGALMSGNFSNGI;GALMSGNFSNGIL;ALMSGNFSNGILW;LMSGNFSNGILWR;MSGNFSNGILWRG;SGNFSNGILWRGN;GNFSNGILWRGNY;NFSNGILWRGNYE;FSNGILWRGNYEG;SNGILWRGNYEGL;NGILWRGNYEGLF;GILWRGNYEGLFS;ILWRGNYEGLFSY;LWRGNYEGLFSYS;WRGNYEGLFSYSY;RGNYEGLFSYSYS;GNYEGLFSYSYSL;NYEGLFSYSYSLD;YEGLFSYSYSLDV;EGLFSYSYSLDVP;GLFSYSYSLDVPR;LFSYSYSLDVPRI;FSYSYSLDVPRIT;SYSYSLDVPRITI;YSYSLDVPRITIL;SYSLDVPRITILD;YSLDVPRITILDA;SLDVPRITILDAH;LDVPRITILDAHF;DVPRITILDAHFT;VPRITILDAHFTG;PRITILDAHFTGA;RITILDAHFTGAF;ITILDAHFTGAFG;TILDAHFTGAFGP;ILDAHFTGAFGPV;LDAHFTGAFGPVV;DAHFTGAFGPVVV;AHFTGAFGPVVVP;HFTGAFGPVVVPP;FTGAFGPVVVPPI;TGAFGPVVVPPIP;GAFGPVVVPPI | |

Fig. 30 continued

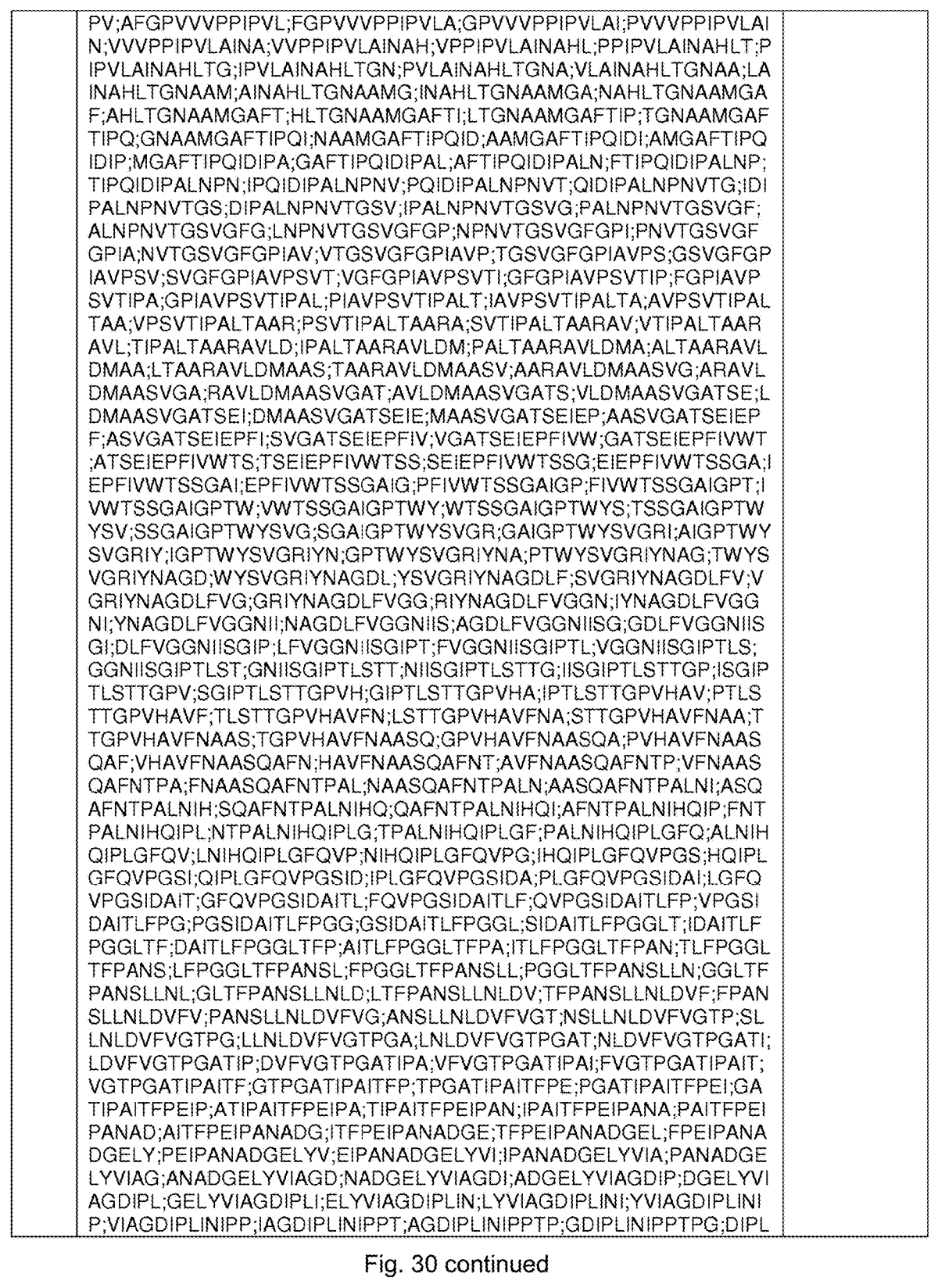

| | | |
|---|---|---|
| | PV;AFGPVVVPPIPVL;FGPVVVPPIPVLA;GPVVVPPIPVLAI;PVVVPPIPVLAIN;VVVPPIPVLAINA;VVPPIPVLAINAH;VPPIPVLAINAHL;PPIPVLAINAHLT;PIPVLAINAHLTG;IPVLAINAHLTGN;PVLAINAHLTGNA;VLAINAHLTGNAA;LAINAHLTGNAAM;AINAHLTGNAAMG;INAHLTGNAAMGA;NAHLTGNAAMGAF;AHLTGNAAMGAFT;HLTGNAAMGAFTI;LTGNAAMGAFTIP;TGNAAMGAFTIPQ;GNAAMGAFTIPQI;NAAMGAFTIPQID;AAMGAFTIPQIDI;AMGAFTIPQIDIP;MGAFTIPQIDIPA;GAFTIPQIDIPAL;AFTIPQIDIPALN;FTIPQIDIPALNP;TIPQIDIPALNPN;IPQIDIPALNPNV;PQIDIPALNPNVT;QIDIPALNPNVTG;IDIPALNPNVTGS;DIPALNPNVTGSV;IPALNPNVTGSVG;PALNPNVTGSVGF;ALNPNVTGSVGFG;LNPNVTGSVGFGP;NPNVTGSVGFGPI;PNVTGSVGFGPIA;NVTGSVGFGPIAV;VTGSVGFGPIAVP;TGSVGFGPIAVPS;GSVGFGPIAVPSV;SVGFGPIAVPSVT;VGFGPIAVPSVTI;GFGPIAVPSVTIP;FGPIAVPSVTIPA;GPIAVPSVTIPAL;PIAVPSVTIPALT;IAVPSVTIPALTA;AVPSVTIPALTAA;VPSVTIPALTAAR;PSVTIPALTAARA;SVTIPALTAARAV;VTIPALTAARAVL;TIPALTAARAVLD;IPALTAARAVLDM;PALTAARAVLDMA;ALTAARAVLDMAA;LTAARAVLDMAAS;TAARAVLDMAASV;AARAVLDMAASVG;ARAVLDMAASVGA;RAVLDMAASVGAT;AVLDMAASVGATS;VLDMAASVGATSE;LDMAASVGATSEI;DMAASVGATSEIE;MAASVGATSEIEP;AASVGATSEIEPF;ASVGATSEIEPFI;SVGATSEIEPFIV;VGATSEIEPFIVW;GATSEIEPFIVWT;ATSEIEPFIVWTS;TSEIEPFIVWTSS;SEIEPFIVWTSSG;EIEPFIVWTSSGA;IEPFIVWTSSGAI;EPFIVWTSSGAIG;PFIVWTSSGAIGP;FIVWTSSGAIGPT;IVWTSSGAIGPTW;VWTSSGAIGPTWY;WTSSGAIGPTWYS;TSSGAIGPTWYSV;SSGAIGPTWYSVG;SGAIGPTWYSVGR;GAIGPTWYSVGRI;AIGPTWYSVGRIY;IGPTWYSVGRIYN;GPTWYSVGRIYNA;PTWYSVGRIYNAG;TWYSVGRIYNAGD;WYSVGRIYNAGDL;YSVGRIYNAGDLF;SVGRIYNAGDLFV;VGRIYNAGDLFVG;GRIYNAGDLFVGG;RIYNAGDLFVGGN;IYNAGDLFVGGNI;YNAGDLFVGGNII;NAGDLFVGGNIIS;AGDLFVGGNIISG;GDLFVGGNIISGI;DLFVGGNIISGIP;LFVGGNIISGIPT;FVGGNIISGIPTL;VGGNIISGIPTLS;GGNIISGIPTLST;GNIISGIPTLSTT;NIISGIPTLSTTG;IISGIPTLSTTGP;ISGIPTLSTTGPV;SGIPTLSTTGPVH;GIPTLSTTGPVHA;IPTLSTTGPVHAV;PTLSTTGPVHAVF;TLSTTGPVHAVFN;LSTTGPVHAVFNA;STTGPVHAVFNAA;TTGPVHAVFNAAS;TGPVHAVFNAASQ;GPVHAVFNAASQA;PVHAVFNAASQAF;VHAVFNAASQAFN;HAVFNAASQAFNT;AVFNAASQAFNTP;VFNAASQAFNTPA;FNAASQAFNTPAL;NAASQAFNTPALN;AASQAFNTPALNI;ASQAFNTPALNIH;SQAFNTPALNIHQ;QAFNTPALNIHQI;AFNTPALNIHQIP;FNTPALNIHQIPL;NTPALNIHQIPLG;TPALNIHQIPLGF;PALNIHQIPLGFQ;ALNIHQIPLGFQV;LNIHQIPLGFQVP;NIHQIPLGFQVPG;IHQIPLGFQVPGS;HQIPLGFQVPGSI;QIPLGFQVPGSID;IPLGFQVPGSIDA;PLGFQVPGSIDAI;LGFQVPGSIDAIT;GFQVPGSIDAITL;FQVPGSIDAITLF;QVPGSIDAITLFP;VPGSIDAITLFPG;PGSIDAITLFPGG;GSIDAITLFPGGL;SIDAITLFPGGLT;IDAITLFPGGLTF;DAITLFPGGLTFP;AITLFPGGLTFPA;ITLFPGGLTFPAN;TLFPGGLTFPANS;LFPGGLTFPANSL;FPGGLTFPANSLL;PGGLTFPANSLLN;GGLTFPANSLLNL;GLTFPANSLLNLD;LTFPANSLLNLDV;TFPANSLLNLDVF;FPANSLLNLDVFV;PANSLLNLDVFVG;ANSLLNLDVFVGT;NSLLNLDVFVGTP;SLLNLDVFVGTPG;LLNLDVFVGTPGA;LNLDVFVGTPGAT;NLDVFVGTPGATI;LDVFVGTPGATIP;DVFVGTPGATIPA;VFVGTPGATIPAI;FVGTPGATIPAIT;VGTPGATIPAITF;GTPGATIPAITFP;TPGATIPAITFPE;PGATIPAITFPEI;GATIPAITFPEIP;ATIPAITFPEIPA;TIPAITFPEIPAN;IPAITFPEIPANA;PAITFPEIPANAD;AITFPEIPANADG;ITFPEIPANADGE;TFPEIPANADGEL;FPEIPANADGELY;PEIPANADGELYV;EIPANADGELYVI;IPANADGELYVIA;PANADGELYVIAG;ANADGELYVIAGD;NADGELYVIAGDI;ADGELYVIAGDIP;DGELYVIAGDIPL;GELYVIAGDIPLI;ELYVIAGDIPLIN;LYVIAGDIPLINI;YVIAGDIPLINIP;VIAGDIPLINIPP;IAGDIPLINIPPT;AGDIPLINIPPTP;GDIPLINIPPTPG;DIPL | |

Fig. 30 continued

| | | |
|---|---|---|
| | INIPPTPGI;IPLINIPPTPGIG;PLINIPPTPGIGN;LINIPPTPGIGNT;INIPPTPGI<br>GNTT;NIPPTPGIGNTTT;IPPTPGIGNTTTV;PPTPGIGNTTTVP;PTPGIGNTT<br>TVPS;TPGIGNTTTVPSS;PGIGNTTTVPSSG;GIGNTTTVPSSGF;IGNTTTVP<br>SSGFF;GNTTTVPSSGFFN;NTTTVPSSGFFNT;TTTVPSSGFFNTG;TTVPS<br>SGFFNTGA;TVPSSGFFNTGAG;VPSSGFFNTGAGG;PSSGFFNTGAGGG;<br>SSGFFNTGAGGGS;SGFFNTGAGGGSG;GFFNTGAGGGSGF;FFNTGAGG<br>GSGFG;FNTGAGGGSGFGN;NTGAGGGSGFGNF;TGAGGGSGFGNFG;G<br>AGGGSGFGNFGA;AGGGSGFGNFGAN;GGGSGFGNFGANM;GGSGFGNF<br>GANMS;GSGFGNFGANMSG;SGFGNFGANMSGW;GFGNFGANMSGWW;<br>FGNFGANMSGWWN;GNFGANMSGWWNQ;NFGANMSGWWNQA;FGANM<br>SGWWNQAH;GANMSGWWNQAHT;ANMSGWWNQAHTA;NMSGWWNQA<br>HTAL;MSGWWNQAHTALA;SGWWNQAHTALAG;GWWNQAHTALAGA;W<br>WNQAHTALAGAG;WNQAHTALAGAGS;NQAHTALAGAGSG;QAHTALAGA<br>GSGI;AHTALAGAGSGIA;HTALAGAGSGIAN;TALAGAGSGIANV;ALAGAGS<br>GIANVG;LAGAGSGIANVGT;AGAGSGIANVGTL;GAGSGIANVGTLH;AGSG<br>IANVGTLHS;GSGIANVGTLHSG;SGIANVGTLHSGV;GIANVGTLHSGVL;IA<br>NVGTLHSGVLN;ANVGTLHSGVLNL;NVGTLHSGVLNLG;VGTLHSGVLNLG<br>S;GTLHSGVLNLGSG;TLHSGVLNLGSGL;LHSGVLNLGSGLS;HSGVLNLGS<br>GLSG;SGVLNLGSGLSGI;GVLNLGSGLSGIY;VLNLGSGLSGIYN;LNLGSGL<br>SGIYNT;NLGSGLSGIYNTS;LGSGLSGIYNTST;GSGLSGIYNTSTL;SGLSGI<br>YNTSTLP;GLSGIYNTSTLPL;LSGIYNTSTLPLG;SGIYNTSTLPLGT;GIYNTS<br>TLPLGTP;IYNTSTLPLGTPA;YNTSTLPLGTPAL;NTSTLPLGTPALV;TSTLPL<br>GTPALVS;STLPLGTPALVSG;TLPLGTPALVSGL;LPLGTPALVSGLG;PLGT<br>PALVSGLGN;LGTPALVSGLGNV;GTPALVSGLGNVG;TPALVSGLGNVGD;<br>PALVSGLGNVGDH;ALVSGLGNVGDHL;LVSGLGNVGDHLS;VSGLGNVGD<br>HLSG;SGLGNVGDHLSGL;GLGNVGDHLSGLL;LGNVGDHLSGLLA;GNVGD<br>HLSGLLAS;NVGDHLSGLLASN;VGDHLSGLLASNV;GDHLSGLLASNVG;D<br>HLSGLLASNVGQ;HLSGLLASNVGQN;LSGLLASNVGQNP;SGLLASNVGQ<br>NPI;GLLASNVGQNPIT;LLASNVGQNPITI;LASNVGQNPITIV;ASNVGQNPIT<br>IVN;SNVGQNPITIVNI;NVGQNPITIVNIG;VGQNPITIVNIGL;GQNPITIVNIGL<br>A;QNPITIVNIGLAN;NPITIVNIGLANV;PITIVNIGLANVG;ITIVNIGLANVGN;TI<br>VNIGLANVGNG;IVNIGLANVGNGN;VNIGLANVGNGNV;NIGLANVGNGNV<br>G;IGLANVGNGNVGL;GLANVGNGNVGLG;LANVGNGNVGLGN;ANVGNGN<br>VGLGNI;NVGNGNVGLGNIG;VGNGNVGLGNIGN;GNGNVGLGNIGNL;NGN<br>VGLGNIGNLN;GNVGLGNIGNLNL;NVGLGNIGNLNLG;VGLGNIGNLNLGA;<br>GLGNIGNLNLGAA;LGNIGNLNLGAAN;GNIGNLNLGAANI;NIGNLNLGAANI<br>G;IGNLNLGAANIGD;GNLNLGAANIGDV;NLNLGAANIGDVN;LNLGAANIGD<br>VNL;NLGAANIGDVNLG;LGAANIGDVNLGF;GAANIGDVNLGFG;AANIGDV<br>NLGFGN;ANIGDVNLGFGNI;NIGDVNLGFGNIG;IGDVNLGFGNIGD;GDVNL<br>GFGNIGDV;DVNLGFGNIGDVN;VNLGFGNIGDVNL;NLGFGNIGDVNLG;LG<br>FGNIGDVNLGF;GFGNIGDVNLGFG;FGNIGDVNLGFGN;GNIGDVNLGFGNI<br>;NIGDVNLGFGNIG;IGDVNLGFGNIGG;GDVNLGFGNIGGG;DVNLGFGNIG<br>GGN;VNLGFGNIGGGNV;NLGFGNIGGGNVG;LGFGNIGGGNVGF;GFGNIG<br>GGNVGFG;FGNIGGGNVGFGN;GNIGGGNVGFGNI;NIGGGNVGFGNIG;IG<br>GGNVGFGNIGD;GGGNVGFGNIGDA;GGNVGFGNIGDAN;GNVGFGNIGDA<br>NF;NVGFGNIGDANFG;VGFGNIGDANFGF;GFGNIGDANFGFG;FGNIGDA<br>NFGFGN;GNIGDANFGFGNS;NIGDANFGFGNSG;IGDANFGFGNSGL;GDA<br>NFGFGNSGLA;DANFGFGNSGLAA;ANFGFGNSGLAAG;NFGFGNSGLAAG<br>L;FGFGNSGLAAGLA;GFGNSGLAAGLAG;FGNSGLAAGLAGM;GNSGLAA<br>GLAGMG;NSGLAAGLAGMGN;SGLAAGLAGMGNI;GLAAGLAGMGNIG;LA<br>AGLAGMGNIGL;AAGLAGMGNIGLG;AGLAGMGNIGLGN;GLAGMGNIGLG<br>NA;LAGMGNIGLGNAG;AGMGNIGLGNAGS;GMGNIGLGNAGSG;MGNIGL<br>GNAGSGN;GNIGLGNAGSGNV;NIGLGNAGSGNVG;IGLGNAGSGNVGW;G | |

Fig. 30 continued

| | | |
|---|---|---|
| | LGNAGSGNVGWA;LGNAGSGNVGWAN;GNAGSGNVGWANM;NAGSGNVGWANMG;AGSGNVGWANMGL;GSGNVGWANMGLG;SGNVGWANMGLGN;GNVGWANMGLGNI;NVGWANMGLGNIG;VGWANMGLGNIGF;GWANMGLGNIGFG;WANMGLGNIGFGN;ANMGLGNIGFGNT;NMGLGNIGFGNTG;MGLGNIGFGNTGT;GLGNIGFGNTGTN;LGNIGFGNTGTNN;GNIGFGNTGTNNL;NIGFGNTGTNNLG;IGFGNTGTNNLGI;GFGNTGTNNLGIG;FGNTGTNNLGIGL;GNTGTNNLGIGLT;NTGTNNLGIGLTG;TGTNNLGIGLTGD;GTNNLGIGLTGDN;TNNLGIGLTGDNQ;NNLGIGLTGDNQS;NLGIGLTGDNQSG;LGIGLTGDNQSGI;GIGLTGDNQSGIG;IGLTGDNQSGIGG;GLTGDNQSGIGGL;LTGDNQSGIGGLN;TGDNQSGIGGLNS;GDNQSGIGGLNSG;DNQSGIGGLNSGT;NQSGIGGLNSGTG;QSGIGGLNSGTGN;SGIGGLNSGTGNI;GIGGLNSGTGNIG;IGGLNSGTGNIGL;GGLNSGTGNIGLF;GLNSGTGNIGLFN;LNSGTGNIGLFNS;NSGTGNIGLFNSG;SGTGNIGLFNSGT;GTGNIGLFNSGTG;TGNIGLFNSGTGN;GNIGLFNSGTGNI;NIGLFNSGTGNIG;IGLFNSGTGNIGF;GLFNSGTGNIGFF;LFNSGTGNIGFFN;FNSGTGNIGFFNS;NSGTGNIGFFNSG;SGTGNIGFFNSGT;GTGNIGFFNSGTA;TGNIGFFNSGTAN;GNIGFFNSGTANF;NIGFFNSGTANFG;IGFFNSGTANFGL;GFFNSGTANFGLF;FFNSGTANFGLFN;FNSGTANFGLFNS;NSGTANFGLFNSG;SGTANFGLFNSGS;GTANFGLFNSGSY;TANFGLFNSGSYN;ANFGLFNSGSYNT;NFGLFNSGSYNTG;FGLFNSGSYNTGI;GLFNSGSYNTGIG;LFNSGSYNTGIGN;FNSGSYNTGIGNS;NSGSYNTGIGNSG;SGSYNTGIGNSGV;GSYNTGIGNSGVA;SYNTGIGNSGVAS;YNTGIGNSGVAST;NTGIGNSGVASTG;TGIGNSGVASTGL;GIGNSGVASTGLV;IGNSGVASTGLVN;GNSGVASTGLVNA;NSGVASTGLVNAG;SGVASTGLVNAGG;GVASTGLVNAGGF;VASTGLVNAGGFN;ASTGLVNAGGFNT;STGLVNAGGFNTG;TGLVNAGGFNTGV;GLVNAGGFNTGVA;LVNAGGFNTGVAN;VNAGGFNTGVANA;NAGGFNTGVANAG;AGGFNTGVANAGS;GGFNTGVANAGSY;GFNTGVANAGSYN;FNTGVANAGSYNT;NTGVANAGSYNTG;TGVANAGSYNTGS;GVANAGSYNTGSF;VANAGSYNTGSFN;ANAGSYNTGSFNA;NAGSYNTGSFNAG;AGSYNTGSFNAGD;GSYNTGSFNAGDT;SYNTGSFNAGDTN;YNTGSFNAGDTNT;NTGSFNAGDTNTG;TGSFNAGDTNTGG;GSFNAGDTNTGGF;SFNAGDTNTGGFN;FNAGDTNTGGFNP;NAGDTNTGGFNPG;AGDTNTGGFNPGS;GDTNTGGFNPGST;DTNTGGFNPGSTN;TNTGGFNPGSTNT;NTGGFNPGSTNTG;TGGFNPGSTNTGW;GGFNPGSTNTGWF;GFNPGSTNTGWFN;FNPGSTNTGWFNT;NPGSTNTGWFNTG;PGSTNTGWFNTGN;GSTNTGWFNTGNA;STNTGWFNTGNAN;TNTGWFNTGNANT;NTGWFNTGNANTG;TGWFNTGNANTGV;GWFNTGNANTGVA;WFNTGNANTGVAN;FNTGNANTGVANA;NTGNANTGVANAG;TGNANTGVANAGN;GNANTGVANAGNV;NANTGVANAGNVN;ANTGVANAGNVNT;NTGVANAGNVNTG;TGVANAGNVNTGA;GVANAGNVNTGAL;VANAGNVNTGALI;ANAGNVNTGALIT;NAGNVNTGALITG;AGNVNTGALITGN;GNVNTGALITGNF;NVNTGALITGNFS;VNTGALITGNFSN;NTGALITGNFSNG;TGALITGNFSNGI;GALITGNFSNGIL;ALITGNFSNGILW;LITGNFSNGILWR;ITGNFSNGILWRG;TGNFSNGILWRGN;GNFSNGILWRGNY;NFSNGILWRGNYE;FSNGILWRGNYEG;SNGILWRGNYEGL;NGILWRGNYEGLA;GILWRGNYEGLAG;ILWRGNYEGLAGF;LWRGNYEGLAGFS;WRGNYEGLAGFSF;RGNYEGLAGFSFG;GNYEGLAGFSFGY;NYEGLAGFSFGYP;YEGLAGFSFGYPI;EGLAGFSFGYPIP;GLAGFSFGYPIPL;LAGFSFGYPIPLF;AGFSFGYPIPLFP;GFSFGYPIPLFPA;FSFGYPIPLFPAV;SFGYPIPLFPAVG;FGYPIPLFPAVGA;GYPIPLFPAVGAD;YPIPLFPAVGADV;PIPLFPAVGADVT;IPLFPAVGADVTG;PLFPAVGADVTGD;LFPAVGADVTGDI;FPAVGADVTGDIG;PAVGADVTGDIGP;AVGADVTGDIGPA;VGADVTGDIGPAT;GADVTGDIGPATI;ADVTGDIGPATII;DVTGDIGPATIIP;VTGDIGPATIIPP;TGDIGPATIIPPI;GDIGPATIIPPIH;DIGPATIIPPIHI;IGPATIIPPIHIP;GPATIIPPIHIPS;PATIIPPIHIPSI;ATIIPPIH | |

Fig. 30 continued

| | | |
|---|---|---|
| | IPSIP;TIIPPIHIPSIPL;IIPPIHIPSIPLG;IPPIHIPSIPLGF;PPIHIPSIPLGFA;PIHIPSIPLGFAA;IHIPSIPLGFAAI;HIPSIPLGFAAIG;IPSIPLGFAAIGH;PSIPLGFAAIGHI;SIPLGFAAIGHIG;IPLGFAAIGHIGP;PLGFAAIGHIGPI;LGFAAIGHIGPIS;GFAAIGHIGPISI;FAAIGHIGPISIP;AAIGHIGPISIPN;AIGHIGPISIPNI;IGHIGPISIPNIA;GHIGPISIPNIAI;HIGPISIPNIAIP;IGPISIPNIAIPS;GPISIPNIAIPSI;PISIPNIAIPSIH;ISIPNIAIPSIHL;SIPNIAIPSIHLG;IPNIAIPSIHLGI;PNIAIPSIHLGID;NIAIPSIHLGIDP;IAIPSIHLGIDPT;AIPSIHLGIDPTF;IPSIHLGIDPTFD;PSIHLGIDPTFDV;SIHLGIDPTFDVG;IHLGIDPTFDVGP;HLGIDPTFDVGPI;LGIDPTFDVGPIT;GIDPTFDVGPITV;IDPTFDVGPITVD;DPTFDVGPITVDP;PTFDVGPITVDPI;TFDVGPITVDPIT;FDVGPITVDPITL;DVGPITVDPITLT;VGPITVDPITLTI;GPITVDPITLTIP;PITVDPITLTIPG;ITVDPITLTIPGL;TVDPITLTIPGLS;VDPITLTIPGLSL;DPITLTIPGLSLD;PITLTIPGLSLDA;ITLTIPGLSLDAA;TLTIPGLSLDAAV;LTIPGLSLDAAVS;TIPGLSLDAAVSE;IPGLSLDAAVSEI;PGLSLDAAVSEIR;GLSLDAAVSEIRM;LSLDAAVSEIRMT;SLDAAVSEIRMTS;LDAAVSEIRMTSG;DAAVSEIRMTSGS;AAVSEIRMTSGSS;AVSEIRMTSGSSS;VSEIRMTSGSSSG;SEIRMTSGSSSGF;EIRMTSGSSSGFK;IRMTSGSSSGFKV;RMTSGSSSGFKVR;MTSGSSSGFKVRP;TSGSSSGFKVRPS;SGSSSGFKVRPSF;GSSSGFKVRPSFS;SSSGFKVRPSFSF;SSGFKVRPSFSFF;SGFKVRPSFSFFA;GFKVRPSFSFFAV;FKVRPSFSFFAVG;KVRPSFSFFAVGP;VRPSFSFFAVGPD;RPSFSFFAVGPDG;PSFSFFAVGPDGM;SFSFFAVGPDGMP;FSFFAVGPDGMPG;SFFAVGPDGMPGG;FFAVGPDGMPGGE;FAVGPDGMPGGEV;AVGPDGMPGGEVS;VGPDGMPGGEVSI;GPDGMPGGEVSIL;PDGMPGGEVSILQ;DGMPGGEVSILQP;GMPGGEVSILQPF;MPGGEVSILQPFT;PGGEVSILQPFTV;GGEVSILQPFTVA;GEVSILQPFTVAP;EVSILQPFTVAPI;VSILQPFTVAPIN;SILQPFTVAPINL;ILQPFTVAPINLN;LQPFTVAPINLNP;QPFTVAPINLNPT;PFTVAPINLNPTT;FTVAPINLNPTTL;TVAPINLNPTTLH;VAPINLNPTTLHF;APINLNPTTLHFP;PINLNPTTLHFPG;INLNPTTLHFPGF;NLNPTTLHFPGFT;LNPTTLHFPGFTI;NPTTLHFPGFTIP;PTTLHFPGFTIPT;TTLHFPGFTIPTG;TLHFPGFTIPTGP;LHFPGFTIPTGPI;HFPGFTIPTGPIH;FPGFTIPTGPIHI;PGFTIPTGPIHIG;GFTIPTGPIHIGL;FTIPTGPIHIGLP;TIPTGPIHIGLPL;IPTGPIHIGLPLS;PTGPIHIGLPLSL;TGPIHIGLPLSLT;GPIHIGLPLSLTI;PIHIGLPLSLTIP;IHIGLPLSLTIPG;HIGLPLSLTIPGF;IGLPLSLTIPGFT;GLPLSLTIPGFTI;LPLSLTIPGFTIP;PLSLTIPGFTIPG;LSLTIPGFTIPGG;SLTIPGFTIPGGT;LTIPGFTIPGGTL;TIPGFTIPGGTLI;IPGFTIPGGTLIP;PGFTIPGGTLIPQ;GFTIPGGTLIPQL;FTIPGGTLIPQLP;TIPGGTLIPQLPL;IPGGTLIPQLPLG;PGGTLIPQLPLGL;GGTLIPQLPLGLG;GTLIPQLPLGLGL;TLIPQLPLGLGLS;LIPQLPLGLGLSG;IPQLPLGLGLSGG;PQLPLGLGLSGGT;QLPLGLGLSGGTP;LPLGLGLSGGTPP;PLGLGLSGGTPPF;LGLGLSGGTPPFD;GLGLSGGTPPFDL;LGLSGGTPPFDLP;GLSGGTPPFDLPT;LSGGTPPFDLPTV;SGGTPPFDLPTVV;GGTPPFDLPTVVI;GTPPFDLPTVVID;TPPFDLPTVVIDR;PPFDLPTVVIDRI;PFDLPTVVIDRIP;FDLPTVVIDRIPV;DLPTVVIDRIPVE;LPTVVIDRIPVEL;PTVVIDRIPVELH;TVVIDRIPVELHA;VVIDRIPVELHAS;VIDRIPVELHAST;IDRIPVELHASTT;DRIPVELHASTTI;RIPVELHASTTIG;IPVELHASTTIGP;PVELHASTTIGPV;VELHASTTIGPVS;ELHASTTIGPVSL;LHASTTIGPVSLP;HASTTIGPVSLPI;ASTTIGPVSLPIF;STTIGPVSLPIFG;TTIGPVSLPIFGF;TIGPVSLPIFGFG;IGPVSLPIFGFGG;GPVSLPIFGFGGA;PVSLPIFGFGGAP;VSLPIFGFGGAPG;SLPIFGFGGAPGF;LPIFGFGGAPGFG;PIFGFGGAPGFGN;IFGFGGAPGFGND;FGFGGAPGFGNDT;GFGGAPGFGNDTT;FGGAPGFGNDTTA;GGAPGFGNDTTAP;GAPGFGNDTTAPS;APGFGNDTTAPSS;PGFGNDTTAPSSG;GFGNDTTAPSSGF;FGNDTTAPSSGFF;GNDTTAPSSGFFN;NDTTAPSSGFFNT;DTTAPSSGFFNTG;TTAPSSGFFNTGG;TAPSSGFFNTGGG;APSSGFFNTGGGG;PSSGFFNTGGGGG;SSGFFNTGGGGGS;SGFFNTGGGGGSG;GFFNTGGGGGSGF;FFNTGGGGGSGF | |

Fig. 30 continued

| | | |
|---|---|---|
| | S;FNTGGGGGSGFSN;NTGGGGGSGFSNS;TGGGGGSGFSNSG;GGGGGSGFSNSGS;GGGGSGFSNSGSG;GGGSGFSNSGSGM;GGSGFSNSGSGMS;GSGFSNSGSGMSG;SGFSNSGSGMSGV;GFSNSGSGMSGVL;FSNSGSGMSGVLN;SNSGSGMSGVLNA;NSGSGMSGVLNAI;SGSGMSGVLNAIS;GSGMSGVLNAISD;SGMSGVLNAISDP;GMSGVLNAISDPL;MSGVLNAISDPLL;SGVLNAISDPLLG;GVLNAISDPLLGS;VLNAISDPLLGSA;LNAISDPLLGSAS;NAISDPLLGSASG;AISDPLLGSASGF;ISDPLLGSASGFA;SDPLLGSASGFAN;DPLLGSASGFANF;PLLGSASGFANFG;LLGSASGFANFGT;LGSASGFANFGTQ;GSASGFANFGTQL;SASGFANFGTQLS;ASGFANFGTQLSG;SGFANFGTQLSGI;GFANFGTQLSGIL;FANFGTQLSGILN;ANFGTQLSGILNR;NFGTQLSGILNRG;FGTQLSGILNRGA;GTQLSGILNRGAG;TQLSGILNRGAGI;QLSGILNRGAGIS;LSGILNRGAGISG;SGILNRGAGISGV;GILNRGAGISGVY;ILNRGAGISGVYN;LNRGAGISGVYNT;NRGAGISGVYNTG;RGAGISGVYNTGT;GAGISGVYNTGTL;AGISGVYNTGTLG;GISGVYNTGTLGL;ISGVYNTGTLGLV;SGVYNTGTLGLVT;GVYNTGTLGLVTS;VYNTGTLGLVTSA;YNTGTLGLVTSAF;NTGTLGLVTSAFV;TGTLGLVTSAFVS;GTLGLVTSAFVSG;TLGLVTSAFVSGF;LGLVTSAFVSGFM;GLVTSAFVSGFMN;LVTSAFVSGFMNV;VTSAFVSGFMNVG;TSAFVSGFMNVGQ;SAFVSGFMNVGQQ;AFVSGFMNVGQQL;FVSGFMNVGQQLS;VSGFMNVGQQLSG;SGFMNVGQQLSGL;GFMNVGQQLSGLL;FMNVGQQLSGLLF;MNVGQQLSGLLFA;NVGQQLSGLLFAG;VGQQLSGLLFAGT;GQQLSGLLFAGTG;QQLSGLLFAGTGP;<br><br>14 mers:<br>MNFPVLPPEINSVL;NFPVLPPEINSVLM;FPVLPPEINSVLMY;PVLPPEINSVLMYS;VLPPEINSVLMYSG;LPPEINSVLMYSGA;PPEINSVLMYSGAG;PEINSVLMYSGAGS;EINSVLMYSGAGSS;INSVLMYSGAGSSP;NSVLMYSGAGSSPL;SVLMYSGAGSSPLL;VLMYSGAGSSPLLA;LMYSGAGSSPLLAA;MYSGAGSSPLLAAA;YSGAGSSPLLAAAA;SGAGSSPLLAAAAA;GAGSSPLLAAAAAW;AGSSPLLAAAAAWD;GSSPLLAAAAAWDG;SSPLLAAAAAWDGL;SPLLAAAAAWDGLA;PLLAAAAAWDGLAE;LLAAAAAWDGLAEE;LAAAAAWDGLAEEL;AAAAAWDGLAEELG;AAAAWDGLAEELGS;AAAWDGLAEELGSA;AAWDGLAEELGSAA;AWDGLAEELGSAAV;WDGLAEELGSAAVS;DGLAEELGSAAVSF;GLAEELGSAAVSFG;LAEELGSAAVSFGQ;AEELGSAAVSFGQV;EELGSAAVSFGQVT;ELGSAAVSFGQVTS;LGSAAVSFGQVTSG;GSAAVSFGQVTSGL;SAAVSFGQVTSGLT;AAVSFGQVTSGLTA;AVSFGQVTSGLTAG;VSFGQVTSGLTAGV;SFGQVTSGLTAGVW;FGQVTSGLTAGVWQ;GQVTSGLTAGVWQG;QVTSGLTAGVWQGA;VTSGLTAGVWQGAA;TSGLTAGVWQGAAA;SGLTAGVWQGAAAA;GLTAGVWQGAAAAA;LTAGVWQGAAAAAM;TAGVWQGAAAAAMA;AGVWQGAAAAAMAA;GVWQGAAAAAMAAA;VWQGAAAAAMAAAA;WQGAAAAAMAAAAA;QGAAAAAMAAAAAP;GAAAAAMAAAAAPY;AAAAAMAAAAAPYA;AAAAMAAAAAPYAG;AAAMAAAAAPYAGW;AAMAAAAAPYAGWL;AMAAAAAPYAGWLG;MAAAAAPYAGWLGS;AAAAAPYAGWLGSV;AAAAPYAGWLGSVA;AAAPYAGWLGSVAA;AAPYAGWLGSVAAQ;APYAGWLGSVAAQA;PYAGWLGSVAAQAV;YAGWLGSVAAQAVA;AGWLGSVAAQAVAV;GWLGSVAAQAVAVA;WLGSVAAQAVAVAG;LGSVAAQAVAVAGQ;GSVAAQAVAVAGQA;SVAAQAVAVAGQAR;VAAQAVAVAGQARA;AAQAVAVAGQARAA;AQAVAVAGQARAAV;QAVAVAGQARAAVA;AVAVAGQARAAVAA;VAVAGQARAAVAAF;AVAGQARAAVAAFE;VAGQARAAVAAFEA;AGQARAAVAAFEAA;GQARAAVAAFEAAL;QARAAVAAFEAALA;ARAAVAAFEAALAA;RAAVAAFEAALAAT;AAVAAFEAALAATV;AVAAFEAALAATVD;VAAFEAALAATVDP;AAFEAALAATVDPA;AFEAALAATVDPAA;FEAALAATVDPAAV;EAALAATVDPAAVA;AALAATVDPAAVAV;ALAATVDPAAVAVN;LAATVDPAAVAVNR;AATVDPAAVAVNRM;ATVDPAAVAVN | |

Fig. 30 continued

| | | |
|---|---|---|
| | RMA;TVDPAAVAVNRMAM;VDPAAVAVNRMAMR;DPAAVAVNRMAMRA;PAAVAVNRMAMRAL;AAVAVNRMAMRALA;AVAVNRMAMRALAM;VAVNRMAMRALAMS;AVNRMAMRALAMSN;VNRMAMRALAMSNL;NRMAMRALAMSNLL;RMAMRALAMSNLLG;MAMRALAMSNLLGQ;AMRALAMSNLLGQN;MRALAMSNLLGQNA;RALAMSNLLGQNAA;ALAMSNLLGQNAAA;LAMSNLLGQNAAAI;AMSNLLGQNAAAIA;MSNLLGQNAAAIAA;SNLLGQNAAAIAAV;NLLGQNAAAIAAVE;LLGQNAAAIAAVEA;LGQNAAAIAAVEAE;GQNAAAIAAVEAEY;QNAAAIAAVEAEYE;NAAAIAAVEAEYEL;AAAIAAVEAEYELM;AAIAAVEAEYELMW;AIAAVEAEYELMWA;IAAVEAEYELMWAA;AAVEAEYELMWAAD;AVEAEYELMWAADV;VEAEYELMWAADVA;EAEYELMWAADVAA;AEYELMWAADVAAM;EYELMWAADVAAMA;YELMWAADVAAMAG;ELMWAADVAAMAGY;LMWAADVAAMAGYH;MWAADVAAMAGYHS;WAADVAAMAGYHSG;AADVAAMAGYHSGA;ADVAAMAGYHSGAS;DVAAMAGYHSGASA;VAAMAGYHSGASAA;AAMAGYHSGASAAA;AMAGYHSGASAAAA;MAGYHSGASAAAAA;AGYHSGASAAAAAL;GYHSGASAAAAALP;YHSGASAAAAALPA;HSGASAAAAALPAF;SGASAAAAALPAFS;GASAAAAALPAFSP;ASAAAAALPAFSPP;SAAAAALPAFSPPA;AAAAALPAFSPPAQ;AAAALPAFSPPAQA;AAALPAFSPPAQAL;AALPAFSPPAQALG;ALPAFSPPAQALGG;LPAFSPPAQALGGG;PAFSPPAQALGGGV;AFSPPAQALGGGVG;FSPPAQALGGGVGA;SPPAQALGGGVGAF;PPAQALGGGVGAFL;PAQALGGGVGAFLN;AQALGGGVGAFLNA;QALGGGVGAFLNAL;ALGGGVGAFLNALF;LGGGVGAFLNALFA;GGGVGAFLNALFAG;GGVGAFLNALFAGP;GVGAFLNALFAGPA;VGAFLNALFAGPAK;GAFLNALFAGPAKM;AFLNALFAGPAKML;FLNALFAGPAKMLR;LNALFAGPAKMLRL;NALFAGPAKMLRLN;ALFAGPAKMLRLNA;LFAGPAKMLRLNAG;FAGPAKMLRLNAGL;AGPAKMLRLNAGLG;GPAKMLRLNAGLGN;PAKMLRLNAGLGNV;AKMLRLNAGLGNVG;KMLRLNAGLGNVGN;MLRLNAGLGNVGNY;LRLNAGLGNVGNYN;RLNAGLGNVGNYNV;LNAGLGNVGNYNVG;NAGLGNVGNYNVGL;AGLGNVGNYNVGLG;GLGNVGNYNVGLGN;LGNVGNYNVGLGNV;GNVGNYNVGLGNVG;NVGNYNVGLGNVGI;VGNYNVGLGNVGIF;GNYNVGLGNVGIFN;NYNVGLGNVGIFNL;YNVGLGNVGIFNLG;NVGLGNVGIFNLGA;VGLGNVGIFNLGAA;GLGNVGIFNLGAAN;LGNVGIFNLGAANV;GNVGIFNLGAANVG;NVGIFNLGAANVGA;VGIFNLGAANVGAQ;GIFNLGAANVGAQN;IFNLGAANVGAQNL;FNLGAANVGAQNLG;NLGAANVGAQNLGA;LGAANVGAQNLGAA;GAANVGAQNLGAAN;AANVGAQNLGAANA;ANVGAQNLGAANAG;NVGAQNLGAANAGS;VGAQNLGAANAGSG;GAQNLGAANAGSGN;AQNLGAANAGSGNF;QNLGAANAGSGNFG;NLGAANAGSGNFGF;LGAANAGSGNFGFG;GAANAGSGNFGFGN;AANAGSGNFGFGNI;ANAGSGNFGFGNIG;NAGSGNFGFGNIGN;AGSGNFGFGNIGNA;GSGNFGFGNIGNAN;SGNFGFGNIGNANF;GNFGFGNIGNANFG;NFGFGNIGNANFGF;FGFGNIGNANFGFG;GFGNIGNANFGFGN;FGNIGNANFGFGNS;GNIGNANFGFGNSG;NIGNANFGFGNSGL;IGNANFGFGNSGLG;GNANFGFGNSGLGL;NANFGFGNSGLGLP;ANFGFGNSGLGLPP;NFGFGNSGLGLPPG;FGFGNSGLGLPPGM;GFGNSGLGLPPGMG;FGNSGLGLPPGMGN;GNSGLGLPPGMGNI;NSGLGLPPGMGNIG;SGLGLPPGMGNIGL;GLGLPPGMGNIGLG;LGLPPGMGNIGLGN;GLPPGMGNIGLGNA;LPPGMGNIGLGNAG;PPGMGNIGLGNAGS;PGMGNIGLGNAGSS;GMGNIGLGNAGSSN;MGNIGLGNAGSSNY;GNIGLGNAGSSNYG;NIGLGNAGSSNYGL;IGLGNAGSSNYGLA;GLGNAGSSNYGLAN;LGNAGSSNYGLANL;GNAGSSNYGLANLG;NAGSSNYGLANLGV;AGSSNYGLANLGVG;GSSNYGLANLGVGN;SSNYGLANLGVGNI;SNYGLANLGVGNIG;NYGLANLGVGNIGF;YGLANLGVGNIGFA;GLANLGVGNIGFAN;LANLGVGNIGFANT;ANLGVGNIGFANTG;NLGVGNIGFANTGS;LGVGNIGFANTGSN;GVGNIGFANTGSNN;VGNIGFANTGSNNI;GNIGFANTGSNNIG;NIGFANTGSNNIGI;IGFANTGSNNIGIG;GFANTGSNNIG | |

Fig. 30 continued

| | | |
|---|---|---|
| | IGL;FANTGSNNIGIGLT;ANTGSNNIGIGLTG;NTGSNNIGIGLTGD;TGSNNIGIGLTGDN;GSNNIGIGLTGDNL;SNNIGIGLTGDNLT;NNIGIGLTGDNLTG;NIGIGLTGDNLTGI;IGIGLTGDNLTGIG;GIGLTGDNLTGIGG;IGLTGDNLTGIGGL;GLTGDNLTGIGGLN;LTGDNLTGIGGLNS;TGDNLTGIGGLNSG;GDNLTGIGGLNSGT;DNLTGIGGLNSGTG;NLTGIGGLNSGTGN;LTGIGGLNSGTGNL;TGIGGLNSGTGNLG;GIGGLNSGTGNLGL;IGGLNSGTGNLGLF;GGLNSGTGNLGLFN;GLNSGTGNLGLFNS;LNSGTGNLGLFNSG;NSGTGNLGLFNSGT;SGTGNLGLFNSGTG;GTGNLGLFNSGTGN;TGNLGLFNSGTGNI;GNLGLFNSGTGNIG;NLGLFNSGTGNIGF;LGLFNSGTGNIGFF;GLFNSGTGNIGFFN;LFNSGTGNIGFFNS;FNSGTGNIGFFNSG;NSGTGNIGFFNSGT;SGTGNIGFFNSGTG;GTGNIGFFNSGTGN;TGNIGFFNSGTGNF;GNIGFFNSGTGNFG;NIGFFNSGTGNFGV;IGFFNSGTGNFGVF;GFFNSGTGNFGVFN;FFNSGTGNFGVFNS;FNSGTGNFGVFNSG;NSGTGNFGVFNSGS;SGTGNFGVFNSGSY;GTGNFGVFNSGSYN;TGNFGVFNSGSYNT;GNFGVFNSGSYNTG;NFGVFNSGSYNTGV;FGVFNSGSYNTGVG;GVFNSGSYNTGVGN;VFNSGSYNTGVGNA;FNSGSYNTGVGNAG;NSGSYNTGVGNAGT;SGSYNTGVGNAGTA;GSYNTGVGNAGTAS;SYNTGVGNAGTAST;YNTGVGNAGTASTG;NTGVGNAGTASTGL;TGVGNAGTASTGLF;GVGNAGTASTGLFN;VGNAGTASTGLFNV;GNAGTASTGLFNVG;NAGTASTGLFNVGG;AGTASTGLFNVGGF;GTASTGLFNVGGFN;TASTGLFNVGGFNT;ASTGLFNVGGFNTG;STGLFNVGGFNTGV;TGLFNVGGFNTGVA;GLFNVGGFNTGVAN;LFNVGGFNTGVANV;FNVGGFNTGVANVG;NVGGFNTGVANVGS;VGGFNTGVANVGSY;GGFNTGVANVGSYN;GFNTGVANVGSYNT;FNTGVANVGSYNTG;NTGVANVGSYNTGS;TGVANVGSYNTGSF;GVANVGSYNTGSFN;VANVGSYNTGSFNA;ANVGSYNTGSFNAG;NVGSYNTGSFNAGN;VGSYNTGSFNAGNT;GSYNTGSFNAGNTN;SYNTGSFNAGNTNT;YNTGSFNAGNTNTG;NTGSFNAGNTNTGG;TGSFNAGNTNTGGF;GSFNAGNTNTGGFN;SFNAGNTNTGGFNP;FNAGNTNTGGFNPG;NAGNTNTGGFNPGN;AGNTNTGGFNPGNV;GNTNTGGFNPGNVN;NTNTGGFNPGNVNT;TNTGGFNPGNVNTG;NTGGFNPGNVNTGW;TGGFNPGNVNTGWL;GGFNPGNVNTGWLN;GFNPGNVNTGWLNT;FNPGNVNTGWLNTG;NPGNVNTGWLNTGN;PGNVNTGWLNTGNT;GNVNTGWLNTGNTN;NVNTGWLNTGNTNT;VNTGWLNTGNTNTG;NTGWLNTGNTNTGI;TGWLNTGNTNTGIA;GWLNTGNTNTGIAN;WLNTGNTNTGIANS;LNTGNTNTGIANSG;NTGNTNTGIANSGN;TGNTNTGIANSGNV;GNTNTGIANSGNVN;NTNTGIANSGNVNT;TNTGIANSGNVNTG;NTGIANSGNVNTGA;TGIANSGNVNTGAF;GIANSGNVNTGAFI;IANSGNVNTGAFIS;ANSGNVNTGAFISG;NSGNVNTGAFISGN;SGNVNTGAFISGNF;GNVNTGAFISGNFS;NVNTGAFISGNFSN;VNTGAFISGNFSNG;NTGAFISGNFSNGV;TGAFISGNFSNGVL;GAFISGNFSNGVLW;AFISGNFSNGVLWR;FISGNFSNGVLWRG;ISGNFSNGVLWRGD;SGNFSNGVLWRGDY;GNFSNGVLWRGDYE;NFSNGVLWRGDYEG;FSNGVLWRGDYEGL;SNGVLWRGDYEGLW;NGVLWRGDYEGLWG;GVLWRGDYEGLWGL;VLWRGDYEGLWGLS;LWRGDYEGLWGLSG;WRGDYEGLWGLSGG;RGDYEGLWGLSGGS;GDYEGLWGLSGGST;DYEGLWGLSGGSTI;YEGLWGLSGGSTIP;EGLWGLSGGSTIPA;GLWGLSGGSTIPAI;LWGLSGGSTIPAIP;WGLSGGSTIPAIPI;GLSGGSTIPAIPIG;LSGGSTIPAIPIGL;SGGSTIPAIPIGLE;GGSTIPAIPIGLEL;GSTIPAIPIGLELN;STIPAIPIGLELNG;TIPAIPIGLELNGG;IPAIPIGLELNGGV;PAIPIGLELNGGVG;AIPIGLELNGGVGP;IPIGLELNGGVGPI;PIGLELNGGVGPIT;IGLELNGGVGPITV;GLELNGGVGPITVL;LELNGGVGPITVLP;ELNGGVGPITVLPI;LNGGVGPITVLPIQ;NGGVGPITVLPIQI;GGVGPITVLPIQIL;GVGPITVLPIQILP;VGPITVLPIQILPT;GPITVLPIQILPTI;PITVLPIQILPTIP;ITVLPIQILPTIPL;TVLPIQILPTIPLN;VLPIQILPTIPLNI;LPIQILPTIPLNIH;PIQILPTIPLNIHQ;IQILPTIPLNIHQT;QILPTIPLNIHQTF;ILPTIPLNIHQTFS;LPTIPLNIHQTFSL;PTIPLNIHQTFSLG;TIPLNIH | |

Fig. 30 continued

| | | |
|---|---|---|
| | QTFSLGP;IPLNIHQTFSLGPL;PLNIHQTFSLGPLV;LNIHQTFSLGPLVV;NIHQTFSLGPLVVP;IHQTFSLGPLVVPD;HQTFSLGPLVVPDI;QTFSLGPLVVPDIV;TFSLGPLVVPDIVI;FSLGPLVVPDIVIP;SLGPLVVPDIVIPA;LGPLVVPDIVIPAF;GPLVVPDIVIPAFG;PLVVPDIVIPAFGG;LVVPDIVIPAFGGG;VVPDIVIPAFGGGT;VPDIVIPAFGGGTA;PDIVIPAFGGGTAI;DIVIPAFGGGTAIP;IVIPAFGGGTAIPI;VIPAFGGGTAIPIS;IPAFGGGTAIPISV;PAFGGGTAIPISVG;AFGGGTAIPISVGP;FGGGTAIPISVGPI;GGGTAIPISVGPIT;GGTAIPISVGPITI;GTAIPISVGPITIS;TAIPISVGPITISP;AIPISVGPITISPI;IPISVGPITISPIT;PISVGPITISPITL;ISVGPITISPITLF;SVGPITISPITLFP;VGPITISPITLFPA;GPITISPITLFPAQ;PITISPITLFPAQN;ITISPITLFPAQNF;TISPITLFPAQNFN;ISPITLFPAQNFNT;SPITLFPAQNFNTT;PITLFPAQNFNTTF;ITLFPAQNFNTTFP;TLFPAQNFNTTFPV;LFPAQNFNTTFPVG;FPAQNFNTTFPVGP;PAQNFNTTFPVGPF;AQNFNTTFPVGPFF;QNFNTTFPVGPFFG;NFNTTFPVGPFFGL;FNTTFPVGPFFGLG;NTTFPVGPFFGLGV;TTFPVGPFFGLGVV;TFPVGPFFGLGVVN;FPVGPFFGLGVVNI;PVGPFFGLGVVNIS;VGPFFGLGVVNISG;GPFFGLGVVNISGI;PFFGLGVVNISGIE;FFGLGVVNISGIEI;FGLGVVNISGIEIK;GLGVVNISGIEIKD;LGVVNISGIEIKDL;GVVNISGIEIKDLA;VVNISGIEIKDLAG;VNISGIEIKDLAGN;NISGIEIKDLAGNV;ISGIEIKDLAGNVT;SGIEIKDLAGNVTL;GIEIKDLAGNVTLQ;IEIKDLAGNVTLQL;EIKDLAGNVTLQLG;IKDLAGNVTLQLGN;KDLAGNVTLQLGNL;DLAGNVTLQLGNLN;LAGNVTLQLGNLNI;AGNVTLQLGNLNID;GNVTLQLGNLNIDT;NVTLQLGNLNIDTR;VTLQLGNLNIDTRI;TLQLGNLNIDTRIN;LQLGNLNIDTRINQ;QLGNLNIDTRINQS;LGNLNIDTRINQSF;GNLNIDTRINQSFP;NLNIDTRINQSFPV;LNIDTRINQSFPVT;NIDTRINQSFPVTV;IDTRINQSFPVTVN;DTRINQSFPVTVNW;TRINQSFPVTVNWS;RINQSFPVTVNWST;INQSFPVTVNWSTP;NQSFPVTVNWSTPA;QSFPVTVNWSTPAV;SFPVTVNWSTPAVT;FPVTVNWSTPAVTI;PVTVNWSTPAVTIF;VTVNWSTPAVTIFP;TVNWSTPAVTIFPN;VNWSTPAVTIFPNG;NWSTPAVTIFPNGI;WSTPAVTIFPNGIS;STPAVTIFPNGISI;TPAVTIFPNGISIP;PAVTIFPNGISIPN;AVTIFPNGISIPNN;VTIFPNGISIPNNP;TIFPNGISIPNNPL;IFPNGISIPNNPLA;FPNGISIPNNPLAL;PNGISIPNNPLALL;NGISIPNNPLALLA;GISIPNNPLALLAS;ISIPNNPLALLASA;SIPNNPLALLASAS;IPNNPLALLASASI;PNNPLALLASASIG;NNPLALLASASIGT;NPLALLASASIGTL;PLALLASASIGTLG;LALLASASIGTLGF;ALLASASIGTLGFT;LLASASIGTLGFTI;LASASIGTLGFTIP;ASASIGTLGFTIPG;SASIGTLGFTIPGF;ASIGTLGFTIPGFT;SIGTLGFTIPGFTI;IGTLGFTIPGFTIP;GTLGFTIPGFTIPA;TLGFTIPGFTIPAA;LGFTIPGFTIPAAP;GFTIPGFTIPAAPL;FTIPGFTIPAAPLP;TIPGFTIPAAPLPL;IPGFTIPAAPLPLT;PGFTIPAAPLPLTI;GFTIPAAPLPLTID;FTIPAAPLPLTIDI;TIPAAPLPLTIDID;IPAAPLPLTIDIDG;PAAPLPLTIDIDGQ;AAPLPLTIDIDGQI;APLPLTIDIDGQID;PLPLTIDIDGQIDG;LPLTIDIDGQIDGF;PLTIDIDGQIDGFS;LTIDIDGQIDGFST;TIDIDGQIDGFSTP;IDIDGQIDGFSTPP;DIDGQIDGFSTPPI;IDGQIDGFSTPPIT;DGQIDGFSTPPITI;GQIDGFSTPPITID;QIDGFSTPPITIDR;IDGFSTPPITIDRI;DGFSTPPITIDRIP;GFSTPPITIDRIPL;FSTPPITIDRIPLN;STPPITIDRIPLNL;TPPITIDRIPLNLG;PPITIDRIPLNLGA;PITIDRIPLNLGAS;ITIDRIPLNLGASV;TIDRIPLNLGASVT;IDRIPLNLGASVTV;DRIPLNLGASVTVG;RIPLNLGASVTVGP;IPLNLGASVTVGPI;PLNLGASVTVGPIL;LNLGASVTVGPILI;NLGASVTVGPILIN;LGASVTVGPILING;GASVTVGPILINGV;ASVTVGPILINGVN;SVTVGPILINGVNI;VTVGPILINGVNIP;TVGPILINGVNIPA;VGPILINGVNIPAT;GPILINGVNIPATP;PILINGVNIPATPG;ILINGVNIPATPGF;LINGVNIPATPGFG;INGVNIPATPGFGN;NGVNIPATPGFGNT;GVNIPATPGFGNTT;VNIPATPGFGNTTT;NIPATPGFGNTTTA;IPATPGFGNTTTAP;PATPGFGNTTTAPS;ATPGFGNTTTAPSS;TPGFGNTTTAPSSG;PGFGNTTTAPSSGF;GFGNTTTAPSSGFF;FGNTTTAPSSGFFN;GNTTTAPSSGFFNS;NTTTAPSSGFFNSG;TTTAPSSGFFNSGD;TTAPSSGFFNSGDG;TAPSSGFFN | |

Fig. 30 continued

| | | |
|---|---|---|
| | SGDGG;APSSGFFNSGDGGV;PSSGFFNSGDGGVS;SSGFFNSGDGGVSG;SGFFNSGDGGVSGF;GFFNSGDGGVSGFG;FFNSGDGGVSGFGN;FNSGDGGVSGFGNF;NSGDGGVSGFGNFG;SGDGGVSGFGNFGA;GDGGVSGFGNFGAG;DGGVSGFGNFGAGS;GGVSGFGNFGAGSS;GVSGFGNFGAGSSG;VSGFGNFGAGSSGW;SGFGNFGAGSSGWW;GFGNFGAGSSGWWN;FGNFGAGSSGWWNQ;GNFGAGSSGWWNQA;NFGAGSSGWWNQAQ;FGAGSSGWWNQAQT;GAGSSGWWNQAQTE;AGSSGWWNQAQTEV;GSSGWWNQAQTEVA;SSGWWNQAQTEVAG;SGWWNQAQTEVAGA;GWWNQAQTEVAGAG;WWNQAQTEVAGAGS;WNQAQTEVAGAGSG;NQAQTEVAGAGSGF;QAQTEVAGAGSGFA;AQTEVAGAGSGFAN;QTEVAGAGSGFANF;TEVAGAGSGFANFG;EVAGAGSGFANFGS;VAGAGSGFANFGSL;AGAGSGFANFGSLG;GAGSGFANFGSLGS;AGSGFANFGSLGSG;GSGFANFGSLGSGV;SGFANFGSLGSGVL;GFANFGSLGSGVLN;FANFGSLGSGVLNF;ANFGSLGSGVLNFG;NFGSLGSGVLNFGS;FGSLGSGVLNFGSG;GSLGSGVLNFGSGV;SLGSGVLNFGSGVS;LGSGVLNFGSGVSG;GSGVLNFGSGVSGL;SGVLNFGSGVSGLY;GVLNFGSGVSGLYN;VLNFGSGVSGLYNT;LNFGSGVSGLYNTG;NFGSGVSGLYNTGG;FGSGVSGLYNTGGL;GSGVSGLYNTGGLP;SGVSGLYNTGGLPP;GVSGLYNTGGLPPG;VSGLYNTGGLPPGT;SGLYNTGGLPPGTP;GLYNTGGLPPGTPA;LYNTGGLPPGTPAV;YNTGGLPPGTPAVV;NTGGLPPGTPAVVS;TGGLPPGTPAVVSG;GGLPPGTPAVVSGI;GLPPGTPAVVSGIG;LPPGTPAVVSGIGN;PPGTPAVVSGIGNV;PGTPAVVSGIGNVG;GTPAVVSGIGNVGE;TPAVVSGIGNVGEQ;PAVVSGIGNVGEQL;AVVSGIGNVGEQLS;VVSGIGNVGEQLSG;VSGIGNVGEQLSGL;SGIGNVGEQLSGLS;GIGNVGEQLSGLSS;IGNVGEQLSGLSSA;GNVGEQLSGLSSAG;NVGEQLSGLSSAGT;VGEQLSGLSSAGTA;GEQLSGLSSAGTAL;EQLSGLSSAGTALN;QLSGLSSAGTALNQ;LSGLSSAGTALNQS;SGLSSAGTALNQSL;GLSSAGTALNQSLI;LSSAGTALNQSLII;SSAGTALNQSLIIN;SAGTALNQSLIINL;AGTALNQSLIINLG;GTALNQSLIINLGL;TALNQSLIINLGLA;ALNQSLIINLGLAD;LNQSLIINLGLADV;NQSLIINLGLADVG;QSLIINLGLADVGS;SLIINLGLADVGSV;LIINLGLADVGSVN;IINLGLADVGSVNV;INLGLADVGSVNVG;NLGLADVGSVNVGF;LGLADVGSVNVGFG;GLADVGSVNVGFGN;LADVGSVNVGFGNV;ADVGSVNVGFGNVG;DVGSVNVGFGNVGD;VGSVNVGFGNVGDF;GSVNVGFGNVGDFN;SVNVGFGNVGDFNL;VNVGFGNVGDFNLG;NVGFGNVGDFNLGA;VGFGNVGDFNLGAA;GFGNVGDFNLGAAN;FGNVGDFNLGAANI;GNVGDFNLGAANIG;NVGDFNLGAANIGD;VGDFNLGAANIGDL;GDFNLGAANIGDLN;DFNLGAANIGDLNV;FNLGAANIGDLNVG;NLGAANIGDLNVGL;LGAANIGDLNVGLG;GAANIGDLNVGLGN;AANIGDLNVGLGNV;ANIGDLNVGLGNVG;NIGDLNVGLGNVGG;IGDLNVGLGNVGGG;GDLNVGLGNVGGGN;DLNVGLGNVGGGNV;LNVGLGNVGGGNVG;NVGLGNVGGGNVGF;VGLGNVGGGNVGFG;GLGNVGGGNVGFGN;LGNVGGGNVGFGNI;GNVGGGNVGFGNIG;NVGGGNVGFGNIGD;VGGGNVGFGNIGDA;GGGNVGFGNIGDAN;GGNVGFGNIGDANF;GNVGFGNIGDANFG;NVGFGNIGDANFGL;VGFGNIGDANFGLG;GFGNIGDANFGLGN;FGNIGDANFGLGNA;GNIGDANFGLGNAG;NIGDANFGLGNAGL;IGDANFGLGNAGLA;GDANFGLGNAGLAA;DANFGLGNAGLAAG;ANFGLGNAGLAAGL;NFGLGNAGLAAGLA;FGLGNAGLAAGLAG;GLGNAGLAAGLAGV;LGNAGLAAGLAGVG;GNAGLAAGLAGVGN;NAGLAAGLAGVGNI;AGLAAGLAGVGNIG;GLAAGLAGVGNIGL;LAAGLAGVGNIGLG;AAGLAGVGNIGLGN;AGLAGVGNIGLGNA;GLAGVGNIGLGNAG;LAGVGNIGLGNAGS;AGVGNIGLGNAGSG;GVGNIGLGNAGSGN;VGNIGLGNAGSGNV;GNIGLGNAGSGNVG;NIGLGNAGSGNVGF;IGLGNAGSGNVGFG;GLGNAGSGNVGFGN;LGNAGSGNVGFGNM;GNAGSGNVGFGNMG;NAGSGNVGFGNMGV;AGSGNVGFGNMGVG;GSGNVGFGNMGVGN;SGNVGFGNMGVGNI;GNVGFGNMGVGNIG;NVGFGNMGVGNIGF;VGFGNMGV | |

Fig. 30 continued

| | | |
|---|---|---|
| | GNIGFG;GFGNMGVGNIGFGN;FGNMGVGNIGFGNT;GNMGVGNIGFGNTG;NMGVGNIGFGNTGT;MGVGNIGFGNTGTN;GVGNIGFGNTGTNN;VGNIGFGNTGTNNL;GNIGFGNTGTNNLG;NIGFGNTGTNNLGI;IGFGNTGTNNLGIG;GFGNTGTNNLGIGL;FGNTGTNNLGIGLT;GNTGTNNLGIGLTG;NTGTNNLGIGLTGD;TGTNNLGIGLTGDN;GTNNLGIGLTGDNQ;TNNLGIGLTGDNQT;NNLGIGLTGDNQTG;NLGIGLTGDNQTGI;LGIGLTGDNQTGIG;GIGLTGDNQTGIGG;IGLTGDNQTGIGGL;GLTGDNQTGIGGLN;LTGDNQTGIGGLNS;TGDNQTGIGGLNSG;GDNQTGIGGLNSGA;DNQTGIGGLNSGAG;NQTGIGGLNSGAGN;QTGIGGLNSGAGNI;TGIGGLNSGAGNIG;GIGGLNSGAGNIGL;IGGLNSGAGNIGLF;GGLNSGAGNIGLFN;GLNSGAGNIGLFNS;LNSGAGNIGLFNSG;NSGAGNIGLFNSGT;SGAGNIGLFNSGTG;GAGNIGLFNSGTGN;AGNIGLFNSGTGNV;GNIGLFNSGTGNVG;NIGLFNSGTGNVGL;IGLFNSGTGNVGLF;GLFNSGTGNVGLFN;LFNSGTGNVGLFNS;FNSGTGNVGLFNSG;NSGTGNVGLFNSGT;SGTGNVGLFNSGTG;GTGNVGLFNSGTGN;TGNVGLFNSGTGNF;GNVGLFNSGTGNFG;NVGLFNSGTGNFGL;VGLFNSGTGNFGLF;GLFNSGTGNFGLFN;LFNSGTGNFGLFNS;FNSGTGNFGLFNSG;NSGTGNFGLFNSGS;SGTGNFGLFNSGSF;GTGNFGLFNSGSFN;TGNFGLFNSGSFNT;GNFGLFNSGSFNTG;NFGLFNSGSFNTGI;FGLFNSGSFNTGIG;GLFNSGSFNTGIGN;LFNSGSFNTGIGNG;FNSGSFNTGIGNGG;NSGSFNTGIGNGGT;SGSFNTGIGNGGTG;GSFNTGIGNGGTGS;SFNTGIGNGGTGST;FNTGIGNGGTGSTG;NTGIGNGGTGSTGL;TGIGNGGTGSTGLF;GIGNGGTGSTGLFN;IGNGGTGSTGLFNA;GNGGTGSTGLFNAG;NGGTGSTGLFNAGN;GGTGSTGLFNAGNF;GTGSTGLFNAGNFN;TGSTGLFNAGNFNT;GSTGLFNAGNFNTG;STGLFNAGNFNTGV;TGLFNAGNFNTGVA;GLFNAGNFNTGVAN;LFNAGNFNTGVANP;FNAGNFNTGVANPG;NAGNFNTGVANPGS;AGNFNTGVANPGSY;GNFNTGVANPGSYN;NFNTGVANPGSYNT;FNTGVANPGSYNTG;NTGVANPGSYNTGS;TGVANPGSYNTGSF;GVANPGSYNTGSFN;VANPGSYNTGSFNV;ANPGSYNTGSFNVG;NPGSYNTGSFNVGD;PGSYNTGSFNVGDT;GSYNTGSFNVGDTN;SYNTGSFNVGDTNT;YNTGSFNVGDTNTG;NTGSFNVGDTNTGG;TGSFNVGDTNTGGF;GSFNVGDTNTGGFN;SFNVGDTNTGGFNP;FNVGDTNTGGFNPG;NVGDTNTGGFNPGS;VGDTNTGGFNPGSI;GDTNTGGFNPGSIN;DTNTGGFNPGSINT;TNTGGFNPGSINTG;NTGGFNPGSINTGW;TGGFNPGSINTGWF;GGFNPGSINTGWFN;GFNPGSINTGWFNT;FNPGSINTGWFNTG;NPGSINTGWFNTGN;PGSINTGWFNTGNA;GSINTGWFNTGNAN;SINTGWFNTGNANT;INTGWFNTGNANTG;NTGWFNTGNANTGV;TGWFNTGNANTGVA;GWFNTGNANTGVAN;WFNTGNANTGVANS;FNTGNANTGVANSG;NTGNANTGVANSGN;TGNANTGVANSGNV;GNANTGVANSGNVD;NANTGVANSGNVDT;ANTGVANSGNVDTG;NTGVANSGNVDTGA;TGVANSGNVDTGAL;GVANSGNVDTGALM;VANSGNVDTGALMS;ANSGNVDTGALMSG;NSGNVDTGALMSGN;SGNVDTGALMSGNF;GNVDTGALMSGNFS;NVDTGALMSGNFSN;VDTGALMSGNFSNG;DTGALMSGNFSNGI;TGALMSGNFSNGIL;GALMSGNFSNGILW;ALMSGNFSNGILWR;LMSGNFSNGILWRG;MSGNFSNGILWRGN;SGNFSNGILWRGNF;GNFSNGILWRGNFE;NFSNGILWRGNFEG;FSNGILWRGNFEGL;SNGILWRGNFEGLF;NGILWRGNFEGLFG;GILWRGNFEGLFGL;ILWRGNFEGLFGLN;LWRGNFEGLFGLNV;WRGNFEGLFGLNVG;RGNFEGLFGLNVGI;GNFEGLFGLNVGIT;NFEGLFGLNVGITI;FEGLFGLNVGITIP;EGLFGLNVGITIPE;GLFGLNVGITIPEF;LFGLNVGITIPEFP;FGLNVGITIPEFPI;GLNVGITIPEFPIH;LNVGITIPEFPIHW;NVGITIPEFPIHWT;VGITIPEFPIHWTS;GITIPEFPIHWTST;ITIPEFPIHWTSTG;TIPEFPIHWTSTGG;IPEFPIHWTSTGGI;PEFPIHWTSTGGIG;EFPIHWTSTGGIGP;FPIHWTSTGGIGPI;PIHWTSTGGIGPII;IHWTSTGGIGPIII;HWTSTGGIGPIIIP;WTSTGGIGPIIIPD;TSTGGIGPIIIPDT;STGGIGPIIIPDTT;TGGIGPIIIPDTTI;GGIGPIIIPDTTIL;GIGPIIIPDTTILP;IGPIIIPDTTILPP; | |

Fig. 30 continued

| | | |
|---|---|---|
| | GPIIIPDTTILPPI;PIIIPDTTILPPIH;IIIPDTTILPPIHL;IIPDTTILPPIHLG;IPDTTILPPIHLGL;PDTTILPPIHLGLT;DTTILPPIHLGLTG;TTILPPIHLGLTGQ;TILPPIHLGLTGQA;ILPPIHLGLTGQAN;LPPIHLGLTGQANY;PPIHLGLTGQANYG;PIHLGLTGQANYGF;IHLGLTGQANYGFA;HLGLTGQANYGFAV;LGLTGQANYGFAVP;GLTGQANYGFAVPD;LTGQANYGFAVPDI;TGQANYGFAVPDIP;GQANYGFAVPDIPI;QANYGFAVPDIPIP;ANYGFAVPDIPIPA;NYGFAVPDIPIPAI;YGFAVPDIPIPAIH;GFAVPDIPIPAIHI;FAVPDIPIPAIHID;AVPDIPIPAIHIDF;VPDIPIPAIHIDFD;PDIPIPAIHIDFDG;DIPIPAIHIDFDGA;IPIPAIHIDFDGAA;PIPAIHIDFDGAAD;IPAIHIDFDGAADA;PAIHIDFDGAADAG;AIHIDFDGAADAGF;IHIDFDGAADAGFT;HIDFDGAADAGFTA;IDFDGAADAGFTAP;DFDGAADAGFTAPA;FDGAADAGFTAPAT;DGAADAGFTAPATT;GAADAGFTAPATTL;AADAGFTAPATTLL;ADAGFTAPATTLLS;DAGFTAPATTLLSA;AGFTAPATTLLSAL;GFTAPATTLLSALG;FTAPATTLLSALGI;TAPATTLLSALGIT;APATTLLSALGITG;PATTLLSALGITGQ;ATTLLSALGITGQF;TTLLSALGITGQFR;TLLSALGITGQFRF;LLSALGITGQFRFG;LSALGITGQFRFGP;SALGITGQFRFGPI;ALGITGQFRFGPIT;LGITGQFRFGPITV;GITGQFRFGPITVS;ITGQFRFGPITVSN;TGQFRFGPITVSNV;GQFRFGPITVSNVQ;QFRFGPITVSNVQL;FRFGPITVSNVQLN;RFGPITVSNVQLNP;FGPITVSNVQLNPF;GPITVSNVQLNPFN;PITVSNVQLNPFNV;ITVSNVQLNPFNVN;TVSNVQLNPFNVNL;VSNVQLNPFNVNLK;SNVQLNPFNVNLKL;NVQLNPFNVNLKLQ;VQLNPFNVNLKLQF;QLNPFNVNLKLQFL;LNPFNVNLKLQFLH;NPFNVNLKLQFLHD;PFNVNLKLQFLHDA;FNVNLKLQFLHDAF;NVNLKLQFLHDAFP;VNLKLQFLHDAFPN;NLKLQFLHDAFPNE;LKLQFLHDAFPNEF;KLQFLHDAFPNEFP;LQFLHDAFPNEFPD;QFLHDAFPNEFPDP;FLHDAFPNEFPDPT;LHDAFPNEFPDPTI;HDAFPNEFPDPTIS;DAFPNEFPDPTISV;AFPNEFPDPTISVQ;FPNEFPDPTISVQI;PNEFPDPTISVQIQ;NEFPDPTISVQIQV;EFPDPTISVQIQVA;FPDPTISVQIQVAI;PDPTISVQIQVAIP;DPTISVQIQVAIPL;PTISVQIQVAIPLT;TISVQIQVAIPLTS;ISVQIQVAIPLTSA;SVQIQVAIPLTSAT;VQIQVAIPLTSATL;QIQVAIPLTSATLG;IQVAIPLTSATLGG;QVAIPLTSATLGGL;VAIPLTSATLGGLA;AIPLTSATLGGLAL;IPLTSATLGGLALP;PLTSATLGGLALPL;LTSATLGGLALPLQ;TSATLGGLALPLQQ;SATLGGLALPLQQT;ATLGGLALPLQQTI;TLGGLALPLQQTID;LGGLALPLQQTIDA;GGLALPLQQTIDAI;GLALPLQQTIDAIE;LALPLQQTIDAIEL;ALPLQQTIDAIELP;LPLQQTIDAIELPA;PLQQTIDAIELPAI;LQQTIDAIELPAIS;QQTIDAIELPAISF;QTIDAIELPAISFS;TIDAIELPAISFSQ;IDAIELPAISFSQS;DAIELPAISFSQSI;AIELPAISFSQSIP;IELPAISFSQSIPI;ELPAISFSQSIPID;LPAISFSQSIPIDI;PAISFSQSIPIDIP;AISFSQSIPIDIPP;ISFSQSIPIDIPPI;SFSQSIPIDIPPID;FSQSIPIDIPPIDI;SQSIPIDIPPIDIP;QSIPIDIPPIDIPA;SIPIDIPPIDIPAS;IPIDIPPIDIPAST;PIDIPPIDIPASTI;IDIPPIDIPASTIN;DIPPIDIPASTING;IPPIDIPASTINGI;PPIDIPASTINGIS;PIDIPASTINGISM;IDIPASTINGISMS;DIPASTINGISMSE;IPASTINGISMSEV;PASTINGISMSEVV;ASTINGISMSEVVP;STINGISMSEVVPI;TINGISMSEVVPID;INGISMSEVVPIDV;NGISMSEVVPIDVS;GISMSEVVPIDVSV;ISMSEVVPIDVSVD;SMSEVVPIDVSVDI;MSEVVPIDVSVDIP;SEVVPIDVSVDIPA;EVVPIDVSVDIPAV;VVPIDVSVDIPAVT;VPIDVSVDIPAVTI;PIDVSVDIPAVTIT;IDVSVDIPAVTITG;DVSVDIPAVTITGT;VSVDIPAVTITGTR;SVDIPAVTITGTRI;VDIPAVTITGTRID;DIPAVTITGTRIDP;IPAVTITGTRIDPI;PAVTITGTRIDPIP;AVTITGTRIDPIPL;VTITGTRIDPIPLN;TITGTRIDPIPLNF;ITGTRIDPIPLNFD;TGTRIDPIPLNFDV;GTRIDPIPLNFDVL;TRIDPIPLNFDVLS;RIDPIPLNFDVLSS;IDPIPLNFDVLSSA;DPIPLNFDVLSSAG;PIPLNFDVLSSAGP;IPLNFDVLSSAGPI;PLNFDVLSSAGPIN;LNFDVLSSAGPINI;NFDVLSSAGPINIS;FDVLSSAGPINISI;DVLSSAGPINISII;VLSSAGPINISIID;LSSAGPINISIIDI;SSAGPINISIIDIP;SAGPINISIIDIPA;AGPINISIIDIPAL;GPINISIIDIPALP;PINISIIDIPALPG;INISIIDIPALPGF;NISIIDIPALPGFG;ISIIDIPALPGFGN;SIIDIPALPGFGNS;IIDIPAL | |

Fig. 30 continued

| | | |
|---|---|---|
| | PGFGNST;IDIPALPGFGNSTE;DIPALPGFGNSTEL;IPALPGFGNSTELP;PALPGFGNSTELPS;ALPGFGNSTELPSS;LPGFGNSTELPSSG;PGFGNSTELPSSGF;GFGNSTELPSSGFF;FGNSTELPSSGFFN;GNSTELPSSGFFNT;NSTELPSSGFFNTG;STELPSSGFFNTGG;TELPSSGFFNTGGG;ELPSSGFFNTGGGG;LPSSGFFNTGGGGG;PSSGFFNTGGGGGS;SSGFFNTGGGGGSG;SGFFNTGGGGGSGI;GFFNTGGGGGSGIA;FFNTGGGGGSGIAN;FNTGGGGGSGIANF;NTGGGGGSGIANFG;TGGGGGSGIANFGA;GGGGGSGIANFGAG;GGGGSGIANFGAGV;GGGSGIANFGAGVS;GGSGIANFGAGVSG;GSGIANFGAGVSGL;SGIANFGAGVSGLL;GIANFGAGVSGLLN;IANFGAGVSGLLNQ;ANFGAGVSGLLNQA;NFGAGVSGLLNQAS;FGAGVSGLLNQASS;GAGVSGLLNQASSP;AGVSGLLNQASSPM;GVSGLLNQASSPMV;VSGLLNQASSPMVG;SGLLNQASSPMVGT;GLLNQASSPMVGTL;LLNQASSPMVGTLS;LNQASSPMVGTLSG;NQASSPMVGTLSGL;QASSPMVGTLSGLG;ASSPMVGTLSGLGN;SSPMVGTLSGLGNA;SPMVGTLSGLGNAG;PMVGTLSGLGNAGS;MVGTLSGLGNAGSL;VGTLSGLGNAGSLA;GTLSGLGNAGSLAS;TLSGLGNAGSLASG;LSGLGNAGSLASGV;SGLGNAGSLASGVL;GLGNAGSLASGVLN;LGNAGSLASGVLNS;GNAGSLASGVLNSG;NAGSLASGVLNSGV;AGSLASGVLNSGVD;GSLASGVLNSGVDI;SLASGVLNSGVDIS;LASGVLNSGVDISG;ASGVLNSGVDISGM;SGVLNSGVDISGMF;GVLNSGVDISGMFN;VLNSGVDISGMFNV;LNSGVDISGMFNVS;NSGVDISGMFNVST;SGVDISGMFNVSTL;GVDISGMFNVSTLG;VDISGMFNVSTLGS;DISGMFNVSTLGSA;ISGMFNVSTLGSAP;SGMFNVSTLGSAPA;GMFNVSTLGSAPAV;MFNVSTLGSAPAVI;FNVSTLGSAPAVIS;NVSTLGSAPAVISG;VSTLGSAPAVISGF;STLGSAPAVISGFG;TLGSAPAVISGFGN;LGSAPAVISGFGNL;GSAPAVISGFGNLG;SAPAVISGFGNLGN;APAVISGFGNLGNH;PAVISGFGNLGNHV;AVISGFGNLGNHVS;VISGFGNLGNHVSG;ISGFGNLGNHVSGV;SGFGNLGNHVSGVS;GFGNLGNHVSGVSI;FGNLGNHVSGVSID;GNLGNHVSGVSIDG;NLGNHVSGVSIDGL;LGNHVSGVSIDGLL;GNHVSGVSIDGLLA;NHVSGVSIDGLLAM;HVSGVSIDGLLAML;VSGVSIDGLLAMLT;SGVSIDGLLAMLTS;GVSIDGLLAMLTSG;VSIDGLLAMLTSGG;SIDGLLAMLTSGGS;IDGLLAMLTSGGSG;DGLLAMLTSGGSGG;GLLAMLTSGGSGGS;LLAMLTSGGSGGSG;LAMLTSGGSGGSGQ;AMLTSGGSGGSGQP;MLTSGGSGGSGQPS;LTSGGSGGSGQPSI;TSGGSGGSGQPSII;SGGSGGSGQPSIID;GGSGGSGQPSIIDA;GSGGSGQPSIIDAA;SGGSGQPSIIDAAI;GGSGQPSIIDAAIA;GSGQPSIIDAAIAE;SGQPSIIDAAIAEL;GQPSIIDAAIAELR;QPSIIDAAIAELRH;PSIIDAAIAELRHL;SIIDAAIAELRHLN;IIDAAIAELRHLNP;IDAAIAELRHLNPL;DAAIAELRHLNPLN;AAIAELRHLNPLNI;AIAELRHLNPLNIV;IAELRHLNPLNIVN;AELRHLNPLNIVNL;ELRHLNPLNIVNLG;LRHLNPLNIVNLGN;RHLNPLNIVNLGNV;HLNPLNIVNLGNVG;LNPLNIVNLGNVGS;NPLNIVNLGNVGSY;PLNIVNLGNVGSYN;LNIVNLGNVGSYNL;NIVNLGNVGSYNLG;IVNLGNVGSYNLGF;VNLGNVGSYNLGFA;NLGNVGSYNLGFAN;LGNVGSYNLGFANV;GNVGSYNLGFANVG;NVGSYNLGFANVGD;VGSYNLGFANVGDV;GSYNLGFANVGDVN;SYNLGFANVGDVNL;YNLGFANVGDVNLG;NLGFANVGDVNLGA;LGFANVGDVNLGAG;GFANVGDVNLGAGN;FANVGDVNLGAGNL;ANVGDVNLGAGNLG;NVGDVNLGAGNLGN;VGDVNLGAGNLGNL;GDVNLGAGNLGNLN;DVNLGAGNLGNLNL;VNLGAGNLGNLNLG;NLGAGNLGNLNLGG;LGAGNLGNLNLGGG;GAGNLGNLNLGGGN;AGNLGNLNLGGGNL;GNLGNLNLGGGNLG;NLGNLNLGGGNLGG;LGNLNLGGGNLGGQ;GNLNLGGGNLGGQN;NLNLGGGNLGGQNL;LNLGGGNLGGQNLG;NLGGGNLGGQNLGL;LGGGNLGGQNLGLG;GGGNLGGQNLGLGN;GGNLGGQNLGLGNL;GNLGGQNLGLGNLG;NLGGQNLGLGNLGD;LGGQNLGLGNLGDG;GGQNLGLGNLGDGN;GQNLGLGNLGDGNV;QNLGLGNLGDGNVG;NLGLGNLGDGNVGF;LGLGNLGDGNVGFG;GLGNLGDGNVGFGN;LGNLGDGNVGFGNL;GNLGDGNVGFGNL | |

Fig. 30 continued

| | | |
|---|---|---|
| | G;NLGDGNVGFGNLGH;LGDGNVGFGNLGHG;GDGNVGFGNLGHGN;DGNVGFGNLGHGNV;GNVGFGNLGHGNVG;NVGFGNLGHGNVGF;VGFGNLGHGNVGFG;GFGNLGHGNVGFGN;FGNLGHGNVGFGNS;GNLGHGNVGFGNSG;NLGHGNVGFGNSGL;LGHGNVGFGNSGLG;GHGNVGFGNSGLGA;HGNVGFGNSGLGAL;GNVGFGNSGLGALP;NVGFGNSGLGALPG;VGFGNSGLGALPGI;GFGNSGLGALPGIG;FGNSGLGALPGIGN;GNSGLGALPGIGNI;NSGLGALPGIGNIG;SGLGALPGIGNIGL;GLGALPGIGNIGLG;LGALPGIGNIGLGN;GALPGIGNIGLGNA;ALPGIGNIGLGNAG;LPGIGNIGLGNAGS;PGIGNIGLGNAGSN;GIGNIGLGNAGSNN;IGNIGLGNAGSNNV;GNIGLGNAGSNNVG;NIGLGNAGSNNVGF;IGLGNAGSNNVGFG;GLGNAGSNNVGFGN;LGNAGSNNVGFGNM;GNAGSNNVGFGNMG;NAGSNNVGFGNMGL;AGSNNVGFGNMGLG;GSNNVGFGNMGLGN;SNNVGFGNMGLGNI;NNVGFGNMGLGNIG;NVGFGNMGLGNIGF;VGFGNMGLGNIGFG;GFGNMGLGNIGFGN;FGNMGLGNIGFGNT;GNMGLGNIGFGNTG;NMGLGNIGFGNTGT;MGLGNIGFGNTGTN;GLGNIGFGNTGTNN;LGNIGFGNTGTNNL;GNIGFGNTGTNNLG;NIGFGNTGTNNLGI;IGFGNTGTNNLGIG;GFGNTGTNNLGIGL;FGNTGTNNLGIGLT;GNTGTNNLGIGLTG;NTGTNNLGIGLTGD;TGTNNLGIGLTGDN;GTNNLGIGLTGDNQ;TNNLGIGLTGDNQT;NNLGIGLTGDNQTG;NLGIGLTGDNQTGF;LGIGLTGDNQTGFG;GIGLTGDNQTGFGG;IGLTGDNQTGFGGL;GLTGDNQTGFGGLN;LTGDNQTGFGGLNS;TGDNQTGFGGLNSG;GDNQTGFGGLNSGA;DNQTGFGGLNSGAG;NQTGFGGLNSGAGN;QTGFGGLNSGAGNL;TGFGGLNSGAGNLG;GFGGLNSGAGNLGL;FGGLNSGAGNLGLF;GGLNSGAGNLGLFN;GLNSGAGNLGLFNS;LNSGAGNLGLFNSG;NSGAGNLGLFNSGT;SGAGNLGLFNSGTG;GAGNLGLFNSGTGN;AGNLGLFNSGTGNI;GNLGLFNSGTGNIG;NLGLFNSGTGNIGF;LGLFNSGTGNIGFF;GLFNSGTGNIGFFN;LFNSGTGNIGFFNT;FNSGTGNIGFFNTG;NSGTGNIGFFNTGT;SGTGNIGFFNTGTG;GTGNIGFFNTGTGN;TGNIGFFNTGTGNW;GNIGFFNTGTGNWG;NIGFFNTGTGNWGL;IGFFNTGTGNWGLF;GFFNTGTGNWGLFN;FFNTGTGNWGLFNS;FNTGTGNWGLFNSG;NTGTGNWGLFNSGS;TGTGNWGLFNSGSY;GTGNWGLFNSGSYN;TGNWGLFNSGSYNT;GNWGLFNSGSYNTG;NWGLFNSGSYNTGI;WGLFNSGSYNTGIG;GLFNSGSYNTGIGN;LFNSGSYNTGIGNS;FNSGSYNTGIGNSG;NSGSYNTGIGNSGT;SGSYNTGIGNSGTG;GSYNTGIGNSGTGS;SYNTGIGNSGTGST;YNTGIGNSGTGSTG;NTGIGNSGTGSTGL;TGIGNSGTGSTGLF;GIGNSGTGSTGLFN;IGNSGTGSTGLFNA;GNSGTGSTGLFNAG;NSGTGSTGLFNAGS;SGTGSTGLFNAGSF;GTGSTGLFNAGSFN;TGSTGLFNAGSFNT;GSTGLFNAGSFNTG;STGLFNAGSFNTGL;TGLFNAGSFNTGLA;GLFNAGSFNTGLAN;LFNAGSFNTGLANA;FNAGSFNTGLANAG;NAGSFNTGLANAGS;AGSFNTGLANAGSY;GSFNTGLANAGSYN;SFNTGLANAGSYNT;FNTGLANAGSYNTG;NTGLANAGSYNTGS;TGLANAGSYNTGSL;GLANAGSYNTGSLN;LANAGSYNTGSLNA;ANAGSYNTGSLNAG;NAGSYNTGSLNAGN;AGSYNTGSLNAGNT;GSYNTGSLNAGNTN;SYNTGSLNAGNTNT;YNTGSLNAGNTNTG;NTGSLNAGNTNTGG;TGSLNAGNTNTGGF;GSLNAGNTNTGGFN;SLNAGNTNTGGFNP;LNAGNTNTGGFNPG;NAGNTNTGGFNPGN;AGNTNTGGFNPGNV;GNTNTGGFNPGNVN;NTNTGGFNPGNVNT;TNTGGFNPGNVNTG;NTGGFNPGNVNTGW;TGGFNPGNVNTGWF;GGFNPGNVNTGWFN;GFNPGNVNTGWFNA;FNPGNVNTGWFNAG;NPGNVNTGWFNAGH;PGNVNTGWFNAGHT;GNVNTGWFNAGHTN;NVNTGWFNAGHTNT;VNTGWFNAGHTNTG;NTGWFNAGHTNTGG;TGWFNAGHTNTGGF;GWFNAGHTNTGGFN;WFNAGHTNTGGFNT;FNAGHTNTGGFNTG;NAGHTNTGGFNTGN;AGHTNTGGFNTGNV;GHTNTGGFNTGNVN;HTNTGGFNTGNVNT;TNTGGFNTGNVNTG;NTGGFNTGNVNTGA;TGGFNTGNVNTGAF;GGFNTGNVNTGAFN;GFNTGNVNTGAFNS;FNTGNVNTGAFNSG;NTGNVNTGAFNSGS;TGNVNTGAFNSGSF;GNVNTGAFNS | |

Fig. 30 continued

| | | |
|---|---|---|
| | GSFN;NVNTGAFNSGSFNN;VNTGAFNSGSFNNG;NTGAFNSGSFNNGA;TGAFNSGSFNNGAL;GAFNSGSFNNGALW;AFNSGSFNNGALWT;FNSGSFNNGALWTG;NSGSFNNGALWTGD;SGSFNNGALWTGDH;GSFNNGALWTGDHH;SFNNGALWTGDHHG;FNNGALWTGDHHGL;NNGALWTGDHHGLV;NGALWTGDHHGLVG;GALWTGDHHGLVGF;ALWTGDHHGLVGFS;LWTGDHHGLVGFSY;WTGDHHGLVGFSYS;TGDHHGLVGFSYSI;GDHHGLVGFSYSIE;DHHGLVGFSYSIEI;HHGLVGFSYSIEIT;HGLVGFSYSIEITG;GLVGFSYSIEITGS;LVGFSYSIEITGST;VGFSYSIEITGSTL;GFSYSIEITGSTLV;FSYSIEITGSTLVD;SYSIEITGSTLVDI;YSIEITGSTLVDIN;SIEITGSTLVDINE;IEITGSTLVDINET;EITGSTLVDINETL;ITGSTLVDINETLN;TGSTLVDINETLNL;GSTLVDINETLNLG;STLVDINETLNLGP;TLVDINETLNLGPV;LVDINETLNLGPVH;VDINETLNLGPVHI;DINETLNLGPVHID;INETLNLGPVHIDQ;NETLNLGPVHIDQI;ETLNLGPVHIDQID;TLNLGPVHIDQIDI;LNLGPVHIDQIDIP;NLGPVHIDQIDIPG;LGPVHIDQIDIPGM;GPVHIDQIDIPGMS;PVHIDQIDIPGMSL;VHIDQIDIPGMSLF;HIDQIDIPGMSLFD;IDQIDIPGMSLFDI;DQIDIPGMSLFDIH;QIDIPGMSLFDIHE;IDIPGMSLFDIHEL;DIPGMSLFDIHELV;IPGMSLFDIHELVN;PGMSLFDIHELVNI;GMSLFDIHELVNIG;MSLFDIHELVNIGP;SLFDIHELVNIGPF;LFDIHELVNIGPFR;FDIHELVNIGPFRI;DIHELVNIGPFRIE;IHELVNIGPFRIEP;HELVNIGPFRIEPI;ELVNIGPFRIEPID;LVNIGPFRIEPIDV;VNIGPFRIEPIDVP;NIGPFRIEPIDVPA;IGPFRIEPIDVPAV;GPFRIEPIDVPAVV;PFRIEPIDVPAVVL;FRIEPIDVPAVVLD;RIEPIDVPAVVLDI;IEPIDVPAVVLDIH;EPIDVPAVVLDIHE;PIDVPAVVLDIHET;IDVPAVVLDIHETM;DVPAVVLDIHETMV;VPAVVLDIHETMVI;PAVVLDIHETMVIP;AVVLDIHETMVIPP;VVLDIHETMVIPPI;VLDIHETMVIPPIV;LDIHETMVIPPIVF;DIHETMVIPPIVFL;IHETMVIPPIVFLP;HETMVIPPIVFLPS;ETMVIPPIVFLPSM;TMVIPPIVFLPSMT;MVIPPIVFLPSMTI;VIPPIVFLPSMTIG;IPPIVFLPSMTIGG;PPIVFLPSMTIGGQ;PIVFLPSMTIGGQT;IVFLPSMTIGGQTY;VFLPSMTIGGQTYT;FLPSMTIGGQTYTI;LPSMTIGGQTYTIP;PSMTIGGQTYTIPL;SMTIGGQTYTIPLD;MTIGGQTYTIPLDT;TIGGQTYTIPLDTP;IGGQTYTIPLDTPP;GGQTYTIPLDTPPA;GQTYTIPLDTPPAP;QTYTIPLDTPPAPA;TYTIPLDTPPAPAP;YTIPLDTPPAPAPP;TIPLDTPPAPAPPP;IPLDTPPAPAPPPF;PLDTPPAPAPPPFR;LDTPPAPAPPPFRL;DTPPAPAPPPFRLP;TPPAPAPPPFRLPL;PPAPAPPPFRLPLL;PAPAPPPFRLPLLF;APAPPPFRLPLLFV;PAPPPFRLPLLFVN;APPPFRLPLLFVNA;PPPFRLPLLFVNAL;PPFRLPLLFVNALG;PFRLPLLFVNALGD;FRLPLLFVNALGDN;RLPLLFVNALGDNW;LPLLFVNALGDNWI;PLLFVNALGDNWIV;LLFVNALGDNWIVG;LFVNALGDNWIVGA;FVNALGDNWIVGAS;VNALGDNWIVGASN;NALGDNWIVGASNS;ALGDNWIVGASNST;LGDNWIVGASNSTG;GDNWIVGASNSTGM;DNWIVGASNSTGMS;NWIVGASNSTGMSG;WIVGASNSTGMSGG;IVGASNSTGMSGGF;VGASNSTGMSGGFV;GASNSTGMSGGFVT;ASNSTGMSGGFVTA;SNSTGMSGGFVTAP;NSTGMSGGFVTAPT;STGMSGGFVTAPTQ;TGMSGGFVTAPTQG;GMSGGFVTAPTQGI;MSGGFVTAPTQGIL;SGGFVTAPTQGILI;GGFVTAPTQGILIH;GFVTAPTQGILIHT;FVTAPTQGILIHTG;VTAPTQGILIHTGP;TAPTQGILIHTGPS;APTQGILIHTGPSS;PTQGILIHTGPSSA;TQGILIHTGPSSAT;QGILIHTGPSSATT;GILIHTGPSSATTG;ILIHTGPSSATTGS;LIHTGPSSATTGSL;IHTGPSSATTGSLA;HTGPSSATTGSLAL;TGPSSATTGSLALT;GPSSATTGSLALTL;PSSATTGSLALTLP;SSATTGSLALTLPT;SATTGSLALTLPTV;ATTGSLALTLPTVT;TTGSLALTLPTVTI;TGSLALTLPTVTIP;GSLALTLPTVTIPT;SLALTLPTVTIPTI;LALTLPTVTIPTIT;ALTLPTVTIPTITT;LTLPTVTIPTITTS;TLPTVTIPTITTSP;LPTVTIPTITTSPI;PTVTIPTITTSPIP;TVTIPTITTSPIPL;VTIPTITTSPIPLK;TIPTITTSPIPLKI;IPTITTSPIPLKID;PTITTSPIPLKIDV;TITTSPIPLKIDVS;ITTSPIPLKIDVSG;TTSPIPLKIDVSGG;TSPIPLKIDVSGGL;SPIPLKIDVSGGLP;PIPLKIDVSGGLPA;IPLKIDVSGGLPAF;PLKIDVSGGLPAFT;LKIDVSGGLPAFTL;KIDVSGGLPAFTLF;ID | |

Fig. 30 continued

| | | |
|---|---|---|
| | VSGGLPAFTLFP;DVSGGLPAFTLFPG;VSGGLPAFTLFPGG;SGGLPAFTLFPGGL;GGLPAFTLFPGGLN;GLPAFTLFPGGLNI;LPAFTLFPGGLNIP;PAFTLFPGGLNIPQ;AFTLFPGGLNIPQN;FTLFPGGLNIPQNA;TLFPGGLNIPQNAI;LFPGGLNIPQNAIP;FPGGLNIPQNAIPL;PGGLNIPQNAIPLT;GGLNIPQNAIPLTI;GLNIPQNAIPLTID;LNIPQNAIPLTIDA;NIPQNAIPLTIDAS;IPQNAIPLTIDASG;PQNAIPLTIDASGV;QNAIPLTIDASGVL;NAIPLTIDASGVLD;AIPLTIDASGVLDP;IPLTIDASGVLDPI;PLTIDASGVLDPIT;LTIDASGVLDPITI;TIDASGVLDPITIF;IDASGVLDPITIFP;DASGVLDPITIFPG;ASGVLDPITIFPGG;SGVLDPITIFPGGF;GVLDPITIFPGGFT;VLDPITIFPGGFTI;LDPITIFPGGFTID;DPITIFPGGFTIDP;PITIFPGGFTIDPL;ITIFPGGFTIDPLP;TIFPGGFTIDPLPL;IFPGGFTIDPLPLS;FPGGFTIDPLPLSL;PGGFTIDPLPLSLA;GGFTIDPLPLSLAL;GFTIDPLPLSLALN;FTIDPLPLSLALNI;TIDPLPLSLALNIS;IDPLPLSLALNISV;DPLPLSLALNISVP;PLPLSLALNISVPD;LPLSLALNISVPDS;PLSLALNISVPDSS;LSLALNISVPDSSV;SLALNISVPDSSVP;LALNISVPDSSVPI;ALNISVPDSSVPII;LNISVPDSSVPIII;NISVPDSSVPIIIV;ISVPDSSVPIIIVP;SVPDSSVPIIIVPP;VPDSSVPIIIVPPT;PDSSVPIIIVPPTP;DSSVPIIIVPPTPG;SSVPIIIVPPTPGF;SVPIIIVPPTPGFG;VPIIIVPPTPGFGN;PIIIVPPTPGFGNA;IIIVPPTPGFGNAT;IIVPPTPGFGNATA;IVPPTPGFGNATAT;VPPTPGFGNATATP;PPTPGFGNATATPS;PTPGFGNATATPSS;TPGFGNATATPSSG;PGFGNATATPSSGF;GFGNATATPSSGFF;FGNATATPSSGFFN;GNATATPSSGFFNS;NATATPSSGFFNSG;ATATPSSGFFNSGA;TATPSSGFFNSGAG;ATPSSGFFNSGAGG;TPSSGFFNSGAGGV;PSSGFFNSGAGGVS;SSGFFNSGAGGVSG;SGFFNSGAGGVSGF;GFFNSGAGGVSGFG;FFNSGAGGVSGFGN;FNSGAGGVSGFGNF;NSGAGGVSGFGNFG;SGAGGVSGFGNFGA;GAGGVSGFGNFGAG;AGGVSGFGNFGAGS;GGVSGFGNFGAGSS;GVSGFGNFGAGSSG;VSGFGNFGAGSSGW;SGFGNFGAGSSGWW;GFGNFGAGSSGWWN;FGNFGAGSSGWWNQ;GNFGAGSSGWWNQA;NFGAGSSGWWNQAH;FGAGSSGWWNQAHA;GAGSSGWWNQAHAA;AGSSGWWNQAHAAL;GSSGWWNQAHAALA;SSGWWNQAHAALAG;SGWWNQAHAALAGA;GWWNQAHAALAGAG;WWNQAHAALAGAGS;WNQAHAALAGAGSG;NQAHAALAGAGSGV;QAHAALAGAGSGVL;AHAALAGAGSGVLN;HAALAGAGSGVLNV;AALAGAGSGVLNVG;ALAGAGSGVLNVGT;LAGAGSGVLNVGTL;AGAGSGVLNVGTLN;GAGSGVLNVGTLNS;AGSGVLNVGTLNSG;GSGVLNVGTLNSGV;SGVLNVGTLNSGVL;GVLNVGTLNSGVLN;VLNVGTLNSGVLNV;LNVGTLNSGVLNVG;NVGTLNSGVLNVGS;VGTLNSGVLNVGSG;GTLNSGVLNVGSGI;TLNSGVLNVGSGIS;LNSGVLNVGSGISG;NSGVLNVGSGISGL;SGVLNVGSGISGLY;GVLNVGSGISGLYN;VLNVGSGISGLYNT;LNVGSGISGLYNTA;NVGSGISGLYNTAI;VGSGISGLYNTAIV;GSGISGLYNTAIVG;SGISGLYNTAIVGL;GISGLYNTAIVGLG;ISGLYNTAIVGLGT;SGLYNTAIVGLGTP;GLYNTAIVGLGTPA;LYNTAIVGLGTPAL;YNTAIVGLGTPALV;NTAIVGLGTPALVS;TAIVGLGTPALVSG;AIVGLGTPALVSGA;IVGLGTPALVSGAG;VGLGTPALVSGAGN;GLGTPALVSGAGNV;LGTPALVSGAGNVG;GTPALVSGAGNVGQ;TPALVSGAGNVGQQ;PALVSGAGNVGQQL;ALVSGAGNVGQQLS;LVSGAGNVGQQLSG;VSGAGNVGQQLSGV;SGAGNVGQQLSGVL;GAGNVGQQLSGVLA;AGNVGQQLSGVLAA;GNVGQQLSGVLAAG;NVGQQLSGVLAAGT;VGQQLSGVLAAGTA;GQQLSGVLAAGTAL;QQLSGVLAAGTALT;QLSGVLAAGTALTQ;LSGVLAAGTALTQS;SGVLAAGTALTQSP;GVLAAGTALTQSPI;VLAAGTALTQSPII;LAAGTALTQSPIIN;AAGTALTQSPIINL;AGTALTQSPIINLG;GTALTQSPIINLGL;TALTQSPIINLGLA;ALTQSPIINLGLAD;LTQSPIINLGLADV;TQSPIINLGLADVG;QSPIINLGLADVGN;SPIINLGLADVGNY;PIINLGLADVGNYN;IINLGLADVGNYNL;INLGLADVGNYNLG;NLGLADVGNYNLGL;LGLADVGNYNLGLG;GLADVGNYNLGLGN;LADVGNYNLGLGNV;ADVGNYNLGLGNVG;DVGNYNLGLGNVGD;VGNYNLGLGNVGDF;GNYNLGLGNVGDF | |

Fig. 30 continued

| | | |
|---|---|---|
| | N;NYNLGLGNVGDFNL;YNLGLGNVGDFNLG;NLGLGNVGDFNLGA;LGLGNVGDFNLGAA;GLGNVGDFNLGAAN;LGNVGDFNLGAANL;GNVGDFNLGAANLG;NVGDFNLGAANLGD;VGDFNLGAANLGDL;GDFNLGAANLGDLN;DFNLGAANLGDLNL;FNLGAANLGDLNLG;NLGAANLGDLNLGL;LGAANLGDLNLGLG;GAANLGDLNLGLGN;AANLGDLNLGLGNI;ANLGDLNLGLGNIG;NLGDLNLGLGNIGN;LGDLNLGLGNIGNA;GDLNLGLGNIGNAN;DLNLGLGNIGNANV;LNLGLGNIGNANVG;NLGLGNIGNANVGF;LGLGNIGNANVGFG;GLGNIGNANVGFGN;LGNIGNANVGFGNI;GNIGNANVGFGNIG;NIGNANVGFGNIGH;IGNANVGFGNIGHG;GNANVGFGNIGHGN;NANVGFGNIGHGNV;ANVGFGNIGHGNVG;NVGFGNIGHGNVGF;VGFGNIGHGNVGFG;GFGNIGHGNVGFGN;FGNIGHGNVGFGNS;GNIGHGNVGFGNSG;NIGHGNVGFGNSGL;IGHGNVGFGNSGLG;GHGNVGFGNSGLGA;HGNVGFGNSGLGAA;GNVGFGNSGLGAAL;NVGFGNSGLGAALG;VGFGNSGLGAALGI;GFGNSGLGAALGIG;FGNSGLGAALGIGN;GNSGLGAALGIGNI;NSGLGAALGIGNIG;SGLGAALGIGNIGL;GLGAALGIGNIGLG;LGAALGIGNIGLGN;GAALGIGNIGLGNA;AALGIGNIGLGNAG;ALGIGNIGLGNAGS;LGIGNIGLGNAGST;GIGNIGLGNAGSTN;IGNIGLGNAGSTNV;GNIGLGNAGSTNVG;NIGLGNAGSTNVGL;IGLGNAGSTNVGLA;GLGNAGSTNVGLAN;LGNAGSTNVGLANM;GNAGSTNVGLANMG;NAGSTNVGLANMGV;AGSTNVGLANMGVG;GSTNVGLANMGVGN;STNVGLANMGVGNI;TNVGLANMGVGNIG;NVGLANMGVGNIGF;VGLANMGVGNIGFA;GLANMGVGNIGFAN;LANMGVGNIGFANT;ANMGVGNIGFANTG;NMGVGNIGFANTGT;MGVGNIGFANTGTN;GVGNIGFANTGTNN;VGNIGFANTGTNNL;GNIGFANTGTNNLG;NIGFANTGTNNLGI;IGFANTGTNNLGIG;GFANTGTNNLGIGL;FANTGTNNLGIGLT;ANTGTNNLGIGLTG;NTGTNNLGIGLTGD;TGTNNLGIGLTGDN;GTNNLGIGLTGDNQ;TNNLGIGLTGDNQT;NNLGIGLTGDNQTG;NLGIGLTGDNQTGI;LGIGLTGDNQTGIG;GIGLTGDNQTGIGG;IGLTGDNQTGIGGL;GLTGDNQTGIGGLN;LTGDNQTGIGGLNS;TGDNQTGIGGLNSG;GDNQTGIGGLNSGA;DNQTGIGGLNSGAG;NQTGIGGLNSGAGN;QTGIGGLNSGAGNI;TGIGGLNSGAGNIG;GIGGLNSGAGNIGL;IGGLNSGAGNIGLF;GGLNSGAGNIGLFN;GLNSGAGNIGLFNS;LNSGAGNIGLFNSG;NSGAGNIGLFNSGT;SGAGNIGLFNSGTG;GAGNIGLFNSGTGN;AGNIGLFNSGTGNI;GNIGLFNSGTGNIG;NIGLFNSGTGNIGF;IGLFNSGTGNIGFF;GLFNSGTGNIGFFN;LFNSGTGNIGFFNS;FNSGTGNIGFFNSG;NSGTGNIGFFNSGT;SGTGNIGFFNSGTG;GTGNIGFFNSGTGN;TGNIGFFNSGTGNW;GNIGFFNSGTGNWG;NIGFFNSGTGNWGL;IGFFNSGTGNWGLF;GFFNSGTGNWGLFN;FFNSGTGNWGLFNS;FNSGTGNWGLFNSG;NSGTGNWGLFNSGS;SGTGNWGLFNSGSF;GTGNWGLFNSGSFN;TGNWGLFNSGSFNT;GNWGLFNSGSFNTG;NWGLFNSGSFNTGI;WGLFNSGSFNTGIG;GLFNSGSFNTGIGN;LFNSGSFNTGIGNS;FNSGSFNTGIGNSG;NSGSFNTGIGNSGT;SGSFNTGIGNSGTG;GSFNTGIGNSGTGS;SFNTGIGNSGTGST;FNTGIGNSGTGSTG;NTGIGNSGTGSTGL;TGIGNSGTGSTGLF;GIGNSGTGSTGLFN;IGNSGTGSTGLFNA;GNSGTGSTGLFNAG;NSGTGSTGLFNAGG;SGTGSTGLFNAGGF;GTGSTGLFNAGGFT;TGSTGLFNAGGFTT;GSTGLFNAGGFTTG;STGLFNAGGFTTGL;TGLFNAGGFTTGLA;GLFNAGGFTTGLAN;LFNAGGFTTGLANA;FNAGGFTTGLANAG;NAGGFTTGLANAGS;AGGFTTGLANAGSY;GGFTTGLANAGSYN;GFTTGLANAGSYNT;FTTGLANAGSYNTG;TTGLANAGSYNTGS;TGLANAGSYNTGSF;GLANAGSYNTGSFN;LANAGSYNTGSFNV;ANAGSYNTGSFNVG;NAGSYNTGSFNVGD;AGSYNTGSFNVGDT;GSYNTGSFNVGDTN;SYNTGSFNVGDTNT;YNTGSFNVGDTNTG;NTGSFNVGDTNTGG;TGSFNVGDTNTGGF;GSFNVGDTNTGGFN;SFNVGDTNTGGFNP;FNVGDTNTGGFNPG;NVGDTNTGGFNPGS;VGDTNTGGFNPGSI;GDTNTGGFNPGSIN;DTNTGGFNPGSINT;TNTGGFNPGSINTG;NTGGFNPGSINTGW;TGGFNPGSINTGWF;GGFNPGSINTGWFN;GFNPGSINTGW | |

Fig. 30 continued

| | | |
|---|---|---|
| | FNT;FNPGSINTGWFNTG;NPGSINTGWFNTGN;PGSINTGWFNTGNA;GSINTGWFNTGNAN;SINTGWFNTGNANT;INTGWFNTGNANTG;NTGWFNTGNANTGI;TGWFNTGNANTGIA;GWFNTGNANTGIAN;WFNTGNANTGIANS;FNTGNANTGIANSG;NTGNANTGIANSGN;TGNANTGIANSGNV;GNANTGIANSGNVD;NANTGIANSGNVDT;ANTGIANSGNVDTG;NTGIANSGNVDTGA;TGIANSGNVDTGAL;GIANSGNVDTGALM;IANSGNVDTGALMS;ANSGNVDTGALMSG;NSGNVDTGALMSGN;SGNVDTGALMSGNF;GNVDTGALMSGNFS;NVDTGALMSGNFSN;VDTGALMSGNFSNG;DTGALMSGNFSNGI;TGALMSGNFSNGIL;GALMSGNFSNGILW;ALMSGNFSNGILWR;LMSGNFSNGILWRG;MSGNFSNGILWRGN;SGNFSNGILWRGNY;GNFSNGILWRGNYE;NFSNGILWRGNYEG;FSNGILWRGNYEGL;SNGILWRGNYEGLF;NGILWRGNYEGLFS;GILWRGNYEGLFSY;ILWRGNYEGLFSYS;LWRGNYEGLFSYSY;WRGNYEGLFSYSYS;RGNYEGLFSYSYSL;GNYEGLFSYSYSLD;NYEGLFSYSYSLDV;YEGLFSYSYSLDVP;EGLFSYSYSLDVPR;GLFSYSYSLDVPRI;LFSYSYSLDVPRIT;FSYSYSLDVPRITI;SYSYSLDVPRITIL;YSYSLDVPRITILD;SYSLDVPRITILDA;YSLDVPRITILDAH;SLDVPRITILDAHF;LDVPRITILDAHFT;DVPRITILDAHFTG;VPRITILDAHFTGA;PRITILDAHFTGAF;RITILDAHFTGAFG;ITILDAHFTGAFGP;TILDAHFTGAFGPV;ILDAHFTGAFGPVV;LDAHFTGAFGPVVV;DAHFTGAFGPVVVP;AHFTGAFGPVVVPP;HFTGAFGPVVVPPI;FTGAFGPVVVPPIP;TGAFGPVVVPPIPV;GAFGPVVVPPIPVL;AFGPVVVPPIPVLA;FGPVVVPPIPVLAI;GPVVVPPIPVLAIN;PVVVPPIPVLAINA;VVVPPIPVLAINAH;VVPPIPVLAINAHL;VPPIPVLAINAHLT;PPIPVLAINAHLTG;PIPVLAINAHLTGN;IPVLAINAHLTGNA;PVLAINAHLTGNAA;VLAINAHLTGNAAM;LAINAHLTGNAAMG;AINAHLTGNAAMGA;INAHLTGNAAMGAF;NAHLTGNAAMGAFT;AHLTGNAAMGAFTI;HLTGNAAMGAFTIP;LTGNAAMGAFTIPQ;TGNAAMGAFTIPQI;GNAAMGAFTIPQID;NAAMGAFTIPQIDI;AAMGAFTIPQIDIP;AMGAFTIPQIDIPA;MGAFTIPQIDIPAL;GAFTIPQIDIPALN;AFTIPQIDIPALNP;FTIPQIDIPALNPN;TIPQIDIPALNPNV;IPQIDIPALNPNVT;PQIDIPALNPNVTG;QIDIPALNPNVTGS;IDIPALNPNVTGSV;DIPALNPNVTGSVG;IPALNPNVTGSVGF;PALNPNVTGSVGFG;ALNPNVTGSVGFGP;LNPNVTGSVGFGPI;NPNVTGSVGFGPIA;PNVTGSVGFGPIAV;NVTGSVGFGPIAVP;VTGSVGFGPIAVPS;TGSVGFGPIAVPSV;GSVGFGPIAVPSVT;SVGFGPIAVPSVTI;VGFGPIAVPSVTIP;GFGPIAVPSVTIPA;FGPIAVPSVTIPAL;GPIAVPSVTIPALT;PIAVPSVTIPALTA;IAVPSVTIPALTAA;AVPSVTIPALTAAR;VPSVTIPALTAARA;PSVTIPALTAARAV;SVTIPALTAARAVL;VTIPALTAARAVLD;TIPALTAARAVLDM;IPALTAARAVLDMA;PALTAARAVLDMAA;ALTAARAVLDMAAS;LTAARAVLDMAASV;TAARAVLDMAASVG;AARAVLDMAASVGA;ARAVLDMAASVGAT;RAVLDMAASVGATS;AVLDMAASVGATSE;VLDMAASVGATSEI;LDMAASVGATSEIE;DMAASVGATSEIEP;MAASVGATSEIEPF;AASVGATSEIEPFI;ASVGATSEIEPFIV;SVGATSEIEPFIVW;VGATSEIEPFIVWT;GATSEIEPFIVWTS;ATSEIEPFIVWTSS;TSEIEPFIVWTSSG;SEIEPFIVWTSSGA;EIEPFIVWTSSGAI;IEPFIVWTSSGAIG;EPFIVWTSSGAIGP;PFIVWTSSGAIGPT;FIVWTSSGAIGPTW;IVWTSSGAIGPTWY;VWTSSGAIGPTWYS;WTSSGAIGPTWYSV;TSSGAIGPTWYSVG;SSGAIGPTWYSVGR;SGAIGPTWYSVGRI;GAIGPTWYSVGRIY;AIGPTWYSVGRIYN;IGPTWYSVGRIYNA;GPTWYSVGRIYNAG;PTWYSVGRIYNAGD;TWYSVGRIYNAGDL;WYSVGRIYNAGDLF;YSVGRIYNAGDLFV;SVGRIYNAGDLFVG;VGRIYNAGDLFVGG;GRIYNAGDLFVGGN;RIYNAGDLFVGGNI;IYNAGDLFVGGNII;YNAGDLFVGGNIIS;NAGDLFVGGNIISG;AGDLFVGGNIISGI;GDLFVGGNIISGIP;DLFVGGNIISGIPT;LFVGGNIISGIPTL;FVGGNIISGIPTLS;VGGNIISGIPTLST;GGNIISGIPTLSTT;GNIISGIPTLSTTG;NIISGIPTLSTTGP;IISGIPTLSTTGPV;ISGIPTLSTTGPVH;SGIPTLSTTGPVHA;GIPTLSTTGPVHAV;IPTLSTTGPVHAVF;PTLSTTGPVHAVFN;TLSTTGPVHAVFNA;LSTTGPVHAVFNAA;STTGPVHA | |

Fig. 30 continued

| | | |
|---|---|---|
| | VFNAAS;TTGPVHAVFNAASQ;TGPVHAVFNAASQA;GPVHAVFNAASQAF;PVHAVFNAASQAFN;VHAVFNAASQAFNT;HAVFNAASQAFNTP;AVFNAASQAFNTPA;VFNAASQAFNTPAL;FNAASQAFNTPALN;NAASQAFNTPALNI;AASQAFNTPALNIH;ASQAFNTPALNIHQ;SQAFNTPALNIHQI;QAFNTPALNIHQIP;AFNTPALNIHQIPL;FNTPALNIHQIPLG;NTPALNIHQIPLGF;TPALNIHQIPLGFQ;PALNIHQIPLGFQV;ALNIHQIPLGFQVP;LNIHQIPLGFQVPG;NIHQIPLGFQVPGS;IHQIPLGFQVPGSI;HQIPLGFQVPGSID;QIPLGFQVPGSIDA;IPLGFQVPGSIDAI;PLGFQVPGSIDAIT;LGFQVPGSIDAITL;GFQVPGSIDAITLF;FQVPGSIDAITLFP;QVPGSIDAITLFPG;VPGSIDAITLFPGG;PGSIDAITLFPGGL;GSIDAITLFPGGLT;SIDAITLFPGGLTF;IDAITLFPGGLTFP;DAITLFPGGLTFPA;AITLFPGGLTFPAN;ITLFPGGLTFPANS;TLFPGGLTFPANSL;LFPGGLTFPANSLL;FPGGLTFPANSLLN;PGGLTFPANSLLNL;GGLTFPANSLLNLD;GLTFPANSLLNLDV;LTFPANSLLNLDVF;TFPANSLLNLDVFV;FPANSLLNLDVFVG;PANSLLNLDVFVGT;ANSLLNLDVFVGTP;NSLLNLDVFVGTPG;SLLNLDVFVGTPGA;LLNLDVFVGTPGAT;LNLDVFVGTPGATI;NLDVFVGTPGATIP;LDVFVGTPGATIPA;DVFVGTPGATIPAI;VFVGTPGATIPAIT;FVGTPGATIPAITF;VGTPGATIPAITFP;GTPGATIPAITFPE;TPGATIPAITFPEI;PGATIPAITFPEIP;GATIPAITFPEIPA;ATIPAITFPEIPAN;TIPAITFPEIPANA;IPAITFPEIPANAD;PAITFPEIPANADG;AITFPEIPANADGE;ITFPEIPANADGEL;TFPEIPANADGELY;FPEIPANADGELYV;PEIPANADGELYVI;EIPANADGELYVIA;IPANADGELYVIAG;PANADGELYVIAGD;ANADGELYVIAGDI;NADGELYVIAGDIP;ADGELYVIAGDIPL;DGELYVIAGDIPLI;GELYVIAGDIPLIN;ELYVIAGDIPLINI;LYVIAGDIPLINIP;YVIAGDIPLINIPP;VIAGDIPLINIPPT;IAGDIPLINIPPTP;AGDIPLINIPPTPG;GDIPLINIPPTPGI;DIPLINIPPTPGIG;IPLINIPPTPGIGN;PLINIPPTPGIGNT;LINIPPTPGIGNTT;INIPPTPGIGNTTT;NIPPTPGIGNTTTV;IPPTPGIGNTTTVP;PPTPGIGNTTTVPS;PTPGIGNTTTVPSS;TPGIGNTTTVPSSG;PGIGNTTTVPSSGF;GIGNTTTVPSSGFF;IGNTTTVPSSGFFN;GNTTTVPSSGFFNT;NTTTVPSSGFFNTG;TTTVPSSGFFNTGA;TTVPSSGFFNTGAG;TVPSSGFFNTGAGG;VPSSGFFNTGAGGG;PSSGFFNTGAGGGS;SSGFFNTGAGGGSG;SGFFNTGAGGGSGF;GFFNTGAGGGSGFG;FFNTGAGGGSGFGN;FNTGAGGGSGFGNF;NTGAGGGSGFGNFG;TGAGGGSGFGNFGA;GAGGGSGFGNFGAN;AGGGSGFGNFGANM;GGGSGFGNFGANMS;GGSGFGNFGANMSG;GSGFGNFGANMSGW;SGFGNFGANMSGWW;GFGNFGANMSGWWN;FGNFGANMSGWWNQ;GNFGANMSGWWNQA;NFGANMSGWWNQAH;FGANMSGWWNQAHT;GANMSGWWNQAHTA;ANMSGWWNQAHTAL;NMSGWWNQAHTALA;MSGWWNQAHTALAG;SGWWNQAHTALAGA;GWWNQAHTALAGAG;WWNQAHTALAGAGS;WNQAHTALAGAGSG;NQAHTALAGAGSGI;QAHTALAGAGSGIA;AHTALAGAGSGIAN;HTALAGAGSGIANV;TALAGAGSGIANVG;ALAGAGSGIANVGT;LAGAGSGIANVGTL;AGAGSGIANVGTLH;GAGSGIANVGTLHS;AGSGIANVGTLHSG;GSGIANVGTLHSGV;SGIANVGTLHSGVL;GIANVGTLHSGVLN;IANVGTLHSGVLNL;ANVGTLHSGVLNLG;NVGTLHSGVLNLGS;VGTLHSGVLNLGSG;GTLHSGVLNLGSGL;TLHSGVLNLGSGLS;LHSGVLNLGSGLSG;HSGVLNLGSGLSGI;SGVLNLGSGLSGIY;GVLNLGSGLSGIYN;VLNLGSGLSGIYNT;LNLGSGLSGIYNTS;NLGSGLSGIYNTST;LGSGLSGIYNTSTL;GSGLSGIYNTSTLP;SGLSGIYNTSTLPL;GLSGIYNTSTLPLG;LSGIYNTSTLPLGT;SGIYNTSTLPLGTP;GIYNTSTLPLGTPA;IYNTSTLPLGTPAL;YNTSTLPLGTPALV;NTSTLPLGTPALVS;TSTLPLGTPALVSG;STLPLGTPALVSGL;TLPLGTPALVSGLG;LPLGTPALVSGLGN;PLGTPALVSGLGNV;LGTPALVSGLGNVG;GTPALVSGLGNVGD;TPALVSGLGNVGDH;PALVSGLGNVGDHL;ALVSGLGNVGDHLS;LVSGLGNVGDHLSG;VSGLGNVGDHLSGL;SGLGNVGDHLSGLL;GLGNVGDHLSGLLA;LGNVGDHLSGLLAS;GNVGDHLSGLLASN;NVGDHLSGLLASNV;VGDHLSGLLASNVG;GDHLSGLLASNVGQ;DHLSGLLASN | |

Fig. 30 continued

| | | |
|---|---|---|
| | VGQN;HLSGLLASNVGQNP;LSGLLASNVGQNPI;SGLLASNVGQNPIT;GLLASNVGQNPITI;LLASNVGQNPITIV;LASNVGQNPITIVN;ASNVGQNPITIVNI;SNVGQNPITIVNIG;NVGQNPITIVNIGL;VGQNPITIVNIGLA;GQNPITIVNIGLAN;QNPITIVNIGLANV;NPITIVNIGLANVG;PITIVNIGLANVGN;ITIVNIGLANVGNG;TIVNIGLANVGNGN;IVNIGLANVGNGNV;VNIGLANVGNGNVG;NIGLANVGNGNVGL;IGLANVGNGNVGLG;GLANVGNGNVGLGN;LANVGNGNVGLGNI;ANVGNGNVGLGNIG;NVGNGNVGLGNIGN;VGNGNVGLGNIGNL;GNGNVGLGNIGNLN;NGNVGLGNIGNLNL;GNVGLGNIGNLNLG;NVGLGNIGNLNLGA;VGLGNIGNLNLGAA;GLGNIGNLNLGAAN;LGNIGNLNLGAANI;GNIGNLNLGAANIG;NIGNLNLGAANIGD;IGNLNLGAANIGDV;GNLNLGAANIGDVN;NLNLGAANIGDVNL;LNLGAANIGDVNLG;NLGAANIGDVNLGF;LGAANIGDVNLGFG;GAANIGDVNLGFGN;AANIGDVNLGFGNI;ANIGDVNLGFGNIG;NIGDVNLGFGNIGD;IGDVNLGFGNIGDV;GDVNLGFGNIGDVN;DVNLGFGNIGDVNL;VNLGFGNIGDVNLG;NLGFGNIGDVNLGF;LGFGNIGDVNLGFG;GFGNIGDVNLGFGN;FGNIGDVNLGFGNI;GNIGDVNLGFGNIG;NIGDVNLGFGNIGG;IGDVNLGFGNIGGG;GDVNLGFGNIGGGN;DVNLGFGNIGGGNV;VNLGFGNIGGGNVG;NLGFGNIGGGNVGF;LGFGNIGGGNVGFG;GFGNIGGGNVGFGN;FGNIGGGNVGFGNI;GNIGGGNVGFGNIG;NIGGGNVGFGNIGD;IGGGNVGFGNIGDA;GGGNVGFGNIGDAN;GGNVGFGNIGDANF;GNVGFGNIGDANFG;NVGFGNIGDANFGF;VGFGNIGDANFGFG;GFGNIGDANFGFGN;FGNIGDANFGFGNS;GNIGDANFGFGNSG;NIGDANFGFGNSGL;IGDANFGFGNSGLA;GDANFGFGNSGLAA;DANFGFGNSGLAAG;ANFGFGNSGLAAGL;NFGFGNSGLAAGLA;FGFGNSGLAAGLAG;GFGNSGLAAGLAGM;FGNSGLAAGLAGMG;GNSGLAAGLAGMGN;NSGLAAGLAGMGNI;SGLAAGLAGMGNIG;GLAAGLAGMGNIGL;LAAGLAGMGNIGLG;AAGLAGMGNIGLGN;AGLAGMGNIGLGNA;GLAGMGNIGLGNAG;LAGMGNIGLGNAGS;AGMGNIGLGNAGSG;GMGNIGLGNAGSGN;MGNIGLGNAGSGNV;GNIGLGNAGSGNVG;NIGLGNAGSGNVGW;IGLGNAGSGNVGWA;GLGNAGSGNVGWAN;LGNAGSGNVGWANM;GNAGSGNVGWANMG;NAGSGNVGWANMGL;AGSGNVGWANMGLG;GSGNVGWANMGLGN;SGNVGWANMGLGNI;GNVGWANMGLGNIG;NVGWANMGLGNIGF;VGWANMGLGNIGFG;GWANMGLGNIGFGN;WANMGLGNIGFGNT;ANMGLGNIGFGNTG;NMGLGNIGFGNTGT;MGLGNIGFGNTGTN;GLGNIGFGNTGTNN;LGNIGFGNTGTNNL;GNIGFGNTGTNNLG;NIGFGNTGTNNLGI;IGFGNTGTNNLGIG;GFGNTGTNNLGIGL;FGNTGTNNLGIGLT;GNTGTNNLGIGLTG;NTGTNNLGIGLTGD;TGTNNLGIGLTGDN;GTNNLGIGLTGDNQ;TNNLGIGLTGDNQS;NNLGIGLTGDNQSG;NLGIGLTGDNQSGI;LGIGLTGDNQSGIG;GIGLTGDNQSGIGG;IGLTGDNQSGIGGL;GLTGDNQSGIGGLN;LTGDNQSGIGGLNS;TGDNQSGIGGLNSG;GDNQSGIGGLNSGT;DNQSGIGGLNSGTG;NQSGIGGLNSGTGN;QSGIGGLNSGTGNI;SGIGGLNSGTGNIG;GIGGLNSGTGNIGL;IGGLNSGTGNIGLF;GGLNSGTGNIGLFN;GLNSGTGNIGLFNS;LNSGTGNIGLFNSG;NSGTGNIGLFNSGT;SGTGNIGLFNSGTG;GTGNIGLFNSGTGN;TGNIGLFNSGTGNI;GNIGLFNSGTGNIG;NIGLFNSGTGNIGF;IGLFNSGTGNIGFF;GLFNSGTGNIGFFN;LFNSGTGNIGFFNS;FNSGTGNIGFFNSG;NSGTGNIGFFNSGT;SGTGNIGFFNSGTA;GTGNIGFFNSGTAN;TGNIGFFNSGTANF;GNIGFFNSGTANFG;NIGFFNSGTANFGL;IGFFNSGTANFGLF;GFFNSGTANFGLFN;FFNSGTANFGLFNS;FNSGTANFGLFNSG;NSGTANFGLFNSGS;SGTANFGLFNSGSY;GTANFGLFNSGSYN;TANFGLFNSGSYNT;ANFGLFNSGSYNTG;NFGLFNSGSYNTGI;FGLFNSGSYNTGIG;GLFNSGSYNTGIGN;LFNSGSYNTGIGNS;FNSGSYNTGIGNSG;NSGSYNTGIGNSGV;SGSYNTGIGNSGVA;GSYNTGIGNSGVAS;SYNTGIGNSGVAST;YNTGIGNSGVASTG;NTGIGNSGVASTGL;TGIGNSGVASTGLV;GIGNSGVASTGLVN;IGNSGVASTGLVNA;GNSGVASTGLVNAG;NSGVASTGLVNAGG;SGVASTGLVNAGGF;GVASTGLVN | |

Fig. 30 continued

| | | |
|---|---|---|
| | AGGFN;VASTGLVNAGGFNT;ASTGLVNAGGFNTG;STGLVNAGGFNTGV;TGLVNAGGFNTGVA;GLVNAGGFNTGVAN;LVNAGGFNTGVANA;VNAGGFNTGVANAG;NAGGFNTGVANAGS;AGGFNTGVANAGSY;GGFNTGVANAGSYN;GFNTGVANAGSYNT;FNTGVANAGSYNTG;NTGVANAGSYNTGS;TGVANAGSYNTGSF;GVANAGSYNTGSFN;VANAGSYNTGSFNA;ANAGSYNTGSFNAG;NAGSYNTGSFNAGD;AGSYNTGSFNAGDT;GSYNTGSFNAGDTN;SYNTGSFNAGDTNT;YNTGSFNAGDTNTG;NTGSFNAGDTNTGG;TGSFNAGDTNTGGF;GSFNAGDTNTGGFN;SFNAGDTNTGGFNP;FNAGDTNTGGFNPG;NAGDTNTGGFNPGS;AGDTNTGGFNPGST;GDTNTGGFNPGSTN;DTNTGGFNPGSTNT;TNTGGFNPGSTNTG;NTGGFNPGSTNTGW;TGGFNPGSTNTGWF;GGFNPGSTNTGWFN;GFNPGSTNTGWFNT;FNPGSTNTGWFNTG;NPGSTNTGWFNTGN;PGSTNTGWFNTGNA;GSTNTGWFNTGNAN;STNTGWFNTGNANT;TNTGWFNTGNANTG;NTGWFNTGNANTGV;TGWFNTGNANTGVA;GWFNTGNANTGVAN;WFNTGNANTGVANA;FNTGNANTGVANAG;NTGNANTGVANAGN;TGNANTGVANAGNV;GNANTGVANAGNVN;NANTGVANAGNVNT;ANTGVANAGNVNTG;NTGVANAGNVNTGA;TGVANAGNVNTGAL;GVANAGNVNTGALI;VANAGNVNTGALIT;ANAGNVNTGALITG;NAGNVNTGALITGN;AGNVNTGALITGNF;GNVNTGALITGNFS;NVNTGALITGNFSN;VNTGALITGNFSNG;NTGALITGNFSNGI;TGALITGNFSNGIL;GALITGNFSNGILW;ALITGNFSNGILWR;LITGNFSNGILWRG;ITGNFSNGILWRGN;TGNFSNGILWRGNY;GNFSNGILWRGNYE;NFSNGILWRGNYEG;FSNGILWRGNYEGL;SNGILWRGNYEGLA;NGILWRGNYEGLAG;GILWRGNYEGLAGF;ILWRGNYEGLAGFS;LWRGNYEGLAGFSF;WRGNYEGLAGFSFG;RGNYEGLAGFSFGY;GNYEGLAGFSFGYP;NYEGLAGFSFGYPI;YEGLAGFSFGYPIP;EGLAGFSFGYPIPL;GLAGFSFGYPIPLF;LAGFSFGYPIPLFP;AGFSFGYPIPLFPA;GFSFGYPIPLFPAV;FSFGYPIPLFPAVG;SFGYPIPLFPAVGA;FGYPIPLFPAVGAD;GYPIPLFPAVGADV;YPIPLFPAVGADVT;PIPLFPAVGADVTG;IPLFPAVGADVTGD;PLFPAVGADVTGDI;LFPAVGADVTGDIG;FPAVGADVTGDIGP;PAVGADVTGDIGPA;AVGADVTGDIGPAT;VGADVTGDIGPATI;GADVTGDIGPATII;ADVTGDIGPATIIP;DVTGDIGPATIIPP;VTGDIGPATIIPPI;TGDIGPATIIPPIH;GDIGPATIIPPIHI;DIGPATIIPPIHIP;IGPATIIPPIHIPS;GPATIIPPIHIPSI;PATIIPPIHIPSIP;ATIIPPIHIPSIPL;TIIPPIHIPSIPLG;IIPPIHIPSIPLGF;IPPIHIPSIPLGFA;PPIHIPSIPLGFAA;PIHIPSIPLGFAAI;IHIPSIPLGFAAIG;HIPSIPLGFAAIGH;IPSIPLGFAAIGHI;PSIPLGFAAIGHIG;SIPLGFAAIGHIGP;IPLGFAAIGHIGPI;PLGFAAIGHIGPIS;LGFAAIGHIGPISI;GFAAIGHIGPISIP;FAAIGHIGPISIPN;AAIGHIGPISIPNI;AIGHIGPISIPNIA;IGHIGPISIPNIAI;GHIGPISIPNIAIP;HIGPISIPNIAIPS;IGPISIPNIAIPSI;GPISIPNIAIPSIH;PISIPNIAIPSIHL;ISIPNIAIPSIHLG;SIPNIAIPSIHLGI;IPNIAIPSIHLGID;PNIAIPSIHLGIDP;NIAIPSIHLGIDPT;IAIPSIHLGIDPTF;AIPSIHLGIDPTFD;IPSIHLGIDPTFDV;PSIHLGIDPTFDVG;SIHLGIDPTFDVGP;IHLGIDPTFDVGPI;HLGIDPTFDVGPIT;LGIDPTFDVGPITV;GIDPTFDVGPITVD;IDPTFDVGPITVDP;DPTFDVGPITVDPI;PTFDVGPITVDPIT;TFDVGPITVDPITL;FDVGPITVDPITLT;DVGPITVDPITLTI;VGPITVDPITLTIP;GPITVDPITLTIPG;PITVDPITLTIPGL;ITVDPITLTIPGLS;TVDPITLTIPGLSL;VDPITLTIPGLSLD;DPITLTIPGLSLDA;PITLTIPGLSLDAA;ITLTIPGLSLDAAV;TLTIPGLSLDAAVS;LTIPGLSLDAAVSE;TIPGLSLDAAVSEI;IPGLSLDAAVSEIR;PGLSLDAAVSEIRM;GLSLDAAVSEIRMT;LSLDAAVSEIRMTS;SLDAAVSEIRMTSG;LDAAVSEIRMTSGS;DAAVSEIRMTSGSS;AAVSEIRMTSGSSS;AVSEIRMTSGSSSG;VSEIRMTSGSSSGF;SEIRMTSGSSSGFK;EIRMTSGSSSGFKV;IRMTSGSSSGFKVR;RMTSGSSSGFKVRP;MTSGSSSGFKVRPS;TSGSSSGFKVRPSF;SGSSSGFKVRPSFS;GSSSGFKVRPSFSF;SSSGFKVRPSFSFF;SSGFKVRPSFSFFA;SGFKVRPSFSFFAV;GFKVRPSFSFFAVG;FKVRPSFSFFAVGP;KVRPSFSFFAVGPD;VRPSFSFFAVGPDG;RPSFSFFAVGPDGM;PSFSFFAVGP | |

Fig. 30 continued

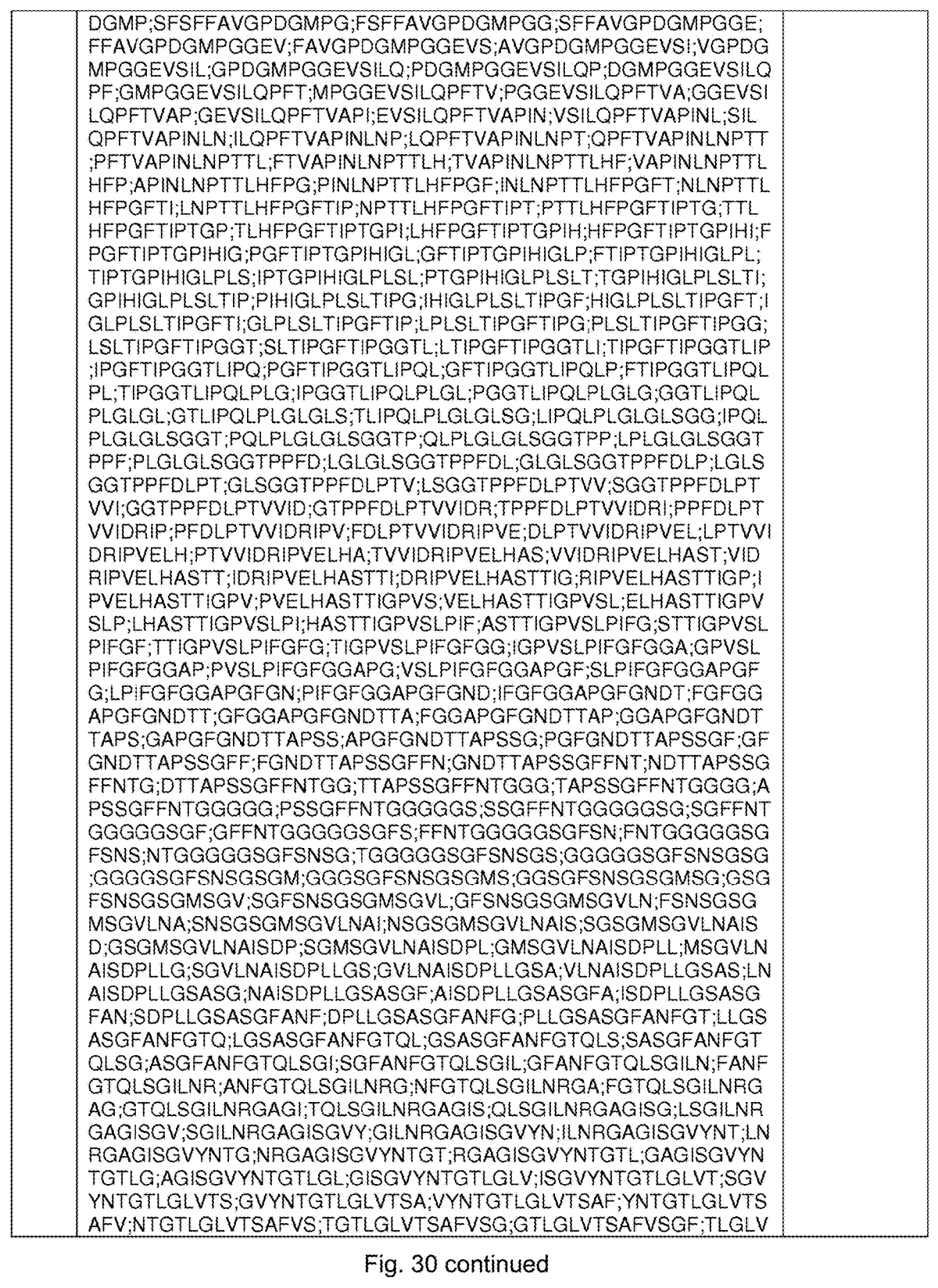

| | | |
|---|---|---|
| | DGMP;SFSFFAVGPDGMPG;FSFFAVGPDGMPGG;SFFAVGPDGMPGGE;FFAVGPDGMPGGEV;FAVGPDGMPGGEVS;AVGPDGMPGGEVSI;VGPDGMPGGEVSIL;GPDGMPGGEVSILQ;PDGMPGGEVSILQP;DGMPGGEVSILQPF;GMPGGEVSILQPFT;MPGGEVSILQPFTV;PGGEVSILQPFTVA;GGEVSILQPFTVAP;GEVSILQPFTVAPI;EVSILQPFTVAPIN;VSILQPFTVAPINL;SILQPFTVAPINLN;ILQPFTVAPINLNP;LQPFTVAPINLNPT;QPFTVAPINLNPTT;PFTVAPINLNPTTL;FTVAPINLNPTTLH;TVAPINLNPTTLHF;VAPINLNPTTLHFP;APINLNPTTLHFPG;PINLNPTTLHFPGF;INLNPTTLHFPGFT;NLNPTTLHFPGFTI;LNPTTLHFPGFTIP;NPTTLHFPGFTIPT;PTTLHFPGFTIPTG;TTLHFPGFTIPTGP;TLHFPGFTIPTGPI;LHFPGFTIPTGPIH;HFPGFTIPTGPIHI;FPGFTIPTGPIHIG;PGFTIPTGPIHIGL;GFTIPTGPIHIGLP;FTIPTGPIHIGLPL;TIPTGPIHIGLPLS;IPTGPIHIGLPLSL;PTGPIHIGLPLSLT;TGPIHIGLPLSLTI;GPIHIGLPLSLTIP;PIHIGLPLSLTIPG;IHIGLPLSLTIPGF;HIGLPLSLTIPGFT;IGLPLSLTIPGFTI;GLPLSLTIPGFTIP;LPLSLTIPGFTIPG;PLSLTIPGFTIPGG;LSLTIPGFTIPGGT;SLTIPGFTIPGGTL;LTIPGFTIPGGTLI;TIPGFTIPGGTLIP;IPGFTIPGGTLIPQ;PGFTIPGGTLIPQL;GFTIPGGTLIPQLP;FTIPGGTLIPQLPL;TIPGGTLIPQLPLG;IPGGTLIPQLPLGL;PGGTLIPQLPLGLG;GGTLIPQLPLGLGL;GTLIPQLPLGLGLS;TLIPQLPLGLGLSG;LIPQLPLGLGLSGG;IPQLPLGLGLSGGT;PQLPLGLGLSGGTP;QLPLGLGLSGGTPP;LPLGLGLSGGTPPF;PLGLGLSGGTPPFD;LGLGLSGGTPPFDL;GLGLSGGTPPFDLP;LGLSGGTPPFDLPT;GLSGGTPPFDLPTV;LSGGTPPFDLPTVV;SGGTPPFDLPTVVI;GGTPPFDLPTVVID;GTPPFDLPTVVIDR;TPPFDLPTVVIDRI;PPFDLPTVVIDRIP;PFDLPTVVIDRIPV;FDLPTVVIDRIPVE;DLPTVVIDRIPVEL;LPTVVIDRIPVELH;PTVVIDRIPVELHA;TVVIDRIPVELHAS;VVIDRIPVELHAST;VIDRIPVELHASTT;IDRIPVELHASTTI;DRIPVELHASTTIG;RIPVELHASTTIGP;IPVELHASTTIGPV;PVELHASTTIGPVS;VELHASTTIGPVSL;ELHASTTIGPVSLP;LHASTTIGPVSLPI;HASTTIGPVSLPIF;ASTTIGPVSLPIFG;STTIGPVSLPIFGF;TTIGPVSLPIFGFG;TIGPVSLPIFGFGG;IGPVSLPIFGFGGA;GPVSLPIFGFGGAP;PVSLPIFGFGGAPG;VSLPIFGFGGAPGF;SLPIFGFGGAPGFG;LPIFGFGGAPGFGN;PIFGFGGAPGFGND;IFGFGGAPGFGNDT;FGFGGAPGFGNDTT;GFGGAPGFGNDTTA;FGGAPGFGNDTTAP;GGAPGFGNDTTAPS;GAPGFGNDTTAPSS;APGFGNDTTAPSSG;PGFGNDTTAPSSGF;GFGNDTTAPSSGFF;FGNDTTAPSSGFFN;GNDTTAPSSGFFNT;NDTTAPSSGFFNTG;DTTAPSSGFFNTGG;TTAPSSGFFNTGGG;TAPSSGFFNTGGGG;APSSGFFNTGGGGG;PSSGFFNTGGGGGS;SSGFFNTGGGGGSG;SGFFNTGGGGGSGF;GFFNTGGGGGSGFS;FFNTGGGGGSGFSN;FNTGGGGGSGFSNS;NTGGGGGSGFSNSG;TGGGGGSGFSNSGS;GGGGGSGFSNSGSG;GGGGSGFSNSGSGM;GGGSGFSNSGSGMS;GGSGFSNSGSGMSG;GSGFSNSGSGMSGV;SGFSNSGSGMSGVL;GFSNSGSGMSGVLN;FSNSGSGMSGVLNA;SNSGSGMSGVLNAI;NSGSGMSGVLNAIS;SGSGMSGVLNAISD;GSGMSGVLNAISDP;SGMSGVLNAISDPL;GMSGVLNAISDPLL;MSGVLNAISDPLLG;SGVLNAISDPLLGS;GVLNAISDPLLGSA;VLNAISDPLLGSAS;LNAISDPLLGSASG;NAISDPLLGSASGF;AISDPLLGSASGFA;ISDPLLGSASGFAN;SDPLLGSASGFANF;DPLLGSASGFANFG;PLLGSASGFANFGT;LLGSASGFANFGTQ;LGSASGFANFGTQL;GSASGFANFGTQLS;SASGFANFGTQLSG;ASGFANFGTQLSGI;SGFANFGTQLSGIL;GFANFGTQLSGILN;FANFGTQLSGILNR;ANFGTQLSGILNRG;NFGTQLSGILNRGA;FGTQLSGILNRGAG;GTQLSGILNRGAGI;TQLSGILNRGAGIS;QLSGILNRGAGISG;LSGILNRGAGISGV;SGILNRGAGISGVY;GILNRGAGISGVYN;ILNRGAGISGVYNT;LNRGAGISGVYNTG;NRGAGISGVYNTGT;RGAGISGVYNTGTL;GAGISGVYNTGTLG;AGISGVYNTGTLGL;GISGVYNTGTLGLV;ISGVYNTGTLGLVT;SGVYNTGTLGLVTS;GVYNTGTLGLVTSA;VYNTGTLGLVTSAF;YNTGTLGLVTSAFV;NTGTLGLVTSAFVS;TGTLGLVTSAFVSG;GTLGLVTSAFVSGF;TLGLV | |

Fig. 30 continued

TSAFVSGFM;LGLVTSAFVSGFMN;GLVTSAFVSGFMNV;LVTSAFVSGFMN
VG;VTSAFVSGFMNVGQ;TSAFVSGFMNVGQQ;SAFVSGFMNVGQQL;AFV
SGFMNVGQQLS;FVSGFMNVGQQLSG;VSGFMNVGQQLSGL;SGFMNVG
QQLSGLL;GFMNVGQQLSGLLF;FMNVGQQLSGLLFA;MNVGQQLSGLLFA
G;NVGQQLSGLLFAGT;VGQQLSGLLFAGTG;GQQLSGLLFAGTGP;

15 mers:
MNFPVLPPEINSVLM;NFPVLPPEINSVLMY;FPVLPPEINSVLMYS;PVLPPEI
NSVLMYSG;VLPPEINSVLMYSGA;LPPEINSVLMYSGAG;PPEINSVLMYSG
AGS;PEINSVLMYSGAGSS;EINSVLMYSGAGSSP;INSVLMYSGAGSSPL;N
SVLMYSGAGSSPLL;SVLMYSGAGSSPLLA;VLMYSGAGSSPLLAA;LMYSG
AGSSPLLAAA;MYSGAGSSPLLAAAA;YSGAGSSPLLAAAAA;SGAGSSPLL
AAAAAW;GAGSSPLLAAAAAWD;AGSSPLLAAAAAWDG;GSSPLLAAAAAW
DGL;SSPLLAAAAAWDGLA;SPLLAAAAAWDGLAE;PLLAAAAAWDGLAEE;
LLAAAAAWDGLAEEL;LAAAAAWDGLAEELG;AAAAAWDGLAEELGS;AAA
AWDGLAEELGSA;AAAWDGLAEELGSAA;AAWDGLAEELGSAAV;AWDGL
AEELGSAAVS;WDGLAEELGSAAVSF;DGLAEELGSAAVSFG;GLAEELGSA
AVSFGQ;LAEELGSAAVSFGQV;AEELGSAAVSFGQVT;EELGSAAVSFGQV
TS;ELGSAAVSFGQVTSG;LGSAAVSFGQVTSGL;GSAAVSFGQVTSGLT;S
AAVSFGQVTSGLTA;AAVSFGQVTSGLTAG;AVSFGQVTSGLTAGV;VSFG
QVTSGLTAGVW;SFGQVTSGLTAGVWQ;FGQVTSGLTAGVWQG;GQVTS
GLTAGVWQGA;QVTSGLTAGVWQGAA;VTSGLTAGVWQGAAA;TSGLTAG
VWQGAAAA;SGLTAGVWQGAAAAA;GLTAGVWQGAAAAAM;LTAGVWQG
AAAAAMA;TAGVWQGAAAAAMAA;AGVWQGAAAAAMAAA;GVWQGAAAA
AMAAAA;VWQGAAAAAMAAAAA;WQGAAAAAMAAAAAP;QGAAAAAMAA
AAAPY;GAAAAAMAAAAAPYA;AAAAAMAAAAAPYAG;AAAAMAAAAAPYA
GW;AAAMAAAAAPYAGWL;AAMAAAAAPYAGWLG;AMAAAAAPYAGWLG
S;MAAAAAPYAGWLGSV;AAAAAPYAGWLGSVA;AAAAPYAGWLGSVAA;A
AAPYAGWLGSVAAQ;AAPYAGWLGSVAAQA;APYAGWLGSVAAQAV;PYA
GWLGSVAAQAVA;YAGWLGSVAAQAVAV;AGWLGSVAAQAVAVA;GWLG
SVAAQAVAVAG;WLGSVAAQAVAVAGQ;LGSVAAQAVAVAGQA;GSVAAQ
AVAVAGQAR;SVAAQAVAVAGQARA;VAAQAVAVAGQARAA;AAQAVAVA
GQARAAV;AQAVAVAGQARAAVA;QAVAVAGQARAAVAA;AVAVAGQARA
AVAAF;VAVAGQARAAVAAFE;AVAGQARAAVAAFEA;VAGQARAAVAAFE
AA;AGQARAAVAAFEAAL;GQARAAVAAFEAALA;QARAAVAAFEAALAA;A
RAAVAAFEAALAAT;RAAVAAFEAALAATV;AAVAAFEAALAATVD;AVAAFE
AALAATVDP;VAAFEAALAATVDPA;AAFEAALAATVDPAA;AFEAALAATVD
PAAV;FEAALAATVDPAAVA;EAALAATVDPAAVAV;AALAATVDPAAVAVN;
ALAATVDPAAVAVNR;LAATVDPAAVAVNRM;AATVDPAAVAVNRMA;ATVD
PAAVAVNRMAM;TVDPAAVAVNRMAMR;VDPAAVAVNRMAMRA;DPAAVA
VNRMAMRAL;PAAVAVNRMAMRALA;AAVAVNRMAMRALAM;AVAVNRMA
MRALAMS;VAVNRMAMRALAMSN;AVNRMAMRALAMSNL;VNRMAMRALA
MSNLL;NRMAMRALAMSNLLG;RMAMRALAMSNLLGQ;MAMRALAMSNLL
GQN;AMRALAMSNLLGQNA;MRALAMSNLLGQNAA;RALAMSNLLGQNAA
A;ALAMSNLLGQNAAAI;LAMSNLLGQNAAAIA;AMSNLLGQNAAAIAA;MSNL
LGQNAAAIAAV;SNLLGQNAAAIAAVE;NLLGQNAAAIAAVEA;LLGQNAAAIA
AVEAE;LGQNAAAIAAVEAEY;GQNAAAIAAVEAEYE;QNAAAIAAVEAEYEL;
NAAAIAAVEAEYELM;AAAIAAVEAEYELMW;AAIAAVEAEYELMWA;AIAAV
EAEYELMWAA;IAAVEAEYELMWAAD;AAVEAEYELMWAADV;AVEAEYEL
MWAADVA;VEAEYELMWAADVAA;EAEYELMWAADVAAM;AEYELMWAAD
VAAMA;EYELMWAADVAAMAG;YELMWAADVAAMAGY;ELMWAADVAAM
AGYH;LMWAADVAAMAGYHS;MWAADVAAMAGYHSG;WAADVAAMAGYH
SGA;AADVAAMAGYHSGAS;ADVAAMAGYHSGASA;DVAAMAGYHSGASA

Fig. 30 continued

| | | |
|---|---|---|
| | A;VAAMAGYHSGASAAA;AAMAGYHSGASAAAA;AMAGYHSGASAAAAA;MAGYHSGASAAAAAL;AGYHSGASAAAAALP;GYHSGASAAAAALPA;YHSGASAAAAALPAF;HSGASAAAAALPAFS;SGASAAAAALPAFSP;GASAAAAALPAFSPP;ASAAAAALPAFSPPA;SAAAAALPAFSPPAQ;AAAAALPAFSPPAQA;AAAALPAFSPPAQAL;AAALPAFSPPAQALG;AALPAFSPPAQALGG;ALPAFSPPAQALGGG;LPAFSPPAQALGGGV;PAFSPPAQALGGGVG;AFSPPAQALGGGVGA;FSPPAQALGGGVGAF;SPPAQALGGGVGAFL;PPAQALGGGVGAFLN;PAQALGGGVGAFLNA;AQALGGGVGAFLNAL;QALGGGVGAFLNALF;ALGGGVGAFLNALFA;LGGGVGAFLNALFAG;GGGVGAFLNALFAGP;GGVGAFLNALFAGPA;GVGAFLNALFAGPAK;VGAFLNALFAGPAKM;GAFLNALFAGPAKML;AFLNALFAGPAKMLR;FLNALFAGPAKMLRL;LNALFAGPAKMLRLN;NALFAGPAKMLRLNA;ALFAGPAKMLRLNAG;LFAGPAKMLRLNAGL;FAGPAKMLRLNAGLG;AGPAKMLRLNAGLGN;GPAKMLRLNAGLGNV;PAKMLRLNAGLGNVG;AKMLRLNAGLGNVGN;KMLRLNAGLGNVGNY;MLRLNAGLGNVGNYN;LRLNAGLGNVGNYNV;RLNAGLGNVGNYNVG;LNAGLGNVGNYNVGL;NAGLGNVGNYNVGLG;AGLGNVGNYNVGLGN;GLGNVGNYNVGLGNV;LGNVGNYNVGLGNVG;GNVGNYNVGLGNVGI;NVGNYNVGLGNVGIF;VGNYNVGLGNVGIFN;GNYNVGLGNVGIFNL;NYNVGLGNVGIFNLG;YNVGLGNVGIFNLGA;NVGLGNVGIFNLGAA;VGLGNVGIFNLGAAN;GLGNVGIFNLGAANV;LGNVGIFNLGAANVG;GNVGIFNLGAANVGA;NVGIFNLGAANVGAQ;VGIFNLGAANVGAQN;GIFNLGAANVGAQNL;IFNLGAANVGAQNLG;FNLGAANVGAQNLGA;NLGAANVGAQNLGAA;LGAANVGAQNLGAAN;GAANVGAQNLGAANA;AANVGAQNLGAANAG;ANVGAQNLGAANAGS;NVGAQNLGAANAGSG;VGAQNLGAANAGSGN;GAQNLGAANAGSGNF;AQNLGAANAGSGNFG;QNLGAANAGSGNFGF;NLGAANAGSGNFGFG;LGAANAGSGNFGFGN;GAANAGSGNFGFGNI;AANAGSGNFGFGNIG;ANAGSGNFGFGNIGN;NAGSGNFGFGNIGNA;AGSGNFGFGNIGNAN;GSGNFGFGNIGNANF;SGNFGFGNIGNANFG;GNFGFGNIGNANFGF;NFGFGNIGNANFGFG;FGFGNIGNANFGFGN;GFGNIGNANFGFGNS;FGNIGNANFGFGNSG;GNIGNANFGFGNSGL;NIGNANFGFGNSGLG;IGNANFGFGNSGLGL;GNANFGFGNSGLGLP;NANFGFGNSGLGLPP;ANFGFGNSGLGLPPG;NFGFGNSGLGLPPGM;FGFGNSGLGLPPGMG;GFGNSGLGLPPGMGN;FGNSGLGLPPGMGNI;GNSGLGLPPGMGNIG;NSGLGLPPGMGNIGL;SGLGLPPGMGNIGLG;GLGLPPGMGNIGLGN;LGLPPGMGNIGLGNA;GLPPGMGNIGLGNAG;LPPGMGNIGLGNAGS;PPGMGNIGLGNAGSS;PGMGNIGLGNAGSSN;GMGNIGLGNAGSSNY;MGNIGLGNAGSSNYG;GNIGLGNAGSSNYGL;NIGLGNAGSSNYGLA;IGLGNAGSSNYGLAN;GLGNAGSSNYGLANL;LGNAGSSNYGLANLG;GNAGSSNYGLANLGV;NAGSSNYGLANLGVG;AGSSNYGLANLGVGN;GSSNYGLANLGVGNI;SSNYGLANLGVGNIG;SNYGLANLGVGNIGF;NYGLANLGVGNIGFA;YGLANLGVGNIGFAN;GLANLGVGNIGFANT;LANLGVGNIGFANTG;ANLGVGNIGFANTGS;NLGVGNIGFANTGSN;LGVGNIGFANTGSNN;GVGNIGFANTGSNNI;VGNIGFANTGSNNIG;GNIGFANTGSNNIGI;NIGFANTGSNNIGIG;IGFANTGSNNIGIGL;GFANTGSNNIGIGLT;FANTGSNNIGIGLTG;ANTGSNNIGIGLTGD;NTGSNNIGIGLTGDN;TGSNNIGIGLTGDNL;GSNNIGIGLTGDNLT;SNNIGIGLTGDNLTG;NNIGIGLTGDNLTGI;NIGIGLTGDNLTGIG;IGIGLTGDNLTGIGG;GIGLTGDNLTGIGGL;IGLTGDNLTGIGGLN;GLTGDNLTGIGGLNS;LTGDNLTGIGGLNSG;TGDNLTGIGGLNSGT;GDNLTGIGGLNSGTG;DNLTGIGGLNSGTGN;NLTGIGGLNSGTGNL;LTGIGGLNSGTGNLG;TGIGGLNSGTGNLGL;GIGGLNSGTGNLGLF;IGGLNSGTGNLGLFN;GGLNSGTGNLGLFNS;GLNSGTGNLGLFNSG;LNSGTGNLGLFNSGT;NSGTGNLGLFNSGTG;SGTGNLGLFNSGTGN;GTGNLGLFNSGTGNI;TGNLGLFNSGTGNIG;GNLGLFNSGTGNIGF;NLGLFNSGTGNIGFF;LGLFNSGTGNIGFFN;GLFNSGTGNIGFFNS;LFNSGTGNIGFFNSG;FNSGTGNIGFFNSGT;N | |

Fig. 30 continued

| | | |
|---|---|---|
| | SGTGNIGFFNSGTG;SGTGNIGFFNSGTGN;GTGNIGFFNSGTGNF;TGNIGFFNSGTGNFG;GNIGFFNSGTGNFGV;NIGFFNSGTGNFGVF;IGFFNSGTGNFGVFN;GFFNSGTGNFGVFNS;FFNSGTGNFGVFNSG;FNSGTGNFGVFNSGS;NSGTGNFGVFNSGSY;SGTGNFGVFNSGSYN;GTGNFGVFNSGSYNT;TGNFGVFNSGSYNTG;GNFGVFNSGSYNTGV;NFGVFNSGSYNTGVG;FGVFNSGSYNTGVGN;GVFNSGSYNTGVGNA;VFNSGSYNTGVGNAG;FNSGSYNTGVGNAGT;NSGSYNTGVGNAGTA;SGSYNTGVGNAGTAS;GSYNTGVGNAGTAST;SYNTGVGNAGTASTG;YNTGVGNAGTASTGL;NTGVGNAGTASTGLF;TGVGNAGTASTGLFN;GVGNAGTASTGLFNV;VGNAGTASTGLFNVG;GNAGTASTGLFNVGG;NAGTASTGLFNVGGF;AGTASTGLFNVGGFN;GTASTGLFNVGGFNT;TASTGLFNVGGFNTG;ASTGLFNVGGFNTGV;STGLFNVGGFNTGVA;TGLFNVGGFNTGVAN;GLFNVGGFNTGVANV;LFNVGGFNTGVANVG;FNVGGFNTGVANVGS;NVGGFNTGVANVGSY;VGGFNTGVANVGSYN;GGFNTGVANVGSYNT;GFNTGVANVGSYNTG;FNTGVANVGSYNTGS;NTGVANVGSYNTGSF;TGVANVGSYNTGSFN;GVANVGSYNTGSFNA;VANVGSYNTGSFNAG;ANVGSYNTGSFNAGN;NVGSYNTGSFNAGNT;VGSYNTGSFNAGNTN;GSYNTGSFNAGNTNT;SYNTGSFNAGNTNTG;YNTGSFNAGNTNTGG;NTGSFNAGNTNTGGF;TGSFNAGNTNTGGFN;GSFNAGNTNTGGFNP;SFNAGNTNTGGFNPG;FNAGNTNTGGFNPGN;NAGNTNTGGFNPGNV;AGNTNTGGFNPGNVN;GNTNTGGFNPGNVNT;NTNTGGFNPGNVNTG;TNTGGFNPGNVNTGW;NTGGFNPGNVNTGWL;TGGFNPGNVNTGWLN;GGFNPGNVNTGWLNT;GFNPGNVNTGWLNTG;FNPGNVNTGWLNTGN;NPGNVNTGWLNTGNT;PGNVNTGWLNTGNTN;GNVNTGWLNTGNTNT;NVNTGWLNTGNTNTG;VNTGWLNTGNTNTGI;NTGWLNTGNTNTGIA;TGWLNTGNTNTGIAN;GWLNTGNTNTGIANS;WLNTGNTNTGIANSG;LNTGNTNTGIANSGN;NTGNTNTGIANSGNV;TGNTNTGIANSGNVN;GNTNTGIANSGNVNT;NTNTGIANSGNVNTG;TNTGIANSGNVNTGA;NTGIANSGNVNTGAF;TGIANSGNVNTGAFI;GIANSGNVNTGAFIS;IANSGNVNTGAFISG;ANSGNVNTGAFISGN;NSGNVNTGAFISGNF;SGNVNTGAFISGNFS;GNVNTGAFISGNFSN;NVNTGAFISGNFSNG;VNTGAFISGNFSNGV;NTGAFISGNFSNGVL;TGAFISGNFSNGVLW;GAFISGNFSNGVLWR;AFISGNFSNGVLWRG;FISGNFSNGVLWRGD;ISGNFSNGVLWRGDY;SGNFSNGVLWRGDYE;GNFSNGVLWRGDYEG;NFSNGVLWRGDYEGL;FSNGVLWRGDYEGLW;SNGVLWRGDYEGLWG;NGVLWRGDYEGLWGL;GVLWRGDYEGLWGLS;VLWRGDYEGLWGLSG;LWRGDYEGLWGLSGG;WRGDYEGLWGLSGGS;RGDYEGLWGLSGGST;GDYEGLWGLSGGSTI;DYEGLWGLSGGSTIP;YEGLWGLSGGSTIPA;EGLWGLSGGSTIPAI;GLWGLSGGSTIPAIP;LWGLSGGSTIPAIPI;WGLSGGSTIPAIPIG;GLSGGSTIPAIPIGL;LSGGSTIPAIPIGLE;SGGSTIPAIPIGLEL;GGSTIPAIPIGLELN;GSTIPAIPIGLELNG;STIPAIPIGLELNGG;TIPAIPIGLELNGGV;IPAIPIGLELNGGVG;PAIPIGLELNGGVGP;AIPIGLELNGGVGPI;IPIGLELNGGVGPIT;PIGLELNGGVGPITV;IGLELNGGVGPITVL;GLELNGGVGPITVLP;LELNGGVGPITVLPI;ELNGGVGPITVLPIQ;LNGGVGPITVLPIQI;NGGVGPITVLPIQIL;GGVGPITVLPIQILP;GVGPITVLPIQILPT;VGPITVLPIQILPTI;GPITVLPIQILPTIP;PITVLPIQILPTIPL;ITVLPIQILPTIPLN;TVLPIQILPTIPLNI;VLPIQILPTIPLNIH;LPIQILPTIPLNIHQ;PIQILPTIPLNIHQT;IQILPTIPLNIHQTF;QILPTIPLNIHQTFS;ILPTIPLNIHQTFSL;LPTIPLNIHQTFSLG;PTIPLNIHQTFSLGP;TIPLNIHQTFSLGPL;IPLNIHQTFSLGPLV;PLNIHQTFSLGPLVV;LNIHQTFSLGPLVVP;NIHQTFSLGPLVVPD;IHQTFSLGPLVVPDI;HQTFSLGPLVVPDIV;QTFSLGPLVVPDIVI;TFSLGPLVVPDIVIP;FSLGPLVVPDIVIPA;SLGPLVVPDIVIPAF;LGPLVVPDIVIPAFG;GPLVVPDIVIPAFGG;PLVVPDIVIPAFGGG;LVVPDIVIPAFGGGT;VVPDIVIPAFGGGTA;VPDIVIPAFGGGTAI;PDIVIPAFGGGTAIP;DIVIPAFGGGTAIPI;IVIPAFGGGTAIPIS;VIPAFGGGTAIPISV;IPAFGGGTAIPISVG;PAFGGGTAIPISVGP;AFGGGTAIPI | |

Fig. 30 continued

| | | |
|---|---|---|
| | SVGPI;FGGGTAIPISVGPIT;GGGTAIPISVGPITI;GGTAIPISVGPITIS;GTAIPISVGPITISP;TAIPISVGPITISPI;AIPISVGPITISPIT;IPISVGPITISPITL;PISVGPITISPITLF;ISVGPITISPITLFP;SVGPITISPITLFPA;VGPITISPITLFPAQ;GPITISPITLFPAQN;PITISPITLFPAQNF;ITISPITLFPAQNFN;TISPITLFPAQNFNT;ISPITLFPAQNFNTT;SPITLFPAQNFNTTF;PITLFPAQNFNTTFP;ITLFPAQNFNTTFPV;TLFPAQNFNTTFPVG;LFPAQNFNTTFPVGP;FPAQNFNTTFPVGPF;PAQNFNTTFPVGPFF;AQNFNTTFPVGPFFG;QNFNTTFPVGPFFGL;NFNTTFPVGPFFGLG;FNTTFPVGPFFGLGV;NTTFPVGPFFGLGVV;TTFPVGPFFGLGVVN;TFPVGPFFGLGVVNI;FPVGPFFGLGVVNIS;PVGPFFGLGVVNISG;VGPFFGLGVVNISGI;GPFFGLGVVNISGIE;PFFGLGVVNISGIEI;FFGLGVVNISGIEIK;FGLGVVNISGIEIKD;GLGVVNISGIEIKDL;LGVVNISGIEIKDLA;GVVNISGIEIKDLAG;VVNISGIEIKDLAGN;VNISGIEIKDLAGNV;NISGIEIKDLAGNVT;ISGIEIKDLAGNVTL;SGIEIKDLAGNVTLQ;GIEIKDLAGNVTLQL;IEIKDLAGNVTLQLG;EIKDLAGNVTLQLGN;IKDLAGNVTLQLGNL;KDLAGNVTLQLGNLN;DLAGNVTLQLGNLNI;LAGNVTLQLGNLNID;AGNVTLQLGNLNIDT;GNVTLQLGNLNIDTR;NVTLQLGNLNIDTRI;VTLQLGNLNIDTRIN;TLQLGNLNIDTRINQ;LQLGNLNIDTRINQS;QLGNLNIDTRINQSF;LGNLNIDTRINQSFP;GNLNIDTRINQSFPV;NLNIDTRINQSFPVT;LNIDTRINQSFPVTV;NIDTRINQSFPVTVN;IDTRINQSFPVTVNW;DTRINQSFPVTVNWS;TRINQSFPVTVNWST;RINQSFPVTVNWSTP;INQSFPVTVNWSTPA;NQSFPVTVNWSTPAV;QSFPVTVNWSTPAVT;SFPVTVNWSTPAVTI;FPVTVNWSTPAVTIF;PVTVNWSTPAVTIFP;VTVNWSTPAVTIFPN;TVNWSTPAVTIFPNG;VNWSTPAVTIFPNGI;NWSTPAVTIFPNGIS;WSTPAVTIFPNGISI;STPAVTIFPNGISIP;TPAVTIFPNGISIPN;PAVTIFPNGISIPNN;AVTIFPNGISIPNNP;VTIFPNGISIPNNPL;TIFPNGISIPNNPLA;IFPNGISIPNNPLAL;FPNGISIPNNPLALL;PNGISIPNNPLALLA;NGISIPNNPLALLAS;GISIPNNPLALLASA;ISIPNNPLALLASAS;SIPNNPLALLASASI;IPNNPLALLASASIG;PNNPLALLASASIGT;NNPLALLASASIGTL;NPLALLASASIGTLG;PLALLASASIGTLGF;LALLASASIGTLGFT;ALLASASIGTLGFTI;LLASASIGTLGFTIP;LASASIGTLGFTIPG;ASASIGTLGFTIPGF;SASIGTLGFTIPGFT;ASIGTLGFTIPGFTI;SIGTLGFTIPGFTIP;IGTLGFTIPGFTIPA;GTLGFTIPGFTIPAA;TLGFTIPGFTIPAAP;LGFTIPGFTIPAAPL;GFTIPGFTIPAAPLP;FTIPGFTIPAAPLPL;TIPGFTIPAAPLPLT;IPGFTIPAAPLPLTI;PGFTIPAAPLPLTID;GFTIPAAPLPLTIDI;FTIPAAPLPLTIDID;TIPAAPLPLTIDIDG;IPAAPLPLTIDIDGQ;PAAPLPLTIDIDGQI;AAPLPLTIDIDGQID;APLPLTIDIDGQIDG;PLPLTIDIDGQIDGF;LPLTIDIDGQIDGFS;PLTIDIDGQIDGFST;LTIDIDGQIDGFSTP;TIDIDGQIDGFSTPP;IDIDGQIDGFSTPPI;DIDGQIDGFSTPPIT;IDGQIDGFSTPPITI;DGQIDGFSTPPITID;GQIDGFSTPPITIDR;QIDGFSTPPITIDRI;IDGFSTPPITIDRIP;DGFSTPPITIDRIPL;GFSTPPITIDRIPLN;FSTPPITIDRIPLNL;STPPITIDRIPLNLG;TPPITIDRIPLNLGA;PPITIDRIPLNLGAS;PITIDRIPLNLGASV;ITIDRIPLNLGASVT;TIDRIPLNLGASVTV;IDRIPLNLGASVTVG;DRIPLNLGASVTVGP;RIPLNLGASVTVGPI;IPLNLGASVTVGPIL;PLNLGASVTVGPILI;LNLGASVTVGPILIN;NLGASVTVGPILING;LGASVTVGPILINGV;GASVTVGPILINGVN;ASVTVGPILINGVNI;SVTVGPILINGVNIP;VTVGPILINGVNIPA;TVGPILINGVNIPAT;VGPILINGVNIPATP;GPILINGVNIPATPG;PILINGVNIPATPGF;ILINGVNIPATPGFG;LINGVNIPATPGFGN;INGVNIPATPGFGNT;NGVNIPATPGFGNTT;GVNIPATPGFGNTTT;VNIPATPGFGNTTTA;NIPATPGFGNTTTAP;IPATPGFGNTTTAPS;PATPGFGNTTTAPSS;ATPGFGNTTTAPSSG;TPGFGNTTTAPSSGF;PGFGNTTTAPSSGFF;GFGNTTTAPSSGFFN;FGNTTTAPSSGFFNS;GNTTTAPSSGFFNSG;NTTTAPSSGFFNSGD;TTTAPSSGFFNSGDG;TTAPSSGFFNSGDGG;TAPSSGFFNSGDGGV;APSSGFFNSGDGGVS;PSSGFFNSGDGGVSG;SSGFFNSGDGGVSGF;SGFFNSGDGGVSGFG;GFFNSGDGGVSGFGN;FFNSGDGGVSGFGNF;FNSGDGGVSGFGNFG;NSGDGGVSGFGNFGA;SGDGGVS | |

Fig. 30 continued

| | | |
|---|---|---|
| | GFGNFGAG;GDGGVSGFGNFGAGS;DGGVSGFGNFGAGSS;GGVSGFGNFGAGSSG;GVSGFGNFGAGSSGW;VSGFGNFGAGSSGWW;SGFGNFGAGSSGWWN;GFGNFGAGSSGWWNQ;FGNFGAGSSGWWNQA;GNFGAGSSGWWNQAQ;NFGAGSSGWWNQAQT;FGAGSSGWWNQAQTE;GAGSSGWWNQAQTEV;AGSSGWWNQAQTEVA;GSSGWWNQAQTEVAG;SSGWWNQAQTEVAGA;SGWWNQAQTEVAGAG;GWWNQAQTEVAGAGS;WWNQAQTEVAGAGSG;WNQAQTEVAGAGSGF;NQAQTEVAGAGSGFA;QAQTEVAGAGSGFAN;AQTEVAGAGSGFANF;QTEVAGAGSGFANFG;TEVAGAGSGFANFGS;EVAGAGSGFANFGSL;VAGAGSGFANFGSLG;AGAGSGFANFGSLGS;GAGSGFANFGSLGSG;AGSGFANFGSLGSGV;GSGFANFGSLGSGVL;SGFANFGSLGSGVLN;GFANFGSLGSGVLNF;FANFGSLGSGVLNFG;ANFGSLGSGVLNFGS;NFGSLGSGVLNFGSG;FGSLGSGVLNFGSGV;GSLGSGVLNFGSGVS;SLGSGVLNFGSGVSG;LGSGVLNFGSGVSGL;GSGVLNFGSGVSGLY;SGVLNFGSGVSGLYN;GVLNFGSGVSGLYNT;VLNFGSGVSGLYNTG;LNFGSGVSGLYNTGG;NFGSGVSGLYNTGGL;FGSGVSGLYNTGGLP;GSGVSGLYNTGGLPP;SGVSGLYNTGGLPPG;GVSGLYNTGGLPPGT;VSGLYNTGGLPPGTP;SGLYNTGGLPPGTPA;GLYNTGGLPPGTPAV;LYNTGGLPPGTPAVV;YNTGGLPPGTPAVVS;NTGGLPPGTPAVVSG;TGGLPPGTPAVVSGI;GGLPPGTPAVVSGIG;GLPPGTPAVVSGIGN;LPPGTPAVVSGIGNV;PPGTPAVVSGIGNVG;PGTPAVVSGIGNVGE;GTPAVVSGIGNVGEQ;TPAVVSGIGNVGEQL;PAVVSGIGNVGEQLS;AVVSGIGNVGEQLSG;VVSGIGNVGEQLSGL;VSGIGNVGEQLSGLS;SGIGNVGEQLSGLSS;GIGNVGEQLSGLSSA;IGNVGEQLSGLSSAG;GNVGEQLSGLSSAGT;NVGEQLSGLSSAGTA;VGEQLSGLSSAGTAL;GEQLSGLSSAGTALN;EQLSGLSSAGTALNQ;QLSGLSSAGTALNQS;LSGLSSAGTALNQSL;SGLSSAGTALNQSLI;GLSSAGTALNQSLII;LSSAGTALNQSLIIN;SSAGTALNQSLIINL;SAGTALNQSLIINLG;AGTALNQSLIINLGL;GTALNQSLIINLGLA;TALNQSLIINLGLAD;ALNQSLIINLGLADV;LNQSLIINLGLADVG;NQSLIINLGLADVGS;QSLIINLGLADVGSV;SLIINLGLADVGSVN;LIINLGLADVGSVNV;IINLGLADVGSVNVG;INLGLADVGSVNVGF;NLGLADVGSVNVGFG;LGLADVGSVNVGFGN;GLADVGSVNVGFGNV;LADVGSVNVGFGNVG;ADVGSVNVGFGNVGD;DVGSVNVGFGNVGDF;VGSVNVGFGNVGDFN;GSVNVGFGNVGDFNL;SVNVGFGNVGDFNLG;VNVGFGNVGDFNLGA;NVGFGNVGDFNLGAA;VGFGNVGDFNLGAAN;GFGNVGDFNLGAANI;FGNVGDFNLGAANIG;GNVGDFNLGAANIGD;NVGDFNLGAANIGDL;VGDFNLGAANIGDLN;GDFNLGAANIGDLNV;DFNLGAANIGDLNVG;FNLGAANIGDLNVGL;NLGAANIGDLNVGLG;LGAANIGDLNVGLGN;GAANIGDLNVGLGNV;AANIGDLNVGLGNVG;ANIGDLNVGLGNVGG;NIGDLNVGLGNVGGG;IGDLNVGLGNVGGGN;GDLNVGLGNVGGGNV;DLNVGLGNVGGGNVG;LNVGLGNVGGGNVGF;NVGLGNVGGGNVGFG;VGLGNVGGGNVGFGN;GLGNVGGGNVGFGNI;LGNVGGGNVGFGNIG;GNVGGGNVGFGNIGD;NVGGGNVGFGNIGDA;VGGGNVGFGNIGDAN;GGGNVGFGNIGDANF;GGNVGFGNIGDANFG;GNVGFGNIGDANFGL;NVGFGNIGDANFGLG;VGFGNIGDANFGLGN;GFGNIGDANFGLGNA;FGNIGDANFGLGNAG;GNIGDANFGLGNAGL;NIGDANFGLGNAGLA;IGDANFGLGNAGLAA;GDANFGLGNAGLAAG;DANFGLGNAGLAAGL;ANFGLGNAGLAAGLA;NFGLGNAGLAAGLAG;FGLGNAGLAAGLAGV;GLGNAGLAAGLAGVG;LGNAGLAAGLAGVGN;GNAGLAAGLAGVGNI;NAGLAAGLAGVGNIG;AGLAAGLAGVGNIGL;GLAAGLAGVGNIGLG;LAAGLAGVGNIGLGN;AAGLAGVGNIGLGNA;AGLAGVGNIGLGNAG;GLAGVGNIGLGNAGS;LAGVGNIGLGNAGSG;AGVGNIGLGNAGSGN;GVGNIGLGNAGSGNV;VGNIGLGNAGSGNVG;GNIGLGNAGSGNVGF;NIGLGNAGSGNVGFG;IGLGNAGSGNVGFGN;GLGNAGSGNVGFGNM;LGNAGSGNVGFGNMG;GNAGSGNVGFGNMGV;NAGSGNVGFGNMGVG;AGSGNVGFGNMGVGN;GSGNVGFGNMGVGNI;SGNVGFGNMGVG | |

Fig. 30 continued

| | | |
|---|---|---|
| | NIG;GNVGFGNMGVGNIGF;NVGFGNMGVGNIGFG;VGFGNMGVGNIGFGN;GFGNMGVGNIGFGNT;FGNMGVGNIGFGNTG;GNMGVGNIGFGNTGT;NMGVGNIGFGNTGTN;MGVGNIGFGNTGTNN;GVGNIGFGNTGTNNL;VGNIGFGNTGTNNLG;GNIGFGNTGTNNLGI;NIGFGNTGTNNLGIG;IGFGNTGTNNLGIGL;GFGNTGTNNLGIGLT;FGNTGTNNLGIGLTG;GNTGTNNLGIGLTGD;NTGTNNLGIGLTGDN;TGTNNLGIGLTGDNQ;GTNNLGIGLTGDNQT;TNNLGIGLTGDNQTG;NNLGIGLTGDNQTGI;NLGIGLTGDNQTGIG;LGIGLTGDNQTGIGG;GIGLTGDNQTGIGGL;IGLTGDNQTGIGGLN;GLTGDNQTGIGGLNS;LTGDNQTGIGGLNSG;TGDNQTGIGGLNSGA;GDNQTGIGGLNSGAG;DNQTGIGGLNSGAGN;NQTGIGGLNSGAGNI;QTGIGGLNSGAGNIG;TGIGGLNSGAGNIGL;GIGGLNSGAGNIGLF;IGGLNSGAGNIGLFN;GGLNSGAGNIGLFNS;GLNSGAGNIGLFNSG;LNSGAGNIGLFNSGT;NSGAGNIGLFNSGTG;SGAGNIGLFNSGTGN;GAGNIGLFNSGTGNV;AGNIGLFNSGTGNVG;GNIGLFNSGTGNVGL;NIGLFNSGTGNVGLF;IGLFNSGTGNVGLFN;GLFNSGTGNVGLFNS;LFNSGTGNVGLFNSG;FNSGTGNVGLFNSGT;NSGTGNVGLFNSGTG;SGTGNVGLFNSGTGN;GTGNVGLFNSGTGNF;TGNVGLFNSGTGNFG;GNVGLFNSGTGNFGL;NVGLFNSGTGNFGLF;VGLFNSGTGNFGLFN;GLFNSGTGNFGLFNS;LFNSGTGNFGLFNSG;FNSGTGNFGLFNSGS;NSGTGNFGLFNSGSF;SGTGNFGLFNSGSFN;GTGNFGLFNSGSFNT;TGNFGLFNSGSFNTG;GNFGLFNSGSFNTGI;NFGLFNSGSFNTGIG;FGLFNSGSFNTGIGN;GLFNSGSFNTGIGNG;LFNSGSFNTGIGNGG;FNSGSFNTGIGNGGT;NSGSFNTGIGNGGTG;SGSFNTGIGNGGTGS;GSFNTGIGNGGTGST;SFNTGIGNGGTGSTG;FNTGIGNGGTGSTGL;NTGIGNGGTGSTGLF;TGIGNGGTGSTGLFN;GIGNGGTGSTGLFNA;IGNGGTGSTGLFNAG;GNGGTGSTGLFNAGN;NGGTGSTGLFNAGNF;GGTGSTGLFNAGNFN;GTGSTGLFNAGNFNT;TGSTGLFNAGNFNTG;GSTGLFNAGNFNTGV;STGLFNAGNFNTGVA;TGLFNAGNFNTGVAN;GLFNAGNFNTGVANP;LFNAGNFNTGVANPG;FNAGNFNTGVANPGS;NAGNFNTGVANPGSY;AGNFNTGVANPGSYN;GNFNTGVANPGSYNT;NFNTGVANPGSYNTG;FNTGVANPGSYNTGS;NTGVANPGSYNTGSF;TGVANPGSYNTGSFN;GVANPGSYNTGSFNV;VANPGSYNTGSFNVG;ANPGSYNTGSFNVGD;NPGSYNTGSFNVGDT;PGSYNTGSFNVGDTN;GSYNTGSFNVGDTNT;SYNTGSFNVGDTNTG;YNTGSFNVGDTNTGG;NTGSFNVGDTNTGGF;TGSFNVGDTNTGGFN;GSFNVGDTNTGGFNP;SFNVGDTNTGGFNPG;FNVGDTNTGGFNPGS;NVGDTNTGGFNPGSI;VGDTNTGGFNPGSIN;GDTNTGGFNPGSINT;DTNTGGFNPGSINTG;TNTGGFNPGSINTGW;NTGGFNPGSINTGWF;TGGFNPGSINTGWFN;GGFNPGSINTGWFNT;GFNPGSINTGWFNTG;FNPGSINTGWFNTGN;NPGSINTGWFNTGNA;PGSINTGWFNTGNAN;GSINTGWFNTGNANT;SINTGWFNTGNANTG;INTGWFNTGNANTGV;NTGWFNTGNANTGVA;TGWFNTGNANTGVAN;GWFNTGNANTGVANS;WFNTGNANTGVANSG;FNTGNANTGVANSGN;NTGNANTGVANSGNV;TGNANTGVANSGNVD;GNANTGVANSGNVDT;NANTGVANSGNVDTG;ANTGVANSGNVDTGA;NTGVANSGNVDTGAL;TGVANSGNVDTGALM;GVANSGNVDTGALMS;VANSGNVDTGALMSG;ANSGNVDTGALMSGN;NSGNVDTGALMSGNF;SGNVDTGALMSGNFS;GNVDTGALMSGNFSN;NVDTGALMSGNFSNG;VDTGALMSGNFSNGI;DTGALMSGNFSNGIL;TGALMSGNFSNGILW;GALMSGNFSNGILWR;ALMSGNFSNGILWRG;LMSGNFSNGILWRGN;MSGNFSNGILWRGNF;SGNFSNGILWRGNFE;GNFSNGILWRGNFEG;NFSNGILWRGNFEGL;FSNGILWRGNFEGLF;SNGILWRGNFEGLFG;NGILWRGNFEGLFGL;GILWRGNFEGLFGLN;ILWRGNFEGLFGLNV;LWRGNFEGLFGLNVG;WRGNFEGLFGLNVGI;RGNFEGLFGLNVGIT;GNFEGLFGLNVGITI;NFEGLFGLNVGITIP;FEGLFGLNVGITIPE;EGLFGLNVGITIPEF;GLFGLNVGITIPEFP;LFGLNVGITIPEFPI;FGLNVGITIPEFPIH;GLNVGITIPEFPIHW;LNVGITIPEFPIHWT;NVGITIPEFPIHWTS;VGITIPEFPIHWTST;GI | |

Fig. 30 continued

| | | |
|---|---|---|
| | TIPEFPIHWTSTG;ITIPEFPIHWTSTGG;TIPEFPIHWTSTGGI;IPEFPIHWTSTGGIG;PEFPIHWTSTGGIGP;EFPIHWTSTGGIGPI;FPIHWTSTGGIGPII;PIHWTSTGGIGPIII;IHWTSTGGIGPIIIP;HWTSTGGIGPIIIPD;WTSTGGIGPIIIPDT;TSTGGIGPIIIPDTT;STGGIGPIIIPDTTI;TGGIGPIIIPDTTIL;GGIGPIIIPDTTILP;GIGPIIIPDTTILPP;IGPIIIPDTTILPPI;GPIIIPDTTILPPIH;PIIIPDTTILPPIHL;IIIPDTTILPPIHLG;IIPDTTILPPIHLGL;IPDTTILPPIHLGLT;PDTTILPPIHLGLTG;DTTILPPIHLGLTGQ;TTILPPIHLGLTGQA;TILPPIHLGLTGQAN;ILPPIHLGLTGQANY;LPPIHLGLTGQANYG;PPIHLGLTGQANYGF;PIHLGLTGQANYGFA;IHLGLTGQANYGFAV;HLGLTGQANYGFAVP;LGLTGQANYGFAVPD;GLTGQANYGFAVPDI;LTGQANYGFAVPDIP;TGQANYGFAVPDIPI;GQANYGFAVPDIPIP;QANYGFAVPDIPIPA;ANYGFAVPDIPIPAI;NYGFAVPDIPIPAIH;YGFAVPDIPIPAIHI;GFAVPDIPIPAIHID;FAVPDIPIPAIHIDF;AVPDIPIPAIHIDFD;VPDIPIPAIHIDFDG;PDIPIPAIHIDFDGA;DIPIPAIHIDFDGAA;IPIPAIHIDFDGAAD;PIPAIHIDFDGAADA;IPAIHIDFDGAADAG;PAIHIDFDGAADAGF;AIHIDFDGAADAGFT;IHIDFDGAADAGFTA;HIDFDGAADAGFTAP;IDFDGAADAGFTAPA;DFDGAADAGFTAPAT;FDGAADAGFTAPATT;DGAADAGFTAPATTL;GAADAGFTAPATTLL;AADAGFTAPATTLLS;ADAGFTAPATTLLSA;DAGFTAPATTLLSAL;AGFTAPATTLLSALG;GFTAPATTLLSALGI;FTAPATTLLSALGIT;TAPATTLLSALGITG;APATTLLSALGITGQ;PATTLLSALGITGQF;ATTLLSALGITGQFR;TTLLSALGITGQFRF;TLLSALGITGQFRFG;LLSALGITGQFRFGP;LSALGITGQFRFGPI;SALGITGQFRFGPIT;ALGITGQFRFGPITV;LGITGQFRFGPITVS;GITGQFRFGPITVSN;ITGQFRFGPITVSNV;TGQFRFGPITVSNVQ;GQFRFGPITVSNVQL;QFRFGPITVSNVQLN;FRFGPITVSNVQLNP;RFGPITVSNVQLNPF;FGPITVSNVQLNPFN;GPITVSNVQLNPFNV;PITVSNVQLNPFNVN;ITVSNVQLNPFNVNL;TVSNVQLNPFNVNLK;VSNVQLNPFNVNLKL;SNVQLNPFNVNLKLQ;NVQLNPFNVNLKLQF;VQLNPFNVNLKLQFL;QLNPFNVNLKLQFLH;LNPFNVNLKLQFLHD;NPFNVNLKLQFLHDA;PFNVNLKLQFLHDAF;FNVNLKLQFLHDAFP;NVNLKLQFLHDAFPN;VNLKLQFLHDAFPNE;NLKLQFLHDAFPNEF;LKLQFLHDAFPNEFP;KLQFLHDAFPNEFPD;LQFLHDAFPNEFPDP;QFLHDAFPNEFPDPT;FLHDAFPNEFPDPTI;LHDAFPNEFPDPTIS;HDAFPNEFPDPTISV;DAFPNEFPDPTISVQ;AFPNEFPDPTISVQI;FPNEFPDPTISVQIQ;PNEFPDPTISVQIQV;NEFPDPTISVQIQVA;EFPDPTISVQIQVAI;FPDPTISVQIQVAIP;PDPTISVQIQVAIPL;DPTISVQIQVAIPLT;PTISVQIQVAIPLTS;TISVQIQVAIPLTSA;ISVQIQVAIPLTSAT;SVQIQVAIPLTSATL;VQIQVAIPLTSATLG;QIQVAIPLTSATLGG;IQVAIPLTSATLGGL;QVAIPLTSATLGGLA;VAIPLTSATLGGLAL;AIPLTSATLGGLALP;IPLTSATLGGLALPL;PLTSATLGGLALPLQ;LTSATLGGLALPLQQ;TSATLGGLALPLQQT;SATLGGLALPLQQTI;ATLGGLALPLQQTID;TLGGLALPLQQTIDA;LGGLALPLQQTIDAI;GGLALPLQQTIDAIE;GLALPLQQTIDAIEL;LALPLQQTIDAIELP;ALPLQQTIDAIELPA;LPLQQTIDAIELPAI;PLQQTIDAIELPAIS;LQQTIDAIELPAISF;QQTIDAIELPAISFS;QTIDAIELPAISFSQ;TIDAIELPAISFSQS;IDAIELPAISFSQSI;DAIELPAISFSQSIP;AIELPAISFSQSIPI;IELPAISFSQSIPID;ELPAISFSQSIPIDI;LPAISFSQSIPIDIP;PAISFSQSIPIDIPP;AISFSQSIPIDIPPI;ISFSQSIPIDIPPID;SFSQSIPIDIPPIDI;FSQSIPIDIPPIDIP;SQSIPIDIPPIDIPA;QSIPIDIPPIDIPAS;SIPIDIPPIDIPAST;IPIDIPPIDIPASTI;PIDIPPIDIPASTIN;IDIPPIDIPASTING;DIPPIDIPASTINGI;IPPIDIPASTINGIS;PPIDIPASTINGISM;PIDIPASTINGISMS;IDIPASTINGISMSE;DIPASTINGISMSEV;IPASTINGISMSEVV;PASTINGISMSEVVP;ASTINGISMSEVVPI;STINGISMSEVVPID;TINGISMSEVVPIDV;INGISMSEVVPIDVS;NGISMSEVVPIDVSV;GISMSEVVPIDVSVD;ISMSEVVPIDVSVDI;SMSEVVPIDVSVDIP;MSEVVPIDVSVDIPA;SEVVPIDVSVDIPAV;EVVPIDVSVDIPAVT;VVPIDVSVDIPAVTI;VPIDVSVDIPAVTIT;PIDVSVDIPAVTITG;IDVSVDIPAVTITGT;DVSVDIPAVTITGTR;VSVDIPAVTITGTRI;SVDIPAVTITGTRID;VDIPAVTITGTRIDP;DIPAVTITGTRIDP | |

Fig. 30 continued

| | | |
|---|---|---|
| | I;IPAVTITGTRIDPIP;PAVTITGTRIDPIPL;AVTITGTRIDPIPLN;VTITGTRIDPIPLNF;TITGTRIDPIPLNFD;ITGTRIDPIPLNFDV;TGTRIDPIPLNFDVL;GTRIDPIPLNFDVLS;TRIDPIPLNFDVLSS;RIDPIPLNFDVLSSA;IDPIPLNFDVLSSAG;DPIPLNFDVLSSAGP;PIPLNFDVLSSAGPI;IPLNFDVLSSAGPIN;PLNFDVLSSAGPINI;LNFDVLSSAGPINIS;NFDVLSSAGPINISI;FDVLSSAGPINISII;DVLSSAGPINISIID;VLSSAGPINISIIDI;LSSAGPINISIIDIP;SSAGPINISIIDIPA;SAGPINISIIDIPAL;AGPINISIIDIPALP;GPINISIIDIPALPG;PINISIIDIPALPGF;INISIIDIPALPGFG;NISIIDIPALPGFGN;ISIIDIPALPGFGNS;SIIDIPALPGFGNST;IIDIPALPGFGNSTE;IDIPALPGFGNSTEL;DIPALPGFGNSTELP;IPALPGFGNSTELPS;PALPGFGNSTELPSS;ALPGFGNSTELPSSG;LPGFGNSTELPSSGF;PGFGNSTELPSSGFF;GFGNSTELPSSGFFN;FGNSTELPSSGFFNT;GNSTELPSSGFFNTG;NSTELPSSGFFNTGG;STELPSSGFFNTGGG;TELPSSGFFNTGGGG;ELPSSGFFNTGGGGG;LPSSGFFNTGGGGGS;PSSGFFNTGGGGGSG;SSGFFNTGGGGGSGI;SGFFNTGGGGGSGIA;GFFNTGGGGGSGIAN;FFNTGGGGGSGIANF;FNTGGGGGSGIANFG;NTGGGGGSGIANFGA;TGGGGGSGIANFGAG;GGGGGSGIANFGAGV;GGGGSGIANFGAGVS;GGGSGIANFGAGVSG;GGSGIANFGAGVSGL;GSGIANFGAGVSGLL;SGIANFGAGVSGLLN;GIANFGAGVSGLLNQ;IANFGAGVSGLLNQA;ANFGAGVSGLLNQAS;NFGAGVSGLLNQASS;FGAGVSGLLNQASSP;GAGVSGLLNQASSPM;AGVSGLLNQASSPMV;GVSGLLNQASSPMVG;VSGLLNQASSPMVGT;SGLLNQASSPMVGTL;GLLNQASSPMVGTLS;LLNQASSPMVGTLSG;LNQASSPMVGTLSGL;NQASSPMVGTLSGLG;QASSPMVGTLSGLGN;ASSPMVGTLSGLGNA;SSPMVGTLSGLGNAG;SPMVGTLSGLGNAGS;PMVGTLSGLGNAGSL;MVGTLSGLGNAGSLA;VGTLSGLGNAGSLAS;GTLSGLGNAGSLASG;TLSGLGNAGSLASGV;LSGLGNAGSLASGVL;SGLGNAGSLASGVLN;GLGNAGSLASGVLNS;LGNAGSLASGVLNSG;GNAGSLASGVLNSGV;NAGSLASGVLNSGVD;AGSLASGVLNSGVDI;GSLASGVLNSGVDIS;SLASGVLNSGVDISG;LASGVLNSGVDISGM;ASGVLNSGVDISGMF;SGVLNSGVDISGMFN;GVLNSGVDISGMFNV;VLNSGVDISGMFNVS;LNSGVDISGMFNVST;NSGVDISGMFNVSTL;SGVDISGMFNVSTLG;GVDISGMFNVSTLGS;VDISGMFNVSTLGSA;DISGMFNVSTLGSAP;ISGMFNVSTLGSAPA;SGMFNVSTLGSAPAV;GMFNVSTLGSAPAVI;MFNVSTLGSAPAVIS;FNVSTLGSAPAVISG;NVSTLGSAPAVISGF;VSTLGSAPAVISGFG;STLGSAPAVISGFGN;TLGSAPAVISGFGNL;LGSAPAVISGFGNLG;GSAPAVISGFGNLGN;SAPAVISGFGNLGNH;APAVISGFGNLGNHV;PAVISGFGNLGNHVS;AVISGFGNLGNHVSG;VISGFGNLGNHVSGV;ISGFGNLGNHVSGVS;SGFGNLGNHVSGVSI;GFGNLGNHVSGVSID;FGNLGNHVSGVSIDG;GNLGNHVSGVSIDGL;NLGNHVSGVSIDGLL;LGNHVSGVSIDGLLA;GNHVSGVSIDGLLAM;NHVSGVSIDGLLAML;HVSGVSIDGLLAMLT;VSGVSIDGLLAMLTS;SGVSIDGLLAMLTSG;GVSIDGLLAMLTSGG;VSIDGLLAMLTSGGS;SIDGLLAMLTSGGSG;IDGLLAMLTSGGSGG;DGLLAMLTSGGSGGS;GLLAMLTSGGSGGSG;LLAMLTSGGSGGSGQ;LAMLTSGGSGGSGQP;AMLTSGGSGGSGQPS;MLTSGGSGGSGQPSI;LTSGGSGGSGQPSII;TSGGSGGSGQPSIID;SGGSGGSGQPSIIDA;GGSGGSGQPSIIDAA;GSGGSGQPSIIDAAI;SGGSGQPSIIDAAIA;GGSGQPSIIDAAIAE;GSGQPSIIDAAIAEL;SGQPSIIDAAIAELR;GQPSIIDAAIAELRH;QPSIIDAAIAELRHL;PSIIDAAIAELRHLN;SIIDAAIAELRHLNP;IIDAAIAELRHLNPL;IDAAIAELRHLNPLN;DAAIAELRHLNPLNI;AAIAELRHLNPLNIV;AIAELRHLNPLNIVN;IAELRHLNPLNIVNL;AELRHLNPLNIVNLG;ELRHLNPLNIVNLGN;LRHLNPLNIVNLGNV;RHLNPLNIVNLGNVG;HLNPLNIVNLGNVGS;LNPLNIVNLGNVGSY;NPLNIVNLGNVGSYN;PLNIVNLGNVGSYNL;LNIVNLGNVGSYNLG;NIVNLGNVGSYNLGF;IVNLGNVGSYNLGFA;VNLGNVGSYNLGFAN;NLGNVGSYNLGFANV;LGNVGSYNLGFANVG;GNVGSYNLGFANVGD;NVGSYNLGFANVGDV;VGSYNLGFANVGDVN;GSYNLGFANV | |

Fig. 30 continued

| | | |
|---|---|---|
| | GDVNL;SYNLGFANVGDVNLG;YNLGFANVGDVNLGA;NLGFANVGDVNLGAG;LGFANVGDVNLGAGN;GFANVGDVNLGAGNL;FANVGDVNLGAGNLG;ANVGDVNLGAGNLGN;NVGDVNLGAGNLGNL;VGDVNLGAGNLGNLN;GDVNLGAGNLGNLNL;DVNLGAGNLGNLNLG;VNLGAGNLGNLNLGG;NLGAGNLGNLNLGGG;LGAGNLGNLNLGGGN;GAGNLGNLNLGGGNL;AGNLGNLNLGGGNLG;GNLGNLNLGGGNLGG;NLGNLNLGGGNLGGQ;LGNLNLGGGNLGGQN;GNLNLGGGNLGGQNL;NLNLGGGNLGGQNLG;LNLGGGNLGGQNLGL;NLGGGNLGGQNLGLG;LGGGNLGGQNLGLGN;GGGNLGGQNLGLGNL;GGNLGGQNLGLGNLG;GNLGGQNLGLGNLGD;NLGGQNLGLGNLGDG;LGGQNLGLGNLGDGN;GGQNLGLGNLGDGNV;GQNLGLGNLGDGNVG;QNLGLGNLGDGNVGF;NLGLGNLGDGNVGFG;LGLGNLGDGNVGFGN;GLGNLGDGNVGFGNL;LGNLGDGNVGFGNLG;GNLGDGNVGFGNLGH;NLGDGNVGFGNLGHG;LGDGNVGFGNLGHGN;GDGNVGFGNLGHGNV;DGNVGFGNLGHGNVG;GNVGFGNLGHGNVGF;NVGFGNLGHGNVGFG;VGFGNLGHGNVGFGN;GFGNLGHGNVGFGNS;FGNLGHGNVGFGNSG;GNLGHGNVGFGNSGL;NLGHGNVGFGNSGLG;LGHGNVGFGNSGLGA;GHGNVGFGNSGLGAL;HGNVGFGNSGLGALP;GNVGFGNSGLGALPG;NVGFGNSGLGALPGI;VGFGNSGLGALPGIG;GFGNSGLGALPGIGN;FGNSGLGALPGIGNI;GNSGLGALPGIGNIG;NSGLGALPGIGNIGL;SGLGALPGIGNIGLG;GLGALPGIGNIGLGN;LGALPGIGNIGLGNA;GALPGIGNIGLGNAG;ALPGIGNIGLGNAGS;LPGIGNIGLGNAGSN;PGIGNIGLGNAGSNN;GIGNIGLGNAGSNNV;IGNIGLGNAGSNNVG;GNIGLGNAGSNNVGF;NIGLGNAGSNNVGFG;IGLGNAGSNNVGFGN;GLGNAGSNNVGFGNM;LGNAGSNNVGFGNMG;GNAGSNNVGFGNMGL;NAGSNNVGFGNMGLG;AGSNNVGFGNMGLGN;GSNNVGFGNMGLGNI;SNNVGFGNMGLGNIG;NNVGFGNMGLGNIGF;NVGFGNMGLGNIGFG;VGFGNMGLGNIGFGN;GFGNMGLGNIGFGNT;FGNMGLGNIGFGNTG;GNMGLGNIGFGNTGT;NMGLGNIGFGNTGTN;MGLGNIGFGNTGTNN;GLGNIGFGNTGTNNL;LGNIGFGNTGTNNLG;GNIGFGNTGTNNLGI;NIGFGNTGTNNLGIG;IGFGNTGTNNLGIGL;GFGNTGTNNLGIGLT;FGNTGTNNLGIGLTG;GNTGTNNLGIGLTGD;NTGTNNLGIGLTGDN;TGTNNLGIGLTGDNQ;GTNNLGIGLTGDNQT;TNNLGIGLTGDNQTG;NNLGIGLTGDNQTGF;NLGIGLTGDNQTGFG;LGIGLTGDNQTGFGG;GIGLTGDNQTGFGGL;IGLTGDNQTGFGGLN;GLTGDNQTGFGGLNS;LTGDNQTGFGGLNSG;TGDNQTGFGGLNSGA;GDNQTGFGGLNSGAG;DNQTGFGGLNSGAGN;NQTGFGGLNSGAGNL;QTGFGGLNSGAGNLG;TGFGGLNSGAGNLGL;GFGGLNSGAGNLGLF;FGGLNSGAGNLGLFN;GGLNSGAGNLGLFNS;GLNSGAGNLGLFNSG;LNSGAGNLGLFNSGT;NSGAGNLGLFNSGTG;SGAGNLGLFNSGTGN;GAGNLGLFNSGTGNI;AGNLGLFNSGTGNIG;GNLGLFNSGTGNIGF;NLGLFNSGTGNIGFF;LGLFNSGTGNIGFFN;GLFNSGTGNIGFFNT;LFNSGTGNIGFFNTG;FNSGTGNIGFFNTGT;NSGTGNIGFFNTGTG;SGTGNIGFFNTGTGN;GTGNIGFFNTGTGNW;TGNIGFFNTGTGNWG;GNIGFFNTGTGNWGL;NIGFFNTGTGNWGLF;IGFFNTGTGNWGLFN;GFFNTGTGNWGLFNS;FFNTGTGNWGLFNSG;FNTGTGNWGLFNSGS;NTGTGNWGLFNSGSY;TGTGNWGLFNSGSYN;GTGNWGLFNSGSYNT;TGNWGLFNSGSYNTG;GNWGLFNSGSYNTGI;NWGLFNSGSYNTGIG;WGLFNSGSYNTGIGN;GLFNSGSYNTGIGNS;LFNSGSYNTGIGNSG;FNSGSYNTGIGNSGT;NSGSYNTGIGNSGTG;SGSYNTGIGNSGTGS;GSYNTGIGNSGTGST;SYNTGIGNSGTGSTG;YNTGIGNSGTGSTGL;NTGIGNSGTGSTGLF;TGIGNSGTGSTGLFN;GIGNSGTGSTGLFNA;IGNSGTGSTGLFNAG;GNSGTGSTGLFNAGS;NSGTGSTGLFNAGSF;SGTGSTGLFNAGSFN;GTGSTGLFNAGSFNT;TGSTGLFNAGSFNTG;GSTGLFNAGSFNTGL;STGLFNAGSFNTGLA;TGLFNAGSFNTGLAN;GLFNAGSFNTGLANA;LFNAGSFNTGLANAG;FNAGSFNTGLANAGS;NAGSFNTGLANAGSY;AGSFNTGLANAGSYN;GSFNTGLANAGSYNT;SFNTGLANAGS | |

Fig. 30 continued

| | | |
|---|---|---|
| | YNTG;FNTGLANAGSYNTGS;NTGLANAGSYNTGSL;TGLANAGSYNTGSLN;GLANAGSYNTGSLNA;LANAGSYNTGSLNAG;ANAGSYNTGSLNAGN;NAGSYNTGSLNAGNT;AGSYNTGSLNAGNTN;GSYNTGSLNAGNTNT;SYNTGSLNAGNTNTG;YNTGSLNAGNTNTGG;NTGSLNAGNTNTGGF;TGSLNAGNTNTGGFN;GSLNAGNTNTGGFNP;SLNAGNTNTGGFNPG;LNAGNTNTGGFNPGN;NAGNTNTGGFNPGNV;AGNTNTGGFNPGNVN;GNTNTGGFNPGNVNT;NTNTGGFNPGNVNTG;TNTGGFNPGNVNTGW;NTGGFNPGNVNTGWF;TGGFNPGNVNTGWFN;GGFNPGNVNTGWFNA;GFNPGNVNTGWFNAG;FNPGNVNTGWFNAGH;NPGNVNTGWFNAGHT;PGNVNTGWFNAGHTN;GNVNTGWFNAGHTNT;NVNTGWFNAGHTNTG;VNTGWFNAGHTNTGG;NTGWFNAGHTNTGGF;TGWFNAGHTNTGGFN;GWFNAGHTNTGGFNT;WFNAGHTNTGGFNTG;FNAGHTNTGGFNTGN;NAGHTNTGGFNTGNV;AGHTNTGGFNTGNVN;GHTNTGGFNTGNVNT;HTNTGGFNTGNVNTG;TNTGGFNTGNVNTGA;NTGGFNTGNVNTGAF;TGGFNTGNVNTGAFN;GGFNTGNVNTGAFNS;GFNTGNVNTGAFNSG;FNTGNVNTGAFNSGS;NTGNVNTGAFNSGSF;TGNVNTGAFNSGSFN;GNVNTGAFNSGSFNN;NVNTGAFNSGSFNNG;VNTGAFNSGSFNNGA;NTGAFNSGSFNNGAL;TGAFNSGSFNNGALW;GAFNSGSFNNGALWT;AFNSGSFNNGALWTG;FNSGSFNNGALWTGD;NSGSFNNGALWTGDH;SGSFNNGALWTGDHH;GSFNNGALWTGDHHG;SFNNGALWTGDHHGL;FNNGALWTGDHHGLV;NNGALWTGDHHGLVG;NGALWTGDHHGLVGF;GALWTGDHHGLVGFS;ALWTGDHHGLVGFSY;LWTGDHHGLVGFSYS;WTGDHHGLVGFSYSI;TGDHHGLVGFSYSIE;GDHHGLVGFSYSIEI;DHHGLVGFSYSIEIT;HHGLVGFSYSIEITG;HGLVGFSYSIEITGS;GLVGFSYSIEITGST;LVGFSYSIEITGSTL;VGFSYSIEITGSTLV;GFSYSIEITGSTLVD;FSYSIEITGSTLVDI;SYSIEITGSTLVDIN;YSIEITGSTLVDINE;SIEITGSTLVDINET;IEITGSTLVDINETL;EITGSTLVDINETLN;ITGSTLVDINETLNL;TGSTLVDINETLNLG;GSTLVDINETLNLGP;STLVDINETLNLGPV;TLVDINETLNLGPVH;LVDINETLNLGPVHI;VDINETLNLGPVHID;DINETLNLGPVHIDQ;INETLNLGPVHIDQI;NETLNLGPVHIDQID;ETLNLGPVHIDQIDI;TLNLGPVHIDQIDIP;LNLGPVHIDQIDIPG;NLGPVHIDQIDIPGM;LGPVHIDQIDIPGMS;GPVHIDQIDIPGMSL;PVHIDQIDIPGMSLF;VHIDQIDIPGMSLFD;HIDQIDIPGMSLFDI;IDQIDIPGMSLFDIH;DQIDIPGMSLFDIHE;QIDIPGMSLFDIHEL;IDIPGMSLFDIHELV;DIPGMSLFDIHELVN;IPGMSLFDIHELVNI;PGMSLFDIHELVNIG;GMSLFDIHELVNIGP;MSLFDIHELVNIGPF;SLFDIHELVNIGPFR;LFDIHELVNIGPFRI;FDIHELVNIGPFRIE;DIHELVNIGPFRIEP;IHELVNIGPFRIEPI;HELVNIGPFRIEPID;ELVNIGPFRIEPIDV;LVNIGPFRIEPIDVP;VNIGPFRIEPIDVPA;NIGPFRIEPIDVPAV;IGPFRIEPIDVPAVV;GPFRIEPIDVPAVVL;PFRIEPIDVPAVVLD;FRIEPIDVPAVVLDI;RIEPIDVPAVVLDIH;IEPIDVPAVVLDIHE;EPIDVPAVVLDIHET;PIDVPAVVLDIHETM;IDVPAVVLDIHETMV;DVPAVVLDIHETMVI;VPAVVLDIHETMVIP;PAVVLDIHETMVIPP;AVVLDIHETMVIPPI;VVLDIHETMVIPPIV;VLDIHETMVIPPIVF;LDIHETMVIPPIVFL;DIHETMVIPPIVFLP;IHETMVIPPIVFLPS;HETMVIPPIVFLPSM;ETMVIPPIVFLPSMT;TMVIPPIVFLPSMTI;MVIPPIVFLPSMTIG;VIPPIVFLPSMTIGG;IPPIVFLPSMTIGGQ;PPIVFLPSMTIGGQT;PIVFLPSMTIGGQTY;IVFLPSMTIGGQTYT;VFLPSMTIGGQTYTI;FLPSMTIGGQTYTIP;LPSMTIGGQTYTIPL;PSMTIGGQTYTIPLD;SMTIGGQTYTIPLDT;MTIGGQTYTIPLDTP;TIGGQTYTIPLDTPP;IGGQTYTIPLDTPPA;GGQTYTIPLDTPPAP;GQTYTIPLDTPPAPA;QTYTIPLDTPPAPAP;TYTIPLDTPPAPAPP;YTIPLDTPPAPAPPP;TIPLDTPPAPAPPPF;IPLDTPPAPAPPPFR;PLDTPPAPAPPPFRL;LDTPPAPAPPPFRLP;DTPPAPAPPPFRLPL;TPPAPAPPPFRLPLL;PPAPAPPPFRLPLLF;PAPAPPPFRLPLLFV;APAPPPFRLPLLFVN;PAPPPFRLPLLFVNA;APPPFRLPLLFVNAL;PPPFRLPLLFVNALG;PPFRLPLLFVNALGD;PFRLPLLFVNALGDN;FRLPLLFVNALGDNW;RLPLLFVNALGDNWI;LPLLFVNALGDNWIV;PLLFVNALGDNWIVG;LLFV | |

Fig. 30 continued

| | | |
|---|---|---|
| | NALGDNWIVGA;LFVNALGDNWIVGAS;FVNALGDNWIVGASN;VNALGDNWIVGASNS;NALGDNWIVGASNST;ALGDNWIVGASNSTG;LGDNWIVGASNSTGM;GDNWIVGASNSTGMS;DNWIVGASNSTGMSG;NWIVGASNSTGMSGG;WIVGASNSTGMSGGF;IVGASNSTGMSGGFV;VGASNSTGMSGGFVT;GASNSTGMSGGFVTA;ASNSTGMSGGFVTAP;SNSTGMSGGFVTAPT;NSTGMSGGFVTAPTQ;STGMSGGFVTAPTQG;TGMSGGFVTAPTQGI;GMSGGFVTAPTQGIL;MSGGFVTAPTQGILI;SGGFVTAPTQGILIH;GGFVTAPTQGILIHT;GFVTAPTQGILIHTG;FVTAPTQGILIHTGP;VTAPTQGILIHTGPS;TAPTQGILIHTGPSS;APTQGILIHTGPSSA;PTQGILIHTGPSSAT;TQGILIHTGPSSATT;QGILIHTGPSSATTG;GILIHTGPSSATTGS;ILIHTGPSSATTGSL;LIHTGPSSATTGSLA;IHTGPSSATTGSLAL;HTGPSSATTGSLALT;TGPSSATTGSLALTL;GPSSATTGSLALTLP;PSSATTGSLALTLPT;SSATTGSLALTLPTV;SATTGSLALTLPTVT;ATTGSLALTLPTVTI;TTGSLALTLPTVTIP;TGSLALTLPTVTIPT;GSLALTLPTVTIPTI;SLALTLPTVTIPTIT;LALTLPTVTIPTITT;ALTLPTVTIPTITTS;LTLPTVTIPTITTSP;TLPTVTIPTITTSPI;LPTVTIPTITTSPIP;PTVTIPTITTSPIPL;TVTIPTITTSPIPLK;VTIPTITTSPIPLKI;TIPTITTSPIPLKID;IPTITTSPIPLKIDV;PTITTSPIPLKIDVS;TITTSPIPLKIDVSG;ITTSPIPLKIDVSGG;TTSPIPLKIDVSGGL;TSPIPLKIDVSGGLP;SPIPLKIDVSGGLPA;PIPLKIDVSGGLPAF;IPLKIDVSGGLPAFT;PLKIDVSGGLPAFTL;LKIDVSGGLPAFTLF;KIDVSGGLPAFTLFP;IDVSGGLPAFTLFPG;DVSGGLPAFTLFPGG;VSGGLPAFTLFPGGL;SGGLPAFTLFPGGLN;GGLPAFTLFPGGLNI;GLPAFTLFPGGLNIP;LPAFTLFPGGLNIPQ;PAFTLFPGGLNIPQN;AFTLFPGGLNIPQNA;FTLFPGGLNIPQNAI;TLFPGGLNIPQNAIP;LFPGGLNIPQNAIPL;FPGGLNIPQNAIPLT;PGGLNIPQNAIPLTI;GGLNIPQNAIPLTID;GLNIPQNAIPLTIDA;LNIPQNAIPLTIDAS;NIPQNAIPLTIDASG;IPQNAIPLTIDASGV;PQNAIPLTIDASGVL;QNAIPLTIDASGVLD;NAIPLTIDASGVLDP;AIPLTIDASGVLDPI;IPLTIDASGVLDPIT;PLTIDASGVLDPITI;LTIDASGVLDPITIF;TIDASGVLDPITIFP;IDASGVLDPITIFPG;DASGVLDPITIFPGG;ASGVLDPITIFPGGF;SGVLDPITIFPGGFT;GVLDPITIFPGGFTI;VLDPITIFPGGFTID;LDPITIFPGGFTIDP;DPITIFPGGFTIDPL;PITIFPGGFTIDPLP;ITIFPGGFTIDPLPL;TIFPGGFTIDPLPLS;IFPGGFTIDPLPLSL;FPGGFTIDPLPLSLA;PGGFTIDPLPLSLAL;GGFTIDPLPLSLALN;GFTIDPLPLSLALNI;FTIDPLPLSLALNIS;TIDPLPLSLALNISV;IDPLPLSLALNISVP;DPLPLSLALNISVPD;PLPLSLALNISVPDS;LPLSLALNISVPDSS;PLSLALNISVPDSSV;LSLALNISVPDSSVP;SLALNISVPDSSVPI;LALNISVPDSSVPII;ALNISVPDSSVPIII;LNISVPDSSVPIIIV;NISVPDSSVPIIIVP;ISVPDSSVPIIIVPP;SVPDSSVPIIIVPPT;VPDSSVPIIIVPPTP;PDSSVPIIIVPPTPG;DSSVPIIIVPPTPGF;SSVPIIIVPPTPGFG;SVPIIIVPPTPGFGN;VPIIIVPPTPGFGNA;PIIIVPPTPGFGNAT;IIIVPPTPGFGNATA;IIVPPTPGFGNATAT;IVPPTPGFGNATATP;VPPTPGFGNATATPS;PPTPGFGNATATPSS;PTPGFGNATATPSSG;TPGFGNATATPSSGF;PGFGNATATPSSGFF;GFGNATATPSSGFFN;FGNATATPSSGFFNS;GNATATPSSGFFNSG;NATATPSSGFFNSGA;ATATPSSGFFNSGAG;TATPSSGFFNSGAGG;ATPSSGFFNSGAGGV;TPSSGFFNSGAGGVS;PSSGFFNSGAGGVSG;SSGFFNSGAGGVSGF;SGFFNSGAGGVSGFG;GFFNSGAGGVSGFGN;FFNSGAGGVSGFGNF;FNSGAGGVSGFGNFG;NSGAGGVSGFGNFGA;SGAGGVSGFGNFGAG;GAGGVSGFGNFGAGS;AGGVSGFGNFGAGSS;GGVSGFGNFGAGSSG;GVSGFGNFGAGSSGW;VSGFGNFGAGSSGWW;SGFGNFGAGSSGWWN;GFGNFGAGSSGWWNQ;FGNFGAGSSGWWNQA;GNFGAGSSGWWNQAH;NFGAGSSGWWNQAHA;FGAGSSGWWNQAHAA;GAGSSGWWNQAHAAL;AGSSGWWNQAHAALA;GSSGWWNQAHAALAG;SSGWWNQAHAALAGA;SGWWNQAHAALAGAG;GWWNQAHAALAGAGS;WWNQAHAALAGAGSG;WNQAHAALAGAGSGV;NQAHAALAGAGSGVL;QAHAALAGAGSGVLN;AHAALAGAGSGVLNV;HAALAGAGSGVLNVG;AALAGAGSGVLNVGT;ALAGAGSGVL | |

Fig. 30 continued

| | | |
|---|---|---|
| | NVGTL;LAGAGSGVLNVGTLN;AGAGSGVLNVGTLNS;GAGSGVLNVGTLNSG;AGSGVLNVGTLNSGV;GSGVLNVGTLNSGVL;SGVLNVGTLNSGVLN;GVLNVGTLNSGVLNV;VLNVGTLNSGVLNVG;LNVGTLNSGVLNVGS;NVGTLNSGVLNVGSG;VGTLNSGVLNVGSGI;GTLNSGVLNVGSGIS;TLNSGVLNVGSGISG;LNSGVLNVGSGISGL;NSGVLNVGSGISGLY;SGVLNVGSGISGLYN;GVLNVGSGISGLYNT;VLNVGSGISGLYNTA;LNVGSGISGLYNTAI;NVGSGISGLYNTAIV;VGSGISGLYNTAIVG;GSGISGLYNTAIVGL;SGISGLYNTAIVGLG;GISGLYNTAIVGLGT;ISGLYNTAIVGLGTP;SGLYNTAIVGLGTPA;GLYNTAIVGLGTPAL;LYNTAIVGLGTPALV;YNTAIVGLGTPALVS;NTAIVGLGTPALVSG;TAIVGLGTPALVSGA;AIVGLGTPALVSGAG;IVGLGTPALVSGAGN;VGLGTPALVSGAGNV;GLGTPALVSGAGNVG;LGTPALVSGAGNVGQ;GTPALVSGAGNVGQQ;TPALVSGAGNVGQQL;PALVSGAGNVGQQLS;ALVSGAGNVGQQLSG;LVSGAGNVGQQLSGV;VSGAGNVGQQLSGVL;SGAGNVGQQLSGVLA;GAGNVGQQLSGVLAA;AGNVGQQLSGVLAAG;GNVGQQLSGVLAAGT;NVGQQLSGVLAAGTA;VGQQLSGVLAAGTAL;GQQLSGVLAAGTALT;QQLSGVLAAGTALTQ;QLSGVLAAGTALTQS;LSGVLAAGTALTQSP;SGVLAAGTALTQSPI;GVLAAGTALTQSPII;VLAAGTALTQSPIIN;LAAGTALTQSPIINL;AAGTALTQSPIINLG;AGTALTQSPIINLGL;GTALTQSPIINLGLA;TALTQSPIINLGLAD;ALTQSPIINLGLADV;LTQSPIINLGLADVG;TQSPIINLGLADVGN;QSPIINLGLADVGNY;SPIINLGLADVGNYN;PIINLGLADVGNYNL;IINLGLADVGNYNLG;INLGLADVGNYNLGL;NLGLADVGNYNLGLG;LGLADVGNYNLGLGN;GLADVGNYNLGLGNV;LADVGNYNLGLGNVG;ADVGNYNLGLGNVGD;DVGNYNLGLGNVGDF;VGNYNLGLGNVGDFN;GNYNLGLGNVGDFNL;NYNLGLGNVGDFNLG;YNLGLGNVGDFNLGA;NLGLGNVGDFNLGAA;LGLGNVGDFNLGAAN;GLGNVGDFNLGAANL;LGNVGDFNLGAANLG;GNVGDFNLGAANLGD;NVGDFNLGAANLGDL;VGDFNLGAANLGDLN;GDFNLGAANLGDLNL;DFNLGAANLGDLNLG;FNLGAANLGDLNLGL;NLGAANLGDLNLGLG;LGAANLGDLNLGLGN;GAANLGDLNLGLGNI;AANLGDLNLGLGNIG;ANLGDLNLGLGNIGN;NLGDLNLGLGNIGNA;LGDLNLGLGNIGNAN;GDLNLGLGNIGNANV;DLNLGLGNIGNANVG;LNLGLGNIGNANVGF;NLGLGNIGNANVGFG;LGLGNIGNANVGFGN;GLGNIGNANVGFGNI;LGNIGNANVGFGNIG;GNIGNANVGFGNIGH;NIGNANVGFGNIGHG;IGNANVGFGNIGHGN;GNANVGFGNIGHGNV;NANVGFGNIGHGNVG;ANVGFGNIGHGNVGF;NVGFGNIGHGNVGFG;VGFGNIGHGNVGFGN;GFGNIGHGNVGFGNS;FGNIGHGNVGFGNSG;GNIGHGNVGFGNSGL;NIGHGNVGFGNSGLG;IGHGNVGFGNSGLGA;GHGNVGFGNSGLGAA;HGNVGFGNSGLGAAL;GNVGFGNSGLGAALG;NVGFGNSGLGAALGI;VGFGNSGLGAALGIG;GFGNSGLGAALGIGN;FGNSGLGAALGIGNI;GNSGLGAALGIGNIG;NSGLGAALGIGNIGL;SGLGAALGIGNIGLG;GLGAALGIGNIGLGN;LGAALGIGNIGLGNA;GAALGIGNIGLGNAG;AALGIGNIGLGNAGS;ALGIGNIGLGNAGST;LGIGNIGLGNAGSTN;GIGNIGLGNAGSTNV;IGNIGLGNAGSTNVG;GNIGLGNAGSTNVGL;NIGLGNAGSTNVGLA;IGLGNAGSTNVGLAN;GLGNAGSTNVGLANM;LGNAGSTNVGLANMG;GNAGSTNVGLANMGV;NAGSTNVGLANMGVG;AGSTNVGLANMGVGN;GSTNVGLANMGVGNI;STNVGLANMGVGNIG;TNVGLANMGVGNIGF;NVGLANMGVGNIGFA;VGLANMGVGNIGFAN;GLANMGVGNIGFANT;LANMGVGNIGFANTG;ANMGVGNIGFANTGT;NMGVGNIGFANTGTN;MGVGNIGFANTGTNN;GVGNIGFANTGTNNL;VGNIGFANTGTNNLG;GNIGFANTGTNNLGI;NIGFANTGTNNLGIG;IGFANTGTNNLGIGL;GFANTGTNNLGIGLT;FANTGTNNLGIGLTG;ANTGTNNLGIGLTGD;NTGTNNLGIGLTGDN;TGTNNLGIGLTGDNQ;GTNNLGIGLTGDNQT;TNNLGIGLTGDNQTG;NNLGIGLTGDNQTGI;NLGIGLTGDNQTGIG;LGIGLTGDNQTGIGG;GIGLTGDNQTGIGGL;IGLTGDNQTGIGGLN;GLTGDNQTGIGGLNS;LTGDNQTGIGGLNSG;TGDNQTGIGGLNSGA;GDNQTGIGGLNSGAG;DNQTGIGGLNSGAGN;NQTGIGGLN | |

Fig. 30 continued

| | | |
|---|---|---|
| | SGAGNI;QTGIGGLNSGAGNIG;TGIGGLNSGAGNIGL;GIGGLNSGAGNIGLF;IGGLNSGAGNIGLFN;GGLNSGAGNIGLFNS;GLNSGAGNIGLFNSG;LNSGAGNIGLFNSGT;NSGAGNIGLFNSGTG;SGAGNIGLFNSGTGN;GAGNIGLFNSGTGNI;AGNIGLFNSGTGNIG;GNIGLFNSGTGNIGF;NIGLFNSGTGNIGFF;IGLFNSGTGNIGFFN;GLFNSGTGNIGFFNS;LFNSGTGNIGFFNSG;FNSGTGNIGFFNSGT;NSGTGNIGFFNSGTG;SGTGNIGFFNSGTGN;GTGNIGFFNSGTGNW;TGNIGFFNSGTGNWG;GNIGFFNSGTGNWGL;NIGFFNSGTGNWGLF;IGFFNSGTGNWGLFN;GFFNSGTGNWGLFNS;FFNSGTGNWGLFNSG;FNSGTGNWGLFNSGS;NSGTGNWGLFNSGSF;SGTGNWGLFNSGSFN;GTGNWGLFNSGSFNT;TGNWGLFNSGSFNTG;GNWGLFNSGSFNTGI;NWGLFNSGSFNTGIG;WGLFNSGSFNTGIGN;GLFNSGSFNTGIGNS;LFNSGSFNTGIGNSG;FNSGSFNTGIGNSGT;NSGSFNTGIGNSGTG;SGSFNTGIGNSGTGS;GSFNTGIGNSGTGST;SFNTGIGNSGTGSTG;FNTGIGNSGTGSTGL;NTGIGNSGTGSTGLF;TGIGNSGTGSTGLFN;GIGNSGTGSTGLFNA;IGNSGTGSTGLFNAG;GNSGTGSTGLFNAGG;NSGTGSTGLFNAGGF;SGTGSTGLFNAGGFT;GTGSTGLFNAGGFTT;TGSTGLFNAGGFTTG;GSTGLFNAGGFTTGL;STGLFNAGGFTTGLA;TGLFNAGGFTTGLAN;GLFNAGGFTTGLANA;LFNAGGFTTGLANAG;FNAGGFTTGLANAGS;NAGGFTTGLANAGSY;AGGFTTGLANAGSYN;GGFTTGLANAGSYNT;GFTTGLANAGSYNTG;FTTGLANAGSYNTGS;TTGLANAGSYNTGSF;TGLANAGSYNTGSFN;GLANAGSYNTGSFNV;LANAGSYNTGSFNVG;ANAGSYNTGSFNVGD;NAGSYNTGSFNVGDT;AGSYNTGSFNVGDTN;GSYNTGSFNVGDTNT;SYNTGSFNVGDTNTG;YNTGSFNVGDTNTGG;NTGSFNVGDTNTGGF;TGSFNVGDTNTGGFN;GSFNVGDTNTGGFNP;SFNVGDTNTGGFNPG;FNVGDTNTGGFNPGS;NVGDTNTGGFNPGSI;VGDTNTGGFNPGSIN;GDTNTGGFNPGSINT;DTNTGGFNPGSINTG;TNTGGFNPGSINTGW;NTGGFNPGSINTGWF;TGGFNPGSINTGWFN;GGFNPGSINTGWFNT;GFNPGSINTGWFNTG;FNPGSINTGWFNTGN;NPGSINTGWFNTGNA;PGSINTGWFNTGNAN;GSINTGWFNTGNANT;SINTGWFNTGNANTG;INTGWFNTGNANTGI;NTGWFNTGNANTGIA;TGWFNTGNANTGIAN;GWFNTGNANTGIANS;WFNTGNANTGIANSG;FNTGNANTGIANSGN;NTGNANTGIANSGNV;TGNANTGIANSGNVD;GNANTGIANSGNVDT;NANTGIANSGNVDTG;ANTGIANSGNVDTGA;NTGIANSGNVDTGAL;TGIANSGNVDTGALM;GIANSGNVDTGALMS;IANSGNVDTGALMSG;ANSGNVDTGALMSGN;NSGNVDTGALMSGNF;SGNVDTGALMSGNFS;GNVDTGALMSGNFSN;NVDTGALMSGNFSNG;VDTGALMSGNFSNGI;DTGALMSGNFSNGIL;TGALMSGNFSNGILW;GALMSGNFSNGILWR;ALMSGNFSNGILWRG;LMSGNFSNGILWRGN;MSGNFSNGILWRGNY;SGNFSNGILWRGNYE;GNFSNGILWRGNYEG;NFSNGILWRGNYEGL;FSNGILWRGNYEGLF;SNGILWRGNYEGLFS;NGILWRGNYEGLFSY;GILWRGNYEGLFSYS;ILWRGNYEGLFSYSY;LWRGNYEGLFSYSYS;WRGNYEGLFSYSYSL;RGNYEGLFSYSYSLD;GNYEGLFSYSYSLDV;NYEGLFSYSYSLDVP;YEGLFSYSYSLDVPR;EGLFSYSYSLDVPRI;GLFSYSYSLDVPRIT;LFSYSYSLDVPRITI;FSYSYSLDVPRITIL;SYSYSLDVPRITILD;YSYSLDVPRITILDA;SYSLDVPRITILDAH;YSLDVPRITILDAHF;SLDVPRITILDAHFT;LDVPRITILDAHFTG;DVPRITILDAHFTGA;VPRITILDAHFTGAF;PRITILDAHFTGAFG;RITILDAHFTGAFGP;ITILDAHFTGAFGPV;TILDAHFTGAFGPVV;ILDAHFTGAFGPVVV;LDAHFTGAFGPVVVP;DAHFTGAFGPVVVPP;AHFTGAFGPVVVPPI;HFTGAFGPVVVPPIP;FTGAFGPVVVPPIPV;TGAFGPVVVPPIPVL;GAFGPVVVPPIPVLA;AFGPVVVPPIPVLAI;FGPVVVPPIPVLAIN;GPVVVPPIPVLAINA;PVVVPPIPVLAINAH;VVVPPIPVLAINAHL;VVPPIPVLAINAHLT;VPPIPVLAINAHLTG;PPIPVLAINAHLTGN;PIPVLAINAHLTGNA;IPVLAINAHLTGNAA;PVLAINAHLTGNAAM;VLAINAHLTGNAAMG;LAINAHLTGNAAMGA;AINAHLTGNAAMGAF;INAHLTGNAAMGAFT;NAHLTGNAAMGAFTI;AHLTGNAAMGAFTIP;HLTGNAA | |

Fig. 30 continued

| | | |
|---|---|---|
| | MGAFTIPQ;LTGNAAMGAFTIPQI;TGNAAMGAFTIPQID;GNAAMGAFTIPQIDI;NAAMGAFTIPQIDIP;AAMGAFTIPQIDIPA;AMGAFTIPQIDIPAL;MGAFTIPQIDIPALN;GAFTIPQIDIPALNP;AFTIPQIDIPALNPN;FTIPQIDIPALNPNV;TIPQIDIPALNPNVT;IPQIDIPALNPNVTG;PQIDIPALNPNVTGS;QIDIPALNPNVTGSV;IDIPALNPNVTGSVG;DIPALNPNVTGSVGF;IPALNPNVTGSVGFG;PALNPNVTGSVGFGP;ALNPNVTGSVGFGPI;LNPNVTGSVGFGPIA;NPNVTGSVGFGPIAV;PNVTGSVGFGPIAVP;NVTGSVGFGPIAVPS;VTGSVGFGPIAVPSV;TGSVGFGPIAVPSVT;GSVGFGPIAVPSVTI;SVGFGPIAVPSVTIP;VGFGPIAVPSVTIPA;GFGPIAVPSVTIPAL;FGPIAVPSVTIPALT;GPIAVPSVTIPALTA;PIAVPSVTIPALTAA;IAVPSVTIPALTAAR;AVPSVTIPALTAARA;VPSVTIPALTAARAV;PSVTIPALTAARAVL;SVTIPALTAARAVLD;VTIPALTAARAVLDM;TIPALTAARAVLDMA;IPALTAARAVLDMAA;PALTAARAVLDMAAS;ALTAARAVLDMAASV;LTAARAVLDMAASVG;TAARAVLDMAASVGA;AARAVLDMAASVGAT;ARAVLDMAASVGATS;RAVLDMAASVGATSE;AVLDMAASVGATSEI;VLDMAASVGATSEIE;LDMAASVGATSEIEP;DMAASVGATSEIEPF;MAASVGATSEIEPFI;AASVGATSEIEPFIV;ASVGATSEIEPFIVW;SVGATSEIEPFIVWT;VGATSEIEPFIVWTS;GATSEIEPFIVWTSS;ATSEIEPFIVWTSSG;TSEIEPFIVWTSSGA;SEIEPFIVWTSSGAI;EIEPFIVWTSSGAIG;IEPFIVWTSSGAIGP;EPFIVWTSSGAIGPT;PFIVWTSSGAIGPTW;FIVWTSSGAIGPTWY;IVWTSSGAIGPTWYS;VWTSSGAIGPTWYSV;WTSSGAIGPTWYSVG;TSSGAIGPTWYSVGR;SSGAIGPTWYSVGRI;SGAIGPTWYSVGRIY;GAIGPTWYSVGRIYN;AIGPTWYSVGRIYNA;IGPTWYSVGRIYNAG;GPTWYSVGRIYNAGD;PTWYSVGRIYNAGDL;TWYSVGRIYNAGDLF;WYSVGRIYNAGDLFV;YSVGRIYNAGDLFVG;SVGRIYNAGDLFVGG;VGRIYNAGDLFVGGN;GRIYNAGDLFVGGNI;RIYNAGDLFVGGNII;IYNAGDLFVGGNIIS;YNAGDLFVGGNIISG;NAGDLFVGGNIISGI;AGDLFVGGNIISGIP;GDLFVGGNIISGIPT;DLFVGGNIISGIPTL;LFVGGNIISGIPTLS;FVGGNIISGIPTLST;VGGNIISGIPTLSTT;GGNIISGIPTLSTTG;GNIISGIPTLSTTGP;NIISGIPTLSTTGPV;IISGIPTLSTTGPVH;ISGIPTLSTTGPVHA;SGIPTLSTTGPVHAV;GIPTLSTTGPVHAVF;IPTLSTTGPVHAVFN;PTLSTTGPVHAVFNA;TLSTTGPVHAVFNAA;LSTTGPVHAVFNAAS;STTGPVHAVFNAASQ;TTGPVHAVFNAASQA;TGPVHAVFNAASQAF;GPVHAVFNAASQAFN;PVHAVFNAASQAFNT;VHAVFNAASQAFNTP;HAVFNAASQAFNTPA;AVFNAASQAFNTPAL;VFNAASQAFNTPALN;FNAASQAFNTPALNI;NAASQAFNTPALNIH;AASQAFNTPALNIHQ;ASQAFNTPALNIHQI;SQAFNTPALNIHQIP;QAFNTPALNIHQIPL;AFNTPALNIHQIPLG;FNTPALNIHQIPLGF;NTPALNIHQIPLGFQ;TPALNIHQIPLGFQV;PALNIHQIPLGFQVP;ALNIHQIPLGFQVPG;LNIHQIPLGFQVPGS;NIHQIPLGFQVPGSI;IHQIPLGFQVPGSID;HQIPLGFQVPGSIDA;QIPLGFQVPGSIDAI;IPLGFQVPGSIDAIT;PLGFQVPGSIDAITL;LGFQVPGSIDAITLF;GFQVPGSIDAITLFP;FQVPGSIDAITLFPG;QVPGSIDAITLFPGG;VPGSIDAITLFPGGL;PGSIDAITLFPGGLT;GSIDAITLFPGGLTF;SIDAITLFPGGLTFP;IDAITLFPGGLTFPA;DAITLFPGGLTFPAN;AITLFPGGLTFPANS;ITLFPGGLTFPANSL;TLFPGGLTFPANSLL;LFPGGLTFPANSLLN;FPGGLTFPANSLLNL;PGGLTFPANSLLNLD;GGLTFPANSLLNLDV;GLTFPANSLLNLDVF;LTFPANSLLNLDVFV;TFPANSLLNLDVFVG;FPANSLLNLDVFVGT;PANSLLNLDVFVGTP;ANSLLNLDVFVGTPG;NSLLNLDVFVGTPGA;SLLNLDVFVGTPGAT;LLNLDVFVGTPGATI;LNLDVFVGTPGATIP;NLDVFVGTPGATIPA;LDVFVGTPGATIPAI;DVFVGTPGATIPAIT;VFVGTPGATIPAITF;FVGTPGATIPAITFP;VGTPGATIPAITFPE;GTPGATIPAITFPEI;TPGATIPAITFPEIP;PGATIPAITFPEIPA;GATIPAITFPEIPAN;ATIPAITFPEIPANA;TIPAITFPEIPANAD;IPAITFPEIPANADG;PAITFPEIPANADGE;AITFPEIPANADGEL;ITFPEIPANADGELY;TFPEIPANADGELYV;FPEIPANADGELYVI;PEIPANADGELYVIA;EIPANADGELYVIAG;IPANADGELYVIAGD;PANADGELYVIAGDI;ANADGELYVIAGDIP;NADGELYVIAGDI | |

Fig. 30 continued

| | | |
|---|---|---|
| | PL;ADGELYVIAGDIPLI;DGELYVIAGDIPLIN;GELYVIAGDIPLINI;ELYVIAGDIPLINIP;LYVIAGDIPLINIPP;YVIAGDIPLINIPPT;VIAGDIPLINIPPTP;IAGDIPLINIPPTPG;AGDIPLINIPPTPGI;GDIPLINIPPTPGIG;DIPLINIPPTPGIGN;IPLINIPPTPGIGNT;PLINIPPTPGIGNTT;LINIPPTPGIGNTTT;INIPPTPGIGNTTTV;NIPPTPGIGNTTTVP;IPPTPGIGNTTTVPS;PPTPGIGNTTTVPSS;PTPGIGNTTTVPSSG;TPGIGNTTTVPSSGF;PGIGNTTTVPSSGFF;GIGNTTTVPSSGFFN;IGNTTTVPSSGFFNT;GNTTTVPSSGFFNTG;NTTTVPSSGFFNTGA;TTTVPSSGFFNTGAG;TTVPSSGFFNTGAGG;TVPSSGFFNTGAGGG;VPSSGFFNTGAGGGS;PSSGFFNTGAGGGSG;SSGFFNTGAGGGSGF;SGFFNTGAGGGSGFG;GFFNTGAGGGSGFGN;FFNTGAGGGSGFGNF;FNTGAGGGSGFGNFG;NTGAGGGSGFGNFGA;TGAGGGSGFGNFGAN;GAGGGSGFGNFGANM;AGGGSGFGNFGANMS;GGGSGFGNFGANMSG;GGSGFGNFGANMSGW;GSGFGNFGANMSGWW;SGFGNFGANMSGWWN;GFGNFGANMSGWWNQ;FGNFGANMSGWWNQA;GNFGANMSGWWNQAH;NFGANMSGWWNQAHT;FGANMSGWWNQAHTA;GANMSGWWNQAHTAL;ANMSGWWNQAHTALA;NMSGWWNQAHTALAG;MSGWWNQAHTALAGA;SGWWNQAHTALAGAG;GWWNQAHTALAGAGS;WWNQAHTALAGAGSG;WNQAHTALAGAGSGI;NQAHTALAGAGSGIA;QAHTALAGAGSGIAN;AHTALAGAGSGIANV;HTALAGAGSGIANVG;TALAGAGSGIANVGT;ALAGAGSGIANVGTL;LAGAGSGIANVGTLH;AGAGSGIANVGTLHS;GAGSGIANVGTLHSG;AGSGIANVGTLHSGV;GSGIANVGTLHSGVL;SGIANVGTLHSGVLN;GIANVGTLHSGVLNL;IANVGTLHSGVLNLG;ANVGTLHSGVLNLGS;NVGTLHSGVLNLGSG;VGTLHSGVLNLGSGL;GTLHSGVLNLGSGLS;TLHSGVLNLGSGLSG;LHSGVLNLGSGLSGI;HSGVLNLGSGLSGIY;SGVLNLGSGLSGIYN;GVLNLGSGLSGIYNT;VLNLGSGLSGIYNTS;LNLGSGLSGIYNTST;NLGSGLSGIYNTSTL;LGSGLSGIYNTSTLP;GSGLSGIYNTSTLPL;SGLSGIYNTSTLPLG;GLSGIYNTSTLPLGT;LSGIYNTSTLPLGTP;SGIYNTSTLPLGTPA;GIYNTSTLPLGTPAL;IYNTSTLPLGTPALV;YNTSTLPLGTPALVS;NTSTLPLGTPALVSG;TSTLPLGTPALVSGL;STLPLGTPALVSGLG;TLPLGTPALVSGLGN;LPLGTPALVSGLGNV;PLGTPALVSGLGNVG;LGTPALVSGLGNVGD;GTPALVSGLGNVGDH;TPALVSGLGNVGDHL;PALVSGLGNVGDHLS;ALVSGLGNVGDHLSG;LVSGLGNVGDHLSGL;VSGLGNVGDHLSGLL;SGLGNVGDHLSGLLA;GLGNVGDHLSGLLAS;LGNVGDHLSGLLASN;GNVGDHLSGLLASNV;NVGDHLSGLLASNVG;VGDHLSGLLASNVGQ;GDHLSGLLASNVGQN;DHLSGLLASNVGQNP;HLSGLLASNVGQNPI;LSGLLASNVGQNPIT;SGLLASNVGQNPITI;GLLASNVGQNPITIV;LLASNVGQNPITIVN;LASNVGQNPITIVNI;ASNVGQNPITIVNIG;SNVGQNPITIVNIGL;NVGQNPITIVNIGLA;VGQNPITIVNIGLAN;GQNPITIVNIGLANV;QNPITIVNIGLANVG;NPITIVNIGLANVGN;PITIVNIGLANVGNG;ITIVNIGLANVGNGN;TIVNIGLANVGNGNV;IVNIGLANVGNGNVG;VNIGLANVGNGNVGL;NIGLANVGNGNVGLG;IGLANVGNGNVGLGN;GLANVGNGNVGLGNI;LANVGNGNVGLGNIG;ANVGNGNVGLGNIGN;NVGNGNVGLGNIGNL;VGNGNVGLGNIGNLN;GNGNVGLGNIGNLNL;NGNVGLGNIGNLNLG;GNVGLGNIGNLNLGA;NVGLGNIGNLNLGAA;VGLGNIGNLNLGAAN;GLGNIGNLNLGAANI;LGNIGNLNLGAANIG;GNIGNLNLGAANIGD;NIGNLNLGAANIGDV;IGNLNLGAANIGDVN;GNLNLGAANIGDVNL;NLNLGAANIGDVNLG;LNLGAANIGDVNLGF;NLGAANIGDVNLGFG;LGAANIGDVNLGFGN;GAANIGDVNLGFGNI;AANIGDVNLGFGNIG;ANIGDVNLGFGNIGD;NIGDVNLGFGNIGDV;IGDVNLGFGNIGDVN;GDVNLGFGNIGDVNL;DVNLGFGNIGDVNLG;VNLGFGNIGDVNLGF;NLGFGNIGDVNLGFG;LGFGNIGDVNLGFGN;GFGNIGDVNLGFGNI;FGNIGDVNLGFGNIG;GNIGDVNLGFGNIGG;NIGDVNLGFGNIGGG;IGDVNLGFGNIGGGN;GDVNLGFGNIGGGNV;DVNLGFGNIGGGNVG;VNLGFGNIGGGNVGF;NLGFGNIGGGNVGFG;LGFGNIGGGNVGFGN;GFGNIGGGNVGFGNI;FGNIGGGNVGFGNIG;GNIGGGNVGFGNIGD;NIG | |

Fig. 30 continued

| | | |
|---|---|---|
| | GGNVGFGNIGDA;IGGGNVGFGNIGDAN;GGGNVGFGNIGDANF;GGNVGFGNIGDANFG;GNVGFGNIGDANFGF;NVGFGNIGDANFGFG;VGFGNIGDANFGFGN;GFGNIGDANFGFGNS;FGNIGDANFGFGNSG;GNIGDANFGFGNSGL;NIGDANFGFGNSGLA;IGDANFGFGNSGLAA;GDANFGFGNSGLAAG;DANFGFGNSGLAAGL;ANFGFGNSGLAAGLA;NFGFGNSGLAAGLAG;FGFGNSGLAAGLAGM;GFGNSGLAAGLAGMG;FGNSGLAAGLAGMGN;GNSGLAAGLAGMGNI;NSGLAAGLAGMGNIG;SGLAAGLAGMGNIGL;GLAAGLAGMGNIGLG;LAAGLAGMGNIGLGN;AAGLAGMGNIGLGNA;AGLAGMGNIGLGNAG;GLAGMGNIGLGNAGS;LAGMGNIGLGNAGSG;AGMGNIGLGNAGSGN;GMGNIGLGNAGSGNV;MGNIGLGNAGSGNVG;GNIGLGNAGSGNVGW;NIGLGNAGSGNVGWA;IGLGNAGSGNVGWAN;GLGNAGSGNVGWANM;LGNAGSGNVGWANMG;GNAGSGNVGWANMGL;NAGSGNVGWANMGLG;AGSGNVGWANMGLGN;GSGNVGWANMGLGNI;SGNVGWANMGLGNIG;GNVGWANMGLGNIGF;NVGWANMGLGNIGFG;VGWANMGLGNIGFGN;GWANMGLGNIGFGNT;WANMGLGNIGFGNTG;ANMGLGNIGFGNTGT;NMGLGNIGFGNTGTN;MGLGNIGFGNTGTNN;GLGNIGFGNTGTNNL;LGNIGFGNTGTNNLG;GNIGFGNTGTNNLGI;NIGFGNTGTNNLGIG;IGFGNTGTNNLGIGL;GFGNTGTNNLGIGLT;FGNTGTNNLGIGLTG;GNTGTNNLGIGLTGD;NTGTNNLGIGLTGDN;TGTNNLGIGLTGDNQ;GTNNLGIGLTGDNQS;TNNLGIGLTGDNQSG;NNLGIGLTGDNQSGI;NLGIGLTGDNQSGIG;LGIGLTGDNQSGIGG;GIGLTGDNQSGIGGL;IGLTGDNQSGIGGLN;GLTGDNQSGIGGLNS;LTGDNQSGIGGLNSG;TGDNQSGIGGLNSGT;GDNQSGIGGLNSGTG;DNQSGIGGLNSGTGN;NQSGIGGLNSGTGNI;QSGIGGLNSGTGNIG;SGIGGLNSGTGNIGL;GIGGLNSGTGNIGLF;IGGLNSGTGNIGLFN;GGLNSGTGNIGLFNS;GLNSGTGNIGLFNSG;LNSGTGNIGLFNSGT;NSGTGNIGLFNSGTG;SGTGNIGLFNSGTGN;GTGNIGLFNSGTGNI;TGNIGLFNSGTGNIG;GNIGLFNSGTGNIGF;NIGLFNSGTGNIGFF;IGLFNSGTGNIGFFN;GLFNSGTGNIGFFNS;LFNSGTGNIGFFNSG;FNSGTGNIGFFNSGT;NSGTGNIGFFNSGTA;SGTGNIGFFNSGTAN;GTGNIGFFNSGTANF;TGNIGFFNSGTANFG;GNIGFFNSGTANFGL;NIGFFNSGTANFGLF;IGFFNSGTANFGLFN;GFFNSGTANFGLFNS;FFNSGTANFGLFNSG;FNSGTANFGLFNSGS;NSGTANFGLFNSGSY;SGTANFGLFNSGSYN;GTANFGLFNSGSYNT;TANFGLFNSGSYNTG;ANFGLFNSGSYNTGI;NFGLFNSGSYNTGIG;FGLFNSGSYNTGIGN;GLFNSGSYNTGIGNS;LFNSGSYNTGIGNSG;FNSGSYNTGIGNSGV;NSGSYNTGIGNSGVA;SGSYNTGIGNSGVAS;GSYNTGIGNSGVAST;SYNTGIGNSGVASTG;YNTGIGNSGVASTGL;NTGIGNSGVASTGLV;TGIGNSGVASTGLVN;GIGNSGVASTGLVNA;IGNSGVASTGLVNAG;GNSGVASTGLVNAGG;NSGVASTGLVNAGGF;SGVASTGLVNAGGFN;GVASTGLVNAGGFNT;VASTGLVNAGGFNTG;ASTGLVNAGGFNTGV;STGLVNAGGFNTGVA;TGLVNAGGFNTGVAN;GLVNAGGFNTGVANA;LVNAGGFNTGVANAG;VNAGGFNTGVANAGS;NAGGFNTGVANAGSY;AGGFNTGVANAGSYN;GGFNTGVANAGSYNT;GFNTGVANAGSYNTG;FNTGVANAGSYNTGS;NTGVANAGSYNTGSF;TGVANAGSYNTGSFN;GVANAGSYNTGSFNA;VANAGSYNTGSFNAG;ANAGSYNTGSFNAGD;NAGSYNTGSFNAGDT;AGSYNTGSFNAGDTN;GSYNTGSFNAGDTNT;SYNTGSFNAGDTNTG;YNTGSFNAGDTNTGG;NTGSFNAGDTNTGGF;TGSFNAGDTNTGGFN;GSFNAGDTNTGGFNP;SFNAGDTNTGGFNPG;FNAGDTNTGGFNPGS;NAGDTNTGGFNPGST;AGDTNTGGFNPGSTN;GDTNTGGFNPGSTNT;DTNTGGFNPGSTNTG;TNTGGFNPGSTNTGW;NTGGFNPGSTNTGWF;TGGFNPGSTNTGWFN;GGFNPGSTNTGWFNT;GFNPGSTNTGWFNTG;FNPGSTNTGWFNTGN;NPGSTNTGWFNTGNA;PGSTNTGWFNTGNAN;GSTNTGWFNTGNANT;STNTGWFNTGNANTG;TNTGWFNTGNANTGV;NTGWFNTGNANTGVA;TGWFNTGNANTGVAN;GWFNTGNANTGVANA;WFNTGNANTGVANAG;FNTGNANTGVANAGN;NTGNANTGVA | |

Fig. 30 continued

| | | |
|---|---|---|
| | NAGNV;TGNANTGVANAGNVN;GNANTGVANAGNVNT;NANTGVANAGNVNTG;ANTGVANAGNVNTGA;NTGVANAGNVNTGAL;TGVANAGNVNTGALI;GVANAGNVNTGALIT;VANAGNVNTGALITG;ANAGNVNTGALITGN;NAGNVNTGALITGNF;AGNVNTGALITGNFS;GNVNTGALITGNFSN;NVNTGALITGNFSNG;VNTGALITGNFSNGI;NTGALITGNFSNGIL;TGALITGNFSNGILW;GALITGNFSNGILWR;ALITGNFSNGILWRG;LITGNFSNGILWRGN;ITGNFSNGILWRGNY;TGNFSNGILWRGNYE;GNFSNGILWRGNYEG;NFSNGILWRGNYEGL;FSNGILWRGNYEGLA;SNGILWRGNYEGLAG;NGILWRGNYEGLAGF;GILWRGNYEGLAGFS;ILWRGNYEGLAGFSF;LWRGNYEGLAGFSFG;WRGNYEGLAGFSFGY;RGNYEGLAGFSFGYP;GNYEGLAGFSFGYPI;NYEGLAGFSFGYPIP;YEGLAGFSFGYPIPL;EGLAGFSFGYPIPLF;GLAGFSFGYPIPLFP;LAGFSFGYPIPLFPA;AGFSFGYPIPLFPAV;GFSFGYPIPLFPAVG;FSFGYPIPLFPAVGA;SFGYPIPLFPAVGAD;FGYPIPLFPAVGADV;GYPIPLFPAVGADVT;YPIPLFPAVGADVTG;PIPLFPAVGADVTGD;IPLFPAVGADVTGDI;PLFPAVGADVTGDIG;LFPAVGADVTGDIGP;FPAVGADVTGDIGPA;PAVGADVTGDIGPAT;AVGADVTGDIGPATI;VGADVTGDIGPATII;GADVTGDIGPATIIP;ADVTGDIGPATIIPP;DVTGDIGPATIIPPI;VTGDIGPATIIPPIH;TGDIGPATIIPPIHI;GDIGPATIIPPIHIP;DIGPATIIPPIHIPS;IGPATIIPPIHIPSI;GPATIIPPIHIPSIP;PATIIPPIHIPSIPL;ATIIPPIHIPSIPLG;TIIPPIHIPSIPLGF;IIPPIHIPSIPLGFA;IPPIHIPSIPLGFAA;PPIHIPSIPLGFAAI;PIHIPSIPLGFAAIG;IHIPSIPLGFAAIGH;HIPSIPLGFAAIGHI;IPSIPLGFAAIGHIG;PSIPLGFAAIGHIGP;SIPLGFAAIGHIGPI;IPLGFAAIGHIGPIS;PLGFAAIGHIGPISI;LGFAAIGHIGPISIP;GFAAIGHIGPISIPN;FAAIGHIGPISIPNI;AAIGHIGPISIPNIA;AIGHIGPISIPNIAI;IGHIGPISIPNIAIP;GHIGPISIPNIAIPS;HIGPISIPNIAIPSI;IGPISIPNIAIPSIH;GPISIPNIAIPSIHL;PISIPNIAIPSIHLG;ISIPNIAIPSIHLGI;SIPNIAIPSIHLGID;IPNIAIPSIHLGIDP;PNIAIPSIHLGIDPT;NIAIPSIHLGIDPTF;IAIPSIHLGIDPTFD;AIPSIHLGIDPTFDV;IPSIHLGIDPTFDVG;PSIHLGIDPTFDVGP;SIHLGIDPTFDVGPI;IHLGIDPTFDVGPIT;HLGIDPTFDVGPITV;LGIDPTFDVGPITVD;GIDPTFDVGPITVDP;IDPTFDVGPITVDPI;DPTFDVGPITVDPIT;PTFDVGPITVDPITL;TFDVGPITVDPITLT;FDVGPITVDPITLTI;DVGPITVDPITLTIP;VGPITVDPITLTIPG;GPITVDPITLTIPGL;PITVDPITLTIPGLS;ITVDPITLTIPGLSL;TVDPITLTIPGLSLD;VDPITLTIPGLSLDA;DPITLTIPGLSLDAA;PITLTIPGLSLDAAV;ITLTIPGLSLDAAVS;TLTIPGLSLDAAVSE;LTIPGLSLDAAVSEI;TIPGLSLDAAVSEIR;IPGLSLDAAVSEIRM;PGLSLDAAVSEIRMT;GLSLDAAVSEIRMTS;LSLDAAVSEIRMTSG;SLDAAVSEIRMTSGS;LDAAVSEIRMTSGSS;DAAVSEIRMTSGSSS;AAVSEIRMTSGSSSG;AVSEIRMTSGSSSGF;VSEIRMTSGSSSGFK;SEIRMTSGSSSGFKV;EIRMTSGSSSGFKVR;IRMTSGSSSGFKVRP;RMTSGSSSGFKVRPS;MTSGSSSGFKVRPSF;TSGSSSGFKVRPSFS;SGSSSGFKVRPSFSF;GSSSGFKVRPSFSFF;SSSGFKVRPSFSFFA;SSGFKVRPSFSFFAV;SGFKVRPSFSFFAVG;GFKVRPSFSFFAVGP;FKVRPSFSFFAVGPD;KVRPSFSFFAVGPDG;VRPSFSFFAVGPDGM;RPSFSFFAVGPDGMP;PSFSFFAVGPDGMPG;SFSFFAVGPDGMPGG;FSFFAVGPDGMPGGE;SFFAVGPDGMPGGEV;FFAVGPDGMPGGEVS;FAVGPDGMPGGEVSI;AVGPDGMPGGEVSIL;VGPDGMPGGEVSILQ;GPDGMPGGEVSILQP;PDGMPGGEVSILQPF;DGMPGGEVSILQPFT;GMPGGEVSILQPFTV;MPGGEVSILQPFTVA;PGGEVSILQPFTVAP;GGEVSILQPFTVAPI;GEVSILQPFTVAPIN;EVSILQPFTVAPINL;VSILQPFTVAPINLN;SILQPFTVAPINLNP;ILQPFTVAPINLNPT;LQPFTVAPINLNPTT;QPFTVAPINLNPTTL;PFTVAPINLNPTTLH;FTVAPINLNPTTLHF;TVAPINLNPTTLHFP;VAPINLNPTTLHFPG;APINLNPTTLHFPGF;PINLNPTTLHFPGFT;INLNPTTLHFPGFTI;NLNPTTLHFPGFTIP;LNPTTLHFPGFTIPT;NPTTLHFPGFTIPTG;PTTLHFPGFTIPTGP;TTLHFPGFTIPTGPI;TLHFPGFTIPTGPIH;LHFPGFTIPTGPIHI;HFPGFTIPTGPIHIG;FPGFTIPTGPIHIGL;PGFTIPTGPIHIGLP;GFTIPTGPIHIGLPL;FTIPTGP | |

Fig. 30 continued

| | | |
|---|---|---|
| | IHIGLPLS;TIPTGPIHIGLPLSL;IPTGPIHIGLPLSLT;PTGPIHIGLPLSLTI;TGPIHIGLPLSLTIP;GPIHIGLPLSLTIPG;PIHIGLPLSLTIPGF;IHIGLPLSLTIPGFT;HIGLPLSLTIPGFTI;IGLPLSLTIPGFTIP;GLPLSLTIPGFTIPG;LPLSLTIPGFTIPGG;PLSLTIPGFTIPGGT;LSLTIPGFTIPGGTL;SLTIPGFTIPGGTLI;LTIPGFTIPGGTLIP;TIPGFTIPGGTLIPQ;IPGFTIPGGTLIPQL;PGFTIPGGTLIPQLP;GFTIPGGTLIPQLPL;FTIPGGTLIPQLPLG;TIPGGTLIPQLPLGL;IPGGTLIPQLPLGLG;PGGTLIPQLPLGLGL;GGTLIPQLPLGLGLS;GTLIPQLPLGLGLSG;TLIPQLPLGLGLSGG;LIPQLPLGLGLSGGT;IPQLPLGLGLSGGTP;PQLPLGLGLSGGTPP;QLPLGLGLSGGTPPF;LPLGLGLSGGTPPFD;PLGLGLSGGTPPFDL;LGLGLSGGTPPFDLP;GLGLSGGTPPFDLPT;LGLSGGTPPFDLPTV;GLSGGTPPFDLPTVV;LSGGTPPFDLPTVVI;SGGTPPFDLPTVVID;GGTPPFDLPTVVIDR;GTPPFDLPTVVIDRI;TPPFDLPTVVIDRIP;PPFDLPTVVIDRIPV;PFDLPTVVIDRIPVE;FDLPTVVIDRIPVEL;DLPTVVIDRIPVELH;LPTVVIDRIPVELHA;PTVVIDRIPVELHAS;TVVIDRIPVELHAST;VVIDRIPVELHASTT;VIDRIPVELHASTTI;IDRIPVELHASTTIG;DRIPVELHASTTIGP;RIPVELHASTTIGPV;IPVELHASTTIGPVS;PVELHASTTIGPVSL;VELHASTTIGPVSLP;ELHASTTIGPVSLPI;LHASTTIGPVSLPIF;HASTTIGPVSLPIFG;ASTTIGPVSLPIFGF;STTIGPVSLPIFGFG;TTIGPVSLPIFGFGG;TIGPVSLPIFGFGGA;IGPVSLPIFGFGGAP;GPVSLPIFGFGGAPG;PVSLPIFGFGGAPGF;VSLPIFGFGGAPGFG;SLPIFGFGGAPGFGN;LPIFGFGGAPGFGND;PIFGFGGAPGFGNDT;IFGFGGAPGFGNDTT;FGFGGAPGFGNDTTA;GFGGAPGFGNDTTAP;FGGAPGFGNDTTAPS;GGAPGFGNDTTAPSS;GAPGFGNDTTAPSSG;APGFGNDTTAPSSGF;PGFGNDTTAPSSGFF;GFGNDTTAPSSGFFN;FGNDTTAPSSGFFNT;GNDTTAPSSGFFNTG;NDTTAPSSGFFNTGG;DTTAPSSGFFNTGGG;TTAPSSGFFNTGGGG;TAPSSGFFNTGGGGG;APSSGFFNTGGGGGS;PSSGFFNTGGGGGSG;SSGFFNTGGGGGSGF;SGFFNTGGGGGSGFS;GFFNTGGGGGSGFSN;FFNTGGGGGSGFSNS;FNTGGGGGSGFSNSG;NTGGGGGSGFSNSGS;TGGGGGSGFSNSGSG;GGGGGSGFSNSGSGM;GGGGSGFSNSGSGMS;GGGSGFSNSGSGMSG;GGSGFSNSGSGMSGV;GSGFSNSGSGMSGVL;SGFSNSGSGMSGVLN;GFSNSGSGMSGVLNA;FSNSGSGMSGVLNAI;SNSGSGMSGVLNAIS;NSGSGMSGVLNAISD;SGSGMSGVLNAISDP;GSGMSGVLNAISDPL;SGMSGVLNAISDPLL;GMSGVLNAISDPLLG;MSGVLNAISDPLLGS;SGVLNAISDPLLGSA;GVLNAISDPLLGSAS;VLNAISDPLLGSASG;LNAISDPLLGSASGF;NAISDPLLGSASGFA;AISDPLLGSASGFAN;ISDPLLGSASGFANF;SDPLLGSASGFANFG;DPLLGSASGFANFGT;PLLGSASGFANFGTQ;LLGSASGFANFGTQL;LGSASGFANFGTQLS;GSASGFANFGTQLSG;SASGFANFGTQLSGI;ASGFANFGTQLSGIL;SGFANFGTQLSGILN;GFANFGTQLSGILNR;FANFGTQLSGILNRG;ANFGTQLSGILNRGA;NFGTQLSGILNRGAG;FGTQLSGILNRGAGI;GTQLSGILNRGAGIS;TQLSGILNRGAGISG;QLSGILNRGAGISGV;LSGILNRGAGISGVY;SGILNRGAGISGVYN;GILNRGAGISGVYNT;ILNRGAGISGVYNTG;LNRGAGISGVYNTGT;NRGAGISGVYNTGTL;RGAGISGVYNTGTLG;GAGISGVYNTGTLGL;AGISGVYNTGTLGLV;GISGVYNTGTLGLVT;ISGVYNTGTLGLVTS;SGVYNTGTLGLVTSA;GVYNTGTLGLVTSAF;VYNTGTLGLVTSAFV;YNTGTLGLVTSAFVS;NTGTLGLVTSAFVSG;TGTLGLVTSAFVSGF;GTLGLVTSAFVSGFM;TLGLVTSAFVSGFMN;LGLVTSAFVSGFMNV;GLVTSAFVSGFMNVG;LVTSAFVSGFMNVGQ;VTSAFVSGFMNVGQQ;TSAFVSGFMNVGQQL;SAFVSGFMNVGQQLS;AFVSGFMNVGQQLSG;FVSGFMNVGQQLSGL;VSGFMNVGQQLSGLL;SGFMNVGQQLSGLLF;GFMNVGQQLSGLLFA;FMNVGQQLSGLLFAG;MNVGQQLSGLLFAGT;NVGQQLSGLLFAGTG;VGQQLSGLLFAGTGP;<br><br>16 mers: | |

Fig. 30 continued

| | | |
|---|---|---|
| | MNFPVLPPEINSVLMY;NFPVLPPEINSVLMYS;FPVLPPEINSVLMYSG;PVLPPEINSVLMYSGA;VLPPEINSVLMYSGAG;LPPEINSVLMYSGAGS;PPEINSVLMYSGAGSS;PEINSVLMYSGAGSSP;EINSVLMYSGAGSSPL;INSVLMYSGAGSSPLL;NSVLMYSGAGSSPLLA;SVLMYSGAGSSPLLAA;VLMYSGAGSSPLLAAA;LMYSGAGSSPLLAAAA;MYSGAGSSPLLAAAAA;YSGAGSSPLLAAAAAW;SGAGSSPLLAAAAAWD;GAGSSPLLAAAAAWDG;AGSSPLLAAAAAWDGL;GSSPLLAAAAAWDGLA;SSPLLAAAAAWDGLAE;SPLLAAAAAWDGLAEE;PLLAAAAAWDGLAEEL;LLAAAAAWDGLAEELG;LAAAAAWDGLAEELGS;AAAAAWDGLAEELGSA;AAAAWDGLAEELGSAA;AAAWDGLAEELGSAAV;AAWDGLAEELGSAAVS;AWDGLAEELGSAAVSF;WDGLAEELGSAAVSFG;DGLAEELGSAAVSFGQ;GLAEELGSAAVSFGQV;LAEELGSAAVSFGQVT;AEELGSAAVSFGQVTS;EELGSAAVSFGQVTSG;ELGSAAVSFGQVTSGL;LGSAAVSFGQVTSGLT;GSAAVSFGQVTSGLTA;SAAVSFGQVTSGLTAG;AAVSFGQVTSGLTAGV;AVSFGQVTSGLTAGVW;VSFGQVTSGLTAGVWQ;SFGQVTSGLTAGVWQG;FGQVTSGLTAGVWQGA;GQVTSGLTAGVWQGAA;QVTSGLTAGVWQGAAA;VTSGLTAGVWQGAAAA;TSGLTAGVWQGAAAAA;SGLTAGVWQGAAAAAM;GLTAGVWQGAAAAAMA;LTAGVWQGAAAAAMAA;TAGVWQGAAAAAMAAA;AGVWQGAAAAAMAAAA;GVWQGAAAAAMAAAAA;VWQGAAAAAMAAAAAP;WQGAAAAAMAAAAAPY;QGAAAAAMAAAAAPYA;GAAAAAMAAAAAPYAG;AAAAAMAAAAAPYAGW;AAAAMAAAAAPYAGWL;AAAMAAAAAPYAGWLG;AAMAAAAAPYAGWLGS;AMAAAAAPYAGWLGSV;MAAAAAPYAGWLGSVA;AAAAAPYAGWLGSVAA;AAAAPYAGWLGSVAAQ;AAAPYAGWLGSVAAQA;AAPYAGWLGSVAAQAV;APYAGWLGSVAAQAVA;PYAGWLGSVAAQAVAV;YAGWLGSVAAQAVAVA;AGWLGSVAAQAVAVAG;GWLGSVAAQAVAVAGQ;WLGSVAAQAVAVAGQA;LGSVAAQAVAVAGQAR;GSVAAQAVAVAGQARA;SVAAQAVAVAGQARAA;VAAQAVAVAGQARAAV;AAQAVAVAGQARAAVA;AQAVAVAGQARAAVAA;QAVAVAGQARAAVAAF;AVAVAGQARAAVAAFE;VAVAGQARAAVAAFEA;AVAGQARAAVAAFEAA;VAGQARAAVAAFEAAL;AGQARAAVAAFEAALA;GQARAAVAAFEAALAA;QARAAVAAFEAALAAT;ARAAVAAFEAALAATV;RAAVAAFEAALAATVD;AAVAAFEAALAATVDP;AVAAFEAALAATVDPA;VAAFEAALAATVDPAA;AAFEAALAATVDPAAV;AFEAALAATVDPAAVA;FEAALAATVDPAAVAV;EAALAATVDPAAVAVN;AALAATVDPAAVAVNR;ALAATVDPAAVAVNRM;LAATVDPAAVAVNRMA;AATVDPAAVAVNRMAM;ATVDPAAVAVNRMAMR;TVDPAAVAVNRMAMRA;VDPAAVAVNRMAMRAL;DPAAVAVNRMAMRALA;PAAVAVNRMAMRALAM;AAVAVNRMAMRALAMS;AVAVNRMAMRALAMSN;VAVNRMAMRALAMSNL;AVNRMAMRALAMSNLL;VNRMAMRALAMSNLLG;NRMAMRALAMSNLLGQ;RMAMRALAMSNLLGQN;MAMRALAMSNLLGQNA;AMRALAMSNLLGQNAA;MRALAMSNLLGQNAAA;RALAMSNLLGQNAAAI;ALAMSNLLGQNAAAIA;LAMSNLLGQNAAAIAA;AMSNLLGQNAAAIAAV;MSNLLGQNAAAIAAVE;SNLLGQNAAAIAAVEA;NLLGQNAAAIAAVEAE;LLGQNAAAIAAVEAEY;LGQNAAAIAAVEAEYE;GQNAAAIAAVEAEYEL;QNAAAIAAVEAEYELM;NAAAIAAVEAEYELMW;AAAIAAVEAEYELMWA;AAIAAVEAEYELMWAA;AIAAVEAEYELMWAAD;IAAVEAEYELMWAADV;AAVEAEYELMWAADVA;AVEAEYELMWAADVAA;VEAEYELMWAADVAAM;EAEYELMWAADVAAMA;AEYELMWAADVAAMAG;EYELMWAADVAAMAGY;YELMWAADVAAMAGYH;ELMWAADVAAMAGYHS;LMWAADVAAMAGYHSG;MWAADVAAMAGYHSGA;WAADVAAMAGYHSGAS;AADVAAMAGYHSGASA;ADVAAMAGYHSGASAA;DVAAMAGYHSGASAAA;VAAMAGYHSGASAAAA;AAMAGYHSGASAAAAA;AMAGYHSGASAAAAAL;MAGYHSGASAAAAALP;AGYHSGASAAAAALPA;GYHSGASAAAAALPAF;YHSGASAAAAALPAFS;HSGASAAAAALPAFSP;SGASAAAAALPAFSPP;GASAAAAALPAFSPPA;ASAAAAALPAFSPPAQ;SAAAAALPAFSPPAQA;AAAAALP | |

Fig. 30 continued

| | | |
|---|---|---|
| | AFSPPAQAL;AAAALPAFSPPAQALG;AAALPAFSPPAQALGG;AALPAFSPPAQALGGG;ALPAFSPPAQALGGGV;LPAFSPPAQALGGGVG;PAFSPPAQALGGGVGA;AFSPPAQALGGGVGAF;FSPPAQALGGGVGAFL;SPPAQALGGGVGAFLN;PPAQALGGGVGAFLNA;PAQALGGGVGAFLNAL;AQALGGGVGAFLNALF;QALGGGVGAFLNALFA;ALGGGVGAFLNALFAG;LGGGVGAFLNALFAGP;GGGVGAFLNALFAGPA;GGVGAFLNALFAGPAK;GVGAFLNALFAGPAKM;VGAFLNALFAGPAKML;GAFLNALFAGPAKMLR;AFLNALFAGPAKMLRL;FLNALFAGPAKMLRLN;LNALFAGPAKMLRLNA;NALFAGPAKMLRLNAG;ALFAGPAKMLRLNAGL;LFAGPAKMLRLNAGLG;FAGPAKMLRLNAGLGN;AGPAKMLRLNAGLGNV;GPAKMLRLNAGLGNVG;PAKMLRLNAGLGNVGN;AKMLRLNAGLGNVGNY;KMLRLNAGLGNVGNYN;MLRLNAGLGNVGNYNV;LRLNAGLGNVGNYNVG;RLNAGLGNVGNYNVGL;LNAGLGNVGNYNVGLG;NAGLGNVGNYNVGLGN;AGLGNVGNYNVGLGNV;GLGNVGNYNVGLGNVG;LGNVGNYNVGLGNVGI;GNVGNYNVGLGNVGIF;NVGNYNVGLGNVGIFN;VGNYNVGLGNVGIFNL;GNYNVGLGNVGIFNLG;NYNVGLGNVGIFNLGA;YNVGLGNVGIFNLGAA;NVGLGNVGIFNLGAAN;VGLGNVGIFNLGAANV;GLGNVGIFNLGAANVG;LGNVGIFNLGAANVGA;GNVGIFNLGAANVGAQ;NVGIFNLGAANVGAQN;VGIFNLGAANVGAQNL;GIFNLGAANVGAQNLG;IFNLGAANVGAQNLGA;FNLGAANVGAQNLGAA;NLGAANVGAQNLGAAN;LGAANVGAQNLGAANA;GAANVGAQNLGAANAG;AANVGAQNLGAANAGS;ANVGAQNLGAANAGSG;NVGAQNLGAANAGSGN;VGAQNLGAANAGSGNF;GAQNLGAANAGSGNFG;AQNLGAANAGSGNFGF;QNLGAANAGSGNFGFG;NLGAANAGSGNFGFGN;LGAANAGSGNFGFGNI;GAANAGSGNFGFGNIG;AANAGSGNFGFGNIGN;ANAGSGNFGFGNIGNA;NAGSGNFGFGNIGNAN;AGSGNFGFGNIGNANF;GSGNFGFGNIGNANFG;SGNFGFGNIGNANFGF;GNFGFGNIGNANFGFG;NFGFGNIGNANFGFGN;FGFGNIGNANFGFGNS;GFGNIGNANFGFGNSG;FGNIGNANFGFGNSGL;GNIGNANFGFGNSGLG;NIGNANFGFGNSGLGL;IGNANFGFGNSGLGLP;GNANFGFGNSGLGLPP;NANFGFGNSGLGLPPG;ANFGFGNSGLGLPPGM;NFGFGNSGLGLPPGMG;FGFGNSGLGLPPGMGN;GFGNSGLGLPPGMGNI;FGNSGLGLPPGMGNIG;GNSGLGLPPGMGNIGL;NSGLGLPPGMGNIGLG;SGLGLPPGMGNIGLGN;GLGLPPGMGNIGLGNA;LGLPPGMGNIGLGNAG;GLPPGMGNIGLGNAGS;LPPGMGNIGLGNAGSS;PPGMGNIGLGNAGSSN;PGMGNIGLGNAGSSNY;GMGNIGLGNAGSSNYG;MGNIGLGNAGSSNYGL;GNIGLGNAGSSNYGLA;NIGLGNAGSSNYGLAN;IGLGNAGSSNYGLANL;GLGNAGSSNYGLANLG;LGNAGSSNYGLANLGV;GNAGSSNYGLANLGVG;NAGSSNYGLANLGVGN;AGSSNYGLANLGVGNI;GSSNYGLANLGVGNIG;SSNYGLANLGVGNIGF;SNYGLANLGVGNIGFA;NYGLANLGVGNIGFAN;YGLANLGVGNIGFANT;GLANLGVGNIGFANTG;LANLGVGNIGFANTGS;ANLGVGNIGFANTGSN;NLGVGNIGFANTGSNN;LGVGNIGFANTGSNNI;GVGNIGFANTGSNNIG;VGNIGFANTGSNNIGI;GNIGFANTGSNNIGIG;NIGFANTGSNNIGIGL;IGFANTGSNNIGIGLT;GFANTGSNNIGIGLTG;FANTGSNNIGIGLTGD;ANTGSNNIGIGLTGDN;NTGSNNIGIGLTGDNL;TGSNNIGIGLTGDNLT;GSNNIGIGLTGDNLTG;SNNIGIGLTGDNLTGI;NNIGIGLTGDNLTGIG;NIGIGLTGDNLTGIGG;IGIGLTGDNLTGIGGL;GIGLTGDNLTGIGGLN;IGLTGDNLTGIGGLNS;GLTGDNLTGIGGLNSG;LTGDNLTGIGGLNSGT;TGDNLTGIGGLNSGTG;GDNLTGIGGLNSGTGN;DNLTGIGGLNSGTGNL;NLTGIGGLNSGTGNLG;LTGIGGLNSGTGNLGL;TGIGGLNSGTGNLGLF;GIGGLNSGTGNLGLFN;IGGLNSGTGNLGLFNS;GGLNSGTGNLGLFNSG;GLNSGTGNLGLFNSGT;LNSGTGNLGLFNSGTG;NSGTGNLGLFNSGTGN;SGTGNLGLFNSGTGNI;GTGNLGLFNSGTGNIG;TGNLGLFNSGTGNIGF;GNLGLFNSGTGNIGFF;NLGLFNSGTGNIGFFN;LGLFNSGTGNIGFFNS;GLFNSGTGNIGFFNSG;LFNSGTGNIGFFNSGT;FNSGTGNIGFFNSGTG;NSGTGNIGFFNSGTGN;SGTGNIGFFNSGTGNF; | |

Fig. 30 continued

GTGNIGFFNSGTGNFG;TGNIGFFNSGTGNFGV;GNIGFFNSGTGNFGVF;N
IGFFNSGTGNFGVFN;IGFFNSGTGNFGVFNS;GFFNSGTGNFGVFNSG;FF
NSGTGNFGVFNSGS;FNSGTGNFGVFNSGSY;NSGTGNFGVFNSGSYN;S
GTGNFGVFNSGSYNT;GTGNFGVFNSGSYNTG;TGNFGVFNSGSYNTGV;
GNFGVFNSGSYNTGVG;NFGVFNSGSYNTGVGN;FGVFNSGSYNTGVGN
A;GVFNSGSYNTGVGNAG;VFNSGSYNTGVGNAGT;FNSGSYNTGVGNAG
TA;NSGSYNTGVGNAGTAS;SGSYNTGVGNAGTAST;GSYNTGVGNAGTA
STG;SYNTGVGNAGTASTGL;YNTGVGNAGTASTGLF;NTGVGNAGTASTG
LFN;TGVGNAGTASTGLFNV;GVGNAGTASTGLFNVG;VGNAGTASTGLFN
VGG;GNAGTASTGLFNVGGF;NAGTASTGLFNVGGFN;AGTASTGLFNVGG
FNT;GTASTGLFNVGGFNTG;TASTGLFNVGGFNTGV;ASTGLFNVGGFNT
GVA;STGLFNVGGFNTGVAN;TGLFNVGGFNTGVANV;GLFNVGGFNTGVA
NVG;LFNVGGFNTGVANVGS;FNVGGFNTGVANVGSY;NVGGFNTGVANV
GSYN;VGGFNTGVANVGSYNT;GGFNTGVANVGSYNTG;GFNTGVANVGS
YNTGS;FNTGVANVGSYNTGSF;NTGVANVGSYNTGSFN;TGVANVGSYNT
GSFNA;GVANVGSYNTGSFNAG;VANVGSYNTGSFNAGN;ANVGSYNTGS
FNAGNT;NVGSYNTGSFNAGNTN;VGSYNTGSFNAGNTNT;GSYNTGSFNA
GNTNTG;SYNTGSFNAGNTNTGG;YNTGSFNAGNTNTGGF;NTGSFNAGN
TNTGGFN;TGSFNAGNTNTGGFNP;GSFNAGNTNTGGFNPG;SFNAGNTN
TGGFNPGN;FNAGNTNTGGFNPGNV;NAGNTNTGGFNPGNVN;AGNTNTG
GFNPGNVNT;GNTNTGGFNPGNVNTG;NTNTGGFNPGNVNTGW;TNTGGF
NPGNVNTGWL;NTGGFNPGNVNTGWLN;TGGFNPGNVNTGWLNT;GGFN
PGNVNTGWLNTG;GFNPGNVNTGWLNTGN;FNPGNVNTGWLNTGNT;NP
GNVNTGWLNTGNTN;PGNVNTGWLNTGNTNT;GNVNTGWLNTGNTNTG;
NVNTGWLNTGNTNTGI;VNTGWLNTGNTNTGIA;NTGWLNTGNTNTGIAN;T
GWLNTGNTNTGIANS;GWLNTGNTNTGIANSG;WLNTGNTNTGIANSGN;L
NTGNTNTGIANSGNV;NTGNTNTGIANSGNVN;TGNTNTGIANSGNVNT;GN
TNTGIANSGNVNTG;NTNTGIANSGNVNTGA;TNTGIANSGNVNTGAF;NTGI
ANSGNVNTGAFI;TGIANSGNVNTGAFIS;GIANSGNVNTGAFISG;IANSGNV
NTGAFISGN;ANSGNVNTGAFISGNF;NSGNVNTGAFISGNFS;SGNVNTGA
FISGNFSN;GNVNTGAFISGNFSNG;NVNTGAFISGNFSNGV;VNTGAFISGN
FSNGVL;NTGAFISGNFSNGVLW;TGAFISGNFSNGVLWR;GAFISGNFSNG
VLWRG;AFISGNFSNGVLWRGD;FISGNFSNGVLWRGDY;ISGNFSNGVLW
RGDYE;SGNFSNGVLWRGDYEG;GNFSNGVLWRGDYEGL;NFSNGVLWR
GDYEGLW;FSNGVLWRGDYEGLWG;SNGVLWRGDYEGLWGL;NGVLWR
GDYEGLWGLS;GVLWRGDYEGLWGLSG;VLWRGDYEGLWGLSGG;LWR
GDYEGLWGLSGGS;WRGDYEGLWGLSGGST;RGDYEGLWGLSGGSTI;G
DYEGLWGLSGGSTIP;DYEGLWGLSGGSTIPA;YEGLWGLSGGSTIPAI;EG
LWGLSGGSTIPAIP;GLWGLSGGSTIPAIPI;LWGLSGGSTIPAIPIG;WGLSG
GSTIPAIPIGL;GLSGGSTIPAIPIGLE;LSGGSTIPAIPIGLEL;SGGSTIPAIPIGL
ELN;GGSTIPAIPIGLELNG;GSTIPAIPIGLELNGG;STIPAIPIGLELNGGV;TIP
AIPIGLELNGGVG;IPAIPIGLELNGGVGP;PAIPIGLELNGGVGPI;AIPIGLELN
GGVGPIT;IPIGLELNGGVGPITV;PIGLELNGGVGPITVL;IGLELNGGVGPITV
LP;GLELNGGVGPITVLPI;LELNGGVGPITVLPIQ;ELNGGVGPITVLPIQI;LN
GGVGPITVLPIQIL;NGGVGPITVLPIQILP;GGVGPITVLPIQILPT;GVGPITVL
PIQILPTI;VGPITVLPIQILPTIP;GPITVLPIQILPTIPL;PITVLPIQILPTIPLN;ITV
LPIQILPTIPLNI;TVLPIQILPTIPLNIH;VLPIQILPTIPLNIHQ;LPIQILPTIPLNIH
QT;PIQILPTIPLNIHQTF;IQILPTIPLNIHQTFS;QILPTIPLNIHQTFSL;ILPTIPL
NIHQTFSLG;LPTIPLNIHQTFSLGP;PTIPLNIHQTFSLGPL;TIPLNIHQTFSLG
PLV;IPLNIHQTFSLGPLVV;PLNIHQTFSLGPLVVP;LNIHQTFSLGPLVVPD;N
IHQTFSLGPLVVPDI;IHQTFSLGPLVVPDIV;HQTFSLGPLVVPDIVI;QTFSLG
PLVVPDIVIP;TFSLGPLVVPDIVIPA;FSLGPLVVPDIVIPAF;SLGPLVVPDIVIP
AFG;LGPLVVPDIVIPAFGG;GPLVVPDIVIPAFGGG;PLVVPDIVIPAFGGGT;L

Fig. 30 continued

| | | |
|---|---|---|
| | VVPDIVIPAFGGGTA;VVPDIVIPAFGGGTAI;VPDIVIPAFGGGTAIP;PDIVIPA<br>FGGGTAIPI;DIVIPAFGGGTAIPIS;IVIPAFGGGTAIPISV;VIPAFGGGTAIPIS<br>VG;IPAFGGGTAIPISVGP;PAFGGGTAIPISVGPI;AFGGGTAIPISVGPIT;FG<br>GGTAIPISVGPITI;GGGTAIPISVGPITIS;GGTAIPISVGPITISP;GTAIPISVGPI<br>TISPI;TAIPISVGPITISPIT;AIPISVGPITISPITL;IPISVGPITISPITLF;PISVGPI<br>TISPITLFP;ISVGPITISPITLFPA;SVGPITISPITLFPAQ;VGPITISPITLFPAQN;<br>GPITISPITLFPAQNF;PITISPITLFPAQNFN;ITISPITLFPAQNFNT;TISPITLFP<br>AQNFNTT;ISPITLFPAQNFNTTF;SPITLFPAQNFNTTFP;PITLFPAQNFNTTF<br>PV;ITLFPAQNFNTTFPVG;TLFPAQNFNTTFPVGP;LFPAQNFNTTFPVGPF;<br>FPAQNFNTTFPVGPFF;PAQNFNTTFPVGPFFG;AQNFNTTFPVGPFFGL;Q<br>NFNTTFPVGPFFGLG;NFNTTFPVGPFFGLGV;FNTTFPVGPFFGLGVV;NT<br>TFPVGPFFGLGVVN;TTFPVGPFFGLGVVNI;TFPVGPFFGLGVVNIS;FPVG<br>PFFGLGVVNISG;PVGPFFGLGVVNISGI;VGPFFGLGVVNISGIE;GPFFGLG<br>VVNISGIEI;PFFGLGVVNISGIEIK;FFGLGVVNISGIEIKD;FGLGVVNISGIEIK<br>DL;GLGVVNISGIEIKDLA;LGVVNISGIEIKDLAG;GVVNISGIEIKDLAGN;VVN<br>ISGIEIKDLAGNV;VNISGIEIKDLAGNVT;NISGIEIKDLAGNVTL;ISGIEIKDLA<br>GNVTLQ;SGIEIKDLAGNVTLQL;GIEIKDLAGNVTLQLG;IEIKDLAGNVTLQL<br>GN;EIKDLAGNVTLQLGNL;IKDLAGNVTLQLGNLN;KDLAGNVTLQLGNLNI;<br>DLAGNVTLQLGNLNID;LAGNVTLQLGNLNIDT;AGNVTLQLGNLNIDTR;GN<br>VTLQLGNLNIDTRI;NVTLQLGNLNIDTRIN;VTLQLGNLNIDTRINQ;TLQLGNL<br>NIDTRINQS;LQLGNLNIDTRINQSF;QLGNLNIDTRINQSFP;LGNLNIDTRINQ<br>SFPV;GNLNIDTRINQSFPVT;NLNIDTRINQSFPVTV;LNIDTRINQSFPVTVN;<br>NIDTRINQSFPVTVNW;IDTRINQSFPVTVNWS;DTRINQSFPVTVNWST;TRI<br>NQSFPVTVNWSTP;RINQSFPVTVNWSTPA;INQSFPVTVNWSTPAV;NQSF<br>PVTVNWSTPAVT;QSFPVTVNWSTPAVTI;SFPVTVNWSTPAVTIF;FPVTVN<br>WSTPAVTIFP;PVTVNWSTPAVTIFPN;VTVNWSTPAVTIFPNG;TVNWSTPA<br>VTIFPNGI;VNWSTPAVTIFPNGIS;NWSTPAVTIFPNGISI;WSTPAVTIFPNGI<br>SIP;STPAVTIFPNGISIPN;TPAVTIFPNGISIPNN;PAVTIFPNGISIPNNP;AVTI<br>FPNGISIPNNPL;VTIFPNGISIPNNPLA;TIFPNGISIPNNPLAL;IFPNGISIPNN<br>PLALL;FPNGISIPNNPLALLA;PNGISIPNNPLALLAS;NGISIPNNPLALLASA;<br>GISIPNNPLALLASAS;ISIPNNPLALLASASI;SIPNNPLALLASASIG;IPNNPLA<br>LLASASIGT;PNNPLALLASASIGTL;NNPLALLASASIGTLG;NPLALLASASIG<br>TLGF;PLALLASASIGTLGFT;LALLASASIGTLGFTI;ALLASASIGTLGFTIP;LL<br>ASASIGTLGFTIPG;LASASIGTLGFTIPGF;ASASIGTLGFTIPGFT;SASIGTL<br>GFTIPGFTI;ASIGTLGFTIPGFTIP;SIGTLGFTIPGFTIPA;IGTLGFTIPGFTIPA<br>A;GTLGFTIPGFTIPAAP;TLGFTIPGFTIPAAPL;LGFTIPGFTIPAAPLP;GFTIP<br>GFTIPAAPLPL;FTIPGFTIPAAPLPLT;TIPGFTIPAAPLPLTI;IPGFTIPAAPLPL<br>TID;PGFTIPAAPLPLTIDI;GFTIPAAPLPLTIDID;FTIPAAPLPLTIDIDG;TIPAA<br>PLPLTIDIDGQ;IPAAPLPLTIDIDGQI;PAAPLPLTIDIDGQID;AAPLPLTIDIDG<br>QIDG;APLPLTIDIDGQIDGF;PLPLTIDIDGQIDGFS;LPLTIDIDGQIDGFST;PL<br>TIDIDGQIDGFSTP;LTIDIDGQIDGFSTPP;TIDIDGQIDGFSTPPI;IDIDGQIDG<br>FSTPPIT;DIDGQIDGFSTPPITI;IDGQIDGFSTPPITID;DGQIDGFSTPPITIDR;<br>GQIDGFSTPPITIDRI;QIDGFSTPPITIDRIP;IDGFSTPPITIDRIPL;DGFSTPPI<br>TIDRIPLN;GFSTPPITIDRIPLNL;FSTPPITIDRIPLNLG;STPPITIDRIPLNLGA;<br>TPPITIDRIPLNLGAS;PPITIDRIPLNLGASV;PITIDRIPLNLGASVT;ITIDRIPL<br>NLGASVTV;TIDRIPLNLGASVTVG;IDRIPLNLGASVTVGP;DRIPLNLGASVT<br>VGPI;RIPLNLGASVTVGPIL;IPLNLGASVTVGPILI;PLNLGASVTVGPILIN;LN<br>LGASVTVGPILING;NLGASVTVGPILINGV;LGASVTVGPILINGVN;GASVTV<br>GPILINGVNI;ASVTVGPILINGVNIP;SVTVGPILINGVNIPA;VTVGPILINGVNI<br>PAT;TVGPILINGVNIPATP;VGPILINGVNIPATPG;GPILINGVNIPATPGF;PILI<br>NGVNIPATPGFG;ILINGVNIPATPGFGN;LINGVNIPATPGFGNT;INGVNIPA<br>TPGFGNTT;NGVNIPATPGFGNTTT;GVNIPATPGFGNTTTA;VNIPATPGFG<br>NTTTAP;NIPATPGFGNTTTAPS;IPATPGFGNTTTAPSS;PATPGFGNTTTAP | |

Fig. 30 continued

| | | |
|---|---|---|
| | SSG;ATPGFGNTTTAPSSGF;TPGFGNTTTAPSSGFF;PGFGNTTTAPSSGFFN;GFGNTTTAPSSGFFNS;FGNTTTAPSSGFFNSG;GNTTTAPSSGFFNSGD;NTTTAPSSGFFNSGDG;TTTAPSSGFFNSGDGG;TTAPSSGFFNSGDGGV;TAPSSGFFNSGDGGVS;APSSGFFNSGDGGVSG;PSSGFFNSGDGGVSGF;SSGFFNSGDGGVSGFG;SGFFNSGDGGVSGFGN;GFFNSGDGGVSGFGNF;FFNSGDGGVSGFGNFG;FNSGDGGVSGFGNFGA;NSGDGGVSGFGNFGAG;SGDGGVSGFGNFGAGS;GDGGVSGFGNFGAGSS;DGGVSGFGNFGAGSSG;GGVSGFGNFGAGSSGW;GVSGFGNFGAGSSGWW;VSGFGNFGAGSSGWWN;SGFGNFGAGSSGWWNQ;GFGNFGAGSSGWWNQA;FGNFGAGSSGWWNQAQ;GNFGAGSSGWWNQAQT;NFGAGSSGWWNQAQTE;FGAGSSGWWNQAQTEV;GAGSSGWWNQAQTEVA;AGSSGWWNQAQTEVAG;GSSGWWNQAQTEVAGA;SSGWWNQAQTEVAGAG;SGWWNQAQTEVAGAGS;GWWNQAQTEVAGAGSG;WWNQAQTEVAGAGSGF;WNQAQTEVAGAGSGFA;NQAQTEVAGAGSGFAN;QAQTEVAGAGSGFANF;AQTEVAGAGSGFANFG;QTEVAGAGSGFANFGS;TEVAGAGSGFANFGSL;EVAGAGSGFANFGSLG;VAGAGSGFANFGSLGS;AGAGSGFANFGSLGSG;GAGSGFANFGSLGSGV;AGSGFANFGSLGSGVL;GSGFANFGSLGSGVLN;SGFANFGSLGSGVLNF;GFANFGSLGSGVLNFG;FANFGSLGSGVLNFGS;ANFGSLGSGVLNFGSG;NFGSLGSGVLNFGSGV;FGSLGSGVLNFGSGVS;GSLGSGVLNFGSGVSG;SLGSGVLNFGSGVSGL;LGSGVLNFGSGVSGLY;GSGVLNFGSGVSGLYN;SGVLNFGSGVSGLYNT;GVLNFGSGVSGLYNTG;VLNFGSGVSGLYNTGG;LNFGSGVSGLYNTGGL;NFGSGVSGLYNTGGLP;FGSGVSGLYNTGGLPP;GSGVSGLYNTGGLPPG;SGVSGLYNTGGLPPGT;GVSGLYNTGGLPPGTP;VSGLYNTGGLPPGTPA;SGLYNTGGLPPGTPAV;GLYNTGGLPPGTPAVV;LYNTGGLPPGTPAVVS;YNTGGLPPGTPAVVSG;NTGGLPPGTPAVVSGI;TGGLPPGTPAVVSGIG;GGLPPGTPAVVSGIGN;GLPPGTPAVVSGIGNV;LPPGTPAVVSGIGNVG;PPGTPAVVSGIGNVGE;PGTPAVVSGIGNVGEQ;GTPAVVSGIGNVGEQL;TPAVVSGIGNVGEQLS;PAVVSGIGNVGEQLSG;AVVSGIGNVGEQLSGL;VVSGIGNVGEQLSGLS;VSGIGNVGEQLSGLSS;SGIGNVGEQLSGLSSA;GIGNVGEQLSGLSSAG;IGNVGEQLSGLSSAGT;GNVGEQLSGLSSAGTA;NVGEQLSGLSSAGTAL;VGEQLSGLSSAGTALN;GEQLSGLSSAGTALNQ;EQLSGLSSAGTALNQS;QLSGLSSAGTALNQSL;LSGLSSAGTALNQSLI;SGLSSAGTALNQSLII;GLSSAGTALNQSLIIN;LSSAGTALNQSLIINL;SSAGTALNQSLIINLG;SAGTALNQSLIINLGL;AGTALNQSLIINLGLA;GTALNQSLIINLGLAD;TALNQSLIINLGLADV;ALNQSLIINLGLADVG;LNQSLIINLGLADVGS;NQSLIINLGLADVGSV;QSLIINLGLADVGSVN;SLIINLGLADVGSVNV;LIINLGLADVGSVNVG;IINLGLADVGSVNVGF;INLGLADVGSVNVGFG;NLGLADVGSVNVGFGN;LGLADVGSVNVGFGNV;GLADVGSVNVGFGNVG;LADVGSVNVGFGNVGD;ADVGSVNVGFGNVGDF;DVGSVNVGFGNVGDFN;VGSVNVGFGNVGDFNL;GSVNVGFGNVGDFNLG;SVNVGFGNVGDFNLGA;VNVGFGNVGDFNLGAA;NVGFGNVGDFNLGAAN;VGFGNVGDFNLGAANI;GFGNVGDFNLGAANIG;FGNVGDFNLGAANIGD;GNVGDFNLGAANIGDL;NVGDFNLGAANIGDLN;VGDFNLGAANIGDLNV;GDFNLGAANIGDLNVG;DFNLGAANIGDLNVGL;FNLGAANIGDLNVGLG;NLGAANIGDLNVGLGN;LGAANIGDLNVGLGNV;GAANIGDLNVGLGNVG;AANIGDLNVGLGNVGG;ANIGDLNVGLGNVGGG;NIGDLNVGLGNVGGGN;IGDLNVGLGNVGGGNV;GDLNVGLGNVGGGNVG;DLNVGLGNVGGGNVGF;LNVGLGNVGGGNVGFG;NVGLGNVGGGNVGFGN;VGLGNVGGGNVGFGNI;GLGNVGGGNVGFGNIG;LGNVGGGNVGFGNIGD;GNVGGGNVGFGNIGDA;NVGGGNVGFGNIGDAN;VGGGNVGFGNIGDANF;GGGNVGFGNIGDANFG;GGNVGFGNIGDANFGL;GNVGFGNIGDANFGLG;NVGFGNIGDANFGLGN;VGFGNIGDANFGLGNA;GFGNIGDANFGLGNAG;FGNIGDANFGLGNAGL;GNIGDANFGLGNAGLA;NIGDANFGLGNAGLAA;IGDANFGLGNAGLAA | |

Fig. 30 continued

| | | |
|---|---|---|
| | G;GDANFGLGNAGLAAGL;DANFGLGNAGLAAGLA;ANFGLGNAGLAAGLAG;NFGLGNAGLAAGLAGV;FGLGNAGLAAGLAGVG;GLGNAGLAAGLAGVGN;LGNAGLAAGLAGVGNI;GNAGLAAGLAGVGNIG;NAGLAAGLAGVGNIGL;AGLAAGLAGVGNIGLG;GLAAGLAGVGNIGLGN;LAAGLAGVGNIGLGNA;AAGLAGVGNIGLGNAG;AGLAGVGNIGLGNAGS;GLAGVGNIGLGNAGSG;LAGVGNIGLGNAGSGN;AGVGNIGLGNAGSGNV;GVGNIGLGNAGSGNVG;VGNIGLGNAGSGNVGF;GNIGLGNAGSGNVGFG;NIGLGNAGSGNVGFGN;IGLGNAGSGNVGFGNM;GLGNAGSGNVGFGNMG;LGNAGSGNVGFGNMGV;GNAGSGNVGFGNMGVG;NAGSGNVGFGNMGVGN;AGSGNVGFGNMGVGNI;GSGNVGFGNMGVGNIG;SGNVGFGNMGVGNIGF;GNVGFGNMGVGNIGFG;NVGFGNMGVGNIGFGN;VGFGNMGVGNIGFGNT;GFGNMGVGNIGFGNTG;FGNMGVGNIGFGNTGT;GNMGVGNIGFGNTGTN;NMGVGNIGFGNTGTNN;MGVGNIGFGNTGTNNL;GVGNIGFGNTGTNNLG;VGNIGFGNTGTNNLGI;GNIGFGNTGTNNLGIG;NIGFGNTGTNNLGIGL;IGFGNTGTNNLGIGLT;GFGNTGTNNLGIGLTG;FGNTGTNNLGIGLTGD;GNTGTNNLGIGLTGDN;NTGTNNLGIGLTGDNQ;TGTNNLGIGLTGDNQT;GTNNLGIGLTGDNQTG;TNNLGIGLTGDNQTGI;NNLGIGLTGDNQTGIG;NLGIGLTGDNQTGIGG;LGIGLTGDNQTGIGGL;GIGLTGDNQTGIGGLN;IGLTGDNQTGIGGLNS;GLTGDNQTGIGGLNSG;LTGDNQTGIGGLNSGA;TGDNQTGIGGLNSGAG;GDNQTGIGGLNSGAGN;DNQTGIGGLNSGAGNI;NQTGIGGLNSGAGNIG;QTGIGGLNSGAGNIGL;TGIGGLNSGAGNIGLF;GIGGLNSGAGNIGLFN;IGGLNSGAGNIGLFNS;GGLNSGAGNIGLFNSG;GLNSGAGNIGLFNSGT;LNSGAGNIGLFNSGTG;NSGAGNIGLFNSGTGN;SGAGNIGLFNSGTGNV;GAGNIGLFNSGTGNVG;AGNIGLFNSGTGNVGL;GNIGLFNSGTGNVGLF;NIGLFNSGTGNVGLFN;IGLFNSGTGNVGLFNS;GLFNSGTGNVGLFNSG;LFNSGTGNVGLFNSGT;FNSGTGNVGLFNSGTG;NSGTGNVGLFNSGTGN;SGTGNVGLFNSGTGNF;GTGNVGLFNSGTGNFG;TGNVGLFNSGTGNFGL;GNVGLFNSGTGNFGLF;NVGLFNSGTGNFGLFN;VGLFNSGTGNFGLFNS;GLFNSGTGNFGLFNSG;LFNSGTGNFGLFNSGS;FNSGTGNFGLFNSGSF;NSGTGNFGLFNSGSFN;SGTGNFGLFNSGSFNT;GTGNFGLFNSGSFNTG;TGNFGLFNSGSFNTGI;GNFGLFNSGSFNTGIG;NFGLFNSGSFNTGIGN;FGLFNSGSFNTGIGNG;GLFNSGSFNTGIGNGG;LFNSGSFNTGIGNGGT;FNSGSFNTGIGNGGTG;NSGSFNTGIGNGGTGS;SGSFNTGIGNGGTGST;GSFNTGIGNGGTGSTG;SFNTGIGNGGTGSTGL;FNTGIGNGGTGSTGLF;NTGIGNGGTGSTGLFN;TGIGNGGTGSTGLFNA;GIGNGGTGSTGLFNAG;IGNGGTGSTGLFNAGN;GNGGTGSTGLFNAGNF;NGGTGSTGLFNAGNFN;GGTGSTGLFNAGNFNT;GTGSTGLFNAGNFNTG;TGSTGLFNAGNFNTGV;GSTGLFNAGNFNTGVA;STGLFNAGNFNTGVAN;TGLFNAGNFNTGVANP;GLFNAGNFNTGVANPG;LFNAGNFNTGVANPGS;FNAGNFNTGVANPGSY;NAGNFNTGVANPGSYN;AGNFNTGVANPGSYNT;GNFNTGVANPGSYNTG;NFNTGVANPGSYNTGS;FNTGVANPGSYNTGSF;NTGVANPGSYNTGSFN;TGVANPGSYNTGSFNV;GVANPGSYNTGSFNVG;VANPGSYNTGSFNVGD;ANPGSYNTGSFNVGDT;NPGSYNTGSFNVGDTN;PGSYNTGSFNVGDTNT;GSYNTGSFNVGDTNTG;SYNTGSFNVGDTNTGG;YNTGSFNVGDTNTGGF;NTGSFNVGDTNTGGFN;TGSFNVGDTNTGGFNP;GSFNVGDTNTGGFNPG;SFNVGDTNTGGFNPGS;FNVGDTNTGGFNPGSI;NVGDTNTGGFNPGSIN;VGDTNTGGFNPGSINT;GDTNTGGFNPGSINTG;DTNTGGFNPGSINTGW;TNTGGFNPGSINTGWF;NTGGFNPGSINTGWFN;TGGFNPGSINTGWFNT;GGFNPGSINTGWFNTG;GFNPGSINTGWFNTGN;FNPGSINTGWFNTGNA;NPGSINTGWFNTGNAN;PGSINTGWFNTGNANT;GSINTGWFNTGNANTG;SINTGWFNTGNANTGV;INTGWFNTGNANTGVA;NTGWFNTGNANTGVAN;TGWFNTGNANTGVANS;GWFNTGNANTGVANSG;WFNTGNANTGVANSGN;FNTGNANTGVANSGNV;NTGNANTGVANSGNVD;TGNANTGVANSGNVDT;GNANTGV | |

Fig. 30 continued

| | | |
|---|---|---|
| | ANSGNVDTG;NANTGVANSGNVDTGA;ANTGVANSGNVDTGAL;NTGVANSGNVDTGALM;TGVANSGNVDTGALMS;GVANSGNVDTGALMSG;VANSGNVDTGALMSGN;ANSGNVDTGALMSGNF;NSGNVDTGALMSGNFS;SGNVDTGALMSGNFSN;GNVDTGALMSGNFSNG;NVDTGALMSGNFSNGI;VDTGALMSGNFSNGIL;DTGALMSGNFSNGILW;TGALMSGNFSNGILWR;GALMSGNFSNGILWRG;ALMSGNFSNGILWRGN;LMSGNFSNGILWRGNF;MSGNFSNGILWRGNFE;SGNFSNGILWRGNFEG;GNFSNGILWRGNFEGL;NFSNGILWRGNFEGLF;FSNGILWRGNFEGLFG;SNGILWRGNFEGLFGL;NGILWRGNFEGLFGLN;GILWRGNFEGLFGLNV;ILWRGNFEGLFGLNVG;LWRGNFEGLFGLNVGI;WRGNFEGLFGLNVGIT;RGNFEGLFGLNVGITI;GNFEGLFGLNVGITIP;NFEGLFGLNVGITIPE;FEGLFGLNVGITIPEF;EGLFGLNVGITIPEFP;GLFGLNVGITIPEFPI;LFGLNVGITIPEFPIH;FGLNVGITIPEFPIHW;GLNVGITIPEFPIHWT;LNVGITIPEFPIHWTS;NVGITIPEFPIHWTST;VGITIPEFPIHWTSTG;GITIPEFPIHWTSTGG;ITIPEFPIHWTSTGGI;TIPEFPIHWTSTGGIG;IPEFPIHWTSTGGIGP;PEFPIHWTSTGGIGPI;EFPIHWTSTGGIGPII;FPIHWTSTGGIGPIII;PIHWTSTGGIGPIIIP;IHWTSTGGIGPIIIPD;HWTSTGGIGPIIIPDT;WTSTGGIGPIIIPDTT;TSTGGIGPIIIPDTTI;STGGIGPIIIPDTTIL;TGGIGPIIIPDTTILP;GGIGPIIIPDTTILPP;GIGPIIIPDTTILPPI;IGPIIIPDTTILPPIH;GPIIIPDTTILPPIHL;PIIIPDTTILPPIHLG;IIIPDTTILPPIHLGL;IIPDTTILPPIHLGLT;IPDTTILPPIHLGLTG;PDTTILPPIHLGLTGQ;DTTILPPIHLGLTGQA;TTILPPIHLGLTGQAN;TILPPIHLGLTGQANY;ILPPIHLGLTGQANYG;LPPIHLGLTGQANYGF;PPIHLGLTGQANYGFA;PIHLGLTGQANYGFAV;IHLGLTGQANYGFAVP;HLGLTGQANYGFAVPD;LGLTGQANYGFAVPDI;GLTGQANYGFAVPDIP;LTGQANYGFAVPDIPI;TGQANYGFAVPDIPIP;GQANYGFAVPDIPIPA;QANYGFAVPDIPIPAI;ANYGFAVPDIPIPAIH;NYGFAVPDIPIPAIHI;YGFAVPDIPIPAIHID;GFAVPDIPIPAIHIDF;FAVPDIPIPAIHIDFD;AVPDIPIPAIHIDFDG;VPDIPIPAIHIDFDGA;PDIPIPAIHIDFDGAA;DIPIPAIHIDFDGAAD;IPIPAIHIDFDGAADA;PIPAIHIDFDGAADAG;IPAIHIDFDGAADAGF;PAIHIDFDGAADAGFT;AIHIDFDGAADAGFTA;IHIDFDGAADAGFTAP;HIDFDGAADAGFTAPA;IDFDGAADAGFTAPAT;DFDGAADAGFTAPATT;FDGAADAGFTAPATTL;DGAADAGFTAPATTLL;GAADAGFTAPATTLLS;AADAGFTAPATTLLSA;ADAGFTAPATTLLSAL;DAGFTAPATTLLSALG;AGFTAPATTLLSALGI;GFTAPATTLLSALGIT;FTAPATTLLSALGITG;TAPATTLLSALGITGQ;APATTLLSALGITGQF;PATTLLSALGITGQFR;ATTLLSALGITGQFRF;TTLLSALGITGQFRFG;TLLSALGITGQFRFGP;LLSALGITGQFRFGPI;LSALGITGQFRFGPIT;SALGITGQFRFGPITV;ALGITGQFRFGPITVS;LGITGQFRFGPITVSN;GITGQFRFGPITVSNV;ITGQFRFGPITVSNVQ;TGQFRFGPITVSNVQL;GQFRFGPITVSNVQLN;QFRFGPITVSNVQLNP;FRFGPITVSNVQLNPF;RFGPITVSNVQLNPFN;FGPITVSNVQLNPFNV;GPITVSNVQLNPFNVN;PITVSNVQLNPFNVNL;ITVSNVQLNPFNVNLK;TVSNVQLNPFNVNLKL;VSNVQLNPFNVNLKLQ;SNVQLNPFNVNLKLQF;NVQLNPFNVNLKLQFL;VQLNPFNVNLKLQFLH;QLNPFNVNLKLQFLHD;LNPFNVNLKLQFLHDA;NPFNVNLKLQFLHDAF;PFNVNLKLQFLHDAFP;FNVNLKLQFLHDAFPN;NVNLKLQFLHDAFPNE;VNLKLQFLHDAFPNEF;NLKLQFLHDAFPNEFP;LKLQFLHDAFPNEFPD;KLQFLHDAFPNEFPDP;LQFLHDAFPNEFPDPT;QFLHDAFPNEFPDPTI;FLHDAFPNEFPDPTIS;LHDAFPNEFPDPTISV;HDAFPNEFPDPTISVQ;DAFPNEFPDPTISVQI;AFPNEFPDPTISVQIQ;FPNEFPDPTISVQIQV;PNEFPDPTISVQIQVA;NEFPDPTISVQIQVAI;EFPDPTISVQIQVAIP;FPDPTISVQIQVAIPL;PDPTISVQIQVAIPLT;DPTISVQIQVAIPLTS;PTISVQIQVAIPLTSA;TISVQIQVAIPLTSAT;ISVQIQVAIPLTSATL;SVQIQVAIPLTSATLG;VQIQVAIPLTSATLGG;QIQVAIPLTSATLGGL;IQVAIPLTSATLGGLA;QVAIPLTSATLGGLAL;VAIPLTSATLGGLALP;AIPLTSATLGGLALPL;IPLTSATLGGLALPLQ;PLTSATLGGLALPLQQ;LTSATLGGLALPLQQT;TSATLGGLALPLQQTI;SATLGGLALPLQQTID;ATLGG | |

Fig. 30 continued

| | | |
|---|---|---|
| | LALPLQQTIDA;TLGGLALPLQQTIDAI;LGGLALPLQQTIDAIE;GGLALPLQQTIDAIEL;GLALPLQQTIDAIELP;LALPLQQTIDAIELPA;ALPLQQTIDAIELPAI;LPLQQTIDAIELPAIS;PLQQTIDAIELPAISF;LQQTIDAIELPAISFS;QQTIDAIELPAISFSQ;QTIDAIELPAISFSQS;TIDAIELPAISFSQSI;IDAIELPAISFSQSIP;DAIELPAISFSQSIPI;AIELPAISFSQSIPID;IELPAISFSQSIPIDI;ELPAISFSQSIPIDIP;LPAISFSQSIPIDIPP;PAISFSQSIPIDIPPI;AISFSQSIPIDIPPID;ISFSQSIPIDIPPIDI;SFSQSIPIDIPPIDIP;FSQSIPIDIPPIDIPA;SQSIPIDIPPIDIPAS;QSIPIDIPPIDIPAST;SIPIDIPPIDIPASTI;IPIDIPPIDIPASTIN;PIDIPPIDIPASTING;IDIPPIDIPASTINGI;DIPPIDIPASTINGIS;IPPIDIPASTINGISM;PPIDIPASTINGISMS;PIDIPASTINGISMSE;IDIPASTINGISMSEV;DIPASTINGISMSEVV;IPASTINGISMSEVVP;PASTINGISMSEVVPI;ASTINGISMSEVVPID;STINGISMSEVVPIDV;TINGISMSEVVPIDVS;INGISMSEVVPIDVSV;NGISMSEVVPIDVSVD;GISMSEVVPIDVSVDI;ISMSEVVPIDVSVDIP;SMSEVVPIDVSVDIPA;MSEVVPIDVSVDIPAV;SEVVPIDVSVDIPAVT;EVVPIDVSVDIPAVTI;VVPIDVSVDIPAVTIT;VPIDVSVDIPAVTITG;PIDVSVDIPAVTITGT;IDVSVDIPAVTITGTR;DVSVDIPAVTITGTRI;VSVDIPAVTITGTRID;SVDIPAVTITGTRIDP;VDIPAVTITGTRIDPI;DIPAVTITGTRIDPIP;IPAVTITGTRIDPIPL;PAVTITGTRIDPIPLN;AVTITGTRIDPIPLNF;VTITGTRIDPIPLNFD;TITGTRIDPIPLNFDV;ITGTRIDPIPLNFDVL;TGTRIDPIPLNFDVLS;GTRIDPIPLNFDVLSS;TRIDPIPLNFDVLSSA;RIDPIPLNFDVLSSAG;IDPIPLNFDVLSSAGP;DPIPLNFDVLSSAGPI;PIPLNFDVLSSAGPIN;IPLNFDVLSSAGPINI;PLNFDVLSSAGPINIS;LNFDVLSSAGPINISI;NFDVLSSAGPINISII;FDVLSSAGPINISIID;DVLSSAGPINISIIDI;VLSSAGPINISIIDIP;LSSAGPINISIIDIPA;SSAGPINISIIDIPAL;SAGPINISIIDIPALP;AGPINISIIDIPALPG;GPINISIIDIPALPGF;PINISIIDIPALPGFG;INISIIDIPALPGFGN;NISIIDIPALPGFGNS;ISIIDIPALPGFGNST;SIIDIPALPGFGNSTE;IIDIPALPGFGNSTEL;IDIPALPGFGNSTELP;DIPALPGFGNSTELPS;IPALPGFGNSTELPSS;PALPGFGNSTELPSSG;ALPGFGNSTELPSSGF;LPGFGNSTELPSSGFF;PGFGNSTELPSSGFFN;GFGNSTELPSSGFFNT;FGNSTELPSSGFFNTG;GNSTELPSSGFFNTGG;NSTELPSSGFFNTGGG;STELPSSGFFNTGGGG;TELPSSGFFNTGGGGG;ELPSSGFFNTGGGGGS;LPSSGFFNTGGGGGSG;PSSGFFNTGGGGGSGI;SSGFFNTGGGGGSGIA;SGFFNTGGGGGSGIAN;GFFNTGGGGGSGIANF;FFNTGGGGGSGIANFG;FNTGGGGGSGIANFGA;NTGGGGGSGIANFGAG;TGGGGGSGIANFGAGV;GGGGGSGIANFGAGVS;GGGGSGIANFGAGVSG;GGGSGIANFGAGVSGL;GGSGIANFGAGVSGLL;GSGIANFGAGVSGLLN;SGIANFGAGVSGLLNQ;GIANFGAGVSGLLNQA;IANFGAGVSGLLNQAS;ANFGAGVSGLLNQASS;NFGAGVSGLLNQASSP;FGAGVSGLLNQASSPM;GAGVSGLLNQASSPMV;AGVSGLLNQASSPMVG;GVSGLLNQASSPMVGT;VSGLLNQASSPMVGTL;SGLLNQASSPMVGTLS;GLLNQASSPMVGTLSG;LLNQASSPMVGTLSGL;LNQASSPMVGTLSGLG;NQASSPMVGTLSGLGN;QASSPMVGTLSGLGNA;ASSPMVGTLSGLGNAG;SSPMVGTLSGLGNAGS;SPMVGTLSGLGNAGSL;PMVGTLSGLGNAGSLA;MVGTLSGLGNAGSLAS;VGTLSGLGNAGSLASG;GTLSGLGNAGSLASGV;TLSGLGNAGSLASGVL;LSGLGNAGSLASGVLN;SGLGNAGSLASGVLNS;GLGNAGSLASGVLNSG;LGNAGSLASGVLNSGV;GNAGSLASGVLNSGVD;NAGSLASGVLNSGVDI;AGSLASGVLNSGVDIS;GSLASGVLNSGVDISG;SLASGVLNSGVDISGM;LASGVLNSGVDISGMF;ASGVLNSGVDISGMFN;SGVLNSGVDISGMFNV;GVLNSGVDISGMFNVS;VLNSGVDISGMFNVST;LNSGVDISGMFNVSTL;NSGVDISGMFNVSTLG;SGVDISGMFNVSTLGS;GVDISGMFNVSTLGSA;VDISGMFNVSTLGSAP;DISGMFNVSTLGSAPA;ISGMFNVSTLGSAPAV;SGMFNVSTLGSAPAVI;GMFNVSTLGSAPAVIS;MFNVSTLGSAPAVISG;FNVSTLGSAPAVISGF;NVSTLGSAPAVISGFG;VSTLGSAPAVISGFGN;STLGSAPAVISGFGNL;TLGSAPAVISGFGNLG;LGSAPAVISGFGNLGN;GSAPAVISGFGNLGNH;SAPAVISGFGNLGNHV; | |

Fig. 30 continued

| | | |
|---|---|---|
| | APAVISGFGNLGNHVS;PAVISGFGNLGNHVSG;AVISGFGNLGNHVSGV;VISGFGNLGNHVSGVS;ISGFGNLGNHVSGVSI;SGFGNLGNHVSGVSID;GFGNLGNHVSGVSIDG;FGNLGNHVSGVSIDGL;GNLGNHVSGVSIDGLL;NLGNHVSGVSIDGLLA;LGNHVSGVSIDGLLAM;GNHVSGVSIDGLLAML;NHVSGVSIDGLLAMLT;HVSGVSIDGLLAMLTS;VSGVSIDGLLAMLTSG;SGVSIDGLLAMLTSGG;GVSIDGLLAMLTSGGS;VSIDGLLAMLTSGGSG;SIDGLLAMLTSGGSGG;IDGLLAMLTSGGSGGS;DGLLAMLTSGGSGGSG;GLLAMLTSGGSGGSGQ;LLAMLTSGGSGGSGQP;LAMLTSGGSGGSGQPS;AMLTSGGSGGSGQPSI;MLTSGGSGGSGQPSII;LTSGGSGGSGQPSIID;TSGGSGGSGQPSIIDA;SGGSGGSGQPSIIDAA;GGSGGSGQPSIIDAAI;GSGGSGQPSIIDAAIA;SGGSGQPSIIDAAIAE;GGSGQPSIIDAAIAEL;GSGQPSIIDAAIAELR;SGQPSIIDAAIAELRH;GQPSIIDAAIAELRHL;QPSIIDAAIAELRHLN;PSIIDAAIAELRHLNP;SIIDAAIAELRHLNPL;IIDAAIAELRHLNPLN;IDAAIAELRHLNPLNI;DAAIAELRHLNPLNIV;AAIAELRHLNPLNIVN;AIAELRHLNPLNIVNL;IAELRHLNPLNIVNLG;AELRHLNPLNIVNLGN;ELRHLNPLNIVNLGNV;LRHLNPLNIVNLGNVG;RHLNPLNIVNLGNVGS;HLNPLNIVNLGNVGSY;LNPLNIVNLGNVGSYN;NPLNIVNLGNVGSYNL;PLNIVNLGNVGSYNLG;LNIVNLGNVGSYNLGF;NIVNLGNVGSYNLGFA;IVNLGNVGSYNLGFAN;VNLGNVGSYNLGFANV;NLGNVGSYNLGFANVG;LGNVGSYNLGFANVGD;GNVGSYNLGFANVGDV;NVGSYNLGFANVGDVN;VGSYNLGFANVGDVNL;GSYNLGFANVGDVNLG;SYNLGFANVGDVNLGA;YNLGFANVGDVNLGAG;NLGFANVGDVNLGAGN;LGFANVGDVNLGAGNL;GFANVGDVNLGAGNLG;FANVGDVNLGAGNLGN;ANVGDVNLGAGNLGNL;NVGDVNLGAGNLGNLN;VGDVNLGAGNLGNLNL;GDVNLGAGNLGNLNLG;DVNLGAGNLGNLNLGG;VNLGAGNLGNLNLGGG;NLGAGNLGNLNLGGGN;LGAGNLGNLNLGGGNL;GAGNLGNLNLGGGNLG;AGNLGNLNLGGGNLGG;GNLGNLNLGGGNLGGQ;NLGNLNLGGGNLGGQN;LGNLNLGGGNLGGQNL;GNLNLGGGNLGGQNLG;NLNLGGGNLGGQNLGL;LNLGGGNLGGQNLGLG;NLGGGNLGGQNLGLGN;LGGGNLGGQNLGLGNL;GGGNLGGQNLGLGNLG;GGNLGGQNLGLGNLGD;GNLGGQNLGLGNLGDG;NLGGQNLGLGNLGDGN;LGGQNLGLGNLGDGNV;GGQNLGLGNLGDGNVG;GQNLGLGNLGDGNVGF;QNLGLGNLGDGNVGFG;NLGLGNLGDGNVGFGN;LGLGNLGDGNVGFGNL;GLGNLGDGNVGFGNLG;LGNLGDGNVGFGNLGH;GNLGDGNVGFGNLGHG;NLGDGNVGFGNLGHGN;LGDGNVGFGNLGHGNV;GDGNVGFGNLGHGNVG;DGNVGFGNLGHGNVGF;GNVGFGNLGHGNVGFG;NVGFGNLGHGNVGFGN;VGFGNLGHGNVGFGNS;GFGNLGHGNVGFGNSG;FGNLGHGNVGFGNSGL;GNLGHGNVGFGNSGLG;NLGHGNVGFGNSGLGA;LGHGNVGFGNSGLGAL;GHGNVGFGNSGLGALP;HGNVGFGNSGLGALPG;GNVGFGNSGLGALPGI;NVGFGNSGLGALPGIG;VGFGNSGLGALPGIGN;GFGNSGLGALPGIGNI;FGNSGLGALPGIGNIG;GNSGLGALPGIGNIGL;NSGLGALPGIGNIGLG;SGLGALPGIGNIGLGN;GLGALPGIGNIGLGNA;LGALPGIGNIGLGNAG;GALPGIGNIGLGNAGS;ALPGIGNIGLGNAGSN;LPGIGNIGLGNAGSNN;PGIGNIGLGNAGSNNV;GIGNIGLGNAGSNNVG;IGNIGLGNAGSNNVGF;GNIGLGNAGSNNVGFG;NIGLGNAGSNNVGFGN;IGLGNAGSNNVGFGNM;GLGNAGSNNVGFGNMG;LGNAGSNNVGFGNMGL;GNAGSNNVGFGNMGLG;NAGSNNVGFGNMGLGN;AGSNNVGFGNMGLGNI;GSNNVGFGNMGLGNIG;SNNVGFGNMGLGNIGF;NNVGFGNMGLGNIGFG;NVGFGNMGLGNIGFGN;VGFGNMGLGNIGFGNT;GFGNMGLGNIGFGNTG;FGNMGLGNIGFGNTGT;GNMGLGNIGFGNTGTN;NMGLGNIGFGNTGTNN;MGLGNIGFGNTGTNNL;GLGNIGFGNTGTNNLG;LGNIGFGNTGTNNLGI;GNIGFGNTGTNNLGIG;NIGFGNTGTNNLGIGL;IGFGNTGTNNLGIGLT;GFGNTGTNNLGIGLTG;FGNTGTNNLGIGLTGD;GNTGTNNLGIGLTGDN;NTGTNNLGIGLTGDNQ;TGTNNLGIGLTGDNQT;GTNNLGIGLTGDNQTG;TNNLGIGLTGDNQTGF;NNLGIGLTGDNQTGFG;NLGIGL | |

Fig. 30 continued

| | | |
|---|---|---|
| | TGDNQTGFGG;LGIGLTGDNQTGFGGL;GIGLTGDNQTGFGGLN;IGLTGDNQTGFGGLNS;GLTGDNQTGFGGLNSG;LTGDNQTGFGGLNSGA;TGDNQTGFGGLNSGAG;GDNQTGFGGLNSGAGN;DNQTGFGGLNSGAGNL;NQTGFGGLNSGAGNLG;QTGFGGLNSGAGNLGL;TGFGGLNSGAGNLGLF;GFGGLNSGAGNLGLFN;FGGLNSGAGNLGLFNS;GGLNSGAGNLGLFNSG;GLNSGAGNLGLFNSGT;LNSGAGNLGLFNSGTG;NSGAGNLGLFNSGTGN;SGAGNLGLFNSGTGNI;GAGNLGLFNSGTGNIG;AGNLGLFNSGTGNIGF;GNLGLFNSGTGNIGFF;NLGLFNSGTGNIGFFN;LGLFNSGTGNIGFFNT;GLFNSGTGNIGFFNTG;LFNSGTGNIGFFNTGT;FNSGTGNIGFFNTGTG;NSGTGNIGFFNTGTGN;SGTGNIGFFNTGTGNW;GTGNIGFFNTGTGNWG;TGNIGFFNTGTGNWGL;GNIGFFNTGTGNWGLF;NIGFFNTGTGNWGLFN;IGFFNTGTGNWGLFNS;GFFNTGTGNWGLFNSG;FFNTGTGNWGLFNSGS;FNTGTGNWGLFNSGSY;NTGTGNWGLFNSGSYN;TGTGNWGLFNSGSYNT;GTGNWGLFNSGSYNTG;TGNWGLFNSGSYNTGI;GNWGLFNSGSYNTGIG;NWGLFNSGSYNTGIGN;WGLFNSGSYNTGIGNS;GLFNSGSYNTGIGNSG;LFNSGSYNTGIGNSGT;FNSGSYNTGIGNSGTG;NSGSYNTGIGNSGTGS;SGSYNTGIGNSGTGST;GSYNTGIGNSGTGSTG;SYNTGIGNSGTGSTGL;YNTGIGNSGTGSTGLF;NTGIGNSGTGSTGLFN;TGIGNSGTGSTGLFNA;GIGNSGTGSTGLFNAG;IGNSGTGSTGLFNAGS;GNSGTGSTGLFNAGSF;NSGTGSTGLFNAGSFN;SGTGSTGLFNAGSFNT;GTGSTGLFNAGSFNTG;TGSTGLFNAGSFNTGL;GSTGLFNAGSFNTGLA;STGLFNAGSFNTGLAN;TGLFNAGSFNTGLANA;GLFNAGSFNTGLANAG;LFNAGSFNTGLANAGS;FNAGSFNTGLANAGSY;NAGSFNTGLANAGSYN;AGSFNTGLANAGSYNT;GSFNTGLANAGSYNTG;SFNTGLANAGSYNTGS;FNTGLANAGSYNTGSL;NTGLANAGSYNTGSLN;TGLANAGSYNTGSLNA;GLANAGSYNTGSLNAG;LANAGSYNTGSLNAGN;ANAGSYNTGSLNAGNT;NAGSYNTGSLNAGNTN;AGSYNTGSLNAGNTNT;GSYNTGSLNAGNTNTG;SYNTGSLNAGNTNTGG;YNTGSLNAGNTNTGGF;NTGSLNAGNTNTGGFN;TGSLNAGNTNTGGFNP;GSLNAGNTNTGGFNPG;SLNAGNTNTGGFNPGN;LNAGNTNTGGFNPGNV;NAGNTNTGGFNPGNVN;AGNTNTGGFNPGNVNT;GNTNTGGFNPGNVNTG;NTNTGGFNPGNVNTGW;TNTGGFNPGNVNTGWF;NTGGFNPGNVNTGWFN;TGGFNPGNVNTGWFNA;GGFNPGNVNTGWFNAG;GFNPGNVNTGWFNAGH;FNPGNVNTGWFNAGHT;NPGNVNTGWFNAGHTN;PGNVNTGWFNAGHTNT;GNVNTGWFNAGHTNTG;NVNTGWFNAGHTNTGG;VNTGWFNAGHTNTGGF;NTGWFNAGHTNTGGFN;TGWFNAGHTNTGGFNT;GWFNAGHTNTGGFNTG;WFNAGHTNTGGFNTGN;FNAGHTNTGGFNTGNV;NAGHTNTGGFNTGNVN;AGHTNTGGFNTGNVNT;GHTNTGGFNTGNVNTG;HTNTGGFNTGNVNTGA;TNTGGFNTGNVNTGAF;NTGGFNTGNVNTGAFN;TGGFNTGNVNTGAFNS;GGFNTGNVNTGAFNSG;GFNTGNVNTGAFNSGS;FNTGNVNTGAFNSGSF;NTGNVNTGAFNSGSFN;TGNVNTGAFNSGSFNN;GNVNTGAFNSGSFNNG;NVNTGAFNSGSFNNGA;VNTGAFNSGSFNNGAL;NTGAFNSGSFNNGALW;TGAFNSGSFNNGALWT;GAFNSGSFNNGALWTG;AFNSGSFNNGALWTGD;FNSGSFNNGALWTGDH;NSGSFNNGALWTGDHH;SGSFNNGALWTGDHHG;GSFNNGALWTGDHHGL;SFNNGALWTGDHHGLV;FNNGALWTGDHHGLVG;NNGALWTGDHHGLVGF;NGALWTGDHHGLVGFS;GALWTGDHHGLVGFSY;ALWTGDHHGLVGFSYS;LWTGDHHGLVGFSYSI;WTGDHHGLVGFSYSIE;TGDHHGLVGFSYSIEI;GDHHGLVGFSYSIEIT;DHHGLVGFSYSIEITG;HHGLVGFSYSIEITGS;HGLVGFSYSIEITGST;GLVGFSYSIEITGSTL;LVGFSYSIEITGSTLV;VGFSYSIEITGSTLVD;GFSYSIEITGSTLVDI;FSYSIEITGSTLVDIN;SYSIEITGSTLVDINE;YSIEITGSTLVDINET;SIEITGSTLVDINETL;IEITGSTLVDINETLN;EITGSTLVDINETLNL;ITGSTLVDINETLNLG;TGSTLVDINETLNLGP;GSTLVDINETLNLGPV;STLVDINETLNLGPVH;TLVDINETLNLGPVHI;LVDINETLNLGPVHID;VDINETLNLGPVHIDQ;DINETLNL | |

Fig. 30 continued

| | | |
|---|---|---|
| | GPVHIDQI;INETLNLGPVHIDQID;NETLNLGPVHIDQIDI;ETLNLGPVHIDQID<br>IP;TLNLGPVHIDQIDIPG;LNLGPVHIDQIDIPGM;NLGPVHIDQIDIPGMS;LGP<br>VHIDQIDIPGMSL;GPVHIDQIDIPGMSLF;PVHIDQIDIPGMSLFD;VHIDQIDIP<br>GMSLFDI;HIDQIDIPGMSLFDIH;IDQIDIPGMSLFDIHE;DQIDIPGMSLFDIHE<br>L;QIDIPGMSLFDIHELV;IDIPGMSLFDIHELVN;DIPGMSLFDIHELVNI;IPGM<br>SLFDIHELVNIG;PGMSLFDIHELVNIGP;GMSLFDIHELVNIGPF;MSLFDIHEL<br>VNIGPFR;SLFDIHELVNIGPFRI;LFDIHELVNIGPFRIE;FDIHELVNIGPFRIEP<br>;DIHELVNIGPFRIEPI;IHELVNIGPFRIEPID;HELVNIGPFRIEPIDV;ELVNIGP<br>FRIEPIDVP;LVNIGPFRIEPIDVPA;VNIGPFRIEPIDVPAV;NIGPFRIEPIDVPA<br>VV;IGPFRIEPIDVPAVVL;GPFRIEPIDVPAVVLD;PFRIEPIDVPAVVLDI;FRIE<br>PIDVPAVVLDIH;RIEPIDVPAVVLDIHE;IEPIDVPAVVLDIHET;EPIDVPAVVL<br>DIHETM;PIDVPAVVLDIHETMV;IDVPAVVLDIHETMVI;DVPAVVLDIHETMVI<br>P;VPAVVLDIHETMVIPP;PAVVLDIHETMVIPPI;AVVLDIHETMVIPPIV;VVLDI<br>HETMVIPPIVF;VLDIHETMVIPPIVFL;LDIHETMVIPPIVFLP;DIHETMVIPPIV<br>FLPS;IHETMVIPPIVFLPSM;HETMVIPPIVFLPSMT;ETMVIPPIVFLPSMTI;T<br>MVIPPIVFLPSMTIG;MVIPPIVFLPSMTIGG;VIPPIVFLPSMTIGGQ;IPPIVFLP<br>SMTIGGQT;PPIVFLPSMTIGGQTY;PIVFLPSMTIGGQTYT;IVFLPSMTIGGQ<br>TYTI;VFLPSMTIGGQTYTIP;FLPSMTIGGQTYTIPL;LPSMTIGGQTYTIPLD;P<br>SMTIGGQTYTIPLDT;SMTIGGQTYTIPLDTP;MTIGGQTYTIPLDTPP;TIGGQ<br>TYTIPLDTPPA;IGGQTYTIPLDTPPAP;GGQTYTIPLDTPPAPA;GQTYTIPLD<br>TPPAPAP;QTYTIPLDTPPAPAPP;TYTIPLDTPPAPAPPP;YTIPLDTPPAPAP<br>PPF;TIPLDTPPAPAPPPFR;IPLDTPPAPAPPPFRL;PLDTPPAPAPPPFRLP;<br>LDTPPAPAPPPFRLPL;DTPPAPAPPPFRLPLL;TPPAPAPPPFRLPLLF;PPA<br>PAPPPFRLPLLFV;PAPAPPPFRLPLLFVN;APAPPPFRLPLLFVNA;PAPPPF<br>RLPLLFVNAL;APPPFRLPLLFVNALG;PPPFRLPLLFVNALGD;PPFRLPLLF<br>VNALGDN;PFRLPLLFVNALGDNW;FRLPLLFVNALGDNWI;RLPLLFVNALG<br>DNWIV;LPLLFVNALGDNWIVG;PLLFVNALGDNWIVGA;LLFVNALGDNWIV<br>GAS;LFVNALGDNWIVGASN;FVNALGDNWIVGASNS;VNALGDNWIVGAS<br>NST;NALGDNWIVGASNSTG;ALGDNWIVGASNSTGM;LGDNWIVGASNST<br>GMS;GDNWIVGASNSTGMSG;DNWIVGASNSTGMSGG;NWIVGASNSTGM<br>SGGF;WIVGASNSTGMSGGFV;IVGASNSTGMSGGFVT;VGASNSTGMSG<br>GFVTA;GASNSTGMSGGFVTAP;ASNSTGMSGGFVTAPT;SNSTGMSGGF<br>VTAPTQ;NSTGMSGGFVTAPTQG;STGMSGGFVTAPTQGI;TGMSGGFVTA<br>PTQGIL;GMSGGFVTAPTQGILI;MSGGFVTAPTQGILIH;SGGFVTAPTQGILI<br>HT;GGFVTAPTQGILIHTG;GFVTAPTQGILIHTGP;FVTAPTQGILIHTGPS;VT<br>APTQGILIHTGPSS;TAPTQGILIHTGPSSA;APTQGILIHTGPSSAT;PTQGILI<br>HTGPSSATT;TQGILIHTGPSSATTG;QGILIHTGPSSATTGS;GILIHTGPSSA<br>TTGSL;ILIHTGPSSATTGSLA;LIHTGPSSATTGSLAL;IHTGPSSATTGSLALT<br>;HTGPSSATTGSLALTL;TGPSSATTGSLALTLP;GPSSATTGSLALTLPT;PS<br>SATTGSLALTLPTV;SSATTGSLALTLPTVT;SATTGSLALTLPTVTI;ATTGSL<br>ALTLPTVTIP;TTGSLALTLPTVTIPT;TGSLALTLPTVTIPTI;GSLALTLPTVTIP<br>TIT;SLALTLPTVTIPTITT;LALTLPTVTIPTITTS;ALTLPTVTIPTITTSP;LTLPT<br>VTIPTITTSPI;TLPTVTIPTITTSPIP;LPTVTIPTITTSPIPL;PTVTIPTITTSPIPLK<br>;TVTIPTITTSPIPLKI;VTIPTITTSPIPLKID;TIPTITTSPIPLKIDV;IPTITTSPIPL<br>KIDVS;PTITTSPIPLKIDVSG;TITTSPIPLKIDVSGG;ITTSPIPLKIDVSGGL;TT<br>SPIPLKIDVSGGLP;TSPIPLKIDVSGGLPA;SPIPLKIDVSGGLPAF;PIPLKIDV<br>SGGLPAFT;IPLKIDVSGGLPAFTL;PLKIDVSGGLPAFTLF;LKIDVSGGLPAF<br>TLFP;KIDVSGGLPAFTLFPG;IDVSGGLPAFTLFPGG;DVSGGLPAFTLFPG<br>GL;VSGGLPAFTLFPGGLN;SGGLPAFTLFPGGLNI;GGLPAFTLFPGGLNIP;<br>GLPAFTLFPGGLNIPQ;LPAFTLFPGGLNIPQN;PAFTLFPGGLNIPQNA;AFT<br>LFPGGLNIPQNAI;FTLFPGGLNIPQNAIP;TLFPGGLNIPQNAIPL;LFPGGLNI<br>PQNAIPLT;FPGGLNIPQNAIPLTI;PGGLNIPQNAIPLTID;GGLNIPQNAIPLTI<br>DA;GLNIPQNAIPLTIDAS;LNIPQNAIPLTIDASG;NIPQNAIPLTIDASGV;IPQN | |

Fig. 30 continued

| | | |
|---|---|---|
| | AIPLTIDASGVL;PQNAIPLTIDASGVLD;QNAIPLTIDASGVLDP;NAIPLTIDASGVLDPI;AIPLTIDASGVLDPIT;IPLTIDASGVLDPITI;PLTIDASGVLDPITIF;LTIDASGVLDPITIFP;TIDASGVLDPITIFPG;IDASGVLDPITIFPGG;DASGVLDPITIFPGGF;ASGVLDPITIFPGGFT;SGVLDPITIFPGGFTI;GVLDPITIFPGGFTID;VLDPITIFPGGFTIDP;LDPITIFPGGFTIDPL;DPITIFPGGFTIDPLP;PITIFPGGFTIDPLPL;ITIFPGGFTIDPLPLS;TIFPGGFTIDPLPLSL;IFPGGFTIDPLPLSLA;FPGGFTIDPLPLSLAL;PGGFTIDPLPLSLALN;GGFTIDPLPLSLALNI;GFTIDPLPLSLALNIS;FTIDPLPLSLALNISV;TIDPLPLSLALNISVP;IDPLPLSLALNISVPD;DPLPLSLALNISVPDS;PLPLSLALNISVPDSS;LPLSLALNISVPDSSV;PLSLALNISVPDSSVP;LSLALNISVPDSSVPI;SLALNISVPDSSVPII;LALNISVPDSSVPIII;ALNISVPDSSVPIIIV;LNISVPDSSVPIIIVP;NISVPDSSVPIIIVPP;ISVPDSSVPIIIVPPT;SVPDSSVPIIIVPPTP;VPDSSVPIIIVPPTPG;PDSSVPIIIVPPTPGF;DSSVPIIIVPPTPGFG;SSVPIIIVPPTPGFGN;SVPIIIVPPTPGFGNA;VPIIIVPPTPGFGNAT;PIIIVPPTPGFGNATA;IIIVPPTPGFGNATAT;IIVPPTPGFGNATATP;IVPPTPGFGNATATPS;VPPTPGFGNATATPSS;PPTPGFGNATATPSSG;PTPGFGNATATPSSGF;TPGFGNATATPSSGFF;PGFGNATATPSSGFFN;GFGNATATPSSGFFNS;FGNATATPSSGFFNSG;GNATATPSSGFFNSGA;NATATPSSGFFNSGAG;ATATPSSGFFNSGAGG;TATPSSGFFNSGAGGV;ATPSSGFFNSGAGGVS;TPSSGFFNSGAGGVSG;PSSGFFNSGAGGVSGF;SSGFFNSGAGGVSGFG;SGFFNSGAGGVSGFGN;GFFNSGAGGVSGFGNF;FFNSGAGGVSGFGNFG;FNSGAGGVSGFGNFGA;NSGAGGVSGFGNFGAG;SGAGGVSGFGNFGAGS;GAGGVSGFGNFGAGSS;AGGVSGFGNFGAGSSG;GGVSGFGNFGAGSSGW;GVSGFGNFGAGSSGWW;VSGFGNFGAGSSGWWN;SGFGNFGAGSSGWWNQ;GFGNFGAGSSGWWNQA;FGNFGAGSSGWWNQAH;GNFGAGSSGWWNQAHA;NFGAGSSGWWNQAHAA;FGAGSSGWWNQAHAAL;GAGSSGWWNQAHAALA;AGSSGWWNQAHAALAG;GSSGWWNQAHAALAGA;SSGWWNQAHAALAGAG;SGWWNQAHAALAGAGS;GWWNQAHAALAGAGSG;WWNQAHAALAGAGSGV;WNQAHAALAGAGSGVL;NQAHAALAGAGSGVLN;QAHAALAGAGSGVLNV;AHAALAGAGSGVLNVG;HAALAGAGSGVLNVGT;AALAGAGSGVLNVGTL;ALAGAGSGVLNVGTLN;LAGAGSGVLNVGTLNS;AGAGSGVLNVGTLNSG;GAGSGVLNVGTLNSGV;AGSGVLNVGTLNSGVL;GSGVLNVGTLNSGVLN;SGVLNVGTLNSGVLNV;GVLNVGTLNSGVLNVG;VLNVGTLNSGVLNVGS;LNVGTLNSGVLNVGSG;NVGTLNSGVLNVGSGI;VGTLNSGVLNVGSGIS;GTLNSGVLNVGSGISG;TLNSGVLNVGSGISGL;LNSGVLNVGSGISGLY;NSGVLNVGSGISGLYN;SGVLNVGSGISGLYNT;GVLNVGSGISGLYNTA;VLNVGSGISGLYNTAI;LNVGSGISGLYNTAIV;NVGSGISGLYNTAIVG;VGSGISGLYNTAIVGL;GSGISGLYNTAIVGLG;SGISGLYNTAIVGLGT;GISGLYNTAIVGLGTP;ISGLYNTAIVGLGTPA;SGLYNTAIVGLGTPAL;GLYNTAIVGLGTPALV;LYNTAIVGLGTPALVS;YNTAIVGLGTPALVSG;NTAIVGLGTPALVSGA;TAIVGLGTPALVSGAG;AIVGLGTPALVSGAGN;IVGLGTPALVSGAGNV;VGLGTPALVSGAGNVG;GLGTPALVSGAGNVGQ;LGTPALVSGAGNVGQQ;GTPALVSGAGNVGQQL;TPALVSGAGNVGQQLS;PALVSGAGNVGQQLSG;ALVSGAGNVGQQLSGV;LVSGAGNVGQQLSGVL;VSGAGNVGQQLSGVLA;SGAGNVGQQLSGVLAA;GAGNVGQQLSGVLAAG;AGNVGQQLSGVLAAGT;GNVGQQLSGVLAAGTA;NVGQQLSGVLAAGTAL;VGQQLSGVLAAGTALT;GQQLSGVLAAGTALTQ;QQLSGVLAAGTALTQS;QLSGVLAAGTALTQSP;LSGVLAAGTALTQSPI;SGVLAAGTALTQSPII;GVLAAGTALTQSPIIN;VLAAGTALTQSPIINL;LAAGTALTQSPIINLG;AAGTALTQSPIINLGL;AGTALTQSPIINLGLA;GTALTQSPIINLGLAD;TALTQSPIINLGLADV;ALTQSPIINLGLADVG;LTQSPIINLGLADVGN;TQSPIINLGLADVGNY;QSPIINLGLADVGNYN;SPIINLGLADVGNYNL;PIINLGLADVGNYNLG;IINLGLADVGNYNLGL;INLGLADVGNYNLGLG;NLGLADVGNYNLGLGN;LGLADVGNYNLGLGNV;GLADVGNYNLG | |

Fig. 30 continued

| | | |
|---|---|---|
| | LGNVG;LADVGNYNLGLGNVGD;ADVGNYNLGLGNVGDF;DVGNYNLGLGNVGDFN;VGNYNLGLGNVGDFNL;GNYNLGLGNVGDFNLG;NYNLGLGNVGDFNLGA;YNLGLGNVGDFNLGAA;NLGLGNVGDFNLGAAN;LGLGNVGDFNLGAANL;GLGNVGDFNLGAANLG;LGNVGDFNLGAANLGD;GNVGDFNLGAANLGDL;NVGDFNLGAANLGDLN;VGDFNLGAANLGDLNL;GDFNLGAANLGDLNLG;DFNLGAANLGDLNLGL;FNLGAANLGDLNLGLG;NLGAANLGDLNLGLGN;LGAANLGDLNLGLGNI;GAANLGDLNLGLGNIG;AANLGDLNLGLGNIGN;ANLGDLNLGLGNIGNA;NLGDLNLGLGNIGNAN;LGDLNLGLGNIGNANV;GDLNLGLGNIGNANVG;DLNLGLGNIGNANVGF;LNLGLGNIGNANVGFG;NLGLGNIGNANVGFGN;LGLGNIGNANVGFGNI;GLGNIGNANVGFGNIG;LGNIGNANVGFGNIGH;GNIGNANVGFGNIGHG;NIGNANVGFGNIGHGN;IGNANVGFGNIGHGNV;GNANVGFGNIGHGNVG;NANVGFGNIGHGNVGF;ANVGFGNIGHGNVGFG;NVGFGNIGHGNVGFGN;VGFGNIGHGNVGFGNS;GFGNIGHGNVGFGNSG;FGNIGHGNVGFGNSGL;GNIGHGNVGFGNSGLG;NIGHGNVGFGNSGLGA;IGHGNVGFGNSGLGAA;GHGNVGFGNSGLGAAL;HGNVGFGNSGLGAALG;GNVGFGNSGLGAALGI;NVGFGNSGLGAALGIG;VGFGNSGLGAALGIGN;GFGNSGLGAALGIGNI;FGNSGLGAALGIGNIG;GNSGLGAALGIGNIGL;NSGLGAALGIGNIGLG;SGLGAALGIGNIGLGN;GLGAALGIGNIGLGNA;LGAALGIGNIGLGNAG;GAALGIGNIGLGNAGS;AALGIGNIGLGNAGST;ALGIGNIGLGNAGSTN;LGIGNIGLGNAGSTNV;GIGNIGLGNAGSTNVG;IGNIGLGNAGSTNVGL;GNIGLGNAGSTNVGLA;NIGLGNAGSTNVGLAN;IGLGNAGSTNVGLANM;GLGNAGSTNVGLANMG;LGNAGSTNVGLANMGV;GNAGSTNVGLANMGVG;NAGSTNVGLANMGVGN;AGSTNVGLANMGVGNI;GSTNVGLANMGVGNIG;STNVGLANMGVGNIGF;TNVGLANMGVGNIGFA;NVGLANMGVGNIGFAN;VGLANMGVGNIGFANT;GLANMGVGNIGFANTG;LANMGVGNIGFANTGT;ANMGVGNIGFANTGTN;NMGVGNIGFANTGTNN;MGVGNIGFANTGTNNL;GVGNIGFANTGTNNLG;VGNIGFANTGTNNLGI;GNIGFANTGTNNLGIG;NIGFANTGTNNLGIGL;IGFANTGTNNLGIGLT;GFANTGTNNLGIGLTG;FANTGTNNLGIGLTGD;ANTGTNNLGIGLTGDN;NTGTNNLGIGLTGDNQ;TGTNNLGIGLTGDNQT;GTNNLGIGLTGDNQTG;TNNLGIGLTGDNQTGI;NNLGIGLTGDNQTGIG;NLGIGLTGDNQTGIGG;LGIGLTGDNQTGIGGL;GIGLTGDNQTGIGGLN;IGLTGDNQTGIGGLNS;GLTGDNQTGIGGLNSG;LTGDNQTGIGGLNSGA;TGDNQTGIGGLNSGAG;GDNQTGIGGLNSGAGN;DNQTGIGGLNSGAGNI;NQTGIGGLNSGAGNIG;QTGIGGLNSGAGNIGL;TGIGGLNSGAGNIGLF;GIGGLNSGAGNIGLFN;IGGLNSGAGNIGLFNS;GGLNSGAGNIGLFNSG;GLNSGAGNIGLFNSGT;LNSGAGNIGLFNSGTG;NSGAGNIGLFNSGTGN;SGAGNIGLFNSGTGNI;GAGNIGLFNSGTGNIG;AGNIGLFNSGTGNIGF;GNIGLFNSGTGNIGFF;NIGLFNSGTGNIGFFN;IGLFNSGTGNIGFFNS;GLFNSGTGNIGFFNSG;LFNSGTGNIGFFNSGT;FNSGTGNIGFFNSGTG;NSGTGNIGFFNSGTGN;SGTGNIGFFNSGTGNW;GTGNIGFFNSGTGNWG;TGNIGFFNSGTGNWGL;GNIGFFNSGTGNWGLF;NIGFFNSGTGNWGLFN;IGFFNSGTGNWGLFNS;GFFNSGTGNWGLFNSG;FFNSGTGNWGLFNSGS;FNSGTGNWGLFNSGSF;NSGTGNWGLFNSGSFN;SGTGNWGLFNSGSFNT;GTGNWGLFNSGSFNTG;TGNWGLFNSGSFNTGI;GNWGLFNSGSFNTGIG;NWGLFNSGSFNTGIGN;WGLFNSGSFNTGIGNS;GLFNSGSFNTGIGNSG;LFNSGSFNTGIGNSGT;FNSGSFNTGIGNSGTG;NSGSFNTGIGNSGTGS;SGSFNTGIGNSGTGST;GSFNTGIGNSGTGSTG;SFNTGIGNSGTGSTGL;FNTGIGNSGTGSTGLF;NTGIGNSGTGSTGLFN;TGIGNSGTGSTGLFNA;GIGNSGTGSTGLFNAG;IGNSGTGSTGLFNAGG;GNSGTGSTGLFNAGGF;NSGTGSTGLFNAGGFT;SGTGSTGLFNAGGFTT;GTGSTGLFNAGGFTTG;TGSTGLFNAGGFTTGL;GSTGLFNAGGFTTGLA;STGLFNAGGFTTGLAN;TGLFNAGGFTTGLANA;GLFNAGGFTTGLANAG;LFNAGGFTTGLANAGS;FNAGGFTTGLANAGSY;NAGGFTTGLANAGSYN;AGGFTTG | |

Fig. 30 continued

| | | |
|---|---|---|
| | LANAGSYNT;GGFTTGLANAGSYNTG;GFTTGLANAGSYNTGS;FTTGLANAGSYNTGSF;TTGLANAGSYNTGSFN;TGLANAGSYNTGSFNV;GLANAGSYNTGSFNVG;LANAGSYNTGSFNVGD;ANAGSYNTGSFNVGDT;NAGSYNTGSFNVGDTN;AGSYNTGSFNVGDTNT;GSYNTGSFNVGDTNTG;SYNTGSFNVGDTNTGG;YNTGSFNVGDTNTGGF;NTGSFNVGDTNTGGFN;TGSFNVGDTNTGGFNP;GSFNVGDTNTGGFNPG;SFNVGDTNTGGFNPGS;FNVGDTNTGGFNPGSI;NVGDTNTGGFNPGSIN;VGDTNTGGFNPGSINT;GDTNTGGFNPGSINTG;DTNTGGFNPGSINTGW;TNTGGFNPGSINTGWF;NTGGFNPGSINTGWFN;TGGFNPGSINTGWFNT;GGFNPGSINTGWFNTG;GFNPGSINTGWFNTGN;FNPGSINTGWFNTGNA;NPGSINTGWFNTGNAN;PGSINTGWFNTGNANT;GSINTGWFNTGNANTG;SINTGWFNTGNANTGI;INTGWFNTGNANTGIA;NTGWFNTGNANTGIAN;TGWFNTGNANTGIANS;GWFNTGNANTGIANSG;WFNTGNANTGIANSGN;FNTGNANTGIANSGNV;NTGNANTGIANSGNVD;TGNANTGIANSGNVDT;GNANTGIANSGNVDTG;NANTGIANSGNVDTGA;ANTGIANSGNVDTGAL;NTGIANSGNVDTGALM;TGIANSGNVDTGALMS;GIANSGNVDTGALMSG;IANSGNVDTGALMSGN;ANSGNVDTGALMSGNF;NSGNVDTGALMSGNFS;SGNVDTGALMSGNFSN;GNVDTGALMSGNFSNG;NVDTGALMSGNFSNGI;VDTGALMSGNFSNGIL;DTGALMSGNFSNGILW;TGALMSGNFSNGILWR;GALMSGNFSNGILWRG;ALMSGNFSNGILWRGN;LMSGNFSNGILWRGNY;MSGNFSNGILWRGNYE;SGNFSNGILWRGNYEG;GNFSNGILWRGNYEGL;NFSNGILWRGNYEGLF;FSNGILWRGNYEGLFS;SNGILWRGNYEGLFSY;NGILWRGNYEGLFSYS;GILWRGNYEGLFSYSY;ILWRGNYEGLFSYSYS;LWRGNYEGLFSYSYSL;WRGNYEGLFSYSYSLD;RGNYEGLFSYSYSLDV;GNYEGLFSYSYSLDVP;NYEGLFSYSYSLDVPR;YEGLFSYSYSLDVPRI;EGLFSYSYSLDVPRIT;GLFSYSYSLDVPRITI;LFSYSYSLDVPRITIL;FSYSYSLDVPRITILD;SYSYSLDVPRITILDA;YSYSLDVPRITILDAH;SYSLDVPRITILDAHF;YSLDVPRITILDAHFT;SLDVPRITILDAHFTG;LDVPRITILDAHFTGA;DVPRITILDAHFTGAF;VPRITILDAHFTGAFG;PRITILDAHFTGAFGP;RITILDAHFTGAFGPV;ITILDAHFTGAFGPVV;TILDAHFTGAFGPVVV;ILDAHFTGAFGPVVVP;LDAHFTGAFGPVVVPP;DAHFTGAFGPVVVPPI;AHFTGAFGPVVVPPIP;HFTGAFGPVVVPPIPV;FTGAFGPVVVPPIPVL;TGAFGPVVVPPIPVLA;GAFGPVVVPPIPVLAI;AFGPVVVPPIPVLAIN;FGPVVVPPIPVLAINA;GPVVVPPIPVLAINAH;PVVVPPIPVLAINAHL;VVVPPIPVLAINAHLT;VVPPIPVLAINAHLTG;VPPIPVLAINAHLTGN;PPIPVLAINAHLTGNA;PIPVLAINAHLTGNAA;IPVLAINAHLTGNAAM;PVLAINAHLTGNAAMG;VLAINAHLTGNAAMGA;LAINAHLTGNAAMGAF;AINAHLTGNAAMGAFT;INAHLTGNAAMGAFTI;NAHLTGNAAMGAFTIP;AHLTGNAAMGAFTIPQ;HLTGNAAMGAFTIPQI;LTGNAAMGAFTIPQID;TGNAAMGAFTIPQIDI;GNAAMGAFTIPQIDIP;NAAMGAFTIPQIDIPA;AAMGAFTIPQIDIPAL;AMGAFTIPQIDIPALN;MGAFTIPQIDIPALNP;GAFTIPQIDIPALNPN;AFTIPQIDIPALNPNV;FTIPQIDIPALNPNVT;TIPQIDIPALNPNVTG;IPQIDIPALNPNVTGS;PQIDIPALNPNVTGSV;QIDIPALNPNVTGSVG;IDIPALNPNVTGSVGF;DIPALNPNVTGSVGFG;IPALNPNVTGSVGFGP;PALNPNVTGSVGFGPI;ALNPNVTGSVGFGPIA;LNPNVTGSVGFGPIAV;NPNVTGSVGFGPIAVP;PNVTGSVGFGPIAVPS;NVTGSVGFGPIAVPSV;VTGSVGFGPIAVPSVT;TGSVGFGPIAVPSVTI;GSVGFGPIAVPSVTIP;SVGFGPIAVPSVTIPA;VGFGPIAVPSVTIPAL;GFGPIAVPSVTIPALT;FGPIAVPSVTIPALTA;GPIAVPSVTIPALTAA;PIAVPSVTIPALTAAR;IAVPSVTIPALTAARA;AVPSVTIPALTAARAV;VPSVTIPALTAARAVL;PSVTIPALTAARAVLD;SVTIPALTAARAVLDM;VTIPALTAARAVLDMA;TIPALTAARAVLDMAA;IPALTAARAVLDMAAS;PALTAARAVLDMAASV;ALTAARAVLDMAASVG;LTAARAVLDMAASVGA;TAARAVLDMAASVGAT;AARAVLDMAASVGATS;ARAVLDMAASVGATSE;RAVLDMAASVGATSEI;AVLDMAASVGATSEIE;VLDMAASVGATSEIEP;LDMAASVGATSEIEPF;DMAASVG | |

Fig. 30 continued

| | | |
|---|---|---|
| | ATSEIEPFI;MAASVGATSEIEPFIV;AASVGATSEIEPFIVW;ASVGATSEIEPFIVWT;SVGATSEIEPFIVWTS;VGATSEIEPFIVWTSS;GATSEIEPFIVWTSSG;ATSEIEPFIVWTSSGA;TSEIEPFIVWTSSGAI;SEIEPFIVWTSSGAIG;EIEPFIVWTSSGAIGP;IEPFIVWTSSGAIGPT;EPFIVWTSSGAIGPTW;PFIVWTSSGAIGPTWY;FIVWTSSGAIGPTWYS;IVWTSSGAIGPTWYSV;VWTSSGAIGPTWYSVG;WTSSGAIGPTWYSVGR;TSSGAIGPTWYSVGRI;SSGAIGPTWYSVGRIY;SGAIGPTWYSVGRIYN;GAIGPTWYSVGRIYNA;AIGPTWYSVGRIYNAG;IGPTWYSVGRIYNAGD;GPTWYSVGRIYNAGDL;PTWYSVGRIYNAGDLF;TWYSVGRIYNAGDLFV;WYSVGRIYNAGDLFVG;YSVGRIYNAGDLFVGG;SVGRIYNAGDLFVGGN;VGRIYNAGDLFVGGNI;GRIYNAGDLFVGGNII;RIYNAGDLFVGGNIIS;IYNAGDLFVGGNIISG;YNAGDLFVGGNIISGI;NAGDLFVGGNIISGIP;AGDLFVGGNIISGIPT;GDLFVGGNIISGIPTL;DLFVGGNIISGIPTLS;LFVGGNIISGIPTLST;FVGGNIISGIPTLSTT;VGGNIISGIPTLSTTG;GGNIISGIPTLSTTGP;GNIISGIPTLSTTGPV;NIISGIPTLSTTGPVH;IISGIPTLSTTGPVHA;ISGIPTLSTTGPVHAV;SGIPTLSTTGPVHAVF;GIPTLSTTGPVHAVFN;IPTLSTTGPVHAVFNA;PTLSTTGPVHAVFNAA;TLSTTGPVHAVFNAAS;LSTTGPVHAVFNAASQ;STTGPVHAVFNAASQA;TTGPVHAVFNAASQAF;TGPVHAVFNAASQAFN;GPVHAVFNAASQAFNT;PVHAVFNAASQAFNTP;VHAVFNAASQAFNTPA;HAVFNAASQAFNTPAL;AVFNAASQAFNTPALN;VFNAASQAFNTPALNI;FNAASQAFNTPALNIH;NAASQAFNTPALNIHQ;AASQAFNTPALNIHQI;ASQAFNTPALNIHQIP;SQAFNTPALNIHQIPL;QAFNTPALNIHQIPLG;AFNTPALNIHQIPLGF;FNTPALNIHQIPLGFQ;NTPALNIHQIPLGFQV;TPALNIHQIPLGFQVP;PALNIHQIPLGFQVPG;ALNIHQIPLGFQVPGS;LNIHQIPLGFQVPGSI;NIHQIPLGFQVPGSID;IHQIPLGFQVPGSIDA;HQIPLGFQVPGSIDAI;QIPLGFQVPGSIDAIT;IPLGFQVPGSIDAITL;PLGFQVPGSIDAITLF;LGFQVPGSIDAITLFP;GFQVPGSIDAITLFPG;FQVPGSIDAITLFPGG;QVPGSIDAITLFPGGL;VPGSIDAITLFPGGLT;PGSIDAITLFPGGLTF;GSIDAITLFPGGLTFP;SIDAITLFPGGLTFPA;IDAITLFPGGLTFPAN;DAITLFPGGLTFPANS;AITLFPGGLTFPANSL;ITLFPGGLTFPANSLL;TLFPGGLTFPANSLLN;LFPGGLTFPANSLLNL;FPGGLTFPANSLLNLD;PGGLTFPANSLLNLDV;GGLTFPANSLLNLDVF;GLTFPANSLLNLDVFV;LTFPANSLLNLDVFVG;TFPANSLLNLDVFVGT;FPANSLLNLDVFVGTP;PANSLLNLDVFVGTPG;ANSLLNLDVFVGTPGA;NSLLNLDVFVGTPGAT;SLLNLDVFVGTPGATI;LLNLDVFVGTPGATIP;LNLDVFVGTPGATIPA;NLDVFVGTPGATIPAI;LDVFVGTPGATIPAIT;DVFVGTPGATIPAITF;VFVGTPGATIPAITFP;FVGTPGATIPAITFPE;VGTPGATIPAITFPEI;GTPGATIPAITFPEIP;TPGATIPAITFPEIPA;PGATIPAITFPEIPAN;GATIPAITFPEIPANA;ATIPAITFPEIPANAD;TIPAITFPEIPANADG;IPAITFPEIPANADGE;PAITFPEIPANADGEL;AITFPEIPANADGELY;ITFPEIPANADGELYV;TFPEIPANADGELYVI;FPEIPANADGELYVIA;PEIPANADGELYVIAG;EIPANADGELYVIAGD;IPANADGELYVIAGDI;PANADGELYVIAGDIP;ANADGELYVIAGDIPL;NADGELYVIAGDIPLI;ADGELYVIAGDIPLIN;DGELYVIAGDIPLINI;GELYVIAGDIPLINIP;ELYVIAGDIPLINIPP;LYVIAGDIPLINIPPT;YVIAGDIPLINIPPTP;VIAGDIPLINIPPTPG;IAGDIPLINIPPTPGI;AGDIPLINIPPTPGIG;GDIPLINIPPTPGIGN;DIPLINIPPTPGIGNT;IPLINIPPTPGIGNTT;PLINIPPTPGIGNTTT;LINIPPTPGIGNTTTV;INIPPTPGIGNTTTVP;NIPPTPGIGNTTTVPS;IPPTPGIGNTTTVPSS;PPTPGIGNTTTVPSSG;PTPGIGNTTTVPSSGF;TPGIGNTTTVPSSGFF;PGIGNTTTVPSSGFFN;GIGNTTTVPSSGFFNT;IGNTTTVPSSGFFNTG;GNTTTVPSSGFFNTGA;NTTTVPSSGFFNTGAG;TTTVPSSGFFNTGAGG;TTVPSSGFFNTGAGGG;TVPSSGFFNTGAGGGS;VPSSGFFNTGAGGGSG;PSSGFFNTGAGGGSGF;SSGFFNTGAGGGSGFG;SGFFNTGAGGGSGFGN;GFFNTGAGGGSGFGNF;FFNTGAGGGSGFGNFG;FNTGAGGGSGFGNFGA;NTGAGGGSGFGNFGAN;TGAGGGSGFGNFGANM;GAGGGSGFGNFGANMS;AGGGSGFGNFGANMSG;GGG | |

Fig. 30 continued

| | | |
|---|---|---|
| | SGFGNFGANMSGW;GGSGFGNFGANMSGWW;GSGFGNFGANMSGWWN;SGFGNFGANMSGWWNQ;GFGNFGANMSGWWNQA;FGNFGANMSGWWNQAH;GNFGANMSGWWNQAHT;NFGANMSGWWNQAHTA;FGANMSGWWNQAHTAL;GANMSGWWNQAHTALA;ANMSGWWNQAHTALAG;NMSGWWNQAHTALAGA;MSGWWNQAHTALAGAG;SGWWNQAHTALAGAGS;GWWNQAHTALAGAGSG;WWNQAHTALAGAGSGI;WNQAHTALAGAGSGIA;NQAHTALAGAGSGIAN;QAHTALAGAGSGIANV;AHTALAGAGSGIANVG;HTALAGAGSGIANVGT;TALAGAGSGIANVGTL;ALAGAGSGIANVGTLH;LAGAGSGIANVGTLHS;AGAGSGIANVGTLHSG;GAGSGIANVGTLHSGV;AGSGIANVGTLHSGVL;GSGIANVGTLHSGVLN;SGIANVGTLHSGVLNL;GIANVGTLHSGVLNLG;IANVGTLHSGVLNLGS;ANVGTLHSGVLNLGSG;NVGTLHSGVLNLGSGL;VGTLHSGVLNLGSGLS;GTLHSGVLNLGSGLSG;TLHSGVLNLGSGLSGI;LHSGVLNLGSGLSGIY;HSGVLNLGSGLSGIYN;SGVLNLGSGLSGIYNT;GVLNLGSGLSGIYNTS;VLNLGSGLSGIYNTST;LNLGSGLSGIYNTSTL;NLGSGLSGIYNTSTLP;LGSGLSGIYNTSTLPL;GSGLSGIYNTSTLPLG;SGLSGIYNTSTLPLGT;GLSGIYNTSTLPLGTP;LSGIYNTSTLPLGTPA;SGIYNTSTLPLGTPAL;GIYNTSTLPLGTPALV;IYNTSTLPLGTPALVS;YNTSTLPLGTPALVSG;NTSTLPLGTPALVSGL;TSTLPLGTPALVSGLG;STLPLGTPALVSGLGN;TLPLGTPALVSGLGNV;LPLGTPALVSGLGNVG;PLGTPALVSGLGNVGD;LGTPALVSGLGNVGDH;GTPALVSGLGNVGDHL;TPALVSGLGNVGDHLS;PALVSGLGNVGDHLSG;ALVSGLGNVGDHLSGL;LVSGLGNVGDHLSGLL;VSGLGNVGDHLSGLLA;SGLGNVGDHLSGLLAS;GLGNVGDHLSGLLASN;LGNVGDHLSGLLASNV;GNVGDHLSGLLASNVG;NVGDHLSGLLASNVGQ;VGDHLSGLLASNVGQN;GDHLSGLLASNVGQNP;DHLSGLLASNVGQNPI;HLSGLLASNVGQNPIT;LSGLLASNVGQNPITI;SGLLASNVGQNPITIV;GLLASNVGQNPITIVN;LLASNVGQNPITIVNI;LASNVGQNPITIVNIG;ASNVGQNPITIVNIGL;SNVGQNPITIVNIGLA;NVGQNPITIVNIGLAN;VGQNPITIVNIGLANV;GQNPITIVNIGLANVG;QNPITIVNIGLANVGN;NPITIVNIGLANVGNG;PITIVNIGLANVGNGN;ITIVNIGLANVGNGNV;TIVNIGLANVGNGNVG;IVNIGLANVGNGNVGL;VNIGLANVGNGNVGLG;NIGLANVGNGNVGLGN;IGLANVGNGNVGLGNI;GLANVGNGNVGLGNIG;LANVGNGNVGLGNIGN;ANVGNGNVGLGNIGNL;NVGNGNVGLGNIGNLN;VGNGNVGLGNIGNLNL;GNGNVGLGNIGNLNLG;NGNVGLGNIGNLNLGA;GNVGLGNIGNLNLGAA;NVGLGNIGNLNLGAAN;VGLGNIGNLNLGAANI;GLGNIGNLNLGAANIG;LGNIGNLNLGAANIGD;GNIGNLNLGAANIGDV;NIGNLNLGAANIGDVN;IGNLNLGAANIGDVNL;GNLNLGAANIGDVNLG;NLNLGAANIGDVNLGF;LNLGAANIGDVNLGFG;NLGAANIGDVNLGFGN;LGAANIGDVNLGFGNI;GAANIGDVNLGFGNIG;AANIGDVNLGFGNIGD;ANIGDVNLGFGNIGDV;NIGDVNLGFGNIGDVN;IGDVNLGFGNIGDVNL;GDVNLGFGNIGDVNLG;DVNLGFGNIGDVNLGF;VNLGFGNIGDVNLGFG;NLGFGNIGDVNLGFGN;LGFGNIGDVNLGFGNI;GFGNIGDVNLGFGNIG;FGNIGDVNLGFGNIGG;GNIGDVNLGFGNIGGG;NIGDVNLGFGNIGGGN;IGDVNLGFGNIGGGNV;GDVNLGFGNIGGGNVG;DVNLGFGNIGGGNVGF;VNLGFGNIGGGNVGFG;NLGFGNIGGGNVGFGN;LGFGNIGGGNVGFGNI;GFGNIGGGNVGFGNIG;FGNIGGGNVGFGNIGD;GNIGGGNVGFGNIGDA;NIGGGNVGFGNIGDAN;IGGGNVGFGNIGDANF;GGGNVGFGNIGDANFG;GGNVGFGNIGDANFGF;GNVGFGNIGDANFGFG;NVGFGNIGDANFGFGN;VGFGNIGDANFGFGNS;GFGNIGDANFGFGNSG;FGNIGDANFGFGNSGL;GNIGDANFGFGNSGLA;NIGDANFGFGNSGLAA;IGDANFGFGNSGLAAG;GDANFGFGNSGLAAGL;DANFGFGNSGLAAGLA;ANFGFGNSGLAAGLAG;NFGFGNSGLAAGLAGM;FGFGNSGLAAGLAGMG;GFGNSGLAAGLAGMGN;FGNSGLAAGLAGMGNI;GNSGLAAGLAGMGNIG;NSGLAAGLAGMGNIGL;SGLAAGLAGMGNIGLG;GLAAGLAGMGNIGLGN;LAAGLAGMGNIGLGNA;AAGLAGMGNIGLGNAG;AGLAGMGNIGLGNAGS;GLAGMGNIGLGN | |

Fig. 30 continued

| | | |
|---|---|---|
| | AGSG;LAGMGNIGLGNAGSGN;AGMGNIGLGNAGSGNV;GMGNIGLGNAGSGNVG;MGNIGLGNAGSGNVGW;GNIGLGNAGSGNVGWA;NIGLGNAGSGNVGWAN;IGLGNAGSGNVGWANM;GLGNAGSGNVGWANMG;LGNAGSGNVGWANMGL;GNAGSGNVGWANMGLG;NAGSGNVGWANMGLGN;AGSGNVGWANMGLGNI;GSGNVGWANMGLGNIG;SGNVGWANMGLGNIGF;GNVGWANMGLGNIGFG;NVGWANMGLGNIGFGN;VGWANMGLGNIGFGNT;GWANMGLGNIGFGNTG;WANMGLGNIGFGNTGT;ANMGLGNIGFGNTGTN;NMGLGNIGFGNTGTNN;MGLGNIGFGNTGTNNL;GLGNIGFGNTGTNNLG;LGNIGFGNTGTNNLGI;GNIGFGNTGTNNLGIG;NIGFGNTGTNNLGIGL;IGFGNTGTNNLGIGLT;GFGNTGTNNLGIGLTG;FGNTGTNNLGIGLTGD;GNTGTNNLGIGLTGDN;NTGTNNLGIGLTGDNQ;TGTNNLGIGLTGDNQS;GTNNLGIGLTGDNQSG;TNNLGIGLTGDNQSGI;NNLGIGLTGDNQSGIG;NLGIGLTGDNQSGIGG;LGIGLTGDNQSGIGGL;GIGLTGDNQSGIGGLN;IGLTGDNQSGIGGLNS;GLTGDNQSGIGGLNSG;LTGDNQSGIGGLNSGT;TGDNQSGIGGLNSGTG;GDNQSGIGGLNSGTGN;DNQSGIGGLNSGTGNI;NQSGIGGLNSGTGNIG;QSGIGGLNSGTGNIGL;SGIGGLNSGTGNIGLF;GIGGLNSGTGNIGLFN;IGGLNSGTGNIGLFNS;GGLNSGTGNIGLFNSG;GLNSGTGNIGLFNSGT;LNSGTGNIGLFNSGTG;NSGTGNIGLFNSGTGN;SGTGNIGLFNSGTGNI;GTGNIGLFNSGTGNIG;TGNIGLFNSGTGNIGF;GNIGLFNSGTGNIGFF;NIGLFNSGTGNIGFFN;IGLFNSGTGNIGFFNS;GLFNSGTGNIGFFNSG;LFNSGTGNIGFFNSGT;FNSGTGNIGFFNSGTA;NSGTGNIGFFNSGTAN;SGTGNIGFFNSGTANF;GTGNIGFFNSGTANFG;TGNIGFFNSGTANFGL;GNIGFFNSGTANFGLF;NIGFFNSGTANFGLFN;IGFFNSGTANFGLFNS;GFFNSGTANFGLFNSG;FFNSGTANFGLFNSGS;FNSGTANFGLFNSGSY;NSGTANFGLFNSGSYN;SGTANFGLFNSGSYNT;GTANFGLFNSGSYNTG;TANFGLFNSGSYNTGI;ANFGLFNSGSYNTGIG;NFGLFNSGSYNTGIGN;FGLFNSGSYNTGIGNS;GLFNSGSYNTGIGNSG;LFNSGSYNTGIGNSGV;FNSGSYNTGIGNSGVA;NSGSYNTGIGNSGVAS;SGSYNTGIGNSGVAST;GSYNTGIGNSGVASTG;SYNTGIGNSGVASTGL;YNTGIGNSGVASTGLV;NTGIGNSGVASTGLVN;TGIGNSGVASTGLVNA;GIGNSGVASTGLVNAG;IGNSGVASTGLVNAGG;GNSGVASTGLVNAGGF;NSGVASTGLVNAGGFN;SGVASTGLVNAGGFNT;GVASTGLVNAGGFNTG;VASTGLVNAGGFNTGV;ASTGLVNAGGFNTGVA;STGLVNAGGFNTGVAN;TGLVNAGGFNTGVANA;GLVNAGGFNTGVANAG;LVNAGGFNTGVANAGS;VNAGGFNTGVANAGSY;NAGGFNTGVANAGSYN;AGGFNTGVANAGSYNT;GGFNTGVANAGSYNTG;GFNTGVANAGSYNTGS;FNTGVANAGSYNTGSF;NTGVANAGSYNTGSFN;TGVANAGSYNTGSFNA;GVANAGSYNTGSFNAG;VANAGSYNTGSFNAGD;ANAGSYNTGSFNAGDT;NAGSYNTGSFNAGDTN;AGSYNTGSFNAGDTNT;GSYNTGSFNAGDTNTG;SYNTGSFNAGDTNTGG;YNTGSFNAGDTNTGGF;NTGSFNAGDTNTGGFN;TGSFNAGDTNTGGFNP;GSFNAGDTNTGGFNPG;SFNAGDTNTGGFNPGS;FNAGDTNTGGFNPGST;NAGDTNTGGFNPGSTN;AGDTNTGGFNPGSTNT;GDTNTGGFNPGSTNTG;DTNTGGFNPGSTNTGW;TNTGGFNPGSTNTGWF;NTGGFNPGSTNTGWFN;TGGFNPGSTNTGWFNT;GGFNPGSTNTGWFNTG;GFNPGSTNTGWFNTGN;FNPGSTNTGWFNTGNA;NPGSTNTGWFNTGNAN;PGSTNTGWFNTGNANT;GSTNTGWFNTGNANTG;STNTGWFNTGNANTGV;TNTGWFNTGNANTGVA;NTGWFNTGNANTGVAN;TGWFNTGNANTGVANA;GWFNTGNANTGVANAG;WFNTGNANTGVANAGN;FNTGNANTGVANAGNV;NTGNANTGVANAGNVN;TGNANTGVANAGNVNT;GNANTGVANAGNVNTG;NANTGVANAGNVNTGA;ANTGVANAGNVNTGAL;NTGVANAGNVNTGALI;TGVANAGNVNTGALIT;GVANAGNVNTGALITG;VANAGNVNTGALITGN;ANAGNVNTGALITGNF;NAGNVNTGALITGNFS;AGNVNTGALITGNFSN;GNVNTGALITGNFSNG;NVNTGALITGNFSNGI;VNTGALITGNFSNGIL;NTGALITGNFSNGILW;TGALITGNFSNGILWR;GALITGNFSNGIL | |

Fig. 30 continued

| | | |
|---|---|---|
| | WRG;ALITGNFSNGILWRGN;LITGNFSNGILWRGNY;ITGNFSNGILWRGNYE;TGNFSNGILWRGNYEG;GNFSNGILWRGNYEGL;NFSNGILWRGNYEGLA;FSNGILWRGNYEGLAG;SNGILWRGNYEGLAGF;NGILWRGNYEGLAGFS;GILWRGNYEGLAGFSF;ILWRGNYEGLAGFSFG;LWRGNYEGLAGFSFGY;WRGNYEGLAGFSFGYP;RGNYEGLAGFSFGYPI;GNYEGLAGFSFGYPIP;NYEGLAGFSFGYPIPL;YEGLAGFSFGYPIPLF;EGLAGFSFGYPIPLFP;GLAGFSFGYPIPLFPA;LAGFSFGYPIPLFPAV;AGFSFGYPIPLFPAVG;GFSFGYPIPLFPAVGA;FSFGYPIPLFPAVGAD;SFGYPIPLFPAVGADV;FGYPIPLFPAVGADVT;GYPIPLFPAVGADVTG;YPIPLFPAVGADVTGD;PIPLFPAVGADVTGDI;IPLFPAVGADVTGDIG;PLFPAVGADVTGDIGP;LFPAVGADVTGDIGPA;FPAVGADVTGDIGPAT;PAVGADVTGDIGPATI;AVGADVTGDIGPATII;VGADVTGDIGPATIIP;GADVTGDIGPATIIPP;ADVTGDIGPATIIPPI;DVTGDIGPATIIPPIH;VTGDIGPATIIPPIHI;TGDIGPATIIPPIHIP;GDIGPATIIPPIHIPS;DIGPATIIPPIHIPSI;IGPATIIPPIHIPSIP;GPATIIPPIHIPSIPL;PATIIPPIHIPSIPLG;ATIIPPIHIPSIPLGF;TIIPPIHIPSIPLGFA;IIPPIHIPSIPLGFAA;IPPIHIPSIPLGFAAI;PPIHIPSIPLGFAAIG;PIHIPSIPLGFAAIGH;IHIPSIPLGFAAIGHI;HIPSIPLGFAAIGHIG;IPSIPLGFAAIGHIGP;PSIPLGFAAIGHIGPI;SIPLGFAAIGHIGPIS;IPLGFAAIGHIGPISI;PLGFAAIGHIGPISIP;LGFAAIGHIGPISIPN;GFAAIGHIGPISIPNI;FAAIGHIGPISIPNIA;AAIGHIGPISIPNIAI;AIGHIGPISIPNIAIP;IGHIGPISIPNIAIPS;GHIGPISIPNIAIPSI;HIGPISIPNIAIPSIH;IGPISIPNIAIPSIHL;GPISIPNIAIPSIHLG;PISIPNIAIPSIHLGI;ISIPNIAIPSIHLGID;SIPNIAIPSIHLGIDP;IPNIAIPSIHLGIDPT;PNIAIPSIHLGIDPTF;NIAIPSIHLGIDPTFD;IAIPSIHLGIDPTFDV;AIPSIHLGIDPTFDVG;IPSIHLGIDPTFDVGP;PSIHLGIDPTFDVGPI;SIHLGIDPTFDVGPIT;IHLGIDPTFDVGPITV;HLGIDPTFDVGPITVD;LGIDPTFDVGPITVDP;GIDPTFDVGPITVDPI;IDPTFDVGPITVDPIT;DPTFDVGPITVDPITL;PTFDVGPITVDPITLT;TFDVGPITVDPITLTI;FDVGPITVDPITLTIP;DVGPITVDPITLTIPG;VGPITVDPITLTIPGL;GPITVDPITLTIPGLS;PITVDPITLTIPGLSL;ITVDPITLTIPGLSLD;TVDPITLTIPGLSLDA;VDPITLTIPGLSLDAA;DPITLTIPGLSLDAAV;PITLTIPGLSLDAAVS;ITLTIPGLSLDAAVSE;TLTIPGLSLDAAVSEI;LTIPGLSLDAAVSEIR;TIPGLSLDAAVSEIRM;IPGLSLDAAVSEIRMT;PGLSLDAAVSEIRMTS;GLSLDAAVSEIRMTSG;LSLDAAVSEIRMTSGS;SLDAAVSEIRMTSGSS;LDAAVSEIRMTSGSSS;DAAVSEIRMTSGSSSG;AAVSEIRMTSGSSSGF;AVSEIRMTSGSSSGFK;VSEIRMTSGSSSGFKV;SEIRMTSGSSSGFKVR;EIRMTSGSSSGFKVRP;IRMTSGSSSGFKVRPS;RMTSGSSSGFKVRPSF;MTSGSSSGFKVRPSFS;TSGSSSGFKVRPSFSF;SGSSSGFKVRPSFSFF;GSSSGFKVRPSFSFFA;SSSGFKVRPSFSFFAV;SSGFKVRPSFSFFAVG;SGFKVRPSFSFFAVGP;GFKVRPSFSFFAVGPD;FKVRPSFSFFAVGPDG;KVRPSFSFFAVGPDGM;VRPSFSFFAVGPDGMP;RPSFSFFAVGPDGMPG;PSFSFFAVGPDGMPGG;SFSFFAVGPDGMPGGE;FSFFAVGPDGMPGGEV;SFFAVGPDGMPGGEVS;FFAVGPDGMPGGEVSI;FAVGPDGMPGGEVSIL;AVGPDGMPGGEVSILQ;VGPDGMPGGEVSILQP;GPDGMPGGEVSILQPF;PDGMPGGEVSILQPFT;DGMPGGEVSILQPFTV;GMPGGEVSILQPFTVA;MPGGEVSILQPFTVAP;PGGEVSILQPFTVAPI;GGEVSILQPFTVAPIN;GEVSILQPFTVAPINL;EVSILQPFTVAPINLN;VSILQPFTVAPINLNP;SILQPFTVAPINLNPT;ILQPFTVAPINLNPTT;LQPFTVAPINLNPTTL;QPFTVAPINLNPTTLH;PFTVAPINLNPTTLHF;FTVAPINLNPTTLHFP;TVAPINLNPTTLHFPG;VAPINLNPTTLHFPGF;APINLNPTTLHFPGFT;PINLNPTTLHFPGFTI;INLNPTTLHFPGFTIP;NLNPTTLHFPGFTIPT;LNPTTLHFPGFTIPTG;NPTTLHFPGFTIPTGP;PTTLHFPGFTIPTGPI;TTLHFPGFTIPTGPIH;TLHFPGFTIPTGPIHI;LHFPGFTIPTGPIHIG;HFPGFTIPTGPIHIGL;FPGFTIPTGPIHIGLP;PGFTIPTGPIHIGLPL;GFTIPTGPIHIGLPLS;FTIPTGPIHIGLPLSL;TIPTGPIHIGLPLSLT;IPTGPIHIGLPLSLTI;PTGPIHIGLPLSLTIP;TGPIHIGLPLSLTIPG;GPIHIGLPLSLTIPGF;PIHIGLPLSLTIPGFT;IHIGLPLSLTIPGFTI;HI | |

Fig. 30 continued

| | | |
|---|---|---|
| | GLPLSLTIPGFTIP;IGLPLSLTIPGFTIPG;GLPLSLTIPGFTIPGG;LPLSLTIPGFTIPGGT;PLSLTIPGFTIPGGTL;LSLTIPGFTIPGGTLI;SLTIPGFTIPGGTLIP;LTIPGFTIPGGTLIPQ;TIPGFTIPGGTLIPQL;IPGFTIPGGTLIPQLP;PGFTIPGGTLIPQLPL;GFTIPGGTLIPQLPLG;FTIPGGTLIPQLPLGL;TIPGGTLIPQLPLGLG;IPGGTLIPQLPLGLGL;PGGTLIPQLPLGLGLS;GGTLIPQLPLGLGLSG;GTLIPQLPLGLGLSGG;TLIPQLPLGLGLSGGT;LIPQLPLGLGLSGGTP;IPQLPLGLGLSGGTPP;PQLPLGLGLSGGTPPF;QLPLGLGLSGGTPPFD;LPLGLGLSGGTPPFDL;PLGLGLSGGTPPFDLP;LGLGLSGGTPPFDLPT;GLGLSGGTPPFDLPTV;LGLSGGTPPFDLPTVV;GLSGGTPPFDLPTVVI;LSGGTPPFDLPTVVID;SGGTPPFDLPTVVIDR;GGTPPFDLPTVVIDRI;GTPPFDLPTVVIDRIP;TPPFDLPTVVIDRIPV;PPFDLPTVVIDRIPVE;PFDLPTVVIDRIPVEL;FDLPTVVIDRIPVELH;DLPTVVIDRIPVELHA;LPTVVIDRIPVELHAS;PTVVIDRIPVELHAST;TVVIDRIPVELHASTT;VVIDRIPVELHASTTI;VIDRIPVELHASTTIG;IDRIPVELHASTTIGP;DRIPVELHASTTIGPV;RIPVELHASTTIGPVS;IPVELHASTTIGPVSL;PVELHASTTIGPVSLP;VELHASTTIGPVSLPI;ELHASTTIGPVSLPIF;LHASTTIGPVSLPIFG;HASTTIGPVSLPIFGF;ASTTIGPVSLPIFGFG;STTIGPVSLPIFGFGG;TTIGPVSLPIFGFGGA;TIGPVSLPIFGFGGAP;IGPVSLPIFGFGGAPG;GPVSLPIFGFGGAPGF;PVSLPIFGFGGAPGFG;VSLPIFGFGGAPGFGN;SLPIFGFGGAPGFGND;LPIFGFGGAPGFGNDT;PIFGFGGAPGFGNDTT;IFGFGGAPGFGNDTTA;FGFGGAPGFGNDTTAP;GFGGAPGFGNDTTAPS;FGGAPGFGNDTTAPSS;GGAPGFGNDTTAPSSG;GAPGFGNDTTAPSSGF;APGFGNDTTAPSSGFF;PGFGNDTTAPSSGFFN;GFGNDTTAPSSGFFNT;FGNDTTAPSSGFFNTG;GNDTTAPSSGFFNTGG;NDTTAPSSGFFNTGGG;DTTAPSSGFFNTGGGG;TTAPSSGFFNTGGGGG;TAPSSGFFNTGGGGGS;APSSGFFNTGGGGGSG;PSSGFFNTGGGGGSGF;SSGFFNTGGGGGSGFS;SGFFNTGGGGGSGFSN;GFFNTGGGGGSGFSNS;FFNTGGGGGSGFSNSG;FNTGGGGGSGFSNSGS;NTGGGGGSGFSNSGSG;TGGGGGSGFSNSGSGM;GGGGGSGFSNSGSGMS;GGGGSGFSNSGSGMSG;GGGSGFSNSGSGMSGV;GGSGFSNSGSGMSGVL;GSGFSNSGSGMSGVLN;SGFSNSGSGMSGVLNA;GFSNSGSGMSGVLNAI;FSNSGSGMSGVLNAIS;SNSGSGMSGVLNAISD;NSGSGMSGVLNAISDP;SGSGMSGVLNAISDPL;GSGMSGVLNAISDPLL;SGMSGVLNAISDPLLG;GMSGVLNAISDPLLGS;MSGVLNAISDPLLGSA;SGVLNAISDPLLGSAS;GVLNAISDPLLGSASG;VLNAISDPLLGSASGF;LNAISDPLLGSASGFA;NAISDPLLGSASGFAN;AISDPLLGSASGFANF;ISDPLLGSASGFANFG;SDPLLGSASGFANFGT;DPLLGSASGFANFGTQ;PLLGSASGFANFGTQL;LLGSASGFANFGTQLS;LGSASGFANFGTQLSG;GSASGFANFGTQLSGI;SASGFANFGTQLSGIL;ASGFANFGTQLSGILN;SGFANFGTQLSGILNR;GFANFGTQLSGILNRG;FANFGTQLSGILNRGA;ANFGTQLSGILNRGAG;NFGTQLSGILNRGAGI;FGTQLSGILNRGAGIS;GTQLSGILNRGAGISG;TQLSGILNRGAGISGV;QLSGILNRGAGISGVY;LSGILNRGAGISGVYN;SGILNRGAGISGVYNT;GILNRGAGISGVYNTG;ILNRGAGISGVYNTGT;LNRGAGISGVYNTGTL;NRGAGISGVYNTGTLG;RGAGISGVYNTGTLGL;GAGISGVYNTGTLGLV;AGISGVYNTGTLGLVT;GISGVYNTGTLGLVTS;ISGVYNTGTLGLVTSA;SGVYNTGTLGLVTSAF;GVYNTGTLGLVTSAFV;VYNTGTLGLVTSAFVS;YNTGTLGLVTSAFVSG;NTGTLGLVTSAFVSGF;TGTLGLVTSAFVSGFM;GTLGLVTSAFVSGFMN;TLGLVTSAFVSGFMNV;LGLVTSAFVSGFMNVG;GLVTSAFVSGFMNVGQ;LVTSAFVSGFMNVGQQ;VTSAFVSGFMNVGQQL;TSAFVSGFMNVGQQLS;SAFVSGFMNVGQQLSG;AFVSGFMNVGQQLSGL;FVSGFMNVGQQLSGLL;VSGFMNVGQQLSGLLF;SGFMNVGQQLSGLLFA;GFMNVGQQLSGLLFAG;FMNVGQQLSGLLFAGT;MNVGQQLSGLLFAGTG;NVGQQLSGLLFAGTGP | |
| 36 | **<YP_177728.1 isocitrate lyase Rv0467;Mycobacterium tuberculosis H37Rv>** | 190440-192622 |

Fig. 30 continued

| | | |
|---|---|---|
| | MSVVGTPKSAEQIQQEWDTNPRWKDVTRTYSAEDVVALQGSVVEEHTLARRGAEVLWEQLHDLEWVNALGALTGNMAVQQVRAGLKAIYLSGWQVAGDANLSGHTYPDQSLYPANSVPQVVRRINNALQRADQIAKIEGDTSVENWLAPIVADGEAGFGGALNVYELQKALIAAGVAGSHWEDQLASEKKCGHLGGKVLIPTQQHIRTLTSARLAADVADVPTVVIARTDAEAATLITSDVDERDQPFITGERTREGFYRTKNGIEPCIARAKAYAPFADLIWMETGTPDLEAARQFSEAVKAEYPDQMLAYNCSPSFNWKKHLDDATIAKFQKELAAMGFKFQFITLAGFHALNYSMFDLAYGYAQNQMSAYVELQEREFAAEERGYTATKHQREVGAGYFDRIATTVDPNSSTTALTGSTEEGQFH<br><br>8mer<br>MSVVGTPK;AEQIQQEW;NPRWKDVT;DVTRTYSA;RTYSAEDV;SAEDVVAL;VVALQGSV;VALQGSVV;SVVEEHTL;LARRGAEV;AEVLWEQL;VLWEQLHD;QLHDLEWV;DLEWVNAL;WVNALGAL;ALTGNMAV;NMAVQQVR;MAVQQVRA;VQQVRAGL;QQVRAGLK;GLKAIYLS;KAIYLSGW;IYLSGWQV;YLSGWQVA;QVAGDANL;HTYPDQSL;TYPDQSLY;SLYPANSV;YPANSVPQ;NSVPQVVR;SVPQVVRR;VPQVVRRI;RRINNALQ;RINNALQR;ALQRADQI;QRADQIAK;KIEGDTSV;DTSVENWL;TSVENWLA;VENWLAPI;ENWLAPIV;WLAPIVAD;VADGEAGF;EAGFGGAL;GFGGALNV;FGGALNVY;GALNVYEL;ALNVYELQ;NVYELQKA;VYELQKAL;YELQKALI;ELQKALIA;LQKALIAA;KALIAAGV;ALIAAGVA;AGVAGSHW;SEKKCGHL;GHLGGKVL;HLGGKVLI;TQQHIRTL;HIRTLTSA;TLTSARLA;LTSARLAA;LAADVADV;DVADVPTV;VADVPTVV;AEAATLIT;ITSDVDER;DERDQPFI;QPFITGER;FITGERTR;RTREGFYR;REGFYRTK;FYRTKNGI;GIEPCIAR;EPCIARAK;CIARAKAY;RAKAYAPF;AYAPFADL;YAPFADLI;APFADLIW;METGTPDL;RQFSEAVK;SEAVKAEY;AEYPDQML;YPDQMLAY;AYNCSPSF;NCSPSFNW;CSPSFNWK;SPSFNWKK;HLDDATIA;ATIAKFQK;FQKELAAM;KELAAMGF;ELAAMGFK;LAAMGFKF;MGFKFQFI;FKFQFITL;FQFITLAG;QFITLAGF;ITLAGFHA;TLAGFHAL;FHALNYSM;HALNYSMF;YSMFDLAY;SMFDLAYG;MFDLAYGY;YAQNQMSA;AQNQMSAY;QMSAYVEL;MSAYVELQ;AYVELQER;VELQEREF;ELQEREFA;LQEREFAA;FAAEERGY;AEERGYTA;YTATKHQR;REVGAGYF;TTVDPNSS;DPNSSTTA;TTALTGST<br>9mer<br>SAEQIQQEW;QEWDTNPRW;NPRWKDVTR;RWKDVTRTY;RTYSAEDVV;YSAEDVVAL;DVVALQGSV;VVALQGSVV;SVVEEHTLA;VVEEHTLAR;TLARRGAEV;LARRGAEVL;AEVLWEQLH;VLWEQLHDL;WEQLHDLEW;EQLHDLEWV;QLHDLEWVN;HDLEWVNAL;ALGALTGNM;GALTGNMAV;ALTGNMAVQ;NMAVQQVRA;AVQQVRAGL;VQQVRAGLK;QVRAGLKAI;VRAGLKAIY;AIYLSGWQV;YLSGWQVAG;WQVAGDANL;DANLSGHTY;HTYPDQSLY;YPDQSLYPA;QSLYPANSV;SLYPANSVP;YPANSVPQV;NSVPQVVRR;SVPQVVRRI;QVVRRINNA;VVRRINNAL;RRINNALQR;RINNALQRA;ALQRADQIA;LQRADQIAK;QRADQIAKI;AKIEGDTSV;DTSVENWLA;SVENWLAPI;VENWLAPIV;APIVADGEA;IVADGEAGF;GEAGFGGAL;AGFGGALNV;ALNVYELQK;NVYELQKAL;VYELQKALI;ELQKALIAA;QKALIAAGV;LIAAGVAGS;AAGVAGSHW;VLIPTQQHI;LIPTQQHIR;HIRTLTSAR;TLTSARLAA;TSARLAADV;RLAADVADV;DVADVPTVV;DVPTVVIAR;VPTVVIART;VIARTDAEA;RTDAEAATL;AEAATLITS;AATLITSDV;LITSDVDER;DVDERDQPF;DQPFITGER;RTREGFYRT;TREGFYRTK;GFYRTKNGI;CIARAKAYA;ARAKAYAPF;RAKAYAPFA;KAYAPFADL;AYAPFADLI;YAPFADLIW;APFADLIWM;FADLIWMET;WMETGTPDL;GTPDLEAAR;EAARQFSEA;AARQFSEAV;RQFSEAVKA;FSEAVKAEY;AEYPDQMLA;EYPDQMLAY;YPDQMLAYN;MLAYNCSPS;LAYNCSPSF;YNCSPSFNW;CSPSFNWKK;HLDDATIAK;DATIAKFQK;TIAKFQKEL;KFQKELAAM;KELAAMGFK;ELAAMGFKF;AAMGFKFQF;AMGFKFQFI;FKFQFIT | |

Fig. 30 continued

| | | |
|---|---|---|
| | LA;FQFITLAGF;FITLAGFHA;ITLAGFHAL;TLAGFHALN;LAGFHALNY;FHAL<br>NYSMF;ALNYSMFDL;NYSMFDLAY;SMFDLAYGY;AYGYAQNQM;YAQNQ<br>MSAY;AQNQMSAYV;NQMSAYVEL;QMSAYVELQ;MSAYVELQE;SAYVELQ<br>ER;YVELQEREF;ELQEREFAA;EREFAAEER;EFAAEERGY;EERGYTATK;<br>GYTATKHQR;HQREVGAGY;EVGAGYFDR;VGAGYFDRI;YFDRIATTV;TTV<br>DPNSST;TVDPNSSTT;DPNSSTTAL;STTALTGST<br>10mer<br>KSAEQIQQEW;AEQIQQEWDT;NPRWKDVTRT;TYSAEDVVAL;AEDVVALQ<br>GS;DVVALQGSVV;SVVEEHTLAR;VVEEHTLARR;EEHTLARRGA;HTLARR<br>GAEV;TLARRGAEVL;LARRGAEVLW;AEVLWEQLHD;EVLWEQLHDL;VLW<br>EQLHDLE;WEQLHDLEWV;QLHDLEWVNA;LHDLEWVNAL;DLEWVNALGA;<br>LEWVNALGAL;NALGALTGNM;ALGALTGNMA;LGALTGNMAV;ALTGNMAV<br>QQ;LTGNMAVQQV;TGNMAVQQVR;MAVQQVRAGL;AVQQVRAGLK;QQV<br>RAGLKAI;QVRAGLKAIY;VRAGLKAIYL;KAIYLSGWQV;AIYLSGWQVA;YLS<br>GWQVAGD;GWQVAGDANL;WQVAGDANLS;NLSGHTYPDQ;YPDQSLYPA<br>N;SLYPANSVPQ;LYPANSVPQV;YPANSVPQVV;NSVPQVVRRI;QVVRRIN<br>NAL;RRINNALQRA;ALQRADQIAK;LQRADQIAKI;TSVENWLAPI;SVENWLA<br>PIV;VENWLAPIVA;PIVADGEAGF;EAGFGGALNV;AGFGGALNVY;FGGALN<br>VYEL;GALNVYELQK;ALNVYELQKA;NVYELQKALI;YELQKALIAA;LQKALIA<br>AGV;ALIAAGVAGS;IAAGVAGSHW;HLGGKVLIPT;VLIPTQQHIR;IPTQQHIR<br>TL;QQHIRTLTSA;HIRTLTSARL;LTSARLAADV;LAADVADVPT;AADVADVP<br>TV;DVADVPTVVI;VVIARTDAEA;RTDAEAATLI;EAATLITSDV;TLITSDVDER<br>;DVDERDQPFI;GERTREGFYR;RTREGFYRTK;EGFYRTKNGI;NGIEPCIAR<br>A;EPCIARAKAY;IARAKAYAPF;KAYAPFADLI;AYAPFADLIW;YAPFADLIWM<br>;IWMETGTPDL;ETGTPDLEAA;TPDLEAARQF;EAARQFSEAV;AARQFSEA<br>VK;QFSEAVKAEY;AEYPDQMLAY;YPDQMLAYNC;MLAYNCSPSF;AYNCS<br>PSFNW;SPSFNWKKHL;HLDDATIAKF;DDATIAKFQK;TIAKFQKELA;FQKEL<br>AAMGF;KELAAMGFKF;ELAAMGFKFQ;LAAMGFKFQF;AAMGFKFQFI;MGF<br>KFQFITL;KFQFITLAGF;FITLAGFHAL;TLAGFHALNY;GFHALNYSMF;HALN<br>YSMFDL;ALNYSMFDLA;LNYSMFDLAY;YSMFDLAYGY;SMFDLAYGYA;LA<br>YGYAQNQM;GYAQNQMSAY;YAQNQMSAYV;MSAYVELQER;AYVELQER<br>EF;REFAAEERGY;FAAEERGYTA;RGYTATKHQR;YTATKHQREV;HQREV<br>GAGYF;EVGAGYFDRI;GYFDRIATTV;TTVDPNSSTT;TVDPNSSTTA;DPNS<br>STTALT;ALTGSTEEGQ<br>11mer<br>QIQQEWDTNPR;IQQEWDTNPRW;DTNPRWKDVTR;NPRWKDVTRTY;RW<br>KDVTRTYSA;DVTRTYSAEDV;VTRTYSAEDVV;RTYSAEDVVAL;AEDVVAL<br>QGSV;ALQGSVVEEHT;LQGSVVEEHTL;SVVEEHTLARR;TLARRGAEVLW;<br>RRGAEVLWEQL;AEVLWEQLHDL;VLWEQLHDLEW;QLHDLEWVNAL;DLE<br>WVNALGAL;NALGALTGNMA;ALGALTGNMAV;ALTGNMAVQQV;LTGNMA<br>VQQVR;NMAVQQVRAGL;MAVQQVRAGLK;VQQVRAGLKAI;QQVRAGLKA<br>IY;QVRAGLKAIYL;YLSGWQVAGDA;WQVAGDANLSG;NLSGHTYPDQS;H<br>TYPDQSLYPA;YPDQSLYPANS;SLYPANSVPQV;LYPANSVPQVV;YPANS<br>VPQVVR;PANSVPQVVRR;VPQVVRRINNA;VVRRINNALQR;NALQRADQIA<br>K;ALQRADQIAKI;QIAKIEGDTSV;IEGDTSVENWL;DTSVENWLAPI;WLAPIV<br>ADGEA;APIVADGEAGF;GEAGFGGALNV;EAGFGGALNVY;GFGGALNVYE<br>L;ALNVYELQKAL;NVYELQKALIA;ELQKALIAAGV;LQKALIAAGVA;ALIAAG<br>VAGSH;LIAAGVAGSHW;GVAGSHWEDQL;QLASEKKCGHL;HLGGKVLIPT<br>Q;KVLIPTQQHIR;VLIPTQQHIRT;LIPTQQHIRTL;IPTQQHIRTLT;TQQHIRTL<br>TSA;QQHIRTLTSAR;QHIRTLTSARL;TLTSARLAADV;RLAADVADVPT;LAA<br>DVADVPTV;AADVADVPTVV;DVADVPTVVIA;VPTVVIARTDA;TVVIARTDA<br>EA;VVIARTDAEAA;IARTDAEAATL;AEAATLITSDV;ATLITSDVDER;DQPFIT<br>GERTR;ITGERTREGFY;RTREGFYRTKN;REGFYRTKNGI;IEPCIARAKAY; | |

Fig. 30 continued

| | | |
|---|---|---|
| | EPCIARAKAYA;CIARAKAYAPF;IARAKAYAPFA;KAYAPFADLIW;AYAPFADLIWM;FADLIWMETGT;LIWMETGTPDL;WMETGTPDLEA;ETGTPDLEAAR;LEAARQFSEAV;EAARQFSEAVK;RQFSEAVKAEY;EAVKAEYPDQM;KAEYPDQMLAY;YPDQMLAYNCS;QMLAYNCSPSF;LAYNCSPSFNW;AYNCSPSFNWK;YNCSPSFNWKK;KKHLDDATIAK;KHLDDATIAKF;HLDDATIAKFQ;ATIAKFQKELA;TIAKFQKELAA;IAKFQKELAAM;KFQKELAAMGF;ELAAMGFKFQF;LAAMGFKFQFI;AMGFKFQFITL;MGFKFQFITLA;FKFQFITLAGF;KFQFITLAGFH;FQFITLAGFHA;QFITLAGFHAL;ITLAGFHALNY;TLAGFHALNYS;LAGFHALNYSM;FHALNYSMFDL;HALNYSMFDLA;ALNYSMFDLAY;NYSMFDLAYGY;YSMFDLAYGYA;SMFDLAYGYAQ;DLAYGYAQNQM;YGYAQNQMSAY;GYAQNQMSAYV;AQNQMSAYVEL;QMSAYVELQER;SAYVELQEREF;REFAAEERGYT;FAAEERGYTAT;AAEERGYTATK;KHQREVGAGYF;REVGAGYFDRI;TTVDPNSSTTA;TVDPNSSTTAL<br><br>13 mers:<br>MSVVGTPKSAEQI;SVVGTPKSAEQIQ;VVGTPKSAEQIQQ;VGTPKSAEQIQQE;GTPKSAEQIQQEW;TPKSAEQIQQEWD;PKSAEQIQQEWDT;KSAEQIQQEWDTN;SAEQIQQEWDTNP;AEQIQQEWDTNPR;EQIQQEWDTNPRW;QIQQEWDTNPRWK;IQQEWDTNPRWKD;QQEWDTNPRWKDV;QEWDTNPRWKDVT;EWDTNPRWKDVTR;WDTNPRWKDVTRT;DTNPRWKDVTRTY;TNPRWKDVTRTYS;NPRWKDVTRTYSA;PRWKDVTRTYSAE;RWKDVTRTYSAED;WKDVTRTYSAEDV;KDVTRTYSAEDVV;DVTRTYSAEDVVA;VTRTYSAEDVVAL;TRTYSAEDVVALQ;RTYSAEDVVALQG;TYSAEDVVALQGS;YSAEDVVALQGSV;SAEDVVALQGSVV;AEDVVALQGSVVE;EDVVALQGSVVEE;DVVALQGSVVEEH;VVALQGSVVEEHT;VALQGSVVEEHTL;ALQGSVVEEHTLA;LQGSVVEEHTLAR;QGSVVEEHTLARR;GSVVEEHTLARRG;SVVEEHTLARRGA;VVEEHTLARRGAE;VEEHTLARRGAEV;EEHTLARRGAEVL;EHTLARRGAEVLW;HTLARRGAEVLWE;TLARRGAEVLWEQ;LARRGAEVLWEQL;ARRGAEVLWEQLH;RRGAEVLWEQLHD;RGAEVLWEQLHDL;GAEVLWEQLHDLE;AEVLWEQLHDLEW;EVLWEQLHDLEWV;VLWEQLHDLEWVN;LWEQLHDLEWVNA;WEQLHDLEWVNAL;EQLHDLEWVNALG;QLHDLEWVNALGA;LHDLEWVNALGAL;HDLEWVNALGALT;DLEWVNALGALTG;LEWVNALGALTGN;EWVNALGALTGNM;WVNALGALTGNMA;VNALGALTGNMAV;NALGALTGNMAVQ;ALGALTGNMAVQQ;LGALTGNMAVQQV;GALTGNMAVQQVR;ALTGNMAVQQVRA;LTGNMAVQQVRAG;TGNMAVQQVRAGL;GNMAVQQVRAGLK;NMAVQQVRAGLKA;MAVQQVRAGLKAI;AVQQVRAGLKAIY;VQQVRAGLKAIYL;QQVRAGLKAIYLS;QVRAGLKAIYLSG;VRAGLKAIYLSGW;RAGLKAIYLSGWQ;AGLKAIYLSGWQV;GLKAIYLSGWQVA;LKAIYLSGWQVAG;KAIYLSGWQVAGD;AIYLSGWQVAGDA;IYLSGWQVAGDAN;YLSGWQVAGDANL;LSGWQVAGDANLS;SGWQVAGDANLSG;GWQVAGDANLSGH;WQVAGDANLSGHT;QVAGDANLSGHTY;VAGDANLSGHTYP;AGDANLSGHTYPD;GDANLSGHTYPDQ;DANLSGHTYPDQS;ANLSGHTYPDQSL;NLSGHTYPDQSLY;LSGHTYPDQSLYP;SGHTYPDQSLYPA;GHTYPDQSLYPAN;HTYPDQSLYPANS;TYPDQSLYPANSV;YPDQSLYPANSVP;PDQSLYPANSVPQ;DQSLYPANSVPQV;QSLYPANSVPQVV;SLYPANSVPQVVR;LYPANSVPQVVRR;YPANSVPQVVRRI;PANSVPQVVRRIN;ANSVPQVVRRINN;NSVPQVVRRINNA;SVPQVVRRINNAL;VPQVVRRINNALQ;PQVVRRINNALQR;QVVRRINNALQRA;VVRRINNALQRAD;VRRINNALQRADQ;RRINNALQRADQI;RINNALQRADQIA;INNALQRADQIAK;NNALQRADQIAKI;NALQRADQIAKIE;ALQRADQIAKIEG;LQRADQIAKIEGD;QRADQIAKIEGDT;RADQIAKIEGDTS;ADQIAKIEGDTSV;DQIAKIEGDTSVE;QIAKIEGDTSVEN;IAKIEGDTSVENW;AKIEGDTSVENWL;KIEGDTSVENWLA;IEGDTSVENWLAP;EGDTSVENWLAPI;GDTSVENWLAPIV;DTSVENWLAPIVA;TSVENW | |

Fig. 30 continued

| | | |
|---|---|---|
| | LAPIVAD;SVENWLAPIVADG;VENWLAPIVADGE;ENWLAPIVADGEA;NWLAPIVADGEAG;WLAPIVADGEAGF;LAPIVADGEAGFG;APIVADGEAGFGG;PIVADGEAGFGGA;IVADGEAGFGGAL;VADGEAGFGGALN;ADGEAGFGGALNV;DGEAGFGGALNVY;GEAGFGGALNVYE;EAGFGGALNVYEL;AGFGGALNVYELQ;GFGGALNVYELQK;FGGALNVYELQKA;GGALNVYELQKAL;GALNVYELQKALI;ALNVYELQKALIA;LNVYELQKALIAA;NVYELQKALIAAG;VYELQKALIAAGV;YELQKALIAAGVA;ELQKALIAAGVAG;LQKALIAAGVAGS;QKALIAAGVAGSH;KALIAAGVAGSHW;ALIAAGVAGSHWE;LIAAGVAGSHWED;IAAGVAGSHWEDQ;AAGVAGSHWEDQL;AGVAGSHWEDQLA;GVAGSHWEDQLAS;VAGSHWEDQLASE;AGSHWEDQLASEK;GSHWEDQLASEKK;SHWEDQLASEKKC;HWEDQLASEKKCG;WEDQLASEKKCGH;EDQLASEKKCGHL;DQLASEKKCGHLG;QLASEKKCGHLGG;LASEKKCGHLGGK;ASEKKCGHLGGKV;SEKKCGHLGGKVL;EKKCGHLGGKVLI;KKCGHLGGKVLIP;KCGHLGGKVLIPT;CGHLGGKVLIPTQ;GHLGGKVLIPTQQ;HLGGKVLIPTQQH;LGGKVLIPTQQHI;GGKVLIPTQQHIR;GKVLIPTQQHIRT;KVLIPTQQHIRTL;VLIPTQQHIRTLT;LIPTQQHIRTLTS;IPTQQHIRTLTSA;PTQQHIRTLTSAR;TQQHIRTLTSARL;QQHIRTLTSARLA;QHIRTLTSARLAA;HIRTLTSARLAAD;IRTLTSARLAADV;RTLTSARLAADVA;TLTSARLAADVAD;LTSARLAADVADV;TSARLAADVADVP;SARLAADVADVPT;ARLAADVADVPTV;RLAADVADVPTVV;LAADVADVPTVVI;AADVADVPTVVIA;ADVADVPTVVIAR;DVADVPTVVIART;VADVPTVVIARTD;ADVPTVVIARTDA;DVPTVVIARTDAE;VPTVVIARTDAEA;PTVVIARTDAEAA;TVVIARTDAEAAT;VVIARTDAEAATL;VIARTDAEAATLI;IARTDAEAATLIT;ARTDAEAATLITS;RTDAEAATLITSD;TDAEAATLITSDV;DAEAATLITSDVD;AEAATLITSDVDE;EAATLITSDVDER;AATLITSDVDERD;ATLITSDVDERDQ;TLITSDVDERDQP;LITSDVDERDQPF;ITSDVDERDQPFI;TSDVDERDQPFIT;SDVDERDQPFITG;DVDERDQPFITGE;VDERDQPFITGER;DERDQPFITGERT;ERDQPFITGERTR;RDQPFITGERTRE;DQPFITGERTREG;QPFITGERTREGF;PFITGERTREGFY;FITGERTREGFYR;ITGERTREGFYRT;TGERTREGFYRTK;GERTREGFYRTKN;ERTREGFYRTKNG;RTREGFYRTKNGI;TREGFYRTKNGIE;REGFYRTKNGIEP;EGFYRTKNGIEPC;GFYRTKNGIEPCI;FYRTKNGIEPCIA;YRTKNGIEPCIAR;RTKNGIEPCIARA;TKNGIEPCIARAK;KNGIEPCIARAKA;NGIEPCIARAKAY;GIEPCIARAKAYA;IEPCIARAKAYAP;EPCIARAKAYAPF;PCIARAKAYAPFA;CIARAKAYAPFAD;IARAKAYAPFADL;ARAKAYAPFADLI;RAKAYAPFADLIW;AKAYAPFADLIWM;KAYAPFADLIWME;AYAPFADLIWMET;YAPFADLIWMETG;APFADLIWMETGT;PFADLIWMETGTP;FADLIWMETGTPD;ADLIWMETGTPDL;DLIWMETGTPDLE;LIWMETGTPDLEA;IWMETGTPDLEAA;WMETGTPDLEAAR;METGTPDLEAARQ;ETGTPDLEAARQF;TGTPDLEAARQFS;GTPDLEAARQFSE;TPDLEAARQFSEA;PDLEAARQFSEAV;DLEAARQFSEAVK;LEAARQFSEAVKA;EAARQFSEAVKAE;AARQFSEAVKAEY;ARQFSEAVKAEYP;RQFSEAVKAEYPD;QFSEAVKAEYPDQ;FSEAVKAEYPDQM;SEAVKAEYPDQML;EAVKAEYPDQMLA;AVKAEYPDQMLAY;VKAEYPDQMLAYN;KAEYPDQMLAYNC;AEYPDQMLAYNCS;EYPDQMLAYNCSP;YPDQMLAYNCSPS;PDQMLAYNCSPSF;DQMLAYNCSPSFN;QMLAYNCSPSFNW;MLAYNCSPSFNWK;LAYNCSPSFNWKK;AYNCSPSFNWKKH;YNCSPSFNWKKHL;NCSPSFNWKKHLD;CSPSFNWKKHLDD;SPSFNWKKHLDDA;PSFNWKKHLDDAT;SFNWKKHLDDATI;FNWKKHLDDATIA;NWKKHLDDATIAK;WKKHLDDATIAKF;KKHLDDATIAKFQ;KHLDDATIAKFQK;HLDDATIAKFQKE;LDDATIAKFQKEL;DDATIAKFQKELA;DATIAKFQKELAA;ATIAKFQKELAAM;TIAKFQKELAAMG;IAKFQKELAAMGF;AKFQKELAAMGFK;KFQKELAAMGFKF;FQKELAAMGFKFQ;QKELAAMGFKFQF;KELAAMGFKFQFI;ELAAMGFKFQFIT;LAAMGFKFQFITL;AAMGFKFQFITLA;AMGFKFQFITLAG;MGFKFQFITLAGF;GFKFQFITLAGFH;FKFQFITLAGFHA;KFQFITLAGFHAL;FQFI | |

Fig. 30 continued

| | | |
|---|---|---|
| | TLAGFHALN;QFITLAGFHALNY;FITLAGFHALNYS;ITLAGFHALNYSM;TLAGFHALNYSMF;LAGFHALNYSMFD;AGFHALNYSMFDL;GFHALNYSMFDLA;FHALNYSMFDLAY;HALNYSMFDLAYG;ALNYSMFDLAYGY;LNYSMFDLAYGYA;NYSMFDLAYGYAQ;YSMFDLAYGYAQN;SMFDLAYGYAQNQ;MFDLAYGYAQNQM;FDLAYGYAQNQMS;DLAYGYAQNQMSA;LAYGYAQNQMSAY;AYGYAQNQMSAYV;YGYAQNQMSAYVE;GYAQNQMSAYVEL;YAQNQMSAYVELQ;AQNQMSAYVELQE;QNQMSAYVELQER;NQMSAYVELQERE;QMSAYVELQEREF;MSAYVELQEREFA;SAYVELQEREFAA;AYVELQEREFAAE;YVELQEREFAAEE;VELQEREFAAEER;ELQEREFAAEERG;LQEREFAAEERGY;QEREFAAEERGYT;EREFAAEERGYTA;REFAAEERGYTAT;EFAAEERGYTATK;FAAEERGYTATKH;AAEERGYTATKHQ;AEERGYTATKHQR;EERGYTATKHQRE;ERGYTATKHQREV;RGYTATKHQREVG;GYTATKHQREVGA;YTATKHQREVGAG;TATKHQREVGAGY;ATKHQREVGAGYF;TKHQREVGAGYFD;KHQREVGAGYFDR;HQREVGAGYFDRI;QREVGAGYFDRIA;REVGAGYFDRIAT;EVGAGYFDRIATT;VGAGYFDRIATTV;GAGYFDRIATTVD;AGYFDRIATTVDP;GYFDRIATTVDPN;YFDRIATTVDPNS;FDRIATTVDPNSS;DRIATTVDPNSST;RIATTVDPNSSTT;IATTVDPNSSTTA;ATTVDPNSSTTAL;TTVDPNSSTTALT;TVDPNSSTTALTG;VDPNSSTTALTGS;DPNSSTTALTGST;PNSSTTALTGSTE;NSSTTALTGSTEE;SSTTALTGSTEEG;STTALTGSTEEGQ;TTALTGSTEEGQF;TALTGSTEEGQFH;<br>14 mers:<br>MSVVGTPKSAEQIQ;SVVGTPKSAEQIQQ;VVGTPKSAEQIQQE;VGTPKSAEQIQQEW;GTPKSAEQIQQEWD;TPKSAEQIQQEWDT;PKSAEQIQQEWDTN;KSAEQIQQEWDTNP;SAEQIQQEWDTNPR;AEQIQQEWDTNPRW;EQIQQEWDTNPRWK;QIQQEWDTNPRWKD;IQQEWDTNPRWKDV;QQEWDTNPRWKDVT;QEWDTNPRWKDVTR;EWDTNPRWKDVTRT;WDTNPRWKDVTRTY;DTNPRWKDVTRTYS;TNPRWKDVTRTYSA;NPRWKDVTRTYSAE;PRWKDVTRTYSAED;RWKDVTRTYSAEDV;WKDVTRTYSAEDVV;KDVTRTYSAEDVVA;DVTRTYSAEDVVAL;VTRTYSAEDVVALQ;TRTYSAEDVVALQG;RTYSAEDVVALQGS;TYSAEDVVALQGSV;YSAEDVVALQGSVV;SAEDVVALQGSVVE;AEDVVALQGSVVEE;EDVVALQGSVVEEH;DVVALQGSVVEEHT;VVALQGSVVEEHTL;VALQGSVVEEHTLA;ALQGSVVEEHTLAR;LQGSVVEEHTLARR;QGSVVEEHTLARRG;GSVVEEHTLARRGA;SVVEEHTLARRGAE;VVEEHTLARRGAEV;VEEHTLARRGAEVL;EEHTLARRGAEVLW;EHTLARRGAEVLWE;HTLARRGAEVLWEQ;TLARRGAEVLWEQL;LARRGAEVLWEQLH;ARRGAEVLWEQLHD;RRGAEVLWEQLHDL;RGAEVLWEQLHDLE;GAEVLWEQLHDLEW;AEVLWEQLHDLEWV;EVLWEQLHDLEWVN;VLWEQLHDLEWVNA;LWEQLHDLEWVNAL;WEQLHDLEWVNALG;EQLHDLEWVNALGA;QLHDLEWVNALGAL;LHDLEWVNALGALT;HDLEWVNALGALTG;DLEWVNALGALTGN;LEWVNALGALTGNM;EWVNALGALTGNMA;WVNALGALTGNMAV;VNALGALTGNMAVQ;NALGALTGNMAVQQ;ALGALTGNMAVQQV;LGALTGNMAVQQVR;GALTGNMAVQQVRA;ALTGNMAVQQVRAG;LTGNMAVQQVRAGL;TGNMAVQQVRAGLK;GNMAVQQVRAGLKA;NMAVQQVRAGLKAI;MAVQQVRAGLKAIY;AVQQVRAGLKAIYL;VQQVRAGLKAIYLS;QQVRAGLKAIYLSG;QVRAGLKAIYLSGW;VRAGLKAIYLSGWQ;RAGLKAIYLSGWQV;AGLKAIYLSGWQVA;GLKAIYLSGWQVAG;LKAIYLSGWQVAGD;KAIYLSGWQVAGDA;AIYLSGWQVAGDAN;IYLSGWQVAGDANL;YLSGWQVAGDANLS;LSGWQVAGDANLSG;SGWQVAGDANLSGH;GWQVAGDANLSGHT;WQVAGDANLSGHTY;QVAGDANLSGHTYP;VAGDANLSGHTYPD;AGDANLSGHTYPDQ;GDANLSGHTYPDQS;DANLSGHTYPDQSL;ANLSGHTYPDQSLY;NLSGHTYPDQSLYP;LSGHTYPDQSLYPA;SGHTYPDQSLYPAN;GHTYPDQSLYPANS;HTYPDQSLYPANSV;TYPDQSLYPANSVP;YPDQSLYPANSVPQ;PDQSLYPANSVPQV;DQSLYPANSVPQVV;QSLYPANSVPQVVR; | |

Fig. 30 continued

| | | |
|---|---|---|
| | SLYPANSVPQVVRR;LYPANSVPQVVRRI;YPANSVPQVVRRIN;PANSVPQVVRRINN;ANSVPQVVRRINNA;NSVPQVVRRINNAL;SVPQVVRRINNALQ;VPQVVRRINNALQR;PQVVRRINNALQRA;QVVRRINNALQRAD;VVRRINNALQRADQ;VRRINNALQRADQI;RRINNALQRADQIA;RINNALQRADQIAK;INNALQRADQIAKI;NNALQRADQIAKIE;NALQRADQIAKIEG;ALQRADQIAKIEGD;LQRADQIAKIEGDT;QRADQIAKIEGDTS;RADQIAKIEGDTSV;ADQIAKIEGDTSVE;DQIAKIEGDTSVEN;QIAKIEGDTSVENW;IAKIEGDTSVENWL;AKIEGDTSVENWLA;KIEGDTSVENWLAP;IEGDTSVENWLAPI;EGDTSVENWLAPIV;GDTSVENWLAPIVA;DTSVENWLAPIVAD;TSVENWLAPIVADG;SVENWLAPIVADGE;VENWLAPIVADGEA;ENWLAPIVADGEAG;NWLAPIVADGEAGF;WLAPIVADGEAGFG;LAPIVADGEAGFGG;APIVADGEAGFGGA;PIVADGEAGFGGAL;IVADGEAGFGGALN;VADGEAGFGGALNV;ADGEAGFGGALNVY;DGEAGFGGALNVYE;GEAGFGGALNVYEL;EAGFGGALNVYELQ;AGFGGALNVYELQK;GFGGALNVYELQKA;FGGALNVYELQKAL;GGALNVYELQKALI;GALNVYELQKALIA;ALNVYELQKALIAA;LNVYELQKALIAAG;NVYELQKALIAAGV;VYELQKALIAAGVA;YELQKALIAAGVAG;ELQKALIAAGVAGS;LQKALIAAGVAGSH;QKALIAAGVAGSHW;KALIAAGVAGSHWE;ALIAAGVAGSHWED;LIAAGVAGSHWEDQ;IAAGVAGSHWEDQL;AAGVAGSHWEDQLA;AGVAGSHWEDQLAS;GVAGSHWEDQLASE;VAGSHWEDQLASEK;AGSHWEDQLASEKK;GSHWEDQLASEKKC;SHWEDQLASEKKCG;HWEDQLASEKKCGH;WEDQLASEKKCGHL;EDQLASEKKCGHLG;DQLASEKKCGHLGG;QLASEKKCGHLGGK;LASEKKCGHLGGKV;ASEKKCGHLGGKVL;SEKKCGHLGGKVLI;EKKCGHLGGKVLIP;KKCGHLGGKVLIPT;KCGHLGGKVLIPTQ;CGHLGGKVLIPTQQ;GHLGGKVLIPTQQH;HLGGKVLIPTQQHI;LGGKVLIPTQQHIR;GGKVLIPTQQHIRT;GKVLIPTQQHIRTL;KVLIPTQQHIRTLT;VLIPTQQHIRTLTS;LIPTQQHIRTLTSA;IPTQQHIRTLTSAR;PTQQHIRTLTSARL;TQQHIRTLTSARLA;QQHIRTLTSARLAA;QHIRTLTSARLAAD;HIRTLTSARLAADV;IRTLTSARLAADVA;RTLTSARLAADVAD;TLTSARLAADVADV;LTSARLAADVADVP;TSARLAADVADVPT;SARLAADVADVPTV;ARLAADVADVPTVV;RLAADVADVPTVVI;LAADVADVPTVVIA;AADVADVPTVVIAR;ADVADVPTVVIART;DVADVPTVVIARTD;VADVPTVVIARTDA;ADVPTVVIARTDAE;DVPTVVIARTDAEA;VPTVVIARTDAEAA;PTVVIARTDAEAAT;TVVIARTDAEAATL;VVIARTDAEAATLI;VIARTDAEAATLIT;IARTDAEAATLITS;ARTDAEAATLITSD;RTDAEAATLITSDV;TDAEAATLITSDVD;DAEAATLITSDVDE;AEAATLITSDVDER;EAATLITSDVDERD;AATLITSDVDERDQ;ATLITSDVDERDQP;TLITSDVDERDQPF;LITSDVDERDQPFI;ITSDVDERDQPFIT;TSDVDERDQPFITG;SDVDERDQPFITGE;DVDERDQPFITGER;VDERDQPFITGERT;DERDQPFITGERTR;ERDQPFITGERTRE;RDQPFITGERTREG;DQPFITGERTREGF;QPFITGERTREGFY;PFITGERTREGFYR;FITGERTREGFYRT;ITGERTREGFYRTK;TGERTREGFYRTKN;GERTREGFYRTKNG;ERTREGFYRTKNGI;RTREGFYRTKNGIE;TREGFYRTKNGIEP;REGFYRTKNGIEPC;EGFYRTKNGIEPCI;GFYRTKNGIEPCIA;FYRTKNGIEPCIAR;YRTKNGIEPCIARA;RTKNGIEPCIARAK;TKNGIEPCIARAKA;KNGIEPCIARAKAY;NGIEPCIARAKAYA;GIEPCIARAKAYAP;IEPCIARAKAYAPF;EPCIARAKAYAPFA;PCIARAKAYAPFAD;CIARAKAYAPFADL;IARAKAYAPFADLI;ARAKAYAPFADLIW;RAKAYAPFADLIWM;AKAYAPFADLIWME;KAYAPFADLIWMET;AYAPFADLIWMETG;YAPFADLIWMETGT;APFADLIWMETGTP;PFADLIWMETGTPD;FADLIWMETGTPDL;ADLIWMETGTPDLE;DLIWMETGTPDLEA;LIWMETGTPDLEAA;IWMETGTPDLEAAR;WMETGTPDLEAARQ;METGTPDLEAARQF;ETGTPDLEAARQFS;TGTPDLEAARQFSE;GTPDLEAARQFSEA;TPDLEAARQFSEAV;PDLEAARQFSEAVK;DLEAARQFSEAVKA;LEAARQFSEAVKAE;EAARQFSEAVKAEY;AARQFSEAVKAEYP;ARQFSEAVKAEYPD;RQFSEAVKAEYPDQ;QFSEAVKAEYPDQM;FSEAVKAEYPDQML;SEAVKA | |

Fig. 30 continued

| | | |
|---|---|---|
| | EYPDQMLA;EAVKAEYPDQMLAY;AVKAEYPDQMLAYN;VKAEYPDQMLAY<br>NC;KAEYPDQMLAYNCS;AEYPDQMLAYNCSP;EYPDQMLAYNCSPS;YPD<br>QMLAYNCSPSF;PDQMLAYNCSPSFN;DQMLAYNCSPSFNW;QMLAYNCS<br>PSFNWK;MLAYNCSPSFNWKK;LAYNCSPSFNWKKH;AYNCSPSFNWKKH<br>L;YNCSPSFNWKKHLD;NCSPSFNWKKHLDD;CSPSFNWKKHLDDA;SPSF<br>NWKKHLDDAT;PSFNWKKHLDDATI;SFNWKKHLDDATIA;FNWKKHLDDAT<br>IAK;NWKKHLDDATIAKF;WKKHLDDATIAKFQ;KKHLDDATIAKFQK;KHLDD<br>ATIAKFQKE;HLDDATIAKFQKEL;LDDATIAKFQKELA;DDATIAKFQKELAA;<br>DATIAKFQKELAAM;ATIAKFQKELAAMG;TIAKFQKELAAMGF;IAKFQKELA<br>AMGFK;AKFQKELAAMGFKF;KFQKELAAMGFKFQ;FQKELAAMGFKFQF;Q<br>KELAAMGFKFQFI;KELAAMGFKFQFIT;ELAAMGFKFQFITL;LAAMGFKFQF<br>ITLA;AAMGFKFQFITLAG;AMGFKFQFITLAGF;MGFKFQFITLAGFH;GFKFQ<br>FITLAGFHA;FKFQFITLAGFHAL;KFQFITLAGFHALN;FQFITLAGFHALNY;Q<br>FITLAGFHALNYS;FITLAGFHALNYSM;ITLAGFHALNYSMF;TLAGFHALNY<br>SMFD;LAGFHALNYSMFDL;AGFHALNYSMFDLA;GFHALNYSMFDLAY;FH<br>ALNYSMFDLAYG;HALNYSMFDLAYGY;ALNYSMFDLAYGYA;LNYSMFDLA<br>YGYAQ;NYSMFDLAYGYAQN;YSMFDLAYGYAQNQ;SMFDLAYGYAQNQM<br>;MFDLAYGYAQNQMS;FDLAYGYAQNQMSA;DLAYGYAQNQMSAY;LAYGY<br>AQNQMSAYV;AYGYAQNQMSAYVE;YGYAQNQMSAYVEL;GYAQNQMSA<br>YVELQ;YAQNQMSAYVELQE;AQNQMSAYVELQER;QNQMSAYVELQERE;<br>NQMSAYVELQEREF;QMSAYVELQEREFA;MSAYVELQEREFAA;SAYVEL<br>QEREFAAE;AYVELQEREFAAEE;YVELQEREFAAEER;VELQEREFAAEER<br>G;ELQEREFAAEERGY;LQEREFAAEERGYT;QEREFAAEERGYTA;EREFA<br>AEERGYTAT;REFAAEERGYTATK;EFAAEERGYTATKH;FAAEERGYTATK<br>HQ;AAEERGYTATKHQR;AEERGYTATKHQRE;EERGYTATKHQREV;ERG<br>YTATKHQREVG;RGYTATKHQREVGA;GYTATKHQREVGAG;YTATKHQRE<br>VGAGY;TATKHQREVGAGYF;ATKHQREVGAGYFD;TKHQREVGAGYFDR;<br>KHQREVGAGYFDRI;HQREVGAGYFDRIA;QREVGAGYFDRIAT;REVGAGY<br>FDRIATT;EVGAGYFDRIATTV;VGAGYFDRIATTVD;GAGYFDRIATTVDP;A<br>GYFDRIATTVDPN;GYFDRIATTVDPNS;YFDRIATTVDPNSS;FDRIATTVDP<br>NSST;DRIATTVDPNSSTT;RIATTVDPNSSTTA;IATTVDPNSSTTAL;ATTVD<br>PNSSTTALT;TTVDPNSSTTALTG;TVDPNSSTTALTGS;VDPNSSTTALTGS<br>T;DPNSSTTALTGSTE;PNSSTTALTGSTEE;NSSTTALTGSTEEG;SSTTALT<br>GSTEEGQ;STTALTGSTEEGQF;TTALTGSTEEGQFH;<br>15 mers:<br>MSVVGTPKSAEQIQQ;SVVGTPKSAEQIQQE;VVGTPKSAEQIQQEW;VGTP<br>KSAEQIQQEWD;GTPKSAEQIQQEWDT;TPKSAEQIQQEWDTN;PKSAEQI<br>QQEWDTNP;KSAEQIQQEWDTNPR;SAEQIQQEWDTNPRW;AEQIQQEWD<br>TNPRWK;EQIQQEWDTNPRWKD;QIQQEWDTNPRWKDV;IQQEWDTNPR<br>WKDVT;QQEWDTNPRWKDVTR;QEWDTNPRWKDVTRT;EWDTNPRWKD<br>VTRTY;WDTNPRWKDVTRTYS;DTNPRWKDVTRTYSA;TNPRWKDVTRTY<br>SAE;NPRWKDVTRTYSAED;PRWKDVTRTYSAEDV;RWKDVTRTYSAEDV<br>V;WKDVTRTYSAEDVVA;KDVTRTYSAEDVVAL;DVTRTYSAEDVVALQ;VT<br>RTYSAEDVVALQG;TRTYSAEDVVALQGS;RTYSAEDVVALQGSV;TYSAED<br>VVALQGSVV;YSAEDVVALQGSVVE;SAEDVVALQGSVVEE;AEDVVALQG<br>SVVEEH;EDVVALQGSVVEEHT;DVVALQGSVVEEHTL;VVALQGSVVEEHT<br>LA;VALQGSVVEEHTLAR;ALQGSVVEEHTLARR;LQGSVVEEHTLARRG;Q<br>GSVVEEHTLARRGA;GSVVEEHTLARRGAE;SVVEEHTLARRGAEV;VVEE<br>HTLARRGAEVL;VEEHTLARRGAEVLW;EEHTLARRGAEVLWE;EHTLARR<br>GAEVLWEQ;HTLARRGAEVLWEQL;TLARRGAEVLWEQLH;LARRGAEVL<br>WEQLHD;ARRGAEVLWEQLHDL;RRGAEVLWEQLHDLE;RGAEVLWEQLH<br>DLEW;GAEVLWEQLHDLEWV;AEVLWEQLHDLEWVN;EVLWEQLHDLEWV<br>NA;VLWEQLHDLEWVNAL;LWEQLHDLEWVNALG;WEQLHDLEWVNALGA; | |

Fig. 30 continued

| | | |
|---|---|---|
| | EQLHDLEWVNALGAL;QLHDLEWVNALGALT;LHDLEWVNALGALTG;HDLEWVNALGALTGN;DLEWVNALGALTGNM;LEWVNALGALTGNMA;EWVNALGALTGNMAV;WVNALGALTGNMAVQ;VNALGALTGNMAVQQ;NALGALTGNMAVQQV;ALGALTGNMAVQQVR;LGALTGNMAVQQVRA;GALTGNMAVQQVRAG;ALTGNMAVQQVRAGL;LTGNMAVQQVRAGLK;TGNMAVQQVRAGLKA;GNMAVQQVRAGLKAI;NMAVQQVRAGLKAIY;MAVQQVRAGLKAIYL;AVQQVRAGLKAIYLS;VQQVRAGLKAIYLSG;QQVRAGLKAIYLSGW;QVRAGLKAIYLSGWQ;VRAGLKAIYLSGWQV;RAGLKAIYLSGWQVA;AGLKAIYLSGWQVAG;GLKAIYLSGWQVAGD;LKAIYLSGWQVAGDA;KAIYLSGWQVAGDAN;AIYLSGWQVAGDANL;IYLSGWQVAGDANLS;YLSGWQVAGDANLSG;LSGWQVAGDANLSGH;SGWQVAGDANLSGHT;GWQVAGDANLSGHTY;WQVAGDANLSGHTYP;QVAGDANLSGHTYPD;VAGDANLSGHTYPDQ;AGDANLSGHTYPDQS;GDANLSGHTYPDQSL;DANLSGHTYPDQSLY;ANLSGHTYPDQSLYP;NLSGHTYPDQSLYPA;LSGHTYPDQSLYPAN;SGHTYPDQSLYPANS;GHTYPDQSLYPANSV;HTYPDQSLYPANSVP;TYPDQSLYPANSVPQ;YPDQSLYPANSVPQV;PDQSLYPANSVPQVV;DQSLYPANSVPQVVR;QSLYPANSVPQVVRR;SLYPANSVPQVVRRI;LYPANSVPQVVRRIN;YPANSVPQVVRRINN;PANSVPQVVRRINNA;ANSVPQVVRRINNAL;NSVPQVVRRINNALQ;SVPQVVRRINNALQR;VPQVVRRINNALQRA;PQVVRRINNALQRAD;QVVRRINNALQRADQ;VVRRINNALQRADQI;VRRINNALQRADQIA;RRINNALQRADQIAK;RINNALQRADQIAKI;INNALQRADQIAKIE;NNALQRADQIAKIEG;NALQRADQIAKIEGD;ALQRADQIAKIEGDT;LQRADQIAKIEGDTS;QRADQIAKIEGDTSV;RADQIAKIEGDTSVE;ADQIAKIEGDTSVEN;DQIAKIEGDTSVENW;QIAKIEGDTSVENWL;IAKIEGDTSVENWLA;AKIEGDTSVENWLAP;KIEGDTSVENWLAPI;IEGDTSVENWLAPIV;EGDTSVENWLAPIVA;GDTSVENWLAPIVAD;DTSVENWLAPIVADG;TSVENWLAPIVADGE;SVENWLAPIVADGEA;VENWLAPIVADGEAG;ENWLAPIVADGEAGF;NWLAPIVADGEAGFG;WLAPIVADGEAGFGG;LAPIVADGEAGFGGA;APIVADGEAGFGGAL;PIVADGEAGFGGALN;IVADGEAGFGGALNV;VADGEAGFGGALNVY;ADGEAGFGGALNVYE;DGEAGFGGALNVYEL;GEAGFGGALNVYELQ;EAGFGGALNVYELQK;AGFGGALNVYELQKA;GFGGALNVYELQKAL;FGGALNVYELQKALI;GGALNVYELQKALIA;GALNVYELQKALIAA;ALNVYELQKALIAAG;LNVYELQKALIAAGV;NVYELQKALIAAGVA;VYELQKALIAAGVAG;YELQKALIAAGVAGS;ELQKALIAAGVAGSH;LQKALIAAGVAGSHW;QKALIAAGVAGSHWE;KALIAAGVAGSHWED;ALIAAGVAGSHWEDQ;LIAAGVAGSHWEDQL;IAAGVAGSHWEDQLA;AAGVAGSHWEDQLAS;AGVAGSHWEDQLASE;GVAGSHWEDQLASEK;VAGSHWEDQLASEKK;AGSHWEDQLASEKKC;GSHWEDQLASEKKCG;SHWEDQLASEKKCGH;HWEDQLASEKKCGHL;WEDQLASEKKCGHLG;EDQLASEKKCGHLGG;DQLASEKKCGHLGGK;QLASEKKCGHLGGKV;LASEKKCGHLGGKVL;ASEKKCGHLGGKVLI;SEKKCGHLGGKVLIP;EKKCGHLGGKVLIPT;KKCGHLGGKVLIPTQ;KCGHLGGKVLIPTQQ;CGHLGGKVLIPTQQH;GHLGGKVLIPTQQHI;HLGGKVLIPTQQHIR;LGGKVLIPTQQHIRT;GGKVLIPTQQHIRTL;GKVLIPTQQHIRTLT;KVLIPTQQHIRTLTS;VLIPTQQHIRTLTSA;LIPTQQHIRTLTSAR;IPTQQHIRTLTSARL;PTQQHIRTLTSARLA;TQQHIRTLTSARLAA;QQHIRTLTSARLAAD;QHIRTLTSARLAADV;HIRTLTSARLAADVA;IRTLTSARLAADVAD;RTLTSARLAADVADV;TLTSARLAADVADVP;LTSARLAADVADVPT;TSARLAADVADVPTV;SARLAADVADVPTVV;ARLAADVADVPTVVI;RLAADVADVPTVVIA;LAADVADVPTVVIAR;AADVADVPTVVIART;ADVADVPTVVIARTD;DVADVPTVVIARTDA;VADVPTVVIARTDAE;ADVPTVVIARTDAEA;DVPTVVIARTDAEAA;VPTVVIARTDAEAAT;PTVVIARTDAEAATL;TVVIARTDAEAATLI;VVIARTDAEAATLIT;VIARTDAEAATLITS;IARTDAEAATLITSD;ARTDAEAATLITSDV;RTDAEAATLITSDVD;TDAEAATLITSDVDE;DAEAATLITSDVDER;AEAATLITSDVDERD;EA | |

Fig. 30 continued

| | | |
|---|---|---|
| | ATLITSDVDERDQ;AATLITSDVDERDQP;ATLITSDVDERDQPF;TLITSDVDERDQPFI;LITSDVDERDQPFIT;ITSDVDERDQPFITG;TSDVDERDQPFITGE;SDVDERDQPFITGER;DVDERDQPFITGERT;VDERDQPFITGERTR;DERDQPFITGERTRE;ERDQPFITGERTREG;RDQPFITGERTREGF;DQPFITGERTREGFY;QPFITGERTREGFYR;PFITGERTREGFYRT;FITGERTREGFYRTK;ITGERTREGFYRTKN;TGERTREGFYRTKNG;GERTREGFYRTKNGI;ERTREGFYRTKNGIE;RTREGFYRTKNGIEP;TREGFYRTKNGIEPC;REGFYRTKNGIEPCI;EGFYRTKNGIEPCIA;GFYRTKNGIEPCIAR;FYRTKNGIEPCIARA;YRTKNGIEPCIARAK;RTKNGIEPCIARAKA;TKNGIEPCIARAKAY;KNGIEPCIARAKAYA;NGIEPCIARAKAYAP;GIEPCIARAKAYAPF;IEPCIARAKAYAPFA;EPCIARAKAYAPFAD;PCIARAKAYAPFADL;CIARAKAYAPFADLI;IARAKAYAPFADLIW;ARAKAYAPFADLIWM;RAKAYAPFADLIWME;AKAYAPFADLIWMET;KAYAPFADLIWMETG;AYAPFADLIWMETGT;YAPFADLIWMETGTP;APFADLIWMETGTPD;PFADLIWMETGTPDL;FADLIWMETGTPDLE;ADLIWMETGTPDLEA;DLIWMETGTPDLEAA;LIWMETGTPDLEAAR;IWMETGTPDLEAARQ;WMETGTPDLEAARQF;METGTPDLEAARQFS;ETGTPDLEAARQFSE;TGTPDLEAARQFSEA;GTPDLEAARQFSEAV;TPDLEAARQFSEAVK;PDLEAARQFSEAVKA;DLEAARQFSEAVKAE;LEAARQFSEAVKAEY;EAARQFSEAVKAEYP;AARQFSEAVKAEYPD;ARQFSEAVKAEYPDQ;RQFSEAVKAEYPDQM;QFSEAVKAEYPDQML;FSEAVKAEYPDQMLA;SEAVKAEYPDQMLAY;EAVKAEYPDQMLAYN;AVKAEYPDQMLAYNC;VKAEYPDQMLAYNCS;KAEYPDQMLAYNCSP;AEYPDQMLAYNCSPS;EYPDQMLAYNCSPSF;YPDQMLAYNCSPSFN;PDQMLAYNCSPSFNW;DQMLAYNCSPSFNWK;QMLAYNCSPSFNWKK;MLAYNCSPSFNWKKH;LAYNCSPSFNWKKHL;AYNCSPSFNWKKHLD;YNCSPSFNWKKHLDD;NCSPSFNWKKHLDDA;CSPSFNWKKHLDDAT;SPSFNWKKHLDDATI;PSFNWKKHLDDATIA;SFNWKKHLDDATIAK;FNWKKHLDDATIAKF;NWKKHLDDATIAKFQ;WKKHLDDATIAKFQK;KKHLDDATIAKFQKE;KHLDDATIAKFQKEL;HLDDATIAKFQKELA;LDDATIAKFQKELAA;DDATIAKFQKELAAM;DATIAKFQKELAAMG;ATIAKFQKELAAMGF;TIAKFQKELAAMGFK;IAKFQKELAAMGFKF;AKFQKELAAMGFKFQ;KFQKELAAMGFKFQF;FQKELAAMGFKFQFI;QKELAAMGFKFQFIT;KELAAMGFKFQFITL;ELAAMGFKFQFITLA;LAAMGFKFQFITLAG;AAMGFKFQFITLAGF;AMGFKFQFITLAGFH;MGFKFQFITLAGFHA;GFKFQFITLAGFHAL;FKFQFITLAGFHALN;KFQFITLAGFHALNY;FQFITLAGFHALNYS;QFITLAGFHALNYSM;FITLAGFHALNYSMF;ITLAGFHALNYSMFD;TLAGFHALNYSMFDL;LAGFHALNYSMFDLA;AGFHALNYSMFDLAY;GFHALNYSMFDLAYG;FHALNYSMFDLAYGY;HALNYSMFDLAYGYA;ALNYSMFDLAYGYAQ;LNYSMFDLAYGYAQN;NYSMFDLAYGYAQNQ;YSMFDLAYGYAQNQM;SMFDLAYGYAQNQMS;MFDLAYGYAQNQMSA;FDLAYGYAQNQMSAY;DLAYGYAQNQMSAYV;LAYGYAQNQMSAYVE;AYGYAQNQMSAYVEL;YGYAQNQMSAYVELQ;GYAQNQMSAYVELQE;YAQNQMSAYVELQER;AQNQMSAYVELQERE;QNQMSAYVELQEREF;NQMSAYVELQEREFA;QMSAYVELQEREFAA;MSAYVELQEREFAAE;SAYVELQEREFAAEE;AYVELQEREFAAEER;YVELQEREFAAEERG;VELQEREFAAEERGY;ELQEREFAAEERGYT;LQEREFAAEERGYTA;QEREFAAEERGYTAT;EREFAAEERGYTATK;REFAAEERGYTATKH;EFAAEERGYTATKHQ;FAAEERGYTATKHQR;AAEERGYTATKHQRE;AEERGYTATKHQREV;EERGYTATKHQREVG;ERGYTATKHQREVGA;RGYTATKHQREVGAG;GYTATKHQREVGAGY;YTATKHQREVGAGYF;TATKHQREVGAGYFD;ATKHQREVGAGYFDR;TKHQREVGAGYFDRI;KHQREVGAGYFDRIA;HQREVGAGYFDRIAT;QREVGAGYFDRIATT;REVGAGYFDRIATTV;EVGAGYFDRIATTVD;VGAGYFDRIATTVDP;GAGYFDRIATTVDPN;AGYFDRIATTVDPNS;GYFDRIATTVDPNSS;YFDRIATTVDPNSST;FDRIATTVDPNSSTT;DRIATTVDPNSSTTA;RIATTVDPNSSTTAL;IATTVDPNSSTTALT;ATTVDP | |

Fig. 30 continued

| | | |
|---|---|---|
| | NSSTTALTG;TTVDPNSSTTALTGS;TVDPNSSTTALTGST;VDPNSSTTALT<br>GSTE;DPNSSTTALTGSTEE;PNSSTTALTGSTEEG;NSSTTALTGSTEEGQ;<br>SSTTALTGSTEEGQF;STTALTGSTEEGQFH;<br>16 mers:<br>MSVVGTPKSAEQIQQE;SVVGTPKSAEQIQQEW;VVGTPKSAEQIQQEWD;<br>VGTPKSAEQIQQEWDT;GTPKSAEQIQQEWDTN;TPKSAEQIQQEWDTNP;<br>PKSAEQIQQEWDTNPR;KSAEQIQQEWDTNPRW;SAEQIQQEWDTNPRW<br>K;AEQIQQEWDTNPRWKD;EQIQQEWDTNPRWKDV;QIQQEWDTNPRWK<br>DVT;IQQEWDTNPRWKDVTR;QQEWDTNPRWKDVTRT;QEWDTNPRWKD<br>VTRTY;EWDTNPRWKDVTRTYS;WDTNPRWKDVTRTYSA;DTNPRWKDVT<br>RTYSAE;TNPRWKDVTRTYSAED;NPRWKDVTRTYSAEDV;PRWKDVTRTY<br>SAEDVV;RWKDVTRTYSAEDVVA;WKDVTRTYSAEDVVAL;KDVTRTYSAE<br>DVVALQ;DVTRTYSAEDVVALQG;VTRTYSAEDVVALQGS;TRTYSAEDVVA<br>LQGSV;RTYSAEDVVALQGSVV;TYSAEDVVALQGSVVE;YSAEDVVALQG<br>SVVEE;SAEDVVALQGSVVEEH;AEDVVALQGSVVEEHT;EDVVALQGSVV<br>EEHTL;DVVALQGSVVEEHTLA;VVALQGSVVEEHTLAR;VALQGSVVEEHT<br>LARR;ALQGSVVEEHTLARRG;LQGSVVEEHTLARRGA;QGSVVEEHTLAR<br>RGAE;GSVVEEHTLARRGAEV;SVVEEHTLARRGAEVL;VVEEHTLARRGAE<br>VLW;VEEHTLARRGAEVLWE;EEHTLARRGAEVLWEQ;EHTLARRGAEVLW<br>EQL;HTLARRGAEVLWEQLH;TLARRGAEVLWEQLHD;LARRGAEVLWEQL<br>HDL;ARRGAEVLWEQLHDLE;RRGAEVLWEQLHDLEW;RGAEVLWEQLHD<br>LEWV;GAEVLWEQLHDLEWVN;AEVLWEQLHDLEWVNA;EVLWEQLHDLE<br>WVNAL;VLWEQLHDLEWVNALG;LWEQLHDLEWVNALGA;WEQLHDLEWV<br>NALGAL;EQLHDLEWVNALGALT;QLHDLEWVNALGALTG;LHDLEWVNAL<br>GALTGN;HDLEWVNALGALTGNM;DLEWVNALGALTGNMA;LEWVNALGAL<br>TGNMAV;EWVNALGALTGNMAVQ;WVNALGALTGNMAVQQ;VNALGALTG<br>NMAVQQV;NALGALTGNMAVQQVR;ALGALTGNMAVQQVRA;LGALTGNM<br>AVQQVRAG;GALTGNMAVQQVRAGL;ALTGNMAVQQVRAGLK;LTGNMAV<br>QQVRAGLKA;TGNMAVQQVRAGLKAI;GNMAVQQVRAGLKAIY;NMAVQQV<br>RAGLKAIYL;MAVQQVRAGLKAIYLS;AVQQVRAGLKAIYLSG;VQQVRAGLK<br>AIYLSGW;QQVRAGLKAIYLSGWQ;QVRAGLKAIYLSGWQV;VRAGLKAIYL<br>SGWQVA;RAGLKAIYLSGWQVAG;AGLKAIYLSGWQVAGD;GLKAIYLSGW<br>QVAGDA;LKAIYLSGWQVAGDAN;KAIYLSGWQVAGDANL;AIYLSGWQVA<br>GDANLS;IYLSGWQVAGDANLSG;YLSGWQVAGDANLSGH;LSGWQVAGD<br>ANLSGHT;SGWQVAGDANLSGHTY;GWQVAGDANLSGHTYP;WQVAGDA<br>NLSGHTYPD;QVAGDANLSGHTYPDQ;VAGDANLSGHTYPDQS;AGDANLS<br>GHTYPDQSL;GDANLSGHTYPDQSLY;DANLSGHTYPDQSLYP;ANLSGHT<br>YPDQSLYPA;NLSGHTYPDQSLYPAN;LSGHTYPDQSLYPANS;SGHTYPD<br>QSLYPANSV;GHTYPDQSLYPANSVP;HTYPDQSLYPANSVPQ;TYPDQSLY<br>PANSVPQV;YPDQSLYPANSVPQVV;PDQSLYPANSVPQVVR;DQSLYPAN<br>SVPQVVRR;QSLYPANSVPQVVRRI;SLYPANSVPQVVRRIN;LYPANSVPQ<br>VVRRINN;YPANSVPQVVRRINNA;PANSVPQVVRRINNAL;ANSVPQVVRRI<br>NNALQ;NSVPQVVRRINNALQR;SVPQVVRRINNALQRA;VPQVVRRINNAL<br>QRAD;PQVVRRINNALQRADQ;QVVRRINNALQRADQI;VVRRINNALQRAD<br>QIA;VRRINNALQRADQIAK;RRINNALQRADQIAKI;RINNALQRADQIAKIE;IN<br>NALQRADQIAKIEG;NNALQRADQIAKIEGD;NALQRADQIAKIEGDT;ALQRA<br>DQIAKIEGDTS;LQRADQIAKIEGDTSV;QRADQIAKIEGDTSVE;RADQIAKIE<br>GDTSVEN;ADQIAKIEGDTSVENW;DQIAKIEGDTSVENWL;QIAKIEGDTSVE<br>NWLA;IAKIEGDTSVENWLAP;AKIEGDTSVENWLAPI;KIEGDTSVENWLAPI<br>V;IEGDTSVENWLAPIVA;EGDTSVENWLAPIVAD;GDTSVENWLAPIVADG;<br>DTSVENWLAPIVADGE;TSVENWLAPIVADGEA;SVENWLAPIVADGEAG;V<br>ENWLAPIVADGEAGF;ENWLAPIVADGEAGFG;NWLAPIVADGEAGFGG;W<br>LAPIVADGEAGFGGA;LAPIVADGEAGFGGAL;APIVADGEAGFGGALN;PIV | |

Fig. 30 continued

| | | |
|---|---|---|
| | ADGEAGFGGALNV;IVADGEAGFGGALNVY;VADGEAGFGGALNVYE;ADGEAGFGGALNVYEL;DGEAGFGGALNVYELQ;GEAGFGGALNVYELQK;EAGFGGALNVYELQKA;AGFGGALNVYELQKAL;GFGGALNVYELQKALI;FGGALNVYELQKALIA;GGALNVYELQKALIAA;GALNVYELQKALIAAG;ALNVYELQKALIAAGV;LNVYELQKALIAAGVA;NVYELQKALIAAGVAG;VYELQKALIAAGVAGS;YELQKALIAAGVAGSH;ELQKALIAAGVAGSHW;LQKALIAAGVAGSHWE;QKALIAAGVAGSHWED;KALIAAGVAGSHWEDQ;ALIAAGVAGSHWEDQL;LIAAGVAGSHWEDQLA;IAAGVAGSHWEDQLAS;AAGVAGSHWEDQLASE;AGVAGSHWEDQLASEK;GVAGSHWEDQLASEKK;VAGSHWEDQLASEKKC;AGSHWEDQLASEKKCG;GSHWEDQLASEKKCGH;SHWEDQLASEKKCGHL;HWEDQLASEKKCGHLG;WEDQLASEKKCGHLGG;EDQLASEKKCGHLGGK;DQLASEKKCGHLGGKV;QLASEKKCGHLGGKVL;LASEKKCGHLGGKVLI;ASEKKCGHLGGKVLIP;SEKKCGHLGGKVLIPT;EKKCGHLGGKVLIPTQ;KKCGHLGGKVLIPTQQ;KCGHLGGKVLIPTQQH;CGHLGGKVLIPTQQHI;GHLGGKVLIPTQQHIR;HLGGKVLIPTQQHIRT;LGGKVLIPTQQHIRTL;GGKVLIPTQQHIRTLT;GKVLIPTQQHIRTLTS;KVLIPTQQHIRTLTSA;VLIPTQQHIRTLTSAR;LIPTQQHIRTLTSARL;IPTQQHIRTLTSARLA;PTQQHIRTLTSARLAA;TQQHIRTLTSARLAAD;QQHIRTLTSARLAADV;QHIRTLTSARLAADVA;HIRTLTSARLAADVAD;IRTLTSARLAADVADV;RTLTSARLAADVADVP;TLTSARLAADVADVPT;LTSARLAADVADVPTV;TSARLAADVADVPTVV;SARLAADVADVPTVVI;ARLAADVADVPTVVIA;RLAADVADVPTVVIAR;LAADVADVPTVVIART;AADVADVPTVVIARTD;ADVADVPTVVIARTDA;DVADVPTVVIARTDAE;VADVPTVVIARTDAEA;ADVPTVVIARTDAEAA;DVPTVVIARTDAEAAT;VPTVVIARTDAEAATL;PTVVIARTDAEAATLI;TVVIARTDAEAATLIT;VVIARTDAEAATLITS;VIARTDAEAATLITSD;IARTDAEAATLITSDV;ARTDAEAATLITSDVD;RTDAEAATLITSDVDE;TDAEAATLITSDVDER;DAEAATLITSDVDERD;AEAATLITSDVDERDQ;EAATLITSDVDERDQP;AATLITSDVDERDQPF;ATLITSDVDERDQPFI;TLITSDVDERDQPFIT;LITSDVDERDQPFITG;ITSDVDERDQPFITGE;TSDVDERDQPFITGER;SDVDERDQPFITGERT;DVDERDQPFITGERTR;VDERDQPFITGERTRE;DERDQPFITGERTREG;ERDQPFITGERTREGF;RDQPFITGERTREGFY;DQPFITGERTREGFYR;QPFITGERTREGFYRT;PFITGERTREGFYRTK;FITGERTREGFYRTKN;ITGERTREGFYRTKNG;TGERTREGFYRTKNGI;GERTREGFYRTKNGIE;ERTREGFYRTKNGIEP;RTREGFYRTKNGIEPC;TREGFYRTKNGIEPCI;REGFYRTKNGIEPCIA;EGFYRTKNGIEPCIAR;GFYRTKNGIEPCIARA;FYRTKNGIEPCIARAK;YRTKNGIEPCIARAKA;RTKNGIEPCIARAKAY;TKNGIEPCIARAKAYA;KNGIEPCIARAKAYAP;NGIEPCIARAKAYAPF;GIEPCIARAKAYAPFA;IEPCIARAKAYAPFAD;EPCIARAKAYAPFADL;PCIARAKAYAPFADLI;CIARAKAYAPFADLIW;IARAKAYAPFADLIWM;ARAKAYAPFADLIWME;RAKAYAPFADLIWMET;AKAYAPFADLIWMETG;KAYAPFADLIWMETGT;AYAPFADLIWMETGTP;YAPFADLIWMETGTPD;APFADLIWMETGTPDL;PFADLIWMETGTPDLE;FADLIWMETGTPDLEA;ADLIWMETGTPDLEAA;DLIWMETGTPDLEAAR;LIWMETGTPDLEAARQ;IWMETGTPDLEAARQF;WMETGTPDLEAARQFS;METGTPDLEAARQFSE;ETGTPDLEAARQFSEA;TGTPDLEAARQFSEAV;GTPDLEAARQFSEAVK;TPDLEAARQFSEAVKA;PDLEAARQFSEAVKAE;DLEAARQFSEAVKAEY;LEAARQFSEAVKAEYP;EAARQFSEAVKAEYPD;AARQFSEAVKAEYPDQ;ARQFSEAVKAEYPDQM;RQFSEAVKAEYPDQML;QFSEAVKAEYPDQMLA;FSEAVKAEYPDQMLAY;SEAVKAEYPDQMLAYN;EAVKAEYPDQMLAYNC;AVKAEYPDQMLAYNCS;VKAEYPDQMLAYNCSP;KAEYPDQMLAYNCSPS;AEYPDQMLAYNCSPSF;EYPDQMLAYNCSPSFN;YPDQMLAYNCSPSFNW;PDQMLAYNCSPSFNWK;DQMLAYNCSPSFNWKK;QMLAYNCSPSFNWKKH;MLAYNCSPSFNWKKHL;LAYNCSPSFNWKKHLD;AYNCSPSFNWKKHLDD;YNCSPSFNWKKHLDDA;NCSPSFNWKKHLDDA | |

Fig. 30 continued

| | | |
|---|---|---|
| | T;CSPSFNWKKHLDDATI;SPSFNWKKHLDDATIA;PSFNWKKHLDDATIAK;SFNWKKHLDDATIAKF;FNWKKHLDDATIAKFQ;NWKKHLDDATIAKFQK;WKKHLDDATIAKFQKE;KKHLDDATIAKFQKEL;KHLDDATIAKFQKELA;HLDDATIAKFQKELAA;LDDATIAKFQKELAAM;DDATIAKFQKELAAMG;DATIAKFQKELAAMGF;ATIAKFQKELAAMGFK;TIAKFQKELAAMGFKF;IAKFQKELAAMGFKFQ;AKFQKELAAMGFKFQF;KFQKELAAMGFKFQFI;FQKELAAMGFKFQFIT;QKELAAMGFKFQFITL;KELAAMGFKFQFITLA;ELAAMGFKFQFITLAG;LAAMGFKFQFITLAGF;AAMGFKFQFITLAGFH;AMGFKFQFITLAGFHA;MGFKFQFITLAGFHAL;GFKFQFITLAGFHALN;FKFQFITLAGFHALNY;KFQFITLAGFHALNYS;FQFITLAGFHALNYSM;QFITLAGFHALNYSMF;FITLAGFHALNYSMFD;ITLAGFHALNYSMFDL;TLAGFHALNYSMFDLA;LAGFHALNYSMFDLAY;AGFHALNYSMFDLAYG;GFHALNYSMFDLAYGY;FHALNYSMFDLAYGYA;HALNYSMFDLAYGYAQ;ALNYSMFDLAYGYAQN;LNYSMFDLAYGYAQNQ;NYSMFDLAYGYAQNQM;YSMFDLAYGYAQNQMS;SMFDLAYGYAQNQMSA;MFDLAYGYAQNQMSAY;FDLAYGYAQNQMSAYV;DLAYGYAQNQMSAYVE;LAYGYAQNQMSAYVEL;AYGYAQNQMSAYVELQ;YGYAQNQMSAYVELQE;GYAQNQMSAYVELQER;YAQNQMSAYVELQERE;AQNQMSAYVELQEREF;QNQMSAYVELQEREFA;NQMSAYVELQEREFAA;QMSAYVELQEREFAAE;MSAYVELQEREFAAEE;SAYVELQEREFAAEER;AYVELQEREFAAEERG;YVELQEREFAAEERGY;VELQEREFAAEERGYT;ELQEREFAAEERGYTA;LQEREFAAEERGYTAT;QEREFAAEERGYTATK;EREFAAEERGYTATKH;REFAAEERGYTATKHQ;EFAAEERGYTATKHQR;FAAEERGYTATKHQRE;AAEERGYTATKHQREV;AEERGYTATKHQREVG;EERGYTATKHQREVGA;ERGYTATKHQREVGAG;RGYTATKHQREVGAGY;GYTATKHQREVGAGYF;YTATKHQREVGAGYFD;TATKHQREVGAGYFDR;ATKHQREVGAGYFDRI;TKHQREVGAGYFDRIA;KHQREVGAGYFDRIAT;HQREVGAGYFDRIATT;QREVGAGYFDRIATTV;REVGAGYFDRIATTVD;EVGAGYFDRIATTVDP;VGAGYFDRIATTVDPN;GAGYFDRIATTVDPNS;AGYFDRIATTVDPNSS;GYFDRIATTVDPNSST;YFDRIATTVDPNSSTT;FDRIATTVDPNSSTTA;DRIATTVDPNSSTTAL;RIATTVDPNSSTTALT;IATTVDPNSSTTALTG;ATTVDPNSSTTALTGS;TTVDPNSSTTALTGST;TVDPNSSTTALTGSTE;VDPNSSTTALTGSTEE;DPNSSTTALTGSTEEG;PNSSTTALTGSTEEGQ;NSSTTALTGSTEEGQF;SSTTALTGSTEEGQFH | |
| 37 | **<NP_215646.1 hypothetical protein Rv1130;Mycobacterium tuberculosis H37Rv>**<br>MPDQDTKVRFFRVFCWCPVLRMVRIMLMHAVRAWRSADDFPCTEHMAYKIAQVAADPVDVDPEVADMVCNRIIDNAAVSAASMVRRPVTVARHQALAHPVRHGAKVFGVEGSYSADWAAWANGVAARELDFHDTFLAADYSHPADNIPPLVAVAQQLGVCGAELIRGLVTAYEIHIDLTRGICLHEHKIDHVAHLGPAVAAGIGTMLRLDQETIYHAIGQALHLTTSTRQSRKGAISSWKAFAPAHAGKVGIEAVDRAMRGEGSPAPIWEGEDGVIAWLLAGPEHTYRVPLPAPGEPKRAILDSYTKQHSAEYQSQAPIDLACRLRERIGDLDQIASIVLHTSHHTHVVIGTGSGDPQKFDPDASRETLDHSLPYIFAVALQDGCWHHERSYAPERARRSDTVALWHKISTVEDPEWTRRYHCADPAKKAFGARAEVTLHSGEVIVDELAVADAHPLGTRPFERKQYVEKFTELADGVVEPVEQQRFLAVVESLADLESGAVGGLNVLVDPRVLDKAPVIPPGIFR<br><br>8mer<br>MPDQDTKV;DTKVRFFR;TKVRFFRV;KVRFFRVF;RFFRVFCW;RVFCWCPV;CPVLRMVR;RMVRIMLM;RIMLMHAV;IMLMHAVR;MLMHAVRA;LMHAVRAW;MHAVRAWR;AVRAWRSA;AWRSADDF;FPCTEHMA;CTEHMAYK;MAYKIAQV;AQVAADPV;VAADPVDV;PVDVDPEV;VADMVCNR;RIIDNAAV;AAVSAASM;AVSAASMV;VSAASMVR;SAASMVRR;MVRRPVTV;RRPVTVAR;T | 192623-195300 |

Fig. 30 continued

| | | |
|---|---|---|
| | VARHQAL;HQALAHPV;QALAHPVR;PVRHGAKV;HGAKVFGV;VFGVEGSY;YSADWAAW;SADWAAWA;WAAWANGV;WANGVAAR;VAARELDF;ELDFHDTF;DTFLAADY;FLAADYSH;NIPPLVAV;IPPLVAVA;LVAVAQQL;AVAQQLGV;QQLGVCGA;AELIRGLV;LIRGLVTA;GLVTAYEI;AYEIHIDL;EIHIDLTR;DLTRGICL;GICLHEHK;KIDHVAHL;HVAHLGPA;VAHLGPAV;HLGPAVAA;GPAVAAGI;VAAGIGTM;GIGTMLRL;RLDQETIY;QETIYHAI;YHAIGQAL;AIGQALHL;GQALHLTT;ALHLTTST;TTSTRQSR;TSTRQSRK;RQSRKGAI;AISSWKAF;FAPAHAGK;APAHAGKV;EAVDRAMR;EGSPAPIW;WEGEDGVI;GEDGVIAW;GVIAWLLA;LLAGPEHT;LAGPEHTY;EHTYRVPL;GEPKRAIL;KRAILDSY;AILDSYTK;ILDSYTKQ;YTKQHSAE;EYQSQAPI;SQAPIDLA;PIDLACRL;LACRLRER;RIGDLDQI;DLDQIASI;QIASIVLH;VLHTSHHT;HTSHHTHV;TSHHTHVV;KFDPDASR;RETLDHSL;TLDHSLPY;HSLPYIFA;SLPYIFAV;LPYIFAVA;PYIFAVAL;YIFAVALQ;VALQDGCW;ALQDGCWH;DGCWHHER;CWHHERSY;ERSYAPER;SYAPERAR;YAPERARR;RARRSDTV;RRSDTVAL;RSDTVALW;DTVALWHK;TVALWHKI;ALWHKIST;STVEDPEW;DPEWTRRY;RYHCADPA;AFGARAEV;AEVTLHSG;VTLHSGEV;TLHSGEVI;GEVIVDEL;EVIVDELA;VIVDELAV;IVDELAVA;AVADAHPL;DAHPLGTR;HPLGTRPF;LGTRPFER;GTRPFERK;YVEKFTEL;FTELADGV;ELADGVVE;EPVEQQRF;EQQRFLAV;QQRFLAVV;FLAVVESL;SLADLESG;ESGAVGGL;GAVGGLNV;AVGGLNVL;NVLVDPRV;VLVDPRVL;RVLDKAPV;VLDKAPVI;APVIPPGI;PVIPPGIF;VIPPGIFR<br>9mer<br>QDTKVRFFR;DTKVRFFRV;KVRFFRVFC;FRVFCWCPV;RVFCWCPVL;VFCWCPVLR;FCWCPVLRM;CPVLRMVRI;VLRMVRIML;RMVRIMLMH;MVRIMLMHA;RIMLMHAVR;IMLMHAVRA;MLMHAVRAW;LMHAVRAWR;RAWRSADDF;FPCTEHMAY;HMAYKIAQV;MAYKIAQVA;QVAADPVDV;DPVDVDPEV;DVDPEVADM;DPEVADMVC;EVADMVCNR;IIDNAAVSA;NAAVSAASM;AAVSAASMV;AVSAASMVR;VSAASMVRR;AASMVRRPV;SMVRRPVTV;MVRRPVTVA;VTVARHQAL;TVARHQALA;HQALAHPVR;LAHPVRHGA;HPVRHGAKV;KVFGVEGSY;FGVEGSYSA;SYSADWAAW;YSADWAAWA;DWAAWANGV;WAAWANGVA;AAWANGVAA;AWANGVAAR;GVAARELDF;RELDFHDTF;ELDFHDTFL;DTFLAADYS;FLAADYSHP;LAADYSHPA;DYSHPADNI;HPADNIPPL;PADNIPPLV;DNIPPLVAV;NIPPLVAVA;PLVAVAQQL;VAVAQQLGV;AQQLGVCGA;QLGVCGAEL;GVCGAELIR;AELIRGLVT;ELIRGLVTA;LIRGLVTAY;TAYEIHIDL;YEIHIDLTR;RGICLHEHK;HVAHLGPAV;LGPAVAAGI;AVAAGIGTM;VAAGIGTML;AAGIGTMLR;TMLRLDQET;MLRLDQETI;RLDQETIYH;ETIYHAIGQ;TIYHAIGQA;IYHAIGQAL;HAIGQALHL;AIGQALHLT;GQALHLTTS;ALHLTTSTR;LTTSTRQSR;TTSTRQSRK;STRQSRKGA;GAISSWKAF;AISSWKAFA;SSWKAFAPA;AFAPAHAGK;FAPAHAGKV;APAHAGKVG;AMRGEGSPA;PIWEGEDGV;GEDGVIAWL;WLLAGPEHT;LLAGPEHTY;LAGPEHTYR;AGPEHTYRV;PEHTYRVPL;HTYRVPLPA;APGEPKRAI;RAILDSYTK;YTKQHSAEY;HSAEYQSQA;AEYQSQAPI;YQSQAPIDL;SQAPIDLAC;QAPIDLACR;APIDLACRL;DLACRLRER;RLRERIGDL;RIGDLDQIA;DLDQIASIV;HTSHHTHVV;GTGSGDPQK;ETLDHSLPY;TLDHSLPYI;HSLPYIFAV;SLPYIFAVA;LPYIFAVAL;ALQDGCWHH;RSYAPERAR;SYAPERARR;APERARRSD;ERARRSDTV;RARRSDTVA;ARRSDTVAL;RRSDTVALW;DTVALWHKI;ALWHKISTV;ISTVEDPEW;TVEDPEWTR;RYHCADPAK;CADPAKKAF;PAKKAFGAR;KAFGARAEV;FGARAEVTL;AEVTLHSGE;EVTLHSGEV;TLHSGEVIV;EVIVDELAV;VIVDELAVA;LAVADAHPL;PLGTRPFER;RPFERKQYV;QYVEKFTEL;YVEKFTELA;KFTELADGV;FTELADGVV;ELADGVVEP;LADGVVEPV;VVEPVEQQR;EPVEQQRFL;VEQQRFLAV;RFLAVVESL;FLAVVESLA;AVVESLADL;SLADLESGA;LESGAVGGL;GAVGGLNVL;AVGGLNVLV;GLNVLVDPR;VLVDPRVLD;LVDPRVLDK;RVLDKAPVI;APVIPPGIF | |

Fig. 30 continued

| | | |
|---|---|---|
| | 10mer<br>MPDQDTKVRF;DQDTKVRFFR;QDTKVRFFRV;DTKVRFFRVF;KVRFFRVFCW;FRVFCWCPVL;RVFCWCPVLR;FCWCPVLRMV;CWCPVLRMVR;WCPVLRMVRI;CPVLRMVRIM;VLRMVRIMLM;RMVRIMLMHA;MVRIMLMHAV;VRIMLMHAVR;RIMLMHAVRA;IMLMHAVRAW;MLMHAVRAWR;DFPCTEHMAY;FPCTEHMAYK;HMAYKIAQVA;MAYKIAQVAA;KIAQVAADPV;AQVAADPVDV;DPVDVDPEVA;DVDPEVADMV;EVADMVCNRI;MVCNRIIDNA;RIIDNAAVSA;IIDNAAVSAA;NAAVSAASMV;AAVSAASMVR;AVSAASMVRR;SAASMVRRPV;SMVRRPVTVA;MVRRPVTVAR;RPVTVARHQA;TVARHQALAH;RHQALAHPVR;ALAHPVRHGA;LAHPVRHGAK;HPVRHGAKVF;EGSYSADWAA;GSYSADWAAW;WAAWANGVAA;WANGVAAREL;RELDFHDTFL;ELDFHDTFLA;DTFLAADYSH;FLAADYSHPA;SHPADNIPPL;HPADNIPPLV;LVAVAQQLGV;QQLGVCGAEL;QLGVCGAELI;CGAELIRGLV;AELIRGLVTA;ELIRGLVTAY;GLVTAYEIHI;VTAYEIHIDL;AYEIHIDLTR;HIDLTRGICL;CLHEHKIDHV;HVAHLGPAVA;HLGPAVAAGI;PAVAAGIGTM;AVAAGIGTML;VAAGIGTMLR;TMLRLDQETI;MLRLDQETIY;RLDQETIYHA;ETIYHAIGQA;TIYHAIGQAL;YHAIGQALHL;GQALHLTTST;QALHLTTSTR;HLTTSTRQSR;LTTSTRQSRK;STRQSRKGAI;QSRKGAISSW;SRKGAISSWK;KGAISSWKAF;KAFAPAHAGK;AFAPAHAGKV;APAHAGKVGI;HAGKVGIEAV;GIEAVDRAMR;RGEGSPAPIW;APIWEGEDGV;PIWEGEDGVI;WEGEDGVIAW;GEDGVIAWLL;IAWLLAGPEH;WLLAGPEHTY;LLAGPEHTYR;LAGPEHTYRV;GPEHTYRVPL;LPAPGEPKRA;APGEPKRAIL;EPKRAILDSY;KRAILDSYTK;ILDSYTKQHS;SYTKQHSAEY;EYQSQAPIDL;YQSQAPIDLA;SQAPIDLACR;DLACRLRERI;RERIGDLDQI;DLDQIASIVL;VLHTSHHTHV;HTSHHTHVVI;RETLDHSLPY;ETLDHSLPYI;TLDHSLPYIF;HSLPYIFAVA;SLPYIFAVAL;LPYIFAVALQ;FAVALQDGCW;ALQDGCWHHE;LQDGCWHHER;RSYAPERARR;APERARRSDT;RARRSDTVAL;RRSDTVALWH;RSDTVALWHK;VALWHKISTV;KISTVEDPEW;STVEDPEWTR;TVEDPEWTRR;RRYHCADPAK;RYHCADPAKK;DPAKKAFGAR;AFGARAEVTL;AEVTLHSGEV;EVTLHSGEVI;VTLHSGEVIV;GEVIVDELAV;EVIVDELAVA;IVDELAVADA;ELAVADAHPL;DAHPLGTRPF;HPLGTRPFER;GTRPFERKQY;FERKQYVEKF;KQYVEKFTEL;EKFTELADGV;ELADGVVEPV;GVVEPVEQQR;EPVEQQRFLA;PVEQQRFLAV;VEQQRFLAVV;QRFLAVVESL;LAVVESLADL;SLADLESGAV;DLESGAVGGL;ESGAVGGLNV;GAVGGLNVLV;GLNVLVDPRV;VLVDPRVLDK;LVDPRVLDKA;DKAPVIPPGI<br>11mer<br>MPDQDTKVRFF;DTKVRFFRVFC;RFFRVFCWCPV;FRVFCWCPVLR;CPVLRMVRIML;PVLRMVRIMLM;RMVRIMLMHAV;MVRIMLMHAVR;RIMLMHAVRAW;IMLMHAVRAWR;MLMHAVRAWRS;LMHAVRAWRSA;AVRAWRSADDF;SADDFPCTEHM;DDFPCTEHMAY;DFPCTEHMAYK;FPCTEHMAYKI;HMAYKIAQVAA;YKIAQVAADPV;AADPVDVDPEV;DPEVADMVCNR;EVADMVCNRII;MVCNRIIDNAA;RIIDNAAVSAA;DNAAVSAASMV;NAAVSAASMVR;AAVSAASMVRR;VSAASMVRRPV;AASMVRRPVTV;SMVRRPVTVAR;RPVTVARHQAL;VARHQALAHPV;QALAHPVRHGA;ALAHPVRHGAK;LAHPVRHGAKV;AHPVRHGAKVF;GAKVFGVEGSY;KVFGVEGSYSA;FGVEGSYSADW;SADWAAWANGV;WAAWANGVAAR;RELDFHDTFLA;ELDFHDTFLAA;DFHDTFLAADY;YSHPADNIPPL;HPADNIPPLVA;PADNIPPLVAV;IPPLVAVAQQL;PLVAVAQQLGV;AVAQQLGVCGA;AQQLGVCGAEL;QQLGVCGAELI;AELIRGLVTAY;ELIRGLVTAYE;LIRGLVTAYEI;TAYEIHIDLTR;YEIHIDLTRGI;LTRGICLHEHK;CLHEHKIDHVA;HEHKIDHVAHL;KIDHVAHLGPA;HVAHLGPAVAA;GPAVAAGIGTM;AVAAGIGTMLR;GTMLRLDQETI;TMLRLDQETIY;RLDQETIYHAI;ETIYHAIGQAL;TIYHAIGQALH;IYHAIGQALHL;GQALHLTTSTR;HLTTSTRQSRK;RQSRKGAISSW;QSRKGAISSWK;AISSWKAFAPA;KA | |

Fig. 30 continued

| | | |
|---|---|---|
| | FAPAHAGKV;FAPAHAGKVGI;AMRGEGSPAPI;APIWEGEDGVI;PIWEGED GVIA;WEGEDGVIAWL;WLLAGPEHTYR;LLAGPEHTYRV;RVPLPAPGEPK; LPAPGEPKRAI;ILDSYTKQHSA;DSYTKQHSAEY;KQHSAEYQSQA;HSAEY QSQAPI;AEYQSQAPIDL;YQSQAPIDLAC;QSQAPIDLACR;SQAPIDLACRL; QAPIDLACRLR;RIGDLDQIASI;IVLHTSHHTHV;VLHTSHHTHVV;VIGTGSG DPQK;DPQKFDPDASR;KFDPDASRETL;RETLDHSLPYI;ETLDHSLPYIF;TL DHSLPYIFA;HSLPYIFAVAL;SLPYIFAVALQ;LPYIFAVALQD;YIFAVALQDG C;IFAVALQDGCW;ALQDGCWHHER;APERARRSDTV;ERARRSDTVAL;RA RRSDTVALW;RRSDTVALWHK;TVALWHKISTV;HKISTVEDPEW;ISTVEDP EWTR;STVEDPEWTRR;TVEDPEWTRRY;WTRRYHCADPA;TRRYHCADP AK;RRYHCADPAKK;RYHCADPAKKA;KAFGARAEVTL;AEVTLHSGEVI;EV TLHSGEVIV;LHSGEVIVDEL;VIVDELAVADA;DELAVADAHPL;AVADAHPLG TR;GTRPFERKQYV;RPFERKQYVEK;PFERKQYVEKF;KQYVEKFTELA;TE LADGVVEPV;ELADGVVEPVE;VVEPVEQQRFL;EPVEQQRFLAV;PVEQQR FLAVV;QQRFLAVVESL;FLAVVESLADL;ESLADLESGAV;SLADLESGAVG; LESGAVGGLNV;SGAVGGLNVLV;GLNVLVDPRVL;NVLVDPRVLDK;VLVDP RVLDKA;KAPVIPPGIFR<br><br>13 mers:<br>MPDQDTKVRFFRV;PDQDTKVRFFRVF;DQDTKVRFFRVFC;QDTKVRFFR VFCW;DTKVRFFRVFCWC;TKVRFFRVFCWCP;KVRFFRVFCWCPV;VRFF RVFCWCPVL;RFFRVFCWCPVLR;FFRVFCWCPVLRM;FRVFCWCPVLRM V;RVFCWCPVLRMVR;VFCWCPVLRMVRI;FCWCPVLRMVRIM;CWCPVLR MVRIML;WCPVLRMVRIMLM;CPVLRMVRIMLMH;PVLRMVRIMLMHA;VLR MVRIMLMHAV;LRMVRIMLMHAVR;RMVRIMLMHAVRA;MVRIMLMHAVRA W;VRIMLMHAVRAWR;RIMLMHAVRAWRS;IMLMHAVRAWRSA;MLMHAVR AWRSAD;LMHAVRAWRSADD;MHAVRAWRSADDF;HAVRAWRSADDFP;A VRAWRSADDFPC;VRAWRSADDFPCT;RAWRSADDFPCTE;AWRSADDFP CTEH;WRSADDFPCTEHM;RSADDFPCTEHMA;SADDFPCTEHMAY;ADDF PCTEHMAYK;DDFPCTEHMAYKI;DFPCTEHMAYKIA;FPCTEHMAYKIAQ;P CTEHMAYKIAQV;CTEHMAYKIAQVA;TEHMAYKIAQVAA;EHMAYKIAQVAA D;HMAYKIAQVAADP;MAYKIAQVAADPV;AYKIAQVAADPVD;YKIAQVAAD PVDV;KIAQVAADPVDVD;IAQVAADPVDVDP;AQVAADPVDVDPE;QVAAD PVDVDPEV;VAADPVDVDPEVA;AADPVDVDPEVAD;ADPVDVDPEVADM; DPVDVDPEVADMV;PVDVDPEVADMVC;VDVDPEVADMVCN;DVDPEVAD MVCNR;VDPEVADMVCNRI;DPEVADMVCNRII;PEVADMVCNRIID;EVADM VCNRIIDN;VADMVCNRIIDNA;ADMVCNRIIDNAA;DMVCNRIIDNAAV;MVC NRIIDNAAVS;VCNRIIDNAAVSA;CNRIIDNAAVSAA;NRIIDNAAVSAAS;RIID NAAVSAASM;IIDNAAVSAASMV;IDNAAVSAASMVR;DNAAVSAASMVRR;N AAVSAASMVRRP;AAVSAASMVRRPV;AVSAASMVRRPVT;VSAASMVRRP VTV;SAASMVRRPVTVA;AASMVRRPVTVAR;ASMVRRPVTVARH;SMVRR PVTVARHQ;MVRRPVTVARHQA;VRRPVTVARHQAL;RRPVTVARHQALA; RPVTVARHQALAH;PVTVARHQALAHP;VTVARHQALAHPV;TVARHQALAH PVR;VARHQALAHPVRH;ARHQALAHPVRHG;RHQALAHPVRHGA;HQALA HPVRHGAK;QALAHPVRHGAKV;ALAHPVRHGAKVF;LAHPVRHGAKVFG;A HPVRHGAKVFGV;HPVRHGAKVFGVE;PVRHGAKVFGVEG;VRHGAKVFG VEGS;RHGAKVFGVEGSY;HGAKVFGVEGSYS;GAKVFGVEGSYSA;AKVF GVEGSYSAD;KVFGVEGSYSADW;VFGVEGSYSADWA;FGVEGSYSADWA A;GVEGSYSADWAAW;VEGSYSADWAAWA;EGSYSADWAAWAN;GSYSA DWAAWANG;SYSADWAAWANGV;YSADWAAWANGVA;SADWAAWANGV AA;ADWAAWANGVAAR;DWAAWANGVAARE;WAAWANGVAAREL;AAWA NGVAARELD;AWANGVAARELDF;WANGVAARELDFH;ANGVAARELDFH D;NGVAARELDFHDT;GVAARELDFHDTF;VAARELDFHDTFL;AARELDFHD | |

Fig. 30 continued

| | | |
|---|---|---|
| | TFLA;ARELDFHDTFLAA;RELDFHDTFLAAD;ELDFHDTFLAADY;LDFHDTFLAADYS;DFHDTFLAADYSH;FHDTFLAADYSHP;HDTFLAADYSHPA;DTFLAADYSHPAD;TFLAADYSHPADN;FLAADYSHPADNI;LAADYSHPADNIP;AADYSHPADNIPP;ADYSHPADNIPPL;DYSHPADNIPPLV;YSHPADNIPPLVA;SHPADNIPPLVAV;HPADNIPPLVAVA;PADNIPPLVAVAQ;ADNIPPLVAVAQQ;DNIPPLVAVAQQL;NIPPLVAVAQQLG;IPPLVAVAQQLGV;PPLVAVAQQLGVC;PLVAVAQQLGVCG;LVAVAQQLGVCGA;VAVAQQLGVCGAE;AVAQQLGVCGAEL;VAQQLGVCGAELI;AQQLGVCGAELIR;QQLGVCGAELIRG;QLGVCGAELIRGL;LGVCGAELIRGLV;GVCGAELIRGLVT;VCGAELIRGLVTA;CGAELIRGLVTAY;GAELIRGLVTAYE;AELIRGLVTAYEI;ELIRGLVTAYEIH;LIRGLVTAYEIHI;IRGLVTAYEIHID;RGLVTAYEIHIDL;GLVTAYEIHIDLT;LVTAYEIHIDLTR;VTAYEIHIDLTRG;TAYEIHIDLTRGI;AYEIHIDLTRGIC;YEIHIDLTRGICL;EIHIDLTRGICLH;IHIDLTRGICLHE;HIDLTRGICLHEH;IDLTRGICLHEHK;DLTRGICLHEHKI;LTRGICLHEHKID;TRGICLHEHKIDH;RGICLHEHKIDHV;GICLHEHKIDHVA;ICLHEHKIDHVAH;CLHEHKIDHVAHL;LHEHKIDHVAHLG;HEHKIDHVAHLGP;EHKIDHVAHLGPA;HKIDHVAHLGPAV;KIDHVAHLGPAVA;IDHVAHLGPAVAA;DHVAHLGPAVAAG;HVAHLGPAVAAGI;VAHLGPAVAAGIG;AHLGPAVAAGIGT;HLGPAVAAGIGTM;LGPAVAAGIGTML;GPAVAAGIGTMLR;PAVAAGIGTMLRL;AVAAGIGTMLRLD;VAAGIGTMLRLDQ;AAGIGTMLRLDQE;AGIGTMLRLDQET;GIGTMLRLDQETI;IGTMLRLDQETIY;GTMLRLDQETIYH;TMLRLDQETIYHA;MLRLDQETIYHAI;LRLDQETIYHAIG;RLDQETIYHAIGQ;LDQETIYHAIGQA;DQETIYHAIGQAL;QETIYHAIGQALH;ETIYHAIGQALHL;TIYHAIGQALHLT;IYHAIGQALHLTT;YHAIGQALHLTTS;HAIGQALHLTTST;AIGQALHLTTSTR;IGQALHLTTSTRQ;GQALHLTTSTRQS;QALHLTTSTRQSR;ALHLTTSTRQSRK;LHLTTSTRQSRKG;HLTTSTRQSRKGA;LTTSTRQSRKGAI;TTSTRQSRKGAIS;TSTRQSRKGAISS;STRQSRKGAISSW;TRQSRKGAISSWK;RQSRKGAISSWKA;QSRKGAISSWKAF;SRKGAISSWKAFA;RKGAISSWKAFAP;KGAISSWKAFAPA;GAISSWKAFAPAH;AISSWKAFAPAHA;ISSWKAFAPAHAG;SSWKAFAPAHAGK;SWKAFAPAHAGKV;WKAFAPAHAGKVG;KAFAPAHAGKVGI;AFAPAHAGKVGIE;FAPAHAGKVGIEA;APAHAGKVGIEAV;PAHAGKVGIEAVD;AHAGKVGIEAVDR;HAGKVGIEAVDRA;AGKVGIEAVDRAM;GKVGIEAVDRAMR;KVGIEAVDRAMRG;VGIEAVDRAMRGE;GIEAVDRAMRGEG;IEAVDRAMRGEGS;EAVDRAMRGEGSP;AVDRAMRGEGSPA;VDRAMRGEGSPAP;DRAMRGEGSPAPI;RAMRGEGSPAPIW;AMRGEGSPAPIWE;MRGEGSPAPIWEG;RGEGSPAPIWEGE;GEGSPAPIWEGED;EGSPAPIWEGEDG;GSPAPIWEGEDGV;SPAPIWEGEDGVI;PAPIWEGEDGVIA;APIWEGEDGVIAW;PIWEGEDGVIAWL;IWEGEDGVIAWLL;WEGEDGVIAWLLA;EGEDGVIAWLLAG;GEDGVIAWLLAGP;EDGVIAWLLAGPE;DGVIAWLLAGPEH;GVIAWLLAGPEHT;VIAWLLAGPEHTY;IAWLLAGPEHTYR;AWLLAGPEHTYRV;WLLAGPEHTYRVP;LLAGPEHTYRVPL;LAGPEHTYRVPLP;AGPEHTYRVPLPA;GPEHTYRVPLPAP;PEHTYRVPLPAPG;EHTYRVPLPAPGE;HTYRVPLPAPGEP;TYRVPLPAPGEPK;YRVPLPAPGEPKR;RVPLPAPGEPKRA;VPLPAPGEPKRAI;PLPAPGEPKRAIL;LPAPGEPKRAILD;PAPGEPKRAILDS;APGEPKRAILDSY;PGEPKRAILDSYT;GEPKRAILDSYTK;EPKRAILDSYTKQ;PKRAILDSYTKQH;KRAILDSYTKQHS;RAILDSYTKQHSA;AILDSYTKQHSAE;ILDSYTKQHSAEY;LDSYTKQHSAEYQ;DSYTKQHSAEYQS;SYTKQHSAEYQSQ;YTKQHSAEYQSQA;TKQHSAEYQSQAP;KQHSAEYQSQAPI;QHSAEYQSQAPID;HSAEYQSQAPIDL;SAEYQSQAPIDLA;AEYQSQAPIDLAC;EYQSQAPIDLACR;YQSQAPIDLACRL;QSQAPIDLACRLR;SQAPIDLACRLRE;QAPIDLACRLRER;APIDLACRLRERI;PIDLACRLRERIG;IDLACRLRERIGD;DLACRLRERIGDL;LACRLRERIGDLD;ACRLRERIGDLDQ;CRLRERIGDLDQI;RLRERIGDLDQIA;LRERIGDLDQIAS;RERIGDLDQIASI;ERIGDLDQIASIV;RIGDLDQIASIVL;IGDLDQIA | |

Fig. 30 continued

| | | |
|---|---|---|
| | SIVLH;GDLDQIASIVLHT;DLDQIASIVLHTS;LDQIASIVLHTSH;DQIASIVLHT<br>SHH;QIASIVLHTSHHT;IASIVLHTSHHTH;ASIVLHTSHHTHV;SIVLHTSHHT<br>HVV;IVLHTSHHTHVVI;VLHTSHHTHVVIG;LHTSHHTHVVIGT;HTSHHTHVV<br>IGTG;TSHHTHVVIGTGS;SHHTHVVIGTGSG;HHTHVVIGTGSGD;HTHVVIG<br>TGSGDP;THVVIGTGSGDPQ;HVVIGTGSGDPQK;VVIGTGSGDPQKF;VIGT<br>GSGDPQKFD;IGTGSGDPQKFDP;GTGSGDPQKFDPD;TGSGDPQKFDPD<br>A;GSGDPQKFDPDAS;SGDPQKFDPDASR;GDPQKFDPDASRE;DPQKFDP<br>DASRET;PQKFDPDASRETL;QKFDPDASRETLD;KFDPDASRETLDH;FDP<br>DASRETLDHS;DPDASRETLDHSL;PDASRETLDHSLP;DASRETLDHSLPY;<br>ASRETLDHSLPYI;SRETLDHSLPYIF;RETLDHSLPYIFA;ETLDHSLPYIFAV;<br>TLDHSLPYIFAVA;LDHSLPYIFAVAL;DHSLPYIFAVALQ;HSLPYIFAVALQD;<br>SLPYIFAVALQDG;LPYIFAVALQDGC;PYIFAVALQDGCW;YIFAVALQDGC<br>WH;IFAVALQDGCWHH;FAVALQDGCWHHE;AVALQDGCWHHER;VALQD<br>GCWHHERS;ALQDGCWHHERSY;LQDGCWHHERSYA;QDGCWHHERSY<br>AP;DGCWHHERSYAPE;GCWHHERSYAPER;CWHHERSYAPERA;WHHE<br>RSYAPERAR;HHERSYAPERARR;HERSYAPERARRS;ERSYAPERARRSD<br>;RSYAPERARRSDT;SYAPERARRSDTV;YAPERARRSDTVA;APERARRSD<br>TVAL;PERARRSDTVALW;ERARRSDTVALWH;RARRSDTVALWHK;ARRS<br>DTVALWHKI;RRSDTVALWHKIS;RSDTVALWHKIST;SDTVALWHKISTV;DT<br>VALWHKISTVE;TVALWHKISTVED;VALWHKISTVEDP;ALWHKISTVEDPE;<br>LWHKISTVEDPEW;WHKISTVEDPEWT;HKISTVEDPEWTR;KISTVEDPEW<br>TRR;ISTVEDPEWTRRY;STVEDPEWTRRYH;TVEDPEWTRRYHC;VEDPE<br>WTRRYHCA;EDPEWTRRYHCAD;DPEWTRRYHCADP;PEWTRRYHCADP<br>A;EWTRRYHCADPAK;WTRRYHCADPAKK;TRRYHCADPAKKA;RRYHCAD<br>PAKKAF;RYHCADPAKKAFG;YHCADPAKKAFGA;HCADPAKKAFGAR;CAD<br>PAKKAFGARA;ADPAKKAFGARAE;DPAKKAFGARAEV;PAKKAFGARAEVT<br>;AKKAFGARAEVTL;KKAFGARAEVTLH;KAFGARAEVTLHS;AFGARAEVTL<br>HSG;FGARAEVTLHSGE;GARAEVTLHSGEV;ARAEVTLHSGEVI;RAEVTLH<br>SGEVIV;AEVTLHSGEVIVD;EVTLHSGEVIVDE;VTLHSGEVIVDEL;TLHSGE<br>VIVDELA;LHSGEVIVDELAV;HSGEVIVDELAVA;SGEVIVDELAVAD;GEVIV<br>DELAVADA;EVIVDELAVADAH;VIVDELAVADAHP;IVDELAVADAHPL;VDEL<br>AVADAHPLG;DELAVADAHPLGT;ELAVADAHPLGTR;LAVADAHPLGTRP;A<br>VADAHPLGTRPF;VADAHPLGTRPFE;ADAHPLGTRPFER;DAHPLGTRPFE<br>RK;AHPLGTRPFERKQ;HPLGTRPFERKQY;PLGTRPFERKQYV;LGTRPFE<br>RKQYVE;GTRPFERKQYVEK;TRPFERKQYVEKF;RPFERKQYVEKFT;PFE<br>RKQYVEKFTE;FERKQYVEKFTEL;ERKQYVEKFTELA;RKQYVEKFTELAD;<br>KQYVEKFTELADG;QYVEKFTELADGV;YVEKFTELADGVV;VEKFTELADG<br>VVE;EKFTELADGVVEP;KFTELADGVVEPV;FTELADGVVEPVE;TELADGV<br>VEPVEQ;ELADGVVEPVEQQ;LADGVVEPVEQQR;ADGVVEPVEQQRF;DG<br>VVEPVEQQRFL;GVVEPVEQQRFLA;VVEPVEQQRFLAV;VEPVEQQRFLA<br>VV;EPVEQQRFLAVVE;PVEQQRFLAVVES;VEQQRFLAVVESL;EQQRFLA<br>VVESLA;QQRFLAVVESLAD;QRFLAVVESLADL;RFLAVVESLADLE;FLAVV<br>ESLADLES;LAVVESLADLESG;AVVESLADLESGA;VVESLADLESGAV;VES<br>LADLESGAVG;ESLADLESGAVGG;SLADLESGAVGGL;LADLESGAVGGLN<br>;ADLESGAVGGLNV;DLESGAVGGLNVL;LESGAVGGLNVLV;ESGAVGGLN<br>VLVD;SGAVGGLNVLVDP;GAVGGLNVLVDPR;AVGGLNVLVDPRV;VGGLN<br>VLVDPRVL;GGLNVLVDPRVLD;GLNVLVDPRVLDK;LNVLVDPRVLDKA;NV<br>LVDPRVLDKAP;VLVDPRVLDKAPV;LVDPRVLDKAPVI;VDPRVLDKAPVIP;<br>DPRVLDKAPVIPP;PRVLDKAPVIPPG;RVLDKAPVIPPGI;VLDKAPVIPPGIF;<br>LDKAPVIPPGIFR;<br>14 mers:<br>MPDQDTKVRFFRVF;PDQDTKVRFFRVFC;DQDTKVRFFRVFCW;QDTKVR<br>FFRVFCWC;DTKVRFFRVFCWCP;TKVRFFRVFCWCPV;KVRFFRVFCWC | |

Fig. 30 continued

| | | |
|---|---|---|
| | PVL;VRFFRVFCWCPVLR;RFFRVFCWCPVLRM;FFRVFCWCPVLRMV;FRVFCWCPVLRMVR;RVFCWCPVLRMVRI;VFCWCPVLRMVRIM;FCWCPVLRMVRIML;CWCPVLRMVRIMLM;WCPVLRMVRIMLMH;CPVLRMVRIMLMHA;PVLRMVRIMLMHAV;VLRMVRIMLMHAVR;LRMVRIMLMHAVRA;RMVRIMLMHAVRAW;MVRIMLMHAVRAWR;VRIMLMHAVRAWRS;RIMLMHAVRAWRSA;IMLMHAVRAWRSAD;MLMHAVRAWRSADD;LMHAVRAWRSADDF;MHAVRAWRSADDFP;HAVRAWRSADDFPC;AVRAWRSADDFPCT;VRAWRSADDFPCTE;RAWRSADDFPCTEH;AWRSADDFPCTEHM;WRSADDFPCTEHMA;RSADDFPCTEHMAY;SADDFPCTEHMAYK;ADDFPCTEHMAYKI;DDFPCTEHMAYKIA;DFPCTEHMAYKIAQ;FPCTEHMAYKIAQV;PCTEHMAYKIAQVA;CTEHMAYKIAQVAA;TEHMAYKIAQVAAD;EHMAYKIAQVAADP;HMAYKIAQVAADPV;MAYKIAQVAADPVD;AYKIAQVAADPVDV;YKIAQVAADPVDVD;KIAQVAADPVDVDP;IAQVAADPVDVDPE;AQVAADPVDVDPEV;QVAADPVDVDPEVA;VAADPVDVDPEVAD;AADPVDVDPEVADM;ADPVDVDPEVADMV;DPVDVDPEVADMVC;PVDVDPEVADMVCN;VDVDPEVADMVCNR;DVDPEVADMVCNRI;VDPEVADMVCNRII;DPEVADMVCNRIID;PEVADMVCNRIIDN;EVADMVCNRIIDNA;VADMVCNRIIDNAA;ADMVCNRIIDNAAV;DMVCNRIIDNAAVS;MVCNRIIDNAAVSA;VCNRIIDNAAVSAA;CNRIIDNAAVSAAS;NRIIDNAAVSAASM;RIIDNAAVSAASMV;IIDNAAVSAASMVR;IDNAAVSAASMVRR;DNAAVSAASMVRRP;NAAVSAASMVRRPV;AAVSAASMVRRPVT;AVSAASMVRRPVTV;VSAASMVRRPVTVA;SAASMVRRPVTVAR;AASMVRRPVTVARH;ASMVRRPVTVARHQ;SMVRRPVTVARHQA;MVRRPVTVARHQAL;VRRPVTVARHQALA;RRPVTVARHQALAH;RPVTVARHQALAHP;PVTVARHQALAHPV;VTVARHQALAHPVR;TVARHQALAHPVRH;VARHQALAHPVRHG;ARHQALAHPVRHGA;RHQALAHPVRHGAK;HQALAHPVRHGAKV;QALAHPVRHGAKVF;ALAHPVRHGAKVFG;LAHPVRHGAKVFGV;AHPVRHGAKVFGVE;HPVRHGAKVFGVEG;PVRHGAKVFGVEGS;VRHGAKVFGVEGSY;RHGAKVFGVEGSYS;HGAKVFGVEGSYSA;GAKVFGVEGSYSAD;AKVFGVEGSYSADW;KVFGVEGSYSADWA;VFGVEGSYSADWAA;FGVEGSYSADWAAW;GVEGSYSADWAAWA;VEGSYSADWAAWAN;EGSYSADWAAWANG;GSYSADWAAWANGV;SYSADWAAWANGVA;YSADWAAWANGVAA;SADWAAWANGVAAR;ADWAAWANGVAARE;DWAAWANGVAAREL;WAAWANGVAARELD;AAWANGVAARELDF;AWANGVAARELDFH;WANGVAARELDFHD;ANGVAARELDFHDT;NGVAARELDFHDTF;GVAARELDFHDTFL;VAARELDFHDTFLA;AARELDFHDTFLAA;ARELDFHDTFLAAD;RELDFHDTFLAADY;ELDFHDTFLAADYS;LDFHDTFLAADYSH;DFHDTFLAADYSHP;FHDTFLAADYSHPA;HDTFLAADYSHPAD;DTFLAADYSHPADN;TFLAADYSHPADNI;FLAADYSHPADNIP;LAADYSHPADNIPP;AADYSHPADNIPPL;ADYSHPADNIPPLV;DYSHPADNIPPLVA;YSHPADNIPPLVAV;SHPADNIPPLVAVA;HPADNIPPLVAVAQ;PADNIPPLVAVAQQ;ADNIPPLVAVAQQL;DNIPPLVAVAQQLG;NIPPLVAVAQQLGV;IPPLVAVAQQLGVC;PPLVAVAQQLGVCG;PLVAVAQQLGVCGA;LVAVAQQLGVCGAE;VAVAQQLGVCGAEL;AVAQQLGVCGAELI;VAQQLGVCGAELIR;AQQLGVCGAELIRG;QQLGVCGAELIRGL;QLGVCGAELIRGLV;LGVCGAELIRGLVT;GVCGAELIRGLVTA;VCGAELIRGLVTAY;CGAELIRGLVTAYE;GAELIRGLVTAYEI;AELIRGLVTAYEIH;ELIRGLVTAYEIHI;LIRGLVTAYEIHID;IRGLVTAYEIHIDL;RGLVTAYEIHIDLT;GLVTAYEIHIDLTR;LVTAYEIHIDLTRG;VTAYEIHIDLTRGI;TAYEIHIDLTRGIC;AYEIHIDLTRGICL;YEIHIDLTRGICLH;EIHIDLTRGICLHE;IHIDLTRGICLHEH;HIDLTRGICLHEHK;IDLTRGICLHEHKI;DLTRGICLHEHKID;LTRGICLHEHKIDH;TRGICLHEHKIDHV;RGICLHEHKIDHVA;GICLHEHKIDHVAH;ICLHEHKIDHVAHL;CLHEHKIDHVAHLG;LHEHKIDHVAHLGP;HEHKIDHVAHLGPA;EHKIDHVAHLGPAV;HKIDHVAHLGPAVA;KIDHVAHLGPAVAA;IDHVAHLGPAVAAG;DHVAHLGPAVAAGI;HVAHLGPAVAAGIG;VAHLGPAVAAGIGT;AH | |

Fig. 30 continued

| | | |
|---|---|---|
| | LGPAVAAGIGTM;HLGPAVAAGIGTML;LGPAVAAGIGTMLR;GPAVAAGIGTMLRL;PAVAAGIGTMLRLD;AVAAGIGTMLRLDQ;VAAGIGTMLRLDQE;AAGIGTMLRLDQET;AGIGTMLRLDQETI;GIGTMLRLDQETIY;IGTMLRLDQETIYH;GTMLRLDQETIYHA;TMLRLDQETIYHAI;MLRLDQETIYHAIG;LRLDQETIYHAIGQ;RLDQETIYHAIGQA;LDQETIYHAIGQAL;DQETIYHAIGQALH;QETIYHAIGQALHL;ETIYHAIGQALHLT;TIYHAIGQALHLTT;IYHAIGQALHLTTS;YHAIGQALHLTTST;HAIGQALHLTTSTR;AIGQALHLTTSTRQ;IGQALHLTTSTRQS;GQALHLTTSTRQSR;QALHLTTSTRQSRK;ALHLTTSTRQSRKG;LHLTTSTRQSRKGA;HLTTSTRQSRKGAI;LTTSTRQSRKGAIS;TTSTRQSRKGAISS;TSTRQSRKGAISSW;STRQSRKGAISSWK;TRQSRKGAISSWKA;RQSRKGAISSWKAF;QSRKGAISSWKAFA;SRKGAISSWKAFAP;RKGAISSWKAFAPA;KGAISSWKAFAPAH;GAISSWKAFAPAHA;AISSWKAFAPAHAG;ISSWKAFAPAHAGK;SSWKAFAPAHAGKV;SWKAFAPAHAGKVG;WKAFAPAHAGKVGI;KAFAPAHAGKVGIE;AFAPAHAGKVGIEA;FAPAHAGKVGIEAV;APAHAGKVGIEAVD;PAHAGKVGIEAVDR;AHAGKVGIEAVDRA;HAGKVGIEAVDRAM;AGKVGIEAVDRAMR;GKVGIEAVDRAMRG;KVGIEAVDRAMRGE;VGIEAVDRAMRGEG;GIEAVDRAMRGEGS;IEAVDRAMRGEGSP;EAVDRAMRGEGSPA;AVDRAMRGEGSPAP;VDRAMRGEGSPAPI;DRAMRGEGSPAPIW;RAMRGEGSPAPIWE;AMRGEGSPAPIWEG;MRGEGSPAPIWEGE;RGEGSPAPIWEGED;GEGSPAPIWEGEDG;EGSPAPIWEGEDGV;GSPAPIWEGEDGVI;SPAPIWEGEDGVIA;PAPIWEGEDGVIAW;APIWEGEDGVIAWL;PIWEGEDGVIAWLL;IWEGEDGVIAWLLA;WEGEDGVIAWLLAG;EGEDGVIAWLLAGP;GEDGVIAWLLAGPE;EDGVIAWLLAGPEH;DGVIAWLLAGPEHT;GVIAWLLAGPEHTY;VIAWLLAGPEHTYR;IAWLLAGPEHTYRV;AWLLAGPEHTYRVP;WLLAGPEHTYRVPL;LLAGPEHTYRVPLP;LAGPEHTYRVPLPA;AGPEHTYRVPLPAP;GPEHTYRVPLPAPG;PEHTYRVPLPAPGE;EHTYRVPLPAPGEP;HTYRVPLPAPGEPK;TYRVPLPAPGEPKR;YRVPLPAPGEPKRA;RVPLPAPGEPKRAI;VPLPAPGEPKRAIL;PLPAPGEPKRAILD;LPAPGEPKRAILDS;PAPGEPKRAILDSY;APGEPKRAILDSYT;PGEPKRAILDSYTK;GEPKRAILDSYTKQ;EPKRAILDSYTKQH;PKRAILDSYTKQHS;KRAILDSYTKQHSA;RAILDSYTKQHSAE;AILDSYTKQHSAEY;ILDSYTKQHSAEYQ;LDSYTKQHSAEYQS;DSYTKQHSAEYQSQ;SYTKQHSAEYQSQA;YTKQHSAEYQSQAP;TKQHSAEYQSQAPI;KQHSAEYQSQAPID;QHSAEYQSQAPIDL;HSAEYQSQAPIDLA;SAEYQSQAPIDLAC;AEYQSQAPIDLACR;EYQSQAPIDLACRL;YQSQAPIDLACRLR;QSQAPIDLACRLRE;SQAPIDLACRLRER;QAPIDLACRLRERI;APIDLACRLRERIG;PIDLACRLRERIGD;IDLACRLRERIGDL;DLACRLRERIGDLD;LACRLRERIGDLDQ;ACRLRERIGDLDQI;CRLRERIGDLDQIA;RLRERIGDLDQIAS;LRERIGDLDQIASI;RERIGDLDQIASIV;ERIGDLDQIASIVL;RIGDLDQIASIVLH;IGDLDQIASIVLHT;GDLDQIASIVLHTS;DLDQIASIVLHTSH;LDQIASIVLHTSHH;DQIASIVLHTSHHT;QIASIVLHTSHHTH;IASIVLHTSHHTHV;ASIVLHTSHHTHVV;SIVLHTSHHTHVVI;IVLHTSHHTHVVIG;VLHTSHHTHVVIGT;LHTSHHTHVVIGTG;HTSHHTHVVIGTGS;TSHHTHVVIGTGSG;SHHTHVVIGTGSGD;HHTHVVIGTGSGDP;HTHVVIGTGSGDPQ;THVVIGTGSGDPQK;HVVIGTGSGDPQKF;VVIGTGSGDPQKFD;VIGTGSGDPQKFDP;IGTGSGDPQKFDPD;GTGSGDPQKFDPDA;TGSGDPQKFDPDAS;GSGDPQKFDPDASR;SGDPQKFDPDASRE;GDPQKFDPDASRET;DPQKFDPDASRETL;PQKFDPDASRETLD;QKFDPDASRETLDH;KFDPDASRETLDHS;FDPDASRETLDHSL;DPDASRETLDHSLP;PDASRETLDHSLPY;DASRETLDHSLPYI;ASRETLDHSLPYIF;SRETLDHSLPYIFA;RETLDHSLPYIFAV;ETLDHSLPYIFAVA;TLDHSLPYIFAVAL;LDHSLPYIFAVALQ;DHSLPYIFAVALQD;HSLPYIFAVALQDG;SLPYIFAVALQDGC;LPYIFAVALQDGCW;PYIFAVALQDGCWH;YIFAVALQDGCWHH;IFAVALQDGCWHHE;FAVALQDGCWHHER;AVALQDGCWHHERS;VALQDGCWHHERSY;ALQDGCWHHERSYA;LQDGCW | |

Fig. 30 continued

| | | |
|---|---|---|
| | HHERSYAP;QDGCWHHERSYAPE;DGCWHHERSYAPER;GCWHHERSYAPERA;CWHHERSYAPERAR;WHHERSYAPERARR;HHERSYAPERARRS;HERSYAPERARRSD;ERSYAPERARRSDT;RSYAPERARRSDTV;SYAPERARRSDTVA;YAPERARRSDTVAL;APERARRSDTVALW;PERARRSDTVALWH;ERARRSDTVALWHK;RARRSDTVALWHKI;ARRSDTVALWHKIS;RRSDTVALWHKIST;RSDTVALWHKISTV;SDTVALWHKISTVE;DTVALWHKISTVED;TVALWHKISTVEDP;VALWHKISTVEDPE;ALWHKISTVEDPEW;LWHKISTVEDPEWT;WHKISTVEDPEWTR;HKISTVEDPEWTRR;KISTVEDPEWTRRY;ISTVEDPEWTRRYH;STVEDPEWTRRYHC;TVEDPEWTRRYHCA;VEDPEWTRRYHCAD;EDPEWTRRYHCADP;DPEWTRRYHCADPA;PEWTRRYHCADPAK;EWTRRYHCADPAKK;WTRRYHCADPAKKA;TRRYHCADPAKKAF;RRYHCADPAKKAFG;RYHCADPAKKAFGA;YHCADPAKKAFGAR;HCADPAKKAFGARA;CADPAKKAFGARAE;ADPAKKAFGARAEV;DPAKKAFGARAEVT;PAKKAFGARAEVTL;AKKAFGARAEVTLH;KKAFGARAEVTLHS;KAFGARAEVTLHSG;AFGARAEVTLHSGE;FGARAEVTLHSGEV;GARAEVTLHSGEVI;ARAEVTLHSGEVIV;RAEVTLHSGEVIVD;AEVTLHSGEVIVDE;EVTLHSGEVIVDEL;VTLHSGEVIVDELA;TLHSGEVIVDELAV;LHSGEVIVDELAVA;HSGEVIVDELAVAD;SGEVIVDELAVADA;GEVIVDELAVADAH;EVIVDELAVADAHP;VIVDELAVADAHPL;IVDELAVADAHPLG;VDELAVADAHPLGT;DELAVADAHPLGTR;ELAVADAHPLGTRP;LAVADAHPLGTRPF;AVADAHPLGTRPFE;VADAHPLGTRPFER;ADAHPLGTRPFERK;DAHPLGTRPFERKQ;AHPLGTRPFERKQY;HPLGTRPFERKQYV;PLGTRPFERKQYVE;LGTRPFERKQYVEK;GTRPFERKQYVEKF;TRPFERKQYVEKFT;RPFERKQYVEKFTE;PFERKQYVEKFTEL;FERKQYVEKFTELA;ERKQYVEKFTELAD;RKQYVEKFTELADG;KQYVEKFTELADGV;QYVEKFTELADGVV;YVEKFTELADGVVE;VEKFTELADGVVEP;EKFTELADGVVEPV;KFTELADGVVEPVE;FTELADGVVEPVEQ;TELADGVVEPVEQQ;ELADGVVEPVEQQR;LADGVVEPVEQQRF;ADGVVEPVEQQRFL;DGVVEPVEQQRFLA;GVVEPVEQQRFLAV;VVEPVEQQRFLAVV;VEPVEQQRFLAVVE;EPVEQQRFLAVVES;PVEQQRFLAVVESL;VEQQRFLAVVESLA;EQQRFLAVVESLAD;QQRFLAVVESLADL;QRFLAVVESLADLE;RFLAVVESLADLES;FLAVVESLADLESG;LAVVESLADLESGA;AVVESLADLESGAV;VVESLADLESGAVG;VESLADLESGAVGG;ESLADLESGAVGGL;SLADLESGAVGGLN;LADLESGAVGGLNV;ADLESGAVGGLNVL;DLESGAVGGLNVLV;LESGAVGGLNVLVD;ESGAVGGLNVLVDP;SGAVGGLNVLVDPR;GAVGGLNVLVDPRV;AVGGLNVLVDPRVL;VGGLNVLVDPRVLD;GGLNVLVDPRVLDK;GLNVLVDPRVLDKA;LNVLVDPRVLDKAP;NVLVDPRVLDKAPV;VLVDPRVLDKAPVI;LVDPRVLDKAPVIP;VDPRVLDKAPVIPP;DPRVLDKAPVIPPG;PRVLDKAPVIPPGI;RVLDKAPVIPPGIF;VLDKAPVIPPGIFR;<br>15 mers:<br>MPDQDTKVRFFRVFC;PDQDTKVRFFRVFCW;DQDTKVRFFRVFCWC;QDTKVRFFRVFCWCP;DTKVRFFRVFCWCPV;TKVRFFRVFCWCPVL;KVRFFRVFCWCPVLR;VRFFRVFCWCPVLRM;RFFRVFCWCPVLRMV;FFRVFCWCPVLRMVR;FRVFCWCPVLRMVRI;RVFCWCPVLRMVRIM;VFCWCPVLRMVRIML;FCWCPVLRMVRIMLM;CWCPVLRMVRIMLMH;WCPVLRMVRIMLMHA;CPVLRMVRIMLMHAV;PVLRMVRIMLMHAVR;VLRMVRIMLMHAVRA;LRMVRIMLMHAVRAW;RMVRIMLMHAVRAWR;MVRIMLMHAVRAWRS;VRIMLMHAVRAWRSA;RIMLMHAVRAWRSAD;IMLMHAVRAWRSADD;MLMHAVRAWRSADDF;LMHAVRAWRSADDFP;MHAVRAWRSADDFPC;HAVRAWRSADDFPCT;AVRAWRSADDFPCTE;VRAWRSADDFPCTEH;RAWRSADDFPCTEHM;AWRSADDFPCTEHMA;WRSADDFPCTEHMAY;RSADDFPCTEHMAYK;SADDFPCTEHMAYKI;ADDFPCTEHMAYKIA;DDFPCTEHMAYKIAQ;DFPCTEHMAYKIAQV;FPCTEHMAYKIAQVA;PCTEHMAYKIAQVAA;CTE | |

Fig. 30 continued

| | | |
|---|---|---|
| | HMAYKIAQVAAD;TEHMAYKIAQVAADP;EHMAYKIAQVAADPV;HMAYKIAQVAADPVD;MAYKIAQVAADPVDV;AYKIAQVAADPVDVD;YKIAQVAADPVDVDP;KIAQVAADPVDVDPE;IAQVAADPVDVDPEV;AQVAADPVDVDPEVA;QVAADPVDVDPEVAD;VAADPVDVDPEVADM;AADPVDVDPEVADMV;ADPVDVDPEVADMVC;DPVDVDPEVADMVCN;PVDVDPEVADMVCNR;VDVDPEVADMVCNRI;DVDPEVADMVCNRII;VDPEVADMVCNRIID;DPEVADMVCNRIIDN;PEVADMVCNRIIDNA;EVADMVCNRIIDNAA;VADMVCNRIIDNAAV;ADMVCNRIIDNAAVS;DMVCNRIIDNAAVSA;MVCNRIIDNAAVSAA;VCNRIIDNAAVSAAS;CNRIIDNAAVSAASM;NRIIDNAAVSAASMV;RIIDNAAVSAASMVR;IIDNAAVSAASMVRR;IDNAAVSAASMVRRP;DNAAVSAASMVRRPV;NAAVSAASMVRRPVT;AAVSAASMVRRPVTV;AVSAASMVRRPVTVA;VSAASMVRRPVTVAR;SAASMVRRPVTVARH;AASMVRRPVTVARHQ;ASMVRRPVTVARHQA;SMVRRPVTVARHQAL;MVRRPVTVARHQALA;VRRPVTVARHQALAH;RRPVTVARHQALAHP;RPVTVARHQALAHPV;PVTVARHQALAHPVR;VTVARHQALAHPVRH;TVARHQALAHPVRHG;VARHQALAHPVRHGA;ARHQALAHPVRHGAK;RHQALAHPVRHGAKV;HQALAHPVRHGAKVF;QALAHPVRHGAKVFG;ALAHPVRHGAKVFGV;LAHPVRHGAKVFGVE;AHPVRHGAKVFGVEG;HPVRHGAKVFGVEGS;PVRHGAKVFGVEGSY;VRHGAKVFGVEGSYS;RHGAKVFGVEGSYSA;HGAKVFGVEGSYSAD;GAKVFGVEGSYSADW;AKVFGVEGSYSADWA;KVFGVEGSYSADWAA;VFGVEGSYSADWAAW;FGVEGSYSADWAAWA;GVEGSYSADWAAWAN;VEGSYSADWAAWANG;EGSYSADWAAWANGV;GSYSADWAAWANGVA;SYSADWAAWANGVAA;YSADWAAWANGVAAR;SADWAAWANGVAARE;ADWAAWANGVAAREL;DWAAWANGVAARELD;WAAWANGVAARELDF;AAWANGVAARELDFH;AWANGVAARELDFHD;WANGVAARELDFHDT;ANGVAARELDFHDTF;NGVAARELDFHDTFL;GVAARELDFHDTFLA;VAARELDFHDTFLAA;AARELDFHDTFLAAD;ARELDFHDTFLAADY;RELDFHDTFLAADYS;ELDFHDTFLAADYSH;LDFHDTFLAADYSHP;DFHDTFLAADYSHPA;FHDTFLAADYSHPAD;HDTFLAADYSHPADN;DTFLAADYSHPADNI;TFLAADYSHPADNIP;FLAADYSHPADNIPP;LAADYSHPADNIPPL;AADYSHPADNIPPLV;ADYSHPADNIPPLVA;DYSHPADNIPPLVAV;YSHPADNIPPLVAVA;SHPADNIPPLVAVAQ;HPADNIPPLVAVAQQ;PADNIPPLVAVAQQL;ADNIPPLVAVAQQLG;DNIPPLVAVAQQLGV;NIPPLVAVAQQLGVC;IPPLVAVAQQLGVCG;PPLVAVAQQLGVCGA;PLVAVAQQLGVCGAE;LVAVAQQLGVCGAEL;VAVAQQLGVCGAELI;AVAQQLGVCGAELIR;VAQQLGVCGAELIRG;AQQLGVCGAELIRGL;QQLGVCGAELIRGLV;QLGVCGAELIRGLVT;LGVCGAELIRGLVTA;GVCGAELIRGLVTAY;VCGAELIRGLVTAYE;CGAELIRGLVTAYEI;GAELIRGLVTAYEIH;AELIRGLVTAYEIHI;ELIRGLVTAYEIHID;LIRGLVTAYEIHIDL;IRGLVTAYEIHIDLT;RGLVTAYEIHIDLTR;GLVTAYEIHIDLTRG;LVTAYEIHIDLTRGI;VTAYEIHIDLTRGIC;TAYEIHIDLTRGICL;AYEIHIDLTRGICLH;YEIHIDLTRGICLHE;EIHIDLTRGICLHEH;IHIDLTRGICLHEHK;HIDLTRGICLHEHKI;IDLTRGICLHEHKID;DLTRGICLHEHKIDH;LTRGICLHEHKIDHV;TRGICLHEHKIDHVA;RGICLHEHKIDHVAH;GICLHEHKIDHVAHL;ICLHEHKIDHVAHLG;CLHEHKIDHVAHLGP;LHEHKIDHVAHLGPA;HEHKIDHVAHLGPAV;EHKIDHVAHLGPAVA;HKIDHVAHLGPAVAA;KIDHVAHLGPAVAAG;IDHVAHLGPAVAAGI;DHVAHLGPAVAAGIG;HVAHLGPAVAAGIGT;VAHLGPAVAAGIGTM;AHLGPAVAAGIGTML;HLGPAVAAGIGTMLR;LGPAVAAGIGTMLRL;GPAVAAGIGTMLRLD;PAVAAGIGTMLRLDQ;AVAAGIGTMLRLDQE;VAAGIGTMLRLDQET;AAGIGTMLRLDQETI;AGIGTMLRLDQETIY;GIGTMLRLDQETIYH;IGTMLRLDQETIYHA;GTMLRLDQETIYHAI;TMLRLDQETIYHAIG;MLRLDQETIYHAIGQ;LRLDQETIYHAIGQA;RLDQETIYHAIGQAL;LDQETIYHAIGQALH;DQETIYHAIGQALHL;QETIYHAIGQALHLT;ETIYHAIGQALHLTT;TIYHAIGQALHLTTS;IYHAIGQALHLTTST;YHAIGQALHLTTSTR;HAIGQALHLTTSTRQ;AIGQALHLT | |

Fig. 30 continued

| | | |
|---|---|---|
| | TSTRQS;IGQALHLTTSTRQSR;GQALHLTTSTRQSRK;QALHLTTSTRQSRKG;ALHLTTSTRQSRKGA;LHLTTSTRQSRKGAI;HLTTSTRQSRKGAIS;LTTSTRQSRKGAISS;TTSTRQSRKGAISSW;TSTRQSRKGAISSWK;STRQSRKGAISSWKA;TRQSRKGAISSWKAF;RQSRKGAISSWKAFA;QSRKGAISSWKAFAP;SRKGAISSWKAFAPA;RKGAISSWKAFAPAH;KGAISSWKAFAPAHA;GAISSWKAFAPAHAG;AISSWKAFAPAHAGK;ISSWKAFAPAHAGKV;SSWKAFAPAHAGKVG;SWKAFAPAHAGKVGI;WKAFAPAHAGKVGIE;KAFAPAHAGKVGIEA;AFAPAHAGKVGIEAV;FAPAHAGKVGIEAVD;APAHAGKVGIEAVDR;PAHAGKVGIEAVDRA;AHAGKVGIEAVDRAM;HAGKVGIEAVDRAMR;AGKVGIEAVDRAMRG;GKVGIEAVDRAMRGE;KVGIEAVDRAMRGEG;VGIEAVDRAMRGEGS;GIEAVDRAMRGEGSP;IEAVDRAMRGEGSPA;EAVDRAMRGEGSPAP;AVDRAMRGEGSPAPI;VDRAMRGEGSPAPIW;DRAMRGEGSPAPIWE;RAMRGEGSPAPIWEG;AMRGEGSPAPIWEGE;MRGEGSPAPIWEGED;RGEGSPAPIWEGEDG;GEGSPAPIWEGEDGV;EGSPAPIWEGEDGVI;GSPAPIWEGEDGVIA;SPAPIWEGEDGVIAW;PAPIWEGEDGVIAWL;APIWEGEDGVIAWLL;PIWEGEDGVIAWLLA;IWEGEDGVIAWLLAG;WEGEDGVIAWLLAGP;EGEDGVIAWLLAGPE;GEDGVIAWLLAGPEH;EDGVIAWLLAGPEHT;DGVIAWLLAGPEHTY;GVIAWLLAGPEHTYR;VIAWLLAGPEHTYRV;IAWLLAGPEHTYRVP;AWLLAGPEHTYRVPL;WLLAGPEHTYRVPLP;LLAGPEHTYRVPLPA;LAGPEHTYRVPLPAP;AGPEHTYRVPLPAPG;GPEHTYRVPLPAPGE;PEHTYRVPLPAPGEP;EHTYRVPLPAPGEPK;HTYRVPLPAPGEPKR;TYRVPLPAPGEPKRA;YRVPLPAPGEPKRAI;RVPLPAPGEPKRAIL;VPLPAPGEPKRAILD;PLPAPGEPKRAILDS;LPAPGEPKRAILDSY;PAPGEPKRAILDSYT;APGEPKRAILDSYTK;PGEPKRAILDSYTKQ;GEPKRAILDSYTKQH;EPKRAILDSYTKQHS;PKRAILDSYTKQHSA;KRAILDSYTKQHSAE;RAILDSYTKQHSAEY;AILDSYTKQHSAEYQ;ILDSYTKQHSAEYQS;LDSYTKQHSAEYQSQ;DSYTKQHSAEYQSQA;SYTKQHSAEYQSQAP;YTKQHSAEYQSQAPI;TKQHSAEYQSQAPID;KQHSAEYQSQAPIDL;QHSAEYQSQAPIDLA;HSAEYQSQAPIDLAC;SAEYQSQAPIDLACR;AEYQSQAPIDLACRL;EYQSQAPIDLACRLR;YQSQAPIDLACRLRE;QSQAPIDLACRLRER;SQAPIDLACRLRERI;QAPIDLACRLRERIG;APIDLACRLRERIGD;PIDLACRLRERIGDL;IDLACRLRERIGDLD;DLACRLRERIGDLDQ;LACRLRERIGDLDQI;ACRLRERIGDLDQIA;CRLRERIGDLDQIAS;RLRERIGDLDQIASI;LRERIGDLDQIASIV;RERIGDLDQIASIVL;ERIGDLDQIASIVLH;RIGDLDQIASIVLHT;IGDLDQIASIVLHTS;GDLDQIASIVLHTSH;DLDQIASIVLHTSHH;LDQIASIVLHTSHHT;DQIASIVLHTSHHTH;QIASIVLHTSHHTHV;IASIVLHTSHHTHVV;ASIVLHTSHHTHVVI;SIVLHTSHHTHVVIG;IVLHTSHHTHVVIGT;VLHTSHHTHVVIGTG;LHTSHHTHVVIGTGS;HTSHHTHVVIGTGSG;TSHHTHVVIGTGSGD;SHHTHVVIGTGSGDP;HHTHVVIGTGSGDPQ;HTHVVIGTGSGDPQK;THVVIGTGSGDPQKF;HVVIGTGSGDPQKFD;VVIGTGSGDPQKFDP;VIGTGSGDPQKFDPD;IGTGSGDPQKFDPDA;GTGSGDPQKFDPDAS;TGSGDPQKFDPDASR;GSGDPQKFDPDASRE;SGDPQKFDPDASRET;GDPQKFDPDASRETL;DPQKFDPDASRETLD;PQKFDPDASRETLDH;QKFDPDASRETLDHS;KFDPDASRETLDHSL;FDPDASRETLDHSLP;DPDASRETLDHSLPY;PDASRETLDHSLPYI;DASRETLDHSLPYIF;ASRETLDHSLPYIFA;SRETLDHSLPYIFAV;RETLDHSLPYIFAVA;ETLDHSLPYIFAVAL;TLDHSLPYIFAVALQ;LDHSLPYIFAVALQD;DHSLPYIFAVALQDG;HSLPYIFAVALQDGC;SLPYIFAVALQDGCW;LPYIFAVALQDGCWH;PYIFAVALQDGCWHH;YIFAVALQDGCWHHE;IFAVALQDGCWHHER;FAVALQDGCWHHERS;AVALQDGCWHHERSY;VALQDGCWHHERSYA;ALQDGCWHHERSYAP;LQDGCWHHERSYAPE;QDGCWHHERSYAPER;DGCWHHERSYAPERA;GCWHHERSYAPERAR;CWHHERSYAPERARR;WHHERSYAPERARRS;HHERSYAPERARRSD;HERSYAPERARRSDT;ERSYAPERARRSDTV;RSYAPERARRSDTVA;SYAPERARRSDTVAL;YAPERA | |

Fig. 30 continued

| | | |
|---|---|---|
| | RRSDTVALW;APERARRSDTVALWH;PERARRSDTVALWHK;ERARRSDTVALWHKI;RARRSDTVALWHKIS;ARRSDTVALWHKIST;RRSDTVALWHKISTV;RSDTVALWHKISTVE;SDTVALWHKISTVED;DTVALWHKISTVEDP;TVALWHKISTVEDPE;VALWHKISTVEDPEW;ALWHKISTVEDPEWT;LWHKISTVEDPEWTR;WHKISTVEDPEWTRR;HKISTVEDPEWTRRY;KISTVEDPEWTRRYH;ISTVEDPEWTRRYHC;STVEDPEWTRRYHCA;TVEDPEWTRRYHCAD;VEDPEWTRRYHCADP;EDPEWTRRYHCADPA;DPEWTRRYHCADPAK;PEWTRRYHCADPAKK;EWTRRYHCADPAKKA;WTRRYHCADPAKKAF;TRRYHCADPAKKAFG;RRYHCADPAKKAFGA;RYHCADPAKKAFGAR;YHCADPAKKAFGARA;HCADPAKKAFGARAE;CADPAKKAFGARAEV;ADPAKKAFGARAEVT;DPAKKAFGARAEVTL;PAKKAFGARAEVTLH;AKKAFGARAEVTLHS;KKAFGARAEVTLHSG;KAFGARAEVTLHSGE;AFGARAEVTLHSGEV;FGARAEVTLHSGEVI;GARAEVTLHSGEVIV;ARAEVTLHSGEVIVD;RAEVTLHSGEVIVDE;AEVTLHSGEVIVDEL;EVTLHSGEVIVDELA;VTLHSGEVIVDELAV;TLHSGEVIVDELAVA;LHSGEVIVDELAVAD;HSGEVIVDELAVADA;SGEVIVDELAVADAH;GEVIVDELAVADAHP;EVIVDELAVADAHPL;VIVDELAVADAHPLG;IVDELAVADAHPLGT;VDELAVADAHPLGTR;DELAVADAHPLGTRP;ELAVADAHPLGTRPF;LAVADAHPLGTRPFE;AVADAHPLGTRPFER;VADAHPLGTRPFERK;ADAHPLGTRPFERKQ;DAHPLGTRPFERKQY;AHPLGTRPFERKQYV;HPLGTRPFERKQYVE;PLGTRPFERKQYVEK;LGTRPFERKQYVEKF;GTRPFERKQYVEKFT;TRPFERKQYVEKFTE;RPFERKQYVEKFTEL;PFERKQYVEKFTELA;FERKQYVEKFTELAD;ERKQYVEKFTELADG;RKQYVEKFTELADGV;KQYVEKFTELADGVV;QYVEKFTELADGVVE;YVEKFTELADGVVEP;VEKFTELADGVVEPV;EKFTELADGVVEPVE;KFTELADGVVEPVEQ;FTELADGVVEPVEQQ;TELADGVVEPVEQQR;ELADGVVEPVEQQRF;LADGVVEPVEQQRFL;ADGVVEPVEQQRFLA;DGVVEPVEQQRFLAV;GVVEPVEQQRFLAVV;VVEPVEQQRFLAVVE;VEPVEQQRFLAVVES;EPVEQQRFLAVVESL;PVEQQRFLAVVESLA;VEQQRFLAVVESLAD;EQQRFLAVVESLADL;QQRFLAVVESLADLE;QRFLAVVESLADLES;RFLAVVESLADLESG;FLAVVESLADLESGA;LAVVESLADLESGAV;AVVESLADLESGAVG;VVESLADLESGAVGG;VESLADLESGAVGGL;ESLADLESGAVGGLN;SLADLESGAVGGLNV;LADLESGAVGGLNVL;ADLESGAVGGLNVLV;DLESGAVGGLNVLVD;LESGAVGGLNVLVDP;ESGAVGGLNVLVDPR;SGAVGGLNVLVDPRV;GAVGGLNVLVDPRVL;AVGGLNVLVDPRVLD;VGGLNVLVDPRVLDK;GGLNVLVDPRVLDKA;GLNVLVDPRVLDKAP;LNVLVDPRVLDKAPV;NVLVDPRVLDKAPVI;VLVDPRVLDKAPVIP;LVDPRVLDKAPVIPP;VDPRVLDKAPVIPPG;DPRVLDKAPVIPPGI;PRVLDKAPVIPPGIF;RVLDKAPVIPPGIFR;<br>16 mers:<br>MPDQDTKVRFFRVFCW;PDQDTKVRFFRVFCWC;DQDTKVRFFRVFCWCP;QDTKVRFFRVFCWCPV;DTKVRFFRVFCWCPVL;TKVRFFRVFCWCPVLR;KVRFFRVFCWCPVLRM;VRFFRVFCWCPVLRMV;RFFRVFCWCPVLRMVR;FFRVFCWCPVLRMVRI;FRVFCWCPVLRMVRIM;RVFCWCPVLRMVRIML;VFCWCPVLRMVRIMLM;FCWCPVLRMVRIMLMH;CWCPVLRMVRIMLMHA;WCPVLRMVRIMLMHAV;CPVLRMVRIMLMHAVR;PVLRMVRIMLMHAVRA;VLRMVRIMLMHAVRAW;LRMVRIMLMHAVRAWR;RMVRIMLMHAVRAWRS;MVRIMLMHAVRAWRSA;VRIMLMHAVRAWRSAD;RIMLMHAVRAWRSADD;IMLMHAVRAWRSADDF;MLMHAVRAWRSADDFP;LMHAVRAWRSADDFPC;MHAVRAWRSADDFPCT;HAVRAWRSADDFPCTE;AVRAWRSADDFPCTEH;VRAWRSADDFPCTEHM;RAWRSADDFPCTEHMA;AWRSADDFPCTEHMAY;WRSADDFPCTEHMAYK;RSADDFPCTEHMAYKI;SADDFPCTEHMAYKIA;ADDFPCTEHMAYKIAQ;DDFPCTEHMAYKIAQV;DFPCTEHMAYKIAQVA;FPCTEHMAYKIAQVAA;PCTEHMAYKIAQVAAD;CTEHMAYKIAQVAADP;TEHMAYKIAQVAADPV;EHMAYKIAQVAADPVD;HMAYKIAQVAADP | |

Fig. 30 continued

| | | |
|---|---|---|
| | VDV;MAYKIAQVAADPVDVD;AYKIAQVAADPVDVDP;YKIAQVAADPVDVDPE;KIAQVAADPVDVDPEV;IAQVAADPVDVDPEVA;AQVAADPVDVDPEVAD;QVAADPVDVDPEVADM;VAADPVDVDPEVADMV;AADPVDVDPEVADMVC;ADPVDVDPEVADMVCN;DPVDVDPEVADMVCNR;PVDVDPEVADMVCNRI;VDVDPEVADMVCNRII;DVDPEVADMVCNRIID;VDPEVADMVCNRIIDN;DPEVADMVCNRIIDNA;PEVADMVCNRIIDNAA;EVADMVCNRIIDNAAV;VADMVCNRIIDNAAVS;ADMVCNRIIDNAAVSA;DMVCNRIIDNAAVSAA;MVCNRIIDNAAVSAAS;VCNRIIDNAAVSAASM;CNRIIDNAAVSAASMV;NRIIDNAAVSAASMVR;RIIDNAAVSAASMVRR;IIDNAAVSAASMVRRP;IDNAAVSAASMVRRPV;DNAAVSAASMVRRPVT;NAAVSAASMVRRPVTV;AAVSAASMVRRPVTVA;AVSAASMVRRPVTVAR;VSAASMVRRPVTVARH;SAASMVRRPVTVARHQ;AASMVRRPVTVARHQA;ASMVRRPVTVARHQAL;SMVRRPVTVARHQALA;MVRRPVTVARHQALAH;VRRPVTVARHQALAHP;RRPVTVARHQALAHPV;RPVTVARHQALAHPVR;PVTVARHQALAHPVRH;VTVARHQALAHPVRHG;TVARHQALAHPVRHGA;VARHQALAHPVRHGAK;ARHQALAHPVRHGAKV;RHQALAHPVRHGAKVF;HQALAHPVRHGAKVFG;QALAHPVRHGAKVFGV;ALAHPVRHGAKVFGVE;LAHPVRHGAKVFGVEG;AHPVRHGAKVFGVEGS;HPVRHGAKVFGVEGSY;PVRHGAKVFGVEGSYS;VRHGAKVFGVEGSYSA;RHGAKVFGVEGSYSAD;HGAKVFGVEGSYSADW;GAKVFGVEGSYSADWA;AKVFGVEGSYSADWAA;KVFGVEGSYSADWAAW;VFGVEGSYSADWAAWA;FGVEGSYSADWAAWAN;GVEGSYSADWAAWANG;VEGSYSADWAAWANGV;EGSYSADWAAWANGVA;GSYSADWAAWANGVAA;SYSADWAAWANGVAAR;YSADWAAWANGVAARE;SADWAAWANGVAAREL;ADWAAWANGVAARELD;DWAAWANGVAARELDF;WAAWANGVAARELDFH;AAWANGVAARELDFHD;AWANGVAARELDFHDT;WANGVAARELDFHDTF;ANGVAARELDFHDTFL;NGVAARELDFHDTFLA;GVAARELDFHDTFLAA;VAARELDFHDTFLAAD;AARELDFHDTFLAADY;ARELDFHDTFLAADYS;RELDFHDTFLAADYSH;ELDFHDTFLAADYSHP;LDFHDTFLAADYSHPA;DFHDTFLAADYSHPAD;FHDTFLAADYSHPADN;HDTFLAADYSHPADNI;DTFLAADYSHPADNIP;TFLAADYSHPADNIPP;FLAADYSHPADNIPPL;LAADYSHPADNIPPLV;AADYSHPADNIPPLVA;ADYSHPADNIPPLVAV;DYSHPADNIPPLVAVA;YSHPADNIPPLVAVAQ;SHPADNIPPLVAVAQQ;HPADNIPPLVAVAQQL;PADNIPPLVAVAQQLG;ADNIPPLVAVAQQLGV;DNIPPLVAVAQQLGVC;NIPPLVAVAQQLGVCG;IPPLVAVAQQLGVCGA;PPLVAVAQQLGVCGAE;PLVAVAQQLGVCGAEL;LVAVAQQLGVCGAELI;VAVAQQLGVCGAELIR;AVAQQLGVCGAELIRG;VAQQLGVCGAELIRGL;AQQLGVCGAELIRGLV;QQLGVCGAELIRGLVT;QLGVCGAELIRGLVTA;LGVCGAELIRGLVTAY;GVCGAELIRGLVTAYE;VCGAELIRGLVTAYEI;CGAELIRGLVTAYEIH;GAELIRGLVTAYEIHI;AELIRGLVTAYEIHID;ELIRGLVTAYEIHIDL;LIRGLVTAYEIHIDLT;IRGLVTAYEIHIDLTR;RGLVTAYEIHIDLTRG;GLVTAYEIHIDLTRGI;LVTAYEIHIDLTRGIC;VTAYEIHIDLTRGICL;TAYEIHIDLTRGICLH;AYEIHIDLTRGICLHE;YEIHIDLTRGICLHEH;EIHIDLTRGICLHEHK;IHIDLTRGICLHEHKI;HIDLTRGICLHEHKID;IDLTRGICLHEHKIDH;DLTRGICLHEHKIDHV;LTRGICLHEHKIDHVA;TRGICLHEHKIDHVAH;RGICLHEHKIDHVAHL;GICLHEHKIDHVAHLG;ICLHEHKIDHVAHLGP;CLHEHKIDHVAHLGPA;LHEHKIDHVAHLGPAV;HEHKIDHVAHLGPAVA;EHKIDHVAHLGPAVAA;HKIDHVAHLGPAVAAG;KIDHVAHLGPAVAAGI;IDHVAHLGPAVAAGIG;DHVAHLGPAVAAGIGT;HVAHLGPAVAAGIGTM;VAHLGPAVAAGIGTML;AHLGPAVAAGIGTMLR;HLGPAVAAGIGTMLRL;LGPAVAAGIGTMLRLD;GPAVAAGIGTMLRLDQ;PAVAAGIGTMLRLDQE;AVAAGIGTMLRLDQET;VAAGIGTMLRLDQETI;AAGIGTMLRLDQETIY;AGIGTMLRLDQETIYH;GIGTMLRLDQETIYHA;IGTMLRLDQETIYHAI;GTMLRLDQETIYHAIG;TMLRLDQETIYHAIGQ;MLRLDQETIYHAIGQA;LRLDQETIYHAIGQAL;RLDQETIYHAIGQALH;LDQETIYHAIGQALHL;DQE | |

Fig. 30 continued

| | | |
|---|---|---|
| | TIYHAIGQALHLT;QETIYHAIGQALHLTT;ETIYHAIGQALHLTTS;TIYHAIGQALHLTTST;IYHAIGQALHLTTSTR;YHAIGQALHLTTSTRQ;HAIGQALHLTTSTRQS;AIGQALHLTTSTRQSR;IGQALHLTTSTRQSRK;GQALHLTTSTRQSRKG;QALHLTTSTRQSRKGA;ALHLTTSTRQSRKGAI;LHLTTSTRQSRKGAIS;HLTTSTRQSRKGAISS;LTTSTRQSRKGAISSW;TTSTRQSRKGAISSWK;TSTRQSRKGAISSWKA;STRQSRKGAISSWKAF;TRQSRKGAISSWKAFA;RQSRKGAISSWKAFAP;QSRKGAISSWKAFAPA;SRKGAISSWKAFAPAH;RKGAISSWKAFAPAHA;KGAISSWKAFAPAHAG;GAISSWKAFAPAHAGK;AISSWKAFAPAHAGKV;ISSWKAFAPAHAGKVG;SSWKAFAPAHAGKVGI;SWKAFAPAHAGKVGIE;WKAFAPAHAGKVGIEA;KAFAPAHAGKVGIEAV;AFAPAHAGKVGIEAVD;FAPAHAGKVGIEAVDR;APAHAGKVGIEAVDRA;PAHAGKVGIEAVDRAM;AHAGKVGIEAVDRAMR;HAGKVGIEAVDRAMRG;AGKVGIEAVDRAMRGE;GKVGIEAVDRAMRGEG;KVGIEAVDRAMRGEGS;VGIEAVDRAMRGEGSP;GIEAVDRAMRGEGSPA;IEAVDRAMRGEGSPAP;EAVDRAMRGEGSPAPI;AVDRAMRGEGSPAPIW;VDRAMRGEGSPAPIWE;DRAMRGEGSPAPIWEG;RAMRGEGSPAPIWEGE;AMRGEGSPAPIWEGED;MRGEGSPAPIWEGEDG;RGEGSPAPIWEGEDGV;GEGSPAPIWEGEDGVI;EGSPAPIWEGEDGVIA;GSPAPIWEGEDGVIAW;SPAPIWEGEDGVIAWL;PAPIWEGEDGVIAWLL;APIWEGEDGVIAWLLA;PIWEGEDGVIAWLLAG;IWEGEDGVIAWLLAGP;WEGEDGVIAWLLAGPE;EGEDGVIAWLLAGPEH;GEDGVIAWLLAGPEHT;EDGVIAWLLAGPEHTY;DGVIAWLLAGPEHTYR;GVIAWLLAGPEHTYRV;VIAWLLAGPEHTYRVP;IAWLLAGPEHTYRVPL;AWLLAGPEHTYRVPLP;WLLAGPEHTYRVPLPA;LLAGPEHTYRVPLPAP;LAGPEHTYRVPLPAPG;AGPEHTYRVPLPAPGE;GPEHTYRVPLPAPGEP;PEHTYRVPLPAPGEPK;EHTYRVPLPAPGEPKR;HTYRVPLPAPGEPKRA;TYRVPLPAPGEPKRAI;YRVPLPAPGEPKRAIL;RVPLPAPGEPKRAILD;VPLPAPGEPKRAILDS;PLPAPGEPKRAILDSY;LPAPGEPKRAILDSYT;PAPGEPKRAILDSYTK;APGEPKRAILDSYTKQ;PGEPKRAILDSYTKQH;GEPKRAILDSYTKQHS;EPKRAILDSYTKQHSA;PKRAILDSYTKQHSAE;KRAILDSYTKQHSAEY;RAILDSYTKQHSAEYQ;AILDSYTKQHSAEYQS;ILDSYTKQHSAEYQSQ;LDSYTKQHSAEYQSQA;DSYTKQHSAEYQSQAP;SYTKQHSAEYQSQAPI;YTKQHSAEYQSQAPID;TKQHSAEYQSQAPIDL;KQHSAEYQSQAPIDLA;QHSAEYQSQAPIDLAC;HSAEYQSQAPIDLACR;SAEYQSQAPIDLACRL;AEYQSQAPIDLACRLR;EYQSQAPIDLACRLRE;YQSQAPIDLACRLRER;QSQAPIDLACRLRERI;SQAPIDLACRLRERIG;QAPIDLACRLRERIGD;APIDLACRLRERIGDL;PIDLACRLRERIGDLD;IDLACRLRERIGDLDQ;DLACRLRERIGDLDQI;LACRLRERIGDLDQIA;ACRLRERIGDLDQIAS;CRLRERIGDLDQIASI;RLRERIGDLDQIASIV;LRERIGDLDQIASIVL;RERIGDLDQIASIVLH;ERIGDLDQIASIVLHT;RIGDLDQIASIVLHTS;IGDLDQIASIVLHTSH;GDLDQIASIVLHTSHH;DLDQIASIVLHTSHHT;LDQIASIVLHTSHHTH;DQIASIVLHTSHHTHV;QIASIVLHTSHHTHVV;IASIVLHTSHHTHVVI;ASIVLHTSHHTHVVIG;SIVLHTSHHTHVVIGT;IVLHTSHHTHVVIGTG;VLHTSHHTHVVIGTGS;LHTSHHTHVVIGTGSG;HTSHHTHVVIGTGSGD;TSHHTHVVIGTGSGDP;SHHTHVVIGTGSGDPQ;HHTHVVIGTGSGDPQK;HTHVVIGTGSGDPQKF;THVVIGTGSGDPQKFD;HVVIGTGSGDPQKFDP;VVIGTGSGDPQKFDPD;VIGTGSGDPQKFDPDA;IGTGSGDPQKFDPDAS;GTGSGDPQKFDPDASR;TGSGDPQKFDPDASRE;GSGDPQKFDPDASRET;SGDPQKFDPDASRETL;GDPQKFDPDASRETLD;DPQKFDPDASRETLDH;PQKFDPDASRETLDHS;QKFDPDASRETLDHSL;KFDPDASRETLDHSLP;FDPDASRETLDHSLPY;DPDASRETLDHSLPYI;PDASRETLDHSLPYIF;DASRETLDHSLPYIFA;ASRETLDHSLPYIFAV;SRETLDHSLPYIFAVA;RETLDHSLPYIFAVAL;ETLDHSLPYIFAVALQ;TLDHSLPYIFAVALQD;LDHSLPYIFAVALQDG;DHSLPYIFAVALQDGC;HSLPYIFAVALQDGCW;SLPYIFAVALQDGCWH;LPYIFAVALQDGCWHH;PYIFAVALQDGCWHHE;YIFAVAL | |

Fig. 30 continued

| | | |
|---|---|---|
| | QDGCWHHER;IFAVALQDGCWHHERS;FAVALQDGCWHHERSY;AVALQDGCWHHERSYA;VALQDGCWHHERSYAP;ALQDGCWHHERSYAPE;LQDGCWHHERSYAPER;QDGCWHHERSYAPERA;DGCWHHERSYAPERAR;GCWHHERSYAPERARR;CWHHERSYAPERARRS;WHHERSYAPERARRSD;HHERSYAPERARRSDT;HERSYAPERARRSDTV;ERSYAPERARRSDTVA;RSYAPERARRSDTVAL;SYAPERARRSDTVALW;YAPERARRSDTVALWH;APERARRSDTVALWHK;PERARRSDTVALWHKI;ERARRSDTVALWHKIS;RARRSDTVALWHKIST;ARRSDTVALWHKISTV;RRSDTVALWHKISTVE;RSDTVALWHKISTVED;SDTVALWHKISTVEDP;DTVALWHKISTVEDPE;TVALWHKISTVEDPEW;VALWHKISTVEDPEWT;ALWHKISTVEDPEWTR;LWHKISTVEDPEWTRR;WHKISTVEDPEWTRRY;HKISTVEDPEWTRRYH;KISTVEDPEWTRRYHC;ISTVEDPEWTRRYHCA;STVEDPEWTRRYHCAD;TVEDPEWTRRYHCADP;VEDPEWTRRYHCADPA;EDPEWTRRYHCADPAK;DPEWTRRYHCADPAKK;PEWTRRYHCADPAKKA;EWTRRYHCADPAKKAF;WTRRYHCADPAKKAFG;TRRYHCADPAKKAFGA;RRYHCADPAKKAFGAR;RYHCADPAKKAFGARA;YHCADPAKKAFGARAE;HCADPAKKAFGARAEV;CADPAKKAFGARAEVT;ADPAKKAFGARAEVTL;DPAKKAFGARAEVTLH;PAKKAFGARAEVTLHS;AKKAFGARAEVTLHSG;KKAFGARAEVTLHSGE;KAFGARAEVTLHSGEV;AFGARAEVTLHSGEVI;FGARAEVTLHSGEVIV;GARAEVTLHSGEVIVD;ARAEVTLHSGEVIVDE;RAEVTLHSGEVIVDEL;AEVTLHSGEVIVDELA;EVTLHSGEVIVDELAV;VTLHSGEVIVDELAVA;TLHSGEVIVDELAVAD;LHSGEVIVDELAVADA;HSGEVIVDELAVADAH;SGEVIVDELAVADAHP;GEVIVDELAVADAHPL;EVIVDELAVADAHPLG;VIVDELAVADAHPLGT;IVDELAVADAHPLGTR;VDELAVADAHPLGTRP;DELAVADAHPLGTRPF;ELAVADAHPLGTRPFE;LAVADAHPLGTRPFER;AVADAHPLGTRPFERK;VADAHPLGTRPFERKQ;ADAHPLGTRPFERKQY;DAHPLGTRPFERKQYV;AHPLGTRPFERKQYVE;HPLGTRPFERKQYVEK;PLGTRPFERKQYVEKF;LGTRPFERKQYVEKFT;GTRPFERKQYVEKFTE;TRPFERKQYVEKFTEL;RPFERKQYVEKFTELA;PFERKQYVEKFTELAD;FERKQYVEKFTELADG;ERKQYVEKFTELADGV;RKQYVEKFTELADGVV;KQYVEKFTELADGVVE;QYVEKFTELADGVVEP;YVEKFTELADGVVEPV;VEKFTELADGVVEPVE;EKFTELADGVVEPVEQ;KFTELADGVVEPVEQQ;FTELADGVVEPVEQQR;TELADGVVEPVEQQRF;ELADGVVEPVEQQRFL;LADGVVEPVEQQRFLA;ADGVVEPVEQQRFLAV;DGVVEPVEQQRFLAVV;GVVEPVEQQRFLAVVE;VVEPVEQQRFLAVVES;VEPVEQQRFLAVVESL;EPVEQQRFLAVVESLA;PVEQQRFLAVVESLAD;VEQQRFLAVVESLADL;EQQRFLAVVESLADLE;QQRFLAVVESLADLES;QRFLAVVESLADLESG;RFLAVVESLADLESGA;FLAVVESLADLESGAV;LAVVESLADLESGAVG;AVVESLADLESGAVGG;VVESLADLESGAVGGL;VESLADLESGAVGGLN;ESLADLESGAVGGLNV;SLADLESGAVGGLNVL;LADLESGAVGGLNVLV;ADLESGAVGGLNVLVD;DLESGAVGGLNVLVDP;LESGAVGGLNVLVDPR;ESGAVGGLNVLVDPRV;SGAVGGLNVLVDPRVL;GAVGGLNVLVDPRVLD;AVGGLNVLVDPRVLDK;VGGLNVLVDPRVLDKA;GGLNVLVDPRVLDKAP;GLNVLVDPRVLDKAPV;LNVLVDPRVLDKAPVI;NVLVDPRVLDKAPVIP;VLVDPRVLDKAPVIPP;LVDPRVLDKAPVIPPG;VDPRVLDKAPVIPPGI;DPRVLDKAPVIPPGIF;PRVLDKAPVIPPGIFR | |
| 38 | **<YP_177792.1 PE family protein Rv1169c;Mycobacterium tuberculosis H37Rv>**<br>MSFVTTRPDSIGETAANLHEIGVTMSAHDDGVTPLITNVESPAHDLVSIVTSMLFSMHGELYKAIARQAHVIHESFVQTLQTSKTSYWLTELANRAGTST<br><br>8mer<br>ETAANLHE;TAANLHEI;NLHEIGVT;EIGVTMSA;MSAHDDGV;HDDGVTPL;VTPLITNV;VESPAHDL;ESPAHDLV;LVSIVTSM;SIVTSMLF;VTSMLFSM;TSM | 195801-195768 |

Fig. 30 continued

| | | |
|---|---|---|
| | LFSMH;MLFSMHGE;FSMHGELY;SMHGELYK;ELYKAIAR;AIARQAHV;IAR<br>QAHVI;RQAHVIHE;HVIHESFV;HESFVQTL;ESFVQTLQ;VQTLQTSK;LQTS<br>KTSY;QTSKTSYW;TSYWLTEL;WLTELANR<br>9mer<br>FVTTRPDSI;RPDSIGETA;SIGETAANL;ETAANLHEI;AANLHEIGV;NLHEIGV<br>TM;HEIGVTMSA;EIGVTMSAH;TMSAHDDGV;AHDDGVTPL;GVTPLITNV;S<br>PAHDLVSI;PAHDLVSIV;DLVSIVTSM;LVSIVTSML;VSIVTSMLF;SIVTSMLF<br>S;IVTSMLFSM;VTSMLFSMH;MLFSMHGEL;LFSMHGELY;FSMHGELYK;S<br>MHGELYKA;ELYKAIARQ;KAIARQAHV;AIARQAHVI;RQAHVIHES;QAHVIH<br>ESF;IHESFVQTL;FVQTLQTSK;TLQTSKTSY;QTSKTSYWL;KTSYWLTEL;T<br>SYWLTELA;YWLTELANR;WLTELANRA<br>10mer<br>RPDSIGETAA;DSIGETAANL;GETAANLHEI;TAANLHEIGV;VTMSAHDDGV;<br>SAHDDGVTPL;DGVTPLITNV;PLITNVESPA;NVESPAHDLV;ESPAHDLVSI;<br>SPAHDLVSIV;DLVSIVTSML;LVSIVTSMLF;SIVTSMLFSM;SMLFSMHGEL;<br>MLFSMHGELY;LFSMHGELYK;FSMHGELYKA;SMHGELYKAI;ELYKAIARQ<br>A;KAIARQAHVI;RQAHVIHESF;QAHVIHESFV;VIHESFVQTL;QTLQTSKTSY<br>;LQTSKTSYWL;KTSYWLTELA;SYWLTELANR<br>11mer<br>MSFVTTRPDSI;ETAANLHEIGV;AANLHEIGVTM;NLHEIGVTMSA;GVTMSA<br>HDDGV;MSAHDDGVTPL;SAHDDGVTPLI;TPLITNVESPA;VESPAHDLVSI;<br>ESPAHDLVSIV;SPAHDLVSIVT;DLVSIVTSMLF;VSIVTSMLFSM;SIVTSMLF<br>SMH;TSMLFSMHGEL;SMLFSMHGELY;MLFSMHGELYK;FSMHGELYKAI;S<br>MHGELYKAIA;YKAIARQAHVI;RQAHVIHESFV;HVIHESFVQTL;ESFVQTLQ<br>TSK;VQTLQTSKTSY;QTLQTSKTSYW;TLQTSKTSYWL;LQTSKTSYWLT;T<br>SYWLTELANR;WLTELANRAGT<br><br>13 mers:<br>MSFVTTRPDSIGE;SFVTTRPDSIGET;FVTTRPDSIGETA;VTTRPDSIGETA<br>A;TTRPDSIGETAAN;TRPDSIGETAANL;RPDSIGETAANLH;PDSIGETAANL<br>HE;DSIGETAANLHEI;SIGETAANLHEIG;IGETAANLHEIGV;GETAANLHEIG<br>VT;ETAANLHEIGVTM;TAANLHEIGVTMS;AANLHEIGVTMSA;ANLHEIGVT<br>MSAH;NLHEIGVTMSAHD;LHEIGVTMSAHDD;HEIGVTMSAHDDG;EIGVTM<br>SAHDDGV;IGVTMSAHDDGVT;GVTMSAHDDGVTP;VTMSAHDDGVTPL;T<br>MSAHDDGVTPLI;MSAHDDGVTPLIT;SAHDDGVTPLITN;AHDDGVTPLITNV<br>;HDDGVTPLITNVE;DDGVTPLITNVES;DGVTPLITNVESP;GVTPLITNVESP<br>A;VTPLITNVESPAH;TPLITNVESPAHD;PLITNVESPAHDL;LITNVESPAHDL<br>V;ITNVESPAHDLVS;TNVESPAHDLVSI;NVESPAHDLVSIV;VESPAHDLVSI<br>VT;ESPAHDLVSIVTS;SPAHDLVSIVTSM;PAHDLVSIVTSML;AHDLVSIVTS<br>MLF;HDLVSIVTSMLFS;DLVSIVTSMLFSM;LVSIVTSMLFSMH;VSIVTSMLF<br>SMHG;SIVTSMLFSMHGE;IVTSMLFSMHGEL;VTSMLFSMHGELY;TSMLFS<br>MHGELYK;SMLFSMHGELYKA;MLFSMHGELYKAI;LFSMHGELYKAIA;FSM<br>HGELYKAIAR;SMHGELYKAIARQ;MHGELYKAIARQA;HGELYKAIARQAH;<br>GELYKAIARQAHV;ELYKAIARQAHVI;LYKAIARQAHVIH;YKAIARQAHVIHE;<br>KAIARQAHVIHES;AIARQAHVIHESF;IARQAHVIHESFV;ARQAHVIHESFVQ<br>;RQAHVIHESFVQT;QAHVIHESFVQTL;AHVIHESFVQTLQ;HVIHESFVQTL<br>QT;VIHESFVQTLQTS;IHESFVQTLQTSK;HESFVQTLQTSKT;ESFVQTLQT<br>SKTS;SFVQTLQTSKTSY;FVQTLQTSKTSYW;VQTLQTSKTSYWL;QTLQTS<br>KTSYWLT;TLQTSKTSYWLTE;LQTSKTSYWLTEL;QTSKTSYWLTELA;TSK<br>TSYWLTELAN;SKTSYWLTELANR;KTSYWLTELANRA;TSYWLTELANRAG<br>;SYWLTELANRAGT;YWLTELANRAGTS;WLTELANRAGTST;<br>14 mers:<br>MSFVTTRPDSIGET;SFVTTRPDSIGETA;FVTTRPDSIGETAA;VTTRPDSIG | |

Fig. 30 continued

ETAAN;TTRPDSIGETAANL;TRPDSIGETAANLH;RPDSIGETAANLHE;PDSI
GETAANLHEI;DSIGETAANLHEIG;SIGETAANLHEIGV;IGETAANLHEIGVT;
GETAANLHEIGVTM;ETAANLHEIGVTMS;TAANLHEIGVTMSA;AANLHEIGV
TMSAH;ANLHEIGVTMSAHD;NLHEIGVTMSAHDD;LHEIGVTMSAHDDG;HE
IGVTMSAHDDGV;EIGVTMSAHDDGVT;IGVTMSAHDDGVTP;GVTMSAHD
DGVTPL;VTMSAHDDGVTPLI;TMSAHDDGVTPLIT;MSAHDDGVTPLITN;SA
HDDGVTPLITNV;AHDDGVTPLITNVE;HDDGVTPLITNVES;DDGVTPLITNV
ESP;DGVTPLITNVESPA;GVTPLITNVESPAH;VTPLITNVESPAHD;TPLITNV
ESPAHDL;PLITNVESPAHDLV;LITNVESPAHDLVS;ITNVESPAHDLVSI;TNV
ESPAHDLVSIV;NVESPAHDLVSIVT;VESPAHDLVSIVTS;ESPAHDLVSIVTS
M;SPAHDLVSIVTSML;PAHDLVSIVTSMLF;AHDLVSIVTSMLFS;HDLVSIVT
SMLFSM;DLVSIVTSMLFSMH;LVSIVTSMLFSMHG;VSIVTSMLFSMHGE;SI
VTSMLFSMHGEL;IVTSMLFSMHGELY;VTSMLFSMHGELYK;TSMLFSMHG
ELYKA;SMLFSMHGELYKAI;MLFSMHGELYKAIA;LFSMHGELYKAIAR;FSM
HGELYKAIARQ;SMHGELYKAIARQA;MHGELYKAIARQAH;HGELYKAIARQ
AHV;GELYKAIARQAHVI;ELYKAIARQAHVIH;LYKAIARQAHVIHE;YKAIARQ
AHVIHES;KAIARQAHVIHESF;AIARQAHVIHESFV;IARQAHVIHESFVQ;AR
QAHVIHESFVQT;RQAHVIHESFVQTL;QAHVIHESFVQTLQ;AHVIHESFVQT
LQT;HVIHESFVQTLQTS;VIHESFVQTLQTSK;IHESFVQTLQTSKT;HESFVQ
TLQTSKTS;ESFVQTLQTSKTSY;SFVQTLQTSKTSYW;FVQTLQTSKTSYW
L;VQTLQTSKTSYWLT;QTLQTSKTSYWLTE;TLQTSKTSYWLTEL;LQTSKT
SYWLTELA;QTSKTSYWLTELAN;TSKTSYWLTELANR;SKTSYWLTELANR
A;KTSYWLTELANRAG;TSYWLTELANRAGT;SYWLTELANRAGTS;YWLTE
LANRAGTST;

15 mers:

MSFVTTRPDSIGETA;SFVTTRPDSIGETAA;FVTTRPDSIGETAAN;VTTRPD
SIGETAANL;TTRPDSIGETAANLH;TRPDSIGETAANLHE;RPDSIGETAANL
HEI;PDSIGETAANLHEIG;DSIGETAANLHEIGV;SIGETAANLHEIGVT;IGETA
ANLHEIGVTM;GETAANLHEIGVTMS;ETAANLHEIGVTMSA;TAANLHEIGVT
MSAH;AANLHEIGVTMSAHD;ANLHEIGVTMSAHDD;NLHEIGVTMSAHDDG
;LHEIGVTMSAHDDGV;HEIGVTMSAHDDGVT;EIGVTMSAHDDGVTP;IGVT
MSAHDDGVTPL;GVTMSAHDDGVTPLI;VTMSAHDDGVTPLIT;TMSAHDDG
VTPLITN;MSAHDDGVTPLITNV;SAHDDGVTPLITNVE;AHDDGVTPLITNVE
S;HDDGVTPLITNVESP;DDGVTPLITNVESPA;DGVTPLITNVESPAH;GVTP
LITNVESPAHD;VTPLITNVESPAHDL;TPLITNVESPAHDLV;PLITNVESPAH
DLVS;LITNVESPAHDLVSI;ITNVESPAHDLVSIV;TNVESPAHDLVSIVT;NVE
SPAHDLVSIVTS;VESPAHDLVSIVTSM;ESPAHDLVSIVTSML;SPAHDLVSIV
TSMLF;PAHDLVSIVTSMLFS;AHDLVSIVTSMLFSM;HDLVSIVTSMLFSMH;
DLVSIVTSMLFSMHG;LVSIVTSMLFSMHGE;VSIVTSMLFSMHGEL;SIVTSM
LFSMHGELY;IVTSMLFSMHGELYK;VTSMLFSMHGELYKA;TSMLFSMHGE
LYKAI;SMLFSMHGELYKAIA;MLFSMHGELYKAIAR;LFSMHGELYKAIARQ;
FSMHGELYKAIARQA;SMHGELYKAIARQAH;MHGELYKAIARQAHV;HGEL
YKAIARQAHVI;GELYKAIARQAHVIH;ELYKAIARQAHVIHE;LYKAIARQAHVI
HES;YKAIARQAHVIHESF;KAIARQAHVIHESFV;AIARQAHVIHESFVQ;IAR
QAHVIHESFVQT;ARQAHVIHESFVQTL;RQAHVIHESFVQTLQ;QAHVIHES
FVQTLQT;AHVIHESFVQTLQTS;HVIHESFVQTLQTSK;VIHESFVQTLQTSK
T;IHESFVQTLQTSKTS;HESFVQTLQTSKTSY;ESFVQTLQTSKTSYW;SFV
QTLQTSKTSYWL;FVQTLQTSKTSYWLT;VQTLQTSKTSYWLTE;QTLQTSK
TSYWLTEL;TLQTSKTSYWLTELA;LQTSKTSYWLTELAN;QTSKTSYWLTEL
ANR;TSKTSYWLTELANRA;SKTSYWLTELANRAG;KTSYWLTELANRAGT;
TSYWLTELANRAGTS;SYWLTELANRAGTST;

16 mers:

MSFVTTRPDSIGETAA;SFVTTRPDSIGETAAN;FVTTRPDSIGETAANL;VTT

Fig. 30 continued

| | | |
|---|---|---|
| | RPDSIGETAANLH;TTRPDSIGETAANLHE;TRPDSIGETAANLHEI;RPDSIGETAANLHEIG;PDSIGETAANLHEIGV;DSIGETAANLHEIGVT;SIGETAANLHEIGVTM;IGETAANLHEIGVTMS;GETAANLHEIGVTMSA;ETAANLHEIGVTMSAH;TAANLHEIGVTMSAHD;AANLHEIGVTMSAHDD;ANLHEIGVTMSAHDDG;NLHEIGVTMSAHDDGV;LHEIGVTMSAHDDGVT;HEIGVTMSAHDDGVTP;EIGVTMSAHDDGVTPL;IGVTMSAHDDGVTPLI;GVTMSAHDDGVTPLIT;VTMSAHDDGVTPLITN;TMSAHDDGVTPLITNV;MSAHDDGVTPLITNVE;SAHDDGVTPLITNVES;AHDDGVTPLITNVESP;HDDGVTPLITNVESPA;DDGVTPLITNVESPAH;DGVTPLITNVESPAHD;GVTPLITNVESPAHDL;VTPLITNVESPAHDLV;TPLITNVESPAHDLVS;PLITNVESPAHDLVSI;LITNVESPAHDLVSIV;ITNVESPAHDLVSIVT;TNVESPAHDLVSIVTS;NVESPAHDLVSIVTSM;VESPAHDLVSIVTSML;ESPAHDLVSIVTSMLF;SPAHDLVSIVTSMLFS;PAHDLVSIVTSMLFSM;AHDLVSIVTSMLFSMH;HDLVSIVTSMLFSMHG;DLVSIVTSMLFSMHGE;LVSIVTSMLFSMHGEL;VSIVTSMLFSMHGELY;SIVTSMLFSMHGELYK;IVTSMLFSMHGELYKA;VTSMLFSMHGELYKAI;TSMLFSMHGELYKAIA;SMLFSMHGELYKAIAR;MLFSMHGELYKAIARQ;LFSMHGELYKAIARQA;FSMHGELYKAIARQAH;SMHGELYKAIARQAHV;MHGELYKAIARQAHVI;HGELYKAIARQAHVIH;GELYKAIARQAHVIHE;ELYKAIARQAHVIHES;LYKAIARQAHVIHESF;YKAIARQAHVIHESFV;KAIARQAHVIHESFVQ;AIARQAHVIHESFVQT;IARQAHVIHESFVQTL;ARQAHVIHESFVQTLQ;RQAHVIHESFVQTLQT;QAHVIHESFVQTLQTS;AHVIHESFVQTLQTSK;HVIHESFVQTLQTSKT;VIHESFVQTLQTSKTS;IHESFVQTLQTSKTSY;HESFVQTLQTSKTSYW;ESFVQTLQTSKTSYWL;SFVQTLQTSKTSYWLT;FVQTLQTSKTSYWLTE;VQTLQTSKTSYWLTEL;QTLQTSKTSYWLTELA;TLQTSKTSYWLTELAN;LQTSKTSYWLTELANR;QTSKTSYWLTELANRA;TSKTSYWLTELANRAG;SKTSYWLTELANRAGT;KTSYWLTELANRAGTS;TSYWLTELANRAGTST | |
| 39 | **<NP_217145.1 hypothetical protein Rv2629;Mycobacterium tuberculosis H37Rv>**<br>MRSERLRWLVAAEGPFASVYFDDSHDTLDAVERREATWRDVRKHLESRDAKQELIDSLEEAVRDSRPAVGQRGRALIATGEQVLVNEHLIGPPPATVIRLSDYPYVVPLIDLEMRRPTYVFAAVDHTGADVKLYQGATISSTKIDGVGYPVHKPVTAGWNGYGDFQHTTEEAIRMNCRAVADHLTRLVDAADPEVVFVSGEVRSRTDLLSTLPQRVAVRVSQLHAGPRKSALDEEEIWDLTSAEFTRRRYAEITNVAQQFEAEIGRGSGLAAQGLAEVCAALRDGDVDTLIVGELGEATVVTGKARTTVARDADMLSELGEPVDRVARADEALPFAAIAVGAALVRDDNRIAPLDGVGALLRYAATNRLGSHRS<br><br>8mer<br>RLRWLVAA;LVAAEGPF;VAAEGPFA;AEGPFASV;EGPFASVY;GPFASVYF;DTLDAVER;TLDAVERR;VERREATW;EATWRDVR;ATWRDVRK;KQELIDSL;LIDSLEEA;DSLEEAVR;AVRDSRPA;LIATGEQV;ATGEQVLV;VLVNEHLI;HLIGPPPA;GPPPATVI;TVIRLSDY;IRLSDYPY;RLSDYPYV;DYPYVVPL;YPYVVPLI;YVVPLIDL;VPLIDLEM;LEMRRPTY;EMRRPTYV;MRRPTYVF;RPTYVFAA;PTYVFAAV;AAVDHTGA;KLYQGATI;YQGATISS;GATISSTK;ATISSTKI;SSTKIDGV;TKIDGVGY;GVGYPVHK;YPVHKPVT;VTAGWNGY;GWNGYGDF;FQHTTEEA;HTTEEAIR;TTEEAIRM;EAIRMNCR;RMNCRAVA;AVADHLTR;HLTRLVDA;DAADPEVV;AADPEVVF;EVVFVSGE;VVFVSGEV;VFVSGEVR;VSGEVRSR;EVRSRTDL;RTDLLSTL;DLLSTLPQ;LLSTLPQR;TLPQRVAV;AVRVSQLH;SQLHAGPR;QLHAGPRK;SALDEEEI;DEEEIWDL;EEIWDLTS;EIWDLTSA;WDLTSAEF;LTSAEFTR;TSAEFTRR;SAEFTRRR;AEFTRRRY;RRYAEITN;RYAEITNV;AEITNVAQ;ITNVAQQF;NVAQQFEA;AQQFEAEI;EIGRGSGL;GLAAQGLA;AAQGLAEV;GLAEVCAA;LAEVCAAL;AEVCAALR;DTLIVGEL;GELGEATV;ELGEATVV;EATVVTGK;TVVTGKAR;KARTTVAR;T | 195769-197667 |

Fig. 30 continued

| | | |
|---|---|---|
| | VARDADM;EPVDRVAR;VARADEAL;RADEALPF;EALPFAAI;ALPFAAIA;LPFAAIAV;FAAIAVGA;AAIAVGAA;AIAVGAAL;IAVGAALV;AVGAALVR;RIAPLDGV;APLDGVGA;PLDGVGAL;DGVGALLR;GVGALLRY;ALLRYAAT;RYAATNRL<br>9mer<br>RSERLRWLV;RLRWLVAAE;WLVAAEGPF;AAEGPFASV;AEGPFASVY;EGPFASVYF;YFDDSHDTL;DSHDTLDAV;HDTLDAVER;DTLDAVERR;EATWRDVRK;DVRKHLESR;ELIDSLEEA;LIDSLEEAV;AVRDSRPAV;DSRPAVGQR;AVGQRGRAL;ALIATGEQV;LIATGEQVL;IATGEQVLV;QVLVNEHLI;HLIGPPPAT;LIGPPPATV;PPPATVIRL;ATVIRLSDY;VIRLSDYPY;RLSDYPYVV;SDYPYVVPL;DYPYVVPLI;YPYVVPLID;PYVVPLIDL;LEMRRPTYV;EMRRPTYVF;RPTYVFAAV;FAAVDHTGA;AVDHTGADV;HTGADVKLY;KLYQGATIS;YQGATISST;QGATISSTK;STKIDGVGY;KIDGVGYPV;VGYPVHKPV;YPVHKPVTA;PVTAGWNGY;FQHTTEEAI;EEAIRMNCR;EAIRMNCRA;AIRMNCRAV;RAVADHLTR;AVADHLTRL;VADHLTRLV;HLTRLVDAA;LVDAADPEV;DAADPEVVF;AADPEVVFV;EVVFVSGEV;VVFVSGEVR;FVSGEVRSR;GEVRSRTDL;EVRSRTDLL;SRTDLLSTL;DLLSTLPQR;LLSTLPQRV;STLPQRVAV;TLPQRVAVR;LPQRVAVRV;QRVAVRVSQ;RVAVRVSQL;AVRVSQLHA;VSQLHAGPR;SQLHAGPRK;HAGPRKSAL;SALDEEEIW;ALDEEEIWD;EEEIWDLTS;IWDLTSAEF;DLTSAEFTR;LTSAEFTRR;TSAEFTRRR;AEFTRRRYA;EFTRRRYAE;FTRRRYAEI;RRYAEITNV;AEITNVAQQ;EITNVAQQF;QQFEAEIGR;AEIGRGSGL;LAAQGLAEV;GLAEVCAAL;LAEVCAALR;AEVCAALRD;ALRDGDVDT;LRDGDVDTL;LIVGELGEA;GELGEATVV;ELGEATVVT;EATVVTGKA;ATVVTGKAR;VTGKARTTV;TTVARDADM;TVARDADML;RDADMLSEL;MLSELGEPV;ELGEPVDRV;EPVDRVARA;RVARADEAL;ARADEALPF;RADEALPFA;DEALPFAAI;EALPFAAIA;ALPFAAIAV;LPFAAIAVG;FAAIAVGAA;AAIAVGAAL;AIAVGAALV;IAVGAALVR;AALVRDDNR;ALVRDDNRI;NRIAPLDGV;APLDGVGAL;PLDGVGALL;DGVGALLRY;GVGALLRYA;LLRYAATNR;LRYAATNRL;ATNRLGSHR<br>10mer<br>MRSERLRWLV;RWLVAAEGPF;WLVAAEGPFA;VAAEGPFASV;AAEGPFASVY;AEGPFASVYF;FASVYFDDSH;VYFDDSHDTL;TLDAVERREA;RREATWRDVR;RKHLESRDAK;LESRDAKQEL;ELIDSLEEAV;EAVRDSRPAV;RPAVGQRGRA;RALIATGEQV;ALIATGEQVL;LIATGEQVLV;GEQVLVNEHL;HLIGPPPATV;LIGPPPATVI;GPPPATVIRL;TVIRLSDYPY;VIRLSDYPYV;IRLSDYPYVV;RLSDYPYVVP;LSDYPYVVPL;YPYVVPLIDL;YVVPLIDLEM;VVPLIDLEMR;IDLEMRRPTY;DLEMRRPTYV;LEMRRPTYVF;EMRRPTYVFA;RRPTYVFAAV;RPTYVFAAVD;AAVDHTGADV;AVDHTGADVK;KLYQGATISS;YQGATISSTK;QGATISSTKI;TISSTKIDGV;TKIDGVGYPV;GVGYPVHKPV;YPVHKPVTAG;KPVTAGWNGY;TAGWNGYGDF;EEAIRMNCRA;EAIRMNCRAV;RAVADHLTRL;AVADHLTRLV;RLVDAADPEV;LVDAADPEVV;DAADPEVVFV;EVVFVSGEVR;VFVSGEVRSR;GEVRSRTDLL;DLLSTLPQRV;LLSTLPQRVA;STLPQRVAVR;TLPQRVAVRV;LPQRVAVRVS;QRVAVRVSQL;RVSQLHAGPR;VSQLHAGPRK;QLHAGPRKSA;LHAGPRKSAL;KSALDEEEIW;ALDEEEIWDL;EEEIWDLTSA;EIWDLTSAEF;DLTSAEFTRR;LTSAEFTRRR;TSAEFTRRRY;RRYAEITNVA;AEITNVAQQF;NVAQQFEAEI;AEIGRGSGLA;GLAAQGLAEV;AQGLAEVCAA;GLAEVCAALR;AEVCAALRDG;ALRDGDVDTL;DVDTLIVGEL;TLIVGELGEA;IVGELGEATV;EATVVTGKAR;VVTGKARTTV;TTVARDADML;DMLSELGEPV;ELGEPVDRVA;VARADEALPF;RADEALPFAA;EALPFAAIAV;LPFAAIAVGA;FAAIAVGAAL;AAIAVGAALV;AIAVGAALVR;GAALVRDDNR;ALVRDDNRIA;VRDDNRIAPL;RIAPLDGVGA;APLDGVGALL;PLDGVGALLR;ALLRYAATNR;LLRYAATNRL;AATNRLGSHR<br>11mer | |

Fig. 30 continued

LRWLVAAEGPF;WLVAAEGPFAS;LVAAEGPFASV;VAAEGPFASVY;SVYF
DDSHDTL;FDDSHDTLDAV;DSHDTLDAVER;DTLDAVERREA;TLDAVERR
EAT;DAVERREATWR;RREATWRDVRK;HLESRDAKQEL;KQELIDSLEEA;E
LIDSLEEAVR;DSLEEAVRDSR;EEAVRDSRPAV;AVRDSRPAVGQ;DSRPA
VGQRGR;RPAVGQRGRAL;RGRALIATGEQ;ALIATGEQVLV;GEQVLVNEH
LI;EHLIGPPPATV;HLIGPPPATVI;LIGPPPATVIR;ATVIRLSDYPY;TVIRLSD
YPYV;VIRLSDYPYVV;RLSDYPYVVPL;DYPYVVPLIDL;YPYVVPLIDLE;PYV
VPLIDLEM;YVVPLIDLEMR;VVPLIDLEMRR;PLIDLEMRRPT;LIDLEMRRPT
Y;EMRRPTYVFAA;MRRPTYVFAAV;YVFAAVDHTGA;FAAVDHTGADV;AAV
DHTGADVK;AVDHTGADVKL;TGADVKLYQGA;KLYQGATISST;LYQGATIS
STK;YQGATISSTKI;ATISSTKIDGV;STKIDGVGYPV;KIDGVGYPVHK;DGVG
YPVHKPV;YPVHKPVTAGW;VTAGWNGYGDF;DFQHTTEEAIR;FQHTTEEA
IRM;TTEEAIRMNCR;EEAIRMNCRAV;EAIRMNCRAVA;RMNCRAVADHL;R
AVADHLTRLV;RLVDAADPEVV;LVDAADPEVVF;EVVFVSGEVRS;VVFVSG
EVRSR;RTDLLSTLPQR;DLLSTLPQRVA;LLSTLPQRVAV;LSTLPQRVAVR;
STLPQRVAVRV;RVSQLHAGPRK;SQLHAGPRKSA;QLHAGPRKSAL;RKSA
LDEEEIW;SALDEEEIWDL;ALDEEEIWDLT;EEIWDLTSAEF;EIWDLTSAEFT
;DLTSAEFTRRR;LTSAEFTRRRY;TSAEFTRRRYA;AEFTRRRYAEI;RRYAEI
TNVAQ;YAEITNVAQQF;EITNVAQQFEA;VAQQFEAEIGR;FEAEIGRGSGL;
AEIGRGSGLAA;SGLAAQGLAEV;AQGLAEVCAAL;AEVCAALRDGD;EVCA
ALRDGDV;ALRDGDVDTLI;DTLIVGELGEA;LIVGELGEATV;IVGELGEATVV
;ELGEATVVTGK;TVVTGKARTTV;VTGKARTTVAR;MLSELGEPVDR;ELGE
PVDRVAR;RVARADEALPF;RADEALPFAAI;DEALPFAAIAV;ALPFAAIAVGA
;LPFAAIAVGAA;FAAIAVGAALV;AAIAVGAALVR;LVRDDNRIAPL;RIAPLDG
VGAL;PLDGVGALLRY;GALLRYAATNR;ALLRYAATNRL;YAATNRLGSHR 13 mers:
MRSERLRWLVAAE;RSERLRWLVAAEG;SERLRWLVAAEGP;ERLRWLVAA
EGPF;RLRWLVAAEGPFA;LRWLVAAEGPFAS;RWLVAAEGPFASV;WLVAA
EGPFASVY;LVAAEGPFASVYF;VAAEGPFASVYFD;AAEGPFASVYFDD;AE
GPFASVYFDDS;EGPFASVYFDDSH;GPFASVYFDDSHD;PFASVYFDDSH
DT;FASVYFDDSHDTL;ASVYFDDSHDTLD;SVYFDDSHDTLDA;VYFDDSHD
TLDAV;YFDDSHDTLDAVE;FDDSHDTLDAVER;DDSHDTLDAVERR;DSHD
TLDAVERRE;SHDTLDAVERREA;HDTLDAVERREAT;DTLDAVERREATW;
TLDAVERREATWR;LDAVERREATWRD;DAVERREATWRDV;AVERREAT
WRDVR;VERREATWRDVRK;ERREATWRDVRKH;RREATWRDVRKHL;RE
ATWRDVRKHLE;EATWRDVRKHLES;ATWRDVRKHLESR;TWRDVRKHLE
SRD;WRDVRKHLESRDA;RDVRKHLESRDAK;DVRKHLESRDAKQ;VRKHL
ESRDAKQE;RKHLESRDAKQEL;KHLESRDAKQELI;HLESRDAKQELID;LE
SRDAKQELIDS;ESRDAKQELIDSL;SRDAKQELIDSLE;RDAKQELIDSLEE;D
AKQELIDSLEEA;AKQELIDSLEEAV;KQELIDSLEEAVR;QELIDSLEEAVRD;
ELIDSLEEAVRDS;LIDSLEEAVRDSR;IDSLEEAVRDSRP;DSLEEAVRDSRP
A;SLEEAVRDSRPAV;LEEAVRDSRPAVG;EEAVRDSRPAVGQ;EAVRDSRP
AVGQR;AVRDSRPAVGQRG;VRDSRPAVGQRGR;RDSRPAVGQRGRA;DS
RPAVGQRGRAL;SRPAVGQRGRALI;RPAVGQRGRALIA;PAVGQRGRALIA
T;AVGQRGRALIATG;VGQRGRALIATGE;GQRGRALIATGEQ;QRGRALIAT
GEQV;RGRALIATGEQVL;GRALIATGEQVLV;RALIATGEQVLVN;ALIATGE
QVLVNE;LIATGEQVLVNEH;IATGEQVLVNEHL;ATGEQVLVNEHLI;TGEQV
LVNEHLIG;GEQVLVNEHLIGP;EQVLVNEHLIGPP;QVLVNEHLIGPPP;VLVN
EHLIGPPPA;LVNEHLIGPPPAT;VNEHLIGPPPATV;NEHLIGPPPATVI;EHLI
GPPPATVIR;HLIGPPPATVIRL;LIGPPPATVIRLS;IGPPPATVIRLSD;GPPPA
TVIRLSDY;PPPATVIRLSDYP;PPATVIRLSDYPY;PATVIRLSDYPYV;ATVIR
LSDYPYVV;TVIRLSDYPYVVP;VIRLSDYPYVVPL;IRLSDYPYVVPLI;RLSDY

Fig. 30 continued

| | | |
|---|---|---|
| | PYVVPLID;LSDYPYVVPLIDL;SDYPYVVPLIDLE;DYPYVVPLIDLEM;YPYVVPLIDLEMR;PYVVPLIDLEMRR;YVVPLIDLEMRRP;VVPLIDLEMRRPT;VPLIDLEMRRPTY;PLIDLEMRRPTYV;LIDLEMRRPTYVF;IDLEMRRPTYVFA;DLEMRRPTYVFAA;LEMRRPTYVFAAV;EMRRPTYVFAAVD;MRRPTYVFAAVDH;RRPTYVFAAVDHT;RPTYVFAAVDHTG;PTYVFAAVDHTGA;TYVFAAVDHTGAD;YVFAAVDHTGADV;VFAAVDHTGADVK;FAAVDHTGADVKL;AAVDHTGADVKLY;AVDHTGADVKLYQ;VDHTGADVKLYQG;DHTGADVKLYQGA;HTGADVKLYQGAT;TGADVKLYQGATI;GADVKLYQGATIS;ADVKLYQGATISS;DVKLYQGATISST;VKLYQGATISSTK;KLYQGATISSTKI;LYQGATISSTKID;YQGATISSTKIDG;QGATISSTKIDGV;GATISSTKIDGVG;ATISSTKIDGVGY;TISSTKIDGVGYP;ISSTKIDGVGYPV;SSTKIDGVGYPVH;STKIDGVGYPVHK;TKIDGVGYPVHKP;KIDGVGYPVHKPV;IDGVGYPVHKPVT;DGVGYPVHKPVTA;GVGYPVHKPVTAG;VGYPVHKPVTAGW;GYPVHKPVTAGWN;YPVHKPVTAGWNG;PVHKPVTAGWNGY;VHKPVTAGWNGYG;HKPVTAGWNGYGD;KPVTAGWNGYGDF;PVTAGWNGYGDFQ;VTAGWNGYGDFQH;TAGWNGYGDFQHT;AGWNGYGDFQHTT;GWNGYGDFQHTTE;WNGYGDFQHTTEE;NGYGDFQHTTEEA;GYGDFQHTTEEAI;YGDFQHTTEEAIR;GDFQHTTEEAIRM;DFQHTTEEAIRMN;FQHTTEEAIRMNC;QHTTEEAIRMNCR;HTTEEAIRMNCRA;TTEEAIRMNCRAV;TEEAIRMNCRAVA;EEAIRMNCRAVAD;EAIRMNCRAVADH;AIRMNCRAVADHL;IRMNCRAVADHLT;RMNCRAVADHLTR;MNCRAVADHLTRL;NCRAVADHLTRLV;CRAVADHLTRLVD;RAVADHLTRLVDA;AVADHLTRLVDAA;VADHLTRLVDAAD;ADHLTRLVDAADP;DHLTRLVDAADPE;HLTRLVDAADPEV;LTRLVDAADPEVV;TRLVDAADPEVVF;RLVDAADPEVVFV;LVDAADPEVVFVS;VDAADPEVVFVSG;DAADPEVVFVSGE;AADPEVVFVSGEV;ADPEVVFVSGEVR;DPEVVFVSGEVRS;PEVVFVSGEVRSR;EVVFVSGEVRSRT;VVFVSGEVRSRTD;VFVSGEVRSRTDL;FVSGEVRSRTDLL;VSGEVRSRTDLLS;SGEVRSRTDLLST;GEVRSRTDLLSTL;EVRSRTDLLSTLP;VRSRTDLLSTLPQ;RSRTDLLSTLPQR;SRTDLLSTLPQRV;RTDLLSTLPQRVA;TDLLSTLPQRVAV;DLLSTLPQRVAVR;LLSTLPQRVAVRV;LSTLPQRVAVRVS;STLPQRVAVRVSQ;TLPQRVAVRVSQL;LPQRVAVRVSQLH;PQRVAVRVSQLHA;QRVAVRVSQLHAG;RVAVRVSQLHAGP;VAVRVSQLHAGPR;AVRVSQLHAGPRK;VRVSQLHAGPRKS;RVSQLHAGPRKSA;VSQLHAGPRKSAL;SQLHAGPRKSALD;QLHAGPRKSALDE;LHAGPRKSALDEE;HAGPRKSALDEEE;AGPRKSALDEEEI;GPRKSALDEEEIW;PRKSALDEEEIWD;RKSALDEEEIWDL;KSALDEEEIWDLT;SALDEEEIWDLTS;ALDEEEIWDLTSA;LDEEEIWDLTSAE;DEEEIWDLTSAEF;EEEIWDLTSAEFT;EEIWDLTSAEFTR;EIWDLTSAEFTRR;IWDLTSAEFTRRR;WDLTSAEFTRRRY;DLTSAEFTRRRYA;LTSAEFTRRRYAE;TSAEFTRRRYAEI;SAEFTRRRYAEIT;AEFTRRRYAEITN;EFTRRRYAEITNV;FTRRRYAEITNVA;TRRRYAEITNVAQ;RRRYAEITNVAQQ;RRYAEITNVAQQF;RYAEITNVAQQFE;YAEITNVAQQFEA;AEITNVAQQFEAE;EITNVAQQFEAEI;ITNVAQQFEAEIG;TNVAQQFEAEIGR;NVAQQFEAEIGRG;VAQQFEAEIGRGS;AQQFEAEIGRGSG;QQFEAEIGRGSGL;QFEAEIGRGSGLA;FEAEIGRGSGLAA;EAEIGRGSGLAAQ;AEIGRGSGLAAQG;EIGRGSGLAAQGL;IGRGSGLAAQGLA;GRGSGLAAQGLAE;RGSGLAAQGLAEV;GSGLAAQGLAEVC;SGLAAQGLAEVCA;GLAAQGLAEVCAA;LAAQGLAEVCAAL;AAQGLAEVCAALR;AQGLAEVCAALRD;QGLAEVCAALRDG;GLAEVCAALRDGD;LAEVCAALRDGDV;AEVCAALRDGDVD;EVCAALRDGDVDT;VCAALRDGDVDTL;CAALRDGDVDTLI;AALRDGDVDTLIV;ALRDGDVDTLIVG;LRDGDVDTLIVGE;RDGDVDTLIVGEL;DGDVDTLIVGELG;GDVDTLIVGELGE;DVDTLIVGELGEA;VDTLIVGELGEAT;DTLIVGELGEATV;TLIVGELGEATVV;LIVGELGEATVVT;IVGELGEATVVTG;VGELGEATVVTGK;GELGEATVVTGKA;ELGEATVVTGKAR;LGEATVVTGKART;GEATVVTGKARTT;EATVVTGKARTTV;ATVVTGKARTTVA;TVVTG | |

Fig. 30 continued

KARTTVAR;VVTGKARTTVARD;VTGKARTTVARDA;TGKARTTVARDAD;G
KARTTVARDADM;KARTTVARDADML;ARTTVARDADMLS;RTTVARDADM
LSE;TTVARDADMLSEL;TVARDADMLSELG;VARDADMLSELGE;ARDADM
LSELGEP;RDADMLSELGEPV;DADMLSELGEPVD;ADMLSELGEPVDR;DM
LSELGEPVDRV;MLSELGEPVDRVA;LSELGEPVDRVAR;SELGEPVDRVAR
A;ELGEPVDRVARAD;LGEPVDRVARADE;GEPVDRVARADEA;EPVDRVA
RADEAL;PVDRVARADEALP;VDRVARADEALPF;DRVARADEALPFA;RVA
RADEALPFAA;VARADEALPFAAI;ARADEALPFAAIA;RADEALPFAAIAV;AD
EALPFAAIAVG;DEALPFAAIAVGA;EALPFAAIAVGAA;ALPFAAIAVGAAL;LP
FAAIAVGAALV;PFAAIAVGAALVR;FAAIAVGAALVRD;AAIAVGAALVRDD;AI
AVGAALVRDDN;IAVGAALVRDDNR;AVGAALVRDDNRI;VGAALVRDDNRI
A;GAALVRDDNRIAP;AALVRDDNRIAPL;ALVRDDNRIAPLD;LVRDDNRIAP
LDG;VRDDNRIAPLDGV;RDDNRIAPLDGVG;DDNRIAPLDGVGA;DNRIAPL
DGVGAL;NRIAPLDGVGALL;RIAPLDGVGALLR;IAPLDGVGALLRY;APLDG
VGALLRYA;PLDGVGALLRYAA;LDGVGALLRYAAT;DGVGALLRYAATN;GV
GALLRYAATNR;VGALLRYAATNRL;GALLRYAATNRLG;ALLRYAATNRLGS
;LLRYAATNRLGSH;LRYAATNRLGSHR;RYAATNRLGSHRS;
14 mers:
MRSERLRWLVAAEG;RSERLRWLVAAEGP;SERLRWLVAAEGPF;ERLRW
LVAAEGPFA;RLRWLVAAEGPFAS;LRWLVAAEGPFASV;RWLVAAEGPFA
SVY;WLVAAEGPFASVYF;LVAAEGPFASVYFD;VAAEGPFASVYFDD;AAE
GPFASVYFDDS;AEGPFASVYFDDSH;EGPFASVYFDDSHD;GPFASVYFD
DSHDT;PFASVYFDDSHDTL;FASVYFDDSHDTLD;ASVYFDDSHDTLDA;SV
YFDDSHDTLDAV;VYFDDSHDTLDAVE;YFDDSHDTLDAVER;FDDSHDTLD
AVERR;DDSHDTLDAVERRE;DSHDTLDAVERREA;SHDTLDAVERREAT;H
DTLDAVERREATW;DTLDAVERREATWR;TLDAVERREATWRD;LDAVERR
EATWRDV;DAVERREATWRDVR;AVERREATWRDVRK;VERREATWRDV
RKH;ERREATWRDVRKHL;RREATWRDVRKHLE;REATWRDVRKHLES;EA
TWRDVRKHLESR;ATWRDVRKHLESRD;TWRDVRKHLESRDA;WRDVRKH
LESRDAK;RDVRKHLESRDAKQ;DVRKHLESRDAKQE;VRKHLESRDAKQE
L;RKHLESRDAKQELI;KHLESRDAKQELID;HLESRDAKQELIDS;LESRDAK
QELIDSL;ESRDAKQELIDSLE;SRDAKQELIDSLEE;RDAKQELIDSLEEA;DA
KQELIDSLEEAV;AKQELIDSLEEAVR;KQELIDSLEEAVRD;QELIDSLEEAVR
DS;ELIDSLEEAVRDSR;LIDSLEEAVRDSRP;IDSLEEAVRDSRPA;DSLEEA
VRDSRPAV;SLEEAVRDSRPAVG;LEEAVRDSRPAVGQ;EEAVRDSRPAVG
QR;EAVRDSRPAVGQRG;AVRDSRPAVGQRGR;VRDSRPAVGQRGRA;RD
SRPAVGQRGRAL;DSRPAVGQRGRALI;SRPAVGQRGRALIA;RPAVGQRG
RALIAT;PAVGQRGRALIATG;AVGQRGRALIATGE;VGQRGRALIATGEQ;G
QRGRALIATGEQV;QRGRALIATGEQVL;RGRALIATGEQVLV;GRALIATGE
QVLVN;RALIATGEQVLVNE;ALIATGEQVLVNEH;LIATGEQVLVNEHL;IATG
EQVLVNEHLI;ATGEQVLVNEHLIG;TGEQVLVNEHLIGP;GEQVLVNEHLIGP
P;EQVLVNEHLIGPPP;QVLVNEHLIGPPPA;VLVNEHLIGPPPAT;LVNEHLIG
PPPATV;VNEHLIGPPPATVI;NEHLIGPPPATVIR;EHLIGPPPATVIRL;HLIGP
PPATVIRLS;LIGPPPATVIRLSD;IGPPPATVIRLSDY;GPPPATVIRLSDYP;P
PPATVIRLSDYPY;PPATVIRLSDYPYV;PATVIRLSDYPYVV;ATVIRLSDYPY
VVP;TVIRLSDYPYVVPL;VIRLSDYPYVVPLI;IRLSDYPYVVPLID;RLSDYPY
VVPLIDL;LSDYPYVVPLIDLE;SDYPYVVPLIDLEM;DYPYVVPLIDLEMR;YPY
VVPLIDLEMRR;PYVVPLIDLEMRRP;YVVPLIDLEMRRPT;VVPLIDLEMRRP
TY;VPLIDLEMRRPTYV;PLIDLEMRRPTYVF;LIDLEMRRPTYVFA;IDLEMRR
PTYVFAA;DLEMRRPTYVFAAV;LEMRRPTYVFAAVD;EMRRPTYVFAAVDH
;MRRPTYVFAAVDHT;RRPTYVFAAVDHTG;RPTYVFAAVDHTGA;PTYVFA
AVDHTGAD;TYVFAAVDHTGADV;YVFAAVDHTGADVK;VFAAVDHTGADV
KL;FAAVDHTGADVKLY;AAVDHTGADVKLYQ;AVDHTGADVKLYQG;VDHT

Fig. 30 continued

| | | |
|---|---|---|
| | GADVKLYQGA;DHTGADVKLYQGAT;HTGADVKLYQGATI;TGADVKLYQGATIS;GADVKLYQGATISS;ADVKLYQGATISST;DVKLYQGATISSTK;VKLYQGATISSTKI;KLYQGATISSTKID;LYQGATISSTKIDG;YQGATISSTKIDGV;QGATISSTKIDGVG;GATISSTKIDGVGY;ATISSTKIDGVGYP;TISSTKIDGVGYPV;ISSTKIDGVGYPVH;SSTKIDGVGYPVHK;STKIDGVGYPVHKP;TKIDGVGYPVHKPV;KIDGVGYPVHKPVT;IDGVGYPVHKPVTA;DGVGYPVHKPVTAG;GVGYPVHKPVTAGW;VGYPVHKPVTAGWN;GYPVHKPVTAGWNG;YPVHKPVTAGWNGY;PVHKPVTAGWNGYG;VHKPVTAGWNGYGD;HKPVTAGWNGYGDF;KPVTAGWNGYGDFQ;PVTAGWNGYGDFQH;VTAGWNGYGDFQHT;TAGWNGYGDFQHTT;AGWNGYGDFQHTTE;GWNGYGDFQHTTEE;WNGYGDFQHTTEEA;NGYGDFQHTTEEAI;GYGDFQHTTEEAIR;YGDFQHTTEEAIRM;GDFQHTTEEAIRMN;DFQHTTEEAIRMNC;FQHTTEEAIRMNCR;QHTTEEAIRMNCRA;HTTEEAIRMNCRAV;TTEEAIRMNCRAVA;TEEAIRMNCRAVAD;EEAIRMNCRAVADH;EAIRMNCRAVADHL;AIRMNCRAVADHLT;IRMNCRAVADHLTR;RMNCRAVADHLTRL;MNCRAVADHLTRLV;NCRAVADHLTRLVD;CRAVADHLTRLVDA;RAVADHLTRLVDAA;AVADHLTRLVDAAD;VADHLTRLVDAADP;ADHLTRLVDAADPE;DHLTRLVDAADPEV;HLTRLVDAADPEVV;LTRLVDAADPEVVF;TRLVDAADPEVVFV;RLVDAADPEVVFVS;LVDAADPEVVFVSG;VDAADPEVVFVSGE;DAADPEVVFVSGEV;AADPEVVFVSGEVR;ADPEVVFVSGEVRS;DPEVVFVSGEVRSR;PEVVFVSGEVRSRT;EVVFVSGEVRSRTD;VVFVSGEVRSRTDL;VFVSGEVRSRTDLL;FVSGEVRSRTDLLS;VSGEVRSRTDLLST;SGEVRSRTDLLSTL;GEVRSRTDLLSTLP;EVRSRTDLLSTLPQ;VRSRTDLLSTLPQR;RSRTDLLSTLPQRV;SRTDLLSTLPQRVA;RTDLLSTLPQRVAV;TDLLSTLPQRVAVR;DLLSTLPQRVAVRV;LLSTLPQRVAVRVS;LSTLPQRVAVRVSQ;STLPQRVAVRVSQL;TLPQRVAVRVSQLH;LPQRVAVRVSQLHA;PQRVAVRVSQLHAG;QRVAVRVSQLHAGP;RVAVRVSQLHAGPR;VAVRVSQLHAGPRK;AVRVSQLHAGPRKS;VRVSQLHAGPRKSA;RVSQLHAGPRKSAL;VSQLHAGPRKSALD;SQLHAGPRKSALDE;QLHAGPRKSALDEE;LHAGPRKSALDEEE;HAGPRKSALDEEEI;AGPRKSALDEEEIW;GPRKSALDEEEIWD;PRKSALDEEEIWDL;RKSALDEEEIWDLT;KSALDEEEIWDLTS;SALDEEEIWDLTSA;ALDEEEIWDLTSAE;LDEEEIWDLTSAEF;DEEEIWDLTSAEFT;EEEIWDLTSAEFTR;EEIWDLTSAEFTRR;EIWDLTSAEFTRRR;IWDLTSAEFTRRRY;WDLTSAEFTRRRYA;DLTSAEFTRRRYAE;LTSAEFTRRRYAEI;TSAEFTRRRYAEIT;SAEFTRRRYAEITN;AEFTRRRYAEITNV;EFTRRRYAEITNVA;FTRRRYAEITNVAQ;TRRRYAEITNVAQQ;RRRYAEITNVAQQF;RRYAEITNVAQQFE;RYAEITNVAQQFEA;YAEITNVAQQFEAE;AEITNVAQQFEAEI;EITNVAQQFEAEIG;ITNVAQQFEAEIGR;TNVAQQFEAEIGRG;NVAQQFEAEIGRGS;VAQQFEAEIGRGSG;AQQFEAEIGRGSGL;QQFEAEIGRGSGLA;QFEAEIGRGSGLAA;FEAEIGRGSGLAAQ;EAEIGRGSGLAAQG;AEIGRGSGLAAQGL;EIGRGSGLAAQGLA;IGRGSGLAAQGLAE;GRGSGLAAQGLAEV;RGSGLAAQGLAEVC;GSGLAAQGLAEVCA;SGLAAQGLAEVCAA;GLAAQGLAEVCAAL;LAAQGLAEVCAALR;AAQGLAEVCAALRD;AQGLAEVCAALRDG;QGLAEVCAALRDGD;GLAEVCAALRDGDV;LAEVCAALRDGDVD;AEVCAALRDGDVDT;EVCAALRDGDVDTL;VCAALRDGDVDTLI;CAALRDGDVDTLIV;AALRDGDVDTLIVG;ALRDGDVDTLIVGE;LRDGDVDTLIVGEL;RDGDVDTLIVGELG;DGDVDTLIVGELGE;GDVDTLIVGELGEA;DVDTLIVGELGEAT;VDTLIVGELGEATV;DTLIVGELGEATVV;TLIVGELGEATVVT;LIVGELGEATVVTG;IVGELGEATVVTGK;VGELGEATVVTGKA;GELGEATVVTGKAR;ELGEATVVTGKART;LGEATVVTGKARTT;GEATVVTGKARTTV;EATVVTGKARTTVA;ATVVTGKARTTVAR;TVVTGKARTTVARD;VVTGKARTTVARDA;VTGKARTTVARDAD;TGKARTTVARDADM;GKARTTVARDADML;KARTTVARDADMLS;ARTTVARDADMLSE;RTTVARDADMLSEL;TTVARDADMLSELG;TVARDADMLSELGE;VARDADMLSELGEP;A | |

Fig. 30 continued

| | | |
|---|---|---|
| | RDADMLSELGEPV;RDADMLSELGEPVD;DADMLSELGEPVDR;ADMLSELGEPVDRV;DMLSELGEPVDRVA;MLSELGEPVDRVAR;LSELGEPVDRVARA;SELGEPVDRVARAD;ELGEPVDRVARADE;LGEPVDRVARADEA;GEPVDRVARADEAL;EPVDRVARADEALP;PVDRVARADEALPF;VDRVARADEALPFA;DRVARADEALPFAA;RVARADEALPFAAI;VARADEALPFAAIA;ARADEALPFAAIAV;RADEALPFAAIAVG;ADEALPFAAIAVGA;DEALPFAAIAVGAA;EALPFAAIAVGAAL;ALPFAAIAVGAALV;LPFAAIAVGAALVR;PFAAIAVGAALVRD;FAAIAVGAALVRDD;AAIAVGAALVRDDN;AIAVGAALVRDDNR;IAVGAALVRDDNRI;AVGAALVRDDNRIA;VGAALVRDDNRIAP;GAALVRDDNRIAPL;AALVRDDNRIAPLD;ALVRDDNRIAPLDG;LVRDDNRIAPLDGV;VRDDNRIAPLDGVG;RDDNRIAPLDGVGA;DDNRIAPLDGVGAL;DNRIAPLDGVGALL;NRIAPLDGVGALLR;RIAPLDGVGALLRY;IAPLDGVGALLRYA;APLDGVGALLRYAA;PLDGVGALLRYAAT;LDGVGALLRYAATN;DGVGALLRYAATNR;GVGALLRYAATNRL;VGALLRYAATNRLG;GALLRYAATNRLGS;ALLRYAATNRLGSH;LLRYAATNRLGSHR;LRYAATNRLGSHRS;<br>15 mers:<br>MRSERLRWLVAAEGP;RSERLRWLVAAEGPF;SERLRWLVAAEGPFA;ERLRWLVAAEGPFAS;RLRWLVAAEGPFASV;LRWLVAAEGPFASVY;RWLVAAEGPFASVYF;WLVAAEGPFASVYFD;LVAAEGPFASVYFDD;VAAEGPFASVYFDDS;AAEGPFASVYFDDSH;AEGPFASVYFDDSHD;EGPFASVYFDDSHDT;GPFASVYFDDSHDTL;PFASVYFDDSHDTLD;FASVYFDDSHDTLDA;ASVYFDDSHDTLDAV;SVYFDDSHDTLDAVE;VYFDDSHDTLDAVER;YFDDSHDTLDAVERR;FDDSHDTLDAVERRE;DDSHDTLDAVERREA;DSHDTLDAVERREAT;SHDTLDAVERREATW;HDTLDAVERREATWR;DTLDAVERREATWRD;TLDAVERREATWRDV;LDAVERREATWRDVR;DAVERREATWRDVRK;AVERREATWRDVRKH;VERREATWRDVRKHL;ERREATWRDVRKHLE;RREATWRDVRKHLES;REATWRDVRKHLESR;EATWRDVRKHLESRD;ATWRDVRKHLESRDA;TWRDVRKHLESRDAK;WRDVRKHLESRDAKQ;RDVRKHLESRDAKQE;DVRKHLESRDAKQEL;VRKHLESRDAKQELI;RKHLESRDAKQELID;KHLESRDAKQELIDS;HLESRDAKQELIDSL;LESRDAKQELIDSLE;ESRDAKQELIDSLEE;SRDAKQELIDSLEEA;RDAKQELIDSLEEAV;DAKQELIDSLEEAVR;AKQELIDSLEEAVRD;KQELIDSLEEAVRDS;QELIDSLEEAVRDSR;ELIDSLEEAVRDSRP;LIDSLEEAVRDSRPA;IDSLEEAVRDSRPAV;DSLEEAVRDSRPAVG;SLEEAVRDSRPAVGQ;LEEAVRDSRPAVGQR;EEAVRDSRPAVGQRG;EAVRDSRPAVGQRGR;AVRDSRPAVGQRGRA;VRDSRPAVGQRGRAL;RDSRPAVGQRGRALI;DSRPAVGQRGRALIA;SRPAVGQRGRALIAT;RPAVGQRGRALIATG;PAVGQRGRALIATGE;AVGQRGRALIATGEQ;VGQRGRALIATGEQV;GQRGRALIATGEQVL;QRGRALIATGEQVLV;RGRALIATGEQVLVN;GRALIATGEQVLVNE;RALIATGEQVLVNEH;ALIATGEQVLVNEHL;LIATGEQVLVNEHLI;IATGEQVLVNEHLIG;ATGEQVLVNEHLIGP;TGEQVLVNEHLIGPP;GEQVLVNEHLIGPPP;EQVLVNEHLIGPPPA;QVLVNEHLIGPPPAT;VLVNEHLIGPPPATV;LVNEHLIGPPPATVI;VNEHLIGPPPATVIR;NEHLIGPPPATVIRL;EHLIGPPPATVIRLS;HLIGPPPATVIRLSD;LIGPPPATVIRLSDY;IGPPPATVIRLSDYP;GPPPATVIRLSDYPY;PPPATVIRLSDYPYV;PPATVIRLSDYPYVV;PATVIRLSDYPYVVP;ATVIRLSDYPYVVPL;TVIRLSDYPYVVPLI;VIRLSDYPYVVPLID;IRLSDYPYVVPLIDL;RLSDYPYVVPLIDLE;LSDYPYVVPLIDLEM;SDYPYVVPLIDLEMR;DYPYVVPLIDLEMRR;YPYVVPLIDLEMRRP;PYVVPLIDLEMRRPT;YVVPLIDLEMRRPTY;VVPLIDLEMRRPTYV;VPLIDLEMRRPTYVF;PLIDLEMRRPTYVFA;LIDLEMRRPTYVFAA;IDLEMRRPTYVFAAV;DLEMRRPTYVFAAVD;LEMRRPTYVFAAVDH;EMRRPTYVFAAVDHT;MRRPTYVFAAVDHTG;RRPTYVFAAVDHTGA;RPTYVFAAVDHTGAD;PTYVFAAVDHTGADV;TYVFAAVDHTGADVK;YVFAAVDHTGADVKL;VFAAVDHTGADVKLY;FAAVDHTGADVKLYQ;AAVDHTGADVKLYQG | |

Fig. 30 continued

| | | |
|---|---|---|
| | ;AVDHTGADVKLYQGA;VDHTGADVKLYQGAT;DHTGADVKLYQGATI;HTGADVKLYQGATIS;TGADVKLYQGATISS;GADVKLYQGATISST;ADVKLYQGATISSTK;DVKLYQGATISSTKI;VKLYQGATISSTKID;KLYQGATISSTKIDG;LYQGATISSTKIDGV;YQGATISSTKIDGVG;QGATISSTKIDGVGY;GATISSTKIDGVGYP;ATISSTKIDGVGYPV;TISSTKIDGVGYPVH;ISSTKIDGVGYPVHK;SSTKIDGVGYPVHKP;STKIDGVGYPVHKPV;TKIDGVGYPVHKPVT;KIDGVGYPVHKPVTA;IDGVGYPVHKPVTAG;DGVGYPVHKPVTAGW;GVGYPVHKPVTAGWN;VGYPVHKPVTAGWNG;GYPVHKPVTAGWNGY;YPVHKPVTAGWNGYG;PVHKPVTAGWNGYGD;VHKPVTAGWNGYGDF;HKPVTAGWNGYGDFQ;KPVTAGWNGYGDFQH;PVTAGWNGYGDFQHT;VTAGWNGYGDFQHTT;TAGWNGYGDFQHTTE;AGWNGYGDFQHTTEE;GWNGYGDFQHTTEEA;WNGYGDFQHTTEEAI;NGYGDFQHTTEEAIR;GYGDFQHTTEEAIRM;YGDFQHTTEEAIRMN;GDFQHTTEEAIRMNC;DFQHTTEEAIRMNCR;FQHTTEEAIRMNCRA;QHTTEEAIRMNCRAV;HTTEEAIRMNCRAVA;TTEEAIRMNCRAVAD;TEEAIRMNCRAVADH;EEAIRMNCRAVADHL;EAIRMNCRAVADHLT;AIRMNCRAVADHLTR;IRMNCRAVADHLTRL;RMNCRAVADHLTRLV;MNCRAVADHLTRLVD;NCRAVADHLTRLVDA;CRAVADHLTRLVDAA;RAVADHLTRLVDAAD;AVADHLTRLVDAADP;VADHLTRLVDAADPE;ADHLTRLVDAADPEV;DHLTRLVDAADPEVV;HLTRLVDAADPEVVF;LTRLVDAADPEVVFV;TRLVDAADPEVVFVS;RLVDAADPEVVFVSG;LVDAADPEVVFVSGE;VDAADPEVVFVSGEV;DAADPEVVFVSGEVR;AADPEVVFVSGEVRS;ADPEVVFVSGEVRSR;DPEVVFVSGEVRSRT;PEVVFVSGEVRSRTD;EVVFVSGEVRSRTDL;VVFVSGEVRSRTDLL;VFVSGEVRSRTDLLS;FVSGEVRSRTDLLST;VSGEVRSRTDLLSTL;SGEVRSRTDLLSTLP;GEVRSRTDLLSTLPQ;EVRSRTDLLSTLPQR;VRSRTDLLSTLPQRV;RSRTDLLSTLPQRVA;SRTDLLSTLPQRVAV;RTDLLSTLPQRVAVR;TDLLSTLPQRVAVRV;DLLSTLPQRVAVRVS;LLSTLPQRVAVRVSQ;LSTLPQRVAVRVSQL;STLPQRVAVRVSQLH;TLPQRVAVRVSQLHA;LPQRVAVRVSQLHAG;PQRVAVRVSQLHAGP;QRVAVRVSQLHAGPR;RVAVRVSQLHAGPRK;VAVRVSQLHAGPRKS;AVRVSQLHAGPRKSA;VRVSQLHAGPRKSAL;RVSQLHAGPRKSALD;VSQLHAGPRKSALDE;SQLHAGPRKSALDEE;QLHAGPRKSALDEEE;LHAGPRKSALDEEEI;HAGPRKSALDEEEIW;AGPRKSALDEEEIWD;GPRKSALDEEEIWDL;PRKSALDEEEIWDLT;RKSALDEEEIWDLTS;KSALDEEEIWDLTSA;SALDEEEIWDLTSAE;ALDEEEIWDLTSAEF;LDEEEIWDLTSAEFT;DEEEIWDLTSAEFTR;EEEIWDLTSAEFTRR;EEIWDLTSAEFTRRR;EIWDLTSAEFTRRRY;IWDLTSAEFTRRRYA;WDLTSAEFTRRRYAE;DLTSAEFTRRRYAEI;LTSAEFTRRRYAEIT;TSAEFTRRRYAEITN;SAEFTRRRYAEITNV;AEFTRRRYAEITNVA;EFTRRRYAEITNVAQ;FTRRRYAEITNVAQQ;TRRRYAEITNVAQQF;RRRYAEITNVAQQFE;RRYAEITNVAQQFEA;RYAEITNVAQQFEAE;YAEITNVAQQFEAEI;AEITNVAQQFEAEIG;EITNVAQQFEAEIGR;ITNVAQQFEAEIGRG;TNVAQQFEAEIGRGS;NVAQQFEAEIGRGSG;VAQQFEAEIGRGSGL;AQQFEAEIGRGSGLA;QQFEAEIGRGSGLAA;QFEAEIGRGSGLAAQ;FEAEIGRGSGLAAQG;EAEIGRGSGLAAQGL;AEIGRGSGLAAQGLA;EIGRGSGLAAQGLAE;IGRGSGLAAQGLAEV;GRGSGLAAQGLAEVC;RGSGLAAQGLAEVCA;GSGLAAQGLAEVCAA;SGLAAQGLAEVCAAL;GLAAQGLAEVCAALR;LAAQGLAEVCAALRD;AAQGLAEVCAALRDG;AQGLAEVCAALRDGD;QGLAEVCAALRDGDV;GLAEVCAALRDGDVD;LAEVCAALRDGDVDT;AEVCAALRDGDVDTL;EVCAALRDGDVDTLI;VCAALRDGDVDTLIV;CAALRDGDVDTLIVG;AALRDGDVDTLIVGE;ALRDGDVDTLIVGEL;LRDGDVDTLIVGELG;RDGDVDTLIVGELGE;DGDVDTLIVGELGEA;GDVDTLIVGELGEAT;DVDTLIVGELGEATV;VDTLIVGELGEATVV;DTLIVGELGEATVVT;TLIVGELGEATVVTG;LIVGELGEATVVTGK;IVGELGEATVVTGKA;VGELGEATVVTGKAR;GELGEATVVTGKART;ELGEATVVTGKARTT;LGEATVVTGKARTTV;GEATVVTGKARTTV | |

Fig. 30 continued

| | | |
|---|---|---|
| | A;EATVVTGKARTTVAR;ATVVTGKARTTVARD;TVVTGKARTTVARDA;VVTGKARTTVARDAD;VTGKARTTVARDADM;TGKARTTVARDADML;GKARTTVARDADMLS;KARTTVARDADMLSE;ARTTVARDADMLSEL;RTTVARDADMLSELG;TTVARDADMLSELGE;TVARDADMLSELGEP;VARDADMLSELGEPV;ARDADMLSELGEPVD;RDADMLSELGEPVDR;DADMLSELGEPVDRV;ADMLSELGEPVDRVA;DMLSELGEPVDRVAR;MLSELGEPVDRVARA;LSELGEPVDRVARAD;SELGEPVDRVARADE;ELGEPVDRVARADEA;LGEPVDRVARADEAL;GEPVDRVARADEALP;EPVDRVARADEALPF;PVDRVARADEALPFA;VDRVARADEALPFAA;DRVARADEALPFAAI;RVARADEALPFAAIA;VARADEALPFAAIAV;ARADEALPFAAIAVG;RADEALPFAAIAVGA;ADEALPFAAIAVGAA;DEALPFAAIAVGAAL;EALPFAAIAVGAALV;ALPFAAIAVGAALVR;LPFAAIAVGAALVRD;PFAAIAVGAALVRDD;FAAIAVGAALVRDDN;AAIAVGAALVRDDNR;AIAVGAALVRDDNRI;IAVGAALVRDDNRIA;AVGAALVRDDNRIAP;VGAALVRDDNRIAPL;GAALVRDDNRIAPLD;AALVRDDNRIAPLDG;ALVRDDNRIAPLDGV;LVRDDNRIAPLDGVG;VRDDNRIAPLDGVGA;RDDNRIAPLDGVGAL;DDNRIAPLDGVGALL;DNRIAPLDGVGALLR;NRIAPLDGVGALLRY;RIAPLDGVGALLRYA;IAPLDGVGALLRYAA;APLDGVGALLRYAAT;PLDGVGALLRYAATN;LDGVGALLRYAATNR;DGVGALLRYAATNRL;GVGALLRYAATNRLG;VGALLRYAATNRLGS;GALLRYAATNRLGSH;ALLRYAATNRLGSHR;LLRYAATNRLGSHRS;<br>16 mers:<br>MRSERLRWLVAAEGPF;RSERLRWLVAAEGPFA;SERLRWLVAAEGPFAS;ERLRWLVAAEGPFASV;RLRWLVAAEGPFASVY;LRWLVAAEGPFASVYF;RWLVAAEGPFASVYFD;WLVAAEGPFASVYFDD;LVAAEGPFASVYFDDS;VAAEGPFASVYFDDSH;AAEGPFASVYFDDSHD;AEGPFASVYFDDSHDT;EGPFASVYFDDSHDTL;GPFASVYFDDSHDTLD;PFASVYFDDSHDTLDA;FASVYFDDSHDTLDAV;ASVYFDDSHDTLDAVE;SVYFDDSHDTLDAVER;VYFDDSHDTLDAVERR;YFDDSHDTLDAVERRE;FDDSHDTLDAVERREA;DDSHDTLDAVERREAT;DSHDTLDAVERREATW;SHDTLDAVERREATWR;HDTLDAVERREATWRD;DTLDAVERREATWRDV;TLDAVERREATWRDVR;LDAVERREATWRDVRK;DAVERREATWRDVRKH;AVERREATWRDVRKHL;VERREATWRDVRKHLE;ERREATWRDVRKHLES;RREATWRDVRKHLESR;REATWRDVRKHLESRD;EATWRDVRKHLESRDA;ATWRDVRKHLESRDAK;TWRDVRKHLESRDAKQ;WRDVRKHLESRDAKQE;RDVRKHLESRDAKQEL;DVRKHLESRDAKQELI;VRKHLESRDAKQELID;RKHLESRDAKQELIDS;KHLESRDAKQELIDSL;HLESRDAKQELIDSLE;LESRDAKQELIDSLEE;ESRDAKQELIDSLEEA;SRDAKQELIDSLEEAV;RDAKQELIDSLEEAVR;DAKQELIDSLEEAVRD;AKQELIDSLEEAVRDS;KQELIDSLEEAVRDSR;QELIDSLEEAVRDSRP;ELIDSLEEAVRDSRPA;LIDSLEEAVRDSRPAV;IDSLEEAVRDSRPAVG;DSLEEAVRDSRPAVGQ;SLEEAVRDSRPAVGQR;LEEAVRDSRPAVGQRG;EEAVRDSRPAVGQRGR;EAVRDSRPAVGQRGRA;AVRDSRPAVGQRGRAL;VRDSRPAVGQRGRALI;RDSRPAVGQRGRALIA;DSRPAVGQRGRALIAT;SRPAVGQRGRALIATG;RPAVGQRGRALIATGE;PAVGQRGRALIATGEQ;AVGQRGRALIATGEQV;VGQRGRALIATGEQVL;GQRGRALIATGEQVLV;QRGRALIATGEQVLVN;RGRALIATGEQVLVNE;GRALIATGEQVLVNEH;RALIATGEQVLVNEHL;ALIATGEQVLVNEHLI;LIATGEQVLVNEHLIG;IATGEQVLVNEHLIGP;ATGEQVLVNEHLIGPP;TGEQVLVNEHLIGPPP;GEQVLVNEHLIGPPPA;EQVLVNEHLIGPPPAT;QVLVNEHLIGPPPATV;VLVNEHLIGPPPATVI;LVNEHLIGPPPATVIR;VNEHLIGPPPATVIRL;NEHLIGPPPATVIRLS;EHLIGPPPATVIRLSD;HLIGPPPATVIRLSDY;LIGPPPATVIRLSDYP;IGPPPATVIRLSDYPY;GPPPATVIRLSDYPYV;PPPATVIRLSDYPYVV;PPATVIRLSDYPYVVP;PATVIRLSDYPYVVPL;ATVIRLSDYPYVVPLI;TVIRLSDYPYVVPLID;VIRLSDYPYVVPLIDL;IRLSDYPYVVPLIDLE;RLSDYPYVVPLIDLEM;L | |

Fig. 30 continued

| | | |
|---|---|---|
| | SDYPYVVPLIDLEMR;SDYPYVVPLIDLEMRR;DYPYVVPLIDLEMRRP;YPYVVPLIDLEMRRPT;PYVVPLIDLEMRRPTY;YVVPLIDLEMRRPTYV;VVPLIDLEMRRPTYVF;VPLIDLEMRRPTYVFA;PLIDLEMRRPTYVFAA;LIDLEMRRPTYVFAAV;IDLEMRRPTYVFAAVD;DLEMRRPTYVFAAVDH;LEMRRPTYVFAAVDHT;EMRRPTYVFAAVDHTG;MRRPTYVFAAVDHTGA;RRPTYVFAAVDHTGAD;RPTYVFAAVDHTGADV;PTYVFAAVDHTGADVK;TYVFAAVDHTGADVKL;YVFAAVDHTGADVKLY;VFAAVDHTGADVKLYQ;FAAVDHTGADVKLYQG;AAVDHTGADVKLYQGA;AVDHTGADVKLYQGAT;VDHTGADVKLYQGATI;DHTGADVKLYQGATIS;HTGADVKLYQGATISS;TGADVKLYQGATISST;GADVKLYQGATISSTK;ADVKLYQGATISSTKI;DVKLYQGATISSTKID;VKLYQGATISSTKIDG;KLYQGATISSTKIDGV;LYQGATISSTKIDGVG;YQGATISSTKIDGVGY;QGATISSTKIDGVGYP;GATISSTKIDGVGYPV;ATISSTKIDGVGYPVH;TISSTKIDGVGYPVHK;ISSTKIDGVGYPVHKP;SSTKIDGVGYPVHKPV;STKIDGVGYPVHKPVT;TKIDGVGYPVHKPVTA;KIDGVGYPVHKPVTAG;IDGVGYPVHKPVTAGW;DGVGYPVHKPVTAGWN;GVGYPVHKPVTAGWNG;VGYPVHKPVTAGWNGY;GYPVHKPVTAGWNGYG;YPVHKPVTAGWNGYGD;PVHKPVTAGWNGYGDF;VHKPVTAGWNGYGDFQ;HKPVTAGWNGYGDFQH;KPVTAGWNGYGDFQHT;PVTAGWNGYGDFQHTT;VTAGWNGYGDFQHTTE;TAGWNGYGDFQHTTEE;AGWNGYGDFQHTTEEA;GWNGYGDFQHTTEEAI;WNGYGDFQHTTEEAIR;NGYGDFQHTTEEAIRM;GYGDFQHTTEEAIRMN;YGDFQHTTEEAIRMNC;GDFQHTTEEAIRMNCR;DFQHTTEEAIRMNCRA;FQHTTEEAIRMNCRAV;QHTTEEAIRMNCRAVA;HTTEEAIRMNCRAVAD;TTEEAIRMNCRAVADH;TEEAIRMNCRAVADHL;EEAIRMNCRAVADHLT;EAIRMNCRAVADHLTR;AIRMNCRAVADHLTRL;IRMNCRAVADHLTRLV;RMNCRAVADHLTRLVD;MNCRAVADHLTRLVDA;NCRAVADHLTRLVDAA;CRAVADHLTRLVDAAD;RAVADHLTRLVDAADP;AVADHLTRLVDAADPE;VADHLTRLVDAADPEV;ADHLTRLVDAADPEVV;DHLTRLVDAADPEVVF;HLTRLVDAADPEVVFV;LTRLVDAADPEVVFVS;TRLVDAADPEVVFVSG;RLVDAADPEVVFVSGE;LVDAADPEVVFVSGEV;VDAADPEVVFVSGEVR;DAADPEVVFVSGEVRS;AADPEVVFVSGEVRSR;ADPEVVFVSGEVRSRT;DPEVVFVSGEVRSRTD;PEVVFVSGEVRSRTDL;EVVFVSGEVRSRTDLL;VVFVSGEVRSRTDLLS;VFVSGEVRSRTDLLST;FVSGEVRSRTDLLSTL;VSGEVRSRTDLLSTLP;SGEVRSRTDLLSTLPQ;GEVRSRTDLLSTLPQR;EVRSRTDLLSTLPQRV;VRSRTDLLSTLPQRVA;RSRTDLLSTLPQRVAV;SRTDLLSTLPQRVAVR;RTDLLSTLPQRVAVRV;TDLLSTLPQRVAVRVS;DLLSTLPQRVAVRVSQ;LLSTLPQRVAVRVSQL;LSTLPQRVAVRVSQLH;STLPQRVAVRVSQLHA;TLPQRVAVRVSQLHAG;LPQRVAVRVSQLHAGP;PQRVAVRVSQLHAGPR;QRVAVRVSQLHAGPRK;RVAVRVSQLHAGPRKS;VAVRVSQLHAGPRKSA;AVRVSQLHAGPRKSAL;VRVSQLHAGPRKSALD;RVSQLHAGPRKSALDE;VSQLHAGPRKSALDEE;SQLHAGPRKSALDEEE;QLHAGPRKSALDEEEI;LHAGPRKSALDEEEIW;HAGPRKSALDEEEIWD;AGPRKSALDEEEIWDL;GPRKSALDEEEIWDLT;PRKSALDEEEIWDLTS;RKSALDEEEIWDLTSA;KSALDEEEIWDLTSAE;SALDEEEIWDLTSAEF;ALDEEEIWDLTSAEFT;LDEEEIWDLTSAEFTR;DEEEIWDLTSAEFTRR;EEEIWDLTSAEFTRRR;EEIWDLTSAEFTRRRY;EIWDLTSAEFTRRRYA;IWDLTSAEFTRRRYAE;WDLTSAEFTRRRYAEI;DLTSAEFTRRRYAEIT;LTSAEFTRRRYAEITN;TSAEFTRRRYAEITNV;SAEFTRRRYAEITNVA;AEFTRRRYAEITNVAQ;EFTRRRYAEITNVAQQ;FTRRRYAEITNVAQQF;TRRRYAEITNVAQQFE;RRRYAEITNVAQQFEA;RRYAEITNVAQQFEAE;RYAEITNVAQQFEAEI;YAEITNVAQQFEAEIG;AEITNVAQQFEAEIGR;EITNVAQQFEAEIGRG;ITNVAQQFEAEIGRGS;TNVAQQFEAEIGRGSG;NVAQQFEAEIGRGSGL;VAQQFEAEIGRGSGLA;AQQFEAEIGRGSGLAA;QQFEAEIGRGSGLAAQ;QFEAEIGRGSGLAAQG;FEAEIGRGSGLAAQGL;EAEIGRGSGLAAQGLA;AEIGRGSGLAAQGLAE;EIGRGSGLA | |

Fig. 30 continued

| | | |
|---|---|---|
| | AQGLAEV;IGRGSGLAAQGLAEVC;GRGSGLAAQGLAEVCA;RGSGLAAQGLAEVCAA;GSGLAAQGLAEVCAAL;SGLAAQGLAEVCAALR;GLAAQGLAEVCAALRD;LAAQGLAEVCAALRDG;AAQGLAEVCAALRDGD;AQGLAEVCAALRDGDV;QGLAEVCAALRDGDVD;GLAEVCAALRDGDVDT;LAEVCAALRDGDVDTL;AEVCAALRDGDVDTLI;EVCAALRDGDVDTLIV;VCAALRDGDVDTLIVG;CAALRDGDVDTLIVGE;AALRDGDVDTLIVGEL;ALRDGDVDTLIVGELG;LRDGDVDTLIVGELGE;RDGDVDTLIVGELGEA;DGDVDTLIVGELGEAT;GDVDTLIVGELGEATV;DVDTLIVGELGEATVV;VDTLIVGELGEATVVT;DTLIVGELGEATVVTG;TLIVGELGEATVVTGK;LIVGELGEATVVTGKA;IVGELGEATVVTGKAR;VGELGEATVVTGKART;GELGEATVVTGKARTT;ELGEATVVTGKARTTV;LGEATVVTGKARTTVA;GEATVVTGKARTTVAR;EATVVTGKARTTVARD;ATVVTGKARTTVARDA;TVVTGKARTTVARDAD;VVTGKARTTVARDADM;VTGKARTTVARDADML;TGKARTTVARDADMLS;GKARTTVARDADMLSE;KARTTVARDADMLSEL;ARTTVARDADMLSELG;RTTVARDADMLSELGE;TTVARDADMLSELGEP;TVARDADMLSELGEPV;VARDADMLSELGEPVD;ARDADMLSELGEPVDR;RDADMLSELGEPVDRV;DADMLSELGEPVDRVA;ADMLSELGEPVDRVAR;DMLSELGEPVDRVARA;MLSELGEPVDRVARAD;LSELGEPVDRVARADE;SELGEPVDRVARADEA;ELGEPVDRVARADEAL;LGEPVDRVARADEALP;GEPVDRVARADEALPF;EPVDRVARADEALPFA;PVDRVARADEALPFAA;VDRVARADEALPFAAI;DRVARADEALPFAAIA;RVARADEALPFAAIAV;VARADEALPFAAIAVG;ARADEALPFAAIAVGA;RADEALPFAAIAVGAA;ADEALPFAAIAVGAAL;DEALPFAAIAVGAALV;EALPFAAIAVGAALVR;ALPFAAIAVGAALVRD;LPFAAIAVGAALVRDD;PFAAIAVGAALVRDDN;FAAIAVGAALVRDDNR;AAIAVGAALVRDDNRI;AIAVGAALVRDDNRIA;IAVGAALVRDDNRIAP;AVGAALVRDDNRIAPL;VGAALVRDDNRIAPLD;GAALVRDDNRIAPLDG;AALVRDDNRIAPLDGV;ALVRDDNRIAPLDGVG;LVRDDNRIAPLDGVGA;VRDDNRIAPLDGVGAL;RDDNRIAPLDGVGALL;DDNRIAPLDGVGALLR;DNRIAPLDGVGALLRY;NRIAPLDGVGALLRYA;RIAPLDGVGALLRYAA;IAPLDGVGALLRYAAT;APLDGVGALLRYAATN;PLDGVGALLRYAATNR;LDGVGALLRYAATNRL;DGVGALLRYAATNRLG;GVGALLRYAATNRLGS;VGALLRYAATNRLGSH;GALLRYAATNRLGSHR;ALLRYAATNRLGSHRS | |
| 40 | **<NP_214736.1 enoyl-CoA hydratase Rv0222;Mycobacterium tuberculosis H37Rv>**<br>MSSESDAANTEPEVLVEQRDRILIITINRPKAKNAVNAAVSRGLADAMDQLDGDAGLSVAILTGGGGSFCAGMDLKAFARGENVVVEGRGLGFTERPPTKPLIAAVEGYALAGGTELALAADLIVAARDSAFGIPEVKRGLVAGGGGLLRLPERIPYAIAMELALTGDNLPAERAHELGLVNVLAEPGTALDAAIALAEKITANGPLAVVATKRIITESRGWSPDTMFAEQMKILVPVFTSNDAKEGAIAFAERRRPRWTGT<br>8mer<br>MSSESDAA;NTEPEVLV;VEQRDRIL;ILIITINR;IITINRPK;TINRPKAK;RPKAKNAV;AVNAAVSR;NAAVSRGL;GLADAMDQ;QLDGDAGL;GLSVAILT;LTGGGGSF;GMDLKAFA;MDLKAFAR;AFARGENV;FARGENVV;ENVVVEGR;VVVEGRGL;RGLGFTER;FTERPPTK;RPPTKPLI;TKPLIAAV;LIAAVEGY;AAVEGYAL;ALAGGTEL;ELALAADL;ALAADLIV;LAADLIVA;IVAARDSA;VAARDSAF;SAFGIPEV;IPEVKRGL;LVAGGGGL;GLLRLPER;LLRLPERI;RLPERIPY;LPERIPYA;RIPYAIAM;PYAIAMEL;YAIAMELA;AIAMELAL;LTGDNLPA;RAHELGLV;HELGLVNV;ELGLVNVL;VLAEPGTA;LAEPGTAL;ALDAAIAL;AAIALAEK;ALAEKITA;KITANGPL;ITANGPLA;TANGPLAV;GPLAVVAT;LAVVATKR;KRIITESR;GWSPDTMF;WSPDTMFA;DTMFAEQM;TMFAEQMK;FAEQMKIL;AEQMKILV;QMKILVPV;ILVPVFTS;GAIAFAER;AIAFAERR;IAFAERRR;FAERRRPR;AERRRPRW | 197668-199055 |

Fig. 30 continued

| | | |
|---|---|---|
| | 9mer<br>DAANTEPEV;EPEVLVEQR;EVLVEQRDR;VLVEQRDRI;RILIITINR;LIITINRP<br>K;ITINRPKAK;NAVNAAVSR;NAAVSRGLA;AVSRGLADA;GLADAMDQL;AM<br>DQLDGDA;QLDGDAGLS;ILTGGGGSF;SFCAGMDLK;CAGMDLKAF;GMDL<br>KAFAR;KAFARGENV;AFARGENVV;FARGENVVV;VVEGRGLGF;TERPPT<br>KPL;RPPTKPLIA;PPTKPLIAA;PTKPLIAAV;LIAAVEGYA;IAAVEGYAL;AAVE<br>GYALA;YALAGGTEL;ALAGGTELA;LAGGTELAL;TELALAADL;ELALAADLI;<br>LALAADLIV;ALAADLIVA;LAADLIVAA;AADLIVAAR;LIVAARDSA;IVAARDSA<br>F;DSAFGIPEV;SAFGIPEVK;AFGIPEVKR;GIPEVKRGL;IPEVKRGLV;GLVA<br>GGGGL;LVAGGGGLL;GLLRLPERI;LRLPERIPY;RLPERIPYA;LPERIPYAI;E<br>RIPYAIAM;IPYAIAMEL;YAIAMELAL;AIAMELALT;ELALTGDNL;ALTGDNLP<br>A;LPAERAHEL;AERAHELGL;ERAHELGLV;HELGLVNVL;ELGLVNVLA;VLA<br>EPGTAL;AEPGTALDA;EPGTALDAA;TALDAAIAL;ALDAAIALA;DAAIALAEK;<br>EKITANGPL;ITANGPLAV;TANGPLAVV;RIITESRGW;RGWSPDTMF;SPDT<br>MFAEQ;DTMFAEQMK;TMFAEQMKI;MFAEQMKIL;FAEQMKILV;EQMKILVP<br>V;QMKILVPVF;ILVPVFTSN;VPVFTSNDA;PVFTSNDAK;DAKEGAIAF;EGAI<br>AFAER;GAIAFAERR;AIAFAERRR;AFAERRRPR;FAERRRPRW<br>10mer<br>DAANTEPEVL;VLVEQRDRIL;DRILIITINR;ILIITINRPK;IITINRPKAK;RPKAK<br>NAVNA;KAKNAVNAAV;AVNAAVSRGL;AVSRGLADAM;QLDGDAGLSV;AIL<br>TGGGGSF;ILTGGGGSFC;GSFCAGMDLK;FCAGMDLKAF;AGMDLKAFAR;<br>KAFARGENVV;AFARGENVVV;VVVEGRGLGF;LGFTERPPTK;FTERPPTK<br>PL;TERPPTKPLI;RPPTKPLIAA;PPTKPLIAAV;KPLIAAVEGY;PLIAAVEGYA;<br>LIAAVEGYAL;GYALAGGTEL;YALAGGTELA;ALAGGTELAL;ELALAADLIV;<br>ALAADLIVAA;LAADLIVAAR;LIVAARDSAF;VAARDSAFGI;DSAFGIPEVK;S<br>AFGIPEVKR;GIPEVKRGLV;IPEVKRGLVA;GLVAGGGGLL;LVAGGGGLLR;<br>VAGGGGLLRL;LLRLPERIPY;RLPERIPYAI;LPERIPYAIA;PERIPYAIAM;RIP<br>YAIAMEL;IPYAIAMELA;PYAIAMELAL;MELALTGDNL;LALTGDNLPA;ALTG<br>DNLPAE;LTGDNLPAER;NLPAERAHEL;AERAHELGLV;RAHELGLVNV;AH<br>ELGLVNVL;NVLAEPGTAL;EPGTALDAAI;GTALDAAIAL;TALDAAIALA;ALD<br>AAIALAE;DAAIALAEKI;ALAEKITANG;AEKITANGPL;KITANGPLAV;ITANGP<br>LAVV;PLAVVATKRI;ATKRIITESR;SPDTMFAEQM;DTMFAEQMKI;TMFAEQ<br>MKIL;MFAEQMKILV;AEQMKILVPV;EQMKILVPVF;FTSNDAKEGA;KEGAIA<br>FAER;EGAIAFAERR;GAIAFAERRR;IAFAERRRPR<br>11mer<br>ESDAANTEPEV;DAANTEPEVLV;NTEPEVLVEQR;EVLVEQRDRIL;VLVEQ<br>RDRILI;RDRILIITINR;RILIITINRPK;ILIITINRPKA;LIITINRPKAK;TINRPKAKN<br>AV;RPKAKNAVNAA;NAVNAAVSRGL;AVNAAVSRGLA;AAVSRGLADAM;A<br>MDQLDGDAGL;DQLDGDAGLSV;QLDGDAGLSVA;VAILTGGGGSF;ILTGG<br>GGSFCA;SFCAGMDLKAF;FCAGMDLKAFA;CAGMDLKAFAR;DLKAFARGE<br>NV;KAFARGENVVV;GENVVVEGRGL;GLGFTERPPTK;FTERPPTKPLI;RP<br>PTKPLIAAV;KPLIAAVEGYA;PLIAAVEGYAL;LIAAVEGYALA;YALAGGTELA<br>L;ALAGGTELALA;ELALAADLIVA;LALAADLIVAA;ALAADLIVAAR;DLIVAAR<br>DSAF;IVAARDSAFGI;DSAFGIPEVKR;FGIPEVKRGLV;LVAGGGGLLRL;GL<br>LRLPERIPY;LLRLPERIPYA;RLPERIPYAIA;LPERIPYAIAM;ERIPYAIAMEL;<br>RIPYAIAMELA;IPYAIAMELAL;AMELALTGDNL;ELALTGDNLPA;ALTGDNL<br>PAER;LPAERAHELGL;AERAHELGLVN;ERAHELGLVNV;RAHELGLVNVL;<br>GLVNVLAEPGT;LVNVLAEPGTA;VLAEPGTALDA;LAEPGTALDAA;AEPGT<br>ALDAAI;EPGTALDAAIA;ALDAAIALAEK;LAEKITANGPL;AEKITANGPLA;EK<br>ITANGPLAV;KITANGPLAVV;GPLAVVATKRI;VATKRIITESR;DTMFAEQMKI<br>L;TMFAEQMKILV;FAEQMKILVPV;AEQMKILVPVF;ILVPVFTSNDA;LVPVFT<br>SNDAK;FTSNDAKEGAI;EGAIAFAERRR;AIAFAERRRPR;IAFAERRRPRW<br>ESDAANTEPEV;DAANTEPEVLV;NTEPEVLVEQR;EVLVEQRDRIL;VLVEQ | |

Fig. 30 continued

| | | |
|---|---|---|
| | RDRILI;RDRILIITINR;RILIITINRPK;ILIITINRPKA;LIITINRPKAK;TINRPKAKN<br>AV;RPKAKNAVNAA;NAVNAAVSRGL;AVNAAVSRGLA;AAVSRGLADAM;A<br>MDQLDGDAGL;DQLDGDAGLSV;QLDGDAGLSVA;VAILTGGGGSF;ILTGG<br>GGSFCA;SFCAGMDLKAF;FCAGMDLKAFA;CAGMDLKAFAR;DLKAFARGE<br>NV;KAFARGENVVV;GENVVVEGRGL;GLGFTERPPTK;FTERPPTKPLI;RP<br>PTKPLIAAV;KPLIAAVEGYA;PLIAAVEGYAL;LIAAVEGYALA;YALAGGTELA<br>L;ALAGGTELALA;ELALAADLIVA;LALAADLIVAA;ALAADLIVAAR;DLIVAAR<br>DSAF;IVAARDSAFGI;DSAFGIPEVKR;FGIPEVKRGLV;LVAGGGGLLRL;GL<br>LRLPERIPY;LLRLPERIPYA;RLPERIPYAIA;LPERIPYAIAM;ERIPYAIAMEL;<br>RIPYAIAMELA;IPYAIAMELAL;AMELALTGDNL;ELALTGDNLPA;ALTGDNL<br>PAER;LPAERAHELGL;AERAHELGLVN;ERAHELGLVNV;RAHELGLVNVL;<br>GLVNVLAEPGT;LVNVLAEPGTA;VLAEPGTALDA;LAEPGTALDAA;AEPGT<br>ALDAAI;EPGTALDAAIA;ALDAAIALAEK;LAEKITANGPL;AEKITANGPLA;EK<br>ITANGPLAV;KITANGPLAVV;GPLAVVATKRI;VATKRIITESR;DTMFAEQMKI<br>L;TMFAEQMKILV;FAEQMKILVPV;AEQMKILVPVF;ILVPVFTSNDA;LVPVFT<br>SNDAK;FTSNDAKEGAI;EGAIAFAERRR;AIAFAERRRPR;IAFAERRRPRW<br><br>13 mers:<br>MSSESDAANTEPE;SSESDAANTEPEV;SESDAANTEPEVL;ESDAANTEPE<br>VLV;SDAANTEPEVLVE;DAANTEPEVLVEQ;AANTEPEVLVEQR;ANTEPEV<br>LVEQRD;NTEPEVLVEQRDR;TEPEVLVEQRDRI;EPEVLVEQRDRIL;PEVLV<br>EQRDRILI;EVLVEQRDRILII;VLVEQRDRILIIT;LVEQRDRILIITI;VEQRDRILII<br>TIN;EQRDRILIITINR;QRDRILIITINRP;RDRILIITINRPK;DRILIITINRPKA;RILI<br>ITINRPKAK;ILIITINRPKAKN;LIITINRPKAKNA;IITINRPKAKNAV;ITINRPKAK<br>NAVN;TINRPKAKNAVNA;INRPKAKNAVNAA;NRPKAKNAVNAAV;RPKAKN<br>AVNAAVS;PKAKNAVNAAVSR;KAKNAVNAAVSRG;AKNAVNAAVSRGL;KN<br>AVNAAVSRGLA;NAVNAAVSRGLAD;AVNAAVSRGLADA;VNAAVSRGLAD<br>AM;NAAVSRGLADAMD;AAVSRGLADAMDQ;AVSRGLADAMDQL;VSRGLA<br>DAMDQLD;SRGLADAMDQLDG;RGLADAMDQLDGD;GLADAMDQLDGDA;<br>LADAMDQLDGDAG;ADAMDQLDGDAGL;DAMDQLDGDAGLS;AMDQLDG<br>DAGLSV;MDQLDGDAGLSVA;DQLDGDAGLSVAI;QLDGDAGLSVAIL;LDGD<br>AGLSVAILT;DGDAGLSVAILTG;GDAGLSVAILTGG;DAGLSVAILTGGG;AGL<br>SVAILTGGGG;GLSVAILTGGGGS;LSVAILTGGGGSF;SVAILTGGGGSFC;V<br>AILTGGGGSFCA;AILTGGGGSFCAG;ILTGGGGSFCAGM;LTGGGGSFCAG<br>MD;TGGGGSFCAGMDL;GGGGSFCAGMDLK;GGGSFCAGMDLKA;GGSF<br>CAGMDLKAF;GSFCAGMDLKAFA;SFCAGMDLKAFAR;FCAGMDLKAFARG<br>;CAGMDLKAFARGE;AGMDLKAFARGEN;GMDLKAFARGENV;MDLKAFAR<br>GENVV;DLKAFARGENVVV;LKAFARGENVVVE;KAFARGENVVVEG;AFAR<br>GENVVVEGR;FARGENVVVEGRG;ARGENVVVEGRGL;RGENVVVEGRGL<br>G;GENVVVEGRGLGF;ENVVVEGRGLGFT;NVVVEGRGLGFTE;VVVEGRG<br>LGFTER;VVEGRGLGFTERP;VEGRGLGFTERPP;EGRGLGFTERPPT;GRG<br>LGFTERPPTK;RGLGFTERPPTKP;GLGFTERPPTKPL;LGFTERPPTKPLI;G<br>FTERPPTKPLIA;FTERPPTKPLIAA;TERPPTKPLIAAV;ERPPTKPLIAAVE;R<br>PPTKPLIAAVEG;PPTKPLIAAVEGY;PTKPLIAAVEGYA;TKPLIAAVEGYAL;K<br>PLIAAVEGYALA;PLIAAVEGYALAG;LIAAVEGYALAGG;IAAVEGYALAGGT;<br>AAVEGYALAGGTE;AVEGYALAGGTEL;VEGYALAGGTELA;EGYALAGGTE<br>LAL;GYALAGGTELALA;YALAGGTELALAA;ALAGGTELALAAD;LAGGTELA<br>LAADL;AGGTELALAADLI;GGTELALAADLIV;GTELALAADLIVA;TELALAAD<br>LIVAA;ELALAADLIVAAR;LALAADLIVAARD;ALAADLIVAARDS;LAADLIVAA<br>RDSA;AADLIVAARDSAF;ADLIVAARDSAFG;DLIVAARDSAFGI;LIVAARDS<br>AFGIP;IVAARDSAFGIPE;VAARDSAFGIPEV;AARDSAFGIPEVK;ARDSAFG<br>IPEVKR;RDSAFGIPEVKRG;DSAFGIPEVKRGL;SAFGIPEVKRGLV;AFGIPE<br>VKRGLVA;FGIPEVKRGLVAG;GIPEVKRGLVAGG;IPEVKRGLVAGGG;PEV | |

Fig. 30 continued

| | | |
|---|---|---|
| | KRGLVAGGGG;EVKRGLVAGGGGL;VKRGLVAGGGGLL;KRGLVAGGGGLLR;RGLVAGGGGLLRL;GLVAGGGGLLRLP;LVAGGGGLLRLPE;VAGGGGLLRLPER;AGGGGLLRLPERI;GGGGLLRLPERIP;GGGLLRLPERIPY;GGLLRLPERIPYA;GLLRLPERIPYAI;LLRLPERIPYAIA;LRLPERIPYAIAM;RLPERIPYAIAME;LPERIPYAIAMEL;PERIPYAIAMELA;ERIPYAIAMELAL;RIPYAIAMELALT;IPYAIAMELALTG;PYAIAMELALTGD;YAIAMELALTGDN;AIAMELALTGDNL;IAMELALTGDNLP;AMELALTGDNLPA;MELALTGDNLPAE;ELALTGDNLPAER;LALTGDNLPAERA;ALTGDNLPAERAH;LTGDNLPAERAHE;TGDNLPAERAHEL;GDNLPAERAHELG;DNLPAERAHELGL;NLPAERAHELGLV;LPAERAHELGLVN;PAERAHELGLVNV;AERAHELGLVNVL;ERAHELGLVNVLA;RAHELGLVNVLAE;AHELGLVNVLAEP;HELGLVNVLAEPG;ELGLVNVLAEPGT;LGLVNVLAEPGTA;GLVNVLAEPGTAL;LVNVLAEPGTALD;VNVLAEPGTALDA;NVLAEPGTALDAA;VLAEPGTALDAAI;LAEPGTALDAAIA;AEPGTALDAAIAL;EPGTALDAAIALA;PGTALDAAIALAE;GTALDAAIALAEK;TALDAAIALAEKI;ALDAAIALAEKIT;LDAAIALAEKITA;DAAIALAEKITAN;AAIALAEKITANG;AIALAEKITANGP;IALAEKITANGPL;ALAEKITANGPLA;LAEKITANGPLAV;AEKITANGPLAVV;EKITANGPLAVVA;KITANGPLAVVAT;ITANGPLAVVATK;TANGPLAVVATKR;ANGPLAVVATKRI;NGPLAVVATKRII;GPLAVVATKRIIT;PLAVVATKRIITE;LAVVATKRIITES;AVVATKRIITESR;VVATKRIITESRG;VATKRIITESRGW;ATKRIITESRGWS;TKRIITESRGWSP;KRIITESRGWSPD;RIITESRGWSPDT;IITESRGWSPDTM;ITESRGWSPDTMF;TESRGWSPDTMFA;ESRGWSPDTMFAE;SRGWSPDTMFAEQ;RGWSPDTMFAEQM;GWSPDTMFAEQMK;WSPDTMFAEQMKI;SPDTMFAEQMKIL;PDTMFAEQMKILV;DTMFAEQMKILVP;TMFAEQMKILVPV;MFAEQMKILVPVF;FAEQMKILVPVFT;AEQMKILVPVFTS;EQMKILVPVFTSN;QMKILVPVFTSND;MKILVPVFTSNDA;KILVPVFTSNDAK;ILVPVFTSNDAKE;LVPVFTSNDAKEG;VPVFTSNDAKEGA;PVFTSNDAKEGAI;VFTSNDAKEGAIA;FTSNDAKEGAIAF;TSNDAKEGAIAFA;SNDAKEGAIAFAE;NDAKEGAIAFAER;DAKEGAIAFAERR;AKEGAIAFAERRR;KEGAIAFAERRRP;EGAIAFAERRRPR;GAIAFAERRRPRW;AIAFAERRRPRWT;IAFAERRRPRWTG;AFAERRRPRWTGT;<br><br>14 mers:<br>MSSESDAANTEPEV;SSESDAANTEPEVL;SESDAANTEPEVLV;ESDAANTEPEVLVE;SDAANTEPEVLVEQ;DAANTEPEVLVEQR;AANTEPEVLVEQRD;ANTEPEVLVEQRDR;NTEPEVLVEQRDRI;TEPEVLVEQRDRIL;EPEVLVEQRDRILI;PEVLVEQRDRILII;EVLVEQRDRILIIT;VLVEQRDRILIITI;LVEQRDRILIITIN;VEQRDRILIITINR;EQRDRILIITINRP;QRDRILIITINRPK;RDRILIITINRPKA;DRILIITINRPKAK;RILIITINRPKAKN;ILIITINRPKAKNA;LIITINRPKAKNAV;IITINRPKAKNAVN;ITINRPKAKNAVNA;TINRPKAKNAVNAA;INRPKAKNAVNAAV;NRPKAKNAVNAAVS;RPKAKNAVNAAVSR;PKAKNAVNAAVSRG;KAKNAVNAAVSRGL;AKNAVNAAVSRGLA;KNAVNAAVSRGLAD;NAVNAAVSRGLADA;AVNAAVSRGLADAM;VNAAVSRGLADAMD;NAAVSRGLADAMDQ;AAVSRGLADAMDQL;AVSRGLADAMDQLD;VSRGLADAMDQLDG;SRGLADAMDQLDGD;RGLADAMDQLDGDA;GLADAMDQLDGDAG;LADAMDQLDGDAGL;ADAMDQLDGDAGLS;DAMDQLDGDAGLSV;AMDQLDGDAGLSVA;MDQLDGDAGLSVAI;DQLDGDAGLSVAIL;QLDGDAGLSVAILT;LDGDAGLSVAILTG;DGDAGLSVAILTGG;GDAGLSVAILTGGG;DAGLSVAILTGGGG;AGLSVAILTGGGGS;GLSVAILTGGGGSF;LSVAILTGGGGSFC;SVAILTGGGGSFCA;VAILTGGGGSFCAG;AILTGGGGSFCAGM;ILTGGGGSFCAGMD;LTGGGGSFCAGMDL;TGGGGSFCAGMDLK;GGGGSFCAGMDLKA;GGGSFCAGMDLKAF;GGSFCAGMDLKAFA;GSFCAGMDLKAFAR;SFCAGMDLKAFARG;FCAGMDLKAFARGE;CAGMDLKAFARGEN;AGMDLKAFARGENV;GMDLKAFARGENVV;MDLKAFARGENVVV;DLKAFARGENVVVE;LKAFARG | |

Fig. 30 continued

| | | |
|---|---|---|
| | ENVVVEG;KAFARGENVVVEGR;AFARGENVVVEGRG;FARGENVVVEGRGL;ARGENVVVEGRGLG;RGENVVVEGRGLGF;GENVVVEGRGLGFT;ENVVVEGRGLGFTE;NVVVEGRGLGFTER;VVVEGRGLGFTERP;VVEGRGLGFTERPP;VEGRGLGFTERPPT;EGRGLGFTERPPTK;GRGLGFTERPPTKP;RGLGFTERPPTKPL;GLGFTERPPTKPLI;LGFTERPPTKPLIA;GFTERPPTKPLIAA;FTERPPTKPLIAAV;TERPPTKPLIAAVE;ERPPTKPLIAAVEG;RPPTKPLIAAVEGY;PPTKPLIAAVEGYA;PTKPLIAAVEGYAL;TKPLIAAVEGYALA;KPLIAAVEGYALAG;PLIAAVEGYALAGG;LIAAVEGYALAGGT;IAAVEGYALAGGTE;AAVEGYALAGGTEL;AVEGYALAGGTELA;VEGYALAGGTELAL;EGYALAGGTELALA;GYALAGGTELALAA;YALAGGTELALAAD;ALAGGTELALAADL;LAGGTELALAADLI;AGGTELALAADLIV;GGTELALAADLIVA;GTELALAADLIVAA;TELALAADLIVAAR;ELALAADLIVAARD;LALAADLIVAARDS;ALAADLIVAARDSA;LAADLIVAARDSAF;AADLIVAARDSAFG;ADLIVAARDSAFGI;DLIVAARDSAFGIP;LIVAARDSAFGIPE;IVAARDSAFGIPEV;VAARDSAFGIPEVK;AARDSAFGIPEVKR;ARDSAFGIPEVKRG;RDSAFGIPEVKRGL;DSAFGIPEVKRGLV;SAFGIPEVKRGLVA;AFGIPEVKRGLVAG;FGIPEVKRGLVAGG;GIPEVKRGLVAGGG;IPEVKRGLVAGGGG;PEVKRGLVAGGGGL;EVKRGLVAGGGGLL;VKRGLVAGGGGLLR;KRGLVAGGGGLLRL;RGLVAGGGGLLRLP;GLVAGGGGLLRLPE;LVAGGGGLLRLPER;VAGGGGLLRLPERI;AGGGGLLRLPERIP;GGGGLLRLPERIPY;GGGLLRLPERIPYA;GGLLRLPERIPYAI;GLLRLPERIPYAIA;LLRLPERIPYAIAM;LRLPERIPYAIAME;RLPERIPYAIAMEL;LPERIPYAIAMELA;PERIPYAIAMELAL;ERIPYAIAMELALT;RIPYAIAMELALTG;IPYAIAMELALTGD;PYAIAMELALTGDN;YAIAMELALTGDNL;AIAMELALTGDNLP;IAMELALTGDNLPA;AMELALTGDNLPAE;MELALTGDNLPAER;ELALTGDNLPAERA;LALTGDNLPAERAH;ALTGDNLPAERAHE;LTGDNLPAERAHEL;TGDNLPAERAHELG;GDNLPAERAHELGL;DNLPAERAHELGLV;NLPAERAHELGLVN;LPAERAHELGLVNV;PAERAHELGLVNVL;AERAHELGLVNVLA;ERAHELGLVNVLAE;RAHELGLVNVLAEP;AHELGLVNVLAEPG;HELGLVNVLAEPGT;ELGLVNVLAEPGTA;LGLVNVLAEPGTAL;GLVNVLAEPGTALD;LVNVLAEPGTALDA;VNVLAEPGTALDAA;NVLAEPGTALDAAI;VLAEPGTALDAAIA;LAEPGTALDAAIAL;AEPGTALDAAIALA;EPGTALDAAIALAE;PGTALDAAIALAEK;GTALDAAIALAEKI;TALDAAIALAEKIT;ALDAAIALAEKITA;LDAAIALAEKITAN;DAAIALAEKITANG;AAIALAEKITANGP;AIALAEKITANGPL;IALAEKITANGPLA;ALAEKITANGPLAV;LAEKITANGPLAVV;AEKITANGPLAVVA;EKITANGPLAVVAT;KITANGPLAVVATK;ITANGPLAVVATKR;TANGPLAVVATKRI;ANGPLAVVATKRII;NGPLAVVATKRIIT;GPLAVVATKRIITE;PLAVVATKRIITES;LAVVATKRIITESR;AVVATKRIITESRG;VVATKRIITESRGW;VATKRIITESRGWS;ATKRIITESRGWSP;TKRIITESRGWSPD;KRIITESRGWSPDT;RIITESRGWSPDTM;IITESRGWSPDTMF;ITESRGWSPDTMFA;TESRGWSPDTMFAE;ESRGWSPDTMFAEQ;SRGWSPDTMFAEQM;RGWSPDTMFAEQMK;GWSPDTMFAEQMKI;WSPDTMFAEQMKIL;SPDTMFAEQMKILV;PDTMFAEQMKILVP;DTMFAEQMKILVPV;TMFAEQMKILVPVF;MFAEQMKILVPVFT;FAEQMKILVPVFTS;AEQMKILVPVFTSN;EQMKILVPVFTSND;QMKILVPVFTSNDA;MKILVPVFTSNDAK;KILVPVFTSNDAKE;ILVPVFTSNDAKEG;LVPVFTSNDAKEGA;VPVFTSNDAKEGAI;PVFTSNDAKEGAIA;VFTSNDAKEGAIAF;FTSNDAKEGAIAFA;TSNDAKEGAIAFAE;SNDAKEGAIAFAER;NDAKEGAIAFAERR;DAKEGAIAFAERRR;AKEGAIAFAERRRP;KEGAIAFAERRRPR;EGAIAFAERRRPRW;GAIAFAERRRPRWT;AIAFAERRRPRWTG;IAFAERRRPRWTGT;<br><br>15 mers:<br>MSSESDAANTEPEVL;SSESDAANTEPEVLV;SESDAANTEPEVLVE;ESDAANTEPEVLVEQ;SDAANTEPEVLVEQR;DAANTEPEVLVEQRD;AANTEPEV | |

Fig. 30 continued

| | | |
|---|---|---|
| | LVEQRDR;ANTEPEVLVEQRDRI;NTEPEVLVEQRDRIL;TEPEVLVEQRDRILI;EPEVLVEQRDRILII;PEVLVEQRDRILIIT;EVLVEQRDRILIITI;VLVEQRDRILIITIN;LVEQRDRILIITINR;VEQRDRILIITINRP;EQRDRILIITINRPK;QRDRILIITINRPKA;RDRILIITINRPKAK;DRILIITINRPKAKN;RILIITINRPKAKNA;ILIITINRPKAKNAV;LIITINRPKAKNAVN;IITINRPKAKNAVNA;ITINRPKAKNAVNAA;TINRPKAKNAVNAAV;INRPKAKNAVNAAVS;NRPKAKNAVNAAVSR;RPKAKNAVNAAVSRG;PKAKNAVNAAVSRGL;KAKNAVNAAVSRGLA;AKNAVNAAVSRGLAD;KNAVNAAVSRGLADA;NAVNAAVSRGLADAM;AVNAAVSRGLADAMD;VNAAVSRGLADAMDQ;NAAVSRGLADAMDQL;AAVSRGLADAMDQLD;AVSRGLADAMDQLDG;VSRGLADAMDQLDGD;SRGLADAMDQLDGDA;RGLADAMDQLDGDAG;GLADAMDQLDGDAGL;LADAMDQLDGDAGLS;ADAMDQLDGDAGLSV;DAMDQLDGDAGLSVA;AMDQLDGDAGLSVAI;MDQLDGDAGLSVAIL;DQLDGDAGLSVAILT;QLDGDAGLSVAILTG;LDGDAGLSVAILTGG;DGDAGLSVAILTGGG;GDAGLSVAILTGGGG;DAGLSVAILTGGGGS;AGLSVAILTGGGGSF;GLSVAILTGGGGSFC;LSVAILTGGGGSFCA;SVAILTGGGGSFCAG;VAILTGGGGSFCAGM;AILTGGGGSFCAGMD;ILTGGGGSFCAGMDL;LTGGGGSFCAGMDLK;TGGGGSFCAGMDLKA;GGGGSFCAGMDLKAF;GGGSFCAGMDLKAFA;GGSFCAGMDLKAFAR;GSFCAGMDLKAFARG;SFCAGMDLKAFARGE;FCAGMDLKAFARGEN;CAGMDLKAFARGENV;AGMDLKAFARGENVV;GMDLKAFARGENVVV;MDLKAFARGENVVVE;DLKAFARGENVVVEG;LKAFARGENVVVEGR;KAFARGENVVVEGRG;AFARGENVVVEGRGL;FARGENVVVEGRGLG;ARGENVVVEGRGLGF;RGENVVVEGRGLGFT;GENVVVEGRGLGFTE;ENVVVEGRGLGFTER;NVVVEGRGLGFTERP;VVVEGRGLGFTERPP;VVEGRGLGFTERPPT;VEGRGLGFTERPPTK;EGRGLGFTERPPTKP;GRGLGFTERPPTKPL;RGLGFTERPPTKPLI;GLGFTERPPTKPLIA;LGFTERPPTKPLIAA;GFTERPPTKPLIAAV;FTERPPTKPLIAAVE;TERPPTKPLIAAVEG;ERPPTKPLIAAVEGY;RPPTKPLIAAVEGYA;PPTKPLIAAVEGYAL;PTKPLIAAVEGYALA;TKPLIAAVEGYALAG;KPLIAAVEGYALAGG;PLIAAVEGYALAGGT;LIAAVEGYALAGGTE;IAAVEGYALAGGTEL;AAVEGYALAGGTELA;AVEGYALAGGTELAL;VEGYALAGGTELALA;EGYALAGGTELALAA;GYALAGGTELALAAD;YALAGGTELALAADL;ALAGGTELALAADLI;LAGGTELALAADLIV;AGGTELALAADLIVA;GGTELALAADLIVAA;GTELALAADLIVAAR;TELALAADLIVAARD;ELALAADLIVAARDS;LALAADLIVAARDSA;ALAADLIVAARDSAF;LAADLIVAARDSAFG;AADLIVAARDSAFGI;ADLIVAARDSAFGIP;DLIVAARDSAFGIPE;LIVAARDSAFGIPEV;IVAARDSAFGIPEVK;VAARDSAFGIPEVKR;AARDSAFGIPEVKRG;ARDSAFGIPEVKRGL;RDSAFGIPEVKRGLV;DSAFGIPEVKRGLVA;SAFGIPEVKRGLVAG;AFGIPEVKRGLVAGG;FGIPEVKRGLVAGGG;GIPEVKRGLVAGGGG;IPEVKRGLVAGGGGL;PEVKRGLVAGGGGLL;EVKRGLVAGGGGLLR;VKRGLVAGGGGLLRL;KRGLVAGGGGLLRLP;RGLVAGGGGLLRLPE;GLVAGGGGLLRLPER;LVAGGGGLLRLPERI;VAGGGGLLRLPERIP;AGGGGLLRLPERIPY;GGGGLLRLPERIPYA;GGGLLRLPERIPYAI;GGLLRLPERIPYAIA;GLLRLPERIPYAIAM;LLRLPERIPYAIAME;LRLPERIPYAIAMEL;RLPERIPYAIAMELA;LPERIPYAIAMELAL;PERIPYAIAMELALT;ERIPYAIAMELALTG;RIPYAIAMELALTGD;IPYAIAMELALTGDN;PYAIAMELALTGDNL;YAIAMELALTGDNLP;AIAMELALTGDNLPA;IAMELALTGDNLPAE;AMELALTGDNLPAER;MELALTGDNLPAERA;ELALTGDNLPAERAH;LALTGDNLPAERAHE;ALTGDNLPAERAHEL;LTGDNLPAERAHELG;TGDNLPAERAHELGL;GDNLPAERAHELGLV;DNLPAERAHELGLVN;NLPAERAHELGLVNV;LPAERAHELGLVNVL;PAERAHELGLVNVLA;AERAHELGLVNVLAE;ERAHELGLVNVLAEP;RAHELGLVNVLAEPG;AHELGLVNVLAEPGT;HELGLVNVLAEPGTA;ELGLVNVLAEPGTAL;LGLVNVLAEPGTALD;GLVNVLAEPGTALDA;LVNVLAEPGTALDAA;VNVLAEPGTALDAAI;NVLAEPGTALDAAIA;VLAEPGTALDAAIAL;LAEPGTAL | |

Fig. 30 continued

| | | |
|---|---|---|
| | DAAIALA;AEPGTALDAAIALAE;EPGTALDAAIALAEK;PGTALDAAIALAEKI;GTALDAAIALAEKIT;TALDAAIALAEKITA;ALDAAIALAEKITAN;LDAAIALAEKITANG;DAAIALAEKITANGP;AAIALAEKITANGPL;AIALAEKITANGPLA;IALAEKITANGPLAV;ALAEKITANGPLAVV;LAEKITANGPLAVVA;AEKITANGPLAVVAT;EKITANGPLAVVATK;KITANGPLAVVATKR;ITANGPLAVVATKRI;TANGPLAVVATKRII;ANGPLAVVATKRIIT;NGPLAVVATKRIITE;GPLAVVATKRIITES;PLAVVATKRIITESR;LAVVATKRIITESRG;AVVATKRIITESRGW;VVATKRIITESRGWS;VATKRIITESRGWSP;ATKRIITESRGWSPD;TKRIITESRGWSPDT;KRIITESRGWSPDTM;RIITESRGWSPDTMF;IITESRGWSPDTMFA;ITESRGWSPDTMFAE;TESRGWSPDTMFAEQ;ESRGWSPDTMFAEQM;SRGWSPDTMFAEQMK;RGWSPDTMFAEQMKI;GWSPDTMFAEQMKIL;WSPDTMFAEQMKILV;SPDTMFAEQMKILVP;PDTMFAEQMKILVPV;DTMFAEQMKILVPVF;TMFAEQMKILVPVFT;MFAEQMKILVPVFTS;FAEQMKILVPVFTSN;AEQMKILVPVFTSND;EQMKILVPVFTSNDA;QMKILVPVFTSNDAK;MKILVPVFTSNDAKE;KILVPVFTSNDAKEG;ILVPVFTSNDAKEGA;LVPVFTSNDAKEGAI;VPVFTSNDAKEGAIA;PVFTSNDAKEGAIAF;VFTSNDAKEGAIAFA;FTSNDAKEGAIAFAE;TSNDAKEGAIAFAER;SNDAKEGAIAFAERR;NDAKEGAIAFAERRR;DAKEGAIAFAERRRP;AKEGAIAFAERRRPR;KEGAIAFAERRRPRW;EGAIAFAERRRPRWT;GAIAFAERRRPRWTG;AIAFAERRRPRWTGT;<br>16 mers:<br>MSSESDAANTEPEVLV;SSESDAANTEPEVLVE;SESDAANTEPEVLVEQ;ESDAANTEPEVLVEQR;SDAANTEPEVLVEQRD;DAANTEPEVLVEQRDR;AANTEPEVLVEQRDRI;ANTEPEVLVEQRDRIL;NTEPEVLVEQRDRILI;TEPEVLVEQRDRILII;EPEVLVEQRDRILIIT;PEVLVEQRDRILIITI;EVLVEQRDRILIITIN;VLVEQRDRILIITINR;LVEQRDRILIITINRP;VEQRDRILIITINRPK;EQRDRILIITINRPKA;QRDRILIITINRPKAK;RDRILIITINRPKAKN;DRILIITINRPKAKNA;RILIITINRPKAKNAV;ILIITINRPKAKNAVN;LIITINRPKAKNAVNA;IITINRPKAKNAVNAA;ITINRPKAKNAVNAAV;TINRPKAKNAVNAAVS;INRPKAKNAVNAAVSR;NRPKAKNAVNAAVSRG;RPKAKNAVNAAVSRGL;PKAKNAVNAAVSRGLA;KAKNAVNAAVSRGLAD;AKNAVNAAVSRGLADA;KNAVNAAVSRGLADAM;NAVNAAVSRGLADAMD;AVNAAVSRGLADAMDQ;VNAAVSRGLADAMDQL;NAAVSRGLADAMDQLD;AAVSRGLADAMDQLDG;AVSRGLADAMDQLDGD;VSRGLADAMDQLDGDA;SRGLADAMDQLDGDAG;RGLADAMDQLDGDAGL;GLADAMDQLDGDAGLS;LADAMDQLDGDAGLSV;ADAMDQLDGDAGLSVA;DAMDQLDGDAGLSVAI;AMDQLDGDAGLSVAIL;MDQLDGDAGLSVAILT;DQLDGDAGLSVAILTG;QLDGDAGLSVAILTGG;LDGDAGLSVAILTGGG;DGDAGLSVAILTGGGG;GDAGLSVAILTGGGGS;DAGLSVAILTGGGGSF;AGLSVAILTGGGGSFC;GLSVAILTGGGGSFCA;LSVAILTGGGGSFCAG;SVAILTGGGGSFCAGM;VAILTGGGGSFCAGMD;AILTGGGGSFCAGMDL;ILTGGGGSFCAGMDLK;LTGGGGSFCAGMDLKA;TGGGGSFCAGMDLKAF;GGGGSFCAGMDLKAFA;GGGSFCAGMDLKAFAR;GGSFCAGMDLKAFARG;GSFCAGMDLKAFARGE;SFCAGMDLKAFARGEN;FCAGMDLKAFARGENV;CAGMDLKAFARGENVV;AGMDLKAFARGENVVV;GMDLKAFARGENVVVE;MDLKAFARGENVVVEG;DLKAFARGENVVVEGR;LKAFARGENVVVEGRG;KAFARGENVVVEGRGL;AFARGENVVVEGRGLG;FARGENVVVEGRGLGF;ARGENVVVEGRGLGFT;RGENVVVEGRGLGFTE;GENVVVEGRGLGFTER;ENVVVEGRGLGFTERP;NVVVEGRGLGFTERPP;VVVEGRGLGFTERPPT;VVEGRGLGFTERPPTK;VEGRGLGFTERPPTKP;EGRGLGFTERPPTKPL;GRGLGFTERPPTKPLI;RGLGFTERPPTKPLIA;GLGFTERPPTKPLIAA;LGFTERPPTKPLIAAV;GFTERPPTKPLIAAVE;FTERPPTKPLIAAVEG;TERPPTKPLIAAVEGY;ERPPTKPLIAAVEGYA;RPPTKPLIAAVEGYAL;PPTKPLIAAVEGYALA;PTKPLIAAVEGYALAG;TKPLIAAVEGYALAGG;KPLIAA | |

Fig. 30 continued

| | | |
|---|---|---|
| | VEGYALAGGT;PLIAAVEGYALAGGTE;LIAAVEGYALAGGTEL;IAAVEGYALAGGTELA;AAVEGYALAGGTELAL;AVEGYALAGGTELALA;VEGYALAGGTELALAA;EGYALAGGTELALAAD;GYALAGGTELALAADL;YALAGGTELALAADLI;ALAGGTELALAADLIV;LAGGTELALAADLIVA;AGGTELALAADLIVAA;GGTELALAADLIVAAR;GTELALAADLIVAARD;TELALAADLIVAARDS;ELALAADLIVAARDSA;LALAADLIVAARDSAF;ALAADLIVAARDSAFG;LAADLIVAARDSAFGI;AADLIVAARDSAFGIP;ADLIVAARDSAFGIPE;DLIVAARDSAFGIPEV;LIVAARDSAFGIPEVK;IVAARDSAFGIPEVKR;VAARDSAFGIPEVKRG;AARDSAFGIPEVKRGL;ARDSAFGIPEVKRGLV;RDSAFGIPEVKRGLVA;DSAFGIPEVKRGLVAG;SAFGIPEVKRGLVAGG;AFGIPEVKRGLVAGGG;FGIPEVKRGLVAGGGG;GIPEVKRGLVAGGGGL;IPEVKRGLVAGGGGLL;PEVKRGLVAGGGGLLR;EVKRGLVAGGGGLLRL;VKRGLVAGGGGLLRLP;KRGLVAGGGGLLRLPE;RGLVAGGGGLLRLPER;GLVAGGGGLLRLPERI;LVAGGGGLLRLPERIP;VAGGGGLLRLPERIPY;AGGGGLLRLPERIPYA;GGGGLLRLPERIPYAI;GGGLLRLPERIPYAIA;GGLLRLPERIPYAIAM;GLLRLPERIPYAIAME;LLRLPERIPYAIAMEL;LRLPERIPYAIAMELA;RLPERIPYAIAMELAL;LPERIPYAIAMELALT;PERIPYAIAMELALTG;ERIPYAIAMELALTGD;RIPYAIAMELALTGDN;IPYAIAMELALTGDNL;PYAIAMELALTGDNLP;YAIAMELALTGDNLPA;AIAMELALTGDNLPAE;IAMELALTGDNLPAER;AMELALTGDNLPAERA;MELALTGDNLPAERAH;ELALTGDNLPAERAHE;LALTGDNLPAERAHEL;ALTGDNLPAERAHELG;LTGDNLPAERAHELGL;TGDNLPAERAHELGLV;GDNLPAERAHELGLVN;DNLPAERAHELGLVNV;NLPAERAHELGLVNVL;LPAERAHELGLVNVLA;PAERAHELGLVNVLAE;AERAHELGLVNVLAEP;ERAHELGLVNVLAEPG;RAHELGLVNVLAEPGT;AHELGLVNVLAEPGTA;HELGLVNVLAEPGTAL;ELGLVNVLAEPGTALD;LGLVNVLAEPGTALDA;GLVNVLAEPGTALDAA;LVNVLAEPGTALDAAI;VNVLAEPGTALDAAIA;NVLAEPGTALDAAIAL;VLAEPGTALDAAIALA;LAEPGTALDAAIALAE;AEPGTALDAAIALAEK;EPGTALDAAIALAEKI;PGTALDAAIALAEKIT;GTALDAAIALAEKITA;TALDAAIALAEKITAN;ALDAAIALAEKITANG;LDAAIALAEKITANGP;DAAIALAEKITANGPL;AAIALAEKITANGPLA;AIALAEKITANGPLAV;IALAEKITANGPLAVV;ALAEKITANGPLAVVA;LAEKITANGPLAVVAT;AEKITANGPLAVVATK;EKITANGPLAVVATKR;KITANGPLAVVATKRI;ITANGPLAVVATKRII;TANGPLAVVATKRIIT;ANGPLAVVATKRIITE;NGPLAVVATKRIITES;GPLAVVATKRIITESR;PLAVVATKRIITESRG;LAVVATKRIITESRGW;AVVATKRIITESRGWS;VVATKRIITESRGWSP;VATKRIITESRGWSPD;ATKRIITESRGWSPDT;TKRIITESRGWSPDTM;KRIITESRGWSPDTMF;RIITESRGWSPDTMFA;IITESRGWSPDTMFAE;ITESRGWSPDTMFAEQ;TESRGWSPDTMFAEQM;ESRGWSPDTMFAEQMK;SRGWSPDTMFAEQMKI;RGWSPDTMFAEQMKIL;GWSPDTMFAEQMKILV;WSPDTMFAEQMKILVP;SPDTMFAEQMKILVPV;PDTMFAEQMKILVPVF;DTMFAEQMKILVPVFT;TMFAEQMKILVPVFTS;MFAEQMKILVPVFTSN;FAEQMKILVPVFTSND;AEQMKILVPVFTSNDA;EQMKILVPVFTSNDAK;QMKILVPVFTSNDAKE;MKILVPVFTSNDAKEG;KILVPVFTSNDAKEGA;ILVPVFTSNDAKEGAI;LVPVFTSNDAKEGAIA;VPVFTSNDAKEGAIAF;PVFTSNDAKEGAIAFA;VFTSNDAKEGAIAFAE;FTSNDAKEGAIAFAER;TSNDAKEGAIAFAERR;SNDAKEGAIAFAERRR;NDAKEGAIAFAERRRP;DAKEGAIAFAERRRPR;AKEGAIAFAERRRPRW;KEGAIAFAERRRPRWT;EGAIAFAERRRPRWTG;GAIAFAERRRPRWTGT | |
| 41 | **<YP_178022.1 PPE FAMILY PROTEIN Rv3873;Mycobacterium tuberculosis H37Rv]>** MLWHAMPPELNTARLMAGAGPAPMLAAAAGWQTLSAALDAQAVELTARLNSLGEAWTGGGSDKALAAATPMVVWLQTASTQAKTRAMQATAQAAAYTQAMATTPSLPEIAANHITQAVLTATNFFGINTIPIALTEMDYFIRMWNQAALAMEVYQAETAVNTLFEKLEPMASILDPGASQSTTNPIFGMPSPGSSTPVGQLP | 199056-199521 |

Fig. 30 continued

PAATQTLGQLGEMSGPMQQLTQPLQQVTSLFSQVGGTGGGNPADEEAA
QMGLLGTSPLSNHPLAGGSGPSAGAGLLRAESLPGAGGSLTRTPLMSQLI
EKPVAPSVMPAAAAGSSATGGAAPVGAGAMGQGAQSGGSTRPGLVAPA
PLAQEREEDDEDDWDEEDDW

8mer
MLWHAMPP;WHAMPPEL;AMPPELNT;MPPELNTA;ELNTARLM;LMAGAG
PA;GPAPMLAA;APMLAAAA;MLAAAAGW;AAAGWQTL;WQTLSAAL;TLSAA
LDA;AALDAQAV;AQAVELTA;QAVELTAR;LTARLNSL;RLNSLGEA;SLGEA
WTG;ALAAATPM;LAAATPMV;AAATPMVV;AATPMVVW;ATPMVVWL;MVV
WLQTA;WLQTASTQ;LQTASTQA;QTASTQAK;TQAKTRAM;KTRAMQAT;A
MQATAQA;MQATAQAA;ATAQAAAY;AQAAAYTQ;QAAAYTQA;AAAYTQAM
;QAMATTPS;AMATTPSL;TTPSLPEI;SLPEIAAN;LPEIAANH;EIAANHIT;NHI
TQAVL;TQAVLTAT;AVLTATNF;VLTATNFF;TATNFFGI;FGINTIPI;GINTIPIA;
NTIPIALT;IPIALTEM;IALTEMDY;ALTEMDYF;TEMDYFIR;EMDYFIRM;DYFI
RMWN;FIRMWNQA;RMWNQAAL;QAALAMEV;AALAMEVY;ALAMEVYQ;LA
MEVYQA;EVYQAETA;VYQAETAV;AETAVNTL;ETAVNTLF;AVNTLFEK;TLF
EKLEP;KLEPMASI;LEPMASIL;ILDPGASQ;SQSTTNPI;TTNPIFGM;NPIFGM
PS;MPSPGSST;SPGSSTPV;GQLPPAAT;QLPPAATQ;LPPAATQT;PPAATQ
TL;TLGQLGEM;EMSGPMQQ;MQQLTQPL;QLTQPLQQ;LTQPLQQV;PLQQ
VTSL;LQQVTSLF;VTSLFSQV;NPADEEAA;EEAAQMGL;EAAQMGLL;AQM
GLLGT;GLLGTSPL;SPLSNHPL;PLSNHPLA;GPSAGAGL;SAGAGLLR;GLL
RAESL;LPGAGGSL;SLTRTPLM;TPLMSQLI;LMSQLIEK;SQLIEKPV;QLIEK
PVA;KPVAPSVM;APSVMPAA;SVMPAAAA;MPAAAAGS;AAAAGSSA;ATG
GAAPV;APVGAGAM;AQSGGSTR;RPGLVAPA;GLVAPAPL;LVAPAPLA;EE
DDEDDW
9mer
MLWHAMPPE;LWHAMPPEL;AMPPELNTA;MPPELNTAR;PPELNTARL;EL
NTARLMA;NTARLMAGA;RLMAGAGPA;MAGAGPAPM;GPAPMLAAA;APM
LAAAAG;MLAAAAGWQ;AAAAGWQTL;AAGWQTLSA;GWQTLSAAL;TLSAA
LDAQ;LSAALDAQA;SAALDAQAV;ALDAQAVEL;AQAVELTAR;QAVELTARL
;ELTARLNSL;RLNSLGEAW;KALAAATPM;ALAAATPMV;LAAATPMVV;AAA
TPMVVW;AATPMVVWL;PMVVWLQTA;MVVWLQTAS;WLQTASTQA;LQTA
STQAK;TASTQAKTR;STQAKTRAM;KTRAMQATA;RAMQATAQA;AMQATA
QAA;MQATAQAAA;QATAQAAAY;AQAAAYTQA;QAAAYTQAM;TQAMATTP
S;QAMATTPSL;ATTPSLPEI;TTPSLPEIA;TPSLPEIAA;LPEIAANHI;AANHIT
QAV;HITQAVLTA;QAVLTATNF;AVLTATNFF;LTATNFFGI;FFGINTIPI;FGIN
TIPIA;GINTIPIAL;NTIPIALTE;TIPIALTEM;PIALTEMDY;IALTEMDYF;ALTEM
DYFI;LTEMDYFIR;TEMDYFIRM;DYFIRMWNQ;FIRMWNQAA;IRMWNQAAL
;RMWNQAALA;MWNQAALAM;NQAALAMEV;QAALAMEVY;ALAMEVYQA;
AMEVYQAET;MEVYQAETA;EVYQAETAV;YQAETAVNT;QAETAVNTL;AET
AVNTLF;ETAVNTLFE;TAVNTLFEK;AVNTLFEKL;TLFEKLEPM;EKLEPMASI
;KLEPMASIL;SILDPGASQ;ILDPGASQS;SQSTTNPIF;STTNPIFGM;MPSPG
SSTP;TPVGQLPPA;GQLPPAATQ;QLPPAATQT;LPPAATQTL;QTLGQLGE
M;QLGEMSGPM;GEMSGPMQQ;EMSGPMQQL;PMQQLTQPL;QLTQPLQQ
V;QPLQQVTSL;QQVTSLFSQ;QVTSLFSQV;SLFSQVGGT;NPADEEAAQ;D
EEAAQMGL;EEAAQMGLL;AQMGLLGTS;MGLLGTSPL;GLLGTSPLS;TSPL
SNHPL;SPLSNHPLA;GPSAGAGLL;SLPGAGGSL;LPGAGGSLT;RTPLMSQ
LI;PLMSQLIEK;MSQLIEKPV;IEKPVAPSV;PVAPSVMPA;APSVMPAAA;MP
AAAAGSS;SATGGAAPV;GAAPVGAGA;AAPVGAGAM;APVGAGAMG;GAQ
SGGSTR;GLVAPAPLA
10mer
MLWHAMPPEL;HAMPPELNTA;MPPELNTARL;LMAGAGPAPM;MAGAGPA

Fig. 30 continued

| | | |
|---|---|---|
| | PML;GPAPMLAAAA;APMLAAAAGW;MLAAAAGWQT;LAAAAGWQTL;AAAGWQTLSA;AAGWQTLSAA;TLSAALDAQA;LSAALDAQAV;AALDAQAVEL;ALDAQAVELT;DAQAVELTAR;AQAVELTARL;VELTARLNSL;RLNSLGEAWT;DKALAAATPM;KALAAATPMV;ALAAATPMVV;LAAATPMVVW;AAATPMVVWL;TPMVVWLQTA;MVVWLQTAST;WLQTASTQAK;QTASTQAKTR;TQAKTRAMQA;KTRAMQATAQ;RAMQATAQAA;AMQATAQAAA;MQATAQAAAY;AQAAAYTQAM;QAAAYTQAMA;TQAMATTPSL;MATTPSLPEI;TTPSLPEIAA;SLPEIAANHI;LPEIAANHIT;EIAANHITQA;IAANHITQAV;AANHITQAVL;TQAVLTATNF;QAVLTATNFF;VLTATNFFGI;ATNFFGINTI;NFFGINTIPI;FGINTIPIAL;NTIPIALTEM;IPIALTEMDY;PIALTEMDYF;IALTEMDYFI;ALTEMDYFIR;LTEMDYFIRM;TEMDYFIRMW;FIRMWNQAAL;RMWNQAALAM;NQAALAMEVY;LAMEVYQAET;AMEVYQAETA;MEVYQAETAV;YQAETAVNTL;QAETAVNTLF;ETAVNTLFEK;TAVNTLFEKL;NTLFEKLEPM;TLFEKLEPMA;PMASILDPGA;SILDPGASQS;ILDPGASQST;GASQSTTNPI;TTNPIFGMPS;MPSPGSSTPV;TPVGQLPPAA;GQLPPAATQT;QLPPAATQTL;GQLGEMSGPM;GEMSGPMQQL;EMSGPMQQLT;GPMQQLTQPL;QQLTQPLQQV;QLTQPLQQVT;TQPLQQVTSL;QPLQQVTSLF;QQVTSLFSQV;NPADEEAAQM;DEEAAQMGLL;AQMGLLGTSP;QMGLLGTSPL;GTSPLSNHPL;HPLAGGSGPS;PLAGGSGPSA;LLRAESLPGA;AESLPGAGGS;SLPGAGGSLT;SLTRTPLMSQ;LTRTPLMSQL;TPLMSQLIEK;LMSQLIEKPV;LIEKPVAPSV;KPVAPSVMPA;PVAPSVMPAA;APSVMPAAAA;SVMPAAAAGS;MPAAAAGSSA;SSATGGAAPV;GAAPVGAGAM;STRPGLVAPA;RPGLVAPAPL;VAPAPLAQER<br>11mer<br>HAMPPELNTAR;AMPPELNTARL;MPPELNTARLM;ELNTARLMAGA;RLMAGAGPAPM;LMAGAGPAPML;MAGAGPAPMLA;PMLAAAAGWQT;MLAAAAGWQTL;AAAAGWQTLSA;AAAGWQTLSAA;AAGWQTLSAAL;TLSAALDAQAV;SAALDAQAVEL;ALDAQAVELTA;LTARLNSLGEA;EAWTGGGSDKA;WTGGGSDKALA;KALAAATPMVV;ALAAATPMVVW;LAAATPMVVWL;ATPMVVWLQTA;TPMVVWLQTAS;PMVVWLQTAST;MVVWLQTASTQ;VWLQTASTQAK;WLQTASTQAKT;LQTASTQAKTR;QTASTQAKTRA;TASTQAKTRAM;KTRAMQATAQA;RAMQATAQAAA;AMQATAQAAAY;MQATAQAAAYT;ATAQAAAYTQA;TAQAAAYTQAM;AQAAAYTQAMA;QAAAYTQAMAT;YTQAMATTPSL;AMATTPSLPEI;MATTPSLPEIA;SLPEIAANHIT;EIAANHITQAV;IAANHITQAVL;ITQAVLTATNF;TQAVLTATNFF;AVLTATNFFGI;LTATNFFGINT;TATNFFGINTI;TNFFGINTIPI;FFGINTIPIAL;TIPIALTEMDY;IPIALTEMDYF;IALTEMDYFIR;ALTEMDYFIRM;EMDYFIRMWNQ;MDYFIRMWNQA;DYFIRMWNQAA;YFIRMWNQAAL;FIRMWNQAALA;IRMWNQAALAM;QAALAMEVYQA;ALAMEVYQAET;LAMEVYQAETA;AMEVYQAETAV;EVYQAETAVNT;VYQAETAVNTL;YQAETAVNTLF;AETAVNTLFEK;ETAVNTLFEKL;NTLFEKLEPMA;TLFEKLEPMAS;FEKLEPMASIL;EPMASILDPGA;SILDPGASQST;ILDPGASQSTT;GASQSTTNPIF;SQSTTNPIFGM;GMPSPGSSTPV;MPSPGSSTPVG;SPGSSTPVGQL;TPVGQLPPAAT;GQLPPAATQTL;ATQTLGQLGEM;QLGEMSGPMQQ;EMSGPMQQLTQ;MQQLTQPLQQV;LTQPLQQVTSL;TQPLQQVTSLF;PLQQVTSLFSQ;LQQVTSLFSQV;EEAAQMGLLGT;AQMGLLGTSPL;HPLAGGSGPSA;GLLRAESLPGA;AESLPGAGGSL;SLPGAGGSLTR;LPGAGGSLTRT;SLTRTPLMSQL;LTRTPLMSQLI;RTPLMSQLIEK;PLMSQLIEKPV;LMSQLIEKPVA;QLIEKPVAPSV;LIEKPVAPSVM;KPVAPSVMPAA;APSVMPAAAAG;VMPAAAAGSSA;MPAAAAGSSAT;AAAGSSATGGA;AQSGGSTRPGL;TRPGLVAPAPL;RPGLVAPAPLA;LVAPAPLAQER | |
| 42 | **<NP_214802.1 LOW MOLECULAR WEIGHT PROTEIN ANTIGEN 7 ESXH (10 kDa ANTIGEN) (CFP-7) (PROTEIN TB10.4) Rv0288;Mycobacterium tuberculosis H37Rv>**<br>MSQIMYNYPAMLGHAGDMAGYAGTLQSLGAEIAVEQAALQSAWQGDTGI | 199522-199640 |

Fig. 30 continued

| | | |
|---|---|---|
| | TYQAWQAQWNQAMEDLVRAYHAMSSTHEANTMAMMARDTAEAAKWGG<br><br>8mer<br>MSQIMYNY;SQIMYNYP;QIMYNYPA;IMYNYPAM;MYNYPAML;YPAMLGHA;HAGDMAGY;MAGYAGTL;YAGTLQSL;GTLQSLGA;LQSLGAEI;SLGAEIAV;AEIAVEQA;EIAVEQAA;IAVEQAAL;QAALQSAW;TGITYQAW;ITYQAWQA;YQAWQAQW;WQAQWNQA;QAQWNQAM;NQAMEDLV;QAMEDLVR;AMEDLVRA;MEDLVRAY;DLVRAYHA;LVRAYHAM;AMSSTHEA;STHEANTM;EANTMAMM;NTMAMMAR;AMMARDTA;MARDTAEA;DTAEAAKW<br>9mer<br>SQIMYNYPA;QIMYNYPAM;IMYNYPAML;YPAMLGHAG;MLGHAGDMA;DMAGYAGTL;GYAGTLQSL;TLQSLGAEI;LQSLGAEIA;AEIAVEQAA;EIAVEQAAL;EQAALQSAW;SAWQGDTGI;WQGDTGITY;DTGITYQAW;TYQAWQAQW;WQAQWNQAM;QAMEDLVRA;AMEDLVRAY;DLVRAYHAM;RAYHAMSST;HAMSSTHEA;THEANTMAM;EANTMAMMA;MAMMARDTA;MMARDTAEA<br>10mer<br>MSQIMYNYPA;SQIMYNYPAM;QIMYNYPAML;IMYNYPAMLG;YPAMLGHAGD;AMLGHAGDMA;LGHAGDMAGY;TLQSLGAEIA;LQSLGAEIAV;SLGAEIAVEQ;AEIAVEQAAL;QSAWQGDTGI;SAWQGDTGIT;WQGDTGITYQ;ITYQAWQAQW;YQAWQAQWNQ;QAWQAQWNQA;WQAQWNQAME;AQWNQAMEDL;NQAMEDLVRA;QAMEDLVRAY;MSSTHEANTM;STHEANTMAM;EANTMAMMAR;TMAMMARDTA;AMMARDTAEA;MMARDTAEAA;MARDTAEAAK<br>11mer<br>MSQIMYNYPAM;SQIMYNYPAML;IMYNYPAMLGH;YPAMLGHAGDM;MLGHAGDMAGY;MAGYAGTLQSL;TLQSLGAEIAV;SLGAEIAVEQA;AEIAVEQAALQ;IAVEQAALQSA;LQSAWQGDTGI;SAWQGDTGITY;WQGDTGITYQA;DTGITYQAWQA;GITYQAWQAQW;YQAWQAQWNQA;QAWQAQWNQAM;AQWNQAMEDLV;NQAMEDLVRAY;AMEDLVRAYHA;MEDLVRAYHAM;LVRAYHAMSST;AMSSTHEANTM;STHEANTMAMM;HEANTMAMMAR;NTMAMMARDTA;MAMMARDTAEA;AMMARDTAEAA;MMARDTAEAAK;MARDTAEAAKW | |
| 43 | **<CAE55426.1 PUTATIVE ESAT-6 LIKE PROTEIN ESXN (ESAT-6 LIKE PROTEIN 5) Rv1793;Mycobacterium tuberculosis H37Rv>**<br>MTINYQFGDVDAHGAMIRAQAASLEAEHQAIVRDVLAAGDFWGGAGSVACQEFITQLGRNFQVIYEQANAHGQKVQAAGNNMAQTDSAVGSSWA<br><br>8mer<br>YQFGDVDA;DVDAHGAM;DAHGAMIR;AMIRAQAA;IRAQAASL;AQAASLEA;SLEAEHQA;LEAEHQAI;IVRDVLAA;VLAAGDFW;GSVACQEF;SVACQEFI;EFITQLGR;ITQLGRNF;QLGRNFQV;GRNFQVIY;FQVIYEQA;VIYEQANA;QANAHGQK;VQAAGNNM;QAAGNNMA;NMAQTDSA;MAQTDSAV;DSAVGSSW;SAVGSSWA<br>9mer<br>MTINYQFGD;TINYQFGDV;YQFGDVDAH;DVDAHGAMI;HGAMIRAQA;MIRAQAASL;RAQAASLEA;AQAASLEAE;SLEAEHQAI;EAEHQAIVR;HQAIVRDVL;VLAAGDFWG;DFWGGAGSV;TQLGRNFQV;QLGRNFQVI;QVIYEQANA;EQANAHGQK;QANAHGQKV;VQAAGNNMA;NNMAQTDSA;NMAQTDSAV;AQTDSAVGS<br>10mer<br>MTINYQFGDV;DVDAHGAMIR;HGAMIRAQAA;AMIRAQAASL;AQAASLEAEH;SLEAEHQAIV;AEHQAIVRDV;EHQAIVRDVL;VLAAGDFWGG;LAAGDFWGGA;EFITQLGRNF;ITQLGRNFQV;TQLGRNFQVI;QLGRNFQVIY;FQVIYEQ | 199641-199727 |

Fig. 30 continued

| | | |
|---|---|---|
| | ANA;QVIYEQANAH;VQAAGNNMAQ;NNMAQTDSAV;QTDSAVGSSW<br>11mer<br>YQFGDVDAHGA;DVDAHGAMIRA;GAMIRAQAASL;MIRAQAASLEA;ASLEAEHQAIV;AEHQAIVRDVL;HQAIVRDVLAA;IVRDVLAAGDF;VLAAGDFWGGA;SVACQEFITQL;QEFITQLGRNF;FITQLGRNFQV;TQLGRNFQVIY;FQVIYEQANAH;VIYEQANAHGQ;IYEQANAHGQK;YEQANAHGQKV;GQKVQAAGNNM;VQAAGNNMAQT;AQTDSAVGSSW | |
| 44 | **<CAE55648.1 6 KDA EARLY SECRETORY ANTIGENIC TARGET ESXA (ESAT-6) Rv3875;Mycobacterium tuberculosis H37Rv>**<br>MTEQQWNFAGIEAAASAIQGNVTSIHSLLDEGKQSLTKLAAAWGGSGSEAYQGVQQKWDATATELNNALQNLARTISEAGQAMASTEGNVTGMFA<br><br>8mer<br>MTEQQWNF;QQWNFAGI;IQGNVTSI;NVTSIHSL;HSLLDEGK;SLLDEGKQ;LLDEGKQS;KQSLTKLA;SLTKLAAA;LTKLAAAW;AYQGVQQK;NALQNLAR;ALQNLART;LQNLARTI;ISEAGQAM;MASTEGNV<br>9mer<br>MTEQQWNFA;EQQWNFAGI;AASAIQGNV;AIQGNVTSI;NVTSIHSLL;SLLDEGKQS;LLDEGKQSL;KQSLTKLAA;KLAAAWGGS;WGGSGSEAY;SGSEAYQGV;EAYQGVQQK;AYQGVQQKW;VQQKWDATA;ATATELNNA;TATELNNAL;ELNNALQNL;NNALQNLAR;ALQNLARTI;NLARTISEA;TISEAGQAM;AMASTEGNV;MASTEGNVT;STEGNVTGM;TEGNVTGMF<br>10mer<br>QQWNFAGIEA;FAGIEAAASA;AAASAIQGNV;SAIQGNVTSI;SIHSLLDEGK;SLLDEGKQSL;LLDEGKQSLT;KQSLTKLAAA;QSLTKLAAAW;AAWGGSGSEA;EAYQGVQQKW;VQQKWDATAT;QKWDATATEL;ATATELNNAL;TELNNALQNL;ELNNALQNLA;NALQNLARTI;RTISEAGQAM;TISEAGQAMA;QAMASTEGNV;STEGNVTGMF<br>11mer<br>MTEQQWNFAGI;QQWNFAGIEAA;FAGIEAAASAI;EAAASAIQGNV;IQGNVTSIHSL;TSIHSLLDEGK;SLLDEGKQSLT;LLDEGKQSLTK;KQSLTKLAAAW;KLAAAWGGSGS;AAAWGGSGSEA;AAWGGSGSEAY;GSEAYQGVQQK;SEAYQGVQQKW;QQKWDATATEL;DATATELNNAL;ELNNALQNLAR;LQNLARTISEA;GQAMASTEGNV;MASTEGNVTGM | 199728-199810 |
| 45 | **<NP_216402.1 secreted antigen 85-B fbpB (Ag85B) (antigen 85 complex B) Rv 1886c;Mycobacterium tuberculosis H37Rv>**<br>MTDVSRKIRAWGRRLMIGTAAAVVLPGLVGLAGGAATAGAFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAG<br><br>8mer<br>KIRAWGRR;RAWGRRLM;AWGRRLMI;RRLMIGTA;RLMIGTAA;LMIGTAAA;MIGTAAAV;GTAAAVVL;AAVVLPGL;AVVLPGLV;VLPGLVGL;LPGLVGLA;GLAGGAAT;GAATAGAF;ATAGAFSR;FSRPGLPV;RPGLPVEY;GLPVEYLQ;LPVEYLQV;LQVPSPSM;SPSMGRDI;PSMGRDIK;SMGRDIKV;FQSGGNNS;NSPAVYLL;AVYLLDGL;VYLLDGLR;YLLDGLRA;LLDGLRAQ;WDINTPAF;INTPAFEW;NTPAFEWY;TPAFEWYY;YYQSGLSI;YQSGLSIV;GLSIVMPV;MPVGGQSS;QSSFYSDW;SSFYSDWY;YSDWYSPA;WYSPACGK;KAGCQTYK;QTYKWETF;TYKWETFL;ETFLTSEL;FLTSELPQ;LTSELPQW;SELPQWL | 199811-200193 |

Fig. 30 continued

| | | |
|---|---|---|
| | S;ELPQWLSA;LPQWLSAN;PQWLSANR;WLSANRAV;LSANRAVK;AVKPTGSA;KPTGSAAI;TGSAAIGL;SAAIGLSM;AAIGLSMA;SMAGSSAM;MAGSSAMI;SSAMILAA;SAMILAAY;ILAAYHPQ;AYHPQQFI;YHPQQFIY;HPQQFIYA;YAGSLSAL;ALLDPSQG;LLDPSQGM;SQGMGPSL;QGMGPSLI;MGPSLIGL;GPSLIGLA;SLIGLAMG;AMGDAGGY;GYKAADMW;GPSSDPAW;SSDPAWER;QQIPKLVA;KLVANNTR;LVANNTRL;VANNTRLW;WVYCGNGT;TPNELGGA;NELGGANI;AEFLENFV;EFLENFVR;NFVRSSNL;FVRSSNLK;NLKFQDAY;FQDAYNAA;NAAGGHNA;AAGGHNAV;GHNAVFNF;FPPNGTHS;PPNGTHSW;GTHSWEYW;HSWEYWGA;WEYWGAQL;WGAQLNAM;GAQLNAMK<br>9mer<br>MTDVSRKIR;DVSRKIRAW;KIRAWGRRL;RAWGRRLMI;RRLMIGTAA;RLMIGTAAA;LMIGTAAAV;MIGTAAAVV;AAAVVLPGL;AAVVLPGLV;VVLPGLVGL;VLPGLVGLA;LPGLVGLAG;GLVGLAGGA;GLAGGAATA;GGAATAGAF;AATAGAFSR;RPGLPVEYL;GLPVEYLQV;LPVEYLQVP;YLQVPSPSM;QVPSPSMGR;FQSGGNNSP;AVYLLDGLR;YLLDGLRAQ;LLDGLRAQD;RAQDDYNGW;NGWDINTPA;GWDINTPAF;DINTPAFEW;NTPAFEWYY;FEWYYQSGL;WYYQSGLSI;YYQSGLSIV;YQSGLSIVM;SGLSIVMPV;MPVGGQSSF;PVGGQSSFY;QSSFYSDWY;FYSDWYSPA;DWYSPACGK;KAGCQTYKW;CQTYKWETF;QTYKWETFL;TYKWETFLT;WETFLTSEL;FLTSELPQW;LTSELPQWL;SELPQWLSA;LPQWLSANR;WLSANRAVK;RAVKPTGSA;GSAAIGLSM;SAAIGLSMA;GLSMAGSSA;LSMAGSSAM;SMAGSSAMI;MAGSSAMIL;SSAMILAAY;MILAAYHPQ;ILAAYHPQQ;LAAYHPQQF;AYHPQQFIY;HPQQFIYAG;QQFIYAGSL;FIYAGSLSA;IYAGSLSAL;YAGSLSALL;SLSALLDPS;ALLDPSQGM;DPSQGMGPS;SQGMGPSLI;GMGPSLIGL;GPSLIGLAM;LAMGDAGGY;AMGDAGGYK;GGYKAADMW;DPTQQIPKL;IPKLVANNT;KLVANNTRL;VANNTRLWV;TPNELGGAN;ELGGANIPA;IPAEFLENF;AEFLENFVR;NFVRSSNLK;FVRSSNLKF;FQDAYNAAG;NAAGGHNAV;AAGGHNAVF;FPPNGTHSW;YWGAQLNAM;AMKGDLQSS;MKGDLQSSL<br>10mer<br>VSRKIRAWGR;KIRAWGRRLM;RRLMIGTAAA;RLMIGTAAAV;LMIGTAAAVV;MIGTAAAVVL;TAAAVVLPGL;AAAVVLPGLV;AVVLPGLVGL;VVLPGLVGLA;LPGLVGLAGG;GLVGLAGGAA;GAATAGAFSR;GAFSRPGLPV;FSRPGLPVEY;LPVEYLQVPS;EYLQVPSPSM;VPSPSMGRDI;SPSMGRDIKV;SMGRDIKVQF;FQSGGNNSPA;SPAVYLLDGL;YLLDGLRAQD;AQDDYNGWDI;NGWDINTPAF;DINTPAFEWY;NTPAFEWYYQ;AFEWYYQSGL;EWYYQSGLSI;WYYQSGLSIV;YYQSGLSIVM;QSGLSIVMPV;VMPVGGQSSF;MPVGGQSSFY;GQSSFYSDWY;CQTYKWETFL;QTYKWETFLT;ETFLTSELPQ;TFLTSELPQW;FLTSELPQWL;ELPQWLSANR;LPQWLSANRA;QWLSANRAVK;RAVKPTGSAA;AVKPTGSAAI;KPTGSAAIGL;GLSMAGSSAM;LSMAGSSAMI;SMAGSSAMIL;MAGSSAMILA;GSSAMILAAY;MILAAYHPQQ;ILAAYHPQQF;LAAYHPQQFI;AAYHPQQFIY;HPQQFIYAGS;FIYAGSLSAL;IYAGSLSALL;SLSALLDPSQ;ALLDPSQGMG;LLDPSQGMGP;DPSQGMGPSL;QGMGPSLIGL;GMGPSLIGLA;SLIGLAMGDA;GLAMGDAGGY;LAMGDAGGYK;AMGDAGGYKA;DMWGPSSDPA;DPAWERNDPT;WERNDPTQQI;RNDPTQQIPK;IPKLVANNTR;KLVANNTRLW;LVANNTRLWV;VANNTRLWVY;YCGNGTPNEL;TPNELGGANI;NIPAEFLENF;IPAEFLENFV;AEFLENFVRS;LENFVRSSNL;ENFVRSSNLK;NFVRSSNLKF;SSNLKFQDAY;NLKFQDAYNA;FQDAYNAAGG;YNAAGGHNAV;NAAGGHNAVF;NFPPNGTHSW;PPNGTHSWEY;HSWEYWGAQL;WEYWGAQLNA;EYWGAQLNAM;AMKGDLQSSL<br>11mer<br>MTDVSRKIRAW;DVSRKIRAWGR;VSRKIRAWGRR;KIRAWGRRLMI;RRLMIGTAAAV;RLMIGTAAAVV;LMIGTAAAVVL;GTAAAVVLPGL;TAAAVVLPGLV; | |

Fig. 30 continued

| | | |
|---|---|---|
| | AAVVLPGLVGL;LPGLVGLAGGA;GLVGLAGGAAT;GLAGGAATAGA;LAGGAATAGAF;ATAGAFSRPGL;AFSRPGLPVEY;FSRPGLPVEYL;RPGLPVEYLQV;LPVEYLQVPSP;VEYLQVPSPSM;YLQVPSPSMGR;SMGRDIKVQFQ;FQSGGNNSPAV;QSGGNNSPAVY;NSPAVYLLDGL;SPAVYLLDGLR;YLLDGLRAQDD;LLDGLRAQDDY;YNGWDINTPAF;GWDINTPAFEW;DINTPAFEWYY;PAFEWYYQSGL;FEWYYQSGLSI;WYYQSGLSIVM;YYQSGLSIVMP;YQSGLSIVMPV;IVMPVGGQSSF;VMPVGGQSSFY;MPVGGQSSFYS;VGGQSSFYSDW;SSFYSDWYSPA;YSDWYSPACGK;SPACGKAGCQT;ACGKAGCQTYK;CQTYKWETFLT;YKWETFLTSEL;ETFLTSELPQW;TFLTSELPQWL;FLTSELPQWLS;LTSELPQWLSA;ELPQWLSANRA;LPQWLSANRAV;RAVKPTGSAAI;AIGLSMAGSSA;GLSMAGSSAMI;SMAGSSAMILA;MILAAYHPQQF;ILAAYHPQQFI;LAAYHPQQFIY;AAYHPQQFIYA;HPQQFIYAGSL;QQFIYAGSLSA;QFIYAGSLSAL;FIYAGSLSALL;ALLDPSQGMGP;LLDPSQGMGPS;SQGMGPSLIGL;QGMGPSLIGLA;GMGPSLIGLAM;GLAMGDAGGYK;AMGDAGGYKAA;QQIPKLVANNT;QIPKLVANNTR;IPKLVANNTRL;KLVANNTRLWV;LVANNTRLWVY;VYCGNGTPNEL;NIPAEFLENFV;IPAEFLENFVR;AEFLENFVRSS;FLENFVRSSNL;RSSNLKFQDAY;NLKFQDAYNAA;DAYNAAGGHNA;YNAAGGHNAVF;AVFNFPPNGTH;FPPNGTHSWEY;PPNGTHSWEYW;THSWEYWGAQL;WEYWGAQLNAM;EYWGAQLNAMK;NAMKGDLQSSL | |
| 46 | **<NP_218321.1\| secreted antigen 85-A FBPA (Ag 85A) Rv3804c;Mycobacterium tuberculosis H37Rv>**<br>MQLVDRVRGAVTGMSRRLVVGAVGAALVSGLVGAVGGTATAGAFSRPGLPVEYLQVPSPSMGRDIKVQFQSGGANSPALYLLDGLRAQDDFSGWDINTPAFEWYDQSGLSVVMPVGGQSSFYSDWYQPACGKAGCQTYKWETFLTSELPGWLQANRHVKPTGSAVVGLSMAASSALTLAIYHPQQFVYAGAMSGLLDPSQAMGPTLIGLAMGDAGGYKASDMWGPKEDPAWQRNDPLLNVGKLIANNTRVWVYCGNGKPSDLGGNNLPAKFLEGFVRTSNIKFQDAYNAGGGHNGVFDFPDSGTHSWEYWGAQLNAMKPDLQRALGATPNTGPAPQGA<br><br>8mer<br>MQLVDRVR;GAVTGMSR;AVTGMSRR;TGMSRRLV;GMSRRLVV;RRLVVGAV;LVVGAVGA;GAVGAALV;GAALVSGL;AALVSGLV;LVSGLVGA;AVGGTATA;GTATAGAF;ATAGAFSR;FSRPGLPV;RPGLPVEY;GLPVEYLQ;LPVEYLQV;LQVPSPSM;SPSMGRDI;PSMGRDIK;SMGRDIKV;VQFQSGGA;FQSGGANS;NSPALYLL;ALYLLDGL;LYLLDGLR;YLLDGLRA;LLDGLRAQ;WDINTPAF;INTPAFEW;NTPAFEWY;GLSVVMPV;MPVGGQSS;QSSFYSDW;SSFYSDWY;YSDWYQPA;WYQPACGK;YQPACGKA;KAGCQTYK;QTYKWETF;TYKWETFL;ETFLTSEL;LTSELPGW;ELPGWLQA;LPGWLQAN;WLQANRHV;LQANRHVK;HVKPTGSA;KPTGSAVV;TGSAVVGL;SAVVGLSM;AVVGLSMA;LSMAASSA;SMAASSAL;MAASSALT;AASSALTL;SSALTLAI;SALTLAIY;TLAIYHPQ;IYHPQQFV;YHPQQFVY;HPQQFVYA;QQFVYAGA;QFVYAGAM;YAGAMSGL;GLLDPSQA;LLDPSQAM;SQAMGPTL;QAMGPTLI;MGPTLIGL;GPTLIGLA;PTLIGLAM;AMGDAGGY;GYKASDMW;ASDMWGPK;WQRNDPLL;RNDPLLNV;PLLNVGKL;LLNVGKLI;KLIANNTR;LIANNTRV;IANNTRVW;WVYCGNGK;KFLEGFVR;FLEGFVRT;GFVRTSNI;FVRTSNIK;NIKFQDAY;FQDAYNAG;FPDSGTHS;GTHSWEYW;HSWEYWGA;WEYWGAQL;WGAQLNAM;GAQLNAMK;AMKPDLQR;KPDLQRAL;LQRALGAT<br>9mer<br>QLVDRVRGA;LVDRVRGAV;RVRGAVTGM;GAVTGMSRR;AVTGMSRRL;TGMSRRLVV;RLVVGAVGA;LVVGAVGAA;VVGAVGAAL;VGAALVSGL;GAALVSGLV;ALVSGLVGA;LVSGLVGAV;GLVGAVGGT;GAVGGTATA;TATAGAFSR;RPGLPVEYL;GLPVEYLQV;LPVEYLQVP;YLQVPSPSM;QVPSPSMGR;FQSGGANSP;ANSPALYLL;ALYLLDGLR;YLLDGLRAQ;LLDGLRAQD;RAQ | 200194-200583 |

Fig. 30 continued

| | | |
|---|---|---|
| | DDFSGW;SGWDINTPA;GWDINTPAF;DINTPAFEW;FEWYDQSGL;WYDQSGLSV;YDQSGLSVV;SGLSVVMPV;MPVGGQSSF;PVGGQSSFY;QSSFYSDWY;SSFYSDWYQ;FYSDWYQPA;KAGCQTYKW;CQTYKWETF;QTYKWETFL;TYKWETFLT;WETFLTSEL;FLTSELPGW;LTSELPGWL;SELPGWLQA;ELPGWLQAN;WLQANRHVK;HVKPTGSAV;GSAVVGLSM;SAVVGLSMA;AVVGLSMAA;GLSMAASSA;LSMAASSAL;SMAASSALT;MAASSALTL;AASSALTLA;SSALTLAIY;TLAIYHPQQ;LAIYHPQQF;AIYHPQQFV;IYHPQQFVY;HPQQFVYAG;QQFVYAGAM;VYAGAMSGL;YAGAMSGLL;AMSGLLDPS;GLLDPSQAM;LLDPSQAMG;DPSQAMGPT;SQAMGPTLI;AMGPTLIGL;GPTLIGLAM;LAMGDAGGY;AMGDAGGYK;GGYKASDMW;KASDMWGPK;AWQRNDPLL;PLLNVGKLI;LLNVGKLIA;KLIANNTRV;LIANNTRVW;IANNTRVWV;VWVYCGNGK;DLGGNNLPA;LPAKFLEGF;FLEGFVRTS;EGFVRTSNI;GFVRTSNIK;FVRTSNIKF;FQDAYNAGG;NAGGGHNGV;FPDSGTHSW;DSGTHSWEY;SGTHSWEYW;YWGAQLNAM;QLNAMKPDL;NAMKPDLQR;AMKPDLQRA;TPNTGPAPQ;NTGPAPQGA<br>10mer<br>MQLVDRVRGA;QLVDRVRGAV;RVRGAVTGMS;AVTGMSRRLV;GMSRRLVVGA;MSRRLVVGAV;RRLVVGAVGA;RLVVGAVGAA;LVVGAVGAAL;VVGAVGAALV;AVGAALVSGL;VGAALVSGLV;ALVSGLVGAV;GLVGAVGGTA;AVGGTATAGA;GTATAGAFSR;GAFSRPGLPV;FSRPGLPVEY;LPVEYLQVPS;EYLQVPSPSM;VPSPSMGRDI;SPSMGRDIKV;SMGRDIKVQF;FQSGGANSPA;GANSPALYLL;SPALYLLDGL;ALYLLDGLRA;YLLDGLRAQD;AQDDFSGWDI;FSGWDINTPA;SGWDINTPAF;DINTPAFEWY;EWYDQSGLSV;WYDQSGLSVV;QSGLSVVMPV;VMPVGGQSSF;MPVGGQSSFY;GQSSFYSDWY;FYSDWYQPAC;YQPACGKAGC;CQTYKWETFL;QTYKWETFLT;TFLTSELPGW;FLTSELPGWL;ELPGWLQANR;LPGWLQANRH;GWLQANRHVK;HVKPTGSAVV;KPTGSAVVGL;SAVVGLSMAA;GLSMAASSAL;SMAASSALTL;MAASSALTLA;AASSALTLAI;ASSALTLAIY;ALTLAIYHPQ;TLAIYHPQQF;LAIYHPQQFV;AIYHPQQFVY;HPQQFVYAGA;FVYAGAMSGL;VYAGAMSGLL;AMSGLLDPSQ;GLLDPSQAMG;LLDPSQAMGP;DPSQAMGPTL;QAMGPTLIGL;AMGPTLIGLA;TLIGLAMGDA;GLAMGDAGGY;LAMGDAGGYK;AMGDAGGYKA;DMWGPKEDPA;DPAWQRNDPL;WQRNDPLLNV;PLLNVGKLIA;KLIANNTRVW;LIANNTRVWV;IANNTRVWVY;RVWVYCGNGK;KPSDLGGNNL;LPAKFLEGFV;PAKFLEGFVR;EGFVRTSNIK;GFVRTSNIKF;TSNIKFQDAY;YNAGGGHNGV;NAGGGHNGVF;GVFDFPDSGT;DSGTHSWEYW;HSWEYWGAQL;WEYWGAQLNA;EYWGAQLNAM;AQLNAMKPDL;NAMKPDLQRA;AMKPDLQRAL;LGATPNTGPA<br>11mer<br>MQLVDRVRGAV;RVRGAVTGMSR;GAVTGMSRRLV;AVTGMSRRLVV;GMSRRLVVGAV;RRLVVGAVGAA;RLVVGAVGAAL;LVVGAVGAALV;GAVGAALVSGL;AVGAALVSGLV;AALVSGLVGAV;GLVGAVGGTAT;LVGAVGGTATA;GAVGGTATAGA;AVGGTATAGAF;ATAGAFSRPGL;AFSRPGLPVEY;FSRPGLPVEYL;RPGLPVEYLQV;LPVEYLQVPSP;VEYLQVPSPSM;YLQVPSPSMGR;SMGRDIKVQFQ;FQSGGANSPAL;QSGGANSPALY;GGANSPALYLL;NSPALYLLDGL;SPALYLLDGLR;ALYLLDGLRAQ;YLLDGLRAQDD;LLDGLRAQDDF;FSGWDINTPAF;GWDINTPAFEW;FEWYDQSGLSV;WYDQSGLSVVM;DQSGLSVVMPV;VVMPVGGQSSF;VMPVGGQSSFY;MPVGGQSSFYS;VGGQSSFYSDW;SSFYSDWYQPA;YSDWYQPACGK;ACGKAGCQTYK;CQTYKWETFLT;YKWETFLTSEL;ETFLTSELPGW;TFLTSELPGWL;FLTSELPGWLQ;LPGWLQANRHV;VVGLSMAASSA;GLSMAASSALT;LSMAASSALTL;SMAASSALTLA;MAASSALTLAI;AASSALTLAIY;ASSALTLAIYH;ALTLAIYHPQQ;LTLAIYHPQQF;TLAIYHPQQFV;LAIYHPQQFVY;AIYHPQQFVYA;HPQQFVYAGAM;FVYAGAMSGLL;AMSGLLDPSQA;MSGLLDPSQAM;GLLDPSQ | |

Fig. 30 continued

| | | |
|---|---|---|
| | AMGP;LLDPSQAMGPT;SQAMGPTLIGL;QAMGPTLIGLA;AMGPTLIGLAM;<br>GLAMGDAGGYK;GYKASDMWGPK;DPAWQRNDPLL;QRNDPLLNVGK;NV<br>GKLIANNTR;KLIANNTRVWV;LIANNTRVWVY;VYCGNGKPSDL;NLPAKFLE<br>GFV;LPAKFLEGFVR;FLEGFVRTSNI;RTSNIKFQDAY;YNAGGGHNGVF;FP<br>DSGTHSWEY;THSWEYWGAQL;WEYWGAQLNAM;EYWGAQLNAMK;QLN<br>AMKPDLQR;KPDLQRALGAT;ALGATPNTGPA;TPNTGPAPQGA | |
| 47 | **<CAA17966.1 10 KDA CULTURE FILTRATE ANTIGEN ESXB(CFP10)Rv3874;Mycobacterium tuberculosis H37Rv>**<br>MAEMKTDAATLAQEAGNFERISGDLKTQIDQVESTAGSLQGQWRGAAGT<br>AAQAAVVRFQEAANKQKQELDEISTNIRQAGVQYSRADEEQQQALSSQM<br>GF<br><br>8mer<br>AEMKTDAA;KTDAATLA;LAQEAGNF;QEAGNFER;EAGNFERI;FERISGDL;<br>TQIDQVES;VESTAGSL;GSLQGQWR;SLQGQWRG;LQGQWRGA;GTAAQA<br>AV;TAAQAAVV;AAQAAVVR;AQAAVVRF;AVVRFQEA;RFQEAANK;ELDEIS<br>TN;RQAGVQYS;QAGVQYSR;DEEQQQAL;QQALSSQM;ALSSQMGF<br>9mer<br>MAEMKTDAA;AEMKTDAAT;EMKTDAATL;DAATLAQEA;AQEAGNFER;QE<br>AGNFERI;DLKTQIDQV;TQIDQVEST;QIDQVESTA;TAGSLQGQW;SLQGQ<br>WRGA;LQGQWRGAA;GQWRGAAGT;GTAAQAAVV;TAAQAAVVR;AAQAA<br>VVRF;AAVVRFQEA;VRFQEAANK;KQKQELDEI;ELDEISTNI;STNIRQAGV;<br>RQAGVQYSR;RADEEQQQA;EEQQQALSS;QQQALSSQM;QALSSQMGF<br>10mer<br>MAEMKTDAAT;AEMKTDAATL;ATLAQEAGNF;LAQEAGNFER;AQEAGNFE<br>RI;RISGDLKTQI;TQIDQVESTA;STAGSLQGQW;TAGSLQGQWR;SLQGQW<br>RGAA;GQWRGAAGTA;AAGTAAQAAV;GTAAQAAVVR;TAAQAAVVRF;QA<br>AVVRFQEA;AAVVRFQEAA;VVRFQEAANK;RFQEAANKQK;EAANKQKQEL<br>;ELDEISTNIR;ISTNIRQAGV;RQAGVQYSRA;RADEEQQQAL;QQALSSQM<br>GF<br>11mer<br>MAEMKTDAATL;AEMKTDAATLA;KTDAATLAQEA;TLAQEAGNFER;ESTA<br>GSLQGQW;STAGSLQGQWR;LQGQWRGAAGT;GQWRGAAGTAA;GAAGT<br>AAQAAV;GTAAQAAVVRF;TAAQAAVVRFQ;AQAAVVRFQEA;QAAVVRFQE<br>AA;AVVRFQEAANK;QEAANKQKQEL;KQELDEISTNI;ELDEISTNIRQ;EIST<br>NIRQAGV;STNIRQAGVQY;NIRQAGVQYSR;SRADEEQQQAL;EEQQQALS<br>SQM;QQQALSSQMGF | 200584-<br>200680 |

Fig. 30 continued

Figure 31. Detection of activated lymphocytes using pentamer MHC multimers and IFN-γ.
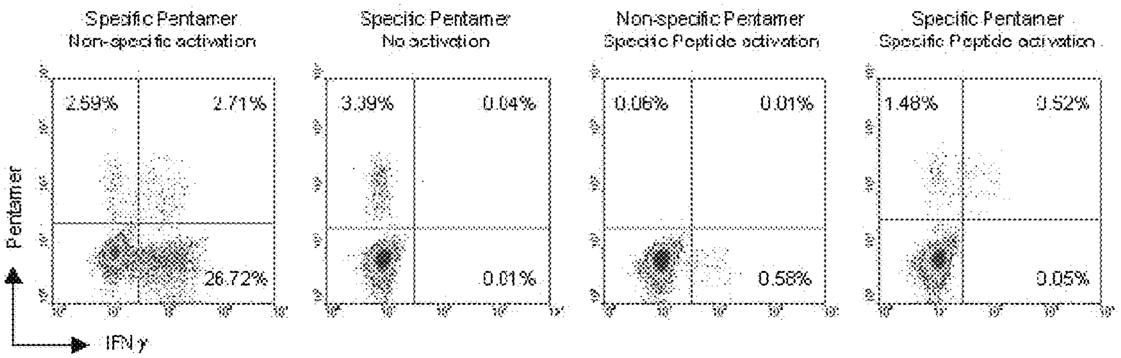

Figure 32. The frequency and the distribution analysis of Ag85A pentamer$^+$ CD8 T cells in CSF and in PBMC
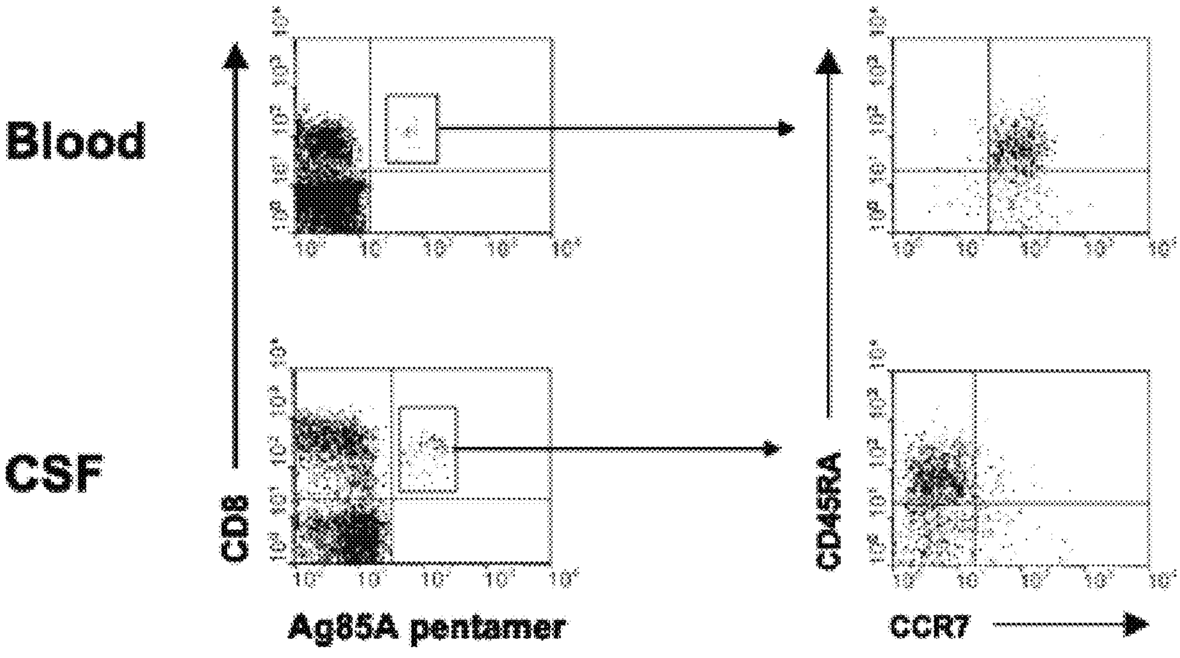

Figure 33. Distribution of frequencies of ESAT-6-specific IFN-γ-secreting T cells in all subjects.
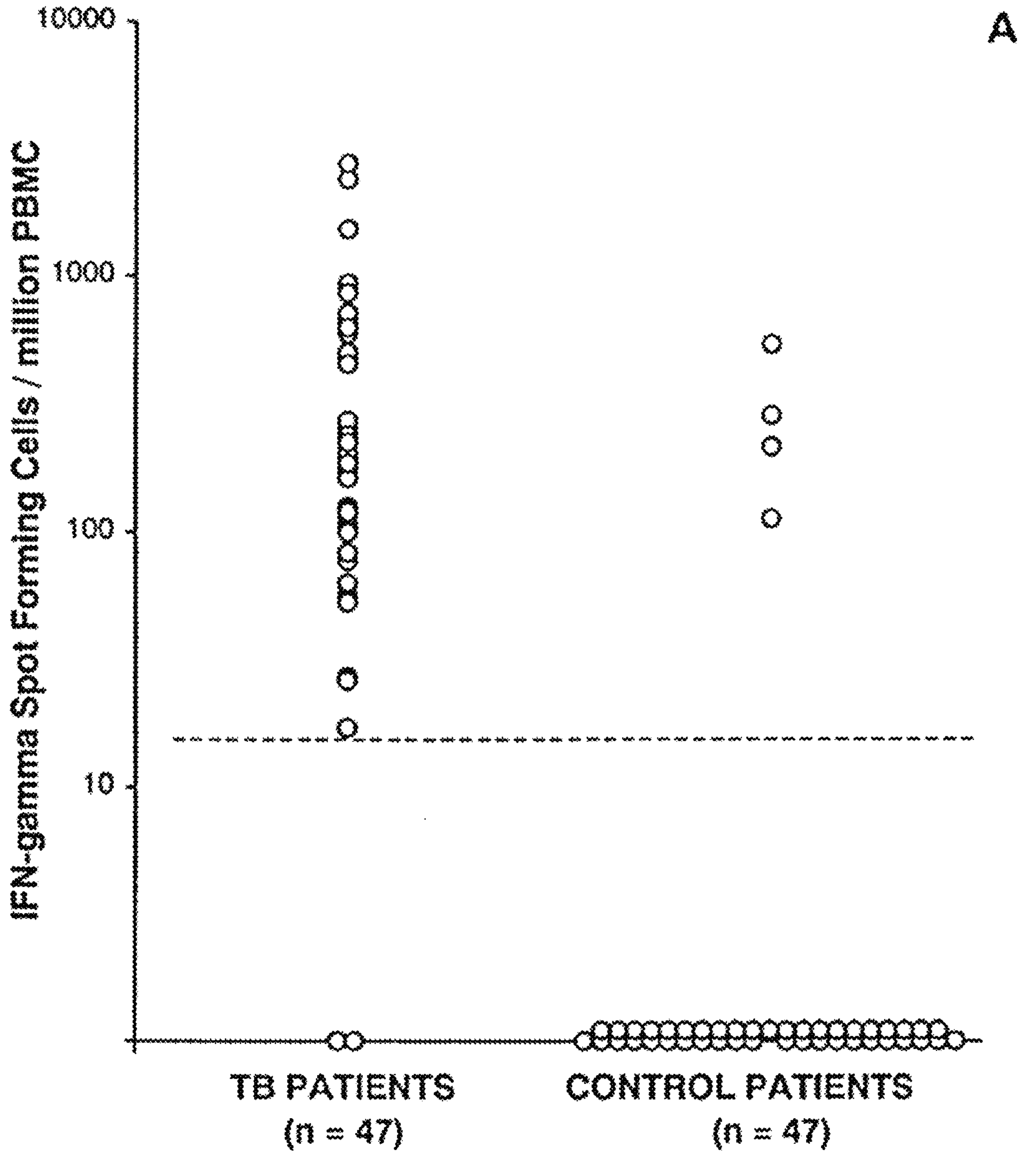

Figure 34. Dot plot of individual responses to CFP-10 and ESAT-6 for 118 culture-positive patients with tuberculosis (TB)
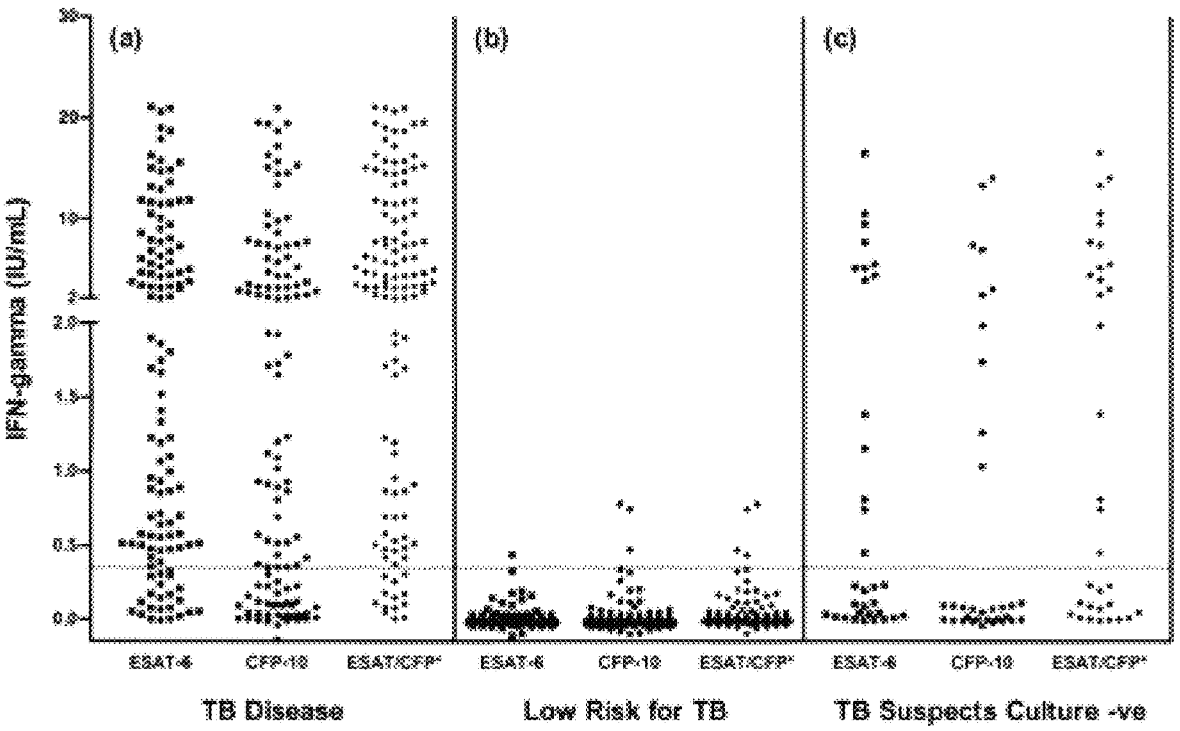

MHC MULTIMERS IN TUBERCULOSIS DIAGNOSTICS, VACCINE AND THERAPEUTICS

All patent and non-patent references cited in 60/960,394 as well as in this application are hereby incorporated by reference in their entirety. U.S. 60/960,394 is hereby also incorporated herein by reference in its entirety.

FIELD OF INVENTION

The present invention relates to MHC-peptide complexes and uses thereof in the treatment of a disease in an individual.

BACKGROUND OF INVENTION

Biochemical interactions between peptide epitope specific membrane molecules encoded by the Major Histocompatibility Complex (MHC, in humans HLA) and T-cell receptors (TCR) are required to elicit specific immune responses. This requires activation of T-cells by presentation to the T-cells of peptides against which a T-cell response should be raised. The peptides are presented to the T-cells by the MHC complexes.

The Immune Response

The immune response is divided into two parts termed the innate immune response and the adaptive immune response. Both responses work together to eliminate pathogens (antigens). Innate immunity is present at all times and is the first line of defense against invading pathogens. The immediate response by means of pre-existing elements, i.e. various proteins and phagocytic cells that recognize conserved features on the pathogens, is important in clearing and control of spreading of pathogens. If a pathogen is persistent in the body and thus only partially cleared by the actions of the innate immune system, the adaptive immune system initiate a response against the pathogen. The adaptive immune system is capable of eliciting a response against virtually any type of pathogen and is unlike the innate immune system capable of establishing immunological memory.

The adaptive response is highly specific to the particular pathogen that activated it but it is not so quickly launched as the innate when first encountering a pathogen. However, due to the generation of memory cells, a fast and more efficient response is generated upon repeated exposure to the same pathogen. The adaptive response is carried out by two distinct sets of lymphocytes, the B cells producing antibodies leading to the humoral or antibody mediated immune response, and the T cells leading to the cell mediated immune response.

T cells express a clonotypic T cell receptor (TCR) on the surface. This receptor enable the T cell to recognize peptide antigens bound to major histocompatibility complex (MHC) molecules, called human leukocyte antigens (HLA) in man. Depending on the type of pathogen, being intracellular or extracellular, the antigenic peptides are bound to MHC class I or MHC class II, respectively. The two classes of MHC complexes are recognized by different subsets of T cells; Cytotoxic CD8+ T cells recognizing MHC class I and CD4+ helper cells recognizing MHC class II. In general, TCR recognition of MHC-peptide complexes result in T cell activation, clonal expansion and differentiation of the T cells into effector, memory and regulatory T cells.

B cells express a membrane bound form of immunoglobulin (Ig) called the B cell receptor (BCR). The BCR recognizes an epitope that is part of an intact three dimensional antigenic molecule. Upon BCR recognition of an antigen the BCR:antigen complex is internalized and fragments from the internalized antigen is presented in the context of MHC class II on the surface of the B cell to CD4+ helper T-cells (Th). The specific Th cell will then activate the B cell leading to differentiation into an antibody producing plasma cell.

A very important feature of the adaptive immune system is its ability to distinguish between self and non-self antigens, and preferably respond against non-self. If the immune system fails to discriminate between the two, specific immune responses against self-antigens are generated. These autoimmune reactions can lead to damage of self-tissue.

The adaptive immune response is initiated when antigens are taken up by professional antigen presenting cells such as dendritic cells, Macrophages, Langerhans cells and B-cells. These cells present peptide fragments, resulting from the degradation of proteins, in the context of MHC class II proteins (Major Histocompatibility Complex) to helper T cells. The T helper cells then mediate help to B-cells and antigen-specific cytotoxic T cells, both of which have received primary activation signals via their BCR respective TCR. The help from the Th-cell is mediated by means of soluble mediators e.g. cytokines.

In general the interactions between the various cells of the cellular immune response is governed by receptor-ligand interactions directly between the cells and by production of various soluble reporter substances e.g. cytokines by activated cells.

MHC-Peptide Complexes.

MHC complexes function as antigenic peptide receptors, collecting peptides inside the cell and transporting them to the cell surface, where the MHC-peptide complex can be recognized by T-lymphocytes. Two classes of classical MHC complexes exist, MHC class I and II. The most important difference between these two molecules lies in the protein source from which they obtain their associated peptides. MHC class I molecules present peptides derived from endogenous antigens degraded in the cytosol and are thus able to display fragments of viral proteins and unique proteins derived from cancerous cells. Almost all nucleated cells express MHC class I on their surface even though the expression level varies among different cell types. MHC class II molecules bind peptides derived from exogenous antigens. Exogenous proteins enter the cells by endocytosis or phagocytosis, and these proteins are degraded by proteases in acidified intracellular vesicles before presentation by MHC class II molecules. MHC class II molecules are only expressed on professional antigen presenting cells like B cells and macrophages.

The three-dimensional structure of MHC class I and II molecules are very similar but important differences exist. MHC class I molecules consist of two polypeptide chains, a heavy chain, α, spanning the membrane and a light chain, β2-microglobulin (β2m). The heavy chain is encoded in the gene complex termed the major histocompatibility complex (MHC), and its extracellular portion comprises three domains, α1, α2 and α3. The β2m chain is not encoded in the MHC gene and consists of a single domain, which together with the α3 domain of the heavy chain make up a folded structure that closely resembles that of the immunoglobulin. The α1 and α2 domains pair to form the peptide binding cleft, consisting of two segmented a helices lying on a sheet of eight β-strands. In humans as well as in mice three different types of MHC class I molecule exist. HLA-A, B, C are found in humans while MHC class I molecules in mice are designated H-2K, H-2D and H-2L.

The MHC class II molecule is composed of two membrane spanning polypeptide chains, α and β, of similar size (about 30000 Da). Genes located in the major histocompatibility complex encode both chains. Each chain consists of two domains, where α1 and β1 forms a 9-pocket peptide-binding cleft, where pocket 1, 4, 6 and 9 are considered as major peptide binding pockets. The α2 and β2, like the α2 and β2m in the MHC class I molecules, have amino acid sequence and structural similarities to immunoglobulin constant domains. In contrast to MHC class I complexes, where the ends of the antigenic peptide is buried, peptide-ends in MHC class II complexes are not. HLA-DR, DQ and DP are the human class II molecules, H-2A, M and E are those of the mice.

A remarkable feature of MHC genes is their polymorphism accomplished by multiple alleles at each gene. The polygenic and polymorphic nature of MHC genes is reflected in the peptide-binding cleft so that different MHC complexes bind different sets of peptides. The variable amino acids in the peptide binding cleft form pockets where the amino acid side chains of the bound peptide can be buried. This permits a specific variant of MHC to bind some peptides better than others.

MHC Multimers

Due to the short half-life of the peptide-MHC-T cell receptor ternary complex (typically between 10 and 25 seconds) it is difficult to label specific T cells with labelled MHC-peptide complexes, and like-wise, it is difficult to employ such monomers of MHC-peptide for therapeutic and vaccine purposes because of their weak binding. In order to circumvent this problem, MHC multimers have been developed. These are complexes that include multiple copies of MHC-peptide complexes, providing these complexes with an increased affinity and half-life of interaction, compared to that of the monomer MHC-peptide complex. The multiple copies of MHC-peptide complexes are attached, covalently or non-covalently, to a multimerization domain. Known examples of such MHC multimers include the following:

- MHC-dimers: Each MHC dimer contains two copies of MHC-peptide. IgG is used as multimerization domain, and one of the domains of the MHC protein is covalently linked to IgG.
- MHC-tetramers: Each MHC-tetramer contains four copies of MHC-peptide, each of which is biotinylated. The MHC complexes are held together in a complex by the streptavidin tetramer protein, providing a non-covalent linkage between a streptavidin monomer and the MHC protein. Tetramers are described in U.S. Pat. No. 5,635,363.
- MHC pentamers: Five copies of MHC-peptide complexes are multimerised by a self-assembling coiled-coil domain, to form a MHC pentamer. MHC pentamers are described in the US patent 2004209295
- MHC dextramers: A large number of MHC-peptide complexes, typically more than ten, are attached to a dextran polymer. MHC-dextramers are described in the patent application WO 02/072631 A2.
- MHC streptamers: 8-12 MHC-peptide complexes attached to Streptactin. MHC streptamers are described in Knabel M et al. Reversible MHC multimer staining for functional isolation of T-cell populations and effective adoptive transfer. Nature medicine 6. 631-637 (2002).

Use of MHC Multimers in Flow Cytometry and Related Techniques

The concentration of antigen-specific T-cells in samples from e.g. peripheral blood can be very low. Flow cytometry and related methods offer the ability to analyze a large number of cells and simultaneously identify the few of interest. MHC multimers have turned out to be very valuable reagents for detection and characterization of antigen-specific T-cells in flow cytometer experiments. The relative amount of antigen-specific T cells in a sample can be determined and also the affinity of the binding of MHC multimer to the T-cell receptor can be determined.

The basic function of a flow cytometer is its ability to analyse and identify fluorochrome labelled entities in a liquid sample, by means of its excitation, using a light source such as a laser beam and the light emission from the bound fluorochrome.

MHC multimers is used as detections molecule for identification of antigen-specific T-cells in flow cytometry, by labelling the MHC multimer with a specific fluorochrome, which is detectable, by the flow cytometer used.

In order to facilitate the identification of a small amount of cells, the cells can be sub-categorized using antibodies or other fluorochrome labelled detections molecules directed against surface markers other than the TCR on the specific T-cells population. Antibodies or other fluorochrome labelled detections molecules can also be used to identify cells known not to be antigen-specific T-cells. Both kinds of detections molecules are in the following referred to as gating reagents. Gating reagents, helps identify the “true” antigen-specific T cells bound by MHC multimers by identifying specific subpopulations in a sample, e.g. T cells and by excluding cells that for some reason bind MHC mulimers without being antigen-specific T-cells.

Other cytometry methods, e.g. fluorescence microscopy and IHC can like flow cytometry be employed in identification of antigen-specific T cells in a cell sample using MHC multimers.

Application of MHC Multimers in Immune Monitoring, Diagnostics, Prognostics, Therapy and Vaccines T cells are pivotal for mounting an adaptive immune response. It is therefore of importance to be able to measure the number of specific T cells when performing a monitoring of a given immune response, for example in connection with vaccine development, infectious diseases e.g. tuberculosis, toxicity studies etc.

Accordingly, the present invention further provides powerful tools in the fields of vaccines, therapy and diagnosis. One objective of the present invention is to provide methods for anti-bacterial immunotherapy by generating antigen-specific T-cells capable of inactivating or eliminating undesirable target cells. Another objective is to isolate antigen-specific T-cells and culture these in the presence of co-stimulatory molecules. Ex vivo priming and expansion of T-cell populations allows the T-cells to be used in immunotherapy of various types of infectious diseases. A third objective of the present invention is to identify and label specific subsets of cells with relevance for the development or treatment of diseases.

One disease of special interest of the present invention is tuberculosis caused by the intracellular bacteria Mycobacteria tuberculosis. MHC multimers of the present invention are can be used in prognostics, diagnosis, vaccine monitoring, vaccine and therapy related to this disease.

SUMMARY OF INVENTION

Measurement of antigen-specific T cells during an immune response are important parameters in vaccine development, autologous cancer therapy, transplantation, infectious diseases, inflammation, autoimmunity, toxicity studies etc. MHC multimers are crucial reagents in monitoring of antigen-specific T cells. The present invention describes novel methods to generate MHC multimers and methods to improve existing and new MHC multimers. The invention also describes improved methods for the use of MHC multimers in analysis of T cells in samples including diagnostic and prognostic methods. Furthermore the use of MHC multimers in therapy are described, e.g. anti-tumour and anti-virus therapy, including isolation of antigen-specific T cells capable of inactivation or elimination of undesirable target cells or isolation of specific T cells capable of regulation of other immune cells. The present invention also relates to MHC multimers comprising one or more *Mycobacterium tuberculosis* derived peptides. In one preferred embodiment the present invention relates to a Tuberculosis vaccine. In a tuberculosis vaccine the peptides bound in the peptide binding cleft of MHC are derived from antigenic tuberculosis proteins.

Definitions

As used everywhere herein, the term "a", "an" or "the" is meant to be one or more, i. e. at least one.

Adjuvant: adjuvants are drugs that have few or no pharmacological effects by themselves, but can increase the efficacy or potency of other drugs when given at the same time. In another embodiment, an adjuvant is an agent which, while not having any specific antigenic effect in itself, can stimulate the immune system, increasing the response to a vaccine.

Agonist: agonist as used herein is a substance that binds to a specific receptor and triggers a response in the cell. It mimics the action of an endogenous ligand that binds to the same receptor.

Antagonist: antagonist as used herein is a substance that binds to a specific receptor and blocks the response in the cell. It blocks the action of an endogenous ligand that binds to the same receptor.

Antibodies: As used herein, the term "antibody" means an isolated or recombinant binding agent that comprises the necessary variable region sequences to specifically bind an antigenic epitope. Therefore, an antibody is any form of antibody or fragment thereof that exhibits the desired biological activity, e.g., binding the specific target antigen. Antibodies can derive from multiple species. For example, antibodies include rodent (such as mouse and rat), rabbit, sheep, camel, and human antibodies. Antibodies can also include chimeric antibodies, which join variable regions from one species to constant regions from another species. Likewise, antibodies can be humanized, that is constructed by recombinant DNA technology to produce immunoglobulins which have human framework regions from one species combined with complementarity determining regions (CDR's) from a another species' immunoglobulin. The antibody can be monoclonal or polyclonal. Antibodies can be divided into isotypes (IgA, IgG, IgM, IgD, IgE, IgG1, IgG2, IgG3, IgG4, IgA1, IgA2, IgM1, IgM2)

Antibodies: In another embodiment the term "antibody" refers to an intact antibody, or a fragment of an antibody that competes with the intact antibody for antigen binding. In certain embodiments, antibody fragments are produced by recombinant DNA techniques. In certain embodiments, antibody fragments are produced by enzymatic or chemical cleavage of intact antibodies. Exemplary antibody fragments include, but are not limited to, Fab, Fab', F(ab')2, Fv, and scFv. Exemplary antibody fragments also include, but are not limited to, domain antibodies, nanobodies, minibodies ((scFv-C.sub.H3).sub.2), maxibodies ((scFv-C.sub.H2-C.sub.H3).sub.2), diabodies (noncovalent dimer of scFv).

Antigen presenting cell: An antigen-presenting cell (APC) as used herein is a cell that displays foreign antigen complexed with MHC on its surface.

Antigenic peptide: Used interchangeably with binding peptide. Any peptide molecule that is bound or able to bind into the binding groove of either MHC class 1 or MHC class 2.

Aptamer: the term aptamer as used herein is defined as oligonucleic acid or peptide molecules that bind a specific target molecule. Aptamers are usually created by selecting them from a large random sequence pool, but natural aptamers also exist. Aptamers can be divided into DNA aptamers, RNA aptamers and peptide aptamers.

Avidin: Avidin as used herein is a glycoprotein found in the egg white and tissues of birds, reptiles and amphibians. It contains four identical subunits having a combined mass of 67,000-68,000 daltons. Each subunit consists of 128 amino acids and binds one molecule of biotin.

Biologically active molecule: A biologically active molecule is a molecule having itself a biological activity/effect or is able to induce a biological activity/effect when administered to a biological system. Biologically active molecules include adjuvants, immune targets (e.g. antigens), enzymes, regulators of receptor activity, receptor ligands, immune potentiators, drugs, toxins, cytotoxic molecules, co-receptors, proteins and peptides in general, sugar moieties, lipid groups, nucleic acids including siRNA, nanoparticles, and small molecules.

Bioluminescent: Bioluminescence, as used herein, is the production and emission of light by a living organism as the result of a chemical reaction during which chemical energy is converted to light energy.

Biotin: Biotin, as used herein, is also known as vitamin H or $B_7$. Niotin has the chemical formula $C_{10}H_{16}N_2O_3S$.

Bispecific antibodies: The term bispecific antibodies as used herein is defined as monoclonal, preferably but not limited to human or humanized, antibodies that have binding specificities for at least two different antigens. The antibody can also be trispecific or multispecific.

Carrier: A carrier as used herein can be any type of molecule that is directly or indirectly associated with the MHC peptide complex. In this invention, a carrier will typically refer to a functionalized polymer (e.g. dextran) that is capable of reacting with MHC-peptide complexes, thus covalently attaching the MHC-peptide complex to the carrier, or that is capable of reacting with scaffold molecules (e.g. streptavidin), thus covalently attaching streptavidin to the carrier; the streptavidin then may bind MHC-peptide complexes. Carrier and scaffold are used interchangeably herein where scaffold typically refers to smaller molecules of a multimerization domain and carrier typically refers to larger molecule and/or cell like structures.

Chelating chemical compound: Chelating chemical compound, as used herein, is the process of reversible binding of a ligand to a metal ion, forming a metal complex.

Chemiluminescent: Chemiluminescence, as used herein, is the emission of light (luminescence) without emission of heat as the result of a chemical reaction.

Chromophore: A chromophore, as used herein, is the part of a visibly coloured molecule responsible for light absorption over a range of wavelengths thus giving rise to the colour. By extension the term can be applied to uv or it absorbing parts of molecules.

Coiled-coil polypeptide: the term coiled-coil polypeptide as used herein is a structural motif in proteins, in which 2-7 alpha-helices are coiled together like the strands of a rope Covalent binding: The term covalent binding is used herein to describe a form of chemical bonding that is characterized by the sharing of pairs of electrons between atoms. Attraction-to-repulsion stability that forms between atoms when they share electrons is known as covalent bonding.

Crosslinking is the process of chemically joining two or more molecules by a covalent bond. Crosslinking reagents contain reactive ends to specific functional groups (primary amines, sulfhydryls, etc.) on proteins or other molecules.

Diagnosis: The act or process of identifying or determining the nature and cause of a disease or injury through evaluation Diabodies: The term “diabodies” refers to small antibody fragments with two antigen-binding sites, which fragments comprise a heavy-chain variable domain (VH) connected to a light-chain variable domain (VL) in the same polypeptide chain (VH-VL). By using a linker that is too short to allow pairing between the two domains on the same chain, the domains are forced to pair with the complementary domains of another chain and create two antigen-binding sites.

Dendritic cell: The term dendritic cell as used herein is a type of immune cells. Their main function is to process antigen material and present it on the surface to other cells of the immune system, thus functioning as antigen-presenting cells.

Detection: In this invention detection means any method capable of measuring one molecule bound to another molecule. The molecules are typically proteins but can be any type of molecule Dextran: the term dextran as used herein is a complex, branched polysaccharide made of many glucose molecules joined into chains of varying lengths. The straight chain consists of $\alpha1\rightarrow6$ glycosidic linkages between glucose molecules, while branches begin from $\alpha1\rightarrow3$ linkages (and in some cases, $\alpha1\rightarrow2$ and $\alpha1\rightarrow4$ linkages as well).

Direct detection of T cells: Direct detection of T cells is used herein interchangeably with direct detection of TCR and direct detection of T cell receptor. As used herein direct detection of T cells is detection directly of the binding interaction between a specific T cell receptor and a MHC multimer.

DNA: The term DNA (Deoxyribonucleic acid) duplex as used herein is a polymer of simple units called nucleotides, with a backbone made of sugars and phosphate atoms joined by ester bonds. Attached to each sugar is one of four types of molecules called bases.

DNA duplex: In living organisms, DNA does not usually exist as a single molecule, but instead as a tightly-associated pair of molecules. These two long strands entwine like vines, in the shape of a double helix.

Electrophilic: electrophile, as used herein, is a reagent attracted to electrons that participates in a chemical reaction by accepting an electron pair in order to bond to a nucleophile.

Enzyme label: enzyme labelling, as used herein, involves a detection method comprising a reaction catalysed by an enzyme.

Epitope-focused antibody: Antibodies also include epitope-focused antibodies, which have at least one minimal essential binding specificity determinant from a heavy chain or light chain CDR3 from a reference antibody, methods for making such epitope-focused antibodies are described in U.S. patent application Ser. No. 11/040,159, which is incorporated herein by reference in its entirety.

Flow cytometry: The analysis of single cells using a flow cytometer.

Flow cytometer: Instrument that measures cell size, granularity and fluorescence due to bound fluorescent marker molecules as single cells pass in a stream past photodectors. A flow cytometer carry out the measurements and/or sorting of individual cells.

Fluorescent: the term fluorescent as used herein is to have the ability to emit light of a certain wavelength when activated by light of another wavelength.

Fluorochromes: fluorochrome, as used herein, is any fluorescent compound used as a dye to mark e.g. protein with a fluorescent label.

Fluorophore: A fluorophore, as used herein, is a component of a molecule which causes a molecule to be fluorescent.

Folding: In this invention folding means in vitro or in vivo folding of proteins in a tertiary structure.

Fusion antibody: As used herein, the term “fusion antibody” refers to a molecule in which an antibody is fused to a non-antibody polypeptide at the N- or C-terminus of the antibody polypeptide.

Glycosylated: Glycosylation, as used herein, is the process or result of addition of saccharides to proteins and lipids.

Hapten: A residue on a molecule for which there is a specific molecule that can bind, e.g. an antibody.

Heteroconjugate antibodies are composed of two covalently joined antibodies. Such antibodies have, for example, been proposed to target immune system cells to unwanted cells.

IgG: IgG as used herein is a monomeric immunoglobulin, built of two heavy chains and two light chains. Each molecule has two antigen binding sites.

Isolated antibody: The term “isolated” antibody as used herein is an antibody which has been identified and separated and/or recovered from a component of its natural environment.

Immunoconjugates: The invention also pertains to immunoconjugates comprising an antibody or a MHC-peptide complex conjugated to a cytotoxic agent such as a chemotherapeutic agent, toxin (e.g., an enzymatically active toxin of bacterial, fungal, plant, or animal origin, or fragments thereof), or a radioactive isotope (i.e., a radioconjugate). Enzymatically active toxins and fragments thereof that can be used include diphtheria A chain, nonbinding active fragments of diphtheria toxin, exotoxin A chain (from *Pseudomonas aeruginosa*), ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. A variety of radionuclides are available for the production of radioconjugated antibodies or MHC-peptide complexes. Conjugates of the antibody or MHC-peptide complex and cytotoxic agent are made using a variety of bifunctional protein-coupling agents such as N-succinimidyl-3-(2-pyridyldithiol) propionate (SPDP), iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis(p-azidobenzoyl)hexanediamine), bis-diazonium derivatives (such as bis-(p-diazoniumbenzoyl)-ethylenediamine), diisocyanates (such as tolyene 2,6- diisocyanate), and bis-active fluorine compounds (such as 1,5-difluoro-2,4-dinitrobenzene).

Immune monitoring: Immune monitoring of the present invention refers to testing of immune status in the diagnosis and therapy of diseases like but not limited to cancer, immunoproliferative and immunodeficiency disorders, autoimmune abnormalities, and infectious diseases. It also refers to testing of immune status before, during and after vaccination and transplantation procedures.

Immune monitoring process: a series of one or more immune monitoring analysis

Immuno profiling: Immuno profiling as used herein defines the profiling of an individual's antigen-specific T-cell repertoire Indirect detection of T cells: Indirect detection of T cells is used interchangeably herein with Indirect detection of TCR and indirect detection of T cell receptor. As used herein indirect detection of T cells is detection of the binding interaction between a specific T cell receptor and a MHC multimer by measurement of the effect of the binding interaction.

Ionophore: ionophore, as used herein, is a lipid-soluble molecule usually synthesized by microorganisms capable of transporting ions.

Label: Label herein is used interchangeable with labeling molecule. Label as described herein is an identifiable substance that is detectable in an assay and that can be attached to a molecule creating a labeled molecule. The behavior of the labeled molecule can then be studied.

Labelling: Labelling herein means attachment of a label to a molecule.

Lanthanide: lanthanide, as used herein, series comprises the 15 elements with atomic numbers 57 through 71, from lanthanum to lutetium.

Linker molecule: Linker molecule and linker is used interchangeable herein. A linker molecule is a molecule that covalently or non-covalently connects two or more molecules, thereby creating a larger complex consisting of all molecules including the linker molecule.

Liposomes: The term liposomes as used herein is defined as a spherical vesicle with a membrane composed of a phospholipid and cholesterol bilayer. Liposomes, usually but not by definition, contain a core of aqueous solution; lipid spheres that contain no aqueous material are called micelles.

Immunoliposomes: The antibodies or MHC-peptide complexes disclosed herein can also be formulated as immunoliposomes. Liposomes comprising the antibody or MHC-peptide complexes are prepared by methods known in the art, such as described in Epstein et al., Proc. Natl. Acad. Sci. USA 82: 3688 (1985); Hwang et al., Proc. Natl. Acad. Sci. USA 77: 4030 (1980); and U.S. Pat. Nos. 4,485,045 and 4,544,545. Particularly useful liposomes can be generated by the reverse-phase evaporation method with a lipid composition comprising phosphatidylcholine, cholesterol, and PEG-derivatized phosphatidylethanolamine (PEG-PE).

Marker: Marker is used interchangeably with marker molecule herein. A marker is molecule that specifically associates covalently or non-covalently with a molecule belonging to or associated with an entity.

MHC: Denotes the major histocompatibility complex.

MHC: Denotes the major histocompatibility complex.

MHC I is used interchangeably herein with MHC class I and denotes the major histocompatibility complex class I.

MHC II is used interchangeably herein with MHC class II and denotes the major histocompatibility complex class I.

MHC molecule: a MHC molecule as used everywhere herein is defined as any MHC class I molecule or MHC class II molecule as defined herein.

A "MHC Class I molecule" as used everywhere herein is used interchangeably with MHC I molecule and is defined as a molecule which comprises 1-3 subunits, including a MHC I heavy chain, a MHC I heavy chain combined with a MHC I beta2microglobulin chain, a MHC I heavy chain combined with MHC I beta2microglobulin chain through a flexible linker, a MHC I heavy chain combined with an antigenic peptide, a MHC I heavy chain combined with an antigenic peptide through a linker, a MHC I heavy chain/MHC I beta2microglobulin dimer combined with an antigenic peptide, and a MHC I heavy chain/MHC I beta2microglobulin dimer combined with an antigenic peptide through a flexible linker to the heavy chain or beta2microglobulin. The MHC I molecule chains can be changed by substitution of single or by cohorts of native amino acids, or by inserts, or deletions to enhance or impair the functions attributed to said molecule.

MHC complex: MHC complex is herein used interchangeably with MHC-peptide complex, and defines any MHC I and/or MHC II molecule combined with antigenic peptide unless it is specified that the MHC complex is empty, i.e. is not complexed with antigenic peptide MHC Class I like molecules (including non-classical MHC Class I molecules) include CD1d, HLA E, HLA G, HLA F, HLA H, MICA, MIC B, ULBP-1, ULBP-2, and ULBP-3.

A "MHC Class II molecule" as used everywhere herein is used interchangeably with MHC II molecule and is defined as a molecule which comprises 2-3 subunits including a MHC II alpha-chain and a MHC II beta-chain (i.e. a MHC II alpha/beta-dimer), an MHC II alpha/beta dimer with an antigenic peptide, and an MHC II alpha/beta dimer combined with an antigenic peptide through a flexible linker to the MHC II alpha or MHC II beta chain, a MHC II alpha/beta dimer combined through an interaction by affinity tags e.g. jun-fos, a MHC II alpha/beta dimer combined through an interaction by affinity tags e.g. jun-fos and further combined with an antigenic peptide through a flexible linker to the MHC II alpha or MHC II beta chain. The MHC II molecule chains can be changed by substitution of single or by cohorts of native amino acids, or by inserts, or deletions to enhance or impair the functions attributed to said molecule. Under circumstances where the MHC II alpha-chain and MHC II beta-chain have been fused, to form one subunit, the "MHC Class II molecule" can comprise only 1 subunit or 2 subunits if antigenic peptide also. Included.

By example, it has been shown that substitution of XX with YY in position nn of human MHC II beta chain enhance the biochemical stability of MHC Class II molecules and thus can lead to more efficient antigen presentation of subdominant antigenic peptide epitopes.

MHC Class II like molecules (including non-classical MHC Class II molecules) include HLA DM, HLA DO, I-A beta2, and I-E beta2.

A "peptide free MHC Class I molecule" is used interchangeably herein with "peptide free MHC I molecule" and as used everywhere herein is meant to be a MHC Class I molecule as defined above with no peptide.

A "peptide free MHC Class II molecule" is used interchangeably herein with "peptide free MHC II molecule" and as used everywhere herein is meant to be a MHC Class II molecule as defined above with no peptide.

Such peptide free MHC Class I and II molecules are also called "empty" MHC Class I and II molecules.

The MHC molecule may suitably be a vertebrate MHC molecule such as a human, a mouse, a rat, a porcine, a bovine or an avian MHC molecule. Such MHC complexes from different species have different names. E.g. in humans, MHC complexes are denoted HLA. The person skilled in the art will readily know the name of the MHC complexes from various species.

In general, the term "MHC molecule" is intended to include all alleles. By way of example, in humans e.g. HLA A, HLA B, HLA C, HLA D, HLA E, HLA F, HLA G, HLA H, HLA DR, HLA DQ and HLA DP alleles are of interest shall be included, and in the mouse system, H-2 alleles are of interest shall be included. Likewise, in the rat system RT1-alleles, in the porcine system SLA-alleles, in the bovine system BoLA, in the avian system e.g. chicken-B alleles, are of interest shall be included.

"MHC complexes" and "MHC constructs" are used interchangeably herein.

By the terms "MHC complexes" and "MHC multimers" as used herein are meant such complexes and multimers thereof, which are capable of performing at least one of the functions attributed to said complex or multimer. The terms include both classical and non-classical MHC complexes. The meaning of "classical" and "non-classical" in connection with MHC complexes is well known to the person skilled in the art. Non-classical MHC complexes are subgroups of MHC-like complexes. The term "MHC complex" includes MHC Class I molecules, MHC Class II molecules, as well as MHC-like molecules (both Class I and Class II), including the subgroup non-classical MHC Class I and Class II molecules.

MHC multimer: The terms MHC multimer, MHC-multimer, MHCmer and MHC'mer herein are used interchangeably, to denote a complex comprising more than one MHC-peptide complexes, held together by covalent or non-covalent bonds.

Monoclonal antibodies: Monoclonal antibodies, as used herein, are antibodies that are identical because they were produced by one type of immune cell and are all clones of a single parent cell.

Monovalent antibodies: The antibodies in the present invention can be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain crosslinking. Alternatively, the relevant cysteine residues are substituted with another amino acid residue or are deleted so as to prevent crosslinking. In vitro methods are also suitable for preparing monovalent antibodies. Digestion of antibodies to produce fragments thereof, particularly, Fab fragments, can be accomplished using routine techniques known in the art.

Multimerization domain: A multimerization domain is a molecule, a complex of molecules, or a solid support, to which one or more MHC or MHC-peptide complexes can be attached. A multimerization domain consist of one or more carriers and/or one or more scaffolds and may also contain one or more linkers connecting carrier to scaffold, carrier to carrier, scaffold to scaffold. The multimerization domain may also contain one or more linkers that can be used for attachment of MHC complexes and/or other molecules to the multimerization domain.

Multimerization domains thus include IgG, streptavidin, streptactin, micelles, cells, polymers, beads and other types of solid support, and small organic molecules carrying reactive groups or carrying chemical motifs that can bind MHC complexes and other molecules.

Mycobacteria: is a genus of bacteria belonging to Actinobacteria. Mycobacteria of the present invention includes all pathogen and non-pathogen species of the Actinobacteria family Mycobacteriaceae and includes but is not limited to the following: *M. abscessus, M. africanum, M. agri, M. aichiense, M. alvei, M. arupense, M. asiaticum, M. aubagnense, M. aurum, M. austroafricanum, Mycobacterium avium* complex, *M. avium, M. avium* paratuberculosis, *M. avium silvaticum, M. avium "hominissuis", M. colombiense, M. boenickei, M. bohemicum, M. bolletii, M. botniense, M. bovis, M. branderi, M. brisbanense, M. brumae, M. canariasense, M. caprae, M. celatum, M. chelonae, M. chimaera, M. chitae, M. chlorophenolicum, M. chubuense, M. conceptionense, M. confluentis, M. conspicuum, M. cookii, M. cosmeticum, M. diernhoferi, M. doricum, M. duvalii, M. elephantis, M. fallax, M. farcinogenes, M. flavescens, M. florentinum, M. fluoroanthenivorans, M. fortuitum, M. fortuitum* subsp. *acetamidolyticum, M. frederiksbergense, M. gadium, M. gastri, M. genavense, M. gilvum, M. goodii, M. gordonae, M. haemophilum, M. hassiacum, M. heckeshornense, M. heidelbergense, M. hiberniae, M. hodleri, M. holsaticum, M. houstonense, M. immunogenum, M. interjectum, M. intermedium, M. intracellulare, M. kansasii, M. komossense, M. kubicae, M. kumamotonense, M. lacus, M. lentiflavum, M. leprae, which causes leprosy, M. lepraemurium, M. madagascariense, M. mageritense, M. malmoense, M. marinum, M. massiliense, M. microti, M. monacense, M. montefiorense, M. moriokaense, M. mucogenicum, M. murale, M. nebraskense, M. neoaurum, M. neworleansense, M. nonchromogenicum, M. novocastrense, M. obuense, M. palustre, M. parafortuitum, M. parascrofulaceum, M. parmense, M. peregrinum, M. phlei, M. phocaicum, M. pinnipedii, M. porcinum, M. poriferae, M. pseudoshottsii, M. pulveris, M. psychrotolerans, M. pyrenivorans, M. rhodesiae, M. saskatchewanense, M. scrofulaceum, M. senegalense, M. seoulense, M. septicum, M. shimoidei, M. shottsii, M. simiae, M. smegmatis, M. sphagni, M. szulgai, M. terrae, M. thermoresistibile, M. tokaiense, M. triplex, M. triviale, Mycobacterium tuberculosis* complex (MTBC), *M. tuberculosis, M. bovis, M. bovis* BCG, *M. africanum, M. canetti, M. caprae, M. pinnipedii', M. tusciae, M. ulcerans, M. vaccae, M. vanbaalenii, M. wolinskyi, M. xenopi.*

Mycobacteria tuberculosis: Mycobacteria tuberculosis is used interchangeably herein with *M. tuberculosis* and defines all genetic variations and strain variations of Mycobacteria tuberculosis that causes tuberculosis or related disease.

Nanobodies: Nanobodies as used herein is a type of antibodies derived from camels, and are much smaller than traditional antibodies.

Neutralizing antibodies: neutralizing antibodies as used herein is an antibody which, on mixture with the homologous infectious agent, reduces the infectious titer.

NMR: NMR (Nuclear magnetic resonance), as used herein, is a physical phenomenon based upon the quantum mechanical magnetic properties of an atom's nucleus. NMR refers to a family of scientific methods that exploit nuclear magnetic resonance to study molecules.

Non-covalent: The term noncovalent bond as used herein is a type of chemical bond, that does not involve the sharing of pairs of electrons, but rather involves more dispersed variations of electromagnetic interactions.

Nucleic acid duplex: A nucleic acid is a complex, high-molecular-weight biochemical macromolecule composed of nucleotide chains that convey genetic information. The most common nucleic acids are deoxyribonucleic acid (DNA) and ribonucleic acid (RNA).

Nucleophilic: a nucleophile, as used herein, is a reagent that forms a chemical bond to its reaction partner (the electrophile) by donating both bonding electrons.

"One or more" as used everywhere herein is intended to include one and a plurality.

A "peptide free MHC Class I molecule" as used everywhere herein is meant to be a MHC Class I molecule as defined above with no peptide.

A "peptide free MHC Class II molecule" as used everywhere herein is meant to be a MHC Class II molecule as defined above with no peptide.

Such peptide free MHC Class I and II molecules are also called "empty" MHC Class I and II molecules.

Pegylated: pegylated, as used herein, is conjugation of Polyethylene glycol (PEG) to proteins.

Pentamer, MHC pentamer and pentamer MHC multimer is used interchangeable herein and refers to a MHC multimer comprising 5 MHC molecules and optionally one or more labelling compounds.

Peptide or protein: Any molecule composed of at least two amino acids. Peptide normally refers to smaller molecules of up to around 30 amino acids and protein to larger molecules containing more amino acids.

Phosphorylated; phosphorylated, as used herein, is the addition of a phosphate ($PO_4$) group to a protein molecule or a small molecule.

"A plurality" as used everywhere herein should be interpreted as two or more.

PNA: PNA (Peptide nucleic acid) as used herein is a chemical similar to DNA or RNA. PNA is not known to occur naturally in existing life on Earth but is artificially synthesized and used in some biological research and medical treatments. DNA and RNA have a deoxyribose and ribose sugar backbone, respectively, whereas PNA's backbone is composed of repeating N-(2-aminoethyl)-glycine units linked by peptide bonds. The various purine and pyrimidine bases are linked to the backbone by methylene carbonyl bonds. PNAs are depicted like peptides, with the N-terminus at the first (left) position and the C-terminus at the right.

"A plurality" as used everywhere herein should be interpreted as two or more. This applies i.a. to the MHC peptide complex and the binding entity. When a plurality of MHC peptide complexes is attached to the multimerization domain, such as a scaffold or a carrier molecule, the number of MHC peptide complexes need only be limited by the capacity of the multimerization domain.

Polyclonal antibodies: a polyclonal antibody as used herein is an antibody that is derived from different B-cell lines. They are a mixture of immunoglobulin molecules secreted against a specific antigen, each recognising a different epitope.

Polymer: the term polymer as used herein is defined as a compound composed of repeating structural units, or monomers, connected by covalent chemical bonds.

Polypeptide: Peptides are the family of short molecules formed from the linking, in a defined order, of various α-amino acids. The link between one amino acid residue and the next is an amide bond and is sometimes referred to as a peptide bond. Longer peptides are referred to as proteins or polypeptide.

Polysaccharide: The term polysaccharide as used herein is defined as polymers made up of many monosaccharides joined together by glycosidic linkages.

Radicals: radicals, as used herein, are atomic or molecular species with unpaired electrons on an otherwise open shell configuration. These unpaired electrons are usually highly reactive, so radicals are likely to take part in chemical reactions.

Radioactivity: Radioactive decay is the process in which an unstable atomic nucleus loses energy by emitting radiation in the form of particles or electromagnetic waves.

RNA: RNA (Ribonucleic acid) as used herein is a nucleic acid polymer consisting of nucleotide monomers that plays several important roles in the processes that translate genetic information from deoxyribonucleic acid (DNA) into protein products Scaffold: A scaffold is typically an organic molecule carrying reactive groups, capable of reacting with reactive groups on a MHC-peptide complex. Particularly small organic molecules of cyclic structure (e.g. functionalized cycloalkanes or functionalized aromatic ring structures) are termed scaffolds. Scaffold and carrier are used interchangeably herein where scaffold typically refers to smaller molecules of a multimerization domain and carrier typically refers to larger molecule and/or cell like structures.

Staining: In this invention staining means specific or unspecific labelling of cells by binding labeled molecules to defined proteins or other structures on the surface of cells or inside cells. The cells are either in suspension or part of a tissue. The labeled molecules can be MHC multimers, antibodies or similar molecules capable of binding specific structures on the surface of cells.

Streptavidin: Streptavidin as used herein is a tetrameric protein purified from the bacterium *Streptomyces avidinii*. Streptavidin is widely use in molecular biology through its extraordinarily strong affinity for biotin.

Sugar: Sugars as used herein include monosaccharides, disaccharides, trisaccharides and the oligosaccharides—comprising 1, 2, 3, and 4 or more monosaccharide units respectively.

Therapy: Treatment of illness or disability

Tuberculosis: tuberculosis is used interchangeably herein with TB and defines infectious disease caused by mycobacteria.

Vaccine: A vaccine is an antigenic preparation used to establish immunity to a disease or illness and thereby protects or cure the body from a specific disease or illness. Vaccines are either prophylactic and prevent disease or therapeutic and treat disease. Vaccines may contain more than one type of antigen and is then called a combined vaccine.

Vaccination: The introduction of vaccine into the body of human or animals for the purpose of inducing immunity.

B.L. is an abereviation for Bind level

Aff. Is an abbreviation for affinity

DETAILED DESCRIPTION OF INVENTION

The present invention in one aspect refers to a MHC monomer comprising a-b-P, or a MHC multimer comprising $(a\text{-}b\text{-}P)_n$, wherein n>1, wherein a and b together form a functional MHC protein capable of binding the peptide P, wherein (a-b-P) is the MHC-peptide complex formed when the peptide P binds to the functional MHC protein, and wherein each MHC peptide complex of a MHC multimer is associated with one or more multimerization domains.

The peptide is in one embodiment a tuberculosis peptide such as e.g. a peptide derived from *Mycobacterium tuberculosis.*

MHC monomers and MHC multimers comprising one or more MHC peptide complexes of class 1 or class 2 MHC are covered by the present invention. Accordingly, the peptide P can have a length of e.g. 8, 9, 10, 11, 12, 13, 14, 15, 16, 16-20, or 20-30 amino acid residues.

Examples of the peptide P is provided herein below. In one embodiment, the peptide P can be selected from the group consisting of sequences disclosed in the electronically enclosed "Sequence Listing" and annotated consecutively (using integers) starting with SEQ ID NO:1 and ending with SEQ ID NO:202024.

In another aspect the present invention is directed to a composition comprising a plurality of MHC monomers and/or MHC multimers according to the present invention, wherein the MHC multimers are identical or different, and a carrier.

In yet another aspect there is provided a kit comprising a MHC monomer or a MHC multimer according to the present invention, or a composition according to the present invention, and at least one additional component, such as a positive control and/or instructions for use.

In a still further aspect there is provided a method for immune monitoring one or more diseases comprising monitoring of antigen-specific T cells, said method comprising the steps of i) providing the MHC monomer or MHC multimer or individual components thereof according to the present invention, or the individual components thereof,
ii) providing a population of antigen-specific T cells or individual antigen-specific T cells, and
iii) measuring the number, activity or state and/or presence of antigen-specific of T cells specific for the peptide P of the said MHC monomer or MHC multimer, thereby immune monitoring said one or more diseases.

In yet another aspect there is provided a method for diagnosing one or more diseases comprising immune monitoring of antigen-specific T cells, said method comprising the following steps: of i) providing the MHC monomer or MHC multimer or individual components thereof according to the present invention, or individual components thereof,
ii) providing a population of antigen-specific T cells or individual antigen-specific T cells, and
iii) measuring the number, activity or state and/or presence of T cells specific for said MHC monomer or the peptide P of the MHC multimer, thereby diagnosing said one or more diseases.

There is also provided a method for isolation of one or more antigen-specific T cells, said method comprising the steps of i) providing the MHC monomer or MHC multimer or individual components thereof according to the present invention, or individual components thereof, and
ii) providing a population of antigen-specific T cells or individual antigen-specific T cells, and
iii) thereby isolating said T cells specific for the peptide P of the said MHC monomer or MHC multimer.

The present invention makes it possible to pursue different immune monitoring methods using the MHC monomers and MHC multimers according to the present invention. The immune monitoring methods include e.g. flow cytometry, ELISPOT, LDA, Quantaferon and Quantaferon-like methods. Using the above-cited methods, the MHC monomers and/or the MHC multimers can be provided as a MHC peptide complex, or the peptide and the MHC monomer and/or multimer can be provided separately.

Accordingly, recognition of TCR's can be achieved by direct or indirect detection, e.g. by using one or more of the following methods:

ELISPOT technique using indirect detection, e.g. by adding the antigenic peptide optionally associated with a MHC monomer or MHC multimer, followed by measurement of INF-gamma secretion from a population of cells or from individual cells.

Another technique involves a Quantaferon-like detection assays, e.g. by using indirect detection, e.g. by adding the antigenic peptide optionally associated with a MHC monomer or MHC multimer, followed by measurement of INF-gamma secretion from a population of cells or from individual cells.

Flow cytometry offers another alternative for performing detection assays, e.g. by using direct detection (e.g. of MHC tetramers), e.g. by adding the antigenic peptide optionally associated with a MHC monomer or MHC multimer, followed by detection of a fluorescein label, thereby measuring the number of TCRs on specific T-cells.

Flow cytometry can also be used for indirect detection, e.g. by adding the antigenic peptide optionally associated with a MHC monomer or MHC multimer, followed by addition of a "cell-permeabilizing factor", and subsequent measurement of an intracellular component (e.g. INF-gamma mRNA), from individual cells or populations of cells.

By using the above-mentioned and other techniques, one can diagnose and/or monitor e.g. infectious diseases caused e.g. by mycobacetrium, Gram positive bacteria, Gram negative bacteria, Spirochetes, intracellular bacterium, extracelular bacterium, *Borrelia*, TB, CMV, HPV, Hepatitis, BK, fungal organisms and microorganisms. The diagnosis and/or monitoring of a particular disease can greatly aid in directing an optimal treatment of said disease in an individual. Cancer diagnostic methods and/or cancer monitoring methods also fall within the scope of the present invention.

In still further aspects of the present invention there is provided a method for performing a vaccination of an individual in need thereof, said method comprising the steps of providing a MHC monomer or a MHC multimer according to the present invention, or the individual components thereof, and
administering said MHC monomer or MHC multimer to said individual and obtaining a protective immune response, thereby performing a vaccination of the said individual.

In yet another embodiment there is provided a method for performing therapeutic treatment of an individual comprising the steps of Providing the MHC multimer according to the present invention, or individual components thereof, and
Isolating or obtaining T-cells from a source, such as an individual or an ex-vivo library or cell bank, wherein said isolated or obtained T-cells are specific for said provided MHC multimer,
Optionally manipulating said T-cells, and
Introducing said isolated or obtained T-cells into an individual to be subjected to a therapeutic treatment, wherein the individual can be the same individual or a different individual from the source individual.

There is also provided a method comprising one or more steps for minimizing undesired binding of the MHC multimer according to the present invention. This method is disclosed herein below in more detail.

In further aspects the present invention provides:

A method for performing a control experiment comprising the step of counting of particles comprising the MHC multimer according to the present invention.

A method for performing a control experiment comprising the step of sorting of particles comprising the MHC multimer according to the present invention.

A method for performing a control experiment comprising the step of performing flow cytometry analysis of particles comprising the MHC multimer according to the present invention.

A method for performing a control experiment comprising the step of performing a immunohistochemistry analysis comprising the MHC multimer according to the present invention.

A method for performing a control experiment comprising the step of performing a immunocytochemistry analysis comprising the MHC multimer according to the present invention.

A method for performing a control experiment comprising the step of performing an ELISA analysis comprising the MHC multimer according to the present invention.

In a still further aspect of the present invention there is provided a method for generating MHC multimers according to the present invention, said method comprising the steps of i) providing one or more peptides P; and/or
ii) providing one or more functional MHC proteins,
iii) optionally providing one or more multimerization domains, and
iv) contacting the one or more peptides P and the one or more functional MHC proteins and the one or more multimerization domains simultaneously or sequentially in any order, thereby obtaining MHC multimers according to the present invention.

The method can also be performed by initially providing one or more antigenic peptide(s) P and one or more functional MHC proteins to generate a MHC-peptide complex (a-b-P); subsequently providing one or more multimerisation domain(s); and reacting the one or more MHC-peptide complexes and the one or more multimerization domain(s) to generate a MHC multimer according to the present invention.

In one aspect, the present invention is directed to novel MHC complexes optionally comprising a multimerization domain preferably comprising a carrier molecule and/or a scaffold.

There is also provided a MHC multimer comprising 2 or more MHC-peptide complexes and a multimerization domain to which the 2 or more MHC-peptide complexes are associated. The MHC multimer can generally be formed by association of the 2 or more MHC-peptide complexes with the multimerization domain to which the 2 or more MHC-peptide complexes are capable of associating.

The multimerization domain can be a scaffold associated with one or more MHC-peptide complexes, or a carrier associated with one or more, preferably more than one, MHC-peptide complex(es), or a carrier associated with a plurality of scaffolds each associated with one or more MHC-peptide complexes, such as 2 MHC-peptide complexes, 3 MHC-peptide complexes, 4 MHC-peptide complexes, 5 MHC-peptide complexes or more than 5 MHC-peptide complexes. Accordingly, multimerization domain collectively refers to each and every of the above. It will be clear from the detailed description of the invention provided herein below when the multimerization domain refers to a scaffold or a carrier or a carrier comprising one or more scaffolds.

Generally, when a multimerization domain comprising a carrier and/or a scaffold is present, the MHC complexes can be associated with this domain either directly or via one or more binding entities. The association can be covalent or non-covalent.

Accordingly, there is provided in one embodiment a MHC complex comprising one or more entities $(a\text{-}b\text{-}P)_n$, wherein a and b together form a functional MHC protein capable of binding a peptide P, and wherein (a-b-P) is the MHC-peptide complex formed when the peptide P binds to the functional MHC protein, said MHC complex optionally further comprising a multimerization domain comprising a carrier molecule and/or a scaffold. “MHC complex” refers to any MHC complex, including MHC monomers in the form of a single MHC-peptide complex and MHC multimers comprising a multimerization domain to which more than one MHC peptide complex is associated.

When the invention is directed to complexes comprising a MHC multimer, i.e. a plurality of MHC peptide complexes of the general composition $(a\text{-}b\text{-}P)_n$ associated with a multimerization domain, n is by definition more than 1, i.e. at least 2 or more. Accordingly, the term “MHC multimer” is used herein specifically to indicate that more than one MHC-peptide complex is associated with a multimerization domain, such as a scaffold or carrier or carrier comprising one or more scaffolds. Accordingly, a single MHC-peptide complex can be associated with a scaffold or a carrier or a carrier comprising a scaffold and a MHC-multimer comprising 2 or more MHC-peptide complexes can be formed by association of the individual MHC-peptide complexes with a scaffold or a carrier or a carrier comprising one or more scaffolds each associated with one or more MHC-peptide complexes.

When the MHC complex comprises a multimerization domain to which the n MHC-peptide complexes are associated, the association can be a covalent linkage so that each or at least some of the n MHC-peptide complexes is covalently linked to the multimerization domain, or the association can be a non-covalent association so that each or at least some of the n MHC-peptide complexes are non-covalently associated with the multimerization domain.

The MHC complexes of the invention may be provided in non-soluble or soluble form, depending on the intended application.

Effective methods to produce a variety of MHC complexes comprising highly polymorphic human HLA encoded proteins makes it possible to perform advanced analyses of complex immune responses, which may comprise a variety of peptide epitope specific T-cell clones.

One of the benefits of the MHC complexes of the present invention is that the MHC complexes overcome low intrinsic affinities of monomer ligands and counter receptors. The MHC complexes have a large variety of applications that include targeting of high affinity receptors (e.g. hormone peptide receptors for insulin) on target cells. Taken together poly-ligand binding to target cells has numerous practical, clinical and scientifically uses.

Thus, the present invention provides MHC complexes which present mono-valent or multi-valent binding sites for MHC recognising cells, such as MHC complexes optionally comprising a multimerization domain, such as a scaffold or a carrier molecule, which multimerization domain have attached thereto, directly or indirectly via one or more linkers, covalently or non-covalently, one or more MHC peptide complexes. "One or more" as used herein is intended to include one as well as a plurality, such as at least 2. This applies i.a. to the MHC peptide complexes and to the binding entities of the multimerization domain. The scaffold or carrier molecule may thus have attached thereto a MHC peptide complex or a plurality of such MHC peptide complexes, and/or a linker or a plurality of linkers.

Product

The product of the present invention is a MHC monomer or a MHC multimer as described above. As used in the description of this invention, the term "MHC multimers" will be used interchangeably with the terms MHC'mers and MHCmers, and will include any number, (larger than one) of MHC-peptide complexes, held together in a large complex by covalent or non-covalent interactions between a multimerization domain and one or more MHC-peptide complexes, and will also include the monomeric form of the MHC-peptide complex, i.e. a MHC-peptide complex that is not attached to a multimerization domain. The multimerization domain consists of one or more carriers and/or one or more scaffolds while the MHC-peptide complex consists of MHC molecule and antigenic peptide. MHC-peptide complexes may be attached to the multimerization domain through one or more linkers. A schematic representation of a MHC multimer is presented in FIG. 1.

Design and Generation of Antigenic Peptides

Approaches and Methods for the Identification and Design of Appropriate Peptides MHC class 1 protein typically binds octa-, nona-, deca- or ondecamer (8-, 9-, 10-, 11-mer) peptides in their peptide binding groove. The individual MHC class 1 alleles have individual preferences for the peptide length within the given range. MHC class 2 proteins typically bind peptides with a total length of 13-18 amino acids, comprising a 9'-mer core motif containing the important amino acid anchor residues. However the total length is not strictly defined, as opposed to most MHC class 1 molecules.

For some of the MHC alleles the optimal peptide length and the preferences for specific amino acid residues in the so called anchor positions are known.

To identify high-affinity binding peptides derived from a specific protein for a given MHC allele it is necessary to systematically work through the amino acid sequence of the protein to identify the putative high-affinity binding peptides. Although a given peptide is a binder it is not necessarily a functional T-cell epitope. Functionality needs to be confirmed by a functional analysis e.g. ELISPOT, CTL killing assay or flow cytometry assay.

The binding affinity of the peptide for the MHC molecules can for some MHC molecules be predicted in databases such as www.syfpeithi.de; www-bimas.cit.nih.gov/molbio/hla_bind/; www.cbs.dtu.dk/services/NetMHC/; www.cbs.dtu.dk/services/NetMHCII/

Design of Binding Peptides

The first step in the design of binding peptides is obtaining the protein's amino acid sequence. When only the genomic DNA sequences are known, i.e. the reading frame and direction of transcription of the genes is unknown, the DNA sequence needs to be translated in all three reading frames in both directions leading to a total of six amino acid sequences for a given genome. From these amino acid sequences binding peptides can then be identified as described below. In organisms having intron/exon gene structure the present approach must be modified accordingly, to identify peptide sequence motifs that are derived by combination of amino acid sequences derived partly from two separate introns. cDNA sequences can be translated into the actual amino acid sequences to allow peptide identification. In cases where the protein sequence is known, these can directly be used to predict peptide epitopes.

Binding peptide sequences can be predicted from any protein sequence by either a total approach, generating binding peptide sequences for potentially any MHC allele, or by a directed approach, identifying a subset of binding peptides with certain preferred characteristics such as affinity for MHC protein, specificity for MHC protein, likelihood of being formed by proteolysis in the cell, and other important characteristics.

Design of MHC Class 1 Binding Peptide Sequence

Many parameters influence the design of the individual binding peptide, as well as the choice of the set of binding peptides to be used in a particular application. Important characteristics of the MHC-peptide complex are physical and chemical (e.g. proteolytic) stability. The relevance of these parameters must be considered for the production of the MHC-peptide complexes and the MHC multimers, as well as for their use in a given application. As an example, the stability of the MHC-peptide complex in assay buffer (e.g. PBS), in blood, or in the body can be very important for a particular application. In the interaction of the MHC-peptide complex with the TCR, a number of additional characteristics must be considered, including binding affinity and specificity for the TCR, degree of cross-talk, undesired binding or interaction with other TCRs. Finally, a number of parameters must be considered for the interaction of MHC-peptide complexes or MHC multimers with the sample or individual it is being applied to. These include immunogenicity, allergenicity, as well as side effects resulting from un-desired interaction with "wrong" T cells, including cross-talk with e.g. autoimmune diseases and un-desired interaction with other cells than antigen-specific T cells.

For some applications, e.g. immuno profiling of an individual's immune response focused on one antigen, it is preferred that all possible binding peptides of that antigen are included in the application (i.e. the "total approach" for the design of binding peptides described below). For other applications, e.g vaccines it may be adequate to include a few or just one binding peptide for each of the HLA-alleles included in the application (i.e. the "directed approach" whereby only the most potent binding peptides can be included). Personalized diagnostics, therapeutics and vaccines will often fall in-between these two extremes, as it will only be necessary to include a few or just one binding peptide in e.g. a vaccine targeting a given individual, but the specific binding peptide may have to be picked from binding peptides designed by the total approach, and identified through the use of immuno profiling studies involving all possible binding peptides. The principles of immuno profiling is described elsewhere herein.

a) Total Approach

The MHC class 1 binding peptide prediction is done as follows using the total approach. The actual protein sequence is split up into 8-, 9-, 10-, and 11-mer peptide sequences. This is performed by starting at amino acid position 1 identifying the first 8-mer; then move the start position by one amino acid identifying the second 8-mer; then move the start position by one amino acid, identifying the third 8-mer. This procedure continues by moving start position by one amino acid for each round of peptide identification. Generated peptides will be amino acid position 1-8, 2-9, 3-10 etc. This procedure can be carried out manually or by means of a software program (FIG. 2). This procedure is then repeated in an identical fashion for 9-, 10 and 11-mers, respectively.

b) Directed Approach

The directed approach identifies a preferred subset of binding peptides from the binding peptides generated in the total approach. This preferred subset is of particularly value in a given context. Software programs are available that use neural networks or established binding preferences to predict the interaction of specific binding peptides with specific MHC class I alleles, and/or probability of the binding peptide in question to be generated by the proteolytic machinery of the average individual. However, the proteolytic activity varies a lot among individuals, and for personalized diagnostics, treatment or vaccination it may be desirable to disregard these general proteolytic data. Examples of such programs are www.syfpeithi.de; www.imtech.res.in/raghava/propred1/index.html; www.cbs.dtu.dk/services/NetMHC/. Identified peptides can then be tested for biological relevance in functional assays such as Cytokine release assays, ELISPOT and CTL killing assays or their binding to selected MHC molecules may be determined in binding assays.

Prediction of good HLA class 1 peptide binders can be done at the HLA superfamily level even taking the combined action of endosolic, cytosolic and membrane bound protease activities as well as the TAP1 and TAP2 transporter specificities into consideration using the program www.cbs.dtu.dk/services/NetCTL/.

Alternatively, simple consensus sequences for the individual MHC allele can be used to choose a set of relevant binding peptides that will suit the "average" individual. Such consensus sequences often solely consider the affinity of the binding peptide for the MHC protein; in other words, a subset of binding peptides is identified where the designed binding peptides have a high probability of forming stable MHC-peptide complexes, but where it is uncertain whether this MHC-peptide complex is of high relevance in a population, and more uncertain whether this MHC-peptide complex is of high relevance in a given individual.

For class I MHC-alleles, the consensus sequence for a binding peptide is generally given by the formula X1-X2-X3-X4- . . . -Xn, where n equals 8, 9, 10, or 11, and where X represents one of the twenty naturally occurring amino acids, optionally modified as described elsewhere in this application. X1-Xn can be further defined. Thus, certain positions in the consensus sequence are the so called anchor positions and the selection of useful amino acids for these positions is limited to those able to fit into the corresponding binding pockets in the HLA molecule. For HLA-A*02, for example, X2 and X9 are primary anchor positions and useful amino acids at these two positions in the binding peptide are preferable limited to leucine or methionine for X2 and to valine or leucine at position X9. In contrast the primary anchor positions of peptides binding HLA-B*08 are X3, X5 and X9 and the corresponding preferred amino acids at these positions are lysine at position X3, lysine or arginine at position X5 and leucine at position X9.

Design of MHC Class 2 Binding Peptide Sequence.

a) Total Approach and b) Directed Approach

The approach to predict putative peptide binders for MHC class 2 can be done in a similar way as described for MHC class 1 binding peptide prediction above. The change is the different size of the peptides, which is preferably 13-16 amino acids long for MHC class 2. The putative binding peptide sequences only describe the central part of the peptide including the 9-mer core peptide; in other words, the peptide sequences shown represent the core of the binding peptide with a few important flanking amino acids, which in some cases may be of considerably length generating binding peptides longer than the 13-16 amino acids.

Alternatively, simple consensus sequences for the individual MHC allele can be used to choose a set of relevant binding peptides that will suit the "average" individual. Such consensus sequences often solely consider the affinity of the binding peptide for the MHC protein; in other words, a subset of binding peptides is identified where the designed binding peptides have a high probability of forming stable MHC-peptide complexes, but where it is uncertain whether this MHC-peptide complex is of high relevance in a population, and more uncertain whether this MHC-peptide complex is of high relevance in a given individual.

For class II MHC-alleles, the consensus sequence for the interacting core of a binding peptide is generally given by the formula X1-X2-X3-X4- . . . -Xn, where n equals 9, and where X represents one of the twenty naturally occurring amino acids, optionally modified as described elsewhere in this application.

X1-Xn can be further defined. Thus, certain positions in the consensus sequence are the so called anchor positions and the selection of useful amino acids for these positions is limited to those able to fit into the corresponding binding pockets in the HLA molecule. For example HLA-DRB1*1501 have X1, X4 and X7 as primary anchor positions where preferred amino acids at the three positions are as follows, X1: leucine, valine and isoleucine, X4: phenylalanine, tyrosine or isoleucine, X7: isoleucine, leucine, valine, methionine or phenylalanine. In general, MHC II binding peptides have much more varied anchor positions than MHC I binding peptides and the number of useful amino acids at each anchor position is much higher.

Choice of MHC Allele

More than 600 MHC alleles (class 1 and 2) are known in humans; for many of these, the peptide binding characteristics are known. FIG. 3 presents an updated list of the HLA class 1 alleles. The frequency of the different HLA alleles varies considerably, also between different ethnic groups (FIG. 4). Thus it is of outmost importance to carefully select the MHC alleles that corresponds to the population that one wish to study.

The Combined Choice of Peptide, MHC and Carrier.

Above it has been described how to generate binding peptides, and which MHC alleles are available. Below it is further described how one may modify the binding peptides in order to increase the stability, affinity, specificity and other features of the MHC-peptide complex or the MHC multimer. In the following it is described what characteristics of binding peptides and MHC alleles are important when using the MHC-peptide complex or MHC-multimer for different purposes.

A first preferred embodiment employs binding peptides of particularly high affinity for the MHC proteins. This may be done in order to increase the stability of the MHC-peptide complex. A higher affinity of the binding peptide for the MHC proteins may in some instances also result in increased rigidity of the MHC-peptide complex, which in turn often will result in higher affinity and/or specificity of the MHC-peptide complex for the T-cell receptor. A higher affinity and specificity will in turn have consequences for the immunogenicity and allergenicity, as well as possible side-effects of the MHC-peptide complex in e.g. the body.

Binding peptides of particularly high affinity for the MHC proteins may be identified by several means, including the following.

- Incubation of candidate binding peptides and MHC proteins, followed by analysis of the resulting complexes to identify those binding peptides that have most frequently been associated with MHC proteins. The binding peptides that have most frequently been associated with MHC proteins typically will represent high-affinity binding peptides. The identification of binding peptides with particularly high-affinity may involve enrichment of binding peptides, e.g. incubation of candidate peptides with immobilized MHC molecules, removal of non-binding peptides by e.g. washing, elution of binding peptides. This pool of peptides enriched for binding to the chosen MHC molecules may then be identified e.g. by mass spectrometry or HPLC and amino acid sequencing or the pool can be further enriched by another round of incubation with immobilized MHC.
- Candidate binding peptides may be compared to consensus sequences for the binding to a specific MHC allele. Thus, for a given class 1 allele, the consensus 8'mer sequence may be given by the sequence "X1-X2-X3-X4-X5-X6-X7-X8", where each of the X1-X8 amino acids can be chosen from a specific subset of amino acids, as described above.
- Those binding peptides that correlate the best with the consensus sequence are expected to have particularly high affinity for the MHC allele in question.
- Based on a large data set of affinities of binding peptides for specific MHC alleles, software programs (often involving neural networks) have been developed that allow a relatively accurate prediction of the affinity of a given candidate binding peptide for a given MHC allele. By examining candidate binding peptides using such software programs, one can identify binding peptides of expected high-affinity for the MHC molecule.

A second preferred embodiment employs binding peptides with medium affinity for the MHC molecule. A medium affinity of the peptide for the MHC protein will often lead to lower physical and chemical stability of the MHC-peptide complex, which can be an advantage for certain applications. As an example, it is often desirable to administer a drug on a daily basis due to convenience. An MHC-peptide complex-based drug with high stability in the body would not allow this. In contrast a binding peptide with medium or low affinity for the MHC protein can be an advantage for such applications, since these functional MHC-peptide molecules will be cleared more rapidly from the body due to their lower stability.

For some applications where some level of cross-talk is desired, e.g. in applications where the target is a number of T cell clones that interact with a number of structurally related MHC-peptide complexes, e.g. MHC-peptide complexes containing binding peptides from different strains of a given species, a medium or low affinity of the binding peptide for the MHC protein can be an advantage. Thus, these MHC-peptide complexes are often more structurally flexible, allowing the MHC-peptide complexes to interact with several structurally related TCRs.

The affinity of a given peptide for a MHC protein, predicted by a software program or by its similarity to a consensus sequence, should only be considered a guideline to its real affinity. Moreover, the affinity can vary a lot depending on the conditions in the environment, e.g. the affinity in blood may be very different from the affinity in a biochemical assay. Further, in the context of a MHC multimer, the flexibility of the MHC-peptide complex can sometimes be an important parameter for overall avidity.

In summary, a lot of factors must be considered for the choice of binding peptides in a certain application. Some applications benefit from the use of all possible binding peptides for an antigen ("total approach"), other applications benefit from the selective choice of just a few binding peptides. Depending on the application, the affinity of the binding peptide for MHC protein is preferably high, medium, or low; the physical and/or chemical stability of the MHC-peptide complex is preferably high, medium or low; the binding peptide is preferably a very common or very rare epitope in a given population; etc.

It is obvious from the above preferred embodiments that most or all of the binding peptides generated by the total approach have important applications. In other words, in order to make relevant MHC multimers that suit the different applications with regard to e.g. personalized or general targeting, or with regard to affinity, avidity, specificity, immunogenicity, stimulatory efficiency, or stability, one must be able to choose from the whole set of binding peptides generated by the total approach Peptide Modifications In addition to the binding peptides designed by the total approach, homologous peptides and peptides that have been modified in the amino acid side chains or in the backbone can be used as binding peptides.

Homologous Peptides

Homologues MHC peptide sequences may arise from the existence of multiple strongly homologous alleles, from small insertions, deletions, inversions or substitutions. If they are sufficiently homologous to peptides derived by the total approach, i.e. have an amino acid sequence identity greater than e.g. more than 90%, more than 80%, or more than 70%, or more than 60%, to one or two binding peptides derived by the total approach, they may be good candidates. Identity is often most important for the anchor residues.

A MHC binding peptide may be of split- or combinatorial epitope origin i.e. formed by linkage of peptide fragments derived from two different peptide fragments and/or proteins. Such peptides can be the result of either genetic recombination on the DNA level or due to peptide fragment association during the complex break down of proteins during protein turnover. Possibly it could also be the result of faulty reactions during protein synthesis i.e. caused by some kind of mixed RNA handling. A kind of combinatorial peptide epitope can also be seen if a portion of a longer peptide make a loop out leaving only the terminal parts of the peptide bound in the groove.

Uncommon, Artificial and Chemically Modified Amino Acids.

Peptides having un-common amino acids, such as selenocysteine and pyrolysine, may be bound in the MHC groove as well. Artificial amino acids e.g. having the isomeric D-form may also make up isomeric D-peptides that can bind in the binding groove of the MHC molecules. Bound peptides may also contain amino acids that are chemically modified or being linked to reactive groups that can be activated to induce changes in or disrupt the peptide. Example post-translational modifications are shown below. However, chemical modifications of amino acid side chains or the peptide backbone can also be performed.

Any of the modifications can be found individually or in combination at any position of the peptide, e.g. position 1, 2, 3, 4, 5, 6, etc. up to n.

TABLE 1

Post translational modification of peptides
Protein primary structure and posttranslational modifications

| | |
|---|---|
| N-terminus | Acetylation, Formylation, Pyroglutamate, Methylation, Glycation, Myristoylation (Gly), carbamylation |
| C-terminus | Amidation, Glycosyl phosphatidylinositol (GPI), O-methylation, Glypiation, Ubiquitination, Sumoylation |
| Lysine | Methylation, Acetylation, Acylation, Hydroxylation, Ubiquitination, SUMOylation, Desmosine formation, ADP-ribosylation, Deamination and Oxidation to aldehyde |
| Cysteine | Disulfide bond, Prenylation, Palmitoylation |
| Serine/ Threonine | Phosphorylation, Glycosylation |
| Tyrosine | Phosphorylation, Sulfation, Porphyrin ring linkage, Flavin linkage GFP prosthetic group (Thr-Tyr-Gly sequence) formation, Lysine tyrosine quinone (LTQ) formation, Topaquinone (TPQ) formation |
| Asparagine | Deamidation, Glycosylation |
| Aspartate | Succinimide formation |
| Glutamine | Transglutamination |
| Glutamate | Carboxylation, Methylation, Polyglutamylation, Polyglycylation |
| Arginine | Citrullination, Methylation |
| Proline | Hydroxylation |

Post Translationally Modified Peptides

The amino acids of the antigenic peptides can also be modified in various ways dependent on the amino acid in question, or the modification can affect the amino- or carboxy-terminal end of the peptide. See table 1. Such peptide modifications are occurring naturally as the result of post translational processing of the parental protein. A non-exhaustive description of the major post translational modifications is given below, divided into three main types.

a) Modification that Adds a Chemical Moiety to the Binding Peptide.

- acetylation, the addition of an acetyl group, usually at the N-terminus of the protein
- alkylation, the addition of an alkyl group (e.g. methyl, ethyl). Methylation, the addition of a methyl group, usually at lysine or arginine residues is a type of alkylation. Demethylation involves the removal of a methyl-group.
- amidation at C-terminus
- biotinylation, acylation of conserved lysine residues with a biotin appendage
- formylation
- gamma-carboxylation dependent on Vitamin K
- glutamylation, covalent linkage of glutamic acid residues to tubulin and some other proteins by means of tubulin polyglutamylase
- glycosylation, the addition of a glycosyl group to either asparagine, hydroxylysine, serine, or threonine, resulting in a glycoprotein. Distinct from glycation, which is regarded as a nonenzymatic attachment of sugars.
- glycylation, covalent linkage of one to more than 40 glycine residues to the tubulin C-terminal tail
- heme moiety may be covalently attached
- hydroxylation, is any chemical process that introduces one or more hydroxyl groups (—OH) into a compound (or radical) thereby oxidizing it. The principal residue to be hydroxylated is Proline. The hydroxylation occurs at the $C^{\gamma}$ atom, forming hydroxyproline (Hyp). In some cases, proline may be hydroxylated instead on its $C^{\beta}$ atom. Lysine may also be hydroxylated on its $C^{\delta}$ atom, forming hydroxylysine (Hyl).
- iodination
- isoprenylation, the addition of an isoprenoid group (e.g. farnesol and geranylgeraniol)
- lipoylation, attachment of a lipoate functionality, as in prenylation, GPI anchor formation, myristoylation, farnesylation, geranylation
- nucleotides or derivatives thereof may be covalently attached, as in ADP-ribosylation and flavin attachment
- oxidation, lysine can be oxidized to aldehyde
- pegylation, addition of poly-ethylen-glycol groups to a protein. Typical reactive amino acids include lysine, cysteine, histidine, arginine, aspartic acid, glutamic acid, serine, threonine, tyrosine. The N-terminal amino group and the C-terminal carboxylic acid can also be used
- phosphatidylinositol may be covalently attached
- phosphopantetheinylation, the addition of a 4'-phosphopantetheinyl moiety from coenzyme A, as in fatty acid, polyketide, non-ribosomal peptide and leucine biosynthesis
- phosphorylation, the addition of a phosphate group, usually to serine, tyrosine, threonine or histidine
- pyroglutamate formation as a result of N-terminal glutamine self-attack, resulting in formation of a cyclic pyroglutamate group.
- racemization of proline by prolyl isomerase
- tRNA-mediated addition of amino acids such as arginylation
- sulfation, the addition of a sulfate group to a tyrosine.
- Selenoylation (co-translational incorporation of selenium in selenoproteins)

b) Modification that Adds Protein or Peptide.

- ISGylation, the covalent linkage to the ISG15 protein (Interferon-Stimulated Gene 15)
- SUMOylation, the covalent linkage to the SUMO protein (Small Ubiquitin-related MOdifier)
- ubiquitination, the covalent linkage to the protein ubiquitin.

c) Modification that Converts One or More Amino Acids to Different Amino Acids.

- citrullination, or deimination the conversion of arginine to citrulline
- deamidation, the conversion of glutamine to glutamic acid or asparagine to aspartic acid The peptide modifications can occur as modification of a single amino acid or more than one i.e. in combinations. Modifications can be present on any position within the peptide i.e. on position 1, 2, 3, 4, 5, etc. for the entire length of the peptide.

Sources of Binding Peptides a) From Natural Sources

The binding peptides can be obtained from natural sources by enzymatic digestion or proteolysis of natural proteins or proteins derived by in vitro translation of mRNA. Binding peptides may also be eluted from the MHC binding groove.

b) From Recombinant Sources

1) As Monomeric or Multimeric Peptide

Alternatively peptides can be produced recombinantly by transfected cells either as monomeric antigenic peptides or as multimeric (concatemeric) antigenic peptides. Optionally, the Multimeric antigenic peptides are cleaved to form monomeric antigenic peptides before binding to MHC protein.

2) As Part of a Bigger Recombinant Protein

Binding peptides may also constitute a part of a bigger recombinant protein e.g. consisting of, 2a) for MHC Class 1 Binding Peptides, Peptide-linker-β2m, β2m being full length or truncated;

Peptide-linker-MHC class 1 heavy chain, the heavy chain being full length or truncated. Most importantly the truncated class I heavy chain will consist of the extracellular part i.e the α1, □ α2, and a domains. The heavy chain fragment may also only contain the α1 and α2 domains, or α1 domain alone, or any fragment or full length β2m or heavy chain attached to a designer domain(s) or protein fragment(s).

2b) for MHC Class 2 Binding Peptides the Recombinant Construction can Consist of, Peptide-linker-MHC class 2 α-chain, full length or truncated;

Peptide-linker-MHC class 2 β-chain, full length or truncated;

Peptide-linker-MHC class 2 α-chain-linker-MHC class 2 β-chain, both chains can be full length or truncated, truncation may involve, omission of α- and/or β-chain intermembrane domain, or omission of α- and/or β□chain intermembrane plus cytoplasmic domains. MHC class 2 part of the construction may consist of fused domains from NH2-terminal, MHC class 2 β1 domain-MHC class 2 α1 domain-constant α3 of MHC class 1, or alternatively of fused domains from NH2-terminal, MHC class 2 α1 domain-MHC class 2 β1 domain-constant α3 of MHC class 1. In both cases □2m will be associated non-covalently in the folded MHC complex. β2m can also be covalently associated in the folded MHC class 2 complex if the following constructs are used from NH2 terminal, MHC class 2 β1 domain-MHC class 2 α1 domain-constant α3 of MHC class 1-linker-β2m, or alternatively of fused domains from NH2-terminal, MHC class 2 α1 domain-MHC class 2 β1 domain-constant α3 of MHC class 1-linker-β2m; the construct may also consist of any of the above MHC class 2 constructs with added designer domain(s) or sequence(s).

c) From Chemical Synthesis

MHC binding peptide may also be chemically synthesized by solid phase or fluid phase synthesis, according to standard protocols.

Comprehensive collections of antigenic peptides, derived from one antigen, may be prepared by a modification of the solid phase synthesis protocol, as described in the following and exemplified in Example 21.

The protocol for the synthesis of the full-length antigen on solid support is modified by adding a partial cleavage step after each coupling of an amino acid. Thus, the starting point for the synthesis is a solid support to which has been attached a cleavable linker. Then the first amino acid X1 (corresponding to the C-terminal end of the antigen) is added and a coupling reaction performed. The solid support now carries the molecule “linker-X1”. After washing, a fraction (e.g. 10%) of the cleavable linkers are now cleaved, to release into solution X1. The supernatant is transferred to a collection container. Additional solid support carrying a cleavable linker is added, e.g. corresponding to 10% of the initial amount of solid support.

Then the second amino acid X2 is added and coupled to X1 or the cleavable linker, to form on solid support the molecules “linker-X2” and “linker-X1-X2”. After washing, a fraction (e.g. 10%) of the cleavable linker is cleaved, to release into solution X2 and X1-X2. The supernatant is collected into the collection container, which therefore now contains X1, X2, and X1-X2. Additional solid support carrying a cleavable linker is added, e.g. corresponding to 10% of the initial amount of solid support.

Then the third amino acid X3 is added and coupled to X2 or the cleavable linker, to form on solid support the molecules “linker-X3”, “linker-X2-X3” and “linker-X1-X2-X3”. After washing, a fraction (e.g. 10%) of the cleavable linker is cleaved, to release into solution X3, X2-X3 and X1-X2-X3. The supernatant is collected into the collection container, which therefore now contains X1, X2, X3, X1-X2, X2-X3 and X1-X2-X3. Additional solid support carrying a cleavable linker is added, e.g. corresponding to 10% of the initial amount of solid support.

This step-wise coupling and partial cleavage of the linker is continued until the N-terminal end of the antigen is reached. The collection container will now contain a large number of peptides of different length and sequence. In the present example where a 10% partial cleavage was employed, a large fraction of the peptides will be 8'-mers, 9'-mers, 10'-mers and 11'-mers, corresponding to class I antigenic peptides. As an example, for a 100 amino acid antigen the 8'-mers will consist of the sequences X1-X2-X3-X4-X5-X6-X7-X8, X2-X3-X4-X5-X6-X7-X8-X9, . . . , X93-X94-X95-X96-X97-X98-X99-X100.

Optionally, after a number of coupling and cleavage steps or after each coupling and cleavage step, the used (inactivated) linkers on solid support can be regenerated, in order to maintain a high fraction of linkers available for synthesis. The collection of antigenic peptides can be used as a pool for e.g. the display by APCs to stimulate CTLs in ELISPOT assays, or the antigenic peptides may be mixed with one or more MHC alleles, to form a large number of different MHC-peptide complexes which can e.g. be used to form a large number of different MHC multimers which can e.g. be used in flow cytometry experiments.

Loading of the Peptide into the MHCmer

Loading of the peptides into the MHCmer being either MHC class 1 or class 2 can be performed in a number of ways depending on the source of the peptide and the MHC, and depending on the application. MHC class 2 molecules can in principle be loaded with peptides in similar ways as MHC class 1. However, due to complex instability the most successful approach have been to make the complexes recombinant in toto in eukaryotic cells from a gene construct encoding the following form (3 chain-flexible linker-α chain-flexible linker-antigenic peptide.

The antigenic peptide may be added to the other peptide chain(s) at different times and in different forms, as follows.

a) Loading of Antigenic Peptide During MHC Complex Folding a1) Antigenic Peptide is Added as a Free Peptide MHC class I molecules are most often loaded with peptide during assembly in vitro by the individual components in a folding reaction i.e. consisting of purified recombinant heavy chain α with the purified recombinant β2 microglobulin and a peptide or a peptide mix.

α2) Antigenic Peptide is Part of a Recombinant Protein Construct

Alternatively the peptide to be folded into the binding groove can be encoded together with e.g. the α heavy chain or fragment hereof by a gene construct having the structure, heavy chain-flexible linker-peptide. This recombinant molecule is then folded in vitro with β2-microglobulin.

b) Antigenic Peptide Replaces Another Antigenic Peptide by an Exchange Reaction.

b1) Exchange Reaction “in Solution”

Loading of desired peptide can also be made by an in vitro exchange reaction where a peptide already in place in the binding groove are being exchanged by another peptide species.

b2) Exchange Reaction “In Situ”

Peptide exchange reactions can also take place when the parent molecule is attached to other molecules, structures, surfaces, artificial or natural membranes and nanoparticles.

b3) Aided Exchange Reaction.

This method can be refined by making the parent construct with a peptide containing a meta-stable amino acid analog that is split by either light or chemically induction thereby leaving the parent structure free for access of the desired peptide in the binding groove.

b4) Display by In Vivo Loading

Loading of MHC class I and II molecules expressed on the cell surface with the desired peptides can be performed by an exchange reaction. Alternatively cells can be transfected by the peptides themselves or by the mother proteins that are then being processed leading to an in vivo analogous situation where the peptides are bound in the groove during the natural cause of MHC expression by the transfected cells. In the case of professional antigen presenting cells e.g. dendritic cells, macrophages, Langerhans cells, the proteins and peptides can be taken up by the cells themselves by phagocytosis and then bound to the MHC complexes the natural way and expressed on the cell surface in the correct MHC context.

Other Features of Product

In one preferred embodiment the MHC multimer is between 50,000 Da and 1,000,000 Da, such as from 50,000 Da to 980,000; for example from 50,000 Da to 960,000; such as from 50,000 Da to 940,000; for example from 50,000 Da to 920,000; such as from 50,000 Da to 900,000; for example from 50,000 Da to 880,000; such as from 50,000 Da to 860,000; for example from 50,000 Da to 840,000; such as from 50,000 Da to 820,000; for example from 50,000 Da to 800,000; such as from 50,000 Da to 780,000; for example from 50,000 Da to 760,000; such as from 50,000 Da to 740,000; for example from 50,000 Da to 720,000; such as from 50,000 Da to 700,000; for example from 50,000 Da to 680,000; such as from 50,000 Da to 660,000; for example from 50,000 Da to 640,000; such as from 50,000 Da to 620,000; for example from 50,000 Da to 600,000; such as from 50,000 Da to 580,000; for example from 50,000 Da to 560,000; such as from 50,000 Da to 540,000; for example from 50,000 Da to 520,000; such as from 50,000 Da to 500,000; for example from 50,000 Da to 480,000; such as from 50,000 Da to 460,000; for example from 50,000 Da to 440,000; such as from 50,000 Da to 420,000; for example from 50,000 Da to 400,000; such as from 50,000 Da to 380,000; for example from 50,000 Da to 360,000; such as from 50,000 Da to 340,000; for example from 50,000 Da to 320,000; such as from 50,000 Da to 300,000; for example from 50,000 Da to 280,000; such as from 50,000 Da to 260,000; for example from 50,000 Da to 240,000; such as from 50,000 Da to 220,000; for example from 50,000 Da to 200,000; such as from 50,000 Da to 180,000; for example from 50,000 Da to 160,000; such as from 50,000 Da to 140,000; for example from 50,000 Da to 120,000; such as from 50,000 Da to 100,000; for example from 50,000 Da to 80,000; such as from 50,000 Da to 60,000; such as from 100,000 Da to 980,000; for example from 100,000 Da to 960,000; such as from 100,000 Da to 940,000; for example from 100,000 Da to 920,000; such as from 100,000 Da to 900,000; for example from 100,000 Da to 880,000; such as from 100,000 Da to 860,000; for example from 100,000 Da to 840,000; such as from 100,000 Da to 820,000; for example from 100,000 Da to 800,000; such as from 100,000 Da to 780,000; for example from 100,000 Da to 760,000; such as from 100,000 Da to 740,000; for example from 100,000 Da to 720,000; such as from 100,000 Da to 700,000; for example from 100,000 Da to 680,000; such as from 100,000 Da to 660,000; for example from 100,000 Da to 640,000; such as from 100,000 Da to 620,000; for example from 100,000 Da to 600,000; such as from 100,000 Da to 580,000; for example from 100,000 Da to 560,000; such as from 100,000 Da to 540,000; for example from 100,000 Da to 520,000; such as from 100,000 Da to 500,000; for example from 100,000 Da to 480,000; such as from 100,000 Da to 460,000; for example from 100,000 Da to 440,000; such as from 100,000 Da to 420,000; for example from 100,000 Da to 400,000; such as from 100,000 Da to 380,000; for example from 100,000 Da to 360,000; such as from 100,000 Da to 340,000; for example from 100,000 Da to 320,000; such as from 100,000 Da to 300,000; for example from 100,000 Da to 280,000; such as from 100,000 Da to 260,000; for example from 100,000 Da to 240,000; such as from 100,000 Da to 220,000; for example from 100,000 Da to 200,000; such as from 100,000 Da to 180,000; for example from 100,000 Da to 160,000; such as from 100,000 Da to 140,000; for example from 100,000 Da to 120,000; such as from 150,000 Da to 980,000; for example from 150,000 Da to 960,000; such as from 150,000 Da to 940,000; for example from 150,000 Da to 920,000; such as from 150,000 Da to 900,000; for example from 150,000 Da to 880,000; such as from 150,000 Da to 860,000; for example from 150,000 Da to 840,000; such as from 150,000 Da to 820,000; for example from 150,000 Da to 800,000; such as from 150,000 Da to 780,000; for example from 150,000 Da to 760,000; such as from 150,000 Da to 740,000; for example from 150,000 Da to 720,000; such as from 150,000 Da to 700,000; for example from 150,000 Da to 680,000; such as from 150,000 Da to 660,000; for example from 150,000 Da to 640,000; such as from 150,000 Da to 620,000; for example from 150,000 Da to 600,000; such as from 150,000 Da to 580,000; for example from 150,000 Da to 560,000; such as from 150,000 Da to 540,000; for example from 150,000 Da to 520,000; such as from 150,000 Da to 500,000; for example from 150,000 Da to 480,000; such as from 150,000 Da to 460,000; for example from 150,000 Da to 440,000; such as from 150,000 Da to 420,000; for example from 150,000 Da to 400,000; such as from 150,000 Da to 380,000; for example from 150,000 Da to 360,000; such as from 150,000 Da to 340,000; for example from 150,000 Da to 320,000; such as from 150,000 Da to 300,000; for example from 150,000 Da to 280,000; such as from 150,000 Da to 260,000; for example from 150,000 Da to 240,000; such as from 150,000 Da to 220,000; for example from 150,000 Da to 200,000; such as from 150,000 Da to 180,000; for example from 150,000 Da to 160,000.

In another preferred embodiment the MHC multimer is between 1,000,000 Da and 3,000,000 Da, such as from 1,000,000 Da to 2,800,000; for example from 1,000,000 Da to 2,600,000; such as from 1,000,000 Da to 2,400,000; for example from 1,000,000 Da to 2,200,000; such as from 1,000,000 Da to 2,000,000; for example from 1,000,000 Da to 1,800,000; such as from 1,000,000 Da to 1,600,000; for example from 1,000,000 Da to 1,400,000.

Above it was described how to design and produce the key components of the MHC multimers, i.e. the MHC-peptide complex. In the following it is described how to generate the MHC monomer or MHC multimer products of the present invention.

Number of MHC Complexes Pr Multimer

A non-exhaustive list of possible MHC mono- and multimers illustrates the possibilities. n indicates the number of MHC complexes comprised in the multimer:

a) n=1, Monomers b) n=2, Dimers, multimerization can be based on IgG scaffold, streptavidin with two MHC's, coiled-coil dimerization e.g. Fos.Jun dimerization c) n=3, Trimers, multimerization can be based on streptavidin as scaffold with three MHC's, TNFalpha-MHC hybrids, triplex DNA-MHC konjugates or other trimer structures
d) n=4, Tetramers, multimerization can be based on streptavidin with all four binding sites occupied by MHC molecules or based on dimeric IgA
e) n=5, Pentamers, multimerization can take place around a pentameric coil-coil structure
f) n=6, Hexamers
g) n=7, Heptamers
h) n=8-12, Octa-dodecamers, multimerization can take place using Streptactin
i) n=10, Decamers, multimerization can take place using IgM
j) 1<n<100, Dextramers, as multimerization domain polymers such as polypeptide, polysaccharides and Dextrans can be used.
k) 1<n<1000, Multimerization can make use of dendritic cells (DC), antigen-presenting cells (APC), micelles, liposomes, beads, surfaces e.g. microtiterplate, tubes, microarray devices, micro-fluidic systems
l) 1<n, n in billions or trillions or higher, multimerization take place on beads, and surfaces e.g. microtiterplate, tubes, microarray devices, micro-fluidic systems MHC Origin Any of the three components of a MHC complex can be of any of the below mentioned origins. The list is non-exhaustive. A complete list would encompass all Chordate species. By origin is meant that the sequence is identical or highly homologous to a naturally occurring sequence of the specific species.

List of Origins:
- Human
- Mouse
- Primate
  - Chimpansee
  - Gorilla
  - Orang Utan
- Monkey
  - Macaques
- Porcine (Swine/Pig)
- Bovine (Cattle/Antilopes)
- Equine (Horse)
- Camelides (Camels)
- Ruminants (Deears)
- Canine (Dog)
- Feline (Cat)
- Bird
  - Chicken
  - Turkey
- Fish
- Reptiles
- Amphibians Generation of MHC Multimers Different approaches to the generation of various types of MHC multimers are described in U.S. Pat. No. 5,635,363 (Altmann et al.), patent application WO 02/072631 A2 (Winther et al.), patent application WO 99/42597, US patent 2004209295, U.S. Pat. No. 5,635,363, and is described elsewhere in the present patent application as well. In brief, MHC multimers can be generated by first expressing and purifying the individual protein components of the MHC protein, and then combining the MHC protein components and the peptide, to form the MHC-peptide complex. Then an appropriate number of MHC-peptide complexes are linked together by covalent or non-covalent bonds to a multimerization domain. This can be done by chemical reactions between reactive groups of the multimerization domain (e.g. vinyl sulfone functionalities on a dextran polymer) and reactive groups on the MHC protein (e.g. amino groups on the protein surface), or by non-covalent interaction between a part of the MHC protein (e.g. a biotinylated peptide component) and the multimerization domain (e.g. four binding sites for biotin on the strepavidin tetrameric protein). As an alternative, the MHC multimer can be formed by the non-covalent association of amino acid helices fused to one component of the MHC protein, to form a pentameric MHC multimer, held together by five helices in a coiled-coil structure making up the multimerization domain.

Appropriate chemical reactions for the covalent coupling of MHC and the multimerization domain include nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions.

Appropriate molecules, capable of providing non-covalent interactions between the multimerization domain and the MHC-peptide complex, involve the following molecule pairs and molecules: streptavidin/biotin, avidin/biotin, antibody/antigen, DNA/DNA, DNA/PNA, DNA/RNA, PNA/PNA, LNA/DNA, leucine zipper e.g. Fos/Jun, IgG dimeric protein, IgM multivalent protein, acid/base coiled-coil helices, chelate/metal ion-bound chelate, streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-transferase) glutathione affinity, Calmodulin-binding peptide (CBP), Strep-tag, Cellulose Binding Domain, Maltose Binding Protein, S-Peptide Tag, Chitin Binding Tag, Immuno-reactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. In particular, when the MHC complex is tagged, the binding entity can be an "anti-tag". By "anti-tag" is meant an antibody binding to the tag and any other molecule capable of binding to such tag.

Generation of Components of MHC

When employing MHC multimers for diagnostic purposes, it is preferable to use a MHC allele that corresponds to the tissue type of the person or animal to be diagnosed. Once the MHC allele has been chosen, a peptide derived from the antigenic protein may be chosen. The choice will depend on factors such as known or expected binding affinity of the MHC protein and the various possible peptide fragments that may be derived from the full sequence of the antigenic peptide, and will depend on the expected or known binding affinity and specificity of the MHC-peptide complex for the TCR. Preferably, the affinity of the peptide for the MHC molecule, and the affinity and specificity of the MHC-peptide complex for the TCR, should be high.

Similar considerations apply to the choice of MHC allele and peptide for therapeutic and vaccine purposes. In addition, for some of these applications the effect of binding the MHC multimer to the TCR is also important. Thus, in these cases the effect on the T-cell's general state must be considered, e.g. it must be decided whether the desired end result is apoptosis or proliferation of the T-cell.

Likewise, it must be decided whether stability is important. For some applications low stability may be an advantage, e.g. when a short-term effect is desired; in other instances, a long-term effect is desired and MHC multimers of high stability is desired. Stabilities of the MHC protein and of the MHC-peptide complex may be modified as described elsewhere herein.

Finally, modifications to the protein structure may be advantageous for some diagnostics purposes, because of e.g. increased stability, while for vaccine purposes modifications to the MHC protein structure may induce undesired allergenic responses.

Generation of Protein Chains of MHC

Generation of MHC Class I Heavy Chain and β2-Microglobulin

MHC class I heavy chain (HC) and β2-mircroglobulin (β2m) can be obtained from a variety of sources.

a) Natural sources by means of purification from eukaryotic cells naturally expressing the MHC class 1 or β2m molecules in question.
b) The molecules can be obtained by recombinant means e.g. using.
    a. in vitro translation of mRNA obtained from cells naturally expressing the MHC or β2m molecules in question
    b. by expression and purification of HC and/or β2m gene transfected cells of mammalian, yeast, bacterial or other origin. This last method will normally be the method of choice. The genetic material used for transfection/transformation can be:
        i. of natural origin isolated from cells, tissue or organisms
        ii. of synthetical origin i.e. synthetic genes identical to the natural DNA sequence or it could be modified to introduce molecular changes or to ease recombinant expression.
        The genetic material can encode all or only a fragment of β2m, all or only a fragment of MHC class 1 heavy chain. Of special interest are MHC class 1 heavy chain fragments consisting of, the complete chain minus the intramembrane domain, a chain consisting of only the extracellular α1 and α2 class 1 heavy chain domains, or any of the mentioned β2m and heavy chain fragments containing modified or added designer domain(s) or sequence(s).

Generation of MHC Class 2 α- and β-Chains

MHC class 2 α- and β-chains can be obtained from a variety of sources:

a) Natural sources by means of purification from eukaryotic cells naturally expressing the MHC class 2 molecules in question.
b) By recombinant means e.g. using:
    a. in vitro translation of mRNA obtained from cells naturally expressing the MHC class 2 molecules in question
    b. By purification from MHC class 2 gene transfected cells of mammalian, yeast, bacterial or other origin. This last method will normally be the method of choice. The genetic material used for transfection/transformation can be
        i. of natural origin isolated from cells, tissue or organisms
        ii. of synthetical origin i.e. synthetic genes identical to the natural DNA sequence or it could be modified to introduce molecular changes or to ease recombinant expression.
        The genetic material can encode all or only a fragment of MHC class 2 α- and β-chains. Of special interest are MHC class 2 α- and β-chain fragments consisting of, the complete α- and β-chains minus the intramembrane domains of either or both chains; and α- and β-chains consisting of only the extracellular domains of either or both, i.e α1 plus α2 and β1 plus β2 domains, respectively. The genetic material can be modified to encode the interesting MHC class 2 molecule fragments consisting of domains starting from the amino terminal in consecutive order, MHC class 2 β1 plus MHC class 2 α1 plus MHC class 1 α3 domains or in alternative order, MHC class 2 α1 plus MHC class 2 β1 plus MHC class 1 α3 domains.
        Lastly, the genetic material can encode any of the above mentioned MHC class 2 α- and β-chain molecules or fragments containing modified or added designer domain(s) or sequence(s).
c) The MHC material may also be of exclusively synthetic origin manufactured by solid phase protein synthesis. Any of the above mentioned molecules can be made this way.

Modified MHC I or MHC II Complexes

MHC I and MHC II complexes modified in any way as described above, can bind TCR. Modifications include mutations (substitutions, deletions or insertions of natural or non-natural amino acids, or any other organic molecule. The mutations are not limited to those that increase the stability of the MHC complex, and could be introduced anywhere in the MHC complex. One example of special interest is mutations introduced in the α3 subunit of MHC I heavy chain. The α3-subunit interacts with CD8 molecules on the surface of T cells. To minimize binding of MHC multimer to CD8 molecules on the surface of non-specific T cells, amino acids in α3 domain involved in the interaction with CD8 can be mutated. Such a mutation can result in altered or abrogated binding of MHC to CD8 molecules. Another example of special interest is mutations in areas of the β2-domain of MHC II molecules responsible for binding CD4 molecules.

Another embodiment is chemically modified MHC complexes where the chemical modification could be introduced anywhere in the complex, e.g. a MHC complex where the peptide in the peptide-binding cleft has a dinitrophenyl group attached. Modified MHC complexes could also be MHC I or MHC II fusion proteins where the fusion protein is not necessarily more stable than the native protein. Of special interest is MHC complexes fused with genes encoding an amino acid sequence capable of being biotinylated with a Bir A enzyme (Schatz, P. J., (1993), Biotechnology 11(10):1138-1143). This biotinylation sequence could be fused with the COOH-terminal of β2m or the heavy chain of MHC I molecules or the COOH-terminal of either the α-chain or β-chain of MHC II. Similarly, other sequences capable of being enzymatically or chemically modified, can be fused to the $NH_2$ or COOH-terminal ends of the MHC complex.

Stabilization of Empty MHC Complexes and MHC-Peptide Complexes.

Classical MHC complexes are in nature embedded in the membrane. A preferred embodiment includes multimers comprising a soluble form of MHC II or I where the transmembrane and cytosolic domains of the membrane-anchored MHC complexes are removed. The removal of the membrane-anchoring parts of the molecules can influence the stability of the MHC complexes. The stability of MHC complexes is an important parameter when generating and using MHC multimers.

MHC I complexes consist of a single membrane-anchored heavy chain that contains the complete peptide binding groove and is stable in the soluble form when complexed with β2m. The long-term stability is dependent on the binding of peptide in the peptide-binding groove. Without a peptide in the peptide binding groove the heavy chain and β2m tend to dissociate. Similarly, peptides with high affinity for binding in the peptide-binding groove will typically stabilize the soluble form of the MHC complex while peptides with low affinity for the peptide-binding groove will typically have a smaller stabilizing effect.

In contrast, MHC II complexes consist of two membrane-anchored chains of almost equal size. When not attached to the cell membrane the two chains tend to dissociate and are therefore not stable in the soluble form unless a high affinity peptide is bound in the peptide-binding groove or the two chains are held together in another way.

In nature MHC I molecules consist of a heavy chain combined with β2m, and a peptide of typically 8-11 amino acids. Herein, MHC I molecules also include molecules consisting of a heavy chain and β2m (empty MHC), or a heavy chain combined with a peptide or a truncated heavy chain comprising α1 and α2 subunits combined with a peptide, or a full-length or truncated heavy chain combined with a full-length or truncated β2m chain. These MHC I molecules can be produced in *E. coli* as recombinant proteins, purified and refolded in vitro (Garboczi et al., (1992), Proc. Natl. Acad. Sci. 89, 3429-33). Alternatively, insect cell systems or mammalian cell systems can be used. To produce stable MHC I complexes and thereby generate reliable MHC I multimers several strategies can be followed. Stabilization strategies for MHC I complexes are described in the following.

Stabilization Strategies for MHC I Complexes

Generation of Covalent Protein-Fusions.

MHC I molecules can be stabilized by introduction of one or more linkers between the individual components of the MHC I complex. This could be a complex consisting of a heavy chain fused with β2m through a linker and a soluble peptide, a heavy chain fused to β2m through a linker, a heavy chain/β2m dimer covalently linked to a peptide through a linker to either heavy chain or β2m, and where there can or can not be a linker between the heavy chain and β2m, a heavy chain fused to a peptide through a linker, or the α1 and α2 subunits of the heavy chain fused to a peptide through a linker. In all of these example protein-fusions, each of the heavy chain, β2m and the peptide can be truncated.

The linker could be a flexible linker, e.g. made of glycine and serine and e.g. between 5-20 residues long. The linker could also be rigid with a defined structure, e.g. made of amino acids like glutamate, alanine, lysine, and leucine creating e.g. a more rigid structure.

In heavy chain-β2m fusion proteins the COOH terminus of β2m can be covalently linked to the $NH_2$ terminus of the heavy chain, or the $NH_2$ terminus of β2m can be linked to the COOH terminus of the heavy chain. The fusion-protein can also comprise a β2m domain, or a truncated β2m domain, inserted into the heavy chain, to form a fusion-protein of the form "heavy chain (first part)-β2m-heavy chain (last part)".

Likewise, the fusion-protein can comprise a heavy chain domain, or a truncated heavy chain, inserted into the β2m chain, to form a fusion-protein of the form "β2m (first part)-heavy chain-β2m(last part)".

In peptide-β2m fusion proteins the COOH terminus of the peptide is preferable linked to the $NH_2$ terminus of β2m but the peptide can also be linked to the COOH terminal of β2m via its $NH_2$ terminus. In heavy chain-peptide fusion proteins it is preferred to fuse the $NH_2$ terminus of the heavy chain to the COOH terminus of the peptide, but the fusion can also be between the COOH terminus of the heavy chain and the $NH_2$ terminus of the peptide. In heavy chain-β2m-peptide fusion proteins the $NH_2$ terminus of the heavy chain can be fused to the COOH terminus of β2m and the $NH_2$ terminus of β2m can be fused to the COOH terminus of the peptide.

Non-Covalent Stabilization by Binding to an Unnatural Component

Non-covalent binding of unnatural components to the MHC I complexes can lead to increased stability. The unnatural component can bind to both the heavy chain and the β2m, and in this way promote the assemble of the complex, and/or stabilize the formed complex. Alternatively, the unnatural component can bind to either β2m or heavy chain, and in this way stabilize the polypeptide in its correct conformation, and in this way increase the affinity of the heavy chain for β2m and/or peptide, or increase the affinity of β2m for peptide.

Here, unnatural components mean antibodies, peptides, aptamers or any other molecule with the ability to bind peptides stretches of the MHC complex. Antibody is here to be understood as truncated or full-length antibodies (of isotype IgG, IgM, IgA, IgE), Fab, scFv or bi-Fab fragments or diabodies.

An example of special interest is an antibody binding the MHC I molecule by interaction with the heavy chain as well as β2m. The antibody can be a bispecific antibody that binds with one arm to the heavy chain and the other arm to the β2m of the MHC complex. Alternatively the antibody can be monospecific, and bind at the interface between heavy chain and β2m.

Another example of special interest is an antibody binding the heavy chain but only when the heavy chain is correct folded. Correct folded is here a conformation where the MHC complex is able to bind and present peptide in such a way that a restricted T cell can recognize the MHC-peptide complex and be activated. This type of antibody can be an antibody like the one produced by the clone W6/32 (M0736 from Dako, Denmark) that recognizes a conformational epitope on intact human and some monkey MHC complexes containing β2m, heavy chain and peptide.

Generation of Modified Proteins or Protein Components

One way to improve stability of a MHC I complex is to increase the affinity of the binding peptide for the MHC complex. This can be done by mutation/substitution of amino acids at relevant positions in the peptide, by chemical modifications of amino acids at relevant positions in the peptide or introduction by synthesis of non-natural amino acids at relevant positions in the peptide. Alternatively, mutations, chemical modifications, insertion of natural or non-natural amino acids or deletions could be introduced in the peptide binding cleft, i.e. in the binding pockets that accommodate peptide side chains responsible for anchoring the peptide to the peptide binding cleft. Moreover, reactive groups can be introduced into the antigenic peptide; before, during or upon binding of the peptide, the reactive groups can react with amino acid residues of the peptide binding cleft, thus covalently linking the peptide to the binding pocket.

Mutations/substitutions, chemical modifications, insertion of natural or non-natural amino acids or deletions could also be introduced in the heavy chain and/or β2m at positions outside the peptide-binding cleft. By example, it has been shown that substitution of XX with YY in position nn of human $\beta_2$m enhance the biochemical stability of MHC Class I molecule complexes and thus may lead to more efficient antigen presentation of subdominant peptide epitopes.

A preferred embodiment is removal of "unwanted cysteine residues" in the heavy chain by mutation, chemical modification, amino acid exchange or deletion. "Unwanted cysteine residues" is here to be understood as cysteines not involved in the correct folding of the final MHC I molecule. The presence of cysteine not directly involved in the formation of correctly folded MHC I molecules can lead to formation of intra molecular disulfide bridges resulting in a non correct folded MHC complex during in vitro refolding.

Another method for covalent stabilization of MHC I complex am to covalently attach a linker between two of the subunits of the MHC complex. This can be a linker between peptide and heavy chain or between heavy chain and beta2microglobulin.

Stabilization with Soluble Additives.

The stability of proteins in aqueous solution depends on the composition of the solution. Addition of salts, detergents organic solvent, polymers ect. can influence the stability. Of special interest are additives that increase surface tension of the MHC molecule without binding the molecule. Examples are sucrose, mannose, glycine, betaine, alanine, glutamine, glutamic acid and ammoniumsulfate. Glycerol, mannitol and sorbitol are also included in this group even though they are able to bind polar regions.

Another group of additives of special interest are able to increase surface tension of the MHC molecule and simultaneously interact with charged groups in the protein. Examples are $MgSO_4$, NaCl, polyethylenglycol, 2-methyl-2,4-pentandiol and guanidiniumsulfate.

Correct folding of MHC I complexes is very dependent on binding of peptide in the peptide-binding cleft and the peptide binding stabilises correct conformation. Addition of molar excess of peptide will force the equilibrium against correct folded MHC-peptide complexes. Likewise is excess β2m also expected to drive the folding process in direction of correct folded MHC I complexes. Therefore peptide identical to the peptide bound in the peptide-binding cleft and β2m are included as stabilizing soluble additives.

Other additives of special interest for stabilization of MHC I molecules are BSA, fetal and bovine calf serum or individual protein components in serum with a protein stabilizing effect.

All of the above mentioned soluble additives could be added to any solution containing MHC I molecules in order to increase the stability of the molecule. That could be during the refolding process, to the soluble monomer or to a solutions containing MHC I bound to a carrier.

MHC II molecules as used herein are defined as classical MHC II molecule consisting of a α-chain and a β-chain combined with a peptide. It could also be a molecule only consisting of α-chain and β-chain (α/β dimer or empty MHC II), a truncated α-chain (e.g. α1 domain alone) combined with full-length β-chain either empty or loaded with a peptide, a truncated β-chain (e.g. β1 domain alone) combined with a full-length α-chain either empty or loaded with a peptide or a truncated α-chain combined with a truncated β-chain (e.g. α1 and β1 domain) either empty or loaded with a peptide.

In contrast to MHC I molecules MHC II molecules are not easily refolded in vitro. Only some MHC II alleles may be produced in *E. coli* followed by refolding in vitro. Therefore preferred expression systems for production of MHC II molecules are eukaryotic systems where refolding after expression of protein is not necessary. Such expression systems could be stable *Drosophila* cell transfectants, baculovirus infected insect cells, CHO cells or other mammalian cell lines suitable for expression of proteins.

Stabilization of soluble MHC II molecules is even more important than for MHC I molecules since both α- and β-chain are participants in formation of the peptide binding groove and tend to dissociate when not embedded in the cell membrane.

Stabilization Strategies for MHC II Complexes

Generation of Covalent Protein-Fusions.

MHC II complexes can be stabilized by introduction of one or more linkers between the individual components of the MHC II complex. This can be a α/β dimer with a linker between α-chain and β-chain; a α/β dimer covalently linked to the peptide via a linker to either the α-chain or β-chain; a α/β dimer, covalently linked by a linker between the α-chain and β-chain, and where the dimer is covalently linked to the peptide; a α/β dimer with a linker between α-chain and β-chain, where the dimer is combined with a peptide covalently linked to either α-chain or β-chain.

The linker can be a flexible linker, e.g. made of glycine and serine, and is typically between 5-20 residues long, but can be shorter or longer. The linker can also be more rigid with a more defined structure, e.g. made of amino acids like glutamate, alanine, lysine, and leucine.

The peptides can be linked to the $NH_2$- or COOH-terminus of either α-chain or β-chain. Of special interest are peptides linked to the $NH_2$-terminus of the β-chain via their COOH-terminus, since the linker required is shorter than if the peptide is linked to the COOH-terminus of the β-chain.

Linkage of α-chain to β-chain can be via the COOH-terminus of the β-chain to the $NH_2$-terminus of the α-chain or from the COOH-terminus of the α-chain to the $NH_2$-terminus of the β-chain.

In a three-molecule fusion protein consisting of α-chain, β-chain and peptide a preferred construct is where one linker connect the COOH-terminus of the β-chain with the $NH_2$-terminus of the α-chain and another linker connects the COOH-terminal of the peptide with the $NH_2$-terminal of the β-chain. Alternatively one linker joins the COOH-terminus of the α-chain with the $NH_2$-terminus of the β-chain and the second linker joins the $NH_2$-terminus of the peptide with the COOH-terminus of the β-chain. The three peptides of the MHC complex can further be linked as described above for the three peptides of the MHC complex, including internal fusion points for the proteins.

Non-Covalent Stabilization by Binding Ligand.

Non-covalent binding of ligands to the MHC II complex can promote assembly of α- and β-chain by bridging the two chains, or by binding to either of the α- or β-chains, and in this way stabilize the conformation of α or β, that binds β or α, respectively, and/or that binds the peptide. Ligands here mean antibodies, peptides, aptamers or any other molecules with the ability to bind proteins.

A particular interesting example is an antibody binding the MHC complex distal to the interaction site with TCR, i.e. distal to the peptide-binding cleft. An antibody in this example can be any truncated or full length antibody of any isotype (e.g. IgG, IgM, IgA or IgE), a bi-Fab fragment or a diabody. The antibody could be bispecific with one arm binding to the α-chain and the other arm binding to the β-chain.

Alternatively the antibody could be monospecific and directed to a sequence fused to the α-chain as well as to the β-chain.

Another example of interest is an antibody binding more central in the MHC II molecule, but still interacting with both α- and β-chain. Preferable the antibody binds a conformational epitope, thereby forcing the MHC molecule into a correct folded configuration. The antibody can be bispecific binding with one arm to the α-chain and the other arm to the β-chain. Alternatively the antibody is monospecific and binds to a surface of the complex that involves both the α- and β-chain, e.g. both the α2- and β2-domain or both the α1- and β1-domain.

The antibodies described above can be substituted with any other ligand that binds at the α-/β-chain interface, e.g. peptides and aptamers. The ligand can also bind the peptide, although, in this case it is important that the ligand does not interfere with the interaction of the peptide or binding cleft with the TCR.

Non-Covalent Stabilization by Induced Multimerization.

In nature the anchoring of the α- and β-chains in the cell membrane stabilizes the MHC II complexes considerably. As mentioned above, a similar concept for stabilization of the α/β-dimer was employed by attachment of the MHC II chains to the Fc regions of an antibody, leading to a stable α/β-dimer, where α and β are held together by the tight interactions between two Fc domains of an antibody. Other dimerization domains can be used as well.

In one other example of special interest MHC II molecules are incorporated into artificial membrane spheres like liposomes or lipospheres. MHC II molecules can be incorporated as monomers in the membrane or as dimers like the MHC II-antibody constructs describes above. In addition to stabilization of the MHC II complex an increased avidity is obtained. The stabilization of the dimer will in most cases also stabilize the trimeric MHC-peptide complex.

Induced multimerization can also be achieved by biotinylation of α- as well as β-chain and the two chains brought together by binding to streptavidin. Long flexible linkers such as extended glycine-serine tracts can be used to extend both chains, and the chains can be biotinylated at the end of such extended linkers. Then streptavidin can be used as a scaffold to bring the chains together in the presence of the peptide, while the flexible linkers still allow the chains to orientate properly.

Generation of Modified Proteins or Protein Components

Stability of MHC II complexes can be increased by covalent modifications of the protein. One method is to increase the affinity of the peptide for the MHC complex. This can be done by exchange of the natural amino acids with other natural or non-natural amino acids at relevant positions in the peptide or by chemical modifications of amino acids at relevant positions in the peptide. Alternatively, mutations, chemical modifications, insertion of natural or non-natural amino acids or deletions can be introduced in the peptide-binding cleft.

Mutations, chemical modifications, insertion of natural or non-natural amino acids or deletions can alternatively be introduced in α- and/or β-chain at positions outside the peptide-binding cleft.

In this respect a preferred embodiment is to replace the hydrophobic transmembrane regions of α-chain and β-chain by leucine zipper dimerisation domains (e.g. Fos-Jun leucine zipper; acid-base coiled-coil structure) to promote assembly of α-chain and β-chain.

Another preferred embodiment is to introduce one or more cysteine residues by amino acid exchange at the COOH-terminal of both α-chain and β-chain, to create disulfide bridges between the two chains upon assembly of the MHC complex. Another embodiment is removal of "unwanted cysteine residues" in either of the chains by mutation, chemical modification, amino acid exchange or deletion. "Unwanted cysteine residues" is here to be understood as cysteines not involved in correct folding of the MHC II-peptide complex. The presence of cysteines not directly involved in the formation of correctly folded MHC II complexes can lead to formation of intra molecular disulfide bridges and incorrectly folded MHC complexes.

MHC II complexes can also be stabilized by chemically linking together the subunits and the peptide. That can be a linker between peptide and α-chain, between peptide and β-chain, between α-chain and β-chain, and combination thereof.

Such linkages can be introduced prior to folding by linking two of the complex constituents together, then folding this covalent hetero-dimer in the presence of the third constituent. An advantage of this method is that it only requires complex formation between two, rather than three species.

Another possibility is to allow all three constituents to fold, and then to introduce covalent cross-links on the folded MHC-complex, stabilizing the structure. An advantage of this method is that the two chains and the peptide will be correctly positioned relatively to each other when the cross linkages are introduced.

Stabilization with Soluble Additives.

Salts, detergents, organic solvent, polymers and any other soluble additives can be added to increase the stability of MHC complexes. Of special interest are additives that increase surface tension of the MHC complex. Examples are sucrose, mannose, glycine, betaine, alanine, glutamine, glutamic acid and ammonium sulfate. Glycerol, mannitol and sorbitol are also included in this group even though they are able to bind polar regions.

Another group of additives of special interest increases surface tension of the MHC complex and simultaneously can interact with charged groups in the protein.

Examples are $MgSO_4$, NaCl, polyethylenglycol, 2-methyl-2,4-pentanediol and guanidiniumsulphate.

Correct formation of MHC complexes is dependent on binding of peptide in the peptide-binding cleft; the bound peptide appears to stabilize the complex in its correct conformation. Addition of molar excess of peptide will force the equilibrium towards correctly folded MHC-peptide complexes. Likewise, excess β2m is also expected to drive the folding process in direction of correctly folded MHC complexes. Therefore peptide identical to the peptide bound in the peptide-binding cleft and β2m can be included as stabilizing soluble additives.

Other additives of special interest for stabilization of MHC complexes are BSA, fetal and bovine calf serum, and other protein components in serum with a protein stabilizing effect.

All of the above mentioned soluble additives could be added to any solution containing MHC complexes in order to increase the stability of the molecule. This can be during the refolding process, to the formed MHC complex or to a solution of MHC multimers comprising several MHC complexes That could be to the soluble monomer, to a solution containing MHC II bound to a carrier or to solutions used during analysis of MHC II specific T cells with MHC II multimers.

Other additives of special interest for stabilization of MHC II molecules are BSA, fetal and bovine calf serum or individual protein components in serum with a protein stabilizing effect.

All of the above mentioned soluble additives could be added to any solution containing MHC II molecules in order to increase the stability of the molecule. That could be to the soluble monomer, to a solution containing MHC II bound to a carrier or to solutions used during analysis of MHC II specific T cells with MHC II multimers.

Chemically Modified MHC I and II Complexes

There are a number of amino acids that are particularly reactive towards chemical cross linkers. In the following, chemical reactions are described that are particularly preferable for the cross-linking or modification of MHC I or MHC II complexes. The amino group at the N-terminal of both chains and of the peptide, as well as amino groups of lysine side chains, are nucleophilic and can be used in a number of chemical reactions, including nucleophilic substitution by activation of electrophiles (e.g. acylation such as amide formation, pyrazolone formation, isoxazolone formation; alkylation; vinylation; disulfide formation), addition to carbon-hetero multiple bonds (e.g. alkene formation by reaction of phosphonates with aldehydes or ketones; arylation; alkylation of arenes/hetarenes by reaction with alkyl boronates or enolethers), nucleophilic substitution using activation of nucleophiles (e.g. condensations; alkylation of aliphatic halides or tosylates with enolethers or enamines), and cycloadditions. Example reagents that can be used in a reaction with the amino groups are activated carboxylic acids such as NHS-ester, tetra and pentafluoro phenolic esters, anhydrides, acid chlorides and fluorides, to form stable amide bonds. Likewise, sulphonyl chlorides can react with these amino groups to form stable sulphone-amides. Iso-Cyanates can also react with amino groups to form stable ureas, and isothiocyanates can be used to introduce thio-urea linkages.

Aldehydes, such as formaldehyde and glutardialdehyde will react with amino groups to form shiff's bases, than can be further reduced to secondary amines. The guanidino group on the side chain of arginine will undergo similar reactions with the same type of reagents.

Another very useful amino acid is cysteine. The thiol on the side chain is readily alkylated by maleimides, vinyl sulphones and halides to form stable thioethers, and reaction with other thiols will give rise to disulphides.

Carboxylic acids at the C-terminal of both chains and peptide, as well as on the side chains of glutamic and aspartic acid, can also be used to introduce cross-links. They will require activation with reagents such as carbodiimides, and can then react with amino groups to give stable amides.

Thus, a large number of chemistries can be employed to form covalent cross-links. The crucial point is that the chemical reagents are bi-functional, being capable of reacting with two amino acid residues.

They can be either homo bi-functional, possessing two identical reactive moieties, such as glutardialdehyde or can be hetero bi-functional with two different reactive moieties, such as GMBS (MaleimidoButyryloxy-Succinimide ester).

Alternatively, two or more reagents can be used; i.e. GMBS can be used to introduce maleimides on the α-chain, and iminothiolane can be used to introduce thiols on the β-chain; the malemide and thiol can then form a thioether link between the two chains.

For the present invention some types of cross-links are particularly useful. The folded MHC-complex can be reacted with dextrans possessing a large number (up to many hundreds) of vinyl sulphones. These can react with lysine residues on both the α and β chains as well as with lysine residues on the peptide protruding from the binding site, effectively cross linking the entire MHC-complex. Such cross linking is indeed a favored reaction because as the first lysine residue reacts with the dextran, the MHC-complex becomes anchored to the dextran favoring further reactions between the MHC complex and the dextran multimerization domain. Another great advantage of this dextran chemistry is that it can be combined with fluorochrome labelling; i.e. the dextran is reacted both with one or several MHC-complexes and one or more fluorescent protein such as APC.

Another valuable approach is to combine the molecular biological tools described above with chemical cross linkers. As an example, one or more lysine residues can be inserted into the α-chain, juxtaposed with glutamic acids in the β-chain, where after the introduced amino groups and carboxylic acids are reacted by addition of carbodiimide. Such reactions are usually not very effective in water, unless as in this case, the groups are well positioned towards reaction. This implies that one avoids excessive reactions that could otherwise end up denaturing or changing the conformation of the MHC-complex.

Likewise a dextran multimerization domain can be cross-linked with appropriately modified MHC-complexes; i.e. one or both chains of the MHC complex can be enriched with lysine residues, increasing reactivity towards the vinylsulphone dextran. The lysine's can be inserted at positions opposite the peptide binding cleft, orienting the MHC-complexes favorably for T-cell recognition.

Another valuable chemical tool is to use extended and flexible cross-linkers. An extended linker will allow the two chains to interact with little or no strain resulting from the linker that connects them, while keeping the chains in the vicinity of each other should the complex dissociate. An excess of peptide should further favor reformation of dissociated MHC-complex.

Other TCR Binding Molecules

MHC I and MHC II complexes bind to TCRs. However, other molecules also bind TCR. Some TCR-binding molecules are described in the following. MHC I and MHC II complexes binding to TCRs may be substituted with other molecules capable of binding TCR or molecules that have homology to the classical MHC molecules and therefore potentially could be TCR binding molecules. These other TCR binding or MHC like molecules include:

Non-Classical MHC Complexes and Other MHC-Like Molecules:

Non-classical MHC complexes include protein products of MHC Ib and MHC IIb genes. MHC Ib genes encode β2m-associated cell-surface molecules but show little polymorphism in contrast to classical MHC class I genes. Protein products of MHC class Ib genes include HLA-E, HLA-G, HLA-F, HLA-H, MIC A, MIC B, ULBP-1, ULBP-2, ULBP-3 in humans and H2-M, H2-Q, H2-T and Rae1 in mice.

Non-classical MHC II molecules (protein products of MHC IIb genes) include HLA-DM, HLA-DO in humans and H2-DM and H2-DO in mice that are involved in regulation of peptide loading into MHC II molecules.

Another MHC-like molecule of special interest is the MHC I-like molecule CD1. CD1 is similar to MHC I molecules in its organization of subunits and association with β2m but presents glycolipids and lipids instead of peptides.

Artificial Molecules Capable of Binding Specific TCRs

Of special interest are antibodies that bind TCRs. Antibodies herein include full length antibodies of isotype IgG, IgM, IgE, IgA and truncated versions of these, antibody fragments like Fab fragments and scFv. Antibodies also include antibodies of antibody fragments displayed on various supramolecular structures or solid supports, including filamentous phages, yeast, mammalian cells, fungi, artificial cells or micelles, and beads with various surface chemistries.

Peptide Binding TCR

Another embodiment of special interest is peptides that bind TCRs. Peptides herein include peptides composed of natural, non-natural and/or chemically modified amino acids with a length of 8-20 amino acid. The peptides could also be longer than 20 amino acids or shorter than 8 amino acids. The peptides can or can not have a defined tertiary structure.

Aptamers

Aptamers are another preferred group of TCR ligands. Aptamers are herein understood as natural nucleic acids (e.g. RNA and DNA) or unnatural nucleic acids (e.g. PNA, LNA, morpholinos) capable of binding TCR. The aptamer molecules consist of natural or modified nucleotides in various lengths.

Other TCR-binding molecules can be ankyrin repeat proteins or other repeat proteins, Avimers, or small chemical molecules, as long as they are capable of binding TCR with a dissociation constant smaller than $10^{-3}$ M.

Verification of correctly folded MHC-peptide complexes

Quantitative ELISA and other techniques to quantify correctly folded MHC complexes When producing MHC multimers, it is desirable to determine the degree of correctly folded MHC.

The fraction or amount of functional and/or correctly folded MHC can be tested in a number of different ways, including:

- Measurement of correctly folded MHC in a quantitative ELISA, e.g. where the MHC bind to immobilized molecules recognizing the correctly folded complex.
- Measurement of functional MHC in an assay where the total protein concentration is measured before functional MHC is captured, by binding to e.g. immobilized TCR, and the excess, non-bound protein are measured. If the dissociation constant for the interaction is known, the amount of total and the amount of non-bound protein can be determined. From these numbers, the fraction of functional MHC complex can be determined.
- Measurement of functional MHC complex by a non-denaturing gel-shift assay, where functional MHC complexes bind to TCR (or another molecule that recognize correctly folded MHC complex), and thereby shifts the TCR to another position in the gel.

Multimerization Domain

A number of MHC complexes associate with a multimerization domain to form a MHC multimer. The size of the multimerization domain spans a wide range, from multimerisation domains based on small organic molecule scaffolds to large multimers based on a cellular structure or solid support. The multimerization domain may thus be based on different types of carriers or scaffolds, and likewise, the attachment of MHC complexes to the multimerization domain may involve covalent or non-covalent linkers. Characteristics of different kinds of multimerization domains are described below.

Molecular Weight of Multimerization Domain.

- In one embodiment the multimerization domain(s) in the present invention is preferably less than 1,000 Da (small molecule scaffold). Examples include short peptides (e.g. comprising 10 amino acids), and various small molecule scaffolds (e.g. aromatic ring structures).
- In another embodiment the multimerization domain(s) is preferably between 1,000 Da and 10,000 Da (small molecule scaffold, small peptides, small polymers). Examples include polycyclic structures of both aliphatic and aromatic compounds, peptides comprising e.g. 10-100 amino acids, and other polymers such as dextran, polyethylenglycol, and polyureas.
- In another embodiment the multimerization domain(s) is between 10,000 Da and 100,000 Da (Small molecule scaffold, polymers e.g. dextran, streptavidin, IgG, pentamer structure). Examples include proteins and large polypeptides, small molecule scaffolds such as steroids, dextran, dimeric streptavidin, and multi-subunit proteins such as used in Pentamers.
- In another embodiment the multimerization domain(s) is preferably between 100,000 Da and 1,000,000 Da (Small molecule scaffold, polymers e.g. dextran, streptavidin, IgG, pentamer structure). Typical examples include larger polymers such as dextran (used in e.g. Dextramers), and streptavidin tetramers.
- In another embodiment the multimerization domain(s) is preferably larger than 1,000,000 Da (Small molecule scaffold, polymers e.g. dextran, streptavidin, IgG, pentamer structure, cells, liposomes, artificial lipid bilayers, polystyrene beads and other beads. Most examples of this size involve cells or cell-based structures such as micelles and liposomes, as well as beads and other solid supports.

As mentioned elsewhere herein multimerisation domains can comprise carrier molecules, scaffolds or combinations of the two.

Type of Multimerization Domain.

In principle any kind of carrier or scaffold can be used as multimerization domain, including any kind of cell, polymer, protein or other molecular structure, or particles and solid supports. Below different types and specific examples of multimerization domains are listed.

Cell.

Cells can be used as carriers. Cells can be either alive and mitotic active, alive and mitotic inactive as a result of irradiation or chemically treatment, or the cells may be dead. The MHC expression may be natural (i.e. not stimulated) or may be induced/stimulated by e.g. Inf-γ. Of special interest are natural antigen presenting cells (APCs) such as dendritic cells, macrophages, Kupfer cells, Langerhans cells, B-cells and any MHC expressing cell either naturally expressing, being transfected or being a hybridoma.

Cell-Like Structures.

Cell-like carriers include membrane-based structures carrying MHC-peptide complexes in their membranes such as micelles, liposomes, and other structures of membranes, and phages such as filamentous phages.

Solid Support.

Solid support includes beads, particulate matters and other surfaces. A preferred embodiment include beads (magnetic or non-magnetic beads) that carry electrophilic groups e.g. divinyl sulfone activated polysaccharide, polystyrene beads that have been functionalized with tosyl-activated esters, magnetic polystyrene beads functionalized with tosyl-activated esters), and where MHC complexes may be covalently immobilized to these by reaction of nucleophiles comprised within the MHC complex with the electrophiles of the beads. Beads may be made of sepharose, sephacryl, polystyrene, agarose, polysaccharide, polycarbamate or any other kind of beads that can be suspended in aqueous buffer.

Another embodiment includes surfaces, i.e. solid supports and particles carrying immobilized MHC complexes on the surface. Of special interest are wells of a microtiter plate or other plate formats, reagent tubes, glass slides or other supports for use in microarray analysis, tubings or channels of micro fluidic chambers or devices, Biacore chips and beads Molecule.

Multimerization domains may also be molecules or complexes of molecules held together by non-covalent bonds. The molecules constituting the multimerization domain can be small organic molecules or large polymers, and may be flexible linear molecules or rigid, globular structures such as e.g. proteins. Different kinds of molecules used in multimerization domains are described below.

Small organic molecules. Small organic molecules here includes steroids, peptides, linear or cyclic structures, and aromatic or aliphatic structures, and many others. The prototypical small organic scaffold is a functionalized benzene ring, i.e. a benzene ring functionalized with a number of reactive groups such as amines, to which a number of MHC molecules may be covalently linked. However, the types of reactive groups constituting the linker connecting the MHC complex and the multimerization domain, as well as the type of scaffold structure, can be chosen from a long list of chemical structures. A non-comprehensive list of scaffold structures are listed below.

Typical scaffolds include aromatic structures, benzodiazepines, hydantoins, piperazines, indoles, furans, thiazoles, steroids, diketopiperazines, morpholines, tropanes, coumarines, qinolines, pyrroles, oxazoles, amino acid precursors, cyclic or aromatic ring structures, and many others.

Typical carriers include linear and branched polymers such as peptides, polysaccharides, nucleic acids, and many others. Multimerization domains based on small organic or polymer molecules thus include a wealth of different structures, including small compact molecules, linear structures, polymers, polypeptides, polyureas, polycarbamates, cyclic structures, natural compound derivatives, alpha-, beta-, gamma-, and omega-peptides, mono-, di- and tri-substituted peptides, L- and D-form peptides, cyclohexane- and cyclopentane-backbone modified beta-peptides, vinylogous polypeptides, glycopolypeptides, polyamides, vinylogous sulfonamide peptide, Polysulfonamide-conjugated peptide (i.e., having prosthetic groups), Polyesters, Polysaccharides such as dextran and aminodextran, polycarbamates, polycarbonates, polyureas, poly-peptidylphosphonates, Azatides, peptoids (oligo N-substituted glycines), Polyethers, ethoxyformacetal oligomers, poly-thioethers, polyethylene, glycols (PEG), polyethylenes, polydisulfides, polyarylene sulfides, Polynucleotides, PNAs, LNAs, Morpholinos, oligo pyrrolinone, polyoximes, Polyimines, Polyethyleneimine, Polyacetates, Polystyrenes, Polyacetylene, Polyvinyl, Lipids, Phospholipids, Glycolipids, polycycles, (aliphatic), polycycles (aromatic), polyheterocycles, Proteoglycan, Polysiloxanes, Polyisocyanides, Polyisocyanates, polymethacrylates, Monofunctional, Difunctional, Trifunctional and Oligofunctional open-chain hydrocarbons, Monofunctional, Difunctional, Trifunctional and Oligofunctional Nonaromat Carbocycles, Monocyclic, Bicyclic, Tricyclic and Polycyclic Hydrocarbons, Bridged Polycyclic Hydrocarbones, Monofunctional, Difunctional, Trifunctional and Oligofunctional Nonaromatic, Heterocycles, Monocyclic, Bicyclic, Tricyclic and Polycyclic Heterocycles, bridged Polycyclic Heterocycles, Monofunctional, Difunctional, Trifunctional and Oligofunctional Aromatic Carbocycles, Monocyclic, Bicyclic, Tricyclic and Polycyclic Aromatic Carbocycles, Monofunctional, Difunctional, Trifunctional and Oligofunctional Aromatic Hetero-cycles. Monocyclic, Bicyclic, Tricyclic and Polycyclic Heterocycles. Chelates, fullerenes, and any combination of the above and many others.

Biological polymers. Biological molecules here include peptides, proteins (including antibodies, coiled-coil helices, streptavidin and many others), nucleic acids such as DNA and RNA, and polysaccharides such as dextran. The biological polymers may be reacted with MHC complexes (e.g. a number of MHC complexes chemically coupled to e.g. the amino groups of a protein), or may be linked through e.g. DNA duplex formation between a carrier DNA molecule and a number of DNA oligonucleotides each coupled to a MHC complex. Another type of multimerization domain based on a biological polymer is the streptavidin-based tetramer, where a streptavidin binds up to four biotinylated MHC complexes, as described above (see Background of the invention).

Self-assembling multimeric structures. Several examples of commercial MHC multimers exist where the multimer is formed through self-assembling. Thus, the Pentamers are formed through formation of a coiled-coil structure that holds together 5 MHC complexes in an apparently planar structure. In a similar way, the Streptamers are based on the Streptactin protein which oligomerizes to form a MHC multimer comprising several MHC complexes (see Background of the invention).

In the following, alternative ways to make MHC multimers based on a molecule multimerization domain are described. They involve one or more of the abovementioned types of multimerization domains.

MHC dextramers can be made by coupling MHC complexes to dextran via a streptavidin-biotin interaction. In principle, biotin-streptavidin can be replaced by any dimerization domain, where one half of the dimerization domain is coupled to the MHC-peptide complex and the other half is coupled to dextran. For example, an acidic helix (one half of a coiled-coil dimer) is coupled or fused to MHC, and a basic helix (other half of a coiled-coil dimmer) is coupled to dextran. Mixing the two results in MHC binding to dextran by forming the acid/base coiled-coil structure.

Antibodies can be used as scaffolds by using their capacity to bind to a carefully selected antigen found naturally or added as a tag to a part of the MHC molecule not involved in peptide binding. For example, IgG and IgE will be able to bind two MHC molecules, IgM having a pentameric structure will be able to bind 10 MHC molecules. The antibodies can be full-length or truncated; a standard antibody-fragment includes the Fab2 fragment.

Peptides involved in coiled-coil structures can act as scaffold by making stable dimeric, trimeric, tetrameric and pentameric interactions. Examples hereof are the Fos-Jun heterodimeric coiled coil, the *E. coli* homo-trimeric coiled-coil domain Lpp-56, the engineered Trp-zipper protein forming a discrete, stable, α-helical pentamer in water at physiological pH.

Further examples of suitable scaffolds, carriers and linkers are streptavidin (SA) and avidin and derivatives thereof, biotin, immunoglobulins, antibodies (monoclonal, polyclonal, and recombinant), antibody fragments and derivatives thereof, leucine zipper domain of AP-1 (jun and fos), hexa-his (metal chelate moiety), hexa-hat GST (glutathione S-tranferase), glutathione, Calmodulin-binding peptide (CBP), Strep-tag, Cellulose Binding Domain, Maltose Binding Protein, S-Peptide Tag, Chitin Binding Tag, Immunoreactive Epitopes, Epitope Tags, E2Tag, HA Epitope Tag, Myc Epitope, FLAG Epitope, AU1 and AU5 Epitopes, Glu-Glu Epitope, KT3 Epitope, IRS Epitope, BtagEpitope, Protein Kinase-C Epitope, VSV Epitope, lectins that mediate binding to a diversity of compounds, including carbohydrates, lipids and proteins, e.g. Con A (*Canavalia ensiformis*) or WGA (wheat germ agglutinin) and tetranectin or Protein A or G (antibody affinity). Combinations of such binding entities are also comprised. Non-limiting examples are streptavidin-biotin and jun-fos. In particular, when the MHC molecule is tagged, the binding entity may be an "anti-tag". By "anti-tag" is meant an antibody binding to the tag, or any other molecule capable of binding to such tag.

MHC complexes can be multimerized by other means than coupling or binding to a multimerization domain. Thus, the multimerization domain may be formed during the multimerization of MHCs. One such method is to extend the bound antigenic peptide with dimerization domains. One end of the antigenic peptide is extended with dimerization domain A (e.g. acidic helix, half of a coiled-coil dimer) and the other end is extended with dimerization domain B (e.g. basic helix, other half of a coiled-coil dimer). When MHC complexes are loaded/mixed with these extended peptides the following multimer structure will be formed: A-MHC-BA-MHC-BA-MHC-B etc. The antigenic peptides in the mixture can either be identical or a mixture of peptides with comparable extended dimerization domains. Alternatively both ends of a peptide are extended with the same dimerization domain A and another peptide (same amino acid sequence or a different amino acid sequence) is extended with dimerization domain B. When MHC and peptides are mixed the following structures are formed: A-MHC-AB-MHC-BA-MHC-AB-MHC-B etc. Multimerization of MHC complexes by extension of peptides are restricted to MHC II molecules since the peptide binding groove of MHC I molecules is typically closed in both ends thereby limiting the size of peptide that can be embedded in the groove, and therefore preventing the peptide from extending out of the groove.

Another multimerization approach applicable to both MHC I and MHC II complexes is based on extension of N- and C-terminal of the MHC complex. For example the N-terminal of the MHC complex is extended with dimerization domain A and the C-terminal is extended with dimerization domain B. When MHC complexes are incubated together they pair with each other and form multimers like: A-MHC-BA-MHC-BA-MHC-BA-MHC-B etc. Alternatively the N-terminal and the C-terminal of a MHC complex are both extended with dimerization domain A and the N-terminal and C-terminal of another preparation of MHC complex (either the same or a different MHC) are extended with dimerization domain B. When these two types of MHC complexes are incubated together multimers will be formed: A-MHC-AB-MHC-BA-MHC-AB-MHC-B etc.

In all the above-described examples the extension can be either chemically coupled to the peptide/MHC complex or introduced as extension by gene fusion.

Dimerization domain AB can be any molecule pair able to bind to each other, such as acid/base coiled-coil helices, antibody-antigen, DNA-DNA, PNA-PNA, DNA-PNA, DNA-RNA, LNA-DNA, leucine zipper e.g. Fos/Jun, streptavidin-biotin and other molecule pairs as described elsewhere herein.

Linker Molecules.

A number of MHC complexes associate with a multimerization domain to form a MHC multimer. The attachment of MHC complexes to the multimerization domain may involve covalent or non-covalent linkers, and may involve small reactive groups as well as large protein-protein interactions.

The coupling of multimerization domains and MHC complexes involve the association of an entity X (attached to or part of the multimerization domain) and an entity Y (attached to or part of the MHC complex). Thus, the linker that connects the multimerization domain and the MHC complex comprises an XY portion.

Covalent Linker.

The XY linkage can be covalent, in which case X and Y are reactive groups. In this case, X can be a nucleophilic group (such as $—NH_2$, —OH, —SH, $—NH—NH_2$), and Y an electrophilic group (such as CHO, COOH, CO) that react to form a covalent bond XY; or Y can be a nucleophilic group and X an electrophilic group that react to form a covalent bond XY. Other possibilities exist, e.g either of the reactive groups can be a radical, capable of reacting with the other reactive group. A number of reactive groups X and Y, and the bonds that are formed upon reaction of X and Y, are shown in FIG. 5.

X and Y can be reactive groups naturally comprised within the multimerization domain and/or the MHC complex, or they can be artificially added reactive groups. Thus, linkers containing reactive groups can be linked to either of the multimerization domain and MHC complex; subsequently the introduced reactive group(s) can be used to covalently link the multimerization domain and MHC complex.

Example natural reactive groups of MHC complexes include amino acid side chains comprising $—NH_2$, —OH, —SH, and —NH—. Example natural reactive groups of multimerization domains include hydroxyls of polysaccharides such as dextrans, but also include amino acid side chains comprising $—NH_2$, —OH, —SH, and —NH— of polypeptides, when the polypeptide is used as a multimerization domain. In some MHC multimers, one of the polypeptides of the MHC complex (i.e. the β2M, heavy chain or the antigenic peptide) is linked by a protein fusion to the multimerization domain. Thus, during the translation of the fusion protein, an acyl group (reactive group X or Y) and an amino group (reactive group Y or X) react to form an amide bond. Example MHC multimers where the bond between the multimerization domain and the MHC complex is covalent and results from reaction between natural reactive groups, include MHC-pentamers (described in US patent 2004209295) and MHC-dimers, where the linkage between multimerization domain and MHC complex is in both cases generated during the translation of the fusion protein.

Example artificial reactive groups include reactive groups that are attached to the multimerization domain or MHC complex, through association of a linker molecule comprising the reactive group. The activation of dextran by reaction of the dextran hydroxyls with divinyl sulfone, introduces a reactive vinyl group that can react with e.g. amines of the MHC complex, to form an amine that now links the multimerization domain (the dextran polymer) and the MHC complex. An alternative activation of the dextran multimerization domain involves a multistep reaction that results in the decoration of the dextran with maleimide groups, as described in the patent Siiman et al. U.S. Pat. No. 6,387,622. In this approach, the amino groups of MHC complexes are converted to —SH groups, capable of reacting with the maleimide groups of the activated dextran. Thus, in the latter example, both the reactive group of the multimerization domain (the maleimide) and the reactive group of the MHC complex (the thiol) are artificially introduced.

Sometimes activating reagents are used in order to make the reactive groups more reactive. For example, acids such as glutamate or aspartate can be converted to activated esters by addition of e.g. carbodiimid and NHS or nitrophenol, or by converting the acid moiety to a tosyl-activated ester. The activated ester reacts efficiently with a nucleophile such as $—NH_2$, —SH, —OH, etc.

For the purpose of this invention, the multimerization domains (including small organic scaffold molecules, proteins, protein complexes, polymers, beads, liposomes, micelles, cells) that form a covalent bond with the MHC complexes can be divided into separate groups, depending on the nature of the reactive group that the multimerization domain contains. One group comprise multimerization domains that carry nucleophilic groups (e.g. $—NH_2$, —OH, —SH, —CN, $—NH—NH_2$), exemplified by polysaccharides, polypeptides containing e.g. lysine, serine, and cysteine; another group of multimerization domains carry electrophilic groups (e.g. —COOH, —CHO, —CO, NHS-ester, tosyl-activated ester, and other activated esters, acid-anhydrides), exemplified by polypeptides containing e.g. glutamate and aspartate, or vinyl sulfone activated dextran; yet another group of multimerization domains carry radicals or conjugated double bonds.

The multimerization domains appropriate for this invention thus include those that contain any of the reactive groups shown in FIG. 5 or that can react with other reactive groups to form the bonds shown in FIG. 5.

Likewise, MHC complexes can be divided into separate groups, depending on the nature of the reactive group comprised within the MHC complex. One group comprise MHCs that carry nucleophilic groups (e.g. $—NH_2$, —OH, —SH, —CN, $—NH—NH_2$), e.g. lysine, serine, and cysteine; another group of MHCs carry electrophilic groups (e.g. —COOH, —CHO, —CO, NHS-ester, tosyl-activated ester, and other activated esters, acid-anhydrides), exemplified by e.g. glutamate and aspartate; yet another group of MHCs carry radicals or conjugated double bonds.

The reactive groups of the MHC complex are either carried by the amino acids of the MHC-peptide complex (and may be comprised by any of the peptides of the MHC-peptide complex, including the antigenic peptide), or alternatively, the reactive group of the MHC complex has been introduced by covalent or non-covalent attachment of a molecule containing the appropriate reactive group.

Preferred reactive groups in this regard include $—CSO_2OH$, phenylchloride, —SH, —SS, aldehydes, hydroxyls, isocyanate, thiols, amines, esters, thioesters, carboxylic acids, triple bonds, double bonds, ethers, acid chlorides, phosphates, imidazoles, halogenated aromatic rings, any precursors thereof, or any protected reactive groups, and many others. Example pairs of reactive groups, and the resulting bonds formed, are shown in FIG. 5.

Reactions that may be employed include acylation (formation of amide, pyrazolone, isoxazolone, pyrimidine, comarine, quinolinon, phthalhydrazide, diketopiperazine, benzodiazepinone, and hydantoin), alkylation, vinylation, disulfide formation, Wittig reaction, Horner-Wittig-Emmans reaction, arylation (formation of biaryl or vinylarene), condensation reactions, cycloadditions ((2+4), (3+2)), addition to carbon-carbon multiplebonds, cycloaddition to multiple bonds, addition to carbon-hetero multiple bonds, nucleophilic aromatic substitution, transition metal catalyzed reactions, and may involve formation of ethers, thioethers, secondary amines, tertiary amines, beta-hydroxy ethers, beta-hydroxy thioethers, beta-hydroxy amines, beta-amino ethers, amides, thioamides, oximes, sulfonamides, di- and tri-functional compounds, substituted aromatic compounds, vinyl substituted aromatic compounds, alkyn substituted aromatic compounds, biaryl compounds, hydrazines, hydroxylamine ethers, substituted cycloalkenes, substituted cyclodienes, substituted 1, 2, 3 triazoles, substituted cycloalkenes, beta-hydroxy ketones, beta-hydroxy aldehydes, vinyl ketones, vinyl aldehydes, substituted alkenes, substituted alkenes, substituted amines, and many others.

MHC dextramers can be made by covalent coupling of MHC complexes to the dextran backbone, e.g. by chemical coupling of MHC complexes to dextran backbones. The MHC complexes can be coupled through either heavy chain or β2-microglobulin if the MHC complexes are MHC I or through α-chain or β-chain if the MHC complexes are MHC II. MHC complexes can be coupled as folded complexes comprising heavy chain/beta2microglobulin or α-chain/β-chain or either combination together with peptide in the peptide-binding cleft. Alternatively either of the protein chains can be coupled to dextran and then folded in vitro together with the other chain of the MHC complex not coupled to dextran and together with peptide. Direct coupling of MHC complexes to dextran multimerization domain can be via an amino group or via a sulphide group. Either group can be a natural component of the MHC complex or attached to the MHC complex chemically. Alternatively, a cysteine may be introduced into the genes of either chain of the MHC complex.

Another way to covalently link MHC complexes to dextran multimerization domains is to use the antigenic peptide as a linker between MHC and dextran. Linker containing antigenic peptide at one end is coupled to dextran. Antigenic peptide here means a peptide able to bind MHC complexes in the peptide-binding cleft. As an example, 10 or more antigenic peptides may be coupled to one dextran molecule. When MHC complexes are added to such peptide-dextran construct the MHC complexes will bind the antigenic peptides and thereby MHC-peptide complexes are displayed around the dextran multimerization domain. The antigenic peptides can be identical or different from each other. Similarly MHC complexes can be either identical or different from each other as long as they are capable of binding one or more of the peptides on the dextran multimerization domain.

Non-Covalent Linker.

The linker that connects the multimerization domain and the MHC complex comprises an XY portion. Above different kinds of covalent linkages XY were described. However, the XY linkage can also be non-covalent.

Non-covalent XY linkages can comprise natural dimerization pairs such as antigen-antibody pairs, DNA-DNA interactions, or can include natural interactions between small molecules and proteins, e.g. between biotin and streptavidin. Artificial XY examples include XY pairs such as $His_6$ tag (X) interacting with Ni-NTA (Y) and PNA-PNA interations.

Protein-Protein Interactions.

The non-covalent linker may comprise a complex of two or more polypeptides or proteins, held together by non-covalent interactions. Example polypeptides and proteins belonging to this group include Fos/Jun, Acid/Base coiled coil structure, antibody/antigen (where the antigen is a peptide), and many others.

A preferred embodiment involving non-covalent interactions between polypeptides and/or proteins are represented by the Pentamer structure described in US patent 2004209295.

Another preferred embodiment involves the use of antibodies, with affinity for the surface of MHC opposite to the peptide-binding groove. Thus, an anti-MHC antibody, with its two binding site, will bind two MHC complexes and in this way generate a bivalent MHC multimer. In addition, the antibody can stabilize the MHC complex through the binding interactions. This is particularly relevant for MHC class II complexes, as these are less stable than class I MHC complexes.

Polynucleotide-Polynucleotide Interactions.

The non-covalent linker may comprise nucleotides that interact non-covalently. Example interactions include PNA/PNA, DNA/DNA, RNA/RNA, LNA/DNA, and any other nucleic acid duplex structure, and any combination of such natural and unnatural polynucleotides such as DNA/PNA, RNA/DNA, and PNA/LNA.

Protein-Small Molecule Interactions.

The non-covalent linker may comprise a macromolecule (e.g. protein, polynucleotide) and a small molecule ligand of the macromolecule. The interaction may be natural (i.e., found in Nature, such as the Streptavidin/biotin interaction) or non-natural (e.g. His-tag peptide/Ni-NTA interaction). Example interactions include Streptavidin/biotin and anti-biotin antibody/biotin.

Combinations—Non-Covalent Linker Molecules.

Other combinations of proteins, polynucleotides, small organic molecules, and other molecules, may be used to link the MHC to the multimerization domain. These other combinations include protein-DNA interactions (e.g. DNA binding protein such as the gene regulatory protein CRP interacting with its DNA recognition sequence), RNA aptamer-protein interactions (e.g. RNA aptamer specific for growth hormone interacting with growth hormone)

Synthetic Molecule-Synthetic Molecule Interaction.

The non-covalent linker may comprise a complex of two or more organic molecules, held together by non-covalent interactions. Example interactions are two chelate molecules binding to the same metal ion (e.g. EDTA-$Ni^{++}$-NTA), or a short polyhistidine peptide (e.g. $His_6$) bound to NTA-$Ni^{++}$.

In another preferred embodiment the multimerization domain is a bead. The bead is covalently or non-covalently coated with MHC multimers or single MHC complexes, through non-cleavable or cleavable linkers. As an example, the bead can be coated with streptavidin monomers, which in turn are associated with biotinylated MHC complexes; or the bead can be coated with streptavidin tetramers, each of which are associated with 0, 1, 2, 3, or 4 biotinylated MHC complexes; or the bead can be coated with MHC-dextramers where e.g. the reactive groups of the MHC-dextramer (e.g. the divinyl sulfone-activated dextran backbone) has reacted with nucleophilic groups on the bead, to form a covalent linkage between the dextran of the dextramer and the beads.

In another preferred embodiment, the MHC multimers described above (e.g. where the multimerization domain is a bead) further contains a flexible or rigid, and water soluble, linker that allows for the immobilized MHC complexes to interact efficiently with cells, such as T-cells with affinity for the MHC complexes. In yet another embodiment, the linker is cleavable, allowing for release of the MHC complexes from the bead. If T-cells have been immobilized, by binding to the MHC complexes, the T-cells can very gently be released by cleavage of this cleavable linker. Appropriate cleavable linkers are shown in FIG. 6. Most preferably, the linker is cleaved at physiological conditions, allowing for the integrity of the isolated cells.

Further examples of linker molecules that may be employed in the present invention include Calmodulin-binding peptide (CBP), 6×HIS, Protein A, Protein G, biotin, Avidine, Streptavidine, Strep-tag, Cellulose Binding Domain, Maltose Binding Protein, S-Peptide Tag, Chitin Binding Tag, Immuno-reactive Epitopes, Epitope Tags, GST tagged proteins, E2Tag, HA Epitope Tag, Myc Epitope, FLAG Epitope, AU1 and AU5 Epitopes, Glu-Glu Epitope, KT3 Epitope, IRS Epitope, Btag Epitope, Protein Kinase-C Epitope, VSV Epitope.

The list of dimerization- and multimerization domains, described elsewhere in this document, define alternative non-covalent linkers between the multimerization domain and the MHC complex.

The abovementioned dimerization- and multimerization domains represent specific binding interactions. Another type of non-covalent interactions involves the non-specific adsorption of e.g. proteins onto surfaces. As an example, the non-covalent adsorption of proteins onto glass beads represents this class of XY interactions. Likewise, the interaction of MHC complexes (comprising full-length polypeptide chains, including the transmembrane portion) with the cell membrane of for example dendritic cells is an example of a non-covalent, primarily non-specific XY interaction.

In some of the abovementioned embodiments, several multimerization domains (e.g. streptavidin tetramers bound to biotinylated MHC complexes) are linked to another multimerization domain (e.g. the bead). For the purpose of this invention we shall call both the smaller and the bigger multimerization domain, as well as the combined multimerization domain, for multimerization domain Additional Features of Product Additional components may be coupled to carrier or added as individual components not coupled to carrier Attachment of Biologically Active Molecules to MHC Multimers Engagement of MHC complex to the specific T cell receptor leads to a signaling cascade in the T cell. However, T-cells normally respond to a single signal stimulus by going into apoptosis. T cells needs a second signal in order to become activated and start development into a specific activation state e.g. become an active cytotoxic T cell, helper T cell or regulatory T cell.

It is to be understood that the MHC multimer of the invention may further comprise one or more additional substituents. The definition of the terms "one or more", "a plurality", "a", "an", and "the" also apply here. Such biologically active molecules may be attached to the construct in order to affect the characteristics of the constructs, e.g. with respect to binding properties, effects, MHC molecule specificities, solubility, stability, or detectability. For instance, spacing could be provided between the MHC complexes, one or both chromophores of a Fluorescence Resonance Energy Transfer (FRET) donor/acceptor pair could be inserted, functional groups could be attached, or groups having a biological activity could be attached.

MHC multimers can be covalently or non-covalently associated with various molecules: having adjuvant effects; being immune targets e.g. antigens; having biological activity e.g. enzymes, regulators of receptor activity, receptor ligands, immune potentiators, drugs, toxins, co-receptors, proteins and peptides in general; sugar moieties; lipid groups; nucleic acids including siRNA; nano particles; small molecules. In the following these molecules are collectively called biologically active molecules. Such molecules can be attached to the MHC multimer using the same principles as those described for attachment of MHC complexes to multimerisation domains as described elsewhere herein. In brief, attachment can be done by chemical reactions between reactive groups on the biologically active molecule and reactive groups of the multimerisation domain and/or between reactive groups on the biologically active molecule and reactive groups of the MHC-peptide complex. Alternatively, attachment is done by non-covalent interaction between part of the multimerisation domain and part of the biological active molecule or between part of the MHC-peptide complex and part of the biological active molecule. In both covalent and non-covalent attachment of the biologically molecule to the multimerisation domain a linker molecule can connect the two. The linker molecule can be covalent or non-covalent attached to both molecules. Examples of linker molecules are described elsewhere herein. Some of the MHCmer structures better allows these kind of modifications than others.

Biological active molecules can be attached repetitively aiding to recognition by and stimulation of the innate immune system via Toll or other receptors.

MHC multimers carrying one or more additional groups can be used as therapeutic or vaccine reagents.

In particular, the biologically active molecule may be selected from proteins such as MHC Class 1-like proteins like MICA, MIC B, CD1d, HLA E, HLA F, HLA G, HLA H, ULBP-1, ULBP-2, and ULBP-3, co-stimulatory molecules such as CD2, CD3, CD4, CD5, CD8, CD9, CD27, CD28, CD30, CD69, CD134 (OX40), CD137 (4-1BB), CD147, CDw150 (SLAM), CD152 (CTLA-4), CD153 (CD30L), CD40L (CD154), NKG2D, ICOS, HVEM, HLA Class II, PD-1, Fas (CD95), FasL expressed on T and/or NK cells, CD40, CD48, CD58, CD70, CD72, B7.1 (CD80), B7.2 (CD86), B7RP-1, B7-H3, PD-L1, PD-L2, CD134L, CD137L, ICOSL, LIGHT expressed on APC and/or tumour cells, cell modulating molecules such as CD16, NKp30, NKp44, NKp46, NKp80, 2B4, KIR, LIR, CD94/NKG2A, CD94/NKG2C expressed on NK cells, IFN-alpha, IFN-beta, IFN-gamma, IL-1, IL-2, IL-3, IL-4, IL-6, IL-7, IL-8, IL-10, IL-11, IL-12, IL-15, CSFs (colony-stimulating factors), vitamin D3, IL-2 toxins, cyclosporin, FK-506, rapamycin, TGF-beta, clotrimazole, nitrendipine, and charybdotoxin, accessory molecules such as LFA-1, CD11a/18, CD54 (ICAM-1), CD106 (VCAM), and CD49a,b,c,d,e,f/CD29 (VLA-4), adhesion molecules such as ICAM-1, ICAM-2, GlyCAM-1, CD34, anti-LFA-1, anti-CD44, anti-beta7, chemokines, CXCR4, CCR5, anti-selectin L, anti-selectin E, and anti-selectin P, toxic molecules selected from toxins, enzymes, antibodies, radioisotopes, chemiluminescent substances, bioluminescent substances, polymers, metal particles, and haptens, such as cyclophosphamide, methrotrexate, Azathioprine, mizoribine, 15-deoxuspergualin, neomycin, staurosporine, genestein, herbimycin A, *Pseudomonas* exotoxin A, saporin, Rituxan, Ricin, gemtuzumab ozogamicin, Shiga toxin, heavy metals like inorganic and organic mercurials, and FN18-CRM9, radioisotopes such as incorporated isotopes of iodide, cobalt, selenium, tritium, and phosphor, and haptens such as DNP, and digoxiginin, and combinations of any of the foregoing, as well as antibodies (monoclonal, polyclonal, and recombinant) to the foregoing, where relevant. Antibody derivatives or fragments thereof may also be used.

Design and Generation of Product to be Used for Immune Monitoring, Diagnosis, Therapy or Vaccination The product of the present invention may be used for immune monitoring, diagnosis, therapy and/or vaccination. The generation of product may follow some or all of the following general steps.

1. Design of antigenic peptides
2. Choice of MHC allele
3. Generation of product
4. Validation and optimization of product Production of a MHC Multimer Diagnostic or Immune Monitoring Reagent May Follow Some or all of the Following Steps.

1. Identify disease of interest. Most relevant diseases in this regard are infectious-, cancer-, auto immune-, transplantation-, or immuno-suppression-related diseases.
2. Identify relevant protein antigen(s). This may be individual proteins, a group of proteins from a given tissue or subgroups of proteins from an organism.
3. Identify the protein sequence. Amino acid sequences can be directly found in databases or deduced from gene- or mRNA sequence e.g. using the following link www.ncbi.nlm.nih.gov/Genbank/index.html. If not in databases relevant proteins or genes encoding relevant proteins may be isolated and sequenced. In some cases only DNA sequences will be available without knowing which part of the sequence is protein coding. Then the DNA sequence is translated into amino acid sequence in all reading frames.
4. Choose MHC allele(s). Decide on needed MHC allele population coverage. If a broad coverage of a given population is needed (i.e. when generally applicable reagents are sought) the most frequently expressed MHC alleles by the population of interest may be chosen e.g. using the database www.allelefrequencies.net/test/default1.asp or epitope.liai.org:8080/tools/population/iedb_input.

In case of personalized medicine the patient is tissue typed (HLA type) and then MHC alleles may be selected according to that.
5. Run the general peptide epitope generator program described elsewhere herein on all selected amino acid sequences from step 3, thereby generating all possible epitopes of defined length (8'-, 9'-, 10'-, 11'-, 13-, 14'-, 15'-, and/or 16'-mers).
6. If searching for broadly applicable epitope sequences, a good alternative to step 5 is to run the "intelligent" peptide epitope prediction programs on the selected amino acid sequences of step 3 using the selected MHC alleles from step 4 e.g. using epitope prediction programs like www.syfpeithi.de/, www.cbs.dtu.dk/services/NetMHC/, and www.cbs.dtu.dk/services/NetMHCII/. This step can also be used supplementary to step 5 by running selected or all epitopes from the general peptide epitope generator program through one or more of the intelligent peptide epitope prediction programs.
7. If searching for broadly applicable epitope sequences, one may choose to select the epitopes with highest binding score, or the most likely proteolytic products of the species in question, for the chosen MHC alleles and run them through the BLAST program (www.ncbi.nlm.nih.gov/blast/Blast.cgi) to validate the uniqueness of the peptides. If the peptide sequences are present in other species, evaluate the potential risk of disease states caused by the non-relevant species in relation to causing false positive results. If considered being a potential problem for evaluating the future analysis outcome, leave out the peptide. Preferably, choose unique peptide sequences only present in the selected protein.
8. Produce selected peptides as described elsewhere herein, e.g. by standard organic synthesis, and optionally test for binding to the desired MHC alleles by e.g in vitro folding, peptide exchange of already preloaded MHC complexes or another method able to test for peptide binding to MHC I or II molecules.
9. Generate desired MHC multimer by covalently or non-covalently attaching MHC-peptide complex(es) to multimerization domain, and optionally attach a fluorophore to the MHC multimer, as described elsewhere herein. Optionally, test efficacy in detecting specific T-cells using e.g. the methods described in the section "Detection".

The MHC multimer reagents may be used in a diagnostic procedure or kit for testing patient and control samples e.g. by flow cytometry, immune histochemistry, Elispot or other methods as described herein.

Production of a MHC Multimer Therapeutic Reagent May Follow Some or all of the Following Steps.

1. As step 1-8 above for diagnostic reagent.
9. Select additional molecules (e.g. biologically active molecules, toxins) to attach to the MHC multimer as described elsewhere herein. The additional molecules can have different functionalities as e.g. adjuvants, specific activators, toxins etc.
10. Test the therapeutic reagent following general guidelines
11. Use for therapy Processes Involving MHC Multimers The present invention relates to methods for detecting the presence of MHC recognising cells in a sample comprising the steps of (a) providing a sample suspected of comprising MHC recognising cells,
(b) contacting the sample with a MHC multimer as defined above, and
(c) determining any binding of the MHC multimer.

Binding indicates the presence of MHC recognising cells.

Such methods are a powerful tool in diagnosing various diseases. Establishing a diagnosis is important in several ways. A diagnosis provides information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC recognising cells, and thus treatment can be targeted effectively against a particular subtype). In this way, it may also be possible to gain information about aberrant cells, which emerge through the progress of the disease or condition, or to investigate whether and how T-cell specificity is affected. The binding of the MHC multimer makes possible these options, since the binding is indicative for the presence of the MHC recognising cells in the sample, and accordingly the presence of MHC multimers displaying the peptide.

The present invention also relates to methods for monitoring MHC recognising cells comprising the steps of (a) providing a sample suspected of comprising MHC recognising cells,
(b) contacting the sample with a MHC complex as defined above, and (c) determining any binding of the MHC multimer, thereby monitoring MHC recognising cells.

Such methods are a powerful tool in monitoring the progress of a disease, e.g. to closely follow the effect of a treatment. The method can i.a. be used to manage or control the disease in a better way, to ensure the patient receives the optimum treatment regime, to adjust the treatment, to confirm remission or recurrence, and to ensure the patient is not treated with a medicament which does not cure or alleviate the disease. In this way, it may also be possible to monitor aberrant cells, which emerge through the progress of the disease or condition, or to investigate whether and how T-cell specificity is affected during treatment. The binding of the MHC multimer makes possible these options, since the binding is indicative for the presence of the MHC recognising cells in the sample, and accordingly the presence of MHC multimers displaying the peptide.

The present invention also relates to methods for establishing a prognosis of a disease involving MHC recognising cells comprising the steps of (a) providing a sample suspected of comprising MHC recognising cells, (b) contacting the sample with a MHC multimer as defined above, and (c) determining any binding of the MHC multimer, thereby establishing a prognosis of a disease involving MHC recognising cells.

Such methods are a valuable tool in order to manage diseases, i.a. to ensure the patient is not treated without effect, to ensure the disease is treated in the optimum way, and to predict the chances of survival or cure. In this way, it may also be possible to gain information about aberrant cells, which emerge through the progress of the disease or condition, or to investigate whether and how T-cell specificity is affected, thereby being able to establish a prognosis. The binding of the MHC multimer makes possible these options, since the binding is indicative for the presence of the MHC recognising cells in the sample, and accordingly the presence of MHC complexes displaying the peptide.

The present invention also relates to methods for determining the status of a disease involving MHC recognising cells comprising the steps of (a) providing a sample suspected of comprising MHC recognising cells, (b) contacting the sample with a MHC complex as defined above, and (c) determining any binding of the MHC complex, thereby determining the status of a disease involving MHC recognising cells.

Such methods are a valuable tool in managing and controlling various diseases. A disease could, e.g. change from one stage to another, and thus it is important to be able to determine the disease status. In this way, it may also be possible to gain information about aberrant cells which emerge through the progress of the disease or condition, or to investigate whether and how T-cell specificity is affected, thereby determining the status of a disease or condition. The binding of the MHC complex makes possible these options, since the binding is indicative for the presence of the MHC recognising cells in the sample, and accordingly the presence of MHC complexes displaying the peptide.

The present invention also relates to methods for the diagnosis of a disease involving MHC recognising cells comprising the steps of (a) providing a sample suspected of comprising MHC recognising cells, (b) contacting the sample with a MHC multimer as defined above, and (c) determining any binding of the MHC multimer, thereby diagnosing a disease involving MHC recognising cells.

Such diagnostic methods are a powerful tool in the diagnosis of various diseases. Establishing a diagnosis is important in several ways. A diagnosis gives information about the disease, thus the patient can be offered a suitable treatment regime. Also, establishing a more specific diagnosis may give important information about a subtype of a disease for which a particular treatment will be beneficial (i.e. various subtypes of diseases may involve display of different peptides which are recognised by MHC recognising cells, and thus treatment can be targeted effectively against a particular subtype). Valuable information may also be obtained about aberrant cells emerging through the progress of the disease or condition as well as whether and how T-cell specificity is affected. The binding of the MHC multimer makes possible these options, since the binding is indicative for the presence of the MHC recognising cells in the sample, and accordingly the presence of MHC multimers displaying the peptide.

The present invention also relates to methods of correlating cellular morphology with the presence of MHC recognising cells in a sample comprising the steps of (a) providing a sample suspected of comprising MHC recognising cells, (b) contacting the sample with a MHC multimer as defined above, and (c) determining any binding of the MHC multimer, thereby correlating the binding of the MHC multimer with the cellular morphology.

Such methods are especially valuable as applied in the field of histochemical methods, as the binding pattern and distribution of the MHC multimers can be observed directly. In such methods, the sample is treated so as to preserve the morphology of the individual cells of the sample. The information gained is important i.a. in diagnostic procedures as sites affected can be observed directly.

The present invention also relates to methods for determining the effectiveness of a medicament against a disease involving MHC recognising cells comprising the steps of (a) providing a sample from a subject receiving treatment with a medicament, (b) contacting the sample with a as defined herein, and (c) determining any binding of the MHC multimer, thereby determining the effectiveness of the medicament.

Such methods are a valuable tool in several ways. The methods may be used to determine whether a treatment is effectively combating the disease. The method may also provide information about aberrant cells which emerge through the progress of the disease or condition as well as whether and how T-cell specificity is affected, thereby providing information of the effectiveness of a medicament in question. The binding of the MHC multimer makes possible these options, since the binding is indicative for the presence of the MHC recognising cells in the sample, and accordingly the presence of MHC multimers displaying the peptide.

The present invention also relates to methods for manipulating MHC recognising cells populations comprising the steps of (a) providing a sample comprising MHC recognising cells, (b) contacting the sample with a MHC multimer immobilised onto a solid support as defined above, (c) isolating the relevant MHC recognising cells, and (d) expanding such cells to a clinically relevant number, with or without further manipulation.

Such ex vivo methods are a powerful tool to generate antigen-specific, long-lived human effector T-cell populations that, when re-introduced to the subject, enable killing of target cells and has a great potential for use in immunotherapy applications against various types of cancer and infectious diseases.

As used everywhere herein, the term "MHC recognising cells" are intended to mean such which are able to recognise and bind to MHC multimers. The intended meaning of "MHC multimers" is given above. Such MHC recognising cells may also be called MHC recognising cell clones, target cells, target MHC recognising cells, target MHC molecule recognising cells, MHC molecule receptors, MHC receptors, MHC peptide specific receptors, or peptide-specific cells. The term "MHC recognising cells" is intended to include all subsets of normal, abnormal and defect cells, which recognise and bind to the MHC molecule. Actually, it is the receptor on the MHC recognising cell that binds to the MHC molecule.

As described above, in diseases and various conditions, peptides are displayed by means of MHC multimers, which are recognised by the immune system, and cells targeting such MHC multimers are produced (MHC recognising cells). Thus, the presence of such MHC protein recognising cells is a direct indication of the presence of MHC multimers displaying the peptides recognised by the MHC protein recognising cells. The peptides displayed are indicative and may involved in various diseases and conditions.

For instance, such MHC recognising cells may be involved in diseases of inflammatory, auto-immune, allergic, viral, cancerous, infectious, allo- or xenogene (graft versus host and host versus graft) origin.

The MHC multimers of the present invention have numerous uses and are a valuable and powerful tool e.g. in the fields of therapy, diagnosis, prognosis, monitoring, stratification, and determining the status of diseases or conditions. Thus, the MHC multimers may be applied in the various methods involving the detection of MHC recognising cells.

Furthermore, the present invention relates to compositions comprising the MHC multimers in a solubilising medium. The present invention also relates to compositions comprising the MHC multimers immobilised onto a solid or semi-solid support.

The MHC multimers can be used in a number of applications, including analyses such as flow cytometry, immunohistochemistry (IHC), and ELISA-like analyses, and can be used for diagnostic, prognostic or therapeutic purposes including autologous cancer therapy or vaccines such as HIV vaccine or cancer vaccine.

The MHC multimers are very suitable as detection systems. Thus, the present invention relates to the use of the MHC multimers as defined herein as detection systems.

In another aspect, the present invention relates to the general use of MHC peptide complexes and multimers of such MHC peptide complexes in various methods. These methods include therapeutic methods, diagnostic methods, prognostic methods, methods for determining the progress and status of a disease or condition, and methods for the stratification of a patient.

The MHC multimers of the present invention are also of value in testing the expected efficacy of medicaments against or for the treatment of various diseases. Thus, the present invention relates to methods of testing the effect of medicaments or treatments, the methods comprising detecting the binding of the MHC multimers to MHC recognising cells and establishing the effectiveness of the medicament or the treatment in question based on the specificity of the MHC recognising cells.

As mentioned above, the present invention also relates generally to the field of therapy. Thus, the present invention relates per se to the MHC multimer as defined herein for use as medicaments, and to the MHC multimers for use in in vivo and ex vivo therapy.

The present invention relates to therapeutic compositions comprising as active ingredients the MHC multimers as defined herein.

An important aspect of the present invention is therapeutic compositions comprising as active ingredients effective amounts of MHC recognising cells obtained using the MHC multimers as defined herein to isolate relevant MHC recognising cells, and expanding such cells to a clinically relevant number.

The present invention further relates to methods for treating, preventing or alleviating diseases, methods for inducing anergy of cells, as well as to methods for up-regulating, down-regulating, modulating, stimulating, inhibiting, restoring, enhancing and/or otherwise manipulating immune responses.

The invention also relates to methods for obtaining MHC recognising cells by using the MHC multimers as described herein.

Also encompassed by the present invention are methods for preparing the therapeutic compositions of the invention.

The present invention is also directed to generating MHC multimers for detecting and analysing receptors on MHC recognising cells, such as epitope specific T-cell clones or other immune competent effector cells.

It is a further object of the present invention to provide new and powerful strategies for the development of curative vaccines. This in turn will improve the possibilities for directed and efficient immune manipulations against diseases caused by tumour genesis or infection by pathogenic agent like viruses and bacteria. HIV is an important example. The ability to generate and optionally attach recombinant MHC multimers to multimerization domains, such as scaffolds and/or carrier molecules, will enable the development of a novel analytical and therapeutical tool for monitoring immune responses and contribute to a rational platform for novel therapy and "vaccine" applications.

Therapeutic compositions (e.g. "therapeutical vaccines") that stimulate specific T-cell proliferation by peptide-specific stimulation is indeed a possibility within the present invention. Thus, quantitative analysis and ligand-based detection of specific T-cells that proliferate by the peptide specific stimulation should be performed simultaneously to monitoring the generated response.

Application of MHC Multimers in Immune Monitoring, Diagnostics, Therapy, Vaccine MHC multimers as described herein can be used to identify and isolate specific T cells in a wide array of applications. In principle all kind of samples possessing T cells can be analyzed with MHC multimers.

MHC multimers detect antigen-specific T cells of the various T cell subsets. T cells are pivotal for mounting an adaptive immune response. It is therefore of importance to be able to measure the number of specific T cells when performing a monitoring of a given immune response. Typically, the adaptive immune response is monitored by measuring the specific antibody response, which is only one of the effector arms of the immune system. This can lead to miss-interpretation of the actual clinical immune status.

In many cases intruders of the organism can hide away inside the cells, which often does not provoke a humoral response. In other cases, e.g. in the case of certain viruses the intruder mutates fast, particularly in the genes encoding the proteins that are targets for the humoral response. Examples include the influenza and HIV viruses. The high rate of mutagenesis renders the humoral response unable to cope with the infection. In these cases the immune system relies on the cellular immune response. When developing vaccines against such targets one needs to provoke the cellular response in order to get an efficient vaccine.

MHC multimers can be used for monitoring immune responses elicited by vaccines One preferred embodiment of the present invention is monitoring the effect of vaccines against infectious disease, e.g. tuberculosis. Tuberculosis is caused by the intracellular bacterium *Mycobacterium tuberculosis* and is a major cause of morbidity and mortality throughout the world. There is a high prevalence of latent infection and this is one of the main factors contributing to the high incidence of active tuberculosis. Many vaccines against tuberculosis is under development and most of them aim at eliciting a cellular immune response generating antigen-specific CD8 and/or CD4 positive T cells able to combat the infection. MHC multimers can be used to monitor the effectiveness of such a vaccine by detecting the number of specific T cells elicited by the vaccine.

In another preferred embodiment of the present invention MHC multimers are used as components of a tuberculosis vaccine. An example of useful MHC multimers are cells expressing MHC-peptide complexes where the antigenic peptides are derived from proteins of *Mycobacterium tuberculosis*. Such cells if used as a vaccine may be able to induce a cellular immune response generating T cells specific for the protein from which the antigenic peptides are derived and thereby generate an immune response against the mycobateria. To further enhance the MHC-peptide specific stimulation of the T cells, T cell stimulatory molecules can be coupled to the multimerisation domain together with MHC or may be added as soluble adjuvant together with the MHC multimer. Example T cell stimulatory molecules include but are not limited to IL-2, CD80 (B7.1), CD86 (B7.2), anti-CD28 antibody, CD40, CD37ligand (4-1BBL), IL-6, IL-15, IL-21, IFN-γ, IFN-α, IFN-β, CD27 ligand, CD30 ligand, IL-23, IL-1a and IL-1β.

One or more T cell stimulatory molecules may be added together with or coupled to the MHC multimer. Likewise, adjuvants or molecules enhancing or otherwise affecting the cellular, humoral or innate immune response may be coupled to or added together with the MHC multimer vaccine.

Other MHC multimers as described elsewhere herein may also be useful as vaccines against tuberculosis or other infectious diseases by eliciting a Mycobacteria tuberculosis-specific immune responses.

In principles any MHC multimer or derivatives of MHC multimers can be useful as vaccines, as vaccine components or as engineered intelligent adjuvant. The possibility of combining MHC multimers that specifically bind certain T cells with molecules that trigger, e.g. the humoral response or the innate immune response, can accelerate vaccine development and improve the efficiency of vaccines.

The number of antigen-specific cytotoxic T cells can be used as surrogate markers for the overall wellness of the immune system. The immune system can be compromised severely by natural causes such as HIV infections or big traumas or by immuno suppressive therapy in relation to transplantation. The efficacy of an anti HIV treatment can be evaluated by studying the number of common antigen-specific cytotoxic T cells, specific for e.g. Cytomegalovirus (CMV) and Epstein-Barr virus. In this case the measured T cells can be conceived as surrogate markers. The treatment can then be corrected accordingly and a prognosis can be made. Similarly measurement of TB specific T cells could be used as surrogate markers for the overall wellness of the immune system since many HIV infected patients also have latent *M. tuberculosis* infection.

A similar situation is found for patients undergoing transplantation as they are severely immune compromised due to pharmaceutical immune suppression to avoid organ rejection. The suppression can lead to outbreak of opportunistic infections caused by reactivation of otherwise dormant viruses residing in the transplanted patients or the grafts. This can be the case for CMV and EBV viruses. Therefore measurement of the number of virus-specific T cells can be used to give a prognosis for the outcome of the transplantation and adjustment of the immune suppressive treatment. Similarly, the BK virus has been implied as a causative reagent for kidney rejection. Therefore measurement of BK-virus specific T cells can have prognostic value. Measurement of mycobacteria specific T cells or T cells specific for other latent bacterial infections can also have a prognostic value.

MHC multimers can be of importance in diagnosis of infections caused by bacteria, virus and parasites that hide away inside cells. Serum titers can be very low and direct measurement of the disease-causing organisms by PCR or other methods directly detecting the presence of pathogen can be very difficult because the host cells are not identified or are inaccessible. Other clinical symptoms of a chronical infection can be unrecognizable in an otherwise healthy individuals, even though such persons still are disease-carriers and at risk of becoming spontaneously ill if being compromised by other diseases or stress.

One aspect of special interest of the present invention involves diagnosis and/or detection of infection with *Mycobacterium tuberculosis* (*M. tuberculosis*) which can lead to tuberculosis (TB).

TB is spread through the air, when people who have the disease cough, sneeze or spit. One third of the world's current population have been infected with *M. tuberculosis*, and new infections occur at a rate of one per second. However, most of these cases will not develop the full-blown disease; asymptomatic, latent infection is most common. About 5-10% of these latent infections will eventually progress to active disease, which, if left untreated, kills more than half of its victims. Therefore, detection of latent tuberculosis and prediction of when the latent infection is progressing to active disease is very important.

*M. tuberculosis* is an intracellular bacterium that resides mainly within marcrophages in the lung but may also be inside other cells and in other parts of the body. The bacteria are able to survive for many years in an intracellular habitat in a slowly-replicating or non-replicating state. During the initial phase of infection when the mycobacteria are present almost exclusively within the macrophage, little if any free unprocessed antigen leaves the marcrophage and is available for recognition by and stimulation of the humoral immune system. However, antigens that are secreted by the slow-replicating bacteria during latent infection and at a higher rate during active infection are presented by the infected antigen presenting cells (the macrophages) and induce a strong cell mediated immune response. Hence, cell mediated immunity (CMI) predominate the immune response to the bacteria in latent as well as active stages of infection and is more specifically a type-1 T-cell response characterized by production of INF-γ and interleukin-2. Both CD4 and CD8 antigen-specific T cells are involved in the CMI to *M. tuberculosis.*

Thus, one embodiment of the present invention relates to methods for detecting the presence of TB antigen-specific CD4 and/or CD8 positive T cells involved in CMI to *M. tuberculosis* either directly or by measurement of substances secreted from these cells (e.g. INF-γ and interleukin-2) using MHC multimers containing antigenic peptides derived from TB antigens. Measurement of these cells can be used for diagnosing latent and/or active TB infection and/or monitoring whether a latent infection is progressing to active infection. Examples of TB antigens and antigenic peptides derived from these are given elsewhere herein. Detection methods and principles for detection of antigen-specific T cells using MHC multimers are also described elsewhere herein.

Other mycobacteria such as *Mycobacterium bovis, Mycobacterium africanum, Mycobacterium canetti*, and *Mycobacterium microti* also cause tuberculosis, but these species are less common. However, infection with these mycobacteria may also be recognised by detection of antigen-specific T cells using MHC multimers and are included in this invention.

Antigen-specific T helper cells and regulatory T cells have been implicated in the development of autoimmune disorders. In most cases the timing of events leading to autoimmune disease is unknown and the exact role of the immune cells not clear. Use of MHC multimers to study these diseases will lead to greater understanding of the disease-causing scenario and make provisions for development of therapies and vaccines for these diseases.

Therapeutic use of MHC multimers is possible, either directly or as part of therapeutic vaccines. In therapies involving T cells, e.g. treatment with in vitro amplified antigen-specific effector T cells, the T cells often do not home effectively to the correct target sites but ends up in undesired parts of the body. If the molecules responsible for interaction with the correct homing receptor can be identified these can be added to the MHC multimer making a dual, triple or multiple molecular structure that are able to aid the antigen-specific T cells home to the correct target, as the MHC multimer will bind to the specific T cell and the additional molecules will mediate binding to the target cells. In a preferable embodiment, MHC multimers bound to other functional molecules are employed to directly block, regulate or kill the targeted cells.

In another aspect of the present invention modulation of regulatory T cells could be part of a treatment. In diseases where the function of regulatory T cells is understood it may be possible to directly block, regulate or kill these regulatory cells by means of MHC multimers that besides MHC-peptide complexes also features other functional molecules. The MHC multimers specifically recognize the target regulatory T cells and direct the action of the other functional molecules to this target T cell.

Diseases

MHCmers can be used in immune monitoring, diagnostics, prognostics, therapy and vaccines for many different diseases, including but not limited to the diseases listed in the following.

a) Infectious Diseases Caused by Virus Such as,

Adenovirus (subgropus A-F), BK-virus, CMV (Cytomegalo virus, HHV-5), EBV (Epstein Barr Virus, HHV-4), HBV (Hepatitis B Virus), HCV (Hepatitis C virus), HHV-6a and b (Human Herpes Virus-6a and b), HHV-7, HHV-8, HSV-1 (Herpes simplex virus-1, HHV-1), HSV-2 (HHV-2), JC-virus, SV-40 (Simian virus 40), VZV (Varizella-Zoster-Virus, HHV-3), Parvovirus B19*, Haemophilus* influenza, HIV-1 (Human immunodeficiency Virus-1), HTLV-1 (Human T-lymphotrophic virus-1), HPV (Human Papillomavirus giving rise to clinical manifestions such as Hepatitis, AIDS, Measles, Pox, Chicken pox, Rubella, Herpes and others b) Infectious Diseases Caused by Bacteria Such as, Gram positive bacteria, gram negative bacteria, intracellular bacterium, extracellular bacterium, *Mycobacterium tuberculosis, Mycobacterium bovis, Mycobacterium avium* subsp. Paratuberculosis, *Mycobacterium africanum, Mycobacterium canetti, Mycobacterium microti, Mycobacterium kansasii, Mycobacterium* malmoense, *Mycobacterium abscessus, Mycobacterium xenopi*, other mycobacteria, *Borrelia burgdorferi*, other spirochetes, *Helicobacter pylori, Streptococcus pneumoniae, Listeria monocytogenes, Histoplasma capsulatum, Bartonella henselae, Bartonella quintana* giving rise to clinical manifestations such as Tuberculosis, Pneumonia, Stomach ulcers, Paratuberculosis and others c) Infectious Diseases Caused by Fungus Such as,

*Aspergillus fumigatus, Candida albicans, Cryptococcus neoformans, Pneumocystis carinii* giving rise to clinical manifestations such as skin-, nail-, and mucosal infections, Meningitis, Sepsis and others d) Parasitic Diseases Caused by Parasites Such as,

*Plasmodium falciparum, Plasmodium vivax, Plasmodium malariae, Schistosoma mansoni, Schistosoma japonicum, Schistosoma haematobium, Trypanosoma cruzi, Trypanosoma rhodesiense, Trypanosoma gambiense, Leishmania donovani*, and *Leishmania tropica.* e) Allergic Diseases Caused by Allergens Such as,

Birch, Hazel, Elm, Ragweed, Wormwood, Grass, Mould, Dust Mite giving rise to clinical manifestations such as Asthma.

f) Transplantation-Related Diseases Caused by reactions to minor histocompatibility antigens such as HA-1, HA-8, USP9Y, SMCY, TPR-protein, HB-1Y and other antigens in relation to, Graft-versus-host-related disease, allo- or xenogene reactions i.e. graft-versus-host and host-versus-graft disease.

g) Cancerous Diseases Associated with Antigens Such as

Survivin, Survivin-2B, Livin/ML-IAP, Bcl-2, Mcl-1, Bcl-X(L), Mucin-1, NY-ESO-1, Telomerase, CEA, MART-1, HER-2/neu, bcr-abl, PSA, PSCA, Tyrosinase, p53, hTRT, Leukocyte Proteinase-3, hTRT, gp100, MAGE antigens, GASC, JMJD2C, JARD2 (JMJ), JHDM3a, WT-1, CA 9, Protein kinases, where the cancerous diseases include malignant melanoma, renal carcinoma, breast cancer, lung cancer, cancer of the uterus, cervical cancer, prostatic cancer, pancreatic cancer, brain cancer, head and neck cancer, leukemia, cutaneous lymphoma, hepatic carcinoma, colorectal cancer, bladder cancer.

h) Autoimmune and inflammatory diseases, associated with antigens such as

GAD64, Collagen, human cartilage glycoprotein 39, □-amyloid, A□42, APP, Presenilin 1, where the autoimmune and inflammatory diseases include Diabetes type 1, Rheumatoid arthritis, Alzheimer, chronic inflammatory bowel disease, Crohn's disease, ulcerative colitis uterosa, Multiple Sclerosis, Psoriasis Approaches to the Analysis or Treatment of Diseases.

For each application of a MHC multimer, a number of choices must be made. These include:

A. Disease (to be e.g. treated, prevented, diagnosed, monitored).

B. Application (e.g. analyze by flow cytometry, isolate specific cells, induce an immune response)

C. Label (e.g. should the MHC multimer be labelled with a fluorophore or a chromophore)

D. Biologically active molecule (e.g. should a biologically active molecule such as an interleukin be added or chemically linked to the complex)

E. Peptide (e.g. decide on a peptide to be complexed with MHC)

F. MHC (e.g. use a MHC allele that does not interfere with the patient's immune system in an undesired way).

A number of diseases $A_1$-$A_n$, relevant in connection with MHC multimers, have been described herein; a number of applications $B_1$-$B_n$, relevant in connection with MHC multimers, have been described herein; a number of Labels $C_1$-$C_n$, relevant in connection with MHC multimers, have been described herein; a number of biologically active molecules $D_1$-$D_n$, relevant in connection with MHC multimers, have been described herein; a number of peptides $E_1$-$E_n$, relevant in connection with MHC multimers, have been described herein; and a number of MHC molecules $F_1$-$F_n$, relevant in connection with MHC multimers, have been described herein.

Thus, each approach involves a choice to be made regarding all or some of the parameters A-F. A given application and the choices it involves can thus be described as follows:

$$Ai \times Bi \times Ci \times Di \times Ei \times Fi$$

Where i specifies a number between 1 and n. n is different for different choices A, B, C, D, E, or F. Consequently, the present invention describes a large number of approaches to the diagnosis, monitoring, prognosis, therapeutic or vaccine treatment of diseases. The total number of approaches, as defined by these parameters, are $$n(A) \times n(B) \times n(C) \times n(D) \times n(E) \times n(F),$$

where n(A) describes the number of different diseases A described herein, n(B) describes the number of different applications B described herein, etc.

Detection

Diagnostic procedures, immune monitoring and some therapeutic processes all involve identification and/or enumeration and/or isolation of antigen-specific T cells. Identification and enumeration of antigen-specific T cells may be done in a number of ways, and several assays are currently employed to provide this information. In the following it is described how MHC multimers as described in the present invention can be used to detect specific T cell receptors (TCRs) and thereby antigen-specific T cells in a variety of methods and assays. In the present invention detection includes detection of the presence of antigen-specific T cell receptors/T cells in a sample, detection of and isolation of cells or entities with antigen-specific T cell receptor from a sample and detection and enrichment of cells or entities with antigen-specific T cell receptor in a sample.

The sample may be a biological sample including solid tissue, solid tissue section or a fluid such as, but not limited to, whole blood, serum, plasma, nasal secretions, sputum, urine, sweat, saliva, transdermal exudates, pharyngeal exudates, bronchioalveolar lavage, tracheal aspirations, cerebrospinal fluid, synovial fluid, fluid from joints, vitreous fluid, vaginal or urethral secretions, or the like. Herein, disaggregated cellular tissues such as, for example, hair, skin, synovial tissue, tissue biopsies and nail scrapings are also considered as biological samples.

Many of the assays are particularly useful for assaying T-cells in blood samples. Blood samples are whole blood samples or blood processed to remove erythrocytes and platelets (e.g., by Ficoll density centrifugation or other such methods known to one of skill in the art) and the remaining PBMC sample, which includes the T-cells of interest, as well as B-cells, macrophages and dendritic cells, is used directly.

In order to be able to detect specific T cells by MHC multimers, labels and marker molecules can be used.

Marker Molecules

Marker molecules are molecules or complexes of molecules that bind to other molecules. Marker molecules thus may bind to molecules on entities, including the desired entities as well as undesired entities. Labeling molecules are molecules that may be detected in a certain analysis, i.e. the labeling molecules provide a signal detectable by the used method. Marker molecules, linked to labeling molecules, constitute detection molecules. Likewise labeling molecules linked to MHC multimers also constitute detection molecules but in contrast to detection molecules made up of marker and lebelling molecule labeled MHC multimers are specific for TCR. Sometimes a marker molecule in itself provides a detectable signal, wherefore attachment to a labeling molecule is not necessary.

Marker molecules are typically antibodies or antibody fragments but can also be aptamers, proteins, peptides, small organic molecules, natural compounds (e.g. steroids), non-peptide polymers, or any other molecules that specifically and efficiently bind to other molecules are also marker molecules.

Labelling Molecules

Labelling molecules are molecules that can be detected in a certain analysis, i.e. the labelling molecules provide a signal detectable by the used method. The amount of labelling molecules can be quantified.

The labelling molecule is preferably such which is directly or indirectly detectable.

The labelling molecule may be any labelling molecule suitable for direct or indirect detection. By the term "direct" is meant that the labelling molecule can be detected per se without the need for a secondary molecule, i.e. is a "primary" labelling molecule. By the term "indirect" is meant that the labelling molecule can be detected by using one or more "secondary" molecules, i.e. the detection is performed by the detection of the binding of the secondary molecule(s) to the primary molecule.

The labelling molecule may further be attached via a suitable linker. Linkers suitable for attachment to labelling molecules would be readily known by the person skilled in the art and as described elsewhere herein for attachment of MHC molecules to multimerisation domains.

Examples of such suitable labelling compounds are fluorescent labels, enzyme labels, radioisotopes, chemiluminescent labels, bioluminescent labels, polymers, metal particles, haptens, antibodies, and dyes.

The labelling compound may suitably be selected:

from fluorescent labels such as 5-(and 6)-carboxyfluorescein, 5- or 6-carboxyfluorescein, 6-(fluorescein)-5-(and 6)-carboxamido hexanoic acid, fluorescein isothio-cyanate (FITC), rhodamine, tetramethylrhodamine, and dyes such as Cy2, Cy3, and Cy5, optionally substituted coumarin including AMCA, PerCP, phycobiliproteins including R-phycoerythrin (RPE) and allophycoerythrin (APC), Texas Red, Princeton Red, Green fluorescent protein (GFP) and analogues thereof, and conjugates of R-phycoerythrin or allophycoerythrin and e.g. Cy5 or Texas Red, and inorganic fluorescent labels based on semiconductor nanocrystals (like quantum dot and Qdot™ nanocrystals), and time-resolved fluorescent labels based on lanthanides like Eu3+ and Sm3+, from haptens such as DNP, biotin, and digoxiginin, from enzymic labels such as horse radish peroxidase (HRP), alkaline phosphatase (AP), beta-galactosidase (GAL), glucose-6-phosphate dehydrogenase, beta-N-acetyl-glucosaminidase, R-glucuronidase, invertase, Xanthine Oxidase, firefly luciferase and glucose oxidase (GO), from luminiscence labels such as luminol, isoluminol, acridinium esters, 1,2-dioxetanes and pyridopyridazines, and from radioactivity labels such as incorporated isotopes of iodide, cobalt, selenium, tritium, and phosphor.

Radioactive labels may in particular be interesting in connection with labelling of the peptides harboured by the MHC multimers.

Different principles of labelling and detection exist, based on the specific property of the labelling molecule. Examples of different types of labelling are emission of radioactive radiation (radionuclide, isotopes), absorption of light (e.g. dyes, chromophores), emission of light after excitation (fluorescence from fluorochromes), NMR (nuclear magnetic resonance form paramagnetic molecules) and reflection of light (scatter from e.g. such as gold-, plastic- or glass-beads/particles of various sizes and shapes). Alternatively, the labelling molecules can have an enzymatic activity, by which they catalyze a reaction between chemicals in the near environment of the labelling molecules, producing a signal, which include production of light (chemi-luminescence), precipitation of chromophore dyes, or precipitates that can be detected by an additional layer of detection molecules. The enzymatic product can deposit at the location of the enzyme or, in a cell based analysis system, react with the membrane of the cell or diffuse into the cell to which it is attached. Examples of labelling molecules and associated detection principles are shown in table 2 below.

TABLE 2

Examples of labelling molecules and associated detection principles.

| Labelling substance | Effect | Assay-principle |
|---|---|---|
| Fluorochromes | emission of light having a specific spectra | [¤]Photometry, Microscopy, spectroscopy<br>PMT, photographic film, CCD's (Color-Capture Device or Charge-coupled device). |
| Radionuclide | irradiation, α, β or gamma rays | Scintillation counting, GM-tube, photographic film, excitation of phosphor-imager screen |
| Enzyme;<br>HRP, (horse reddish peroxidase),<br>peroxidases in general | catalysis of $H_2O_2$ reduction using luminol as Oxygen acceptor, resulting in oxidized luminal + light<br>catalysis of $H_2O_2$ reduction using a soluble dye, or molecule containing a hapten, such as a biotin residue as Oxygen acceptor, resulting in precipitation. The habten can be recognized by a detection molecule. | [¤]Photometry, Microscopy, spectroscopy<br>PMT, photographic film, CCD's (Colour-Capture Device or Charge-coupled device),<br>Secondary label linked antibody |
| Particles; gold, polystyrene beads, pollen and other particles | Change of scatter, reflection and transparency of the associated entity | Microscopy, cytometry, electron microscopy<br>PMT's, light detecting devices, flowcytometry scatter |
| AP (Alkaline Phosphatase) | Catalyze a chemical conversion of a non-detectable to a precipitated detectable molecule, such as a dye or a hapten | [¤]Photometry, Microscopy, spectroscopy<br>Secondary label linked antibody |
| Ionophores or chelating chemical compounds binding to specific ions, e.g. $Ca^{2+}$ | Change in absorption and emission spectrums when binding.<br>Change in intensity | [¤]Photometry, Cytometry, spectroscopy |
| Lanthanides | Fluorescence<br>Phosphorescence<br>Paramagnetic | [¤]photometry, cytometry, spectroscopy<br>NMR (Nuclear magnetic resonance) |
| DNA fluorescing stains | Propidium iodide<br>Hoechst stain<br>DAPI<br>AMC<br>DraQ5 ™<br>Acridine orange<br>7-AAD | [¤]Photometry, cytometry, spectroscopy |

[¤]Photometry; is to be understood as any method that can be applied to detect the intensity, analyze the wavelength spectra, and or measure the accumulation of light derived form a source emitting light of one or multiple wavelength or spectra.

Labelling molecules can be used to label MHC multimers as well as other reagents used together with MHC multimers, e.g. antibodies, aptamers or other proteins or molecules able to bind specific structures in another protein, in sugars, in DNA or in other molecules. In the following molecules able to bind a specific structure in another molecule are named a marker.

¤Photometry; is to be understood as any method that can be applied to detect the intensity, analyze the wavelength spectra, and or measure the accumulation of light derived form a source emitting light of one or multiple wavelength or spectra.

Labelling molecules can be attached to a given MHC multimer or any other protein marker by covalent linkage as described for attachment of MHC multimers to multimerization domains elsewhere herein. The attachment can be directly between reactive groups in the labelling molecule and reactive groups in the marker molecule or the attachment can be through a linker covalently attached to labelling molecule and marker, both as described elsewhere herein. When labelling MHC multimers the label can be attached either to the MHC complex (heavy chain, β2m or peptide) or to the multimerization domain.

In particular, one or more labelling molecules may be attached to the carrier molecule, or one or more labelling molecules may be attached to one or more of the scaffolds, or one or more labelling compounds may be attached to one or more of the MHC complexes, or one or more labelling compounds may be attached to the carrier molecule and/or one or more of the scaffolds and/or one or more of the MHC complexes, or one or more labelling compounds may be attached to the peptide harboured by the MHC molecule.

A single labelling molecule on a marker does not always generate sufficient signal intensity. The signal intensity can be improved by assembling single label molecules into large multi-labelling compounds, containing two or more label molecule residues. Generation of multi-label compounds can be achieved by covalent or non-covalent, association of labelling molecules with a major structural molecule. Examples of such structures are synthetic or natural polymers (e.g. dextramers), proteins (e.g. streptavidin), or polymers. The labelling molecules in a multi-labelling compound can all be of the same type or can be a mixture of different labelling molecules.

In some applications, it may be advantageous to apply different MHC complexes, either as a combination or in individual steps. Such different MHC multimers can be differently labelled (i.e. by labelling with different labelling compounds) enabling visualisation of different target MHC recognising cells. Thus, if several different MHC multimers with different labelling compounds are present, it is possible simultaneously to identify more than one specific receptor, if each of the MHC multimers present a different peptide.

Detection principles, such as listed in Table 2, can be applied to flow cytometry, stationary cytometry, and batch-based analysis. Most batch-based approaches can use any of the labelling substances depending on the purpose of the assay. Flow cytometry primarily employs fluorescence, whereas stationary cytometry primarily employs light absorption, e.g. dyes or chromophore deposit from enzymatic activity. In the following section, principles involving fluorescence detection will be exemplified for flow cytometry, and principles involving chromophore detection will be exemplified in the context of stationary cytometry. However, the labelling molecules can be applied to any of the analyses described in this invention.

Labelling Molecules of Particular Utility in Flow Cytometry:

In flowcytometry the typical label is detected by its fluorescence. Most often a positive detection is based on the presents of light from a single fluorochrome, but in other techniques the signal is detected by a shift in wavelength of emitted light; as in FRET based techniques, where the exited fluorochrome transfer its energy to an adjacent bound fluorochrome that emits light, or when using $Ca^{2+}$ chelating fluorescent props, which change the emission (and absorption) spectra upon binding to calcium. Preferably labelling molecules employed in flowcytometry are illustrated in Table 3 and 4 and described in the following.

- Simple fluorescent labels:
- Fluor dyes, Pacific Blue™, Pacific Orange™, Cascade Yellow™
- AlexaFluor® (AF);
  - AF405, AF488, AF500, AF514, AF532, AF546, AF555, AF568, AF594, AF610, AF633, AF635, AF647, AF680, AF700, AF710, AF750, AF800
- Quantum Dot based dyes, QDot® Nanocrystals (Invitrogen, MolecularProbs)
  - Qdot® 525, Qdot® 565, Qdot® 585, Qdot® 605, Qdot® 655, Qdot® 705, Qdot® 800
- DyLight™ Dyes (Pierce) (DL);
  - DL549, DL649, DL680, DL800
- Fluorescein (Flu) or any derivate of that, ex. FITC
- Cy-Dyes
  - Cy2, Cy3, Cy3.5, Cy5, Cy5.5, Cy7
- Fluorescent Proteins;
  - RPE, PerCp, APC
  - Green fluorescent proteins;
    - GFP and GFP-derived mutant proteins; BFP, CFP, YFP, DsRed, T1, Dimer2, mRFP1, MBanana, mOrange, dTomato, tdTomato, mTangerine, mStrawberry, mCherry
- Tandem dyes:
  - RPE-Cy5, RPE-Cy5.5, RPE-Cy7, RPE-AlexaFluor® tandem conjugates; RPE-Alexa610, RPE-TxRed
  - APC-Aleca600, APC-Alexa610, APC-Alexa750, APC-Cy5, APC-Cy5.5
- Ionophors; ion chelating fluorescent props
  - Props that change wavelength when binding a specific ion, such as Calcium
  - Props that change intensity when binding to a specific ion, such as Calcium
- Combinations of fluorochromes on the same marker. Thus, the marker is not identified by a single fluorochrome but by a code of identification being a specific combination of fluorochromes, as well as inter related ratio of intensities.

Example

Antibody Ab1 and Ab2, are conjugated to both. FITC and BP but Ab1 have 1 FITC to 1 BP whereas Ab2 have 2 FITC to 1 BP. Each antibody may then be identified individually by the relative intensity of each fluorochrome. Any such combinations of n fluorochromes with m different ratios can be generated.

TABLE 3

| Examples of preferable fluorochromes | | |
|---|---|---|
| Fluorofor/Fluorochrome | Excitation nm | Emission nm |
| 2-(4'-maleimidylanilino)naphthalene-6-sulfonic acid, sodium salt | 322 | 417 |
| 5-((((2-iodoacetyl)amino)ethyl)amino)naphthalene-1-sulfonic acid | 336 | 490 |
| Pyrene-1-butanoic acid | 340 | 376 |
| AlexaFluor 350 (7-amino-6-sulfonic acid-4-methyl coumarin-3-acetic acid) | 346 | 442 |
| AMCA (7-amino-4-methyl coumarin-3-acetic acid) | 353 | 442 |
| 7-hydroxy-4-methyl coumarin-3-acetic acid | 360 | 455 |
| Marina Blue (6,8-difluoro-7-hydroxy-4-methyl coumarin-3-acetic acid) | 362 | 459 |
| 7-dimethylamino-coumarin-4-acetic acid | 370 | 459 |
| Fluorescamin-N-butyl amine adduct | 380 | 464 |
| 7-hydroxy-coumarine-3-carboxylic acid | 386 | 448 |
| CascadeBlue (pyrene-trisulphonic acid acetyl azide) | 396 | 410 |
| Cascade Yellow | 409 | 558 |
| Pacific Blue (6,8 difluoro-7-hydroxy coumarin-3-carboxylic acid) | 416 | 451 |
| 7-diethylamino-coumarin-3-carboxylic acid | 420 | 468 |
| N-(((4-azidobenzoyl)amino)ethyl)-4-amino-3,6-disulfo-1,8-naphthalimide, dipotassium salt | 426 | 534 |
| Alexa Fluor 430 | 434 | 539 |
| 3-perylenedodecanoic acid | 440 | 448 |
| 8-hydroxypyrene-1,3,6-trisulfonic acid, trisodium salt | 454 | 511 |
| 12-(N-(7-nitrobenz-2-oxa-1,3-diazol-4-yl)amino)dodecanoic acid | 467 | 536 |
| N,N'-dimethyl-N-(iodoacetyl)-N'-(7-nitrobenz-2-oxa-1,3-diazol-4-yl)ethylenediamine | 478 | 541 |
| Oregon Green 488 (difluoro carboxy fluorescein) | 488 | 518 |
| 5-iodoacetamidofluorescein | 492 | 515 |
| propidium iodide-DNA adduct | 493 | 636 |
| Carboxy fluorescein | 495 | 519 |

TABLE 4

| Examples of preferable fluorochrome families | |
|---|---|
| Fluorochrome family | Example fluorochrome |
| AlexaFluor ®(AF) | AF ®350, AF405, AF430, AF488, AF500, AF514, AF532, AF546, AF555, AF568, AF594, AF610, AF633, AF635, AF647, AF680, AF700, AF710, AF750, AF800 |
| Quantum Dot (Qdot ®) based dyes | Qdot ®525, Qdot ®565, Qdot ®585, Qdot ®605, Qdot ®655, Qdot ®705, Qdot ®800 |
| DyLight ™ Dyes (DL) | DL549, DL649, DL680, DL800 |
| Small fluorescing dyes | FITC, Pacific Blue ™, Pacific Orange ™, Cascade Yellow ™, Marina blue ™, DSred, DSred-2, 7-AAD, TO-Pro-3, |
| Cy-Dyes | Cy2, Cy3, Cy3.5, Cy5, Cy5.5, Cy7 |
| Phycobili Proteins: | R-Phycoerythrin (RPE), PerCP, Allophycocyanin (APC), B-Phycoerythrin, C-Phycocyanin |
| Fluorescent Proteins | (E)GFP and GFP ((enhanced) green fluorescent protein) derived mutant proteins; BFP, CFP, YFP, DsRed, T1, Dimer2, mRFP1, MBanana, mOrange, dTomato, tdTomato, mTangerine, mStrawberry, mCherry |
| Tandem dyes with RPE | RPE-Cy5, RPE-Cy5.5, RPE-Cy7, RPE-AlexaFluor ® tandem conjugates; RPE-Alexa610, RPE-TxRed |
| Tandem dyes with APC | APC-Aleca600, APC-Alexa610, APC-Alexa750, APC-Cy5, APC-Cy5.5 |
| Calcium dyes | Indo-1-Ca2+ Indo-2-Ca2+ |

Preferably Labelling Molecules Employed in Stationary Cytometry and IHC

Enzymatic labelling, as exemplified in Table 5:

a Horse radish peroxidase; reduces peroxides ($H_2O_2$), and the signal is generated by the Oxygen acceptor when being oxidized.

Precipitating dyes; Dyes that when they are reduced they are soluble, and precipitate when oxidized, generating a coloured deposit at the site of the reaction.

Precipitating agent, carrying a chemical residue, a hapten, for second layer binding of marker molecules, for amplification of the primary signal.

Luminol reaction, generating a light signal at the site of reaction.

Other enzymes, such as Alkaline Phosphatase, capable of converting a chemical compound from a non-detectable molecule to a precipitated detectable molecule, which can be coloured, or carries a hapten as described above.

Fluorescent labels, as exemplified in Table 3 and 4; as those described for Flow cytometry are likewise important for used in stationary cytometry, such as in fluorescent microscopy.

TABLE 5

| Examples of preferable labels for stationary cytometry | | | |
|---|---|---|---|
| Label | Enzyme substrate, Oxygen acceptor Chromogen/precipitating agent | Precipitate or Residue, hapten* for secondary detection layer | Binding partner to hapten |
| HRP | diaminobenzidine (DAB) | Colored precipitate | — |
| HRP | 3-amino-9-ethyl-carbazole (AEC+) | Colored precipitate | — |
| AP | Fast red dye | Red precipitate | — |
| HRP | biotinyl tyramide | Exposed Biotin residue | Streptavidin, avidine |
| HRP | fluorescein tyramide | Exposed Fluorescein residue | Anti-Fluorecein Antibody |
| "Enzyme" | Substrate that when reacted precipitate | Primary label; being a dye, chemiluminescence's, or exposure of a hapten | Secondary label in case the primary label is a hapten |

Detection Methods and Principles

Detection of TCRs with multimers may be direct or indirect.

Direct Detection

Direct detection of TCRs is detection directly of the binding interaction between the specific T cell receptor and the MHC multimer. Direct detection includes detection of TCR when TCR is attached to lipid bilayer, when TCR is attached to or in a solid medium or when TCR is in solution.

Direct Detection of TCR Attached to Lipid Bilayer

One type of TCRs to detect and measure are TCRs attached to lipid bilayer including but is not limited to naturally occurring T cells (from blood, spleen, lymphnode, brain or any other tissue containing T cells), TCR transfected cells, T cell hybridomas, TCRs embedded in liposomes or any other membrane structure. In the following methods for direct detection of entities of TCRs attached to lipid bilayer will be described and any entity consisting of TCR attached to lipid bilayer will be referred to as T cells.

T cells can be directly detected either when in a fluid solution or when immobilized to a support.

Direct Detection of T Cells in Fluid Sample.

T cells can be detected in fluid samples as described elsewhere herein and in suspension of disrupted tissue, in culture media, in buffers or in other liquids. T cells in fluid samples can be detected individually or detected as populations of T cells. In the following different methods for direct detection of T cells in fluid samples are shown.

Direct Detection of Individual T Cells

Direct Detection of Individual T Cells Using Flow Cytometry.

A suspension of T cells are added MHC multimers, the sample washed and then the amount of MHC multimer bound to each cell are measured. Bound MHC multimers may be labelled directly or measured through addition of labelled marker molecules. The sample is analyzed using a flow cytometer, able to detect and count individual cells passing in a stream through a laser beam. For identification of specific T cells using MHC multimers, cells are stained with fluorescently labeled MHC multimer by incubating cells with MHC multimer and then forcing the cells with a large volume of liquid through a nozzle creating a stream of spaced cells. Each cell passes through a laser beam and any fluorochrome bound to the cell is excited and thereby fluoresces. Sensitive photomultipliers detect emitted fluorescence, providing information about the amount of MHC multimer bound to the cell. By this method MHC multimers can be used to identify specific T cell populations in liquid samples such as synovial fluid or blood.

When analyzing blood samples whole blood can be used with or without lysis of red blood cells. Alternatively lymphocytes can be purified before flow cytometry analysis using standard procedures like a Ficoll-Hypaque gradient. Another possibility is to isolate T cells from the blood sample for example by binding to antibody coated plastic surfaces, followed by elution of bound cells. This purified T cell population can then be used for flow cytometry analysis together with MHC multimers. Instead of actively isolating T cells unwanted cells like B cells and NK cells can be removed prior to the analysis. One way to do this is by affinity chromatography using columns coated with antibodies specific for the unwanted cells. Alternatively, specific antibodies can be added to the blood sample together with complement, thereby killing cells recognized by the antibodies.

Various gating reagents can be included in the analysis. Gating reagents here means labeled antibodies or other labeled markers identifying subsets of cells by binding to unique surface proteins. Preferred gating reagents when using MHC multimers are antibodies directed against CD3, CD4, and CD8 identifying major subsets of T cells. Other preferred gating reagents are antibodies against CD14, CD15, CD19, CD25, CD56, CD27, CD28, CD45, CD45RA, CD45RO, CCR7, CCR5, CD62L, Foxp3 recognizing specific proteins unique for different lymphocytes of the immune system.

Following labelling with MHC multimers and before analysis on a flow cytometer stained cells can be treated with a fixation reagent like formaldehyde to cross-link bound MHC multimer to the cell surface. Stained cells can also be analyzed directly without fixation.

The number of cells in a sample can vary. When the target cells are rare, it is preferable to analyze large amounts of cells. In contrast, fewer cells are required when looking at T cell lines or samples containing many cells of the target cell type.

The flow cytometer can be equipped to separate and collect particular types of cells. This is called cell sorting. MHC multimers in combination with sorting on a flowcytometer can be used to isolate specific T cell populations. Isolated specific T cell populations can then be expanded in vitro. This can be useful in autologous cancer therapy.

Direct determination of the concentration of MHC-peptide specific T cells in a sample can be obtained by staining blood cells or other cell samples with MHC multimers and relevant gating reagents followed by addition of an exact amount of counting beads of known concentration. Counting beads is here to be understood as any fluorescent bead with a size that can be visualized by flow cytometry in a sample containing T cells. The beads could be made of polystyrene with a size of about 1-10 μm. They could also be made of agarose, polyacrylamide, silica, or any other material, and have any size between 0.1 μm and 100 m. The counting beads are used as reference population to measure the exact volume of analyzed sample. The sample are analyzed on a flow cytometer and the amount of MHC-specific T cell determined using a predefined gating strategy and then correlating this number to the number of counted counting beads in the same sample using the following equation: Amounts of MHC-peptide specific T cells in a blood sample can be determined by flow cytometry by calculating the amount of MHC'mer labeled cells in a given volume of sample with a given cell density and then back calculate. Exact enumeration of specific T cells is better achieved by staining with MHC'mers together with an exact amount of counting beads followed by flow cytometry analysis. The amount of T cells detected can then be correlated with the amount of counting beads in the same volume of the sample and an exact number of MHC-peptide specific T cells determined:

Concentration of MHC-specific T-cell in sample=(number of MHC-peptide specific T cells counted/number of counting beads counted)×concentration of counting beads in sample Direct Detection of Individual T Cells in Fluid Sample by Microscopy A suspension of T cells are added MHC multimers, the sample washed and then the amount of MHC multimer bound to each cell are measured. Bound MHC multimers may be labelled directly or measured through addition of labelled marker molecules. The sample is then spread out on a slide or similar in a thin layer able to distinguish individual cells and labelled cells identified using a microscope. Depending on the type of label different types of microscopes may be used, e.g. if fluorescent labels are used a fluorescent microscope is used for the analysis. For example MHC multimers can be labeled with a flourochrome or bound MHC multimer detected with a fluorescent antibody. Cells with bound fluorescent MHC multimers can then be visualized using an immunofluorescence microscope or a confocal fluorescence microscope.

Direct Detection of Individual T Cells in Fluid Sample by Capture on Solid Support Followed by Elution.

MHC multimers are immobilized to a support e.g. beads, immunotubes, wells of a microtiterplate, CD, mircrochip or similar and as described elsewhere herein, then a suspension of T cells are added allowing specific T cells to bind MHC multimer molecules. Following washing bound T cells are recovered/eluted (e.g. using acid or competition with a competitor molecules) and counted.

Direct Detection of Populations of T Cells

- Cell suspensions are added labeled MHC multimer, samples are washed and then total signal from label are measured. The MHC multimers may be labeled themselves or detected through a labeled marker molecule.
- Cell suspensions are added labeled MHC multimer, samples are washed and then signal from label are amplified and then total signal from label and/or amplifier are measured.

Direct Detection of Immobilized T Cells.

T cells may be immobilized and then detected directly. Immobilization can be on solid support, in solid tissue or in fixator (e.g. paraffin, a sugar matrix or another medium fixing the T cells).

Direct Detection of T Cells Immobilized on Solid Support.

In a number of applications, it may be advantageous immobilise the T cell onto a solid or semi-solid support. Such support may be any which is suited for immobilisation, separation etc. Non-limiting examples include particles, beads, biodegradable particles, sheets, gels, filters, membranes (e. g. nylon membranes), fibres, capillaries, needles, microtitre strips, tubes, plates or wells, combs, pipette tips, micro arrays, chips, slides, or indeed any solid surface material. The solid or semi-solid support may be labelled, if this is desired. The support may also have scattering properties or sizes, which enable discrimination among supports of the same nature, e.g. particles of different sizes or scattering properties, colour or intensities.

Conveniently the support may be made of glass, silica, latex, plastic or any polymeric material. The support may also be made from a biodegradable material.

Generally speaking, the nature of the support is not critical and a variety of materials may be used. The surface of support may be hydrophobic or hydrophilic.

Preferred are materials presenting a high surface area for binding of the T cells. Such supports may be for example be porous or particulate e.g. particles, beads, fibres, webs, sinters or sieves. Particulate materials like particles and beads are generally preferred due to their greater binding capacity. Particularly polymeric beads and particles may be of interest.

Conveniently, a particulate support (e.g. beads or particles) may be substantially spherical. The size of the particulate support is not critical, but it may for example have a diameter of at least 1 μm and preferably at least 2 μm, and have a maximum diameter of preferably not more than 10 μm and more preferably not more than 6 μm. For example, particulate supports having diameters of 2.8 μm and 4.5 μm will work well.

An example of a particulate support is monodisperse particles, i.e. such which are substantially uniform in size (e. g. size having a diameter standard deviation of less than 5%). Such have the advantage that they provide very uniform reproducibility of reaction. Monodisperse particles, e.g. made of a polymeric material, produced by the technique described in U.S. Pat. No. 4,336,173 (ref. 25) are especially suitable.

Non-magnetic polymer beads may also be applicable. Such are available from a wide range of manufactures, e.g. Dynal Particles AS, Qiagen, Amersham Biosciences, Serotec, Seradyne, Merck, Nippon Paint, Chemagen, Promega, Prolabo, Polysciences, Agowa, and Bangs Laboratories.

Another example of a suitable support is magnetic beads or particles. The term “magnetic” as used everywhere herein is intended to mean that the support is capable of having a magnetic moment imparted to it when placed in a magnetic field, and thus is displaceable under the action of that magnetic field. In other words, a support comprising magnetic beads or particles may readily be removed by magnetic aggregation, which provides a quick, simple and efficient way of separating out the beads or particles from a solution. Magnetic beads and particles may suitably be paramagnetic or superparamagnetic. Superparamagnetic beads and particles are e.g. described in EP 0 106 873 (Sintef, ref. 26). Magnetic beads and particles are available from several manufacturers, e.g. Dynal Biotech ASA (Oslo, Norway, previously Dynal AS, e.g. Dynabeads®).

The support may suitably have a functionalised surface. Different types of functionalisation include making the surface of the support positively or negatively charged, or hydrophilic or hydrophobic. This applies in particular to beads and particles. Various methods therefore are e.g. described in U.S. Pat. No. 4,336,173 (ref. 25), U.S. Pat. No. 4,459,378 (ref. 27) and U.S. Pat. No. 4,654,267 (ref. 28).

Immobilized T cells may be detected in several ways including:

Direct Detection of T Cells Directly Immobilized on Solid Support.

- T cells may be directly immobilized on solid support e.g. by non-specific adhesion. Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. cells are immobilized in a monolayer on a cell culture well or a glass slide. Following staining with labelled multimer a digital picture is taken and labelled cells identified and counted. Alternatively a population of T cells is detected by measurement of total signal from all labelled T cells, e.g. cells are plated to wells of a microtiter plate, stained with labelled MHC multimer and total signal from each well are measured.

Direct Detection of T Cells Immobilized on Solid Support Through Linker Molecule

- T cells can also be immobilized to solid support through a linker molecule. The linker molecule can be an antibody specific for the T cell, a MHC multimer, or any molecule capable of binding T cells. In any case the linker may be attached directly to the solid support, to the solid support through another linker, or the linker may be embedded in a matrix, e.g. a sugar matrix.
- Then MHC multimers are added to the immobilized T cells thereby allowing specific T cells to bind the MHC multimers. Bound MHC multimer may be measured through label directly attached to the multimer or through labeled marker molecules. Individual T cells may be detected if the method for analysis is able to distinguish individual labelled cells, e.g. a digital picture is taken and labelled cells identified and counted.
- By using a specific MHC multimer both for the immobilization of the T-cells and for the labelling of immobilized cells (e.g. by labelling immobilized cells with chromophore- or fluorophore-labelled MHC multimer), a very high analytical specificity may be achieved because of the low background noise that results.

Alternatively a population of T cells is detected by measurement of total signal from all labeled T cells.

Immuno Profiling: Phenotyping T Cell Sample Using MHC Multimer Beads or Arrays.

Different MHC multimers are immobilized to different beads with different characteristics (e.g. different size, different fluorophores or different fluorescence intensities) where each kind of bead has a specific type of MHC multimer molecule immobilized. The immobilization may be direct or through a linker molecule as described above. The amount of bound T cells to a specific population of beads can be analyzed, thereby phenotyping the sample. The TCR on the T cell is defined by the MHC multimer and hence the bead to which it binds.

Likewise, MHC multimers can be immobilized in an array, e.g. on a glass plate or pin array so that the position in the array specifies the identity of the MHC multimer. Again, the immobilization may be direct or through a linker molecule as described above. After addition of T cells, the amount of bound T cells at a specified position in the array can be determined by addition of a label or labelled marker that binds to cells in general, or that binds specifically to the cells of interest. For example, the cells may be generally labelled by the addition of a labelled molecule that binds to all kinds of cells, or specific cell types, e.g. CD4+ T-cells, may be labelled with anti-CD4 antibodies that are labelled with e.g. a chromophore or fluorophore. Either of these approaches allow a phenotyping of the sample.

Profiling of an Individual's Disease-Specific T-Cell Repertoire.

Mass profiling of the T-cells of an individual may be done by first immobilizing specific MHC multimers (e.g. $10\text{-}10^6$ different MHC multimers, each comprising a specific MHC-peptide combination) in an array (e.g. a glass plate), adding e.g. a blood sample from the individual, and then after washing the unbound cells off, label the immobilized cells. Positions in the array of particularly high staining indicate MHC-peptide combinations that recognize specific T-cells of particularly high abundance or affinity. Thus, an immuno profiling of the individual with regard to the tested MHC-peptide combinations is achieved. A similar profiling of an individuals disease may be made using MHC multimers immobilized to different beads as described above.

Whether the profiling is performed using beads or arrays, the profiling may entail a number of diseases, a specific disease, a set of specific antigens implicated in one or more diseases, or a specific antigen (e.g. implicated in a specific disease or set of diseases).

In a preferred embodiment, an individual's immuno profile for a particular antigen is obtained. Thus, peptides corresponding to all possible 8'-, 9'- 10'- and 11'-mer peptide sequences derived from the peptide antigen sequence are generated, for example by standard organic synthesis or combinatorial chemistry, and the corresponding MHC multimers are produced, using one or more of the class I MHC-alleles of the individual in question. Further, peptides of e.g. 13, 14, 15, 16 and up to 25 amino acids length may be generated, for example by organic synthesis or combinatorial chemistry, corresponding to all 13', 14', 15', 16' and up to 25'-mers of the antigen, and the corresponding class II MHC multimers are produced, using one or more of the class II MHC-alleles of the individual in question. For a complete profiling for this particular antigen, all of the HLA-alleles of the individual in question should be used for the generation of the array; i.e., if the HLA class I haplotype of the individual is HLA-A*02, HLA-A*03, HLA-B*08 and HLA-B*07, all these HLA class I alleles should be combined with every tested peptide and similarly for all HLA class II alleles of the given individual.

Based on the profile, a personalized drug, -vaccine or -diagnostic test may be produced.

The principle described above may also be employed to distinguish between the immune response raised against a disease (e.g. an infection with a bacterium or the formation of a tumour), and the immune response raised against a vaccine for the same disease (in the example, a vaccine against the bacterium or the tumour). Most vaccines consists of subcomponents of the pathogen/tumour they are directed against and/or are designed to elicit an immune response different from the natural occurring immune response i.e. the T cell epitopes of the two immune reponses differs. Thus, by establishing the immuno profile, using a comprehensive array (i.e. an array that comprises all possible epitopes from one or more antigen(s)) or a subset of these epitopes, it is possible to deduce whether the immune response has been generated against the disease or the vaccine, or against both the disease and the vaccine. If the vaccine raises a response against a particular epitope or a particular set of epitopes, the corresponding positions in the array will give rise to high signals (compared to the remaining positions). Similarly a natural generated immune response will be directed against other and/or more particular epitopes and therefore give rise to high signals in other positions and/or more positions in the array. When an individual is vaccinated the immuno profile will reflect the effect of the vaccination on the immune response, and even if the individual has encountered the disease before and has generated a general immune response towards this disease, it will still be possible to deduce from the profiling whether this individual also has generated a specific response against the vaccine.

In another preferred embodiment, an individual's immuno profile for a set of antigens implicated in a specific disease is obtained. A subset of epitopes from a number of antigens is used. Thus, this is not a comprehensive profiling of this individual with regard to these antigens, but careful selection of the epitopes used may ensure that the profiling data can be used afterwards to choose between e.g. a limited set of vaccines available, or the data can be used to evaluate the immune response of the individual following an infection, where the epitopes used have been selected in order to avoid interference from related infectious diseases.

As above, a personalized drug, -vaccine or -diagnostic test may be produced. based on the information obtained from the immuno profiling.

In yet another preferred embodiment, the array comprising all possible 8'-, 9'-10'- and 11'-mer peptide sequences derived from a given peptide antigen, and all 13, 14, 15 and 16'-mers of the same antigen, are synthesized and assembled in MHC multimers, and immobilized in an array. Then, the ability of the individual peptide to form a complex with MHC is tested. As an example, one may add labelled W6/32 antibody, an antibody that binds correctly folded MHC I heavy chain, when this heavy chain is assembled together with antigenic peptide and beta2microglobulin, and which therefore can be used to detect formation of MHC-peptide complex, as binding of W6/32 antibody is usually considered a strong indication that the MHC-peptide complex has been formed. The ability of different peptides to enter into a MHC-peptide complex may also be promoted by the addition to the array of T-cells. Specific T-cells will drive the formation of the corresponding specific MHC-peptide complexes. Thus, after addition of T-cells to the array, the MHC-peptide complex integrity can be examined by addition of the labelled W6/32 antibody or other antibodies specific for correct conformation. Positions on the array that have strong signals indicate that the peptide that was added to MHC and immobilized at this position, was capable of forming the MHC-peptide complex in the presence of specific T-cells. Alternatively, the binding of the specific T-cells to the corresponding MHC-peptide complexes may be detected directly through a labeled antibody specific for the T cell.

Direct Detection of Immobilized T Cells Followed by Sorting

T cells immobilized to solid support in either of the ways described above can following washing be eluted from the solid support and treated further. This is a method to sort out specific T cells from a population of different T cells. Specific T-cells can e.g. be isolated through the use of bead-based MHC multimers. Bead-based MHC multimers are beads whereto monomer MHC-peptide complexes or MHC multimers are immobilized. After the cells have been isolated they can be manipulated in many different ways. The isolated cells can be activated (to differentiate or proliferate), they can undergo induced apoptosis, or undesired cells of the isolated cell population can be removed. Then, the manipulated cell population can be re-introduced into the patient, or can be introduced into another patient.

A typical cell sorting experiment, based on bead-based MHC multimers, would follow some of the steps of the general procedure outlined in general terms in the following: Acquire the sample, e.g. a cell sample from the bone marrow of a cancer patient. Block the sample with a protein solution, e.g. BSA or skim milk.

Block the beads coated with MHC complexes, with BSA or skim milk.

Mix MHC-coated beads and the cell sample, and incubate.

Wash the beads with washing buffer, to remove unbound cells and non-specifically bound cells.

Isolate the immobilized cells, by either cleavage of the linker that connects MHC complex and bead; or alternatively, release the cells by a change in pH, salt-concentration addition of competitive binder or the like. Preferably, the cells are released under conditions that do not disrupt the integrity of the cells. Manipulate the isolated cells (induce apoptosis, proliferation or differentiation)

Direct Detection of T Cells in Solid Tissue.

Direct Detection of T Cells in Solid Tissue In Vitro.

For in vitro methods of the present invention solid tissue includes tissue, tissue biopsies, frozen tissue or tissue biopsies, paraffin embedded tissue or tissue biopsies and sections of either of the above mentioned. In a preferred method of this invention sections of fixed or frozen tissues are incubated with MHC multimer, allowing MHC multimer to bind to specific T cells in the tissue section. The MHC multimer may be labeled directly or through a labeled marker molecule. As an example, the MHC multimer can be labeled with a tag that can be recognized by e.g. a secondary antibody, optionally labeled with HRP or another label. The bound MHC multimer is then detected by its fluorescence or absorbance (for fluorophore or chromophore), or by addition of an enzyme-labeled antibody directed against this tag, or another component of the MHC multimer (e.g. one of the protein chains, a label on the multimerization domain). The enzyme can be Horse Raddish Peroxidase (HRP) or Alkaline Phosphatase (AP), both of which convert a colorless substrate into a colored reaction product in situ. This colored deposit identifies the binding site of the MHC multimer, and can be visualized under a light microscope. The MHC multimer can also be directly labeled with e.g. HRP or AP, and used in IHC without an additional antibody.

The tissue sections may derive from blocks of tissue or tissue biopsies embedded in paraffin, and tissue sections from this paraffin-tissue block fixed in formalin before staining. This procedure may influence the structure of the TCR in the fixed T cells and thereby influence the ability to recognize specific MHC complexes. In this case, the native structure of TCR needs to be at least partly preserved in the fixed tissue. Fixation of tissue therefore should be gentle. Alternatively, the staining is performed on frozen tissue sections, and the fixation is done after MHC multimer staining.

Direct Detection of T Cells in Solid Tissue In Vivo

For in vivo detection of T cells labeled MHC multimers are injected in to the body of the individual to be investigated. The MHC multimers may be labeled with e.g. a paramagnetic isotope. Using a magnetic resonance imaging (MRI) scanner or electron spin resonance (ESR) scanner MHC multimer binding T cells can then be measured and localized. In general, any conventional method for diagnostic imaging visualization can be utilized. Usually gamma and positron emitting radioisotopes are used for camera and paramagnetic isotopes for MRI.

The methods described above for direct detection of TCR embedded in lipid bilayers collectively called T cells using MHC multimers also applies to detection of TCR in solution and detection of TCR attached to or in a solid medium. Though detection of individual TCRs may not be possible when TCR is in solution.

Indirect Detection of TCR

Indirect detection of TCR is primarily useful for detection of TCRs embedded in lipid bilayer, preferably natural occurring T cells, T cell hybridomas or transfected T cells. In indirect detection, the number or activity of T cells are measured, by detection of events that are the result of TCR-MHC-peptide complex interaction. Interaction between MHC multimer and T cell may stimulate the T cell resulting in activation of T cells, in cell division and proliferation of T cell populations or alternatively result in inactivation of T cells. All these mechanism can be measured using various detection methods.

Indirect Detection of T Cells by Measurement of Activation.

MHC multimers, e.g. antigen presenting cells, can stimulate T cells resulting in activation of the stimulated T cells. Activation of T cell can be detected by measurement of secretion of specific soluble factor from the stimulated T cell, e.g. secretion of cytokines like INFγ and IL2. Stimulation of T cells can also be detected by measurement of changes in expression of specific surface receptors, or by measurement of T cell effector functions.

Measurement of activation of T cells involves the following steps:

a) To a sample of T cells, preferably a suspension of cells, is added MHC multimer to induce either secretion of soluble factor, up- or down-regulation of surface receptor or other changes in the T cell.

Alternatively, a sample of T cells containing antigen presenting cells is added antigenic peptide or protein/protein fragments that can be processed into antigenic peptides by the antigen presenting cell and that are able to bind MHC I or MHC II molecules expressed by the antigen presenting cells thereby generating a cell based MHC multimer in the sample. Several different peptides and proteins be added to the sample. The peptide-loaded antigen presenting cells can then stimulate specific T cells, and thereby induce the secretion of soluble factor, up- or down-regulation of surface receptors, or mediate other changes in the T cell, e.g. enhancing effector functions.

Optionally a second soluble factor, e.g. cytokine and/or growth factor(s) may be added to facilitate continued activation and expansion of T cell population.

b) Detect the presence of soluble factor, the presence/absence of surface receptor or detect effector function c) Correlate the measured result with presence of T cells. The measured signal/response indicate the presence of specific T cells that have been stimulated with particular MHC multimer.

The signal/response of a T lymphocyte population is a measure of the overall response. The frequency of specific T cells able to respond to a given MHC multimer can be determined by including a limiting-dilution culture in the assay also called a Limiting dilution assay.

The limiting-dilution culture method involves the following steps:

a) Sample of T cells in suspension are plated into culture wells at increasing dilutions b) MHC multimers are added to stimulate specific T cells. Alternatively antigen presenting cells are provided in the sample and then antigenic peptide I added to the sample as described above.

Optionally growth factors, cytokines or other factors helping T cells to proliferate are added.

c) Cells are allowed to grow and proliferate (½-several days). Each well that initially contained a specific T cell will make a response to the MHC multimer and divide.

d) Wells are tested for a specific response e.g. secretion of soluble factors, cell proliferation, cytotoxicity or other effector function.

The assay is replicated with different numbers of T cells in the sample, and each well that originally contained a specific T cell will make a response to the MHC multimer. The frequency of specific T cells in the sample equals the reciprocal of the number of cells added to each well when 37% of the wells are negative, because due to Poisson distribution each well then on average contained one specific T cell at the beginning of the culture.

In the following various methods to measure secretion of specific soluble factor, expression of surface receptors, effector functions or proliferation is described.

Indirect Detection of T Cells by Measurement of Secretion of Soluble Factors.

Indirect Detection of T Cells by Measurement of Extracellular Secreted Soluble Factors.

Secreted soluble factors can be measured directly in fluid suspension, captured by immobilization on solid support and then detected or an effect of the secreted soluble factor can be detected.

Indirect Detection of T Cells by Measurement of Extracellular Secreted Soluble Factor Directly in Fluid Sample.

A sample of T cells are added MHC multimer or antigenic peptide as described above to induce secretion of soluble factors from antigen-specific T cells. The secreted soluble factors can be measured directly in the supernatant using e.g. mass spectrometry.

Indirect Detection of T Cells by Capture of Extracellular Secreted Soluble Factor on Solid Support.

A sample of T cells are added MHC multimer or antigenic peptide as described above to induce secretion of soluble factors from antigen-specific T cells. Secreted soluble factors in the supernatant are then immobilized on a solid support either directly or through a linker as described for immobilization of T cells elsewhere herein. Then immobilized soluble factors can be detected using labeled marker molecules.

Soluble factors secreted from individual T cells can be detected by capturing of the secreted soluble factors locally by marker molecules, e.g antibodies specific for the soluble factor. Soluble factor recognising marker molecules are then immobilised on a solid support together with T cells and soluble factors secreted by individual T cells are thereby captured in the proximity of each T cell. Bound soluble factor can be measured using labelled marker molecule specific for the captured soluble factor. The number of T cells that has given rise to labelled spots on solid support can then be enumerated and these spots indicate the presence of specific T cells that may be stimulated with particular MHC multimer.

Soluble factors secreted from a population of T cells are detected by capture and detection of soluble factor secreted from the entire population of specific T cells. In this case soluble factor do not have to be captured locally close to each T cell but the secreted soluble factors my be captured and detected in the same well as where the T cells are or transferred to another solid support with marker molecules for capture and detection e.g. beads or wells of ELISA plate.

Indirect Detection of T Cells Immobilized to Solid Support in a Defined Pattern.

Different MHC multimers og MHC-peptide complexes are immobilized to a support to form a spatial array in a defined pattern, where the position specifies the identity of the MHC multimer/MHC-peptide complex immobilized at this position. Marker molecules able to bind T cell secreted soluble factors are co-spotted together with MHC multimer/MHC-peptide complex. Such marker molecules can e.g. be antibodies specific for cytokines like INFγ or IL-2. The immobilization may be direct or through a linker molecule as described above. Then a suspension of labeled T cells are added or passed over the array of MHC multimers/MHC-peptide complexes and specific T cells will bind to the immobilized MHC multimers/MHC-peptide complexes and upon binding be stimulated to secrete soluble factors e.g. cytokines like INFγ ord IL-2. Soluble factors secreted by individual T cells are then captured in the proximity of each T cell and bound soluble factor can be measured using labelled marker molecule specific for the soluble factor. The number and position of different specific T cells that has given rise to labelled spots on solid support can then be identified and enumerated. In this way T cells bound to defined areas of the support are analyzed, thereby, phenotyping the sample. Each individual T cell is defined by the TCR it expose and depending on these TCRs each entity will bind to different types of MHC multimers/MHC-peptide complexes immobilized at defined positions on the solid support.

Indirect Detection of T Cells by Measurement of Effect of Extracellular Secreted Soluble Factor.

Secreted soluble factors can be measured and quantified indirectly by measurement of the effect of the soluble factor on other cell systems. Briefly, a sample of T cells are added MHC multimer or antigenic peptide as described above to induce secretion of soluble factors from antigen-specific T cells. The supernatant containing secreted soluble factor are transferred to another cell system and the effect measured. The soluble factor may induce proliferation, secretion of other soluble factors, expression/downregulation of receptors, or the soluble factor may have cytotoxic effects on these other cells. All effects can be measured as described elsewhere herein.

Indirect Detection of T Cells by Measurement of Intracellular Secreted Soluble Factors Soluble factor production by stimulated T cells can be also be measured intracellular by e.g. flow cytometry. This can be done using block of secretion of soluble factor (e.g. by monensin), permeabilization of cell (by e.g. saponine) followed by immunofluorescent staining. The method involves the following steps: 1) Stimulation of T cells by binding specific MHC multimers, e.g. antigen presenting cells loaded with antigenic peptide. An reagent able to block extracellular secretion of cytokine is added, e.g. monensin that interrupt intracellular transport processes leading to accumulation of produced soluble factor, e.g. cytokine in the Golgi complex. During stimulation other soluble factors may be added to the T cell sample during stimulation to enhance activation and/or expansion. This other soluble factor can be cytokine and or growth factors. 2) addition of one or more labelled marker able to detect special surface receptors (e.g. CD8, CD4, CD3, CD27, CD28, CD2). 3) Fixation of cell membrane using mild fixator followed by permeabilization of cell membrane by. e.g. saponine. 4) Addition of labelled marker specific for the produced soluble factor to be determined, e.g. INFγ, IL-2, IL-4, IL-10. 5) Measurement of labelled cells using a flow cytometer.

An alternative to this procedure is to trap secreted soluble factors on the surface of the secreting T cell as described by Manz, R. et al., Proc. Natl. Acad. Sci. USA 92:1921 (1995).

Indirect Detection of T Cells by Measurement of Expression of Receptors

Activation of T cells can be detected by measurement of expression and/or down regulation of specific surface receptors. The method includes the following steps. A sample of T cells are added MHC multimer or antigenic peptide as described above to induce expression or downregulation of specific surface receptors on antigen-specific T cells. These receptors include but are not limited to CD28, CD27, CCR7, CD45RO, CD45RA, IL2-receptor, CD62L, CCR5. Their expression level can be detected by addition of labelled marker specific for the desired receptor and then measure the amount of label using flow cytometry, microscopy, immobilization of activated T cell on solid support or any other method like those described for direct detection of TCR in lipid bilayer.

Indirect Detection of T Cells by Measurement of Effector Function

Activation of T cells can be detected indirectly by measurement of effector functions. A sample of T cells are added MHC multimer or antigenic peptide as described above to induce the T cell to be able to do effector function. The effector function is then measured. E.g. activation of antigen-specific CD8 positive T cells can be measured in a cytotoxicity assay.

Indirect Detection of T Cells by Measurement of Proliferation

T cells can be stimulated to proliferate upon binding specific MHC multimers. Proliferation of T cells can be measured several ways including but not limited to:

Detection of mRNA

Proliferation of T cells can be detected by measurement of mRNA inside cell. Cell division and proliferation requires production of new protein in each cell which as an initial step requires production of mRNA encoding the proteins to be synthesized.

A sample of T cells are added MHC multimer or antigenic peptide as described above to induce proliferation of antigen-specific T cells. Detection of levels of mRNA inside the proliferating T cells can be done by quantitative PCR and indirectly measure activation of a T cell population as a result of interaction with MHC multimer. An example is measurement of cytokine mRNA by in sity hybridization.

Detection of Incorporation of Thymidine

The proliferative capacity of T cells in response to stimulation by MHC multimer can be determined by a radioactive assay based on incorporation of [$^3$H]thymidine ([$^3$H]TdR) into newly generated DNA followed by measurement of radioactive signal.

Detection of Incorporation of BrdU

T cell proliferation can also be detected by of incorporation of bromo-2'-deoxyuridine (BrdU) followed by measurement of incorporated BrdU using a labeled anti-BrdU antibody in an ELISA based analysis.

Viability of cells may be measured by measurement ATP in a cell culture.

Indirect Detection of T Cells by Measurement of Inactivation

Not all MHC multimers will lead to activation of the T cells they bind. Under certain circumstances some MHC multimers may rather inactivate the T cells they bind to.

Indirect Detection of T Cells by Measurement of Effect of Blockade of TCR

Inactivation of T cells by MHC multimers may be measured be measuring the effect of blocking TCR on antigen-specific T cells. MHC multimers, e.g. MHC-peptide complexes coupled to IgG scaffold can block the TCR of an antigen-specific T cell by binding the TCR, thereby prevent the blocked T cell receptor interacting with e.g. antigen presenting cells. Blockade of TCRs of a T cell can be detected in any of the above described methods for detection of TCR by addition of an unlabeled blocking MHC multimer together with the labelled MHC multimer and then measuring the effect of the blockade on the readout.

Indirect Detection of T Cells by Measurement of Induction of Apoptosis

Inactivation of T cells by MHC multimers may be measured be measuring apoptosis of the antigen-specific T cell. Binding of some MHC multimers to specific T cells may lead to induction of apoptosis. Inactivation of T cells by binding MHC multimer may therefore be detected by measuring apoptosis in the T cell population. Methods to measure apoptosis in T cells include but are not limited to measurement of the following:

DNA fragmentation

Alterations in membrane asymmetry (phosphatidylserine translocation)

Activation of apoptotic caspases

Release of cytochrome C and AIF from mitochondria into the cytoplasm

Positive Control Experiments for the Use of MHC Multimers in Flow Cytometry and Related Techniques When performing flow cytometry experiments, or when using similar technologies, it is important to include appropriate positive and negative controls. In addition to establishing proper conditions for the experiments, positive and negative control reagents can also be used to evaluate the quality (e.g. specificity and affinity) and stability (e.g. shelf life) of produced MHC multimers.

The quality and stability of a given MHC multimer can be tested in a number of different ways, including:

- Measurement of specific MHC multimer binding to beads, other types of solid support, or micelles and liposomes, to which TCR's have been immobilized. Other kinds of molecules that recognize specifically the MHC-peptide complex can be immobilized and used as well. Depending on the nature of the solid support or membrane structure to which the TCR is immobilized, the TCR can be full-length (i.e. comprise the intracellular- and intra-membrane domains), or can be truncated (e.g. only comprise the extracellular domains). Likewise, the TCR can be recombinant, and can be chemically or enzymatically modified.
- Measurement of MHC multimer binding to beads, other types of solid support, or micelles and liposomes, to which aptamers, antibodies or other kinds of molecules that recognize correctly folded MHC-peptide complexes have been immobilized.
- Measurement of specific MHC multimer binding to specific cell lines (e.g. T-cell lines) displaying MHC multimer-binding molecules, e.g. displaying TCRs with appropriate specificity and affinity for the MHC multimer in question.
- Measurement of specific MHC multimer binding to cells in blood samples, preparations of purified lymphocytes (HPBMCs), or other bodily fluids that contain cells carrying receptor molecules specific for the MHC multimer in question.
- Measurement of specific MHC multimer binding to soluble TCRs, aptamers, antibodies, or other soluble MHC-peptide complex-binding molecules, by density-gradient centrifugation (e.g. in CsCl) or by size exclusion chromatography, PAGE or other type of chromatographic method.

Measurement of specific MHC binding to TCRs, aptamers, antibodies, streptavidin, or other MHC-peptide complex-binding molecules immobilized on a solid surface (e.g. a microtiter plate). The degree of MHC multimer binding can be visualized with a secondary component that binds the MHC multimer, e.g. a biotinylated fluorophore in cases where the MHC multimer contains streptavidin proteins, not fully loaded with biotin. Alternatively, the secondary component is unlabelled, and a labelled second component-specific compound is employed (e.g. EnVision System, Dako) for visualization. This solid surface can be beads, immunotubes, microtiterplates act. The principle for purification are basically the same I.e. T cells are added to the solid with immobilized MHC'mer, non-binding T cells are washed away and MHC-peptide specific T cells can be retrieved by elution with mild acid or a competitive binding reagent.

- Measurement of specific MHC multimer binding to TCRs, aptamers, antibodies, streptavidin, or other MHC-peptide complex-binding molecules immobilized on a solid surface (e.g. a microtiter plate) visualized with a secondary component specific to MHC multimer (e.g. TCRs, aptamers, antibodies, streptavidin, or other MHC-peptide binding complex-binding molecules). Alternatively the secondary receptor is unlabelled, and a labelled second receptor-specific compound is employed (e.g. EnVision System, Dako) before visualization.

In the above mentioned approaches, positive control reagents include MHC multimers comprising correctly folded MHC, complexed with an appropriate peptide that allows the MHC multimer to interact specifically and efficiently with its cognate TCR. Negative control reagents include empty MHC multimers, or correctly folded MHC multimers complexed with so-called nonsense peptides that support a correct conformation of the MHC-peptide complex, but that do not efficiently bind TCRs through the peptide-binding site of the MHC complex.

Negative Control Reagents and Negative Control Experiments for the Use of MHC Multimers in Flow Cytometry and Related Techniques Experiments with MHC multimers require a negative control in order to determine background staining with MHC multimer. Background staining can be due to unwanted binding of any of the individual components of the MHC multimer, e.g., MHC complex or individual components of the MHC complex, multimerization domain or label molecules. The unwanted binding can be to any surface or intracellular protein or other cellular structure of any cell in the test sample, e.g. undesired binding to B cells, NK cells or T cells. Unwanted binding to certain cells or certain components on cells can normally be corrected for during the analysis, by staining with antibodies that bind to unique surface markers of these specific cells, and thus identifies these as false positives, or alternatively, that bind to other components of the target cells, and thus identifies these cells as true positives. A negative control reagent can be used in any experiment involving MHC multimers, e.g. flow cytometry analysis, other cytometric methods, immunohistochemistry (IHC) and ELISA. Negative control reagents include the following:

- MHC complexes or MHC multimers comprising MHC complexes carrying nonsense peptides. A nonsense peptide is here to be understood as a peptide that binds the MHC protein efficiently, but that does not support binding of the resultant MHC-peptide complex to the desired TCR. An example nonsense peptide is a peptide with an amino acid sequence different from the linear sequence of any peptide derived from any known protein. When choosing an appropriate nonsense peptide the following points are taken into consideration. The peptide should ideally have appropriate amino acids at relevant positions that can anchor the peptide to the peptide-binding groove of the MHC. The remaining amino acids should ideally be chosen in such a way that possible binding to TCR (through interactions with the peptide or peptide-binding site of MHC) are minimized. The peptide should ideally be soluble in water to make proper folding with MHC alpha chain and β2m possible in aqueous buffer. The length of the peptide should ideally match the type and allele of MHC complex. The final peptide sequence should ideally be taken through a blast search or similar analysis, to ensure that it is not identical with any peptide sequence found in any known naturally occurring proteins.
- MHC complexes or MHC multimers comprising MHC complexes carrying a chemically modified peptide in the peptide-binding groove. The modification should ideally allow proper conformation of the MHC-peptide structure, yet should not allow efficient interaction of the peptide or peptide-binding site of MHC with the TCR.

MHC complexes or MHC multimers comprising MHC complexes carrying a naturally occurring peptide different from the peptide used for analysis of specific T cells in the sample. When choosing the appropriate natural peptide the following should be taken into consideration. The peptide in complex with the MHC protein should ideally not be likely to bind a TCR of any T cell in the sample with such an affinity that it can be detected with the applied analysis method. The peptide should ideally be soluble in water to make proper folding with MHC alpha chain and β2m possible in aqueous buffer. The length of the peptide should match the type and allele of MHC complex.

Empty MHC complexes or MHC multimers comprising empty MHC complexes, meaning any correctly folded MHC complex without a peptide in the peptide-binding groove.

MHC heavy chain or MHC multimers comprising MHC heavy chain, where MHC heavy chain should be understood as full-length MHC I or MHC II heavy chain or any truncated version of MHC I or MHC II heavy chain. The MHC heavy chains can be either folded or unfolded. Of special interest is MHC I alpha chains containing the α3 domain that binds CD8 molecules on cytotoxic T cells. Another embodiment of special interest is MHC II 13 chains containing the β2 domain that binds CD4 on the surface of helper T cells.

Beta2microglobulin or subunits of beta2microglobulin, or MHC multimers comprising Beta2microglobulin or subunits of beta2microglobulin, folded or unfolded.

MHC-like complexes or MHC multimers comprising MHC-like complexes, folded or unfolded. An example could be CD1 molecules that are able to bind peptides in a peptide-binding groove that can be recognized by T cells (Russano et al. (2007). CD1-restricted recognition of exogenous and self-lipid antigens by duodenal gammadelta+ T lymphocytes. J Immunol. 178(6):3620-6)

Multimerization domains without MHC or MHC-like molecules, e.g. dextran, streptavidin, IgG, coiled-coil-domain liposomes.

Labels, e.g. FITC, PE, APC, pacific blue, cascade yellow, or any other label listed elsewhere herein.

Negative controls 1-4 can provide information about potentially undesired binding of the MHC multimer, through interaction of a surface of the MHC-peptide complex different from the peptide-binding groove and its surroundings. Negative control 5 and 6 can provide information about binding through interactions through the MHC I or MHC II proteins (in the absence of peptide). Negative control 7 can provide information about binding through surfaces of the MHC complex that is not unique to the MHC complex. Negative controls 8 and 9 provide information about potential undesired interactions between non-MHC-peptide complex components of the MHC multimer and cell constituents.

Minimization of Undesired Binding of the MHC Multimer

Identification of MHC-peptide specific T cells can give rise to background signals due to unwanted binding to cells that do not carry TCRs. This undesired binding can result from binding to cells or other material, by various components of the MHC multimer, e.g. the dextran in a MHC dextramer construct, the labelling molecule (e.g. FITC), or surface regions of the MHC-peptide complex that do not include the peptide and the peptide-binding cleft.

MHC-peptide complexes bind to specific T cells through interaction with at least two receptors in the cell membrane of the T-cell. These two receptors are the T-cell receptor (TCR) and CD8 for MHC I-peptide complexes and TCR and CD4 receptor protein for MHC II-peptide complexes. Therefore, a particularly interesting example of undesired binding of a MHC multimer is its binding to the CD8 or CD4 molecules of T cells that do not carry a TCR specific for the actual MHC-peptide complex. The interaction of CD8 or CD4 molecules with the MHC is not very strong; however, because of the avidity gained from the binding of several MHC complexes of a MHC multimer, the interaction between the MHC multimer and several CD8 or CD4 receptors potentially can result in undesired but efficient binding of the MHC multimer to these T cells. In an analytical experiment this would give rise to an unwanted background signal; in a cell sorting experiment undesired cells might become isolated. Other particular interesting examples of undesired binding is binding to lymphoid cells different from T cells, e.g. NK-cells, B-cells, monocytes, dendritic cells, and granulocytes like eosinophils, neutrophils and basophiles.

Apart from the MHC complex, other components in the MHC multimer can give rise to unspecific binding. Of special interest are the multimerization domain, multimerization domain molecules, and labelling molecules.

One way to overcome the problem with unwanted binding is to include negative controls in the experiment and subtract this signal from signals derived from the analyzed sample, as described elsewhere in the invention.

Alternatively, unwanted binding could be minimized or eliminated during the experiment. Methods to minimize or eliminate background signals include:

Mutations in areas of the MHC complex responsible for binding to unwanted cells can be introduced. Mutations here mean substitution, insertion, or deletion of natural or non-natural amino acids. Sub-domains in the MHC complex can be responsible for unwanted binding of the MHC multimer to cells without a TCR specific for the MHC-peptide complex contained in the MHC multimer. One example of special interest is a small region in the α3-domain of the α-chain of MHC I molecules that is responsible for binding to CD8 on all cytotoxic T cells. Mutations in this area can alter or completely abolish the interaction between CD8 on cytotoxic T cells and MHC multimer (Neveu et al. (2006) Int Immunol. 18, 1139-45). Similarly a sub domain in the β2 domain of the β-chain of MHC II molecules is responsible for binding CD4 molecules on all CD4 positive T cells. Mutations in this sub domain can alter or completely abolish the interaction between MHC II and CD4.

Another embodiment is to mutate other areas of MHC I/MHC II complexes that are involved in interactions with T cell surface receptors different from TCR, CD8 and CD4, or that bind surface receptors on B cells, NK cells, Eosiniophils, Neutrophils, Basophiles, Dendritic cells or monocytes.

Chemical alterations in areas of the MHC complex responsible for binding to unwanted cells can be employed in order to minimize unwanted binding of MHC multimer to irrelevant cells. Chemical alteration here means any chemical modification of one or more amino acids. Regions in MHC complexes that are of special interest are as mentioned above the α3 domain of the α-chain in MHC I molecules and β2 domains in the β-chain of MHC II molecules. Other regions in MHC I/MHC II molecules that can be chemically modified to decrease the extent of undesired binding are regions involved in interaction with T cell surface receptors different from TCR, CD8 and CD4, or that bind surface receptors on B cells, NK cells, Eosiniophils, Neutrophils, Basophiles, Dendritic cells or monocytes.

Another method to minimize undesired binding involves the addition of one or more components of a MHC multimer, predicted to be responsible for the unwanted binding. The added component is not labeled, or carries a label different from the label of the MHC multimer used for analysis. Of special interest is addition of MHC multimers that contain nonsense peptides, i.e. peptides that interact efficiently with the MHC protein, but that expectably do not support specific binding of the MHC multimer to the TCR in question. Another example of interest is addition of soluble MHC complexes not coupled to a multimerization domain, and with or without peptide bound in the peptide binding cleft. In another embodiment, individual components of the MHC complex can be added to the sample, e.g. I α-chain or subunits of MHC I α-chain either folded or unfolded, beta2microglobulin or subunits thereof either folded or unfolded, α/β-chain of MHC II or subunits thereof either folded or unfolded. Any of the above mentioned individual components can also be attached to a multimerization domain identical or different from the one used in the MHC multimer employed in the analysis.

Of special interest is also addition of multimerization domain similar or identical to the multimerization domain used in the MHC multimer or individual components of the multimerization domain.

Reagents able to identify specific cell types either by selection or exclusion can be included in the analysis to help identify the population of T cells of interest, and in this way deselect the signal arising from binding of the MHC multimer to undesired cells.

Of special interest is the use of appropriate gating reagents in flow cytometry experiments. Thus, fluorescent antibodies directed against specific surface markers can be used for identification of specific subpopulations of cells, and in this way help to deselect signals resulting from MHC multimers binding to undesired cells. Gating reagents of special interest that helps identify the subset of T cells of interest when using MHC I multimers are reagents binding to CD3 and CD8 identifying all cytotoxic T cells. These reagents are preferably antibodies but can be any labeled molecule capable of binding CD3 or CD8. Gating reagents directed against CD3 and CD8 are preferably used together. As they stain overlapping cell populations they are preferably labeled with distinct fluorochromes. However, they can also be used individually in separate samples. In experiments with MHC II multimers reagents binding to CD3 and CD4 identifying T helper cells can be used. These reagents are preferably antibodies but can be any labeled molecule capable of binding CD3 or CD4. Gating reagents directed against CD3 and CD4 are preferable used together. As they stain overlapping cell populations they are preferably labeled with distinct fluorochromes. However, they can also be used individually in separate samples.

Other gating reagents of special interest in experiments with any MHC multimer, are reagents binding to the cell surface markers CD2, CD27, CD28, CD45RA, CD45RO, CD62L and CCR7. These surface markers are unique to T cells in various differentiation states. Co staining with either of these reagents or combinations thereof together with MHC multimers helps to select MHC multimer binding T cells expressing a correct TCR. These reagents can also be combined with reagents directed against CD3, CD4 and/or CD8.

Another flow cytometric method of special interest to remove signals from MHC multimer stained cells not expressing the specific TCR, is to introduce an exclusion gate. Antibodies or other reagents specific for surface markers unique to the unwanted cells are labeled with a fluorochrome and added to the test sample together with the MHC multimer. The number of antibodies or surface marker specific reagents are not limited to one but can be two, three, four, five, six, seven, eight, nine, ten or more individual reagents recognizing different surface markers, all of which are unique to the unwanted cells. During or after collection of data all events representing cells labeled with these antibodies are dumped in the same gate and removed from the dataset. This is possible because all the antibodies/reagents that bind to the wrong cells are labeled with the same fluorochrome.

Reagents of special interest that exclude irrelevant cells include reagents against CD45 expressed on red blood cells, CD19 expressed on B cells, CD56 expressed on NK cells, CD4 expressed on T helper cells and CD8 expressed on cytotoxic T cells, CD14 expressed on monocytes and CD15 expressed on granulocytes and monocytes.

Vaccine Treatment

For the purpose of making cancer vaccines or other types of vaccines it can be desirable to employ MHC multimers that comprise a polymer such as dextran, or that are cell-based (e.g. specialized dendritic cells such as described by Banchereau and Palucka, Nature Reviews, Immunology, 2005, vol. 5, p. 296-306).

- Preventive vaccination leading to prophylaxis/sterile immunity by inducing memory in the immune system may be obtained by immunizing/vaccinating an individual or animal with MHC alone, or with MHC in combination with other molecules as mentioned elsewhere in the patent.
  - Vaccine antigens can be administered alone
  - Vaccine can be administered in combination with adjuvant(s).
    - Adjuvant can be mixed with vaccine component or administered alone, simultaneously or in any order.
    - Adjuvant can be administered by the same route as the other vaccine components
  - Vaccine administered more than once may change composition from $1^{st}$ administration to the $2^{nd}$, $3^{rd}$ etc.
  - Vaccine administered more than once can be administered by alternating routes
  - Vaccine components can be administered alone or in combinations by the same route or by alternating/mixed routes
  - Vaccine can be administered by the following routes
    - Cutaneously
    - Subcutaneously (SC)
    - Intramuscular (IM)
    - Intravenous (IV)
    - Per-oral (PO)

- Inter peritoneally
- Pulmonally
- Vaginally
- Rectally

Therapeutic vaccination i.e. vaccination "teaching" the immune system to fight an existing infection or disease, may be obtained by immunizing/vaccinating an individual or animal with MHC alone, or with MHC in combination with other molecules as mentioned elsewhere in the patent.

- Vaccine antigens can be administered alone
- Vaccine can be administered in combination with adjuvant(s).
  - Adjuvant can be mixed with vaccine component or administered alone, simultaneously or in any order.
  - Adjuvant can be administered by the same route as the other vaccine components
- Vaccine administered more than once may change composition from 1$^{st}$ administration to the 2$^{nd}$, 3$^{rd}$, etc.
- Vaccine administered more than once can be administered by alternating routes
- Vaccine components can be administered alone or in combinations by the same route or by alternating/mixed routes
- Vaccine can be administered by the following routes
  - Cutaneously
  - Subcutaneously (SC)
  - Intramuscular (IM)
  - Intravenous (IV)
  - Per-oral (PO)
  - Inter peritoneally
  - Pulmonally
  - Vaginally
  - Rectally Therapeutic Treatment Therapeutic treatment includes the use of MHC molecules alone or in any molecular combination mentioned elsewhere in the patent application for the purpose of treating a disease in any state. Treatment may be in the form of

- Per-orally intake
  - Pills
  - Capsules
- Injections
  - Systemic
  - Local
- Jet-infusion (micro-drops, micro-spheres, micro-beads) through skin
- Drinking solution, suspension or gel
- Inhalation
- Nose-drops
- Eye-drops
- Ear-drops
- Skin application as ointment, gel or creme
- Vaginal application as ointment, gel, crème or washing
- Gastro-Intestinal flushing
- Rectal washings or by use of suppositories Treatment can be performed as

- Single intake, injection, application, washing
- Multiple intake, injection, application, washing
  - On single day basis
  - Over prolonged time as days, month, years Treatment dose and regimen can be modified during the course Personalized Medicine Takes Advantage of the Large Diversity of Peptide Epitopes that May be Generated from a Given Antigen.

The immune system is very complex. Each individual has a very large repertoire of specific T cells (on the order of $10^6$-$10^9$ different T cell specificities), which again is only a small subset of the total T cell repertoire of a population of individuals. It is estimated that the Caucasian population represents a T cell diversity of $10^{10}$-$10^{12}$. MHC allele diversity combined with large variation among individuals' proteolytic metabolism further enhances the variation among different individuals' immune responses. As a result, each individual has its own characteristic immune response profile.

This is important when designing a MHC multimer-based immune monitoring reagent or immunotherapeutic agent. If an agent is sought that should be as generally applicable as possible, one should try to identify peptide epitopes and MHC alleles that are common for the majority of individuals of a population. As described elsewhere in this application, such peptide epitopes can be identified through computerized search algorithms developed for that same purpose, and may be further strengthened by experimental testing of a large set of individuals.

This approach will be advantageous in many cases, but because of the variability among immune responses of different individuals, is likely to be inefficient or inactive in certain individuals, because of these individuals' non-average profile. In these latter cases one may have to turn to personalized medicine. In the case of immune monitoring and immunotherapy, this may involve testing a large number of different epitopes from a given antigen, in order to find peptide epitopes that may provide MHC multimers with efficiency for a given individual.

Thus, personalized medicine takes advantage of the wealth of peptide epitopes that may be generated from a given antigen. A large number of the e.g. 8-, 9-, 10-, and 11-mer epitopes that may be generated from a given antigen to be included in a class 1 MHC multimer reagent, for use in immune monitoring or immunotherapy, are therefore of relevance in personalized medicine. Only in the case where one wants to generate a therapeutic agent or diagnostic reagent that is applicable to the majority of individuals of a population can the large majority of epitope sequences be said to be irrelevant, and only those identified by computerized search algorithms and experimental testing be said to be of value. For the odd individual with the odd immune response these disregarded peptide epitopes may be the epitopes that provide an efficient diagnostic reagent or cures that individual from a deadly disease.

Antigenic Peptides

The present invention relates in one embodiment to antigenic peptides derived from *Mycobacterium tuberculosis* antigens. The one or more antigenic peptides can in one embodiment comprise one or more fragments from one or more *Mycobacterium tuberculosis* antigens capable of interacting with one or more MHC class 1 molecules. The one or more antigenic peptides can in another embodiment comprise one or more fragments from one or more *Mycobacterium tuberculosis* antigens capable of interacting with one or more MHC class 2 molecules.

The antigenic peptides can be generated from any *Mycobacterium tuberculosis* antigen such as the *Mycobacterium tuberculosis* antigens listed in Table 6.

TABLE 6

| Mycobacterium tuberculosis antigens | | |
|---|---|---|
| Antigen designation | Amino acid sequences | SEQ ID NO |
| Rv0116c | MRRVVRYLSVVVAITLMLTAESVSIATAAVPPL<br>QPIPGVASVSPANGAVVGVAHPVVVTFTTPVTD<br>RRAVERSIRISTPHNTTGHFEWVASNVVRWVPH<br>RYWPPHTRVSVGVQELTEGFETGDALIGVASIS<br>AHTFTVSRNGEVLRTMPASLGKPSRPTPIGSFH<br>AMSKERTVVMDSRTIGIPLNSSDGYLLTAHYAV<br>RVTWSGVYVHSAPWSVNSQGYANVSHGCINLSP<br>DNAAWYFDAVTVGDPIEVVG | 1 |
| Rv0122 | MAGSVSAAAGIGWVGLNVTETNRDQCYRVERTT<br>VDALTHPEYRVHTRGVQRVRVTRNARKHRVSKH<br>RIVAAMRHCGVPVIQEDGSLYYQGRDTSGRLTE<br>VVAVEADDGDLIITHAMPKEWKR | 2 |
| Rv0188 | MSTVHSSIDQHPDLLALRASFDRAAESTIAHFT<br>FGLALLAGLYVAASPWIVGFSATRGLPTCDLIV<br>GIAVAYLAYGFASALDRTHGMTWTLPVLGVWVI<br>FSPWVLPGVAVTAGMMWSHIIAGAVVAVLGFYF<br>GMRTRAAANQG | 3 |
| Rv0284 | MSRLIFEARRRLAPPSSHQGTIIIEAPPELPRV<br>IPPSLLRRALPYLIGILIVGMIVALVATGMRVI<br>SPQTLFFPFVLLLAATALYRGNDKKMRTEEVDA<br>ERADYLRYLSVVRDNIRAQAAEQRASALWSHPD<br>PTALASVPGSRRQWERDPHDPDFLVLRAGRHTV<br>PLATTLRVNDTADEIDLEPVSHSALRSLLDTQR<br>SIGDVPTGIDLTKVSPITVLGERAQVRAVLRAW<br>IAQAVTWHDPTVLGVALAARDLEGRDWNWLKWL<br>PHVDIPGRLDALGPARNLSTDPDELIALLGPVL<br>ADRPAFTGQPTDALRHLLIVVDDPDYDLGASPL<br>AVGRAGVTVVHCSASAPHREQYSDPEKPILRVA<br>HGAIERWQTGGWQPYIDAADQFSADEAAHLARR<br>LSRWDSNPTHAGLRSAATRGASFTTLLGIEDAS<br>RLDVPALWAPRRRDEELRVPIGVTGTGEPLMFD<br>LKDEAEGGMGPHGLMIGMTGSGKSQTLMSILLS<br>LLTTHSAERLIVIYADFKGEAGADSFRDFPQVV<br>AVISNMAEKKSLADRFADTLRGEVARREMLLRE<br>AGRKVQGSAFNSVLEYENAIAAGHSLPPIPTLF<br>VVADEFTLMLADHPEYAELFDYVARKGRSFRIH<br>ILFASQTLDVGKIKDIDKNTAYRIGLKVASPSV<br>SRQIIGVEDAYHIESGKEHKGVGFLVPAPGATP<br>IRFRSTYVDGIYEPPQTAKAVVVQSVPEPKLFT<br>AAAVEPDPGTVIADTDEQEPADPPRKLIATIGE<br>QLARYGPRAPQLWLPPLDETIPLSAALARAGVG<br>PRQWRWPLGEIDRPFEMRRDPLVFDARSSAGNM<br>VIHGGPKSGKSTALQTFILSAASLHSPHEVSFY<br>CLDYGGGQLRALQDLAHVGSVASALEPERIRRT<br>FGELEQLLLSRQQREVFRDRGANGSTPDDGFGE<br>VFLVIDNLYGFGRDNTDQFNTRNPLLARVTELV<br>NVGLAYGIHVIITTPSWLEVPLAMRDGLGLRLE<br>LRLHDARDSNVRVVGALRRPADAVPHDQPGRGL<br>TMAAEHFLFAAPELDAQTNPVAAINARYPGMAA<br>PPVRLLPTNLAPHAVGELYRGPDQLVIGQREED<br>LAPVILDLAANPLLMVFGDARSGKTTLLRHIIR<br>TVREHSTADRVAFTVLDRRLHLVDEPLFPDNEY<br>TANIDRIIPAMLGLANLIEARRPPAGMSAAELS<br>RWTFAGHTHYLIIDDVDQVPDSPAMTGPYIGQR<br>PWTPLIGLLAQAGDLGLRVIVTGRATGSAHLLM<br>TSPLLRRFNDLQATTLMLAGNPADSGKIRGERF<br>ARLPAGRAILLTDSDSPTYVQLINPLVDAAAVS<br>GETQQKGSQS | 4 |
| Rv0285 | MTLRVVPEGLAAASAAVEALTARLAAAHASAAP<br>VITAVVPPAADPVSLQTAAGFSAQGVEHAVVTA<br>EGVEELGRAGVGVGESGASYLAGDAAAAATYGV<br>VGG | 5 |
| Rv0287 | MSLLDAHIPQLVASQSAFAAKAGLMRHTIGQAE<br>QAAMSAQAFHQGESSAAFQAAHARFVAAAAKVN<br>TLLDVAQANLGEAAGTYVAADAAAASTYTGF | 6 |
| Rv0288 | MSQIMYNYPAMLGHAGDMAGYAGTLQSLGAEIA<br>VEQAALQSAWQGDTGITYQAWQAQWNQAMEDLV<br>RAYHAMSSTHEANTMAMMARDTAEAAKWGG | 7 |

TABLE 6-continued

| Mycobacterium tuberculosis antigens | | |
|---|---|---|
| Antigen designation | Amino acid sequences | SEQ ID NO |
| Rv0455c | MSRLSSILRAGAAFLVLGIAAATFPQSAAADST<br>EDFPIPRRMIATTCDAEQYLAAVRDTSPVYYQR<br>YMIDFNNHANLQQATINKAHWFFSLSPAERRDY<br>SEHFYNGDPLTFAWVNHMKIFFNNKGVVAKGTE<br>VCNGYPAGDMSVWNWA | 8 |
| Rv0516c | MTTTIPTSKSACSVTTRPGNAAVDYGGAQIRAY<br>LHHLATVVTIRGEIDAANVEQISEHVRRFSLGT<br>NPMVLDLSELSHFSGAGISLLCILDEDCRAAGV<br>QWALVASPAVVEQLGGRCDQGEHESMFPMARSV<br>HKALHDLADAIDRRRQLVLPLISRSA | 9 |
| Rv0569 | MKAKVGDWLVIKGATIDQPDHRGLIIEVRSSDG<br>SPPYVVRWLETDHVATVIPGPDAVVVTAEEQNA<br>ADERAQHRFGAVQSAILHARGT | 10 |
| Rv0789c | MSRRAIHSGRAAPRRSGNSHLVLRNRVPSSKDS<br>PRRRPHHEFMTESIGEPLSTNLIERYLRARGRR<br>YFRGHHDAEFFFVANAHLLHVHLEISPAYRDVF<br>TIRVSPAYFFPATDHTRLAEIVNAWNLQNHEVT<br>AIVHGSSDPHRIGVAAERSLIRDRIRFDDFATF<br>VDNAVSAATELFGQLTAAGLPPTATPPLLRDAG | 11 |
| Rv0918 | MHRAGAAVTANVWCRAGGIRMAPRPVIPVATQQ<br>RLRRQADRQSLGSSGLPALNCTPIRHTIDVMAT<br>KPERKTERLAARLTPEQDALIRRAAEAEGTDLT<br>NFTVTAALAHARDVLADRRLFVLTDAAWTEFLA<br>ALDRPVSHKPRLEKLFAARSIFDTEG | 12 |
| Rv1036c | MFRTVGDQASLWESVLPEELRRLPEELARVDAL<br>LDDSAFFCPFVPFFDPRMGRPSIPMETYLRLMF<br>LKFRYRLGYESLCREVTDSITWRRFCRIPLEGS<br>VPHPTTLMKLTTRCGEDAVAGLNEALLAKAASE<br>KLLRTNKVRADTTVVEGDVGYPTDTGLLAKAVG<br>SMARTVARIKAADAGSAPLGGSSGPRDRLQAAV<br>TRRAATRSGAGLRAPDHRGASRDRRAGADRGCR<br>GGT | 13 |
| Rv1037c | MTINYQFGDVDAHGAMIRAQAGSLEAEHQAIIS<br>DVLTASDFWGGAGSAACQGFITQLGRNFQVIYE<br>QANAHGQKVQAAGNNMAQTDSAVGSSWA | 14 |
| Rv1038c | MASRFMTDPHAMRDMAGRFEVHAQTVEDEARRM<br>WASAQNISGAGWSGMAEATSLDTMTQMNQAFRN<br>IVNMLHGVRDGLVRDANNYEQQEQASQQILSS | 15 |
| Rv1152 | MELRDWLRVDVKAGKPLFDQLRTQVIDGVRAGA<br>LPPGTRLPTVRDLAGQLGVAANTVARAYRELES<br>AAIVETRGRFGTFISRFDPTDAAMAAAAKEYVG<br>VARALGLTKSDAMRYLTHVPDD | 16 |
| Rv1195 | MSFVMAYPEMLAAAADTLQSIGATTVASNAAAA<br>APTTGVVPPAADEVSALTAAHFAAHAAMYQSVS<br>ARAAAIHDQFVATLASSASSYAATEVANAAAAS | 17 |
| Rv1197 | MASRFMTDPHAMRDMAGRFEVHAQTVEDEARRM<br>WASAQNISGAGWSGMAEATSLDTMAQMNQAFRN<br>IVNMLHGVRDGLVRDANNYEQQEQASQQILSS | 18 |
| Rv1198 | MTINYQFGDVDAHGAMIRAQAGSLEAEHQAIIS<br>DVLTASDFWGGAGSAACQGFITQLGRNFQVIYE<br>QANAHGQKVQAAGNNMAQTDSAVGSSWA | 19 |
| Rv1250 | MTTAIRRAAGSSYFRNPWPALWAMMVGFFMIML<br>DSTVVAIANPTIMAQLRIGYATVVWVTSAYLLA<br>YAVPMLVAGRLGDRFGPKNLYLIGLGVFTVASL<br>GCGLSSGAGMLIAARVVQGVGAGLLTPQTLSTI<br>TRIFPAHRRGVALGAWGTVASVASLVGPLAGGA<br>LVDSMGWEWIFFVNVPVGVIGLILAAYLIPALP<br>HHPHRFDWFGVGLSGAGMFLIVFGLQQGQSANW<br>QPWIWAVIVGGIGFMSLFVYWQARNAREPLIPL<br>EVFNDRNFSLSNLRIAIIAFAGTGMMLPVTFYA<br>QAVCGLSPTHTAVLFAPTAIVGGVLAPFVGMII<br>DRSHPLCVLGFGFSVLAIAMTWLLCEMAPGTPI | 20 |

TABLE 6-continued

*Mycobacterium tuberculosis* antigens

| Antigen designation | Amino acid sequences | SEQ ID NO |
|---|---|---|
| | WRLVLPFIALGVAGAFVWSPLTVTATRNLRPHL AGASSGVFNAVRQLGAVLGSASMAAFMTSRIAA EMPGGVDALTGPAGQDATVLQLPEFVREPFAAA MSQSMLLPAFVALFGIVAALFLVDFTGAAVAKE PLPESDGDADDDDYVEYILRREPEEDCDTQPLR ASRPAAAAASRSGAGGPLAVSWSTSAQGMPPGP PGRRAWQADTESTAPSAL | |
| Rv1284 | MTVTDDYLANNVDYASGFKGPLPMPPSKHIAIV ACMDARLDVYRMLGIKEGEAHVIRNAGCVVTDD VIRSLAISQRLLGTREIILLHHTDCGMLTFTDD DFKRAIQDETGIRPTWSPESYPDAVEDVRQSLR RIEVNPFVTKHTSLRGFVFDVATGKLNEVTP | 21 |
| Rv1386 | MTLRVVPESLAGASAAIEAVTARLAAAHAAAAP FIAAVIPPGSDSVSVCNAVEFSVHGSQHVAMAA QGVEELGRSGVGVAESGASYAARDALAAASYLS GGL | 22 |
| Rv1472 | MPHRCAAQVVAGYRSTVSLVLVEHPRPEIAQIT LNRPERMNSMAFDVMVPLKEALAQVSYDNSVRV VVLTGAGRGFSPGADHKSAGVVPHVENLTRPTY ALRSMELLDDVILMLRRLHQPVIAAVNGPAIGG GLCLALAADIRVASSSAYFRAAGINNGLTASEL GLSYLLPRAIGSSRAFEIMLTGRDVSAEEAERI GLVSRQVPDEQLLDACYAIAARMAGFSRPGIEL TKRTLWSGLDAASLEAHMQAEGLGQLFVRLLTA NFEEAVAARAEQRAPVFTDDT | 23 |
| Rv1552 | MTAQHNIVVIGGGGAGLRAAIAIAETNPHLDVA IVSKVYPMRSHTVSAEGGAAAVTGDDDSLDEHA HDTVSGGDWLCDQDAVEAFVAEAPKELVQLEHW GCPWSRKPDGRVAVRPFGGMKKLRTWFAADKTG FHLLHTLFQRLLTYSDVMRYDEWFATTLLVDDG RVCGLVAIELATGRIETILADAVILCTGGCGRV FPFTTNANIKTGDGMALAFRAGAPLKDMEFVQY HPTGLPFTGILITEAARAEGGWLLNKDGYRYLQ DYDLGKPTPEPRLRSMELGPRDRLSQAFVHEHN KGRTVDTPYGPVVYLDLRHLGADLIDAKLPFVR ELCRDYQHIDPVVELVPVRPVVHYMMGGVHTDI NGATTLPGLYAAGETACVSINGANRLGSNSLPE LLVFGARAGRAAADYAARHQKSDRGPSSAVRAQ ARTEALRLERELSRHGQGGERIADIRADMQATL ESAAGIYRDGPTLTKAVEEIRVLQERFATAGID DHSRTFNTELTALLELSGMLDVALAIVESGLRR EESRGAHQRTDFPNRDDEHFLAHTLVHRESDGT LRVGYLPVTITRWPPGERVYGR | 24 |
| Rv1660 | MSVIAGVFGALPPYRYSQRELTDSFVSIPDFEG YEDIVRQLHASAKVNSRHLVLPLEKYPKLTDFG EANKIFIEKAVDLGVQALAGALDESGLRPEDLD VLITATVTGLAVPSLDARIAGRLGLRADVRRVP LFGLGCVAGAAGVARLHDYLRGAPDGVAALVSV ELCSLTYPGYKPTLPGLVGSALFADGAAAVVAA GVKRAQDIGADGPDILDSRSHLYPDSLRTMGYD VGSAGFELVLSRDLAAVVEQYLGNDVTTFLASH GLSTTDVGAWVTHPGGPKIINAITETLDLSPQA LELTWRSLGEIGNLSSASVLHVLRDTIAKPPPS GSPGLMIAMGPGFCSELVLLRWH | 25 |
| Rv1792 | MATRFMTDPHAMRDMAGRFEVHAQTVEDEARRM WASAQNISGAGWSGMAEATSLDTMAQMNQAFRN IVNMLHGVRDGLVRDANNYEQQEQASQQILSS | 26 |
| Rv1793 | MTINYQFGDVDAHGAMIRAQAASLEAEHQAIVR DVLAAGDFWGGAGSVACQEFITQLGRNFQVIYE QANAHGQKVQAAGNNMAQTDSAVGSSWA | 27 |
| Rv1809 | MDFGLQPPEITSGEMYLGPGAGPMLAAAVAWDG LAAELQSMAASYASIVEGMASESWLGPSSAGMA AAAAPYVTWMSGTSAQAKAAADQARAAVVAYET AFAAVVPPPQIAANRSQLISLVATNIFGQNTAA IAATEAEYGEMWAQDTMAMFGYASSSATASRLT PFTAPPQTTNPSGLAGQAAATGQATALASGTNA | 28 |

TABLE 6-continued

*Mycobacterium tuberculosis* antigens

| Antigen designation | Amino acid sequences | SEQ ID NO |
|---|---|---|
| | VTTALSSAAAQFPFDIIPTLLQGLATLSTQYTQ LMGQLINAIFGPTGATTYQNVFVTAANVTKFST WANDAMSAPNLGMTEFKVFWQPPPAPEIPKSSL GAGLGLRSGLSAGLAHAASAGLGQANLVGDLSV PPSWASATPAVRLVANTLPATSLAAAPATQIPA NLLGQMALGSMTGGALGAAAPAIYTGSGARARA NGGTPSAEPVKLEAVIAQLQKQPDAVRHWNVDK ADLDGLLDRLSKQPGIHAVHVSNGDKPKVALPD TQLGSH | |
| Rv1954c | MAAGSGGGTVGLVLPRVASLSGLDGAPTVPEGS DKALMHLGDPPRRCDTHPDGTSSAAAALVLRRI DVHPLLTGLGRGRQTVSLRNGHLVATANRAILS RRRSRLTRGRSFTSHLITSCPRLDDHQHRHPTR CRAEHAGCTVATCIPNAHDPAPGHQTPRWGPFR LKPAYTRI | 29 |
| Rv1955 | MPSGWVSHRLGGSPKCISALSLPSGTVGAPSKP DNDATRGRTRPTVPPPDPAAMGTWKFFRASVDG RPVFKKEFDKLPDQARAALIVLMQRYLVGDLAA GSIKPIRGDILELRWHEANNHFRVLFFRWGQHP VALTAFYKNQQKTPKTKIETALDRQKIWKRAFG DTPPI | 30 |
| Rv2034 | MSTYRSPDRAWQALADGTRRAIVERLAHGPLAV GELARDLPVSRPAVSQHLKVLKTARLVCDRPAG TRRVYQLDPTGLAALRTDLDRFWTRALTGYAQL IDSEGDDT | 31 |
| Rv2050 | MADRVLRGSRLGAVSYETDRNHDLAPRQIARYR TDNGEEFEVPFADDAEIPGTWLCRNGMEGTLIE GDLPEPKKVKPPRTHWDMLLERRSIEELEELLK ERLELIRSRRRG | 32 |
| Rv2169c | MPLSDHEQRMLDQIESALYAEDPKFASSVRGGG FRAPTARRRLQGAALFIIGLGMLVSGVAFKETM IGSFPILSVFGFVVMFGGVVYAITGPRLSGRMD RGGSAAGASRQRRTKGAGGSFTSRMEDRFRRRF DE | 33 |
| Rv2270 | MRLPGRHVLYALSAVTMLAACSSNGARGGIAST NMNPTNPPATAETATVSPTPAPQSARTETWINL QVGDCLADLPPADLSRITVTIVDCATAHSAEVY LRAPVAVDAAVVSMANRDCAAGFAPYTGQSVDT SPYSVAYLIDSHQDRTGADPTPSTVICLLQPAN GQLLTGSARR | 34 |
| Rv2302 | MHAKVGDYLVVKGTTTERHDQHAEIIEVRSADG SPPYVVRWLVNGHETTVYPGSDAVVVTATEHAE AEKRAAARAGHAAT | 35 |
| Rv2346c | MTINYQFGDVDAHGAMIRAQAGLLEAEHQAIVR DVLAAGDFWGGAGSVACQEFITQLGRNFQVIYE QANAHGQKVQAAGNNMAQTDSAVGSSWA | 36 |
| Rv2347c | MATRFMTDPHAMRDMAGRFEVHAQTVEDEARRM WASAQNISGAGWSGMAEATSLDTMAQMNQAFRN IVNMLHGVRDGLVRDANNYEQQEQASQQILSS | 37 |
| Rv2348c | MLLPLGPPLPPDAVVAKRAESGMLGGLSVPLSW GVAVPPDDYDHWAPAPEDGADVDVQAAEGADAE AAAMDEWDEWQAWNEWVAENAEPRFEVPRSSSS VIPHSPAAG | 38 |
| Rv2497c | MGEGSRRPSGMLMSVDLEPVQLVGPDGTPTAER RYHRDLPEETLRWLYEMMVVTRELDTEFVNLQR QGELALYTPCRGQEAAQVGAAACLRKTDWLFPQ YRELGVYLVRGIPPGHVGVAWRGTWHGGLQFTT KCCAPMSVPIGTQTLHAVGAAMAAQRLDEDSVT VAFLGDGATSEGDVHEALNFAAVFTTPCVFYVQ NNQWAISMPVSRQTAAPSIAHKAIGYGMPGIRV DGNDVLACYAVMAEAAARARAGDGPTLIEAVTY RLGPHTTADDPTRYRSQEEVDRWATLDPIPRYR TYLQDQGLWSQRLEEQVTARAKHVRSELRDAVF | 39 |

TABLE 6-continued

Mycobacterium tuberculosis antigens

| Antigen designation | Amino acid sequences | SEQ ID NO |
|---|---|---|
| | DAPDFDVDEVFTTVYAEITPGLQAQREQLRAEL<br>ARTD | |
| Rv2517c | MNSAIIKIAKWAQSQQWTVEDDASGYTRFYNPQ<br>GVYIARFPATPSNEYRRMRDLLGALKKAGLTWP<br>PPSKKERRAQHRKEGAQ | 40 |
| Rv2526 | MTVKRTTIELDEDLVRAAQAVTGETLRATVERA<br>LQQLVAAAAEQAAARRRRIVDHLAHAGTHVDAD<br>VLLSEQAWR | 41 |
| Rv2557 | MTGGATGALPRTMKEGWIVYARSTTIQAQSECI<br>DTGIAHVRDVVMPALQGMDGCIGVSLLVDRQSG<br>RCIATSAWETAEAMHASREQVTPIRDRCAEMFG<br>GTPAVEEWEIAAMHRDHRSAEGACVRATWVKVP<br>ADQVDQGIEYYKSSVLPQIEGLDGFCSASLLVD<br>RTSGRAVSSATFDSFDAMERNRDQSNALKATSL<br>REAGGEELDECEFELALAHLRVPELV | 42 |
| Rv2558 | MPGSAGWRKVFGGTGGATGALPRHGRGSIVYAR<br>STTIEAQPLSVDIGIAHVRDVVMPALQEIDGCV<br>GVSLLVDRQSGRCIATSAWETLEAMRASVERVA<br>PIRDRAALMFAGSARVEEWDIALLHRDHPSHEG<br>ACVRATWLKVVPDQLGRSLEFYRTSVLPELESL<br>DGFCSASLMVDHPACRRAVSCSTFDSMDAMARN<br>RDRASELRSRRVRELGAEVLDVAEFELAIAHLR<br>VPELV | 43 |
| Rv2653c | MTHKRTKRQPAIAAGLNAPRRNRVGRQHGWPAD<br>VPSAEQRRAQRQRDLEAIRRAYAEMVATSHEID<br>DDTAELALLSMHLDDEQRRLEAGMKLGWHPYHF<br>PDEPDSKQ | 44 |
| Rv2654c | MSGHALAARTLLAAADELVGGPPVEASAAALAG<br>DAAGAWRTAAVELARALVRAVAESHGVAAVLFA<br>ATAAAAAAVDRGDPP | 45 |
| Rv2655c | MADIPYGRDYPDPIWCDEDGQPMPPVGAELLDD<br>IRAFLRRFVVYPSDHELIAHTLWIAHCWFMEAW<br>DSTPRIAFLSPEPGSGKSRALEVTEPLVPRPVH<br>AINCTPAYLFRRVADPVGRPTVLYDECDTLFGP<br>KAKEHEEIRGVINAGHRKGAVAGRCVIRGKIVE<br>TEELPAYCAVALAGLDDLPDTIMSRSIVVRMRR<br>RAPTEPVEPWRPRVNGPEAEKLHDRLANWAAAI<br>NPLESGWPAMPDGVTDRRADVWESLVAVADTAG<br>GHWPKTARATAETDATANRGAKPSIGVLLLRDI<br>RRVFSDRDRMRTSDILTGLNRMEEGPWGSIRRG<br>DPLDARGLATRLGRYGIGPKFQHSGGEPPYKGY<br>SRTQFEDAWSRYLSADDETPEERDLSVSAVSAV<br>SPPVGDPGDATGATDATDLPEAGDLPYEPPAPN<br>GHPNGDAPLCSGPGCPNKLLSTEAKAAGKCRPC<br>RGRAAASARDGAR | 46 |
| Rv2656c | MTAVGGSPPTRRCPATEDRAPATVATPSSTDPT<br>ASRAVSWWSVHEYVAPTLAAAVEWPMAGTPAWC<br>DLDDTDPVKWAAICDAARHWALRVETCQAASAE<br>ASRDVSAAADWPAVSREIQRRRDAYIRRVVV | 47 |
| Rv2657c | MCAFPSPSLGWTVSHETERPGMADAPPLSRRYI<br>TISEAAEYLAVTDRTVRQMIADGRLRGYRSGTR<br>LVRLRRDEVDGAMHPFGGAA | 48 |
| Rv2658c | MADAVKYVVMCNCDDEPGALIIAWIDDERPAGG<br>HIQMRSNTRFTETQWGRHIEWKLECRACRKYAP<br>ISEMTAAAILDGFGAKLHELRTSTIPDADDPSI<br>AEARHVIPFSALCLRLSQLGG | 49 |
| Rv2659c | MTQTGKRQRRKFGRIRQFNSGRWQASYTGPDGR<br>VYIAPKTFNAKIDAEAWLTDRRREIDRQLWSPA<br>SGQEDRPGAPFGEYAEGWLKQRGIKDRTRAHYR<br>KLLDNHILATFADTDLRDITPAAVRRWYATTAV<br>GTPTMRAHSYSLLRAIMQTALADDLIDSNPCRI<br>SGASTARRVHKIRPATLDELETITKAMPDPYQA<br>FVLMAAWLAMRYGELTELRRKDIDLHGEVARVR<br>RAVVRVGEGFKVTTPKSDAGVRDISIPPHLIPA<br>IEDHLHKHVNPGRESLLFPSVNDPNRHLAPSAL<br>YRMFYKARKAAGRPDLRVHDLRHSGAVLAASTG<br>ATLAELMQRLGHSTAGAALRYQHAAKGRDREIA<br>ALLSKLAENQEM | 50 |
| Rv2660c | MIAGVDQALAATGQASQRAAGASGGVTVGVGVG<br>TEQRNLSVVAPSQFTFSSRSPDFVDETAGQSWC<br>AILGLNQFH | 51 |
| Rv2661c | MRARSDAGGQSVKSRTSNRSRSSRRSRVRSSIS<br>ALVDNPQARPRELPVLCGWPVVRVEPVCEFVPE<br>PVCGQAEVLGEPAAAHRVTSARRSPSTTVCSRS<br>QKASAVVISSVSSVARVRRASVSSVDATTA | 52 |
| Rv2662 | MDDLTRLRRELLDRFDVRDFTDWPPASLRALIA<br>TYDPWIDMTASPPQPVSPGGPRLRLVRLTTNPS<br>ARAAPIGNGGDSSVCAGEKQCRPP | 53 |
| Rv2663 | MEVRASARKHGINDDAMLHAYRNALRYVELEYH<br>GEVQLLVIGPDQTGRLLELVIPADEPPRIIHAN<br>VLRPKFYDYLR | 54 |
| Rv2745c | MSVGFVTPVGVRWSDIDMYQHVNHATMVTILEE<br>ARVPFLKDAFGADITSTGLLIADVRVTYKGQLR<br>LSDSPLQVTIWTKRLRAVDFTLGYEVRSVNAEP<br>DSRPAVIAESQLAAFHIEEQRLVRLSPHHREYL<br>QRWFRG | 55 |
| Rv3019c | MSQIMYNYPAMMAHAGDMAGYAGTLQSLGADIA<br>SEQAVLSSAWQGDTGITYQGWQTQWNQALEDLV<br>RAYQSMSGTHESNTMAMLARDGAEAAKWGG | 56 |
| Rv3020c | MSLLDAHIPQLIASHTAFAAKAGLMRHTIGQAE<br>QQAMSAQAFHQGESAAAFQGAHARFVAAAAKVN<br>TLLDIAQANLGEAAGTYVAADAAAASSYTGF | 57 |
| Rv3287c | MADSDLPTKGRQRGVRAVELNVAARLENLALLR<br>TLVGAIGTFEDLDFDAVADLRLAVDEVCTRLIR<br>SALPDATLRLVVDPRKDEVVVEASAACDTHDVV<br>APGSFSWHVLTALADDVQTFHDGRQPDVAGSVF<br>GITLTARRAASSR | 58 |
| Rv3288c | MGQIPPQPVRRVLPLMVVPGNGQKWRNRTETEE<br>AMGDTYRDPVDHLRTTRPLAGESLIDVVHWPGY<br>LLIVAGVVGGVGALAAFGTGHHAEGMTFGVVAI<br>VVTVVGLAWLAFEHRRIRKIADRWYTEHPEVRR<br>QRLAG | 59 |
| Rv3289c | MHEVGGPSRGDRLGRDDSEVHSAIRFAVVAAVV<br>GVGFLIMGALLVSTCSGVDTAACGPPQRILLAL<br>GGPLILCAAGLWAFLRTYRVWRAEGTWWGWHGA<br>GWFLLTLMVLTLCIGVPPIAGPVMAP | 60 |
| Rv3290c | MAAVVKSVALAGRPTTPDRVHEVLGRSMLVDGL<br>DIVLDLTRSGGSYLVDAITGRRYLDMFTFVASS<br>ALGMNPPALVDDREFHAELMQAALNKPSNSDVY<br>SVAMARFVETFARVLGDPALPHLFFVEGGALAV<br>ENALKAAFDWKSRHNQAHGIDPALGTQVLHLRG<br>AFHGRSGYTLSLTNTKPTITARFPKFDWPRIDA<br>PYMRPGLDEPAMAALEAEALRQARAAFETRPHD<br>IACFVAEPIQGEGGDRHFRPEFFAAMRELCDEF<br>DALLIFDEVQTGCGLTGTAWAYQQLDVAPDIVA<br>FGKKTQVCGVMAGRRVDEVADNVFAVPSRLNST<br>WGGNLTDMVRARRILEVIEAEGLFERAVQHGKY<br>LRARLDELAADFPAVVLDPRGRGLMCAFSLPTT<br>ADRDELIRQLWQRAVIVLPAGADTVRFRPPLTV<br>STAEIDAAIAAVRSALPVVT | 61 |
| Rv3291c | MNEALDDIDRILVRELAADGRATLSELATRAGL<br>SVSAVQSRVRRLESRGVVQGYSARINPEAVGHL<br>LSAFVAITPLDPSQPDDAPARLEHIEEVESCYS<br>VAGEESYVLLVRVASARALEDLLQRIRTTANVR<br>TRSTIIILNTFYSDRQHIP | 62 |

TABLE 6-continued

Mycobacterium tuberculosis antigens

| Antigen designation | Amino acid sequences | SEQ ID NO |
|---|---|---|
| Rv3444c | MNADPVLSYNFDAIEYSVRQEIHTTAARFNAALQELRSQIAPLQQLWTREAAAAYHAEQLKWHQAASALNEILIDLGNAVRHGADDVAHADRRAAGAWAR | 63 |
| Rv3445c | MVEPGRIGGNQTRLAAVLLDVSTPNTLNADFDLMRSVAGITDARNEEIRAMLQAFIGRMSGVPPSVWGGLAAARFQDVVDRWNAESTRLYHVLHAIADTIRHNEAALREAGQIHARHIAAAGGDL | 64 |
| Rv3477 | MSFTAQPEMLAAAAGELRSLGATLKASNAAAAVPTTGVVPPAADEVSLLLATQFRTHAATYQTASAKAAVIHEQFVTTLATSASSYADTEAANAVVTG | 65 |
| Rv3619c | MTINYQFGDVDAHGAMIRAQAGSLEAEHQAIISDVLTASDFWGGAGSAACQGFITQLGRNFQVIYEQANAHGQKVQAAGNNMAQTDSAVGSSWA | 66 |
| Rv3620c | MTSRFMTDPHAMRDMAGRFEVHAQTVEDEARRMWASAQNISGAGWSGMAEATSLDTMTQMNQAFRNIVNMLHGVRDGLVRDANNYEQQEQASQQILSS | 67 |
| Rv3675 | MFTLLVSWLLVACVPGLLMLATLGLGRLERFLARDTVTATDVAEFLEQAEAVDVHTLARNGMPEALDYLHRRQARRITDSPPLGSGAGPRYAGPLFVTDLDSPVEPPRHGQPNPQFRTARHANHV | 68 |
| Rv3735 | MSLAWDVVSVDKPDDVNVVIGQAHFIKAVEDLHEAMVGVSPSLRFGLAFCEASGPRLVRHTGNDGDLVELATRTALAIAAGHSFVIFLREGFPINILNPVQAVPEVCTIYCATANPVDVVVAVTPHGRGIVGVVDGQTPLGVETDRDIAQRRDLLRAIGYKL | 69 |
| Rv3810 | MPNRRRRKLSTAMSAVAALAVASPCAYFLVYESTETTERPEHHEFKQAAVLTDLPGELMSALSQGLSQFGINIPPVPSLTGSGDASTGLTGPGLTSPGLTSPGLTSPGLTDPALTSPGLTPTLPGSLAAPGTTLAPTPGVGANPALTNPALTSPTGATPGLTSPTGLDPALGGANEIPITTPVGLDPGADGTYPILGDPTLGTIPSSPATTSTGGGGLVNDVMQVANELGASQAIDLLKGVLMPSIMQAVQNGGAAAPAASPPVPPIPAAAAVPPTDPITVPVA | 70 |
| Rv3873 | MLWHAMPPELNTARLMAGAGPAPMLAAAAGWQTLSAALDAQAVELTARLNSLGEAWTGGGSDKALAAATPMVVWLQTASTQAKTRAMQATAQAAAYTQAMATTPSLPEIAANHITQAVLTATNFFGINTIPIALTEMDYFIRMWNQAALAMEVYQAETAVNTLFEKLEPMASILDPGASQSTTNPIFGMPSPGSSTPVGQLPPAATQTLGQLGEMSGPMQQLTQPLQQVTSLFSQVGGTGGGNPADEEAAQMGLLGTSPLSNHPLAGGSGPSAGAGLLRAESLPGAGGSLTRTPLMSQLIEKPVAPSVMPAAAAGSSATGGAAPVGAGAMGQGAQSGGSTRPGLVAPAPLAQEREEDDEDDWDEEDDW | 71 |
| Rv3874 (CFP10) | MAEMKTDAATLAQEAGNFERISGDLKTQIDQVESTAGSLQGQWRGAAGTAAQAAVVRFQEAANKQKQELDEISTNIRQAGVQYSRADEEQQQALSSQMGF | 72 |
| Rv3875 (ESAT-6/ESAT6) | MTEQQWNFAGIEAAASAIQGNVTSIHSLLDEGKQSLTKLAAAWGGSGSEAYQGVQQKWDATATELNNALQNLARTISEAGQAMASTEGNVTGMFA | 73 |
| Rv3878 | MAEPLAVDPTGLSAAAAKLAGLVFPQPPAPIAVSGTDSVVAAINETMPSIESLVSDGLPGVKAALTRTASNMNAAADVYAKTDQSLGTSLSQYAFGSSGEGLAGVASVGGQPSQATQLLSTPVSQVTTQLGETAAELAPRVVATVPQLVQLAPHAVQMSQNASPIAQTISQTAQQAAQSAQGGSGPMPAQLASAEKPATEQAEPVHEVTNDDQGDQGDVQPAEVVAAARDEGAGASPGQQPGGGVPAQAMDTGAGARPAASPLAAPVDPSTPAPSTTTTL | 74 |
| Rv3879c | MSITRPTGSYARQMLDPGGWVEADEDTFYDRAQEYSQVLQRVTDVLDTCRQQKGHVFEGGLWSGGAANAANGALGANINQLMTLQDYLATVITWHRHIAGLIEQAKSDIGNNVDGAQREIDILENDPSLDADERHTAINSLVTATHGANVSLVAETAERVLESKNWKPPKNALEDLLQQKSPPPPDVPTLVVPSPGTPGTPGTPITPGTPITPGTPITPIPGAPVTPITPTPGTPVTPVTPGKPVTPVTPVKPGTPGEPTPITPVTPPVAPATPATPATPVTPAPAPHPQPAPAPAPSPGPQPVTPATPGPSGPATPGTPGGEPAPHVKPAALAEQPGVPGQHAGGGTQSGPAHADESAASVTPAAASGVPGARAAAAAPSGTAVGAGARSSVGTAAASGAGSHAATGRAPVATSDKAAAPSTRAASARTAPPARPPSTDHIDKPDRSESADDGTPVSMIPVSAARAARDAATAAASARQRGRGDALRLARRIAAALNASDNNAGDYGFFWITAVTTDGSIVVANSYGLAYIPDGMELPNKVYLASADHAIPVDEIARCATYPVLAVQAWAAFHDMTLRAVIGTAEQLASSDPGVAKIVLEPDDIPESGKMTGRSRLEVVDPSAAAQLADTTDQRLLDLLPPAPVDVNPPGDERHMLWFELMKPMTSTATGREAAHLRAFRAYAAHSQEIALHQAHTATDAAVQRVAVADWLYWQYVTGLLDRALAAAC | 75 |
| Rv3890c | MSDQITYNPGAVSDFASDVGSRAGQLHMIYEDTASKTNALQEFFAGHGAQGFFDAQAQMLSGLQGLIETVGQHGTTTGHVLDNAIGTDQAIAGLF | 76 |
| Rv3891c | MADTIQVTPQMLRSTANDIQANMEQAMGIAKGYLANQENVMNPATWSGTGVVASHMTATEITNELNKVLTGGTRLAEGLVQAAALMEGHEADSQTAFQALFGASHGS | 77 |
| Rv3904c | MDPTVLADAVARMAEFGRHVEELVAEIESLVTRLHVTWTGEGAAAHAEAQRHWAAGEAMMRQALAQLTAAGQSAHANYTGAMATNLGMWS | 78 |
| Rv3905c | MGADDTLRVEPAVMQGFAASLDGAAEHLAVQLAELDAQVGQMLGGWRGASGSAYGSAWELWHRGAGEVQLGLSMLAAAIAHAGAGYQHNETASAQVLREVGGG | 79 |
| MT3106.1 | MSRQASRQVSIIRSAGDGNRSCGCVTPKEGVWVVTLRVVPEGLAAASAAVEALTARLAAAHAGAAPAITAVVAPAADPVSLQSAVGFSALGSEHAAIAGEGVEELGRSGVAVGESGIGYAAGDAVAAATYLVSGGSL | 80 |
| Rv3804c/Ag85A | MQLVDRVRGAVTGMSRRLVVGAVGAALVSGLVGAVGGTATAGAFSRPGLPVEYLQVPSPSMGRDIKVQFQSGGANSPALYLLDGLRAQDDFSGWDINTPAFEVVYDQSGLSWMPVGGQSSFYSDWYQPACGKAGCQTYKWETFLTSELPGWLQANRHVKPTGSAVVGLSMAASSALTLAIYHPQQFVYAGAMSGLLDPSQAMGPTLIGLAMGDAGGYKASDMWGPKEDPAWQRNDPLLNVGKLIANNTRVWVYCGNGKPSDLGGNNLPAKFLEGFVRTSNIKFQDAYNAGGGHNGVFDFPDSGTHSWEYWGAQLNAMKPDLQRALGATPNTGPAPQGA | 81 |
| Rv1886c/Ag85B | MTDVSRKIRAWGRRLMIGTAAAVVLPGLVGLAGGAATAGAFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAG | 82 |

MHC Class I and MHC Class II molecules have different structures, as described above, and therefore have different restrictions on the size of the peptide which may be accommodated. In general, MHC Class I molecules will accommodate peptides of from about 8 amino acids in length to about 11 amino acids. MHC Class II molecules will in general accommodate peptides of from about 13 amino acids in length to about 16 amino acids. Peptides derived from the sequences shown in Table 6, for use preferably with MHC Class I-based multimers are shown in FIG. 28. Peptides derived from the sequences shown in Table 6 for use preferably with MHC Class II-based multimers are shown in FIG. 29.

The antigenic peptides can in one embodiment be generated by computational prediction using NetMHC (www.cbs.dtu.dk/services/NetMHC/) or by selected of specific 8, 9, 10, 11, 13, 14, 15 or 16 amino acid sequences. FIG. 30 comprises *Mycobacterium tuberculosis* antigen peptides.

The present invention relates to one or more MHC multimers and/or one or more MHC complexes comprising one or more antigenic peptides such as the antigenic peptides listed in FIG. 28, FIG. 29 and/or FIG. 30 (SEQ ID NO 83 to SEQ ID NO 200680) and/or the antigenic peptides characterized by item 1 to 735 herein below.

The one or more antigenic peptides can in one embodiment comprise or consist of a fragment of one or more antigenic peptides listed in FIG. 28, FIG. 29 and/or FIG. 30 (SEQ ID NO 83 to SEQ ID NO 200680) and/or the antigenic peptides characterized by item 1 to 735 herein below, such as a fragment consisting of 1, 2, 3, 4, 5, 6, 7, 8, 9, 10, 11, 12, 13, 14, or 15 amino acids.

In another embodiment the antigenic peptide listed in FIG. 28, FIG. 29 and/or FIG. 30 (SEQ ID NO 83 to SEQ ID NO 200680) and/or the antigenic peptides characterized by item 1 to 735 herein below can be part of a larger peptide/protein, wherein the larger peptide/protein may be of a total length of 17, such as 18, for example 19, such as 20, for example 21, such as 22, for example 23, such as 24, for example 25, such as 26, for example 27, such as 28, for example 29, such as 30, for example 31, such as 32, for example 33, such as 34, for example 35, such as 36, for example 37, such as 38, for example 39, such as 40 amino acids, wherein 8 to 16 of said amino acids are defined in the items below. In another embodiment, the larger protein may be of a total length of between 20 to 30, such as 30-40, for example 40-50, such as 50-60, for example 60-70, such as 70-80, for example 80-90, such as 90-100, for example 100-150, such as 150-200, for example 200-250, such as 250-300, for example 300-500, such as 500-1000, for example 1000-2000, such as 2000-3000, for example 3000-4000, such as 4000-5000, for example 5000-10,000, such as 10,000-20,000, for example 20,000-30,000, such as 30,000-40,000, for example 40,000-50,000, such as 50,000-75,000, for example 75,000-100,000, such as 100,000-250,000, for example 250,000-500,000, such as 500,000-1,000,000 amino acids.

In one embodiment the antigenic peptides listed in FIG. 28, FIG. 29 and/or FIG. 30 (SEQ ID NO 83 to SEQ ID NO 200680) are modified by one or more type(s) of post-translational modifications such as one or more of the post-translational modifications listed in the items (item 1 to 735) herein below. The same or different types of post-translational modification can occur on one or more amino acids in the antigenic peptide such as on 2, 3, 4, 5, 6, 7, 8, 9, 10, 11, 12, 13, 14, 15 or 16 amino acids.

Preferred Peptide Sequences

The peptide according to the present invention may be defined as outlined in the items herein below. It is to be understood that said items are not meant to be limiting to the peptide according to the present invention in that said peptide may consist of more than said 8 to 16 amino acids, but at least comprising said 8 to 16 amino acids.

Thus, in one embodiment of the present invention, the peptide may be a fragment or part of a larger protein, wherein the larger protein may be of a total length of 17, such as 18, for example 19, such as 20, for example 21, such as 22, for example 23, such as 24, for example 25, such as 26, for example 27, such as 28, for example 29, such as 30, for example 31, such as 32, for example 33, such as 34, for example 35, such as 36, for example 37, such as 38, for example 39, such as 40 amino acids, wherein 8 to 16 of said amino acids are defined in the items below. In another embodiment, the larger protein may be of a total length of between 20 to 30, such as 30-40, for example 40-50, such as 50-60, for example 60-70, such as 70-80, for example 80-90, such as 90-100, for example 100-150, such as 150-200, for example 200-250, such as 250-300, for example 300-500, such as 500-1000, for example 1000-2000, such as 2000-3000, for example 3000-4000, such as 4000-5000, for example 5000-10,000, such as 10,000-20,000, for example 20,000-30,000, such as 30,000-40,000, for example 40,000-50,000, such as 50,000-75,000, for example 75,000-100,000, such as 100,000-250,000, for example 250,000-500,000, such as 500,000-1,000,000 amino acids.

It is also to be understood, that the co-translational and post-translational modifications may occur either individually or in combination, on the same or different amino acid residues. Thus, in one embodiment, any one amino acid may be modified once, twice or three times with the same or different types of modifications. Furthermore, said identical and/or different modification may be present on 1, 2, 3, 4, 5, 6, 7, 8, 9, 10, 11, 12, 13, 14, 15, 16, 17 or 18 of the amino acid residues of the peptide according to the present invention as defined in the items below. In addition, modifications may also be present on amino acid residues outside said 8 to 16 amino acids, in case the peptide is part of a larger protein.

Items

1. An antigenic peptide of between 8 to 16 consecutive amino acids, comprising at least 8 of amino acid number $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$
2. The peptide according to item 1, wherein $X_1$ is alanine
3. The peptide according to item 1, wherein $X_1$ is arginine
4. The peptide according to item 1, wherein $X_1$ is asparagine
5. The peptide according to item 1, wherein $X_1$ is aspartic acid
6. The peptide according to item 1, wherein $X_1$ is cysteine
7. The peptide according to item 1, wherein $X_1$ is glutamic acid
8. The peptide according to item 1, wherein $X_1$ is glutamine
9. The peptide according to item 1, wherein $X_1$ is glycine
10. The peptide according to item 1, wherein $X_1$ is histidine
11. The peptide according to item 1, wherein $X_1$ is isoleucine
12. The peptide according to item 1, wherein $X_1$ is leucine
13. The peptide according to item 1, wherein $X_1$ is lysine
14. The peptide according to item 1, wherein $X_1$ is methionine
15. The peptide according to item 1, wherein $X_1$ is phenylalanine
16. The peptide according to item 1, wherein $X_1$ is proline
17. The peptide according to item 1, wherein $X_1$ is serine
18. The peptide according to item 1, wherein $X_1$ is threonine 19. The peptide according to item 1, wherein $X_1$ is tryptophan
20. The peptide according to item 1, wherein $X_1$ is tyrosine
21. The peptide according to item 1, wherein $X_1$ is valine
22. The peptide according to item 1, wherein $X_2$ is alanine
23. The peptide according to item 1, wherein $X_2$ is arginine
24. The peptide according to item 1, wherein $X_2$ is asparagine
25. The peptide according to item 1, wherein $X_2$ is aspartic acid
26. The peptide according to item 1, wherein $X_2$ is cysteine
27. The peptide according to item 1, wherein $X_2$ is glutamic acid
28. The peptide according to item 1, wherein $X_2$ is glutamine
29. The peptide according to item 1, wherein $X_2$ is glycine
30. The peptide according to item 1, wherein $X_2$ is histidine
31. The peptide according to item 1, wherein $X_2$ is isoleucine
32. The peptide according to item 1, wherein $X_2$ is leucine
33. The peptide according to item 1, wherein $X_2$ is lysine
34. The peptide according to item 1, wherein $X_2$ is methionine
35. The peptide according to item 1, wherein $X_2$ is phenylalanine
36. The peptide according to item 1, wherein $X_2$ is proline
37. The peptide according to item 1, wherein $X_2$ is serine
38. The peptide according to item 1, wherein $X_2$ is threonine
39. The peptide according to item 1, wherein $X_2$ is tryptophan
40. The peptide according to item 1, wherein $X_2$ is tyrosine
41. The peptide according to item 1, wherein $X_2$ is valine
42. The peptide according to item 1, wherein $X_3$ is alanine
43. The peptide according to item 1, wherein $X_3$ is arginine
44. The peptide according to item 1, wherein $X_3$ is asparagine
45. The peptide according to item 1, wherein $X_3$ is aspartic acid
46. The peptide according to item 1, wherein $X_3$ is cysteine
47. The peptide according to item 1, wherein $X_3$ is glutamic acid
48. The peptide according to item 1, wherein $X_3$ is glutamine
49. The peptide according to item 1, wherein $X_3$ is glycine
50. The peptide according to item 1, wherein $X_3$ is histidine
51. The peptide according to item 1, wherein $X_3$ is isoleucine
52. The peptide according to item 1, wherein $X_3$ is leucine
53. The peptide according to item 1, wherein $X_3$ is lysine
54. The peptide according to item 1, wherein $X_3$ is methionine
55. The peptide according to item 1, wherein $X_3$ is phenylalanine
56. The peptide according to item 1, wherein $X_3$ is proline
57. The peptide according to item 1, wherein $X_3$ is serine
58. The peptide according to item 1, wherein $X_3$ is threonine
59. The peptide according to item 1, wherein $X_3$ is tryptophan
60. The peptide according to item 1, wherein $X_3$ is tyrosine
61. The peptide according to item 1, wherein $X_3$ is valine
62. The peptide according to item 1, wherein $X_4$ is alanine
63. The peptide according to item 1, wherein $X_4$ is arginine
64. The peptide according to item 1, wherein $X_4$ is asparagine
65. The peptide according to item 1, wherein $X_4$ is aspartic acid
66. The peptide according to item 1, wherein $X_4$ is cysteine
67. The peptide according to item 1, wherein $X_4$ is glutamic acid
68. The peptide according to item 1, wherein $X_4$ is glutamine
69. The peptide according to item 1, wherein $X_4$ is glycine
70. The peptide according to item 1, wherein $X_4$ is histidine
71. The peptide according to item 1, wherein $X_4$ is isoleucine
72. The peptide according to item 1, wherein $X_4$ is leucine
73. The peptide according to item 1, wherein $X_4$ is lysine
74. The peptide according to item 1, wherein $X_4$ is methionine
75. The peptide according to item 1, wherein $X_4$ is phenylalanine
76. The peptide according to item 1, wherein $X_4$ is proline
77. The peptide according to item 1, wherein $X_4$ is serine
78. The peptide according to item 1, wherein $X_4$ is threonine
79. The peptide according to item 1, wherein $X_4$ is tryptophan
80. The peptide according to item 1, wherein $X_4$ is tyrosine
81. The peptide according to item 1, wherein $X_4$ is valine
82. The peptide according to item 1, wherein $X_5$ is alanine
83. The peptide according to item 1, wherein $X_5$ is arginine
84. The peptide according to item 1, wherein $X_5$ is asparagine
85. The peptide according to item 1, wherein $X_5$ is aspartic acid
86. The peptide according to item 1, wherein $X_5$ is cysteine
87. The peptide according to item 1, wherein $X_5$ is glutamic acid
88. The peptide according to item 1, wherein $X_5$ is glutamine
89. The peptide according to item 1, wherein $X_5$ is glycine
90. The peptide according to item 1, wherein $X_5$ is histidine
91. The peptide according to item 1, wherein $X_5$ is isoleucine
92. The peptide according to item 1, wherein $X_5$ is leucine
93. The peptide according to item 1, wherein $X_5$ is lysine
94. The peptide according to item 1, wherein $X_5$ is methionine
95. The peptide according to item 1, wherein $X_5$ is phenylalanine
96. The peptide according to item 1, wherein $X_5$ is proline
97. The peptide according to item 1, wherein $X_5$ is serine
98. The peptide according to item 1, wherein $X_5$ is threonine 99. The peptide according to item 1, wherein $X_5$ is tryptophan
100. The peptide according to item 1, wherein $X_5$ is tyrosine
101. The peptide according to item 1, wherein $X_5$ is valine
102. The peptide according to item 1, wherein $X_6$ is alanine
103. The peptide according to item 1, wherein $X_6$ is arginine
104. The peptide according to item 1, wherein $X_6$ is asparagine
105. The peptide according to item 1, wherein $X_6$ is aspartic acid
106. The peptide according to item 1, wherein $X_6$ is cysteine
107. The peptide according to item 1, wherein $X_6$ is glutamic acid
108. The peptide according to item 1, wherein $X_6$ is glutamine
109. The peptide according to item 1, wherein $X_6$ is glycine
110. The peptide according to item 1, wherein $X_6$ is histidine
111. The peptide according to item 1, wherein $X_6$ is isoleucine
112. The peptide according to item 1, wherein $X_6$ is leucine
113. The peptide according to item 1, wherein $X_6$ is lysine
114. The peptide according to item 1, wherein $X_6$ is methionine
115. The peptide according to item 1, wherein $X_6$ is phenylalanine
116. The peptide according to item 1, wherein $X_6$ is proline
117. The peptide according to item 1, wherein $X_6$ is serine
118. The peptide according to item 1, wherein $X_6$ is threonine
119. The peptide according to item 1, wherein $X_6$ is tryptophan
120. The peptide according to item 1, wherein $X_6$ is tyrosine
121. The peptide according to item 1, wherein $X_6$ is valine
122. The peptide according to item 1, wherein $X_7$ is alanine
123. The peptide according to item 1, wherein $X_7$ is arginine
124. The peptide according to item 1, wherein $X_7$ is asparagine
125. The peptide according to item 1, wherein $X_7$ is aspartic acid
126. The peptide according to item 1, wherein $X_7$ is cysteine
127. The peptide according to item 1, wherein $X_7$ is glutamic acid
128. The peptide according to item 1, wherein $X_7$ is glutamine
129. The peptide according to item 1, wherein $X_7$ is glycine
130. The peptide according to item 1, wherein $X_7$ is histidine
131. The peptide according to item 1, wherein $X_7$ is isoleucine
132. The peptide according to item 1, wherein $X_7$ is leucine
133. The peptide according to item 1, wherein $X_7$ is lysine
134. The peptide according to item 1, wherein $X_7$ is methionine
135. The peptide according to item 1, wherein $X_7$ is phenylalanine
136. The peptide according to item 1, wherein $X_7$ is proline
137. The peptide according to item 1, wherein $X_7$ is serine
138. The peptide according to item 1, wherein $X_7$ is threonine
139. The peptide according to item 1, wherein $X_7$ is tryptophan
140. The peptide according to item 1, wherein $X_7$ is tyrosine
141. The peptide according to item 1, wherein $X_7$ is valine
142. The peptide according to item 1, wherein $X_8$ is alanine
143. The peptide according to item 1, wherein $X_8$ is arginine
144. The peptide according to item 1, wherein $X_8$ is asparagine
145. The peptide according to item 1, wherein $X_8$ is aspartic acid
146. The peptide according to item 1, wherein $X_8$ is cysteine
147. The peptide according to item 1, wherein $X_8$ is glutamic acid
148. The peptide according to item 1, wherein $X_8$ is glutamine
149. The peptide according to item 1, wherein $X_8$ is glycine
150. The peptide according to item 1, wherein $X_8$ is an histidine
151. The peptide according to item 1, wherein $X_8$ is isoleucine
152. The peptide according to item 1, wherein $X_8$ is leucine
153. The peptide according to item 1, wherein $X_8$ is lysine
154. The peptide according to item 1, wherein $X_8$ is methionine
155. The peptide according to item 1, wherein $X_8$ is phenylalanine
156. The peptide according to item 1, wherein $X_8$ is proline
157. The peptide according to item 1, wherein $X_8$ is serine
158. The peptide according to item 1, wherein $X_8$ is threonine
159. The peptide according to item 1, wherein $X_8$ is tryptophan
160. The peptide according to item 1, wherein $X_8$ is tyrosine
161. The peptide according to item 1, wherein $X_8$ is valine
162. The peptide according to item 1, wherein $X_9$ is alanine
163. The peptide according to item 1, wherein $X_9$ is arginine
164. The peptide according to item 1, wherein $X_9$ is asparagine
165. The peptide according to item 1, wherein $X_9$ is aspartic acid
166. The peptide according to item 1, wherein $X_9$ is cysteine
167. The peptide according to item 1, wherein $X_9$ is glutamic acid
168. The peptide according to item 1, wherein $X_9$ is glutamine
169. The peptide according to item 1, wherein $X_9$ is glycine
170. The peptide according to item 1, wherein $X_9$ is an histidine 171. The peptide according to item 1, wherein $X_9$ is isoleucine
172. The peptide according to item 1, wherein $X_9$ is leucine
173. The peptide according to item 1, wherein $X_9$ is lysine
174. The peptide according to item 1, wherein $X_9$ is methionine
175. The peptide according to item 1, wherein $X_9$ is phenylalanine
176. The peptide according to item 1, wherein $X_9$ is proline
177. The peptide according to item 1, wherein $X_9$ is serine
178. The peptide according to item 1, wherein $X_9$ is threonine
179. The peptide according to item 1, wherein $X_9$ is tryptophan
180. The peptide according to item 1, wherein $X_9$ is tyrosine
181. The peptide according to item 1, wherein $X_9$ is valine
182. The peptide according to item 1, wherein $X_9$ is alanine
183. The peptide according to item 1, wherein $X_9$ is arginine
184. The peptide according to item 1, wherein $X_9$ is asparagine
185. The peptide according to item 1, wherein $X_9$ is aspartic acid
186. The peptide according to item 1, wherein $X_9$ is cysteine
187. The peptide according to item 1, wherein $X_9$ is glutamic acid
188. The peptide according to item 1, wherein $X_9$ is glutamine
189. The peptide according to item 1, wherein $X_9$ is glycine
190. The peptide according to item 1, wherein $X_9$ is an histidine
191. The peptide according to item 1, wherein $X_9$ is isoleucine
192. The peptide according to item 1, wherein $X_9$ is leucine
193. The peptide according to item 1, wherein $X_9$ is lysine
194. The peptide according to item 1, wherein $X_9$ is methionine
195. The peptide according to item 1, wherein $X_9$ is phenylalanine
196. The peptide according to item 1, wherein $X_9$ is proline
197. The peptide according to item 1, wherein $X_9$ is serine
198. The peptide according to item 1, wherein $X_9$ is threonine
199. The peptide according to item 1, wherein $X_9$ is tryptophan
200. The peptide according to item 1, wherein $X_9$ is tyrosine
201. The peptide according to item 1, wherein $X_9$ is valine
202. The peptide according to item 1, wherein $X_{10}$ is alanine
203. The peptide according to item 1, wherein $X_{10}$ is arginine
204. The peptide according to item 1, wherein $X_{10}$ is asparagine
205. The peptide according to item 1, wherein $X_{10}$ is aspartic acid
206. The peptide according to item 1, wherein $X_{10}$ is cysteine
207. The peptide according to item 1, wherein $X_{10}$ is glutamic acid
208. The peptide according to item 1, wherein $X_{10}$ is glutamine
209. The peptide according to item 1, wherein $X_{10}$ is glycine
210. The peptide according to item 1, wherein $X_{10}$ is an histidine
211. The peptide according to item 1, wherein $X_{10}$ is isoleucine
212. The peptide according to item 1, wherein $X_{10}$ is leucine
213. The peptide according to item 1, wherein $X_{10}$ is lysine
214. The peptide according to item 1, wherein $X_{10}$ is methionine
215. The peptide according to item 1, wherein $X_{10}$ is phenylalanine
216. The peptide according to item 1, wherein $X_{10}$ is proline
217. The peptide according to item 1, wherein $X_{10}$ is serine
218. The peptide according to item 1, wherein $X_{10}$ is threonine
219. The peptide according to item 1, wherein $X_{10}$ is tryptophan
220. The peptide according to item 1, wherein $X_{10}$ is tyrosine
221. The peptide according to item 1, wherein $X_{10}$ is valine
222. The peptide according to item 1, wherein $X_{11}$ is alanine
223. The peptide according to item 1, wherein $X_{11}$ is arginine
224. The peptide according to item 1, wherein $X_{11}$ is asparagine
225. The peptide according to item 1, wherein $X_{11}$ is aspartic acid
226. The peptide according to item 1, wherein $X_{11}$ is cysteine
227. The peptide according to item 1, wherein $X_{11}$ is glutamic acid
228. The peptide according to item 1, wherein $X_{11}$ is glutamine
229. The peptide according to item 1, wherein $X_{11}$ is glycine
230. The peptide according to item 1, wherein $X_{11}$ is an histidine
231. The peptide according to item 1, wherein $X_{11}$ is isoleucine
232. The peptide according to item 1, wherein $X_{11}$ is leucine
233. The peptide according to item 1, wherein $X_{11}$ is lysine
234. The peptide according to item 1, wherein $X_{11}$ is methionine
235. The peptide according to item 1, wherein $X_{11}$ is phenylalanine
236. The peptide according to item 1, wherein $X_{11}$ is proline
237. The peptide according to item 1, wherein $X_{11}$ is serine
238. The peptide according to item 1, wherein $X_{11}$ is threonine
239. The peptide according to item 1, wherein $X_{11}$ is tryptophan 240. The peptide according to item 1, wherein $X_{11}$ is tyrosine
241. The peptide according to item 1, wherein $X_{11}$ is valine
242. The peptide according to item 1, wherein $X_{12}$ is alanine
243. The peptide according to item 1, wherein $X_{12}$ is arginine
244. The peptide according to item 1, wherein $X_{12}$ is asparagine
245. The peptide according to item 1, wherein $X_{12}$ is aspartic acid
246. The peptide according to item 1, wherein $X_{12}$ is cysteine
247. The peptide according to item 1, wherein $X_{12}$ is glutamic acid
248. The peptide according to item 1, wherein $X_{12}$ is glutamine
249. The peptide according to item 1, wherein $X_{12}$ is glycine
250. The peptide according to item 1, wherein $X_{12}$ is histidine
251. The peptide according to item 1, wherein $X_{12}$ is isoleucine
252. The peptide according to item 1, wherein $X_{12}$ is leucine
253. The peptide according to item 1, wherein $X_{12}$ is lysine
254. The peptide according to item 1, wherein $X_{12}$ is methionine
255. The peptide according to item 1, wherein $X_{12}$ is phenylalanine
256. The peptide according to item 1, wherein $X_{12}$ is proline
257. The peptide according to item 1, wherein $X_{12}$ is serine
258. The peptide according to item 1, wherein $X_{12}$ is threonine
259. The peptide according to item 1, wherein $X_{12}$ is tryptophan
260. The peptide according to item 1, wherein $X_{12}$ is tyrosine
261. The peptide according to item 1, wherein $X_{12}$ is valine
262. The peptide according to item 1, wherein $X_{13}$ is alanine
263. The peptide according to item 1, wherein $X_{13}$ is arginine
264. The peptide according to item 1, wherein $X_{13}$ is asparagine
265. The peptide according to item 1, wherein $X_{13}$ is aspartic acid
266. The peptide according to item 1, wherein $X_{13}$ is cysteine
267. The peptide according to item 1, wherein $X_{13}$ is glutamic acid
268. The peptide according to item 1, wherein $X_{13}$ is glutamine
269. The peptide according to item 1, wherein $X_{13}$ is glycine
270. The peptide according to item 1, wherein $X_{13}$ is histidine
271. The peptide according to item 1, wherein $X_{13}$ is isoleucine
272. The peptide according to item 1, wherein $X_{13}$ is leucine
273. The peptide according to item 1, wherein $X_{13}$ is lysine
274. The peptide according to item 1, wherein $X_{13}$ is methionine
275. The peptide according to item 1, wherein $X_{13}$ is phenylalanine
276. The peptide according to item 1, wherein $X_{13}$ is proline
277. The peptide according to item 1, wherein $X_{13}$ is serine
278. The peptide according to item 1, wherein $X_{13}$ is threonine
279. The peptide according to item 1, wherein $X_{13}$ is tryptophan
280. The peptide according to item 1, wherein $X_{13}$ is tyrosine
281. The peptide according to item 1, wherein $X_{13}$ is valine
282. The peptide according to item 1, wherein $X_{14}$ is alanine
283. The peptide according to item 1, wherein $X_{14}$ is arginine
284. The peptide according to item 1, wherein $X_{14}$ is asparagine
285. The peptide according to item 1, wherein $X_{14}$ is aspartic acid
286. The peptide according to item 1, wherein $X_{14}$ is cysteine
287. The peptide according to item 1, wherein $X_{14}$ is glutamic acid
288. The peptide according to item 1, wherein $X_{14}$ is glutamine
289. The peptide according to item 1, wherein $X_{14}$ is glycine
290. The peptide according to item 1, wherein $X_{14}$ is histidine
291. The peptide according to item 1, wherein $X_{14}$ is isoleucine
292. The peptide according to item 1, wherein $X_{14}$ is leucine
293. The peptide according to item 1, wherein $X_{14}$ is lysine
294. The peptide according to item 1, wherein $X_{14}$ is methionine
295. The peptide according to item 1, wherein $X_{14}$ is phenylalanine
296. The peptide according to item 1, wherein $X_{14}$ is proline
297. The peptide according to item 1, wherein $X_{14}$ is serine
298. The peptide according to item 1, wherein $X_{14}$ is threonine
299. The peptide according to item 1, wherein $X_{14}$ is tryptophan
300. The peptide according to item 1, wherein $X_{14}$ is tyrosine
301. The peptide according to item 1, wherein $X_{14}$ is valine
302. The peptide according to item 1, wherein $X_{15}$ is alanine
303. The peptide according to item 1, wherein $X_{15}$ is arginine
304. The peptide according to item 1, wherein $X_{15}$ is asparagine
305. The peptide according to item 1, wherein $X_{15}$ is aspartic acid 306. The peptide according to item 1, wherein $X_{15}$ is cysteine
307. The peptide according to item 1, wherein $X_{15}$ is glutamic acid
308. The peptide according to item 1, wherein $X_{15}$ is glutamine
309. The peptide according to item 1, wherein $X_{15}$ is glycine
310. The peptide according to item 1, wherein $X_{15}$ is histidine
311. The peptide according to item 1, wherein $X_{15}$ is isoleucine
312. The peptide according to item 1, wherein $X_{15}$ is leucine
313. The peptide according to item 1, wherein $X_{15}$ is lysine
314. The peptide according to item 1, wherein $X_{15}$ is methionine
315. The peptide according to item 1, wherein $X_{15}$ is phenylalanine
316. The peptide according to item 1, wherein $X_{15}$ is proline
317. The peptide according to item 1, wherein $X_{15}$ is serine
318. The peptide according to item 1, wherein $X_{15}$ is threonine
319. The peptide according to item 1, wherein $X_{15}$ is tryptophan
320. The peptide according to item 1, wherein $X_{15}$ is tyrosine
321. The peptide according to item 1, wherein $X_{15}$ is valine
322. The peptide according to item 1, wherein $X_{16}$ is alanine
323. The peptide according to item 1, wherein $X_{16}$ is arginine
324. The peptide according to item 1, wherein $X_{16}$ is asparagine
325. The peptide according to item 1, wherein $X_{16}$ is aspartic acid
326. The peptide according to item 1, wherein $X_{16}$ is cysteine
327. The peptide according to item 1, wherein $X_{16}$ is glutamic acid
328. The peptide according to item 1, wherein $X_{16}$ is glutamine
329. The peptide according to item 1, wherein $X_{16}$ is glycine
330. The peptide according to item 1, wherein $X_{16}$ is histidine
331. The peptide according to item 1, wherein $X_{16}$ is isoleucine
332. The peptide according to item 1, wherein $X_{16}$ is leucine
333. The peptide according to item 1, wherein $X_{16}$ is lysine
334. The peptide according to item 1, wherein $X_{16}$ is methionine
335. The peptide according to item 1, wherein $X_{16}$ is phenylalanine
336. The peptide according to item 1, wherein $X_{16}$ is proline
337. The peptide according to item 1, wherein $X_{16}$ is serine
338. The peptide according to item 1, wherein $X_{16}$ is threonine
339. The peptide according to item 1, wherein $X_{16}$ is tryptophan
340. The peptide according to item 1, wherein $X_{16}$ is tyrosine
341. The peptide according to item 1, wherein $X_{16}$ is valine
342. The peptide according to any of items 2, 22, 42, 62, 82, 102, 122, 142, 162, 182, 202, 222, 242, 262, 282, 302 or 322, wherein the alanine is D-alanine
343. The peptide according to any of items 2, 22, 42, 62, 82, 102, 122, 142, 162, 182, 202, 222, 242, 262, 282, 302 or 322, wherein the alanine is L-alanine
344. The peptide according to any of items 3, 23, 43, 63, 83, 103, 123, 143, 163, 183, 203, 223, 243, 263, 283, 303 or 323, wherein the arginine is D-arginine
345. The peptide according to any of items 3, 23, 43, 63, 83, 103, 123, 143, 163, 183, 203, 223, 243, 263, 283, 303 or 323, wherein the arginine is L-arginine
346. The peptide according to any of items 4, 24, 44, 64, 84, 104, 124, 144, 164, 184, 204, 224, 244, 264, 284, 304 or 324, wherein the asparagine is D-asparagine
347. The peptide according to any of items 4, 24, 44, 64, 84, 104, 124, 144, 164, 184, 204, 224, 244, 264, 284, 304 or 324, wherein the asparagine is L-asparagine
348. The peptide according to any of items 5, 25, 45, 65, 85, 105, 125, 145, 165, 185, 205, 225, 245, 265, 285, 305 or 325, wherein the aspartic acid is D-aspartic acid
349. The peptide according to any of items 5, 25, 45, 65, 85, 105, 125, 145, 165, 185, 205, 225, 245, 265, 285, 305 or 325, wherein the aspartic acid is L-aspartic acid
350. The peptide according to any of items 6, 26, 46, 66, 86, 106, 126, 146, 166, 186, 206, 226, 246, 266, 286, 306 or 326, wherein the cysteine is D-cysteine
351. The peptide according to any of items 6, 26, 46, 66, 86, 106, 126, 146, 166, 186, 206, 226, 246, 266, 286, 306 or 326, wherein the cysteine is L-cysteine
352. The peptide according to any of items 7, 27, 47, 67, 87, 107, 127, 147, 167, 187, 207, 227, 247, 267, 287, 307 or 327, wherein the glutamic acid is D-glutamic acid
353. The peptide according to any of items 7, 27, 47, 67, 87, 107, 127, 147, 167, 187, 207, 227, 247, 267, 287, 307 or 327, wherein the glutamic acid is L-glutamic acid
354. The peptide according to any of items 8, 28, 48, 68, 88, 108, 128, 148, 168, 188, 208, 228, 248, 268, 288, 308 or 328, wherein the glutamine is D-glutamine
355. The peptide according to any of items 8, 28, 48, 68, 88, 108, 128, 148, 168, 188, 208, 228, 248, 268, 288, 308 or 328, wherein the glutamine is L-glutamine
356. The peptide according to any of items 9, 29, 49, 69, 89, 109, 129, 149, 169, 189, 209, 229, 249, 269, 289, 309 or 329, wherein the glycine is D-glycine
357. The peptide according to any of items 9, 29, 49, 69, 89, 109, 129, 149, 169, 189, 209, 229, 249, 269, 289, 309 or 329, wherein the glycine is L-glycine
358. The peptide according to any of items 10, 30, 50, 70, 90, 110, 130, 150, 170, 190, 210, 230, 250, 270, 290, 310 or 330, wherein the histidine is D-histidine
359. The peptide according to any of items 10, 30, 50, 70, 90, 110, 130, 150, 170, 190, 210, 230, 250, 270, 290, 310 or 330, wherein the histidine is L-histidine
360. The peptide according to any of items 11, 31, 51, 71, 91, 111, 131, 151, 171, 191, 211, 231, 251, 271, 291, 311 or 331, wherein the isoleucine is D-isoleucine 361. The peptide according to any of items 11, 31, 51, 71, 91, 111, 131, 151, 171, 191, 211, 231, 251, 271, 291, 311 or 331, wherein the isoleucine is L-isoleucine
362. The peptide according to any of items 12, 32, 52, 72, 92, 112, 132, 152, 172, 192, 212, 232, 252, 272, 292, 312 or 332, wherein the leucine is D-leucine
363. The peptide according to any of items 12, 32, 52, 72, 92, 112, 132, 152, 172, 192, 212, 232, 252, 272, 292, 312 or 332, wherein the leucine is L-leucine
364. The peptide according to any of items 13, 33, 53, 73, 93, 113, 133, 153, 173, 193, 213, 233, 253, 273, 293, 313 or 333, wherein the lysine is D-lysine
365. The peptide according to any of items 13, 33, 53, 73, 93, 113, 133, 153, 173, 193, 213, 233, 253, 273, 293, 313 or 333, wherein the lysine is L-lysine
366. The peptide according to any of items 14, 34, 54, 74, 94, 114, 134, 154, 174, 194, 214, 234, 254, 274, 294, 314 or 334, wherein the methionine is D-methionine
367. The peptide according to any of items 14, 34, 54, 74, 94, 114, 134, 154, 174, 194, 214, 234, 254, 274, 294, 314 or 334, wherein the methionine is L-methionine
368. The peptide according to any of items 15, 35, 55, 75, 95, 115, 135, 155, 175, 195, 215, 235, 255, 275, 295, 315 or 335, wherein the phenylalanine is D-phenylalanine
369. The peptide according to any of items 15, 35, 55, 75, 95, 115, 135, 155, 175, 195, 215, 235, 255, 275, 295, 315 or 335, wherein the phenylalanine is L-phenylalanine
370. The peptide according to any of items 16, 36, 56, 76, 96, 116, 136, 156, 176, 196, 216, 236, 256, 276, 296, 316 or 336, wherein the proline is D-proline
371. The peptide according to any of items 16, 36, 56, 76, 96, 116, 136, 156, 176, 196, 216, 236, 256, 276, 296, 316 or 336, wherein the proline is L-proline
372. The peptide according to any of items 17, 37, 57, 77, 97, 117, 137, 157, 177, 197, 217, 237, 257, 277, 297, 317 or 337, wherein the serine is D-serine
373. The peptide according to any of items 17, 37, 57, 77, 97, 117, 137, 157, 177, 197, 217, 237, 257, 277, 297, 317 or 337, wherein the serine is L-serine
374. The peptide according to any of items 18, 38, 58, 78, 98, 118, 138, 158, 178, 198, 218, 238, 258, 278, 298, 318 or 338, wherein the threonine is D-threonine
375. The peptide according to any of items 18, 38, 58, 78, 98, 118, 138, 158, 178, 198, 218, 238, 258, 278, 298, 318 or 338, wherein the threonine is L-threonine
376. The peptide according to any of items 19, 39, 59, 79, 99, 119, 139, 159, 179, 199, 219, 239, 259, 279, 299, 319 or 339, wherein the tryptophan is D-tryptophan
377. The peptide according to any of items 19, 39, 59, 79, 99, 119, 139, 159, 179, 199, 219, 239, 259, 279, 299, 319 or 339, wherein the tryptophan is L-tryptophan
378. The peptide according to any of items 20, 40, 60, 80, 100, 120, 140, 160, 180, 200, 220, 240, 260, 280, 300, 320 or 340, wherein the tyrosine is D-tyrosine
379. The peptide according to any of items 20, 40, 60, 80, 100, 120, 140, 160, 180, 200, 220, 240, 260, 280, 300, 320 or 340, wherein the tyrosine is L-tyrosine
380. The peptide according to any of items 21, 41, 61, 81, 101, 121, 141, 161, 181, 201, 221, 241, 261, 281, 301, 321 or 341, wherein the valine is D-valine
381. The peptide according to any of items 21, 41, 61, 81, 101, 121, 141, 161, 181, 201, 221, 241, 261, 281, 301, 321 or 341, wherein the valine is L-valine
382. The peptide according to item 1 to 381, wherein one or more of said amino acid residues are modified, such as post-translationally modified or co-translationally modified
383. The peptide according to item 382, wherein said modification is acetylation of one or more amino acid residues
384. The peptide according to item 382, wherein said modification is phosphorylation of one or more amino acid residues
385. The peptide according to item 382, wherein said modification is glycosylation of one or more amino acid residues
386. The peptide according to item 382, wherein said modification is nonenzymatic glycosylation (or glycation) of one or more amino acid residues
387. The peptide according to item 382, wherein said modification is methylation of one or more amino acid residues
388. The peptide according to item 382, wherein said modification is amidation of one or more amino acid residues
389. The peptide according to item 382, wherein said modification is deamidation of one or more amino acid residues
390. The peptide according to item 382, wherein said modification is succinimide formation of one or more amino acid residues
391. The peptide according to item 382, wherein said modification is biotinylation of one or more amino acid residues
392. The peptide according to item 382, wherein said modification is formylation of one or more amino acid residues
393. The peptide according to item 382, wherein said modification is carboxylation of one or more amino acid residues
394. The peptide according to item 382, wherein said modification is carbamylation of one or more amino acid residues
395. The peptide according to item 382, wherein said modification is hydroxylation of one or more amino acid residues
396. The peptide according to item 382, wherein said modification is iodination of one or more amino acid residues
397. The peptide according to item 382, wherein said modification is isoprenylation (or prenylation or lipidation or lipoylation) of one or more amino acid residues
398. The peptide according to item 382, wherein said modification is GPI (glycosyl phosphatidylinositol) anchor formation of one or more amino acid residues
399. The peptide according to item 382, wherein said modification is myristoylation of one or more amino acid residues
400. The peptide according to item 382, wherein said modification is farnesylation of one or more amino acid residues
401. The peptide according to item 382, wherein said modification is geranylgeranylation of one or more amino acid residues
402. The peptide according to item 382, wherein said modification is covalent attachment of nucleotides or derivates thereof to one or more amino acid residues 403. The peptide according to item 382, wherein said modification is ADP-ribosylation of one or more amino acid residues
404. The peptide according to item 382, wherein said modification is flavin attachment to one or more amino acid residues
405. The peptide according to item 382, wherein said modification is oxidation of one or more amino acid residues
406. The peptide according to item 382, wherein said modification is oxidative deamination of one or more amino acid residues
407. The peptide according to item 382, wherein said modification is deamination of one or more amino acid residues
408. The peptide according to item 382, wherein said modification is palmitoylation of one or more amino acid residues
409. The peptide according to item 382, wherein said modification is pegylation of one or more amino acid residues
410. The peptide according to item 382, wherein said modification is attachment of phosphatidyl-inositol of one or more amino acid residues
411. The peptide according to item 382, wherein said modification is phosphopantetheinylation of one or more amino acid residues
412. The peptide according to item 382, wherein said modification is polysialylation of one or more amino acid residues
413. The peptide according to item 382, wherein said modification is sulfation of one or more amino acid residues
414. The peptide according to item 382, wherein said modification is selenoylation of one or more amino acid residues
415. The peptide according to item 382, wherein said modification is arginylation of one or more amino acid residues
416. The peptide according to item 382, wherein said modification is glutamylation or polyglutamylation of one or more amino acid residues
417. The peptide according to item 382, wherein said modification is glycylation or polyglycylation of one or more amino acid residues
418. The peptide according to item 382, wherein said modification is acylation (or alkanoylation) of one or more amino acid residues
419. The peptide according to item 382, wherein said modification is Methylidene-imidazolone (MIO) formation of one or more amino acid residues
420. The peptide according to item 382, wherein said modification is p-Hydroxybenzylidene-imidazolone formation of one or more amino acid residues
421. The peptide according to item 382, wherein said modification is Lysine tyrosyl quinone (LTQ) formation of one or more amino acid residues
422. The peptide according to item 382, wherein said modification is Topaquinone (TPQ) formation of one or more amino acid residues
423. The peptide according to item 382, wherein said modification is Porphyrin ring linkage of one or more amino acid residues
424. The peptide according to item 382, wherein said modification is glypiation (addition of glycosyl phosphatidyl inositol) of one or more amino acid residues
425. The peptide according to item 382, wherein said modification is addition of heme to one or more amino acid residues
426. The peptide according to item 382, wherein said modification is ubiquitination of one or more amino acid residues
427. The peptide according to item 382, wherein said modification is SUMOylation (Small Ubiquitin-like Modifier) of one or more amino acid residues
428. The peptide according to item 382, wherein said modification is ISGylation of one or more amino acid residues
429. The peptide according to item 382, wherein said modification is citrullination (or deimination) of one or more amino acid residues
430. The peptide according to item 382, wherein said modification is the formation of pyroglutamic acid (or pidolic acid) of one or more amino acid residues
431. The peptide according to item 382, wherein said modification is formation of disulfide bridges (or disulfide bond or SS-bond or persulfide connection) between two amino acid residues
432. The peptide according to item 382, wherein said modification is formation of a desmosine cross-link between two or more amino acid residues
433. The peptide according to item 382, wherein said modification is transglutamination between two or more amino acid residues
434. The peptide according to item 1, wherein any of $X_1$, $X_2$, $X_3$, $X_4$, $X_5$, $X_6$, $X_7$, $X_8$, $X_9$, $X_{10}$, $X_{11}$, $X_{12}$, $X_{13}$, $X_{14}$, $X_{15}$ and/or $X_{16}$ is an uncommon or modified amino acid
435. The peptide according to item 434, wherein said uncommon amino acid is acetylalanine
436. The peptide according to item 434, wherein said uncommon amino acid is acetylaspartic acid
437. The peptide according to item 434, wherein said uncommon amino acid is acetylcysteine
438. The peptide according to item 434, wherein said uncommon amino acid is acetylglutamic acid
439. The peptide according to item 434, wherein said uncommon amino acid is acetylglutamine
440. The peptide according to item 434, wherein said uncommon amino acid is acetylglycine
441. The peptide according to item 434, wherein said uncommon amino acid is acetylisoleucine
442. The peptide according to item 434, wherein said uncommon amino acid is acetyllysine
443. The peptide according to item 434, wherein said uncommon amino acid is acetylmethionine
444. The peptide according to item 434, wherein said uncommon amino acid is acetylproline
445. The peptide according to item 434, wherein said uncommon amino acid is acetylserine
446. The peptide according to item 434, wherein said uncommon amino acid is acetylthreonine
447. The peptide according to item 434, wherein said uncommon amino acid is acetyltyrosine
448. The peptide according to item 434, wherein said uncommon amino acid is acetylvaline
449. The peptide according to item 434, wherein said uncommon amino acid is acetyllysine
450. The peptide according to item 434, wherein said uncommon amino acid is acetylcysteine
451. The peptide according to item 434, wherein said uncommon amino acid is alanine amide
452. The peptide according to item 434, wherein said uncommon amino acid is arginine amide 453. The peptide according to item 434, wherein said uncommon amino acid is asparagine amide
454. The peptide according to item 434, wherein said uncommon amino acid is aspartic acid amide
455. The peptide according to item 434, wherein said uncommon amino acid is cysteine amide
456. The peptide according to item 434, wherein said uncommon amino acid is glutamine amide
457. The peptide according to item 434, wherein said uncommon amino acid is glutamic acid amide
458. The peptide according to item 434, wherein said uncommon amino acid is glycine amide
459. The peptide according to item 434, wherein said uncommon amino acid is histidine amide
460. The peptide according to item 434, wherein said uncommon amino acid is isoleucine amide
461. The peptide according to item 434, wherein said uncommon amino acid is leucine amide
462. The peptide according to item 434, wherein said uncommon amino acid is lysine amide
463. The peptide according to item 434, wherein said uncommon amino acid is methionine amide
464. The peptide according to item 434, wherein said uncommon amino acid is phenylalanine amide
465. The peptide according to item 434, wherein said uncommon amino acid is proline amide
466. The peptide according to item 434, wherein said uncommon amino acid is serine amide
467. The peptide according to item 434, wherein said uncommon amino acid is threonine amide
468. The peptide according to item 434, wherein said uncommon amino acid is tryptophan amide
469. The peptide according to item 434, wherein said uncommon amino acid is tyrosine amide
470. The peptide according to item 434, wherein said uncommon amino acid is valine amide
471. The peptide according to item 434, wherein said uncommon amino acid is an amino acid alcohol
472. The peptide according to item 434, wherein said uncommon amino acid is Aminobenzoic Acid
473. The peptide according to item 434, wherein said uncommon amino acid is Aminobutyric Acid
474. The peptide according to item 434, wherein said uncommon amino acid is Aminocyanobutyric acid
475. The peptide according to item 434, wherein said uncommon amino acid is Aminocyanopropionic acid
476. The peptide according to item 434, wherein said uncommon amino acid is Aminocyclohexanoic acid
477. The peptide according to item 434, wherein said uncommon amino acid is Aminocyclopropanoic acid
478. The peptide according to item 434, wherein said uncommon amino acid is Aminocylopentanoic acid
479. The peptide according to item 434, wherein said uncommon amino acid is Aminodecanoic acid
480. The peptide according to item 434, wherein said uncommon amino acid is Aminododecanoic acid
481. The peptide according to item 434, wherein said uncommon amino acid is Aminohexanoic acid
482. The peptide according to item 434, wherein said uncommon amino acid is Aminoisobutyric acid
483. The peptide according to item 434, wherein said uncommon amino acid is Aminomethylbenzoic acid
484. The peptide according to item 434, wherein said uncommon amino acid is Aminomethylcyclohexanoic acid
485. The peptide according to item 434, wherein said uncommon amino acid is Aminononanoic acid
486. The peptide according to item 434, wherein said uncommon amino acid is Aminooctanoic acid
487. The peptide according to item 434, wherein said uncommon amino acid is Aminophenylalanine
488. The peptide according to item 434, wherein said uncommon amino acid is Amino Salicylic acid
489. The peptide according to item 434, wherein said uncommon amino acid is 2-Amino-2-Thiazoline-4-carboxylic acid
490. The peptide according to item 434, wherein said uncommon amino acid is Aminoundecanoic acid
491. The peptide according to item 434, wherein said uncommon amino acid is Aminovaleric acid
492. The peptide according to item 434, wherein said uncommon amino acid is 4-Benzoylphenylalanine
493. The peptide according to item 434, wherein said uncommon amino acid is Biphenylalanine
494. The peptide according to item 434, wherein said uncommon amino acid is Bromophenylalanine
495. The peptide according to item 434, wherein said uncommon amino acid is gamma-Carboxyglutamic acid
496. The peptide according to item 434, wherein said uncommon amino acid is canavanine
497. The peptide according to item 434, wherein said uncommon amino acid is Carnitine
498. The peptide according to item 434, wherein said uncommon amino acid is Chlorophenylalanine
499. The peptide according to item 434, wherein said uncommon amino acid is Chlorotyrosine
500. The peptide according to item 434, wherein said uncommon amino acid is Cine
501. The peptide according to item 434, wherein said uncommon amino acid is Citrulline
502. The peptide according to item 434, wherein said uncommon amino acid is 4-Cyano-2-Aminobutyric acid
503. The peptide according to item 434, wherein said uncommon amino acid is Cyclohexylalanine
504. The peptide according to item 434, wherein said uncommon amino acid is Cyclohexylglycine
505. The peptide according to item 434, wherein said uncommon amino acid is Diaminobenzoic acid
506. The peptide according to item 434, wherein said uncommon amino acid is 2,4-Diaminobutyric acid
507. The peptide according to item 434, wherein said uncommon amino acid is 2,3-Diaminopropionic acid
508. The peptide according to item 434, wherein said uncommon amino acid is Dibutylglycine
509. The peptide according to item 434, wherein said uncommon amino acid is Diethylglycine
510. The peptide according to item 434, wherein said uncommon amino acid is Dihydrotryptophan
511. The peptide according to item 434, wherein said uncommon amino acid is Dipropylglycine
512. The peptide according to item 434, wherein said uncommon amino acid is Fluorophenylalanine
513. The peptide according to item 434, wherein said uncommon amino acid is formylmethionine
514. The peptide according to item 434, wherein said uncommon amino acid is formylglycine
515. The peptide according to item 434, wherein said uncommon amino acid is formyllysine
516. The peptide according to item 434, wherein said uncommon amino acid is farnesylcysteine
517. The peptide according to item 434, wherein said uncommon amino acid is hydroxyfarnesylcysteine 518. The peptide according to item 434, wherein said uncommon amino acid is Homoalanine
519. The peptide according to item 434, wherein said uncommon amino acid is Homoarginine
520. The peptide according to item 434, wherein said uncommon amino acid is Homoasparagine
521. The peptide according to item 434, wherein said uncommon amino acid is Homoaspartic acid
522. The peptide according to item 434, wherein said uncommon amino acid is Homoglutamic acid
523. The peptide according to item 434, wherein said uncommon amino acid is Homoglutamine
524. The peptide according to item 434, wherein said uncommon amino acid is Homoisoleucine
525. The peptide according to item 434, wherein said uncommon amino acid is Homophenylalanine
526. The peptide according to item 434, wherein said uncommon amino acid is Homoserine
527. The peptide according to item 434, wherein said uncommon amino acid is Homotyrosine
528. The peptide according to item 434, wherein said uncommon amino acid is Hydroxyproline
529. The peptide according to item 434, wherein said uncommon amino acid is Hydroxylysine
530. The peptide according to item 434, wherein said uncommon amino acid is 2-Indanylglycine
531. The peptide according to item 434, wherein said uncommon amino acid is 2-Indolecarboxylic acid
532. The peptide according to item 434, wherein said uncommon amino acid is Indoleglycine
533. The peptide according to item 434, wherein said uncommon amino acid is Iodophenylalanine
534. The peptide according to item 434, wherein said uncommon amino acid is Isonipecotic Acid
535. The peptide according to item 434, wherein said uncommon amino acid is Kynurenine
536. The peptide according to item 434, wherein said uncommon amino acid is β-(S-Benzyl)Mercapto-β,β-cyclopentamethylene propionic acid
537. The peptide according to item 434, wherein said uncommon amino acid is Methyltyrosine
538. The peptide according to item 434, wherein said uncommon amino acid is Methylphenylalanine
539. The peptide according to item 434, wherein said uncommon amino acid is methylalanine
540. The peptide according to item 434, wherein said uncommon amino acid is trimethylalanine
541. The peptide according to item 434, wherein said uncommon amino acid is methylglycine
542. The peptide according to item 434, wherein said uncommon amino acid is methylmethionine
543. The peptide according to item 434, wherein said uncommon amino acid is methylphenylalanine
544. The peptide according to item 434, wherein said uncommon amino acid is dimethylproline
545. The peptide according to item 434, wherein said uncommon amino acid is dimethylarginine
546. The peptide according to item 434, wherein said uncommon amino acid is methylarginine
547. The peptide according to item 434, wherein said uncommon amino acid is methylasparagine
548. The peptide according to item 434, wherein said uncommon amino acid is methylglutamine
549. The peptide according to item 434, wherein said uncommon amino acid is methylhistidine
550. The peptide according to item 434, wherein said uncommon amino acid is trimethyllysine
551. The peptide according to item 434, wherein said uncommon amino acid is dimethyllysine
552. The peptide according to item 434, wherein said uncommon amino acid is methyllysine
553. The peptide according to item 434, wherein said uncommon amino acid is methylcysteine
554. The peptide according to item 434, wherein said uncommon amino acid is glutamic acid 5-methyl ester
555. The peptide according to item 434, wherein said uncommon amino acid is Naphthylalanine
556. The peptide according to item 434, wherein said uncommon amino acid is Nipecotic acid
557. The peptide according to item 434, wherein said uncommon amino acid is Nitrophenylalanine
558. The peptide according to item 434, wherein said uncommon amino acid is Norleucine
559. The peptide according to item 434, wherein said uncommon amino acid is Norvaline
560. The peptide according to item 434, wherein said uncommon amino acid is Octahydroindolecarboxylic acid
561. The peptide according to item 434, wherein said uncommon amino acid is ornithine
562. The peptide according to item 434, wherein said uncommon amino acid is Penicillamine
563. The peptide according to item 434, wherein said uncommon amino acid is Phenylglycine
564. The peptide according to item 434, wherein said uncommon amino acid is phosphocysteine
565. The peptide according to item 434, wherein said uncommon amino acid is phosphohistidine
566. The peptide according to item 434, wherein said uncommon amino acid is phosphoserine
567. The peptide according to item 434, wherein said uncommon amino acid is phosphothreonine
568. The peptide according to item 434, wherein said uncommon amino acid is phosphotyrosine
569. The peptide according to item 434, wherein said uncommon amino acid is phosphoarginine
570. The peptide according to item 434, wherein said uncommon amino acid is (phospho-5'-adenosine)-tyrosine
571. The peptide according to item 434, wherein said uncommon amino acid is phosphopantetheine-serine
572. The peptide according to item 434, wherein said uncommon amino acid is (phospho-5'-RNA)-serine
573. The peptide according to item 434, wherein said uncommon amino acid is (phospho-5'-adenosine)-lysine
574. The peptide according to item 434, wherein said uncommon amino acid is (phospho-5'-guanosine)-lysine
575. The peptide according to item 434, wherein said uncommon amino acid is (phospho-5'-DNA)-serine
576. The peptide according to item 434, wherein said uncommon amino acid is (phospho-5'-RNA)-tyrosine
577. The peptide according to item 434, wherein said uncommon amino acid is (phospho-5'-adenosine)-threonine
578. The peptide according to item 434, wherein said uncommon amino acid is (phospho-5'-DNA)-tyrosine
579. The peptide according to item 434, wherein said uncommon amino acid is (phospho-5'-DNA)-threonine
580. The peptide according to item 434, wherein said uncommon amino acid is (phospho-5'-uridine)-tyrosine 581. The peptide according to item 434, wherein said uncommon amino acid is 4-Phosphonomethylphenylalanine
582. The peptide according to item 434, wherein said uncommon amino acid is palmitoylcysteine
583. The peptide according to item 434, wherein said uncommon amino acid is palmitoyllysine
584. The peptide according to item 434, wherein said uncommon amino acid is palmitoylthreonine
585. The peptide according to item 434, wherein said uncommon amino acid is palmitoylserine
586. The peptide according to item 434, wherein said uncommon amino acid is palmitoylcysteine
587. The peptide according to item 434, wherein said uncommon amino acid is phycoerythrobilin-bis-cysteine
588. The peptide according to item 434, wherein said uncommon amino acid is phycourobilin-bis-cysteine
589. The peptide according to item 434, wherein said uncommon amino acid is pyrrolidone-5-carboxylic acid
590. The peptide according to item 434, wherein said uncommon amino acid is Pipericolic Acid
591. The peptide according to item 434, wherein said uncommon amino acid is Propargylglycine
592. The peptide according to item 434, wherein said uncommon amino acid is Pyridinylalanine
593. The peptide according to item 434, wherein said uncommon amino acid is pyroglutamic acid
594. The peptide according to item 434, wherein said uncommon amino acid is Sarcosine
595. The peptide according to item 434, wherein said uncommon amino acid is Tert-Leucine
596. The peptide according to item 434, wherein said uncommon amino acid is Tetrahydoisoquinoline-3-carboxylic acid
597. The peptide according to item 434, wherein said uncommon amino acid is Thiazolidinecarboxylic acid
598. The peptide according to item 434, wherein said uncommon amino acid is Thyronine
599. The peptide according to item 434, wherein said uncommon amino acid is selenocysteine
600. The peptide according to item 434, wherein said uncommon amino acid is selenomethionine
601. The peptide according to item 434, wherein said uncommon amino acid is erythro-beta-hydroxyasparagine
602. The peptide according to item 434, wherein said uncommon amino acid is erythro-beta-hydroxyaspartic acid
603. The peptide according to item 434, wherein said uncommon amino acid is gamma-carboxyglutamic acid
604. The peptide according to item 434, wherein said uncommon amino acid is aspartic 4-phosphoric anhydride
605. The peptide according to item 434, wherein said uncommon amino acid is2'-[3-carboxamido-3-(trimethylammonio)propyl]-histidine
606. The peptide according to item 434, wherein said uncommon amino acid is glucuronoylglycine
607. The peptide according to item 434, wherein said uncommon amino acid is geranylgeranylcysteine
608. The peptide according to item 434, wherein said uncommon amino acid is myristoylglycine
609. The peptide according to item 434, wherein said uncommon amino acid is myristoyllysine
610. The peptide according to item 434, wherein said uncommon amino acid is cysteine methyl disulfide
611. The peptide according to item 434, wherein said uncommon amino acid is diacylglycerolcysteine
612. The peptide according to item 434, wherein said uncommon amino acid is isoglutamylcysteine
613. The peptide according to item 434, wherein said uncommon amino acid is cysteinylhistidine
614. The peptide according to item 434, wherein said uncommon amino acid is lanthionine
615. The peptide according to item 434, wherein said uncommon amino acid is mesolanthionine
616. The peptide according to item 434, wherein said uncommon amino acid is methyllanthionine
617. The peptide according to item 434, wherein said uncommon amino acid is cysteinyltyrosine
618. The peptide according to item 434, wherein said uncommon amino acid is carboxylysine
619. The peptide according to item 434, wherein said uncommon amino acid is carboxyethyllysine
620. The peptide according to item 434, wherein said uncommon amino acid is (4-amino-2-hydroxybutyl)-lysine
621. The peptide according to item 434, wherein said uncommon amino acid is biotinyllysine
622. The peptide according to item 434, wherein said uncommon amino acid is lipoyllysine
623. The peptide according to item 434, wherein said uncommon amino acid is pyridoxal phosphate-lysine
624. The peptide according to item 434, wherein said uncommon amino acid is retinal-lysine
625. The peptide according to item 434, wherein said uncommon amino acid is allysine
626. The peptide according to item 434, wherein said uncommon amino acid is lysinoalanine
627. The peptide according to item 434, wherein said uncommon amino acid is isoglutamyllysine
628. The peptide according to item 434, wherein said uncommon amino acid is glycyllysine
629. The peptide according to item 434, wherein said uncommon amino acid is isoaspartylglycine
630. The peptide according to item 434, wherein said uncommon amino acid is pyruvic acid
631. The peptide according to item 434, wherein said uncommon amino acid is phenyllactic acid
632. The peptide according to item 434, wherein said uncommon amino acid is oxobutanoic acid
633. The peptide according to item 434, wherein said uncommon amino acid is succinyltryptophan
634. The peptide according to item 434, wherein said uncommon amino acid is phycocyanobilincysteine
635. The peptide according to item 434, wherein said uncommon amino acid is phycoerythrobilincysteine
636. The peptide according to item 434, wherein said uncommon amino acid is phytochromobilincysteine
637. The peptide according to item 434, wherein said uncommon amino acid is heme-bis-cysteine
638. The peptide according to item 434, wherein said uncommon amino acid is heme-cysteine
639. The peptide according to item 434, wherein said uncommon amino acid is tetrakis-cysteinyl iron
640. The peptide according to item 434, wherein said uncommon amino acid is tetrakis-cysteinyl diiron disulfide
641. The peptide according to item 434, wherein said uncommon amino acid is tris-cysteinyl triiron trisulfide 642. The peptide according to item 434, wherein said uncommon amino acid is tris-cysteinyl triiron tetrasulfide
643. The peptide according to item 434, wherein said uncommon amino acid is tetrakis-cysteinyl tetrairon tetrasulfide
644. The peptide according to item 434, wherein said uncommon amino acid is cysteinyl homocitryl molybdenum-heptairon-nonasulfide
645. The peptide according to item 434, wherein said uncommon amino acid is cysteinyl molybdopterin
646. The peptide according to item 434, wherein said uncommon amino acid is (8alpha-FAD)-cysteine
647. The peptide according to item 434, wherein said uncommon amino acid is (8alpha-FAD)-histidine
648. The peptide according to item 434, wherein said uncommon amino acid is (8alpha-FAD)-tyrosine
649. The peptide according to item 434, wherein said uncommon amino acid is dihydroxyphenylalanine
650. The peptide according to item 434, wherein said uncommon amino acid is topaquinone
651. The peptide according to item 434, wherein said uncommon amino acid is tryptophyl quinine
652. The peptide according to item 434, wherein said uncommon amino acid is (tryptophan)-tryptophyl quinone
653. The peptide according to item 434, wherein said uncommon amino acid is glycosylasparagine
654. The peptide according to item 434, wherein said uncommon amino acid is glycosylcysteine
655. The peptide according to item 434, wherein said uncommon amino acid is glycosylhydroxylysine
656. The peptide according to item 434, wherein said uncommon amino acid is glycosylserine
657. The peptide according to item 434, wherein said uncommon amino acid is glycosylthreonine
658. The peptide according to item 434, wherein said uncommon amino acid is glycosyltryptophan
659. The peptide according to item 434, wherein said uncommon amino acid is glycosyltyrosine
660. The peptide according to item 434, wherein said uncommon amino acid is asparaginyl-glycosylphosphatidylinositolethanolamine
661. The peptide according to item 434, wherein said uncommon amino acid is aspartyl-glycosylphosphatidylinositolethanolamine
662. The peptide according to item 434, wherein said uncommon amino acid is cysteinyl-glycosylphosphatidylinositolethanolamine
663. The peptide according to item 434, wherein said uncommon amino acid is glycyl-glycosylphosphatidylinositolethanolamine
664. The peptide according to item 434, wherein said uncommon amino acid is seryl-glycosylphosphatidylinositolethanolamine
665. The peptide according to item 434, wherein said uncommon amino acid is seryl-glycosylsphingolipidinositolethanolamine
666. The peptide according to item 434, wherein said uncommon amino acid is (phosphoribosyl dephospho-coenzyme A)-serine
667. The peptide according to item 434, wherein said uncommon amino acid is (ADP-ribosyl)-arginine
668. The peptide according to item 434, wherein said uncommon amino acid is (ADP-ribosyl)-cysteine
669. The peptide according to item 434, wherein said uncommon amino acid is glutamyl-glycerylphosphorylethanolamine
670. The peptide according to item 434, wherein said uncommon amino acid is sulfocysteine
671. The peptide according to item 434, wherein said uncommon amino acid is sulfotyrosine
672. The peptide according to item 434, wherein said uncommon amino acid is bromohistidine
673. The peptide according to item 434, wherein said uncommon amino acid is bromophenylalanine
674. The peptide according to item 434, wherein said uncommon amino acid is triiodothyronine
675. The peptide according to item 434, wherein said uncommon amino acid is thyroxine
676. The peptide according to item 434, wherein said uncommon amino acid is bromotryptophan
677. The peptide according to item 434, wherein said uncommon amino acid is dehydroalanine
678. The peptide according to item 434, wherein said uncommon amino acid is dehydrobutyrine
679. The peptide according to item 434, wherein said uncommon amino acid is dehydrotyrosine
680. The peptide according to item 434, wherein said uncommon amino acid is seryl-imidazolinone glycine
681. The peptide according to item 434, wherein said uncommon amino acid is oxoalanine
682. The peptide according to item 434, wherein said uncommon amino acid is alanyl-imidazolinone glycine
683. The peptide according to item 434, wherein said uncommon amino acid is allo-isoleucine
684. The peptide according to item 434, wherein said uncommon amino acid is isoglutamyl-polyglycine
685. The peptide according to item 434, wherein said uncommon amino acid is isoglutamyl-polyglutamic acid
686. The peptide according to item 434, wherein said uncommon amino acid is aminovinyl-cysteine
687. The peptide according to item 434, wherein said uncommon amino acid is (aminovinyl)-methylcysteine
688. The peptide according to item 434, wherein said uncommon amino acid is cysteine sulfenic acid
689. The peptide according to item 434, wherein said uncommon amino acid is glycyl-cysteine
690. The peptide according to item 434, wherein said uncommon amino acid is hydroxycinnamyl-cysteine
691. The peptide according to item 434, wherein said uncommon amino acid is chondroitin sulfate glucuronyl-galactosyl-galactosyl-xylosyl-serine
692. The peptide according to item 434, wherein said uncommon amino acid is dermatan sulfate glucuronyl-galactosyl-galactosyl-xylosyl-serine
693. The peptide according to item 434, wherein said uncommon amino acid is heparan sulfate glucuronyl-galactosyl-galactosyl-xylosyl-serine
694. The peptide according to item 434, wherein said uncommon amino acid is glycosyl-hydroxyproline
695. The peptide according to item 434, wherein said uncommon amino acid is hydroxy-arginine
696. The peptide according to item 434, wherein said uncommon amino acid is isoaspartyl-cysteine
697. The peptide according to item 434, wherein said uncommon amino acid is alpha-mannosyl-tryptophan
698. The peptide according to item 434, wherein said uncommon amino acid is mureinyl-lysine 699. The peptide according to item 434, wherein said uncommon amino acid is chondroitin sulfate-aspartic acid ester
700. The peptide according to item 434, wherein said uncommon amino acid is (6-FMN)-cysteine
701. The peptide according to item 434, wherein said uncommon amino acid is diphytanylglycerol diether-cysteine
702. The peptide according to item 434, wherein said uncommon amino acid is bis-cysteinyl bis-histidino diiron disulfide
703. The peptide according to item 434, wherein said uncommon amino acid is hexakis-cysteinyl hexairon hexasulfide
704. The peptide according to item 434, wherein said uncommon amino acid is cysteine glutathione disulfide
705. The peptide according to item 434, wherein said uncommon amino acid is nitrosyl-cysteine
706. The peptide according to item 434, wherein said uncommon amino acid is (ADP-ribosyl)-asparagine
707. The peptide according to item 434, wherein said uncommon amino acid is beta-methylthioaspartic acid
708. The peptide according to item 434, wherein said uncommon amino acid is (lysine)-topaquinone
709. The peptide according to item 434, wherein said uncommon amino acid is hydroxymethyl-asparagine
710. The peptide according to item 434, wherein said uncommon amino acid is (ADP-ribosyl)-serine
711. The peptide according to item 434, wherein said uncommon amino acid is cysteine oxazolecarboxylic acid
712. The peptide according to item 434, wherein said uncommon amino acid is cysteine oxazolinecarboxylic acid
713. The peptide according to item 434, wherein said uncommon amino acid is glycine oxazolecarboxylic acid
714. The peptide according to item 434, wherein said uncommon amino acid is glycine thiazolecarboxylic acid
715. The peptide according to item 434, wherein said uncommon amino acid is serine thiazolecarboxylic acid
716. The peptide according to item 434, wherein said uncommon amino acid is phenyalanine thiazolecarboxylic acid
717. The peptide according to item 434, wherein said uncommon amino acid is cysteine thiazolecarboxylic acid
718. The peptide according to item 434, wherein said uncommon amino acid is lysine thiazolecarboxylic acid
719. The peptide according to item 434, wherein said uncommon amino acid is keratan sulfate glucuronyl-galactosyl-galactosyl-xylosyl-threonine
720. The peptide according to item 434, wherein said uncommon amino acid is selenocysteinyl molybdopterin guanine dinucleotide
721. The peptide according to item 434, wherein said uncommon amino acid is histidyl-tyrosine
722. The peptide according to item 434, wherein said uncommon amino acid is methionine sulfone
723. The peptide according to item 434, wherein said uncommon amino acid is dipyrrolylmethanemethyl-cysteine
724. The peptide according to item 434, wherein said uncommon amino acid is glutamyl-tyrosine
725. The peptide according to item 434, wherein said uncommon amino acid is glutamyl-poly-glutamic acid
726. The peptide according to item 434, wherein said uncommon amino acid is cysteine sulfinic acid
727. The peptide according to item 434, wherein said uncommon amino acid is trihydroxyphenylalanine
728. The peptide according to item 434, wherein said uncommon amino acid is (sn-1-glycerophosphoryl)-serine
729. The peptide according to item 434, wherein said uncommon amino acid is thioglycine
730. The peptide according to item 434, wherein said uncommon amino acid is heme P460-bis-cysteine-tyrosine
731. The peptide according to item 434, wherein said uncommon amino acid is tris-cysteinyl-cysteine persulfido-bis-glutamato-histidino tetrairon disulfide trioxide
732. The peptide according to item 434, wherein said uncommon amino acid is cysteine persulfide
733. The peptide according to item 434, wherein said uncommon amino acid is Lactic acid (2-hydroxypropanoic acid)
734. The peptide according to any of items 434 to 733, wherein said uncommon amino acid is the L-enantiomer
735. The peptide according to any of items 434 to 733, wherein said uncommon amino acid is the D-enantiomer

FIGURE LEGENDS

FIG. 1: Schematic representation of MHC multimer.

A MHC multimer consist of a multimerization domain whereto one or more MHC-peptide complexes are attached through one or more linkers. The multimerization domain comprise one or more carriers and/or one or more scaffolds. The MHC-peptide complexes comprise a peptide and a MHC molecule.

FIG. 2: Program for peptide sequence motifs prediction

Figure 3:
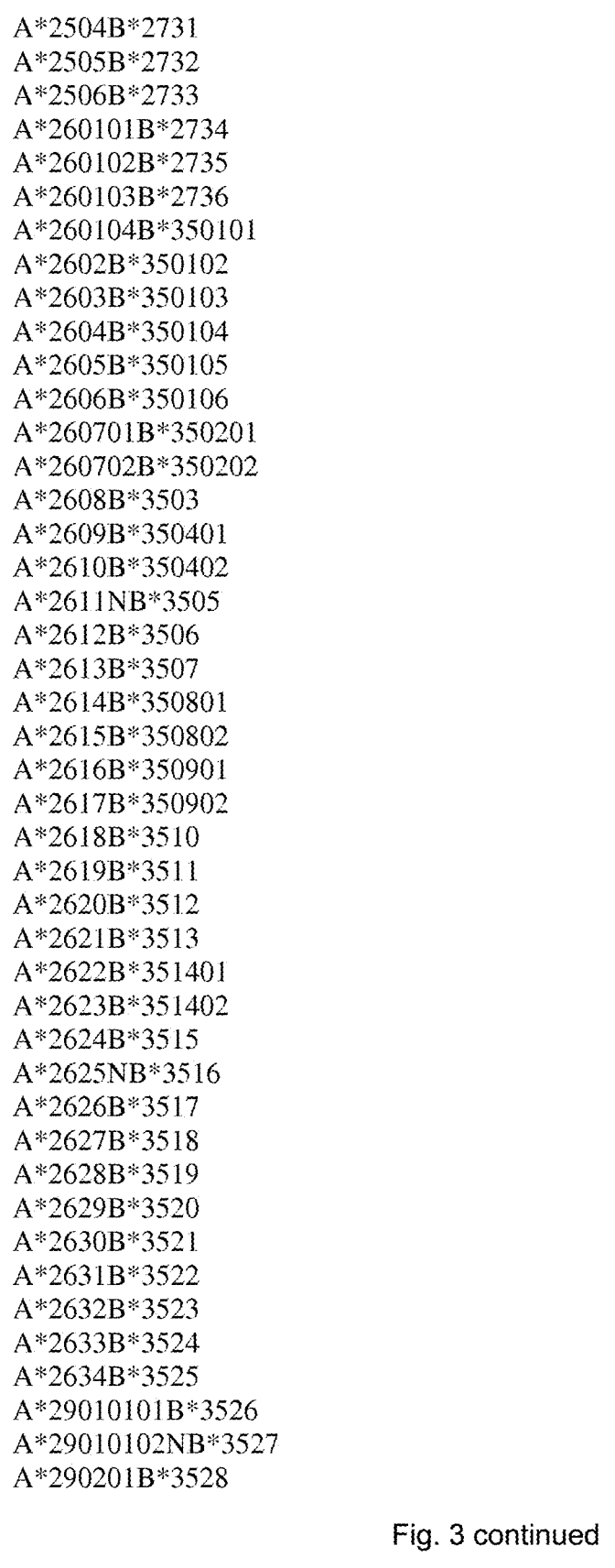
Figure 3:
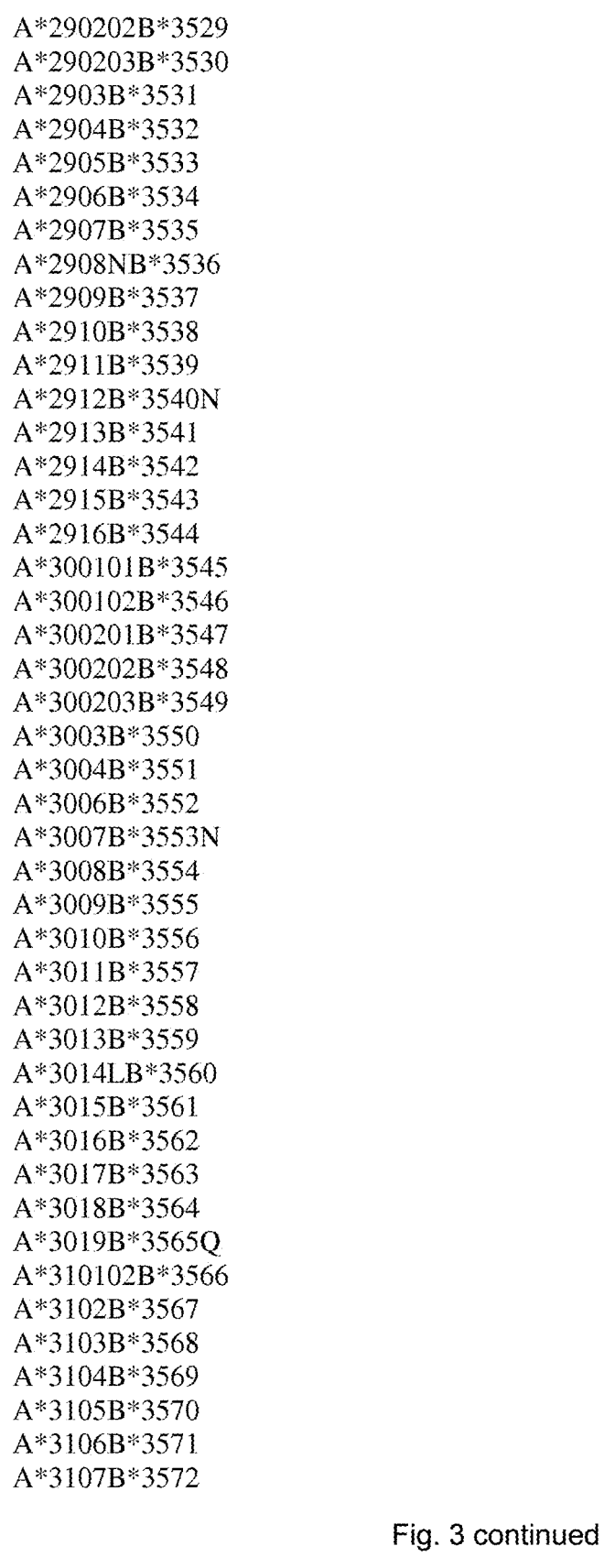
Figure 3:
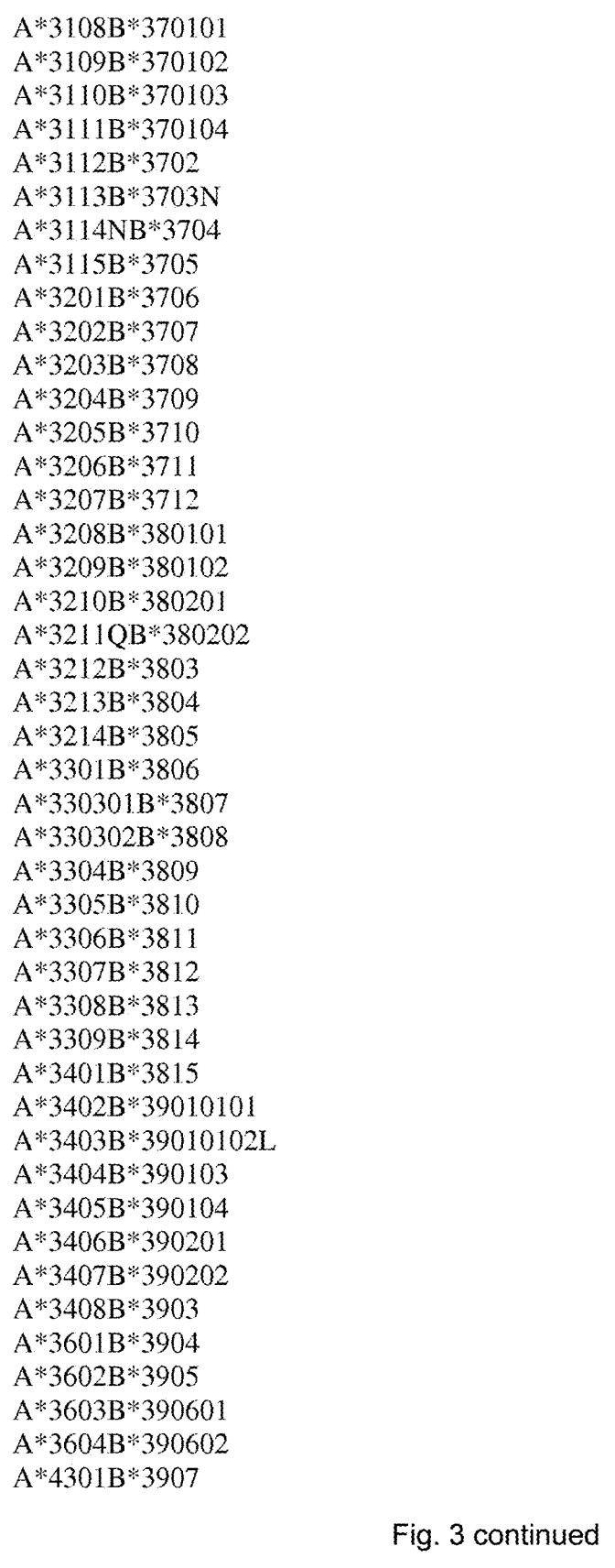
Figure 3:
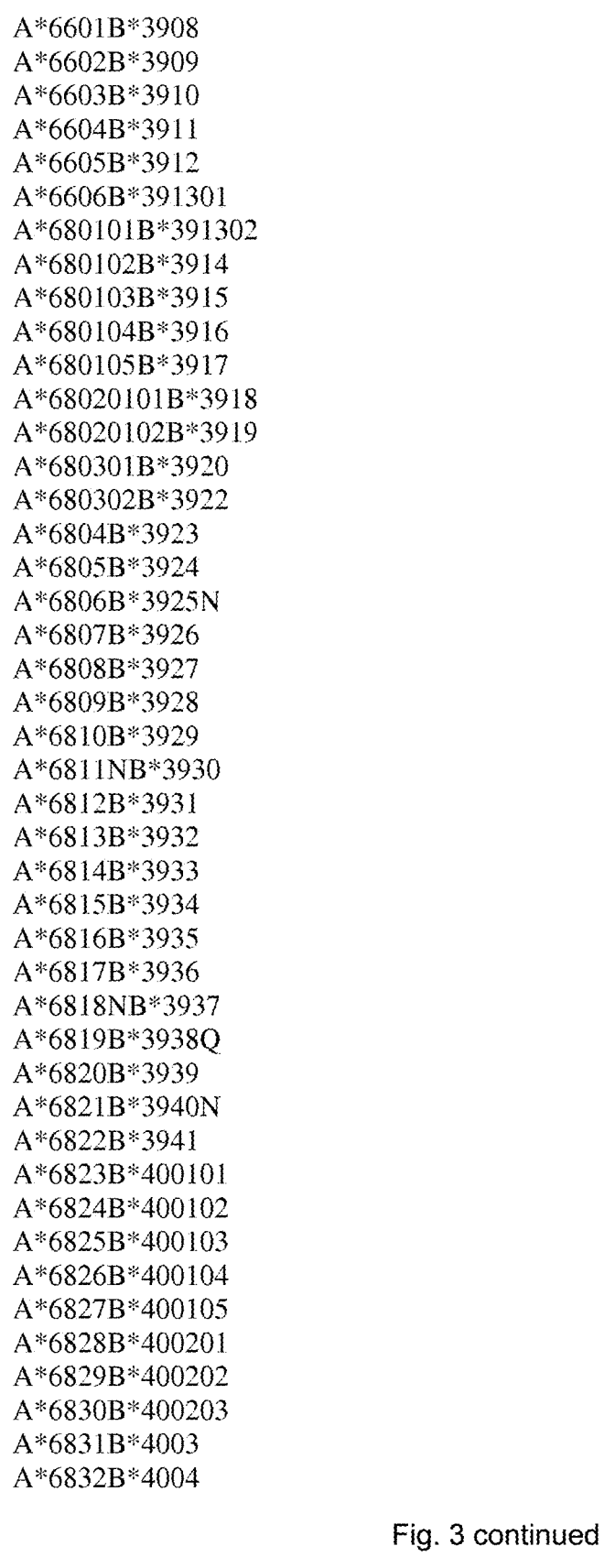
Figure 3:
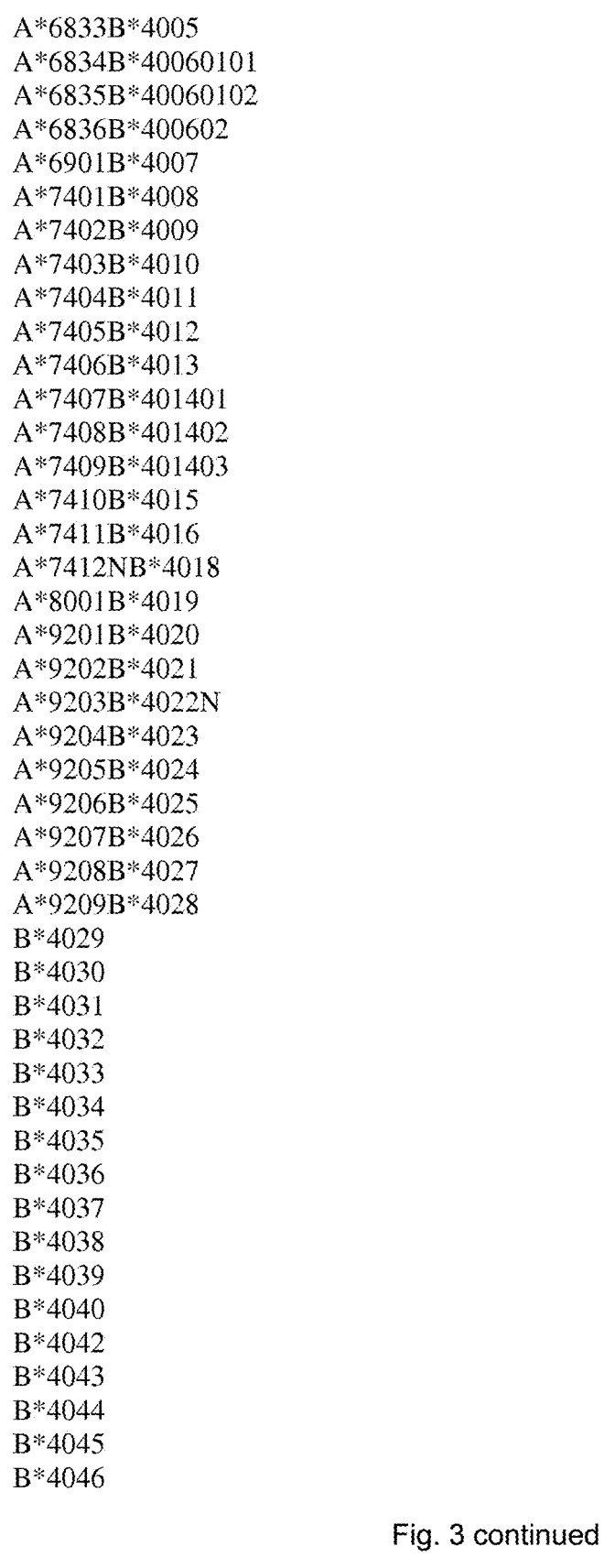
Figure 3:
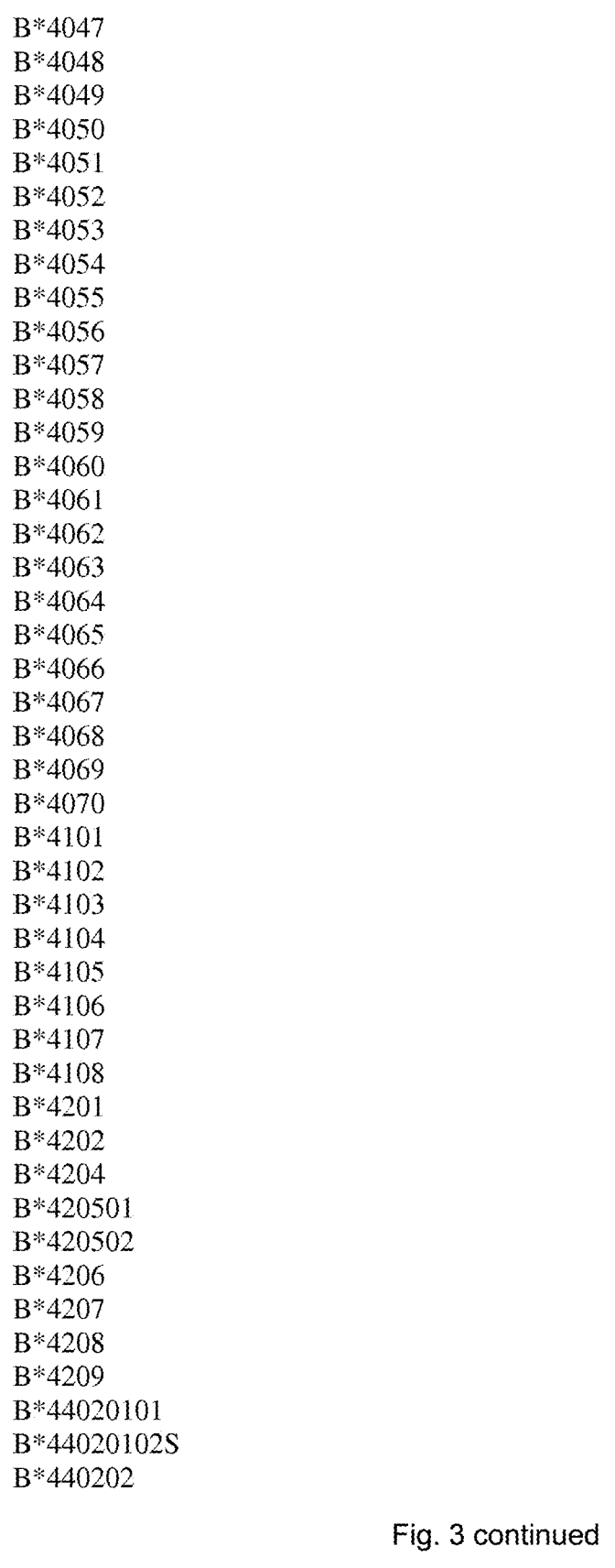
Figure 3:
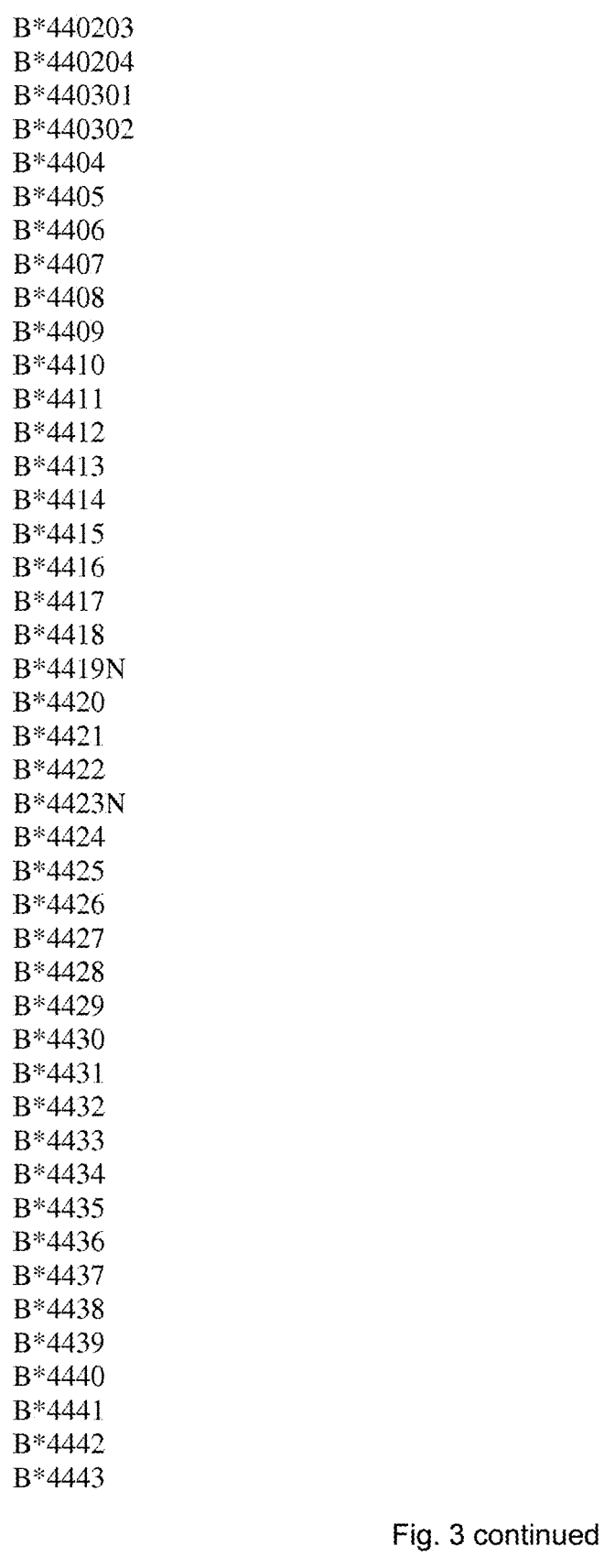
Figure 3:
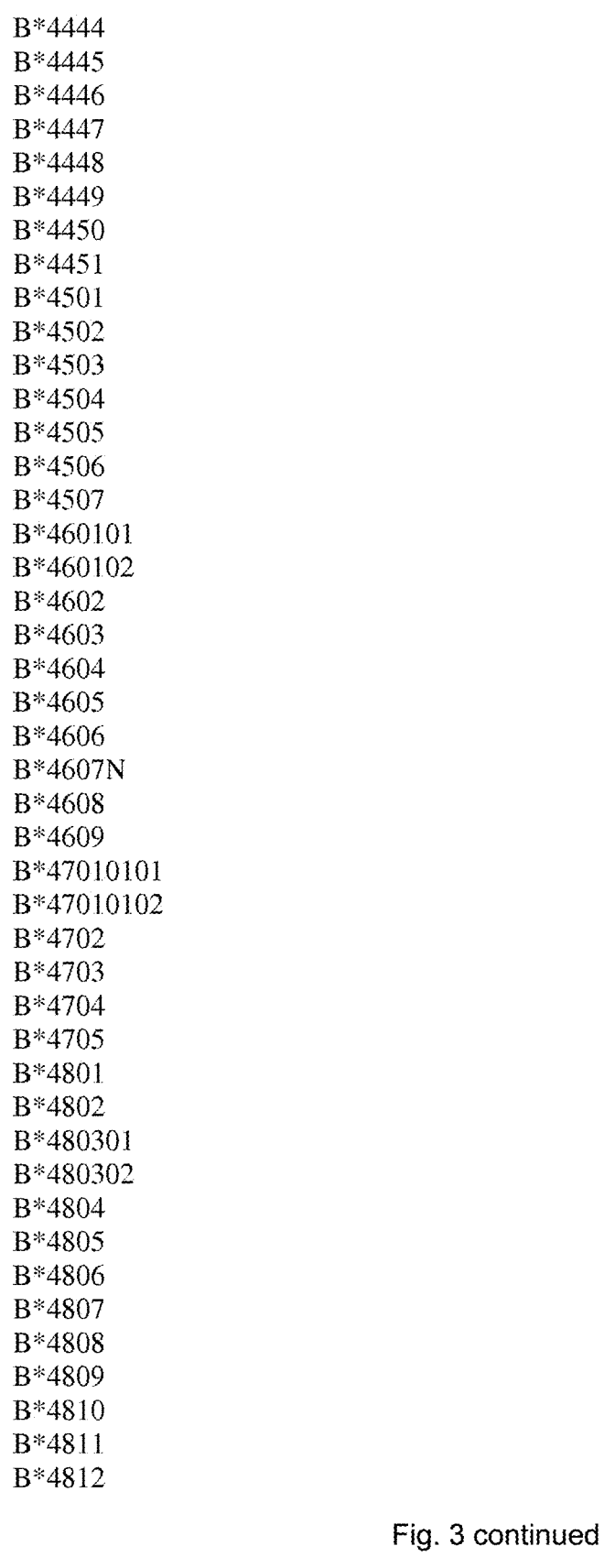
Figure 3:
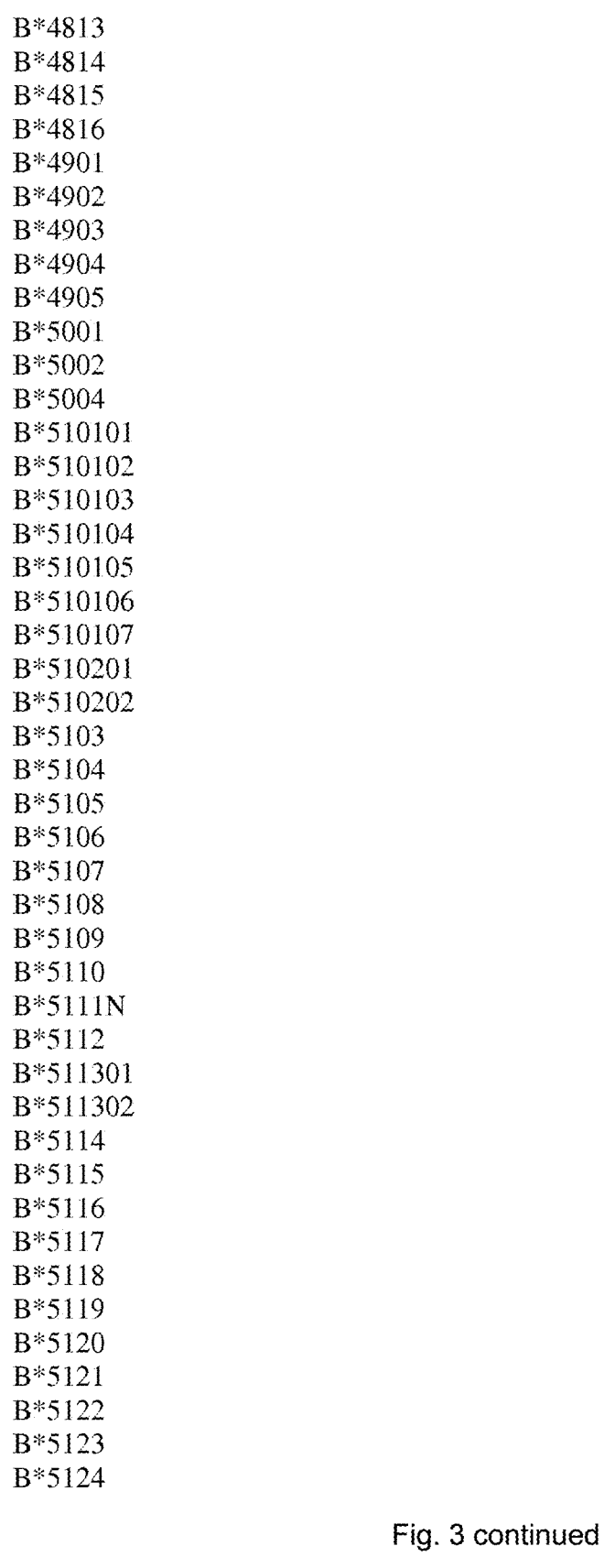
Figure 3:
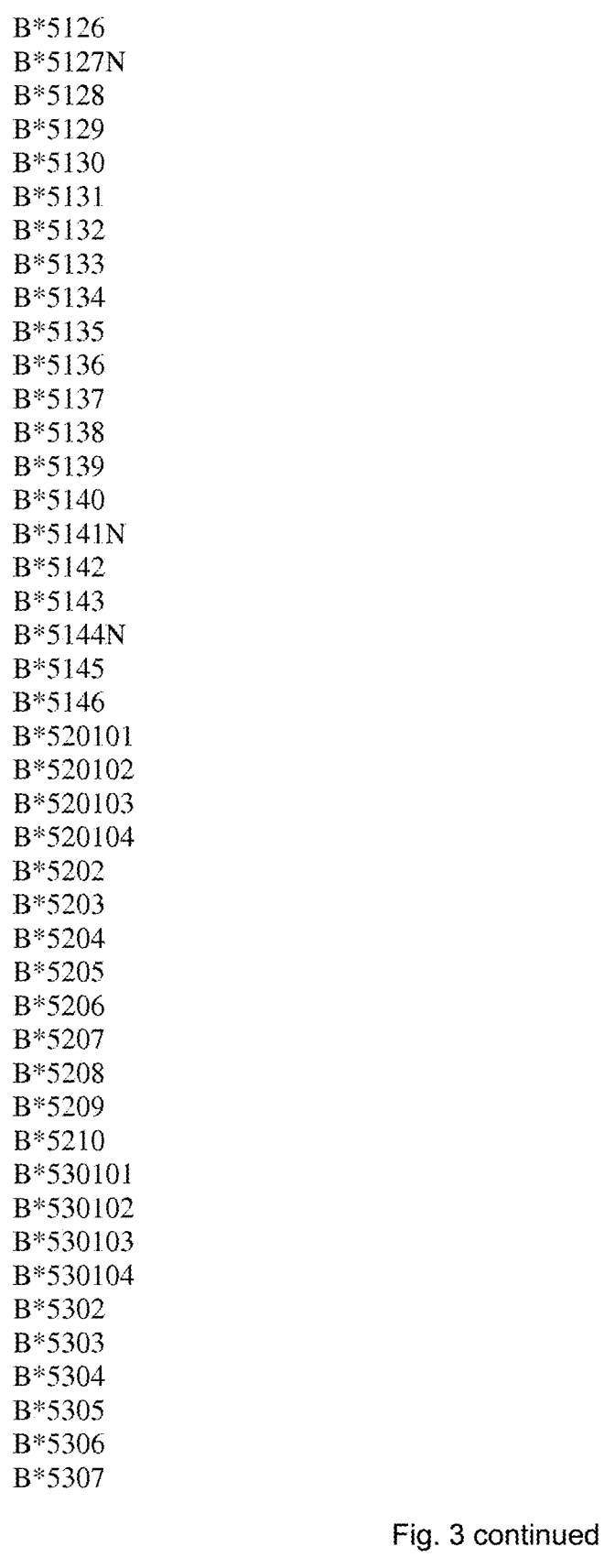
Figure 3:
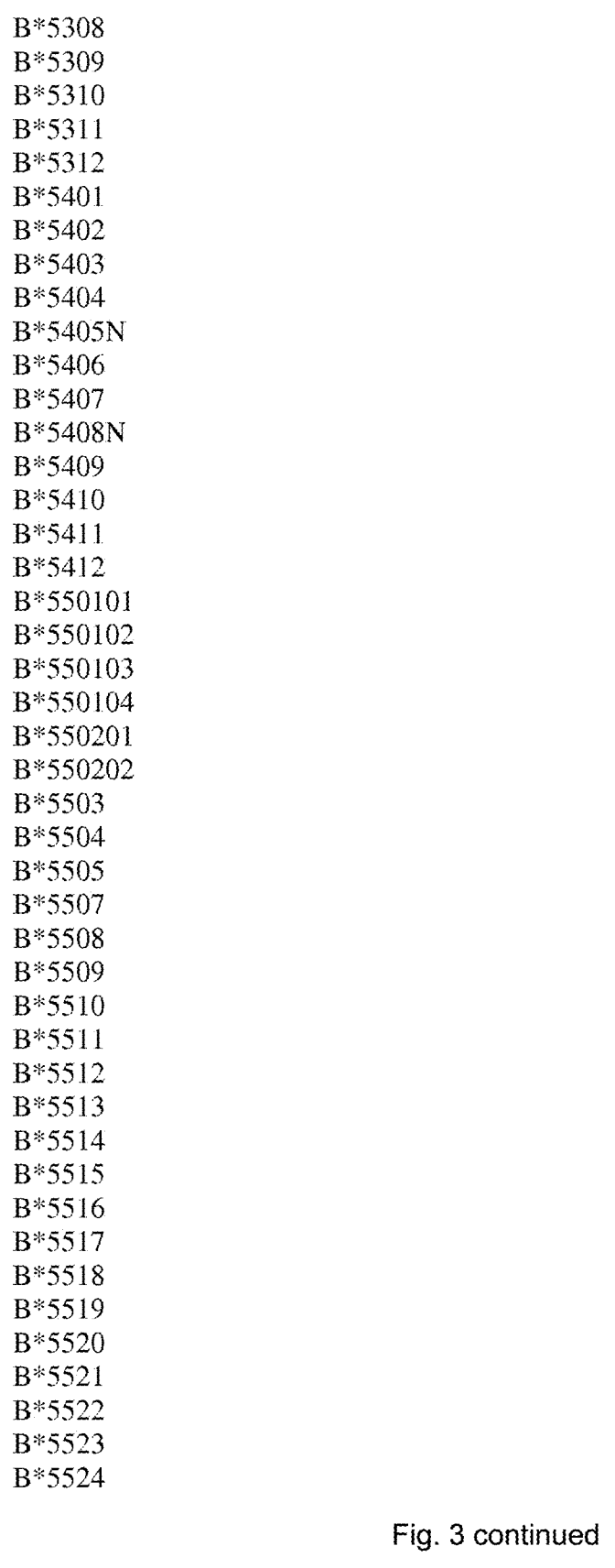
Figure 3:
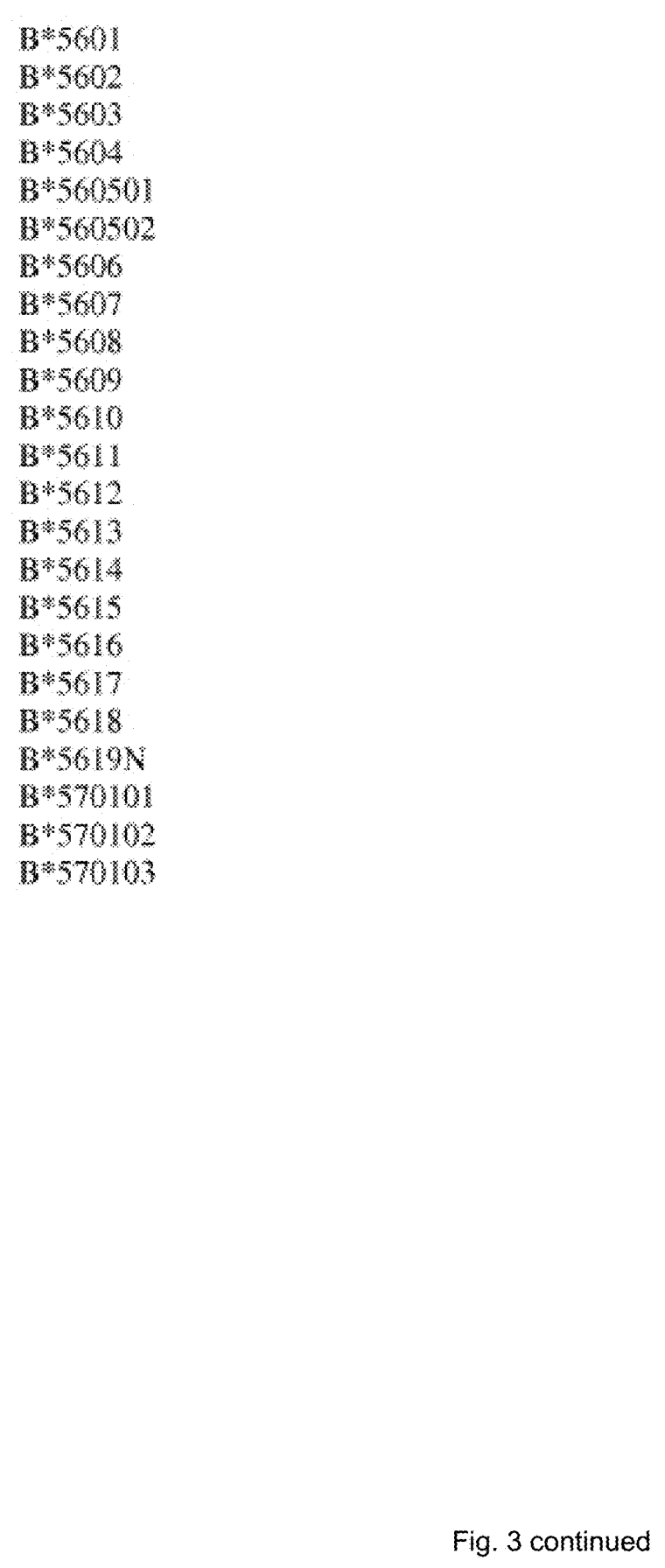
Figure 3:
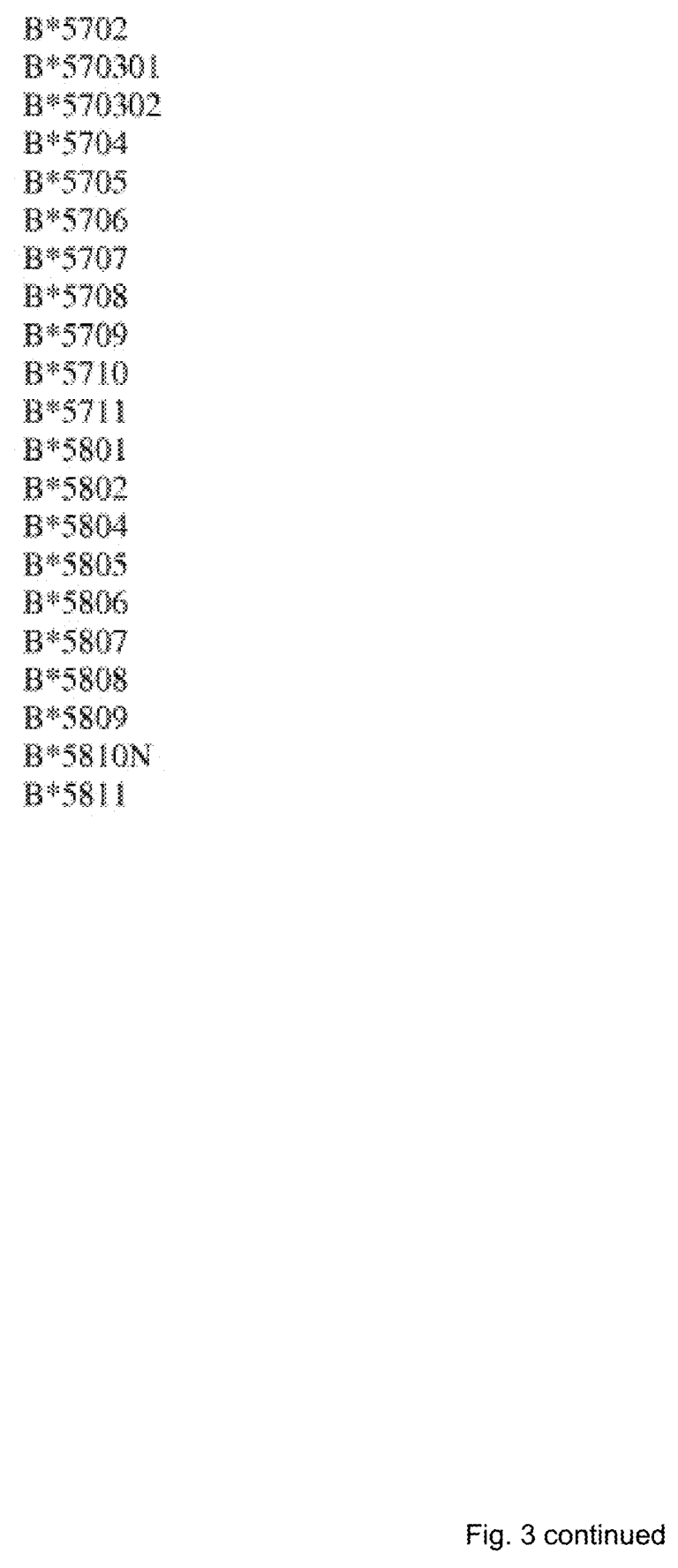
Figure 3:
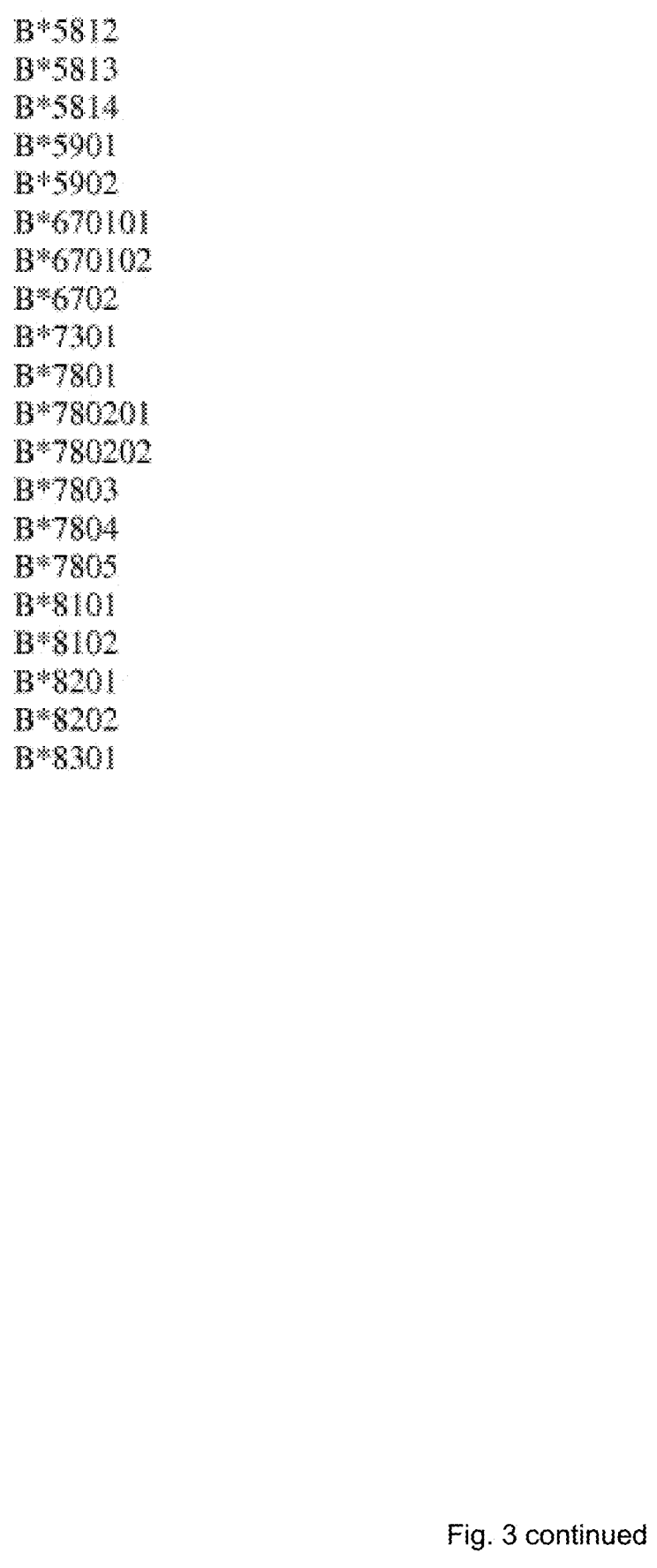

FIG. 3: Full List of HLA Class I alleles assigned as of January 2007 from www.anthonynolan.org.uk/HIG/lists/class 1list.html FIG. 4: Top 30 HLA class 1 alleles in human ethnic groups FIG. 5: Reactive groups and the bonds formed upon their reaction.

FIG. 6: Cleavable linkers, conditions for cleaving them and the resulting products of the cleavage.

FIG. 7: Size exclusion chromatography of folded HLA-A*0201-β2m-QLFEELQEL peptide-complex (SEQ ID NO 201986).

Purification of HLA-A*0201-β2m-QLFEELQEL (SEQ ID NO 201986) peptide-complex by size exclusion chromatography on a HiLoad 16/60 Superdex 75 column. Eluted protein was followed by measurement of the absorbance at 280 nm. The elution profile consisted of 4 peaks, corresponding to aggregated Heavy Chain, correctly folded MHC-complex, β2m and excess biotin and peptide.

FIG. 8: MHC-SHIFT Assay.

The SHIFT Assay shows that heavy chain is efficiently biotinylated, since the band corresponding to biotinylated heavy chain (lane 2) is shifted up-wards upon incubation with streptavidin.

Lane 1: Benchmark protein-ladder

Lane 2: Folded HLA-A*0201-β2m-QLFEELQEL peptide-complex (SEQ ID NO 201986).

Lane 3: Folded HLA-A*0201-β2m-QLFEELQEL peptide-complex (SEQ ID NO 201986) incubated with molar excess Streptavidin.

FIG. 9: Composition of Fluorescein-linker molecule.

(A) Schematic representation of an example of a Fluorescein-linker molecule. (B) Composition of a L15 linker.

FIG. 10: HLA alleles of the NetMHC databases

List of the 24 MHC class 1 alleles used for peptide prediction by the database www.cbs.dtu.dk/services/NetMHC/ and the 14 MHC class 2 alleles used for peptide prediction by the database www.cbs.dtu.dk/services/NetMHCII/FIG. 11: Ex vivo ELISPOT analysis of BclX(L)-specific CD8 positive T cells in PBL from a breast cancer patient.

Ex vivo ELISPOT analysis of BclX(L)-specific, CD8 positive T cells in PBL from a breast cancer patient either with or without the BclX(L) YLNDHLEPWI peptide (SEQ ID NO 201987). Analysis were performed in doublets and number of IFN-gamma producing T-cells are presented. (Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 12: PBL from a breast cancer patient analyzed by flow cytometry.

PBL from a breast cancer patient was analyzed by flow cytometry to identify Bcl-X(L)173-182 (peptide YLNDHLEPWI) (SEQ ID NO 201987) specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control.

(Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 13: 51-Cr release assay of isolated T cell clones.

Ten expanded T cell clones isolated by Flow sorting and then expanded were tested for their specificity by analysis in a standard 51-Cr release assay. For this purpose, T2 cells loaded with either Bcl-X(L)173-182, YLNDHLEPWI peptide (SEQ ID NO 201987) or an irrelevant peptide (BA4697-105, GLQHWVPEL) (SEQ ID NO 201988) were used as target cells.

(Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 14: Bcl-X(L)173-182 specific clone tested for its cytotoxic potential in 51Cr-release assays.

A Bcl-X(L)173-182 specific clone was tested for its cytotoxic potential in 51Cr-release assays. Two assays were performed a Cell lysis of T2 cells pulsed with Bcl-X(L)173-182 peptide or an irrelevant peptide (BA4697-105, GLQHWVPEL) (SEQ ID NO 201988) in three E:T ratios. b Cell lysis of T2 cells pulsed with different concentrations of Bcl-X(L)173-182 peptide at the E:T ratio 1:1

(Reference: Sorensen R B, Hadrup S R, Kollgaard T, Svane I M, Thor Straten P, Andersen M H (2006) Efficient tumor cell lysis mediated by a Bcl-X(L) specific T cell clone isolated from a breast cancer patient. Cancer Immunol Immunother April; 56(4)527-33)

FIG. 15: Detection of CMV specific T cells using MHC dextramers.

Dot plots showing live gated $CD3^+/CD4^-$ lymphocytes from CMV infected patient stained with (A) Negative Control MHC Dextramers (HLA-A*0201(GLAGDVSAV)) (SEQ ID NO 201989) or (B) MHC Dextramers containing peptides from CMV pp65 antigen (HLA-A*0201(NLVPMVATV)) (SEQ ID NO 201990).

FIG. 16: Conformational ELISA.

The ELISA is carried out as a sandwich-ELISA. The ELISA-plate was coated with W6/32 mouse-anti-hHLA-ABC (DAKO M0736) antibody, which recognizes a conformational epitope on correctly folded MHC-complex. Then MHC complex in various concentration was added. β2m in various concentrations was used as negative control. HRP-conjugated rabbit anti-β2m (DAKO P0174) was used for detection of bound MHC complex. TMB One-step substrate system (Dako) was used as a substrate for HRP, and color formation was followed by measurement of absorbance at 450 nm.

FIG. 17. Carboxylate-modified beads coupled to TCR and stained with HLA-A*0201(NLVPMVATV)/RPE (SEQ ID NO 201990) or HLA-A*0201(ILKEPVHGV)/RPE (SEQ ID NO 201991) dextramers.

TCR in various concentrations were coupled to carboxylate-modified beads and then stained with HLA-A*0201 (NLVPMVATV)/RPE (SEQ ID NO 201990) or HLA-A*0201(ILKEPVHGV)/RPE (SEQ ID NO 201991) dextramers in a flow cytometry experiment.

A) Histogram showing x-axis: Fluorescence intensity measured in the RPE channel (FL2), y-axis: events counted. Events measured in the Region R9 are regarded as negative, and events measured in Region R10 are regarded as positive.

B) Percentage of positively stained beads is shown for each preparation of beads. Negative control samples:

1) Beads coupled with 10 μg TCR stained with HLA-A*0201(ILKEPVHGV)/RPE (SEQ ID NO 201991)

2) Beads coupled with 0 μg TCR stained with HLA-A*0201(NLVPMVATV)/RPE (SEQ ID NO 201990)

Positive control samples:

3) Beads coupled with 2 μg TCR stained with HLA-A*0201(NLVPMVATV)/RPE (SEQ ID NO 201990)

4) Beads coupled with 5 μg TCR stained with HLA-A*0201(NLVPMVATV)/RPE (SEQ ID NO 201990)

5) Beads coupled with 10 μg TCR stained with HLA-A*0201(NLVPMVATV)/RPE (SEQ ID NO 201990)

6) Beads coupled with 20 μg TCR stained with HLA-A*0201(NLVPMVATV)/RPE (SEQ ID NO 201990)

FIG. 18: Flow cytometry analysis of human cell samples added TCR-coated beads. TCR-beads were added into human peripheral whole blood (left panel) or HPBMC (right panel) and then the samples were analysed by flow cytometry. Region R1 represents TCR-beads; region R2 represents lymphocyte cell population of interest.

FIG. 19: Flow cytometry analysis of MHC multimer constructs carrying nonsense peptides.

Human Peripheral Blood Lymphocytes were ficoll purified from blood from a human donor and stained with mouse anti-human CD3/PE antibody and mouse anti-human CD8/PB antibody together with either of the MHC Dextramer molecule constructs A) HLA-A*0201(NLVPMVATV)/APC (SEQ ID NO 201990), B) HLA-A*0201(ILKEPVHGV)/APC (SEQ ID NO 201991), C) HLA-A*0201(nonsense peptide 1)/APC or D) HLA-A*0201(nonsense peptide 2)/APC. The staining was analysed on a CyAn ADP flow cytometer. Live-gated and CD3 positive lymphocytes are shown.

FIG. 20: Summary of flow cytometry analysis of the binding of different MHC multimer constructs to specific T cells in purified Human Peripheral Blood.

Mononuclear Cell samples. Purified HPBMC were stained with different MHC(peptide) molecules attached to APC labeled dextran270 multimerization domain and analyzed by flow cytometry. See example 58 for details on experimental procedures. 5 different MHC(peptide) molecules were investigated. Construct 1: HLA-A*0201 (GLAGDVSAV) (SEQ ID NO 201989), construct 2: HLA-A*0201(ALIAPVHAV) (SEQ ID NO 201992), construct 3: HLA-A*0201(NLVPMVATV) (SEQ ID NO 201990), construct 4: HLA-A*0201(GLCTLVAML) (SEQ ID NO 201993) and construct 5: HLA-A*0201(ILKEPVHGV) (SEQ ID NO 201991). A positive staining is symbolized with a (+) and is here defined as the identification of a distinct CD8 positive and MHC (peptide) positive population when visualized in a dot plot (as exemplified in FIG. 15). Negative staining is symbolized with a (−) and is defined as absence of a distinct CD8 positive and MHC (peptide) positive population when visualized in a dot plot. Nt means not determined. All samples have previously been analyzed for the presence of T-cells restricted by HLA-A*0201(NLVPMVATV) (SEQ ID NO 201990), HLA-A*0201(GLCTLVAML) (SEQ ID NO 201993) and HLA-A*0201(ILKEPVHGV) (SEQ ID NO 201991) and these results are shown in italics in the figure (column 2 and 3).

FIG. 21: Gating strategy for no-lyse no-wash procedure.

Whole blood was stained with MHC multimer, anti-CD8/APC, anti-CD3/PB and CD45/CY antibody in a no-lyse no-wash procedure. For further details see text in example 66. During analysis of data the following gating strategy was used: CD45/PB antibody was used to set a trigger discriminator to allow the flow cytometer to distinguish between red blood cells and stained white blood cells. This was done during data collection by gating on CD45/PB positive cells in a CD45/PB vs. side scatter dot plot as shown in A. After data collection and during data analysis CD3 positive cells were selected by gating CD3/FITC positive cells in a CD3/FITC vs side scatter plot as shown in B. The final data was illustrated in a MHC multimer/PE vs CD8/APC plot (see FIG. 22).

FIG. 22: Identification of CMV-specific T cells in a blood sample using no-lyse no-wash procedure.

Whole blood from three different donors were analysed for the presence of CMV-specific T cells by flow cytometry using a no-lyse no-wash procedure. Donor 1 was stained with a MHC multimer consisting of PE-conjugated 270 kDa dextran coupled with HLA-A*0201 in complex with beta2microglobulin and the peptide NLVPMVATV (SEQ ID NO 201990) derived from Human Cytomegalo Virus (HCMV) (left panel) and with a negative control MHC multimer consisting of PE conjugated 270 kDa dextran coupled with HLA-A*0201 in complex with beta2microglobulin and the peptide ILKEPVHGV (SEQ ID NO 201991) derived from Human Immunodeficiency Virus (HIV) (right panel). Donor 2 was stained with a MHC multimer consisting of PE-conjugated 270 kDa dextran coupled with HLA-A*0101 in complex with beta2microglobulin and the peptide VTEHDTLLY (SEQ ID NO 201994) derived from Human Cytomegalo Virus (HCMV) (left panel) and a negative control MHC multimer consisting of PE-conjugated 270 kDa dextran coupled with HLA-A*0101 in complex with beta2microglobulin and the peptide IVDCLTEMY (SEQ ID NO 201995) derived from ubiquitin specific peptidase 9 (USP9) (right panel). Donor 3 was stained with two MHC multimers consisting of PE conjugated 270 kDa dextran coupled with HLA-B*0207 in complex with beta2microglobulin and either of the peptides TPRVTGGGAM (SEQ ID NO 201996) (left panel) or RPHERNGFTVL (SEQ ID NO 201997) (center panel) both derived from Human Cytomegalo Virus (HCMV) and with a negative control MHC multimer consisting of PE-conjugated 270 kDa dextran coupled with HLA-B*0207 in complex with beta2microglobulin and the peptide TPGPGVRYPL (SEQ ID NO 201998) derived from Human Immunodeficiency Virus (HIV) (right panel).

All samples were also added Anti-CD45/PB, anti-CD3/FITC and anti-CD8/APC antibodies. The samples were gated as shown in FIG. 21.

FIG. 23: Enumeration of specific T cells using CytoCount™ beads.

Whole blood from a human donor were analysed for the presence of CMV-specific T cells with MHC multimers by flow cytometry using a no-lyse no-wash procedure. 2×100 μl donor blood was analysed with two different MHC multimers: A) PE-conjugated 270 kDa dextran coupled with HLA-A*0101 in complex with beta2microglobulin and the peptide VTEHDTLLY (SEQ ID NO 201994) derived from Human Cytomegalo Virus (HCMV) and a negative control construct B) consisting of PE-conjugated 270 kDa dextran coupled with HLA-A*0101 in complex with beta2microglobulin and the peptide IVDCLTEMY (SEQ ID NO 201995) derived from ubiquitin specific peptidase 9 (USP9). To each sample Anti-CD45/CY, anti-CD3/APC and anti-CD8/PB antibody was added together with 50 μl Cyto-Count beads (1028 beads/μ1). Following staining for 15 minutes PBS was added to 1 ml and the samples analysed on a CyAn flow cytometer. During analysis CD45/CY antibody was used to set a trigger discriminator to allow the flow cytometer to distinguish between red blood cells and stained white blood cells and CD3/APC antibody was used to gate for CD3 positive T lymphocytes.

Amount of counted beads in sample A are shown in the histogram C and amount of beads counted in the negative control sample B are show in histogram D. Concentration of HLA-A*0101(VTEHDTLLY) (SEQ ID NO 201994) specific T cells in the blood sample was determined as follows:

((count of MHC multimer+CD8+cells in A×concentration of beads×dilution factor of beads)/counted beads C))−((counted MHC multimer+CD8+cells in B×concentration of beads×dilution factor of beads)/counted beads D)=((1300 cells×1028 beads/μl×0.05)/67225 beads)−((2 cells×1028 beads/μl×0,05)/72623 beads)=0,9926 cells/μl=992.6 celler/ml FIG. 24: MHC dextramers can be embedded in a sugar matrix together with antibodies and used for detection of specific T cells in a blood sample.

MHC dextramer constructs was embedded in a sugar matrix together with relevant gating reagents (anti-CD3/Pacific Blue, anti-CD8/Alexa700 and anti-CD45/Cascade Yellow antibodies) and the matrix dried. Then EDTA stabilized blood from a human donor were added and the samples analyzed by flow cytometry. Two different MHC construct were used HLA-A*0101(VTEHDTLLY)/PE (SEQ ID NO 201994) dextramer (A) and the negative control construct HLA-A*0101(IVDCLTEMY)/PE (SEQ ID NO 201995) (B). As a control antibodies and MHC dextramer constructs were used to stain blood from the same donor following a general staining procedure without embedding the antibodies and MHC dextramers in a sugar matrix as described elsewhere herein. (C) Staining with HLA-A*0101(VTEHDTLLY)/PE (SEQ ID NO 201994) dextramer following a normal staining procedure and (D) Staining with HLA-A*0101(IVDCLTEMY)/PE (SEQ ID NO 201995) dextramer following a normal staining procedure.

FIG. 25: Summary flow chart, ELISPOT summary flow chart showing measurement of antigen reactive T-Cells by IFN-γ capture in blood samples by ELISPOT. See example 31 for more detailed information.

FIG. 26: Prediction of cancer antigen BclX(L) specific MHC class 1, 8-, 9-, 10-, 11-mer peptide binders.

Prediction of cancer antigen BclX(L) specific MHC class 1, 8-, 9-, 10-, 11-mer peptide binders for 24 MHC class 1 alleles using the www.cbs.dtu.dk/services/NetMHC/database. The MHC class 1 molecules for which no binders were found are not listed.

FIG. 27: Prediction of cancer antigen BclX(L) specific MHC class 2, 15-mer peptide binders.

Prediction of cancer antigen BclX(L) specific MHC class 2, 15-mer peptide binders for 14 MHC class 2 alleles using the www.cbs.dtu.dk/services/NetMHCII/database. The MHC class 2 molecules for which no binders were found are not listed.

FIG. 28: Peptides useful in MHC Class I-based applications.

The peptides derived from the antigens described in Table 6, which are useful in MHC Class I-based applications are depicted in FIG. 28 (SEQ ID NO 83-59784).

FIG. 29: Peptides useful in MHC Class II-based applications.

The peptides derived from the antigens described in Table 6, which are useful in MHC Class II-based applications are depicted in FIG. 29 (SEQ ID NO 59785-117871).

FIG. 30:

Peptides derived from *Mycobacterium tuberculosis* antigens, which are useful in MHC Class I or II-based applications are depicted in FIG. 30 (SEQ ID NO 117872-200680). MHC Class I peptides are predicted by the Net MHC algorithm and the MHC Class II peptides are specific 13, 14, 15 or 16 amino acid sequences selected from the *Mycobacterium tuberculosis* antigens.

FIG. 31. Detection of activated lymphocytes using MHC pentamers and IFN-γ.

The figures illustrate IFN-γ versus MHC Pentamer staining of live lymphocytes. PBMCs were incubated with either a negative control (non-specific) Pentamer (A*0201/EBV (GLCTLVAML) (SEQ ID NO 201993)) or a Pentamer specific for the cells of interest (B*0801/EBV (RAKFKQLL) (SEQ ID NO 202008)), then stimulated with LAC (non-specific activation) or B*0801/EBV peptide (specific peptide activation) for 15 hours in the presence of Brefeldin A. Fixation, permeabilization and staining for IFN-γ were carried out exactly as detailed in the protocol. From www.proimmune.com: *Pro5 Recombinant MHC Pentamer staining protocol for human Intracellular Proteins*. Version 4.1 February 2007.

FIG. 32. The frequency and the distribution analysis of Ag85A pentamer$^+$ CD8 T cells in CSF and in PBMC. Frequency and subset distribution of Ag85A MHC pentamer$^+$ CD8 T cells obtained from PBMC and CSF of a patient affected by TB meningitis. In the flow analyses, at least $10^6$ events were acquired, viable lymphocytes were gated by forward and side scatter. A plot showing pentamer positive vs CD8 positive cells are shown on the left. To obtain plots on the right cells were furthermore gated on pentamer$^{positive}$ and CD8 positive cells. Modified from "*Phenotypical and Functional Analysis of Memory and Effector Human CD8 T Cells Specific for Mycobacterial Antigens*" *The Journal of Immunology,* 2006, 177: 1780-1785

FIG. 33. Distribution of frequencies of ESAT-6-specific IFN-γ-secreting T cells in all subjects. Frequencies of ESAT-6-specific IFN-7-secreting T cells for all 47 patients with tuberculosis (TB patients) and 47 control patients (77% of whom are BCG vaccinated). Each circle represents an individual subject; the frequency of IFN-γ-secreting T cells to each peptide was summated to give the total number of ESAT-6 peptide-specific T cells. Circles on the baseline represent individuals with no response to any of the ESAT-6 peptides. The broken horizontal line represents the pre-defined cutoff point (5 IFN-γ SFCs per $3\times10^5$ PBMCs, which translates into a lower threshold of detection of 17 peptide-specific T cells per million PBMCs). Modified from Lalvani et al. "*Rapid detection of Mycobacterium tuberculosis infection by enumeration of antigen-specific T cells.*" (2001) *Am J of respiratory and critical care medicine* vol 163 p 824-828.

FIG. 34. Dot plot of individual responses to CFP-10 and ESAT-6 for 118 culture-positive patients with tuberculosis (TB) (a), 213 subjects with a low risk for TB exposure (b), and 33 TB suspects whose TB status could not be determined, as *Mycobacterium tuberculosis* could not be cultured (c). *For "ESAT/CFP" the data for the antigen (ESAT-6 or CFP-10) giving the highest response is shown. The dashed line represents the cutoff of 0.35 IU/ml for IFN-γ. Modified from Mori et al. "Specific detection of Tuberculosis infection" (2004). Am J of respiratory and critical care medicine Vol. 170, 59-64.

EXAMPLES

Example 1

This example describes how to make a MHC class I complex with a peptide in the peptide binding-groove using in vitro refolding. The MHC-complex in this example consisted of light chain β2m, the MHC class I Heavy Chain allele HLA-A*0201 (a truncated version in which the intracellular and transmembrane domains have been deleted) and the peptide QLFEELQEL (SEQ ID NO 201986).

MHC I-complexes consists of 3 components; Light Chain (β2m), Heavy Chain and a peptide of typically 8-10 amino acids. In this example MHC-complexes was generated by in vitro refolding of heavy chain, β2m and peptide in a buffer containing reduced and oxidized glutathione. By incubation in this buffer a non-covalent complex between Heavy Chain, β2m and peptide was formed. Heavy chain and β2m was expressed as inclusion bodies in *E. coli* prior to in vitro refolding following standard procedures as described in Garboczi et al., (1996), Nature 384, 134-141. Following refolding the MHC complexes was biotinylated using BirA enzyme able to biotinylate a specific amino acid residue in a recognition sequence fused to the C-terminal of the Heavy Chain by genetic fusion. Monomer MHC complexes was then purified by size exclusion chromatography.

1. 200 ml of refolding buffer (100 mM Tris, 400 mM L-arginin-HCL, 2 mM NaEDTA, 0.5 mM oxidized Gluthathione, 5 mM reduced Glutathione, pH 8.0) was supplied with protease inhibitors PMSF (phenylmethylsulphonyl fluoride), Pepstatin A and Leupeptin (to a final concentration of 1 mM, 1 mg/l and 1 mg/l, respectively). The refolding buffer was placed at 10° C. on a stirrer.

2. 12 mg of peptide QLFEELQEL (SEQ ID NO 201986) was dissolved in DMSO or another suitable solvent (300-500 μl), and added drop-wise to the refolding buffer at vigorous stirring.
3. 4.4 mg of human Light Chain β2m was added drop-wise to the refolding buffer at vigorous stirring.
4. 6.2 mg of Heavy Chain HLA-A*0201 (supplied with DTT to a concentration of 0.1 mM) was added drop-wise to the refolding buffer at vigorous stirring.
5. The folding reaction was placed at 10° C. at slow stirring for 4-8 hours.
6. After 4-8 hours, step 3 and 4 was repeated and the folding reaction is placed at 10° C. at slow stirring O/N.
7. Step 3 and 4 was repeated, and the folding reaction is placed at 10° C. at slow stirring for 6-8 hours.

Optionally, steps 5-7 may be done in less time, e.g. a total of 0.5-5 hours.

8. After 6-8 hours the folding reaction was filtrated through a 0.2 μm filter to remove aggregates.
9. The folding reaction was concentrated O/N at 10° C. shaking gently in a suitable concentrator with a 5000 mw cut-off filter. The folding reaction was concentrated to approximately 5-10 ml. (Optionally the filtrate can be stored at 4° C. and reused for another folding with the same peptide and heavy chain.)
10. The concentrated folding reaction was buffer-exchanged at least 8 times, into a MHC-buffer (20 mM Tris-HCl, 50 mM NaCl, pH 8.0) and concentrated (at 10° C. in a suitable concentrator with a 5000 mw cut-off filter) down to approximately 1 ml.
11. The heavy chain part of the MHC-complex was biotinylated by mixing the following components: approximately 1000 μl folded MHC-complex, 100 μl each of Biomix-A, Biomix-B and d-Biotin (all 3 from Biotin Protein Ligase Kit from Avidity, 10 μl birA enzyme (3 mg/ml, from Biotin Protein Ligase Kit from Avidity, 0.5 μl Pepstatin A (2 mg/ml) and 0.5 μl Leupeptin (2 mg/ml). The above was gently mixed and incubated O/N at room temperature.
12. The biotinylated and folded MHC-complex solution was centrifuged for 5 min. at 1700×g, room temperature.
13. Correctly folded MHC-complex was separated and purified from excess biotin, excess β2m, excess heavy chain and aggregates thereof, by size exclusion chromatography on a column that separates proteins in the 10-100 kDa range. Correctly folded monomer MHC-complex was eluted with a MHC-buffer (20 mM Tris-HCl, 50 mM NaCl, pH 8.0). The elution profile consisted of 4 peaks, corresponding to aggregated Heavy Chain, correctly folded monomer MHC-complex, β2m and excess biotin and peptide (See FIG. 7).
14. Fractions containing the folded MHC-complex were pooled and concentrated to approximately 1 ml in a suitable concentrator with a 5000 mw cut-off filter. The protein-concentration was estimated from its abosorption at 280 nm.
15. Folded MHC-complex can optionally be stored stored at −170° C. before further use.
16. The grade of biotinylation was analyzed by a SDS PAGE SHIFT-assay with Streptavidin (FIG. 8) and correct folding was confirmed by ELISA, using the antibody W6/32 that recognizes correctly folded MHC-peptide complex.

The above procedure may be used for folding any MHC I complexes consisting of any β2m, any heavy chain and any peptide approx. 8-11 amino acids long. Either of the components can be truncated or otherwise modified. The above procedure can also be used for generation of "empty" MHC I complexes consisting of β2m and heavy chain without peptide.

Example 2

This example describes how to generate soluble biotinylated MHC II complexes using a baculovirus expression system, where the MHC II complex was DR4 consisting of the α-chain DRA1*0101 and the β-chain DRB1*0401 as described by Svendsen et al., (2004), J. Immunol. 173(11): 7037-45. Briefly, The hydrophobic transmembrane regions of the DRα and DRβ chains of DR4 were replaced by leucine zipper dimerization domains from the transcription factors Fos and Jun to promote DR α/β assembly. This was done by ligating cytoplasmic cDNA sequences of DRA1*0101 and DRB1*0401 to fos- and jun-encoding sequences. A birA site GLNDIFEAQKIEWH (SEQ ID NO 201999) was added to the 3' end of the DRA1*0101-fos template. Covalently bound peptide AGFKGEQGPKGEP (SEQ ID NO 202000) derived from collagen II amino acid 261-273 were genetically attached by a flexible linker peptide to the N terminus of the DRβ-chain. Finally, the modified DRA1*0101 and DRB1*0401 inserts were cloned into the expression vector pAcAb3. The pAcAB3-DRA1*0101/DRB1*0401 plasmids were cotransfected with linearized baculovirus DNA (BD Pharmingen; BaculoGold kit) into Sf9 insect cells, according to the manufacturer's instructions. Following two rounds of plaque purification, clonal virus isolates were further amplified three times before preparation of high-titer virus ($10^8$-$10^{16}$/ml). These stocks were used to infect High Five or serum-free Sf21 insect cells (Invitrogen Life Technologies, Carlsbad, Calif.) for protein production. Spinner cultures (2-3×$10^6$ cells/ml) were infected at a multiplicity of infection of 1-3 in a volume of 150 ml per 2 L spinner flask. Supernatants were harvested and proteinase inhibitor tablets (Roche, Basel, Switzerland) were added before affinity purification on MiniLeak-Low columns (Kem-En-Tec) coupled with the anti-HLA-DR monoclonal antibody L243. HLA-DR4 complexes were eluted with diethylamine (pH 11) into neutralization buffer (2 M Tris, pH 6.5) and immediately buffer exchanged and concentrated in PBS, 0.01% $NaN_3$, using Millipore (Bedford, Mass.) concentrators. The purity of protein was confirmed by SDS-PAGE. The purified DR4 complexes were biotinylated in vitro as described for MHC I complexes elsewhere herein. These complexes may now be used for coupling to any dimerization domain, e.g. divynylsulfone activated dextran 270 coupled with SA and a fluorochrome.

Example 3

This example describes how to generate empty biotinylated MHC II complexes using a baculovirus expression system, where the MHC II complex consist of any α-chain and any β-chain, including truncated and otherwise modified versions of the two. Briefly, The hydrophobic transmembrane regions of the DRα and DRβ chains of MHC II are replaced by leucine zipper dimerization domains from the transcription factors Fos and Jun to promote DR α/β assembly. This is done by ligating cytoplasmic cDNA sequences of DRα and DRβ to fos- and jun-encoding sequences. A birA site GLNDIFEAQKIEWH (SEQ ID NO 201999) is added to the 3' end of either the DRα-fos/DRα-jun or the DRβ-jun/DRβ-fos template. The modified DRα and DRβ inserts is cloned into the expression vector pAcAb3 and cotransfected with linearized baculovirus DNA into Sf9 insect cells, according to the manufacturer's instructions. Following rounds of plaque purification, clonal virus isolates is further amplified before preparation of high-titer virus. These stocks are used to infect High Five or serum-free Sf21 insect cells (Invitrogen Life Technologies, Carlsbad, Calif.) for protein production, e.g. as Spinner cultures. Supernatants are harvested and proteinase inhibitors added before affinity purification, e.g. using a MiniLeak-Low columns (Kem-En-Tec) coupled with anti-MHC II antibody. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 4

This example describes how to generate biotinylated MHC II complexes using a cell based protein expression system, where the MHC II complex consist of any α-chain and any β-chain, including truncated and otherwise modified versions of the two. The MHC II complex may also have a peptide bound in the peptide binding cleft.

The hydrophobic transmembrane regions of the MHC II α-chain and MHC II β-chain are replaced by leucine zipper dimerization domains from the transcription factors Fos and Jun to promote α/β chain assembly. This is done by ligating cytoplasmic cDNA sequences of α-chain and β-chain to fos- and jun-encoding sequences. A birA site GLN-DIFEAQKIEWH (SEQ ID NO 201999) is added to the 3' end of the DRα-fos template. Optionally covalently bound peptide is genetically attached by a flexible linker peptide to the N terminus of the DRβ-chain. The modified DRα and DRβ inserts is cloned into a suitable expression vector and transfected into a cell line capable of protein expression, e.g. insect cells, CHO cells or similar. Transfected cells are grown in culture, supernatants are harvested and proteinase inhibitors added before affinity purification, e.g. using a MiniLeak-Low columns (Kem-En-Tec) coupled with anti-MHC II antibody. Alternatively the expressed MHC II complexes may be purified by anion- or cation-exchange chromatography. The purified MHC II complexes is biotinylated in vitro as described for MHC I complexes elsewhere herein. These biotinylated MHC II complexes may now be used for coupling to any dimerization domain, e.g. divynylsulfone activated dextran 270 coupled with SA and a fluorochrome.

Example 5

This is an example of how to make a MHC multimer that is a tetramer and where the MHC are attached to the multimerization domain through a non-covalent interaction The multimerization domain consist of Streptavidin. The MHC molecule was biotinylated DR4 consisting of the α-chain DRA1*0101 and the β-chain DRB1*0401 and the peptide AGFKGEQGPKGEP (SEQ ID NO 202000) derived from collagen II amino acid 261-273. The biotinylated MHC-peptide complexes was generated as described in a previous example herein.

Fluorescent DR4-peptide tetramer complexes were assembled by addition of ultra-avidin-R-PE (Leinco Technologies, St. Louis, Mo.) at a final molar ratio of biotinylated to DR4-peptide ultra-avidin-R-PE of 6:1. The resulting DR4-peptide multimer complexes were subjected to size exclusion on a Superdex-200 column to separate the tetramer complexes from protein aggregates and lower molecular weight complexes and excess fre DR4-peptide. The tetramer complexes were concentrated using Centicon-30 concentrators and stored at 0.1-0.3 mg/ml in a mixture of protease inhibitors.

These complexes could be used to detect specific T cells in a flow cytometry assay as described by Svendsen et al. (2004) Tracking of Proinflammatory Collagen-Specific T cells in Early and Late Collagen-Induced Arthritis in Humanized mice. J. Immunol. 173:7037-7045.

Example 6

This example describes how an activated divinylsylfone-dextran (270 kDa)(VS-dex270) was coupled with streptavidin (SA) and Allophycocyanin (APC). Such molecules can be used as multimerization domains for attachment of biotinylated MHC molecules.

1. Streptavidin (approx. 100 mg SA/ml in 10 mM HEPES, 0.1M NaCl, pH 7.85) was dialysed with gentle stirring for 2 days against 10 mM HEPES, 0.1M NaCl, pH 7.85 (20 fold excess volume) at 2-8° C. with 1 buffer change/day.
2. 5 ml of APC from a homogen suspension (approx. 10 mg/ml) was centrifuged 40 min. at 3000 rpm. The supernatant was discharged and the precipitate dissolved in 5 ml of 10 mM HEPES, 0.1M NaCl, pH 7.85. This APC solution was dialysed with gentle stirring in the dark for 2 days against 10 mM HEPES, 0.1M NaCl, pH 7.85 (20 fold excess volume) at 2-8° C. with 1 buffer change/day.
3. The APC-solution was concentrated to 1 ml and the concentration measured to 47 g/L at UV 650 nm. The A650/A278-ratio was measured to 4.2.
4. The SA-solution was filtrated through a 0.45 μm filter and the protein concentration was measured to 61.8 g SNL at UV 278 nm.
5. Conjugation: The reagents was mixed to a total volume of 500 μl in the following order with 8.1 mol SA/mol Dex and 27 mol APC/mol Dex.:
   a) 90 μl water
   b) 160 μl activated VS-dex270
   c) 23 μl SA (61.8 g/L)~8.1 equivalents,
   d) 177 μl APC (47 g/L)~27 equivalents,
   e) 50 μl of 100 mM HEPES, 1M NaCl, pH 8

The reaction was placed in a water bath with stirring at 30° C. in the dark for 18 hours.
6. The coupling was stopped by adding 50 μl 0.1M ethanolamine, pH 8.0.
7. The conjugate was purified on a Sephacryl S-200 column with 10 mM HEPES, 0.1M NaCl buffer, pH 7.2.
8. 3 peaks were collected (peak 1: APC-SA-dex270; peak 2: Free APC; peak 3: Free SA). Volume, UV A650 and UV A278 were measured.
9. The concentration of dextran270, APC/Dex and SA/Dex were calculated to $22.4\times10^{-8}$ M; 3.48 and 9.54 respectively.
10. The conjugate were added $NaN_3$ and BSA to a final concentration of 15 mM and 1% respectively. The volume was adjusted with 10 mM HEPES, 0.1M NaCl, pH 7.2 to a final concentration of $16\times10^{-8}$M Dex270.
11. The conjugate were kept at 2-8° C. in dark until further use.

The conjugate can be coupled with biotinylated MHC molecules to generate a MHC multimer as described in example 8.

Example 7

This example describes how an activated divinylsylfone-dextran (270 kDa)(VS-dex270) was coupled with streptavidin (SA) and R-phycoerythrin (RPE).

The coupling procedure described for coupling of SA and APC to VS-dex270 (as described in example 6) were followed with the exception that APC were replaced with RPE.

The conjugate can be coupled with biotinylated MHC molecules to generate a MHC multimer as described in example 8.

Example 8

This example describes how to couple an empty MHC or a MHC-complex to a dextran multimerization domain through a non-covalent coupling, to generate a MHC-dextramer. The MHC-dextramer in this example consisted of APC-streptavidin (APC-SA)-conjugated 270 kDA dextran and a biotinylated, folded MHC-complex composed of β2m, HLA-A*0201 heavy chain and the peptide NLVPMVATV (SEQ ID NO 201990). The APC-SA conjugated 270 kDA dextran was generated as described in example 6 and contained 3.7 molecules of SA per dextran (each SA can bind 3 MHC-complexes) and the concentration was $16\times10^{-8}$ M. The concentration of the HLA-A*0201/NLVPMVATV-complex (SEQ ID NO 201990) was 4 mg/ml (1 μg=20,663 pmol). The molecular concentration of the MHC-complex was $8.27\times10^{-5}$M.

The MHC-complex was attached to the dextran by a non-covalent Biotin-Streptavidin interaction between the biotinylated Heavy Chain part of the MHC-complex and the SA, conjugated to dextran.

Here follows a protocol for how to produce 1000 μl of a MHC-dextramer solution with a final concentration of approximately $32\times10^{-9}$M:

1. 200 μL 270 kDA vinylsulfone-activated dextran, corresponding to $3.2\times10^{-11}$ mol, and 4 μl MHC-complex, corresponding to $3.55\times10^{-1o}$ mol was mixed and incubated at room temperature in the dark for 30 min.
2. A buffer of 0.05M Tris-HCl, 15 mM $NaN_3$, 1% BSA, pH 7.2 was added to a total volume of 1000 μl.
3. The resulting MHC-dextramer preparation may now be used in flow cytometry experiments.

Example 9

This is an example of how to make and use MHC multimers that are trimers consisting of a streptavidin multimerization domain with 3 biotinylated MHC complexes and 1 fluorophore molecule attached to the biotin binding pockets of streptavidin. MHC complexes consisting of HLA-A*0201 heavy chain, beta2microglobulin and NLVPMVATV (SEQ ID NO 201990) peptide or the negative control peptide GLAGDVSAV (SEQ ID NO 201989) were generated as described elsewhere herein. The fluorophore in this example was Fluorescein-linker molecules as shown in FIG. 9. Each of these molecules consist of a linker-biotin molecule mounted with 4 trippel fluorescein-linker molecules. The linker-biotin molecule was here H-L30-Lys($NH_2$)-L30-Lys($NH_2$)-L30-Lys($NH_2$)L300Lys(caproylamidobiotin)-$NH_2$ where L30 was a 30 atom large linker and L300 was a 300 atom large linker. Both L30 and L300 was composed of multiple L15 linkers with the structure shown in FIG. 9B. Linker-biotin molecules were generated as follows: Downloaded Boc-L300-Lys(Fmoc) resin (100 mg) was deprotected and subjected to coupling with Boc-Lys(2C1Z)-OH, Boc-L30-OH, Boc-Lys(2C1Z)-OH, Boc-L30-OH, Boc-Lys(2CIZ)-OH then Boc-L30-OH. The resin was Fmoc deprotected and reacted twice (2×2 h) with caproylamido biotin NHS ester (25 mg in 0.5 mL NMP+25 microL DIPEA). The resin was washed with TFA and the product cleaved off with TFA:TFMSA:mCresol:thioanisol (6:2:1:1), 1 mL, precipitated with diethyl ether and purified by RP-HPLC. MS calculated for $C_{300}H_{544}N_{64}O_{137}S$ is 7272.009 Da, found 7271.19 Da.

Alternatively linker-biotin molecule was H-L60-Lys($NH_2$)-L60-Lys($NH_2$)-L60-Lys($NH_2$)L300Lys(caproylamidobiotin)-$NH_2$ and made from downloaded Boc-L300-Lys(Fmoc) resin (100 mg), and then prepared analogously to H-L30-Lys($NH_2$)-L30-Lys($NH_2$)-L30-Lys($NH_2$)L300Lys(caproylamidobiotin)-$NH_2$. MS calculated for $C_{360}H_{652}N_{76}O_{167}S$ is 8749.5848 Da and was found to be 7271.19 Da. Yield 3 mg. The trippel fluorescein-linker molecules was here betaalanin-L90-Lys(Flu)-L90-Lys(Flu)-L90-Lys(Flu)-$NH_2$ where Lys=Lysine, Flu=Fluorescein and L90 is a 90 atom linker (se FIG. 9 for further details). The trippel-fluorescein-linker molecule was generated as follows: Downloaded Boc-Lys(Fmoc) resin, 2 g, was Boc deprotected and subjected to 3×coupling with Boc-L30-OH, Boc-Lys(Fmoc)-OH, 3×Boc-L30-OH, Boc-Lys(Fmoc)-OH, 3×Boc-L30-OH. The three Fmoc groups were removed and carboxyfluorescein, 301 mg, activated with HATU, 274 mg, and DIPEA, 139 μL, in 8 mL NMP, was added to the resin twice for 30 min. The resin was Boc deprotected and subjected to 2×30 min coupling with beta-alanine-N,N-diacetic acid benzyl ester, followed by 5 min treatment with 20% piperidine in NMP. The resin was washed with DCM, then TFA and the product was cleaved off the resin, precipitated with diethyl ether and purified by RP-HPLC. Yield was 621 mg. MS calculated for C268H402N44O116 is 6096.384 Da, while MS found was 6096 Da.

Biotin-linker molecule were coupled together with 4 trippel fluorescein-linker molecules as follows: (500 nmol) was dissolved in 88 microliter NMP+2 μl pyridine and activated for 10 min at room temperature (conversion to cyclic anhydride) by addition of 10 μl N,N' diisopropylcarbodiimide. Following activation the trippel fluorescein-linker was precipitated with diethyl ether and redissolved in 100 microliter NMP containing 10 nmol biotin-linker. Once dissolved the coupling was initiated by addition of 5 μl diisopropyl ethyl amine, and was complete after 30 min.

Streptavidin and Fluorescein-linker molecules are then mixed in a molar ration of 1:1 and incubated for ½ hour. Then MHC complexes are added in 3-fold molar excess in respect to streptavidin and incubated for another ½ hour. Alternatively, MHC complexes are added first, then Fluorescein-linker molecules or MHC complexes are mixed with Fluorescein-linker molecules before addition to Streptavidin.

These MHC multimers are then used to stain CMV specific T cells in a flow Cytometry experiment. $1\times10^6$ purified HPBMC from a donor with T cells specific for HLA-A*0201(NLVPMVATV) (SEQ ID NO 201990) are incubated with 10 μl of each of the two HLA-A*0201 (peptide)/Fluorescein constructs described above for 10 minutes in the dark at room temperature with a cell concentration of $2\times10^7$ cells/ml. 10 μl of mouse-anti-human CD8/PB (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are resuspended in 400-500 μl PBS; pH=7.2 and analyzed on a flowcytometer.

In the above described example the Fluorescein-linker is as shown in FIG. 9 but the linker molecule can be any linker molecule as described in patent application WO 2007/015168 A2 (Lohse (2007)) or alternatively chemical biotinylated fluorochrome can be used instead of Fluorescein-linker molecules. The MHC complexes described in this example is a MHC I molecule composed of HLA-A*0201 heavy chain, beta2microglobulin and NLVPMVATV (SEQ ID NO 201990) peptide but can in principle be any MHC complex or MHC like molecule as described elsewhere herein.

Example 10

This is an example of how to make MHC multimers consisting of a streptavidin multimerization domain with 3 biotinylated MHC complexes attached to the biotin binding pockets of streptavidin and how to use such trimer MHC complexes to detect specific T cells by direct detection of individual cells in a flow cytometry experiment by addition of a biotinylated fluorophore molecule. In this example the fluorophore is Fluorescein linker molecules constructed as described elsewhere herein.

MHC complexes consisting of HLA-A*0201 heavy chain, beta2microglobulin and peptide are generated as described elsewhere. MHC complexes are incubated with streptavidin in a molar ratio of 3:1 for ½ hour.

These trimer MHC multimers are then used to stain CMV specific T cells in a flow Cytometry experiment. $1\times10^6$ purified HPBMC from a donor with T cells specific for HLA-A*0201(NLVPMVATV) (SEQ ID NO 201990) are incubated with 10 μl HLA-A*0201(peptide) multimer construct for 10 minutes in the dark at room temperature with a cell concentration of $2\times10^7$ cells/ml. Then Fluorescein linker molecules (as described in Example 9) are added and incubation continued for 5 minutes. 10 μl mouse-anti-human CD8/PB antibody (clone DK25 from Dako) is added and the incubation continued for another 20 minutes at 4° C. in the dark. The samples are then washed by addition of 2 ml PBS; pH=7.2 followed by centrifugation for 5 minutes at 200×g and the supernatant removed. Cells are resuspended in 400-500 μl PBS; pH=7.2 and analyzed on a flowcytometer.

In this example the Fluorescein-linker is as shown in FIG. 9 but the linker molecule can be any linker molecule as described in Lohse, Jesper, (2007), WO 2007/015168 A2 or alternative chemically biotinylated fluorochrome may be used. The MHC complexes described in this example is a MHC I molecule composed of HLA-A*0201 heavy chain, beta2microglobulin and NLVPMVATV (SEQ ID NO 201990) peptide but can in principle be any MHC complex or MHC like molecule as described elsewhere herein.

Example 11

This is an example of how to make MHC multimers where the multimerization domain is dextran and the MHC complexes are chemically conjugated to the dextran multimerization domain.

MHC complexes consisting of HLA-A*0201 heavy chain, beta2microglobulin and NLVPMVATV (SEQ ID NO 201990) peptide or the negative control peptide GLAGDVSAV (SEQ ID NO 201989) are generated as described elsewhere herein. Dextran with a molecular weight of 270 kDa is activated with divinylsulfone. Activated Dextran is then incubated with MHC and RPE in a 0.05 M $NaCHO_3$ buffer; pH=9.5 with a molar ratio between MHC and Dextran of 30-60 and a molar ratio between RPE and dextran of 3-7:1 The mixture is placed in a water bath at 30° C. for 16 hours. Excess fluorochrome, MHC and dextran are removed by FPLC using a sephacryl S-300 column.

These MHC/RPE dextramers are then used to stain CMV specific T cells in a flow Cytometry experiment. Briefly, $1\times10^6$ purified HPBMC from a donor with T cells specific for HLA-A*0201(NLVPMVATV) (SEQ ID NO 201990) are incubated with 10 μl of each of the two HLA-A*0201 (peptide)/RPE constructs described above for 10 minutes in the dark at room temperature with a cell concentration of $2\times10^7$ cells/ml. 10 μl mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 μl PBS; pH=7.2 and analyzed on a flow cytometer.

Example 12

This is an example of how to make MHC multimers where the multimerization domain is dextran and MHC complexes are MHC I molecules chemically conjugated to dextran multimerization domain and the dextran multimerization domain also have fluorochrome chemically coupled.

Human beta2microglobulin is coupled to dextran as follows. Dextran with a molecular weight of 270 kDa is activated with divinylsulfone. Activated dextran is incubated with human beta2microglobulin and RPE in a 0.05 M $NaCHO_3$ buffer; pH=9.5 with a molar ratio between beta2microglobulin and Dextran of 30-60 and a molar ratio between RPE and dextran of 3-7:1. The molar ratio of the final product is preferable 4-6 RPE and 15-24 beta2microglobulin per dextran. The mixture is placed in a water bath at 30° C. for 16 hours. Excess fluorochrome, beta2microglobulin and dextran are removed by FPLC using a sephacryl S-300 column. The beta2microglobulin-RPE-dextran construct is then refolded in vitro together with heavy chain and peptide using the following procedure. 200 ml refolding buffer (100 mM Tris, 400 mM L-arginin-HCL, 2 mM NaEDTA, 0.5 mM oxidized Gluthathione, 5 mM reduced Glutathione, pH 8.0) supplied with protease inhibitors PMSF, Pepstatin A and Leupeptin (to a final concentration of 1 mM, 1 mg/I and 1 mg/I, respectively) is made and cooled to 10° C. 12 mg NLVPMVATV (SEQ ID NO 201990) peptide is dissolved in DMSO and added to the refolding buffer together with 20-30 mg beta2microglobulin-RPE-dex and 6 mg HLA-A*0201 heavy chain. Incubation at 10° C. for 4-8 hours, then 20-30 mg beta2microglobulin-RPE-dex and 6 mg HLA-A*0201 heavy chain is added and incubation continued for 4-8 hours. Another 20-30 mg beta2microglobulin-RPE-dex and 6 mg HLA-A*0201 heavy chain is added and incubation continued for 6-8 hours. The folding reaction is filtrated through a 0.2 μm filter to remove larger aggregates and then buffer exchanged into a buffer containing 20 mM Tris-HCl, 50 nM NaCl; pH=8.0 followed by concentration to 1-2 ml sample. Dextran-RPE-MHC complexes are then separated from excess heavy chain and peptide by size exclusion chromatography using a sephacryl S-300, S-400 or sephacryl S-500 column.

These MHC/RPE dextramers may be used to stain CMV specific T cells in a flow Cytometry experiment. Briefly, $1\times10^6$ purified HPBMC from a donor with T cells specific for HLA-A*0201(NLVPMVATV) (SEQ ID NO 201990) are incubated with 10 μl of each of the two HLA-A*0201

(peptide)/RPE constructs described above for 10 minutes in the dark at room temperature with a cell concentration of $2\times10^7$ cells/ml. 10 μl of mouse-anti-human CD8/PB antibody (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The cells are then resuspended in 400-500 μl PBS; pH=7.2 and analyzed on a flowcytometer.

Example 13

The preparation of a Pentamer MHC multimer is described in e.g. (United States Patent application 20040209295). Briefly, the following steps lead to a fluorescent Pentamer MHC multimer reagent:

The following is a detailed example for cloning, expressing, and purifying a pentameric class I MHC multimer, which comprises a chimeric fusion of .beta.2m with COMP. The chimeric .beta.2m-COMP protein is expressed in insoluble inclusion bodies in *E. coli* and subsequently assembled as pentameric .beta.2m-COMP in vitro. The pentameric class I MHC peptide multimer is then formed in a second refolding reaction by combining .beta.2m-COMP pentamers and the human MHC class I .alpha. molecule known as HLA-A*0201, in the presence of an appropriate synthetic binding peptide representing the T cell antigen. In this example, a well characterized antigen derived from Epstein-Barr virus BMLF1 protein, GLCTLVAML (SEQ ID NO 201993), is used. The resultant complex is labelled with a fluorescent entity and used as a staining reagent for detecting antigen-specific T cells from a mixed lymphocyte population, in a flow cytometry application.

The strategy involves the sequential cloning into pET-24c vector of .beta.2m, yielding a construct referred to as pETBMC01, followed by the insertion of the oligomerisation domain of cartilage oligomeric matrix protein (COMP) with a biotin acceptor sequence (BP) for site-specific biotinylation with the biotin-protein ligase BirA, yielding a construct referred to as pETBMC02. Thirdly a polyglycine linker is cloned in between .beta.2m and COMP, yielding a construct referred to as pETBMC03, and finally, a serine-residue is removed by site-directed mutagenesis, which serine residue precedes the poly-glycine linker, to give the final .beta.2m-COMP/pET-24c construct, referred to as pETBMC04 (see also FIG. 3). Removal of the serine residue is carried out to avoid steric hindrance when the .beta.2m molecule is associated with the MHC class I chain protein.

The extracellular portion of .beta.2m comprises of 99 amino acids (equivalent to Ile1-Met99 of the mature protein) encoded by 74 bp-370 bp of the DNA sequence. This region of the .beta.2m sequence is amplified from a normal human lymphocyte cDNA library, by polymerase chain reaction (PCR)

beta.2m PCR product is purified from the above reaction mix using a QIAquick® PCR purification kit according to the manufacturer's instructions (Qiagen). 200 ng of purified PCR product and 1 .mu.g pET-24c vector (Novagen) are each digested with BamH I (10 U) and Nde I (10 U) restriction enzymes (New England Biolabs, NEB) for 4 h at 37.degree. C., in accordance with the manufacturer's instructions, and purified.

The gel-purified insert and vector DNA are ligated at a 1:3 molar ratio (vector:insert, 50 ng: 7.5 ng) using T4 DNA ligase (5 U; Bioline), in T4 DNA ligase buffer (as supplied) for 16 hrs at 16.degree. C.

The ligation mixtures and appropriate controls are subsequently transformed into XL1-Blue strain competent *E. coli* cells, according to the manufacturer's instructions (Stratagene). Successful transformants are selected by plating the cells on Luria-Bertani (LB) agar plates containing 30 .mu.g/ml kanamycin, and incubating overnight at 37.degree. C.

A selection of single colonies from the bacterial transformation plates are screened by PCR with T7 promoter (1 .mu.M) and T7 terminator (1 .mu.M) primers (Sigma Genosys, see Appendix I for primer sequences), which are complementary to regions of the pET vector flanking the cloning site. Amplification is carried out using Taq DNA polymerase (1 U, Bioline) in Taq reaction buffer (as supplied), supplemented with 2 mM MgSO.sub.4 and 0.2 mM dNTPs, using 25 thermal-cycling reactions as detailed above. Successful transformants generated a DNA fragment of approximately 500 bp, ascertained by 1.5% agarose gel electrophoresis.

Bacterial transformants that generated the correct size of PCR products are inoculated into 6 ml of sterile LB-kanamycin medium and incubated overnight at 37.degree. C. with 200 rpm shaking. pETBMC01 plasmid DNA is recovered from the bacterial cultures using a QIAprep® Spin Mini-prep kit according to the manufacturer's instructions (Qiagen). The presence of the .beta.2m fragment in these plasmids is further verified by automated DNA sequencing.

The sequence of the oligomerisation domain of COMP is obtained from the Genbank database (accession #1705995) and a region encoding the coiled-coil domain (amino acids 21-85) is selected based on self-association experiments of COMP (Efinov et al., FEBS Letters 341:54-58 (1994)). A biotin acceptor sequence 'BP': SLNDIFEAQKIEWHE [SEQ ID NO 202011] is incorporated at the C terminus and an additional 14 amino acid linker, PQPQPKPQPKPEPET [SEQ ID NO 202012] is included to provide a physical separation between the COMP oligomerising domain and BP.

The whole region is synthesized using the overlapping complementary oligonucleotides, and purified COMP-BP and 1 .mu.g pETBMC01 vector are digested for 4 hrs at 37.degree. C. using Hind III (10 U) and Xho I (10 U) restriction enzymes (NEB), as described in Section 1.1. The digestion products are purified, ligated, transformed and PCR screened as in Section 1.1. Plasmids positive from the screen are purified and sequenced as described in Section 1.1.

The poly-glycine linker is synthesized by annealing overlapping oligonucleotides. Since the nucleotide sequence of the polyGlycine linker only incorporates the 5' overhang of the cut BamH I restriction site, and the 3' overhang of the cut Hind III nucleotide recognition motifs, there is no need to digest the annealed product to produce the complementary single-stranded overhangs suitable for subsequent ligation. The oligonucleotides are phosphorylated and annealed as described in Section 1.2.

pETBMC02 is digested with BamH I (10 U) and Hind III (10 U). Ligation of the annealed poly-glycine linker into pETBMC02 was as described previously (Section 1.1), assuming 96 fmoles of annealed oligonucleotide/.mu.l. The transformation and PCR-screening reactions are as described in Section 1.1, but in addition, the presence of an inserted linker is verified by a restriction enzyme digestion of the PCR screen product to ascertain the presence or absence of a Sal I restriction site. Successful transformants are not susceptible to Sal I digestion, given the removal of the site from the plasmid vector backbone. Purification of pETBMC03 and automated sequencing is as described in Section 1.1.

Analysis of X-ray crystallography models of MHC class I molecules reveal that the C terminus of .beta.2m closely abuts the .alpha.3 domain of the .alpha. chain. It is therefore desirable to achieve maximum flexibility at the start of the poly-glycine linker. The extracellular portion of HLA-A*0201.alpha. chain (EMBL M84379) comprises of 276 amino acids (equivalent to Gly1-Pro276 of the mature protein) encoded by bases 73-900 of the messenger RNA sequence. In the following HLA-A*0201 is used interchangeably with A*0201. This region of the A*0201 sequence is amplified from a normal human lymphocyte cDNA library by PCR, using suitable primers which incorporated NcoI and BamHI restriction sites respectively. The procedure for cloning the A*0201 insert into Nco I/BamH I-digested pET-11d vector (Novagen) is essentially as described for .beta.2m in Section 1.1.

An identical procedure is carried out to produce either .beta.2m-COMP or A*0201 .alpha. chain proteins. Plasmid DNA is transformed into an *E. coli* expression host strain in preparation for a large scale bacterial prep. Protein is produced as insoluble inclusion bodies within the bacterial cells, and is recovered by sonication. Purified inclusion bodies are solubilised in denaturing buffer and stored at −80.degree. C. until required.

Purified plasmid DNA is transformed into the BL21(DE3) pLysS *E. coli* strain, which carries a chromosomal copy of the T7 RNA polymerase required to drive protein expression from pET-based constructs. Transformations into BL21 (DE3)pLysS competent cells (Stratagene) are carried out with appropriate controls.

A single bacterial transformant colony is innoculated into 60 ml sterile LB medium, containing appropriate antibiotics for selection, and left to stand overnight in a warm room (.about.24.degree. C.) The resulting overnight culture is added to 6 litres of LB and grown at 37.degree. C. with shaking (.about.240 rpm), up to mid-log phase (OD-.sub.600=0.3-0.4). Protein expression is induced at this stage by addition of 1.0 ml of 1M IPTG to each flask. The cultures are left for a further 4 h at 37.degree. C. with shaking, after which the cells are harvested by centrifugation and the supernatant discarded.

The bacterial cell pellet is resuspended in ice-cold balanced salt solution and sonicated (XL series sonicator; Misonix Inc., USA) in a small glass beaker on ice in order to lyse the cells and release the protein inclusion bodies. Once the cells are completely lysed the inclusion bodies are spun down in 50 ml polycarbonate Oak Ridge centrifuge tubes in a Beckman high-speed centrifuge (J2 series) at 15,000 rpm for 10 min. The inclusion bodies are then washed three times in chilled Triton® wash This is followed by a final wash in detergent-free wash buffer.

The resultant purified protein preparation is solubilised in 20-50 ml of 8 M urea buffer, containing 50 mM MES, pH 6.5, 0.1 mM EDTA and 1 mM DTT, and left on an end-over-end rotator overnight at 4.degree. C. Insoluble particles are removed by centrifugation and the protein yield is determined using Bradford's protein assay reagent (Bio-Rad Laboratories) and by comparison with known standards. Urea-solubilised protein is dispensed in 10 mg aliquots and stored at −80.degree. C. for future use.

Assembly of .beta.2m-COMP from the urea-solubilised inclusion bodies is performed by diluting the protein into 20 mM CAPS buffer, pH 11.0, containing 0.2 M sodium chloride and 1 mM EDTA, to give a final protein concentration of 1.5 mg/ml. The protein is oxidised at room temperature by addition of oxidised and reduced glutathione to final concentrations of 20 mM and 2 mM, respectively. Following an overnight incubation, disulphide bond formation is analysed by non-reducing SDS-PAGE on 10% bis-tricine gels (Invitrogen).

The protein mixture is subsequently buffer exchanged into 20 mM Tris, pH 8.0, 50 mM sodium chloride ('S200 buffer'), and concentrated to a final volume of 4.5 ml, in preparation for enzymatic biotinylation with BirA (Affinity, Denver, Colo.). 0.5 ml of 10.times. BirA reaction buffer (as supplied) is added, and recombinant BirA enzyme at 10 .mu.M final concentration, supplemented with 10 mM ATP, pH 7.0. A selection of protease inhibitors is also used to preserve the proteins: 0.2 mM PMSF, 2 .mu.g/ml pepstatin and 2 .mu.g/ml leupeptin. The reaction is left for 4 hours at room temperature.

Biotinylated .beta.2m-COMP is purified by size exclusion chromatography (SEC) on a Superdex® 200 HR 26/60 column (Amersham Biosciences), running S200 buffer.

500 ml of refolding buffer is prepared as follows: 100 mM Tris, pH 8.0, 400 mM Larginine hydrochloride, 2 mM EDTA, 5 mM reduced glutathione and 0.5 mM oxidised glutathione, dissolved in deionised water and left stirring at 4.degree. C. 15 mg of lyophilised synthetic peptide GLCTLVAML (SEQ ID NO 201993) is dissolved in 0.5 ml dimethylsulfoxide and added to the refolding buffer whilst stirring. 50 mg of biotinylated pentameric .beta.2m-COMP and 30 mg of A*0201.alpha. chain is added sequentially, injected through a 23 gauge hypodermic needle directly into the vigorously-stirred buffer, to ensure adequate dispersion. The refolding mixture is then left stirring gently for 16 hours at 4.degree. C.

The protein refolding mixture is subsequently concentrated from 500 ml to 20 ml using a MiniKros hollow fibre ultrafiltration cartridge (Spectrum Labs, Rancho Dominguez, Calif.) with a 30 kD molecular weight cutoff. Further concentration of the complex from 20 ml to 5 ml is carried out in Centricon Plus-20 centrifugal concentrators (30 kD molecular weight cut-off) according to the manufacturers instructions, followed by buffer exchange into S200 buffer using disposable PD10 desalting columns (Amersham Biosciences), according to the manufacturer's instructions. Final volume is 7.5 ml. The concentrated protein refold mixture is first purified by SEC on a Superdex® 200 HR 26/60 gel filtration chromatography column, as in Section 4.2. Fractions containing protein complexes in the region of 310 kD is collected.

Fractions collected from SEC are pooled and subjected to further purification by anion exchange chromatography on a MonoQ® HR 5/5 column (Amersham Biosciences), running a salt gradient from 0-0.5 M sodium chloride in 20 mM Tris over 15 column volumes. The dominant peak is collected. Protein recovery is determined using the Bradford assay.

Since each streptavidin molecule is able to bind up to 4 biotin entities, final labelling with phycoerythrin (PE)-conjugated streptavidin is carried out in a molar ratio of 1:0.8, streptavidin to biotinylated pentamer complex respectively, taking into account the initial biotinylation efficiency measurement made for .beta.2m-COMP in Section 4.2. The total required amount of pentamer complex is subdivided (e.g. into 5 equal amounts) and titrated successively into streptavidin-PE. The concentration of A*0201 pentamer-streptavidin complex is adjusted to 1 mg/ml with phosphate buffered saline (PBS), supplemented with 0.01% azide and 1% BSA.

This resultant fluorescent Pentamer MHC multimer reagent is stored at 4.degree until use. This reagent may be used for detection of antigen specific T cells by flow cytometry, IHC or other procedures described herein useful for detection of specific T cells using MHC multimers.

Pentamer MHC multimers are used in the following interchangeably with Pentamers or pentamer complexes.

Example 14

This is an example of how the directed approach described elsewhere herein for selection of antigenic peptides (as described elsewhere herein) is applied to an antigenic protein with known protein sequence, the cancer protein BclX(L) encoded by the human genome. The purpose is to predict BclX(L) peptide sequences that binds to MHC class 1 molecules for use in construction of MHC-'mers designed to be used for analytical, diagnostic, prognostic, therapeutic and vaccine purposes, through the interaction of the MHC'mers with human BclX(L) specific T-cells. Prediction is carried out using the known preferences of the 24 HLA class 1 alleles included in the www.cbs.dtu.dk/services/NetMHC/database (FIG. 10).

The result of the prediction software is used to find all strong and weak 8-, 9-, 10- and 11-mer peptide binders of the 24 HLA class 1 alleles. The result can be seen in FIG. 26. The MHC class 1 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 15 Prediction of MHC Class 2 Peptide Binders for Human Cancer Protein BclX(L) Using Directed Approach This is an example of how the directed approach described elsewhere herein for selection of antigenic peptides (as described elsewhere herein) is applied to an antigenic protein with known protein sequence, the cancer protein BclX(L) encoded by the human genome. The purpose is to predict BclX(L) peptide sequences that binds to MHC class 2 molecules for use in construction of MHC-'mers designed to be used for analytical, diagnostic, prognostic, therapeutic and vaccine purposes, through the interaction of the MHC'mers with human BclX(L) specific T-cells. Prediction is carried out using the known preferences of the 14 HLA class 2 alleles included in the www.cbs.dtu.dk/services/NetMHCII/database (FIG. 10).

The result of the prediction software is used to find all strong and weak 15-mer peptide binders of the 14 HLA class 2 alleles. It also finds the important central nonamer core peptide sequence of each binding peptide. The result can be seen in FIG. 27. The MHC class 2 alleles for whom no binders are predicted are omitted from the list. The listed peptides are ranked according to decreased binding affinity for the individual MHC alleles. Strong binders are defined as binders with an affinity value of less than 50 nM and weak binders with a value of less than 500 nM. Only peptides defined as weak or strong binders are shown.

Example 16. Test of Predicted BclX(L) 10-Mer Binding Peptide Functionality in

ELISPOT

In example 14 the best binding BclX(L) 10-mer peptide for HLA-A*0201 was identified to be YLNDHLEPWI (SEQ ID NO 201987). This peptide has then been tested in ELISPOT to see if it were able to detect the presence Bcl-X(L)-specific, CD8 positive T cells in PBL (Peripheral Blood Lymphocytes) from a breast cancer patient. PBL from a breast cancer patient was analyzed by ELISPOT ex vivo either with or without the Bcl-X(L)173-182 peptide (YLNDHLEPWI; (SEQ ID NO 201987)), 106 PBL/well in doublets. The number of spots was counted using the Immunospot Series 2.0 Analyzer (CTL Analysers). The result is given as number of spots above the pictures of the result as shown in FIG. 11 and it clearly shows the presence of BclX(L) specific T-cells and thereby the functionality of the peptide as compared to the absence of added peptide.

This example is from *Cancer Immunol Immunother April;* 56(4)527-33.

Example 17. Test of Predicted BclX(L) 10-Mer Binding Peptide Functionality in Flow Cytometry In example 14 the best binding BclX(L) 10-mer peptide for HLA-A*0201 was identified to be YLNDHLEPWI (SEQ ID NO 201987). In the present example the functionality of the peptide is shown in a flow cytometric analysis of PBL from the patient was analyzed ex vivo by Flow cytometry to identify Bcl-X(L)173-182 specific CD8 T cells using the dextramer complex HLA-A2/Bcl-X(L)173-182-APC, 7-AAD-PerCP, CD3-FITC, and CD8-APC-Cy7. The dextramer complex HLA-A2/HIV-1 pol476-484-APC was used as negative control. The result (FIG. 12) clearly demonstrate that a MHC Dextramer HLA-A*0201/YLNDHLEPWI (SEQ ID NO 201987) complex detects BclX(L) antigen specific CD-8 cells in the patient sample at a level of 0.03% as compared with the negative control using HIV specific MHC Dextramer.

This example is from *Cancer Immunol Immunother* April; 56(4)527-33.

Example 18. Use of BclX(L) Specific MHC Dextramer for Sorting of Antigen Specific CD8 T Cells from Patient Sample The antigen specific CD8 positive T-cells of example 17 were sorted out during the flow cytometric analysis using the MHC Dextramer HLA-A*0201/YLNDHLEPWI (SEQ ID NO 201987). The detectable population of dextramer positive CD8 T cells was sorted as single cells into 96 well plates using the following protocol:

Small lymphocytes were gated by forward and side scatter profile, before cloning according to CD8/MHC-multimer double staining. CD8/MHC-multimer double-positive cells were sorted as single cells into 96 well plates (Nunc) already containing $10^5$ cloning mix cells/well. The cloning mix was prepared containing $10^6$ irradiated (20 Gy) lymphocytes from three healthy donors per ml in X-vivo with 5% heat-inactivated human serum, 25 mM HEPES buffer (GibcoBRL), 1 μg/ml phytohemagglutinin (PHA) (Peprotech) and 120 U/ml IL-2. The cloning mix was incubated for two hours at 37° C./5% $CO_2$, prior to cloning. After cloning, the plates were incubated at 37° C./5% $CO_2$. Every 3-4 days 50 μl fresh media were added containing IL-2 to a final concentration of 120 U/ml. Following 10-14 days of incubation, growing clones were further expanded using cloning mix cells. Consequently, each of the growing clones were transferred (split) into two or three wells (depending on the number of growing cells) of a new 96 well plate containing $5×10^4$ cloning mix cells/well. Clones that were not growing at this time were incubated for another week with IL-2, and then expanded. Subsequently, the specificity of the growing clones was tested in a $^{51}$Cr-release assay or by FACS.

Out of twenty-isolated dextramer positive CD8 T cells, ten were able to be expanded into T-cell clones.

Example 19. Demonstration of Specific Cytolytic Activity of Isolated BclX(L) Specific CD8 T-Cells The ten expanded T cell clones isolated by Flow sorting as shown in example 18 were tested for their specificity by analysis in a standard 51-Cr release assay. For this purpose, T2 cells loaded with either Bcl-X(L)173-182 peptide or an irrelevant peptide (BA4697-105, GLQHWVPEL) (SEQ ID NO 201988) were used as target cells. Five CD8 T-cell clones (Clone 8, 9, 10, 11, and 12) effectively lysed T2 cells pulsed with Bcl-X(L)173-182 without killing of T2 cells pulsed with an irrelevant peptide (FIG. 13). One of these BclX(L)173-182 specific CD8 T-cell clones [Clone 9] were expanded for further analyses. The remaining five expanded clones (Clone 7, 13, 15, 17, and 18) did not show specific lysis against T2 cells pulsed with Bcl-X(L)173-182 peptide.

This example is from *Cancer Immunol Immunother* April; 56(4)527-33.

Example 20. Demonstration of the Cytotoxic Capacity of a BclX(L)173-182 Specific CD8 T Cell Clone Isolated by Flow Aided Sorting of Antigen (HLA-A*0201/YLNDHLEPWI) (SEQ ID NO 201987) Specific T Cells The Bcl-X(L)173-182 specific clone 9 from example 19 was expanded for additional 2 weeks before the cytotoxic potential was examined further in 51Cr-release assays. Two assays were performed a Cell lysis of T2 cells pulsed with Bcl-X(L)173-182 peptide or an irrelevant peptide (BA4697-105, GLQHWVPEL) (SEQ ID NO 201988) in three E:T ratios. b Cell lysis of T2 cells pulsed with different concentrations of Bcl-X(L)173-182 peptide at the E:T ratio 1:1 The result is given in FIG. 14. As can be seen the presence of the specific peptide is necessary to get killing of the target cell and the effect of the peptide is significant even at low concentrations.

This example is from *Cancer Immunol Immunother* April; 56(4)527-33.

Example 21. Synthesis of a Comprehensive Library of Antigenic Peptides of Variable Size Derived from a Full-Length Antigen Sequence In this example it is described how virtually all of the possible 8'- to 20'-mer peptide epitopes of an antigen may be synthetically prepared by modification of the standard Fmoc peptide synthesis protocol.

N-α-amino acids are incorporated into a peptide of the desired sequence with one end of the sequence remaining attached to a solid support matrix. All soluble reagents can be removed from the peptide-solid support matrix by filtration and washed away at the end of each coupling step. After each of the coupling steps, and after the removal of reagents, a fraction of the generated peptides are removed and recovered from the polymeric support by cleavage of the cleavable linker that links the growing peptide to solid support.

The solid support can be a synthetic polymer that bears reactive groups such as —OH. These groups are made so that they can react easily with the carboxyl group of an N-α-protected amino acid, thereby covalently binding it to the polymer. The amino protecting group can then be removed and a second N-α-protected amino acid can be coupled to the attached amino acid. These steps are repeated until the desired sequence is obtained. At the end of the synthesis, a different reagent is applied to cleave the bond between the C-terminal amino acid and the polymer support; the peptide then goes into solution and can be obtained from the solution.

Initially, the first Fmoc amino acid (starting at the C-terminal end of the antigen sequence) is coupled to a precursor molecule on an insoluble support resin via an acid labile linker. Deprotection of Fmoc is accomplished by treatment of the amino acid with a base, usually piperidine. Before coupling the next amino acid, a fraction of the synthesized peptide (for example 0.1%) is detached from the solid support, and recovered. Then additional beads carrying only the precursor molecule including the linker (for example corresponding to 0.1% of the total amount of solid support in the reaction) is added. Then the next Fmoc amino acid is coupled utilizing a pre-activated species or in situ activation.

This cycle of amino acid coupling, removal of reagents, detachment of a small fraction of synthesized peptide and recovery of these, and activation of the immobilized peptide to prepare for the next round of coupling, goes on until the entire antigen sequence has been processed.

The recovered peptides thus represent different fragments of the antigen, with varying lengths. The peptide pool thus contains most or all of the possible peptide epitopes of the antigen, and may be used in the preparation of MHC multimers as a pool.

The entire process, including the detachment of a fraction of the peptides after each round of coupling, follows standard Fmoc peptide synthesis protocols, and involves weak acids such as TFA or TMSBr, typical scavengers such as thiol compounds, phenol and water, and involves standard protecting groups.

Example 22

This is an example of how MHC multimers may be used for detection of Cytomegalovirus (CMV) specific T cells in blood samples from humans infected with CMV.

In this example the MHC multimer used are MHC complexes coupled to fluorophor-labelled dextran (Dextramers). The dextramers are used for direct detection of TCR in flow cytometry. The antigen origin is CMV, thus, immune monitoring of CMV. MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived from a region in CMV internal matrix protein pp65 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8x10e-8 M. The following MHC(peptide)/APC dextran constructs are made:

1. APC-SA conjugated 270 kDa dextran coupled with HLA-A*0201 in complex with beta2microglobulin and the peptide NLVPMVATV (SEQ ID NO 201990) derived from CMV pp65.
2. APC-SA conjugated 270 kDa dextran coupled with HLA-A*0201 in complex with beta2microglobulin and the non-sense peptide GLAGDVSAV (SEQ ID NO 201989)

The binding of the above described MHC(peptide)/APC dextran is used to determine the presence of CMV pp65 specific T cells in the blood from CMV infected individuals by flow cytometry following a standard flow cytometry protocol.

Blood from a patient with CMV infection is isolated and 100 ul of this blood is incubated with 10 μl of the MHC (peptide)/APC dextran constructs described above for 10 minutes in the dark at room temperature. 5 μl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated twice. The washed cells are resuspended in 400-500 μl PBS+1% BSA; pH=7.2 and analyzed on flowcytometer.

The presence of cells labeled with anti-CD3/PB, anti-CD8/PE and the MHC(peptide)/APC dextran construct 1 described above and thereby the presence of CMV specific T cells indicate that the patient are infected with Cytomegalovirus. Blood analysed with MHC(peptide)/APC dextran construct 2 show no staining of CD3 and CD8 positive cells with this MHC(peptide)/APC dextran construct. The result is shown in FIG. 15

The sensitivity of the above described test may be enhanced by addition of labeled antibodies specific for activation markers expressed in or on the surface of the CMV specific T cells.

We conclude that the MHC(peptide)/APC dextran constructs can be used to detect the presence of CMV specific T cells in the blood of patients infected with Cytomegalovirus.

Example 23

This is an example of how MHC multimers may be used for detection of Cytomegalovirus (CMV) specific T cells in blood samples from humans infected with CMV.

In this example the MHC multimer used are MHC complexes coupled to fluorophor-labelled multimerisation domain Streptavidin (SA), used for direct detection of TCR in flow cytometry. The antigen origin is CMV, thus, immune monitoring of CMV. MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived from a region in CMV internal matrix protein pp65 or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

3. APC-SA coupled with HLA-A*0201 in complex with beta2microglobulin and the peptide NLVPMVATV (SEQ ID NO 201990) derived from CMV pp65.
4. APC-SA coupled with HLA-A*0201 in complex with beta2microglobulin and the non-sense peptide GLAGDVSAV (SEQ ID NO 201989)

The binding of the above described MHC(peptide)/APC dextran can be used to determine the presence of CMV pp65 specific T cells in the blood from Cytomegalovirus infected individuals by flow cytometry following a standard flow cytometry protocol.

Blood from a patient with CMV is isolated and 100 ul of this blood is incubated with either of the SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the SA-MHC(peptide)/APC tetramers 3 described above and thereby the presence of CMV specific T cells will indicate that the patient are infected with Cytomegalovirus. Blood analysed with SA-MHC(peptide)/APC tetramers 4 should show no staining of CD3 and CD8 positive cells with this SA-MHC(peptide)/APC tetramer.

The sensitivity of the above described test may be enhanced by addition of labeled antibodies specific for activation markers expressed in or on the surface of the CMV specific T cells.

We conclude that the APC-SA coupled MHC(peptide) constructs may be used to detect the presence of CMV specific T cells in the blood of patients infected with Cytomegalovirus.

Example 24

This is an example of how MHC multimers may be used for detection of Cytomegalovirus (CMV) specific T cells in blood samples from humans infected with CMV.

In this example the MHC multimer used are MHC complexes coupled to any fluorophor-labelled multimerisation as described elsewhere herein. The MHC multimers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*0201 heavy chain, human beta2microglobulin and peptide derived a region in CMV internal matrix protein pp65 or a negative control peptide were generated by in vitro refolding and purified or purified from antigen presenting cells. MHC-peptide complexes are then coupled to a multimerisation domain together with APC.

The following MHC(peptide)/APC multimers are made:

5. APC-multimerisation domain coupled with HLA-A*0201 in complex with beta2microglobulin and the peptide NLVPMVATV (SEQ ID NO 201990) derived from CMV pp65.
6. APC-multimerisation domain coupled with HLA-A*0201 in complex with beta2microglobulin and the non-sense peptide GLAGDVSAV (SEQ ID NO 201989).

The binding of the above described MHC(peptide)/APC multimers can be used to determine the presence of CMV pp65 specific T cells in the blood from CMV infected individuals by flow cytometry following a standard flow cytometry protocol.

Blood from a patient with CMV infection is isolated and 100 ul of this blood is incubated with either of the MHC (peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the MHC(peptide)/APC multimers 5 described above and thereby the presence of CMV specific T cells will indicate that the patient are infected with Cytomegalovirus. Blood analysed with MHC(peptide)/APC multimer 6 should show no staining of CD3 and CD8 positive cells with this SA-MHC(peptide)/APC multimer.

The sensitivity of the above described test may be enhanced by addition of labeled antibodies specific for activation markers expressed in or on the surface of the CMV specific T cells.

We conclude that the APC-multimerisation domain coupled MHC(peptide) constructs may be used to detect the presence of CMV specific T cells in the blood of patients infected with Cytomegalovirus.

Example 25

This is an example of how MHC multimers may be used for detection of Cytomegalovirus (CMV) specific T cells in blood samples from humans infected with CMV.

In this example the MHC multimer used are MHC complexes coupled to fluorophor-labelled dextran (Dextramers). The dextramers are used for direct detection of TCR in flow cytometry. The antigen origin is CMV, thus, immune monitoring of CMV. MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived from a region in CMV internal matrix protein pp65 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contains 3.7 SA molecule and 8.95 molecules APC. The final concentration of dextran is 3.8×10e-8 M. The following MHC(peptide)/APC dextran constructs are made:

7. APC-SA conjugated 270 kDa dextran coupled with HLA-A*2402 in complex with beta2microglobulin and the peptide QYDPVAALF (SEQ ID NO 202001) derived from CMV pp65.
8. APC-SA conjugated 270 kDa dextran coupled with HLA-A*2402 in complex with beta2microglobulin and the peptide VYALPLKML (SEQ ID NO 202002) derived from CMV pp65.
9. APC-SA conjugated 270 kDa dextran coupled with HLA-A*2402 in complex with beta2microglobulin and the non-sense peptide.

The binding of the above described MHC(peptide)/APC dextran is used to determine the presence of CMV pp65 specific T cells in the blood from CMV infected individuals by flow cytometry following a standard flow cytometry protocol.

Blood from a patient with CMV infection is isolated and 100 ul of this blood is incubated with 10 μl of the MHC (peptide)/APC dextran constructs described above for 10 minutes in the dark at room temperature. 5 μl of each of each of the antibodies mouse-anti-human CD3/PB (clone UCHT1 from Dako), and mouse-anti-human CD8/PE (clone DK25 from Dako) are added and the incubation continues for another 20 minutes at 4° C. in the dark. The samples are then washed by adding 2 ml PBS; pH=7.2 followed by centrifugation for 5 minutes at 300×g and the supernatant removed. The washing step is repeated. The washed cells are resuspended in 400-500 μl PBS+1% BSA; pH=7.2 and analyzed on flowcytometer.

The presence of cells labeled with anti-CD3/PB, anti-CD8/PE and the MHC(peptide)/APC dextran constructs 7 or 8 described above and thereby the presence of CMV specific T cells indicate that the patient are infected with Cytomegalovirus. Blood analysed with MHC(peptide)/APC dextran construct 9 show no staining of CD3 and CD8 positive cells with this MHC(peptide)/APC dextran construct.

The sensitivity of the above described test may be enhanced by addition of labeled antibodies specific for activation markers expressed in or on the surface of the CMV specific T cells.

We conclude that the MHC(peptide)/APC dextran constructs can be used to detect the presence of CMV specific T cells in the blood of patients infected with Cytomegalovirus.

Example 26

This is an example of how MHC multimers may be used for detection of Cytomegalovirus (CMV) specific T cells in blood samples from humans infected with CMV.

In this example the MHC multimer used are MHC complexes coupled to fluorophor-labelled multimerisation domain Streptavidin (SA), used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived from a region in CMV internal matrix protein pp65 or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

10. APC-SA coupled with HLA-A*2402 in complex with beta2microglobulin and the peptide QYDPVAALF (SEQ ID NO 202001) derived from CMV pp65.
11. APC-SA coupled with HLA-A*2402 in complex with beta2microglobulin and the peptide VYALPLKML (SEQ ID NO 202002) derived from CMV pp65.
12. APC-SA coupled with HLA-A*2402 in complex with beta2microglobulin and the non-sense peptide.

The binding of the above described MHC(peptide)/APC dextran can be used to determine the presence of CMV pp65 specific T cells in the blood from Cytomegalovirus infected individuals by flow cytometry following a standard flow cytometry protocol.

Blood from a patient with CMV is isolated and 100 ul of this blood is incubated with either of the SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 10 or 11 described above and thereby the presence of CMV specific T cells will indicate that the patient are infected with Cytomegalovirus. Blood analysed with SA-MHC(peptide)/APC tetramers 12 should show no staining of CD3 and CD8 positive cells with this SA-MHC(peptide)/APC tetramer.

The sensitivity of the above described test may be enhanced by addition of labeled antibodies specific for activation markers expressed in or on the surface of the CMV specific T cells.

We conclude that the APC-SA coupled MHC(peptide) constructs may be used to detect the presence of CMV specific T cells in the blood of patients infected with Cytomegalovirus.

Example 27

This is an example of how MHC multimers may be used for detection of Cytomegalovirus (CMV) specific T cells in blood samples from humans infected with CMV.

In this example the MHC multimer used are MHC complexes coupled to any fluorophor-labelled multimerisation as described elsewhere herein. The MHC multimers are used for direct detection of TCR in flow cytometry. The antigen origin is CMV, thus, immune monitoring of CMV.

MHC multimers carrying CMV specific peptides is in this example used to detect the presence of CMV specific T cells in the blood of patients infected with Cytomegalovirus.

Purified MHC-peptide complexes consisting of HLA-A*2402 heavy chain, human beta2microglobulin and peptide derived a region in CMV internal matrix protein pp65 or a negative control peptide were generated by in vitro refolding and purified or purified from antigen presenting cells. MHC-peptide complexes are then coupled to a multimerisation domain together with APC.

The following MHC(peptide)/APC multimers are made:

13. APC-multimerisation domain coupled with HLA-A*2402 in complex with beta2microglobulin and the peptide QYDPVAALF (SEQ ID NO 202001) derived from CMV pp65.
14. APC-multimerisation domain coupled with HLA-A*2402 in complex with beta2microglobulin and the peptide VYALPLKML (SEQ ID NO 202002) derived from CMV pp65.
15. APC-multimerisation domain coupled with HLA-A*2402 in complex with beta2microglobulin and the non-sense peptide.

The binding of the above described MHC(peptide)/APC multimers can be used to determine the presence of CMV pp65 specific T cells in the blood from CMV infected individuals by flow cytometry following a standard flow cytometry protocol. Blood from a patient with CMV infection is isolated and 100 ul of this blood is incubated with either of the MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 13 or 14 described above and thereby the presence of CMV specific T cells will indicate that the patient are infected with Cytomegalovirus. Blood analysed with MHC(peptide)/APC multimer 15 should show no staining of CD3 and CD8 positive cells with this SA-MHC(peptide)/APC multimer.

The sensitivity of the above described test may be enhanced by addition of labeled antibodies specific for activation markers expressed in or on the surface of the CMV specific T cells.

We conclude that the APC-multimerisation domain coupled MHC(peptide) constructs may be used to detect the presence of CMV specific T cells in the blood of patients infected with Cytomegalovirus.

Example 28

This example describes how to identify specific T cells in a blood sample with MHC multimers using flow cytometry analysis without lysis of red blood cells and without washing the cells after staining. MHC complexes in this example consisted of HLA-A*0201 heavy chain, human beta2microglobulin and different peptides, and the MHC complexes were coupled to a 270 kDa dextran multimerization domain.

Purified MHC-peptide complexes consisting of human heavy chain, human beta2microglobulin and peptide were generated by in vitro refolding, purified and biotinylated as described elsewhere herein. Biotinylated MHC-peptide complexes were then coupled to a 270 kDa dextran multimerization domain labelled with PE by interaction with streptavidin (SA) on the dextran multimerization domain. The SA-PE-dextran was made as described elsewhere herein. MHC-peptide complexes was added in an amount corresponding to a ratio of three MHC-peptide molecules per SA molecule and each molecule dextran contained 6.1 SA molecule and 3.9 molecules PE. The final concentration of dextran was 3.8×10e-8 M. The following constructs were made:

1. PE conjugated 270 kDa dextran coupled with HLA-A*0101 in complex with beta2microglobulin and the peptide VTEHDTLLY (SEQ ID NO 201994) derived from Human Cytomegalo Virus (HCMV).
2. PE conjugated 270 kDa dextran coupled with HLA-A*0101 in complex with beta2microglobulin and the peptide IVDCLTEMY (SEQ ID NO 201995) derived from ubiquitin specific peptidase 9 (USP9).
3. PE conjugated 270 kDa dextran coupled with HLA-A*0201 in complex with beta2microglobulin and the peptide NLVPMVATV (SEQ ID NO 201990) derived from Human Cytomegalo Virus (HCMV).
4. PE conjugated 270 kDa dextran coupled with HLA-A*0201 in complex with beta2microglobulin and the peptide ILKEPVHGV (SEQ ID NO 201991) derived from Human Immunodeficiency Virus (HIV).
5. PE/SA conjugated 270 kDa dextran coupled with HLA-B*0207 in complex with beta2microglobulin and the peptide TPRVTGGGAM (SEQ ID NO 201996) derived from Human Cytomegalo Virus (HCMV).
6. PE conjugated 270 kDa dextran coupled with HLA-B*0207 in complex with beta2microglobulin and the peptide RPHERNGFTVL (SEQ ID NO 201997) derived from Human Cytomegalo Virus (HCMV).
7. PE conjugated 270 kDa dextran coupled with HLA-B*0207 in complex with beta2microglobulin and the peptide TPGPGVRYPL (SEQ ID NO 201998) derived from Human Immunodeficiency Virus (HIV).

These seven MHC multimer constructs were used for detection of specific T cells in flow cytometry analysis using a no-lyse no-wash procedure. Blood samples from three individual donors were analyzed. The donors had previously been screened for the presence of specific T cells using a general staining procedure including lysis and wash of the cell sample, and donor one turned out to be positive for HLA*0201 in complex with the peptide NLVPMVATV (SEQ ID NO 201990), donor two were positive for HLA*0101 in complex with the peptide VTEHDTLLY (SEQ ID NO 201994) and donor three were positive for HLA-B*0207 in complex with the peptides TPRVTGGGAM (SEQ ID NO 201996) and RPHERNGFTVL (SEQ ID NO 201997). In this experiment blood from each donor were analyzed with the MHC multimer construct they were supposed to have specific T cells restricted for and with MHC multimers of same haplotype but carrying a negative control peptide. The negative control peptides were either derived from HIV or the self-protein USP 9. Self-protein here means a naturally occurring protein in normal cells of a human individual. Normal healthy donors not infected with HIV are not expected to have specific T cells recognizing HIV derived peptides or peptides derived from self-proteins in complex with any HLA molecule in an amount detectable with this analysis method.

The blood were stained as follows:

100 μl EDTA stabilized blood were incubated with 5 μl MHC(peptide)/PE dextran for 5 minutes at room temperature. Anti-CD45/PB, anti-CD3/FITC and anti-CD8/APC antibody in an amount of 0.4-1.2 μg/sample was added to each tube and the incubation continued for another 15 minutes. 850 μl PBS; pH=7.2 was added and the sample analyzed on a CyAn ADP flowcytometry instrument with a speed of 150 μl/minute. A total of 20.000 CD8 positive cells were acquired. During analysis CD45/PB antibody was used to set a trigger discriminator to allow the flow cytometer to distinguish between red blood cells and stained white blood cells (see FIG. 21A). Furthermore CD3/FITC antibody was used to select CD3 positive cells in a second gating strategy (see FIG. 21B).

Blood from donor one showed specific staining with HLA-A*0201(NLVPMVATV) (SEQ ID NO 201990) multimer (construct 3) while no staining of specific T cells was observed with the negative control HLA-A*0201(ILKEPVHGV) (SEQ ID NO 201991) multimer (construct 4). Donor two showed specific staining with HLA-A*0101 (VTEHDTLLY) (SEQ ID NO 201994) multimer (construct 1) and no staining was observed with the negative control HLA-A*0101(IVDCLTEMY) (SEQ ID NO 201995) multimer (construct 2). In blood from donor three a population of T cells were stained with HLA-B*0207(TPRVTGGGAM) (SEQ ID NO 201996) multimer (construct 5) and another population with HLA-B*0207(RPHERNGFTVL) (SEQ ID NO 201997) multimer (construct 6) while no specific staining was observed with the negative control HLA-B*0207 (TPGPGVRYPL) (SEQ ID NO 201998) multimer (construct 7). The results are shown in FIG. 22.

We have shown that MHC multimers of three different haplotypes can be used to identify specific T cells in blood samples from three different donors using an approach without lysing red blood cells and without wash following staining with MHC multimer. This method is simple, fast and interfere as little as possible with cells in the blood sample.

Example 29

This example illustrates how MHC multimers together with counting beads was used for exact numeration of MHC-peptide specific T cells in a flow cytometry analysis whit no lyses of red blood cells and no washing steps during or after staining. Counting beads in this example was CytoCount™, Count Control Beads from Dako that are polystyrene Fluorospheres with a diameter of 5.2 μm. The MHC multimer consisted of HLA-A*0101 heavy chain complexed with human beta2microgloblin and a peptide and the MHC-peptide complexes were coupled to a 270 kDa dextran multimerization domain labelled with PE. MHC multimers were generated as described elsewhere herein and the following two constructs were made:

1) PE conjugated 270 kDa dextran coupled with HLA-A*0101 in complex with beta2microglobulin and the peptide VTEHDTLLY (SEQ ID NO 201994) derived from Human Cytomegalo Virus (HCMV).
2) PE conjugated 270 kDa dextran coupled with HLA-A*0101 in complex with beta2microglobulin and the peptide IVDCLTEMY (SEQ ID NO 201995) derived from ubiquitin specific peptidase 9 (USP9).

Construct 2 is a negative control for construct 1 in this example and both were used for detection of specific T cells by flow cytometry using a no-lyse no-wash procedure: 100 μl of EDTA stabilized blood from a donor positive for HLA*0101 in complex with the peptide VTEHDLLY were incubated with 5 μl MHC multimer for 5 minutes at room temperature. Anti-CD45/CY, anti-CD3/PB and anti-CD8/APC antibody in an amount of 0.4-1.2 μg/sample was added and the incubation continued for another 15 minutes. 850 μl PBS; pH=7.2 was added together with precise 50 μl CytoCount beads 1028 bead/μl and the sample analyzed on a CyAn ADP flowcytometry instrument with a speed of 150 μl/minute. A total of 20.000 CD8 positive cells were acquired. During analysis CD45/CY antibody was used to set a trigger discriminator to allow the flow cytometer to distinguish between red blood cells and stained white blood cells. A dot plot was made for each sample showing MHC multimer vs CD8 positive events (se FIGS. 23 A and B). Based on the negative control a gate comprising events representing CD8 positive T cells specific for MHC multimer was defined. Similarly histogram plots for each sample was made showing FITC signal vs counts (FIGS. 23 C and D). In these histograms the amount of beads in the analyzed sample were identified since the beads in contrast to the cells emit light in the FITC channel. In principle the beads could be visualized in any fluorochrome channel because they emit light in all channels but it was important to visualize the beads in a channel where there was no interfering signal from labelled cells.

The concentration of T cells specific for HLA-A*0101 (VTEHDTLLY) (SEQ ID NO 201994) multimer (construct 1) in the blood sample were determined using the counting beads as an internal standard. Events obtained from staining with the negative control MHC multimer, construct 2, were defined as background signals and subtracted from the result obtained from staining with construct 1.

Concentration of HLA-A*0101(VTEHDTLLY) (SEQ ID NO 201994) specific T cells in the blood sample=((Count of MHC multimer+CD8+positive cells, construct 1×concentration of beads×dilution factor of beads)/counted beads))−((Counted MHC multimer+CD8+cells, construct 2×concentration of beads×dilution factor of beads)/counted beads)=992.6 cells/ml For details see FIG. 23.

This experiment demonstrated how CytoCount™ counting beads together with MHC multimers could be used to determine the exact concentration of MHC-peptide specific T cells in a blood sample using a no-lyse no-wash method.

Example 30

This example describes an analysis of specific T cells in blood using MHC multimers where MHC multimers together with antibodies are pre-mixed and embedded in a matrix material to retain and immobilize the reagents prior to use. In this example the matrix was composed of Trehalose and Fructose and the MHC complex consisted of HLA-A*0101 heavy chain complexed with human beta2microglobulin and peptide. The MHC-peptide complexes were coupled to a 270 kDa dextran multimerization domain.

Purified MHC-peptide complexes consisting of heavy chain, human beta2microglobulin and peptide were generated by in vitro refolding, purified and biotinylated as described elsewhere herein. Biotinylated MHC(peptide) complexes were coupled to a 270 kDa dextran multimerization domain labelled with PE, thereby generating PE labelled MHC multimers. The following MHC multimer constructs were made:

1) PE conjugated 270 kDa dextran coupled with HLA-A*0101 in complex with beta2microglobulin and the peptide VTEHDTLLY (SEQ ID NO 201994) derived from Human Cytomegalo Virus (HCMV).

2) PE conjugated 270 kDa dextran coupled with HLA-A*0101 in complex with beta2microglobulin and the negative control peptide IVDCLTEMY (SEQ ID NO 201995) derived from ubiquitin specific peptidase 9 (USP9).

Tubes with a matrix material to retain and immobilize the above described MHC multimer constructs together with antibodies relevant for later flow cytometer analysis was made. The matrix material was made to retain MHC multimer and antibody in the container when dry but release them into the sample medium when a sample comprising cells of interest was added to the tube.

Experimentally, solutions of 20% Fructose in water and 20% Trehalose in water were made and mixed in a 1:1 ratio. 15 μl of this mixture were transferred to two 5 ml Falcon tubes. A premix of antibodies were made consisting of 40 μl anti-CD8 Alexa700 labelled antibody in a concentration of 25 μg/ml+40 μl anti-CD3 Pacific Blue labelled antibody in a concentration of 100 μg/ml+160 μl anti-CD45 Cascade Yellow labelled antibody in a concentration of 200 μg/ml. 12 μl of this mixture were added to each Falcon tube together with 3 μl of either of the two MHC multimer constructs. 100 μl butylated hydroxytoluen (BHT) with a concentration of 99 mg/L were added. The mixtures were dried under vacuum a 2-8° C. over night. 100 μl EDTA stabilized blood from a donor with T cells specific for HLA-A*0101 complexed with the peptide VTEHDTLLY (SEQ ID NO 201994) were added to each of the two tubes. As a control experiment 6 μl of the antibody premix described above were transferred to two empty 5 ml Falcon tubes together with 3 μl of either of the MHC multimer constructs and 100 μl blood from the same donor. All four tubes were incubated for 15 minutes at room temperature. Then 900 μl PBS; pH=7.2 was added and the sample analyzed on a CyAn ADP flowcytometer instrument.

A total of 20.000 CD8 positive cells were acquired for each sample. During analysis CD45/CY antibody was used to set a trigger discriminator to allow the flow cytometer to distinguish between red blood cells and stained white blood cells.

As expected and shown in FIG. 24 a population of CD8 positive and HLA-A*0101(VTEHDTLLY) (SEQ ID NO 201994) multimer positive cells were observed in the two samples stained with construct 1. The amount of specific T cells detected in the matrix sample was comparable to the amount of specific T cells detected in the control sample without matrix material. No HLA-A*0101(IVDCLTEMY) (SEQ ID NO 201995) multimer specific CD8 positive cells were observed in the two samples stained with the negative control MHC multimer construct 2.

This experiment demonstrates that the MHC multimer constructs used in this experiment can be embedded in a sugar matrix and later used for analysis of specific T cells in a blood sample and that this method gives results comparable to results obtained from a no-lyse no-wash staining procedure.

Example 31

This example describes the generation and application of negative controls, where the MHC complex is HLA-A*0201 loaded with either of the nonsense peptides GLAGDVSAV (SEQ ID NO 201989) or ALIAPVHAV (SEQ ID NO 201992) and these MHC complexes are coupled to a 270 kDa dextran multimerization domain. The nonsense peptides have an amino acid sequence different from the linear sequence of any peptide derived from any known naturally occurring protein. This was analyzed by a blast search. The amino acids at position 2 and 9 can serve as anchor residues when binding to HLA-A*0201 molecules.

Purified MHC(peptide) molecules consisting of the allele HLA-A*0201, human beta2microglobulin and peptide was generated by in vitro refolding, purified and biotinylated as described elsewhere herein. Biotinylated HLA-A*0201 (peptide) was mixed with APC-SA-conjugated 270 kDa dextran in an amount corresponding to a ratio of three biotinylated HLA-A*0201(peptide) molecules per SA molecule and incubated for 30 minutes in the dark at room temperature. The APC-SA-conjugated 270 kDa dextran contained 9 molecules APC and 3.7 molecules SA per dextran molecule. Following incubation the mixture was diluted into a buffer comprising 0.05M Tris/HCl, 15 nM $NaN_3$ and 1% BSA to a final concentration of $3.8\times10^{-8}$ M dextran. By this procedure the following MHC multimer constructs were made:

1) A negative control construct comprising APC-SA-conjugated 270 kDa dextran and biotinylated HLA-A*0201 in complex with beta2microglobulin and the nonsense peptide GLAGDVSAV (nonsense peptide 1; (SEQ ID NO 201989)).
2) A negative control construct comprising APC-SA-conjugated 270 kDa dextran and biotinylated HLA-A*0201 in complex with beta2microglobulin and the nonsense peptide ALIAPVHAV (nonsense peptide 2) (SEQ ID NO 201992).
3) A construct comprising APC-SA-conjugated 270 kDa dextran and biotinylated HLA-A*0201 in complex with beta2microglobulin and the peptide NLVPMVATV (SEQ ID NO 201990) derived from pp65 protein from human cytomegalovirus (HCMV).
4) A construct comprising APC-SA-conjugated 270 kDa dextran and biotinylated HLA-A*0201 in complex with beta2microglobulin and the peptide GLCTLVAML (SEQ ID NO 201993) derived from BMLF-1 protein from Epstein Barr virus (EBV).
5) A construct comprising APC-SA-conjugated 270 kDa dextran and biotinylated HLA-A*0201 in complex with beta2microglobulin and the peptide ILKEPVHGV (SEQ ID NO 201991) Reverse Transcriptase from Human Immunodeficiency Virus (HIV).

The binding of the HLA-A*0201(peptide)/APC dextran constructs to Human Peripheral Blood Mononuclear Cells (HPBMC) from various donors was analyzed by flow cytometry following a standard flow cytometry protocol. Briefly, HPBMC from the blood of 9 individual donors were isolated, by a standard protocol using Ficoll-Hypaque. $1\times10^6$ purified HPBMC at a concentration of $2\times10^7$ cells/ml were incubated with 10 μl of one of the HLA-A*0201 (peptide)/APC dextran constructs described above for 10 minutes in the dark at room temperature. 10 μl of each of the antibodies mouse-anti-human CD3/PE (clone UCHT1 from Dako) and mouse-anti-human CD8/PB (clone DK25 from Dako) were added and the incubation continued for another 20 minutes at 4° C. in the dark. The samples were then washed by adding 2 ml PBS; pH=7.2 followed by centrifugation for 5 minutes at 200×g and the supernatant removed. The cells were then resuspended in 400-500 μl PBS; pH=7.2 and analyzed on a CYAN ADP flowcytometer.

Donor 1-5 were known to have detectable T cells specific for HLA-A*0201(NLVPMVATV) (SEQ ID NO 201990) and no detectable T cells specific for HLA-A*0201(ILKEPVHGV) (SEQ ID NO 201991) while donor 6 were known not to have detectable specific T cells for either HLA-A*0201(NLVPMVATV) (SEQ ID NO 201990) nor HLA-A*0201(ILKEPVHGV) (SEQ ID NO 201991). Lymphocytes from these 6 donors were stained with MHC multimer construct 1, 2, 3, and 5. Donor 1-5 showed positive staining with MHC multimer construct 3 as expected while no staining was observed with the either of the negative control MHC complex constructs 1 and 2 or with MHC complex construct 5. An example showing the staining patterns for donor 2 is shown in FIG. 19. No specific staining was observed of lymphocytes from donor 6 with either of the MHC multimer constructs.

Donor 7-8 known to have detectable T cells specific for HLA-A*0201(GLCTLVAML) (SEQ ID NO 201993) and no detectable T cells recognizing HLA-A*0201(ILKEPVHGV) (SEQ ID NO 201991) and donor 9 having no detectable T cells specific for either HLA-A*0201(GLCTLVAML) (SEQ ID NO 201993) nor HLA-A*0201(ILKEPVHGV) (SEQ ID NO 201991) were all stained with MHC multimer construct 1, 2, 4, and 5. Donor 7 and 8 demonstrated efficient staining with MHC multimer construct 4 as expected while no staining was observed with the other MHC multimer constructs tested. No staining was observed of lymphocytes from donor 9 with either of the MHC multimer constructs tested. A summary of the results is shown in FIG. 20.

In conclusion this experiment demonstrates that the negative MHC multimer constructs 1 and 2 did not stain any specific T cells in lymphocyte preparations from 10 different donors. Donors known to have specific T cells for either HLA-A*0201(GLCTLVAML) (SEQ ID NO 201993) or HLA-A*0201(NLVPMVATV) (SEQ ID NO 201990) also demonstrated positive staining with the corresponding MHC multimer constructs 3 and 4. None of the 10 donors were infected with HIV and as expected did not appear to have T cells specific for HLA-A*0201 in complex with the HIV derived peptide ILKEPVHGV (SEQ ID NO 201991), and as expected none of these donors showed staining with MHC multimere construct 5. MHC multimer construct 1 and 2 are therefore suitable negative controls when using HLA-A*0201(peptide) multimers for detection of specific T cells in Flow Cytometry.

Example 32

This example describes the generation of a negative control, where the MHC complex is HLA-A*0201 coupled to a 270 kDa dextran, and where the MHC is loaded with the peptide ILAKFLHWL (SEQ ID NO 202006) that have pivaloyl coupled to Lysine at position 4. ILAKFLHWL (SEQ ID NO 202006) is a peptide derived from telomerase and is known to bind HLA-A*0201. Pivaloyl is a small molecule that confers high sterical hindrance. Because pivaloyl is placed at a central position in the peptide it is likely to inhibit or completely abrogate the interaction with a specific TCR, because TCR-recognition is normally directed to the middle of the peptide when bound in the peptide-binding cleft. In the following the pivaloyl-modified peptide will be designated ILAK$^p$FLHWL (SEQ ID NO 202007).

Purified HLA-A*0201(ILAK$^p$FLHWL) (SEQ ID NO 202007) molecules consisting of the HLA-A*0201 heavy chain, human beta2microglobulin and ILAK$^p$FLHWL (SEQ ID NO 202007) peptide is generated by in vitro refolding, purified and biotinylated as described elsewhere herein. Biotinylated HLA-A*0201(ILAK$^p$FLHWL) (SEQ ID NO 202007) molecules are mixed with flourochrome-SA-conjugated 270 kDa dextran molecules. The resulting HLA-A*0201(ILAK$^p$FLHWL) (SEQ ID NO 202007)/flourochrome-carrying dextran molecules can be used as negative controls in e.g. flow cytometric analysis.

Example 33

This example describes the generation of a negative control, where the MHC complex is any MHC I or MHC II molecule of human, mouse, rabbit, rat, swine, monkey or any other origin loaded with the peptide ILAK$^{P}$FLHWL (SEQ ID NO 202007) and coupled to any multimerization domain labeled with fluorochrome, HRP or any other label. Purified MHC(ILAK$^{P}$FLHWL) (SEQ ID NO 202007) complexes consisting of the heavy chain, human beta2microglobulin and ILAK$^{P}$FLHWL (SEQ ID NO 202007) peptide is generated by in vitro refolding, purified and biotinylated as described elsewhere herein. Biotinylated MHC(ILAK$^{P}$FLHWL) (SEQ ID NO 202007) complexes are mixed with labeled multimerization domain, thereby generating MHC(ILAK$^{P}$FLHWL) (SEQ ID NO 202007) multimers. The MHC(ILAK$^{P}$FLHWL) (SEQ ID NO 202007) multimers may be used as negative controls in e.g. flow cytometric analysis, IHC, ELISA or similar.

Example 34

This example describes how to verify that a MHC-complex is correctly folded by a sandwich-ELISA assay. W6/32 mouse-anti-HLA-ABC antibody (Dako M0736), that recognizes a conformational epitope on correctly folded MHC-complex, was used as coating-antibody. HRP-conjugated rabbit anti-β2m (Dako P0174) was used for visualization.

1. Wells of a microtiter plate was pre-coated with W6/32 antibody (Dako M0736, 5 μg/ml in 0.1M $NaHCO_3$, 1 mM $MgCl_2$, pH 9.8, 50 μl/well) following a standard ELISA procedure regarding washes and blocking ect.
2. After addition of 50 μl of 0.5M Tris-HCl, 0.1 M NaCl, 0.1% Tween 20, 0.01% Bronidox, pH 7.2 to each well, 50 μl of a sample of purified folded MHC-complex (in a concentration of approx. 0.4 mg/ml) was added to two wells in to columns in the microtiter plate, diluted 2-fold down the column and incubated 2 hours at 4° C. Light chain β2m (0.15 mg/ml in 0.5M Tris-HCl, 0.1 M NaCl, 0.1% Tween 20, 0.01% Bronidox, pH 7.2) was used as a negative control and the cell-line KG-1a, expressing HLA-A*30, HLA-A*31 and HLA-B*35 heavy chains, was used as positive control ($10^6$ cells/well).
3. After a standard ELISA wash, 50 μl of the detecting antibody; HRP-conjugated rabbit anti-β2m (Dako P0174), diluted 1:2500 in 1% Skimmed Milk in 0.5M Tris-HCl, 0.1 M NaCl, 0.1% Tween 20, 0.01% Bronidox, pH 7.2 was added to each well. The plate was incubated 1 hour at 4° C.
4. After a standard ELISA wash, 50 μl of an amplifying antibody; HRP-Dextran500-conjugated goat anti-rabbit (Dako DM0106), diluted 1:2000 in 1% Skimmed Milk in 0.5M Tris-HCl, 0.1 M NaCl, 0.1% Tween 20, 0.01% Bronidox, 1% mouse serum (Dako X0190) pH 7.2 was added. The plate was incubated 30 min. at 20° C.
5. After a standard ELISA wash, 50 μl of Dako S1599 (TMB+Substrat Chromogen) was added to each well for visualization.
6. After 10 min. the visualization reaction was stopped with 50 μl 0.5M $H_2SO_4$/well.
7. The chromogenic intensity was measured at $OD_{450}$ and the result from the ELISA assay evaluated.

As shown in FIG. 16 the $OD_{450}$ values from wells with MHC complex was more than 6 times higher than $OD_{450}$ values from wells with the negative control β2m. This ELISA procedure can be used to verify the presence of correctly folded MHC-peptide complexes in a preparation of MHC complexes.

Example 35

This example describes how the quality of a MHC multimer can be tested. The MHC multimer is in this example a MHC-dextramer, and the test involves specific binding of the MHC-dextramer to TCRs immobilized on beads.

Recombinant TCRs (CMV3 TCRs; Soluble CMVpp65 (NLVPMVATV)-specific TCR protein) (SEQ ID NO 201990) specific for the MHC-peptide complex HLA-A*0201(NLVPMVATV) (SEQ ID NO 201990), where the letters in parenthesis denote the peptide complexed to the MHC-allel HLA-A*0201, were obtained from Altor Biosciences. The TCRs were dimers linked together via an IgG framework.

The purity of the TCRs were verified by SDS PAGE and was between 95-100% pure. The quality of the TCRs were verified by their ability to recognize the relevant MHC-dextramer and not irrelevant MHC dextramers in ELISA experiments (data not shown).

Carboxylate-modified beads were coupled with dimeric TCR (CMV3 TCRs; Soluble CMVpp65(NLVPMVATV)-specific TCR protein) (SEQ ID NO 201990), incubated with fluorescently labeled MHC-dextramers and the extend of cell staining analysed by flow cytometry, as follows:

Immobilization of TCR on Carboxylate Beads:

1. $3\times10^9$ Carboxylate-modified beads, Duke Scientific Corporation, XPR-1536, 4 μm, lot:4394 were washed in 2×500 μl Wash buffer 1 (0.05% Tetronic 1307, 0.1 M MES-buffer (2-[N-morpholino]ethanesulfonic acid), pH 6.0), centrifuged 4 min at 15000 g, and the supernatant was discarded.
2. 125 μl EDAC/Sulfo-NHS (50 mM EDAC (1-ethyl-3-(3-dimethylaminopropyl)carbodiimide), 50 mM Sulfo-NHS, in Wash buffer 1) was added to the beads, and the suspension incubated at room temperature for 20 min.
3. Beads were washed in 2×250 μlWash buffer 1 and centrifuged 2 min at 15000 g, and the supernatant was discarded.
4. TCR was added in various concentrations from 0 μg to 20 μg, and incubated with slow shaking overnight at 4° C.
5. Beads were centrifuged 4 min at 15000 g, and the supernatant discarded.
6. Beads were washed in 2×500 μl Wash buffer 1 and centrifuged 4 min at 1500 g, and the supernatant was discarded.
7. 125 μl 20 mM Glycin in Wash buffer 1 was added, and resuspended beads incubated for 1 hour at room temperature.
8. Beads were washed in 2×500 μl phosphate-buffered saline (PBS) pH 7.2, 0.5% Tetronic 1307, and centrifuged 2 min at 15000 g, and the supernatant was discarded.
9. Beads were resuspended in 250 μl PBS pH 7.2, 0.05% Tetronic 1307.

Bead concentration after resuspension was $1.2\times10^7$ beads/μl. Beads coated with TCR were stored at 2-8° C. until further use.

Flow Cytometry Analysis:

1. 20 μl beads ($1.2\times10^7$ beads/μl) coated with 0-20 μg TCRs, as described above were washed in 200 μl Wash buffer 2 (5% FCS, PBS, pH 7.4).
2. Beads were centrifuged 3 min at 12000 g, and the supernatant was discarded, and beads resuspended in 50 μl Wash buffer 2.
3. 10 μl MHC-dextramers were added, and samples were incubated 15 min. at room temperature in the dark.
4. Samples were washed in 1 ml Wash buffer 2, centrifuged at 300 g for 5 min. The supernatant was discarded, and pellet resuspended in 0.4 ml PBS pH 7.4, and kept at 4° C. in the dark until analysis on flow cytometer.
5. Samples were analysed by flow cytometry on a CyAn instrument.

The results are shown in FIG. 17. Beads coated with 2-20 μg TCR all showed positive staining with the specific HLA-A*0201(NLVPMVATV)/RPE (SEQ ID NO 201990) and not with an irrelevant HLA-A*0201(ILKEPVHGV)/RPE (SEQ ID NO 201991) dextramer. It can be concluded that carboxylate beads coated with dimeric TCRs can be used to test the quality of the MHC-dextramers.

Example 36

This example describes how TCR-coated beads can be used as internal, positive controls when analysing suspensions of Human Peripheral Blood Mononuclear Cells (HPBMCs), whole blood samples or any other cell sample of interest. The MHC multimer employed in this example is a MHC-dextramer.

In this example TCR-coated carboxylated beads generated as described in example 35 were added to a sample comprising either HPBMCs or whole peripheral blood.

HPBMCs and TCR-beads were incubated with fluorescently labelled MHC-dextramers and the extent of cell staining analysed by flow cytometry according to this general staining procedure:

1. Transfer 1-3×$10^6$ lymphoid cells (PBMC or splenocytes) to a 12×75 mm polystyrene test tube. Other cells of interest can be used. Allocate only 2-5×$10^5$ cells per tube when staining T-cell clones or cell lines due to the high frequency of antigen-specific T cells
2. Add 2 ml 0.01 mol/L PBS comprising 5% fetal calf serum and centrifuge at 300×g for 5 minutes. Remove supernatant and resuspend cells in remaining liquid.
3. Add 10 μl of MHC Dextramer and mix gently with a vortex mixer. Incubate in the dark at room temperature for 10 minutes.
4. Add an optimally titrated amount of anti-CD8 antibody conjugated with a relevant flourochrome (e.g. Dako clone DK25 for human lymphocytes or clone YTS169.4/KT15 for mouse lymphocytes). Incubate in the dark at 2-8° C. for 20 min.
5. Add 2 ml of 0.01 mol/L PBS comprising 5% fetal calf serum and centrifuge at 300×g for 5 minutes.
6. Resuspend pellet in an appropriate fluid for flow cytometry, e.g. 0.4 ml PBS. Analyse on a flow cytometer or store at 2-8° C. in the dark until analysis. Do not store longer than 2 hours before analysis.

Human peripheral whole blood and TCR-beads were incubated with fluorescently labelled MHC-dextramers and the extent of cell staining analysed by flow cytometry as follows:

1. Transfer 100 μL whole blood to a 12×75 mm polystyrene test tube.
2. Add 10 μl of MHC Dextramer and mix with a vortex mixer. Incubate in the dark at room temperature for 10 minutes.
3. Add an optimally titrated amount of anti-CD8 antibody (e.g. Dako clone DK25) conjugated with a relevant fluorochromes and mix well. Continue incubation at 2-8° C. in the dark for 20 minutes.
4. Add 2 mL EasyLyse™ working solution (Code No. S2364) and incubate for 10 minutes.
5. Centrifuge for 5 minutes at 300×g and aspirate supernatant.
6. Add 2 mL 0.01 mol/L PBS and centrifuge for 5 minutes at 300×g and aspirate supernatant.
7. Resuspend pellet in an appropriate fluid for flow cytometry, e.g. 0.4 mL PBS, and analyze on a flow cytometer or store at 2-8° C. in the dark until analysis. Do not store longer than 2 hours before analysis.

FIG. 18 shows examples of TCR-beads added into whole blood or HPBMC samples.

In both experiments it is possible, by forward- vs. side-scatter measurements, to distinguish TCR-beads from cell populations in the sample. Region R1 is TCR-beads, and region R2 is lymphocyte cell population of interest in the analysis of MHC positive T cells.

The size and conditions of coating of beads might be optimized. The size of beads or labeling of beads (e.g. fluorescent labeling) can be optimized to allow separation of cells of interest in the sample. In this example the forward- vs. side-scatter dot plot has been used for gating of cell populations of interest. Other parameters (e.g. fluorescence intensity) for cell populations of interest can be used.

Human peripheral whole blood and other cells (e.g. HPBMCs) can be stained with MHC Dextramers simultaneously with immuno-phenotyping of relevant antigens. The staining procedure describes the use of labelled CD8 antibody together with MHC dextramers; additional antibodies for detection of other extracellular antigens can be added. Likewise, detection of intracellular antigens can be performed simultaneously with MHC-detection (for protocol, see IntraStain procedure, cat no. K2311, Dako. Additional washing step prior to IntraStain Reagent A is essential for good results using MHC Dextramers together with this IntraStain procedure).

Example 37

This is an example of measurement of antigen reactive T-Cells by IFN-γ capture in blood samples by ELISPOT.

This is an example of indirect detection of TCR, where individual cells are immobilized and measured by a chromogen assay.

The example provides a sensitive assay for the detection of T-cells reactive to an antigen by detecting a soluble factor whose secretion is induced by stimulation of the T-cell by the antigen.

A summary flow chart of the method is shown in FIG. 25. In brief, peripheral blood is diluted threefold in Dulbecco's phosphate buffered saline (DPBS), underlain with 15 ml of Ficoll (Pharmacia Ficoll-Paque #17-0840-02, Piscataway, N.J.) per 40 ml diluted blood in a 50 ml polypropylene centrifuge tube, and spun at 2000 RPM for 20 minutes in a Beckman CS-6R centrifuge (Beckman Inc., Palo Alto, Calif.). The buffy layer at the DPBS/Ficoll interface is removed, washed twice with DPBS and once with human tissue culture medium (hTCM: αMEM+5% heat inactivated human AB serum (Ultraserum, BioWhittaker, Walkersville, Md.), penicillin/streptomycin, 1-glutamine) at low RCF to remove platelets. Sixty percent of the PBMCs are resuspended in freezing medium (10% dimethyl sulfoxide (Sigma Chemical Co., St. Louis, Mo.), 90% fetal bovine serum to a concentration of 5×$10^6$ cells/ml, frozen in a programmable Cryo-Med (New Baltimore, Mich.) cell freezer, and stored under liquid nitrogen until needed.

The purified PBMCs are plated at 2×$10^5$ cells/well at a volume of 0.1 ml in 96 well Costar cell culture plates. An equal volume of antigen at 10 μg/ml is added to triplicate or sextuplet sets of wells and the plate is incubated in a 37° C., 5% $CO_2$ incubator. On day five, 10 μl/well of 100 U/ml stock recombinant IL-2 (Advanced Biotechnologies Inc., Columbia, Md.) is added to each well. On day 8, frozen PBMCs are thawed, washed in DPBS+0.5% bovine serum albumin (BSA) to remove DMSO, resuspended to a concentration of $4\times10^6$ cells/ml in hTCM, and γ-irradiated (3,000 RADS). Fifty microliters/well are dispensed along with 50 μl of the appropriate antigen at a stock concentration of 40 μl/ml to give a final antigen concentration of 10 μg/ml.

To prepare a capture plate, IFN-γ capture antibody (monoclonal mouse anti-human IFN-g, Endogen # M700A, Cambridge, Mass.) is diluted to 10 μg/ml in sterile 0.1 M $Na(CO_3)_2$ pH 8.2 buffer, aliquotted at 50 μl/well in flat bottomed 96 well sterile microtiter plates (Corning Costar Corp.), and incubated at 4° C. for a minimum of 24 hours. Prior to use, excess antibody is removed and wells are washed twice with dPBS+1% Tween 20 (PBST). To block further nonspecific protein binding, plates are incubated with 250 μl/well of PBS+5% BSA at room temperature for 1 hour. After discarding the blocking solution, wells are washed once with PBST (0.1% Tween), followed by hTCM in preparation for the antigen stimulated cells.

On day 9 of the assay, twenty four hours after the second antigen stimulation, the stimulation plate is spun for 5 minutes at 1500 RPM in a Beckman CS-6R centrifuge and 90 μl of supernatant is carefully removed from each well with a micropipette. The pelleted cells are resuspended in 100 μl of hTCM, pooled in sterile tubes (Corning Costar corp sterile ClusterTAb #4411, Cambridge, Mass.), mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody (Endogen # P700, Cambridge, Mass.) in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody (Jackson Immunological #211-055-109, West Grove, Pa.) diluted in TBST is added to each well and incubated at room temperature for 1.5-2 hours with gentle rocking. Excess enzyme-conjugated antibody is removed by three washes with PBST and two washes with alkaline phosphatase buffer (APB=0.1 M NaCl, 0.05 M MgCl.sub.2, 0.1 M Tris HCl, pH 9.5) followed by addition of the substrate mix of p-Toluidine salt and nitroblue tetrazolium chloride (BCIP/NBT, GIBCO BRL #18280-016, Gaithersburg, Md.). To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed by NIH image software. Captured images are enhanced using the Look Up Table which contrasts the images. Thresholding is then applied to every image and a wand tool is used to highlight the border to effectively subtract the edge of the well so that background counts won't be high and artificial. Density slicing over a narrow range is then used to highlight the spots produced from secreting cells. Pixel limits are set to subtract out small debris and large particles, and the number of spots falling within the prescribed pixel range are counted by the software program. Totals from each well are then manually recorded for future analysis. Alternatively, spots can be counted by other commercially available or customized software applications, or may be quantitated manually by a technician using standard light microscopy. Spots can also be counted manually under a light microscope.

We conclude that the protocol detailed above can be used for the enumeration of single IFN-γ secreting T cells.

Example 38

This is an example of measurement of antigen reactive T-Cells by IFN-γ capture in blood samples by ELISPOT.

This is an example of indirect detection of TCR, where individual cells are immobilized and measured by a chromogen assay. The antigenic peptide origin is a library of antigens.

The example provides a sensitive assay for the detection of T-cells reactive to the antigen of a library generated as described in example 21, by detecting a soluble factor whose secretion is induced by stimulation of the T-cell by the antigen.

This example is similar to the experiment above. PMBC are isolated, prepared and stored as described in the example above.

The purified PBMCs are plated at $2\times10^5$ cells/well at a volume of 0.1 ml in 96 well Costar cell culture plates. An equal volume of antigens from the library, at 10 μg/ml is added to triplicate or sextuplet sets of wells and the plate is incubated in a 37° C., 5% $CO_2$ incubator. On day five, 10 μl/well of 100 U/ml stock recombinant IL-2 is added to each well. On day 8, frozen PBMCs are thawed, washed in DPBS+0.5% BSA to remove DMSO, resuspended to a concentration of $4\times10^6$ cells/ml in hTCM, and γ-irradiated (3,000 RADS). 50 μl/well are dispensed along with 50 μl of the appropriate antigen at a stock concentration of 40 μl/ml to give a final antigen concentration of 10 μg/ml.

A capture plate with IFN-γ antibody is prepared, washed and blocked as described in the example above.

On day 9 of the assay, twenty four hours after the second antigen stimulation, the stimulation plate is spun for 5 minutes at 1500 RPM and 90 μl of supernatant is carefully removed from each well with a micropipette. The pelleted cells are resuspended in 100 μl of hTCM, pooled in sterile tubes, mixed and transferred into an equal number of wells of an anti IFN-γ capture plate. Capture plates are incubated undisturbed at 37° C. for 16-20 hours. At the end of the IFN-γ secretion phase, the cells are discarded and the plates are washed three times with 0.1% PBST. A final aliquot of PBST is added to the wells for ten minutes, removed, and 100 μl of a 1:500 dilution of rabbit anti-human IFN-γ polyclonal antibody in PBST+1% BSA is added to each well for 3.5 hours at room temperature with gentle rocking. Unbound anti-IFN-γ polyclonal antibody is removed by three washes with PBST, followed by a wash with 250 μl of 1×Tris-buffered saline+0.05% Tween 20 (TBST). Next, a 100 μl aliquot of 1:5000 alkaline phosphatase-conjugated mouse anti-rabbit polyclonal antibody diluted in TBST is added to each well and incubated at room temperature for 1.5-2 hours with gentle rocking. Excess enzyme-conjugated antibody is removed by three washes with PBST and two washes with alkaline phosphatase followed by addition of the substrate mix of p-Toluidine salt and nitroblue tetrazolium chloride. To stop the calorimetric reaction, plates were washed three times in $dH_2O$, inverted to minimize deposition of dust in the wells, and dried overnight at 28° C. in a dust free drying oven.

Images of the spots corresponding to the lymphokine secreted by individual antigen-stimulated T cells are captured with a CCD video camera and the image is analyzed as described in the example above We conclude that the experiment detailed above can be used for the enumeration of single IFN-γ secreting T cells in blood.

Example 39

This is and example of indirect detection of T cells in blood by measurement of extracellular secreted soluble factors. The soluble factors secreted from individual T cells were detected by capturing of the secreted soluble factors locally by marker molecules. The MHC multimers used are antigen presenting cells presenting antigenic peptides derived from the TB antigen ESAT-6. The measured secreted soluble factor was IFN-7.

Blood from 47 TB patients and 47 control patients with other disease were analysed using the following procedure:

96-well polyvinylidene difluoride backed plates (MAIP S 45; Millipore, Bedford, Mass.) were coated with 15 μg/ml of anti-IFN-γ mAb 1-D1K (Mabtech, Stockholm, Sweden) overnight at 4° C. Plates were then washed 6 times with RPMI-1640 and blocked with RPMI supplemented with L-glutamine, penicillin, and 10% heat-inactivated pooled human AB serum (R10) for 1 h. PBMCs were separated from heparinized whole blood on LYMPHOPREP (Nycomed Pharma AS, Oslo, Norway), washed 3 times, and resuspended in R10. PBMCs were added in 100 μl R10/well to the precoated plates. Input cell numbers were $5\times10^5$/well, in duplicate wells.

8 peptides (MTEQQWNFAGIEAAA (SEQ ID NO 109381), WNFAGIEAAASAIQG (SEQ ID NO 109386), SAIQGNVTSIHSLLD (SEQ ID NO 109396), EGKQSLTKLAAAWGG (SEQ ID NO 109411), YQGVQQKWDATATEL (SEQ ID NO 109431), QKWDATATELNNALQ (SEQ ID NO 109436), NNALQNLARTISEAG (SEQ ID NO 109446) and NLARTISEAGQAMAS (SEQ ID NO 109451) derived from the ESAT-6 antigen from *M. tuberculosis* were added to a final concentration of 2 μM. Assays were incubated for 6-14 h at 37° C., 5% $CO_2$, but some experiments were run overnight for convenience. Assays were arrested by shaking off the contents and washing 6 times with PBS 0.05% Tween 20 (Sigma Chemical Co., St. Louis, Mo.). Next, 100 μl of 1 μg/ml of the biotinylated anti-IFN-γ mAb 7-B6-1 biotin (Mabtech, Stockholm, Sweden) was added. After 3 h of incubation, plates were washed six times more and a 1:1,000 dilution of streptavidin alkaline phosphatase conjugate (Mabtech) was added to the wells and the plates incubated at room temperature for a further 2 h. Next, wells were again washed 6 times and 100 μl of chromogenic alkaline phosphatase substrate (Bio Rad Labs., Hercules, Calif.), diluted 1:25 with deionized water, was added. After 30 min, the colorimetric reaction was terminated by washing with tap water and plates were air dried.

Enumeration of IFN-γ spot-forming cells (SFCs). The above assay detects secreted IFN-γ molecules in the immediate vicinity of the cell from which they are derived, while still at a relatively high concentration; each spot in the read-out represents a footprint of the original IFN-1 producing cell. Spots were counted under magnification of 20 with a stereomicroscope (Leitz GZ6; Leitz, Wetzlar, Germany). Only large spots with fuzzy borders were scored as SFCs. Responses were considered significant if a minimum of five SFCs were present per well, and additionally, this number was at least twice that in negative control wells. The number of spots per well were convertet to SFCs pr million PBMC considering relevant dilution ect in the protocol. The result is shown in FIG. 33. IFN-γ secreting cells could be detected in blood from 45 of 47 TB patients, in contrast only 4 of 47 negative control patients responded to one or more of the 8 ESAT-6 derived peptides.

This example illustrates that addition of antigenic peptide derived from a TB antigen to PBMC's generate MHC multimers (antigen presenting cells) displaying these peptides and that these multimers can detect antigen specific T cells indirectly by stimulation followed by measurement of a soluble factor secreted from the cells as a result of the stimulation.

Example 40

This is and example of indirect detection of T cells in blood by measurement of extracellular secreted soluble factors. The soluble factors secreted from individual T cells are detected by capturing of the secreted soluble factors locally by marker molecules. The MHC multimers used are antigen presenting cells presenting antigenic peptides derived from the TB antigen Rv0116c. The measured secreted soluble factor is IFN-7.

Blood from 47 TB patients and 47 control patients with other disease are analysed using the following procedure:

96-well polyvinylidene difluoride backed plates (MAIP S 45; Millipore, Bedford, Mass.) are coated with 15 μg/ml of anti-IFN-γ mAb 1-D1K (Mabtech, Stockholm, Sweden) overnight at 4° C. Plates are then washed 6 times with RPMI-1640 and blocked with RPMI supplemented with L-glutamine, penicillin, and 10% heat-inactivated pooled human AB serum (R10) for 1 h. PBMCs are separated from heparinized whole blood on LYMPHOPREP (Nycomed Pharma AS, Oslo, Norway), washed 3 times, and resuspended in R10. PBMCs are added in 100 μl R10/well to the precoated plates. Input cell numbers are $5\times10^5$/well, in duplicate wells.

9 peptides (MRRWRYLSWVAIT (SEQ ID NO 60262); RRWRYLSVWAITL (SEQ ID NO 60263); RVVRYLSWVAITLM (SEQ ID NO 60264); VVRYLSWVAITLML (SEQ ID NO 60265); VRYLSVWAITLMLT (SEQ ID NO 60266); RYLSWVAITLMLTA (SEQ ID NO 60267); YLSWVAITLMLTAE (SEQ ID NO 60268); LSVWAITLMLTAES (SEQ ID NO 60269) and SVVVAITLMLTAESV (SEQ ID NO 60270)) derived from the Rv0116c antigen from *M. tuberculosis* (see FIG. 29) are added to a final concentration of 2 μM. Assays are incubated for 6-14 h at 37° C., 5% $CO_2$, but some experiments are run overnight for convenience. Assays are arrested by shaking off the contents and washing 6 times with PBS 0.05% Tween 20 (Sigma Chemical Co., St. Louis, Mo.). Next, 100 μl of 1 μg/ml of the biotinylated anti-IFN-γ mAb 7-B6-1 biotin (Mabtech, Stockholm, Sweden) is added. After 3 h of incubation, plates are washed six times more and a 1:1,000 dilution of streptavidin alkaline phosphatase conjugate (Mabtech) is added to the wells and the plates incubated at room temperature for a further 2 h. Next, wells are again washed 6 times and 100 μl of chromogenic alkaline phosphatase substrate (Bio Rad Labs., Hercules, Calif.), diluted 1:25 with deionized water, is added. After 30 min, the colorimetric reaction is terminated by washing with tap water and plates are air dried.

Enumeration of IFN-γ Spot-Forming Cells (SFCs).

The above assay detects secreted IFN-γ molecules in the immediate vicinity of the cell from which they are derived, while still at a relatively high concentration; each spot in the read-out represents a footprint of the original IFN-γ producing cell. E.g spots can are counted under magnification of 20 with a stereomicroscope (Leitz GZ6; Leitz, Wetzlar, Germany). Only large spots with fuzzy borders are scored as SFCs. Responses are considered significant T cell response if a minimum of five SFCs are present per well, and additionally, this number is at least twice that in negative control wells. The number of spots per well are convertet to SFCs pr million PBMC considering relevant dilutions in the protocol.

This example illustrates that addition of antigenic peptide derived from a TB antigen to PBMC's generate MHC multimers (antigen presenting cells) displaying these peptides and that these multimers can detect antigen specific T cells indirectly by stimulation followed by measurement of a soluble factor secreted from the cells as a result of the stimulation.

Example 41

This is and example of indirect detection of T cells in blood by measurement of extracellular secreted soluble factors. The soluble factors secreted from individual T cells are detected by capturing of the secreted soluble factors locally by marker molecules. The measured secreted soluble factor in this example is IFN-γ. The MHC multimers used are antigen presenting cells presenting antigenic peptides derived from a peptide library covering all 8, 9, 10, 11, 13, 14, 15, and 16 mers of the TB antigen Rv0122. The peptide library may be generated as described in example 21.

Blood from TB patients and negative control subjects are analysed using the following procedure:

96-well polyvinylidene difluoride backed plates (MAIP S 45; Millipore, Bedford, Mass.) are coated with 15 μg/ml of anti-IFN-γ mAb 1-D1K (Mabtech, Stockholm, Sweden) overnight at 4° C. Plates are then washed 6 times with RPMI-1640 and blocked with RPMI supplemented with L-glutamine, penicillin, and 10% heat-inactivated pooled human AB serum (R10) for 1 h. PBMCs are separated from heparinized whole blood on LYMPHOPREP (Nycomed Pharma AS, Oslo, Norway), washed 3 times, and resuspended in R10. PBMCs are added in 100 μl R10/well to the precoated plates. Input cell numbers are $5\times10^5$/well, in duplicate wells.

A library of peptides covering all possible 8, 9, 19, 11, 13, 14, 15 and 16'mers of the antigen Rv0122 (see FIGS. 28 and 29) are generated using the procedure described in example 21. The library peptides are added to a final concentration of 0.1-10 μM each. The peptides may be added in to one well each or pooled in groups of two or more and then added to wells of the microtiterplate.

Assays are incubated for 6-14 h at 37° C., 5% $CO_2$, but some experiments are run overnight for convenience. Assays are arrested by shaking off the contents and washing 6 times with PBS 0.05% Tween 20 (Sigma Chemical Co., St. Louis, Mo.). Next, 100 μl of 1 μg/ml of the biotinylated anti-IFN-γ mAb 7-B6-1 biotin (Mabtech, Stockholm, Sweden) is added. After 3 h of incubation, plates are washed six times more and a 1:1,000 dilution of streptavidin alkaline phosphatase conjugate (Mabtech) is added to the wells and the plates incubated at room temperature for a further 2 h. Next, wells are again washed 6 times and 100 μl of chromogenic alkaline phosphatase substrate (Bio Rad Labs., Hercules, Calif.), diluted 1:25 with deionized water, is added. After 30 min, the colorimetric reaction is terminated by washing with tap water and plates are air dried.

Enumeration of IFN-γ Spot-Forming Cells (SFCs). The Above Assay Detects Secreted IFN-γ molecules in the immediate vicinity of the cell from which they are derived, while still at a relatively high concentration; each spot in the read-out represents a footprint of the original IFN-γ producing cell. E.g spots can are counted under magnification of 20 with a stereomicroscope (Leitz GZ6; Leitz, Wetzlar, Germany). Only large spots with fuzzy borders are scored as SFCs. Responses are considered significant T cell response if a minimum of five SFCs are present per well, and additionally, this number is at least twice that in negative control wells. A significant response is a measure of the presence of T cells specific for the TB antigen Rv0122.

The above described method may be used to detect T cells specific for the TB antigen Rv0122 in blood from patients suspected to be infected with *M. tuberculosis*. The presence of T cells specific for the antigen Rv0122 may be used as a surrogate marker for the presence of TB infection.

Example 42

This is and example of indirect detection of T cells in blood by measurement of extracellular secreted soluble factors. The soluble factors secreted from individual T cells are detected by capturing of the secreted soluble factors locally by marker molecules. The measured secreted soluble factor in this example is IFN-7. The MHC multimers used are antigen presenting cells presenting antigenic peptides derived from a peptide library covering all 8, 9, 10, 11, 13, 14, 15, and 16 mers of any TB antigen described herein.

Blood from suspected TB patients and/or negative control subjects are analysed using the following procedure:

96-well polyvinylidene difluoride backed plates (MAIP S 45; Millipore, Bedford, Mass.) are coated with 15 μg/ml of anti-IFN-γ mAb 1-D1K (Mabtech, Stockholm, Sweden) overnight at 4° C. Plates are then washed 6 times with RPMI-1640 and blocked with RPMI supplemented with L-glutamine, penicillin, and 10% heat-inactivated pooled human AB serum (R10) for 1 h. PBMCs are separated from heparinized whole blood on LYMPHOPREP (Nycomed Pharma AS, Oslo, Norway), washed 3 times, and resuspended in R10. PBMCs are added in 100 μl R10/well to the precoated plates. Input cell numbers are $5\times10^5$/well, in duplicate wells.

A library of peptides covering all possible 8, 9, 19, 11, 13, 14, 15 and 16'mers of any *M. tuberculosis* derived antigen as described herein are generated using the procedure described in example 21 or another procedure able to produce the relevant peptides. The peptides are added to a final concentration of 0.1-10 μM each. The peptides may be added in to one well each or pooled in groups of two or more and then added to wells of the microtiterplate.

Assays are incubated for 6-14 h at 37° C., 5% $CO_2$, but some experiments are run overnight for convenience. Assays are arrested by shaking off the contents and washing 6 times with PBS 0.05% Tween 20 (Sigma Chemical Co., St. Louis, Mo.). Next, 100 μl of 1 μg/ml of the biotinylated anti-IFN-γ mAb 7-B6-1 biotin (Mabtech, Stockholm, Sweden) is added. After 3 h of incubation, plates are washed six times more and a 1:1,000 dilution of streptavidin alkaline phosphatase conjugate (Mabtech) is added to the wells and the plates incubated at room temperature for a further 2 h. Next, wells are again washed 6 times and 100 μl of chromogenic alkaline phosphatase substrate (Bio Rad Labs., Hercules, Calif.), diluted 1:25 with deionized water, is added.

After 30 min, the colorimetric reaction is terminated by washing with tap water and plates are air dried.

Enumeration of IFN-γ Spot-Forming Cells (SFCs).

The above assay detects secreted IFN-γ molecules in the immediate vicinity of the cell from which they are derived, while still at a relatively high concentration; each spot in the read-out represents a footprint of the original IFN-γ producing cell. E.g spots can are counted under magnification of 20 with a stereomicroscope (Leitz GZ6; Leitz, Wetzlar, Germany). Only large spots with fuzzy borders are scored as SFCs. Responses are considered significant T cell response if a minimum of five SFCs are present per well, and additionally, this number is at least twice that in negative control wells. A significant response is a measure of the presence of T cells specific for the chosen TB antigen.

The above described method may be used to detect T cells specific for any TB antigen described herein in blood from patients suspected to be infected with *M. tuberculosis*. The presence of T cells specific for the one or more TB antigen(s) may be used as a surrogate marker for the presence of TB infection.

Example 43

This is an example of how antigen specific T-cells can be detected using a direct detection method detecting T cell immobilized in solid tissue. In this example MHC dextramers are used to detect antigen specific T cells on frozen tissue sections using enzymatic chromogenic precipitation detection.

Equilibrate the cryosection tissue (e.g. section of spleen from transgenic mice) to −20° C. in the cryostate. Cut 5 μm sections and then dry sections on slides at room temperature. Store slides frozen until use at −20° C.

Equilibrate frozen sections to room temperature. Fix with acetone for 5 min. Immediately after fixation transfer slides to TBS buffer (50 mM Tris-HCL pH 7.6, 150 mM NaCl) for 10 min.

Incubate slides with FITC-conjugated MHC-dextramers at appropriate dilution (1:40-1:80) and incubate for 30 min at room temperature. Other dilution ranges, as well as incubation time and temperature, may be desirable.

Decant solution and gently tap slides against filter paper, submerge in TBS buffer. Decant and wash for 10 min in TBS buffer.

Incubate with rabbit polyclonal anti-FITC antibody (Dako P5100) at 1:100 dilution in TBS at room temperature for 30 min.

Repeat step 5 and 6.

Incubate with Envision anti-Rabbit HRP (Dako K4003) at room temperature for 30 min. Other visualization systems may be used.

Repeat step 5 and 6.

Develop with DAB+(Dako K3468) in fume hood for 10 min. Other substrates may be used. Rinse slides in tap-water for 5 min. Counterstain with hematoxylin (Dako S3309) for 2 min. Repeat step 12, mount slides. The slides stained with MHC-Dextramers can now be evaluated by microscopy.

Example 44

This is an example of how antigen specific T-cells can be detected using a direct detection method detecting T cell immobilized in solid tissue. In this example MHC dextramers are used to detect antigen specific T cells on paraffin embedded tissue sections using enzymatic chromogenic precipitation detection.

Formaldehyde fixed paraffin-embedded tissue are cut in section and mounted on the glass slice, for subsequent IHC staining with MHC-dextramers. Tissue fixed and prepared according to other protocols may be used as well. E.g. fresh tissue, lightly fixed tissue section (e.g. tissue fixed in 2% formaldehyde) or formalin-fixed, paraffin-embedded tissue section.

Optimal staining may require target retrieval treatment with enzymes as well as heating in a suitable buffer before incubation with antibodies and MHC-dextramer.

The sample is stained for DNA using DAPI stain, followed by incubated with an antigen specific MHCdex/FITC reagent, followed by addition of anti-FITC antibody labeled with HRP.

Then the substrate for HRP, "DAP" is added and the reaction allows to progress.

The sample is analyzed by light microscopy for the present of a colored precipitate on the cells (DAPI stained nucleus) positive for the specific MHC/dex reagent.

A digital image of the stained sample is obtained, and this can be analyzed manually in the same way as by microscopy. However, a digital image may be used for automatic determination of where and how many cells that are positive, related to the total amount of cells, determined by the DAPI staining, or other criteria or stainings.

Example 45

This example describes how the quality of a MHC multimer can be tested. The MHC multimer in this example is a MHC-dextramer, and the test involves specific binding of the MHC-dextramer to a cell line that express specific TCRs and display these on the cell surface.

A transfected Jurkat T celle line (JT3A) from Altor Biosciences specific for the MHC complex HLA-A*0201 (NLVPMVATV) (SEQ ID NO 201990) was evaluated as positive control for the MHC-dextramer HLA-A*0201 (NLVPMVATV) (SEQ ID NO 201990). The cells were cultured and treated to express TCR just before evaluation. Under the conditions used, 20-50% of the cells were expected to express and display TCR. After stimulation the cells were incubated with fluorescently labeled MHC-dextramers and the extent of cell staining analyzed by flow cytometry, as follows:

1. JT3A cells growing in log phase were incubated at room temperature for 2-3 hours to express TCRs (The TCRs are not stable expressed at 37° C.).
2. After 3 hours cells were centrifuged for 5 min at 400 g, and the supernatant was discarded.
3. Cells were washed in PBS pH 7.4+5% FCS, and centrifuged for 5 min at 400 g. The supernatant was discarded, and cells resuspended in proper volume PBS pH 7.4+5% FCS for counting in a Bürker chamber.
4. $1\times10^6$ cells per sample in 100 μl PBS pH 7.4+5% FCS were added to each sample tube.
5. 10 μl MHC-dextramers were added. Incubation for 30 min at 4° C. in the dark.
6. 5 μl anti-CD3 was added to each sample. Further incubation for 30 min at 4° C. in the dark.
7. Samples were washed in 2 ml PBS, centrifuged for 5 min at 300 g. Supernatant discarded and sample resuspended in 0.4 ml PBS pH 7.4.
8. Samples were kept at 2-8° C. in the dark until analysis on flow cytometer.
9. Samples were analyzed by flow cytometry on a CyAn instrument.

Data were analyzed by the Summit software. Stimulated JT3A cells were stained with the specific MHC-dextramer HLA-A*0201(NLVPMVATV) (SEQ ID NO 201990) and anti-CD3. Another sample of cells were stained with the irrelevant MHC-dextramer HLA-A*0201(GILGFVFTL) (SEQ ID NO 202003) and anti-CD3. The cells stained with HLA-A*0201(GILGFVFTL) (SEQ ID NO 202003) had weak signals (low fluorescent intensity), and therefore regarded as the negative population. A boundary was introduced in the dot plot, to mark the negative population. Cells with fluorescence higher than the negative boundary were hereafter regarded positive. 19% and 0.25% of the cells were regarded positive when stained with the relevant and irrelevant MHC-dextramer, respectively. See table below.

| MHC-complex | Percentage of positive cells |
|---|---|
| HLA-A*0201(NLVPMVATV) (SEQ ID NO 201990) | 19% |
| HLA-A*0201(GILGFVFTL) (SEQ ID NO 202003) | 0.25% |

The results thus correlate well with the expected 20-50% HLA-A*0201(NLVPMVATV) (SEQ ID NO 201990) positive JT3A cells after stimulation. We conclude that the transfected Jurkat cell line (JT3A) can be used as positive control for the MHC-dextramer.

Example 46

This example describes how the quality of a MHC multimer can be tested. The MHC multimer in this example is a MHC-dextramer, and the test involves specific binding of the MHC-dextramer to cell preparations expressing TCRs.

Three different peptide specific T-cell preparations of Human cytotoxic T lymphocyte lines specific for a viral peptides were incubated with fluorescently labeled MHC-dextramers and the extent of cell staining analyzed by flow cytometry. The following T-cell preparations were examined: (NLV) specific for MHC-dextramer HLA-A*0201 (NLVPMVATV) (SEQ ID NO 201990), (IPSI) specific for MHC-dextramer B*3501(IPSINVHHY) (SEQ ID NO 202004) and (GLC) specific for MHC-dextramer A*0201 (GLCLVALM) (SEQ ID NO 202005).

1. Cells were added 1 ml RPMI and then transfer to a tube with 9 ml RPMI. Cells were centrifuged for 5 min at 300 g, and the supernatant was discarded.
2. Cells were washed in 10 ml PBS pH 7.4+5% FCS, and centrifuged for 5 min at 300 g, and the supernatant was discarded.
3. $1\times10^6$ cells per sample in 100 μl PBS pH 7.4+5% FCS were added to sample tubes.
4. 10 μl MHC Dextramers were added, and incubated at room temperature in the dark for 10 min.
5. 5 μl anti-CD3 and anti-CD8 were added to each sample. Further incubation for 20 min at 4° C. in the dark.
6. Samples were washed in 2 ml PBS pH 7.4+5% FCS and centrifuged for 5 min at 300 g, and the supernatant was discarded.
7. Pellets were resuspended in 0.4 ml PBS pH 7.4.
8. Samples were kept in the dark at 2-8° C. until analysis on a flow cytometer.
9. Samples were analyzed by flow cytometry on a CyAn instrument.

Data were analyzed by the Summit software. The cell preparations were stained with anti-CD3, anti-CD8, the respective specific MHC-dextramer, or an irrelevant MHC-dextramer. Anti-CD3 positive cells were positively gated and anti-CD8 vs. MHC-dextramer were depicted in a dot plot. The main population of anti-CD8 positive cells stained with the irrelevant MHC-dextramer was regarded as negative, and a boundary was introduced in the dot plot to mark the negative population. Anti-CD8 positive cells with fluorescence higher than the negative boundary were regarded positive. In the NLV and IPSI cell preparations, approximately 95% of the $CD8^+$ cells were positive for the relevant MHC dextramer. 45% of the $CD8^+$ GLC cells were positive for relevant MHC Dextramers, see table below. Cell preparations were not stained by the irrelevant MHC-dextramer.

We conclude that the different peptide specific T-cell preparations can be used as positive controls for the relevant MHC-dextramer.

| Cell preparation | MHC-complex | Percentage of positive cells |
|---|---|---|
| NLV | HLA-A*0201(NLVPMVATV) (SEQ ID NO 201990) | 97% |
| | HLA-B*3501(IPSINVHHY) (SEQ ID NO 202004) | 0.02% |
| IPSI | HLA-B*3501(IPSINVHHY) (SEQ ID NO 202004) | 95% |
| | HLA-A*0201(NLVPMVATV) (SEQ ID NO 201990) | 0.01% |
| GLC | HLA-A*0201(GLCLVALM) (SEQ ID NO 202005) | 45% |
| | HLA-A*0201(ILKEPVHGV) (SEQ ID NO 201991) | 0.1% |

Example 47

This example describes the prediction of MHC class 1 and 2 *Mycobacterium tuberculosis* CFP10 peptide sequences for use in construction of MHC multimers designed to be used for analytical, diagnostic, prognostic, therapeutic and vaccine purposes, through the interaction of the MHC multimers with *Mycobacterium tuberculosis* CFP10 specific T-cells. Prediction of the 8-, 9-, 10-, 11-, 13-, 14-, 15- and 16-mer peptide sequences are carried out using the protein sequence for the *M. tuberculosis* derived antigen CFP10 (see table 6) and the peptide generation software program described in FIG. 2. The outcome is shown in FIGS. 28 and 29 under the CFP10/Rv3874 antigen.

Example 48

This is an example of how MHC multimers may be used for diagnosis of Tuberculosis (TB) in blood samples from humans infected with *Mycobacterium tuberculosis*. In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis Antigen* 85B (Ag85B) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8x10e-8 M. The following MHC(peptide)/APC dextran constructs are made:

16. APC-SA conjugated 270 kDa dextran coupled with HLA-A*0201 in complex with beta2microglobulin and the peptide KLVANNTRL (SEQ ID NO 199992) derived from Ag85B.
17. APC-SA conjugated 270 kDa dextran coupled with HLA-A*0201 in complex with beta2microglobulin and the peptide YLLDGLRAQ (SEQ ID NO 199937) derived from Ag85B.
18. APC-SA conjugated 270 kDa dextran coupled with HLA-A*0201 in complex with beta2microglobulin and the peptide FLTSELPQW (SEQ ID NO 199959) derived from Ag85B.
19. APC-SA conjugated 270 kDa dextran coupled with HLA-A*0201 in complex with beta2microglobulin and the non-sense peptide GLAGDVSAV (SEQ ID NO 201989).

The binding of the above described MHC(peptide)/APC dextran can be used to determine the presence of Ag85B specific T cells in the blood from TB infected individuals by flow cytometry following a standard flow cytometry protocol. Blood from a patient with TB is isolated and 100 ul of this blood is incubated with 10 μl of one of the MHC (peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flow-cytometer.

The presence of cells labeled with anti-CD3/PB, anti-CD8/PE and either of the MHC(peptide)/APC dextran constructs 1, 2 or 3 described above and thereby the presence of TB specific T cells will indicate that the patient are infected with *Mycobacterium tuberculosis*. Blood analysed with MHC(peptide)/APC dextran construct 4 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 49

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis* Antigen 85B (Ag85B) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes. The following SA-MHC(peptide)/APC tetramers are made:

20. APC-SA coupled with HLA-A*0201 in complex with beta2microglobulin and the peptide KLVANNTRL (SEQ ID NO 199992) derived from Ag85B.
21. APC-SA coupled with HLA-A*0201 in complex with beta2microglobulin and the peptide YLLDGLRAQ (SEQ ID NO 199937) derived from Ag85B.
22. APC-SA coupled with HLA-A*0201 in complex with beta2microglobulin and the peptide FLTSELPQW (SEQ ID NO 199959) derived from Ag85B.
23. APC-SA coupled with HLA-A*0201 in complex with beta2microglobulin and the non-sense peptide GLAGDVSAV (SEQ ID NO 201989).

The binding of the above described MHC(peptide)/APC dextran can be used to determine the presence of Ag85B specific T cells in the blood from TB infected individuals by flow cytometry following a standard flow cytometry protocol. Blood from a patient with TB is isolated and 100 ul of this blood is incubated with either of the four SA-MHC (peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 5, 6 or 7 described above and thereby the presence of TB specific T cells will indicate that the patient are infected with *Mycobacterium tuberculosis*. Blood analysed with SA-MHC (peptide)/APC tetramers 8 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis.*

Example 50

This is an example of how MHC multimers may be used for diagnosis of Tuberculosis (TB) in blood samples from humans infected with *Mycobacterium tuberculosis.*

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis.*

This is an example of how MHC multimers may be used for diagnosis of Tuberculosis (TB) in blood samples from humans infected with *Mycobacterium tuberculosis*. The MHC multimer used are MHC complexes coupled to TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis.*

Purified MHC-peptide complexes consisting of HLA-A*0201 heavy chain, human beta2microglobulin and peptide derived from regions in *Mycobacterium tuberculosis Antigen* 85B (Ag85B) or a negative control peptide are generated by in vitro refolding and purified or purified from antigen presenting cells. MHC-peptide complexes are then coupled to a multimerisation domain together with APC.

The following MHC(peptide)/APC multimers are made:

24. APC-multimerisation domain coupled with HLA-A*0201 in complex with beta2microglobulin and the peptide KLVANNTRL (SEQ ID NO 199992) derived from Ag85B.
25. APC-multimerisation domain coupled coupled with HLA-A*0201 in complex with beta2microglobulin and the peptide YLLDGLRAQ (SEQ ID NO 199937) derived from Ag85B.
26. APC-multimerisation domain coupled coupled with HLA-A*0201 in complex with beta2microglobulin and the peptide FLTSELPQW (SEQ ID NO 199959) derived from Ag85B.
27. APC-multimerisation domain coupled with HLA-A*0201 in complex with beta2microglobulin and the non-sense peptide GLAGDVSAV (SEQ ID NO 201989).

The binding of the above described MHC(peptide)/APC multimers can be used to determine the presence of Ag85B specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 9, 10 or 11 described above and thereby the presence of TB specific T cells will indicate that the patient are infected with *Mycobacterium tuberculosis*. Blood analysed with MHC (peptide)/APC multimer 12 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis.*

Example 51

This is an example of how MHC multimers may be used for diagnosis of Tuberculosis (TB) in blood samples from humans infected with *Mycobacterium tuberculosis.*

In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis.*

Purified MHC-peptide complexes consisting of HLA-B*0801 heavy chain, human beta2microglobulin and peptide derived from regions in *Mycobacterium tuberculosis* Antigen 85B (Ag85B) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8×10e-8 M. The following MHC(peptide)/APC dextran constructs are made:

28. APC-SA conjugated 270 kDa dextran coupled with HLA-B*0801 in complex with beta2microglobulin and the peptide MGRDIKVQF (SEQ ID NO 57592) derived from Ag85B.
29. APC-SA conjugated 270 kDa dextran coupled with HLA-B*0801 in complex with beta2microglobulin and the peptide DIKVQFQSG (SEQ ID NO 57595) derived from Ag85B.
30. APC-SA conjugated 270 kDa dextran coupled with HLA-B*0801 in complex with beta2microglobulin and the peptide ENFVRSSNL (SEQ ID NO 59106) derived from Ag85B.
31. APC-SA conjugated 270 kDa dextran coupled with HLA-B*0801 in complex with beta2microglobulin and the non-sense peptide.

The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC dextran constructs 13, 14 or 15 described above and thereby the presence of TB specific T cells will indicate that the patient are infected with *Mycobacterium tuberculosis*. Blood analysed with MHC(peptide)/APC dextran construct 16 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 52

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-A*0201 heavy chain, human beta2microglobulin and peptide derived from regions in *Mycobacterium tuberculosis Antigen* 85B (Ag85B) or a negative control peptide were generated by in vitro refolding, purified and biotinylated as described elsewhere herein. Biotinylated MHC-peptide complexes are then coupled SA labelled with APC. MHC-peptide complexes were added in an amount corresponding to a ratio of 5 MHC-peptide molecules per SA molecule. Then SA/APC carrying four MHC complexes were purified from free SA, free monomeric MHC complex, SA carrying three, two and one MHC complexes.

The following SA-MHC(peptide)/APC tetramers are made:

32. APC-SA coupled with HLA-B*0801 in complex with beta2microglobulin and the peptide MGRDIKVQF (SEQ ID NO 57592) derived from Ag85B.
33. APC-SA coupled with HLA-B*0801 in complex with beta2microglobulin and the peptide DIKVQFQSG (SEQ ID NO 57595) derived from Ag85B.
34. APC-SA coupled with HLA-B*0801 in complex with beta2microglobulin and the peptide ENFVRSSNL (SEQ ID NO 59106) derived from Ag85B.
35. APC-SA coupled with HLA-B*0801 in complex with beta2microglobulin and the non-sense peptide.

The binding of the above described MHC(peptide)/APC dextran can be used to determine the presence of Ag85B specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the SA-MHC(peptide)/APC tetramers 17, 18 or 19 described above and thereby the presence of TB specific T cells will indicate that the patient are infected with *Mycobacterium tuberculosis*. Blood analysed with SA-MHC (peptide)/APC tetramers 20 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis.*

Example 53

This is an example of how MHC multimers may be used for diagnosis of Tuberculosis (TB) in blood samples from humans infected with *Mycobacterium tuberculosis*. In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis.*

Purified MHC-peptide complexes consisting of HLA-B*0801 heavy chain, human beta2microglobulin and peptide derived from regions in *Mycobacterium tuberculosis* Antigen 85B (Ag85B) or a negative control peptide are generated by in vitro refolding and purified or purified from antigen presenting cells. MHC-peptide complexes are then coupled to a multimerisation domain together with APC.

The following MHC(peptide)/APC multimers are made:

36. APC-multimerisation domain coupled with HLA-B*0801 in complex with beta2microglobulin and the peptide MGRDIKVQF (SEQ ID NO 57592) derived from Ag85A.
37. APC-multimerisation domain coupled with HLA-B*0801 in complex with beta2microglobulin and the peptide DIKVQFQSG (SEQ ID NO 57595) derived from Ag85A.
38. APC-multimerisation domain coupled with HLA-B*0801 in complex with beta2microglobulin and the peptide ENFVRSSNL (SEQ ID NO 59106) derived from Ag85AB.
39. APC-multimerisation domain coupled with HLA-B*0801 in complex with beta2microglobulin and the non-sense peptide.

The binding of the above described MHC(peptide)/APC multimers can be used to determine the presence of Ag85B specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 21, 22 or 23 described above and thereby the presence of TB specific T cells will indicate that the patient are infected with *Mycobacterium tuberculosis*. Blood analysed with MHC (peptide)/APC multimer 24 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis.*

Example 54

This is an example of how MHC multimers may be used for diagnosis of Tuberculosis (TB) in blood samples from humans infected with *Mycobacterium tuberculosis*. In this example the MHC multimer used are MHC complexes coupled to fluorophor-labelled dextran (Dextramers). The dextramers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis.*

Purified MHC-peptide complexes consisting of HLA-B*44 heavy chain, human beta2microglobulin and peptide derived from regions in antigen Mtb39 or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8x10e-8 M. The following MHC(peptide)/APC dextran constructs are made:

40. APC-SA conjugated 270 kDa dextran coupled with HLA-B*44 in complex with beta2microglobulin and the peptide MWAQDAAAMF (SEQ ID NO 202009) derived from Mtb39.
41. APC-SA conjugated 270 kDa dextran coupled with HLA-B*44 in complex with beta2microglobulin and the peptide AAERGPGQML (SEQ ID NO 202010) derived from Mtb39.

42. APC-SA conjugated 270 kDa dextran coupled with HLA-B*44 in complex with beta2microglobulin a non-sense peptide (as described elsewhere herein).

The binding of the above described MHC(peptide)/APC dextran can be used to determine the presence of Mtb39 specific T cells in the blood from TB infected individuals by flow cytometry following a standard flow cytometry protocol.

Blood from a patient with TB is isolated and 100 ul of this blood is incubated with 10 µl of one of the MHC(peptide)/APC dextran constructs described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the MHC(peptide)/APC dextran constructs 25 or 26 described above and thereby the presence of TB specific T cells will indicate that the patient are infected with *Mycobacterium tuberculosis*. Blood analysed with MHC(peptide)/APC dextran construct 27 should show no staining of CD3 and CD8 positive cells with this MHC (peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 55

This is an example of how MHC multimers may be used for diagnosis of Tuberculosis (TB) in blood samples from humans infected with *Mycobacterium tuberculosis*. In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*44 heavy chain, human beta2microglobulin and peptide derived from regions in antigen Mtb39 or a negative control peptide are generated by in vitro refolding, purified and biotinylated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:

43. APC-SA coupled with HLA-B*44 in complex with beta2microglobulin and the peptide MWAQDAAAMF (SEQ ID NO 202009) derived from Ag85B.

44. APC-SA coupled with HLA-B*44 in complex with beta2microglobulin and the peptide AAERGPGQML (SEQ ID NO 202010) derived from Ag85B.

45. APC-SA coupled with HLA-B*44 in complex with beta2microglobulin and the non-sense peptide.

The binding of the above described MHC(peptide)/APC dextran can be used to determine the presence of Mtb39 specific T cells in the blood from TB infected individuals by flow cytometry following a standard flow cytometry protocol. Blood from a patient with TB is isolated and 100 ul of this blood is incubated with either of the four SA-MHC (peptide)/APC tetramers described above for 10 minutes in the dark at room temperature. 5 µl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 µl PBS; pH=7.2 and analyzed on flowcytometer.

The presence of cells labeled with anti-CD3/PB, anti-CD8/PE and either of the SA-MHC(peptide)/APC tetramers 28 or 29 described above and thereby the presence of TB specific T cells will indicate that the patient are infected with *Mycobacterium tuberculosis*. Blood analysed with SA-MHC (peptide)/APC tetramers 30 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 56

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*44 heavy chain, human beta2microglobulin and peptide derived from regions in antigen Mtb39 or a negative control peptide are generated by in vitro refolding and purified or purified from antigen presenting cells. MHC-peptide complexes are then coupled to a multimerisation domain together with APC.

The following MHC(peptide)/APC multimers are made:

46. APC-multimerisation domain coupled with HLA-B*44 in complex with beta2microglobulin and the peptide MWAQDAAAMF (SEQ ID NO 202009) derived from Mtb39.
47. APC-multimerisation domain coupled coupled with HLA-B*44 in complex with beta2microglobulin and the peptide AAERGPGQML (SEQ ID NO 202010) derived from Mtb39.
48. APC-multimerisation domain coupled coupled with HLA-B*44 in complex with beta2microglobulin and the non-sense peptide.

The binding of the above described MHC(peptide)/APC multimers can be used to determine the presence of Mtb39 specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and either of the MHC(peptide)/APC multimers 31 or 32 described above and thereby the presence of TB specific T cells will indicate that the patient are infected with *Mycobacterium tuberculosis*. Blood analysed with MHC (peptide)/APC multimer 33 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 57

This is an example of how MHC multimers may be used for diagnosis of Tuberculosis (TB) in blood samples from humans infected with *Mycobacterium tuberculosis*. In this example the MHC multimer used are MHC complexes coupled to fluorophor-labelled dextran (Dextramers). The dextramers are used for direct detection of TCR in flow cytometry. The antigen origin is TB, thus, immune monitoring of TB. TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (Table 6) or a negative control peptide are generated by in vitro refolding, purified and biotinylated as described elsewhere herein. Biotinylated MHC-peptide complexes are then coupled to a 270 kDa dextran multimerization domain labelled with APC by interaction with streptavidin (SA) on the dextran multimerization domain. The dextran-APC-SA multimerization domain is generated as described elsewhere herein. MHC-peptide complexes are added in an amount corresponding to a ratio of three MHC-peptide molecules per SA molecule and each molecule dextran contained 3.7 SA molecule and 8.95 molecules APC. The final concentration of dextran was 3.8x10e-8 M. The following MHC (peptide)/APC dextran constructs are made:

49. APC-SA conjugated 270 kDa dextran coupled with HLA-B*14 in complex with beta2microglobulin and the peptide RADEEQQQAL (SEQ ID NO 50831) derived from CFP10.
50. APC-SA conjugated 270 kDa dextran coupled with HLA-B*14 in complex with beta2microglobulin and the non-sense peptide.

The binding of the above described MHC(peptide)/APC dextran can be used to determine the presence of CFP10 specific T cells in the blood from TB infected individuals by flow cytometry following a standard flow cytometry protocol.

Blood from a patient with TB is isolated and 100 ul of this blood is incubated with 10 μl of one of the MHC(peptide)/APC dextran constructs described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the MHC(peptide)/APC dextran constructs 34 described above and thereby the presence of TB specific T cells will indicate that the patient are infected with *Mycobacterium tuberculosis*. Blood analysed with MHC(peptide)/APC dextran construct 25 should show no staining of CD3 and CD8 positive cells with this MHC(peptide)/APC dextran construct.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 58

This is an example of how MHC multimers may be used for diagnosis of Tuberculosis (TB) in blood samples from humans infected with *Mycobacterium tuberculosis*.

In this example the MHC multimer used are MHC complexes coupled to fluorophor-labelled the multimerisation domain Streptavidin (SA), used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (Table 6) or a negative control peptide are generated by in vitro refolding, purified and biotinylated as described elsewhere herein. Biotinylated MHC-peptide complexes are then coupled SA labelled with APC. MHC-peptide complexes are added in an amount corresponding to a ratio of 5 MHC-peptide molecules per SA molecule. Then SA/APC carrying four MHC complexes are purified from free SA, free monomeric MHC complex, SA carrying three, two and one MHC complexes.

The following SA-MHC(peptide)/APC tetramers are made:

51. APC-SA coupled with HLA-B*14 in complex with beta2microglobulin and the peptide RADEEQQQAL (SEQ ID NO 50831) derived from CFP10.
52. APC-SA coupled with HLA-B*44 in complex with beta2microglobulin and a non-sense peptide (as described elsewhere herein).

The binding of the above described MHC(peptide)/APC dextran can be used to determine the presence of CFP10 specific T cells in the blood from TB infected individuals by flow cytometry following a standard flow cytometry protocol.

Blood from a patient with TB is isolated and 100 ul of this blood is incubated with either of the four SA-MHC(peptide)/APC tetramers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the SA-MHC(peptide)/APC tetramers 36 described above and thereby the presence of TB specific T cells will indicate that the patient are infected with *Mycobacterium tuberculosis*. Blood analysed with SA-MHC(peptide)/APC tetramers 37 should show no staining of CD3 and CD8 positive cells with this SA-MHC(peptide)/APC tetramer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 59

This is an example of how MHC multimers may be used for diagnosis of Tuberculosis (TB) in blood samples from humans infected with *Mycobacterium tuberculosis*.

In this example the MHC multimer used are MHC complexes coupled to any fluorophor-labelled multimerisation as described elsewhere herein. The MHC multimers are used for direct detection of TCR in flow cytometry. The antigen origin is TB, thus, immune monitoring of TB.

TB is caused by infection by *Mycobacterium tuberculosis*. During acute infection TB specific activated T cells will be present in increased amounts in an activated state compared to healthy individuals. The presences of an increased amount of activated TB specific T cells may thereby act as a surrogate marker for infection with *Mycobacterium tuberculosis*. MHC multimers carrying TB specific peptides is in this example used to detect the presence of TB specific T cells in the blood of patients infected with *Mycobacterium tuberculosis*.

Purified MHC-peptide complexes consisting of HLA-B*14 heavy chain, human beta2microglobulin and peptide derived from regions in culture filtrate protein 10 (CFP10) antigen (table 6) or a negative control peptide are generated by in vitro refolding and purified or purified from antigen presenting cells. MHC-peptide complexes are then coupled to a multimerisation domain together with APC.

The following MHC(peptide)/APC multimers are made:

53. APC-multimerisation domain coupled with HLA-B*14 in complex with beta2microglobulin and the peptide RADEEQQQAL (SEQ ID NO 50831) derived from CFP10.
54. APC-multimerisation domain coupled coupled with HLA-B*14 in complex with beta2microglobulin and the non-sense peptide.

The binding of the above described MHC(peptide)/APC multimers can be used to determine the presence of CFP10 specific T cells in the blood from TB infected individuals by flow cytometry following a standard flow cytometry protocol.

Blood from a patient with TB is isolated and 100 ul of this blood is incubated with either of the four MHC(peptide)/APC multimers described above for 10 minutes in the dark at room temperature. 5 μl of each of each of the antibodies mouse-anti-human CD3/PB (clone UCHT1 from Dako) and mouse-anti-human CD8/PE (clone DK25 from Dako) are added and the incubation continued for another 20 minutes at 4° C. in the dark. The samples are then washed by adding 2 ml PBS; pH=7.2 followed by centrifugation for 5 minutes at 200×g and the supernatant removed. The washing step is repeated. The washed cells are resuspended in 400-500 μl PBS; pH=7.2 and analyzed on flowcytometer.

The presence of cells labeled with anti-CD3/PB, anti-CD8/PE and the MHC(peptide)/APC multimers 38 described above and thereby the presence of TB specific T cells will indicate that the patient are infected with *Mycobacterium tuberculosis*. Blood analysed with MHC(peptide)/APC multimer 39 should show no staining of CD3 and CD8 positive cells with this SA-MHC(peptide)/APC multimer.

The sensitivity of the above described diagnostic test may be enhanced by addition of labeled antibodies specific for activation markers expressed in or on the surface of the TB specific T cells.

We conclude that the MHC(peptide)/APC dextran constructs can be used to detect the presence of TB specific T cells in the blood of patients infected with *Mycobacterium tuberculosis*.

Example 60

This is an example of how MHC multimers may be used for the detection of antigen specific T-cells simultaneously with activation of T cells.

This example is a combination of i) direct detection of TCR, using MHC complexes coupled to any multimerisation as described elsewhere herein to stain antigen specific T cells, and ii) indirect detection of TCR, by detection of induced intracellular cytokine production by addition of fluorophor-labelled anti-cytokine antibodies by flow cytometry.

Multicolor immunofluorescent staining with antibodies against intracellular cytokines and cell surface markers provides a high resolution method to identify the nature and frequency of cells which express a particular cytokine(s). In addition to enabling highly specific and sensitive measurements of several parameters for individual cells simultaneously, this method has the capacity for rapid analysis of large numbers of cells which are required for making statistically significant measurements.

Production of cytokines plays an important role in the immune response. Examples include the induction of many antiviral proteins by IFN-γ, the induction of T cell proliferation by IL-2 and the inhibition of viral gene expression and replication by TNF-α. Cytokines are not preformed factors; instead they are rapidly produced upon relevant stimulation. Intracellular cytokine staining relies upon the stimulation of T cells in the presence of an inhibitor of protein transport thus retaining the cytokines inside the cell.

Cellular activation to trigger cytokine production generally results in down-regulation of the T cell receptor. For this reason, MHC multimer staining is carried out prior to activation to ensure a good level of staining. The MHC multimers may be internalized with the T cell receptor during this period, but can still be detected in permeabilized cells. To analyze the effector function of antigen-specific T cells, the cells are first stained with MHC multimers, and then stimulated with antigen. This is followed by staining with antibodies specific for extracellular epitopes (such as CD8), then by membrane permeabilization and intracellular cytokine staining. The following protocol is an example of MHC multimer co-staining with anti-IFN-γ, TNF-α, MIP-1b, or IL-2.

Protocol applicable for intracellular staining of IFN-gamma, TNFa, MIP-1b, or IL-2

1. Prepare peripheral blood cells in phosphate buffered saline (PBS) at a cell concentration of $2\times10^7$ cells/ml.
2. Transfer the cell suspension to individual tubes in 50 μl aliquots.
3. Add relevant titrated fluorescently-labeled MHC multimers to the desired tubes, and incubate for 10 min at 22° C. (nonstimulated single-color controls should not be stained at this stage). Add 10 μl PBS to remaining tubes.
4. Add 500 μl PBS to each tube. Centrifuge at 450×g for 5 minutes at 10° C.
5. Aspirate supernatant. Agitate to disrupt cell pellets and resuspend in 200 μl complete RPMI.
6. Dilute peptide/antigen stock 1:50 in complete RPMI. Add 2 μl of this (10 μg/ml (investigate the effect on cytokine response of titrating your peptide)) to each desired tube. If using Leukocyte Activation cocktail (LAC) as a control, rapidly thaw this at 37° C. in a water bath and add 0.33 μl of this to each desired tube.
7. Place the tubes at 37° C. in a humidified $CO_2$ incubator for 15 minutes to 1 hour.
8. Add Brefeldin A (10 μg/ml final) to the desired tubes (n.b. LAC contains Brefeldin A) and return to the incubator. Incubate for 15 hours (the optimal incubation time is variable and must be determined).
9. Remove tubes from the incubator. Centrifuge at 450×g for 5 minutes at 10° C.
10. Aspirate supernatant. Resuspend desired cell pellets in 50 μl PBS containing an optimally titrated amount of anti-CD8 antibody. Add 50 μl PBS to remaining tubes. Note: Single-color controls should be stained at this stage. If additional phenotyping of samples is desired, antibodies to other cell surface receptors may also be added at this time.
11. Incubate for 20 minutes on ice.
12. Add 500 μl PBS to each tube. Centrifuge at 450×g for 5 minutes at 10° C.
13. Aspirate supernatant. Agitate to disrupt cell pellets.
14. Add 200 μl 4% paraformaldehyde to each sample tube. Vortex tubes. Incubate for 20 minutes on ice. This step will fix the cell morphology of the activated cells. Note: The procedure can be stopped at this point. Repeat steps 12 and 13. Resuspend the cells in 100 μl/tube PBS. Cover and store the cells at 4° C. for up to 3 days. To proceed, repeat steps 12 and 13. Resuspend the cells in 100 μl/tube permeabilization buffer and proceed to step 16.
15. Add 200 μl permeabilization buffer to each tube.
16. Centrifuge at 450×g for 5 minutes at 10° C. Aspirate supernatant.
17. Add 100 μl permeabilization buffer to the sample tubes that are to be stained with anti-cytokine antibody. Add 100 μl PBS to the remaining tubes (i.e. Single-color controls).
18. Incubate for 5 minutes at room temperature.
19. Add an optimally titrated amount of conjugated anti-cytokine antibody to the desired sample tubes and mix.
20. Incubate for 20 minutes at room temperature.
21. Add 200 μl permeabilization buffer to each tube and centrifuge at 450×g for 5 minutes at 10° C. Aspirate supernatant and agitate tubes to disrupt the cell pellets.
22. Resuspend the cells in 200 μl fix solution. Vortex tubes. It is important to vortex well when adding this fixative so that cells do not clump.
23. The samples are now ready for data acquisition and analysis on a flow cytometer but may be stored overnight at 4° C. in the dark prior to analysis.

We conclude that the MHC multimer constructs can be used to detect the presence of specific T cells in the blood simultaneously with activation and intracellular staining of cytokines.

Example 61

This is an example of how MHC multimers may be used for the detection of antigen specific T-cells simultaneously with activation of T cells.

This example is a combination of i) direct detection of TCR, using MHC complexes coupled as pentamer structures to stain antigen specific T cells, and ii) indirect detection of TCR, by detection of induced intracellular cytokine production by addition of fluorophor-labelled anti-cytokine antibodies by flow cytometry. The antigenic origin is Epstein-Barr Virus (EBV), thus, immune monitoring of EBV infection PBMCs were incubated with either a negative control (non-specific) Pentamer MHC multimer (A*0201/EBV (GLCTLVAML) (SEQ ID NO 201993)) or a Pentamer MHC multimer specific for the cells of interest (B*0801/EBV (RAKFKQLL) (SEQ ID NO 202008)), then stimulated with LAC (non-specific activation) or B*0801/EBV peptide (specific peptide activation) for 15 hours in the presence of Brefeldin A. Pentamer MHC multimers were produced as described elsewhere herein. Fixation, permeabilization and staining for IFN-γ were carried out exactly as detailed in the protocol outlined in example 60 above.

FIG. 31 illustrates Pentamer (specific or non-specific) versus intracellular IFN-γ staining after activation with specific or non-specific antigen.

We conclude that the MHC multimer constructs can be used to detect the presence of EBV specific T cells in the blood simultaneously with activation and intracellular staining of cytokines.

Modified from www.proimmune.com: Pro5 Recombinant MHC Pentamer staining protocol for human Intracellular Proteins. Version 4.1 February 2007.

Example 62

This is an example of how MHC multimers may be used for the detection of antigen specific T-cells and activation of T cells This example is a combination of i) direct detection of TCR, using MHC complexes coupled as any multimerisation as described elsewhere herein to stain antigen specific T cells, and ii) indirect detection of TCR, by detection of induced intracellular cytokine production by addition of fluorophor-labelled anti-cytokine antibodies by flow cytometry.

PBMCs are stimulated with either a negative control (non-specific) MHC multimer or a MHC multimer specific for the cells of interest (specific peptide activation) for an optimal period of time in the presence of Brefeldin A. Fixation, permeabilization and staining for IFN-γ are carried out as detailed in the protocol outlined in the example 60.

We conclude that the MHC multimer constructs can activate T cells. The cytokine production is detected by intracellular staining in flow cytometric analysis.

Example 63

This is an example of how MHC multimers may be used for detection of Tuberculosis specific T cells in blood samples from a human infected with *Mycobacterium tuberculosis*. In this example the MHC multimer used were MHC pentamers where the multimerisation domain was a coil-coiled pentameric structure as described elsewhere herein. The MHC multimers were used for direct detection of TCR by flow cytometry. The antigen origin is *M. tuberculosis*, thus, immune monitoring of TB.

PE labelled HLA-A2 pentamer MHC multimer complexes loaded with the *M. tuberculosis* Ag85A epitope GLPVEYLQV (SEQ ID NO 57579), the 16-kDa epitope GILTVSVAV (SEQ ID NO 124191), or the ESAT-6 epitope AMASTEGNV (SEQ ID NO 199766) were produced as described in example 13 and used to stain CD8 positive lymphocytes as described below:

Mononuclear cells from heparinized blood (PBMC) or CSF were isolated from a patient with TB by centrifugation on Ficoll-Hypaque (Pharmacia) using a standard procedure. The medium used throughout was RPMI 1640 (Invitrogen Life Technologies) supplemented with 10% heat-inactivated pooled human $AB^+$ serum, 2 mM L-glutamine, 20 mM HEPES, 100 U/ml penicillin, 100 μg/ml streptomycin, $5\times10^{-5}$ M 2-ME. PBMC or CSF cells were washed in complete medium and incubated with FITC-labeled anti-CD8 mAb, PE-labeled pentamers, allophycocyanin-labeled anti-CCR7 mAb and PE-Cy5-labeled anti-CD45RA mAb in incubation buffer (PBS containing 1% FCS and 0.1% sodium azide) for 30 min at 4° C., washed twice, and analyzed on a flow cytometry. A standard staining protocol as described elsewhere herein for staining with pentamers or MHC dextramers was used.

Viable lymphocytes were gated by forward and side scatter, and analysis was performed on at least 100,000 acquired events for each sample.

CD8 positive T cells specific for the Ag85A epitope, the 16-kDa epitope and the ESAT-6 epitope could be detected in both PBMC and CSF. As shown in FIG. 32 www.jimmunol.org/cgi/content/full/177/3/1780-F5, the frequency of Ag85A-specific CD8 T cells was greater in CSF (1.30%) than in PBMC (0.21%), indicating compartmentalization of mycobacteria-specific T cells at the site of disease. No Ag-specific bias in the repertoire of the polyclonal T responses in CSF was evident because the frequency of HLA-*A0201 pentamer complexes loaded with *M. tuberculosis* 16-kDa epitope GILTVSVAV (SEQ ID NO 124191) demonstrated a similar enrichment in CSF compared with PBMC (0.14 and 1.56% in PBMC and CSF, respectively), and the frequency of HLA-A*0201 pentamer complexes loaded with ESAT-6 epitope AMASTEGNV (SEQ ID NO 199766) was 0.18 and 0.97% in PBMC and CSF, respectively.

As shown for the staining with pentamers containing the Ag85A epitope, cells in blood were primarily naïve (CCR7+,CD45RA+) or central memory cells (CCR7+, CD45RA−) in contrast to cells in CSF that were effector memory (CCR7−,CD45RA−) or effector memory RA+ cells (CCR7−,CD45RA+).

This example demonstrates that MHC pentamers carrying different epitopes derived from *M. tuberculosis* antigens can be used for detection og antigen specific T cells in blood and CSF of a patient with TB.

Example 64

This is an example of how MHC multimers may be used for detection of Tuberculosis specific T cells in blood samples from a human infected with *Mycobacterium tuberculosis*. In this example the MHC multimer used are MHC dextramers where the multimerisation domain is fluorophor-labelled dextran. The MHC multimers are used for direct detection of TCR by flow cytometry. The antigen origin is *M. tuberculosis*, thus, immune monitoring of TB.

PE labelled HLA-A2 dextramers complexed with the *M. tuberculosis* Ag85A epitope GLPVEYLQV (SEQ ID NO 57579), the 16-kDa epitope GILTVSVAV (SEQ ID NO 124191), or the ESAT-6 epitope AMASTEGNV (SEQ ID NO 199766) were produced as described elsewhere herein and used to stain CD8 positive lymphocytes as described below:

Mononuclear cells from heparinized blood (PBMC) or CSF are isolated from patients with TB by centrifugation on Ficoll-Hypaque (Pharmacia) using a standard procedure. The medium used throughout is RPMI 1640 (Invitrogen Life Technologies) supplemented with 10% heat-inactivated pooled human $AB^+$ serum, 2 mM L-glutamine, 20 mM HEPES, 100 U/ml penicillin, 100 μg/ml streptomycin, $5\times10^{-5}$ M 2-ME. PBMC or CSF cells are washed in complete medium and incubated with FITC-labeled anti-CD8 mAb, PE-labeled dextramers, allophycocyanin-labeled anti-CCR7 mAb and PE-Cy5-labeled anti-CD45RA mAb in incubation buffer (PBS containing 1% FCS and 0.1% sodium azide) for 30 min at 4° C., washed twice, and analyzed on a flow cytometry. A standard staining protocol as described elsewhere herein for staining with MHC dextramers is used.

Viable lymphocytes are gated by forward and side scatter, and analysis is performed on at least 100,000 acquired events for each sample.

This method can detect CD8 positive T cells specific for the Ag85A epitope, the 16-kDa epitope and the ESAT-6 epitope in PBMC and CSF of a patient with TB. The MHC dextramer positive T CD8 T cells can be further phenotyped using the anti-CCR7 and anti-CD45RA antibodies.

Example 65

This is an example of indirect detection of a population of TCR, where cells in suspension are induced to produce soluble factor. The soluble factor produced is a cytokine (IFN-γ) and is detected by a chromogen assay using anti-cytokine antibodies. The antigenic peptides origin is *M. tuberculosis*, thus, immune monitoring of TB infection.

Blood from 119 patients proven to have *M. tuberculosis* infection, 213 subjects with low risk for TB exposure and 33 subjects suspected to have TB but with no proven *M. tuberculosis* infection were withdrawn and the presence of IFN-γ releasing T cells were detected as described in the following.

The procedure used in this example was a whole blood IFN-γ assay (QUANTIFERON [QFT]; Cellestis, Carnegie, Australia) and involves two stages: (1) overnight incubation of whole blood with antigens and (2) measurement of IFN-γ production in harvested plasma samples by ELISA.

Briefly, the procedure was as follows:

Within 12 hours of collection, 1-ml aliquots of blood samples were dispensed into 24-well tissue culture plates and antigens were added to appropriate wells. Three drops of saline (nil control) or phytohemagglutinin (5 μg/ml; mitogen-positive control), and 100 μl of ESAT-6 or CFP-10 peptide cocktail, were added to separate wells to give a final peptide concentration of 1 μg/ml. The peptide cocktail contained 6 peptides from the *M. tuberculosis* antigen CFP-10 and 7 peptides from the *M. tuberculosis* antigen ESAT-6. The 13 peptide sequences are given below:

| CFP-10 | |
|---|---|
| Peptide 1<br>MAEMKTDAATLAQEAGNFERISGDL | (SEQ ID NO 202013) |
| Peptide 2<br>GNFERISGDLKTQIDQVESTAGSLQ | (SEQ ID NO 202014) |
| Peptide 3<br>DQVESTAGSLQGQWRGAAGTAAQAAV | (SEQ ID NO 202015) |
| Peptide 4<br>AAGTAAQAAVVRFQEAANKQKQELD | (SEQ ID NO 202016) |
| Peptide 5<br>AANKQKQELDEISTNIRQAGVQYSR | (SEQ ID NO 202017) |
| Peptide 6<br>IRQAGVQYSRADEEQQQALSSQMGF | (SEQ ID NO 202018) |

-continued

| ESAT-6 | |
|---|---|
| Peptide 1<br>MTEQQWNFAGIEAAASAIQG | (SEQ ID NO 202019) |
| Peptide 2<br>GIEAAASAIQGNVTSI | (SEQ ID NO 109471) |
| Peptide 3<br>SAIQGNVTSIHSLLDEGKQSLTKLA | (SEQ ID NO 202020) |
| Peptide 4<br>EGKQSLTKLAAAWGGSGSEAYQGVQ | (SEQ ID NO 202021) |
| Peptide 5<br>SGSEAYQGVQQKWDATATELNNALQ | (SEQ ID NO 202022) |
| Peptide 6<br>TATELNNALQNLARTISEAGQAMAS | (SEQ ID NO 202023) |
| Peptide 7<br>NLARTISEAGQAMASTEGNVTGMFA | (SEQ ID NO 202024) |

Blood samples were incubated with antigens for 16 to 24 hours at 37° C. before harvesting about 300 μl of plasma from above the settled blood cells.

The concentration of IFN-γ produced in the four plasma samples from each subject, as a result of stimulation of specific T cells with antigen presenting cells displaying the above listed peptides, was determined by QUANTIFERON-CMI ELISA as per the manufacturer's instructions. This ELISA is reported by the manufacturer to have a limit of detection of 0.05 IU/ml for IFN-γ. Samples from up to 16 subjects were tested in each ELISA run, which also included a set of standards that were measured in duplicate. For an ELISA run to be valid, strict performance criteria (coefficient of variation less than 15% and correlation coefficient for the standard curve greater than 0.98) had to be met. ELISA data for the *M. tuberculosis*-specific antigens CFP-10 and ESAT-6 and the nil and mitogen controls were converted to international units per milliliter on the basis of the IFN-γ standard curve generated for each ELISA plate. For an individual's test to be deemed valid, their response to at least one antigen (ESAT-6, CFP-10, or mitogen) had to be at least 0.25 IU of IFN-γ per milliliter above that of their nil control (five times the limit of detection for the ELISA). Results for ESAT-6 and CFP-10 are expressed as the concentration of IFN-γ detected minus the concentration of IFN-γ in the respective nil control plasma. The results are shown in FIG. 34. As can be seen from the figure patients with culture-proven tuberculosis infection had significantly higher IFN-γ response than subjects with a low risk for TB exposure. The presence of IFN-γ indicates the presence of activated T cells specific for one or more of the investigated peptide epitopes from the *M. tuberculosis* antigens CFP-10 and ESAT-6 and can be correlated with actual infection with *M. tuberculosis*.

Modified from Mod et al. "*Specific detection of Tuberculosis infection*" (2004).*Am J of respiratory and critical care medicine* Vol. 170, 59-64.

Example 66

This is an example of indirect detection of a population of TCR, where cells in suspension are induced to produce soluble factor. The soluble factor produced is a cytokine (IFN-γ) and is detected by a chromogen assay using anti-cytokine antibodies. The antigenic peptides origin is *M. tuberculosis*, thus, immune monitoring of TB infection.

Blood from patients suspected to have are withdrawn and the presence of IFN-γ releasing T cells are detected as described in the following.

The procedure used in this example is a whole blood IFN-γ assay (QUANTIFERON [QFT]; Cellestis, Carnegie, Australia) and involves two stages: (1) overnight incubation of whole blood with antigens and (2) measurement of IFN-γ production in harvested plasma samples by ELISA.

Briefly, the procedure is as follows:

Within 12 hours of collection, 1-ml aliquots of blood samples are dispensed into 24-well tissue culture plates and antigens are added to appropriate wells. Three drops of saline (nil control) or phytohemagglutinin (5 μg/ml; mitogen-positive control), and 100 μl of a peptide cocktail, are added to separate wells to give a final peptide concentration of 1 μg/ml. The peptide cocktail contain 10 peptides selected randomly from the *M. tuberculosis* antigen Rv0188 with the following sequences: MSTVHSSIDQHPD (SEQ ID NO 61169); STVHSSIDQHPDL (SEQ ID NO 61170); TVHSSIDQHPDLL (SEQ ID NO 61171); VHSSIDQHPDLLA (SEQ ID NO 61172); HSSIDQHPDLLAL (SEQ ID NO 61173); STVHSSIDQHPDLL (SEQ ID NO 61301); STVHSSIDQHPDLLA (SEQ ID NO 61431); TVHSSIDQHPDLLAL (SEQ ID NO 61432); VHSSIDQHPDLLALR (SEQ ID NO 61433) and HSSIDQHPDLLALRA (SEQ ID NO 61434) (see FIG. 29).

Blood samples were incubated with antigens for 16 to 24 hours at 37° C. before harvesting about 300 μl of plasma from above the settled blood cells.

The concentration of IFN-γ produced in the four plasma samples from each subject, as a result of stimulation of specific T cells with antigen presenting cells displaying the above listed peptides, is determined by QUANTIFERON-CMI ELISA or another IFN-γ measuring ELISA assay following the manufacturer's instructions.

Samples from up to 16 subjects are tested in each ELISA run, which also included a set of standards that are measured in duplicate. For an ELISA run to be valid, strict performance criteria (coefficient of variation less than 15% and correlation coefficient for the standard curve greater than 0.98) had to be met. ELISA data for the *M. tuberculosis*-specific antigen Rv0188 and the nil and mitogen controls are converted to international units per milliliter on the basis of the IFN-γ standard curve generated for each ELISA plate. For an individual's test to be deemed valid, their response to at least one antigen (Rv0188 or mitogen) has to be at least 0.25 IU of IFN-γ per milliliter above that of their nil control (five times the limit of detection for the ELISA). Results for Rv0188 are expressed as the concentration of IFN=γ detected minus the concentration of IFN-γ in the respective nil control plasma.

The presence of IFN-γ in blood of the tested individual indicates the presence of activated T cells specific for one or more of the investigated peptide epitopes from the *M. tuberculosis* antigen tested and can be regarded as a surrogate marker for infection with *M. tuberculosis*.

---

SEQUENCE LISTING (202024 sequences)

SEQ ID NO: 1 - protein, 251 aa, Mycobacterium tuberculosis
MRRVVRYLSVVVAITLMLTAESVSIATAAVPPLQPIPGVASVSPANGAVVGVAHPVVVTFTTPVTDRRAVERSIRISTPHNTTGHFEWVASNVVRWVPHRYWPPHTRVSVGVQELTEGFETGDALIGVASISAHTFTVSRNGEVLRTMPASLGKPSRPTPIGSFHAMSKERTVVMDSRTIGIPLNSSDGYLLTAHYAVRVTWSGVYVHSAPWSVNSQGYANVSHGCINLSPDNAAWYFDAVTVGDPIEVVG

SEQ ID NO: 2 - protein, 122 aa, Mycobacterium tuberculosis
MAGSVSAAAGIGWVGLNVTETNRDQCYRVERTTVDALTHPEYRVHTRGVQRVRVTRNARKHRVSKHRIVAAMRHCGVPVIQEDGSLYYQGRDTSGRLTEVVAVEADDGDLIITHAMPKEWKR

SEQ ID NO: 3 - protein, 143 aa, Mycobacterium tuberculosis
MSTVHSSIDQHPDLLALRASFDRAAESTIAHFTFGLALLAGLYVAASPWIVGFSATRGLPTCDLIVGIAVAYLAYGFASALDRTHGMTWTLPVLGVWVIFSPWVLPGVAVTAGMMWSHIIAGAVVAVLGFYFGMRTRAAANQG

SEQ ID NO: 4 - protein, 1330 aa, Mycobacterium tuberculosis
MSRLIFEARRRLAPPSSHQGTIIIEAPPELPRVIPPSLLRRALPYLIGILIVGMIVALVATGMRVISPQTLFFPFVLLLAATALYRGNDKKMRTEEVDAERADYLRYLSVVRDNIRAQAAEQRASALWSHPDPTALASVPGSRRQWERDPHDPDFLVLRAGRHTVPLATTLRVNDTADEIDLEPVSHSALRSLLDTQRSIGDVPTGIDLTKVSPITVLGERAQVRAVLRAWIAQAVTWHDPTVLGVALAARDLEGRDWNWLKWLPHVDIPGRLDALGPARNLSTDPDELIALLGPVLADRPAFTGQPTDALRHLLIVVDDPDYDLGASPLAVGRAGVTVVHCSASAPHREQYSDPEKPILRVAHGAIERWQTGGWQPYIDAADQFSADEAAHLARRLSRWDSNPTHAGLRSAATRGASFTTLLGIEDASRLDVPALWAPRRRDEELRVPIGVTGTGEPLMFDLKDEAEGGMGPHGLMIGMTGSGKSQTLMSILLSLLTTHSAERLIVIYADFKGEAGADSFRDFPQVVAVISNMAEKKSLADRFADTLRGEVARREMLLREAGRKVQGSAFNSVLEYENAIAAGHSLPPIPTLFVVADEFTLMLADHPEYAELFDYVARKGRSFRIHILFASQTLDVGKIKDIDKNTAYRIGLKVASPSVSRQIIGVEDAYHIESGKEHKGVGFLVPAPGATPIRFRSTYVDGIYEPPQTAKAVVVQSVPEPKLFTAAAVEPDPGTVIADTDEQEPADPPRKLIATIGEQLARYGPRAPQLWLPPLDETIPLSAALARAGVGPRQWRWPLGEIDRPFEMRRDPLVFDARSSAGNMVIHGGPKSGKSTALQTFILSAASLHSPHEVSFYCLDYGGGQLRALQDLAHVGSVASALEPERIRRTFGELEQLLLSRQQREVFRDRGANGSTPDDGFGEVFLVIDNLYGFGRDNTDQFNTRNPLLARVTELVNVGLAYGIHVIITTPSWLEVPLAMRDGLGLRLELRLHDARDSNVRVVGALRRPADAVPHDQPGRGLTMAAEHFLFAAPELDAQTNPVAAINARYPGMAAPPVRLLPTNLAPHAVGELYRGPDQLVIGQREEDLAPVILDLAANPLLMVFGDARSGKTTLLRHIIRTVREHSTADRVAFTVLDRRLHLVDEPLFPDNEYTANIDRIIPAMLGLANLIEARRPPAGMSAAELSRWTFAGHTHYLIIDDVDQVPDSPAMTGPYIGQRPWTPLIGLLAQAGDLGLRVIVTGRATGSAHLLMTSPLLRRFNDLQATTLMLAGNPADSGKIRGERFARLPAGRAILLTDSDSPTYVQLINPLVDAAAVSGETQQKGSQS

SEQ ID NO: 5 - protein, 102 aa, Mycobacterium tuberculosis
MTLRVVPEGLAAASAAVEALTARLAAAHASAAPVITAVVPPAADPVSLQTAAGFSAQGVEHAVVTAEGVEELGRAGVGVGESGASYLAGDAAAAATYGVVGG

SEQ ID NO: 6 - protein, 97 aa, Mycobacterium tuberculosis
MSLLDAHIPQLVASQSAFAAKAGLMRHTIGQAEQAAMSAQAFHQGESSAAFQAAHARFVAAAAKVNTLLDVAQANLGEAAGTYVAADAAAASTYTGF

SEQ ID NO: 7 - protein, 96 aa, Mycobacterium tuberculosis
MSQIMYNYPAMLGHAGDMAGYAGTLQSLGAEIAVEQAALQSAWQGDTGITYQAWQAQWNQAMEDLVRAYHAMSSTHEANTMAMMARDTAEAAKWGG

SEQ ID NO: 8 - protein, 148 aa, Mycobacterium tuberculosis
MSRLSSILRAGAAFLVLGIAAATFPQSAAADSTEDFPIPRRMIATTCDAEQYLAAVRDTSPVYYQRYMIDFNNHANLQQATINKAHWFFSLSPAERRDYSEHFYNGDPLTFAWVNHMKIFFNNKGVVAKGTEVCNGYPAGDMSVWNWA

SEQ ID NO: 9 - protein, 158 aa, Mycobacterium tuberculosis
MTTTIPTSKSACSVTTRPGNAAVDYGGAQIRAYLHHLATVVTIRGEIDAANVEQISEHVRRFSLGTNPMVLDLSELSHFSGAGISLLCILDEDCRAAGVQWALVASPAVVEQLGGRCDQGEHESMFPMARSVHKALHDLADAIDRRRQLVLPLISRSA

SEQ ID NO: 10 - protein, 88 aa, Mycobacterium tuberculosis
MKAKVGDWLVIKGATIDQPDHRGLIIEVRSSDGSPPYVVRWLETDHVATVIPGPDAVVVTAEEQNAADERAQHRFGAVQSAILHARGT

SEQ ID NO: 11 - protein, 198 aa, Mycobacterium tuberculosis
MSRRAIHSGRAAPRRSGNSHLVLRNRVPSSKDSPRRRPHHEFMTESIGEPLSTNLIERYLRARGRRYFRGHHDAEFFFVANAHLLHVHLEISPAYRDVFTIRVSPAYFFPATDHTRLAEIVNAWNLQNHEVTAIVHGSSDPHRIGVAAERSLIRDRIRFDDFATFVDNAVSAATELFGQLTAAGLPPTATPPLLRDAG

SEQ ID NO: 12 - protein, 158 aa, Mycobacterium tuberculosis
MHRAGAAVTANVWCRAGGIRMAPRPVIPVATQQRLRRQADRQSLGSSGLPALNCTPIRHTIDVMATKPERKTERLAARLTPEQDALIRRAAEAEGTDLTNFTVTAALAHARDVLADRRLFVLTDAAWTEFLAALDRPVSHKPRLEKLFAARSIFDTEG

SEQ ID NO: 13 - protein, 234 aa, Mycobacterium tuberculosis
MFRTVGDQASLWESVLPEELRRLPEELARVDALLDDSAFFCPFVPFFDPRMGRPSIPMETYLRLMFLKFRYRLGYESLCREVTDSITWRRFCRIPLEGSVPHPTTLMKLTTRCGEDAVAGLNEALLAKAASEKLLRTNKVRADTTVVEGDVGYPTDTGLLAKAVGSMARTVARIKAADAGSAPLGGSSGPRDRLQAAVTRRAATRSGAGLRAPDHRGASRDRRAGADRGCRGGT

SEQ ID NO: 14 - protein, 94 aa, Mycobacterium tuberculosis
MTINYQFGDVDAHGAMIRAQAGSLEAEHQAIISDVLTASDFWGGAGSAACQGFITQLGRNFQVIYEQANAHGQKVQAAGNNMAQTDSAVGSSWA

SEQ ID NO: 15 - protein, 98 aa, Mycobacterium tuberculosis
MASRFMTDPHAMRDMAGRFEVHAQTVEDEARRMWASAQNISGAGWSGMAEATSLDTMTQMNQAFRNIVNMLHGVRDGLVRDANNYEQQEQASQQILSS

SEQ ID NO: 16 - protein, 121 aa, Mycobacterium tuberculosis
MELRDWLRVDVKAGKPLFDQLRTQVIDGVRAGALPPGTRLPTVRDLAGQLGVAANTVARAYRELESAAIVETRGRFGTFISRFDPTDAAMAAAAKEYVGVARALGLTKSDAMRYLTHVPDD

SEQ ID NO: 17 - protein, 99 aa, Mycobacterium tuberculosis
MSFVMAYPEMLAAAADTLQSIGATTVASNAAAAAPTTGVVPPAADEVSALTAAHFAAHAAMYQSVSARAAAIHDQFVATLASSASSYAATEVANAAAAS

SEQ ID NO: 18 - protein, 98 aa, Mycobacterium tuberculosis
MASRFMTDPHAMRDMAGRFEVHAQTVEDEARRMWASAQNISGAGWSGMAEATSLDTMAQMNQAFRNIVNMLHGVRDGLVRDANNYEQQEQASQQILSS

SEQ ID NO: 19 - protein, 94 aa, Mycobacterium tuberculosis; identical to SEQ ID NO: 14

SEQ ID NO: 20 - protein, 579 aa, Mycobacterium tuberculosis
MTTAIRRAAGSSYFRNPWPALWAMMVGFFMIMLDSTVVAIANPTIMAQLRIGYATVVWVTSAYLLAYAVPMLVAGRLGDRFGPKNLYLIGLGVFTVASLGCGLSSGAGMLIAARVVQGVGAGLLTPQTLSTITRIFPAHRRGVALGAWGTVASVASLVGPLAGGALVDSMGWEWIFFVNVPVGVIGLILAAYLIPALPHHPHRFDWFGVGLSGAGMFLIVFGLQQGQSANWQPWIWAVIVGGIGFMSLFVYWQARNAREPLIPLEVFNDRNFSLSNLRIAIIAFAGTGMMLPVTFYAQAVCGLSPTHTAVLFAPTAIVGGVLAPFVGMIIDRSHPLCVLGFGFSVLAIAMTWLLCEMAPGTPIWRLVLPFIALGVAGAFVWSPLTVTATRNLRPHLAGASSGVFNAVRQLGAVLGSASMAAFMTSRIAAEMPGGVDALTGPAGQDATVLQLPEFVREPFAAAMSQSMLLPAFVALFGIVAALFLVDFTGAAVAKEPLPESDGDADDDDYVEYILRREPEEDCDTQPLRASRPAAAAASRSGAGGPLAVSWSTSAQGMPPGPPGRRAWQADTESTAPSAL

SEQ ID NO: 21 - protein, 163 aa, Mycobacterium tuberculosis
MTVTDDYLANNVDYASGFKGPLPMPPSKHIAIVACMDARLDVYRMLGIKEGEAHVIRNAGCVVTDDVIRSLAISQRLLGTREIILLHHTDCGMLTFTDDDFKRAIQDETGIRPTWSPESYPDAVEDVRQSLRRIEVNPFVTKHTSLRGFVFDVATGKLNEVTP

SEQ ID NO: 22 - protein, 102 aa, Mycobacterium tuberculosis
MTLRVVPESLAGASAAIEAVTARLAAAHAAAAPFIAAVIPPGSDSVSVCNAVEFSVHGSQHVAMAAQGVEELGRSGVGVAESGASYAARDALAAASYLSGGL

SEQ ID NO: 23 - protein, 285 aa, Mycobacterium tuberculosis
MPHRCAAQVVAGYRSTVSLVLVEHPRPEIAQITLNRPERMNSMAFDVMVPLKEALAQVSYDNSVRVVVLTGAGRGFSPGADHKSAGVVPHVENLTRPTYALRSMELLDDVILMLRRLHQPVIAAVNGPAIGGGLCLALAADIRVASSSAYFRAAGINNGLTASELGLSYLLPRAIGSSRAFEIMLTGRDVSAEEAERIGLVSRQVPDEQLLDACYAIAARMAGFSRPGIELTKRTLWSGLDAASLEAHMQAEGLGQLFVRLLTANFEEAVAARAEQRAPVFTDDT

SEQ ID NO: 24 - protein, 583 aa, Mycobacterium tuberculosis
MTAQHNIVVIGGGGAGLRAAIAIAETNPHLDVAIVSKVYPMRSHTVSAEGGAAAVTGDDDSLDEHAHDTVSGGDWLCDQDAVEAFVAEAPKELVQLEHWGCPWSRKPDGRVAVRPFGGMKKLRTWFAADKTGFHLLHTLFQRLLTYSDVMRYDEWFATTLLVDDGRVCGLVAIELATGRIETILADAVILCTGGCGRVFPFTTNANIKTGDGMALAFRAGAPLKDMEFVQYHPTGLPFTGILITEAARAEGGWLLNKDGYRYLQDYDLGKPTPEPRLRSMELGPRDRLSQAFVHEHNKGRTVDTPYGPVVYLDLRHLGADLIDAKLPFVRELCRDYQHIDPVVELVPVRPVVHYMMGGVHTDINGATTLPGLYAAGETACVSINGANRLGSNSLPELLVFGARAGRAAADYAARHQKSDRGPSSAVRAQARTEALRLERELSRHGQGGERIADIRADMQATLESAAGIYRDGPTLTKAVEEIRVLQERFATAGIDDHSRTFNTELTALLELSGMLDVALAIVESGLRREESRGAHQRTDFPNRDDEHFLAHTLVHRESDGTLRVGYLPVTITRWPPGERVYGR

SEQ ID NO: 25 - protein, 353 aa, Mycobacterium tuberculosis
MSVIAGVFGALPPYRYSQRELTDSFVSIPDFEGYEDIVRQLHASAKVNSRHLVLPLEKYPKLTDFGEANKIFIEKAVDLGVQALAGALDESGLRPEDLDVLITATVTGLAVPSLDARIAGRLGLRADVRRVPLFGLGCVAGAAGVARLHDYLRGAPDGVAALVSVELCSLTYPGYKPTLPGLVGSALFADGAAAVVAAGVKRAQDIGADGPDILDSRSHLYPDSLRTMGYDVGSAGFELVLSRDLAAVVEQYLGNDVTTFLASHGLSTTDVGAWVTHPGGPKIINAITETLDLSPQALELTWRSLGEIGNLSSASVLHVLRDTIAKPPPSGSPGLMIAMGPGFCSELVLLRWH

SEQ ID NO: 26 - protein, 98 aa, Mycobacterium tuberculosis
MATRFMTDPHAMRDMAGRFEVHAQTVEDEARRMWASAQNISGAGWSGMAEATSLDTMAQMNQAFRNIVNMLHGVRDGLVRDANNYEQQEQASQQILSS

SEQ ID NO: 27 - protein, 94 aa, Mycobacterium tuberculosis
MTINYQFGDVDAHGAMIRAQAASLEAEHQAIVRDVLAAGDFWGGAGSVACQEFITQLGRNFQVIYEQANAHGQKVQAAGNNMAQTDSAVGSSWA

SEQ ID NO: 28 - protein, 468 aa, Mycobacterium tuberculosis
MDFGLQPPEITSGEMYLGPGAGPMLAAAVAWDGLAAELQSMAASYASIVEGMASESWLGPSSAGMAAAAAPYVTWMSGTSAQAKAAADQARAAVVAYETAFAAVVPPPQIAANRSQLISLVATNIFGQNTAAIAATEAEYGEMWAQDTMAMFGYASSSATASRLTPFTAPPQTTNPSGLAGQAAATGQATALASGTNAVTTALSSAAAQFPFDIIPTLLQGLATLSTQYTQLMGQLINAIFGPTGATTYQNVFVTAANVTKFSTWANDAMSAPNLGMTEFKVFWQPPPAPEIPKSSLGAGLGLRSGLSAGLAHAASAGLGQANLVGDLSVPPSWASATPAVRLVANTLPATSLAAAPATQIPANLLGQMALGSMTGGALGAAAPAIYTGSGARARANGGTPSAEPVKLEAVIAQLQKQPDAVRHWNVDKADLDGLLDRLSKQPGIHAVHVSNGDKPKVALPDTQLGSH

SEQ ID NO: 29 - protein, 173 aa, Mycobacterium tuberculosis
MAAGSGGGTVGLVLPRVASLSGLDGAPTVPEGSDKALMHLGDPPRRCDTHPDGTSSAAAALVLRRIDVHPLLTGLGRGRQTVSLRNGHLVATANRAILSRRRSRLTRGRSFTSHLITSCPRLDDHQHRHPTRCRAEHAGCTVATCIPNAHDPAPGHQTPRWGPFRLKPAYTRI

SEQ ID NO: 30 - protein, 170 aa, Mycobacterium tuberculosis
MPSGWVSHRLGGSPKCISALSLPSGTVGAPSKPDNDATRGRTRPTVPPPDPAAMGTWKFFRASVDGRPVFKKEFDKLPDQARAALIVLMQRYLVGDLAAGSIKPIRGDILELRWHEANNHFRVLFFRWGQHPVALTAFYKNQQKTPKTKIETALDRQKIWKRAFGDTPPI

SEQ ID NO: 31 - protein, 107 aa, Mycobacterium tuberculosis
MSTYRSPDRAWQALADGTRRAIVERLAHGPLAVGELARDLPVSRPAVSQHLKVLKTARLVCDRPAGTRRVYQLDPTGLAALRTDLDRFWTRALTGYAQLIDSEGDDT

SEQ ID NO: 32 - protein, 111 aa, Mycobacterium tuberculosis
MADRVLRGSRLGAVSYETDRNHDLAPRQIARYRTDNGEEFEVPFADDAEIPGTWLCRNGMEGTLIEGDLPEPKKVKPPRTHWDMLLERRSIEELEELLKERLELIRSRRRG

SEQ ID NO: 33 - protein, 134 aa, Mycobacterium tuberculosis
MPLSDHEQRMLDQIESALYAEDPKFASSVRGGGFRAPTARRRLQGAALFIIGLGMLVSGVAFKETMIGSFPILSVFGFVVMFGGVVYAITGPRLSGRMDRGGSAAGASRQRRTKGAGGSFTSRMEDRFRRRFDE

SEQ ID NO: 34 - protein, 175 aa, Mycobacterium tuberculosis
MRLPGRHVLYALSAVTMLAACSSNGARGGIASTNMNPTNPPATAETATVSPTPAPQSARTETWINLQVGDCLADLPPADLSRITVTIVDCATAHSAEVYLRAPVAVDAAVVSMANRDCAAGFAPYTGQSVDTSPYSVAYLIDSHQDRTGADPTPSTVICLLQPANGQLLTGSARR

SEQ ID NO: 35 - protein, 80 aa, Mycobacterium tuberculosis
MHAKVGDYLVVKGTTTERHDQHAEIIEVRSADGSPPYVVRWLVNGHETTVYPGSDAVVVTATEHAEAEKRAAARAGHAAT

SEQ ID NO: 36 - protein, 94 aa, Mycobacterium tuberculosis
MTINYQFGDVDAHGAMIRAQAGLLEAEHQAIVRDVLAAGDFWGGAGSVACQEFITQLGRNFQVIYEQANAHGQKVQAAGNNMAQTDSAVGSSWA

SEQ ID NO: 37 - protein, 98 aa, Mycobacterium tuberculosis; identical to SEQ ID NO: 26

SEQ ID NO: 38 - protein, 108 aa, Mycobacterium tuberculosis
MLLPLGPPLPPDAVVAKRAESGMLGGLSVPLSWGVAVPPDDYDHWAPAPEDGADVDVQAAEGADAEAAAMDEWDEWQAWNEWVAENAEPRFEVPRSSSSVIPHSPAAG

SEQ ID NO: 39 - protein, 367 aa, Mycobacterium tuberculosis
MGEGSRRPSGMLMSVDLEPVQLVGPDGTPTAERRYHRDLPEETLRWLYEMMVVTRELDTEFVNLQRQGELALYTPCRGQEAAQVGAAACLRKTDWLFPQYRELGVYLVRGIPPGHVGVAWRGTWHGGLQFTTKCCAPMSVPIGTQTLHAVGAAMAAQRLDEDSVTVAFLGDGATSEGDVHEALNFAAVFTTPCVFYVQNNQWAISMPVSRQTAAPSIAHKAIGYGMPGIRVDGNDVLACYAVMAEAAARARAGDGPTLIEAVTYRLGPHTTADDPTRYRSQEEVDRWATLDPIPRYRTYLQDQGLWSQRLEEQVTARAKHVRSELRDAVFDAPDFDVDEVFTTVYAEITPGLQAQREQLRAELARTD

SEQ ID NO: 40 - protein, 83 aa, Mycobacterium tuberculosis
MNSAIIKIAKWAQSQQWTVEDDASGYTRFYNPQGVYIARFPATPSNEYRRMRDLLGALKKAGLTWPPPSKKERRAQHRKEGAQ

SEQ ID NO: 41 - protein, 75 aa, Mycobacterium tuberculosis
MTVKRTTIELDEDLVRAAQAVTGETLRATVERALQQLVAAAAEQAAARRRRIVDHLAHAGTHVDADVLLSEQAWR

SEQ ID NO: 42 - protein, 224 aa, Mycobacterium tuberculosis
MTGGATGALPRTMKEGWIVYARSTTIQAQSECIDTGIAHVRDVVMPALQGMDGCIGVSLLVDRQSGRCIATSAWETAEAMHASREQVTPIRDRCAEMFGGTPAVEEWEIAAMHRDHRSAEGACVRATWVKVPADQVDQGIEYYKSSVLPQIEGLDGFCSASLLVDRTSGRAVSSATFDSFDAMERNRDQSNALKATSLREAGGEELDECEFELALAHLRVPELV

SEQ ID NO: 43 - protein, 236 aa, Mycobacterium tuberculosis
MPGSAGWRKVFGGTGGATGALPRHGRGSIVYARSTTIEAQPLSVDIGIAHVRDVVMPALQEIDGCVGVSLLVDRQSGRCIATSAWETLEAMRASVERVAPIRDRAALMFAGSARVEEWDIALLHRDHPSHEGACVRATWLKVVPDQLGRSLEFYRTSVLPELESLDGFCSASLMVDHPACRRAVSCSTFDSMDAMARNRDRASELRSRRVRELGAEVLDVAEFELAIAHLRVPELV

SEQ ID NO: 44 - protein, 107 aa, Mycobacterium tuberculosis
MTHKRTKRQPAIAAGLNAPRRNRVGRQHGWPADVPSAEQRRAQRQRDLEAIRRAYAEMVATSHEIDDDTAELALLSMHLDDEQRRLEAGMKLGWHPYHFPDEPDSKQ

SEQ ID NO: 45 - protein, 81 aa, Mycobacterium tuberculosis
MSGHALAARTLLAAADELVGGPPVEASAAALAGDAAGAWRTAAVELARALVRAVAESHGVAAVLFAATAAAAAAVDRGDPP

SEQ ID NO: 46 - protein, 475 aa, Mycobacterium tuberculosis
MADIPYGRDYPDPIWCDEDGQPMPPVGAELLDDIRAFLRRFVVYPSDHELIAHTLWIAHCWFMEAWDSTPRIAFLSPEPGSGKSRALEVTEPLVPRPVHAINCTPAYLFRRVADPVGRPTVLYDECDTLFGPKAKEHEEIRGVINAGHRKGAVAGRCVIRGKIVETEELPAYCAVALAGLDDLPDTIMSRSIVVRMRRRAPTEPVEPWRPRVNGPEAEKLHDRLANWAAAINPLESGWPAMPDGVTDRRADVWESLVAVADTAGGHWPKTARATAETDATANRGAKPSIGVLLLRDIRRVFSDRDRMRTSDILTGLNRMEEGPWGSIRRGDPLDARGLATRLGRYGIGPKFQHSGGEPPYKGYSRTQFEDAWSRYLSADDETPEERDLSVSAVSAVSPPVGDPGDATGATDATDLPEAGDLPYEPPAPNGHPNGDAPLCSGPGCPNKLLSTEAKAAGKCRPCRGRAAASARDGAR

SEQ ID NO: 47 - protein, 130 aa, Mycobacterium tuberculosis
MTAVGGSPPTRRCPATEDRAPATVATPSSTDPTASRAVSWWSVHEYVAPTLAAAVEWPMAGTPAWCDLDDTDPVKWAAICDAARHWALRVETCQAASAEASRDVSAAADWPAVSREIQRRRDAYIRRVVV

SEQ ID NO: 48 - protein, 86 aa, Mycobacterium tuberculosis
MCAFPSPSLGWTVSHETERPGMADAPPLSRRYITISEAAEYLAVTDRTVRQMIADGRLRGYRSGTRLVRLRRDEVDGAMHPFGGAA

SEQ ID NO: 49 - protein, 120 aa, Mycobacterium tuberculosis
MADAVKYVVMCNCDDEPGALIIAWIDDERPAGGHIQMRSNTRFTETQWGRHIEWKLECRACRKYAPISEMTAAAILDGFGAKLHELRTSTIPDADDPSIAEARHVIPFSALCLRLSQLGG

SEQ ID NO: 50 - protein, 375 aa, Mycobacterium tuberculosis
MTQTGKRQRRKFGRIRQFNSGRWQASYTGPDGRVYIAPKTFNAKIDAEAWLTDRRREIDRQLWSPASGQEDRPGAPFGEYAEGWLKQRGIKDRTRAHYRKLLDNHILATFADTDLRDITPAAVRRWYATTAVGTPTMRAHSYSLLRAIMQTALADDLIDSNPCRISGASTARRVHKIRPATLDELETITKAMPDPYQAFVLMAAWLAMRYGELTELRRKDIDLHGEVARVRRAVVRVGEGFKVTTPKSDAGVRDISIPPHLIPAIEDHLHKHVNPGRESLLFPSVNDPNRHLAPSALYRMFYKARKAAGRPDLRVHDLRHSGAVLAASTGATLAELMQRLGHSTAGAALRYQHAAKGRDREIAALLSKLAENQEM

SEQ ID NO: 51 - protein, 75 aa, Mycobacterium tuberculosis
MIAGVDQALAATGQASQRAAGASGGVTVGVGVGTEQRNLSVVAPSQFTFSSRSPDFVDETAGQSWCAILGLNQFH

SEQ ID NO: 52 - protein, 129 aa, Mycobacterium tuberculosis
MRARSDAGGQSVKSRTSNRSRSSRRSRVRSSISALVDNPQARPRELPVLCGWPVVRVEPVCEFVPEPVCGQAEVLGEPAAAHRVTSARRSPSTTVCSRSQKASAVVISSVSSVARVRRASVSSVDATTA

SEQ ID NO: 53 - protein, 90 aa, Mycobacterium tuberculosis
MDDLTRLRRELLDRFDVRDFTDWPPASLRALIATYDPWIDMTASPPQPVSPGGPRLRLVRLTTNPSARAAPIGNGGDSSVCAGEKQCRPP

SEQ ID NO: 54 - protein, 77 aa, Mycobacterium tuberculosis [sequence omitted]

SEQ ID NO: 55 - protein, 138 aa, Mycobacterium tuberculosis
MSVGFVTPVGVRWSDIDMYQHVNHATMVTILEEARVPFLKDAFGADITSTGLLIADVRVTYKGQLRLSDSPLQVTIWTKRLRAVDFTLGYEVRSVNAEPDSRPAVIAESQLAAFHIEEQRLVRLSPHHREYLQRWFRG

SEQ ID NO: 56 - protein, 96 aa, Mycobacterium tuberculosis
MSQIMYNYPAMMAHAGDMAGYAGTLQSLGADIASEQAVLSSAWQGDTGITYQGWQTQWNQALEDLVRAYQSMSGTHESNTMAMLARDGAEAAKWGG

SEQ ID NO: 57 - protein, 97 aa, Mycobacterium tuberculosis
MSLLDAHIPQLIASHTAFAAKAGLMRHTIGQAEQQAMSAQAFHQGESAAAFQGAHARFVAAAAKVNTLLDIAQANLGEAAGTYVAADAAAASSYTGF

SEQ ID NO: 58 - protein, 145 aa, Mycobacterium tuberculosis
MADSDLPTKGRQRGVRAVELNVAARLENLALLRTLVGAIGTFEDLDFDAVADLRLAVDEVCTRLIRSALPDATLRLVVDPRKDEVVVEASAACDTHDVVAPGSFSWHVLTALADDVQTFHDGRQPDVAGSVFGITLTARRAASSR

SEQ ID NO: 59 - protein, 137 aa, Mycobacterium tuberculosis
MGQIPPQPVRRVLPLMVVPGNGQKWRNRTETEEAMGDTYRDPVDHLRTTRPLAGESLIDVVHWPGYLLIVAGVVGGVGALAAFGTGHHAEGMTFGVVAIVVTVVGLAWLAFEHRRIRKIADRWYTEHPEVRRQRLAG

SEQ ID NO: 60 - protein, 125 aa, Mycobacterium tuberculosis
MHEVGGPSRGDRLGRDDSEVHSAIRFAVVAAVVGVGFLIMGALLVSTCSGVDTAACGPPQRILLALGGPLILCAAGLWAFLRTYRVWRAEGTWWGWHGAGWFLLTLMVLTLCIGVPPIAGPVMAP

SEQ ID NO: 61 - protein, 449 aa, Mycobacterium tuberculosis
MAAVVKSVALAGRPTTPDRVHEVLGRSMLVDGLDIVLDLTRSGGSYLVDAITGRRYLDMFTFVASSALGMNPPALVDDREFHAELMQAALNKPSNSDVYSVAMARFVETFARVLGDPALPHLFFVEGGALAVENALKAAFDWKSRHNQAHGIDPALGTQVLHLRGAFHGRSGYTLSLTNTKPTITARFPKFDWPRIDAPYMRPGLDEPAMAALEAEALRQARAAFETRPHDIACFVAEPIQGEGGDRHFRPEFFAAMRELCDEFDALLIFDEVQTGCGLTGTAWAYQQLDVAPDIVAFGKKTQVCGVMAGRRVDEVADNVFAVPSRLNSTWGGNLTDMVRARRILEVIEAEGLFERAVQHGKYLRARLDELAADFPAVVLDPRGRGLMCAFSLPTTADRDELIRQLWQRAVIVLPAGADTVRFRPPLTVSTAEIDAAIAAVRSALPVVT

SEQ ID NO: 62 - protein, 150 aa, Mycobacterium tuberculosis
MNEALDDIDRILVRELAADGRATLSELATRAGLSVSAVQSRVRRLESRGVVQGYSARINPEAVGHLLSAFVAITPLDPSQPDDAPARLEHIEEVESCYSVAGEESYVLLVRVASARALEDLLQRIRTTANVRTRSTIILNTFYSDRQHIP

SEQ ID NO: 63 - protein, 100 aa, Mycobacterium tuberculosis
MNADPVLSYNFDAIEYSVRQEIHTTAARFNAALQELRSQIAPLQQLWTREAAAAYHAEQLKWHQAASALNEILIDLGNAVRHGADDVAHADRRAAGAWAR

SEQ ID NO: 64 - protein, 125 aa, Mycobacterium tuberculosis
MVEPGRIGGNQTRLAAVLLDVSTPNTLNADFDLMRSVAGITDARNEEIRAMLQAFIGRMSGVPPSVWGGLAAARFQDVVDRWNAESTRLYHVLHAIADTIRHNEAALREAGQIHARHIAAAGGDL

SEQ ID NO: 65 - protein, 98 aa, Mycobacterium tuberculosis
MSFTAQPEMLAAAAGELRSLGATLKASNAAAAVPTTGVVPPAADEVSLLLATQFRTHAATYQTASAKAAVIHEQFVTTLATSASSYADTEAANAVVTG

SEQ ID NO: 66 - protein, 94 aa, Mycobacterium tuberculosis; identical to SEQ ID NO: 14

SEQ ID NO: 67 - protein, 98 aa, Mycobacterium tuberculosis
MTSRFMTDPHAMRDMAGRFEVHAQTVEDEARRMWASAQNISGAGWSGMAEATSLDTMTQMNQAFRNIVNMLHGVRDGLVRDANNYEQQEQASQQILSS

SEQ ID NO: 68 - protein, 125 aa, Mycobacterium tuberculosis
MFTLLVSWLLVACVPGLLMLATLGLGRLERFLARDTVTATDVAEFLEQAEAVDVHTLARNGMPEALDYLHRRQARRITDSPPLGSGAGPRYAGPLFVTDLDSPVEPPRHGQPNPQFRTARHANHV

SEQ ID NO: 69 - protein, 162 aa, Mycobacterium tuberculosis
MSLAWDVVSVDKPDDVNVVIGQAHFIKAVEDLHEAMVGVSPSLRFGLAFCEASGPRLVRHTGNDGDLVELATRTALAIAAGHSFVIFLREGFPINILNPVQAVPEVCTIYCATANPVDVVVAVTPHGRGIVGVVDGQTPLGVETDRDIAQRRDLLRAIGYKL

SEQ ID NO: 70 - protein, 284 aa, Mycobacterium tuberculosis
MPNRRRRKLSTAMSAVAALAVASPCAYFLVYESTETTERPEHHEFKQAAVLTDLPGELMSALSQGLSQFGINIPPVPSLTGSGDASTGLTGPGLTSPGLTSPGLTSPGLTDPALTSPGLTPTLPGSLAAPGTTLAPTPGVGANPALTNPALTSPTGATPGLTSPTGLDPALGGANEIPITTPVGLDPGADGTYPILGDPTLGTIPSSPATTSTGGGGLVNDVMQVANELGASQAIDLLKGVLMPSIMQAVQNGGAAAPAASPPVPPIPAAAAVPPTDPITVPVA

SEQ ID NO: 71 - protein, 368 aa, Mycobacterium tuberculosis
MLWHAMPPELNTARLMAGAGPAPMLAAAAGWQTLSAALDAQAVELTARLNSLGEAWTGGGSDKALAAATPMVVWLQTASTQAKTRAMQATAQAAAYTQAMATTPSLPEIAANHITQAVLTATNFFGINTIPIALTEMDYFIRMWNQAALAMEVYQAETAVNTLFEKLEPMASILDPGASQSTTNPIFGMPSPGSSTPVGQLPPAATQTLGQLGEMSGPMQQLTQPLQQVTSLFSQVGGTGGGNPADEEAAQMGLLGTSPLSNHPLAGGSGPSAGAGLLRAESLPGAGGSLTRTPLMSQLIEKPVAPSVMPAAAAGSSATGGAAPVGAGAMGQGAQSGGSTRPGLVAPAPLAQEREEDDEDDWDEEDDW

SEQ ID NO: 72 - protein, 100 aa, Mycobacterium tuberculosis
MAEMKTDAATLAQEAGNFERISGDLKTQIDQVESTAGSLQGQWRGAAGTAAQAAVVRFQEAANKQKQELDEISTNIRQAGVQYSRADEEQQQALSSQMGF

SEQ ID NO: 73 - protein, 95 aa, Mycobacterium tuberculosis
MTEQQWNFAGIEAAASAIQGNVTSIHSLLDEGKQSLTKLAAAWGGSGSEAYQGVQQKWDATATELNNALQNLARTISEAGQAMASTEGNVTGMFA

SEQ ID NO: 74 - protein, 280 aa, Mycobacterium tuberculosis
MAEPLAVDPTGLSAAAAKLAGLVFPQPPAPIAVSGTDSVVAAINETMPSIESLVSDGLPGVKAALTRTASNMNAAADVYAKTDQSLGTSLSQYAFGSSGEGLAGVASVGGQPSQATQLLSTPVSQVTTQLGETAAELAPRVVATVPQLVQLAPHAVQMSQNASPIAQTISQTAQQAAQSAQGGSGPMPAQLASAEKPATEQAEPVHEVTNDDQGDQGDVQPAEVVAAARDEGAGASPGQQPGGGVPAQAMDTGAGARPAASPLAAPVDPSTPAPSTTTTL

SEQ ID NO: 75 - protein, 729 aa, Mycobacterium tuberculosis
MSITRPTGSYARQMLDPGGWVEADEDTFYDRAQEYSQVLQRVTDVLDTCRQQKGHVFEGGLWSGGAANAANGALGANINQLMTLQDYLATVITWHRHIAGLIEQAKSDIGNNVDGAQREIDILENDPSLDADERHTAINSLVTATHGANVSLVAETAERVLESKNWKPPKNALEDLLQQKSPPPPDVPTLVVPSPGTPGTPGTPITPGTPITPGTPITPIPGAPVTPITPTPGTPVTPVTPGKPVTPVTPVKPGTPGEPTPITPVTPPVAPATPATPATPVTPAPAPHPQPAPAPAPSPGPQPVTPATPGPSGPATPGTPGGEPAPHVKPAALAEQPGVPGQHAGGGTQSGPAHADESAASVTPAAASGVPGARAAAAAPSGTAVGAGARSSVGTAAASGAGSHAATGRAPVATSDKAAAPSTRAASARTAPPARPPSTDHIDKPDRSESADDGTPVSMIPVSAARAARDAATAAASARQRGRGDALRLARRIAAALNASDNNAGDYGFFWITAVTTDGSIVVANSYGLAYIPDGMELPNKVYLASADHAIPVDEIARCATYPVLAVQAWAAFHDMTLRAVIGTAEQLASSDPGVAKIVLEPDDIPESGKMTGRSRLEVVDPSAAAQLADTTDQRLLDLLPPAPVDVNPPGDERHMLWFELMKPMTSTATGREAAHLRAFRAYAAHSQEIALHQAHTATDAAVQRVAVADWLYWQYVTGLLDRALAAAC

SEQ ID NO: 76 - protein, 95 aa, Mycobacterium tuberculosis
MSDQITYNPGAVSDFASDVGSRAGQLHMIYEDTASKTNALQEFFAGHGAQGFFDAQAQMLSGLQGLIETVGQHGTTTGHVLDNAIGTDQAIAGLF

SEQ ID NO: 77 - protein, 107 aa, Mycobacterium tuberculosis
MADTIQVTPQMLRSTANDIQANMEQAMGIAKGYLANQENVMNPATWSGTGVVASHMTATEITNELNKVLTGGTRLAEGLVQAAALMEGHEADSQTAFQALFGASHGS

SEQ ID NO: 78 - protein, 90 aa, Mycobacterium tuberculosis
MDPTVLADAVARMAEFGRHVEELVAEIESLVTRLHVTWTGEGAAAHAEAQRHWAAGEAMMRQALAQLTAAGQSAHANYTGAMATNLGMWS

SEQ ID NO: 79 - protein, 103 aa, Mycobacterium tuberculosis
MGADDTLRVEPAVMQGFAASLDGAAEHLAVQLAELDAQVGQMLGGWRGASGSAYGSAWELWHRGAGEVQLGLSMLAAAIAHAGAGYQHNETASAQVLREVGGG

SEQ ID NO: 80 - protein, 137 aa, Mycobacterium tuberculosis
MSRQASRQVSIIRSAGDGNRSCGCVTPKEGVWVVTLRVVPEGLAAASAAVEALTARLAAAHAGAAPAITAVVAPAADPVSLQSAVGFSALGSEHAAIAGEGVEELGRSGVAVGESGIGYAAGDAVAAATYLVSGGSL

SEQ ID NO: 81 - protein, 338 aa, Mycobacterium tuberculosis
MQLVDRVRGAVTGMSRRLVVGAVGAALVSGLVGAVGGTATAGAFSRPGLPVEYLQVPSPSMGRDIKVQFQSGGANSPALYLLDGLRAQDDFSGWDINTPAFEWYDQSGLSVVMPVGGQSSFYSDWYQPACGKAGCQTYKWETFLTSELPGWLQANRHVKPTGSAVVGLSMAASSALTLAIYHPQQFVYAGAMSGLLDPSQAMGPTLIGLAMGDAGGYKASDMWGPKEDPAWQRNDPLLNVGKLIANNTRVWVYCGNGKPSDLGGNNLPAKFLEGFVRTSNIKFQDAYNAGGGHNGVFDFPDSGTHSWEYWGAQLNAMKPDLQRALGATPNTGPAPQGA

SEQ ID NO: 82 - protein, 325 aa, Mycobacterium tuberculosis
MTDVSRKIRAWGRRLMIGTAAAVVLPGLVGLAGGAATAGAFSRPGLPVEYLQVPSPSMGRDIKVQFQSGGNNSPAVYLLDGLRAQDDYNGWDINTPAFEWYYQSGLSIVMPVGGQSSFYSDWYSPACGKAGCQTYKWETFLTSELPQWLSANRAVKPTGSAAIGLSMAGSSAMILAAYHPQQFIYAGSLSALLDPSQGMGPSLIGLAMGDAGGYKAADMWGPSSDPAWERNDPTQQIPKLVANNTRLWVYCGNGTPNELGGANIPAEFLENFVRSSNLKFQDAYNAAGGHNAVFNFPPNGTHSWEYWGAQLNAMKGDLQSSLGAG

SEQ ID NO: 83 - protein, 8 aa, Mycobacterium tuberculosis
MRRVVRYL

SEQ ID NO: 84 - protein, 8 aa, Mycobacterium tuberculosis
RRVVRYLS

SEQ ID NO: 85 - protein, 8 aa, Mycobacterium tuberculosis
RVVRYLSV

SEQ ID NO: 86 - protein, 8 aa, Mycobacterium tuberculosis
VVRYLSVV

SEQ ID NO: 87 - protein, 8 aa, Mycobacterium tuberculosis
VRYLSVVV

SEQ ID NO: 88 - protein, 8 aa, Mycobacterium tuberculosis
RYLSVVVA

SEQ ID NO: 89 - protein, 8 aa, Mycobacterium tuberculosis
YLSVVVAI

SEQ ID NO: 90 - protein, 8 aa, Mycobacterium tuberculosis
LSVVVAIT

SEQ ID NO: 91 - protein, 8 aa, Mycobacterium tuberculosis
SVVVAITL

SEQ ID NO: 92 - protein, 8 aa, Mycobacterium tuberculosis
VVVAITLM

SEQ ID NO: 93 - protein, 8 aa, Mycobacterium tuberculosis
VVAITLML

SEQ ID NO: 94 - protein, 8 aa, Mycobacterium tuberculosis
VAITLMLT

SEQ ID NO: 95 - protein, 8 aa, Mycobacterium tuberculosis
AITLMLTA

SEQ ID NO: 96 - protein, 8 aa, Mycobacterium tuberculosis
ITLMLTAE

SEQ ID NO: 97 - protein, 8 aa, Mycobacterium tuberculosis
TLMLTAES

SEQ ID NO: 98 - protein, 8 aa, Mycobacterium tuberculosis
LMLTAESV

SEQ ID NO: 99 - protein, 8 aa, Mycobacterium tuberculosis
MLTAESVS

SEQ ID NO: 100 - protein, 8 aa, Mycobacterium tuberculosis
LTAESVSI

SEQ ID NO: 101 - protein, 8 aa, Mycobacterium tuberculosis
TAESVSIA

SEQ ID NO: 102 - protein, 8 aa, Mycobacterium tuberculosis
AESVSIAT

SEQ ID NO: 103 - protein, 8 aa, Mycobacterium tuberculosis
ESVSIATA

SEQ ID NO: 104 - protein, 8 aa, Mycobacterium tuberculosis
SVSIATAA

SEQ ID NO: 105 - protein, 8 aa, Mycobacterium tuberculosis
VSIATAAV

SEQ ID NO: 106 - protein, 8 aa, Mycobacterium tuberculosis
SIATAAVP

SEQ ID NO: 107 - protein, 8 aa, Mycobacterium tuberculosis
IATAAVPP

SEQ ID NO: 108 - protein, 8 aa, Mycobacterium tuberculosis
ATAAVPPL

SEQ ID NO: 109 - protein, 8 aa, Mycobacterium tuberculosis
TAAVPPLQ

SEQ ID NO: 110 - protein, 8 aa, Mycobacterium tuberculosis
AAVPPLQP

SEQ ID NO: 111 - protein, 8 aa, Mycobacterium tuberculosis
AVPPLQPI

SEQ ID NO: 112 - protein, 8 aa, Mycobacterium tuberculosis
VPPLQPIP

SEQ ID NO: 113 - protein, 8 aa, Mycobacterium tuberculosis
PPLQPIPG

SEQ ID NO: 114 - protein, 8 aa, Mycobacterium tuberculosis
PLQPIPGV

SEQ ID NO: 115 - protein, 8 aa, Mycobacterium tuberculosis
LQPIPGVA

SEQ ID NO: 116 - protein, 8 aa, Mycobacterium tuberculosis
QPIPGVAS

SEQ ID NO: 117 - protein, 8 aa, Mycobacterium tuberculosis
PIPGVASV

SEQ ID NO: 118 - protein, 8 aa, Mycobacterium tuberculosis
IPGVASVS

SEQ ID NO: 119 - protein, 8 aa, Mycobacterium tuberculosis
PGVASVSP

SEQ ID NO: 120 - protein, 8 aa, Mycobacterium tuberculosis
GVASVSPA

SEQ ID NO: 121 - protein, 8 aa, Mycobacterium tuberculosis
VASVSPAN

SEQ ID NO: 122 - protein, 8 aa, Mycobacterium tuberculosis
ASVSPANG

SEQ ID NO: 123 - protein, 8 aa, Mycobacterium tuberculosis
SVSPANGA

SEQ ID NO: 124 - protein, 8 aa, Mycobacterium tuberculosis
VSPANGAV

SEQ ID NO: 125 - protein, 8 aa, Mycobacterium tuberculosis
SPANGAVV

SEQ ID NO: 126 - protein, 8 aa, Mycobacterium tuberculosis
PANGAVVG

SEQ ID NO: 127 - protein, 8 aa, Mycobacterium tuberculosis
ANGAVVGV

SEQ ID NO: 128 - protein, 8 aa, Mycobacterium tuberculosis
NGAVVGVA

SEQ ID NO: 129 - protein, 8 aa, Mycobacterium tuberculosis
GAVVGVAH

SEQ ID NO: 130 - protein, 8 aa, Mycobacterium tuberculosis
AVVGVAHP

SEQ ID NO: 131 - protein, 8 aa, Mycobacterium tuberculosis
VVGVAHPV

SEQ ID NO: 132 - protein, 8 aa, Mycobacterium tuberculosis
VGVAHPVV

SEQ ID NO: 133 - protein, 8 aa, Mycobacterium tuberculosis
GVAHPVVV

SEQ ID NO: 134 - protein, 8 aa, Mycobacterium tuberculosis
VAHPVVVT

SEQ ID NO: 135 - protein, 8 aa, Mycobacterium tuberculosis
AHPVVVTF

SEQ ID NO: 136 - protein, 8 aa, Mycobacterium tuberculosis
HPVVVTFT

SEQ ID NO: 137 - protein, 8 aa, Mycobacterium tuberculosis
PVVVTFTT

SEQ ID NO: 138 - protein, 8 aa, Mycobacterium tuberculosis
VVVTFTTP

SEQ ID NO: 139 - protein, 8 aa, Mycobacterium tuberculosis
VVTFTTPV

SEQ ID NO: 140 - protein, 8 aa, Mycobacterium tuberculosis
VTFTTPVT

SEQ ID NO: 141 - protein, 8 aa, Mycobacterium tuberculosis
TFTTPVTD

SEQ ID NO: 142 - protein, 8 aa, Mycobacterium tuberculosis
FTTPVTDR

SEQ ID NO: 143 - protein, 8 aa, Mycobacterium tuberculosis
TTPVTDRR

SEQ ID NO: 144 - protein, 8 aa, Mycobacterium tuberculosis
TPVTDRRA

SEQ ID NO: 145 - protein, 8 aa, Mycobacterium tuberculosis
PVTDRRAV

SEQ ID NO: 146 - protein, 8 aa, Mycobacterium tuberculosis
VTDRRAVE

SEQ ID NO: 147 - protein, 8 aa, Mycobacterium tuberculosis
TDRRAVER

SEQ ID NO: 148 - protein, 8 aa, Mycobacterium tuberculosis
DRRAVERS

SEQ ID NO: 149 - protein, 8 aa, Mycobacterium tuberculosis
RRAVERSI

SEQ ID NO: 150 - protein, 8 aa, Mycobacterium tuberculosis
RAVERSIR

SEQ ID NO: 151 - protein, 8 aa, Mycobacterium tuberculosis
AVERSIRI

SEQ ID NO: 152 - protein, 8 aa, Mycobacterium tuberculosis
VERSIRIS

SEQ ID NO: 153 - protein, 8 aa, Mycobacterium tuberculosis
ERSIRIST

SEQ ID NO: 154 - protein, 8 aa, Mycobacterium tuberculosis
RSIRISTP

SEQ ID NO: 155 - protein, 8 aa, Mycobacterium tuberculosis
SIRISTPH

SEQ ID NO: 156 - protein, 8 aa, Mycobacterium tuberculosis
IRISTPHN

SEQ ID NO: 157 - protein, 8 aa, Mycobacterium tuberculosis
RISTPHNT

SEQ ID NO: 158 - protein, 8 aa, Mycobacterium tuberculosis
ISTPHNTT

SEQ ID NO: 159 - protein, 8 aa, Mycobacterium tuberculosis
STPHNTTG

SEQ ID NO: 160 - protein, 8 aa, Mycobacterium tuberculosis
TPHNTTGH

SEQ ID NO: 161 - protein, 8 aa, Mycobacterium tuberculosis
PHNTTGHF

SEQ ID NO: 162 - protein, 8 aa, Mycobacterium tuberculosis
HNTTGHFE

SEQ ID NO: 163 - protein, 8 aa, Mycobacterium tuberculosis
NTTGHFEW

SEQ ID NO: 164 - protein, 8 aa, Mycobacterium tuberculosis
TTGHFEWV

SEQ ID NO: 165 - protein, 8 aa, Mycobacterium tuberculosis
TGHFEWVA

SEQ ID NO: 166 - protein, 8 aa, Mycobacterium tuberculosis
GHFEWVAS

SEQ ID NO: 167 - protein, 8 aa, Mycobacterium tuberculosis
HFEWVASN

SEQ ID NO: 168 - protein, 8 aa, Mycobacterium tuberculosis
FEWVASNV

SEQ ID NO: 169 - protein, 8 aa, Mycobacterium tuberculosis
EWVASNVV

SEQ ID NO: 170 - protein, 8 aa, Mycobacterium tuberculosis
WVASNVVR

SEQ ID NO: 171 - protein, 8 aa, Mycobacterium tuberculosis
VASNVVRW

SEQ ID NO: 172 - protein, 8 aa, Mycobacterium tuberculosis
ASNVVRWV

SEQ ID NO: 173 - protein, 8 aa, Mycobacterium tuberculosis
SNVVRWVP

SEQ ID NO: 174 - protein, 8 aa, Mycobacterium tuberculosis
NVVRWVPH

SEQ ID NO: 175 - protein, 8 aa, Mycobacterium tuberculosis
VVRWVPHR

SEQ ID NO: 176 - protein, 8 aa, Mycobacterium tuberculosis
VRWVPHRY

SEQ ID NO: 177 - protein, 8 aa, Mycobacterium tuberculosis
RWVPHRYW

SEQ ID NO: 178 - protein, 8 aa, Mycobacterium tuberculosis
WVPHRYWP

SEQ ID NO: 179 - protein, 8 aa, Mycobacterium tuberculosis
VPHRYWPP

SEQ ID NO: 180 - protein, 8 aa, Mycobacterium tuberculosis
PHRYWPPH

SEQ ID NO: 181 - protein, 8 aa, Mycobacterium tuberculosis
HRYWPPHT

SEQ ID NO: 182 - protein, 8 aa, Mycobacterium tuberculosis
RYWPPHTR

SEQ ID NO: 183 - protein, 8 aa, Mycobacterium tuberculosis
YWPPHTRV

SEQ ID NO: 184 - protein, 8 aa, Mycobacterium tuberculosis
WPPHTRVS

SEQ ID NO: 185 - protein, 8 aa, Mycobacterium tuberculosis
PPHTRVSV

SEQ ID NO: 186 - protein, 8 aa, Mycobacterium tuberculosis
PHTRVSVG

SEQ ID NO: 187 - protein, 8 aa, Mycobacterium tuberculosis
HTRVSVGV

SEQ ID NO: 188 - protein, 8 aa, Mycobacterium tuberculosis
TRVSVGVQ

SEQ ID NO: 189 - protein, 8 aa, Mycobacterium tuberculosis
RVSVGVQE

SEQ ID NO: 190 - protein, 8 aa, Mycobacterium tuberculosis
VSVGVQEL

SEQ ID NO: 191 - protein, 8 aa, Mycobacterium tuberculosis
SVGVQELT

SEQ ID NO: 192 - protein, 8 aa, Mycobacterium tuberculosis
VGVQELTE

SEQ ID NO: 193 - protein, 8 aa, Mycobacterium tuberculosis
GVQELTEG

SEQ ID NO: 194 - protein, 8 aa, Mycobacterium tuberculosis
VQELTEGF

SEQ ID NO: 195 - protein, 8 aa, Mycobacterium tuberculosis
QELTEGFE

SEQ ID NO: 196 - protein, 8 aa, Mycobacterium tuberculosis
ELTEGFET

SEQ ID NO: 197 - protein, 8 aa, Mycobacterium tuberculosis
LTEGFETG

SEQ ID NO: 198 - protein, 8 aa, Mycobacterium tuberculosis
TEGFETGD

SEQ ID NO: 199 - protein, 8 aa, Mycobacterium tuberculosis
EGFETGDA

SEQ ID NO: 200 - protein, 8 aa, Mycobacterium tuberculosis
GFETGDAL

SEQ ID NO: 201 - protein, 8 aa, Mycobacterium tuberculosis
FETGDALI

SEQ ID NO: 202 - protein, 8 aa, Mycobacterium tuberculosis
ETGDALIG

SEQ ID NO: 203 - protein, 8 aa, Mycobacterium tuberculosis
TGDALIGV

SEQ ID NO: 204 - protein, 8 aa, Mycobacterium tuberculosis
GDALIGVA

SEQ ID NO: 205 - protein, 8 aa, Mycobacterium tuberculosis
DALIGVAS

SEQ ID NO: 206 - protein, 8 aa, Mycobacterium tuberculosis
ALIGVASI

SEQ ID NO: 207 - protein, 8 aa, Mycobacterium tuberculosis
LIGVASIS

SEQ ID NO: 208 - protein, 8 aa, Mycobacterium tuberculosis
IGVASISA

SEQ ID NO: 209 - protein, 8 aa, Mycobacterium tuberculosis
GVASISAH

SEQ ID NO: 210 - protein, 8 aa, Mycobacterium tuberculosis
VASISAHT

SEQ ID NO: 211 - protein, 8 aa, Mycobacterium tuberculosis
ASISAHTF

SEQ ID NO: 212 - protein, 8 aa, Mycobacterium tuberculosis
SISAHTFT

SEQ ID NO: 213 - protein, 8 aa, Mycobacterium tuberculosis
ISAHTFTV

SEQ ID NO: 214 - protein, 8 aa, Mycobacterium tuberculosis
SAHTFTVS

SEQ ID NO: 215 - protein, 8 aa, Mycobacterium tuberculosis
AHTFTVSR

SEQ ID NO: 216 - protein, 8 aa, Mycobacterium tuberculosis
HTFTVSRN

SEQ ID NO: 217 - protein, 8 aa, Mycobacterium tuberculosis
TFTVSRNG

SEQ ID NO: 218 - protein, 8 aa, Mycobacterium tuberculosis
FTVSRNGE

SEQ ID NO: 219 - protein, 8 aa, Mycobacterium tuberculosis
TVSRNGEV

SEQ ID NO: 220 - protein, 8 aa, Mycobacterium tuberculosis
VSRNGEVL

SEQ ID NO: 221 - protein, 8 aa, Mycobacterium tuberculosis
SRNGEVLR

SEQ ID NO: 222 - protein, 8 aa, Mycobacterium tuberculosis
RNGEVLRT

SEQ ID NO: 223 - protein, 8 aa, Mycobacterium tuberculosis
NGEVLRTM

SEQ ID NO: 224 - protein, 8 aa, Mycobacterium tuberculosis
GEVLRTMP

SEQ ID NO: 225 - protein, 8 aa, Mycobacterium tuberculosis
EVLRTMPA

SEQ ID NO: 226 - protein, 8 aa, Mycobacterium tuberculosis
VLRTMPAS

SEQ ID NO: 227 - protein, 8 aa, Mycobacterium tuberculosis
LRTMPASL

SEQ ID NO: 228 - protein, 8 aa, Mycobacterium tuberculosis
RTMPASLG

SEQ ID NO: 229 - protein, 8 aa, Mycobacterium tuberculosis
TMPASLGK

SEQ ID NO: 230 - protein, 8 aa, Mycobacterium tuberculosis
MPASLGKP

SEQ ID NO: 231 - protein, 8 aa, Mycobacterium tuberculosis
PASLGKPS

SEQ ID NO: 232 - protein, 8 aa, Mycobacterium tuberculosis
ASLGKPSR

SEQ ID NO: 233 - protein, 8 aa, Mycobacterium tuberculosis
SLGKPSRP

SEQ ID NO: 234 - protein, 8 aa, Mycobacterium tuberculosis
LGKPSRPT

SEQ ID NO: 235 - protein, 8 aa, Mycobacterium tuberculosis
GKPSRPTP

SEQ ID NO: 236 - protein, 8 aa, Mycobacterium tuberculosis
KPSRPTPI

SEQ ID NO: 237 - protein, 8 aa, Mycobacterium tuberculosis
PSRPTPIG

SEQ ID NO: 238 - protein, 8 aa, Mycobacterium tuberculosis
SRPTPIGS

SEQ ID NO: 239 - protein, 8 aa, Mycobacterium tuberculosis
RPTPIGSF

SEQ ID NO: 240 - protein, 8 aa, Mycobacterium tuberculosis
PTPIGSFH

SEQ ID NO: 241 - protein, 8 aa, Mycobacterium tuberculosis
TPIGSFHA

SEQ ID NO: 242 - protein, 8 aa, Mycobacterium tuberculosis
PIGSFHAM

SEQ ID NO: 243 - protein, 8 aa, Mycobacterium tuberculosis
IGSFHAMS

SEQ ID NO: 244 - protein, 8 aa, Mycobacterium tuberculosis
GSFHAMSK

SEQ ID NO: 245 - protein, 8 aa, Mycobacterium tuberculosis
SFHAMSKE

SEQ ID NO: 246 - protein, 8 aa, Mycobacterium tuberculosis
FHAMSKER

SEQ ID NO: 247 - protein, 8 aa, Mycobacterium tuberculosis
HAMSKERT

SEQ ID NO: 248 - protein, 8 aa, Mycobacterium tuberculosis
AMSKERTV

SEQ ID NO: 249 - protein, 8 aa, Mycobacterium tuberculosis
MSKERTVV

SEQ ID NO: 250 - protein, 8 aa, Mycobacterium tuberculosis
SKERTVVM

SEQ ID NO: 251 - protein, 8 aa, Mycobacterium tuberculosis
KERTVVMD

SEQ ID NO: 252 - protein, 8 aa, Mycobacterium tuberculosis
ERTVVMDS

SEQ ID NO: 253 - protein, 8 aa, Mycobacterium tuberculosis
RTVVMDSR

SEQ ID NO: 254 - protein, 8 aa, Mycobacterium tuberculosis
TVVMDSRT

SEQ ID NO: 255 - protein, 8 aa, Mycobacterium tuberculosis
VVMDSRTI

SEQ ID NO: 256 - protein, 8 aa, Mycobacterium tuberculosis
VMDSRTIG

SEQ ID NO: 257 - protein, 8 aa, Mycobacterium tuberculosis
MDSRTIGI

SEQ ID NO: 258 - protein, 8 aa, Mycobacterium tuberculosis
DSRTIGIP

SEQ ID NO: 259 - protein, 8 aa, Mycobacterium tuberculosis
SRTIGIPL

SEQ ID NO: 260 - protein, 8 aa, Mycobacterium tuberculosis
RTIGIPLN

SEQ ID NO: 261 - protein, 8 aa, Mycobacterium tuberculosis
TIGIPLNS

SEQ ID NO: 262 - protein, 8 aa, Mycobacterium tuberculosis
IGIPLNSS

SEQ ID NO: 263 - protein, 8 aa, Mycobacterium tuberculosis
GIPLNSSD

SEQ ID NO: 264 - protein, 8 aa, Mycobacterium tuberculosis
IPLNSSDG

SEQ ID NO: 265 - protein, 8 aa, Mycobacterium tuberculosis
PLNSSDGY

SEQ ID NO: 266 - protein, 8 aa, Mycobacterium tuberculosis
LNSSDGYL

SEQ ID NO: 267 - protein, 8 aa, Mycobacterium tuberculosis
NSSDGYLL

SEQ ID NO: 268 - protein, 8 aa, Mycobacterium tuberculosis
SSDGYLLT

SEQ ID NO: 269 - protein, 8 aa, Mycobacterium tuberculosis
SDGYLLTA

SEQ ID NO: 270 - protein, 8 aa, Mycobacterium tuberculosis
DGYLLTAH

SEQ ID NO: 271 - protein, 8 aa, Mycobacterium tuberculosis
GYLLTAHY

SEQ ID NO: 272 - protein, 8 aa, Mycobacterium tuberculosis
YLLTAHYA

SEQ ID NO: 273 - protein, 8 aa, Mycobacterium tuberculosis
LLTAHYAV

SEQ ID NO: 274 - protein, 8 aa, Mycobacterium tuberculosis
LTAHYAVR

SEQ ID NO: 275 - protein, 8 aa, Mycobacterium tuberculosis
TAHYAVRV

SEQ ID NO: 276 - protein, 8 aa, Mycobacterium tuberculosis
AHYAVRVT

SEQ ID NO: 277 - protein, 8 aa, Mycobacterium tuberculosis
HYAVRVTW

SEQ ID NO: 278 - protein, 8 aa, Mycobacterium tuberculosis
YAVRVTWS

SEQ ID NO: 279 - protein, 8 aa, Mycobacterium tuberculosis
AVRVTWSG

SEQ ID NO: 280 - protein, 8 aa, Mycobacterium tuberculosis
VRVTWSGV

SEQ ID NO: 281 - protein, 8 aa, Mycobacterium tuberculosis
RVTWSGVY

SEQ ID NO: 282 - protein, 8 aa, Mycobacterium tuberculosis
VTWSGVYV

SEQ ID NO: 283 - protein, 8 aa, Mycobacterium tuberculosis
TWSGVYVH

SEQ ID NO: 284 - protein, 8 aa, Mycobacterium tuberculosis
WSGVYVHS

SEQ ID NO: 285 - protein, 8 aa, Mycobacterium tuberculosis
SGVYVHSA

SEQ ID NO: 286 - protein, 8 aa, Mycobacterium tuberculosis
GVYVHSAP

SEQ ID NO: 287 - protein, 8 aa, Mycobacterium tuberculosis
VYVHSAPW

SEQ ID NO: 288 - protein, 8 aa, Mycobacterium tuberculosis
YVHSAPWS

SEQ ID NO: 289 - protein, 8 aa, Mycobacterium tuberculosis
VHSAPWSV

SEQ ID NO: 290 - protein, 8 aa, Mycobacterium tuberculosis
HSAPWSVN

SEQ ID NO: 291 - protein, 8 aa, Mycobacterium tuberculosis
SAPWSVNS

SEQ ID NO: 292 - protein, 8 aa, Mycobacterium tuberculosis
APWSVNSQ

SEQ ID NO: 293 - protein, 8 aa, Mycobacterium tuberculosis
PWSVNSQG

SEQ ID NO: 294 - protein, 8 aa, Mycobacterium tuberculosis
WSVNSQGY

SEQ ID NO: 295 - protein, 8 aa, Mycobacterium tuberculosis
SVNSQGYA

SEQ ID NO: 296 - protein, 8 aa, Mycobacterium tuberculosis
VNSQGYAN

SEQ ID NO: 297 - protein, 8 aa, Mycobacterium tuberculosis
NSQGYANV

SEQ ID NO: 298 - protein, 8 aa, Mycobacterium tuberculosis
SQGYANVS

SEQ ID NO: 299 - protein, 8 aa, Mycobacterium tuberculosis
QGYANVSH

SEQ ID NO: 300 - protein, 8 aa, Mycobacterium tuberculosis
GYANVSHG

SEQ ID NO: 301 - protein, 8 aa, Mycobacterium tuberculosis
YANVSHGC

SEQ ID NO: 302 - protein, 8 aa, Mycobacterium tuberculosis
ANVSHGCI

SEQ ID NO: 303 - protein, 8 aa, Mycobacterium tuberculosis
NVSHGCIN

SEQ ID NO: 304 - protein, 8 aa, Mycobacterium tuberculosis
VSHGCINL

SEQ ID NO: 305 - protein, 8 aa, Mycobacterium tuberculosis
SHGCINLS

SEQ ID NO: 306 - protein, 8 aa, Mycobacterium tuberculosis
HGCINLSP

SEQ ID NO: 307 - protein, 8 aa, Mycobacterium tuberculosis
GCINLSPD

SEQ ID NO: 308 - protein, 8 aa, Mycobacterium tuberculosis
CINLSPDN

SEQ ID NO: 309 - protein, 8 aa, Mycobacterium tuberculosis
INLSPDNA

SEQ ID NO: 310 - protein, 8 aa, Mycobacterium tuberculosis
NLSPDNAA

SEQ ID NO: 311 - protein, 8 aa, Mycobacterium tuberculosis
LSPDNAAW

SEQ ID NO: 312 - protein, 8 aa, Mycobacterium tuberculosis
SPDNAAWY

SEQ ID NO: 313 - protein, 8 aa, Mycobacterium tuberculosis
PDNAAWYF

SEQ ID NO: 314 - protein, 8 aa, Mycobacterium tuberculosis
DNAAWYFD

SEQ ID NO: 315 - protein, 8 aa, Mycobacterium tuberculosis
NAAWYFDA

SEQ ID NO: 316 - protein, 8 aa, Mycobacterium tuberculosis
AAWYFDAV

SEQ ID NO: 317 - protein, 8 aa, Mycobacterium tuberculosis
AWYFDAVT

SEQ ID NO: 318 - protein, 8 aa, Mycobacterium tuberculosis
WYFDAVTV

SEQ ID NO: 319 - protein, 8 aa, Mycobacterium tuberculosis
YFDAVTVG

SEQ ID NO: 320 - protein, 8 aa, Mycobacterium tuberculosis
FDAVTVGD

SEQ ID NO: 321 - protein, 8 aa, Mycobacterium tuberculosis
DAVTVGDP

SEQ ID NO: 322 - protein, 8 aa, Mycobacterium tuberculosis
AVTVGDPI

SEQ ID NO: 323 - protein, 8 aa, Mycobacterium tuberculosis
VTVGDPIE

SEQ ID NO: 324 - protein, 8 aa, Mycobacterium tuberculosis
TVGDPIEV

SEQ ID NO: 325 - protein, 8 aa, Mycobacterium tuberculosis
VGDPIEVV

SEQ ID NO: 326 - protein, 8 aa, Mycobacterium tuberculosis
GDPIEVVG

SEQ ID NO: 327 - protein, 9 aa, Mycobacterium tuberculosis
MRRVVRYLS

SEQ ID NO: 328 - protein, 9 aa, Mycobacterium tuberculosis
RRVVRYLSV

SEQ ID NO: 329 - protein, 9 aa, Mycobacterium tuberculosis
RVVRYLSVV

SEQ ID NO: 330 - protein, 9 aa, Mycobacterium tuberculosis
VVRYLSVVV

SEQ ID NO: 331 - protein, 9 aa, Mycobacterium tuberculosis
VRYLSVVVA

SEQ ID NO: 332 - protein, 9 aa, Mycobacterium tuberculosis
RYLSVVVAI

SEQ ID NO: 333 - protein, 9 aa, Mycobacterium tuberculosis
YLSVVVAIT

SEQ ID NO: 334 - protein, 9 aa, Mycobacterium tuberculosis
LSVVVAITL

SEQ ID NO: 335 - protein, 9 aa, Mycobacterium tuberculosis
SVVVAITLM

SEQ ID NO: 336 - protein, 9 aa, Mycobacterium tuberculosis
VVVAITLML

SEQ ID NO: 337 - protein, 9 aa, Mycobacterium tuberculosis
VVAITLMLT

SEQ ID NO: 338 - protein, 9 aa, Mycobacterium tuberculosis
VAITLMLTA

SEQ ID NO: 339 - protein, 9 aa, Mycobacterium tuberculosis
AITLMLTAE

SEQ ID NO: 340 - protein, 9 aa, Mycobacterium tuberculosis
ITLMLTAES

SEQ ID NO: 341 - protein, 9 aa, Mycobacterium tuberculosis
TLMLTAESV

SEQ ID NO: 342 - protein, 9 aa, Mycobacterium tuberculosis
LMLTAESVS

SEQ ID NO: 343 - protein, 9 aa, Mycobacterium tuberculosis
MLTAESVSI

SEQ ID NO: 344 - protein, 9 aa, Mycobacterium tuberculosis
LTAESVSIA

SEQ ID NO: 345 - protein, 9 aa, Mycobacterium tuberculosis
TAESVSIAT

SEQ ID NO: 346 - protein, 9 aa, Mycobacterium tuberculosis
AESVSIATA

SEQ ID NO: 347 - protein, 9 aa, Mycobacterium tuberculosis
ESVSIATAA

SEQ ID NO: 348 - protein, 9 aa, Mycobacterium tuberculosis
SVSIATAAV

SEQ ID NO: 349 - protein, 9 aa, Mycobacterium tuberculosis
VSIATAAVP

SEQ ID NO: 350 - protein, 9 aa, Mycobacterium tuberculosis
SIATAAVPP

SEQ ID NO: 351 - protein, 9 aa, Mycobacterium tuberculosis
IATAAVPPL

SEQ ID NO: 352 - protein, 9 aa, Mycobacterium tuberculosis
ATAAVPPLQ

SEQ ID NO: 353 - protein, 9 aa, Mycobacterium tuberculosis
TAAVPPLQP

SEQ ID NO: 354 - protein, 9 aa, Mycobacterium tuberculosis
AAVPPLQPI

SEQ ID NO: 355 - protein, 9 aa, Mycobacterium tuberculosis
AVPPLQPIP

SEQ ID NO: 356 - protein, 9 aa, Mycobacterium tuberculosis
VPPLQPIPG

SEQ ID NO: 357 - protein, 9 aa, Mycobacterium tuberculosis
PPLQPIPGV

SEQ ID NO: 358 - protein, 9 aa, Mycobacterium tuberculosis
PLQPIPGVA

SEQ ID NO: 359 - protein, 9 aa, Mycobacterium tuberculosis
LQPIPGVAS

SEQ ID NO: 360 - protein, 9 aa, Mycobacterium tuberculosis
QPIPGVASV

SEQ ID NO: 361 - protein, 9 aa, Mycobacterium tuberculosis
PIPGVASVS

SEQ ID NO: 362 - protein, 9 aa, Mycobacterium tuberculosis
IPGVASVSP

SEQ ID NO: 363 - protein, 9 aa, Mycobacterium tuberculosis
PGVASVSPA

SEQ ID NO: 364 - protein, 9 aa, Mycobacterium tuberculosis
GVASVSPAN

SEQ ID NO: 365 - protein, 9 aa, Mycobacterium tuberculosis
VASVSPANG

SEQ ID NO: 366 - protein, 9 aa, Mycobacterium tuberculosis
ASVSPANGA

SEQ ID NO: 367 - protein, 9 aa, Mycobacterium tuberculosis
SVSPANGAV

SEQ ID NO: 368 - protein, 9 aa, Mycobacterium tuberculosis
VSPANGAVV

SEQ ID NO: 369 - protein, 9 aa, Mycobacterium tuberculosis
SPANGAVVG

SEQ ID NO: 370 - protein, 9 aa, Mycobacterium tuberculosis
PANGAVVGV

SEQ ID NO: 371 - protein, 9 aa, Mycobacterium tuberculosis
ANGAVVGVA

SEQ ID NO: 372 - protein, 9 aa, Mycobacterium tuberculosis
NGAVVGVAH

SEQ ID NO: 373 - protein, 9 aa, Mycobacterium tuberculosis
GAVVGVAHP

SEQ ID NO: 374 - protein, 9 aa, Mycobacterium tuberculosis
AVVGVAHPV

SEQ ID NO: 375 - protein, 9 aa, Mycobacterium tuberculosis
VVGVAHPVV

SEQ ID NO: 376 - protein, 9 aa, Mycobacterium tuberculosis
VGVAHPVVV

SEQ ID NO: 377 - protein, 9 aa, Mycobacterium tuberculosis
GVAHPVVVT

SEQ ID NO: 378 - protein, 9 aa, Mycobacterium tuberculosis
VAHPVVVTF

SEQ ID NO: 379 - protein, 9 aa, Mycobacterium tuberculosis
AHPVVVTFT

SEQ ID NO: 380 - protein, 9 aa, Mycobacterium tuberculosis
HPVVVTFTT

SEQ ID NO: 381 - protein, 9 aa, Mycobacterium tuberculosis
PVVVTFTTP

SEQ ID NO: 382 - protein, 9 aa, Mycobacterium tuberculosis
VVVTFTTPV

SEQ ID NO: 383 - protein, 9 aa, Mycobacterium tuberculosis
VVTFTTPVT

SEQ ID NO: 384 - protein, 9 aa, Mycobacterium tuberculosis
VTFTTPVTD

SEQ ID NO: 385 - protein, 9 aa, Mycobacterium tuberculosis
TFTTPVTDR

SEQ ID NO: 386 - protein, 9 aa, Mycobacterium tuberculosis
FTTPVTDRR

SEQ ID NO: 387 - protein, 9 aa, Mycobacterium tuberculosis
TTPVTDRRA

SEQ ID NO: 388 - protein, 9 aa, Mycobacterium tuberculosis
TPVTDRRAV

SEQ ID NO: 389 - protein, 9 aa, Mycobacterium tuberculosis
PVTDRRAVE

SEQ ID NO: 390 - protein, 9 aa, Mycobacterium tuberculosis
VTDRRAVER

SEQ ID NO: 391 - protein, 9 aa, Mycobacterium tuberculosis
TDRRAVERS

SEQ ID NO: 392 - protein, 9 aa, Mycobacterium tuberculosis
DRRAVERSI

SEQ ID NO: 393 - protein, 9 aa, Mycobacterium tuberculosis
RRAVERSIR

SEQ ID NO: 394 - protein, 9 aa, Mycobacterium tuberculosis
RAVERSIRI

SEQ ID NO: 395 - protein, 9 aa, Mycobacterium tuberculosis
AVERSIRIS

SEQ ID NO: 396 - protein, 9 aa, Mycobacterium tuberculosis
VERSIRIST

SEQ ID NO: 397 - protein, 9 aa, Mycobacterium tuberculosis
ERSIRISTP

SEQ ID NO: 398 - protein, 9 aa, Mycobacterium tuberculosis
RSIRISTPH

SEQ ID NO: 399 - protein, 9 aa, Mycobacterium tuberculosis
SIRISTPHN

SEQ ID NO: 400 - protein, 9 aa, Mycobacterium tuberculosis
IRISTPHNT

SEQ ID NO: 401 - protein, 9 aa, Mycobacterium tuberculosis
RISTPHNTT

SEQ ID NO: 402 - protein, 9 aa, Mycobacterium tuberculosis
ISTPHNTTG

SEQ ID NO: 403 - protein, 9 aa, Mycobacterium tuberculosis
STPHNTTGH

SEQ ID NO: 404 - protein, 9 aa, Mycobacterium tuberculosis
TPHNTTGHF

SEQ ID NO: 405 - protein, 9 aa, Mycobacterium tuberculosis
PHNTTGHFE

SEQ ID NO: 406 - protein, 9 aa, Mycobacterium tuberculosis
HNTTGHFEW

SEQ ID NO: 407 - protein, 9 aa, Mycobacterium tuberculosis
NTTGHFEWV

SEQ ID NO: 408 - protein, 9 aa, Mycobacterium tuberculosis
TTGHFEWVA

SEQ ID NO: 409 - protein, 9 aa, Mycobacterium tuberculosis
TGHFEWVAS

SEQ ID NO: 410 - protein, 9 aa, Mycobacterium tuberculosis
GHFEWVASN

SEQ ID NO: 411 - protein, 9 aa, Mycobacterium tuberculosis
HFEWVASNV

SEQ ID NO: 412 - protein, 9 aa, Mycobacterium tuberculosis
FEWVASNVV

SEQ ID NO: 413 - protein, 9 aa, Mycobacterium tuberculosis
EWVASNVVR

SEQ ID NO: 414 - protein, 9 aa, Mycobacterium tuberculosis
WVASNVVRW

SEQ ID NO: 415 - protein, 9 aa, Mycobacterium tuberculosis
VASNVVRWV

SEQ ID NO: 416 - protein, 9 aa, Mycobacterium tuberculosis
ASNVVRWVP

SEQ ID NO: 417 - protein, 9 aa, Mycobacterium tuberculosis
SNVVRWVPH

SEQ ID NO: 418 - protein, 9 aa, Mycobacterium tuberculosis
NVVRWVPHR

SEQ ID NO: 419 - protein, 9 aa, Mycobacterium tuberculosis
VVRWVPHRY

SEQ ID NO: 420 - protein, 9 aa, Mycobacterium tuberculosis
VRWVPHRYW

SEQ ID NO: 421 - protein, 9 aa, Mycobacterium tuberculosis
RWVPHRYWP

SEQ ID NO: 422 - protein, 9 aa, Mycobacterium tuberculosis
WVPHRYWPP

SEQ ID NO: 423 - protein, 9 aa, Mycobacterium tuberculosis
VPHRYWPPH

SEQ ID NO: 424 - protein, 9 aa, Mycobacterium tuberculosis
PHRYWPPHT

SEQ ID NO: 425 - protein, 9 aa, Mycobacterium tuberculosis
HRYWPPHTR

SEQ ID NO: 426 - protein, 9 aa, Mycobacterium tuberculosis
RYWPPHTRV

SEQ ID NO: 427 - protein, 9 aa, Mycobacterium tuberculosis
YWPPHTRVS

SEQ ID NO: 428 - protein, 9 aa, Mycobacterium tuberculosis
WPPHTRVSV

SEQ ID NO: 429 - protein, 9 aa, Mycobacterium tuberculosis
PPHTRVSVG

SEQ ID NO: 430 - protein, 9 aa, Mycobacterium tuberculosis
PHTRVSVGV

SEQ ID NO: 431 - protein, 9 aa, Mycobacterium tuberculosis
HTRVSVGVQ

SEQ ID NO: 432 - protein, 9 aa, Mycobacterium tuberculosis
TRVSVGVQE

SEQ ID NO: 433 - protein, 9 aa, Mycobacterium tuberculosis
RVSVGVQEL

SEQ ID NO: 434 - protein, 9 aa, Mycobacterium tuberculosis
VSVGVQELT

SEQ ID NO: 435 - protein, 9 aa, Mycobacterium tuberculosis
SVGVQELTE

SEQ ID NO: 436 - protein, 9 aa, Mycobacterium tuberculosis
VGVQELTEG

SEQ ID NO: 437 - protein, 9 aa, Mycobacterium tuberculosis
GVQELTEGF

SEQ ID NO: 438 - protein, 9 aa, Mycobacterium tuberculosis
VQELTEGFE

SEQ ID NO: 439 - protein, 9 aa, Mycobacterium tuberculosis
QELTEGFET

SEQ ID NO: 440 - protein, 9 aa, Mycobacterium tuberculosis
ELTEGFETG

SEQ ID NO: 441 - protein, 9 aa, Mycobacterium tuberculosis
LTEGFETGD

SEQ ID NO: 442 - protein, 9 aa, Mycobacterium tuberculosis
TEGFETGDA

SEQ ID NO: 443 - protein, 9 aa, Mycobacterium tuberculosis
EGFETGDAL

SEQ ID NO: 444 - protein, 9 aa, Mycobacterium tuberculosis
GFETGDALI

SEQ ID NO: 445 - protein, 9 aa, Mycobacterium tuberculosis
FETGDALIG

SEQ ID NO: 446 - protein, 9 aa, Mycobacterium tuberculosis
ETGDALIGV

SEQ ID NO: 447 - protein, 9 aa, Mycobacterium tuberculosis
TGDALIGVA

SEQ ID NO: 448 - protein, 9 aa, Mycobacterium tuberculosis
GDALIGVAS

SEQ ID NO: 449 - protein, 9 aa, Mycobacterium tuberculosis
DALIGVASI

SEQ ID NO: 450 - protein, 9 aa, Mycobacterium tuberculosis
ALIGVASIS

SEQ ID NO: 451 - protein, 9 aa, Mycobacterium tuberculosis
LIGVASISA

SEQ ID NO: 452 - protein, 9 aa, Mycobacterium tuberculosis
IGVASISAH

SEQ ID NO: 453 - protein, 9 aa, Mycobacterium tuberculosis
GVASISAHT

SEQ ID NO: 454 - protein, 9 aa, Mycobacterium tuberculosis
VASISAHTF

SEQ ID NO: 455 - protein, 9 aa, Mycobacterium tuberculosis
ASISAHTFT

SEQ ID NO: 456 - protein, 9 aa, Mycobacterium tuberculosis
SISAHTFTV

SEQ ID NO: 457 - protein, 9 aa, Mycobacterium tuberculosis
ISAHTFTVS

SEQ ID NO: 458 - protein, 9 aa, Mycobacterium tuberculosis
SAHTFTVSR

SEQ ID NO: 459 - protein, 9 aa, Mycobacterium tuberculosis
AHTFTVSRN

SEQ ID NO: 460 - protein, 9 aa, Mycobacterium tuberculosis
HTFTVSRNG

SEQ ID NO: 461 - protein, 9 aa, Mycobacterium tuberculosis
TFTVSRNGE

SEQ ID NO: 462 - protein, 9 aa, Mycobacterium tuberculosis
FTVSRNGEV

SEQ ID NO: 463 - protein, 9 aa, Mycobacterium tuberculosis
TVSRNGEVL

SEQ ID NO: 464 - protein, 9 aa, Mycobacterium tuberculosis
VSRNGEVLR

SEQ ID NO: 465 - protein, 9 aa, Mycobacterium tuberculosis
SRNGEVLRT

SEQ ID NO: 466 - protein, 9 aa, Mycobacterium tuberculosis
RNGEVLRTM

SEQ ID NO: 467 - protein, 9 aa, Mycobacterium tuberculosis
NGEVLRTMP

SEQ ID NO: 468 - protein, 9 aa, Mycobacterium tuberculosis
GEVLRTMPA

SEQ ID NO: 469 - protein, 9 aa, Mycobacterium tuberculosis
EVLRTMPAS

SEQ ID NO: 470 - protein, 9 aa, Mycobacterium tuberculosis
VLRTMPASL

SEQ ID NO: 471 - protein, 9 aa, Mycobacterium tuberculosis
LRTMPASLG

SEQ ID NO: 472 - protein, 9 aa, Mycobacterium tuberculosis
RTMPASLGK

SEQ ID NO: 473 - protein, 9 aa, Mycobacterium tuberculosis
TMPASLGKP

SEQ ID NO: 474 - protein, 9 aa, Mycobacterium tuberculosis
MPASLGKPS

SEQ ID NO: 475 - protein, 9 aa, Mycobacterium tuberculosis
PASLGKPSR

SEQ ID NO: 476 - protein, 9 aa, Mycobacterium tuberculosis
ASLGKPSRP

SEQ ID NO: 477 - protein, 9 aa, Mycobacterium tuberculosis
SLGKPSRPT

SEQ ID NO: 478 - protein, 9 aa, Mycobacterium tuberculosis
LGKPSRPTP

SEQ ID NO: 479 - protein, 9 aa, Mycobacterium tuberculosis
GKPSRPTPI

SEQ ID NO: 480 - protein, 9 aa, Mycobacterium tuberculosis
KPSRPTPIG

SEQ ID NO: 481 - protein, 9 aa, Mycobacterium tuberculosis
PSRPTPIGS

SEQ ID NO: 482 - protein, 9 aa, Mycobacterium tuberculosis
SRPTPIGSF

SEQ ID NO: 483 - protein, 9 aa, Mycobacterium tuberculosis
RPTPIGSFH

SEQ ID NO: 484 - protein, 9 aa, Mycobacterium tuberculosis
PTPIGSFHA

SEQ ID NO: 485 - protein, 9 aa, Mycobacterium tuberculosis
TPIGSFHAM

SEQ ID NO: 486 - protein, 9 aa, Mycobacterium tuberculosis
PIGSFHAMS

SEQ ID NO: 487 - protein, 9 aa, Mycobacterium tuberculosis
IGSFHAMSK

SEQ ID NO: 488 - protein, 9 aa, Mycobacterium tuberculosis
GSFHAMSKE

SEQ ID NO: 489 - protein, 9 aa, Mycobacterium tuberculosis
SFHAMSKER

SEQ ID NO: 490 - protein, 9 aa, Mycobacterium tuberculosis
FHAMSKERT

SEQ ID NO: 491 - protein, 9 aa, Mycobacterium tuberculosis
HAMSKERTV

SEQ ID NO: 492 - protein, 9 aa, Mycobacterium tuberculosis
AMSKERTVV

SEQ ID NO: 493 - protein, 9 aa, Mycobacterium tuberculosis
MSKERTVVM

SEQ ID NO: 494 - protein, 9 aa, Mycobacterium tuberculosis
SKERTVVMD

SEQ ID NO: 495 - protein, 9 aa, Mycobacterium tuberculosis
KERTVVMDS

SEQ ID NO: 496 - protein, 9 aa, Mycobacterium tuberculosis
ERTVVMDSR

SEQ ID NO: 497 - protein, 9 aa, Mycobacterium tuberculosis
RTVVMDSRT

SEQ ID NO: 498 - protein, 9 aa, Mycobacterium tuberculosis
TVVMDSRTI

SEQ ID NO: 499 - protein, 9 aa, Mycobacterium tuberculosis
VVMDSRTIG

SEQ ID NO: 500 - protein, 9 aa, Mycobacterium tuberculosis
VMDSRTIGI

SEQ ID NO: 501 - protein, 9 aa, Mycobacterium tuberculosis
MDSRTIGIP

SEQ ID NO: 502 - protein, 9 aa, Mycobacterium tuberculosis
DSRTIGIPL

SEQ ID NO: 503 - protein, 9 aa, Mycobacterium tuberculosis
SRTIGIPLN

SEQ ID NO: 504 - protein, 9 aa, Mycobacterium tuberculosis
RTIGIPLNS

SEQ ID NO: 505 - protein, 9 aa, Mycobacterium tuberculosis
TIGIPLNSS

SEQ ID NO: 506 - protein, 9 aa, Mycobacterium tuberculosis
IGIPLNSSD

SEQ ID NO: 507 - protein, 9 aa, Mycobacterium tuberculosis
GIPLNSSDG

SEQ ID NO: 508 - protein, 9 aa, Mycobacterium tuberculosis
IPLNSSDGY

SEQ ID NO: 509 - protein, 9 aa, Mycobacterium tuberculosis
PLNSSDGYL

SEQ ID NO: 510 - protein, 9 aa, Mycobacterium tuberculosis
LNSSDGYLL

SEQ ID NO: 511 - protein, 9 aa, Mycobacterium tuberculosis
NSSDGYLLT

SEQ ID NO: 512 - protein, 9 aa, Mycobacterium tuberculosis
SSDGYLLTA

SEQ ID NO: 513 - protein, 9 aa, Mycobacterium tuberculosis
SDGYLLTAH

SEQ ID NO: 514 - protein, 9 aa, Mycobacterium tuberculosis
DGYLLTAHY

SEQ ID NO: 515 - protein, 9 aa, Mycobacterium tuberculosis
GYLLTAHYA

SEQ ID NO: 516 - protein, 9 aa, Mycobacterium tuberculosis
YLLTAHYAV

SEQ ID NO: 517 - protein, 9 aa, Mycobacterium tuberculosis
LLTAHYAVR

SEQ ID NO: 518 - protein, 9 aa, Mycobacterium tuberculosis
LTAHYAVRV

SEQ ID NO: 519 - protein, 9 aa, Mycobacterium tuberculosis
TAHYAVRVT

SEQ ID NO: 520 - protein, 9 aa, Mycobacterium tuberculosis
AHYAVRVTW

SEQ ID NO: 521 - protein, 9 aa, Mycobacterium tuberculosis
HYAVRVTWS

SEQ ID NO: 522 - protein, 9 aa, Mycobacterium tuberculosis
YAVRVTWSG

SEQ ID NO: 523 - protein, 9 aa, Mycobacterium tuberculosis
AVRVTWSGV

SEQ ID NO: 524 - protein, 9 aa, Mycobacterium tuberculosis
VRVTWSGVY

SEQ ID NO: 525 - protein, 9 aa, Mycobacterium tuberculosis
RVTWSGVYV

SEQ ID NO: 526 - protein, 9 aa, Mycobacterium tuberculosis
VTWSGVYVH

SEQ ID NO: 527 - protein, 9 aa, Mycobacterium tuberculosis
TWSGVYVHS

SEQ ID NO: 528 - protein, 9 aa, Mycobacterium tuberculosis
WSGVYVHSA

SEQ ID NO: 529 - protein, 9 aa, Mycobacterium tuberculosis
SGVYVHSAP

SEQ ID NO: 530 - protein, 9 aa, Mycobacterium tuberculosis
GVYVHSAPW

SEQ ID NO: 531 - protein, 9 aa, Mycobacterium tuberculosis
VYVHSAPWS

SEQ ID NO: 532 - protein, 9 aa, Mycobacterium tuberculosis
YVHSAPWSV

SEQ ID NO: 533 - protein, 9 aa, Mycobacterium tuberculosis
VHSAPWSVN

SEQ ID NO: 534 - protein, 9 aa, Mycobacterium tuberculosis
HSAPWSVNS

SEQ ID NO: 535 - protein, 9 aa, Mycobacterium tuberculosis
SAPWSVNSQ

SEQ ID NO: 536 - protein, 9 aa, Mycobacterium tuberculosis
APWSVNSQG

SEQ ID NO: 537 - protein, 9 aa, Mycobacterium tuberculosis
PWSVNSQGY

SEQ ID NO: 538 - protein, 9 aa, Mycobacterium tuberculosis
WSVNSQGYA

SEQ ID NO: 539 - protein, 9 aa, Mycobacterium tuberculosis
SVNSQGYAN

SEQ ID NO: 540 - protein, 9 aa, Mycobacterium tuberculosis
VNSQGYANV

SEQ ID NO: 541 - protein, 9 aa, Mycobacterium tuberculosis
NSQGYANVS

SEQ ID NO: 542 - protein, 9 aa, Mycobacterium tuberculosis
SQGYANVSH

SEQ ID NO: 543 - protein, 9 aa, Mycobacterium tuberculosis
QGYANVSHG

SEQ ID NO: 544 - protein, 9 aa, Mycobacterium tuberculosis
GYANVSHGC

SEQ ID NO: 545 - protein, 9 aa, Mycobacterium tuberculosis
YANVSHGCI

SEQ ID NO: 546 - protein, 9 aa, Mycobacterium tuberculosis
ANVSHGCIN

SEQ ID NO: 547 - protein, 9 aa, Mycobacterium tuberculosis
NVSHGCINL

SEQ ID NO: 548 - protein, 9 aa, Mycobacterium tuberculosis
VSHGCINLS

SEQ ID NO: 549 - protein, 9 aa, Mycobacterium tuberculosis
SHGCINLSP

SEQ ID NO: 550 - protein, 9 aa, Mycobacterium tuberculosis
HGCINLSPD

SEQ ID NO: 551 - protein, 9 aa, Mycobacterium tuberculosis
GCINLSPDN

SEQ ID NO: 552 - protein, 9 aa, Mycobacterium tuberculosis
CINLSPDNA

SEQ ID NO: 553 - protein, 9 aa, Mycobacterium tuberculosis
INLSPDNAA

SEQ ID NO: 554 - protein, 9 aa, Mycobacterium tuberculosis
NLSPDNAAW

SEQ ID NO: 555 - protein, 9 aa, Mycobacterium tuberculosis
LSPDNAAWY

SEQ ID NO: 556 - protein, 9 aa, Mycobacterium tuberculosis
SPDNAAWYF

SEQ ID NO: 557 - protein, 9 aa, Mycobacterium tuberculosis
PDNAAWYFD

SEQ ID NO: 558 - protein, 9 aa, Mycobacterium tuberculosis
DNAAWYFDA

SEQ ID NO: 559 - protein, 9 aa, Mycobacterium tuberculosis
NAAWYFDAV

SEQ ID NO: 560 - protein, 9 aa, Mycobacterium tuberculosis
AAWYFDAVT

SEQ ID NO: 561 - protein, 9 aa, Mycobacterium tuberculosis
AWYFDAVTV

SEQ ID NO: 562 - protein, 9 aa, Mycobacterium tuberculosis
WYFDAVTVG

SEQ ID NO: 563 - protein, 9 aa, Mycobacterium tuberculosis
YFDAVTVGD

SEQ ID NO: 564 - protein, 9 aa, Mycobacterium tuberculosis
FDAVTVGDP

SEQ ID NO: 565 - protein, 9 aa, Mycobacterium tuberculosis
DAVTVGDPI

SEQ ID NO: 566 - protein, 9 aa, Mycobacterium tuberculosis
AVTVGDPIE

SEQ ID NO: 567 - protein, 9 aa, Mycobacterium tuberculosis
VTVGDPIEV

SEQ ID NO: 568 - protein, 9 aa, Mycobacterium tuberculosis
TVGDPIEVV

SEQ ID NO: 569 - protein, 9 aa, Mycobacterium tuberculosis
VGDPIEVVG

SEQ ID NO: 570 - protein, 10 aa, Mycobacterium tuberculosis
MRRVVRYLSV

SEQ ID NO: 571 - protein, 10 aa, Mycobacterium tuberculosis
RRVVRYLSVV

SEQ ID NO: 572 - protein, 10 aa, Mycobacterium tuberculosis
RVVRYLSVVV

SEQ ID NO: 573 - protein, 10 aa, Mycobacterium tuberculosis
VVRYLSVVVA

SEQ ID NO: 574 - protein, 10 aa, Mycobacterium tuberculosis
VRYLSVVVAI

SEQ ID NO: 575 - protein, 10 aa, Mycobacterium tuberculosis
RYLSVVVAIT

SEQ ID NO: 576 - protein, 10 aa, Mycobacterium tuberculosis
YLSVVVAITL

SEQ ID NO: 577 - protein, 10 aa, Mycobacterium tuberculosis
LSVVVAITLM

SEQ ID NO: 578 - protein, 10 aa, Mycobacterium tuberculosis
SVVVAITLML

SEQ ID NO: 579 - protein, 10 aa, Mycobacterium tuberculosis
VVVAITLMLT

SEQ ID NO: 580 - protein, 10 aa, Mycobacterium tuberculosis
VVAITLMLTA

SEQ ID NO: 581 - protein, 10 aa, Mycobacterium tuberculosis
VAITLMLTAE

SEQ ID NO: 582 - protein, 10 aa, Mycobacterium tuberculosis
AITLMLTAES

SEQ ID NO: 583 - protein, 10 aa, Mycobacterium tuberculosis
ITLMLTAESV

SEQ ID NO: 584 - protein, 10 aa, Mycobacterium tuberculosis
TLMLTAESVS

SEQ ID NO: 585 - protein, 10 aa, Mycobacterium tuberculosis
LMLTAESVSI

SEQ ID NO: 586 - protein, 10 aa, Mycobacterium tuberculosis
MLTAESVSIA

SEQ ID NO: 587 - protein, 10 aa, Mycobacterium tuberculosis
LTAESVSIAT

SEQ ID NO: 588 - protein, 10 aa, Mycobacterium tuberculosis
TAESVSIATA

SEQ ID NO: 589 - protein, 10 aa, Mycobacterium tuberculosis
AESVSIATAA

SEQ ID NO: 590 - protein, 10 aa, Mycobacterium tuberculosis
ESVSIATAAV

SEQ ID NO: 591 - protein, 10 aa, Mycobacterium tuberculosis
SVSIATAAVP

SEQ ID NO: 592 - protein, 10 aa, Mycobacterium tuberculosis
VSIATAAVPP

SEQ ID NO: 593 - protein, 10 aa, Mycobacterium tuberculosis
SIATAAVPPL

SEQ ID NO: 594 - protein, 10 aa, Mycobacterium tuberculosis
IATAAVPPLQ

SEQ ID NO: 595 - protein, 10 aa, Mycobacterium tuberculosis
ATAAVPPLQP

SEQ ID NO: 596 - protein, 10 aa, Mycobacterium tuberculosis
TAAVPPLQPI

SEQ ID NO: 597 - protein, 10 aa, Mycobacterium tuberculosis
AAVPPLQPIP

SEQ ID NO: 598 - protein, 10 aa, Mycobacterium tuberculosis
AVPPLQPIPG

SEQ ID NO: 599 - protein, 10 aa, Mycobacterium tuberculosis
VPPLQPIPGV

SEQ ID NO: 600 - protein, 10 aa, Mycobacterium tuberculosis
PPLQPIPGVA

SEQ ID NO: 601 - protein, 10 aa, Mycobacterium tuberculosis
PLQPIPGVAS

SEQ ID NO: 602 - protein, 10 aa, Mycobacterium tuberculosis
LQPIPGVASV

SEQ ID NO: 603 - protein, 10 aa, Mycobacterium tuberculosis
QPIPGVASVS

SEQ ID NO: 604 - protein, 10 aa, Mycobacterium tuberculosis
PIPGVASVSP

SEQ ID NO: 605 - protein, 10 aa, Mycobacterium tuberculosis
IPGVASVSPA

SEQ ID NO: 606 - protein, 10 aa, Mycobacterium tuberculosis
PGVASVSPAN

SEQ ID NO: 607 - protein, 10 aa, Mycobacterium tuberculosis
GVASVSPANG

SEQ ID NO: 608 - protein, 10 aa, Mycobacterium tuberculosis
VASVSPANGA

SEQ ID NO: 609 - protein, 10 aa, Mycobacterium tuberculosis
ASVSPANGAV

SEQ ID NO: 610 - protein, 10 aa, Mycobacterium tuberculosis
SVSPANGAVV

SEQ ID NO: 611 - protein, 10 aa, Mycobacterium tuberculosis
VSPANGAVVG

SEQ ID NO: 612 - protein, 10 aa, Mycobacterium tuberculosis
SPANGAVVGV

SEQ ID NO: 613 - protein, 10 aa, Mycobacterium tuberculosis
PANGAVVGVA

SEQ ID NO: 614 - protein, 10 aa, Mycobacterium tuberculosis
ANGAVVGVAH

SEQ ID NO: 615 - protein, 10 aa, Mycobacterium tuberculosis
NGAVVGVAHP

SEQ ID NO: 616 - protein, 10 aa, Mycobacterium tuberculosis
GAVVGVAHPV

SEQ ID NO: 617 - protein, 10 aa, Mycobacterium tuberculosis
AVVGVAHPVV

SEQ ID NO: 618 - protein, 10 aa, Mycobacterium tuberculosis
VVGVAHPVVV

SEQ ID NO: 619 - protein, 10 aa, Mycobacterium tuberculosis
VGVAHPVVVT

SEQ ID NO: 620 - protein, 10 aa, Mycobacterium tuberculosis
GVAHPVVVTF

SEQ ID NO: 621 - protein, 10 aa, Mycobacterium tuberculosis
VAHPVVVTFT

SEQ ID NO: 622 - protein, 10 aa, Mycobacterium tuberculosis
AHPVVVTFTT

SEQ ID NO: 623 - protein, 10 aa, Mycobacterium tuberculosis
HPVVVTFTTP

SEQ ID NO: 624 - protein, 10 aa, Mycobacterium tuberculosis
PVVVTFTTPV

SEQ ID NO: 625 - protein, 10 aa, Mycobacterium tuberculosis
VVVTFTTPVT

SEQ ID NO: 626 - protein, 10 aa, Mycobacterium tuberculosis
VVTFTTPVTD

SEQ ID NO: 627 - protein, 10 aa, Mycobacterium tuberculosis
VTFTTPVTDR

SEQ ID NO: 628 - protein, 10 aa, Mycobacterium tuberculosis
TFTTPVTDRR

SEQ ID NO: 629 - protein, 10 aa, Mycobacterium tuberculosis
FTTPVTDRRA

SEQ ID NO: 630 - protein, 10 aa, Mycobacterium tuberculosis
TTPVTDRRAV

SEQ ID NO: 631 - protein, 10 aa, Mycobacterium tuberculosis
TPVTDRRAVE

SEQ ID NO: 632 - protein, 10 aa, Mycobacterium tuberculosis
PVTDRRAVER

SEQ ID NO: 633 - protein, 10 aa, Mycobacterium tuberculosis
VTDRRAVERS

SEQ ID NO: 634 - protein, 10 aa, Mycobacterium tuberculosis
TDRRAVERSI

SEQ ID NO: 635 - protein, 10 aa, Mycobacterium tuberculosis
DRRAVERSIR

SEQ ID NO: 636 - protein, 10 aa, Mycobacterium tuberculosis
RRAVERSIRI

SEQ ID NO: 637 - protein, 10 aa, Mycobacterium tuberculosis
RAVERSIRIS

SEQ ID NO: 638 - protein, 10 aa, Mycobacterium tuberculosis
AVERSIRIST

SEQ ID NO: 639 - protein, 10 aa, Mycobacterium tuberculosis
VERSIRISTP

SEQ ID NO: 640 - protein, 10 aa, Mycobacterium tuberculosis
ERSIRISTPH

SEQ ID NO: 641 - protein, 10 aa, Mycobacterium tuberculosis
RSIRISTPHN

SEQ ID NO: 642 - protein, 10 aa, Mycobacterium tuberculosis
SIRISTPHNT

SEQ ID NO: 643 - protein, 10 aa, Mycobacterium tuberculosis
IRISTPHNTT

SEQ ID NO: 644 - protein, 10 aa, Mycobacterium tuberculosis
RISTPHNTTG

SEQ ID NO: 645 - protein, 10 aa, Mycobacterium tuberculosis
ISTPHNTTGH

SEQ ID NO: 646 - protein, 10 aa, Mycobacterium tuberculosis
STPHNTTGHF

SEQ ID NO: 647 - protein, 10 aa, Mycobacterium tuberculosis
TPHNTTGHFE

SEQ ID NO: 648 - protein, 10 aa, Mycobacterium tuberculosis
PHNTTGHFEW

SEQ ID NO: 649 - protein, 10 aa, Mycobacterium tuberculosis
HNTTGHFEWV

SEQ ID NO: 650 - protein, 10 aa, Mycobacterium tuberculosis
NTTGHFEWVA

SEQ ID NO: 651 - protein, 10 aa, Mycobacterium tuberculosis
TTGHFEWVAS

SEQ ID NO: 652 - protein, 10 aa, Mycobacterium tuberculosis
TGHFEWVASN

SEQ ID NO: 653 - protein, 10 aa, Mycobacterium tuberculosis
GHFEWVASNV

SEQ ID NO: 654 - protein, 10 aa, Mycobacterium tuberculosis
HFEWVASNVV

SEQ ID NO: 655 - protein, 10 aa, Mycobacterium tuberculosis
FEWVASNVVR

SEQ ID NO: 656 - protein, 10 aa, Mycobacterium tuberculosis
EWVASNVVRW

SEQ ID NO: 657 - protein, 10 aa, Mycobacterium tuberculosis
WVASNVVRWV

SEQ ID NO: 658 - protein, 10 aa, Mycobacterium tuberculosis
VASNVVRWVP

SEQ ID NO: 659 - protein, 10 aa, Mycobacterium tuberculosis
ASNVVRWVPH

SEQ ID NO: 660 - protein, 10 aa, Mycobacterium tuberculosis
SNVVRWVPHR

SEQ ID NO: 661 - protein, 10 aa, Mycobacterium tuberculosis
NVVRWVPHRY

SEQ ID NO: 662 - protein, 10 aa, Mycobacterium tuberculosis
VVRWVPHRYW

SEQ ID NO: 663 - protein, 10 aa, Mycobacterium tuberculosis
VRWVPHRYWP

SEQ ID NO: 664 - protein, 10 aa, Mycobacterium tuberculosis
RWVPHRYWPP

SEQ ID NO: 665 - protein, 10 aa, Mycobacterium tuberculosis
WVPHRYWPPH

SEQ ID NO: 666 - protein, 10 aa, Mycobacterium tuberculosis
VPHRYWPPHT

SEQ ID NO: 667 - protein, 10 aa, Mycobacterium tuberculosis
PHRYWPPHTR

SEQ ID NO: 668 - protein, 10 aa, Mycobacterium tuberculosis
HRYWPPHTRV

SEQ ID NO: 669 - protein, 10 aa, Mycobacterium tuberculosis
RYWPPHTRVS

SEQ ID NO: 670 - protein, 10 aa, Mycobacterium tuberculosis
YWPPHTRVSV

SEQ ID NO: 671 - protein, 10 aa, Mycobacterium tuberculosis
WPPHTRVSVG

SEQ ID NO: 672 - protein, 10 aa, Mycobacterium tuberculosis
PPHTRVSVGV

SEQ ID NO: 673 - protein, 10 aa, Mycobacterium tuberculosis
PHTRVSVGVQ

SEQ ID NO: 674 - protein, 10 aa, Mycobacterium tuberculosis
HTRVSVGVQE

SEQ ID NO: 675 - protein, 10 aa, Mycobacterium tuberculosis
TRVSVGVQEL

SEQ ID NO: 676 - protein, 10 aa, Mycobacterium tuberculosis
RVSVGVQELT

SEQ ID NO: 677 - protein, 10 aa, Mycobacterium tuberculosis
VSVGVQELTE

SEQ ID NO: 678 - protein, 10 aa, Mycobacterium tuberculosis
SVGVQELTEG

SEQ ID NO: 679 - protein, 10 aa, Mycobacterium tuberculosis
VGVQELTEGF

SEQ ID NO: 680 - protein, 10 aa, Mycobacterium tuberculosis
GVQELTEGFE

SEQ ID NO: 681 - protein, 10 aa, Mycobacterium tuberculosis
VQELTEGFET

SEQ ID NO: 682 - protein, 10 aa, Mycobacterium tuberculosis
QELTEGFETG

SEQ ID NO: 683 - protein, 10 aa, Mycobacterium tuberculosis
ELTEGFETGD

SEQ ID NO: 684 - protein, 10 aa, Mycobacterium tuberculosis
LTEGFETGDA

SEQ ID NO: 685 - protein, 10 aa, Mycobacterium tuberculosis
TEGFETGDAL

SEQ ID NO: 686 - protein, 10 aa, Mycobacterium tuberculosis
EGFETGDALI

SEQ ID NO: 687 - protein, 10 aa, Mycobacterium tuberculosis
GFETGDALIG

SEQ ID NO: 688 - protein, 10 aa, Mycobacterium tuberculosis
FETGDALIGV

SEQ ID NO: 689 - protein, 10 aa, Mycobacterium tuberculosis
ETGDALIGVA

SEQ ID NO: 690 - protein, 10 aa, Mycobacterium tuberculosis
TGDALIGVAS

SEQ ID NO: 691 - protein, 10 aa, Mycobacterium tuberculosis
GDALIGVASI

SEQ ID NO: 692 - protein, 10 aa, Mycobacterium tuberculosis
DALIGVASIS

SEQ ID NO: 693 - protein, 10 aa, Mycobacterium tuberculosis
ALIGVASISA

SEQ ID NO: 694 - protein, 10 aa, Mycobacterium tuberculosis
LIGVASISAH

SEQ ID NO: 695 - protein, 10 aa, Mycobacterium tuberculosis
IGVASISAHT

SEQ ID NO: 696 - protein, 10 aa, Mycobacterium tuberculosis
GVASISAHTF

SEQ ID NO: 697 - protein, 10 aa, Mycobacterium tuberculosis
VASISAHTFT

SEQ ID NO: 698 - protein, 10 aa, Mycobacterium tuberculosis
ASISAHTFTV

SEQ ID NO: 699 - protein, 10 aa, Mycobacterium tuberculosis
SISAHTFTVS

SEQ ID NO: 700 - protein, 10 aa, Mycobacterium tuberculosis
ISAHTFTVSR

SEQ ID NO: 701 - protein, 10 aa, Mycobacterium tuberculosis
SAHTFTVSRN

SEQ ID NO: 702 - protein, 10 aa, Mycobacterium tuberculosis
AHTFTVSRNG

SEQ ID NO: 703 - protein, 10 aa, Mycobacterium tuberculosis
HTFTVSRNGE

SEQ ID NO: 704 - protein, 10 aa, Mycobacterium tuberculosis
TFTVSRNGEV

SEQ ID NO: 705 - protein, 10 aa, Mycobacterium tuberculosis
FTVSRNGEVL

SEQ ID NO: 706 - protein, 10 aa, Mycobacterium tuberculosis
TVSRNGEVLR

SEQ ID NO: 707 - protein, 10 aa, Mycobacterium tuberculosis
VSRNGEVLRT

SEQ ID NO: 708 - protein, 10 aa, Mycobacterium tuberculosis
SRNGEVLRTM

SEQ ID NO: 709 - protein, 10 aa, Mycobacterium tuberculosis
RNGEVLRTMP

SEQ ID NO: 710 - protein, 10 aa, Mycobacterium tuberculosis
NGEVLRTMPA

SEQ ID NO: 711 - protein, 10 aa, Mycobacterium tuberculosis
GEVLRTMPAS

SEQ ID NO: 712 - protein, 10 aa, Mycobacterium tuberculosis
EVLRTMPASL

SEQ ID NO: 713 - protein, 10 aa, Mycobacterium tuberculosis
VLRTMPASLG

SEQ ID NO: 714 - protein, 10 aa, Mycobacterium tuberculosis
LRTMPASLGK

SEQ ID NO: 715 - protein, 10 aa, Mycobacterium tuberculosis
RTMPASLGKP

SEQ ID NO: 716 - protein, 10 aa, Mycobacterium tuberculosis
TMPASLGKPS

SEQ ID NO: 717 - protein, 10 aa, Mycobacterium tuberculosis
MPASLGKPSR

SEQ ID NO: 718 - protein, 10 aa, Mycobacterium tuberculosis
PASLGKPSRP

SEQ ID NO: 719 - protein, 10 aa, Mycobacterium tuberculosis
ASLGKPSRPT

SEQ ID NO: 720 - protein, 10 aa, Mycobacterium tuberculosis
SLGKPSRPTP

SEQ ID NO: 721 - protein, 10 aa, Mycobacterium tuberculosis
LGKPSRPTPI

SEQ ID NO: 722 - protein, 10 aa, Mycobacterium tuberculosis
GKPSRPTPIG

SEQ ID NO: 723 - protein, 10 aa, Mycobacterium tuberculosis
KPSRPTPIGS

SEQ ID NO: 724 - protein, 10 aa, Mycobacterium tuberculosis
PSRPTPIGSF

SEQ ID NO: 725 - protein, 10 aa, Mycobacterium tuberculosis
SRPTPIGSFH

SEQ ID NO: 726 - protein, 10 aa, Mycobacterium tuberculosis
RPTPIGSFHA

SEQ ID NO: 727 - protein, 10 aa, Mycobacterium tuberculosis
PTPIGSFHAM

SEQ ID NO: 728 - protein, 10 aa, Mycobacterium tuberculosis
TPIGSFHAMS

SEQ ID NO: 729 - protein, 10 aa, Mycobacterium tuberculosis
PIGSFHAMSK

SEQ ID NO: 730 - protein, 10 aa, Mycobacterium tuberculosis
IGSFHAMSKE

SEQ ID NO: 731 - protein, 10 aa, Mycobacterium tuberculosis
GSFHAMSKER

SEQ ID NO: 732 - protein, 10 aa, Mycobacterium tuberculosis
SFHAMSKERT

SEQ ID NO: 733 - protein, 10 aa, Mycobacterium tuberculosis
FHAMSKERTV

SEQ ID NO: 734 - protein, 10 aa, Mycobacterium tuberculosis
HAMSKERTVV

SEQ ID NO: 735 - protein, 10 aa, Mycobacterium tuberculosis
AMSKERTVVM

SEQ ID NO: 736 - protein, 10 aa, Mycobacterium tuberculosis
MSKERTVVMD

SEQ ID NO: 737 - protein, 10 aa, Mycobacterium tuberculosis
SKERTVVMDS

SEQ ID NO: 738 - protein, 10 aa, Mycobacterium tuberculosis
KERTVVMDSR

SEQ ID NO: 739 - protein, 10 aa, Mycobacterium tuberculosis
ERTVVMDSRT

SEQ ID NO: 740 - protein, 10 aa, Mycobacterium tuberculosis
RTVVMDSRTI

SEQ ID NO: 741 - protein, 10 aa, Mycobacterium tuberculosis
TVVMDSRTIG

SEQ ID NO: 742 - protein, 10 aa, Mycobacterium tuberculosis
VVMDSRTIGI

SEQ ID NO: 743 - protein, 10 aa, Mycobacterium tuberculosis
VMDSRTIGIP

SEQ ID NO: 744 - protein, 10 aa, Mycobacterium tuberculosis
MDSRTIGIPL

SEQ ID NO: 745 - protein, 10 aa, Mycobacterium tuberculosis
DSRTIGIPLN

SEQ ID NO: 746 - protein, 10 aa, Mycobacterium tuberculosis
SRTIGIPLNS

SEQ ID NO: 747 - protein, 10 aa, Mycobacterium tuberculosis
RTIGIPLNSS

SEQ ID NO: 748 - protein, 10 aa, Mycobacterium tuberculosis
TIGIPLNSSD

SEQ ID NO: 749 - protein, 10 aa, Mycobacterium tuberculosis
IGIPLNSSDG

SEQ ID NO: 750 - protein, 10 aa, Mycobacterium tuberculosis
GIPLNSSDGY

SEQ ID NO: 751 - protein, 10 aa, Mycobacterium tuberculosis
IPLNSSDGYL

SEQ ID NO: 752 - protein, 10 aa, Mycobacterium tuberculosis
PLNSSDGYLL

SEQ ID NO: 753 - protein, 10 aa, Mycobacterium tuberculosis
LNSSDGYLLT

SEQ ID NO: 754 - protein, 10 aa, Mycobacterium tuberculosis
NSSDGYLLTA

SEQ ID NO: 755 - protein, 10 aa, Mycobacterium tuberculosis
SSDGYLLTAH

SEQ ID NO: 756 - protein, 10 aa, Mycobacterium tuberculosis
SDGYLLTAHY

SEQ ID NO: 757 - protein, 10 aa, Mycobacterium tuberculosis
DGYLLTAHYA

SEQ ID NO: 758 - protein, 10 aa, Mycobacterium tuberculosis
GYLLTAHYAV

SEQ ID NO: 759 - protein, 10 aa, Mycobacterium tuberculosis
YLLTAHYAVR

SEQ ID NO: 760 - protein, 10 aa, Mycobacterium tuberculosis
LLTAHYAVRV

SEQ ID NO: 761 - protein, 10 aa, Mycobacterium tuberculosis
LTAHYAVRVT

SEQ ID NO: 762 - protein, 10 aa, Mycobacterium tuberculosis
TAHYAVRVTW

SEQ ID NO: 763 - protein, 10 aa, Mycobacterium tuberculosis
AHYAVRVTWS

SEQ ID NO: 764 - protein, 10 aa, Mycobacterium tuberculosis
HYAVRVTWSG

SEQ ID NO: 765 - protein, 10 aa, Mycobacterium tuberculosis
YAVRVTWSGV

SEQ ID NO: 766 - protein, 10 aa, Mycobacterium tuberculosis
AVRVTWSGVY

SEQ ID NO: 767 - protein, 10 aa, Mycobacterium tuberculosis
VRVTWSGVYV

SEQ ID NO: 768 - protein, 10 aa, Mycobacterium tuberculosis
RVTWSGVYVH

SEQ ID NO: 769 - protein, 10 aa, Mycobacterium tuberculosis
VTWSGVYVHS

SEQ ID NO: 770 - protein, 10 aa, Mycobacterium tuberculosis
TWSGVYVHSA

SEQ ID NO: 771 - protein, 10 aa, Mycobacterium tuberculosis
WSGVYVHSAP

SEQ ID NO: 772 - protein, 10 aa, Mycobacterium tuberculosis
SGVYVHSAPW

SEQ ID NO: 773 - protein, 10 aa, Mycobacterium tuberculosis
GVYVHSAPWS

SEQ ID NO: 774 - protein, 10 aa, Mycobacterium tuberculosis
VYVHSAPWSV

SEQ ID NO: 775 - protein, 10 aa, Mycobacterium tuberculosis
YVHSAPWSVN

SEQ ID NO: 776 - protein, 10 aa, Mycobacterium tuberculosis
VHSAPWSVNS

SEQ ID NO: 777 - protein, 10 aa, Mycobacterium tuberculosis
HSAPWSVNSQ

SEQ ID NO: 778 - protein, 10 aa, Mycobacterium tuberculosis
SAPWSVNSQG

SEQ ID NO: 779 - protein, 10 aa, Mycobacterium tuberculosis
APWSVNSQGY

SEQ ID NO: 780 - protein, 10 aa, Mycobacterium tuberculosis
PWSVNSQGYA

SEQ ID NO: 781 - protein, 10 aa, Mycobacterium tuberculosis
WSVNSQGYAN

SEQ ID NO: 782 - protein, 10 aa, Mycobacterium tuberculosis
SVNSQGYANV

SEQ ID NO: 783 - protein, 10 aa, Mycobacterium tuberculosis
VNSQGYANVS

SEQ ID NO: 784 - protein, 10 aa, Mycobacterium tuberculosis
NSQGYANVSH

SEQ ID NO: 785 - protein, 10 aa, Mycobacterium tuberculosis
SQGYANVSHG

SEQ ID NO: 786 - protein, 10 aa, Mycobacterium tuberculosis
QGYANVSHGC

SEQ ID NO: 787 - protein, 10 aa, Mycobacterium tuberculosis
GYANVSHGCI

SEQ ID NO: 788 - protein, 10 aa, Mycobacterium tuberculosis
YANVSHGCIN

SEQ ID NO: 789 - protein, 10 aa, Mycobacterium tuberculosis
ANVSHGCINL

SEQ ID NO: 790 - protein, 10 aa, Mycobacterium tuberculosis
NVSHGCINLS

SEQ ID NO: 791 - protein, 10 aa, Mycobacterium tuberculosis
VSHGCINLSP

SEQ ID NO: 792 - protein, 10 aa, Mycobacterium tuberculosis
SHGCINLSPD

SEQ ID NO: 793 - protein, 10 aa, Mycobacterium tuberculosis
HGCINLSPDN

SEQ ID NO: 794 - protein, 10 aa, Mycobacterium tuberculosis
GCINLSPDNA

SEQ ID NO: 795 - protein, 10 aa, Mycobacterium tuberculosis
CINLSPDNAA

SEQ ID NO: 796 - protein, 10 aa, Mycobacterium tuberculosis
INLSPDNAAW

SEQ ID NO: 797 - protein, 10 aa, Mycobacterium tuberculosis
NLSPDNAAWY

SEQ ID NO: 798 - protein, 10 aa, Mycobacterium tuberculosis
LSPDNAAWYF

SEQ ID NO: 799 - protein, 10 aa, Mycobacterium tuberculosis
SPDNAAWYFD

SEQ ID NO: 800 - protein, 10 aa, Mycobacterium tuberculosis
PDNAAWYFDA

SEQ ID NO: 801 - protein, 10 aa, Mycobacterium tuberculosis
DNAAWYFDAV

SEQ ID NO: 802 - protein, 10 aa, Mycobacterium tuberculosis
NAAWYFDAVT

SEQ ID NO: 803 - protein, 10 aa, Mycobacterium tuberculosis
AAWYFDAVTV

SEQ ID NO: 804 - protein, 10 aa, Mycobacterium tuberculosis
AWYFDAVTVG

SEQ ID NO: 805 - protein, 10 aa, Mycobacterium tuberculosis
WYFDAVTVGD

SEQ ID NO: 806 - protein, 10 aa, Mycobacterium tuberculosis
YFDAVTVGDP

SEQ ID NO: 807 - protein, 10 aa, Mycobacterium tuberculosis
FDAVTVGDPI

SEQ ID NO: 808 - protein, 10 aa, Mycobacterium tuberculosis
DAVTVGDPIE

SEQ ID NO: 809 - protein, 10 aa, Mycobacterium tuberculosis
AVTVGDPIEV

SEQ ID NO: 810 - protein, 10 aa, Mycobacterium tuberculosis
VTVGDPIEVV

SEQ ID NO: 811 - protein, 10 aa, Mycobacterium tuberculosis
TVGDPIEVVG

SEQ ID NO: 812 - protein, 11 aa, Mycobacterium tuberculosis
MRRVVRYLSVV

SEQ ID NO: 813 - protein, 11 aa, Mycobacterium tuberculosis
RRVVRYLSVVV

SEQ ID NO: 814 - protein, 11 aa, Mycobacterium tuberculosis
RVVRYLSVVVA

SEQ ID NO: 815 - protein, 11 aa, Mycobacterium tuberculosis
VVRYLSVVVAI

SEQ ID NO: 816 - protein, 11 aa, Mycobacterium tuberculosis
VRYLSVVVAIT

SEQ ID NO: 817 - protein, 11 aa, Mycobacterium tuberculosis
RYLSVVVAITL

SEQ ID NO: 818 - protein, 11 aa, Mycobacterium tuberculosis
YLSVVVAITLM

SEQ ID NO: 819 - protein, 11 aa, Mycobacterium tuberculosis
LSVVVAITLML

SEQ ID NO: 820 - protein, 11 aa, Mycobacterium tuberculosis
SVVVAITLMLT

SEQ ID NO: 821 - protein, 11 aa, Mycobacterium tuberculosis
VVVAITLMLTA

SEQ ID NO: 822 - protein, 11 aa, Mycobacterium tuberculosis
VVAITLMLTAE

SEQ ID NO: 823 - protein, 11 aa, Mycobacterium tuberculosis
VAITLMLTAES

SEQ ID NO: 824 - protein, 11 aa, Mycobacterium tuberculosis
AITLMLTAESV

SEQ ID NO: 825 - protein, 11 aa, Mycobacterium tuberculosis
ITLMLTAESVS

SEQ ID NO: 826 - protein, 11 aa, Mycobacterium tuberculosis
TLMLTAESVSI

SEQ ID NO: 827 - protein, 11 aa, Mycobacterium tuberculosis
LMLTAESVSIA

SEQ ID NO: 828 - protein, 11 aa, Mycobacterium tuberculosis
MLTAESVSIAT

SEQ ID NO: 829 - protein, 11 aa, Mycobacterium tuberculosis
LTAESVSIATA

SEQ ID NO: 830 - protein, 11 aa, Mycobacterium tuberculosis
TAESVSIATAA

SEQ ID NO: 831 - protein, 11 aa, Mycobacterium tuberculosis
AESVSIATAAV

SEQ ID NO: 832 - protein, 11 aa, Mycobacterium tuberculosis
ESVSIATAAVP

SEQ ID NO: 833 - protein, 11 aa, Mycobacterium tuberculosis
SVSIATAAVPP

SEQ ID NO: 834 - protein, 11 aa, Mycobacterium tuberculosis
VSIATAAVPPL

SEQ ID NO: 835 - protein, 11 aa, Mycobacterium tuberculosis
SIATAAVPPLQ

SEQ ID NO: 836 - protein, 11 aa, Mycobacterium tuberculosis
IATAAVPPLQP

SEQ ID NO: 837 - protein, 11 aa, Mycobacterium tuberculosis
ATAAVPPLQPI

SEQ ID NO: 838 - protein, 11 aa, Mycobacterium tuberculosis
TAAVPPLQPIP

SEQ ID NO: 839 - protein, 11 aa, Mycobacterium tuberculosis
AAVPPLQPIPG

SEQ ID NO: 840 - protein, 11 aa, Mycobacterium tuberculosis
AVPPLQPIPGV

SEQ ID NO: 841 - protein, 11 aa, Mycobacterium tuberculosis
VPPLQPIPGVA

SEQ ID NO: 842 - protein, 11 aa, Mycobacterium tuberculosis
PPLQPIPGVAS

SEQ ID NO: 843 - protein, 11 aa, Mycobacterium tuberculosis
PLQPIPGVASV

SEQ ID NO: 844 - protein, 11 aa, Mycobacterium tuberculosis
LQPIPGVASVS

SEQ ID NO: 845 - protein, 11 aa, Mycobacterium tuberculosis
QPIPGVASVSP

SEQ ID NO: 846 - protein, 11 aa, Mycobacterium tuberculosis
PIPGVASVSPA

SEQ ID NO: 847 - protein, 11 aa, Mycobacterium tuberculosis
IPGVASVSPAN

SEQ ID NO: 848 - protein, 11 aa, Mycobacterium tuberculosis
PGVASVSPANG

SEQ ID NO: 849 - protein, 11 aa, Mycobacterium tuberculosis
GVASVSPANGA

SEQ ID NO: 850 - protein, 11 aa, Mycobacterium tuberculosis
VASVSPANGAV

SEQ ID NO: 851 - protein, 11 aa, Mycobacterium tuberculosis
ASVSPANGAVV

SEQ ID NO: 852 - protein, 11 aa, Mycobacterium tuberculosis
SVSPANGAVVG

SEQ ID NO: 853 - protein, 11 aa, Mycobacterium tuberculosis
VSPANGAVVGV

SEQ ID NO: 854 - protein, 11 aa, Mycobacterium tuberculosis
SPANGAVVGVA

SEQ ID NO: 855 - protein, 11 aa, Mycobacterium tuberculosis
PANGAVVGVAH

SEQ ID NO: 856 - protein, 11 aa, Mycobacterium tuberculosis
ANGAVVGVAHP

SEQ ID NO: 857 - protein, 11 aa, Mycobacterium tuberculosis
NGAVVGVAHPV

SEQ ID NO: 858 - protein, 11 aa, Mycobacterium tuberculosis
GAVVGVAHPVV

SEQ ID NO: 859 - protein, 11 aa, Mycobacterium tuberculosis
AVVGVAHPVVV

SEQ ID NO: 860 - protein, 11 aa, Mycobacterium tuberculosis
VVGVAHPVVVT

SEQ ID NO: 861 - protein, 11 aa, Mycobacterium tuberculosis
VGVAHPVVVTF

SEQ ID NO: 862 - protein, 11 aa, Mycobacterium tuberculosis
GVAHPVVVTFT

SEQ ID NO: 863 - protein, 11 aa, Mycobacterium tuberculosis
VAHPVVVTFTT

SEQ ID NO: 864 - protein, 11 aa, Mycobacterium tuberculosis
AHPVVVTFTTP

SEQ ID NO: 865 - protein, 11 aa, Mycobacterium tuberculosis
HPVVVTFTTPV

SEQ ID NO: 866 - protein, 11 aa, Mycobacterium tuberculosis
PVVVTFTTPVT

SEQ ID NO: 867 - protein, 11 aa, Mycobacterium tuberculosis
VVVTFTTPVTD

SEQ ID NO: 868 - protein, 11 aa, Mycobacterium tuberculosis
VVTFTTPVTDR

SEQ ID NO: 869 - protein, 11 aa, Mycobacterium tuberculosis
VTFTTPVTDRR

SEQ ID NO: 870 - protein, 11 aa, Mycobacterium tuberculosis
TFTTPVTDRRA

SEQ ID NO: 871 - protein, 11 aa, Mycobacterium tuberculosis
FTTPVTDRRAV

SEQ ID NO: 872 - protein, 11 aa, Mycobacterium tuberculosis
TTPVTDRRAVE

SEQ ID NO: 873 - protein, 11 aa, Mycobacterium tuberculosis
TPVTDRRAVER

SEQ ID NO: 874 - protein, 11 aa, Mycobacterium tuberculosis
PVTDRRAVERS

SEQ ID NO: 875 - protein, 11 aa, Mycobacterium tuberculosis
VTDRRAVERSI

SEQ ID NO: 876 - protein, 11 aa, Mycobacterium tuberculosis
TDRRAVERSIR

SEQ ID NO: 877 - protein, 11 aa, Mycobacterium tuberculosis
DRRAVERSIRI

SEQ ID NO: 878 - protein, 11 aa, Mycobacterium tuberculosis
RRAVERSIRIS

SEQ ID NO: 879 - protein, 11 aa, Mycobacterium tuberculosis
RAVERSIRIST

SEQ ID NO: 880 - protein, 11 aa, Mycobacterium tuberculosis
AVERSIRISTP

SEQ ID NO: 881 - protein, 11 aa, Mycobacterium tuberculosis
VERSIRISTPH

SEQ ID NO: 882 - protein, 11 aa, Mycobacterium tuberculosis
ERSIRISTPHN

SEQ ID NO: 883 - protein, 11 aa, Mycobacterium tuberculosis
RSIRISTPHNT

SEQ ID NO: 884 - protein, 11 aa, Mycobacterium tuberculosis
SIRISTPHNTT

SEQ ID NO: 885 - protein, 11 aa, Mycobacterium tuberculosis
IRISTPHNTTG

SEQ ID NO: 886 - protein, 11 aa, Mycobacterium tuberculosis
RISTPHNTTGH

SEQ ID NO: 887 - protein, 11 aa, Mycobacterium tuberculosis
ISTPHNTTGHF

SEQ ID NO: 888 - protein, 11 aa, Mycobacterium tuberculosis
STPHNTTGHFE

SEQ ID NO: 889 - protein, 11 aa, Mycobacterium tuberculosis
TPHNTTGHFEW

SEQ ID NO: 890 - protein, 11 aa, Mycobacterium tuberculosis
PHNTTGHFEWV

SEQ ID NO: 891 - protein, 11 aa, Mycobacterium tuberculosis
HNTTGHFEWVA

SEQ ID NO: 892 - protein, 11 aa, Mycobacterium tuberculosis
NTTGHFEWVAS

SEQ ID NO: 893 - protein, 11 aa, Mycobacterium tuberculosis
TTGHFEWVASN

SEQ ID NO: 894 - protein, 11 aa, Mycobacterium tuberculosis
TGHFEWVASNV

SEQ ID NO: 895 - protein, 11 aa, Mycobacterium tuberculosis
GHFEWVASNVV

SEQ ID NO: 896 - protein, 11 aa, Mycobacterium tuberculosis
HFEWVASNVVR

SEQ ID NO: 897 - protein, 11 aa, Mycobacterium tuberculosis
FEWVASNVVRW

SEQ ID NO: 898 - protein, 11 aa, Mycobacterium tuberculosis
EWVASNVVRWV

SEQ ID NO: 899 - protein, 11 aa, Mycobacterium tuberculosis
WVASNVVRWVP

SEQ ID NO: 900 - protein, 11 aa, Mycobacterium tuberculosis
VASNVVRWVPH

SEQ ID NO: 901 - protein, 11 aa, Mycobacterium tuberculosis
ASNVVRWVPHR

SEQ ID NO: 902 - protein, 11 aa, Mycobacterium tuberculosis
SNVVRWVPHRY

SEQ ID NO: 903 - protein, 11 aa, Mycobacterium tuberculosis
NVVRWVPHRYW

SEQ ID NO: 904 - protein, 11 aa, Mycobacterium tuberculosis
VVRWVPHRYWP

SEQ ID NO: 905 - protein, 11 aa, Mycobacterium tuberculosis
VRWVPHRYWPP

SEQ ID NO: 906 - protein, 11 aa, Mycobacterium tuberculosis
RWVPHRYWPPH

SEQ ID NO: 907 - protein, 11 aa, Mycobacterium tuberculosis
WVPHRYWPPHT

SEQ ID NO: 908 - protein, 11 aa, Mycobacterium tuberculosis
VPHRYWPPHTR

SEQ ID NO: 909 - protein, 11 aa, Mycobacterium tuberculosis
PHRYWPPHTRV

SEQ ID NO: 910 - protein, 11 aa, Mycobacterium tuberculosis
HRYWPPHTRVS

SEQ ID NO: 911 - protein, 11 aa, Mycobacterium tuberculosis
RYWPPHTRVSV

SEQ ID NO: 912 - protein, 11 aa, Mycobacterium tuberculosis
YWPPHTRVSVG

SEQ ID NO: 913 - protein, 11 aa, Mycobacterium tuberculosis
WPPHTRVSVGV

SEQ ID NO: 914 - protein, 11 aa, Mycobacterium tuberculosis
PPHTRVSVGVQ

SEQ ID NO: 915 - protein, 11 aa, Mycobacterium tuberculosis
PHTRVSVGVQE

SEQ ID NO: 916 - protein, 11 aa, Mycobacterium tuberculosis
HTRVSVGVQEL

SEQ ID NO: 917 - protein, 11 aa, Mycobacterium tuberculosis
TRVSVGVQELT

SEQ ID NO: 918 - protein, 11 aa, Mycobacterium tuberculosis
RVSVGVQELTE

SEQ ID NO: 919 - protein, 11 aa, Mycobacterium tuberculosis
VSVGVQELTEG

SEQ ID NO: 920 - protein, 11 aa, Mycobacterium tuberculosis
SVGVQELTEGF

SEQ ID NO: 921 - protein, 11 aa, Mycobacterium tuberculosis
VGVQELTEGFE

SEQ ID NO: 922 - protein, 11 aa, Mycobacterium tuberculosis
GVQELTEGFET

SEQ ID NO: 923 - protein, 11 aa, Mycobacterium tuberculosis
VQELTEGFETG

SEQ ID NO: 924 - protein, 11 aa, Mycobacterium tuberculosis
QELTEGFETGD

SEQ ID NO: 925 - protein, 11 aa, Mycobacterium tuberculosis
ELTEGFETGDA

SEQ ID NO: 926 - protein, 11 aa, Mycobacterium tuberculosis
LTEGFETGDAL

SEQ ID NO: 927 - protein, 11 aa, Mycobacterium tuberculosis
TEGFETGDALI

SEQ ID NO: 928 - protein, 11 aa, Mycobacterium tuberculosis
EGFETGDALIG

SEQ ID NO: 929 - protein, 11 aa, Mycobacterium tuberculosis
GFETGDALIGV

SEQ ID NO: 930 - protein, 11 aa, Mycobacterium tuberculosis
FETGDALIGVA

SEQ ID NO: 931 - protein, 11 aa, Mycobacterium tuberculosis
ETGDALIGVAS

SEQ ID NO: 932 - protein, 11 aa, Mycobacterium tuberculosis
TGDALIGVASI

SEQ ID NO: 933 - protein, 11 aa, Mycobacterium tuberculosis
GDALIGVASIS

SEQ ID NO: 934 - protein, 11 aa, Mycobacterium tuberculosis
DALIGVASISA

SEQ ID NO: 935 - protein, 11 aa, Mycobacterium tuberculosis
ALIGVASISAH

SEQ ID NO: 936 - protein, 11 aa, Mycobacterium tuberculosis
LIGVASISAHT

SEQ ID NO: 937 - protein, 11 aa, Mycobacterium tuberculosis
IGVASISAHTF

SEQ ID NO: 938 - protein, 11 aa, Mycobacterium tuberculosis
GVASISAHTFT

SEQ ID NO: 939 - protein, 11 aa, Mycobacterium tuberculosis
VASISAHTFTV

SEQ ID NO: 940 - protein, 11 aa, Mycobacterium tuberculosis
ASISAHTFTVS

SEQ ID NO: 941 - protein, 11 aa, Mycobacterium tuberculosis
SISAHTFTVSR

SEQ ID NO: 942 - protein, 11 aa, Mycobacterium tuberculosis
ISAHTFTVSRN

SEQ ID NO: 943 - protein, 11 aa, Mycobacterium tuberculosis
SAHTFTVSRNG

SEQ ID NO: 944 - protein, 11 aa, Mycobacterium tuberculosis
AHTFTVSRNGE

SEQ ID NO: 945 - protein, 11 aa, Mycobacterium tuberculosis
HTFTVSRNGEV

SEQ ID NO: 946 - protein, 11 aa, Mycobacterium tuberculosis
TFTVSRNGEVL

SEQ ID NO: 947 - protein, 11 aa, Mycobacterium tuberculosis
FTVSRNGEVLR

SEQ ID NO: 948 - protein, 11 aa, Mycobacterium tuberculosis
TVSRNGEVLRT

SEQ ID NO: 949 - protein, 11 aa, Mycobacterium tuberculosis
VSRNGEVLRTM

SEQ ID NO: 950 - protein, 11 aa, Mycobacterium tuberculosis
SRNGEVLRTMP

SEQ ID NO: 951 - protein, 11 aa, Mycobacterium tuberculosis
RNGEVLRTMPA

SEQ ID NO: 952 - protein, 11 aa, Mycobacterium tuberculosis
NGEVLRTMPAS

SEQ ID NO: 953 - protein, 11 aa, Mycobacterium tuberculosis
GEVLRTMPASL

SEQ ID NO: 954 - protein, 11 aa, Mycobacterium tuberculosis
EVLRTMPASLG

SEQ ID NO: 955 - protein, 11 aa, Mycobacterium tuberculosis
VLRTMPASLGK

SEQ ID NO: 956 - protein, 11 aa, Mycobacterium tuberculosis
LRTMPASLGKP

SEQ ID NO: 957 - protein, 11 aa, Mycobacterium tuberculosis
RTMPASLGKPS

SEQ ID NO: 958 - protein, 11 aa, Mycobacterium tuberculosis
TMPASLGKPSR

SEQ ID NO: 959 - protein, 11 aa, Mycobacterium tuberculosis
MPASLGKPSRP

SEQ ID NO: 960 - protein, 11 aa, Mycobacterium tuberculosis
PASLGKPSRPT

SEQ ID NO: 961 - protein, 11 aa, Mycobacterium tuberculosis
ASLGKPSRPTP

SEQ ID NO: 962 - protein, 11 aa, Mycobacterium tuberculosis
SLGKPSRPTPI

SEQ ID NO: 963 - protein, 11 aa, Mycobacterium tuberculosis
LGKPSRPTPIG

SEQ ID NO: 964 - protein, 11 aa, Mycobacterium tuberculosis
GKPSRPTPIGS

SEQ ID NO: 965 - protein, 11 aa, Mycobacterium tuberculosis
KPSRPTPIGSF

SEQ ID NO: 966 - protein, 11 aa, Mycobacterium tuberculosis
PSRPTPIGSFH

SEQ ID NO: 967 - protein, 11 aa, Mycobacterium tuberculosis
SRPTPIGSFHA

SEQ ID NO: 968 - protein, 11 aa, Mycobacterium tuberculosis
RPTPIGSFHAM

SEQ ID NO: 969 - protein, 11 aa, Mycobacterium tuberculosis
PTPIGSFHAMS

SEQ ID NO: 970 - protein, 11 aa, Mycobacterium tuberculosis
TPIGSFHAMSK

SEQ ID NO: 971 - protein, 11 aa, Mycobacterium tuberculosis
PIGSFHAMSKE

SEQ ID NO: 972 - protein, 11 aa, Mycobacterium tuberculosis
IGSFHAMSKER

SEQ ID NO: 973 - protein, 11 aa, Mycobacterium tuberculosis
GSFHAMSKERT

SEQ ID NO: 974 - protein, 11 aa, Mycobacterium tuberculosis
SFHAMSKERTV

SEQ ID NO: 975 - protein, 11 aa, Mycobacterium tuberculosis
FHAMSKERTVV

SEQ ID NO: 976 - protein, 11 aa, Mycobacterium tuberculosis
HAMSKERTVVM

SEQ ID NO: 977 - protein, 11 aa, Mycobacterium tuberculosis
AMSKERTVVMD

SEQ ID NO: 978 - protein, 11 aa, Mycobacterium tuberculosis
MSKERTVVMDS

SEQ ID NO: 979 - protein, 11 aa, Mycobacterium tuberculosis
SKERTVVMDSR

SEQ ID NO: 980 - protein, 11 aa, Mycobacterium tuberculosis
KERTVVMDSRT

SEQ ID NO: 981 - protein, 11 aa, Mycobacterium tuberculosis
ERTVVMDSRTI

SEQ ID NO: 982 - protein, 11 aa, Mycobacterium tuberculosis
RTVVMDSRTIG

SEQ ID NO: 983 - protein, 11 aa, Mycobacterium tuberculosis
TVVMDSRTIGI

SEQ ID NO: 984 - protein, 11 aa, Mycobacterium tuberculosis
VVMDSRTIGIP

SEQ ID NO: 985 - protein, 11 aa, Mycobacterium tuberculosis
VMDSRTIGIPL

SEQ ID NO: 986 - protein, 11 aa, Mycobacterium tuberculosis
MDSRTIGIPLN

SEQ ID NO: 987 - protein, 11 aa, Mycobacterium tuberculosis
DSRTIGIPLNS

SEQ ID NO: 988 - protein, 11 aa, Mycobacterium tuberculosis
SRTIGIPLNSS

SEQ ID NO: 989 - protein, 11 aa, Mycobacterium tuberculosis
RTIGIPLNSSD

SEQ ID NO: 990 - protein, 11 aa, Mycobacterium tuberculosis
TIGIPLNSSDG

SEQ ID NO: 991 - protein, 11 aa, Mycobacterium tuberculosis
IGIPLNSSDGY

SEQ ID NO: 992 - protein, 11 aa, Mycobacterium tuberculosis
GIPLNSSDGYL

SEQ ID NO: 993 - protein, 11 aa, Mycobacterium tuberculosis
IPLNSSDGYLL

SEQ ID NO: 994 - protein, 11 aa, Mycobacterium tuberculosis
PLNSSDGYLLT

SEQ ID NO: 995 - protein, 11 aa, Mycobacterium tuberculosis
LNSSDGYLLTA

SEQ ID NO: 996 - protein, 11 aa, Mycobacterium tuberculosis
NSSDGYLLTAH

SEQ ID NO: 997 - protein, 11 aa, Mycobacterium tuberculosis
SSDGYLLTAHY

SEQ ID NO: 998 - protein, 11 aa, Mycobacterium tuberculosis
SDGYLLTAHYA

SEQ ID NO: 999 - protein, 11 aa, Mycobacterium tuberculosis
DGYLLTAHYAV

SEQ ID NO: 1000 - protein, 11 aa, Mycobacterium tuberculosis
GYLLTAHYAVR

SEQ ID NO: 1001 - protein, 11 aa, Mycobacterium tuberculosis
YLLTAHYAVRV

SEQ ID NO: 1002 - protein, 11 aa, Mycobacterium tuberculosis
LLTAHYAVRVT

SEQ ID NO: 1003 - protein, 11 aa, Mycobacterium tuberculosis
LTAHYAVRVTW

SEQ ID NO: 1004 - protein, 11 aa, Mycobacterium tuberculosis
TAHYAVRVTWS

SEQ ID NO: 1005 - protein, 11 aa, Mycobacterium tuberculosis
AHYAVRVTWSG

SEQ ID NO: 1006 - protein, 11 aa, Mycobacterium tuberculosis
HYAVRVTWSGV

SEQ ID NO: 1007 - protein, 11 aa, Mycobacterium tuberculosis
YAVRVTWSGVY

SEQ ID NO: 1008 - protein, 11 aa, Mycobacterium tuberculosis
AVRVTWSGVYV

SEQ ID NO: 1009 - protein, 11 aa, Mycobacterium tuberculosis
VRVTWSGVYVH

SEQ ID NO: 1010 - protein, 11 aa, Mycobacterium tuberculosis
RVTWSGVYVHS

SEQ ID NO: 1011 - protein, 11 aa, Mycobacterium tuberculosis
VTWSGVYVHSA

SEQ ID NO: 1012 - protein, 11 aa, Mycobacterium tuberculosis
TWSGVYVHSAP

SEQ ID NO: 1013 - protein, 11 aa, Mycobacterium tuberculosis
WSGVYVHSAPW

SEQ ID NO: 1014 - protein, 11 aa, Mycobacterium tuberculosis
SGVYVHSAPWS

SEQ ID NO: 1015 - protein, 11 aa, Mycobacterium tuberculosis
GVYVHSAPWSV

SEQ ID NO: 1016 - protein, 11 aa, Mycobacterium tuberculosis
VYVHSAPWSVN

SEQ ID NO: 1017 - protein, 11 aa, Mycobacterium tuberculosis
YVHSAPWSVNS

SEQ ID NO: 1018 - protein, 11 aa, Mycobacterium tuberculosis
VHSAPWSVNSQ

SEQ ID NO: 1019 - protein, 11 aa, Mycobacterium tuberculosis
HSAPWSVNSQG

SEQ ID NO: 1020 - protein, 11 aa, Mycobacterium tuberculosis
SAPWSVNSQGY

SEQ ID NO: 1021 - protein, 11 aa, Mycobacterium tuberculosis
APWSVNSQGYA

SEQ ID NO: 1022 - protein, 11 aa, Mycobacterium tuberculosis
PWSVNSQGYAN

SEQ ID NO: 1023 - protein, 11 aa, Mycobacterium tuberculosis
WSVNSQGYANV

SEQ ID NO: 1024 - protein, 11 aa, Mycobacterium tuberculosis
SVNSQGYANVS

SEQ ID NO: 1025 - protein, 11 aa, Mycobacterium tuberculosis
VNSQGYANVSH

SEQ ID NO: 1026 - protein, 11 aa, Mycobacterium tuberculosis
NSQGYANVSHG

SEQ ID NO: 1027 - protein, 11 aa, Mycobacterium tuberculosis
SQGYANVSHGC

SEQ ID NO: 1028 - protein, 11 aa, Mycobacterium tuberculosis
QGYANVSHGCI

SEQ ID NO: 1029 - protein, 11 aa, Mycobacterium tuberculosis
GYANVSHGCIN

SEQ ID NO: 1030 - protein, 11 aa, Mycobacterium tuberculosis
YANVSHGCINL

SEQ ID NO: 1031 - protein, 11 aa, Mycobacterium tuberculosis
ANVSHGCINLS

SEQ ID NO: 1032 - protein, 11 aa, Mycobacterium tuberculosis
NVSHGCINLSP

SEQ ID NO: 1033 - protein, 11 aa, Mycobacterium tuberculosis
VSHGCINLSPD

SEQ ID NO: 1034 - protein, 11 aa, Mycobacterium tuberculosis
SHGCINLSPDN

SEQ ID NO: 1035 - protein, 11 aa, Mycobacterium tuberculosis
HGCINLSPDNA

SEQ ID NO: 1036 - protein, 11 aa, Mycobacterium tuberculosis
GCINLSPDNAA

SEQ ID NO: 1037 - protein, 11 aa, Mycobacterium tuberculosis
CINLSPDNAAW

SEQ ID NO: 1038 - protein, 11 aa, Mycobacterium tuberculosis
INLSPDNAAWY

SEQ ID NO: 1039 - protein, 11 aa, Mycobacterium tuberculosis
NLSPDNAAWYF

SEQ ID NO: 1040 - protein, 11 aa, Mycobacterium tuberculosis
LSPDNAAWYFD

SEQ ID NO: 1041 - protein, 11 aa, Mycobacterium tuberculosis
SPDNAAWYFDA

SEQ ID NO: 1042 - protein, 11 aa, Mycobacterium tuberculosis
PDNAAWYFDAV

SEQ ID NO: 1043 - protein, 11 aa, Mycobacterium tuberculosis
DNAAWYFDAVT

SEQ ID NO: 1044 - protein, 11 aa, Mycobacterium tuberculosis
NAAWYFDAVTV

SEQ ID NO: 1045 - protein, 11 aa, Mycobacterium tuberculosis
AAWYFDAVTVG

SEQ ID NO: 1046 - protein, 11 aa, Mycobacterium tuberculosis
AWYFDAVTVGD

SEQ ID NO: 1047 - protein, 11 aa, Mycobacterium tuberculosis
WYFDAVTVGDP

SEQ ID NO: 1048 - protein, 11 aa, Mycobacterium tuberculosis
YFDAVTVGDPI

SEQ ID NO: 1049 - protein, 11 aa, Mycobacterium tuberculosis
FDAVTVGDPIE

SEQ ID NO: 1050 - protein, 11 aa, Mycobacterium tuberculosis
DAVTVGDPIEV

SEQ ID NO: 1051 - protein, 11 aa, Mycobacterium tuberculosis
AVTVGDPIEVV

SEQ ID NO: 1052 - protein, 11 aa, Mycobacterium tuberculosis
VTVGDPIEVVG

SEQ ID NO: 1053 - protein, 8 aa, Mycobacterium tuberculosis
MAGSVSAA

SEQ ID NO: 1054 - protein, 8 aa, Mycobacterium tuberculosis
AGSVSAAA

SEQ ID NO: 1055 - protein, 8 aa, Mycobacterium tuberculosis
GSVSAAAG

SEQ ID NO: 1056 - protein, 8 aa, Mycobacterium tuberculosis
SVSAAAGI

SEQ ID NO: 1057 - protein, 8 aa, Mycobacterium tuberculosis
VSAAAGIG

SEQ ID NO: 1058 - protein, 8 aa, Mycobacterium tuberculosis
SAAAGIGW

SEQ ID NO: 1059 - protein, 8 aa, Mycobacterium tuberculosis
AAAGIGWV

SEQ ID NO: 1060 - protein, 8 aa, Mycobacterium tuberculosis
AAGIGWVG

SEQ ID NO: 1061 - protein, 8 aa, Mycobacterium tuberculosis
AGIGWVGL

SEQ ID NO: 1062 - protein, 8 aa, Mycobacterium tuberculosis
GIGWVGLN

SEQ ID NO: 1063 - protein, 8 aa, Mycobacterium tuberculosis
IGWVGLNV

SEQ ID NO: 1064 - protein, 8 aa, Mycobacterium tuberculosis
GWVGLNVT

SEQ ID NO: 1065 - protein, 8 aa, Mycobacterium tuberculosis
WVGLNVTE

SEQ ID NO: 1066 - protein, 8 aa, Mycobacterium tuberculosis
VGLNVTET

SEQ ID NO: 1067 - protein, 8 aa, Mycobacterium tuberculosis
GLNVTETN

SEQ ID NO: 1068 - protein, 8 aa, Mycobacterium tuberculosis
LNVTETNR

SEQ ID NO: 1069 - protein, 8 aa, Mycobacterium tuberculosis
NVTETNRD

SEQ ID NO: 1070 - protein, 8 aa, Mycobacterium tuberculosis
VTETNRDQ

SEQ ID NO: 1071 - protein, 8 aa, Mycobacterium tuberculosis
TETNRDQC

SEQ ID NO: 1072 - protein, 8 aa, Mycobacterium tuberculosis
ETNRDQCY

SEQ ID NO: 1073 - protein, 8 aa, Mycobacterium tuberculosis
TNRDQCYR

SEQ ID NO: 1074 - protein, 8 aa, Mycobacterium tuberculosis
NRDQCYRV

SEQ ID NO: 1075 - protein, 8 aa, Mycobacterium tuberculosis
RDQCYRVE

SEQ ID NO: 1076 - protein, 8 aa, Mycobacterium tuberculosis
DQCYRVER

SEQ ID NO: 1077 - protein, 8 aa, Mycobacterium tuberculosis
QCYRVERT

SEQ ID NO: 1078 - protein, 8 aa, Mycobacterium tuberculosis
CYRVERTT

SEQ ID NO: 1079 - protein, 8 aa, Mycobacterium tuberculosis
YRVERTTV

SEQ ID NO: 1080 - protein, 8 aa, Mycobacterium tuberculosis
RVERTTVD

SEQ ID NO: 1081 - protein, 8 aa, Mycobacterium tuberculosis
VERTTVDA

SEQ ID NO: 1082 - protein, 8 aa, Mycobacterium tuberculosis
ERTTVDAL

SEQ ID NO: 1083 - protein, 8 aa, Mycobacterium tuberculosis
RTTVDALT

SEQ ID NO: 1084 - protein, 8 aa, Mycobacterium tuberculosis
TTVDALTH

SEQ ID NO: 1085 - protein, 8 aa, Mycobacterium tuberculosis
TVDALTHP

SEQ ID NO: 1086 - protein, 8 aa, Mycobacterium tuberculosis
VDALTHPE

SEQ ID NO: 1087 - protein, 8 aa, Mycobacterium tuberculosis
DALTHPEY

SEQ ID NO: 1088 - protein, 8 aa, Mycobacterium tuberculosis
ALTHPEYR

SEQ ID NO: 1089 - protein, 8 aa, Mycobacterium tuberculosis
LTHPEYRV

SEQ ID NO: 1090 - protein, 8 aa, Mycobacterium tuberculosis
THPEYRVH

SEQ ID NO: 1091 - protein, 8 aa, Mycobacterium tuberculosis
HPEYRVHT

SEQ ID NO: 1092 - protein, 8 aa, Mycobacterium tuberculosis
PEYRVHTR

SEQ ID NO: 1093 - protein, 8 aa, Mycobacterium tuberculosis
EYRVHTRG

SEQ ID NO: 1094 - protein, 8 aa, Mycobacterium tuberculosis
YRVHTRGV

SEQ ID NO: 1095 - protein, 8 aa, Mycobacterium tuberculosis
RVHTRGVQ

SEQ ID NO: 1096 - protein, 8 aa, Mycobacterium tuberculosis
VHTRGVQR

SEQ ID NO: 1097 - protein, 8 aa, Mycobacterium tuberculosis
HTRGVQRV

SEQ ID NO: 1098 - protein, 8 aa, Mycobacterium tuberculosis
TRGVQRVR

SEQ ID NO: 1099 - protein, 8 aa, Mycobacterium tuberculosis
RGVQRVRV

SEQ ID NO: 1100 - protein, 8 aa, Mycobacterium tuberculosis
GVQRVRVT

SEQ ID NO: 1101 - protein, 8 aa, Mycobacterium tuberculosis
VQRVRVTR

SEQ ID NO: 1102 - protein, 8 aa, Mycobacterium tuberculosis
QRVRVTRN

SEQ ID NO: 1103 - protein, 8 aa, Mycobacterium tuberculosis
RVRVTRNA

SEQ ID NO: 1104 - protein, 8 aa, Mycobacterium tuberculosis
VRVTRNAR

SEQ ID NO: 1105 - protein, 8 aa, Mycobacterium tuberculosis
RVTRNARK

SEQ ID NO: 1106 - protein, 8 aa, Mycobacterium tuberculosis
VTRNARKH

SEQ ID NO: 1107 - protein, 8 aa, Mycobacterium tuberculosis
TRNARKHR

SEQ ID NO: 1108 - protein, 8 aa, Mycobacterium tuberculosis
RNARKHRV

SEQ ID NO: 1109 - protein, 8 aa, Mycobacterium tuberculosis
NARKHRVS

SEQ ID NO: 1110 - protein, 8 aa, Mycobacterium tuberculosis
ARKHRVSK

SEQ ID NO: 1111 - protein, 8 aa, Mycobacterium tuberculosis
RKHRVSKH

SEQ ID NO: 1112 - protein, 8 aa, Mycobacterium tuberculosis
KHRVSKHR

SEQ ID NO: 1113 - protein, 8 aa, Mycobacterium tuberculosis
HRVSKHRI

SEQ ID NO: 1114 - protein, 8 aa, Mycobacterium tuberculosis
RVSKHRIV

SEQ ID NO: 1115 - protein, 8 aa, Mycobacterium tuberculosis
VSKHRIVA

SEQ ID NO: 1116 - protein, 8 aa, Mycobacterium tuberculosis
SKHRIVAA

SEQ ID NO: 1117 - protein, 8 aa, Mycobacterium tuberculosis
KHRIVAAM

SEQ ID NO: 1118 - protein, 8 aa, Mycobacterium tuberculosis
HRIVAAMR

SEQ ID NO: 1119 - protein, 8 aa, Mycobacterium tuberculosis
RIVAAMRH

SEQ ID NO: 1120 - protein, 8 aa, Mycobacterium tuberculosis
IVAAMRHC

SEQ ID NO: 1121 - protein, 8 aa, Mycobacterium tuberculosis
VAAMRHCG

SEQ ID NO: 1122 - protein, 8 aa, Mycobacterium tuberculosis
AAMRHCGV

SEQ ID NO: 1123 - protein, 8 aa, Mycobacterium tuberculosis
AMRHCGVP

SEQ ID NO: 1124 - protein, 8 aa, Mycobacterium tuberculosis
MRHCGVPV

SEQ ID NO: 1125 - protein, 8 aa, Mycobacterium tuberculosis
RHCGVPVI

SEQ ID NO: 1126 - protein, 8 aa, Mycobacterium tuberculosis
HCGVPVIQ

SEQ ID NO: 1127 - protein, 8 aa, Mycobacterium tuberculosis
CGVPVIQE

SEQ ID NO: 1128 - protein, 8 aa, Mycobacterium tuberculosis
GVPVIQED

SEQ ID NO: 1129 - protein, 8 aa, Mycobacterium tuberculosis
VPVIQEDG

SEQ ID NO: 1130 - protein, 8 aa, Mycobacterium tuberculosis
PVIQEDGS

SEQ ID NO: 1131 - protein, 8 aa, Mycobacterium tuberculosis
VIQEDGSL

SEQ ID NO: 1132 - protein, 8 aa, Mycobacterium tuberculosis
IQEDGSLY

SEQ ID NO: 1133 - protein, 8 aa, Mycobacterium tuberculosis
QEDGSLYY

SEQ ID NO: 1134 - protein, 8 aa, Mycobacterium tuberculosis
EDGSLYYQ

SEQ ID NO: 1135 - protein, 8 aa, Mycobacterium tuberculosis
DGSLYYQG

SEQ ID NO: 1136 - protein, 8 aa, Mycobacterium tuberculosis
GSLYYQGR

SEQ ID NO: 1137 - protein, 8 aa, Mycobacterium tuberculosis
SLYYQGRD

SEQ ID NO: 1138 - protein, 8 aa, Mycobacterium tuberculosis
LYYQGRDT

SEQ ID NO: 1139 - protein, 8 aa, Mycobacterium tuberculosis
YYQGRDTS

SEQ ID NO: 1140 - protein, 8 aa, Mycobacterium tuberculosis
YQGRDTSG

SEQ ID NO: 1141 - protein, 8 aa, Mycobacterium tuberculosis
QGRDTSGR

SEQ ID NO: 1142 - protein, 8 aa, Mycobacterium tuberculosis
GRDTSGRL

SEQ ID NO: 1143 - protein, 8 aa, Mycobacterium tuberculosis
RDTSGRLT

SEQ ID NO: 1144 - protein, 8 aa, Mycobacterium tuberculosis
DTSGRLTE

SEQ ID NO: 1145 - protein, 8 aa, Mycobacterium tuberculosis
TSGRLTEV

SEQ ID NO: 1146 - protein, 8 aa, Mycobacterium tuberculosis
SGRLTEVV

SEQ ID NO: 1147 - protein, 8 aa, Mycobacterium tuberculosis
GRLTEVVA

SEQ ID NO: 1148 - protein, 8 aa, Mycobacterium tuberculosis
RLTEVVAV

SEQ ID NO: 1149 - protein, 8 aa, Mycobacterium tuberculosis
LTEVVAVE

SEQ ID NO: 1150 - protein, 8 aa, Mycobacterium tuberculosis
TEVVAVEA

SEQ ID NO: 1151 - protein, 8 aa, Mycobacterium tuberculosis
EVVAVEAD

SEQ ID NO: 1152 - protein, 8 aa, Mycobacterium tuberculosis
VVAVEADD

SEQ ID NO: 1153 - protein, 8 aa, Mycobacterium tuberculosis
VAVEADDG

SEQ ID NO: 1154 - protein, 8 aa, Mycobacterium tuberculosis
AVEADDGD

SEQ ID NO: 1155 - protein, 8 aa, Mycobacterium tuberculosis
VEADDGDL

SEQ ID NO: 1156 - protein, 8 aa, Mycobacterium tuberculosis
EADDGDLI

SEQ ID NO: 1157 - protein, 8 aa, Mycobacterium tuberculosis
ADDGDLII

SEQ ID NO: 1158 - protein, 8 aa, Mycobacterium tuberculosis
DDGDLIIT

SEQ ID NO: 1159 - protein, 8 aa, Mycobacterium tuberculosis
DGDLIITH

SEQ ID NO: 1160 - protein, 8 aa, Mycobacterium tuberculosis
GDLIITHA

SEQ ID NO: 1161 - protein, 8 aa, Mycobacterium tuberculosis
DLIITHAM

SEQ ID NO: 1162 - protein, 8 aa, Mycobacterium tuberculosis
LIITHAMP

SEQ ID NO: 1163 - protein, 8 aa, Mycobacterium tuberculosis
IITHAMPK

SEQ ID NO: 1164 - protein, 8 aa, Mycobacterium tuberculosis
ITHAMPKE

SEQ ID NO: 1165 - protein, 8 aa, Mycobacterium tuberculosis
THAMPKEW

SEQ ID NO: 1166 - protein, 8 aa, Mycobacterium tuberculosis
HAMPKEWK

SEQ ID NO: 1167 - protein, 8 aa, Mycobacterium tuberculosis
AMPKEWKR

SEQ ID NO: 1168 - protein, 9 aa, Mycobacterium tuberculosis
MAGSVSAAA

SEQ ID NO: 1169 - protein, 9 aa, Mycobacterium tuberculosis
AGSVSAAAG

SEQ ID NO: 1170 - protein, 9 aa, Mycobacterium tuberculosis
GSVSAAAGI

SEQ ID NO: 1171 - protein, 9 aa, Mycobacterium tuberculosis
SVSAAAGIG

SEQ ID NO: 1172 - protein, 9 aa, Mycobacterium tuberculosis
VSAAAGIGW

SEQ ID NO: 1173 - protein, 9 aa, Mycobacterium tuberculosis
SAAAGIGWV

SEQ ID NO: 1174 - protein, 9 aa, Mycobacterium tuberculosis
AAAGIGWVG

SEQ ID NO: 1175 - protein, 9 aa, Mycobacterium tuberculosis
AAGIGWVGL

SEQ ID NO: 1176 - protein, 9 aa, Mycobacterium tuberculosis
AGIGWVGLN

SEQ ID NO: 1177 - protein, 9 aa, Mycobacterium tuberculosis
GIGWVGLNV

SEQ ID NO: 1178 - protein, 9 aa, Mycobacterium tuberculosis
IGWVGLNVT

SEQ ID NO: 1179 - protein, 9 aa, Mycobacterium tuberculosis
GWVGLNVTE

SEQ ID NO: 1180 - protein, 9 aa, Mycobacterium tuberculosis
WVGLNVTET

SEQ ID NO: 1181 - protein, 9 aa, Mycobacterium tuberculosis
VGLNVTETN

SEQ ID NO: 1182 - protein, 9 aa, Mycobacterium tuberculosis
GLNVTETNR

SEQ ID NO: 1183 - protein, 9 aa, Mycobacterium tuberculosis
LNVTETNRD

SEQ ID NO: 1184 - protein, 9 aa, Mycobacterium tuberculosis
NVTETNRDQ

SEQ ID NO: 1185 - protein, 9 aa, Mycobacterium tuberculosis
VTETNRDQC

SEQ ID NO: 1186 - protein, 9 aa, Mycobacterium tuberculosis
TETNRDQCY

SEQ ID NO: 1187 - protein, 9 aa, Mycobacterium tuberculosis
ETNRDQCYR

SEQ ID NO: 1188 - protein, 9 aa, Mycobacterium tuberculosis
TNRDQCYRV

SEQ ID NO: 1189 - protein, 9 aa, Mycobacterium tuberculosis
NRDQCYRVE

SEQ ID NO: 1190 - protein, 9 aa, Mycobacterium tuberculosis
RDQCYRVER

SEQ ID NO: 1191 - protein, 9 aa, Mycobacterium tuberculosis
DQCYRVERT

SEQ ID NO: 1192 - protein, 9 aa, Mycobacterium tuberculosis
QCYRVERTT

SEQ ID NO: 1193 - protein, 9 aa, Mycobacterium tuberculosis
CYRVERTTV

SEQ ID NO: 1194 - protein, 9 aa, Mycobacterium tuberculosis
YRVERTTVD

SEQ ID NO: 1195 - protein, 9 aa, Mycobacterium tuberculosis
RVERTTVDA

SEQ ID NO: 1196 - protein, 9 aa, Mycobacterium tuberculosis
VERTTVDAL

SEQ ID NO: 1197 - protein, 9 aa, Mycobacterium tuberculosis
ERTTVDALT

SEQ ID NO: 1198 - protein, 9 aa, Mycobacterium tuberculosis
RTTVDALTH

SEQ ID NO: 1199 - protein, 9 aa, Mycobacterium tuberculosis
TTVDALTHP

SEQ ID NO: 1200 - protein, 9 aa, Mycobacterium tuberculosis
TVDALTHPE

SEQ ID NO: 1201 - protein, 9 aa, Mycobacterium tuberculosis
VDALTHPEY

SEQ ID NO: 1202 - protein, 9 aa, Mycobacterium tuberculosis
DALTHPEYR

SEQ ID NO: 1203 - protein, 9 aa, Mycobacterium tuberculosis
ALTHPEYRV

SEQ ID NO: 1204 - protein, 9 aa, Mycobacterium tuberculosis
LTHPEYRVH

SEQ ID NO: 1205 - protein, 9 aa, Mycobacterium tuberculosis
THPEYRVHT

SEQ ID NO: 1206 - protein, 9 aa, Mycobacterium tuberculosis
HPEYRVHTR

SEQ ID NO: 1207 - protein, 9 aa, Mycobacterium tuberculosis
PEYRVHTRG

SEQ ID NO: 1208 - protein, 9 aa, Mycobacterium tuberculosis
EYRVHTRGV

SEQ ID NO: 1209 - protein, 9 aa, Mycobacterium tuberculosis
YRVHTRGVQ

SEQ ID NO: 1210 - protein, 9 aa, Mycobacterium tuberculosis
RVHTRGVQR

SEQ ID NO: 1211 - protein, 9 aa, Mycobacterium tuberculosis
VHTRGVQRV

SEQ ID NO: 1212 - protein, 9 aa, Mycobacterium tuberculosis
HTRGVQRVR

SEQ ID NO: 1213 - protein, 9 aa, Mycobacterium tuberculosis
TRGVQRVRV

SEQ ID NO: 1214 - protein, 9 aa, Mycobacterium tuberculosis
RGVQRVRVT

SEQ ID NO: 1215 - protein, 9 aa, Mycobacterium tuberculosis
GVQRVRVTR

SEQ ID NO: 1216 - protein, 9 aa, Mycobacterium tuberculosis
VQRVRVTRN

SEQ ID NO: 1217 - protein, 9 aa, Mycobacterium tuberculosis
QRVRVTRNA

SEQ ID NO: 1218 - protein, 9 aa, Mycobacterium tuberculosis
RVRVTRNAR

SEQ ID NO: 1219 - protein, 9 aa, Mycobacterium tuberculosis
VRVTRNARK

SEQ ID NO: 1220 - protein, 9 aa, Mycobacterium tuberculosis
RVTRNARKH

SEQ ID NO: 1221 - protein, 9 aa, Mycobacterium tuberculosis
VTRNARKHR

SEQ ID NO: 1222 - protein, 9 aa, Mycobacterium tuberculosis
TRNARKHRV

SEQ ID NO: 1223 - protein, 9 aa, Mycobacterium tuberculosis
RNARKHRVS

SEQ ID NO: 1224 - protein, 9 aa, Mycobacterium tuberculosis
NARKHRVSK

SEQ ID NO: 1225 - protein, 9 aa, Mycobacterium tuberculosis
ARKHRVSKH

SEQ ID NO: 1226 - protein, 9 aa, Mycobacterium tuberculosis
RKHRVSKHR

SEQ ID NO: 1227 - protein, 9 aa, Mycobacterium tuberculosis
KHRVSKHRI

SEQ ID NO: 1228 - protein, 9 aa, Mycobacterium tuberculosis
HRVSKHRIV

SEQ ID NO: 1229 - protein, 9 aa, Mycobacterium tuberculosis
RVSKHRIVA

SEQ ID NO: 1230 - protein, 9 aa, Mycobacterium tuberculosis
VSKHRIVAA

SEQ ID NO: 1231 - protein, 9 aa, Mycobacterium tuberculosis
SKHRIVAAM

SEQ ID NO: 1232 - protein, 9 aa, Mycobacterium tuberculosis
KHRIVAAMR

SEQ ID NO: 1233 - protein, 9 aa, Mycobacterium tuberculosis
HRIVAAMRH

SEQ ID NO: 1234 - protein, 9 aa, Mycobacterium tuberculosis
RIVAAMRHC

SEQ ID NO: 1235 - protein, 9 aa, Mycobacterium tuberculosis
IVAAMRHCG

SEQ ID NO: 1236 - protein, 9 aa, Mycobacterium tuberculosis
VAAMRHCGV

SEQ ID NO: 1237 - protein, 9 aa, Mycobacterium tuberculosis
AAMRHCGVP

SEQ ID NO: 1238 - protein, 9 aa, Mycobacterium tuberculosis
AMRHCGVPV

SEQ ID NO: 1239 - protein, 9 aa, Mycobacterium tuberculosis
MRHCGVPVI

SEQ ID NO: 1240 - protein, 9 aa, Mycobacterium tuberculosis
RHCGVPVIQ

SEQ ID NO: 1241 - protein, 9 aa, Mycobacterium tuberculosis
HCGVPVIQE

SEQ ID NO: 1242 - protein, 9 aa, Mycobacterium tuberculosis
CGVPVIQED

SEQ ID NO: 1243 - protein, 9 aa, Mycobacterium tuberculosis
GVPVIQEDG

SEQ ID NO: 1244 - protein, 9 aa, Mycobacterium tuberculosis
VPVIQEDGS

SEQ ID NO: 1245 - protein, 9 aa, Mycobacterium tuberculosis
PVIQEDGSL

SEQ ID NO: 1246 - protein, 9 aa, Mycobacterium tuberculosis
VIQEDGSLY

SEQ ID NO: 1247 - protein, 9 aa, Mycobacterium tuberculosis
IQEDGSLYY

SEQ ID NO: 1248 - protein, 9 aa, Mycobacterium tuberculosis
QEDGSLYYQ

SEQ ID NO: 1249 - protein, 9 aa, Mycobacterium tuberculosis
EDGSLYYQG

SEQ ID NO: 1250 - protein, 9 aa, Mycobacterium tuberculosis
DGSLYYQGR

SEQ ID NO: 1251 - protein, 9 aa, Mycobacterium tuberculosis
GSLYYQGRD

SEQ ID NO: 1252 - protein, 9 aa, Mycobacterium tuberculosis
SLYYQGRDT

SEQ ID NO: 1253 - protein, 9 aa, Mycobacterium tuberculosis
LYYQGRDTS

SEQ ID NO: 1254 - protein, 9 aa, Mycobacterium tuberculosis
YYQGRDTSG

SEQ ID NO: 1255 - protein, 9 aa, Mycobacterium tuberculosis
YQGRDTSGR

SEQ ID NO: 1256 - protein, 9 aa, Mycobacterium tuberculosis
QGRDTSGRL

SEQ ID NO: 1257 - protein, 9 aa, Mycobacterium tuberculosis
GRDTSGRLT

SEQ ID NO: 1258 - protein, 9 aa, Mycobacterium tuberculosis
RDTSGRLTE

SEQ ID NO: 1259 - protein, 9 aa, Mycobacterium tuberculosis
DTSGRLTEV

SEQ ID NO: 1260 - protein, 9 aa, Mycobacterium tuberculosis
TSGRLTEVV

SEQ ID NO: 1261 - protein, 9 aa, Mycobacterium tuberculosis
SGRLTEVVA

SEQ ID NO: 1262 - protein, 9 aa, Mycobacterium tuberculosis
GRLTEVVAV

SEQ ID NO: 1263 - protein, 9 aa, Mycobacterium tuberculosis
RLTEVVAVE

SEQ ID NO: 1264 - protein, 9 aa, Mycobacterium tuberculosis
LTEVVAVEA

SEQ ID NO: 1265 - protein, 9 aa, Mycobacterium tuberculosis
TEVVAVEAD

SEQ ID NO: 1266 - protein, 9 aa, Mycobacterium tuberculosis
EVVAVEADD

SEQ ID NO: 1267 - protein, 9 aa, Mycobacterium tuberculosis
VVAVEADDG

SEQ ID NO: 1268 - protein, 9 aa, Mycobacterium tuberculosis
VAVEADDGD

SEQ ID NO: 1269 - protein, 9 aa, Mycobacterium tuberculosis
AVEADDGDL

SEQ ID NO: 1270 - protein, 9 aa, Mycobacterium tuberculosis
VEADDGDLI

SEQ ID NO: 1271 - protein, 9 aa, Mycobacterium tuberculosis
EADDGDLII

SEQ ID NO: 1272 - protein, 9 aa, Mycobacterium tuberculosis
ADDGDLIIT

SEQ ID NO: 1273 - protein, 9 aa, Mycobacterium tuberculosis
DDGDLIITH

SEQ ID NO: 1274 - protein, 9 aa, Mycobacterium tuberculosis
DGDLIITHA

SEQ ID NO: 1275 - protein, 9 aa, Mycobacterium tuberculosis
GDLIITHAM

SEQ ID NO: 1276 - protein, 9 aa, Mycobacterium tuberculosis
DLIITHAMP

SEQ ID NO: 1277 - protein, 9 aa, Mycobacterium tuberculosis
LIITHAMPK

SEQ ID NO: 1278 - protein, 9 aa, Mycobacterium tuberculosis
IITHAMPKE

SEQ ID NO: 1279 - protein, 9 aa, Mycobacterium tuberculosis
ITHAMPKEW

SEQ ID NO: 1280 - protein, 9 aa, Mycobacterium tuberculosis
THAMPKEWK

SEQ ID NO: 1281 - protein, 10 aa, Mycobacterium tuberculosis
MAGSVSAAAG

SEQ ID NO: 1282 - protein, 10 aa, Mycobacterium tuberculosis
AGSVSAAAGI

SEQ ID NO: 1283 - protein, 10 aa, Mycobacterium tuberculosis
GSVSAAAGIG

SEQ ID NO: 1284 - protein, 10 aa, Mycobacterium tuberculosis
SVSAAAGIGW

SEQ ID NO: 1285 - protein, 10 aa, Mycobacterium tuberculosis
VSAAAGIGWV

SEQ ID NO: 1286 - protein, 10 aa, Mycobacterium tuberculosis
SAAAGIGWVG

SEQ ID NO: 1287 - protein, 10 aa, Mycobacterium tuberculosis
AAAGIGWVGL

SEQ ID NO: 1288 - protein, 10 aa, Mycobacterium tuberculosis
AAGIGWVGLN

SEQ ID NO: 1289 - protein, 10 aa, Mycobacterium tuberculosis
AGIGWVGLNV

SEQ ID NO: 1290 - protein, 10 aa, Mycobacterium tuberculosis
GIGWVGLNVT

SEQ ID NO: 1291 - protein, 10 aa, Mycobacterium tuberculosis
IGWVGLNVTE

SEQ ID NO: 1292 - protein, 10 aa, Mycobacterium tuberculosis
GWVGLNVTET

SEQ ID NO: 1293 - protein, 10 aa, Mycobacterium tuberculosis
WVGLNVTETN

SEQ ID NO: 1294 - protein, 10 aa, Mycobacterium tuberculosis
VGLNVTETNR

SEQ ID NO: 1295 - protein, 10 aa, Mycobacterium tuberculosis
GLNVTETNRD

SEQ ID NO: 1296 - protein, 10 aa, Mycobacterium tuberculosis
LNVTETNRDQ

SEQ ID NO: 1297 - protein, 10 aa, Mycobacterium tuberculosis
NVTETNRDQC

SEQ ID NO: 1298 - protein, 10 aa, Mycobacterium tuberculosis
VTETNRDQCY

SEQ ID NO: 1299 - protein, 10 aa, Mycobacterium tuberculosis
TETNRDQCYR

SEQ ID NO: 1300 - protein, 10 aa, Mycobacterium tuberculosis
ETNRDQCYRV

SEQ ID NO: 1301 - protein, 10 aa, Mycobacterium tuberculosis
TNRDQCYRVE

SEQ ID NO: 1302 - protein, 10 aa, Mycobacterium tuberculosis
NRDQCYRVER

SEQ ID NO: 1303 - protein, 10 aa, Mycobacterium tuberculosis
RDQCYRVERT

SEQ ID NO: 1304 - protein, 10 aa, Mycobacterium tuberculosis
DQCYRVERTT

SEQ ID NO: 1305 - protein, 10 aa, Mycobacterium tuberculosis
QCYRVERTTV

SEQ ID NO: 1306 - protein, 10 aa, Mycobacterium tuberculosis
CYRVERTTVD

SEQ ID NO: 1307 - protein, 10 aa, Mycobacterium tuberculosis
YRVERTTVDA

SEQ ID NO: 1308 - protein, 10 aa, Mycobacterium tuberculosis
RVERTTVDAL

SEQ ID NO: 1309 - protein, 10 aa, Mycobacterium tuberculosis
VERTTVDALT

SEQ ID NO: 1310 - protein, 10 aa, Mycobacterium tuberculosis
ERTTVDALTH

SEQ ID NO: 1311 - protein, 10 aa, Mycobacterium tuberculosis
RTTVDALTHP

SEQ ID NO: 1312 - protein, 10 aa, Mycobacterium tuberculosis
TTVDALTHPE

SEQ ID NO: 1313 - protein, 10 aa, Mycobacterium tuberculosis
TVDALTHPEY

SEQ ID NO: 1314 - protein, 10 aa, Mycobacterium tuberculosis
VDALTHPEYR

SEQ ID NO: 1315 - protein, 10 aa, Mycobacterium tuberculosis
DALTHPEYRV

SEQ ID NO: 1316 - protein, 10 aa, Mycobacterium tuberculosis
ALTHPEYRVH

SEQ ID NO: 1317 - protein, 10 aa, Mycobacterium tuberculosis
LTHPEYRVHT

SEQ ID NO: 1318 - protein, 10 aa, Mycobacterium tuberculosis
THPEYRVHTR

SEQ ID NO: 1319 - protein, 10 aa, Mycobacterium tuberculosis
HPEYRVHTRG

SEQ ID NO: 1320 - protein, 10 aa, Mycobacterium tuberculosis
PEYRVHTRGV

SEQ ID NO: 1321 - protein, 10 aa, Mycobacterium tuberculosis
EYRVHTRGVQ

SEQ ID NO: 1322 - protein, 10 aa, Mycobacterium tuberculosis
YRVHTRGVQR

SEQ ID NO: 1323 - protein, 10 aa, Mycobacterium tuberculosis
RVHTRGVQRV

SEQ ID NO: 1324 - protein, 10 aa, Mycobacterium tuberculosis
VHTRGVQRVR

SEQ ID NO: 1325 - protein, 10 aa, Mycobacterium tuberculosis
HTRGVQRVRV

SEQ ID NO: 1326 - protein, 10 aa, Mycobacterium tuberculosis
TRGVQRVRVT

SEQ ID NO: 1327 - protein, 10 aa, Mycobacterium tuberculosis
RGVQRVRVTR

SEQ ID NO: 1328 - protein, 10 aa, Mycobacterium tuberculosis
GVQRVRVTRN

SEQ ID NO: 1329 - protein, 10 aa, Mycobacterium tuberculosis
VQRVRVTRNA

SEQ ID NO: 1330 - protein, 10 aa, Mycobacterium tuberculosis
QRVRVTRNAR

SEQ ID NO: 1331 - protein, 10 aa, Mycobacterium tuberculosis
RVRVTRNARK

SEQ ID NO: 1332 - protein, 10 aa, Mycobacterium tuberculosis
VRVTRNARKH

SEQ ID NO: 1333 - protein, 10 aa, Mycobacterium tuberculosis
RVTRNARKHR

SEQ ID NO: 1334 - protein, 10 aa, Mycobacterium tuberculosis
VTRNARKHRV

SEQ ID NO: 1335 - protein, 10 aa, Mycobacterium tuberculosis
TRNARKHRVS

SEQ ID NO: 1336 - protein, 10 aa, Mycobacterium tuberculosis
RNARKHRVSK

SEQ ID NO: 1337 - protein, 10 aa, Mycobacterium tuberculosis
NARKHRVSKH

SEQ ID NO: 1338 - protein, 10 aa, Mycobacterium tuberculosis
ARKHRVSKHR

SEQ ID NO: 1339 - protein, 10 aa, Mycobacterium tuberculosis
RKHRVSKHRI

SEQ ID NO: 1340 - protein, 10 aa, Mycobacterium tuberculosis
KHRVSKHRIV

SEQ ID NO: 1341 - protein, 10 aa, Mycobacterium tuberculosis
HRVSKHRIVA

SEQ ID NO: 1342 - protein, 10 aa, Mycobacterium tuberculosis
RVSKHRIVAA

SEQ ID NO: 1343 - protein, 10 aa, Mycobacterium tuberculosis
VSKHRIVAAM

SEQ ID NO: 1344 - protein, 10 aa, Mycobacterium tuberculosis
SKHRIVAAMR

SEQ ID NO: 1345 - protein, 10 aa, Mycobacterium tuberculosis
KHRIVAAMRH

SEQ ID NO: 1346 - protein, 10 aa, Mycobacterium tuberculosis
HRIVAAMRHC

SEQ ID NO: 1347 - protein, 10 aa, Mycobacterium tuberculosis
RIVAAMRHCG

SEQ ID NO: 1348 - protein, 10 aa, Mycobacterium tuberculosis
IVAAMRHCGV

SEQ ID NO: 1349 - protein, 10 aa, Mycobacterium tuberculosis
VAAMRHCGVP

SEQ ID NO: 1350 - protein, 10 aa, Mycobacterium tuberculosis
AAMRHCGVPV

SEQ ID NO: 1351 - protein, 10 aa, Mycobacterium tuberculosis
AMRHCGVPVI

SEQ ID NO: 1352 - protein, 10 aa, Mycobacterium tuberculosis
MRHCGVPVIQ

SEQ ID NO: 1353 - protein, 10 aa, Mycobacterium tuberculosis
RHCGVPVIQE

SEQ ID NO: 1354 - protein, 10 aa, Mycobacterium tuberculosis
HCGVPVIQED

SEQ ID NO: 1355 - protein, 10 aa, Mycobacterium tuberculosis
CGVPVIQEDG

SEQ ID NO: 1356 - protein, 10 aa, Mycobacterium tuberculosis
GVPVIQEDGS

SEQ ID NO: 1357 - protein, 10 aa, Mycobacterium tuberculosis
VPVIQEDGSL

SEQ ID NO: 1358 - protein, 10 aa, Mycobacterium tuberculosis
PVIQEDGSLY

SEQ ID NO: 1359 - protein, 10 aa, Mycobacterium tuberculosis
VIQEDGSLYY

SEQ ID NO: 1360 - protein, 10 aa, Mycobacterium tuberculosis
IQEDGSLYYQ

SEQ ID NO: 1361 - protein, 10 aa, Mycobacterium tuberculosis
QEDGSLYYQG

SEQ ID NO: 1362 - protein, 10 aa, Mycobacterium tuberculosis
EDGSLYYQGR

SEQ ID NO: 1363 - protein, 10 aa, Mycobacterium tuberculosis
DGSLYYQGRD

SEQ ID NO: 1364 - protein, 10 aa, Mycobacterium tuberculosis
GSLYYQGRDT

SEQ ID NO: 1365 - protein, 10 aa, Mycobacterium tuberculosis
SLYYQGRDTS

SEQ ID NO: 1366 - protein, 10 aa, Mycobacterium tuberculosis
LYYQGRDTSG

SEQ ID NO: 1367 - protein, 10 aa, Mycobacterium tuberculosis
YYQGRDTSGR

SEQ ID NO: 1368 - protein, 10 aa, Mycobacterium tuberculosis
YQGRDTSGRL

SEQ ID NO: 1369 - protein, 10 aa, Mycobacterium tuberculosis
QGRDTSGRLT

SEQ ID NO: 1370 - protein, 10 aa, Mycobacterium tuberculosis
GRDTSGRLTE

SEQ ID NO: 1371 - protein, 10 aa, Mycobacterium tuberculosis
RDTSGRLTEV

SEQ ID NO: 1372 - protein, 10 aa, Mycobacterium tuberculosis
DTSGRLTEVV

SEQ ID NO: 1373 - protein, 10 aa, Mycobacterium tuberculosis
TSGRLTEVVA

SEQ ID NO: 1374 - protein, 10 aa, Mycobacterium tuberculosis
SGRLTEVVAV

SEQ ID NO: 1375 - protein, 10 aa, Mycobacterium tuberculosis
GRLTEVVAVE

SEQ ID NO: 1376 - protein, 10 aa, Mycobacterium tuberculosis
RLTEVVAVEA

SEQ ID NO: 1377 - protein, 10 aa, Mycobacterium tuberculosis
LTEVVAVEAD

SEQ ID NO: 1378 - protein, 10 aa, Mycobacterium tuberculosis
TEVVAVEADD

SEQ ID NO: 1379 - protein, 10 aa, Mycobacterium tuberculosis
EVVAVEADDG

SEQ ID NO: 1380 - protein, 10 aa, Mycobacterium tuberculosis
VVAVEADDGD

SEQ ID NO: 1381 - protein, 10 aa, Mycobacterium tuberculosis
VAVEADDGDL

SEQ ID NO: 1382 - protein, 10 aa, Mycobacterium tuberculosis
AVEADDGDLI

SEQ ID NO: 1383 - protein, 10 aa, Mycobacterium tuberculosis
VEADDGDLII

SEQ ID NO: 1384 - protein, 10 aa, Mycobacterium tuberculosis
EADDGDLIIT

SEQ ID NO: 1385 - protein, 10 aa, Mycobacterium tuberculosis
ADDGDLIITH

SEQ ID NO: 1386 - protein, 10 aa, Mycobacterium tuberculosis
DDGDLIITHA

SEQ ID NO: 1387 - protein, 10 aa, Mycobacterium tuberculosis
DGDLIITHAM

SEQ ID NO: 1388 - protein, 10 aa, Mycobacterium tuberculosis
GDLIITHAMP

SEQ ID NO: 1389 - protein, 10 aa, Mycobacterium tuberculosis
DLIITHAMPK

SEQ ID NO: 1390 - protein, 10 aa, Mycobacterium tuberculosis
LIITHAMPKE

SEQ ID NO: 1391 - protein, 10 aa, Mycobacterium tuberculosis
IITHAMPKEW

SEQ ID NO: 1392 - protein, 10 aa, Mycobacterium tuberculosis
ITHAMPKEWK

SEQ ID NO: 1393 - protein, 10 aa, Mycobacterium tuberculosis
THAMPKEWKR

SEQ ID NO: 1394 - protein, 11 aa, Mycobacterium tuberculosis
MAGSVSAAAGI

SEQ ID NO: 1395 - protein, 11 aa, Mycobacterium tuberculosis
AGSVSAAAGIG

SEQ ID NO: 1396 - protein, 11 aa, Mycobacterium tuberculosis
GSVSAAAGIGW

SEQ ID NO: 1397 - protein, 11 aa, Mycobacterium tuberculosis
SVSAAAGIGWV

SEQ ID NO: 1398 - protein, 11 aa, Mycobacterium tuberculosis
VSAAAGIGWVG

SEQ ID NO: 1399 - protein, 11 aa, Mycobacterium tuberculosis
SAAAGIGWVGL

SEQ ID NO: 1400 - protein, 11 aa, Mycobacterium tuberculosis
AAAGIGWVGLN

SEQ ID NO: 1401 - protein, 11 aa, Mycobacterium tuberculosis
AAGIGWVGLNV

SEQ ID NO: 1402 - protein, 11 aa, Mycobacterium tuberculosis
AGIGWVGLNVT

SEQ ID NO: 1403 - protein, 11 aa, Mycobacterium tuberculosis
GIGWVGLNVTE

SEQ ID NO: 1404 - protein, 11 aa, Mycobacterium tuberculosis
IGWVGLNVTET

SEQ ID NO: 1405 - protein, 11 aa, Mycobacterium tuberculosis
GWVGLNVTETN

SEQ ID NO: 1406 - protein, 11 aa, Mycobacterium tuberculosis
WVGLNVTETNR

SEQ ID NO: 1407 - protein, 11 aa, Mycobacterium tuberculosis
VGLNVTETNRD

SEQ ID NO: 1408 - protein, 11 aa, Mycobacterium tuberculosis
GLNVTETNRDQ

SEQ ID NO: 1409 - protein, 11 aa, Mycobacterium tuberculosis
LNVTETNRDQC

SEQ ID NO: 1410 - protein, 11 aa, Mycobacterium tuberculosis
NVTETNRDQCY

SEQ ID NO: 1411 - protein, 11 aa, Mycobacterium tuberculosis
VTETNRDQCYR

SEQ ID NO: 1412 - protein, 11 aa, Mycobacterium tuberculosis
TETNRDQCYRV

SEQ ID NO: 1413 - protein, 11 aa, Mycobacterium tuberculosis
ETNRDQCYRVE

SEQ ID NO: 1414 - protein, 11 aa, Mycobacterium tuberculosis
TNRDQCYRVER

SEQ ID NO: 1415 - protein, 11 aa, Mycobacterium tuberculosis
NRDQCYRVERT

SEQ ID NO: 1416 - protein, 11 aa, Mycobacterium tuberculosis
RDQCYRVERTT

SEQ ID NO: 1417 - protein, 11 aa, Mycobacterium tuberculosis
DQCYRVERTTV

SEQ ID NO: 1418 - protein, 11 aa, Mycobacterium tuberculosis
QCYRVERTTVD

SEQ ID NO: 1419 - protein, 11 aa, Mycobacterium tuberculosis
CYRVERTTVDA

SEQ ID NO: 1420 - protein, 11 aa, Mycobacterium tuberculosis
YRVERTTVDAL

SEQ ID NO: 1421 - protein, 11 aa, Mycobacterium tuberculosis
RVERTTVDALT

SEQ ID NO: 1422 - protein, 11 aa, Mycobacterium tuberculosis
VERTTVDALTH

SEQ ID NO: 1423 - protein, 11 aa, Mycobacterium tuberculosis
ERTTVDALTHP

SEQ ID NO: 1424 - protein, 11 aa, Mycobacterium tuberculosis
RTTVDALTHPE

SEQ ID NO: 1425 - protein, 11 aa, Mycobacterium tuberculosis
TTVDALTHPEY

SEQ ID NO: 1426 - protein, 11 aa, Mycobacterium tuberculosis
TVDALTHPEYR

SEQ ID NO: 1427 - protein, 11 aa, Mycobacterium tuberculosis
VDALTHPEYRV

SEQ ID NO: 1428 - protein, 11 aa, Mycobacterium tuberculosis
DALTHPEYRVH

SEQ ID NO: 1429 - protein, 11 aa, Mycobacterium tuberculosis
ALTHPEYRVHT

SEQ ID NO: 1430 - protein, 11 aa, Mycobacterium tuberculosis
LTHPEYRVHTR

SEQ ID NO: 1431 - protein, 11 aa, Mycobacterium tuberculosis
THPEYRVHTRG

SEQ ID NO: 1432 - protein, 11 aa, Mycobacterium tuberculosis
HPEYRVHTRGV

SEQ ID NO: 1433 - protein, 11 aa, Mycobacterium tuberculosis
PEYRVHTRGVQ

SEQ ID NO: 1434 - protein, 11 aa, Mycobacterium tuberculosis
EYRVHTRGVQR

SEQ ID NO: 1435 - protein, 11 aa, Mycobacterium tuberculosis
YRVHTRGVQRV

SEQ ID NO: 1436 - protein, 11 aa, Mycobacterium tuberculosis
RVHTRGVQRVR

SEQ ID NO: 1437 - protein, 11 aa, Mycobacterium tuberculosis
VHTRGVQRVRV

SEQ ID NO: 1438 - protein, 11 aa, Mycobacterium tuberculosis
HTRGVQRVRVT

SEQ ID NO: 1439 - protein, 11 aa, Mycobacterium tuberculosis
TRGVQRVRVTR

SEQ ID NO: 1440 - protein, 11 aa, Mycobacterium tuberculosis
RGVQRVRVTRN

SEQ ID NO: 1441 - protein, 11 aa, Mycobacterium tuberculosis
GVQRVRVTRNA

SEQ ID NO: 1442 - protein, 11 aa, Mycobacterium tuberculosis
VQRVRVTRNAR

SEQ ID NO: 1443 - protein, 11 aa, Mycobacterium tuberculosis
QRVRVTRNARK

SEQ ID NO: 1444 - protein, 11 aa, Mycobacterium tuberculosis
RVRVTRNARKH

SEQ ID NO: 1445 - protein, 11 aa, Mycobacterium tuberculosis
VRVTRNARKHR

SEQ ID NO: 1446 - protein, 11 aa, Mycobacterium tuberculosis
RVTRNARKHRV

SEQ ID NO: 1447 - protein, 11 aa, Mycobacterium tuberculosis
VTRNARKHRVS

SEQ ID NO: 1448 - protein, 11 aa, Mycobacterium tuberculosis
TRNARKHRVSK

SEQ ID NO: 1449 - protein, 11 aa, Mycobacterium tuberculosis
RNARKHRVSKH

SEQ ID NO: 1450 - protein, 11 aa, Mycobacterium tuberculosis
NARKHRVSKHR

SEQ ID NO: 1451 - protein, 11 aa, Mycobacterium tuberculosis
ARKHRVSKHRI

SEQ ID NO: 1452 - protein, 11 aa, Mycobacterium tuberculosis
RKHRVSKHRIV

SEQ ID NO: 1453 - protein, 11 aa, Mycobacterium tuberculosis
KHRVSKHRIVA

SEQ ID NO: 1454 - protein, 11 aa, Mycobacterium tuberculosis
HRVSKHRIVAA

SEQ ID NO: 1455 - protein, 11 aa, Mycobacterium tuberculosis
RVSKHRIVAAM

SEQ ID NO: 1456 - protein, 11 aa, Mycobacterium tuberculosis
VSKHRIVAAMR

SEQ ID NO: 1457 - protein, 11 aa, Mycobacterium tuberculosis
SKHRIVAAMRH

SEQ ID NO: 1458 - protein, 11 aa, Mycobacterium tuberculosis
KHRIVAAMRHC

SEQ ID NO: 1459 - protein, 11 aa, Mycobacterium tuberculosis
HRIVAAMRHCG

SEQ ID NO: 1460 - protein, 11 aa, Mycobacterium tuberculosis
RIVAAMRHCGV

SEQ ID NO: 1461 - protein, 11 aa, Mycobacterium tuberculosis
IVAAMRHCGVP

SEQ ID NO: 1462 - protein, 11 aa, Mycobacterium tuberculosis
VAAMRHCGVPV

SEQ ID NO: 1463 - protein, 11 aa, Mycobacterium tuberculosis
AAMRHCGVPVI

SEQ ID NO: 1464 - protein, 11 aa, Mycobacterium tuberculosis
AMRHCGVPVIQ

SEQ ID NO: 1465 - protein, 11 aa, Mycobacterium tuberculosis
MRHCGVPVIQE

SEQ ID NO: 1466 - protein, 11 aa, Mycobacterium tuberculosis
RHCGVPVIQED

SEQ ID NO: 1467 - protein, 11 aa, Mycobacterium tuberculosis
HCGVPVIQEDG

SEQ ID NO: 1468 - protein, 11 aa, Mycobacterium tuberculosis
CGVPVIQEDGS

SEQ ID NO: 1469 - protein, 11 aa, Mycobacterium tuberculosis
GVPVIQEDGSL

SEQ ID NO: 1470 - protein, 11 aa, Mycobacterium tuberculosis
VPVIQEDGSLY

SEQ ID NO: 1471 - protein, 11 aa, Mycobacterium tuberculosis
PVIQEDGSLYY

SEQ ID NO: 1472 - protein, 11 aa, Mycobacterium tuberculosis
VIQEDGSLYYQ

SEQ ID NO: 1473 - protein, 11 aa, Mycobacterium tuberculosis
IQEDGSLYYQG

SEQ ID NO: 1474 - protein, 11 aa, Mycobacterium tuberculosis
QEDGSLYYQGR

SEQ ID NO: 1475 - protein, 11 aa, Mycobacterium tuberculosis
EDGSLYYQGRD

SEQ ID NO: 1476 - protein, 11 aa, Mycobacterium tuberculosis
DGSLYYQGRDT

SEQ ID NO: 1477 - protein, 11 aa, Mycobacterium tuberculosis
GSLYYQGRDTS

SEQ ID NO: 1478 - protein, 11 aa, Mycobacterium tuberculosis
SLYYQGRDTSG

SEQ ID NO: 1479 - protein, 11 aa, Mycobacterium tuberculosis
LYYQGRDTSGR

SEQ ID NO: 1480 - protein, 11 aa, Mycobacterium tuberculosis
YYQGRDTSGRL

SEQ ID NO: 1481 - protein, 11 aa, Mycobacterium tuberculosis
YQGRDTSGRLT

SEQ ID NO: 1482 - protein, 11 aa, Mycobacterium tuberculosis
QGRDTSGRLTE

SEQ ID NO: 1483 - protein, 11 aa, Mycobacterium tuberculosis
GRDTSGRLTEV

SEQ ID NO: 1484 - protein, 11 aa, Mycobacterium tuberculosis
RDTSGRLTEVV

SEQ ID NO: 1485 - protein, 11 aa, Mycobacterium tuberculosis
DTSGRLTEVVA

SEQ ID NO: 1486 - protein, 11 aa, Mycobacterium tuberculosis
TSGRLTEVVAV

SEQ ID NO: 1487 - protein, 11 aa, Mycobacterium tuberculosis
SGRLTEVVAVE

SEQ ID NO: 1488 - protein, 11 aa, Mycobacterium tuberculosis
GRLTEVVAVEA

SEQ ID NO: 1489 - protein, 11 aa, Mycobacterium tuberculosis
RLTEVVAVEAD

SEQ ID NO: 1490 - protein, 11 aa, Mycobacterium tuberculosis
LTEVVAVEADD

SEQ ID NO: 1491 - protein, 11 aa, Mycobacterium tuberculosis
TEVVAVEADDG

SEQ ID NO: 1492 - protein, 11 aa, Mycobacterium tuberculosis
EVVAVEADDGD

SEQ ID NO: 1493 - protein, 11 aa, Mycobacterium tuberculosis
VVAVEADDGDL

SEQ ID NO: 1494 - protein, 11 aa, Mycobacterium tuberculosis
VAVEADDGDLI

SEQ ID NO: 1495 - protein, 11 aa, Mycobacterium tuberculosis
AVEADDGDLII

SEQ ID NO: 1496 - protein, 11 aa, Mycobacterium tuberculosis
VEADDGDLIIT

SEQ ID NO: 1497 - protein, 11 aa, Mycobacterium tuberculosis
EADDGDLIITH

SEQ ID NO: 1498 - protein, 11 aa, Mycobacterium tuberculosis
ADDGDLIITHA

SEQ ID NO: 1499 - protein, 11 aa, Mycobacterium tuberculosis
DDGDLIITHAM

SEQ ID NO: 1500 - protein, 11 aa, Mycobacterium tuberculosis
DGDLIITHAMP

SEQ ID NO: 1501 - protein, 11 aa, Mycobacterium tuberculosis
GDLIITHAMPK

SEQ ID NO: 1502 - protein, 11 aa, Mycobacterium tuberculosis
DLIITHAMPKE

SEQ ID NO: 1503 - protein, 11 aa, Mycobacterium tuberculosis
LIITHAMPKEW

SEQ ID NO: 1504 - protein, 11 aa, Mycobacterium tuberculosis
IITHAMPKEWK

SEQ ID NO: 1505 - protein, 11 aa, Mycobacterium tuberculosis
ITHAMPKEWKR

SEQ ID NO: 1506 - protein, 8 aa, Mycobacterium tuberculosis
MSTVHSSI

SEQ ID NO: 1507 - protein, 8 aa, Mycobacterium tuberculosis
STVHSSID

SEQ ID NO: 1508 - protein, 8 aa, Mycobacterium tuberculosis
TVHSSIDQ

SEQ ID NO: 1509 - protein, 8 aa, Mycobacterium tuberculosis
VHSSIDQH

SEQ ID NO: 1510 - protein, 8 aa, Mycobacterium tuberculosis
HSSIDQHP

SEQ ID NO: 1511 - protein, 8 aa, Mycobacterium tuberculosis
SSIDQHPD

SEQ ID NO: 1512 - protein, 8 aa, Mycobacterium tuberculosis
SIDQHPDL

SEQ ID NO: 1513 - protein, 8 aa, Mycobacterium tuberculosis
IDQHPDLL

SEQ ID NO: 1514 - protein, 8 aa, Mycobacterium tuberculosis
DQHPDLLA

SEQ ID NO: 1515 - protein, 8 aa, Mycobacterium tuberculosis
QHPDLLAL

SEQ ID NO: 1516 - protein, 8 aa, Mycobacterium tuberculosis
HPDLLALR

SEQ ID NO: 1517 - protein, 8 aa, Mycobacterium tuberculosis
PDLLALRA

SEQ ID NO: 1518 - protein, 8 aa, Mycobacterium tuberculosis
DLLALRAS

SEQ ID NO: 1519 - protein, 8 aa, Mycobacterium tuberculosis
LLALRASF

SEQ ID NO: 1520 - protein, 8 aa, Mycobacterium tuberculosis
LALRASFD

SEQ ID NO: 1521 - protein, 8 aa, Mycobacterium tuberculosis
ALRASFDR

SEQ ID NO: 1522 - protein, 8 aa, Mycobacterium tuberculosis
LRASFDRA

SEQ ID NO: 1523 - protein, 8 aa, Mycobacterium tuberculosis
RASFDRAA

SEQ ID NO: 1524 - protein, 8 aa, Mycobacterium tuberculosis
ASFDRAAE

SEQ ID NO: 1525 - protein, 8 aa, Mycobacterium tuberculosis
SFDRAAES

SEQ ID NO: 1526 - protein, 8 aa, Mycobacterium tuberculosis
FDRAAEST

SEQ ID NO: 1527 - protein, 8 aa, Mycobacterium tuberculosis
DRAAESTI

SEQ ID NO: 1528 - protein, 8 aa, Mycobacterium tuberculosis
RAAESTIA

SEQ ID NO: 1529 - protein, 8 aa, Mycobacterium tuberculosis
AAESTIAH

SEQ ID NO: 1530 - protein, 8 aa, Mycobacterium tuberculosis
AESTIAHF

SEQ ID NO: 1531 - protein, 8 aa, Mycobacterium tuberculosis
ESTIAHFT

SEQ ID NO: 1532 - protein, 8 aa, Mycobacterium tuberculosis
STIAHFTF

SEQ ID NO: 1533 - protein, 8 aa, Mycobacterium tuberculosis
TIAHFTFG

SEQ ID NO: 1534 - protein, 8 aa, Mycobacterium tuberculosis
IAHFTFGL

SEQ ID NO: 1535 - protein, 8 aa, Mycobacterium tuberculosis
AHFTFGLA

SEQ ID NO: 1536 - protein, 8 aa, Mycobacterium tuberculosis
HFTFGLAL

SEQ ID NO: 1537 - protein, 8 aa, Mycobacterium tuberculosis
FTFGLALL

SEQ ID NO: 1538 - protein, 8 aa, Mycobacterium tuberculosis
TFGLALLA

SEQ ID NO: 1539 - protein, 8 aa, Mycobacterium tuberculosis
FGLALLAG

SEQ ID NO: 1540 - protein, 8 aa, Mycobacterium tuberculosis
GLALLAGL

SEQ ID NO: 1541 - protein, 8 aa, Mycobacterium tuberculosis
LALLAGLY

SEQ ID NO: 1542 - protein, 8 aa, Mycobacterium tuberculosis
ALLAGLYV

SEQ ID NO: 1543 - protein, 8 aa, Mycobacterium tuberculosis
LLAGLYVA

SEQ ID NO: 1544 - protein, 8 aa, Mycobacterium tuberculosis
LAGLYVAA

SEQ ID NO: 1545 - protein, 8 aa, Mycobacterium tuberculosis
AGLYVAAS

SEQ ID NO: 1546 - protein, 8 aa, Mycobacterium tuberculosis
GLYVAASP

SEQ ID NO: 1547 - protein, 8 aa, Mycobacterium tuberculosis
LYVAASPW

SEQ ID NO: 1548 - protein, 8 aa, Mycobacterium tuberculosis
YVAASPWI

SEQ ID NO: 1549 - protein, 8 aa, Mycobacterium tuberculosis
VAASPWIV

SEQ ID NO: 1550 - protein, 8 aa, Mycobacterium tuberculosis
AASPWIVG

SEQ ID NO: 1551 - protein, 8 aa, Mycobacterium tuberculosis
ASPWIVGF

SEQ ID NO: 1552 - protein, 8 aa, Mycobacterium tuberculosis
SPWIVGFS

SEQ ID NO: 1553 - protein, 8 aa, Mycobacterium tuberculosis
PWIVGFSA

SEQ ID NO: 1554 - protein, 8 aa, Mycobacterium tuberculosis
WIVGFSAT

SEQ ID NO: 1555 - protein, 8 aa, Mycobacterium tuberculosis
IVGFSATR

SEQ ID NO: 1556 - protein, 8 aa, Mycobacterium tuberculosis
VGFSATRG

SEQ ID NO: 1557 - protein, 8 aa, Mycobacterium tuberculosis
GFSATRGL

SEQ ID NO: 1558 - protein, 8 aa, Mycobacterium tuberculosis
FSATRGLP

SEQ ID NO: 1559 - protein, 8 aa, Mycobacterium tuberculosis
SATRGLPT

SEQ ID NO: 1560 - protein, 8 aa, Mycobacterium tuberculosis
ATRGLPTC

SEQ ID NO: 1561 - protein, 8 aa, Mycobacterium tuberculosis
TRGLPTCD

SEQ ID NO: 1562 - protein, 8 aa, Mycobacterium tuberculosis
RGLPTCDL

SEQ ID NO: 1563 - protein, 8 aa, Mycobacterium tuberculosis
GLPTCDLI

SEQ ID NO: 1564 - protein, 8 aa, Mycobacterium tuberculosis
LPTCDLIV

SEQ ID NO: 1565 - protein, 8 aa, Mycobacterium tuberculosis
PTCDLIVG

SEQ ID NO: 1566 - protein, 8 aa, Mycobacterium tuberculosis
TCDLIVGI

SEQ ID NO: 1567 - protein, 8 aa, Mycobacterium tuberculosis
CDLIVGIA

SEQ ID NO: 1568 - protein, 8 aa, Mycobacterium tuberculosis
DLIVGIAV

SEQ ID NO: 1569 - protein, 8 aa, Mycobacterium tuberculosis
LIVGIAVA

SEQ ID NO: 1570 - protein, 8 aa, Mycobacterium tuberculosis
IVGIAVAY

SEQ ID NO: 1571 - protein, 8 aa, Mycobacterium tuberculosis
VGIAVAYL

SEQ ID NO: 1572 - protein, 8 aa, Mycobacterium tuberculosis
GIAVAYLA

SEQ ID NO: 1573 - protein, 8 aa, Mycobacterium tuberculosis
IAVAYLAY

SEQ ID NO: 1574 - protein, 8 aa, Mycobacterium tuberculosis
AVAYLAYG

SEQ ID NO: 1575 - protein, 8 aa, Mycobacterium tuberculosis
VAYLAYGF

SEQ ID NO: 1576 - protein, 8 aa, Mycobacterium tuberculosis
AYLAYGFA

SEQ ID NO: 1577 - protein, 8 aa, Mycobacterium tuberculosis
YLAYGFAS

SEQ ID NO: 1578 - protein, 8 aa, Mycobacterium tuberculosis
LAYGFASA

SEQ ID NO: 1579 - protein, 8 aa, Mycobacterium tuberculosis
AYGFASAL

SEQ ID NO: 1580 - protein, 8 aa, Mycobacterium tuberculosis
YGFASALD

SEQ ID NO: 1581 - protein, 8 aa, Mycobacterium tuberculosis
GFASALDR

SEQ ID NO: 1582 - protein, 8 aa, Mycobacterium tuberculosis
FASALDRT

SEQ ID NO: 1583 - protein, 8 aa, Mycobacterium tuberculosis
ASALDRTH

SEQ ID NO: 1584 - protein, 8 aa, Mycobacterium tuberculosis
SALDRTHG

SEQ ID NO: 1585 - protein, 8 aa, Mycobacterium tuberculosis
ALDRTHGM

SEQ ID NO: 1586 - protein, 8 aa, Mycobacterium tuberculosis
LDRTHGMT

SEQ ID NO: 1587 - protein, 8 aa, Mycobacterium tuberculosis
DRTHGMTW

SEQ ID NO: 1588 - protein, 8 aa, Mycobacterium tuberculosis
RTHGMTWT

SEQ ID NO: 1589 - protein, 8 aa, Mycobacterium tuberculosis
THGMTWTL

SEQ ID NO: 1590 - protein, 8 aa, Mycobacterium tuberculosis
HGMTWTLP

SEQ ID NO: 1591 - protein, 8 aa, Mycobacterium tuberculosis
GMTWTLPV

SEQ ID NO: 1592 - protein, 8 aa, Mycobacterium tuberculosis
MTWTLPVL

SEQ ID NO: 1593 - protein, 8 aa, Mycobacterium tuberculosis
TWTLPVLG

SEQ ID NO: 1594 - protein, 8 aa, Mycobacterium tuberculosis
WTLPVLGV

SEQ ID NO: 1595 - protein, 8 aa, Mycobacterium tuberculosis
TLPVLGVW

SEQ ID NO: 1596 - protein, 8 aa, Mycobacterium tuberculosis
LPVLGVWV

SEQ ID NO: 1597 - protein, 8 aa, Mycobacterium tuberculosis
PVLGVWVI

SEQ ID NO: 1598 - protein, 8 aa, Mycobacterium tuberculosis
VLGVWVIF

SEQ ID NO: 1599 - protein, 8 aa, Mycobacterium tuberculosis
LGVWVIFS

SEQ ID NO: 1600 - protein, 8 aa, Mycobacterium tuberculosis
GVWVIFSP

SEQ ID NO: 1601 - protein, 8 aa, Mycobacterium tuberculosis
VWVIFSPW

SEQ ID NO: 1602 - protein, 8 aa, Mycobacterium tuberculosis
WVIFSPWV

SEQ ID NO: 1603 - protein, 8 aa, Mycobacterium tuberculosis
VIFSPWVL

SEQ ID NO: 1604 - protein, 8 aa, Mycobacterium tuberculosis
IFSPWVLP

SEQ ID NO: 1605 - protein, 8 aa, Mycobacterium tuberculosis
FSPWVLPG

SEQ ID NO: 1606 - protein, 8 aa, Mycobacterium tuberculosis
SPWVLPGV

SEQ ID NO: 1607 - protein, 8 aa, Mycobacterium tuberculosis
PWVLPGVA

SEQ ID NO: 1608 - protein, 8 aa, Mycobacterium tuberculosis
WVLPGVAV

SEQ ID NO: 1609 - protein, 8 aa, Mycobacterium tuberculosis
VLPGVAVT

SEQ ID NO: 1610 - protein, 8 aa, Mycobacterium tuberculosis
LPGVAVTA

SEQ ID NO: 1611 - protein, 8 aa, Mycobacterium tuberculosis
PGVAVTAG

SEQ ID NO: 1612 - protein, 8 aa, Mycobacterium tuberculosis
GVAVTAGM

SEQ ID NO: 1613 - protein, 8 aa, Mycobacterium tuberculosis
VAVTAGMM

SEQ ID NO: 1614 - protein, 8 aa, Mycobacterium tuberculosis
AVTAGMMW

SEQ ID NO: 1615 - protein, 8 aa, Mycobacterium tuberculosis
VTAGMMWS

SEQ ID NO: 1616 - protein, 8 aa, Mycobacterium tuberculosis
TAGMMWSH

SEQ ID NO: 1617 - protein, 8 aa, Mycobacterium tuberculosis
AGMMWSHI

SEQ ID NO: 1618 - protein, 8 aa, Mycobacterium tuberculosis
GMMWSHII

SEQ ID NO: 1619 - protein, 8 aa, Mycobacterium tuberculosis
MMWSHIIA

SEQ ID NO: 1620 - protein, 8 aa, Mycobacterium tuberculosis
MWSHIIAG

SEQ ID NO: 1621 - protein, 8 aa, Mycobacterium tuberculosis
WSHIIAGA

SEQ ID NO: 1622 - protein, 8 aa, Mycobacterium tuberculosis
SHIIAGAV

SEQ ID NO: 1623 - protein, 8 aa, Mycobacterium tuberculosis
HIIAGAVV

SEQ ID NO: 1624 - protein, 8 aa, Mycobacterium tuberculosis
IIAGAVVA

SEQ ID NO: 1625 - protein, 8 aa, Mycobacterium tuberculosis
IAGAVVAV

SEQ ID NO: 1626 - protein, 8 aa, Mycobacterium tuberculosis
AGAVVAVL

SEQ ID NO: 1627 - protein, 8 aa, Mycobacterium tuberculosis
GAVVAVLG

SEQ ID NO: 1628 - protein, 8 aa, Mycobacterium tuberculosis
AVVAVLGF

SEQ ID NO: 1629 - protein, 8 aa, Mycobacterium tuberculosis
VVAVLGFY

SEQ ID NO: 1630 - protein, 8 aa, Mycobacterium tuberculosis
VAVLGFYF

SEQ ID NO: 1631 - protein, 8 aa, Mycobacterium tuberculosis
AVLGFYFG

SEQ ID NO: 1632 - protein, 8 aa, Mycobacterium tuberculosis
VLGFYFGM

SEQ ID NO: 1633 - protein, 8 aa, Mycobacterium tuberculosis
LGFYFGMR

SEQ ID NO: 1634 - protein, 8 aa, Mycobacterium tuberculosis
GFYFGMRT

SEQ ID NO: 1635 - protein, 8 aa, Mycobacterium tuberculosis
FYFGMRTR

SEQ ID NO: 1636 - protein, 8 aa, Mycobacterium tuberculosis
YFGMRTRA

SEQ ID NO: 1637 - protein, 8 aa, Mycobacterium tuberculosis
FGMRTRAA

SEQ ID NO: 1638 - protein, 8 aa, Mycobacterium tuberculosis
GMRTRAAA

SEQ ID NO: 1639 - protein, 8 aa, Mycobacterium tuberculosis
MRTRAAAN

SEQ ID NO: 1640 - protein, 8 aa, Mycobacterium tuberculosis
RTRAAANQ

SEQ ID NO: 1641 - protein, 9 aa, Mycobacterium tuberculosis
MSTVHSSID

SEQ ID NO: 1642 - protein, 9 aa, Mycobacterium tuberculosis
STVHSSIDQ

SEQ ID NO: 1643 - protein, 9 aa, Mycobacterium tuberculosis
TVHSSIDQH

SEQ ID NO: 1644 - protein, 9 aa, Mycobacterium tuberculosis
VHSSIDQHP

SEQ ID NO: 1645 - protein, 9 aa, Mycobacterium tuberculosis
HSSIDQHPD

SEQ ID NO: 1646 - protein, 9 aa, Mycobacterium tuberculosis
SSIDQHPDL

SEQ ID NO: 1647 - protein, 9 aa, Mycobacterium tuberculosis
SIDQHPDLL

SEQ ID NO: 1648 - protein, 9 aa, Mycobacterium tuberculosis
IDQHPDLLA

SEQ ID NO: 1649 - protein, 9 aa, Mycobacterium tuberculosis
DQHPDLLAL

SEQ ID NO: 1650 - protein, 9 aa, Mycobacterium tuberculosis
QHPDLLALR

SEQ ID NO: 1651 - protein, 9 aa, Mycobacterium tuberculosis
HPDLLALRA

SEQ ID NO: 1652 - protein, 9 aa, Mycobacterium tuberculosis
PDLLALRAS

SEQ ID NO: 1653 - protein, 9 aa, Mycobacterium tuberculosis
DLLALRASF

SEQ ID NO: 1654 - protein, 9 aa, Mycobacterium tuberculosis
LLALRASFD

SEQ ID NO: 1655 - protein, 9 aa, Mycobacterium tuberculosis
LALRASFDR

SEQ ID NO: 1656 - protein, 9 aa, Mycobacterium tuberculosis
ALRASFDRA

SEQ ID NO: 1657 - protein, 9 aa, Mycobacterium tuberculosis
LRASFDRAA

SEQ ID NO: 1658 - protein, 9 aa, Mycobacterium tuberculosis
RASFDRAAE

SEQ ID NO: 1659 - protein, 9 aa, Mycobacterium tuberculosis
ASFDRAAES

SEQ ID NO: 1660 - protein, 9 aa, Mycobacterium tuberculosis
SFDRAAEST

SEQ ID NO: 1661 - protein, 9 aa, Mycobacterium tuberculosis
FDRAAESTI

SEQ ID NO: 1662 - protein, 9 aa, Mycobacterium tuberculosis
DRAAESTIA

SEQ ID NO: 1663 - protein, 9 aa, Mycobacterium tuberculosis
RAAESTIAH

SEQ ID NO: 1664 - protein, 9 aa, Mycobacterium tuberculosis
AAESTIAHF

SEQ ID NO: 1665 - protein, 9 aa, Mycobacterium tuberculosis
AESTIAHFT

SEQ ID NO: 1666 - protein, 9 aa, Mycobacterium tuberculosis
ESTIAHFTF

SEQ ID NO: 1667 - protein, 9 aa, Mycobacterium tuberculosis
STIAHFTFG

SEQ ID NO: 1668 - protein, 9 aa, Mycobacterium tuberculosis
TIAHFTFGL

SEQ ID NO: 1669 - protein, 9 aa, Mycobacterium tuberculosis
IAHFTFGLA

SEQ ID NO: 1670 - protein, 9 aa, Mycobacterium tuberculosis
AHFTFGLAL

SEQ ID NO: 1671 - protein, 9 aa, Mycobacterium tuberculosis
HFTFGLALL

SEQ ID NO: 1672 - protein, 9 aa, Mycobacterium tuberculosis
FTFGLALLA

SEQ ID NO: 1673 - protein, 9 aa, Mycobacterium tuberculosis
TFGLALLAG

SEQ ID NO: 1674 - protein, 9 aa, Mycobacterium tuberculosis
FGLALLAGL

SEQ ID NO: 1675 - protein, 9 aa, Mycobacterium tuberculosis
GLALLAGLY

SEQ ID NO: 1676 - protein, 9 aa, Mycobacterium tuberculosis
LALLAGLYV

SEQ ID NO: 1677 - protein, 9 aa, Mycobacterium tuberculosis
ALLAGLYVA

SEQ ID NO: 1678 - protein, 9 aa, Mycobacterium tuberculosis
LLAGLYVAA

SEQ ID NO: 1679 - protein, 9 aa, Mycobacterium tuberculosis
LAGLYVAAS

SEQ ID NO: 1680 - protein, 9 aa, Mycobacterium tuberculosis
AGLYVAASP

SEQ ID NO: 1681 - protein, 9 aa, Mycobacterium tuberculosis
GLYVAASPW

SEQ ID NO: 1682 - protein, 9 aa, Mycobacterium tuberculosis
LYVAASPWI

SEQ ID NO: 1683 - protein, 9 aa, Mycobacterium tuberculosis
YVAASPWIV

SEQ ID NO: 1684 - protein, 9 aa, Mycobacterium tuberculosis
VAASPWIVG

SEQ ID NO: 1685 - protein, 9 aa, Mycobacterium tuberculosis
AASPWIVGF

SEQ ID NO: 1686 - protein, 9 aa, Mycobacterium tuberculosis
ASPWIVGFS

SEQ ID NO: 1687 - protein, 9 aa, Mycobacterium tuberculosis
SPWIVGFSA

SEQ ID NO: 1688 - protein, 9 aa, Mycobacterium tuberculosis
PWIVGFSAT

SEQ ID NO: 1689 - protein, 9 aa, Mycobacterium tuberculosis
WIVGFSATR

SEQ ID NO: 1690 - protein, 9 aa, Mycobacterium tuberculosis
IVGFSATRG

SEQ ID NO: 1691 - protein, 9 aa, Mycobacterium tuberculosis
VGFSATRGL

SEQ ID NO: 1692 - protein, 9 aa, Mycobacterium tuberculosis
GFSATRGLP

SEQ ID NO: 1693 - protein, 9 aa, Mycobacterium tuberculosis
FSATRGLPT

SEQ ID NO: 1694 - protein, 9 aa, Mycobacterium tuberculosis
SATRGLPTC

SEQ ID NO: 1695 - protein, 9 aa, Mycobacterium tuberculosis
ATRGLPTCD

SEQ ID NO: 1696 - protein, 9 aa, Mycobacterium tuberculosis
TRGLPTCDL

SEQ ID NO: 1697 - protein, 9 aa, Mycobacterium tuberculosis
RGLPTCDLI

SEQ ID NO: 1698 - protein, 9 aa, Mycobacterium tuberculosis
GLPTCDLIV

SEQ ID NO: 1699 - protein, 9 aa, Mycobacterium tuberculosis
LPTCDLIVG

SEQ ID NO: 1700 - protein, 9 aa, Mycobacterium tuberculosis
PTCDLIVGI

SEQ ID NO: 1701 - protein, 9 aa, Mycobacterium tuberculosis
TCDLIVGIA

SEQ ID NO: 1702 - protein, 9 aa, Mycobacterium tuberculosis
CDLIVGIAV

SEQ ID NO: 1703 - protein, 9 aa, Mycobacterium tuberculosis
DLIVGIAVA

SEQ ID NO: 1704 - protein, 9 aa, Mycobacterium tuberculosis
LIVGIAVAY

SEQ ID NO: 1705 - protein, 9 aa, Mycobacterium tuberculosis
IVGIAVAYL

SEQ ID NO: 1706 - protein, 9 aa, Mycobacterium tuberculosis
VGIAVAYLA

SEQ ID NO: 1707 - protein, 9 aa, Mycobacterium tuberculosis
GIAVAYLAY

SEQ ID NO: 1708 - protein, 9 aa, Mycobacterium tuberculosis
IAVAYLAYG

SEQ ID NO: 1709 - protein, 9 aa, Mycobacterium tuberculosis
AVAYLAYGF

SEQ ID NO: 1710 - protein, 9 aa, Mycobacterium tuberculosis
VAYLAYGFA

SEQ ID NO: 1711 - protein, 9 aa, Mycobacterium tuberculosis
AYLAYGFAS

SEQ ID NO: 1712 - protein, 9 aa, Mycobacterium tuberculosis
YLAYGFASA

SEQ ID NO: 1713 - protein, 9 aa, Mycobacterium tuberculosis
LAYGFASAL

SEQ ID NO: 1714 - protein, 9 aa, Mycobacterium tuberculosis
AYGFASALD

SEQ ID NO: 1715 - protein, 9 aa, Mycobacterium tuberculosis
YGFASALDR

SEQ ID NO: 1716 - protein, 9 aa, Mycobacterium tuberculosis
GFASALDRT

SEQ ID NO: 1717 - protein, 9 aa, Mycobacterium tuberculosis
FASALDRTH

SEQ ID NO: 1718 - protein, 9 aa, Mycobacterium tuberculosis
ASALDRTHG

SEQ ID NO: 1719 - protein, 9 aa, Mycobacterium tuberculosis
SALDRTHGM

SEQ ID NO: 1720 - protein, 9 aa, Mycobacterium tuberculosis
ALDRTHGMT

SEQ ID NO: 1721 - protein, 9 aa, Mycobacterium tuberculosis
LDRTHGMTW

SEQ ID NO: 1722 - protein, 9 aa, Mycobacterium tuberculosis
DRTHGMTWT

SEQ ID NO: 1723 - protein, 9 aa, Mycobacterium tuberculosis
RTHGMTWTL

SEQ ID NO: 1724 - protein, 9 aa, Mycobacterium tuberculosis
THGMTWTLP

SEQ ID NO: 1725 - protein, 9 aa, Mycobacterium tuberculosis
HGMTWTLPV

SEQ ID NO: 1726 - protein, 9 aa, Mycobacterium tuberculosis
GMTWTLPVL

SEQ ID NO: 1727 - protein, 9 aa, Mycobacterium tuberculosis
MTWTLPVLG

SEQ ID NO: 1728 - protein, 9 aa, Mycobacterium tuberculosis
TWTLPVLGV

SEQ ID NO: 1729 - protein, 9 aa, Mycobacterium tuberculosis
WTLPVLGVW

SEQ ID NO: 1730 - protein, 9 aa, Mycobacterium tuberculosis
TLPVLGVWV

SEQ ID NO: 1731 - protein, 9 aa, Mycobacterium tuberculosis
LPVLGVWVI

SEQ ID NO: 1732 - protein, 9 aa, Mycobacterium tuberculosis
PVLGVWVIF

SEQ ID NO: 1733 - protein, 9 aa, Mycobacterium tuberculosis
VLGVWVIFS

SEQ ID NO: 1734 - protein, 9 aa, Mycobacterium tuberculosis
LGVWVIFSP

SEQ ID NO: 1735 - protein, 9 aa, Mycobacterium tuberculosis
GVWVIFSPW

SEQ ID NO: 1736 - protein, 9 aa, Mycobacterium tuberculosis
VWVIFSPWV

SEQ ID NO: 1737 - protein, 9 aa, Mycobacterium tuberculosis
WVIFSPWVL

SEQ ID NO: 1738 - protein, 9 aa, Mycobacterium tuberculosis
VIFSPWVLP

SEQ ID NO: 1739 - protein, 9 aa, Mycobacterium tuberculosis
IFSPWVLPG

SEQ ID NO: 1740 - protein, 9 aa, Mycobacterium tuberculosis
FSPWVLPGV

SEQ ID NO: 1741 - protein, 9 aa, Mycobacterium tuberculosis
SPWVLPGVA

SEQ ID NO: 1742 - protein, 9 aa, Mycobacterium tuberculosis
PWVLPGVAV

SEQ ID NO: 1743 - protein, 9 aa, Mycobacterium tuberculosis
WVLPGVAVT

SEQ ID NO: 1744 - protein, 9 aa, Mycobacterium tuberculosis
VLPGVAVTA

SEQ ID NO: 1745 - protein, 9 aa, Mycobacterium tuberculosis
LPGVAVTAG

SEQ ID NO: 1746 - protein, 9 aa, Mycobacterium tuberculosis
PGVAVTAGM

SEQ ID NO: 1747 - protein, 9 aa, Mycobacterium tuberculosis
GVAVTAGMM

SEQ ID NO: 1748 - protein, 9 aa, Mycobacterium tuberculosis
VAVTAGMMW

SEQ ID NO: 1749 - protein, 9 aa, Mycobacterium tuberculosis
AVTAGMMWS

SEQ ID NO: 1750 - protein, 9 aa, Mycobacterium tuberculosis
VTAGMMWSH

SEQ ID NO: 1751 - protein, 9 aa, Mycobacterium tuberculosis
TAGMMWSHI

SEQ ID NO: 1752 - protein, 9 aa, Mycobacterium tuberculosis
AGMMWSHII

SEQ ID NO: 1753 - protein, 9 aa, Mycobacterium tuberculosis
GMMWSHIIA

SEQ ID NO: 1754 - protein, 9 aa, Mycobacterium tuberculosis
MMWSHIIAG

SEQ ID NO: 1755 - protein, 9 aa, Mycobacterium tuberculosis
MWSHIIAGA

SEQ ID NO: 1756 - protein, 9 aa, Mycobacterium tuberculosis
WSHIIAGAV

SEQ ID NO: 1757 - protein, 9 aa, Mycobacterium tuberculosis
SHIIAGAVV

SEQ ID NO: 1758 - protein, 9 aa, Mycobacterium tuberculosis
HIIAGAVVA

SEQ ID NO: 1759 - protein, 9 aa, Mycobacterium tuberculosis
IIAGAVVAV

SEQ ID NO: 1760 - protein, 9 aa, Mycobacterium tuberculosis
IAGAVVAVL

SEQ ID NO: 1761 - protein, 9 aa, Mycobacterium tuberculosis
AGAVVAVLG

SEQ ID NO: 1762 - protein, 9 aa, Mycobacterium tuberculosis
GAVVAVLGF

SEQ ID NO: 1763 - protein, 9 aa, Mycobacterium tuberculosis
AVVAVLGFY

SEQ ID NO: 1764 - protein, 9 aa, Mycobacterium tuberculosis
VVAVLGFYF

SEQ ID NO: 1765 - protein, 9 aa, Mycobacterium tuberculosis
VAVLGFYFG

SEQ ID NO: 1766 - protein, 9 aa, Mycobacterium tuberculosis
AVLGFYFGM

SEQ ID NO: 1767 - protein, 9 aa, Mycobacterium tuberculosis
VLGFYFGMR

SEQ ID NO: 1768 - protein, 9 aa, Mycobacterium tuberculosis
LGFYFGMRT

SEQ ID NO: 1769 - protein, 9 aa, Mycobacterium tuberculosis
GFYFGMRTR

SEQ ID NO: 1770 - protein, 9 aa, Mycobacterium tuberculosis
FYFGMRTRA

SEQ ID NO: 1771 - protein, 9 aa, Mycobacterium tuberculosis
YFGMRTRAA

SEQ ID NO: 1772 - protein, 9 aa, Mycobacterium tuberculosis
FGMRTRAAA

SEQ ID NO: 1773 - protein, 9 aa, Mycobacterium tuberculosis
GMRTRAAAN

SEQ ID NO: 1774 - protein, 9 aa, Mycobacterium tuberculosis
MRTRAAANQ

SEQ ID NO: 1775 - protein, 9 aa, Mycobacterium tuberculosis
RTRAAANQG

SEQ ID NO: 1776 - protein, 10 aa, Mycobacterium tuberculosis
MSTVHSSIDQ

SEQ ID NO: 1777 - protein, 10 aa, Mycobacterium tuberculosis
STVHSSIDQH

SEQ ID NO: 1778 - protein, 10 aa, Mycobacterium tuberculosis
TVHSSIDQHP

SEQ ID NO: 1779 - protein, 10 aa, Mycobacterium tuberculosis
VHSSIDQHPD

SEQ ID NO: 1780 - protein, 10 aa, Mycobacterium tuberculosis
HSSIDQHPDL

SEQ ID NO: 1781 - protein, 10 aa, Mycobacterium tuberculosis
SSIDQHPDLL

SEQ ID NO: 1782 - protein, 10 aa, Mycobacterium tuberculosis
SIDQHPDLLA

SEQ ID NO: 1783 - protein, 10 aa, Mycobacterium tuberculosis
IDQHPDLLAL

SEQ ID NO: 1784 - protein, 10 aa, Mycobacterium tuberculosis
DQHPDLLALR

SEQ ID NO: 1785 - protein, 10 aa, Mycobacterium tuberculosis
QHPDLLALRA

SEQ ID NO: 1786 - protein, 10 aa, Mycobacterium tuberculosis
HPDLLALRAS

SEQ ID NO: 1787 - protein, 10 aa, Mycobacterium tuberculosis
PDLLALRASF

SEQ ID NO: 1788 - protein, 10 aa, Mycobacterium tuberculosis
DLLALRASFD

SEQ ID NO: 1789 - protein, 10 aa, Mycobacterium tuberculosis
LLALRASFDR

SEQ ID NO: 1790 - protein, 10 aa, Mycobacterium tuberculosis
LALRASFDRA

SEQ ID NO: 1791 - protein, 10 aa, Mycobacterium tuberculosis
ALRASFDRAA

SEQ ID NO: 1792 - protein, 10 aa, Mycobacterium tuberculosis
LRASFDRAAE

SEQ ID NO: 1793 - protein, 10 aa, Mycobacterium tuberculosis
RASFDRAAES

SEQ ID NO: 1794 - protein, 10 aa, Mycobacterium tuberculosis
ASFDRAAEST

SEQ ID NO: 1795 - protein, 10 aa, Mycobacterium tuberculosis
SFDRAAESTI

SEQ ID NO: 1796 - protein, 10 aa, Mycobacterium tuberculosis
FDRAAESTIA

SEQ ID NO: 1797 - protein, 10 aa, Mycobacterium tuberculosis
DRAAESTIAH

SEQ ID NO: 1798 - protein, 10 aa, Mycobacterium tuberculosis
RAAESTIAHF

SEQ ID NO: 1799 - protein, 10 aa, Mycobacterium tuberculosis
AAESTIAHFT

SEQ ID NO: 1800 - protein, 10 aa, Mycobacterium tuberculosis
AESTIAHFTF

SEQ ID NO: 1801 - protein, 10 aa, Mycobacterium tuberculosis
ESTIAHFTFG

SEQ ID NO: 1802 - protein, 10 aa, Mycobacterium tuberculosis
STIAHFTFGL

SEQ ID NO: 1803 - protein, 10 aa, Mycobacterium tuberculosis
TIAHFTFGLA

SEQ ID NO: 1804 - protein, 10 aa, Mycobacterium tuberculosis
IAHFTFGLAL

SEQ ID NO: 1805 - protein, 10 aa, Mycobacterium tuberculosis
AHFTFGLALL

SEQ ID NO: 1806 - protein, 10 aa, Mycobacterium tuberculosis
HFTFGLALLA

SEQ ID NO: 1807 - protein, 10 aa, Mycobacterium tuberculosis
FTFGLALLAG

SEQ ID NO: 1808 - protein, 10 aa, Mycobacterium tuberculosis
TFGLALLAGL

SEQ ID NO: 1809 - protein, 10 aa, Mycobacterium tuberculosis
FGLALLAGLY

SEQ ID NO: 1810 - protein, 10 aa, Mycobacterium tuberculosis
GLALLAGLYV

SEQ ID NO: 1811 - protein, 10 aa, Mycobacterium tuberculosis
LALLAGLYVA

SEQ ID NO: 1812 - protein, 10 aa, Mycobacterium tuberculosis
ALLAGLYVAA

SEQ ID NO: 1813 - protein, 10 aa, Mycobacterium tuberculosis
LLAGLYVAAS

SEQ ID NO: 1814 - protein, 10 aa, Mycobacterium tuberculosis
LAGLYVAASP

SEQ ID NO: 1815 - protein, 10 aa, Mycobacterium tuberculosis
AGLYVAASPW

SEQ ID NO: 1816 - protein, 10 aa, Mycobacterium tuberculosis
GLYVAASPWI

SEQ ID NO: 1817 - protein, 10 aa, Mycobacterium tuberculosis
LYVAASPWIV

SEQ ID NO: 1818 - protein, 10 aa, Mycobacterium tuberculosis
YVAASPWIVG

SEQ ID NO: 1819 - protein, 10 aa, Mycobacterium tuberculosis
VAASPWIVGF

SEQ ID NO: 1820 - protein, 10 aa, Mycobacterium tuberculosis
AASPWIVGFS

SEQ ID NO: 1821 - protein, 10 aa, Mycobacterium tuberculosis
ASPWIVGFSA

SEQ ID NO: 1822 - protein, 10 aa, Mycobacterium tuberculosis
SPWIVGFSAT

SEQ ID NO: 1823 - protein, 10 aa, Mycobacterium tuberculosis
PWIVGFSATR

SEQ ID NO: 1824 - protein, 10 aa, Mycobacterium tuberculosis
WIVGFSATRG

SEQ ID NO: 1825 - protein, 10 aa, Mycobacterium tuberculosis
IVGFSATRGL

SEQ ID NO: 1826 - protein, 10 aa, Mycobacterium tuberculosis
VGFSATRGLP

SEQ ID NO: 1827 - protein, 10 aa, Mycobacterium tuberculosis
GFSATRGLPT

SEQ ID NO: 1828 - protein, 10 aa, Mycobacterium tuberculosis
FSATRGLPTC

SEQ ID NO: 1829 - protein, 10 aa, Mycobacterium tuberculosis
SATRGLPTCD

SEQ ID NO: 1830 - protein, 10 aa, Mycobacterium tuberculosis
ATRGLPTCDL

SEQ ID NO: 1831 - protein, 10 aa, Mycobacterium tuberculosis
TRGLPTCDLI

SEQ ID NO: 1832 - protein, 10 aa, Mycobacterium tuberculosis
RGLPTCDLIV

SEQ ID NO: 1833 - protein, 10 aa, Mycobacterium tuberculosis
GLPTCDLIVG

SEQ ID NO: 1834 - protein, 10 aa, Mycobacterium tuberculosis
LPTCDLIVGI

SEQ ID NO: 1835 - protein, 10 aa, Mycobacterium tuberculosis
PTCDLIVGIA

SEQ ID NO: 1836 - protein, 10 aa, Mycobacterium tuberculosis
TCDLIVGIAV

SEQ ID NO: 1837 - protein, 10 aa, Mycobacterium tuberculosis
CDLIVGIAVA

SEQ ID NO: 1838 - protein, 10 aa, Mycobacterium tuberculosis
DLIVGIAVAY

SEQ ID NO: 1839 - protein, 10 aa, Mycobacterium tuberculosis
LIVGIAVAYL

SEQ ID NO: 1840 - protein, 10 aa, Mycobacterium tuberculosis
IVGIAVAYLA

SEQ ID NO: 1841 - protein, 10 aa, Mycobacterium tuberculosis
VGIAVAYLAY

SEQ ID NO: 1842 - protein, 10 aa, Mycobacterium tuberculosis
GIAVAYLAYG

SEQ ID NO: 1843 - protein, 10 aa, Mycobacterium tuberculosis
IAVAYLAYGF

SEQ ID NO: 1844 - protein, 10 aa, Mycobacterium tuberculosis
AVAYLAYGFA

SEQ ID NO: 1845 - protein, 10 aa, Mycobacterium tuberculosis
VAYLAYGFAS

SEQ ID NO: 1846 - protein, 10 aa, Mycobacterium tuberculosis
AYLAYGFASA

SEQ ID NO: 1847 - protein, 10 aa, Mycobacterium tuberculosis
YLAYGFASAL

SEQ ID NO: 1848 - protein, 10 aa, Mycobacterium tuberculosis
LAYGFASALD

SEQ ID NO: 1849 - protein, 10 aa, Mycobacterium tuberculosis
AYGFASALDR

SEQ ID NO: 1850 - protein, 10 aa, Mycobacterium tuberculosis
YGFASALDRT

SEQ ID NO: 1851 - protein, 10 aa, Mycobacterium tuberculosis
GFASALDRTH

SEQ ID NO: 1852 - protein, 10 aa, Mycobacterium tuberculosis
FASALDRTHG

SEQ ID NO: 1853 - protein, 10 aa, Mycobacterium tuberculosis
ASALDRTHGM

SEQ ID NO: 1854 - protein, 10 aa, Mycobacterium tuberculosis
SALDRTHGMT

SEQ ID NO: 1855 - protein, 10 aa, Mycobacterium tuberculosis
ALDRTHGMTW

SEQ ID NO: 1856 - protein, 10 aa, Mycobacterium tuberculosis
LDRTHGMTWT

SEQ ID NO: 1857 - protein, 10 aa, Mycobacterium tuberculosis
DRTHGMTWTL

SEQ ID NO: 1858 - protein, 10 aa, Mycobacterium tuberculosis
RTHGMTWTLP

SEQ ID NO: 1859 - protein, 10 aa, Mycobacterium tuberculosis
THGMTWTLPV

SEQ ID NO: 1860 - protein, 10 aa, Mycobacterium tuberculosis
HGMTWTLPVL

SEQ ID NO: 1861 - protein, 10 aa, Mycobacterium tuberculosis
GMTWTLPVLG

SEQ ID NO: 1862 - protein, 10 aa, Mycobacterium tuberculosis
MTWTLPVLGV

SEQ ID NO: 1863 - protein, 10 aa, Mycobacterium tuberculosis
TWTLPVLGVW

SEQ ID NO: 1864 - protein, 10 aa, Mycobacterium tuberculosis
WTLPVLGVWV

SEQ ID NO: 1865 - protein, 10 aa, Mycobacterium tuberculosis
TLPVLGVWVI

SEQ ID NO: 1866 - protein, 10 aa, Mycobacterium tuberculosis
LPVLGVWVIF

SEQ ID NO: 1867 - protein, 10 aa, Mycobacterium tuberculosis
PVLGVWVIFS

SEQ ID NO: 1868 - protein, 10 aa, Mycobacterium tuberculosis
VLGVWVIFSP

SEQ ID NO: 1869 - protein, 10 aa, Mycobacterium tuberculosis
LGVWVIFSPW

SEQ ID NO: 1870 - protein, 10 aa, Mycobacterium tuberculosis
GVWVIFSPWV

SEQ ID NO: 1871 - protein, 10 aa, Mycobacterium tuberculosis
VWVIFSPWVL

SEQ ID NO: 1872 - protein, 10 aa, Mycobacterium tuberculosis
WVIFSPWVLP

SEQ ID NO: 1873 - protein, 10 aa, Mycobacterium tuberculosis
VIFSPWVLPG

SEQ ID NO: 1874 - protein, 10 aa, Mycobacterium tuberculosis
IFSPWVLPGV

SEQ ID NO: 1875 - protein, 10 aa, Mycobacterium tuberculosis
FSPWVLPGVA

SEQ ID NO: 1876 - protein, 10 aa, Mycobacterium tuberculosis
SPWVLPGVAV

SEQ ID NO: 1877 - protein, 10 aa, Mycobacterium tuberculosis
PWVLPGVAVT

SEQ ID NO: 1878 - protein, 10 aa, Mycobacterium tuberculosis
WVLPGVAVTA

SEQ ID NO: 1879 - protein, 10 aa, Mycobacterium tuberculosis
VLPGVAVTAG

SEQ ID NO: 1880 - protein, 10 aa, Mycobacterium tuberculosis
LPGVAVTAGM

SEQ ID NO: 1881 - protein, 10 aa, Mycobacterium tuberculosis
PGVAVTAGMM

SEQ ID NO: 1882 - protein, 10 aa, Mycobacterium tuberculosis
GVAVTAGMMW

SEQ ID NO: 1883 - protein, 10 aa, Mycobacterium tuberculosis
VAVTAGMMWS

SEQ ID NO: 1884 - protein, 10 aa, Mycobacterium tuberculosis
AVTAGMMWSH

SEQ ID NO: 1885 - protein, 10 aa, Mycobacterium tuberculosis
VTAGMMWSHI

SEQ ID NO: 1886 - protein, 10 aa, Mycobacterium tuberculosis
TAGMMWSHII

SEQ ID NO: 1887 - protein, 10 aa, Mycobacterium tuberculosis
AGMMWSHIIA

SEQ ID NO: 1888 - protein, 10 aa, Mycobacterium tuberculosis
GMMWSHIIAG

SEQ ID NO: 1889 - protein, 10 aa, Mycobacterium tuberculosis
MMWSHIIAGA

SEQ ID NO: 1890 - protein, 10 aa, Mycobacterium tuberculosis
MWSHIIAGAV

SEQ ID NO: 1891 - protein, 10 aa, Mycobacterium tuberculosis
WSHIIAGAVV

SEQ ID NO: 1892 - protein, 10 aa, Mycobacterium tuberculosis
SHIIAGAVVA

SEQ ID NO: 1893 - protein, 10 aa, Mycobacterium tuberculosis
HIIAGAVVAV

SEQ ID NO: 1894 - protein, 10 aa, Mycobacterium tuberculosis
IIAGAVVAVL

SEQ ID NO: 1895 - protein, 10 aa, Mycobacterium tuberculosis
IAGAVVAVLG

SEQ ID NO: 1896 - protein, 10 aa, Mycobacterium tuberculosis
AGAVVAVLGF

SEQ ID NO: 1897 - protein, 10 aa, Mycobacterium tuberculosis
GAVVAVLGFY

SEQ ID NO: 1898 - protein, 10 aa, Mycobacterium tuberculosis
AVVAVLGFYF

SEQ ID NO: 1899 - protein, 10 aa, Mycobacterium tuberculosis
VVAVLGFYFG

SEQ ID NO: 1900 - protein, 10 aa, Mycobacterium tuberculosis
VAVLGFYFGM

SEQ ID NO: 1901 - protein, 10 aa, Mycobacterium tuberculosis
AVLGFYFGMR

SEQ ID NO: 1902 - protein, 10 aa, Mycobacterium tuberculosis
VLGFYFGMRT

SEQ ID NO: 1903 - protein, 10 aa, Mycobacterium tuberculosis
LGFYFGMRTR

SEQ ID NO: 1904 - protein, 10 aa, Mycobacterium tuberculosis
GFYFGMRTRA

SEQ ID NO: 1905 - protein, 10 aa, Mycobacterium tuberculosis
FYFGMRTRAA

SEQ ID NO: 1906 - protein, 10 aa, Mycobacterium tuberculosis
YFGMRTRAAA

SEQ ID NO: 1907 - protein, 10 aa, Mycobacterium tuberculosis
FGMRTRAAAN

SEQ ID NO: 1908 - protein, 10 aa, Mycobacterium tuberculosis
GMRTRAAANQ

SEQ ID NO: 1909 - protein, 10 aa, Mycobacterium tuberculosis
MRTRAAANQG

SEQ ID NO: 1910 - protein, 11 aa, Mycobacterium tuberculosis
MSTVHSSIDQH

SEQ ID NO: 1911 - protein, 11 aa, Mycobacterium tuberculosis
STVHSSIDQHP

SEQ ID NO: 1912 - protein, 11 aa, Mycobacterium tuberculosis
TVHSSIDQHPD

SEQ ID NO: 1913 - protein, 11 aa, Mycobacterium tuberculosis
VHSSIDQHPDL

SEQ ID NO: 1914 - protein, 11 aa, Mycobacterium tuberculosis
HSSIDQHPDLL

SEQ ID NO: 1915 - protein, 11 aa, Mycobacterium tuberculosis
SSIDQHPDLLA

SEQ ID NO: 1916 - protein, 11 aa, Mycobacterium tuberculosis
SIDQHPDLLAL

SEQ ID NO: 1917 - protein, 11 aa, Mycobacterium tuberculosis
IDQHPDLLALR

SEQ ID NO: 1918 - protein, 11 aa, Mycobacterium tuberculosis
DQHPDLLALRA

SEQ ID NO: 1919 - protein, 11 aa, Mycobacterium tuberculosis
QHPDLLALRAS

SEQ ID NO: 1920 - protein, 11 aa, Mycobacterium tuberculosis
HPDLLALRASF

SEQ ID NO: 1921 - protein, 11 aa, Mycobacterium tuberculosis
PDLLALRASFD

SEQ ID NO: 1922 - protein, 11 aa, Mycobacterium tuberculosis
DLLALRASFDR

SEQ ID NO: 1923 - protein, 11 aa, Mycobacterium tuberculosis
LLALRASFDRA

SEQ ID NO: 1924 - protein, 11 aa, Mycobacterium tuberculosis
LALRASFDRAA

SEQ ID NO: 1925 - protein, 11 aa, Mycobacterium tuberculosis
ALRASFDRAAE

SEQ ID NO: 1926 - protein, 11 aa, Mycobacterium tuberculosis
LRASFDRAAES

SEQ ID NO: 1927 - protein, 11 aa, Mycobacterium tuberculosis
RASFDRAAEST

SEQ ID NO: 1928 - protein, 11 aa, Mycobacterium tuberculosis
ASFDRAAESTI

SEQ ID NO: 1929 - protein, 11 aa, Mycobacterium tuberculosis
SFDRAAESTIA

SEQ ID NO: 1930 - protein, 11 aa, Mycobacterium tuberculosis
FDRAAESTIAH

SEQ ID NO: 1931 - protein, 11 aa, Mycobacterium tuberculosis
DRAAESTIAHF

SEQ ID NO: 1932 - protein, 11 aa, Mycobacterium tuberculosis
RAAESTIAHFT

SEQ ID NO: 1933 - protein, 11 aa, Mycobacterium tuberculosis
AAESTIAHFTF

SEQ ID NO: 1934 - protein, 11 aa, Mycobacterium tuberculosis
AESTIAHFTFG

SEQ ID NO: 1935 - protein, 11 aa, Mycobacterium tuberculosis
ESTIAHFTFGL

SEQ ID NO: 1936 - protein, 11 aa, Mycobacterium tuberculosis
STIAHFTFGLA

SEQ ID NO: 1937 - protein, 11 aa, Mycobacterium tuberculosis
TIAHFTFGLAL

SEQ ID NO: 1938 - protein, 11 aa, Mycobacterium tuberculosis
IAHFTFGLALL

SEQ ID NO: 1939 - protein, 11 aa, Mycobacterium tuberculosis
AHFTFGLALLA

SEQ ID NO: 1940 - protein, 11 aa, Mycobacterium tuberculosis
HFTFGLALLAG

SEQ ID NO: 1941 - protein, 11 aa, Mycobacterium tuberculosis
FTFGLALLAGL

SEQ ID NO: 1942 - protein, 11 aa, Mycobacterium tuberculosis
TFGLALLAGLY

SEQ ID NO: 1943 - protein, 11 aa, Mycobacterium tuberculosis
FGLALLAGLYV

SEQ ID NO: 1944 - protein, 11 aa, Mycobacterium tuberculosis
GLALLAGLYVA

SEQ ID NO: 1945 - protein, 11 aa, Mycobacterium tuberculosis
LALLAGLYVAA

SEQ ID NO: 1946 - protein, 11 aa, Mycobacterium tuberculosis
ALLAGLYVAAS

SEQ ID NO: 1947 - protein, 11 aa, Mycobacterium tuberculosis
LLAGLYVAASP

SEQ ID NO: 1948 - protein, 11 aa, Mycobacterium tuberculosis
LAGLYVAASPW

SEQ ID NO: 1949 - protein, 11 aa, Mycobacterium tuberculosis
AGLYVAASPWI

SEQ ID NO: 1950 - protein, 11 aa, Mycobacterium tuberculosis
GLYVAASPWIV

SEQ ID NO: 1951 - protein, 11 aa, Mycobacterium tuberculosis
LYVAASPWIVG

SEQ ID NO: 1952 - protein, 11 aa, Mycobacterium tuberculosis
YVAASPWIVGF

SEQ ID NO: 1953 - protein, 11 aa, Mycobacterium tuberculosis
VAASPWIVGFS

SEQ ID NO: 1954 - protein, 11 aa, Mycobacterium tuberculosis
AASPWIVGFSA

SEQ ID NO: 1955 - protein, 11 aa, Mycobacterium tuberculosis
ASPWIVGFSAT

SEQ ID NO: 1956 - protein, 11 aa, Mycobacterium tuberculosis
SPWIVGFSATR

SEQ ID NO: 1957 - protein, 11 aa, Mycobacterium tuberculosis
PWIVGFSATRG

SEQ ID NO: 1958 - protein, 11 aa, Mycobacterium tuberculosis
WIVGFSATRGL

SEQ ID NO: 1959 - protein, 11 aa, Mycobacterium tuberculosis
IVGFSATRGLP

SEQ ID NO: 1960 - protein, 11 aa, Mycobacterium tuberculosis
VGFSATRGLPT

SEQ ID NO: 1961 - protein, 11 aa, Mycobacterium tuberculosis
GFSATRGLPTC

SEQ ID NO: 1962 - protein, 11 aa, Mycobacterium tuberculosis
FSATRGLPTCD

SEQ ID NO: 1963 - protein, 11 aa, Mycobacterium tuberculosis
SATRGLPTCDL

SEQ ID NO: 1964 - protein, 11 aa, Mycobacterium tuberculosis
ATRGLPTCDLI

SEQ ID NO: 1965 - protein, 11 aa, Mycobacterium tuberculosis
TRGLPTCDLIV

SEQ ID NO: 1966 - protein, 11 aa, Mycobacterium tuberculosis
RGLPTCDLIVG

SEQ ID NO: 1967 - protein, 11 aa, Mycobacterium tuberculosis
GLPTCDLIVGI

SEQ ID NO: 1968 - protein, 11 aa, Mycobacterium tuberculosis
LPTCDLIVGIA

SEQ ID NO: 1969 - protein, 11 aa, Mycobacterium tuberculosis
PTCDLIVGIAV

SEQ ID NO: 1970 - protein, 11 aa, Mycobacterium tuberculosis
TCDLIVGIAVA

SEQ ID NO: 1971 - protein, 11 aa, Mycobacterium tuberculosis
CDLIVGIAVAY

SEQ ID NO: 1972 - protein, 11 aa, Mycobacterium tuberculosis
DLIVGIAVAYL

SEQ ID NO: 1973 - protein, 11 aa, Mycobacterium tuberculosis
LIVGIAVAYLA

SEQ ID NO: 1974 - protein, 11 aa, Mycobacterium tuberculosis
IVGIAVAYLAY

SEQ ID NO: 1975 - protein, 11 aa, Mycobacterium tuberculosis
VGIAVAYLAYG

SEQ ID NO: 1976 - protein, 11 aa, Mycobacterium tuberculosis
GIAVAYLAYGF

SEQ ID NO: 1977 - protein, 11 aa, Mycobacterium tuberculosis
IAVAYLAYGFA

SEQ ID NO: 1978 - protein, 11 aa, Mycobacterium tuberculosis
AVAYLAYGFAS

SEQ ID NO: 1979 - protein, 11 aa, Mycobacterium tuberculosis
VAYLAYGFASA

SEQ ID NO: 1980 - protein, 11 aa, Mycobacterium tuberculosis
AYLAYGFASAL

SEQ ID NO: 1981 - protein, 11 aa, Mycobacterium tuberculosis
YLAYGFASALD

SEQ ID NO: 1982 - protein, 11 aa, Mycobacterium tuberculosis
LAYGFASALDR

SEQ ID NO: 1983 - protein, 11 aa, Mycobacterium tuberculosis
AYGFASALDRT

SEQ ID NO: 1984 - protein, 11 aa, Mycobacterium tuberculosis
YGFASALDRTH

SEQ ID NO: 1985 - protein, 11 aa, Mycobacterium tuberculosis
GFASALDRTHG

SEQ ID NO: 1986 - protein, 11 aa, Mycobacterium tuberculosis
FASALDRTHGM

SEQ ID NO: 1987 - protein, 11 aa, Mycobacterium tuberculosis
ASALDRTHGMT

SEQ ID NO: 1988 - protein, 11 aa, Mycobacterium tuberculosis
SALDRTHGMTW

SEQ ID NO: 1989 - protein, 11 aa, Mycobacterium tuberculosis
ALDRTHGMTWT

SEQ ID NO: 1990 - protein, 11 aa, Mycobacterium tuberculosis
LDRTHGMTWTL

SEQ ID NO: 1991 - protein, 11 aa, Mycobacterium tuberculosis
DRTHGMTWTLP

SEQ ID NO: 1992 - protein, 11 aa, Mycobacterium tuberculosis
RTHGMTWTLPV

SEQ ID NO: 1993 - protein, 11 aa, Mycobacterium tuberculosis
THGMTWTLPVL

SEQ ID NO: 1994 - protein, 11 aa, Mycobacterium tuberculosis
HGMTWTLPVLG

SEQ ID NO: 1995 - protein, 11 aa, Mycobacterium tuberculosis
GMTWTLPVLGV

SEQ ID NO: 1996 - protein, 11 aa, Mycobacterium tuberculosis
MTWTLPVLGVW

SEQ ID NO: 1997 - protein, 11 aa, Mycobacterium tuberculosis
TWTLPVLGVWV

SEQ ID NO: 1998 - protein, 11 aa, Mycobacterium tuberculosis
WTLPVLGVWVI

SEQ ID NO: 1999 - protein, 11 aa, Mycobacterium tuberculosis
TLPVLGVWVIF

SEQ ID NO: 2000 - protein, 11 aa, Mycobacterium tuberculosis
LPVLGVWVIFS

SEQ ID NO: 2001 - protein, 11 aa, Mycobacterium tuberculosis
PVLGVWVIFSP

SEQ ID NO: 2002 - protein, 11 aa, Mycobacterium tuberculosis
VLGVWVIFSPW

SEQ ID NO: 2003 - protein, 11 aa, Mycobacterium tuberculosis
LGVWVIFSPWV

SEQ ID NO: 2004 - protein, 11 aa, Mycobacterium tuberculosis
GVWVIFSPWVL

SEQ ID NO: 2005 - protein, 11 aa, Mycobacterium tuberculosis
VWVIFSPWVLP

SEQ ID NO: 2006 - protein, 11 aa, Mycobacterium tuberculosis
WVIFSPWVLPG

SEQ ID NO: 2007 - protein, 11 aa, Mycobacterium tuberculosis
VIFSPWVLPGV

SEQ ID NO: 2008 - protein, 11 aa, Mycobacterium tuberculosis
IFSPWVLPGVA

SEQ ID NO: 2009 - protein, 11 aa, Mycobacterium tuberculosis
FSPWVLPGVAV

SEQ ID NO: 2010 - protein, 11 aa, Mycobacterium tuberculosis
SPWVLPGVAVT

SEQ ID NO: 2011 - protein, 11 aa, Mycobacterium tuberculosis
PWVLPGVAVTA

SEQ ID NO: 2012 - protein, 11 aa, Mycobacterium tuberculosis
WVLPGVAVTAG

SEQ ID NO: 2013 - protein, 11 aa, Mycobacterium tuberculosis
VLPGVAVTAGM

SEQ ID NO: 2014 - protein, 11 aa, Mycobacterium tuberculosis
LPGVAVTAGMM

SEQ ID NO: 2015 - protein, 11 aa, Mycobacterium tuberculosis
PGVAVTAGMMW

SEQ ID NO: 2016 - protein, 11 aa, Mycobacterium tuberculosis
GVAVTAGMMWS

SEQ ID NO: 2017 - protein, 11 aa, Mycobacterium tuberculosis
VAVTAGMMWSH

SEQ ID NO: 2018 - protein, 11 aa, Mycobacterium tuberculosis
AVTAGMMWSHI

SEQ ID NO: 2019 - protein, 11 aa, Mycobacterium tuberculosis
VTAGMMWSHII

SEQ ID NO: 2020 - protein, 11 aa, Mycobacterium tuberculosis
TAGMMWSHIIA

SEQ ID NO: 2021 - protein, 11 aa, Mycobacterium tuberculosis
AGMMWSHIIAG

SEQ ID NO: 2022 - protein, 11 aa, Mycobacterium tuberculosis
GMMWSHIIAGA

SEQ ID NO: 2023 - protein, 11 aa, Mycobacterium tuberculosis
MMWSHIIAGAV

SEQ ID NO: 2024 - protein, 11 aa, Mycobacterium tuberculosis
MWSHIIAGAVV

SEQ ID NO: 2025 - protein, 11 aa, Mycobacterium tuberculosis
WSHIIAGAVVA

SEQ ID NO: 2026 - protein, 11 aa, Mycobacterium tuberculosis
SHIIAGAVVAV

SEQ ID NO: 2027 - protein, 11 aa, Mycobacterium tuberculosis
HIIAGAVVAVL

SEQ ID NO: 2028 - protein, 11 aa, Mycobacterium tuberculosis
IIAGAVVAVLG

SEQ ID NO: 2029 - protein, 11 aa, Mycobacterium tuberculosis
IAGAVVAVLGF

SEQ ID NO: 2030 - protein, 11 aa, Mycobacterium tuberculosis
AGAVVAVLGFY

SEQ ID NO: 2031 - protein, 11 aa, Mycobacterium tuberculosis
GAVVAVLGFYF

SEQ ID NO: 2032 - protein, 11 aa, Mycobacterium tuberculosis
AVVAVLGFYFG

SEQ ID NO: 2033 - protein, 11 aa, Mycobacterium tuberculosis
VVAVLGFYFGM

SEQ ID NO: 2034 - protein, 11 aa, Mycobacterium tuberculosis
VAVLGFYFGMR

SEQ ID NO: 2035 - protein, 11 aa, Mycobacterium tuberculosis
AVLGFYFGMRT

SEQ ID NO: 2036 - protein, 11 aa, Mycobacterium tuberculosis
VLGFYFGMRTR

SEQ ID NO: 2037 - protein, 11 aa, Mycobacterium tuberculosis
LGFYFGMRTRA

SEQ ID NO: 2038 - protein, 11 aa, Mycobacterium tuberculosis
GFYFGMRTRAA

SEQ ID NO: 2039 - protein, 11 aa, Mycobacterium tuberculosis
FYFGMRTRAAA

SEQ ID NO: 2040 - protein, 11 aa, Mycobacterium tuberculosis
YFGMRTRAAAN

SEQ ID NO: 2041 - protein, 11 aa, Mycobacterium tuberculosis
FGMRTRAAANQ

SEQ ID NO: 2042 - protein, 11 aa, Mycobacterium tuberculosis
GMRTRAAANQG

SEQ ID NO: 2043 - protein, 8 aa, Mycobacterium tuberculosis
MSRLIFEA

SEQ ID NO: 2044 - protein, 8 aa, Mycobacterium tuberculosis
SRLIFEAR

SEQ ID NO: 2045 - protein, 8 aa, Mycobacterium tuberculosis
RLIFEARR

SEQ ID NO: 2046 - protein, 8 aa, Mycobacterium tuberculosis
LIFEARRR

SEQ ID NO: 2047 - protein, 8 aa, Mycobacterium tuberculosis
IFEARRRL

SEQ ID NO: 2048 - protein, 8 aa, Mycobacterium tuberculosis
FEARRRLA

SEQ ID NO: 2049 - protein, 8 aa, Mycobacterium tuberculosis
EARRRLAP

SEQ ID NO: 2050 - protein, 8 aa, Mycobacterium tuberculosis
ARRRLAPP

SEQ ID NO: 2051 - protein, 8 aa, Mycobacterium tuberculosis
RRRLAPPS

SEQ ID NO: 2052 - protein, 8 aa, Mycobacterium tuberculosis
RRLAPPSS

SEQ ID NO: 2053 - protein, 8 aa, Mycobacterium tuberculosis
RLAPPSSH

SEQ ID NO: 2054 - protein, 8 aa, Mycobacterium tuberculosis
LAPPSSHQ

SEQ ID NO: 2055 - protein, 8 aa, Mycobacterium tuberculosis
APPSSHQG

SEQ ID NO: 2056 - protein, 8 aa, Mycobacterium tuberculosis
PPSSHQGT

SEQ ID NO: 2057 - protein, 8 aa, Mycobacterium tuberculosis
PSSHQGTI

SEQ ID NO: 2058 - protein, 8 aa, Mycobacterium tuberculosis
SSHQGTII

SEQ ID NO: 2059 - protein, 8 aa, Mycobacterium tuberculosis
SHQGTIII

SEQ ID NO: 2060 - protein, 8 aa, Mycobacterium tuberculosis
HQGTIIIE

SEQ ID NO: 2061 - protein, 8 aa, Mycobacterium tuberculosis
QGTIIIEA

SEQ ID NO: 2062 - protein, 8 aa, Mycobacterium tuberculosis
GTIIIEAP

SEQ ID NO: 2063 - protein, 8 aa, Mycobacterium tuberculosis
TIIIEAPP

SEQ ID NO: 2064 - protein, 8 aa, Mycobacterium tuberculosis
IIIEAPPE

SEQ ID NO: 2065 - protein, 8 aa, Mycobacterium tuberculosis
IIEAPPEL

SEQ ID NO: 2066 - protein, 8 aa, Mycobacterium tuberculosis
IEAPPELP

SEQ ID NO: 2067 - protein, 8 aa, Mycobacterium tuberculosis
EAPPELPR

SEQ ID NO: 2068 - protein, 8 aa, Mycobacterium tuberculosis
APPELPRV

SEQ ID NO: 2069 - protein, 8 aa, Mycobacterium tuberculosis
PPELPRVI

SEQ ID NO: 2070 - protein, 8 aa, Mycobacterium tuberculosis
PELPRVIP

SEQ ID NO: 2071 - protein, 8 aa, Mycobacterium tuberculosis
ELPRVIPP

SEQ ID NO: 2072 - protein, 8 aa, Mycobacterium tuberculosis
LPRVIPPS

SEQ ID NO: 2073 - protein, 8 aa, Mycobacterium tuberculosis
PRVIPPSL

SEQ ID NO: 2074 - protein, 8 aa, Mycobacterium tuberculosis
RVIPPSLL

SEQ ID NO: 2075 - protein, 8 aa, Mycobacterium tuberculosis
VIPPSLLR

SEQ ID NO: 2076 - protein, 8 aa, Mycobacterium tuberculosis
IPPSLLRR

SEQ ID NO: 2077 - protein, 8 aa, Mycobacterium tuberculosis
PPSLLRRA

SEQ ID NO: 2078 - protein, 8 aa, Mycobacterium tuberculosis
PSLLRRAL

SEQ ID NO: 2079 - protein, 8 aa, Mycobacterium tuberculosis
SLLRRALP

SEQ ID NO: 2080 - protein, 8 aa, Mycobacterium tuberculosis
LLRRALPY

SEQ ID NO: 2081 - protein, 8 aa, Mycobacterium tuberculosis
LRRALPYL

SEQ ID NO: 2082 - protein, 8 aa, Mycobacterium tuberculosis
RRALPYLI

SEQ ID NO: 2083 - protein, 8 aa, Mycobacterium tuberculosis
RALPYLIG

SEQ ID NO: 2084 - protein, 8 aa, Mycobacterium tuberculosis
ALPYLIGI

SEQ ID NO: 2085 - protein, 8 aa, Mycobacterium tuberculosis
LPYLIGIL

SEQ ID NO: 2086 - protein, 8 aa, Mycobacterium tuberculosis
PYLIGILI

SEQ ID NO: 2087 - protein, 8 aa, Mycobacterium tuberculosis
YLIGILIV

SEQ ID NO: 2088 - protein, 8 aa, Mycobacterium tuberculosis
LIGILIVG

SEQ ID NO: 2089 - protein, 8 aa, Mycobacterium tuberculosis
IGILIVGM

SEQ ID NO: 2090 - protein, 8 aa, Mycobacterium tuberculosis
GILIVGMI

SEQ ID NO: 2091 - protein, 8 aa, Mycobacterium tuberculosis
ILIVGMIV

SEQ ID NO: 2092 - protein, 8 aa, Mycobacterium tuberculosis
LIVGMIVA

SEQ ID NO: 2093 - protein, 8 aa, Mycobacterium tuberculosis
IVGMIVAL

SEQ ID NO: 2094 - protein, 8 aa, Mycobacterium tuberculosis
VGMIVALV

SEQ ID NO: 2095 - protein, 8 aa, Mycobacterium tuberculosis
GMIVALVA

SEQ ID NO: 2096 - protein, 8 aa, Mycobacterium tuberculosis
MIVALVAT

SEQ ID NO: 2097 - protein, 8 aa, Mycobacterium tuberculosis
IVALVATG

SEQ ID NO: 2098 - protein, 8 aa, Mycobacterium tuberculosis
VALVATGM

SEQ ID NO: 2099 - protein, 8 aa, Mycobacterium tuberculosis
ALVATGMR

SEQ ID NO: 2100 - protein, 8 aa, Mycobacterium tuberculosis
LVATGMRV

SEQ ID NO: 2101 - protein, 8 aa, Mycobacterium tuberculosis
VATGMRVI

SEQ ID NO: 2102 - protein, 8 aa, Mycobacterium tuberculosis
ATGMRVIS

SEQ ID NO: 2103 - protein, 8 aa, Mycobacterium tuberculosis
TGMRVISP

SEQ ID NO: 2104 - protein, 8 aa, Mycobacterium tuberculosis
GMRVISPQ

SEQ ID NO: 2105 - protein, 8 aa, Mycobacterium tuberculosis
MRVISPQT

SEQ ID NO: 2106 - protein, 8 aa, Mycobacterium tuberculosis
RVISPQTL

SEQ ID NO: 2107 - protein, 8 aa, Mycobacterium tuberculosis
VISPQTLF

SEQ ID NO: 2108 - protein, 8 aa, Mycobacterium tuberculosis
ISPQTLFF

SEQ ID NO: 2109 - protein, 8 aa, Mycobacterium tuberculosis
SPQTLFFP

SEQ ID NO: 2110 - protein, 8 aa, Mycobacterium tuberculosis
PQTLFFPF

SEQ ID NO: 2111 - protein, 8 aa, Mycobacterium tuberculosis
QTLFFPFV

SEQ ID NO: 2112 - protein, 8 aa, Mycobacterium tuberculosis
TLFFPFVL

SEQ ID NO: 2113 - protein, 8 aa, Mycobacterium tuberculosis
LFFPFVLL

SEQ ID NO: 2114 - protein, 8 aa, Mycobacterium tuberculosis
FFPFVLLL

SEQ ID NO: 2115 - protein, 8 aa, Mycobacterium tuberculosis
FPFVLLLA

SEQ ID NO: 2116 - protein, 8 aa, Mycobacterium tuberculosis
PFVLLLAA

SEQ ID NO: 2117 - protein, 8 aa, Mycobacterium tuberculosis
FVLLLAAT

SEQ ID NO: 2118 - protein, 8 aa, Mycobacterium tuberculosis
VLLLAATA

SEQ ID NO: 2119 - protein, 8 aa, Mycobacterium tuberculosis
LLLAATAL

SEQ ID NO: 2120 - protein, 8 aa, Mycobacterium tuberculosis
LLAATALY

SEQ ID NO: 2121 - protein, 8 aa, Mycobacterium tuberculosis
LAATALYR

SEQ ID NO: 2122 - protein, 8 aa, Mycobacterium tuberculosis
AATALYRG

SEQ ID NO: 2123 - protein, 8 aa, Mycobacterium tuberculosis
ATALYRGN

SEQ ID NO: 2124 - protein, 8 aa, Mycobacterium tuberculosis
TALYRGND

SEQ ID NO: 2125 - protein, 8 aa, Mycobacterium tuberculosis
ALYRGNDK

SEQ ID NO: 2126 - protein, 8 aa, Mycobacterium tuberculosis
LYRGNDKK

SEQ ID NO: 2127 - protein, 8 aa, Mycobacterium tuberculosis
YRGNDKKM

SEQ ID NO: 2128 - protein, 8 aa, Mycobacterium tuberculosis
RGNDKKMR

SEQ ID NO: 2129 - protein, 8 aa, Mycobacterium tuberculosis
GNDKKMRT

SEQ ID NO: 2130 - protein, 8 aa, Mycobacterium tuberculosis
NDKKMRTE

SEQ ID NO: 2131 - protein, 8 aa, Mycobacterium tuberculosis
DKKMRTEE

SEQ ID NO: 2132 - protein, 8 aa, Mycobacterium tuberculosis
KKMRTEEV

SEQ ID NO: 2133 - protein, 8 aa, Mycobacterium tuberculosis
KMRTEEVD

SEQ ID NO: 2134 - protein, 8 aa, Mycobacterium tuberculosis
MRTEEVDA

SEQ ID NO: 2135 - protein, 8 aa, Mycobacterium tuberculosis
RTEEVDAE

SEQ ID NO: 2136 - protein, 8 aa, Mycobacterium tuberculosis
TEEVDAER

SEQ ID NO: 2137 - protein, 8 aa, Mycobacterium tuberculosis
EEVDAERA

SEQ ID NO: 2138 - protein, 8 aa, Mycobacterium tuberculosis
EVDAERAD

SEQ ID NO: 2139 - protein, 8 aa, Mycobacterium tuberculosis
VDAERADY

SEQ ID NO: 2140 - protein, 8 aa, Mycobacterium tuberculosis
DAERADYL

SEQ ID NO: 2141 - protein, 8 aa, Mycobacterium tuberculosis
AERADYLR

SEQ ID NO: 2142 - protein, 8 aa, Mycobacterium tuberculosis
ERADYLRY

SEQ ID NO: 2143 - protein, 8 aa, Mycobacterium tuberculosis
RADYLRYL

SEQ ID NO: 2144 - protein, 8 aa, Mycobacterium tuberculosis
ADYLRYLS

SEQ ID NO: 2145 - protein, 8 aa, Mycobacterium tuberculosis
DYLRYLSV

SEQ ID NO: 2146 - protein, 8 aa, Mycobacterium tuberculosis
YLRYLSVV

SEQ ID NO: 2147 - protein, 8 aa, Mycobacterium tuberculosis
LRYLSVVR

SEQ ID NO: 2148 - protein, 8 aa, Mycobacterium tuberculosis
RYLSVVRD

SEQ ID NO: 2149 - protein, 8 aa, Mycobacterium tuberculosis
YLSVVRDN

SEQ ID NO: 2150 - protein, 8 aa, Mycobacterium tuberculosis
LSVVRDNI

SEQ ID NO: 2151 - protein, 8 aa, Mycobacterium tuberculosis
SVVRDNIR

SEQ ID NO: 2152 - protein, 8 aa, Mycobacterium tuberculosis
VVRDNIRA

SEQ ID NO: 2153 - protein, 8 aa, Mycobacterium tuberculosis
VRDNIRAQ

SEQ ID NO: 2154 - protein, 8 aa, Mycobacterium tuberculosis
RDNIRAQA

SEQ ID NO: 2155 - protein, 8 aa, Mycobacterium tuberculosis
DNIRAQAA

SEQ ID NO: 2156 - protein, 8 aa, Mycobacterium tuberculosis
NIRAQAAE

SEQ ID NO: 2157 - protein, 8 aa, Mycobacterium tuberculosis
IRAQAAEQ

SEQ ID NO: 2158 - protein, 8 aa, Mycobacterium tuberculosis
RAQAAEQR

SEQ ID NO: 2159 - protein, 8 aa, Mycobacterium tuberculosis
AQAAEQRA

SEQ ID NO: 2160 - protein, 8 aa, Mycobacterium tuberculosis
QAAEQRAS

SEQ ID NO: 2161 - protein, 8 aa, Mycobacterium tuberculosis
AAEQRASA

SEQ ID NO: 2162 - protein, 8 aa, Mycobacterium tuberculosis
AEQRASAL

SEQ ID NO: 2163 - protein, 8 aa, Mycobacterium tuberculosis
EQRASALW

SEQ ID NO: 2164 - protein, 8 aa, Mycobacterium tuberculosis
QRASALWS

SEQ ID NO: 2165 - protein, 8 aa, Mycobacterium tuberculosis
RASALWSH

SEQ ID NO: 2166 - protein, 8 aa, Mycobacterium tuberculosis
ASALWSHP

SEQ ID NO: 2167 - protein, 8 aa, Mycobacterium tuberculosis
SALWSHPD

SEQ ID NO: 2168 - protein, 8 aa, Mycobacterium tuberculosis
ALWSHPDP

SEQ ID NO: 2169 - protein, 8 aa, Mycobacterium tuberculosis
LWSHPDPT

SEQ ID NO: 2170 - protein, 8 aa, Mycobacterium tuberculosis
WSHPDPTA

SEQ ID NO: 2171 - protein, 8 aa, Mycobacterium tuberculosis
SHPDPTAL

SEQ ID NO: 2172 - protein, 8 aa, Mycobacterium tuberculosis
HPDPTALA

SEQ ID NO: 2173 - protein, 8 aa, Mycobacterium tuberculosis
PDPTALAS

SEQ ID NO: 2174 - protein, 8 aa, Mycobacterium tuberculosis
DPTALASV

SEQ ID NO: 2175 - protein, 8 aa, Mycobacterium tuberculosis
PTALASVP

SEQ ID NO: 2176 - protein, 8 aa, Mycobacterium tuberculosis
TALASVPG

SEQ ID NO: 2177 - protein, 8 aa, Mycobacterium tuberculosis
ALASVPGS

SEQ ID NO: 2178 - protein, 8 aa, Mycobacterium tuberculosis
LASVPGSR

SEQ ID NO: 2179 - protein, 8 aa, Mycobacterium tuberculosis
ASVPGSRR

SEQ ID NO: 2180 - protein, 8 aa, Mycobacterium tuberculosis
SVPGSRRQ

SEQ ID NO: 2181 - protein, 8 aa, Mycobacterium tuberculosis
VPGSRRQW

SEQ ID NO: 2182 - protein, 8 aa, Mycobacterium tuberculosis
PGSRRQWE

SEQ ID NO: 2183 - protein, 8 aa, Mycobacterium tuberculosis
GSRRQWER

SEQ ID NO: 2184 - protein, 8 aa, Mycobacterium tuberculosis
SRRQWERD

SEQ ID NO: 2185 - protein, 8 aa, Mycobacterium tuberculosis
RRQWERDP

SEQ ID NO: 2186 - protein, 8 aa, Mycobacterium tuberculosis
RQWERDPH

SEQ ID NO: 2187 - protein, 8 aa, Mycobacterium tuberculosis
QWERDPHD

SEQ ID NO: 2188 - protein, 8 aa, Mycobacterium tuberculosis
WERDPHDP

SEQ ID NO: 2189 - protein, 8 aa, Mycobacterium tuberculosis
ERDPHDPD

SEQ ID NO: 2190 - protein, 8 aa, Mycobacterium tuberculosis
RDPHDPDF

SEQ ID NO: 2191 - protein, 8 aa, Mycobacterium tuberculosis
DPHDPDFL

SEQ ID NO: 2192 - protein, 8 aa, Mycobacterium tuberculosis
PHDPDFLV

SEQ ID NO: 2193 - protein, 8 aa, Mycobacterium tuberculosis
HDPDFLVL

SEQ ID NO: 2194 - protein, 8 aa, Mycobacterium tuberculosis
DPDFLVLR

SEQ ID NO: 2195 - protein, 8 aa, Mycobacterium tuberculosis
PDFLVLRA

SEQ ID NO: 2196 - protein, 8 aa, Mycobacterium tuberculosis
DFLVLRAG

SEQ ID NO: 2197 - protein, 8 aa, Mycobacterium tuberculosis
FLVLRAGR

SEQ ID NO: 2198 - protein, 8 aa, Mycobacterium tuberculosis
LVLRAGRH

SEQ ID NO: 2199 - protein, 8 aa, Mycobacterium tuberculosis
VLRAGRHT

SEQ ID NO: 2200 - protein, 8 aa, Mycobacterium tuberculosis
LRAGRHTV

SEQ ID NO: 2201 - protein, 8 aa, Mycobacterium tuberculosis
RAGRHTVP

SEQ ID NO: 2202 - protein, 8 aa, Mycobacterium tuberculosis
AGRHTVPL

SEQ ID NO: 2203 - protein, 8 aa, Mycobacterium tuberculosis
GRHTVPLA

SEQ ID NO: 2204 - protein, 8 aa, Mycobacterium tuberculosis
RHTVPLAT

SEQ ID NO: 2205 - protein, 8 aa, Mycobacterium tuberculosis
HTVPLATT

SEQ ID NO: 2206 - protein, 8 aa, Mycobacterium tuberculosis
TVPLATTL

SEQ ID NO: 2207 - protein, 8 aa, Mycobacterium tuberculosis
VPLATTLR

SEQ ID NO: 2208 - protein, 8 aa, Mycobacterium tuberculosis
PLATTLRV

SEQ ID NO: 2209 - protein, 8 aa, Mycobacterium tuberculosis
LATTLRVN

SEQ ID NO: 2210 - protein, 8 aa, Mycobacterium tuberculosis
ATTLRVND

SEQ ID NO: 2211 - protein, 8 aa, Mycobacterium tuberculosis
TTLRVNDT

SEQ ID NO: 2212 - protein, 8 aa, Mycobacterium tuberculosis
TLRVNDTA

SEQ ID NO: 2213 - protein, 8 aa, Mycobacterium tuberculosis
LRVNDTAD

SEQ ID NO: 2214 - protein, 8 aa, Mycobacterium tuberculosis
RVNDTADE

SEQ ID NO: 2215 - protein, 8 aa, Mycobacterium tuberculosis
VNDTADEI

SEQ ID NO: 2216 - protein, 8 aa, Mycobacterium tuberculosis
NDTADEID

SEQ ID NO: 2217 - protein, 8 aa, Mycobacterium tuberculosis
DTADEIDL

SEQ ID NO: 2218 - protein, 8 aa, Mycobacterium tuberculosis
TADEIDLE

SEQ ID NO: 2219 - protein, 8 aa, Mycobacterium tuberculosis
ADEIDLEP

SEQ ID NO: 2220 - protein, 8 aa, Mycobacterium tuberculosis
DEIDLEPV

SEQ ID NO: 2221 - protein, 8 aa, Mycobacterium tuberculosis
EIDLEPVS

SEQ ID NO: 2222 - protein, 8 aa, Mycobacterium tuberculosis
IDLEPVSH

SEQ ID NO: 2223 - protein, 8 aa, Mycobacterium tuberculosis
DLEPVSHS

SEQ ID NO: 2224 - protein, 8 aa, Mycobacterium tuberculosis
LEPVSHSA

SEQ ID NO: 2225 - protein, 8 aa, Mycobacterium tuberculosis
EPVSHSAL

SEQ ID NO: 2226 - protein, 8 aa, Mycobacterium tuberculosis
PVSHSALR

SEQ ID NO: 2227 - protein, 8 aa, Mycobacterium tuberculosis
VSHSALRS

SEQ ID NO: 2228 - protein, 8 aa, Mycobacterium tuberculosis
SHSALRSL

SEQ ID NO: 2229 - protein, 8 aa, Mycobacterium tuberculosis
HSALRSLL

SEQ ID NO: 2230 - protein, 8 aa, Mycobacterium tuberculosis
SALRSLLD

SEQ ID NO: 2231 - protein, 8 aa, Mycobacterium tuberculosis
ALRSLLDT

SEQ ID NO: 2232 - protein, 8 aa, Mycobacterium tuberculosis
LRSLLDTQ

SEQ ID NO: 2233 - protein, 8 aa, Mycobacterium tuberculosis
RSLLDTQR

SEQ ID NO: 2234 - protein, 8 aa, Mycobacterium tuberculosis
SLLDTQRS

SEQ ID NO: 2235 - protein, 8 aa, Mycobacterium tuberculosis
LLDTQRSI

SEQ ID NO: 2236 - protein, 8 aa, Mycobacterium tuberculosis
LDTQRSIG

SEQ ID NO: 2237 - protein, 8 aa, Mycobacterium tuberculosis
DTQRSIGD

SEQ ID NO: 2238 - protein, 8 aa, Mycobacterium tuberculosis
TQRSIGDV

SEQ ID NO: 2239 - protein, 8 aa, Mycobacterium tuberculosis
QRSIGDVP

SEQ ID NO: 2240 - protein, 8 aa, Mycobacterium tuberculosis
RSIGDVPT

SEQ ID NO: 2241 - protein, 8 aa, Mycobacterium tuberculosis
SIGDVPTG

SEQ ID NO: 2242 - protein, 8 aa, Mycobacterium tuberculosis
IGDVPTGI

SEQ ID NO: 2243 - protein, 8 aa, Mycobacterium tuberculosis
GDVPTGID

SEQ ID NO: 2244 - protein, 8 aa, Mycobacterium tuberculosis
DVPTGIDL

SEQ ID NO: 2245 - protein, 8 aa, Mycobacterium tuberculosis
VPTGIDLT

SEQ ID NO: 2246 - protein, 8 aa, Mycobacterium tuberculosis
PTGIDLTK

SEQ ID NO: 2247 - protein, 8 aa, Mycobacterium tuberculosis
TGIDLTKV

SEQ ID NO: 2248 - protein, 8 aa, Mycobacterium tuberculosis
GIDLTKVS

SEQ ID NO: 2249 - protein, 8 aa, Mycobacterium tuberculosis
IDLTKVSP

SEQ ID NO: 2250 - protein, 8 aa, Mycobacterium tuberculosis
DLTKVSPI

SEQ ID NO: 2251 - protein, 8 aa, Mycobacterium tuberculosis
LTKVSPIT

SEQ ID NO: 2252 - protein, 8 aa, Mycobacterium tuberculosis
TKVSPITV

SEQ ID NO: 2253 - protein, 8 aa, Mycobacterium tuberculosis
KVSPITVL

SEQ ID NO: 2254 - protein, 8 aa, Mycobacterium tuberculosis
VSPITVLG

SEQ ID NO: 2255 - protein, 8 aa, Mycobacterium tuberculosis
SPITVLGE

SEQ ID NO: 2256 - protein, 8 aa, Mycobacterium tuberculosis
PITVLGER

SEQ ID NO: 2257 - protein, 8 aa, Mycobacterium tuberculosis
ITVLGERA

SEQ ID NO: 2258 - protein, 8 aa, Mycobacterium tuberculosis
TVLGERAQ

SEQ ID NO: 2259 - protein, 8 aa, Mycobacterium tuberculosis
VLGERAQV

SEQ ID NO: 2260 - protein, 8 aa, Mycobacterium tuberculosis
LGERAQVR

SEQ ID NO: 2261 - protein, 8 aa, Mycobacterium tuberculosis
GERAQVRA

SEQ ID NO: 2262 - protein, 8 aa, Mycobacterium tuberculosis
ERAQVRAV

SEQ ID NO: 2263 - protein, 8 aa, Mycobacterium tuberculosis
RAQVRAVL

SEQ ID NO: 2264 - protein, 8 aa, Mycobacterium tuberculosis
AQVRAVLR

SEQ ID NO: 2265 - protein, 8 aa, Mycobacterium tuberculosis
QVRAVLRA

SEQ ID NO: 2266 - protein, 8 aa, Mycobacterium tuberculosis
VRAVLRAW

SEQ ID NO: 2267 - protein, 8 aa, Mycobacterium tuberculosis
RAVLRAWI

SEQ ID NO: 2268 - protein, 8 aa, Mycobacterium tuberculosis
AVLRAWIA

SEQ ID NO: 2269 - protein, 8 aa, Mycobacterium tuberculosis
VLRAWIAQ

SEQ ID NO: 2270 - protein, 8 aa, Mycobacterium tuberculosis
LRAWIAQA

SEQ ID NO: 2271 - protein, 8 aa, Mycobacterium tuberculosis
RAWIAQAV

SEQ ID NO: 2272 - protein, 8 aa, Mycobacterium tuberculosis
AWIAQAVT

SEQ ID NO: 2273 - protein, 8 aa, Mycobacterium tuberculosis
WIAQAVTW

SEQ ID NO: 2274 - protein, 8 aa, Mycobacterium tuberculosis
IAQAVTWH

SEQ ID NO: 2275 - protein, 8 aa, Mycobacterium tuberculosis
AQAVTWHD

SEQ ID NO: 2276 - protein, 8 aa, Mycobacterium tuberculosis
QAVTWHDP

SEQ ID NO: 2277 - protein, 8 aa, Mycobacterium tuberculosis
AVTWHDPT

SEQ ID NO: 2278 - protein, 8 aa, Mycobacterium tuberculosis
VTWHDPTV

SEQ ID NO: 2279 - protein, 8 aa, Mycobacterium tuberculosis
TWHDPTVL

SEQ ID NO: 2280 - protein, 8 aa, Mycobacterium tuberculosis
WHDPTVLG

SEQ ID NO: 2281 - protein, 8 aa, Mycobacterium tuberculosis
HDPTVLGV

SEQ ID NO: 2282 - protein, 8 aa, Mycobacterium tuberculosis
DPTVLGVA

SEQ ID NO: 2283 - protein, 8 aa, Mycobacterium tuberculosis
PTVLGVAL

SEQ ID NO: 2284 - protein, 8 aa, Mycobacterium tuberculosis
TVLGVALA

SEQ ID NO: 2285 - protein, 8 aa, Mycobacterium tuberculosis
VLGVALAA

SEQ ID NO: 2286 - protein, 8 aa, Mycobacterium tuberculosis
LGVALAAR

SEQ ID NO: 2287 - protein, 8 aa, Mycobacterium tuberculosis
GVALAARD

SEQ ID NO: 2288 - protein, 8 aa, Mycobacterium tuberculosis
VALAARDL

SEQ ID NO: 2289 - protein, 8 aa, Mycobacterium tuberculosis
ALAARDLE

SEQ ID NO: 2290 - protein, 8 aa, Mycobacterium tuberculosis
LAARDLEG

SEQ ID NO: 2291 - protein, 8 aa, Mycobacterium tuberculosis
AARDLEGR

SEQ ID NO: 2292 - protein, 8 aa, Mycobacterium tuberculosis
ARDLEGRD

SEQ ID NO: 2293 - protein, 8 aa, Mycobacterium tuberculosis
RDLEGRDW

SEQ ID NO: 2294 - protein, 8 aa, Mycobacterium tuberculosis
DLEGRDWN

SEQ ID NO: 2295 - protein, 8 aa, Mycobacterium tuberculosis
LEGRDWNW

SEQ ID NO: 2296 - protein, 8 aa, Mycobacterium tuberculosis
EGRDWNWL

SEQ ID NO: 2297 - protein, 8 aa, Mycobacterium tuberculosis
GRDWNWLK

SEQ ID NO: 2298 - protein, 8 aa, Mycobacterium tuberculosis
RDWNWLKW

SEQ ID NO: 2299 - protein, 8 aa, Mycobacterium tuberculosis
DWNWLKWL

SEQ ID NO: 2300 - protein, 8 aa, Mycobacterium tuberculosis
WNWLKWLP

SEQ ID NO: 2301 - protein, 8 aa, Mycobacterium tuberculosis
NWLKWLPH

SEQ ID NO: 2302 - protein, 8 aa, Mycobacterium tuberculosis
WLKWLPHV

SEQ ID NO: 2303 - protein, 8 aa, Mycobacterium tuberculosis
LKWLPHVD

SEQ ID NO: 2304 - protein, 8 aa, Mycobacterium tuberculosis
KWLPHVDI

SEQ ID NO: 2305 - protein, 8 aa, Mycobacterium tuberculosis
WLPHVDIP

SEQ ID NO: 2306 - protein, 8 aa, Mycobacterium tuberculosis
LPHVDIPG

SEQ ID NO: 2307 - protein, 8 aa, Mycobacterium tuberculosis
PHVDIPGR

SEQ ID NO: 2308 - protein, 8 aa, Mycobacterium tuberculosis
HVDIPGRL

SEQ ID NO: 2309 - protein, 8 aa, Mycobacterium tuberculosis
VDIPGRLD

SEQ ID NO: 2310 - protein, 8 aa, Mycobacterium tuberculosis
DIPGRLDA

SEQ ID NO: 2311 - protein, 8 aa, Mycobacterium tuberculosis
IPGRLDAL

SEQ ID NO: 2312 - protein, 8 aa, Mycobacterium tuberculosis
PGRLDALG

SEQ ID NO: 2313 - protein, 8 aa, Mycobacterium tuberculosis
GRLDALGP

SEQ ID NO: 2314 - protein, 8 aa, Mycobacterium tuberculosis
RLDALGPA

SEQ ID NO: 2315 - protein, 8 aa, Mycobacterium tuberculosis
LDALGPAR

SEQ ID NO: 2316 - protein, 8 aa, Mycobacterium tuberculosis
DALGPARN

SEQ ID NO: 2317 - protein, 8 aa, Mycobacterium tuberculosis
ALGPARNL

SEQ ID NO: 2318 - protein, 8 aa, Mycobacterium tuberculosis
LGPARNLS

SEQ ID NO: 2319 - protein, 8 aa, Mycobacterium tuberculosis
GPARNLST

SEQ ID NO: 2320 - protein, 8 aa, Mycobacterium tuberculosis
PARNLSTD

SEQ ID NO: 2321 - protein, 8 aa, Mycobacterium tuberculosis
ARNLSTDP

SEQ ID NO: 2322 - protein, 8 aa, Mycobacterium tuberculosis
RNLSTDPD

SEQ ID NO: 2323 - protein, 8 aa, Mycobacterium tuberculosis
NLSTDPDE

SEQ ID NO: 2324 - protein, 8 aa, Mycobacterium tuberculosis
LSTDPDEL

SEQ ID NO: 2325 - protein, 8 aa, Mycobacterium tuberculosis
STDPDELI

SEQ ID NO: 2326 - protein, 8 aa, Mycobacterium tuberculosis
TDPDELIA

SEQ ID NO: 2327 - protein, 8 aa, Mycobacterium tuberculosis
DPDELIAL

SEQ ID NO: 2328 - protein, 8 aa, Mycobacterium tuberculosis
PDELIALL

SEQ ID NO: 2329 - protein, 8 aa, Mycobacterium tuberculosis
DELIALLG

SEQ ID NO: 2330 - protein, 8 aa, Mycobacterium tuberculosis
ELIALLGP

SEQ ID NO: 2331 - protein, 8 aa, Mycobacterium tuberculosis
LIALLGPV

SEQ ID NO: 2332 - protein, 8 aa, Mycobacterium tuberculosis
IALLGPVL

SEQ ID NO: 2333 - protein, 8 aa, Mycobacterium tuberculosis
ALLGPVLA

SEQ ID NO: 2334 - protein, 8 aa, Mycobacterium tuberculosis
LLGPVLAD

SEQ ID NO: 2335 - protein, 8 aa, Mycobacterium tuberculosis
LGPVLADR

SEQ ID NO: 2336 - protein, 8 aa, Mycobacterium tuberculosis
GPVLADRP

SEQ ID NO: 2337 - protein, 8 aa, Mycobacterium tuberculosis
PVLADRPA

SEQ ID NO: 2338 - protein, 8 aa, Mycobacterium tuberculosis
VLADRPAF

SEQ ID NO: 2339 - protein, 8 aa, Mycobacterium tuberculosis
LADRPAFT

SEQ ID NO: 2340 - protein, 8 aa, Mycobacterium tuberculosis
ADRPAFTG

SEQ ID NO: 2341 - protein, 8 aa, Mycobacterium tuberculosis
DRPAFTGQ

SEQ ID NO: 2342 - protein, 8 aa, Mycobacterium tuberculosis
RPAFTGQP

SEQ ID NO: 2343 - protein, 8 aa, Mycobacterium tuberculosis
PAFTGQPT

SEQ ID NO: 2344 - protein, 8 aa, Mycobacterium tuberculosis
AFTGQPTD

SEQ ID NO: 2345 - protein, 8 aa, Mycobacterium tuberculosis
FTGQPTDA

SEQ ID NO: 2346 - protein, 8 aa, Mycobacterium tuberculosis
TGQPTDAL

SEQ ID NO: 2347 - protein, 8 aa, Mycobacterium tuberculosis
GQPTDALR

SEQ ID NO: 2348 - protein, 8 aa, Mycobacterium tuberculosis
QPTDALRH

SEQ ID NO: 2349 - protein, 8 aa, Mycobacterium tuberculosis
PTDALRHL

SEQ ID NO: 2350 - protein, 8 aa, Mycobacterium tuberculosis
TDALRHLL

SEQ ID NO: 2351 - protein, 8 aa, Mycobacterium tuberculosis
DALRHLLI

SEQ ID NO: 2352 - protein, 8 aa, Mycobacterium tuberculosis
ALRHLLIV

SEQ ID NO: 2353 - protein, 8 aa, Mycobacterium tuberculosis
LRHLLIVV

SEQ ID NO: 2354 - protein, 8 aa, Mycobacterium tuberculosis
RHLLIVVD

SEQ ID NO: 2355 - protein, 8 aa, Mycobacterium tuberculosis
HLLIVVDD

SEQ ID NO: 2356 - protein, 8 aa, Mycobacterium tuberculosis
LLIVVDDP

SEQ ID NO: 2357 - protein, 8 aa, Mycobacterium tuberculosis
LIVVDDPD

SEQ ID NO: 2358 - protein, 8 aa, Mycobacterium tuberculosis
IVVDDPDY

SEQ ID NO: 2359 - protein, 8 aa, Mycobacterium tuberculosis
VVDDPDYD

SEQ ID NO: 2360 - protein, 8 aa, Mycobacterium tuberculosis
VDDPDYDL

SEQ ID NO: 2361 - protein, 8 aa, Mycobacterium tuberculosis
DDPDYDLG

SEQ ID NO: 2362 - protein, 8 aa, Mycobacterium tuberculosis
DPDYDLGA

SEQ ID NO: 2363 - protein, 8 aa, Mycobacterium tuberculosis
PDYDLGAS

SEQ ID NO: 2364 - protein, 8 aa, Mycobacterium tuberculosis
DYDLGASP

SEQ ID NO: 2365 - protein, 8 aa, Mycobacterium tuberculosis
YDLGASPL

SEQ ID NO: 2366 - protein, 8 aa, Mycobacterium tuberculosis
DLGASPLA

SEQ ID NO: 2367 - protein, 8 aa, Mycobacterium tuberculosis
LGASPLAV

SEQ ID NO: 2368 - protein, 8 aa, Mycobacterium tuberculosis
GASPLAVG

SEQ ID NO: 2369 - protein, 8 aa, Mycobacterium tuberculosis
ASPLAVGR

SEQ ID NO: 2370 - protein, 8 aa, Mycobacterium tuberculosis
SPLAVGRA

SEQ ID NO: 2371 - protein, 8 aa, Mycobacterium tuberculosis
PLAVGRAG

SEQ ID NO: 2372 - protein, 8 aa, Mycobacterium tuberculosis
LAVGRAGV

SEQ ID NO: 2373 - protein, 8 aa, Mycobacterium tuberculosis
AVGRAGVT

SEQ ID NO: 2374 - protein, 8 aa, Mycobacterium tuberculosis
VGRAGVTV

SEQ ID NO: 2375 - protein, 8 aa, Mycobacterium tuberculosis
GRAGVTVV

SEQ ID NO: 2376 - protein, 8 aa, Mycobacterium tuberculosis
RAGVTVVH

SEQ ID NO: 2377 - protein, 8 aa, Mycobacterium tuberculosis
AGVTVVHC

SEQ ID NO: 2378 - protein, 8 aa, Mycobacterium tuberculosis
GVTVVHCS

SEQ ID NO: 2379 - protein, 8 aa, Mycobacterium tuberculosis
VTVVHCSA

SEQ ID NO: 2380 - protein, 8 aa, Mycobacterium tuberculosis
TVVHCSAS

SEQ ID NO: 2381 - protein, 8 aa, Mycobacterium tuberculosis
VVHCSASA

SEQ ID NO: 2382 - protein, 8 aa, Mycobacterium tuberculosis
VHCSASAP

SEQ ID NO: 2383 - protein, 8 aa, Mycobacterium tuberculosis
HCSASAPH

SEQ ID NO: 2384 - protein, 8 aa, Mycobacterium tuberculosis
CSASAPHR

SEQ ID NO: 2385 - protein, 8 aa, Mycobacterium tuberculosis
SASAPHRE

SEQ ID NO: 2386 - protein, 8 aa, Mycobacterium tuberculosis
ASAPHREQ

SEQ ID NO: 2387 - protein, 8 aa, Mycobacterium tuberculosis
SAPHREQY

SEQ ID NO: 2388 - protein, 8 aa, Mycobacterium tuberculosis
APHREQYS

SEQ ID NO: 2389 - protein, 8 aa, Mycobacterium tuberculosis
PHREQYSD

SEQ ID NO: 2390 - protein, 8 aa, Mycobacterium tuberculosis
HREQYSDP

SEQ ID NO: 2391 - protein, 8 aa, Mycobacterium tuberculosis
REQYSDPE

SEQ ID NO: 2392 - protein, 8 aa, Mycobacterium tuberculosis
EQYSDPEK

SEQ ID NO: 2393 - protein, 8 aa, Mycobacterium tuberculosis
QYSDPEKP

SEQ ID NO: 2394 - protein, 8 aa, Mycobacterium tuberculosis
YSDPEKPI

SEQ ID NO: 2395 - protein, 8 aa, Mycobacterium tuberculosis
SDPEKPIL

SEQ ID NO: 2396 - protein, 8 aa, Mycobacterium tuberculosis
DPEKPILR

SEQ ID NO: 2397 - protein, 8 aa, Mycobacterium tuberculosis
PEKPILRV

SEQ ID NO: 2398 - protein, 8 aa, Mycobacterium tuberculosis
EKPILRVA

SEQ ID NO: 2399 - protein, 8 aa, Mycobacterium tuberculosis
KPILRVAH

SEQ ID NO: 2400 - protein, 8 aa, Mycobacterium tuberculosis
PILRVAHG

SEQ ID NO: 2401 - protein, 8 aa, Mycobacterium tuberculosis
ILRVAHGA

SEQ ID NO: 2402 - protein, 8 aa, Mycobacterium tuberculosis
LRVAHGAI

SEQ ID NO: 2403 - protein, 8 aa, Mycobacterium tuberculosis
RVAHGAIE

SEQ ID NO: 2404 - protein, 8 aa, Mycobacterium tuberculosis
VAHGAIER

SEQ ID NO: 2405 - protein, 8 aa, Mycobacterium tuberculosis
AHGAIERW

SEQ ID NO: 2406 - protein, 8 aa, Mycobacterium tuberculosis
HGAIERWQ

SEQ ID NO: 2407 - protein, 8 aa, Mycobacterium tuberculosis
GAIERWQT

SEQ ID NO: 2408 - protein, 8 aa, Mycobacterium tuberculosis
AIERWQTG

SEQ ID NO: 2409 - protein, 8 aa, Mycobacterium tuberculosis
IERWQTGG

SEQ ID NO: 2410 - protein, 8 aa, Mycobacterium tuberculosis
ERWQTGGW

SEQ ID NO: 2411 - protein, 8 aa, Mycobacterium tuberculosis
RWQTGGWQ

SEQ ID NO: 2412 - protein, 8 aa, Mycobacterium tuberculosis
WQTGGWQP

SEQ ID NO: 2413 - protein, 8 aa, Mycobacterium tuberculosis
QTGGWQPY

SEQ ID NO: 2414 - protein, 8 aa, Mycobacterium tuberculosis
TGGWQPYI

SEQ ID NO: 2415 - protein, 8 aa, Mycobacterium tuberculosis
GGWQPYID

SEQ ID NO: 2416 - protein, 8 aa, Mycobacterium tuberculosis
GWQPYIDA

SEQ ID NO: 2417 - protein, 8 aa, Mycobacterium tuberculosis
WQPYIDAA

SEQ ID NO: 2418 - protein, 8 aa, Mycobacterium tuberculosis
QPYIDAAD

SEQ ID NO: 2419 - protein, 8 aa, Mycobacterium tuberculosis
PYIDAADQ

SEQ ID NO: 2420 - protein, 8 aa, Mycobacterium tuberculosis
YIDAADQF

SEQ ID NO: 2421 - protein, 8 aa, Mycobacterium tuberculosis
IDAADQFS

SEQ ID NO: 2422 - protein, 8 aa, Mycobacterium tuberculosis
DAADQFSA

SEQ ID NO: 2423 - protein, 8 aa, Mycobacterium tuberculosis
AADQFSAD

SEQ ID NO: 2424 - protein, 8 aa, Mycobacterium tuberculosis
ADQFSADE

SEQ ID NO: 2425 - protein, 8 aa, Mycobacterium tuberculosis
DQFSADEA

SEQ ID NO: 2426 - protein, 8 aa, Mycobacterium tuberculosis
QFSADEAA

SEQ ID NO: 2427 - protein, 8 aa, Mycobacterium tuberculosis
FSADEAAH

SEQ ID NO: 2428 - protein, 8 aa, Mycobacterium tuberculosis
SADEAAHL

SEQ ID NO: 2429 - protein, 8 aa, Mycobacterium tuberculosis
ADEAAHLA

SEQ ID NO: 2430 - protein, 8 aa, Mycobacterium tuberculosis
DEAAHLAR

SEQ ID NO: 2431 - protein, 8 aa, Mycobacterium tuberculosis
EAAHLARR

SEQ ID NO: 2432 - protein, 8 aa, Mycobacterium tuberculosis
AAHLARRL

SEQ ID NO: 2433 - protein, 8 aa, Mycobacterium tuberculosis
AHLARRLS

SEQ ID NO: 2434 - protein, 8 aa, Mycobacterium tuberculosis
HLARRLSR

SEQ ID NO: 2435 - protein, 8 aa, Mycobacterium tuberculosis
LARRLSRW

SEQ ID NO: 2436 - protein, 8 aa, Mycobacterium tuberculosis
ARRLSRWD

SEQ ID NO: 2437 - protein, 8 aa, Mycobacterium tuberculosis
RRLSRWDS

SEQ ID NO: 2438 - protein, 8 aa, Mycobacterium tuberculosis
RLSRWDSN

SEQ ID NO: 2439 - protein, 8 aa, Mycobacterium tuberculosis
LSRWDSNP

SEQ ID NO: 2440 - protein, 8 aa, Mycobacterium tuberculosis
SRWDSNPT

SEQ ID NO: 2441 - protein, 8 aa, Mycobacterium tuberculosis
RWDSNPTH

SEQ ID NO: 2442 - protein, 8 aa, Mycobacterium tuberculosis
WDSNPTHA

SEQ ID NO: 2443 - protein, 8 aa, Mycobacterium tuberculosis
DSNPTHAG

SEQ ID NO: 2444 - protein, 8 aa, Mycobacterium tuberculosis
SNPTHAGL

SEQ ID NO: 2445 - protein, 8 aa, Mycobacterium tuberculosis
NPTHAGLR

SEQ ID NO: 2446 - protein, 8 aa, Mycobacterium tuberculosis
PTHAGLRS

SEQ ID NO: 2447 - protein, 8 aa, Mycobacterium tuberculosis
THAGLRSA

SEQ ID NO: 2448 - protein, 8 aa, Mycobacterium tuberculosis
HAGLRSAA

SEQ ID NO: 2449 - protein, 8 aa, Mycobacterium tuberculosis
AGLRSAAT

SEQ ID NO: 2450 - protein, 8 aa, Mycobacterium tuberculosis
GLRSAATR

SEQ ID NO: 2451 - protein, 8 aa, Mycobacterium tuberculosis
LRSAATRG

SEQ ID NO: 2452 - protein, 8 aa, Mycobacterium tuberculosis
RSAATRGA

SEQ ID NO: 2453 - protein, 8 aa, Mycobacterium tuberculosis
SAATRGAS

SEQ ID NO: 2454 - protein, 8 aa, Mycobacterium tuberculosis
AATRGASF

SEQ ID NO: 2455 - protein, 8 aa, Mycobacterium tuberculosis
ATRGASFT

SEQ ID NO: 2456 - protein, 8 aa, Mycobacterium tuberculosis
TRGASFTT

SEQ ID NO: 2457 - protein, 8 aa, Mycobacterium tuberculosis
RGASFTTL

SEQ ID NO: 2458 - protein, 8 aa, Mycobacterium tuberculosis
GASFTTLL

SEQ ID NO: 2459 - protein, 8 aa, Mycobacterium tuberculosis
ASFTTLLG

SEQ ID NO: 2460 - protein, 8 aa, Mycobacterium tuberculosis
SFTTLLGI

SEQ ID NO: 2461 - protein, 8 aa, Mycobacterium tuberculosis
FTTLLGIE

SEQ ID NO: 2462 - protein, 8 aa, Mycobacterium tuberculosis
TTLLGIED

SEQ ID NO: 2463 - protein, 8 aa, Mycobacterium tuberculosis
TLLGIEDA

SEQ ID NO: 2464 - protein, 8 aa, Mycobacterium tuberculosis
LLGIEDAS

SEQ ID NO: 2465 - protein, 8 aa, Mycobacterium tuberculosis
LGIEDASR

SEQ ID NO: 2466 - protein, 8 aa, Mycobacterium tuberculosis
GIEDASRL

SEQ ID NO: 2467 - protein, 8 aa, Mycobacterium tuberculosis
IEDASRLD

SEQ ID NO: 2468 - protein, 8 aa, Mycobacterium tuberculosis
EDASRLDV

SEQ ID NO: 2469 - protein, 8 aa, Mycobacterium tuberculosis
DASRLDVP

SEQ ID NO: 2470 - protein, 8 aa, Mycobacterium tuberculosis
ASRLDVPA

SEQ ID NO: 2471 - protein, 8 aa, Mycobacterium tuberculosis
SRLDVPAL

SEQ ID NO: 2472 - protein, 8 aa, Mycobacterium tuberculosis
RLDVPALW

SEQ ID NO: 2473 - protein, 8 aa, Mycobacterium tuberculosis
LDVPALWA

SEQ ID NO: 2474 - protein, 8 aa, Mycobacterium tuberculosis
DVPALWAP

SEQ ID NO: 2475 - protein, 8 aa, Mycobacterium tuberculosis
VPALWAPR

SEQ ID NO: 2476 - protein, 8 aa, Mycobacterium tuberculosis
PALWAPRR

SEQ ID NO: 2477 - protein, 8 aa, Mycobacterium tuberculosis
ALWAPRRR

SEQ ID NO: 2478 - protein, 8 aa, Mycobacterium tuberculosis
LWAPRRRD

SEQ ID NO: 2479 - protein, 8 aa, Mycobacterium tuberculosis
WAPRRRDE

SEQ ID NO: 2480 - protein, 8 aa, Mycobacterium tuberculosis
APRRRDEE

SEQ ID NO: 2481 - protein, 8 aa, Mycobacterium tuberculosis
PRRRDEEL

SEQ ID NO: 2482 - protein, 8 aa, Mycobacterium tuberculosis
RRRDEELR

SEQ ID NO: 2483 - protein, 8 aa, Mycobacterium tuberculosis
RRDEELRV

SEQ ID NO: 2484 - protein, 8 aa, Mycobacterium tuberculosis
RDEELRVP

SEQ ID NO: 2485 - protein, 8 aa, Mycobacterium tuberculosis
DEELRVPI

SEQ ID NO: 2486 - protein, 8 aa, Mycobacterium tuberculosis
EELRVPIG

SEQ ID NO: 2487 - protein, 8 aa, Mycobacterium tuberculosis
ELRVPIGV

SEQ ID NO: 2488 - protein, 8 aa, Mycobacterium tuberculosis
LRVPIGVT

SEQ ID NO: 2489 - protein, 8 aa, Mycobacterium tuberculosis
RVPIGVTG

SEQ ID NO: 2490 - protein, 8 aa, Mycobacterium tuberculosis
VPIGVTGT

SEQ ID NO: 2491 - protein, 8 aa, Mycobacterium tuberculosis
PIGVTGTG

SEQ ID NO: 2492 - protein, 8 aa, Mycobacterium tuberculosis
IGVTGTGE

SEQ ID NO: 2493 - protein, 8 aa, Mycobacterium tuberculosis
GVTGTGEP

SEQ ID NO: 2494 - protein, 8 aa, Mycobacterium tuberculosis
VTGTGEPL

SEQ ID NO: 2495 - protein, 8 aa, Mycobacterium tuberculosis
TGTGEPLM

SEQ ID NO: 2496 - protein, 8 aa, Mycobacterium tuberculosis
GTGEPLMF

SEQ ID NO: 2497 - protein, 8 aa, Mycobacterium tuberculosis
TGEPLMFD

SEQ ID NO: 2498 - protein, 8 aa, Mycobacterium tuberculosis
GEPLMFDL

SEQ ID NO: 2499 - protein, 8 aa, Mycobacterium tuberculosis
EPLMFDLK

SEQ ID NO: 2500 - protein, 8 aa, Mycobacterium tuberculosis
PLMFDLKD

SEQ ID NO: 2501 - protein, 8 aa, Mycobacterium tuberculosis
LMFDLKDE

SEQ ID NO: 2502 - protein, 8 aa, Mycobacterium tuberculosis
MFDLKDEA

SEQ ID NO: 2503 - protein, 8 aa, Mycobacterium tuberculosis
FDLKDEAE

SEQ ID NO: 2504 - protein, 8 aa, Mycobacterium tuberculosis
DLKDEAEG

SEQ ID NO: 2505 - protein, 8 aa, Mycobacterium tuberculosis
LKDEAEGG

SEQ ID NO: 2506 - protein, 8 aa, Mycobacterium tuberculosis
KDEAEGGM

SEQ ID NO: 2507 - protein, 8 aa, Mycobacterium tuberculosis
DEAEGGMG

SEQ ID NO: 2508 - protein, 8 aa, Mycobacterium tuberculosis
EAEGGMGP

SEQ ID NO: 2509 - protein, 8 aa, Mycobacterium tuberculosis
AEGGMGPH

SEQ ID NO: 2510 - protein, 8 aa, Mycobacterium tuberculosis
EGGMGPHG

SEQ ID NO: 2511 - protein, 8 aa, Mycobacterium tuberculosis
GGMGPHGL

SEQ ID NO: 2512 - protein, 8 aa, Mycobacterium tuberculosis
GMGPHGLM

SEQ ID NO: 2513 - protein, 8 aa, Mycobacterium tuberculosis
MGPHGLMI

SEQ ID NO: 2514 - protein, 8 aa, Mycobacterium tuberculosis
GPHGLMIG

SEQ ID NO: 2515 - protein, 8 aa, Mycobacterium tuberculosis
PHGLMIGM

SEQ ID NO: 2516 - protein, 8 aa, Mycobacterium tuberculosis
HGLMIGMT

SEQ ID NO: 2517 - protein, 8 aa, Mycobacterium tuberculosis
GLMIGMTG

SEQ ID NO: 2518 - protein, 8 aa, Mycobacterium tuberculosis
LMIGMTGS

SEQ ID NO: 2519 - protein, 8 aa, Mycobacterium tuberculosis
MIGMTGSG

SEQ ID NO: 2520 - protein, 8 aa, Mycobacterium tuberculosis
IGMTGSGK

SEQ ID NO: 2521 - protein, 8 aa, Mycobacterium tuberculosis
GMTGSGKS

SEQ ID NO: 2522 - protein, 8 aa, Mycobacterium tuberculosis
MTGSGKSQ

SEQ ID NO: 2523 - protein, 8 aa, Mycobacterium tuberculosis
TGSGKSQT

SEQ ID NO: 2524 - protein, 8 aa, Mycobacterium tuberculosis
GSGKSQTL

SEQ ID NO: 2525 - protein, 8 aa, Mycobacterium tuberculosis
SGKSQTLM

SEQ ID NO: 2526 - protein, 8 aa, Mycobacterium tuberculosis
GKSQTLMS

SEQ ID NO: 2527 - protein, 8 aa, Mycobacterium tuberculosis
KSQTLMSI

SEQ ID NO: 2528 - protein, 8 aa, Mycobacterium tuberculosis
SQTLMSIL

SEQ ID NO: 2529 - protein, 8 aa, Mycobacterium tuberculosis
QTLMSILL

SEQ ID NO: 2530 - protein, 8 aa, Mycobacterium tuberculosis
TLMSILLS

SEQ ID NO: 2531 - protein, 8 aa, Mycobacterium tuberculosis
LMSILLSL

SEQ ID NO: 2532 - protein, 8 aa, Mycobacterium tuberculosis
MSILLSLL

SEQ ID NO: 2533 - protein, 8 aa, Mycobacterium tuberculosis
SILLSLLT

SEQ ID NO: 2534 - protein, 8 aa, Mycobacterium tuberculosis
ILLSLLTT

SEQ ID NO: 2535 - protein, 8 aa, Mycobacterium tuberculosis
LLSLLTTH

SEQ ID NO: 2536 - protein, 8 aa, Mycobacterium tuberculosis
LSLLTTHS

SEQ ID NO: 2537 - protein, 8 aa, Mycobacterium tuberculosis
SLLTTHSA

SEQ ID NO: 2538 - protein, 8 aa, Mycobacterium tuberculosis
LLTTHSAE

SEQ ID NO: 2539 - protein, 8 aa, Mycobacterium tuberculosis
LTTHSAER

SEQ ID NO: 2540 - protein, 8 aa, Mycobacterium tuberculosis
TTHSAERL

SEQ ID NO: 2541 - protein, 8 aa, Mycobacterium tuberculosis
THSAERLI

SEQ ID NO: 2542 - protein, 8 aa, Mycobacterium tuberculosis
HSAERLIV

SEQ ID NO: 2543 - protein, 8 aa, Mycobacterium tuberculosis
SAERLIVI

SEQ ID NO: 2544 - protein, 8 aa, Mycobacterium tuberculosis
AERLIVIY

SEQ ID NO: 2545 - protein, 8 aa, Mycobacterium tuberculosis
ERLIVIYA

SEQ ID NO: 2546 - protein, 8 aa, Mycobacterium tuberculosis
RLIVIYAD

SEQ ID NO: 2547 - protein, 8 aa, Mycobacterium tuberculosis
LIVIYADF

SEQ ID NO: 2548 - protein, 8 aa, Mycobacterium tuberculosis
IVIYADFK

SEQ ID NO: 2549 - protein, 8 aa, Mycobacterium tuberculosis
VIYADFKG

SEQ ID NO: 2550 - protein, 8 aa, Mycobacterium tuberculosis
IYADFKGE

SEQ ID NO: 2551 - protein, 8 aa, Mycobacterium tuberculosis
YADFKGEA

SEQ ID NO: 2552 - protein, 8 aa, Mycobacterium tuberculosis
ADFKGEAG

SEQ ID NO: 2553 - protein, 8 aa, Mycobacterium tuberculosis
DFKGEAGA

SEQ ID NO: 2554 - protein, 8 aa, Mycobacterium tuberculosis
FKGEAGAD

SEQ ID NO: 2555 - protein, 8 aa, Mycobacterium tuberculosis
KGEAGADS

SEQ ID NO: 2556 - protein, 8 aa, Mycobacterium tuberculosis
GEAGADSF

SEQ ID NO: 2557 - protein, 8 aa, Mycobacterium tuberculosis
EAGADSFR

SEQ ID NO: 2558 - protein, 8 aa, Mycobacterium tuberculosis
AGADSFRD

SEQ ID NO: 2559 - protein, 8 aa, Mycobacterium tuberculosis
GADSFRDF

SEQ ID NO: 2560 - protein, 8 aa, Mycobacterium tuberculosis
ADSFRDFP

SEQ ID NO: 2561 - protein, 8 aa, Mycobacterium tuberculosis
DSFRDFPQ

SEQ ID NO: 2562 - protein, 8 aa, Mycobacterium tuberculosis
SFRDFPQV

SEQ ID NO: 2563 - protein, 8 aa, Mycobacterium tuberculosis
FRDFPQVV

SEQ ID NO: 2564 - protein, 8 aa, Mycobacterium tuberculosis
RDFPQVVA

SEQ ID NO: 2565 - protein, 8 aa, Mycobacterium tuberculosis
DFPQVVAV

SEQ ID NO: 2566 - protein, 8 aa, Mycobacterium tuberculosis
FPQVVAVI

SEQ ID NO: 2567 - protein, 8 aa, Mycobacterium tuberculosis
PQVVAVIS

SEQ ID NO: 2568 - protein, 8 aa, Mycobacterium tuberculosis
QVVAVISN

SEQ ID NO: 2569 - protein, 8 aa, Mycobacterium tuberculosis
VVAVISNM

SEQ ID NO: 2570 - protein, 8 aa, Mycobacterium tuberculosis
VAVISNMA

SEQ ID NO: 2571 - protein, 8 aa, Mycobacterium tuberculosis
AVISNMAE

SEQ ID NO: 2572 - protein, 8 aa, Mycobacterium tuberculosis
VISNMAEK

SEQ ID NO: 2573 - protein, 8 aa, Mycobacterium tuberculosis
ISNMAEKK

SEQ ID NO: 2574 - protein, 8 aa, Mycobacterium tuberculosis
SNMAEKKS

SEQ ID NO: 2575 - protein, 8 aa, Mycobacterium tuberculosis
NMAEKKSL

SEQ ID NO: 2576 - protein, 8 aa, Mycobacterium tuberculosis
MAEKKSLA

SEQ ID NO: 2577 - protein, 8 aa, Mycobacterium tuberculosis
AEKKSLAD

SEQ ID NO: 2578 - protein, 8 aa, Mycobacterium tuberculosis
EKKSLADR

SEQ ID NO: 2579 - protein, 8 aa, Mycobacterium tuberculosis
KKSLADRF

SEQ ID NO: 2580 - protein, 8 aa, Mycobacterium tuberculosis
KSLADRFA

SEQ ID NO: 2581 - protein, 8 aa, Mycobacterium tuberculosis
SLADRFAD

SEQ ID NO: 2582 - protein, 8 aa, Mycobacterium tuberculosis
LADRFADT

SEQ ID NO: 2583 - protein, 8 aa, Mycobacterium tuberculosis
ADRFADTL

SEQ ID NO: 2584 - protein, 8 aa, Mycobacterium tuberculosis
DRFADTLR

SEQ ID NO: 2585 - protein, 8 aa, Mycobacterium tuberculosis
RFADTLRG

SEQ ID NO: 2586 - protein, 8 aa, Mycobacterium tuberculosis
FADTLRGE

SEQ ID NO: 2587 - protein, 8 aa, Mycobacterium tuberculosis
ADTLRGEV

SEQ ID NO: 2588 - protein, 8 aa, Mycobacterium tuberculosis
DTLRGEVA

SEQ ID NO: 2589 - protein, 8 aa, Mycobacterium tuberculosis
TLRGEVAR

SEQ ID NO: 2590 - protein, 8 aa, Mycobacterium tuberculosis
LRGEVARR

SEQ ID NO: 2591 - protein, 8 aa, Mycobacterium tuberculosis
RGEVARRE

SEQ ID NO: 2592 - protein, 8 aa, Mycobacterium tuberculosis
GEVARREM

SEQ ID NO: 2593 - protein, 8 aa, Mycobacterium tuberculosis
EVARREML

SEQ ID NO: 2594 - protein, 8 aa, Mycobacterium tuberculosis
VARREMLL

SEQ ID NO: 2595 - protein, 8 aa, Mycobacterium tuberculosis
ARREMLLR

SEQ ID NO: 2596 - protein, 8 aa, Mycobacterium tuberculosis
RREMLLRE

SEQ ID NO: 2597 - protein, 8 aa, Mycobacterium tuberculosis
REMLLREA

SEQ ID NO: 2598 - protein, 8 aa, Mycobacterium tuberculosis
EMLLREAG

SEQ ID NO: 2599 - protein, 8 aa, Mycobacterium tuberculosis
MLLREAGR

SEQ ID NO: 2600 - protein, 8 aa, Mycobacterium tuberculosis
LLREAGRK

SEQ ID NO: 2601 - protein, 8 aa, Mycobacterium tuberculosis
LREAGRKV

SEQ ID NO: 2602 - protein, 8 aa, Mycobacterium tuberculosis
REAGRKVQ

SEQ ID NO: 2603 - protein, 8 aa, Mycobacterium tuberculosis
EAGRKVQG

SEQ ID NO: 2604 - protein, 8 aa, Mycobacterium tuberculosis
AGRKVQGS

SEQ ID NO: 2605 - protein, 8 aa, Mycobacterium tuberculosis
GRKVQGSA

SEQ ID NO: 2606 - protein, 8 aa, Mycobacterium tuberculosis
RKVQGSAF

SEQ ID NO: 2607 - protein, 8 aa, Mycobacterium tuberculosis
KVQGSAFN

SEQ ID NO: 2608 - protein, 8 aa, Mycobacterium tuberculosis
VQGSAFNS

SEQ ID NO: 2609 - protein, 8 aa, Mycobacterium tuberculosis
QGSAFNSV

SEQ ID NO: 2610 - protein, 8 aa, Mycobacterium tuberculosis
GSAFNSVL

SEQ ID NO: 2611 - protein, 8 aa, Mycobacterium tuberculosis
SAFNSVLE

SEQ ID NO: 2612 - protein, 8 aa, Mycobacterium tuberculosis
AFNSVLEY

SEQ ID NO: 2613 - protein, 8 aa, Mycobacterium tuberculosis
FNSVLEYE

SEQ ID NO: 2614 - protein, 8 aa, Mycobacterium tuberculosis
NSVLEYEN

SEQ ID NO: 2615 - protein, 8 aa, Mycobacterium tuberculosis
SVLEYENA

SEQ ID NO: 2616 - protein, 8 aa, Mycobacterium tuberculosis
VLEYENAI

SEQ ID NO: 2617 - protein, 8 aa, Mycobacterium tuberculosis
LEYENAIA

SEQ ID NO: 2618 - protein, 8 aa, Mycobacterium tuberculosis
EYENAIAA

SEQ ID NO: 2619 - protein, 8 aa, Mycobacterium tuberculosis
YENAIAAG

SEQ ID NO: 2620 - protein, 8 aa, Mycobacterium tuberculosis
ENAIAAGH

SEQ ID NO: 2621 - protein, 8 aa, Mycobacterium tuberculosis
NAIAAGHS

SEQ ID NO: 2622 - protein, 8 aa, Mycobacterium tuberculosis
AIAAGHSL

SEQ ID NO: 2623 - protein, 8 aa, Mycobacterium tuberculosis
IAAGHSLP

SEQ ID NO: 2624 - protein, 8 aa, Mycobacterium tuberculosis
AAGHSLPP

SEQ ID NO: 2625 - protein, 8 aa, Mycobacterium tuberculosis
AGHSLPPI

SEQ ID NO: 2626 - protein, 8 aa, Mycobacterium tuberculosis
GHSLPPIP

SEQ ID NO: 2627 - protein, 8 aa, Mycobacterium tuberculosis
HSLPPIPT

SEQ ID NO: 2628 - protein, 8 aa, Mycobacterium tuberculosis
SLPPIPTL

SEQ ID NO: 2629 - protein, 8 aa, Mycobacterium tuberculosis
LPPIPTLF

SEQ ID NO: 2630 - protein, 8 aa, Mycobacterium tuberculosis
PPIPTLFV

SEQ ID NO: 2631 - protein, 8 aa, Mycobacterium tuberculosis
PIPTLFVV

SEQ ID NO: 2632 - protein, 8 aa, Mycobacterium tuberculosis
IPTLFVVA

SEQ ID NO: 2633 - protein, 8 aa, Mycobacterium tuberculosis
PTLFVVAD

SEQ ID NO: 2634 - protein, 8 aa, Mycobacterium tuberculosis
TLFVVADE

SEQ ID NO: 2635 - protein, 8 aa, Mycobacterium tuberculosis
LFVVADEF

SEQ ID NO: 2636 - protein, 8 aa, Mycobacterium tuberculosis
FVVADEFT

SEQ ID NO: 2637 - protein, 8 aa, Mycobacterium tuberculosis
VVADEFTL

SEQ ID NO: 2638 - protein, 8 aa, Mycobacterium tuberculosis
VADEFTLM

SEQ ID NO: 2639 - protein, 8 aa, Mycobacterium tuberculosis
ADEFTLML

SEQ ID NO: 2640 - protein, 8 aa, Mycobacterium tuberculosis
DEFTLMLA

SEQ ID NO: 2641 - protein, 8 aa, Mycobacterium tuberculosis
EFTLMLAD

SEQ ID NO: 2642 - protein, 8 aa, Mycobacterium tuberculosis
FTLMLADH

SEQ ID NO: 2643 - protein, 8 aa, Mycobacterium tuberculosis
TLMLADHP

SEQ ID NO: 2644 - protein, 8 aa, Mycobacterium tuberculosis
LMLADHPE

SEQ ID NO: 2645 - protein, 8 aa, Mycobacterium tuberculosis
MLADHPEY

SEQ ID NO: 2646 - protein, 8 aa, Mycobacterium tuberculosis
LADHPEYA

SEQ ID NO: 2647 - protein, 8 aa, Mycobacterium tuberculosis
ADHPEYAE

SEQ ID NO: 2648 - protein, 8 aa, Mycobacterium tuberculosis
DHPEYAEL

SEQ ID NO: 2649 - protein, 8 aa, Mycobacterium tuberculosis
HPEYAELF

SEQ ID NO: 2650 - protein, 8 aa, Mycobacterium tuberculosis
PEYAELFD

SEQ ID NO: 2651 - protein, 8 aa, Mycobacterium tuberculosis
EYAELFDY

SEQ ID NO: 2652 - protein, 8 aa, Mycobacterium tuberculosis
YAELFDYV

SEQ ID NO: 2653 - protein, 8 aa, Mycobacterium tuberculosis
AELFDYVA

SEQ ID NO: 2654 - protein, 8 aa, Mycobacterium tuberculosis
ELFDYVAR

SEQ ID NO: 2655 - protein, 8 aa, Mycobacterium tuberculosis
LFDYVARK

SEQ ID NO: 2656 - protein, 8 aa, Mycobacterium tuberculosis
FDYVARKG

SEQ ID NO: 2657 - protein, 8 aa, Mycobacterium tuberculosis
DYVARKGR

SEQ ID NO: 2658 - protein, 8 aa, Mycobacterium tuberculosis
YVARKGRS

SEQ ID NO: 2659 - protein, 8 aa, Mycobacterium tuberculosis
VARKGRSF

SEQ ID NO: 2660 - protein, 8 aa, Mycobacterium tuberculosis
ARKGRSFR

SEQ ID NO: 2661 - protein, 8 aa, Mycobacterium tuberculosis
RKGRSFRI

SEQ ID NO: 2662 - protein, 8 aa, Mycobacterium tuberculosis
KGRSFRIH

SEQ ID NO: 2663 - protein, 8 aa, Mycobacterium tuberculosis
GRSFRIHI

SEQ ID NO: 2664 - protein, 8 aa, Mycobacterium tuberculosis
RSFRIHIL

SEQ ID NO: 2665 - protein, 8 aa, Mycobacterium tuberculosis
SFRIHILF

SEQ ID NO: 2666 - protein, 8 aa, Mycobacterium tuberculosis
FRIHILFA

SEQ ID NO: 2667 - protein, 8 aa, Mycobacterium tuberculosis
RIHILFAS

SEQ ID NO: 2668 - protein, 8 aa, Mycobacterium tuberculosis
IHILFASQ

SEQ ID NO: 2669 - protein, 8 aa, Mycobacterium tuberculosis
HILFASQT

SEQ ID NO: 2670 - protein, 8 aa, Mycobacterium tuberculosis
ILFASQTL

SEQ ID NO: 2671 - protein, 8 aa, Mycobacterium tuberculosis
LFASQTLD

SEQ ID NO: 2672 - protein, 8 aa, Mycobacterium tuberculosis
FASQTLDV

SEQ ID NO: 2673 - protein, 8 aa, Mycobacterium tuberculosis
ASQTLDVG

SEQ ID NO: 2674 - protein, 8 aa, Mycobacterium tuberculosis
SQTLDVGK

SEQ ID NO: 2675 - protein, 8 aa, Mycobacterium tuberculosis
QTLDVGKI

SEQ ID NO: 2676 - protein, 8 aa, Mycobacterium tuberculosis
TLDVGKIK

SEQ ID NO: 2677 - protein, 8 aa, Mycobacterium tuberculosis
LDVGKIKD

SEQ ID NO: 2678 - protein, 8 aa, Mycobacterium tuberculosis
DVGKIKDI

SEQ ID NO: 2679 - protein, 8 aa, Mycobacterium tuberculosis
VGKIKDID

SEQ ID NO: 2680 - protein, 8 aa, Mycobacterium tuberculosis
GKIKDIDK

SEQ ID NO: 2681 - protein, 8 aa, Mycobacterium tuberculosis
KIKDIDKN

SEQ ID NO: 2682 - protein, 8 aa, Mycobacterium tuberculosis
IKDIDKNT

SEQ ID NO: 2683 - protein, 8 aa, Mycobacterium tuberculosis
KDIDKNTA

SEQ ID NO: 2684 - protein, 8 aa, Mycobacterium tuberculosis
DIDKNTAY

SEQ ID NO: 2685 - protein, 8 aa, Mycobacterium tuberculosis
IDKNTAYR

SEQ ID NO: 2686 - protein, 8 aa, Mycobacterium tuberculosis
DKNTAYRI

SEQ ID NO: 2687 - protein, 8 aa, Mycobacterium tuberculosis
KNTAYRIG

SEQ ID NO: 2688 - protein, 8 aa, Mycobacterium tuberculosis
NTAYRIGL

SEQ ID NO: 2689 - protein, 8 aa, Mycobacterium tuberculosis
TAYRIGLK

SEQ ID NO: 2690 - protein, 8 aa, Mycobacterium tuberculosis
AYRIGLKV

SEQ ID NO: 2691 - protein, 8 aa, Mycobacterium tuberculosis
YRIGLKVA

SEQ ID NO: 2692 - protein, 8 aa, Mycobacterium tuberculosis
RIGLKVAS

SEQ ID NO: 2693 - protein, 8 aa, Mycobacterium tuberculosis
IGLKVASP

SEQ ID NO: 2694 - protein, 8 aa, Mycobacterium tuberculosis
GLKVASPS

SEQ ID NO: 2695 - protein, 8 aa, Mycobacterium tuberculosis
LKVASPSV

SEQ ID NO: 2696 - protein, 8 aa, Mycobacterium tuberculosis
KVASPSVS

SEQ ID NO: 2697 - protein, 8 aa, Mycobacterium tuberculosis
VASPSVSR

SEQ ID NO: 2698 - protein, 8 aa, Mycobacterium tuberculosis
ASPSVSRQ

SEQ ID NO: 2699 - protein, 8 aa, Mycobacterium tuberculosis
SPSVSRQI

SEQ ID NO: 2700 - protein, 8 aa, Mycobacterium tuberculosis
PSVSRQII

SEQ ID NO: 2701 - protein, 8 aa, Mycobacterium tuberculosis
SVSRQIIG

SEQ ID NO: 2702 - protein, 8 aa, Mycobacterium tuberculosis
VSRQIIGV

SEQ ID NO: 2703 - protein, 8 aa, Mycobacterium tuberculosis
SRQIIGVE

SEQ ID NO: 2704 - protein, 8 aa, Mycobacterium tuberculosis
RQIIGVED

SEQ ID NO: 2705 - protein, 8 aa, Mycobacterium tuberculosis
QIIGVEDA

SEQ ID NO: 2706 - protein, 8 aa, Mycobacterium tuberculosis
IIGVEDAY

SEQ ID NO: 2707 - protein, 8 aa, Mycobacterium tuberculosis
IGVEDAYH

SEQ ID NO: 2708 - protein, 8 aa, Mycobacterium tuberculosis
GVEDAYHI

SEQ ID NO: 2709 - protein, 8 aa, Mycobacterium tuberculosis
VEDAYHIE

SEQ ID NO: 2710 - protein, 8 aa, Mycobacterium tuberculosis
EDAYHIES

SEQ ID NO: 2711 - protein, 8 aa, Mycobacterium tuberculosis
DAYHIESG

SEQ ID NO: 2712 - protein, 8 aa, Mycobacterium tuberculosis
AYHIESGK

SEQ ID NO: 2713 - protein, 8 aa, Mycobacterium tuberculosis
YHIESGKE

SEQ ID NO: 2714 - protein, 8 aa, Mycobacterium tuberculosis
HIESGKEH

SEQ ID NO: 2715 - protein, 8 aa, Mycobacterium tuberculosis
IESGKEHK

SEQ ID NO: 2716 - protein, 8 aa, Mycobacterium tuberculosis
ESGKEHKG

SEQ ID NO: 2717 - protein, 8 aa, Mycobacterium tuberculosis
SGKEHKGV

SEQ ID NO: 2718 - protein, 8 aa, Mycobacterium tuberculosis
GKEHKGVG

SEQ ID NO: 2719 - protein, 8 aa, Mycobacterium tuberculosis
KEHKGVGF

SEQ ID NO: 2720 - protein, 8 aa, Mycobacterium tuberculosis
EHKGVGFL

SEQ ID NO: 2721 - protein, 8 aa, Mycobacterium tuberculosis
HKGVGFLV

SEQ ID NO: 2722 - protein, 8 aa, Mycobacterium tuberculosis
KGVGFLVP

SEQ ID NO: 2723 - protein, 8 aa, Mycobacterium tuberculosis
GVGFLVPA

SEQ ID NO: 2724 - protein, 8 aa, Mycobacterium tuberculosis
VGFLVPAP

SEQ ID NO: 2725 - protein, 8 aa, Mycobacterium tuberculosis
GFLVPAPG

SEQ ID NO: 2726 - protein, 8 aa, Mycobacterium tuberculosis
FLVPAPGA

SEQ ID NO: 2727 - protein, 8 aa, Mycobacterium tuberculosis
LVPAPGAT

SEQ ID NO: 2728 - protein, 8 aa, Mycobacterium tuberculosis
VPAPGATP

SEQ ID NO: 2729 - protein, 8 aa, Mycobacterium tuberculosis
PAPGATPI

SEQ ID NO: 2730 - protein, 8 aa, Mycobacterium tuberculosis
APGATPIR

SEQ ID NO: 2731 - protein, 8 aa, Mycobacterium tuberculosis
PGATPIRF

SEQ ID NO: 2732 - protein, 8 aa, Mycobacterium tuberculosis
GATPIRFR

SEQ ID NO: 2733 - protein, 8 aa, Mycobacterium tuberculosis
ATPIRFRS

SEQ ID NO: 2734 - protein, 8 aa, Mycobacterium tuberculosis
TPIRFRST

SEQ ID NO: 2735 - protein, 8 aa, Mycobacterium tuberculosis
PIRFRSTY

SEQ ID NO: 2736 - protein, 8 aa, Mycobacterium tuberculosis
IRFRSTYV

SEQ ID NO: 2737 - protein, 8 aa, Mycobacterium tuberculosis
RFRSTYVD

SEQ ID NO: 2738 - protein, 8 aa, Mycobacterium tuberculosis
FRSTYVDG

SEQ ID NO: 2739 - protein, 8 aa, Mycobacterium tuberculosis
RSTYVDGI

SEQ ID NO: 2740 - protein, 8 aa, Mycobacterium tuberculosis
STYVDGIY

SEQ ID NO: 2741 - protein, 8 aa, Mycobacterium tuberculosis
TYVDGIYE

SEQ ID NO: 2742 - protein, 8 aa, Mycobacterium tuberculosis
YVDGIYEP

SEQ ID NO: 2743 - protein, 8 aa, Mycobacterium tuberculosis
VDGIYEPP

SEQ ID NO: 2744 - protein, 8 aa, Mycobacterium tuberculosis
DGIYEPPQ

SEQ ID NO: 2745 - protein, 8 aa, Mycobacterium tuberculosis
GIYEPPQT

SEQ ID NO: 2746 - protein, 8 aa, Mycobacterium tuberculosis
IYEPPQTA

SEQ ID NO: 2747 - protein, 8 aa, Mycobacterium tuberculosis
YEPPQTAK

SEQ ID NO: 2748 - protein, 8 aa, Mycobacterium tuberculosis
EPPQTAKA

SEQ ID NO: 2749 - protein, 8 aa, Mycobacterium tuberculosis
PPQTAKAV

SEQ ID NO: 2750 - protein, 8 aa, Mycobacterium tuberculosis
PQTAKAVV

SEQ ID NO: 2751 - protein, 8 aa, Mycobacterium tuberculosis
QTAKAVVV

SEQ ID NO: 2752 - protein, 8 aa, Mycobacterium tuberculosis
TAKAVVVQ

SEQ ID NO: 2753 - protein, 8 aa, Mycobacterium tuberculosis
AKAVVVQS

SEQ ID NO: 2754 - protein, 8 aa, Mycobacterium tuberculosis
KAVVVQSV

SEQ ID NO: 2755 - protein, 8 aa, Mycobacterium tuberculosis
AVVVQSVP

SEQ ID NO: 2756 - protein, 8 aa, Mycobacterium tuberculosis
VVVQSVPE

SEQ ID NO: 2757 - protein, 8 aa, Mycobacterium tuberculosis
VVQSVPEP

SEQ ID NO: 2758 - protein, 8 aa, Mycobacterium tuberculosis
VQSVPEPK

SEQ ID NO: 2759 - protein, 8 aa, Mycobacterium tuberculosis
QSVPEPKL

SEQ ID NO: 2760 - protein, 8 aa, Mycobacterium tuberculosis
SVPEPKLF

SEQ ID NO: 2761 - protein, 8 aa, Mycobacterium tuberculosis
VPEPKLFT

SEQ ID NO: 2762 - protein, 8 aa, Mycobacterium tuberculosis
PEPKLFTA

SEQ ID NO: 2763 - protein, 8 aa, Mycobacterium tuberculosis
EPKLFTAA

SEQ ID NO: 2764 - protein, 8 aa, Mycobacterium tuberculosis
PKLFTAAA

SEQ ID NO: 2765 - protein, 8 aa, Mycobacterium tuberculosis
KLFTAAAV

SEQ ID NO: 2766 - protein, 8 aa, Mycobacterium tuberculosis
LFTAAAVE

SEQ ID NO: 2767 - protein, 8 aa, Mycobacterium tuberculosis
FTAAAVEP

SEQ ID NO: 2768 - protein, 8 aa, Mycobacterium tuberculosis
TAAAVEPD

SEQ ID NO: 2769 - protein, 8 aa, Mycobacterium tuberculosis
AAAVEPDP

SEQ ID NO: 2770 - protein, 8 aa, Mycobacterium tuberculosis
AAVEPDPG

SEQ ID NO: 2771 - protein, 8 aa, Mycobacterium tuberculosis
AVEPDPGT

SEQ ID NO: 2772 - protein, 8 aa, Mycobacterium tuberculosis
VEPDPGTV

SEQ ID NO: 2773 - protein, 8 aa, Mycobacterium tuberculosis
EPDPGTVI

SEQ ID NO: 2774 - protein, 8 aa, Mycobacterium tuberculosis
PDPGTVIA

SEQ ID NO: 2775 - protein, 8 aa, Mycobacterium tuberculosis
DPGTVIAD

SEQ ID NO: 2776 - protein, 8 aa, Mycobacterium tuberculosis
PGTVIADT

SEQ ID NO: 2777 - protein, 8 aa, Mycobacterium tuberculosis
GTVIADTD

SEQ ID NO: 2778 - protein, 8 aa, Mycobacterium tuberculosis
TVIADTDE

SEQ ID NO: 2779 - protein, 8 aa, Mycobacterium tuberculosis
VIADTDEQ

SEQ ID NO: 2780 - protein, 8 aa, Mycobacterium tuberculosis
IADTDEQE

SEQ ID NO: 2781 - protein, 8 aa, Mycobacterium tuberculosis
ADTDEQEP

SEQ ID NO: 2782 - protein, 8 aa, Mycobacterium tuberculosis
DTDEQEPA

SEQ ID NO: 2783 - protein, 8 aa, Mycobacterium tuberculosis
TDEQEPAD

SEQ ID NO: 2784 - protein, 8 aa, Mycobacterium tuberculosis
DEQEPADP

SEQ ID NO: 2785 - protein, 8 aa, Mycobacterium tuberculosis
EQEPADPP

SEQ ID NO: 2786 - protein, 8 aa, Mycobacterium tuberculosis
QEPADPPR

SEQ ID NO: 2787 - protein, 8 aa, Mycobacterium tuberculosis
EPADPPRK

SEQ ID NO: 2788 - protein, 8 aa, Mycobacterium tuberculosis
PADPPRKL

SEQ ID NO: 2789 - protein, 8 aa, Mycobacterium tuberculosis
ADPPRKLI

SEQ ID NO: 2790 - protein, 8 aa, Mycobacterium tuberculosis
DPPRKLIA

SEQ ID NO: 2791 - protein, 8 aa, Mycobacterium tuberculosis
PPRKLIAT

SEQ ID NO: 2792 - protein, 8 aa, Mycobacterium tuberculosis
PRKLIATI

SEQ ID NO: 2793 - protein, 8 aa, Mycobacterium tuberculosis
RKLIATIG

SEQ ID NO: 2794 - protein, 8 aa, Mycobacterium tuberculosis
KLIATIGE

SEQ ID NO: 2795 - protein, 8 aa, Mycobacterium tuberculosis
LIATIGEQ

SEQ ID NO: 2796 - protein, 8 aa, Mycobacterium tuberculosis
IATIGEQL

SEQ ID NO: 2797 - protein, 8 aa, Mycobacterium tuberculosis
ATIGEQLA

SEQ ID NO: 2798 - protein, 8 aa, Mycobacterium tuberculosis
TIGEQLAR

SEQ ID NO: 2799 - protein, 8 aa, Mycobacterium tuberculosis
IGEQLARY

SEQ ID NO: 2800 - protein, 8 aa, Mycobacterium tuberculosis
GEQLARYG

SEQ ID NO: 2801 - protein, 8 aa, Mycobacterium tuberculosis
EQLARYGP

SEQ ID NO: 2802 - protein, 8 aa, Mycobacterium tuberculosis
QLARYGPR

SEQ ID NO: 2803 - protein, 8 aa, Mycobacterium tuberculosis
LARYGPRA

SEQ ID NO: 2804 - protein, 8 aa, Mycobacterium tuberculosis
ARYGPRAP

SEQ ID NO: 2805 - protein, 8 aa, Mycobacterium tuberculosis
RYGPRAPQ

SEQ ID NO: 2806 - protein, 8 aa, Mycobacterium tuberculosis
YGPRAPQL

SEQ ID NO: 2807 - protein, 8 aa, Mycobacterium tuberculosis
GPRAPQLW

SEQ ID NO: 2808 - protein, 8 aa, Mycobacterium tuberculosis
PRAPQLWL

SEQ ID NO: 2809 - protein, 8 aa, Mycobacterium tuberculosis
RAPQLWLP

SEQ ID NO: 2810 - protein, 8 aa, Mycobacterium tuberculosis
APQLWLPP

SEQ ID NO: 2811 - protein, 8 aa, Mycobacterium tuberculosis
PQLWLPPL

SEQ ID NO: 2812 - protein, 8 aa, Mycobacterium tuberculosis
QLWLPPLD

SEQ ID NO: 2813 - protein, 8 aa, Mycobacterium tuberculosis
LWLPPLDE

SEQ ID NO: 2814 - protein, 8 aa, Mycobacterium tuberculosis
WLPPLDET

SEQ ID NO: 2815 - protein, 8 aa, Mycobacterium tuberculosis
LPPLDETI

SEQ ID NO: 2816 - protein, 8 aa, Mycobacterium tuberculosis
PPLDETIP

SEQ ID NO: 2817 - protein, 8 aa, Mycobacterium tuberculosis
PLDETIPL

SEQ ID NO: 2818 - protein, 8 aa, Mycobacterium tuberculosis
LDETIPLS

SEQ ID NO: 2819 - protein, 8 aa, Mycobacterium tuberculosis
DETIPLSA

SEQ ID NO: 2820 - protein, 8 aa, Mycobacterium tuberculosis
ETIPLSAA

SEQ ID NO: 2821 - protein, 8 aa, Mycobacterium tuberculosis
TIPLSAAL

SEQ ID NO: 2822 - protein, 8 aa, Mycobacterium tuberculosis
IPLSAALA

SEQ ID NO: 2823 - protein, 8 aa, Mycobacterium tuberculosis
PLSAALAR

SEQ ID NO: 2824 - protein, 8 aa, Mycobacterium tuberculosis
LSAALARA

SEQ ID NO: 2825 - protein, 8 aa, Mycobacterium tuberculosis
SAALARAG

SEQ ID NO: 2826 - protein, 8 aa, Mycobacterium tuberculosis
AALARAGV

SEQ ID NO: 2827 - protein, 8 aa, Mycobacterium tuberculosis
ALARAGVG

SEQ ID NO: 2828 - protein, 8 aa, Mycobacterium tuberculosis
LARAGVGP

SEQ ID NO: 2829 - protein, 8 aa, Mycobacterium tuberculosis
ARAGVGPR

SEQ ID NO: 2830 - protein, 8 aa, Mycobacterium tuberculosis
RAGVGPRQ

SEQ ID NO: 2831 - protein, 8 aa, Mycobacterium tuberculosis
AGVGPRQW

SEQ ID NO: 2832 - protein, 8 aa, Mycobacterium tuberculosis
GVGPRQWR

SEQ ID NO: 2833 - protein, 8 aa, Mycobacterium tuberculosis
VGPRQWRW

SEQ ID NO: 2834 - protein, 8 aa, Mycobacterium tuberculosis
GPRQWRWP

SEQ ID NO: 2835 - protein, 8 aa, Mycobacterium tuberculosis
PRQWRWPL

SEQ ID NO: 2836 - protein, 8 aa, Mycobacterium tuberculosis
RQWRWPLG

SEQ ID NO: 2837 - protein, 8 aa, Mycobacterium tuberculosis
QWRWPLGE

SEQ ID NO: 2838 - protein, 8 aa, Mycobacterium tuberculosis
WRWPLGEI

SEQ ID NO: 2839 - protein, 8 aa, Mycobacterium tuberculosis
RWPLGEID

SEQ ID NO: 2840 - protein, 8 aa, Mycobacterium tuberculosis
WPLGEIDR

SEQ ID NO: 2841 - protein, 8 aa, Mycobacterium tuberculosis
PLGEIDRP

SEQ ID NO: 2842 - protein, 8 aa, Mycobacterium tuberculosis
LGEIDRPF

SEQ ID NO: 2843 - protein, 8 aa, Mycobacterium tuberculosis
GEIDRPFE

SEQ ID NO: 2844 - protein, 8 aa, Mycobacterium tuberculosis
EIDRPFEM

SEQ ID NO: 2845 - protein, 8 aa, Mycobacterium tuberculosis
IDRPFEMR

SEQ ID NO: 2846 - protein, 8 aa, Mycobacterium tuberculosis
DRPFEMRR

SEQ ID NO: 2847 - protein, 8 aa, Mycobacterium tuberculosis
RPFEMRRD

SEQ ID NO: 2848 - protein, 8 aa, Mycobacterium tuberculosis
PFEMRRDP

SEQ ID NO: 2849 - protein, 8 aa, Mycobacterium tuberculosis
FEMRRDPL

SEQ ID NO: 2850 - protein, 8 aa, Mycobacterium tuberculosis
EMRRDPLV

SEQ ID NO: 2851 - protein, 8 aa, Mycobacterium tuberculosis
MRRDPLVF

SEQ ID NO: 2852 - protein, 8 aa, Mycobacterium tuberculosis
RRDPLVFD

SEQ ID NO: 2853 - protein, 8 aa, Mycobacterium tuberculosis
RDPLVFDA

SEQ ID NO: 2854 - protein, 8 aa, Mycobacterium tuberculosis
DPLVFDAR

SEQ ID NO: 2855 - protein, 8 aa, Mycobacterium tuberculosis
PLVFDARS

SEQ ID NO: 2856 - protein, 8 aa, Mycobacterium tuberculosis
LVFDARSS

SEQ ID NO: 2857 - protein, 8 aa, Mycobacterium tuberculosis
VFDARSSA

SEQ ID NO: 2858 - protein, 8 aa, Mycobacterium tuberculosis
FDARSSAG

SEQ ID NO: 2859 - protein, 8 aa, Mycobacterium tuberculosis
DARSSAGN

SEQ ID NO: 2860 - protein, 8 aa, Mycobacterium tuberculosis
ARSSAGNM

SEQ ID NO: 2861 - protein, 8 aa, Mycobacterium tuberculosis
RSSAGNMV

SEQ ID NO: 2862 - protein, 8 aa, Mycobacterium tuberculosis
SSAGNMVI

SEQ ID NO: 2863 - protein, 8 aa, Mycobacterium tuberculosis
SAGNMVIH

SEQ ID NO: 2864 - protein, 8 aa, Mycobacterium tuberculosis
AGNMVIHG

SEQ ID NO: 2865 - protein, 8 aa, Mycobacterium tuberculosis
GNMVIHGG

SEQ ID NO: 2866 - protein, 8 aa, Mycobacterium tuberculosis
NMVIHGGP

SEQ ID NO: 2867 - protein, 8 aa, Mycobacterium tuberculosis
MVIHGGPK

SEQ ID NO: 2868 - protein, 8 aa, Mycobacterium tuberculosis
VIHGGPKS

SEQ ID NO: 2869 - protein, 8 aa, Mycobacterium tuberculosis
IHGGPKSG

SEQ ID NO: 2870 - protein, 8 aa, Mycobacterium tuberculosis
HGGPKSGK

SEQ ID NO: 2871 - protein, 8 aa, Mycobacterium tuberculosis
GGPKSGKS

SEQ ID NO: 2872 - protein, 8 aa, Mycobacterium tuberculosis
GPKSGKST

SEQ ID NO: 2873 - protein, 8 aa, Mycobacterium tuberculosis
PKSGKSTA

SEQ ID NO: 2874 - protein, 8 aa, Mycobacterium tuberculosis
KSGKSTAL

SEQ ID NO: 2875 - protein, 8 aa, Mycobacterium tuberculosis
SGKSTALQ

SEQ ID NO: 2876 - protein, 8 aa, Mycobacterium tuberculosis
GKSTALQT

SEQ ID NO: 2877 - protein, 8 aa, Mycobacterium tuberculosis
KSTALQTF

SEQ ID NO: 2878 - protein, 8 aa, Mycobacterium tuberculosis
STALQTFI

SEQ ID NO: 2879 - protein, 8 aa, Mycobacterium tuberculosis
TALQTFIL

SEQ ID NO: 2880 - protein, 8 aa, Mycobacterium tuberculosis
ALQTFILS

SEQ ID NO: 2881 - protein, 8 aa, Mycobacterium tuberculosis
LQTFILSA

SEQ ID NO: 2882 - protein, 8 aa, Mycobacterium tuberculosis
QTFILSAA

SEQ ID NO: 2883 - protein, 8 aa, Mycobacterium tuberculosis
TFILSAAS

SEQ ID NO: 2884 - protein, 8 aa, Mycobacterium tuberculosis
FILSAASL

SEQ ID NO: 2885 - protein, 8 aa, Mycobacterium tuberculosis
ILSAASLH

SEQ ID NO: 2886 - protein, 8 aa, Mycobacterium tuberculosis
LSAASLHS

SEQ ID NO: 2887 - protein, 8 aa, Mycobacterium tuberculosis
SAASLHSP

SEQ ID NO: 2888 - protein, 8 aa, Mycobacterium tuberculosis
AASLHSPH

SEQ ID NO: 2889 - protein, 8 aa, Mycobacterium tuberculosis
ASLHSPHE

SEQ ID NO: 2890 - protein, 8 aa, Mycobacterium tuberculosis
SLHSPHEV

SEQ ID NO: 2891 - protein, 8 aa, Mycobacterium tuberculosis
LHSPHEVS

SEQ ID NO: 2892 - protein, 8 aa, Mycobacterium tuberculosis
HSPHEVSF

SEQ ID NO: 2893 - protein, 8 aa, Mycobacterium tuberculosis
SPHEVSFY

SEQ ID NO: 2894 - protein, 8 aa, Mycobacterium tuberculosis
PHEVSFYC

SEQ ID NO: 2895 - protein, 8 aa, Mycobacterium tuberculosis
HEVSFYCL

SEQ ID NO: 2896 - protein, 8 aa, Mycobacterium tuberculosis
EVSFYCLD

SEQ ID NO: 2897 - protein, 8 aa, Mycobacterium tuberculosis
VSFYCLDY

SEQ ID NO: 2898 - protein, 8 aa, Mycobacterium tuberculosis
SFYCLDYG

SEQ ID NO: 2899 - protein, 8 aa, Mycobacterium tuberculosis
FYCLDYGG

SEQ ID NO: 2900 - protein, 8 aa, Mycobacterium tuberculosis
YCLDYGGG

SEQ ID NO: 2901 - protein, 8 aa, Mycobacterium tuberculosis
CLDYGGGQ

SEQ ID NO: 2902 - protein, 8 aa, Mycobacterium tuberculosis
LDYGGGQL

SEQ ID NO: 2903 - protein, 8 aa, Mycobacterium tuberculosis
DYGGGQLR

SEQ ID NO: 2904 - protein, 8 aa, Mycobacterium tuberculosis
YGGGQLRA

SEQ ID NO: 2905 - protein, 8 aa, Mycobacterium tuberculosis
GGGQLRAL

SEQ ID NO: 2906 - protein, 8 aa, Mycobacterium tuberculosis
GGQLRALQ

SEQ ID NO: 2907 - protein, 8 aa, Mycobacterium tuberculosis
GQLRALQD

SEQ ID NO: 2908 - protein, 8 aa, Mycobacterium tuberculosis
QLRALQDL

SEQ ID NO: 2909 - protein, 8 aa, Mycobacterium tuberculosis
LRALQDLA

SEQ ID NO: 2910 - protein, 8 aa, Mycobacterium tuberculosis
RALQDLAH

SEQ ID NO: 2911 - protein, 8 aa, Mycobacterium tuberculosis
ALQDLAHV

SEQ ID NO: 2912 - protein, 8 aa, Mycobacterium tuberculosis
LQDLAHVG

SEQ ID NO: 2913 - protein, 8 aa, Mycobacterium tuberculosis
QDLAHVGS

SEQ ID NO: 2914 - protein, 8 aa, Mycobacterium tuberculosis
DLAHVGSV

SEQ ID NO: 2915 - protein, 8 aa, Mycobacterium tuberculosis
LAHVGSVA

SEQ ID NO: 2916 - protein, 8 aa, Mycobacterium tuberculosis
AHVGSVAS

SEQ ID NO: 2917 - protein, 8 aa, Mycobacterium tuberculosis
HVGSVASA

SEQ ID NO: 2918 - protein, 8 aa, Mycobacterium tuberculosis
VGSVASAL

SEQ ID NO: 2919 - protein, 8 aa, Mycobacterium tuberculosis
GSVASALE

SEQ ID NO: 2920 - protein, 8 aa, Mycobacterium tuberculosis
SVASALEP

SEQ ID NO: 2921 - protein, 8 aa, Mycobacterium tuberculosis
VASALEPE

SEQ ID NO: 2922 - protein, 8 aa, Mycobacterium tuberculosis
ASALEPER

SEQ ID NO: 2923 - protein, 8 aa, Mycobacterium tuberculosis
SALEPERI

SEQ ID NO: 2924 - protein, 8 aa, Mycobacterium tuberculosis
ALEPERIR

SEQ ID NO: 2925 - protein, 8 aa, Mycobacterium tuberculosis
LEPERIRR

SEQ ID NO: 2926 - protein, 8 aa, Mycobacterium tuberculosis
EPERIRRT

SEQ ID NO: 2927 - protein, 8 aa, Mycobacterium tuberculosis
PERIRRTF

SEQ ID NO: 2928 - protein, 8 aa, Mycobacterium tuberculosis
ERIRRTFG

SEQ ID NO: 2929 - protein, 8 aa, Mycobacterium tuberculosis
RIRRTFGE

SEQ ID NO: 2930 - protein, 8 aa, Mycobacterium tuberculosis
IRRTFGEL

SEQ ID NO: 2931 - protein, 8 aa, Mycobacterium tuberculosis
RRTFGELE

SEQ ID NO: 2932 - protein, 8 aa, Mycobacterium tuberculosis
RTFGELEQ

SEQ ID NO: 2933 - protein, 8 aa, Mycobacterium tuberculosis
TFGELEQL

SEQ ID NO: 2934 - protein, 8 aa, Mycobacterium tuberculosis
FGELEQLL

SEQ ID NO: 2935 - protein, 8 aa, Mycobacterium tuberculosis
GELEQLLL

SEQ ID NO: 2936 - protein, 8 aa, Mycobacterium tuberculosis
ELEQLLLS

SEQ ID NO: 2937 - protein, 8 aa, Mycobacterium tuberculosis
LEQLLLSR

SEQ ID NO: 2938 - protein, 8 aa, Mycobacterium tuberculosis
EQLLLSRQ

SEQ ID NO: 2939 - protein, 8 aa, Mycobacterium tuberculosis
QLLLSRQQ

SEQ ID NO: 2940 - protein, 8 aa, Mycobacterium tuberculosis
LLLSRQQR

SEQ ID NO: 2941 - protein, 8 aa, Mycobacterium tuberculosis
LLSRQQRE

SEQ ID NO: 2942 - protein, 8 aa, Mycobacterium tuberculosis
LSRQQREV

SEQ ID NO: 2943 - protein, 8 aa, Mycobacterium tuberculosis
SRQQREVF

SEQ ID NO: 2944 - protein, 8 aa, Mycobacterium tuberculosis
RQQREVFR

SEQ ID NO: 2945 - protein, 8 aa, Mycobacterium tuberculosis
QQREVFRD

SEQ ID NO: 2946 - protein, 8 aa, Mycobacterium tuberculosis
QREVFRDR

SEQ ID NO: 2947 - protein, 8 aa, Mycobacterium tuberculosis
REVFRDRG

SEQ ID NO: 2948 - protein, 8 aa, Mycobacterium tuberculosis
EVFRDRGA

SEQ ID NO: 2949 - protein, 8 aa, Mycobacterium tuberculosis
VFRDRGAN

SEQ ID NO: 2950 - protein, 8 aa, Mycobacterium tuberculosis
FRDRGANG

SEQ ID NO: 2951 - protein, 8 aa, Mycobacterium tuberculosis
RDRGANGS

SEQ ID NO: 2952 - protein, 8 aa, Mycobacterium tuberculosis
DRGANGST

SEQ ID NO: 2953 - protein, 8 aa, Mycobacterium tuberculosis
RGANGSTP

SEQ ID NO: 2954 - protein, 8 aa, Mycobacterium tuberculosis
GANGSTPD

SEQ ID NO: 2955 - protein, 8 aa, Mycobacterium tuberculosis
ANGSTPDD

SEQ ID NO: 2956 - protein, 8 aa, Mycobacterium tuberculosis
NGSTPDDG

SEQ ID NO: 2957 - protein, 8 aa, Mycobacterium tuberculosis
GSTPDDGF

SEQ ID NO: 2958 - protein, 8 aa, Mycobacterium tuberculosis
STPDDGFG

SEQ ID NO: 2959 - protein, 8 aa, Mycobacterium tuberculosis
TPDDGFGE

SEQ ID NO: 2960 - protein, 8 aa, Mycobacterium tuberculosis
PDDGFGEV

SEQ ID NO: 2961 - protein, 8 aa, Mycobacterium tuberculosis
DDGFGEVF

SEQ ID NO: 2962 - protein, 8 aa, Mycobacterium tuberculosis
DGFGEVFL

SEQ ID NO: 2963 - protein, 8 aa, Mycobacterium tuberculosis
GFGEVFLV

SEQ ID NO: 2964 - protein, 8 aa, Mycobacterium tuberculosis
FGEVFLVI

SEQ ID NO: 2965 - protein, 8 aa, Mycobacterium tuberculosis
GEVFLVID

SEQ ID NO: 2966 - protein, 8 aa, Mycobacterium tuberculosis
EVFLVIDN

SEQ ID NO: 2967 - protein, 8 aa, Mycobacterium tuberculosis
VFLVIDNL

SEQ ID NO: 2968 - protein, 8 aa, Mycobacterium tuberculosis
FLVIDNLY

SEQ ID NO: 2969 - protein, 8 aa, Mycobacterium tuberculosis
LVIDNLYG

SEQ ID NO: 2970 - protein, 8 aa, Mycobacterium tuberculosis
VIDNLYGF

SEQ ID NO: 2971 - protein, 8 aa, Mycobacterium tuberculosis
IDNLYGFG

SEQ ID NO: 2972 - protein, 8 aa, Mycobacterium tuberculosis
DNLYGFGR

SEQ ID NO: 2973 - protein, 8 aa, Mycobacterium tuberculosis
NLYGFGRD

SEQ ID NO: 2974 - protein, 8 aa, Mycobacterium tuberculosis
LYGFGRDN

SEQ ID NO: 2975 - protein, 8 aa, Mycobacterium tuberculosis
YGFGRDNT

SEQ ID NO: 2976 - protein, 8 aa, Mycobacterium tuberculosis
GFGRDNTD

SEQ ID NO: 2977 - protein, 8 aa, Mycobacterium tuberculosis
FGRDNTDQ

SEQ ID NO: 2978 - protein, 8 aa, Mycobacterium tuberculosis
GRDNTDQF

SEQ ID NO: 2979 - protein, 8 aa, Mycobacterium tuberculosis
RDNTDQFN

SEQ ID NO: 2980 - protein, 8 aa, Mycobacterium tuberculosis
DNTDQFNT

SEQ ID NO: 2981 - protein, 8 aa, Mycobacterium tuberculosis
NTDQFNTR

SEQ ID NO: 2982 - protein, 8 aa, Mycobacterium tuberculosis
TDQFNTRN

SEQ ID NO: 2983 - protein, 8 aa, Mycobacterium tuberculosis
DQFNTRNP

SEQ ID NO: 2984 - protein, 8 aa, Mycobacterium tuberculosis
QFNTRNPL

SEQ ID NO: 2985 - protein, 8 aa, Mycobacterium tuberculosis
FNTRNPLL

SEQ ID NO: 2986 - protein, 8 aa, Mycobacterium tuberculosis
NTRNPLLA

SEQ ID NO: 2987 - protein, 8 aa, Mycobacterium tuberculosis
TRNPLLAR

SEQ ID NO: 2988 - protein, 8 aa, Mycobacterium tuberculosis
RNPLLARV

SEQ ID NO: 2989 - protein, 8 aa, Mycobacterium tuberculosis
NPLLARVT

SEQ ID NO: 2990 - protein, 8 aa, Mycobacterium tuberculosis
PLLARVTE

SEQ ID NO: 2991 - protein, 8 aa, Mycobacterium tuberculosis
LLARVTEL

SEQ ID NO: 2992 - protein, 8 aa, Mycobacterium tuberculosis
LARVTELV

SEQ ID NO: 2993 - protein, 8 aa, Mycobacterium tuberculosis
ARVTELVN

SEQ ID NO: 2994 - protein, 8 aa, Mycobacterium tuberculosis
RVTELVNV

SEQ ID NO: 2995 - protein, 8 aa, Mycobacterium tuberculosis
VTELVNVG

SEQ ID NO: 2996 - protein, 8 aa, Mycobacterium tuberculosis
TELVNVGL

SEQ ID NO: 2997 - protein, 8 aa, Mycobacterium tuberculosis
ELVNVGLA

SEQ ID NO: 2998 - protein, 8 aa, Mycobacterium tuberculosis
LVNVGLAY

SEQ ID NO: 2999 - protein, 8 aa, Mycobacterium tuberculosis
VNVGLAYG

SEQ ID NO: 3000 - protein, 8 aa, Mycobacterium tuberculosis
NVGLAYGI

SEQ ID NO: 3001 - protein, 8 aa, Mycobacterium tuberculosis
VGLAYGIH

SEQ ID NO: 3002 - protein, 8 aa, Mycobacterium tuberculosis
GLAYGIHV

SEQ ID NO: 3003 - protein, 8 aa, Mycobacterium tuberculosis
LAYGIHVI

SEQ ID NO: 3004 - protein, 8 aa, Mycobacterium tuberculosis
AYGIHVII

SEQ ID NO: 3005 - protein, 8 aa, Mycobacterium tuberculosis
YGIHVIIT

SEQ ID NO: 3006 - protein, 8 aa, Mycobacterium tuberculosis
GIHVIITT

SEQ ID NO: 3007 - protein, 8 aa, Mycobacterium tuberculosis
IHVIITTP

SEQ ID NO: 3008 - protein, 8 aa, Mycobacterium tuberculosis
HVIITTPS

SEQ ID NO: 3009 - protein, 8 aa, Mycobacterium tuberculosis
VIITTPSW

SEQ ID NO: 3010 - protein, 8 aa, Mycobacterium tuberculosis
IITTPSWL

SEQ ID NO: 3011 - protein, 8 aa, Mycobacterium tuberculosis
ITTPSWLE

SEQ ID NO: 3012 - protein, 8 aa, Mycobacterium tuberculosis
TTPSWLEV

SEQ ID NO: 3013 - protein, 8 aa, Mycobacterium tuberculosis
TPSWLEVP

SEQ ID NO: 3014 - protein, 8 aa, Mycobacterium tuberculosis
PSWLEVPL

SEQ ID NO: 3015 - protein, 8 aa, Mycobacterium tuberculosis
SWLEVPLA

SEQ ID NO: 3016 - protein, 8 aa, Mycobacterium tuberculosis
WLEVPLAM

SEQ ID NO: 3017 - protein, 8 aa, Mycobacterium tuberculosis
LEVPLAMR

SEQ ID NO: 3018 - protein, 8 aa, Mycobacterium tuberculosis
EVPLAMRD

SEQ ID NO: 3019 - protein, 8 aa, Mycobacterium tuberculosis
VPLAMRDG

SEQ ID NO: 3020 - protein, 8 aa, Mycobacterium tuberculosis
PLAMRDGL

SEQ ID NO: 3021 - protein, 8 aa, Mycobacterium tuberculosis
LAMRDGLG

SEQ ID NO: 3022 - protein, 8 aa, Mycobacterium tuberculosis
AMRDGLGL

SEQ ID NO: 3023 - protein, 8 aa, Mycobacterium tuberculosis
MRDGLGLR

SEQ ID NO: 3024 - protein, 8 aa, Mycobacterium tuberculosis
RDGLGLRL

SEQ ID NO: 3025 - protein, 8 aa, Mycobacterium tuberculosis
DGLGLRLE

SEQ ID NO: 3026 - protein, 8 aa, Mycobacterium tuberculosis
GLGLRLEL

SEQ ID NO: 3027 - protein, 8 aa, Mycobacterium tuberculosis
LGLRLELR

SEQ ID NO: 3028 - protein, 8 aa, Mycobacterium tuberculosis
GLRLELRL

SEQ ID NO: 3029 - protein, 8 aa, Mycobacterium tuberculosis
LRLELRLH

SEQ ID NO: 3030 - protein, 8 aa, Mycobacterium tuberculosis
RLELRLHD

SEQ ID NO: 3031 - protein, 8 aa, Mycobacterium tuberculosis
LELRLHDA

SEQ ID NO: 3032 - protein, 8 aa, Mycobacterium tuberculosis
ELRLHDAR

SEQ ID NO: 3033 - protein, 8 aa, Mycobacterium tuberculosis
LRLHDARD

SEQ ID NO: 3034 - protein, 8 aa, Mycobacterium tuberculosis
RLHDARDS

SEQ ID NO: 3035 - protein, 8 aa, Mycobacterium tuberculosis
LHDARDSN

SEQ ID NO: 3036 - protein, 8 aa, Mycobacterium tuberculosis
HDARDSNV

SEQ ID NO: 3037 - protein, 8 aa, Mycobacterium tuberculosis
DARDSNVR

SEQ ID NO: 3038 - protein, 8 aa, Mycobacterium tuberculosis
ARDSNVRV

SEQ ID NO: 3039 - protein, 8 aa, Mycobacterium tuberculosis
RDSNVRVV

SEQ ID NO: 3040 - protein, 8 aa, Mycobacterium tuberculosis
DSNVRVVG

SEQ ID NO: 3041 - protein, 8 aa, Mycobacterium tuberculosis
SNVRVVGA

SEQ ID NO: 3042 - protein, 8 aa, Mycobacterium tuberculosis
NVRVVGAL

SEQ ID NO: 3043 - protein, 8 aa, Mycobacterium tuberculosis
VRVVGALR

SEQ ID NO: 3044 - protein, 8 aa, Mycobacterium tuberculosis
RVVGALRR

SEQ ID NO: 3045 - protein, 8 aa, Mycobacterium tuberculosis
VVGALRRP

SEQ ID NO: 3046 - protein, 8 aa, Mycobacterium tuberculosis
VGALRRPA

SEQ ID NO: 3047 - protein, 8 aa, Mycobacterium tuberculosis
GALRRPAD

SEQ ID NO: 3048 - protein, 8 aa, Mycobacterium tuberculosis
ALRRPADA

SEQ ID NO: 3049 - protein, 8 aa, Mycobacterium tuberculosis
LRRPADAV

SEQ ID NO: 3050 - protein, 8 aa, Mycobacterium tuberculosis
RRPADAVP

SEQ ID NO: 3051 - protein, 8 aa, Mycobacterium tuberculosis
RPADAVPH

SEQ ID NO: 3052 - protein, 8 aa, Mycobacterium tuberculosis
PADAVPHD

SEQ ID NO: 3053 - protein, 8 aa, Mycobacterium tuberculosis
ADAVPHDQ

SEQ ID NO: 3054 - protein, 8 aa, Mycobacterium tuberculosis
DAVPHDQP

SEQ ID NO: 3055 - protein, 8 aa, Mycobacterium tuberculosis
AVPHDQPG

SEQ ID NO: 3056 - protein, 8 aa, Mycobacterium tuberculosis
VPHDQPGR

SEQ ID NO: 3057 - protein, 8 aa, Mycobacterium tuberculosis
PHDQPGRG

SEQ ID NO: 3058 - protein, 8 aa, Mycobacterium tuberculosis
HDQPGRGL

SEQ ID NO: 3059 - protein, 8 aa, Mycobacterium tuberculosis
DQPGRGLT

SEQ ID NO: 3060 - protein, 8 aa, Mycobacterium tuberculosis
QPGRGLTM

SEQ ID NO: 3061 - protein, 8 aa, Mycobacterium tuberculosis
PGRGLTMA

SEQ ID NO: 3062 - protein, 8 aa, Mycobacterium tuberculosis
GRGLTMAA

SEQ ID NO: 3063 - protein, 8 aa, Mycobacterium tuberculosis
RGLTMAAE

SEQ ID NO: 3064 - protein, 8 aa, Mycobacterium tuberculosis
GLTMAAEH

SEQ ID NO: 3065 - protein, 8 aa, Mycobacterium tuberculosis
LTMAAEHF

SEQ ID NO: 3066 - protein, 8 aa, Mycobacterium tuberculosis
TMAAEHFL

SEQ ID NO: 3067 - protein, 8 aa, Mycobacterium tuberculosis
MAAEHFLF

SEQ ID NO: 3068 - protein, 8 aa, Mycobacterium tuberculosis
AAEHFLFA

SEQ ID NO: 3069 - protein, 8 aa, Mycobacterium tuberculosis
AEHFLFAA

SEQ ID NO: 3070 - protein, 8 aa, Mycobacterium tuberculosis
EHFLFAAP

SEQ ID NO: 3071 - protein, 8 aa, Mycobacterium tuberculosis
HFLFAAPE

SEQ ID NO: 3072 - protein, 8 aa, Mycobacterium tuberculosis
FLFAAPEL

SEQ ID NO: 3073 - protein, 8 aa, Mycobacterium tuberculosis
LFAAPELD

SEQ ID NO: 3074 - protein, 8 aa, Mycobacterium tuberculosis
FAAPELDA

SEQ ID NO: 3075 - protein, 8 aa, Mycobacterium tuberculosis
AAPELDAQ

SEQ ID NO: 3076 - protein, 8 aa, Mycobacterium tuberculosis
APELDAQT

SEQ ID NO: 3077 - protein, 8 aa, Mycobacterium tuberculosis
PELDAQTN

SEQ ID NO: 3078 - protein, 8 aa, Mycobacterium tuberculosis
ELDAQTNP

SEQ ID NO: 3079 - protein, 8 aa, Mycobacterium tuberculosis
LDAQTNPV

SEQ ID NO: 3080 - protein, 8 aa, Mycobacterium tuberculosis
DAQTNPVA

SEQ ID NO: 3081 - protein, 8 aa, Mycobacterium tuberculosis
AQTNPVAA

SEQ ID NO: 3082 - protein, 8 aa, Mycobacterium tuberculosis
QTNPVAAI

SEQ ID NO: 3083 - protein, 8 aa, Mycobacterium tuberculosis
TNPVAAIN

SEQ ID NO: 3084 - protein, 8 aa, Mycobacterium tuberculosis
NPVAAINA

SEQ ID NO: 3085 - protein, 8 aa, Mycobacterium tuberculosis
PVAAINAR

SEQ ID NO: 3086 - protein, 8 aa, Mycobacterium tuberculosis
VAAINARY

SEQ ID NO: 3087 - protein, 8 aa, Mycobacterium tuberculosis
AAINARYP

SEQ ID NO: 3088 - protein, 8 aa, Mycobacterium tuberculosis
AINARYPG

SEQ ID NO: 3089 - protein, 8 aa, Mycobacterium tuberculosis
INARYPGM

SEQ ID NO: 3090 - protein, 8 aa, Mycobacterium tuberculosis
NARYPGMA

SEQ ID NO: 3091 - protein, 8 aa, Mycobacterium tuberculosis
ARYPGMAA

SEQ ID NO: 3092 - protein, 8 aa, Mycobacterium tuberculosis
RYPGMAAP

SEQ ID NO: 3093 - protein, 8 aa, Mycobacterium tuberculosis
YPGMAAPP

SEQ ID NO: 3094 - protein, 8 aa, Mycobacterium tuberculosis
PGMAAPPV

SEQ ID NO: 3095 - protein, 8 aa, Mycobacterium tuberculosis
GMAAPPVR

SEQ ID NO: 3096 - protein, 8 aa, Mycobacterium tuberculosis
MAAPPVRL

SEQ ID NO: 3097 - protein, 8 aa, Mycobacterium tuberculosis
AAPPVRLL

SEQ ID NO: 3098 - protein, 8 aa, Mycobacterium tuberculosis
APPVRLLP

SEQ ID NO: 3099 - protein, 8 aa, Mycobacterium tuberculosis
PPVRLLPT

SEQ ID NO: 3100 - protein, 8 aa, Mycobacterium tuberculosis
PVRLLPTN

SEQ ID NO: 3101 - protein, 8 aa, Mycobacterium tuberculosis
VRLLPTNL

SEQ ID NO: 3102 - protein, 8 aa, Mycobacterium tuberculosis
RLLPTNLA

SEQ ID NO: 3103 - protein, 8 aa, Mycobacterium tuberculosis
LLPTNLAP

SEQ ID NO: 3104 - protein, 8 aa, Mycobacterium tuberculosis
LPTNLAPH

SEQ ID NO: 3105 - protein, 8 aa, Mycobacterium tuberculosis
PTNLAPHA

SEQ ID NO: 3106 - protein, 8 aa, Mycobacterium tuberculosis
TNLAPHAV

SEQ ID NO: 3107 - protein, 8 aa, Mycobacterium tuberculosis
NLAPHAVG

SEQ ID NO: 3108 - protein, 8 aa, Mycobacterium tuberculosis
LAPHAVGE

SEQ ID NO: 3109 - protein, 8 aa, Mycobacterium tuberculosis
APHAVGEL

SEQ ID NO: 3110 - protein, 8 aa, Mycobacterium tuberculosis
PHAVGELY

SEQ ID NO: 3111 - protein, 8 aa, Mycobacterium tuberculosis
HAVGELYR

SEQ ID NO: 3112 - protein, 8 aa, Mycobacterium tuberculosis
AVGELYRG

SEQ ID NO: 3113 - protein, 8 aa, Mycobacterium tuberculosis
VGELYRGP

SEQ ID NO: 3114 - protein, 8 aa, Mycobacterium tuberculosis
GELYRGPD

SEQ ID NO: 3115 - protein, 8 aa, Mycobacterium tuberculosis
ELYRGPDQ

SEQ ID NO: 3116 - protein, 8 aa, Mycobacterium tuberculosis
LYRGPDQL

SEQ ID NO: 3117 - protein, 8 aa, Mycobacterium tuberculosis
YRGPDQLV

SEQ ID NO: 3118 - protein, 8 aa, Mycobacterium tuberculosis
RGPDQLVI

SEQ ID NO: 3119 - protein, 8 aa, Mycobacterium tuberculosis
GPDQLVIG

SEQ ID NO: 3120 - protein, 8 aa, Mycobacterium tuberculosis
PDQLVIGQ

SEQ ID NO: 3121 - protein, 8 aa, Mycobacterium tuberculosis
DQLVIGQR

SEQ ID NO: 3122 - protein, 8 aa, Mycobacterium tuberculosis
QLVIGQRE

SEQ ID NO: 3123 - protein, 8 aa, Mycobacterium tuberculosis
LVIGQREE

SEQ ID NO: 3124 - protein, 8 aa, Mycobacterium tuberculosis
VIGQREED

SEQ ID NO: 3125 - protein, 8 aa, Mycobacterium tuberculosis
IGQREEDL

SEQ ID NO: 3126 - protein, 8 aa, Mycobacterium tuberculosis
GQREEDLA

SEQ ID NO: 3127 - protein, 8 aa, Mycobacterium tuberculosis
QREEDLAP

SEQ ID NO: 3128 - protein, 8 aa, Mycobacterium tuberculosis
REEDLAPV

SEQ ID NO: 3129 - protein, 8 aa, Mycobacterium tuberculosis
EEDLAPVI

SEQ ID NO: 3130 - protein, 8 aa, Mycobacterium tuberculosis
EDLAPVIL

SEQ ID NO: 3131 - protein, 8 aa, Mycobacterium tuberculosis
DLAPVILD

SEQ ID NO: 3132 - protein, 8 aa, Mycobacterium tuberculosis
LAPVILDL

SEQ ID NO: 3133 - protein, 8 aa, Mycobacterium tuberculosis
APVILDLA

SEQ ID NO: 3134 - protein, 8 aa, Mycobacterium tuberculosis
PVILDLAA

SEQ ID NO: 3135 - protein, 8 aa, Mycobacterium tuberculosis
VILDLAAN

SEQ ID NO: 3136 - protein, 8 aa, Mycobacterium tuberculosis
ILDLAANP

SEQ ID NO: 3137 - protein, 8 aa, Mycobacterium tuberculosis
LDLAANPL

SEQ ID NO: 3138 - protein, 8 aa, Mycobacterium tuberculosis
DLAANPLL

SEQ ID NO: 3139 - protein, 8 aa, Mycobacterium tuberculosis
LAANPLLM

SEQ ID NO: 3140 - protein, 8 aa, Mycobacterium tuberculosis
AANPLLMV

SEQ ID NO: 3141 - protein, 8 aa, Mycobacterium tuberculosis
ANPLLMVF

SEQ ID NO: 3142 - protein, 8 aa, Mycobacterium tuberculosis
NPLLMVFG

SEQ ID NO: 3143 - protein, 8 aa, Mycobacterium tuberculosis
PLLMVFGD

SEQ ID NO: 3144 - protein, 8 aa, Mycobacterium tuberculosis
LLMVFGDA

SEQ ID NO: 3145 - protein, 8 aa, Mycobacterium tuberculosis
LMVFGDAR

SEQ ID NO: 3146 - protein, 8 aa, Mycobacterium tuberculosis
MVFGDARS

SEQ ID NO: 3147 - protein, 8 aa, Mycobacterium tuberculosis
VFGDARSG

SEQ ID NO: 3148 - protein, 8 aa, Mycobacterium tuberculosis
FGDARSGK

SEQ ID NO: 3149 - protein, 8 aa, Mycobacterium tuberculosis
GDARSGKT

SEQ ID NO: 3150 - protein, 8 aa, Mycobacterium tuberculosis
DARSGKTT

SEQ ID NO: 3151 - protein, 8 aa, Mycobacterium tuberculosis
ARSGKTTL

SEQ ID NO: 3152 - protein, 8 aa, Mycobacterium tuberculosis
RSGKTTLL

SEQ ID NO: 3153 - protein, 8 aa, Mycobacterium tuberculosis
SGKTTLLR

SEQ ID NO: 3154 - protein, 8 aa, Mycobacterium tuberculosis
GKTTLLRH

SEQ ID NO: 3155 - protein, 8 aa, Mycobacterium tuberculosis
KTTLLRHI

SEQ ID NO: 3156 - protein, 8 aa, Mycobacterium tuberculosis
TTLLRHII

SEQ ID NO: 3157 - protein, 8 aa, Mycobacterium tuberculosis
TLLRHIIR

SEQ ID NO: 3158 - protein, 8 aa, Mycobacterium tuberculosis
LLRHIIRT

SEQ ID NO: 3159 - protein, 8 aa, Mycobacterium tuberculosis
LRHIIRTV

SEQ ID NO: 3160 - protein, 8 aa, Mycobacterium tuberculosis
RHIIRTVR

SEQ ID NO: 3161 - protein, 8 aa, Mycobacterium tuberculosis
HIIRTVRE

SEQ ID NO: 3162 - protein, 8 aa, Mycobacterium tuberculosis
IIRTVREH

SEQ ID NO: 3163 - protein, 8 aa, Mycobacterium tuberculosis
IRTVREHS

SEQ ID NO: 3164 - protein, 8 aa, Mycobacterium tuberculosis
RTVREHST

SEQ ID NO: 3165 - protein, 8 aa, Mycobacterium tuberculosis
TVREHSTA

SEQ ID NO: 3166 - protein, 8 aa, Mycobacterium tuberculosis
VREHSTAD

SEQ ID NO: 3167 - protein, 8 aa, Mycobacterium tuberculosis
REHSTADR

SEQ ID NO: 3168 - protein, 8 aa, Mycobacterium tuberculosis
EHSTADRV

SEQ ID NO: 3169 - protein, 8 aa, Mycobacterium tuberculosis
HSTADRVA

SEQ ID NO: 3170 - protein, 8 aa, Mycobacterium tuberculosis
STADRVAF

SEQ ID NO: 3171 - protein, 8 aa, Mycobacterium tuberculosis
TADRVAFT

SEQ ID NO: 3172 - protein, 8 aa, Mycobacterium tuberculosis
ADRVAFTV

SEQ ID NO: 3173 - protein, 8 aa, Mycobacterium tuberculosis
DRVAFTVL

SEQ ID NO: 3174 - protein, 8 aa, Mycobacterium tuberculosis
RVAFTVLD

SEQ ID NO: 3175 - protein, 8 aa, Mycobacterium tuberculosis
VAFTVLDR

SEQ ID NO: 3176 - protein, 8 aa, Mycobacterium tuberculosis
AFTVLDRR

SEQ ID NO: 3177 - protein, 8 aa, Mycobacterium tuberculosis
FTVLDRRL

SEQ ID NO: 3178 - protein, 8 aa, Mycobacterium tuberculosis
TVLDRRLH

SEQ ID NO: 3179 - protein, 8 aa, Mycobacterium tuberculosis
VLDRRLHL

SEQ ID NO: 3180 - protein, 8 aa, Mycobacterium tuberculosis
LDRRLHLV

SEQ ID NO: 3181 - protein, 8 aa, Mycobacterium tuberculosis
DRRLHLVD

SEQ ID NO: 3182 - protein, 8 aa, Mycobacterium tuberculosis
RRLHLVDE

SEQ ID NO: 3183 - protein, 8 aa, Mycobacterium tuberculosis
RLHLVDEP

SEQ ID NO: 3184 - protein, 8 aa, Mycobacterium tuberculosis
LHLVDEPL

SEQ ID NO: 3185 - protein, 8 aa, Mycobacterium tuberculosis
HLVDEPLF

SEQ ID NO: 3186 - protein, 8 aa, Mycobacterium tuberculosis
LVDEPLFP

SEQ ID NO: 3187 - protein, 8 aa, Mycobacterium tuberculosis
VDEPLFPD

SEQ ID NO: 3188 - protein, 8 aa, Mycobacterium tuberculosis
DEPLFPDN

SEQ ID NO: 3189 - protein, 8 aa, Mycobacterium tuberculosis
EPLFPDNE

SEQ ID NO: 3190 - protein, 8 aa, Mycobacterium tuberculosis
PLFPDNEY

SEQ ID NO: 3191 - protein, 8 aa, Mycobacterium tuberculosis
LFPDNEYT

SEQ ID NO: 3192 - protein, 8 aa, Mycobacterium tuberculosis
FPDNEYTA

SEQ ID NO: 3193 - protein, 8 aa, Mycobacterium tuberculosis
PDNEYTAN

SEQ ID NO: 3194 - protein, 8 aa, Mycobacterium tuberculosis
DNEYTANI

SEQ ID NO: 3195 - protein, 8 aa, Mycobacterium tuberculosis
NEYTANID

SEQ ID NO: 3196 - protein, 8 aa, Mycobacterium tuberculosis
EYTANIDR

SEQ ID NO: 3197 - protein, 8 aa, Mycobacterium tuberculosis
YTANIDRI

SEQ ID NO: 3198 - protein, 8 aa, Mycobacterium tuberculosis
TANIDRII

SEQ ID NO: 3199 - protein, 8 aa, Mycobacterium tuberculosis
ANIDRIIP

SEQ ID NO: 3200 - protein, 8 aa, Mycobacterium tuberculosis
NIDRIIPA

SEQ ID NO: 3201 - protein, 8 aa, Mycobacterium tuberculosis
IDRIIPAM

SEQ ID NO: 3202 - protein, 8 aa, Mycobacterium tuberculosis
DRIIPAML

SEQ ID NO: 3203 - protein, 8 aa, Mycobacterium tuberculosis
RIIPAMLG

SEQ ID NO: 3204 - protein, 8 aa, Mycobacterium tuberculosis
IIPAMLGL

SEQ ID NO: 3205 - protein, 8 aa, Mycobacterium tuberculosis
IPAMLGLA

SEQ ID NO: 3206 - protein, 8 aa, Mycobacterium tuberculosis
PAMLGLAN

SEQ ID NO: 3207 - protein, 8 aa, Mycobacterium tuberculosis
AMLGLANL

SEQ ID NO: 3208 - protein, 8 aa, Mycobacterium tuberculosis
MLGLANLI

SEQ ID NO: 3209 - protein, 8 aa, Mycobacterium tuberculosis
LGLANLIE

SEQ ID NO: 3210 - protein, 8 aa, Mycobacterium tuberculosis
GLANLIEA

SEQ ID NO: 3211 - protein, 8 aa, Mycobacterium tuberculosis
LANLIEAR

SEQ ID NO: 3212 - protein, 8 aa, Mycobacterium tuberculosis
ANLIEARR

SEQ ID NO: 3213 - protein, 8 aa, Mycobacterium tuberculosis
NLIEARRP

SEQ ID NO: 3214 - protein, 8 aa, Mycobacterium tuberculosis
LIEARRPP

SEQ ID NO: 3215 - protein, 8 aa, Mycobacterium tuberculosis
IEARRPPA

SEQ ID NO: 3216 - protein, 8 aa, Mycobacterium tuberculosis
EARRPPAG

SEQ ID NO: 3217 - protein, 8 aa, Mycobacterium tuberculosis
ARRPPAGM

SEQ ID NO: 3218 - protein, 8 aa, Mycobacterium tuberculosis
RRPPAGMS

SEQ ID NO: 3219 - protein, 8 aa, Mycobacterium tuberculosis
RPPAGMSA

SEQ ID NO: 3220 - protein, 8 aa, Mycobacterium tuberculosis
PPAGMSAA

SEQ ID NO: 3221 - protein, 8 aa, Mycobacterium tuberculosis
PAGMSAAE

SEQ ID NO: 3222 - protein, 8 aa, Mycobacterium tuberculosis
AGMSAAEL

SEQ ID NO: 3223 - protein, 8 aa, Mycobacterium tuberculosis
GMSAAELS

SEQ ID NO: 3224 - protein, 8 aa, Mycobacterium tuberculosis
MSAAELSR

SEQ ID NO: 3225 - protein, 8 aa, Mycobacterium tuberculosis
SAAELSRW

SEQ ID NO: 3226 - protein, 8 aa, Mycobacterium tuberculosis
AAELSRWT

SEQ ID NO: 3227 - protein, 8 aa, Mycobacterium tuberculosis
AELSRWTF

SEQ ID NO: 3228 - protein, 8 aa, Mycobacterium tuberculosis
ELSRWTFA

SEQ ID NO: 3229 - protein, 8 aa, Mycobacterium tuberculosis
LSRWTFAG

SEQ ID NO: 3230 - protein, 8 aa, Mycobacterium tuberculosis
SRWTFAGH

SEQ ID NO: 3231 - protein, 8 aa, Mycobacterium tuberculosis
RWTFAGHT

SEQ ID NO: 3232 - protein, 8 aa, Mycobacterium tuberculosis
WTFAGHTH

SEQ ID NO: 3233 - protein, 8 aa, Mycobacterium tuberculosis
TFAGHTHY

SEQ ID NO: 3234 - protein, 8 aa, Mycobacterium tuberculosis
FAGHTHYL

SEQ ID NO: 3235 - protein, 8 aa, Mycobacterium tuberculosis
AGHTHYLI

SEQ ID NO: 3236 - protein, 8 aa, Mycobacterium tuberculosis
GHTHYLII

SEQ ID NO: 3237 - protein, 8 aa, Mycobacterium tuberculosis
HTHYLIID

SEQ ID NO: 3238 - protein, 8 aa, Mycobacterium tuberculosis
THYLIIDD

SEQ ID NO: 3239 - protein, 8 aa, Mycobacterium tuberculosis
HYLIIDDV

SEQ ID NO: 3240 - protein, 8 aa, Mycobacterium tuberculosis
YLIIDDVD

SEQ ID NO: 3241 - protein, 8 aa, Mycobacterium tuberculosis
LIIDDVDQ

SEQ ID NO: 3242 - protein, 8 aa, Mycobacterium tuberculosis
IIDDVDQV

SEQ ID NO: 3243 - protein, 8 aa, Mycobacterium tuberculosis
IDDVDQVP

SEQ ID NO: 3244 - protein, 8 aa, Mycobacterium tuberculosis
DDVDQVPD

SEQ ID NO: 3245 - protein, 8 aa, Mycobacterium tuberculosis
DVDQVPDS

SEQ ID NO: 3246 - protein, 8 aa, Mycobacterium tuberculosis
VDQVPDSP

SEQ ID NO: 3247 - protein, 8 aa, Mycobacterium tuberculosis
DQVPDSPA

SEQ ID NO: 3248 - protein, 8 aa, Mycobacterium tuberculosis
QVPDSPAM

SEQ ID NO: 3249 - protein, 8 aa, Mycobacterium tuberculosis
VPDSPAMT

SEQ ID NO: 3250 - protein, 8 aa, Mycobacterium tuberculosis
PDSPAMTG

SEQ ID NO: 3251 - protein, 8 aa, Mycobacterium tuberculosis
DSPAMTGP

SEQ ID NO: 3252 - protein, 8 aa, Mycobacterium tuberculosis
SPAMTGPY

SEQ ID NO: 3253 - protein, 8 aa, Mycobacterium tuberculosis
PAMTGPYI

SEQ ID NO: 3254 - protein, 8 aa, Mycobacterium tuberculosis
AMTGPYIG

SEQ ID NO: 3255 - protein, 8 aa, Mycobacterium tuberculosis
MTGPYIGQ

SEQ ID NO: 3256 - protein, 8 aa, Mycobacterium tuberculosis
TGPYIGQR

SEQ ID NO: 3257 - protein, 8 aa, Mycobacterium tuberculosis
GPYIGQRP

SEQ ID NO: 3258 - protein, 8 aa, Mycobacterium tuberculosis
PYIGQRPW

SEQ ID NO: 3259 - protein, 8 aa, Mycobacterium tuberculosis
YIGQRPWT

SEQ ID NO: 3260 - protein, 8 aa, Mycobacterium tuberculosis
IGQRPWTP

SEQ ID NO: 3261 - protein, 8 aa, Mycobacterium tuberculosis
GQRPWTPL

SEQ ID NO: 3262 - protein, 8 aa, Mycobacterium tuberculosis
QRPWTPLI

SEQ ID NO: 3263 - protein, 8 aa, Mycobacterium tuberculosis
RPWTPLIG

SEQ ID NO: 3264 - protein, 8 aa, Mycobacterium tuberculosis
PWTPLIGL

SEQ ID NO: 3265 - protein, 8 aa, Mycobacterium tuberculosis
WTPLIGLL

SEQ ID NO: 3266 - protein, 8 aa, Mycobacterium tuberculosis
TPLIGLLA

SEQ ID NO: 3267 - protein, 8 aa, Mycobacterium tuberculosis
PLIGLLAQ

SEQ ID NO: 3268 - protein, 8 aa, Mycobacterium tuberculosis
LIGLLAQA

SEQ ID NO: 3269 - protein, 8 aa, Mycobacterium tuberculosis
IGLLAQAG

SEQ ID NO: 3270 - protein, 8 aa, Mycobacterium tuberculosis
GLLAQAGD

SEQ ID NO: 3271 - protein, 8 aa, Mycobacterium tuberculosis
LLAQAGDL

SEQ ID NO: 3272 - protein, 8 aa, Mycobacterium tuberculosis
LAQAGDLG

SEQ ID NO: 3273 - protein, 8 aa, Mycobacterium tuberculosis
AQAGDLGL

SEQ ID NO: 3274 - protein, 8 aa, Mycobacterium tuberculosis
QAGDLGLR

SEQ ID NO: 3275 - protein, 8 aa, Mycobacterium tuberculosis
AGDLGLRV

SEQ ID NO: 3276 - protein, 8 aa, Mycobacterium tuberculosis
GDLGLRVI

SEQ ID NO: 3277 - protein, 8 aa, Mycobacterium tuberculosis
DLGLRVIV

SEQ ID NO: 3278 - protein, 8 aa, Mycobacterium tuberculosis
LGLRVIVT

SEQ ID NO: 3279 - protein, 8 aa, Mycobacterium tuberculosis
GLRVIVTG

SEQ ID NO: 3280 - protein, 8 aa, Mycobacterium tuberculosis
LRVIVTGR

SEQ ID NO: 3281 - protein, 8 aa, Mycobacterium tuberculosis
RVIVTGRA

SEQ ID NO: 3282 - protein, 8 aa, Mycobacterium tuberculosis
VIVTGRAT

SEQ ID NO: 3283 - protein, 8 aa, Mycobacterium tuberculosis
IVTGRATG

SEQ ID NO: 3284 - protein, 8 aa, Mycobacterium tuberculosis
VTGRATGS

SEQ ID NO: 3285 - protein, 8 aa, Mycobacterium tuberculosis
TGRATGSA

SEQ ID NO: 3286 - protein, 8 aa, Mycobacterium tuberculosis
GRATGSAH

SEQ ID NO: 3287 - protein, 8 aa, Mycobacterium tuberculosis
RATGSAHL

SEQ ID NO: 3288 - protein, 8 aa, Mycobacterium tuberculosis
ATGSAHLL

SEQ ID NO: 3289 - protein, 8 aa, Mycobacterium tuberculosis
TGSAHLLM

SEQ ID NO: 3290 - protein, 8 aa, Mycobacterium tuberculosis
GSAHLLMT

SEQ ID NO: 3291 - protein, 8 aa, Mycobacterium tuberculosis
SAHLLMTS

SEQ ID NO: 3292 - protein, 8 aa, Mycobacterium tuberculosis
AHLLMTSP

SEQ ID NO: 3293 - protein, 8 aa, Mycobacterium tuberculosis
HLLMTSPL

SEQ ID NO: 3294 - protein, 8 aa, Mycobacterium tuberculosis
LLMTSPLL

SEQ ID NO: 3295 - protein, 8 aa, Mycobacterium tuberculosis
LMTSPLLR

SEQ ID NO: 3296 - protein, 8 aa, Mycobacterium tuberculosis
MTSPLLRR

SEQ ID NO: 3297 - protein, 8 aa, Mycobacterium tuberculosis
TSPLLRRF

SEQ ID NO: 3298 - protein, 8 aa, Mycobacterium tuberculosis
SPLLRRFN

SEQ ID NO: 3299 - protein, 8 aa, Mycobacterium tuberculosis
PLLRRFND

SEQ ID NO: 3300 - protein, 8 aa, Mycobacterium tuberculosis
LLRRFNDL

SEQ ID NO: 3301 - protein, 8 aa, Mycobacterium tuberculosis
LRRFNDLQ

SEQ ID NO: 3302 - protein, 8 aa, Mycobacterium tuberculosis
RRFNDLQA

SEQ ID NO: 3303 - protein, 8 aa, Mycobacterium tuberculosis
RFNDLQAT

SEQ ID NO: 3304 - protein, 8 aa, Mycobacterium tuberculosis
FNDLQATT

SEQ ID NO: 3305 - protein, 8 aa, Mycobacterium tuberculosis
NDLQATTL

SEQ ID NO: 3306 - protein, 8 aa, Mycobacterium tuberculosis
DLQATTLM

SEQ ID NO: 3307 - protein, 8 aa, Mycobacterium tuberculosis
LQATTLML

SEQ ID NO: 3308 - protein, 8 aa, Mycobacterium tuberculosis
QATTLMLA

SEQ ID NO: 3309 - protein, 8 aa, Mycobacterium tuberculosis
ATTLMLAG

SEQ ID NO: 3310 - protein, 8 aa, Mycobacterium tuberculosis
TTLMLAGN

SEQ ID NO: 3311 - protein, 8 aa, Mycobacterium tuberculosis
TLMLAGNP

SEQ ID NO: 3312 - protein, 8 aa, Mycobacterium tuberculosis
LMLAGNPA

SEQ ID NO: 3313 - protein, 8 aa, Mycobacterium tuberculosis
MLAGNPAD

SEQ ID NO: 3314 - protein, 8 aa, Mycobacterium tuberculosis
LAGNPADS

SEQ ID NO: 3315 - protein, 8 aa, Mycobacterium tuberculosis
AGNPADSG

SEQ ID NO: 3316 - protein, 8 aa, Mycobacterium tuberculosis
GNPADSGK

SEQ ID NO: 3317 - protein, 8 aa, Mycobacterium tuberculosis
NPADSGKI

SEQ ID NO: 3318 - protein, 8 aa, Mycobacterium tuberculosis
PADSGKIR

SEQ ID NO: 3319 - protein, 8 aa, Mycobacterium tuberculosis
ADSGKIRG

SEQ ID NO: 3320 - protein, 8 aa, Mycobacterium tuberculosis
DSGKIRGE

SEQ ID NO: 3321 - protein, 8 aa, Mycobacterium tuberculosis
SGKIRGER

SEQ ID NO: 3322 - protein, 8 aa, Mycobacterium tuberculosis
GKIRGERF

SEQ ID NO: 3323 - protein, 8 aa, Mycobacterium tuberculosis
KIRGERFA

SEQ ID NO: 3324 - protein, 8 aa, Mycobacterium tuberculosis
IRGERFAR

SEQ ID NO: 3325 - protein, 8 aa, Mycobacterium tuberculosis
RGERFARL

SEQ ID NO: 3326 - protein, 8 aa, Mycobacterium tuberculosis
GERFARLP

SEQ ID NO: 3327 - protein, 8 aa, Mycobacterium tuberculosis
ERFARLPA

SEQ ID NO: 3328 - protein, 8 aa, Mycobacterium tuberculosis
RFARLPAG

SEQ ID NO: 3329 - protein, 8 aa, Mycobacterium tuberculosis
FARLPAGR

SEQ ID NO: 3330 - protein, 8 aa, Mycobacterium tuberculosis
ARLPAGRA

SEQ ID NO: 3331 - protein, 8 aa, Mycobacterium tuberculosis
RLPAGRAI

SEQ ID NO: 3332 - protein, 8 aa, Mycobacterium tuberculosis
LPAGRAIL

SEQ ID NO: 3333 - protein, 8 aa, Mycobacterium tuberculosis
PAGRAILL

SEQ ID NO: 3334 - protein, 8 aa, Mycobacterium tuberculosis
AGRAILLT

SEQ ID NO: 3335 - protein, 8 aa, Mycobacterium tuberculosis
GRAILLTD

SEQ ID NO: 3336 - protein, 8 aa, Mycobacterium tuberculosis
RAILLTDS

SEQ ID NO: 3337 - protein, 8 aa, Mycobacterium tuberculosis
AILLTDSD

SEQ ID NO: 3338 - protein, 8 aa, Mycobacterium tuberculosis
ILLTDSDS

SEQ ID NO: 3339 - protein, 8 aa, Mycobacterium tuberculosis
LLTDSDSP

SEQ ID NO: 3340 - protein, 8 aa, Mycobacterium tuberculosis
LTDSDSPT

SEQ ID NO: 3341 - protein, 8 aa, Mycobacterium tuberculosis
TDSDSPTY

SEQ ID NO: 3342 - protein, 8 aa, Mycobacterium tuberculosis
DSDSPTYV

SEQ ID NO: 3343 - protein, 8 aa, Mycobacterium tuberculosis
SDSPTYVQ

SEQ ID NO: 3344 - protein, 8 aa, Mycobacterium tuberculosis
DSPTYVQL

SEQ ID NO: 3345 - protein, 8 aa, Mycobacterium tuberculosis
SPTYVQLI

SEQ ID NO: 3346 - protein, 8 aa, Mycobacterium tuberculosis
PTYVQLIN

SEQ ID NO: 3347 - protein, 8 aa, Mycobacterium tuberculosis
TYVQLINP

SEQ ID NO: 3348 - protein, 8 aa, Mycobacterium tuberculosis
YVQLINPL

SEQ ID NO: 3349 - protein, 8 aa, Mycobacterium tuberculosis
VQLINPLV

SEQ ID NO: 3350 - protein, 8 aa, Mycobacterium tuberculosis
QLINPLVD

SEQ ID NO: 3351 - protein, 8 aa, Mycobacterium tuberculosis
LINPLVDA

SEQ ID NO: 3352 - protein, 8 aa, Mycobacterium tuberculosis
INPLVDAA

SEQ ID NO: 3353 - protein, 8 aa, Mycobacterium tuberculosis
NPLVDAAA

SEQ ID NO: 3354 - protein, 8 aa, Mycobacterium tuberculosis
PLVDAAAV

SEQ ID NO: 3355 - protein, 8 aa, Mycobacterium tuberculosis
LVDAAAVS

SEQ ID NO: 3356 - protein, 8 aa, Mycobacterium tuberculosis
VDAAAVSG

SEQ ID NO: 3357 - protein, 8 aa, Mycobacterium tuberculosis
DAAAVSGE

SEQ ID NO: 3358 - protein, 8 aa, Mycobacterium tuberculosis
AAAVSGET

SEQ ID NO: 3359 - protein, 8 aa, Mycobacterium tuberculosis
AAVSGETQ

SEQ ID NO: 3360 - protein, 8 aa, Mycobacterium tuberculosis
AVSGETQQ

SEQ ID NO: 3361 - protein, 8 aa, Mycobacterium tuberculosis
VSGETQQK

SEQ ID NO: 3362 - protein, 8 aa, Mycobacterium tuberculosis
SGETQQKG

SEQ ID NO: 3363 - protein, 8 aa, Mycobacterium tuberculosis
GETQQKGS

SEQ ID NO: 3364 - protein, 8 aa, Mycobacterium tuberculosis
ETQQKGSQ

SEQ ID NO: 3365 - protein, 8 aa, Mycobacterium tuberculosis
TQQKGSQS

SEQ ID NO: 3366 - protein, 9 aa, Mycobacterium tuberculosis
MSRLIFEAR

SEQ ID NO: 3367 - protein, 9 aa, Mycobacterium tuberculosis
SRLIFEARR

SEQ ID NO: 3368 - protein, 9 aa, Mycobacterium tuberculosis
RLIFEARRR

SEQ ID NO: 3369 - protein, 9 aa, Mycobacterium tuberculosis
LIFEARRRL

SEQ ID NO: 3370 - protein, 9 aa, Mycobacterium tuberculosis
IFEARRRLA

SEQ ID NO: 3371 - protein, 9 aa, Mycobacterium tuberculosis
FEARRRLAP

SEQ ID NO: 3372 - protein, 9 aa, Mycobacterium tuberculosis
EARRRLAPP

SEQ ID NO: 3373 - protein, 9 aa, Mycobacterium tuberculosis
ARRRLAPPS

SEQ ID NO: 3374 - protein, 9 aa, Mycobacterium tuberculosis
RRRLAPPSS

SEQ ID NO: 3375 - protein, 9 aa, Mycobacterium tuberculosis
RRLAPPSSH

SEQ ID NO: 3376 - protein, 9 aa, Mycobacterium tuberculosis
RLAPPSSHQ

SEQ ID NO: 3377 - protein, 9 aa, Mycobacterium tuberculosis
LAPPSSHQG

SEQ ID NO: 3378 - protein, 9 aa, Mycobacterium tuberculosis
APPSSHQGT

SEQ ID NO: 3379 - protein, 9 aa, Mycobacterium tuberculosis
PPSSHQGTI

SEQ ID NO: 3380 - protein, 9 aa, Mycobacterium tuberculosis
PSSHQGTII

SEQ ID NO: 3381 - protein, 9 aa, Mycobacterium tuberculosis
SSHQGTIII

SEQ ID NO: 3382 - protein, 9 aa, Mycobacterium tuberculosis
SHQGTIIIE

SEQ ID NO: 3383 - protein, 9 aa, Mycobacterium tuberculosis
HQGTIIIEA

SEQ ID NO: 3384 - protein, 9 aa, Mycobacterium tuberculosis
QGTIIIEAP

SEQ ID NO: 3385 - protein, 9 aa, Mycobacterium tuberculosis
GTIIIEAPP

SEQ ID NO: 3386 - protein, 9 aa, Mycobacterium tuberculosis
TIIIEAPPE

SEQ ID NO: 3387 - protein, 9 aa, Mycobacterium tuberculosis
IIIEAPPEL

SEQ ID NO: 3388 - protein, 9 aa, Mycobacterium tuberculosis
IIEAPPELP

SEQ ID NO: 3389 - protein, 9 aa, Mycobacterium tuberculosis
IEAPPELPR

SEQ ID NO: 3390 - protein, 9 aa, Mycobacterium tuberculosis
EAPPELPRV

SEQ ID NO: 3391 - protein, 9 aa, Mycobacterium tuberculosis
APPELPRVI

SEQ ID NO: 3392 - protein, 9 aa, Mycobacterium tuberculosis
PPELPRVIP

SEQ ID NO: 3393 - protein, 9 aa, Mycobacterium tuberculosis
PELPRVIPP

SEQ ID NO: 3394 - protein, 9 aa, Mycobacterium tuberculosis
ELPRVIPPS

SEQ ID NO: 3395 - protein, 9 aa, Mycobacterium tuberculosis
LPRVIPPSL

SEQ ID NO: 3396 - protein, 9 aa, Mycobacterium tuberculosis
PRVIPPSLL

SEQ ID NO: 3397 - protein, 9 aa, Mycobacterium tuberculosis
RVIPPSLLR

SEQ ID NO: 3398 - protein, 9 aa, Mycobacterium tuberculosis
VIPPSLLRR

SEQ ID NO: 3399 - protein, 9 aa, Mycobacterium tuberculosis
IPPSLLRRA

SEQ ID NO: 3400 - protein, 9 aa, Mycobacterium tuberculosis
PPSLLRRAL

SEQ ID NO: 3401 - protein, 9 aa, Mycobacterium tuberculosis
PSLLRRALP

SEQ ID NO: 3402 - protein, 9 aa, Mycobacterium tuberculosis
SLLRRALPY

SEQ ID NO: 3403 - protein, 9 aa, Mycobacterium tuberculosis
LLRRALPYL

SEQ ID NO: 3404 - protein, 9 aa, Mycobacterium tuberculosis
LRRALPYLI

SEQ ID NO: 3405 - protein, 9 aa, Mycobacterium tuberculosis
RRALPYLIG

SEQ ID NO: 3406 - protein, 9 aa, Mycobacterium tuberculosis
RALPYLIGI

SEQ ID NO: 3407 - protein, 9 aa, Mycobacterium tuberculosis
ALPYLIGIL

SEQ ID NO: 3408 - protein, 9 aa, Mycobacterium tuberculosis
LPYLIGILI

SEQ ID NO: 3409 - protein, 9 aa, Mycobacterium tuberculosis
PYLIGILIV

SEQ ID NO: 3410 - protein, 9 aa, Mycobacterium tuberculosis
YLIGILIVG

SEQ ID NO: 3411 - protein, 9 aa, Mycobacterium tuberculosis
LIGILIVGM

SEQ ID NO: 3412 - protein, 9 aa, Mycobacterium tuberculosis
IGILIVGMI

SEQ ID NO: 3413 - protein, 9 aa, Mycobacterium tuberculosis
GILIVGMIV

SEQ ID NO: 3414 - protein, 9 aa, Mycobacterium tuberculosis
ILIVGMIVA

SEQ ID NO: 3415 - protein, 9 aa, Mycobacterium tuberculosis
LIVGMIVAL

SEQ ID NO: 3416 - protein, 9 aa, Mycobacterium tuberculosis
IVGMIVALV

SEQ ID NO: 3417 - protein, 9 aa, Mycobacterium tuberculosis
VGMIVALVA

SEQ ID NO: 3418 - protein, 9 aa, Mycobacterium tuberculosis
GMIVALVAT

SEQ ID NO: 3419 - protein, 9 aa, Mycobacterium tuberculosis
MIVALVATG

SEQ ID NO: 3420 - protein, 9 aa, Mycobacterium tuberculosis
IVALVATGM

SEQ ID NO: 3421 - protein, 9 aa, Mycobacterium tuberculosis
VALVATGMR

SEQ ID NO: 3422 - protein, 9 aa, Mycobacterium tuberculosis
ALVATGMRV

SEQ ID NO: 3423 - protein, 9 aa, Mycobacterium tuberculosis
LVATGMRVI

SEQ ID NO: 3424 - protein, 9 aa, Mycobacterium tuberculosis
VATGMRVIS

SEQ ID NO: 3425 - protein, 9 aa, Mycobacterium tuberculosis
ATGMRVISP

SEQ ID NO: 3426 - protein, 9 aa, Mycobacterium tuberculosis
TGMRVISPQ

SEQ ID NO: 3427 - protein, 9 aa, Mycobacterium tuberculosis
GMRVISPQT

SEQ ID NO: 3428 - protein, 9 aa, Mycobacterium tuberculosis
MRVISPQTL

SEQ ID NO: 3429 - protein, 9 aa, Mycobacterium tuberculosis
RVISPQTLF

SEQ ID NO: 3430 - protein, 9 aa, Mycobacterium tuberculosis
VISPQTLFF

SEQ ID NO: 3431 - protein, 9 aa, Mycobacterium tuberculosis
ISPQTLFFP

SEQ ID NO: 3432 - protein, 9 aa, Mycobacterium tuberculosis
SPQTLFFPF

SEQ ID NO: 3433 - protein, 9 aa, Mycobacterium tuberculosis
PQTLFFPFV

SEQ ID NO: 3434 - protein, 9 aa, Mycobacterium tuberculosis
QTLFFPFVL

SEQ ID NO: 3435 - protein, 9 aa, Mycobacterium tuberculosis
TLFFPFVLL

SEQ ID NO: 3436 - protein, 9 aa, Mycobacterium tuberculosis
LFFPFVLLL

SEQ ID NO: 3437 - protein, 9 aa, Mycobacterium tuberculosis
FFPFVLLLA

SEQ ID NO: 3438 - protein, 9 aa, Mycobacterium tuberculosis
FPFVLLLAA

SEQ ID NO: 3439 - protein, 9 aa, Mycobacterium tuberculosis
PFVLLLAAT

SEQ ID NO: 3440 - protein, 9 aa, Mycobacterium tuberculosis
FVLLLAATA

SEQ ID NO: 3441 - protein, 9 aa, Mycobacterium tuberculosis
VLLLAATAL

SEQ ID NO: 3442 - protein, 9 aa, Mycobacterium tuberculosis
LLLAATALY

SEQ ID NO: 3443 - protein, 9 aa, Mycobacterium tuberculosis
LLAATALYR

SEQ ID NO: 3444 - protein, 9 aa, Mycobacterium tuberculosis
LAATALYRG

SEQ ID NO: 3445 - protein, 9 aa, Mycobacterium tuberculosis
AATALYRGN

SEQ ID NO: 3446 - protein, 9 aa, Mycobacterium tuberculosis
ATALYRGND

SEQ ID NO: 3447 - protein, 9 aa, Mycobacterium tuberculosis
TALYRGNDK

SEQ ID NO: 3448 - protein, 9 aa, Mycobacterium tuberculosis
ALYRGNDKK

SEQ ID NO: 3449 - protein, 9 aa, Mycobacterium tuberculosis
LYRGNDKKM

SEQ ID NO: 3450 - protein, 9 aa, Mycobacterium tuberculosis
YRGNDKKMR

SEQ ID NO: 3451 - protein, 9 aa, Mycobacterium tuberculosis
RGNDKKMRT

SEQ ID NO: 3452 - protein, 9 aa, Mycobacterium tuberculosis
GNDKKMRTE

SEQ ID NO: 3453 - protein, 9 aa, Mycobacterium tuberculosis
NDKKMRTEE

SEQ ID NO: 3454 - protein, 9 aa, Mycobacterium tuberculosis
DKKMRTEEV

SEQ ID NO: 3455 - protein, 9 aa, Mycobacterium tuberculosis
KKMRTEEVD

SEQ ID NO: 3456 - protein, 9 aa, Mycobacterium tuberculosis
KMRTEEVDA

SEQ ID NO: 3457 - protein, 9 aa, Mycobacterium tuberculosis
MRTEEVDAE

SEQ ID NO: 3458 - protein, 9 aa, Mycobacterium tuberculosis
RTEEVDAER

SEQ ID NO: 3459 - protein, 9 aa, Mycobacterium tuberculosis
TEEVDAERA

SEQ ID NO: 3460 - protein, 9 aa, Mycobacterium tuberculosis
EEVDAERAD

SEQ ID NO: 3461 - protein, 9 aa, Mycobacterium tuberculosis
EVDAERADY

SEQ ID NO: 3462 - protein, 9 aa, Mycobacterium tuberculosis
VDAERADYL

SEQ ID NO: 3463 - protein, 9 aa, Mycobacterium tuberculosis
DAERADYLR

SEQ ID NO: 3464 - protein, 9 aa, Mycobacterium tuberculosis
AERADYLRY

SEQ ID NO: 3465 - protein, 9 aa, Mycobacterium tuberculosis
ERADYLRYL

SEQ ID NO: 3466 - protein, 9 aa, Mycobacterium tuberculosis
RADYLRYLS

SEQ ID NO: 3467 - protein, 9 aa, Mycobacterium tuberculosis
ADYLRYLSV

SEQ ID NO: 3468 - protein, 9 aa, Mycobacterium tuberculosis
DYLRYLSVV

SEQ ID NO: 3469 - protein, 9 aa, Mycobacterium tuberculosis
YLRYLSVVR

SEQ ID NO: 3470 - protein, 9 aa, Mycobacterium tuberculosis
LRYLSVVRD

SEQ ID NO: 3471 - protein, 9 aa, Mycobacterium tuberculosis
RYLSVVRDN

SEQ ID NO: 3472 - protein, 9 aa, Mycobacterium tuberculosis
YLSVVRDNI

SEQ ID NO: 3473 - protein, 9 aa, Mycobacterium tuberculosis
LSVVRDNIR

SEQ ID NO: 3474 - protein, 9 aa, Mycobacterium tuberculosis
SVVRDNIRA

SEQ ID NO: 3475 - protein, 9 aa, Mycobacterium tuberculosis
VVRDNIRAQ

SEQ ID NO: 3476 - protein, 9 aa, Mycobacterium tuberculosis
VRDNIRAQA

SEQ ID NO: 3477 - protein, 9 aa, Mycobacterium tuberculosis
RDNIRAQAA

SEQ ID NO: 3478 - protein, 9 aa, Mycobacterium tuberculosis
DNIRAQAAE

SEQ ID NO: 3479 - protein, 9 aa, Mycobacterium tuberculosis
NIRAQAAEQ

SEQ ID NO: 3480 - protein, 9 aa, Mycobacterium tuberculosis
IRAQAAEQR

SEQ ID NO: 3481 - protein, 9 aa, Mycobacterium tuberculosis
RAQAAEQRA

SEQ ID NO: 3482 - protein, 9 aa, Mycobacterium tuberculosis
AQAAEQRAS

SEQ ID NO: 3483 - protein, 9 aa, Mycobacterium tuberculosis
QAAEQRASA

SEQ ID NO: 3484 - protein, 9 aa, Mycobacterium tuberculosis
AAEQRASAL

SEQ ID NO: 3485 - protein, 9 aa, Mycobacterium tuberculosis
AEQRASALW

SEQ ID NO: 3486 - protein, 9 aa, Mycobacterium tuberculosis
EQRASALWS

SEQ ID NO: 3487 - protein, 9 aa, Mycobacterium tuberculosis
QRASALWSH

SEQ ID NO: 3488 - protein, 9 aa, Mycobacterium tuberculosis
RASALWSHP

SEQ ID NO: 3489 - protein, 9 aa, Mycobacterium tuberculosis
ASALWSHPD

SEQ ID NO: 3490 - protein, 9 aa, Mycobacterium tuberculosis
SALWSHPDP

SEQ ID NO: 3491 - protein, 9 aa, Mycobacterium tuberculosis
ALWSHPDPT

SEQ ID NO: 3492 - protein, 9 aa, Mycobacterium tuberculosis
LWSHPDPTA

SEQ ID NO: 3493 - protein, 9 aa, Mycobacterium tuberculosis
WSHPDPTAL

SEQ ID NO: 3494 - protein, 9 aa, Mycobacterium tuberculosis
SHPDPTALA

SEQ ID NO: 3495 - protein, 9 aa, Mycobacterium tuberculosis
HPDPTALAS

SEQ ID NO: 3496 - protein, 9 aa, Mycobacterium tuberculosis
PDPTALASV

SEQ ID NO: 3497 - protein, 9 aa, Mycobacterium tuberculosis
DPTALASVP

SEQ ID NO: 3498 - protein, 9 aa, Mycobacterium tuberculosis
PTALASVPG

SEQ ID NO: 3499 - protein, 9 aa, Mycobacterium tuberculosis
TALASVPGS

SEQ ID NO: 3500 - protein, 9 aa, Mycobacterium tuberculosis
ALASVPGSR

SEQ ID NO: 3501 - protein, 9 aa, Mycobacterium tuberculosis
LASVPGSRR

SEQ ID NO: 3502 - protein, 9 aa, Mycobacterium tuberculosis
ASVPGSRRQ

SEQ ID NO: 3503 - protein, 9 aa, Mycobacterium tuberculosis
SVPGSRRQW

SEQ ID NO: 3504 - protein, 9 aa, Mycobacterium tuberculosis
VPGSRRQWE

SEQ ID NO: 3505 - protein, 9 aa, Mycobacterium tuberculosis
PGSRRQWER

SEQ ID NO: 3506 - protein, 9 aa, Mycobacterium tuberculosis
GSRRQWERD

SEQ ID NO: 3507 - protein, 9 aa, Mycobacterium tuberculosis
SRRQWERDP

SEQ ID NO: 3508 - protein, 9 aa, Mycobacterium tuberculosis
RRQWERDPH

SEQ ID NO: 3509 - protein, 9 aa, Mycobacterium tuberculosis
RQWERDPHD

SEQ ID NO: 3510 - protein, 9 aa, Mycobacterium tuberculosis
QWERDPHDP

SEQ ID NO: 3511 - protein, 9 aa, Mycobacterium tuberculosis
WERDPHDPD

SEQ ID NO: 3512 - protein, 9 aa, Mycobacterium tuberculosis
ERDPHDPDF

SEQ ID NO: 3513 - protein, 9 aa, Mycobacterium tuberculosis
RDPHDPDFL

SEQ ID NO: 3514 - protein, 9 aa, Mycobacterium tuberculosis
DPHDPDFLV

SEQ ID NO: 3515 - protein, 9 aa, Mycobacterium tuberculosis
PHDPDFLVL

SEQ ID NO: 3516 - protein, 9 aa, Mycobacterium tuberculosis
HDPDFLVLR

SEQ ID NO: 3517 - protein, 9 aa, Mycobacterium tuberculosis
DPDFLVLRA

SEQ ID NO: 3518 - protein, 9 aa, Mycobacterium tuberculosis
PDFLVLRAG

SEQ ID NO: 3519 - protein, 9 aa, Mycobacterium tuberculosis
DFLVLRAGR

SEQ ID NO: 3520 - protein, 9 aa, Mycobacterium tuberculosis
FLVLRAGRH

SEQ ID NO: 3521 - protein, 9 aa, Mycobacterium tuberculosis
LVLRAGRHT

SEQ ID NO: 3522 - protein, 9 aa, Mycobacterium tuberculosis
VLRAGRHTV

SEQ ID NO: 3523 - protein, 9 aa, Mycobacterium tuberculosis
LRAGRHTVP

SEQ ID NO: 3524 - protein, 9 aa, Mycobacterium tuberculosis
RAGRHTVPL

SEQ ID NO: 3525 - protein, 9 aa, Mycobacterium tuberculosis
AGRHTVPLA

SEQ ID NO: 3526 - protein, 9 aa, Mycobacterium tuberculosis
GRHTVPLAT

SEQ ID NO: 3527 - protein, 9 aa, Mycobacterium tuberculosis
RHTVPLATT

SEQ ID NO: 3528 - protein, 9 aa, Mycobacterium tuberculosis
HTVPLATTL

SEQ ID NO: 3529 - protein, 9 aa, Mycobacterium tuberculosis
TVPLATTLR

SEQ ID NO: 3530 - protein, 9 aa, Mycobacterium tuberculosis
VPLATTLRV

SEQ ID NO: 3531 - protein, 9 aa, Mycobacterium tuberculosis
PLATTLRVN

SEQ ID NO: 3532 - protein, 9 aa, Mycobacterium tuberculosis
LATTLRVND

SEQ ID NO: 3533 - protein, 9 aa, Mycobacterium tuberculosis
ATTLRVNDT

SEQ ID NO: 3534 - protein, 9 aa, Mycobacterium tuberculosis
TTLRVNDTA

SEQ ID NO: 3535 - protein, 9 aa, Mycobacterium tuberculosis
TLRVNDTAD

SEQ ID NO: 3536 - protein, 9 aa, Mycobacterium tuberculosis
LRVNDTADE

SEQ ID NO: 3537 - protein, 9 aa, Mycobacterium tuberculosis
RVNDTADEI

SEQ ID NO: 3538 - protein, 9 aa, Mycobacterium tuberculosis
VNDTADEID

SEQ ID NO: 3539 - protein, 9 aa, Mycobacterium tuberculosis
NDTADEIDL

SEQ ID NO: 3540 - protein, 9 aa, Mycobacterium tuberculosis
DTADEIDLE

SEQ ID NO: 3541 - protein, 9 aa, Mycobacterium tuberculosis
TADEIDLEP

SEQ ID NO: 3542 - protein, 9 aa, Mycobacterium tuberculosis
ADEIDLEPV

SEQ ID NO: 3543 - protein, 9 aa, Mycobacterium tuberculosis
DEIDLEPVS

SEQ ID NO: 3544 - protein, 9 aa, Mycobacterium tuberculosis
EIDLEPVSH

SEQ ID NO: 3545 - protein, 9 aa, Mycobacterium tuberculosis
IDLEPVSHS

SEQ ID NO: 3546 - protein, 9 aa, Mycobacterium tuberculosis
DLEPVSHSA

SEQ ID NO: 3547 - protein, 9 aa, Mycobacterium tuberculosis
LEPVSHSAL

SEQ ID NO: 3548 - protein, 9 aa, Mycobacterium tuberculosis
EPVSHSALR

SEQ ID NO: 3549 - protein, 9 aa, Mycobacterium tuberculosis
PVSHSALRS

SEQ ID NO: 3550 - protein, 9 aa, Mycobacterium tuberculosis
VSHSALRSL

SEQ ID NO: 3551 - protein, 9 aa, Mycobacterium tuberculosis
SHSALRSLL

SEQ ID NO: 3552 - protein, 9 aa, Mycobacterium tuberculosis
HSALRSLLD

SEQ ID NO: 3553 - protein, 9 aa, Mycobacterium tuberculosis
SALRSLLDT

SEQ ID NO: 3554 - protein, 9 aa, Mycobacterium tuberculosis
ALRSLLDTQ

SEQ ID NO: 3555 - protein, 9 aa, Mycobacterium tuberculosis
LRSLLDTQR

SEQ ID NO: 3556 - protein, 9 aa, Mycobacterium tuberculosis
RSLLDTQRS

SEQ ID NO: 3557 - protein, 9 aa, Mycobacterium tuberculosis
SLLDTQRSI

SEQ ID NO: 3558 - protein, 9 aa, Mycobacterium tuberculosis
LLDTQRSIG

SEQ ID NO: 3559 - protein, 9 aa, Mycobacterium tuberculosis
LDTQRSIGD

SEQ ID NO: 3560 - protein, 9 aa, Mycobacterium tuberculosis
DTQRSIGDV

SEQ ID NO: 3561 - protein, 9 aa, Mycobacterium tuberculosis
TQRSIGDVP

SEQ ID NO: 3562 - protein, 9 aa, Mycobacterium tuberculosis
QRSIGDVPT

SEQ ID NO: 3563 - protein, 9 aa, Mycobacterium tuberculosis
RSIGDVPTG

SEQ ID NO: 3564 - protein, 9 aa, Mycobacterium tuberculosis
SIGDVPTGI

SEQ ID NO: 3565 - protein, 9 aa, Mycobacterium tuberculosis
IGDVPTGID

SEQ ID NO: 3566 - protein, 9 aa, Mycobacterium tuberculosis
GDVPTGIDL

SEQ ID NO: 3567 - protein, 9 aa, Mycobacterium tuberculosis
DVPTGIDLT

SEQ ID NO: 3568 - protein, 9 aa, Mycobacterium tuberculosis
VPTGIDLTK

SEQ ID NO: 3569 - protein, 9 aa, Mycobacterium tuberculosis
PTGIDLTKV

SEQ ID NO: 3570 - protein, 9 aa, Mycobacterium tuberculosis
TGIDLTKVS

SEQ ID NO: 3571 - protein, 9 aa, Mycobacterium tuberculosis
GIDLTKVSP

SEQ ID NO: 3572 - protein, 9 aa, Mycobacterium tuberculosis
IDLTKVSPI

SEQ ID NO: 3573 - protein, 9 aa, Mycobacterium tuberculosis
DLTKVSPIT

SEQ ID NO: 3574 - protein, 9 aa, Mycobacterium tuberculosis
LTKVSPITV

SEQ ID NO: 3575 - protein, 9 aa, Mycobacterium tuberculosis
TKVSPITVL

SEQ ID NO: 3576 - protein, 9 aa, Mycobacterium tuberculosis
KVSPITVLG

SEQ ID NO: 3577 - protein, 9 aa, Mycobacterium tuberculosis
VSPITVLGE

SEQ ID NO: 3578 - protein, 9 aa, Mycobacterium tuberculosis
SPITVLGER

SEQ ID NO: 3579 - protein, 9 aa, Mycobacterium tuberculosis
PITVLGERA

SEQ ID NO: 3580 - protein, 9 aa, Mycobacterium tuberculosis
ITVLGERAQ

SEQ ID NO: 3581 - protein, 9 aa, Mycobacterium tuberculosis
TVLGERAQV

SEQ ID NO: 3582 - protein, 9 aa, Mycobacterium tuberculosis
VLGERAQVR

SEQ ID NO: 3583 - protein, 9 aa, Mycobacterium tuberculosis
LGERAQVRA

SEQ ID NO: 3584 - protein, 9 aa, Mycobacterium tuberculosis
GERAQVRAV

SEQ ID NO: 3585 - protein, 9 aa, Mycobacterium tuberculosis
ERAQVRAVL

SEQ ID NO: 3586 - protein, 9 aa, Mycobacterium tuberculosis
RAQVRAVLR

SEQ ID NO: 3587 - protein, 9 aa, Mycobacterium tuberculosis
AQVRAVLRA

SEQ ID NO: 3588 - protein, 9 aa, Mycobacterium tuberculosis
QVRAVLRAW

SEQ ID NO: 3589 - protein, 9 aa, Mycobacterium tuberculosis
VRAVLRAWI

SEQ ID NO: 3590 - protein, 9 aa, Mycobacterium tuberculosis
RAVLRAWIA

SEQ ID NO: 3591 - protein, 9 aa, Mycobacterium tuberculosis
AVLRAWIAQ

SEQ ID NO: 3592 - protein, 9 aa, Mycobacterium tuberculosis
VLRAWIAQA

SEQ ID NO: 3593 - protein, 9 aa, Mycobacterium tuberculosis
LRAWIAQAV

SEQ ID NO: 3594 - protein, 9 aa, Mycobacterium tuberculosis
RAWIAQAVT

SEQ ID NO: 3595 - protein, 9 aa, Mycobacterium tuberculosis
AWIAQAVTW

SEQ ID NO: 3596 - protein, 9 aa, Mycobacterium tuberculosis
WIAQAVTWH

SEQ ID NO: 3597 - protein, 9 aa, Mycobacterium tuberculosis
IAQAVTWHD

SEQ ID NO: 3598 - protein, 9 aa, Mycobacterium tuberculosis
AQAVTWHDP

SEQ ID NO: 3599 - protein, 9 aa, Mycobacterium tuberculosis
QAVTWHDPT

SEQ ID NO: 3600 - protein, 9 aa, Mycobacterium tuberculosis
AVTWHDPTV

SEQ ID NO: 3601 - protein, 9 aa, Mycobacterium tuberculosis
VTWHDPTVL

SEQ ID NO: 3602 - protein, 9 aa, Mycobacterium tuberculosis
TWHDPTVLG

SEQ ID NO: 3603 - protein, 9 aa, Mycobacterium tuberculosis
WHDPTVLGV

SEQ ID NO: 3604 - protein, 9 aa, Mycobacterium tuberculosis
HDPTVLGVA

SEQ ID NO: 3605 - protein, 9 aa, Mycobacterium tuberculosis
DPTVLGVAL

SEQ ID NO: 3606 - protein, 9 aa, Mycobacterium tuberculosis
PTVLGVALA

SEQ ID NO: 3607 - protein, 9 aa, Mycobacterium tuberculosis
TVLGVALAA

SEQ ID NO: 3608 - protein, 9 aa, Mycobacterium tuberculosis
VLGVALAAR

SEQ ID NO: 3609 - protein, 9 aa, Mycobacterium tuberculosis
LGVALAARD

SEQ ID NO: 3610 - protein, 9 aa, Mycobacterium tuberculosis
GVALAARDL

SEQ ID NO: 3611 - protein, 9 aa, Mycobacterium tuberculosis
VALAARDLE

SEQ ID NO: 3612 - protein, 9 aa, Mycobacterium tuberculosis
ALAARDLEG

SEQ ID NO: 3613 - protein, 9 aa, Mycobacterium tuberculosis
LAARDLEGR

SEQ ID NO: 3614 - protein, 9 aa, Mycobacterium tuberculosis
AARDLEGRD

SEQ ID NO: 3615 - protein, 9 aa, Mycobacterium tuberculosis
ARDLEGRDW

SEQ ID NO: 3616 - protein, 9 aa, Mycobacterium tuberculosis
RDLEGRDWN

SEQ ID NO: 3617 - protein, 9 aa, Mycobacterium tuberculosis
DLEGRDWNW

SEQ ID NO: 3618 - protein, 9 aa, Mycobacterium tuberculosis
LEGRDWNWL

SEQ ID NO: 3619 - protein, 9 aa, Mycobacterium tuberculosis
EGRDWNWLK

SEQ ID NO: 3620 - protein, 9 aa, Mycobacterium tuberculosis
GRDWNWLKW

SEQ ID NO: 3621 - protein, 9 aa, Mycobacterium tuberculosis
RDWNWLKWL

SEQ ID NO: 3622 - protein, 9 aa, Mycobacterium tuberculosis
DWNWLKWLP

SEQ ID NO: 3623 - protein, 9 aa, Mycobacterium tuberculosis
WNWLKWLPH

SEQ ID NO: 3624 - protein, 9 aa, Mycobacterium tuberculosis
NWLKWLPHV

SEQ ID NO: 3625 - protein, 9 aa, Mycobacterium tuberculosis
WLKWLPHVD

SEQ ID NO: 3626 - protein, 9 aa, Mycobacterium tuberculosis
LKWLPHVDI

SEQ ID NO: 3627 - protein, 9 aa, Mycobacterium tuberculosis
KWLPHVDIP

SEQ ID NO: 3628 - protein, 9 aa, Mycobacterium tuberculosis
WLPHVDIPG

SEQ ID NO: 3629 - protein, 9 aa, Mycobacterium tuberculosis
LPHVDIPGR

SEQ ID NO: 3630 - protein, 9 aa, Mycobacterium tuberculosis
PHVDIPGRL

SEQ ID NO: 3631 - protein, 9 aa, Mycobacterium tuberculosis
HVDIPGRLD

SEQ ID NO: 3632 - protein, 9 aa, Mycobacterium tuberculosis
VDIPGRLDA

SEQ ID NO: 3633 - protein, 9 aa, Mycobacterium tuberculosis
DIPGRLDAL

SEQ ID NO: 3634 - protein, 9 aa, Mycobacterium tuberculosis
IPGRLDALG

SEQ ID NO: 3635 - protein, 9 aa, Mycobacterium tuberculosis
PGRLDALGP

SEQ ID NO: 3636 - protein, 9 aa, Mycobacterium tuberculosis
GRLDALGPA

SEQ ID NO: 3637 - protein, 9 aa, Mycobacterium tuberculosis
RLDALGPAR

SEQ ID NO: 3638 - protein, 9 aa, Mycobacterium tuberculosis
LDALGPARN

SEQ ID NO: 3639 - protein, 9 aa, Mycobacterium tuberculosis
DALGPARNL

SEQ ID NO: 3640 - protein, 9 aa, Mycobacterium tuberculosis
ALGPARNLS

SEQ ID NO: 3641 - protein, 9 aa, Mycobacterium tuberculosis
LGPARNLST

SEQ ID NO: 3642 - protein, 9 aa, Mycobacterium tuberculosis
GPARNLSTD

SEQ ID NO: 3643 - protein, 9 aa, Mycobacterium tuberculosis
PARNLSTDP

SEQ ID NO: 3644 - protein, 9 aa, Mycobacterium tuberculosis
ARNLSTDPD

SEQ ID NO: 3645 - protein, 9 aa, Mycobacterium tuberculosis
RNLSTDPDE

SEQ ID NO: 3646 - protein, 9 aa, Mycobacterium tuberculosis
NLSTDPDEL

SEQ ID NO: 3647 - protein, 9 aa, Mycobacterium tuberculosis
LSTDPDELI

SEQ ID NO: 3648 - protein, 9 aa, Mycobacterium tuberculosis
STDPDELIA

SEQ ID NO: 3649 - protein, 9 aa, Mycobacterium tuberculosis
TDPDELIAL

SEQ ID NO: 3650 - protein, 9 aa, Mycobacterium tuberculosis
DPDELIALL

SEQ ID NO: 3651 - protein, 9 aa, Mycobacterium tuberculosis
PDELIALLG

SEQ ID NO: 3652 - protein, 9 aa, Mycobacterium tuberculosis
DELIALLGP

SEQ ID NO: 3653 - protein, 9 aa, Mycobacterium tuberculosis
ELIALLGPV

SEQ ID NO: 3654 - protein, 9 aa, Mycobacterium tuberculosis
LIALLGPVL

SEQ ID NO: 3655 - protein, 9 aa, Mycobacterium tuberculosis
IALLGPVLA

SEQ ID NO: 3656 - protein, 9 aa, Mycobacterium tuberculosis
ALLGPVLAD

SEQ ID NO: 3657 - protein, 9 aa, Mycobacterium tuberculosis
LLGPVLADR

SEQ ID NO: 3658 - protein, 9 aa, Mycobacterium tuberculosis
LGPVLADRP

SEQ ID NO: 3659 - protein, 9 aa, Mycobacterium tuberculosis
GPVLADRPA

SEQ ID NO: 3660 - protein, 9 aa, Mycobacterium tuberculosis
PVLADRPAF

SEQ ID NO: 3661 - protein, 9 aa, Mycobacterium tuberculosis
VLADRPAFT

SEQ ID NO: 3662 - protein, 9 aa, Mycobacterium tuberculosis
LADRPAFTG

SEQ ID NO: 3663 - protein, 9 aa, Mycobacterium tuberculosis
ADRPAFTGQ

SEQ ID NO: 3664 - protein, 9 aa, Mycobacterium tuberculosis
DRPAFTGQP

SEQ ID NO: 3665 - protein, 9 aa, Mycobacterium tuberculosis
RPAFTGQPT

SEQ ID NO: 3666 - protein, 9 aa, Mycobacterium tuberculosis
PAFTGQPTD

SEQ ID NO: 3667 - protein, 9 aa, Mycobacterium tuberculosis
AFTGQPTDA

SEQ ID NO: 3668 - protein, 9 aa, Mycobacterium tuberculosis
FTGQPTDAL

SEQ ID NO: 3669 - protein, 9 aa, Mycobacterium tuberculosis
TGQPTDALR

SEQ ID NO: 3670 - protein, 9 aa, Mycobacterium tuberculosis
GQPTDALRH

SEQ ID NO: 3671 - protein, 9 aa, Mycobacterium tuberculosis
QPTDALRHL

SEQ ID NO: 3672 - protein, 9 aa, Mycobacterium tuberculosis
PTDALRHLL

SEQ ID NO: 3673 - protein, 9 aa, Mycobacterium tuberculosis
TDALRHLLI

SEQ ID NO: 3674 - protein, 9 aa, Mycobacterium tuberculosis
DALRHLLIV

SEQ ID NO: 3675 - protein, 9 aa, Mycobacterium tuberculosis
ALRHLLIVV

SEQ ID NO: 3676 - protein, 9 aa, Mycobacterium tuberculosis
LRHLLIVVD

SEQ ID NO: 3677 - protein, 9 aa, Mycobacterium tuberculosis
RHLLIVVDD

SEQ ID NO: 3678 - protein, 9 aa, Mycobacterium tuberculosis
HLLIVVDDP

SEQ ID NO: 3679 - protein, 9 aa, Mycobacterium tuberculosis
LLIVVDDPD

SEQ ID NO: 3680 - protein, 9 aa, Mycobacterium tuberculosis
LIVVDDPDY

SEQ ID NO: 3681 - protein, 9 aa, Mycobacterium tuberculosis
IVVDDPDYD

SEQ ID NO: 3682 - protein, 9 aa, Mycobacterium tuberculosis
VVDDPDYDL

SEQ ID NO: 3683 - protein, 9 aa, Mycobacterium tuberculosis
VDDPDYDLG

SEQ ID NO: 3684 - protein, 9 aa, Mycobacterium tuberculosis
DDPDYDLGA

SEQ ID NO: 3685 - protein, 9 aa, Mycobacterium tuberculosis
DPDYDLGAS

SEQ ID NO: 3686 - protein, 9 aa, Mycobacterium tuberculosis
PDYDLGASP

SEQ ID NO: 3687 - protein, 9 aa, Mycobacterium tuberculosis
DYDLGASPL

SEQ ID NO: 3688 - protein, 9 aa, Mycobacterium tuberculosis
YDLGASPLA

SEQ ID NO: 3689 - protein, 9 aa, Mycobacterium tuberculosis
DLGASPLAV

SEQ ID NO: 3690 - protein, 9 aa, Mycobacterium tuberculosis
LGASPLAVG

SEQ ID NO: 3691 - protein, 9 aa, Mycobacterium tuberculosis
GASPLAVGR

SEQ ID NO: 3692 - protein, 9 aa, Mycobacterium tuberculosis
ASPLAVGRA

SEQ ID NO: 3693 - protein, 9 aa, Mycobacterium tuberculosis
SPLAVGRAG

SEQ ID NO: 3694 - protein, 9 aa, Mycobacterium tuberculosis
PLAVGRAGV

SEQ ID NO: 3695 - protein, 9 aa, Mycobacterium tuberculosis
LAVGRAGVT

SEQ ID NO: 3696 - protein, 9 aa, Mycobacterium tuberculosis
AVGRAGVTV

SEQ ID NO: 3697 - protein, 9 aa, Mycobacterium tuberculosis
VGRAGVTVV

SEQ ID NO: 3698 - protein, 9 aa, Mycobacterium tuberculosis
GRAGVTVVH

SEQ ID NO: 3699 - protein, 9 aa, Mycobacterium tuberculosis
RAGVTVVHC

SEQ ID NO: 3700 - protein, 9 aa, Mycobacterium tuberculosis
AGVTVVHCS

SEQ ID NO: 3701 - protein, 9 aa, Mycobacterium tuberculosis
GVTVVHCSA

SEQ ID NO: 3702 - protein, 9 aa, Mycobacterium tuberculosis
VTVVHCSAS

SEQ ID NO: 3703 - protein, 9 aa, Mycobacterium tuberculosis
TVVHCSASA

SEQ ID NO: 3704 - protein, 9 aa, Mycobacterium tuberculosis
VVHCSASAP

SEQ ID NO: 3705 - protein, 9 aa, Mycobacterium tuberculosis
VHCSASAPH

SEQ ID NO: 3706 - protein, 9 aa, Mycobacterium tuberculosis
HCSASAPHR

SEQ ID NO: 3707 - protein, 9 aa, Mycobacterium tuberculosis
CSASAPHRE

SEQ ID NO: 3708 - protein, 9 aa, Mycobacterium tuberculosis
SASAPHREQ

SEQ ID NO: 3709 - protein, 9 aa, Mycobacterium tuberculosis
ASAPHREQY

SEQ ID NO: 3710 - protein, 9 aa, Mycobacterium tuberculosis
SAPHREQYS

SEQ ID NO: 3711 - protein, 9 aa, Mycobacterium tuberculosis
APHREQYSD

SEQ ID NO: 3712 - protein, 9 aa, Mycobacterium tuberculosis
PHREQYSDP

SEQ ID NO: 3713 - protein, 9 aa, Mycobacterium tuberculosis
HREQYSDPE

SEQ ID NO: 3714 - protein, 9 aa, Mycobacterium tuberculosis
REQYSDPEK

SEQ ID NO: 3715 - protein, 9 aa, Mycobacterium tuberculosis
EQYSDPEKP

SEQ ID NO: 3716 - protein, 9 aa, Mycobacterium tuberculosis
QYSDPEKPI

SEQ ID NO: 3717 - protein, 9 aa, Mycobacterium tuberculosis
YSDPEKPIL

SEQ ID NO: 3718 - protein, 9 aa, Mycobacterium tuberculosis
SDPEKPILR

SEQ ID NO: 3719 - protein, 9 aa, Mycobacterium tuberculosis
DPEKPILRV

SEQ ID NO: 3720 - protein, 9 aa, Mycobacterium tuberculosis
PEKPILRVA

SEQ ID NO: 3721 - protein, 9 aa, Mycobacterium tuberculosis
EKPILRVAH

SEQ ID NO: 3722 - protein, 9 aa, Mycobacterium tuberculosis
KPILRVAHG

SEQ ID NO: 3723 - protein, 9 aa, Mycobacterium tuberculosis
PILRVAHGA

SEQ ID NO: 3724 - protein, 9 aa, Mycobacterium tuberculosis
ILRVAHGAI

SEQ ID NO: 3725 - protein, 9 aa, Mycobacterium tuberculosis
LRVAHGAIE

SEQ ID NO: 3726 - protein, 9 aa, Mycobacterium tuberculosis
RVAHGAIER

SEQ ID NO: 3727 - protein, 9 aa, Mycobacterium tuberculosis
VAHGAIERW

SEQ ID NO: 3728 - protein, 9 aa, Mycobacterium tuberculosis
AHGAIERWQ

SEQ ID NO: 3729 - protein, 9 aa, Mycobacterium tuberculosis
HGAIERWQT

SEQ ID NO: 3730 - protein, 9 aa, Mycobacterium tuberculosis
GAIERWQTG

SEQ ID NO: 3731 - protein, 9 aa, Mycobacterium tuberculosis
AIERWQTGG

SEQ ID NO: 3732 - protein, 9 aa, Mycobacterium tuberculosis
IERWQTGGW

SEQ ID NO: 3733 - protein, 9 aa, Mycobacterium tuberculosis
ERWQTGGWQ

SEQ ID NO: 3734 - protein, 9 aa, Mycobacterium tuberculosis
RWQTGGWQP

SEQ ID NO: 3735 - protein, 9 aa, Mycobacterium tuberculosis
WQTGGWQPY

SEQ ID NO: 3736 - protein, 9 aa, Mycobacterium tuberculosis
QTGGWQPYI

SEQ ID NO: 3737 - protein, 9 aa, Mycobacterium tuberculosis
TGGWQPYID

SEQ ID NO: 3738 - protein, 9 aa, Mycobacterium tuberculosis
GGWQPYIDA

SEQ ID NO: 3739 - protein, 9 aa, Mycobacterium tuberculosis
GWQPYIDAA

SEQ ID NO: 3740 - protein, 9 aa, Mycobacterium tuberculosis
WQPYIDAAD

SEQ ID NO: 3741 - protein, 9 aa, Mycobacterium tuberculosis
QPYIDAADQ

SEQ ID NO: 3742 - protein, 9 aa, Mycobacterium tuberculosis
PYIDAADQF

SEQ ID NO: 3743 - protein, 9 aa, Mycobacterium tuberculosis
YIDAADQFS

SEQ ID NO: 3744 - protein, 9 aa, Mycobacterium tuberculosis
IDAADQFSA

SEQ ID NO: 3745 - protein, 9 aa, Mycobacterium tuberculosis
DAADQFSAD

SEQ ID NO: 3746 - protein, 9 aa, Mycobacterium tuberculosis
AADQFSADE

SEQ ID NO: 3747 - protein, 9 aa, Mycobacterium tuberculosis
ADQFSADEA

SEQ ID NO: 3748 - protein, 9 aa, Mycobacterium tuberculosis
DQFSADEAA

SEQ ID NO: 3749 - protein, 9 aa, Mycobacterium tuberculosis
QFSADEAAH

SEQ ID NO: 3750 - protein, 9 aa, Mycobacterium tuberculosis
FSADEAAHL

SEQ ID NO: 3751 - protein, 9 aa, Mycobacterium tuberculosis
SADEAAHLA

SEQ ID NO: 3752 - protein, 9 aa, Mycobacterium tuberculosis
ADEAAHLAR

SEQ ID NO: 3753 - protein, 9 aa, Mycobacterium tuberculosis
DEAAHLARR

SEQ ID NO: 3754 - protein, 9 aa, Mycobacterium tuberculosis
EAAHLARRL

SEQ ID NO: 3755 - protein, 9 aa, Mycobacterium tuberculosis
AAHLARRLS

SEQ ID NO: 3756 - protein, 9 aa, Mycobacterium tuberculosis
AHLARRLSR

SEQ ID NO: 3757 - protein, 9 aa, Mycobacterium tuberculosis
HLARRLSRW

SEQ ID NO: 3758 - protein, 9 aa, Mycobacterium tuberculosis
LARRLSRWD

SEQ ID NO: 3759 - protein, 9 aa, Mycobacterium tuberculosis
ARRLSRWDS

SEQ ID NO: 3760 - protein, 9 aa, Mycobacterium tuberculosis
RRLSRWDSN

SEQ ID NO: 3761 - protein, 9 aa, Mycobacterium tuberculosis
RLSRWDSNP

SEQ ID NO: 3762 - protein, 9 aa, Mycobacterium tuberculosis
LSRWDSNPT

SEQ ID NO: 3763 - protein, 9 aa, Mycobacterium tuberculosis
SRWDSNPTH

SEQ ID NO: 3764 - protein, 9 aa, Mycobacterium tuberculosis
RWDSNPTHA

SEQ ID NO: 3765 - protein, 9 aa, Mycobacterium tuberculosis
WDSNPTHAG

SEQ ID NO: 3766 - protein, 9 aa, Mycobacterium tuberculosis
DSNPTHAGL

SEQ ID NO: 3767 - protein, 9 aa, Mycobacterium tuberculosis
SNPTHAGLR

SEQ ID NO: 3768 - protein, 9 aa, Mycobacterium tuberculosis
NPTHAGLRS

SEQ ID NO: 3769 - protein, 9 aa, Mycobacterium tuberculosis
PTHAGLRSA

SEQ ID NO: 3770 - protein, 9 aa, Mycobacterium tuberculosis
THAGLRSAA

SEQ ID NO: 3771 - protein, 9 aa, Mycobacterium tuberculosis
HAGLRSAAT

SEQ ID NO: 3772 - protein, 9 aa, Mycobacterium tuberculosis
AGLRSAATR

SEQ ID NO: 3773 - protein, 9 aa, Mycobacterium tuberculosis
GLRSAATRG

SEQ ID NO: 3774 - protein, 9 aa, Mycobacterium tuberculosis
LRSAATRGA

SEQ ID NO: 3775 - protein, 9 aa, Mycobacterium tuberculosis
RSAATRGAS

SEQ ID NO: 3776 - protein, 9 aa, Mycobacterium tuberculosis
SAATRGASF

SEQ ID NO: 3777 - protein, 9 aa, Mycobacterium tuberculosis
AATRGASFT

SEQ ID NO: 3778 - protein, 9 aa, Mycobacterium tuberculosis
ATRGASFTT

SEQ ID NO: 3779 - protein, 9 aa, Mycobacterium tuberculosis
TRGASFTTL

SEQ ID NO: 3780 - protein, 9 aa, Mycobacterium tuberculosis
RGASFTTLL

SEQ ID NO: 3781 - protein, 9 aa, Mycobacterium tuberculosis
GASFTTLLG

SEQ ID NO: 3782 - protein, 9 aa, Mycobacterium tuberculosis
ASFTTLLGI

SEQ ID NO: 3783 - protein, 9 aa, Mycobacterium tuberculosis
SFTTLLGIE

SEQ ID NO: 3784 - protein, 9 aa, Mycobacterium tuberculosis
FTTLLGIED

SEQ ID NO: 3785 - protein, 9 aa, Mycobacterium tuberculosis
TTLLGIEDA

SEQ ID NO: 3786 - protein, 9 aa, Mycobacterium tuberculosis
TLLGIEDAS

SEQ ID NO: 3787 - protein, 9 aa, Mycobacterium tuberculosis
LLGIEDASR

SEQ ID NO: 3788 - protein, 9 aa, Mycobacterium tuberculosis
LGIEDASRL

SEQ ID NO: 3789 - protein, 9 aa, Mycobacterium tuberculosis
GIEDASRLD

SEQ ID NO: 3790 - protein, 9 aa, Mycobacterium tuberculosis
IEDASRLDV

SEQ ID NO: 3791 - protein, 9 aa, Mycobacterium tuberculosis
EDASRLDVP

SEQ ID NO: 3792 - protein, 9 aa, Mycobacterium tuberculosis
DASRLDVPA

SEQ ID NO: 3793 - protein, 9 aa, Mycobacterium tuberculosis
ASRLDVPAL

SEQ ID NO: 3794 - protein, 9 aa, Mycobacterium tuberculosis
SRLDVPALW

SEQ ID NO: 3795 - protein, 9 aa, Mycobacterium tuberculosis
RLDVPALWA

SEQ ID NO: 3796 - protein, 9 aa, Mycobacterium tuberculosis
LDVPALWAP

SEQ ID NO: 3797 - protein, 9 aa, Mycobacterium tuberculosis
DVPALWAPR

SEQ ID NO: 3798 - protein, 9 aa, Mycobacterium tuberculosis
VPALWAPRR

SEQ ID NO: 3799 - protein, 9 aa, Mycobacterium tuberculosis
PALWAPRRR

SEQ ID NO: 3800 - protein, 9 aa, Mycobacterium tuberculosis
ALWAPRRRD

SEQ ID NO: 3801 - protein, 9 aa, Mycobacterium tuberculosis
LWAPRRRDE

SEQ ID NO: 3802 - protein, 9 aa, Mycobacterium tuberculosis
WAPRRRDEE

SEQ ID NO: 3803 - protein, 9 aa, Mycobacterium tuberculosis
APRRRDEEL

SEQ ID NO: 3804 - protein, 9 aa, Mycobacterium tuberculosis
PRRRDEELR

SEQ ID NO: 3805 - protein, 9 aa, Mycobacterium tuberculosis
RRRDEELRV

SEQ ID NO: 3806 - protein, 9 aa, Mycobacterium tuberculosis
RRDEELRVP

SEQ ID NO: 3807 - protein, 9 aa, Mycobacterium tuberculosis
RDEELRVPI

SEQ ID NO: 3808 - protein, 9 aa, Mycobacterium tuberculosis
DEELRVPIG

SEQ ID NO: 3809 - protein, 9 aa, Mycobacterium tuberculosis
EELRVPIGV

SEQ ID NO: 3810 - protein, 9 aa, Mycobacterium tuberculosis
ELRVPIGVT

SEQ ID NO: 3811 - protein, 9 aa, Mycobacterium tuberculosis
LRVPIGVTG

SEQ ID NO: 3812 - protein, 9 aa, Mycobacterium tuberculosis
RVPIGVTGT

SEQ ID NO: 3813 - protein, 9 aa, Mycobacterium tuberculosis
VPIGVTGTG

SEQ ID NO: 3814 - protein, 9 aa, Mycobacterium tuberculosis
PIGVTGTGE

SEQ ID NO: 3815 - protein, 9 aa, Mycobacterium tuberculosis
IGVTGTGEP

SEQ ID NO: 3816 - protein, 9 aa, Mycobacterium tuberculosis
GVTGTGEPL

SEQ ID NO: 3817 - protein, 9 aa, Mycobacterium tuberculosis
VTGTGEPLM

SEQ ID NO: 3818 - protein, 9 aa, Mycobacterium tuberculosis
TGTGEPLMF

SEQ ID NO: 3819 - protein, 9 aa, Mycobacterium tuberculosis
GTGEPLMFD

SEQ ID NO: 3820 - protein, 9 aa, Mycobacterium tuberculosis
TGEPLMFDL

SEQ ID NO: 3821 - protein, 9 aa, Mycobacterium tuberculosis
GEPLMFDLK

SEQ ID NO: 3822 - protein, 9 aa, Mycobacterium tuberculosis
EPLMFDLKD

SEQ ID NO: 3823 - protein, 9 aa, Mycobacterium tuberculosis
PLMFDLKDE

SEQ ID NO: 3824 - protein, 9 aa, Mycobacterium tuberculosis
LMFDLKDEA

SEQ ID NO: 3825 - protein, 9 aa, Mycobacterium tuberculosis
MFDLKDEAE

SEQ ID NO: 3826 - protein, 9 aa, Mycobacterium tuberculosis
FDLKDEAEG

SEQ ID NO: 3827 - protein, 9 aa, Mycobacterium tuberculosis
DLKDEAEGG

SEQ ID NO: 3828 - protein, 9 aa, Mycobacterium tuberculosis
LKDEAEGGM

SEQ ID NO: 3829 - protein, 9 aa, Mycobacterium tuberculosis
KDEAEGGMG

SEQ ID NO: 3830 - protein, 9 aa, Mycobacterium tuberculosis
DEAEGGMGP

SEQ ID NO: 3831 - protein, 9 aa, Mycobacterium tuberculosis
EAEGGMGPH

SEQ ID NO: 3832 - protein, 9 aa, Mycobacterium tuberculosis
AEGGMGPHG

SEQ ID NO: 3833 - protein, 9 aa, Mycobacterium tuberculosis
EGGMGPHGL

SEQ ID NO: 3834 - protein, 9 aa, Mycobacterium tuberculosis
GGMGPHGLM

SEQ ID NO: 3835 - protein, 9 aa, Mycobacterium tuberculosis
GMGPHGLMI

SEQ ID NO: 3836 - protein, 9 aa, Mycobacterium tuberculosis
MGPHGLMIG

SEQ ID NO: 3837 - protein, 9 aa, Mycobacterium tuberculosis
GPHGLMIGM

SEQ ID NO: 3838 - protein, 9 aa, Mycobacterium tuberculosis
PHGLMIGMT

SEQ ID NO: 3839 - protein, 9 aa, Mycobacterium tuberculosis
HGLMIGMTG

SEQ ID NO: 3840 - protein, 9 aa, Mycobacterium tuberculosis
GLMIGMTGS

SEQ ID NO: 3841 - protein, 9 aa, Mycobacterium tuberculosis
LMIGMTGSG

SEQ ID NO: 3842 - protein, 9 aa, Mycobacterium tuberculosis
MIGMTGSGK

SEQ ID NO: 3843 - protein, 9 aa, Mycobacterium tuberculosis
IGMTGSGKS

SEQ ID NO: 3844 - protein, 9 aa, Mycobacterium tuberculosis
GMTGSGKSQ

SEQ ID NO: 3845 - protein, 9 aa, Mycobacterium tuberculosis
MTGSGKSQT

SEQ ID NO: 3846 - protein, 9 aa, Mycobacterium tuberculosis
TGSGKSQTL

SEQ ID NO: 3847 - protein, 9 aa, Mycobacterium tuberculosis
GSGKSQTLM

SEQ ID NO: 3848 - protein, 9 aa, Mycobacterium tuberculosis
SGKSQTLMS

SEQ ID NO: 3849 - protein, 9 aa, Mycobacterium tuberculosis
GKSQTLMSI

SEQ ID NO: 3850 - protein, 9 aa, Mycobacterium tuberculosis
KSQTLMSIL

SEQ ID NO: 3851 - protein, 9 aa, Mycobacterium tuberculosis
SQTLMSILL

SEQ ID NO: 3852 - protein, 9 aa, Mycobacterium tuberculosis
QTLMSILLS

SEQ ID NO: 3853 - protein, 9 aa, Mycobacterium tuberculosis
TLMSILLSL

SEQ ID NO: 3854 - protein, 9 aa, Mycobacterium tuberculosis
LMSILLSLL

SEQ ID NO: 3855 - protein, 9 aa, Mycobacterium tuberculosis
MSILLSLLT

SEQ ID NO: 3856 - protein, 9 aa, Mycobacterium tuberculosis
SILLSLLTT

SEQ ID NO: 3857 - protein, 9 aa, Mycobacterium tuberculosis
ILLSLLTTH

SEQ ID NO: 3858 - protein, 9 aa, Mycobacterium tuberculosis
LLSLLTTHS

SEQ ID NO: 3859 - protein, 9 aa, Mycobacterium tuberculosis
LSLLTTHSA

SEQ ID NO: 3860 - protein, 9 aa, Mycobacterium tuberculosis
SLLTTHSAE

SEQ ID NO: 3861 - protein, 9 aa, Mycobacterium tuberculosis
LLTTHSAER

SEQ ID NO: 3862 - protein, 9 aa, Mycobacterium tuberculosis
LTTHSAERL

SEQ ID NO: 3863 - protein, 9 aa, Mycobacterium tuberculosis
TTHSAERLI

SEQ ID NO: 3864 - protein, 9 aa, Mycobacterium tuberculosis
THSAERLIV

SEQ ID NO: 3865 - protein, 9 aa, Mycobacterium tuberculosis
HSAERLIVI

SEQ ID NO: 3866 - protein, 9 aa, Mycobacterium tuberculosis
SAERLIVIY

SEQ ID NO: 3867 - protein, 9 aa, Mycobacterium tuberculosis
AERLIVIYA

SEQ ID NO: 3868 - protein, 9 aa, Mycobacterium tuberculosis
ERLIVIYAD

SEQ ID NO: 3869 - protein, 9 aa, Mycobacterium tuberculosis
RLIVIYADF

SEQ ID NO: 3870 - protein, 9 aa, Mycobacterium tuberculosis
LIVIYADFK

SEQ ID NO: 3871 - protein, 9 aa, Mycobacterium tuberculosis
IVIYADFKG

SEQ ID NO: 3872 - protein, 9 aa, Mycobacterium tuberculosis
VIYADFKGE

SEQ ID NO: 3873 - protein, 9 aa, Mycobacterium tuberculosis
IYADFKGEA

SEQ ID NO: 3874 - protein, 9 aa, Mycobacterium tuberculosis
YADFKGEAG

SEQ ID NO: 3875 - protein, 9 aa, Mycobacterium tuberculosis
ADFKGEAGA

SEQ ID NO: 3876 - protein, 9 aa, Mycobacterium tuberculosis
DFKGEAGAD

SEQ ID NO: 3877 - protein, 9 aa, Mycobacterium tuberculosis
FKGEAGADS

SEQ ID NO: 3878 - protein, 9 aa, Mycobacterium tuberculosis
KGEAGADSF

SEQ ID NO: 3879 - protein, 9 aa, Mycobacterium tuberculosis
GEAGADSFR

SEQ ID NO: 3880 - protein, 9 aa, Mycobacterium tuberculosis
EAGADSFRD

SEQ ID NO: 3881 - protein, 9 aa, Mycobacterium tuberculosis
AGADSFRDF

SEQ ID NO: 3882 - protein, 9 aa, Mycobacterium tuberculosis
GADSFRDFP

SEQ ID NO: 3883 - protein, 9 aa, Mycobacterium tuberculosis
ADSFRDFPQ

SEQ ID NO: 3884 - protein, 9 aa, Mycobacterium tuberculosis
DSFRDFPQV

SEQ ID NO: 3885 - protein, 9 aa, Mycobacterium tuberculosis
SFRDFPQVV

SEQ ID NO: 3886 - protein, 9 aa, Mycobacterium tuberculosis
FRDFPQVVA

SEQ ID NO: 3887 - protein, 9 aa, Mycobacterium tuberculosis
RDFPQVVAV

SEQ ID NO: 3888 - protein, 9 aa, Mycobacterium tuberculosis
DFPQVVAVI

SEQ ID NO: 3889 - protein, 9 aa, Mycobacterium tuberculosis
FPQVVAVIS

SEQ ID NO: 3890 - protein, 9 aa, Mycobacterium tuberculosis
PQVVAVISN

SEQ ID NO: 3891 - protein, 9 aa, Mycobacterium tuberculosis
QVVAVISNM

SEQ ID NO: 3892 - protein, 9 aa, Mycobacterium tuberculosis
VVAVISNMA

SEQ ID NO: 3893 - protein, 9 aa, Mycobacterium tuberculosis
VAVISNMAE

SEQ ID NO: 3894 - protein, 9 aa, Mycobacterium tuberculosis
AVISNMAEK

SEQ ID NO: 3895 - protein, 9 aa, Mycobacterium tuberculosis
VISNMAEKK

SEQ ID NO: 3896 - protein, 9 aa, Mycobacterium tuberculosis
ISNMAEKKS

SEQ ID NO: 3897 - protein, 9 aa, Mycobacterium tuberculosis
SNMAEKKSL

SEQ ID NO: 3898 - protein, 9 aa, Mycobacterium tuberculosis
NMAEKKSLA

SEQ ID NO: 3899 - protein, 9 aa, Mycobacterium tuberculosis
MAEKKSLAD

SEQ ID NO: 3900 - protein, 9 aa, Mycobacterium tuberculosis
AEKKSLADR

SEQ ID NO: 3901 - protein, 9 aa, Mycobacterium tuberculosis
EKKSLADRF

SEQ ID NO: 3902 - protein, 9 aa, Mycobacterium tuberculosis
KKSLADRFA

SEQ ID NO: 3903 - protein, 9 aa, Mycobacterium tuberculosis
KSLADRFAD

SEQ ID NO: 3904 - protein, 9 aa, Mycobacterium tuberculosis
SLADRFADT

SEQ ID NO: 3905 - protein, 9 aa, Mycobacterium tuberculosis
LADRFADTL

SEQ ID NO: 3906 - protein, 9 aa, Mycobacterium tuberculosis
ADRFADTLR

SEQ ID NO: 3907 - protein, 9 aa, Mycobacterium tuberculosis
DRFADTLRG

SEQ ID NO: 3908 - protein, 9 aa, Mycobacterium tuberculosis
RFADTLRGE

SEQ ID NO: 3909 - protein, 9 aa, Mycobacterium tuberculosis
FADTLRGEV

SEQ ID NO: 3910 - protein, 9 aa, Mycobacterium tuberculosis
ADTLRGEVA

SEQ ID NO: 3911 - protein, 9 aa, Mycobacterium tuberculosis
DTLRGEVAR

SEQ ID NO: 3912 - protein, 9 aa, Mycobacterium tuberculosis
TLRGEVARR

SEQ ID NO: 3913 - protein, 9 aa, Mycobacterium tuberculosis
LRGEVARRE

SEQ ID NO: 3914 - protein, 9 aa, Mycobacterium tuberculosis
RGEVARREM

SEQ ID NO: 3915 - protein, 9 aa, Mycobacterium tuberculosis
GEVARREML

SEQ ID NO: 3916 - protein, 9 aa, Mycobacterium tuberculosis
EVARREMLL

SEQ ID NO: 3917 - protein, 9 aa, Mycobacterium tuberculosis
VARREMLLR

SEQ ID NO: 3918 - protein, 9 aa, Mycobacterium tuberculosis
ARREMLLRE

SEQ ID NO: 3919 - protein, 9 aa, Mycobacterium tuberculosis
RREMLLREA

SEQ ID NO: 3920 - protein, 9 aa, Mycobacterium tuberculosis
REMLLREAG

SEQ ID NO: 3921 - protein, 9 aa, Mycobacterium tuberculosis
EMLLREAGR

SEQ ID NO: 3922 - protein, 9 aa, Mycobacterium tuberculosis
MLLREAGRK

SEQ ID NO: 3923 - protein, 9 aa, Mycobacterium tuberculosis
LLREAGRKV

SEQ ID NO: 3924 - protein, 9 aa, Mycobacterium tuberculosis
LREAGRKVQ

SEQ ID NO: 3925 - protein, 9 aa, Mycobacterium tuberculosis
REAGRKVQG

SEQ ID NO: 3926 - protein, 9 aa, Mycobacterium tuberculosis
EAGRKVQGS

SEQ ID NO: 3927 - protein, 9 aa, Mycobacterium tuberculosis
AGRKVQGSA

SEQ ID NO: 3928 - protein, 9 aa, Mycobacterium tuberculosis
GRKVQGSAF

SEQ ID NO: 3929 - protein, 9 aa, Mycobacterium tuberculosis
RKVQGSAFN

SEQ ID NO: 3930 - protein, 9 aa, Mycobacterium tuberculosis
KVQGSAFNS

SEQ ID NO: 3931 - protein, 9 aa, Mycobacterium tuberculosis
VQGSAFNSV

SEQ ID NO: 3932 - protein, 9 aa, Mycobacterium tuberculosis
QGSAFNSVL

SEQ ID NO: 3933 - protein, 9 aa, Mycobacterium tuberculosis
GSAFNSVLE

SEQ ID NO: 3934 - protein, 9 aa, Mycobacterium tuberculosis
SAFNSVLEY

SEQ ID NO: 3935 - protein, 9 aa, Mycobacterium tuberculosis
AFNSVLEYE

SEQ ID NO: 3936 - protein, 9 aa, Mycobacterium tuberculosis
FNSVLEYEN

SEQ ID NO: 3937 - protein, 9 aa, Mycobacterium tuberculosis
NSVLEYENA

SEQ ID NO: 3938 - protein, 9 aa, Mycobacterium tuberculosis
SVLEYENAI

SEQ ID NO: 3939 - protein, 9 aa, Mycobacterium tuberculosis
VLEYENAIA

SEQ ID NO: 3940 - protein, 9 aa, Mycobacterium tuberculosis
LEYENAIAA

SEQ ID NO: 3941 - protein, 9 aa, Mycobacterium tuberculosis
EYENAIAAG

SEQ ID NO: 3942 - protein, 9 aa, Mycobacterium tuberculosis
YENAIAAGH

SEQ ID NO: 3943 - protein, 9 aa, Mycobacterium tuberculosis
ENAIAAGHS

SEQ ID NO: 3944 - protein, 9 aa, Mycobacterium tuberculosis
NAIAAGHSL

SEQ ID NO: 3945 - protein, 9 aa, Mycobacterium tuberculosis
AIAAGHSLP

SEQ ID NO: 3946 - protein, 9 aa, Mycobacterium tuberculosis
IAAGHSLPP

SEQ ID NO: 3947 - protein, 9 aa, Mycobacterium tuberculosis
AAGHSLPPI

SEQ ID NO: 3948 - protein, 9 aa, Mycobacterium tuberculosis
AGHSLPPIP

SEQ ID NO: 3949 - protein, 9 aa, Mycobacterium tuberculosis
GHSLPPIPT

SEQ ID NO: 3950 - protein, 9 aa, Mycobacterium tuberculosis
HSLPPIPTL

SEQ ID NO: 3951 - protein, 9 aa, Mycobacterium tuberculosis
SLPPIPTLF

SEQ ID NO: 3952 - protein, 9 aa, Mycobacterium tuberculosis
LPPIPTLFV

SEQ ID NO: 3953 - protein, 9 aa, Mycobacterium tuberculosis
PPIPTLFVV

SEQ ID NO: 3954 - protein, 9 aa, Mycobacterium tuberculosis
PIPTLFVVA

SEQ ID NO: 3955 - protein, 9 aa, Mycobacterium tuberculosis
IPTLFVVAD

SEQ ID NO: 3956 - protein, 9 aa, Mycobacterium tuberculosis
PTLFVVADE

SEQ ID NO: 3957 - protein, 9 aa, Mycobacterium tuberculosis
TLFVVADEF

SEQ ID NO: 3958 - protein, 9 aa, Mycobacterium tuberculosis
LFVVADEFT

SEQ ID NO: 3959 - protein, 9 aa, Mycobacterium tuberculosis
FVVADEFTL

SEQ ID NO: 3960 - protein, 9 aa, Mycobacterium tuberculosis
VVADEFTLM

SEQ ID NO: 3961 - protein, 9 aa, Mycobacterium tuberculosis
VADEFTLML

SEQ ID NO: 3962 - protein, 9 aa, Mycobacterium tuberculosis
ADEFTLMLA

SEQ ID NO: 3963 - protein, 9 aa, Mycobacterium tuberculosis
DEFTLMLAD

SEQ ID NO: 3964 - protein, 9 aa, Mycobacterium tuberculosis
EFTLMLADH

SEQ ID NO: 3965 - protein, 9 aa, Mycobacterium tuberculosis
FTLMLADHP

SEQ ID NO: 3966 - protein, 9 aa, Mycobacterium tuberculosis
TLMLADHPE

SEQ ID NO: 3967 - protein, 9 aa, Mycobacterium tuberculosis
LMLADHPEY

SEQ ID NO: 3968 - protein, 9 aa, Mycobacterium tuberculosis
MLADHPEYA

SEQ ID NO: 3969 - protein, 9 aa, Mycobacterium tuberculosis
LADHPEYAE

SEQ ID NO: 3970 - protein, 9 aa, Mycobacterium tuberculosis
ADHPEYAEL

SEQ ID NO: 3971 - protein, 9 aa, Mycobacterium tuberculosis
DHPEYAELF

SEQ ID NO: 3972 - protein, 9 aa, Mycobacterium tuberculosis
HPEYAELFD

SEQ ID NO: 3973 - protein, 9 aa, Mycobacterium tuberculosis
PEYAELFDY

SEQ ID NO: 3974 - protein, 9 aa, Mycobacterium tuberculosis
EYAELFDYV

SEQ ID NO: 3975 - protein, 9 aa, Mycobacterium tuberculosis
YAELFDYVA

SEQ ID NO: 3976 - protein, 9 aa, Mycobacterium tuberculosis
AELFDYVAR

SEQ ID NO: 3977 - protein, 9 aa, Mycobacterium tuberculosis
ELFDYVARK

SEQ ID NO: 3978 - protein, 9 aa, Mycobacterium tuberculosis
LFDYVARKG

SEQ ID NO: 3979 - protein, 9 aa, Mycobacterium tuberculosis
FDYVARKGR

SEQ ID NO: 3980 - protein, 9 aa, Mycobacterium tuberculosis
DYVARKGRS

SEQ ID NO: 3981 - protein, 9 aa, Mycobacterium tuberculosis
YVARKGRSF

SEQ ID NO: 3982 - protein, 9 aa, Mycobacterium tuberculosis
VARKGRSFR

SEQ ID NO: 3983 - protein, 9 aa, Mycobacterium tuberculosis
ARKGRSFRI

SEQ ID NO: 3984 - protein, 9 aa, Mycobacterium tuberculosis
RKGRSFRIH

SEQ ID NO: 3985 - protein, 9 aa, Mycobacterium tuberculosis
KGRSFRIHI

SEQ ID NO: 3986 - protein, 9 aa, Mycobacterium tuberculosis
GRSFRIHIL

SEQ ID NO: 3987 - protein, 9 aa, Mycobacterium tuberculosis
RSFRIHILF

SEQ ID NO: 3988 - protein, 9 aa, Mycobacterium tuberculosis
SFRIHILFA

SEQ ID NO: 3989 - protein, 9 aa, Mycobacterium tuberculosis
FRIHILFAS

SEQ ID NO: 3990 - protein, 9 aa, Mycobacterium tuberculosis
RIHILFASQ

SEQ ID NO: 3991 - protein, 9 aa, Mycobacterium tuberculosis
IHILFASQT

SEQ ID NO: 3992 - protein, 9 aa, Mycobacterium tuberculosis
HILFASQTL

SEQ ID NO: 3993 - protein, 9 aa, Mycobacterium tuberculosis
ILFASQTLD

SEQ ID NO: 3994 - protein, 9 aa, Mycobacterium tuberculosis
LFASQTLDV

SEQ ID NO: 3995 - protein, 9 aa, Mycobacterium tuberculosis
FASQTLDVG

SEQ ID NO: 3996 - protein, 9 aa, Mycobacterium tuberculosis
ASQTLDVGK

SEQ ID NO: 3997 - protein, 9 aa, Mycobacterium tuberculosis
SQTLDVGKI

SEQ ID NO: 3998 - protein, 9 aa, Mycobacterium tuberculosis
QTLDVGKIK

SEQ ID NO: 3999 - protein, 9 aa, Mycobacterium tuberculosis
TLDVGKIKD

SEQ ID NO: 4000 - protein, 9 aa, Mycobacterium tuberculosis
LDVGKIKDI

SEQ ID NO: 4001 - protein, 9 aa, Mycobacterium tuberculosis
DVGKIKDID

SEQ ID NO: 4002 - protein, 9 aa, Mycobacterium tuberculosis
VGKIKDIDK

SEQ ID NO: 4003 - protein, 9 aa, Mycobacterium tuberculosis
GKIKDIDKN

SEQ ID NO: 4004 - protein, 9 aa, Mycobacterium tuberculosis
KIKDIDKNT

SEQ ID NO: 4005 - protein, 9 aa, Mycobacterium tuberculosis
IKDIDKNTA

SEQ ID NO: 4006 - protein, 9 aa, Mycobacterium tuberculosis
KDIDKNTAY

SEQ ID NO: 4007 - protein, 9 aa, Mycobacterium tuberculosis
DIDKNTAYR

SEQ ID NO: 4008 - protein, 9 aa, Mycobacterium tuberculosis
IDKNTAYRI

SEQ ID NO: 4009 - protein, 9 aa, Mycobacterium tuberculosis
DKNTAYRIG

SEQ ID NO: 4010 - protein, 9 aa, Mycobacterium tuberculosis
KNTAYRIGL

SEQ ID NO: 4011 - protein, 9 aa, Mycobacterium tuberculosis
NTAYRIGLK

SEQ ID NO: 4012 - protein, 9 aa, Mycobacterium tuberculosis
TAYRIGLKV

SEQ ID NO: 4013 - protein, 9 aa, Mycobacterium tuberculosis
AYRIGLKVA

SEQ ID NO: 4014 - protein, 9 aa, Mycobacterium tuberculosis
YRIGLKVAS

SEQ ID NO: 4015 - protein, 9 aa, Mycobacterium tuberculosis
RIGLKVASP

SEQ ID NO: 4016 - protein, 9 aa, Mycobacterium tuberculosis
IGLKVASPS

SEQ ID NO: 4017 - protein, 9 aa, Mycobacterium tuberculosis
GLKVASPSV

SEQ ID NO: 4018 - protein, 9 aa, Mycobacterium tuberculosis
LKVASPSVS

SEQ ID NO: 4019 - protein, 9 aa, Mycobacterium tuberculosis
KVASPSVSR

SEQ ID NO: 4020 - protein, 9 aa, Mycobacterium tuberculosis
VASPSVSRQ

SEQ ID NO: 4021 - protein, 9 aa, Mycobacterium tuberculosis
ASPSVSRQI

SEQ ID NO: 4022 - protein, 9 aa, Mycobacterium tuberculosis
SPSVSRQII

SEQ ID NO: 4023 - protein, 9 aa, Mycobacterium tuberculosis
PSVSRQIIG

SEQ ID NO: 4024 - protein, 9 aa, Mycobacterium tuberculosis
SVSRQIIGV

SEQ ID NO: 4025 - protein, 9 aa, Mycobacterium tuberculosis
VSRQIIGVE

SEQ ID NO: 4026 - protein, 9 aa, Mycobacterium tuberculosis
SRQIIGVED

SEQ ID NO: 4027 - protein, 9 aa, Mycobacterium tuberculosis
RQIIGVEDA

SEQ ID NO: 4028 - protein, 9 aa, Mycobacterium tuberculosis
QIIGVEDAY

SEQ ID NO: 4029 - protein, 9 aa, Mycobacterium tuberculosis
IIGVEDAYH

SEQ ID NO: 4030 - protein, 9 aa, Mycobacterium tuberculosis
IGVEDAYHI

SEQ ID NO: 4031 - protein, 9 aa, Mycobacterium tuberculosis
GVEDAYHIE

SEQ ID NO: 4032 - protein, 9 aa, Mycobacterium tuberculosis
VEDAYHIES

SEQ ID NO: 4033 - protein, 9 aa, Mycobacterium tuberculosis
EDAYHIESG

SEQ ID NO: 4034 - protein, 9 aa, Mycobacterium tuberculosis
DAYHIESGK

SEQ ID NO: 4035 - protein, 9 aa, Mycobacterium tuberculosis
AYHIESGKE

SEQ ID NO: 4036 - protein, 9 aa, Mycobacterium tuberculosis
YHIESGKEH

SEQ ID NO: 4037 - protein, 9 aa, Mycobacterium tuberculosis
HIESGKEHK

SEQ ID NO: 4038 - protein, 9 aa, Mycobacterium tuberculosis
IESGKEHKG

SEQ ID NO: 4039 - protein, 9 aa, Mycobacterium tuberculosis
ESGKEHKGV

SEQ ID NO: 4040 - protein, 9 aa, Mycobacterium tuberculosis
SGKEHKGVG

SEQ ID NO: 4041 - protein, 9 aa, Mycobacterium tuberculosis
GKEHKGVGF

SEQ ID NO: 4042 - protein, 9 aa, Mycobacterium tuberculosis
KEHKGVGFL

SEQ ID NO: 4043 - protein, 9 aa, Mycobacterium tuberculosis
EHKGVGFLV

SEQ ID NO: 4044 - protein, 9 aa, Mycobacterium tuberculosis
HKGVGFLVP

SEQ ID NO: 4045 - protein, 9 aa, Mycobacterium tuberculosis
KGVGFLVPA

SEQ ID NO: 4046 - protein, 9 aa, Mycobacterium tuberculosis
GVGFLVPAP

SEQ ID NO: 4047 - protein, 9 aa, Mycobacterium tuberculosis
VGFLVPAPG

SEQ ID NO: 4048 - protein, 9 aa, Mycobacterium tuberculosis
GFLVPAPGA

SEQ ID NO: 4049 - protein, 9 aa, Mycobacterium tuberculosis
FLVPAPGAT

SEQ ID NO: 4050 - protein, 9 aa, Mycobacterium tuberculosis
LVPAPGATP

SEQ ID NO: 4051 - protein, 9 aa, Mycobacterium tuberculosis
VPAPGATPI

SEQ ID NO: 4052 - protein, 9 aa, Mycobacterium tuberculosis
PAPGATPIR

SEQ ID NO: 4053 - protein, 9 aa, Mycobacterium tuberculosis
APGATPIRF

SEQ ID NO: 4054 - protein, 9 aa, Mycobacterium tuberculosis
PGATPIRFR

SEQ ID NO: 4055 - protein, 9 aa, Mycobacterium tuberculosis
GATPIRFRS

SEQ ID NO: 4056 - protein, 9 aa, Mycobacterium tuberculosis
ATPIRFRST

SEQ ID NO: 4057 - protein, 9 aa, Mycobacterium tuberculosis
TPIRFRSTY

SEQ ID NO: 4058 - protein, 9 aa, Mycobacterium tuberculosis
PIRFRSTYV

SEQ ID NO: 4059 - protein, 9 aa, Mycobacterium tuberculosis
IRFRSTYVD

SEQ ID NO: 4060 - protein, 9 aa, Mycobacterium tuberculosis
RFRSTYVDG

SEQ ID NO: 4061 - protein, 9 aa, Mycobacterium tuberculosis
FRSTYVDGI

SEQ ID NO: 4062 - protein, 9 aa, Mycobacterium tuberculosis
RSTYVDGIY

SEQ ID NO: 4063 - protein, 9 aa, Mycobacterium tuberculosis
STYVDGIYE

SEQ ID NO: 4064 - protein, 9 aa, Mycobacterium tuberculosis
TYVDGIYEP

SEQ ID NO: 4065 - protein, 9 aa, Mycobacterium tuberculosis
YVDGIYEPP

SEQ ID NO: 4066 - protein, 9 aa, Mycobacterium tuberculosis
VDGIYEPPQ

SEQ ID NO: 4067 - protein, 9 aa, Mycobacterium tuberculosis
DGIYEPPQT

SEQ ID NO: 4068 - protein, 9 aa, Mycobacterium tuberculosis
GIYEPPQTA

SEQ ID NO: 4069 - protein, 9 aa, Mycobacterium tuberculosis
IYEPPQTAK

SEQ ID NO: 4070 - protein, 9 aa, Mycobacterium tuberculosis
YEPPQTAKA

SEQ ID NO: 4071 - protein, 9 aa, Mycobacterium tuberculosis
EPPQTAKAV

SEQ ID NO: 4072 - protein, 9 aa, Mycobacterium tuberculosis
PPQTAKAVV

SEQ ID NO: 4073 - protein, 9 aa, Mycobacterium tuberculosis
PQTAKAVVV

SEQ ID NO: 4074 - protein, 9 aa, Mycobacterium tuberculosis
QTAKAVVVQ

SEQ ID NO: 4075 - protein, 9 aa, Mycobacterium tuberculosis
TAKAVVVQS

SEQ ID NO: 4076 - protein, 9 aa, Mycobacterium tuberculosis
AKAVVVQSV

SEQ ID NO: 4077 - protein, 9 aa, Mycobacterium tuberculosis
KAVVVQSVP

SEQ ID NO: 4078 - protein, 9 aa, Mycobacterium tuberculosis
AVVVQSVPE

SEQ ID NO: 4079 - protein, 9 aa, Mycobacterium tuberculosis
VVVQSVPEP

SEQ ID NO: 4080 - protein, 9 aa, Mycobacterium tuberculosis
VVQSVPEPK

SEQ ID NO: 4081 - protein, 9 aa, Mycobacterium tuberculosis
VQSVPEPKL

SEQ ID NO: 4082 - protein, 9 aa, Mycobacterium tuberculosis
QSVPEPKLF

SEQ ID NO: 4083 - protein, 9 aa, Mycobacterium tuberculosis
SVPEPKLFT

SEQ ID NO: 4084 - protein, 9 aa, Mycobacterium tuberculosis
VPEPKLFTA

SEQ ID NO: 4085 - protein, 9 aa, Mycobacterium tuberculosis
PEPKLFTAA

SEQ ID NO: 4086 - protein, 9 aa, Mycobacterium tuberculosis
EPKLFTAAA

SEQ ID NO: 4087 - protein, 9 aa, Mycobacterium tuberculosis
PKLFTAAAV

SEQ ID NO: 4088 - protein, 9 aa, Mycobacterium tuberculosis
KLFTAAAVE

SEQ ID NO: 4089 - protein, 9 aa, Mycobacterium tuberculosis
LFTAAAVEP

SEQ ID NO: 4090 - protein, 9 aa, Mycobacterium tuberculosis
FTAAAVEPD

SEQ ID NO: 4091 - protein, 9 aa, Mycobacterium tuberculosis
TAAAVEPDP

SEQ ID NO: 4092 - protein, 9 aa, Mycobacterium tuberculosis
AAAVEPDPG

SEQ ID NO: 4093 - protein, 9 aa, Mycobacterium tuberculosis
AAVEPDPGT

SEQ ID NO: 4094 - protein, 9 aa, Mycobacterium tuberculosis
AVEPDPGTV

SEQ ID NO: 4095 - protein, 9 aa, Mycobacterium tuberculosis
VEPDPGTVI

SEQ ID NO: 4096 - protein, 9 aa, Mycobacterium tuberculosis
EPDPGTVIA

SEQ ID NO: 4097 - protein, 9 aa, Mycobacterium tuberculosis
PDPGTVIAD

SEQ ID NO: 4098 - protein, 9 aa, Mycobacterium tuberculosis
DPGTVIADT

SEQ ID NO: 4099 - protein, 9 aa, Mycobacterium tuberculosis
PGTVIADTD

SEQ ID NO: 4100 - protein, 9 aa, Mycobacterium tuberculosis
GTVIADTDE

SEQ ID NO: 4101 - protein, 9 aa, Mycobacterium tuberculosis
TVIADTDEQ

SEQ ID NO: 4102 - protein, 9 aa, Mycobacterium tuberculosis
VIADTDEQE

SEQ ID NO: 4103 - protein, 9 aa, Mycobacterium tuberculosis
IADTDEQEP

SEQ ID NO: 4104 - protein, 9 aa, Mycobacterium tuberculosis
ADTDEQEPA

SEQ ID NO: 4105 - protein, 9 aa, Mycobacterium tuberculosis
DTDEQEPAD

SEQ ID NO: 4106 - protein, 9 aa, Mycobacterium tuberculosis
TDEQEPADP

SEQ ID NO: 4107 - protein, 9 aa, Mycobacterium tuberculosis
DEQEPADPP

SEQ ID NO: 4108 - protein, 9 aa, Mycobacterium tuberculosis
EQEPADPPR

SEQ ID NO: 4109 - protein, 9 aa, Mycobacterium tuberculosis
QEPADPPRK

SEQ ID NO: 4110 - protein, 9 aa, Mycobacterium tuberculosis
EPADPPRKL

SEQ ID NO: 4111 - protein, 9 aa, Mycobacterium tuberculosis
PADPPRKLI

SEQ ID NO: 4112 - protein, 9 aa, Mycobacterium tuberculosis
ADPPRKLIA

SEQ ID NO: 4113 - protein, 9 aa, Mycobacterium tuberculosis
DPPRKLIAT

SEQ ID NO: 4114 - protein, 9 aa, Mycobacterium tuberculosis
PPRKLIATI

SEQ ID NO: 4115 - protein, 9 aa, Mycobacterium tuberculosis
PRKLIATIG

SEQ ID NO: 4116 - protein, 9 aa, Mycobacterium tuberculosis
RKLIATIGE

SEQ ID NO: 4117 - protein, 9 aa, Mycobacterium tuberculosis
KLIATIGEQ

SEQ ID NO: 4118 - protein, 9 aa, Mycobacterium tuberculosis
LIATIGEQL

SEQ ID NO: 4119 - protein, 9 aa, Mycobacterium tuberculosis
IATIGEQLA

SEQ ID NO: 4120 - protein, 9 aa, Mycobacterium tuberculosis
ATIGEQLAR

SEQ ID NO: 4121 - protein, 9 aa, Mycobacterium tuberculosis
TIGEQLARY

SEQ ID NO: 4122 - protein, 9 aa, Mycobacterium tuberculosis
IGEQLARYG

SEQ ID NO: 4123 - protein, 9 aa, Mycobacterium tuberculosis
GEQLARYGP

SEQ ID NO: 4124 - protein, 9 aa, Mycobacterium tuberculosis
EQLARYGPR

SEQ ID NO: 4125 - protein, 9 aa, Mycobacterium tuberculosis
QLARYGPRA

SEQ ID NO: 4126 - protein, 9 aa, Mycobacterium tuberculosis
LARYGPRAP

SEQ ID NO: 4127 - protein, 9 aa, Mycobacterium tuberculosis
ARYGPRAPQ

SEQ ID NO: 4128 - protein, 9 aa, Mycobacterium tuberculosis
RYGPRAPQL

SEQ ID NO: 4129 - protein, 9 aa, Mycobacterium tuberculosis
YGPRAPQLW

SEQ ID NO: 4130 - protein, 9 aa, Mycobacterium tuberculosis
GPRAPQLWL

SEQ ID NO: 4131 - protein, 9 aa, Mycobacterium tuberculosis
PRAPQLWLP

SEQ ID NO: 4132 - protein, 9 aa, Mycobacterium tuberculosis
RAPQLWLPP

SEQ ID NO: 4133 - protein, 9 aa, Mycobacterium tuberculosis
APQLWLPPL

SEQ ID NO: 4134 - protein, 9 aa, Mycobacterium tuberculosis
PQLWLPPLD

SEQ ID NO: 4135 - protein, 9 aa, Mycobacterium tuberculosis
QLWLPPLDE

SEQ ID NO: 4136 - protein, 9 aa, Mycobacterium tuberculosis
LWLPPLDET

SEQ ID NO: 4137 - protein, 9 aa, Mycobacterium tuberculosis
WLPPLDETI

SEQ ID NO: 4138 - protein, 9 aa, Mycobacterium tuberculosis
LPPLDETIP

SEQ ID NO: 4139 - protein, 9 aa, Mycobacterium tuberculosis
PPLDETIPL

SEQ ID NO: 4140 - protein, 9 aa, Mycobacterium tuberculosis
PLDETIPLS

SEQ ID NO: 4141 - protein, 9 aa, Mycobacterium tuberculosis
LDETIPLSA

SEQ ID NO: 4142 - protein, 9 aa, Mycobacterium tuberculosis
DETIPLSAA

SEQ ID NO: 4143 - protein, 9 aa, Mycobacterium tuberculosis
ETIPLSAAL

SEQ ID NO: 4144 - protein, 9 aa, Mycobacterium tuberculosis
TIPLSAALA

SEQ ID NO: 4145 - protein, 9 aa, Mycobacterium tuberculosis
IPLSAALAR

SEQ ID NO: 4146 - protein, 9 aa, Mycobacterium tuberculosis
PLSAALARA

SEQ ID NO: 4147 - protein, 9 aa, Mycobacterium tuberculosis
LSAALARAG

SEQ ID NO: 4148 - protein, 9 aa, Mycobacterium tuberculosis
SAALARAGV

SEQ ID NO: 4149 - protein, 9 aa, Mycobacterium tuberculosis
AALARAGVG

SEQ ID NO: 4150 - protein, 9 aa, Mycobacterium tuberculosis
ALARAGVGP

SEQ ID NO: 4151 - protein, 9 aa, Mycobacterium tuberculosis
LARAGVGPR

SEQ ID NO: 4152 - protein, 9 aa, Mycobacterium tuberculosis
ARAGVGPRQ

SEQ ID NO: 4153 - protein, 9 aa, Mycobacterium tuberculosis
RAGVGPRQW

SEQ ID NO: 4154 - protein, 9 aa, Mycobacterium tuberculosis
AGVGPRQWR

SEQ ID NO: 4155 - protein, 9 aa, Mycobacterium tuberculosis
GVGPRQWRW

SEQ ID NO: 4156 - protein, 9 aa, Mycobacterium tuberculosis
VGPRQWRWP

SEQ ID NO: 4157 - protein, 9 aa, Mycobacterium tuberculosis
GPRQWRWPL

SEQ ID NO: 4158 - protein, 9 aa, Mycobacterium tuberculosis
PRQWRWPLG

SEQ ID NO: 4159 - protein, 9 aa, Mycobacterium tuberculosis
RQWRWPLGE

SEQ ID NO: 4160 - protein, 9 aa, Mycobacterium tuberculosis
QWRWPLGEI

SEQ ID NO: 4161 - protein, 9 aa, Mycobacterium tuberculosis
WRWPLGEID

SEQ ID NO: 4162 - protein, 9 aa, Mycobacterium tuberculosis
RWPLGEIDR

SEQ ID NO: 4163 - protein, 9 aa, Mycobacterium tuberculosis
WPLGEIDRP

SEQ ID NO: 4164 - protein, 9 aa, Mycobacterium tuberculosis
PLGEIDRPF

SEQ ID NO: 4165 - protein, 9 aa, Mycobacterium tuberculosis
LGEIDRPFE

SEQ ID NO: 4166 - protein, 9 aa, Mycobacterium tuberculosis
GEIDRPFEM

SEQ ID NO: 4167 - protein, 9 aa, Mycobacterium tuberculosis
EIDRPFEMR

SEQ ID NO: 4168 - protein, 9 aa, Mycobacterium tuberculosis
IDRPFEMRR

SEQ ID NO: 4169 - protein, 9 aa, Mycobacterium tuberculosis
DRPFEMRRD

SEQ ID NO: 4170 - protein, 9 aa, Mycobacterium tuberculosis
RPFEMRRDP

SEQ ID NO: 4171 - protein, 9 aa, Mycobacterium tuberculosis
PFEMRRDPL

SEQ ID NO: 4172 - protein, 9 aa, Mycobacterium tuberculosis
FEMRRDPLV

SEQ ID NO: 4173 - protein, 9 aa, Mycobacterium tuberculosis
EMRRDPLVF

SEQ ID NO: 4174 - protein, 9 aa, Mycobacterium tuberculosis
MRRDPLVFD

SEQ ID NO: 4175 - protein, 9 aa, Mycobacterium tuberculosis
RRDPLVFDA

SEQ ID NO: 4176 - protein, 9 aa, Mycobacterium tuberculosis
RDPLVFDAR

SEQ ID NO: 4177 - protein, 9 aa, Mycobacterium tuberculosis
DPLVFDARS

SEQ ID NO: 4178 - protein, 9 aa, Mycobacterium tuberculosis
PLVFDARSS

SEQ ID NO: 4179 - protein, 9 aa, Mycobacterium tuberculosis
LVFDARSSA

SEQ ID NO: 4180 - protein, 9 aa, Mycobacterium tuberculosis
VFDARSSAG

SEQ ID NO: 4181 - protein, 9 aa, Mycobacterium tuberculosis
FDARSSAGN

SEQ ID NO: 4182 - protein, 9 aa, Mycobacterium tuberculosis
DARSSAGNM

SEQ ID NO: 4183 - protein, 9 aa, Mycobacterium tuberculosis
ARSSAGNMV

SEQ ID NO: 4184 - protein, 9 aa, Mycobacterium tuberculosis
RSSAGNMVI

SEQ ID NO: 4185 - protein, 9 aa, Mycobacterium tuberculosis
SSAGNMVIH

SEQ ID NO: 4186 - protein, 9 aa, Mycobacterium tuberculosis
SAGNMVIHG

SEQ ID NO: 4187 - protein, 9 aa, Mycobacterium tuberculosis
AGNMVIHGG

SEQ ID NO: 4188 - protein, 9 aa, Mycobacterium tuberculosis
GNMVIHGGP

SEQ ID NO: 4189 - protein, 9 aa, Mycobacterium tuberculosis
NMVIHGGPK

SEQ ID NO: 4190 - protein, 9 aa, Mycobacterium tuberculosis
MVIHGGPKS

SEQ ID NO: 4191 - protein, 9 aa, Mycobacterium tuberculosis
VIHGGPKSG

SEQ ID NO: 4192 - protein, 9 aa, Mycobacterium tuberculosis
IHGGPKSGK

SEQ ID NO: 4193 - protein, 9 aa, Mycobacterium tuberculosis
HGGPKSGKS

SEQ ID NO: 4194 - protein, 9 aa, Mycobacterium tuberculosis
GGPKSGKST

SEQ ID NO: 4195 - protein, 9 aa, Mycobacterium tuberculosis
GPKSGKSTA

SEQ ID NO: 4196 - protein, 9 aa, Mycobacterium tuberculosis
PKSGKSTAL

SEQ ID NO: 4197 - protein, 9 aa, Mycobacterium tuberculosis
KSGKSTALQ

SEQ ID NO: 4198 - protein, 9 aa, Mycobacterium tuberculosis
SGKSTALQT

SEQ ID NO: 4199 - protein, 9 aa, Mycobacterium tuberculosis
GKSTALQTF

SEQ ID NO: 4200 - protein, 9 aa, Mycobacterium tuberculosis
KSTALQTFI

SEQ ID NO: 4201 - protein, 9 aa, Mycobacterium tuberculosis
STALQTFIL

SEQ ID NO: 4202 - protein, 9 aa, Mycobacterium tuberculosis
TALQTFILS

SEQ ID NO: 4203 - protein, 9 aa, Mycobacterium tuberculosis
ALQTFILSA

SEQ ID NO: 4204 - protein, 9 aa, Mycobacterium tuberculosis
LQTFILSAA

SEQ ID NO: 4205 - protein, 9 aa, Mycobacterium tuberculosis
QTFILSAAS

SEQ ID NO: 4206 - protein, 9 aa, Mycobacterium tuberculosis
TFILSAASL

SEQ ID NO: 4207 - protein, 9 aa, Mycobacterium tuberculosis
FILSAASLH

SEQ ID NO: 4208 - protein, 9 aa, Mycobacterium tuberculosis
ILSAASLHS

SEQ ID NO: 4209 - protein, 9 aa, Mycobacterium tuberculosis
LSAASLHSP

SEQ ID NO: 4210 - protein, 9 aa, Mycobacterium tuberculosis
SAASLHSPH

SEQ ID NO: 4211 - protein, 9 aa, Mycobacterium tuberculosis
AASLHSPHE

SEQ ID NO: 4212 - protein, 9 aa, Mycobacterium tuberculosis
ASLHSPHEV

SEQ ID NO: 4213 - protein, 9 aa, Mycobacterium tuberculosis
SLHSPHEVS

SEQ ID NO: 4214 - protein, 9 aa, Mycobacterium tuberculosis
LHSPHEVSF

SEQ ID NO: 4215 - protein, 9 aa, Mycobacterium tuberculosis
HSPHEVSFY

SEQ ID NO: 4216 - protein, 9 aa, Mycobacterium tuberculosis
SPHEVSFYC

SEQ ID NO: 4217 - protein, 9 aa, Mycobacterium tuberculosis
PHEVSFYCL

SEQ ID NO: 4218 - protein, 9 aa, Mycobacterium tuberculosis
HEVSFYCLD

SEQ ID NO: 4219 - protein, 9 aa, Mycobacterium tuberculosis
EVSFYCLDY

SEQ ID NO: 4220 - protein, 9 aa, Mycobacterium tuberculosis
VSFYCLDYG

SEQ ID NO: 4221 - protein, 9 aa, Mycobacterium tuberculosis
SFYCLDYGG

SEQ ID NO: 4222 - protein, 9 aa, Mycobacterium tuberculosis
FYCLDYGGG

SEQ ID NO: 4223 - protein, 9 aa, Mycobacterium tuberculosis
YCLDYGGGQ

SEQ ID NO: 4224 - protein, 9 aa, Mycobacterium tuberculosis
CLDYGGGQL

SEQ ID NO: 4225 - protein, 9 aa, Mycobacterium tuberculosis
LDYGGGQLR

SEQ ID NO: 4226 - protein, 9 aa, Mycobacterium tuberculosis
DYGGGQLRA

SEQ ID NO: 4227 - protein, 9 aa, Mycobacterium tuberculosis
YGGGQLRAL

SEQ ID NO: 4228 - protein, 9 aa, Mycobacterium tuberculosis
GGGQLRALQ

SEQ ID NO: 4229 - protein, 9 aa, Mycobacterium tuberculosis
GGQLRALQD

SEQ ID NO: 4230 - protein, 9 aa, Mycobacterium tuberculosis
GQLRALQDL

SEQ ID NO: 4231 - protein, 9 aa, Mycobacterium tuberculosis
QLRALQDLA

SEQ ID NO: 4232 - protein, 9 aa, Mycobacterium tuberculosis
LRALQDLAH

SEQ ID NO: 4233 - protein, 9 aa, Mycobacterium tuberculosis
RALQDLAHV

SEQ ID NO: 4234 - protein, 9 aa, Mycobacterium tuberculosis
ALQDLAHVG

SEQ ID NO: 4235 - protein, 9 aa, Mycobacterium tuberculosis
LQDLAHVGS

SEQ ID NO: 4236 - protein, 9 aa, Mycobacterium tuberculosis
QDLAHVGSV

SEQ ID NO: 4237 - protein, 9 aa, Mycobacterium tuberculosis
DLAHVGSVA

SEQ ID NO: 4238 - protein, 9 aa, Mycobacterium tuberculosis
LAHVGSVAS

SEQ ID NO: 4239 - protein, 9 aa, Mycobacterium tuberculosis
AHVGSVASA

SEQ ID NO: 4240 - protein, 9 aa, Mycobacterium tuberculosis
HVGSVASAL

SEQ ID NO: 4241 - protein, 9 aa, Mycobacterium tuberculosis
VGSVASALE

SEQ ID NO: 4242 - protein, 9 aa, Mycobacterium tuberculosis
GSVASALEP

SEQ ID NO: 4243 - protein, 9 aa, Mycobacterium tuberculosis
SVASALEPE

SEQ ID NO: 4244 - protein, 9 aa, Mycobacterium tuberculosis
VASALEPER

SEQ ID NO: 4245 - protein, 9 aa, Mycobacterium tuberculosis
ASALEPERI

SEQ ID NO: 4246 - protein, 9 aa, Mycobacterium tuberculosis
SALEPERIR

SEQ ID NO: 4247 - protein, 9 aa, Mycobacterium tuberculosis
ALEPERIRR

SEQ ID NO: 4248 - protein, 9 aa, Mycobacterium tuberculosis
LEPERIRRT

SEQ ID NO: 4249 - protein, 9 aa, Mycobacterium tuberculosis
EPERIRRTF

SEQ ID NO: 4250 - protein, 9 aa, Mycobacterium tuberculosis
PERIRRTFG

SEQ ID NO: 4251 - protein, 9 aa, Mycobacterium tuberculosis
ERIRRTFGE

SEQ ID NO: 4252 - protein, 9 aa, Mycobacterium tuberculosis
RIRRTFGEL

SEQ ID NO: 4253 - protein, 9 aa, Mycobacterium tuberculosis
IRRTFGELE

SEQ ID NO: 4254 - protein, 9 aa, Mycobacterium tuberculosis
RRTFGELEQ

SEQ ID NO: 4255 - protein, 9 aa, Mycobacterium tuberculosis
RTFGELEQL

SEQ ID NO: 4256 - protein, 9 aa, Mycobacterium tuberculosis
TFGELEQLL

SEQ ID NO: 4257 - protein, 9 aa, Mycobacterium tuberculosis
FGELEQLLL

SEQ ID NO: 4258 - protein, 9 aa, Mycobacterium tuberculosis
GELEQLLLS

SEQ ID NO: 4259 - protein, 9 aa, Mycobacterium tuberculosis
ELEQLLLSR

SEQ ID NO: 4260 - protein, 9 aa, Mycobacterium tuberculosis
LEQLLLSRQ

SEQ ID NO: 4261 - protein, 9 aa, Mycobacterium tuberculosis
EQLLLSRQQ

SEQ ID NO: 4262 - protein, 9 aa, Mycobacterium tuberculosis
QLLLSRQQR

SEQ ID NO: 4263 - protein, 9 aa, Mycobacterium tuberculosis
LLLSRQQRE

SEQ ID NO: 4264 - protein, 9 aa, Mycobacterium tuberculosis
LLSRQQREV

SEQ ID NO: 4265 - protein, 9 aa, Mycobacterium tuberculosis
LSRQQREVF

SEQ ID NO: 4266 - protein, 9 aa, Mycobacterium tuberculosis
SRQQREVFR

SEQ ID NO: 4267 - protein, 9 aa, Mycobacterium tuberculosis
RQQREVFRD

SEQ ID NO: 4268 - protein, 9 aa, Mycobacterium tuberculosis
QQREVFRDR

SEQ ID NO: 4269 - protein, 9 aa, Mycobacterium tuberculosis
QREVFRDRG

SEQ ID NO: 4270 - protein, 9 aa, Mycobacterium tuberculosis
REVFRDRGA

SEQ ID NO: 4271 - protein, 9 aa, Mycobacterium tuberculosis
EVFRDRGAN

SEQ ID NO: 4272 - protein, 9 aa, Mycobacterium tuberculosis
VFRDRGANG

SEQ ID NO: 4273 - protein, 9 aa, Mycobacterium tuberculosis
FRDRGANGS

SEQ ID NO: 4274 - protein, 9 aa, Mycobacterium tuberculosis
RDRGANGST

SEQ ID NO: 4275 - protein, 9 aa, Mycobacterium tuberculosis
DRGANGSTP

SEQ ID NO: 4276 - protein, 9 aa, Mycobacterium tuberculosis
RGANGSTPD

SEQ ID NO: 4277 - protein, 9 aa, Mycobacterium tuberculosis
GANGSTPDD

SEQ ID NO: 4278 - protein, 9 aa, Mycobacterium tuberculosis
ANGSTPDDG

SEQ ID NO: 4279 - protein, 9 aa, Mycobacterium tuberculosis
NGSTPDDGF

SEQ ID NO: 4280 - protein, 9 aa, Mycobacterium tuberculosis
GSTPDDGFG

SEQ ID NO: 4281 - protein, 9 aa, Mycobacterium tuberculosis
STPDDGFGE

SEQ ID NO: 4282 - protein, 9 aa, Mycobacterium tuberculosis
TPDDGFGEV

SEQ ID NO: 4283 - protein, 9 aa, Mycobacterium tuberculosis
PDDGFGEVF

SEQ ID NO: 4284 - protein, 9 aa, Mycobacterium tuberculosis
DDGFGEVFL

SEQ ID NO: 4285 - protein, 9 aa, Mycobacterium tuberculosis
DGFGEVFLV

SEQ ID NO: 4286 - protein, 9 aa, Mycobacterium tuberculosis
GFGEVFLVI

SEQ ID NO: 4287 - protein, 9 aa, Mycobacterium tuberculosis
FGEVFLVID

SEQ ID NO: 4288 - protein, 9 aa, Mycobacterium tuberculosis
GEVFLVIDN

SEQ ID NO: 4289 - protein, 9 aa, Mycobacterium tuberculosis
EVFLVIDNL

SEQ ID NO: 4290 - protein, 9 aa, Mycobacterium tuberculosis
VFLVIDNLY

SEQ ID NO: 4291 - protein, 9 aa, Mycobacterium tuberculosis
FLVIDNLYG

SEQ ID NO: 4292 - protein, 9 aa, Mycobacterium tuberculosis
LVIDNLYGF

SEQ ID NO: 4293 - protein, 9 aa, Mycobacterium tuberculosis
VIDNLYGFG

SEQ ID NO: 4294 - protein, 9 aa, Mycobacterium tuberculosis
IDNLYGFGR

SEQ ID NO: 4295 - protein, 9 aa, Mycobacterium tuberculosis
DNLYGFGRD

SEQ ID NO: 4296 - protein, 9 aa, Mycobacterium tuberculosis
NLYGFGRDN

SEQ ID NO: 4297 - protein, 9 aa, Mycobacterium tuberculosis
LYGFGRDNT

SEQ ID NO: 4298 - protein, 9 aa, Mycobacterium tuberculosis
YGFGRDNTD

SEQ ID NO: 4299 - protein, 9 aa, Mycobacterium tuberculosis
GFGRDNTDQ

SEQ ID NO: 4300 - protein, 9 aa, Mycobacterium tuberculosis
FGRDNTDQF

SEQ ID NO: 4301 - protein, 9 aa, Mycobacterium tuberculosis
GRDNTDQFN

SEQ ID NO: 4302 - protein, 9 aa, Mycobacterium tuberculosis
RDNTDQFNT

SEQ ID NO: 4303 - protein, 9 aa, Mycobacterium tuberculosis
DNTDQFNTR

SEQ ID NO: 4304 - protein, 9 aa, Mycobacterium tuberculosis
NTDQFNTRN

SEQ ID NO: 4305 - protein, 9 aa, Mycobacterium tuberculosis
TDQFNTRNP

SEQ ID NO: 4306 - protein, 9 aa, Mycobacterium tuberculosis
DQFNTRNPL

SEQ ID NO: 4307 - protein, 9 aa, Mycobacterium tuberculosis
QFNTRNPLL

SEQ ID NO: 4308 - protein, 9 aa, Mycobacterium tuberculosis
FNTRNPLLA

SEQ ID NO: 4309 - protein, 9 aa, Mycobacterium tuberculosis
NTRNPLLAR

SEQ ID NO: 4310 - protein, 9 aa, Mycobacterium tuberculosis
TRNPLLARV

SEQ ID NO: 4311 - protein, 9 aa, Mycobacterium tuberculosis
RNPLLARVT

SEQ ID NO: 4312 - protein, 9 aa, Mycobacterium tuberculosis
NPLLARVTE

SEQ ID NO: 4313 - protein, 9 aa, Mycobacterium tuberculosis
PLLARVTEL

SEQ ID NO: 4314 - protein, 9 aa, Mycobacterium tuberculosis
LLARVTELV

SEQ ID NO: 4315 - protein, 9 aa, Mycobacterium tuberculosis
LARVTELVN

SEQ ID NO: 4316 - protein, 9 aa, Mycobacterium tuberculosis
ARVTELVNV

SEQ ID NO: 4317 - protein, 9 aa, Mycobacterium tuberculosis
RVTELVNVG

SEQ ID NO: 4318 - protein, 9 aa, Mycobacterium tuberculosis
VTELVNVGL

SEQ ID NO: 4319 - protein, 9 aa, Mycobacterium tuberculosis
TELVNVGLA

SEQ ID NO: 4320 - protein, 9 aa, Mycobacterium tuberculosis
ELVNVGLAY

SEQ ID NO: 4321 - protein, 9 aa, Mycobacterium tuberculosis
LVNVGLAYG

SEQ ID NO: 4322 - protein, 9 aa, Mycobacterium tuberculosis
VNVGLAYGI

SEQ ID NO: 4323 - protein, 9 aa, Mycobacterium tuberculosis
NVGLAYGIH

SEQ ID NO: 4324 - protein, 9 aa, Mycobacterium tuberculosis
VGLAYGIHV

SEQ ID NO: 4325 - protein, 9 aa, Mycobacterium tuberculosis
GLAYGIHVI

SEQ ID NO: 4326 - protein, 9 aa, Mycobacterium tuberculosis
LAYGIHVII

SEQ ID NO: 4327 - protein, 9 aa, Mycobacterium tuberculosis
AYGIHVIIT

SEQ ID NO: 4328 - protein, 9 aa, Mycobacterium tuberculosis
YGIHVIITT

SEQ ID NO: 4329 - protein, 9 aa, Mycobacterium tuberculosis
GIHVIITTP

SEQ ID NO: 4330 - protein, 9 aa, Mycobacterium tuberculosis
IHVIITTPS

SEQ ID NO: 4331 - protein, 9 aa, Mycobacterium tuberculosis
HVIITTPSW

SEQ ID NO: 4332 - protein, 9 aa, Mycobacterium tuberculosis
VIITTPSWL

SEQ ID NO: 4333 - protein, 9 aa, Mycobacterium tuberculosis
IITTPSWLE

SEQ ID NO: 4334 - protein, 9 aa, Mycobacterium tuberculosis
ITTPSWLEV

SEQ ID NO: 4335 - protein, 9 aa, Mycobacterium tuberculosis
TTPSWLEVP

SEQ ID NO: 4336 - protein, 9 aa, Mycobacterium tuberculosis
TPSWLEVPL

SEQ ID NO: 4337 - protein, 9 aa, Mycobacterium tuberculosis
PSWLEVPLA

SEQ ID NO: 4338 - protein, 9 aa, Mycobacterium tuberculosis
SWLEVPLAM

SEQ ID NO: 4339 - protein, 9 aa, Mycobacterium tuberculosis
WLEVPLAMR

SEQ ID NO: 4340 - protein, 9 aa, Mycobacterium tuberculosis
LEVPLAMRD

SEQ ID NO: 4341 - protein, 9 aa, Mycobacterium tuberculosis
EVPLAMRDG

SEQ ID NO: 4342 - protein, 9 aa, Mycobacterium tuberculosis
VPLAMRDGL

SEQ ID NO: 4343 - protein, 9 aa, Mycobacterium tuberculosis
PLAMRDGLG

SEQ ID NO: 4344 - protein, 9 aa, Mycobacterium tuberculosis
LAMRDGLGL

SEQ ID NO: 4345 - protein, 9 aa, Mycobacterium tuberculosis
AMRDGLGLR

SEQ ID NO: 4346 - protein, 9 aa, Mycobacterium tuberculosis
MRDGLGLRL

SEQ ID NO: 4347 - protein, 9 aa, Mycobacterium tuberculosis
RDGLGLRLE

SEQ ID NO: 4348 - protein, 9 aa, Mycobacterium tuberculosis
DGLGLRLEL

SEQ ID NO: 4349 - protein, 9 aa, Mycobacterium tuberculosis
GLGLRLELR

SEQ ID NO: 4350 - protein, 9 aa, Mycobacterium tuberculosis
LGLRLELRL

SEQ ID NO: 4351 - protein, 9 aa, Mycobacterium tuberculosis
GLRLELRLH

SEQ ID NO: 4352 - protein, 9 aa, Mycobacterium tuberculosis
LRLELRLHD

SEQ ID NO: 4353 - protein, 9 aa, Mycobacterium tuberculosis
RLELRLHDA

SEQ ID NO: 4354 - protein, 9 aa, Mycobacterium tuberculosis
LELRLHDAR

SEQ ID NO: 4355 - protein, 9 aa, Mycobacterium tuberculosis
ELRLHDARD

SEQ ID NO: 4356 - protein, 9 aa, Mycobacterium tuberculosis
LRLHDARDS

SEQ ID NO: 4357 - protein, 9 aa, Mycobacterium tuberculosis
RLHDARDSN

SEQ ID NO: 4358 - protein, 9 aa, Mycobacterium tuberculosis
LHDARDSNV

SEQ ID NO: 4359 - protein, 9 aa, Mycobacterium tuberculosis
HDARDSNVR

SEQ ID NO: 4360 - protein, 9 aa, Mycobacterium tuberculosis
DARDSNVRV

SEQ ID NO: 4361 - protein, 9 aa, Mycobacterium tuberculosis
ARDSNVRVV

SEQ ID NO: 4362 - protein, 9 aa, Mycobacterium tuberculosis
RDSNVRVVG

SEQ ID NO: 4363 - protein, 9 aa, Mycobacterium tuberculosis
DSNVRVVGA

SEQ ID NO: 4364 - protein, 9 aa, Mycobacterium tuberculosis
SNVRVVGAL

SEQ ID NO: 4365 - protein, 9 aa, Mycobacterium tuberculosis
NVRVVGALR

SEQ ID NO: 4366 - protein, 9 aa, Mycobacterium tuberculosis
VRVVGALRR

SEQ ID NO: 4367 - protein, 9 aa, Mycobacterium tuberculosis
RVVGALRRP

SEQ ID NO: 4368 - protein, 9 aa, Mycobacterium tuberculosis
VVGALRRPA

SEQ ID NO: 4369 - protein, 9 aa, Mycobacterium tuberculosis
VGALRRPAD

SEQ ID NO: 4370 - protein, 9 aa, Mycobacterium tuberculosis
GALRRPADA

SEQ ID NO: 4371 - protein, 9 aa, Mycobacterium tuberculosis
ALRRPADAV

SEQ ID NO: 4372 - protein, 9 aa, Mycobacterium tuberculosis
LRRPADAVP

SEQ ID NO: 4373 - protein, 9 aa, Mycobacterium tuberculosis
RRPADAVPH

SEQ ID NO: 4374 - protein, 9 aa, Mycobacterium tuberculosis
RPADAVPHD

SEQ ID NO: 4375 - protein, 9 aa, Mycobacterium tuberculosis
PADAVPHDQ

SEQ ID NO: 4376 - protein, 9 aa, Mycobacterium tuberculosis
ADAVPHDQP

SEQ ID NO: 4377 - protein, 9 aa, Mycobacterium tuberculosis
DAVPHDQPG

SEQ ID NO: 4378 - protein, 9 aa, Mycobacterium tuberculosis
AVPHDQPGR

SEQ ID NO: 4379 - protein, 9 aa, Mycobacterium tuberculosis
VPHDQPGRG

SEQ ID NO: 4380 - protein, 9 aa, Mycobacterium tuberculosis
PHDQPGRGL

SEQ ID NO: 4381 - protein, 9 aa, Mycobacterium tuberculosis
HDQPGRGLT

SEQ ID NO: 4382 - protein, 9 aa, Mycobacterium tuberculosis
DQPGRGLTM

SEQ ID NO: 4383 - protein, 9 aa, Mycobacterium tuberculosis
QPGRGLTMA

SEQ ID NO: 4384 - protein, 9 aa, Mycobacterium tuberculosis
PGRGLTMAA

SEQ ID NO: 4385 - protein, 9 aa, Mycobacterium tuberculosis
GRGLTMAAE

SEQ ID NO: 4386 - protein, 9 aa, Mycobacterium tuberculosis
RGLTMAAEH

SEQ ID NO: 4387 - protein, 9 aa, Mycobacterium tuberculosis
GLTMAAEHF

SEQ ID NO: 4388 - protein, 9 aa, Mycobacterium tuberculosis
LTMAAEHFL

SEQ ID NO: 4389 - protein, 9 aa, Mycobacterium tuberculosis
TMAAEHFLF

SEQ ID NO: 4390 - protein, 9 aa, Mycobacterium tuberculosis
MAAEHFLFA

SEQ ID NO: 4391 - protein, 9 aa, Mycobacterium tuberculosis
AAEHFLFAA

SEQ ID NO: 4392 - protein, 9 aa, Mycobacterium tuberculosis
AEHFLFAAP

SEQ ID NO: 4393 - protein, 9 aa, Mycobacterium tuberculosis
EHFLFAAPE

SEQ ID NO: 4394 - protein, 9 aa, Mycobacterium tuberculosis
HFLFAAPEL

SEQ ID NO: 4395 - protein, 9 aa, Mycobacterium tuberculosis
FLFAAPELD

SEQ ID NO: 4396 - protein, 9 aa, Mycobacterium tuberculosis
LFAAPELDA

SEQ ID NO: 4397 - protein, 9 aa, Mycobacterium tuberculosis
FAAPELDAQ

SEQ ID NO: 4398 - protein, 9 aa, Mycobacterium tuberculosis
AAPELDAQT

SEQ ID NO: 4399 - protein, 9 aa, Mycobacterium tuberculosis
APELDAQTN

SEQ ID NO: 4400 - protein, 9 aa, Mycobacterium tuberculosis
PELDAQTNP

SEQ ID NO: 4401 - protein, 9 aa, Mycobacterium tuberculosis
ELDAQTNPV

SEQ ID NO: 4402 - protein, 9 aa, Mycobacterium tuberculosis
LDAQTNPVA

SEQ ID NO: 4403 - protein, 9 aa, Mycobacterium tuberculosis
DAQTNPVAA

SEQ ID NO: 4404 - protein, 9 aa, Mycobacterium tuberculosis
AQTNPVAAI

SEQ ID NO: 4405 - protein, 9 aa, Mycobacterium tuberculosis
QTNPVAAIN

SEQ ID NO: 4406 - protein, 9 aa, Mycobacterium tuberculosis
TNPVAAINA

SEQ ID NO: 4407 - protein, 9 aa, Mycobacterium tuberculosis
NPVAAINAR

SEQ ID NO: 4408 - protein, 9 aa, Mycobacterium tuberculosis
PVAAINARY

SEQ ID NO: 4409 - protein, 9 aa, Mycobacterium tuberculosis
VAAINARYP

SEQ ID NO: 4410 - protein, 9 aa, Mycobacterium tuberculosis
AAINARYPG

SEQ ID NO: 4411 - protein, 9 aa, Mycobacterium tuberculosis
AINARYPGM

SEQ ID NO: 4412 - protein, 9 aa, Mycobacterium tuberculosis
INARYPGMA

SEQ ID NO: 4413 - protein, 9 aa, Mycobacterium tuberculosis
NARYPGMAA

SEQ ID NO: 4414 - protein, 9 aa, Mycobacterium tuberculosis
ARYPGMAAP

SEQ ID NO: 4415 - protein, 9 aa, Mycobacterium tuberculosis
RYPGMAAPP

SEQ ID NO: 4416 - protein, 9 aa, Mycobacterium tuberculosis
YPGMAAPPV

SEQ ID NO: 4417 - protein, 9 aa, Mycobacterium tuberculosis
PGMAAPPVR

SEQ ID NO: 4418 - protein, 9 aa, Mycobacterium tuberculosis
GMAAPPVRL

SEQ ID NO: 4419 - protein, 9 aa, Mycobacterium tuberculosis
MAAPPVRLL

SEQ ID NO: 4420 - protein, 9 aa, Mycobacterium tuberculosis
AAPPVRLLP

SEQ ID NO: 4421 - protein, 9 aa, Mycobacterium tuberculosis
APPVRLLPT

SEQ ID NO: 4422 - protein, 9 aa, Mycobacterium tuberculosis
PPVRLLPTN

SEQ ID NO: 4423 - protein, 9 aa, Mycobacterium tuberculosis
PVRLLPTNL

SEQ ID NO: 4424 - protein, 9 aa, Mycobacterium tuberculosis
VRLLPTNLA

SEQ ID NO: 4425 - protein, 9 aa, Mycobacterium tuberculosis
RLLPTNLAP

SEQ ID NO: 4426 - protein, 9 aa, Mycobacterium tuberculosis
LLPTNLAPH

SEQ ID NO: 4427 - protein, 9 aa, Mycobacterium tuberculosis
LPTNLAPHA

SEQ ID NO: 4428 - protein, 9 aa, Mycobacterium tuberculosis
PTNLAPHAV

SEQ ID NO: 4429 - protein, 9 aa, Mycobacterium tuberculosis
TNLAPHAVG

SEQ ID NO: 4430 - protein, 9 aa, Mycobacterium tuberculosis
NLAPHAVGE

SEQ ID NO: 4431 - protein, 9 aa, Mycobacterium tuberculosis
LAPHAVGEL

SEQ ID NO: 4432 - protein, 9 aa, Mycobacterium tuberculosis
APHAVGELY

SEQ ID NO: 4433 - protein, 9 aa, Mycobacterium tuberculosis
PHAVGELYR

SEQ ID NO: 4434 - protein, 9 aa, Mycobacterium tuberculosis
HAVGELYRG

SEQ ID NO: 4435 - protein, 9 aa, Mycobacterium tuberculosis
AVGELYRGP

SEQ ID NO: 4436 - protein, 9 aa, Mycobacterium tuberculosis
VGELYRGPD

SEQ ID NO: 4437 - protein, 9 aa, Mycobacterium tuberculosis
GELYRGPDQ

SEQ ID NO: 4438 - protein, 9 aa, Mycobacterium tuberculosis
ELYRGPDQL

SEQ ID NO: 4439 - protein, 9 aa, Mycobacterium tuberculosis
LYRGPDQLV

SEQ ID NO: 4440 - protein, 9 aa, Mycobacterium tuberculosis
YRGPDQLVI

SEQ ID NO: 4441 - protein, 9 aa, Mycobacterium tuberculosis
RGPDQLVIG

SEQ ID NO: 4442 - protein, 9 aa, Mycobacterium tuberculosis
GPDQLVIGQ

SEQ ID NO: 4443 - protein, 9 aa, Mycobacterium tuberculosis
PDQLVIGQR

SEQ ID NO: 4444 - protein, 9 aa, Mycobacterium tuberculosis
DQLVIGQRE

SEQ ID NO: 4445 - protein, 9 aa, Mycobacterium tuberculosis
QLVIGQREE

SEQ ID NO: 4446 - protein, 9 aa, Mycobacterium tuberculosis
LVIGQREED

SEQ ID NO: 4447 - protein, 9 aa, Mycobacterium tuberculosis
VIGQREEDL

SEQ ID NO: 4448 - protein, 9 aa, Mycobacterium tuberculosis
IGQREEDLA

SEQ ID NO: 4449 - protein, 9 aa, Mycobacterium tuberculosis
GQREEDLAP

SEQ ID NO: 4450 - protein, 9 aa, Mycobacterium tuberculosis
QREEDLAPV

SEQ ID NO: 4451 - protein, 9 aa, Mycobacterium tuberculosis
REEDLAPVI

SEQ ID NO: 4452 - protein, 9 aa, Mycobacterium tuberculosis
EEDLAPVIL

SEQ ID NO: 4453 - protein, 9 aa, Mycobacterium tuberculosis
EDLAPVILD

SEQ ID NO: 4454 - protein, 9 aa, Mycobacterium tuberculosis
DLAPVILDL

SEQ ID NO: 4455 - protein, 9 aa, Mycobacterium tuberculosis
LAPVILDLA

SEQ ID NO: 4456 - protein, 9 aa, Mycobacterium tuberculosis
APVILDLAA

SEQ ID NO: 4457 - protein, 9 aa, Mycobacterium tuberculosis
PVILDLAAN

SEQ ID NO: 4458 - protein, 9 aa, Mycobacterium tuberculosis
VILDLAANP

SEQ ID NO: 4459 - protein, 9 aa, Mycobacterium tuberculosis
ILDLAANPL

SEQ ID NO: 4460 - protein, 9 aa, Mycobacterium tuberculosis
LDLAANPLL

SEQ ID NO: 4461 - protein, 9 aa, Mycobacterium tuberculosis
DLAANPLLM

SEQ ID NO: 4462 - protein, 9 aa, Mycobacterium tuberculosis
LAANPLLMV

SEQ ID NO: 4463 - protein, 9 aa, Mycobacterium tuberculosis
AANPLLMVF

SEQ ID NO: 4464 - protein, 9 aa, Mycobacterium tuberculosis
ANPLLMVFG

SEQ ID NO: 4465 - protein, 9 aa, Mycobacterium tuberculosis
NPLLMVFGD

SEQ ID NO: 4466 - protein, 9 aa, Mycobacterium tuberculosis
PLLMVFGDA

SEQ ID NO: 4467 - protein, 9 aa, Mycobacterium tuberculosis
LLMVFGDAR

SEQ ID NO: 4468 - protein, 9 aa, Mycobacterium tuberculosis
LMVFGDARS

SEQ ID NO: 4469 - protein, 9 aa, Mycobacterium tuberculosis
MVFGDARSG

SEQ ID NO: 4470 - protein, 9 aa, Mycobacterium tuberculosis
VFGDARSGK

SEQ ID NO: 4471 - protein, 9 aa, Mycobacterium tuberculosis
FGDARSGKT

SEQ ID NO: 4472 - protein, 9 aa, Mycobacterium tuberculosis
GDARSGKTT

SEQ ID NO: 4473 - protein, 9 aa, Mycobacterium tuberculosis
DARSGKTTL

SEQ ID NO: 4474 - protein, 9 aa, Mycobacterium tuberculosis
ARSGKTTLL

SEQ ID NO: 4475 - protein, 9 aa, Mycobacterium tuberculosis
RSGKTTLLR

SEQ ID NO: 4476 - protein, 9 aa, Mycobacterium tuberculosis
SGKTTLLRH

SEQ ID NO: 4477 - protein, 9 aa, Mycobacterium tuberculosis
GKTTLLRHI

SEQ ID NO: 4478 - protein, 9 aa, Mycobacterium tuberculosis
KTTLLRHII

SEQ ID NO: 4479 - protein, 9 aa, Mycobacterium tuberculosis
TTLLRHIIR

SEQ ID NO: 4480 - protein, 9 aa, Mycobacterium tuberculosis
TLLRHIIRT

SEQ ID NO: 4481 - protein, 9 aa, Mycobacterium tuberculosis
LLRHIIRTV

SEQ ID NO: 4482 - protein, 9 aa, Mycobacterium tuberculosis
LRHIIRTVR

SEQ ID NO: 4483 - protein, 9 aa, Mycobacterium tuberculosis
RHIIRTVRE

SEQ ID NO: 4484 - protein, 9 aa, Mycobacterium tuberculosis
HIIRTVREH

SEQ ID NO: 4485 - protein, 9 aa, Mycobacterium tuberculosis
IIRTVREHS

SEQ ID NO: 4486 - protein, 9 aa, Mycobacterium tuberculosis
IRTVREHST

SEQ ID NO: 4487 - protein, 9 aa, Mycobacterium tuberculosis
RTVREHSTA

SEQ ID NO: 4488 - protein, 9 aa, Mycobacterium tuberculosis
TVREHSTAD

SEQ ID NO: 4489 - protein, 9 aa, Mycobacterium tuberculosis
VREHSTADR

SEQ ID NO: 4490 - protein, 9 aa, Mycobacterium tuberculosis
REHSTADRV

SEQ ID NO: 4491 - protein, 9 aa, Mycobacterium tuberculosis
EHSTADRVA

SEQ ID NO: 4492 - protein, 9 aa, Mycobacterium tuberculosis
HSTADRVAF

SEQ ID NO: 4493 - protein, 9 aa, Mycobacterium tuberculosis
STADRVAFT

SEQ ID NO: 4494 - protein, 9 aa, Mycobacterium tuberculosis
TADRVAFTV

SEQ ID NO: 4495 - protein, 9 aa, Mycobacterium tuberculosis
ADRVAFTVL

SEQ ID NO: 4496 - protein, 9 aa, Mycobacterium tuberculosis
DRVAFTVLD

SEQ ID NO: 4497 - protein, 9 aa, Mycobacterium tuberculosis
RVAFTVLDR

SEQ ID NO: 4498 - protein, 9 aa, Mycobacterium tuberculosis
VAFTVLDRR

SEQ ID NO: 4499 - protein, 9 aa, Mycobacterium tuberculosis
AFTVLDRRL

SEQ ID NO: 4500 - protein, 9 aa, Mycobacterium tuberculosis
FTVLDRRLH

SEQ ID NO: 4501 - protein, 9 aa, Mycobacterium tuberculosis
TVLDRRLHL

SEQ ID NO: 4502 - protein, 9 aa, Mycobacterium tuberculosis
VLDRRLHLV

SEQ ID NO: 4503 - protein, 9 aa, Mycobacterium tuberculosis
LDRRLHLVD

SEQ ID NO: 4504 - protein, 9 aa, Mycobacterium tuberculosis
DRRLHLVDE

SEQ ID NO: 4505 - protein, 9 aa, Mycobacterium tuberculosis
RRLHLVDEP

SEQ ID NO: 4506 - protein, 9 aa, Mycobacterium tuberculosis
RLHLVDEPL

SEQ ID NO: 4507 - protein, 9 aa, Mycobacterium tuberculosis
LHLVDEPLF

SEQ ID NO: 4508 - protein, 9 aa, Mycobacterium tuberculosis
HLVDEPLFP

SEQ ID NO: 4509 - protein, 9 aa, Mycobacterium tuberculosis
LVDEPLFPD

SEQ ID NO: 4510 - protein, 9 aa, Mycobacterium tuberculosis
VDEPLFPDN

SEQ ID NO: 4511 - protein, 9 aa, Mycobacterium tuberculosis
DEPLFPDNE

SEQ ID NO: 4512 - protein, 9 aa, Mycobacterium tuberculosis
EPLFPDNEY

SEQ ID NO: 4513 - protein, 9 aa, Mycobacterium tuberculosis
PLFPDNEYT

SEQ ID NO: 4514 - protein, 9 aa, Mycobacterium tuberculosis
LFPDNEYTA

SEQ ID NO: 4515 - protein, 9 aa, Mycobacterium tuberculosis
FPDNEYTAN

SEQ ID NO: 4516 - protein, 9 aa, Mycobacterium tuberculosis
PDNEYTANI

SEQ ID NO: 4517 - protein, 9 aa, Mycobacterium tuberculosis
DNEYTANID

SEQ ID NO: 4518 - protein, 9 aa, Mycobacterium tuberculosis
NEYTANIDR

SEQ ID NO: 4519 - protein, 9 aa, Mycobacterium tuberculosis
EYTANIDRI

SEQ ID NO: 4520 - protein, 9 aa, Mycobacterium tuberculosis
YTANIDRII

SEQ ID NO: 4521 - protein, 9 aa, Mycobacterium tuberculosis
TANIDRIIP

SEQ ID NO: 4522 - protein, 9 aa, Mycobacterium tuberculosis
ANIDRIIPA

SEQ ID NO: 4523 - protein, 9 aa, Mycobacterium tuberculosis
NIDRIIPAM

SEQ ID NO: 4524 - protein, 9 aa, Mycobacterium tuberculosis
IDRIIPAML

SEQ ID NO: 4525 - protein, 9 aa, Mycobacterium tuberculosis
DRIIPAMLG

SEQ ID NO: 4526 - protein, 9 aa, Mycobacterium tuberculosis
RIIPAMLGL

SEQ ID NO: 4527 - protein, 9 aa, Mycobacterium tuberculosis
IIPAMLGLA

SEQ ID NO: 4528 - protein, 9 aa, Mycobacterium tuberculosis
IPAMLGLAN

SEQ ID NO: 4529 - protein, 9 aa, Mycobacterium tuberculosis
PAMLGLANL

SEQ ID NO: 4530 - protein, 9 aa, Mycobacterium tuberculosis
AMLGLANLI

SEQ ID NO: 4531 - protein, 9 aa, Mycobacterium tuberculosis
MLGLANLIE

SEQ ID NO: 4532 - protein, 9 aa, Mycobacterium tuberculosis
LGLANLIEA

SEQ ID NO: 4533 - protein, 9 aa, Mycobacterium tuberculosis
GLANLIEAR

SEQ ID NO: 4534 - protein, 9 aa, Mycobacterium tuberculosis
LANLIEARR

SEQ ID NO: 4535 - protein, 9 aa, Mycobacterium tuberculosis
ANLIEARRP

SEQ ID NO: 4536 - protein, 9 aa, Mycobacterium tuberculosis
NLIEARRPP

SEQ ID NO: 4537 - protein, 9 aa, Mycobacterium tuberculosis
LIEARRPPA

SEQ ID NO: 4538 - protein, 9 aa, Mycobacterium tuberculosis
IEARRPPAG

SEQ ID NO: 4539 - protein, 9 aa, Mycobacterium tuberculosis
EARRPPAGM

SEQ ID NO: 4540 - protein, 9 aa, Mycobacterium tuberculosis
ARRPPAGMS

SEQ ID NO: 4541 - protein, 9 aa, Mycobacterium tuberculosis
RRPPAGMSA

SEQ ID NO: 4542 - protein, 9 aa, Mycobacterium tuberculosis
RPPAGMSAA

SEQ ID NO: 4543 - protein, 9 aa, Mycobacterium tuberculosis
PPAGMSAAE

SEQ ID NO: 4544 - protein, 9 aa, Mycobacterium tuberculosis
PAGMSAAEL

SEQ ID NO: 4545 - protein, 9 aa, Mycobacterium tuberculosis
AGMSAAELS

SEQ ID NO: 4546 - protein, 9 aa, Mycobacterium tuberculosis
GMSAAELSR

SEQ ID NO: 4547 - protein, 9 aa, Mycobacterium tuberculosis
MSAAELSRW

SEQ ID NO: 4548 - protein, 9 aa, Mycobacterium tuberculosis
SAAELSRWT

SEQ ID NO: 4549 - protein, 9 aa, Mycobacterium tuberculosis
AAELSRWTF

SEQ ID NO: 4550 - protein, 9 aa, Mycobacterium tuberculosis
AELSRWTFA

SEQ ID NO: 4551 - protein, 9 aa, Mycobacterium tuberculosis
ELSRWTFAG

SEQ ID NO: 4552 - protein, 9 aa, Mycobacterium tuberculosis
LSRWTFAGH

SEQ ID NO: 4553 - protein, 9 aa, Mycobacterium tuberculosis
SRWTFAGHT

SEQ ID NO: 4554 - protein, 9 aa, Mycobacterium tuberculosis
RWTFAGHTH

SEQ ID NO: 4555 - protein, 9 aa, Mycobacterium tuberculosis
WTFAGHTHY

SEQ ID NO: 4556 - protein, 9 aa, Mycobacterium tuberculosis
TFAGHTHYL

SEQ ID NO: 4557 - protein, 9 aa, Mycobacterium tuberculosis
FAGHTHYLI

SEQ ID NO: 4558 - protein, 9 aa, Mycobacterium tuberculosis
AGHTHYLII

SEQ ID NO: 4559 - protein, 9 aa, Mycobacterium tuberculosis
GHTHYLIID

SEQ ID NO: 4560 - protein, 9 aa, Mycobacterium tuberculosis
HTHYLIIDD

SEQ ID NO: 4561 - protein, 9 aa, Mycobacterium tuberculosis
THYLIIDDV

SEQ ID NO: 4562 - protein, 9 aa, Mycobacterium tuberculosis
HYLIIDDVD

SEQ ID NO: 4563 - protein, 9 aa, Mycobacterium tuberculosis
YLIIDDVDQ

SEQ ID NO: 4564 - protein, 9 aa, Mycobacterium tuberculosis
LIIDDVDQV

SEQ ID NO: 4565 - protein, 9 aa, Mycobacterium tuberculosis
IIDDVDQVP

SEQ ID NO: 4566 - protein, 9 aa, Mycobacterium tuberculosis
IDDVDQVPD

SEQ ID NO: 4567 - protein, 9 aa, Mycobacterium tuberculosis
DDVDQVPDS

SEQ ID NO: 4568 - protein, 9 aa, Mycobacterium tuberculosis
DVDQVPDSP

SEQ ID NO: 4569 - protein, 9 aa, Mycobacterium tuberculosis
VDQVPDSPA

SEQ ID NO: 4570 - protein, 9 aa, Mycobacterium tuberculosis
DQVPDSPAM

SEQ ID NO: 4571 - protein, 9 aa, Mycobacterium tuberculosis
QVPDSPAMT

SEQ ID NO: 4572 - protein, 9 aa, Mycobacterium tuberculosis
VPDSPAMTG

SEQ ID NO: 4573 - protein, 9 aa, Mycobacterium tuberculosis
PDSPAMTGP

SEQ ID NO: 4574 - protein, 9 aa, Mycobacterium tuberculosis
DSPAMTGPY

SEQ ID NO: 4575 - protein, 9 aa, Mycobacterium tuberculosis
SPAMTGPYI

SEQ ID NO: 4576 - protein, 9 aa, Mycobacterium tuberculosis
PAMTGPYIG

SEQ ID NO: 4577 - protein, 9 aa, Mycobacterium tuberculosis
AMTGPYIGQ

SEQ ID NO: 4578 - protein, 9 aa, Mycobacterium tuberculosis
MTGPYIGQR

SEQ ID NO: 4579 - protein, 9 aa, Mycobacterium tuberculosis
TGPYIGQRP

SEQ ID NO: 4580 - protein, 9 aa, Mycobacterium tuberculosis
GPYIGQRPW

SEQ ID NO: 4581 - protein, 9 aa, Mycobacterium tuberculosis
PYIGQRPWT

SEQ ID NO: 4582 - protein, 9 aa, Mycobacterium tuberculosis
YIGQRPWTP

SEQ ID NO: 4583 - protein, 9 aa, Mycobacterium tuberculosis
IGQRPWTPL

SEQ ID NO: 4584 - protein, 9 aa, Mycobacterium tuberculosis
GQRPWTPLI

SEQ ID NO: 4585 - protein, 9 aa, Mycobacterium tuberculosis
QRPWTPLIG

SEQ ID NO: 4586 - protein, 9 aa, Mycobacterium tuberculosis
RPWTPLIGL

SEQ ID NO: 4587 - protein, 9 aa, Mycobacterium tuberculosis
PWTPLIGLL

SEQ ID NO: 4588 - protein, 9 aa, Mycobacterium tuberculosis
WTPLIGLLA

SEQ ID NO: 4589 - protein, 9 aa, Mycobacterium tuberculosis
TPLIGLLAQ

SEQ ID NO: 4590 - protein, 9 aa, Mycobacterium tuberculosis
PLIGLLAQA

SEQ ID NO: 4591 - protein, 9 aa, Mycobacterium tuberculosis
LIGLLAQAG

SEQ ID NO: 4592 - protein, 9 aa, Mycobacterium tuberculosis
IGLLAQAGD

SEQ ID NO: 4593 - protein, 9 aa, Mycobacterium tuberculosis
GLLAQAGDL

SEQ ID NO: 4594 - protein, 9 aa, Mycobacterium tuberculosis
LLAQAGDLG

SEQ ID NO: 4595 - protein, 9 aa, Mycobacterium tuberculosis
LAQAGDLGL

SEQ ID NO: 4596 - protein, 9 aa, Mycobacterium tuberculosis
AQAGDLGLR

SEQ ID NO: 4597 - protein, 9 aa, Mycobacterium tuberculosis
QAGDLGLRV

SEQ ID NO: 4598 - protein, 9 aa, Mycobacterium tuberculosis
AGDLGLRVI

SEQ ID NO: 4599 - protein, 9 aa, Mycobacterium tuberculosis
GDLGLRVIV

SEQ ID NO: 4600 - protein, 9 aa, Mycobacterium tuberculosis
DLGLRVIVT

SEQ ID NO: 4601 - protein, 9 aa, Mycobacterium tuberculosis
LGLRVIVTG

SEQ ID NO: 4602 - protein, 9 aa, Mycobacterium tuberculosis
GLRVIVTGR

SEQ ID NO: 4603 - protein, 9 aa, Mycobacterium tuberculosis
LRVIVTGRA

SEQ ID NO: 4604 - protein, 9 aa, Mycobacterium tuberculosis
RVIVTGRAT

SEQ ID NO: 4605 - protein, 9 aa, Mycobacterium tuberculosis
VIVTGRATG

SEQ ID NO: 4606 - protein, 9 aa, Mycobacterium tuberculosis
IVTGRATGS

SEQ ID NO: 4607 - protein, 9 aa, Mycobacterium tuberculosis
VTGRATGSA

SEQ ID NO: 4608 - protein, 9 aa, Mycobacterium tuberculosis
TGRATGSAH

SEQ ID NO: 4609 - protein, 9 aa, Mycobacterium tuberculosis
GRATGSAHL

SEQ ID NO: 4610 - protein, 9 aa, Mycobacterium tuberculosis
RATGSAHLL

SEQ ID NO: 4611 - protein, 9 aa, Mycobacterium tuberculosis
ATGSAHLLM

SEQ ID NO: 4612 - protein, 9 aa, Mycobacterium tuberculosis
TGSAHLLMT

SEQ ID NO: 4613 - protein, 9 aa, Mycobacterium tuberculosis
GSAHLLMTS

SEQ ID NO: 4614 - protein, 9 aa, Mycobacterium tuberculosis
SAHLLMTSP

SEQ ID NO: 4615 - protein, 9 aa, Mycobacterium tuberculosis
AHLLMTSPL

SEQ ID NO: 4616 - protein, 9 aa, Mycobacterium tuberculosis
HLLMTSPLL

SEQ ID NO: 4617 - protein, 9 aa, Mycobacterium tuberculosis
LLMTSPLLR

SEQ ID NO: 4618 - protein, 9 aa, Mycobacterium tuberculosis
LMTSPLLRR

SEQ ID NO: 4619 - protein, 9 aa, Mycobacterium tuberculosis
MTSPLLRRF

SEQ ID NO: 4620 - protein, 9 aa, Mycobacterium tuberculosis
TSPLLRRFN

SEQ ID NO: 4621 - protein, 9 aa, Mycobacterium tuberculosis
SPLLRRFND

SEQ ID NO: 4622 - protein, 9 aa, Mycobacterium tuberculosis
PLLRRFNDL

SEQ ID NO: 4623 - protein, 9 aa, Mycobacterium tuberculosis
LLRRFNDLQ

SEQ ID NO: 4624 - protein, 9 aa, Mycobacterium tuberculosis
LRRFNDLQA

SEQ ID NO: 4625 - protein, 9 aa, Mycobacterium tuberculosis
RRFNDLQAT

SEQ ID NO: 4626 - protein, 9 aa, Mycobacterium tuberculosis
RFNDLQATT

SEQ ID NO: 4627 - protein, 9 aa, Mycobacterium tuberculosis
FNDLQATTL

SEQ ID NO: 4628 - protein, 9 aa, Mycobacterium tuberculosis
NDLQATTLM

SEQ ID NO: 4629 - protein, 9 aa, Mycobacterium tuberculosis
DLQATTLML

SEQ ID NO: 4630 - protein, 9 aa, Mycobacterium tuberculosis
LQATTLMLA

SEQ ID NO: 4631 - protein, 9 aa, Mycobacterium tuberculosis
QATTLMLAG

SEQ ID NO: 4632 - protein, 9 aa, Mycobacterium tuberculosis
ATTLMLAGN

SEQ ID NO: 4633 - protein, 9 aa, Mycobacterium tuberculosis
TTLMLAGNP

SEQ ID NO: 4634 - protein, 9 aa, Mycobacterium tuberculosis
TLMLAGNPA

SEQ ID NO: 4635 - protein, 9 aa, Mycobacterium tuberculosis
LMLAGNPAD

SEQ ID NO: 4636 - protein, 9 aa, Mycobacterium tuberculosis
MLAGNPADS

SEQ ID NO: 4637 - protein, 9 aa, Mycobacterium tuberculosis
LAGNPADSG

SEQ ID NO: 4638 - protein, 9 aa, Mycobacterium tuberculosis
AGNPADSGK

SEQ ID NO: 4639 - protein, 9 aa, Mycobacterium tuberculosis
GNPADSGKI

SEQ ID NO: 4640 - protein, 9 aa, Mycobacterium tuberculosis
NPADSGKIR

SEQ ID NO: 4641 - protein, 9 aa, Mycobacterium tuberculosis
PADSGKIRG

SEQ ID NO: 4642 - protein, 9 aa, Mycobacterium tuberculosis
ADSGKIRGE

SEQ ID NO: 4643 - protein, 9 aa, Mycobacterium tuberculosis
DSGKIRGER

SEQ ID NO: 4644 - protein, 9 aa, Mycobacterium tuberculosis
SGKIRGERF

SEQ ID NO: 4645 - protein, 9 aa, Mycobacterium tuberculosis
GKIRGERFA

SEQ ID NO: 4646 - protein, 9 aa, Mycobacterium tuberculosis
KIRGERFAR

SEQ ID NO: 4647 - protein, 9 aa, Mycobacterium tuberculosis
IRGERFARL

SEQ ID NO: 4648 - protein, 9 aa, Mycobacterium tuberculosis
RGERFARLP

SEQ ID NO: 4649 - protein, 9 aa, Mycobacterium tuberculosis
GERFARLPA

SEQ ID NO: 4650 - protein, 9 aa, Mycobacterium tuberculosis
ERFARLPAG

SEQ ID NO: 4651 - protein, 9 aa, Mycobacterium tuberculosis
RFARLPAGR

SEQ ID NO: 4652 - protein, 9 aa, Mycobacterium tuberculosis
FARLPAGRA

SEQ ID NO: 4653 - protein, 9 aa, Mycobacterium tuberculosis
ARLPAGRAI

SEQ ID NO: 4654 - protein, 9 aa, Mycobacterium tuberculosis
RLPAGRAIL

SEQ ID NO: 4655 - protein, 9 aa, Mycobacterium tuberculosis
LPAGRAILL

SEQ ID NO: 4656 - protein, 9 aa, Mycobacterium tuberculosis
PAGRAILLT

SEQ ID NO: 4657 - protein, 9 aa, Mycobacterium tuberculosis
AGRAILLTD

SEQ ID NO: 4658 - protein, 9 aa, Mycobacterium tuberculosis
GRAILLTDS

SEQ ID NO: 4659 - protein, 9 aa, Mycobacterium tuberculosis
RAILLTDSD

SEQ ID NO: 4660 - protein, 9 aa, Mycobacterium tuberculosis
AILLTDSDS

SEQ ID NO: 4661 - protein, 9 aa, Mycobacterium tuberculosis
ILLTDSDSP

SEQ ID NO: 4662 - protein, 9 aa, Mycobacterium tuberculosis
LLTDSDSPT

SEQ ID NO: 4663 - protein, 9 aa, Mycobacterium tuberculosis
LTDSDSPTY

SEQ ID NO: 4664 - protein, 9 aa, Mycobacterium tuberculosis
TDSDSPTYV

SEQ ID NO: 4665 - protein, 9 aa, Mycobacterium tuberculosis
DSDSPTYVQ

SEQ ID NO: 4666 - protein, 9 aa, Mycobacterium tuberculosis
SDSPTYVQL

SEQ ID NO: 4667 - protein, 9 aa, Mycobacterium tuberculosis
DSPTYVQLI

SEQ ID NO: 4668 - protein, 9 aa, Mycobacterium tuberculosis
SPTYVQLIN

SEQ ID NO: 4669 - protein, 9 aa, Mycobacterium tuberculosis
PTYVQLINP

SEQ ID NO: 4670 - protein, 9 aa, Mycobacterium tuberculosis
TYVQLINPL

SEQ ID NO: 4671 - protein, 9 aa, Mycobacterium tuberculosis
YVQLINPLV

SEQ ID NO: 4672 - protein, 9 aa, Mycobacterium tuberculosis
VQLINPLVD

SEQ ID NO: 4673 - protein, 9 aa, Mycobacterium tuberculosis
QLINPLVDA

SEQ ID NO: 4674 - protein, 9 aa, Mycobacterium tuberculosis
LINPLVDAA

SEQ ID NO: 4675 - protein, 9 aa, Mycobacterium tuberculosis
INPLVDAAA

SEQ ID NO: 4676 - protein, 9 aa, Mycobacterium tuberculosis
NPLVDAAAV

SEQ ID NO: 4677 - protein, 9 aa, Mycobacterium tuberculosis
PLVDAAAVS

SEQ ID NO: 4678 - protein, 9 aa, Mycobacterium tuberculosis
LVDAAAVSG

SEQ ID NO: 4679 - protein, 9 aa, Mycobacterium tuberculosis
VDAAAVSGE

SEQ ID NO: 4680 - protein, 9 aa, Mycobacterium tuberculosis
DAAAVSGET

SEQ ID NO: 4681 - protein, 9 aa, Mycobacterium tuberculosis
AAAVSGETQ

SEQ ID NO: 4682 - protein, 9 aa, Mycobacterium tuberculosis
AAVSGETQQ

SEQ ID NO: 4683 - protein, 9 aa, Mycobacterium tuberculosis
AVSGETQQK

SEQ ID NO: 4684 - protein, 9 aa, Mycobacterium tuberculosis
VSGETQQKG

SEQ ID NO: 4685 - protein, 9 aa, Mycobacterium tuberculosis
SGETQQKGS

SEQ ID NO: 4686 - protein, 9 aa, Mycobacterium tuberculosis
GETQQKGSQ

SEQ ID NO: 4687 - protein, 9 aa, Mycobacterium tuberculosis
ETQQKGSQS

SEQ ID NO: 4688 - protein, 10 aa, Mycobacterium tuberculosis
MSRLIFEARR

SEQ ID NO: 4689 - protein, 10 aa, Mycobacterium tuberculosis
SRLIFEARRR

SEQ ID NO: 4690 - protein, 10 aa, Mycobacterium tuberculosis
RLIFEARRRL

SEQ ID NO: 4691 - protein, 10 aa, Mycobacterium tuberculosis
LIFEARRRLA

SEQ ID NO: 4692 - protein, 10 aa, Mycobacterium tuberculosis
IFEARRRLAP

SEQ ID NO: 4693 - protein, 10 aa, Mycobacterium tuberculosis
FEARRRLAPP

SEQ ID NO: 4694 - protein, 10 aa, Mycobacterium tuberculosis
EARRRLAPPS

SEQ ID NO: 4695 - protein, 10 aa, Mycobacterium tuberculosis
ARRRLAPPSS

SEQ ID NO: 4696 - protein, 10 aa, Mycobacterium tuberculosis
RRRLAPPSSH

SEQ ID NO: 4697 - protein, 10 aa, Mycobacterium tuberculosis
RRLAPPSSHQ

SEQ ID NO: 4698 - protein, 10 aa, Mycobacterium tuberculosis
RLAPPSSHQG

SEQ ID NO: 4699 - protein, 10 aa, Mycobacterium tuberculosis
LAPPSSHQGT

SEQ ID NO: 4700 - protein, 10 aa, Mycobacterium tuberculosis
APPSSHQGTI

SEQ ID NO: 4701 - protein, 10 aa, Mycobacterium tuberculosis
PPSSHQGTII

SEQ ID NO: 4702 - protein, 10 aa, Mycobacterium tuberculosis
PSSHQGTIII

SEQ ID NO: 4703 - protein, 10 aa, Mycobacterium tuberculosis
SSHQGTIIIE

SEQ ID NO: 4704 - protein, 10 aa, Mycobacterium tuberculosis
SHQGTIIIEA

SEQ ID NO: 4705 - protein, 10 aa, Mycobacterium tuberculosis
HQGTIIIEAP

SEQ ID NO: 4706 - protein, 10 aa, Mycobacterium tuberculosis
QGTIIIEAPP

SEQ ID NO: 4707 - protein, 10 aa, Mycobacterium tuberculosis
GTIIIEAPPE

SEQ ID NO: 4708 - protein, 10 aa, Mycobacterium tuberculosis
TIIIEAPPEL

SEQ ID NO: 4709 - protein, 10 aa, Mycobacterium tuberculosis
IIIEAPPELP

SEQ ID NO: 4710 - protein, 10 aa, Mycobacterium tuberculosis
IIEAPPELPR

SEQ ID NO: 4711 - protein, 10 aa, Mycobacterium tuberculosis
IEAPPELPRV

SEQ ID NO: 4712 - protein, 10 aa, Mycobacterium tuberculosis
EAPPELPRVI

SEQ ID NO: 4713 - protein, 10 aa, Mycobacterium tuberculosis
APPELPRVIP

SEQ ID NO: 4714 - protein, 10 aa, Mycobacterium tuberculosis
PPELPRVIPP

SEQ ID NO: 4715 - protein, 10 aa, Mycobacterium tuberculosis
PELPRVIPPS

SEQ ID NO: 4716 - protein, 10 aa, Mycobacterium tuberculosis
ELPRVIPPSL

SEQ ID NO: 4717 - protein, 10 aa, Mycobacterium tuberculosis
LPRVIPPSLL

SEQ ID NO: 4718 - protein, 10 aa, Mycobacterium tuberculosis
PRVIPPSLLR

SEQ ID NO: 4719 - protein, 10 aa, Mycobacterium tuberculosis
RVIPPSLLRR

SEQ ID NO: 4720 - protein, 10 aa, Mycobacterium tuberculosis
VIPPSLLRRA

SEQ ID NO: 4721 - protein, 10 aa, Mycobacterium tuberculosis
IPPSLLRRAL

SEQ ID NO: 4722 - protein, 10 aa, Mycobacterium tuberculosis
PPSLLRRALP

SEQ ID NO: 4723 - protein, 10 aa, Mycobacterium tuberculosis
PSLLRRALPY

SEQ ID NO: 4724 - protein, 10 aa, Mycobacterium tuberculosis
SLLRRALPYL

SEQ ID NO: 4725 - protein, 10 aa, Mycobacterium tuberculosis
LLRRALPYLI

SEQ ID NO: 4726 - protein, 10 aa, Mycobacterium tuberculosis
LRRALPYLIG

SEQ ID NO: 4727 - protein, 10 aa, Mycobacterium tuberculosis
RRALPYLIGI

SEQ ID NO: 4728 - protein, 10 aa, Mycobacterium tuberculosis
RALPYLIGIL

SEQ ID NO: 4729 - protein, 10 aa, Mycobacterium tuberculosis
ALPYLIGILI

SEQ ID NO: 4730 - protein, 10 aa, Mycobacterium tuberculosis
LPYLIGILIV

SEQ ID NO: 4731 - protein, 10 aa, Mycobacterium tuberculosis
PYLIGILIVG

SEQ ID NO: 4732 - protein, 10 aa, Mycobacterium tuberculosis
YLIGILIVGM

SEQ ID NO: 4733 - protein, 10 aa, Mycobacterium tuberculosis
LIGILIVGMI

SEQ ID NO: 4734 - protein, 10 aa, Mycobacterium tuberculosis
IGILIVGMIV

SEQ ID NO: 4735 - protein, 10 aa, Mycobacterium tuberculosis
GILIVGMIVA

SEQ ID NO: 4736 - protein, 10 aa, Mycobacterium tuberculosis
ILIVGMIVAL

SEQ ID NO: 4737 - protein, 10 aa, Mycobacterium tuberculosis
LIVGMIVALV

SEQ ID NO: 4738 - protein, 10 aa, Mycobacterium tuberculosis
IVGMIVALVA

SEQ ID NO: 4739 - protein, 10 aa, Mycobacterium tuberculosis
VGMIVALVAT

SEQ ID NO: 4740 - protein, 10 aa, Mycobacterium tuberculosis
GMIVALVATG

SEQ ID NO: 4741 - protein, 10 aa, Mycobacterium tuberculosis
MIVALVATGM

SEQ ID NO: 4742 - protein, 10 aa, Mycobacterium tuberculosis
IVALVATGMR

SEQ ID NO: 4743 - protein, 10 aa, Mycobacterium tuberculosis
VALVATGMRV

SEQ ID NO: 4744 - protein, 10 aa, Mycobacterium tuberculosis
ALVATGMRVI

SEQ ID NO: 4745 - protein, 10 aa, Mycobacterium tuberculosis
LVATGMRVIS

SEQ ID NO: 4746 - protein, 10 aa, Mycobacterium tuberculosis
VATGMRVISP

SEQ ID NO: 4747 - protein, 10 aa, Mycobacterium tuberculosis
ATGMRVISPQ

SEQ ID NO: 4748 - protein, 10 aa, Mycobacterium tuberculosis
TGMRVISPQT

SEQ ID NO: 4749 - protein, 10 aa, Mycobacterium tuberculosis
GMRVISPQTL

SEQ ID NO: 4750 - protein, 10 aa, Mycobacterium tuberculosis
MRVISPQTLF

SEQ ID NO: 4751 - protein, 10 aa, Mycobacterium tuberculosis
RVISPQTLFF

SEQ ID NO: 4752 - protein, 10 aa, Mycobacterium tuberculosis
VISPQTLFFP

SEQ ID NO: 4753 - protein, 10 aa, Mycobacterium tuberculosis
ISPQTLFFPF

SEQ ID NO: 4754 - protein, 10 aa, Mycobacterium tuberculosis
SPQTLFFPFV

SEQ ID NO: 4755 - protein, 10 aa, Mycobacterium tuberculosis
PQTLFFPFVL

SEQ ID NO: 4756 - protein, 10 aa, Mycobacterium tuberculosis
QTLFFPFVLL

SEQ ID NO: 4757 - protein, 10 aa, Mycobacterium tuberculosis
TLFFPFVLLL

SEQ ID NO: 4758 - protein, 10 aa, Mycobacterium tuberculosis
LFFPFVLLLA

SEQ ID NO: 4759 - protein, 10 aa, Mycobacterium tuberculosis
FFPFVLLLAA

SEQ ID NO: 4760 - protein, 10 aa, Mycobacterium tuberculosis
FPFVLLLAAT

SEQ ID NO: 4761 - protein, 10 aa, Mycobacterium tuberculosis
PFVLLLAATA

SEQ ID NO: 4762 - protein, 10 aa, Mycobacterium tuberculosis
FVLLLAATAL

SEQ ID NO: 4763 - protein, 10 aa, Mycobacterium tuberculosis
VLLLAATALY

SEQ ID NO: 4764 - protein, 10 aa, Mycobacterium tuberculosis
LLLAATALYR

SEQ ID NO: 4765 - protein, 10 aa, Mycobacterium tuberculosis
LLAATALYRG

SEQ ID NO: 4766 - protein, 10 aa, Mycobacterium tuberculosis
LAATALYRGN

SEQ ID NO: 4767 - protein, 10 aa, Mycobacterium tuberculosis
AATALYRGND

SEQ ID NO: 4768 - protein, 10 aa, Mycobacterium tuberculosis
ATALYRGNDK

SEQ ID NO: 4769 - protein, 10 aa, Mycobacterium tuberculosis
TALYRGNDKK

SEQ ID NO: 4770 - protein, 10 aa, Mycobacterium tuberculosis
ALYRGNDKKM

SEQ ID NO: 4771 - protein, 10 aa, Mycobacterium tuberculosis
LYRGNDKKMR

SEQ ID NO: 4772 - protein, 10 aa, Mycobacterium tuberculosis
YRGNDKKMRT

SEQ ID NO: 4773 - protein, 10 aa, Mycobacterium tuberculosis
RGNDKKMRTE

SEQ ID NO: 4774 - protein, 10 aa, Mycobacterium tuberculosis
GNDKKMRTEE

SEQ ID NO: 4775 - protein, 10 aa, Mycobacterium tuberculosis
NDKKMRTEEV

SEQ ID NO: 4776 - protein, 10 aa, Mycobacterium tuberculosis
DKKMRTEEVD

SEQ ID NO: 4777 - protein, 10 aa, Mycobacterium tuberculosis
KKMRTEEVDA

SEQ ID NO: 4778 - protein, 10 aa, Mycobacterium tuberculosis
KMRTEEVDAE

SEQ ID NO: 4779 - protein, 10 aa, Mycobacterium tuberculosis
MRTEEVDAER

SEQ ID NO: 4780 - protein, 10 aa, Mycobacterium tuberculosis
RTEEVDAERA

SEQ ID NO: 4781 - protein, 10 aa, Mycobacterium tuberculosis
TEEVDAERAD

SEQ ID NO: 4782 - protein, 10 aa, Mycobacterium tuberculosis
EEVDAERADY

SEQ ID NO: 4783 - protein, 10 aa, Mycobacterium tuberculosis
EVDAERADYL

SEQ ID NO: 4784 - protein, 10 aa, Mycobacterium tuberculosis
VDAERADYLR

SEQ ID NO: 4785 - protein, 10 aa, Mycobacterium tuberculosis
DAERADYLRY

SEQ ID NO: 4786 - protein, 10 aa, Mycobacterium tuberculosis
AERADYLRYL

SEQ ID NO: 4787 - protein, 10 aa, Mycobacterium tuberculosis
ERADYLRYLS

SEQ ID NO: 4788 - protein, 10 aa, Mycobacterium tuberculosis
RADYLRYLSV

SEQ ID NO: 4789 - protein, 10 aa, Mycobacterium tuberculosis
ADYLRYLSVV

SEQ ID NO: 4790 - protein, 10 aa, Mycobacterium tuberculosis
DYLRYLSVVR

SEQ ID NO: 4791 - protein, 10 aa, Mycobacterium tuberculosis
YLRYLSVVRD

SEQ ID NO: 4792 - protein, 10 aa, Mycobacterium tuberculosis
LRYLSVVRDN

SEQ ID NO: 4793 - protein, 10 aa, Mycobacterium tuberculosis
RYLSVVRDNI

SEQ ID NO: 4794 - protein, 10 aa, Mycobacterium tuberculosis
YLSVVRDNIR

SEQ ID NO: 4795 - protein, 10 aa, Mycobacterium tuberculosis
LSVVRDNIRA

SEQ ID NO: 4796 - protein, 10 aa, Mycobacterium tuberculosis
SVVRDNIRAQ

SEQ ID NO: 4797 - protein, 10 aa, Mycobacterium tuberculosis
VVRDNIRAQA

SEQ ID NO: 4798 - protein, 10 aa, Mycobacterium tuberculosis
VRDNIRAQAA

SEQ ID NO: 4799 - protein, 10 aa, Mycobacterium tuberculosis
RDNIRAQAAE

SEQ ID NO: 4800 - protein, 10 aa, Mycobacterium tuberculosis
DNIRAQAAEQ

SEQ ID NO: 4801 - protein, 10 aa, Mycobacterium tuberculosis
NIRAQAAEQR

SEQ ID NO: 4802 - protein, 10 aa, Mycobacterium tuberculosis
IRAQAAEQRA

SEQ ID NO: 4803 - protein, 10 aa, Mycobacterium tuberculosis
RAQAAEQRAS

SEQ ID NO: 4804 - protein, 10 aa, Mycobacterium tuberculosis
AQAAEQRASA

SEQ ID NO: 4805 - protein, 10 aa, Mycobacterium tuberculosis
QAAEQRASAL

SEQ ID NO: 4806 - protein, 10 aa, Mycobacterium tuberculosis
AAEQRASALW

SEQ ID NO: 4807 - protein, 10 aa, Mycobacterium tuberculosis
AEQRASALWS

SEQ ID NO: 4808 - protein, 10 aa, Mycobacterium tuberculosis
EQRASALWSH

SEQ ID NO: 4809 - protein, 10 aa, Mycobacterium tuberculosis
QRASALWSHP

SEQ ID NO: 4810 - protein, 10 aa, Mycobacterium tuberculosis
RASALWSHPD

SEQ ID NO: 4811 - protein, 10 aa, Mycobacterium tuberculosis
ASALWSHPDP

SEQ ID NO: 4812 - protein, 10 aa, Mycobacterium tuberculosis
SALWSHPDPT

SEQ ID NO: 4813 - protein, 10 aa, Mycobacterium tuberculosis
ALWSHPDPTA

SEQ ID NO: 4814 - protein, 10 aa, Mycobacterium tuberculosis
LWSHPDPTAL

SEQ ID NO: 4815 - protein, 10 aa, Mycobacterium tuberculosis
WSHPDPTALA

SEQ ID NO: 4816 - protein, 10 aa, Mycobacterium tuberculosis
SHPDPTALAS

SEQ ID NO: 4817 - protein, 10 aa, Mycobacterium tuberculosis
HPDPTALASV

SEQ ID NO: 4818 - protein, 10 aa, Mycobacterium tuberculosis
PDPTALASVP

SEQ ID NO: 4819 - protein, 10 aa, Mycobacterium tuberculosis
DPTALASVPG

SEQ ID NO: 4820 - protein, 10 aa, Mycobacterium tuberculosis
PTALASVPGS

SEQ ID NO: 4821 - protein, 10 aa, Mycobacterium tuberculosis
TALASVPGSR

SEQ ID NO: 4822 - protein, 10 aa, Mycobacterium tuberculosis
ALASVPGSRR

SEQ ID NO: 4823 - protein, 10 aa, Mycobacterium tuberculosis
LASVPGSRRQ

SEQ ID NO: 4824 - protein, 10 aa, Mycobacterium tuberculosis
ASVPGSRRQW

SEQ ID NO: 4825 - protein, 10 aa, Mycobacterium tuberculosis
SVPGSRRQWE

SEQ ID NO: 4826 - protein, 10 aa, Mycobacterium tuberculosis
VPGSRRQWER

SEQ ID NO: 4827 - protein, 10 aa, Mycobacterium tuberculosis
PGSRRQWERD

SEQ ID NO: 4828 - protein, 10 aa, Mycobacterium tuberculosis
GSRRQWERDP

SEQ ID NO: 4829 - protein, 10 aa, Mycobacterium tuberculosis
SRRQWERDPH

SEQ ID NO: 4830 - protein, 10 aa, Mycobacterium tuberculosis
RRQWERDPHD

SEQ ID NO: 4831 - protein, 10 aa, Mycobacterium tuberculosis
RQWERDPHDP

SEQ ID NO: 4832 - protein, 10 aa, Mycobacterium tuberculosis
QWERDPHDPD

SEQ ID NO: 4833 - protein, 10 aa, Mycobacterium tuberculosis
WERDPHDPDF

SEQ ID NO: 4834 - protein, 10 aa, Mycobacterium tuberculosis
ERDPHDPDFL

SEQ ID NO: 4835 - protein, 10 aa, Mycobacterium tuberculosis
RDPHDPDFLV

SEQ ID NO: 4836 - protein, 10 aa, Mycobacterium tuberculosis
DPHDPDFLVL

SEQ ID NO: 4837 - protein, 10 aa, Mycobacterium tuberculosis
PHDPDFLVLR

SEQ ID NO: 4838 - protein, 10 aa, Mycobacterium tuberculosis
HDPDFLVLRA

SEQ ID NO: 4839 - protein, 10 aa, Mycobacterium tuberculosis
DPDFLVLRAG

SEQ ID NO: 4840 - protein, 10 aa, Mycobacterium tuberculosis
PDFLVLRAGR

SEQ ID NO: 4841 - protein, 10 aa, Mycobacterium tuberculosis
DFLVLRAGRH

SEQ ID NO: 4842 - protein, 10 aa, Mycobacterium tuberculosis
FLVLRAGRHT

SEQ ID NO: 4843 - protein, 10 aa, Mycobacterium tuberculosis
LVLRAGRHTV

SEQ ID NO: 4844 - protein, 10 aa, Mycobacterium tuberculosis
VLRAGRHTVP

SEQ ID NO: 4845 - protein, 10 aa, Mycobacterium tuberculosis
LRAGRHTVPL

SEQ ID NO: 4846 - protein, 10 aa, Mycobacterium tuberculosis
RAGRHTVPLA

SEQ ID NO: 4847 - protein, 10 aa, Mycobacterium tuberculosis
AGRHTVPLAT

SEQ ID NO: 4848 - protein, 10 aa, Mycobacterium tuberculosis
GRHTVPLATT

SEQ ID NO: 4849 - protein, 10 aa, Mycobacterium tuberculosis
RHTVPLATTL

SEQ ID NO: 4850 - protein, 10 aa, Mycobacterium tuberculosis
HTVPLATTLR

SEQ ID NO: 4851 - protein, 10 aa, Mycobacterium tuberculosis
TVPLATTLRV

SEQ ID NO: 4852 - protein, 10 aa, Mycobacterium tuberculosis
VPLATTLRVN

SEQ ID NO: 4853 - protein, 10 aa, Mycobacterium tuberculosis
PLATTLRVND

SEQ ID NO: 4854 - protein, 10 aa, Mycobacterium tuberculosis
LATTLRVNDT

SEQ ID NO: 4855 - protein, 10 aa, Mycobacterium tuberculosis
ATTLRVNDTA

SEQ ID NO: 4856 - protein, 10 aa, Mycobacterium tuberculosis
TTLRVNDTAD

SEQ ID NO: 4857 - protein, 10 aa, Mycobacterium tuberculosis
TLRVNDTADE

SEQ ID NO: 4858 - protein, 10 aa, Mycobacterium tuberculosis
LRVNDTADEI

SEQ ID NO: 4859 - protein, 10 aa, Mycobacterium tuberculosis
RVNDTADEID

SEQ ID NO: 4860 - protein, 10 aa, Mycobacterium tuberculosis
VNDTADEIDL

SEQ ID NO: 4861 - protein, 10 aa, Mycobacterium tuberculosis
NDTADEIDLE

SEQ ID NO: 4862 - protein, 10 aa, Mycobacterium tuberculosis
DTADEIDLEP

SEQ ID NO: 4863 - protein, 10 aa, Mycobacterium tuberculosis
TADEIDLEPV

SEQ ID NO: 4864 - protein, 10 aa, Mycobacterium tuberculosis
ADEIDLEPVS

SEQ ID NO: 4865 - protein, 10 aa, Mycobacterium tuberculosis
DEIDLEPVSH

SEQ ID NO: 4866 - protein, 10 aa, Mycobacterium tuberculosis
EIDLEPVSHS

SEQ ID NO: 4867 - protein, 10 aa, Mycobacterium tuberculosis
IDLEPVSHSA

SEQ ID NO: 4868 - protein, 10 aa, Mycobacterium tuberculosis
DLEPVSHSAL

SEQ ID NO: 4869 - protein, 10 aa, Mycobacterium tuberculosis
LEPVSHSALR

SEQ ID NO: 4870 - protein, 10 aa, Mycobacterium tuberculosis
EPVSHSALRS

SEQ ID NO: 4871 - protein, 10 aa, Mycobacterium tuberculosis
PVSHSALRSL

SEQ ID NO: 4872 - protein, 10 aa, Mycobacterium tuberculosis
VSHSALRSLL

SEQ ID NO: 4873 - protein, 10 aa, Mycobacterium tuberculosis
SHSALRSLLD

SEQ ID NO: 4874 - protein, 10 aa, Mycobacterium tuberculosis
HSALRSLLDT

SEQ ID NO: 4875 - protein, 10 aa, Mycobacterium tuberculosis
SALRSLLDTQ

SEQ ID NO: 4876 - protein, 10 aa, Mycobacterium tuberculosis
ALRSLLDTQR

SEQ ID NO: 4877 - protein, 10 aa, Mycobacterium tuberculosis
LRSLLDTQRS

SEQ ID NO: 4878 - protein, 10 aa, Mycobacterium tuberculosis
RSLLDTQRSI

SEQ ID NO: 4879 - protein, 10 aa, Mycobacterium tuberculosis
SLLDTQRSIG

SEQ ID NO: 4880 - protein, 10 aa, Mycobacterium tuberculosis
LLDTQRSIGD

SEQ ID NO: 4881 - protein, 10 aa, Mycobacterium tuberculosis
LDTQRSIGDV

SEQ ID NO: 4882 - protein, 10 aa, Mycobacterium tuberculosis
DTQRSIGDVP

SEQ ID NO: 4883 - protein, 10 aa, Mycobacterium tuberculosis
TQRSIGDVPT

SEQ ID NO: 4884 - protein, 10 aa, Mycobacterium tuberculosis
QRSIGDVPTG

SEQ ID NO: 4885 - protein, 10 aa, Mycobacterium tuberculosis
RSIGDVPTGI

SEQ ID NO: 4886 - protein, 10 aa, Mycobacterium tuberculosis
SIGDVPTGID

SEQ ID NO: 4887 - protein, 10 aa, Mycobacterium tuberculosis
IGDVPTGIDL

SEQ ID NO: 4888 - protein, 10 aa, Mycobacterium tuberculosis
GDVPTGIDLT

SEQ ID NO: 4889 - protein, 10 aa, Mycobacterium tuberculosis
DVPTGIDLTK

SEQ ID NO: 4890 - protein, 10 aa, Mycobacterium tuberculosis
VPTGIDLTKV

SEQ ID NO: 4891 - protein, 10 aa, Mycobacterium tuberculosis
PTGIDLTKVS

SEQ ID NO: 4892 - protein, 10 aa, Mycobacterium tuberculosis
TGIDLTKVSP

SEQ ID NO: 4893 - protein, 10 aa, Mycobacterium tuberculosis
GIDLTKVSPI

SEQ ID NO: 4894 - protein, 10 aa, Mycobacterium tuberculosis
IDLTKVSPIT

SEQ ID NO: 4895 - protein, 10 aa, Mycobacterium tuberculosis
DLTKVSPITV

SEQ ID NO: 4896 - protein, 10 aa, Mycobacterium tuberculosis
LTKVSPITVL

SEQ ID NO: 4897 - protein, 10 aa, Mycobacterium tuberculosis
TKVSPITVLG

SEQ ID NO: 4898 - protein, 10 aa, Mycobacterium tuberculosis
KVSPITVLGE

SEQ ID NO: 4899 - protein, 10 aa, Mycobacterium tuberculosis
VSPITVLGER

SEQ ID NO: 4900 - protein, 10 aa, Mycobacterium tuberculosis
SPITVLGERA

SEQ ID NO: 4901 - protein, 10 aa, Mycobacterium tuberculosis
PITVLGERAQ

SEQ ID NO: 4902 - protein, 10 aa, Mycobacterium tuberculosis
ITVLGERAQV

SEQ ID NO: 4903 - protein, 10 aa, Mycobacterium tuberculosis
TVLGERAQVR

SEQ ID NO: 4904 - protein, 10 aa, Mycobacterium tuberculosis
VLGERAQVRA

SEQ ID NO: 4905 - protein, 10 aa, Mycobacterium tuberculosis
LGERAQVRAV

SEQ ID NO: 4906 - protein, 10 aa, Mycobacterium tuberculosis
GERAQVRAVL

SEQ ID NO: 4907 - protein, 10 aa, Mycobacterium tuberculosis
ERAQVRAVLR

SEQ ID NO: 4908 - protein, 10 aa, Mycobacterium tuberculosis
RAQVRAVLRA

SEQ ID NO: 4909 - protein, 10 aa, Mycobacterium tuberculosis
AQVRAVLRAW

SEQ ID NO: 4910 - protein, 10 aa, Mycobacterium tuberculosis
QVRAVLRAWI

SEQ ID NO: 4911 - protein, 10 aa, Mycobacterium tuberculosis
VRAVLRAWIA

SEQ ID NO: 4912 - protein, 10 aa, Mycobacterium tuberculosis
RAVLRAWIAQ

SEQ ID NO: 4913 - protein, 10 aa, Mycobacterium tuberculosis
AVLRAWIAQA

SEQ ID NO: 4914 - protein, 10 aa, Mycobacterium tuberculosis
VLRAWIAQAV

SEQ ID NO: 4915 - protein, 10 aa, Mycobacterium tuberculosis
LRAWIAQAVT

SEQ ID NO: 4916 - protein, 10 aa, Mycobacterium tuberculosis
RAWIAQAVTW

SEQ ID NO: 4917 - protein, 10 aa, Mycobacterium tuberculosis
AWIAQAVTWH

SEQ ID NO: 4918 - protein, 10 aa, Mycobacterium tuberculosis
WIAQAVTWHD

SEQ ID NO: 4919 - protein, 10 aa, Mycobacterium tuberculosis
IAQAVTWHDP

SEQ ID NO: 4920 - protein, 10 aa, Mycobacterium tuberculosis
AQAVTWHDPT

SEQ ID NO: 4921 - protein, 10 aa, Mycobacterium tuberculosis
QAVTWHDPTV

SEQ ID NO: 4922 - protein, 10 aa, Mycobacterium tuberculosis
AVTWHDPTVL

SEQ ID NO: 4923 - protein, 10 aa, Mycobacterium tuberculosis
VTWHDPTVLG

SEQ ID NO: 4924 - protein, 10 aa, Mycobacterium tuberculosis
TWHDPTVLGV

SEQ ID NO: 4925 - protein, 10 aa, Mycobacterium tuberculosis
WHDPTVLGVA

SEQ ID NO: 4926 - protein, 10 aa, Mycobacterium tuberculosis
HDPTVLGVAL

SEQ ID NO: 4927 - protein, 10 aa, Mycobacterium tuberculosis
DPTVLGVALA

SEQ ID NO: 4928 - protein, 10 aa, Mycobacterium tuberculosis
PTVLGVALAA

SEQ ID NO: 4929 - protein, 10 aa, Mycobacterium tuberculosis
TVLGVALAAR

SEQ ID NO: 4930 - protein, 10 aa, Mycobacterium tuberculosis
VLGVALAARD

SEQ ID NO: 4931 - protein, 10 aa, Mycobacterium tuberculosis
LGVALAARDL

SEQ ID NO: 4932 - protein, 10 aa, Mycobacterium tuberculosis
GVALAARDLE

SEQ ID NO: 4933 - protein, 10 aa, Mycobacterium tuberculosis
VALAARDLEG

SEQ ID NO: 4934 - protein, 10 aa, Mycobacterium tuberculosis
ALAARDLEGR

SEQ ID NO: 4935 - protein, 10 aa, Mycobacterium tuberculosis
LAARDLEGRD

SEQ ID NO: 4936 - protein, 10 aa, Mycobacterium tuberculosis
AARDLEGRDW

SEQ ID NO: 4937 - protein, 10 aa, Mycobacterium tuberculosis
ARDLEGRDWN

SEQ ID NO: 4938 - protein, 10 aa, Mycobacterium tuberculosis
RDLEGRDWNW

SEQ ID NO: 4939 - protein, 10 aa, Mycobacterium tuberculosis
DLEGRDWNWL

SEQ ID NO: 4940 - protein, 10 aa, Mycobacterium tuberculosis
LEGRDWNWLK

SEQ ID NO: 4941 - protein, 10 aa, Mycobacterium tuberculosis
EGRDWNWLKW

SEQ ID NO: 4942 - protein, 10 aa, Mycobacterium tuberculosis
GRDWNWLKWL

SEQ ID NO: 4943 - protein, 10 aa, Mycobacterium tuberculosis
RDWNWLKWLP

SEQ ID NO: 4944 - protein, 10 aa, Mycobacterium tuberculosis
DWNWLKWLPH

SEQ ID NO: 4945 - protein, 10 aa, Mycobacterium tuberculosis
WNWLKWLPHV

SEQ ID NO: 4946 - protein, 10 aa, Mycobacterium tuberculosis
NWLKWLPHVD

SEQ ID NO: 4947 - protein, 10 aa, Mycobacterium tuberculosis
WLKWLPHVDI

SEQ ID NO: 4948 - protein, 10 aa, Mycobacterium tuberculosis
LKWLPHVDIP

SEQ ID NO: 4949 - protein, 10 aa, Mycobacterium tuberculosis
KWLPHVDIPG

SEQ ID NO: 4950 - protein, 10 aa, Mycobacterium tuberculosis
WLPHVDIPGR

SEQ ID NO: 4951 - protein, 10 aa, Mycobacterium tuberculosis
LPHVDIPGRL

SEQ ID NO: 4952 - protein, 10 aa, Mycobacterium tuberculosis
PHVDIPGRLD

SEQ ID NO: 4953 - protein, 10 aa, Mycobacterium tuberculosis
HVDIPGRLDA

SEQ ID NO: 4954 - protein, 10 aa, Mycobacterium tuberculosis
VDIPGRLDAL

SEQ ID NO: 4955 - protein, 10 aa, Mycobacterium tuberculosis
DIPGRLDALG

SEQ ID NO: 4956 - protein, 10 aa, Mycobacterium tuberculosis
IPGRLDALGP

SEQ ID NO: 4957 - protein, 10 aa, Mycobacterium tuberculosis
PGRLDALGPA

SEQ ID NO: 4958 - protein, 10 aa, Mycobacterium tuberculosis
GRLDALGPAR

SEQ ID NO: 4959 - protein, 10 aa, Mycobacterium tuberculosis
RLDALGPARN

SEQ ID NO: 4960 - protein, 10 aa, Mycobacterium tuberculosis
LDALGPARNL

SEQ ID NO: 4961 - protein, 10 aa, Mycobacterium tuberculosis
DALGPARNLS

SEQ ID NO: 4962 - protein, 10 aa, Mycobacterium tuberculosis
ALGPARNLST

SEQ ID NO: 4963 - protein, 10 aa, Mycobacterium tuberculosis
LGPARNLSTD

SEQ ID NO: 4964 - protein, 10 aa, Mycobacterium tuberculosis
GPARNLSTDP

SEQ ID NO: 4965 - protein, 10 aa, Mycobacterium tuberculosis
PARNLSTDPD

SEQ ID NO: 4966 - protein, 10 aa, Mycobacterium tuberculosis
ARNLSTDPDE

SEQ ID NO: 4967 - protein, 10 aa, Mycobacterium tuberculosis
RNLSTDPDEL

SEQ ID NO: 4968 - protein, 10 aa, Mycobacterium tuberculosis
NLSTDPDELI

SEQ ID NO: 4969 - protein, 10 aa, Mycobacterium tuberculosis
LSTDPDELIA

SEQ ID NO: 4970 - protein, 10 aa, Mycobacterium tuberculosis
STDPDELIAL

SEQ ID NO: 4971 - protein, 10 aa, Mycobacterium tuberculosis
TDPDELIALL

SEQ ID NO: 4972 - protein, 10 aa, Mycobacterium tuberculosis
DPDELIALLG

SEQ ID NO: 4973 - protein, 10 aa, Mycobacterium tuberculosis
PDELIALLGP

SEQ ID NO: 4974 - protein, 10 aa, Mycobacterium tuberculosis
DELIALLGPV

SEQ ID NO: 4975 - protein, 10 aa, Mycobacterium tuberculosis
ELIALLGPVL

SEQ ID NO: 4976 - protein, 10 aa, Mycobacterium tuberculosis
LIALLGPVLA

SEQ ID NO: 4977 - protein, 10 aa, Mycobacterium tuberculosis
IALLGPVLAD

SEQ ID NO: 4978 - protein, 10 aa, Mycobacterium tuberculosis
ALLGPVLADR

SEQ ID NO: 4979 - protein, 10 aa, Mycobacterium tuberculosis
LLGPVLADRP

SEQ ID NO: 4980 - protein, 10 aa, Mycobacterium tuberculosis
LGPVLADRPA

SEQ ID NO: 4981 - protein, 10 aa, Mycobacterium tuberculosis
GPVLADRPAF

SEQ ID NO: 4982 - protein, 10 aa, Mycobacterium tuberculosis
PVLADRPAFT

SEQ ID NO: 4983 - protein, 10 aa, Mycobacterium tuberculosis
VLADRPAFTG

SEQ ID NO: 4984 - protein, 10 aa, Mycobacterium tuberculosis
LADRPAFTGQ

SEQ ID NO: 4985 - protein, 10 aa, Mycobacterium tuberculosis
ADRPAFTGQP

SEQ ID NO: 4986 - protein, 10 aa, Mycobacterium tuberculosis
DRPAFTGQPT

SEQ ID NO: 4987 - protein, 10 aa, Mycobacterium tuberculosis
RPAFTGQPTD

SEQ ID NO: 4988 - protein, 10 aa, Mycobacterium tuberculosis
PAFTGQPTDA

SEQ ID NO: 4989 - protein, 10 aa, Mycobacterium tuberculosis
AFTGQPTDAL

SEQ ID NO: 4990 - protein, 10 aa, Mycobacterium tuberculosis
FTGQPTDALR

SEQ ID NO: 4991 - protein, 10 aa, Mycobacterium tuberculosis
TGQPTDALRH

SEQ ID NO: 4992 - protein, 10 aa, Mycobacterium tuberculosis
GQPTDALRHL

SEQ ID NO: 4993 - protein, 10 aa, Mycobacterium tuberculosis
QPTDALRHLL

SEQ ID NO: 4994 - protein, 10 aa, Mycobacterium tuberculosis
PTDALRHLLI

SEQ ID NO: 4995 - protein, 10 aa, Mycobacterium tuberculosis
TDALRHLLIV

SEQ ID NO: 4996 - protein, 10 aa, Mycobacterium tuberculosis
DALRHLLIVV

SEQ ID NO: 4997 - protein, 10 aa, Mycobacterium tuberculosis
ALRHLLIVVD

SEQ ID NO: 4998 - protein, 10 aa, Mycobacterium tuberculosis
LRHLLIVVDD

SEQ ID NO: 4999 - protein, 10 aa, Mycobacterium tuberculosis
RHLLIVVDDP

SEQ ID NO: 5000 - protein, 10 aa, Mycobacterium tuberculosis
HLLIVVDDPD

SEQ ID NO: 5001 - protein, 10 aa, Mycobacterium tuberculosis
LLIVVDDPDY

SEQ ID NO: 5002 - protein, 10 aa, Mycobacterium tuberculosis
LIVVDDPDYD

SEQ ID NO: 5003 - protein, 10 aa, Mycobacterium tuberculosis
IVVDDPDYDL

SEQ ID NO: 5004 - protein, 10 aa, Mycobacterium tuberculosis
VVDDPDYDLG

SEQ ID NO: 5005 - protein, 10 aa, Mycobacterium tuberculosis
VDDPDYDLGA

SEQ ID NO: 5006 - protein, 10 aa, Mycobacterium tuberculosis
DDPDYDLGAS

SEQ ID NO: 5007 - protein, 10 aa, Mycobacterium tuberculosis
DPDYDLGASP

SEQ ID NO: 5008 - protein, 10 aa, Mycobacterium tuberculosis
PDYDLGASPL

SEQ ID NO: 5009 - protein, 10 aa, Mycobacterium tuberculosis
DYDLGASPLA

SEQ ID NO: 5010 - protein, 10 aa, Mycobacterium tuberculosis
YDLGASPLAV

SEQ ID NO: 5011 - protein, 10 aa, Mycobacterium tuberculosis
DLGASPLAVG

SEQ ID NO: 5012 - protein, 10 aa, Mycobacterium tuberculosis
LGASPLAVGR

SEQ ID NO: 5013 - protein, 10 aa, Mycobacterium tuberculosis
GASPLAVGRA

SEQ ID NO: 5014 - protein, 10 aa, Mycobacterium tuberculosis
ASPLAVGRAG

SEQ ID NO: 5015 - protein, 10 aa, Mycobacterium tuberculosis
SPLAVGRAGV

SEQ ID NO: 5016 - protein, 10 aa, Mycobacterium tuberculosis
PLAVGRAGVT

SEQ ID NO: 5017 - protein, 10 aa, Mycobacterium tuberculosis
LAVGRAGVTV

SEQ ID NO: 5018 - protein, 10 aa, Mycobacterium tuberculosis
AVGRAGVTVV

SEQ ID NO: 5019 - protein, 10 aa, Mycobacterium tuberculosis
VGRAGVTVVH

SEQ ID NO: 5020 - protein, 10 aa, Mycobacterium tuberculosis
GRAGVTVVHC

SEQ ID NO: 5021 - protein, 10 aa, Mycobacterium tuberculosis
RAGVTVVHCS

SEQ ID NO: 5022 - protein, 10 aa, Mycobacterium tuberculosis
AGVTVVHCSA

SEQ ID NO: 5023 - protein, 10 aa, Mycobacterium tuberculosis
GVTVVHCSAS

SEQ ID NO: 5024 - protein, 10 aa, Mycobacterium tuberculosis
VTVVHCSASA

SEQ ID NO: 5025 - protein, 10 aa, Mycobacterium tuberculosis
TVVHCSASAP

SEQ ID NO: 5026 - protein, 10 aa, Mycobacterium tuberculosis
VVHCSASAPH

SEQ ID NO: 5027 - protein, 10 aa, Mycobacterium tuberculosis
VHCSASAPHR

SEQ ID NO: 5028 - protein, 10 aa, Mycobacterium tuberculosis
HCSASAPHRE

SEQ ID NO: 5029 - protein, 10 aa, Mycobacterium tuberculosis
CSASAPHREQ

SEQ ID NO: 5030 - protein, 10 aa, Mycobacterium tuberculosis
SASAPHREQY

SEQ ID NO: 5031 - protein, 10 aa, Mycobacterium tuberculosis
ASAPHREQYS

SEQ ID NO: 5032 - protein, 10 aa, Mycobacterium tuberculosis
SAPHREQYSD

SEQ ID NO: 5033 - protein, 10 aa, Mycobacterium tuberculosis
APHREQYSDP

SEQ ID NO: 5034 - protein, 10 aa, Mycobacterium tuberculosis
PHREQYSDPE

SEQ ID NO: 5035 - protein, 10 aa, Mycobacterium tuberculosis
HREQYSDPEK

SEQ ID NO: 5036 - protein, 10 aa, Mycobacterium tuberculosis
REQYSDPEKP

SEQ ID NO: 5037 - protein, 10 aa, Mycobacterium tuberculosis
EQYSDPEKPI

SEQ ID NO: 5038 - protein, 10 aa, Mycobacterium tuberculosis
QYSDPEKPIL

SEQ ID NO: 5039 - protein, 10 aa, Mycobacterium tuberculosis
YSDPEKPILR

SEQ ID NO: 5040 - protein, 10 aa, Mycobacterium tuberculosis
SDPEKPILRV

SEQ ID NO: 5041 - protein, 10 aa, Mycobacterium tuberculosis
DPEKPILRVA

SEQ ID NO: 5042 - protein, 10 aa, Mycobacterium tuberculosis
PEKPILRVAH

SEQ ID NO: 5043 - protein, 10 aa, Mycobacterium tuberculosis
EKPILRVAHG

SEQ ID NO: 5044 - protein, 10 aa, Mycobacterium tuberculosis
KPILRVAHGA

SEQ ID NO: 5045 - protein, 10 aa, Mycobacterium tuberculosis
PILRVAHGAI

SEQ ID NO: 5046 - protein, 10 aa, Mycobacterium tuberculosis
ILRVAHGAIE

SEQ ID NO: 5047 - protein, 10 aa, Mycobacterium tuberculosis
LRVAHGAIER

SEQ ID NO: 5048 - protein, 10 aa, Mycobacterium tuberculosis
RVAHGAIERW

SEQ ID NO: 5049 - protein, 10 aa, Mycobacterium tuberculosis
VAHGAIERWQ

SEQ ID NO: 5050 - protein, 10 aa, Mycobacterium tuberculosis
AHGAIERWQT

SEQ ID NO: 5051 - protein, 10 aa, Mycobacterium tuberculosis
HGAIERWQTG

SEQ ID NO: 5052 - protein, 10 aa, Mycobacterium tuberculosis
GAIERWQTGG

SEQ ID NO: 5053 - protein, 10 aa, Mycobacterium tuberculosis
AIERWQTGGW

SEQ ID NO: 5054 - protein, 10 aa, Mycobacterium tuberculosis
IERWQTGGWQ

SEQ ID NO: 5055 - protein, 10 aa, Mycobacterium tuberculosis
ERWQTGGWQP

SEQ ID NO: 5056 - protein, 10 aa, Mycobacterium tuberculosis
RWQTGGWQPY

SEQ ID NO: 5057 - protein, 10 aa, Mycobacterium tuberculosis
WQTGGWQPYI

SEQ ID NO: 5058 - protein, 10 aa, Mycobacterium tuberculosis
QTGGWQPYID

SEQ ID NO: 5059 - protein, 10 aa, Mycobacterium tuberculosis
TGGWQPYIDA

SEQ ID NO: 5060 - protein, 10 aa, Mycobacterium tuberculosis
GGWQPYIDAA

SEQ ID NO: 5061 - protein, 10 aa, Mycobacterium tuberculosis
GWQPYIDAAD

SEQ ID NO: 5062 - protein, 10 aa, Mycobacterium tuberculosis
WQPYIDAADQ

SEQ ID NO: 5063 - protein, 10 aa, Mycobacterium tuberculosis
QPYIDAADQF

SEQ ID NO: 5064 - protein, 10 aa, Mycobacterium tuberculosis
PYIDAADQFS

SEQ ID NO: 5065 - protein, 10 aa, Mycobacterium tuberculosis
YIDAADQFSA

SEQ ID NO: 5066 - protein, 10 aa, Mycobacterium tuberculosis
IDAADQFSAD

SEQ ID NO: 5067 - protein, 10 aa, Mycobacterium tuberculosis
DAADQFSADE

SEQ ID NO: 5068 - protein, 10 aa, Mycobacterium tuberculosis
AADQFSADEA

SEQ ID NO: 5069 - protein, 10 aa, Mycobacterium tuberculosis
ADQFSADEAA

SEQ ID NO: 5070 - protein, 10 aa, Mycobacterium tuberculosis
DQFSADEAAH

SEQ ID NO: 5071 - protein, 10 aa, Mycobacterium tuberculosis
QFSADEAAHL

SEQ ID NO: 5072 - protein, 10 aa, Mycobacterium tuberculosis
FSADEAAHLA

SEQ ID NO: 5073 - protein, 10 aa, Mycobacterium tuberculosis
SADEAAHLAR

SEQ ID NO: 5074 - protein, 10 aa, Mycobacterium tuberculosis
ADEAAHLARR

SEQ ID NO: 5075 - protein, 10 aa, Mycobacterium tuberculosis
DEAAHLARRL

SEQ ID NO: 5076 - protein, 10 aa, Mycobacterium tuberculosis
EAAHLARRLS

SEQ ID NO: 5077 - protein, 10 aa, Mycobacterium tuberculosis
AAHLARRLSR

SEQ ID NO: 5078 - protein, 10 aa, Mycobacterium tuberculosis
AHLARRLSRW

SEQ ID NO: 5079 - protein, 10 aa, Mycobacterium tuberculosis
HLARRLSRWD

SEQ ID NO: 5080 - protein, 10 aa, Mycobacterium tuberculosis
LARRLSRWDS

SEQ ID NO: 5081 - protein, 10 aa, Mycobacterium tuberculosis
ARRLSRWDSN

SEQ ID NO: 5082 - protein, 10 aa, Mycobacterium tuberculosis
RRLSRWDSNP

SEQ ID NO: 5083 - protein, 10 aa, Mycobacterium tuberculosis
RLSRWDSNPT

SEQ ID NO: 5084 - protein, 10 aa, Mycobacterium tuberculosis
LSRWDSNPTH

SEQ ID NO: 5085 - protein, 10 aa, Mycobacterium tuberculosis
SRWDSNPTHA

SEQ ID NO: 5086 - protein, 10 aa, Mycobacterium tuberculosis
RWDSNPTHAG

SEQ ID NO: 5087 - protein, 10 aa, Mycobacterium tuberculosis
WDSNPTHAGL

SEQ ID NO: 5088 - protein, 10 aa, Mycobacterium tuberculosis
DSNPTHAGLR

SEQ ID NO: 5089 - protein, 10 aa, Mycobacterium tuberculosis
SNPTHAGLRS

SEQ ID NO: 5090 - protein, 10 aa, Mycobacterium tuberculosis
NPTHAGLRSA

SEQ ID NO: 5091 - protein, 10 aa, Mycobacterium tuberculosis
PTHAGLRSAA

SEQ ID NO: 5092 - protein, 10 aa, Mycobacterium tuberculosis
THAGLRSAAT

SEQ ID NO: 5093 - protein, 10 aa, Mycobacterium tuberculosis
HAGLRSAATR

SEQ ID NO: 5094 - protein, 10 aa, Mycobacterium tuberculosis
AGLRSAATRG

SEQ ID NO: 5095 - protein, 10 aa, Mycobacterium tuberculosis
GLRSAATRGA

SEQ ID NO: 5096 - protein, 10 aa, Mycobacterium tuberculosis
LRSAATRGAS

SEQ ID NO: 5097 - protein, 10 aa, Mycobacterium tuberculosis
RSAATRGASF

SEQ ID NO: 5098 - protein, 10 aa, Mycobacterium tuberculosis
SAATRGASFT

SEQ ID NO: 5099 - protein, 10 aa, Mycobacterium tuberculosis
AATRGASFTT

SEQ ID NO: 5100 - protein, 10 aa, Mycobacterium tuberculosis
ATRGASFTTL

SEQ ID NO: 5101 - protein, 10 aa, Mycobacterium tuberculosis
TRGASFTTLL

SEQ ID NO: 5102 - protein, 10 aa, Mycobacterium tuberculosis
RGASFTTLLG

SEQ ID NO: 5103 - protein, 10 aa, Mycobacterium tuberculosis
GASFTTLLGI

SEQ ID NO: 5104 - protein, 10 aa, Mycobacterium tuberculosis
ASFTTLLGIE

SEQ ID NO: 5105 - protein, 10 aa, Mycobacterium tuberculosis
SFTTLLGIED

SEQ ID NO: 5106 - protein, 10 aa, Mycobacterium tuberculosis
FTTLLGIEDA

SEQ ID NO: 5107 - protein, 10 aa, Mycobacterium tuberculosis
TTLLGIEDAS

SEQ ID NO: 5108 - protein, 10 aa, Mycobacterium tuberculosis
TLLGIEDASR

SEQ ID NO: 5109 - protein, 10 aa, Mycobacterium tuberculosis
LLGIEDASRL

SEQ ID NO: 5110 - protein, 10 aa, Mycobacterium tuberculosis
LGIEDASRLD

SEQ ID NO: 5111 - protein, 10 aa, Mycobacterium tuberculosis
GIEDASRLDV

SEQ ID NO: 5112 - protein, 10 aa, Mycobacterium tuberculosis
IEDASRLDVP

SEQ ID NO: 5113 - protein, 10 aa, Mycobacterium tuberculosis
EDASRLDVPA

SEQ ID NO: 5114 - protein, 10 aa, Mycobacterium tuberculosis
DASRLDVPAL

SEQ ID NO: 5115 - protein, 10 aa, Mycobacterium tuberculosis
ASRLDVPALW

SEQ ID NO: 5116 - protein, 10 aa, Mycobacterium tuberculosis
SRLDVPALWA

SEQ ID NO: 5117 - protein, 10 aa, Mycobacterium tuberculosis
RLDVPALWAP

SEQ ID NO: 5118 - protein, 10 aa, Mycobacterium tuberculosis
LDVPALWAPR

SEQ ID NO: 5119 - protein, 10 aa, Mycobacterium tuberculosis
DVPALWAPRR

SEQ ID NO: 5120 - protein, 10 aa, Mycobacterium tuberculosis
VPALWAPRRR

SEQ ID NO: 5121 - protein, 10 aa, Mycobacterium tuberculosis
PALWAPRRRD

SEQ ID NO: 5122 - protein, 10 aa, Mycobacterium tuberculosis
ALWAPRRRDE

SEQ ID NO: 5123 - protein, 10 aa, Mycobacterium tuberculosis
LWAPRRRDEE

SEQ ID NO: 5124 - protein, 10 aa, Mycobacterium tuberculosis
WAPRRRDEEL

SEQ ID NO: 5125 - protein, 10 aa, Mycobacterium tuberculosis
APRRRDEELR

SEQ ID NO: 5126 - protein, 10 aa, Mycobacterium tuberculosis
PRRRDEELRV

SEQ ID NO: 5127 - protein, 10 aa, Mycobacterium tuberculosis
RRRDEELRVP

SEQ ID NO: 5128 - protein, 10 aa, Mycobacterium tuberculosis
RRDEELRVPI

SEQ ID NO: 5129 - protein, 10 aa, Mycobacterium tuberculosis
RDEELRVPIG

SEQ ID NO: 5130 - protein, 10 aa, Mycobacterium tuberculosis
DEELRVPIGV

SEQ ID NO: 5131 - protein, 10 aa, Mycobacterium tuberculosis
EELRVPIGVT

SEQ ID NO: 5132 - protein, 10 aa, Mycobacterium tuberculosis
ELRVPIGVTG

SEQ ID NO: 5133 - protein, 10 aa, Mycobacterium tuberculosis
LRVPIGVTGT

SEQ ID NO: 5134 - protein, 10 aa, Mycobacterium tuberculosis
RVPIGVTGTG

SEQ ID NO: 5135 - protein, 10 aa, Mycobacterium tuberculosis
VPIGVTGTGE

SEQ ID NO: 5136 - protein, 10 aa, Mycobacterium tuberculosis
PIGVTGTGEP

SEQ ID NO: 5137 - protein, 10 aa, Mycobacterium tuberculosis
IGVTGTGEPL

SEQ ID NO: 5138 - protein, 10 aa, Mycobacterium tuberculosis
GVTGTGEPLM

SEQ ID NO: 5139 - protein, 10 aa, Mycobacterium tuberculosis
VTGTGEPLMF

SEQ ID NO: 5140 - protein, 10 aa, Mycobacterium tuberculosis
TGTGEPLMFD

SEQ ID NO: 5141 - protein, 10 aa, Mycobacterium tuberculosis
GTGEPLMFDL

SEQ ID NO: 5142 - protein, 10 aa, Mycobacterium tuberculosis
TGEPLMFDLK

SEQ ID NO: 5143 - protein, 10 aa, Mycobacterium tuberculosis
GEPLMFDLKD

SEQ ID NO: 5144 - protein, 10 aa, Mycobacterium tuberculosis
EPLMFDLKDE

SEQ ID NO: 5145 - protein, 10 aa, Mycobacterium tuberculosis
PLMFDLKDEA

SEQ ID NO: 5146 - protein, 10 aa, Mycobacterium tuberculosis
LMFDLKDEAE

SEQ ID NO: 5147 - protein, 10 aa, Mycobacterium tuberculosis
MFDLKDEAEG

SEQ ID NO: 5148 - protein, 10 aa, Mycobacterium tuberculosis
FDLKDEAEGG

SEQ ID NO: 5149 - protein, 10 aa, Mycobacterium tuberculosis
DLKDEAEGGM

SEQ ID NO: 5150 - protein, 10 aa, Mycobacterium tuberculosis
LKDEAEGGMG

SEQ ID NO: 5151 - protein, 10 aa, Mycobacterium tuberculosis
KDEAEGGMGP

SEQ ID NO: 5152 - protein, 10 aa, Mycobacterium tuberculosis
DEAEGGMGPH

SEQ ID NO: 5153 - protein, 10 aa, Mycobacterium tuberculosis
EAEGGMGPHG

SEQ ID NO: 5154 - protein, 10 aa, Mycobacterium tuberculosis
AEGGMGPHGL

SEQ ID NO: 5155 - protein, 10 aa, Mycobacterium tuberculosis
EGGMGPHGLM

SEQ ID NO: 5156 - protein, 10 aa, Mycobacterium tuberculosis
GGMGPHGLMI

SEQ ID NO: 5157 - protein, 10 aa, Mycobacterium tuberculosis
GMGPHGLMIG

SEQ ID NO: 5158 - protein, 10 aa, Mycobacterium tuberculosis
MGPHGLMIGM

SEQ ID NO: 5159 - protein, 10 aa, Mycobacterium tuberculosis
GPHGLMIGMT

SEQ ID NO: 5160 - protein, 10 aa, Mycobacterium tuberculosis
PHGLMIGMTG

SEQ ID NO: 5161 - protein, 10 aa, Mycobacterium tuberculosis
HGLMIGMTGS

SEQ ID NO: 5162 - protein, 10 aa, Mycobacterium tuberculosis
GLMIGMTGSG

SEQ ID NO: 5163 - protein, 10 aa, Mycobacterium tuberculosis
LMIGMTGSGK

SEQ ID NO: 5164 - protein, 10 aa, Mycobacterium tuberculosis
MIGMTGSGKS

SEQ ID NO: 5165 - protein, 10 aa, Mycobacterium tuberculosis
IGMTGSGKSQ

SEQ ID NO: 5166 - protein, 10 aa, Mycobacterium tuberculosis
GMTGSGKSQT

SEQ ID NO: 5167 - protein, 10 aa, Mycobacterium tuberculosis
MTGSGKSQTL

SEQ ID NO: 5168 - protein, 10 aa, Mycobacterium tuberculosis
TGSGKSQTLM

SEQ ID NO: 5169 - protein, 10 aa, Mycobacterium tuberculosis
GSGKSQTLMS

SEQ ID NO: 5170 - protein, 10 aa, Mycobacterium tuberculosis
SGKSQTLMSI

SEQ ID NO: 5171 - protein, 10 aa, Mycobacterium tuberculosis
GKSQTLMSIL

SEQ ID NO: 5172 - protein, 10 aa, Mycobacterium tuberculosis
KSQTLMSILL

SEQ ID NO: 5173 - protein, 10 aa, Mycobacterium tuberculosis
SQTLMSILLS

SEQ ID NO: 5174 - protein, 10 aa, Mycobacterium tuberculosis
QTLMSILLSL

SEQ ID NO: 5175 - protein, 10 aa, Mycobacterium tuberculosis
TLMSILLSLL

SEQ ID NO: 5176 - protein, 10 aa, Mycobacterium tuberculosis
LMSILLSLLT

SEQ ID NO: 5177 - protein, 10 aa, Mycobacterium tuberculosis
MSILLSLLTT

SEQ ID NO: 5178 - protein, 10 aa, Mycobacterium tuberculosis
SILLSLLTTH

SEQ ID NO: 5179 - protein, 10 aa, Mycobacterium tuberculosis
ILLSLLTTHS

SEQ ID NO: 5180 - protein, 10 aa, Mycobacterium tuberculosis
LLSLLTTHSA

SEQ ID NO: 5181 - protein, 10 aa, Mycobacterium tuberculosis
LSLLTTHSAE

SEQ ID NO: 5182 - protein, 10 aa, Mycobacterium tuberculosis
SLLTTHSAER

SEQ ID NO: 5183 - protein, 10 aa, Mycobacterium tuberculosis
LLTTHSAERL

SEQ ID NO: 5184 - protein, 10 aa, Mycobacterium tuberculosis
LTTHSAERLI

SEQ ID NO: 5185 - protein, 10 aa, Mycobacterium tuberculosis
TTHSAERLIV

SEQ ID NO: 5186 - protein, 10 aa, Mycobacterium tuberculosis
THSAERLIVI

SEQ ID NO: 5187 - protein, 10 aa, Mycobacterium tuberculosis
HSAERLIVIY

SEQ ID NO: 5188 - protein, 10 aa, Mycobacterium tuberculosis
SAERLIVIYA

SEQ ID NO: 5189 - protein, 10 aa, Mycobacterium tuberculosis
AERLIVIYAD

SEQ ID NO: 5190 - protein, 10 aa, Mycobacterium tuberculosis
ERLIVIYADF

SEQ ID NO: 5191 - protein, 10 aa, Mycobacterium tuberculosis
RLIVIYADFK

SEQ ID NO: 5192 - protein, 10 aa, Mycobacterium tuberculosis
LIVIYADFKG

SEQ ID NO: 5193 - protein, 10 aa, Mycobacterium tuberculosis
IVIYADFKGE

SEQ ID NO: 5194 - protein, 10 aa, Mycobacterium tuberculosis
VIYADFKGEA

SEQ ID NO: 5195 - protein, 10 aa, Mycobacterium tuberculosis
IYADFKGEAG

SEQ ID NO: 5196 - protein, 10 aa, Mycobacterium tuberculosis
YADFKGEAGA

SEQ ID NO: 5197 - protein, 10 aa, Mycobacterium tuberculosis
ADFKGEAGAD

SEQ ID NO: 5198 - protein, 10 aa, Mycobacterium tuberculosis
DFKGEAGADS

SEQ ID NO: 5199 - protein, 10 aa, Mycobacterium tuberculosis
FKGEAGADSF

SEQ ID NO: 5200 - protein, 10 aa, Mycobacterium tuberculosis
KGEAGADSFR

SEQ ID NO: 5201 - protein, 10 aa, Mycobacterium tuberculosis
GEAGADSFRD

SEQ ID NO: 5202 - protein, 10 aa, Mycobacterium tuberculosis
EAGADSFRDF

SEQ ID NO: 5203 - protein, 10 aa, Mycobacterium tuberculosis
AGADSFRDFP

SEQ ID NO: 5204 - protein, 10 aa, Mycobacterium tuberculosis
GADSFRDFPQ

SEQ ID NO: 5205 - protein, 10 aa, Mycobacterium tuberculosis
ADSFRDFPQV

SEQ ID NO: 5206 - protein, 10 aa, Mycobacterium tuberculosis
DSFRDFPQVV

SEQ ID NO: 5207 - protein, 10 aa, Mycobacterium tuberculosis
SFRDFPQVVA

SEQ ID NO: 5208 - protein, 10 aa, Mycobacterium tuberculosis
FRDFPQVVAV

SEQ ID NO: 5209 - protein, 10 aa, Mycobacterium tuberculosis
RDFPQVVAVI

SEQ ID NO: 5210 - protein, 10 aa, Mycobacterium tuberculosis
DFPQVVAVIS

SEQ ID NO: 5211 - protein, 10 aa, Mycobacterium tuberculosis
FPQVVAVISN

SEQ ID NO: 5212 - protein, 10 aa, Mycobacterium tuberculosis
PQVVAVISNM

SEQ ID NO: 5213 - protein, 10 aa, Mycobacterium tuberculosis
QVVAVISNMA

SEQ ID NO: 5214 - protein, 10 aa, Mycobacterium tuberculosis
VVAVISNMAE

SEQ ID NO: 5215 - protein, 10 aa, Mycobacterium tuberculosis
VAVISNMAEK

SEQ ID NO: 5216 - protein, 10 aa, Mycobacterium tuberculosis
AVISNMAEKK

SEQ ID NO: 5217 - protein, 10 aa, Mycobacterium tuberculosis
VISNMAEKKS

SEQ ID NO: 5218 - protein, 10 aa, Mycobacterium tuberculosis
ISNMAEKKSL

SEQ ID NO: 5219 - protein, 10 aa, Mycobacterium tuberculosis
SNMAEKKSLA

SEQ ID NO: 5220 - protein, 10 aa, Mycobacterium tuberculosis
NMAEKKSLAD

SEQ ID NO: 5221 - protein, 10 aa, Mycobacterium tuberculosis
MAEKKSLADR

SEQ ID NO: 5222 - protein, 10 aa, Mycobacterium tuberculosis
AEKKSLADRF

SEQ ID NO: 5223 - protein, 10 aa, Mycobacterium tuberculosis
EKKSLADRFA

SEQ ID NO: 5224 - protein, 10 aa, Mycobacterium tuberculosis
KKSLADRFAD

SEQ ID NO: 5225 - protein, 10 aa, Mycobacterium tuberculosis
KSLADRFADT

SEQ ID NO: 5226 - protein, 10 aa, Mycobacterium tuberculosis
SLADRFADTL

SEQ ID NO: 5227 - protein, 10 aa, Mycobacterium tuberculosis
LADRFADTLR

SEQ ID NO: 5228 - protein, 10 aa, Mycobacterium tuberculosis
ADRFADTLRG

SEQ ID NO: 5229 - protein, 10 aa, Mycobacterium tuberculosis
DRFADTLRGE

SEQ ID NO: 5230 - protein, 10 aa, Mycobacterium tuberculosis
RFADTLRGEV

SEQ ID NO: 5231 - protein, 10 aa, Mycobacterium tuberculosis
FADTLRGEVA

SEQ ID NO: 5232 - protein, 10 aa, Mycobacterium tuberculosis
ADTLRGEVAR

SEQ ID NO: 5233 - protein, 10 aa, Mycobacterium tuberculosis
DTLRGEVARR

SEQ ID NO: 5234 - protein, 10 aa, Mycobacterium tuberculosis
TLRGEVARRE

SEQ ID NO: 5235 - protein, 10 aa, Mycobacterium tuberculosis
LRGEVARREM

SEQ ID NO: 5236 - protein, 10 aa, Mycobacterium tuberculosis
RGEVARREML

SEQ ID NO: 5237 - protein, 10 aa, Mycobacterium tuberculosis
GEVARREMLL

SEQ ID NO: 5238 - protein, 10 aa, Mycobacterium tuberculosis
EVARREMLLR

SEQ ID NO: 5239 - protein, 10 aa, Mycobacterium tuberculosis
VARREMLLRE

SEQ ID NO: 5240 - protein, 10 aa, Mycobacterium tuberculosis
ARREMLLREA

SEQ ID NO: 5241 - protein, 10 aa, Mycobacterium tuberculosis
RREMLLREAG

SEQ ID NO: 5242 - protein, 10 aa, Mycobacterium tuberculosis
REMLLREAGR

SEQ ID NO: 5243 - protein, 10 aa, Mycobacterium tuberculosis
EMLLREAGRK

SEQ ID NO: 5244 - protein, 10 aa, Mycobacterium tuberculosis
MLLREAGRKV

SEQ ID NO: 5245 - protein, 10 aa, Mycobacterium tuberculosis
LLREAGRKVQ

SEQ ID NO: 5246 - protein, 10 aa, Mycobacterium tuberculosis
LREAGRKVQG

SEQ ID NO: 5247 - protein, 10 aa, Mycobacterium tuberculosis
REAGRKVQGS

SEQ ID NO: 5248 - protein, 10 aa, Mycobacterium tuberculosis
EAGRKVQGSA

SEQ ID NO: 5249 - protein, 10 aa, Mycobacterium tuberculosis
AGRKVQGSAF

SEQ ID NO: 5250 - protein, 10 aa, Mycobacterium tuberculosis
GRKVQGSAFN

SEQ ID NO: 5251 - protein, 10 aa, Mycobacterium tuberculosis
RKVQGSAFNS

SEQ ID NO: 5252 - protein, 10 aa, Mycobacterium tuberculosis
KVQGSAFNSV

SEQ ID NO: 5253 - protein, 10 aa, Mycobacterium tuberculosis
VQGSAFNSVL

SEQ ID NO: 5254 - protein, 10 aa, Mycobacterium tuberculosis
QGSAFNSVLE

SEQ ID NO: 5255 - protein, 10 aa, Mycobacterium tuberculosis
GSAFNSVLEY

SEQ ID NO: 5256 - protein, 10 aa, Mycobacterium tuberculosis
SAFNSVLEYE

SEQ ID NO: 5257 - protein, 10 aa, Mycobacterium tuberculosis
AFNSVLEYEN

SEQ ID NO: 5258 - protein, 10 aa, Mycobacterium tuberculosis
FNSVLEYENA

SEQ ID NO: 5259 - protein, 10 aa, Mycobacterium tuberculosis
NSVLEYENAI

SEQ ID NO: 5260 - protein, 10 aa, Mycobacterium tuberculosis
SVLEYENAIA

SEQ ID NO: 5261 - protein, 10 aa, Mycobacterium tuberculosis
VLEYENAIAA

SEQ ID NO: 5262 - protein, 10 aa, Mycobacterium tuberculosis
LEYENAIAAG

SEQ ID NO: 5263 - protein, 10 aa, Mycobacterium tuberculosis
EYENAIAAGH

SEQ ID NO: 5264 - protein, 10 aa, Mycobacterium tuberculosis
YENAIAAGHS

SEQ ID NO: 5265 - protein, 10 aa, Mycobacterium tuberculosis
ENAIAAGHSL

SEQ ID NO: 5266 - protein, 10 aa, Mycobacterium tuberculosis
NAIAAGHSLP

SEQ ID NO: 5267 - protein, 10 aa, Mycobacterium tuberculosis
AIAAGHSLPP

SEQ ID NO: 5268 - protein, 10 aa, Mycobacterium tuberculosis
IAAGHSLPPI

SEQ ID NO: 5269 - protein, 10 aa, Mycobacterium tuberculosis
AAGHSLPPIP

SEQ ID NO: 5270 - protein, 10 aa, Mycobacterium tuberculosis
AGHSLPPIPT

SEQ ID NO: 5271 - protein, 10 aa, Mycobacterium tuberculosis
GHSLPPIPTL

SEQ ID NO: 5272 - protein, 10 aa, Mycobacterium tuberculosis
HSLPPIPTLF

SEQ ID NO: 5273 - protein, 10 aa, Mycobacterium tuberculosis
SLPPIPTLFV

SEQ ID NO: 5274 - protein, 10 aa, Mycobacterium tuberculosis
LPPIPTLFVV

SEQ ID NO: 5275 - protein, 10 aa, Mycobacterium tuberculosis
PPIPTLFVVA

SEQ ID NO: 5276 - protein, 10 aa, Mycobacterium tuberculosis
PIPTLFVVAD

SEQ ID NO: 5277 - protein, 10 aa, Mycobacterium tuberculosis
IPTLFVVADE

SEQ ID NO: 5278 - protein, 10 aa, Mycobacterium tuberculosis
PTLFVVADEF

SEQ ID NO: 5279 - protein, 10 aa, Mycobacterium tuberculosis
TLFVVADEFT

SEQ ID NO: 5280 - protein, 10 aa, Mycobacterium tuberculosis
LFVVADEFTL

SEQ ID NO: 5281 - protein, 10 aa, Mycobacterium tuberculosis
FVVADEFTLM

SEQ ID NO: 5282 - protein, 10 aa, Mycobacterium tuberculosis
VVADEFTLML

SEQ ID NO: 5283 - protein, 10 aa, Mycobacterium tuberculosis
VADEFTLMLA

SEQ ID NO: 5284 - protein, 10 aa, Mycobacterium tuberculosis
ADEFTLMLAD

SEQ ID NO: 5285 - protein, 10 aa, Mycobacterium tuberculosis
DEFTLMLADH

SEQ ID NO: 5286 - protein, 10 aa, Mycobacterium tuberculosis
EFTLMLADHP

SEQ ID NO: 5287 - protein, 10 aa, Mycobacterium tuberculosis
FTLMLADHPE

SEQ ID NO: 5288 - protein, 10 aa, Mycobacterium tuberculosis
TLMLADHPEY

SEQ ID NO: 5289 - protein, 10 aa, Mycobacterium tuberculosis
LMLADHPEYA

SEQ ID NO: 5290 - protein, 10 aa, Mycobacterium tuberculosis
MLADHPEYAE

SEQ ID NO: 5291 - protein, 10 aa, Mycobacterium tuberculosis
LADHPEYAEL

SEQ ID NO: 5292 - protein, 10 aa, Mycobacterium tuberculosis
ADHPEYAELF

SEQ ID NO: 5293 - protein, 10 aa, Mycobacterium tuberculosis
DHPEYAELFD

SEQ ID NO: 5294 - protein, 10 aa, Mycobacterium tuberculosis
HPEYAELFDY

SEQ ID NO: 5295 - protein, 10 aa, Mycobacterium tuberculosis
PEYAELFDYV

SEQ ID NO: 5296 - protein, 10 aa, Mycobacterium tuberculosis
EYAELFDYVA

SEQ ID NO: 5297 - protein, 10 aa, Mycobacterium tuberculosis
YAELFDYVAR

SEQ ID NO: 5298 - protein, 10 aa, Mycobacterium tuberculosis
AELFDYVARK

SEQ ID NO: 5299 - protein, 10 aa, Mycobacterium tuberculosis
ELFDYVARKG

SEQ ID NO: 5300 - protein, 10 aa, Mycobacterium tuberculosis
LFDYVARKGR

SEQ ID NO: 5301 - protein, 10 aa, Mycobacterium tuberculosis
FDYVARKGRS

SEQ ID NO: 5302 - protein, 10 aa, Mycobacterium tuberculosis
DYVARKGRSF

SEQ ID NO: 5303 - protein, 10 aa, Mycobacterium tuberculosis
YVARKGRSFR

SEQ ID NO: 5304 - protein, 10 aa, Mycobacterium tuberculosis
VARKGRSFRI

SEQ ID NO: 5305 - protein, 10 aa, Mycobacterium tuberculosis
ARKGRSFRIH

SEQ ID NO: 5306 - protein, 10 aa, Mycobacterium tuberculosis
RKGRSFRIHI

SEQ ID NO: 5307 - protein, 10 aa, Mycobacterium tuberculosis
KGRSFRIHIL

SEQ ID NO: 5308 - protein, 10 aa, Mycobacterium tuberculosis
GRSFRIHILF

SEQ ID NO: 5309 - protein, 10 aa, Mycobacterium tuberculosis
RSFRIHILFA

SEQ ID NO: 5310 - protein, 10 aa, Mycobacterium tuberculosis
SFRIHILFAS

SEQ ID NO: 5311 - protein, 10 aa, Mycobacterium tuberculosis
FRIHILFASQ

SEQ ID NO: 5312 - protein, 10 aa, Mycobacterium tuberculosis
RIHILFASQT

SEQ ID NO: 5313 - protein, 10 aa, Mycobacterium tuberculosis
IHILFASQTL

SEQ ID NO: 5314 - protein, 10 aa, Mycobacterium tuberculosis
HILFASQTLD

SEQ ID NO: 5315 - protein, 10 aa, Mycobacterium tuberculosis
ILFASQTLDV

SEQ ID NO: 5316 - protein, 10 aa, Mycobacterium tuberculosis
LFASQTLDVG

SEQ ID NO: 5317 - protein, 10 aa, Mycobacterium tuberculosis
FASQTLDVGK

SEQ ID NO: 5318 - protein, 10 aa, Mycobacterium tuberculosis
ASQTLDVGKI

SEQ ID NO: 5319 - protein, 10 aa, Mycobacterium tuberculosis
SQTLDVGKIK

SEQ ID NO: 5320 - protein, 10 aa, Mycobacterium tuberculosis
QTLDVGKIKD

SEQ ID NO: 5321 - protein, 10 aa, Mycobacterium tuberculosis
TLDVGKIKDI

SEQ ID NO: 5322 - protein, 10 aa, Mycobacterium tuberculosis
LDVGKIKDID

SEQ ID NO: 5323 - protein, 10 aa, Mycobacterium tuberculosis
DVGKIKDIDK

SEQ ID NO: 5324 - protein, 10 aa, Mycobacterium tuberculosis
VGKIKDIDKN

SEQ ID NO: 5325 - protein, 10 aa, Mycobacterium tuberculosis
GKIKDIDKNT

SEQ ID NO: 5326 - protein, 10 aa, Mycobacterium tuberculosis
KIKDIDKNTA

SEQ ID NO: 5327 - protein, 10 aa, Mycobacterium tuberculosis
IKDIDKNTAY

SEQ ID NO: 5328 - protein, 10 aa, Mycobacterium tuberculosis
KDIDKNTAYR

SEQ ID NO: 5329 - protein, 10 aa, Mycobacterium tuberculosis
DIDKNTAYRI

SEQ ID NO: 5330 - protein, 10 aa, Mycobacterium tuberculosis
IDKNTAYRIG

SEQ ID NO: 5331 - protein, 10 aa, Mycobacterium tuberculosis
DKNTAYRIGL

SEQ ID NO: 5332 - protein, 10 aa, Mycobacterium tuberculosis
KNTAYRIGLK

SEQ ID NO: 5333 - protein, 10 aa, Mycobacterium tuberculosis
NTAYRIGLKV

SEQ ID NO: 5334 - protein, 10 aa, Mycobacterium tuberculosis
TAYRIGLKVA

SEQ ID NO: 5335 - protein, 10 aa, Mycobacterium tuberculosis
AYRIGLKVAS

SEQ ID NO: 5336 - protein, 10 aa, Mycobacterium tuberculosis
YRIGLKVASP

SEQ ID NO: 5337 - protein, 10 aa, Mycobacterium tuberculosis
RIGLKVASPS

SEQ ID NO: 5338 - protein, 10 aa, Mycobacterium tuberculosis
IGLKVASPSV

SEQ ID NO: 5339 - protein, 10 aa, Mycobacterium tuberculosis
GLKVASPSVS

SEQ ID NO: 5340 - protein, 10 aa, Mycobacterium tuberculosis
LKVASPSVSR

SEQ ID NO: 5341 - protein, 10 aa, Mycobacterium tuberculosis
KVASPSVSRQ

SEQ ID NO: 5342 - protein, 10 aa, Mycobacterium tuberculosis
VASPSVSRQI

SEQ ID NO: 5343 - protein, 10 aa, Mycobacterium tuberculosis
ASPSVSRQII

SEQ ID NO: 5344 - protein, 10 aa, Mycobacterium tuberculosis
SPSVSRQIIG

SEQ ID NO: 5345 - protein, 10 aa, Mycobacterium tuberculosis
PSVSRQIIGV

SEQ ID NO: 5346 - protein, 10 aa, Mycobacterium tuberculosis
SVSRQIIGVE

SEQ ID NO: 5347 - protein, 10 aa, Mycobacterium tuberculosis
VSRQIIGVED

SEQ ID NO: 5348 - protein, 10 aa, Mycobacterium tuberculosis
SRQIIGVEDA

SEQ ID NO: 5349 - protein, 10 aa, Mycobacterium tuberculosis
RQIIGVEDAY

SEQ ID NO: 5350 - protein, 10 aa, Mycobacterium tuberculosis
QIIGVEDAYH

SEQ ID NO: 5351 - protein, 10 aa, Mycobacterium tuberculosis
IIGVEDAYHI

SEQ ID NO: 5352 - protein, 10 aa, Mycobacterium tuberculosis
IGVEDAYHIE

SEQ ID NO: 5353 - protein, 10 aa, Mycobacterium tuberculosis
GVEDAYHIES

SEQ ID NO: 5354 - protein, 10 aa, Mycobacterium tuberculosis
VEDAYHIESG

SEQ ID NO: 5355 - protein, 10 aa, Mycobacterium tuberculosis
EDAYHIESGK

SEQ ID NO: 5356 - protein, 10 aa, Mycobacterium tuberculosis
DAYHIESGKE

SEQ ID NO: 5357 - protein, 10 aa, Mycobacterium tuberculosis
AYHIESGKEH

SEQ ID NO: 5358 - protein, 10 aa, Mycobacterium tuberculosis
YHIESGKEHK

SEQ ID NO: 5359 - protein, 10 aa, Mycobacterium tuberculosis
HIESGKEHKG

SEQ ID NO: 5360 - protein, 10 aa, Mycobacterium tuberculosis
IESGKEHKGV

(The sequence listing continues in the following parts.)

---

The invention claimed is:

1. A composition comprising a plurality of soluble MHC multimers wherein, each MHC multimer comprises (a-b-P) n, wherein n>4, wherein a and b together form a functional MHC protein capable of binding the peptides P, wherein (a-b-P) is the MHC-peptide complex formed when the peptide P binds to the functional MHC protein, wherein each MHC-peptide complex of each MHC multimer is associated with one or more multimerization domains selected from the group consisting of polysaccharides, dextran moieties, coiled-coil polypeptide structures, avidins, streptavidins and antibodies, wherein each MHC protein is an HLA-A*0201 allele, and wherein the composition comprises at least one multimer wherein each P is SEQ ID NO: 12637, at least one multimer wherein each P is SEQ ID NO: 12603, at least one multimer wherein each P is SEQ ID NO: 12731, at least one multimer wherein each P is SEQ ID NO: 124191, at least one multimer wherein each P is SEQ ID NO: 124224, at least one multimer wherein each P is SEQ ID NO: 124174 and at least one multimer wherein each P is SEQ ID NO: 124187.

2. A kit comprising the composition according to claim 1.

3. The kit according to claim 2, comprising at least one additional component.

4. The kit according to claim 3, wherein the additional component is a positive control.

5. The kit according to claim 3, wherein the additional component is instructions for use.

6. The composition according to claim 1, wherein the MHC multimer comprises one or more covalently or non-covalently attached label selected from the group consisting of fluorophores, fluorescent labels, enzyme labels, radioactive labels, chemiluminescent labels, dyes, chromophores, fluorochromes, bioluminescent labels, metal particles, haptens, DNA fluorescing stains, polymers, and antibodies.

7. The composition according to claim 1, wherein n>10.

8. The composition according to claim 1, wherein n is between 10 and 20.

* * * * *